US007635798B2

(12) United States Patent
Weglarz et al.

(10) Patent No.: US 7,635,798 B2
(45) Date of Patent: Dec. 22, 2009

(54) NUCLEIC ACID COMPOSITIONS CONFERRING ALTERED METABOLIC CHARACTERISTICS

(75) Inventors: Thaddeus Weglarz, Noblesville, IN (US); Daniel Gachotte, Indianapolis, IN (US); Beth Blakeslee, Fishers, IN (US); Ignacio Larrinua, Indianapolis, IN (US); David A. McCrery, Lake Jackson, TX (US); Randy J. Pell, Midland, MI (US); J. Vincent B. Oriedo, Midland, MI (US); Barbara A. Miller, Midland, MI (US); Avutu S. Reddy, Carmel, IN (US); Vipula Shukla, Indianapolis, IN (US); Rodney Crosley, Indianapolis, IN (US)

(73) Assignee: Dow Agrosciences, LLC, Indianapolis, IN (US)

( * ) Notice: Subject to any disclaimer, the term of this patent is extended or adjusted under 35 U.S.C. 154(b) by 0 days.

(21) Appl. No.: 10/487,901

(22) PCT Filed: Aug. 30, 2002

(86) PCT No.: PCT/US02/27884

§ 371 (c)(1),
(2), (4) Date: Oct. 1, 2004

(87) PCT Pub. No.: WO03/020936

PCT Pub. Date: Mar. 13, 2003

(65) Prior Publication Data

US 2005/0091708 A1     Apr. 28, 2005

(51) Int. Cl.
*C12N 15/00* (2006.01)
*C12N 15/82* (2006.01)
*C12N 15/87* (2006.01)
*C12N 15/05* (2006.01)
*C12N 15/11* (2006.01)
*C12N 15/29* (2006.01)
*A01H 5/00* (2006.01)

(52) U.S. Cl. .................. 800/281; 435/320.1; 536/23.6; 800/278; 800/279; 800/295; 800/298

(58) Field of Classification Search ........................ None
See application file for complete search history.

(56) References Cited

U.S. PATENT DOCUMENTS

| 4,801,340 | A | 1/1989 | Inoue et al. ................. 148/103 |
| 4,940,838 | A | 7/1990 | Schilperoort et al. ........ 800/294 |
| 5,283,184 | A | 2/1994 | Jorgensen et al. ........... 800/285 |
| 5,451,514 | A | 9/1995 | Boudet et al. ............... 800/286 |
| 5,453,566 | A | 9/1995 | Shewmaker et al. ........ 800/286 |
| 5,584,807 | A | 12/1996 | McCabe ........................ 604/71 |
| 5,592,402 | A | 1/1997 | Beebe et al. .................... 703/6 |
| 5,686,649 | A | 11/1997 | Chua et al. .................. 800/285 |
| 5,733,731 | A | 3/1998 | Schatz et al. ..................... 506/9 |
| 5,811,238 | A | 9/1998 | Stemmer et al. ................ 506/1 |
| 5,830,721 | A | 11/1998 | Stemmer et al. .............. 506/10 |
| 5,837,458 | A | 11/1998 | Minshull et al. ................ 435/6 |
| 5,859,342 | A | 1/1999 | Graham et al. .............. 800/298 |
| 6,031,154 | A | 2/2000 | Bennett et al. .............. 800/284 |
| 6,063,947 | A | 5/2000 | DeBonte et al. ............. 554/223 |
| 6,303,848 | B1 | 10/2001 | Kumagai et al. ............ 800/300 |
| 7,109,033 | B2* | 9/2006 | Harper et al. ............... 435/419 |

FOREIGN PATENT DOCUMENTS

| EP | 1 033 405 A2 * | 9/2000 |
| WO | WO96/40867 | 12/1996 |
| WO | WO99/36516 | 8/1999 |
| WO | WO02/10486 | 2/2002 |

OTHER PUBLICATIONS

Kennell, Progr. Nucl. Acid Res. Mol. Biol. 11: 259 (1971).*
Zhang et al, Plant Cell 7 (12), 2241 (1995).*
Altschul, (1991) "Amino acid substitution matrices from an information theoretic perspective." *J. Mol. Biol.* 219:555-565.
Altschul, et al. (1990) "Basic local alignment search tool." *J. Mol. Biol.*, 215:403-410.
Anderson and Young, (1985) Quantitative Filter Hybridization in Nucleic Acid Hybridisation, A Practical Approach (Hames, B. D. and Higgins, S. J., eds.) IRL Press, Oxford, pp. 73-111.
Attwood, (2000) "Prints-S: the database formerly known as Prints." *Nucleic Acids Res.* 28:225-227.
Attwood et al. (1997) "Novel developments with the Prints protein fingerprint database." *Nucleic Acids Res.* 25: 212-216.
Barker (2001) "Protein Information Resource: a community resource for expert annotation of protein data." *Nucleic Acids Res.* 29:29-32.
Bateman et al. (1999) "Pfam 3.1: 1313 multiple alignments and profile HMMs match the majority of proteins." *Nucleic Acids Res.*, 27: 260-262.
Bidney, et al. (1992) "Microprojectile bombardment of plant tissues increases transformation frequency by *Agrobacterium tumefaciens*." *Plant Molec. Biol.* 18:301-313.
Bitter, et al., (1987) "Expression and secretion vectors for yeast." *Methods Enzymol.* 153:516-544.
Broglie, et al. (1984) "Light-regulated expression of a pea ribulose-1,5-bisphosphate carboxylase small subunit gene in transformed plant cells." *Science* 224:838-843.

(Continued)

*Primary Examiner*—James Martinell
(74) *Attorney, Agent, or Firm*—Medlen & Carroll, LLP

(57) ABSTRACT

This invention encompasses the identification and isolation genes and gene fragments that confer altered metabolic characteristics in *Nicotiana benthamiana* plants, when expressed using GENEWARE™ viral vectors. These genes are derived from a variety of sources. Expression of these genes resulted in alterations of the levels of at least one of the following metabolites: acids, fatty acids, amino acids and related compounds, branched fatty acids, carbohydrates, hydrocarbons, alkaloids and other bases, esters, glycerides, phenols and related compounds, alcohols, alkenes and alkynes, sterols, oxygenated terpenes, and other isoprenoids, and ketones and quinones.

12 Claims, 2471 Drawing Sheets

OTHER PUBLICATIONS

Caldwell and Joyce, (1992) "Randomization of genes by PCR mutagenesis." *Genome Res. . . ,* 2:28-33.

Cannon, et al. (1990) "Organ-specific modulation of gene expression in transgenic plants using antisene RNA." *Plant Mol. Biol.* 15:39-47.

Caruthers, et al. (1980) "New chemical methods for synthesizing polynucleotides." Nucl. Acids Res. Symp. Ser. 215-223; Oxford University Press.

Ch'ng et al. (1989) Antisense RNA complementary to 3' coding and noncoding sequences of creatine kinase is a potent inhibitor of translation in vivo, *Proc. Natl. Acad. Sci. USA* 86:10006-10010.

Colbere-Garapin, et al. (1981) "A new dominant hybrid selective marker for higher eukaryotic cells" *J. Mol. Biol.,* 150:1-14.

Cortés, et al. (1998) "The expression of genes involved in parasitism by *Trichoderma harzianum* is triggered by a diffusible factor." *Mol. Gen. Genet.* 260:218-225.

Coruzzi, et al. (1984) "Tissue-specific and light-regulated expression of a pea nuclear gene encoding the small subunit of ribulose-1,5-bisphosphate carboxylase." *EMBO J.* 3:1671-1679.

Crameri, et al. (1996) "Improved green fluorescent protein by molecular evolution using DNA shuffling." *Nat. Biotech.,* 14:315-19.

Crameri, et al. (1997) "Molecular evolution of an arsenate detoxification pathway by DNA shuffling" *Nat. Biotech.,* 15:436-38.

Dieffenbach and Dveksler, (1995) PCR Primer, a Laboratory Manual, Cold Spring Harbor Press, Plainview, N.Y.

Eckert and Kunkel, (1991) "DNA polymerase fidelity and the polymerase chain reaction." *PCR Methods Appl.,* 1:17-24.

Engelhard, et al. (1994) "The insect tracheal system: a conduit for the systemic spread of Autographa californica M nuclear polyhedrosis virus." *Proc. Nat. Acad. Sci.* 91:3224-3227.

Ewing, et al. (1998) "Base-calling of automated sequencer traces using phred. I. Accuracy assessment." *Genome Res.,* 8:175-185.

Ewing and Green, (1998) "Base-calling of automated sequencer traces using phred. II. Error probabilities." *Genome Res.* 8:186-194.

Goldman, et al. (1992) "Molecular cloning of the imidazoleglycerolphosphate dehydratase gene of *Trichoderma harzianum* by genetic complementation in *Saccharomyces cerevisiae* using a direct expression vector." *Mol. Gen. Genet.* 234:481-488.

Gordon, et al. (1998) "*Consed:* A Graphical Tool for Sequence Finishing" *Genome Res.* 8:195-202.

Hampton, et al. 1990; Serological Methods, a Laboratory Manual, APS Press, St. Paul, Minnesota, Title page only.

Hartman and Mulligan, (1988) "Two dominant-acting selectable markers for gene transfer studies in mammalian cells." *Proc. Natl. Acad. Sci.,* 85:8047-8051.

Haseloff, et al. (1988) "Simple RNA enzymes with new and highly specific endoribonuclease activities." *Nature* 334:585-591.

Henikoff and Henikoff, (1991) "Automated assembly of protein blocks for database searching", *Nucleic Acids Res.* 19:6565-6572.

Henikoff and Henikoff, (1994) "Protein family classification based on searching a database of blocks", *Genomics* 19:97-107.

Henikoff, et al., (1995) "Automated construction and graphical presentation of protein blocks from unaligned sequences", *Gene* 163 GC 17-26.

Henikoff and Henikoff, (1996) "Blocks database and its applications." *Meth. Enz.,* 266:88-105.

Hofmann et al., (1999) "The prosite database, its status in 1999" *Nucleic Acids Res.* 27:215-219.

Hooykas-Van Slogteren et al. (1984) "Expression of Ti plasmid genes in monocotyledonous plants infected with *Agrobacterium tumefaciens*" *Nature* 311:763-764.

Horn, et al. (1980) "Synthesis of oligonucleotides on cellulose. Part II: Design and synthetic strategy to the synthesis of 22 oligodeoxynucleotides coding for gastric inhibitory polypeptide (GIP)." Nucleic Acids Symp Ser. 7:225-32 in Nucleic Acids Synthesis: Applications to Molecular Biology and Genetic Engineering, Proceedings of the International Symposium on Chemical Synthesis of Nucleic Acids, Egestorf, GFR, 1980.

Kroll, et al. (1993) "A multifunctional prokaryotic protein expression system: overproduction, affinity purification, and selective detection." *DNA Cell Biol.,* 12:441-453.

Klee, et al. (1987) "Agrobacterium-Mediated Plant Transformation and its Further Applications to Plant Biology." *Ann. Rev. Plant Phys.* 38:467-486.

Kimmel, (1987) "Identification and characterization of specific clones: strategy for confirming the validity of presumptive clones." *Methods Enzymol.,* 152:507-511.

Leung, et al. (1989) "A method for random mutagenesis of a defined DNA segment using a modified polymerase chain reaction technique." *J Methods Cell Mol Biol,* 1, 11-15.

Lagerstroõm, et al. (1991) "Capture PCR: efficient amplification of DNA fragments adjacent to a known sequence in human and YAC DNA." *PCR Methods Applic.* 1:111-119.

Logan and Shenk, (1984) "Adenovirus tripartite leader sequence enhances translation of mRNAs late after infection." *Proc. Natl. Acad. Sci.,* 81:3655-3659.

Lowy, et al. (1980) "Isolation of transforming DNA: Cloning the hamster aprt gene" *Cell* 22:817.

Maddox et al. (1983) "Elevated serum levels in human pregnancy of a molecule immunochemically similar to eosinophil granule major basic protein." *J. Exp. Med.,* 158:1211-1226.

Merrifield, (1963) "Solid Phase Peptide Synthesis. I. The Synthesis of a Tetrapeptide." *J. Am. Chem. Soc.,* 85:2149-2154.

Moore and Arnold, (1996) "Directed evolution of a para-nitrobenzyl esterase for aqueous-organic solvents." *Nat. Biotech.,* 14, 458-67.

Napoli, et al. (1990) "Introduction of a Chimeric Chalcone Synthase Gene into Petunia Results in Reversible Co-Suppression of Homologous Genes in trans." *Plant Cell* 2:279-289.

Parker, et al. (1991) "Targeted gene walking polymerase chain reaction." *Nucleic Acids Res.,* 19:3055-3060.

Pearson and Lipman, (1988) "Improved tools for biological sequence comparison." *Proc. Natl. Acad. Sci.,* 85: 2444-2448.

Porath, (1992) "Immobilized metal ion affinity chromatography." *Prot. Exp. Purif.,* 3(4): 263-281.

Pietrokovski, (1996) "Searching Databases of Conserved Sequence Regions by Aligning Protein Multiple-Alignments." *Nucleic Acids Res.* 24:3836-3845.

Rhodes, et al. (1995) "Transformation of maize by electroporation of embryos." Plant Cell Electroporation And Electrofusion Protocols:121, ed Nickoloff, ch 9 pp. 121-131 in: Methods Mol. Biol., vol. 55, Series Ed.: Walker.

Roberge, et al. (1995) "A strategy for a convergent synthesis of N-linked glycopeptides on a solid support." *Science* 269:202-204.

Sarkar, (1993) "Restriction-site PCR: a direct method of unknown sequence retrieval adjacent to a known locus by using universal primers." *PCR Methods and Appln.* 2:318-322.

Scharf, et al. (1994) "Heat stress promoters and transcription factors." *Results Probl. Cell Differ.,* 20:125-162.

Seki, et al. (1998) "High-efficiency cloning of Arabidopsis full-length cDNA by biotinylated CAP trapper." *Plant J.,* 15:707-720.

Sheikholeslam, et al. (1987) "Acetosyringone promotes high efficiency transformation of Arabidopsis thaliana explants by *Agrobacterium tumefaciens.*" *Plant Molec. Biol,.* 8:291-298.

Sheehy, et al. (1988) "Reduction of polygalacturonase activity in tomato fruit by antisense RNA." *Proc. Natl. Acad. Sci.,* USA 85:8805-8809.

Smith, (1994) "Applied evolution. The progeny of sexual PCR." *Nature,* 370:324-25.

Smith, et al, (1990) "Finding sequence motifs in groups of functionally related proteins." *Proc. Natl. Acad. Sci.,* USA 87:826-830.

Smith, et al. (1990) "Expression of a truncated tomato polygalacturonase gene inhibits expression of the endogenous gene in transgenic plants." *Mol. Gen. Genetics,* 224:477-481.

Stemmer, (1994) "Rapid evolution of a protein in vitro by DNA shuffling." *Nature,* 370:389-391.

Stemmer, (1994) "DNA shuffling by random fragmentation and reassembly: in vitro recombination for molecular evolution." *Proc. Natl. Acad. Sci.* USA, 91:10747-51.

Sonhammer, et al. (1997) "Pfam: a comprehensive database of protein domain families based on seed alignments." *Proteins: Structure, Function and Genetics,* 28:405-420.

Sonhammer, et al. (1998) "Pfam: multiple sequence alignments and HMM-profiles of protein domains." *Nucleic Acids Res.,* 26:320-322.

Takamatsu, (1987) "Expression of bacterial chloramphenicol acetyltransferase gene in tobacco plants mediated by TMV-RNA." *EMBO J.* 6:307-311.

Triglia, et al. (1988) "A procedure for in vitro amplification of DNA segments that lie outside the boundaries of known sequences." *Nucleic Acids Res.* 16:8186.

Van der Hoeven et al., GenBank Accession No. BG600206, (2003).

van der Krol, et al. (1988) "Modulation of eukaryotic gene expression by complementary RNA or DNA sequences." Biotechniques 6:958-976.

van der Krol, et al. (1990) "Flavonoid genes in petunia: addition of a limited number of gene copies may lead to a suppression of gene expression." *Plant Cell* 2:291-299.

van Heeke and Schuster, (1989) "Expression of human asparagine synthetase in *Escherichia coli*." *J. Biol. Chem.* 264:5503-5509.

Vasseur, et al. (1995) "*Trichoderma harzianum* genes induced during growth on *Rhizoctonia solani* cell walls." *Microbiology* 141:767-774.

Wahl, et al. (1987) "Molecular hybridization of immobilized nucleic acids: Theoretical concepts and practical considerations." *Methods Enzymol.*, 152:399-407.

Wigler, et al. (1980) Transformation of mammalian cells with an amplifiable dominant-acting gene. *Proc. Natl. Acad. Sci.*, 77:3567-3570.

Wigler, et al. (1977) "Transfer of purified herpes virus thymidine kinase gene to cultured mouse cells." *Cell* 11:223-232 (abstract only).

Winter, et al. (1991) The expression of heat shock protein and cognate genes during plant development. In Nover, Hightower, ed, *Results and Problems in Cell Differentiation*: Heat Shock and Development, vol. 17., Springer-Verlag, Berlin, p. 85-105.

Zhang, et al. (1997) "Directed evolution of a fucosidase from a galactosidase by DNA shuffling and screening" *Proc. Natl. Acad. Sci. USA*, 94:4504-09.

Zhao and Arnold, (1997) "Optimization of DNA shuffling for high fidelity recombination" *Nuc. Acids. Res.*, 25:1307-08.

\* cited by examiner

> SEQ ID NO:1 103535 Nicotiana benthamiana
TGGTATGAACGCAGAGTGGCCATTACGGCCGGGGAGGGTTTAAGGCAGTAGCACTCCAACAAAGAGCACTTCTGCACTT
GCAAGCTCTGTTGCCTATTTTTCCAGAGAAGAGAAAAATATGGGTGCTGACAAAGGGAAGAAGCAAAAAGTTGATGAAG
AGAACAACATCATTGATGGTGAGCTCGTTTTTTCCATTGAGAAATTGCAAGAAATACAAGACGAGCTTGAGAAGATCAA
TGAGGAAGCAAGTGATAAAGTATTGGAAGTGGAACAGAAGTACAATGAGATCCGCAAGCCTGTCTATGACAAACGAAAT
GACATCATTAAAGCTATCCCGGACTTCTGGTTGACTGCTTTTTTGAGTCATCCTGTCCTAGGTGAGCTTCTAACTGAAG
AAGACCAAAAGATCTTCAAGTTTCTAAGTTCTATTGAAGTTGAAGACTCTAAAGATGTGAAGTCGGGCTACTCGATAAC
CTTTAACTTCAATGCGAATCCTTATTTTGAAAATACAAAGCTGGCAAAGACCTATACCTTCCTTGAAGATGGACCCACA
AAGATTTCTGCTACAACAATAAAATGGAAAGAAGGCATGGCCATTCCTAATGGAGTTGCACATGAGAAGAAAGGAAACA
AGCGATCTCATGCTGAGGAAAGCTTCTTCACAT > SEQ ID NO:2 103541 Nicotiana benthamiana
TGGTATGAACGCAGATGGCCATTACGGCCGGGGGCCTGAAACAAATTTCAGAAAGTTCACCAAAATGGCTCATGCTATG
GCTTCAATGGGTGGCCTAATTGGTTCTTCTCAAACTGTGTTGGATGGTCAGCTCAGTGGCTCAGCCCGTTTGAGCACTG
TTAGCACCAGCAGAATTGCCTTGGCTAGACCAGGACTCAGCATTAGAGCCCAACAGGGGTCTGCTGACACTGAAACTAG
CCGTAGAGCCGTCATCGGTCTTGTTGCTGCTGGCCTTGCTGGTTCCTTTGCTCAAGCAGCCTTTGCTGCAGCTAAATCA
ATCAAGATTGGGGGCGCTCCTCCTCCCTCTGGTGGATTACCTGGAACTTTGAACTCGGATGAGGCAAGGGACTTTGGTC
TACCATTGAAGAAGAGGTTTTACCTTCAACCATTGACTCCAGCTGAAGCAGCCCAGAGAGTTAAGGATTCAGCCAAGGA
GATTGTTAGCGTCAAGAATTTCATCGACAAGAAGGCCTGGCCATATGTCCAGAATGACCTTCGTCTCAGAGCAGAATAC
CTTCGCTATGACCTTAAAACCGTCATCTCTGCTAAGCCAAAAGAAGAAAAGGGAAAACTCCAGGACCTGACTGGAAAGC
TCTTCAAGACCATTAGTGATCTGGACCATGCAGCA > SEQ ID NO:3 103560 Nicotiana benthamiana
TGGTATCAACGCAGAGTGGCCATTACGCCGGGGGTATCATCATCCTAGAACTGCTAAAATGAAGGAGTTCATTTCTGAT
CCTAATCTCTTTGGACAAGTCAAAGCAATTCACAGCTCATCATCATATTCACCTGGTCCGGTATTTCTTGAAAACAACA
TCAGAGTAAAGCCAGACTTGGATGCCCTTGGGCGCTGGGAGATGCGGGTTGGTACTGCATTGGCGCAATATTATGGGC
TATGAACCAAAACCTGCCAACAACTGTGACAGCACTGCCTACTGTTGCAAGAAACTCGGCTGGCGTTATCTTGACATGC
AGTGCCTCCCTGCATTGGGAAAAGAGGAAACTGTCGCTACATTTTACTGCTCTTTCGTTTCACATGAAACGATGGACT
TGATAGTTTATGGCTCCAACGGTACCTTTTATCTCTACGACTTCATTATCCCCATGGACGAGAACTCTGCTTCGTTCAG
CTTTACTTCTGGTGCCAAGTTCGTGGATCGCCATATCGGATGGAACATGAAACCTCGGGCAGTTGAAGTAACTTCTAAG
TTTCCGCAAGAGGCTTCTATGATTCAAGAATTTTCTAGGCTGGTTAAGGCTATTGAAGTTTCGAGAAGCAAACCGGAAA
GCAAAT > SEQ ID NO:4 103619 Nicotiana benthamiana
TGGTATCAACGCAGAGTGGCCATTACGGCCGGGGATTTGAGGTGATTGATACAATCAAATCTGAGGTTGATAAAGTTTG
TGGACGTCCGGTTGTATCTTGTGCGGACATCTTGGCAGTTGCTGCTCGTGACTCTGTAGTGGCTCTACATGAACCAACA
TGGGAAGTGAAACTAGGAAGGAGAGACTCCACAACAGCAAGTAGAACCAAAGCCAACAATGATATTCCATCTCCAGTTA
TGGACTTACCTGCACTTATCAACAACTTCAAGAAGCAAGGATTGGATAAGGAAGACCTCGTTGCACTCTCCGGTGGCCA
TACATTAGGGTTTGCTCAGCGTTTCACCTTCAGAAATCGCATCTACAATGAAACTAACAACATTGACTCTACCTTTGCA
AGACAACGCCAAGCAAATTGTCCACGTAGTGGAGGTGATTCCAATCTTGCTTCTCTTGATCCAACACCAGCTCTTTTCG
ACTCGAAATATTTTAGTAACTTGGTGTCCAAGAAAGGGCTTTTGCATTCTGATCAGGCTCTACTTAGTGGTGGAAAAAC
TGATGATCTTGTAAAAAAATATAGTAAGAACTTAAAAACTTTCTCCAAAGATTTTGCTGAGTCTATGATTAAGATGGGT
AATATCAAGCCATTGACAGGGAAAC > SEQ ID NO:5 103718 Nicotiana benthamiana
TGGTATCAACGCAGAGTGGCCATTACGGCCGGGGACCAAGCAAAAACTCAAAACTTCACATCTTTAGTAGTAGCATCAA
TATTCAAGATGGTTCTCCAAACTCAACTTGGGTTGAACAAGCCCCAATCCTACGCTCACGAGCAAAATTATTATTGCGA
CGGCAGCCATGGCGGCTCTATGCAAATGACAAGGCCATCGGGCTATTCCACCATGCCATATGGCCAGTCCACTCACAAT
CACATGATGATGGGTCATGGTGGCCAACATCATGGCGGACACTATGGTGGTCATGGCCATGGCTACGGCGGTCATGAAC
ATCATGGGCGCATATGCCCCATGACTCCACTAACTTTTCAAGCAGCACCAATATGGTCCATAGTGATGCTGGCTATGG
CAGTGGAATGCAACAATCTACCCATATGTTGTCAGCCATGGGCATGGGATCGACCAATTATCATGGCCATGGTTATGGT
GGCAGCCACCCTAGTCAGTACAGCCAGAGCCAAAAGTTCAACTGGGCTCTTAAGGATCTGGAGGAATAAATATATGATA
AATTTTATGCTATC

FIG. 1

> SEQ ID NO:6 103752 Nicotiana benthamiana
TGGTATGAACGCAGAGTGGCCATTACGGCCGGGGGTGGTCCTACGCATGTGCAAAGCAATTGATTGAGAGGTTGATCTA
TGCTGAGGGTGCTGAGAATGGCTTAGAATTCACCATTGTTAGGCCCTTCAACTGGATTGGTCCGAGGATGGATTTCATA
CCTGGGATTGATGGTCCTAGCGAAGGTGTTCCGAGAGTGTTGGCTTGCTTTAGTAATAATCTTTTAAGACATGAACCAC
TAAAGCTAGTGGATGGCGGACACTCGCAAAGAACCTTCATATATATTAAGGATGCTATTGAAGCTGTTCTCCTGATGAT
TGAAAATCCTGCACGGGCTAATGGCCAGATCTTTAATGTCGGCAATCCTAATAATGAAGTTACAGTTAGGCAGCTAGCT
GAAATGATGACTCAGGTGTACTCAAAGGTGAGTGGAGAATCTCCTCCTGAAACACCCACCATCGATGTAAGTTCTAAAG
AATTTTACGGCGAGGGGTACGATGACAGTGACAAGCGAATTCCAGACATGACCTTAATTAACAGACAACTCGGTTGGAA
CCCGAAGACATCCCTATG > SEQ ID NO:7 104065 Nicotiana benthamiana
AGAAAAAGGAGGTCCAAGAGCACCTCCAAGGAACAAGATGGCTGTATATGAGCAGCTCAGTATACCTTCTCAGAGATTC
AATTCAGGGGTTTTGCCTGTTAACCCCAACAATAACACTGCAAAGGGTGGTGGGCACGAAAGAGTTGTATATTTCCCCG
TACAACACCCTCCATCTGGACATCTAGCTGATAAACCACCTGGCCACAGTTCAGATCCCAATACGCACTTGCAACAATT
TGAGTTGAATAAGAGAACTGAAGAGGATGACTTTACGGTCCCTGTCTTTGTTAACTCCATGCCGGATCATGCCAATGGG
AGTCATAATCTGGGTATGGAGAAGCTTACTCCCTCTGGTCCTGTCTTTTCAGGGTGTACCAATAAAGACTTGGAAGGAC
TTACAGATCGAATTCTGAGGCAACAGCGCAAGAGCAAGAATGAGGAGAATCCCAAATGTATTCCAGCTAGTAGAGAGCA
TAGAACAACCTCGAACTCTCCATCCAAGGAATGCAGATTCGAACGTCAGGTTGGTTATACCATCATATCTGAACCTGTT
ACGGGTATAGATGATGATGATTCTTATCCCAGAAAAGAATTTGCATCAGAAGAGCAGATAATTACTAACAATCTCATTA
ATGG > SEQ ID NO:8 104067 Nicotiana benthamiana
CAAGGCGGTCTTCGTCTGTAAGAGGCAATACAAAAACGCGCTGATCCTGAATTCATAACCAACATCAATTTACTAGAAC
CCTAATTGGCAATACGAAGCGATGGGGAATGCTAATTGTGTATTCTGTGGATGCATAGAACAAGCGAGCGTCGGTGTGG
TTGAGAAATGGGGACGTTTTGACAGGCTAGCAGAACCGGGGCTTAACTTCTTCAATCCTTTCGCCGGCGAATGCCTTTC
TGGTATTCTCTCCACCAGGATCAGTTCTCTCGATGTCAAATCGAGACTAAAACCAAGGACAATGTCTTTGTTCATTTA
GTGTGCTCGATCCAATATAGAGTGATCAAGCAAATGCTGATGATGCTTTCTATGAGTTGCAAAATCCAAAGGAGCAGA
TTCAGGCTTATGTATTTGATGTTGTTCGTGCCCATGTCCCCAAAATGAATTTGGATGAACTTTTCGAGCAAAAGGATGA
AGTTGCTAAGGCTGTGTTGGAGGAACTTGAGAAGGTAATGGGTGCATATGGATATAACATCGAGCACATACTGATGGTT
GACATTATTCCTGATGCTTCTGTGCGAAAGGCGATGAACGAGATAAATGCAGCTC > SEQ ID NO:9 104254 Nicotiana benthamiana
AAAAATCATAAAGTTCCTCTTCTCCTTCTGTAGTTTCCTCTGTAATTTCAAGGTTTCCTCACACCCTTCAAACTCGAGC
AATCTTAAGGAACTCAGATGGCTCGTACGAAGCAAACGGCTCGTAAATCTACTGGAGGCAAGGCTCCAAGGAAGCAACT
TGCAACAAAGGCTGCCCGTAAGTCTGCCCCAACAACAGGAGGAGTTAAGAAGCCTCACAGATACAGACCTGGAACCGTT
GCTCTTCGTGAAATTCGCAAGTACCAGAAGAGTACTGAGCTGTTGATCAGGAAATTGCCATTCCAAAGGCTTGTTCGTG
AAATTGCACAGGACTTCAAGACTGATTTGCGTTTCCAGAGTCACGCTGTATTGGCTTTGCAAGAAGCAGCTGAGGCCTA
CCTTGTTGGATTGTTTGAGGACACAAATCTGTGCGCCATTCACGCCAAGCGTGTCACTATCATGCCCAAGGATATCCAG
TTGGCCCGAAGAATTAGGGGAGAAAGAGCTTAGAATGATCTGTTCTGCCGTATCGTGCTTAGATTGTTGATTTTTTTTT
TTGAATTGCCGTCTTTCTGCATTTTTCTTCTTCTTTGTTCTTCATATAGGTAGTTTTTACTAGATATGAATGGCTGTGG
CATACTGGAAATTTGATACTCT > SEQ ID NO:10 104407
CAAAATATCTTACATATATTCACCATTAGAAATACATCCATAGAAGGAGAGTGCATATATATAATATATATCTTCAAAC
ACAACAGTCTTTATTTCACACGTAGCTAGCTAGAGCTTGCCAATATTGCCAAATACTCATCACACACATAGATATATAT
GTGTATTGACATACGTATAAATGGCTATAAGCCATTGAATAGCATAGATTATATTACTTGAGAAGGTGACCCTCTATAT
CTTTGGTCACATGTAGGACAAAACCCAAGAGAACGAGAGGCTCTGGGGTGTCTTCAGTTTTCTTCTCGTACACAAATGT
CCATGTAGTCCACTGGTGGTCGgggaaTgtggaaAttgtaaAGGAATTGTACAACTTTAACAAATCTCCTCCCCCGGCC
gaaatGGC > SEQ ID NO:11 104475 Contig A
GGGCCACAAAAGCTAATTCTCCCATCCATTCTTAAGGCAGAATAAACTTAAGAAACAACTGACAAAATTCTCTGTTCTA
TGATACAAATCATGTATGATATGACCCATTGACCAGACTAAAGCAAAAAAAAAGGACCAAAATTACAAAGTACATCTTA CAGTTAAAACTACAAGACAGGTTAGTACCAAAGTATATTTTTGCTTTGACATCATAGATGAGGATACAGAACACCATGT
TAGAGAATATTGACGTTTCACCCTTGACGTGAGACACGTCAGTCTGAACAAAATGAGAAGGAACTGCAGAAACATTCTT
TTTCCCTCGTTTTCTTGATGACCTAATGGTTTTTGGCTCATGATCCTGCCCAACTCCATTATCTGCCTCCCTCTGTGTA
GTACCATTGCTCGAATGTACCAGGTCAACAAAAGCTCAGATCTTATTGTTCTAATGTCACTTGTAATCGAAACAATGAT
GGATTTCTCTGGACTTTCAACCCACCCCGGCCGAGGCGGCCGACAT > SEQ ID NO:12 104475 Contig B
GCCATTACGGCCGGGGAAGGCTGTAATGTTCGCATCCATGGAGTATTGCCTGCGAATGAAGTTCTCCCAACGCAAGGCT
GAAAAAGTTTGTCCAGGGTGTGGGACAGAATGGCATTATAACATTGCAAAAGCAGAAGTTGTAGATGAAGAAGAGGATG
CATGTGCTCCTCCTGAAAGTCAGCAGCCTGGTGAACCTTTAATGAGAAAGAGGCGGAGGACCTGTGGAGGGACCGATTC
AGATACTCTCAAGCCTGGATCATCTCAGAGTATGAGGGTGACTCGGGGCCGGCTGAGGAATGCAAGTTAAGAAATTTGT
TTTGCTAGTTTTGGCACTTATGCACCTCTAACTATATGAAAATGGCTGTCCATATATTTTTGCATCCCGTGAAGGTTTA
CTTATTTGGTAGACCTATTTAACTTATGATTGTAGATTATAGGAGCATCCAGAATAGTATCTTAATCATCTCTATTCTC
TTGGTGTTCTCCAATTGCCATTATCGCGCAGATGATTTCTTGCTATTATATAGTAGTGAAATATTTTATCAN > SEQ ID NO:13 104702 Nicotiana benthamiana
CAATTTCTCAAATGGCAGTCTCATCCATAGCCAATCTCTTCTCCTTCTTCACCCCCTCCAAACCCCCACCCCCCAGAGC
TTCCCCCCTCCAATTCTCTCTTCCTGCTGTTGATTCCCTCTCTTCTTCAACACCTATCAACAATCACAAATACCCATTA
TCACTATCGTGTTCTAATTCTGATGTTACGGCCGCCGTTTACCCCTCACTTGCAAATGCAAACACTCTTTACTTCAGGT
CGGGATACAATGTTCAGGTAATTGTGGATGATAATGAGCACGAAGAGAAGCTTGTTGGACGGTTTCGTAGGGAGGTTAT
GAGAGCTGGAGTCATACAGGAATGCAAGCGTAGGAGATATTTCGAGAACAAGCACGACAAATTGAAGCGCAAGTCACGT
GAGGCTGCTAAACGCAACCGCAAGAGACGTGGCCCACCAAGAAATTTCTCAGATGATAAGCAAGAGGCATCTAAGAGCA
AGAGGGATGACGAAGGGGAAGATAACTGGGAACTTCCTGATGGAGGTCTTCCCTATTGATTTTATTGTAGTTCCTTTTT
CCTTTTTTTTGGGGTCCTGTAGAAATGTGGTTTATTTCCACTTTGGAGAAAATCTATTCATATAATTCCCCATGGGAAT
CATTTTCCTTG > SEQ ID NO:14 104765 Nicotiana benthamiana
TCGCCCACTATAATCTCACCTAAGCAGTACAAAAAGAGGTTGCGCAAGGCCATGACCACCTATTTTCTCATGGTCCCAG
ATCAATGGTCACCACCGTCTATCATTCCCAGTAAATCACAGACTGATTTATGTGAAGAGAACATGCAAGATGGATGATC
TGCCAAGTGATTTTGTACATCTGTTCGTATATTGAGCACATATTTGGGTTTCTCGCATTGGTTATCCCAGGTTCATACA
TCTCCCATATTTTCGATTCCCATTCTTTTGGAACGCAGTTCCGGTTGCATTCTCCCTAAAGTGGGAGAACACATGATTT
CTTGTCAGAGCACTTGGTAAGAGGTTTGTATTTCAGTGAAAGTCTCCATTGCACAGAATATAGGTGGCTCTCCGTGGAA
ATATTTTGTAAATCTTTTTCTTTTAATTACAATTTCTTTGGGTGTAAAATCCAAGGTATACATGAGTTCCGAAGGAT
CATTGGCAATTTTATACAATGCATGATTTTGGAGCAATTTAGCTGGTGTAGTTTCAAGTGTATCGCGATTCTTTCCTCT
GTAATTTTTGTAATTGTGATTTTGAAAGGTGAATCTTCTTACCTT > SEQ ID NO:15 104768 Nicotiana benthamiana
GACGTTGAAGATCTTATCCAATTTGGAACATCTGGAAAAGGTGCTGCGTTTATGTCTGAATTCATACAGGGAGTTGGTG
GAATAGTTGAATTGGCTCCAGGTTACTTGCCTGCTGTATACAACATTATACGAAAAGCAGGAGGCCTTTGTATCGCGGA
TGAGGTTCAAGCTGGATTTGCTCGCACTGGAAGCTATTTCTGGGGATTTGAGAACCAAGGAGTAGCTCCTGACATAGTG
ACAATGGCAAAAGGCATTGGAAATGGAATACCACTTGGGGCTGTGGTAACAACTCCTGAGATTGCACAGGTCTTGACTC
ATCATAATTACTTCAACACATTTGGTGGAAACCCTGTATGTACTGCTGCTGGACTTGCTGTTCTTAAAGTGATCGAAAA
AGAAAAGCTTCAAGAAAATGCTCGTGGTGTTGGTTCATACTTAAAAGAGCGCCTTTTGGCTATCAAGGATAAGTATGAA
ATTGTTGGTGATGTGAGGGGAAAAGGACTGATGCTTGGCGTTGAACTAGTTACTGACCGTGAACTGAAAACTCCTGCGA
GAGCAGAAACTCTGCATATCATGGACAAGATAAAAGATATGGGAGTATTAGTTGGCAAGGGTGGATTCTATGGAAATGT
CTTCAGGATTACACCTCCACTATGTTTCACTAAAG > SEQ ID NO:16 104790 Nicotiana benthamiana
TGATTCGATTAGGCAAAGCAAAAATGCAAAGGGTTTTGAAGGCTCGCCAGCTCGTTAGGGTTTTGAGAAACTCGTCATC
TCCTATTCTGCTCAACTCAGTGTCACGAATTCAATCTCATTGTACCTATGAATCTACTGAATCATGCCTCAATTTTTCT
TTACGGCGTGGTTACTTTACCTCTGGTACTGCAATTTGTGGAATTATATTCAAACAAAACACAATATTCAGAGAAATG
TATGTCAATGTGAAAAATGCTCTATGATGCTCAAGGCATCATTTTCTACAGAAGCAGGGACAGTTGAAAGTAGTGTGGC
AACAGAGTCTGTGAAGGAATTGTATGATAAGATGCTGAAATCTGTCGTGGAACAAAGATCTGCTCCGCCAAATGCTTGG
TTGTGGTCCCTAATACAAAGTTGTGCAAACCGTGAAGATGTTAATTTTTTACACGACATTTTGCAGAGACTTCGGATAT

FIG. 1 continued

TTAGACTTTCAAATCTCCGTATCCATGAGAACTTCAATTGTGCCCTCTGCCAGGACATTACAAAGGCTTGTGTACGTGT
TGGCGCCATTGACTTGGGTAAGAAGGTGTTGTGGAAGCATAATGTGTACGGATTGACTCCTAATATTGGATCTGCTCAC
CATTTACTGTTGTTTGCTAAACAGCATAATGATGTTAAACTGTTGGTAGAAATTATGAAACTGGTGA

> SEQ ID NO:17   105019 *Nicotiana benthamiana*
TTTCTCTGCTACAACTTCAAGATTTTCTTTACTCAGCCCTGGGATTATAGGGAAGTTATCTCTCGTTTGAAGAAGCAAT
GGCATCGCCATCAGATCACAAGGCTAACATCATTGATGGTAAAGCAATTGCTCAAACTATTCGTTCCGAGATTGCTTCT
GAAGTCCAACTCCTTTCAGAAAAGTACGGCAAGGTCCCTGGGTTGGCCGTAGTCATTGTAGGAAATAGGAAAGATTCTC
AAAGTTATGTGAATATGAAGAGAAATCATGTGCTGAGCTTCACATTAAGTCTTTTGACATAGACCTGCTAGAGGACGT
AGCTGAAGCTGAATTAATTAGCAAGGTCCACGAGCTGAATGCTGATCCGATGTACATGGTATACTGGTACAACTTCCG
TTACCAAAACACATTAATGAAGAGAGAGTTCTTGGTGAAATCAGTCTGGAAAACGATGTAGATGGCTTTCATCCTCTGA
ATATTGGCAAGCTTGCAATGAAAGGCAGACAACCTCTGTTCCTCCCTTGCACGCCCAAGGGATGCATCGAGCTTTTGCA
TCGAAGTGGGATTAGCATAAAAGGGAAGAATGCCGTTGTGGTTGGTCGAAGTAACATTGTTGGATTACCAGTGTC > SEQ ID NO:18   105143 *Nicotiana benthamiana*
GTTTCTTCTTATTCTTATTAATCAGAAAAGAATGGCAGAAGTTGAATACAGGTGCTTCGTCGGTGGGCTAGCATGGGCT
ACCACCGACCAAACACTTGGGGATGCTTTTTCTCAGTTCGGCGAAATTCTCGACTCGAAGATCATCAATGACAGAGAAA
CTGGTAGATCTAGAGGATTTGGATTTGTTACCTTCAAGGATGAGAATCCATGAGGGACGCTATTGAAGGGATGAACGG
TCAAGACCTTGACGGCCGTAACATCACCGTCAACGAAGCTCAGTCTCGCGGTAGCGGCGGAGGCGGTGGTGGTGGTGGC
GGTTACCGTGGTGGTGGCGGTGGAGGCTACGGAGGTGGTGGCCGTCGTGAAGGTGGATACGGTGGTGGTGGTGGTTACG
GAGGTGGCCGACGTGAAGGTGGTTATGGTGGTGGCGGCGGTTATGGAGGTGGTCGTCGTGAAGGTGGTTACGGTGGTGG
TTCTGAAGGAAACTGGAGGAGTTAGATTTCCGTTGCCTTTAGATTTATTTTTTTGTTTGAAATTTATGGTTCTACGTTT > SEQ ID NO:19   105154 *Nicotiana benthamiana*
AAACAACCAAACATGGCGATTCATACTTCCACTCTCTCCAGGTCCATGCTTGTAATGCTCATGTTCTCCGCCGTAATAT
CATCGGCGGAGGACATGTCCATTATAAGCTACAACGAAAAACATCACACGAACGGCGAGTCAACGGTCTGGCGAACAAA
CGATGAAGTCATGTCTTTATATGAATCTTGGCTAGTTGAACATAAAAAAGTGTACAACGCCTTAGGAGAAAGGGACAAA
CGCTTTCAGATCTTTAAAGATAACCTTAGATACATCGATGAACATAACTCTGTGCCTGAAAAAAGTTACAAGCTGGGTT
TGACTCAGTTTGCTGATTTGACCAACGAGGAGTACAAGTCCATCTACTTGGGTACTAAACCCGATGGTCGTAGCACGTT
ATTAAATACCCAAAGTGACCGTTATGCCTCTAAGGTCGGAGATAGTTTGCCGGATTCCGTTGACTGGAGGAAGAAAGGT
GTTCTTGTTGACGTCAAAAATCAAGGG > SEQ ID NO:20   105271 *Nicotiana benthamiana*
CGTTTAGACCCTTCACTTGAAATTGATCATCTTTTATCCCAGACTGAATCATCCCAATCTGAAAACCCTAGTTCTAAGG
TACCAACACCTGATTTTTCATCTGAAAATGGGCCCCGCCATAGGGTTTCGGGTAGTGGTGGGTCATCGGTGGCGTATAG
TGAGGAGCAAGTGACAGTTGTGAAAGAAATTAAGAGGAAAAAGGATTACTATGAGATTCTCGGGTTGGAGAAAAGTAGT
TGTAGTGTTGAGGATGTACGCAAGGCGTATAGGAAGTTGTCGTTGAAAGTCCATCCTGATAAGAATAAAGCACCGGGAG
CTGAGGATGCTTTTAAGATGGTGTCTAAGGCGTTTCAATGTTTGAGCGACGAGGAGAGTCGAAGTAGGTATGATCTTGT
TGGATCTGAGGAATCTGTTTACGAAAGACGCGCTCATAGGCATGCAGGTGGTGCTAGAATGAATACATTTAATGGGTTC
TATGATGACGGTAATGTTGACGCGGAAGAGATTTTCAGGAATTTCTTCTTTGGTGGAATGCGTCCGGCAACGACTACTA
CACATTTTAGCTTTGGCCCTAGAGTGGATGTGAGATATCAAGGACCGACTGGGTGGC > SEQ ID NO:21   105272 *Nicotiana benthamiana*
TGAACATGGCATACCAAAAGAAATGGCCACTCTATCTTAGGGCAAAGAATACCATTCTTAAGAAATATGATGGGAGGTT
CAAGGATATTTTCCAAGAAGTTTATGAAGCAAATTGGAAATCCAAGTATGAGGAAGCAGGAATTTGGTACGAACACCGT
CTTATCGACGATATGGTTGCTTATGCTTTAAAGAGTGAAGGTGGTTATGTATGGGCCTGCAAGAACTATGATGGGGATG
TACAGAGTGATTTCTTAGCACAAGGTTTTGGATCCCTTGGGTTGATGACATCTGTCCTGGTGTGTCCTGATGGAAAGAC
CATTGAGGCTGAAGCAGCCCATGGAACTGTCACCCGCCACTACAGGGTTCACCAGAAAGGAGGTGAAACCAGCACAAAT
AGTATTGCGTCAATCTTTGCCTGGACTCGTGGACTTGCACACAGGGCAACATTAGACAAGAATGAAGGCTGTTGGATT
TTACTGACAAACTAGAGGCAGCATGCATCGGTGCAGTGGAATCTGGAAAGATGACCAAAGATCTTGCACTCATCATCCA
TGGATCCAAGCTCTCAAGAGAACATTATCTCAACACGGAAGAGTTCATCGACACTGTGGCGGATGAGCTCAAAGCA

FIG. 1 continued

> SEQ ID NO:22 105352 Nicotiana benthamiana
AAGATGATGATGAGAGGGCTGCCGGTTATCTTTCAATTGTTGTCAGGTCAGCAAAACAGAAGGCAAGTAATTTCAAGTG
GCCTCAGTTAGAGTCTGGAGAATCTCGACCAGCCAGGAGTGAACCATCTTTATCGAACAGGGACGAGCCATCTGTAGCG
CATACAAATGACGCGCTATTAGCTGCAGATGCGAGCTCTTCTTCCTCACTTGGACAGGCCAATAGTGAAGACTTAAGAT
TGTCAAGTCAAGTTGCTGATGAGATGCAACAAGAACAGGTAAACAAAAGTATGTCTCATGATCAAGTGCTGTCTTTATC
TGAAAATTATGAAGAATTTAAAGCTGATAAGAGGCTAAATTAGAAGAGTGGTTGGAAGAATAAAGGATTTGTGAAGTC
CTTTAGCTTGATAAATCTCTGAACCTCAACAAGACTATTCTTATGAACGACACTTATTTTGTATTATGATTCAGATATT
TTATACTAGATGAATATATGTAGAGGAGTTTATAGCAGACAGGAAAGAGAAAAAATAGTCTTCAATTTATGACCATTCA
AGTTGTGTTTGTACATTGAGGAATGTATTGTTTGTAAACTTAAACTGTTGTCCAAAATAAGTAAATTTT > SEQ ID NO:23 105377 Nicotiana benthamiana
GGTATGCAAATCTTTGTTAAAACCCTAACCGGGAAAACAATAACCCTTGAAGTCGAAAGCTCTGACACAATTGACAATG
TCAAGGCGAAGATTCAGGACAAGGAGGGAATCCCTCCAGACCAGCAAAGGTTGATTTTTGCCGGAAAGCAACTCGAAGA
CGGCAGAACCCTAGCTGATTACAACATCCAGAAGGAATCGACCCTTCACTTGGTCCTTCGTCTTCGTGGTGGGATGCAG
ATCTTCGTCAAAACCTTAACTGGGAAAACAATCACCCTTGAAGTCGAAAGCTCCGACACCATTGACAATGTCAAGGGTA
AAATCCAGGATAAGGAGGGAATCCCACCAGACCAGCAAAGGTTGATTTTTGCTGGTAAGCAATTGGAAGATGGCCGTAC
CCTAGCTGATTACAACATTCAAAAGGAGTCGACTTTGCACCTTGTGCTCCGTCTTCGTGGTGGGATGCAGATTTTCGTG
AAGACATTGACCGGGAAAACCATCACTCTTGAGGTGGAAAGCTCTGACACTATTGACAACGTTAAGGCCAAAATCCAGG
ATAAGGAGGGAATCCCACCAGACCAGCAGAGATTGATTTTTGCTGGTAAGCAGCTGG > SEQ ID NO:24 105405 Nicotiana benthamiana
CTTCCTCTTCTCTACNTTCTCCTTCCTTAGCTCCACCGTAATGTTTAACTGGTTTTAAGAGATGGCTGATTCAGAAGAT
ATTCAACCCCTTGTCTGTGATAACGGAACAGGAATGGTTAAGGCTGGATTTGCTGGTGATGATGCTCCGAGGGCTGTTT
TTCCTAGTATTGTTGGTCGACCTCGACACACCGGTGTTATGGTTGGTATGGGTCAAAAGGATGCATATGTTGGTGACGA
AGCTCAGTCCAAAAGGGGTATTCTCACCTTGAAGTATCCCATTGAGCATGGAATAGTAAGCAACTGGGACGATATGGAG
AAGATCTGGCATCATACCTTTTACAATGAGTTACGTGTTGCTCCTGATGAGCATCCTGTGCTACTTACTGAAGCACCCT
TGAATCCAAAGGCCAATAGAGAGAAGATGACGCAGATCATGTTTGAGACTTTCAATGTGCCTGCCATGTATGTTGCTAT
TCAAGCTGTGTTGTCCCTATACGCCAGTGGCCGTACAACAGGTATTGTGTTGGATTCTGGCGATGGTGTCTCACATACA
GTACCAATTTATGAAGGTTACGCCCTTCCTCATGCAATTCTTCGGTTGGATCTTGCTGGTCGTGATCTTACTGATTGTT
TGATGAAAATCTTGACGGAA > SEQ ID NO:25 107421 Nicotiana benthamiana
CGGACGCGTGGTTCTGATCTTCTTGTGATTCGATGTCGGTTAGAACAGTGAAAGTGAGCAATGTCTCTCTTGGTGTGTC
AGAGCAAGATATCAAGGAGTTCTTCTCATTCTCCGGGGATATTGAGTATGTTGAGATGATAAGTGAGAATGAGCGATCT
CAAATTGCATATGTGACATTCAAGGATCCCCAGGGTGCAGAAACTGCAGTTCTTCTTTCTGGAGCCACAATTGTTGATC
AGTCTGTCACAGTAGCTCTGGAACCTGACTACGAGCTGCCTCCTACAGCTCCAGTGCCAATCAAGGCAACCGAGAGGGC
TAATGCAGCTGGTGGTGGATCTGCTATTCAAAAGGCAGAAGATGTTGTGAGCAGCATGCTGGCAAAGGGCTTCATCTTG
GGCAAGGATGCAGTTAACAAAGCAAAGACATTTGATGAGAAACACCAGTTCATATCCACTGCCTCAGCCA > SEQ ID NO:26 107594 Nicotiana benthamiana
GCGTCTTGATAAACGCCGTTTCCTATTCCAATCTCCATCTACACTTTCTCTTTCTGAATTCAAAACAAAAACAAGTGTG
AAAATGAGAGAGTGCATTTCAATCCACATTGGCCAGGCCGGTATTCAGGTCGGAAATGCATGCTGGGAACTTTACTGCC
TCGAACACGGCATTCAGCCTGATGGCCAGATGCCGGGTGACAAGACTATTGGAGGTGGTGATGATGCATTCAACACCTT
CTTCAGTGAAACTGGAGCTGGAAAGCATGTTCCACGTGCTGTTTTTGTAGATCTTGAGCCTACTGTCATTGATGAAGTC
AGGACGGGAACATACAGACAGCTCTTTCACCCTGAGCAGCTCATCAGTGGCAAAGAAGATGCAGCCAACAACTTCGCCC
GTGGCCACTACACAATTGGGAAGAAATAGTTGATCTTTGTTTGGACCGCATTAGGAAGCTTGCAGACAACTGCACTGG
CCTTCAAGGTTTTCTGGTTTTCAATGCTGTTGGTGGTGGCACTGGTTCTGGCCTTGGGTCACTTTTACTGGAACGTCTC
TCAGTTGACTATGGCAAGAAATCGAAACTTGGATTCACAATTTATCCCTCACCACAGGTCTCAACGTCTGTTGTGGAGC
CTTACAACAGTGTGCTTTCAACTCACTCGCTGCTTGA > SEQ ID NO:27 108256 Nicotiana benthamiana
CACACTTCTATCTTACATATGTAGCCAAAGCATCGTTAAAATGGCGTACATTAAGCAAGCTTTTCTCTTGATTGCTCTC
TTTGTTGCAATTACAGTTAATCTCTCTGGATCTCCTAAGTTGCAAGTGATGGCTTTACGAGACTTACCCGAAGAGGTTG
CAATGATGAAAGATAAATTACTTCCATTAGGTGATATAGTAACTTGCTTGAAATACTGCAATGTCGAAAGCGATTGCAG

FIG. 1 continued

TGATGGTTGGATTTGCTCCAATTGTGTTCCATCTGCATTTCAGGGATGGAGATCTCAATGTGACTCGCTTACTGCTACT
GGTGAAGGTTATTTTGGAACTATACTCCGCGCTAAGCACAACAAAATATAAATTATATTGCTGCAATATATGAACTATT
TATAAATGCTTGATCTCGTGTTATATTCAAGCATTTTAAATAATATAATGTTGTGTTTCCTACTTGTCCAAGTTTATGT
AAGAAAATGAATATGTAACCATGTTTCTTGTTGTTGTCATCTTATATGCAGTTATTATGAAATATATGTTCTCTATTAT
CCCAATTAAAGTGGCACGAAACTTAATGGGAGATAATATTTACTATATATGATATGAATAGTGTCAT

> SEQ ID NO:28 108358 *Nicotiana benthamiana*
TAGCTCTAGTAATACACACATGAGCCGCACTTCCCACATTTTTAGTCTGAATAAAATGGCCAAGGCTACTGTATCATCC
ATTGTCCTCCTCCTCACTTTGAACATTCTCTTCTTCGCAATGGTTAGTTCAACTTACATCCCATGCCCACCAAAACAA
AGAATCAACCCCATCCCACTACCCCATCATCCAAGGGTTATAAGAAGTGCCAAAAGGACACACTAAAATTGAAGGTGTG
TGCCAATTTATTGAATGACTTGGTGCATGTTGTTATTGGAAGCTCATCAAAGAGTTCATGCTGCTCTCTCATTGAGAAT
CTTGCTGATGTTGATGCTGCAGTTTGCCTTTGCACTGCCATTAAAGCTAAGCTCTTGGGAACTAACCTTGATACCGCTC
TTTCCCTCAGCTTATTGCTCAACAATTGTGGAAAGACTGTTCCTAAAGACTTCCAATGTGCATAAATGGCCATCTTCCC
ACCCCAACTTGTTTGGTAATGAGGCGTAGTTGTCTGTTTGTGGTGTTTGTTTTCTCCATAAGATTTTCGTCGGAGATTT
CAACTAAAAAATAATCAGTACTGAGTGTGTTTGTGCACGGTTGCTTATTTTCTCAGGAAATATGTGGAATTATTCTAGT
GC > SEQ ID NO:29 108404 *Nicotiana benthamiana*
ATCTACTTGTCAAAGTTATCGATTGCATTTAATTAGTTTTGCTCTCAGTTAGACAGTTTCTTTTGTAGGGTGGTGCCGC
TGTCTGGTGCATGGGCTTTCAGAAAATTCCGGGCCAAGGATTGACAATTTTAGGAGATCTTGTTCTAAAAGACAAGATT
ATTGTTTACGATTTGGCTGGACAACGGGTTGGATGGGCCAATTACGATTGTTCGCAGGCGGTTAATGTTTCAGCTACCA
CAAGCAGAGGGAAAACTGAGTATGTCAATGCAGGACAGATCGGTAACAACAGTTCGCCGTGTAGCGACTCTTACAAGCT
GTTACTAAGCTTCATTCTAACTTCTGTCTTACATGTATTAGTGCGTGGCACAAACTCAATCTCGTAACGGCTTAGGCAA
ACTGCTCAACTTTTTCTCATTTTTTTCTCTTTTTTTTCTGTATAGCTGACTGTCCTGTAGTTATTTATTTACAGGTG
TCGATGAAGATCTGTCTTCAGATCTGGATTGCAAAAATTTTAGGTGCCTTTAATGGTAGCCTTAGATATGTTGTTTGTT
C > SEQ ID NO:30 109191 *Nicotiana benthamiana*
TACTACTCAGATTCAAAAAACAGCTGAATCTGCTTTAGAGGTGGTATACCAGCCTATTATTTCTGGAGATTTACCAATT
GCGAGACGAGCTTCACTTACTAGGTTTTAGAGAAAAGAAAAGATAGGCTGACTGCAAAAGCACCGTACCAATTAAGCA
ACCCAAATAAACAAGCAGCAGTTTCTGAAAACAAGGCGTGGCTTGGATTGGGTGCTCAATTTCCAGTGAAAGCTGAGCA
ATTCTAGTACTCTACTTAATTGTTTTGGCTTTCATTACTTGTTATTAGGCCTAAATACACTACTAGTACTGCTTAATCC
TTTATCTAAACCAAAAATTATTAGATCTGACTACTCTGGATTCATTACTAGTAATAGATTTTTGTATTGAAACCAGAGA
TGGTTATTCAGTGCCCTTTTGTGTAGGTATTCAATTCGTCTGAGGCTTAAGTTTTTATTTCCTATTGTACTGCAAATGG
AATGTTTATCACAACAGCAATTTCTATGTTT > SEQ ID NO:31 109274 *Nicotiana benthamiana*
AAATAGGCTGCTTTGAATACCAGCAGAAGAAGAACTGGCTGCTTCTAGTGTTAGTGAAGCAGCAAGGAAACTGCAAAAT
AGATTTCTTGAGCTGAGATATGTGAATTTTTCTCAAGAAATTCTATCTCTTTGGCTTTCTGTAGTGGGTATATAAAGAC
ATAAAGGTTGAATCTTTTATGGTTTAACATGGATATAAGGAACAATCTCTCCACAGAATCTTGGTTAGCATCAGTTTCT
TGTTCTGCCTCCACACTACAATCTTCAGCAGTGGTTAAATGGTTAAGATTCATCTTCCTCTCTCCATGTCCACAAAGGA
CTCTTCTATCTTCCATTGATGTGCTGCTTTTGCTTACTTTCATTGTGTTTGCCGTACAAAAGTTTTACTCAAAGTTGAG
GTCCAATGAGCACTCTAATTCTGGCATTGATAAGCCTCTTATTGCACACAACAGGACTTCTGTTAAAACCAATCTATGG
TTTAAGCTGTCTCTGATTTTGTCAGCTATTTTAGCCTTATCTTCTATAGTTTTATGCATTTTGGTTATTGTGGGAAATC
CCCAGTCGTCTTGGAAAGTCATCGATGGCTGTAT > SEQ ID NO:32 109329 *Nicotiana benthamiana*
CCGTATCAAACGAATTGAAGAGGTGATGGCTCCGAAGCAGCGGAATACAGGGCTATCTGTTGGGCTAAACAAGGGCCAT
GTTGTGACCAAGAAGGAATTAGCTCCACGTCCTTCCGACAGAAAAGGGAAAACAAGCAAAAGAGTCCACTTTGTGAGGA
GCCTTATTAGAGAAGTCGCTGGATTTGCTCCATACGAGAAAAGGATTACTGAGCTTCTTAAAGTTGGAAAGGACAAGCG
TGCCTTGAAGGTAGCTAAGAGGAAGTTGGGCACTCACAAGAGGGCAAAGAAGAAGAGAAGAGATGTCTAGTGTTCTC
CGTAAGATGAGGGCCACTGGAGGTGGTGAAAAGAAGAAATGAAACCTGTATCTGCGGTTGATGATTGAAGAACCCAGTT
AGTTAATTCACTAGCTTTTATGTTTGCAATGTATTTTTGCTTTCAAGAAAGAGGACTTGTGATTAAAAGCTCCCGATCT

FIG. 1 continued

ATGTTCCATGAAGATTTTGAAATTAGTGATATTGTAGACATTTTTGCCAAGTGCATGTTTTTTCTGGTAATACTAGTGT
TAATTATCTGCTA

> SEQ ID NO:33 109411 Nicotiana benthamiana
AGGATGGTTATATTATAGCTTTACATGCAAGACATCACCCTGCTTTGCATGTCTCCAGACAAAGAGTTAAAGGGGGTGG
TTGGTTCCTCGACACAATGTCAGATGTTACAAAAAGAGACCCAGCAGCACAGTTCCTTGTGGTTTTTAGAAGCAAGGAT
ACAATTGGGTTGAGATCATTTACTGCTGGTGGGAAGTTATTACAGATAAATAGGAGGATGGAATTTGTATTTGCGAGTC
ACAGTTTTGATGTTTGGGAAAGCTGGACATTTGAAGGTACTATGGAAGAATGTCGACTAGTGAACTGTAGGAATCCTCT
GGCCGTTTTGGATGTTCGTGTTGAAGTACTAGCAGCGGTTGGAGAAGATGGTATCACCAGATGGCTTGACTAGGCAGTG
TCAGAGCCGTTGCACATGATTTTTAAAATATGCTATGCTGATTTGTTTGGAATATTTACCACAAGTAGTTTTGTAAGGC
ATTGAGTCTCACTCGAAGCAAGAGTTGTATGTTTTTAATGTAACTTTCATTATTGCCTCCTATCAGGGATCTTTTCCCC
CCATGAAAATGGCTGATTGTATTTCGAGGATTCAAAATAGC > SEQ ID NO:34 109420 Nicotiana benthamiana
CGACAGTGGCCATGGCTACTCAACGAAGGGCAAACCCTAGCTCTCTCCATCTAATTACTGTGTTCTCTCTGCTTGTCAC
TGTTGTCTCCGCTGAGGTCTTCTTCGAGGAGAGTTTCAACGATGGTTGGGAAAGCAGGTGGGTGAAATCTGAATGGAAG
AAAGATGAAAACATGGCTGGAGAGTGGAATCACACATCTGGCAAGTGGAATGGAGACGCTAATGACAAAGGTATCCAAA
CCAGTGAGGACTACAGGTTCTATGCCATTTCAGCTGAGTTCCCTGAATTTAGCAACAAGGGAAAAAACTTAGTGTTCCA
GTTCTCGGTGAAGCATGAGCAGAAGCTTGACTGTGGTGGTGGGTACATGAAGTTGCTTAGTGGGACGTTGACCAAAAG
AAATTCGGTGGTGACACTCCCTACAGCATCATGTTTGGCCCAGACATCTGTGGCTACAGCACCAAGAAGGTCCATGCTA
TTATCACTTATAATGACACAAACCACTTGATCAAGAAGGAAGTACCTTGTGAGACTGATCAACTTACCCATGTTTACAC
TTTCATCCTCCACCCTGATGCTACATACAGCATTCTCATTGATAATGTGGAGAAACAGTCTGGTAGCTTGTACTCTGAC
T > SEQ ID NO:35 109513 Nicotiana benthamiana
GGCCGTGAAGATCGACACCGTCCGCAATGTCGAAGCGAGGACGAGGAGGTTCCGCTGGGAACAAGTTCAGAATGTCGCT
GGGTCTGCCGGTGGCGGCGACGGTGAACTGCGCCGATAACACAGGTGCTAAGAACCTGTACATCATTTCAGTGAAAGGG
ATCAAAGGAAGGCTTAACAGGTTGCCTTCAGCTTGTGTTGGTGACATGGTTATGGCTACTGTTAAGAAAGGTAAGCCAG
ATCTTAGGAAGAAGGTTATGCCAGCTGTCATTGTTCGTCAGCGCAAGCCCTGGCGCCGAAAGGACGGTGTTTTTATGTA
CTTCGAAGATAATGCTGGTGTGATTGTGAACCCCAAGGGTGAAATGAAAGGGTCTGCCATCACTGGCCCTATTGGAAAA
GAATGTGCTGATCTTTGGCCTAGGATTGCAAGTGCTGCCAATGCTATTGTGTAGGAGTAGGGTTGCTAAGTAGTTTACA
GTTCTCGTTTTGTTGGGTTTTCATCAAGTTTCTGAATATCTGAGGGCTTTGTCTTAATAAGAATTATTGCTCGGAATTT
TGCAGTAAA > SEQ ID NO:36 109523 Nicotiana benthamiana
CCCACGCATCCGGTTGGTCACAATGCTCTTGGTGCTGGAAGGATCTTTGCTCAAGGTGCAAAGCTTGTTGATCTGGCCC
TTGCCTCTGGTAAAATATATGAGGGAGCAGGTTTCAAGTACGTTAAAGAATGCTTTGAAAAGGAACTTTACACCTTAT
TGGGCTCTTGAGTGATGGGGGTGTCCACTCCAGGCTTGACCAAGTGCAGTTGTTGCTGAAAGGTGCTGCTGAGCATGGT
GCCAAAAGAATTCGTGTCCATGCCCTCACTGATGGACGTGATGTTCTAGATGGTTCTAGTGTGGACTTCATGGAGACTC
TTGATAATTCTCTTGCACAATTACGTGAAAAAGGTATTGATTCCCAGGTTGCATCTGGCGGAGGTCGCATGTATGTTAC
CATGGATCGATATGAGAATGACTGGGATGTCGTAAAAAGAGGCTGGGATGCTCAAGTTCTTGGTGAGGCTCCACACAAG
TTCAAGGATCCCGTTGAAGCAGTTAAAAAGTTGAGGCAGGAACCCAACACCAGTGATCAATACTTGGCCCCTTTTGTTA
TTGTTGACGATTATGGAAAGCCCGTTGGGCCTATTTT > SEQ ID NO:37 110965 Nicotiana benthamiana
TTGAAACAGTACTTCAGGCCAGAGTTCTTGAACAGATTGGATGAGATGATTGTATTCCGTCAGCTAACTAAGTTAGAGG
TGAAGGAGATAGCTGATATCATGCTTAAGGAGGTCTTTGAGAGGTTGAAAAATAAGGAGATAGAACTTCAAGTGACAGA
GAGGTTTAGAGACAGGGTGGTTGATGAAGGGTACAACCCAAGCTACGGAGCAAGACCGTTGAGGAGAGCTATTATGAGA
CTGCTGGAAGACAGCATGGCTGAGAAGATGCTTGCCGGTGAGATCAAAGAAGGTGATTCAGTAATTGTGGACGTGGACT
CTGATGGCAATGTGACCGTCCTCAATGGCACTAGCAGAACTCCCTCAGATCCAGCTCCCGAGCCTATCCCTGTGTAGAT
CCGCTTCTTGCTTTAGCTCTGCAAATTTGTTGTTTGTAATGTTGCTTTCATTTGTCGTGGCCACTAAGCCCTCCTGGGG
TTATGAAGCAACTTGTGAGTAATTTATGGG

FIG. 1 continued

> SEQ ID NO:38 111075 Nicotiana benthamiana
AAAAAAATGGCAGAAGGTGAATACAGGTGCTTCGTCGGTGGGTTAGCATGGGCTACTACCGACCAAACACTTGGGGAGG
CTTTTTCTCAGTTCGGCGAAATTCTTGACTCGAAGATTATCAATGACAGAGAAACTGGTCGATCTAGAGGGTTTGGATT
TGTTACATTCAAGGACGAGAAATCTATGAGGGACGCTATTGAAGGGATGAACGGCCAGGACCTTGACGGTCGTAACATC
ACCGTCAACGAAGCTCAGTCTCGCGGAAGCGGTGGAGGCGGTGGCGGTTACCGTGGTGGTGGCGGTGGAGGCTACGGAG
GCGGTGGCCGTCGTGAAGGTGGTTATGGCGGCGGTGGTGGTTACAGAGGTGGCCGTCGTGAAGGTGGTTATGGCGGCGG
TGGCGGCTATGGAGGTGGCCGCCGTGAAGGTGGTTACGGTGGTGGCTCTGAAGGAAACTGGAGGAGTTAGATTTTCCGG
GTCCTTTAGATATAATTTTTTGTTTGAATTTTATGGGTCTAAGTTTGGGTGA > SEQ ID NO:39 111108 Nicotiana benthamiana
AAACCAATGACCCAGGCTTTCATCTCCTGTGGTGTTGGGGTTTGGCCCGGTCACATGGCAACAACTTTGCTGGTTACAC
CAAGATTCTAACTAGCAAAGATCAACTATTACAAAAAGCAAAAGAGGAAAAATTTTTAAGGGGTATTGCGAGGGTGCA
TTACCTTTCAAACCAACTTACAAATATGATATTGGAAGCACCAGCTATGATACCTGTCACAGGGTAATTAATTAGGCTA
ATCTTATTGGTCCTTTTATTTAATCATTTGAGGCGCCACGTTTAAAATGTTAATTTAACTTGCGTAATTGTGAAAAAAA
G > SEQ ID NO:40 111175 Nicotiana benthamiana
CGGACGCGTGGGTTCGTATTTTCCTAACACCAACCTCAGGAGGCTCTTCGTATTTTCCTGAATCTATGGCTTTCTCTTC
TCTTCTCAAACCTACCGCCTCCATTGTTCGACCTTCCCATCGTTCCCAGGTATCATGTGCAGGTCTTCACCAGAGTGCT
AACTCTGTCAAATTACAATCGTCCATCTTCGGAGATGCTGTCTCAGTCATGCAATGTTCGTCCTTACAAAAATCTGGTG
CCTGTAGCATTCAACCTGTTAGAGCAACTGCTACTGAGTTGCCTCCGACAGTTCCAAAGTCACGGACCAGTGGGAAGAC
AAGGATTGGTATAAATGGTTTTGGACGGATTGGGAGATTGGTATTACGAATTGCAACATTCAGGGATGATATTGAAGTT
GTGGCAGTTAATGACCCATTTATCGATGCAAAGTACATGGCTTACATGTTCAAGTATGACTCCACTCACGGGTCTACA
ACTCATCCATCAGTGTCCTGGATGAGTCTACTTTGGAAATCAATGGGAAGCAGATTAAAGTCAGTAGCAAAAGGGATCC
CGCAGATATTCCATGGGGTGATTTAGGTGCAGATTACGTTGTTGAATCTTCCGGTGTCTTCACAACT > SEQ ID NO:41 111223 Nicotiana benthamiana
AGCAGCTCGCCCCAGAGACGAAACCAAGCTTTCAAATACCAGTGATATGCTTAAGACCTCCACTACTAAGCATGACTCA
GATGGGTTTGGATCTGCTGGCTTAAAGTCTTTCAGAGCATTAGCAGTCATTGGTGCTGGAGTCTCTGGGCTCCTTAGCT
TCACAAGTGTTGCTTATTCTGATGAAGCAGAACATGGGTTAGAGTGTCCCAGCTATCCTTGGCCTCACCAAGGCATCCT
CAGTTCTTATGACCATGCTTCGATACGTCGAGGTCACCAGGTTTACCAGCAAGTGTGTGCGTCGTCCACTCGATGTCA
CTAATTTCGTACCGTGATCTTGTTGGTGTGGCATACACTGAAGAAGAAACTAAGGCCATGGCAGCAGAAATTGAGGTGG
TTGATGGTCCTAATGACGAGGGTGAGATGTTCAGCCGCCCTGGGAAGTTGAGTGATCGTTTTCCACAGCCTTATGCAAA
TGAAGCAGCTGCAAGGTTTGCTAATGGCGGAGCCTATCCTCCTGATCTAAGTCTTATCACTAAGGCCCGACATAATGGT
CAAAACTATGTTTTTGCTCTTTTAACTGGCTATCGGGACCCTCCTGCTGGTGTCTCG > SEQ ID NO:42 111277 Nicotiana benthamiana
CAAAAATGGCTCTCCAAGCAGCATCTCTGCTTCCTTCTGCATTTTCCATGCACAAAGAGGGTAAATCATGTGCTACTCT
CAAGGACAGTAGCCTCTTTGGAGTTACATTATCTTACAATCAAAAATCTAAGTTCATTCCTCCTGCTGCATCGAACAAG
GAATTGACAAAGAAAATAGCAGCTGTACCTATTAGAGCACAAACAGCTGCTACCACACCAGCAGTCAACCAGTCTACCT
CAGAACAGAAGAAAATCCTCAGGAAAGGCAATGTGATAATTACCGGAGCCTCCTCTGGTTTAGGACTAGCTACAGCAAA
GGCTATAGGTGAAACAGGAGAGTGGCACGTTATAATGGCCTGCAGAGACTTCCTTAAGGCTGAGAAAGCAGCAAAATCT
GTGGGCATTCCAAAGGAAAACTACACTGTCATGCATCTGGACCTCGCTTCCCTTGAAAGTGTCCGCCAATTTGTAGATA
CTTTCCGACGTTCAGGCAGGCCACTTGATGCACTAGTCTGCAATGCTGCAGTGTACTTGCCGACT > SEQ ID NO:43 111358 Nicotiana benthamiana
CGGACGCGTGGGGTCGAGGAGAAAGACTAGGGAGCCAAAGGAAGAGACAGTAACACTTGGACCAGTAACCAGGGAGGGT
GAATTGGTGTTCGGTGTTGCTCACATTTTTGCCTCTTTCAACGATACTTTTATTCATGTGACTGATTTGTCTGGAAGAG
AAACTATGGTTCGCATTACTGGTGGAATGAAGGTAAAGGCTGATAGAGATGAATCTTCTCCATATGCTGCCATGCTTGC
AGCTCAAGATGTGTCACAGCGATGCAAGGAACTTGGAATTAATGCTCTTCACATTAAGCTTCGGGCTACAGGAGGCAAC
AAGACTAAGACTCCTGGTCCTGGTGCCCAGTCTGCTCTTAGGGCTTTGGCTCGATCTGGCATGAAAATTGGACGTATAG
AGGATGTGACTCCAATTCCCACAGATAGCACTCGCAGAAAGGGTGGTAGAAGGGGAAGGAGGCTGTGAAGATGGTTCGT
TTCTGCAGCATAATGCACCTTGGAGGATTTTGGTGTTGAGGATGCTCCTTTCAATTTCTTTTTACAATTGATATCTAAA
TACTTT

FIG. 1 continued

> SEQ ID NO:44 111437 Nicotiana benthamiana
CTCAAATCGAGCAATGGAACGATTTTTCTGCCACTGAGATTGATGCAAACATTGGGCAATGGTTGTACCCACGTCTCGG
CTATCGTGTATTCATTCCTCCAGCCGAGGAAGCTGCAGTAGCTGCATTAAAGAGAGCTCTTGCTGCTTTAAACATCCAT
CTTGCGTCTAACACTTACTTGGTTGGACATTCAATCACATTGGCCGACATTATAATGGCCTGCAACTTGAGCCATGGTT
TTAGGTATATAATGACTAAGACCTTTACCAAGGAATTCCCACATGTAGAGAGATACTTCTGGACTGTGGTTAATCAGCC
AAATTTCTGCAAGATATTGGGCGAGGTGAAACAAGCTGAATCTATCCCGGCGCCCCCGTCCAAGAAGCCTGCACCAGCG
AAGGAACCTGCAAAACCCAAAGCAAAGGAGGAGCCAAAGAAAGAGGTTAAGAAGGAAGAACCAAAGTTTGAAGAGGAGG
AAGAAGCACCCAAGCCTAAGGCAAAGAATCCTCTTGATCTCTTGCCTCCAAGTAAGATGATTCTGGATGAGTGGAAGAG
GCTTTACTCCAATACCAAGACCAACTTCCGTGAGGTTGCCATTAAAGGTTTCTGGGACATGTATGATCCT > SEQ ID NO:45 111469 Nicotiana benthamiana
CATGGGTTCACTCGCCGATCCCGGCGAACTCGACTCGGTGGCGCCGCCACCGAGTTTTGATGACTTCCAGCGCCAAACT
TCCTTAATGACAAGCTGCACTCTCCTCTGGAAAGAGCTCTCCGATCACTTCAATTCACTCGAACAAGACATCCTCAAGA
AATCCGAAGCCTTAAAAGCTAAAATCCAAACCCTAGATTCCGAAACCAAAGCTTCCCTCGACGCCCTCGAAAAACGCGA
GATTTCAATGAATGTTTCACTCTCAATTTCTCTTCAGAAGGTTCTCGAAAACAAGCAAGCTGCTATTTTAGCTCTAGAT
GAGGGTGCAGAACAACCCGAAGTCGATGACTCTACTGGATTGTATCTAAAATTGAAGAGCTTTTGTGTTAAGATGGATT
CTAGAAGCTTCTGGAGGTTTTTAATTGTGAAAAGAAGGATTTGGATTCACTTAGGGTTGAGATACCGAAAGCATTAGG
AGACTGCGTGGATCCGCCGAGGTTCGTGTTGGAATCGATATC > SEQ ID NO:46 111751 Nicotiana benthamiana
TTTCCCAATATTCCATAGAGAGAAAAAAAGTAAGAACCAAAAGGATGAGATTTTCAGTTGTAATTGTCTTTGTGATGTT
GGCTTTGTTGCTAACCACAACTTATGCAGAACAATGTGGTAAACAAAACCATAAGCGCAAGTGTCCCAACAAGTTGTGT
TGTAGCAAGTTTGGTTGGTGTGGCACTAGTTGTGACTACTGTGGATCTGGCTGCCAGAGCAACTGTCACAAAGGCTGTG
CCACCGCCATGTTCGCCAATGAAACAGCCAATAATAACGATGCTAATTTCAACTGATCGATCACGACCATATTACTAAA
AGTTTGTCGTACAACATACACTTAAGGGTGATATGCTATAAGTTATGAAAAAAATAAAGGAAGGTGTGTTGTGTATGTA
AAAATAAGTAAGAATATAAGTGATGCACACTATGTGAGCTTCACAAGTTGAATATTGTGTAAGATCAGTGATCCCCACT
ATGTAATAAATAATACTAATATTATATTTTACATAACCCC > SEQ ID NO:47 111752 Nicotiana benthamiana
AAAACTTGCCAACTTTCCTGAGTGCGATGTCTTCATTTATGTTTCTTGTGCACAAACTGCTCTATTGGATAGTAAAGAG
TTCTTAGCTCCAGTTATTACTCCTTTTGAAGCAATGATTGCTTTCGGCAGAGGAAGTGAATGGACTGGAGCTTATGTGA
CAGAATTTCGGGATTTGATTACTTCTTCCCCTGTGGAAGTGAAAGACCAGTCAGAAGCGCGGTTTTCTTTCGTTCAGGG
TGGATATGTGGAAGATTTTGAACAGCAAGATGTTGAAGAAGATGTCGAAGATGGAGTTTCTGCTTTAGTGAACATCACA
GAGAAAGCTCTGCGTGTTCGTGACAAGGACTCGCAAACTCTTATGAATGGAACAGCTAAATCTGGGGCAGAATACTTCG
CAGCTAGGTCGTTTCACGGCCTTGACATTCATACTGACAATAATTTTCCCGAGCCATTTTTAATTGGTAAAAGTGGGAG
AGCATCAGGGTACAAGAATGAGACTACAGAGTAAAAGTAAATTTGTGATGATTC > SEQ ID NO:48 111758 Nicotiana benthamiana
CCCACGCGTCCGGCCAAAACTAGTATCCCACCTACTATATTTGTATAATATGGAAGTTGCCAAAGTTCTTCACCTGAAT
GAAGGAATTGGAAAGGCTAGCTATGCCAAAAATTCTCTGTTTCAGCAAAAGGTGATCCTAATGACAAAGTCAATAAGAG
ATGAAGCCATATATGCACTATACCGCAGCCTTTCCCCAGAAGCCATTTGTATTGCAGACTTAGGATGTTCCTCTGGACC
TAATACTTTCCTTACTATTTCCGAACTCATTAAAACTATTTATGAAGAAAGCAAAATCAATGGCAAAAACAGTCGCCG
GAATTCCAAGTTTTCTTGAATGATCTTCCCGGAAATGATTTCAATACCATTTTCCGGTCGTTGCCAGAGTTCTACGAAG
ATTTGAGGAAACATATGGGAGATGGATTTGGTACAAATTGCTTTGTTGCAGGAGTTGCTGGTTCATTTATAATAGACT
TTTCCCTTCCAACAGTGTGCACTTTGTCCACTCCTCATACAGTCTCCACTGGCTTTCTCGAGTACCTCATGGAATAGAG
AATAACAAAGGAAATATTCACGTGGCAAGTACAAGCCCACAAGATGTGGTTGAAGCATACTACGAGCAATATGAAAGAG
ATTTTGTGAATTT > SEQ ID NO:49 111761 Nicotiana benthamiana
ATTTAATATCAAAGAAAAGAAAGGAAAATGACTTGTACATTGGCTCTCAAATTGATTGTTAGTGTTGTCACTTTGCTTT
GTTTAATTCACTTTTCCTGTGTTTGTGATGCTAAAAGGATGCTTAGGGAGGAAAATGAGAAGTTATTTAAGGTAAAAAA
GGATGATTCGGCTTCTCCTTCTCCAGATTCAACAAACATTGGTGGATTTCCTTTTCCATTCAATTTTCCACCATTTTCT
GATGGAATTCCAAATATACCCTTCAATTTTCCATTTCCTGACTTTGGATCATCAGGAGGATTGCCTGGTTTTGGAATTC

FIG. 1 continued

CTGGTACTGGTGATAATAACCCATTTACTTTTCCAATCCCTGGAGTTCCTAATGTTGCTGTTCCACCCCCAGCTGCCGC
CCCTTAAATTCCTATACAACTTTCTCTCTGTTATTATCAGTTTAATTTTGTAAGAAGAAGGAAATCAAGGAGTAAGTTT
TAGAGCCATAGGCTCAAATGAATTACTATTTCTTGTCCTTGTTTAATTAGAAAATGGGAAATGACATATATATCAAGTA
AAAAAGAACTCGTATTCTCCTACCATT

> SEQ ID NO:50 112105 Nicotiana benthamiana
TCCGGCGGCAGCAGATACTGATGAAACAAAGGCACCGGCAGCGGCTCCTGCGGCAGCAGATACTGAAGAAACAAAGGCA
TCGGCTCCGGCACCGGCGGCAGCAGATACTGAGGAAACAAAGGCACCGGCAACCGCAGATACCGAAGAACCACCGGCAC
CGGCACCAGCACCGGCGCCGGCACCGGAAGAGAAGGGAGAAGGGTATGGGCAATACGTGAAAATGGCAGAAGGATTTCT
GAAATCAGGAGATGATGAATCAGCGAAAGCATCTGAAGGAGGATCAGATTATCTTAAGATGGCCGGTGACTTCTTAGGC
AAGAAGTGATTAGTTTAATCAGATTCTTTTTAATAATGACTGTTATTTTCCAAGTTTTTCTTCTTTCATTTTCTTTGCC
ACTGTTCAGTGTTCATTACCGGCGGCGAACTTCTTCAGTAGCCGTCGCCGGAGCTGGTTTTTACTTGGCATGTATGTAA
TTT > SEQ ID NO:51 113170 Nicotiana benthamiana
CGAAAACCTCACTGAAATATTTAGAGAGATGGCAAACCCGAAGGTGTTCTTTGACCTTACTATCGGCGGCACACCAGCT
GGCCGTGTGGTGATGGAGCTCTTTGCCGACACCGTTCCCAAGACGGCGGAGAACTTCCGTGCTCTCTGCACCGGCGAGA
AAGGCGTCGGAAGGATGGGCAAGCCTTTGCACTACAAAGGCTCAACCTTCCACCGTGTGATCCCAGGGTTCATGTGTCA
AGGAGGTGATTTCACCGCCGGAAACGGTACCGGAGGTGAATCAATCTACGGCGCCAAATTCGCCGACGAGAACTTCAAA
AGGAAGCACACCGGCCCTGGAGTCCTCTCCATGGCTAATGCTGGACCTGGAACCAACGGTTCTCAGTTCTTTATCTGTA
CCGCTAAGACAGAGTGGCTCGACGGCAAGCACGTTGTGTTCGGTCAAGTTGTTGAAGGCTATGATGCGATTAAGAAGGC
TGAGGCTGTTGGATCTGGATCTGGCAGGTGCTCCAAGCCTGTTGTGATTGCTGACTGTGGTCAACTCTGCTAGATCTGA
GGACGTTGATGATGATCTAGTTTATCTATATTTAACTCGCCGTTTTTGGCTTTGTTTTTAATTTTAATCTATCGGTTAC
TGCTTGCTTACT > SEQ ID NO:52 113595 Nicotiana benthamiana
TAAGCATACACCGCCAGCCCCAAAAATCTAAGCATCGGCCGAATGGCAGCAGCAGCTTCTACTTCAATGGCAGCTACTG
CCGTCTTTGCTTCTCGTTTCCCACTTTCCTCCACCACCAAAGCCGCCCCTGTTCGCTGCTCCGCTTTGCCTTACCTTCC
ACCCCGCCTTTCTGCTACCGCGTTCTCTACTTCCTTCCAGTTTGCTGAACCCAAGAAGGCTTCGCTACTCCAGGTCAAA
GCCTCTTCATCAGAAGAATCCGGTGCTGTTGATACCAGTGAATTGTTGACAGATCTAAAAGAAAAGTGGGATGCTGTTG
AAAATAAGTCTACAGTTATAGTATATGGAGGTGGGGCAATTGTTGCAGTTTGGCTGTCTTCAATTGTTGTTGGTGCTAT
CAACTCAGTTCCTTTGCTCCCAAAAATTATGGAGCTGGTGGGCCTTGGATATACTGGGTGGTTTGTCTACCGCTATCTT
CTATTCAAGTCAAGTAGAAAAGAATTGGCAGAAGACATTGAGCAATTGAAGAAGAAGATTGCAGGAACTGAATAAATGC
ACACAAATGGCAATGCCAGTTCAGACTGTTAATTTTCTGTATG > SEQ ID NO:53 114370 Nicotiana benthamiana
TCTCCATCTTACTAACAATGGCACCAAAAGCTGAGAAAAAGCCCGCCGAGAAGAAACCAGCAGCAGAAAAAATCCCCGC
CGCAGAGAAAGCTCCGAAGCCAAAGGCCGGCAAAAAACTACCTAAGGACGGCGGAGCTGCCGCTGCCGGAGACAAAAAG
AAGAAGAGAGCCAAAAAATCGGTTGAAACTTACAAGATCTACATCTTCAAGGTGCTGAAACAAGTACATCCTGATATAG
GTATCTCAAGTAAAGCTATGGGTATAATGAACAGTTTCATCAACGATATCTTCGAGAAGCTTGCTCAAGAATCTTCCAG
ACTTGCCAGGTACAACAAGAAGCCAACCATTACTTCTCGGGAAATTCAGACTGCTGTGAGACTTGTACTTCCTGGTGAA
TTGGCTAAGCACGCCGTTTCTGAAGGCACTAAGGCTGTTACGAAATTCACTAGCTCTTGAATGTTGTTAGGGTTTGCGT
TCTCTTTTCATGTCTTAATCAAGGGTTTTATGGATGTAAAAATAGTTTAATTAGTTTGTTTTAAGTAAATCTTTTGTAT
TCGACTGCCAGTTATGAATGGAATTGCTAAGTTTTCTACTTTG > SEQ ID NO:54 114380 Nicotiana benthamiana
TCGACTCAACAAACCTTTACCCCATCTCTAAATCTATATTGGTTTGACAAAGATGATAGAAAGGAATCTTGGAAAATGT
TTGTTGCTCCTTCTTTGTTTAAACGTTGTCTCAAATATAGTGGCTGCTGGGGCTCCACCAACTTGTCCTGCTGATATTG
GTAGTGATTGTGGAAGTGATTCAGGTGAATGGAAGGGGAGTTCTTCCCTGGAATTCCAAAAATTAAGTATGAGGGTCC
ATCTAGTAAGAATCCACTTTCCTTCAAATGGTACAATGCTGAAGAGGAAATTCTTGGCAAAAAGATGAAGGATTGGATG
CGATTTAGCGTTGCGTTCTGGCATACGTTCCGTGGCACAGGAGCTGATCCATTTGGTGCTCCTACAAAGTTGTGGCCGT
GGGAAGATGGTACCAATTCCCTGGCTATGGCCAAGACAAGATTGAGAGCAAACTTTGAGTTCCTGGAGAAACTTGGAGT
AGATAGATGGTGTTTCCATGATCGGGACATTGCTCCGGAGGGCAAAACCCTTGAGGAAACAAATGCAAACTTGGACGAA
GTGGTGGCTCTTGCCAAAGAGCTTCAGGGAAATAAAATTCATCTTTTGTGGGGTACCGCTC

FIG. 1 continued

> SEQ ID NO:55 114404 Nicotiana benthamiana
CTTTTCCTAATTTCTTCCGACCCCTCCATTTCCCTTTCCAGCTCCGCCGTATTTTTCTATTAGGGTGCGACATGGCAGC
AACATCAGCAACTACTTTCTCAGTTGGCTCAGCCACATCTCTGGGCTGCAAAGGAAGCTCAGTATCGCAATCAAAAGCC
ATTGGTGTGAAATTCAACTCCAAAAACAACCTTAGAAGTTTCAGCGGTTTGAAGGCTGCCACAACTGTAAGCTGTGAAT
CAGAATCGTCCTTTTTAGGAAAAGAAAGTGTTGCCGTCCTTAAACAATCTATTACTCCAAAGGCTCAAAAAGAAAACAA
GGTATGTGGGAACTGTGTTCAGCCTCAAGCATCTTACAAAGTAGCCGTTCTTGGAGCGAGCGGCGGTATAGGCCAGCCC
CTGTCTCTTCTGGTCAAGATGTCACCGTTAGTTTCAGAGCTGAACCTTTATGATATAGCTAATGTTAAAGGAGTTGCGG
CTGATCTCAGTCACTGCAACACTCCCTCCAAGGTTTCAGATTTCACTGGAGCTTCTGAATTGGCCAACTGTTTGAAAGG
TGTAAATGTGGTGGTCATACCTGCTGGTGTTCCAAGAAAGCCAGGTATGACACGTGATGACCTGTTCAACA > SEQ ID NO:56 114417 Nicotiana benthamiana
ACGTTACAACAACTACAGAGGGCGTGGCGGAAGAGGGATGGGGGTTTCAAGACCAGTTACAAAATTTGAAGAGGATTTT
GATTTTATGGCCATGAATGAGAAGTTCAAGAAAGACGAAGTGTGGGTCATCTTGGCAAAAGTAACAGAGAAGGAGATG
GAAATGGCAGCGATGAAGATATCTCTTTCAATAAATATGATGATGATCTTCCTAAGATTGATGTGAAGCCTGTTTACAA
CAAGGATGATTTTTTCGACTCTTTGTCAAGTAATGCACTTGATAATGACCCAAGTCATGGAAGGACCAGGTTCTCTGAG
CAAAGGAAGATAGACGTTGAGACATTTGGAGATTTCTCAAGATACAGGGGTGGCCGCGGTGGCCGTGGTCCTGGACGTG
GTGGACGTTCTCGAGGTTCGTATTATGGAAGAGGAGGATATGGAGGATACGGTGGAAATAGAGGAAATGGGTATGTTTA
TGGTTATGGTGGTAGAGGCAGAGGCCGTGGTATGCCATCCCGTGCTTCGTAAAAGCGTTTGCTGTATTATCTCGAGCTT
GAGCTAGAAGAAACTATCTGCCTCTTTTAGGCAAGATAGTGTTAGTACTATCTGATCCTGTAACGT > SEQ ID NO:57 120342 Nicotiana benthamiana
TTGATGAATATCTAGATGGACGATGTATATACCTCGTTGGAGTGATGGGCTCTGGCAAAACAACTGTGGGCCGTATTTT
GGCAGAAACACTGGATATTCCTTTTTTGACTGTGACAGGCTGATAGAGCAGGCTGTTGGTGGAACTACAGTAGCTGAA
ATCTTCAAGCTTCGTGGAGAGAGCTTCTTTAGGGACAATGAGACGGAGGTATTGCACAAGCTGTCTGCGATGCATCGGC
TTGTTGTTTCAACAGGTGGAGGTGCAGTTGTTCGTCCCATTAATTGGAGACATATGCACAAGGGTATTAGTGTTTGGTT
AGATGTTCCTTTAGATGCTTTGGCCAAGAGAGTTACTGCTGAAGGAACTAAATCTCGACCCCTATTACATGAAGAATCA
GGAGACATTTATGATAAGACTTTGAAGCGGTTAACTACTTTAATGGAGACAAGGGGTGAAAACTATGCCAATGCAAGTG
TCAGGGTTTCACTAGAAAATATTGCAGTGAAAAGGGGAAAAGATGTCTGCCATATTACACCTACTGAAATTACTCTAGA
GGTTCTTATACAAATTCAGAACTTCTTAAAGAAACAAGAGAGCGTAGTTGTGCTATAAGATTTTTTACTTCCCAATGGG
GGGCG > SEQ ID NO:58 120557 Nicotiana benthamiana
AACATTGAGAATTTGATCGTCCCCATTCAGCATCAGTGTTTGTATGGGTATGAAGTATTATGCAGGATCCTTCTGATGC
CAGGCTTCTAATTCATGGTTCTGGTGGAGATAACTTGTCAAGAGACTCAGGCAACCTGCTTTATTAAAGTATTGGAAAG
TTCTTCCAGAAAAGAAGCTAAAGTGATTAATTCTATCTGAGGTGACATGGAAGCTTCTTGTTGAGTTTTGAATCATCCT
GATTGTAGGCCATATTTCCTGGAGATCCTGAGAAGCAGTGTTTTAAAAAGTGGAATGGGATGGGGGGGAATTTTGGTTC
CGTTACTATTCTCCATCACTTTGGTCGAATCATCAAGAAATGCTGAAAAAATGTGGTCGCTAAACGTAGTCTCAGGATC
ATCTCCACTTTATAGCTGGGCTTTGTACAGTGCTGGTTTTTCTGTACTGGTGGCTGTAGTCCTGTCTATGTATCTAATC
GTCGAGCATCTAGCTGCATACCATCAGCCTGAGGAGCAGAAGTTTTTGATTGGACTAATCTTGATGGTTCCTGTTTATG
CACTGGAATCGTTCTTATCCTTACTGGACTCAAATGCCCGCAT > SEQ ID NO:59 17661 Contig A
acttctcttttcctttattcaatcaaacaagtcttttacattaaaatacaattaacagtttaaaaaatggctttattct
tGTTTTTCTCAAACATTAAAAAACTTTTTAAATACAATCAGCCGAAAAAAATACAaGAAAAACAATTATATATATAAAT
CCTCGAagagaATTACAAAATCCTTTTAGCaaACAACAGTagcTGCTCCGGAagaCACAGGGCTTGCAACATCAAGCAT
CATGGGATTCCACTTCATCACCACTTTATCACCGCATCTTCCATCTGATGAAACTCCGGCAAATTGCATCTGATCTGCT
TCAACAGAAGACGGATTTGGTACCTCCAATGTCAACTTCTTCTCAGCTACAGACTTGAGTCTCCGCCTCTCTGCTCTTG
ACCCAATCACCTGTCCCAAAACTGATGCTGCTATGGTGAATACCATAGCTGTTTTAGGCATCAACACTGACTTTCTCAG
TATTCCTATGAATGGAAACGCTGCGTGAAGAGCTATAAACCAAGATGCCGAAAACTTTTCAGTGTGCTCTCTCCAGACC
CCTAAAGGCACATTTAACGCCATGCCCAGCATCCCGATCACTAGTACTTTAGCTGGTAAAGGTTGTGGACGGAGGTTCT
TGGCGAAAGGTGTTTTTGATATCGCTGCTCGAGCTGTGACTATTGCTTGAGGGCATTTAAATTTCATGCCTGGAGGGGG
TTGCAGGATCTTTGCCACAAGTGGTGCCACACCACTTACAGCTCGATATGATTTTGCTATTGGGCAGTTtcctgtttta
agccattcgtcgcccatggcttcgtggtttcctcccttattttggatgaatctgaccggacgcgtgggc

FIG. 1 continued

> SEQ ID NO:60 17661 Contig B
CCCACGCGTCCGAATTATCATTATCTCAAACACAACAAGGATAGATCATCCTCATAGGCGATGTTGTTTAGTGGTTCAG
CGATCCCATTAAGCAGCTTCTGCTCTCTTCCGGAGAAACCCCACACTCTTCCTATGAAACTCTCTCCCGCTGCAATCCG
ATCTTCATCCTCATCTGCCCCGGGGTCGTTGAACTTCGATCTGAGGACGTATTGGACGACTCTGATCACCGAGATCAAC
CAGAAGCTGGATGAGGCCATACCGGTCAAGCACCCTGCGGGGATCTACGAGGCTATGAGATACTCTGTACTCGCACAAG
GCGCCAAGCGTGCCCCTCCTGTGATGTGTGTGGC > SEQ ID NO:61 17884 Contig A
CCCACGCGTCCGCTTTGAGCGAGAGAATCAGCTTTCAGAGAAAAAAGCATACCTACAGAGAGAGTTATG > SEQ ID NO:62 17884 Contig B
CCCACGCGTCCGCTTTGAGTGAGAGAATCAGCTTTCAGAGAAAAAAGTATACCTACAGAGAGAGTTATGGCGGAGAGTG
GTGGACGAAGGATCGGAGTGGCGGTGGATTTCTCGGACTGCAGTAAGAAGGCTCTGAGCTGGGCGATCGATAACGTGGT
TCGCGATGGAGATCATCTGATCCTAATCACTATTGCTCACGATATGAATTACGAGGAAGGCGAGATGCAGCTCTGGGAG
ACCGTTGGATCACCTTTTATTCCTATGAGTGAATTCTCTGACGCTGCTGTGATGAAAAAGTATGCATTGAAGCCAGATG
CTGAAACCCTTGACATTGTCAATACTGCCGCTAGGAAGAAAACGATTACAGTAGTGATGAAGATATATTGGGGAGATCC
TCGTGAGAAGATTTGTGCAGCAGCTGAACAGATTCCTCTCTCAAGCCTTGTGATGGGTAACAGAGGCCTTGGTGGTCTT
AAGAGGATGATTATGGGAAGTGTAAGCAACCATGTTGTCAACAACGTTGCATGCCCTGTTACCGTTGTCAAGGCTCACA
TCTGAGTTTGCTCGGAGAACTCTAAATAACACCACCGTGTATTCTATAATTTGTGTTTTTGTGGTCGGAATTTCTATTG
TTAactgttgtgtgactggtgttttgttcatctgtaccgataaacaacactccaccttctaataaatacagactctttt
gatt > SEQ ID NO:63 20019 Arabidopsis thaliana
AAAGGGTAGCCATGTCTTCCTTAACAACCAGACAACTTTTCCACAGAACAAGTAGTAATTCCCAAGTGCAAATTTGTCC
TTCTAGGTGTATTCCTGTTTTCATCACCAACAAGACCAACAACAGTAATAGATTCTTTAACATCAGTAAGTTTTCAGGT
TTCAAGAATTTGAGTGTTGTGGTAAAGGCAGCTGCTGGGGATGGAGGAATTTCACCTAAGAATCAAGATGATGAAGATG
GTGTGTCTTTGGGAACCATGAAATTGCCTCTGGATATTGATGTTGCAAGATTTGAAACTCTACTTTTTCAGTGGGCTAA
CAGTCTTT > SEQ ID NO:64 23558 Arabidopsis thaliana
gTCGACCCACGCGTCCGCTCTTTCCTTCTCTCACCGCGAGAGTAACCGAGAGACATGATTCTGATAAACTCTAATTCTC
CGACGCTAATCTCAGCCGTTAGATTCGTGGGCTCATCTCCGTTCACCACTCGGGGGCTTTCTCAGTCCACTGTCTCAAT
CTCTAGAAACAAAAGCTTCTTCTTCCACTTCACCGAGACGAAGGAGAAGAACGCAAGAAGAGATTATTTGAGAGTATCA
ATCGTGTGTGACGCAGGAGGGATGTTTCCGGTGGATCCATGGGCTCCAACCATTGATTCACAGAGCATAGCATCACAAC
TCTTCGCTGTATCTCTGTTTCCTTACATTGGCTTTCTCTATTTCCTCACTAAATCCAAATCAGCTCCAAAACTCACACT
TTTCGGTTTCTACTTCTTGCTTGCCTTCGTTGGAGCTACAATTCCAGCTGGGATTTATGCTAAGGTGCATTATGGAACA
TCGTTGTCGAATGTTGATTGGTTACACGGAGGAGCTGAATCACTTCTTGCTCTTACCAATTTGTTTATCGTGTTGGGTC
TTAGACAAGCTCTGAGGAAGTCTCAAGATGATGATGATGATAAACTTGGTAATGATGATGAAGTTCCAACAACTCAAGA
ACAAGGGAAATCTTCAGTGTAGTAAAACAAATGTAAATTTTTTAATTATGGAGTTTCACTTGTTTTTTAATTAGATTAT
ATATAGTCGACGCCCATCTAATTCCCATTTTAG > SEQ ID NO:65 23777 Arabidopsis thaliana
CCCACGCGTCCGGGTCAAAAGCTTAATGTCGTTGTCATATCTGCTAGGATTCCATCAACGGCTCAGTCTCCTCACGCCG
CTGCACCGGGAAGCTCTACGCCGGGATCAATGACTCCGCCGGGAGGAGCCCACTCGCCTAAATCTTCCTCCCCTGTTTC
TCCGACGACTTCTCCTCCGGGATCGACTACTCCGCCTGGAGGAGCTCACTCGCCTAAATCTTCATCAGCTGTCTCTCCG
GCGACTTCTCCTCCAGGATCAATGGCGCCTAAATCCGGCTCCCCTGTTTCTCCGACGACTTCACCACCGGCACCACCTA
AATCCACGTCCCCTGTTTCCCCATCCTCTGCTCCGATGACTTCACCGCCGGCACCAATGGCACCTAAATCATCTTCAAC
TATTCCTCCGTCTTCTGCTCCGATGACTTCACCACCTggaTCAATGGCACCTAAATCTTCATCCCTGTTTCAAACTCA
CCCAccgtttCTCCATCGTTGGCTCCGGGAGGCTCTACTTCttCTTCACCGTCAGATTCTccgtcAggcTcggCGATGG
GTccctt

FIG. 1 continued

> SEQ ID NO:66 25975 *Arabidopsis thaliana*
CCCACGCGTCCGCTACAGGGCCTCTGTCGCTCTCACCAGTTAACAGCTACAGCACAAAACTGTAACCACGCTTCCGATC
TCTAAAACCTGAGAGAGAGAGAGAGAGAGAGAGAGAGACAGAGAGAAGTGTTTCAATAGTTTGGCGTGAAGATGGCCGGAG
GAGGCGGATACGGCGGCGCATCGGGGAAAGATGATTACGTCTTCAAAGTTGTTCTAATCGGAGATTCGGCTGTAGGGAA
ATCACAACTACTTGCTCGATTCGCTAGAGACGAATTCAGCATGGATTCTAAAGCCACCATCGGCGTCGAGTTCCAAACT
CGTACCCTCTCCATTGAACAAAAAAGCATTAAGGCTCAGATCTGGGATACCGCTGGTCAGGAAAGATACAGAGCCGTTA
CAAGCGCATACTACAGAGGAGCAGTTGGCGCAATGCTGGTTTATGATATGACGAA > SEQ ID NO:67 2658 Contig A
cccacgcgtccgatttcatCgAACACTTGGTGATCAATATTTGAAAACGAAGAGCACAGCCAAAATTCGATAAACCCTA
AGGAACAGTGAGATGGAGAAGAAGAAAGCAATGCAAATTGAAGGTTACCCGATCGAGGGATTGTCGATTGGTGGGCACG
AGACGTGCATCATATTTCCATCTCTTCGGATAGCTTTCGACATTGGTCGTTGCCCACATCGCGCAATTTCTCAAGACTT
CCTCTTCATCTCTCACTCTCACATGGATCATATCGGTGGATTACCAATGTATGTTGCTACTAGAGGCTTGTACAAAATG
AAGCCTCCAACGATTATAGTACCCGCATCCATTAAAGAAACTGTTGAGAGTTTATTCGAAGTTCACAGAAAGTTAGATT
CTTCAGAGCTAAAGCACAATCTTGTTGGCTTGGACATAGGGGAGGAGTTTATTATAAGGAAAGATCTCAAAGTCAAAGC
CTTTAAGACATACCATGTCATCCAAAGCCAGGGTTATGTAGTGTATTCAACTAAATATAAACTCAAGAAGGAATATATT
GGCCTATCTGGAAATGAAATTAAGAACTTGAAGGCTTCAGGTGTTGAGATTACAGACAGCATAATAACTCCTGAAGTTG
CTTTTACGGGAGATACAACGTCGGATTTTGTAGTTGATGAAACTAATGCTGATGCTCTCAAGGCAAAGGTTCTCGTCAT
GGAGAGCACATTTCTTGATGATTCGGTATCGGTAGAGCATGCGAGAGATTATGGACATATCCATATATCTGAGATAGTA
AATCATGCTGAAAAGTTTGAAAACAAAGCAATCCTGCTAATCCACTTTTCGGCTCGGTATACAGTGAAGGAAATCGAAG
ATGCGGTTtctGCATTGCCTCCACCTTTAGAGGGACGTGTGTTTGCACTAACACAAGGATTCtAAACATTATAACACtc
ttataggttttacatacttttgttttgtattccacatgtaaacattgtattctgttgttaattttaagatttcttct > SEQ ID NO:68 2658 Contig B
CCCACGCGTCCGATATCATCGACCACTTGTGGATCAATATTAGAAAGCTAATAGCGCAACCCTAATTCTATAAACCCTA
GCGAACAGTGAGATG > SEQ ID NO:69 26650 *Arabidopsis thaliana*
AACAGCAAAACCATATCTTGATGATTCAAAATATAGAGTTAACAAGCAAAGATGAGACAATCTTGTACGAGAGAGCTAA
AACAAATGGATTCCAAATCCAGCAAGTACAAAAATCGCAGAAAATAAGATGAAACCAACTTAAAACAGAGATGTTCCCT
TTCCCTTCTTGTCACCACCGATCTCGAAATGCTTGCACCTCTGATAGGACGCTGCGAAAAGTGCTTGCAGCTTTGACA
CTGAAGCCTCAAAACAATCTTCTTCGTGGTCTTAGCCTTTTTGTGGAAGACAGGCTTAGTCTGACCACCATAACCAGAT
TGTTTACGGTCATAACGACGCTTTCCTTGAGCAGCAAGACTGTCTTTACCCTTCTTGTATTGGGTAACCTTGTGCAAAG
TATGCTTTTTGCATTCCTTGTTCTTACAGTAAGTGTTCTTTGTCTTTGGAATGTTCACCATTTTCGCGTCTCTGATCTC
CGGTGAAGCTTTTGTGCCGTCGTCCGGACGCGTGGG > SEQ ID NO:70 2696
cccacgcgtccggaatgtagagaatgatgattcaagttctcaatcatttgcttctgtttcctccagagatcaagaagtt
gGTGATGTTAGATTCTCCGGCGGCTATGGGTTAGGACAAGATCTAAGCTTTGGTGTTTGTAAGAAAGTGGTGCAGTTGA
TTCATGGGAATATCTCGGTGGTCCCTGGCTCGGATGGTTCACCGGAGACCATGTCGTTGCTCCTTCGGTTTCGACGTAG
ACCCTCCATATCTGTCCATGGATCCAGCGAGTCGCCAGCTCCTGACCACCACGCTCACCCACATTCGAATTCTCTGTTA
CGTGGCTTACAAGTTTTATTGGTAGACACCAACGATTCGAACCGGGCAGTTACACGTAAACTCTTAGAGAAACTCGGGT
GCGATGTAACCGCGGTTTCCTCTGGATTCGATTGCCTTACCGCCATTGCTCCCGGCTCGTCCTCGCCTTCTACTTCGTT
TCAAGTGGTGGTGCTTGATCTTCAAATGGCAGAGATGGACGGTTATGAAGTGGCCATGAGGATCAGGAGTCgatTTTGG
CCGTTGATtGtggcGACgacagTGAgCTTGGatgaAaAaTGTGGgacaAgtgtgcccagaTTGGAATCAatgGAGTtg
tgagaAagccaGTGgtGTtaagagctatGGagaGtgaGCTCcgaagagtATTGTTGCAagctGACCAACTtctTtAAgt
tgttATTTCAACTTTTTTTTTACATTCAAAATTTTTAcccCATAGATTTATGtcaAATATATCAAAatgAAATTTTGAA
ATTGTTATTATATataccacccatatctttatgatttggacatcctggttttttttgttcttttttctcattttgaaccc
cccgaaattgcattg > SEQ ID NO:71 27245 *Arabidopsis thaliana*
TTTTTAATAGTACACGATTATTTCGGAACGTAAATGTCGCGGAACAATAGTTCAAAGACATCATTATTACGGTGACTGA
AAACAGCAAAGAGAGATAAATAAAGGACAAAGAAACGACAGCGTTTTTGTGTGATGTGTCATTTTCAGATGGCTTCGAG
AGCTTGAAGAATGTCAGCTTTGACATCTTCAAAGTCTTCAACTCCAAAGCTGAAACGAACCAAGTTATCTTTGATTCCA

FIG. 1 continued

TACTTTAGTCTCTCCTCTTGCGGCAGATCCCAGTAGGACATGATAGCAGGTTGGTCAACAATGCTTTCGCAGCCACCGA
AGGATGGTGCAATGTAAGGAATCTTTAGAGAATCCACAAACTTGATTGTCGTTTCAATGTCTCCATCAATCTCGAAACT
GACCACACCTCCAAAACCAGTCATTTGTCGCTTGGCGAGTTCATGTTCGGGATGACTTGGAAGGCCTGGATAGTACACA
TGACTCACCTTAGGATGTGCCTCTAAAATTTCGGCCATTCTAAAAGCGGTCGAATTCTGTTGCTGTACACGAAGATGCA
ATGTCTTCATGCCTCGGATGATTAGGTACGCAGCGTTTGGGTTAAGTGTTCCTCCCAACACATGATGCAGATTGCGAAT
TTCTGAAACCAACTTCAGTGAACCACAGATGCATCCAGCAAGAACATCATTGTGTCCTCCAATGTACTTTGTAGCAGAG
TGCACGACAAGATCAGCACCAAGAGCAAGGGCTTTCTGATTCAGAGGTGTTGCAAAGGTGCCATCAATGCAAACCAGAG
TTCCCCTCTTGTGGCATATTTTTGAaactagctcaatgtcgacacatctaaggaatgggtttgtcgggactcagtgaa
gaacagagataccttgaactcattca > SEQ ID NO:72 27429 Arabidopsis thaliana
TTGTAAAAAATGTTATTTCCATTAATATAAATTCTGCAAAACTCTTTAACTTGTCGAGTAATGCTTCATACATAAATGA
GAAACCGTTCCGTTAAATAAAATTAAGCATGAAATTATTTAGCAATAAAAGAGAAACAAAGGAACACTGCCCAATTAAA
ACAAGGGCAAGTTCAGAAATAAGCAAAGAATTGCGTTTTGACCAGAGCACGACTTAGTTTTGTAGTTAAACGAATTGTC
TTCCTCGAGAAGAGAAGGTTTGGCCAAACCACCAAGAAGAAGGGACAACGTTCAAAAATGTCTGCGTTTTGCTGTCCGT
CAGAGTAACTTTGAAGGAGAGTCTCTGTCCCCGGAGATCACCGGAGCTCTGCCAGTTGGCACCCCAATTACGGGTCATC
TGAAGCCAAGTCTTTCCCTTTGAGCCTCTCACCGCTACTGATCTCACCGAGCCGCCACCACCAACGTTTGAGATCATTA
CCATATTGAAGTTACCTTGCCCTCTCATCGTGAACCTCACGCCTCCTCTTCTTTTGCATCCCACCCGGCGATAGAAGAC
GGGGACGATGCCTTCATTGCCGCGACGGGCAATGCGGAAGAAAGCGGGGGAGGACATGTCAAAGTGATGGCGAGGGAGA
TTGCACCAACCATTATTGTTATTCGTTGGGCAAAAGTTTGTAGCCGTCACCGTCACGGCGGCTCCTCGGAGACACCACT
TAGGATCCGCCGGAAAGTCGCACCTCACCTGGTAGCACCCACCGCATGACTCACCGCTTCTGAATAGCTCACCGCTTAG
CGCCGCCGTGTGTGCTCCGAATCCGGCGTGGTACGGATTGTCATACCCACAAGCTCCTCCAAGTGAAGCAGGGCTATCA
TTGACACCATAATACGTTGCATGAGCTCTTATCCAACCGTTAGAACACATCCCCACACTTAACGTACTAACCAAGAGAA
TAACCGTTACTAAGTATGTTCCCTTCATATCCATATATATATAttttatttatttgagataagtataaattttttcgt
gatgcaagaaagagaggtcgagaaaagaaagccggacgcgtggg > SEQ ID NO:73 27507 Arabidopsis thaliana
AACATCAAATTAAATTTTTTCTTTCTTATATAAATAAAGATCAGAAATAGATTATTTTCTCCATTTTTTAGTTTCGTTG
TTGATGAATCATGTATTCACAAATCTGCAATTTCTTCTAACTTCTCCATCAGCCAAGCTTTCAGAGTTCAAAATGTTCC
CCATCTTTACCATCGACTTCGAGAATTGCTCGAAGAAAGCCACTGGATCCTCCGCATACTTGCTCACGATTCGCCGCGT
TTGTATCCCGAACAAGCTCGTGTACATCTCCTGGTCCGAATTCAGTAACCCTTCTCCTCTTAGCAGTGTGTGGTAGATC
GAGTTATCGAAGAGATTCGGCGTCACATTGTCTATCGCCGTCACGTTACTATCACCTTCTCCGCTACTCGCCGGACAAA
TCTCTCGAAGACTTGCCAAGTACGTCTCCGAAACTGGATTTAGGGCTGACGTCACTTGAAAATCTCCATAAATTCGGGA
TCGGAAGTTGCGACATTGTGCTTTTCCGATCGTGTGCGCTCCTATAAGAGCGACCATGTCTTCAACCGAGAGACCTTGA
GAATAGAACTTAGCAATGATGCTGATTAAACCCTCtTCTGGAGTTGGAAGGTTTGTTGTGGCAAGCTCGTAGCTTGCGG
TTTTTGAATCTTTTCTTTCCCACAGGAACATCCCAGTAAGGCCCACCCACCAGGATTGTAGCATCTCTAGCACCAATTGT
GAGAAGATCAGCGCATGAAACAACTCCAGGACATTCGGATTCGATTATGTTCTTGATTCTGTCGACAATTTTGTATCCT
TTCAATGAATTTATGTTGGGAGAAGCTTTCTTCTCTCCCTGTAGAGTTTCTGTCTCGTCTAGCAACACCGATCCATCAC
ATCCTTGGACAAAGCAGTCGTGGAAGTGAAGACGAATAATTATGGCTGCATTTCTAGGATCTTCCTTCACTATGCATTC
CATTTCTTTCTTGATGACGTCAAATACGGTTGGACAAGTAGACTTGTAATAATCTAGGGTTAAAGGAAGATCCTTCCCC
GGTGTATCAAAGGAAAAGCATGGGATAAAGATGGTGTGAACCATGAAGAATACAAAGaggagtctcatcatatttaatt
tcttctatcggaaaactctttgatccaaattttgggaaaatatgtgcggacgcgtggg > SEQ ID NO:74 3033
CCCACGCGTCCGCATCTTCTTCAGGCTCATCTTTCATCTCTATTCCATCCCAAACATCTTCTCTAGTAGCGCATTTGGT
ATGAAATGTAGACTCAGAACACCTCTTACAAGAATATCCCCCACAACTCCAATCCATTTTCTTACGACAAACACCACAT
ACTGAATCAATAATACCAAGAAGAGAAGTGCGAGAAATGCGATGATCATGGCGGTTGATATTGATGACCCATGGAAATC
CAGAGCAATTGTTATGGGAAGTGAAATTGCATTGAAGACAGACATATGGGCTTCGATCTCCATGGAGGCCGCAAGTGGT
GCAAGTAAAAGAGATCAATTTTGGCATAAGGGTTAGTTCATGGTTGTGGGTGTTTTGGTCGTGAAGATTTAGTGGTGGT
GGAAGAGAAACACATCGCAAATCCAAAGTAAAGTTACAAGCGGAACAGTGATAAAACATTTCGTCAAAAATCTTTTTCC
CACATAAACTACAATTCCCATCAGTATAAGCCGGTGGTTCACCAGTGATGAGTTTTAGTGTGTGTAAGGAGTGGGAAGG
GTGGTTTACCTCTGCTCCATACTTTTCGCAATCCACATGGAATGCCAAATCGCATTCATGGCATTTGTACGGATATCCA
CTGCCTCCCTTCCCACAAGTAAAGCAGGTGAAGGAGCTTCTCACCATCTCTAGCTTGAGTTTGTGGTCATGGTTCTGGG
GAAAATCAATGACTTCCGGTGGTGGGTACTTGAcacAATCCAAATGGATGTTGAATTcacAGCGCTGACATTCATAGTT

FIG. 1 continued

CTGGATATAGGGCTGGATTGTCTCTTTACATGTACGGCAtCTCACACTCCAGCTGGCAAAATTTGTAATAAGAGAAAGA
TTCTTATcacacTTGTGAGAAGGGTGGTTGATCTCTTTAGGGCAGTTGCTGCAACTCTTATGGAAGAAATAACcacATT
TtctacAGTTGTAGCCATCACTGATAGTTTTGAATTGGAGTCcacAACATTTACCCcacCGATTATCTCTTGCAGGTGT
CAGCCAGTGCTCATGAATGGGTAGTCGCACCATCTCAGGCTCCATGGTTACTAAGAGATCTAGTGAGAATTTCTCGTTG
AACTTTTGGTCTCTGATTTCTCTTAGCTCATGTGACGGAGATAAGTGAAGAaaacaatagttattctattaataatcat
ttaatgattaattatttgttttttagtatattaataaaagaaagtttagatct > SEQ ID NO:75    30367  Arabidopsis thaliana
TTTTTTTTTTGAGAACAAGCTCTTATTACATATAATATTCGAACTACAAATACACCCCTTAAGCAAATCTAATGAAAGA
AGGGGTAATTAAACAATAACAAAACAAAATACACGAAACTGATATTAAAGGTGATTATCTAATGACGAATCACAATCAT
TCTCTTCAGGTTTTCTTGTTTGGCCCGTATGCATACTTAATCAGAGACTCCTTGATAGAGAGTAGCTCAGGGAACTCTT
TCTTGAGCTTGGAAGCATCCATCTCGTTGTTGCTTCTTGGAGCCACAATGACTTTAGCTTGCTCCTCTAATGTGAAGTT
TGCCCATTTGAATTCAGGGTTGATGTAGTCTCTGTACATCTCTAGGATCTCGTTGTGGCTCACCACACCTGGGTTTGTG
AAGTTCCAGATTCCTTTCAAGTTTCTTTTCGCCATCTCGATGGAGATTGGTAATAACTCGTCCAACACAGTCATGCTGT
TTGGGATGTTCACTACTTTGTTGTACCTGGAGATCTTGGTGATGAAGTTGCGCGGGTTGTTTAGATCCGAGGAGATCGG
CATCCTTACCCTCAATGTGCATACGTTGTCATACTCCTTTAGCAGCTCCTCGACCATGGCTTTGGTTTTCGAGTAGAAA
GAGCCAGTGAAGTTGGGTGTGTCTTCCTCCTTGAAGCCAATTCCTGAACCTTCCGGATGCTTGTCGTCATATTCGAATA
TACAACCAGTAGCGAAATTCATCATTAGGAGTCCgtgctct > SEQ ID NO:76    30518  Arabidopsis thaliana
TGGAAATAAGAAGATGTTTCTAAATCTTAGGGACATGAAGAAACAGAACATCCATACACATTTGTTGCAACTTGCAAGC
ACACTAAACCTACACAATTCGTTTCCTCTGTACAATTACTTTATACAACTTAAGGAAACTGCTCACACTCTTAATATGC
TAAAATGCATCACAGGAAGATGAAGATGAATTGCTCTGAGTTCTTTGAAGCTCTTCATGCACATCACTTCTCTTCCTTT
TCCTTCCTGAATTCGCTGGAGCTTCATATTTCCCGGCGTCAAGAGGGAAGTTGAGCACGGCTTTTCTTCCCCGGAGCTT
GAAAGCTGCACAGTCATAGGCTCTTGCAGCATCAACATCACTCTCAAATGTTCCTAGCCAGATTCTTGATCCTTTCTTT
GCTGGATCTCGAATCTCTGCTGCAAATTTCCCCCACGGCCTTCGCCTCACTCCTCGGTAATGTCTAGCATCTACTTCTT
CTTCGAACCTCTCTGCCTTTTTCACACTCTGATCAGTCTCATATGTTGATGACGATGAATTCAGCTCTGGTGATGATGA
TGATGATGATTCCCCTTCCACTTGCAAGAACTCGTTGACGAAAGAATCCGGATCAAGAACTGGAGAATCAGGTTCTTGT
TTAGGAACGTGTGGTTCTATACACCAAAGTCCTGAGACAAAAGAAGCATCGAAGTCAAAATCTCCCATGAAACCATCAC
AAACCAACAAGTCTTCTAAGAgatggctctgtatagcttccaaatcagagctttcctcaaaactcgccattttttacgaa
agagagaaagcggacgcgtggg > SEQ ID NO:77    30548  Arabidopsis thaliana
TTAGACGAATGTAGTGTTATTACAACTAACCCCAAGATAAAAAAAAATACAAGGGGCTTTTTGTTTGGAAGTTACACT
ATTCCCCTGTACATTATATATATCATGTTAGTAAAATAAATATAAAAAGATTAAATAATGGTGGGAAGACTAAGAAAGT
AAATAACAAATTTAAGCAGGAAATTAATATTACAATGTAATTATTACCTGTTGTTTATCTTTCTTTTTTCACTAAAGA
GAATTTTTACCCACCATCAAAACTTTTTTTTTCACTTTTCTTCCAAACCTTCTTTTTCAATTCAAGGATTTGCTCTTGA
ATTCCTTATTCCCTTCAAATCAACCACTACCACACTTATATTGTCTTTGCTTCCTTTTTGCAAAGCCATCTTCGACAA
ATACTCTGCCGCGGACATTG > SEQ ID NO:78    3054
CCCACGCGTCCGAAGCATACTCATCCTCTGATTTCGCTGGATTCAGCTGTACAATTCCGCACAAAGAAGCTGCATTGCA
ATGTTGTGATGAAGTTGATCCATTGGCAAAGTCTATAGGAGCTGTGAACACTATACTAAGGAGAAAAAGTGACGGAAAG
TTGTTGGGTTACAACACAGATTGTATTGGTTCCATTTCTGCTATTGAGGATGGCCTACGAAGTTCAGGTGATCCAAGCA
GTGTACCTTCTTCTTCTTCGCCATTGGCCAGTAAAACAGTGGTGGTTATTGGTGCTGGTGGAGCAGGCAAGGCTCTTGC
TTATGGTGCAAAAGAAAAGGGGGCCAAAGTTGTAATTGCTAATCGAACTTACGAACGAGCACTAGAACTCGCAGAAGCA
ATAGGAGGCAAAGCGTTATCTCTGACAGATTTAGATAACTATCACCCAGAAGATGGCATGGTTTTGGCAAACACAACAT
CTATGGGTATGCAACCAAATGTTGAGGAGACTCCAATTTCTAAGGATGCATTGAAGCACTATGCACTGGTCTTTGATGC
GGTATACACTCCGAGAATCACCAGACTGTTGAGGGAAGCAGAAGAAAGTGGAGCCATAACTGTCTCAGGGTCAGAGATG
TTTGTCAGGCAGGCTTACGAGCAGTTTGAGATCTTCACCGGTTTACCCGCTCCAAAGGAACTCTACTGGCAAATAATGT
CAAAGTACTGAGACATAGCTTAAGTGTGTGTGTGTGTACTTCCATGAAAAGTCGTCGATTCAATAAAGCTTTAGATTGC
CATTTGTATGTTCCGAGAATGTCCTTTTTTGAGGCCATAAGCcgaatgactggttctctctttgtatttatatatatgt
ataaactattaagcctaacattaatcttttttaagcttctttg

FIG. 1 continued

> SEQ ID NO:79 3442
CCCACGCGTCCGAGCGTTCAAAGCCAATTGCCTCAGCCCGAGTTTAACCTAAACCAGCTCAACGGCATGTTTAGCCGTC
ACGGCCTCTCTCAAACCGATATGATTGCCCTCTCAGGAGCACACACTATAGGATTTGCACATTGTGGAAAAATGTCAAA
GAGAATATACAATTTTAGCCCTACAACACGTATCGACCCGAGTATAAACCGTGGATACGTGGTTCAGCTTAAGCAAATG
TGCCCGATCGGTGTCGACGTAAGAATCGCAATCAACATGGATCCGACCAGTCCACGTACTTTCGATAATGCTTATTTCA
AGAATCTCCAACAAGGAAAGGGTTTGTTCACGTCAGATCAAATCTTGTTCACAGATCAACGGTCAAGATCTACAGTTAA
TTCGTTTGCCAATAGTGAAGGAGCTTTTAGACAAGCTTTCATCACAGCGATCACGAAGTTAGGTCGGGTTGGTGTTTTG
ACTGGTAATGCTGGTGAGATTCGAAGGGATTGTTCACGTGTCAATTAGTGTGATTTGAGGTTTTCTTTCTTTTATTCCT
TAAAGAGGATTTTTTTTTTAATAATAAAATTTAATTTCTTGTTGTCAAAATAAGGAGTTCATAAGTGTGAAACATGGA
AACTTAAATTAATAAGATGGGTTTATTTCGTTGAC

> SEQ ID NO:80 35605 Arabidopsis thaliana
CCCACGCGTCCGTGTGTCGTACCAAAGCGACCCAAGTGTAGTCATAGCTAAGCTAGATGCAACCGCAAACGACTTCCCA
AAAGATACCTTTGATGTGAAGGGATTCCCGACCATTTACTTCAAATCAGCGAGCGGAAACGTTGTGGTTTACGAAGGAG
ACAGGACAAAGGAAGATTTCATAAGCTTCGTCGACAAGAACAAGGACACAGTTGGAGAGCCTAAGAAGGAGGAAGAGAC
AAGTGAGGAAGTCAAGGATGAGCTCTGAAAAGAGAAGTGTGTTTGTGTCTCTTAGCTGCTAGCTTAGTTTGGTAGTTTT
GAGGAAAATACACAGAAGAAGACAGAGCTTTGAGTAGACAGAGAGAAGACAAAGAGAGAGACGACAGACAGACAGAGAA
TCTCTTTATCTATTCATTAGGTTTTTATATGTGCACTCTTCAGAACAATAATGGCTGCCTCCTTTTCTTTTTTTTGGTT
GATGTTACCTTTTTTTGTTTGAATTCAGTTCTCCTTTAATATAGTTTTTGAGGCA > SEQ ID NO:81 36009 Contig A Arabidopsis thaliana
TTTAGCCTCCGAGAGATTCAGAAATATTATATTAACCAAAAAGGTAATCACAACAGCTTATGTGATATGCATCAACAAT
AGAACATTAAAGATGAATTCAACAATTCCAAAACTGAAGAAAAGAGAATTGTCGACAAAGTTAAGAACTGATAACAGAA
TACAAAGCTTAAAAATTGGTCGAGTAACATAGATGTCCTCACATGACTGCACCAAGTCCTATCACTTGAACATAGCCAT
AATTCCAAAACAGAGAAGAATAAAACATAAAAGCTTAAGCCTTGGGGGCTACTTTCTCCTTAGCCTTTTGGAGTTTCAA
CACTTTCTTCACAATCTTTTGCTCTTCGACAAGGAATGCCCGAATGATCCTTTCCCTGACTGCAGCGGGTTCTCCGGCA
GGTGCCAGCTGGTCATCATCGTTACGTCCGGGTGCAGCTCGTACGGCCCGTCGATATTTTGGAACGCAGCACCACGAC
GGCGTGCTCGTAGCTGGTGCCGCCCTCGGCGGCCATCAGGTAGTACCATCCCGCGTGGCGATACAGGTGCGCGCCTTCG
GTGTAACAGAGCGGCGTGCCGGTAAACAGCGTTTTGCGCTCGGGCGAGAGCGTGCCGGTCTGCGGGTCAAACGCCTGTA
ACACGATGGTGTTGTGCGGGTTGCTGTGGTGGCGCGGCCCCACGGGCGGTAGATATAGTATTTGCGGCCATCGTCGTC
GTGGAACAGGGACGGGTCAAACCCGCCGTTGCCCATCGGGATTGGCTCGCTCCATGGCCCCT > SEQ ID NO:82 36009 Contig B Arabidopsis thaliana
TGGCTGATGGCTTCTGACGTGGTGGACTACGAGGAGAGCCGCAGCGGTCGCCGCCTCGACGGGCTGGTGTTCTCCACCT
ACCTGTTCAGCCTGAAGATTGGCCTGGCGATTGGCGGGGCGGTGGTGGGCTGGATCCTGGCGTACGTCAACTATTCCGC
CAGCAGCAGCGTGCAGCCGGTTGAGGTGCTCACCACCATCAAAATTCTGTTCTGCGTGGTGCCGGTGGTGCTCTACGCG
GGCATGTTCATCATGCTGTCGCTCTACAAGCTCACCGATGCCCGCGTGGAGGCCATCAGCCGGCAGCTGATTAAGCACC
GCGCGGCGCAGGGCGAGGCCGTTCCCGACGCCGCGACAGCCGCATCCCATTAACCGGAGGCAATATGGAAATCACTAAC
CCGATACTCACCGGCTTCAACCCGGACCCGTCCCTGTGCCGCCAGGGCGAGGACTACTACATCGCCACCTCGACCTTCG
AGTGGTTCCCGGGCGTGCGCATCTACCACTCCCGTGACCTGAAAAACTGGTCGCTGGTCAGCACCCCGTTGGACCGCGT
GTCGATGCTGGACATGAAGGGCAACCCGGACTCCGGCGGCATCTGGGCGCCGTGCCTGAGCTACGCCGACGGTAAATTC
TGGCTGCTCTACACCGACGTGAAGATTGTCGACTCGCCGTGGAAAAACGGCCGCAACTTCCTCGTCACCGCGCCCTCCA
TCGAGGGGCCATGGAGCGAGCCAATCCCGATGGGC > SEQ ID NO:83 36204 Arabidopsis thaliana
TTTTTTAAGAACAAAGCAGATAGGTTTTTCCTTTGTGGTTTAAAAACGAAGGTTTAAAATAACACAAACGCAGTTATGT
GGAGGAATCCAAATTCCCAGGGAGAAAACGAATAGCAAAGAAACAACTCCAATTGTATGGGAGAGACAAAAGCCAAAGA
TCAAATGATAAAAAGCAATTTAAGAGAGGTTCAAGGAAGCGAGCTGCTCGGTTGCACCACCAGCAGCGACACTCCTGAG
AACATCCATAGCCTCTGCAACTTTGGCCTTGAGAGCTTCTGGTGACTCCAACAGATGGAGCACTTCAGTCTGGTCCATC
TCCAAAAGCATCCCAGTCACTTTGG > SEQ ID NO:84 36934 Arabidopsis thaliana
tttttttggtttatctgtccacTTTTTTATTCAAATAAAAGAAAAGCAGATTACATTGGATGATTTTATACAGTCGGT
TCTTTAACAAAGAAAGATGATTGATGCTAATATACACAATTACATAATCTTATACTTGAATTATACAGTAGTTTGGAAG

FIG. 1 continued

AAAGAATTATACAGTAGAAAAATATTACCGTGAAAAAAGTAAAAAGTAAAAGTAAAACCATCATTATTAGTTGGTACTC
TCCACTTCATCTCTAAACCAATCTGAAGTACCCCAATCAAACGGCGTGGACTTTTCCTCCGGTAAGAACCGGTTCCGAC
AAATCGGGCACGTTATCTTATTACAGTCAACGATCCAACGGTCTAAACAACGATGATGAAACACGTGTCCACACTTCGG
TAGCTGTCTAATCTTATCGTCGGATACAAAATCGGATAAGCAAACCGTGCAGCAATCTTCCGGATCGGTCAAGAGATCG
GAGAAACGAACCACCGGGATTAACTCGTTGGCAAGAGTTGCTGACGTGGAGAGAGCGAGTCGGGTCGGGTCGGGTCGAG
AGGTCTCGTTGTGGTCAAGAAAACTTGGTAGACCGATGTAAGGACAAAGAGCATCGACCATGTCTCTAAAGAAACCGAT
GACGTAAAGTGTTTTTAGTACGTAACctggaatctgaagctctttgaaatctgtaggaagacccatgagtgtgagagaa
agatagagacgagagcggacgcgtggg > SEQ ID NO:85 37131 Arabidopsis thaliana
ATCGAATGATAATAATATTTAAAATTTCCTTATTGATACGAAACATATATCCCTCGACAATACATATATAGCGGTCTTT
ATTATTTTTATGTAGACCGATCGATATTGACCTCAAAATCATTACATAATATCAAACGCGATCAATGGCCGAAACAAGC
ATGTTTCTGGAATCAGGCTGCCCAATGAGCTCATTGCCACAGTCGACAAATTGGTAGTCAACAATGAGATGGCCTTGTT
GATAGCCAAAACCATCGGTGTCTATTTGATTGAACATTGCTACATCCAAATCCAAGCCTCCGTTGCTGCATTGGTCCAC
TATTCTCACAGTTA > SEQ ID NO:86 38707 Arabidopsis thaliana
agaatccgaaggtgattagcctactcgatccggtttactgattaccggattccacaaaagacaaaataaaagcataaac
cTAGGATAATAGATAGTTTTTTTTGTTCAGAAACCGACgaAgAATTAGATCCGACGACAGATTCTAAACCTCTTTGTTC
TCGTCGGTGATCACGGTCTTCTTCTCCGCGAAGATCCAAGTGACACCAAAAGGATCCGTAACTTTTCCTTTGAATCCCA
GTTCAACTTCTGCCTCCGTAACCTCCACTTTCACAGCTCCGGCGTCAACAGCTTTCGCAACGGCGGCTTCAGCATCCTT
AGTTCCGAGAAGAAAAGTCACTCCCGAACCTTCCGATTTCGCAGTAGAAAAACCAGGGAGAGAGGAAACGTCGCAAACA
ACGAAGGAAGAGCCAGCGAGATTAAGCTCAGAAGAGAGAACATGAGGAAGCTCTTGGTCAAGCTTACGCTTAGGGTAAA
GAGAATGACCAGACTCGATCGCACCAAAAGCAGATTTGTAGAAAGTAACAGCGTCACCGACCTTTTGAGCTTCAACGAG
CAACATCTGCTTGAACTCAGTGAAGACAAGATGCGTCTCCACCGGACCAGCACCGTTAGTAGCAACAGCAGTaacatct
tcttgagccatcgcagagagaaaataaaactttgagaagagagattcgtttacggttaagacggacgcgtggg > SEQ ID NO:87 39086 Arabidopsis thaliana
GCAGTGGCTCAACCTCGACGTGTCAATCTCTCGTTGGTTACTCAAGCAAGAACGCAACAACGTTGCGCAATATCCAAAC
CCTTTTTGCCGTCAAGAACCTCCGCTCGATCCTCGGAGCTAACAATCTCCCACTCAACACCTCACGTGACCAACGCGTG
AACCCGAATCAAGTCGTACGTGTCCCAATCCATTGCTCTTGCTCCAATGGAACCGGTGTCTCGAACGGGACATCGAAT
ACACCATCAAGAAAGACGACATACTCTCTTTCGTCGCAACTGAGATTTTCGGTGGTCTCGTTACGTACGAGAAGATCAG
TGAGGTTAACAAAATCCCTGACCCGAACAAAATCGAAATCGGTCAAAAGTTTTGGATCCCTTTGCCTTGTAGCTGTGAT
AAATTGAACGGTGAGGATGTTGTTCACTACGCACATGTAGTCAAACTAGGAAGCTCTCTCGGTGAGATCGCTGCTCAGT
TTGGAACGGACAACACGACGTTGGCTCAGCTCAATGGAATCATTGGTGACTCTCAGCTTCTTGCTGATAAACCTCTCGA
CGTCCCTCTCAAAGCATGTAGCTCTTCTGTGAGGAACGACTCGTTGGATGCACCTCTGCTTCTGTCTAACAACTCATAC
GTCTTCACTGCAAACAATTGCGTCAAGTGTACTTGTGACGCTTTGAAGAATTGGACTTTAAGTTGTCAATCATCATCTG
AGATTAAGCCTTCGAACTGGCAAACCTGCCCACCATTTTCACAATGTGATGGAGCTTTGCTTAACGCCTCTTGCAGACg
acCTCGTGATTGCGTCTATGCTGGTTACTCCAACCAAACCATCTTCACCACAGCTTCCCCAGCTTGTCCAGATTCTGCT
GGTCCTGGTAACTATGCATCAACGCTCAGCTCAAGCTTCAGTTTCGTGATTGTGTTGATTCAGTGTGCTCTGCTTTGTC
TCTGCCTTCTCTAGTAATGTTTTGTTGTGTgtttatgagtgtatctaagtactgttcggattaaaataaagacattgtt
tcacatgaagcatcaggtccttgtaccatta > SEQ ID NO:88 42037 Nicotiana benthamiana
AGAAAGAGAAATCTTTCTGTCTTAAGAGTAATTAGCAATGGCTTCCTCAGTTCTTTCCTCAGCAGCAGTTGCCACCCGC
AGCAATGTTGCTCAAGCTAACATGGTTGCACCTTTCACAGGTCTTAAGTCTGCTGCCTCATTCCCTGTTTCAAGAAAGC
AAAAACCTTGACATCACTTTCAT > SEQ ID NO:89 43341 Nicotiana benthamiana
CTTGAAGACGAGTATGATTTACACATTCTGTCATTGTTATTCATTTACTGTTGGGGGCCACATAATTGTGGGAGTTGTA
ATTCTAAGTAGCTATTTAATTGTAGCAGCTGCTGACCGCTAAAATGGAGTTGGAACAAGAACAACAACAACAACCC

FIG. 1 continued

> SEQ ID NO:90 43460 Contig A *Nicotiana benthamiana*
CGATAAGAGAGAAGAAAAGAACCCATTTGCTGGCTCTTACGCTAACCTGAGATCACACAAATCCTCTTTTTTCTTCAGC
TTTTTTGTGCCTTCTCACTTAAGCAGGGACCATGATTAAGTTGTTTAAAGTAAAAGAAAAGCAGAGAGAGCAAGCTGAG
AATGCAAATGGAAAGCCACCAGTCAAGAAACAAAGTGCAGGAGAGTTGCGTCTTCACAAAGATATAAGTGAGCTAAATC
TACCCAAAACATGTAGCATATCATTTCCCAATGGAAAAGATGACCTCATGAACTTTGAAGTCACTATTCGGCCTGATGA
AGGATATTATATGGGTGGCACATTTACGTTCTCTTTCAGTATTTCCCCAATGTATCCTCATGAAGCCCCAAAGGTGAAG
TGCAAGACAAAGGTTTACCACCCTAATATTGACTTAGAAGGAAATGTGTGTCTCAACATTCTTCGAGAAGACTGGAAAC
CTGTGCTCAACATTAACACCATTATCTATGGTCTATATCATCTGTTCACGGAGCCGAATCACGAGGATCCCCTCAATCA
TGACGCAGCTGCTGTATTAAGAGACAACCCAAAGTTGTTCGAGTCCAACGTTAGAAGGGCAATGCATGGAGGCTATGTT
GGGC > SEQ ID NO:91 43460 Contig B *Nicotiana benthamiana*
ATCTTCCAAGTCTGAAATGTAACTTTTATACTAGTACGTTCTTTTATATCTGATGTAAACAATGTTATATTGCCATGTA
ACCACAGCTTATAATTTCAATTATAACTTATATGATATAAAAATATGTCTGTTAATCTGGTT > SEQ ID NO:92 44067 Contig A *Nicotiana benthamiana*
GCCATTACGGCCGGGGACAGCGACTCTCTCTTAGGGGGGCGACGCTGTTAATCTTCAACTGCAAAAAGTTGATCTCACA
GATATGGAAATCAAGGCCGGATGTGACGGATCCTTGCTTTTAATCAAACAGGGAGCTGAGGCTGAGGCTAGGTGTATGA
CAAAAGCTAGACGGCTTGGCTGTTACTACTCCAGTGCTGTATGCTGATGACCCTGTTACACATACTCTCACCTTTGAAT
ATATTGAAGGTCCTTCTGTGAAAGATATATTCCTTGGCTTTGGATTAGTTGGTGTTGACGATGAACGGATGACCGATAT
TGCAACACAGATTGGTAATGCTATTGGCAAACTACACGCATGTGGCCTAGTCCATGGCGATTTGACAACATCAGATATG
TTAATGAGGAGTTCTGCTAATCAGCTGGTTCTGATAGACTTTGGTCTAAGCTTTACTTCAACACTTCCAGAAGATAAAG
CAGTTGATTTATATGTACTTGAACGTGCTTTGCTCTCCATGCACTCTTCTTGTGGAAATGTGATGGACCAGATACTTGC
TGGATACAAGAAATCT > SEQ ID NO:93 44067 Contig B *Nicotiana benthamiana*
GGAAACTAAAGTAAGCACCGTTGCAGTTCAATTAGCACATGCTTTACAAGCAATCACATGATTTTAGATAGGCATATTT
TTGTTAACAGGCACAGAAAAGAGGGAAAAACAAACTTTTTGCGTTCAGATGGCCAAAATTGAATAAGA > SEQ ID NO:94 44139 Contig A *Nicotiana benthamiana*
GCCATTACGGCCGGGGGTCTCTTGGGGAAGAAATTGGCAtCCCAATAGAGGTATATGGACCTGAGGCAACCATGACTGG
TATCTGCAAACAGGCTATTGAGTGCATCACTGCAGCTGCATAGAGGAACCAACTCTGTATTCTTCAAGCTTAATTGCTT
TGCTTATTCTTTTCTAGCTTTGTGTTAGCATGATGTTGTTTGCCAAAGATAAAAGAGATGTGTTTGTATTTTTATGACT
TTTTTTTACATAAGAAACGAGCCATCAGCAATGGCTTCGTTTCAAATATGGCTCGTTTCAAATCAGTTTAGTAACGCAG
AAAATTGCTGC > SEQ ID NO:95 44139 Contig B *Nicotiana benthamiana*
GGCGGGAATTTTCTGCGTTACTAAACTGATTTGAAACGACCCATATTTGAAACGAACCCATTGCTGAGGGCTCGTTTTT
TATGTAAAAAAAAGTCTTAAAAATCCAACCCCTTTTTTTTTATTTTTGGCAAACAACATCTTGCTAACCCAAAGCTAGA
AAAGAATAACCAAAGCATTTAACCTTGAAAAATACAGAGTTGGTTCCTTTATGCAGCTGCAGGGATGCACTCAATACCC
TGTTTGCAAATACCAGCCATGGTTGCCTCAGGTCCATATACCTTTATGGGGATGCCAATTTTTTCCCCAAAAAACCCCC
GGCCGTAAGGGC > SEQ ID NO:96 44146 Contig A *Nicotiana benthamiana*
gctgatTTACACATTCATGAAATTGTCAATGTCATGATACAAGTTACAACTTATTAAGCACGAGCATGAAAACTGCCTC
AAAGAAAAAAATGAGGGGCAAGAACTAGTAACAGGTCCAAAACATTGTACCTGAATTTCCAAGTTCTTCGGCTAAGCAA
ATAGTagaAACGGCAATATTATGCCATAATTTACCAAGAATTTagaGTTTCTACGGCATCACTGTACAGCTGCTGAAGC
ATCACAAAGATCAGCCCTTTGTTCAACAAAGGTAGTTGCTTGCACCTTTAagaGTTTTGATCTCtCagaCTTCACCGTC
CTTCCGTGGAGACGATATCATTCTTTCCTGTACAAACTGTCTCCTGCTTAAAACCATGGTCAAGGCTGTGCTAATGtga
gaTTTACTTCAATGGTATCtctGCagaCTGCAAAGTGACCTGCCCAGCAGCAGCTTGCTCGTATTCAGCACTGGCCTCC
GGAGTGTCTTCTTCACTGGGTGGAACCAATTGCCAAAATagtgGCAAATATTTGTCCCACTCCTTgagaatagtTGCGC
CTTTCGtgCTGccCGTTTTTTccacATGGGCTtcGattaggctctTT

FIG. 1 continued

> SEQ ID NO:97 44146 Contig B *Nicotiana benthamiana*
GCCATTACGGCCGGGGACAAAAAAAATTGAAGCTCGGGGTAGCTCATCAAAATGTTTTGGAAAACTAATCTTTTTATTT
GGGTTTCTTTGGCTATTTTGCTAATAGTAATACTCCAACTAGCTGATGCAAGGGAGATGTCTAAGGCGGTTGCTCCAAT
TACCCAAGGAATGGATTCAAACAACATTAGTGATCAAGCGGGTTATGCTCGGGTTTTACATTGCTTGGCTTGCACATGT
TGGGTCGGTTAAATTTTATATATTTTTTACGATCAAATATTATACAATGGTTTTGTATGTGCTAAAAGTAATAATACTC
CAAAATAAGGCACAACATTGGGG > SEQ ID NO:98 44189 *Nicotiana benthamiana*
tCACAAATACCTTAAATAATCAACATTATGTGTAATATCCACAGCAATTACAGATTAATACAAAGTATTCTTGAAAAGA
TACATGGTGCGAGCTGGAATACAACTAACTAGGAGTACAAGGATAACGATCTACTGTGCCAAAGCACTTGTGTTGAAAA
CAAGGAGAGCACCTCCAGCTAGAATGCCAACCAAGGTAACTGCCCATATGGCTAAGCCAGTGGTACCTCCAACATAGAC
ATCACCGCTTGGAGACCAGTCATCTGTGTTGTAGATGGGGCTGTATCCATCAACATTTGCTCCATATTTGTCAACGAAT
TGGTAAACACCCTTTCCCTTGGGCTTTCTGCCAGAGGCATCGACGCCGTCTCTCAAGCTCATGCTTCCATTAATTCCAT
AAGGCTTGTCAGTCTTAAGCTTCTTGACACCACTAGCTTGAACTCTGAAGGAAGAAGAAGACCTAGCAAGTGATGGCAG
TCCTTTCACTGCTGTCTTCTCAACACTGAAAGCTGCAGGTTTGAGGCTCATTACTGTGCTTGCCATTTCCTATACTCTC
TTTTCTTCCTGTAAATGTCCCCGGCCGTAATGGC > SEQ ID NO:99 44503 *Nicotiana benthamiana*
tttAAAAAGCCACACTTATTTTATTTATTATATTGAAATAGTACAGTACATGAAGAGTACACTATAGAACACCAGTACT
CTATTTATTAATTCTTGGGGCAACTTATTCTGAATCTTCCATAATAGTCCCATAGAACTATTTAATTAACCCATGCTGG
GAGTATCTCGAACAATGAGTTTCCAGTTAACAACAACAAAAACTCGACCACAAACATAATTAAGTGGCCTAACCATACC
AGGGAACAAAAACTGAACTTTGGCTATGGGATTTTCTTTCTCAATTATTCTCTTAGCAGTCGCCGCTGGCTTTCCCACA
AGTTCAGGCCATGATTGCTTTCCTGGGCAAATTATTGAGAGAGAGGGATCATCAAGTGTTTCCACTTGGTTTTCTTTTG
CCATTGGGAATTGCAAGACTTCTATTCCGTCACTTACTTCGAATACTAGATCTCTTGCCGTAAGAGGTTGAAAAAGCGA
TGCAAGGAGCAAGAAAGCAACTACATGAGATAACTTGAACATAGTCTTCCCTTCCATTGCCTTTGCTTTGAAAAATACA
AAgAaagaaAATCCAaactgtatTCCccggccgtaatggc > SEQ ID NO:100 44508 *Nicotiana benthamiana*
CATACATTgtGTACTTGCTAAACATGAAAATTGAAAATCTGTATCTCGCTGATACGTGTTATCCCGCTCAAAGTAGAGA
TTGACAATGACCTTTCATCAACAGTGACATAAGTCATTCCTTTCGAACCTAATACTTGGAGACATTCAGACATAATAAC
CAGTAATCGTGAACCCTCGTCCTATGATCTCCCCAGCACAAAACCAAGCAAAACATTCAAGGCCAAAAAGAGCAGCAAT
GCCAGCATCCTCGATTTTCAGCTCCTGTTTGTGCTTCCACAAGTGCTTGACATCAAGTTCCTTCCAGAATGCTTGATAG
CGGCAAGGAATACTAGCTAAGCGAGTGTAGAATACTTGTTTTGCCAAATGCTGGCATTTCTCCACAGTAGGTGGCTCTT
GAATATATTGCTTGTTCTGTTCCAACGTCTGCTTGTAGTATGCACATCCATGCTTGGTCAAGAATTTTGAAACTTCAAC
AGCCTTTGCTTTCACTATAGGTAGTTTTGAAGCcatagTTccCTaaTCaacacATAAT > SEQ ID NO:101 44558 Contig A *Nicotiana benthamiana*
GACAGCTGACATCTGTATTATGAGTAGCAATACGTGTAAATTTGTAATACAAAATCTTCAAAATGTTATGATCCAGTTA
CTTCTGAATCCAGTTTCATACAAACTTTCACAACCTGTACCATAATGAATTGTATTGTCCTTTTTTCACTTCTTATGTA
AACCTTGTTAGCAGAAGAGGTTCTTTGCTAAAAGGACCCTTAGTGACTATAAATGTTGGAACCTCTAAAATTCAGAATA
TAAACGAACTAAACGCAGGGACGTAAATGATGTCTCCAAGCGCCAATCTCTTTGCTTTTTGCTTAAAGGTTTACCTTTC
CCTGCTTTTTCTCTATTCACTCTAACATCTGCTATGCCCCAAATACAAGCATTAGTTTCCAAATTGTAGGAGACGAGCC
TGAGAACACCATCATGTTCAGATGATGATCCACCCTCAGCCACTTCATCACTAACATATTTTACATACATAGGACGATC
CTTGAACCGTTCGAGATCTTGGGGAATCCGAATAACTCTCTCAACACCAGGTGATGATACCTCAAGAGATA > SEQ ID NO:102 44558 Contig B *Nicotiana benthamiana*
GCCATTACGGCCGGGGCCAAACGTTAGGTAAGATTGTTGGGTGATGAACTGGAACGGCGTTGTCAACTGCAGATGAAT
TCCAATAACGTCGTCATTACTTTTGTCGACCAGCAAAGCCATTAGTTTTTATGGTATTTAATTTGTTGTTTCCTTTTCT
TTTCCATCGAATAAACTGGCCATAGGAATGAATTCAAGTACCGGTTGGATGACATGGAGCCCAAGTTCAGCTTTCCTAC
CAATATCCATGGGTTCTAGCTGTAATAATAGCAGGATTTCCTGTCATACACTTTGGAATATGGCGAGAAGGAGAAGGGT
GTATATAACGGTGAATACCAAGAAGAGAAGCGAACCAGTTTTCAAGCCTTCCGTTGTTGAAAAGTTTCTTTGGTTGAT
GAGGCTGAGGATGAGCTTCTTCTTGAAGATGAGGACCTGGTGGATGATGATGATGCGGGTCTTTGAAGAGTATTTTGAGG
AAGACGCCGAGCTTTGTGTTGGGGATGGATCGGGAGGAGGAGGGATCTCTCTGGCTGGGACATCATGGGACAAAAGAGC

FIG. 1 continued

ATTAGAACTTGCAGAAGAAGTTGCTCTATCATTTGATGGAGAATTGGGAATTTATGCGTTTAAAACATTAAAAAATGCC
AACATTCAAGTACGAGTGGAGAGACTTACAAATAAGT

> SEQ ID NO:103 4743
AGATATTAATATATGTGATCACACAATATTACAATTATAAGAAAGATACCAAATGGAAACATTACAAAGTATTGAAAAA
CAAAACCTTTTCTTTTTAATCTCAAATCATAGAGGACCGGACGCTCAACTGCTTCAATATAGTTTCCAGTGTGGACCCG
TCACAAGACCTCCAATTATTCATGTATGTTTGATAATGCAAAATAAAATTATTATAACCTTTCTTTTGTTTGTTTGTTT
TAACATTCTGGTGTTTGGGTATGGTCTCTTTTCGGATCATGGCAATAGTTATAGACCAAGAAGTTCCTCTGTGCCCATG
TCAATGCCGCCATCTGCTGCCGGCTCAACCCGCGGTTGCGCATGGGTGCAGGCGATGGCGGTCTGCATGAGCTAGAGCT
ATCCGCTGTGCATCCCGCTAGCTTAAAGTTTTTGTACTTAGCCACAAATGGTTGGTATCGATAGTCGGCTTTGATCCTT
CCATTTTCTGTGGCCCAGTCCGATGCATCCCATATCGATCCGTAAACCCACATCGGTCTTGTGGGGAATATAGCTTCAT
TCTTTCGCGGCCGCAATTCTCGAGC

> SEQ ID NO:104 4837 Contig A
CGCGCACTACTCAACCTCAATGGCCGCCTCAACAATGGCTCTCTCCTCCCCTGCCTTCGCCGGTAAGGCCGTCAAGCTT
TCCCCCGCGGCATCTGAAGTCCTTGGAAGCGGCCGTGTGACAATGAGGAAGACTGTTGCCAAGCCAAAGGGCCCATCAG
GCAGCCCATGGTACGGATCTGACCGTGTCAAGTACTTGGGTCCATTCTCTGGCGAATCACCGAGCTACCTTACCGGAGA
GTTCCCCGGAGACTACGGATGGGACACCGCCGGACTTTCAGCTGACCCCGAGACATTCGCAAGGAACCGTGAACTAGAA
GTTATCCACAGCAGGTGGGCCATGCTCGGAGCC > SEQ ID NO:105 4837 Contig B
TCGCGCGTCTTGGTTGTAAACACCGACCCTTCTATCGTGTAGTTGTCGCCGATGAAAAATCGCGCAGGGACGGTAAACA
AATCGAGGTGTTAGGCTTTTATGATCCACTCCAAGGCAAAGAAGATGCGGATAGAGTGAGCCTCAAATTCGACAGAATC
AAGTACTGGTTATCTGTTGGAGCTCAACCAACAGACACAGTGGAAAGCATGCTTTTCAGGGCCGGTTTGATACCACCAA
AGCCTATGGTAGTGGTCGGTTCGAAAAATGGGCAGAAGTCTACGAGCCAACATGTTTCACCCATTACAGGTGAAATCTT
GAACTAAGAGTGTTGATGCGTTGAGCAAGAAAGAGCCTTTTGTGTCTGTGTGAAAGGAGTTTATGTAATGTTGTTTAAG
ACTTTTCTGTTTATGTGAAAGGAGTTAATGTAATGTTGTTTAAGACTTTTGCTTTCTATGTGAAAGCAGTTTAATGTTA
TGTTGGTTAAGACGCGGCCGCCCGTATTATACATAAAATCTCATGTATCTTTACATCAAACTTCAAATCTAAATACAAA
AACAAAAAGAACATCACTAGAGATGGATCTCTCGTCGGACAAAACCCCGAAGTTTCGTCTTTCACGGTCAACTTTAGTC
AAACTCCGATCCGAATCAAACCAAAAAGGGTTTTTCATTCATCGATCATAGTCATCATCTCCTTTTTAGACAAAAGATT
CTCAGCTTCTCTGGATCATAAGGAAGAGTCTAGAgcCAGGAGCGTCGGATCccTTCATGATTCTGAGTCTCTTACAAGAA
GAAGAGAACATGTCCCATGGAACATCACCAACCAACATCCAGTCACCATCTTTATCTTCGTATGTTGGTACAAATCCAG
ATCCTTTGTATCCTTCTCTCTcacAATATTCACCAATCATGACTTTGAACATATTCTCTAACGCTTTGAGAAGCTCGGG
GTAGTTTTTGTATGTCTTGAGATCGATCTTGCGAAGGTAAGGAGCTCCGTCCATACTCACTTTCACGTAGCTCACACTG
TTGTTGTTCTTACGGGAAGATCTCACTGGTGGCCAACCAACGATTTGAGTTTTGGTAGGAGGTGTAGATTCTTCTTCAT
CACGAGTTTCCTCAAATAGACGCTTGTTGTTACTTTTAACGCAAGAAACCTCTTGTTCTTCTTTGATCTTCTCTGTTCT
TCCGGGTAATCCAAGACATAGCTCTGTGTCCTTaaggttaagctcgttgcctttctcgtacgccattgcttttggatca
atatcaatctttgtggcggccgcaattctcgagc > SEQ ID NO:106 48458 Contig A Nicotiana benthamiana
GGATATGCTGATTGAGCAATACAGATCCAAGTTCACTAACAACAGTTCTAATCAAACTGATAGTAAGCAGCAGGGCTCT
AAACAGCTTAAAAGGTGGTTCCAATCCTAAATCAATAGTTCTTCTGTAGCTTAATTTTATTTGATGATAACTGAGTATC
ATTTTGG > SEQ ID NO:107 48458 Contig B Nicotiana benthamiana
GCCATTACGGCCGGGGGGAAACTGGTGGATGCAATTTGGGAATGACTATGTATTGGGATATTGGCCAGGCTTTTTATTT
TCATATTTAACAGACAGTGCTTCAATGATTGAATGGGGTGGGAAGTGGTGAATTCAGAATCAGATGGACTTCACACCA
CAACTCAAATGGGGAGTGGCCATTTTCCAGATGAAGGTTTGGGAAATCAAGCTATTTCAGGAATATACAAGTAGTTCA
TGGTTCAAATAATTTGAGAGCTCCTCAAGATCTTGGGATTTATACTGAGGATAACAATTGCTATGATGTTCAACTAGGA
AAGAATAATGACTGGGGGAACTACTTTTACTATGGTGGACCTGGTAGAAATTCTAATTGTCCATGACCAAGATTCTAAA
TGTTTTTTACTTAATTCTTTCACTCTTTTAATGTAGTAAAACTGGTAATGTACACATTGAGTCCTTTGTATGGTCATTG
TTTTACTCTTTGTAAAACTTTTGTTTTAGGGGCTAAGTTAGTGCGCAACAAAATGTGTATCATTGTTGGTCTTTGTGT
GAAAAGTTTTTCACCTTTCTTTTTAGACCTCCAGTCTCTAAATAAAAATATTGTTGGGGAC

FIG. 1 continued

> SEQ ID NO:108 4845 Contig A
AAAAATGGCTTCAAGTTCCATAGCTCTTTTCTTGGCTCTCAATCTTCTCTTTTTCACAACAATCTCCGCCTGTGGTAGC
TGTACTCCGTGCGGCGGAGGTTGCCCCTCTCCCAAGCCAAAGCCAACTCCTAAACCAACCCCAAGCCCTAGCTCTGGCT
CGAGCAAGTGCCCTAAAGACACCCTCAAGCTCGGTGTCTGCGCTAATGTGCTCAAC > SEQ ID NO:109 4845 Contig B
CGCAGTTGATGTCACCAAGAAAGCCGACCCTAAGGCTAAGGCTTTGAAAGCTGCGAAAGCAGTGAAATCTGGCCAAATC
GTTAAAAAGCCTGCGAAGAAGATCAGGACAAAGGTTACTTTCCACAGGCCAAAGACATTGACCGTTCCTAGAAAGCCTA
AGTACCCAAAGATCAGTGCTACTCCAAGGAACAAATTGGATCATTACCAGATCCTCAAGTACCCTCTCACTACTGAATC
TGCCATGAAAAAGATTGAAGACAACAACACCTTAGTCTTCATTGTTGACATCCGTGCTGACAAGAAAAAGATCAAAGAT
GCTGTCAAGAAGATGTATGACATTCAGACCAAGAAAGTCAACACCCTCATTAGGCCCGATGGAACAAAGAAGGCGTATG
TGAGGTTGACTCCTGATTATGATGCTTTGGATGTGGCTAACAAAATCGGGATCATCTAATCTGATCATTGTCGCTCTGT
GATTTTACTTTTTCTGGTTTTTCTCTTCCATAGTCTCAGTTTTGCTAGAGAAGTTAAGATATTACTATCACCATCTCTT
TGTTATGCTTTTATCTTTGGATTCAAAAAGATTATATGTTTGGTATTTGGCGGCCGCAATTCTCGAGC > SEQ ID NO:110 48493 Nicotiana benthamiana
GCCATTACGGCCGGGGATCTGCTTCAAGATTGTGCAGCTTGTTGAGTAGCCAGAAATGATTTAAAGCTACCTTAAGCTT
GACTTCAATTTTGGCAATTATTCGTCACACTGCCTAAGAAGAACCTAAACTTATCCAGGCCTCTGGAGTCCAATAAGTA
GCTCCATTTAAGAGGCTTTCTATGTCCAAATAGTTTGAAACAGAGTCAGTTGCTATCTTGTTTATGTTATGCCCCTGCA
ATTATAGCTTGCTTATATGAGACTGGCTTAATGATGCG > SEQ ID NO:111 48602 Nicotiana benthamiana
GCCATTACGGCCGGGCATATTGGTGGGTGGAGAAGGGTTGTGATGATGCAGAGTGGGATGTTCCTTTCGAGAGTAATGC
TTTTCGTTTTTGGATTCTATTGGATTAGCGAAACTTATTGCCCCATTGATCTCAATAGCAACTCAAATAATGAGCATGG
ATCAAACGATCAGGCTGAAGAACTTGAAAGACCAGGGGCTATTGTGTCAAATCGCATTTCGTACTTGGATATCTTGTAT
CACATGTCTTCCTCATTTCCTAGCTTTGTTGCTAAGAGATCAGTGGCTAAGCTTCCTCTGGTTGGTCTCATCAGCAAGT
GCCTTGGCTGTGTCTATGTCCAGCGAGAATCGAAATCACCTGACTTTAAAGGTGTCTCAGGTGTTGTAAATGAAAGGAT
TCATGAAGCTCACCAGAACAAATCTGCACCAATCATGCTGCTTTTTCCAGAAGGGACAACCACAAATGGTGATTTTCTC
CTTCCGTTCAAGTCTGGTGCATTTCTGTCAGGAGCTCCGGTGCAGCCTGTGATATTAAGATATCCATTCCAGAGATTAA
GTCCTGCGTGGGACTCGATATCTGGGGTTCGCCATGTGATTCTCCTTCTCTGTCA > SEQ ID NO:112 48673 Nicotiana benthamiana
GCCATTACGGCCGGGGTGTAGGTTTGAATGCTTCCCAGTGTTCCTCTTTTATTATTGAGGGAGAATCGGGGATTATGC
AGATGGAATTACGTTGGGGCAGTAGGCTAATTGTACATAGTAGGAAAGAACGTAAAAATTCTTGGAGGTTTTACTGAAG
TACCAAGACTCGGATGCTTCAAATTCCTTATCTTGCTTCTGCCTCGAGGATGAGATGTATCCGACTTATGAAAGGCTAC
AAGTTATATGTACTTAACAGTGTAGACAATATGAGTGTAATTGTTTATTTAGTAGTAGTTTGAAATTGTAGTTCAACAT
CCCATGTGAATGACGATCTGAGTTTGTGAAGCAAACAGCTCTTATGTAAGAGATATTTTGGCTGCATTAAAGGCCAGTT
CGGTTACT > SEQ ID NO:113 51719 Arabidopsis thaliana
GCAGCGCGGGCCTGATCTCAGTTGATCTAGCCCGCGACTTGCTCCAAGTTCATCCCAATTCAAATGCAATCATCGTCAG
CACGGAGATCATAACGCCAAATTACTATCAAGGCAACGAGAGAGCCATGTTGTTACCCAATTGTCTCTTCCGCATGGGT
GCGGCAGCCATACACATGTCAAACCGCCGGTCTGACCGGTGGCGAGCCAAATACAAGCTTTCCCACCTCGTCCGGACAC
ACCGTGGCGCTGACGACAAGTCTTTCTACTGTGTCTACAACAGGAAGACAAAGAAGGACACGTTGGCATCAACTTGTC
CAAAGATCTCATGGCCATCGCCGGTGAAGCCCTCAAGGCAAACATCACCACAATAGGTCCTTTGGTCCTACCGGCGTCA
GAACAACTTCTCTTCCTCACGTCCCTAATCGGACGTAAAATCTTCAACCCGAAATGGAAACCATACATACCGGATTTCA
AGCTGGCCTTCGAACACTTTTGCATTCACGCAGGAGGCAGAGCGGTGATCGACGAGCTCCAAAAGAATCTACAACTATC
AGGAGAACACGTTGAGGCCTCAAGAATGACACTACATCGTTTGGTAACACGTCATCTTCATCGTTATGGTACGAGCTT
AGCTACATCGAGTCTAAAGGGAGAATGAGGAGAGGCGATCGCGTTTGGCAAATCGCGTTTGGGAGTGGTTTCAAGTGTA
ACTCTGCCGTGTGGAAGTGTAACCGTACGATTAAGCACACCTAAGGACGGACCATGGTCCGATTGTATCGACCGTTACC
TGTCTTTATTCCCAAGTTGTCAAACTCTAAACTGAAAACGTCTTTGAACGGTTTAGTAACGGTTTGATTTTGTGTTAC
GGTTTAGGTTTATTTGGTCTCGGGATTTGGTTTAAAGGGGATTGAGAAATGGGAAGTTAGAGAGAAGAAAAAGCAAAGC
ATAAATGTTTGTATTTAATTGCTCTGCATATACTTAAATCTCTGCTTTTCATTtggggtatttttagtttctcgtgct
gtaattaataacttgtggtgtactcaaataagaatatttctctctgttttatta

FIG. 1 continued

> SEQ ID NO:114 51843 Contig A *Arabidopsis thaliana*
CCCACGCGTCCGAAAATACAAATCGACTTTCATATTTTCTCTGCATAAGAGAGAAAGAAAATGGGATCTCATGTCGCAC
AAAAACAACACGTAGTTTGCGTTCCTTATCCGGCTCAAGGCCACATCAACCCAATGATGAAAGTGGCTAAACTCCTTTA
CGCCAAAGGCTTCCATATTACCTTCGTCAACACCGTCTACAACCACAACCGTCTCCTCCGGTCCCGTGGGCCTAACGCC
GTTGACGGGCTTCCTTCTTTCCGGTTTGAGTCCATCCCTGACGGTCTACCCGAGACTGACGTGGACGTCACTCAGGACA
TCCCTACTCTTTGCGAGTCCACAATGAAGCACTGTCTCGCTCCATTCAAGGAGCTTCTCCGGCAGATCAACGCAAGGGA
TGATGTTCCTCCTGTGAGCTGTATCGTATCCGACGGTTGTATGAGCTTCACACTTGATGCTGCGGAGGAGCTCGGTGTC
CCGGAGGTTCTTTTTTGGACAACTAGTGCTTGTGGCTTCTTGGCTTACCTTTACTACTATCGCTTCATCGAGAAGGGAT
TATCACCAATAAAAGATGAGAGTTACTTAACCaaggAACACTTGGACACAAAAATAGACTGGATACCATCGATGAAGAA
CCTAAGACTAAAAGACATCCCTAGCTTCATCCGaaCGACTAAtcctgAcGACATCATGCTCAactTTATCATCcgtgag
gcTGAccgagccaAacgcGCttcaGCta > SEQ ID NO:115 51843 Contig B *Arabidopsis thaliana*
TTTTTTTTTGGGATGAATAAGAAGATGTTTATTTGATTATGAGTAAATGAGTAATTAATTTGGGAAATAAAGAGGTTCT
TTGTGAGCAATGGTCTACTCTTGTGTGCTTAAATCCCTTTTTTCTTGAAATCCATATTTACTAGTCTCTACTCCCCTAA
AAGAACCTTATTAACGAGCATCTCAAAGTTCAATTTAGAAGAACCATGCTTATGCTCCGTCGCTTCATTCGCCAAGCGC
CGCCACTCTTCCGCCTTCTCTCTCATATTCTTTCCCTTCTCTTCATCCATCAACTCCCTAACCACCGCCTCAACCTCTT
CTCTCTTCACATCTCCACCAATCTCAATCCCAACCTCCCATTCGTCACGAGAAAACTTACAATTAGTTTGTTGCTCTGC
AAAAAACGGCCAACACACCATTGGAACTCCACCGCATAGACTTTCCAACGTCGAGTTCCACCCGCAATGCGTCAAGAAC
CCTCCAATGGCCGGATGAGAAAGGACTTTCTCTTGAGGACACCAACTTGCCAACATCCTCCGGTCCGCCGTAGCCGTTA
AAAACTCCGGTGGAACCATTGCCTCATCCCCGGCTACTAAATCCGGCCGGATCACCCACAAAAACTCTTTCCCCGTTGC
AGCCAAACCCCATGCAAACTCCACAAGCTGTTTTGCGCTCAAAACAGTTATACTCCCGAAGTTAACGTACACAACACTG
TTTCTAGCTTTCGTGTTTAGCCAGTCCAGACACTCAGTCTCC > SEQ ID NO:116 52689 *Arabidopsis thaliana*
CCCACGCGTCCGCTCGGTGGAGACTATTGATGGAGGAAACACTATTGTGAAAGGTAAACATATCATTGTTGCTACTGGC
TCGGATGTTAAGTCCTTGCCTGGTATTACGATTGATGAAAAGAAGATTGTTTCGTCGACTGGAGCGTTGTCTCTATCGG
AAGTTCCGAAGAAATTGATTGTTATTGGTGCGGGGTATATTGGGCTTGAGATGGGTTCTGTTTGGGGTAGGCTTGGATC
TGAGGTTACGGTTGTTGAGTTTGCTGGAGATATTGTTCCTTCGATGGATGGTGAAATTCGTAAGCAGTTTCAACGTTCT
CTTGAGAAGCAGAAGATGAAGTTCATGCTCAAGACTAAAGTTGTTTCTGTGGATTCCTCCTCTGATGGTGTGAAGCTTA
CAGTGGAACCGGCAGAAGGAGGAGAGCAGTCTATTCTGGAAGCTGATGTGGTACTTGTCTCAGCGGGAAGAACACCGTT
CACTTCTGGACTTGATCTGGAGAAAATCGGAGTGGAAACTGACAAAGCCGGGAGGATTCTGGTGAATGATAGATTCTTG
AGTAATGTC > SEQ ID NO:117 53369 *Arabidopsis thaliana*
GCAGGAAGTATAGTTACGTTAGTCTCATTTTCAAGTAGTTCAATCGTCACTTACGCTTTCAACTTTCTGTTCGAATGGA
GCACTCAAGGAACGTTTTTCATATTCGCGGGTATCGGTGGAGCAGCGTTGCTTTTTATATGGTTGCTCGTTCCAGAAAC
GAAAGGATTATCACTCGAAGAAATACAAGTTTCACTTATTCATCAGCCCGATGAAAGAAATCAAACTTAATTTGAATTA
TTTTATTTTATTATAAAAATGATCAAATTCAGTTTATGGTGTTATATTTGTTTATTTACAAACAAGGATTTTTTTTTC
ATTATGTAATTACTACTTTATTTTTCTGGGTAATTAGCCCCATTTTTATGATGTATATTTACGAGATGTAAAACTTGGC
CTACGTACATGTGTATTTTATCTCTAAAATTGCAAATGTAATATTTTTCGGACATATATTAAAGAAGAGATTGATTTCA
AA > SEQ ID NO:118 53564 *Arabidopsis thaliana*
cccacgcgtccgcctttgggcgaagattcttcagtcttccatggagtcgagcactggacaaagggtaagcgatctaaga
gATCAAGATCCGATTTCCACCACCAAAACCTCACTGAGGAAGAGTATCTAGCTTTTTGCCTCATGCTTCTCGCTCGCGA
CAACCGTCAGCCTCCTCCTCCTCCGGCGGTGGAGAAGTTGAGCTACAAGTGTAGCGTCTGCGACAAGACGTTCTCTTCT
TACCAAGCTCTCGGTGGTCACAAGGCAAGCCACCGTAAGAACTTATCACAGACTCTCTCCGGCGGAGGAGATGATCATT
CAACCTCGTCGGCGACAACCACATCCGCCGTGACTACTGGAAGTGGGAAATCACACGTTTGCACCATCTGTAACAAGTC
TTTTCCTTCCGGTCAAGCTCTCGGCGGACACAAGCGGTGCCACTACGAAGGAAACAACAACATCAACACTAGTAGCGTG
TCCAACTCCGAAGGTGCGGGGTCCACTAGCCACGTTAGCAGTAGCCACCGTGGGTTTGACCTCAACATCCCTCCGATCC
CTGAATTCTCGATGGTCAACGGAGACGACGAAGTCATGAGCCCTATGCCGGCGAAGAAGCCTCGGTTTGACTTTCCGGT

FIG. 1 continued

CAAACTTCAACTTTAAGGAAATTTACTTAGACGATAAGATTTCGTTTGTATACTGTTGAGAGTTGTGTAGGAATTTGTT
GACTGTACATACCAAATTGGACTTTGACTGATtccaattcttcttgttctcccattttaaaaattattaaaccgattct
ttaccacataaa > SEQ ID NO:119 57119 *Nicotiana benthamiana*
ATTTCCCTTCCTTGCAAACAGTAGGGCCAAGGCAATTGATGATGCTGAGGGAATTGTAAAAGTACTTGCTGAGAAGGAG
ACTGACAAAATCTTGGGTGTTCATATTATGTCACCAAATGCAGGGGAGCTTATTCACGAGGCTGTCCTGGCTTTGCATT
ATGGAGCATCAAGTGAGGACATTGCTCGTACATGCCATGCACATCCAACAATGAGTGAGGCTCTGAAAGAAGCAGCCAT
GGCCACTTACGACAAGCCCATTCACATATAAAAATAGTGTCATATATTTGTTTTTGTTTTTCCTCTGAGTATCTTGAAT
ACTTAGAGCATATTTTCTAATTGCCACCTCATCACTCAAGTATCTCTTGAACAGATATTTCCTCCCTCTTCTCTAATTA
TCCAAAGTACTTCCAACTTAATGTTTCTGTTCTGCATATTCATATCTGTAATAAAGTCAGGAGCTGTATGTCAAAGTTT
AAATGCCATCGATTTGAGTTTCATTGAGTTTTG > SEQ ID NO:120 57135 *Nicotiana benthamiana*
ATGAACCTGTATAAAAAAATCTCCGTTGCTGAATTTTCTGGCCCACCTTGGATGTCTTTTGGCGCTATGAAGTTAATTA
CTCGCCTTTTGGATCCAAATCCTATGACACGTATTACCGTCCCAGAAATTTTGGAGGATGAGTGGTTCAAGAAAGATTA
TAAACCTCCTGTTTTTGATGAGAAAAAAGATGCCAACCTGGATGATGTTGAAGCTGTATTCAAGGATTCTGAAGAATAT
CATGTAACAGAGAAAAAAGAAGAGCAGCCAACTCCTATGAATGCATTTGAGTTGATCTCAATGTCAAGAGGACTCAACC
TTGGGAATCTCTTCGATGAACAGGAATTTAAGAGAGAAACAAGGTTCACATCTAAATGCTCGGCCAATGAAATAATCAG
TAAGATTGAAGAAGCTGCAAAGCCCCTTGGTTTTGATGTTCACAAAAAGAATTACAAGATGAGGCTGGAAAATGTTAAA
GCTGGAAGAAAAGGGAACCTTAATGTTGCCACTGAGGTATTTCAAGTCGCCCCTTCTCTTCATATGGTTGAAGTGCGAA
AAGCAAAAGGAGATACTTTGGAATTCCACAAGTTTTACAAGAATCTTTCAACTAGTCTAGAGGATGTAGTGTGGAAAAC
TG > SEQ ID NO:121 57152 *Nicotiana benthamiana*
CTTACATTGGTAGATGTCTACTCAACACTAAGATCACGGGTGATGATGCTCCTGGTGAAACTTGGCACATGGTCTTCAG
CACTGAGGGAGAGGTCCCATACAGAGAAGGACAATCCATTGGTGTGATTGCTGATGGTGTTGATGCCAATGGGAAGCCT
CATAAGCTCAGATTATACTCCATTGCTAGCAGTGCCCTTGGTGACTTCGGCGACTCCAAAACCGTTTCTCTGTGTGTCA
AAAGGCTTATCTACACCAATGACAAAGGGGAAGAAGTTAAAGGAGTTTGCTCAAACTTCTTATGTGACTTGAAGCCTGG
AGCAGAGGTCAAGATTACTGGACCTGTTGGGAAGAAATGCTCATGCCTAAGGATCCAAATGCCACCATTGTTATGCTT
GCAACTGGAACTGGAATTGCTCCTTTCCGTTCATTCTTGTGGAAAATGTTCTTTGAGAAACATGAGGATTACAAGTTCA
ACGGTTTGGCATGGCTTTTCTTGGGTGTTCCCACCAGCAGCTCGCTACTTTACAAAGAGGAGTTCGAGAAAATGAAGGA
GAAGGCCCCAGAAAACTTTAGACTGGACTTTGCAGTGAGCAGAGAGCAAACAAACGAAAAAGGCGAAAAGATGTACATC > SEQ ID NO:122 57194 *Nicotiana benthamiana*
CCCACGCGTCCGATCTCTTCTATTCATAAGTTGTAAATTCTTATTATTGGGATTTTTTCCCTTTTTAATTCAATCCAAG
AATTGAGTAGGACTAATGGCATCCAGGAGAATTCACAAGGAACTAAGGGAGTTGCAAAGAGACCCTCCTACTTCATGCA
GTGCAGGTCCGGTGGCACAGGATATGTTCCATTGGCAAGCAACCATTATAGGTCCAAATGACAGCCCTTATGCAGGTGG
TGTTTTCCAAGTGGCCATCCATTTTCCTCCTGATTACCCTTTCAAACCTCCCAAGGTGGCTTTCAAGACCAAAGTTTTC
CATCCAAATATAAATAATAATGGAAATATTTGTTTGGACATTCTTAAGGATCAATGGAGTCCTGCCCTCACCATATCAA
AGGTTTTGCTTTCCATATGTTCACTACTAACAGATCCAAATCCAGATGATCCATTGGTTCCAGAAATTGCTCATATGTA
CAAATCTGATCGGAAGAAATATGAATCAATGGCTCGTAATTGGACCCAAAAGTTTGCTATGAATTGAGTTGTTGTATTC
ATATAAAGCTCATGTGCTATAATTTGTAACAAAAGATCAATGATTTTCTCCTCCGCAGGCATGTAATAAAAGCACAAAA
TTATAACA > SEQ ID NO:123 57510 *Nicotiana benthamiana*
gccattacggccgggatccttctgctcttcattttggggtgctgactgctgcCTAGGGTTTTAGTTCTCTATTCTTCA
CCAAGATGAATGTAGAAAAGCTACGGAAAATGGCCGGTTCGGTCAGGACTGGTGGTAAGGGAACCATGCGAAGAAAGAA
GAAGGCCGTTCACAAGACAACTACAACTGATGACAAGAGACTTCAAAGCACCCTAAAAAGAATAGGGGTGAATGCTATT
CCTGCTATTGAAGAGGTTAACATTTTTAAGGAGGATGTAGTTATCCAATTCATGAACCCCAAAGTTCAAGCCTCTATTG
CTGCAAACACTTGGGTTGTTAGTGGTTCCCCTCAGACCAAGAAGTTGCAGGATATTCTTCCTCAAATTATTCACCAGTT
GGGCCCTGATAATTTGGAGAATTTGAAGAAGCTAGCGGAGCAGTTCCAGAAGCAGGCGCCTACCGGTGCGCCTGaaggt
GGTGCTGCAGCACAGGAGGACGATGATGATGaggtgCCGGAACCTGTGGCtggccaaACCTTTGAAG

FIG. 1 continued

> SEQ ID NO:124 57702 Contig A *Nicotiana benthamiana*
GCCATTACGGCCGGGGATCCCAGATAACATCCCTAGGGTATTCCTTAAACTCCCCATCTTCTCTTCGCACTCTGGCTTG
AGACCTATAGCCATGACTGTGACCAGCGGCGATTTCATCAATATTTATCCCACACAGCTCAAATTCCCATTGGACCTGA
GGAACCGGAGTGCATGTTCTTTGCAGTTAAGTACCAGGACTGATCAATACATTGCATTCAAGGCTAAGACGACCAACCC
CAAGACGTACTGTGTTAGGCCTAATGCAGGTGTTGTTTTGCCTGGTTCTTCCATGCAATGACACAGTTACAATGCAAGC
ACAGAAAGAGGTACCTCCTGATATGCAGTGCAAGGATAAGTTCCTAA > SEQ ID NO:125 57702 Contig B *Nicotiana benthamiana*
AACTTTGGTTTGAGACCTATAGCCATGACTATGAGCAGCGGTGACTTCATCAATATTTATCCCACAGAGCTCAAATTCC
CATTTGAGCTGAGGAAGCAGAGTGCATGTTCTTTGCAATTAAGTAACAAGACTGATCAATACATTGCATTCATGGGTAA
GACGACCAACCCCAAGAAGTACTGTGTTAGGCCTAATGCAG > SEQ ID NO:126 57707 *Nicotiana benthamiana*
GCCATTACGGCCGGGGCACCAGAATAGCACGGCGTGCAAATAAGAATTCATTTTACAGATGTCAAAGTGAAAGACCCTT
CACTGTGTAATCAAATCTTGATGTCTTTCTTCCAACCTAATTACCCTGAGTTGGGT > SEQ ID NO:127 57708 *Nicotiana benthamiana*
GCCATTACGGCCGGGGGCGTTGGAAATAAGAAGCGTAgGGTAATAAAGGAAGAAAAGTATGCTGCTCGAAGGGCTATCT
TGCCCATGCTTCAAGCTGAAGAGGATGAAAGATTCGTTAAAGAGTGGAAGAAGTATCTTGAAGAAGAGGCTAGAATCAT
GAAGGATGTTCCCGGTTGGAAAGTTGGTGAAAGTGTTTACAACTCTGGAAAATGGATGCCTCCAGCAACCGGAGAGCTT
CGTCCTGATGTCTGGTAATATGTTGGCAGGAGACAACGAAAACTGCTTTGTTTCAGTGGAGTTCATACTTACCTTTGGA
TTTCTTTCCTCATTGGAATAAAATGTATCTGCAAAATCTGTACACATGTTTAGAATGAAGTTACATGATTTGCTTTAAC
GCGGTTAGCGTTCTCCCTCCTATCTCATGGAAGTTCAGATAATCAGAGACAATGCTAGTTCCATGTTCTCTTa > SEQ ID NO:128 57804 *Nicotiana benthamiana*
GCCATTACGGCCGGGGAATAAATTGGTAGTTGGTGTTACTGTTCGCTGAGGGACCAGATCCAGAGTTCAACGACTGCAT
CGCCCCTCGCCTTTTAGTGTCAAAATTCTCTATTTTCTGACTGTTGCTGGTCTTTAAGAGTAGTTTGTATTGCATTACC
TGCGCATCACAATCCCCCCATCTTTATTTCGCCTTTTCTATTGTTGTATACTGGGGGTTGGTAAGAGCTAGTTGGATGT
GTGTTTTCTCTGTTTTGTTTTAATTCTTACACGGATAAATATTTGGGTTCTCCATT > SEQ ID NO:129 6025
cccacgcgtgcgcacaaATTCACAACCGCAAAAAATCCTCTCCCGGCTTAAAAACGAGTGATAAAGAGGTGTAACAAAA
CATGGCGTATGAACCGATGAAGCCCACGAAAGCTGGTTTGGAGGCTCCTCGGAGCAGATTCATAAGATCAGGATCACT
CTCTCTTCAAAAAATGTGAAGAACTTGGAAAAAGTGTGCACTGATTTGGTCCGTGGAGCTAAGGATAAGAGACTTAGAG
TTAAGGGACCAGTGAGAATGCCCACTAAGGTTCTTAAGATCACTACCAGAAAGGCACCTTGTGGTGAAGGTACCAATAC
TTGGGACAGGTTTGAGCTCAGGGTTCACAAGCGTGTCATCGATCTCTTCAGCTCCCCTGACGTTGTTAAGCAAATCACG
TCTATCACCATTGAGCCCGGTGTTGAGGTCGAGGTCACTATTGCTGACTCTTAGACACTTGTTCCAAAACCGCTTCAAA
AGAATGTATTTTATCGTTTCTGGTCCTACATTTTGTTTGCAACCTTGTTTCTTGGGTTTTGATAGTTCTGAGGTGGTT
TTTGTCtAtcgaatttttttcatctataagagaccttaatgaaccaaaaaaaaaaacccaaaaggggcggccgcaccc
taggccagt > SEQ ID NO:130 6153
CCCACGCGTCCGTCATCTTCTTCTTCACTCGCCTCAATTTTTGTTCCCTTCTTCTTCTATAATTCAACTGTGAATTTCA
CCGACGAAACAAAAAGAGAGAGAGAGAGAGAAACGATGAGTTCTCAGATTTCGGAGATTGAACAAGAGCAGCTGAT
CGAGAAGCTTGAGATCTTCAAGATCCATGGCAGAGACAAACGTGGCCGTAAGATCCTTCGTATTATCGGAAAATTCTTC
CCAGCTCGATTTCTGTCACTGGATGTGTTGAAGAAGTATCTAGAGGAGAAGATATTTCCTCGATTAGGTAGAAAACCAT
TCGCCGTACTCTACGTCCACACCGGCGTACAGAGAAGCGAGAACTTCCCAGGTATCTCAGCTCTACGAGCGATCTACGA
CGCAATTCCGGTAAACGTCAGAGACAATCTTCAGGAGGTTTACTTCCTCCATCCAGGTCTTCAATCACGTCTCTTCCTC
GCCACCTGCGGCCGATTTCTATTTTCCGGCGGGTTGTACGGGAAGCTGAGGTACATAAGCAGAGTTGATTATCTGTGGG
AACATGTGAGGAGGAATGAGATAGAGATGCCGGAGTTTGTATACGATCACGATGATGATCTGGAGTATCGTCCGATGAT
GGATTACGGTCAAGAAAGCGATCACGCGAGGGTTTTCGCCGGAGCCGCCGTGGATTCATCAGTCTCAAGTTTCTCCATG
AGGTGTATCTCATAGCGTaaaaggctaaaactccacccactagatatcggatcgtatcttataaccatataatatacg
aatacgattaataatatat

FIG. 1 continued

> SEQ ID NO:131 6198
CCCACGCGTCCGCGTTTCCTAAGATCAAGAAGCCTTGTCCCCCAATTTACAAACCACCGGTGGTGATCCCTAAGAAGCC
GTGTCCACCAAAGATTGCACATAAACCCATCTACAAGCCGCCGGTTCCCATCTACAAGCCTCCAGTGCCTATCTACAAG
CCACCAGTGGTTATCCCCAAGAAACCGTGTCCACCAAAGATACACAAGCCCATCTACAAGCCACCCGTGCCTATCTACA
AGCCTCCAGTGGTGATCCCAAAGAAGACATTTCCTCCACTTCACAAGCCGATCTACAAGCACCCGGTTCCTATCTACAA
ACCAATCTTCAAGCCGCCAGTGGTGGTGATTCCAAAGAAACCATGTCCACCACTTCCCAAGTTTCCACACTTCCCACCT
AAATACATTCCACACCCTAAGTTCGGAAAATGGCCTCCTTTCCCTTCTCATCCTTGATAAAGATGCAAAATCCTCTGTC
TTTCTTAATTTAAGAAAAGTGATCGAGTGATGCCACAAAAGAATGTTCCTTTGTTGCTTTGTTGAATTCTACGTAGATG
TTTCATGTTTATGTATCGTAAATTCCAGCCAATCATATTTGTAATTTTTTACCGTTAAAATAAATCTGTAATCTCGTTT
CTGTTG

> SEQ ID NO:132 6437
CCCACGCGTCCGGAGAGAGAGAGAGAGAGAGAGAAAGAAAGATCCAACTTCCACAAAGAACCATGGAAGCTGAGAAAGAAA
CAGAACAAGAAGGAAACTTGACAGTAATGAAACTTCCGGTGTTACCAACTAAACCCAACACTCACAGCCACTCTATGTC
ATCACCAATTCACAGTTCCATATCAGCTTCAGTTCCCTTTAGCTGGGAAGAAGAGCCTGGCAAGCCCAAGCAACACTCT
ACTTCTTCTTCCTCCTCTTCCTCTTCCTCACCATTAACTTCTTATTCTTCATCTCCTTTTGAAACTCACAAGTCCTTAG
AGCTACCACCAAGGCTTCACTTACTTGAAAAAGATGGAGGATCAGTAACCAAACTTCACTCGCCTATAACAGTCTTTGA
TGGACCTTATAGCATGACGACATCAAAAAGGATGGATTCACCTTCCTTTAGGATGATGGTGAAAGGTAGTGCTGATTGT
TATGGGTCTTTCAGGAGTGATATCGATGGTGATTAGAGGATTTGGAAGTGGGCTCTAAGCAGCAGGAGAACTTGAGTA
GTGGCTCTTTGGCTGTTGTGAAGAAGAGAGGGAGATTAGGGTTTTTTGGGTTTAGGAGGAGGAGAGCATTGAAAGGGAA
AACAGAGTTTGGTAGAGGTAGTTATGTGTTCCCATCTTCTGTAGACAGAGAGAGTGAATACAGTAGAAAGGAAGAGGAA
GAAGAAAAGAAGACAAAAGGTTTGGTTATGATGATACTGATGGTATTAGTTGCAGCCAAAGCAGCAGGTTTTGTGATG
TGAAGATCTCAAGCATTAGTAGAACAGGCAGCTTCTCTACTCTGCCTGCACCACCTTCTTCTTCTTCAAAGTCTCACTT
TTGGACGAATGTGTATGCAGGACTAAAGCAAGTGGTTCCATGGAAGAGCAAGAAGACTACAGTTTGACATTCTGCCATA
TCAAAGATTCGAAAGATAAAACACCAAGTAACAAGAAAGCTTCTATGGTTTCTACAAGTATTTTTAAGCTTTTGTTTAT
GATTTTTTTCAATATTTCCAAGAAAATGACACGACTAGTAAAACCATTGTGAAcccagtttttttttcacgcttgttgt
tgtgtttgaatgtttttgagacttttgtaaagagaaacagagaatcttacgatg > SEQ ID NO:133 6477
CCCACGCGTCCGCCGCAGCTGAAGAATTTCGAAGGTTTATTTTCAACCGAAGTCCGACCTAGTAAAGGTTCAGGGGTAC
AAGCCTTCGCCTCTCGTGCATTTGATGCTTCATTTAGCTGGAAGGACATTGAATGGTTAAGATCTATTACAGAGTTACC
TATTCTGGTCAAAGGGATACTCACCCGAGAAGACGCTCTTAAGGCTGTTGAAGCTGGTGTAGATGGAATAATTGTATCT
AACCATGGGGGTCGCCAGCTCGACTATTCCCCTGCTACAATAACTGTTTTAGAAGAGGTTGTTCAAGTTGTTAGAGGTA
GGATTCCGGTTTTGCTTGATGGAGGAGTAAGACGAGGGACAGATGTTTTCAAAGCCCTGGCACTTGGAGCACAAGCTGT
TCTTATAGGGAGGCCTATGATCTATGGGCTTGCAGCTAAGGGTGAAGATGGAGTGAAAAAAGTGATTGATATGTTAAAG
AATGAGTTTGAGATTACTATGGCTCTTTCTGGTTGTCCAACCATTGATGACATAACCAGAAACCATGTTAGGACAGAGA
ATGAGAGACTTCACTCTATGCTCTGATCCAAAAAAACCAACAGATATGGTTTGAGAAACTTAATCAGACAGCTGAAGAA
CCGTGGCAACCAGCAGCCATGTTAGAAGAACAAGGACTGAAGCATGGATTCAATTCAacACTCATCTTTTGAAAAGTAC
ATATGATAAACATATTGAATGCTTGTCTGACacaaTGAT > SEQ ID NO:134 6606
CCCACGCGTCCGAGCAAAGAGAAACAAACAATGGCGGCTTCTCTGCAATCAGCAAACCCTACATTGTCACGAACCCTAG
CTTCTCCGAACAAACCTTCCTCCTTCGCCACCTTCCGATCTCCATTTCTCAGATTCAATTCAACATCCGTCGCTTCCAA
TTTCAAACCCCTAGTTTCTCGAGAAGCATCCTCATCGTTCGTCACTCGCTCCGCCGCCGAGCCACAAGAAAGAAAAACC
TTCCATGGACTGTGCTATGTCGTCGGCGACAACATCGACACTGACCAAATCATTCCCGCGGAGTTTCTCACTCTCGTCC
CTTCGAATCCAGAGGAATACGAGAAACTCGGTTCTTACGCTTTAGTTGGTCTTCCAGCTTCTTACAAGGAACGATTCGT
TCAGCCAGGTGAGATGAAGACGAAGTACTCAATCATCATTGGCGGTGAAAACTTTGGATGTGGATCGTCACGTGAACAT
GCTCCGGTTTGTTTAGGAGCAGCGGGAGCTAAAGCAGTGGTGGCTCAGTCTTATGCTAGAATCTTTTTCAGGAACTCTG
TTGCTACTGGTGAGGTTTATCCTTTGGATTCTGAAGTTAGGGTTTGTGATGAGTGTACAACTGGTGATGTTGCGACTGT
TGAGTTGAGGGAAGGAGATAGTATTTTGATCAATCATACGACTGGGAAAGAGTATAAGCTTAAGCCGATTGGTGATGCT
GGACCAGTGATTGATGCTGGTGGTATATTTGCTTATGCTAGGAAAGCTGGAATGATTCCATCTGCTGCTGCTTGATTTT
GACTTCAGGTGTCAATGGAAGTGCATGAGAGTCACTTCAAGGATCTTGATCCAATAATAAGAATATGTAATGTTTCCAA
AAGCTTATGAACCTAATCTATGTTTTATGAATATATATGACTATCGGCTTTAGTCTTCAGTATCagtttcttgtttaca
tttggatgtatcagctgctaaaaaaatgcatagtttcccatcccatttgaaacgccgttttctct

FIG. 1 continued

> SEQ ID NO:135 6681
CCCACGCGTCCGCGATTTCAGCCAAGAGATGTCGGCATACGACAATGTTATTGGTGGGAAGCTAAAGCTAAAAGGGAAG
GCTTTGGATGTGAAAGCAGGTGGAGTAAAGAAGAAGAAGAAACATAAGAGACAGGAAGAACAAGCTCTTAAAATTACTG
ATCATGAACTCATAGAAGGAGAAAGCACTGAAGCATTGGGTAAATTGATTGAAGGAGAAGAAGGAGATGAAGAAATGAA
CAGGAGTGAAAAGGCAAGCGAGGATGCGAAGTTGCAGCAGCAGCTCGATGATGATGATCACTTAACGCCAGCAGAAAGG
CGATACATAGAGCAGAAACAAAGATTGGATGTGCAGAAGCTAGCTAAGGAAGCGAACAAGTCTCACCGTAACAGGATTG
AGGATTTCAATCAGTATCTGGCTAACATGAGTGAGCACTACGATATCCCTAAAGTCGGACCTGGTTAATATAATTCTTT
CTTGTCTTTGTTTTACTCTGCTTATCTATTTTGCATCGTTAAACGACTACTTTGGATGTCTGTTATGTTTAGTCCCTTT
AACTTTTGAATGATGTGATCGCAAATCTGTAATGTCAAAAACACATTTTCTTGG

> SEQ ID NO:136 6682
CCCACGCGTCCGGTCTTCTTCTTCTTCTGATAACTAGATTTTTCAATCTTCTGAAGCTTTAATTTTTTCATAGCCATGG
CTAATCGTTATGATCCAAATCCTTTCGCTGAGGAAGAAGAAGTCAATCCTTTCGCTAATGCTAGAGGAGTTCCACCTGC
GTCGAATTCGAGACTTTCGCCTTTGCCTCCAGAGCCTGTTGGTTTCGATTATGGTCGAACCGTAGACATTCCTCTTGAC
AGAGCTGGTACACAGGATTTGAAGAAGAAAGAGAAGGAACTCCAAGCCAAAGAAGCTGAGCTAAAACGACGAGAGCAGG
ACCTCAAACGGAAGAAGATGCTGCTGCACGAGCTGGAATCGTTATCGAAGTGAAAAACTGGCCGCCTTTCTTCCCGCT
TATCCACCATGATATTGCAAATGAAATTCCGGTTCATCTCCAAAGACTACAGTATGTTACCTTTGCAACGTATTTGGGG
TTGGTTCTTTGTCTTTTCTGGAATATCATCGCCGTTACTACAGCTTGGATCAAAGGAGAAGGAGTGACGATATGGCTTC
TTGCCTTAATTTACTTCATAGCGGGTGTTCCAGGAGGCTATGTGTTATGGTATCGACCACTCTACCGTGCCTTCAGAAC
TGATAGTGCATTGAGCTTTGGATGGTTTTCTTGTTCTATATGCTCCACATTGCTTTCTGCGTCTTTGCTGCAGTTGCT
CCACCTGTCGTCTTCAAAGGAAAATCTCTTGCTGGGATCTTACCTGCAATAGATGTCTTAAGCGGTCAAGCAATTGTTG
GGATATTCTACTTCATTGGGTTTGCATTTTTCtGCCTCGAATCAGTGGTTAGCATCTGGGTTATACAGCAAGTGTATAT
GTACTTCCGAGGCAGCGGGAAACAAGATCAAATGAGACGGGAAGCAGCGAGAGGAGCCTTGAGAGCCGCTGTTTGAGAG
TTCTCCTTGTAACATTCTGGTTTGTGTATGCACTGTTTCTTTTTTCAGATTTTCTTGAAGTCTCTCTCTCTCTCTCTCT
CTCTGCTCTATAAacaaaaaaaaaaagatttaattttttcctttgtacctttatgtcatgtaaatttgtttgttcaaaaa
tcagcgttcagatt > SEQ ID NO:137 6686
CCCACGCGTCCGAAAAAGCCTGCTTGATAGTATGACTGACATTGATCCATCAGTTTATGCCAACTTCTTTTGGGTCTCT
TCTCAGTACCATAAAGTCCGTCAAGAGTTCTCTGAGTTCTATAAAAATGCTCTTCTTTACCTCGCTTATCGTCTGTGG
ACTCACTCTCGGAATCATTTAAGCTGGATTTGGCTTTTGATTTGTCGCTTTCAGCTCTACTTGGGGAGAATATCTATAA
CTTTGGGGAACTGTTAGCCCATCCAATTTTGAAAAGTCTGCTTGGAACAAATGTGGAATGGCTTTACCACATTCTACAA
GCATTCAACCACGGAGATTTAGTTCAGTACCAAGAACTCTGTCGTGTGCACAATGCATCGTTGAGTGCTCAACCAGCAC
TGGTTGAGAATGAGAAGAAACTATTAGAGAAGATCAACATTCTCTGCCTTATTGAGATCATTTTCAGCCGACCTGCTGA
AGATAGGACCATACCTTTGAGTGTCATTGCCGAGCGTACTAAACTTTCAATCGAAGATGTTGAGCACCTTCTCATGAAG
AGCTTATCGGTGCACTTGATAGAGGGAATACTAGATCAGGTGAATGGAACAGTTTACGTCTCATGGGCGCAACCGAGGG
TGTTAGGAATACCGCAGATCAAGTCATTGAGGGATCAGCTAGACAGCTGGGTCGATAAGGTTCACACCACATTGTTATC
TGTTGAGGCCGAGACACCTGATCTTGTTGCAGCTTAAACTCTTCTTTCCTCTTTTTTCCTTCACTGTTCGTTTAAGCTA
CAGATTGTAACATTCTCTGAGGATTAAATGCAACTTCCTtttaagttttttaggtattacagttatacttttgaactttg
ttctccacagacacatgaatctatcctattaagttgagtt > SEQ ID NO:138 6717
CCCACGCGTCCGCATTTCTTGTTATTATCCACGAACGAAGAAAAACCTAGAAAACAGTTGAAGAAAGAAAATCACAAGA
GAAGCCATGGCCGGAATTGGACCGATTACTCAGGATTGGGAACCAGTTGTGATCCGCAAGAGAGCTCCTAACGCTGCAG
CTAAGCGCGACGAGAAGACTGTCAACGCCGCTCGTCGAAGCGGCGCCGATATTGAGACCGTTCGAAAATTCAATGCTGG
ATCGAACAAGGCTGCATCAAGCGGCACCTCCTTGAACACAAAGAAGCTAGATGATGATACTGAGAACTTATCTCATGAT
CGTGTGCCCACTGAATTGAAGAAAGCCATCATGCAAGCTAGAGGGAGAAGAAGCTGACTCAGTCCCAACTTGCCCATC
TGATCAATGAGAAGCCACAAGTGATCCAAGAATACGAGTCTGGGAAAGCAATTCCGAATCAACAGATCCTTTCAAAGCT
GGAGAGGGCACTTGGTGCTAAACTCCGTGGAAAGAAGTAGAAGTGTAGAACAAAGCTCTTAAAGGTAACAACAAAAGCT
GATCGCAGTTTCTCTCCAGTCCACATGCTTTACCATATCCTAAAAACTATATCTATGTATGGTTTGGTTTAATGGCGTA
GTAGTTTGTTGCGAGGAATCTTTCATGATGTAAGAAAAACAAAGCTGTTTGGAACCTTTTGTCATTATAAATAATCTCT
TCTCTTTCTtT

FIG. 1 continued

> SEQ ID NO:139 7393
CCCACGCGTCCGCGCAGCTTTTGCTTCTTCGATAGAAAATCTAATTATCATCAATCATGTCTAAGTTCACGGGATTCTC
ATCTCTCGCTATCTCTTATTTTCTCTTGGTTTCAACGATTGTTGCAGCCACCGATGTTCACTACTGCGATAATAACGAA
GAGTATGAAGTAAAAGTACAAGGAGTTGATATAACTCCTTATCCTATAGCTAGAGGCGAGCCAGCTACTTTCAGAATTT
CTGCTAACACAGACACTGAGATCTCGAGCGGCAAGTTGGTGATCGAAGTTTCCTACTTTGGATGGCATATTCATTCTGA
GACACATGATCTTTGTGATGAGACAAGTTGTCCTGTGGCCATTGGAGATTTCTTGGTAGCGCACTCGCAAGTTCTTCCC
GGATATACCCCTCCTGGTTCATACTCACTAAAAATGAAGATGCTTGATGGACGCAAGAAGGAGTTAACTTGCATCAAGT
TCTCATTTGATATTGGATTTGGATCCTCCGTGGCCGACATGTAGAGCTGATTTGCTCGACGGGATACACCATCTTGTTC
TATACCATGGAACCACTCTCATTTATTTTGTATAAAATACACTCTCCTGCTATACATAATTGTTGATCAAAAACCCTTT
GAAAATTCTCATTCTGGACCATTCATGAATCCCCCCATTtatagaaaaaacacagtaatgaat > SEQ ID NO:140 104081 Nicotiana benthamiana
AATTCACAGGGACATCAAGGCTTCAAACATTTTGTTGAGTGAGGAATATGAGCCACAGATATCAGATTTTGGGCTAGCA
AAATGGCTTCCATCACAATGGACCCATCATTCCATTGTTCCAATTGAAGGGACTTTTGGGCACTTAGCACCAGAATATT
TCATGCATGGAGTGGTTGATGAAAAGACAGATGTTTTTGCATTTGGGGTGTTCTGCTTGGAGCTCATTTCTGGGAAAAA
ACCAGTTGACAATTCCCATCAAAGCATACACAGCTGGGCAAAACCTCTTTTGAGCAGAGGAGTTATAGAAGAAGTAGTA
GATCCAAGGCTAGAAGGCAGATTTGATTCGACACAACTTCATAAACTTGCTTTTGCTGCTTCACTTTGCATTCGTGCTT
CTTCTATATGGCGCCCAACCATGAATGAGGTGAGAGCTTCAACAGATTATATACACACTGTGTGACAATTAATTTCATT
GAAATTAACTACAATGTTTTTTCTTTATCTACAACATTCTCGTTTCTCATCGACGTTCATGGCATTCATGAACTTGCAT
TTGATCCAGTCTCAAACTTCTTGATGCTTGGTATCTAGTTTTACAGTGTTCGCGAACATAGTTCTGAATTTATATGTGA
TTGCATG > SEQ ID NO:141 104711 Nicotiana benthamiana
CCCACGCGTCCGCTTCGATTGTGTTGGGAAGATGGAACTCAAGCAATGCAAGTCAACCGTCTCCCTCAAACTGAGGGTT
TCTTTCAGCCTCTAGGATTGACTTCTTCTCCTCAATTTGGATACAATCATGTGGGTACGGATGAGGTGAATGGAGGAGC
TTCAGCTCATAATATGAATGGGTTTATTCCAGGGTGGATGCTGTAAATCTGATAAATCAAGACAGCTGCTCCATCTTGC
TTCAACGAAATAAAATAATAGTATATTGCATTTTCTTTTTGTTTGTTGCAACTTGTATTTAGAAACTCTTTAAGTATTA
TTGGGCACGGACAATAATATGCATTCATAAGTTACTATAACATTTGAATGGTCCTGCTTGATTGGCCATTATGTATTTC
TGATTGTATTCCATGTAACTAAATTGAATTGTTGTATTATATTAGTTGTATCTTTGAATCATATAGATGTGTTGGCTTT
GTACGCCATAAATTTCAN > SEQ ID NO:142 105187 Contig A Nicotiana benthamiana
CTCTCTCTCTCTTTATCCGTCCTCCGGCGACCCTTTTACTGCGGTCAAACTCCGCCGGAAAATCTTAAATTCTTGTTTT
ATTGACGGCTTACTTGCTTGTACCTTCATCTCGCTTCACCGATCTTGCACTTCACATTAATCATCATGAATCCCGAATA
CGACTATCTTTTCAAGCTTTTGCTTATTGGAGATTCTGGTGTTGGCAAATCGTGTCTCCTCTTAAGATTTGCTGATGAC
TCATATCTTGAGAGTTACATTAGTACTATTGGTGTGGACTTTAAAATCCGCACAGTTGAGCAGGATGGGAAAACCATTA
AACTTCAAATTTGGGATACTGCTGGTCAAGAACGTTTTAGGACAATTACCAGCAGCTACTATCGCGGTGCTCACGGCAT
AATTGTTGTCTATGACGTAACTGATCAAGATAGTTTCAATAACGTCAAGCAATGGTTGAGTGAAATTGATCGATATGCA
AGTGATAATGTGAACAAACTTCTTGTCGGAAATAAGTGCGATCTCACAGCGCAAAAGGTAGTTTCCACAGAGACAGCTC
AGGCTTTTGCTGATGAGATCGGCATTCCTTTCATGGAAACTAGT > SEQ ID NO:143 105187 Contig B Nicotiana benthamiana
AACACTAAAATATTTAAACTTGCCCTTTAAATCATTTCGATGAAGGTCCAAAAAATAAAAAGCAATTACTATTTTTCCC
CAATTTTCCTAAATTTCCTACTAATCGTTTATCCAAATACTTGGCAAAAAATTGATTTTTTGGACAGAGTGCCGAAAAA
AATTAAAATGTGATAACAGGGAACAGTCTTCCTATCAACCCATTAAAAGAGACTATTTTTACTTGCCACATCAAAATCG
TCATTGGGGCGATAAAGCTTCGCCCTTGTCCTTTAAAAATGACCAGCAACCGCTCTTCTGGTTGACAGGTTGTCCGCGG
TTCTGCACAGTTGGAGGCCGGGCATTGTTGGATGCTGGTGGGCTTGCCATTCTGTCCTTGATGGAACCACCCATACCCA
TGAAAGCCTGTCCCACATGGGGGGCATTTTCCGCACTATTTCCCATGAAAGGAATGC > SEQ ID NO:144 107101 Nicotiana benthamiana
CGCTTTTGTCTGCCCCTCCTTACCCTTTCTTCAATATGGATGGTTCTCACTGGCCACAGGGCATAGGACTAGTGAAAGC
TGTGGAACCCTCAAAACCAGTGCCAGCAACAGAACGAAAGCCAAGACCACAAAAGGAACAAGCAATAAATTGTCCAAGA
TGCAATTCAACAAACACAAAATTCTGTTATTACAACAATTATAGCCTCTCTCAACCAAGGTATTTTTGCAAAACTTGTA
GAAGGTATTGGACTGAAGGTGGTTCTTTAAGAAATGTTCCTGTTGGTGGTGGTTCAAGAAAAAACAAAAGATCAAATTC

FIG. 1 continued

```
CTCTAATAATTCTTCATCCTCCACATCATCATATAAGAAAATTCCAGATATCACAATTCCAACTTCTTCTCAAAACCCT
AAAATAATAAACGAACCCCATGATCTCAATTTAACGTTTAACCCATCTACTACTAGCAATTTCAGTAATATTTCTGAGT
TTATGACCTTACCTTTAATGAACCCTAATTCCACAACTTCATTTATGTCCTCTATTATGCCACAGCTTTCGGATTCTAA
TAATATTATGTACTCATCATCTTCAACTAGGCTA

> SEQ ID NO:145 107642 Nicotiana benthamiana
ATTTATCAGATGATGGTTCACAAGCAGGAGAAAAGAAAAGAAGACTTAATATGGAACAAGTAAAAACTCTTGAGAAGAA
TTTTGAGTTAGGAAACAAACTTGAACCTGAGAGAAAAATGCAATTGGCTAGAGCTCTAGGCTTACAACCAAGGCAAATT
GCAATTTGGTTCCAAAATAGAAGAGCAAGATGGAAAACAAAGCAATTGGAGAAAGATTATGAAATTCTTAAAAGACAAT
TTGAAGCTATTAAAGCTGAAAATGATGCTCTCCAATCTCAGAACCAAAAACTTCATGCAGAGGTATGACACCAAAAAAA
TAATCAAAATGTAGTACTAATTATTTAATTATAAGCTTTTCTTGTTATGTAGGAAATAAAATAATGTTGCACTTTAATG
ATGTCTCTTTCTTTTTTGGTTGTTAAAAATTCAAGAAGATTATGCTATTTTGGTGAAATAGTAAACCTTTCTTCTCTG
CTAGTTGTATTTTCAGAACCATGATATGTATTTGGTGCATGATTTCGCCA > SEQ ID NO:146 108274 Nicotiana benthamiana
GAGGCCGTTAACAAGATGCGGGAGGTTGAGGGGAAGCTTTTATCTGTGGATACCTATTATTCAGGCGTTGCTTCAGAAG
CAGTCAAGAATGGAGTTCATCTTGTAAACGATGTATCTGGTGGACGGTTGGATTCCAACATGCACAGTGTCATTGCAGC
ACTTCGAGTACCCTTTATAGCAATGCATATGAGAGGTGATCCGTCTTCAATGCAAAATCCCAAGAACTTGCAGTACAAC
GATGTCTATAAGGATGTGGCATTTGAACTTTATGAGAGGCTCAAGGAAGCAGAGTTAGCCGGTATCCCTGCTTGGAGGC
TAATACTTGATCGGAATCGGATTCTCCAAAAATACTGAACACAATTTGGATATTCTAACGGGTTTGCCAACAATTCG
AAGTGAGATTGCAAGGAGGAACTTGGCGTTGTCTCGTGCACCTTTCTTGATTGGACCGTCCAGAAAGAGATTCCTAGGC
GAAGTCTGTGCTCGCCCTGCTGCAGATGAACGAGATCCAGCAACTGTTGCAGCTGTGAC > SEQ ID NO:147 109024 Nicotiana benthamiana
TCTCTTTCTTTTCCCTTCTACAGTCTGAAGGGTCAATTATTGCTCATAGAGAAGAACTGTTGAACAGACTTTTGGAACC
AAAAAAAGAAAAAAAAATCACTCTTTGAGGTTGTTGCTTTTTTAACCGTTAATTCGGGGTTGCCAAGATGATGATGTTT
GAAGAAATGGGGTTCTGTGGCGATCTTGATTTCTTCCCTGCTCCGCTAAAGGAAGTGGAAACAGCTGCTTCGCAGATCG
AGCAGGAGCAGGAGCCGGTGATGGATGATGATTATAGCGATGAGGAGATTGATGTGGATGAGCTGGAGAGGAGAATGTG
GAGGGACAAGATGAAGCTGAAAAGGCTGAAAGAAATGACTAAGGGGGGTAAGGAAGGTGTCGACGCTGTCAAACAACGC
CAATCTCAGGAGCAAGCTAGGAGGAAGAAGATGTCGAGGGCACAAGACGGGATCTTGAAGTACATGTTGAAGATGATGG
AGGTGTGTAAAGCTCAGGGCTTTGTTTATGGGATTATCCCGGAGAAAGGGAAACCGGTTACCGGGGCATCGGATAATCT
CAGGGAGTGGTGGAAGGATAAAGTGAGGTTTGATCGAAATGGACCTGCAGCCATAGCAAAGTACCAAGCTGAT > SEQ ID NO:148 109138 Nicotiana benthamiana
TGAGATTCATTTTAGCACATCTTGGATTGAAGTTGAAATGAGGAATATACTTGAGGCTCTTCAAAGTTCTGCTCAAATA
TTCCATCACTAAGACAAATAAGTATGGGACATAGGGTCACCTTGTCTCAATCCCTTTTTTGCTTGAAATCCTTTTGTG
AGTCCCCCATTGATCAGTATAGAGTAGTTTGCATTTGTTATACATTCCATAATTCACTGAACTAGCTTTATAGGGATCC
CATACTCCAACAACACCATTTGTAAGAAAGACCATTCAACACAATCATATGCCTTTCTTATATCTACTTTGATAATGCA
TCTAGGTGAAATCCCTTTTTTACTATGCCCTTTCACCAATTCATGAGCAAGGATAACATTGTCTAGTATACTTTTTGTA
ACACTCCTTAAATTTATAAAGTTTCAAGATACGTTGATTATAAAAATAAATTATTTTTATTTTTGCCTATAGTGATAT
ATATACATACACACACAAAAATAGGAAAATATTAATAATTTTAATATTATTAATGGTTAACAGTAAGTATAATAAG
ATATTAGTTAACAAAAGA > SEQ ID NO:149 109146 Nicotiana benthamiana
ATTCTCCTCAAATCAAACATGGCTCTTCCAGGTCAGCAAGGCGTGGATTATCCCAGTTTTAAACTTGTTATTGTTGGCG
ATGGTGGAACTGGAAAAACTACATTTGTGAAGAGGCATCTTACTGGTGAATTCGAAAAGAAATATGAACCTACCATTGG
AGTGGAGGTGCATCCATTGGATTTCTTCACAAACTGTGGGAAGATTAGGTTTTACTGCTGGGACACTGCTGGTCAAGAG
AAATTTGGTGGCCTTAGGGATGGATACTACATTCATGGTCAATGTGCTATCATCATGTTTGATGTGACAGCCCGATTGA
CATACAAAAATGTCCCCACATGGCATAGGGATCTTTGCCGTGTCTGTGAAAATATTCCCATTGTTCTTTGCGGAAACAA
GGTTGATGTGAAGAACCGTCAAGTTAAGGCTAAGCAGGTTACTTTCCACCGGAAGAAGAATCTGCAATACTATGAGATA
TCAGCAAAGAGTAACTACAACTTTGAAGAGCCTTTCCTTTACCTTGCCAGGAAACTTGCCGGGGATCCTAACTTGCACT
TTGTGGAGTCTCCTGCCCTCGCTCCCCCTGAAGTACAGATCGACTTGGCTGCACAACAACAACATG
```

FIG. 1 continued

> SEQ ID NO:150 109175 Nicotiana benthamiana
TTTGAGATGAAGGACATAAAAAGTGCGGACTCCAACTGTCGAGGTGCCAATGCTGCCGAGGGATCATCAATTGCACGGG
TGAACATGGTGCAGCCAACATGCAGCAATGCAGAATTTGCAGATTCTGGGATGAGCTGCAAGACGGATTCTATCCTTTA
CTTTGCTAGACAATCTAGCCTTTCATTTTCCAACCAAAGTGGAGAGAGCACCGCTGGGGATCACCAAGACTGTGGAGTC
TCCCCAATGCTCCTAATGGGAGAGCCGCCACCGTGGGGTCCTCCTTGCCCTGAACCTTCGTCGCCATCGACTAGTAGGA
GCAATGCTGTGTTGCGCTACAAGGAAAAGAAGAAAACAAGGAAATTTGACAAGCGAGTGAGATATGTTTCCCGCAAGGC
AAGAGCTGATGTCAGAAGGCGTGTGAAGGGACGGTTTGTCAAGGCTGGTGATGCTTATGACTATGATCCACTCCCGACC
AGAAGCTATTGATTGTAAACTTTCTTATCATACATGTAAAGAAACAAATTATCCGTATTAAATTGAGACCAAACATTTG
AGGTTTCTTTCAAATAGATGAAAGAAATGAGATATTTGTTGTTGCGAATGATAAATGGTATGATTATGTCTC > SEQ ID NO:151 109369 Nicotiana benthamiana
TCATCTTAAAAAAACTAACACAACCAAGAAAGAAAAAAACGTGCTAATGGAAGATCCTCAAGAAAAAAGCAATATTCAT
ATGTATAGAGGAGTAAGGAAGAGAAAATGGGGGAAATGGGTGTCGGAGATACGCGAACCGGGGAAGAAAACACGAATAT
GGCTAGGGAGTTATGAGACACCGGAGATGGCTGCTGCAGCCTATGATGTTGCTGCATTTCATCTAAAAGGCGAGAGAGC
AAGACTCAATTTCCCCGAATTAATCCATAGTTTTCCAAAACCCTCAAGTTCTAAGCCTGAAGATGTGCAAATGTCAGCT
CATGAAGCAGCAATGAGGTTCAAAAGACAAACTCCAGAGCCACCCGAGGGGGGTGGCTGTGGCGGTGGTGGCACGGTGG
TTCCGGTGAGGGTAGGTCTATCGTCGAGTCAAATTCAGGCGATTAATGAGTCGCCATTGGACTCACCTAAAATGTGGAT
GGAGCTAGCTGGGGCATTGTTATTACGAGATCCAGTTAGAGAATACACTTGTCCCTCGTATTCTTTTACCGATCCTATG
GTATTGTGTGAAGACATTGCTGAGGTTGGGGAGTGGGATGAAATGCAACAGAATCATGATTCCATTTGGA > SEQ ID NO:152 109391 Nicotiana benthamiana
CTAACCTTGGCCTCACTTATCCCATTGTTCCAAGGAATTAGGGCTGAGTCTAAATCTGGTGGGATTATGAGTGCTGATG
CCGAAATTTGGAATGGAAGATTTGCCATGCTGGGATTAGTTGCTTTAGCGTTTACTGAATATGTTAAAGGAGGTGGCAT
CTTCCAAGTCTGAAATGTAACTTTTATACTAGTACGTTCTTTTATATCTGATGTAAACAATGTTATATTGCCATGTAAC
CACAGCTTATAATTTCAATTATAACTTATATGATAT > SEQ ID NO:153 110764 Nicotiana benthamiana
CCCACGCGTCCGGCGCTCTCTTGCTTCTATTGATGGGATTATTCATATCAGGCACAACAAGAAGTACCACAGGCTCTAG
CAACTATGTCTCTCACTGATCAACATGATAATCATCTCTACATGGACTCTGGTGCTACTTATCACATGGTGCAATCTTC
TGGTACTCTTGTGAATTCATCTCCATTTGAAGGAACTAATCTTGTTATGGTAGGTAATGGTGATAAAATGTTGATTACA
CATATAGGAGATAAGATTATTGGGAAGAACCTACATTTAAAATATTTCTTTGTTGTGCCTAAACTCAAGAAGAATCTCA
TTTCTGTC > SEQ ID NO:154 111139 Nicotiana benthamiana
CAAAAATGGGGAGAGCTCCTTGTTGTGATAAAGCTAATGTGGGGAGAGGACCATGGTCACCAGAAGAAGATGCTAAGCT
TAAGGAATTCATACAAAAATATGGCACTGGTGGTAATTGGATTGCTCTTCCTCAAAAAGCTGGATTAAGAAGATGTGGA
AAGAGCTGTACATTGAGATGGCTGAATTATCTAAGGCCTACTATCAAACATGGTGATTTTTCTGATGAGGAAGATAGAG
TTATATGCCGCTTGTATGCCAGCATTGGAAGCACGTGGT > SEQ ID NO:155 111230 Nicotiana benthamiana
AATACCTCAAACTGAGACAACATCCAATCCTACTCTTCTACTACTACTACTTTTACTCTCTTAAGTATATCAGTG
ATCAAGAATAATGGATATATTTAGAAGCTATTACTCGGACCCACTTGCTGAATGTTCATCAATTTCTGACAATGGTGGC
AGCTCCTGTAATAGAGCTAACCTTTTTGATGAGGAAGTTATATTAGCTTCGAATAACCCCAAGAGGCGCGCAGGGAGAA
AGAAGTTTCGAGAAACTCGACACCCAGTATACAGGGGAGTGAGGAAGAGGAATTCAGACAAGTGGGTTTGTGAAGTGAG
AGAACCAAACAAGAAATCAAGAATATGGCTGGGCACTTTCCCTTCAGCAGAAATGGCGGCTAGAGCTCATGACGTGGCG
GCTATTGCATTAAAGGGCCGTTCTGCTTGCTTGAACTTCGCTGACTCTGCTTGGAAGTTGCCGATTCCTGCTTCCACCG
ACGCCAAGGATATTCAGAAAGCGGCGGCTGAGGCCGCGGAGGCATTCCGATCATCGGAGGCCGAAAACATGCCGGAATA
CTCAGGAGAAGATACGAAGGAAGTGAACAGTACTCCTGAAAATATGTTTTATATGGATGAGGAAGCGCTATTTTGCATG
CCGGGATTACTAGCGAATAT

FIG. 1 continued

> SEQ ID NO:156 111312 Nicotiana benthamiana
CAAAAACAACCAGCCCCATTTTCTTCTTCACTCTGCTTCTCCTTACTTTCACTCCAACCCCATCTTTCTCCATTGAAAA
TGATATCAAATGTCTTGAAGGAATCAAATCTGCACTTTCTGACCCTTTCAATAAGCTCTCATCTTGGTCTTTTTCAAAC
ACATCTGTTGCTGCTTCAATTTGCAAACTTGTTGGTGTTTCTTGTTGGAATGAGAAAGAAAACCGGCTCATTTCTCTTC
AGCTCCCTTCTATGTCTCTCTCCGGTTCTCTACCTCCTTCTCTTCAGTATTGTACCTCTCTTCAATCCCTTGATCTCTC
TGGTAACTCCCTTTCCGGTTCACTCCCGGTTCAACTCTGTTCTTGGTTGCCTTATCTTGTTAATCTTGATTTATCTGGT
AACTCTTTCTCTGGTTCCATACCTCCTGAGTTTATTTACTGCAAATTCTTGAATACCCTTTTGCTAAATGACAATAAAC
TTACTGGTTCGATCCCTTTTGAGATTGGCCGGCTTGACCGGTTGAAACGGTTCAGTGTGTCAAACAATGGTCTTACAGG
TCCGGTTCCTGATGATTTAGACCGGTTCTTGAAAGATGATTTTGAAGGGAATAATGGGCTTTGTGGGGAACCACTTGGA
TCTAAA > SEQ ID NO:157 111758 Nicotiana benthamiana
CCCACGCGTCCGGCCAAAACTAGTATCCCACCTACTATATTTGTATAATATGGAAGTTGCCAAAGTTCTTCACCTGAAT
GAAGGAATTGGAAAGGCTAGCTATGCCAAAAATTCTCTGTTTCAGCAAAAGGTGATCCTAATGACAAAGTCAATAAGAG
ATGAAGCCATATATGCACTATACCGCAGCCTTTCCCCAGAAGCCATTTGTATTGCAGACTTAGGATGTTCCTCTGGACC
TAATACTTTCCTTACTATTTCCGAACTCATTAAAACTATTTATGAAGAAAGCAAAATCAATGGCAAAAAACAGTCGCCG
GAATTCCAAGTTTTCTTGAATGATCTTCCCGGAAATGATTTCAATACCATTTTCCGGTCGTTGCCAGAGTTCTACGAAG
ATTTGAGGAAACATATGGGAGATGGATTTGGTACAAATTGCTTTGTTGCAGGAGTTGCTGGTTCATTTTATAATAGACT
TTTCCCTTCCAACAGTGTGCACTTTGTCCACTCCTCATACAGTCTCCACTGGCTTTCTCGAGTACCTCATGGAATAGAG
AATAACAAAGGAAATATTCACGTGGCAAGTACAAGCCCACAAGATGTGGTTGAAGCATACTACGAGCAATATGAAAGAG
ATTTTGTGAATTT > SEQ ID NO:158 112381 Nicotiana benthamiana
CCCACGCGTCCGAGAGAGGGTGCCTTTTTTGTTTGTTTAATCGGAATAACAAAGCAGGTTAGATATAAAAAGGCAGAAG
AGCTTTGTTGATAAAAGTATTTTTTTTCATCTGCCATATTTCTAACTCTGATTAGTTATTGAGATTGAGGATTTTCAGG
CTTCTGTAAATAATAATAAGGAGAAAAAAATTAAATAAAAGATAAAAATGGCATTCACAGGAACTTTGGATAAATGCTC
AGCTTGTGACAAGACTGTTTACTTTGTTGATTTGTTGTCTGCGGATGGTGTTACTTATCATAAATCCTGCTTCAAATGT
AGCCATTGCAAAGGCACTCTTGTGATGAGCAACTACTCTTCCATGGAAGGAGTCCTCTACTGCAAGACTCATTTCGAAC
AGCTTTTTAAGGAATCTGGAAACTTTACCAAGAATTTTCAGAATTCTAAGGCTGAGAGGCAAAATTCACTGACAAGGGC
TCCAAGCAAACTATCTGCTATGTTCTCTGGAACCCAAGATAAATGTGCTGCTTGCGACAAAACTGTTTATCCACTTGAA
AAGGTGACAATGGAAGGAGAATCATTCCACAAGTCATGTTTCAAGTGTGCACATGGAGGGTGTCCACTTACCCATGCAA
CATATGCTTCCCTTGATGGAAATCTC > SEQ ID NO:159 112417 Nicotiana benthamiana
AAAAAAACCCTTTTGGGTATGCCGTATGCAGGTGTAAAGTTTTAGCCAAACCCATTCTTGATTTTCCTTTTTTTCATTT
GGTGTCATCCATTTTCCTTTCTAAGCCCCTTTCAAGATTCCTCGTCTTATAATTCCAGGTTTTCAATTCTGGACAGGTG
AATCAATGGATGCGTTGCGTTCAACTAATATGAATTCTGACCCTGGTGATTTTGAATGCAATATCTGCTTTGAGTTAGC
TCAAGATCCAATTGTCACTCTTTGTGGCCACCTTTATTGTTGGCCATGTCTTTACGAATGGTTGCAAGTTCATTCACAT
TCCCACGAGTGCCCAGTATGTAAGGCTCTCGTAGAAGAGCACAAGTTGGTTCCGATATATGGACGAGGCAAATCAAGTT
CTGACCCAAGATCTCGGTTAGTACCTGGGATCAATATACCTAAGCGTCCAATGGGACAGAGACCTCAAACTGCTCCAGC
TGTAGATATGGACTATCTCCGACATGATGAATTGGATCCAATAGGGGCGTTCAGGCCCGTGCCCATGCCCATGCCAAGT
GCAAGGTTTGGAAACTCGATGTTATCTGATCTTTTTGGAGCTATTCCAGCTTTTTTTAACCTTCATGTACATGGATTTC
ATGATG > SEQ ID NO:160 113024 Nicotiana benthamiana
TAGAGAGATGGATAATCTTGGGGGAGGAAATGGTAAGGGAGGATTTCATGGCTACCGCAGATTCCCTCAACCAACCCCT
GCTACGGACATGAGCATGGGACTATCTGCTCATCTCAACCAGGCCATTGCTGCCAATACAAACAATAATGGCACCAACA
ACTCAGAACAAGATTCTGAGTGCACCATTCGGGAGCAAGACCGATTCATGCCAATAGCAAACGTGATCAGAATCATGCG
CAGAATCCTTCCTCCGCATGCCAAGATATCGGATGACTCCAAAGAGACCATCCAAGAATGTGTGTCTGAGTTCATAAGC
TTCATCACGGGCGAAGCCAACGAGCGTTGCCAGCGTGAGCAGCGGAAGACCATCACTGCTGAGGACGTTCTTTGGGCCA
TGAGCAAGCTTGTTTTGATGACTACATTGAACCCTTGACTTTGTACTTGCATCGTTATCGTGAGTTTGATGGTGGTGA
ACGTGGATCTTTGAGAGGGGAGCCTTTGCTGATGAAGCGGCCGATGATGGATCCTGCTTCAGCTAGCATGACGACCATG
GCGCCCTATCAGCTGCCTCCTTTTCAAATTGCTCATCACCATGGATACTTTGCGTATCCACCACCAATGGGCAAC

FIG. 1 continued

> SEQ ID NO:161 113124 Nicotiana benthamiana
AATTATCTCTCCGTTTCTCTATTTTAACCTTACCCTAAGGTTACCTTATGGCCACAGTTGCCGAGTTTGAATTTCCCCA
ACTCGTCAACGACCTTCAAGATCTATCCATTGAACCTCAGAACAAAATGAAGAGCACAGCTGAGGGAACACACCGAGTT
GGGTGCGAGAATAACCATCATGGGATTTGTGCTATTTGCTTGAATAAGATAGTGCTTGAAGAAACTGCCCTGGTAAAAG
GTTGCGAGCATGCGTACTGCGTGACTTGTATCCTTCGGTGGGCAACCTATAAAAAGGAACCAACATGCCCTCAGTGTAA
GCATCCATTTGAGTTTGTCTACATCCATCGTGCACTTGATGGAAGCCTTCAGGACTACATGTTTGAGGAGAGCGTTTGC
CTTCTCCTCAGGGCTTCATGGTTTAAACCTTTGATTGTGGAGGAAAGGGCAGAGGTGGATGATGATATGGATGACTTAT
ACATGTATGATTATGAAGAAGAAGAAGATTTAGCAGAAGATTATTTAGTTAGTAGTTCATCTAGACTCCGTTTAGGCAA
TAGACGATGGGGTGATAATGGATATGTTAGTGCAGGAAGGCAAGAAGCAAGGCCTGTTTATCGACCTAACTCTCAGGAA
TCTGGGGCTGGTCCCTCTCGCGAGCC > SEQ ID NO:162 113183 Nicotiana benthamiana
CCCACGCGTCCGGGAATATTAGAAGGCATATACAAGGCTGGTCTCTTGAGGGTCCTATCCCTCCTGCTATATCTTTCCT
TAAGCTTAATTGATTTAAGAATCAGTGACCTAAAAAGTGGACAATCTGGTTTTCCACCATTAGATAATCTAGAATCCAT
GAAAGTACTAATTCTAAGGAAGTGCTTAATTCATGGTGAGATTCCTGAATATATAGGGGACATGAAGAAATTGAAGACA
TTGGACCTTAGTTTTAACAGCTTGTCTGGTGAGATCCCGTTATCTTTTGCAGAACTATCCAAAGTAGATTTTATGTATT
TGACAGGAAACAAACTTACTGGACCTGTTCCTGGGTGGATTTTATCAAGAAATAAGAATGTAGATGTTTCGTATAACAA
TTTTACACGGGAAACCACAGCACCTATTGAATGCCCGCGTGGAAGTGTAAACTTGGTGGAGAGCTATTCTGCGTTGGGA
CAAGAATCAAACAAAGTTCATCCTTGCCTGAAGCATGATTTCCCTTGTTCGGAACCAACAAATAAGCAACAGT > SEQ ID NO:163 113742 Nicotiana benthamiana
CCCTAGTACGAGAGGATTAGCACCCATGGCTTCATCAAACTGTGTCAATTTCACCATGTTTCTTTCTATATCAGTCTTGT
TTGTTAATGTTCTGCCAGTGAATTCAACATCAAGGCATGCTCTGATCAACAACCATAAGGGATTCAAGGTGAGTCTAAA
ACATGTTGACTCAGGTGGGAATTTCACCAAATTCGAGCGTTTACAACGCGCGATGGCACGAGGGAAATCAAGACTTCAA
AGGTTAAACCTAATGGCTAATAATTTGGTAGCAACAACAGCCATAGATGACTCTGACATTGTAAAGTCTACAATCCATG
CAGGAAATGGTGAGTTTCTCATGCAAATATCCATTGGTAGTCCAAATGAAACCTATAATGTTATAATGGATACAGGAAG
TGACTTAATTTGGACTCAATGCAAGCCTTGTAAAGAGTGTTTTGATCAATCCACACCTATTTTTGATCCATCAAAATCA
TCCACTTTTTCCAAGATTTCATGTTCTAACAAACTTTGTGAAGCATTGCCAATGTCATCTTGTGGGGATAATAATTGTG
AATATATGTACACATATGGTGATTATTCATCAAGTGAAGGTTTTTAGCTAGTGAAACATTCAGTTTTGGCAAAA > SEQ ID NO:164 114161 Nicotiana benthamiana
CTTGTCTCTCAATCTGACCCTTTTGGCCAATTGAAATCTGCATCTGTGGAACACACTGAGTTGCCAAAGGGGAATGCAA
CTGAGTTCACTATTTTCTCTGTATCTCCTTCAGGTGATTGGAAATCTTCAGGATATGGGCAAAACCAATCAAACATTCA
GGCTGCTGCTACCTCAGTTAATATGGACTATCGAAGTCACTTTGAGCTAGGGTTTAGTCAGTCCCTGATTTCTGCAAAA
TATCCTTACGGAGGACAGCAATCCGTCGGGTTATTTTCAGCTTATGGTCCTCAAATTTCGGGCCGTGTTATGCTGCCAT
TGAATTTGGCCTCTGATGAAGGCCCGATATTCGTAAACGCCAAGCAGTATCATGGGATACTGAGGCGTCGAAAGTCCCG
GGCTAAGGAAATGGAGAAGAAAGCTCTTAAACCACGCAAGCCATACTTGCACCTCTCTCGCCATCTCCATGCAATGCGC
CGACCTAGGGGCTGTGGTGGACGCTTCTTGAACACAAGGAAAATGAATGGAACTATGAAGGGTGGAAAAACCAACGATA
CAGTTAAGACTGGTGATGTTCACAGTTTTTACCCAACTGGATCCCAGAATTCTGAAGTGCTGCAGTCTGATAGTAGCAA
TTT > SEQ ID NO:165 114865 Nicotiana benthamiana
CAGAAGAGCAACATTTGAACAAGTATGGAAAAGGAAAACAAACTAAAATCAGAGACTTCATTGGAAAATCCGATGTTTT
CACAACAGATTCAAACTGAAAAGGATTCTTTAGGTTTTTTAGACAACATGTTTGGTGCTCATCTTCTTGATTTCAATAC
TACTATTCCTTCCATTTTCGATTTGCTTCAAACTTCACCACCTCAATCACTGACTAATATTCCATCTCCAACTTCCACA
TTTCAAGAATCATGTGAGGTGGAGGTGGTGAATTCACTGTCGATCTCTTCATCATCAACTGAAGCTGCCGAAGATGATC
AGCAGAGTAATACAGTAAAGCAACAAGATGAAGATGAAGACAAGTATAAGAAACAGTTAAAACCTAAAAGAAGAATGT
TCAAAAGAGGCAAAGAGAGCCAAGATTTGCATTCATGACCAAGAGCGAAATTGATCATTTGGATGATGGTTTTAGATGG
AGGAAATATGGCCAAAAAGCAGTGAAAAACAGCCCCTTCCAAGGTATATATGTTTAAAATATGACACATTTTTATATT
TGATAATTCATTACGAAGGGAGTACAATTAAAATGTCTCTAGGTTAATTCTTCTACCGGTTAAACTAATAAAACACGCT
GGTGGATGCATATCATTTATAATATGTACATACTGTACTCATGTATAATTAATATATAATCTATATATACCGAT

FIG. 1 continued

> SEQ ID NO:166 114926 Nicotiana benthamiana
CGAGTAGCCGCATACAGGCAGTTGAAGAATAGAGTTTCTTGGATAAGTTCATTCAATTCTACCAGATCAAATCATACTT
TGCCCTTTGCTACGTTAAAAGCTGAAGAAATATCAGGCTCTCAACCTGCTGAAGTCCACAACTTGGTGCAGGGGAAGTG
GACAGGATCTTCTAGTTGGAATGCAATATTGGATCCCTTGAATGGGCAACCATTCATTAAAGTTGCAGAAGTAGATGAA
TCAGAATTGCAGCCATTTGTGGAGAGCTTGTCCAAGTGCCCGAAACATGGTCTACATAATCCATTCAAAGCACCAGAAA
GGTACCTAATGCTTGGAGACGTATCTACAAAAGCAGCTCATATGCTTGGCTTGCCTGAGGGTTCTGACTTCTTTGCTAA
GCTAATACAACGGGTGTCTCCTAAGAGTTACCAACAAGCTCATGGTGAAGTTTTTGTCACGCAGAAATTTCTGGAAAAT
TTCTGTGGTGATCAGGTTCGCTTTCTAGCTAGGTCTTTTGCAGTACCAGGAAATCATCTGGGCAGCAGAGCCATGGGT
TTCGC > SEQ ID NO:167 115121 Nicotiana benthamiana
TTTCTGTCAAAACCTAACCAGCACTTCTTCCCCCGGGGCACCGAACCTTCGGCCGTCCGGCAGAGAACGTCACCTCAAA
TGGAGTTCGATGAGTACGATTATCTGGAGAAGACTGTAGAAGAGCCCAACGGTGGTCCTTCTACAAAGAGCAAAGACAA
CAACAACAACAGCAGCGCTGAGAAGGAGAAGAGCGAGAAAGCCTATCGCCGGAGGGAGAGAGACGGGAGCGAGGAATAC
GCTGCCGAAGACGACAATAGAGATCGCCGGAGCAGCAAAAGGTCTCGCGGCGACGGCGAAAAGGATAAGGATAGAGATA
AAGATAGAGATAGGGAAAGGGAAAGATCTTCGAGGCATCGGAGCAGGGAGCGAGAATCGGAGAGAGACAGAGAGAGAAG
CTCAAAGGACCGAGACCGAGAACGTGACAGAGAGAAGAGGGAGAAGGAGAAAGAGAGGGAGAAGGAGAAGGAACGAGAG
AGGGAGAGGAAGAGTAGAGATCGGGATAGGGAGAGAGATAAGGAACGGGAGAAGGAGAAGGATAGAGAGAGGGAGAGGT
CAAGGAGGAGCCGGAGTCGCTCCAGGATTGAACGAGAGCGAGAGCGAG > SEQ ID NO:168 116435 Oryza sativa
CCCACGCGTCCGCAGGAAGCTGAAGACCACCTTCAAGGCATCTAGGCCGAACTTGTTCATGTGATCTACCAGTGTGTAC
CCATGTTCTGCAATTTAGCCCAAGAATCAAAAGATTTTGTCTGTGGAAGTTTTGGTGCCCTGCTGGTTAGGCATTTCCA
GTTTCATATCCAAATGATGCTTAGGCATTTCCAGTTACCCTTCCAAATGATGCTTTGCAAACCCTTGAATTTCCTCGTA
TT > SEQ ID NO:169 116461 Oryza sativa
TCTAGATCGCGAGCGCCCCAATCCCACCACCGATCGATCCATTCCTGCTGCTCGCGGCCACCGGAGAAGGAGAGAGAGA
GAGCTCGACCTCGTCGGCGGGTGAAGGATCGCAGCAGCAGCAGCGGCGGTAGAGCAGGAGGAGAGGCGAAGATGTCGTC
GGTGTTCAGCGGCGATGAGACCGCCCCCTTCTTCGGCTTCCTCGGCGCCGCCTCCGCCCTCGTCTTCTCATGCATGGGG
GCGGCGTACGGGACGGCGAAGAGCGGCGTCGGGTGGCGTCGATGGGGGTGATGCGCCCGGAGCTCGTGATGAAGTCCA
TCGTGCCCGTGGTCATGGCTGGTGTGCTGGGTATCTACGGCCTCATCATCGCAGTCATCATCAGCACGGGGATCAACCC
CAAGGCCAAGCCCTACTACCTCTTCGACGGCTACGCGCACCTCTCATCTGGCCTCGCCTGTGGTCTCGCCGGTCTCGCT
GCCGGAATGGCCATTGGCATCGTTGGTGACGCCGGAGTCAGGGCGAACGCCCAGCAACCAAAGCTGTTCGTGGGTATGA
TCCTCATCCTCATTTTTGCCGAAGCGCTTGCTCTCTATGGGCTCATCGTCGGCATCATTCTGTCATCCCGCGCTGGCCA
ATCTCGTGCGGATTAGGCATGTTTCAACACGCAAACCCTTAGTGGGTTCTTGTTTCATATTCCTGAAACTACAAGCTGA
GCtctAGGGGTTTATTcTgtctTAGTTTCTGTTcTtCTGTTGGGTCATGAACAAAAAAACATCTGTATCCAAGGGATGT
TTGCCCTTGTGGTGCCATTCTTTTTCGCTATGGTGGTGCTGGCGGCGGTCTGAatctTATTTATGCACAGTTTTTTgg
gtctggctagacagtgatgtaatctggtgaataagcaaatcattcgtaatgcaatgggagcataagactcttttgttc > SEQ ID NO:170 116519 Oryza sativa
CGCCTCCTCGGCTCCAATCCCCCACTCAATCTTTCCCTCGACGGCGGAACGCCGCGCCGGCCGTTGCTCCGTCGCCAGC
GCCGGTGGTCCGGTGACCACATCCCAGCCGGAACGAGATTTACATTGCAAGCAGAGGTTGGCGCCTAAGGCATCACAAA
GGTCGACGGCCATGAGGCCTCCCCACCGTCAGAGATTGCGCCAGGCACCACGCCGGCGGGTAAGCTCGCCGGCGTCCTC
CACCTCGTCGTGCTCGCCTCCTAAACCGCCGCCGCGCTACAGCCTGCGTTCGACTCCTGCTCGTCGTCTCCACCGCGCT
ACTACGGAATTGCAGGACGCGAAGGAGCAAGTGGTTGACAGCCTTGAACCGAAGAAGAAGAAGAAGAGATCATTCATCG
AATACCACATCGGTCGCATATCCAACATAATTCAACAATCAATCAACAGAATTCAGAGAGAGCGAGATGAGAGACTTCA
AATGCTGAAGACCTTAAGGGAGGACGGGTTGACGCGAACTCGGACGCAGTATCATCTTGCCAAAGAGCTACTAAGGTCA
CGAACACGCCGCACCGTCTTCAAGAGATTCGATTCGAAGGAAACTCGACTGAAGTGGCTGCAGTGGTCGTGGCAGAACC
GAAAAGCAATTACGGCCTCGTCATCATCGTCAGAAGATGAGTCAGAGGATGATCTGTTGTTCAGTAGTTGATCAGCATG
TGATGAGTAGCAAATGTATCAAAGCTTAACAGTCCGATCGGATCAGGTGGCTTGCACGATGGCACAAAAATGCTAG

FIG. 1 continued

> SEQ ID NO:171 116525 *Oryza sativa*
CTCGAATCGAATCCACCACACGGTACCCTCCTCTCTCCTCCTCCGACCACCATGGCCATGGCCACGCAAGCCTCCGCCG
CCAAGTGCCACCTCCTCGCCGCCTGGGCACCGGCGAAGCCGCGCTCATCCACCCTCTCCATGCCCACCTCGAGGGCACC
CACCTCCCTCAGAGCGGCGGCGGAGGATCAGCCCGCCGCGGCGGCGACGGAGGAGAAGAAGCCAGCCCCCGCGGGGTTC
GTGCCGCCGCAGCTGGACCCCAACACGCCGTCCCCGATCTTCGGCGGGAGCACGGGGGGACTCCTCCGGAAGGCGCAGG
TGGAGGAGTTCTACGTCATCACATGGACGTCGCCCAAGGAGCAGGTGTTCGAGATGCCCACGGGCGGCGCCGCCATCAT
GCGCGAGGGCCCCAACCTGCTGAAGCTGGCCAGGAAGGAGCAGTGCCTGGCCCTGGGCACCAGGCTCCGCTCCAAGTAC
AAGATCAACTACCAGTTCTACCGCGTCTTCCCCAATGGCGAGGTGCAGTACCTCCACCCCAAGGACGGCGTCTACCCGG
AGAAGGTCAACGCCGGCAGGCAGGGCGTCG > SEQ ID NO:172 116686 *Oryza sativa*
CACCGCCTGCCGCCGAGAGCTCTCTCAGCCGTCGCCATGGGCACCGCTACCAACGGCAACGCCTCCGCCGCCGCCGCCG
CCGCTGACTCCGCCGTCAAGGAGCCCCCGCACAAGATCGCCAAGGTTGCTCCCTTGCTCAAGGTCAAGAAGCTCTCCGA
GAACGCCGTCCTGCCGTCCCGCGGCTCCGCCCTCGCCGCCGGCTACGACCTGTCGAGCGCGGCGGAGGTCGTCGTGCCG
GCGAGTGGGAAGGCGATGGTGCCGACGGACCTCAGCATCGCCATCCCGGAGGGCACCTACGCGCGTCGCGCCGAGGT
CTGGGCTGGCGTTGAAGCACTCGATCGACGTGGGCGCCGGGGTGATCGACGCCGACTACCGTGGCCCGGTAGGGTCAT
CCTCTTCAACCACTCCGACACCGACTTCGCCGTGAAGCCCGGCGACCGGATCGCGCAGATGATCATCGAGGTGATCGTG
ACGCCGGAGGTCGCCGAGGTGGAGGACCTCGACGCCACCGTCAGGGGAGAGGGAGGGTTCGGATCCACCGGCGTCTGAA
TGAATGAAGCATCGTCGTCGTTAGCTCCAGGAAGTTGGGGGAGTTCATTTAGTCTGTGATGGATGGATGGGTGATGTCG
TGATGAAACACTTGTATCCTCTTAATGCCTCGGATGCTT > SEQ ID NO:173 116692 *Oryza sativa*
CGCCCTTCTTCGGCCCGCTCGCCGACGCGCCGCAGCCCTTGACCTTCTCCCAGGCCGCCGCGGATGCCGCCGCGGCGCG
GGAGGAGGATGCGGACGATGACCGGAGCAACGAGGCCGAGGCGGCGTCGTGGCTTCTCCCCGAGCCCGACGACAATAGC
CACGAGGATAGCGCCGCAGCCGCCGACGCGTTCTTCGCCGACACCGGCGCGTACCTCGGCGTCGACCTGGACTTCGCCC
GGTCCATGGACGGAATCAAGGCCATCGGGGTACCGGTCGCGCCGCCCGAGCTGGACCTCACCGCCGGCAGCCTTTTCTA
CCCCGAACACTCCATGGCCCACAGCTTGTCGTCGTCGGAGGTCGCGATCGTACCGGACGCGCTGTCGGCGGGCGCGGCG
GCGCCGCCCATGGTGGTGGTGGTGGCGAGCAAGGGGAAGGAGAGGGAGGCGCGGCTGATGCGGTACAGGGAGAAGCGCA
AGAACCGGCGGTTCGACAAGACCATCCGGTACGCGTCCCGCAAGGCGTACGCCGAGAC > SEQ ID NO:174 116784 *Oryza sativa*
CTCGCCGCCGCCGCCGCCGCCGCGGGGATGGCCGGAGTTTCCGCCGCCTCCACCGCCGGGAAGATCGGGAGCTTCCTCT
CCAAGAGGCCGTACGCGCCGCCGTCCTGGGCCTCGCACCTGTCCCCCGCCCCCTCGCAGACCTTCTCGCTCGGCCATTT
CCCGACGCCGATCCACAAGTGGAATCTGCCCAATTTGCCGAATGGCACGGAGGTGTGGATCAAGCGAGACGACATCTCA
GGCATGCAGTTGAGCGGGAACAAGGTCCGGAAGCTCGAGTTCCTGATGGCGGATGCCGTCGCGCAGGGCGCTGACTGCG
TTATAACTGTAGGTGGCATCCAGAGCAATCACTGCCGTGCCACCGCAGTGGCTGCAAAGTATATAAATCTTGATTGTTA
TCTGATACTGCGCACATCCAAGCTTCTTGTGGATAAGGACCCTGGTTTGGTTGGGAATCTCCTTGTTGAGAGATTGGTG
GGAGCGCATATTGATCTTGTTTCAAAAGAAGAATATGGAAAAATTGGCAGTGTGGCTTTAGCGGACTTGCTGAAAAAGA
AGCTTTTGGAAGAAGGCCGAAAACCATATGTTATTCCTGTTGGTGGATCAAACTCTCTAGGAACTTGGGGATATATAG > SEQ ID NO:175 118051 *Nicotiana benthamiana*
TTGCATTTCCAACGTGTATTTCAGTTAACAACACTGTGTGTCATTTCTCTCCATTGTCTAGCGATGAGACAGTACTGGA
AGAAGGTGATATATTGAAGATTGATATGGGATGTCAAATTGATGGATTTATTGCTGTAGTTGGACATACACATGTTCTT
CATGAAGGACCAGTTACCGGTAGAGCTGCTGATGTCATTGCAGCTGCTAATACAGCTGCTGAAGTTGCTTTGAGGCTTG
TGAGACCAGGAAAGAAGAACTCGGATGTAACAGAAGCTATTCAGAAAGTTGCTGCTGCCTATGACTGCAAGATTGTTGA
GGGTGTCTTGAGCCATCAAATGAAGCAATTTGTTATTGATGGAAACAAAGTTGTATTGAGTGTGACCAATCCTGAAACA
AGAGTACATGAAGCAGAATTCGAGGAGAATGAGGTTTACTCAATTGATATTGTGACAAGCACTGGTGAAGGAAAGCCAA
AATTGTTGGATGAGAAACAAACAACTATCTACA > SEQ ID NO:176 119262 *Nicotiana benthamiana*
ttttttttttttgttttaattctgaacgagcttaatcttatataaaatttaattttttttccttttgcataagtatacat
aATTGAATCTACAGACCTCGTCCTagaTTCAAAATTTTATTCTAACACATAATCTCGAAACTTCATAAAATGTATGCGA
ATCTGTTCATTTGGGAGCGGAAGCaaaAGTTGTAGCAGCTTGAGAACGAGCTCGGAAAAAAGCAAGCAACTCAtctctT
GGAGGCAGAGATTCCTTGAGTTGGCTGCAGTTAGTGTACTCATCTCTCCACTTAGAAAAATTTGGAAATTTTTCACTTG

FIG. 1 continued

```
TCATTAAAACAATTCCAGAGGCTTCTTCGAAAACTCCTAGCCAAAATGCCACCAAATTTGCTGCAATATCAGCAAACCC
AAATTTGTCACCTACAAGAAACTTCTTATCCTTGAGCTCATTGTCAAGAACTTTCAACATCTCCCAAACTTGCTCTTTA
GCTTTTTCTTGTTCCTCCCCTTTGCTAAGGAAAGTATTCACTATTACAGTCACCTTATCGTCAAGGAACTTAGCCCAGA
AACGAGCTAAAGATCGATCATAAGGGTCTTTAGGCAAAATGGAAGGACCTTCAAAAGTCTCGTCAATGTATTCAAGAAT
GACAAGAGACTCAGAAATGGGTTTGCCATTGTGAATAAGCACTGGTATTTTCTTGTGAACAGGGTTTGATTGAAGAAGC
AGAGGGCTCTTGTTTTGTAAATCTTCTTCTACAAATTCATATTTCACGCCCTTAAGCTTTAGAGCCCACTCAACTCTGT
GACTAAAAGGGctataccaaagaccaagcaacttcactcctgccatatgatatcactactttggttctaaatgttttttg
cggacgcgtggg > SEQ ID NO:177    119350   Nicotiana benthamiana
tttttttttttaggcagccaagttaaaacagcatcgacagctgctgcatcttcttgccattgagctaaaaaacagtagt
tCGTGATCAGCAACAAAATTACAACCAACAGCAAATAAAACAGCATCAACAGCTACTGCATCATCTTGCTATTCAGCCA
CATTGACTTTTCACGGACCCAACTTATAAATAAGTCAGGCGAATCAGTTCTAGCAAGCAGAAAATAGATGAAAGGTCCT
TCATTTGGGAATGTCCTCTTGATACGCAGCATTGACCAAAGCCTGATGCAATTGCGGCCTCCTCCTTTGCTACTTAATC
ATCGGCATCAAAACGTGGCAAGGGGCTGCGagaACCAGCACGTCTACCACGCGgtgagACACTCTTGGGAGTTGGAGAG
CGCTCCTTGCGATTACGACCATCTGGACTAGCATCCCTagaAGgtgTTGTTCTGCGTGGagaAGGGCTCCTCCGAGGAC
TGGGGCTACGAcgaACAGGGGAGGCACTTCCATGAGACCGACTTCGGCTGCGCCTTTCTTCATCATATTTACCCCTTCC
ACGAGCTTTTTGATAATCCGGGCTGCGGCTTCTGTTCCGGTGACGGTAAtCTTtgtctcTTCCacGGTACCGATCACGG
TCATACCTCCCCCCACTTCTACTTCGGCTTCTCCTTTCAGAATCCTTGTCCCTATAATGATCTCGATGCCTTGATCTAG
GACTACGGCTTCTTGACCTTCCTCCTGTCCTATGTACAGGCTCCAAAATTCTACCTTTGTCGATTCTCTCGGCATTTGG
GCCGTACTTTGCAAATCGAACCATTATTTCTCGACCATCTACAACTCTTCCATCGAGCTTCTCCACTGCCTTTTGAGCC
TCATCCTGATACTTGTAGCGCACAAATGCAAAACCTCTAGAATCTCCGGTCCTTCGGTCTCTAGGGATAAAGACATCGA
CGACTTTTCCATACTTATCGAAAAGAGGAAACAAGTCATCAGCAGTGGTACGGAAAGTAACGTTGAGAACGAggagaga
gaaggtatctttgatgtccggagggcctgttcttccgaagtgagacatcgccgttcgctggagtgaatgactg > SEQ ID NO:178    119915   Nicotiana benthamiana
CCCCCATCGCGATCAACAATTATTGCGTAATGCATCGTTCTGACTGCGGATTTTCAGTGTTAGCCATTTACTTGAAGAG
TGGCATTCCATTTGATATTATCACATTTAACACCTTACTAAGGGGACTCTTCGCTGAAAATAAAATCAAAGATGCAGTT
AACTTGTTCAAAAAGTTGGTGAGAGAGCATATTTGTGAGCCTGATGAATTCATGTATTCAATTGTCATGAATGGGCTTA
GCAAAAGGGGTCATACTCAAAAAACTTTCGATTTGCTTAGGGTAATGGAACAAGGAAGCACTAAGCCCGATGCATACAT
CTATAGCATTGTTATAGATACCCTATGCAAAGATAGAATGTTAGATGCTGCAATTAGCCTTTTTGAAGAGATGAAACAA
AAAGGCATTCCTCCAAACGTTGTCACTTATAATTCATTGATTGATGGTTGTTGTAAGCTTGGCCAGTGGGAAAGGTTAT
GAATTTGTTCTCTGAAATGGTAAGTCTGAATATTTATCCAAATGTCCGCACCTTCAGCATACTGATAGATGGTCTATGC
AAAGAAGGGAAAGTTGAAGATGCTGAGGAGGTAATGAGACGCATGATTGTAAAAGGTGTAGAGCTAGATGTATTCACCT
ACAATACCATGCTCGATGGATATTGCTTG > SEQ ID NO:179    119938   Nicotiana benthamiana
CCCCCCCCGATAAATCTACAACACCTGGTCATCTAAGTTCCTCTCTCTACAAATATTTCAAAGAGAAAAAAAAGAGCAA
AAGCTTCATTCATAAACAATGGCGTCCGCCATTAAGAAAGGAAACATGATTACTCAAATCGTGAGACTTAAACAAGTTG
TCAAACGCTGGAAAAATAAGTCCCTTAAGCGCCGGGGTGTCCTCTCGTACTCCTCATCTGATTCAGATGAACCGGCATT
ATCCGGTTCGGGCCGGCGTACGCCCTCAGGATCGTTGGCGGTTTACGTGGGGCCAGAACGCCGCCGGTTCGTTATACCC
ACCCGGTTCTTGAACCTCCCCGTGTTCATCTCGCTGCTCGACAAGGCAGAGGAGGAATTTGGGTACCAGAGGACAGGTG
GGTTAGTTTTGCCTTGTAAAGTCGAGTACTTTTCGGAGATTTTAAGGTTACTGGACCGGGATGAGGAACGGTTCGGCCA
TTTGGGTTTGGATGAGCTTGTTAAGCTGATATCTGAAGTGGGGTTTGAATCTTTAGATCAGTCTTGCAAAGCTGCTTCC
CATGGTTTTGCTCCTCTTCTG > SEQ ID NO:180    120147   Nicotiana benthamiana
CCCCCCCCGGAGTCCCTAACCAAAGCCCCTTCTTATCTCTTCCCCTTTCAGCCCACAACACACACACACAACCACCCAA
CGGGCATATAACTCTGTTTTTTCCTCTCTTGTTGTCAATACCATATTATTATTCTCAACCCTAAAGGTTTAATCATGAA
AGGAGGTAAATCAAAGGCTAAATCTGACAATAAGCTCGGCGTTAAGAAGGCTGCTCCTCAGACTAAAAAGGAGAAGCAG
GCTGCCAAGGATCCCAACAAGCCTAAGAGGCCAGCAAGTGCTTTCTTTGTTTTCATGGAGGACTTCAGGAAGCAGTATA
AGGAAAAACACCCAAACAACAAATCTGTTGCTGCTGTTGGTAAAGCTGGCGGTGACAAGTGGAAACATTTGTCAGAGGC
TGAGAAAGCTCCATATATAGCAAAGGCAGAGAAAAGGAAGGCTGAATATGAAAAGAACATGGATGCTTATAACAGGCGA
```

FIG. 1 continued

CAGGCTGGTGAGGCTGAAGAGGAGGAATCTGACAAGTCAAAGTCTGAGGTTGACGAGGAAGACGGAAGTGACGAGGAGG
AAGAGGATGACTAAATGAAGTCTTAGGGGATGAAGAAAATGTGGAGGAATTGTGTAATATCTT

> SEQ ID NO:181 120161 Nicotiana benthamiana
CCCGCCCGGCTTGAAGCCGAAGCTAGGCTTGTTAGACAATCCAAACTTCGGTCCAATAGTTTCCAAAATTCAACATTTG
TATCCCAAGAATTTACTACCACTTCACCTTCTAGTCCTCTTGACAAACCGGTTGTGGGTCCCTCTCGGTGTCTGGACGT
ACTCAAAGCGTGGAATGGTGTTTGGACCAAACCAATGAATGAACTTATGGCAAGTGGCGGTGCGACTATATCTGTCACT
GGACTAGACCTGGAGGAGTCTCCTACGTCTACACTAGGCTATTTTGATCAAAACGCGCCACATATTTCTACACCAGGGA
TTAATGGAGGAAATTCTACGGTTTTATTTGAATTCGTTGGAAATTCGTCAGGATCAAGCGAAGGTGGAATTATGAATAA
CGAGGAAAGTGAAGAAGATTGGAAAGGATTTGGAAACTCATCAACAGGACAATTACCTGAATATAAAGATGGTATTAAT
GAAAATTCAGTGTCATTCACTTCAGGACTTCAAGATTTAACTATGCCAATGGACAATATGTGGACAGCTGAATCTCTAA
GGTCAAATGCAGAGCAAATTTCCCCTGGCAATTTTGTGGAAACATTTACAGATCTATTGC > SEQ ID NO:182 120246 Nicotiana benthamiana
CCACGCGTCCGCTTTCCTTTTTTATTATAGCATTTTTTCTTTACAAATATAAATAAATCAAATAGCAATCCCAAAAGAG
GCATAACAGTTTTGTTTTCCGAAAGAGTTTTCTCTCTATTTCTGTCTAAAGAAGTCATGGCGGAAAAAGGGCGACCACT
TCCTAAGTTTGGAGAGTGGGATGTAAATGACCCAGCTTCAGCTGAGGGATTTACAGTGATCTTTAATAAAGCTCGAAAT
GAGAAGAAAGGTGGTAAGATAGACTCACCACCTAAAGGTGATTCTGCATACAAGAATAAAGCAATGCTTGGAAAAACCTC
AATCAAAAAAATGGTTTTGCTGTATGCAATCTACTGCGGCCGAATCATGAACTGTTTTAGCTCCTACATACTGAACTGG
AAAGTGATGTTGGTTGGAACCAGACTCTACGAGTGACCTATAACACTGGAGCTGTAGTCATGATCTGACGAGGAATACT
GGGATTTTTGCTGTTGTATTTTGGAATAGTTGCTCAATTTGCAGGCTTTTGCTGCCAAAATATTAATGATATATATTTG
TTTG > SEQ ID NO:183 120670 Nicotiana benthamiana
TTGAGGATAGAGCTCTCTTTTGCAAGGACTGTGACGAAGCGAGTCATTCTGCCAGCAGCCTTGCTGCAAACCACCAGCG
CTTCCTAGCCACTGGAATTCGAGTAGCCTTGAGCTCAAGCTGTAATAAGGATGCAGTAAAAACCCAATTGGATCCACCA
CAACCACCTCAGCAGAATTCTCAACAAGTTTGCCTGAAAATGCCTCCACATCAGTTGTCCAGTATCACATCGCCATCTT
GGCCTGTTGATGATTTACTAGGATTTCCAGATTATGATTCAACTGACAAGAAGGAGCTACTTGAGCTAGGGGAACTGGA
GTGGTTGGGAGCCATTGATCTCTTTGGTGAACAAACAGCAGCAGAAGTACCCGAGCTATCAGTATCTCAGGCGGGCAAC
ACACATAATATTTACAAGCCAACCAGATATCAAATGTCTTACAAGAAGCCCAGGATTGAAATCCCAGATGACGATGAGT
ACTTTACA > SEQ ID NO:184 120859 Oryza sativa
CACCAACAAAAAACAGAGCACGGGCATGGCACCGACGACGGCGGCGGCGGCGGCGAGCAGCAACGGCGGCGGCGAGAGC
GACGGCAGCAGCAAGGAGTGGAGGCTGACGGCGCCGACGAGGGGCGGCGCGATGGCGGCGGCGGGGGACAAGATGAGCA
TCCGGGCGGTGCGGTACAAGATCAGCGCCAGCGTCGACGACCGCGGCCCGCGCCCCGTCCTGCCGCTCGCCCACGGCGA
CCCCTCCGTGTTCCCCGAGTTCCGCACCGCCGCCGAGGCCGAGGACGCCGTCGCCGACGCGCTCCGCTCCGGCGACTTC
AACTGCTACCCCGCCGGCGTCGGCCTCCCCGCCGCGCGACGTGCTGTGGCAGATCATTTGTCACGCGACCTCCCATACA
AGCTATCTTCTGATGACATCTTCCTAACCGCTGGAGGAACTCACGCCATCGAGGTCGTAATCTCAATCCTTGCCCAACC
TGGCACAAACATATTGCTTCCTAGACCAGGCTACCCAAACTATGAAGCTCGAGCCGCGTTCAACAACCTTGAAGTTCGC
CACTTTGATCTTATT > SEQ ID NO:185 120870 Oryza sativa
CATCCATCCCATCCTCGATCCTGGATTCCTGCCCGGCGGCGAGCGAGAGAGAGGCGGAGGAGATCCGAGATGGCGGGGA
GCGGGTGGAGGAGGATCCCGGCGGCGAGGAGGCCGCCCATGTCGCGCCCGGCCTCGGTCTGCCTCTGGATCGTGCTCGT
CGCCGCCACCCTGGCGCTCGCCCAGGCGAAGAAATCGAAGGCGGATTTGACTGAGGTCACCCACAAGGTCTACTTCGAC
GTCGAGATTGATGGCAAGCCCGCAGGACGGGTTGTCATGGGACTTTTCGGGAAGACTGTTCCTAAAACGGCAGAGAACT
TCCGAGCACTTTGCACAGGAGAGAAAGGAACTGGAAAGAGTGGCAAAGCACTCCACTTCAAGGGAAGTGCATTCCACAG
AATTATACCCAGCTTTATGATCCAAGGAGGTGACTTCACACTTGGTGATGGAAGGGGTGGTGAATCTATCTATGGGACG
AAGTTCGCCGATGAAACTTCAAGATCAAGCACACCGGACCAGGCCTCCTGTCCATGGCCAATGCTGGGAGAGACACAA
ACGGGTCCCAGTTTTTCATCACCACTGTAACCACCAGCTGGTTGGACGGGAAGCACGTCGTGTTCGGTAAGGTGCTGTC
TGGAATGGATGTGGTTTACAAGATTGAAG

FIG. 1 continued

> SEQ ID NO:186 120925 *Oryza sativa*
GCGGCGGCGGCGGCGGAGGGGGAGGCGGAGGCGGCGAAAATGCAGTACAAGAACCTTGGGAGGTCGGGGCTGCGGGTGA
GCCAGCTGTCGTACGGGGCGTGGGTGACGTTCGGCAACCAGCTGGACGTGAAGGAGGCGAAGGCGCTGCTCCAGGCGTG
CCGCGACGCCGGCGTGAACTTCTTCGACAACGCCGAGGTGTACGCGAACGGGCGCGCCGAGGAGATCATGGGGCAGGCG
ATGCGGGACCTCGGGTGGCGCCGCTCCGACGTCGTCGTCTCCACCAAGCTCTTCTGGGGAGGGCAGGGCCCCAACGACA
AGGGCCTCTCCCGGAAGCACATCGTCGAGGGCCTCCGCGGCTCGCTCAAGCGCCTCGACATGGACTACGTCGACGTCGT
CTACTGCCACCGCCCCGACGCCACCACCCCCGTCGAGGAGACCGTGCGCGCCATGAACTGGGTCATCGACCACGGCATG
GCCTTCTACTGGGGCACCTCCGAGTGGTCCGCCCAGCAGATCACCGAGGCGTGGAGCGTCGCCAACCGCCTCGACCTCG
TCGGACCCATCGTCGAACAGCCTGAGTACAACCTCTTCTCGCGCCACAAGGTGGAATCTGAGTTCTTACCTCTTTACAG
CACGTATGGCCTGGGTTTGACTACA > SEQ ID NO:187 120933 *Oryza sativa*
CTGAAGAGGTACCCAGCTAGGCTGTCAGTTCTATCACTGACCTGCATCTTTGGGCTCCTCCAGTTCCTGGTCATTGCAG
CCTTCACTGAAGAAGACCTGAGCAGATGGAAGGTGAACTCCGGAAGCGAGCTGTTCACAATCCTCTACGCTGGTCTTGT
GGCATCTGGCGTGGCGTTTGCTCTGCAGATATGGTGCATCGACAGGGGAGGGCCGCTGTTCACCGCCGTGTTCCAGCCG
GTCCAGACCGTCGCCGTCGCCGTCATGGCCGCCATCATTCTCGGAGATCAGCTATACTCAGGAGGGATCATCGGAGCAG
TTCTGATTGTGATCGGGCTGTACTTCGTGCTGTGGGGCAAAAGCGAGGAGAAGAAGAGCAAGAACAATCTGCAGGACCA
GTCATCGGTGCAGGGAGGAGGAGGAGACGACATCAGGAGGCATCTGCTCGGGCAAGAAGATGCATCTCGCAAAGACGAA
GAAGCTGCAGTCACTGATGAACTGGCATGACGATCGATCGAGCTGAGGGGCGTTCTTCACCAGTAATATGCATGATGAT
GTTGGAGTTGGAAAATATATGTTGATGTCAGTGACTGTACTTTTCTTAACTATGTTAATCAAAGAAGAAGATCCAAGCG
TGCCAGTGTAATTAAAAACAGTACTGCTAGCTGGTCCTCACTCACCAGTGATATACTATATATAATTGCTA > SEQ ID NO:188 120952 *Oryza sativa*
CTCCCATCCTCTCGCGCGGCCTCCTCCGACTACCTCGGTTGGGTTTTGGGGGCGGCTGGAGATGTCGGACTCCGAGGAG
CACCACTTCGAGTCGAAGGCCGACGCCGGCGCGTCCAAGACCTACCCGCAGCAGGCTGGTACTATTCGCAAGAACGGTC
ATATTGTCATCAAGAACCGCCCATGCAAGGTTGTTGAGGTCTCCACCTCCAAGACTGGAAAGCATGGACATGCAAAATG
CCACTTTGTGGCCATTGACATCTTCAATGGGAAGAAGCTTGAAGATATTGTGCCCTCCTCCCACAACTGTGACGTCCCC
CACGTGAACCGTACTGACTATCAGCTGATTGACATTTCTGAAGATGGATTTGTCAGCCTCCTGACTGAAAGTGGAGGCA
CTAAGGATGACCTGAGGCTCCCTAGTGATGAGGCTCTGCTTACTCAGATCAAGGATGGATTCGCCGAGGGGAAGGATCT
GATTGTTACCGTGATGTCTGCCATGGGTGAGGAGCAGATCTGCGCTCTGAAGGATATTGCCCCAAGAACTAGAATACC
TTGTTACCGTGTTTGGCTACCTGTCTGGTCGCTTTAAGTTTGGAGCTGGTCTTGAGATTATATATAAACTTT > SEQ ID NO:189 120979 *Oryza sativa*
GGTCATCTCCATGCAGATGGGTGCAGTGCAGGCATGCGAGCCCTACTGCCCCACCCCGACGCCGCCGGTGACGCCGCCT
CCGTCGCCGCCGTCGGGTGGAGGGAATAAGTGCCCGATCGACGCGCTGAAGCTGGGCGTGTGCGCCAACGTGCTCAACC
TGCTCAAGCTCAAGGTGGGGGTGCCGGCGAGCGAGGAGTGCTGCCCGCTGCTGGGGGGCTCGTCGACCTCGACGCCGC
CGTCTGCCTCTGCACCGCCATCAAGGCCAACGTCCTCGGCATCAACATCAACGTCCCCGTCGACCTCGTCCTCCTCCTC
AACTACTGCCACAAGACCTGCCCTTCCGACTTCTCCTGCCCACTCATCTGATTCTTAATCTTCATTACCACCACAACCC
TAGCTACCTAATTAAGGCTTAAGCTTTGCATGGCTTAGTCTGTGTGTTGCAGTTGTGTCATACATATATACTTATCTCG
ATCTATCAGTGTGATTATTGATGATCAGATCGATCATCTAATATATGTATCTTGTTATTTTAATGCGTACTGTCAAATA
AAAGTTTCCTCCAGTGTACGTACGTTCTATCT > SEQ ID NO:190 121144 *Oryza sativa*
CAGAAAATGGCACCTTCCGAGGTCAGCCTCGCCGCCGTGCTCGCCGTGGCCATCTCGCTGGCAATGGCGGCCACCACCA
CCACCTCGGCGCAGAACACGCCGCAGGACTACGTCAACCTGCACAACAGCGCGCGGCGCGCGGACGGCGTCGGCCCGGT
GAGCTGGGACCCCAAGGTCGCCAGCTTCGCGCAGAGCTACGCGGCCAAGCGCGCCGGCGACTGCCGGCTGCAGCACTCC
GGCGGGCCGTACGGCGAGAACATCTTCTGGGGCTCGGCGGGGCGCGCCTGGAGCGCCGCCGACGCGGTGGCGTCGTGGG
TGGGCGACAAGAACAACTACCACTACGACACCAACACG > SEQ ID NO:191 121146 *Oryza sativa*
GGCCTTCAAGGCCGCAGGGGGCATGACAGGGGTGACATCCGCCTCGTTGGATGGAGACAAGCTCCTCGTGATCGGCGAC
GGCGTGGACCCCATCGCGCTGACGACGATGCTCCGGCGCAGCCTCGGCCACGCCGAGCTGCTAAGCGTCTCCTCCGGCG
ACGACAAGAAGATGGGCGGCGGCGGCGGCGGCCACGGCGGCATGGGCATGGGCATGGGCATGGGGTTCGGCGGTGGCCA

FIG. 1 continued

```
CGGCGGCATGGGGTTCGGCGGCGGCCACGGCGGCAAAGAAGGCAAGGAAGGCGGCGGCAAGGTCTTCGTCGACGGTGTC
CACCACCACCAACAGCAGCAGCATGCGATGGCGCCGCCGATGCAGCCGTACCCGGCGGCGCCGGCGTACTACAACGCCG
CCGCGCCGTCCTACCCCGTCTACCCCTCCTACCCTGGCTACCCGCAGCAAGAACAGGATCCTAGCTGCAGCATCATGTA
AAAGATTGTGAGTATCAATCAGAGGAGCTTAAATCTGGCAAAAACTATGGAGAATTATTAAGGTATTTGAGTTCACAAT
CAGGCCAA
```

> SEQ ID NO:192  122182  *Oryza sativa*
```
CCCCCCCCCGACAAGCACCCACACCAACCAAAGATGAGCAACACCACCATGGCTATTTCCACCATCCTTCTCTTCCTCC
TCGCCGGCCTCGTCGCCGCCCACGGCGACGGCGACACCATGATCCGTCTCCCAAGCGACGGCGCCGAAGCACCACCACG
CCCGCCCAAACCCTGGGACTGCTGCGACAACATCGAGATGTCCCCGCTCGAGATCTTCCCGCCGCTGTACCGCTGCAAC
GACGAGGTGAAGCAGTGCTCCGCCGCCTGCAAGGAGTGCGTGGAGGCGCCCGGCGACTTCCCCCGCGGCGCCTTCGTGT
GCCGCGACTGGTACTCGACGGTGGACCCGGGCCACATGTGCACGGCGCCGGATCAGCCGACGACGAAGAGGCCGTGGAA
GTGCTGTGACAGCATCGTGCAGCTGCCGCAGAGGATCTTCCCGCCGTTCTGGCGCTGCGACGACGAGCTGGAGCCCGGC
AAGTGCACCGCCGCGTGCAAGTCGTGCAGGGAGGCGCCGGGGCCGTTCCCGGGGCCGCTCATCTGCGAGGACGTCTACT
GGGGCGCCGACCCGGGCCCCTT
```

> SEQ ID NO:193  124883  *Nicotiana benthamiana*
```
AGCAGAGGTGCAAGCTGTCACTGTCCATGCGACCAATAACTATTTTGTGACTGCTTCTCTTGATAGCACATGGTGCTTT
TATGATCTTGCTTCTGGCTTATGCCTTGCACAGGTGGCAGATGCTACAGAATCTGAAGGCTACACATCCGCAGCTTTCC
ACCCTGATGGTCTGATCCTTGGAACAGGGACCTCAGGGTCTCTGGTTAAGATATGGGATGTAAAAAGTCAGGCAAATGT
TGCAAGATTTGATGGCCATGTTGGGTCTGTAACTGCTATTTCCTTTTCAGAAAATGGTTATTTCTTAGCAACTGCTGCT
CATGATGGTGTTAAACTTTGGGATTTACGCAAATTGAAGAATTTCCGAAATTTCTCTCTTTATGATGAAAATACACCGA
CTCAATCAGTGCAATTTGACCATAGTGGAAGTTATCTTGCCTTAGGAGGCTCAGATATACGAGTTTTCCAAGTCGCCAG
TGTTAAGGCTGAATGGAATCACATCAAAACCCTCCCCGACTTATCAGGCACAGGTAAAGCAACATGTCTGAAATTTGGT
CCAGATGCAAAATACATAGCTGTAGGATCTATGGACCGTAATTTAAGAATATTTGGGCTGCCTGGCGAGGATCAAATGG
AGAGTTAGGCTCATTTCCAGCATGAAAGCAAACAGTCAGCGCCACAGCTTCGAATCTGC
```

> SEQ ID NO:194  126117  *Nicotiana benthamiana*
```
GCCATTACGGCCGGGGATATGGGCTGATATTTCTCTTGGTGGGTATAGGCCAATGTATTTGTTCTGCAGTTTACTGTTA
ATTAGTTTGGACCAAAGTGCTTATGTATCAATAGTACATAGACCCGACTCATTACATAGGGAACTATTATTTTCTTTTT
TCAATTAAAATATTTGGAAGCTTCAAAAAAAAACAAAATATAAAAAAAAAAAAACTTGTCGGCCGCCTTGGCC
```

> SEQ ID NO:195  126149  *Nicotiana benthamiana*
```
GCCATTACGGCCGGGGGACCAAATTAAGTCGAAAAAAAAAGGGCAACTCCTGAAGAAAACATTGCACCTGCAGCTCCAC
CACCGCCGGCGGCAGAACCATCAGCGGTGGAGGCTTTAGTGACCACTATTGAAACAGCGACCAAACAGGTTGAAACACC
GAAGGAAGTCAAGGAGGAGAAGAAAGGAGGAGCACAGGATCTCAAGTTAACCCTTTTGATTCCAGGGGCTGTAGTAGCT
GTTGTTGGAGTAGTTCTTGCCATTGTCAAGAAGGTGAAAGAGTCGGCTAATTGAATGTAGATCCCTTGTATCGTCAACT
TTATATTTCTGTACATTTTTTCCCCCTTTTTGTAAGACGAGCCTAAACTCTTTGTCAGCTTTGAAGGGAAATAAATAAA
TTTCATATGCTTTT
```

> SEQ ID NO:196  126157  *Nicotiana benthamiana*
```
GCCATTACGGCCGGGATAGGAAATGGCAAGCACAGTAATGAGCTCATTGAGCCTCAAACCTGCAACTTTCAGTGTTGAG
AAGACAGCAGTGAAAGGACTGCCATCACTTGCTAGGTCTTCTTCTTCCTTCAGAGTTCAAGCTAGTGGTGTCAAGAAGC
TTAAGACCGACAAGCCTTACGGAATTAATGGAAGCATGAGCTTGAGAGACGGCGTTGATGCCTCAGGCAGGAAGCCCAA
GGGAAAGGGTGTTTACCAATTCGTTGACAAATATGGAGCAAATGTTGATGGATACAGCCCCATCTACAACACAGATGAC
TGGTCTCCAAGCGGTGATGTCTATGTTGGAGGCACCACTTGCGCTTAGCCATATGGGCAGTCACCTTGGTTGGCATTCTGG
CTGGAGGTGCTCTCCTTGTTTTCAACACAAGTGCTTTGGCACAGTAGATCATTATCCTTGTACTCCTATTTCAGTTGTA
TTCCAGCTCGCACCATGTATCTTTTCAAGAATACTTTGTATTTGCTGGCATCTTGATTAATCTGTAATTGCTGTGGATA
TTACACATAATGTTGATTATTTAAGGT
```

> SEQ ID NO:197  126168  *Nicotiana benthamiana*
```
GCCATTACGGCCGGGGCAAAGAGTGTGTTTGGTGAGGATGCTTTGGTGAATGTAAGCATTGAGAAACAAGCAGATGGTA
AGCTGAGTGGTTATATTAGGATAAGGAGCAAAACGCAAGGAATTGCGCTTAGCTTGGGGGACAAGATAACACTCAAGCA
GAAGGGAGGCACTTGATCAGGCCAACCGGAATTTAGTATGACCTGGATATGCTGATTATTACACTTGAATTTGAGGCTC
```

FIG. 1 continued

CTCCAGATCTCCCATTTTGCAGCTTGGTGGAGTGCTGGGGTTATTGAGAGAGCATGTAGATATTATAATACTGCACTTA
TTCTTAGGTTCGGATGTAAAAGATTCAAGTATTTTATTTTCTGTGAGGACAGTTTTTGTAGAGAATGACTTGAAGAAAT
ATTGCATTATTTTTGACATGTTTTGAAGCGGAAGTTTCTTCTTAAGTTCATGC

> SEQ ID NO:198 126335 Nicotiana benthamiana
GCCATTACGGCCAGGGATAACCTCAAAGGCCAAATAGATAGTTTCTTCCCACGAAAGTAAAAATCTCCCTCATTTTTCC
CCCTACTACTTTTCATCATCATGTCTCAGACCGTTGTTCTCAAGGTTGGCATGTCATGCCAAGGCTGTGTAGGAGCTGT
GAACAGAGTTTTGGGGAAAATGGAAGGTGTTGAATCTTATGACATTGATATTAAGGAGCAAAAAGTGACTGTAAAAGGA
AATGTGGAGCCAGAAGCTGTTTTCCAGACTGTTTCAAAGACTGGAAAGAAGACTTCTTTCTGGGAAGCAGAAACACCAG
CACCAGCACCAGCACCAACTGAACCCGAAACAAAGCCCGTTGAAGTAAAGCCCACAGAAGAAAAGCCTGCaGATACACC
AGCTGAACCCGAAGCTAAGCCCGCAGACGAAAAGCCagCAGAAGCTGTTGCTTGATGACTGATATATATATCAAGCT
TAAAGCAGAATGTGATATGTAACAGTTAATCagcTCTTAAATAACGTGTTACTAATTTTTGCgTTTGgttTTTATTgta
ATAATATAGATAAGAAGtcctgttATCTACTGAAAAGaaCTACTtCagTATACTGgagtgtattgtttaacTagtcTAC
TggatttGC > SEQ ID NO:199 126358 Nicotiana benthamiana
GCCATTACGGCCGGGGGTCTGTTTATAGTCAGAGACTGATCAGTTGTCCTGCCATAACTTTGGCACTTTTGACATTTCT
GTAGCAGGGTGCCTGAAAGAAAAACATTCTCAAGGTGGAAAAGTCGGTTGAAAAGATAAAGCATTTTGCCATGTGAATG
TTATACTTCTACTCCTGCTGATAGACGTGAATTCCTTCTGAGATAACAAGATTAGGTTTACAATTGGTAGTCAGATTTG
AAGCTGTATTATTTAGGGAAAAAGTAGCCCTTTCTTTCAGTTCAGAGTTCTCTTTTGAATCACTTTTGACTTCTCTTTa
gttTTGGTATGTGTACAGCTTaggATtgttATtgttgCAACAAATATACATAACATTTTGaggcaTCATATCcTtCATT
TTGaaa > SEQ ID NO:200 126367 Nicotiana benthamiana
GCCATTACGGCCGGGGAAAGGAGAGAGCCCAAGTTGCATATGAGAGGAGAAAGCAGTTGGCTAAACTGAGAGTTAAGGC
CGAGAAAGCTGCCGAGGAGAAGCTCGGTCCACAGCTTGCTGTTATTGAACCTATCAAGTATTAGAGTGCAAATTTAGTA
GTTATCTGAGGTGAAATTTTGCTGGAGATTGAGATTTCAGCTTATCTGTTTTTTTAAAAGTTGTACCGCATGGTTTGGT
ATTTTGCTTCTAGCAATATTTGAGCAGACTTTAAATTGTTTTAACTATCTTTTTGAAGTTACAATTCTCTCATGGTTTT
ATTGGTACAGCTTTGTTTTCTACTCCTTGATAGTTTGCATCTATAAGATGAATGACTCCATTGAGCTGAGTCTCTATTA
ga > SEQ ID NO:201 126374 Nicotiana benthamiana
GCCATTACGGCCGGGGGGTGTTATTTGTCCTCATAAGCTtggCTGTCACAGGAATTCAACACGTTCAATTCTGTCTGAA
CCATTTTGCTGCAGATGTCTATGTTGGACAACCCAAGGGAAACGATTGGTTCGAGAAACAAACAGCCGGGACTATAGAT
ATTGCTTGTTCTCCTCAGATGGATTGGTTCTTTGGAGGATTGCAATTCCagCTTGAGCATCATTTATTTCCAAGGTTGC
CTaggTGCCAATTGAGGAAAATTTCTCCTATTGTACAGGAGCTATGCAAAAAGCACAATTTGCCCTACAGGAGTTTGTC
TTTCTTTGAGGCCAATAGATGGACAATAAGGACACTTAGGGTAgcGGCAATGCAGGCTagaagTTTGCTATGGGAAGCT
GTTAATACTcgtggctAATAAttgttGAAGATCTgttTATtgtgattAcaattGAATAATGTCTTGCTGGATTggAACa
aagaggGAATgtgtATGCt > SEQ ID NO:202 126375 Nicotiana benthamiana
gccattacggccggggagagcaaagcaaaacaaagaaaaaattTGTAAAAATGGCCAGTATTTCAGGTACCATGGTTAG
CACCTCTTTCCTCCCAAGGAAACCAGCAGTGACTAGCCTGAAAGCCATACCAAATGTTGGGCAAGCTCTCTTTGGTCTT
AAATCTCAGAGGGGTGGTAGGATTACTTGCATGGCCAGTTACAAAGTGAAGCTTATTACACCAGAAGGAGCTGTTGAGT
TTGATTGTCCCGATGATGTTTACATTCTTGATCAAGCTGAGGAAATGGGACATGATCTTCCTTACTCATGCAGAGCTGG
TTCTTGTTCTTCTTGTGCTGGAAAAGTTACAGCTGGAAATGTTGATCAGTCTGATGGAAACTTTCTTGATGATGACCAA
ATGGCTGATGGATTTGTTCTAACTTGTGTTGCTTACCCACAGTCTGATGTTACTATTGAGACACACAAGgAGGAGGAGC
TCACTGCCTAAACTCCTCAATCTCATTATTTCAAAAAAGTTTGATGAGCATTTATTTTCATATGTAACTCTTTtgttCT
CATAAAAGaTGCCATGTTGCAACTTCAGTCAATGACTTTGATtGC > SEQ ID NO:203 126534 Nicotiana benthamiana
GCCATTACGGCCGGGGACAAAAAACTGACTTCTTGCAGCTGTGGCTGGAAGAAAAAGAAGAAAATGAAGTTATTAGCT
GCAACAACTCCAACTAATGGTGGTCCTTCTACTGAGGAGCGTGAAGGATCTGATGAGCAAAACTCATTGTTTTGTGTAC
CAATGGAAATTCTAGAACTGATTCTCTCCCGGTTAAACTTGAGAGAAAACATCCGTGCTTCTGCTGTTTGCAAGCAATG

FIG. 1 continued

```
GCTTGCTGTCTCCATTTCTGTACGAGTTGCAAATAAACCACCTTGGCTTATGTTTTTCCCAAAATTCGGTGACTTGGTT
GAATTCTATGACCCTTCGGTGAGGCAAACTTATTCAGTTGAGTTACCAGAGTTACGTGGCTCTAGGCTTTGTTACGCGA
AGGATGGCTGGTTGCTGTTATACAAACCGAGAACTTTACGTGTGTTGTTCTTCAATCCTTATACGAAGAGTGTGATCAA
TTTGCCAAGACTAGAATTAACATACCAGATAGTTGCTTTTTCTGCAGCTCCTACATCTCCGAACTGTATCGTTTTCACA
GTTAAGCATATCAGCCCCACTTTGGTCGCAATTAGCACATGTCAACCAGGGGCAACGGAATGGATAACTGCCAATTACC
AAAATCGTTTGCCATTTGTTAGCAGCATTTGGA

> SEQ ID NO:204  126593  Nicotiana benthamiana
GCCATTACGGCCGGGGAGCAGTGACCAAATTAAGTCGAAAGAAAAAATGGCAACTCCTGAAGAAAACATTGCACCTGCA
GCTCCACCACCGCCGGCGGCAGAACCATCAGCGGTGGAGGCTTTAGTGACCACTATTGAAACAGCGACCAAACAGGTTG
AAACACCGAAGGAAGTCAAGGAGGAGAAGAAAGGAGGAGCACAGGATCTCAAGTTAACCCTTTTGATTCCAGGGGCTGT
AGTAGCTGTTGTTGGAGTAGTTCTTGCCATTGTCAAGAAGGTGAAAGAGTCGGCTAATTGAATGTAGATCCCTTGTATC
GTCAACTTTATATTTCTGTACATTTTTTCCCCCTTTTTGTAAGACGAGCCTAAACTCTTTGTCAGCTTTGAAGGGAAAT
AAATAAATTTCATATGCTTTTATTAT > SEQ ID NO:205  126611  Nicotiana benthamiana
GCCATTACGGCCGGGGGCCTAAAACAAATTTCAGAAGGTTGACCTAAATGGCTCATGCTATGGCTTCAATGGGTGGCCT
AATTGGTTCTTCTCAAACTGTGTTGGATGGTCAGCTCTGTGGTTCAGCCCGTTTGAGCACTGTTAGCACCAGCAGAATT
GCCTTGGCTAGACCAGGTCTCAGCATTAGAGCCCAACAGGGGTCTGCTGACACTGAAACTAGCCGTAGAGCCGTCATCG
GTCTTGTTGCTGCTGGCCTTGCTGGTTCCTTTGCTCAAGCAGCCTTTGCTGCAGCTAAATCAATCAAGATTGGTGGCGC
TCCTCCTCCCTCCGGTGGATTACCTGGAACTTTGAACTCGGATGAGGCAAGGGACTTTGGTCTACCACTTAAGAAGAGG
TTTTACCTTCAACCATTGACTCCAGCTGAAGCAGCCCAGAGAGTTAAGGATTCAGCCAAGGAGATTGTTAGCGTCAAGA
ATTTCATCGACAAGAAGGCCTGGCCATATGTCCAGAATGACCTTCGTCTCAGAGCAGAATACCTTCGCTATGACCTTAA
AACCGTAATCTCAGCTAAGCCAAAAGAAGAGAAGGGAAAGCTCCAGGACCTGACTGGAAAGCTCTTCAAGACCATTAGT
GATCTGGACCATGCAGCAAAGACCAAGAACAGCCCTGAAGCAGAGAAGTACTATGCTGAAACTGTATCTACCTTAAATG
ATGTTTTG > SEQ ID NO:206  126632  Nicotiana benthamiana
GCCATTACGGCCGGGGAGAGATCGGGAAGAAAAGATGCGTGGAATGGTAGAGTATGGTTGGCAAAACACGTCGTCGAAT
GAGTATCTTGATCATATTAAACGAATGGAGAGATCGCCAACGATGCACCCTGATCTTCCTCTCTACCCAAATGTCCACT
CCCTCTTCAAAAATGGAATAGTGAGCAACGGACAAGAAAAGAAATGCACTACACTAACACCACAGTCGCAGAAGAAAGT
TCATTTCGTGGAACCTAAAGCTGAACTTACCATGAATGAAAAGAAGAGTATTGACATGGAGGCTGATGGCTATATAAAG
CAGAAGCACGTCAACTTTGAGCTCCACAAATGGAGAACCTTCAAAGCTTGTTAAAAAGTTTCCAACGTACTTCATACAA
GATATACTACATGATATCTTAGTATAAATAACATGTAATATATGTCTGTCTTATTAGCTTCTGTTTGTACTCTAAAGGG
AAAGATATCTCTTTATATGCGCTGTGACTATATATTTCGTAGATGTGGTGTTTTGATTTCAATTTATCTAATAATAAGC
TATAGGTATGTTTATT > SEQ ID NO:207  126840  Nicotiana benthamiana
GCCATTACGGCCGGGGAAAGGAAAAGTAGGTAAACCAATGGTCAGACAGCAAGATCCCAGCAAAGACTAGCCAAGATCT
GCGTCTCCTCTCTCTCTCTCTCTCTCTCTCTAACTTTCAACTGCTGATTGAGTGTACAGAAGCTTAGTGTTCT
GGTTTAAAAAAAGATGGCGAGTGGGTATGGGGATGCGAGCCAGAAGATAGATTATGTATTCAAAGTGGTGTTAATCGGC
GACTCAGCTGTAGGCAAGTCTCAGATACTGGCTCGATTTGCTCGTAATGAATTTAGCCTGGATTCTAAGGCCACGATTG
GGGTTGAGTTCCTGACCCGAACCCTAGTCATTCAACACAAGTCTGTTAAAGCTCAGATCTGGGATACTGCTGGTCAAGA
ACGATATAGAGCTGTCACAAGTGCATACTACAGGGGCGCAGTTGGAGCTATGTTGGTTTATGACATAACGAAACGGCAA
ACCTTTGATCACATACCCCGTTGGCTGGAAGAGTTGCGTGCACATGCCGATAGGAATATCGTGATCATGCTGATCGGAA
ACAAAACAGATCTTGAAGACCAACGAGCTGTCCCTACCGAAGATGCTAAAGAATTCGCCC > SEQ ID NO:208  127269  Nicotiana benthamiana
CCCCGAGTATTTCGATCTCACAACAGTGCCCGTGGCTACTCAACGAAGGGCAAACCCTAGCTCTCTCCATCTAATTACT
GTATTCTCTCTGCTTGTCGCTGTCGTCTCCGCTGAGGTCTTCTTCGAGGAGAGTTTCAACGATGGTTGGGAAAGCAGGT
GGGTGAAATCTGAATGGAAGAAAGATGAAAACATGGCTGGAGAGTGGAATCACACATCTGGCAAGTGGAATGGAGACAC
TAATGACAAAGGTATCCAAACCAGTGAAGACTACAGGTTCTATGCCATTTCAGCTGAGTTCCCTGAATTTAGCAACAAG
GGAAAAAACTTAGTGTTCCAGTTCTCTGTGAAGCATGAGCAGAAGCTTGACTGTGGTGGTGGGTACATGAAGTTGCTTA
GTGGGGATGTTGACCAAAAGAAATTCGGTGGTGACACTCCCTACAGCATCATGTTTGGCCCAGACATCTGTGGCTACAG
```

FIG. 1 continued

CACCAAGAAGGTCCATGCTATTCTCACTTATAATGACACAAACCACTTGATCAAGAAGGAAGTACCTTGTGAGACTGAT
CAACTGACCCATGTCTACACTTTCATCCTCCGCCCTGATGCTACATACAGCATTCTTATTGATAATGTGGAGAAACAGT
CTGGTAGCTTGTACTCTGACTGGGACCTTCTCCCTC

> SEQ ID NO:209 127270 Nicotiana benthamiana
CCCACCCCCCCCAAGTTGTTATCCAAAAAGAGGGCGCCATTAAATTGTTTACACGACAGTCTAAACCTAGAGTAGGATC
TGTACAGGCATTAGGTGCAATTTACTCAAAAGGCTTCCTATTTTTTCGGAATGCCGCCTCTTTTGAGCTCTGTATATCT
GTCATGTTAGTTATTTCATTGTTGTATCTTCCTGCCTTTGAAGTTTTCAAGGCACTTGCCATTTTAGAGATGTACCCAT
ATTTCCTTTACCTCCCTAACCATTTCTGTTCCCTGTACAAATGATAGGCTTGTATTTGTTGTACATTTACTGGGAATAC
CCTTATTTATTTTGATATTCTGGAAAATTATCG > SEQ ID NO:210 127645 Nicotiana benthamiana
CCGACTTCACATCCCACTTCTTACTTAGAATGTTGATTGATATATATTCCTTTTGGATATTTGTCTAATTAGGCTTTAA
CTTTAGCATTAGATATGAGTTTAATAACACTCAAAAACCACTGCATTATTCTACTAGTGACACTGATTTTTCCTGCAAT
TTGCTATTGTGAAGAAGCCAATTCTCTTTACACTAGAGCAACTTATTATGGCAGCCCTGATTGCTATGGAACCCCTAGT
GGAGCATGTGGATTTGGTGAATATGGGAGGAAAATTTATGATGGGAAAGTGAGTGGAGTTTCTAGGCTCTACAAAAATG
GAACTGGCTGTGGTGCTTGCTACCAGGTTAGGTGCAAGATACCAGGTCATTGCACAGATGAGGGTACAAAAATAGTAGT
GACAGATTATGGGGAAGGAGACCATACCGATTTTATACTAAGTGTACGTGCCTATTCAGAAATGGCTAGTCAAGGAATG
GCTAATCATTTATTGGCCTATGGAGTTGTTGACGTTGAATATCGCAGGATTCCTTGCCGTTACTATGGTTACAATTTAA
TGATTAAAGTTCATGAAAACAGTAGGTTTTGTAGCTATTTGGCCATTCTCCCAATCTATCAAAGTGGTTCATTTGACGT
TCAAGCTGTTGAAGTTTGGC > SEQ ID NO:211 127667 Nicotiana benthamiana
CCCCCCGAGCCCTGCTCTATCCCATTTCCCGGGTCTACTCTACCTGAAAATAGGAGAAATATATTCTCTAAAATGATAT
CCAGAAAAGAGAGAGAGGAGAGAAGAAAAGCTTAGTACTGTTATGTCTACTTTGTGAGAGATTCCACAATTTCTTATCC
TCCAAATTTTAGAAGAATGAGTTCATATACTAGCATAAAATGCCCTACTGCTGTTAGAAACTCCACAACTCAATTCCCT
CATCCAAGAACACCAACATCTAGGAATGAAAAAGCTTCTTATCCTTTCAGTAAAACTAAACCCCTCATCTCCCAGATTT
CACTCTCTACTAGCTGCTCATCCTTCAGTCACCAAAGTAAAGCAGATAATCTCAACCAATGTCTAGCCGAAACAAGAAC
CTATAGTGCTAGTTCTGAAGACAAATATCCCACTATGTCAGAAATAATGGAAGCATCAAGAGCCCAAATCTTGATCTT
CACCTTCAAAAATTGGGACCCTTTTTTAGAATAACAGCTAGGAGCTTAAAACCCCAAAGGGAACTTGGAAAAGCTGAGG
GTTTGTTAAGGGTCTGGTTTCAAGGTAAAATTCTACACTTGGACTCCATAAGACTAAAGAGAGAGACTTTGGGGATGGA
AAAATCAATATTTGGGATT > SEQ ID NO:212 127679 Nicotiana benthamiana
CCCCGACTCTTCCCCTATCCTTTCAATCTCTGTCTCCGCCGCTACGTTCACTTCAAACCCTTCACCGGCGTTCGAAAAC
CCTAGGCCCTAATTTCTTCCATGTCCTATCAATCGTTTAGGTAGCTCCGTAAGATCGTTATTTATTCTTATCCGTCAAT
TTATCTGATAAAAGTTGGATTCGGAGGAATGGCGAGTTCGACTACGAGCAATGTTTACATCCACGTCATCGAAGATGTC
ATCAGCAAGGTCCGTGATGAGTTCATCAACAACGGTGGTCCCGGAGAGAGTATCCTCAACGAGCTCCAAGGATTATGGG
AGATGAAAATGATGCATGCTGGGGCAATATTGGGTACAACGGAGAGGAATCCAGCTCCGAAGGGACCCCTGGAGGTCC
AATAACAACCCCTGTTCATGACCTTAATGTGCCTTATGAAGGCACTGAGGAGTATGAAACTCCCACTGCCGATATATTG
TTTCCTCCAACTCCATTGCAGACTCCGTTGCCTGGTACCGCCCAGACACCGCTACCTGGAACAGTGCGGACACCCCTCC
CGGGAACTGCCCAAACACCTCTTCCTGGAACAGCAGATAGCAGCTCAATGTATAATATTCCTACAGGTGGCAGTACTCC
CTTTACACCGAATGAGTACT > SEQ ID NO:213 127748 Nicotiana benthamiana
CCCCCCCCCCTAATGACAGAATACATTATGAGGGTTAACCAGTGATTGATGCTAAGCAAGCCGTTGAGTTGGTGATCTT
TCTTTCTT > SEQ ID NO:214 127750 Nicotiana benthamiana
CTGTTCCCCTAACAACAAGAATTCATTTCCACCAATGGAGCATCCAAATACAAGGGACCATACTGCACAAAAAAGTAAT
CTTTGCTGAAAACAACAAATGGCAAGAAACAGCACTTTTACGTATTACAATTCACGGAATTCACAACTACACAAACAGC
AAAATTCCGATCAATGAGCACAGTCCATAGGATTGCAATCCTAAACAAGGAGGCTTCACTCACATTACTGCTGCTCCTCT
GCTTTCGATGGTACTTCGATCTCATCAGTCCCATCATCCTGCATATCCGAGGTCCACAACGTAAGGTTATCACCAAGAA
GCTGCATAATCAAGGTGCTATCCTTGTAAGACTCCTCTCCAAGGGTGTCAAGCTCCGCAATCGCCTCATCAAATGCCTG

FIG. 1 continued

```
TTGGGCAAGATTACAAGCACGGTCAGGATAATTCAATATCTCATAGTAAAACACTGAGAAATTGAGAGCTATCCCCAAT
CGGATCGGATGTGTACGGGCTAATTCGACATTAGCAATATCCTGAGCCGACTTGTAAGCCGAAAGAGTATTCTCGGCGG
CTTCTTTTCTCTCAGCTCCGGTT

> SEQ ID NO:215 128348 Nicotiana benthamiana
CGACCATCTCAAAATCACTTGCTTTTTTCGTCTCATTTTCTAGAGAAAGAAACAACAAGACGTACAGAACGAGAGTTCA
AGAATCTGCAATGGGAGTGGCTCGAGTTAACCAATTCTGGTTGCATCTTGTCATCCTCTTCTCCATCTCCGTTGCTTCC
ATTTCTAGCACTGAACTGAATTGTGTATACACAGCTTATGTTCGGACTGGGACATACTGGGGGTCTGGAACTGACTCAA
AAATTTCCTTGTCTCTTTACGATGCCAATGGCCATGGTCTTAAAATCAATAACCTACAAGCCTGGGGTGGGCTTATGGG
CCCGGGTTATGACTACTTTGAAATGGACCAATTGGATATGTTTACGGGCCGTGGTCCATGTTTGACTGGACCAATCTGT
AAAATGAACTTGACTTCTGATGGATCACGTGAGCACCACGGATGGTACTGTAACTACGTGGAAGTCACGTCTACA > SEQ ID NO:216 128843 Nicotiana benthamiana
CCCCTCTTTGTTCTCCGAGCTGTAACAAAGGCAAAAGATTACTTGGAGCAGGCTGAGTATGATACTGGTAATCCTGAGG
AAGATCTTAAAGCACAGTCCCTTATGCGACAGCTACTATACAGCCCCAAACTGCAGGCTGCATGTCCAGTTCCTTTTGA
CGAAGCTAAACTGTGGAAAGGCCAAAGTGGACCTGAGCTAAAGCAGCAGATTCAAAAGCAATTCAGGAATATCAGCGCT
ATCATGGATTGTGTAGGATGTGAGAAATGCCGACTGTGGGGAAAGCTCCAGGTTCTTGGTCTTGGAACTGCACTAAAGA
TTCTCTTCTCTGTTGATGGTGAATATCGCCATGATAAACATCTGCAGTTGCAAAGAAATGAAGTGATTGCTCTGGTAAA
CCTCCTTAATCGACTATCAGAATCGATCAAACTTGTACAGGAAATGAGCCCTACGTTTGAGAAGACAATTGGGGGGCTA
AGTCTACAGCCAGCTGCTAAGCTAATAAGTTCATGGAAAAGACTATGGGAAACAGTAGTAGGGGATAGGTAAACATCAC
TCTCTGTTGTTTGTGATTAGTTATTTGAATCTAAGGGTCAGGTGATTTAGCTTCTGCTATTCTTTGTTTTCAAAGCTTG
AAAT > SEQ ID NO:217 129204 Oryza sativa
CCCCCCAGATAAACCCAAGAACGATTAGGGCACACGAAACCATGGCGACGCAAGCGACGGCGAGAGAAATTGCGGTGGT
GGGAGTGATCGGCGCGGGGCAGATGGGCTCGGGCATCGCCCAGCTCGCCGCCGCCGCCGGCTGCGGCGTCCTCCTCCTC
GACTCCGACACCGCCGCCCTCTCCCGCGCCGTCGACTCCATCTCCTCCTCCCTCCGCCGCCTCGTCGCCAAGGGCCAGC
TTTCTCAGGCCTCCTGTGAGCATTCCATCGAGCAGATTAAGTGCGTCTCCAGTGTGCAAGAGCTTAGGGATGCGGATCT
TGTGATTGAGGCTATCGTGGAGTCAGAAGACATAAAAAAGAAGCTGTTTGTTGAGCTGGATAAGATCACTAAACCTTCT
GCTATTCTTGCCTCCAATACTAGCTCAATCTCTATAACCCGATTGGCTTCAGCCACTAATCGCCCCTGTCAGGTGATTG
GTATGCACTTTTTTAACCCTCCTCCGATAATGAAATTGATTGAAATCATACGTGGGGCTGATACATCAGAAGAGGTTTT
CACTAAAGTCAAATCTTTTTCTGAAAGGCTTGGGAAGACGGTAATATGCTCACAAGACTACCCTGGTTTCATCGTGAAC
CGCATCCTCATGCCAATGATCAACGAGGCGTTCTGGGCACTTTACA > SEQ ID NO:218 129329 Contig A Oryza sativa
CGACCACCCTCCTTGTTACAGCTGTGCCGCCTCTTGCTTCCTCCTCCTCATCGTCCGCCATGGCTTCTCTCACCGATCT
CGTCAACCTCAACCTCTCCGACACCACGGAGAAGATCATCGCCGAGTACATATGGATCGGTGGATCTGGCATGGATCTC
AGGAGCAAGGCTAGGACTCTCTCCGGCCCTGTGACTGATCCCAGCAAGCTGCCCAAGTGGAACTACGATGGCTCCAGCA
CCGGCCAGGCCCCCGGCGAGGACAGTGAGGTCATCCTGTACCCACAGGCTATCTTCAAGGACCCATTCAGGAAGGGAAA
CAACATCCTTGTCATGTGCGATTGCTACACGCCAGCCGGAGAACCGATCCCCACCAACAAGAGGCACAATGCTGCCAAG
ATCTTCAGCTCCCCTGAGGTTGCTTCTGAGGAGCCCTGGTACGGTATTGAGCAAGAGTACACCCTCCTCCAGAAGGACA
TCAACTGGCCCCTTGGCTGGCCTGTTGGTGGCTTCCCTGGTCCTCAGGGTCCTTACTACTGTGGTATCGGTGCTGACAA
GTCTTTTGGGCGTGATATTGTTGACTCCCACTACAAGGCTTGCCTCTatgccGgCATCAacaTCAGTgga > SEQ ID NO:219 129329 Contig B Oryza sativa
AAAGGTGATCACTAATAACAATGATGATAAAACCACATGTGGAAAGGAGGACGATGATCCACAGGATGGGACAAGTACC
GTAGGTACGGCCATTATTGGAGGATTACACAAGAGCACCCAAACGCACTCACCCAAAAGACGAAGAAAAAGCTAATCTA
AATGGCAGATGAGCAATGTAGTAGTAGTGGTAGCATGCAACCAAATCGAAATGGAATGAGAATTTTTTTGGCGTGATTT
TCTTTTTTTTCTCTTTCCTTTTTTTTTTTTACTTCTCCCAGCACAAATGCAATTCACCAGATCGTCCGATCAATGGA
GCAACCGGAGCGACACGGCGAGCTGGGGAGGACGATGACGAGGATGTCGTGGCGTCAAAAAGCCGCTTCAGGGCTTCCA
GATGATGGTGGTCTCGGCGATCATGGAGGTGACGACGTAAGGGTCCATGTTGGACGCCGGCCGGCGATCCTCGAAGTAG
CCCTTGCCGTTCTGCTCCGTCTCCCGGCCGACGCGGACCGAGGCGCCGCGGTTGGCAACTCCCCAGCTGAAGGTGTTGA
TGTCGGCGGTCTCGTGCCTGCCGGTGAGCCGGCGCTCG
```

FIG. 1 continued

> SEQ ID NO:220 129410 *Poppy*
GAATTCGAGTTTTGGAAAAAAGTTCCTGTAAGGGAACCATATCGTGTTATACTTAGTGATGTGAGGGATAAGCTGTATC
AGACTCGTGAGCGCTCTCGACATTTACTATCCAATGAAATTTCAGAGGTTCCAGAGGAGGCAACATATACAAATCTTGA
GCAGTTCTTAGAGCCTCTCGAGCTTTGTTACAGATCCCTTTGCTCTTGTGGTGATCGAGCAATTGCTGATGGTAGCCTT
CTTGATTTCTTACGTCAAGTTTCTACTTTTGGTCTCTCACTCGTGAGACTTGATATTAGGCAAGAATCAGATAGGCACA
CTGATGTCATAGATGCCATCACAAATCACCTGGGCATTGGTTCTTACAAAGAGTGGTCCGAGGAACGCCGTCAAGAGTG
GCTCCTCTCTGAACTCAGTGGAAAGCGACCACTTTTGGCCCTGATCTTCCAAAAACCGAAGAAATCGCTGATGTGTTG
GACACATTCCATGTCCTATCAGAACTCCCTTCTGACAACTTTGGTGCGTATATTATCTCAATGGCCACATCCCCATCAG
ATGTATTGGCTGTAGAGCTCCTACAACGTGAATGTCACGTGAAGAATCCCTTGAGAGTTGTACCGTTATTTGAAAAGCT
TGCGGATCTAGAAGCTGCTCCTGCTGCCATGGCTCGTCTTTTCTCTGTAGAATGGTACAGGAATAGAATAGAC > SEQ ID NO:221 129424 *Poppy*
GAATTCAATCAAATGGCTACTGCTAGAGTTTTGGCTGCTAGTATGTTGCATGAATGCAACAACACTCACAGTGCTTCAT
TTCTTTTGAGACAATCTTCTTTCATCTTACCTATTAAACATCAAAGTATTAATTTCAGTAGAAGAGCATCTTCTAGGAG
AGCTTTTACTTGCAAATCTCTTTACAAACCTGAAATTCAAATCAAACAAGAAGGTGAACCTCAAACCCTAGATTACAGA
GTCTTCTTTCATGATAAATCTGGCAAAAAGCTTTCACCTTGGCATGATGTACCATTGCAATTGGGTGATGGAGTGTTCA
ATTTTATCGTGGAAATACCAAAAGAGACAAGTGCAAAGATGGAAGTTGCAACTGATGAGCCATATACTCCCATTAAACA
GGACACCAAGAAGGGAAAACTTAGATTCTACCCCTACAACATCAATTGGAACTATGGATTGCTCCCACAGACATGGGAA
GACCCAACAGTAGCTAATTCTGAAGTTGAAGGGGCATTCGGAGATAATGATCCAGTTGATGTTGTTGAAATTGGGGAGA
GGCAAGGAAAATTGGCGAGATTCTTAAAGTCAAGCCTTTAGGTGCTTTGGCTATGATTGACGAAGGAGAACTCGACTG
GAAAATTGTTGCGATTTCGTTGGATGACCCAAAAGCTTCACTCGTCAATGATGTTGGTGATGTTG > SEQ ID NO:222 129491 *Poppy*
GAATTCAGAGTATACGGAGACGACGAAGAAGAAGGCGCGCGCCATCACCATGGCTGCAAACGCAACCCACCAATTCCTC
AAAATTCTATCTTCTAAAACCCTAAACCCTACATTATCATCACCATTAACTCAAATTCGAAAATTCCCAATTTCTCAAA
ACCCCAGAAAATATACTTCAGTTTTACAAGCTGCTGTGAACGATAATGTTAGTAGTAGTGGAGGTAGATCTGGAGGTCT
TTCATCACCTCCTCCTCCATCTGTGAATGAAATTTCTGAGAGAATTGATATTAATCCTCCTAAAGGAACTAGGGATTTT
CCTCCTGATGAAATGCGACTTCGGACTTGGCTTTTTCAGAATTTCAGAGAGGTTTCTCGATTGTTTGGGTTTGAAGAGA
TTGATTTTCCTGTACTTGAATCTGAAGCTCTTTATATTAGAAAAGCTGGGGAAGAAATTAGAGACCAGTTATATAGTTT
TGAGGATAGAGGGGGTCGTCGTGTTGCGTTGAGGCCGGAGCTTACTCCTTCTTTGGCAAGACTTGTGCTACAGAAAGGA
AAATCTTCTCCACTCCCATTCAAATGGTTCGCAATAGGACAGTGTTGGCGCTACGAACGTATGACTAGGGGACGTCGTC
GTGAGCATTACCAGTGGAATATGGA > SEQ ID NO:223 129584 *Poppy*
GAATTCACTGCAATTATTCTTGTTTGTTTTGTTCATCCCGCTTTTGGTCTGTTGGTACTCCTTCTGTCTCATGCTCTAT
ATTGTCATACAGCTCTCTGTAGGTACGTGCTTGGGCTTGTGCAAGTTTTCTTCCTAATGTGTAATGTGGCTGTCATGGT
TACACCTTTTCACCACGTCATACATCATCTGATTTATTACCAAATTTGTTGATGATTTATTACCATCTGATTCATAAAT
TTAAGTTTTACCCTACTAGCTGTCAAGCTCTTGATCCGCACTACACATAAGAAATGTATCATCTGATTTGTAACATAAT
ATGTTGCTTGTTTGGTGCATTATGTTTAGTTTTACACTACACGCCCTTGATCCTTGCTACCCACAATTTTAGTTTTTAG
AGTAGTTATGTAGGTTTAAAGGCTTGGTTTCTGTTTGAAGTTGATGACTTCTCATTTAAGCTATCACAATCCTTGGTTC
ACTGCTATATACTTGATTCATGATCGACCGGTTCACCACTTATTCATTTGTTTTGTGATTGGTAGAATTAATGTTAGTT
GAAGAGACGTGATTTATGGGAGGATGTGAGTGACATAGGTTGACCATTATACAATTGTGAAATTTGACT > SEQ ID NO:224 129725 *Poppy*
GAATTCGAAACCCAGTGAAGCACTTGGGAAACGAACACAATGTCTTTTTCGACAATCAAAATCATTCAACCTGTCCCAG
TTACTAGATCTCATGAAAAATCCATTCTTGACCCTTTAAAATCAAACAACAATTCCTTCTTGGGCACTACTAATAATCT
TCGTTCAATCTCATCCAAATCGAATTTCCCTTCATTTATTCGTCGATCTTCTTCAATTTCAGCTGTTTCTGATGTCGTT
AAGGAGAAAAAACTCAAATCTAACTCCGCCATCTCCAATTTGTTGATAACTAAAGAGGAAGGACTGGTATTATATGAAG
ATATGGTATTAGGGAGAGCATTTGAAGATATGTGTGCTCAGATGTATTACAGAGGTAAAATGTTTGGATTTGTTCATCT
TTACAATGGACAAGAAGCTGTTTCAACTGGATTTATTAAGCTATTGAAAAAGGAAGATTCTGTAGTTAGTACTTACCGT
GATCATGTTCATGCACTAAGTAAGGGTGTACCTGCTCGTCAAGTTATGAGTGAGCTCTTTGGTAAGGCTACTGGATGTT
GTCGTGGACAAGGAGGATCTATGCATATGTTTTCCAAAGAACATAATTTACTTGGTGGATTTGCGTTTATTGCT

FIG. 1 continued

> SEQ ID NO:225 129748 Poppy
GAATTCAATGGCTTCTTCAGTGATTTCCTCTGGTGCAGTCGCCTCCGTGAGGAGCTCTGCTCCCGCTCAAGCTAGCATG
GTTGCACCATTCAGCGGCTTGAAATCCGTTGCTGCATTCCCAGTTACCCGCAAATCAAACGACATCACCTCCGTTGCCA
GCAACGGTGGAAGAGTTAACTGCATGCAGGTGTGGCCACCAAGTGGTTTGAAGAAGTTTGAGACCCTCTCATACCTTCC
TCCATTGACCGTTGAGCAACTATCAAAGGAAGTCGATTACCTTCTCCGTAATGGATGGGTTCCCTGTTTGGAATTCGAC
GCCAGAGGATTCGTTTACAGAGAACACGGTAACACCCCTGGATACTATGATGGTCGTTACTGGACAATGTGGAAGCTGC
CCATGTTCGGTTGTACCGACGCTTCCCAGGTTATCAAGGAGCTAGAGGAGGCCAAGGCTGCATACCCAGACTCTTTCAT
CAGAATCATCGGATTCGACAACGTCCGTCAAGTACAATGTGTTAGTTTCATCGCATACAAGCCAGAGAGTACTGCCTAC
TGAAAACCTTTGATGGATTGTGTCTTTTTATTAATTTCTTCCCTGTTGGTTTGTACTTTTGGAGCTGGTCGCTAAT > SEQ ID NO:226 129753 Poppy
GAATTCACACACATCTTTTCCTTTCTCTCTCGGTGTTCGTTTTTCTCTCAAATCTCTAAATCAATGGCGTCCGAAGGTA
TTCTATTGGGTATGGGTAATCCCCTTCTTGATATCTCTGCTGTCGTCGATGAGCCTTTCCTTGAGAAATACGACATCAA
GTTGAACAATGCTATCCTTGCTGAGGAAAAGCATGTGCCTATGTACGATGAATTGGCTGCTAAAGACAATGTTGAGTAC
ATTGCTGGAGGTGCAACTCAAAATTCTATCAGAGTTGCTCAGTGGATGCTACAAACTCCTGGTGCCACTAGTTTCATTG
GTTGCATCGGAAAGGATAAATATGGTGAAGAGATGACGAAAAACTCAAAGCTTGCTGGTCTTAACGTTCACTACTACGA
GGATGAGACCGCAGCTACTGGTACATGCGCTGTTTGTGTTGTTGGTGGCGAGAGGTCTCTCATTGCCAACCTGGCCGCA
GCAAATTGCTACAAATCCGAACATTTACAGAAACCAGAAAACTGGGCTTTGGTTGAGAAGGCTAAATACTATTACATTG
CTGGATTTTTCCTCACTGTTTCCCCCGACTCCATTCAGCTTGT > SEQ ID NO:227 129764 Poppy
GAATTCAAGGAGTTCTCTACATCAGATGCAGGTGGGAAAGATTGTAAAGTTGAAAGCTTTTACAAAGTTTGAGAACACC
TCCGAGGCTTTGTCCACTGCTACTTTACTTATTGATAGCAAACCAAGCAAGGGTCTTCGTAAGTTCTTGAAGGCTCATT
GCGATGGTGAAACATTGGGAGTAGCTGATTCTAAACTAGGAAATGCCATCAAGGAGAAACTGCAAATTGATTGCGTCCA
TAACAATGGAGTAATGGAGCTGATGAGAGGTGTCAGAAGCCAGTTGACTGAACTCATTTCAGGCCTTGGTGTTCAAGAT
TTGGCTCCAATGAGTTTGGGTTTGTCTCACAGTTTGTCCAGATACAAGCTAAAGTTCAGCCCTGATAAGGTGGATACCA
TGATCATTCAAGCTATTGGTTTGTTGGATGATCTTGACAAAGAGCTTAATACATATGCGATGAGGGTTAGGGAATGGTA
TGGATGGCACTTTCCAGAGCTTGCAAAGATTGTATCAGACAATATCCTGTACGCCAAAGCAGTTAAGCTGATGGGCAAC
CGTACAAATGCCGCTGATCTTGATTTCTCT > SEQ ID NO:228 129833 Poppy
GAATTCAACAGAGGAAGAGAGAGAAAAAAGAGAGCTTTTATTTATTTCGCTGCTTCTTCTGTTTCTCCTTGTTTGATTC
TTTTCAAATCTCAAATTCCTCACTTATTCACTTACACACACACACTCTCTCTCTTTCTTGATTGTTGAACTCATCTC
TTGTTTCCTTAGCCGCCATGGATCTAGATCTGTGGATTACAAAGGTTAAAGAAGGTCAACATTTAATGGAGAACGAACT
TCAACTTCTTTGTGAATATGTGAAGGATATCCTCATCGAGGAATCTAATGTTCAACCTGTAAATAGCCCAGTCACTGTT
TGCGGTGACATCCATGGCCAGTTTCATGATCTTTACAGAAACTTCCAGACTGGCGGTCATGTACCAGAAACTAATTATA
TATTTATGGGCGATTTCGTGGATCGTGGATATAACAGTCTTGAAGTCTTCACTATTCTTTTGCTTCTAAAGGCAAGATA
TCCTGCACATATTACTCTATTGCGTGGAAATCATGAAAGCAGGCAATTGACTCAGGTTTACGGTTTTTATGACGAGTGC
CAAAGGAAATATGGTAATGCTAATGCCTGGAGATATTGCACTGATGTATTTGACTATCTCACACTCTCAGCTATTATAG
ATGGAACTGTTCT > SEQ ID NO:229 129848 Poppy
GAATTCAAGGATACTTCCTCCCTATCTTCCGGGGGTTCAATCGAATTACTTCAAGATAAGTTGTCAATGGCATCCCAGC
TAGTCCGTGAATGGATCGGTATTAAACAGTTCCCTGCCTGCCACACAGACTAAATCGTTCGAGTTACTTGGGAAACTAA
AGCAAGAGGAAGTGAGCACGTTGACAATCCTTGTAATGGGGAAAGGTGGAGTTGGAAAATCTTCCACTGTGAATTCCCT
TGTTGGAGAACGAGTTGTAGCTGTCAGTGCATTCCAGTCCGAAGCATCACGACCTGTTATGGTATCACGATCAAGGGCA
GGGTTCACATTGAACATCATTGACACCCCTGGGCTTATAGAAGGAGGATATGTCAATGATCAAGCTCTTGAGATTATAA
AACGGTTTCTTCTGAACAAGACGATCGATGTTTTGCTCCTATGTACACCGCTTGGATGCCTATAGAGTGGATAATTTGG
ATAGACAAATTATTAAGGCCATTACTGAT > SEQ ID NO:230 129932 Poppy
GAATTCAAGGCTTACGGTGGATACCTAGGCACCGGGAGACGAGGAAGGGCGTATCAAGCGACGAAATGCTTCGGGGAGT
TGAAAATAAGCATAGATCCGGAGATTCCCGAATAGGTCAACCTTTCGAACTGCTGCTGAATCCATGGGCAGGCAAGAGA

FIG. 1 continued

CAACCTGGCGAACTGAAACATCTTAGTAGCCAGAGGAAAGGAAAGCAAAAGCGATTCCCGTAGTAGCGGCGAGCGAAAT
GGGAGCAGCCTAAACCGTGAAAACGGGGTTGTGGGAGAGCAATACAAGCGTCGTGCTGCTAGGCGAAGCGGTGGAGTGC
TGCACCCTAGATGGTGAGAGTCCAGTAGCCGAAAGCTTCTCATCTTCTCAAGTACGATTCTACCCTCGGCATTTTTGAT
GCTGATGTCAAGCCTGTTGGTGACGATGCTATCTCTGTTGATGGCAAGATCATCAAGGTAGTCTCCAGCCGTAACCCCC
TCGACCTCCCCTGGGGGGATATGGAGGTGGATCTAGTTATTGAAGGGACAGGAGTGTTTGTGGACAGAGAAGGTGCAGG
GAAACACATACAGGCAGGTGCTAAGAAGGTGTTGATCACAGCACCTGGTAAAGGTGACATTCCCACTTACGTTATTGGT
GTCAACCAAAAACTTTACACCCACGCCGATACAATCATCAGCAATGCT

> SEQ ID NO:231 130172 Poppy
GATCCGAGAAGAGAAAATCAATGGAAGCCATGGCTGGTGTCGGTGGAAGTTCATGTGTTATCTCGTCTATTCATTCATC
ATCCCGTAGAAATGGAGCCTTATCTTTATCTTACTCTTCTCAAAATCTTACCTTGCGCAACACTAATCATCTTGCAGCA
TTTCGTTCATCTTCTTCACTTTTATCATTTTCTCATGTTAAAATACATTCCAAGAAAAATAAACCCCATATCTTCCTTC
CTCACTTGGTTGCTTCCATGGAACAAGTTGATGAAACTTATATTATGATTAAGCCAGATGGAGTTCAACGTGGGCTGGT
TGGAGAAATAATTTCTAGGTTTGAAAAGAAAGGGTTTAAATTGACTGGTTTGAAGCTATTTCAATGTCCTAAAGAATTA
GCAGAGGAGCATTACAAAGATCTAAGTTCGAAGCCGTTCTTCCCTAGCCTCATCGAGTACATTACTTCCGGCCCAGTTG
TTTGTATGGCATGGGAGGGTGTCGGTGTTGTTCCATCAGCACGTAAGCTTATAGGGCAACAAATCCTCTCCAAGCCGA
ACCAGGCACCATTAGAGGGGATTTAGCTGTTCAAACAGGAAGGAACGTCGTTCATGGAAGTGACAGTCCTGAGAATGGC
GAGCGTGAAATTG > SEQ ID NO:232 130212 Poppy
GAATTCACCAACTCCCATCTAATCCCAAATCCCGGCACTAAAATTATTTTTTTAGTGAGAGAAATCTTTTTTTGGGGTT
GAGAGGAGAGAGAGAGACACACAGAGAAAAATGGCGATGGCAATGGCACTTCGTAGGCTCTCATCTTCTTCAATCAAC
AAACCTATCCGTCCTCTCTTCAATGCCGATTCCTACTATTGCATGTCATCTCTTCCAAGTGAAGCTGTTGATGATTCTA
AGGATAAATCTCGTGTTCAATGGCCAAAGCAATTGAATGCACCATTAGCAGAAGTGGATCCAGAGATTGCTGACATTAT
TGAGCTTGAGAAAGCTAGGCAATGGAAGGGTCTGGAATTGATTCCTTCAGAGAATTTCACATCTGTGTCGGTCATGGAA
GCTGTTGGTTCTATCATGACTAACAAATACAGTGAAGGTTATCCTGGTGCTAGATACTATGGAGGAAACGAGTACATTG
ATATGGCAGAAACTTTGTGCCAGAAACGTGCCTTGGAGGCTTTCCGTTTGGATCCTGCTAAATGGGGAGTTAACGTGCA
ATCTTTGTCTGGGTCCCCTGCCAATTTCCAAGTCTACACTGCACTATTGAAGCCCCACGAGAGAATTATGGCACTTGAC
CTTCCACATGGTGGGCATCTTTCTCATGGGTATCAGACTGACACCAAAAGATATCT > SEQ ID NO:233 130426 Poppy
GCGACGAATTCAAGTGAAGGCAGCCCATTCCTACCTCTGAGCCCTGAAACACCATTCTTGTCTGTGTCTGAATTTCACT
CTAATCTCTGTATAATCATGGCGATTACAACACCATTATCACAATCAAATCTCTATTCAACAAACAATACAATCATCAA
AACACCAAGACTGATTCATCAAATTCAATCCAATTCAATTTCATTGAATTTGAGGAACCCAAGCTTCCAAAACGAGTTG
TGGGGGAATAGGAATTGTTCTCTGGTTGTTCAGAGGGGGTAGCGGCATCTGTGATTACAGCAACTGCTGCTGCTGAGA
AACAGAAGAAGAGGTATCCTGGTGAAGGGAAAGGTTTGTGGAAGAAATGAGATTTGTAGCTATGAAATTACATACAAA
AGATCAAGCTAAAGAAGGTGAGAAGGAATCTCAAGCGCAACCTTTGGGGAGATGGGAACCTTCTATTGAGGGTATATT
CAATTTCTTGTTGATAGCAAGTGTGTTTATCATACTCTTGAGAGTATTGTTGATAAAGCTGCTGTTCCTTCATATGCTG
AGTTCAGAAATACAGGATTGGAACGGGCAGGAGCATTGGCTAAAGATCTGGAGTGGTTTAAAG > SEQ ID NO:234 130430 Poppy
GAATTCAGGAGAGAGAAACTAAAACCCCCACCAGGAAAAAACAAGAAAAAAAAAAATGGCCGTCTCAGCAGGATGTGCT
AGGGTTCTACCGGTTTTTGAATGTAGATCAGATCCAGATTTCTCTACAAACCAGAACCAGCAGAAATCAAGTTCCAGAT
TCATTTCTGGATCTTTCAATGGTGGTGGTGGGTTATATTCATCATTGATTCTGCGGTTTCCTCCTAATTTCGTGAGGCA
ATTGAGTATTAAAGCAAGAAGGAATTGTAGCAATATTGGTGTAGCACAAGTTGTTGCTGCTTCCTGGTCAAACAATGAC
AATACCAACAAGAAGGTTCCTAATGTATCTGCTGTCGATTCTGCTTCTGCTGCTTCTGAGATTGAAGAAATTCCTTTGA
TTGATGATGAAGTTGTGGATGCTGGGGTTGATGGTGGTGATATTTGTAATAATAATGGTGTACAGTTGTCTGGTTTGGC
CGCTTTAAAGGCCTCATTTTTACGCTCCGATGGGAGCATCACAGTTCATGCAGGAGAATGATTAGGTCGTGGAATTGCT
ACAGATGGAATCACTACCCCAGTCGTCAATACTTCTGCTTATTGGTTCAAGAACTCCAATGAA > SEQ ID NO:235 130438 Poppy
GAATTCAACAATGGGTAGTCTTCCAACTAATAACGGTGAAAGCATGTCAATATGTTCACAGAACCCACTTGATCCATAT
GAATTCAGAAGGCAAGGTCACATGATAATTGATTTTCTTGCCGATTACTACAAAAATGTTGAGAGTTATCCTGTCAGGA
GTCAAGTCGAACCTGGTTACTTGCGGAAACGATTACCCGAATCAGCTCCAAACAACTCTGAATCCATTGAAACCATTCT

FIG. 1 continued

```
CCAAGATGTCACAAACGATATCATCCCGGGTCTTACTCATTGGCAGAGTCCAAATTACTTTGCTTATTTTCCTTCTAGT
GGTTCCATTGCTGGGTTCCTTGGTGAAATGCTTAGTACTGGGTTTAATGTTGTTGGTTTCAATTGGATGTCTTCACCAG
CTGCAACTGAGTTGGAAAGTATTGTTATGAATTGGCTCGGTCAAATGCTTACACTTCCCAAATCGTTTCTCTTCTCGTC
AGATGGAAGTTCAGGAGGAGGAGGTGTTCTACAAGGCACTACTTGTGAAGCCATTTTATGTACACTAACTGCGGCAAGA
GATAAAATGTTGAACAAAATCGGCAGAGAAATATTAACAAGCTAGTTGTCTATGCTTCTGA

> SEQ ID NO:236    130492 Poppy
GAATTCACCTAACCAACCAGCACTAAAGATCTTCGTCCATCCCTTTGTTGAATTCATTTGTCTCTCTGTTTCACACCTT
GAAAGTTTGAAGTAGAATCTATCTATCAATGGCAACAGTCATGGCAAAGATTGCACCTTCAATGCTCTCATCTGATTTT
GCAAATTTAGCTTCTGAAGCTGAAAAAATGATCAAATTTGGCGCTGATTGGCTTCACATGGACATCATGGATGGCCATT
TTGTCCCAAATCTTACCATCGGAGCACCGGTAATTGAAGGTTTAAGGAAGCACACGAAGGCATATCTAGACTGTCATCT
TATGGTCACAAATCCTCTTGATTATGTGGAACCTCTAGGAAAGGCTGGTGCTTCAGGTTATACTTTTCATGTGGAGGCG
TCGAAAGATGATTGGCAAGAAATTATCGACAAAGTCAAGGCAAAGGGCATGCGTGCTGGGGTTGCACTGAAGCCTGGAA
CTCCAATCGAAGAAGTTTATCCACTGGTTGAAGCTAAAAACCCTGTTGACATGGTCCTTGTCATGACAGTTGAACCTGG
ATTTGGAGGTCAAAAGTTCATGCCAGAGATGATGGATAAGGTTCGTGCATTGA > SEQ ID NO:237    130504 Poppy
TCGCTAATTTTAATAACGCCTTTAATAATGTCGCGTTTGGGGGTAACTGACTCTTCAAATGCCTGTTGTACATCCCGAT
AATCGTAAATATGCGTCACCATCGATTTCACATCGAATCGCCCTGAAGAAATAGCTTCAATCGTGACCGGATAACGATT
GGCATAGCGGAATACCGTCTGGATAGTGACTTCGCGATTGATTTTGAGGAAATTGATTGCCGAATCGCCGGGTACAGTA
CCAACAATCATAATTTTACCGCCGCGCATTACCAGATAAGGTGCCTGTTTAACGGTGACCGCAGAACCCGCTGTTTCGA
AAACAATATCTGCGCCCATGTCTTCGGTAAATTGCTGACAGCGTGCAATAGTGTCTTCTTTTGCGCCGTTAATAACCAC
TGTCGCACCAAGCTGTTCCGCCATTGCCAGACGTTTTTCCAGCACATCAACGACGGCAATTTCCGTTGCTCCCAGGCAT
TTGCACGCTTGCAACGTCATCAAACCAATACAACCTGCTCCCAGAATAATTATCTTCTTACCCGGTTTAACATCTGCCA
GCATCGCGGCATGCATCCCGACTGCGGCAGGCTCCACCAGCGCCCCTT > SEQ ID NO:238    130569 Poppy
GAATTCGATCAACATCTTTTAGAATCCTTCTTGAGCGAATAAATTTCTATGGAAAAATGGAGCATCCTGTAGTAGTGTT
TAGTAATGATTTTCAGACCTTCCTATATAATTCGCATTCATATACATGAGAATTATATAGGAAGAAGAAAAAGCGTTGA
TTCTCCTTTGAAAAAAGGGAAATTGCTTTATTTTGAGTAATAAGACTATAGCAATTACGATACTCATGGAGAAAGAATC
GCAATAAATGCAAAGAGGGAACATCCTGTAGTAGTGTTTAGTAATGATTTTCAGACCTTCCTATGGTTGTTCAAGGATC
CTTTTATGCATTATGTCAGATATCAAGGAAATCAATTCTGGCTTCAAAGGGAAGTACTCTTTTGATGAATAAATGGAA
ATGGAATCTTGTAAATTTATGGCAATGTCATTTTTCCTTGTGGTCTCAACCAGATAGAATTAAGATAAATAAATTATCC
AATCATTCCCTCGAGCTTTTGAGCTATCTTGCAAGTGTACGACTTAACCCTTCGGTGGTAAGGAGTCAAATGATAGAAA
GTACATTTATAATGGATATTTGTATTAAGAAGTTTGATACCAAAGTCCCAATTATTTCTTTGGTTGGGTCGTTGG > SEQ ID NO:239    130646 Poppy
GAATTCAGGAGAAAAACCAGAAACTGGTTTCATCGTGAGTGATGGCAAACATGATCATGGCTTCCTCATCTAAAACCCT
AATCACATCTCCTTCAATCCAATCAACACCAAAATTCCAACTTCCCCAATTCACAACCCTAAGAATCAGAAGCCAAGCC
AATCAAACCAGCACCAGCAGCAACAAAATCAAACTCCCAACTCTAAACCTAAACTCACTCAAATCAACAGCAGCAATTG
CAGCAGCAGTTCTAACAATGGCTCCACCATCACTAGCAGCAGAAATTGAGAAAGCAGCATTGTTTGATTTCAATCTTAC
TCTACCACTAATCATGGCAGAATTTCTCATACTTATGTTTGCCTTAGACAAGATTTACTACACTCCATTGGGTAACTTT
ATGGATGCAAGAGATGCAGATATTAGAGGGAAATTGAACAGTGTTAAAGATACGTCTAGTGAAGTCAAGGAATTGGATG
AACAAGCTGCTGCTATCATGAGAGCAGCTAGAGCTGAAATTGCTGCTGCTTTGAACCAGATGAAGAAAGAAACAACTGT
GGAAGTTGAAGCACAGATGGCTGAAGGAAGGAAGAAATTGGAAGCTGAATTGGCTGAAGCTCTTGGTAATTTGGAG > SEQ ID NO:240    130653 Poppy
GAATTCAAGGAGAAAGGGGATCTCCTTGTCTTATGGGTCTTGTTGGGTTGAAAGAATCACAAGGAGATCCATTAAGAAG
TACAGACAAAGATGTTGTACTTATACATTGATGAATTAAGTGACACCAGTCTTCACTAAAACCAAAACTAGTAAGGATT
TTCATGATAAATGGCCATTCTAGTCTATCAAAAGCTTTGGACATGTCAAGCTTGAGGGCTAACCATCCACTTTCACCTT
GTTTTCTCTTCATTGAATGAATTAATTCATGGGCAATGATTGTGTTATCATTTATCATTCTGCCAGAGACATAAGCAGC
TTGATAAGGAGAAATGATAGAGTTCATGAAAGGCTTCATTCTATTGACAAGGATTTTGAGATTATCTTGTAAGAGGTA
TTGCAAAGGCCAATTGGCCTGAATTCAGATGGAGAAGTTGGCTTACTTTTCTTTGGAATTAAGGAGATGAAAGTCTTGT
TAATTTTAGATGGAAGATATTTAGCATGGAAAAATCTTTTAACCATTTCACAACAGTCAGGGCCCACAGTTTGCCATTG
```

FIG. 1 continued

TGATTTGTAGAAACCAGCTTGAAATCCTTCTGGTCCAGGTGCAGACCAATTTTCCATGCCTTTGAGAGTTTTTAAGACT
TCATCATCTGAGGGGAGAGCCATCAACCTTATATTATCTTCATCTGTAATTACAGAAGGAAGAACAGAATAATGATGTT
CTTCAATAACTGGTG

> SEQ ID NO:241 130680 Poppy
GATCCAAAATAAAAAGAGAAGCAGCACTGAGAAGAGAAGAGCGAGAAACCAACAAAAAAATGGCTCTGACACTCAATCC
TCTAACATTTCAATCTCCTCAAAAGCTTCCAACTTTTGGTTTCCCAAATGTTGCCAATGTCAGATCTCCTAAAGTTTTC
ATGGCTTCCACTCTCCGCACCTCCGCTAAGGAGACGGAGAATGCCAAGAAACCCTTCACCCCTCCACGCGAGGCGCATG
TTCAAGTAACCCACTCTATGCCACCTCAAAAGATTGAGATTTTCAAGGGCTTAGAAGACTGGGCAGATGACAATATCTT
GGTACACTTGAAGCCTGTTGAGAAATGTTGGCAACCACAACATTTCCTACCTGACCCAGCCTCAGATGGGTTCTATGAT
CAAGTCAAGGAGCTGACAGAGAGAGCAAAGGAGATCCCCGATGATTACTTTGTTTGTCTGGTTGGGGATATGATCACAG
AGGAAGCCCTTCCAACATATCAAACTATGCTCAACACTTTGGATGGAGTCACAGATGAAACAGGCGCAAGCCCCACTTC
TTGGGCTCGTTGGACAAGGGCTTGGACTGCT > SEQ ID NO:242 130712 Poppy
GAATTCAGAGAAAAACAGAGAGCTAGATAGATAAGGTGTCATTGTTAATTCATCATATTCATTCGTCAAATATGTCTCT
TCTAACAGATCTTATCAACTTAGATCTCTCAGACAAAACTGAGAAGATCATCGCTGAATACATATGGATCGGTGGATCT
GGTATGGACCTTCGAAGCAAAGGAAGGACATTACCTGGACCTGTTAGTGATCCTTCAAAGCTACCAAAATGGAACTACG
ATGGTTCTAGCACTGGACAAGCTCCAGGAGAAGATAGTGAAGTCATCCTATATCCTCAGGCTATCTTCAAAGACCCATT
CAGGAGGGGAAACAACATTCTTGTTATGTGTGATGCTTACACTCCACAAGGAGAACCAATCCCAACTAACAAGAGATGC
GCTGCTGCAAAGATCTTCAGCAATCCTATTGTTGAGAAAGAAGTTCCATGGTACGGAATTGAGCAAGAATACACCCTCT
TGCAGAAGGATATTAACTGGCCTCTTGGATGGCCCCAGGGAGGCTTTCCTGGACCACAGGGACCTTACTACTGCGGTAC
TGGTGCGGACAAGGCATTCGGACGTGACATTGTTGATGCCCATTACAAAGCCTGTCTCTATGCAGGAATTAACATCAGT
GGAATCAACGGAGAAGTTATGCCCGGACAGTGGGAATTCC > SEQ ID NO:243 130722 Poppy
AACAACGCAACAATGGGGGCCTCATTAGGAGCTCCAAGAGCCACAACTTTTTCATCAAAAACTCTAATAAATCTCTGCA
GAAGAGTACCAATTTTCCTTCCACGTAGATCATTTCATTCCTCTACTCAATTCCAAACCCTAAAATTCATTCCCAATAC
TTACAGAGAACGTCGTTCCAGTGTTAGAGCTGAGACTCCATCAGAAAACGGTGGTGTAAATTACGATTATGACCTATTT
ACAATCGGTGCTGGTAGTGGTGGTGTTCGTGCTTCTCGTTTCGCTTCTAATTTTGGTGCTTCTGTTGCTGTCTGTGAGC
TCCCTTTTAACACTATCTCTTCTGATACTGCTGGTGGCGTTGGTGGAACGTGTGTACTTCGTGGGTGTGTACCAAAGAA
ATTGCTCGTCTACGCCTCCAAATATTCACATGATTTTGATGATAGTTGTGGGTTTGGTTGGAAATATGAATCGGACCCA
GTTCATGATTGGGGAACATTGATGGCTAATAAGAATGCTGAGTTACAGCGTCTTACTGGAATTTACAAGAATATATTGA
AAAATGCTAATGTGGCCTTAATCGAAGGGCGTGGAAAGATTGTGGATCCTCACACTGTTGATGTGGATGGGAAGCTGTA
TAAAGCAAGGCACATTCTTATATCAGTTGGAGGAAGGCCTTTTATTCCTGATATACCTGGAAAGGAGTATGCTATTGAT
TCTGATGCTGCACTTGA > SEQ ID NO:244 130792 Poppy
GAATTCGAAGCTAATCAAAGAATTGCGAGGATTGCGAGCTCATCTTCACCCTTCTAATCTCCAGATGGAGGGAAGTTCT
GGTTTGAGACGGGCAGATTGCCGAGCAAAAGGTAGTGCACCAGGGTTTAAAGTTGCTATCTTGGGTGCTGCTGGAGGGA
TTGGTCAACCTCTTGCATTGTTGATGAAGATGAACCCATTGGTATCAGTTCTCCATCTCTACGATGTTGTCAATGCTCC
TGGTGTCACCGCCGATGTTAGTCACATGGACACTGGTGCTGTGGTACGAGGTTTTCTTGGGCAGCCACAACTTGAGAAT
GCACTAACAGGGATGGATCTTGTAATCATTCCTGCTGGTGTTCCTAGGAAACCAGGAATGACAAGAGATGATTTGTTCA
AGATCAATGCTGGAATTGTTAGAACTCTAGCTGAAGGCATTGCCAAGTGCTGTCCTAATGCTATTGTGAACTTGATCAG
CAATCCAGTAAATTCAACTGTTCCTATAGCAGCTGAGGTTTTCAAGAAGGCAGGCACCTTTGATCCTAAGAAGCTTCTC
GGAGTCACAACTCTTGATGTTGTCAGGGCTAACACTTTTGTGGCAGAAGTTTTAGGGGTTGATCCTTAAGAAGTTAATG
TTCCCGTAGTTGGGGGTCATGCAGGAGTTACAATTTTACCTCTTCTATCACAGGTTAACCCCCCCTAAATGAGTATG > SEQ ID NO:245 130826 Poppy
GAATTCAATAGTGATGGCAGCAACAGCAACATCAGTGTGGAGGATTAGTTCCAACACATTCATCATCAGTTGTTAACAA
AAATACAACATGTTCTTGAAATCTTCGAATCACCAATCCCTCTCATCTTCATCTTCTTCTCATGTTTCTAGTGATCAA
CTTTCACTAAGAACTGTTTTAATAACACAAAAATCTCCACATCCGGTGGAAGAAGAAGAATTCCGTTTGTTGTTTCTC
CCAAAGCTGTTTCTGATTCCAAGAATTCACAAACTTGTCTTGATCCAGATGCTAGCAGAAGTGTTTTGGGAATTATACT
TGGGGGTGGAGCTGGGACACGGTTATACCCTCTTACAAAGAAGAGAGCAAAGCCTGCTGTTCCACTGGGAGCAAATTAC

FIG. 1 continued

AGGCTGATTGATATCCCTGTTAGCAACTGCTTGAACAGTAACATATCGAAAATATATGTTCTTACGCAATTCAATTCTG
CCTCGCTGAATCGTCATCTTTCTCGGGCATATGCTAGTAACATGGGTGGAAAAATGAAGGTTTTGTTGAAGTCCTTGCT
GCTCAGCAGAGTCCAGAGAATCCGAATTGGTTTCAGGGCACAGCTGATGCTGTGAGGCAGTATTTATGGTTGTTTGAGG
AACACAATGTTATGGAGTACCTTATTCTAGCTG

> SEQ ID NO:246 130864 Poppy
GAATTCAGAGGAGAAAAACAAGAGGCGGCGATAATGGGGCTTCAAGGTCAGCAGACTGTGAGTTACCCTAGTTTCAAAC
TAGTTATTGTTGGTGATGGAGGAACTGGAAAGACTACTTTTGTGAAGAGACATCTTACTGGTGAATTTGAGAAGAAATA
CGAACCCACTATTGGTGTTGAAGTTCATCCTTTGGATTTCCACACTAACTGTGGACCTATTAGGTTTTACTGTTGGGAT
ACTGCCGGACAGGAGAAATTCGGTGGGCTTAGAGATGGATATTATATCCATGGACAGTGTGCTATAATTATGTTTGATG
TCACTGCTCGTTTGACCTACAAGAATGTCCCTACATGGCACAGAGATCTCTGCAGGGTGTGTGAAAATATCCCTATTGT
TCTTTGTGGAAACAAGGTTGATGTCAAGAACAGGCAAGTGAAAGCAAAGCAAGTTACTTTCCACAGGAAGAAGAACCTG
CAGTACTATGAGATTTCTGCAAAGAGTAACTACAACTTTGAGAAGCCTTTCTTGTATCTCGCCAGGAAGCTTGCTGGTG
ATGCCAATCTCCACTTTGTTGAGTCACCTGCACTTGTTCC > SEQ ID NO:247 130866 Poppy
GAATTCAAGAACATGGTTTGCGAAACTTACCACGTGTGCTTATTCGAAAAGGTTTTTTATGTTAATTCTCTTCGTCTTC
TTTCTCATCTTTATGATCGGTGGAGATCCAGAAAGTAGACGCTTGTGCAGAAGAGAATTTCCAGTTGGTTATGGCCTGC
GCCTCTATTTTCATTGCGCTTTATTTTTGTCCTTGTATCTTGTTTTACAGTTGTTTCATCTACACTTGACAGTGATGAA
CAACAGATGGTTGTTCCAAATACCCATGTTGTGGTAATAAAGTATCGAATTTCTGGATTCTCATTTCAACAAACATGTT
CTTGTCACCTTATCAACACAATCAAATTCCAGTACTAGCAAAAACCAGTCAATCTTGGGCTTCTAGTGTAATGGGCCGT
TTAAATTTCTATTTTTTTTACTTTTTTTTTATAAAGTAAGTGAAGTAACCCTCCTACTTCAACAAAATATTCCACTTA
TGGAACTGTTAAATGCCAGGATACCAAAAGCAGAAGTTGGTTTTTTTTTTTTGCATATAAAAGTCGTTCCGAAATTAT
ATACCTATAAACTAATTTACTGTTTGTTAACTTTTAGAAGTTAAAAGAACTATTTCAGGGAGTGTATCAAAAAACGCCA
TAAAAACAATTCTGGAA > SEQ ID NO:248 130870 Poppy
GAATTCGCTCTATCACATTCTTCTTCATAATTTCTGGTATTACGAACTTGCTCTCGTCTTCTTATCCTGTTGTCATGGT
TATTCTGCCGAATTGCTTCCTCTATTTCCAATCCTTCCATCTGCAACCTTATTCTTTCTCTTTCGCGAGCATCTCGAGC
TCTTACTTGACCATGTTCAGTTTCCTCTATTTGTGGATTTCTTTGATTCTCAACTTCTTCTCCATTTTGCCTTCCATTC
TCACGATTTTCTTCATTGTTTTGTTGATTTCTTCTCTTTCGTGCTTCATTTCGCAAGCTTTCTGCGTTATGTTCTTGGT
TAGGAAGGAGAATGAATCTATTTTCTGGATTTCTTTCTCCTACTCCTTGTGTTTGACCTTGAACTGCATTCCCATTTTC
CTGAGGATCTCGTCCTTCTCTTTCTGATCTTGCACTTGATCTTGTGATGCTTTGTGATCTCCTGCTCTGCAACATCTCA
TTCTCCCTCCTTAGTTCGTGATTTTCTCTAGTAAGATTTGCACGTGCTTCTGCTTCTCTTCTTCGTTCTTCTAGAAATC
TTTCGTTTTGTGCTTGTAATGTTTCCCTTTCTCTGTTATGAGTAACTCTTCCAAGTAATCTTCCGCTTTCATCTATTTG
TACTTCCCTTTCTGCTCTTGAAAGTGAATCTGA > SEQ ID NO:249 130930 Poppy
GAATTCAAACCTTGGAGGAGTCCAATGCGAATTTGGATGAAGTGGTCGCTTTGGCAAAAGAGCTTCAGGGAAACAAAAT
CCATCCTTTGTGGGGCACAGCTCAGTTGTTCATGCATCCTCGCTACATGCATGGTGCTGCTACTAGCTCCGATGTAGGT
GTCTATGCTTATGCCGCAGCCCAAGTCAAGAAAGCCATGGAGGTCACACATTATCTTGGTGGTGAAAATTACGTCTTCT
GGGGTGGTCGCGAGGGTTATCAAACTTTATTGAACACTGATATGAAAAGAGAGCTTGATCATTTGGCAAGATTTTGGA
AGGTGCTGTTGCCTGGAAGAAAAAGATTGGATTCAAAGGGACTTTACTGATCGAGCCAAAGCCTCAAGAACCAACTAAG
CACCAGTATGACTGGGATGCGGCAACTACAGCTGCATTTCTACTAAAATATGGACTTTCTGGTGAATTCAAACTCAACA
TTGAGTGCAACCATGCTACACTTTCTGGTCACAGCTGCCACCATGAGCTTGAGACCGCCAGAAATTTTGGGATGCTTGG
AAACATTGATGCAAACACTGGAGATCCTCAGATTGGATGGGATACTGATCAGTTCCTTACTGACATT > SEQ ID NO:250 131046 Poppy
GAATTCACAAAACATTTCCCTTCCTTCTCTCTCCCGAAACACACAAAAAAAGAAAATGGCAGCTCTGCAACAATCCCCA
GTTGCATTCCAATCAAAATTCCCCACCACCACATCCTCATCATCAACCAGAGTATTTGCCAAAACTCAAATCTCCAGCA
AACTCTCATCCACAGGACTCAGACTCCCAAAACTGAGCATAAAACTCTCAAAGAAGAACAAAATCAGCAACAACCATGG
TGGTGCAACAATGTTAGACACAGCAGCAAGTAGATATGCAACAGCCTTAGCACAATCAGCAAACTCAAATGGAACATTA
GAAGCAACACAACAAGACATTGAAAAGATTGAAAAAATCTTCACATCACCAGAAGTTTATGATTTCTTTGTCAATCCAA
CAGTTGCTGTGGAGAAGAAATACTCATTGATCGATGAAATTGCAAAATCATCAAACCTCAAAACAACTACAATCAATTT

FIG. 1 continued

CTTGAATATCTTAGTTGATGTCAAGAGAATTGATTTGATTAGAGAAGTTGTGAAGGAATTTGAGTTGGTTTTTAATGCA
ATGACTGATACTGAATTGGCTGTTGTTACATCTGTTGTGAAGCTGGAAGCTAATCATTTAGCACAGATTGCTAAAGGAG
TCCAGAGATTGACAAATTCTAAGAATGTTAGGATTAAGACTGTGATTGGTCCTTCTCTTGTTGCTGGGTTTACAATCAG
GTATGGGAATTCTGGGTCTAAATTGATTGATATGAGTGTTA

> SEQ ID NO:251 131104 Poppy
AACAACGCATTGCGATGGTCCCTGCGGATGCTAACGCAATGGGATTTCTGCCCAGTGCTCTGAATGTCAAAGTGAAGAA
ATTCAACCAAGCGCGGGTAAACGGCGGGAGTAACTATGACTCTCTTAAGGTAGCCAAATGCCTCGTCATCTAATTAGTG
ACGCGCATGAATGGATTAACGAGATTCCCACTGTCCCTGTCTACTATCCAGCGAAACCACAGCCAAGGGAACGGGCTTG
GCAGAATCAGCGGGGAAAGAAGACCCTGTTGAGCTTGACTCTAGTCCGACTTTGTGAAATGACTTGAGAGGTGTAGGAT
AAGTGGGAGCCGTCTTTGGCGGCGAAGGTGAAATACCACTACTTTTAACGTTATTTTACTTATTCCGTGAGGCGGAAGC
GGGGCATCGCCCCTCTTTTAGATCCAAGGCTAGCTTGCTATGCCGATCCGGGCGGAAGACATTGTCAGGTGGGGAGTT
TGGCTGGGGCGGCACATCTGTTAAAAGATAACGCAGGTGTCCTAAGATGAGCTCAACGAGAACAGAAATCTCGTGTGGA
ACAAAAGGGTAAAAGCTCGTTTGATTCTGATTTCCAGTACGAATACAAACCGTGAAAGCGTGGCCTATCGA > SEQ ID NO:252 131281 Poppy
GAATTCCAAAACCTCACTCTCATCGATATAAGCAAGACCACCTTGAGCACGAATATCTGCTGGTACACGTTCTAATGCC
ATGACAGCACAAGCACCTGCTTCTTCAGCGATTCTGGCTTGTTCTGCATTAACAACATCCATGATTACTCCTCCTCTAA
GCATCTGTGCTAATCCTACTTTAACAGAGAATGGTGAGGTTTTGCCTCTGTTATTGCTCCATTTCCATATACTGTTAC
TATTCCTGTCATGGCTAAAGCTCGAATTGGTCATTTCGTTGAAGCTCAGATTCTTGAAGCGATTGGTGTTGATTATATC
GATGAGAGTGAGGTTTTGACCCTTGCTGATGAAGAACATCATATTAACAAGCATAATTTCAGGATTCCATTTGTTTGTG
GTTGTCGTAATCTTGGGGAAGTCCAAGGAGGATTCGGAAGGTGCGGCCATGATTCGAACAAAAGGTGAAGCTGGAAC
TGGTAATGTTGTTGAAGCTGTTAAGCATGTGAGGTCTGTCATGGGTGATATTAGGCTTTTGCGTAATATGGATGATGAT
GAGGTGTTGTCATATGCAAAGAAAATTGCTGCTCCTTATGATTGGGCTATGCAAACTAAACA > SEQ ID NO:253 131313 Poppy
GAATTCACAAGGAAAGAAAGTATTTGTTAGAGTTGAGTTGAATGTACCATTGGATGATAATTCTAATATCACTGATGAT
ACCAGAGTTAGAGCTGCTGTTCCTACTATTCAATACCTAATTAGTCATGGTGCTAGAGTTATTCTATCTTCCCATCTTG
GACGCCCAAAGGGCGTTACACCAAAGTACAGCTTGAAGCCACTTGTGCCCAGACTATCAGAGCTTATTGGTATCAAGGT
TGAGATGGCAAACGACTGTATTGGAGAGGAAGTTGAGAAGATGGTTGCTGCTATCCCTAATGGAGGTGTTCTACTTCTT
GAGAACGTCAGATTCTACAAGGAGGAAGAGAAGAATGACCCAGAGTTCGCACACAAGTTAGCTTCCCTTGCTGACCTAT
ATGTCAATGATGCTTTCGGAACTGCCCACAGAGCCCATGCCTCCACTGAGGGAGTTACCAAGTTCTTGAGACCTTCTGT
TGCTGGATTCCTCATGCAGAAGGAACTTGACTATCTTGTCGGAGCTGTATCAAACCCCAAGAGGCCATTTGCTGCCATT
GTTGGTGGTTCAAAGGTCTCATCCAAGATTGGAGTTATCGAGTCTTTGTTGGAGAAAGTTGATATCCTTCTGTTGGGTG
GAGGAATGATCTTTACATTTTACAA > SEQ ID NO:254 131378 Poppy
GAATTCAGTTTCTCTCTACTACTCCGCCATGGCTAGGTCTTCTGCTTTCTCCACTCCTTCCGTTTTTCAGCAAAAATCA
AATGTGGGTAACCTAAATATGGTTTCCCCTATTATTACATCATCATCGGTTAATTTTTGGGGAAAAGAAGTTTGTTAT
CATCTAGGTGTTCTAGATATGCTTCAGGAGGACTTCAAATCAAACAGATTTCTAATGTTACTACTCCAGTTGTTGGACA
TAGGAGGATGGTGTGTACTAATGCTGTTGCAACAAATTTACAAGCAGAAGTCACAACTAAGGTATTCTTTGATGTGGAC
ATCGGAGGAGAGCCAGCAGGTAGGATTGTAATGGGTTTGTTTGGAAATGAAGTTCCAAGGACTGTTGAGAATTTCCGCG
CTCTGTGCACTGGAGAGAAAGGTTTTGGTTACAAAGGGTGCTCGTTCCATCGTATTATCAAACAATTCATGATTCAGGG
TGGGGACTTTACTAATGGAAATGGAACTGGAGGTAAAAGCATTTATGGGGAAAAATTTGCAGATGAGGACTTCACCTTA
AAGCACGTTGGACAAGGAGTATTAAGCATGGCAAATGCAGGCCCTAATACCAATGGGAGCCAGTTTTTCATTTGCACTG
TTAAGACTCCATGGTTGGATGGCCGCCACGTTGTTTTTGGACATGTTATTGATGGCATGGATGT > SEQ ID NO:255 132564 Contig A Nicotiana benthamiana
TTTTACCAATTTTCTAGGATTTATTTTTTTTAAATGATGGTGGGATTAGAAGAAGTTCAAAGTGATGAAGAGTTTGT
TATTAGAGTATGTGAGGAAGTCATCGCCGTCGCCGTTCTTACTGAAAACGTACATGCTGGTGGAGGATCCGGCGACGGA
CGACGTCGTTTCTTGGAATTCCGATGGGACGGCGTTTGTTGTGTGGAAGCCGGCGGAATTTGCTAGAGATTTACTTCCA
ACTCTCTTCAAACATAGCAACTTCTCCAGCTTTGTCCGGCAGCTCAATACCTATGGTTTTCGTAAAATAGCAACAAGCC
AGTGGGAGTTCAGTAATGACAGGTTTAGAAAGGGAGAAAAGGATTTACTATGTGATATTCGTCGTAGAAAAGCATGGAC
AAACAGACACCAACCAAACAATAACAATAACAACAATAATAACGGACAGAGTCAATGTGCGAACAGTAACAAGAAAGAA

FIG. 1 continued

```
ACTGAAGATCAAAGGTCATCGTCATCAACAACATCATCATCTGAACTTACAATTCTTGTGGATGAGAATAAAAGACTCA
AGATGGAGAATGGAGTCCTTAGCTCTGAGCTTTCAGTAATGAAAAACAAGTGCAAAGAATTAATTGATATAGTTACCAT
TTTTGCTAAAAATCCAGAGAAAGAAGAAAAAAAG
```

> SEQ ID NO:256 132564 Contig B Nicotiana benthamiana
```
GGGCTTCTCTAAAACCCTTATAGAAGAAGAGAAAAAAGCCTCTCAAATCTCATCTCAAACCACCTAATTTCTCTCATAC
TCGCTCGACCCATGGCTCTATTAGTCGAGAAAACCACCTCTGGCCGCGAGTACAAGGTCAAGGACATGTCTCAGGCCGA
TTTCGGCCGGCTCGAAATCGAGCTGGCCGAAGTTGAAATGCCTGGTCTCATGGCTTGTCGTACTGAGTTTGGCCCTTCA
CAGCCATTTAAAGGTGCTAAGATTACTGGATCTTTACATATGACCATTCAAACTGCAGTTTTGATTGAAACCCTTACTG
CTTTGGGTGCTGAAGTTAGATGGTGTTCTTGTAATATCTTCTCCACTCAAGATCACGCCGCTGCTGCCATTGCACGTGA
CAGCGCTGCCGTGTTCGCGTGGAAGGGTGAAACTTTGCAGGAGTACTGGTGGTGCACTGAGAGGGCACTTGACTGGGGT
CCAGGAGGTGGTCCCGACTTGATCGTCGATGATGGTGGTGATGCTACACTCTTGATTCATGAGGGTGTTAAGGCAGAAG
AAGAGTATGCTAAGAATGGGACAATCCCAGATCCTAACTCTACCGATAATGCTGAGTTTCAGCTTGTGCTTACTATTAT
CAAGGAAAGTTTAAAGACTGATCCTTTAAAGTATACT
```

> SEQ ID NO:257 133405 Nicotiana benthamiana
```
AAGAACTTGACTGAATTCAAGCTGAGGAAATTGCTACAAAAGGAAAGAAAAAAAAAAGATTTTCTCAAATGGGTTTTCT
CAGTTTTACGCTTCAGTTGATCGATTTCCTCGCTTGGCCGGTACTTGCTCTGGGCTATCCTATATGTGCTTCAATCCGA
GCGATTGAGACTGGCTCCAAGTATCACATGAGGAAGCTAGTAACATATTGGACCATCTTTTCCTTTATTTCTCTGTTCG
AGCACGTATTTGAGAACCTTATTGAATGGGTTCCTCTGTGGCCTTATATAAAATTAATTACTATATGTTGGTTGGTAAT
ACCTGAGTTTAACGGCGCATGTTATTCATATCAACATCTTGTTCATCCATGTTTGCCTTTGAAACTGCACAATGTTATT
GCTCAGTTTTATGGTTCTTGTTATGTTTACCAATACTTTGCATATTTGTGCTCGTTTGTCAATCTTCAAACTTTTATTG
ACTGGTTTAACAAGCCAATGGAGGATCCATCTCTCAAGAATGAAACATTTCTGTCTGTGGTGGAAAGGTATCTTGAAGA
AAATGGATCTGATGCTCTGGTGAAACTTATTTCAAACAAGTGGCGCACTAATCAGACAGCATGTGAAGGGAGTGGTCCT
GTTTGGGAAGATATCAAAGTGAT
```

> SEQ ID NO:258 133507 Nicotiana benthamiana
```
AACTCCTGAAATTTATGCTACAGTTGATTTGGAAAAGGCTAGGGGTGGGAGAACCAGAAAGATTAAAAATGAACCAAAA
AATCCGAGGTGGTATGAGTCTTTTCACATTTACTGTGCACATATGGCTTCAAATGTTATATTCACTGTAAAAGATGACA
ATCCCATTGGTGCAACCTTAATTGGAAGAGCTTATGTACCAGTTGAAGAACTTTTGGAAGGGGAAGAGATTGATAAATG
GGTTGAGATACTGGATAGAGAAATGAATCCTATAGAAGAAGGTTCCAAAATCCATGTGAATCTACAGTTTTTTGATGTC
AGTCGAGATCCTAACTGGGCACGTGGCATTAGAAGTTCTAAATATCCTGGTGTCCCTTACACTTTCTTTGCACAGAGAA
CAGGATGTCGGGTTTCCTTATATCAAGATGCGCATGTGCCAGACAATTTTATTCCTAAAATCCCTCTCGCTGGGGGAAA
GTATTATGAGCCCCACAGATGTTGGGAAGATATCTTTGATGCTATTACTAATGCAAAGCACTTGATATATATTACTGGC
TGGTCAGTGTATACTGAAATAACCTTGGTGAGGGACTCGAGGAGGCAAAAGCCCGGAGGTGATATTACACTTGGGGAGC
TGCTC
```

> SEQ ID NO:259 133537 Nicotiana benthamiana
```
CTCATTCTTTCAACTAATTCAATACCCCCTTTTATTTCTTCAACTTTCTACAACAAACAAACTTTATCCATCTCCAAGG
AATTGATGTGCAGTGGTTCAAAGAGTAAAGTTTGTCCTTTTGATTTAAACATGGATAAGAAAGGCGGGGCTAGTAAAAA
TTGCTCTAAATTGCTTGAATTGTCAGCTTCAGATGATCTTGCTGGATTCATATGTGAAGTGGAAAAAGGTTGTGGGATT
GATGAGTTAAGCTTTTGGTATGTTAGAAATTACGGTTCGAAAAGATGGGGTTTGAGGAGAGAACTCCTTTAATGATTG
CTTCTATGTATGGAAGTATTGGGGTTTTGAGGTTTATTATTGGAACTGGGAAAGTTGATGTCAACAGAGCTTGTGGATC
TGATGGTGCAACTGCTCTTCACTGTGCTGCTGCTGGTGGATCTGAATTGACAATCGAGGTCGTTAAGATCTTGATTGAT
GCTTCGGCGGATGTTAATGCTTGTGATTCAAGTGGAAACAGGCCACATGATGTGATTGCTTCTTATCCTAAGTGTTTGA
GGAATTCGAAAAGGAAATCGCTCGAGTTGTTGTTGAATGGTAGCTTGGCTGAGCTGGAGGAAGAAGAAGGAAAAGCAGT
GATTCAAACGA
```

> SEQ ID NO:260 133547 Nicotiana benthamiana
```
TATCAGCCTTGGACTACATTTAGTTCACATTGGAGGAAACTCAAAGTTGTGCTAATATCGTCTCTTCTCGCTGTAGGGA
ACACAAGTAAAAGTTAGAAGACCAACTGATTATAACCCCTCTCTGGCTGCAACACTTGGTCCGAGCCAACCGAATCCAA
ACCTTGACCTTGCTGCAGTGGGATTATCACCAGGATCCACTGGTGGGCTTGAAGGTCCTGACCGTATTTTGTGGGAGG
CCTGCCATACTATTTCACTGAAGCCCAGATTAGGGAGTTGCTCGAGTCCTTTGGCCCTCTTCGGGGGTTTAATCTGGTC
AAAGATAAAGAAACTGGAAACTCGAAAGGCTATGCCTTTTGTGTTTACTCTGACGTGTCGGTTACAGATATTGCATGTG
```

CAGCTCTTAACGGGATTAAGATGGGTGATAAAACTCTTACTGTCAGACGTGCAAGTCAAGATACTTTACAGCCTAAGCC
AGAGCAGGAGAGTATATTAATGCATGCTCAGCAACAAATAGCACTGCAGAGACTCATGCTACAACCTGGTGGACCTCCT
ACTAAAGTCTTATGCCTAACAAATGTGGTTAGCGCAGATGAGCTCAAAGATGATGAAGACTATGAAGATATAGTGGAAG
ATATGAGAACTGAATGCGGGAAATTTGGTAATTTAGTGAATTTAGTCAT

> SEQ ID NO:261 134744 Oryza sativa
GAAATCTCGTCGCTTCCCCCGGGTTCGATTCGAGTCTTCTCTCTCGCAGCACAAAGATGGACGCAAACAGACGCCAAAG
TGGAATCCAGCAATTGTTGGCTGCAGAGCAAGAGGCTCAGCAAATAGTAAATGCTGCTAGGACTGCAAAATCGGCAAGG
CTTAGGCAAGCAAAAGAGGAGGCTGAGAGGGAAATAGCTGAATACCGTGCCCAGATGGAGGCTGAATTTCAGAGGAAGG
TTGCAGAGAGTAGCGGTGACTCTGGTGCAAATGTCAAGCGTCTTGAGCAGGAGACAGCGGAAAAAATCGCACAACTCAA
GCAGCAGGCTGCAAGTATCTCCCCTGAAGTGATTCAGATGCTTCTGAGGCATGTCACTACTGTGAAGAACTAAGGGTTG
ATGGCTTGCTGCTAGGCGATTTGCCATACATCTGATGGCAAACTTGTACTGTTTATTTTTTGAGAGGGTGGTAAGAATA
ACTTCGTCTCTTCTAGCTGTAATTCCGTGTTCCGAATAACGGAATAAACTGCTTCTGTTCATCAGCAGCCATGTTTCGT
ACTTTGAAAACCTCGGTTCCTGTCTGGTAAATATTATCCTTTCATGTATCATTTGAACAAAATAATGGGAGATTCTTTT
TGTTAAAAAAAAA > SEQ ID NO:262 134962 Oryza sativa
GATTGCTTTGCTCTGATCTGGTTGATCGATCTCGTCGTCGGCGATGGAGAAGTTGCTTTCCTCCTCCGGCGCCGCCGCC
GCCGTGGCGTCGCAGGGCCAGCTCCCGGACTGCTTCGTGTTCCCGGCCGACCGGCGCCCACCGGCCTCCACCGCGGCCG
TGTCGCTCCCCGTCATCGACCTCTCCGGCCCCCGCGACGCCGTCCGCCGCGCCGTCCTCGACGCCGGCAAGGAGCTCGG
CTTCTTCCAGGTGGTGAACCACGGCGTGCCGCCGGAGACGATGCGGGAGATGGCGGCGGTGTGCGAGGAGTTCTTCCGG
CTGCCGGCGGAGGACAAGGCGGCGTTCTACTCCGACGCGGAGGAGAACCCCAACCGCCTCTTCTCCAGCACCATCTACG
AGGTCGGCGACCAGCGCTACTGGCGCGACTGCCTCCGCCTCGCCTGCGGCTTCCCCGTCGCCGACGACACCAACACCCA
CTGGCCCGACAAGCCCCACCATCTCCGGGATGTCACGGAGAAGTTCTTCGTGGCGACGAGGGGATTGGGGATCGAGCTG
CTGCGGCTGCTGTGCGAGGGGATGGGGCTCaggCCGGACTACTTCGaGCGCGACCTCAccgccggcgATGTCATCATCA
ACGTcaacCACTACccTccaTGcccg > SEQ ID NO:263 135016 Oryza sativa
ATAACATTATATTGCAGCAATGGGATCCTCCTCCCTTCTACTCGCCTGTGTTGTGGTGGCGGCTATGGTGTCCGCCGTC
TCCTGCGGGCCACCCAAGGTGCCACCGGGCCCCAACATCACGACAAGCTACGGCGACAAGTGGCTGGAAGCCAAGGCCA
CCTGGTATGGTGCGCCCAAGGGTGCTGGCCCCAAGGACAACGGCGGCGCCTGCGGGTACAAGGATGTCGACAAGGCTCC
CTTCCTCGGCATGAACTCCTGCGGCAACGACCCCATCTTCAAGGACGGCAAGGGCTGCGGCTCATGCTTCGAGATCAAG
TGCTCCAAGCCGGAGGCCTGCTCCGACAAGCCCGCCCTTATCCACGTCACCGACATGAACGACGAGCCCATCGCTGCCT
ACCACTTTGACCTCTCCGGCCTTGCCTTCGGCGCCATGGCTAAGGATGGCAAGGACGAAGAGCTCCGTAAGGCCGGCAT
CATCGACACGCAGTTCCGCCGCGTCAAGTGCAAGTATCCTGCCGACACCAAGATCACCTTCCACATCGAGAAGGCCTCC
AACCCCAACTACCTTGCGCTGCTAGTCAAGTACGTCGCTGGTGATGGTGA > SEQ ID NO:264 135042 Oryza sativa
AATAGAGAGAGTGAAAGAAAGCGCCCACACACACTAACACTAACACAAAGTGGGAGAGAGAGAGAGAGGGGATGGAAAT
GGCGGATGAGCTGGGGCACTTGCTGGTGTTCGGGTTCCTCTTCAACCTGGGCGTTTACATGGTGGCGCCGGCGATGACC
GACGTGACCATGGACGCCCTCTGCCCCGGCCAGGACGAGTGCTCCCTCGCCATCTACCTCACCGGCCTCCAGCAAGCCA
TTACAGGGTTGGGTGCTCTTGTGGCGACTCCGATCGTGGGCAACCTGTCGGACAAATATGGTCGCAAGGCGTTGTTGCT
GCTCCCTGCAACTGCATCCATCCTTCCGTTGGTTATTTTAGCGTGCAACCGGACGAAGGCCTTCTTCTACGCCTACTAC
ATCACCAGGATGGTGACAGCCATGGTCGCCGAGGGCAGCATGCACTGCCTCTCGCTGGCCTACGTGGCCGACAAGGTGC
CGCCGTCGCGGCGAGCGGCAGCCTTCGGCGTGTTCTCCGGCGTCTGCCTCGCCGGCTTCGTCGCCGGCACGGTGGCGGC
CCGCTTCCTCGCTGTCCAGTCGACGTTCCAGGTGGCCGCCGTGGTGACGGCGGCGGCGGTGTACATG > SEQ ID NO:265 135085 Oryza sativa
CGGACGCGTGGGTGCAAAAACATACAGGTACGTCTCGCCAGATGGCCGGCCTTCTCCCCGGCGTGCTCGTGGCCGTTCT
CCTCGCCGCCGCCGCGGCGCCGGCGTCTGCGAAAGACTACACCGTCGGCGACTCGTCGGGGTGGACTACCGGTGTGGAC
TACACCGCCTGGGCCAGAGGCAAGACGTTCAACATCGGCGATACGCTATTGTTCCAGTACACCAGCGCGGGGCACTCGG
TGGTGGAGGTGAGCGAGGCGGACCACACCTCGTGCTCGGCGGCGAACCCGCTGCGGTCGTACAAGGACGGGACGACCAT
CGTCACGCTAACCAGGTCGGGCACCCGCTACTTCATCTGCGGCAGCACGGGCCACTGCGGCGCCGGCATGAAGCTCACC
GTGACGGTCGCCTCCCTCTCCGGCAGCGCCACCGGCGGCACGAGGCTGGCGAAGCCGTCGTCGTCCGACGCGGACCCGA

FIG. 1 continued

CGACGACGACGACGACCAGGACCTCGTCGGCCACGGGCGGCGCCACTGGCAGCTGGGCCCCGCGCACTGCCACGTGGCT
GCTGTTCTTCGCCGCCGTGGGGGCCTTGCTGTGATAGGCTGATCGTATGGCCGCTTGGA

> SEQ ID NO:266  135224  *Oryza sativa*
CGCCGTCGCAGATCCGATCCGGGAAGAGCTCGCCGCCGCCGCTGCCATGGCGCTCTCCGTGGAGAAGACCTCGTCGGGG
AGGGAGTACAAGGTGAAGGACCTCTCCCAGGCGGACTTCGGCCGCCTCGAGATCGAGCTCGCCGAGGTCGAGATGCCGG
GGCTCATGGCGTGCCGCGCCGAGTTCGGCCCCTCCCAGCCGTTCAAGGGCGCCCGGATCTCCGGGTCCCTCCACATGAC
CATCCAGACCGCCGTCCTCATCGAGACCCTCACCGCCCTCGGCGCCGAGGTCCGCTGGTGCTCCTGCAACATCTTCTCC
ACGCAGGACCACGCCGCCGCCGCCATCGCCAGGGACTCCGCCGCCGTGTTCGCCTGGAAGGGGGAGACCCTCGAGGAGT
ACTGGTGGTGCACCGAGCGCTGCCTCGACTGGGGCGTCGGCGGCGGCCCCGACCTCATCGTCGACGACGGCGGCGACGC
CACGCTGCTCATCCACGAGGGCGTCAAGGCCGAGGAGGAGTTCGAGAAGTCAGGCAAGGTCCCCGACCCGGAGTCCACC
GACAACGCCGAGTTCAAGATCGTGCTCACCATCATCCGCGACGGCCTCAAGTCCGATCCCAGCAAGTACCGC > SEQ ID NO:267  135281  *Oryza sativa*
GCTAGCCACGCCGTCCGCTCGGGCCGAGGCGCATCGCGCGGGGGGAGAAGGGGAGGAGAAGATGTCGAGCGACGGAGGG
CCGGTGCTTGGCGGCCTCGAGCCGGTGGGGAACGAGAACGACCTCCACCTCGTCGACCTCGCCCGCTTCGCCGTCACCG
AGCACAACAAGAAGGCCAATTCTCTGCTGGAGTTCGAGAAGCTTGTGAGTGTGAAGCAGCAAGTTGTCGCTGGCACTTT
GTACTATTTCACAATTGAGGTGAAGGAAGGGGATGCCAAGAAGCTCTATGAAGCTAAGGTCTGGGAGAAACCATGGATG
GACTTCAAGGAGCTCCAGGAGTTCAAGCCTGTCGATGCCAGTGCAAATGCCTAAGGCCCATCTCGTATCCTATGTGTAT
CAAGTTATCAAGAAGATGGGGAATAATATGGTGTGGATATAGCTATTGGACATGTTAATTATCCACATGATAATATGGC
TTGGATATAAGGATCTCACACGATAATATGGCTTGGATATATAGCTATTAAAGATTTTACCTATGGCATATTTCAATGT
GTATTAGTACTAAGTAAGAATGATTGCAAGGTGTATT > SEQ ID NO:268  135357  *Oryza sativa*
GCTCTCCCCCTCCCCTTCCTCCCGCTCCGGCGAAGGCGAGCGCGCGGATCGGCGTGATGGCGGCGGCGGCGCCCTCTCC
CCCACCCGTCGCGGCGCTGGAGCAGATGAGCAGGACCAAAATGTTCGGCGGCCACAACCTCCGCTTCCGCCACCACAGC
GCCACGCTCGGCTGCCCCATGACCTTCTCCGTCTTCCTCCCGCCGTCGCCGGCATCCGACCTCCCCGTGCTGTACTGGC
TCTCCGGCCTCACGTGCAACGACGAGAACTTCGTCACCAAGGCCGGCGCGCAGCGCGCCGCCGCCGCCCACGGCATCGC
CCTCGTCGCCCCCGACACCTCCCCACGTGGGCTTAATATAGAGGGAGAGGCAGACAGTTGGGATTTTGGTGTTGGTGCT
GGATTCTATTTGAATGCAACAAATGAAAAGTGGAAAAATTGGCGCATGTATGACTATGTTGTGAAGGAGCTTCCAAAAG
TTTTAAGTGACAACTTTGAACAGCTGAACACTT > SEQ ID NO:269  135373  *Oryza sativa*
GCCATTCGTACAATCATGGTGGCGCAGGCCTCCGATAGTTCATCATAAGTTTCAGTCAATAGAGTTCAAGATGATCAGA
GAATGATGATGGAAGACGTCTACAGCTTGAAGCGCATGGTGTCCGCCCTCGAAGAGCAGGCTGCGAGCATCGAATCGCA
GTTCCATGACTACTGCGACATGAAGGAGCAGGAATCAACATACCAGAAGATGCAGATCATGTGCCTGGGGATGAAGCTG
GAGCAGCTGGAGTCTCAGAACCAGAGGCTGGAAGCAGCTGCTGCGGAGATCCGCGCATCTGCTGAAGAGTTCGCGACGA
TGCGAGC > SEQ ID NO:270  135416  *Oryza sativa*
TCTATATCTTGTCAACTTGGATTTGGTAATCCCTGGAACTAAAAAGGCCATTCAAAATGGTGGTTCTTGCAGCTTCTAT
TATATCGAAGTCTGGAAAAGCTCTTGTTTCGAGACAATTTGTTGACATGTCCCGGATAAGGATCGAGGGGCTGCTTGCA
GCATTTCCGAAGCTGGTCGGAAGTGGAAAGCAACATACTTATGTTGAGACTGAAAATGTCCGTTATGTCTATCAACCAA
TTGAAGCACTGTATTTGCTTCTCATCACAAATAAGCAAAGTAACATTCTTGAAGATCTGGATACTTTAAGGCTACTCTC
CAAGCTTATACCTGAATATGCTCCCTCTTTGGATGAAGAGGGTGTCTGTAAGGCAGCATTCGAGCTTCTGTTTGCCTTT
ATTGAAGCCATTTCTCTTGGAAACAAAGAGAACGTAACTGTTGCACAAGTTAAACAATACTGTGAAATGGAGAGCCATG
AAGAAAAGCTGCACAAGCTGGTTATGCAAAGCAAATAAATGAAACTAAGGATGTCATGAGGAGGAAAGTCACTGAGAT
TGAGAAAAGCAAGACTGATAGAGGGAAGCCTGACAAGGGAGGATTTGGATCCTTGAGAACTCCAAACAGCTTCAGTGGC
ATGGGCATT > SEQ ID NO:271  135511  *Oryza sativa*
ATTTCCCACTTGCCCTTTCAGACACAGCGCCGCCACTAAACAAATCCGCGACACAATCCTCCGCCATTAAACTCTCTCT
CTCCTCTCGACACCACATCACAGCAGTGAGGTGGTTGTTGGCGGAGGAGGGAGGCTGGCTGCTGCTGCTGCCGCCG
CCTCCATCCATGGCGGCTTCTCCTCCTCCTCCTCCTCGTCCCTGCTGCTGCTTCTCCCGTTGCTGCTCGTTTGGGGCG

FIG. 1 continued

TGGTGGTTGCGGCGGCGGCGGCGACGGATACGTTGAGGCAGGGGGAGTCGCTGACGGGGGCGGCGACGCTGGTGTCGTC
GCCGTCGGGGGTGTTCGAGGTGGGGTTCTTCGCGCCGGACCCGAAGCTGCCGTCGCGGCTCTACCTCGGCATCTGGTAC
CGCAGCATCTCGCCGAGGACCGTCGTCTGGGTCGCCAACCGCGCCGCGCCGGCCACCGCGCCGTCGCCGTCGCTCACGC
TCGCGGCCAACGGCGAGCTCCGCGTGCTCGACGGCTCCGCCGCGGACGCGGACGCGCCGCTCTTGTGGAGGTCGAACGC
GTCCACGC

> SEQ ID NO:272  135525  *Oryza sativa*
CCCACGCGTCCGGAGGGGAGAAGCCGAGGAGGAGGCAGCGGGGAGAGAGGATGCCGCGGCCGGAGGTGCAGGCGCCGCC
GGAGATATTCTACAACGAGTCGGAGGCCCGCAAGTACACCACCTCCTCTCGCATCATCGAAATCCAGTCGAGGATTACC
GAGAGGGCGCTCGAGTTGCTTGCGCTACCCAACGATGGCGTCCCCAAGTTGCTTCTCGACATCGGGTGTGGTTCTGGAC
TTAGTGGCGAGACATTGACAGAGCAGGGCCATCACTGGATTGGTTATGATATTTCGAAGTCCATGCTTGATGTTGCTCT
GGAGCGTGAAGCGGAGGGTGATCTCCTTCTTGCAGATATGGGCCAGGGTTTAGGCTTGCCGCCTGGAGTTATTGATGGC
GCAATCAGTATTTCAGCAGTTCAGTGGTTATGCAATGCTGACAAGTCTTGTCACAACCCAAGATTGCGGTTAAAGGCTT
TCTTTGGATCATTATATAGATGCCTAGCAAGGGGAGCAAGAGCCGTTTTGCAATTTTATGCTGATAATGTGAAGCAGAG
TGAAATGATCGTGACTGCTGCCATGCGTGCTGGATTTGCAGGTGGAG > SEQ ID NO:273  135668  *Oryza sativa*
GTTCCAGCCATGGCAGCAGACGAAGGGAGTGAAGGTGTTCGGCATGTGGGCGAGCCCCATGGCGATCCGTGTGGAGTGG
GCGCTCCGGCTCAAGGGCGTCGACTACGAGTACGTCGACGAGGACCTCGCCAACAAGAGCGAGGCGCTGCTCCGGCACA
ACCCGGTGACCAAGAAGGTGCCCGTGCTGGTCCACGACGGCAAGCCTCTCGCCGAGTCCACCGTCATCGTCGAGTACAT
CGACGAGGCCTGGAAGCACGGTTACCCCATCATGCCCTCCGACCCCTTCGACCGTGCTCAGGCGAGGTTCTGGGCCAGG
TTCGCTGAAGAAAAGTGCAACGCTGCTCTGTACCCGATCTTCATGACGACCGGAGAGGAGCAGAGAAAGCTGGTGCACG
AGGCCCAGCAGTGCCTGAAGACGCTGGAGACGGCCCTGGAGGGGAAGAAGTTCTTCGGCGGCGACGCCTTCGGCTACCT
TGACATCGTCACCGGGTGGTTCGCCTACTGGCTGCCGGTCATCGAGGAGGCCTGCGGCGTCGAAGTCGTCACCGACGAG
GCGCTGCCCCTGATGAAGGCCTGGTTCGACCGGGTCCTCGCCGTCGACGCCGT > SEQ ID NO:274  136763  Contig A  *Oryza sativa*
CACCGCACCCACCAATGGCGTCCTCCACCAAGATCCCCTTCCTCCTCCTCGCCGTCCTCCTCCTCCTTTCCGTCGCCTT
CCCAGCGGAGGTGATGGCAGGAGGGCACGGGCGCGGCGGAAGCAGCGGCGGCGGCGGAGGGGTGGCCGGCGGCGGGAAC
CTGAGGCCGTGGGAGTGCTCGCCCAAGTGCGCGGGCCGGTGCTCCAACACGCAGTACAAGAAGGCGTGCCTGACGTTCT
GCAACAAGTGCTGCGCCAAGTGCCTGTGCGTGCCGCCCGGCCACCTACGGCAACAAGGGCGCCTGCCCCTGCTACAACAA
CTGGAAGACCAAGGAAGGCGGCCCCAAGTGCCCCTAAGATGCATGCTTTGTTTCTTTTCTTCTTTTTTTTACCCTAT
GATTAATACCTCCTCCTACTAGTTCTACATTGGTGTCACTGCCTCACTGACACTGGTTTAGCTCATGGATCCGGTTGAT
TAGTTAAATGGTGGTGGGGTTTATTGCTAGATCTGGGCTTATAAGTATTAGTTTATCCTGTTCTAGTAAGGTTGTTGGT
TGGGGGAATGTGTGTGAGAGAGGAGAGTGAGGATTCGTCAAAGCTGGTCAAAAACTTGGATCCCCTCTCCCTgtagtgA
TTGATTGATTTGCTACTACTGGAGtGagCt > SEQ ID NO:275  136763  Contig B  *Oryza sativa*
CGCTTTTTTTTTCTTTAGCAATTATACATTAAAATCAGCTCATCACCTGCGGATACTATTATGCACTATTAATTACTCG
ACCGGCAACAGCCACCCCATCATCCT > SEQ ID NO:276  136767  *Oryza sativa*
CCCCCCCCTGGAGCCAGAGCCAACCATGGCGGCGACTAGGGTTTGGCTCTCCGCCCTCCTCCTCGCCTTCCTCCTCGCC
GCCGCCCCCGTCGTCCAAGTTGCCAGAGCTCAGTCCGAGGAAGAAGCTGCTACAGCTGAAGTTGTTGATGGGGCTGATC
TAGGAATCGTCAGTGATGATACACAAGTTTCCAGCGATGGGCCTCTAAGTCCGGCTCCTGGTGTGGAGACAGTATGTGT
TTTTCCCAAAAACGCTGGCAAAATTGTGCTAGCAGGTGAAGAAACTGAACTACTGGTTGGCCTGCAAAACGAGGGTGAA
TCAACTTTGAATGTTGTTGCTATCCATTCAACTCTCCATCTTCCTTTTGACCATAAGATGTATGGACAAAACCTTACTG
TTCAGAACTTCTTCAATGCATCAGTTCCTGTCTCTGTACAAGCAACCTTTCCGTATACATTCGCCGTGAGCAAGTTCTT
GCAGCCTGGAGCATATGATCTAGTTGGTTACATAGTGTATGAGATTGATCAGAACCCATACCAGAATGTCTTTTACAAT
GGCACTGT > SEQ ID NO:277  136817  *Oryza sativa*
CCCCCGAGCAACTCCCCTCCTCCACTAGACCACCATGCACAGATCGATGGCCTCTCAGGCGGTGGCGCCCCTCCTCCTC
ATCCTCATGCTCGCGGCGGCGGCGGGGGGCGCGTCGGCGGCGGTGCAGTGCGGGCAGGTGATGCAGCTGATGGCGCCGT

FIG. 1 continued

```
GCATGCCGTACCTCGCCGGCGCCCCCGGGATGACGCCCTACGGCATTTGCTGCGACAGCCTCGGCGTGCTCAACCGGAT
GGCCCCGGCCCCGCCGACCGCGTCGCCGTCTGCAACTGCGTCAAGGACGCCGCCGCCGGCTTCCCCGCCGTCGACTTC
TCCCGCGCCTCCGCCCTCCCCGCCGCCTGCGGCCTCTCCATCAGCTTCACCATCGCCCCCAACATGGACTGCAACCAGG
TTACAGAGGAACTGAGAATCTGAGAGCGTGAGGAATCGAGTTCATGTTGCATTTATCATCAATCATCATCGACTAGATC
AATAAATCGAGCAAAGCTTTgAT
```

> SEQ ID NO:278 137131 *Oryza sativa*
```
CCCCCGAACTTTCTGCTTGCAAAGTTTCAATGCACTGGAGTGAGTCAGTGAGGTTGGTGAAGCAGAGTGAGGAAAGGAG
GATGGGAAGGGTGGCGCCTAGCGTCGAGGAGGTCGGGGCGAGCAGCCGCCGCCCGCGCTTGGGCCCGGCGAGACCGTG
AGCGGGACGGTGGCCGAGCTGAGGCGGCGTACGAGAGCGGCAGGACGCGGAGCCTGGAGTGGAGGCAGTCGCAGCTCC
GGGGGCTCCTCCGGCTCTTGGCGGAGGAGGAGGCCGCCGCGTTCCGGGCGCTCCGCGAGGACCTCGGCAAGCACCAAGC
CGAGGCCTACAGAGACGAGATCGGCGTGCTTGTCAAGTCGGCGAACGCCGCGCTGCGTGAGGTCGGGAAATGGATGGCG
CCGGAGAAGGTCTGGGTGCCGCTAATCGCGTTCCCGGCAAGGGCGCAGCTGGAGCCGCAGCCGCTCGGGGTCATCCTCG
TCTTCTCTTGCTGGAATGTCCCGTTGGGCCTCTCTCTGGAGCCTCTCGTTGGAGCATTGGCGGCCGGCAATGCGGTCGC
GCTGAAGCCATCGGAGCTGGCGCCGGCCACCGCTAAGTTCCTCGGCGACAACGTCGGCA
```

> SEQ ID NO:279 138578 *Oryza sativa*
```
GCTAACTACTCCATCTAGCTAAGACCCGTAGTGTATAGTAGTCAAGATCAATGGCGTCCCGACGCCTTGCCCCGCTGCT
GGTCCTACTGCTCTCGTCCAGCCTCGCCGCCGGCCAGAGCACCGGCGACACCGTCGTGTTCTGGGGCCGGAACACGGAC
CAGCTCGAGGGGTCCCTCCGTGAGGCGTGCGACACCGGCCTCTACACCACCGTCATCATCTCCTTCCTCAGCGCCTTCG
GCTACATCCCGGGCACCTACAAGCTGGACATCTCCGGCCACACCGTCTCCGCCGTCGGCCCCGACATCAAGCACTGCCA
GTCCAGGGGCATCCTCGTCCTCCTCGCCATCGGCGGCCAGGGCGGCGAGTACTCCCTGCCGACCTCCCAGGCGGCCGTC
GACCTCGAGGACTACCTCTGGAACGCCTTCCTCGGC
```

> SEQ ID NO:280 138832 *Oryza sativa*
```
CTACGACTGCGGGTCCAGGCTGTGGAGGCTCAAGGGTGAGCCGCAGGCGGCGGCGGGGCGCGAGATGGCGGAGATCCTC
CGCACGCTGGAGGCGGAGCTCCGCGACCGGGAGATCTTCGGCGGCGGCGGCGGCGGCAGGCTCGGGTTCGTCGACGTCG
```

> SEQ ID NO:281 138843 *Oryza sativa*
```
TTATTACTCGACCCACGCGTCGACAACCCAACACCCAAAAGCAAAAGAAAAGCAGCAACCAAAGGATGTGCGGCGGAGC
GATCCTTGCGGAGCTCATACCGAGCGCGCCGGCGGCGAGGCGCGTCACGGCGGGCCACGTCTGGCCGGGCGACGCCAA
```

> SEQ ID NO:282 139222 *Oryza sativa*
```
CCCCCCGGAGAGAGAGAGAAAGGGTCTCCTCCTCAACATCAACAATGGCGGTCGCAACCTCCTTCGCCACACTCGCCAT
CGCGCGGCCGGCGGCGGAGCGAGCCCTCCTCGCCTCCAAAACCCCCTCGCCGCTCCTCTCCATCCGCACCGGCACCGGC
ACCGCACGCCTCCCCTCATCGGCCGTCTTTGGAGGTTTCACTCCTGCGCTTTCCGCTGCTCACAGCCGCGCGCGCTTCG
TCTCCTCCGCCACCGCTGACCCCAAGGAAGTGGACCTCCAGTCCAAAATCACAAACAAGGTGTACTTTGACATAAGCAT
CGGAAACCCTGTTGGGAAGAACGTTGGGAGGGTCGTTATTGGCCTATACGGGGATGATGTTCCCCAGACCGCAGAGAAC
TTCCGTGCTCTTTGCACTGGAGAAAAAGGGTTTGGTTACAAGGGGTCCAGTTTCCACCGTGTCATTAAGGACTTCATGA
TTCAGGGAGGAGACTTTGACAAGGGCAACGGTACTGGAGGGAAAAGCATATATGGCCGGACCTTCAAAGACGAGAACTT
CAAATTGGTTCATACTGGACCTGGAGTGGTCAGCATGGCCAATGCTGGGCCAAACACCAATGGCAGCC
```

> SEQ ID NO:283 139281 *Oryza sativa*
```
CCACCTACGCATCCCCGACCAGCACCGGCGACCGGCGGCGGCGGCGGCTACCCCCCTTCAATGGCGACTGTGCCAGTTA
ACCCGAAGCCTTTCTTGAACAACCTGACAGGGAAGCCTGTCATTGTCAAACTTAAGTGGGGTATGGAATACAAAGGATA
TCTTGTTTCTGTCGACTCTTATATGAATCTGCAGCTGGCTAATACAGAGGAGTATATTGATGGGCA
```

> SEQ ID NO:284 139321 *Oryza sativa*
```
CCCCCCCCCCCGGACCTCTCTCTCCCCATGGTATCTCCTCTCCCTCTCCGCCCATTTCTCCTCTCCACCTGCGATCCAT
CCGCGCCCGCGAGGAGGAGGGAGCCGGACGCCGCCGCGGGGAGAGCAGGGGAGAGAAGGAGAGGAGGAGATCGCCGTCG
CCGTCGCCGTCGTCGATCTCGAGCGGGAGCGGAGATGGGGCTCACGTTCACGAAGCTGTTCAGCCGCCTCTTCGCCAAG
AAGGAGATGAGGATCCTCATGGTCGGTCTCGATGCGGCCGGTAAAACCACCATCCTCTACAAGCTCAAGCTCGGCGAGA
TCGTCACCACTATCCCCACCATCGGTTTTAATGTCGAAACTGTTGAGTACAAGAACATTAGCTTCACCGTTTGGGATGT
TGGTGGTCAGGACAAGATCAGGCCCCTGTGGAGGCACTATTTCCAGAACACCCAGGGCCTCATTTTTGTTGTGGACAGC
```

FIG. 1 continued

AATGACAGAGAGCGTGTTGTTGAGGCCAGGGATGAGCTCCACCGTATGCTAAATGAGGATGAGCTACGTGATGCTGTGC
TGCTGGTGTTTGCAAA

> SEQ ID NO:285 139357 Oryza sativa
CCCCCCGTCCATCTCATCAGCAACGAACCAAGTCACACCGATCGATCGAGCAACAGTAGTAGGAACCATGGCCCGTGCA
CAGTTGGTGTTGGTCGCCGTTGTGGCAGCTCTGCTCCTCGCCGCCCCGCACGCCGCCGTGGCCATCACCTGCGGCCAGG
TCAACTCCGCCGTTGGGCCCTGCCTCACCTACGCCCGCGGCGGCGCCGGCCCGTCGGCGGCCTGCTGCAGCGGCGTGAG
GAGCCTCAAGGCCGCAGCCAGCAGCACCGCTGACAGGCGCACCGCGTGCAACTGCCTCAAGAACGCGGCCCGCGGCATC
AAGGGGCTCAACGCCGGCAACGCCCGCCAGCATCCCCTCTAAGTGCGGCGTCAGCGTCCCCTACACCATCAGCGCTTCCA
TCGACTGCTCCAGGGTGAGCTGAGCTATCGATCGGATGGATCATTTATATGCATACAGAAGCGCGACGGTGGGTCGATG
TGTGGAGCCGATCGAATTCTGTATCCAATATTAGTAGTATCTGTACGTATTCTGGAATAAAAAGATGAGCTAGCTAAGG
TCGATCAATCACCATGCATGCATGTGTGTGCAT > SEQ ID NO:286 141821 Oryza sativa
AGAGAGAGAGAGAGAGAGAGAGAGATGGCGCTCGCAATCCTGGCGAGGAGGCGGGGGGCGGAGGCGCTGCTGCGACG
GCCGCTGGGGGCGGCGGGGGTGTCGGCGCTGAGGGCGTCGTACGCGGCGGTGGCGGGGGAGGAGAGCGACGTGGTGGTG
GTGGGCGGCGGGCCGGGAGGGTACGTGGCGGCGATCAAGGCGGCGCAGCTGGGGCTCAAGACCACCTGCATCGAGAAGA
GGGGCACCCTCGGCGGGACATGCCTCAACGTCGGCTGCATCCCCTCCAAGGCTCTGTTGCACTCATCTCATATGTACCA
TGAAGCAAAAAGTTCCTTTGCACACCATGGAGTGAAATTTTCCAATCTGGAGGTAGACCTCCCAGCTATGATGGCACAG
AAAGACAAGGCTGTGGCAGGCCTGACTAAGGGGATTGAAGGTCTCTTCAAGAAGAACAAAGTGACGTATGTCAAAGGCT
TTGGGAAACTTGCTTCGCCCTCAGAGGTGTCTGTTGATCTGAGCGATGGTGGCAGCACAGTTGTCAAAGGGAAAAACAT
AATCATTGCTACAGGGTCTGATGTAAAATCACTCCCTGGAGTCACAATTGATGAAAAGAAAATCGTCTCATCTACTGGG
GCCTTGTGCT > SEQ ID NO:287 142731 Nicotiana benthamiana
AACCACTAGTTGATGTGTACAAGCAAGTAAAGATTGGGGACCGTTTAGAAAAAGGTACCTTACTTGGGCCACTGCATAC
TCGCACTTCTAGGGAAAACTTTCAAAAGGGAATCCAAAATATCAAGTCCCAGTGCTTTGCAGGGTGGAAAGATCCTCAC
AGGGGGTTCAGTCATAGAATCTGAGGGTAACTTTGTGCATCCAACAATTGTCGAAATATCTTCAAAAGCTGAAGTTGTG
AAGGAAGAATTGTTTGCTCCAGTTCTTTATGTAATAAAGTTTAAGACTTTCGAAGAAGCAGTTGAAATTAACAACTCTG
TCCCTCAAGGTTTAAGTAGTTCCATCTTCACCCGAAATCCACAAATTATGTTTAAGTGGATTGGAGCTCAAGGAAGTGA
CTGTGGCATTGTCAATATAAACATACCAACAAATGGAGCTGAAATTGGTGGTGCATTTGGAGGTGAAAAAGGTACTGGT
GGTGGTCGTGAGGCANGAAGTGACTCTTGGAAACAATATATGAGGCGCTCAACTTGTACAATCAATTATGGGAATGAAC
TACCATTGGCTCAAGGAATCAACTTTGGCTAACGAAATTGATGC > SEQ ID NO:288 167332 Poppy
GAATTCAGAACCCTCTTCATCATCTTCTTCCTCAGAAATCTCCTGATCTTCTTTCTAAATTCCCAATCTAACCCTCTCC
AATGGATCCCGTCAATGAATGGGGTAACACACCCTTAAACGTTGCAGATCCAGACATCTTCGATTTAATCGAAAAAGAA
AAGAGAAGACAATGCAGAGGTATCGAATTGATCGCTTCTGAAAACTTCACATCTTTCGCTGTGATTGAAGCACTTGGTA
GTGCTTTAACAAACAAATACTCCGAAGGTATTCCGGTAACAGATACTACGGAGGTAATGAATTCATCGATGAGATTGA
AAATCTATGTCGTTCAAGAGCTTTGGAAGCATTCCGATGTGATCCAGCGAAATGGGGTGTGAATGTACAGCCTTACTCT
GGTAGTCCTGCTAATTTTGCAGCGTATACTGCTTTGTTGAATCCACATGATAGAATTATGGGTCTTGATTTGCCATCAG
GTGGTCATTTGACACATGGTTATTATACATCTGGTGGTAAGAAGATTTCTGCTACTTCAATTTACTTTGAGAGTTTGCC
TTATAAGGTGAATTCTACTACTGGGTATATTGATTATGATAAGTTGGA > SEQ ID NO:289 167347 Poppy
GAATTCGCAGAGAAAAAGAGAGAAACATGGGGAGATCATTTGGAAATGGTGGGTTGGGAGGAGGCGCAAGTGGTAGTG
GTGGCATGTTAAGAGCAGTAAGGATTAGGGCAACTGTTGGTGGAGGATTGCAAGATCCTGTAACCATAAAAAAACCTAA
CTCAACAAAACCCACAACACCAAACTCTTACAATACTAATGTGTTAACCCTATCAACACATACTCGCGGTGGTTCATCA
GTTAATAATAATCAAGTTTTATTATCATCACCAACATCATCAGCTTCAGTTTCTAATGCTTCTTCGTCTAGATATTCAT
CATCTTGTTCATATTTATATGATTCTACTGATGAATGGGAGTGGGAAACTGTTGACAAAGATGGTGAGGAAAACAAAGA
TGATTTGGTTTTATCAAATGGATATTATGATATCTTTGGCGCTGTTCCTTCTATGGATGAAGTTAGAGATGCGGTTTCT
AATCTTCAACAATTTTCTTCGGCTGCATCAGACGAGGATTGGGTCGAACCTGCTTTACAGGTTAATAATCCAAGAACAT
TGAGGTCTCATGGATATGAAAGGGTTTATACTGCTTTCCATTTATTGCAGACAGATCCAAGTGTTCAGAGAATGGTAGT
TTCTTTATCTACCGATAAAGCTCTATGGGATGCTGTTTTAAATAATGA

FIG. 1 continued

> SEQ ID NO:290 167403 Poppy
GAATTCAAGACTTTCTTCTTTGTTTTTATATCGCTAAGATTATTTGCTAGAGTCTCATCCAGTAATCCTTCTTTCTTCA
TGGCAGAAGAGATGGTTGGAAGTATCAAATACGAAGAAGAGATAATACAGGTACCTCGTGGAGTAGAGCTATTTACATG
TAGTTGGGTACCTGCTAACACAGAACCCAAAGCTTTAGTTTTTCTCTGCCATGGTTATGCCATGGAGTGCAGCATCTCC
ATGAAAGATACTGCGATTCGTCTAGCGAAAGCCGGTTACGGAGTTTATGGAATAGATTATGAAGGTCATGGAAAATCTT
CAGGACTACAAGGTTTCGTCCCTAGTTTCGACAGAGTTGTCGACGATTGTTCTGACCATTACTCAAGCATTTGCGAAAA
GAAAGAAAACAAAAGAAAGTTAAGATATCTACTGGGAGAATCCATGGGAGGTGCAGTTCTTCTTCTTTTACACAGGAAG
AAACCACAGTACTGGGATGGTGCTATCTTAGTTGCTCCCATGTGTAAGCTTGCGGATGATATGAAACCACCAGCACTGG
TTGTGAGTGTTTTATCAATGCTCACCCATGTCATACCGACATGGAAAATTGTCCCAACAACTGATATTATCGATATCGC
CTTCAAACTACCTTCCAAA > SEQ ID NO:291 167406 Poppy
GAATTCAAACTAACCTCAGTTTCTCCGCCTGGGTCTCTCTCCACATCAATAGAACTATCTCTCTCATCTTTTCTCACAT
TACTCTCTTCTTTGTTTCTCATTCTGAATCTCCCGAGCAGAAGAACATGGCGACGATTTTACAAGGAATTGGAACCACA
ACTTCATTATCTTCCACTTCTTTGGATTCCAAGAGATTTGAGTCTTCATCAGGAAAGGTTTTAGGAGGTATCAGATCTG
ATTCAAGAGACATTTCTTTTGGATCATCTAATAACAGCAAAGCTCGTAAATTAGTAGCTACTAATGCACTTACAGGTTT
AAAGAGCTCACAATGTAGCTTCATGGTTGGAAGTGGGGCGATTCCTAGTCAGAAAGTACAAGCCAGTCATTTAAGCCTA
AAGTCAAGAAGACGGGCAGGAGCATTGAGCGTGACATGTCGCGGTGAAAAGATTCTTGTGGCAAATAGAGGTGAAATTG
CTGTTCGTGTCATTCGAACTGCTCATGAAATGGGCATACCATGTGTGGCAGTTTATTCAACAATAGACAAAGACGCACT
GCATGTTAAGCTTGCTGATGAGGCTGTTTGCATTGGAGAAGCACCTAGTAACCAATCCGTATTTGGTGATCCCAAATGT
TCTCTCTGCAGCTATAAGCCGTGGATGTACCATGCTGCATCCTGGATATGGATTCCTTG > SEQ ID NO:292 167420 Poppy
GAATTCAGGAGTCTTATTTCTACTCCTTCCGTGCTAGCTTGCAGAGCATTCTCTCTTGAAAGCTCATCATGGCTTCTGC
ATTTCTCTCAGTAGCCAAGCCTTCTACTCTCCAGGTTGCAAAGGGACTCGGCGAATTCTCTGGTCTCCGCAATTCCTCT
GCTTCTTCCCTTCCCTTTGCTTCAAGGAAATCCAACGAGGATTTTCTCTCCCTCGTGGCCTTCCAGACATCTGCTGTTG
CTGTTGGAAGCGGTTACAGGAGAGGAGTAACAGAAGCAAAGTTAAAGGTTGCAATCAACGGGTTTGGAAGGATCGGAAG
GAATTTCTTGAGGTGTTGGCACGGTAGGAAGGATTCCCCCTTGAATATCATCGCCATCAACGACACCGGCGGTGTCAAG
CAAGCTTCTCATCTTCTCAAGTACGATTCTACCCTCGGCATTTTTGATGCTGATGTCAAGCCTGTTGGTGACGATGCTA
TCTCCGTCGATGGCAAGATCATCAAGGTAGTCTCCAGCCGTAACCCCCTCGACCTCCCCTGGGGGATATGGAGGTGGA
TCTAGTTATTGAAGGGACAGGAGTGTTTGTGGACAGAGAAAGTGCAGGGAAACACATACAGGCAGGTGCTA > SEQ ID NO:293 167515 Poppy
GAATTCAAACAGAAATGGCAAGAAGAAGCTGACCGATCTTAAAGCAACTTTTGCAGAGATCATCATCAGAATCTTCATC
TTCCTCATCTTTGTTGAATCCTAGTATTGTTGGAGGAGGATTATCAGGTACAAGATATGAACCAAAGAGATCTGTAACG
TATATGCCAAGACCAGGTGATGGAACACCAAGAGCAGTAACCCTAATACCAGGAGATGGAATCGGACCATTAGTAACAG
GTGCCGGTTGAACAAGTAATGGAAGCGATGCACGCACCTATTTACTTTGAGAAATTTGAAGTACATGGTGATATGCCAAA
AGTACCTGATGAAGTTATGGAATCGATTAAGAAAAACAAAGTTTGTTTGAAAGGTGGATTAGCAACACCAGTTGGTGGT
GGTGTTAGTTCTTTGAATGTTGAATTGAGGAAAGAACTTGATCTTTTTGCTTCTCTTGTTAATTGTTTTAATCTTCCTG
GTTTGGCTACTAGACATGAGAATGTTGATATTGTTGTCATTCGTGAGAATACTGAAGGTGAATATGCTGGTCTTGAGCA
TGAAGTCGTTGATGGTGTTGTTGAAAGTCTTAAGGTAATCACAAAGTTCTGTTCAGAACGTATTGCAAAGTATGCCTTC
GAATATGCTTATCTT > SEQ ID NO:294 167575 Poppy
GAATTCGGAAGCTATACAAGACAAGGACCATGAATTCGTAACAAAAGCAGTTGAAGAAGCATACAAAGGAGTGGATAAT
GGAGATGGAGGCCCTTTCGGTGCAGTCGTTGTTCGCAATAATGAAGTAGTTGTGAGCTGTCACAACATGGTTTTGAAGC
ATACTGATCCTACTGCCCATGCTGAGGTGACTGCAATAAGAGAGGCATGCAAGAAGCTCAACCAAATCGAGCTATCTGA
CTGTGAAATATATACATCTTGCGAGCCTTGTCCAATGTGTTTGGTGCAATCCACCTTTCACGTATCAAGAGGTTGGTA
TATGGAGCCAAAGCGGAAGCAGCCATAGCAATTGGATTTGATGACTTCATCGCAGATGCCCTGAGGGGTACTGGCTTCT
ATCAAAAGGCTAGCATGGAGATCAAGATGGCTGACGGGAATGGTGCCATCGCTGCAGAACAGGTCTTCGAGAAAACAAA
AGCTAAGTTCCAAATGTACTGATCATCACTACATTTATCATCTGAATTCCCGTCATTTCTGCGCATCTGCAAAGGAAAG

FIG. 1 continued

CACCTCGCCAGGAATTCACTAATCTGCTTTCAACAGCTTACCAAGAAGGAAAAAGGAAAAATCTGTGAATACATTTCTG
AAAATAAAAATGTTCCCAGAAAAGACATCTAAAACTATTATTGGTTTCATTTTACATGCACTTTCTAATAGTCAGCAAA
AAATTACAAAACTGATCATCACTTTGT

> SEQ ID NO:295 167582 Poppy
GAATTCAAAGAAGGACAAGGAAGGGAAGGAGAGAGATGGAAAGGAGAAGAAAGAAAAAGGAAGCTAAGAAGGAAAAGAA
AGACAAAGAAGTTAAAAAAGATAAGAAAGACAAGGAGAAGAAAAATGAAGGTCTAGAAGATGAAGAAGGCGAAGACAAA
AAGAAAGAGAAGAAGAAGAAAAAGAAAGACAAAGATGGCGAAGAAGAACTGAAGGAAGGGGACGGCGAAAAGAAAGAAA
AGAAGAAGAAGAAAGACAAGGATGGAGAAGAAGAATTGAAGGAGGGGGAAGACGAAAAGAAAGAAAAGAAGAAGAAGAA
AAACAAAGATGGCCAAGAAGACAGCAAGGATGAAAAGAAGACTAAAGACAAAGATGAAAAATCAAAGAAGAAGGAGAAG
GATGAAGGCACTGACATGAAAGAAGAAAAAAAGAAGGACAAGGAAGGGAAGGAGAAAGATGGAAAGGAGAAGAAAGGAA
AAGAAAAGAAGGACAAGAGCAAAGATGAGAAAGATGGCAGCAGCAAGAAGAAAGAAAAGGATGGGGAATCAAAGGAAGA
GAAGAAGGAGAAGAAGAACAAGGATGAAGATAAAGAAGAAGAAGAACAAGAACAAGGAAAGTGAGGAA > SEQ ID NO:296 167874 Poppy
GAATTCAACATCAGTTGATTCAGACTAGCTAGGGGGGGATCAATTGCAGCAACGGCTTCTCATCAGCTTCTATTCTCTA
GCACTACTACCTCTGCTCACCGCTCCTCATCGTCATATGCATCATCCTCTGCTCGAGTACTCTTTGATGTCTCTAAGCA
GTCGACAAACCCAATAACCAGGAAATTATCACTCAGTAATGAAGTCAGGTGTGCCGCAGTTGGGACAACAACACCTGAG
ACTGCAACGGTAACCCCCAAAAGGAGCAAGTATGACATAGTGACTTTGACAAGTTGGTTATTGGACCAAGAGAAGTCTG
GGAATATCGATGCAGAACTTACCGTTGTGCTGTCTAGTATTTCCATGGCTTGTAAACAGATTGCTTCTTTGGTACAGAG
AGCCAGCATTTCTAACCTCACTGGAGGTCAAGGTGCCGTTAACATTCAAGGTGAAGACCAGAAGAAGCTCGATGTTATC
TCCAATGAGGTGTTCTCAAGCTGTTTGAGATCAAGTGGAAGAACAGGGATCATAGCTTCAGAGGAAGAGGATGTACCTG
TTGCAGTGGAGGAAAGTTACTCAGGGAACTACATTGTTGTATTTGATCCCCTTGACGGCTCATCCAACATTGACGCTGC
TGTATCAACCGGATCCATCTTTGGGATATACCATCCTAACGATGAATGTCTTGCTGATTTTGGCCGATGATGTGTCCGC
TCT > SEQ ID NO:297 168151 Poppy
GAATTCCCCACCACTAAAATTATTTTTTAGGGAGAGAAATCTTTTTTTGGGGTTGAGAGGAGAGAGAGAGACACACAGA
GAGAAAAATGGCGATGGCAATGGCACTTCGAAGGCTCTCATCTTCTTCAATCAACAAACCTATCCGTCCTCTCTTCAA
TGCCGATTCCTACTATTGCATGTCATCTCTTCCAAGTGAAGCTGTTGATGATTCTAAGGATAAATCTCGTGTTCAATGG
CCAAAGCAATTGAATGCACCATTAGCAGAAGTGGATCCAGAGATTGCTGACATTATTGAGCTTGAGAAAGCTAGGCAAT
GGAAGGGTCTCGAATTGATTCCTTCAGAGAATTTCACATCTGTGTCGGTCATGGAAGCTGTTGGCTCTATCATGACTAA
CAAATACAGTGAAGGTTATCCTGGTGCTAGATACTATGGAGGAAATGAGTACATTGATATGGCAGAAACCTTGTGCCAG
AAACGTGCCTTGGAGGCCTCCCGTTTGGATCCTGCTAAATGGGGAGTTAACGTGCAATCTTTGTCTGGGTCCCCTGCCA
ATTTCCAAGTCTACACTGCACTATTGAAGCCCCACGAGAGAATTATGGCACTTGACCTTCCACAT > SEQ ID NO:298 168217 Poppy
GAATTCAAAATATTAACAAGCTAGTTGTCTGGGCTTCTGATCAAACTCATTGTGCCCTGCAAAAAGCTGCTCAAATTGC
TGGGATAAACCCAAAGAACTTCCGTGCTATCGCTACTTCAAAGGCTACAAACTTTGGGCTGTCACCCAATTCACTTCAA
TCTACAATTCTCGCTGATATCGAATCCGGATTAGTTCCATTGTTTCTATGTGCTACCGTTGGTACAACTTCATCAACAG
CAGTAGATCCTATTGGTCCTCTCTGCGAGGTTGCTAAAATGTATGGCATTTGGGTTCATGTGGATGCAGCATATGCCGG
AAGTGCTTGTATTTGCCCAGAGTTCAGGCACTTCATTGATGGTGTGGAGGAGGCAGACTCATTTAGTCTAAATGCACAC
AAGTGGTTCTTCACTACTTTAGATTGCTGTTGTTTATGGGTTAAAGACTCTGACTCACTTGTTAAGGCATTATCAACAA
ATCCAGAGTACTTGAAAAACAAAGCAACTGAATCAAAACAAGTTATTGATTACAAGGATTGGCAAATAGCTCTCAGCCG
AAGATTTCGGTCTATGAAGCTTTGGTTAGTACTT > SEQ ID NO:299 168219 Poppy
GAATTCAATAACATTTCTAATGAACTTGTGGGATCCGTGACTCTTTTATCTAATATCAATGTAGACTCTTTGCGCCATA
ATTGAAGGTACCAATATATTGAAGCCGTGAGTTGGTGAGCCTGAAACAAAAATTAAAATCAACCCAAATTAGAAGAGAT
CCAAGTGATAAGTAAACTACTATTTTCTAAAGAAAGAAAGAAACCCAGAAAACATAATGTATTTCTACACCACCAGAAT
ATGTCAAAGTAAAAGTAACGAATTAATTCAAACCTGCAAGATTGTAGTACTGGATAGAAATTGGATGTGCAACAAGTAC
TATACCATGAAAAGTTCAAACCACTAAACAAATAGAAGAAGCCTCTGAAATCAAATTGAAAATCAGAGATTTATGAGAT
GGAAAACTGTAGTAAATTAAGACCCCAGAAAATAAAATTGCAAACATTACGGTACCTGAGAATTCCATCAGCAACCAAG

FIG. 1 continued

TGAAAATATTGAGAGGAGAAATTATCATGTTAAGGTAAGTTGTAACGTTGATCCGTGGTTTTGATTTGATGATCATAGA
TCAAAATTTTTCTTAAAAAGAATCTGGTAATGTGTTGATTTCTAGGGTCTCTTCT

> SEQ ID NO:300 168244 Poppy
GAATTCATCATCATCAACAACATCTGCACTTTCATCAAGAACATCTTCTATCTTTTCAGATAGAATCAGCTTCCCCAAG
AACTCTGCTTACACCGGTGGTATCTCAATTTCTAACAATGCTGTTACCATAAAATCTCAAGTTACTACTACTGAAGCTG
CTGCACCTGTAAAGAAGGTAGAAAAGATCTCCAAGAAGGATGAGGAAGGAATTGTTGTAAACAAATTCAAACCAAAGAA
TCCTTACATTGGTAGATGCCTTCTTAACACTAAGATTACTGGTGATGATGCCCCTGGAGAAACATGGCATATGGTTTTC
ACTACTGAGGGTGAAGTTCCTTACAGAGAAGGACAATCCATTGGGATTATTCCTGAAGGAGTTGACAAGAATGGGAAGC
CACATAAACTCAGGTTGTACTCAATTGCTAGCAGTGCTATTGGTGATTTTGGAGACTCCAAAACTGTTTCATTGTGTGT
GAAGCGACTAGTTTACACCAATGATCAAGGTGAAGAAGTTAAGGGAGTTTGTTCAAATTTCCTGTGTGACTGGAAACCA
GGATCTGAAGTGACAATCACAGGGCCAATTGGAAAAGAAATGCTTATGCCTAAAGA > SEQ ID NO:301 168264 Poppy
GAATTCAGCAAGATTAGTTGCTTCTGGTTTGGCGAATTTCCATGGAGTATCAAGTACTAAAATTGATGGATTAAAGCTG
AAAGACCAGAGTAATGGAAGCTATGGTGTAATAGAAGCAAAGAAAGGGAACCCACCGAAATACAGCAAGATTAGTTGCT
TCTGGTTTGCCGAATTTCCATGGAGTATCAAGTACTAAAATTGATGGATTAAAGCTGAAAGACCAGAGTAATGGAAGCT
ATGGTGTAATAGAAGCAAGGAAAGGGAACCCACCTGTAATGCCAGCTGTGGTGACACCAGGAGGACCTATAGACCTTTC
ATCTGTGTTGTTCAGGAATCGCATAATCTTCATTGGTCAACCAATTAATTCACAAGTTGCTCAACGAGTAATATCACAG
CTTGTAACACTAGCAGCTATTGATGAGAATGCAGATATTCTGATATACCTGAACTGCCCTGGTGGAAGTACATACTCCG
TGTTAGCAATATATGACTGCATGTCATGGATAAAGCCCAAGGTGGGCACAGTCTGTTTTGGTGTAGCTGCAAGCCAAGG
AGCACTTCTTCTTGCTGGGGGTGAAAAAGGAATGCGCTATTCAATGCCAAATGCACGT > SEQ ID NO:302 168331 Poppy
GAATTCACAACCATTTCACCCTGTAAATCAAGGGCACTTTCATCATCGACTTTCATTCCCACCATCTCCACTAATATTA
TACCTCAAAATTTCTTACACAAAATACCCATAACCATGAGCAATAACTCCTCACCGTCGAATTTAACTGTAAAGTGTGG
CGGTGGAGTTGAAATTAGAGAAACCCAAGATGAAAATTCATCTAATAAACCCATCTTTGAAACACTTAATTCAAGTCCT
GATTTGTTACAGAAGTTGATTTATGATGCTCTTGTTTGGACTTCTCTTCATGGTCTTGTTGTTGGTCACAAATCTGTAC
AGAAATCAGGAACTGTTCCTGGAGTAGGCATGGTACATGCCCCGTTTGCATTGTTGCCTATGTCTTTCCCTAAGAATCA
TTTTGAACAAGCGTGTGAGTTGGCTCCAGTTTTTAATGAGCTCGTTGATCGTGTAAGCCTTGACGGCAAGTTCTACAA
GATTCATTGTCCAGAACAAAAAAGTGGATGCTTTTACCAGTAGACTCTTAGATATTCATTCGAAGATGCTAGAACTAA
ATAAGAAAGAGGAAATTCGATTGGGTTTGCATCGTTCTGATTATATGCTTGATGCTCAAACTAAAGAACTTCTTTAAAT
AGAGCTCAATACCATTTCTTCTTCGTTTGCTGGAC > SEQ ID NO:303 168338 Poppy
GAATTCATGTCTATTTCTTTTGTACGTTTTTGGGATCAAACAGAAGGAGATGGATATCGAAGAAGAAAAATTGAAAGGG
CAGGCAGAGATATGGGACAATATGTTTGCATTTGTAAATTCAATGGCATTGAAATGTGCAGTTGAACTTGGTATACCCG
ATATCATAAACTCTCATGGTCGACCGGTCACAATATCGGAGATCATAAACAGTTTGAAAAAAAACATCATCATCATC
TCCTAATGTCGATTATCTTACTCGTGTAATGAGATTGTTGGTTCATAAACGTATTTTTGCTTCTCAATTTCATCAAGAA
AGCAATCAGATTTTATATGATTTAACTCCATCATCAAAATGGTTATTAAGAGATTCAAAATGTACTCTAGCACCAATGA
TTTTACTTCACCTTCATCCTCTCTTTTAAAACCATGGAATTATGTGGGAAAAAGTGTTGAAGAAAGTGGTTCTCCTTT
TGAGAAAGCTCATGGATGTGATACTTGGGATTTGGCTTTAGCTAATCCTCAATTTAATCAGCTTTTCAACGATGGCATG
GAATGCACGGCTAAGATAGTCGTCAACAAGATGTTGGCTAACTACAAAGATGGATTTAATGGT > SEQ ID NO:304 168353 Poppy
GAATTCAACCCTAACAACAAGTTAGAATGGGGGAAGTTAAAGACGGCGAGTATGAGGAGGAACTTCTCGATTACGAAGA
AGACGAAGAAAAAGCACCAGATTCTATCGGTGCTAAGACTAATGGAGAAACTGTCAAGAAGGGATACGTTGGAATTCAC
AGCTCTGGATTTAGAGATTTTCTTTTAAAGCCGGAACTACTTAGAGCTATTGTTGATTCTGGATTTGAACATCCTTCTG
AAGTGCAACATGAGTGTATCCCTCAAGCTATTTTGGGAATGGATGTTATTTGCCAAGCCAAATCCGGGATGGGAAAGAC
TGCCGTTTTTGTTTTATCTACACTTCAGCAAATTGAGCCTGTTGCAGGACAAGTGGCTGCACTTGTTTTGTGCCATACA
AGAGAGTTGGCTTACCAGATCTGTCACGAGTTTGAGAGGTTTAGTACATACTTAACTGACACCAAGGTTGCCGTCTTTT
ATGGTGGGGTTAACATCAAAAGCCACAAGGATTTACTTAAAAATGAGTGTCCTCATATTGTCGTTGGAACTCCTGGGAG
GATACTAGCATTGGCAAGAGACAAGGACCTTGCTTTGAAGAATGTGAGACACTTCATCCTTGATGAATGTGACAAGATG
CTGGAGTCGCTTGACATGCGAAAGGATGTGCAGGAAATATTTAAGATGACTCCTCATGATAAGC > SEQ ID NO:305 168479 Poppy
GAATTCAACTCAGTTTTCTCCTCAATCTCTGGTGTATTGGAACTTGTTTAGTTCTCAATCCTTTCTTTTCTTTCTTAAG
CTTAGATATTCATTCTTTTGCAACATTTGTGTGAAGTTGTTTTGTTGTAAGAATAAGAAGAAGCTAAGAAGATGAAGAT
TCAGTGTGATGTGTGTGAGAATGCACCAGCAACAGTAATATGTTGTGCAGATGAAGCAGCTTTGTGTAGTAAATGTGAT
GTTGAAGTTCATGCAGCTAACAAACTTGCTAGCAAGCATCAGAGGCTTCATCTTGATGCACTCTCTGATAAGCTTCCTA
AGTGTGATATCTGCCAAGACAAAACAGCATTTATATTCTGTGTTGAAGACAGAGCACTATTTTGCAAAGATTGTGATGA
GCCAATTCATTCAGCTGGTAGCATTTCTAGTAACCATCAGCGATTTTTGGCTACTGGAATTCGTGTAGCGTTGGCCTCT
AGTTGTGCTAAAGAAACTGAGAAACAAATTCCAGAACCACCAAGCAACCAAAAGTTGCAGCCCCAATGTGCAGTGAAAC
ATACTGTTCAGAGTCTCCAGACTGTTCCACAACAACCGTCTAATTACGCAAACTCTCCAACTTGGGCTGTTGATGATTT
GCTACAATTTTCCGATTTTGAATCTAGTGAC > SEQ ID NO:306 168524 Poppy
GAATTCGCCTCACCAACCTCTGCAATCGGTTGGGAAGGTTTCGAGAAAAGACTCGAAATCTCATTCTTTGAGCCTGGGG
TATTTGCTGACCCAGCAGGCAATGGCCTTAGGGCTCTAACAAAATCTCAACTGGATGAGATACTAGAACCAGCTGAGTG
CACTATTGTAGGGTCCATGTCCAATGCTGATCTCGACTCCTACATACTCTCTGAGTCTAGCTTCTTTGTCTACCCATAC
AAGATGATCATCAAAACTTGTGGAACCACCAAGTTATTGCTTTCAATCCCACCTATCCTTGAGTTAGCAAAAACTCTGT
CCCTCACTGTAAAAGCTGTGAATTACACCCGTGGTAACTTCATTTTCCCAGGTGCTCAAACTTTCCCACACCGCAGCTT
CTCAGAGGAAGTTTCAGTTCTAGACAGCCAGTTTATTAAGCTTGGTCTGCAAAGCAGTGCATATGTGATGGGTGATAAT
GAAGCACAAAACTGGCATGTGTACTCTGCTTACGCTGAAGCAACTGGTGATCAGGCTAACCCCAATTTCACTCTTGAGA
TGTGTATGACTGGTCTAAACAAGGAGTGCGCGTCTGTGTTCTACAAAACTGAATCAAGCACAGCTAATGAGATGACTGA
AGCCTCTGGCATAAGGAAGATTCTTCCAGATTCTAACATAAATGACTTTGAGTTTGACCCATGCGGCTAC > SEQ ID NO:307 171033 Oryza sativa
TGGTGGTGAGGGTATGGGGGCTGAAGGGGTCGGGAGGAGGAGGCGGGTGGTGGCGCCTGCGGTGAACGGGGTGGCGAAG
GACGGGGCGCCACAGCCGCCTCCGCCCAAGCTGCTCACGCTGCCCACCGTGCTCACCATTGGCCGCGTCGCCGCCGTGC
CGCTCCTGATAAGCACTTTCTACATGGAGGGGCCTTGGGCAGCAACTGCGACAACTGGCATCTTCCTTGCTGCTGCAGT
CACTGATTGGCTAGATGGTTATATTGCGAGAAAGATGCAGTTAGGAACACCTTTTGGTGCATTTCTTGATCCTGTGGCT
GACAAGCTTATGGTAGCTGCAACATTAGTGTTGCTGTGCACCAAACCTTTGGAAATTTCACTGCTCAGAGATGGGCCAT
GGCTTCTAACGGTTCCTGCCATTGCTATTATTGGGAGAGAGATCACAATGTCAGCTGTGAGAGAATGGGCTGCGTCTCA
GAATACCAAAGTTCTTGAGGCTGTGGCAGTTAACAATTTGGGGAAGTGGAAGACCGCAACGCAGATGACAGCATTGACT
ATCCTCCTTGCGAGCAGAGACAAAAGTCTTCCTGCACAAGA > SEQ ID NO:308 171051 Oryza sativa
CCCGCGACAAGCTCAGCTGGGCTAGGCCAAGACGGTGGCGAGCGGCGGCGATCTGGTGCTCTGCTTGAGTTGAGTTCTT
GATTTTGCCGAGGTGTATCGATGGAGACGACGGCGGCGGCGAAGAAGCTGCCGCCGGGGTTCAGGTTCAGGCCCACCGACGA
GGAGCTTGTGGTGCACTACCTCCGCCGCCGCCGTCGGCTCCCCTCTCCCGCCCGCCGTCGACATCCCCGATGTCCGC
CTCCTCGCGCATGACCCCTCCGACCTGCTTCCTCCAGGGTGGAGTGAGCAGGAGAGGTACTTCTTCACGTGCAAGGAGG
CCAAGTATGTCAAGGGGCGCCGCGCCAACCGCGCCACGGGCGCCGGGTACTGGAAGGCGACGGGGAAGGAGAAGCCGGT
GGCGGTGTCCGTG > SEQ ID NO:309 171278 Oryza sativa
CTTAGATCACCATCTTGGGGAGACGGTTGAAGTCACCTATCATTTCTAGGCTCCTGGTTACCACACTTTGAGCTTTGG
GATTACTGCTTTCTTTGGCGTGATGGCGGAGCAGAGAGGGAAATATGTTGATGAAAAGTATGAGATGGGGAAATTACTC
GGGCAAGGAACCTTTGCCAAGGTTTACCATGCCCGTAACACCGAGACTTCTGAGAGTGTTGCTATCAAGATGATTGATA
AAGAGAAGGTTTTGAAAGGCGGGCTCATGGATCAGATCAAACGTGAGATTTCTGTGATGAAGTTGGTGAGGCATCCAAA
CATTGTGCAGTTATATGAGGTCATGGCTACCAAGACTAAGATATATTTTGTGCTGGAGCACGTCAAAGGTGGAGAGTTG
TTCAACAAAGTTCAGAGAGGAAGACTAAAGGAAGATGCAGCAAGGAAGTACTTCCAACAACTGATTTGCGCTGTTGACT
TTTGCCACAGCAGGGGTGTTTATCACCGTGATTTGAAGCCAGAAAATCTTCTTCTTGATGAGAACAGCAATCTGAAGGT
TTCAGATTTTGGCCTAAGTGCTCTTGCTGATTGCAAAAGACAGGATGGGCTGCTCCACACAACCTGTGGCACACCTGCT
TATGTTGCTCCAGAAGTGATCAA

FIG. 1 continued

> SEQ ID NO:310 171917 *Oryza sativa*
CCTCTCGCCAGTGCCACCGGGGCTCAAGCGTGATCCAGCGTTGGGCCGTGCGTGCGATATGTCGGCCGCCGGGGAGGAG
GACAAGAAGCCGGTGGGGGGAGAGGGCGGCGGCGCCCACATCATCCTCAAGGTCAAGGGACAGGATGGGAACGAGGTAT
TCTTTCGCATCAAGAGATCTACGCAGCTGAAGAAGCTGATGAACGCCTATTGTGACCGTCAGTCTGTGGATATGAATGC
TATTGCATTCCTATTTGATGGTCGTAGGCTCCGTGGCGAGCAGACCCCTGACGAGCTCGAGATGGAAGACGGGACGAG
ATCGACGCCATGCTCCACCAGACTGGAGGCTGCCTGCCTGCCTAGAAGCTTACGAGTTCTTGCAGCCTCGTAAAATTGT
GCCTTTAGTAGGCTCAATATCTAGAAGTACATGAAAAAAAGAAGCCTAAAAGAACTTGTGAGGCTTTGGTCCTGTGCC
ATAGCTGAAGGACATTAGAAGAGCTTTGTTTGGCAAAAATATTTTGGTACTTCGGCTGTTATGACTCGTTTATCC > SEQ ID NO:311 174804 *Oryza sativa*
GTAGATAACGCCTTCTTGCATCGCAGGAGGTGCGCTTCCTATCCCCATCGCCACCCATGGCGACTCCCGCCGCTTCCCC
TCTCCTGCTGCCGCTCCCCCTCCCCCTCCCGGCCTCCACCTTCCCGCCTCGCCGCGCCGTCCCCTGCGCCCGCCGCCTC
GTCTTGCGGCCTCCCCGCGCCGGACGCCCTCGCCTCCGGGACCCGCCTCCCGCGGCACCCCCACCGGCGGTGGAGGAG
TCGGCGAGGAGGAAGAGGACGACGATGCCCCCCCGCTCAGGCTCCTCGAACCGCCCCAGGAGGACGACCCCTTCCCGCC
CGAGATGGAGCCGGCCGACCCCGACTTCTACCGGATAGGGTACGCGCGGATGATGCGGGCGTACGGGGTTGAGTTCTTG
GAAGGCCCCGATGGGATGGCCGTCTATGCCTCCCGGGACGTCGACCCACTCCGCAGAGCTAGAGTGATTATGGAGATTC
CATTGGAGCTGATGCTGACTATAACTCAAAAACGCCCTTGGATGTTTTTCCCCGACATTATTCCACTAGGCCATCCCAT
ATTTGACATCATTGAATCAACAGATCCTGAG > SEQ ID NO:312 174874 *Oryza sativa*
atccattaattactcggttcgtggtcggaatcCATGGCCGCCGCCGCAGCCGCTGTCGGGAACCCTAACGCGGCTGCCG
CCGCTGCGTCGGTCTCGGCGTCGAGGGTCGGTGCGGGGCGCTGCGCGCGGGGGGTTTGAGGGTGGCGGCGGGGGGAAG
TGTGGCGAGGAGGGGAGGGGCTGTGGTGGCGGCGGCAATGCGGCCGGCGAAGGCGGTGGCGTCGCCGGCGAAGGAGGCG
GCCGGGGAGGTGAACGGGGCGGCGCCGGGGGGGTTCGCGAGGCCCGACGCGTTCGGGAGGTTCGGGAAGTTCGGGGGCA
AGTACGTGCCCGAGACGCTGATGCACGCGCTCACCGAGCTCGAGGCCGCGTTCCACGCCCTCGCCGGCGACGAGGATTT
CCAGAAAGAACTTGATGGTATCCTCAAGGATTACGTCGGCCGTGAGACCCCGCTGTACTTTGCGGAGCGATTGACTGAG
CACTACAAGCGCGCTGATGGCACAGGCCCCAAGATTTACCTCAAGAGGGAGGATCTTAACCACACTGGCGCCCACAAGA
TCAACAATGCTGTCGCGcaagtcTTGCTTG > SEQ ID NO:313 174878 *Oryza sativa*
GGTTTAGCTCGCTCTGTGCGTTGATTTCTTGATATCATGGCCAAGAGGCACCTCTTGTTGGTGACAACTTGTTTGTGGG
CTCTGTCATGTGCCTTGCTGCTTCATGCTTCCTCTGATGGGTTCCTGAGAGTCAACCTCAACAAGAAGAGATTGGACAA
GGAAGATCTCACTGCCGCCAAGTTGGCGCAGCAGGGCAACCGTCTTCTGAAGACCGGCAGTTCAGACAGTGATCCTGTC
CCTCTGGTGGACTACCTCAACACCCAGTACTATGGGGTGATTGGCCTCGGCTCACCGCCGCAGAACTTCACGGTGATAT
TTGACACTGGAAGCTCCAACCTGTGGGTTCCTTCAGCAAAATGCTATTTTTCGATAGCATGCTACCTCCACAGCAGATA
CAACTCGAAAAAGTCGAGCTCTTACAAAGCAGATGGAGAAACTTGCAAAATTACATACGGTTCTGGGGCAATTTCTGGA
TTCTTCAGTAAGGATAATGTGTTGGTTGGAGACCTTGTAGTGAAAAACCAGAAGTTCATTGAGGCAACACGCGAAACAA
GCGTTACCTTTATCATCGGAAAGTTTGATGG > SEQ ID NO:314 174917 *Oryza sativa*
TTCTTCTTCTTCTTTCTGTACTCACCTGCATCTGTAGAGAGAGAGAGAGAGAGAGAGAGAGAGAGAGATGGCAGGAGGT
GACAACAACTCCCAGACCACCAATGGCGGCTCAGGTCACGAGCAGAGAGCCATGGAGGAAGGCAGGAAGCAGGAGGAGT
TCGCCGCCGACGGCCAGGGCTGCGGCCTCGCCTTCTCCGTCCCCTTCATCCAGAAGATCATCGCGGAGATCTTTGGGAC
ATACTTCTTGATCTTCGCGGGGTGCGGGGCGGTGACGATCAACCAGAGCAAGAACGGGCAGATCACGTTCCCGGGGGTG
GCGATCGTGTGGGGCTGGCGGTGATGGTGATGGTGTACGCCGTGGGGCACATCTCCGGCGCGCACTTCAACCCCGCGG
TGACGCTGGCGTTCGCGACGTGCCGGAGGTTCCCTTGGCGGCAGGTGCCGGCGTACGCGGCGGCGCAGATGCTGGGCGC
CACCCTCGCCGCCGGCACGCTCCGGCTCATGTTC > SEQ ID NO:315 175484 *Oryza sativa*
TTAGCTCTTGGGAGAAGAAGGCAAGAAGAAAATGGACGGGGTGAACAGGCTGGCGGCGCAGCGGGCGGTGGTGATCTTC
AGCATGAGCTCGTGCTGCATGTGCCACACCGTGACGCGCCTCTTCTGCGAGCTCGGGGTGAACCCGACGGTGGTGGAGC
TGGACGAGGACCCGAGGGGGAAGGAGATGGAGAAGGCGCTGGCGAGGCTCCTCGGCCGCAGCCCCGCCGTGCCGGCGGT
GTTCATCGGCGGGAGGCTCGTCGGCTCCACCGACAAGGTCATGTCGCTGCACCTCAGCGGCAACCTTGTCCCGCTGCTT

FIG. 1 continued

CGCAATGCGGGTGCCCTCTGGGTGTAGCACCAACGACGCAACTATACCTACCAGCGACTGGTTCTTGATTTGGACTGAT
ACCGTGGCGCAGAATAATTTTATACGGGTACTTTGGTTTGTATCAGGCAGGTCAGGTATATCTAAGGGAAAATAAATAG
TACGTGCAG

> SEQ ID NO:316 175535 *Oryza sativa*
CCCCCCGATGAGAATGGCCGCGCCGCAGCGGGTGCATGTGCGTGCCGCCCCGCTCGCGCGCGCGCTCCGAACTCGCGTC
GCCGCCGCCGCCGCGTCTGCGAGCTCTCCCGAACGCGCGCTCCTCGGCCTCTCCGAACCAGATCTCCGGCAGCTCGCCG
TCGACCTCGGCCAGCAAAGTTACAGGGGGAAGCAGCTTCACGACCTCCTCTACAAGTCCAGGGCCAAGCAAATCCAAGA
ATTTAGCCACGTACCAAAGGTGTTCCGTGAGGCCTTGGTCGGCGCTGGCTGGAAGGTTGGCCGCTCGCCAGTGCACCAT
GCTGTGACGGCCTCCGATGGCACTACCAAGATACTTCTCAAGTTGGAGGATAACAGATTGATCGAAACAGTAGGGATCC
CTGTCGATGATGACAAAGGCCCGTCAAGACTCACTGCCTGCGTTTCATCACAGGTTGGCTGCCCCTTGCGTTGCTCATT
TTGTGCCACTGGCAAGGGAGGGTTTGCAAGAAACCTTCATGCACATGAGATTGTTGAGCAGGTTTTGGCCATAGAGGAG
ACGTTCCAACACAGGGTGACAAATGTAGTGTTCATGGGGATGGGTGAGCCTATGTTGAACCTGAAATCAGTTTTAGAGG
CACATCGATGCTTGAACAAGGAACTAAAAATTGG > SEQ ID NO:317 175706 *Oryza sativa*
CCCCACAGCATAGTAACCAACCGAACCAGGCATCAGCCATGGCGCGAAGGCTCTCGCTGCTGGCCGTCGTGCTGGCGAT
GGTGGCGGCCGTGTCGGCGAGCACGGCGGCGGCGCAGAGCTGCGGGTGCGCGTCGGACCAGTGCTGCAGCAAGTGGGGG
TTCTGCGGCACCGGCAGCGACTACTGCGGCACGGGGTGCCAGGCGGGCCCCTGCGACGTGCCGGCCACCAACGACGTGT
CCGTGGCGAGCATCGTCACGCCGGAGTTCTTCGCGGCGCTCGTCGCCCAGGCCGACGACGGCTGCGCCGCCAAGGGCTT
CTACACCCGCGACGCCTTCCTCACCGCCGCCGGTGGCTACCCTTCCTTCGGCCGCACCGGCTCCGTCGACGACTCCAAG
CGCGAGATCGCCGCCTTCTTCGCCCACGCCAACCACGAGACCATAAAGTTCTGCTACATCGAGGAGATCGACGGACCGA
GCAAGAACTACTGCGACGAGACGAGCACGCAGTGGCCGTGCATGGCGGGGAAGGGGTACTACGGGCGCGGGCCGCTGCA
GATCTCGTGGAACTTCAACTACGGGCCGGCGGGGCAGAGCATCGGGTTCGACGGGCTGGGCGA > SEQ ID NO:318 175736 Contig A *Oryza sativa*
CGATCGCTTCTCATCGCAAATCGCATCGACTTCGATTCGCTTCGTTTCGTTCTCGCTGTTGATTTGTTCGTGAGATTTG
AATTCTAGCAATGGCTCCTCTCGGTGACGGAGCGGCGGCGGCGGCGGCGGCGGAGCCCAACCTGGTGGTGTCGTTCGGG
GAGATGCTGATCGACTTCGTCCCCGACGTCGCCGGCGTCTCGCTGGCCGAGTCCGGCGGCTTCGTCAAGGCTCCCGGCG
GCGCCCCCGCCAACGTCGCCTGCGCCATCTCCAAGCTCGGTGGCTCCTCCGCCTTCGTCGGCAAGTTTGGTGATGATGA
GTTCGGGCACATGCTGGTGGACATCCTGAAGAAGAACGGGGTGAACGCGGAGGGGTGCCTGTTCGACGAGCACGCGCGC
ACGGCGCTGGCGTTCGTGACCTTGAAAAGCAACGGCGAGCGCGAGTTCATGTTCTACCGGAACCCGAGCGCCGACATGC
TCCTGACGGAGGCGGAGCTCAACCTGGACCTGATCCGGCGCGCCAAGATCTTCCACTACGGCTCCATCTCCCTCATCAC
CGAGCCGTGCCGCTCCGCCCACGTCGccGCCATGCGCGCCgccaagTCggccggCATCCTCTGCTccTAcgaccCc > SEQ ID NO:319 175736 Contig B *Oryza sativa*
gaacaaagacatgacacaataaatttcgccaagtagctgcctcattacacaaattcagaccaaaatatccaccgcaaat
cCAAGAGCTTCTTATTAATAATAATAGTAAAAATAAACGCCAAAAGTTCTCACACGGAAGCAACTAACTTAGCACACAA
AAGACAGACATGAACACACCCAAGCCCCTCCTCTTCCTTGTCTAAAACGAAGCAGCAACTAAATTAAATCGACCTAAAA
TTCCGAGGCCCCCAATGGCGGCGATCGACGACGAAACCGAGGAGCTCTAGTTGGCTGCCTTGCTGATGAGCTCCTGCGC
GACGGCGACGGTGGGCAGCGCCGGGATGGCACCCTTCTTGGTGGTGCAGATGGCTCCGCACGCGTTCGAGAACTTGAGC
GCCTCCCTCAGCTTCTCCTCGTTGTGGAAGATGGAGTCGTCCTTGGCGACGTTGACGAGGAGGGAGCCGACGAAGGCGT
CGCCGGCGCCGGTGGTGTCgacGGTGTTGACGGAGaaGCCGGGGACGGAGCCCTTGAAGTCCTTGGTGAAGTACctgca
TCCCTTCTCGCCGTCGGTGACGATGAGGAGCTTgaggccgTCGAAccAGaGcgagagcacgttcttcTCGTCGTTGgcg
tcgccctgggTGag > SEQ ID NO:320 175912 *Oryza sativa*
CCCCCCCCCGACTCATCCACCACCCAAAGACAAAGCAAGCAAGTACAGTAGCCATGGCGAAGCATCTCGCGCTGTCCGT
GGCCGCCGCGGTGGCCGTGTCGTGGCTGGCGGCGTCGTCGGCGGCGGCGGCGGGGTTCTACGAGAAGTTCGACGTGGTG
GGCGCCGGCGACCACGTGAGGGTGGTGAGCGACGACGGGAAGACGCAGCAGGTGGCGCTGACGCTGGACCGGAGCTCCG
GGTCCGGGTTCACCTCCAAGGACACCTACCTGTTCGGCGAGTTCAGCGTCCAGATGAAGCTCGTCGGCGGCAACTCCGC
CGGCACCGTCACCTCCTTCTACCTCTCCTCCGGCGAGGGCGACGGCCACGACGAGATCGACATCGAGTTCATGGGCAAC
CTCAGCGGCAACCCCTACGTCATGAACACCAACGTCTGGGCTAATGGCGACGGCAAGAAGGAGCACCAGTTCTACCTCT

FIG. 1 continued

GGTTCGACCCCACCGCCGACTTCCACACCTACAAGATCATCTGGAATCCCCAAAACATCATATTCCAGGTGGACGATGT
GCCGGTGAGGACGTTCAAGAAGTACGACGACCTGGCGTACCCGCAGAGCAAGCCGATGAGGCTGCACGCGACGCTGTGG
GACGGCAGCTACTGGGCGA

> SEQ ID NO:321 175951 Oryza sativa
CCCCGAGTGCTCGGCACGTCGGTTGTTGCTGGTGCTGCTGCTGCTCCTCCCGTTTTCCGATCGCAGCCATGGGAACCCG
CAGCGTGGCCTTGGTGCTCCTCGCGGCCGCGCTGCTCCAAGCCCTCCTCCCCGCTTCGGCGGCGGAGGGTTTGGTGCGG
ATCGCGCTGAAGAAGCGCCCGATCGACGAGAACAGCCGCGTCGCCGCGCGACTCTCCGGTGAGGAAGGGGCGCGCCGGC
TGGGCCTCCGCGGCGCCAACTCCCTTGG > SEQ ID NO:322 175977 Oryza sativa
CCCCCCCGGTGCTCGGGGAAGTTCGATCGATGCCTCACCATGGCGTCGGAGAAGGAGGCGGCGCTCGCCGCCGTGCCCA
ACGACAACCCCACCATATTTGACAAGATCATCAAGAAGGAAATACCTTCCACTGTGGTATTTGACGATGAGAAGGTTCT
GGCTTTCAGAGACATAAATCCTCAAGCTCCGACCCACATTGTGATCATTCCCAAAGTGAAGGATGGATTAACTGGCCTA
TCAAAGGCAGAAGAGAGGCATGTACAAATACTCGGTTACCTCCTCTATGTTGCCAAAGTTGTTGCAAAGCAGGAGGGAC
TTGAAGATGGCTACCGTATTGTCATCAATGATGGCCCCACTGGATGCCAATCTGTTTACCACATACATGTACATCTCCT
CGGAGGCAGGCAGATGAACTGGCCGCCGGCCTAACGAGTGCCCGTCTGTTGAACTGCCTTCATGGCAAGGATGTCACAC
TGCCTCTC > SEQ ID NO:323 176047 Oryza sativa
CCCCACCCAGCCAGCTCGAGCGAGCGAAGCCAGCAGCAGAAGCAGTAGAGAGAAAGTAGAGAGATGGAGGGGAAGGAGG
AGGATGTCCGGCTGGGAGCCAACAAGTTCTCGGAGAGGCAGCCGATCGGCACGGCGGCGCAGGGCTCCGACGACAAGGA
CTACAAGGAGCCGCCGCCGGCGCCGCTGTTCGAGCCAGGGGAGCTCAAGTCGTGGTCCTTCTACCGCGCAGGGATCGCC
GAGTTCATGGCCACCTTCCTCTTCCTTTACATCACCGTCCTCACCGTCATGGGGGTCAACAACTCCACCTCCAAGTGCG
CCACCGTCGGCATCCAGGGCATCGCCTGGTCCTTCGGCGGCATGATCTTCGCCCTCGTCTACTGCACCGCCGGCATCTC
CGGCGGCCACATCAACCCGGCCGTCACCTTCGGCCTCTTCCTCGCCAGGAAGCTGTCCCTCACCA > SEQ ID NO:324 181039 Poppy
TGATACTCATCACCTACACTGAACGAGAACAAGACTAATTAATTCAGCTGTATCAAATCTTAAACGCCAGTAGCGGATA
AAACACCAATCGCTACAGAGCGGATAACTCTCCGCTACTGGAGGCTCAAAACGGGGTTTAGAGCGCGGTTCCCCATAAA
GAAATAAAAACATTTATCTAACTTTATAGATACCGCACTAGTGTCTTATTCCCAGTATTTAGCAACTTATTATGCTCGA
GTGGTGGGCTCCTAGGCCTTGAAGTCCTGAGCCGAACCGGAGCACTCCGCGCGCGTCGACTCCGGTGCGGACGTGAACA
GGTCCGTCCGGCACGGGACACCCGGGTCAACGAGGTGGTCGTCAAAGCCGGAGAGGACCGGGTC > SEQ ID NO:325 181056 Poppy
GACTCCATCCCAAATACGTTAAGCACTTACTGTTAATAACTCTCCCTAAATATGTACTTTTTGGTATTACTTAACGTGG
AACTCAACAACACAGAACCCCTTTAAAGAAACACTTTACACTTATAATTGTTGTTTTGAGGGTCAGGGAAAGAAGATTG
TGCATGAACACGAGGAGGAGGATTAGGAGTTACACCGATAGTAGATAATGGATAAACTCCAACAGCTTCACCAGGAGTT
TACTTGTTTGCAATACGTTTTCAAGCTCACTTTAACCTACCAGTAGAATTATTTCTGGCTTTAGCGCTTGTGTTTAACT
AGTGGTAATTTCTAGCAATATTATCGAAGAAGTTAACGGTTACTCGGCGATTTATAGTAATCGGTTGTGGTGTTTCAGG
AGGAATAACTGCAACG > SEQ ID NO:326 181743 Poppy
GAATTCATCATCAACAGTCTCAACATTACTTTATTTCTTAAGCTTCAGCAGTCTCAGCTGATTCAGCAGCTGCAAGGAT
AAGCTCTGGTACAATACCTCCCATGTCACTGTAGTTTCCATCAATAACATTAGGTTGTCCCAATGCCTTCAGTGCTAAA
TGTGCTGCCTTTTGCCCTGAGATCATCATGGCTCCGAATGTTGGTCCCATTCTTGGGGCACCATCAATTTCAGCCACTT
CCATTCCAGTAACAATCATACCAGGAACAATTTCTCTAGTGAGTTTAACAATGGCATCTTCAGCGGCGTTCATGTCAAG
AGCTTTCATTCCAGGAACTGAGTCGATTAAACCAATACTCTTCAACCTTTTAACACCAGTAGCACCAAAAGGACCATCA
TGACCACATGAACTGACAACAATCTTGGCTTCCATGACATTAGGGTCCATGCAAGATTGTGTGTCATGGTTCATTGAGA
CTAACGCCCAGTTGGTGACAACTCCGGCAACTTTATTGTTCTTAACGATCAAATCCTCTGCTGCAACAGCATTGAACAA
CTTGACGTTTGGTCTGGCCAACAACTTTGACATGATGGTGGAAGTGAAC

FIG. 1 continued

> SEQ ID NO:327 181759 Poppy
GAATTCACTTGACAATAATTCAAAGAGAGTTCCTACTCACAGAAGATTTGGTAGTACTATTTCAAAACCGATTAAAACC
GTCATATCTCTGAGAAGAAGTACATTAGTATTCCACCATGTTTGCCGTGCTGCTGCCTCTTCTGCAGAAGGAGAATCAG
GGTCATCATCCTCAAACCAACAGAAACCAATTAATAGAGCTCCACCAGGTGTAGACACCAGAATTCATTGGGAAAATTC
AGAGGATGGATGGATAGGAGGTAGCACAACCACTAATTCGTCACAGTCGACGAAAAACGAGACAGGCGGTGAAGGCAAG
TACTCTTCTCAACAAGAGAGCTTTCTTGGCCAGGATTTCCCTGATTTGCTCAATAGTGCTTCCAACGATTCCCACTACC
AGTTTCTGGGAATATCAGCAGAAGCAGATTTGGAAGAGATCAGAGCAGCATATCGGCGACTATCAAAAGAATACCATCC
AGACACAACACTGCTTCCACTAAAAACTGCATCAGAAAAATTCATGAAGTTGAGAGATATATATGACATATTAAGCGAC
GAAGAAACTCGGCGTGTCTATGATTGGACTTTAGCTCAAGAAGCAGCCAGTCG > SEQ ID NO:328 181824 Poppy
GAATTCAGTACTATTGTTTTTCTGTTTTCTAACAGAAGGTATCCAACCCTGTGGCGATATGCCGAAACTAATGGGTATA
ACTGAGGCCCACTCCATAACTGAAGATGAACGCCACAGCTTATACAAGAGTCTAGGCATTACTACCAAGCATAAGCAAA
TCTTTTCAATCACTGGGATCACCAATAATACTGCCATTTCTACTCTCGGAAGAGAGATTGCAATAGCTGGTCGCTTCCT
TGATGAACAGCCAGATATTGACTGGAAGAAAACTCGATTCTTCTTTATATTTGGGAACAGAAGTCACCGTGCTGTATGC
CTAGGAGAGTGGGTGTTCTCTTGTATACCAATGTTTCGTCTACCTGGAACAGTTAACTTTTATTTGAGCCTCGATGGCA
CAACTCCCATTAGCCAGATCCTGAAATTCGACTTTCTCTCAACTCCAACTAATCAGGAGCTCTTCTCTACATTTGTGGG
GTTCCGCCAACAACTATGTCTTGCTCACCTGCTCTACTCTAAAACCAAAAGACTGACTGATCTGTCACGTCTCTCTAAT
TCTTCGGAGGCAAAAATTATGCACAACCTCGTCTTGTCTTATTGCGAACGCAATACTACCACCTTCATCCGCTCAATTC
AAAACCCA > SEQ ID NO:329 181971 Poppy
GAATTCAGGTAACTCCTCAGCTCATCAGTAGCCGCCCTGTCTTTGCTGCTCCAGCTCCATACATCACTCCTAGGGGGAG
AGAAGAAGTTCAAATCGTTGAAGAAGAACAAATGGCGTCAAAGGATAACTACGAAGAAGCCATTGCTGGGCTCAAGAAG
CTTCTTAGCGAGAACAATGGTCTGGAGGCAGTTGCCGCGGCTAAGATCGAACAGATAACAGCTGAATTACAGACTACTG
CTAACGGGAAAGCCGACGGATTCTGCCCGGTTGAAAGGATCAAGACTGGATTCGTCCAATTCAAGAAGGACAAATACGA
GACTGATCCAAAACTGTATGGGGAACTTTCCAAGGGTCAGAGCCCCAAGTTCATGGTGTTTGCATGCTCTGACTCTCGA
GTGTGCCCTTCCCACATCTTGGGATTCCAACCAGGAGAAGCTTTTGTTGTTAGAAACATTGCTAACATGGTTCCAGCCT
ATTGTCAAAACAGGTACTCTGGAGTTGGAGCTGCCATAGAATATGCTGTCTTGCATCTCAAGGTTGGGCATATTGTGGT
GATTGGACACAGCTGTTGTGGTGGGATCAAAGGACTTATGTCTCTTTCTGACGATGGCTCCACTTCCACTGATTTCATC
GAAGACTGGGTCAAAATCGGTTTAACAGCCAAATCCAAGGTT > SEQ ID NO:330 182002 Poppy
gAATTCGAATCTCATCACTTATCTCTCTCTCAATCTCTCTTTTAAATTTCAAAAAGTTCCTGAAAGAACTTCAAAACCA
TATTGAGATCTTAGAACCCCAGGAGAAAAAAATACATTCAGCGAGCGAATTGATTGATTTTTCAAATCAATTCGCTCGT
ATTCTGGTTTATTTCAGATTAACGAATCTATTTCTTGTTTGTTGAAATTATATCAATCACGCATGCCTGAATTAATCGA
GATCTCATCAGAAAATTCATTATTTGGCAAATATGAGCTCGGTAAATTGCTTGGTTGTGGCGCATTCGCTAAAGTTTAT
CACGCAAGGAATATCAAAACAGGGCAAAGCGTAGCAATAAAATGTATAAGCAAACAGAAAATCCTCAAAGGAGGATTAA
TGGCACATGTCAAGAGAGAAATCACTATTATGCGTCGTCTCCACCATAAGAATATTGTGAAGCTTTATGAAGTTTTGGC
CACGAAAACAAAGATTTATTTCGTTATGGAATTTATTAAAGGTGGTGAATTGTTTGCTAAAGTAGCTAAAGGTAAATTT
AGTGAAGATTTGAGTCGTAAATATTTCCAGCAATTAATATCAGcTgttggctattgtcaTTCTCATggtATTTTTcaca
gagatttGAAAccTGaAAATCtA > SEQ ID NO:331 182007 Poppy
GAATTCAGAGAGAGAGTTTTCTCCTCCTCTTTCTCTCTTTACTTTCAGTTCTTCTTCATCCAAGAAGGAGAAGAAGAAA
GCTTAGACAGGTTAGTGTTCTTCGTGCTTGGTTATATTTCAAATCTCTTGCAATGTCAGACAGTCAGGATACTGATAAG
AATATCGAGATATGGAAGATCAAGAAATTGATTAAAGCGCTAGAAGCTGCTAGAGGTAATGGTACCAGCATGATTTCTC
TCATCATGCCACCACGAGATCAGGTTGCTCGGGTCACTAAGATGTTGGGTGATGAATTTGGTACTGCCTCAAACATCAA
GAGTAGAGTTAACCGTCAATCAGTATTGGGTGCGATTACCTCTGCTCAACAGAGATTGAAACTTTACAATAAGGTCCCT
CCAAATGGTTTAGTTTTGTACACAGGAACTATCATGACAGATGATGGGAAGGAGAAGAAGGTTACAATTGATTTTGAGC
CTTTCAAGGCAATTAATGCATCATTGTACCTTTGTGATAATAAGTTTCATACAGAGGCTCTAAATGAACTTTTGGAATC
TGATGACAAGTTTGGTTTCATAGTCATGGATGGAAATGGTACActTTTTGGGA

FIG. 1 continued

> SEQ ID NO:332 182081 Poppy
gaattcaaCCCCAACCAAATCAAAAACAGACGATCCGAATTCAGTCATTTTCTCGCTCGCTCTCTTGTTTCGTAAAAAT
TTTCTATCTTGAATTAAGATCTAAAAGATGGCGGGACAAAATCAAAGATTAACAGTAGTACCAACAGTCACGATGCTTG
GAGTAATGAAAGCACGTTTAATAGGAGCAACAAGAGGTCATGCTTTACTTAAGAAGAAATCTGATGCATTAACTGTTCA
ATTTCGTCAGATCTTAAAAAACATTGTTTCAGCTAAAGAATCAATGGGTGATATTATGAAAACTTCATCATTTGCTTTG
ACTGAAGCTAAATATGTAGCTGGTGAGAATATTAAACATACTGTTCTTGAAAATGTTCATAACGCTTCGTTAAAGGTGA
GATCGCGTACTGAGAATGTTGCTGGAGTTAAATTACCCAAGTTTGAGTATTTCACTGAAGGTGAAACTAAGAATGATTT
GACTGGATTAGCACGAGGTGGACAACAGGTGCAACTTTGTAAGGCTGCTTATGTCAAAGCAATCGAAGTTCTTGTTGAA
CTTGCTTCGCTTCAAACGTCTTTTTTGACTCTTGATGAAGCAATTAAGAC > SEQ ID NO:333 182229 Poppy
CTTGAAAATCCGGAGGACCGAGTGCCATCCACGCCCGGTCGTACTCATAACCGGATCAGGTCTCCAAGGTGAACA > SEQ ID NO:334 182274 Poppy
GAATTCGGGCTTACCATGAATCCACTGATTTCTGCCGCTTCCGTTATTGCTGCTGGATTGGCCGTAGGGCTTGCGTGCT
ATTGGACCCGGAGTTGGTCAAGGTACTGCTGCGGGACAAGCCGTAGAAGGTATTGCGAGACAACCAGAGGCAGAGGGTA
AAATACGAGGTACTTTATTGCTGAGTCTGGCTTTTATGGAAGCTTTAACAATTTATGGGTTGGTTGTGGCATTAGCACT
TTTATTTGCAAATCCTTTTGTTTAATCCTAAGAATAGAAAGTTTTTTTCTAAATTTTATTGCCCTGGATTTCCCACCTG
CTTTTTTGAATTCTATCAAGATTTTACTCCTACAATCACTTTTTGATTGAGACAATATCCGTGGGAAGGACTGATTTGA
GGATGAGGAATTAGCAGACCTACTCGCTTTCTTCCTTCCCGTTCTTAGTCCAACGAAACCCTTTTTTTAGAAAGCGTT
GCAAAAGATGAGGTATTTCACGACTGACATGAGATCTGGACCTAATTCTAATAAGTGTGTTTCTGAGTAGGAACTTCAA
TTGAAATATCAAAAAATTTCAAAATGGAAAAAAATAATAAATCAAACAATAAAAAAA > SEQ ID NO:335 182358 Poppy
GAATTCCGGGACGAATCTGTGGTTAATACTTGTGTGTGTGTTTCTTCTCTCTCAGCCCTCCCTTCATCTTTGGGAGTTT
GGATCTCGTATCCAATAATGGCGAGTTGGTTCTCACCAAAATATGGTCTTAGATCCATTCTTCGTCTTCCCAGAACCTT
GTTCTCCTCAGCTTCAGCAAACAGAGTGCACAAGAACAATGAATATGCAAAGATAAATGAGGTTCAAAATGAAGCGGAG
GATGATGGGTTTAATCCAGGTGCACCACCTCCATTTAAGATTGCTGAGATCCGTAATGCCATTCCTAAACACTGTTGGA
TCAAGAATCCATGGAGGTCGATGGTTATGTTCTCAGAGATATTCTTGTGGTTGCTGCATTAGCTGCTTCTGCTGAGTA
TTTTAATAACTGGGTTTTCTGGATTTTCTATTGGGCTGCTCAAGGAACCATGTTCTGGGCTATCTTTGTTCTTGGCCAT
GACTGCGGCCATGGGAGCTTTTCAAACAGTTCAGAAACTTAACAGTATTGTTGGACATCTTCTTCATTCCTTCATTCTTG
TACCTTACAATGGATGGAGAATCAGTCACAGAACTCATCACCAGAATCATGGACACGTTGAGAATGATGAATCATGGCA
CCCGTTGCCTGAGAAGGTTTACAGAAACATGGATGA > SEQ ID NO:336 186849 Oryza sativa
GAAGGATCACAACTCATTCTTCTCTTCTGTCAGTATAGAGAGAGAGAGAGAGAGAGATCAAGAACTAGAGAGAGAAAGG
TAGGTAGCTAGAGAGAGAGTAGGCGATCGATGGCGGATTGGGGGCCGGTGTTCATAGGGCTGGTGCTGTTCATCCTGCT
GTCGCCGGGGCTGCTGTTCCAGATCCCGGGGAAGGGGAGGATCGTGGAGTTCGGCAACTTCCAGACCAGCGGGCTCTCC
ATCCTCGGCCACTCCATCATCTACTTCGCGCTCATCGCCATCTTCCTCCTCGCCGGCAACGTCCACATGTACCTCGGCT
AGCTAGCTAGGAGGTACCATGGGTGGCTCTGGCATGTGAAATGTGCATCGATC > SEQ ID NO:337 186860 Oryza sativa
ATTCATCATGGCGCCTGAACTATTGTGTTGGTGGCGAGGTCACCACGATGTATCACTTGGATCGCCCTATGTACTTGTT
GGGATATCTAGCGAATCAAAGCCGAGTTTATCTTATTGACAAGGAATTCAATGTCATGGGGTACACATTACTTCTTAGT
TTGATTGAGTACAAGACACTTGTGATGCGTGGGGATATTGAACGTGCAAATGATATTTTACCATCCATACCAAAGGCGC
AATATAATAATGTTGCTCATTTCTTGGAGTCAAGAGGTATGCTGGAGGAAGCACTTGAGATAGCTACTGATGCTGATTA
CAGGTTTGACCTAGCTGTGCAACTTGGAAAATTAGAAGTTGCAAAGGCTATCGCGATGGAAGCGCAAAGTGAATCTAAG
TGGAAGCAGTTGGGTGAACTGGCTATGTCCACAGGCAAGCTAAATATGGCGGAAGAGTGCCTTGTGCAAGCGAAGGACT
TAAGTGGCCTGTTGCTACTATATTCATCTCTTGGAGATGCTGAGGGAATCGAGAAGCTTGCTTCTCAAGCAAAGGAGCA
TGGCAAAAACAATGTTGCTTCCCTCTGTCTCTTTATGCTTGGTAAATTGGAA > SEQ ID NO:338 186919 Oryza sativa
TGGTTCTCCGGCACGGGGCCCTCCGTCTCGTCGGCGTCGTCGTCGTCGGCGCCGCCGCAGCGCGTCGCTGGTCGCGGAA
TGGAACTCCTACGCCGCCGCGCGCTCCGCGGAGGAGGAGGAGGACGG

FIG. 1 continued

> SEQ ID NO:339 186963 *Oryza sativa*
CAGGAGGCTGCGGAGGCATACCTTGTTGGTCTCTTCGAGGACACCAACCTGTGCGCTATTCATGCCAAGCGTGTGACCA
TCATGCCTAAGGACATTCAGCTGGCTAGGAGGATTCGTGGTGAGAGGGCTTAAATTCCCCTCGGCGACTCCTTTGACAA
ATGAAGCATGCGTCGTAGTGTTAGTAGTGGGTTTAATCTTTTGCTTATAAGAACAATCTGAGTAGGGTGTATTTTGTGG
AACAATATGTTTCTCTCTGTGACATGATGGTGCTGTATTCGTCTTATTGGTGGATCTGTCAAAAATACTCAGAATATTG
TCAGTGTGTTTGGTGACTCGTATTTTGTTAGTCGGATTCGTTTGCGTCTTATTCTAGCGGTGCTGCCTCTTTGGCACTG
TGCATGGCTAGATACAATTACATTGTAATTCACCTGTCTCTAATCCGTGTTAATGTAATGTTCCGTTGCTGTTCGTGTG > SEQ ID NO:340 188836 *Oryza sativa*
CTGGAATCTTGTTTAACACTAGTATTGTAGAATCAGCAATGGCAGCATACACCAGCAAGATCTTTGCCCTGTTTGCCTT
AATTGCTCTTTCTGCAAGTGCCACTACTGCAATCACCACTATGCAGTATTTCCCACCAACATTAGCCATGGGCACCATG
GATCCGTGTAGGCAGTACATGATGCAAACGTTGGGCATGGGTAGCTCCACAGCCATGTTCATGTCGCAGCCAATGGCGC
TCCTGCAGCAGCAATGTTGCATGCAGCTACAAGGCATGATGCCTCAGTGCCACTGTGGCACCAGTTGCCAGATGATGCA
GAGCATGCAACAAGTTATTTGTGCTGGACTCGGGCAGCAGCAGATGATGAAGATGGCGATGCAGATGCCATACATGTGC
AACATGGCCCCTGTCAACTTCCAACTCTCTTCCTGTGGTTGTTGTTGATCAAACGTTGGTTACATGTACTCTAGTAATA
AGGTGTTGCATACTATCGTGTGCAAACACTAGAAATAAGAACCATTGAATAAAATATCAATCATTTTCAGAAAAACAAA
AACAAACAACCC > SEQ ID NO:341 188837 *Oryza sativa*
TGAACGGTGGAACGCGTACTTACCCACAAGTTAGGTGCATGCCATGGCACCATTCATGGCATGCGCCTCGCCACCGGTA
CTCGCGCTGGCCCTGCTCGCGTCGTGCGGTGCCTTTCTCGCCACCTCCATGCTCCCGGCGCGTGCGACGGCGAGCAGCT
GCTTGGACGTCGGCGACATGGTGATGATGGACAGGTTCCGCGCTTGGCAGGGAGCTCACAACCGGTCGTACCCGAGCGC
AGAAGAGGCGCTGCAGCGGTTCGATGTGTACCGCCGCAACGCGGAGTTCATCGACGCCGTCAACCTGCGCGGCGACCTC
ACTTACCAGCTCGCCGAGAACGAGTTCGCAGACCTCACCGAGGAGGAGTTCCTGGCCACGTACACCGGGTACTACATCG
GCGATGGCCCCGTGGACGACTTCGTTTTCACGACGGGTGCCGGAGACGTCGACGCCAGCTTCTCCTACCGCGTGGACGT
TCCGGCCAGTGTCGACTGGAGGGCCCAAGGCGCCGTTGTGCCTCCCAAGTCCCAAACTTCAACATGCACTAACAGCTTG
ATCACTATGTGGATTTTAGTTTCGAGCACGACGACCCAACATATTCAAAATAAGTGATTTCAGATGCTCTGTATAATGC > SEQ ID NO:342 188873 *Oryza sativa*
ATTCATGGCATCAGCTTCAGACAAGCTCGTCCTCTCGGCCATCGTGCTCGCCGTCCTCGCCGCCGTGGTGGCAGCGGCG
TCGGGCTACGGCGACGTCGGCGAGTACTGCCGCGTGGGGAAGGCGGTGTCCCGGAACCCGGTCCCGTCGTGCCGGAACT
ACATCGCGCGGTGGTGCGCCGCCGCCGGGGGCCGCATGGACTCCCGCAAGCAGCCGCCGCGGGAGTTCCTGGAGCCGTG
CTGCCGGGAGCTCGCCGCCGTGCCGATGCAGTGCCGGTGCGACGCGCTGAGCGTGCTGGTGCGCGGCGTGGTCACGGAG
GAGGGCGACCGCGTCTCCGGGATGATCTCCCAGCACGCGGCACCGGGGTGCGACGCCGCGACGATCGCCGGGATGGCGA
GCGCGCTGACGGACTACGGCCGGTGCAACCTGCAGCACACGGCCGGTTCCTTTGCCTGCCTCATGTTTGGTGGTGGCAT
GGATTAGATCAATTATTTCATTAGTGATTAATTAATTAATTAGGCCTTTGCTTAATTAATTATCGATGTTTGCTAGTAC
TAGCTAGCAGTATCATGGTTTGGATGCTGCTTCTCTATG > SEQ ID NO:343 188876 *Oryza sativa*
AGAGAGCCACGAGCTCAAGTCCAGCTCTCTATCAATCAATCAGATGCATGTCATCCTCAAAGCTTTTTGTTGGAGGCCT
TTCGTACGGCACAGATGAGCAGAGCCTCAGAGATACTTTTGCCAATTATGGTCAAGTTATTGAAGCTAAGATCATCAAT
GACCGTGAAACTGGGAGGTCTAGAGGTTTTGGCTTCATAACTTACGCATCAAGTGAAGAGGCTTCAGCTGCAATCACAG
CCTTGGATGGAAAGGATCTCGATGGGCGTAACATCAGGGTTAACACTGCCAATGAGAGAACTGGTGGCTTCCGTAGTGG
GGGTGGTGGCTATGGAGGCGGTGGCTATGGCGGCGGCGGTGGCGGCTATGGTGGTGGTGGCTACAGTGGTGGTGGTGGC
TATGGCGGTGGTGGCTACAGTGGTGGTGGTGGCGGCAGGGGCTACCAAGGAGGCGGCGGTGGTTATGGTGGCAACA
ATGGAGGGTATGGCAACAGGGGTGGTGGTGGAGGTGGTTATGGAGTTGCAGAAGGATCTGCAGATGCCTTCTCTGGAAT
CAACTTAGGTGGTGATGGTAGTTTT > SEQ ID NO:344 188943 *Oryza sativa*
CCCACGCGTCCGCCCTACAACAACATGGCATCCATAAATCGCCCCATAGTTTTCTTCACAGTTTGCTTGTTCCTCTTGT
GCGATGGCTCCCTAGCCCAGCAGCTATTAGGCCAGAGCACTAGTCAATGGCAGAGTTCTCGTCGTGGAAGTCCGAGAGG
ATGTAGATTTGATAGGTTGCAAGCATTTGAGCCAATTCGGAGTGTGAGGTCTCAAGCTGGCACAACTGAGTTCTTCGAT
GTCTCTAATGAGTTGTTTCAATGTACCGGAGTATCTGTTGTCCGCCGAGTTATTGAACCTAGAGGCCTACTACTACCCC

FIG. 1 continued

```
ATTACACTAATGGTGCATCTCTAGTATATATCATCCAAGGGAGAGGTATAACAGGGCCGACTTTCCCAGGCTGTCCTGA
GACCTACCAGCAGCAGTTCCAACAATCAGGGCAAGCCCAATTGACCGAAAGTCAAAGCCAAAGCCATAAGTTCAAGGAT
GAACATCAAAAGATTCACCGTTTCAGACAAGGAGATGTTATCGCGTTGCCTGCTGGTGTAGCTCATTGGTGCTACAATG
ATGGTGAAGTGCCGGTTGTTGCCATATATGTCACTGATATCAACAACGGTGCTAATCAACTTGACCCTCGACAGAGGGA
TTTCTTGTTAGCTGGAAATAAGAGAAACCCTCAAGCATACAGGCGTGAAGTTGA

> SEQ ID NO:345  188959  Oryza sativa
GGAGGAGATCGAGGAGGGGATGGGGATCCGGTTCGTGGTGATGGTGAACAAGCAGGGGCAGACGCGGGTGGCGCAATAC
TACGAGCACCTCTCCGTCGACGAGCGCCGCGCCCTCGAGGGCGAGATCGTCCGCAAGTGCCTCGCCCGCACCGACCACC
AGTGTTCTTTCGTGGAGCACCGCAACTACAAGGTGGTGTACCGGCGCTACGCCTCCCTCTTCTTCCTAGTCGGCGTCGA
CAACGATGAGAATGAGTTAGCTATCCTTGAATTCATTCATCTTTTGGTTGAAACTATGGACCGTCACTTTGGCAATGTG
TGTGAGCTCGACATTATGTTCCATCTGGAGAAGGTGCACTTCATGCTGGAAGAGATGGTGATGAATGGTTGCATTGTTG
AAACCAGTAAACAGAACATCTTGGCACCAATCCACCTGATGGAGAAAACTTCTTAGAAAAATGCTATCCAATAGGGGAG
TGCCTCATACTCTTCTGCTTATGGCCACCGCTCTGTGATTCTATTGATTTTTCATCTCAATGTGTAACCATCAACGAT
TTCCATGTGCATAGACTATTAAACTTGACCTGATAGGAAATAATGAGAATATGGCAGATGCCATCTATGTTCCTT > SEQ ID NO:346  188984  Oryza sativa
CACCACAATTCAAATATTATAGTTGAAGCATAGTAGTAGAATCCAACAACAATGAAGATCATTTTCGTATTTGCTCTCC
TTGCTATTGTTGCATGCAATGCCTCTGCGCGGTTTGATCCTCTTAGTCAAAGTTATAGGCAATATCAACTACAGTCGCA
TCTCCTACTACAGCAACAAGTGCTCAGCCCATGCAGTGAGTTCGTAAGGCAACAGTATAGCATAGTGGCAACCCCCTTC
TGGCAACCAGCTACGTTTCAATTGATAAACAACCAAGTCATGCAGCAGCAGTGTTGCCAACAGCTCAGGCTGGTAGCAC
AACAATCTCACTACCAGGCCATTAGTATTGTTCAAGCGATTGTGCAACAGCTACAACTGCAGCAATTTAGTGGTGTCTA
CTTTGATCAGACTCAAGCTCAAGCCCAAACTCTGTTGACCTTCAACTTGCCATCCATATGTGGTATCTACCCTAACTAC
TATAGTGCTCCCAGGAGCATTGCCACTGTTGGTGGTGTCTGGTACTGAATTGTAACAATATAATAGTTCCGTATGTTAA
AAATAAAGTCATACATCATCATGTGTGACTGTTGAA > SEQ ID NO:347  194652  Oryza sativa
CCCCCCCGAGCTCGTTTCACACTCTCATGGCGATTCCTTCATATTCTTAAGCTCAAGCTGATCAAGTGTGTACTAGCTA
GTAATTAGTCCTATCCTATATACTATAGTAGCTGGGTTGCTCGGCTCGCCGGAGATCTCCGGCCGGCTGCCGGCGGCGG
TGAGCCGGTGACACTAATCACATATCGATCGTACACGCGCGCGTATTACGTGTGTGAAGGAACATTAGATAGATAGAGA
GAGAGAGGGGATGGGCGGTGGGTCGCCGTGCGCGTCGTGCAAGCTGCTGCGGCGGCGGTGCACCAAGGACTGCATCTTC
GCGCCCTTCTTCCCCGCCGACGACCCCCACAAGTTCGCCATCGTCCACAAGGTCTTCGGCGCCAGCAATGTCAGCAAGA
TGCTCCAGGAGCTGCCGGCGCAGCAGCGAGGCGACGCGGTGAGCAGCCTGGTGTACGAGGCGAACGCCCGGATGCGGGA
CCCCGTCTACGGCTGCGTCGGGGCCATCTCCTTCCTCCAGAACCAGGTGTCGCAGCTGCAGATGCAGCTCGCCGTCGCG
CAGGCCGAGATCCTCT > SEQ ID NO:348  200602  Saccharomyces cereviseae
GAATTCCAGCTGACCACCATGTCTCAAAGACTACAAAGTATCAAGGATCATGTGGTGGAGAGCGCCATGGGTAAGGGTG
AATCGAAGAGGAAGAACTCGTTGCTGGAGAAAGGACCCGAAGATGTAGTTATTGTGGCTGCTAACAGGTCTGCCATCGG
TAAAGGTTTTAAAGGTGCCTTCAAAGATGTAAACACAGACTACTTATTATACAACTTTCTCAATGAGTTCATCGGGAGG
TTTCCGGAACCTTTGAGGGCTGATTTGAACTTAATCGAAGAAGTTGCCTGTGGAAATGTTCTCAATGTTGGAGCCGGTG
CTACAGAACACAGGGCTGCATGCTTGGCAAGTGGGATTCCCTACTCGACGCCATTTGTCGCTTTAAACAGACAATGTTC
TTCAGGTTTAACGGCGGTGAACGATATTGCCAACAAGATTAAGGTTGGGCAAATTGATATTGGTTTGGCGCTGGGAGTG
GAATCAATGACCAATAACTACAAAAACGTCAATCCCTTGGGCATGATCTCCTCTGAAGAGCTGCAAAAAAACCGAGAAG
C > SEQ ID NO:349  200605  Saccharomyces cereviseae
GAATTCCAGCTGACCACCATGACGGAGACTAAGGATTTGTTGCAAGACGAGGAGTTTCTTAAGATCCGCAGACTCAATT
CCGCAGAAGCCAACAAACGGCATTCGGTCACGTACGATAACGTGATCCTGCCACAGGAGTCCATGGAGGTTTCGCCACG
GTCGTCTACCACGTCGCTGGTGGAGCCAGTGGAGTCGACTGAAGGAGTGGAGTCGACTGAGGCGGAACGTGTGGCAGGG
AAGCAGGAGCAGGAGGAGGAGTACCCTGTGGACGCCCACATGCAAAAGTACCTTTCACACCTGAAGAGCAAGTCTCGGT
CGAGGTTCCACCGAAAGGATGCTAGCAAGTATGTGTCGTTTTTTGGGGACGTGAGTTTTGATCCTCGCCCCACGCTCCT
GGACAGCGCCATCGACGTGCCCTTCCAGACGACTTTCAAAGGTCCGGTGCTGGAGAAACAGCTCAAAAATTTACAGTTG
```

FIG. 1 continued

ACAAAGACCAAGACCAAGGCCACGGTGAAGACTACGGTGAAGACTACGGAGAAAACGGACAAGGCAGATGCCCCCCCAG
GAGAAAAACTGGAGTCGAACTTTTCAGGGATCTACGTGTTCGCATGGATGTTCTTGGGCTGGATAGCCATCAGGGTGC

> SEQ ID NO:350 200614 Saccharomyces cereviseae
GAATTCCAGCTGACCACCATGTCTACCACACTACTTTGGTTTTCAAGTGTGATAGGCTACGTGATTCAAACAAAATGTT
TGTCTAACATACAATCTAAAAAGGAAATCTCCGTGGGGCCCAATGGTACAATTGCAACGCCTGAAACTAACGGCGACAA
CGGAAACTCAAGTTCATTAGCCTTCTATCTGACCTTTATGTATTTTGCTTCGTGGCTGCTCTTGGTGCCTGCATCTCGA
CTTTGGGAGAAGATGAGACCGATGTTTGTCTCTGACTCAGACTCGAACAGGAATTCTCAGTTTGACAACAACAACAGCG
GGTCTGTGACAAACGAAGATGTCGATACGTTCTCGCACGTGTTGGATGATCCTCAACCACGGATTCCAGCCCAACAGCA
GAAGCAAAAAATCATATCCGTGGCTACCTTCAAATATGTGGCTAAGCTAACAGTGCTGGCTCTCATAATGATTGTCGCT
GATTTGACTTATAACATGGCTTTGTCATTGTCACCGGCATTTGATGTTGCTTTGATGCAAAATACTGCCATTTTCGAAA
TTGTCACTTTACTATATGGTGTTTGTGGAATCTCCAGGAAGAACTACGTTTTCCGTAATTTCCTCATCATGATGAACG > SEQ ID NO:351 200615 Saccharomyces cereviseae
GAATTCCAGCTGACCACCATGATTCAAATGGTGCCCATTTATTCATGCTCCGCATTACTTCGGAGAACTATACCGAAAA
GGCCATTCTATCATGTGTTATCAGGGTTAACTGTACGCTTTAAGGTAAACCCGCAATTAAATTACAATCTTTTCAGAGA
TCTCACTAGGAGGGAATATGCTACCAATCCGAGTAAAACTCCTCATATAAAGAGCAAGTTGCTCAATATTCCCAACATT
TTGACTTTATCACGAATAGGATGTACACCCTTTATCGGACTCTTCATTATAACGAATAATTTGACCCCAGCATTAGGTT
TGTTTGCATTTTCCAGCATCACTGATTTTATGGATGGGTATATAGCAAGAAAATACGGCCTGAAAACCATTGCAGGAAC
CATATTAGATCCACTTGCAGATAAACTACTCATGATCACAACAACTTTGGCATTATCTGTACCATCCGGCCCTCAGATT
ATACCGGTATCTATTGCGGCGATAATTCTGGGTAGAGATGTGCTACTAGCCATAAGTGCTTTGTTTATACGATATAGCA
CTTTAAAGTTGAAGTATCCTGGTCGTGTGGCATGGAATTCCTATTGGGATATTGTTCGCTAT > SEQ ID NO:352 200616 Saccharomyces cereviseae
GAATTCCAGCTGACCACCATGCCAAACTTAAAGAGACTACCCATCTTCCGCGACAAGTCCTGGACTACCATGCAGAACA
ACGTCTTGAGCACCTCCAACTGCGGTAACCCCTGGCTCAAGAGCTTCGGGTTCGGGCCTGTCACCGGCAACGGCTTCGG
CATCGGCTACATCATCAGAGACCACTCCGTCTCTGTGGTGGTGTCCTCAAGGCATCGCCAGACTGGTCGGTTTGCGTCG
CTCATGGAAAAGTCGCTGCTGGAGATCGACCGCATCTTCAAACGGCAGCAAGCTCGCGCAGCAAAACCCGCTGCCAGGA
CCACTGGTAGCGCCAACACCAAATCAGAAGACATGAAATACCTGTTGTCCGGCTACGATTACTTCGACGTGAGCGTGTC
CGGTTGACATGGCAATTCCCGGGGATC > SEQ ID NO:353 200617 Saccharomyces cereviseae
GAATTCCAGCTGACCACCATGGTTGAATCAGATGATGAAGATTTCGCACCTCAAGAATTCCCACACACGGACACAGACGTTA
TCGTAAATGAACACAGAGACGAAAATGACGGGTATGCCTCAGATGAAGTTGGTGGCACATTAAGCAGAAGGGCCTCAAG
TATATTTTCTATAAATACAACTCCATTGGCCCCCCCTAATGCTACTGATATCCAAAAATTTACAAGTGACGAACATCAT
TTCAGCATGATGAGGAATTTGCATATGGCAGATTACATTACTATGCTGAATGGATTTTCTGGGTTTTACTCTATTGTAA
GTTGTCTGAGATTTACGCTTACAGGTAAACCTCATTACGTCCAGCGTGCCCATTTCCTTATTTTATTGGGTATGTGTTT
CGATTTCCTTGACGGGAGAGTAGCACGTCTGAGAAATAGGTCTTCCTTAATGGGTCAAGAACTGGACTCTTTGGCCGAC
TTGGTTTCCTTTGGTGTGGCTCCGGCTGCAATTGCTTTTGCCATTGGATTTCAAACTACATTCGATGTCATG > SEQ ID NO:354 200619 Saccharomyces cereviseae
GAATTCCAGCTGACCACCATGGTACAAGAATCACGTCCAGGGAGTGTAAGAAGTTACTCGGTCGGTTACCAAGCAAGGC
CCAGATCGAGTTCTCAAAGAAGACATTCGTTAACACGCCAACGTTCCTCGCAAAGACTGATTAGAACCATCAGTATCGA
GTCTGATGTGTCTAATATTACTGACGATGACGATTTGAGAGCTGTCAATGAGGGAGTAGCGGGTGTGCAACTGGACGTC
TCTGAAACCGCAAATAAGGGACCAAGAAGAGCATCAGCAACTGATGTCACAGATAGTTTGGGTTCGACTTCGTCGGAAT
ATATTGAGATTCCCTTTGTTAAGGAAACATTGGATGCAAGTTTACCTTCGGATTATCTGAAGCAGGACATATTAAATCT
CATTCAGAGTTTGAAGATATCCAAATGGTATAACAACAAGAAAATCCAACCGGTAGCACAAGATATGAACTTAGTCAAG
ATCTCTGGTGCGATGACAAACGCAATTTTCAAAGTTGAATACCCTAAGTTACCATCGTTGCTATTGAGAATATACGGAC
CGAATATTGATAATATCATTGACAGGGAATATGAATTGCAGATTTTGGCTAGGGTTTCATTGAAAAATATAGGT > SEQ ID NO:355 200621 Saccharomyces cereviseae
GAATTCCAGCTGACCACCATGGCAAACCCAACAACAGGGAAGTCCTCGATTAGGGCTAAGCTTTCTAACTCATCGCTAT
CAAACCTATTTAAAAAAAATAAAAATAAAAGACAGCGTGAGGAAACGGAAGAGCAGGACAATGAGGATAAGGATGAGAG
TAAGAACCAGGATGAAAATAAGGACACACAGCTCACTCCCCGCAAGCGTCGCCGGTTGACGAAGGAGTTTGAAGAGAAG

FIG. 1 continued

```
GAGGCTCGTTACACCAACGAGTTGCCCAAGGAACTGCGCAAGTATCGTCCTAAAGGTTCCAGATTCAATTTGCCTCCAA
CGGATAGACCCATCAGGATATATGCAGATGGTGTTTTTGATCTTTTCCATCTTGGCCACATGAAGCAACTGGAACAGTG
TAAGAAGGCTTTCCCCAATGTAACACTGATAGTTGGTGTGCCTAGCGACAAAATCACTCACAAACTAAAAGGTTTGACT
GTGCTGACCGATAAGCAGCGTTGTGAAACTTTAACGCACTGCAGATGGTTGACGAAGTCGTGCCTAACGCTCCCTGGT
GTGTCACCCCAGAATTTCTACTAGAACACAAGATTGACTACGTGGCACATGACGATATTCCTTACGTTAGCGCCGACAG

> SEQ ID NO:356 200622 Saccharomyces cereviseae
GAATTCCAGCTGACCACCATGCCTAAAGTTTACAGTTACCAAGAAGTTGCCGAACACAATGGCCCAGAAAATTTCTGGA
TTATCATCGATGACAAAGTTTACGATGTTTCTCAATTCAAAGATGAACATCCAGGTGGTGATGAAATTATAATGGGTTT
GGGTGGACAAGATGCTACAGAAAGCTTTGTCGATATCGGTCATTCTGACGAAGCATTGAGACTACTGAAAGGTTTATAC
ATTGGTGACGTTGACAAGACCAGTGAGCGCGTTTCTGTGGAAAAGGTATCTACCTCTGAAAACCAAAGTAAAGGTAGTG
GTACATTGGTTGTCATATTGGCCATTTTAATGCTAGGTGTTGCTTATTATTTGTTGAACGAATAACATGGCAATTCCCG
GGGATC > SEQ ID NO:357 200625 Saccharomyces cereviseae
GAATTCCAGCTGACCACCATGAACAGAGTTTCGTTTATTAAAACGCCTTTCAACATAGGGGCGAAATGGAGATTAGAAG
ATGTCTTTTTGCTCATTATCATGATAGTTCTTAAGTACCCAGTGTATTACCAACAACCGGTCGAACGTCAGTTTTACAT
TAACGATCTCACTATATCGCATCCTTATGCGACAACTGAACGTGTAAATAACAACGTGTTGTTTGTTTATAGTTTTGTC
GTGCCATCTTTAACCATATTGATAATTGGTTCCATTTTGGCCGATAGAAGACATTTGATTTTTATTTTGTACACATCTC
TCCTTGGTTTATCACTCGCTTGGTTCAGTACGAGTTTCTTTACAAACTTCATCAAGAATTGGATTGGAAGACTAAGACC
AGATTTTCTAGATCGTTGCCAACCTGTTGAAGGCTTGCCATTGGACACTTTATTTACTGCAAAAGATGTGTGTACGACT
AAGAATCACGAACGTCTGTTGGATGGGTTTAGGACAACTCCGTCAGGTCATTCAAGTGAAAGCTTTGCAGGACTGGGTT
ATTTGTACTTCTGGCTATGTGGGCAACTTTTGACTGAATCACCGTTGATGCCTTTATGGAGAAAAATGG > SEQ ID NO:358 200626 Saccharomyces cereviseae
GAATTCCAGCTGACCACCATGAGTGGAGTATCAAATAAAACAGTATCAATTAATGGTTGGTATGGCATGCCAATTCATT
TACTAAGGGAAGAAGGCGACTTTGCCCAGTTTATGATTCTAACCATCAACGAATTAAAAATAGCCATACATGGTTACCT
CAGAAATACCCCATGGTACAACATGTTGAAGGATTATTTGTTTGTGATCTTTTGTTACAAGCTAATAAGTAATTTTTTT
TATCTGTTGAAAGTTTATGGGCCGGTGAGGTTAGCAGTGAGAACATACGAGCATAGTTCCAGAAGATTGTTTCGTTGGT
TATTGGACTCACCATTTTTGAGGGGTACCGTAGAAAAGGAAGTCACAAAGGTCAAACAATCGATCGAAGACGAACTAAT
TAGATCGGACTCTCAGTTAATGAATTTCCCACAATTGCCATCCAATGGGATACCTCAGGATGATGTTATTGAAGAGCTA
AATAAATTGAACGACTTGATACCACATACCCAATGGAAGGAAGGAAAGGTCTCTGGTGCCGTTTACCACGGTGGTGATG
ATTTGATCCACTTACAAACAATCGCATACGAAAAATATTGCGTTGCCAATCAATTACATCCCGATGTCTTTCCT > SEQ ID NO:359 200628 Saccharomyces cereviseae
GAATTCCAGCTGACCACCATGTCCGTTTCCAAGATTGCTTTCGTTTTAAGTGCCATTGCCTCTTTGGCCGTCGCTGACA
CCAGCGCCGCCGAAACTGCTGAACTGCAAGCTATTATCGGTGACATCAACTCTCATCTTTCTGACTACTTGGGTCTAGA
AACTGGCAACAGTGGATTCCAAATTCCATCTGATGTCTTGAGTGTGTATCAACAAGTCATGACTTACACCGATGACGCT
TACACTACCTTGTTTAGTGAATTGGACTTTGATGCTATCACTAAGACAATTGTTAAATTGCCATGGTACACCACAAGAT
TGAGTTCTGAAATCGCTGCTGCTCTTGCCTCCGTTTCCCCAGCTTCTTCCGAGGCTGCATCTTCTTCCGAGGCTGCATC
TTCTTCCAAGGCTGCATCTTCTTCCGAAGCTACATCCTCTGCCGCTCCATCCTCTTCTGCTGCCCCATCTTCTTCTGCT
GCCCCATCATCATCTGCCGAATCATCTTCTAAGGCCGTTTCTTCTTCTGTCGCTCCAACTACCTCTTCTGTCAGCACTT
CTACAGTCGAAACTGCTTCCAATGCCGGTCAAAGAGTCAATGCAGGCGCTGCCTCTTTCGGTGCTGTTGTTGC > SEQ ID NO:360 200629 Saccharomyces cereviseae
GAATTCCAGCTGACCACCATGCACCAAGATTTTCAAGAAGACGAGCATGAGTATCCAGACATCAGACGCAATCCGCTGC
ATGAGGTGACCATGACTTCCTACATACTGGGGATTCTTTTAGGTATATTTGTTGGTCTTTTTCCACAAATTAGATTCAA
GAATTTTAACCTCTTTATTATTGCCCTGTCCTTATTCCATTTTTGGAGTATAATATTACAGCTAGATACAATCCTCTT
AAGGTACATTCAGAGTCCTTTCTTCTGAACAACGGCAAAAGTTACATGGCGGCACATTCCTTTGCTATTCTGGAATGCC
TCGTAGAAAGCTTTCTTTTTCCTGATCTGAAAATTTTAGCTACTCTCTAGCTACCAAGCTTTGTACAGTACTTGGATG
TCTTCTAGTTATTCTGGGACAATATACCAGAACTATTGCTATGCATACTGCGGGACATTCCTTTTCTCATATTGTGAAG
ACCAAGAAGGAGTCCGATCATGTTTTAGTGAAAACTGGCGTTTACTCCTGGTCAAGACATCCAAGTTATCTTGGGTTCT
TTTGGTGGGCAATTGGCACTCAGCTACTGCTTCTAAATCCCCTATCA
```

FIG. 1 continued

> SEQ ID NO:361 200630 *Saccharomyces cereviseae*
GAATTCCAGCTGACCACCATGAGTTACTTTCCTCGAACATATGCTCACTTGATGAGAAATGTTCTTGCTCATAATAAAG
GGAATATATACTTACAAATTGGTACACAGCTGCACGATACTCAAATAAAAATTCGATTTAATGGAGTTCGTTATATTAG
TCGGAATCATGGCGGGAAACAGCAACATATAAACACTGCGCCGATAGAATTTACTCCCAATTTTGGATATGGTGATAGA
ACCTCTAATTGCAATAAAAAGGTTGAATCGACCGCCATGAAAACGCTAAGATGCACAGATGATATATCAACTTCAAGTG
GAAGCGAAGCTACTACCGATGCAAGCACACAACTTCCATTTAACGTCAAACTTGTAGACCCGATGGTAAGAAAATCTAA
GAGACCATCTCACGCAATCAGCGAAGGGCTGAATATGAAAACTTTAAAGAAGAAGGTAATTATGCCATATCTTCAGTTG
ACCAAGCCCCGACTCACCATTCTAGTGATGTTAAGTGCCATTTGTTCGTATGCTTTATCTCCATATCCAGCCTCCGTCA
ATGAATTGTTATGTTTAACAGTAGGCACTACTTTGTGTTCCGGTTCTGCAAACGCTATAAATATGGGCAG > SEQ ID NO:362 200631 *Saccharomyces cereviseae*
GTAAGGAATTCCATCTGACCACCATGGGAAAGCTATTACAATTGGCATTGCATCCGGTCGAGATGAAGGCAGCTTTGAA
GCCGAAGTTTTGCAGAACACCGCTATTCTCCATCTATGATCAGTCCACGTCTCCATATCTCTTGCACTGTTTCGAACTG
TTGAACTTGACCTCCAGATCGTTTGCTGCTGTGATCAGAGAGCTGGATCCAGAATTGAGAAACTGTGTTACTCTCTTTT
ATTTGATTTTAAGGGCTTTGGATACCATCGAAGACGATATGTCCATCGAACACGATTTGAAAATTGACTTGGGGCGTCA
CTTCCACGAGAAATTGTTGTTAACTAAATGGAGTTTCGACGGAAATGCCCCCGATGTGAAGGACAGAGCCGTTTTGACA
GATTTCGAATCGATTCTTATTGAATTCCACAAATTGAAACCAGAATATCAAGAAGTCATCAAGGAGATCACCGAGAAAA
TGGGTAATGGTATGGCCGAGTACATCTTAGATGAAAATGACAAGTTGGATGGGTTGCAAACCGTCCACGACTACGACGT
GTACTGTCACTACGTAGCTGGTTTGGTCGGTGATGGTTTGACCC > SEQ ID NO:363 200633 *Saccharomyces cereviseae*
GAATTCCAGCTGACCACCATGGAGGCCAACATACATGAGCTGATCAATAATGATCCTGTTTGGTCCAGCCAAAATGAAA
GCTTGATTTCAAAACCTTATAATCACATCCTTTTGAAACCTGGCAAGAACTTTAGACTAAATTTAATAGTTCAAATTAA
CAGAGTTATGAATTTGCCCAAAGACCAGCTGGCCATAGTTTCGCAAATTGTTGAGCTCTTGCATAATTCCAGCCTTTTA
ATCGACGATATAGAAGATAATGCTCCCTTGAGAAGGGGACAGACCACTTCTCACTTAATCTTCGGTGTACCCTCCACTA
TAAACACCGGAAATTATATGTATTTCAGAGCCATGCAACTTGTATCGCAGCTAACCACAAAAGAGCCTTTGTATCATAA
TTTGATTACAATTTTCAACGAAAAATTGATCAATCTACATAGGGGACAAGGCTTGGATATATACTGGAGAGACTTTCTG
CCTGAAATCATACCTACTCAGGAGATGTATTTGAATATGGTTATGAATAAAACAGGCGGCCTTTTCAGATTAACGTTGA
GACTCATGGAAACACTGTCTCCTTCCTCACACCACGGGCATTCGTT > SEQ ID NO:364 200638 *Saccharomyces cereviseae*
GAATTCCAGCTGACCACCATGTCTGACGCAGGTAGAAAAGGATTCGGTGAAAAAGCTTCTGAAGCTTTGAAGCCAGACT
CTCAAAAGTCATACGCTGAACAAGGTAAGGAATACATCACTGAAGGCCGACAAGGTCGCTGGTAAGGTTCAACCAGA
AGACAACAAGGGTGTCTTCCAAGGTGTCCACGACTCTGCCGAAAAAGGCAAGGATAACGCTGAAGGTCAAGGTGAATCT
TTGGCAGACCAAGCTAGAGATTACATGGGAGCCGCCAAGTCCAAGTTGAACGATGCCGTCGAATATGTTTCCGGTCGTG
TCCACGGTGAAGAAGACCCAACCAAGAAGTAACATGGCAATTCCCGGGGATC > SEQ ID NO:365 200641 *Saccharomyces cereviseae*
GAATTCCAGCTGACCACCATGTCCACAAGCATTACAGTAAGAAATAGAGATCGATCGCTACCACCGCTATTGCTCCCCA
ATGTTTCCCTGCTAGAAAAGATATACGGCGTAAAGGCACCCAAAATGTGGGCATCACCGATCCAGAACTCTTGTCGAC
CACTTGGACGAGGAAGCGGGCTTTTCCGACTGACGAGCTTTTAGGAGGCTATAAGAGATTAAAGCCTGCTGCCACTGAC
AGCAATGAGTGCGCTATTGGTATTGCCACGGTGACGCCGCCGCCAACGCTCCCCGTAAGAGCGATTGTTCCCCCTCCAC
AAAATTACACTCCACCATTGTTTGAGTATCATCCTCATGCTCTTGCTTCCATGGTCAATGAATACGCTAATGCGTCATG
CACTCAAATGTCTATAATTTCGCGCTCAACGAGCAACTCGACAACCTCCTCTGCCACATCTACTAGTTCAATTTCCAAG
AGACAAAGAAGTGGCCCAAGTTGTGACAAATGTCGTTTGAAAAAAATAAAATGTAATGCGAAAATTGAGATTTTGCTTC
AAGACGATACTATAATGCCAATGATCTCGAACA > SEQ ID NO:366 200642 *Saccharomyces cereviseae*
GAATTCCAGCTGACCACCATGTCTAGCAAATGGTTTAATGCTATACACCTACTGGTGTGCCCGTTGACGGTACTGGTAG
GATATCTCATGAACGCGTATGGCTACGGTGCGGCACTGCAAGCAACCCTGAATAAGGATGGTCTGGTAAATGCTATGTT
GGTAAAGAGAGGGTGGTTTTGGACTTCCTTGGTCGGATGGTGGTGTATTATACGCTACCGTGCGGTGCCGGGGCAACC
GGCAGAGACCGAAGACACATTGTCCAGTCATTCAAAAGGTATGCCATACTGACAGTGTGGTGGTACGTATTCACGCAAG
GTATATGGTTTGGCGTAGGCCCCATCATGGACTTGGTATTCGTATATACGGGTGGCCATTGTCACTATGACGTCTTCGA
TGATGCAGGTCACGTGAACGAAGACTTCCAGGGTTCTGTCACCCGGACTAATCGCGCGTTGGCGCTCATTCACAATGTC

FIG. 1 continued

CTCACTTTGCACGGACACCACCAAGAACACCGTCAGCAACAACTCTGGGACCGCTCCATAGGGTCGATCCAGGGCGCCC
TGCAGGCGACGCAACCGAAAACCCCAAAAAACGTAACGGCCAGCGCTGCCGCTGCCATCAATACTTTTATTCATGACCA
GA

> SEQ ID NO:367 200646 Saccharomyces cereviseae
GAATTCCAGCTGACCACCATGACTGCCGACAACAATAGTATGCCCCATGGTGCAGTATCTAGTTACGCCAAATTAGTGC
AAAACCAAACACCTGAAGACATTTTGGAAGAGTTTCCTGAAATTATTCCATTACAACAAAGACCTAATACCCGATCTAG
TGAGACGTCAAATGACGAAAGCGGAGAAACATGTTTTTCTGGTCATGATGAGGAGCAAATTAAGTTAATGAATGAAAAT
TGTATTGTTTTGGATTGGGACGATAATGCTATTGGTGCCGGTACCAAGAAAGTTTGTCATTTAATGGAAAATATTGAAA
AGGGTTTACTACATCGTGCATTCTCCGTCTTTATTTTCAATGAACAAGGTGAATTACTTTTACAACAAAGAGCCACTGA
AAAAATAACTTTCCCTGATCTTTGGACTAACACATGCTGCTCTCATCCACTATGTATTGATGACGAATTAGGTTTGAAG
GGTAAGCTAGACGATAAGATTAAGGGCGCTATTACTGCGGCGGTGAGAAAACTAGATCATGAATTAGGTATTCCAGAAG
ATGAAACTGAGACAAGGGGTAAGTTTCACTTTTTAAACAGAATCCATTACATGGCACCAAGCAATGAACCATGGGGTGA
ACATG > SEQ ID NO:368 200647 Saccharomyces cereviseae
GAATTCCAGCTGACCACCATGATCTCTGTCATGGCGGATGAGAAACATAAGGAGTATTTTAAGCTATACTACTTTCAGT
ACATGATAATTGGTCTATGTACGATATTATTCCTCTATTCGGAGATATCCCTGGTACCTAGGGGCCAAAACATCGAATT
TAGCCTTGATGACCCCAGTATATCAAAACGTTATGTACCTAACGAACTCGTGGGCCCACTAGAATGTTTGATTTTGAGT
GTTGGACTGAGTAATATGGTCGTCTTCTGGACCTGCATGTTTGACAAGGACTTACTGAAGAAGAATAGAGTAAAGAGAC
TAAGAGAGAGGCCGGACGGAATCTCGAACGATTTTCACTTCATGCATACTAGCATTCTATGTCTGATGCTGATTATAAG
CATAAATGCTGCCCTAACAGGCGCCTTAAAGTTGATTATAGGAAACTTGAGGCCTGACTTTGTTGATAGATGTATACCT
GACCTCCAAAAGATGAGTGATTCAGATTCTTTGGTTTTTGGCTTGGACATTTGCAAGCAGACTAACAAATGGATTCTAT
ACGAAGGCTTAAAAAGCACTCCAAGCGGACATTCAAGTTTCATAGTCAGTACCATGGGCTTTACATATCTTCGGCAAAG
GGT > SEQ ID NO:369 200649 Saccharomyces cereviseae
GGAAGGAATTCCAGCTGACCACCATGAAGGAGTCAGTCCAAGAGATCATCCAGCAACTCATCCACAGTGTCGATTTACA
GTCTTCCAAGTTCCAGCTGGCCATTGTGTGCACGATGTTCAATCCTATCTTTTGGAACATCGTTGCAAGAATGGAATAC
CACAAGCATTCTCTCACCAAGATGTGTGGTGGGGCCAGAAAGGGCTGTTACATGTTGGCGGCGACCATATTTTCGCTAG
GTATCGTCAGAGACATGGTGTACGAGTCTGCATTGCGTGAACAGCCTACGTGTTCTCTGATCACGGGCGAGAACTGGAC
CAAGCTGGGTGTGGCTCTCTTTGGTTTGGGGCAAGTGCTTGTTTTGAGTTCCATGTACAAGCTGGGTATCACAGGGACG
TACTTGGGTGACTATTTCGGCATCCTGATGGATGAGAGAGTCACCGGCTTCCCCTTCAACGTTTCCAACAACCCCATGT
ACCAGGGTTCCACTTTGTCCTTCTTGGGCATAGCCCTTTACAAAGGAAAGCCTGCGGGGCTGGTTGTTTCTGCCGTAGT
TTACTTCATGTACAAGATCGCTCTTCGTTGGGAAGAACCTTTTACTGCCATGATCTACGCTAACCGTGATA > SEQ ID NO:370 200653 Saccharomyces cereviseae
GAATTCCAGCTGACCACCATGACAAGATCTCCCTGGAAGCGCCTACTATGGTTGAAACAGGAGTACCCAGATAATTATA
CAGATCCAAGTTTTATTGAGTTGAGAGCAAGACAAAAGGCTGAGAGTAACCAGAAGTCTGATAGAAAATTATCAGAAGC
TGCTCGCGCTCAAATTAGGTTGGATTTTATAAGTTTCTACCAAACCATATTGAACACTTCTTTCATTTACATCACTTTT
ACATATATTTACTATTATGGCTTCGATCCTATTCCGCCAACTATTTTCCTTTCATTTATAACATTGATTATATCAAGGA
CGAAAGTCGACCCTCTATTGTCCTCATTCATGGACGTAAAGTCTTCGCTGATTATCACATTTGCAATGTTGACTCTCTC
TCCAGTCCTCAAATCTCTTTCTAAAACAACTGCATCTGATTCCATATGGACATTGTCTTTTGGCTGACCCTATGGTAC
ATTTTCGTTATTTCGTCAACAAAGTCCAAAGATAAACCCTCTAACCTTTCCACCAATATACTTGTCGCCCTTGTTGCTG
TCCTATCATCGAGGCTTTCGACCACAATCGACGTATTCTGTTTTCTTTTAATTTGTATTCAGTTGAATATCATTCT > SEQ ID NO:371 200659 Saccharomyces cereviseae
GAATTCCAGTGACCACCATGAAGTTGCAGAGTTTGTTGGTTTCTGCTGCAGTTTTGACTTCTCTAACAGAGAACGTTAA
CGCTTGGTCACCAAATAACAGTTACGTCCCTGCGAACGTAACCTGTGATGATGATATTAACTTAGTCAGAGAAGCATCT
GGTTTGTCAGATAACGAAACAGAATGGCTGAAAAAAAGAGATGCATACACCAAGGAGGCTTTGCATTCTTTTTTGAATA
GGGCCACTTCGAATTTCAGTGACACTTCCTTGCTATCCACTCTTTTTGGTAGCAACTCTTCCAATATGCCTAAGATTGC
CGTCGCCTGTTCTGGTGGTGGTTACCGTGCCATGTTGTCTGGTGCTGGTATGCTTGCTGCTATGGACAATCGTACTGAT
GGCGCAAATGAGCATGGTCTTGGTGGGCTGCTGCAAGGTGCAACTTACTTGGCAGGTCTGTCGGGTGGTAACTGGTTAA

FIG. 1 continued

CAAGTACTTTGGCTTGGAACAACTGGACGTCTGTGCAAGCTATCGTGGATAATACAACAGAATCTAACTCAATTTGGGA
CATCTCTCATTCAATTCTTACCCCAGACGGCATTAACATCTTTAAGACTGGGAGTAGATGGGACGACATATCAGAT

> SEQ ID NO:372  200665  *Saccharomyces cereviseae*
GAATTCCAGCTGACCACCATGCATTATTTGCCTGTTGCGATAGTAACAGGTGCCACTAGGGGTATAGGCAAGGCAATAT
GTCAAAAGTTATTTCAAAAGGGTTTAAGTTGCATTATACTTGGGTCTACTAAAGAAAGTATAGAGCGCACCGCGATAGA
TAGAGGCCAATTACAATCGGGATTATCATATCAGCGGCAATGTGCTATAGCAATTGATTTTAAGAAATGGCCTCACTGG
CTTGACTATGAGTCATATGACGGTATCGAATATTTCAAAGATAGACCGCCCTTGAAACAGAAATATTCCACATTGTTCG
ACCCATGTAACAAATGGTCAAATAATGAACGCCGCTACTACGTAAACTTATTGATTAACTGCGCAGGCTTGACTCAAGA
ATCATTAAGTGTAAGAACCACTGCATCTCAAATTCAGGACATAATGAATGTTAACTTTATGAGCCCTGCGACGATGACA
AACATCTGTATTAAGTATATGATGAAGTCGCAAAGGAGATGGCCGGAACTCAGTGGTCAATCTGCTCGACCCACCATCG
TAAATATTTCCTCCATTCTACACTCCGGAAAAGTGAAGGTTCCAGGTACATCTGTTTACTCCGCCTCTAAAGCCGCACT
GTCCAGATTTACAGAAGTTTTAGCTGCAGAAATGGAACCAAGAAACATTAGGTGTTTTACGATATCTCCAGGTTTAGTC
AAAGGGACCGATATGATCCAAAATTTGCCAGTGGAGGCTAAAGAAATGCTGGAGAGAACCATTGGGCAAGCGGTACAA
GCGCACCCGCTGAAATAGCGGAAGAAGTCTGGTCTCTATACAGTAGAACTGCTTTGGAGACGTAACATGGCAATTCCCG
GGGATC > SEQ ID NO:373  200666  *Saccharomyces cereviseae*
GAATTCCAGCTGACCACCATGTGGACAAACACTTTCAAATGGTGCAGCAAAACTGAGAAGGAGACCACTACTGCAGACG
CCAAGGTGTGTGCTAGCGTGCAGGGCCTGAAGGCCCTGCAGCAGCAAATTATGGATAGCACCACTGTGCGTGGGTCCGT
TAATGACACGATGACTCCAGGCGGGATTAACCAGTGGCATTTCCACAATAAGCGTGCGAACAAAGTGTGCACGCCTACA
GTACTAATCCGTGGATACGCTGCCTCGTCGATGGCGTTCTACAGGACGTTTGAGAACCTGTCAGACAACATTAAAGATC
TATATGCCATCGACTTGCCAGCCAATGGTGCCTCAGAGGCGCCAGCATTGCAAGTGAACAAAACCAAGAAGATCAAGTC
TCTCAGGTTTAAGCATATAGAAGATGACGTAGTAATCCCTGTGATAGAGAAGCGCCCCCCAGCAGAGGACATCAAGTCA
CACCTGGAGCAGTACGAAAGCTACTTCGTAGACAGGATAGAGCAATGGCGGAAGGATAACAAGCTTCGCAAAATAAACG
TGGTGGGCCATTCATTCGGAGGATATATTTCATTCAAATACGCCCTCAAGTACCCTGATTCCATTGAGAAACTGTGTCT
CATA > SEQ ID NO:374  200669  *Saccharomyces cereviseae*
GAATTCCAGCTGACCACCATGTCGACTAATACTTCCAAGACTTTGGAACTGTTTTCAAAAAAGACGGTACAAGAACACA
ATACTGCCAATGACTGCTGGGTCACTTATCAAAACAGAAAGATTTATGACGTGACCAGGTTTTTGAGCGAACACCCTGG
TGGTGACGAGTCCATCTTGGACTATGCTGGTAAGGACATTACTGAGATCATGAAAGACTCAGATGTGCATGAACACAGC
GACTCCGCGTATGAAATCCTTGAGGACGAATATTTGATTGGTTACTTGGCAACTGACGAAGAGGCAGCGAGATTGTTGA
CTAACAAGAACCATAAGGTTGAAGTGCAGTTGTCAGCTGACGGTACTGAGTTTGACTCCACTACTTTTGTAAAGGAGTT
GCCCGCCGAGGAGAAACTAAGTATTGCTACGGACTACAGTAACGACTACAAAAAGCATAAATTTTTGGATCTGAACCGT
CCTTTGCTGATGCAGATTCTGCGTAGTGATTTCAAGAAAGATTTTTACGTTGACCAAATCCATAGACCAAGACATTACG
GTAAGGGGTCTGCCCCGCTATTTGGTAATTTCTTGGAACCATTAACTAAAACAGCTTGGTGGGTTGTTCCGGTTGCTT > SEQ ID NO:375  200670  *Saccharomyces cereviseae*
GAATTCCAGCTGACCACCATGAGAAAGAATTAAAATACCTTATCTGCTTCAACATACTCCTCCTGTTATCTATAATAT
ACTACACTTTCGATTTGCTAACGTTGTGTATTGACGATACTGTTAAAGATGCTATACTTGAGGAAGACTTAAATCCAGA
TGCACCTCCAAAGCCTCAACTAATACCTAAAATCATACATCAGACTTATAAAACGGAAGACATCCCTGAGCACTGGAAA
GAGGGTAGACAAAAATGTCTCGATCTACATCCAGATTACAAGTACATCCTATGGACGGACGAGATGGCCTATGAGTTTA
TAAAGGAAGAATACCCGTGGTTTCTCGATACTTTTGAGAACTACAAATACCCCATAGAACGTGCCGATGCCATTCGTTA
CTTTATCCTGTCCCATTATGGTGGTGTATACATCGATTTAGATGACGGCTGCGAAAGGAAACTAGATCCTTTGTTAGCT
TTCCCGGCCTTCTTAAGAAAGACTTCACCTTTAGGTGTCTCAAACGATGTCATGGGTTCTGTGCCTAGACATCCCTTCT
TTTTAAAGGCTTTAAAGTCTTTGAAACACTATGACAAGTACTGGTTTATCCCTTACATGACTATTATGGGGTCTACTGG > SEQ ID NO:376  200671  *Saccharomyces cereviseae*
GAATTCCAGCTGACCACCATGAACGTAACATCGAATGCAACTGCAGCCGGTTCCTTTCCACTAGCATTTGGTCTCAAGA
CCTCATTTGGGTTTATGCACTATGCCAAGGCCCCTGCCATTAATTTACGCCCAAGGAATCCTTGCTGCCGGAAATGAG
TGATGGTGTGCTGGCCTTGGTTGCGCCGGTTGTTGCCTACTGGGCGTTGTCTGGTATATTCCATGTAATAGACACTTTC
CATCTGGCTGAGAAGTACAGAATTCATCCGAGCGAAGAGGTTGCCAAGAGGAACAAGGCGTCGAGAATGCATGCTTTCC
TTGAAGTGATTCTACAACATATCATACAGACCATTGTTGGCCTTATCTTTATGCACTTCGAGCCGATCTACATGACTGG

```
GTTTGAAGAAAATGCCATGTGGAAGCTTCGTGCAGACCTTCCTCGGATTATTCCAGATGCCGCTATTTATTACGGCTAT
ATGTACGGAATGTCCGCTTTGAAGATCTTTGCAGGCTTTTTATTCGTTGATACATGGCAATACTTTTTGCATAGATTGA
TGCATATGAATAAGACCTTATACAAATGGTTCCACTCTGTTCATCATGAACTATACGTGCCATATGCTTACGGTGCTC
```

> SEQ ID NO:377 200672 Saccharomyces cereviseae
```
GAATTCCAGCTGACCACCATGAGTGAAACAGAATTGAGAAAAAGACAGGCCCAATTCACTAGGGAGTTACATGGTGATG
ATATTGGTAAAAAGACAGGTTTGAGTGCATTGATGTCGAAGAACAACTCTGCCCAAAAGGAAGCCGTTCAGAAGTACTT
GAGAAATTGGGATGGTAGAACCGATAAAGATGCCGAAGAACGTCGTCTTGAGGATTATAATGAAGCCACACATTCCTAC
TATAACGTCGTTACAGATTTCTATGAATATGGTTGGGGTTCCTCTTTCCATTTCAGCAGATTTTATAAAGGTGAGAGTT
TCGCTGCCTCGATAGCAAGACATGAACATTATTTAGCTTACAAGGCTGGTATTCAAAGAGGCGATTTAGTTCTCGACGT
TGGTTGTGGTGTTGGGGGCCCAGCAAGAGAGATTGCAAGATTTACCGGTTGTAACGTCATCGGTCTAAACAATAACGAT
TACCAAATTGCCAAGGCAAAATATTACGCTAAAAAATACAATTTGAGTGACCAAATGGACTTTGTAAAGGGTGATTTCA
TGAAAATGGATTTCGAAGAAAACACTTTCGACAAAGTTTATGCAATTGAGGCCACATGTCACGCTCCAAAATTAGAAGG
TGT
```

> SEQ ID NO:378 200673 Saccharomyces cereviseae
```
GAATTCCAGTGACCACCATGCCTTACACTCTTCCGACGCTCATCATAAGTTAATCACCTCTCATTTGGTGGACACCGAC
CCTGAAGTGGACTCCATTATCAAGGATGAAATTGAAAGACAAAAGCACTCCATCAATTTGATTGCTTCTGAAAATTTCA
CCTCAACCTCCGTTTTCGATGCCCTTGGAACTCCATTGTCCAACAAATACTCTGAAGGTTATCCAGGTGCTCGTTACTA
CGGTGGTAATGAACACATTGACAGAATGGAAATTCTATGTCAACAAAGAGCTTTGAAAGCTTTCCATGTTACTCCAGAC
AAGTGGGGTGTTAACGTCCAAACTTTATCTGGTTCTCCTGCTAACTTGCAGGTTTATCAAGCTATTATGAAGCCTCATG
AAAGATTGATGGGTCTATACCTACCAGATGGTGGTCATTTGTCTCACGGTCACGCTACTGAAAACAGAAAAATTTCTGC
TGTTTCCACATACTTCGAATCTTTCCCATACAGAGTTAACCCAGAAACCGGTATTATCGACTACGATACTTTAGAAAAG
AACGCCATCCTATATAGACCAAAGGTTCTTGTTGCTGGTACTTC
```

> SEQ ID NO:379 200674 Saccharomyces cereviseae
```
GAATTCCAGCTGACCACCATGGGTAAAGTTATTTTAGTTACAGGTGTTTCCAGAGGTATCGGTAAGTCCATCGTGGATG
TTCTTTTCAGTTTGGACAAGGACACGGTTGTTTACGGTGTAGCCAGGTCTGAGGCACCCTTGAAGAAGTTGAAAGAGAA
GTATGGCGACAGGTTTTTTTACGTTGTCGGTGATATTACCGAGGATTCCGTGTTGAAGCAGTTGGTTAACGCTGCTGTT
AAGGGCCACGGCAAGATCGACTCCTTGGTTGCCAACGCTGGTGTCCTAGAGCCCGTGCAAAATGTCAACGAGATTGATG
TCAACGCTTGGAAGAAGCTGTATGACATCAACTTCTTCAGCATTGTTTCCTTGGTTGGCATTGCGTTACCTGAATTGAA
GAAGACCAACGGTAACGTGGTATTCGTCAGTTCGGACGCCTGTAACATGTACTTCAGCAGTTGGGGAGCTTACGGTTCT
TCAAAAGCCGCTCTGAACCACTTCGCCATGACTCTGGCCAACGAGGAAAGGCAAGTGAAAGCCATTGCCGTCGCCCCAG
GTATTGTGGACACAGATATGCAAGTTAACATTAGGGAGAACGTGGGGCCTTCCTCCATG
```

> SEQ ID NO:380 200677 Saccharomyces cereviseae
```
GAATTCCAGCTGACCACCATGGGCTCCAAAAAACTGACCGTAGGATCTGATTCGCACCGGTTGAGCAAATCCAGTTTTT
CAAGTAATAAGTCGTCACATTCAGCAACAAACGATCAGCCAATTGATACCGACGATATTGATGAAGACGATGAATCTGG
TCATAATATTATCTTGAACATCATCTCACAATTGAGACCAGGCTGCGATTTGACCAGGATCACCTTGCCTACTTTTATC
TTAGAAAAAAAATCGATGCTTGAACGTGTCACAAATCAGTTACAATTCCCTGAGTTTTTGTTACAGGCGCATTCAGAAA
AGGACCCCTTGAAAAGATTTTTGTACGTAATGAAATGGTATTTGGCAGGCTGGCATATTGCTCCAAAGGCTGTAAAAAA
ACCATTGAACCCAGTCCTTGGTGAATATTTTACAGCTTATTGGGATCTACCAAACAAGCAGCAGGCATATTATATATCT
GAACAGACAAGTCACCATCCTCCAGAATGTGCATATTTTTACATGATTCCTGAATCTTCGATTAGAGTGGATGGGGTCG
TTATTCCTAAATCTAGATTTTTAGGTAATTCAAGTGCGGCCATGATGGATGGATCAACAGTCTTGCAATTTCTGGACAT
AAA
```

> SEQ ID NO:381 200680 Saccharomyces cereviseae
```
GAATTCCAGCTGACCACCATGTCTGCTGTTAACGTTGCACCTGAATTGACTAATGCCGACAACACAATTACCTACGATG
CGATTGTCATCGGTGCCGGTGTTATCGGTCCATGTGTTGCTACTGGTCTAGCAAGAAAGGGTAAGAAAGTTCTTATCGT
AGAACGTGACTGGGCTATGCCTGATAGAATTGTTGGTGAATTGATGCAACCAGGTGGTGTTAGAGCATTGAGAAGTCTG
GGTATGATTCAATCTATCAACAACATCGAAGCATATCCTGTTACCGGTTATACCGTCTTTTTCAACGGCGAACAAGTTG
ATATTCCATACCCTTACAAGGCCGATATCCCTAAAGTTGAAAAATTGAAGGACTTGGTCAAAGATGGTAATGACAAGGT
CTTGGAAGACAGCACTATTCACATCAAGGATTACGAAGATGATGAAAGAGAAGGGGTGTTGCTTTTGTTCATGGTAGAT
```

FIG. 1 continued

```
TCTTGAACAACTTGAGAAACATTACTGCTCAAGAGCCAAATGTTACTAGAGTGCAAGGTAACTGTATTGAGATATTGAA
GGATGAAAAGAATGAGGTTGTTGGTGCCAAGGTTGACATTGATGGCCGTGGCAAGGTGGAATTCAA
```

> SEQ ID NO:382  212301  *Trichoderma harzianum*
```
GTGGCGGGTTTACATTGATAAGTGACGGATATGCATCCCGAAAATGACAAATTTGTAAGCATGTCACTGCCGGCAAAGA
ACCCTGAATGCTCTAGATGCTTCCGAAGGATTCTCCATAAGATGATATCCCATGCAGTTTGTGCCAAAATGGGTTAACG
GACGCCCGATTCCGTGGGTGTGCATTTGATTGAGACCCCCATGTTTGCAGTGAATCGGTTGGGTAAGATGCATTGGAGA
GGATGTACGTAGGAGGTTCATTTATTGCC
```

> SEQ ID NO:383  212347  *Trichoderma harzianum*
```
CCCACGCGTCCGGTTTCTCAAAACACCAAATGCACCTGAATCTCAGCTGAGCCTCGCCCGCCCGCCAAAGTCAGTTTTT
TATGCTTCACGCAATTTAGAACAAACAAGGGGAATCCGAAACCAAAACCTTCCTGAATCGCCAATCATGGGCTCCTCAA
GCCTGCTTGACCAGTACGGCGACGCCGTCAGCCAGAGTGGCTTCTCGTCTCGTCACCACGCGAAGAGCAGCCGCCACAA
GAAGCGCCGCTCGCACTCGCACTCGCCGTCGCGATCCCGGTCCCGGGACCGATCTCGAGATCGTGATCGTGAACGTGAA
CGGGACAGAGACAGAGACAGGTCGCGCTCCCGGAACCGCGGCGGGATCTTTGGCGGCGAGAGCGGCCACCGCAGGCACA
GCGGCTCCAAGGGCTCGTTCTTTGGCCTGGGTGGCGGTAATAACAGCCGCTCCAGCCTGTTTGGAAGCAGCCGTCCCTC
GTACTACAAACGCTCTCCTCG
```

> SEQ ID NO:384  212356  *Trichoderma harzianum*
```
GGTGCCGGGACAAGCAGCCCGAGTCTTTCTTCTCCCAGAGCGCTGTTTCTTGAATCTTTGTTTCCGCCACATCCTCCGT
GAAGCCCGAGAAAAAAACATCTCTAGCATCAGAAGATCCTATAAAAGATAAAAAAGACTTATACAAAAAATCCTTCCTC
GCAAGGGAAGCGCCGGAGCAACAACATGCCCATAGCACTGTCCCCTCCCTTCCGGCCAAGAAATGGCTTGACCAAGTTC
ACCAACTGCCGCCTCCTGCGCGGCGATAAGCTGGTCGAGGAGGATCTCTGGGTCAGCTCGCTGTCTGGCAAGGTTGTCA
ACAGCCAGGCTGCCTTTTTCGATGACCTCGTTCTCCCTGACCAGACCATCGACCTCGACGGCCGCATCATCTCGCCGGG
CATGATTGATGTGCAGCTCAACGGCGCGTTCGGCTTCAACTTCTCGACGCTGCTCGATGACATGTCACAGTACGGCAAA
AAGGTCAAGGAGGTGCAGAAGTTGCTGGTGCAGACGGGCGTCACATCGTACAATCCCACCATCACCAGCCAGAGGCCAG
AACTATACCAGAAGGCTCTTCCGTTCCTAGGACCGTC
```

> SEQ ID NO:385  212363  *Trichoderma harzianum*
```
CCCACGCGTCCGCCCACGCGTCCGAAACAACCTTCTTCATCAATTCTACTACAACGACCTTCCTACTTAAACAATCTCT
CGATACCAACTCCCCAAGATGAAGTTCACTCTCGTCCTTGCTACCTTTGCCGCCGTCGTCTACGGTCAAACCATCGATG
ACATTCCCGCATGTGCTCGTACTTGCATTGAGAACGCCGTTCTAGCCGCTGGTTGCTCGTCTGGAACTGACGTCGCATG
CGCTTGCGCACATTTCACTGCTGTTCAGAATGGCTCTACTAGCTGTGTCATTGCTGCTTGTGGCGTTTCTGTCGCCATT
AACCAAGTTCTGCCTGCCACCCAGGCTCTTTGTGCCAACCAGTGAACTCATCCATCG
```

> SEQ ID NO:386  212412  *Trichoderma harzianum*
```
CTTTTTGATATCTCAAAACTCCCCAAACAACCCACATCAATCATCATGACTGGACGCGGCAAAGGTGGCAACGGGCCTC
GGCAAGGGTGGTGCCAAGCGTCACCGCAAGATTCTTCGTGACAACATCCAGAGTATTACCAAGCCCGCTATCCGACGTC
TCGCTCGTCGTGGTGGTGTCAAGCGTATCTCTGCCATGATCTACGAGGAGACCCGTGGTGTCCTCAAGTCCTTCCTCGA
GGGTGTCATCCGTGATGCCGTCACATACACTGAGCACGCCAAGCGCAAGACCGTCACATCACTAGACGTTGTCTATGCT
CTGAAACGACAGGGCCGCACCCTGTACGGTTTCGGTGGTTAAGCGATCTGCCACTAGGTCGGGTCGACATAATGTGTTA
TTCGCGTGTTTGTTACGATTGGGCTTTTCACTATGGGCGCGGGTCATTGCTTTTTGAGATTTCGTACTGTATAACGTAC
TGGGAAATGGGTGACCCCGAAAGGGGGTAATTGAGACTTATTCAGTGGTGACCT
```

> SEQ ID NO:387  212444  *Trichoderma harzianum*
```
ACTGAATGAGACAAGAGACAAGAGACAGAAGAGATCGGGACCGGCATTCGGGGGGGACACCCTGGCCGAACTAAATCAA
TCCGTGCTACTGTACGTCTTACACGATTTCGGCTCTGCTAGGGGCCCCGAATGGCCACGGAGCCCATGGACAGAGAGAG
AAAAGTGGCGGATCAGGATGAGGCTGATGGTGATGGATGATGCCATGCTGCATTTCGTCTGAAACGACTTACTTTTATG
TAGCTTGTGAGGCCATAATCTCGCAGATAAATAACACGAATATTTCCTCACC
```

> SEQ ID NO:388  212454  *Trichoderma harzianum*
```
CCCACGCGTCCGATTTGGCAATTCCTCAAGCTCACCCATTTGTTGACTCTGGCAGTGTAGCACACAGTCTGCTCAACAA
ACCACATCACCATGTCCGCCGCAGAGAAGACCACGGTGGCGACCGACGTCGCAAATCCCCCCAGTCGC
```

FIG. 1 continued

> SEQ ID NO:389 212475 *Trichoderma harzianum*
GCCTCGCTGCTACTCTCAATTGAACTCGACTCGAGCTCCGTCAATCGCAAATCCCTACAAGATGCTGCGCTCTATGGTT
CTACGAGGCAATGCCTTGACGCAGACCACCCGACTGGCTGCATCCAGGGCCATGTCGAGCCAGGCGCTCTCCAACCCGA
CCCTGTCCAACATCGAGAAACGCTGGGAGGGAATGCCTCTCCAGGAGCAGGCCGACCTGTGGATGGCCCTGCGTGACCG
CATGAAGGGCAGCTGGAACGACCTGACCCTGCAGGAGAAGAAGGCCGCTTACTGGATCGCCTTCGGCCCTCACGGCCCC
CGCACCGTTGACGCTCCCGGAGCCGGTGCCCGTGTTGCCTGGGGAGTTGCCGTTGGCCTTGCCGCCTCTCTCGCTCTCT
TCGCTGCCATCCGAGTTGCCGCCAAGCCTGCGCCTTACACCATGAACAAGGAGTACCAGGAGGCCACTAACGAGCTTCT
CAAGGCTCAAGGTGCTGATCCCCTCACTGGTATCTCTTCTCCCGGCTATACTGGCAAGGGTGTCGTGCAGTCTCCTCCC
AAAAACTAAAATAAAACACGATAATATCGCTTCAAGCTTCGCACAATTGGGG > SEQ ID NO:390 212492 *Trichoderma harzianum*
GGTTTCGGAGAGCTAGATTGAATCGGAGGGGCTGCCTATATTGCGGCAGAGGAATAGTGACGTCATGACTATCAAGGAC
CCTGGGAGGTTACCTAAAAGAAAAGCATCTGGACGAGGTGACGTAGCCATCAATGCGATCGATTGTTTGCTCTATCTCC
TCGGGTCGGCTGTTGATTTAGTATTAAACTAATGGATAT > SEQ ID NO:391 212584 *Trichoderma harzianum*
TAAGATTTTCAGCTCACCTCAAAAGGAGCACTTTCACTGCTGGAAACCAGAATCTCTTGCGGATCCCCAGATTAAGCCA
GAGGTACTCCGTACCTACAGGACCCAGTTACAATCGTGGAGAATCCTCTCTCCAATCGCCTCCAATCGTCTCCAACTTT
GGTGTCAGATAGTACATCGATCCGCCAATTTTATGTTGCTCTTGGGAGTCATTCTCCATTCGACGTTTGACCCGCCATC
GGAGCCTTGTCTTGCCGACTATCCTCTTAACTCCCGGGCTTCCCTTCCAAACTTTTAATCTTCCACCGCAACATCTTTT
CTTCCTTTCTTCTTCTTTTTCCTTTCTTCATTGA > SEQ ID NO:392 212616 *Trichoderma harzianum*
CCCACGCGTCCGCCCACGCGTCCGGGATCTTGGTGGGCACCACGACGTTCTTCTCCATCCTCATCTTCTCGATCAACAC
TGTCTTTGCTCAGGAAACACTCGCGCAGTGGATTGGAGATTACCTGACTCAATCTGCTGGTGTTACGGTTGTCTTCGAA
TCAGCCATAGTGCCCAAGTGGAAGAATGGCGTTATCGCATTTCGTAATGTGTTTATTTCAAGAAGACCCGGGCAGATCG
AATCATCCGTCAGCAAGGGATCGTCTGACGCTGCTGCTGTTGCTGCCGCAGGGCGCCAGGTTCAGCATAACGGGACTGT
TACCGAAGACGATGGCAACTATACGCAATTTGATGTAACGATCGCAAACGTCAATGTCACACTTTCATTCCTCAACTGG
TGGAATGGCAGGGGGCTTCTCAAAGATGTGGAAGTAAATGGTGTTAGAGGAATTGTCGATCGCACCTCTGTCCGTTGGC
CACTGCAGCAAATCGACCCCTTGTCTTACCGCCACAAACACCAACCAGGCGATTTTGAGATTGAATCTTTCAAATTGGA
AGATCTTTTGCTCACCATTCGCCAACCTGATG > SEQ ID NO:393 212623 *Trichoderma harzianum*
GGCGCCCATAAACAATGTCTCAGGGCCCAAGGAATGTGCTGTGAACGAGCTGCTACTGCACCGCCGATTGTCTGATGCA
AGCAAGGGACTTGTTTGTTTGCTCCATCCTTGATTCACTTTAATGCTTGTTATTAGGTACTTTAACAGCCACTTTGAAA
AGGTACTTTGCAAATGCTTAAATCTCCATTCTGCCTTATACTCCATGCCTGTAATTGTATATTACCACCATGGTAATCC
AGTAATACCGCAAGCTGGCAGTATCAATCGCCATTTTTCTCTACATAAAAGGAGCTGTATCACGTGCCTTTAAATCCAT
CT > SEQ ID NO:394 212646 *Trichoderma harzianum*
GATGAGGACGATGTTGAGGATGTGATTGGAGAAGACATGGACGAAGACATTTATGATTAAGCGGATTGATCAATCCAGG
AAACAAAGTTTCACCCAAAAGTTATTTTTCTTTTCTCGTCACGGATATGGCATACGGAGTTTCAGGAGGAAATGGGGAA
ACCGTTTTTGGTTTGAGTAATTACTCATAAATTGGCCCTCTATAATGTATCATA > SEQ ID NO:395 212661 *Trichoderma harzianum*
GCCAAGCCTTGTAGTTGTGTATTCACAAAGTGTGGGCCTGCCTTCATTTATATTTATTCTCCTCATGCCGTGTCTTGGC
TGAAGCGCGAAGTTCTTCTCTTCTCCAATTCTATCGATGCTACTGCTGACCAACGTCAGTTCCTCTACTGATTCCACCC
CATATTTGACGCCTATCCTACTTACCTTGTGGTCCT > SEQ ID NO:396 212682 *Trichoderma harzianum*
GGCGCCCAGGAGCAATGTCTCAGGGCCCAACGAATGTGCGGTGAACGACCTGCTACTGCACCGCCGATTGTCTGATGCA
AGCAAGGGAGTTGTTTGTTTGCTCCATCCTTGATTCACTTTAATGCTTGTTATTAGGTACTTTAAGAGCCATGTTGAAA
GGGTACTTTGCAAGTGCTTAAATCTCCATTCTGCCTTATACTCCATGCCTGTAATTGTATAGTAGCACCAGGGTAAGCC
AGCAATACCGCAAGCTGGCAGTATCAATCGCCATTTTTCTCTACAAAAAAGAAAGAAAAAAAAAC > SEQ ID NO:397 212714 Trichoderma harzianum
GATTTCTCCACCACTCGCTCGGCATTTGTGGGCTCTTCCTCAGCGATTTAAAGGACCTGACCCGTCTCACGAATCAAGA
GGCATAACCGTTACTGCCATCTCAGACCGCTAAGCAGCGATATCGTCATATTCGCGGCGCTGTGAAGGACAAGAACGAG
AACGAGAACTGTTGAAGCTTGGCTCACCCAGTCCCCGCAGCAATGGGCCTGGCCTACAACACCTACCTCACCAGCAACA
AGATCTACGGTTGCAAAACATGCAAGGCGCATCTTGCGAACCACGAGGACATCATCTCTCGGAACTTCCGGGGCCAACA
TGGCAAGGCCTACCTGTTCCATCGTGTCGTCAATATCGACACCGGTGACCCTAATGAGCGTAACATGACCACCGGCCGC
CACATTGTCCGTGACATCGCCTGCCATCAGTGCAAAGAAACGGTGGGTTGGAAGTACGACAAGGCTTTTGAGACTTCTG
AAAAGTACAAGGAGGGCAAGTTCATCCTTGAAGCTGAGCTGCTATGTAACGTCGCTTGATTGTACGAATTTCACCTCTT
TAGCATGATTTC > SEQ ID NO:398 212719 Trichoderma harzianum
GGGAAGCCTCTCGCAATCGGCCCAATCCGGGATTTGTGTCGTGCCCCGGCGCTCTCAACAGCTCCTTCACCAGCTCTCT
CAAGTTTGAGACGCCCGAATCATAAACAGACCTGCCGACGTACAGAGTCGTGGACCAAAATGGGCAATTGGTTGACCCC
TCCTTCACCCCTGACATCAGCGATGAGGCCGTCATCAATGCTGTACAAGGATATGCTGTACATCTCCATCATGGATCTC
ATCATGGTTTGATGCTC > SEQ ID NO:399 212738 Trichoderma harzianum
GGCTTCTGGAAATATTCTAGCCTCCGCCCTGGATTAGATACCCGAAGACTCGGGCAGGCTGTATTCTGCGCCCAAGATC
TCCAAGTGCCGGCACCAACCCGGGCGCTACGGGCTTTTCTGTTTATGTGTGTGAATACCCCAATTTCTGGAAAATCTCC
AAAAAGAGGAAAGAAACAGCCCCAAAATGTCCCACCGGGCTAGTTCGGGAGACTCACCGCCTGTGGGAGCACAGGAGAA
GGGAAACGCAGGCCAGGCCGTGCAGGACACTGGTGTGGTGCAGCAATCAGACGCTGCCTTCACGAATTCATACGATGAG
GAGGATTTCTGGACGAGGAACGGCTTGAATGCCAAGTCATTCCACAAGAAACACTATGGATTGGGACTGGTGGAACTGG
ACCGAGCGATGAAGACAAGGCACCTTACAGATGATTGCCATTGG > SEQ ID NO:400 212744 Trichoderma harzianum
CCCACGCGTCCGCCCACGCGTCCGGGCAAAGAGATGCTACATCCATAATTCCATCACATGCCGGTTGCCTCGTCATCAT
TATTTCTCAAGCAGCACATTCCGTCAAAACCTTGTGTTGAGCCGTGGAAATAGCCAGAAAGTATCTTGCTCAACCCTCA
TTCAGCTTGCCTTGTCGTTTCCTAATCTACCAACATGGATGCCTAGAAGTCTGGGCCTTCCGTCCATTTACCGTGGGG
TCGGGGACTTGACTGATTCCGAGGAGTTCTGGTGACACAGCACGCAAGGCAGCCATTCCTCCTGGTTAAGCATATCTCT
TTGCCATCGGATTCCGAAGAGGCCGAAATTTGGAACCGCAATGACAGATCCCGTTGATAACGGCATGCCGGGGAGTGTC
ATTCCAGTATTACGCAGCGTATGGGCGGCGGTTCGGTTTCGATCTACGGGCATGCTATGCATTTGGA > SEQ ID NO:401 212755 Trichoderma harzianum
GATCCTGTGAACATGGTCGGATTTGTTGGCTCGAACTTGCTCCGCGGGGACTATCAGATCGTACACGCCGAAGACATTA
ACATCAAGAATCTTCATGCCTGGCAAGTCGTGGATGTTCGCACACCCGAGGAGTTTGCGACTGGCCACCTCCCGGGGGC
AATCAACTTGCCAATTGCAACACTGCGCAATCAGAAATTGGAGCTTGACCAATCCATGCCAATTCTTGTGTACTGTTAT
GTGGGCTATCGGGGATACTTGGCCTACCGCATCCTCAGTCAGAGAGGATTCAGCGTAGTAAACCTTGATGGCGGACTGA
AGACAGTAGTCGAGGGGGAACCAGGCTTTGAAAATTTGTTCTTCAGAAAATTTGTTCTTCATGTTTCTAACATATTTA
AGTGATATCTAAGTAATATAATCTCAGTCTTACGCG > SEQ ID NO:402 212756 Trichoderma harzianum
GCAGTTAGCTCAAAGGGGGCATTTCGATGGGAACGAAGCAATCTGGAACGTGGTAACCAAGGAGTGTAGAGGTAGTTTC
GATGTATACTCGCCACATCGTATCTTGAGCGAGTTCCTCGTCAGTTTCGATGTGTCAACGCTCCGGGATTGGAACAAAA
CAGCCAATGCTTGACCTCGCGTAATCTGTATCTTGCACAACATTGCGGGATGATCTTTAGCCGATATCTTGGAAGGCA
GCGGCGCGAATGACCATCTACTACGTCCAAACCGGGCGATAAGAGAGGCCGCCACGTACGCGATTCGCGCGGTCCTCGG
TCGTTCGGAGTGGTGTTGTGGATAGTGCCAGGCGAAAAAAAAACAGCCAACATCT > SEQ ID NO:403 212767 Trichoderma harzianum
CCCCAATCGCCAAATACACAAATCCATTGCGCTACAAAGAACAAGCACCATGGACGCCAAGCCTGCCACTTTCTCCTTG
GCCGCTGCGCCAGTTGCTTCTCCCGCAGCCTCCGCGAGCGCTTCCAAGCCCAAGCCGTGCTGCGTATGCAAAGAGGAAA
AGTCGAAGCGCGATGAGTGCATGCTCTTCTCAACGGCCAAGGATCCCGCAGCCGACTGCAGATCGCTCGTTGACCAATA
CAAGAGCTGCATGCAGGGCTTCGGATTCACTGTATAAATCAAATATCTTCATCTTGGCGCTATGCCTTTGTACATTAT
CACCATATAGACTACTCGGAAAAGTACAGCGCTCGATTATTCTAC

FIG. 1 continued

> SEQ ID NO:404 212775 *Trichoderma harzianum*
GCCCAATCGCCAAATACACAAATCCATTGAGCTACAAATAACAAGCAGCATGGACACCAAACCTGACACTTTCTCCTTG
GCCGTATGCGCCATGTTGACTTCTCCCGCAATCTCCGCTAAACGCTTCCAAACCCAAGCCGGGCTGCGTATGCTAAGAG
GAAAATTCTAACCGCGAAGAGTGAATGATCTTCTCAACG > SEQ ID NO:405 212777 *Trichoderma harzianum*
CGCCCCCATACAATCTCCAACTCAACTCAAGCAGGCTATCTGTGGACCACAAGTACAACTCATCACAACAATATCAGCC
CTTTCAACAACAGCAACAGCACCAGTATAACAACAACATCACCAACAACAACAACAACCTGAACAACCATCATCAGACA
AAGCTGGACGACTTCACCTTCGGCAACTCGACCGACTTTGACTTCTCGACCTCGACCTTCCCCTCAACCGAGCTCTCTG
TGTCCAATCTCGAGTATCTCAACGCCGCAATCGCCTCTGCGTTTTCGTCTGACTCGATGCGGCCCGAATCCTGGGACGC
CGCCGCTCGCTTCTCAACTCCCAAGTTTGGTCGTCTTCCCCATCAACGAGAATCCTCTCTGTCTTCTCTGGGATCTACG
GGGCCGGGGTCGCCCTTCAACTCGCACATCGGGAACCCCCACATCGCCGGCACTGACGCCAATGGTGACGG > SEQ ID NO:406 212785 *Trichoderma harzianum*
CGCCCGACAGGTTACCCGCAACGCCCCGCGGTGTGCTGCGCAGCTGCGCACTCCCATGCAGGGCCGCTTCGCCAGCACC
GCCGAGAACGAGTTCATCGCTGAGCGCCAGCACATCAAGGAACACGCCAAGGGCACCACTGAGCTTTGGAAGAAGATTT
CCATCTACGCCGTTGTTCCTGCGCTGGCTATCGCCGGTGCCAATGCCTACTGGCTGTGGACTGAGCACTGGGAGCACTG
GAGCCATCTTCCTCCTCTGCCCGAGCGCACCGAGTACCCCTACCAGAACATCCGGACCAAGAACTACCAGTGGGGTGAT
GGTGACAAGACTATCTTCTGGAACGACAACGTCAACTACCACAACAAGGACAAGACCAAATAAGCTGGAACAATGGCTC
CCGGAGGAAAACTGCTGGTATTTGTAGATTACCCTTTTTGGGACCCCTCTGTATATTTCCCTTGGAGCTTCAATCGATT
ACACTGTGG > SEQ ID NO:407 212792 Contig A *Trichoderma harzianum*
CCCCCATAGAGTCGACTCATTGCTGGCATACGGAGCATTCCTATCTTACTCTTACTAGTGTTTTTGCCATCGTTCATCA
TGCTGCCCAATGCGATCATCGCGATTGTCGCATTGGATTTCAGCCCACTAAATGCGCTGTGGCCCATTCCTC > SEQ ID NO:408 212792 Contig B *Trichoderma harzianum*
AGCAATTATACATTAAAATCACCTCATCACCTGCGGATACTATTATGCATATTAATTACTCGACCGGCAACAGCCATCC
CAGCATCCTCTTTTGGTAAAGTAGTGGCCTTCACATGCAAACATCGGCTATCGCAACTAACACCCCCTTCCCCTGTCC > SEQ ID NO:409 212794 *Trichoderma harzianum*
CGAATACATTACAAGTAGCAGATTGTTTCCTTCTTGCACGGACTTTTTACGGACTCTTTGTTGTCACTCTGGCCCGATC
CTTTTGACCGTGTGGCCGTTTGCATTACTAGCTCCGTCCAGCATCAGGGATCCCCATCGATACCAGGTCGAGATACCTA
CCTAGTAGTACCTATCTGCTTGAAGTTACCACTTGCGAGTTGTCCATATTGACTTCATCTGCCCTGTGCTATCATACAG
CCCAGGGGAACAACTCCCCTGATAACAAAAAGAAGCTCCAGTCCCGCCGTCTCTAGATTTTGGACCCCGTTTGTCTCCG
TACAGCACGCATTGGATCCCGTGGGCCTCAAAAATTCAAGTCAGGGATATGTCTGGTGACGTGCATATGCGGGCCTTTT
CAGGCGTCTAATCATACGTGGCGGGTTTCTCCAGACGCCTCTCCAGGCCCCCTCTAGGACCTGTCCAAATGCGCTGC > SEQ ID NO:410 212808 *Trichoderma harzianum*
CAGAGGATTAAGGATTGGGAAATAATAAGAGAGTTGTCGAGAGGTCACTGGTGGCAAATGTTTTTGTTATAGGTAGCCC
ATCAACCCGTATCACACAAGACTGAGCAGTATATATAGAATTCTCAG > SEQ ID NO:411 212824 *Trichoderma harzianum*
ATTCTTCCCCCCGTTAAAATCGAATCCTTCAGTGCTCGCCGCTAGAAAAAACCGCTTCCACTCATTCCCACGCGACAAT
CTCGATCATCATAGCCCTTTTGATCGCTTCGCCACATCACATAGATCATGTCTAACCAGGACTGGGATTCTGCCACCAA
TATTGGAACCCGCGTTCGCGGTCCCGGTGCTTCGGACCGCGAAACCGTCATCCGAGGAAAGATTGCGTTGAAGGCTGCC
CATAGATCTGGTGCTGCCATTAGCACGGAGAAGAAGTATCCCAGCGCCAATACGGTCATCGGTACTGAGGGTCAGCGTC
TCAACAAGGTCGATCGTTCCGACGACATCATCAAGCCCAGGATTGTCGGAAAGGAAGTCGGAAAGGCCATCGAGCAGGG
CCGACAGAAGTTGGAGCCTACCATGACCCAGGCTGGTCTGG > SEQ ID NO:412 212830 *Trichoderma harzianum*
CATAACCACAACTAAGTCATAAGGAAACAAGTCACGATTCTGAATATCTATTCGCGTTATATACAACCTAAAATGAAGC
CGTTTTATCTGATTGCTATTCTATTTACCACTTTGGGCACTGCTATCCCAGGTTATCCCTAGGGATAATAACGGAATCC
TCGATAATTTCCTAGCTATTGTGAAAGACGCGACAGGAATTGATCGGACACCCGTCCACGGGCTCGTCGGCACTGTCCT

FIG. 1 continued

```
GAATGGTGGCACCAAATCTATCTTGATTAACTCGACTGTCCTGGGTCTTGCAGAGGCAATTTTTGATGAGGTGAAATCC
CAATTAGGCATTCAAGATCCGCGGTCGCTTGAAGAAACTATTGCGTCTTTGGAAGAGGCGGGTAATGAGACTTTTAACC
AATTCTGCCAACTACTCGACACGTTCCGCAGAGAGGATAAAGGTCCTGCTGGAGGAACCATTGACTCGCTAGGCGTGGG
CAATATATCCTCATTAAACTTGGCATTTTCTATCGACTTGATCATAAACTTGGTCGGACTACAATGTCCA

> SEQ ID NO:413  212833  Trichoderma harzianum
GCCTATAAGTCGCGATTCCTTGGAGATAACGCGAAGGAATCGGGTACAGTAAACGAACCCCGCTGGGACAATGCATTGA
TAATCTCACGCAATCGCCCATCTCGTGCAAGAGATCCGTCATTTGCTTCAATGGGAGCGAGCATTTGTACTTGATTGGG
GAAATACAGCAGAAGACAGACGAATTGACCAAGAGTGGGGAGTTCATTTACAACTCCAACCCTCGACTTCACCATGATC
ATCTCCAACAGGGTCATTGGTTCGGGCATTTTGCTCGCTGGCAGCACGAGAGCTCATTTACGGCTTCCCCCGTTCTTTA
CGGCCAAGCAGCAGGGTCTGGGCCCGTCTGCCCGATCCCAATTCCAAAGCTTCGGGTTCG > SEQ ID NO:414  212858  Trichoderma harzianum
CTCGTGTGGCGCCTCGTCTCAGGGACAACAGACGAGGACCAATTCAAATACCAGACCTAACCATGGCTGGGCTAGATGG
CAATAACCATAGCACGCTTCACTCGAGAACAGACGCGCTCGACAATCAAGGATGTGCTACGGCACACCCATTGGGACAG
ATGATGTCGCGGTTCAACGGTAACTCTTGTGATCTAGTAGATTGACCATCATACCGTGAGGCCGCCTCTAGTTGTCCAG
GACGATAAATGCCACTTGCAATGACCGAAGCTGTCTGAGTCTCAATACACTCTGTACCACATGAAAGGGCTGCTATGTC
TG > SEQ ID NO:415  212871  Trichoderma harzianum
CTTCGTTGCCTTCGATTTCCATCCGTTGGTCCGTTCCAAGCTCGACGGGATCCGGGGCGGATGACGGGGACCTGACTGT
GCCTGCATCGGTCACGGTGCCGGAGGGCGTGACGGAAGATACCATTGTCCAGCGATTCGCCTGGGCTTGCTGCGGTGAC
AACTGCGTATTGGCCATGGGGATGTCGCCCGGGGCGGCACCGCTTGCGCCTCCGGATTGTATGGAGGCGTCGTTGTATA
CGCGGCGCTCTGCAGCATTTCTCCGCTTTGTGAGATAGAACCACACGGTTGCCGCGACGAGGAGGCCGCCGCCCACCAC
TGCACCGACGGCGATACCCGCTTCCGCCCCGGGAGAGAGACCCCCGGACGATGAGGACCCGGAGTT > SEQ ID NO:416  212877  Trichoderma harzianum
CTCGTGTGGCGCCTTGTCTCAGGGACAACAGACGAGCGAGCAACTCAAAGACCAGAGCTAAACATGGCTTGGCTATATG
GCAATAAGCAGAGCACGCTTCAAGTCGAGAACAGACGCGCTCGACAATAAAGGATGTGCTACGGCACAGCCATTGGGAC
AGATGATGTCGCGGTGCAACGGTAACTCTCCCGATCTTGTTGATGGAGCATCATAACGTGAGGCCG > SEQ ID NO:417  212883  Trichoderma harzianum
CTTTTTCGGCGTTTGGCATCAAAATCCCTTGGTCAGCGAACCCCGAGCCCGTGCGCTTGGGAAAAGTATGGGGGATTGA
CTTTTCGAGGGAGGGTCATGTGATCTTAGTACGTACCGCAGTTTTTAGTAACAGCCTAGAGGTTGCAAGTTTTTTTTTA
GAAATTCCCAACGCCAATGTTGGCTGTGGC > SEQ ID NO:418  212892  Trichoderma harzianum
CCCACGCGTCCGCGCATCTTCACCAAGGCGCCGTCATCGCGCGGCATCATCGTCATTGACTTGAGCTTGGAAAGCTCAG
CAAGATGCCAGCAACCATGGCCCCTCCAACGCAGACTTTCAACCTCGATGTTGAGGCAATCTCGGGCATTTGCGGATCT
ATCTCTATAGCCTGTTGGGTGGTCGTGTTCTCTCCGCAAATCATACAAAATTTCCAACGCAGCAGCGCCGACGCTCTTT
CGATTCAATTCATCATTGCTTGGCTCCTAGGAGATGTCTTCAATATCCTCGGAGCCGTTTTACAGGGAGTTCTCCCCAC
CATGATCATCCTAGCCATCTACTACACCATTGCCGATCTCGTACTGCTCTGCCAGCTGTTTTACTATCGCGGATTTACG
TGGCGCGACGAGCCGACTCCATCCCCGCCCAAGACAAATGGCCACTCTTCGACATCA > SEQ ID NO:419  212902  Trichoderma harzianum
CCCACGCGTCCGCCGTGACTGAAGTTCAACCACATCCCAAACACAATATAAAACCCTCACATTTTCAAAAGAAAATCGA
TTATTATCACACTAGAAATTAAGAAAAATAACAGGAAGCATGTCTGACGAAGAGGGCGGCACAACAAGATGCTGCGCCC
CGTTCCTCGCTCTCACCGAGCCCATTGAAGTCAGCGAACTAGGATGGCCTCGACAAACCATCCGCATTTTCCAATGGC
CCTGGCCCAGTCCCTCTTGTTCATCAACGAAAGTAGCGATGCGCGGGATCACTGCGCCAACGAGCGAACTTTCCTTTC
GTACCTCCGCCTGTCGATATACATGGCCATCGTCTCTGTCGCCATCACCGTCTCGTTCCACATCAAGGGTACGCCCAGC
GATCTCGAGCGCCGGGTGGCAAAGCCCCTTGGTGGCATTTTTTGGGTACTGTCTGTTGTGACTTTGCCTTTAGGAGCGG
GAAACTATATCAGGACTGTCAATTTATATGGTAAAAGAGCCGCTATTGTGCAATCTGGCTGGAAGACTCAGGTGGTGTG
GGGTATAATAGCTGCTTCAATCATTGGGACGTGCATCA
```

FIG. 1 continued

> SEQ ID NO:420 212943 Trichoderma harzianum
CGCTACGGCTTATTTACTCTTCTGACCGGAGGTCTCGGTATTGACATGACCTTGGAGCCATCGCTGCCGCAACGAAATG
GAGTACTCGTACATGTAGCCGCAGTCTCTTGTCCATGCGAGCGGGCATTTCGTCGGCGTCCCAATGGTCACCGCGAGAC
CTATCATTTGAGATACTGTCTATCTTCCTGCATGTTGGCTGTACGAGACGAACGATATGACGGCTCCCTGCCTTTGATT
TCTATGCAGCAGTAGCCAAAAGAGAAAAGGTGTAATATGCAGCAAGGCCGCTATGTTGCCACCCCACGAGACCTCGACT
GCATGCACGTCCAGCGATACGTCTCCACGAGGCCGCGCATGACCGCTGTGTCGAGAGTGGATGGACTGCGGACACCTCT
CTGCTTGCAACGGCTCAGCAAATTTTGCCGTTGGGCCACCGAAGCCAAACGGCTCACCGTCTACGCAATTGGCACTCTA
AATGCTCCTTTCCGCAGCCGCCTTGCTTTCAATACGCGTCCACAAGCGTTTGTAGCCCTTGTCAGGCCGTTGCGGTT > SEQ ID NO:421 212987 Trichoderma harzianum
CATACATACACGAGGGGATATCCCCAAGTCCAGTCTTCTTGCTTTCTTGCTCTCGTCGGGAAAATGAGGAGAGGGCTAT
AGAAAAATAAAGTCTATTCTCGCAATAAAGCTTAGACAAACTTTGATTTGTCTGCTCCGGCAAACGCCTCATTTCGTCA
TAGCGCCAGTAATATGTCACCGGACGTTTATGAAAGAAGAGAGACCATAGGGAAAAAAGGTTGGATATTATCCGAGTGG
GCTGGCAGAAAATGACGCCAACCCGGGCAGCGAATGGTTATCGTATCACCTGAACTCCGCCTTTTTGATTTCTCTTTCC
AATGGGACAGCGGGCGATACAGCAAGGCAAGGGACATGTACCGTATTGGTTCTCGGGGCTCGAATGCAATAGTGCCTCA
TGGATATTGATTGCAGTGTGCAATAAATTGCCTATCTGCGGTGGAAAAAAAAAAAAA > SEQ ID NO:422 212990 Trichoderma harzianum
CCCACGCGTCCGCTGTTCCTCCTCCTAGCTTCAAAAAGACGCCAAACCCTCAAAACTGCTCCCAACCAAAAATAATCCA
CTACAAACGCTTTCGATAAACTTGCTCAAATGCTCTCAGATGGGTAACGCAGATGCGTGTGATTGGCTGGCTGTGCGCC
TGGTCCCTGTTTTAGCCTCCCCGCCATTCGGATCCGGAAACCGACTGTCTCTTTTGGACTGGGCTGGAAGATTTGGAA
GAAAGACGGTACTGTAGGGGAAAGATGATGCTTAATATTTGCTGTAAATTCTTATTGTTACTCATTGCATGTTACGCAA
TCGGGGCCTTCTTTTTGGCTTGGCAGTTGGTTATGTTAGTAATTGGCATGTACAGTACTGTATGACTCTGC > SEQ ID NO:423 212995 Trichoderma harzianum
TGCCCCTTATGATGTTTTGTGTTTGAGACACGGCTGATGAGGGCTGAGAAGTTGTTCAACATTGCACAACGTCTGGAAA
GACGGCAGTGGGCCATTCGAGTAAGAAAAGAACAACAGACGGATCCAGACTCTTGGTAGTAGCTAGGCAGCAGTTTAAC
AGAAGGAACAAAACGGGTAATGCGGGTGGTTTTGGACGCCCATGTGGCGACGTCTCTCCAGCTTTCTCCATCTTCTCCGT
ACTGACTCTGTCTCCATTTGGCGGGTTAGTCTTGTCAGTTTGGGGTTGGTCTTTGTCATGGAGCCATGGCCAGAGCCAG
TGTGGGCGGCCATGCCGAGTTGAATGGCTGACCAAGGACAATGCAGCATTTACGATTATATGAATGTGCTCGTATATAC
GAGTGCTACTCCGTACCATGCTGGTGTACCAAGTGATATATGAACGGCATGCACGCACTGCTCACTTANNAAAAAAAAA
AAA > SEQ ID NO:424 212996 Trichoderma harzianum
AAGCTTCTGCTACATCGCCAACATTCTGTTTTGATTATAACGATCTGAATGCCTACCTCCTCACCGTTGTGGGTGTTTC
TCGGCCTGAGAGCGATCAAGCCACGCTTTTTCATGACATCATGACCAAGGCTCAAGGGGGAGCTCGTATATCACTTCGC
GAGATCCAGACCTTGTGTTCCAGAGAAGCCATCGTCAAATTGGACTCGGGTGTGAATCTAGCTCAAGCTATAGAAAAGC
TTGGTAGCGGAATACACAGAATCTTGGTTACTGAACAAGCTGGGAATGTTATTGGGATTATAAGCCAACTTCGCATGGT
GGAGTTCTTCTGGAACGAAGGGATCAATTTTCCCACCATTGACCGACTTAATCCAGTCACGCTACAAGAGTTAGGAATT
GGAGTGCGGCCGATAATCTCTGTCCACGCCGACGCTCCTCTTACTGAAGCTTTATCGCTCATGTATGATGAGGGCCTTT
CAAGCGTAGCTATTGTAGACAACGGACAAAATGTGGTGGGCAACATCTCAACAAAGGATGTGCGGCATTTGACAAGCTC
CTCGAGTGCATATTTGCTTGGTAACTCTTGTATGCACTT > SEQ ID NO:425 213005 Trichoderma harzianum
CCAGCAATCCATTGATTCCCGCCCGTTCCTCCCGTCCACCCCTTCGACGCATATTCCGAGGTCAAAATGGCTGGTGTCG
CTACCTACACTATTGCTGGTCGACAGATCGGCGGTCACTACCTTGCCATGGGCTGGTTGGCTACCCTCTTCGGTGGTGC
CTACTATGCTGCTTCCGGCCCCAAGAAGCCTGCGTCTGCTGTCGCTACTCCCCGATCAACGCTTCCAGCTCTGACGAG
GCCGACTTCATCAAAAAATTCCTTGAGGAGCAGGATAAGAATCACTAAAGGGCGAAACTCGAAAACTACCGGCATGGAG
GGGGATAGTGTATTGTTGTCTTGTACATAATATATGCCCATAGAGCGAATGTGTCTCGAGATAGAAAATACGATGCGA
TGTACTCACGCCAAAATTCATGGATCTCTATCAATTT

FIG. 1 continued

> SEQ ID NO:426 213013 *Trichoderma harzianum*
GTTTCCTCCAAATCAAGTCATCCGATTCGTGGACAGCATGACACTTCCCCAAACGAGATTATTTCCCCCTCAAGCACTA
CTCCGGAATACCCAAAGCCAGAAGTTTATCCGAACGATTGCTTCAATGGCTACTGATGCACCTAATTTCCCATTTCGGC
GAGCTTCTGGCATGGAGCCACCAGCCGAGTTCGCACGGTTAAGGGCTGTTGATCCAGTATCCAGAGTTAAGCTTTTCGA
TGGAAGCTTGGCTTGGCTGGTGACTAAATACAAGGACGTAATTACTGTTGCAACCGATGAAAGGCTCTCCAAGGTCCGG
ACACGCCCTGGCTTCCCCGAGTTGGGTGCTGGTGGCAAAGAGGCCGCCAAAGCGAAGCCAACATTCGTTGACATGGACC
CTCCAGACCATATGCATCAAAGGAGCATGGTTGAGTCGATATTCTCTGCTGACCATATCAAGGAGCTGCAGCCATATAT
TCAGAAGACGGTGGATGATCTCCTTGGTTCTCTGAAAGCTAAGGGTTGCGCTGA > SEQ ID NO:427 213037 *Trichoderma harzianum*
CCTTGTTTCTTCATCCTCTATTCAATTGAGGTGATTCACTCTTGTCTAACAATCAGTGACCACTTGCATCATTCATCAT
GGCCTCCAACAACATGGTGACGCTGGCTGTGAATCCAAACAAAGAAAACGATCTCTTCCTCCAAGAAGTCCAGCAGGTC
AAAGATTGGTGGCGCGATTCACGATGGAGGCACACCAAGCGTCCCTTCACTGCTGAGCAGATCGTTTCTAAGAGAGGCC
ATCTGAAAATTGAGTATCCCAGCAATGCCCAGGCCAAGAATCTATGGAACATCCTGGAGAACCGTTTTCAGAACAAAGA
TGCTAGCTATACCTATGGCTGCTTAGAGCCTACAATGGTCACTCAGATGGCCAAGTACCTCGACACCGTCTATGTCTCT
GGCTGGCAGTCGTCTTCAACCGCCTCTGCGTCAGACGAGCCCGGCCCTGACTTGGCAGACTACCCATACACCACTGTGC
CCAACAAAGTTGGCCACCTCTTCACGGCCCAGCTCTTCCATGATCGAAAGCAACGCCAGGAACGCTTGAGCACCCCCAA
GGCTCAGCGTGCCAATGTGGCCAATATTGACTATCTACAACCCATCATCGCCGATGCCGATACT > SEQ ID NO:428 213048 *Trichoderma harzianum*
CATCCACGACAGCTTCGATAGCTTCGACAGGAGACGAAAATCATCATGAAGCTTACGCTGGGGATTGCCGCAGCATTTG
TGAGCTGCGCTGCAGCATCGCAGCCCGCCGCCGACGTTTACGTACTGGCGAATCGCGAATCCGCATCGCCGCCGTCCAT
TCCCAGCAGCGTTGCCCGACTCATCTTGCTGAAGCTGGCGGACTCCAGTTCCTTGTCCTTGGTCCGAGATATTCCTGAC
GACGTCCATGTATAACAGGTGGTCTCGTTGATGAATCGATATGGAGGCGTCACTACTCCATCGTTCGATGAGCTCGCTC
ATGAGCCTAAGCAGCTGTTCATTGCGCTTCAGGGCTTGACGGACGATCAAATGAAAGAGACCAGAGCGAAATGACAGCG
GAAGCCCTCATGCACTATCCCCGATGTGCCTCATATCGACCGTCTGCAATGGGCAACGGGCACTGAACCGCCTCCATCC
GACTTTGTAAAAGGAAAAGGGATCAGATGCTCTTATGATGAGATGACCAACCCAGTCGAGTCCCGCTGCTGGAACGGAA > SEQ ID NO:429 213052 *Trichoderma harzianum*
CCCACGCGTCCGGCACCAATTCCCAATTCGTGCTATATAATCTTCTATATCCCGATCGACACCACATCACATCCCGCCA
TGGCCGCTCCGACAGAAGCGCAGCTCGCGCATATCCAGCTCCTCGAACAGCTCGACATCCACTCCATCCACAAGAACTT
CCGCAACCCCAACTGGAAGCCCAACCAGCGCCGAAACAAGAACCTCAAGGCCATCGTAGGCGACGCGTCGAAACGAGAA
GCCTCTGCCCTTGCGACTCCACAAGACGTCAGCGGCGATGCGACCCCAGCCGCCGACGATGGCCTCTCGACCAGCGGCA
CCTCGACGCCGGCCACAAGCACCAATGGGAACCCGCCGCCGCCGAATCTTGCGCAGGCTTCGCGTAGTTTGTCGAAGCT
CGTGCTGGAAAAGACGTTGAAGCCGCCTGTGGGAGGGGCTGGAGCTGTGTCGGCACCAAACGCGACGTACACAAATATT
GAGTCGGCGCCTTCATTAGCACATTCGAAGCACTACTGCGATATTACGGGCCTTCCGGCGCCTTACTTGGATCCCAAGA
CCAGGCTGCGGTATCACAACAAGGAAGTGTTTGGGTTGATCAGAGCA > SEQ ID NO:430 213063 *Trichoderma harzianum*
ATTGAACGCACAGTAAAAGTGCCACTGGATAGGGACGAGGATGTTCAAATAGCCGACTCAGCAATTGCACTCAAAATGA
TGATTGACCAAGTGAGTAAGAACTGGTGAGTATAGCGAATTGAGAAAAATAAGACAAGGAGGGGGGCTATTAGGGACCA
TAACTGTCTCGTAAATTAAGAGTTGTCTAGCTAATACACTACGAATGTGTATGTAATGCAAAATTTGGATGAAAAAAAA
AAAACAA > SEQ ID NO:431 213084 *Trichoderma harzianum*
CCCACGCGTCCGCAAAACAACGTAAGCCCGGAGTTTATAATCGATCATCGTCAGGTTGTTCAAAGCCAAGATTTAGAAT
AATCACCTATGCGTGTAATTAGGACGGTTCAGAGAAGATGCGACCAACTCCAAGTCAGGTACAAATTTCAATGATGCAA
AGACTGGTATATATGGCCTTGTTGCGCAGAGCATGAAAGTTTCTGCCGGGTCGGTACCTAAA > SEQ ID NO:432 213112 *Trichoderma harzianum*
CCCACGCGTCCGATCTATTGGTTTGACGTGCTCGACGACAACTCAGATGTCATCATGACTGAGAAGGATATTGAGCTCA
ACCTCCAGACGATTGTGGACGATGCTACCCAGACCCCCATCCAGGATGCGGCAAAGAACGCCCTTGGCGTGCTCAGCAC
AGAGAACCGCAAGGTTTGGTCAAGATATCTCGTAAGCCTGGTTCCAACAATGCCGACTCGCTTAATATTGTCGACTCAG
CCCTCTTCGTCTTGTGCCTTGACTATATCGAACCGACCAATGTTGCGGATCTCTGCCAGAACATGCTCTGTGGAACCAG

FIG. 1 continued

TGAGGTCAAGAACGGAGTACAGATCGGTACCTGCACCAACCGTTGGTACGACAAGCTTCAGATCATTGTCTGTAAGAAC
GGCAGTGCTGGAATCAACTTTGAGCATACGGGCGTGGACGGCCACACAGTGCTCCGGTTCGCAAGTGACGTCTATACCG
ACACCATTCTTCGCTTCGCACGCACCATTAACGGACAGGCGCCGACCCTCTGGACCTCTACCAGGCCTGACCCGTCCAA
GCGAGAGATTGATAGTTTCGGAGACGTCAACACCACCCCTCGAAAGCTCGGGTGGGATATGA

> SEQ ID NO:433 213119 *Trichoderma harzianum*
CGCAAACGCACGCACTCGCGCACAAGGCAGGTGATAATCCAAATCTACCTACGCATAATAATCTTCAACAACCTGCATC
CAACGAAGCGAAACCCAAAAACAACATACATGAGTGTAACACCACCAAACGTCCCTCGCATCGAAGACAAGCAAAGCAA
TACGATGCCCTCACAACGTCCCTTCTTCCTCTCCTCCTTCTTCAACTCTTTCCGCCAGCAAGCGCCCTCCCTCACCCAG
CAGGCGGCCAGCAAACACACCTCGCAAGCTGCTGCATCTGCATCTGCCGTCGCCTCCACAACAGCCGCAGCAGCAGCAG
CAGCTTCTTCAACCGCCTCCACCGCCCGCGCAATCTCCACAAACGCTGCTACCACATCATCCACCAACGTCGCCATCCA
CACGCCTCGCGGATCTCCCGGCGGCGCCATCCCCATTCCTGGCGGGCGCAGAAGAGGCAGCGATAGCAGTAGTGAAGGC
TTTCGCGATGCCCTCGGCGCCGACAAGTGGTATATCGGCGGCAGGACGGCGACTGGAGAGGAGAAGTTCTTTAAGCTTG
GCGTGATACGCCGAGTAAGGAGTAATGATGGCCTGAGTCTCGATCGCCTAAGCTTATAGGTGATGACCACATCACTGAA
CGACTCGAGAATGACTGGTTTTGATTTTTTTCCCCCTCTCTCCTTCTCA > SEQ ID NO:434 213120 *Trichoderma harzianum*
GTTTGGCTTGCAGTAAGACCGGCTTATGAGAAAGACCATTGTGAGAGATGTAAGGCTGATCCGGAGCTCTACGTCATCT
GAGACATGACATTGGCATGATGAGGGTCCAGTAACTACCTGATGATTGGGGTAATCGAAAGAGATGCAGAGAGAAACAC
GCAACTCTGAGAAAGCGTCCCGTTACACACGGAACACACTGCCTCCGGACAGCGGCTTGTGGCTCATTGCTTGAGTCCC
TTAATCAGCAATCCCCAGGTTCTCTTGACAGCTCAGCGGTGCAGTTTTGCGGGCACAGCTGATCCACCCGTCAACGGGG
CGGGACGCCGGGAAGCCGGGACTCCGGGGCTAAAATGACATCGCCATGACATCCGCACCGTCCGACCAGAACTGCTACT
ACTCAAGACGGTAAGCAAGTGCTAGCAAAAGTGAGTTTTACGAGGTAAGCAAGTAGGAACGTGGCTTATAAAGCCACAG
CTAGCTTGAGGCGAAGGCTGCTAGTAGGAACTAAAGTCAGCTTATACTATTGATAAGCTCACTGCATGGGCTAGTAATA
ATAGCT > SEQ ID NO:435 213122 *Trichoderma harzianum*
GTCATGGAGAACGTCCTCTTCAAGGTCTCCTACCCTGCCGAGTTCCACTCCCAGACCGTGACCACTGCATCCAGTACAT
GGCCTCCGTCATGCTCGTCTTCGGCCGCCTCGAGGCCACCGACTACGTCGACGGCTCTGAGGCTGCTACTTCGGAGCTT
GTCGAGTCTCTGCGCAAGAAGATCAAGTGCGTTGAGGACCCCCAGTACACTCAGGACTACCATGACCCTGCCCTGCGAA
CCATCTCCAACGCCCTGACCGTTGAGCTCAACGACGGCACCGTCCTCGAGGAGGTCGCTGTTGAGGCTCCTCTGGGCCA
CCGTCTTCGTCGTGAGGAGGCCAAGCCCGTCATCCTGGCCAAGTACAAGCGCCACCTGGCTCCTCACTTCCCTGAGGCC
ACCGTCAACGAGCTCGTTGAGCTCAGCCAGGACAGCAAGAAGCTCGAGGCCATGACCGTGGACGAGTACGTTGACAAGT
ACGCTGTCAAGGAGAGCAAGTTTGTTGTTTAAATTGGGGTTGTGCAAAAGTAGAAGAAAATCCTGATGTACCTAGATGT
TTATGATGACGGTCATATAGACCAAACAAAAGTAGCATTATATTAATAAAAAAAA > SEQ ID NO:436 213123 *Trichoderma harzianum*
GCTGATCTACCAAATTTTAACAAAAGATTAAAGCTTACAAGTGCCTGATGCGATATTGACTCCTTACACATCTGTGCGG
CATTCCACACCGGATCACGTGACAATTCACGAGGAAATGTGCACGGAACCCCGATCCGTGAATGGACCTAAATAGATGC
AAATATGTATCCGTGCATGAGAGAATATCCCTGATAAATGCTGCAATAATAGCACGTGAAGAGGGCCATC > SEQ ID NO:437 213124 *Trichoderma harzianum*
ATCGTCCCTTCGGTTGCACGGTTTCAGATGGGAACTCGCGCCCACAGATACAAATCGCCGTATCCCATCGAACGTCAAA
CTCTACTGAGCTTATATCAATTAGTACTATGCCGTCTTCGAATATTTCCAGAAAAAGACATCTGCCTTTCTATAAAATC
AATTAGGAAAGAATAGCCAGTTCTTCACCATGGATGATGATGACAATCATGTAGCATGGCCTGTCATTACAGACGTCTC
CCCCGTCCAGTCCTATGCGGCTGCCCACAAGGAGTTTCATAAGCGGCTTCCCGGATGGATTTACAAGGGCCACCACATC
TTTGGTTGGGAGATGTACTATGCCTCATCCATAGTGCAATTCATGATGGTTGATCTCGTGTGTATCCTCTGCCGCGGGA
TGTACAATTTCTTGACTGGTCTGGGATGTGGTGG > SEQ ID NO:438 213126 *Trichoderma harzianum*
GTTCTGTGTCTTCTCACCTTTTTGCGTCAGCTCGACTTTCGTTTTGCACCGGTCGACCTTTTACCCTCTCTTCTCTTCT
ACTCTAGAGACATCGACCAGTTCGCTCGTTGTCAACCCCTCCGCCTGACGGAATCCCCACCGATAAACAGACAAACAA
ACAAAACAAATCCAAAAAAATCAGCCAGAAACAAGACACCATGGGTGCCGGTCGGTTTTTCTGCGTGGCTCTGCCGCTA
CTCCTCACAATTGCCTCCATCGGCACTCTGCTCTACGCAGTTCTCGCTGGCGTTGCCCACGAGAACGTCAAGCTCATCC

FIG. 1 continued

AGGTGGACCTCAGCAACCTGAGCATCAGCCCGCTGAGCTTAAAGACCCTCACCTCCCGAGCCGAATTCAATATGAAGGA
GACCCAGACGGATAACATCACCGCCGAAGCCCTCGGCCTCCACAAGTACTATGACCTCACGCTCTGGGGATCTTGCTCC
TCCGATGACAACAAGAAGTGGACTTGCACCAAGAGCCAGTTCGACTGGGCCAGCAAGCAGATCAATGCCGACGATATCA
AGGAGGGTAGCACCACTATCGAGTTGCCCAAGGATATCAAGGACGCCCTCAAGGT

> SEQ ID NO:439 213128 *Trichoderma harzianum*
CTCAAATAAACCACTCAATCGATTCCTTGATACCCCTTGGGACAAATCTACTTGTTCTCTCCAAACTTATCCCTCCAAA
TACCATCATCACCATCACCATGATCAAAGATGTTTCTACCAACGGGTCTTCTGCCGCTCCTGCTACCACCTTTGCCCTC
AAGGCTGGTCTCGCCCATATGCTCAAGGGCGGGGTCATCATGGACGTCACCAACGCCGAGCAGGCCCGCATCGTCGAAG
AAGCTGGTGCCTGCGCCGTCGTGGCCCTCGATCGAGTGCCCGCCGATATCCGCAAGGACGGCGGCGTCATCCGCATGTC
CGAGCCGGGTATGATCAAGGAGATCCAATACGCCGTCACCATCCCCGTCATG > SEQ ID NO:440 213131 *Trichoderma harzianum*
CCCACGCGTCCGCCGTGATGATAATAGTCGAAGACCAAATCTCTTCTACGGACATTGAGACGATATCAATGAGCCGAGA
CAAAATGGAAAAGCGGAAGCACTAACGATTCAACTCTTTCTTCTCCTTGGCGCTGCCCTAGTGTCCATCGGCGGACGA
TTATACGCCCGATGGCGGCAGGTCGGAATGAAGAATCTTGGTCTTGATGATGGGCTTGCCATTACAGGAGTGATTCTCT
TTGTGCCCAATGTGGTCTTGGCATACATGATGAACACGCGGACCCATTGGATGGGCAATCATTCTGTCGGCAACAATAC
TACAACACAGCCGAGCCATAACGAAGATCAAATGAGGGAACTGGGATCGAAACTCTATCTATACAGCTGGTTATCCTAT
TCCGCTGCATTATGGACGTTCAAGGCAGCCTTTCTCGCAAATGTCCTTCGTCGAATTCCCGAATCCGGCAGACGACAAA
CCCACCAGTATCTCGGCTTTGGCTTCCTGGCTGCAACATGGGTAGCAACGACGATGGCTCTCCTCCAAAGCTGTCGACC
GTTGCCCCACATGTGGCAGGTTTATCCCAGCCCAGGACTGTACTGCCAGCCTGCTACTTCACCGGTGCTGGCGTGGGTT
TACTTCAGCTTCGATATCGT > SEQ ID NO:441 213133 *Trichoderma harzianum*
CATAATACATAAAAGAATCAACCAGAGCTCGCGCGTGACCCCGGGGGTTTGGTCCACCATCTGACTGCTATGTACTGCT
ACTACTGCCCGGAGTGCGACTAACAGCCGCTCGTATTATCGCTACGCCTT > SEQ ID NO:442 213137 *Trichoderma harzianum*
CAACTTACAAATTACAACCTACAACTGCCCACAATGTCGCTTTCTGTTGGTGCTTCTCTGCGGCCTGCGGCCTTCCGCT
GCGTTGGTGCGTCTGCCGTGCGCATGCGATGTGCTTTTGGCACAACTGCGTCCAGAAGGAGTGAGAGCTCGACGCCGGG
CGAGCTTGGGGTTGGAGAGCTGCAGGGCGCATCGTTTCGCATTGAGCCTCTCCGGAGGGTTGGGGAGGATGCTTCGACT
ATGCGAGCGAGACTTTTATACCAATCTCGGAAGCGCGGAACCCTCGAGTCGGATCTTTTACTGTCTACGTTTGCCTCAC
AGAACCTGCCCACCATGACGGCCGAAGAACTGCGGCAGTACGACCTCTTCCTCGACGAGAACGACTGGGACATATACTA
CTGGGCGACGCAGCGGGAGCCGAATTCCACGACGAACCCTTCCGTGACGGCGAGTCCGGCGAGTGCTTCGGCGAGCGAA
GGGTTCGAGGCGAGACAGCAGGATGAGTTGCCCAAGAATCCGCCAAAGGGGGAGTGGGCGCAGACGGTGGGCAATTTTA
AGCCTGCGTATAGGCCGGTGCCGCAGAGGTGGAAGGATAGCGAGATTTTG > SEQ ID NO:443 213138 *Trichoderma harzianum*
GAAAAAAAAAAGTTGCGCCAGACGGGATGGAAGGCGAGACAAGGGGCTGGCTTGGGCTTTGGGCATGCACTGGGACTTT
GGGCTGAAGGTTGACCGAACCGAGTTGCTCAAACTGCGACATCGGTGCTGTATCAGGCTGCTATCTATGTATCCTCGTA
CAAGGCAAATGCACACACGGCTGATCTGAGATTACGGGGGGAAGAAACGCACTCAGTGGCCAATATGGTGGTTCGCAC
ACCCAGCGTTTGCTCTCCTATGTCGTTTGTATGGCGGGTATGCTCATGCTTGGGCTGAGGTGATGCGCGTCTGATTCCG
GCTAGCATACCGAACCCACTAGGTAGCGAGTTGATAGTATCGCCATTATATTGGATGTTGGATCG > SEQ ID NO:444 213144 *Trichoderma harzianum*
GATCACTCCACCACGAAGCACTTTTCAAAGCGAAGACCTACACGCATCTTCATTTTCAACCGCCAAAATGGGTATGATC
GACGCCAAGAACAGGGTGACGGAGCACCAGCGCTTTTACCAGGCTGCGTACAAGGCTCACACCCGCCTGTGGAAGATTA
ACCCCCGAAGCAACTGGTACATGGCCCCCTACCTCGTCGCCCTCTGGGGAGGTTTCGGAGCTACCCTTTACGCTGCCAG
CCGAAAGGTTGCCGGCCACAACACCTGGTTCAGCAAGGATTAAAGTATCGGTATCTATGGGACGAGCCAATTGAGTTAC
CCCAACTTGCGTCAAATGCAAGATTGAGGGTATGTATGAGTTTAAAGTCTTATAGACAGTAAATATAGGATTTGTCAGT
CCGTCTCATACGTCTCGCTGCT

FIG. 1 continued

> SEQ ID NO:445 213149 *Trichoderma harzianum*
TGAACTTTTCCTCCGGATCATCATACTGAGAATAACCAGTAGCCCGCAATATCCGCCTGGGGGCCTCATCTCGCTGCTC
TTACCGCGATCAAAGCCCAATGAAAATAATCCCGGTCTACCGCTACCGGGCCATCAGCGCAAGCGGATCTCCAGTCCCC
CATCAGTGCTGCCCGCTCGGAGGTTTACTGTTGGCGCAAACCGGGCCTGGTGTCGTCATCGAGCCAACTCCAAATCCAC
TTGGCCATATTGTGATAATGCGACTCTCGCCTCTGCTTGACCGTTTCTTGTTTGATCTCCCTG > SEQ ID NO:446 213169 *Trichoderma harzianum*
CCCACGCGTCCGCCCACGCGTCCGATCGGTGGGTTTCTTTGGGAGCGTTAATCGACCTTGCTCATTCTTCATACCATCG
GCGTCGTTGGCATTTATACGGCATCTCGTCTTGTTTCCTTCGTACTCGAGGTACGGTACCCTGACCG > SEQ ID NO:447 213171 *Trichoderma harzianum*
CCATGTACCTCTGGGATCCTTCACAAGGCGCAAAGCCGGTTGCACGGCTTCTGGGACACCAAAAGGCCATTAACCACGT
GACATTTTCCCCTGATGGCAGTCTCATCGCGAGTGCCGGATGGGACAATCATACCAAAATCTGGAGCGCAAGGGATGGC
AAATTCATCAACACACTCCGTGGCCATGTCGCGCCCATATACCAGTGTGCCTTTTCTGCCGATAGTCGGCTCCTTGTGA
CGGCATCCAAAGATACCACATTGAAAGTGTGGTCGATGGCTACGTGTAAGCTGGCCGTTGATCTACCGGGACACCAAGA
TGAAGTTTTTGCCGTATGTTTGCCCCCTTGCCCTTCCAATTTTGTTAACCCCCGAGCCTGTGGCTGACAGCGTGCTAGG
TTGATTGGAGTCCTGATGGACAACGAGTAGGCAGCGGAGGAAAAGACAAGGCCGTACGCCTTTGGATGAACTGATGACG
ATGATGGGAGCGAATCAAAAAAGGATACATCATGTGTGTCATCGGCGTCCAGTCAGGGATTGATTACGTGTATGTTCTA
GGTCTAGACTCTGTACAGCTGTATGTGCAGCATCCGCTAATGATAGAGAGCAAATGTGGCATTTGCCCAAGGGCACGGC
TGATGCAATT > SEQ ID NO:448 213177 *Trichoderma harzianum*
GAAAAGAGCAGCCAGAGGACAGCCTCTGGGGCATTCAACGTGATACCACTTTGGATGTAACTCGTCGCCCCCGTTGCCG
GCCGATACGTCTCTTCTTCTCGACTCGCCTCTCTCCGTCCACTGCATTATCATTGACCCCCCTTACCTGCATGTGCTCC
CGCCTTGCTACTCCGCATACTTCTCATCACTTTACACCCCACCAATACCCGGGTACATGACTATTATTTCAATCAGGCC
GTTCTTTTCCTCCATCTCTTTAGGGACAATGTCCTTTTACTTGGAGGAGGGCTCTTGCAGCGCCAGTTTTCTAACCTTT
GTCTTTTAGCTGACTCCGGCGATAACTACCGACCGCGTGAGAGGTCTCGATCACCTCGGCGACGATCTATGAGTCCAGG
CCGACAGTCTCGTCGGAGGTCTTATTCGCCTCGCAGCAGATCAAATAGTCGGGACGACTATCGACGGGCCGCGATCGC
TCCCCAATGACTGGAACAGGAGCTGCACCAGCCGGTGGTCCCACTGGCAATTATGCGGGACAGCAATCCCATCGATCAT
A > SEQ ID NO:449 213179 *Trichoderma harzianum*
CGCCCCTCCTTCATACGATGATACTCCCGGTCCTGGCGTCCCCACGCGCTCTCCGGCTCCGGCTGGGAAGCCCGTTTTG
GCCCATGCGAGAGCCTTGTACCGCTACGATGCCAGCGATGCCCGCGACCTGAGCCTGGAAAAGGACGATAAGATCGATG
TCTACGAATACATGAACCAGGACTGGTGGATGGGCCGTAACCACCGCACTGGCATGGAGGGCATCTTCCCCCAAAACTA
CGTTTTTGTCGAGCAGGAGCAAAAGGCTCCTATGCCAGCTCCCGTGGCCTACCCCCAGCAGTCGGCATATGGCTACCCG
CAGGGACCTCCGGCGCAGCAGAACCCTTACAATGCCAGTGTGCCACCTATGGCGATAGCAGAGGGCGGCCAGCCGTCTC
AACAGCAAGGCGGAGATGGAAACAGCAAGGTTGGCGAGTACGGAAAGAAGTCTGGCAAGAAGCTTGGTAACGCCGCCAT
CTTCGGTGCGGGTGCATCGATTGGTAGCAACATCGTGAACAGCATCTTCTGAGGGCAATACGCGATCTTCTTCGGCCTC
TATTTTGCTGGCTCTGTTTTATTTTATTGAACTTTCAAGTTTGGCGTCTGGAATGGGTTTGAGGCATCACCTACAGTTC
TCGAAAT > SEQ ID NO:450 213206 *Trichoderma harzianum*
CATACCCAACACACAACACAGTCATCATGGAGGTTCTTCTGGGAATTACAGGCAAGGACTTTACTCTCATCGGCGCCTC
CAAAGCTGCCATGAGGGGAGCCACCATCCTCAAGGCATCCGACGACAAGACAAGAGCGTTGAACAAGCACACTCTGCTG
GCTTTCTCTGGAGAAGCTGGCGATACAGTACAAtTCGCCGAATACATCCAACGAAATGCCCAACTCTACTCCATGCGCA
ACGAGACCGAGCTGTCACCCTCTGGCCTCGCcCACTTCGTCCGAGGAGAACTCGCCaccAGCCTCCGATCCCGAAACcC
ATACAACGTAAATCTCCTCATGGGAGGAGTTGACCCCATTACCGGCAAGCCCTCTCTATACTGGCTGGACTACCTAGCG
TCTCTGGCGGAGGTACCGTACGCAGCACACGGCTATGCGCAATACTACTGCCTGTCTCTCCTTgacAAGCACCACcaCC
CAGACATTACACTAGGACAGGGAATCAAGCTCATGACGATGTGCATAGAtgagCTGAAGCGTCGACTACCGATCGACTT
caagggaaTGGTGgTca > SEQ ID NO:451 213208 *Trichoderma harzianum*

FIG. 1 continued

```
TCTTGTTCATCTTGCTACCGCTCACAAATCACCAGCCAAGCGGAGACTTAACAAGGGCTTATGTACATGTAGGATTGGG
CCGTGTCCGGGAATTACCTGTTAGGTACTAAGGCATGTAAGAGATGATGCAATCACAAAGCAAAACCCTTTTGATGGTA
TCAAAGTAAGGCATCAACATCAATTAATGTCTCCGAAACTACATGCAATCCGTAGCTCCAAGCCCCTCTCATTCTTCAA
CTTATCATCATCTTTACTCCTTTTATACAAACCGGAGCCCACAAGCCTTGCCGATTCTAACTAAACTAAACCCTCACTC
CCCGCTTCCAAACTACCGGCGACTTTACAACCAACAAATCTTCACCATGAGTGCCTCACAGCAACACGACGAGGAGTCC
AAAGCCCTCGCCTCAATCATCCCAACCTTCACTCCTTCCGAATCTTCCGAATCCACTGCCGTCAAATCAATCATCAGCT
CCCTCTCCCTCATCGAGCACGTCGAAGGAGGCTATTTCGCAGTCACAGACGTCAGCAACATCAAGATCCCTTCCCCGTA
CCCAGCCACGCCCCTCTCACAGCGCACCATCGACCTCGTCAATGGCCTCCCCGAAGATTTCGACTACG

> SEQ ID NO:452 213226 Trichoderma harzianum
acaacctcagctgcaagcttaccgccccgggGCAAGCCTTTCGCATCGATCTCTAATATCGTTCCGTCTCGCCGACGA
AGCTTCTACTCAACCAAAGCATCATCGTCCCATCATCACAATGGCGGAAGCAAAGCCTGCGTCCCAGAAGATCTGGTTG
GTCTCCAACGACAACGCGACCATGGAAGTCGACCGTGCCGTGGTTGAGCGATCCATGCTCTTGAAGAACATGTTGGAGG
ATCTGGGCGGTGCCGACGTCAGCCCTGAGAACCCGATTCCCATCCCCAACGTCAACGAAGCAGTGCTGCGAAAGGTGGT
CGAGTGGTGCGAGCACCACCGCAACGACCCCGTCGCCGCTCCCGATGACGAGTCGGATGCCCGCAAGAAGACCACTGAT
ATCGAGGAGTGGGACCAGAAGTTTATGCAGGTCGACCAAGAAATGCTTTTCGAGATCATCTTGGCCTCAAACTTCCTCG
ACATTAAGCCGCTCTTGGATGTGGGCTGTAAGACTGTGGCCAACATGATCAAGGGCAAGTCCCCCGAAGAGATCCGCAA
GACATTCAACATCACAAACGATTTCTCAGCCGAGGAGGAGGAGCAGATCcgccgTGAGAACGAATGGGCCGaggaccga
taaATAATGGTCTACTATGGGTGTCTCTTAAcTcTTCCTCTTTttttcAgtggagAGcagcagCgtgaa > SEQ ID NO:453 213237 Trichoderma harzianum
GCGTTTTGCATTGGCCAATATAGCCTGGAACTTTATTTTGGGGCAAAAGCAAGAAGCCTGGAACAAGCTTGTTGTGTTT
GTTAGCGACCAAAAAAAAGGTACCTGCGACTACAACTGAGGGTCCCCCAGTGGCTGAACGACGACTTACACCCGTTGGC
AGCAGAGCTTTTGTCTTTTCACCACAACAATTTTGACATTCGTCTATACAAAACTTGCACGGTTTCTTTCACCTGGCAG
GTAGCATCTCGACATTCACCATGTCCAAACTCCAGATTTGGGCCTCGTGGCCCGAAGCCCACCTCTTCAACTTCCCTCC
TGCCAACCCTCCGGCCCCAATCCCACCGGCACATGTCCCTGCCACTATTCTGAGGCCCTTCAACATCCCAGATGATCTC
TATGTGTCTGCTCTGGATGCTCGAGTTCCGTTGACGATTGCTGCTCTTTATGCCATCTCGGCCAAGCTGCTCAACAAGT
ACAACAAGGCGCGCAACAAGAAGCCCTGGGGCATCAGCAAAACACGCCCCTTCTTCGTCTTTGTCGTCCTGCACAACAT
CTTCCTCGCCGTCTactCTGCCtggaccTTCTggGG > SEQ ID NO:454 213242 Trichoderma harzianum
AAGAAACACAAACAAGCAAATCAATTCCCGAGCAAGAAAAAAAGAAGAAGCCCATCATGAAGATGCTTTCGTTTGCCGC
CCTCTCGGTGCTCGTGTTGGGCGCTTCGGCCCTGGCTGCGCCGCCGGCCCACCCCCCGGCCGACAATGGGTGCTGCTGC
TGCGACATCAACAAGAAGAGAATCGACTGCGACAGGTCGATCCCGGCGTCGGAGTGCATCTGCCCCCAGGTCATCTGCC
CCGCCGGCGCGCCCACGTTCACGCACGCACGCCGCCGAAAGCCACCCCACCGCCCACGCCGCTGCCGACTTACAAGCA
GTGCTGCTGCTGCAATCCCAACATTAACAAGATTGTGTCTCGCTGAGGCTCGTGGAGGACTGTATCTGCTTGGCCGTG
ATGTGTCCGACGGATGCAAAGACCATCTTTGTCAGGCCAACTGGCGTTCCGACTGTCGCTTAAGAGTATTCGTTGGCGA
GCCGACTTGCCTGAATCCTGGACCGGGGACATGACATGGGGGAGGGAAAATACAGGCAAGGCATTGCTGATGGTGAA
TGCACAACACGCGTGgcaGACTGGCCGAAAATTGATGATTTACTGAtgggcgACtttggactTgaaatgGGGcATg > SEQ ID NO:455 213243 Trichoderma harzianum
AAGCATTCGCCTCTCGTTCAGATCTCAAGACAAAAAGCACTCAAACCAATCACTCAACCTCTTCAAGACCACCTTTCAA
AACAAACCTTCAACATGAAGTTCACCGCCGTTGCCTTTGCCGCCCTCGCTACTCTGGCTACAGCCAGCCCTCACCCTCC
TCCTCCTCACGGTTGCAAGCCTGCTACCTACTCTTGCCTTCCCAACGACAGCGGTTGGCAAGTGTGCAGCACTGCCGGT
CAGTGGGTGTTTGCTGGCACCTGCCCTCCCAAGACTGTCTGCAAGTTCGACAGCCAAAATGGCAGCCCCTACTGCGTTC
CCCCCAACTTCACCATCCCATAAATCCATTAAATGGGGATCAACGGGGCTACTTACAAAAGCCTACCGGATGAGCATGA
GATTTAGAGTTTTTGGTTGCTAAGACGTTTCGTGGCCTGTCATTGTCTTGCAGATCAATCCTGGACATAAAGTTTACAC
ATAACATATGGTACACTCCTTTGAATGCGATGTATCTCTATAGCTATATGAATACAATAAATTGAAGcagaaaAAAAaa
ccgaAAAAAa > SEQ ID NO:456 213246 Trichoderma harzianum
cgaccacgcgtcgaccatctcgaaaaccccccttctgacatttTGTGCTGAGGAGGTGTAATTACTATTGATAATTATT
TGATTGGAGTCTTCATTTTTTTTTTTGGAATAACGAGATACGAAGTGACTGCGCTCTCCCCCCTTTATCTACCTATCC
ATCTTTGATATCCGAGTAAAATCTACACACACACACACAACACACAAAACCATGTCCAGCAACCCGCCCATCCACTC
```

FIG. 1 continued

```
CGGCGCCGACGCGGCCCAAACCGCCTCAACCTGCGCAAGTCTCAACATCACCACCGCCGAGTTCGCCGAGCTGCAGCGC
CGCGCCACGGCGGCAAAGGCCACCGCGTACTGCCGCTACAGCCGGTTCCGCGTGGGCGCGACGCTGCTCTGCGCCGACG
ACGCCGGCGAGACGGTTTATGTGGCCGGGGCCAACGTGGAGAACGCGTCGTATCCCGTCGGGACGTGCGCCGAGAGGGT
GGCCTTTGGGACGGCGGTGAcgaGCGGGATTAGGAACTTTCGGGCGATTGCTGTGGCGACGGATATTAGTCCGCCGGCG
AGCCCTTGCGGGATGTGCAGGCAGTTCATCCGCgagatttgctcCCTgcaGACTCccgtCATCATGTTTGACAaAaact
CcgACTACGTtgtCATga > SEQ ID NO:457 213257 Trichoderma harzianum
ctcgaccacgcgggcgacatattaaagccccagcaggccaagtcatcGACAGCGTCCCTCGCGCATCTGCCAGACTTCG
GAAGCTTCGCACGAGCACCAGAAACCACTCCTCCCTACGCCTCTTTAAAATCTTTATCGCTTCGATAACCCATCGTCGT
CACAATGGCCACCGAACTTTGCCCCGTCTACGCGCCCTTCTTTGGTGCCATGGGCTgCACCTGCGCCATCGTCTTCACC
TGCCTGGGTGCCTCATACGGTACTGCCAAGTCTGGTGTTGGTATTGCCGCCATGGGTGTCCTCCGCCCTGACCTTATCG
TCAAGAACATTGTCCCCGTTATTATGGCTGGTATCATTGGTATTTACGGCCTCGTCGTTTCCGTCCTGATCTCCGATGG
TCTCAAGCAGGACCTCCCTCTCTACACTGGCTTCATTCAGTTTGGTGCTGGTCTCTCTGTCGGTCTCGCTGGTCTCGCT
GCTGGTTTTGCCATCGGTATTGTTGGTGATGCTGGTGTCCGAGGAACTGCCCAACAGCCCGTCTCTTCGTCGGAATGA
TTCTGATTCTTATTTTTgCTGAAGTCttgggTCTTTACGGTCTCAttgttgCTCTGTtgat > SEQ ID NO:458 213260 Trichoderma harzianum
AAAACCCCACGATATACCCCGCGTCATCGCTTGTATTGCCGAGCTGTACCAGTGCTAGCCGTTGCCTCACTACAGCTCT
ACCCGTCTTCTCCAAATAGAATCCCCCAACTCTTTATCTCAACCTCAATTCGATTCATTTCTGTCCAATTGCCTCTCAT
AACACCCGCGTCGCCGagaTCTACATCCAGGGACACGGAATTTCACCACTACCAGCAAGCTCCTCTGCTGTATAACTAA
AAGcAAGCTTCCCCCGAattacATCATCGCCTCAAACCGccaCCATGAGCGCAGACACGGGCGAAAAAgTctataccCA
CATCATCACactCACGCGCTTCCTCACCGaaGAGCAGATtaagcACAAagaagcCACTGGTgatttCACAttGCTCTGC
CATGCTCTCCAATACTCCTTCaaGTCCAtcgccTACTagaTCCgtcGCGCCaCCCTCGTcaagcTGACGGGTCTGGCCG
GTTCCTCCAACACCACCGGtgAcgatcagaataagCTCGACgTCATCTCCAACgacCTCTTCATCGAGGCCATGCGCTC
CTGCCGgcaaagt > SEQ ID NO:459 213279 Trichoderma harzianum
ATCATCAGCTACAAAGACATCTACTCATCtacACACACAAACAAACATTCAAAAAGCATCATCACACAAAGCTTCCAAAGC
TCCAGCTTCTCAACAATCCACTATTCTCTACACTTCAAACCACAACAACCACAACCAAAACCTTCAAAATGTTCGTCGG
TGACCTCGTCCACTTCCGCGCGTGCTCTCAGCAACGGCATCACCCACGAGATGATTCTCTGCCCCTCAGCCGCCACTTCT
CCCGCCACCTCCGCCGCAAACACCCCAGACAACCGCTCCCTCGCCTCGGAGAAGAAGAAGAAGCGTTTCTCCTCTTTCT
TCTCCCGCCCTCGCCCTTCTGTCAAGGCCGCCAACGTCGGTGCTGGCATGAAGCTGCCCATGAACATTGCCTAAATAAA
ACCAATCTTTCACACCAACAAAACAACTACAACAATGTGCTCCTGAACTGCGGATATAAAGAGGAATGGATGAACCGGT
CTATGCCCAGCACGATGGAATAAAATACACAAAACACACAAACACAAAAAACACACTCCTTTAAGAGACGACGAccAAC
GAAACAACAACACCTa > SEQ ID NO:460 213287 Trichoderma harzianum
GCCAATCGGGAACAAAAAAGGGCTGCGCGTTCTTTTGCCTCTCCTGACTCCTTACAGATGGGTGGCATTGCTAAGGTA
CAGTGTGGAGTCTGCAGTGGATTCGAgaGCTGCGATTTCAGTTGTTTGGACCTGGACGGAGAATTTTACGGAGCAGCTC
ACCCTTGATGCAGTTTAGGTAGGCGGTGTCTCTTGTTGGCGTGTTTTATAAGAGCAACTTTGCTGGTGGTAATAATGAT
GTCCATGCTATTTTCGTATTTCTGGAATAGGTACCTGGTATGGCAAAGAGAATagaATGATGGTGAATGagaTTACACA
GTTCGAAacaAAAactacgg > SEQ ID NO:461 213315 Trichoderma harzianum
aaggggaaGTAATACCATGGCATCGCtAAACATGCACAGAGCAGCGTCGCGATTCGTCGCCGCTTCAATCTCGAGGCCA
CTGCCGGCATGTCGAATCGCAGTAGCCTCTCAGCGGCATCTCAGCACCGGCATGCGGATCCCAGTCATTGCCGCATCAC
GGCCTCACGCAAGGAAGACACAGCGCCCTATTCCGAGCGGCGTACGGACAATCTTCATCCAGACTGAAAATACACCAAA
CCCGGATGCCCTCAAATTCTTACCGAACCACCgcaTCATCCCGCCAGACATGAGCACCCCGTTTATAGAGTATCTCAAC
CCGCGAGCTACgATTTCTCCGCCGCATCCCTCGCCCTTGGCTGCGAAGCTCATGAACATTGACGGCATTACCTCAGTCT
TCTACGGAGCCGACTTTATCACTGTAACCAAGGCTGGAGATGCCAACTGGGCTCATGTGCGACCCGaGATCTTTGCTCT
CATAACCGAGgctATCACTTCCGGCgAgacTATAGTCAATgtcGCGGAGcGCAAggGGGATGAGTCCGCGgCtgtGgaa
gaagaCagtcctggctTACAaCGAAAAcgacAGTgaggtggtgggcatGatcaagGAG
```

FIG. 1 continued

> SEQ ID NO:462 213318 Trichoderma harzianum
ACTCTCTCCACAACGccGGAACTCCTGcTAATTGACAATCTctaccCCAATTGCTGCGTCCTGCCGGCGCTACAGATTG
TTGCCCAGCATGCACAgctCCTTCACCCGTCTCCAgaATGTCTTTGGCTTCTTCACCACAGTTGCCTTCGTCCTGGGCG
CAttcATCGCTGCCACAGATCTAggCTCTACTCGCTCTCCCAgcgGTGTCATTaagacGGACAAtaTTcaagTCGTcaA
GGGCCGACCCCATTACTACTCTTCGAAAAAGGaagattATGCCATCATCCgCTTCTCTCTataggCCgaccTCTCCTCC
CTCTTCagaTGGAACACaAagcacCTTtttgTATACGTAACGgtagactGGACcggtcCCGgtaATagcaaCAactCcG
CTGTCATCTGGGACagtaTCATCACCAACCCCAGTGCCGACCACTTaCagaACATtggacCCgtgGCCATgaagaatcT
CaacAGAagcGCCGAaggcaagagcattgCgcCTGagCGAGGAATACTCA > SEQ ID NO:463 213330 Trichoderma harzianum
gctccttctaccaatttaagagagcggagactttatgttgttggcggtgaatggctcaacatcgaagctctaggcgccg
gAGGTATTGCTCCTGTTGCAAGCTTGGCCGCAAATGGGAAAACTTTTATGCCGGGCTGTTTTTTTCCGGTTTGTCAATG
GGGCCGTGCGATTACCTAAGATGAGGCAGAGCAGCGGCGGCTTCgagTTTGAATTTACAAGAAACATGGATTGTGCTCG
GAGTACGCCGTGGTATGTAGGATGGTCTGTGGCTGAGGTCGTCCAGCTTCAGGTGTTTATATATGGCTTTACCGGCAGA
TTTCACAAGCTCAATCGACTTTTGGAAAGTGTGTTTCAGGCTATTCTTGAACTTTATACTCGACGTATAAGTCTGGCTA
AGAGATTTTGCTATTTCCTATATCATTATCATAACATGGGCATATATGGGTCAATGGATGGTAAATGAAATTtgATttg
TACGGGATAAATAACAGACACCGTCCATACGAAATAACGCTATTCATtggcttaacacctt TCGAAaa > SEQ ID NO:464 213333 Trichoderma harzianum
ACAGTAGTAggTGAGTATGATGATACACTGGGTCAAACGGATGTTGTTAACACTACTTACCTGTAGTGGCGCTTGCTTT
TTACTTACTTGCAGATATTGTGGTTAAGCAGAATCCCAACTCTCCAGTGCAAGACACTCTGTCAGGTTCAAGCCCAATT
TCCTTCCGCTGCTCATTGGCAAACTCACGAAGCTCGCCACGAATCTCATTTACCACGTCCCACATATGCACTACAGATT
CGTAAGTCCGATTGTAGATACGATCAGCGCAAAGCGATACAATCTTCATTAGCTTCACCAAGGCCGCCATCATCTTGTC
ATCTGTGGGAACAGGTATATCCAAGCCGAGCTCGGACATAGaCGTCTGGCGCCCAAGAATAAAGCAAACCCATCTTGGC
ACACCAGTCAAGtTAGTTATTTCATCAAGATAAAAAGACATTGaggGgCACTCACACTTCc > SEQ ID NO:465 213340 Trichoderma harzianum
ttgccCAGCCAGAGGCCCTTCCTCGCGTCACGAGACACGGCCGCCTCCTCAACACGATGCCGTACCCAAGCCGATGGCC
CCACCGCAGGTTGAAGCTCAGTCGCCTTCTCCAACAACCTCCTCAGTTCCTCCATCTCCCAAAGCCGCCGAGACCGATG
CGCAAAAGACACAGCCTGCTCCCGCTGCTCGACCTCGTTCCAAGCTTCGCGCGCGCAAGGccGCAATGAAGCTCACACC
CGCCGCCGTGGAGCAGCTGCGCGCACTGCTCAACCAGCCCGACCCGAAGCTCATCAAGGTCGGTGTGCGGAACCGAGGC
TGCAGTGGGCTCGCATACCAGCTGGAATACGTCGATAAGCCGGGCGCTTTCGATGAACTGGTGGAGCAAGACGgcgTCA
AGgTCTTGATTGACAGCAAGGCACTCTTCAGCATCATTGGCAGCgAAATGGACTGGGCGGAagaTAAACTGAGTCAGAA
GTTTgtgTTTAAGaACCCTAATATTaaggagCaaTGcgGCTGCGGAgagtcATTTATGGTCTAAGGAGCTTGTGaaGCt
Ac > SEQ ID NO:466 213354 Trichoderma harzianum
gaccacgcgtccgggagtttgttcgtttatttcgttctccctaagatgttgcggatcatgatgtagttgctctccaagt
aTACATAAGATAGCCATAAACATAGCCACAGCAGCGCCCAACAACAACTGTGACCAAGGGTGGGTGGAAGTCTGGCTTC
CAGCACAGTACTTTGCATGATAGAGTCATGACAATGTCATGAAAAGAGAATTGTATGTACATGTCTTATATTTCCTGAT
ACAGTTGGGCACGGAGCGCGTGTGACGAAGGTAGGTGATGGTTGCTAGGTATAGGTAGGTTGGGATTGAAGTCACATG
CTTCATCCTCACTTGTATGAAACCCGTTTCTCAGCCCATACCaGCATatttgAACCAGTTGGGACGGCAATCTTCTCGG
TGGAGGAACGGCTCACCATCCGTCAGTCGACCAGTAACACAgcccttgcatttggGAGAGTTGGGgcagttgaagaagG
GgatgtgcttggtagccaatatcaCGGAACCaGTG > SEQ ID NO:467 213363 Trichoderma harzianum
agaacaacagacgAGGAATTGCTGTGGTTGTATAAGTTGAAGAGTAGCGGTATGTTTAAGCACCACCAAGTGGTCAGAT
GAAAATTAAGCGCTTCGGTACTTGGCCTGCCAGAGTTCAGTTGAGAGTGAAGATGCTCCGTTTGATCCATAATTGACAT
CAGCCCCGAGGGCCTTTCTTTGAGGGTGGAGCGGCATCCCTGTtgGACTGTGGAACCGATATTGTGGGCGGCCTTGAag
AGCACAAAGCTCTCGTGACGATGCTGTCTGTAGCTCGAAAA > SEQ ID NO:468 213369 Trichoderma harzianum
ACTTTGTGTACCTCGAGATCGGGTATAAAGTTACCTCGGGGCGCCTCTTAGTGCTGGCGTTCGTGGCTTGTCTGCTAAC
AATCAGGTTATATCCAGAGCTTGGGCACCAGAGCTCTTCTTACACTGCCAATCTCTGCATCATCTCGTAAACAGAGTAT

FIG. 1 continued

```
ACAATTCTGGATACAATTTTTCTTCGCTCCATGGGGTCTCAAGTCCAAGAAGAGCTGACAGTGCTCGTCACTGGATTTC
AGCCTTTCCGGCCAGAATATCCAATCAACCCGTCATGGGAAATCGCGAGAGCCCTCCCAGAATACCTCCCTCCGCTAAG
GGCCAAGGACCCAAACTCTCGAAATGCCGTCGACATCCCGCCTGTGCGCATTCTGGTGCACCCCGACCCCATCCGAGTC
AACTACAAGGTGGTGAGGGAGCTTGTGCCAACACTGTGGGAGGAGACGTACGCGGGCCGCAAGATTGACGTCGTCATTC
ACATGGGCATGGCAGGGCCGCGGCTCATGTATCAGATCGAGAGCCGAGGACATCGTACGGGTTACAAGTCTCTCGATGT
TGACGGGAAGCACCTTGAcGAGCTCGATGGGAAACGGGACGAAGAGTGGAtctggCATGGCCTCCCGGATGTGCTGA > SEQ ID NO:469 213377 Trichoderma harzianum
agtctgccctccaataaacgcttctgcccctcgagtccagactctctgttctgccactggctctggctctggctctaa
gCGATCTCCGCCCCGGTCCGTCCAAGCTTGCCCCCCGAAGATGACGGCCGATGCCATCTCCGGCTCCGGGCCCGCATCC
GGCTCTCCCCAGCCTCTCCGGCTGCTCATCCTCGAGGCCGATACGCCGCAGCCCATCACAAACGCCAAATATGGTGGTT
ACCGCGGAGTCTTCACTGCTCTGTTGACGGCGGCGGCGGAAATCATGGTTCCGCCACGGCAGCTCTCCGACGTGGCCAC
AATCACGGCGCACAACATTGTGGAAGACATGCAGTCATACCCGCCGCTGGACGACGTCGACGCCGTTCTAATTACTGGC
TCGCGTCACACGGCATATGAGGATGACCCCTGgaTCCTGAAGCTGGTGGAGTATGCAAGGCAGGCCATCGACACCGGTC
GCATCAAGGTCGTGGGCGTGTGCTTTGGCCACCAAATCATTGGCAGGGCCATGGGTGCGCGGCTCGGCaggagtgaT > SEQ ID NO:470 213387 Contig A Trichoderma harzianum
GGGGGGGGGGGGATGATATCCCGGGTGTATTTGTACTAGCTATCAAACCAAAAACTCTTTCTGTCATCTAAAAAAGAAGA
GAGAACAGAGATGCTATGCTCATTGCTATATGCGAAACAATCTATATCAGGGGGGGGAAATAATACGCCAAA > SEQ ID NO:471 213387 Contig B Trichoderma harzianum
GTGGGGGGGGATGACATCCCGGGTGTATGGGGACTAGCTATCAAACCACAAACTCTTTCTGTCATCTAAAAAAGAAGAG
AGAACATACCATGCTATGCTCATTGCGATATGCGAAACAATCTATATCACGGGGGGGAAATAATACGCCAAAACCGTCA
ACTCCAACTCATGTGCCA > SEQ ID NO:472 213388 Contig A Trichoderma harzianum
ATTATTACTCGACCACGCGTCGGCTCATGTAGTCCCTGTATCTAATGTACTAAGGACGTGTACTACTGCACCTGTGAAT
GGGGGCCTGCTTTGTGCTCTGGCTACCTTAGTGAATGATATCTGACTTTTGTTATTTGATTTAAATTGATTCATGTCTC
GATTTGCATTTCTAGAGAAGCCACAGGCAAAGGCGACAAGCC > SEQ ID NO:473 213388 Contig B Trichoderma harzianum
TGTGAATGGGGGCCTGCTTTGTGCTCTGGCTACCCTACTGAATGATATCTGACTTCTGTTATTTGATTTAAA > SEQ ID NO:474 213396 Trichoderma harzianum
ggatTAGGTTTCTTTCATTCTTTCTTTCTCCCTTCCTCTGCCGAGCTCGACGAATACCCGCCTCGAACCGAATGACGCT
GGCAATATCCCGTTCTTGATTCCGTTGCCTCTTTGTCCTCCGTTGTGCCCCGCAAAACCTGCCCAACGCGCTTCCTCAT
CATCCGTGCTTCGCGATTTTCTACCATCGACGCCTGAGGAGACATAATTTCACCCAAGATGAAATCCATGAAGGGCCTT
TCTATGAATAAGATGCTGGGGAGCATCAGGAAAAAGACCAGTAGCACAGATCGTTCAGCTGCCACGACACCAGGGGACA
CCCCCGAAGTAACGGCCCATAACAGCGTGAAAGCATTTTGCGAATCTGGCGGAACCGCAAAGAGCGAGGAAGTGCTTTT
CCTCCCCCCGATTGTCGATGCCGCCGAGTCTTCACCCACCGCCGCTGCCGAATGCGCACGCATCATCAGGAAATACATG
TCCAAGGAGTATTCCTCGCGGCCGTCATGGCAGTACAACGCCATTATGCTGATGCGGATACTGgccgACAACCCTGGCG
AGACGTTTACGAGgaaccctcgacaCCAAGTTTGTagacaccacgcGGGCGCTGCtc > SEQ ID NO:475 213728 Trichoderma harzianum
GGGCGTTTGTGGTTGACAGAGGGAGAGGCTGTGTTTGGTTGAAGGAGGAGAAGAAGAAGAAGAAGATGTGAAGAGGAAA
TGCCGAAAAGAAGGATGAAAGATATGTTCTTGTCTCGAGCTCTTTCCAATTGCTCTGGCCTTGTGCATACCATACAGAG
GCAGGCAGTCGCAAGACCAAATAACGAGGCAATTTGCAATGC > SEQ ID NO:476 213734 Trichoderma harzianum
GTCCTCTCATCTCGTCCCAATCAACTCCGTCTGCCTCTCTCGCCCGCATCAACAACATTGCGAGCCACATCTCTCCCAC
AATGGCTTCCACCACCAGTTTCCCGGCAGAAACGGTGCCCCAGGCGCCTGAAGATCCCCTCTTTGGCCTGGCCCGCGCC
TACAAGGCTGACAACAGCCCGCTAAAGGTCGACCTGGGAATCGGCGCCTACCGAGATAACAATGCGAAGCCATGGGTTC
TTCCTGTGGTAAAGAAGGCTGATGAGATTCTCCGAAACAACCCCGAACTGAACCACGAGTATGCCCCGATTGCAGGTAT
CGAGAGCTTCACCAGCAAGGCTGCGGAGCTGATGCTCGGCGCCGATTCGCCCGCTCTCGCGGAGCGCCGCACTACGTCT
```

FIG. 1 continued

ATGCAGACCATCTCGGGAACCGGTGCCGTTCACTTGGGAGCTCTGTTCCTCGCCAAGTTTTACAAAGGCAGCCAGACCG
TCTATGTGTCAAATCCCACATGGGCAAACCACCATCAGATCT

> SEQ ID NO:477 213738 *Trichoderma harzianum*
CCGCTGCTCTGCAACAGCTGAAGAGAGGTAGTCGTACGGCGCGCCAAGCTGCGCCTGAATGTCACCCGCGGGCGTGGCA
CCATGACGTCCCGTAGAGGCGATCTGCTGTCATACAACCACGTCTCCGAAAATAGCACCCTCTCGGGGCGTCTTGTCCC
GAAATGTGCCGTCAGCCGCTCTGACACTGCGTCGACAATATCTGTCAATTGTTTGTCTTCGTCGCGGAGGGCCGCCGAG
TCGCGACTCAGCTGGACTCGCTGAGCAATCACAGTCGTCCGCATCACCTTGCTTTGGCTGCTATATTTGGTGTGCAGCG
TCATGCCAGCGCTCTCTGCGTCTGCTTGCAGCTGCTCCAGGCGCGAGAGCGTCTCTTCTAGGAAGCTCAATAAAGCGGC
ATCTTGTTCCTTGGTCGAC > SEQ ID NO:478 213742 *Trichoderma harzianum*
AGCTGTAAAATCACAACTCATAAACAGATCTCGTCCTTTACATCTTATTCTCTTCAAGCTCATCACAGCATCGTATCAT
CATAGTCAACATGTCTCTCCAATACTTCCCTTCCGTCAAACCCTCCGCCATCGCCCTCGGCACCTTCTTCAACCACGGC
GTCGACCTCGTCGTCCTCGCCCCCGTCTTCGGCCAGACCTACCAGCGCGCAAAGGCCTCCAACACAAAGGAGGAGTTCA
TCCGCTCNCGCGAGGCCAGCGGCGCCGCCGTCGCCTGGGGCACCTCGTTTGTGGGATCTGCCCTGCAGAGCTACGGCGT
GGGCGCGCTGCTTAATGCCACGGGCACCCTGAGCCACAAGGGCGCTGCGTATCTCGGCGCCTTGATCTTCCGCGGCGAC
GTCAGCTCCTGGATTCATCTCTCAGATCTT > SEQ ID NO:479 213749 *Trichoderma harzianum*
CTCAGATACACAGCAAACACCCAAGCAACAACAAAAGCAAAGCACTCCAGCAACAAACATCTACCCACCTCACAACAAC
ATCAACCAACCTGACAACTTCTTCACAACTCCACAAACAACAACACTCAACCATCACAATGGCTTTCTTCCCTCGCACT
TTCTACCACCCCACCGAGGCCTCTTTCACGCCTCTCTTCCGTCTCCTTGACGACTTTGACAGCTACAGCCGACAGAATG
GCAAAAGCCGCTCTGTTCGCCGCCAGCAAGTTCCCCAGTGGCAGCCCAAGTTTGACGTGCGCGAGACCACCGAGGCCTA
CGAGCTCCACGGCGAACTTCCTGGCATAAGCAAGGAGAACATCCAGATCGAATTCTCTGACGCCCAGACCTTGGTTGTT
CGCGGCAAGACTGAGCGCACATACACTGCGGGCACATCAGCCTCTGCTTCCGTCGAAAACACTCCTTCTACAGAGACTG
TCGCTGAAAAGGCCGAGTCTGAACGCAGGAACTCGCACCAGGCGACTGTTGAGGACGAAAGACGAGGCCAGCGAGCGCG
AGTCGGGCTATGAAGTCG > SEQ ID NO:480 213754 *Trichoderma harzianum*
GCAGAGACACACGCACACATGGATTCGAGCGCCTTCGTTTTGACCTACCCAATTGTACGGCCCTAGCCCACGGTCTTGC
AAATGGCGCTCAGACAGCAGCAAAGCAGGCGCAGGCGCAGCCCCCATTCGAGACGAGAAACGGGCCTTTGATTGGGGGC
GTCCGTGTGACCCGAAGTGCTATATCTACTGCAGCCGCTGCCCGCCTCGTCGAAGCTTCTTTTCCGCATCTCCCCTCAG
AAGCATTTTGCACCAGGACTATCCGCCGATAGCATATATTTTTTCCCTAAGGCTTACGCGCAAATTCCGATTTCTTACG
GACCTACACGTACTTCAGTTAAAGTCCAATCGCCCAAAATGAACACCAGCACCGTCAAGAGCCGCTTCCTTTCTCACCC
CGAGGACCTTGGTATTGTCACCGTAGGCTTCTCGGGCGGTCAGCCCAAAGCCGGTGTGGATGCAGGCCCTACTGCCCTC
ATCGAGTCTGGTCTCTTGACCCAGATTCGAGATGAGCTTGGTTACAAGCTGCACGGTGATGAGACGGTCAAGTTCTACA
ACGACCTGACTCCCGCGTCCGACCCCGACTACCGCGGCATGAAGAACCCTCTCCTTGTCTCGGCTGTCACTCAAAAGAT
TGCATCTGAGAC > SEQ ID NO:481 213756 *Trichoderma harzianum*
GGCGAATGATGCTGATGGATTGATGATTTGACGTTCAGTCTTTTTCCCTTCTCGCTCGTCGCCACAATGTCAATTGCAG
CAGCGCCCAATGCGCTTCGAGCCTCATCAGGCTGCGCCTCAAGGCTGGGGCTGTCTCTCCAGAAAGGCCCATCATCAAG
CCTTTTCCTGCCGGTAGCAAGTTTCTCGACAACGGCGCCGCAATGCAAGCGCAAGACAAAGGACAGCAACAAGCGACGA
GGCGTCAGCAGCCTCTACGGATCGGGCCCGCGAGAGCCGCTGTCCATGTCCAACATGCCGCTGCCGAAGCCCGTCGAGT
TCAAGCCCAAGATCGAGGTCGACGAGAGCCACGGGCTGTGGGGTTCTTCCCCGCGCCGGGGAAGCTCCTGCTGACGCC
CAAAGAGACGGAGGAGCACGGGCGAGCGTGGGAGGTGGAGGAGCTGCGGCGGAAGTCGTGGGAAGATTTACATGCTCTG
TGGTGGAAGTGCTGCAAGGAGAGGAACATGCTTGCTACGGCGAGGGCGGAGCTGTTGACGGGGAAGCTTGGGTTTGGAG
AGCGGGAGATTGATTCACGGGATGAGGAGGTTACGAAGACGATGAGGGCGATCAAGCATGCTCTTACGGAGCGATTCTA
TACTTGGCAGGATGCCGTCGAGGTTGCCAGGTCGGACCCCGAGA > SEQ ID NO:482 213758 *Trichoderma harzianum*
CGCAAGCAAAAGATGCGAGGCAGTGTCGTGGCTAGCAGGCCCTTGAGCCGGATAAGCTGCTCGGCGTGTTGCGCGCGGA
GCCGGCAGTTTAGCAGGTCGTTTCGGGTGCAGTCGGCACAACCAGTGGTCGTGCGAGCGGGATTGAGTGGCGGCGTTGG

FIG. 1 continued

```
AAGATATCTCGATGCTCGAGCCAAGCGTGGTACATATCAGGTTTCATTGGCGACGACGAGATCTTTGGCGACAGTTTCA
GATCGTCCGGTGGTTGGACTGGGTCCGTTGGAGGAGTATGACCGGCGGGTGGACGCTGGGATTCTGCGGAACGACGAGC
ATCAACGAGGCATCATCGAGAACCTGCAACATCTTCACAATGAGCTTCGCAACTACCATGCACCGCCCGTTGTCCATCC
CAGCTTCGATCTCCTCAAGCCCGCCAAGAAATCCGTCTTCTCATCGTTATTCGGCAATGGAGGCGCCGCAAAGGCTACA
ATTAAGGATATCCCCGAGAACTTACCTCGGGGATTGTATCTATTTGGTGATGTGGGCAGTGGCAAGACGATGCTCATGG
ACCTATTCTACGATACACTACCCAG

> SEQ ID NO:483  213764  Trichoderma harzianum
GAGCTCCCGGCAGCTTGGTGACACGGAAGGATATATGATTCAATTCCAGGCGGAGCCCGAAAAGTATGATGCAGCCGTG
AACTGGCTTCGTACCATGATGTTCGATTCCGTCTTTGACCCAGTCCGGATCAAGGCCGCTGTTATGAAGGCATTGGCTG
ACATCCCAGAATCGAAGCGTGACGGGCGCAGCATGGCCGCGGAGGTGGACACAGCTATTCACATGGAAAAGTCTACTCT
TACCGTTGCCAGACGTGTTGTTGTCAAGGCAGTTTATCTCAAGCGTCTGAAGAAGCTCTTGAAGAAGAATCCCGACCAG
GTTGTGGAGTGGTTCAATGAAATCCGCAACTCTCTTTTCACATTTGAGAACATGAGAGTCCTTGTTACGGCAGACTTGC
AAAGGCTTCCCAACCCCATCGCCACTTGGGATGCGCTCTCAACAGCGCTACAGTCGCAGAATGGTTCTATGGCTCCTAT
TCCAAAGCCATCGAGTCTTTTGAACGCTGAAGGAAAAGCCCCGGTTCTGTGGGTGTCACCATCATCCCATGACAGCT
CTAGACAGCTCTTTCTCCGTCAGCACCGCCCCTGGCCTCTCTTCGTTTTTAGATCCCAGGCTGCCTGCCATTACTGTTG
CCGGAGGATACCTCGAGTCG > SEQ ID NO:484  213767  Trichoderma harzianum
TCCGTATGGGGGGCTTCAATCAATCATCACTTTTGGGATTAATGGGCGTTACTGGACACACTACAAGCGCGGTGCACTG
ATAGACTTTGCTATTTTATTATTTTTTACCATCATTTGTTTATTTCTGTATATGTGGTACATATTCTGGAAAGGGGCG
GTAGGGGTGGACCTTGGGTCGGGGATCAATCGATAATGGGAGCGTGACGAAGTTACGGAAACGGAACCGAAGCAAGCAA
ACAGAGCTTTTGAAATAGAATGATGGCAACACCAATGCCACTCTTGAAGTAATTCAC > SEQ ID NO:485  213769  Trichoderma harzianum
ACGCGTCGGAGGTCCAGAATCTTCCAGGTTGACCTCTGTATTGGCGGAAGTTACCATGGATGGGCTGCTGTTACACAAT
GATTCAACTTGTGAGCCTCCTTCGATCCTTTGGACATCTGAAGTCACAGATGAGTCAATTATGTGTTGTATCCCTTTCA
CAAGGATCGGAACTTGGGGGAGGGCTTTGTCTTGTTTCGGAATCATAGTTGAGAGGCAATCAACAGCGTTTTGCAT > SEQ ID NO:486  213777  Trichoderma harzianum
GCGTCCGGGGGACATTATTCTGTTTTTCACCTCTTTGTCGTTGTCCCTCATACGGCTTCGTAATTACCGCCGTTATGTA
CCCATGTCCTGTCTGATGCGTTGGTCACGCTGGTCGACGCTGCGGGGGGAAGGCAAACGAAGGCAACAGAACGGAAAAG
GGAAATAAAAATAAAAGTTGAACCTAGGGGGGTTTGATAATGGCCAGCGTGCGGCAGGCTTACAAAACAACGGGAAGAT
TTTCACGTTGGGCGGGATTACGGCTCTGATTTGTTATTCACTCTAGCTACTAGTCATGGCCGAAAACAATAATGCCAAG
GTTTTTTCGGTCAAGCAAGGGAAAGAAAAAGCACAAGCCCAAGCTTTTTGGGGGCCCCAGAAGGAGAGGAGAGGGAGAG
GCAAACAGGCAAACAAAGGTGAACGGGCGGGCTTTAGAAAACACCCATTCGGCATGTACCGTGGCTCGGATCTCATAAG
CATCACGGC > SEQ ID NO:487  213778  Trichoderma harzianum
CCCACGCGTCCGCCCACGCGTCCGCCCACGCGTCCGCACGATAATAGCAACATTAATTGTTCTTCTTTTGTCTTTGTTA
TAGACTTGTCTTCCAAGCGACCTCTATTAGACTCCGTATAGAACTATAGAGCCACACGGAACAAACCCAATAGGCTATT
GCCAGCACACACACCCGGG > SEQ ID NO:488  213783  Trichoderma harzianum
GATTTGTCTGCCGAATAACGCGCTGCCTCATCTCCATCTCCATCCTCCTTCAAAGCGACCCCAAAGCAGGACAGGCGCC
GCAGTTCCAGTGGCATCGAGAGACGATTTGTCCATTGACTTCGTCAAGAGGATGCCGCAGGCCGAGCCTCTAGACCCCG
GCTTGATCCTCGATGATTGGATCAACCGCGTTCAGAATCTCCCCGAGGAGATTCGCTTTATCCAAGAAGAGATTACAGA
CAAGGACCGCCAGTACAATGAGTGTATTCGAATGATTGAGGATCGTGATGGAAAGATTCAAAAGTGGATAAAGACGAAT
GGGAGCCATGAGCCCAACCCAAAGGAGGATATGCTACGGGCCCAGATTCGCGAAAACTATGCTCGCGCCGACCAGTTTG
CTCAAGACAAGATCACCTTGATACAAAGGCTACAGCTCGTTATGGACAAACATCTGCGGAATCTGGATGTCCAGATCAA
GCTGGTATACGACCGTGCCGAGCCTGGATTTACAGACCCTGACGAGGTTCCTTCACTCCTCCGCCCAGTGCGAC
```

FIG. 1 continued

> SEQ ID NO:489 213789 *Trichoderma harzianum*
CACCGCGTTGCCGAAGCTCTCGAGGTTGGCATGATTGGTGTCAACACAGGCATCATCTCTGACCCTGCGGCGCCGTTCG
GTGGTGTTAAGGAGAGCGGTTTCGGCCGAGAGGGATCAAAGTACGGTATTGCAGAGTACCAGATCACCAAGATGATTAC
TTACGGCGGCATGGGTAAGCCTCTGCAAAGCTAAGTAGTTAAAAGCGAGATAGAGTAGCCAATGCTTTTTAATGTCCCA
CGATTCAATGAAATAACGATAATTACCAAAAAAAAAAACAC > SEQ ID NO:490 213794 *Trichoderma harzianum*
CAAAGAAAAGGTCTCCGGCTCTGCAGCAGGCCTGGACCTGGAGAGCCTAAGCAGCAGTAGTGACAGCAGTACTGTCCTG
TACGGAGCAGTGGCGGCTGCAGCAACCAGCACAACTGGACGGAACAGCAGCAGCAAGCAGCAGCAGCAGCACGACCTGG
CCCTCCCTGCCATCTCCCCACCCCTGCCCTGGCCCGTGGTTCGACTACCGCTACGATACCAGAACTGCACTGCACTGCT
TGTGCTCGCTATACCTGCCGCACCGCTGTCTGTGACGTGTGAGGAGGCCCTACAGGGAAGCACAACCACCACCAAGTAC
TGCGCTTTTCCCGCACCAGACACTTGACCTCCAAACCTCTCCACACAACCAACCCGTTTTGCCCGGCGTAGCGAGAACA
CGAGAGCGAAATAGAAGCCGAGGCCAAAGGGGAACGGAGACAAGAAGCAGGAAACAAGACAGAGTGAGAGAGAAAACAA
ACAACCAAAC > SEQ ID NO:491 213802 *Trichoderma harzianum*
CTCCCTCTACCGCACAGCATGTCAAGCTTCGTCACCCCCGGCCAGCAGCGCTACCTGCGCGCCTGCATGGTCTGCTCCA
TCGTCATGACATACAGCCGCTTCCGCGACGAAGGATGCCCCAACTGCGAGGAGTTCCTGCACCTCATCGGCTCGCAGGA
CCAGATCGAAAGCTGCACGTCGCAGGTCTTTGAGGGCTTGATAACGCTGGCCAACCCGGCCAAGTCGTGGGTCGCAAAG
TGGCAGCGCTTGGACGGATATGTGCCCGGCGTGTACGCGATCAAGGTCTCGGGCCAGCTTCCCGACGAGATTAGGTCGT
CTTTGGAGGATGAGTATAGGATACAATACATTCCGAGAGATGGCACGCAGACCGAGGCCGATGCTTAAACGAGTATGAA
TGTTCACACAATGATTTGGCGTACAACAGAGGCGAATACGGCGTTTTGGTGATGGAATCAAACATTGGAGGACCAAAGA
TTAATATATAAGTTGTTGTTAGGTCATTATGGTATCTATGGAAACGCAACATGCTACAAAATACATCCGTTCCCATATG
C > SEQ ID NO:492 213803 *Trichoderma harzianum*
AGACACCATATTAACTCCAAGATTCAGCTCCCTCAGCTCAGCAATAGCCTCAGCCTCAGCCTCAGCCTCAGCCTCAAAA
TAAAATGGCCGTCACTGGCCTTGTTGCAGTCGAGACGCTGCCCCGATTCCTCCTCCCACGGCTCAGCTGGACTGCGCCG
CTCGCCGCATCTCGATCTGCTGCAGCCCAACCCTTTGCCCCTCTACAAGCACGAACGAACCAAAGAGCAGTGCCCGCCT
TCAACACCAATTTCTCGGCCAGAAGATACAACAATGGCCAGATACCGGCGCTGAGGCGAGGGTTTCACGCGACGAGTCG
ACGATCCCGAGAGCATCATTTCGATACGCTCAAGTTTGTCAAGCAGCTCAAGGATGAGGGCTTTACCGAGGAGCAATCA
GTCGCCATGATGAAGGTTCTCAACGACGTCATCCAGGAGAGCATCCAAAACCTGACCCGAACCATGGTCCTCCGCGACG
ATGCTGCCAGAACCACATACACGCAAAAGGTGGACTTCGCCAAGCTCCGTTCCGAGCTCACTTCGGCAGACAGCACCGA
GTCCAACACGACGCGCAGTGCGCACGAGCGCCTCACCAACGACATTGCCAAGCTCAGCAGCC > SEQ ID NO:493 213804 *Trichoderma harzianum*
GCTCCTCTCTCATTGCCCCGATGCCCTCCATCGCTTGAGCGTATTTGCTGTCCCCAAAGCTGTCGGTGATGAGGGATCG
TATAATGGCTCCCATCTGCTTTGTCGCCTCTGCAATATGTTCGACCTCTTCTGACGAGTTCAAAGCTCGCTTGAAATCG
GGAATTGCATTCTCAGGACTAATTGAACCCTTCTTTTCTTCTCCCAAAAGAGCATCCACATCCAGCCCCGAGATGGGCT
TGACCGCTTCTCTTTGACGTTTACCTTTAGCCTTGGGTGGTACTAAGGAGACATTAGCACATTAAATTTCCAGTGTCTG
GGATGCTTGTAATAATCACCTTTCTTGACATCTGCAGCCTGGACTAGAGAATCAATCTTGGCCTGCACTGTTTCAATCA
GTTCCGTTGGAGGAGCTGCAAATCTCAGCAAGACTGGGGGGACTTCTGGTATTGGCCTTTCTGGGTGGACTGCTCGCTG
CTTGATGGCATGGGTGATGCGATGTATTGCAGGGTTATATATTTCATCAATGGTGGCGTATTCGGCAGGCTCCCTGACA
AAACGAGCAAGATTAGCGATGGAAACTTATCTGAAGGGGCTATCTCCATATACTCACCCATCCTCGTCAATGCCATAAT
TTGATA > SEQ ID NO:494 213806 *Trichoderma harzianum*
AAGTTAAATAAGGGCCAATGGACGGCGATCATGGGAGCCCGTCTTCAACTCACTTTTGCCAATCTGCAGGCTCTCAACC
GACAGTTCAATCACCGCGGCGCAATGGCTGAAAACATCCTCGTTCTGGGTGCTGGCGAGCTTGGCCTCGCCGTTCTGGA
GGCGCTCTCCAGACACCCCAAGCGCAACCACAGCAAGATTACCGTCATGATGCGGCAGGCCACGCTGGACTCTGCCGCA
CCCGATAAGAAGAAGCTGATTCAGCAAATCAGGGCGCTGGGCGTCGACTTTGAGGCGGCTGATGTGGTGCAGGCTTCGG
TGTCGGAGCTCGCCGCCATCTTCACCAGATACGACACTGTGGTGTCCTGCAACGGCATGGGCCTGCCGTCAGGAACGCA
GACCAAGGCTCTCCCAGGCGGCGCTCGAGGCAAAGGTGCGGTGGTTTCCCTGGCAGTTTGGCATGGACTACGATGCCAT
CGGCCTGGGCAGCTCGCAGGACCTATTTGACGAGCAGCTGGGCGTGCGAGCGATGCTTCGCGCCCAAGACACTACGGAA

FIG. 1 continued

TGGATCATCGTGTCAACCGGCCTCTTCATGAGCTTCCTCTTCGTTGCCGAGTTTGGCATCGTCGACTTCAGCACCCGGA
CGGTGCGCGGGCTCGGCTCGTGGGACAACAGCATCACGCTCACAACGCCCGTGGAC

> SEQ ID NO:495  213809  Trichoderma harzianum
GCGGACGCGTGGGCGACCAGCGTCCGGGGGAGGTGAGGAGGGTTTGTATTCATGAAAGGAGATTTGCGCCTAAGCTCAA
GCGCAAAATGAATCCT > SEQ ID NO:496  213811  Trichoderma harzianum
GCCAAAGCGACCACGAGCGCATGCGCAGATGACTGACTAAGCGGCCCGTTGGCGAACAAATAGTGAGGAGTTTCGCTGC
GTCACCGCCTGCGCATCCGCATCTGCATCCGCCCGCCCTGGACAAGAACAAGCGAGTGCGACGATACAATGGACAAGGA
CAAGCCGGGGGACAACAAGCCGGTGGACACCTCGGGCAAACATGGTCACGACGAAACATCGCCTATCGCAACACCGACC
AAGAAGCCTCGCACCGCCAGTCCAGCTGAGCCAGCCGCAGCGTCAACGAGGCTTGAGCCGCTCCAGGCGCCGCTCGTCA
CAGACCCGACGTTGGATGCGGGCATCGAAGCAGACGACACGGCCAGCGATGGCGGCTACGAGTCCGATTTGGCGTCGCG
AGCGTCTACGTCGGTATGCAGCGCCGTGCGCGACTACGAATTCGAGAACAACAGGCGCTACCATCGCTTTC > SEQ ID NO:497  213812  Trichoderma harzianum
AGGAACATTACAGCCCATAAAGGATTACAAGCATCGTGGCGTACTACCGACAAGAGTTCATAGTCATCGAAAATTTGCG
ACTATGGCTCGGGTAGTTTCAGTGGCATTATCTCGGAAGGCGGGTTCGATGACTTTGTACGCCACGGGGGATAGCACGT
TGTATCAAGCCTCTTCAAATTGTTAGACACGGCTATGTGCTGTTGGAAGTGGGTGGGCATTAAACGAGGCGAACTTTAC
CTGATGAGACCCGGGGTCTGGAGGAGCCATAAGCGAGATACACTGGGAATGAAATAAATCCCATGTCTCTACAGTTGGT
GGAACTTGGTGGAGGAATATGAATTGAGTTGACTTAGGAAGATGGCTATGCCTGTGGAGAAGCTGAATAGATTGAGTTT
TTGGTTCCATCG > SEQ ID NO:498  213813  Trichoderma harzianum
CCCACGCGTCCGCCCACGCGTCCGAGATCAGATTGCAGGCACCCTCAATTGGCATCACATCATGCTGGCGACAAGAGCA
CTCCGAGCGGCCCACGGGCCCAAGCCCAACATCACCGGCTTCAACATGCGAGCCCTCAAAGAGGCCACTGGCCAGCCCC
GATACGACCCTTGGGAGAGAGCCGAGGCATGGCGATACAAGGGCACCTTTTCCAGATGGAACCGATTCCGGAGCGGCTT
CCCTGGCTTGGGAATCGCGTCTGTTGCATTTGCCGGATACTGCGCCTACGAGTACCTCTTCCTCAAGGATGAACACCAC
GGCGAGGGACATGGCGAGGGGCACCACTAGAGCGTTTTTTTTTGCGAGCGAGAGCAGTCAGGAGTGTGCGAGAGGAGA
AGAGAGAGGAAATGTATATACATCTCTCCAAAGACAAGAAAACTCAGGCCTGGTCTTGCGGCGGGCAAAAAATGAATCC
AACACAAATCAATATAAACTCTATTTAGAGC > SEQ ID NO:499  213814  Trichoderma harzianum
GACAAGTCGAAACGAACCCAATTGGCACGCACACCAGAGGCCATATACAAATACAAATATCCCCCCCCTTGAACCGACT
CTCGCCCACCCGCCCATCATGCATCTCATGTACACCCTCGACGCCAGCGGCAACCGCCTCTACAGCCTCAAGAAGGTCG
CCCACGGCCAGGTCACCAAGTCTGCGCACCCGGCGCCTTCTCTCCCGACGACAAGTGGTCTCGCCAGCGCGTTACGCT
GAAGCGCCGCTTTAACCTGCTCTTGACGCAGCAGAAGGAGGAGGCTATGTAAATTCGCATCATGGAGATACCCTCGAAC
CAAAGAAATCCCAAGCGGCGTTAATTGGGAGCGACTTCGGGCATGCTTTTTGAGGTGATAATTGATTCGTCATTGTCCT
CTGTTGGCGATACGGGATAAAGAGAACGGCAAG > SEQ ID NO:500  213816  Trichoderma harzianum
ACACTCTCCAGGCTCACACAAAACTCACTACAATAAAAACACAATCTTCAATTCTTTGAACCTTTTTCAAGTTTCGCCA
ACATGAAGTTCACCACTACTGCCGTTCTTGCCATTGCCGCATTCGTTGAATCGGCCACTGCTCTGGGCAAGGCCCGTGT
CGTCAACAAGTGCCCCTTCAGCGTCACCACC > SEQ ID NO:501  213817  Trichoderma harzianum
GTCGACAAGTTCAATTCGCAGCAACAGAAGCGGCGCAGACAGCATGAGCTCATCACTGAGGAGCTGCGTTGCGGCCCGG
CCGCTGGCTCGCATCTCGCAGACGGTCGCTTCACGGAACGGCGTCCAGAGCGTCCGGTGTCTGTCCCAGACAAGCCCAC
GATGGGAGGATTCAAAAGATGCAAAGCCAGAACCACCCAAGGCGGTGCCTCCAAAGCCTCGAACCGAGTCGCTCCTCGA
CAGCATCTACAGCATTACCCAGGCGCCAAACAGCCGGTCCGCGCAGTCCAACCCCATGGGCAGCCTCTCCCAGAGCATG
GTCTTCCAGGCCCTCAGCAAATCCAACATCGACACCAGCGTCCTGTCAGGCGGTCCCTCGCAGGCAGCGCAGAAGAAGG
AGGATGAATTGGAGCCATTCCATTTCCACGTCTACTCGCACAAGCACAACACTCACATTACATGCACAAAGCCCAATCG
GGAACCCATCATCTCCATGTCATGCGGCAACATT

FIG. 1 continued

> SEQ ID NO:502 213825 *Trichoderma harzianum*
GTTTCCTCTCGTTCTACTAGCTGGGAAGGGGAAGCCGGCTAGCAGTTAGAGCGGATGGGCATCGTGATGGGCAGTGACG
ATAGTGTACACCCGGAAAAAGTGACTGCGTATCGCTTTGCCCCTCCGTGTCTTCCGACGGGATTGTCTCGATAAAAATG
ACATCAGCACGGGAAGAAGAAGAGCATCTCCACTAACGGCACACACAAACACGCATAGAACAAGACGCTCTCCGACTCC
TCGGAGCCGGTGCTCTCCCTGCAGGGCGTTGGCTACCTGATCCGCAAGGGCATCAGCCTGGCCACCATCACCCTCGAGG
TCGAGCAGTACGAGGGCCCGCCCAAGCCGACCAAAAACGGCGCCGACGTCGTCACGCACATCGACATCAAGCAGTCCGC
GTCGGGCCTGTCG > SEQ ID NO:503 213826 *Trichoderma harzianum*
CCTTCATTCTCATTGTCGACATCCATCGTGATTCCCCTGAAACTGCGTCTTTCAGTTGACTCTGGTGATTCTCTGAGGC
GCCGAGGCTCTGTGTGAGCATCCCGATCCAACATCATGGCGATACGCGAGGAAATCGTGGCGTCTGCAGCGCAATTTCT
ACAAGATCCCAGCGTTGCCACCTCGTCCGTCGAGAACAAAATCTCGTTTCTTCGAACCAAGAATCTGACACAGGAAGAG
ATTGATGCCGCCATTGCCAGAGCTGGGGCGGTAGCGGCGCGGTAGCTCCTAGGGCTCCCTATGCTGGCGCGCCTCAGG
GTCCTCCTCAGGGTCCTCCTCAACAGTATTACCAATCCTACCCCCAGTATGCGTGGCAGCCGCCTGCGTCAACACAACG
GGATTGGAGAGATTGGTTCATCATGGCAACCGTGGTTGGAGGGGTCAGCTATGGCCTGTACTCATTGGGCAAGCGTTAT
GTATACCCCCTTGTAGCGCCACCTACCCCTGAAAAGCTGGAGCAGGACAAGAAGTCGATCGAGGAGCAGTTTGACAAGG
CCTTTGCTCTGGTTGAGCAGCTGTCCAAGGACACAGAGGCACTAAAGGATGCCGAGAAGCAGCGGACAGAACGACTGGA
CATTACACTGGCAGACCTGGACACGATCATGACGGAGCTGAAATCAGCAAACAAGCGCCGGGA > SEQ ID NO:504 213827 *Trichoderma harzianum*
GCGGTCGAATAAACACCGACTGCATCTCCATCAGATTGCGCTTGGCGGCCGGGTCTACTGTTGCAGTTGATGCCGCCCA
ACTCTGGCAAAACCTGGCGCTGCGGCTGCGGCTGGAGACCGGGGAGCGATTCTGGCTGCCCAAACGAGAACCGGGGGG
GATGTCAATGCACAGTTGCATCGAAATTTGGCGATTAATTTTTTTACGAGGGAGGATTAGGATTAGGACTTTGCACGGT
AGTATTACTAGGACCCCTAGGCAGAAAGTTGGATATAGATTGCATTGGATGTTTTGATTGAGTTGCCTTGCTGGGATGT
TGAGAGTCTATCAAGCAAGCAAGGCAGACGAGGATGCCTTGTGCAGAGACGGCATTTCAATTCACTAATTGGATAAAAT
AGATATCAACGTATTATACAGAAATACTGCATGCAAAGTAATAACG > SEQ ID NO:505 213829 *Trichoderma harzianum*
TCTACATCTTCCATATTGGGGATTGCTTGCTTACAGGTCATCGGCCATGGCTCTCTTTGGAAACAGAGCTCGCGCTCCT
GCGGGACAGGCCCCAGCAGCCAACACTACGACTACGCCGACGACGACGACAAAACGGAGATGGGGACTCGGCCGTGGTG
GAGGAGGATTTGGCCGTGGTCGTCAACACACTCCGTATGCGATGCACTCGCGTCCTAGCTTTGGGCAATGGCTCAGAGT
CACTTGGTTGGACATCTTGACCATGGTAGCTATGGGAGCCATCGGCCTCGGTGTCTACGAAGCCAAACCAGCGCCTACA
CGCTCGTTCCCCGTCACATTTTCCGATGGAGAAATCGTCTGGCCTGAATTCGGCTACCCTCTTCGAAAGGAGATTGTTC
CCATCTGGCTGGCAGCTTTCCTCGCATCCATCATCCCCATCTTCATCATCCTCGTCATGCAGATCCGCATCCGCTCATT
CTGGGACGTCAACAACGGTGTCATTGGTCTCTTGTACTCTCTCATCTGCGCAGCCGTGTTCCAAGTGTTCTGCAAGTGG
CTCATCGGAGGCCTTCGCCCACACTTTCTTGACGTGTGCAAACCGGATCTGAGCCGCGTCACAACTTCAGGACTCGACA
GAACCGGATTCCAGCAGATCTACTTTACGCGCGACATTTG > SEQ ID NO:506 213831 *Trichoderma harzianum*
AAATTCTAATCGAACGACGCTGGGGAGATTTCAACCACGGCGTTTTCCCTTCCCACATTTCGCCAATGGCACGAATAAC
GAGGATGCGGAGACTGCAGTCTCTGCAATTGGCCATCCCGTCACAATGCGCCGCTTCCAGACCTTCTTTCGCCGCTGCC
CGCGCCATCTCGACGACCGGCCCCGCGCACAGCAAGAACACGGAATGGATCCGGGGAAAGCTCTGGAAGGGCGAGGCCC
CCGGCCCGGCTGATCCCTATACGCAGAGGATGGAGCCCGAAGCCCAGTCGAATCTGCCCGAGGAGGCACTCGAGAGCCG
GGCGCGCCAGGATAAGACGCCCGCGGCCGTGGAAGAGTCCAGGTTGACTCTGCCCGCGAGGAGGACTGAGGCGACGGCG
GAGAAGGAAGTGCAGGCGGCAGACCCGTCGTATGTGCCCGCTACGGATGCCGAAGGCGTGGAGGAGATTGGGCGTTGA
ACACGTGGTGGGAGCAGCCAGGACACTGGGGCGACGAGAGTGTCTTCAAGGGATTCGGCAGCGCGGACAAGGTTGTGGA
AAGGGAAGTCCTGGAGGTTCACCTGCGACGAGCCGTTGTTGAGGCACTGGCGCTG > SEQ ID NO:507 213832 *Trichoderma harzianum*
GGTGTAGACTATGTGTATACTACTGTACAAGTTTGGAATCAACTAAAATTGTGCAGAATGAAGAGAGAGAAAACAGAGC
TTATTAGGATGGCAATAATGCACCGTCAAAGGGTAGCGCCGTTTCCAATGTGGTGCCCAACAAAGTGGAGGGAAAATAT
GCTCACTTACAAACCCACATGCAAAATCGCTCTCCTCTATACAGGCATCCTCACCTGCAGTTCATGTCCGTTCGATGGT

FIG. 1 continued

```
GAGATGACAAGTGGATTGATTTCTCATCAGTATGTAATCTCCATCTGAGTCGTACATGTAGTTAGTTTACCGATACACG
GCTGCCTACGCAAGAGACCAACAACCAAGACGAGTTAACGAAGTAAGACTTTGGTCAACAGCAGTATTAGTCCAGAGGT
CGACA
```

> SEQ ID NO:508  213836  *Trichoderma harzianum*
```
GAGGTAACCACCAGCACACGCAAACGATACGAAAAACCGAGAACAAGTATACCTTCAGCTCCGCGGACAACAATCATCA
CCGCGGACAACAATCGTCACTGCACGTCTGCCTAGTTGAGAGTTCCAAGTGTAAAAACATCAGCAGTTGCCTTGCTGCG
TGGTTCCCAAGTCCAGATAGTCAACAGATCAAACACAAGACAAACCTGCCTGTTCGATTACTTTGCCTCCTTGTAGTAC
AATTCGCAATAGTTCACCAAATCACCAGTCATCATGCCTGTCACTGAGTTTGCCATTATCAAGCTGAGGCCCAATTTCG
ACCCCCTCGAGTTTCTCGAGACACTCATGGAGTGTCAAGAGATTCAGGACAATTGGATTCGCCGCAATCAGCCATGCAA
TCTGGCGCCTGGCATGAACCTGAGCAGCATGTACACGGATGCCACAGACCAATCAACACTTCTCATCACGGCGCCGTGG
GATTCGCCCGAGGGGCATGGGAATGGATCCAGAGTCTTGAGAACAGGACGGCCAATGGCAACTTAACCGAGTTCAGCG
CTCCGGGTTGCGACTCCGTCTTGCTCTTCCACATGGACCCGGCGGGAGCGAGGCCACAGATGCGGGAAGCCTTTCAGCA
CAAGGATACCAACGACGTATTCGACGTCTGTCG
```

> SEQ ID NO:509  213839  *Trichoderma harzianum*
```
CATGTGGCCACGGGAATGACGCAAAAGGCGCCGAGAGCGGAAATGGAGAGAAAAAAAACCCAATTGCACCTCGCTGATG
ATGCCACTCAAATGTCTGTGGTCGAGCCACTGTGCTTCTACCTACGACTTACATTACCTAACAAGGCAACGAAACATTT
TGCGGCAAGGAGAATTGGATCATTGACTTGGCGAATGGGCTAATGAATGTCGTCAATTGCAGGCCTCGTGGTTTGGCG
```

> SEQ ID NO:510  213845  *Trichoderma harzianum*
```
CCCACGCGTCCGAGAGCATCAAATCTTTCGCGAGACAAGATCGACGGATACACAAACATGAGCTACGAAGATACTTTAA
TTCGATCGAGAATAACGGGTTTATCCTATATAACCAGGAGAAATTCCACGAGTGACACATCAACAGGAGGCACCAGTCA
TGACTACGTCCCCATAATTGTTATGACTGTTATTGTCGTGGCGATCGTTCTGGTACTCCTTATCCTTGCGTACGTTTCA
AAGGCGCCCAGTCTTGTTCTTCAACCATGCCTGAAAAATGCAAATAGCTGATAGCTGTAACAGTCAATACACAAAGGTG
CTTGATCGGAAAAAGCCAGCCAACGGATTTGATGATCCAGAAAGCGCACAGAATGCCGGC
```

> SEQ ID NO:511  213851  *Trichoderma harzianum*
```
CTTGTATCAGGCACGAGAATAGGTGAGGCACCGAGCAAGAGGCTGTCGTTTGACAGGAACTTGTAATATCTGCTTTAGC
AGTTAGGCTCTGCAGTAATCTTACTTTAGTGGTCCGGGGATACTAGAAAAGGTGATAATTTGAGCTTGCTCTCCAACGA
CTGGGAAAGGATCTCATTCT
```

> SEQ ID NO:512  213861  *Trichoderma harzianum*
```
CTCTCTGCGATAAGTCGCAGTACAAGGACGTCATCTCGTCGTTTGTCAAGTACGTTGTGACCGAGCTGCGGCTCGTCCC
CATGTGGATGCTTGTCTCGTACGACGTGCAGAGGATTCTAGCACACGACTTGGGCTGGCGAACCCTCTCCTGTACCGAG
GAGCAGCGTGTCGATACCGCGAGACACCAGAGCCCGGCTGGCGGACCCAAGGCCCGCAGAGTCGAGCGTGAAGGCGTCA
AGATTCACGAAGTCAAGCCCGACGAGGACTTTATCTCGCGC
```

> SEQ ID NO:513  213863  *Trichoderma harzianum*
```
CTTTGTATGGCGCCAGAATCGCTAGCACCGTTCTGAATGACGCCCAGCTCTTCGCCGAGTGGGAGGAGAATCTGAAGAC
CATGTCCGGCCGCATCATCGACATGCGC
```

> SEQ ID NO:514  213868  *Trichoderma harzianum*
```
GACTCTACACTATTGATTGGGATAACATGCCTCTGCCCCAAGCCTGGTGAGAGCTGACCGTGAGGCACTGCTTAAGCTT
CGCCATACCTCGTTGACCACGCCGATATATGCCGACGACTCTTTCAATCCCAGAAAGCGCAAGTCGAATGATTTTCCAA
ACAATGATGCATCCGTGCCGCCTTGGCACTCTACTAACTCAGGCCGATCCCTCGAGGATCGCATTTCGTATTCCCCCGA
TAAGCGGGTAGCCCTCGATGACAGTAAGTTCCAGAAAGAAGCCAACAAGCGAAAGCGCCGTTTCGAAAACGAATACAAG
GCGGCCAACGTAGCGTCGCTCAGCCCAACTCCGCCATCATCCGGCCCCATCGTCGGCACCTCTGAAACCCTTGAAAAGA
AGTATCTCCGCCTCACTGCCCCCCCTATTCCGTCCAATGTGCGACCCGAGAGAGTTCTCCGTCAAACGTTAGATTTGTT
GAAGAAGAAGTGGCGAAAGGAGAGCAACTATTCGTACATCTGCGACCAATTTAAATCTATGCGTCAAGATCTTACCGTG
CAGCGCATCAAGAACGAGTTTACTGTTTCCGTCTATGAAATCATGCCCGGAT
```

FIG. 1 continued

> SEQ ID NO:515 213877 Trichoderma harzianum
GCAGTCTCCAGCAGAGTAAGCCCATCAAACTCATCAGGCTGGACAGAATGCCGTCCGAACGCCATCCTCTCCTATCCAA
CCGCGGCGAGTCGGCCGAAGCCGCCCAAGCAAAGGCTGCCTTGCGCTCTTCACGCATCCGCGAGATTGCCTTCTTCGCC
TGGGGCCTGCTCGCCACTGCCGCCTTCATCGTCGCTGCTGTCTGGATCCAGCATGACGCTCAGACCGGCCATGGCGACA
ACAACAATAACAATAATACTGTCGCTCCCAAGCGCAACTTGGTCTTCATGGTGTCCGACGGCATGGGACCGGCGTCGCT
CTCCTTGACTCGAAGCTACCGCCAGTACATCAACAACCTCCCCGAGAACGACACTCTCGTCCTGGACCAGCACTTTTGG
GGCACCAGCCGCACTCGCTCCAGTAACTCCCTCGTCACCGATAGCGCTGCCGGCGCCACGGCCTTTGCCTGCGGCCTCA
AGAGCTACAACGGCGCCATCTCAGTTCTGCCCGACTTTGAGCCATGCGGATCTGTCATGGAGGCGGCAAAGAGGGTCGG
ATACACAACGGGACTTGTCGTCACAACAGACATCACAGATGCCACGCCTGCTACCTTTGCCAGCCACGTCCTGAGG > SEQ ID NO:516 213881 Trichoderma harzianum
ACGAATGGAGTGACACCTGCACATCAGCACATCCAAATCGCTGTGCTGAGCTACACCGAACAAGCTGAAAGCAGTGA > SEQ ID NO:517 213882 Trichoderma harzianum
CATGTGGCCACGGGAATGACGCAAAAGGCGCCGAGAGCGGAAATGGAGAGAAAAAAAACCCAATTGCACCTCGTGATGA
TGCCACTCAAATGTCTGTGGTCGAGCCACTGGCTTCTACCTACGCTTACATTACCTAACAAGGAACGAAACATTTTGCG
GCAAGGAGAATTGGATCATTGACTTGGCGAATGGCCTAATGAATGTCGTCAATTGCAGGCCTCGTGGTTTGGCGGTTGG
ATGAGAGGGGGAATTGGAGTGAGTGGGATGGGGAGTTGGAGTCATTGGATTCATTTGACAATTGGTTATTACGAGCGGT
TTAGGTAAGAATGTAACAATGGAACAGCAAAACGTGCACGC > SEQ ID NO:518 213889 Trichoderma harzianum
CTGGCAGAACCCAATGGCGCCAAAAGGCAAACTTGGGGTCATCTGGCGTGGGTGCATCGNGGATCGACAAGGAGCAACA
TATACGATGCGTCTCCCGATGAATCCCCAGCCTATATATATGTGTGTGATGGGAAATCGTCAGGAACTCTAGCTTCAAC
TCCATAGAACAACTTTAAAAAACCAAAAAAAAAAAACACA > SEQ ID NO:519 213894 Trichoderma harzianum
GCCCACGCGTCCGGCGTGAAGATAGGAGAGAATAGAGATAGAGAGGCAATTGCACGGAATGTTTAGCCAACAAGTTGCT
CGTGGCGGGCGCCGCATCGGCCAGATGGCTCGAGGCGGCCAATATCCGTCACTCGCTGCGCTCAGAGGAGCTGCTCAAC
GACGATGTTATGCTGAGGCTGCACAGGCAGCCCCCAAGGGACGTATCGGTCGAGGCCTCGGGCTGCTCCTGTATGGCGT
TGCATTTAGCGGCCTCGGAGCAGCAGCAACATTCTATTCGATGGTACAAAAGGGTTTCGCCTCGTTCACCGACGCCGAG
TCAGCCAAACTGTTTGTCCCAGATAGCGACGAGCTGCAACAAATCGAAGAGACAATCAACAAACACCCGCTCGTCCAAG
AGCTTCGATCACGACCAGAGTTCAAGGAGTCACGACCACACCTAAAGATGTCAAGCGAAGTCCGCAGCCGCACCCTCAC
CGGCGGCGCTCTACAAGGCGACGGCATGATCATGGTCCCCCCCGTCGCCTTCATCGAGGACGGCGGCAAGTCCATCGTC
AGCGTCACGTACATTGGCGACAAACTATG > SEQ ID NO:520 213895 Trichoderma harzianum
GGTGGGTTCTGCGGTGCCACGGCTGCTTCAACATCACCAAGGACATGAACAAGCAGTTCTGCCCCAAGTGCGGCAACCC
ACCCTCACGAGGACAAGCTGCTCGACGGACCAGCATGGCAACTTCAAGATCCACCTCAAGCAGAACTTTCAGTGGAATA
ACCGCGGAAACGTGTTTAGCGTGCCCAAGCCAGTCCACGGCAGCGCCAACGGAAGACTTCCTAAGAATGTCGGTGGCAA
GAATGGCTGGGGCAGGGACTTGATCCTGGCTGAGGACCAGAAGGAGCACGTCAATGCGCTGGATGACCAGCGGAGGCAG
AGGAAGAAGGATTTGATGGACGAGGATTTCTTGCCTGGTCTCTTGACGGGTAACAGGTCGGGAGCGGGCGGCAAGATCA
AGGTTGGTGCAGGACGAGCTGTGAACTCTAGGCGGAAGCGGTAGACGGAGAGAGGCTGGTTACGGTTGTTATGAAAAG
AAGATAAAAAGGCAGAATATAGAAGTGAATATCCATCATGATTGTATGACTTTAA > SEQ ID NO:521 213896 Trichoderma harzianum
TGCTTGTGATGCGTGTTCAGATAAAATTGTCTTGAAATGTACATTTGATGCTTTTGAGGGCTTCTAAAAGTAAATCAAC
TCTGAGACCAGCGGGGCAAACATGGTCCATAGGCACGCATGCTACGCTGCCGTAAATAGAGCAAGACACGCAGGGTTAT
AGGAGCGCGCCCAGGTCTCAACCTAAAAAGCTTCAATCCATGTTCAATCTGAAGCACAACATGGATGAAATATTCAAAC
CGAGGAGCTAG > SEQ ID NO:522 213903 Trichoderma harzianum
GCCCACGCGTCCGAAGTAGGGCAGGCTAGCTGGTCCCCTGGAGAAAGATGAGGAAAAGACCCGGAAGGAGAAAAGGGAA
TCGTGTGATTTAATTTGCTATGCCGGATCGTAGCCGTGGATGTGAGATGAGGCGGGAAGGGAGAAGCCGGAGAAGGCGG

FIG. 1 continued

```
GCCTTGACACGGAGCTGAAGAATTTTCTTTTTCTTTGTGTCGCGTGTTGTGTGCTTTGATCGTGATTCTTTTGCCGTAG
CCCTTTTTTTACATACATTTGTGTGC

> SEQ ID NO:523  213909  Trichoderma harzianum
GAACCTACATCATCTAATTCAACAAACTCAAGTATAACTTATACCTACTATTTATACCTACTCAACAGTATACTCGACC
TTGTCCAA > SEQ ID NO:524  213911  Trichoderma harzianum
NGAATAGAGGGAAAACAAGAAGCGCTGCTTAGCCCCGATCATGCGTACAATCTTCACACACTTGTGTCAGCTCATACCA
AATCGAGCTGGGATTGGTTGCCT > SEQ ID NO:525  213914  Trichoderma harzianum
CGTCCCGGACTTCTCAACCGGTGTACGCAACATCACCCTTGATCTGCCTCCGCGTTCACGTACGCTCCTGATTGGTGCC
AACGGTGCGGGCAAGACCACTCTTCTCCGTCTGCTGGCTGGAAAGCGTCTGGCTCCCGGAGATGCCATCTCCATCTGCG
GCGTCGACCCCTTCAAGGAGGGTCTCGAGGGCGTCACCTACCTTGGTCTTGAGTGGGTGCTGAACCCCATCGTGCGCAA
CGACATTGGCGTCATGGAGTTGCTTCGATCTGTTGGTGGCGATGCTTACCCTGAGCGCCGCGACGAGCTGGTTGAGATG
CTTGACATTGACATCAACTGGCGTATGCATGCTGTGTCTGATGGCGAACGCCGCAGAGTTCAGCTGGCCATGGGCCTCC
TGCGTCCCTGGACGGTTCTCTTC > SEQ ID NO:526  213919  Trichoderma harzianum
CGGACGCGTGGGCGGACGCGTGGGGATGGAGGCCCTCCTGCGCAATACCACGCCTCTCCCCCTATGCCAACTTATCAGC
CTCCCTCTGACAAGCCGGCTATTCCTCAGGGATGGATTCCTCTCTTTGACCAGAGTCGCCAGCGATGGTATTATGCCAA
CAAGGAGACCGGGGCGACCCAGTGGGAGGCTCCAGGCTACATTGCCCCTCCACGACCTCCCATGGAGAGCTACCCAGC
GAGGAATCACGAGGCAGCGGCCCTTCGCCGTATCCCCCAGCAGCCCCATACGGGCCTACGCCTGGAGGCTACGGAGCTC
CTCCTCCAGGACCTCCCCCCTCCGCCTCTTACGGTGCACCCCTACCACCTGCTGGCTACGGGGCTCCGGCAGGAGAGTA
TGGCCATAGTAGCCATGGTAGTTATGGTGGCGAGGGCCGCGGTGAGGGCTAC > SEQ ID NO:527  213922  Trichoderma harzianum
AAGAAAATAGAGAAGGGGGAGAAAAGAAGAGAGCCTCTTAGAGGATGATGCTGAATGACGCTGTGGATGGTGAAATGTG
AGATGAGCAAGGTTTGTGTTACATGTATATTAAGAGGAT > SEQ ID NO:528  213923  Trichoderma harzianum
GCAAAGAATCCGCGGCCGACGTGCCCACCAACGGGCACTATGTTTCCAATGGCATGGGCTCTGGACAGCAATTCCAGCC
CCAGCAGTATCAGCAG > SEQ ID NO:529  213935  Trichoderma harzianum
GATAAATAGTAGCTGCTGTTGTGAAGCACTGCTTTCATCAAAACAAGGTACTCTCCAATCACATCTGGGTGTTCGAACA > SEQ ID NO:530  213942  Trichoderma harzianum
CAGCATAATCTAATCACGATGCCCAAGTTCTTTTGCGACTACTGCGATGTCTACCTCACGCACGACTCCATGTCGGTGC
GCAAGGCCCACAACAGCGGCCGAAACCACCTGCGCAACGTCGTAGACTATTACCAGCAAATCGGCCACGAAAAGGCCCA
GTCCGTTATTGACTCGATTACTTCTTCGTACGCTGCCGAGGGCCAGGCCCATGCGAACCCGATGCTTCTTCAGAACCAG
CCCGGCCAGTGATTTCCGGCCTTTGGCTTCCCCGGCGGCATCCCTCCGCCATTCCCCGGTATG > SEQ ID NO:531  213950  Trichoderma harzianum
ACGCGTCGGCGGCGTCTCCTACAAGAAATCGTTCGTTTCCCTCTGTCATTGCGAGCCTGTTGAGCAACACAACAAAAAG
GCGTCAACACACAAAGATCCAATCGCCAGATCTAAAGCCTCTGTGCTACTCAGTCCAACAATTGCACAAAGCGACACAA
CATACCGAAATCTGCAAACAATGTGTNCCGCGTGGAGCCAAAGGCCAAATACTACTACCAGGAGGAAATCATTCCCTC
ACGGCCGTACCGCCATCACCATCAACATCACCATTCTTCCCACCACTCGCCGCGAGCGAGCTACTCGGCGGTTGAGCGC
TACAGCCCGCGGGGTAGCACCAGCAGCTACAGACGCAGCGTGCCGTCGAGGGTCGTGTATGAGGAGACAAACGCGGGAG
TCGGTACTGAATGGGGCTTTGATTAGGACCAGGAATATCCTGTGATTTCTTACTCTTTTGTTTTTTTAACGACTCTAT
GGGTACTGGTTATGGGAAATGAGACACATGTTAGAGGCTAGAATAATGGGCGGATTGGGATGGAAACTCGAGG
```

FIG. 1 continued

> SEQ ID NO:532 213951 *Trichoderma harzianum*
AGCGTCCGCGGACGCGTGGGAACCCGAACAAAATGCTTATGAGCGGGCCGCGGGTACCATGTCAGTGTACGGGTACTCG
TACAAGTTCCCTCTGGACGAGCAGATGCAACCATCCGGCAGTCAAACTTGATGCTACTTGACCTGTAACATTTGCATTG
ATGAGCGGCAGCAGGGCCTGGCAACCTGGGTAGTACTCCCAAGTATTGCCCGTACACGTCCTAACATGCGGCAGGCGAT
CAAGCCGTTCTC > SEQ ID NO:533 213958 *Trichoderma harzianum*
GCGTCCGCCCACGCGTCCGCAACCGTCAAAATGGGTCACGAAGATGCTGTTTATCTGGCCAAGCTCGCCGAGCAGGCCG
AGCGATATGAGGAGATGGTCGAGAACATGAAGATCGTCGCCTCCGAGGACCGCGACCTGACCGTCGAGGAGCGCAACCT
CCTCTCCGTCGCCTACAAGAACGTCATTGGTGCCCGCCGTGCCTCTTGGAGAATAGTCACTTCCATCGAGCAGAAGGAG
GAGTCTAAGGGCAACTCTTCCCAGGTTACCCTTATCAAGGAGTACCGCCAGAAGATTGAGGCCGAGCTTGCCAAGATCT
GCGATGAC > SEQ ID NO:534 213962 *Trichoderma harzianum*
CATCACTTATTATTACTGGTATATATTACTGGTATTTGATGATGTGAGCAGTGGATAAAGCTGGATTACGAACGAGGAT
TGGGAGCATTCAAAATTCACATTGTCAACCACGCATCGCAGCACCTATACGTGCATTTTCGACTATGGCCTCCAACAAG
GATGCGCCAGCTGCGATTAAACGCAAGGACCTCTACGAGGCCCTGAGGCTCTCGCGACTCCCAGATGAGCAGAGCGGCT
CACAGGATCCCATCAAGAGATTCGTCAGTCGTACACCAGACCTGGAGGCCTGNGGAATGAGCTGGCCCATGGGGGATTC
CAATCCCGACTCTGAAGGGTATAAGAAGGGCAACACGGTTGACTTTAACCCGGCTGCGTTTGGAGGCCACGTCTTCGCC
CAGGCACCCTTGGCGGCTGCGAGAGCGGTGGAGGAAGAAGAGAATGGCAATGGCAATGGCAATGACAAACTAGGCATTC
ATTCCATCCAAGGCGTCTTTACAAAAGCGGGCGCGATTGATCGGNCATTCATCTATGATGTGACAAATGTCCACTCAAG
CCGTTCATTCACCAACAAGCTGGTCC > SEQ ID NO:535 213963 *Trichoderma harzianum*
GTCCTTTACCCACCAAGTGATCTTATCATGATCAATTAAGTGCCGGTCGAAAATACGAATATCCGGAATCGCTCAAGAC
TTGATA > SEQ ID NO:536 213967 *Trichoderma harzianum*
AGCAAATACCGCAAAGATGTCTGACGACGGGCTCTCAATATACGATGAGATCGAAATCGAAGATATGACCTTCGACGAG
GTTCTTCAAACATACTTCTACCCGTGTCCCTGCGGCGATCGTTTCCAGATCGCTATCGATGACCTGCGCGACGAGCAGG
ATATTGCTGTGTGCCCCAGCTGTAGCTTGATGATTAGAGTTATTTTCGACCTTGACGACTTACCCAAACCTCCTCCTAC
TGGCAATACTGGTGGCCAGATACCAGTCGCTGCTTAAAGCCATCGCTATATTTGAGCTTCCCTGGGCGAATACTTGATC
TATTCGGCAGACACATCGAGATACTACACTAATTAGGCCCGCATAGCGTACACAGTGCCTCAACGGCCGTTCTGAAGAG
GCTTCTCAGATTGATCCGTCTAACATCGGATGTATTGATAGACGCGGACGAGAAGACGACGATGTACCAGCGACAGACC
AAAGTCATCCCAAGCATCCAAGCTACTGATGCAAAAATATGCGTGCCTTGGGAGTACCACTCTCCGAGGCAAAAATTCA
GTCACTTAAAGAGACAGGCTTCGGGAATGCCATGAAGAATTCAGGCTCACGTGGGGGACATTTGATGAAAGAA > SEQ ID NO:537 213981 *Trichoderma harzianum*
GCGTCTTATAACATATATGTAGATGAATTTGAATTATATACAGTTAATAATATACCGCCCCAAGCCGGATACCCACCCA
GCTCCTCTTAAGCCATACCTGTTTTAACCACTGTACACTAATGATAATACGTGAAAAATAGAAAAAACCCTGCCCAATA
AAAGAAAAAAGTCATCCTAGACTTAAAACAGCGTGCAAGCAGTGGCGTTGAGCTGAGTGCAGTAAGTCATCTGGATGGG
GAACGCGCTGACCCCACGGGCAAGCAAGCGTTCTCGGAACTCGTTCAGACGAGGAACAACGTCCAGCTGGCTGCGCTGT
TGGCCAGAGGCATCGGTATTGCCGGACCANCAAAGCTCACCGGCGGCGCTGCCACGAGGCCAGATGATGTTGTCCAGGT
TGCCTGGCGTCAATCATCTCGCTCCATA > SEQ ID NO:538 213983 *Trichoderma harzianum*
AGACTCCAAGATGCATCATCAGCTTCTCACTCTCACCGCTGCTGCTGGCCTCCTCGCGACGGCCTCAGCTACCTACTCG
AAGCTTCCCAGTGTCAATGTGCCTTCATGTCCTCGTGTTGGCACGATTAGCTACAGCAAGTCAGTGCCCGACCTGACGC
CCTTCCCGCTCACACAGGTCAACCTGTGCTACACAGACAAGAGCCTCGAGCTCTCATTCATTGCCTATGACGAGGTCAA
TTACTTCTTCAATGCCTCTCAGGGTACAAACGACGACATCTGGGAGTACGAAGTCATGGAGGCTTTCCTCTACAAGGGC
ACCGAAGACCCTCAGACATACGTCGAGCTCGAGGTCAACCCCAACAACGTCACATACCAGGCATTTGTTTACAACCCCT
CCAAGAATCGCGCGGTCGGCGCACCCTTCGACCACTTCTTCGTTTCGGATCCCGCCACGGACGGCTTCAGCTCGAAGAC

FIG. 1 continued

TGTCCTCAACAAGCTCGCAAAGACTTGGAAGAGCACTGTTACCGTCCCTCTGGGCATCTTCAACGTCGACGTCGGCAAG
GCCAAGGGCACATCTTGGAGGATGAACTTCTTCCGAACCGTCGTCAGCCCTGAGATTTACCCTAATCAGACTCTTGGTG
GATGGTCG

> SEQ ID NO:539 214001 *Trichoderma harzianum*
TCCGTCCAAGCAAGGGAGGCCACGATGGCGAATGCCGCCAGCCCGGAAGAGATGCCTAAAATGCCTCCTCCACGGCTTC
TTCTGGAAGCATCAGTCAAACTCGTTCACTTGCATGCAGAGGCGCTAGCAAGGCCTGGCCGCATGCTGCGCGACTTTTG
CAAGTGAGTTCGAAGGAAAGCGGCCGGCCACGTTTTGGACATGGGGAGAGAAGAGAGAGGAGGGCATGCTAGTTAGTTG
CCAGATTGAGCGTCGGTGTCCAATGTATTCATGTTTCGGAAAGATTTTTGTTCTTCTTCCATAGCTATTGTAACGGCAG > SEQ ID NO:540 214003 *Trichoderma harzianum*
GAGGGCCGGACTAACACGGAACGAGACAGGGTGTGGATGAGACGTCGAGCACGTGTACCACCACTTTTGGGCAGCGGAA
GTGCGGGCGCGGGATACGTAAGATTGACGGGGTTTTCGAGGTAGTGGGAATGGTGTGTCTGCCAAGAGAATTGGCGTTT
GAATAGAGGCAAGTGGTTTCTTTTTTCTGGTGACAAATGAGGTGCGGGGTTTTGATATGAAGATGATGAGGATTGTGGT
GATGCCGGAGATGGGCTTGGGATGTGGTGGTTTGATGAGGTACCCTGGATGGTGATATTTGAGATTGGGAGGCTCGAGA
TGGGGGATCTCAGAGGAAGCAAAATAGAAATAGAAACGGACCTCGGCCGAAAGTAACCCAAAACACAATCTATGACGGT
TAACAAAAAAAAGAAC > SEQ ID NO:541 214010 *Trichoderma harzianum*
GGCAGGCAGACAGCATAGATGAGGAACTTGTTTTCATCCAGGCAGCCAAAAAGGGCAGTGCAAGGCAGGCATCGTCAGT
TGCAGCGCGGGTGATTGGCTCATCCGCCGGGCTCTTTTTTTGCCCTTCGACTTGCTTTGATGCCCGGAGGGATGTGAAT
CCAAAGAGAGGCGACCTGCCCAAAGAGGGAAACAGGGCAACGTGAGCGGGTAGATTCGCAGCTAGGAACAGGACAAGCA
TCACACATGTATGTAAGATGGTCACTCCGGCCCTTGCTCGGAATCAACCGCGGGGACCCGTGTGAGCAAAGATAGATAC
CGTATGAATATATCGTATCCTACG > SEQ ID NO:542 214014 *Trichoderma harzianum*
AATTTACAACAGCAACCTAAGCGCACCTAGATATCATGGCGGACAACACTAACCCCGGAAACTTTGCCAACCGCCCCAA
GGAGGAAGTGCAGTCGATTGCATCCAAGGGTGGACAGGCGAGTCACCAGGGCGGCTTCGCTTCCATGGATCCTGACAAG
CAGCGCGAGATTGCGTCCAAGGGCGGCCAGGCCTCTGGAGGATCTTTTGAGCCCGGAAGCAAGAAAGCTCAAGAGGCGG
GCCGCAAGGGTGGTTTGCAGTAAAGCATGACCGTAACTCTAGTGTCGATTCACTGGTAGACGGTGTGATTATCTCTTAT
TGTAGATAAACATACACTAGCAATTTTGCTCTAATACAAACTAATTGGTCCT > SEQ ID NO:543 214017 *Trichoderma harzianum*
GGCGGCTGCGTCTTCTCACAGCGCATAATGCCGTCGCAGAAAATACAAGCTACCTACCTAGGTATTGTGAGGAATGTGC
AATGGTAAGTCCCTAAGTACTAACAGAGGTTGAATTGCTACTAATAAGGGAGTGGCTATTCCACATCCCCGGATGGAGT
ATCCTCAGTCGCATATACTATTCTCACATAACAGTGGATGCCTAGATACCTATAGTATTACACTCTTTCAGCCAGCTCT
TCGCCAGCATTATATCCTGAAAAAAAGGAGCTATAGCATATATGCATGCACCAGCAGAAATCATCATCACACCAATCTC
CGTCTTAGCCCCCACCACCTGTCCTCTTCATCGTCAATGACATGTAGCAGAATGCTCAGCCTCATGTCGGCATCGAGTC
CGGCCTGGCGCCGCTTCTCACTTTCTTCATTATACCTTTCGACCGCATGAATGATCGCCATCTTGCTTCGTCTCGGCCC
CAACCACTCAAGCGCGGCCCTACCTGAAATATATGTGTCGTCCTCACATACCCCCTTGTAAGTGCCAGTGTGGAGGAAC
GCGTCGTTGTCATGCTCATGCTCGGGAGTTGGAGCTGTACTT > SEQ ID NO:544 214023 *Trichoderma harzianum*
AAAAAGGTTTGACCTTGGTAGACCAAAGATCGCCCACTTCTCGAGATGACATGACGGCAAACCAGGCTCTAGTGGAGTT
TGCTTTTAAGAAACGACGAAGCAAGGCGAAGGTGCAGGCCAGGCAGCATCTGCTTACTTGCCTCCAATTCGCCGCTCGG
GATGGATTGCAGCAAATGGGCTGGAGATGGCTTGCCCCGCTCTTGGACGCGTTGGCACATGCGTGGCACGATAGAAGA
GACTCGCCTTGCAAGGCATTCATGCATTCGGAGGAGAAGAATGTTTCATCTCGATTGGATCCCAGTCGGCTTTCTTTTC
ATTTTGGCGTGATCGCCTTGTGATTTTTGCATCAGCTGGAGTAGTTGAAGCTGCGTCATAGCTTCCCAGTGCTGCTTGG
AGGCTGCCACAACACAACTGGATAATGCCTGCTGTCAGTAATGGGCAGGCAATCGTTGAGGGAAGCTCAAAGGATATCA
GTCGTCAATTGGAGAGGTTGTTAGGGCAAATGATATTCAAAACCGGTGATTAGACAAGCCATGTATAGGCGATGGTTTT
TTGGTCAGTATGTTGGATTTGTTTGGATGT

FIG. 1 continued

> SEQ ID NO:545 214047 *Trichoderma harzianum*
GTGGATCGTAACAAATAGCCTTGCCATAGAAGACAAGGGAAACAATTTTCTTTGATTCAGTGTTCACTGAACCGTTGTC
TGTCGTTCATCTCGCTTGCATTGTGCCATTTATGAATCTCCAGAACCGCAACACCTTTGTATCGTCATCCACCCAAACG
TATGCCTTTCAACCATGGGAAACACGCTATTGAACCTATTCAGCTTGTCCATGTATAAAACGGAAATCAAGGCCTACGT
GGAAGGAACATCGGATCTAGTACTCCTGCGAATTATATCATAACGCCACCCGCTGTCCCAAGGATTT > SEQ ID NO:546 214052 *Trichoderma harzianum*
ATTGAGTTGAATGACGAAAGGAGTTTCACTGCTACAAATGTACTGTACAGAAGGTATACAGATTGACAGTCAGGGTCCA
CGATGCTTCAAGATCAGTCAGATCAGTCTCCCATCTCAGCTCCGCTATGACCTCAGCTGCAGAGCCGGGGTGGAGGCAG
CACTCGACGGCTCGGACTGCTAACAAAATCCCCACCGAAGATCGGCATCGTCTCCGAAGGGTCCCTTGGCCGGATACAG
AGCGAAACGACCGTGTTGGATCGCATTGCCCT > SEQ ID NO:547 214067 *Trichoderma harzianum*
GGTGATGATGATGATGTATTTCACGAACTATTATTGTACATGTTCACCCCTATTCAAGCAGCATCTTTCCCATAGTCAC
CAAACATGACATCCGATACAAAAGACACACGTCGTGACAAATACAATCTAATACACCAATCAGACGAATCTCGAAATTC
CACCATTTGCTATCCCATAAAACGCCCTGCTCCCAAATCCAAGCCTAAAACGCAGGAAATAACACCAATTCAAAAAGTA
GTCTGGCTCAAATCAACAACACACACAACACAACAAACACTCTTACAACGCGCTCACACAACCGAGTCTCAAAAGACTA
CATCTCTTTCTAAGCCAATCATCAGCCATCAAACAAACAAACAATCACCAAACCTCTCATCTCATCATCCAAAATGGCC
TTTCTTCAGCGCAACTTTTACACTCCCGAGACCTCTTTCACTCCCCTCTTCCGCCTTCTTGAGGACTTCGACAACTACT
CCCGCCAAGGCAACGACAACCAGCGTACCAGCCGCCGCACTATCGCTCACTGGCAGCCCAAGTTTGATGTCCGCGAGAC
GGGCGAAGCTTACGAACTCCATGGCGAGCTCCCTGGGAATGAAGAACCAGGATGTGCACATCGAGTTTACCGA > SEQ ID NO:548 214087 *Trichoderma harzianum*
AAACAACGAAACAACCGCCCAATCGCCAAGTCGCCGCCTCGACATGGTGCTCGGCGACTACGAGGAAGCACAATAGGCG
GGACGCGAAGCAAACAAGCGCTGGGCGTCTGAGAAGTAGCCCGAGAGTCACAGCTACAGCTACAGCTACAGTGAACACG
CGATAGAGTGATTCAGGACATCCAGAGACGAGACGAGGCGCCTGAACGAGATACGAAGCAAACAGACACGGGAAAGCAG
ATGCAATGTCGGCAAACGTAACAAAGCCGGCGCCCAATCGGCCGCAGCGGCGCGTAACGGCCGGCCAGATCCTGTCGAT
GCCGCCGAAATGGCTCGGCATGTACGACGAATTCATCACCAAGAACGCCGGCCAGGTGTCGCAGATTGAGAGCGCGCTG
AGGAGCTTGACGTATATCATTCCAGGCCGCTTTCGCGATGCTGAAATCGCCTCCGAGTCGATTCACTCGGGCGTCCAGC
TGGTGTCGCTCTACCACGACGGCATCCTCTCGCAGGCA > SEQ ID NO:549 214105 *Trichoderma harzianum*
GCGTCGAGGCGTCAACTTCACGGCATCACGAGGTTCCTGGACAAGCCGTCACCATGTCCACTGACGATCTGAGCACCCA
TCTGGCCGACTCCGGCATCACCATGCGGTCCGACAGCGAGCAGTACTCTCCGGGCGATGAGGTCTCATCACCCTCGTCA
TCAAACTCACCGGTTATTCTCTACAAGCCCCCCACAGCATGGAGTCTGATACGGAGCGCCGCCATCAATCTGGTTCTGC
CATTCATCAACGGAATGATGCTGGGATTTGGAGAGTTGTTTGCTCATGAGGCAGCATTCCGGTTAGGATGGGGCGGTAC
AAAGGTTTTCCCTCTTTCTCGAAGACGAGCCCACCCCATTGGCCCAGGCATCGAAGTCCGTGAACGACCAGAGCGACCC
GGGCCTTCACTAAGTGATTACGCAAGCTTAGAGTANAAGGGAAGAATGGAATGAGGACGATAGGGTATTGTATATGAA
TCAATCATGTCTAAATAAACAGATGCAGGCGCTTTTCCAAAAGACTGTGGCCCATCTGCTGCACTTTCAGAGCTCCCCA
ACCATA > SEQ ID NO:550 214110 *Trichoderma harzianum*
GGAGCAGCTGTCCTTGACTCCAGCTAGGCATGGAGAGATTTTTGGGCGGTTTGCGGTGCCTTTTGCGGTAAGGCTGAGC
AGTGTTTGAGGTCGGGAGAATGGATGGAACGAAATCGAGTTTGGCTGCGTGGGGGCCGCAGATCGCATGTCAGATCGC
CGGTCGGTCTGCTAAGCGATGCTTAAAGTCGGAATTGCCCGATCGAATCTCCATTCCGATGGCGGAGATAGAAGGCTGT
ATGATGGAGAGCCAGTCTGACGAGAACATGGGAAAAGATGGAAGATGGGGATGGAAAGGAAATGGAGATGGAGATGGCG
ATGGAGATGATAGAGATGGAAAATGGAAGATGAATATCTATTACTCTGGGCTCGAAGAGAGTCAGTAGAGTCAGAACGG
TGGGGGAGAGATACCTTAGGCTTTGATGTGCTGAACGCGCGAAACATCGCGAGAACG > SEQ ID NO:551 214117 *Trichoderma harzianum*
GGAGTGGTTCCCGTTGTATAACAGGGCTGGACTATACTTCTTCATCTTCAGCTACACATACTCTCAGGCTCTTTCAAAG
TATTCGCCGGAGTCGTCTTTCCCCGACATGGTCATAACAAGCTTACAGAATGAGCCACGGACTCGATAACCTCACCGGC
CTCGCCGAGGGTATCGGTCTGCGCTTTCTAAATGAAGAGTGGAACGATAGCATCTCAAACGACCACCCGTTCACCATCC
AATGGAACGAGTCGCTGGATGGGGCTCAGGCACCAGAGCTTGGGCTGTTCAAGATTACATATCCCAAAGATGGCGTTAT

FIG. 1 continued

CGCATACGAGCTGGTATCAAATCTGACAGGCCGCATGAATAATGAAAATGCAACATGCTTGTGGACACCAAGCCACTTG
GACGACGAATTATATACTCTATGGCTCTCATCCTCTCGAGACGCTCGCGCAAATTGGACGACGTCTCCTCCTTGGAGAC
TAAAAGAAACTCCCCGACATTCACATCATTGGGCCGCCCCCATTGTTATCCCCATTA

> SEQ ID NO:552 214135 *Trichoderma harzianum*
AGAAGCTTCGAAGCTCTCGAGATATATATTCGCTACTGAGCCACATCCCTCCACTCTAGCTTCCCATAGCTATCACCAC
CGCACTCCCCTACACAACCAACCCCCAACAGTCATCATGAAGGTCGTCACCAAAGAAGAAGAAGCCGCCCACTACGGCG
CTGTCGTCAAGGGCGGACTCATTGGTGGTACTCTTGGTCTTGCCATTGGTGTCTCTGGTGTTGTCTACGCCTCAAGGCG
CTACCCCAGCTTCCGTGGCTTGACACTCCCCTTCCGAACTTTCCTCGTCACATCCACCGCCACCTTTGGAGCCATTGTC
CAGGCTGATCGAGCTGGCATCAAGTTCCAGCAGGGCAAGGACCCCATGAAGACCTACCGCGATGCCTCTCAGCGTGCTC
AGGAGGTTATCCGTGAGAACGAGACTGCATACGAGCGATTCATGAACTATGGACGCGAGCACCGCTACAGCATTGTCTG
CGCCTCAT > SEQ ID NO:553 214138 *Trichoderma harzianum*
GAGACTGTTATTGAAAAGACTCTTTGCCTTGGTTGGCAGATTGGTTGTATTAGGCATACTGTTTCGATACGCTTCAACG
TACTTTTTGAGTCGCAAAGCTACCATGACTGTGGCTCCTGTGATTGCGCTCTCACATGGTGGAGGTCCCCTCCCTATCC
TTGGTGATCCCTCTCACAAGGACATTGTTTACTCTCTCAAGAACAGAGTGCCCAAGATTCTCAAGCTCGGCACTCCTGA
GCAGCCCCGTGCCATTGTCCTTGTTACGGCGCACTGGTCGACGAAGAACCCGACCATTTCATCTGCGGCTTCTCACGAC
CTCTACTATGACTACTACAACTTTCCCAAGGCGGCCTACTCGCTCAAGTACCCAGCGTCAGGCCAGCCAGAGGTTGCGC
GCGAAGTCAAGGCGGCGCTGGAAGAGCAGGGCCTCGCATCAGTTCTCGACGGCGACAGAGGATGGGATCACGGCGTCTT
CATTCCCATGCTGCTTGTGAACCCTG > SEQ ID NO:554 214144 *Trichoderma harzianum*
AGAGATTGGAGTTTGATAATTCTTACAAACTTGTACATAATACTGATGCATTCAGCCCTTGGTCCTGATGGCATGAGCA
GACATAGCCTCGGCCGACGATTTTGCCCCTGCAATGGTTCTCTGCCGATGTTTCCCGCAGCTTCTTGGCAGTTGGGGTA
ATACGATAATACGACGATGGCATCTTTGGCCTGCACGCCGAATTGGGGTCAAATAGACGGTATTCCGAACATTTCATAT
TTAAGAAGCTGTGCTGCACGCCAACCAACCTTTGGAATGGTGTGAATTGTGAAGGACATGATGCATGGTATAGGCCATG
AGCTAGTCTCAGAGAGATGGAGCCTCCGGTGTAAAAGTTGTACATTAATACGATCAAAGCCCGCTACGAAAAAAGAATG
GCAATTGTATTAAAAA > SEQ ID NO:555 214146 *Trichoderma harzianum*
CCCACGCGTCCGCATTGACTTTGAAGCTCTGTAATTTTGTTGGAAATTTCGGGGCGTTTGAGGCTGCCTTTACCATGGC
CGCTCCATTGGCCACCGCCAAGCAGCAGCTTAGGCGTCTCCTTAAGCAGAGGCTCTCCAAAGTCTCTCAGGATTCCGTT
CTCGCCCAAAGCAGCACAATATTCGAAACGCTCAAAACCTTCAAGCCCTACCAAGACGCCAACCGCATCAGCGTATACC
TCTCCATGCCCGTCGGAGAGATTCAGACGGACGCAATTGTTCGCCATGCTCTAAACTCGGGAAAGCAAGTCTTTGTCCC
GTATCTACACAAGTCACCCCTAGACGAACCTGGAACTCCAGCTCGCGTAATGGACATGGTTCAACTGCAGGATGTCCAG
GACTACGACGGCCTTCAGAGAGATTCTTGGGGGATTCCTAGCATAGATCCAGCTACCGTTCATCTGCGGCAGCGCATCC
TCGGAGGACCAGATGTGCACAAATCAGATCAGTCCACCTTGGATCTGATCCTTATGCCTGGGTGTGGCTTTTGATACCG
ATAGCGCGGG > SEQ ID NO:556 214158 *Trichoderma harzianum*
AGCGATGGAGGACGAGATTCGAGGTCCTTGCTTGGCCCGGGTGGCGTGGCGTGGGTGTGCCCGGGGCTGCGGTCCTGGG
AGCGGGGCCTTGCTGCTGAAGAATTTCAGAAGTTTGGAAACAAGGCACGTTGGGATTTGTGCATGTATGTAGGTACTAA
TGTATGTATGTATGTACATCCAAGTACATGTATACCTATGCGAGGTCGGACCAGCCACCATGTACCTACAAAGGAATCA
GTGCAAGCGTGCATTCAACATGACATGTCAGGTAGCGGACTTGACATGTTTGCTGGTCCCTTGCGCGAGACGAGATTGG
GATGGACAAGGTCGAGGTGGCTTACCACGTGAGTTTAGTGCACAGGGCCGCCTGCAATAATGGGATCAATCTGATTATG
GCCTCAATTCCAATGATTACAGTTGAAAAACAAAAACCAA > SEQ ID NO:557 214162 *Trichoderma harzianum*
AGCCGAAGCGCTCGTAGTATCTGATGTTTGCTTTGGAGCTTGACTCGAGTTACTTACCTTGGCAGCCATGTCCATGATG
AGCTTCTTGGCATAGCCTTTGCCTCGGGCGCTCGGCTTGGTGCCGATATAAGCAAGGTAATAATACTCACGATCTCCCA
TGACCTCGTCCATGGTCTCATGCAGAAGAGGCAGGACGTCTTCGTAGTAGCGCTTGCGGCCCTCGGAACCAAGTTGGTA
GTAGAGGCGCCACATGCCGCTTCGGAAGATGGTCCACCAGTCGTCCATATGCATCCCGGGAGGCATCCTAAGATGAACA
GACGTCATAGTCAGGACCAATGGTCGTGACAACGCCGCTATAGCAATGGGCCGAGACCAGATAGGTCATGATGCGGACG

FIG. 1 continued

```
TGAAGCTTCCACTTGGTCTCGTCCGAGTAGCGGTCCTCGCCGTCGCCGTCGAGAAGATACATGCTCAGAGCATCGGCGG
CGAATGCGTGGGCGAGAGAGACTCCCGCCTGCTCGCACTCGGCCAGACCGATCTTACGGACAGACTTCTCCCAGGCCTG
AGGGACGAGAGAGCGACGACGGTCCACAACAACGGCAGAGGAAGCTGTCGTAGCAATGGTATTGATCGCGGGCTTACTT
ATAACATGCGCCATGCTGGGCT

> SEQ ID NO:558  214172  Trichoderma harzianum
AAGGCGTAATGCCAGGCAGCGTCCACCGCCTTTCGCCAGCTGCCTAATCTCTGCCAATGCCAATCATCATCACCCATTA
GCTGGCTAAACTCTCACAATTCCCACTTCCCCAAAACCCACTGCTGCAGGAGTGCTGTGCCAATTGCTGGCCCACGAGC
TCGAGGACGTCGAACCATGACTGCAGAAGCAAGCGGGCGTCAGGCCCCGGCCGAGTCGGTTGCACCGGCTTCGGAGCGC
ACGCCGTTGTTGGGATCCGGCGCGTCAGAGTCACGCACAGACGGCAGTGGATTGACGGGGGCGGCGGCAGCAGCGGCGG
CGATTCTGAGACGGCATCAGCGTAATGAGAGCGAGAATGAGCGGCTGCTGGCCGGAAACGACGACGACGATGATGGCGA
CAATGGCAATGGCCAGGAGGAGGAGACGACGGTGGTGGCCGAGGAAGTGTCCTTCGCCAAGCTGTGCCTCATCATGGGA
ACCGCCTACCTAGGTGTCTTCCTCGGGGCAATCGATTCGTCCATCATCGCCACGCTCTCG > SEQ ID NO:559  214178  Trichoderma harzianum
AGACAAGAGTGAACCACGCATCATCCACGCTGAGATTGAGATGACCAAGGGGGAAAAAAGGGGGGCAAGTTTTCTGTTT
ACGCCACTGGGACGAACTCCCCTTTTTTTTGATGAGAAGAAGAAACGGATGGTTTTAGTGTCTTACGCATATATATGAA
CTGAGCGGCAATGCTTAATACCGTGTAGCTGCTTTGCTTTGCTATTTACAGAGTGGCGAGGGGGGAGATTGAGGAGGCC
TCTGGAGAAAGCAAAGAGCCTTAATGTCTGTTTTTACCATTGGATGGTTTCTTACTTCCAAGGTGGCTCTTAATTTGTG
CTTACTGCTTGTTGGAACACCGACTGTTGCTTCAGT > SEQ ID NO:560  214188  Trichoderma harzianum
AAGTTGTGAAAGGGGTTGCAGATCCAATAATGCCACGCCGATCCATATCGAGCAATGTATTTATACCCAAATCGTCCCT
TTACCGAAAATTCCGAGCCTCTCTAGCGCTCGAATTTATCAATTTTTGACGAGTATCCATGAGCTCCGTGAAAATCAAC
AAGAGATTTCAGGACATATAGAAGGGAGGGCTTAACATATATGGATATAAATTTTTCTATTGCTTCATCCAGCAACAAA
CCCTTACTGGAGCTCCTGTCAGCCACCGTCGAGATATTCCTGGAGGCGTCACAAAACTCTATGTCGATCTCATAAGATC
AATCGTCGTTGGCGCCCATACTGTACTCTGAGCTACAAGTTTGAGAAAAATACTTGGGTCAACATACATTTACTACGTA
TCTTGAATTCTCACCAGCATGATTGATGGAATACAGCACCACGTTGAGACATAATAGCTTGGTAGTACTGTACGGGCC
GCCTCAACTATGGAGACGTCTAACCGATCGCGAGTTTAGCTCTCCCGGTACGAGTAGCCGTCTTCCGGGCCGGTATTTG
GTGCTCGGACCTG > SEQ ID NO:561  214194  Trichoderma harzianum
GGCAGAGCTACAACGGCCCTAGCACACAATTGGCCACAATTCACGCCTCACAATCGCCAAGATTGCTCTAATTCTCGGG
CAGTCAAGTCTTGTCAAGTCTTGTCAAGTCTCGAACTCGTATCCTTGAGCATATGCAGGTGGCGTCTGTGTCTCGAGAC
AAGAGAGGGTGAACATGTGCACAGAACAAGGCACCGAAGCCGAAAGGGACAAACCGAAGCCGAGGTGGGAAAAAGGCGC
CACGAACCAGTATCCAAGAGTTTAGCCACTGTGTCCTAATAGAATCCCCCCTTCTTTTTTTCCTTC > SEQ ID NO:562  214201  Trichoderma harzianum
GACCCTTGCTTGAGTACAATAATTTGACAATGGGTAAACCATTCCCGCAAGTTCAGCCTGGAGGGAGCCTGATTCTGGC
TTACCGCGTCAAGGACAAGAATGTCCTGGTGGTAGGCGGTGGTGAGGTCGCGGCTGGCCGCATCCTCAACTGCCTCAAT
GCCGATGCCCAAGTCACCGTCGTCTGCCCTGCGTCAGGCCTCAACGAAGAGGTCGCATTCCGAATTGCCGAGAAGCAGG
TGACACACATCGACCGCCTGTTCGAGCCGTCCGATTTAGACAAAGCAGACATGGTGCTGGTCGCCATTGACGATCCGGC
AGCCTCGACAGCGATATGGAAACTGTGCAAGGAAAAGAGAATCCCGGCCAACATTGCGGACGTGCCCCCTGAGTGCGAC
TTTTACTTTGGCAGCGTCCATCGTGACGGGCCTCTACAGGTCATGGTCAGCACCAACGGCAAGGGACCGGGGCTGGCGG
CATCACTAC > SEQ ID NO:563  214221  Trichoderma harzianum
CGCCAATCTCGAACGCCTGTCAAAATGCTCTCCCGCGCCGCCACTCGCACCACCTCCGTGGTCGCCCGCCGAGGCTTCC
ACACCACCCGCCCTCGCATGTCCTCTCCTTACCACTACCCGAGGGTCCTTACTCCAACTTGCCCTTCAACCCTCGCAG
CAAGTGGTTCGGCGCCGGCTACTGGGCCTTCATGGCCACCGGCTTCTTCGCTCCCTTTGGCATTGCCGTCTACCAAACC
TACAAGACCCAGTAAACGGATGCTTCGATTACAAAAGGCTTATATGGGCTGGACGCTTGGTGCTATGAATGGGTGGTGG
ACTGTTGCGACAGAGTAAATAGCTCGAATTAGACGTGGGACCAATTCACAAGTCACATACATCANAG
```

FIG. 1 continued

> SEQ ID NO:564 214235 *Trichoderma harzianum*
GAAGCAACCAAGAATCTGCACCTCACTCGATAATAAAAAGAAATCGGTACTCAAGGTTTATAACTCATTCAAAATGCGT
TATACTGCTGTCCTCGCTGTCCTCGGCTTCTCCGGAGTCATGGCCAACAAAAACTTCGGACCCTTCGGATTTTTCGGAC
CCTGGTTCGATGGCGACTTAACTATCGATGACCTCGCTGACTTTCAGTTTCCTGAGAACCCTTGTGAGTTCATTGGTGG
TACTTGCGAGATCGCCACTTCCCTTACATTCTGCGCTGGTCGGGGCGACTTCAGCGTTGATTTGCCTTGTGGCGTTGGC
CTCGGCTGCTGCTGGCACCAGGACACCAGCAATGTTTGGTTTGAGCAATGGAAGGAGTGGCTCGAGCTACACAGCCGCA
TCAACTAAAGCCGCTTTAATGTCTTGACGCTTTGATGGCTTGACGCTTCTATGGCTTGACGCTTCTATGGCTTGATGCT
TTAATGGCTTGACGGAGTCTTCAATTGGCACGGTAGTGGGTGATGGAGAAATTAGCCGTACTGAACTCAATGAGAGATT
GTTAACCCTGAAAA > SEQ ID NO:565 214242 *Trichoderma harzianum*
ACCGCATCTTCAATCTCGTTTGCCGTCTTTGTCTTTGCGCTGACAGAAGCCCTGCCGAACCCGAAGAGCCACCGCCATC
CGTGGAACGAGATTAAAAACCGCGTAAAGATCCGGCCAACAGCGGGAGCAAAAAAGGAACCTGGAAAGGATAAGGGAAC
AAGAGAAAGAGAAGAAGAAAAAAGGGTGCGCTCTGTTACAAAAGCAAAGATGCCGGATCTCAACTCGGTGCCCCCCTCG
CCTCACGTCCTGGCCAGCGGAACACCTTCTCGTCGTCAGTCGGCCAACTTGCAGTCCGCATCATCGCCGCCCTCTGCGT
CTGCCTCTGTCAACATCCTGCCTTCCCCCCGCCTCAGTCGCCCATGGGCTCAGCCGATGCCGCCGTTGGGCCAGGCCCG
GGACCTCTGCGGCACCCGAGGCCTCTGACAGCCTCTGAGCTTCACATACAGCTGGAAAAGGAGCAGGAGGCAGTGGTAA
ATCGTCTGACTCGCGAGCTCTCGATGCTTCGGGTCGCCCACAATGCGTCGGTCGTTTCAAACGCCTCGTCGACGTCGAA
TGCTACTTCTTCCCACGACCCCATTGTCGAGTCGTCGCT > SEQ ID NO:566 214250 *Trichoderma harzianum*
ATCCTTTTTCTTTCTTCAATATCGCCTCAAATCTCACTGCAACTCTCTCCCCTCTGCGGCATCTTCACCATGGCTGAAC
CAACCCCCGGCCTCACTCCCGAGCAGCTCTCGGCCTTCCAAAAAGACGGCTATCTCATCATCCGCAACGCCCTCAAGCC
AGAAACCGTCTCATCGCTCCTTAGCGAAACAAAGGGCCTGCTCGAGGGCTTCTCCCTCAAGGACCACCCGCTGACTCGC
TTCTCCACGGGCGAGAAGTCGGACCACGTGGGCGACGACTACTTCCTCACGTCGGGCGACAAGATCCGCTTCTTCTTCG
AGGAGGACGCCTTTGACGACGCGGGCAACCTGACCAAGCCCAAGGAGCGCGCCGTCAACAAAATCGGACACGGCCTGCA
CGTGCACTCGCCGCCGTTTGCGCGGCTCATTGACGAGGCGTCGACGCGGGCCGCGGGCGAAGTGAGTCCTGCGGCTGTG
GCTCGTGATCTCGGGTTCAAGGATGCGCGGTGTCTGCAGAGCATGGTGATTTGCAAGCAGCCCGAGATCGGGGGCGCGG
TGCCGCCGCACCAGGACTCGACGTTTTTGTACACGAGC > SEQ ID NO:567 214256 *Trichoderma harzianum*
ACTGCTTCGATTCCGCGCTCGCCTGTTCATCTCTCTACGAAACCGCCCCCCAACACACGATCCTACAAGAGGAAAAGCG
GATTGATTAAGACCCGCCAAAGAAGAGGCGTCACGCAACATGGCGGAGGAGATCCTGGACAAAGTTCGGGATGTGGTGG
AGGGCCAAATTGACTTTGAGGGCCAGAGACGAGCAGAAGGCCTTGCCACTCTGTTACTTGCCCTGACAGGACTCATCGC
ATTCAACGTCGGATACGTACTACAAGACATCGTCAAATGCCTATATGTTGGACTAGGAGGAACGGTCTTGACATTTCTC
ATTATCATTCCGCCGTGGCCCTTCTATAACAAGAACCCGGTCAAGTGGCTGCCTATCGGATCTGCATTTAACACGGGCG
GGACATGACGACTGGATAACGCCGCTCTGAGTAGGCCCCGGCGTTTTGTCACGTTGTCAAAATCAGCATGTAGCTTAAA
TCTTTTCGAG > SEQ ID NO:568 214259 *Trichoderma harzianum*
AAAGACCAAGATCAGGACAAGACAATTCGAGAGTGCCAAAAACAGCAAAAGGGCAGAGAGACGTCATCATGGCTCAGGC
CAAGTTCGCCGTTTATCCCAGCCTCGTCGACCGCACCGTCGTCATCACAGGTGGTGCGCAGGGTATCGCCGCCGACATG
GTCGAGCAGTTTTCCCTGCAGGGTTCTCAAGTCATATTTTTCGACGTCGAGGACGAGCTTGCCGCTGATTTAGTCCGAA
AAGTGTCTGATCAGGGCGTCAAACACAAGCCCATATACTACCACTGCGATGTCATCAAGATCGACGAGGAGCTCAAACC
CACAGCGGCCAAGATCCTGAAAGACCATCCCAAGATCGACGGACTCATAAACAGTGCCGCGAGGGCAATGGTGAAGCCC
TCGCAGGATATCACGACTGAGTGGTGGGATGAGAGCGTCCCCGTGAACCTGCGGCATCAGTTCTTCCTGACCCAGGCCT
TGCTGCCGGGGCTTCTCCTTGCTGCTGGAAACGCTTCGGTGATTAACATGGGGAGCA > SEQ ID NO:569 214262 *Trichoderma harzianum*
GTTCGATGCACTGCCACCATCCTCGGAGAAAGGTGTGTGTAGTGGACAATGTATGTGTGTCATTGAAGAAAGTAGGAGT
AGGTGGCGGCTCCTTGGCAAAGTGGCAATGTTGCTTGGTATTATGGATCGGTGGGTTGTGCCCAGCTGGAATGGCTTGT
CTTGGCGATAGGGGGAATATGGAGTCGTTTTGATGGGAACGGCCTTTTTGGTTTACCGAGGAGGGGTCAACATGTGCGA
GCATGTATGTTCAAAGATGGGAGAGGGAGAGAAGAAGAGAGAAAAATCAAGAATCAGTCGTGCCT

FIG. 1 continued

> SEQ ID NO:570 214264 *Trichoderma harzianum*
TCAACATAATGTCGGCATACGGCGGATACCAAAAGACTAGCTACGGCGCCCAGGGCGGCGATGACTCTGGTGGCTTCTT
TGCCGGAGGGGGTTCACAGCAAGGCAGCCAAGGTGGTGGTGGTGGCAAGTCATACCAAGACGAATCATTACGGCCCTTG
ACCATCAAGCAAATCCTCGAAGCTGAGGAACCGTACTCTGGTGCAGACTTCAAAGTGGACGGCGCTCCCATCACTCAAA
TCACATTCGTCGGCCAGGTTCGCAGCATAAATCCACAACAGACGAATCTGACGATCAAGGTCGACGACGGCACAGGGCA
AATTGACGTCAAGAAGTGGATCGACGCGGACAAACAAGGCGATGCAGAGCCCGGCTTTGAGATTGATTCACACATCCGC
GTCTGGGGTCGTCTCAAGTCATTTTCCAACAAGCGACACGTTGGAGCCCACGTCATTCGACCAGTAACGGATTTTAACG
AGGTCAACTACCACCTACTCGAGGCGACATACGTACATTTGTTCTACACTCGTGGCGCCAGCGGTAACTCCGGTGCAGG
ACCAAACAACAGTGATAGCATGTTTGTTGATGGCGGCGATGG > SEQ ID NO:571 214267 *Trichoderma harzianum*
AGAGCATCTTCCTGACATGCCGGGGTTGATGCAACGCTTTGACTGTATGGAAACATCCGTATTGCTGACATACATGTCT
TCCATGTTGTCTTACACTGCACTCAGGAGGAGCAGTCATCCACCGAGTTGATTCACATGGCAGCAAAATTGTGCTGGAT
CTACTGCAGCGCAGATCCTCTATTTGGGCATTTCTTCTCGGAGACAGACACAGATCGGCTCGGCGAACCCGAGAGCAAG
TGATAGCAAGACAAGCACAGATATGCTTGGCGAGGCTGTCCTCACCAGGAAACGAAAGAGGAGGTTTCACCAGCAACTC
CATTCCCAGCAGAGGTCAGCCTGTCCTACCTGTCACATTAG > SEQ ID NO:572 214270 *Trichoderma harzianum*
GCGGGAGGTCGCAAGTCCAAGGCCGCCGCACCGGCTCGTCCCCAAAAGACCCTCGTCGTCGACAATGGCGCCTGGACGC
TCAAGGCCGGCCTCGTCTGCGGCGGCTCGATTCCAGAGCCTCGCGTGATCCCCAACTGCATCGCGCGCGACCGCTCCAA
GAAGATTTACGTGGGCTCCGAGCTCGAAAAGTGCCGGGACTTTAGTGAGATTCAGTTCCGGCGGCCCGTGGAAAAGGGC
TACCTGGTCAACTGGGAGGCGCAGAAGGAGATTTGGGACCAGGAGCTGTTTGGCGACAAGGCAGAGGTGAAATGCGACC
CCAGCGAGACGAGACTGATGCTCACGGAGCAGCCGAACACGCTGCCTGTGCTGCAGACCAACTGCGATCAGATTGTCTT
TGAGGAATACGGCTTCTCGAGCTACTACGAGGGATCGGATCAACATTCAATGCCTATCACGACCTGCAGAGCCTCTTC
CGCACGCCAAAAGACGTCCTCACAGCCGCAAACACGCCAGCTGAAATCATGCTGGTCGTCGACTCCGGCTTCTCGCACA > SEQ ID NO:573 214275 *Trichoderma harzianum*
AGATTGTGAGAAATACGAAGATATTAGTGGATTTCTCGTACCAGGAACGAGGACAGACATTGGTGTGTTGATGAAAATA
GAAACTTGAACCGGCGAAACCTTGAACGGTGAGTACGAGATATGGAAGACGAATAGCAGCGTATGAGTCAAGTTGCAGC
ACTAGACTTCTTGGTTAGGCCCTTTTCTCTTCCCATTTTCCCGCCATGAGCGTGGATAGATGCATCTACATGGTGATAG
GCGAGCCGAAATCGAATCATTTCTCACGTCTCCAAAGGCCCAGCCCTACGTTACAGCCGGCCATCGCTAAGCAGATCGC
CTACTCGGTGCTAAATTCTGACTTCTCAGGCAGCACGAGATGCCGTCCAGTCGCTGCTTGTTCACGGGCACAAGGGGGG
GATCTCTCCCTTGATGCCTACTTGTATACGAGAAGAGAGACGACGGACATTAGCCGCATGCAAGATTACGAACGGGTCA
TCTCGCCAAGAGAAAGCTTGTGTTGTATGTTACCGCTTCTTTGGAATTAATCGCTATCGAAAGGAACAGGGCCTAGAAC
TTAGTAGCTTCCCATCGAAATTCTCGTGCTATTGTTTCCTTGA > SEQ ID NO:574 214276 *Trichoderma harzianum*
GGCTGGCTGGCCTGAGACGATCTGGCAGACCAACAACGAGACAAGGGCTTTGCCGGCGGTTAGACCCCAGTGATGAGAT
TCGCAAACAGGCGCGCCCGCTGGGAGACGGCCCCCAGCTGATTGATTGATACCTGGTAGTACATGGGCAGTTGGAGTAC
TCGTATGGACAAAGTACCGTACCGGTACTCGGGGCTTGTAAGACGGCTCTCTGGAGGGGAATACGAGCTGGCAAAACAT
TAAAAGGCAAGGCTCAGGGCGGGCTGTAAGCCGCAGCGCAGTGGCTCTTTTTAAGTTGTCGGGGAGATAGATGGCCACA
GCCGTTCTGGGGACCACGACGGCAAAAGGAATTGAGAGAAAATAGTCTAAAAGTATGTCCTCTTCCGTCAAGCACAAAG
TCGATGGACGCCGTCACCCCAAAGAATCTGGGTGTTGCTGCAACGGGATCATCCCCAAGGCTGGATTC > SEQ ID NO:575 214279 *Trichoderma harzianum*
TCCTGCACAAATTCATAGCCGTACGCCTTCAGGCGCGAAGCATGGCGTCTACAAGCAGGACTTACAATGATGCGATTGA
CAAGCTCAATGAGCTGCAGACGCCGTTCGCGGTGATTGAGGCCCGTCGCAAGGCCGGGATTCTGCCTGATTCTGTGCTT
GGCATCGCCAAGATGAGGGCGTATCTCACAAGAATCGGATACACACCCGCGGATCTTGATCGCCTCAACATTGTTCATG
TCGCGGGCACAAAAGGAAAAGGCAGCACCTGCGCCTTTGTCGATTCCATCTTCTCTCAGTACCAACAGCACCATGGTGG
CCCTCGTAAGACGGGACTCTTCACATCACCTCACCTCATGGCCGTGCGTGAACGCATCCGTATCGATTCCAAGCCCATA
TCCGAGGAGCTGTTCGCAAAGTACTTTTTCGAGGTATGGGACCGACTCGAGGAATCGCGAGAGGCTCCCGAAGAGGACA
CGCCTTTTGGATCAAAGCCCGTGTATGCTCGCTATCTTACGCTCGTGAGCTGGCACGCATTCTTGCAGGAGGGCGTCGA
GGTGGCAGTGTACGAAACCGGAATAGGCGGCGAGTACGACTCA

FIG. 1 continued

> SEQ ID NO:576 214283 *Trichoderma harzianum*
AAACGATGACGAAAAGAGAGCTTGTGCTCGAGAATAACCAACAAGATGTATCCAGCCCAGAGAAGAGGTGGAAGAAGGA
TATTGATAATGTGCAGACTCCTTTGCGGAAGCTGAAGCCTGATGACTATACTGTCGGGTGGATCTGTGCTATCACAGTC
GAATACGTTGCTGCGCAAGAGTTTCTTGATGAAGAACATGAGGGGCCGAAAAATGTATCGCTTCATGACAACAACAATT
ACACGTTAGGCAGCATTGGGGAGCACAACGTCGTCATCGCCACCTTGCCCCTTGGGGAGTATGGGATAGCGTCAGCAGC
AACTGTTGCTAGGGACATGATGCACTCGTTTCCCAATGTCAGAATTGGTCTAATGGTCGGCATTGGCGGCGGCGCTCCG
AGCGAACAACATGACATCCGTCTTGGTGACATTGTAGTCAGCGCTCCAAAGAACGGTAACGGTGGCCTGCTCCAGTACG
ACTTGGGCAAAAATATTCAGGACCAGGAATTCTTAGCTACGGGATTTTTGAATCAACCACCCGTTGTCCTGCGGGCAGC
ACTGGCAGGGCTCCAGGCTCAATACGAGAGAAAAGGCCATCG > SEQ ID NO:577 214291 *Trichoderma harzianum*
AATGTCAATGGAATTGAATGATTGCGTCCTGGTACTACGACTAGGACTTGTACATCAATGTATGCCGGCGGCTGACAAT
CAAGGTTCTCACAGCGGCCGGTTACCCGTCAGCATCTGCCCGTCAAAAAGGGAGTTGATAAGATTCGTTGGGTCGAATA
GTAGATCGTTGATATGGCT > SEQ ID NO:578 214295 *Trichoderma harzianum*
AGCCAGAATGCCGCTGCAAAGGCCAGGGCGGACAGCAGCATGAGCCGCAGCCGCCGGCGCAACAGACTATGGGGGAGCA
ACATATGGCTTATGGTCACAAATCAAATGACCTGCGACGCGCGGGCATACGTCTAGGTTCGTAAAGACGCTGTAACTCC
GAGCACAGCAAACTGGCGATAGTACGGTCCAGGCTCACAAGCACGTGGGCTCAATCGAGTTAGTCCCTTCGCGGGGGGG
AATCCCGACAACTTGCAGCACAGCACGCAAGCACGAGATACGAGACAATTTAGACGACTGTCTGTCTCTGACAGGATGA
CACGCACAAACAGTAGCTCTGTTCTGTTCTGGAACAAACCGGCGAGGCTCAGAGGGTGCTTCGACCAAGGCAAGGCAGA
GCACAAGCCATGAGCCAGAGCCCAGAGAGAACAAGGCCAAAATCCAACACG > SEQ ID NO:579 214307 *Trichoderma harzianum*
TGATGATGAATAGAATGATGGACCAAGGGAATGGTTGGTAAGATGTTCTGGGAGGAATCTGTGTTTTTCTCAGGGTGAG
AGTGTATAAATGTGTAGCGTGTACATGTGTTGAGGCTCGTCGATACCCGGCAACATGATGACTGTGCGCCACCGGCCAT
TGATTTGTGCTGATCTCTGCTTGATGAACACTGCCCTGTTTACACTGTCGTGTACTGTTAGTATGTCCATCGTGAAATG
GTGGTGTGCGATGTTTGTCGCGGGCTATGAAGATAAAGCAATGAG > SEQ ID NO:580 214309 *Trichoderma harzianum*
AGGTGCTTGTTGTCTGTTTCTGTCTAGAGGTATTGGATGTAAATAAGATCAGCACGAGATGAGATGAGATGAGCAGACA
GACGATCAGATGGCGAGATTGAGAGGCAAATTGCAAGTGAATTTAAATTGCTTCGCTGGCGCCTAAATTGGAAGCATCC
ATGGCTCGCCTTTTGCCTCCCCACGTGTGGAAAGTAGAGCCGAGAGCGATCCCTAGCGGCTATTCTATTCTGGCGGTTT
GGAGTCAATCTGGCCCCCCGGAGATTGAGATGGTGGCTGTCGAGGTGCCGGATGGGATGGGATGGGCTTGTCTTTGGAT
ACTTCATCTTTTCATC > SEQ ID NO:581 214326 *Trichoderma harzianum*
GGGCGATACGTCGAGATGATTCGTCCGCAGCTTCAGTCCGTGAGATGCTGGTGCTATCAGATGCTAGCAGATGTTATCC
CAAGTTACCCGATGCTACAGACCATCCACGCTGCAGATCAACGGCCGCTTCGTGATGCAAGTCTCACGCAAACTTTACC
CTCTTTCAGTTCTTACGAGATGCAAGGGATTGATCCACTGGAGTCAGAGAATCTGAACCGCGACCGCGACCGCGACGGC
TACGCGCAAAGTTTGGGCCAGTGACTGACGCGGCCGTTGTTTGTCATCAAGAGTCACAGAGTTCAATGGCCCTCAGGAC
AGCGGCATTTGCTGAATACGAAGCGCTGTGCTCATGGCATGGGGCAATGTTCCTGCAGTAGCGCGTGATATGCAAAACC
TCTGTGCCGTGCAGCTTGCATGATGCTAGGATGCAAGAGCCACTGCGGTTCACTGGGCTGAGCCCCCAGACTCCTGACAT
GGCTTACAATACAATATGGATGCTGTGCTCGTAAGCAAAAGGCTTCTCCAGTAGGTACCTTGCTGCCCGTTTGGAAAAG
CGCCGAGAGCCCATGAGATATCGCAACACCGGGCGATTAGTCGTT > SEQ ID NO:582 214329 *Trichoderma harzianum*
GGGATCATCGTACATGATACTATTGGCGACTTGGATTTCTAAGAGGGTGTCCAGGCAGGGCTCATTTGTAAGCCGAGCC
GATTTGGGATGACATGTTGCAGTGCATATGCATTTGACAGCGAGGTTAGTAAGTTTCTGTTCAAGTTTAGGGCGTGTAC
TATTTGATGTTGTGAGATGTGAATTTGATTTCCAAGCACTGCGACCTGGGCCTCCTGCGCGATCAGAGGTCTCTATGAG
GAGATGAGCTATTGATTGCACTCAGCGCTAGATGTTTGATGAACCCTCAGGACACAGCATTGGAAGTATTATTGATCAG
AGAAAGGCTCTGGGCTATTCACTCCAGAGTTGCGAGAACTATGATTCACGTTGACATACGTGTCGGCCTGCAAGACCG
CTGGAGCAGCCAACGTAAACTGCAGCATTTCATCCAACGAAGAAGAGTCATATTTTGTAGTAAGAGTAGCCAATGATGG
CCCATCTATCAAGTACTTGCNANAAAAAAAAAAAAAA

FIG. 1 continued

> SEQ ID NO:583 214339 *Trichoderma harzianum*
AGCCCATCATCTGCTTCAGATATTCATTATTGGCGCATCTGTCGAGCACCAAAATGGCTCCCCCGATTCACTTCATCAC
CGGCAATGCGAATAAGCTGAGAGAAGTCAAAGCGATCCTCGAGCCGCAAATTGAGATTGACAGCCAGTCGCTGGATCTC
GAGGAAATCCAGGGAACGATTGAAGAGGTTGCCGAGTCAAAATGTCGTCGAGCTGCCGACTTGGTAAACGGCCCGGTGC
TGGTTGAAGACACGGCGCTCTGTTTTAATGCTCTCGGAGGCCTACCTGGGCCTTACATCAAATGGTTCCTGGATAAGAC
TGGCCACCAAGGGCTCAACAACCTTCTTGCGGCATACGAAGATAAATCTGCAGAAGCAGTTTGTACATTTGCATACTCA
CCAGGACCTGGCCGCGACCCAATCATCTTCCAAGGACGGACGCCGGGTCGCATTGTACCTGCGCGAGGCCCTTCGAAGT
TTGGCTGGGACCCGGTATTTGAGTTTGAAGGGAAAACGTATGCCGAGATGGAGTCTGCGGAGAAGAACAAGATATCGCA
TCGTGCTCGAGCTCTGAAGAAGCTGCAGACATGGTTTGAGAGCCAACA > SEQ ID NO:584 214342 *Trichoderma harzianum*
AGAGACGACTACGTTTGGGTCACATGTGCTCTGGAGTTTGGTACCTAGTTATTTGAATGGACGACAACGTGGAGGAGGA
AGCTCAGGTAATGAGTGGGATTGGCTTACAGTATGTTGAATAGGATGTCCGTTAGAATGCGGAATGCAAGTAGTTTTCA
ATGCATCTTGATTTAAGCC > SEQ ID NO:585 214345 *Trichoderma harzianum*
GACGCTCAACGCAAAAATGTCGGATCTCAGCAACAAGAAGAGAAAGCGAGACGGGGAAAAGGCCGGTTCTGCGAAGAAA
AAGGTCGTTATTGACGCACCGGCTTCAATTGCAACCGTCTCCTCTGTTCTCCGGCCGAAATCATGCCCTCCTGTGATTG
CAAACACTCCAGGAATGGAAATGCCCTCGAATCTGGTCTTTAACTCATATATTCCCAAGAATGCCTCTTCAAAGTCCAA
AAAGGCAGCCGACAAGGCACTCCTGCTGCACTCCACGACGCACCGGAATCTGGACTATACGGCAAGAGAAGAAGAGTCG
CGCGACTCAAAGCCGCTCCTGAACCACTTCATCGGCATCTACGATCCCAAGACTGGCAAATTGCAAGTTGTCGAAGCGA
AAAAGATGGTCGTACGAGGCGCCGTCCGCTCTAAGCAAGTGCCGACTTCTGCAGATCAGACGGAAGCCAAGAACAGCAT
CATGGACCAGAGGACAGACCTTGGACAGACTTTTGGAACGAAGAAGGCCAAGAAGGTTATCCAACATAAGGTGTTGAAC
GC > SEQ ID NO:586 214346 *Trichoderma harzianum*
GCGCGCCAAAAGACTGTACACAGACGTCTTTTGATATATTTTCAAAATGGGTGGCGGTGGAAAAATCCCTTACCCCAAG
CACGTCTGGTCGCCTTCTGGTGGTTGGTACGCCCAGCCTGCCAACTGGCGCGCCAACACGCTCATCGCCGGAGCCGCCA
TGTTCGGCGTCATCGCTATTACGTGGAAGTTCAGCGCCGACAGGGAACGATGGGCGCATAAGCCGGAGCCGTGGGAGTG
GCATCCTAGCCGATACTGGTCAAAGCAGTTGATCGAGTGGGACAAGGAGGACAACCTGAAGGCAGCAAGCAACAGCAAG
GAGTAGAGTCTTCTTTTTGGGAGAAGGATAATACACGAAATTGTACAAATTCTATACGAACAAAAGGCAAACA > SEQ ID NO:587 214356 *Trichoderma harzianum*
GCACAGACAAATCTCACACAATGTCTACCGCCGAGCTCGCATCTTCCTACGCGGCCCTGATCCTTGCCGACGATGGCAT
TGAGATCACCGTGAGTTGCTTTCCAAAATCCTCGCTCTGAGTCTCCCTTTGTCGCCGGGGCGCAGAGTTCGAAAATTCT
GTGCCCCGCGAAAAGGACGACATGGAGGAAAAAAAACCGTGGGAGAGTGTTTTGTGTGCTAAGCGACAATTTTCACAAC
CGTATAGGCCGACAAGCTCCAGACCCTGATCGCCGCCGCCAAGGTCGAGGTTGAGCCCATCTGGACATCAATCTTCGCC
AAGGTACGAATTTCCGAAAGACACCCGCCCATGACGGAATAGGCTCTACGAAGTCGAATTTCCAATAGCCGAGAGAAAT
GAGAATTGGTCGCTGACGAGTTATGGTTTTTTCCCGACACACAGGCTCTTGAGGGCAAGGACATTAAGGACCTCCTGGT
CAACGTCGGCTCCGGTGGTGGTGCCGCCGCTGCCCCTGGCGCTGCCGCCGCTGCTGGCGGTGCC > SEQ ID NO:588 214367 *Trichoderma harzianum*
CGACCTGTAACTGGGTACGTGCCTACATGTATATCCGGCATGCCCTCATGTAGGTGACATCTAAACCATGTTCATGCGG
AGCATCTCGACGGCGCCTATCTGCTCCTATGAACGGCCAACCCTATACACATCGTACTCTGTACACAGTACATGTACGC
AACTACAGTAAAACGACATGGTAGTATCCCGTGGTGGCCATCCATGGGCTACTCTCTGTATGCTTTATAGGCCCGGAAT
AGGATCCCGCGGAGCCGGAAACCGTGGGGATGGAAGGCTGTGCAAAGACTACATGTATAGTTTACGGCTCAGAATTGTT
GGCCGGAAGCTTGTTGTCGTTACGGGAGAGAGACCGATGTGACAAGCTCCCCTCGAGTCAAGACCTCTTCATTTCATAT
TCACCAACGCTGGATAAGGTACTGTAAATGAACTCAGGTGTGCTCTCAGGTTCACATTTACAGGAATCATGCCCTCCAC
ACTCTCGGGGCATTTACACGGCCCGAAGAGAATGAAGAAGGAGTGTGTGCTCTCCTATCTGGATAACGGGGTTTCATTG
TGGGCATCTTATGCCCGCATGGATAGCA

FIG. 1 continued

> SEQ ID NO:589 214370 Trichoderma harzianum
TGGCTGGGGGGAGAAGAAAAGCCAGAAGATGCGATGGGGCCGTGAGTTTGAGTGTGAGTATTGCGGCGTTGTCCAGGTA
CAACGGGGGGGACGAAATGCGAAAAGCGCACAAGACAAGGTAAAGGAAACGGCTAAAAGAACAGACAGGGCGTGAGGAT
AGGAAAAGGAAACAAAAACGAAGAGATTCCCAGTATTAAAT > SEQ ID NO:590 214382 Trichoderma harzianum
ACGCGGTGGTGATTGGAGGTGCGGATTTCACGCTTTCTGATGATACTGGCAGCAATTACATTTGCGCGGCTGGCGTCCT
TTGCAAGGATGCCCGGAATGCGGTTGTCTTTACTGTGAGCTACAACAGCGGGAAGGGATATGCGTTCAACGTCAAGGGC
ACGCAACAAGTATCTGTCTATTGGCGGGCGTGGATCGTCCAGTTATGTTTCCTTGACGGGGGGGCTGGGATACTGGCAG
GCTTATACCGTGAGTCATTGAATGTCTGGGAATATATAGCATGGCTAG > SEQ ID NO:591 214388 Trichoderma harzianum
AATGAACCCAAAGACCATTGAAGTGGCCTCAATATTGATCTATCAAGTTTCACCTACTCTCGAACGTTTATTCTCGAGG
TAATAGCTTTTGGAGTCTTCATCATGTCCACCAAGGTGGTCATAGT > SEQ ID NO:592 214394 Trichoderma harzianum
AGCAGAACGGCTGTATTTGTATGTATCCATCATTGGATGGCGTTTTCTGGAGCGAGTGCGAAGCATGCGTACTCGTATG
TGTATGTCTATGTATGGACTAATGTGCGTGGGGGTTCATGGAATCGCCATGAGTGCTTTCATGATTCTGCAATGCCGTT
TTGCGTCAGTAATGTGGAGGGAAGATGTACGACTATGGATCATGTATATCGCAAGTTTGATTTGTCGGAACAGCGTATC
ATCAGGGAGAAGATAGAATTAGCATTGCACAATTCAATTGCAAAACC > SEQ ID NO:593 214401 Trichoderma harzianum
ATTGGCCTCGACGACGGAACTGAACAGCGACGCTTCTCGCTGCGAGGCGCCTTATCTTTTGGCGCGAGACTGAGATTGG
AGTCCGATTCTGGCCGGTGCCCCGCGAGAGGCGCATCCAATTTCCAGCCGGAGGAGCGCGTTGACATTTGCTCGATCCT
TATCTTCTTTTTGCTGCTTGGGCGGCAGTCAATCACATCGACACGGCACCAAGTTTCCCTGCTGGCCGTTGTGTTTGAT
CCGGTCTTTGCTCGATTGGCATGACTCTGGACGGCGTATCGACAATCTAAACCAATTCGATTTCCCCCTCCGACACCCA
AAAAAAAGCACCCCTGATTACGAAGTCCCTGCTATCACAGATCTGGCCTCTATACTGCCACTGCCACATCTCCACACCA
CATTCGATACGAAGCCTCTGTCATCGTCAGCCACGGCCTGACCTGATTCCTTTTTGCCCGACCGATTTACACGTCGATA
TTTGGCTTGCTGTTGCTGTTCCTGCCGCATAGGCAGGCTGGTTGCTCGTCGCCATGGACTTGTTCAGGCGATCAAAATC
GGGTGCGGGACGCCATTCAGAACTTCCGACGTCGGATGAGAAGCG > SEQ ID NO:594 214402 Trichoderma harzianum
TTCCTGAGGCCGCATCTCATTCAGCTTTTACCCCACCATCTCACAGCCCATCATCTATCTCATCCAACCTCTCACCACA
ACAGCACCTACATCTACAAGAGAGAACACTTCCCTCTTGAAAAAGTAAACCTAAATAAACACATCAAATCAAAATCCTC
CATCATGGCCGACAAAGACCGCATCACCTGCCACGTCCTCGACACCACCGCCGGCCGCCCCGCAAAGGGCATCCGCGTC
CGCCTCGAAGGCCCCGTCCCCAGCTCTCCCAACGCCCACACTGCCGTCAACACCTTCGAGTCCCTCACCAACGACGACG
GCCGCATCACCGTCTGGCTGCCCTACTCCTCAGAGTCCTCGGCCGGCGAGGTGCCCGTCTACACTCTCGAGGACGTCCT
GGGCGCTATCAAGGGGCCTTCCCGGTGGACGCTGCGTTTCGACACTGCCGGCTACTTTGGCGAGGAAAAAACATTCTTC
CCAGAAGCCACCATTGTGTTTCGTGTTGAAGAGGGCCAGCATTACCATGTGCCGCTGCTGTTGAGTCCGTACAGCTACA
CCACTTACCGGGGAAGCTAAAGGGGGCATGGGAGGACAACGCGGCTTCACAGCCACAGTCGTTTCAGTTTCAGAGTCA
GAGTCAGAGTCAGTATTCAGAGATACATATGACAACAATGAT > SEQ ID NO:595 214403 Trichoderma harzianum
AGTATTCCAAGGATAGAAGGCTTCCATAGGGGCTCGGAGCGTACGAGCCGTCGAATGTTGGGTCTTTTAGGAGAATGC
CGAGAGAGGGGGGTTGAGGTAAGGTGAGGAGCTGACGCGGATCCGAAGCTGCGGCTGGGGATGTGGAGAGCCGGAAAGG
CGGGATATGCACTCGCACGGAGAATATGATGGATCCCAAGGGGCGGTGCCCGTGTCGACGAGGTTTATAGG > SEQ ID NO:596 214404 Trichoderma harzianum
GAATAAGCAATCACGAGTAACATCCTGTTTCACAGCAAAAAATTGAGAAAATTCAAGATGCCACCTGAAAGATTGATCG
AGACCAAAGCTCAGAAAGCCTGCCGCCACTGCCGTCTCCATAAGCGGAGATGTGACAAGCGTTTACCGAAATGCTCGCG
ATGCTCCTTAAAACTCCTCAGATGCGAATATGATGACGACGCGCCGATTGAGGAGACAGGACCAGATACCAAGCTGCTG
TGGAGCGAGCACCTGGCCATCAAGCGAGACTCTTCCGGCCTCGAATTGACTCCAGCAGGCGAGAAGCAGCTCCTATGGA
TCGCTTGCCAGACTCAAGAGCAGCATTCCGATCAAGCTGACACCAAGTCATTAATGAGTCTGGTCAGCGACATCTTCAA
GTATGGCGACACCTCCGCGGAGCAAGTCTCGAATAGGTACTTTGCCACAGCCCATCACTGGATACCCATTGTAGACGAA

FIG. 1 continued

CCAAGGTTCAAGTTCACTCTTGGAGTCAATCGAAGCTATACGGAACTCTACCACGATTCCTTCGCATTACTACTGTTGT
GCATGCTCCTGATGAATCAACAACCCTGTCACCACCCTAATCACACCCCCAACAGCGCGCTCTATCGGACCACAAGGCG
GCTATTCTCTCTCCTCAACACGGGCTACATTGACACATATCCCCTCGCAAG

> SEQ ID NO:597 214407 *Trichoderma harzianum*
AACCTCATAACAACCACAATGGCTGCACAAGAAGGACGAGCTCCATATCCGCCATTCACACTTGAGACAGCTCAAGTCA
AAGTCAAGGCCGCTCAAGATGCTTGGAACACCAGAAACCCAGATGGTGTCAAAATGGCATACACCCCAGACTCAATCTG
GCGCAATCGCGGCACATTTCTACAAGGCCGCGACGAGATCAAGGCGTTCTTAACCGACAAATGGAGCAAAGAAGACGGC
TACCGACTTCGCAAGGAGCTTTTTGCTTTTACAGACAACAAGATTGCCGTGCAGTTCTGGTACGAGTGGCATGATGAGG
CAGGCCAGTGGTGGCGCACGTACGGGCTTGAGGACTGGACTTTTGCCGAGAATGGGCTGATGAGGAAACGTCAGATGAG
TGGAAATGACGTGAAGATTAGCGATGCGGAGAGATGGTTCAAGGATGGCGTTGATGTGAACACCGTCGACATTTCCGAG
AAGCACTGGTGAGGGAGGCTATTTACTAAACTTTAATGAAGTCTTTTGAATATATAGATAAG > SEQ ID NO:598 214411 *Trichoderma harzianum*
GGATGGATACTTGCAGTAATATGGGGTAAGTGAGTGAGTGAGTGAGTGATATGGATACAGCGGGATGATGATGATGGTG
GTGGTGGTGGTGTTGTCACTGATGTTGTCGAGTGAGTTGTTTGTTTTGTTTACCTTTGGAATTGATTGAAATGAAATGA
AATGAAACAGCCCAATGCACAGCCTAAGTCCAAAGAAAACAAACC > SEQ ID NO:599 214414 *Trichoderma harzianum*
GCCACATTTCCATGATTGCCATTGGTGGTGCGCTCGGCACTGGTCTCATCATTGGTACCGGAAAAGCCCTCGCTCAGGC
TGGTCCCGGCTCGCTGCTCATCTCGTATTGTTTCGTTGGGATTCTCGTCTACGGTGTCATGGCTTCTTTGGGAGAAATG
GCTGCTTGGTTGCCTATGAGTGCTGGATTTACGGGCTATGCGACGCGATACTGCCACCCTTCTCTGGGATTTGCTCTTG
GTTGGACATATTGGTTCAAGTACATCATTACCACCCCGAATCAGTTGACAGCTGCCGCTTTGGTCATCCAGTATTGGTG
TCCTCGAGACAAGGTCAATCCAGGTGTCTTCATTGCCATTTTCCTAGTCACCATTCTTGTTGTGAACTACCTAGGAATT
GAACTGTTTGGCGAACTTGAGTTCTGGCTGTCCTCTTTCAAAGTCATCATCATCGTTGGTATCATCATCTTCTCCTTGT
GCATTGCCTGCGGTGGCGGTCCCAACGGCGATGCCCCTGGATTCCGATACTGGCACCACCCCGGTGCCTTTGCCGAACT
ATATTCAACGGGCTCTTTGGGCAAGTTCCTCGGCTTTTGGTCTGTCATGGTCAATGCCACTTTTGCGTACCT > SEQ ID NO:600 214415 *Trichoderma harzianum*
ACACAACCGAAATGGAGAACGACCGTGGCGACATCGTGGACCTCTACGTCCCGCGCAAGTGCAGCGCTACCAACCGCAT
CATCAAGGCCAAGGACCACGGCTCTGTCCAGATCTCCATTGCCAAGGTCGACGAGAACGGCCGCGTCGTCCCCGGCGAG
AACCACGTCTACGCCCTCTGCGGCTTCATCCGCGCCATGGGCGAGTCCGATGACTCCCTGAACCGATTGGCCCAGCGTG
ACGGCCTCGTCAAGAGCGTCTGGAGCGCTCAGCGATAAATTTTGCAAAACAAAAATTTGGAAGAGGGACAAGCTCGGGT
ATGAAGGCAGGCGTGGAAACTAGAGTTGGCTGCATGTAGCAATTCCAATTCAAGGCGTTTTGGCTCCG > SEQ ID NO:601 214417 *Trichoderma harzianum*
GTTTGTTAGCCTTTGTGATGCAATAGCATGTTGTAAGATTGTTTGTGTAAGTGAAGTCTATAGCAATGCCTGGAATGTG
ATGGAACATAGGAATACAGGATGGATGACAGAGTTGGTGATGGATATGTACACTTACCCTCGCTGATACGGCACGTCGT
CAACGGTCTGGTATTCTTGTGGCTGGACGATAGACATTGTTGCGGTTTTCGAACGGTTTGTTATGTGCTTCAATGGTTT
CTTGGCTTTGTAAGTTGTCACACGATCCAAATAACCCAAAATCACC > SEQ ID NO:602 214421 *Trichoderma harzianum*
ATTGAGTCCCTAGGCCAGAACCGCGCGAGTATACATCTATCTGCAACATCTCTTACCTCCATCTTCGCAATGGCTTCTG
ATAAGATGGACCGCGGCCTCGACGAAATCATTGCAGACAAGCGCAGCAATGGATCTCGAACCCGACGCGGTGGCGACCG
CCGTCGTGACCGTCAAGACTATCCCCGTGATGGGGTGGAAAAGTCTCTCCGCAACGAACCTCGAAACTTGGATAGCGAA
TGGGTACATGATCGATACGAAGAGAACACGTATCGCAATAGAGGCCCTGCACCGCGTCGCAGGCGCGAGTCTCCCAGCG
GGGGAGATGCCCGCGGCGCACGACTCCGAGTCGAAAATATCCACTACGATCTCACCGAGGAGGATCTCGATGAACTTTT
CCGAAGAATTGGCCCCATCACAAAATTGCAACTGCGTTATGATCGGTCTGGACGGTCCGAAGGTGTAGCTTTCGTAACG
TATGAGAGCAAAGACGATGCCGCAGAGGCTGTGAGACAATTCGATGGTGCCAATGCGAACGGCCAGCCAATTCGTTTGT
CCGTCATGTCAAGTGGGCCTTCTCGAAACCCGTTTGATACTGCTGTGATGCCAGGCAAGCCTTTGTCCGAACGCATTTC
TGCTCCTGGTGGCAGATCTCGATCACTCTCCCCTCG > SEQ ID NO:603 214423 *Trichoderma harzianum*

FIG. 1 continued

AGCAGCGACTCTTCGTCTTCGTCTCCAACCACCACAATGTCTGGCTACACCGTCCGCAAGGTTGCTGCCCAGAACACTC
TGGAGCACCGCGTCTACATCGAGAAGGATGGCGTCCCCGTGTCGCCCTTCCACGACATTCCTCTCTTTGCCAACCAGGA
GCAGACCATCCTGAACATGGTTGTCGAGATTCCTCGATGGACCAATGGCAAGCTCGAGATCTCCAAGGAGGAGCTCCTT
AACCCCATCAAGCAGGACGTCAAGAAGGGCAAGCTTCGCTTCGTCCGCAACTGCTTCCCCCACAAGGGCTACCTCTGGA
ACTACGGTGCCTTCCCCCAGACCTGGGAAGACCCCAACACCGTCCACCCCGAGACCAAGGCCAAGGGTGACAACGACCC
TCTCGATGTCTGCGAGATCGGTGAGCTTGTTGGCTACCCCGGCCAGATCAAGCAGGTCAAGGTCCTCGGTGTCATGGCC
CTTCTCGACGAAGAGGAGACTGACTGGAAGGTCATTGTCATTGACGTCAACGACCCCCTTGCTCCTAAGTTGAACGACG
TTGAGGACGTCGAGCGCCACCTGCCTGGCCTGCTCCGTGCCACCAACGAGTGGTTCCGTATCTACAAGATCCCCGAC

> SEQ ID NO:604  214425 Trichoderma harzianum
ATCATATCCGTAATGGGGGACTCATTCGATTTCCACGGCTAATGTTTTGCACGGCGCATAATGGCAACGGCGGAAAAAG
GGCTGGGTTCGAAAAACAGAAAAAAAGGCCGCAAACTCCTACTTACTCTACTCCTACTGCTTGACCCTGTATTCCAACC
CACTTCATACATCCATCTACGCACTTAAGTACCTTGGGCTATCTGCATGTACGTTCTGTCCTGGACGACTTCATCTACG
TTTGGTTATGTTTTTGGCTGTTCATTAGATTTAGCTATTTTATACGGCGTTGTTTACATACCACAATACATATGTATAG
CCTATCCTGTATAACAAGGCAAAAAATGCAAGAGAATAGACAAAAACTACGCTTCTC > SEQ ID NO:605  214437 Trichoderma harzianum
AACGAGCAGCACGGCAACGTCCCATACAGTTGCCCAGCATGTCGCTCGTCACGGGAGAGAAGACGAACTTTCAGTTCAT
TCTCCGTCTTCTGAACACCAACGTCGATGGAAAGCAGAAGGTTATGTACGCCTTGACCAAGATCAAGGGTGTCGGTCGC
CGATACTCCAACTTGGTCTGCAAGAAGGCCGATGTCGACCTGAACAAGCGCGCCGGTGAGCTTACCTCCGAAGAGCTCG
AGCGTATCGTCACCATCATCCAAAACCCTACCCAGTACAAGATCCCCGCCTGGTTCTTGAACAGACAACGCGATATTGT
TGACGGCAAGGACTCTCACATCCTGGCCAACGGTGTCGACTCCAAGCTCCGTGAGGATCTGGAGCGCCTCAAGAAGATC
CGTGCCCACCGTGGTCTCCGACACTACTGGGGTCTCCGTGTCCGTGGTCAGCACACCAAGACTACCGGTCGTCGTGGCC
GAACTGTCGGTGTCTCCAAGAAGAAGGGTGGCTAATGGTTTTACTGTTTTCGGTCTGGGGTGGACAGGCGTGACGGCTG
GGTTTTTCATCACTGTGATGAGCATTTCCATGGGACTGCTTTCTGGCATACGCAGCTGGAGCTGTACTCTAGATCAGAG
TCAAATG > SEQ ID NO:606  214438 Trichoderma harzianum
TGGATGGGGTCCGGACTGGTCTCACTGGATTTTCTTCTTCTTCTTTGGCTGTCCTCCGGTTCTTTCGGGCTCGGGCTCT
GGCGGTCTTCGCGGCAAAGGGAGATAAGAGCCCACGTGCGAATTTACGAAAGCCCTAGCGCTGATCGGGTTTAAAGCAA
GTGACGTGATGAATCCGAGTTCATTTGCATAAAAAAAAAACATAAAAATAATAGAGCCAGAGATTTGCCGACCAGGGCA
GGGGGCGCAACCATCTTCATCGTCCATCTTCGAGTGTGTGCCACCCGGAGCAGCAAAGACGGTGCCTCGGCCAAGAGTC
AAATGTCAAAAGATGGAGATGCAATATCACGGAAGCCGAGCTCCACTTGATGCTCGGCGGCAAGTATTACACAATGGC
AAGAGATCCGGGGTAAACACCGCAGTCCCGGCCGATCCTCGAGGCCTATTGGATGAGCGTTCCGGCACCCAAAGGGATT
TTTCGGAACCGATGGTCGGGGATTCCCACCCCCAGCTTGCTTTCTCCCATGTGTCTGTGGGCAGAACCAGAATGCGGG
GAGTAGATACATAGATCTAGAATTGCCTTGAGATCTCCTGATATTTGAAGAATAGGAAATTTTTTAACCTTT > SEQ ID NO:607  214439 Trichoderma harzianum
GAAGCATATCGGGCTGAAACCCCCACAACGGGAAGACGGGACGATACGAGGCAATGAGGCAATTCAGCGGCCGGTAGCT
GTCGGGATGTTTTTTCCCCGGGGAATTTCGCGGTGGCTGACACTTGGCGTCTCGGGAAATGATTTGACGGATGGATGCC
TAAGAAATGATCCGACTGATCAGGTACGGCTTATCGGCTGTTAATGACGCAGCATAAACAAGTTGCATGTGTATCCTAA
GAGCATGCTCGCCAGATGTAGATGGACAGAGGGCACAAGGATTGGAAGAATACATTGCCAATAGTGGTTCATATAGGGA
GTAACTACATGTATCTTACGCTTGAGCGCCTGCTTTTAAGTAGCTATGTAGTACAGATGGAGGAAGCACC > SEQ ID NO:608  214441 Trichoderma harzianum
AAACCGGCAAAGAAATACCCTGCAGTCCTCGAGACTCGCGATAGAGCAGAAGTACATCAGTCTTATTTACTAGCGAGCA
AGACAGTCAAAATGTCGTGGGCGGGTACGGAGCTTGCGGATGCCCCGCTGAGAGAGAGGGAGAGGGGCTGACGGGATTC
TAGGATTCAAGAAGAATGTGAACCGCGCGACGACGCAGGTGATGATGAAGACGGGTGAGCAGCGTTGGTATTCATTCGG
TTGGGATAGCATTCTGATCTTGTGGTTGCAGGGCATGTGGAAAAGACAAACGATCG > SEQ ID NO:609  214443 Trichoderma harzianum
GACGCTATCGAGGGCTGACCTGCATCGTCGTCAGTCGGCAGACGAGCGGATTAACAACATTCTCGAGACGGCTCTGCAA
CGAGCAGAAACGATGGATCCCGCCTCTCTAAGCCTTCTCCAGAAAGGCTCTTCCCACAATTCCTCTCCCAACTATGGAG
CCTCCGGAACGGTGACAAGAGGGATATTGCAAGACTATCAGGCGGTACCGACCAGCGATGAAAGCGATGCCACCCGTCC

FIG. 1 continued

```
GAGAAAGGTTTCATACAGCGATGCGGCGAAGAAGGCCGGGAACCATGCGAAGAGCCAGAGCTCTCTGCGGCAACGAAAC
GGAGTCTCCGGCTCGGAGGATACAAGATCGCCAACAAAAGCAAAGTCATCATGGACGAAGGAAACATTTCGAAAATTTC
AGTCCCTTCAGTTGGAAAACAAGGGAAGCGTGGCTAGAGATCACCTGGCTCTCGAACGCACATTTCTAGCATGGCTTCG
AACCTCTCTCGCTTTTGCATCGATTGGCGTCGCCGTGACGCAGCTATTCCGCCTCAACACTGATAACGCTTCCGCCTCC
GATTTCGACCACACAAGGCTACAAAAGATGGGCCGCCCGTTGGGTGCGACATTCCTCGCCATTAGTATTGTGACCTTGC
TCCTCGGTTGCAGACGATATTTCCATGCCCAGGAATGGATCCTTCAG

> SEQ ID NO:610 214452 Trichoderma harzianum
ATAGAAGCATTTGAAGCCTCCTCCTCCAGGTTGCAGCAAAAGCACAGGAAGCAGCGAGATGGAAGGCAAGAGCCGGCGA
CCGGAGATAACCGTCGTGCCGGCGGCAGGCGGCGGCGCCGCCGCCGCCGTTGATGCGGTGAAGGCGGCGAACAAGGAGC
CCATCAGCCCGGGCTCGCCGTCCCTGGCGAGCGGCGCCGGCAAGGAGAGCCTGAGCCGCCATGAGGCCGCCGTCGTGTC
CCTGCCCGCGTGGAAGCTCGACGCGCTCTGCCAGGAGTCCGGCTCGTCGCCGGCGGTGATGAGGGCGCGCTTCCCCTAC
TTCTGAATTTCTGAATTTCTGATGAAGCCATGAGCTTTTTGCCATCTTCGTACGTGTGTGTGTGTGTGTGTGTGATT
GTAACTGTGTTGTTCATGGCTGAGTAAAGAATTATACTTCCTAC > SEQ ID NO:611 214460 Trichoderma harzianum
TAATTCTATTTCACTCTTCTGCAGACGAGGACGGACCCGATTGACCATGTTGCGACAATCCTTCAGAGCCTTTGCCCGC
ACGGCTGTTGCGAGACCGGCCGCGGCGAGAAGCTACGCTACCTTCAACTGGGAGGATCCCCTCAATGCGAACAACCTCT
TTACCGAGGAAGAGCAGGCCATTGCAGAAACCGCAGAGCGATACTGCCAGGAACGACTACAGCCTAGGGTCTTGCAGGC
CTACCGAGACGAACACTATGACCCCAAGATCCTCGAAGAGATGGGCGAGCTGGGCCTGCTTGGCTCCAGCATCAAGGGC
TACGGATGCGCTGGCGTTTCTTCGGTGGCCGGCGGCCTGATTACACGAGCGGTCGAGCGAGTCGATAGCGGCTACCGGT
CTGGCATGTCGGTGCAGTCGTCCCTCGTCATGGGCGGCATCCACGAGTTCGGCACCGAGGAGCAGAAGGAGAGATTCCT
CCCCGAGATGGCCAGGGGCAAGCTCATTGGCGCCTTTGGTCTGACGGAGCCCAATCACGGCAGCGACCCGGGCAGCATG
GAGAGCGTCGCGAAGCCGCATCCGACCAAGAAGGGATACTACTCACTGAGCGGAGCCAAGACGTGGATCACCAACAGCC
CAATTGCCGACGTGCTGT > SEQ ID NO:612 214471 Trichoderma harzianum
TCTCGCCTCAAAATTCATGCGCCTCAAAGAATGGAAGAAAACACAGGCGAATGACGTGAAACGAAAGATAAAAAGACAG
GCGCCTTCATGCGAGGGTTTCGCCAGTCGCCTCTAGCGTGTTTCGAAGCGCAGGGTTGAAACGCGGCTGCATGATGCCC
GGCCGCCCATCTGAGGCATGGCGGCTACCGGAACAGGACGACATCCGAAGACTTGAGGAGGCTCCGTGTTTGTTCGTTT
CGTTTCGTCTTTCGAGTGAAGGGTTGGTTCTTGTTTTCGGCTGTTGTGTGTTTTGGTTGACTTGTGTTTACGGGTTGGG
GGTGAGTTGAATTGAGTGCGAGACT > SEQ ID NO:613 214472 Trichoderma harzianum
GGGAAAATCAGGAGAGATGAAGTGGTATAGAGAAAGGAAAAAGAAGGAAAAGCAAGGAAAAACCCAAGCCAGAGCCGAT
AAAGAGGTGGAAACGCACGACAGCACGCAGAGACCAGACGATCGTTGGGTCTAGGATTCAATGGGCTGACATGCCACGC
GCCAAATTTTCTGCTTGTTCCTTTCGCCTCTGACACACACACGCACTGACAAAGCTGACTGGCTGTGGGCAACTCCCTA
GGCCGCCTCGCTCTCGGTCGTATGGCACCGAGAAAAGGGACCAGACTGATAGCGGCGGGGCCTCGATAAACGCCGCAGC
AAGGGTCTACCGTCAAGAGCCGGAAGTTGTTGGCTCGCAGCTAGTTGCCCGGTTGGTGGATCCGATAATGCGAAGAGAG
TCTTTGGGACCTGCGATCAGATTGCGCAATACTAGGGGGTGGCAAGAGATTTGTTTGTTGGTGGGATGTTGTTGGAGGA
GGGAGGACGAAGGAGGAAGAGAAGAGAAGAGAAGAGAAGAGAAGAAGAGAAACAAGAGATGAAGAAAGAAGAAG
AAGTGGAAACTAAGAGAGA > SEQ ID NO:614 214473 Trichoderma harzianum
GCGAGGGAGAAACGGGTATGGGCTGGGGGGCCGCACTAGATTCTTTGACGTGTCTTGTACGGAATTCCAGCGCGGTGG
AAGGGTGTGGCTGCTGCACGTTTTCGGGGGCCAGGTTCTTTACACTATTCCCACGGACAAGGTTCCCAAGTGAGGCTGA
TGGAGGGTCCGCGGGCCTTTTGGGGGGGAGGGTCCAATCGAGTGTTGTTTGTGTGTTCACCAAGTTCAAGTACATGGG
TATGCGTATATTTCGGCCATGTATGCGCGATGGATTCCTGCTGTTCGGCAGCGAGCATGAGAAAAAGGGAAAATAGAC
TGCGAGAGAGAGAGCGACAAAAAGAAGGAAATGCTCCGATCACGATTAGGGGCGGAATTGGAAATCCG > SEQ ID NO:615 214476 Trichoderma harzianum
GCATTTTGGGGTCGCAAATCTACAGCAAAAATGGCCTCGACAACGACCAAGCAGACCCCGGCGTCCTTTGTCGGGACCA
GCAAGGTCGTCGAGACTGACTATCCGCTCATCGACAACGACCCTCACTTTAAGCGGGTTATCGGATATGCGAGAACGTC
AGACTACGTAGCTGGTGCAACCTCTGCGGCCTTTGCACCGACTGCTCTCTATGCCCTCGAGAGGCTCGCCCCGTCGCAT
```

```
GTTGGCCGGGGAGGCTTTGCCAAAGCCATGCGGTTAGCCGGATTCATTGGCTTGGCCGGCGGTTTCCTCTACTTTTACC
AGCGATCAGCCCTTCGATTCTACGGCGCCACTGAGAACTCAAGGGAAGTCGAGATGGATATGCGAGAGATGGTTTCCAA
GGTCAAGGCGGGACAGCCTCTGTATGGCGAGAGCAAGCTGAGCCCTCACCTGCAGGGAGTTGCGGCCCGACAGAGCAGA
TACTCTGCGCTCTTTTTCAGCACAGTACCGTGGTTCAACTTTGTCAACCACAACCAGCACGGCGTGGACACGGCCAAGT
ACTATCAGCAGGCCGAGAGGGAACTGGAAGCAGAGCGGGCGGCGGGCAAGAGCTAGACGGGACCAAATGTGTATA

> SEQ ID NO:616  214478  Trichoderma harzianum
TCAATGCCGCCTCCATGAACGACTCGAGCGTCGTCCAAGCCCAACAGCGCGTCGCTGACCGACGAGCGGCCCGCGAGGT
CGAACAACGGGCCCGAATCGCGGATCAGCGCGAATCGTCTCGCGTGAACAAGCAGCTGCAGCGTCTGTCATATCCCCTC
AATCGGCTCGGCGGTGTCTGGGATGCAG > SEQ ID NO:617  214502  Trichoderma harzianum
GTTTTTGCTGGATGGCTCGGTGGTTAGCAAAACGGCACGGCGCGGCACACGGCTGAATGGCATGTCCGCATCTTCGGCT
GTTCGGGAGCTGCGTCACCAGAACAAGGTTGGCCCGATGTCTGGATGTCGCTGCTGATGGGCTGAGAAGTGCTGATGTG
TTCCATTGCGTGCCTGTAAGCTGTCTATCAGTCACACAATCAAGTCATCCTATATGGCTCGTAATGCTGAGGTTTGATC
TCGTTCGCGGGTTTCGGGCCGGGGGGAGCTGTTTTATTGTACGAGTAGCAGCACGTTAATTAAGGTGGTGCCAGATCG
ACGAGCTGGGACCGAGTACGGGTACATGGAGG > SEQ ID NO:618  214504  Trichoderma harzianum
AACCGCAACCATGTCGACCCTCCCCAGGACTCTGGGCAACCTGCGCAAGATTGGCATCAAGGAATACTTCCGCCAGATG
CTGTACATCGGTGACACCAAGTACGGTACTCTCATCGGCCAGGATCGCTTCGGCAACAAATACTACGAGAACCTCGAGG
AACTGCCCCTCCGAACCCGCTGGGTCGACTACGCCAAGCACGACTACGATGCCTCCCACATCGAGCCCGGCTGGCACGC
CTGGATCAGCTACTCCGTCGACAAGCCCCCGACCCAGGACAGCCTCATCGCCACGGGCACCAGACACTTTGAGCCCGCC
CTTCCCAAGCCCAACTTTACCGGAACGCGAGGCGCTTACAAGCCGTATAACACAGTGAAATCGAAGCTTAATGCTTGGG
AGCCGGTGGCCAAGGATCGGGTATGAGTGGTTTTTACGTTTTCTTTTTTAAACCGTGGGAAAATATGGTGTACATATTG
AAATCGCGCAACAAACGCAAACAAATCAAACAATAGA > SEQ ID NO:619  214519  Trichoderma harzianum
GGAGGATCAGGTGCGATGTGAGGCTGATTTGGGGTGTATGATTCGTGAGCGTGTAAGAGGAGGCAGCCCACGACTTTCT
CTCTGTGTCTGTGCTTGCTCACTTGCTCGCCTCCTTGGATTCGGCCTGTTGATCCGAATCAGAAGTAAATGTGTTTGAG
ACTGAGACTTGGTCTGGTCGAGACGATATGAGATGTGGCATGGAATTAGAAACACGTGTTTGGTATGGCGATTGCGATG
CGATGATCCGCAGAAAGCAAGATCTCAGGGCGACTAACACGGATATACGGAGGTTCGACCAAGACACGAGGAATGATGG
GGAAAGTCTCAGTATGTCACTACGGAATTTATGATTACGTAGCAATGTAT > SEQ ID NO:620  214527  Trichoderma harzianum
GGCCAGTTCAATTCTTCGAGGGAGGGCGCTGGGAGCCGTGCGCCAGGCCCGTTGCTTCAGCTCTACTCCAAGGCAATAT
GCCGCTGATGTCAAGAGCGTCGGTGTTCTCGGCGCCGGCCAGATGGGTCTGGGTATCGCTCTTGTTGCTGCGCAAAAGG
CGCAAGTTCCGGTTACTCTCGTCGATGCTTCTGACCAGGCATTGAGTAAAGGCATTGCTTTTGCCGAGAAGCTGCTGGC
CAAGGACGTGTCCAAGTCTAGAATTACTCAGGAACAGGCTGATCAAGCCC > SEQ ID NO:621  214529  Trichoderma harzianum
AGGCATATAAGTACTTAGGAGCGAGTGAAAGTTGTTTCTTACGCATTTCACATGGCAATTCATTTCATCCTAGTCAGAC
ACTGAAGTCGTTTCTTCATCTTATCAGAATCACAATTGCGAAATTGCAGATTGAGAGAATATTCATGAATATAAATATC
ACATTATGAATTCCACTACAGACGATTCGTAAGAAGGTCAAAACTAATGAAAACGATAACTCACTTCAGCGACTCTTCC
GTATTCGCGATTTGATAAGGGTACGTGTTAATTCCTCTATAGACTACCTGATGCTTTTTCGAAATTGGCCAATGCAACA
AATTCTAGTACAACTTCAATCAAGGTGTTAATATAGACTACGTAGGTTAACCCTGGCTGGAGACATGAAGCGGCATTCA
ACTGTTCGACTTGATCAATGAACAACTGCCCATCTTGGAATCATAAGAGCAATCAAAGCTCCATCATCATCCC > SEQ ID NO:622  214530  Trichoderma harzianum
AGTATCTCAAAGATGGGCACCAAGATGGATTTCCAACACTTTGCGCCGCAAATCGACAAGATCCCCAAAGTTACACCGA
GGCAAATCGCTTCTACTGCTCTTTGGAATACTGTCCGCGACAACTTCTCCATCTCGACGTGGATGGCCATTGGAGCCAC
CCTCCAGGGTCTCTTAGTTTTGTTCGCTCGACCTACATTCGCGATTGCACCGGCAACGCTCATCTTGCTTTACCGATTC
TCCCACACGATGCTCATGCACTACGGCTTTATTCGCAACACGCAGATGGAAGATGTCATCATGGGAAAGTATACCGTGC
AAATTCCCGACAAGGACGGTAAACCGCCAAGTGAGCCGTCGGGGACAGGCATGGCTGTCATCATGCTGGGCTTCAGAAA
```

FIG. 1 continued

```
CAATTCCGCCCTCGGTATGTTTGGAGCAGGCGGGCTGGAGACCTCCCTCAAGTTTCAAGCGATGTTGAAGGATCTCGAG
AATGATCCGGACTCCGGCTTTCTTGGCATGTGTGGGTATAAAGCTGCCAATGAGCGACCGACGGCCAACGGTTTCATGT
CGGTGCTTTATTTCCGTAGTGTTGAGGATATCAATCGATTCGCTCACGCCCCGCTTCATCGTGA

> SEQ ID NO:623  214532  Trichoderma harzianum
AGAAGGAAAAGGACGTCGATTCGTACACCGTCGAAGAACTAGCTGCCGGTAAGATCGCCGGCCTCGTCTCCCAGCGCCT
GCACGAGCAGTACAAGGTCGGCGACAAGGTCCAGCTCAGCCCTCCCCACGGCGAGTTCACCTTCAGCGCCGCCAACACG
CCCGTGACCGCCCCCATCGTGCTGCTGTCTGCTGGTGGTGTTGGTGTTACTCCCCTGTTGTCCATCCTCGACACCATCCTCG
ACAACTCGTCCCAGGGTGCTCGCCCCGTGACTTGGATCCACGGAGCTCGACACTCTGGAGCCGTGACATACGGCAAGCA
CATCCGCGAGGCCGACGCCAAGCACAGCAACCTGTCCACCAAGATCTTCATCAAGAACGTCAGCGAGGCCGACGTCAAG
GGCCAGCAGTACGACTACGCCGGCCGCATTAGCCTGGACACCCTCGAGGCTGAGGGCGTGCTGCCTGTGAGCGATGCCT
CTGCCGAGTACTACATCTGTGGTCCTGAGGAGTGGATGATCCAGACCCGAGCGGAGCTGCTC > SEQ ID NO:624  214533  Trichoderma harzianum
AGAAGATGAAGCCGGCGTTACTGCAACGGCAGTTTGGTAAGATCAAGTATGCTAATACGGTGTTTAGGGTGTGATAGTA
GAGGCATCCGGCGAGGCGGCTGAGACATATGAGGGCGAAACAGGAGTAGAGGAGACAGTGGCAGCAGCAGCAGCGTTAA
TGGCAATAACAATAGATGGCAGAGAACGGCCGGGCCCTCGGATTCCCTCTTGAGAGCGAAGGCGAAGGTGAAGGTTCAG
CTGATGGATAAAACCGGGAGACAGCCGAGCGACGCAGAGGATGTCAGGCGTAGGTTGCGTGAGGGTGGCTGCAGAGGCC
GAGAGCAGGTTCAATCAATGGGCGAGAGACGGCTAATCGAGCAGAGCGTGACGAGGAGCGCGGCAATGGCGAGTGCGTG
AAGGGGTGTTGATTCAAGACTGCGCGCGTGAGGGTGTGGGAGAGATGAGGCAGAGGCCAGAGGCAGCTCAAAAGGGTTC
AAAGTT > SEQ ID NO:625  214539  Trichoderma harzianum
AATATACCTTGGTATCCCAAAAGTTGAAAAGATGTCGTCGCCCCCTCTAGCCGCCACCAAGACCCCAGACTCCCCACAA
GATAGCAGCATAGAAGAAGCAGAATGCACCTCTGTCAGACAGTCTGCCTCCACTGCTTCTATTCATAAGTGGAGTGATG
AGAATATTGAAGATAGAGGAATGTATCGATTACTGTCTTCACCAAATAGAGACTGCCATGACGAGATCAGAATTTCGAC
ACGTCCTGCAACTCCATCTAAGGCACTAATGTGCCTTATACTTTCAATACATAAAAATAGGATTTTGGATCCAGGAGAC
TGCTATGACGACATTAAATCGATAGGTGCTTTAACTCCATCTATGGCACCTTATATTTTCCTAACAAAAGAAAACCTCG
TGTCTTCAATCCTTCGAGATCGTTTTTTGCGTCGAGGCGAGCCTGATAATTTAACCTGTACCCAAATACTGAAATGCTA
GAGGAGCCTGCTAACAGCTCACATAAGCAAGAAGGTGGCCTCGACATCTGGAAATGCTGAAGAGCTTAGGACGCGTCGA
CACTGGGATGCCAAAAATGCGA > SEQ ID NO:626  214545  Trichoderma harzianum
GATTCCTCCTTTCTTCCCCTCCATACTATTTATCCTGCCTCTTCCTCGTCTTCCATCTGTTGCCGGTGTGACTCTTGCA
ATTCATTCCCTGCCCGGCTTCCTCGCTTGATTGAATAGCCGTTGCTACTTCCAACTGCAAATCATTATAGCTATACCTC
CCTAGCTTCATATAAGCTCGGCTCTTCTAGGAACGCGCAAGCAAACATCCTCGGCAGTGACCCACGAGCCTTGTCTGGA
GATTTTAAATAGGAAAGCTCATCAACGGCACCTGAGCAGCGTCCAATTGCTCTGTTCAGCTCAATTAAGCTTTCAAGAT
GCCTAGAGACGGCAGTAAACAACCGCCCTCAGCGGCGACAAACCTCATCGCTGGTGGTGGCGCCGGTATGATGGAAGCC
CTCGCCTGCCACCCTCTAGACACAATCAAAGTGCGAATGCAGCTCTCTCGCCGTGCACGAATGCCCGGCGCCCCCCGCC
GCGGCTTCATCAAGACTGGTGTAGAGGTTGTGAAAAAGGAAACTCCTCTCGCTCTATACAAGGGCCTCGGCGCCGTCTT
GACGGGCATTGTCCCTAAAATG > SEQ ID NO:627  214547  Trichoderma harzianum
AAGTTTCAGCATTAGCATTACACCAGTAACCCTCCAGGGCAGCTAGCGAAGAGAGCAGGCCCAGTTCCGGGTGACAGGT
CGGGCAACGCCGCGACGGCTGCGATTCCGAGCGAACGGCGCTGGCGTTCCAGACGGCACAGCAGCAAGCACAGCAACAG
CACAGCACAGCTACGAACATCGAGGATCCCGCTCCAGGAACCGGTGCTATCCAGAACAAGGCCCCGGCGCTAGGACCCG
CGGTTGGCAGTGGTGGATCGCAAGGCTCCAGTCATGCCATGCAAGCGAGGGAAAAACGCTTGCATGCTCATGCTTTGCT
CTGGCTCTAGATGAGTCTGAATCTCATCCATCCTCGACCTGCTGCTGTGTCTCCCCGTCCCGCACGAGGCTTCGGTCGG
CGAGAGCCGGGATCGAGGCGTTGGGGGATGGCGTCTGTGAGCCAGACATGACCTGTCACTGCCGTGGGTATCAGCAAGG
CGCAATGGCGAATTGCAGGTGGGCAGCGAGAAAAATTCGAAGGGATAGCCTTTTACCAGCGCTGCGTCGATGATGAAAA
TGGGCTGATTTCTT
```

FIG. 1 continued

> SEQ ID NO:628 214548 Trichoderma harzianum
ACCGAACCGCCAGCGAATCGACGAGGGCATCTGTGTCGGTACCGGATGCTGCCTTTGCGGATGGAGCGTCTTCATCGAG
ACGGCAGGTAGAAGGAAAGACATGGCCTTGTTTGTGGCGCCGCGGGCACTGGCAACGTTGGTCCCTCGGCGGTATCCCC
TGGAGAAGCAGTGGCGAGAGAAGTTGATATTCGCAGCGAGCACGGCAGTCGTGTTTACTTGCGCCCTTGAGAATCCAAA
GAGAGTTAGAGGCGTACTAGGGGGGATTTTGGGCATGGTGTTGAAGAAATAAACCGGGCATATGGGCAAATATGATCTC
TTTTAGGGAGTTCTGAGACGTGACATGACTAATTTCTTCTTCTTCTTTGGATGTCTTTGGAATAAGCTACGGTTTTTAG
ATGATATACACAAACAACCCTGATGCTATAATTGGTAATAAATACCA > SEQ ID NO:629 214553 Trichoderma harzianum
GCGCCTCAAGCACAGTCCCGTTGCCTGACACCCAAAAGTCCATTCCTCTCTCTGTTCGCCTTGCCGCTCCACGACTCTC
CGTCCGTCCGTCTGTGCTCTGCGGATCCAACCAAGCACCGGCCCAAGCACCGGCATCAGCGCGAGATTCAGCTCCAGCT
CCATCCAGCCCCAGCCAGCTCGCTCTAGCCTAGCCTCACTTGCCTGGCTGCCAGCATGTCCTCGGCGTCTCAGCGGCGG
CGACGAGATGAAGACGACTATATTCCATTTGGACCCCCATCACTCCCCAGCACACAGACGCACCTCGACAACATGTCGT
CGGAACTTGGCTGGCCACCGCCGGTGACCATGTCCGACTCGAGCGACGAGGAATTTCGAGACCACCGGACGAATGCGCG
ACGCATTTCGCGCCGAAACCACATGCCGCATGGCATTGACGGACTGATGAACAATGGCCGATACTCGCCCGACGTGTAT
TCAGTCACCTCCGATCCTCCAAGCCAGACGCCCATGCTCGACGCCGGCATGCAATCTCAATACGCCGGCATACACTCGC
AATACTACGCCACGAGAACGCCCA > SEQ ID NO:630 214554 Trichoderma harzianum
ATTTCTTGGCAAGGGTACAACACCCAAAACACGCGGCGATCTGAGGCCATCGTCCGCGCCAAAGATCCCTGCCTCCAGA
AACTCTTTCCACCCCCTGTTGTCTTTGTCGCCTGGTTACGGATACAGTATTTGCTCCTCCGAGTCAGTTTCGCGGGACC
CTAAATGCTGATGGGCTCCGTATCAGCGCGACTCCCTCATCGTATCGTAGCTAGTATTCGTGTTGTCCTTAGCCGTTCC
CCTTTGCAACGAATTGCGTGTAAGCCGGCGCTT > SEQ ID NO:631 214557 Trichoderma harzianum
AATCGCGCTGATGGCCCTGACGAATCTCCCGGGGCTTTGCCATGGCGGATGACTATCTGCTGCAAAATGTTCACACCCT
CACCGACTTGGAGCTGGCCGTGCTGCTGTGT > SEQ ID NO:632 214558 Trichoderma harzianum
GGAACGTCAAGTGCGAAACGCACTGGTGTCGCCTGACGAAGCAGGACAAGAGTCAATCAATTCCAAACCAGCCGATAGA
TCTCGAACTCTGTTCAAGACCAATACCAAGATGGAAACGAAAATAGGAGAAGAGCCTATACGACATACCGATTTTGCCA
TGACAGATGCTCAGGGAGGGCGAGGCCCGCTGCAGCAACCAGCCACCACGGCACGCACCGGCTTGGCGATGGGACGCAG
GTTACAAAAATTAGCTCGCCCAAAACGCTCGGCAAGTCATGAACAGCAGTACATAGGTGACGAGCTCCGTGGCCAAACT
ACTAGGCCCAGATCATCTTACGACCCGTTGGTCTCAACAGAATATAGTCTAAGACGTCCAAAGCAACATGCGACACACA
ACTCGACTGCAGAACCTACGGTAAATACTGTCATTAAGCCTACTTTACGGCGACGAGGATCCGACTCTAGTGAGAGCAG
TTTCGTACGTAGTAGGTCCATCGGCAGTCCTCGAAGTGGATTTAGGTCATCGATGCGAAGCAGCTCTTTCGATCCGAGG
CCATCATCATCTGGTAATAAGGGTAGAAACAGGTTGACTCTACGCTCGTTATCACCCACAACGTCACATCAGAGGCACC
ATTCT > SEQ ID NO:633 214563 Trichoderma harzianum
ATGGCGCTAGAAAGTCGGCACATCGAGCCTCGGGCATTGTCAGTCCATTCTCGCCATGGCGAATCCTCTAATCCCAACA
CAGCACACAAATCTGCCTCTATGAGCGCATCCGTCGACCAGGAAGCGGCTCAGAGGGATGAGGCACAGGCTTCCACCGT
CCATGTGCGGGCTATGGTAGCAGCCGTGCAGCAGCAGAAGACGCGGCGCCGCAGAGGATCACTCAGGAAAGTTGCGCTG
CTGGGAACAGGCGCCCACCGTGACAGG > SEQ ID NO:634 214564 Trichoderma harzianum
GCTCATCCTATTTTGCCTTCCCTCCTCCCAACTCCTTCCGAAATCTCGGCATCGTGAACTCCGGGCTCCAATGGCTACC
AGAACGGGTTCGACCGGCGTGGCCACCTATGCCGACTGCGTCGATTCGCTGCGCAACTCTCTCAAATTCCTCGAGGCCT
CCGTGGAGACCATTGACCGTGGCGTATCTGACTTCCTCGCCTCGTGAACGTCCTCAAGACAGTCCGACACTACGAACT
CATTCCCCAGCCCACACTCGCTGCTGCTGAGGCTTCCCTGCGCGACGAAATTGGGCCCTACATCGCTTTTCTCCTCAGC
CGCGCTGATGCTCAAGTTGAACGCCAGGAACGCCGCATTGAGACGCTCAAAGCCCGGGCTGAGTTACAACAGGGACGGT
TAACTAGGCCTGATGAACCGGCACGCAGCGTATCAAGGCCTGCTTCTGCAAGGAGCCGGCAGCTCCGAGGCGAGGACAA
GCTGAGAGCTCGGATTGTGCGCCAGCGTAAGGAAGCTCTACGTTATGGCATTGAGAGG

FIG. 1 continued

> SEQ ID NO:635  214569  *Trichoderma harzianum*
ATTATTCAAAATGAAGTTCACAACCATCGTCACCGCTGCTGTCTCTTCAGCCATTGCCGTCTCCGGCACTCCCATCCAC
AAGCGCGAGATCGGCGGCGTATGTCTTCTCCCTCTCCTCTCCCTTGCATCTTCTCCATTCCTATCACTCGTCTGATTCA
ATATCATCTCTAACTATTGGTCAATCCCTCACAGGTCCTCTTGTGCACCGGCGTCAATGCAACCGGCACCTGCAGCTAC
AACGTCTACGAACTCAAGACGTGCCACCAGCTTCCCGCGCCTTTCCACCAAAACACCAGCACGTTTGCCCCCGACGGCG
AAGACTTTGAGTGCTTCCCTCGTATTGGCGACTGCGGTTCTATTTGCACCAGCCCGACGGGATGTACCTTTGGCAGCGT
CGACTTTAACTACAAGAACAAGTTCAATCTGGGGGCTATTAAGTGTAACACCTTGATTTCCAGCTTTGACTGTTCGCTG
AAGACGACGACGACTTCAACTGAGTAAAAAGGAAAAAAGACAAAATTATGTTTTACAAAGTGTTGGAGGATCGCATCTT
GTTTTGTTTAATGTACGACTTATACCAACGATGAGGATCCATCTCAT > SEQ ID NO:636  214572  *Trichoderma harzianum*
ATATTTGAACAATGAGCGATGAGACAGGGCACCGAATAGGCACAACACGTGCGTCAGCACACTCTGCGAACATCAGTGG
ATCTAGTTTTGGGGACAACACCCGAATACAACAAGCATTTCTAAACATCTTCTTCAGAAACCGGAGAAATCCAACGGTG
TCCCCCGAAAACACCCCGTCCCCTGCAGTGCAAGCTCAATTACAAGAGAAAGAGAGAACAGACTGTCGACGCTCTCTCA
GCTTCCGCGATCTTGACGCCCGCCTGCAGAATATCTCACCAGTACAACAAGGCACTTGCGAATGGATTTTTCAAATGCC
GGTGTTTCAGAACTGGTATGAGCATACTGAATGTGATAATGGATTGCTTTGGGTCAAAGGAAGCCCTGGTACTGGGAAG
TCGACATTGATGAAGCATGTTTTACAATACTGCGAAACCAAAGGAAAATATGCTATCGCGGCATACTTCTTTAACGCTC
GAGGGGCCGAACTTGAGCAAACACCTCTGGGTATGCTGCGCTCCTTACTATTTCAACTACTCCGGCATGAACCTCGTTT
ATATGACCAGCTTCTTCCAATTTATC > SEQ ID NO:637  214575  *Trichoderma harzianum*
GTCCCGCCGAAAGGGGCGACAATTTGGGTTGTGAGGCGGCAGACGGTGATTGGGGCGATTTGGGCAGCTCTGCCAAGGG
TTGGGTTCATGAAGATACAGTACGTGTTAGTGATGTGAAGCTGCTCCATGATGGGACTCGGAATGGCGGACGGATGCGG
TCATGGGCTTTTGGAGATTGGCTTTTCTTGGTGGGCCGAGACGGCATCTAACTGGAGATTTGATGAAGGGGAATTCCAG
CTATCAATACGGATATGCAGGACTGGATGATTCTGATTTGATGGCCCGAGGTGAAACTTGTCTGG > SEQ ID NO:638  214579  *Trichoderma harzianum*
GGCTGACAGATGCTCTATGACGGAGAGGCGAAGCTGGGTCGAAGCAGACGGGCAAAGCGATTTGAAATGGTGAACAGGG
GAGAATTTGCTCGCTGGCCAAGGGGGAAGAAATGATG > SEQ ID NO:639  214593  *Trichoderma harzianum*
GGAGCGAGATTCACCACGGGACACCGAGTAGGAAAGGGTGATGACGGTGTTGCGGAGACTGAGGGTGGTATTCTCTCGC
CCGAGTATCACAGGAGAATTCCCGCGGATGACTGTCGGTGTAGACAGAGGGCATCTGGGATCAAATCGTGAACAACAA
GGACCTGCATCTGCCGACGCAACACGAGCTTCTATCCCAGTTCCGATGTGACGAGATCTCTCCAGAAGTCCTGATTGCC
TTTGACCTACTTCTGACCCCACTTGAGGAGCAGCAGGCCCAACCCTCTAAGCTCGGCAAGGCCAATGTGCTCCCCGATC
TGGGCAC > SEQ ID NO:640  214602  *Trichoderma harzianum*
ACGCGTCGGGCGGATAGTTGTGCTATCGTTGTCTTCATGTTTTCATGTTTGCACATAGATACGAGAAGAGTTGTGGGAG
TTGGTTGCGTCATGACATAAGTTGTAATTATAGTATTTGCTGATTATAGCTGATTACGCAGGGTGTGTTTCCTAGTTGT
GTGGATGGATGTGTGTTGATCTGGCCCCCTGCATATTTCGGAGTAAATCATCCTCCCGATGGCTATAGTCGAGAGGTTA
ATGGGCTCTACTCGAGTTCTGTCGTGTAACAGCATCCATAAAGACAGTCATAAAGAAGTTCTTGAGTCATTTCTGATTC
TCCCTGTCAACATCATGATTCATCCAACTGAGGAACCATAATGAGCTTGTATAAACACTCACTAACCTCATTCTAGAGC
ATCCTTAAGAGGGTCTCTAAG > SEQ ID NO:641  214613  *Trichoderma harzianum*
GAGAGACTTGCGCTTCGGCCCGGCATTTGCACATTTTGAGAACCGAAACGAAGAAGAAAAAGGATAAAAAAAACATGGC
TTCTAATCAGTTTGATTCCCAGGCCTCGACCAACTACAAGGAGGCTTTTGCCCTGTTCGACAAGCGCGGCAACGGTCGC
TGTGCCGTCGACTCGCTGGGCGACCTGCTGCGAGCATGCGGCCAGAACCCCACGCTGGCTGAGATCCAGGAACTGGAGA
AGGGCCTTGGAGGCGAATTTGATTTCGAGGCCTTCCAGCCCATCCTGAACCGACCCGGCGGATTCCGCGACCCTGGCGA
GCCCGAAGAATACTGCCGTGGCCTTCCAAGTGTTTGATAAAGACATGACGGGCTTTATCGGCGTCGGCCAGCTCAAGTAC
ATCTTGACCAACCTGGGCGAGAAGATGACGGAGGAGGAGGTCGACGAGCTGCTCAAGGCCGTGGACACCAGCTCTGGCC

FIG. 1 continued

```
AGATCAACTACACAGATCTTGTCCGAACTATCCTCGCCAACTAAGATTCCCCTTGTACGAAGAACCTAACCCCCGGTGG
TATCTAAGTGCATCTGCGAACGGGATGGCGTTGCTATGTGTTTGTTTTGATTATGGCAGTGAAATTGGGCACGCTTGGG
ATTGATGAATTTTTCTTTTGTACGGGA
```

> SEQ ID NO:642  214620  *Trichoderma harzianum*
```
ACATATATACCCATCATGACTATGTGGGGTGGATTCACGCGATAGCAGACTATTTGCTGTCCTGGGTGAAACTCGAGCA
AAATGCGGAAATTGGGTGGCGTTCGTTCAATCGAAAGACCGGAAAGTTAGAGCGCGAACAACAGACACTGTGGAAGAAG
CTCAAGCTTCTCGTCTTATTTAACCCACTCATGGAATGGATTGATAGGAGTCAACTCATGCGTTTATACATGCATGAAG
AGTCAATTGCAGAAGGGCGAAGAGAAAGAACAACGAGTTCCAGGAGGCGCATCAAGGCTTTCGTTGACGCCTATGGAAT
AAACATGCATGATTTCGAGCCCTCTGATATCAGTCGCTATCCTACCTTTGAAGATTTCTTCACTCGTTCACTCAAAACA
GAGTCGCGTCCCATTTGTAAATGTTGACGACCCTTCCCATGCCGTCGTGGTGGCTGACTCGAGAGTCGTCGTCTTCAAT
TCCATTGGGGAAGCAAAAGCGTTGTGGATCAAAGGCAAGAACTTTAGCCTCAATGATCTAGTCATGAGCAATGAAGTAG
GTGATAAGTTTAGAGACGCTGCCATTGCGAGCTTTCGGCTTTCACCGCAGGACTA
```

> SEQ ID NO:643  214623  *Trichoderma harzianum*
```
GTGTGAATTCGCGAGCGAATGAAACTCGTCGCATGCTTTGGATCCTGCTTCCGACAAGCTCCCACGACTTGGCTTGGAT
AAACCTCTAACCTCCATTTTGGAATCGAGTGTCCTCCATGGCTCGAGAATAAGTCACATATTCAATCAACAGTATACAT
AGTTGTAATCGATACACCAATTTCTACTGG
```

> SEQ ID NO:644  214633  *Trichoderma harzianum*
```
GCCCTCATATATTGAAGGCATCGCCAACCCGATCACAAACCTTCTTGTCCAGACTTGCAAACCACTCAATCGATTCCTT
GATACCCCTTGGGACAACTCTACTTGTTCTCTCCAAACTTACCCCTCCAAATACCATCATCACCATCACCATGACCAAC
GACGTCTCTACCAACGGCTCTTCTGCCGCTCCTGCGACCACCTTTGCCCTCAAGGCTGGTCTCGCCCAGATGCTCAAGG
GCGGCGTCATCATGGACGTCACCAACGCCGAGCAGGCCCGCATCGCCGAAGAAGCTGGTGCCTGCGCCGTCATGGCCCT
CGAGCGAGTTCCCGCCGATATCCGCAAGGACGGCGGCGTCGCCCGCATGTCCGACCCGGCTATGATCAAGGAGATCCAG
GACGCCGTCACCATCCCCGTCATGGCAAAGGCCCGTATCGGCCACTTCGTCGAGTGCCAGATCCTCGAGGCTCTTGGTG
TCGACTACATTGACGAGTCCGAGGTCCTGACGCCCGCCGACGACGA
```

> SEQ ID NO:645  214634  *Trichoderma harzianum*
```
AGCAATTCACCATGTTGAGCTTCCTCGGAAAATCGGTAGCCTTGCTGGCTGCGCTGCAGGCTACTCTCAGCTCTGCAAG
CCCCCTAGCCACAGAAGAGCGCTCTGTTGAGAAGAGAGCCAACGGATACGCAAACTCCGTCTATTTCACCAACTGGGGC
ATTTACGACCGCAACTTCCAGCCTGCCGATTTGGTGGCATCAGATGTCACTCATGTCATCTACTCATTCATGAACCTCC
AGGCAGACGGCACAGTTGTCTCTGGCGATACCTACGCTGATTTCGAGAAGCACTATGCCGATGATTCTTGGAATGATGT
CGGCACCAATGCCTACGGCTGTGTCAAGCAGCTGTTCAAGGTCAAAAAGGCCAACCGAGGCCTCAAGGTTCTGCTCTCC
ATCGGTGGCTGGACCTGGTCCACCAACTTCCCCTCTGCAGCAAGCACGGATGCCAACCGAAAGAACTTTGCGAAGACTG
CCATTACCTTCATGAAGGATTGGGGTTTCGATGGCATTGACGTCGATTGGGAGTACCCTGCAGACGCCACCCAGGCCTC
CAACATGG
```

> SEQ ID NO:646  214637  *Trichoderma harzianum*
```
ACGAGAAAAAGGAACAAGCCGCGGGTTCTCAAAGTCTTCCGGTGCCGCCGGCCGTTTGGCTGCGGACCGAAAGTGTGGA
CAGGAATCAACTCGTGATGAGATCCGGGAAATG
```

> SEQ ID NO:647  214639  *Trichoderma harzianum*
```
GATGCTCCACCATTGCTTGCCTTATCGCATTCAAGGCCAGGTAACGACACTTGCTGCTGAGTCGAACGCAACACCGCCT
TCAACAGCTCCTCTGCAAGTCTCCCGCAAAAGGACAGGCTCAGTCTTGTGTGGGCAGCATGCGCGTCATTGCCCTTTTC
TCGGCCCTGTGTGCCGCAGCTCTGGTCCAGGCCGATTTCCACACGGCGCAAATCTATGTGCAGCCCGTCGAAAACTCCG
AGTCGCCCAGCCTCCTCGCCGAAGTGGCATACGATCCTAGCATCAGCGGGTCGTCCTCTATCATCTCCTACGAAGCTCC
TGAAATCCCGGAGTCTACACAGCTGGTCCGCGTCGGGTTGTACGACGTCAAGTCTGCGCGATGGATATCTGGCACAACT
GTTGCCTCGGTGGACAACTTTGGCAACGGCTACTCGCCCAATTTGATACTCTCAGTCGATGAAAGGGAGAGCTTCTCA
GTG
```

> SEQ ID NO:648  214643  *Trichoderma harzianum*
```
TGCAGGAACCTGCGCGGCAAGGTGACAAGGAACATACATTGCTTTCGACACAACCGACCCGGCCAGCCTCGTCAAGAAG
ATGAAGAGCCTGGGCGTCAACATTGGCACATGCGGCACCCAGACGGTGCGACTCCGTCCCATGCTCATCTTTGAGGAAG
```

FIG. 1 continued

CTCACATTCCTTTCTTGATTTCCGCATTGGACAAGGCTCTTGGATCCGCATAGATTGCAAAGTTGAAAACATTTTGGGA
AGCATAGGGGCGTTGTTTAATCAAGAGAAAGCGATATTTCATTTTACTTGGACTTTTGTAGTATATATTGG

> SEQ ID NO:649 214664 Trichoderma harzianum
ATCTTCTACACGATTGCGGACAAAGTCTATCGCGGTTTCTACTGCTGTTCAATCATTCTTCAACATTATTAGCACAATC
GCCATGCCGTATATGCTAAATAGCGACCAGGCCAACTGGGGAGGTAAGGCGGGCTTTTTGTTCGGAGGGTTCAGTTTCT
TCTGCACCATCTGGTGTCATTTCAGGCTACCTGAAAGCCAGGGAAGGACATTTGAGGAGCTTGATATTCTGTTCCAGAG
AAGAGTGCCACTGAGGCAGTTCAAGACGTATGACCTCTTGCAAGAGGTTGAAGGAGAAAAGACTACGACGGCATAATAC
CTAATAAAGGAAAGAAATTAATGCTTCTACCACTCGTTCGCCGCGAAGTCGGTTCCATAGTATGTGAATAATTATTTAA
TAGGGTTACACCTTTAATAAAAAATAATTCTCGTTTGCTGGAAAAAAAAAAACACAAAC > SEQ ID NO:650 214665 Trichoderma harzianum
CAATTGCAGTTTAGAGACATCTTAGAAATCAGAATGTTTGCCAGATCAGTTTTCCGTGCGGCCCAGCCGCTGAAGATGC
ATGCGCGCCGCTATGCCACCGAGTCTGGTGCCAAGGGCAGCTCAAACACTCTCCTGTATGGCGCTGGCGCTGTTGGTGT
AGCTGGTGCCGCCGCCTACTTCCTCAGCGGCTCCAATTGCTGAGAGCAAGGTCAAGGAGGTCGTTGGCGCTGCTCCCAA
GGCGGCGTTTACCGGTGGTGACCAGGGCTGGCTGTCCTTGAAGGTCTCAGAGGTCGAGGATGTGAACCACAACACCAAG
AGAGTTCGATTCGAGCTGCCGGAGAAGGACCAAGTTTCTGGCCTGCACATTGCCAGCGCTGTCCTCACCAAGTTCAAGG
CCCCCGATGCCGAGAAGGCAACTCTCCGTCCTTATACTCCCGTCAGTGATGAGGATGACCGAGGCTTCATCGATCTATT
GGTCAAGAAGTACCCCGATGGACCTATGAGCACCCACATCCACGGGCTCAAGGTTGGCGAGGAGCTTGCCATCAAAGGG
CCCTCTCCCCAAGTACCCCTGGTCTGAGAACAAGCAC > SEQ ID NO:651 214666 Trichoderma harzianum
GACCATTACCATCATACAGCCAACCTCTACATAAGCACAAATACCATTCAAAATGTCTTACGGCGGTGACAACAACGAC
AACTCTCGCCGTAATGACGACAACTTTGGCTCCGGAGGAGATTCTTTCGGCTCTGGTGGAAACCAGCAATATGGCTCCG
GAGGAGACTCATTTGGCTCTGGGGGAGATTCATACGGCTCTGGTGGAAATCAATTCGGCTCCGGCAACCGCCGTAACGA
TGACAGCTCATTTGGTACCAGTGGCCAGGGCGAGTTCGGCTCTGGAGGTAACTATGGCAGCTCTGGCGGTGACTCCTAT
GGGTCTGGAGGAAACACCTATGGCTCCGGCGGCAATGACAACTTTGGCTCTGGGGGCAATGATACGTACGGCTCGTCCC
GTAACCAAGAGTCTTCTTTTGGATCCA > SEQ ID NO:652 214672 Trichoderma harzianum
GACACAATTCCTCGCTGCGTGTGACTCGTGTCTCCAGCAAATACCGCAAAGATGTCTGACGACGGGCTCTCAATATACG
ATGAGATCGAAATCGAAGATATGACCTTCGACGAGGTTCTTCAAACATACTTCTACCCGTGTCCCTGCGGCGATCGTTT
CCAGATCGCTATCGATGACCTGCGCGACGAGCAGGATATTGCTGTGTGCCCCAGCTGTAGCTTGATGATTAGAGTTATT
TTCGACCTTGACGACTTACCCAAACCTCCTCCTACTGGCAATACTGGTGGCCAGATACCAGTCGCTGCTTAAAGCCATC
GCTATATTTGAGCTTCCCTGGGCGAATACTTGATCTATTCGGCAGACACATCGAGATACTACACTAATTAGGCCCGCAT
AGCGTACACAGTGCCTCAACGGCCGTTCTGAAGAGGCTTCTCAGATTGATCCGTCTAACATCGGATGTATTGATAGACG
CGGACGAGAAGACGACGATGTACCAGCGACAGACCAAAGTCATCCCAAGCATCCAAGCTACTGATGCAAAAATATGCGT
GCCTTGGGAGTACCACTCTCCGAGGCAAAAATTCAGTCACTTAAAGAGACAGGCTTCGGGAATGCCATGAAGAATTCAG
GCTCACGTGGGGGACATTTGATG > SEQ ID NO:653 214676 Trichoderma harzianum
ATTGTGGCCATGACCGTCCTCAACACCGCACAAGCCCTCTGGGCCCGCCTCGTAGCAACCCACGATCCCCATACCATAG
ACTTCGTCGGCACCCTCATCATCCAATTCATCTTCTGGTGGATCCCCTGCATCCTCTTTGTCTCTCTCGACTCTATCGC
GCCCTCCTTCTCCGCGAAACACAAGATCCAGCCCGCCCCCAAACAACCCTCCGCCAACGACATCCTCCACTCCGTCCTC
GTCTGCATCCGCAACCAAGTCATCGTCTTCGCCCTCCACGCCGTCCTCCTCTATGCCTCCTCTGCCAAGGGCCAGTCCC
CCAGCATCAGAGTCGACGCGAGCTTCCCCACGGTCCAGGAGTTCACCTACCACCTCGCCGTCAGCGTGCTCGCCCGCGA
AGTCCTCTTCTACACCTCCCACCGCATCTTCCACTGGCGGCCCTTGTACAGGCGCTTCCACAAGACGCACCACAAGTTC
ACCGCCCCCGTGGCCTTCTCCTCGCAGTACGCCCATCCCGTGGAGCATCTCATGGCAAACGTCCTGCCAATCTTGCTTC
CGCCGCTGCTGCTGGGGTCTCATATCCTGACCATGTGGGTTTTTGTGGCCTTTCAGCTCATCGAGACATCAACGGTGCA
CAGCGGATACGACTTCTTTGCGGGAGC

FIG. 1 continued

> SEQ ID NO:654 214687 *Trichoderma harzianum*
GACTCGACATATCGCACTGAGACTCCCCCATCGCTGACGCAAGATGGCTTCTCATGCGGCAGCAAAGGCTGCTGGAGTG
CGTTGTTTCCATTGCAAAGAAACAAACCTCCAGTCCACCGGCTTGTGGGAGACCTTCCGCAAGGCCTTCGCCCTCGACC
CCAATCGCTCCAACGGCGTCCCCCTGAACCCTTACTTCCGAAACCCGACGCCCGGAGCCTTGGAACCCCTCAGCT > SEQ ID NO:655 214707 *Trichoderma harzianum*
CGTGAAACGAGCCACTCTCACTCTCACCCTCATTCTCACTCCCACTCTCACTCTCACATGTTTTTCTTACAGAATCTCC
ACCAGTTCAAAGGTCTGATCCTTCTGGCCACTGCACTGCGCAGACTCCACCCGGTCAGCGCCAGCGACCAAGCAAGTCG
TGTTGGTGGCCGAGGCGGGAGTAAGGATGATGTTGTTGTCGCCCGCCTTGAAGGGGAACAGCTGCGAAGTCGCGGTTTT
GCCACCTGTTGAGGTTCATCGTTAGCATTTGATCTCTTGTGAAACTAAAACGGTACAAACGCGATAACTCGCATGCCCT
TGGATCGGGTGGATCGAGCAGATCACCGAGATGGGGTGGGGGGAAATGATGTCAATGACTTACTTCCATCGGCGCGTCC
ACCGCAAGAAAACATGATGACCTGGTCGTTGGCGGCTCTGCGGCCATCAAAGTTGATGCAGCCGTTGGTGAGCACGCTG
ACAAGCAGCGCCTCGCCGGCCTGAGCGTCGTCGTGGACTCCCTTGGTGACAACGTCAAACTTCTGGCTCGCGTCTTCGC
TGCAGGTAGCCAGTCCAACGGGGATCAGGTTCTCGCGGAAATCACCGGCCGTGGGGTTGACAAAGAAGCAGCGTCCATC
GGCGGCTCGGATGTTGACACTCTCC > SEQ ID NO:656 214715 *Trichoderma harzianum*
TAATGAACGAGGAAAAGCTCGGCCACAGTAATCATGAGGACATTGTGCCTCCAGAATCCTCTACTGGAGATGAATTACA
GACACCATCTACGGATTCCAAGGGCAAACAGAAGGCAGGCCTGGAGTTAGCAGCATCTCAACTTGGGGCCTCTACAAAG
CTGGTCGTCAATGCCATCACAACGTTTCGGGAAATGCCAGCTTTGGCATCAGAATCAAAGTCCTCTCATGGTTCAAGTA
GCATGGGCTCGTTTTCATCTATCGCTGGCGAG > SEQ ID NO:657 214724 *Trichoderma harzianum*
ACTCGACCACGCGTCCGTCGGATCGGCCTCTTTTCCTCTCTTCCCTCTCTGCTTTCCATCTGCCCAGCAGACCGAGTTT
GGCAGCGCAATGTTGCCTCTATCGGTGCGGCGCGCGGTGGCCGCTGCTCCTCAGGGGGCAAGTGGGCTGACTTCTCTCG
CCGCGTCGGCTCCAAAGATCACAGCCTCGAGCTTCATCCTGAATCGTCCTCAGCGGCGCTACTCCTCGTCGAAACCCTC
AAGATCCGATGAGCCCAACGATATTGCTGCCGGCCAGTCGGTGCCGGCATCTACCTCGCGCGGAGAGAGCAAAGGCAGC
AGGAAACGAAAGAGCAAGGATTTCAGCCGACCGAAATGCGGCTTTCAAGAAACTGCCCAGTGTCCCTAGCACTCACCAC
ATGTTTCAAGAGGCCCTGAGCTTATCGAGCTTCTTCTCACTCCAC > SEQ ID NO:658 214740 *Trichoderma harzianum*
CCCACGCGTCCGAAGACTACAAAGCTTTTGGTCCAGCAACCATAAATCCAACTCATTGTCCCTCCACCACGAAATCTAG
CAACCTCTCCTCCTCGCCACACAGCCCGCAATGCTCACACCAGCTTCTTCAAGAATACTCGCCAGCGGCGCCCGCCGTG
CCCTTTCGTCGCGCAGCTTCCACGCTTCGGCTCGGCATCTGAACGACTCTCCCCCCCTGCCCGCGCGGAAGCCCATGGG
CGCCTTCAGAGGAGGTCTTTTCGGCTTCTTGTTTGGCAGCGTCCTGGCCGGCGGTGCCGTCTACAGCTACGTCCTGCAG
GAGTACAAGGCATCCAACGAGTTGCTTACCGAGGATATCTACACTCTTCAAGCCTCCGTCACCCGACTGACAAACACG
TCAAGATCCTTGAGGAGAAGATCCAGCAGAAGAGAAAGTAAAGCCCGAAAAGATAAAAAACACAAATAGCGCAATGTCA
TTAGGGATGGTATGATACCAGCGCTTCAACGCTGGTGGAAAATACTGGGCAAACGAACAGCATTATGGCAATACTTGTG
TCCTTGTTTGTAACAACCTAACAAAGCCTCAATTGTAAATCGTACCTTAAGTATCTAGCCTCTGAAATATCTAGCACAG
GAAACAGCACAAAAGCCCATCATACG > SEQ ID NO:659 214746 *Trichoderma harzianum*
GTTTTTTTTTTTTTTTTTTTTTTTTTTTTTTTTTTTTTTTAAATATGTGAATATGATCATGTATTTAAATAA
TAACATGGAAAATAAGAGCAGCAATAAATGAACCTCCTACGTACATCCTCTCCAATGCATCTTACCCAACCGATTCACT
GCAAACATGGGGGTCTCAATCAAATGCACACCCACGGAATCGGGCGTCCGTTAACCCATTTGGGCACAAACTGCATGGG
ATATCATCTTATGGAGAATCCTTCGGAAGCATCTAGAGCATTCAGGGTTCTTTGCCGGCAGTGACATGCTTACAAATTT
GTCATTTTCGGGATGCATATCCGTCACTTATCAATGTAAACCCGGACTAGTTCTAGATCGCGA > SEQ ID NO:660 214756 *Trichoderma harzianum*
TCTCATCTTCTCTCCAATCCCCAATCCTCAATAACCTACGCCGTGTCAGTCAAGCAGCTGTACATCATCGCATATCGAC
CGACGACGACCTTGTCCTGCCGTCTTCCATCTCCAATTCTCACCCACCACTTACACCATCACACATCACAATGCCTGCT
CCTCAGGTTAACGGCGAGGTCACCAGCCATGTCAATTCCGCCTTCCTCCAGCACCTCTTCTCCTATCCTCTAGTTAGCG
ACGGCATTCACACTGTGACCACCAACGAATACGCACAGCGGCCTATCAAGCTGGGCGAATCTGCCTATAAACTTTTGC
CGCCCCTGTTCTTCCCTACTTTTCCAAGCCCTATGGTATTGTCTCTCCCTACGTCCAGAGGGCCGACTCCTTTGGCGAC

FIG. 1 continued

AAGACCCTGGACCGCATTGACGAGCGTTTTCCCATTGTCAAGAAGCCCACTGGTGATCTCTACAACGAGACCCGTGGTC
TGATTCTGTTCCCCTACCAGAAGGGACTCGAGGGCAAGGAGCACGTTTTCAAGATCTATGCTTCCGAGCTTAAGAAGCT
TGAGCAGGAGGGCGTCGTGGCCCAGGCCAAGGCTGCCGTTTCCACCGCCTTCGTCATTAGCAACGAAACGCTGGCCTGG
CTGAGCAGCTGGGTCGCTGTCAAGAAGGCCGACGCCTC

> SEQ ID NO:661 214762 *Trichoderma harzianum*
ATTCTCCGTGACATTTGCGACGACGCACAGCCCAGCGAGCCGCGTCACCGCCTGAAACGCTTTGCCTAAGCTATTGTCT
TCATTTCCCACATAGTGGCGGGAATCCTGTGGAAAGGCGCCACTCCAACAGCGGAAGCTGTGGGTGGCTCCAGTAAACC
GGACTCCATCATGTCGCAGCCTCCCGGACAGCCTCGCCTTTCACCCCAGTTCTGCTTCTCCTTTGGCACGCTTCGCTGC
ATTTCNCTGCGCGCTGTCTCGCATCATCAATAGACGACTCCATCACTCAGAATCTCAATGCTCTGGTAACACCGGCTCG
GACGGGCTTCGACCCGAACTCAACTTCAAAACGTGCCCCGCGATCCTTTGCCGAGCCGATCGGCCCTGAAGCATGTCAG
TCTTTCAAAGAGAAAGTCTTGTTTCCGTCGTGGAAGGCTAGAGCCGAAGTGCTCAGCTATTGCGGCATCGTTGCCACCA
GGCCGGACCCCGATGACCCCG > SEQ ID NO:662 214766 *Trichoderma harzianum*
GCGGTCTTCGATTTCACCCTACCGTCAACTTGTCCATTCTCAAGTTTCTTGGATTTGAGCAGATTTTCAAGAATGCTCT
GACCGGTTTGTCAATGGGTGGAGGAAAAGGTGGTGCCGATTTCGACCCCAAGGGCAAGTCTGACAATGAGATCCGCCGT
TTCTGCCAGGCCTTTATGCGCGAGCTGTCTCGTCACATTGGCGCTGACACCGACGTTCCCGCTGGCGACATTGGTGTTT
CTGGCCGCGAGATTGGATACATGTTTGGAGCCTACCGCCAGGCGAGGAACAAGTTTGAGGGTGTCCTGACCGGAAAGGG
GCTGAGCTGGGCTGGCAGTTTGATTCGACCTGAGGCTACCGGCTACGGCCTCGTCTACTACGTCGAGCACATGCTCCAG
CACGCCGGCAAGGGCTCTCTCGCCGGCAAGCGTGTCGCCATCTCCGGCTCCGGAAATGTCGCTCAATATGCTGCTCTTA
AATGTATCGAGCTCGGCGCCACCGTCGTCTCGCTGTCCGATTCTAATGGCGCTCTCGTGGCCCCCGACAGCGGATCCTT
CACGCCGGAGCACATCAACGAGATCGCCGCGCTCAAGGCCCAGCGCCGGCCCCTGACGGATTTCCAGTACGGCGACAAG
TTCAAGTACTACCAC > SEQ ID NO:663 214771 *Trichoderma harzianum*
CGCCCATAACCAGCAATCATGTTCTGTCTCCGAAGCTGGCTCCCGCTCCTCTTCATCCCGACAAACGCCTCGCCCGCCT
TCATCCTCCTCTTCTTCATCTGCACCTACTTCCTCAACCGCCCNCTGCGTCTACTCGCTNNCCGTCCTCCTCCTCATCC
TCTTCCTCACCTCGTGCAACTGGTCCGACCGCTGCTTCTTCGACCTCAGCAGCAACTGGTTCCTCCCTCGACCTCCTTC
GTCCCTCCAGCTCCCCGTCGACGATCAAGACTCGCACGCCCTCGCCCTCGCCTTCAACGACACCCTCGTCGACATGGTC
AATTCTACAGCCAAAGCCGCTGCCCGCGCCGCTGCGGACGGAGGTCGCTGTGCTGCGCAACGAGTGGACTGGCTTGGGC
GTCGAGTGGCTGCGTAATTTGCTGGGCAAGCGGGAGTGGAGGATCGACTGCATGGACATTTACATCAGGTTGTAAAACG
AAGGGGAATTACATACAT > SEQ ID NO:664 214787 *Trichoderma harzianum*
ACCACCACTCAGCAAGCAACTCATCAAAACAGCCACTCTCACTTTTCTCTCAAAGTAAAACACTTCAAACCGCCAACAT
GCAGGTTACTTCTATGCTCGCTCTCCTCTTTACCGTTGCCACTGGCGCTCTTGCAGCTCCCGGCCACGGAGCTCCTCCT
CCTCCCCATGTTCCTCCCCCTCCCCCTCCTCCTCCCACCAACCAAAACACCAACACCAACAACAATTGGCAATCCAACA
GCTGTGGCAACGGCGCTTCTCCTTACTGCTGCAGTGCTACAGCTGATGGCCTGGGAGAGAACTACTGGAAGTGCTCTGA
TCTCAATGATGTGTGCAACGACGTCATTGTTTGCTGCAACAACAATAGCAACAACAACAACCAGCAGGGAAAGCAAAAC
AACATCGACACCGGCAACCAGTCTTGCAGTGCCTTCGGACAACAGAAGGTCATCTACCTCTAAGCTTGCCTGCAGAAGC
TCAAAGTCGGCAATGGCTCTCTTATTTGCTTGTATCTTAGTCTTATAAGG > SEQ ID NO:665 214794 *Trichoderma harzianum*
TACATTAGCAGAGTGGTTTTAGTTTTGGAGGAGTTTTACTTTTTATTCTCTTTCATATTCCAATTCTGTACTTGTCTCG
GAAGCCATATTTACAACTCTCAACACCACAATGGCGGGCTTCAAGAAACTACTCCAGACTCTAACTGGGAAAAGAGCG
ACGATGCCACTCAACCCGAAGAGCAGCAACGCCAAACTCCTCAGCCCAAACCTTGGTCCGGCATCGACAACACCCAACC
AGCAGGCTCGAACCCCATCCGCGGCTTCTCCACCGAATATCTCGGCGAGCAAAAGTCCAGCAACACGGCCGTCCGCCGG
GACCTCGGCTTCGCGGGCCACATCGGCGGCCAGTGGTTCGGCGTGTACGGTGACACGCTGTGGTGCAGTCCCGGGGTGA
CGGACCCGGATTTGGAGCCGGATCCGGAAGGGTTCCACGGCATGGTGCGGAACTCGGTGGCGGTGTTGACGGATGATCC
GCTGGTAGTTCGGTTTGTGCATTTGAATGGGGATGAGCCGGTGGCGCATCCGTTGCAGTTTACGCCGTTTGAGGAGCGG
TGGGGGGAGACGAATTTGTTTGGGTTTGGGGGACGAGTCTTGTGGAGGTTGATGGCTATGGGGAGGGTGTTGGGGCGC

FIG. 1 continued

> SEQ ID NO:666 214809 *Trichoderma harzianum*
GGCAAAATGTCCACAATGGAGGCTCCAGTTGAGAAGAAGATTGAAAAGACAGCAAAGCCTTATGGCATGCGCAAAAATG
GAATGCAATGGCATGCTCCGAAGAAGGCGTTTCGCCCGACCAAAGGCCTCTCATCGTATGAGCAGAGGACTAAGGAGCG
AGCTGCAATGGCTCAGATGAAGGCAAAGGAAAAGGAGATGAAGGAGGAGAAGGAGGAAGAGCGCCAGCGTCGGATT > SEQ ID NO:667 214819 *Trichoderma harzianum*
GGGATCACGAAACTGAGGATGTACGAGTACAGATATTTGCATCATGGATCTGATATTGGGAGAGGAGAGGAGATGCACG
GGCCTTGCTTTTTTGGGGATGCAGGCAGGGGAAAAGCCGTCTGACAAGTCATTTTCGCGTATTGAGATGGACAGAGTTC
TAGATCCATTACTAGTTGCAAGCACGGTCTGACGGCATGTCGTATGGTGTTACTGCGTCTTGTGTGAGGCCAAGACAGG
ACAT > SEQ ID NO:668 214824 *Trichoderma harzianum*
AACACCTCTCAACCATCTACCTCTTTATTATCTCATTAGTTTTCTCATCTCTCAGGACTTGACTGCTTCTACTTCATAT
TCATAAGTGAGAAGGAATAGACGCAATGGCTGAGTCCGAGAAGCATGACCTCGAGAAGCGCGAGCTCGAGGACGTCGGC
GTCGATCCGATCCGCGACTCGGAGAGCAATGCCAAGCCCATGACGCTTCAAGACAGCGAAGAGGACTTTGGCTTCACGC
CTGAGGAGCAGCGCAAGATTCTGTGGAAGGTCGACAGACGCTTGGTCGTCACTGTTGGGGCCATG > SEQ ID NO:669 214826 *Trichoderma harzianum*
AGCGGCAAACCGACGCCATGAGGTCCAATGGCGCTTCTGCACTGCTGAACGCCTTCCAGGGGCTGAAGATTTCCGCATG
CACCCCGTTGCGACAACTGAGGGCCCCGATTCAGCACCAGTCCAAGGTTCTCGGCGCCGCTCTGCTCCAGAATGGCAGA
GCCTTTTCCACAAGCCCGGCCATGATGGGCACATGGCTCGAGCCTAGCTTGAACCGAAAGAAGAAAATGGCAAAGGGAC
GGCCGCGAGTAGCGACGGGAGGGTCTACAAGGGCACAACGGTCATCTGGGCGACTACGGATTGCGCATGGTTGATCA
CCACCGAAGAATCAGCGCCAAGTCACTAAAGATGGCTGAGGATACGATTAAAGTGCGACTTCGAGGAGAGAAATACCGA
CTTTACAAGAGGAAGTGCTGCAACGTTGGTGTCTACGTCAGCGGTAACGAGATGCGAATGGGTAAAGGAAAAGGTTCTT
TCGACCACTGGGCCACAAGAATGGCAGTCAGCCAAGTCCTGTTCGAGATCAAGGGCCGAATCCACGAGCAGATTGTCCG
AGACGCTTTCCGGTTGGCTGGCAACAAGCTCCCAGGCCAGTGGGAATTTGTGA > SEQ ID NO:670 214828 *Trichoderma harzianum*
CTCGCATTCGCCCATCATGTCGGCTAGAATCCCAGCTCTTGTTTCAGCACACGTCAGCGAGGCGGCGCGACAGAAGATT
GACATTGTCGCCAAGTTTGTCGAGGAAGAATGCATCCCCGCCGATCCCGTACTTGAAGCCCAGGTTGGCGAAGGCGATA
ACCGCTGGGAGAACCACCCGTCCATCATCGAGGAGCTCAAGGACAAGGCACGCAAGCTGGGCTTGTGGAACATGTTCCT
GCCCAAGGGCTTCTACGCCGAGTCTCCCGGCTGGACCAACCTCGAGTATGCCCTCATGGCAGAGTGGCTGGGCCGCTCG
CGCAGCGCCTCGGAGGCGTGCAACTGCGCTGCTCCCGATACAGGCAACATGGAGGTGGTGGCCAAGTACGGCAATGCCG
CGCAGAAGGAGGAGTGGTTGAAGCCCCTGATGGAGGGCAAGATTCGCTCGGCTTTCCTGATGACTGAGCCCGAAGTCGC
GTCATCGGATGCCACCAACATTCAGCTCCAGATCACTCGCGACGGCGACCACTACGTCCTCAATGGCTCCAAGTGGTGG
TCCAGCGGTGC > SEQ ID NO:671 214837 *Trichoderma harzianum*
AGAAGTCCAACTACCAATTCACCCACAAGATGCTGGACCAGGAGCCCAAGAAGACGTCCGGTGGTGAGGTGCGCATCAC
TGACTCCAAGAACTTCCCAATCTCCAAGACCGTGGCTGCTGCCCACGCCGTCATCGAGCCCGGCGCGATCCGTGAGATG
CACTGGCACCCCAACGCCGACGAGTGGTCCTTCTTCATCA > SEQ ID NO:672 214840 *Trichoderma harzianum*
GGAGCGATTGGTCTCCGAGACCAAGAAGCTCACTCAGGGCGTCCCCTGGGACCACTCCAACTTCATGGGCCCCGTGATT
CACAGAGGCTTCCTTCAAGAAGCTCTCGGGTGCCATTGACGAGGCCAAGAGCGACAAGGACCTCGAGCTCGTCTTTGGC
GGCACCTACGACTCGTCCAAGGGCTACTTTGTCCAGCCCACCATCTACCAGGCCATCAGCCCTTCCCACAAGTTCCTCT
CCACCGAGTTCTTCGGCCCCATCCTCACCGTGCACGTCTACGACGATGCCGCGCCCGATGCCTTTGCCAAGGTCTGCGA
GCTGGTCGATGGCACCTCCGAGTATGGCCTCACCGGATCCGTCTTTGCCAACGACCGCGAGGCCGTGCGCTTTGCCGAG
GAGAAGCTGCGCAACGCGGCGGGCAACTTTTACATCAACTGCAAGAGCACCGGTGCTGTTGTCGGACAGCAGCCGTTTG
GTGGTGCCAGGGCCAGCGGCACAGACGACAAGGCCGGTAGTCCCAACCTGCTGACGAGGTTCGTCCACATCCGGTCAAT
TAAGGAGGAGTTTGCGGCCACGACACAGGTATCATATCCTAGCAACG

FIG. 1 continued

> SEQ ID NO:673 214847 *Trichoderma harzianum*
GGGAAGGGTTTCAGGGCTCGGCGCACATGTCCACGACTGGCTAGTAGGCAATGCGTCCTGATCGCTTCTTCAATTTAGC
ATTCGGCTGAGCCCTCGCACCGTGATGAAAACAAACCAGCAGGCGGGTCGGAGCCGCTTTGTTGACTGACCAGGGAAGC
GGCCAAGATGTTCTATACCTAGAAATGCGCGGCCCTGAGGTACAAGTAGCGTTCGCGCCAATGCTAGCAGCCATTCCTG
GATGGGCGGAGGCGAAAACAAAGACCAGAGGAGTTGGCTACTGCACCCATTTCAGGACTAGGTGACATTAACGCGAAGC
ACAAGGGTTGCTCGTATGGGCAAGTTAGGTATGTACGAGTACAATATCACCAACAAAAGTTGTACTTGTATGAGCACAC > SEQ ID NO:674 214873 *Trichoderma harzianum*
ACGCGTCGTCATGGTCGGCTCCGCCTCCGAGCGCGACGGCATCGCCAAGCACGGCGCCAAGCTCGTCACCGCCGTCGCT
TGTGCTGATGTCCCCAAGTTCACCGTCGTCGTTGGTGGCAGCTACGGCGCGGGCAACTACGGCATGTGCGGCCGTGCGT
ACAGCCCGCGATTCCTGTGGATGTGGCCCAACGCCCGCGTCGGCGTCATGGGCGGCGAGCAGCTCGCCTCCGTCATGGA
GACGGTCGGCAAGTCGGTCGACCCGGAGCTCAAGGAGCGCATTGAGAAGGAGAGCGAGGCTACTTACTCCTCGGCCCGT
CTTTGGGACGACGGCATCATCCCTCCCCAGCACACTCGCCAGTATCTCGGTCTCGGCCTGAGAGCCGCCATGGGAGGCC
GCAACGAGGTCAAGGCCGGAGACACCAAATTCGGCGTCTTCCGAATGTAAGCAAACAAAGAAAAGACAAGAGAAAGAAA
CAAGAAAAAATGTATCAAAAAAAGATGTAAAAAGTAATATATACTACACACTCATGTAAACATGCAAACAACCCCGTGT
CTTTTTGA > SEQ ID NO:675 214888 *Trichoderma harzianum*
CCACGCGTCCGCCAGGCAAGGTGTTCAGTCGAAATCCAACAAGGGCCCTCCATCACCGACATTGGCCAATGTTGCGCGC
CACTTTGCTGTGGACAGCGGCTCAACATTGCTTGCCACGGCGGTAATCACAGTCTTGATATTCGGTGGATGGTGCTCTA
ACGTGTATGCTTTAGAGGCCATCATCAACTTCGATCCGACAAACGGAACCCTCGTAACTTTCGTTCAATTCCTATTCGT
CTCTATAACGGGCTACGTAGCGCAATTCGATAGATCACGCCCGCCGTTCTTCCTGACTCCCAACGTCGTCCCGCTTAGC
CGCTGGCTTGTCAATATCCTGTTGTTCTTTACCATCAACGTCTTGAACAACCATGCCTTCAGCTATGACATATCCGTAC
CGGTTCACATCATTCTACGATCCGGAGGTAGCATAACCACCATGGCTGCCGGATACCTTTACGGCAAGACGTATTCGCG
CCCCCAAATATTTGCAGTGTTTCTGCTGAGTATTGGCGTCAGCCTCGCTGCTTTGGTCGGATTCAAAAGACAAGAAACC
GAGTGACGGTATTTCTGACCCTGTATTCAACCCTGGGCTCTTGATCATCTTTG > SEQ ID NO:676 214902 *Trichoderma harzianum*
ACCCACCATTGAGATTCTATCGCCCACCGAGCCTACAACACACAGCACAAGTATTATCGCCCATCATGCCTCAGCCTAT
TCCCGCAGCCAGCCGTCTCACCGACCTCTTCAGCTTGAAGGGCAAGGTCGTTGTCGTCACCGGAGCTTCCGGGCCCCGA
GGCATGGGAATTGAAGCTGCGCGTGGTTGCGCCGAGATGGGCGCCGACCTCGCCATCACATATTCGTCTCGCAAGGAGG
GTGCAGAGAAAAACGCTGCAGAACTGGAGAAAGAGTACGGCGTCAAGGTCAAGGTGTACAAGATCAATGTGAGCGAGTA
CAAAGACGTCGAAAAGTTCGTCGATCAAGTGGTTTCCGATTTTGGCAAGATTGATGCCTTCATTGCCAACGCCGGTGCG
ACAGCAAACAGCGGAGTTGTTGATGGCAGTTCTGACGACTGGGATCATGTTATCCAGATCGATCTGAGCGGCACCGCGT
ATTGCGCAAAGGCCGTCGGCGCTCACTTCAAGAAGCAGGGTCGCGGATCCTTTGTCATAACAGCTTCAATGTCTGGCCA
TGTCGCAAACTACCCTCAGGAACAGACCTCATACAACGTTGCCAAGGCTGGCTGCATACATCTG > SEQ ID NO:677 214904 *Trichoderma harzianum*
GGCTTCTCACGGGTAGTTGTATGAAGAGGAGATATCTTGCAGGTTTTTTTATCTACCTGTTTTCACCCCTTGGACGTAT
TATTTCTTATTAGTTTTGTTTGTTTGCCAAGAAATTCTATTCGCCATGGCTGTAAGACGAATGGTGTTTGCCGCGGCTC
TTGCTGGTCTGGCGATGGCCAAGCCCATCAAGCCCATCAAGCCAACAGGCACATTCTGTGGCATCATCTGCATAAGCGC
GATTAGCGATTGCGGCGTACCATATGGAGGTTGCTACGATCCTTGTGTTGACCCAGCCCCTACACCTCTTCCTTGTGAC
GTGGAAGGTCCAGTTCCGGAGAGTCCAGTCGTTGTGAGCCCAGTCCCAGCAACGCCAACCAGCGAAAATCCGTTCTCAG
TCACGCCTGGTTCGACCTCAGTCACTCCCACCGTGGAGAGTCCGAGTTCAGTCACTCCAGCCTCACAGACCCCAGTCGT
TGTGGTGAGCCCAGTCCCAGCGACGACAACCGGTGAGAACCCGAGTTCAGTCACTCCAGCCTCGGACACTCCAGAAGAT
GAGGAAACTCGACAAGATTCTGA > SEQ ID NO:678 214907 *Trichoderma harzianum*
GCATGATATTGAATGGTTGGAAAGTCAGGTGGAGGCGTTCAAAGCAATCACAGCGACCCTGCCGCAGCTTTCCTTTCAT
GAGACGAAGCGGTCGGAACATGGCTTTGTCGTCGAACAGCGGCATTCCATGTCTGGCTCGGATGGTGTGCGGATCGGCC
TGTCCGCTACTCATTCGGGTTTGATCCAATTTGAGGGCCGCGATGCAAACTACCAGACGTTTGTAGAAAAGTTCCGCGA
AATGATACATAAAGCCAAGG

FIG. 1 continued

> SEQ ID NO:679 214908 *Trichoderma harzianum*
TGGCGTGGCGCCTCAGCCAGAAGCGTTGGTGATGACACCCGACCTCGCATTTGTGTACTAGTATGTACACAACACAGCC
GTGTGTCAGAGTATCATATCAGAGCTAAGGTTAGGTAGACAGACAGACGGCTTCGTTTGGCAACTCGCTGGATGCCAGA
TGGCAGAGCTTAGATGGTCAGCTTGGATGGTTGAGCACAGATGTGAATAGGCACCTGCGAGGACCAGCAGTGAGCAATA
TTGGAGCAGTAAGAGTAAGGTAGCTGTCGGGATAGAGACTTGAGGACGGGCTGCTCCGTCCGGTCCCCATCTCGTGGAA
CCCGTAATCCAGTCAATGGATACCATAATCAATCCATAACTCCTCCAT > SEQ ID NO:680 214918 *Trichoderma harzianum*
TACAACTCTCGCCCACAATGTCTCTCAAGAATGACGCTTTCCCTTCCTCCGAGGCCTTCGAGGCCATCAACGCCGCTCT
CAGCAGCAGCGAAGCCGACCGCAAGGACGCCATCAAGAATGGCAAGGCCGTCTTCGCCTTCACCCTCAAGAACAAGGCC
GGCGAGACGGCCAGCTGGCACATTGACCTCAAGGAGAAGGGCACAGTGGGCACTGGCGTCGGCGAGAACCCCACCGTCA
CTCTGTCTCTCTCCGACGAAGACTTTGGCAAGCTCGTCACCGGCAAGGCCCAGGCCCAGCGCCTCTTCATGTCCGGCAA
GCTCAAGGTCAAGGGCGACGTCATGAAGGCTACCAAGATGGAGCCCATCCTGAAGAAGGCCCAGACCAAGGCCAAGCTG
TAAAAAGCGGGCATTGGCAAGTTGGGCTGTTGATTATGGGAAAACAGGTGGAAACAAACCATTAAACGGCATTTTTTTG
TTTTTATATGTATCATACCATCGCTGTTTACTACCACTGATGTTTACTGTGTTTTCTTTGTTCCCCGGCCGCAAAAGA > SEQ ID NO:681 214919 *Trichoderma harzianum*
GCAAATGGAACGCCGAGGGGTTCGCTGAGGAGGAAGACGACGATGTGCAGCTGGATTATTCCCGGCCTAGTCTCACAAG
TGACTCGGAGGCTGAGGCAGTTGGGCGGTCCAGCGCTCTGGATGCTGTTGAGTCGTCTACCTGGGGATCCACAAGCAAG
GGCAAGTTCATTCTCAAGGACTTGGGAGACGAGGTGCACGACATCTTGGCCTCCGGCAGAGGCTCAGAAAGCCGAGAAGG
CTGCACGAGCAGACACCAAGACTGGCCTTTTGGGCACCGGAGTCAATGCCATCAGTGGGCTGTTCCGGAATGTGGTGGG
CGGCAAGACGTTGACCAAGGAGGATCTCGACAAGGCCATGAAGGGCATGGAAGATCATTTGCTGCGCAAAAACGTGGCG
CGCGAAGCTGCCGTTCGTCTTTGCGAAGGTGTCGAAAAGGAGCTGGTCGGTGTCAAGACTGGAAACTTTGAAAGTATCA
ACGCCAAGATCCAGGCGGCAATGGAGTCGTCTCTCACCAAAATGCTTACTCCCACCTCATCCCTCGATCTCCTTCGCGA
AATCGACTCCATCACA > SEQ ID NO:682 214920 *Trichoderma harzianum*
AACCACGGCCACGACGACCGCGTCTGTCCGGGATTGATCCTGTCAACTGCTTTACCAGATATCTAGCCGTGCCACGATA
GAGCGCGCATGTCGGCGAGAGGGGGGCAGAAGAGGAGAAGAGTCAAGAGAAGGGGGGGCACAGCTGATAGACAGAGCGC
CGTCGAGCCTGTAGCATCGCCAAACTCAATGTAGGTACGTCTGATGAGTGTCGCTGCATGCAGATGACAGTCGTGGATG
CATGTCATTGGCACTTGATCAGCTCCATATTTGACAGTGCCCCTCCAACGGCGGCAAGCGAGAGTGAGGGGTTTGCTGT
TGTTATTTGTTGTTGCTGTTGCTTTGCTGTTGCATTTTCCTGAGGCATATGGGCCAAGATGAGAGATGGATGGATGACA
TGGATGAGATTGGTTTTTGTGTATAACAAAGCTTGATAATGGCATTGAACAAAGCTTGTGCCGGCTAGTCGATAAGGAC
GATGTCGATAACGCGTATCGCAGCTATCAGCCCATCTAATCGCAGCACAGCCTAACCCCGAGGAAAAAAAAAA > SEQ ID NO:683 214922 *Trichoderma harzianum*
GATACCCAGTATACAGCAGACCGTCCCGAGTATCCCAAGTATATCAAGTGCAAGACTGGGTTTATAACAATCGTTTTTG
ATAAACTGCAATTTTTCTCATTTCATACGCGTATTGGAAGACACTTTATTCGTATATTTACGATCTGTTCCTTTGCCTG
TCGAGTACACCACTACACCACTCAACGACACCTACATATTTCCTTTCACCATGGCACCAACCGCTATCGTTGATCTCGG
CGAGACCTTTTCCGTCGGCCAGAAGCTGGAAAATGTCTCCGACGCCATCGACGACGTAAACTGCATCAAGTACGATTCC
GAGTCCAAGTTCGACGCCAACAAAGACAAGGCAAACTTCCGCCAGTACGAGGATGCCTGCGACAGGGTCAAGAACTTTT
ACAAGGAGCAGCACGAAAAGCAGACTGTCGCCTACAACCTTGCTGCTCGCAACAGGTTCAAGAGCGCTTCACGGGTGCG
CCCGGAGATGACCGTCTGGGAGGCCATAGAGAAGCTCAACACTCTCGTTGATGAATCTGACCCAGACACGTCGCTGTCT
CAGATCGAGCACTTGCTCCAGTCTGCTGAGGCGATTCGCCGCGATGGCAAGCCACGATGGATGCAGGTAACAGGTCTGA
TCCATGA > SEQ ID NO:684 214928 *Trichoderma harzianum*
ATTCTGGTTTGTTGGGGGCTAAGCCTTTCAACGTTATGCGTGTTACTCCCGGATATTATCTTGCAACATGGGCTTGTCA
TCTCCCGCCAGCCATTCGCTGTGATTCGTCCCGGGATGCTCCGCGGACATTGCTTCCTGGCGTATTTCAGCATCCGGCA
TTGGTGAAGTTCCCACTATGGAGATAGAATCATGGATTTTGCCCCCGCCCCTTTTTTTTTCTTCTTTTCCACCCTTCT
TTATGCTTATCTCTCAGCCCCTAGCAAACGGTGGACGGATATTCTCATCTAGATTGCTGACAACATGCCGTTAGCCCCC
ATCAACCACGAACCCGTCCCGACCCGGGGTCCAATATTCGTTCAGCTCGGCTGTTCACCCGTATACTCGTGCTTGACTT
TTATTTTTGTTTTTAGTTGGGAGATTATTTTGTATTTTGCAGAAGCAATATTTGCCACCTGGGCAATATTCTCTCGAGT
CAGCCATTGTAGGCAGCTGAAAAGGCTGATCTGTCTTGGCCTTGCTCGTTTCCCCGCGCT

FIG. 1 continued

> SEQ ID NO:685 214931 *Trichoderma harzianum*
TGAAAGCTTCCATATCGCATTCTCATGGCGACTGTTGGGAATGCGGCCCGGCAGATACGAGATCGGGCACTGCGCGAAA
GATCGATCCGCGTGCTCGTATCGCCAACGCCAATCTCCTTCGCCGAGCGTCGCTCAGTTCTGCAGGTGCTGGAGCAATA
TGGCCCTGTCGAGTTCTTCAAGATGACTCCCGGCTACTACGCCAACTTTGTTTCTATAACGAGAGAGCCCTCGACCGCC
GAAAGATTGATAGCTAGCAGCCCTCTAACATACAAGATCACGGAGCCTGTCCGCAGCGCGGTGGAAGACATTTACGTTG
CAGATCTAAACGAACCAGAGAGCTTTAGCACCATGCAGCCGACAATAACTGGGCAACAGACGAGCGGCGCGAACTCTTG
GTCCGACGGCACGGAACAGGGACAGGAACAGGAACAAGGACGAGAGGCGGAACTAAAGCAAGGGGAGAGAGAGTTCAAA
CTGGAAATCTTCCCTGCGCCCGAGTACAATCATAGATTTGCCATGGCCGGTTCACCGCTGCACGGCATCTGGAACGATG
GCTACGAACAGGATCAATCCT > SEQ ID NO:686 214938 *Trichoderma harzianum*
GCAAACATATTGTGAGTGGATCGAGGGCAACGAGCTCACGACATACACATATTGCGTAATGACAAGTCAAACTGCAAAT
AAGGAAGTTCTGCTCTTTGAGCGTTATAAGGATCTTCCTTCCGTCAAGACCCATGGCCAAACAAATGAGTTCAAGTCTA
TGTTCAAACGAATTTCGCCTTGGATTGAAACAAAGCGTACCGAAATAACTCCATGGAGCGAATTAGACGGTTCTTTCTT
CTCTTCCCTAGACTTAGAAGCCACAGCGAAGCTCTAAAGATAGCTCTATATTCCTTATAATTTTGTATTTTTTCTTCTA
TTCT > SEQ ID NO:687 214942 *Trichoderma harzianum*
AGATGTTGATTCCAACGCCAGAGACTAGCTGTGGGACTGCTATTAAAATAGAATAAAGATCTTACTTGGCAGCCGTTTT
CCGGTTCACCAAGCTGCGGAGATTAGATAGAGGGCTACATGCGACCCTTGTACGATCAGCGCATATCATGAGAACAATT
CTGGACTCAGAATTTTGACGAGACCAGTTCCTT > SEQ ID NO:688 214953 *Trichoderma harzianum*
GCTACGGCTTATTTACTCTTCTGACCGGAGGTCTCGGTATTGACATGACCTTGGAGCCATCGCTGCCGCAACGAAATGG
AGTACTCGTACATGTAGCCGCAGTCTCTTGTCCATGCGAGCGGGCATTTCGTCGGCGTCCCAATGGTCACCGCGAGACC
TATCATTGAGATACTGTCTATCTTCCTGCATGTTGGCTGTACGAGACGAACGATATGACGGCTCCCTGCCTTTGATTT
CTATGCAGCAGTAGCCAAAAGAGAAAAGGTGTAATATGCAGCAAGGCCGCTATGTTGCCACCCCACGAGACCTCGACTG
CATGCACGTCCAGCGATACGTCTCCACGAGGCCGCGCATGACCGCTGTGTCGAGAGTGGATGGACTGCGGACACCTCTC
TGCTTGCAACGGCTCAGCAAATTTTGCCGTTGGGCCACCGAAGCCAAACGGCTCACCGTCTACGCAATTGGCACTCTAA
ATGCTCCTTTCCGCAGCCGCCTTGCTTTCAATACGCGTCCACAAGCGTTTGTAGCCCTTGTCAGGCCGTTGCGGTTGCC
CGCGTACCACCGCCCAGTGGAGAACAAGCG > SEQ ID NO:689 215009 *Trichoderma harzianum*
AACCAACCATCCAACACCGTTAAAATGGGCGGCGGAATCACCGTTCGCGATGTCGATGCGCAAAAGTTCATCACTGCCT
ATGCTGCTTTCTTGAAGCGCCAGGGCAAGCTGCCCATCCCTGGTTGGGTTGACACCGTCAAGACTGGTCCCGCCAAGGA
GCTGCCTCCCCAGGACATTGACTGGTTCTACGTCCGTGCCGCCTCCGTCGCCCGCCACGTCTACCTCCGCAAGACCGTC
GGTGTTGGCCGTCTCCGCAAGGTTCACGGCACTGCCAAGAACCGTGGCAACCGCCCCAGCCACCACGTCGATGCCTCCG
GCTCCGTCGACCGCAAGGTCCTCCAGGCCCTCGAGAAGATTGGCGTCGTTGAGCAGGACGAGGACAAGGGTGGCCGCCG
CATCACCCAGTCCGGCCAGCGTGATTTGGACCGAATTGCCCAGACCACCGCTGAGGCCGANGAGGAGGATGAGGAGTAA
ATCAAAATAAAGAAAAAAGTCTTTTTGTTTCTTCTTACAACTGTCATGGATGG > SEQ ID NO:690 215021 *Trichoderma harzianum*
AAGCCCTCACCTCACATAAACACGGGAGAACTACATTCAAGATGGATTTCTCTAAATTCAGCAAGGGTTTCTCTGATTT
CAGTGCGCAGATTACTCCGTTTGCGTCACGGACCTTCCAGTTTACCAAGGAGCAGTTGGGCCAAGCAGATGATCGAACT
GAGCTTCCTGCCGATTACATCGACCTCGAGAAAAGGTCGATGCGCTGAAACAAGCCCACCAGAAGATGCTTGCGGTGA
CTTCGCAATATACCAACGAAGCCTATGACTATCCTCCCAACATCAAGGAGACATTTCAAGATCTTGGCCGAACCGTGAG
TGAGAAGGTCAGCCTTCTATCTTCGGCTACATCTACTTCAGAGGCCCAAGCAGCTCTTGTGGCTCCAGCATCTGCGAAG
CCGCAACCAAAGACTTTCAACCATGCCATCTCTCGTGCGAGCTTATCCAGCAGCCAGCTCCTGCACCAGCACCACACTG
GTGCTGGCGAAGATCCTCTGGCAACAGCTCTCGAGAAATATGCACTCGCGATGGAACGAGTGGGCGACGCGCGCCTTGC
TCAAGATTCACAAATCCAAAGCCGATTCCTAGCAGGATGGAACACAACCCTCAATACCAATCTTACCTTTGCGGCGCGT
GCT

FIG. 1 continued

> SEQ ID NO:691 215023 Trichoderma harzianum
TGAAAGAGAAGGACTTTATCACACAAGCCGTTTCGGTTTCTACTTCTCCTTATTGTTATTATTACATCTCGGTGCACCG
CTGCATATGGGCATGGAATGGAGGCTTTTTCTTTTTCTTCTTTTCTTCTTGTTGGTCAGTCTTTTACGAAATACGCAAC
AAGACCTTGGGTGGAGTTCTATGGATACGAATATGAGGCGTTTGCAGTGGATACGTGAATGTGGAACGAGAAACGTACG
CAAGACGAGTATGAGTCTCTTGCATGAAATAGCATGATGGGTGGTTTGGAGAAGGACTAAGCAAGTGGTTGCTGTCCTG
AGCCTTTGGCCGTCTGCGACTTGGGGTTGTTGGAACAGGCCTTGCATGTCTTTATGACTGACAGAGGTGAGCTTGGAGT
TAGCGCTTTTGAAGGCAGCTCTTTTCAACAAGTTGCAAATTTCCATTTTATCATTCTATAAGCTGTTCCATCTCCTTAT
TTCCACT > SEQ ID NO:692 215024 Trichoderma harzianum
GTGGAGATCATTTTACTGTACTATAACGGGGGTGGCTGGATCGTCATGAGGCAAATCGGGCAATGCGATGCGATACGAT
GGATCACGGCTAACATGACAATATTGATTAGTAGCATGATGATGAACCAACAGCACAGATCTGGATGGCTTTAGCTTTG
ACCACATGCCAAGCAGGCTGCCCAGGTTCACAGACCAGCC > SEQ ID NO:693 215032 Trichoderma harzianum
TAATCGCAAGATCGCAGCTCGCGCCCAAGAGTCAGTCAAAATGGCCCCTCAGAAGAAGAGCAAGAAGGATGCCAACAGC
ATCAACTCCAAGTTGGCGCTTGTTATGAAGTCCGGAAAGGTCACTCTCGGCTACAAGTCTACTCTCAAGTCTCTGCGAT
CCGGCAAGGGCAAGCTGATCATCATTGCTGGCAACACTCCTCCCCTGAGAAAGAGTGAACTCGAGTACTACAGCATGCT
GTCCAAGGCTCCCATCCACCACTTCGCTGGTAACAACGTAAGTTTTGCAATCTCAGACGCCCTGGACAAGTGAAGACCT
GGAAACGGGTATATCTACTTGCGCCATTACACACTTCTCGCTTCTTTCAGAAGCTACTCTTGCTACCCGAGAATTGCCA
ATTCTTGCGGAATTGCCCAGAGAAGAAGTCTTTCAGACTTTGGAGGGTTCACATTGGCTTACATTATTCGTAAAACAGA
TTGAGCTCGGCACTGCCTGCGGAAAGCTCTTCCGCTGCTCCACCCTTGCCATCCTGGATGCTGGTGACTCTGATATCCT
CAGCGACCAGCAGGCTTAAATAGCCGAAATCTAGTGCATTCAAAACGGCGTTGGGGGTAAAACGGTTCAAGGGCAATAT
GGATACCATACACTTTCACATTATGTG > SEQ ID NO:694 215033 Trichoderma harzianum
ACCTCGGTCTCTACGCAATCGCGACTGCGTCAGAAGCATTCAATTGCTCGTCAACGTCAACATGTCTCTCGCACAGTCT
ATCTACAGCACCGTCTTCCGCAAGAACTTCACCATGCTTGCGGCCGTTTTCGGTGCCGGCTTCGCTTGGGAGATCGGTT
TCAATGCCACCATGAACAAAATCTGGGACAGCAACAACCGAGGCCGCCAATGGAAGGACATCCGACACAAGTACATTGA
GGGCGGCGAGGACGAGGAGTAAGATCAACATGCAAATTCCGGTTGCTACGGCTAGAATGGGTGTGGCATGGGACTGCCT
GGGGAAAATGTACAAAACCAACGAGAAATAGAATGATTC > SEQ ID NO:695 215043 Trichoderma harzianum
TCCGCCCTCTTCTCTTCAACCCGAACAATCGAATCTAACGAGCAGCACGGCAACGTCCCATACAGTTGCCCAGCATGTC
GCTCGTCACGGGAGAGAAGACGAACTTTCAGTTCATTCTCCGTCTTCTGAACACCAACGTCGATGGAAAGCAGAAGGTT
ATGTACGCCTTGACCAAGATCAAGGGTGTCGGTCGCCGATACTCCAACTTGGTCTGCAAGAAGGCCGATGTCGACCTGA
ACAAGCGCGCCGGTGAGCTTACCTCCGAAGAGCTCGAGCGTATCGTCACCATCATCCAAAACCCTACCCAGTACAAGAT
CCCCGCCTGGTTCTTGAACAGACAACGCGATATTGTTGACGGCAAGGACTCTCACATCCTGGCCAACGGTGTCGACTCC
AAGCTCCGTGAGGATCTGGAGCGCCTCAAGAAGATCCGTGCCCACCGTGGTCTCCGACACTACTGGGGTCTCCGTGTCC
GTGGTCAGCACACCAAGACTACCGGTCGTCGTGGCCGAACTGTCGGTGTCTCCAAGAAGAAGGGTGGCTAATGGTTTTA
CTGTTTTCGGTCTGGGGTGGACAGGCGTGACGGCTGGGTTTTCATCACTGTGATGAGCATTTCCATGGGACTGCTTTC
TGGCATACGCAGCTGGAGCTGTA > SEQ ID NO:696 215047 Trichoderma harzianum
TTCAATCCTTTGCGCAGAGGCGAGGCTGGACACAATGGCTGAACAACTGATCCTCAAAGGTACCCTCGAGGGCCACAAT
GGCTGGGTTACCAGCTTGGCCACCTCAATGGAGAACCCCAACATGCTCCTGTCTGGTAGCCGAGACAAGACCCTGATCA
TCTGGAACCTCACACGCGACGAGACTCAATACGGATACCCCAAGCGATCCCTCCACGGCCACTCCCACATTGTGTCGGA
CTGTGTCATCTCCTCTGACGGTGCCTACGCCCTCTCTGCCTCTTGGGACAAGACCCTCCGTCTGTGGGAGCTCGCCACT
GGCACCACCACCCGAAGATTCGTCGGCCACACCAACGATGTTCTCTCCGTCTCCTTCTCCGCCGACAACCGACAGATTG
TCTCCGGCTCTCGTGACCGCACCATCAAGCTGTGGAACACCCTCGGTGACTGCAAGTACACCATCACCGACAAGGGCCA
CACTGAGTGGGTTTCCTGCGTCCGATTCAGCCCCAACCCCCAGAACCCTGTGATTGTTTCCAGCGGTTGGGACAAGTTG
GTCAAGGTTTGGGAGCTGTCCAGCTGCAAGCTGCAGACCGACCACATCGGCCACACCGGCTACATCAACACCGTCACCA
TCTCCCCCGATGGCTCTCTCTGCGCATCTGGTGGCAAGGACGGTACCACCATGCTCTGGGACCTCAAC > SEQ ID NO:697 215048 *Trichoderma harzianum*
GTTAAGCGTCTCTTCATGGCGCCAGGACCACTGGCACTCTGCCAGATTTGCCCAAGTGCAGCTGGGGGGGGAGGTTGTT
AGCATGTCGTCTCGGTGCCAATCACCCGGTATGTACCAAAGGGAGATAGCCTCTTTCTTTGCTGGCACGGTACAGATGA
AGCACAGCAAGGCCGGCGTTACGTATGTGTGACGGCTCATCCCAAGATTTGTGAACGCACACGCTTCCTCCTACCGACG
ATCGAAGCCACCACCGACTAACCTGGAGTGAACCAATCCAGCCAAACAGCTGCGCGAGCTGACCACCAATGCCTCTAGG
GATGTGAGCACGACTGAAAGATGTGTCCATGCCCGCCAAGCAGCATGTGTGTGTTCCAACCGTGCACATATTCTATTCG
TGCAAATCCAATGGGTGCAATTGGAGCATTCATCCTGCTTTTCCAACTGGGGCTGTAACAAGTTCGTGCTGTAGACCAA
GTTCATGTTACCAGTCACGGTGTATGCTCTGCACCCAAGGTCACCGACAATACACAGATATCTGCACAAGGCGCCATCT
GTGGGATCCTGCTGTGCA > SEQ ID NO:698 215055 *Trichoderma harzianum*
ACGGTGTCCATGGCGGGCGGATGGGCGGGGCGAGAGGGGGAAGCTCGGCGCCACCATGCCTTTACAAAAAGTATCATTG
ATGAATAGAGTCGTAAATCCGATTCACGGCTGCGGAGGCAGTGAGCGGAAGATCGACCAACAGATTAGCGATGAGCGAG
AGGGTCAAGGAAACTGACAGGGTGATTCAGATGCCCCCCGGAAGTGGAGAGGAAACAAGAAGCCAGGGGTGTTTGTCGT
ACACATGTTGCCAGCCTGCATCTGGCATCTGCTGCCAGCTATTGACAGCTACTTTCATTGGCCAGATGCTGCAAATTGG
AGCTGCACTGCACGGGCACAAGTTCGGATGGGGGATGACGGAAGCAAAACGGCTGCGTATTACCTGCGTTGGTAGAATA
CTAAGGTATTGATGTAATATTTGGGTAGGTACGGATACGGTACTTTCATACAAAGAATCACTTAGTCATGGCAAAG > SEQ ID NO:699 215059 *Trichoderma harzianum*
GGAATAGAAAGACGATACACAAGACAAGGAGTCAGACAGGACTTGCACAAGACATAGATCACAAGAAACGCGACCTCAC
CTCATCCTCGACGATGCCTTTCAACACAGAGCTCACCCGCCGCCTGGGCATTCGCGTCCCCGTCATCCAGGGCGGCCTC
ATGCACGTCGGCACCGCAGACCTCGCGTCCGCAGTCTCCAACGGCGGCGGCCTGGGCATCATCACCGCCCTCATCTCCC
CCACGCCCGAAGCCCTGCGCGCCGAGATCCAGCGCTGCCGCACCCTCACCGACAAGCCCTTTGGCGTCAACCTGACCCT
CCTCCCGTCCCTCCTCCCGCCCGACTACCCGGCCTACGCCCAGGCCATCATCGACGAGGGCGTCAAGATTGTCGAGACG
GCCGGAAACTCGCCCGGCCCGGTGATTCGCCAGCTCAAGGCCGCGGGCATCACGGTGCTGCACAAGTGTACGACGATTC
GTCATGCCCAGAGCGCGATCAAGTTGGGCGTCGACTTTTTGAGCATTGATGGGTTTGAGTGCGCGGGACATGTTGGCGA
GAGCGACAT > SEQ ID NO:700 215060 *Trichoderma harzianum*
ACACCAGCCATGGACTCTTCCTCGCGAAGATCGCGATCGCGATCACCCCCGCGGAAGCGCGCCAAAAGGCAGTGGTGGGT
TTCGGTGGAAGGATAAAAGCCGCCCAAGCGAAGACAACCGCGGCAGCTATGATTCGAGAAGAGACCGATATGGAGACCG
AGACCGGGATCGAGAAAGAGAACGTGACCGAGGCCGCGACCGCGATTATGGAGAGCGACGACGTGACTACCGCGATCGC
TCGCGAGATCGTGGTGGCCGTGATCGATACGAGGGCCGCCCAAGATCGCGATCACCTCGGCGACACGGTTCTGGACCAA
AAGACACGGGCGACAAGGTGAAGAGAGACGACAAGAAGGAAAAGAAAGAAACCAAGGCGCCCAAAGCTGCCGTTGGAGC
GGGACAAGAATTCATCATTGTTCATGTCAACGACCGGCTGGGCACCAAATCAGCGATTCCATGCTTGCCTTCGGACACG
GTTGGGCAGTTCAAGCTCATGATTGCGGCGCGCATTGGACGAGAAGCGGGACAGATTATGCTGAGACGGCAGGGTGAAC
GGCCGTTCAAGGATCACATCACGTTGGAGGACTATGGCATTTCGAATGGAGTTCAGCTGGATCTCGAGGTTGACACTGG
CGATTGAGCA > SEQ ID NO:701 215066 *Trichoderma harzianum*
TCTTCTCCAACTAAACAAGAGCTCTTTTCTACTTCTAATTTTTTTTTATCTCAACTCACCATCTGAGCTATCAAGCTA
GAAAGTAACCACAGCAAATAATCATCATGGAGCTCGTCAACTACAACCACAAGACCTGCCCCAAGTGCTCTGCCACCAT
CACCTCCGAGTCCAAGACTTGCTCGAGCTGCGGCGCTACTTGCCCCGTCTAAGCTACCTCAGCTCGACCCGCCATCAAC
CTCAACCATCGCAACAACATGACGAGAATATCCTGAGGTGTGGCGGACTGCAAGGACGCGCGGATGAGTCAATGAATA
GATGAATGAAGGAATGATATACCTCAGCAGGACATGGTGCATTAAGACAAGGCGTTGATGGAAGAAGAGAAGCGATCAT
GTATGTCTAATATTCTAAGCTATATGCCAGTCCTTGTTACAGACAGGCGGCTAGAATAGTTCCTCGCAATGGAAGGAAT
CTAGAATGGCAATGGGCAATGGGCAATGG > SEQ ID NO:702 215074 *Trichoderma harzianum*
ATCCGCGACTTTGGCACGTTTCTCACGACGGTAACGCCCCCAACCCTTCAGACACAATGGCCAAGCAATCTCGTGGTGC
CCCTGGTGGCAAGCTCAAGATGACCCTCGGTCTCCCCGTCGGTGCCGTCATGAACTGCGCCGACAACTCTGGTGCCCGT
AACCTGTACATCATCTCCGTCAAGGGTATCGGTGCTCGCCTGAACCGCCTGCCCGCCGGCGGTGTCGGTGACATGGTCA
TGGCCACCGTCAAGAAGGGAAAGCCTGAGCTGCGAAAGAAGGTCCACCCCGCCGTCATTGTCCGACAGTCCAAGCCCTG
GAAGCGATTCGACGGTGTTTTCCTGTACTTCGAGGACAACGCTGGTGTTATCGTCAACCCCAAGGGTGAGATGAAGGGC

```
TCTGCCATCACTGGCCCCGTCGGCAAGGAGGCTGCTGAGCTGTGGCCCCGTATTGCCAGCAACTCCGGTGTCGTCATGT
AAAGAGGTTGTTAAACGAAGGGAGGGATTTTTTTTTATTTACCAAAGAGAAGAGAGGAATGAAAAAAAGACAAATGAC
CAAGTCCCTCGATGCGATCTTATAGAAGCGTGGAAACTCTTTTTCCCGCCTCCTGTCCCTTTTTTCTGATTTTTTTGTT
CTTTGGGGCATGGGAGGGGGAAAAAAAAGAAACGGGAAA
```

> SEQ ID NO:703  215084  *Trichoderma harzianum*
```
ACCCACATATCAGACACCCGAGAGAGTCGGTATGTCGGCCAAGCCCACGACCAAGCAGTTCGGGAAGTCGACCCGGGAG
GTTCCCGCCTCCGCGGACCAGGCGAAGAAGTGGTACCCTGCCGACGACGAGAGCGCCCCGAAGAAGGTTCGCAAGTCCG
TCCGAACTTGGGCCCCCCGAAAGACCCTCCAGCCTGGTACCGTCCTGATCCTCCTCGCTGGCCGCTTCCGCGGCAAGCG
TGTCGTCCTCCTCAAGACTCTTGACCAGGGTGTTCTCCTCGTCACTGGTCCCTTCAAGATCAACGGCGTTCCCCTGCGA
AGAGTCAACGCCCGATACGTCATCGCCACCTCCTACAAGGTCGACATCTCCGGCCTTGACGCCGCCAAGATTGAGGAGA
TCTCTCAGCCCAAGTACTTCACCGCCGAGAAGGCCAAGGAGAAGGCTTCCGCTGAGGCTTTCTTCAAGCAGGGAGAGAA
GCCCCAGAAGAAGGAGATCAACAGCAGCCGTGCTGCTGACCAGAAGGCCGTCGACAAGGCTCTGCTTGCTAGCATCAAG
AAGGTGGATCTGTTGGCCAGCTACCTCGCCAGCACCTTCAGCCTGCGGAAGGGTGACAAGCCTCACGAGATGGGGTGGT
AAATTTGATTCAAACACAAAATCTCTCTGGCAGGTCGAAAGCACGGGGTGGAGTTTACTGGGGTGTTGGT
```

> SEQ ID NO:704  215085  *Trichoderma harzianum*
```
CCCACGCGTCCGCGATGATAAAGTTGTGGGGTAATTTAGATAGAGATGATTCGGCTGCAACGCTGAAAAGTGTTGATCA
AACTGGTAGGATTCAGTTCATTATTGTTCCTTCGCCCTTCGTGGATCGACGCTTCGCTTAACAGTGGCAGTGCTCGCGG
ATGATGATCCGTCTGACGCGATCTGGAGGCGGACCCAGAATGTGGATGAGGGAATCTCCACAAGGCGTAACTCCTTGGT
TTACTCTTGTTCGCACACAGATGTATCTTGAGAGTTGTTAAGGCTATAACGAGTGCGGTTGAGATACGTCTACGACTAA
GCATCTTGAGCAGAGTGTTAGTTGCGAAACGTTCAATTGACTAAGTAAGAGTAGAGAGTATCAAGCCTGCAAATCCATC
CCCCCGAATCTCCGATTTTATGAGCCACCATAGCTCTTTTCGCCAAATGCAAATGCCGTAGATAGTGCCCATCCG
```

> SEQ ID NO:705  215087  *Trichoderma harzianum*
```
GTCTTTCAGGTGCCCAGAGAAGACAGCTCGGAAAGTGCGGAAGTCTTGATTGACCAGGATGGAGATTTGGATGGTTTTG
ATATGAAAGGCTTAAAAGACCAAGTTCTTGTATTCAAGTACAGAGGGAAATTCCACGCCGTTGATCATAAATGCCCTCA
TTCGTCTTACCCCCTCTCACAAGCCACTCCATTTGACATTGAGGATTTTGGCGTTGTCTTGAGTGCAGGACTGACCTGT
CCAAAACATGGTTGGTCGTTTGATCTGTTTACTGGCTCAGGAGACCGTGGAAACTATCAGCTTGGACTTTGGGAAACTC
AGTTGCGTGAAGTAAAGAATTCGGATACATCAGCAGACGAGGCTTCAGGTTCCGCGGAACAGGAAGTATGGGTTCGGAG
AAAACAGCGACAGCGCATTGGATAGATTAGGGATGGCGTTGGGCATGTGCATATAGACAGGGTAATAAATTACAAGCAT
ATTTTGGTCAGAAC
```

> SEQ ID NO:706  215090  *Trichoderma harzianum*
```
CCCACGCGTCCGAGACCGGCCATCAATCACAACTCCGTACTCGCTGCAGACAGACACTCTTGCACCTTGAGCAAGTTCA
ATTGGCGCTGAGAGGGCGAAAGAGTGCAAAAGTTATCTTGCTGCCACCAGTTATCTGCCTGCAACCCGAAAGTGGCCC
AAACCAAAGGCTCAGCCCAACGCTGATCACGGCTTTCGTATTCGGCAGCGATGGACAGGCACCACAATCGCACTCCCTT
TCATCTGCTTCTTCTCTCGAGCTTCTTTTTTTCCTTTGCTCGCCTCACATTTCTTCTAGTGGATGACGCAACTGGCCGC
GGGGATCGTCGACGCCAATCTATCTCTCTCATTCTCTCTCTCTTTTTCTGAGGGTTAATTTCGTATCTACCTACTTA
CAGCCACAGTCACAGCTCGACAAGTATTGGCAGTATTGCCTACTAGTATTCCCACCGCTCGCTTAGGCGGCCAAGGCAT
TCCCTGTCGAATGACACGAATCTCATCTTACAGTAGACAGACCCGGAAAAGCGGGGATGGACATGACATGTGTGTGTGC
TTCATGGCGGCCTGAGAGCCTGGCCATGCGTGAAATGCCATGCCGTGCGTCAACAAGCGTCGAGCAGCGCTGGCTGGCT
GGTGATACGCCATGGCCTCGTTCGTTCTCTGGTCTGGG
```

> SEQ ID NO:707  215091  *Trichoderma harzianum*
```
TCCTCGAGGCAATATTGTTTTCGAATTTGGGCATAGCGAGTGGCTTCGTTGGTGGTTTGAGGGCTGGAGCCCCGGTGCC
CAGACAATGAGATTTGTGGAGTTTTACCCGTGTTGGTTTTCTTTAGTGACGTATTGATGAACAGGTACAACGACTTCAG
GCGATCGGCGGCGACGCTTATTTCTTGCACGCCCCTTGGATGGGTCCCGCGAGAACCTTGGTAGGTTTAAAGGAGGTA
GCTGTGCTCCGTAACGGGGTTGTTATTTATAGGCTAGTATTAAGGAGCTGAATGACGCGCTCGTGTCGAACCCAGGAAA
TGGAATATTCATTTTTGTGTGGTGATGGCGACAGAGAGTAGGGTTTGGTTACCCCGAAGAAAGCAAGATCGAGATTGAA
GTGTGTATCGGCGATTTATCAGATCTAGGCCGACTTGAGCATGTGAGATGACACGAGCTAACACCAGCATGATACAGCT
GGCAGTCAATAAGAGACAAAGCTTGTTGTAC
```

FIG. 1 continued

> SEQ ID NO:708 215095 *Trichoderma harzianum*
TCGCATCGCGCCGTTCCGCGCTAAAACGGCGCCCTCCGTTGCCTTCTTCTATTTTCTACTGGAACGGAGGAGTCCGTCC
TGGTTCCTGGACTGGACTGGACTTGGAACAAGCAGATGCAGTTAGAGAGGGGGGGAAGAGTGAAAATGCCATTGCCAGG
GAAGAACCTGTTTGGCGAGGAGGGGGAAAAGCTGGTGGGCTGGGCGGGAATGTCGTCATGGCTCCATTCTAGGCCTGTC
GCTTCCAAGCAGCCCACTAAATCCAACCCAGTAGGTCAGTTTATGCACAGAATAGCTGCATGTCTGGCACCATCATCAA
GGGATCCCCGAAAGGAACAAACACAAAAGGAAAAAATCACCGCCAAGTGGCGGATTGACTCGTAGAGTCTCTTTCGGCC
ATTGCCGGTATGCCTCCGAATCAGCCTGGCAACTTGACTGTGCGCTACCGGAGCTTGGGCCCTACCAGTATTACTGGCC
GGT > SEQ ID NO:709 215106 *Trichoderma harzianum*
GTGTTTTGGTGCCCTCGTCCGCTTCCGGGCGCTCACCTCAGATGGCCGCGCCGACCCGAGCTGTGGCCGGTGTGGCAAG
CGGCCTGTCCCGGCTGGTGCCTCGTTCTCGTCCACGGCTGCCAATTGCCTCTGTTTCTATTACAGCAAAGACGACGGCA
TCATCGCGATGGCACTCGGGCTTCTCGTCGGTCAACCCCAACGAGGTCTCACACTTCAATGCCCTCGCCGCTGAGTGGT
GGGAGCCGCACGGATCGTCGCGCCTACTACACCTCATGAACCCGCTGCGCCACGACTTCATCCGCTCCTGTCGCGAGTC
CTCCGACGACCTCAATTCCATCACATACCTCGACATTGGCTGCGGCGGCGGCATCTTCGCTGAGAGCGCCGCCCGCCTA
GCCACCACCAAGCACGTCACCGCCATCGATCCCACACCGTCCGTCCTCAACGTCGCAAAAGCACATGCCCGCAAAGACC
CTTCTTTGGCGGGGAAGCTGTCCTACCGACAGTCTTCGGTCGAGCAGCTCGAGGTCCCTGCCGAGGGCCAGGGCTACGA
CGTCGTGACTCTCTTTGAAGTTAT > SEQ ID NO:710 215107 *Trichoderma harzianum*
GATTGATTGCTCAAACATCACAACATCAGGGAATCTCTCCAAATGGCTCGGTCAGCCGCCACAACGGCCACCAAAGAGG
CCAAGCCTCAGGCTACTGCTGCTGCTGCTCCTCCAGCTCCAGCTCCAACCGACGGCGATAATAAGCTGCACGACTT
CTTCTGGACTTACACCGAAGAGCCGCACCGCACACGCCGTCTGGCCATCATCAAGGCCCATCCCGAGGTCCTCAAGCTA
TGCGGCCCTGAGCCTCTGACCAAATATGTCGTTGCCGGCGTCGTCGGGCTCCAGATCGTCCTGGCCTACCTCCTGCGGT
CAACGCCCTTCTGGTCCTGGAAGTTCTGGGCCGTCGCCTACGTCTTTGGCGCCACTGCCAACCAGAACCTGTTCCTGGC
CATCCACGAAATCTCGCATAACCTCGCCTTCAGGAGCCCGCTTGCCAACCGGCTCATCGCCATCATTGCTAACCTGCCC
ATTGGCATCCCTTATAGTGCTTCATTCAGGCCGTATCACCTCACTCACCACAAGTCCCTCGGCGTGGATGGCCTCGACA
CCGATCTCCCCACTGCCCTAGAAGCCTTCGTC > SEQ ID NO:711 215108 *Trichoderma harzianum*
ATACGACAAAGTCAACTACATGATGAGCTCGCACAAGAAGAAGAACGACAACAACAACAGCAGCAACATCCCGGAGGCA
CCACTGCCGCCAACATTCAAGGAGCAGCTCGACCAGGAGGCGATCGACAGCCGGGTTCACCAGCATGAGAGCGAAGAAC
ACTCGACAGTGAAGGATATTGTCGATAAGATATCGCATGCCATTCCTGCTGTCGCCCCTCTCATCGGCGGATCAAATCC
AGACAACAAGGTGGAGGAGCATAAAGAGGTGCCTCCGGGGCCTCCTAATCGACCAGAGCATGATACCCAGATTGAAGAG
TTTGTGAGGGAGCAGCATCGAAGCAACGGCATCGAGAATCTGAGCGAGGGAAAGTCGTGATGGATTCATCCACGCTCTC
GGTTCAGCAGAGTTTCTTCATGTACCAATAGCCATCAAGCTTTTACTTTTTCTTGCTTTAATACAGTGAAACCTGCGGC
TACTATGCAGGCTCTTTACAGATAATCCAGGAAAAAAAA > SEQ ID NO:712 215110 *Trichoderma harzianum*
GGATTTGCGAAAGGGCGAGATTTTGGGTGGGAGGCGGCAGACGGTGATTGGGGCGATTTGGGCAGCTCTGCCAAGGGTT
GGGTTCATGAAGATACAGTACGTGTTAGTGATGTGAAGCTGCTCCATGATGGGACTCGGAATGGCGGACGGATGCGGTC
ATGGGCTTTTGGAGATTGGCTTTTCTTGGTGGGCCGAGACGGCATCTAACTGGAGATTTGATGAAGGGGAATTCGAGCT
ATCAATACGGATATGCAGGACTGGATGATTCTGATTTGATGGCCCGAGGTGAAACTTGTCTGGAAACTTGATTCGGGGG
CAGCGAGAAAGATTGCCCAACGACCGGGTGTCTTTTCTTTCTTCCTCTCTTTGTCTAAGATGTACGAATACGTCGGCGG
CAGGGCGAGCACAGTTAGCCAGAAGCAAGGGGATGGACTTTTT > SEQ ID NO:713 215114 *Trichoderma harzianum*
GAACAAGCCACATCGGGGAGACGGGAAGATGGTGACACGGATGCGTTTGTGGAGGTGGGTAAGCTTTGCGCAACATGTG
CCAGCCTTATCTTGATATTGGACGCGGCGACGGCGAAATGGTTGGAAGGGTGTGTCTATGTGTACCGACAAACGCATGG
CTGATGAGACGGTGAATAAAACTGCACCAAGAAAGAGATGCATGAGAGATGAATGACCAGTACCTAAGGTCTATGACAT
GTCGCTTTGCACTCGGTCGGACTCATTCACATGTAGTAAATACTACATAACACCCACTTGCTCCAGTAATCATCACTTA
TAATAATACGGCGAGAAGACAAGTTGACACAGGGCGAAACAGGGCGGAACAAGGCCAAAAAAAAAAACAA

FIG. 1 continued

> SEQ ID NO:714 215116 *Trichoderma harzianum*
TTTTTCTCGCAACTCGCTGCTTGGCTGCGAGTATCTGGCATTAGCACCTGTTGTGTGCGTTGGCCTGCCGTAGGTTGAT
GCATCTGCAGCTGCAGCGTTTCCGCATCACATCACCTTCATCTTACATGACAAACCCCCTCTTTTTACTCCCTTCGATA
CGGTTATTGGTTCGAAGGCTTTACAATTCAGACGTGCAGGCACTAAGACATCCATCTCGACTGTTAGAGGTTGTCTTGC
TGCAGACGTTATCGTACCAGCACGGCTTATATAGCACCAGACAGACCCCTCCGCTGCAGCTGGTTTACTTCTTTTTATT
AATCTCAACTATCACCACGGCTACCTATTCTTCACTTCAAAAAAAAAAAAG > SEQ ID NO:715 215117 *Trichoderma harzianum*
ATCTTGGGATGTTCTGCAGACGATTGTCAAAGCCGGATTAACCCCGCAGGCATTGATGGCTGTCTCTCATCTCCACTTT
GCATCCTGTTGTTGGGGTAAAAGAATAAGCTCACCGTCATTGCTCAGCTTCTCGAAATCGTGAAGAATGAATCGCCGAA
AATTGATTACATGTACTCACCAGGGACATGTAGGCAGCTTCATATTTCACTCCTCCGACGTCTCGGCTAGACTTAGCCA
TGTCGATCAAGCATGAGCAAATCCCACATTGTTAGCTGTCAATCATTGTCCAGTGTCATCTCCCCACGTGGCAAAGACG
GCGTCAATCAATTTGGACAATCCCTGTGATATCTTAGACGCATCCTTGGCATCTTCTAAATGCTTAAAGTTTTGAGCTG
AAAATCGGTCATTAAAGTAACG > SEQ ID NO:716 215119 *Trichoderma harzianum*
TGAAGATTTGCTTTGTTTTCTAAGTTCATGGGGTGCAATTGAGTCTTCTAAAGCGTGCTGGTGCAACATTCAAGCTGAC
GTTGGATAAACCTTCAACCGTAACTCTTGTACCTCTCAAGACATCAGAATCAGATGATGGATGGATTGATGAACTGACC
TGCATCTGCCCACTCAACAATTTAATCCAGTCGAGCTTCTACAACGCCAATCTCAAAGCTCACAACTCTGTATTCACTC
ATCTTGACCAATTCTCTTTCAGTTTGACCTCAATCACTCTTTCCCTCATGAAGACCGACGACGCAGTGTCACAAACCAA
AAAAATAAAAAAA > SEQ ID NO:717 215120 *Trichoderma harzianum*
GTCTGACTAACACAATGGCTTCGACTGTGGGCAAGACCATCACCTGCAAGGCTGCCGTTGCCTGGGAGGCCGGCAAGGA
GCTGAGCATTGAGGATGTCGAAGTTGCTCCTCCCAAGGCTCACGAGGTTCGCGTGCAGATCTACTACACCGGTGTCTGC
CACACTGATGCCTACACCCTCTCTGGCAAGGACCCGGAGGGTGCTTTCCCCGTCATCTTGGGACACGAGGGAGCTGGTA
TTGTCGAGTCTGTTGGCGAGGGCGTCACCAACGTGAAGCCCGGCGACCACGTCGTTGCTCTCTACACTCCCGAGTGTAA
AGAGTGCAAGTTCTGCAAGTCTGGCAAGACAAACCTCTGCGGCAAGATCCGAGCCACTCAGGGCCAGGGTGTCATGCCT
GATGGCACCAGCCGATTCAAGTGCAAGGGCAAGGACCTTCTCCACTTCATGGGAACATCGACTTTCTCTCAGTACACTG
TCCTCGCCGACATCTCCGTTGTAGCTGTCCAGCCCGATGCCCCCATGGACCGCACTTGTCTCCTTGGATGTGGTATCAC
CACCGGCTA > SEQ ID NO:718 215124 *Trichoderma harzianum*
CTTCAACGAGGGCAATTGCTGGGAGGAAAACGGCGTCAATTGGCAGCAGGAGAGACTCTTGAGTCTTTTTTTCACAGGG
GATGTAAATAGCCGTAGGCGGAATGACGTCAGGGCTAGCGCGGACAGTTGCCGAATTTGGAAATCAGGGACACGAACGT
TGCAAAGGGAACGGCACCGACCAAAGGGCATTGACAGCTGGTATAATTGAGGCATGTGGATGATGTGTTGAGATAAACA
GCACGATTTACATGTCATTGTGAGAATTGAGTTGCGTGCATTGTTTG > SEQ ID NO:719 215138 *Trichoderma harzianum*
GGCCGCTATCCGCTCCTCGATGCGAGTCCGCAGCTCCTCTACTAGGGCAGCTTTCCGTCCCAGTGCCGTCTTCTCGCGG
TCCATGGCATCGGTCAGCGAGACTACTGAGCAGCAGCCCAAGATCAAGTCGTTCCAGATCTACCGATGGAATCCCGATA
CCCCGACCGAGAAGCCCAAGCTTCAGACCTACTCCATTGACCTCAACAAGACGGGCCCCATGATCCTGGATGCCCTGAT
CAAGATCAAGAACGAGCAGGACCCGTCCTTGACCTTCCGAAGGAGTTGCCGAGAGGGCATCTGCGGCAGCTGTGCCATG
AACATCAACGGCCAGAACACCCTGGCTTGCTTGTGCCGAATCCCCGCCGAGTCCTCGTCCGATGTCAAGATCTACCCCC
TGCCGCACACCTACGTCGTCAAGGACCTGGTACCTGACTTGACGCACTTTTACAAGCAATACAAGTCCATTGAGCCCTA
CCTGCAGCGCGACACCCCTGCTGAAGATGGCAAGGAGTACCGCCAGAGCAAGGCGGACCGAAAGAAGCTGGACGGTCTC
TACGAGTGCATTCTGTGCGCCTGCTGCTCAACCTCGTG > SEQ ID NO:720 215139 *Trichoderma harzianum*
GGAATGCTTGAGCCAAGAGATTGCCTAGGTGAGGAAAAAGAAGAGAGAGAAAAAGGCAATTTGTTAGCGATCCATGGA
TTGATTCCATGACTAGCTAAACGAGGCTAGATGAGATGAGGCAGCGTGAGAGAGATGGATGGGACGAGATCTGGTGGGT
TTGGTTTGGGAGGCGGTTTGGAGGTTTGGGGATCATACAGTAGTACTAGTACTACAAGTGCTGATGATGCATAGATAAT
GTACTTGAGGGGCGATGAGATGCGATGCGATGCGACGCGGTGCACGCGTATGTCATCCATCAGCGGTGATGCCCTCTCA

FIG. 1 continued

GACGAGTACGGAGTCGGTACCAGACAGCAATCAAAATTGGCGGGTGTTGGCTCTGCTCTGGTTGCAAAAAAAGCGAAAG
TACG

> SEQ ID NO:721 215148 *Trichoderma harzianum*
GACGAGACGAGTCTGGAGGGATGAGACGAGACTTGGAGCAAATATGGCGTTACCAAATAAGACGCGGAGGATGGTCCTT
GGAACAAGCACTACAAGAGCTCAAGAGCTACTATATAGATGCTATACGCCCATCTCGGAACATTTCTGCTGCAGCTACT
GTTGCTGTTGCTGCTAGTAACACTGCTAGTAACGACGCTCGGCGAAAACCGTGCACCAAAACATATGCTACTAATTACT
CCTTACAGACTACTACAGACATTAGATGACAGAGTAGTTGATTCCGACCAACGACTGGACTGGATTAATCATACGACCA
CACGAGAAACCTTCAACATGGCTTCGATGGATAGATATTGACTGTTTGTTTTTGGGCTCTGACTTGGCTGCTCTCGCTA
ACTCCATCTCAACTTACCCCA > SEQ ID NO:722 215150 *Trichoderma harzianum*
AGCTTGCGAGCCTCTCAAATCGTTGCCAGATTTCGTCAAGACCCTCGACCTCGCAAGACACTTTACGGCAAATTTTTTT
CGAGACAATCAGACAAGATGGTGCTCGCTGTTGACCTTCTCAACCCTTCAGCGGCCTCTGAGGCCAAGAAGCACAAGCT
CAAGACCCTTGTTCCTCAGCCCCGATCCTTCTTCATGGACGTCAAGTGCCCCGGCTGCTTCACCATCACCACCGTCTTC
TCTCACGCCCAGACCGTTGTCATCTGCCAGGGATGCACCACCGTGCTGTGCCAGCCTACCGGCGGTAAGGCCAGATTAA
CCGAGGGCTGCTCTTTCCGAAGAAAGTAAACTGCCCGCGGGGCGGCTTTCTTTCCTTGGGTACTGATGACTCTTATGGT
TATATGGTGGTGATCATCTCGGATCTGCAAACAAAACATCATCGACGTGGGGGATAGACATTATACCTTGCGAAAATAA
TCAATCTCTTTTGCAGATAGAAGATGGAACACCCAACACAGGGGCGTTTGGGGGTCTCCGGGATATCTTGCATGGCACA
TCATTCTTCTCGTTT > SEQ ID NO:723 215163 *Trichoderma harzianum*
CAGATGGTGGCGCTCAAGCATCCCACTCTTGTTCGCAAGCTTATTCTAGCTGGAACTGGGCCTAGTGCCGGTGAAGGTA
TTGAAGGTGGTGATCCGGTCATTTTTGGGCGTCTTGCTTCAGCTTCAAACGATGCAGAAGAAAAGAGCGGCTTTTTGGA
GGGCTTTTACTCCCTGACTGCCAAGAAGCAATCTCAAGGCGGGAACTGGTGGAAGCGTATGACAACGGCTCGCCAGAAT
AGGTCTGATTACCTTGGACCTGAAGGCACCAAGGCTCAGATCGACGCAGTTCTTCGCTGGTCGAACCCTGAATATGTCT
CTGAGGGCTCATACAACCGTCTGAGCGAGATCAAGATCCCCGTCCTCGTGGCCAACGGCGACAATGACATCATTATCCC
CACAGTCAACAGCTGGGTCATGTTCAAGAGACTGACCAACGCTGATGCCCATCTCCACTTATACCCGGATGTGGGACAT
GGGTTCTTGAACGAGTATGCAGGCCAGTTCTCTGGCCTTGTCAACCAGTTCCTAGACGCTTAAGTGGGAATCAGGGGTT
CTTTAAAGGCGCGAGTCTATCTA > SEQ ID NO:724 215176 *Trichoderma harzianum*
GTCGAGTTTTCTCGCTGGAAGGTAGTTAGGGGGGACTGCCGAAGATGCATGACCCCGGGAGGCTTGCAAGCAGGCGGAG
AGCATACATAATAAAGCTTGACGAAGCTATCGCGGTCCGCCTGGAGGTCCCCATAGTACTTGCTCGCAAACTGGGCTTT
TGTATCGACAGTCAATATGGCTTAAAGCAGATGCGCGGTAAGAGAGGCACCCTTATGGGCGAGACGCTGGGAGAGGCAC
TCGGAGACATACAGGCAAGCTCGTCGGGCGGTAAGCCTTTTGCGCACATTAGTATATTAGCGCAAGCAAGCAGGGTAGA
CGCAATGGCAATCACTCACTATCCATATTGACTTCCTGAAAGTTTGAGCACGGAGCTTGCTTGACACCAAAAGGCGAGG
GTTTTTAGGGGTGAACTCTTGAGGTGAGACAGTGAGTGAGTTGTGAAAAATAGTATGCTAAAGGGAAGTGAGACTATTA
TATAGTAGAATAGGAAGTTTCCTAGTGTTACGACCT > SEQ ID NO:725 215194 *Trichoderma harzianum*
TTCACATAATCATTTCTATAGTATTCGTGGGTTGGTTTGGTTCCCAAAATAGCCATCGAATCCACCCTGGTTGATGATT
GTATATCCTCGATATCCAAGAGTGAATATTTTTGGCCCTCTCGAACCATCCGGAAGGATGGCGGTAGAAGCCTCGTGCA
TCTGCTGGATACAGAGTTGTTTTGTCTCTTGATGATCTCGACCCCGTCAATGGTCTGCCTTCGGGCGCATTGGCGGGGT
GGATG > SEQ ID NO:726 215208 *Trichoderma harzianum*
GAACAGCCCTCACCGTCGGAGGAGAAGGGGCACTGGCCGCGCAGATACCTTTCGTCGCGAGAATCGTCAGACAGCTCTG
GCGAGATTGAGCAATTTTCTATTTCTCGAGAGTCGTTTGGCTCGTACCGACGCTCATTTGATATCTCGGCACGATCCCC
CATTTCTGGGTACGACGTTCCCGGTCGCATGAGTCTCGACTCAGCTCGATTCGCTCGAATGGCTAGGTCGGCAATCAAC
CGTAACATAGAGCAACTGGCCACCGGTGAGGAGAACTTTGAGGGCGTCGGACTCGAGGACCAGAAGCAGCCGGCCCGGA
AACGAGGTTTCTTTTCCAAACT

FIG. 1 continued

> SEQ ID NO:727 215211 *Trichoderma harzianum*
TGCCCACAATGTCGCTTTCTGTTGGTGCTTCTCTGCGGCCTGCGGCCTTCCGCTGCGTTGGTGCGTCTGCCGTGCGCAT
GCGATGTGCTTTTGGCACAACTGCGTCCAGAAGGAGTGAGAGCTCGACGCCGGGCGAGCTTGGGGTTGGAGAGCTGCAG
GGCGCATCGTTTCGCATTGAGCCTCTCCGGAGGGTTGGGGAGGATGCTTCGACTATGCGAGCGAGACTTTTATACCAAT
CTCGGAAGCGCGGAACCCTCGAGTCGGATCTTTTACTGTCTACGTTTGCCTCACAGAACCTGCCCACCATGACGGCCGA
AGAACTGCGGCAGTACGACCTCTTCCTCGACGAGAACGACTGGGACATATACTACTGGGCGACGCAGCGGGAGCCGAAT
TCCACGACGAACCCTTCCGTGACGGCGAGTCCGGCGAGTGCTTCGGCGAGCGAAGGGTTCGAG > SEQ ID NO:728 215241 *Trichoderma harzianum*
GACGATTCGTAGCGATTCAACACGGCAAATCGTGAGCGGACGTTGGGAAATCCGGAAAAGGGAAAAAGAAACAGAACAA
GATGGCGCAGGGCTCGATCAAAAAGTCCAACAAGGCCGCCGCGCCAAAGGCCGTCCACTCGAAGCGCCAGGCCTCCAAG
GTCACCAAACCCAAGAAGAAGGTCAACGCCGACAAGATGCTCAAGAAGTTCACTTCGGGCATGGTAGCCAAGACGGAAG
CGCTCTTGGGCGAGAGAGCGGGCCATCTGGAGTTGATTGGACCCGGAAAGAAGGGGAGCAAGAAGCTGTCGCAGAAGGG
AGGATCAAAGAAGTTTGGCTAAAGAAAGAGCTTGGAAAATGGAGGAATGGGCGCTGGGTGGGATTGGAGGAGAGGGATT
GGGATAAGGCGACATATTCGGACTGCGAGCGATATTGATTTTTTAACAACTATTCTTTTTCTTTTTTTTACGATGACAA
ACATTTCTCG > SEQ ID NO:729 215244 *Trichoderma harzianum*
AGCGAACAAGCTCAGTTGATGCCTCGAGACAGCGGCAGAAACCGACAACCACGAACCCCAAACTCGAATTCGAGCGCAA
ACCAGAGCACAGGAAGAGGGCAAATGTCGAACCCAAACAACTGGCAGGAGGAGGCGATGCGGCGTCTGCGCCAGATGCA
GACGCGGGGCGGGTATCCCGGACGAGGAGGACCGCAGATGCCCAGAGGAGCAAACGGCGCCTTGATTGGAGGAATCTTG
CTGGCGGGCGGCGCTTGGTTGCTGTCGAACTCGCTGTTCAACGTGGACGGTGGTCACCGAGCGATCAAGTACCAGCGAT
TAAGAGGCGTGAGCAAGGAGATTTACAGCGAAGGAACACACATCAACATTCCTTGGTTCGAGACACCCATCATCTACGA
TGTACGAGCGAAGCCGCGCAATGTTGCTTCGCTGACTGGCACCAAAGACTTGCAGATGGTCAACATCACCTGCCGTGTT
CTGTCAAGACCGAATGTCGAAGCTCTGCCTCAGATTTACCGAACACTTGGAACCGACTACGATGAGCGAGTGCTGCCAT
CAATTGTGAACGAGGTCCTG > SEQ ID NO:730 215249 *Trichoderma harzianum*
CCCACGCGTCCGCCCACGCGTCCGCCCACGCGTCCGCACAATCACCACTCTCTTACACATACATCTATCAACTCCTTGT
TGTAAAACCACCACCACATTCAAAATGAAGTTCTTCGCCGTCGCCGCTCTCTTCGTCGCCAGCGCCATGGCCGGCCCAA
TGGGCAGCGAAGGATGCCCAGGTGGTCTTACTGGCACCGTTCCGCTCTGCTGTGCCACCAACGTCCTCGGCCTCGCGAC
CCTCGATTGCAGCACCCCCACTGTTCCTGTACCCAATGTCGGCATCTTCCAGGCCCACTGTGCTTCCAAGGGCAAACAG
CCTGTCTGCTGCACTGTTCCCGTTGCCGGCCAGGGCCTTCTTTGCAACAAGCCCACTGGAGCTCAGTAGAGTGCCTGTT
GTACTTGGATGGTGAACCCCGTCCACGGGATCACGGGGTTCACAAC > SEQ ID NO:731 215258 *Trichoderma harzianum*
ATTTTTGTATTCCAAAGTAGTTAACCGGTCCAGGTTTCTCTTTGGACTTTTTCGACTCTTACATCTTTCATTTCTTCCT
AAGAACTCTTTAATACCCCATACTTCAAAATGGCTGGCGGTGATGTTAAGAAGGGTGCCAACCTCTTCAAGACCCGTTG
CGCTCAGTGCCACACCGTCGAGGCCAACGGCGGCAACAAGATCGGCCCTGCTCTGCACGGCCTCTTCGGCCGCAAGACC
GGCTCCGTCGACGGCTACGCCTACACCGACGCCAACAAGCAGGCCGGCATCACCTGGGACGACAAGACCCTCTTCGCCT
ACCTTGAGAACCCCAAGAAGTACATTCCCGGCACCAAGATGGCCTTTGGTGGCCTGAAGAAGGACAAGGATCGCAACGA
CCTCATTGCCTACCTCAAGGAGTCTACCGCTTAAGCGATGAATGAAGAAAAAGAATTGTAATGACAGAGATATCAATAG
ACGGGGTGCGGCGATTGTACTACTATAGATAAAGTTAGAATAGTCGAAGCACCATCACTGTGCTTGTACCATTAATATC
CAACTCCGCTTTTTCAGCGACTGGACGCTGCTT > SEQ ID NO:732 215259 *Trichoderma harzianum*
AAGCAACAAGCAACAACAAAAACACATCAAGTTACAACCCAACACACAATCTCTTCAATTACATCCCACTTATATACTACCT
TTAAAGAAAACATCCAATCAAAATGACCAAAGTCCTCATCCTTGGCGCTACTGGTTATGTCGGCAAGAGACTAGCTGAG
ACTCTAGTTCGAAGCGGCCAGCACCAGGTATACGGCATTGCTCGAACTGAGGCCAAGGCCAAAACATTGGCTCTCGCAG
AGGTCACGCCCATCATCTGCGCTGATCCAGTAAATGAACCTAAATCCTATATGAAGGCTGTCCGCGACTACCACATCGA
TGTTATTGTCGACATTGCTGGCGCCAATCAAGAGTCGGCCAAGTTCCTCAGCCATGCCAAGGAGATCAGCCAAGAGCGA
CTGAACAGCTATGCCGCTTCTGGCATTAAGGGCCCTAAGCTTGGATTCATCTATTGTTCGGGCACTTGGGTTCATGGAT
CTAGTGATAAAGCAGTCAACGATCTCAACATCGCTGGGCCCAGCGGTGTCACCCCTCC

FIG. 1 continued

> SEQ ID NO:733 215270 *Trichoderma harzianum*
GATAGAGCCGACGAACCGGAATATTTGCCATTCAGGCAAACAAAGATAGCTTCCCCACGCGTTAAGAGATTGCAGCCGC
GCTACCAGGCCCTCCCAAAGCTTGCAAGCACTCCGTAGAGACCCGTAAACGGAGATGGCACCTCCCGCTCCGTGAGCGA
TTTCGGGGAGGGGGAGGGGACCAAAGATCATGGGGGAGGCTTTTTATTCTATCGACTCTCGGGAAGCATCTGCTCTCAT
CATCCCATTATCGGCAGCAAAGCAGCCAAGAGCCCCCACCAGACGGCCAGAAACTCGGGGTCAGCCCTGGCAACCTGGC
TCGATTTCTGTCCTTGTGTGGGCGTGGGCGCGTGGGCGAAGATGTTTTGAGTGATGGATGAGAATTAGGAAGAGACCAG
GGAGAGCAACCAATAAGAATCTGACGATAAGCAGCCCTGCTGTGTGGCGGCTAGTGTGAGCCTTTTGGGCACATGTTTG
GAGATTCTTGCGCGCCCTTGTACTTGTACTCCGTAGTTTTGAATGGACTCGGGTACAGTACGGAGCTGATGTCGTGATG
TTTCTAAATTAGATAGGAGACGG > SEQ ID NO:734 215283 *Trichoderma harzianum*
GCAATTATATTATGCTTGACAAGTTGAAACTGACCAAATAACAAAATACAACAACACCATGGCTACCACCAACGGCCCA
TCCAAATTCATCCCAGAACAGCTCTTCCACACTGTTCTCACCATAATCGACTACTCCCACGACGCCTCCGGCGCCAACC
GCACGCTATTCGTCCTCAAAACCCACGGCACCCTCGCCGCTGCAAAGAAATACGCCAGCCACGCCCTAGAAGCCGTCAA
CTTCACAGCCGAAGACTTTGAAGTCTATCGCATCCGCGCCGACGAAGACCCAGCCAAACCCTGGACCCACGGCGACGGC
GTGCTGGTTTTCGCTCGCTCCTTTGATGGGCAGGAGTTTCTCGTGGGAATCGACACTACTCCGAACAATGAGGCTTTGA
CCGCGACCTCGGATGGAGAGATGGTGCTGCCCGAGGGCGCAAAGTTCTTGCACTACCTTTTGCAGATTACGGTGGACTA
CAACGCCGACCGTAGCGGCAGCTCGCAGACCACGGAAATTGAAGGGACGTATGTCCATCGTGCGGATGCTTGGA > SEQ ID NO:735 215293 *Trichoderma harzianum*
AAAACCCAAAATAATCGCCATCAATTGCGCGCCGGCCAGCGATTCCCTGCCACCGAGACGAGCCTCCTCGAAATCCGCC
GCTTCTCCCTAGAGCCGACCCGGTTTCCTCTCTCTCACTCTCTCCTCCCTCTCCGGTCCAACCGGCAGACTTTCGCTCC
ATAACCCATCATGGCCCCCTCATCGCTTGGTCGCCCCATGCTCCGCTCGCCGGCCCTGAGCCACTTTGCCTTCCGCCGT
TTCGAGAGCTCTGGCGCCAGCAAGGCCACCGACGCCGCCAAAAATGCTGCCGGCAAGGCCAACGGGTACCAGGCAAAGG
CTGCGCAGGG > SEQ ID NO:736 215296 *Trichoderma harzianum*
ACAAAGCATCCCAGAGTCCTCGTATTCGCGGGGACCCCAAGTTCCACGATCCGCAGTCGCTGGTCGGTTTATTGGCCGT
CTCAGTCCTTCTTGGCAAACACGTTGCATCGTCTCATCATCTCACTCCTCGTAGCACAACATGTCTGAAGTTGTGGTGC
GTGATGCGCGCTACTCAGAGTTACCCGAAATTGCTCGCGTGATGGCAAAAGCATTCTGGGAAGATAATTTGTTTGGCCA
GCTCATTCACCCTCATCGAAATCAGTATCCGGATGATGTGCACCTGTACTGGCTGAGGCGGGCTCGTGTCAACTTCTGG
GACTGTCGCTGGCGATGGCTGGTCGCTGTTGATAAAGATGAGACTGGTCGTGAGGTTATCACCGGTATTGCGCAATGGG
CAAGATTGGGCGATGGTGGTAAGAGGTTGGACCGCTCGTACTTGGATCCTCGGAATTTGCTGAAGCCTCTGTCTTCTAT
TGCCATGACAATTCATGCCTGGTTGTG > SEQ ID NO:737 215303 *Trichoderma harzianum*
CCCACGCGTCCGCGCAAGCGAAAAAGGATTAATCGCAACTCCGAGATCCTGCTGAATCACAATGAGACCTACTCAGGTT
CGTCTGGGCGGCGGCGCCCCTCAACCCAAGACTGGCCACTGGCTCGGTGACTGGGGCTCCTTTGGTGGTGCCAAGCAGA
AGGGCATTATCGACTACGGGCTGTCTGCCAACCGTCAGAACCCCTTTGCCGGTGCTGCCCACGATGCCATCTTCAACAC
CTTCCGCCGCACCAAGTCCCAGATCTTCTACTGGCTCCCTCCTATGCTGGCTGGCTACTACCTGCTGAGCTGGGCCACC
GAGCGAAACCACTACCTCAACTCCAAGGCTGGCCGTGCTGAGTTTGCCGACTCGGAGTAAAATGGTGCACGAATATGTT
GAATTATGGGTGTCCAGGGGACACAGTGTATATCAGCGTCTAGATTAGGAGAAAACAATAGAAACGTTTGACTCTA > SEQ ID NO:738 215308 *Trichoderma harzianum*
CAGGGTGTTTCACAATGCCGATTGCACCTATAATCACATTCAAGGGCGGCCAGTGTGACGTCGACACATCGTCNAAGCC
ATACAAGGTCACGCCACAGCCTGAACCTGGTTATATCTATCTATACTCCGAAGATGATCTGGTGCATTTCTGCTGGCGA
CGACGGGACCAGCCTCTGGATGACCCCGAACTCGACCTCGTCATGGTTCCCACAGACGGTAGCTTCCTCCCCATACGAAT
ACAAGACCACCCCTCAGCCCACAGCGAAGACCAACGGGCGCATATTCGCCCTGAAATTTGGCTCTTCCTCTCAGCGCCA
CCTCTTCTGGATGCAGTCTAAGCCCCAGGGACGAAGTGGCGACGCGAGCTACTTCAGCCCCCGGGATCGCAAGATCGGC
GACATTGTTCACAGACTCTT > SEQ ID NO:739 215309 *Trichoderma harzianum*
AAAGTCATTCCTTAAAGACAAAAGACATCGGGTGCGTTGCCAACCACCTTCTTTTACGCAACCCTACAAACAACGGCAT
CTCGCCCGCGCATCTAGTCGCCTCGCTCCTTCGGCCTCCTCCAGCAACAACCTCCTCGCGGTATTCTGGAAATACTAAG ACGCTCGCTCACTCCTTTGGATATACAACCTAGACAGCATCTTTTATACAAATCGCCAACATGAAGTTCTCCACCGGCT
CCATCTTCCTCGCCGCCCTCGGCGCCTCTGCTCACCCCAGCGGCCACGCTCACAAGCGCGCCCACGACTCTCTCGAGGG
CCGCAGCGACTTTGTCATTGCCAACAAGCCTGTTGAGCCCAGCCCTCCCGTCGCGACTCCCACTCCCACTCCTTCGCCT
GCTGTTCCTACTCCTTCGCCTTCTGGTGCCGGTCCTCCTGCTCAGAAGGCTGCCAGCTCTGCTGCTGGTGTCGGCTCTG
GCCCTTCCACCTACACTCCCTTCTGCGGTGGTAACAACAAGCGTGCTACCGCTGCTGAGATCGCTTACAAGGG > SEQ ID NO:740 215325 Trichoderma harzianum
AATTTCACAAGTTTGAGGAGCAAGCCAGGGGTCGCCAGGCACCACCGTCAAAATGCCTTTCCAAAAGCTCGCCAAGAAC
AGCGCGTACTACAGCCGCTACCAGACCAAGTACAAGCGTAGACGTGAGGGAAAGACCGACTACTATGCTCGTAAGCGCC
TCATCACCCAGGCCAAGAACAAGTACAATGCTCCCAAGTACCGCCTGGTCGTCCGCTTCACCAACAAGGACATCGTCAT
GCAGATCGTCAGCTCTGAGATCGCTGGTGACAAGGTCCTGGTCGCTGCCTACGCCCACGAGCTGAAGGCTTACGGCATC
AACCACGGTCTGACCAACTGGTCCGCCGCCTATGCCACCGGTCTCCTGATCGCTCGCCGTGTCCTCACCAAGCTCGGGC
TCGACAAGGATTTCGTCGGTGTTGAGGAGGCTGACGGTGAGTTCACCCTCACCGAGGCCGCTGAGACCGACGATGGCGA
GCGCCGCCCCTTCAAGGGCTTCCTTGACGTTGGACTTGCCCGTACCTCCACCGG > SEQ ID NO:741 215331 Trichoderma harzianum
GTGCTCTGCTATCTCAATTATCTCCGATCTGGCTTGCAGAAGAGTCATCTGTACCGCAGGAATCTCACCTAACAATGTT
TCCAACCCTCGTCAGACGGCTGGCCCAATCAGCAAAGGAGCCCCTCACCAAACAGGTTCCCTTGACTATCATAAACAAT
CCCTACAAGGGTCGAAAAGTATGGCCACCTGACTTCAAAGGGTTGACTCATCAACAACAGCTTCGGTTTGAGAAGAAGT
ACAAGCGTCGCATTACCCTCGCACACCATTCACCAAGATGGGAGAAGGGTGTGAAATATGCGCAGCTCATTACAATTGG
AGCCGCGTTGGTATGGTTGCTTTTCTATTCTGAATTCGAGTGGTGGGGACGACAGTATAAGCCATCAGAAGAGTTGCGA
AAACACTACACCAATCTCTTTGGCGTTCTTGATCCTGAAAAGCGATACGAGCGCCGGAAGGACGCCCCAGAAGTAAATC
CATCATCAAAAACCCCAGAGTCGAAATGAGCTGTAGGATAATGGAGCTCTCCGATGCGTGTAATATAGTACTTGTATAT
ATATGGCGTTTGGCGCGATACCCGTGTTGGGCAAGGGAG > SEQ ID NO:742 215347 Trichoderma harzianum
GACTACGTACCTCCCCCCTACGGCGCCGATCCCCAAACCCGGTAGCGACACCCACCGGCCAGCCTAAACACGAACCCT
ATTTCCCGCCGCCAACTCGACCCCAGCGAGCGCAAGGCTTCGAGGCTCCAAATCAAAACGCCGCACCTCCCGTATCGTA
CAGGCCCGACGGACGGAGTTTCAGACCGTCGCTGCCTCCATTATCCACGTCGACCGACCCCTACCAATCTTTTGGAAGC
GCTGGCCTTCCATCGTCCTCATCCTCAGATATGCCGCCACGAAAGGTAGTGGCGCCTCCGCCCCCTACCCCAGCCGTCG
AGCCGTCTCCTGTCCGGACAAAATTCCCGACGGCCCGGATCAAGCGGATCATGCAGGCCGACGAGGAGGTAGGCAAGGT
CGCTCAGCAAACGCCCATTGCTGTGGGCAAGGCATTAGAGCTGTTTATGATCCAGCTCGTCACAAAGAGCGCAGATGTT
GCCAAGGACAAGGGTTCCAAGAGAGTGACGGCGTCCATGTTGA > SEQ ID NO:743 215360 Trichoderma harzianum
GTCGAGTCACCGCATAAAAAAAAACACAGGGAAGGCGCTCAGCCCCTCTCCCCGCCGACCCTTTTTTTTCCCTGTCCCG
CATCACCAAAAACCAAAACACCTCAGAGACCGTCGCCTTTCGCAGCCGCCGGTTCATCAACCTCGCCTCCCCCAAACTT
TCCTTTTTCCCACGAGAAACCCCGGAACATCCGAGTTTATGTCCATCGAAAATCTCAAGTCCTTCGACCCCTTCGCCGA
AGCCGACGACGACACCGGTGATATCAAAAAGGTCGAGAACCATATCCATATTCGTATTCAACAGCGAAATGGTCGCAAG
TCTCTGACCACGGTTACTGGTCTTCCTGCTAAATTTGACCCCGGCAAGATTCTCACCTTCTTCAGGAAGGAATTCGCTT
GCAATGGCAACAAGGTCAATGATGAAAAGGCCGGCGAGGTGATCCAGCTCCAGGGCGACCAACGCAAGAAGGTCATGGA
TTTCCTCGTTGACAAGAAGAGCGGTCTCGGTCTCAACCCCGATAACATCACCGTTCACGGTGCCTAAATCGTCCTCTTT
CGCGCCGGCGCCCCGGCCCGCCCTTCCAGCGACTTGGCTTCACAGCATGCTGGTGATGAGCGTGTCGGAATGGG > SEQ ID NO:744 215369 Trichoderma harzianum
CCCACGCGTCCGCCCACGGGTCCGCCCACGCGTCCGCGCTTTCTAGGCCCTTGTTTCATTTGAGTTCAAACGCTTCTTC
TCGTCTCTCGTTCAGAATTTATTTCGCGTCCTTCAAACAACTCAAAATGAAGTACTCTGTCGCTGCCGTCTCGGCCTTT
GCCGCCGTCGTTCTCGCCAAGCCCGAGTTCCTCAACTCTGCTTTCCAGGTCCAGGAGGGCAAGCCTTTTACCCTCGAGT
ACTCTGGCTGCTCTTCTGGCTGCGAGATTGTTCTCCAGACTGGTGCTAGCACCAACCTGAAGGACGTCAAGGTTCTTGC
TTCTTCTGCCACCGGCTCCTCCACTACCGTCACCCTGGAGGACATTCCCTCTGGCATCTACAGCTTCAAGATCACCGAC
AAGAGCGGCGAGAGCAACTACAGCCAGCAGTTCTCCTACCAGGGCAGCGGCAAGGCCATCTCCAGCGCCTCATCTGCCA
CCAGCGCTGCTGAGTCCAACACGGCTGCTCCCACCTCCGAGACCACCACGGCTGAGCCCACCAGCACCAAGGCTTCCTC
CACCAAGGAGCACTCCACCACGCTGGTCAAGTCAACCACTGCTCACTCCACCACCGA

FIG. 1 continued

> SEQ ID NO:745 215372 *Trichoderma harzianum*
GATGCCCGGAAGACAAGACGCTTATTCCGGGTCCATGCCCACAAACTCTCCTCCTCCCCCACAGAGCATCTCCAGCTAC
TCTCGCTTCATCCACGACCACACAAAACGCCAAATGCAGGCCTTTGGAGCTGCTCTATCGCCTACAAGTTCCGGTGCTT
CGGGTCGATCATCAGTCGGTACATCCATGACCAACGGCACAGCACCTGCCATGTAACCATCTTGCATTTCCGCGGGTGT
CCAAAAGCGAAAACTCGCTGCTTGAATTTGCGCATGTTTAGCTTTAGCGGTGCTTCTCTTTTTTCCAGTAGCTTGCCAT
TATGGCAGCTACATTGGTAATCTGGACGGGACTTGGAAAAAAATGAATTTCGGGACAGTCTAATATGGAATAACGCCCC
CGGTGTAACATGGCGAATCCAAGATTGGAACGCCTGCATAGAGACAAAGCAGCTTCTTTTTACCGATCACGCATTTACA
CTACAGCAAAAGCAACTCTTGCGTCACATCGAAAACGAGCCGACTTGGTGCCACTCGCTAATTTGTCGCTTCGTTTCTA
TTTATTATTGATTTTATGACTATATGATACACGCACGGGGTTTTGGGGGGGATCTTTATGGCAGGATACTAATCGG > SEQ ID NO:746 215373 *Trichoderma harzianum*
TGGGGTCGCAAATCTACAGCAAAAATGGGGTCGACAACGACCAAGCAGACCCCGGCGTCCTTTGTCGGGACCAGCAAGG
TCGTCGAGACTGACTATCCGCTCATCGACAACGACCCTCACTTTAAGCGGGTTATCGGATATGCGAGAACGTCAGACTA
CGTAGCTGGTGCAACCTCTGCGGCCTTTGCACCGACTGCTCTCTATGCCCTCGAGAGGCTCGCCCCGTCGCATGTTGGC
CGGGGAGGCTTTGCCAAAGCCATGCGGTTAGCCGGATTCATTGGCTTGGCCGGCGGTTTCCTCTACTTTTACCAGCGAT
CAGCCCTTCGATTCTACGGCGCCACTGAGAACTCAAGGGAAGTCGAGATGGATATGCGAGAGATGGTTTCCAAGGTCAA
GGCGGGACAGCCTCTGTATGGCGAGAGCAAGCTGAGCCCTCACCTGCAGGGAGTTGCGGCCCGACAGAGCAGATACTCT
GCGCTCTTTTTCAGCACAGTACCGTGGTTCAACTTTGTCAACCACAACCAGCACGGCGTGGACACGGGCAAGTACTATC
AGCAGGCCGAGAGGGAACTGGA > SEQ ID NO:747 215379 *Trichoderma harzianum*
CGACAAGTCGATTGCCCTGGTGAGCACCATTATCATCAGAAACCGCAATCATGGGTATCTCTCGTGACTCTCGCCACAA
GCGCTCCGCCTCCGGTGCCAAGCGCGCCTACTACCGGAAGAAGCGCGCTTTCGAGGCTGGCCGCCAGGGTGCCAACACC
AAGATTGGCGCCAAGCGAATCCACACCGTCCGCACTCGTGGTGGTAACCACAAGTACCGTGCCCTGCGTCTCGACTCCG
GCAACTTCGCCTGGGCCTCCGAGGGCTGCACCCGCAAGACCCGTGTCATTGCCGTCGCCTACCACCCTTCCAACAACGA
GCTGGTCCGAACCAACACCCTGACCCGTAGCGCCATCGTCCAGATCGACGCTGCTCCTTTCCGACAGTGGTACGAGTCC
CACTACGGCCAGCCCATCGGCCGTAGACGCCAGAAGGCCCAGGCCGCCAAGGAGGGCAAGGAGGTCGAGGAGGTCAAGA
AGAGCAAGTCCGTCGAGAAGAAGCAGGCTGCTCGCTAC > SEQ ID NO:748 215382 *Trichoderma harzianum*
TCAACGCCCCGACAACCCCCAAGTCACGGGAGCCATGAGGTACATTCACTCTCAGGAGATCCTGGAAATTCCAGAGGGC
GGTACGTTTCACCATTTTCCTTTTTTTTGATTTCGGCCTTGCAGATTCGATCGATTGCACTGGAGGAAAACATGTCTTG
GATGACGATGGAAAGGAAGAGGTGGAACTTAATCTCTGCTGTTGGAGATGAGGGATTGGACTGGAACAATGGGAGGGAA
CTACGATCGAACGAAAATCTGCTTGCTGGCTTGGATTACGCACTTCTTGAGGAAAACGAAGCTGACATTGAATTTTTTT
CTCCGAATAGTCAAGGTCAACATCAAGACCCGTATCGTCACCGTTGAGGGTCCCCGAGGCAAGCTCACCAAGAACCTCG
GTCACTTGGCTGTCAACTTCGGTCACCCCCAAGAAGAACCATCTCCATCGAGATCCACCACGGCAACCGTAAGAATGT
CGCCACTCTCCGTACCGTCCGCTCCATCATCGAGAACTTGATCACCGGTGTCACCAAGGGCTTCAAGTACAAGATGCGA
TACGTCTACGCCCATTTTCCCATCAACGTCAACCTGGACAAGAACAAGGAGACCGGTCTG > SEQ ID NO:749 215387 *Trichoderma harzianum*
GTGTGGCCTATCGATCCTTTAGTCCCTCGGCATTTGAGGCTAGAGGTGCCAGAAAAGTTACCACAGGGATAACTGGCTT
GTGGCGGCCAAGCGTTCATAGCGACGTCGCTTTTTGATCCTTCGATGTCGGCTCTTCCTATCATACCGAAGCAGAATTC
GGTAAGCGTTGGATTGTTCACCCACTAATAGGGAACGTGAGCTGGGTTTAGACCGTCGTGAGACAGGTTAGTTTTACCC
TACTGATGACCTCACCGCAATGGTAATTGAGCTTAGTACGAGAGGAACCGCTCATTCAGATAATTGGTTTTGCGGCTG
TCCGACCGGGCAGTGCCGCGAAGCTACCATCTGCTGGATAATGGCTGAACGCCTCTAAGTCAGAATCCATGCCAGAACG
CGGTGATAGCACCCGCACGTATAGACGGACAAGAATAGGCTTCGGCTTAGTGTCTCACCAGGCGATTCCTCCGTGGTCC
TCGAAGCGGGCCGCGGTATTTCGCGTA > SEQ ID NO:750 215405 *Trichoderma harzianum*
ACGGTCACCGCTCAAGGGCTTCCTCGCCGGAGTCACGATGAAGAACGGGCTATTACCACCCTTGCGATTCCTTCGCAGC
ACCAGCTTCCTGGGCGCAAACCAGGCACGATGGCTTCACAAGACGAGGGCGGCTCCGACAATCCCACAGCCTAGACCAT
TCGTCCCCGACGTCCAGACCTTCCTCACGCTCATTGGCCGCGGCCTCAACAAGCACGCCTCCAAGTTCCCGTCATGGGA
GTCTCTCTTCTCCCTCACCTCGCCACAACTCAAGGAGCTTGGAATCGAGCCTCCCCGCAGCCGCAGATACCTGCTGCAG
TGGATGCAGCGATACCGAAAGGGTGCGCTGGGACCTGGCGGAGACTTCAAATACGTCACAGACGGGCAAGCTCTGCTGA

FIG. 1 continued

AAGTAGCAACACCACCGGCCTCTGTTGTCAGCGATGCGAAATATGTGGTCAATGTGCCTCAAGACCAGGAGGCAGGTCT
GGGGGATTCTGAAATCCTTCCTCGACCCAATGGCTACACAGTTAGAGGACTCAAGTCAATAGCGGGGCCGTTTGCGACA
CCCTTGCCGCAACAGGCCGGTGCAGTCGTCAAAGTTACGGAGGGCATGTGGGAGCAACGCCA

> SEQ ID NO:751 215420 Trichoderma harzianum
ACACATCAAGATGGCCTCTTCCGCCCGTCAGTTTGCCCGCGTGGCAACCCGCACAACCACCCGCTCCTTCGCTGCCGTC
CCCCGACAGGCTTTCCGCCAGCAGGGTCGCCGCTTCTACTCTTCTGAGCCCGAGAAGAAGTCATCCTCCTCTCTCCTGT
ACCTTGGTGCTGCCGCCGCCGCCGGTGGTCTCGGTATCTGGTTCTTCACCTCTGGTGCCTCTGCCTCTTCCAAGACCTT
TGTCCCCACCCAGGCCGATTACCAGAAGGTCTACAACGACATCGCCGAGCGTCTCGATGCCGATTATGATGATGGCAGC
TACGGCCCCGTCCTGGTCCGTCTTGCATGGCACTGCAGCGGTACCTACGACAAGGAGACCAAGACTGGTGGCAGTAACG
GTGCTACCATGCGATTCGCTCCCGAGAGCGGCCACGGTGCCAACGCCGGTCTGATTGCTGCTCGTGACTTCCTCGAGCC
TATCAAGGCCAAGTATCCCTGGATCTCCTACTCTGATCTCTGGATCCTCGGTGGTGTTTGCGCCATCCAGGAGATGCAC
GGTCCCATTGTCCCTTACCGACCTGGCCGCCGTGATGGTGACGCTGCTGCTTGCACCCCCGA > SEQ ID NO:752 215422 Trichoderma harzianum
TTCATCGCTCAACAATCAATTACAATCCCGCAATCCAGTCGCGTCAGACGCCCGCTTATCCAGACTCTCTCTCTCTCAA
ATCACAGTCGAACACGTTCTTCGCACCATCCACAGCCATGCCTCCCAAGAAGACCGAAGGTGCTGCCCCCAAGGCCAAG
TCTGGCGCTGCCCATGCCAGCTACCAGGACATGATTACGGATGCCATTCTCAATCTCAAGGATCGCAATGGCTCTAGCC
GTCAGTCTCTGAAGAAGTACGTCAAGGCCAACAACACCTTGAACGTTTCGGACAACATGTTCGATTCTCTCTTCAACAA
GGCCCTCAAGGCCGGTGTTGAGAAGGGCATCTTCGCCCAGCCCAAGGGCCCCTCTGGAGGCACCAAGCTGGCCAAGAAG
AAGCCCGAGGCCAAGAAGGCTGCTGCTCCCAAGAAGGCCACCGCCACCGCTAAGAAGACCAAGGAGGCTCCCGCCAAGC
CCGAGAAGCCTGAGACCGTTCTGACCAAGACCAAGTCCGGCCGTGTTGCCAAGGCCCAGAAGCCCGCT > SEQ ID NO:753 215431 Trichoderma harzianum
AAAACAACCGCAGCAATGGCCGCCGAAAGGTCCAGCAACCCCATGCGGGAGCTTAAGATTCAGAAGCTCGTTCTGAACA
TCTCCGTCGGTGAATCTGGTGACAGACTCACTCGTGCCGCCAAGGTGCTTGAGCAGCTGTCTGGTCAAACCCCCGTCTA
CAGCAAGGGCCGTTACACCGTCCGTACCTTTGGTATCCGCCGTAACGAAAAAGATTGCTGTCCACGTCACCGTCCGCGGC
CCCAAGGCTGAGGAGATTCTCGAGCGTGGCCTCAAGGTCAAGGAGTACGAGCTTCGCAAGCGCAACTTCTCCGAGACTG
GCAACTTCGGCTTCGGTATCAGCGAGCACATCGATCTTGGTATCAAGTACGACCCTTCCATCGGTATCTACGGCATGGA
CTTCTACTGCTGCATGACCCGCCCCGGTGAGCGTGTCACCCGCCGCCGCCGCATGAAGAGCAGAATCGGTGCTTCTCAC
CGCATCAAGCGCGATGAGACCGTCAAGTGGTTCAAGGGCCGCTTCGATGGCATTGTCCGATAAACGGTTTAAAATCCAA
ACCGAATAAAATACTTTTTTTTTCTTGTCTTGAAGGAAATGGGCATGGCGAACATTTGGGGGTAAAAAGGATCATATGG
TCATGTATTCTTCCGCTTGATTTTTACATCAGCTCGTACCAA > SEQ ID NO:754 215445 Trichoderma harzianum
TGATAGTTGACGTCTTGGTTTGTTTGTTCGCCGCTTCCAATCTCCGTGACACCTCCGCCACCAGTTCTCTCTCCCTCCA
TTGAACTCTCTCCTCCCGAGTAAATCACCAGCTTTCGTATCTTCACACAAACAATTCAATTCATCTCACCATCATGGCT
ACTGCTCACGTCTCCGCCGCCCGCTATGGCAAGGACAACGTCCGCGTCCTCAAGACCGACCGCGACGCCGCCACCGGCA
TCCACACCGTCACAGAAATGACCGTCAGCTGCCTCCTCGAGGGCGACATCGACGTCTCCTACACAAAGGGCGACAACAG
CGTCGTCGTCGCCACTGACTCCATCAAGAACACAATCTTCATCACCGCAAAGCTGAACCCCGTCAACCCCCCGGAGCTC
TTCGCCGCCATCCTCGGCTCCCACTTCATCGACACCTACAGCCACATCCACGCCGCAAACGTCAAGGTCATCACGCACC
GCTGGACGCGCATGGAGGTCCGCGGAAAGCCGCATCCTCACAGCTTCTTGCGCGACGGCCAGGAGACGCGCAACGTCGA
GGCCCGCATCACGCGCAAGGGTGGCATCGTCATCAACAGCGGCATTGAGGGCCTGACTGTGCTCAAGAGCACCGGCTCG
GCATTCCACGGCTTTGTGCGGGACGAGTACACCACTCTGGGCGAGACCTGGGA > SEQ ID NO:755 215459 Trichoderma harzianum
CACACACAACTCAACCAGGCTTTCAACTCTCAACTACACCACAACTTACAATCTCATCTCGCGACCAACCAACTTTCAC
AATGGAGACTGTCAAGCAAGCCGTCAACTACGTCGCTGAGTCCGTCCAGGGCGCTGCCTCTGGTATCAGCAAGGAGACC
AACAAGGAGATTGCCAAGGACAGCAACGTCGACGTTTCCACTCGTTTGTCCGCTGGCAAGGACGCCCTTGGTGACAAGA
TCGACGAGACTGGCCACAACAACAAGGCCGAGGCTCACAAGCAGCTGGCTGAGCACAACTAGATTGGCATAAGGAGCTT
CGATTGCTTCACAGGCGTTGAACCGGATCAGAGCGAAGGGAATATATAGCCTCACTAGGCAGGAATTGATGATTTGAAT
TC

FIG. 1 continued

> SEQ ID NO:756 215474 Trichoderma harzianum
CACTGTCGCTATCATGGCCCGCGGAAGGTCAGCGTGATTTGGCGCGCGCAAAAAATCAGAAGAATGCGTCCAAACATGT
GAGTCGGTTTTGCATATAAAATCCTCAACAGGAACCAGGGTTGACTAATTCGGTGTCGTGTCTTTGCAGAAAGGCGGCA
ATACCGAGAACGGATATGAGCAAGCAAAATCCAAGTTGAGTAACGCCGAGATTATGAGGCAGAAGCAAGCCAAAGGTCC
GAACAACCAAGTCTACCCAATACCTCTTACGAACCAGTCAACTTACCAAGGCAACAGCCAATGCCGAGAGAGACCTAGC
GGCAGCAAAGGCATTACAAGAGAAAAGGGACGCAAAGGCGAAGAAACCGACTGAATTGGGCGCTTCAGCTGTGGAGGTT
ACTGGACATGCAAATAACCCAAGAGGATAGCAAGAGATGGGAGAAAACACGGCACGGCGAAATCAGGCGCTCCTTGAGA
CTTTCACAATACGGCGCAAATTTGGGACAATCTAGGTGAAGAGGGGGAAGCGTTTTTTGGCTTAATACCAGGTATAGCC
ATGGATAATAGCGAAATGGATATTTTGTTGCGGTATTGCTATTATTATTCTACCAAAAAAAGTTCGACCTTTGTGTCCC
TTTTTTTCCCCTCG > SEQ ID NO:757 215477 Trichoderma harzianum
ATTATCCTCCCCTGGCAAGCAAACCACGAGCCTCTGTCAGATAATCAATCGCCATCATGCCTCCCAAGTTCGATCCCAG
CGAGGTCAAGGTCATCCACCTCCGTGCCACCGGTGGTGAGGTTGGTGCCTCTTCGGCCCTTGCTCCCAAGATTGGTCCT
CTTGGTCTGTCGCCCAAGAAGGTCGGTGAAGATATCGCCAAGGCCACTGGTGACTGGAAAGGTCTCCGTGTCACCGTCA
AGTTGACCATTCAGAACCGTCAGGCTGCCGTCTCTGTCGTGCCCACTGCCTCCTCTCATCATCAAGGCCCTCAAGGA
GCCCCCGCGTGACCGCAAGAAGGAGAAGAACATCAAGCACAACAAGTCCGTCAGCCTCGATGAGATCATTGAGATTGCC
CGCACCATGCGCTTCAAGTCTTTCGCCAAGGAGCTGAAGGGAACCGTCAGGGAGATGCTGGGAACTGCTCAGAGTGTTG
GCTGGCAGGTCGATGGAAAGACCCCCCAGGCTATCCTGGAGGCCATCGAGAACGGCGAGATTGATATCCCCGAGGAGTA
GAGTGTCTGGTTCAGACCGCCTGTCCCACCGAGAAGAAATTCTCGTGCA > SEQ ID NO:758 215480 Trichoderma harzianum
CCCACGCGTCCGCCCACGGGTCCGCCCACGCGTCCGCGAGCACTTGGACCGCCATGGCCGCATATATAAAGTCCATGAC
GGGGGTTGAGCTGCCCATGCTGGACAAGCTGGTCTCAACCCTCAATTCATTCAACATCTGGCGTTCGCCCGCAATGGCT
CTGCCCCAGGTCAAATCCCTGCAGGACTGCGTCGACTACTCAAAGGTCGTTGAGCCTTTCTTGCCCCAGCTCTACCAGC
TTCCCCACCACATCTGGGAGAGCATCGACAGTCTCGATGCCCTGAGAGAGCTCTATGTCACGACGAATCCCCTGATTTC
AGGCTTTGCGGCCTCTCTGGTTGTTGGGCTTCTCGCCTTGATCGTGTCCGAGATCAATCGCAACTATTCTCAGATCGAC
CGCCTGTGGAGTATCCTGCCCAATCTATACGTTGTCCACATTGCGCTCTGGGCACGTGTAGCTGGTTTGGCGCATGGTC
G > SEQ ID NO:759 215494 Trichoderma harzianum
AGCAATTGGACCCTCGCTTTAGCCGAGGGGCGAAGATATAGGCCAAGATGAGGTCATTAGGAGAGCGGTTAAACCTGCT
TCGAAAGAAACTCATTAACATCAGATGCGGCCCCGGCGCAGCGATCCTCCCCGCGGAGGTCACCCGGATACACATGGAC
TTCGCCCTCCGTCTAAAAGGCGGCCACATGGGAGCTAGGAAATTCTGGAGAGAATACCTCCCCGCCTGAAATACCACA
ACCCTTCCATCCCCATGATCGTCAACCGCCACGACCAGAACCAGCTCCCCCCAACCATGACAATCTACCTCCGCAAGGG
CGGCTCCTCAGTAGCAGACCCAGCGTCTTCTTCTTCTTCTTCCTCCGAACCCATCGCCCAGCCCTCATCCTCCCGA
ACGAACCTCTCCAAGGCCCAGCCCCCCACCGCGGACGAGCGCGTCGTCCACATCGACATGGCCAACAAGCACTCATCAC
ACATCCTCGAGTTCTTCATGGCCGAGACCCGCGCCGTTCCGCTGCAGCCCACGAACGAGGAGATTGCCGAGATGCAGGC
CCTCGAAACGCTGCGCAAGAACGC > SEQ ID NO:760 215516 Trichoderma harzianum
TTCTCATCACATTCCAACCATCTTCATCCAGTCGTCTTGGATTCATCAAACAGCTCTTGGATCCGTTCTGATCCAGCCA
ACCAACCATCGCCATGTCTGAACCTCTCACCAAGGTCGAATCCGGCGGTCAAGGGCTGTCATCATCACCGGCCAAAGAG
AAAGGCCATAGGAAAACAACCTCTAGCGCGGGTGGTGTTATGACCATTGGGGAAATCAATGAAAGCCATGCTCCTCTAA
AACTCGCAATAGAGACACAGCAGACAGCGTGGAAAATAAATCATCGGCCCAAGGATCTCGACAATGATCATCTGCTACA
GGTTCCCCTCAGCAAGCCTCCCATC > SEQ ID NO:761 215528 Trichoderma harzianum
AGATCTCTTTCGATATCTCATCCTTGCAACTCGTCTGTCTCCTGCAGCACCGAATATCGTTTCCTGGAAACTTTAAATC
TATCAAAACAACAACTTCCTTTTACACATCCACCATGAAGTTCTCTAGCTTTGCTGTCCTTGCCGTTGCCGCCCTTGTT
CAGGCCAACCCAGCTCCCTCTCCCGCCCCATCTCCTGCTCCCGGCCTGGGCGACTTCATCGACGACGCTTCCACCTGGC
TCACTGGCAAGGCCGGCGAGGTCAAGACCTGGCTCTCCGACAAGGCTGGCGAGGCCTCCTCCTTCGCCAGCCACGTCCA
GTCCAAAGTCGACGCCAACGAGTCCAAGGCCAGCGCGGCAGCAGCGCCATCAAATCCATCTTCGACGATGCGCCCTCC

FIG. 1 continued

```
AGCGTCATCGCCAGCCTGACCTCCGAAGCCGGCTCCAAGTTCAGCTCCCTCAGCAGCGTTGCCGCCACTGCCACCGGTG
CAGCTGCCTCCTCGGTCAACGCCGACATTTCCAAGCTCAGCGCCTCCCTT

> SEQ ID NO:762  215538  Trichoderma harzianum
GTAGGTTGTCGATAGCCTCAAATATCTAGAGAGCAGCGATAGCCACAAGACACTCGACAAGACTCGATTCGAGAGCTCG
CGACAAGCGCACCATAGAAAATGCCAGCTCGGCGGAACAGGCGCTTCTTCTCGCGAGAGCCATTCCACAATGACGACCG
GCTAACATTGCAGCACGCCGAGGGGCCTTTTGGCTTTCTCAATCCAACAAGAGCTCATTTCGACCACTCAGCACTGGCT
CCGAAGCCGACGCCTGACGAGATAGCGGAACCACATGAGAGCGGCGATGATGCGGAAACCAAGCACCAACAGACAAAAC
AAGCCGCCGATTCGAACGTCCCCGCCAAGAACGTCAAGTTCCTATGGCGGTCTCGAGACAATCGAAAGGGTCGGCATCC
CTTGCTCGTTCAAAAGCCGGTCCC > SEQ ID NO:763  215552  Trichoderma harzianum
TCGTTCCCAATCAACTCCGTCTGCCTCTCTCGCCCGCATCAACAACATTGCGAGCCACATCTCTCCCACAATGGCTTCC
ACCACCAGTTTCCCGGCAGAAACGGTGCCCCAGGCGCCTGAAGATCCCCTCTTTGGCCTGGCCCGCGCCTACAAGGCTG
ACAACAGCCCGCTAAAGGTCGACCTGGGAATCGGCGCCTACCGAGATAACAATGCGAAGCCATGGGTTCTTCCTGTGGT
AAAGAAGGCTGATGAGATTCTCCGAAACAACCCCGAACTGAACCACGAGTATGCCCCGATTGCAGGTATCGAGAGCTTC
ACCAGCAAGGCTGCGGAGCTGATGCTCGGCGCCGATTCGCCCGCTCTCGCGGAGCGCCGCACTACGTCTATGCAGACCA
TCTCGGGAACCGGTGCCGTTCACTTGGGAGCTCTGTTCCTCGCCAAGTTTTACAAAGGCAGCCAGACCGTCTATGTGTC
AAATCCCACATGGGCAAACCACCATCAGATCTTTTCCAATGTCGGCATCAAGGTCG > SEQ ID NO:764  215570  Trichoderma harzianum
CCCACGCGTCCGCCCACGCGTCCGCCCACGCGTCCGGCTCCGCAAGCGAAGCAGCATCTTCGGCTCAGACGACGTGTTT
GACGGCCTGAAGCACACCTTCAAGATGGACGGCTTCAAGGGCTATGCTGGTCACTTCCACGAGTCCACCATCGAGCAGG
TCCGGAATCACCCGGATGTCGAGTACATCGAGCGCGACAGCATTGTCCACACTATGCTTCCCCTCGAGTCCAAGGACAA
CATCATCATTGAGGATTCTTGCACTCCCGAGACTGAGAAGCAGGCTCCTTGGGGTCTTGCTCGTATCTCTCACCGAGAT
ACCCTCAACTTCGGCTCCTTCAACAAGTACCTCTACACCGCTGAGGGTGGTGAGGGTGTTGATGCCTACATCATTGACA
CTGGTACCAACATTGAGCACGTCGACTTCGAGGGTCGTGCCAAGTGGGGAAAGACCATCCCTGCCGGCGACGAGGACGA
GGATGGCAATGGCCACGGCACTCACTGCTCTGGTACCGTTGCTGGTA > SEQ ID NO:765  215575  Trichoderma harzianum
GGCTCTATCCCCTCATCATGAAGTTTGCAGCTCTTCTGGCCACTCTTGCCCCGGCCGTTCTGGCATTGCCGGCCTCTGA
TGCCGCATTGACCAGACGCCAGACCAGCCTCTCAACCATCACAGACCAATATCTCTTCAGCCTCACTCTCCCTGATTTC
ATTTCCCGCCGCAATGCCAAGAACCCAGCCACCCTTGACTGGACGTCTGACGGCTGCACCAGCTCACCCGATAACCCTT
TTGGATTCCCTTTTGTTCCTGCTTGCTACCGCCACGACTTTGGCTACCAAAACTACCGCATCCAAAACCGATTCACAGA
GAGCGGCAAGCTCAGCATCGATAACAACTTCAAGGCCGATCTATACTTCCAGTGCCAGACATCGAGTGTCCAAAGCGTT
TGCAATGCTCTTGCTGATGTTTACTACGCTGCTGTGAGAGCGTTCGGAGGCGGCGATGCTTCTCCTGGAAAGCGCGAAC
AATCACAAGAGGACTTGGTTA > SEQ ID NO:766  215579  Trichoderma harzianum
TCGTTCTGCGCACCAACTCGCCCATCATGGTGTCTCGAAGCATAGCCGTCGTCTCTCGCATGGCGCCCATGCGCCATTT
GCGCCCTTCTCCTGTCTTCCGCCAGGGACTTCCCAGCCTTGTCCGGTACTATGCAGACAAGATCATCCAGGTGCCGGTC
ATGGCTGAGTCCATATCTGAGGGCACTCTCAAGCAGTTCTCCAAATCCATTGGCGACTACGTCGAGCAGGACGAGGAGA
TTGCCACCATTGAAACCGACAAGATCGATGTCGCCGTCAACGCAACAGAAGCTGGTGTTATCAAGGAGTTTTTCGTCAG
CGAGGAGGACACCGTGACGGTC > SEQ ID NO:767  215586  Trichoderma harzianum
CCCACGCGTCCGTCACAGGCTTGCCTTGGCAAATAGACAACAGAAACCCTGTTTCAAGCCCGTTGACTCTGTGAAGCCA
GATCTGGATTTGGCTTCCATGCGTGCGTCTTATACTTTCAGGAGAACGCCGCAGTAGACTACTTAAAGACTTACTCTCC
CCACGTCAAGACGTTCCTCTTCATCCATCTTTTCCAAGCACGACACCATGACTACCCGCTCCCTTCCTAGCAATGGCAG
CTCTGCCTTTGACTACATCATCGTTGGTGGAGGCACCGCAGGCTGTGTGATTGCCTCGAGACTCTCCAGCTATCTGGCC
GAGCTCCGCGTTCTTCTCATCGAGGCTGGTCCCTCCGACTTTAACCTCAACCACGTCCTCAATCTG
```

FIG. 1 continued

> SEQ ID NO:768 215595 Trichoderma harzianum
TACAATAAAAACACAATCTTCAATTCTTTGAACCTTTTTCAAGTTTCGCCAACATGAAGTTCACCACTACTGCCGTTCT
TGCCATTGCCGCATTCGTTGAATCGGCCACTGCTCTGGGCAAGGCCCGTGTCGTCAACAAGTGCCCCTTCAGCGTCACC
ACCTGGTCCGTTGGCAGCGCCATCTCCAACCCAACAACCCTTGCTCAAGGCGGTTCCTATGGCGAGACCTTCTCACGAG
ACCCCGTAACCGGCGGTCGTGCCATCAAGGTCACCGTCCAGCCCGATGGCCTCTACACTGGCAAGCCCCAGACCAACTT
CGCCATCAACCTTGAGGGGAACACCATCTGGTACGATCTTTCAGATGTCTTTGGCGATGCCTTCAACG > SEQ ID NO:769 215601 Trichoderma harzianum
TAGATCTTACAGTATTACGAACTCGGTACCCGGGGATCCTCTAGAGTGGACCTGCAGGCATGCAAGCTTGAGTATTCTA
TAGTGTCACCTAAATAGCTTGGGGTAATCATGGTCATAGCTGTTTCCTGTGTGAAATTGTTATCCGCTCACAATTCCAC
ACAACATACGAGCCGGAAGCATAAAGTGTAAAGCCTGGGGTGCCTAATGAGTGAGCTAACTCACATTAATTGCGTTGCG
CTCACTGGCCGCTTTCCAGTCGGGAAACCTGTCGTGCCAGCTGCATTAATGAATCGGCCAACGCGCGGGGAGAGGCGGT
TTGCGTATTGGGCGCTCTTCCGCTTCCTCGCTCACTGACTCGCTGCGCTCGGTCGTTCGGCTGCGGCGAGCGGTATCAG
CTCACTCAAAGGCGGTAATACGGTTATCCACAGAATCAGGGGATAACGCAGGAAAGAACATGTGAGCAAAAGGCCAGCA
AAAGGCCAGGAACCGTAAAAAGGCCGCGTTGCTGGCGTTTTTCCATAGGCTCCGCCCCCTGACGAGCATCACAAAAAT
CGACGCTCAAGTC > SEQ ID NO:770 215608 Trichoderma harzianum
CCACGCGTCCGCCCACGCGTCCGGCCACGCGTCCGCGCTCGCTAAGCACCTGGAAAACTTACCTTGGCACTTTTGTCAA
TTTCATTCTTTAAGAGCAACCGGATCAATAATCTTAATCAAGCTCCCTCGAGTTTAATTCCTAATAGCGACAAAATGAA
GTTCACCGGTGCTGGCGCTCTCGCCGGCGTTGGCGTTTCTGGCGGCTAGGTTCCTCCTAGCAACGTCACCGTTGTGACC
GGTGTCGTTGACCAATACGTCACCTACTGGCCCTACGCTACCCAGATCACCCACGGGAGCAAGACCTACACCGTCACTG
GCCCACCACTCTGACCATCACCGGCTGGCCCTGGACCATCACCCGGCCC > SEQ ID NO:771 215610 Trichoderma harzianum
CCCACGCGTCCGCCCACGCGTCCGAGCTTACCACGCATAACCATCAATCGCAGTCACAAATCAGCTACAATGGCTCCCA
TCAAGGTCGGCATCAACGGCTTCGGTCGAATTGGACGTATCGTCTTCCGCAACGCTGTTGAGCACCCCGACATCGAGGT
CGTCGCCGTCAACGACCCCTTCATCGAGACCACCTATGCTGCCTACATGCTCAAGTATGATTCCTCCCACGGTATTTTC
AAGGGCGACATCGATGTCGATGGCAAGGACCTCGTTGTGAACGGCAAGAAGGTCCGCTTCTACACCGAGCGTGACCCTG
CCAACATCAAGTGGAGCGAGACTGGCGCCGACTACATTGTCGAGTCCACCGGTGTCTTCACCACCACCGACAAGGCCAA
GGCTCACTTGGCTGGCGGTGCCAAGAAGGTCATCATCTCTGCCCCCTCTGCCGATGCCCCATGTACGTGATGGGTGTC
AACGAGGACAAGTACGACGGCTCTGCCGATGTCATCTCCAACGCCTC > SEQ ID NO:772 215611 Trichoderma harzianum
TCGATCAGTCGACAATTCATTCAAGATGGGTAAGGAAACGCCTGCAAAGACCGGTCTGGCCGTTGGCCTGAACAAGGGC
CACGTACGTCAATACAACTCGCGATCTCACCTCGTGGAGGATCTCTGCCCCCAACCTTGATCTCGGCAGACGATGGACG
CTGACGTTTTATGGTTTGTGTTTGCCTGAATATAGAAGACCACTGCTCGTGTCGTCAAGCCCCGTGTTTCTCGCACCAA
GGGCCACCTGAGCAAGCGAACCGCTTTCGTGCGTGAGGTCGTCAAGGAGGTTGCTGGCCTCGCCCCCTACGAGCGTCGT
GTCATCGAACTGCTCCGAAACAGCAAGGACAAGCGTGCCCGTAAGCTGGCCAAGAAGAGGCTCGGTACCTTGGCCGTG
CCAAGAGAAAGGTCGATGAGCTCCAGCGCGTCATCGCCGAGTCTCGTCGTGCTCACTAAACGATTTCTTCTTTAAGCGA
GCGGGAGAGATTCATCTTGGTAATGGGGAAAAACAAAAATTATTTCAACAGGGAAATGAATTTAAAAAAACACTACGGG
TTTCGCATGGATTTGGCGTGGTCATGAATTTTGATTGAAT > SEQ ID NO:773 215629 Trichoderma harzianum
CACAAAAATCGTTCAAGATGCAGATTTTCGTGAAGACCCTGACGGGCAAGACCATCACCCTTGAGGTCGAGTCCTCCGA
CACGATCGACAATGTCAAGTCCAAGATCCAGGACAAGGAGGGCATTCCCCCGGACCAGCAGCGATTGATCTTTGCTGGC
AAGCAGCTCGAGGATGGCCGCACCCTTTCCGACTACAACATCCAGAAGGAGTCCACCCTCCACCTCGTCCTCCGTCTGC
GTGGTGGTGTCATTGAGCCCTCTCTGAAGGTTCTTGCCTCCAAGTTCAACTGCGACAAGATGATCTGCCGCAAGTGCTA
CGCCCGTCTCCCTCCCCGTGCCACCAACTGCCGTAAGCGAAAGTGCGGTCACACCAACCAGCTCCGACCCAAGAAGAAG
CTCAAATAAATCATTTCACCAAGGATGTGGCGTCTGGGTTATGGCATTCTGGGGTGGCGAGGACAGAGGTGCTTCTGCT
TTATTCCGGATTTTGTTTCTACATTAGCATCAGGGCAGAGGCAAAATATATCAATCTAGATGATGTCT

FIG. 1 continued

> SEQ ID NO:774 215642 *Trichoderma harzianum*
TCATCCTTTTGCTTCCAGCAGCTATCAAGACTTGACTTAAAAAAACCAGTCCTCATAAAGACATCTACAATCAGTCACC
ATGCAGATCACCAAGAGCCTCATCGCTACCCTCTTTGCCGCTTCGACCGCCTTTGCGGCTCCCACTCCTGCGGACAAGT
CCATGATGGCCGCTGTCCCTGAGTGGACAATCACCAACCTGAAGAGAGTGTGCAACTCCGGCAATACCTCCTGCACATG
GACCTTTGGCGTCGATACACATCTCGCCACTGCCACCTCATGCACATACACCGTCAAGGCTACCGCCAACGCTTCTCAG
GCCACCGGCGGCCCCGTTACTTGCGGCCCTTACACTATCACATCCAGCTGGAGCGGCCAGTTTGGCCCTAACAACGGCT
TCACTACCTTTGCTGTTACCGACTTTTCGAAGAAGCTCATCACCTGGCCTGCCTATACCGATGTTCAAGTTCAGGGCGG
CAAGGTTGTTTCGCCCAACCAGAGCTACGCCCCGACCAACCTGCCATAGATGGAATGAATTTGCTTGGAATTACTATAC
GCAAGGTCAATTTACTCCCAAA > SEQ ID NO:775 215655 *Trichoderma harzianum*
AAACAAGCTTCTCCATCTTTTTTCAGACTCCTTGAGAAGAGAACTCGGACTTAGACTTGACTTAACTGTCTATTACACA
CACAGCTCTCCACTAAAAGCATCGAGCTCTTACACAACAACACACAAACAACTTTGTCAACACTCACAAACCCTTATCC
GGTTTCACTCAACTCTTTTCTCTCTCAACAACAAACTCACTCACAATCACTATGCCTTCTTCTCAAGGACAAAGCTGGT
GGGCCCGCCACTGCACCCCCCGACCCCCGATCAACAAGGTCGTCGCCTGCCCCTGCCACTACTGCTACAACAAGCCCGC
CTGCGAGCTCGACTACCCCGAGTCGTCCAACTGCTCCGAGACGAACACCCCTGCTCAGTCGAGGCCTGTCAGCCCCCGA
GGCCGCACCAGCTCGTCTTCGTCTTTTCACGTTGAGAAGGCCGAGAAGCAGTAAACGACACATTCGATCATCGAAATCA
TTCAAATCACAAAAGCGAGTACATCTTTGAAGATCCTTTGGATACTATAGGATATACACACACTTTCGGTTTCAACATT
TTCTTTGTGTCATTCTCTCTCTACTGAGCGAGCGAATACAAATAT > SEQ ID NO:776 215665 *Trichoderma harzianum*
ATCACCACTACATCTTCCCAAGATACTTTGGTTCCCCCGCCAGCTCTGGGAAGCTATCCATCCATCGACACCATGGATA
ATATCGGCGGCACCATCAAGCGCCGTTCGACGGAGGTATGGCAAGCTGCGCAGAACAACATGCCCACCATGCCCTCTAT
GCCTGCCATGCCTTCTTTGCCCGCTCTCCCTTCTCTGGCGGCCATGCCACAATTCTCGTTTGATTCTTTCCGGAGGCAA
CCCCAGCAGGAAGGCCTGAAAGGCACCTGGGAGCGCATTGACTTGCCCCCGGTTCCTCGTTCCTCCCACTCTCTTGACA
TCATCTCTGGGTGCGCCTACATCTTTGGTGGCGAGATCACCCCCCACGAACCCGTTGACAATGACATTGTTGTCATTCG
CCTTCCCTTTAGCAGGGCTCCCGGCGACTACTTCAAGATCCCG > SEQ ID NO:777 215667 *Trichoderma harzianum*
AAACATCTCGACTCCCTACAGCCAAAAGCTTCTCTCATGTCCGACTACGCTCCTCCCACAGGGCCTCCGCCGCCCAAGG
CCCCCGAAGTTCCCGCTGGCTGGGCCGCCCGGTGGAACGACCAATACAAAGAATGGTTCTACGTAAATATCTACACCAA
AAAGTCCCAATGGGACAAGCCCACCAGTCCTGTCTTCCCTGACGGAGACGCCCCGCCTTCCGGGCCTCCCCCAGGCTAT
GACGGCCACAACGCTCCCCGCACGTCCGATGCCAAGACGAACCCCTATGGCGATCAGAGCAACAACTTTGGAGGCTCAT
CATCAAGGCAGACGCAGGAAGACGAGGATGCTCGCCTGGCAGCCAAGATGCAGGCCGAAGAAAATGCCCGAGCTCGCAG
CGCTTCTTCCAACCCTCCCGGATACAACAACTATTCCGGAGGCGCTGCCGATTCGTACCGCCAGCAGAGCACCAGCCCG
TACCCTCCCCCGCAAAGCAGCCCGTACGGTACACCCCAGCCGCAGCAGCAACAGGGCGAAT > SEQ ID NO:778 215669 *Trichoderma harzianum*
AATCAAACTCTTAATCTCTATTCTTAAATACATCTACCTCTCACAATGGATTTCGTCAACAAGGCTATGGGCAAGGAGG
AGCGCTCCACTCAGGGCACCGCTCCCGCTGCTCCCAAGCAGGCGGCCAGGTCCAGAAGGACGATTACGTCGACAAGGC
TTTCGCCATGGGTGCCAAAAAGAGCGGCCACAACATGGATCGCAACACACAGGAGAAGATTACGGATGCAGGCCGTAAC
ATGTACGAGAAGGTGACAGGAAACAAGGTCGACCCCAAGTGGTCTAATTAATGAACGGACGAGTTATGACTCACAACAA
GACTGTACAATAGTAATAATAACATCTTACC > SEQ ID NO:779 215670 *Trichoderma harzianum*
ATAAATTCGAGGTGTTTTAGACGCAAGCTTCTCTTTTACACACTGAAGCTGCTGCTGCAACCATCACCAACATACCACA
CGCAACAACACAACACCACCACGTAATAACGAGCAGAACACCCCTCGCTTGAACTTGTTGCAAAAAACACTCTCGCCTC
TATTTCATAAATCAAATTACACACGAACAAAACAATGAATCCAACAGTCAGAGGCTTCTCAACCGCCGCAAGAGTGCAC
CCGCCCTTTTTGCCACATCTCCGCCCATCGCCGCGCCGAGCCCCGATCCGACGCTGGTAAGCACTCAACTCTCTCTCAC
GTCCCCCATCCATAAGGATACCATAGCAGCAAAAAGACACAACC > SEQ ID NO:780 215672 *Trichoderma harzianum*
ATCTAACAGTTCAATCCAGACACCGCCAAAATGGTCAAGAAGAGAAAGAACAACGGCCGCAACAAGAAGGGCCGCGGCC
ACACCAAGCCCATCCGCTGCAGCAACTGCTCGCGATGCACTCCCAAGGATAAGGCGATCAAGCGCTTCACCATCCGCAA

FIG. 1 continued

```
CATGGTCGAGTCTGCTGCCATCCGTGATATCTCCGATGCCTCTGTCTTCGCCGAGTACACTGTCCCCAAGATGTACCTG
AAGCTGCAGTACTGCGTCTCTTGCGCTATCCACGGCAAGATTGTCCGTGTCCGATCTCGCGTTGGCCGCCGTAACAGGG
CTCCCCCCCCTCGTGTCCGCTACAACAAGGACGGGAAGAAGATCACCCCTACCGCTGCCCCCAAGGTTTAAAAAATGGG
TATGACGGGAATGGGTTGGACGGAGTCTGGTTTACTTTAACGCCTTCATGTAATTTGCTTAGATGAATACCCAGGACAA
AGAGAATCCTGGAGCCTAAATGAATCGGACTTTTTTTCTTG

> SEQ ID NO:781 215676 Trichoderma harzianum
GGAAAGCGTTTGCACATCGGTCAAAATGTCTGAGAAGCCTCAAAAGGTCCTGGGCATGCCGCCCTTCATGGCGGACTTT
CTCATGGGTGGTGTCTCCGCCGCTGTCTCCAAGACTGCTGCCGCCCCCATTGAGCGTGTCAAGCTCCTCATCCAGAACC
AGGATGAGATGATCAAGAACGGCCGTCTCGACCGCCGCTACGCCGGTATTGGTGACTGCTTCAAGCGTACCGCCGCCGA
CGAGGGTGTCTTGTCCCTGTGGCGTGGTAACACTGCCAACGTTATCCGATACTTCCCTACCCAGGCCCTGAACTTTGCT
TTCCGTGACAAGTTCAAGAAGATGTTCGGTTTCAAGAAGGAGCGTGATGGCTACGGCATGTGGATGCTCGGTAACCTGG
CCTCCGGTGGTGCTGCTGGTGCCACTTCTATGCTTTTCGTCTACTCCCTGGATTATGCCCGTACCCGTCTTGCCAACGA
TGCCAAGTCCGCCAAGAAGGGCGGTGAGCGCCAGTTCAACGGTCTTGTTGACGTCTACCGCAAGACCCTCGCCTCTGAC
GGTA > SEQ ID NO:782 215678 Trichoderma harzianum
AGCAAACAACAATACAATCCATAGAGGATTACCTCTCAACTCAACCACCTTTACGACAATCGCAACTCAATAAGATTCT
TTCAGTGTATTATCACTCAAGATTTGAATTTCGATTCGACCAAGAAAACTCCAATCAAATTTATTACACCATATAATAT
TTTCAACTTCAAACATTTTTCTCAATATGTCTGCTGCTACCGTCACCCGCGCTGCTGCCAGCACTGTTCGCAAGCCTAT
TTCCTTCTACACTCAAGTCCGAAGAATGGGCCGTGTCTTTGAGAGCCACCCATACGAGAGATTTGCAACCACCATGAAG
CCTGCAAAGCCCGACTACTACAAGAACATTTCTTTCACTGCTGGCAAGGTTGTCACTTATTTCCCCATCATCGGCGCCA
TGCTTGGCTGGCCCGTCCTTTGCAAATGGGCTTTGGACGGACAGATCGGTCGCCTGGTAAGAGGTGATAGAGGCAATGG
TATAGAGTGGGACAGCAAAAAGATATAGAGATGTCCATCTTTCGACTGTATATATACACTTTGGGCGTTTGGATGGACT
ATGGG > SEQ ID NO:783 215679 Trichoderma harzianum
GCGCTCCGCCGTGCCCGCAGTCTCCATGCGGGGCGGGCCAGCGACAAGACCACCGATGGAGTCGTTCCCGCCAAGCGC
CAGCGCACAGATTGGGTTTCCCACAAGGACCTGGCCCGTTTAAAGAAGGTTGCCGATGGACATCACGAGAATACCGTTG
CCGTCAAAGACGCCACGTTTGACCTATGGGATGCCCCTGCGCCGGTGACCCAAGATCCTACAGATTTCCTGCCTGAAAA > SEQ ID NO:784 215680 Trichoderma harzianum
AAGCATTCTCCTCTCGTTCAGATCTCAAGAGAGGGAAGCACTCAAACCAATCACTCAACCTCTTCAAGACCACCTTTCA
AAACAAACCTTCAACATGAAGTTCACCGCCGTTGCCTTTGCCGCCCTCGCTACTCTGGCTACAGCCAGCCCTCACCCTC
CTCCTCCTCACGGTTGCAAGCCTGCTACCTACTCTTGCCTTCCCAACGACAGCGGTTGGCAAGTGTGCAGCACTGCCGG
TCAGTGGGTGTTTGCTGGCACCTGGCCTCCCAAGACTGTCTGCAAGTTCGACAGCCAAAATGGCAGCCCCTACTGGGTT
CCCCCCAACTTCACCATCCCATAAATCCATTAAATGGGGATCAACGGGGCTACTTACAAAAGCCTACCGGATGAGCATG
AGATTTAGAGTTTTTGGTTGCTAAGACGTTTCGTGGCCTGTCATTGTCTTGCAGATCAATCCTGGACATAAAGTTTACA
CATAACATATGGTACACTCCTTTG > SEQ ID NO:785 215685 Trichoderma harzianum
ATCACCAATTGCACCCGCCATGGCTTCACCAATGGCTGCCTCTCGCCATGTCCAGCGCGTGGCTACACAGATCCGTCT
GCGCTCAGCGCGGGTTCCCAGAGGCCAATTGACCTTCAATCGATGGGCATCGTCCGCTTCGGGCAGTCGGCGAGCTCCC
GCCAGCTTCGGAACTTCATCCTCGGCAGCCGTTTGGCTTGCAGCCGCCGCCATTGGCATCACGGCTCCCTTGGCCTACA
GCTTGACAACAGCAGAACCTGCAAAGCTCGACGTCACATCCCTTGCCGAAAAGGATGAGCAGAAGAAGAGAGAGGCGGT
TGTCACCGAAGAGTCGCCCATGCGCCTGCGGATGGAAAAGTTCATCAAGGAGCAGCAGCAAATAATTGTCAAGGAACTC
GAGCGCATCGACGGCAAGAAGTTTCGCAAAGACGAGTGGACGCGACCCAATGGCGGCGGCGGCATAACCTGTGTGCTGC
AGGAGGGCAACGTATTCGAAA > SEQ ID NO:786 215691 Trichoderma harzianum
AGAACCACAGAATTCATGGGCCGCCGCTATGCAGATGGGCACATCGAGCAGATCATGGGGCTTCATTTAGCGAAGCGAA
GCATCCTCGAGGCTTGGATTCGTCCAAGCCAAACTAGCGCAGATAGCAGGTATCACGATACCTTGTCTCTCATTTACTC
ATGACGAATTATCTTGTTGAGAAAAAAGAAAAGAAAAGAGTCGGCAACGCGCGTTTTGGCGAGCATGGCTTGTCGGGAT
CTTTTGTCGAATCTCGGCGGACGGTTGATACCCAGCATCAAGGGGGTTTGGGCGCGCATAGCGACGATTTTGGTTCTGT
```

FIG. 1 continued

```
GCCGTTTGCCATCTCATATCGAGCCTGGAGTTTTGGACGGCTGATATTTTTCACCCTCGTGGAATTTTCCTTTGTCGTC
TAGTTCACGCTGACAAGTTGTTTTTTCCTTGGTTTATTTTGTCTCCTTGCGCGCAAGTTGTTGCACCTCGAGCCGGCGT
TTTGG
```

> SEQ ID NO:787 215692 *Trichoderma harzianum*
```
CCCACGCGTCCGCTGTCTGGCTTACTCTGTTACTGAACTCATTGTTCTTTGAATTGAACCTTACGATATCAATTACAAC
CCATTGAGCTGCTGCACCACCAAGCTACCACACTTACATACAAACACACACACACACACAAATCACCACTACAATAACCAC
ACAAATCAACAACACCAAAACAACAACAACAACCGTCACAATGCCCGTCAACTACGTCTTCACAGAGTCCGCCCCCTCC
CAAAACAACTACATCAGATCCGGCCGCGGCGGCGCTGGCAACATTGTCCGCTCCTCAGCCCTCCCTCCCACATCATCAT
CCTCCGCCTCCTCCTCAGCCTCCCGCCAGCTCCCCAACCAGCGCTTCTTCTCTGGCATCGGCGGCGCCGGCAACGTCCA
CCAGGCCGACAAGCTCCAGCCCGCTCT
```

> SEQ ID NO:788 215716 *Trichoderma harzianum*
```
CAAAGAAACAAACCCTCGAGTCCACCGGCTTGTGGGAGACTTCCGCAAGGCCTTCGCCCTCGACCCCAATCGCTCCAAC
GGCGTCCCCCTGAACCTTTACTTCCGAAACCCGACGCCCGGAGCCTTGGACCCCCTCAGCTTCGACGACCCCGTCACTA
TTTTNNCTGGCTCCATTGCCGACAACGCCTACTGGAAGCGTGATGTCCGTCGCGCGTACCCGCAGCTCAGCGTCGTTAC
GCAGGGCGACGCCGTGTCGTTGTTGACGGTTGGAAGCGCCGCACAGCCCAAGGTCGAGCTGATTGGCGAGGCCGGCGAG
AAGGCTCTCGTTGCGGCGCAGAAGGAGGGCGAGACGACGGGCCTGGCCAAGTTCCTGGAGAAGGCGCCCAAGGATGTGG
CAAAGGACGTGTTCGTCAATGGATTGCCTCCGCTGCCGACGGACAGGCCCTGGAGGCTGGAGGATGGGATGTGCACAA
GTACGAGCTCAATGAGGATCAGACATATGGTGAAGGCTATCCTACCAGGACGTTCAAATAACACGGGCAATAGGGTCGA
CTTGTGTAAATACAGATAAGATGAAGAAAGATTAGAATTTCCCGAAAAAAA
```

> SEQ ID NO:789 215727 *Trichoderma harzianum*
```
CAAGCTGGGAGAATTGCGCCCACGCGGAAACCGAATATTGGGACAGGAAATAGACAGACTGAAGGGAATGGAGAAGAGA
GGATGAACATGTACAATTACTTGTATCAACGCCGTAATGCCACGACTTATTGCATGCTTTGAATCATTGGCACAAAAA
```

> SEQ ID NO:790 215729 *Trichoderma harzianum*
```
GGCGCGCCAAAAGACTGTACACAGACGTCTTTTGATATATTTTCAAAATGGGTGGCGGTGGAAAAATCCCTTACCCCAA
GCACGTCTGGTCGCCTTCTGGTGGTTGGTACGCCCAGCCTGCCAACTGGCGCGCCAACACGCTCATCGCCGGAGCCGCC
ATGTTCGGCGTCATCGCTATTACGTGGAAGTTCAGCGCCGACAGGGAACGATGGGCGCATAAGCCGGAGCCGTGGGAGT
GGCATCCTAGCCGATACTGGTCAAAGCAGTTGATCGAGTGGGACAAGGAGGACAAGCTGAAGGCAGCAAGCAACAGCAA
GGAGTAGAGTTTTCTTTTTGGGAGAAGGATAATAGACGAAATTGTAC
```

> SEQ ID NO:791 215730 *Trichoderma harzianum*
```
GGCAACAAGGATATCCGAAAGTTCTTGGACGGTCTGTACGTTTCCGAGAAGGGCAACGTTGTTGAGGAGGCTTAAATGT
ACCGGACAAGGATCTCTGTTTCTTTTGCGTTTCTGGGACTCCGGAGTGGCGAAGGTTCATCATTGCATGTCACGTAGCA
ACGGGGCTACTCTTTTACAAAAAATACATTAAAAAGTAAAGTG
```

> SEQ ID NO:792 215737 *Trichoderma harzianum*
```
GCTTTGTTGATAGTTTGGCCGCCACTCGTAATTCAATTGGGGCGAGCGAGTGAGTTGCGAGTGTTGGTTTACGAGCACT
ACTGGGACGTTCTCCTACCGATAAAAGAAAAGAAGAAAAAGATGGCTGAGGAAGCATCGTTTCGAGACGCAGTTGCGTC
TGTTCCCGGCCTCTCGGGTGCTTCCGAGTCGGTTGCCGCCGACCAGCAGCCCAAGAAGTTCCCCAAGGGAGTGGTTCTG
GGCAAGGATGGCAAACCATGTCGAAGCTGCACATCATTTGCTTCCTGGGCCGCGCAGACAAAAAAAGACGTCGCCACCG
GCAGCAGAGCAGTATCTACAACAGCAACAGCCGTCGCCTCGGGCCCTCCGGCCGACTGTCCGCCCGACGTCGAGACCCT
TGGCCGGAGCACCTGGACGCTCCTCCACTCCATCGCGGCATCGTACCCAGAATTGCCCTCGCAGGGACAAAAGTCGGAC
CTGCTGAGCTTCGTCGGGCTCTTCTCCAAGCTGTACCCGTGCTGGGTATGCGCTGAGGACTTCCAGGGCTACATGGCGC
GGCAGAAGCCGCAGGTGAACAGCCGAGACGAGTTTTCGCAGTGGCTGTGCCGGGCTCACAACGATGTCAACAGGAAG
```

> SEQ ID NO:793 215744 *Trichoderma harzianum*
```
CCTTCTTTCATTGTCACCCTCAAGGACGATGTGTCAGATGAACAGGTTGCCGCAGCCAAGCAGAATGCCAAGGATGCCG
GCGGCACGATCACACACGAGTACACCCTGATCAAGGGCTTTGCCGTTGTATGTATCCTGAGGGCATAGTTCACTCGCTC
GCTGAGGACCCCTCAGTGCAGGCCGTCGAGGAGGATAAGGATATGAGGACGCAGTTTTTTTTTTTCTCTATTCTGTTC
TTGTTGCATCTACATCTACATACATCTACATTAGAAAGACGTAATATAGAGATTGTATCAAC
```

FIG. 1 continued

> SEQ ID NO:794 215751 *Trichoderma harzianum*
GCCATGCTGTGAGTTGTCTCTCCTCTGTCTTGTATCCAACGAACCTGGTCCTGGAAGGCTGCAGCCTCACTGCCTCACG
TTCTCGTACGCCGCCAGCCAGTGCTAGCATCCGCATCTCCCGTGGCTCGTCGCGGTGCAGCAAGCCCCCGTCACTCCTT
GGTCACAGAGCGCCATCATCATGCCAGCGTCGTTGTCACCAAGCCCTCAGTCCTCTCAGTCATCCCTGATGGAGACCAT
TCCAGATGACAAGGGTCCTGATTTGACCCTGGATAAGCCTTTGCCCCAACGCCCCAGGACGCCCGCTAAGCTCTTGCGT
CTTGGGGTGCGGAATCGCCGCCACGAGTACCTGGTGAAAACTCGGTCGTATTTTGACAATCTGGAACATGAACTTGCTG
GTATGATATCGCATCTCATTTTTTTCAATCTCTCTCCTGTTGTCGGCTGATGGGTCATGTCGACCGATCCTGTAGCCTC
GAGAGAGACCTCATCATCCCTTTCCAAACTGACTTGACTGAAAACCAACATTGCGGTGTCGTG > SEQ ID NO:795 215772 *Trichoderma harzianum*
CCCACGCGTCCGGGGGGGGAATTGAACGGGGGTGAGGGCTTTATGAGAGAGGCGAGCTTTCGTACGAGCCTTCGGATCA
GATAAGATCAGGTCGGGCTGGTGACAGGCAGCCACGGCCCACCAGGGTCCGCCATAGGCGTACAACGACCCCGTAAGAT
CCCAGTAATGGCTCATTAATTGCTCCAGCTGTGGCTGGCATGATCATCGTCACATGGCCGGGTTTGGGCGACTAAAATT
AGCGGGCTGTGCCAGCAGGATGAGACCAAGACGGCAGAGGAGCACGGCCGAGAAGG > SEQ ID NO:796 215781 *Trichoderma harzianum*
ATGAGGCTATGTTTGCCCTACCTGCCATGGTCCAAGGCCCTCTCTTCTCCATGGCCACTGCCGCCGCCCGTGAGAACGA
GAAGACCAACGTCCGCGTTAACGAGGTGTATCTGATGTTCCGCGTTGAGGTTGATTAGGCTGCCAAGGAGCATGGCGTC
TCAAGCAGCTCCGAATTCGCCTCCGTCTACGAAGGAATTTTTTACAACCCTGAGATCCGCAGCTCGCGCGTTCGTGTTG
CCTCGCCTGCTGACTTCACCGACCTGAAGTGGGCTAAGAAGTTCTAAAAAGACTGATGCGTCTTTTTTAAACCTTCGTG
TTTCTCTCCATTAAGCATTTTGAGAAATCATCTCCCTGTTGCTGGCTGATTACACATGGTTCAGTAGTTGACAATACTG
TTAAAAAGAATGAAATGAAATAAATTGAAACAAAAAAAAA > SEQ ID NO:797 215803 *Trichoderma harzianum*
CGTATCTGCGGATGCCGGGGATGGACTCCGGTGTACTTGGCACGGCTCGCTTCCGTTTGACATAAAAATGCAGTGTAAC
AGGTAGATGGACGTACATGTAGATGTAAATGCGGTACT > SEQ ID NO:798 215806 *Trichoderma harzianum*
ATCAAAGAACAAACGCATCGTTCAAGATGAGAGCCAAATGGAGGAAGAAGCGCGTCGTCGCCTTAGCGCAGAGAAGAAA
GAT > SEQ ID NO:799 215807 *Trichoderma harzianum*
AAAAAGGCTCCAGGCATCGTCTTTGACAAGGAGGACTACACTGCTCGCTACAACTGGTCAATTCCGCTACGTTCATACG
CGGAAGAAAAAGAACATGTCGCTAACAGCAATCGCAACAACAATGCAGACGG > SEQ ID NO:800 215810 *Trichoderma harzianum*
GCGGCGTCTCCTACAAGAAATCGTTCGTTTCCCTCTGTCATTGCGAGCCTGTTGAGCAACACAACAAAAGGCGTCAAC
ACACAAAGATCCAATCGCCAGATCTAAAGCCTCTGTGCTACTCAGTCCAACAATTGCACAAAGCGACACAACATACCG > SEQ ID NO:801 215813 *Trichoderma harzianum*
ATCCTAAGGTCGAAGTCGACACGCGTGTTTGGAGTAGTTGCTGAATGCTATGGTTGGTTTATATCAATATGATGAGTT
TCAGATTAGTTCACAAAGGTTCTTTATGGCTCTTTTAAGGATGGGAAGCCGCAGAGAGTCGTGATCCTTTCAAAACCCA
AGGCGTCGCACGTCCGACGCTGTGTCTGAGCAAACATTGTTCACCCTTCAAGTTTCCACTACAACCTCGACCGGTACCA
CCATGAGCGGCATAGAAAAGCGCATGTGGCTTGGACACCTCAACAAGGACCTGGGGCCCATTCCGAGGCCAGAAATCCC
ATTCGCCCTCGTCTGGCTTGTTTAACGCCTTGCAGGGGGGGAGAGGGGAAGCTGAGCATGGGAGAGGGAGACGGAAAG
AAAAAAAAAGCAAACATATTTGATCATCATGC > SEQ ID NO:802 215817 *Trichoderma harzianum*
GCTGCCCAGGCATTCCTCTGGGTCAGCAGCTGACATCTGCCGTATCATCGCTCGTATCAGTTCGTCTCAACATGGCGCC
CCTGGCTCAGGCTGTGACTGTGTCTCTCAAGGACCTGCAGAATGGAGACGTCTCCTTCGAGACTCTGCAGAAAGCCTTT
GGCCCTGATTCCCTCGGTATCCTAGTGGTCAAGGACGTTCCACAAGAGTTCGCCCAGCTGCGCCATGTCGCCCTATCAT
ATGGATCCTATTTGGGAAACCTGCCCAAAGAGGAACTGGACAGGTTGGAAAACGCCAAAGCAAAGTATCTCACCGGCTG
GTCGCTGGGCAAGGAGACTCTCAAGAATGGCCAGGCCGACACCTTCAAGGGATCCTACTACGCCAACTGCGCCTTTTAC

FIG. 1 continued

GTGAATCCCACCCTAGAATGCGCTGAGCCCACGGCCGAGTTCTCGCCAGAGACGTTCCCAGAATACCTGTCGGCAAACG
TCTGGCCCGCCGAGAATGTGCTTCCCGGCA

> SEQ ID NO:803 215823 Trichoderma harzianum
AGCAATCATGAATAATGACCAATTCCGAAAGTTGATGCTGGCCAAGTCGGGCAAAGCGTCAAAAGATGGCGCTTCATCC
AAAGGCACGAGCTCCGGTGCGAACACGGGCTCCTTGGGATCTCGGCAGCGGAGCAGCATACCTATGACTCCGCGATCTT
TGGGAGGTGCCCAGGCCGATTTCGCGAGACAGCTGGCTGAGCGCAACCAAGCTCTAAACCCTCCAAAGAAGTTTAAGAC
ATCTGTACCAAAGGGTGTGAAACTAGGGGAAGGATACATCGATAGATCGCAAGTTCGAGAGAGCGAAGAGGACGACCGA
GAAGAGAGACTAAAGGCGTTGGAAAAAGCTTTCAAAGACGAAGAAATTGACGAGGCAACATACGAAAAGCTACGGTTTC
AGATTGCAGGCGGAGATCTGGCAAGCACTCATCTAGTCAAAGGGCTTGATTTTAAACTCCTCGAAAGGATACGAAAAGG
AGAGGATGTCTACGGAAATAAGGGAGTAGAAAAGGATAGCGCCGAAGAAGCACCCATAGAGGACGACGTGGATGACGAA
TTCGATCGACTCGAAGAACAAGACGTACAAGCCATTACGA > SEQ ID NO:804 215825 Trichoderma harzianum
GTAGCATTAGCTGGAATTTTGTTCATGCATCTGGCCCAGCAACAAGGTGAGAAGAGAAAGACACGATACGGATTTGCAA
GTCGGTCTTCGAGATCTACTCTGCTAGGAGACAACATCTTGCTCGGCTTTTAGAATTCTGACATGTCTTGCCGTGGTGA
AACGCTCATCCTCCAGGTTAGGTGCTAGACAATAAACCTCGACGGGATCTTCGAGTCATGATGACGCACGGCAAGGCCT
CCGACCTTCCTATCGAAACCTGGAAGCCTGGTCTTCTTTTGATACGAGCAAGATGTACTGTACATCGTAATCAATATAG
CTGGCAGAGTATGGACCTGGAAAGATTGGCGATGCCTCCAGACTCCAGATCGAATAACCAAATTCTTCGTCAGAAGTTG
CCACAGCTGCACGGTCCCTCGCGCCCTCTAATCAAGAGAGTCAGCTACTCAACTCAGATAGGGCAACATATCCCAATAA
ACCTCTGCAATAGGCAGGAGGAGATGCGTAATATACTAATAATGGAAC > SEQ ID NO:805 215827 Trichoderma harzianum
GGCGTGGGAATATGTGCCCCTCGGACCGTTCAACGGAAAGAACTTTGGCTCAACTATCAGCCCTTGGGTTGTTGTCGCG
GATGCGCTGGAGCCCTTCCGAGCCCAGCCGCTGCCGAATGATACCCCTGTTCAGGATTATCTCAAGGAGTCACAGAAGG
AGAGCGTGTTTGACATTCAGCTTGAAGTCGGCCTTACAACTGCGGATGGCGACCATGTCGACCTGTCCAAGACAAGCGG
CCGAAATCTGCTCTGGTCCTTCCCGCAGATGATAACGCACCATACCGTTGGCGGATGTCCTCTCAGGGCCGGAGATTTG
TTGGGCTCGGGAACCATTAGCGGCTCAGAGCCTCGGGAACGTGGTAGCTTGCTTGAAATGACCGAGGGCGGCAAGGTCG
ATGTTCAGCTCGAAAAGGGCGGGGTGCGTCGCTTCATCCAAGACGGTGACAGCCTGAACATGCGAGGATACTGCGAGAA
GAACGGAGTGCGGATCGGGTTTGGCGACTGTGAGGGCACGATTCTGCCTGCTCACGGGGCGTAAAATTTGGGAGGGGAC
AACGGCATAATGAGAAATGTAACCAAAATATCCATTAGATGAAATCAAAAACAGAAGCCAAGAGCTCT > SEQ ID NO:806 215830 Trichoderma harzianum
GGAACCGCCCGGAGGTTGTTGCAAGATGCCGCCGCCCAGCAGCGTCACTATCTCCTGACCATGCGGCCACTTTTTGTTT
TATTTCCCGAGAGAGCAAAAGTCGTCCCATCCAT > SEQ ID NO:807 215852 Trichoderma harzianum
GGCTAATACATGGCTCTTTCCCGCTCAGATACGTTTACAGTAGCAGGTACTGCCTACCAGGACTTTACTTGCTTTTGGC
AACTTGGGTAGGCCACGGCTGTCATGAAGGCGCATCTAATCCGTACATT > SEQ ID NO:808 215859 Trichoderma harzianum
GATTGTCCTTCTTCCAGCTGCCAAAATGTTGAATCCGCTCAAGGCCAACTCGCGCGTCCTTCGCAGGGCCTCCATCCGG
AGACTGGCTCAGCCGTCCGTCTCCGTCATCTCCAATCCCATCCGGAGCGCGGGAAGCCTCTCGCAACGGCCCAATTCGG
GATTTGTGTCGTTCCCCGGCGCTCTCAAGAGCTCCTTCACCAGCTCTCTCAAGTTTGAGACGCCCGAATCATACACAGC
CCTGCCGACGTACAGAGTCGTGGACCAGAATGGCCAAGTGGTTGACCCCTCCTTCACCCCTGACATCAGCGATGAGGCC
GTCATCAAGCTGTACAAGGATATGCTGTACATCTCCATCATGGATCTCATCATGTTTGATGCTCAGAGACAGGGCCGAC
TAAGCTTTTACATGGTAAGCGCTGGCGAGGAAGCCGTGAGCGTTGGCACCTCGAGTGTGCTGGACAAGGATGATCCCGT
CTTCTGCCAGTATCGAGAGCAGGGGCTGTTCAAG > SEQ ID NO:809 215863 Trichoderma harzianum
GCCCGGAACAAGGCCTTTTTGGTCATCGCTTCATTTCGCATATCGGCGCCATTCGTTCTTTCCACCTACTGACATACAA
ACGCACCTTATTTTCTTTCATTCTTACTCTTTTCGTCCAGCCATCCGCTCTCTTTGTCTTGGCCTCATCACCGGTAGCT
TCCTGACAGTAATTCGCCCGTCTAGCCTGCCGTCTTGCCCATCAAAAGACAAAGCGCCAGGAGGGGAGAACCCAGTAT
CGCGTCTACCAGCCCTGCGGCTTCGATTCGGCTCAACCATCCATCTATCTCGGCGGCGTCAAAGACAAGCTCCGACGAA

FIG. 1 continued

```
TCCAACTAACCAGAGCACCGAGTCTTTGCTCTGCGTCAACTTGAACTCAGCTCTCTCCTTCGTCTATCTTACGCTTCGA
GATATTCATCATGTATTCTTCAAGGCTTATTTCGGTACTGGTCGTGGTGGTGTCCATCCTCTGCATGGCCCAGGCCACT
TGGTGGGACAACCAAAAAGTTCACCACCGAGGATTGATTCGACGAGCGGATTCCATTTCCGAGGCTCTGAATGGCTTGA
CCGGCTCTTCAAGCCCGAGTAGTCCACCC

> SEQ ID NO:810   215864   Trichoderma harzianum
CCCACGCGTCCGCCCACGCGTCCGCGACCCACGCGTCGTACCCCGTCCGAAACGTTCTCACAATGGCGTCCCGCTTGGT
ACGAAGCGCTGTCGGCGCATCTCCCCTCCTCCGAACCACCATCTCACGATCCGTCCCGGCCATTTCTGCCGCCGCCGTG
CGATACTCGAGCAACGTGCCCGCCGAGGAGCCCAAGATTTATGCCCAGAGCATCATCGACGCCCTGCCCGGCAGCAGCC
TCATCAGCAAGACCGCCTTCCTCAGCGGTGCCGCCGGTCTCTCCGTCTACGCCCTCAGCAATGAGTACTACGTCATGAA
CGAGGAGACGGTCGTTGCCGTGTGCTTGCTGGCCGTCTGGACTGGTCTGCTCAAGTACGGCGGCCCTGCCTACAAGGAG
TGGGCCGAGGCTCAGAACGAGAAGATCAAGAACATCCTCAACAGCGCCCGCGCCGACCACACGGAGGCCGTCAAGACCC
GCATTGAGGACGTCAAGCAGATGAGCGGCGTTGTCGACATCACCAAGGCCCTCTTTGAGGTCTCCAAGGAGACTGCC > SEQ ID NO:811   215872   Trichoderma harzianum
GTTGTTTCTTTTGGTGGCGGGTTTACATTGATAAGTGACGGATATGCATCCCGAAAATGACAAATTTGTAAGCATGTCA
CTGCCGGCAAAGAACCCTGAATGCTCTAGATGCTTCCGAAGGATTCTCCATAAGATGATATCCCATGCAGTTTGTGCCA
AAATGGGTTAACGGACGCCCGATTCCGTGGGTGTGCATTTGATTGAGACCCCCATGTTTGCAGTGAATCGGTTGGGTAA
GATGCATTGGAGAGGATGTACGTAGGAGGTTCATTTATTGCTGCTCTTATTTTCCATGTTAG > SEQ ID NO:812   215880   Trichoderma harzianum
CATCGACAATGGCATCCCTGCTGCGCACGCTCTCTCTGGCCGCAGGGCTTTTGCGCTCTTCTCAGGTTGTCAAGCCGTT
TGCGGCTGGCAGCTTTGCGACGGCAACGAGCAGCCCGGCTTCCTCGTGGATGGTATGGTTGTCCAAGCCCGCAGTTGGA
GGGACCCTGCAGCAGACGCGGGGCATGAAGGTTC > SEQ ID NO:813   215885   Trichoderma harzianum
CACGCGGCGTAATTGACTACTATGTGGGCATTCAATAACTCAGTCACATGCCAAAGACCTCCCCATCCATTGCATCTCC
CTCAGTGAAGAACAAAGCAGTTAGTTGTTGGCACTTTGTTCACCCATCAACAAAAAATTTCTTGCTCCTTGAATTGAAA
GCCCTAAAGGGAAAAAAAAAATTCAACAGCCGCGCATATAGCTCGTGACTCGACCATTTTTTGAGCTAGTCATACGATA
AAGCTGGGGAACCAACAACGTGGGCAGATTTCCCCCCAGGACTCGGCCCACTTCCCCAGACTCCTCCAGACTCCTCCGC
AGAGTGGAAGATGCATGTTTCTTCCAGGTTCTGTGCCGAAATAAGCCTCTGGTATACTTAATGGCAGATGTCGAGCTCG
CACAATGCAGTAAAGTAATACCGAGCTCGCCAAAGCCCTCCAAAGCGGCATCATTGGGCGAACTCGGCTATATGTCTAC
GTGTTGGATAGAATAGAGTGACCAAGTCACGATCAATAGTACTTTTTACAATGCAAAAAAAAAAACA > SEQ ID NO:814   215888   Trichoderma harzianum
GATGGATTTGAGACACCAGGAAATGCAATGCACCTGTCTCTCGCTACTCTGCTGGTTAATTTCTGACTCTGGCGCTAAT
ACACAACGACGATGGCGATGCTTTTTCCATACCCCATAGACCCGCTAGTCCCATCTGACATTACTCGACGATCAGCACA
TGTCGACCATCATATCCGCGCATNTGGGCTGCTACGGNGATATTTAGATGCCAAGGGCGAGCCTAAATGTTGAGCTGGT
TGACCAACGCTGCTTGTGACCAACAAGGAGCATGAGTTGGCCTCGTCAGCATTGCTCCCGCCAGAAATCTTTTACAAAC
ACAATACTACAGTGTACCTCCTTGGGCTTGACTTTCTACTACTCGTACA > SEQ ID NO:815   215922   Trichoderma harzianum
ACCACGCGTCGAAGCAATATCATTGTTTGCTCAGGAGGCCAAAGCGAGCTTTTCGATTGATTGTCCTCTTTGTTCTTTG
TTACATTTCATATTTATTTGCGTCTTGGGGAGCCATTGCAATTGAATTGCTGCGCTCTGGGCATCGTACACACGCATTT
TTCTCGGCAATTCCGGCTTGAGCTGCACGGCATACGAAATTGCTGCCGGTGCGGACTCTTGCAGTCTCCGAGGCTCCGC
TATCTCCATCTCACCGGTGATTCCTTGTGCGAGGTTCGGCGAGAATTCCAGCAATTATTGTCACTCTTTGTCCTTTCAC
GAACGGAGCGAAATATATATAATCAGCTACGCTGGGTAA > SEQ ID NO:816   215926   Trichoderma harzianum
CGCGTCGCCCGCTCAGCATGGAGGATATGGACCACCTCAGCCTCAATACGGCGGCCACCAGAACCAATATCCTCCTCCC
GGCGGCCCTCCCCCGAGCCACTACGCACCTCCTGCGCACCATCCTCCTCCGGGTCTAGATGCTTACGGCTATCCTCTCA
ACCCTCCGACTGCCATGCACGCAAAGGCCGGCCCCCCGTCTCCCTCGGCCCCTCAGCAGTTTGGCCACGGTGCTCCGGG
CGGCTACACCTTCCAGTACTCCAACTGCACAGGGAAAGCGAAAGGCGCTGTTGATTGGAATCAACTATTTTGGCACAAAG
GCCGAGCTCAAGGGATGCATCAACGATGTCCACAACGTGTCGGCATTCTTGGTTGAGCGATATGGCTATAAGCGCGAGG
```

ACATGGTCATCCTGACAGATGACCAAAGCAACCCTGTCATGCGCCCAACCAAGGCCAACATCGTCCGTGCCATGGGATG
GCTTGTTAATGGCGCCCAGCCCAACGATGCCTTGTTCCTTCACTATTCTGGCCACGGCGGCCAGACCGAGGACAAGGAC
GGCGACGAAGACGACGGCTACGATGAAGTTATATACCCCGTTGACTTTGAACAAGCTGGACATCTTGTAGATGATGAGA
TCCACTTCCATGTTGTCAAGCCTCTGCAGCAGGGAGTGCGCCTCACAGCCATTTTCGAT

> SEQ ID NO:817 215929 Trichoderma harzianum
ACGCGTCGCTCTTCCGCCTTCTTGATGACTTTTGTGGACGCGCGCAGTATCTCCTTGATCTTGTGCACTGGCCGCAAAT
GGGGCTTGCCTCGTCGCCTGTCAGAAAAGGGGCACATGTCAGTCATTCCAATGACGTGTATAACGAGGGCGAGTGAATA
TTCTGATACTTAAGGGGTGTATAGGCAGCTATGGGGGTCTGACGAGATCCAGTGTTACTCACATTTTACTTTGCGCTGC
CTGCACGTATCGCTGTTAAGCAGAAGCCGACGGCAGAAGCGATTAGACACTGGCGTCGATAGTCTGAAAGACGAATCAT
TGCTTACCAGGCTGTGATACCACAAGGTCAGTAAGAGTAACAGCGGCAGGGTATGGAAGCAGGGGAGTCGATGCAAAGA
TAACATGTCCACACACACACGCACGCACGCACCGTTGCATGCGCGACAGTACGCATATCAGGATACATGTATGTACACA
CTCAGATGCATAGGAGCAAAGGAATGGGCCGAACCTAGCGTCCTGTTTGACCACCAAGCGCTTACCTGCTATATTCAAT
GCTCGAGGCATTGGCTCTCGATG > SEQ ID NO:818 215931 Trichoderma harzianum
AAATTAATCTATCGTGGTGATCAATTGGGAGCTTCATACCACCACTGAGCTCGTTCCGGCTTGCTCGGGCTTCTTCTTC
TCGCCAGGACGAGCCTTCTTGGCTGCTTTCGCCTGCTGAGAGCCTGCTGCTGGCAGACATAGCACCGCGTATGCCACCT
GGACAACGGCGACGACAGGCAGCGCGGATTGCAGCGTCATTTTCGGCTCTGCCACCAGGTCGTTGAATTGAGCGGCCAG
TAGCCCGAGCAGGACAGCTACTCGGCCGAAAGC > SEQ ID NO:819 215934 Trichoderma harzianum
GCTGGGTTGAGCCTTTTTGCGCATCTTGACCTATATTTACACCTTAGAACGACGCATATACATATTCCTAAACATTACG
CTTATGGCGGTTGATACCGAGGGGTCCGCCATCAACATTCCTGCTCCCGCAGCTGCCATGGGACTCACCCAAACGCCTG
GAAAAGGCGCTGCGAGCCACGATCTTCACCCGTCGGGCAAGCGGGCTCACGGCCGAGGAGTGCAGATACTTCGAGGCCT
GGCTCTCGCTGTGTACTTTTTAATCTGCTGTGTGACTATTGTCGCTTCGCAAGTTCTTGGGTGTTGGCTGTATTCGTG
AACCGCGAGATATACTACGATTACATGGCCTTGACCAAACGGTGGTTTGCCATAGTCGTAACTTGGATGACACAGATTT
GGGGCCCGGTAATCATCCGAATCAGCGGCGATGAGTCAGTCGCGGGAGAGATCCGTCCCACGGACGGTGGCGGAGTGCA
GTTCAACTTTCCTGAGCGGTTGGTGATGATAGCGAACCACCAGATTTATACCGACTGGTTGTACCTCTGGTGGGTT > SEQ ID NO:820 215935 Trichoderma harzianum
ATTCGTGTATATCCGAGGAATGCCATGCGGTTGTTTGGTGTTTGTTGCTGCTATGGAAGAGAGTCCACCAGAGCTGAA
AACTGCTTGCTCTCTTCCATTGCCATTACTACCACCACTACTGCTAATGCTTACGGGCTTGGCACGGTCAAGCATAACT
CCAAGCTTGGGCTCGGGAATAAAGT > SEQ ID NO:821 215938 Trichoderma harzianum
TTTGTCATGTTGTAATGCAGGATCACGATTAATCTTTTCTTCTTCTCTCAACACACGGCCATGCGGCGTGAGAGGGATG
ACTCAGACGATGAAGACATTCCGCTGCATCACAAACGCCCGTTTGGCGCTGGGCTGAAGCGCAAGAAAATTGAGTTTGT
CAAAGCCACAGACGCAGACGCAAGCAACACGATCAAGAATCTGGGCAAGGAAACCGCCTCTATCGGAGATGTCTACGCC
AGCATAGTCCTAGGCGGCAGCTCCAGGGATTCATCATCAAAACCTGAAGGCACCAGCCGATGAAAAGGACGACCAAAAGG
AGGACGCTGTTGAAAAGAGCCGGAACCTCCAATATGTCCCGTCTGCTCTCTTCCCATCACAACGACGCTGCAGCAACA
CGAGGCCTCGCTTGCCCATCAAGTCAGCCTGGAACACTCCCACCCTCCATCTGCACTAGATCGATCGCGCATGGGTTTG
AAAGCCCTGGAATCTCAGGGCTGGGATCCCGATTCCCGTCTTGGCCTGGGCCGAGAAGGCGAGGGCACCCGGTTCCCCA
TCAAGGTAGCCAGGAAAGAGGACACGCTGGGAATCGGGGCTACTCGTACGCAGCCAAAGCAGGCGGTCCAAGAGAAGCC
TCGGGCTCTGACTGGCAAGGAAATGCGCGCTCTGGCG > SEQ ID NO:822 215951 Trichoderma harzianum
GAGATTGCAGGCACCCTCAATTGGCATCACATCATGCTGGCGACAAGAGCACTCCGAGCGGCCCACGGGCCCAAGCCCA
ACATCACCGGCTTCAACATGCGAGCCCTCAAAGAGGCCACTGGCCAGCCCCGATACGACCCTTGGGAGAGAGCCGAGGC
ATGGCGATACAAGGGCACCTTTTCCAGATGGAACCGATT > SEQ ID NO:823 215952 Trichoderma harzianum
TTGATACCCTGTTTTGATATACAACTACTACATGTTGGGCAATGATGGCGCAAGATGGGATGGGATGGGACAAGGAGGA
CTTACAGCAGGGACTCAAAGGTATATCCATCTTACCTCCCTCGGGCACTTGAAGCATGAAGCTTTGTTTTGTTTTTGCA

FIG. 1 continued

```
ACACATCTTTGACCGCTTCTGCATGTGGTTCCATGTATAATTATCATTTCATTTGTTTGCACGAACTTGGGAGGGAATT
TTTCATTTGTATGGATCAAGATGTATGAGGCACGGGCATCTCATGACAAGATGGCTTGTTATGTAATATTATTTGATGT
CATACGACATGAAGCAAAATATTTTTTACAAAAAAATATTATAATGAAAATATCTAAAGATGT
```

> SEQ ID NO:824 215953 *Trichoderma harzianum*
```
CGGGGAGCTATGATGGGCTTCATGGCGTGGAAATTGGTTTGTTTTCTCTCATTCGTTGACTCTTTTCAATCAATATACA
CAAGCAGATGGGTATTGGTTAAAGAGGGCGAGCGAGAGATTCACTTCAACGCAAAGCCTTGAAGAGAGAACAACTACTA
TAGCAGTTACATCACCACGTCCAAACTATTTCGTGCATTATGAATCCTGCTTCTTGGGACGCGCTTGTGGCACCTCTTC
ATCAATGGGCATCAGTGCGTCTGCCGTGGCATCTGCGCGACATCGTCACGGCATAAACTGGCGCTACACCTCGTGTGTC
TTCCTCCAGGGTAGAGCCGGCCAGCTGCGTAGTTATGCAGAGGTAGCTTCTTGAGCCCATTGGCGGTCAGGTCACTTGT
CGCCCAATCCGAGCTCAGGAGGCACTTGCATGGAATTTATGCGGATGACGCTTGCAGAAGCGTTTGGAATACAGTATAG
GTGACTACCTCG
```

> SEQ ID NO:825 215961 *Trichoderma harzianum*
```
AACAACCACCACCACCACCACTCAACCTACAAACAACGTCACAATGGCCGCCAAGCTCTCCGCCGATCTCCTCTTCCAG
ATGGCCAAGGTCCGCCGCTCCATCTATCCCTTGAACAAGACTCTCCCCATCTCAACCTCTCGCATCCACGAGATCGTCA
AGGAGGCCACCCTCCACACTCCCTCCTCCTTTAACGTCCAGACCAACCGTGCCGTCGTCCTCTTCGGCGCCGAGCACGA
GAAGCTCTGGGACATCACCTCCGAGACCCTCAAGGCCATTGTCCCCGAGGACCAGTTCAAGTCCACCGCCGACAAGCTC
GCCCTCTTCAAGGGCGGCGCCGGCACCGTCCTCTTCTACGAGGACACCGACGCCACCAAGGCCCTCCAGGCCAAGTTCC
CCATCTACGCCGACCGCTTCCCTCCCTGGGCCGTTCAGTCCCTCGGCATGGAGCAGCTGCTCATTTGGACTGCCCTCGA
GGTTGAGGGCCTGGGCGCCAAACTCCAGCACTACAACCCCCTGATTGACCTCAAGGTTGCTG
```

> SEQ ID NO:826 215966 *Trichoderma harzianum*
```
GGGCGGACGCGTGGGCGAATAACCAGACGTCGACAAATTCCTCAAAATGCCTCCCAAGAAGGTCGCCGCTCCTAAGGAG
AACATCTCCCTGGGCCCCTCTGCCCGCGATGGCGAGCTCGTCTTCGGCGTTGCTCGTATCTTCGCCTCCTTCAACGACA
CCTTCGTCCACGTCACCGATCTGTCCGGCCGTGAAACCATCACCCGTGTCACCGGTGGAATGAAGGTCAAGGCTGACCG
TGACGAGTCCTCCCCCTACGCTGCCATGTTGGCTGCCCAGGACGTCGCCGCCCGCTGCAAGGAGCTCGGCATCAACGCT
CTGCACATCAAGATCCGTGCCACCGGTGGTAACGGCACCAAGACTCCTGGCCCCGGTGCCCAGTCTGCTCTCCGTGCCC
TGGCCCCGTGCTGGCATGAAGATTGGCCGCATTGAGGACGTTACTCCTACCCCTCCGACTCTACCCGCAGAAAGGGTGG
TCGCCCGTGGTCGTCGTCTGTAATTGCTGTATTTTTTTTATACAAACAAAAAAAGTACGGCATCTGCATGCTTGGCGAA
CCTTTGGTTTGGGATCAAGGCAGGAGTTTCGCTATCTGGTTCTTTTATGTGGCGTTGAGAAAAAACGAGCAGAACGGCC
CTTAAAGCCTGGT
```

> SEQ ID NO:827 215973 *Trichoderma harzianum*
```
AATCATTCATCCATCCTCCATCCCATCCCATCCCATCTTCCAAACCACATCATCAATCTCTAAGCGTTGCCCATTATGA
AGAGCGCTTTGATCGCCGCCGCGGCGCTTGTTGGCTCCGCCCAAGCTGGCGTCCACAAGATGAAGCTGCAGAAGGTCTC
CCTCGAGCAGCAGCTGGAGGGTTCAACCATCGAGTTCCAGGTCCAGCAGCTCGGCCAGAAGTACATGGGCATCCGCCCT
ACTAGCCGTGCCGATGTCATGTTCAATGACAAGGTGCCCAAGGTCCAGGGCGGTCACCCAGTGCCCGTCACCAACTTCA
TGAACGCCCAATACTTCTCCGAGATTACC
```

> SEQ ID NO:828 215980 *Trichoderma harzianum*
```
GAGAGGCGTTTGGTGATCTTGACATCATAGGAGCTGCTCTTCGTTGCGGCACCAGAACTTGCGCGCATCTTTGAACAGA
ATACTTCGTGGAGCAATTGCTACCCCATGGCTCGGGTGCATCGTGTCAGATACATTAATCACTCATAGCTGCAAGTACT
CTTTGCGCCGGGGGCAGTGTTTTGCCCATGAGCCGCGCAATGTCATCGGTCTTATGCCGGCATTCAATCGGAATACGAC
TCTGGATCCGTCGTGCCGGTCTCGATATCGAAGCTCGGGCAACACCAACAAGATGTAACGTAAAATAACAAGACGAAA
AACAAAAAAAAA
```

> SEQ ID NO:829 215981 *Trichoderma harzianum*
```
GCTTGTTCCCCCCCAAGGGAGTCGGCGCTTGCTGCATGGCAAGTCATGTCTTACGTCTCGCCATTGCAGCCGCCTTTCC
TGATGAAACCAGGGAATCGCCAGCCAGCCTAGCTTCAGATGGGGTTTGAAGTTCAGNTTTTTNTACTACTTGGGCGGTT
AAAAGGGCCTCGGGGATTGCTCGCAGCAAGGCCAGAGAGCGATGAGATGGGATGGAGAGAGAGAGAGGGCTGCCGAC
TACCGGTGCACTGCATGTTATCTGCCGTAACATATACATGTACCTACTTAGTTAAGATGTATCACGCACGCGACCATAG
TGGCTTTCG
```

FIG. 1 continued

> SEQ ID NO:830 215982 *Trichoderma harzianum*
TCAACCAGACTCAACTCAACTCGACTCACCAGGCTTCCATCTCCTCGCTACTCAAAAAGGCTCAGCCTTACCACTTCCT
CCTCCTCCAACCTCATGGCATAAACGACACACCTCTCTCTCTCCGATTGGTGATGGCAAAGGCGACAACGCCGCCTCCG
AGCTACGAGGCCGTGTCCGCCGCTCCTCCTCACCCTCCTCATCCTTCACATCCTCCTCACCCTCCTCCGCCTCCCATCT
CCGTCGCGACGCCGGGCCTGTCTAAGCGCCGTCCCGCCTCGTCTCCCTCGTCCCCGACTTCGTCCAGATCATCGTCGTC
CAACCCCTGGTCATCGCCCACCAAGTCTTGGTCATCGTCGTCATGTCCGCCTCCGCCCGCGCCTGTCCTGCGACGTAAC
GTCTCGTCTTCTAGCCTCTCGTCCGGACGGCCTTCGGAACTGACGCCTCTGACCACCAATGGTCCCCTAACCTCGACCT
CATCCTCCTCTACTGCTCGCATGCGCT > SEQ ID NO:831 215995 *Trichoderma harzianum*
GAGCCATTCCTGCGCAATCCTGTAGCTGCCCTCACGCACATCCCCCGGCACGGTGTGGCCCGCGCCGTCCACGGCCACA
AACGCCAGCCGGCCGGAGCTCTTCCACGACCCCGTCGCCGCCATGCTCTCCGGCAGCTCCCGCCACGGCGCGAGGCGAT
AGTCGGCCAGCCCGCTCCAGCGCAGGTTCTCGTACGCCCAGATGTTGCCCGGCGTGTTGACGATGTAGTCCTCGTTGCC
CTGCAGGACCAGCACGCGGATGTCGCCCAGGTTGGGGGTTCGGTAGGCGTCGAGGATGCGGGCGACCTCGCGGGTGGTG
GTCCGGAAGGGATCTTTGGAGTGGACGAAGGCGGAGTTGAGGACCATGTCGATGTCTTCGAATATATAATATGGGGGAA
GCTTCAGGNCTTTCTTGATGTGGGCTTGGTTGATGTAGGCTGACATGTTGCCTTTCCTGATGTCTGCGCAGAAGGGCCA
GTTGGGGACATGGAATATGGACTGTTTTGCAAATATTAGACAACTACGTTCAGA > SEQ ID NO:832 216004 *Trichoderma harzianum*
GACAGAAGCAGTTAACTACTTATACAGCTACTATATAAGCTTTCCAACCAACCCCTCACCTGTCGCCTCAACCTCATAC
GACTCATCATCCTATTCCTCCTTCAACAATTTCAATTCATTTCACAACTCTCAGTCAAGATGCAACTCTTCGCCGTCTT
TGCCGCTGCCACTACACTTATTGCCGGCTCCAACGCCCTCTTCATCCCCCGCAACATCCACGTCGCAGACTTCCGCCTC
TACAGCGCCGAGGGCTGCCACGACGGCAACCTCGGCGTCTGGACCGTCATTGATGACGACTTCAAGAATGGCGAATGCA
AGGGCCTCAACGATAGTGAGCCCAAGTCTCTGAGCCTGACAGACATTAACAAGGGCTGCACATTCACGGCTTACACCGA
CGACAAGTGCACCAAGGGCAAGAAGGATTTCACAAAGGGACATTGCTTCGACAACAAGGCCGGCTGGAAAGCCTGGAGC
ATGAAGTGCGACTACAAGGACTAAAAGGGTCCTCCCTACCTTCTTTTTTTCCTCACCGCAACTTTGCCAGCACCATTT
ATTTTCATCACTTTTTTTTCCATTCCTTACATCATGGTGGAGTTTCACGTTTTTTTGAATCAGGATTACACTGGACTGA
TTTGTGGGAACCGGGACATGAACACAACAAGCATATTGATTGACACGGAACGCATTATGGGGTTATCGG > SEQ ID NO:833 216005 *Trichoderma harzianum*
ACTCACAATATTGGTTTAGCATTTCAAAACCGGCATCATGGCGGACGCAGATTTCAATCCTGACTCTGTCAACCTCACA
GCTATTGTTGATCAAGATGGAGACATCAGAGACATCATCTGCTTTCTCAATGCTGGCGACAACGACTACAATGGACAGC
TTGGTGCACGTGTTTCGGCTCTATTCGTCATCCTTGTCATTTCATCGGCAGCCACCCTGTTCCCCGTCCTGGCCACTCG
TGTCCGGCGTCTACGAATCCCGCTCTATGTCTATCTCTTTGCCCGATACTTTGGCTCCGGAGTCATCATTGCTACTGCC
TTCATCCATCTCCTCGACCCTGCCTATGAGGAGATTGGACCGGCTAGCTGCGTCGGCTTGACTAGTGGCTGGGCTGAAT
ACACATGGCCCCCTGCACTGGCTCTGACTTCGGCCATGCTCATCTTCCTGCTGGATTTCTTGGCCGAGTACTACGTCGA
GAGGAAGTACAAGCTGGCACATGTCGAAGTCGAAGGCACAATTACATCGGATCCTACTGTCCCTCATACTCATCAAGGA
CTTCACTCGGCTGACCAGGATGGTGCAATTCCCCCTTTCAACCAGAAGCCTGAAGAGCACAGCCACGCTTCTAGCGATA
AGCTCGCTTCAAGCGATAATCTCGATGTGGAA > SEQ ID NO:834 216006 *Trichoderma harzianum*
ACCACTCTCAAGCAACAATAACAACCTTTACCCAACTTCAAAGACTTTCAGTCTCTCAACTCAACACCTTCAAGATGTC
TCCCTGGTGAGTCTTCTGAGGACCATTGGTCCATCACTTGCTCGGGAGTTCCTCTTTGCTTTACCTTCAGCGTTCCACT
ACCTGATCTATGATACCTTCTTTCCCACCACCGAGCAAAGCACTCATTAGACATGTCACTAACGATTTTCTTTCAATAG
CGCATGCAACTCCTGTGGATGCAAGGACAACTGCTCCAGCTGCTCCACCAGCTGCAGCGTAAGTCCTGCTTCTCTC
CCCTGCTTTGGGCATTGAGAAACTTTTCCACCAGAAAGCTAACAGATGGGAACATATAGCACTAAATCATCGTGCTCTT
TTTCCTTCGCTGGATCTATACTCTCTCGGAATGACAGCTTGAGGGCTCGGATGTGCTTAAGACGCCATGGGAAGGGCAA
GGCATTTGGGCGAATAGACCTCCATCATGTGGGATATAGCAGAATAGGAATTTGAAGATTTTGCCCTAAC > SEQ ID NO:835 216008 *Trichoderma harzianum*
GCACGGAGCACCACCATGGCTTCAAGGTTGAAGATCTGGGGTGCCTGCAGGACTCTGGCGGTCCGGACGCAGCCCGTCC
GCCTTGCGGCTCAGCCATTCCGAAACCAGGTTTCAGCGACTCGATTCTATGCCGTCGATGCGACCAACAAACCCTCCAA
TTCTCCGAGCGGTGCAAAGAGAGAAGCTTCTAGATCATTTCTAAATCAGAACCAACAAGTTCCAGGGTTACTGAGGGC
ACCTCTGGAGAATTGACCCAGAAAGCCGCACAAGAGACATCTTCATCACAAGCCTCACCCATTGAAGCGCTAGACGATG

FIG. 1 continued

CGACCTTGGAACAAATACTATATGGCGGTCGACCCGTAACAAGTCAGCGGGAGGGCGGCTTGACAGAGGCGCAAGAGGA
GGCTCTATATCGCGAGGGTGTCATTCCCCCACCAGAGCAGGCGGAAGCTATCGTTGCTGCCGGGTCACAGTCAATAGTC
CCTGTTGGCTCAGAAGTGCAAAACGCCGGCCATAAGTTTGGTCTTCCTCAGAAGCCCTATCCGGACGGGTTCCATGTCA
AGAAGCGATACCACCCCGTGCTGGAGCAAATCACTAGGCTCCTGATGCGACATGGAGAACTCAGTGTTGCGCAAAGAAA
CATGGCTGCTGTCATGAACTTCTTACGAACGTCGCCCGCCCCTATCTACAGCCCGAAATTCCCCCTATTAC

> SEQ ID NO:836 216009 Trichoderma harzianum
GCACTCACCCCTCCAACCCCTCCAAAGATCTCACCACCGGCCGAACCCTCCTCGATCTCTGCGCCGAGAATCAGCTCCT
CCTCTCCGAATCCGTCGCTTCCAAATATGGCTCCAAGCTGCCCTTCCTCTTCAAGGTCCTGTCCATCAACAAGGCCCTC
TCCATCCAGGCCCATCCCAACAAGAAGCTCGCCGAGCAGCTCCACGCGCGGGACTCCAAAAACTACCCCGATGACAACC
ACAAGCCCGAGATGGCCATTGCAATCACCCCCTTTGAGGGACTCTGCGGATTCAGGCCTCTGGGAGAGATTGCCCACTT
CCTGGAGACGGTAAAGCCATTGAGAACTCTGGTCGGAGAGAGCGAGGCGTCGCAGTTTGTGCAGGCTGCCAAGCAAGAG
GGCGGTGACGAGGCGGCAAAGAAGAAGGCCCTGCAGACGGCATTCGGAGGATTGATGTCGTCCTCTGCCGAAGACGTTG
ACAGAGAAACTGCTAGCCTCGTTGCACTCGCCGAGTCTGAGGGCGCCGACTTCGCTGCCGGTGGTGTGTCATCCACCAA
GGGCGCTGTCCTCGCCGAGCTTGTCACTCGACTCAACGGCCAGTTTGGCTCCGACATTGGCATTTTCGTCCTCTTCTTC
CTCAACTTTGTCACACTACAGCCCGGAGAGGCGCTGTTCCTCGTCGCCGATG > SEQ ID NO:837 216010 Trichoderma harzianum
GACCATTACTCGCATTTGCGTCCAGAGATTGGAGTTTGATAATTTTTACAAACTTGTACATAATACTGATGCATTCAGC
CCTTGGTCCTGATGGCATGAGCAGACATAGCCTCGGCCGACGATTTTGCCCCTGCAATGGTTCTCTGCCGATGTTTCCC
GCAGCTTCTTGGCAGTTGGGGTAATACGATAATACGACGATGGCATCTTTGGCCTGCACGCCGAATTGGGGTCAAATAG
ACGGTATTCCGAACATTTCATATTTAAGAAGCTGTGCTGCACGCCAACCAACCTTTGGAATGGTGTGAATTGTGAAGGA
CATGATGCATGGTATAGGCCATGAGCTAGTCTCAGAGAGATGGAGCCTCCGGTGTAAAAGTTGTACATTAATACGATCA
AAGCCCGCTACGAAAAAAGAATGGCAATTGTATTACCCACG > SEQ ID NO:838 216013 Trichoderma harzianum
GCTGCATGTCTTGGACCTGCCTCTCATCATCTCATCTCCCTCTTGTTTGAAGAAGAGAGATCTTGTCTCTTCCCACCTC
TCACAGTTTGAAGCTGTGCATTGTTCAACAGCAACAGAAACATCATGTCAGACGACGGCCACGAAAAGGCGAAACTCGA
GTCTCACATAGACTTTGTTTCCACCGCGCCAGACTCACAAGATGTCAACGCCTTCATCGATGACATGGAGGGCCAGCTC
GAGGCTTCTGGAGGTCTCAAGACGGGCTTCTTCCATGTGCAGTTCAGCGACCCGCGGCACTTTACATGGCTGCTCGTCG
CCTTTGCCAGCATGGGCGGCCTGCTGTCTGGCCTGGACCAGAGCTTGATCTCTGGCGCCAATCTGTTCTTGCCCAAAGA
CTTGGACTTGACGGAGAGGCAGAACAGTTTGGTGAATTCGGGTATGCCGTTGGGTGCTGTGGGAGGCGCCTTGTTGCTG
TCGCCTGCGAATGAGTACTGTGGACGCAAGTGGGCGATTATCATCTCCATCCTGCTGTATACTGTTGGTGCTGCGCTGG
AAGCTGGCTCCATCAGCTTTGGTATGATTGTTTCTGGTCGTGTCATTCTGGGTCTTGGTGTCGGCCTCGAGGGCGGCAC
TGTCCCCGTCTATGTCGCCGAGACTGTCGAGCGCCGTATCCGAGGCAACCTCGTCTCGCTCTACCAGT > SEQ ID NO:839 216018 Trichoderma harzianum
GCTTGTCGCCAATAACCCACACAACGCGGCAAGATGCGTACCTACGAAGACAGCTTCTCCGGTCAGAGGATCTACCCTG
GAAAGGGTAAGATCTATGTCCGTGGCGACAGCAAGGTGTTCCGATTCGTCAACGGCAAGTCGGAGTCACTGTTCCTGCA
GCGAAAGAACCCCCGTCGCATTGCCTGGACGGTTCTGTACCGACGACAGCACCGCAAGGGTATCTCTGAGGAGGTTGCC
AAGAAGCGCACTCGCCGTGCCGTCAAGGCCCAGCGTGCCATCGTTGGTGCTTCCCTCGATGTCATCAAGGAGCGCCGAT
CCATGCGCCCCGAGGCCCGATCTGCCGCTCGCGCCGAGGCCATCCGACAGGACAAGGAGAAGAAGGCTGCTGCTCAGGC
CGTCAAGAAGGCTGAGAAGGCTAAGAACGCCGCCATCGCCGCCAAGGGCCAGGCCAAGGCAAATGTCAGCAAGCAGGGC
GCAAAGGGCGCACAGGTCAAGGTCGCCGCCCGAACCCGCTAAAAATATGAATAGACGGGATTGAGGGGAGCGAGGGGAG
AAAGATGTTGTGTGCAGTGCAGCGCAGCGGATGAGCAAAATGACACAAAGTATGGAGTCTGTGGTTCTTGTCTCTTTCC
GGCCGGTTCTTCT > SEQ ID NO:840 216020 Trichoderma harzianum
TTGCATGTTGCATTTGTCTTTGCTGTTTTTTCTCGGGTTCGGGACGAGAACGAAAAAGAAAAAAAAAGTTGCGCCAGAC
GGGATGAAAGGCGAGACAAGGGGCTGGCTTGGGCTTTGGGCATGCACTGGGACTTTGGGCTGAAGGTTGACCGAACCGA
GTTGCTCAAACTGCGACATCGGTGCTGTATCAGGCTGCTATCTATGTATCCTCGTACAAGGCAAATGCACACACGGCTG
ATCTGAGATTACGGGGGGGAAGAAACGCACTCAGTGGCCAATATGGTGGTTCGCACACCCAGCGTTTGCTCTCCTATGT
CGTTTGTATGGCGGGTATGCTCATGCTTGGGCTGAGGTGATGCGCGTCTGATTCCGGCTAGCATACCGAACCCACTAGG
TAGCGAGTTGATAGC

FIG. 1 continued

> SEQ ID NO:841 216036 *Trichoderma harzianum*
GCGCATCATTATGCCGGCATGGGCCCGGGGTCTGACCCTCACCATTTCCGAGACCAGAGCGTGCCGCATTTCGACAAGG
CGGGCCATACGCGGACGCACGAGCGGGAGGATCACCGGCGGTGGCAGCGGCAGAGAAGGGCTGTGGGGATGATGGCAT
AGAGTTTGAGCCGCAGACGAG > SEQ ID NO:842 216040 *Trichoderma harzianum*
ATGACCCCTACCAGGATGTCGAATTACACAACTTGAACGAGGGGACGAGCCAAGGTGGCACAGCACGGGAATTGATTCG
AGAGTTTTTAAATGATACCCATCTCCCAGCGAGGAGATTGCACTTAGAAAACGTGGCGGAGGCCCTCGAAGGAGAAAAT
GGTCTTTGTTTTGTTCTTCATCTTCTGCCTTGTCGAAGGGTCATGTATATGTCAGGAATAGCTGTGCACTAATATTTAA
ACATAAGTTCCGTCT > SEQ ID NO:843 216042 *Trichoderma harzianum*
CGGCGTACGAGTAGCAAAAGCGTACGGTCCATCTGGGTCCGGTTGGTAGGATTGGAACGAGAAAGAGGGGAATGGGATT
CGAGAACGTGGAACTTGCTTGTGCCCTGGCAGTCTTCGGGT > SEQ ID NO:844 216043 *Trichoderma harzianum*
ATCAATGGAACATGAAGTTGGATGTGCGCAGTACTGTAGCATCACATAGACTAGAAGCTACATGGAAATGCGACACAGT
GTTGCACATCCG > SEQ ID NO:845 216049 *Trichoderma harzianum*
ACGTCCGGATGAGGAGGGGGGGTGTTTGTGTTGCGATAGGTAACTTAGTACGAGTAGATTCAAGATGGAGGGGGGGAAT
GAATCTTGCTTGCTTGACTGCAGTCTGTAGTGTAATCAGGCAAATAAGGCAAATGAATACCTGC > SEQ ID NO:846 216050 *Trichoderma harzianum*
GATACAGTACAGAAATGCTGCAGTCGTACGAGAGCCATGGGTGCTCCGTCGAGCGCCTCTAGCTTGACGCCAGAAGGAT
CGAGGCTGATTGACGATGGAGCCCTGGCCCGCTTTTGGTCCTGTGCGCGACAGATGCTGGGATGAGGAGAATCGTGATG
ACGAATATGTATTGATATCATATCGTGAGAGAGACATGGTTGGGGCTTACTGGTCTCTGTACGAGTACGATGCTGTACG
TTCGTGTTGAATTATCTTGTACTGTATCGTGTTTTGTCGATCTGGGTGGTCAGTCT > SEQ ID NO:847 216053 *Trichoderma harzianum*
TCCGGGCATGATGATTGTTGAACAGGTACGGAGGTTGGGAGACAGGAGACTAACACACCTTATTGTGCAAACTGTACAG
CACAGCAGAAAGTGGTTACATCGCCAGAATAAGCTTGTGATTATGGCCTCACCTTTTCCACAGCCCGCAGGTGACAGGC
CACATGCAATCTTGGCATACTGTTCCTCTCTCTACAACAGCTGAACTCAGCCCAGTCGCCAAGGTTTCCTTCACGCT
GGCTTTCACTCTTATCATGGAGCATTGACGAGAGCCGGCACCAACGAGCATACCAAGGTGAAAAAAAGTTCTCCACAAC
ACTCCGTCCAATGTCCACCTTACATCCTACAGTACGCAAGGGCCCCGTAAGGCTATTCAGCTTCAAGCACAATCAAGCC
ATCCAGGCAAGCCGACAAAAGCCGTCGGCCGAATCTCTCCTCGTATCGTCCTAAAAAGGGCGCGCGTGAGCCGCTTTGA
CCACAAGCCTTCACGTATCAAACTTGCGCATGGTGTACGAGGGAGAAGAAAAAAAAACGGTCCTCAGCCACTGAGATCC
CGT > SEQ ID NO:848 216055 *Trichoderma harzianum*
AGCGTACGGCTGGCGGCAAGTAATACTGTAGCAGGTACCTCGTGGAGCTCCATCGGGATGGGGCCGGTTGGGAGTCGGT
TGGGCACAAACAAGGTTTCTAACTGGATCTATTTCTTTCCATGTGTCTTTTAATCATTTTGAATTTTATTTTCCCCGGA
GGCCGTGACACGTTTTTGACAGATGGGAGGAAGAGGCGGAGGCAGAGAGCAAAAAAACGCTCACACGTGTCAGTCCGTA
GCGGTGCCTTTTTTCTAACTGTCCGTATCTGGTCAGAGGCGGCGGCAGTAAATAAGTGTTGCCT > SEQ ID NO:849 216057 *Trichoderma harzianum*
CGTGTCTTGTCATTATTACTCGACCACTCGCCTCAATCTCGGCGATCAATATCTTCTCTCGACGTGGTTCGATTTCGAT
TCGACGTATCGGTGGCGGGGCATGAATAAGGTAATGGTTGTGTTTAGTTGGGCTCGAAACTAATGTTACCCATCAGTAG
TATCACCTATTGCTGACGTCGGCTTGAGGAAGTGGGTTCAATCGTGATACATTCGGCTCGTACAGTGCAATACAGATAA
GATGATGCGATCAGAGAGGCAATTGTTAGGTCATGATTGACGGAGGATTCGAGCCGATGATNGACAAGGCGACCAAAGA
AAGCTGGGCAATCCCGACCCCAATTGGATGATTCTGGCACCCCAAGCTGTGAATTCGGCTTGACCTTTGAACATCAACT
TGCTGTAGGGTAGTGCAACCTTGGACGTAAAGAGAAGGCAGCGTCAGCATTTGTTAC

FIG. 1 continued

> SEQ ID NO:850 216062 Trichoderma harzianum
GAACATTCAGCCTTGTGCAGGGAAGCAGAAATCATATAGAGCATTTATCAAGCGAATAACAGACCCTGAGACACTGAAT
CAGAGAAGCTTAGAAGCTCTTCTTCTCTCTGTCTCCGCGCCTCTTATCGCAAACAGCCCCTCTACTGCTGCTGCTGCCT
TTGTCAGGCCTGTCTTTTCAGTGTCGCATGCCCCGCCTCATCTTTCTACCTTGCACAACTCAGCCTTTGCGCTAATCAA
CGACATCTGCGATCTGTGTCGGCAGCAGAAGAGTCCCA > SEQ ID NO:851 216068 Trichoderma harzianum
GTCAATTCGGCTCTGCGCAACACCAAGTAGCCATGTCGACAACCACCACCACAACAACGGCGCAGCCGATCACGGCTGA
GACCATCCTTCGTCTCTTCCCCGACATCGATACCACCAGCGAAGCGCTCTCAGGCCACGATGAGGAGCAGATCCGTCTG
ATGGACGAAGTCTGCATCGTAACGGACGAGAACGATGCGCCAATTGGCACCGCAAGCAAGAAGATTTGCCACCTGATGA
CCAACATCGACAAGGGACTCTTGCACCGCGCCTTTTCCGTCTTCCTCTTCAACGACAAGAACGAGCTCCTCCTCCAGCA
GCGCGCCACTGAAAAGATTACCTTCCCAGACATGTGGACCAACACTTGCTGCTCCCACCCTCTGAGCATCCCTACCGAG
ACGGGCGCCAACCTGGTCGACTCTATCGCTGGAGCCAAGCGTGCGGCTCAGCGCAAGCTGGATCACGAGCTTGGCATCA
AGAAGGAGCAGGTCCCATTCGAAAACTTCCGCTTCTTGACCCGAATCCATTACAAGGCTCCCAGCGACGGCAAATGGGG
CGAGCACGAGAGTACGAGGCTGAGCTGTCCTACCTATCTACAGGCCATATGATGGAACTTGAGCTAACGGTTTCTCTAA
TCTAGTTGACTA > SEQ ID NO:852 216072 Trichoderma harzianum
GCAAAAAGCCCACCAACATGGCGACAATGTCAAATCAGTCGCTGAGGGCGGCTGTTCGGTCGGTTGGACGATTAAATGG
ACGGACGGCTAGGTCTTCGGGCCTTACATCGAGGCAATTCAGCACCTCGCCAGCTCATGGCGTCAGGGCTGTCTTCGCC
GAGACGGACAACACCGAAATGAACAAGATCCTCAACACCATCCAAGAAAACATCATCCTCCCCGCCTACCTCCCCGAAA
AGCAGCGCAGGCTCGTCTTTGACCCCAAGATGAAGTCCTACCTCGAGCAAAACCCCATCATCATCGAGGTCGAGGGCCT
CGAACACAAATTCTCCTCCATCGACCACTTCACCGGTATCGAAAACTCAAAGACGATCCTCTCCGAGGCCCTCAGCAGC
ATGAAGAGCCAGGACGACTGGGCCAACCTCCTGGGGAACCCTCCTGGCGGGGTACAAGAAGGCGGGGATACGGCTCAAGGCAA
ACCACTGGGGGAAGATTGTGCGCATGGCAGGCAAGAGCGGCAACATTCACGCCGTCATTGAGTGCGCGAAGCAGTCTGA
CAAGACGGGCCTCCTGTTCACCAACCGAGAGACGGTGGTACGGGTGCTCTCTTACATCAATGAAAAGGTCAGCGGCAGC
AATTG > SEQ ID NO:853 216074 Trichoderma harzianum
TACACCAGACGAAGAAAGCATCCAATCGTTCACCATGAAGCCCCAAACTTTCGTTGTCGCTGCCCTCGGCCTCCTGTCC
GGAGAAGCCATGGCCCAGAGCGTGCCGCCTCTGATCTCGTCTGTGTCTGCCGCCGTCTCCTCTGCCATTGCCTCTGGCA
GTGCCATTGCTTCCAGCATTCGCTCCGAGGCCTCGTCCGTCGCCAGCAGCATCCGCTCAGAAGCTTCTTCCATCGCCTC
CAGCGAGACCAATACCGCAACCACTGGCACTGAGACCACCAGCAGTGAGACCACCTTGACAACTACCATCGCCACCACC
ACCACCCAAACCACTGTCGAGTCTGCCACCACAGAGCCTGCCACTACTATCCCCGGAACCACCAACAGCGAGACTACCA
GGGCTGCCACCACCATTCCTGCTACTACCCGCTCTGCCACCACTCGCGTCACCACCAGAACCTCTGCTACCACTTCTAC
CTCTACCGGTCTGGCCATTGCTCCCACTGCTGATGCCAAGCTGCTGGCTCCCATCCTCGGTGCTGCCGCCGCCGTCTTG
ATGCTGTAAACACCTGTCTCTTGGAACTACTACTATCTATTTCATATGTTGGGCGGAGGACTTGATATGGAGCGGACG > SEQ ID NO:854 216079 Trichoderma harzianum
AGCGCCATCTTGACCCGCGAGAACTTGGGCCGCTGGTCACGCGCCATGGCCCTGGGCACTGCAAACTGGTTCCCTTGGC
CATTTGCCGTCACACAGACGCTTTGGGCTGGATTCCTCTGCGGAAACCGCTTCATCGAATGGGTCATTGGCAAGGAGCC
CGCGCCGGTGTTCAGCGTCAAAGCGGTGATTAACCCATACTACGAGACCAAGGATACGCGACACTTGTATATCTACAGC
GAAGATGATGATCTCATCCCGTATCAGGAAATTGAAGAGCACATTGCACAAGCACGGAAAAGGGGATACAAGTCTGATA
ATCACATGTTCAAGGGAAGCGGCCATGTGCGCCACATGCAAATGTTTAATGGAGAGTACTGGGGAGCTATCGGAACGTC
GTGGAATAGAGCGACGAGCGAGCCTTCTGAGGAGGCGTAATGGGTTGTGCTCAAGGCCAAAAGGGGTCAAGATGGAAAT
TTGCGTTGCTTTCTATAGACGAACTCGCGTTGCTTGTTTG > SEQ ID NO:855 216082 Trichoderma harzianum
AGGGTACGAGTATATCGTGGCACCAATGCTGCAGGTACCTCGTATGTATGAAGATGGAAAGCATCAATGAAAAATAGGG
ACCGCCGGTTCAGACGGTTTAGACAAGACGGGACGAACCTCGTTTTGTCAGACATGATGGAAATGACAACATCCAAACC
ATTTTATAGCATCAGCAACAACCCGCCAACTGCCTCGATATCTAGCGGTTACGCGGCCCTAACAAAGCAAACAAGCGGT
GCTCTTTTTTCCCGTACGGAGTAATTTGCACCAAGTACGAATAGCTGGAAACAGGTACGAAATCGTATGCGGAGTCTG
GCCCTCCGTCTTATCAGATGTGCTCCTTTACGGTAATACCTGCGCAGGACCTATACCCGACACAGGTCTCACCACGCTT
CATTTGCTTTGGCCGTGGCAAAATCCATATCTCCTAGCTCGTTCATTTATCTCAACGGTTGAGCTTGTCGTTTCCAAA

FIG. 1 continued

```
CAACAGGCCATGTGCGGATGTCATGACACGCCTGTGGACATGACAGCTGATGGAGGGATGGGCTGTATACCTGTCCATG
TATGTACGAGTATGAGTATGCTCGCCAAGTCGGA
```

> SEQ ID NO:856 216087 *Trichoderma harzianum*
```
GCGATGATCCCCGCAGCAGCAAAAACGGCCGAAATCCATCCCGGCTGCCACTAAGAATCTCCCTTTGGGGCAGCCGCTA
GTGTCGGGAGCTGTTCTTCCCGAACACTTCTGCGACGTGCCTTGCCCTGTTTCAGACAAGCTGATGATGATGATGGGCT
TGCACGACCACGCGCCCGTCTGTGCTACACGCCCGGATCTGCCTTTTCGCAGGTTTGCTTGCGGGGCTGAGGACAGAG
GCCAGAGGACAGGATGCGGTGAGTAGGCTACTCTGGAGGACGGTTGAATGAAACGTTGATTTGGTTTGTTGTTCGCG
CCTCACGCCCTCTCTATTATCGCGCTTTCAACATCTGCATCTGTCTTTGTGATATATTCGTTTACAGCTCGCGGACACG
AATTTTTCTCCATTATCAGTCAACTAAGACTCACTGCTCTGGTGCACTTCTCTCCTAGGGCTTTCAACGAATGCTCCAG
CGTAATACTGGACTGCTGGTGCCTCCTATTCGTTGCCGCCTACAGTCTACAGTCTGCACACTTGAGACAAGAGAGACAG
AGAGAGAAATGCCAGCACCGCTACTCTAGACAATATCCCTTGCTCTCCCTACAGGAGAGATATCTCCCTCCCTTGCATG
CCCTTTTCAGCAAACAACTCTTATCACCCGAAGCTGAG
```

> SEQ ID NO:857 216090 *Trichoderma harzianum*
```
GCATTGACTACACACATAAATACACCAGCAAAACATCTTCTGCGATTTCTAGTGTTTTTTCACTTACACCAGCGCGACC
ATCGCCAAAGCTACATACAACACAACACACAACACAATACATACACATCCAGACACTACCGTCTAACATAACACAAACC
GCCGAAATGGTCACTCAACCAGCCAAGATCCCCGTTGCCGCCCCAGGCCCCCTCGCTAGAGCTTTCCCAGCCGTCATCG
CCGTCGGCGTCATCTCTGCCGTCGCGCTAAACGTTCGCTCCCAACTCAAGACTCATTCAGCCACTCAGGACCGCTTCTT
CTCCCAGTACAAGAACCCCGAGAGCGAAGCCGTCCGCCAAAAGGTGTTTGAGGGCGCTGTCGAGGACCCCCGCAAGAGC
TGGTTCAACGTCCTGGGCTGGTGACTATTTGAGGATTAAGCAGGGGTTTTGAAGACACAATCGCATTGCTGGGCGTTTA
TTTTAATTTTTAGTATCGAGGAGTTGGAAAGGATATTTGTTGGCTGGTGAAGGCGTCGTGCATTGCTGTTTCGATGTGA
CCGCCTGGTGTATAAATGGCGAAAGAAGGGGTTGTTGAGAGGCCCGAGTATTGATACCAGCCTTATTTAGATGGCACT
```

> SEQ ID NO:858 216095 *Trichoderma harzianum*
```
CGACCCACGCGGCGGCATCTCGACATCAGTCACAATGGCTTTCGGAACTCTCTTCACCACCGCCGACCAACCTCGTGCC
GCCGCCATCAAGGCCGTCGCCAAGGCCAACGGCCTCGAGCTCAACATCTCCAACGTTGAGGCTGGCAATCCCACTGCTG
AGCACCTCAAGGCTCACCCTCTGGGCAAATACCCTGCTTTCCTCGGCGAGGATGTTTTTGCCCTGAGCGAGAGCATTGC
TATCGCCATCTACGTCACCTCCCAGAACGAGAAGACCACCCTTCTCGGCAAGACCAAGCAGGACTACGCTTCCATCCTC
CGATGGATGTCCTACTTCAACACCGAGGTTTGCCCCAAGATCGGTGCTTGGATCAAGCCCCTGACCGGCGCCTCCCCCT
ACAACAAGAAGGCTGTCGATGACATCTCCAAGGAGGTTGCCCGTGCTGTTGATGCTGCTGAGGAGCACCTCACTCACCA
CACCTACCTCGTTGGTGAGCGCATCACCCTGGCTGATCTCTTCAGCGCTGGCCTCCTCTACCGCGGCTTCCAGTACTTC
TTCGACAAGCATTGGCGCCAGCA
```

> SEQ ID NO:859 216103 *Trichoderma harzianum*
```
GCGGTGACATCCTAACCAAAAAGAAACTTGACCCTCATCGTAGCCGCTGTCGAGGCGCAACCTTTACCTGTATTGATTG
CATGGTATACTTTCCCGGCGTCGAATATCGTTCTCATACATCTTGCATGACAGAAGAGCAGAAATACCAAGGCGCATTG
TATAAGCCGAAGCAAAACAACAAGAAGCAGCAGCAACAGCAGCAACATCATCAGCAACAACAGCCCACCATGAACTCGC
ATCGGTTAGGCATGGCCAACACGTTGGCCCTGCAGCCATTTGTCGAAGATGTCAACGAAGACAAGGAATACGAGTCGTG
GCACGAGTACGAAGACAAGTCTCGACCTCCCCCCGAGGCGCCAACCCCTCCATCTGCCGCCGACGATGACCACGTCAAC
GTCTTTGACTTCCTAGACAACTCTCAAACCCCGACTGCCTCAAACGTGAGCCATGCGCGAGACCGAAAAGCTCCTGGTC
CCAGCGACAGCACCTCTCTTGTGCGCTACGAGACAAAGAGCGGAGAGCTCCTGGAGCCGGTTATTATGGACCGAGACGG
AGAGCCGCTTGTACAATACG
```

> SEQ ID NO:860 216105 *Trichoderma harzianum*
```
CCCACGCGTCCGGGATCTTGGTGGGCACCACGACGTTCTTCTCCATCCTCATCTTCTCGATCAACACTGTCTTTGCTCA
GGAAACACTCGCGCAGTGGATTGGAGATTACCTGACTCAATCTGCTGGTGTTGTCTTCGAATCAGCCATAGTG
CCCAAGTGGAAGAATGGCGTTATCGCATTTCGTAATGTGTTTATTTCAAGAAGACCCGGGCAGATCGAATCATCCGTCA
GCAAGGGATCGTCTGACGCTGCTGCTGTTGCTGCCGCAGGGCGCCAGGTTCAGCATAACGGGACTGTTACCGAAGACGA
TGGCAACTATACGCAATTTGATGTAACGATCGCAAACGTCAATGTCACACTTTCATTCCTCAACTGGTGGAATGGCAGG
GGGCTTCTCAAAGATGTGGAAGTAAATGGTGTTAGAGGAATTGTCGATCGCACCTCTGTCCGTTGGCCACTGCAGCAAA
TCGACCCCTTGTCTTACCGCCACAAACACCAACCAGGCGATTTTGAGATTGAATCTTTCAAATTGGAAGATCTTTTGCT
CACCATTCGCCAACCTGATG
```

FIG. 1 continued

> SEQ ID NO:861 216107 *Trichoderma harzianum*
GCAGAAACTCGCTGCGGAATCAACCACTGGAATATGTCTTATCAAGGATATGGCCAGCCCTACGGGCAACCACCGGCTC
CCCAGGGGTATGGGCAGTATCCCCCTCCTCAACAGGGGCAATATCCTCCTCAACAGCAGGGGCAGTACCCTCCTCCTCA
TGGGCAATATCCTCCGGCCCAGCAAGGGCAATACGGGCAGCATCCTCCCCCTCAGCAGGGAGGTTATTACCAGTCTCCC
CCGGCCCCTCCAGGCCAGTATCCCCCACCACAAGCGCCCTACGGACAGGCGGCGGCTCAGCAATACGGGGCTCCTCCTC
CTCAACACCAACAGCCTTACGGAGCTCCCCCAGTGCAGCCTACGCCGCCGTCTATTGGCTATGGGGCACCCCAGATCAT
TCAATGGGACGGGACCCCAGATGCCCAGGCTTT > SEQ ID NO:862 216108 *Trichoderma harzianum*
GTGGTCTGACTGTAGAACAATCTCTCTTTGGCCTGTAGTCTCTTTGACTTATAATCTGGTCTATCCTGGTGTTGCGTGG
AAACTTCAGAGTCCTCCCTTTGTGTGTGCGCGTGAGCCGAAACAATCACCACAATTGGTGGTCGCACGCCCCGGAAACA
ACAAAGAGCCCGCTGATCCGATCCGGCATCTCCGGCATACAATGCGCCGCTGCTCTTCTTCTTCATCAATCAGCTCTCA
GTGGTCCTCTATAAGCGAGGACCAGCTCAACTCCATCGTCCACATCAACAGGATCACCACCGCCGCCACCACAGTCACC
GCCAGCAACTCGTCTGTTGTATCTTCATCTGCCTCTGTTGCACCCTCAATCATGCCTTCAGTCCACACAATGTCTGAGC
GCCGCCCTTCCACCCCCAGTATGAGCGCAGTCGCCAGGGAAGCACATGCTCCGTACTGAGCT > SEQ ID NO:863 216109 *Trichoderma harzianum*
GATCTTGCTGGGAGCTGTGATTTTGGCAGCGCGAAGCGTTTCCGGGTGCCAATTCTCACCACTGGAATCACAAGTCCCG
AGTACTACTCTGTCAACCATGGCCTCGATTGTGCGACCTTCTCTGGTGCGGCAGACTGCGCTGGCGGCTCGTTGCGCCA
AGCCTGCTTTCCGAAACAACGCCATCAAGGGTTCGGCTTTCCACACCTCGACTCAGCTCTCTGCCTTTCTGCCTCCCGG
ACCTCAGCGAATTGAGGGCACAGTCAACGACCCTGCCCCTATTCCCCAACCTAACGCCTCGCACGGCTCCTACCACTGG
ACCTTTGAGCGCCTCCTCGCCGCCGGGCTCGTACCCCTCTCCATTGCTCCCTTCGCCGCCGGCTCTCTCAACCCCACCA
CCGACGCCATCCTGTGCTCTGCCGTCCTCCTGCACTCTCACATTGGCTTCCAGTCCGTCATCATCGACTACATCCCCAA
GAACCGCTACTCCGGCCTGGGAAAGATCTTCTGGTGGGGCTTGAACCTGGC > SEQ ID NO:864 216112 *Trichoderma harzianum*
GTTAACGAGTCGTTTGTTGAGCTCCTTTTCCCTTCCCAGTCTTTCGCTTTTGGGTCCGCACTTCTCCTGCAGGTCGCCG
TTTCCATACCATTTTCTAATAGTATCACTTCCGCACATCTTCACGAACGCGTCTCCCCGTCGTCGTACTATACAGTCAA
TATGGTGTCTTTCAAATCAGCCGTTGCCGCCGCCACGATGGCCTTTGTCTCGTTGGCCAATGCGAAGAGCTACTACATC
GACCCTGACAGTGTCCCTCTGGCCACAAGACAGAGCTGGTGCCGTTCTGAGACGTCGACATGCCCCATCATCTGCCAGC
AGACCACCAACAAGCCGACATTGGTCAACGACTGCAGTCCTGATACCTTGAGCTTCGGTTGTCTCTGTGGTGATAACAA
GCAGCCTAACATTTCTGAGTACACCTTGACACTGCCCTTTTTCATTTGCCAGGAGTTTGTGGTCCAGTGCAGGACAGCT
TGTGGCTCGGACAACACTTGTGCGTCTAACTGCGCCGAGGATAACCCTTGTGGTGCCACCGATCCTAAGCGTTACAACT
CAACTTCGACTGCTACAACAACAAC > SEQ ID NO:865 216114 *Trichoderma harzianum*
GGAACACAGCCCAAGCAATAGCACAAAGAGGGGTCTACTCCAACCATATCCAGCCATTATCTAGAGAAAATAGAGAAAG
AAACAGAGAAAAGCCACGATATCGGATATCGACCAACTTCAAACTGGCAAAGCTGCAATCAACCCCCGACGTTGGGCTT
GGTCTAGAATCCGCCCAGCTGGCTGAGGAAGCGAATTCCTTCTCCTCGGGCTCCGTTATACTTCCTTTTACGTACCGTG
ATATTGTGATAGACAGACGCCTCCAAAAAGGAACATCACAACAAAGTATCGCCAAGAATCCTCATCCGCAAGTACACAG
GGGGAAACAACAAAACAAGCTTCCGACTCCTCGACTCCAGTGGGGGGCATCCCAGCCAGTCAATGATAAACACACAATC
AAACAGAGCACGATACAGAGAGAAGAAGCACCTCAAGCCGCCGTCAGTTTCACCCCCCCTTTAAAAGAGATTTGAACCC
GAAAAGGGCCGCTCGCATATTCAAGCCTTTCGCCAATGAGATCCCCCATCCATCCTCTCACATCCCGCACCCTCCACAC
CAAATGCAAAACCCCCAATAAATTCTGTCGAC > SEQ ID NO:866 216130 *Trichoderma harzianum*
AAACAACCATGCCTCACAAACACAAGTCAAGGAAGGGCGAATTTGAAGCAGAATTCGATCTCGCCCCTACAGAGAAAGC
GCGATCTCTTCCAGTAAACAAACGAAAAGCGGCATCAAGTTCTGGAGAGCAAGTCACAAAGAAGCGTGCCAGAAGCTCA
TTAAGAGGCAATGACACTCCGCGAGCATTCAAGAGAATCATGGCTGTGGCAGGGGGGAAGAAAATTAGATCAGGCTTGG
ATGATGGTCAACTCGACAAAACGACTACGAAGGCTACCGATGTAACGAGCGAGAAACTTCAAATTCGTCCCGGTGAAAA
TTTAGGGGCCTTTGCCAGCCGGGTTGATGCGGCTCTACCAGTATCAGGGCTTGCGAAGAAAACCAGCACGAATGCAGAG
GGCAAAGACGCATTAGGATTGAAAGTGTATCGCACTCGCAAAGAGCGCAAAATGCACAAACTCTACGATCAGTGGAGGG
CAGAGGAATCCAAGATACGAGAAAAGAGGGAGGAGGAGCTAGAGCGCATAGCAGAACGCGACTTGGAAGACGATGCTGC
CGGCATTCTTACTTCAGCTGCCTTCGAAAACGACAATAGCCACACGAAAAA

FIG. 1 continued

> SEQ ID NO:867 216131 Trichoderma harzianum
GAAGCCTGCATCGCCCGCCATGGCCATTACGCCGACCCAATTCGCCAAGAAGACGGCGCAGTCGACCAGCTGGTCGGAT
GCGAAGCGTCGAGTCCTTTCTTCGTACCGCGAATGGATCCGAGCTGCGCCTGAGATCCAGACCATGTACAATGTCCCTC
TCCCCATTTCTACCCTCCGAACACGGATGCGACAAGAGTTCGAGCGACACCGATACACGAACCAGCTGTCCATAGTTGA
CGTGCTTCTCTTCAAGTCCCATGCAGAGTACCAGGAAACAATGAACTTCTGGAAGCAGCAGACTCACATCTTGTCTTAT
TTCGGCGAAAACTTTAGAGGTGACAAGAGGCTTCCGTCCAGCTTCATGGCTGGTTTCCTTGAGGGTCGAAATTAGAAAG
ACAATGCAAGAAAGTTTGTTTTGTAAATATCTCTGTATAAAGATTTTGTGCCGAAACCCTCCAA > SEQ ID NO:868 216136 Trichoderma harzianum
GGGGATTCATTCAGCTGGTCAATATTTCACGATAGAGAGAGGGGTTGATTTCAATTCAATTCAATTACAGGAGGGGTAT
TCGTGGGACCACCTCGGCAGATACCAGTAGAGGCAAAGGGAATCCCGCAACTCAACTCAAAACCCGAAGCCTCTCCGCT
CCCTTATCTAGGGCGGGGAATTCTGACGTTGCTGATCCGATATCCGTCGCGCGGCACGGCAGTCAGGGACGGGATGCGG
CAAAGATTTGGCAATTCGTCTGGGTTGCTGTTGCAGCCTTCTTCACTAGAAATGGAATCTCGCGGATCAAAAGGGAAGT
GTGGGAAGCTCTCGCGCGGTACTTGGTGCGAGTTGGAGCGAAAGCGAAGGGAGCCGCGGAAAGGGTTCGGGGCCGTGAT
TCCGGGGCAAGCGGCCAGATACCGACCTGGGTCCGAGTTCGCCGGGTCGTAGATCACGAGGCTGGTCCTTAGACTCAAA
ATCCCAAGGGTTTGGTTATGGTGTGA > SEQ ID NO:869 216142 Trichoderma harzianum
AATCAATGGGCGAGAGACGGCTAATCGAGCAGAGCGTGACGAGGAGCGCGGCAATGGCGAGTGCGTGAAGGGGTGTTGA
TTCAAGACTGCGCGCGTGAGGGTGTGGGAGAGATGAGGCAGAGGCCAGAGGCAGCTCAAAAGGGTTCAAAGTTGAGAAT
CGACGTCAAGCCGCTTTAGTGGCTGATGGGCACTAAGCCTCAGTGGTCGACGAAAAACCCACAGCCGAGGCAAGCCTGC
AGACGGCCAGCGGGAAAAATTGCTGCAGGGCGGGTAGCACCGCAGCAGAGAATTGATGGCAAAGACGCCACAGGTGGTA
TGACGGCTGTGATTGGAGGCAGAAAATATCGAGATGTCAATTTTGCCGATTGTTTTGTGATCCAAGAAGAGAAGAGGAG
AGGAAGGCAAACAAAGAGGAAAAGCTTGAAATCCTCTCTGATGCAGATCTCTGTGATGCAGATCTGCGGAAATGTCCGT
GGAAGACGGCAAAGTGATTGTGACAAA > SEQ ID NO:870 216147 Trichoderma harzianum
AAGAGGCAGGAAACTCTCTTTTGGCCCCAGAAAATGCCAGACTAGGTCCGAAGAACTATCGATTCTAACGCCGATGATG
TCGCTTGCCGGCAGTCGAGGGCTCGGAATCGGCAACGCGGTTCCTTGGTAATTGGCCACAAGCTGGGGCACTATCTGGA
GACTATCCGCCCGAGCTGTCCGTTTGGCCTTTCCTAAATTGCCCATTCGAGTTAATGATGTAATGAGGAGAGGGACTCT
TGAAAATGGATATAAGGGCGCAGTCGCGCAAGCTGTTCTGAGCTGAAAAGAAAGGAGAGAGAAGGTCTCTGTACAAGCA
GGAGAACAAATCTTATCTCAATTGCAATTTGAAATTCCATCGCC > SEQ ID NO:871 216150 Trichoderma harzianum
GCAGGGTGGTGGCTTCAGCAACTACAGCGGAGGGTCTCAGGGAGGCTCTGGCTATGGCGGCGGCGGCGGCTACGGAGGC
GGTTACGGCAACGGTGGCAGCTACGGCAACCCCGGCGGTGCTGGAGCCCAGTCCTCGTGGTGGTAAATACTCACGCTCT
CTCGTGATGGGCATATCACTGTGTCTATCATTGTGGCTCAAGTTTCAGCCACTACTCTTTTTTTTTTTCTCGTCTTCAC
TTTTCCCTTATCGTCATTTATTCTATTTGCGCATCAATTTGCTTTGATAAAATCGGTTATTTCACATTTACGCATCAT
GTCATTTGTTTTCGACGACACGGCGGCATCATGACCTGCGAAGGCGGAAGAGTGCCTTTTTTTATTTGCTGCAAAGGG
CAGTAACGGTCAGGGGCATTTCACGACGCATGTGATAGATTGCATTTCTTTTGATTTCAGCATCCTCCCTCGCTTGATA
CCCTTAGACCGAGAATAGAGGAACTTAACGACGCTGGCAGAACGTGTGGTGTTGAGAGATCTACGGTTGTTAGATCTGG
ACTAGGACATCACGGTTTTTTTCAT > SEQ ID NO:872 216152 Trichoderma harzianum
AATACGGATTACTCGCACATATCGCGTGAGAGGGAGCCTCCTCGTGGTTATTTGATGCTAGAAATCCGCAGGTCCGTGG
GTTGTTTCGGGACAGGAGGAAACCCATGGGAAAGGGTCGCTTCGGATGAGGCTGTGCCGTATTACCCGCGTATATTGCC
ACTGAATGTGCTGTGTCTGGTGGTTGTGTTGCCTT > SEQ ID NO:873 216156 Trichoderma harzianum
ACATTCACTTCCTGGGGCCGCATCTCATGGAGCTTTTACCCCACCATCTCACAGCCCATCATCTATCTCATCCAACCTC
TCACCACAACAGCACCTACATCTACAAGAGAGAACGCTTCCCTCTTGAAAAAGTAAACCTAAATAAACACATCAAATCA
AAGATCCTCCATCATGGGCGACAAAGACCGCATCAGCTGGCACGTCCTCGACACCACCGGCGGCCGCCCCGGAAAGGGC
ATCCGGGTCCGCCTCGAAGGCCCCGTCCCCAGCTCTCCCAACGCCCACACTGGCGGCAACACCTTCGAGTCCCTCACCA

FIG. 1 continued

ACGACGACGGGCGGATCACCGTCTGGCTGGCCTACTCCTCAGAGTCCTCGGCCGGCGAGGTGCCCGTCTACACTCTCGA
GGACGTCCTGGGCGCTATCAAGGGGCCTTCCCGGTGGACGCTGCGTTTCGACACTGGCGGCTACTTTGGCGAGGAAAAA
AACATTCTTCCCAGAAGCCACCATTGTGTTTCGTG

> SEQ ID NO:874 216160 Trichoderma harzianum
GTTCGTGCTGAAGATTTGCAATGCGCGCGCACATCTGAGTATCCTGAGACGGCTGCAGTCTACTGCAACTTGTACTCTA
CTTGGGGTACCAGATGCTCCCTTCGGAGCAGGATCACGATTCAAACGCGCATCAATCACAGGAAATCCCTGTCGTCTGT
GTTTTGTTCCAACCCGGAACTGCTCAAATTGGGAACCCGAATGACATACTGTTTACCGCCATGTGTGTGGTTGGTTCTC
TTGAGAATCCGAGACATATTGTCTGTGACAATCGCATTGTCGACAAATCAACAAATCAAAAATGCGCCGTTGCGCTGTT
TGCCAAAGTTGGTGGGTGGGATGCTCTTTTATTCATTTTGCTCGCCTTTTTTTCTTCTTGCGCTCTAGCACGCCAACCT
GGATTCCAACCTTCTGGGACCACCCGATCGATCGTGGCAGAATTGAACGCACGAATAGGGCTTTTGTGTAACGCTGGAA
AGGACCACGGTGGCCGCTGGTATCCATTCTGTCCGCACACTTACTTCGGCATTGGGGCCAACGTTCCTGGCGATGCAGC
GGGACTGGTGGCATGAGTGGGTAGTTGACATGTTGGCT > SEQ ID NO:875 216166 Trichoderma harzianum
AAGAAGGAATACAAGACTCCAAGATGCATCATCAGCTTCTCACTCTCACCGCTGCTGCTGGCCTCCTCGCGACGGCCTC
AGCTACCTACTCGAAGCTTCCCAGTGTCAATGTGCCTTCATGTCCTCGTGTTGGCACGATTAGCTACAGCAAGTCAGTG
CCCGACCTGACGCCCTTCCCGCTCACACAGGTCAACCTGTCTACACAGACAAGAGCCTCGAGCTCTCATTCATTGCCT
ATGACGAGGTCAATTACTTCTTCAATGCCTCTCAGGGTACAAACGACGACATCTGGGAGTACGAAGTCATGGAGGCTTT
CCTCTACAAGGGCACCGAAGACCCTCAGACATACGTCGAGCTCGAGGTCAACCCCAACAACGTCACATACCAGGCATTT
GTTTACAACCCCTCCAAGAATCGCGCGGTCGGCGCACCCTTCGACCACTTCTTCGTTTCGGATCCCGCCACGGACGGCT
TCAGCTCGAAGACTGTCCTCAACAAGCTCGCAAAGACTTGGAAGAGCACTGTTACCGTCCCTCTGGGCATCTTCAACGT
CGACGTCGGC > SEQ ID NO:876 216175 Trichoderma harzianum
CGGACGCGTGGGAATGATTCTCATCAAAGAACAAACGCATCGTTCAAGATGAGAGCCAAATGGAGGAAGAAGCGCGTTC
GTCGCCTTAAGCGCAAGAGAAGAAAGATGAGGGCTCGCTCCAAATAAACGACTCGCTCTACCACTTGACTTGACACATC
TTTCACATTTTGAATGAGTTCACGATAAAACACGACAAGCAAAGCTGCTGCACCACGGTACCACTCTATGACCGATTAC
AGCCATCAAGTTGGAATCAGCATATTGGTGCGCCTCTCCAATTCAGCTACGGGAGTCAATGGACGAACGCGAGAGATGA
GGACTGGACAATTTCAGTCAGGTGGAGACATCGTTTTGAGGACGCGAAGGCCATGAAGCAAAACGCTGCTGCAAGAAGC
ACGCTTAGGATCGATACGTTGCTTGACAAAGATCAAAGGCAGAATTTACTTCATTTCCAAACCAG > SEQ ID NO:877 216176 Trichoderma harzianum
GGAAATTTGTTCAACCTCGACAAATCAACCCCGTCGCCCATAGTACAAGATGGTAAGTTAACAGTCAACCAAAAGACTC
TAATGGCCACAGTTTGTGAGTCAAATGCGCGAAAGCGCAATTGATGCAACAGCGTCTAGCTTTTATGCAAACCTGTTGG
AAAACATTCCGCCTGACATTCACACCTCGTGTGTGGACTGAAAGGTGAAGACTTGGCTGGAGACACAAATGTGTTGCTG
AAATATGCCACAATGTGTTCTCGTTAGAGTTCAGAGAAGACTTTTTGGCTTGAGCCCCTCGCTGATGTCTTCTTTTCTC
AATGACAGCCTCCCAAATCTGGCAAGAAGGTCGCCCCTGCTCCGTTCCCTCAGAGCAAGGCTGGCAAGAAGGGACCCAA
GAACCCCCTCATCGAGAAGCGCCCTCGCAACTATGGCATCGGCCAGGACATCCAGCCCAAGCGAAACCTGTCTCGCATG
GTAAAGTGGCCCGAGTATGTCCGCCTCCAGCGCCAGCGCAAGATCCTTCGCCTGCGTCTCAAGGTCCCCCCCTCTCTGG
CC > SEQ ID NO:878 216180 Trichoderma harzianum
GGGGGGACGATGCGGCGCATGTACCAGGTGTGCAAGCTGGTGCACGCCGATCTGAGCGAGTACAACATCCTCTACCAC
GACGGCAAGCTGTACATCATCGACGTTTCGCAGACGCGTGGAGCCGGACCACCCGCGGTCGCTCGAGTTCTTGCGCATGG
ATATCAAGAACGTGGGCGACTTCTTCCGGCGCAAGGGCGTCGACACGCTGCCTGACTGCGAGGCCCATTTTCAACTTCATCAC
CGGGCCTGAGGGGCCGGTCGAGGAGCCTGAGCTGGCGGAGGCGATTGCCAAGTTATACGAGACGAGACTTCCTGCTGCG
AACGAGGAGGAGGGTGCTGCTGAGGAGGTGGACACGGAGGTTTTCCGGAACCAGTACATCCCGCAGACGCTGGAGCAGG
TGTATGACATTGAAAAGGATGTCAAGAAGCTCGGTCTTGGAGAGGGCAATGAGTTGGTGTACACCAAGTTGCTGGCTGA
CCAGGTTGTTGCGCCCAA > SEQ ID NO:879 216187 Trichoderma harzianum
ATTTATCGAGTTTCACAGGGCTTAGCAACTCCTGTCCGGGGGATTGGCAGATCTTGACAACTGAGGAGGACCGGATGC
CGTGACGTGTAGCTGCTAGGATGAATCTTGGATTGGAGATTTGCCAGTCGATTTGGATGGTGCCTTTCGGGATGGAGGG

FIG. 1 continued

```
GTGGAGGGTGGAGAGATATGACTAGTGTGGAGGTATCACAGCGTCGGGGGGCTGTGGAGAGTTCAGGGTAAGCCATTTG
CGGCTTTCACGCTCAGTAACACTCGGGGGTTTAAAACTGACTGATGGCCCATCTATACCTTGCAGAAAAAATTTAGGTC
CTCGCAAGACTCTCCCTAGAGCCGCGTCCCGTCACTACTGCTGCTTTGGCATCAAATAGTGCTCAATGGCTAGGCCGAG
GGATTTGAAGACGATAGCAATGTAACCCATACGATCTGACTGAACGACAAAACAAAACGATAC
```

> SEQ ID NO:880   216195   *Trichoderma harzianum*
```
GGACGGACCCGTGGGCGGACGCGTGGGCGACATCAGTCACAATGGCTTTCGGAACTCTCTTCACCACCGGCGACCAACC
TCGTGCCGCCGGCATCAAGGCCGTCGCCAAGGCCAACGGGCTCGAGGCTCAACATCTCCAACGTTGAGGCTGGAAAGCC
CACTGGTGAGCACCTCAAGGCTCACCCTCTGGGCAAATACCCTGCTTTCCTCGGAGAGGATGGATTTGCCCTGAGCGAT
AGCATTGCTATCGCCATCTACGTCACCTCCC
```

> SEQ ID NO:881   216196   *Trichoderma harzianum*
```
ACGAGAACAACAATCAAGATGTCGGACGTAGAAGAGAACAACGCCCCCGAGGTCGTCTAGGAGGTTGAAGTTTCCGGAG
ATGCCCCCAAGGGCCAGATGTCCGGTCTGGACGCCCTCAAGGGTGTTCTCAAGCTCGCTCTCATGCACGAGGGTCTCGC
CCGGGGTCTCCGAGAAGCCTCCAAGGGTCTTGACCGGCGCCAGGCTCACATGTGCGTCCTGAACGAGAACTGGGAGGAG
GAGGGCTACAAGAAGCTGGTCATTGGTCTCTGCAATGAGCACAAGATTCCTCTCATCAAGGTTCCCGATGGCAAGCAGC
TCGGCGAGTGGGCCGGTCTTT
```

> SEQ ID NO:882   216204   *Trichoderma harzianum*
```
ACAAGACATTGATCCTCAGTGGTTTTTGGTGGAATGCGCATCCTTTCTAGCCTTTATTATCTGCTGTGATGTTGAGGGG
CACAAGAGCTGACTGGATTGGCAGAAGATAATGGCAAAAAAGAGATGCGCAAACGTTAGTACAAGCTCGACCAAGAGCA
TCATCTTTACCATCACATCTCATTTTTCAAATACATGAAATGGTCAGATATATTCATACGTGTCCAAGCGTTCAGAAAC
CAGCCAATCTCAGTCTTACATACTTGGAACATTTACATAGTATTGAGTCGCCTATTCATCAGGAAATCCTGGTTCAACA
AAACTCCTCCACTC
```

> SEQ ID NO:883   216207   *Trichoderma harzianum*
```
GAAAATCGTCATCATCACCAGACTCGATACGCAAGGTCAATACGATGGCGAGCCACAAGACATTCCGAACCAAGCAGAA
GCTGGCCAAGGCCCAGAAGCAGAACCGCCCGGTTCCGCAATGGATTCGCCTTCGCACTGGCAACACAATCCGCTACAAC
GCCAAGAGAAGGCACTGGAGAAAGACTCGCCTGGGCATCTAAGCGATTTCGCCCAATCACCTGGCATTCCCGACCCTCT
TGCACCGACGGTACCGACGTCTGGTTTCTTTGGCATGGTTTCGCGGTGAAATAGTGGCGGATGGCGTAAAAGAAAAAGA
TTTTTTATCGTCTTTACGGCGTGTGGGGAGGGAGGATGCANACGCAATGGAATGGGCACGGTTGCCTGGTTTCTCGAT
TCTTGATATTGCTTCATGTCACGGTCGGTCATAGGGAAAGGAATGAACCTATTTTGATGTCCATTTTGCTTTTTACCCG
AGGATCAGTTTCCTTTTCTTTCTAAACATTGTGCTCG
```

> SEQ ID NO:884   216211   *Trichoderma harzianum*
```
GCAGAATGTCCCGCGCCGGGTCTGAGGCCAAAATGGGAAGACCTTCGATCAGACTCATCTCGTCATACATCTTCGACTG
GATTGTTCTCATCGTGGTTGCTGGAGTCGGTTATGTCCTCGGTGTTATCACGCCCAACAAGCGGCCCTTTTCTCTGGTG
AATCCAGACATCTCTTTCCCTTTTACAGAACATGAGACCGTCCCAGACTGGCTGCTCTTTGTCTTGAGCTGCGGTGTCC
CTGCCGTCATCATCGTCATTGTCTCCATCATCTTTGTACCTGGAGCAACAGTACCCAAGAACACCCCTGCTTCACTGAT
ATGGAAACGTAAGCTATGGGAGCTTCACACCGGTCTTCTGGGGCTCCTAATGTCCGTTGCCTGTGGCTTCTTCTTCGTC
AGCGGTATCAAGAACATGTGTGGCAAGCCTCGACCTGATCTCCTCGCACGATGCCTGCCAGACCTGGAGAACGCTTCCA
AGTTCCTGATTGGCGGTTTCCAAGGAGAGTCCAAGTTGGGCAACAGCATTGGCCAGCTCTATTCGGCAGACATCTGCCA
GCAGACCGACAAGGCGAAGCTCAACGACGGCTTC
```

> SEQ ID NO:885   216212   *Trichoderma harzianum*
```
GTTGGGACTGCCAACCTCCAATTGGATGCGCATCGTGGTTTGAGGGAACATGCGACAATTACCTTCCTCAAACACCACA
GTCAATCAATCCCGCTGACAGCCGAGGGATTGCCCCCCATGCCGCCGCATCTGCACCCACGGTCACGAATGACCTCGTC
ACTCTTCGCTACGACGGTCCTTGCCAGCTTCTTCGTTGTTGCCCTACCGCACTTATTACCATGCCCGGTCCCGCGGACA
AAGTACGCTGATGGAGAGATTATCGTCGACGAAAACGGCAGACGGAAGAGATGGAAGAGGAGGGATGTCGATACAAAAG
ACGGACTTGTGCAATTCAACCAGACAACAGACGATGAGATTGAGCGTGCAGCGGAGCGAATGACGAGGGAATGTCCCGT
ACCGAAACCCGGAGGGATGTTGGGAGAGTGGCTCGGATTCCACGCCACGGAAGACAAGACAAGGGCAAACAGATGACGA
TTGATACCGCCAAATGAATAAAAAGCAAAGAAAAAAGTTCAAATATGAAGAAC
```

FIG. 1 continued

> SEQ ID NO:886 216213 *Trichoderma harzianum*
AGCAATTGCGCGCCAAAAGACTGTACACAGACGTCTTTTGATATATTTTCAAAATGGGTGGCGGTGGAAAAATCCCTTA
CCCCAAGCACGTCTGGTCGCCTTCTGGTGGTTGGTACGCCCAGCCTGCCAACTGGCGCGCCAACACGCTCATCGCCGGA
GCCGCCATGTTCGGCGTCATCGCTATTACGTGGAAGTTCAGCGCCGACAGGGAACGATGGGCGCATAAGCCGGAGCCGT
GGGAGTGGCATCCTAGCCGATAGTACGTTTATTTTTGATTGTATTGGGTGTGGTTGTGGGAATTTGGTCGTTTTTGCTA
ACGTTTTTCTTTTGCTTGAAGCTGGTCAAAGCAGTTGATCGAGTGGGACAAGGAGGACAAGCTGAAGGCAGCAAGCAAC
AGCAAGGAGTAGAGTTTTCTTTTTGGGAGAAGGATAATAGACGAAATTGTACAAATTCTATACGAACAAAAGGCAAACA
TTTC > SEQ ID NO:887 216216 *Trichoderma harzianum*
GGAACCAATGAGTCTACGGCTAGCCACTCGGCGGCTGGCGCTGTCAAGCCCATCTTCTCCAGCCTCATTGCTGGCGCCG
ATTAATGGAGTTTCACATGGAACGGTTGGCGTACTGACTCAGCGTCGTCACAAATGGTCGATCAATGTGTTCAAAGGAT
GGGGGAAATCTAGTTCCAAAGAATCTGGCGACAGAGGCCAGGACCCATCCGCCTCTGAATTGGACGATCCCAAGAAGCG
ACAGCAGTTCCTGCAAAGGAATATGCGGGGTGGAGTCGAAGACAACATTTTCCAGGACGAGATTGAGGCCGCGAAGCCG
GTAACCGATTCTCCAGCTGCCCAGACGACAGAGGAAAGGACGAAGGAGAGCCTAGCAATGGTGGTCGATCCAGATGCTC
GGAGCCGTATCCGGTGGCAGCGAAGAAAGGTCATCCAATCAGTGCGCCGCAACGGGCAGCTGACGAGAGAGGAGAAGAT
CAAAATGACGGAGCGCGAGCTCATTCACAAGAGCGACTTTTTCCCAACCAGCGTCAAAAAACTGGTCATGTTGGCACGG
CAGATTGCCGGCAAGCCAGTCGACGAGGCTATTCAACAAATGAAATGGTC > SEQ ID NO:888 216219 *Trichoderma harzianum*
ACTCGGCACATCATGAGTTCAGGATACGGCATGCATGGCGGCGTCGGCCGTTGCTTTCCTTTCTGGCAGGAGGTCATGG
CCTGCTATGTCGTCAACACATCCGCCGCAGACGACTCAGGCAAGAAGAAGTGCTCGCCCGTACTAGAGGATTACTACGA
GTGTCTGCACCACAAGAAGGAGCATGCGAGAGCGCTGGCCCTACAAGCCGCATATGCCCGAGCTCAATCGGCAACCGCA
CGAGACGATGCGCCAAGTGCCAGCCAGATCCGGAATCTAGGACTGCTAGGGAAGACGGAGGACACAAAAGCGGTGCTTG
GACAGGGAAACTGAGGCAATAGACGTGGCGGAGTTCGATTTCTTCTGCGCGAATACAACCCCCTTGGCGCGCATAGATA
GCGCAGCAAGTTCAATATAGGAAAAGCAGACAGAACTGGAGAGCCTTTTCGGATGCTGATTGTGAATTGGCGGCTAATT
CTGTCAGTTTGGAGGCTGTAATTCTGTACAAATTCGACGTACATTTTCATCCACC > SEQ ID NO:889 216223 *Trichoderma harzianum*
GCCAGCATCCTTTTTCCCTTATCCTCATTGCGTCGCTGATCCGTGACCGAGCCTGCCCAAGATGGCGCGCGTCTACGCC
GACGTCAACCAGAACATGCCCCGTAGTTACTGGGACTACGACAGCGTCAACATCAGCTGGGGAGTTCTCGAGAACTACG
AGGTCGTTCGCAAGATCGGCCGGGGCAAGTACTCCGAGGTCTTTGAGTGCATCAACGTCGTCAACTATCAGAAGTGCGT
CGTCAAGGTTCTCAAGCCTGTTAAGAAGAAGAAGATCAAGCGAGAGATCAAGATCCTGCAGAATCTGGCGGGTGGCCCC
AACGTCGTTGCGCTGCTCGATGTCGTGCGAGACTCTCAGAGTAAGACACCGTCTCTCATTTTCGAATATGTCAACAACA
CCGACTTCCGAAGCCTGTACCCCAAGTTCAACGACCTTGACGTGCGATTCTACATCCTGGAGCTGCTCAAGGCTCTGGA
CTACTGCCACAGCAAGGGAATCATGCACAGAGACGTCAAACCTCATAACGTTATGATCGACCATGAGAACAGAAAGTTG
CGTCTGATTGATTGGGGCTTGGCTGAGTTCTACCATCCTGGAACCGAAT > SEQ ID NO:890 216227 *Trichoderma harzianum*
AAATCTTCAAGCTTCACTACAATCAAAATGCAGTTCTCCCTTGCCATCGCCGCCTCCGTGCTGGCTGCCACCGCCTCGG
CTGCTCCTGCAACCGTCTCCGGCACAAACACCAACGGCTCCATCTTCATGTTCGGAGACCCAGCTCCCGCTCGCAACCT
TCTCAACCAATTTGGTGCTTGCGGCCTCACCACCTACTTCGTCGGCCAGGTCCCCGACGACATGCCCCTGGTTGCTATG
CCCGCCAACATCTTCGACCAATTCGGCTCTGCAGCACAACACTCTCTGTGCCAAGATCATCACCCTCACCCGAAACG
GCGTTACTCGCCAGGCTGCTATTGCGGACCGCAACCTCAGCAACACCAACTCCATTGACATGACTCTTGATCGTGGGA
GGCCTTTGGTGGACACGACAACGACGGCAGCATCATTCCTGGCTTCAGCTGGTCCATTGCCAACTAAGGAGTTGGTGGA
AGTGGCCTGCGGTTGAGTAGACTGCGACCTGTACATATTTCTACTCTCTTTCTGATGTATATATTTATGACTTTTGAGC
CCTCTCAGCAGGAGATTCTTGTATATATATGATCCTGCATGGGAGGGCA > SEQ ID NO:891 216230 *Trichoderma harzianum*
CGAAAGCATTTGCCATCGCACAATCGTCATTCAGCTACCAGAATTCCAGTTGTTCAATAAGGAGTCGCAATCATGGGTG
GCGGAGATTTAAACTTGAAAAAGTCGTTTCATCCCGGTCTGCGGCGGAACCAGCAGGCCGTCTACGAAGAAGAACAAA
GGCTCTCGCCGAGCGCAAACGAACCCAGCAGCGCATCAATGAGATCAAGGAGGAGCGCGCAAAGGAGGAGATCCAGAGA
CAGCTGGAGGCTGCGGGAGGCACCAAAAGGGTTGATCGCGTCGACTGGATGTACCAGGGCCCTACCGATGGCCAGGCTG
GGACAACAGAAGAAACAGAGGCCTATTTGCTGGGCAAGCGGAGGATCGACAACCTCATCAAGGGCACCGACCACAAGAA

```
CCTCGAAAAGGCCGCTGGACAGGAGAGCTTCATTGCGCTGCAGAACGCGAACAGCGCGCGCGACACAGCCGCCAAGATC
CGCGATGATCCTCTGCTGGCCATCAAACGACAGGAACAAGCCGCGTACGAGGCCATGATGAACGACCCCATCAGACGCC
GCCAGCTCCTCTCGTCCATGGGCATCGA

> SEQ ID NO:892  216234  Trichoderma harzianum
TTCACGACCATGGGACTCACCTTGAGGGTGTCAGCAGTTGTAGGCAGTATCTTAAGCTGACACGGACACCGTGCTCGGA
AATTTTGTCAATGGCAGCGTCCGTAATAGACACACCCTCTGTCGTGGCCCGGAGCTTGACAATCTTCTTAATCTCGTCT
GCCGAGTATGGGGAGGTGGGGATGATGAGCATTCGGGCAAGGAAGTCAGGAGGAATGCCATGAGCCGCGACAACGTCGT
CGGTACCTCTTATTGTGGACATTCCACGGTTGGATGCCAAAACCACAATGGGGGCGAGGTGTGATTCCAATGCTCGGTT
TAAATAGGTGAAGCACTCCACGTCAAGCATGTGAGCCTATTGTAGTCCAGTGTTAGTATCTGATACCAGTAGATT > SEQ ID NO:893  216237  Trichoderma harzianum
ACAGCCTGAAACCGCGAGTACAAGCATCTTGTTGTAAGCTCGACGTGTGAGCTCTCCTTTCGTCTGCCGTCAAAAAGTC
GATGCCAAGGAGGGTATTGCAGATGTGTTGTTGGCCATCAGCTTACCACTGCAGAGATCCAAGCAGTCATCCCGTGTGC
AGGCACAAGCCCAGTAAGCCGCTGCTCCCAATATGGACCACGTCAGCCATGCCGCCAACCGAGTCCCTCACCGTCTTCC
AAGATGGAGATGCTGTAGGGCTCACCCAGCGGTCGAAACATACCGCCTGTCTGAGGCCCCCTCCAGGGCATTTGCTAGC
CGACCTACTGTACTCGTGTCTCGTACACGGCAGTCGAATTGGTATACCTCCTCCGAAGCTGGTTCGTCATGCGCATGAA
AAGGCTGTAGCGAGCAAGACTCAGCCGCCCAATCACGAATATCTCGGGCATCCTTGTCCGTCCAGGAATAGGCACACCA
CTCGAAATTAAGCTGCCATGCAAGACGTGGCATGCGGGGAGGGTCCCAAAGATCCTTCCAAACATTCCAGACA > SEQ ID NO:894  216238  Trichoderma harzianum
AACCTCATAACAACCACAATGGCTGCACAAGAAGGACGAGCTCCATATCCGCCATTCACACTTGAGACAGCTCAAGTCA
AAGTCAAGGCCGCTCAAGATGCTTGGAACACCAGAAACCCAGATGGTGTCAAAATGGCATACACCCCAGACTCAATCTG
GCGCAATCGCGGCACATTTCTACAAGGCCGCGACGAGATCAAGGCGTTCTTAACCGACAAATGGAGCAAAGAAGACGGC
TACCGACTTCGCAAGGAGCTTTTTGCTTTTACAGACAACAAGATTGCCGTGCAGTTCTGGTACGAGTGGCATGATGAGG
CAGGCCAGTGGTGGCGCACGTACGGGCTTGAGGACTGGACTTTTGCCGAGAATGGGCTGATGAGGAAACGTCAGATGAG
TGGAAATGACGTGAAGATTAGCGATGCGGAGAGATGGTTCAAGGATGGCGTTGATGTGAACACCGTCGACATTTCCGAG
AAGCACTGGTGAGGGAGGCTATTTACTAAACTTTAATGAAGTCTTTTGAATATATAGATAAGCAAAGTTTGGTTTATGA
A > SEQ ID NO:895  216240  Trichoderma harzianum
AAACAAGTTATCGTGGCCATGGGTTTACACGAACGACGCTTGCGATTCAACTGGTGCCCATTAGGAAAGAGAAAGGAAA
TCAGTTGAAAATGCTGGCATGAGAACACTTTACAGCGAACGATTGTAAATATCAAAGTGACAAAATCAAGTATCATGGA
GCCAGGAAGCGGCAAATGTC > SEQ ID NO:896  216241  Trichoderma harzianum
GTTGAACGGAAGGAAGTAGCCAATCCGTCAACTCCAGACACAATCTCTGCCCTCCTCTGGCCTCACAATGTCCGCCATC
TCCCGCAGCATCAGATCAGCATCCAAGCTGCGAGTCCAGTCGCGAGCCGCAAGTGGTCTCTGCTCGGCCTCCATCGGCG
CCGCTCGCTTTGTCTCGTCCGGCTTTGCTGTGCCTTCAACCCCCGCCTCGCGCAGCAACTTCTCGACTTCCATTCCCAA
GCTTTCTGGAGCGCCCATCATGTCTTCCTCGCGCGAGTACGATCCTGAGATCAAGGACATTGCCGACTATGTCGCCAAC
AAGACAATTGACTCTGAGCTAGCTTTTGACACTGCTCGATGGATTCTCCTCGACACCCTCGGCTGCGGTCTTGAGGGCC
TCCGCTTCAAGGAGTGCGCCAAGCTGCTGGGCCCGATTGTCCCTGGCACCGTCGTGCCCAACGGCACAAAGGTTCCCGG
CACTCCCTTTGTGCTGGATCCCGTCAACGGAGCCTTCAACATTGGCGCCATGATCCGATGGCTCGACTTCAACGACT > SEQ ID NO:897  216242  Trichoderma harzianum
GCTCGTTATTATCTTTTGTGTTTAATCGGTTGATTGAGAAATCATGGCGACGACTGTGTCGGAGGCGCCCAAGATGGGC
ATTGAGATGATGCTGGAGCGCATCATGGGCGCGATGGAGAAGCAGAACCAAGAATTGACTGAGCTGCGAAAAGAATGCT
CAGATCTTCGTACGTCGAACAAGAGCATGGAGATTATGCTCCAGAACATTGCTCAAGGACGCAGCAATAGCCCTCCGGG
TCTCTCCGCCGGCATGTCTCCCAGCATTGGCCGCGAGCGAGCCCGCTCGCCTTTCTTGCCTCGCCGCTCCACAGCCCCC
CAGGCTGGTCCTTCTCAGGTCTTAATCACATCGCCCTCTCACGATATCACCACCCACTCTTTTCCCTTCCCGGATGATC
GTGAGATCCCCGGATTCTACGTCGTCATCCCTGCAGGCGGTGCTGGTACCCGCCTGTGGCCCCTCTCTCGCGAGAACCA
CCCCAAGTTTCTCCTCGATGTCAACCTTTGCGGCAACAGCTTGCTGCAGTCGACCTGGGAACGACTTCTTCCTCTGGCT
GGCCCTTCACGAATGACTGTCGTCGCGGGACCTGCTCACTCCG
```

FIG. 1 continued

> SEQ ID NO:898 216246 Trichoderma harzianum
AAAGGAAACGCTCAAAGGTACGTTTATTACTTTGCACAGCTGCGAGACTCCCATCAGCCATAAGAAAACCAAAGAAAAA
CGGGGTTTGTTCATCATGTCACATCCACCACCTCCAGGCACGAATCTCCCTGCGCGCCCGCCCGCCAGCACATCGAGGC
CGGGCTTCAGATCGAGCTTCAACCCGTCGGGCCAGAATTCTGCCGCCCCGGTATCATCGTCGTCGACGTCGTCGTACTC
GAATGCAAACTCCGCGCGAGCAGCCGCCGCCTCGAGCTACCCAGCTGCCCAAACCCACTATGGCTCGTCCTACTCGAGC
TATCCTAGCCACGGTGCGGGCTCGTCCGTGAACCGCTCTGCTTCGGGATACTCGTACCCTCAAGCAGGCAATCAGCAGC
AACACTATCCCCAGCAACAACAAGCGCAAAGCTACGCCCCTCATGCCTATTCGCAGCAACAACCGCAGTCGTACCAGGG
CCAGTCATACCAGGCTCAGCCATACCAAGGCCAGCAGTACCAAGCAGCACCGCGTATCCAGAACCCTTTTCCTACGCCG
GGTGCTGCTGCTGCCGCTGGACCCGATTACGACCCGGACATG > SEQ ID NO:899 216249 Trichoderma harzianum
CAATCGCCAAATACACAAATCCATTGCGCTACAAAGAACAAGCACCATGGACGCCAAGCCTGCCACTTTCTCCTTGGCC
GCTGCGCCAGTTGCTTCTCCCGCAGCCTCCGCGAGCGCTTCCAAGCCCAAGCCGTGCTGCGTATGCAAAGAGGAAAAGT
CGAAGCGCGATGAGTGCATGCTCTTCTCAACGGCCAAGGATCCCGCAGCCGACTGCAGATCGCTCGTTGACCAATACAA
GAGCTGCATGCAGGGCTTCGGATTCACTGTATAAATCAAAATATCTTCATCTTGGCGCTATGCCTTTGTACATTATCAC
CATATAGACTACTCGGAAAAGTACAGCGCTCGATTATTCTAC > SEQ ID NO:900 216256 Trichoderma harzianum
AGCGCAGCAACAGCCCACGGGACAGGCGGGAGGACAGTCGCAGTCGGGACAATCTCAGTCGCAGGTTCCCCAGCACAAG
CGCGTCTACCAGGCGTGCATCCCGTGCCGTCGCCGCAAGGTGCGCTGCGACCTGGGCAGCGTCGACAACCCGCACGACC
CGCCGTGCGTGCGCTGCCGCCGCGAGAGCAAGGAGTGCTTCTTTAGTGCTACGCGCCGCAAGAGAAAGACGGACGAGGA
CGACAGCGATGCCGACGAGTACGTGGTGCGCAACGGCCGCAAGAAGCTGCACGCCGCCGACAGCCCGCCCTTTTCGCGC
TTCGACAAGCGCCAGTACAGCGACACGCCCCTGACCCCCGGGGGATCCCATGGCAGGACCCAGCCGCTGCGCAGGCCGG
ACGGCAAGGCT > SEQ ID NO:901 216257 Trichoderma harzianum
AGTGACGGCACTTTTCGACGACGAATTGACGAGCAATTGATCGATACACGCGGTTCCCGCTGCCAGAACAAGTCAAGAT
GGTTTCTCAGACTCCCTTCCGCGCTGCGGAATTCAAGAGCGCCTACGGCCCCAAGTACGCTTTCCAGCCCAACTACCGC
GGCATCACCGTCCAGACTGCCACCCGATATGGCTTCCGAGCTGCCACCATCGGCGGTGGTCTCGGCGTTGCTCTGATGC
TCTTCGCCTCCAGCCTGCCCCGTGTCCGTTCTGACATCCTCGTAAAAATCCCCTTGGTTGGCGGCTTCTGGGAGAAGCA
GGAGGTTCACCCTGCCGACAACCCTTTCTAAATGCACTTGTTGGATGGTGTTTGTAAAATTGTAACAAGGCTTTGCGCA
GCTTGCCTTTGTATAAGAGATACACAATAGACTTTTCCTAAACCG > SEQ ID NO:902 216259 Trichoderma harzianum
GTTGGAAGTATATAACTTATCCGGCTACAAGGTTGAATAGCGTTGCCCAAAATGAATCCCTATCCATTCCAATTCAACA
GCACATCCTCTTCAAAAGATGAATCAACCAGGGAT > SEQ ID NO:903 216262 Trichoderma harzianum
AGAGAACGCAGATACCTTCAACAGGCTCGAGGCTCCCGTGTCTCGTGTTGCTGGATGGAGTATCCACAACGCTCTGATA
TTCGAAAAGTTTCACGTCCCAGATGTTGCAAGAATTTACGACAGTATTAAAAAGACGGTTCAGTACTAAGAATGTGGGG
AGCGAGTAACGTGTGACTTTATCTTTGAATTTCTAGAGCTTCTTCCTAGCATAAGTGTAAATAATAGAGAATAAAGCTT
TCTGTAACACAC > SEQ ID NO:904 216268 Trichoderma harzianum
GACACACAGACGCACTCACACACTCAGCTTAAGCGAGCGAGCGAGTGAACGAGAGAGAGAGACAGAGATGGCGAGTGTT
GCCTCCTTCCCGGTGATCAACATGGAGAACCTGGAGACCGAGGAGAGGGGCGCAGCAATGGAGGTCATCCGCGACGCCT
GCGAGAACTGGGGCTTCTTCGAGATGCTGAACCATGGCATCGCGCACGAGCTGATGGACGAGGTGGAGCGGGTGAGCAA
GGCGCACTACGCCAACTGCCGGGAGGAGAAGTTCAAGGAGTTCGCGCGGCGGATGCTGGAGGCCGGCGAGAAGGGCGCC
GACGTGAAGGGCATCGACTGGGAGAGCACCTTCTTCGTCCGCCACCGCCCGTCTCCAACCTCGCCGACCTCCCCGACG
TCGACGACCACTACAGGCAGGTGATGAAGCAATTTGCGTCGGAGATCGAGAAGCTCTCGGAGAGGGTGCTGGACCTGCT
GTGCGAGAATCTGGGCCTGGAGAAGGGTTACCTGAAGAAGGCCTTCGCCGGGTCGAACGGCCCAACGTTCGGCACCAAG
GTGAGCAGCTACCCGCCGTGCCCGCGCCCCGATCTCGTCGACG

FIG. 1 continued

> SEQ ID NO:905 216272 *Trichoderma harzianum*
GCTGCTTCGTAAGATCAAGCAAGTGTACAATCATCTCATTCTCTATCTACTTATTAGTCATGGGGAAAAGAAGCGAAAG
TGAAAGCGGCTCAAAGCCGGAGCGGGAAGAATCTCACGGCGCACCGGCTGAGCTTCCGCAAGAGGTGATCCCTTTCGAC
CCGGTGCCGACATACGAAGAATCGAGGCCAGGGCCATCGGATTCGGCCTCACTTTCCGTCTCCCATTCACTCTCTGCCA
CAGTCTCGGCATCAACACCGCAGCCGCCGGCCGGAACCTCAGCCCTGGCCCCAACCGTTACCTCGCCATTTAATTTCCC
TACCGATGGCAAAGGCAAAGACGGCTCCGTGAATGCTCCTCCACCAGTCTACAAGGTCGGGTCATCCAGTAGCAGCTCC
AGCGCCGCCCGAACCATTGCCTTTCCTCAGATCAAACCAGATCCAGACTCGCCTTTCCTGGTGGCCTATGCCCCTGTTC
TTCTCAGCTATGGCATCACCGAAGAAACATGGCGGTCTTTCATGACCACCATCTCGGCTTTCCTGACGGGCACCATCTC
AGATCGTGCCCTATCACATGCCACCGATGTAGCTGCTCACATTGGCCAAA > SEQ ID NO:906 216274 *Trichoderma harzianum*
GAATAGTTTAAAGAGCAAGGGTATAAGACTGAATTAGAAAGTCACCTCCAAATAGCAAGAGCTAATGATAGCTCCGTGT
TGACTAAAGGCATTGCAACTCTATACTGTAGGTAGTTTAAAGCTCTCAACACTAA > SEQ ID NO:907 216280 *Trichoderma harzianum*
AGGACGCGTGGGCGGACGCGTGGGCGGACGCGGGGGCGGTATTTGACATCTACCATTGGCTTGGTGAAGGGTGACCTAA
TACGAGCTGTGATGCCTCGGTATTCAGACTCAGGAGGCGGGCTTCACACTCTCCGCCACAGCCAACCCGAACTCTATCG
AAATATCCTCCACGTCCTT > SEQ ID NO:908 216283 *Trichoderma harzianum*
GATTTCTCCACCACTCGCTCGGCATTTGTTCTCTCTTCCTCAGCGATTTAAAGGACCTGACCCGTCTCACGAATCAAGA
GGCATAACCGTTACTGCCATCTCAGACCGCTAAGCAGCGATATCGTCATATTCGCGGCGCTGTGAAGGACAAGAACGAG
AACGAGAACTGTTGAAGCTTGGCTCACCCAGTCCCCGCAGCAATGGGCCTGGCCTACAACACCTACCTCACCAGCAACA
AGATCTACGGTTGCAAAACATGCAAGGCGCATCTTGCGAACCACGAGGACATCATCTCTCGGAACTTCCGGGGCCAACA
TGGCAAGGCCTACCTGTTCCATCGTGTCGTCAATATCGACACCGGTGACCCTAATGAGCGTAACATGACCACCGGCCGC
CACATTGTCCGTGACATCGCCTGCCATCAGTGCAAAGAAACGGTGGGTTGGAAGTACGACAAGGCTTTTGAGACTTCTG
AAAAGTACAAGGAGGGCAAGTTCATCCTTGAAGCTGAGCTGCTATGTAACGTCGCTTGATTGTACGAATTTCACCTCTT
TAGCATGATTTCATCAAGATGGGCCCTTCTTTTTTCTCTCAT > SEQ ID NO:909 216284 *Trichoderma harzianum*
CTCCCGTTGAGCATACCCAGTCAAGATGAGCGCCATTAACAAGATCGCCGCCAACAGCCCCTCGAGGCAAAACCCCTCC
GAGCTTGAGCAGAACATTGCTCAGGCTCTCTTCGATCTCGAGACCAACACTGCCGACCTCAAGGTTGCCCTGCGACCTC
TGCAGATCGTCTCTGCCCGTGAGATCGAAGTTGGCCACGGCAAGAAGGCTATTGTCATCTTTGTCCCCGTCCCTTCCCT
GCAGGGCTTCCACCGTGTTCAGCAGCGCCTGACCCGTGAGCTGGAGAAGAAGTTCTCCGACCGCCACGTCCTCATCCTG
GCTTCTCGCCGCATCCTGCCCCGCCCCAAGCGCTCTGCCCGCTCCCGCAACACCCAGAAGCAGAAGCGCCCTCGTTCCC
GCACTCTGACTGCTGTCCACGACGCCATCCTGGCTGATCTCACCTACCCCGTTGAGATCGTCGGCAAGCGTATCCGCAC
CAAGGAGGACGGCAGCAAGACCCTCAAGGTCATCCTTGACGAGAAGGAGCGTGGTGGTGTTGACTACAGACTCGACACC
TACTCTGAGGTCTACCGACGATT > SEQ ID NO:910 216286 *Trichoderma harzianum*
AGACCATGACCGTGCAAGCCGAGCCCAAGGTGCCCATGGACGCCCTGGCTGCCCACACTCTCAAGCACGGTGTCATTCC
AAAGATTGTCATGGAATTCAAGGGCATCACTGTTGGTGGTGGCTACTCTGGCTTTTCCGGCGAGAGCAGCATGTACCGC
TATGGCCTCTTCAACAATACCGTCTCCGAGATTGAGATTGTGCTTGGCGACGGCACGCTGGAAACGGCCAACCGCGAGC
ACAATGCGGATCTGCTGGAGCACGCTGCTGGCAGCTTGGGCACGTTTGGCATTGTCACCCTGCTCACCATTGAGCTGAT
TCCGGCCACTACCTACGTCAAGCTGGACGTCCAGCTGGTCAACGACGTTGCCACCGCCCACGACTTGTTTGAGGAGGCC
ACCAAGGACGAGTCGATCCACTTCATTGATGGAGTCTACTTCCGCAAGGGCACAATTGCCGTCATGTTTGGCCGTTTTG
TCAACGTCCTCCCCCAGGGCAGGTCTGCTCTTAAGAAGATGGAGGTTCACTGGTTTGCCGATACCATTGAGGACGCTCT
CAAGAAGAAGCCCACCGCCGAGAAACCCATAGACATCTACATG > SEQ ID NO:911 216287 *Trichoderma harzianum*
CCCACGCGTCCGATCCCTCGGCATGGCGTCGTCTCTCCCCACCGAGCTCGGCAGCACCATCCAGGCCGGCCATATCAGA
AGACATCCCGACCCTCGACAAGACATTGCGCCATCAACCGCCGCCGACAAGAGGCAGCTGGTGGATTTCCACAGCGCGA
GACGCGGTGATATCGACAACGACGACGACGATATCCCGTACAGCGTCTTGCGTCCTCCAAAGAAGCACTACAACCTCCC
ACCCCTTCCAGACCTGCGATTCGAGCAGAGCTATCTCCACAGCATCGCCTCAGCCGATACGTGGTGGAAAGTATTACTC

FIG. 1 continued

ATTACAGCTAGGGATCAGGTATTGATGCCCTTGGCTCAGGGTGTCCTCCTCAACTTGGCCTTGGTTGGGTGGCAGCATT
GGAACAAGAATGCCAGAGTACACGGTGACTCAATAGGCATTCGCTTGAGGAGGTGGTGGTATGGGGTGAATAATTGGAA
ACTGCCCGCCCCTACTAAGAGACGGGTGTAGAGAATGATGGCGGTTGGTTTCAAAATAAATGTGAACACTCCAGTCGTG
AGTATGTATTACTACTATC

> SEQ ID NO:912 216302 Trichoderma harzianum
GGCAAAGGGATATGTGAATTTGGCGGTATACTTTTCTGTCTGAAGGTCTAGGAGGCGGAAGCCCTGGTCATTGCTTGCA
ATGGCGGCGGCAGGACTGTCAGACCTCCTGGGTTTGTATATCTTGATGTGGTTGGTAATCCCGCTAACGTCGTTGGATA
TCTGTCCCTCCGAGTAGCTCTTCTTATCCTCGGCAGTCAATGACTGCAGGAAGTAGTCGCCATTGAAGGTGCCGGCCAT
CAAGACACCGCAGCCGGCATCAAGGGTTGATATGGCGGGAGACGCCATTCCAGCAAAAGCACGCAGATTCATCGCTAGG
T > SEQ ID NO:913 216304 Trichoderma harzianum
AAAGGAGAGCAAGACAGGGCAAAGTAAATCAAATCTGTCGTGGTTACATTGCATGGTTTACTTTGTACGCACTGTCGGA
TCGGCTGGATGCTTGGCAGCTTTTGCGGCGCGGCGTCATCAATGAAATATTCATCTCTCAATCCAGGCACGCGAGCTCT
TTTCGAGATTTCCCTGGAAAAGCCACACAAAGAAAGGCAATCTAGGTGTTGACTAAGCTTCTAGATAAGAGCTTCACTT
CATCTTCTACGTCTTACACAATATCGCATCCCACCTCTTCTATCACCATGCCGATGCATAAGGGCTTCCTGCCGCGTGA
AGGTCTGTGTGCCGACGTGATTCTCAAGCTCATTCGCAGAACACTTCTGAACCCGAACCTCCTGCTGCCTTTGCTTCTG
CTTGCCCGCTACACCAAGAAGGGCCGGGACCTCTCGATCCTGCATCCCAAGGCAGCACGGAGGCTTAGGCTGCTCTTCT
ACGTTGCCGTGGCTCGTGGCTTCAGCGGTTGGCTCTCAGACAAAGTCCGCAACAACTGGGTCAGCGACAGGTATGAGTG
GTCCAAGGAGATTGTGCTCATCACGGGCGGCGCGTC > SEQ ID NO:914 216315 Trichoderma harzianum
AGTCCAGATAGTCAACAGATCAAACACAAGACAAACCTGCCTGTTCGATTACTTTGCCTCCTTGTAGTACAATTCGCAA
TAGTTCACCAAATCACCAGTCATCATGCCTGTCACTGAGTTTGCCATTATCAAGCTGAGGCCCAATTTCGACCCCCTCG
AGTTTCTCGAGACACTCATGGAGTGTCAAGAGATTCAGGACAATTGGATTCGCCGCAATCAGCCATGCAATCTGGCGCC
TGGCATGAACCTGAGCAGCATGTACACGGATGCCACAGACCAATCAACACTTCTCATCACGGCGCCGTGGGATTCGCCC
GAGGGGCATGGGGAATGGATCCAGAGTCTTGAGAACAGGACGGCCAATGGCAACTTAACCGAGTTCAGCGCTCCGGGTT
GCGACTCCGTCTTGCTCTTCCACATGGACCCGGCGGGAGCGAGGCCACAGATGCGGGAAGCCTTTCAGCACAAGGATAC
CAACGACGTATTCGACGTCTGTCGCTTAACATTCAACGGCGATCAGCGGGAGGCAATACAAACCAAATATCAAGCACTG
GAAAACGAGCTGCGAAAGGAAGGTCTGGAGAAGAGCATATGGGCGGGCTGGAGGATTGAAAA > SEQ ID NO:915 216318 Trichoderma harzianum
GTCGTGGATAGCGGATGGATACTTGCAGGGAGTATGGGGTAAGTGAGTGAGTGAGTGAGTGATATGGATACAGCGGGAT
GATGATGATGGTGGTGGTGGTGGTGTTGTCACTGATGTTGTCGAGTGAGTTGTTTGTTTTGTTTACCTTTGGAATTGAT
TGAAATGAAATGAAATGAAACAGG > SEQ ID NO:916 216319 Trichoderma harzianum
AAACCACCGTCATCATGCCTCCAGCAAGGTACTCGCGCCCGCCACAACACGACTCGTGGTTCGCGCCTCTATCCGTCGA
CCTGATCCTCAAGGTTCTCAACGTCACCATCTTCCATCCCTTCATCTGCTGGCTGATCCCGCTGTGCCTGCGCGCCCAG
ACGACCAAATGGGAGGCGCCGCCCATGGTGGGCGCCATTGCCTGGGCCATCTTCATCTCGGCCATGTGGATCGCGAGCG
CGGTCAACCAGCGCATTGCCAACGGCGCGCCGCCGAGGTGGACCTGGGCGAGGAGGTGATTGTGGTGACGGGCGGCGC
GAGCGGGCTGGGCATGCTGGTGGCCGAGGTGTACGGCATGAGGGGCGCCAGCGTGGCCGTGCTGGATGTGAACGAGATG
GAGAATGGCGAGGCGAGGGGCGTGACGTTTTACAAGTGCGATGTGAGCGACAAGGAGCAGGTGGCCAAGGTTGCCGTTG
AGATTGAGAAGGATCTCGGTACGCCTACTGTGCTCATTAACAACGCTGCTATTGTCGTGGGCAAGCCGCTGCTGGACCT
CTCCATCGATGAGATCGAGACCAGCATCGGCACCAACCTCCTCGGCCCCTTCTACTGCCTCAAGACATTCCTCCCAGCC
ATCAT > SEQ ID NO:917 216329 Trichoderma harzianum
GATCGGGATCGAGTGGGGAAATAAGATGGAGAGTCGAGAGTGCCTTATGTAAAAACCTGACCACCGGCAGGATGGAATC
ACCAGAATCACCAGACTTGTCTCCGGGTCTTTCCTCTATCCTGCATTTTCCTGCAGGACAGGGAGAGCTGCCTGCACCT
GCACACCGAGGTACCTGGATACTCCGCGTGGTGAGGGGCAGGCAGCGTGCGTCCGAGGTACTGCCAGGCTGCCAGGTAC
TTGGGACGGCAGTGCACAAGCTCCGTACTTGGCGCGCCCTGCCCTTTGGTCCAGCTTTGGGAAGAGATCTCCGTTCCGG

FIG. 1 continued

```
CTGCCTATCCTCCGCTTTCGTGCAGCTGGGGGGAGGGTTAAAGACGGCTTTCGGTCAAGAGTCGAATCGGTCCTGATTC
AGAAAAGAAAACACGAACAAAAAAAAAAAA

> SEQ ID NO:918 216332 Trichoderma harzianum
ACAAGACCTTGTGTTGCTTTCTGACCAGCTTGCCGAGAAGGAAAATGAACTCCGTAATGAGATTGAGACCAAGGTGCAG
AATCATCGGAGGTGGAACCAGAATCATATTGATCTCACTCGAGATCCGCTTTCGCCGGTAAAAGCATTGGGTATGGAGC
TCAAGTTCAGACCGGCAAAGACGCAATACTTAATGACGCCGCCGGCGTCAACGTCTTCAGAGTCGATGGATGTCGACGA
CGTACCTGAGCCTATGCAACTGGACAAGCTAGAGCTGCCAGTATTCCAGTTTCGTGGTGCGGACGTCGACGAGACACCG
CAAACTAATCAGCCGGCGTTCCGACGCCGTATCGGCCGACTCCAACGGCTCTGGATCGATCGAAGAGGTCTTTCGACAC
CTTCTAGGGCAGATGCGTACGAGTACTCGGACCGGTGGAAGTATGATTCTGATGATGAAGACGATGAGCCTCCCGTATA
CGAGGTTGATCCCTTTGACACAAGAGCGCTGAAGTTTAGGGCTACTATCCCTCTCAGCCCATACATCTTCCGGGCGAGG
CCAACGGCCCCTACAGAAGCG > SEQ ID NO:919 216338 Trichoderma harzianum
GGGCGGACGCGTGGGCGACCACCAGCGCCGCCAGAATGTTCGCCGCACGATCAAGGGCAGTCTGCGCCGCCCGCCAGCT
GCAGCGGACAACCCGAACCTACGCCTCCGAGTCCCACGGCCACCACTCGCCCGCTCCGGTCAACGAGTCCTTTGGGGCC
GGATCTGTTATTGCCCTGGGCGCTTTCCTGGGCACCGTCCTAGTCTACCAGTTCCGCCCCACGGAGAGCGACAACTGGA
CGCCCTCTGCCCTGCTCAACAAGTATCGATCAAAGGCCGAGGACTGGGAGGCCGTCAACACTCTGCACACAAAGGCCAT
GGAGCAGGCCGGCTATGACAGGAATCTGTTCGAGAACGGCTCCAACAAGCACCGATTTGTCGACGTCGCATACCCCGAA
GCTCTCCAATCCCACGCCGCGCGAAACATCCAGGCCGGCCACCTTGCCAACATTGACCATGCTGTGGAACACTACCGAC
AGCAGCACCTGAAGATGGAGGAGAAGAAGGCGGCCAAGCTGGCGGCTGCCAAGGCAGAGTAGTTGCAGTTGCTACAGTA
TATCCAATTTATAGAACAAAGTTT > SEQ ID NO:920 216339 Trichoderma harzianum
AAACAAGCAAATCAATTCCCGAGCAAGAAAAAAAGAAGAAGCCCATCATGAAGATGCTTTCGTTTGCCGCCCTCTCGGT
GCTCGTGTTGGGCGCTTCGGCCCTGGCTGCGCCGCCGGCCCACCCCCCGGCCGACAATGGGTGCTGCTGCTGCGACATC
AACAAGAAGAGAATCGACTGCGACAGGTCGATCCCGGCGTCGGAGTGCATCTGCCCCCAGGTCATCTGCCCCGCCGGCG
CGCCCACGTTCACGCACGGCACGCCGCCGAAAGCCACCCCACCGCCCACGCCGCTGCCGACTTACAAGCAGTGCTGCTG
CTGCAATCCCAACATTAACAAGATTGTGTGCTCGCTGAGGCTCGTGGAGGACTGTATCTGCTTGGCCGTGATGTGTCCG
ACGGATGCAAAGACCATCTTTGTCAGGCCAACTGGCGTTCCGACTGTCGCTTAAGAGTATTCGTTGGCGAGCCGACTTG
CCTGAATCCTGGACCGGGGACATGACATGGGGGAGGGAAAATACAGGGGCAAGGCATTGCTGATGGTGAATGCACAAC
ACGCGTGGCAGACTGGCCGAAAATTGATGATTTACTGATGGGCGACTTTGGACTTGAAATGGGGCATGCCGGATGGGTT
ACTTGACAGTATTTACACCATTTCTATTCAACAATAAAT > SEQ ID NO:921 216345 Trichoderma harzianum
ACGGGACGAGCGATCGATCAAGTCAGAGACAACAAATACCGAGTGGCGATGCCTTCATCCGATAGTCTTGGGAGGCGGG
CCTCACACGGCGCTGCCAGCCTGGCGACGTCGGCATCTTCTATACACGGCGCAGCAGTTGGGTTTCGAGAAGGCCTGGG
CTTGGCTGGAGTTGCGAGGAGGACGTTGGGAATCTGCTTTCTGCTATTGACGGTGTTTCTATGGACGCTGTCCAACTTT
CTCGCCAGCTTTATCTTTTCCGATGCAACCTACGATAAGCCCTTCTTCCTCGTCTACTTCAACACCTCCATGTTCGCCA
TCTCTTTAATACCCATGTTTGTACGATATCTGCTCCAGAAAGGATTCCATGGCCTACGAAGCGACGTCAGGCGCATGTG
GGCGGAGCATCGATACCAAGCCGCCCCAGGCAGTCCCGCGATAGATGAAGAAGATCACCTAGCTCAAGAACGCTTGCTA
GTAGACGAACGAGACCCCATGGCACCAACCTCGACTCCTTCAAAAGAGAAGCTCAGCTTCCGAGAAACCGCAGTACTGA
GCCTGGAGTTCTGCATGTTGTGGTTCCTCGCAAACTATTTT > SEQ ID NO:922 216349 Trichoderma harzianum
AAGGGCATTGAACCTCGATACGAGTTCGGGTGTGGACTTGGTTACACGACCTTTGCATATTCCAACATATCCATCAACT
ATATTCAGGGGGCAAACACGTATCCATGGCCGGGCGGCCCTATTGTCAGCGGCGGACAAACGGATCTATGGGATGCAAT
CGCCACCGTCAGCGTAAACATCAAGAATACAGGCAGCGTTGCTGGTGCCGAAGTGGCGCAGCTCTACATTGGTATTCCA
GGGGCTCCGGCGAAGCAGCTTCGCGGCTTTGAAAAGCCCTTTTTGCAGCCTAATGAGTCACAGTCGGTGACATTCCATC
TCACAAGAAGAGATTTGAGCGTATGGAGCGTGGAGAGACAGAAGTGGCAGTTGCAGCAGGGCAACTACAAGTTCTACGT
TGGGAGCAGCAGCAGACGACTGCCCCTGAATGGGACGATGGATTTATAAGAGAACCTCAGCAAGGCCAGCGGACTTTCA
GATGCAGCTCGAGTATGCCAAAATCGTATGCTGCGTGATGAATGGAGCTCTGTATGGGGTACATCATGTGTAGATACAG
CTGCGAGAAGGTTGTTGTTTCCTCCTTCAAGCGAGCTGAGAAGGCAGCAACTAACCGTCTATTGGGATAGATCG
```

FIG. 1 continued

> SEQ ID NO:923 216352 *Trichoderma harzianum*
TCGTCACTCACACTCACAACTCAGGAGGGGGGAGGATCTCCAAACCTCTACTCCTTAATCTACAATCCTCTAGTCTTCA
AGACAAACCCCAAAAACTCCATTCAAAATGAAGTTCTTCACTGTTGCCACCGTCTTCTTTACCGCTGTCCTCGCTGCCC
CAGGCGGCTACTACCCTCCTCCTCCTCCTCCTACCTATACCCTGGCTCCCAATGGCAACGGCAACGGCAACGGCAACGG
CAACGGCAATGGCAATGGCAACACCAACACTGGCGGTTCTGCCCTGTGCCCTTCTGGCCTCTACTCCAACCCCAATTGC
TGCGCCACCGATGTCCTCGGCCTCGCTGATCTCGACTGCAGCGTTCTTCCACAACTCCACACGATGGCGCTGCTTTCC
GAAGCATCTGTGCGGCGACTGGCAAGAGAGCTCGCTGCTGTGTTCTCCCCGTTGCTGGCGTAGCTGTTCTTTGCCAGGA
CCCCATTGGCGCCAATTAAAAGGCATCGCCAATATGACTCACGAGGTCCTTTGATGAATGTGTTATTGCACATGGCTCG
GACCTACGGTATCAAGACTGAACACTGACTTGAACATATGAGTCGTGAGCTTTTGGATATATGGAATATG > SEQ ID NO:924 216357 *Trichoderma harzianum*
TTACATATTACAAACTGTCCTCTTACATGGGAGAAATATCCAACATAGACAGCAGACTCTCTCAAGGGCATGACCCGAA
CCGCAAAGTGCAGGCCATTTCCCCCCTCAGCTCCGATAAACGGCAGGGAGAAAAACTACGACCAACCCCGAGATGAGCA
CAAGGAAAACTTGGGCACCTTCTCCGTGGCAAACATCCAGGTCCAGATCCGGGAGCTCAAGCACCCCGGTTCACAGCGC
TTCCTCGGCGCCGTCAACGCAAACGATCTCCTCACCAGAGGCACTCTGAAAGTCCTCAAGCTCTTGTACAACACTCCCC
CAAACCCGGAGACGACCGTTCCGCCAACCAGCTCCGTGACGCTCGTCCTCGAGGATATGCCCGGCGTGGCCTACA > SEQ ID NO:925 216358 *Trichoderma harzianum*
GGCCAACATTGCGACGCAACCACAAAGGGGAGGCTTTGACACTCAACTTTCTTTGAGCTCCACCCGGCACTAGGCGGAA
GAGGCGCGTCTAACTGAAAAAAGAAAAAAGCTTTTTTTTCTCCGAGCAGGTTCCCTCTCGCTTTCTCTCTCGCGCGGA
CAACGGAACGAATCGAAACAGCCTCGTCTTTGTCCAAGCTCCAAGCTCCAAGCTCCAAAGCTCAGCCTCGCATCCGCCC
GCCATGGACGCCGTCCGGTCTCTCGTCCAGCCCATCACACACAACCTGCCGGCCCCATCCGGGACCTAGGCGTGTCGA
TCGTGGGCGAAACCTGCTACAAGGCGCTGCTACTCGACGTCGACGTCGAAAACACGGAATGCATCAAGCTGGCCATCAG
CAAGGGCCTGGGCATCGGCATCGTCGGCGCATCGGCCGTCGTCAAGGTGCCCCAGATCCTCAAGCTGCTGCGGTCCAAG
TCCGCCGAGGGCGTGTCCTTTTTGTCGTACCTGCTGGAGACGAGCGCGTACCTCATCTCGCTGGCCTACAACGTGCGCA
ACGGCTTCCCCTTTAGCACCTTTGGCGAGACCGCCTTTATCATGGGCCAGAACGTCGTCATCGCCATGCTCGTCCTCAA
CTACAGCGGCCGGCCCGCCAC > SEQ ID NO:926 216360 *Trichoderma harzianum*
AAGCCTCTTCGACCACCCTCTGCCATCGTCAGCCTTCGACTCTCTTCACCAAACCTCAACAAGCGACAAATTATCGCCA
GGGTGCTCCAACGCTCGCTCCGCCATCGCCAGTATCCTTTGGACCCATACTTTCGCTCTACAACACACACAACCCCTCT
TACGCCCACATAGCTTCGGCTACGTCAAGTTTCGGCATCATGTCTAGCAGAGATCGCCGTATAATGAAGGAGCTGCAGG
ATCTGACCGAGGACAAGGACACTTCCGGCATTCATGCTGCCCTAGAACAAGAGGGCTCGCTGACCGCTCTCAAGGGCTG
GTTCTTTGGCCCTGGAAATACGCCGTACGCTGGTGGCAAATTCGTGATTCACATTCAGCTTCCCACCGACTACCCCTTC
AAGCCACCCAAGATGAAGTTTGAGACCAGGATCTGGCATCCTAATGTCAGCAGTCAGACGGGCGTCATTTGTCTCGACA
CCCTCAACAAGAACTGGTCGCCTGTCCAAACGATCAAGACGGCTCTCCTCTCCGTCCGAATGCTTCTCGAAAACCCAAA
CCCCTCAGATCCACAGGACGGCGAAGTTGCACGGATGCTGCTCGACAGTCCCGACTCG > SEQ ID NO:927 216362 *Trichoderma harzianum*
GCGCTTGCGTTGCGTGTACCTCCGTGAAGCAAAAATGCATGCTACATCGGCCCAACATGTGCCAGAGATGCGAACGCCT
TGGCAAAGAATGTGTCTTTCTCGAGTTGTCACAACGGAAGCGCAAGCGCAGCGAGTCTCGGCGCGTGGAAAAGCTTGAA
AACACAGTTAATCAGCTGATTACGCACTTGACAGGCCTGACAGGACAGGATGTAACACCGCTAGCATCACCCTCCCGAA
CAACACAGTCCGTGATTTCTTCTGCCGAGGGCATGTTGGCTATCCAAAGAGATAGTTCTCTTTCACAATCAGGGGACCT
ACAAGACCGCAGTCCAGAGCCCGTAATTGGACATGAGAGTGTTTGCTCTATTGTTTGGAAGCTCTCAATAACGATGAA
ACAGAGGCGCTCCTTCAGAAATTCCAACAAAAATTCGTACCTATTTTTCCTTTCGCGGCGATTTCTATATACAAAGGCT
CGTATCACATCAGGCATCTAAACCCTTTTCTGTTCCTGTGCATCATGGCCGTAACTATAGGACCAAAGCATCCTTTACG
GGCGCATGTGCAACATGAAGTCGTGAATCAGGGCATCCGCCGAATG > SEQ ID NO:928 216365 *Trichoderma harzianum*
ATGAGACCTGTTCGGAAGATTCTGCAAGGGAGTCATTTCAAACCCGTAATGAAAGATGGCAAGAGAATGTTGACGCCTT
GCTCTCCAGGAGACCCGGAGAAGATTGAGATGACGTACGACGATGTCAAGCCGGAAGAACTGTCGGCTCCGGACGTGAC
ACTCCAAGATTTTGAGATAGCTTTGGCCGACTCACATCCTACAGTGTCCAAGGATGACATTGAGAAGCAGATTGAATGG
ACGAATGAATTTGGAAGCGAGGGAGCTTAGGCAATGGGGCGTGTCTTTGAGAGTACATGGCACAGCGGCGCTTTGAGGA

FIG. 1 continued

```
GTTAGAGGGGCATCTAGGCACTCTTTGCACATACAATGTTGAATTCGGGAATCGTAATGCATCTGTCTTACTGGAAAAG
AAGAAGAAGCTGTTCATATTCGATTCTTTTTATGGTAGATAGTGGGCCGGCATCTTTGTAGGATGTGATTAATTTTGAG
TCCAAGATGAATT
```

> SEQ ID NO:929  216371  *Trichoderma harzianum*
```
CCCACGCGTCCGCCCACGCGTCCGCCCACGCGTCCGATGTATTCAGACGGCCAATCACCGAAACAGCACAAATAAGAAT
ATAAGCAATTATTGGTATGATATTGCAAGCTACATGAGTCAAACATCATAAAGCACCTAAGATACAGAGAGTGAAATTT
AAGCTGCCTGCTTCGTCAGAGCTTCGCTAATACGCCAGAGCTTTTCTGCCTGTGCGGGATCAACAGCCCCAGGCAACAA
GCCCTCTTTTGTCAAGACTCCGTCGGCCAAGTAGTAGCCATCCTTGTCTGACAAAATGTGTTAGTATTTGATTAGGTTA
CATGAGTGAAGTTGAGGTATAGGAATGCTGGGATACACTGGGTGTGACGTACTGGACAGTCGAGAGTCGAAAGCGGCGA
TAATTCCAGTTGAGGATCCCTCAGCCAAGGTCTTGGCCTTAATCGCCGAGTTCAGGTTACCGTTGTCATCGATCCAGCC
TATCGCATATTAGCATTGTGACAAATTCAGAAAGACAAGCAATGAACAGTAGGATCAACGCTGAAAGAGCGCAATCCCC
GCTGGCCAAAGTGCTGGACCAAG
```

> SEQ ID NO:930  216373  *Trichoderma harzianum*
```
ATTCCAAACGCGCATCACGACCAGCGATGGTTACTTCCTCGAACGGACCAAACGAATACTCTGGACGAGCTTAAAATCC
CTCAAACTCATTCTTTTATACGCCATAGATCCCCTAATTCTACGGACGTTGCGTCCAGTCCGCAGAGCCCATCATGCCT
TCTGCGACCGGTCAAAACTGGGAGAAATACACCAAGAAATTCGCCGACGATGAGATAGAGGAGAAGAAGATCACACCTC
TCACCGATGAGGATATTCAAGTGCTCAAGACATACGGTGCTGCCCCATATGCATCGACCATCTCAAAGCTCGAGAAGCA
AATCAAAGAGAAACAACAGAGCGTAGATGAGAAGATTGGCATCAAGGTATGAGTCGGCGCAACTGCGATGCGTCTACGG
CTATCTAACGTGTTGACGTAGGAGTCCGATACTGGTCTCGCACCGCCGCATTTATGGGATGTGGCCGCCGACCGACAGC
GAATGTCTGAAGAGCAGCCTTTCCAGGTGGCACGTTGCACGAAGATTATTGCGGACGATAAGGGCGACGAGTCGAAGAG
CAAGTATGTCATCAACGTCAAGCAGATTGCCAAGTTTGTCGTCCAGC
```

> SEQ ID NO:931  216384  *Trichoderma harzianum*
```
GGAAATTGCCCTCCAACCGCAACCATGTCGACCCTCCCCAGGACTCTGGGCAACCTGCGCAAGATTGGCATCAAGGAAT
ACTTCCGCCAGATGCTGTACATCGGTGACACCAAGTACGGTACTCTCATCGGCCAGGATCGCTTCGGCAACAAATACTA
CGAGAACCTCGAGGAACTGCCCCTCCGAACCCGCTGGGTCGACTACGCCAAGCACGACTACGATGCCTCCCACATCGAG
CCCGGCTGGCACGCCTGGATCAGCTACTCCGTCGACAAGCCCCCGACCCAGGACAGCCTCATCGCCACGGGCACCAGAC
ACTTTGAGCCCGCCCTTCCCAAGCCCAACTTTACCGGAACGCGAGGCGCTTACAAGCCGTATAACACAGTGAAATCGAA
GCTTAATGCTTGGGAGCCGGTGGCCAAGGATCGGGTATGAGTGGTTTTTACGTTTTCTTTTTTAAACCGTGGGAAAATA
TGGTGTACATATTGAAATCGCGCAACAAACGCAAACAAATCAAACAATAGACACAGACATGTGA
```

> SEQ ID NO:932  216387  *Trichoderma harzianum*
```
GCGATGTGAGGCTGATTTGGGGTGTATGATTCGTGAGCGTGTAAGAGGAGGCAGCCCACGACTTTCTCTCTGTGTCTGT
GCTTGCTCACTTGCTCGCCTCCTTGGATTCGGCCTGTTGATCCGAATCAGAAGTAAATGTGTTTGAGACTGAGACTTGG
TCTGGTCGAGACGATATGAGATGTGGCATGGAATTAGAAACACGTGTTTGGTATGGCGATTGCGATGCGATGATCCGCA
GAAAGCAAGATCTCAGGGCGACTAACACGGATATACGGAGGTTCGACCAAGACACGAGGAATGATGGGGAAAGTCTCAG
TATGTCACTACGGAATTTATGATTACGTAGCAATGTATGAATTATCATTTCAC
```

> SEQ ID NO:933  216403  *Trichoderma harzianum*
```
GGCTGCACATCCAGATGCTAGATCTGGTCAGAACCAATTCATCGGAAGTCCGATCCCATACGAGTACTCGTATGACGAC
ACTTGCTCACTGTCATATCTG
```

> SEQ ID NO:934  216406  *Trichoderma harzianum*
```
AACCAGACGGAGAGTCTGTTTCATACCTGGTCCCAGTTCTCGACTGGATCCAACATCCCACCTAAGCCATCAGCAGAGG
AGCGTGACATAGAAGCGAGATTGGAGGATGTATTAGACAAGCGCGACAATGTCATCGCCCAGCTCGCCCGACTTCTGGA
TTCTGAAGCATCCCTCAACACATCCGCGCTCAAACAAAACAACCTATCCCTGCTCCGAGAGAAGCTTGCCTCTCATCGC
CGCGACCTGACCCGTCTCAAGTCTACACTGCAGCAAGCTCGCAATCGCGCCAACCTCCTCAGCAACGTGCAGTCCGATA
TTGACGAGTACCGCGCGAACAACCCGGAAGCTGCCGAGGCCGATTACATGTTGGACGAGCGTAATCGCATCGACAGAAG
TAACGATGCGACAGACAGCGTCCTCAGCCAGGCATATGCTATCAACGAAAGTTTTATTATCCAAAGGGAGACCTTGGCG
AGCATCAACCGGAGAATAACCATGGCCGCCAGCAAAGTGCCAGGCATCAACTTCAATAATTGGACGTATAAGTACCAGGA
AGAGGAGAGATGGAATCATTATGGGAACTTTTATCGCATTGTGCTTTATCGTCTTCTTCTGGTTCAGGTAAACGGGCCA
TCATACATTCACCGGTGCTGCACATGTCGTTTGGCGTTTAGGGGGGGTATATCAGC
```

FIG. 1 continued

> SEQ ID NO:935 216408 Trichoderma harzianum
ATCAATCTAATCGCAAGATCGCAGCTCGGGCCCAAAATCAGTCAAAATGGCCCCTCAGAAGAAGAGCAAGAAGGATGCC
AACAGCATCAACTCCAAGTTGGCGCTTGTTATGAAGTCCGGAAAGGTCACTCTCGGCTACAAGTCTACTCTCAAGTCTC
TGCGATCCGGCAAGGCCAAGCTGATCATCATTGCTGGCAACACTCCTCCCCTGAGAAAGAGTGAACTCGAGTACTACAG
CATGCTGTCCAAGGCTCCCATCCACCACTTCGCTGGTAACAACATTGAGCTCGGCACTGCCTGCGGAAAGCTCTTCCGC
TGCTCCACCCTTGCCATCCTGGATGCTGGTGACTCTGATATCCTCAGCGACCAGCAGGCTTAAATAGCCGAAATCTAGT
GCATTCAAAACGGCGTTGGGGGTAAAACGGTTCAAGGGCAATATGGATACCATACACTTTCACATTATGTGCGAGACGA
AAACTTTTGATGCGAGACATCATCTACTAGGAAGGCAAATCCTTTGGGGATGGAAAAAAGCCCCAGAAATTTCCAAGTG
ATAGTTATCTCAATGGAATAATACAGCCATGA > SEQ ID NO:936 216419 Trichoderma harzianum
AAAGGGGGTGATATTGGGATACCTAGGGACGCCTCTCAAACCGGCCTGTTCCATGAAGGAAACCCTGCAGCAGCGCCGT
TAGACTGACCTGACTTGACGAAAGCACCGGTCGAGACAGGATGAATTTGCGCAGCCGGGCATCGCAGCCGCACCCGCAG
CGCATCGCATCGCATCGCATCGCAGCGCATCCAAGACAAGGCCGGTCCGGGTCCGGCCCAGCCAGCTGCTTTTT
TTCATCATCTTCTTTTTGTTTCGGCGCCCCTCATGATATCAGTCCAGTGACGCTAGAGCAGGTGTCACATGGCCGATGA
CAACAACGTGGTGGTGCAGCTAAGCTCCGGCTAGCTGTTATCTGGCGACGGAATGTGTGTGATGCCATTGGGTGGTGTT
GCGAATGGCTGCTGGTTCGCGCGGGCTCACACTCACACCATCCATCACCAACAGCCCAATGACCTGTTCAACGTCCCTT
GCCCCATACGGTACTGTACATACATGTACTCGTGCAGTCCAGTCCAGACAATCTCGCTGACGGAGGGGCGCGCCACAAG
TGGAATCAATGGAGTGATCCAATGTGAAGGCATTTCTGTCTTCTTGGACAGGCAGGGGGT > SEQ ID NO:937 216425 Trichoderma harzianum
GGCCACTGAACTGCGCAGCTTCGGCGAGGAACCATGACTTTCCTCATACTTGTGATTGGGGACCTGCACATCCCGGACA
GGGCGCTGGACATTCCCGCCAAGTTCAAGAAGCTGCTTGTGCCCGGCAAGATTGGCCAGACTCTATGTCTCGGTAACCT
CACCGACAAACACACCTACGAGTATCTCCGGTCCCTGTCGCCGGACCTTAAGATCGTCAAGGGCCGCACCGATGTCGAA
GCCACGTCTCTCCCCTTGACGCAGGTCGTCACTCACGGCGGCATCCGAATTGGCTTCCTGGAAGGCTTCACGCTTGTTT
CTAACGAGCCCGACCTGCTTCTAGCTGAAGCCAACAGACTGGACGTCGATGTCCTGTGCTGGGCGGCACTCACCGTTT
CGATGCCTTTGAGTACATGGACAAGTTCTTCGTGAACCCGGGCAGCGCGACAGGAGCCTTCTTGACAGGAGCAAGCCTG
GATGCGGAGCCTACGTCTCCAAGCTTTTGCCTGATGGATGTCCAAGGCATTTCATTGACTCTCTATGTTTACCAACTAA
AGACGGATGAAAAGGGAAATGACAATGTGGCGGTAGAGAAGGTTACTTATACAAAGCCCGTGGAGCCATCTATGGGTTC
ATCATGACACACCTGACTTAATTGT > SEQ ID NO:938 216427 Trichoderma harzianum
ACGCCTGTTCCCGAAAAACCGTCAACTTTCCAACATCGACCCTCCGAGCAGCAAACCGCCACGATGTTGATTCCCAAGG
CCGACCGCAAGAAGATTCACGAGTACCTCTTCCGCGAGGGTGTCCTCGTCGCGCAGAAGGACTTCAACCTCCCCAAGCA
CCCCGATATTGACACCAAGAACCTGTTCGTCATCAAGGCTGCTCAGTCCCTCAACTCCCGCGGCTATGTCAAGACTCAG
TTCTCTTGGCAATACTACTACTACACCCTGACCCCCGAGGGTCTCGACTACCTCCGGGAATGGCTTCACCTGCCTGCCG
AGATCGTTCCTGCTACTCACATCAAGCAGCAGCGATCACACGCTCCTCCCCGTGGCATGCTCGGCGAGGGCGAGCGTGA
GCGACGACCTTTCGGTCGTGGACGTGGCGGCGACCGTGGTGACCGTGAGGGTGGATACCGAAGGAGGGATGCTGGCGAG
GGCAAGGAGGGTGGTGCTCCCGGCGAGTTTGCTCCTCAATTCCGTGGTGGCTTTGGCCGTGGACGTGGTGCTGCTCCTC
CTTCCTAAACGAATCTGTCTCTTTCGGGGTTAACAAATCTTATGATGCATGGCGCAATAAGACAACGGCATGTAGTCTA
AAAAAC > SEQ ID NO:939 216429 Trichoderma harzianum
ACCATCTCGCTCCGGACACGGGAGAGACTGCGCTGTCCATCTGATGGCCTAGATTGGCAGACGCCGGGGCAATTGGCAC
GTACGCTGCCACCGACTTTGCATCCCCGGGGTCCTGTCCTGTCTCTCCAAATCCAAAGACCTCTTCTCCATCGCACACG
AAGCATCGAGCCAGAGCATCCAGCCCCGCCCAGATCCCAGCCCGAGTACGTTGCGTGAATGAGCGGCCAAGACGGGACA
AATCTCGAGGTTACGCTGCATCTGTTCTAACCTGCCACGCTGCTACAGTACAAGGACACCCTCAATCACATACGGATCG
GCCCTGCGAATCAGCCCTGCGACTAATAATAGCCCTGTGAATCGGCCCCTGCTGAACCGCCATCCG

FIG. 1 continued

> SEQ ID NO:940 216430 *Trichoderma harzianum*
GTACCGGCTAAATACTCGACGAAATGGTGTGAATCGTCGCGTAATGGTTGGACGATGGAGCGATGTCTTTATACTCTGC
TACGCTTACTTATCCACAACTTTATTTCGATTCACCGTGTGCTACAAATAGCACCCCACGGCGGGCTCTCGGAATTATA
GCTACAGTATTAAGCAATTGTATAATAGATTAAGGTTAGTTTTCCGAGTGAGCCGTTGCATCTCGGGCGGCAATCTGGG
GAGCATATTAGCAATAGATGAGCAATAG > SEQ ID NO:941 216432 *Trichoderma harzianum*
GGTGATCTGAAGAGAATGGGTCGACCAGCGCTACTTGTACAGTATCGAATGCACGATGCGTCTTATGATCAGCGCGTGT
CTTGCACATATGCATACGTCAAACAATGCATCCTCCACAATCTTCATCATCACTCCACAAATAGCTTCCATGTTACTTT
CCGCATTCTAGGTACCGCCTCAGTGTTGGCTGAGGTTTGCCACATGCACACCATTGTTGACGTACCATGTGGCTCAGTT
CAGCCATCGACATCTCCAGACAAGCCTACCAAAGAAAGTCAGCCTCAGCCTTAACTGCTCTCGAGGGTTTCAGTCATCA
ATTAGCCCTACAGCTCCGCCTTCCCTCGGCCCGTGCGGCAAAAGACGACTGGAGATCTAGATTGTGAGAAATACGAAGA
TATTAGTGGATTTCTCGTACCAGGAACGAGGAC > SEQ ID NO:942 216433 *Trichoderma harzianum*
GCCGCCTCCTCACAAGTTTGAAGAAGCGCTCAAGGACGGCATCACGGAGGCAATGAAGCTGTACAAGGTCAGAGAGGTC
ATGGTAAAGAGATGGTCGAGCAATCGAAACCGATGAATGGACTGTTGATGTCTATTTCAATTTCTACATTTTCCTTTGC
AGTGTCTTTTTGTGTAACATTACGGCGATACCTGGGGAATTTATTGAATGTGCAAATGCTATGGGAATACACGTCGGCG
ACAACGTGTGTAATGTATACGAGAAACGATGGAACGAATCTGGATCAAATTACAGATGCATTTTAAAC > SEQ ID NO:943 216438 *Trichoderma harzianum*
TGTCAGGGAGCTTCCGTGGGCTGGCGCCAGACGCGGTTCGTGAATGCATAGGTGCTCTGCTGGCAACTGACGTCTTGGG
GCTTGGGTTGAGGGATGCGGGCGTGTTGTATGGAGAGGTGCATGATGTGGGAGAGAGGGCCCCTGGTGAGACCCCACCG
GGTGAGCGGTGGCCATATGAGCTAGCAGAAGGCGGGATAGAGATGGAAGACACGAAGAAGCCGGGTCGCGAAGAGGCGC
TGTTCAGCATTGATGTCGCGGATTGAGGGCCCGACGACAGGCGAGGAGTAGGAGAACCGCGGGATGCACCTTGGCCAGA
CATCATGTGTAAGCCAAGGTCGTCCGATGCTGGGCTGGCGGCCCGGCGCTTCTGACCTGCGCCTGCGTATGCATCTTCA
ATGTGAAGTCTCTTGAGAGAGGATGTCTCATCAATCTCCATATCGTCAGCAAAGCTGCCCTGGGTGGAAGTGGCATCAT
CGCTGTTGTTCCGTCTTGACCTGCCTCGGGGTGAACGATCTGGTTCTG > SEQ ID NO:944 216449 *Trichoderma harzianum*
GGAAGATACGCAATTCCACAATCGCCATGGCGAAGCCGTATGTGCCGCATGACGTCCTTGACGAGACGGCCAAGACTTC
ATTGGTCGGCCTGGGCAGCGGCTTCTTCATTGCCGCCATCCAGAATGCCCTGTCGAAGCGCAACGTGGGCGCTATGAGC
GTCTTTACGCGGGGAGCTCCCATCATTGGCATTTGCGCTGCCGGTCCCGGTGCCTACGCCTTCTTCTCCCGGACGATGA
TGAACCTGCGGGAGAAGGATGATGCTTGGGCCGCCGCCTTTGGAGGCTTCATGTGCGGCAGTGTCCTCGGACTTCCTTT
CCGACGCACACCCATCGTGCTGGCTCTTGGTGCTTTCGTTGGCACTGCCCAGGGCCTTTTCCACGTCACCGGAGGAAAA
CTGGACAGCTTCTACAAGGAGGAGGATGAGTTTGAGCGCAAGGAGACTGTTAGACGGACAACCCGGTTGCCCGTTGAGC
AGACTATTGCCGAGCTGGGCGAGGGACGAGGCATCCGTCCTCCTGGATATGAGGAGAGAAGACGAGAGCGCATCAAGGA
AAAGTATGGC > SEQ ID NO:945 216450 *Trichoderma harzianum*
GGCCAAATGAGATTCTTTTCTATTTCGAGCCCCAAGCAGAGCTCATTCGTTAGCATCTTGCTACCTACACCCTGCATGC
GCATACGCGATGAATGGGCACCCGGTCTGTCTGCACTCTCGTACCCTCTGCTCAAACAAGCGAGAAACAGACGCCTCTG
TCGTCTCACTCGCTGCGCCAGCGCCTTGGCCTGGGTAAAGCGGCTGGGTAATGCAATCCGGCGCAACGGCCTTTGCCAT
GTCTGGAACGCAATGCTACGCAAGTAACAGTAATGCCTGCGTTTGGTGCAGGTCGTCGCTCGCCACCGCTGGCTGGCTG
ACAGCCGGCAGTGCCGCAGACACGTATAATGATCCCACTCCAATACGTACAGAGACAACTGGCACACACCCCCAGGCCT
GAACGAGAGACTTGGATCTGGGAGCGAGCAAATTGATCTGATGCTGGCTAGCACGTACTACCCGACTTGACTTGCTACC
ATGTTGATACTGTATGCCTCGCCTCGCCTTGCACGAACCATCTCATCGCAAGTCTGATCCGACGTGGAGCTAAGCCTAC
CATGGCAACCGCGGCCACACATACAACACGTTAGGCTTGTGACGATGCAAGGGAGATGGCTCTGCCACGGT

FIG. 1 continued

> SEQ ID NO:946 216455 Trichoderma harzianum
TCGTGTGGCGCCTTGTCTCAGGGACAACAGACGACGAGCAACTCAAAGACCAGAGCTAAACATGGCTTGGCTAGATGGC
AATAAGCAGAGCACGCTTCAATCGAGAACAGACGCGCTCGACAATAAAGGATGTGCTACGGCACAGCCATTGGGACAGA
TGATGTCGCGGTTCAACGGTAAGTCTTTTGATCTTGTTGATTGAGCATCATAACGTGAGGCCGGCTCTAGTTGTTCAGG
ACGATAAATGCCACTTGCAATGACCGAAGCTGTTTGAGTCTCAATACACTCTGTACCAGATGAAAGGGCTTCTATGTCT
GCTAGGTTTTCATAGATTTGTCATAGTTATGACTCCTGAAGAAGTAGTTGTACTGCG > SEQ ID NO:947 216461 Trichoderma harzianum
AGCCGAGTTAAGCGGCGATAGAAGCAACAGAGGTGAAGTTGTGCCGGTCTGGTGGTTTATTGGAAAGAAACGAAGAGAA
GAATGTTCCGGTCAAGGGAAGCGGCCTTTGGTCAGTAGCCAAAGGGCAGATCAAGCGCCGCCTTGGAGGATTAAAAGGG
CGGCTGCAGGGGTCCCAAGGCTGGTGCGCCTCATGGAATTGTATCGAAGAAAGTCGATGGTGTGGCGGTGCCCGATAAC
GCAAAAAGCTGGCAACCTTTGTGCTGCCATGCGGGCTATCAGCGGGTACCGCCGAGTATTTGTTTGTCACTGTACAGAG
GCGAGACGTGAGGCCGAGATTCGCATTGGTTCGGAGTCTGGAGTAGGGAGGACAATATGGTAGCACGATTGTCATTGTG
ATTGCTTTGTTTATTAGTACTTAAAAAACAAATAAAAAACGAAAAAAAACAACCAC > SEQ ID NO:948 216463 Trichoderma harzianum
GCCAATAGGTGGCCTGCAGGCTGTTTCTGATACAAATCCTCGTAATGCACAGACGTGAATAGTGCTGGCACAAGTCACA
TTGCTGCTGCCTTGAAGGGTTCCATTTACATTTTGGTGCAGCTCTACCAACCG > SEQ ID NO:949 216465 Trichoderma harzianum
TGATAATAGTCAAAGACCAAATCTCTTCTACGGACATTGAGACGATATCAATGAGCCGAGACAAAATGGAAAAAGCGGA
AGCACTAACGATTCAACTCTTTCTTCTCCTTGGCGCTGCCCTAGTGTCCATCGGCGGACGATTATACGCCCGATGGCGG
CAGGTCGGAATGAAGAATCTTGGTCTTGATGATGGGCTTGCCATTACAGGAGTGATTCTCTTTGTGCCCAATGTGGTCT
TGGCATACATGATGAACACGCGGACCCATTGGATGGGCAATCATTCTGTCGGCAACAATACTACAACACAGCCGAGCCA
TAACGAAGATCAAATGAGGGAACTGGGATCGAAACTCTATCTATACAGCTGGTTATCCTATTCCGCTGCATTATGGACG
TTCAAGGCAGCCTTTCTCGCAAATGTCCTTCGTCGAATTCCCGAATCCGGCAGACGACAAACCCACCAGTATCTCGGCT
TTGGCTTCCTGGCTGCAACATGGGTAGCAACGACGATGGCTCTCCTCCAAAGCTGTCGACCGTTGCCCCACATGTGGCA
GGTTTATCCCAGCCCAGGACTGTACTGCCAGCCTGCTACTTCACCGGTGCTGGCGTGGGTTTACTTCAGCTTCGATATC
GTTACAAACCTCTA > SEQ ID NO:950 216469 Trichoderma harzianum
GGATTGGCTGTGCTGGGGATGAGATGAGACTGGCGGGGTGAATGGAGGAGAGAGGGGCGTGGAGCGAAGCCGGTGAGAT
GGAAAGATGGAAAGGAGGAGGGAAAAAAAAAGTTTGATCAGATGAGGGGTGGCGCACGAGACGAGGCACGGAAAAGGT
ACGGCTTAGATGGAAGAGGTAAGATGAGATGAGGTACTAGGCAAATACTTGAGTGCT > SEQ ID NO:951 216471 Trichoderma harzianum
GAACAATGCAGCTGGTGACAGGTTTGTCAAGTGGCAGGGGAGAATCGTATTCGTGTGGCGATGGTGATGTCGAATTTCG
AATGAGGGAGCCTTGGCGCGAAGAAAAAGAAGAGAGAGAGAGAGCGGAGAGGAGAGGAGAGGAGAGTGAAAGAAGGAG
AAGTAGAGAGGAGAGGAGAGAGACGCTGTGGTGCTAAGCAACCACGAGAGAGGAAGATGAATGCGGTTTACAAGGTT
GACATTGGCGAACGAGCTTGGACCGCTTTGACAATGTGATGTGATGCAGGCTGGGTACTCCAAATGTTTCCAATTGAAC
GAATATCCAATCAGACAAGTAGAGAT > SEQ ID NO:952 216474 Trichoderma harzianum
TGCTCACTTGACATGGTTTTGCCGCGTGCTGCGCTCCTCCTCCCTGGTTCCAGACTGTTACCCGTCTCGGAATACAGCG
AGACACGGACGACGGAGATCGGGAATGTGGGGCCGGAGAATCCGATGTTCACACGGATTGAGTCTCTGGAATGTGTTTG
CTACGTTTTTATCGGGCCGGGCGATGTCTGAGCACGTGAAGGGAGACGTGTTTGACGTGTAAGCAAAAGAAGGAAATAA
CTTTACTTCTGGGCTCGTGGGCTTGGGCTTGGATGATCCAACAGCATATGACGTCTAAGTGTTCGAATTGCGTCTAAAC
TACGAACCCCCTTGCAGTTGATGGGTTAGAGCTGAAAGGGGACGCCGTTTGCAATCAATTAATAAGATCATCCGTTCTG
AAGCGCTACAGCGGTTTGAGTTTCGGTAATGCCAAACAAGCTGCTGACATGG > SEQ ID NO:953 216488 Trichoderma harzianum
GGAGGAGTGGCCGCCTTGGTAGCGGGCAAGGATGGCGATGAAACGTCAATCGTGCTTGACCCGGTAGCTTTGGAGCATG
AGTCTGTTCTTGCTGCCTGCTGCGTTGCATATCTACCCAACAGAGATGAGATCACAAATCTGTGGTTCAAAGGTCGGCT
GCCCTCAACAGCATCTCACAATCATCAGTCACTTGTCTCAAGGGCAGTGCACGCGAGTAAAGGAACACATGGGTTGATA

FIG. 1 continued

```
TCGGCGGCTCTCAGCGAAGTTATTGGCAATTCTCAAAACTAAAAGTACACCGCGTTGAGTAATAATGACGATAATAACG
ATAATCTGGATCATGTATGCGCATTGCATACATTCGACATTCGCGTAGGCCAGGTGGGTGTGCTCCAGAGGGGCATCTC
GAACATCTGGTGAGCGAAGAGAGGTCAGCACCGCTGTAAGTGCAACCAATCAAATTCATTACGAATACCATTGGCTATT
GATGGAGACAATCACCAATGTTAGGTGGTATGAGGCATTGCTATAAAATGCTACTTGTTCGTTACCACAATCAGAGAAA
TATCAAGTATATTTATTAAGATCTATCTAAAGCCTTCATTTCCATACCATATC
```

> SEQ ID NO:954  216489  *Trichoderma harzianum*
```
AATTGACACCCAAAGCTTCAATAACCTAGGGCAACCCTCTTATCCACAATGAAGAAAGCTGCGCCTGCGGCAAACGCTG
CCCGAGATGCCGGATCTCACGATCATATGCTCCAAGGAGGCCATGCCATAATGAAAGACGACCCTGAAGACTTCAACGC
TCCCAAGCTTTCCGAGAACATGTCGAAGCAGACTGGTCTTGGGGATCCAAGCAGGGCAGCTTGCAAGGCAGCGCCGGC
ACTGGCGATAGTATGAGGCAGCGAGACACTCAAAGCCATGTAGGTCAAACATGCGGTGGTATACAATTGTGCTGACTAG
TATGAGTGATGAATACGGCCACGTAAAAAACGAGAATGCATTGCCGATTCGAAAAGCTGGTATCAGTGGGACATGCACA
CGATGATAGGAGTTGACGAGAATCCCGAGTTTGAAACATGTTGAAATAGGTTGTATAATATCATGGGGAGCAAAACCAA
TAT
```

> SEQ ID NO:955  216492  *Trichoderma harzianum*
```
AACAGCGGGAAGCAAAACAATTCAATTTCTACTTTTCCTTTCAAGTACAACATTGTTTGTAAAATACTCCAAAATCAAT
CGTATCACCAATTCTATCAACTGCATCGCCAAATCGCCATGCCTGAGGGACGTCAATCTCCTCCTCCCGAGCGCCAATC
CGCCGCCCAAGTAGGGAACACTGGATCCGGCAAGGCCTCAGATATCAGCAAGACCAGCCAAAAGGACCCAAAATCCCAG
CTCGACTGTCTCACATCGAACCCCAAGGGACCGATGGACGATGTGCTTAAACACAAGTTTTCCAGGGAGCCTGGAAACT
GTGAGCGCTAATTAGAGCGACTCGTCTTCCGCAGTTCGCGACTAATGAATTATCATAGACACTCCGTTGAACGCTTAGG
GAGAATAAATCGTCATGTTGTACAATAGTCATTCATAGCATCAATTATTGCATCGCTATACTAT
```

> SEQ ID NO:956  216495  *Trichoderma harzianum*
```
GCTGACTGAAAATGTTTGAATCTTGCCAATAGAGTCCTANATTTGTTCCTGCTATGGGTTCGACAGCATTTTGGCACAA
GGGGACGTATTTTCGGGTTCACCGAAAAAAGGAATCGTTTGTCAACACTCATTCGTGGGGAGGCCCAATGAAAGACCTA
GAAGAGATTAAGGTTTCTTGCTTTGGTCGTTCCATCGATCCAATCAAAGAGTTACTCGCGGATGCCAAAGCTCTTTATT
ATAATGACACGCGCCAAAAGACGACCATCTATCGTCCCAGAGTCAAGGAGCAACGAAGGGACCATAACATGTGGCAGCA
AGTACCACGACGGCCCGTTAGACCCATGTCAACAGTTGTGCTCGACTCTGGCGAAAAGCATGATATTCTGGCCGACGTC
AACGAATATCTGCACCCCTGGACGCCGCGATGGTATGCATCTCGAGGTATTCCGTTGAGGCGGGGATATCTGTTCCAAG
GGCCACCAGGCACCGGAAAGACGACCTTCTCCTTTGCGCTGGGGGGCGTGTTTGGC
```

> SEQ ID NO:957  218801  *Trichoderma harzianum*
```
CACTATAGGGCGAATTCGAGCTCGGTACCCGGGGATCCTCTAGAGGCGACCTGCAGGCATGCAAGCTTGAGTATTCTAT
AGTGTCACCTAAATAGCTTGGCGTAATCATGGTCATAGCTGTTTCCTGTGTGAAATTGTTATCCGCTCACAATTCCACA
CAACATACGAGCCGGAAGCATAAAGTGTAAAGCCTGGGGTGCCTAATGAGTGAGCTAACTCACATTAATTGCGTTGCGC
TCACTGGCCGCTTTCCAGTCGGGAAACCTGTCGTGCCAGCTGCATTAATGAATCGGCCAACGCGCGGGGAGAGGCGGTT
TGCGTATTGGGCGCTCTTCCGCTTCCTCGCTCACTGACTCGCTGCGCTCGGTCGTTCGGCTGCGGCGAGCGGTATCAGC
TCACTCAAAGGCGGTAATACGGTTATCCACAGAATCAGGGGATAACGCAGGAAAGAACATGTGAGCAAAAGGCCAGCAA
AAGGCCAGGAACCGTAAAAAGGCCGCGTTGCTGGCGTTTTTCCATAGGCTCCGCCCCCCTGACGAGCATCACAAAAATC
GACGCTCAAGTCAGAGGTGGCGAAACCCGACAGGACTATAAAGATACCAGGCGTT
```

> SEQ ID NO:958  218813  *Trichoderma harzianum*
```
GGCAAGTGCGTCTTCTTCTCGTGTCCACGGAGCCAACGTTTGGCGCATCACAGCCGCGGCAGAGCCCAACTTGATTATC
ACATCCTTGGTCACATCCTTGGGTTGTTGTCGATTCGCCTTCCATCCCCTCCATCTAGGCCTAATTTCATCCACCTCCA
ACCTTCCGCCCCCAACCTCCTTTCTCCTTGTTTACAACAACAACAAACGACCATCGATTCGACAGCTCGCGTGCGCATA
CAACACACATATCGTCGCCAACATGTCGTTCATGGGAGGCGCACAGTGCTCAACGGCTGGCAACCCCCTGAGCCAGTTC
CAGAAGCACGTTCAAGATGACAAGACACTACAACGCGATCGTCTCGTCGGCCGGGGACCAGGCGGCCAGCTGGGAGGCT
TTCGCAGCTCGCCTGCCAATGCGCCCCAGGATGAGATGATGAACGGTTTCCTCAATGGTGGCCCAGGTCTTCAACAAGA
GTTTCCAACCTTGCCAGGCGGGCCTGCTGCCCACCTGAGCGCTGCCCCTATGGGCCCTTCGCCTGCGGCATGGGCACAA
GACTTCAACGCC
```

FIG. 1 continued

> SEQ ID NO:959 218821 Trichoderma harzianum
GGAATACAAGACTCCAGGATGCATCATCAGCTTCTCACTCTCACCGCTGCTGCTGGCCTCCTCGCGACGGCCTCAGCTA
CCTACTCGAAGCTTCCCAGTGTCAATGTGCCTTCATGTCCTCGTGTTGGCACGATTAGCTACAGCAAGTCAGTGCCCGA
CCTGACGCCCTTCCCGCTCACACAGGTCAACCTGTGCTACACAGACAAGAGCCTCGAGCTCTCATTCATTGCCTATGAC
GAGGTCAATTACTTCTTCAATGCCTCTCAGGGTACAAACGACGACATCTGGGAGTACGAAGTCATGGAGGCTTTCCTCT
ACAAGGGCACCGAAGACCCTCAGACATACGTCGAGCTCGAGGTCAACCCCAACAACGTCACATACCAGGCATTTGTTTA
CAACCCCTCCAAGAATCGCGCGGTCGGCGCACCCTTCGACCACTTCTTCGTTTCGGATCCCGCCACGGACGGCTTCAGC
TCGAAGACTGTCCTCAACAAGCTCGCAAAGACTTGGAAGAGCACTGTTACCGTCCCTCTGGGCATCTTCAACGTCGACG > SEQ ID NO:960 218859 Trichoderma harzianum
ATTCTAAAACAGTCAGCAGGGCTCGAGGCCTTGTGCGGCAGATATGGGGGCCAGCGACTCCAAGATAGGATTTAAGCAG
GGCATCTTCAGATTATCAGAGGAGCGCAACATTGCGGCGCATGATCCTTACTGGACTTCGGTTCGTCATGCCTTTGATC
CCAGATGGCCGCGGGGATGCTGATGCTGATGGGGTCATAGTTTTGGGAGCTTCCTGAATCGTCGGAAGATGTTTTTAGT
CTTTT > SEQ ID NO:961 218904 Trichoderma harzianum
GTCCTCTCAATCTCGTTCCCAATCAACTCCGTCTGCCTCTCTCGCCCGCATCAACAACATTGCGAGCCACATCTCTCCC
ACAATGGCTTCCACCACCAGTTTCCCGGCAGAAACGGTGCCCCAGGCGCCTGAAGATCCCCTCTTTGGCCTGGCCCGCG
CCTACAAGGCTGACAACAGCCCGCTAAAGGTCGACCTGGTATGTCGCAAGCTGCTTGTTGCTGATAATGTTTTTATTTC
ATCTGGATTCACATCCAACCCCTTTTGTCCTTGCTGTCCTTATCCTCCCAAACCCTTCCCGTCGCAGCCGTGACAAGAC
TCTGGCGCAATCCTTTACGATTGCGACGTCGGAGCCGGCGAACCCACAAATATCCCATCGCTTGACTAATAGCTACCGT
GTCTAATGCACTCTATGACTGATGATATTCTTACTTACAGGGAATCGGCGCCTACCGAGATAACAATGCGAAGCCATGG
GTTCTTCCTGTGGTAA > SEQ ID NO:962 218922 Trichoderma harzianum
TACCGCATTGCATTCCATTTGATTGCTTCATTTTCAGTCCATTTGTTGGTCTTTTCTGAAATACCCATATACCGGTGTA
CACCCGTATATATACAGCTGGTTGAACTGCACTCCGCTCGCATTCAATCTTCCCCACTACATCATCACATTTCTTCTTT
CTCCCACAAACAACATCACACACAACCGTCATCATGGCCAACCGAGAAATTCTGTCGTCTCGAACCGAGACTCTCAACA
AGTACCTGAAGCTCGACCAGAAGGGCAAGATCATGGCCGAGTATGTCTGGATCGATTCTACCGGCGAGACTCGATCAAA
ATCCAGGACGCTCCCTGAGCTCAAGGACAAGGAATACACCCCCGAGGATCTGCCCGTCTGGAACTTTGACGGCTCTTCA
ACTGGCCAGGCTCCTGGTCACGATTCCGATGTCTACCTGCGCCCTGCCGCCGTCTACCCCGATCCTTTCCGTGGCTCTC
CCAACATCATCGTCCTCGCCGAGTGCTGGAACG > SEQ ID NO:963 218924 Trichoderma harzianum
ATTAAACCGCCCCTACTTGCTTTTGCTCTCTTTGTTGTTCACTCGCAGCTACAACTCTCGCCCACAATGTCTCTCAAGA
ATGACGCTTTCCCTTCCTCCGAGGCCTTCGAGGCCATCAACGCCGCTCTCAGCAGCAGCGAAGCCGACCGCAAGGACGC
CATCAAGAATGGCAAGGCCGTCTTCGCCTTCACCCTCAAGAACAAGGCCGGCGAGACGGCCAGCTGGCACATTGACCTC
AAGGAGAAGGGCACAGTGGGCACTGGCGTCGGCGAGAACCCCACCGTCACTCTGTCTCTCCGACGAAGACTTTGGCA
AGCTCGTCACCGGCAAGGCCCAGGCCCAGCGCCTCTTCATGTCCGGCAAGCTCAAGGTCAAGGGCGACGTCATGAAGGC
TACCAAGATGCGCCCATCCTGAAGAAGGCCCAGACCAAGGCCAAGCTGTAAAAAGCGGGCATTGGCAAGTTGGGCTGTT
GATTATGGGAAAACAGGTGGAAACAAACCATTAA > SEQ ID NO:964 218926 Trichoderma harzianum
CCAAACATGAGCTCACCCCATAGGCTGTCGCCCTGGCACAACTGGGTCACAATCAGGAACTCAATGGGAAATTTCTCCC
TGATTTCTATGCTGGGTCTTGCCTTTGCCATCCTCAACACATGGACGGCCTTGGCAGCTTCAATTACACTCGCTCTCCC
CTCTGGTGGGGCTAGTTCCGTTATCTGGGGTCTGATCGTGGCCGGTATCTGCAATCTGTGCCAGGCTGCTTCTCTCGCC
GAGTGCCTTTCCGCCTACCCCACAGGCGGAGGTCAGTATCACTGGGC > SEQ ID NO:965 218947 Trichoderma harzianum
AGCTCTGCTCTGTTGTGTCTGTATATTAAGACGTCGTTCCTGCCATCTCTTCCCCCTTATCCTCCCTCTTCTTCTCTTT
CTCGCCACCCTATACTTACCCCTCCTTGGCCTTGTTCGTACAACAGGACCAACAACTTGTGAATGCTCTCATCCTTTTC
CAAAAGACTCAAGAGCAAGAGATTCAGAAAGTCCAAAGCCATGATCCGACCCACCTTCGTCGGAGCCATAGACCAGGGC
ACCACAAGCTCTCGGTTCCTCATCTTCAACCAGAGGGGCGAGGTGGTTGCCACGCATCAGTTAGAGTTTGCACAGCACT

FIG. 1 continued

ATCCTCATCCTGGATGGCATGAGCATGATCCTGAAGAGCTTGTTTCGTCTGTGGAGACTTGCGTTGATGGTGCTGTTGT
TGAGTTTCGAAGCAGGGTCACAACCGTGAGCAGATTGTTGCCGTCGGTATCACCAATCAGCGTGAGACAACTGTCGTTT
GGGACAAGACGACGGGCAAGGCGCTGCA

> SEQ ID NO:966 218977 Trichoderma harzianum
GGATTCCAACCAAATCTCCGGGATGGGCTCGACCTGCTTCCGCGCCGCCGCCCGCATGGCCTCCTCCGCCTGCCGCTCG
GCGGCCTCCCGCTCAATCCCCTCCGCCGCGCGGCGGCGGCGCCCCTCGCATCTCCAGGCTGCCGGTGGAGCTCGGGTGCA
GCGCGGGGTTGTCGCTGCTGCCGCTGCACAGCGCGGTGGCGGCGGCGAGGCTGACGTCGCGGCTGAGCACGGCGTCGCG
GACCTGCTGCGCGCTCTCTCAGGAGATGGGTCAGTCTGTCCCAAGGTGATAAATGCTGGAAGACCTGCTCATGTCGTGC
TATCAGACAATTGATTTTGTAGAGTGAACTAAATTGGTTTCTGTGTTGCCTGA > SEQ ID NO:967 218985 Trichoderma harzianum
TGATGAGCAAATCATCTCATCAAGCTGGGTTTTATCAGTTGTTGATGCTGAATTAGGTGGTTTTCATTTAAATAATTCC
AATTCTTTCAACATTCACTTGACGAAATGGCAAACCTTGCTACTGGGATTCACAAATTCCAAGGGCCGGACATTGAACT
AACTTATACGGTGCGAGGATCCGGACCATATCTTATTATTCAGGCAGCAGGATGGGGAATTTCTTCTCAGTATCTTCAA
ATTGGGCTTTCGCCTCTTGAGGCTCAATTTACCCTAATATACATGGAGCCCCGCGGCTCAGGCCCCTCCGAGCGACCAC
AAGAAGACATAATGAGCACTTCCGATATGACTGACGACCTCGAGCTTTTACGAAAACACTTGGAATTTGAACAAATTAA
TTTGCTCGGTCATTCTAATTGAGGCACCATCGCCTTAGCGTATGCTGAGCGGTACCCCGCCTCAGTCCGAAACTTGATC
CTCCTCACACATTGGCCCGAAGGATA > SEQ ID NO:968 218986 Trichoderma harzianum
GGCAGTAGTACACAGTCTTGGTCTTGTCTTTGTCTTGTTTCTTCGTTGATATACCGGCGCCTATCATGCGCCGTCTCCT
CTCCGTCAGCGCCTCTGCCAGTGCCCGCGGA > SEQ ID NO:969 219006 Trichoderma harzianum
CCCACGCGTCCGCCCACGCGTCCGCTCTCCATATCGAATCTTCTCTTCTCCTTTGATACCCTCTCGGTGTTGCAGACAG
AATCATCAGTCACAATGGCTTCTCAGCAGATCCGCACTCCCATCACCGATCTTTTCAAGATCAAGCACCCCATCTTACT
GGCCGGCATGAACGTCGCCGCCGGTCCCAAGTTGGCGGCTGCCGTCACCAACGCCGGCGGCATGGGCGTCATCGGCGGT
GTCGGATACACCCCAGAGATGCTCAAGGAGCAGATTGCCGAGCTCAAGAGCTACCTCAACGACAAGAACGCTCCCTTTG
GTGTTGACCTGCTTATCCCCCAGGTTGGTGGCAATGCCCGTAAGACCAACTATGACTACACCAAGGGCAAGCTCAACGA
GCTTACCGACATCATCATCGAGTCCGGCGCCAAGCTGTTCGTCTCCGCCGTCGGTGTTCCCCCCAAGGCCATCGTCGAC
AAGCTGCACAAGCATGGCATCCTGTACATGAACATGATCGGCCACGTCAAGCACGTCCAGAAGTGCATCGACGTCGGCG
TCGACATCATCT > SEQ ID NO:970 219027 Trichoderma harzianum
GTGGTGTCGATCCAAGGGGACGCGTGGCGACCGCTGCACAGCCCGCGTGTGGTGACTAGAGGCGGCTAACAGGTGGTAA
GTAATCGGATCTGCTGTCTCTCTTGTGCAGTCTCACACATGTCGCAGGGGTGGGTTTTGAATGGAGACGAAGCTTGTTG
CGATGAATCAAGTCATGCTAGCTGCATGCCTGACCGAGATGAGGAGG > SEQ ID NO:971 219045 Trichoderma harzianum
CGGACGCGTGGGGACTAGATAGGTAGAGATGGTTTGGCGGTCAATGCTGTGCTCGTTAGATGTCTCACGGGGGCCCGCA
TGTATCTCCATGTAGTTCCTCGCACGCAGCAAGAAAGAGGCAAAACCCGCGCGGTGTTAGTAGCGTTTGCCATCGGAAG
ACGATCGCCCAGCACGTCAAAGAGGCCATTTGATCAGTTACTCGATTGGTGCTCGCACGGGTTGGTTACGAAAAACAAA
AAAAAA > SEQ ID NO:972 219066 Trichoderma harzianum
CCCACGCGTCCGCCCACGCGTCCGAACGAATCGTCCACTCAGCTCGGCTCAATCATCATCACAATGGCTCTCAACCTCA
CCACGTCGGCTCGAGCCCTGCGCTCCTTCAAGCCCTACACCCGTGCTGCTCTCCTTGCCAACGCCGCGCGATGCTACTC
TACCGCTGAGCCCGATCTCAAGACAACCCTCAAGGAGGTCATTCCCGCCAAGCGCGAGCTGCTCAAGAAGGTCAAGGCC
CATGGCAGCAAGGTCATTGGCGAGGTCAAGGTCGAGAACACCCTCGGCGGCATGCGTGGCCTCAAGGCCATGGTCTGGG
AGGGATCCGTCCTCGATGCCAACGAGGGCATTCGCTTCCACGGCCGCACCATCAAGGACTGCCAAAAGGAGCTCCCCAA
GGGCAAGACGGGAACTGAGATGCTCCCCGAGTCCATGTTCTGGCTGCTTCTCACCGGCCAGGTCCCCTCCGTCAACCAG
GTCCGCGAGTTCTCCCGTGAGCTCGCCTCCAAGGCCCAGATCCCCGCCTTCGGCAACAAGATGCTCGACGA

FIG. 1 continued

> SEQ ID NO:973 219090 Trichoderma harzianum
ATTAGGCATTGACAGCAAACCAATTCCCTCCATAACTGGGCCTCTTCACACCCGTACTCAGAATGACCGACAGAATATT
CCGCATCTTTAACCCGGGAGAACCAAAGGGTGATCCCGTTGAGAAGAGGCGCGCTCAGCTGCGACGTGCCCAACAATCT
TATCGAGATCGCAAGGACAAGTACACCAAGGCGCTCGAGGCTGAACTAGCACGGTCTCGGAAGAGCGAGGCGGGCTTGA
CGTTCCAGATCGAGCAGCTTCGTGTCAAAGTTCAGAAACTGGCCAGTCTCTTGTCCCAAAATGGCATCTCACTTCCTCC
AGATTTTGACAATGAGGAACAACTTCATGATGATGTACCGCGTATAGATTCATCTCCGCTCACAACGCGTGGACAACCA
CAAACCGCTGAAGGCTTCCTATCAAGTACAGATTCAACCTCTCCTGAGTCGGTGACGGACCAAGGAGCTATCTTAAATA
GTGGAAACCGCACTCTACGGCAGTACAGTTCGAGAATCTTTTCCCGACATCATGAACCGCAGGTTCCAGCGCCGACGAG
GACCGTCCAAGATGAGCCCGGTGACAGGACTCGCCTTGCTGAACTTGATCCCACACAGGTCG > SEQ ID NO:974 219108 Trichoderma harzianum
TACGTGGTCTCTTGGGGTGTAGCAATCAATACTTGTGTACACGTAGATACAGTAGTCTATGTCCGTGTGCTTCTGGGGG
TGGGCATTGATTATCTCCGTGCGGAGGAATATGGGGGTGTTCGTGTGTCTTGGTATCAATCAGGCTATGCGGGAATACG
ATGTAGTTACGACGCCTCCTCTACTGTACATTACTGACATGCCCTGTAAAGACAAGGTGAGCATACGAGACAATGCCGC
TGTCTCTTTGGGAGGGAATTCGTTAGAGTCAGCCAAGAGCGCCATGTTGAATGAAAGAATCGGACATGGCTTATCTTAG
TCCCCCGG > SEQ ID NO:975 219136 Trichoderma harzianum
TCTTCCTCTGTCTGCTATCTTTCCTCCTATCTCAGTCACCCATCCATCCTTTTCCTCCCATCTTTTCACACATTATTAC
AAAATGGGCGCCGCCGACAGAATTTCCCAGATTGGAGGCCAGATCTCCGGCAACCCTACCGCCGGTGGTCGCGACAAGA
TCCTCGAGAAGCGCCCTGACGATGTCGTCGTCACTGCCGCCTGCCGTACCGCCTTCACCAAGGGCGGCAAGGGTGGCTT
CAAGGACACCCCCGCTGGCGACCTTCTCGCTGGTGTCCTAAAGGCCATCATCGAACGCTCCAAGATCAACCCTGCGCTC
GTCGAGGACGTCGCCGTCGGCAACGTGCTTGCGCCGGGTGCCGGTGCCACTGAGTTCCGCGCCGCCGCTTTTGTCGCCG
GCTTCACAGAGGAGACGGCCGTGCGTGCGGTCAACAGACAGTGCTCTTCTGGCCTGCAGGCCTGTGTCGATGTCGCGAA
CCAGATCCAGGCTGGTATGATTGATATCGGTATTGGTGC > SEQ ID NO:976 219145 Trichoderma harzianum
GGACAGGGGAAGGGGGTGTTAGTTGCGATAGCCGATGTTTGCATGTGAAGGCCACTACTTTACCAAAAGAGGATGCTGG
GATGGCTGTTGCCGGTCGAGTAATTAATATGCATAATAGTATCCGCAGGTGATGAGGTGATTTTAATGTATAATTGCTA
AAAAAAAAACAAAA > SEQ ID NO:977 219159 Trichoderma harzianum
CGAAACCAAGGAGTGGCTCTCTGAGGTTGCTGAGCATGCGCAGGCGCTCAAGGTCGATGGTGGCTTCGATGAGGGTGCC
GATCTGGGCCCCGTCATCTCCCCCAGAGCAAGGAGCGCATCTTGAGCATCATTGACAGCGCCGAGAAGGAGGGTGCTA
CGATCCTGCTCGACGGGCGTGGCTTCAAGTCTGAAAAGTACCCCAACGGCAACTTCATCGGACCCACCATCATCTCCAA
CGTCACTCCCGACATGACCTGCTACAAGCAGGAGGATCTTCGGCCCCGTGCTGGTGTGCCTCAACGTCGAAACCATCGA
C > SEQ ID NO:978 219178 Trichoderma harzianum
GACTCATTGTTGGCATATGGAGCATCCCAATCTTATTCGTACTCATGTGATCGTCATCGCTCATCATGCTGACCA > SEQ ID NO:979 219188 Trichoderma harzianum
TCGACCGACGCTCGGCAACAATGGCGACAATTGCAAGCGGCTTGCGGCATGCGAGATGCGCAAGCTCGATTGCTGCAGC
TCAATGGCGGCCGGCAATCTTCCCGCGGTCGAACTTTCAACTCGCCATCCGGTCTATAACCAGCGACTCTCAAAAGCCT
CCCAGTCTTGAACTTGAAGCCGCCGAGTCCGTCCCGATCCCATACCAGGGCGTTACGCATGCGCGAGTTGTTCCGGCGA
CACCATCTTATTTCTCAAGAGAACCCCAGTTCAACGATTGATACATTGGAATCTCCAATCTGCTCACCAAGTACAACCA
CCTGCCCAC > SEQ ID NO:980 219193 Trichoderma harzianum
GTCAGCAATCCGTTCCCAGAGACCGAGAAATACCTTTCGAGAGGTTGGCATCTCTTCTACCCATCGGATCGGCATGGGA
CCGCCTAAACGCAACAGCACCTCGCTGCCTGCCGGCTATGT

FIG. 1 continued

> SEQ ID NO:981 219218 *Trichoderma harzianum*
GTGTGGTACAGACGCCCCCGAGGCCGCCGCTGGTCCCGTGTCCAACGGGTCGCATGCCAGCAAGGCCAACCCAGCCAGC
TCTCCGTATCAGAACGTCAACGACTTCATCTCCAATGTCGCCCGATTCAAGATCATCGAGAGCACTCTTCGTGAGGGCG
AGCAGTTTGCCAATGCCTTCTTTGACACTGAAACCAAGATTAAGATCGCCAAAGCTCTGTAAGCCCGAACCACCTCGCA
ACTCACTTGGTTCTGTTGTTCCTCTCCACACTCGTCTCATATGCTAACATCCCTACGGTGACGAGTTTGGTGTCGACTA
CATAGAGCTCACAAGTCCTGTGTCTTCTC > SEQ ID NO:982 219244 *Trichoderma harzianum*
ATAAATAGTAGCTGCTTGTTGTGAAGCACTGCTTTCATCAAAACAAGTACTCTCCAATCACATCTGGTGTTCGAACAAG
GTCACCACCCAACAACATTTCGCATATTCCATCAGGTCGATCGATTCCCAAGTCCGACAATCACCATGGCTGACGAAAC
CGTCAACATCGCTCCCAATGAGAAGGAGACCAACGGTGTCCAGCAGCAGACGGCGGTACCGCGCCAGGGCTTCACACAC
AACCACCACAGCGACTTCAATGAGATGACCATTGGCCAGTATGCTCAGGCTTTTGGTGGTGCTCTCCAACCCGGGGCAT
GGAGGCCATATGAGCACCGCAAGCTCGCCAACCCCGCCCCTCTGGGTCTTTCTGCTTTCGCCTTGACTACCTTTGTCCT
CTCCGCCATCAACATGCACGCTCGAGGAGTCTCGGCCCCAATGTCGTCGTCTCTCGCCTTTGGTTATGGCGGTCTT
GTTCAGCTGCTTGCTGGCATGTGGGAGGTTGCTGCCGGTAA > SEQ ID NO:983 219269 *Trichoderma harzianum*
AAAACATCACAGTGCACATCAGGGCGCGAGTACTTCGCAATAGAGCGGTTGCGTCACCGAAAACCACCGACGCCGTAAA
GCCTGACAGCACCCCAAAGGGCAAGAGAAAGGCCGCCGAAGAGTCTTCTCCCGTTGTGCTGAAGAAGCAGAAATCCGCC
AAGAAGGAAGATGTCGAGACCAAGGCAGCCAAGTCACCCAAGGCAGCCAAGTCACCAAAGACTAAGAAGGAGGAAAAGA
AGAAAGAAGAAGAAAAGAAGCAAGATGTGATTGACATGGAGGAAGATTCCGAGTCTGAGGGACAAGAAGATGAGGGAAA
TCTTCAGGCTTTGGCCGTCAACATTGACCCGGAAGAAGAGGCCCCCGTGAACGACGAAGAATTCCAGCCCGGTCAGGAC
GTTGGCAAGATCCCCAAGGTCTCGAAAGACGTCCAGAAGTCGATCAAGGCATCGAAGGAAGAACCTGGCGTCGTTTACA
TTGGCCGAATACCCCATGGTTTCTACGAATACGAAATGAG > SEQ ID NO:984 219290 *Trichoderma harzianum*
GCAGCCTAAAAGCAAACCGTCTCATCTTACATGGCCTTGTTCCTTTCCATACTCCATTCTTCCCCAACCCCAACACCCC
GCCAGCCGTTCTGTCAGCGCCACAGCGCATTAGCCTCATCACCTCATTGCTCACTGGTCTGCAAACATTGCGCAAGGCG
GTGAATTTTTCATGTCGAGAATTGACATTATATAACAGCACGTATTCTAAGATTCATGTATTAAGTGCCGAGGAAATTC
ATTTCTTCCCCATCCGTCAAAGTCCTAGGTAAGTAACAATGCATTAATCGTAATGTCCAACTCGGAGAGTTTTCAATAC
TCCTTATCGATAAGTCATTATGTAATCAATCCTGCCGGGAAGGGAAATTTTGCTCCTCTCCCAAACCTCAAATCGCATC
TCCAAAGCCCTGTGACGACATACAACACCCGAACAGCAATATCAAACCCCCAAACACCAAGGAACAAGCCCTCACCCCG
TATTTTACCTCCCAGTTTACAAAAACAAAACA > SEQ ID NO:985 23794 *Arabidopsis thaliana*
CCCACGCGTCCGCTCGATTTCAGATTTAAGATCTCAGATACAAAACTCCGACATGTCTACGTTCAGCGGCGATGAAACA
GCTCCCTTCTTCGGCTTCCTCGGCGCTGCAGCCGCACTCGTTTTCTCCTGTATGGGAGCTGCTTATGGAACCGCAAAGA
GTGGTGTTGGTGTGGCTTCTATGGGAGTTATGAGACCTGAGTTGGTGATGAAATCTATTGTCCCTGTTGTTATGGCTGG
AGTGTTGGGTATCTATGGATTGATCATTGCTGCTGTTATCATCAGTACCGGGATTAACCCCAAGGCTAAGTCTTACTACCTC
TTTGATGGATACGCACATCTCTCGTCTGGTCTTGCTTGTGGTCTTGCTGGTCTCTCAGCTGGAATGGCCATTGGGATTG
TTGGTGATGCCGGTGTCAGGGCAAATGCTCAGCAGCCTAAGCTCTTTGTTGGGATGATTCTTATCCTTATTTTCGCAGA
AGCGCTTGCTCTTTACGGGCTTATTGTAGGAATCATTCTTTCCTCACGAGCTGGCCAGTCTAGAGCTGAATGAGAATCT
AAACCACAAGACTGCTCAAAGGTACTTCCTTTACTTCTGTGTGCGTTTTGTTTTATCGTGATTAGTATGATGTATCATC
GGGAACCAAAAATTTTACTGGATTCTTGGAAATTTGTTTCGGAAACAAAACCGCCTATCTTCATTCTCCTTTTCTTTTC
CGGTGGTTACTCTCCGATGTAGAATTTTATTGTTTGATTCTGTAATAAAGAAGCTCTGAGGAGTTTGGTATGTTTTTGT
ATTCTTGTATTTGTCCTGAGGAAGTTAAATACATTTATTTGTAAAGAAGTTTGCTTTTCTGAAAAAA > SEQ ID NO:986 258904 Contig A *Arabidopsis thaliana*
GCAGCATGCAGACTCCGTACACTACTTCAACGCAGGGGCAATATTGTCATTCTTGTGGAATGTTCCACCACCATAGCCA
AAGCTGCTGCTACAACAACAACAACTCCAACGCCGGTTCTTACTCGATGGTCTTCTCCATGCAAAACGGTGGCGTT
TTCGAGCAGAACGGTGAGGACTATCATCACTCTTCCTCCCTCGTTGACTGCACTCTCTCTTGGAACTCCTTCTACGA
GGCTTTGTGAGGAAGATGAGAAACGTAGACGCTCTACTTCATCTGGTGCTTCTTCTTGCATCTCCAACTTTTGGGACTT

FIG. 1 continued

GATTCACACCAAAAACAACAACTCCAAAACGGCACCGTACAATAACGTTCCTTCTTTCTCCGCTAACAAGCCAAGTCGC
GGTTGTTCCGGTGGTGGTGGTGGCGGAGGAGGCGGTGGCGGGGGTGACTCTCTTCTCGCTAGACGCTGTGCCAACTGTG
ACACTACTTCTACTCCACTATGGAGGAATGGTCCTAGAGGCCCTAAGTCCCTATGCAACGCATGCGGCATTCGTTTCAA
GAAGGAAGAGAGAAGAACTACTGCGGCTACAGGAAACACCGTCGTCGGAGCTGCACCGGTTCAAACCGACCAGTACGGG
CATCACAACTCTGGCTACAATAATTACCATGC

> SEQ ID NO:987 258904 Contig B *Arabidopsis thaliana*
TTATCATCTGGTAAAGTCATGGACAAGACTTGCCCTATCCGCTACATTAAGCCTCCAAGAAAGGAACGGAACACCGCCG
TGAGCACCGTCGGATTCAACGTTGTTTGCTACTCCACTGCCGTAATCATCCATGAACCTGATCTCATTTGCCGGATAAT
TACACGGAACCCTCTGCGTCGAGTGGTGATGAGCCCACGGAGTACCATTA > SEQ ID NO:988 258906 *Arabidopsis thaliana*
gcagcatgggaaggggcaagatcgcgattaagaggatcaataactctacgagccgtcaggttacgttctcgaagcgaag
gAATGGATTGtTGAAGaAAGCTAAGGAGCTTGCGATTCTCTGCGATGCTGAGGTTGGTGTCATCATCTTCTCCAGCACC
GGTAGGCTCTACGATTTCTCCAGCTCCAGCATGAAATCGGTCATAGAGAGATACAGCGATGCCAAAGGAGAAACCAGTT
CAGAAAATGATCCCGCTTCAGAAATTCAGTTCTGGCAAAAGGAGGCtgcgATTCTAAAGCGTCAGCTACATAACTTGcA
AGAAAACCACCGGCAAATGATGGGGGAGGAGCTCTCTGGACTAAGTGtagaAGCTTTACAGAATTTggAAAATCAGCTT
GAAttgagCCTTCGTGGCGTTCGAAtGaAAAAggatCaaatgttaaTCGAAGAAATACAAGTACTTAACCGAGAGGGGA
ATCTCGTTCACCAAGAGAATTTAGACCTCCACAAGAAAGTAAACCTAATGCACCAACAGAACATGGAACTACATGAAAA
GGTTTCAGAGGTCGAGGGTGTGAAAATCGCAAACAAGAATTCTCTTCTCACAAATGGtcTAGACATGAGAGATACCtCG
AACGAACATGTCCAtctTCagctcagccaaccgcagcatgatcatgagacgcattcaaaagctatccaactcaactatt
tttccttcattgcataataa > SEQ ID NO:989 258915 *Arabidopsis thaliana*
gcagcatgggaactccagaatttccagatctgggtaaacactgctccgtcgattattgcaaacagatcgatttcttgcc
cTTCACATGCGATCGCTGCCTTCAGGTGTATTGTCTGGACCATCGTAGCTATATGAAACACGATTGTCCAAAAGGAAAC
AGAGGAGATGTCACTGTGGTTATTTGTCCATTATGTGCTAAAGGAGTTAGATTAAACCCTGACGAAGATCCCAACATCA
CCTGGGAGAAACATGTTAATACAGACTGTGATCCATCTAACTACGAAAAAGCTGTCAAGaagAAGAAATGTCCTGttCC
TAGATGCAGAGAACTCTTGACATTCTCCAATACTATTAAATGTCGAGATTGTAGCATCGACCATTGTTTGAAACATCGG
TTTGGACCTGATCATAGTTGTTCTGGACCCAAGAAGCCTGAATCGAGTTTCTCATTCATGGGTTTCTTGAGTACAAACA
CAAAAGAAGCTCCTGCATCATCATCATCTTCTTCGAGATGGTCTagTCTTttcGCTTCTGCGGAAGcaagtattaGTAG
ACTCGGTAACGATATAAGCCAGAAGTTACAGTTTGCGAGTGGCAATGATgacaaTtCAgagatgaCgcaagaGAGgaat
ggaataCagaaTtCTGGCaaagttacgatTGATgtttgtCCCATAtgtagtagagggtttcgtgatccgctggatctat
tgaagcatatcgataaggatcatcgtggcacttctaaagcctaataa > SEQ ID NO:990 258924 Contig A *Arabidopsis thaliana*
GAAGTGAACTGCAGCATGGATTATTCTTCGATGCATCAGAATGTGATGGGAGTATCTTCATGTGCAACACAAGATTATC
AAAACCAGAAGAAACCATTGTCGGCGACTAGGCCAGCTCCACCAGAGCAATCATTAAGATGCCCTCGCTGTGACTCCAC
CAACACAAAGTTCTGCTACTACAACAACTACAGTCTCTCTCAACCTCGCTACTTCTGCAAATCTTGTAGGAGATACTGG
ACCAAGGGTGGAATCCTAAGAAACATCCCAATCGGTGGTGCTTACCGGAAACACAAACGCTCCTCCTCCGCAACCAAAA
GCCTCAGAACAACTCCTGAGCCCACGATGACCCATGACGGCAAATCATTCCCAACGGCGAGTTTCGGCTATAATAATAA
TAACATTAGCAACGAACAGATGGAGCTTGGGTTAGCATATGCCTTGTTGAACAAGCAACCTCTAGGGGTTTCTTCACAT
CTAGGGTTCGGAAGCTCTCAGTCTCCAATGGCCATGGATGGCGTGTATGGGACCACGAGCCATCAGATG > SEQ ID NO:991 258924 Contig B *Arabidopsis thaliana*
GTTACTACAATAAAGCACCAGTATTAATGTAGTTGACAGTACTGCTCCAAATCTCTCTCCCTGAATCAATCTGATCAAC
ATGACCATGACCATGACCACTTCCTCCTCCCATGTTCATCTGCCAGGGGAATCCCCACAA > SEQ ID NO:992 258965 *Arabidopsis thaliana*
gcagctttctgcaacttctccaaatctcatactttccagaaaatcatttttcccaagaaaaataaaactttcccctttgt
tCTTCTCCCCCCAACAGCAATCACGGCGTACCAATCGGAGCTAGGAGGAGATTCCTCTCCCTTGAGGAAATCTGGGAGA
GGAAAGATCGAAATCAAACGGATCGAGAACACAACGAATCGTCAAGTCACTTTTTGCAAACGTAGAAATGGTTTGCTCA
AGAAAGCTTACGAGCTCTCTGTTCTTTGTGATGCTGAAGTCGCACTCATCGTCTTCTCTAGCCGTGGTCGTCTCTATGA
GTACTCTAACAACAGTGTAAAAGGGACTATTGAGAGGTACAAGAAGGCAATATCGGACAATTCTAACACCGGATCGGTG

FIG. 1 continued

```
GCAGAAATTAATGCACAGTATTATCAACAAGAATCAGCCAAATTGCGTCAACAAATAATCAGCATACAAAACTCCAACA
GGCAATTGATGGGTGAGACGATAGGGTCAATGTCTCCCAAAGAGCTCAGGAACTTGGAAGGCAGATTAGAGAGAAGTAT
TACCCGAATCCGATCCAAGAAGAATGAGCTCTTATTTTCTGAAATCGACTACATGCAGAAAAGACAGGAAGTTGATTTG
CATAACGATAACCAGATTCTTCGTGCAAAGATAGCTGAAAATGAGAGGAACAATCCGAGTATAAGTCTAATGCCAGGAG
GATCTAACTACGAGCAGCTTATGCCACCACCTCAAACGCAATCTCAACCGTTTGATTCACGGAATTATTTCCAAgtcgc
ggcattgcaacctaacaatcaccattactcatccgcgggtcgccaagaccaaaccgctctcagttagtgtaataa > SEQ ID NO:993 258966 Contig A Arabidopsis thaliana
GCAGCATGGCGTTATCCGGGTCGGGTTCTTACTATATCCAAAGAGGAATCCCCGGTTCTGGTCCTCCTCCTCCTCAAAC
TCAACCAACGTTTCACGGATCACAAGGATTTCATCATTTCACCAATTCCATCTCTCCTTTTGGGTCAAACCCAAACCCA
AATCCAAACCCTGGAGGTGTCTCTACTGGATTCGTGTCTCCTCCTTTACCCGTTGACTCTTCTCCGGCTGATTCGTCAG
CGGCGGCGGCGGGAGCTTTGGTTGCTCCTCCTTCAGGTGACACGTCTGTGAAGCGGAAGAGAGGACGGCCTACAAAATA
TGGACAAGATGGTGGTTCTGTTTCGTTGGCATTGTCTCCTTCTATCTCCAACGTTTCCCCGAACTCTAACAAACGTGGC
CGTGGAAGACCTCCTGGCTCCGGCAAGAAGCAACGGCTATCTTCCATTGGTGAAATGATGCCTTCATCAACTGGGATGA
GCTTCACACCGCATGTAATCGTAGTTTCCATTGGTGAAGACATTGCTTCAAAGGTTATATCGTTCTCGCATCAAGGTCC
ACGAGCGATATGTGTCTTATCCGCAAGTGGTGCTGTCTCTACTGCAACTCTTCTTCAGCCAGCACCTTCTCATGGAACT
ATTATATACGAGGGTCTATTCG > SEQ ID NO:994 258966 Contig B Arabidopsis thaliana
TTATCATCCACGCATTAGATCAATGTCCATATGGGGGTGATGCATATCCATTGACCTTGAACCAGTTGACCAAATGCCT
ACAGGAGTCTGAACAATGTTCTGACTTTGCTGAGGAACAGGAGGTGACGTTGCTGCTGTGTGATCGTTGTTGTTTTCCA
AAGCATCAGTATCTTGGACATCTTCAGAAGTTTCTTCACGTCATATAATCTTCCCTTTCGGAATTGCCCAAATGAAGCT
GCCAACAATGAGCTGGACTTGGCTTGCTGCTATTATAGGACCTCCAATTCCACCACCAATGACACGACCATCGGGGCTA
GCAAGTGAGACCGCTAGACTTCCAGTGCGGTTTGGGTAGTCATTGTCAGTCGTGTTCAGATAAGAACTTGAGAGAGATA
TGAGCTCTAATAGACCCTCGTATATAATATTTCCATGAGAAGGTGCTGGCTGA > SEQ ID NO:995 258967 Arabidopsis thaliana
GCAGCATGAGTTTACCAAGCTCCGATGGATTTGGTTCGATTCCGAGCACGGGACGGACCATGACGGTGTCGTTTTCTGA
GGATCCGACGACGAAGATTCGGAAGCCGTACACAATCAAGAAGTCGAGAGAGAATTGGACAGATCAAGAGCACGATAAA
TTTCTACAAGCTCTTCACTTATACGATAGGGATTGGAACCAAAATAGAATGCTTTGTCGGATCAAAAACAGCAGTTCAG
ATACTAAGCCACGCTCATAAATACTTTCTCAAAGTTCAGAAGAGTGGTGCTAACGAACATCTTCCACCTCCTCGACCTA
AGAGGAAAGCGAGTCATCCTTATCCTATAAAGGCTCCTAAAAATGTAGCTTATACCTCTCTCCCGTCTTCGAGTACATT
ACCGTTGCTTGAGCCTGGTTATTTGTATAGCTCTGATTCGAAGTCATTGATGGGAAACCAGGATGTGTGTGCATCTACC
TCTTCTTCGTGGAATCATGAATCG > SEQ ID NO:996 258970 Arabidopsis thaliana
GCAGCATGGCGGCTTCTCCGTTGGTGGTTCAGAAAACAGAGGAGGAGTGGCGTGCGGTTCTTTCTCCGGAGCAGTTTCG
TATTCTTCGTCAAAAAGGCACTGAAAAGCCAGGAACTGGAGAATATGACAAGTTTTTCGAGGAAGGAATCTTCGATTGC
GTAGGATGCAAGACTCCTCTTTATAAATCAACCACGAAGTTCGATTCCGGATGTGGCTGGCCAGCTTTCTTTGAAGGAC
TCCCTGGTGCCATAAACCGAACCCCTGATCCAGATGGGAGAAGAACTGAGATCACTTGTGCTGCGTGCGATGGACATTT
AGGCCATGTTTTCAAAGGAGAAGGTTACGGTAATCCAACCGATGAACGTCATTGCGTTAACAGTGTTTCGATCAGTTTT
AACCCGGCAAAATCTTCCTCTATAATCTGATAA > SEQ ID NO:997 258978 Arabidopsis thaliana
gcagcatggatgtgacagatgatgaagagatccaccaagatcgccattcctacgcttctgtttccaagcatcatcatac
tAATAACAACACCACCAACGTTAATGCTGCTGCTTCTGGGCTTCTCCCTACCACCACCAGTGTTCATGGGCTTCTCGAA
TGTCCTGTCTGCACCAATTCTATGTACCCTCCCATTCATCAGTGTCACAATGGACATACGTTGTGTTCAACCTGTAAAG
CCAGGGTTCACAACCGCTGCCCAACTTGTAGACAAGAGCTCGGTGATATCCGTTGTTGGCACTGGAAAAAGTACCCGA
ATCACTTGAACTACCTTGTAAACACATGTCACTTGGATGTCCTGAAATCTTCCCTTATTACAGTAAGCTCAAACATGAG
ACTGTATGTAACTTCAGACCTTATAGCTGCCCTTATGCTGGATCCGAGTGTTCTGTTACGGGCGATATCCCTTTCTTAG
TTGCTCATCTGAGGGGTGATCATAAGGTGGATATGCATTCTGGGTGTACTTTCAACCATCGTTATGTCAAGTCTAATCC
TCGTGAAGTCGAAAACGCCACATGGATGTTAACTGTCTTTCACTGCTTCGGTCAATACTTCTGTCTTCACTTTGAGGCA
TTCCAGCTCGGAATGGCTCCAGTCTACATGGCGTTCCTGCGTTTCATGGGGACGAGACAGAAGCTCGAAACTACAATT
ACAGTTTAGAAGTGGGAGGTTATGGTCGGAAGCTGATATGGGAAGGAACACCAAGAAGCGTAAGAGACAGCCACAGGAA
```

FIG. 1 continued

AGTTAGAGACAGTCATGATGGACTAATTATACAAAGAAACATGGCTCTCTTCTTCTCAGGTGGAGATAGGAAAGAGCTG
AAACTTCgagtcactggaaggatatggaaagagcaacaacaaagtggtgaaggtggaggagcttgtatcccaaacttgt
cttgataa > SEQ ID NO:998 258996 *Arabidopsis thaliana*
GCAGCATGGAAACGAAGGCGGCTCCTGAAGCTGGTATGATCAAAAAGTCCAACGAGGAGTGGCGTACGGTTCTATCTCC
TGAACAGTTTAAGATTCTTAGAGAGAAATCTATTGAAAAGAGAGGGTCAGGAGAATATGTGAAGTTGTTCGAGGAAGGA
ATCTACTGTTGTGTTGGTTGTGGAAATCCGGTTTATAAATCAACCACTAAATTCGATTCCGGTTGCGGTTGGCCGGCTT
TTTTTGATGCTATTCCTGGCGCCATTAACCGAACCGAGGAGAGAGCTGGATTAAGATATGAGATAACTTGCACAAAATG
TGATGGACATCTAGGTCATGTCTTAAAAAATGAAGGTTTTCCAACACCAACTGACGAACGCCATTGCGTCAACAGCGTT
GCTCTCAAGTTCTCTTCCGCTATCACATCTCAGTGATAA > SEQ ID NO:999 259006 *Arabidopsis thaliana*
GCAGCATGGGAAGGTCTCCTTGCTGTGAGAAAGACCACACAAACAAAGGAGCTTGGACTAAGGAAGAAGACGATAAGCT
CATCTCTTACATCAAAGCTCACGGTGAAGGTTGTTGGCGTTCTCTTCCTAGATCCGCCGGTCTTCAACGTTGCGGAAAA
AGCTGTCGTCTCCGATGGATTAACTATCTCCGACCTGATCTCAAGAGGGGTAACTTCACCCTGAAGAAGATGATCTCA
TCATCAAACTACATAGCCTTCTCGGTAACAAGTGGTCTCTTATTGCGACGAGATTACCAGGAAGAACAGATAACGAGAT
TAAGAATTACTGGAACACACATGTTAAGAGGAAGCTATTAAGAAAAGGGATTGATCCGGCGACTCATCGACCTATCAAC
GAGACCAAAACTTCTCAAGATTCGTCTGATTCTAGTAAAACAGAGGACCCTCTTGTCAAGATTCTCTCTTTTGGTCCTC
AGCTGGAGAAAATAGCAAATTTCGGGGACGAGAGAATTCAAAAGAGAGTTGAGTACTCAGTTGTTGAAGAAAGATGTCT
GGACTTGAATCTTGAGCTTAGGATCAGTCCACCATGGCAAGACAAGCTCCATGATGAGAGGAACCTAAGGTTTGGGAGA
GTGAAGTATAGGTGCAGTGCG > SEQ ID NO:1000 259007 *Arabidopsis thaliana*
gcagcatgggtcttgatgattcatgcaacacaggtcttgttcttggtttaggcctctcaccaacgcctaataattacaa
tCATGCCATCAAGAAATCTTCCTCCACTGTGGACCATCGTTTCATCAGGCTCGATCCGTCGTTGACTCTAAGCCTATCC
GGTGAGAGCTACAAGATCAAGACTGGTGCCGGCGCCGGCGACCAAATTTGCCGGCAGACCTCGTCCCACAGCGGCATCT
CATCTTTCTCGAGCGGAAGGGTAAAGAGAGAAAGAGAAATCTCCGGCGGCGATGGAGAAGAAGAGGCGGAGGAGACGAC
GGAGAGAGTGGTGTGTTCGAGAGTGAGTGATGATCATGACGATGAAGAAGGTGTTAGTGCTCGTAAAAAGCTTAGACTC
ACTAAACAACAATCTGCTCTTCTCGAAGATAACTTCAAACTTCATAGCACCCTTAATCCCAAGCAAAAACAAGCTCTTG
CGAGACAGCTGAATCTAAGGCCTAGACAAGTTGAAGTGTGGTTCCAAAACAGGAGAGCTAGAACAAAACTAAAGCAAAC
AGAAGTGGATTGTGAGTTTTTGAAGAAATGTTGCGAGACTTTAACGGATGAGAATAGAAGGCTTCAAAAACAGCTTCAA
GACCTTAAGGCTTTAAAATTGTCTCAACCGTTTTACATGCACATGCCGGCGGCGACTTTGACTATGTGCCCTTCTTGTG
AGAGACTCGGCGGTGGTGGTGTCGGAGGAGATACGACGGCGGTTGATGAAGAAAcggcgaaaggagctttctccatcgt
cacaaagcctcgtttctataacccttctcactaatccttctgcagcatgttagtaa > SEQ ID NO:1001 259018 *Arabidopsis thaliana*
gcagcatgggttccaattttcattacacaatagatctcaatggagatcaaaaccatcagcctttttcgcttctcttgg
aTCCTCTCTTCATCATCATCTACAACAACAACAACAACAACAACATTTTCATCACCAagcTTCTTCTAATCCCTCT
TCTTTGATGTCACCGTCTCTTtcCTACTTTCCTTTCTTGATAAACTCTCGCCAAGATCAAGTATATGTGGGTACAACA
ATAACACTTTTCATGATGTTCTTGATACCCATATCTCCCAACCTCTCGAGACCAAGAACTTTGTATCTGATGGTGGTTC
ATCATCAAGTGATCAAATGGTGCCCAAGAAGGAGACACGACTAAAATTGACGATAAAGAAgaAAGATAATCATCAAgaC
CAAACCGATCTTCCTCAATCCCCAATAAAAGACATGACAGGAACTAACTCGCTCAAGTGGATATCTTCGAAGGTGAGAT
TAATGAAGAAGAAAAGGCGATTATTACCACCAGCGACAGCAGCAAGCAACACACTAATAACGACCAATCCTCAAACCT
AAGCAATTCGGAAAGACAGAATGGTTATAACAACGATTGCGTGATTAGGATTTGCTCCGATTGTAACACAACCAAGACT
CCTCTTTGGAGAAGTGGTCCGAGAGGTCCCAAGTCTCTTTGTAACGCTTGTGGAATAAGGCAAAGGAAGGCCAGGCGGG
CCGCTATGGCCACGGCAACCGCAACCGCAGTCTCTGGCGTATCCCCACCGGTCATGAAGAAGAAGATGCAAAACAAGAA
CAAGATATCAAATGGAGTTTATAAAATCTTATCTCCTTTGCCCCTAAAGGTAAACACGTGTAAGAGAATGATCACACTA
GAGGAGACCGCATTAGCCGAGGATTTGGAGACCCAGAGCAACTCCACGATGTTATCATCTTCAGACAATATCTATTTCG
ATGATCTAGCATTACTGTTGAGCAAAAGTTCAGCTTATCagcaagtttccctcaagatgagaaggaggctgccatttt
actaatggctctatcgcacggaatggttcacgggtgataa

FIG. 1 continued

> SEQ ID NO:1002 259028 Contig A *Arabidopsis thaliana*
GCAGCATGCTGATGTCATCGCTCTATCGCCAACAACACTCATGGCAACAAACAGATTCGTGTGCGAGATCTGCAACAAA
GGGTTTCAAAGGGACCAGAATTTACAACTACATCGCCGTGGCCACAACCTTCCATGGAAGCTAAAGCAACGGTCCAAAC
AAGAAGTGATAAAGAAGAAAGTATACATATGTCCTATCAAGACTTGTGTACACCATGATGCCTCCAGGGCCCTTGGAGA
CCTCACTGGGATCAAGAAACACTACAGCCGCAAACACGGTGAAAAGAAGTGGAAGTGTGAAAAGTGTTCTAAGAAATAC
GCTGTTCAGTCTGATTGGAAGGCACATGCGAAAACTTGTGGTACTCGTGAGTATAAATGTGACTGTGGCACGTTGTTCT
CCAGGAAAGATAGTTTCATCACACATAGAGCGTTCTGCGACGCATTAACTGAGGAAGGAGCGAGGATGAGTTCACTTAG
TAACAACAATCCGGTGATCTCTACGACGAATCTGAATTTTGGAAATGAGTCAAATGTTATGAATAATCCAAATCTTCCT
CATGGATTTGTACACCGAGGAGTTCATCATCCCGACATTAATGCTGCTATCTCTCAATTCGGTCTAGGGTTTGGACATG
ACCTAAGTGCAATGCATGCGCAAGGTCTATC > SEQ ID NO:1003 259028 Contig B *Arabidopsis thaliana*
TTATCAACCCAATGGAGCAAACCTTGCGAGTTCTTGAGGCAAAAACGGACGACGACCCGTTTGGTGAGGGTGATGCTCG
TTGCTCACTCCAAGAAAATCCCGGGTTAGACCCATCTGTTGAGCCGGGTTTAGACCCGATCGGTTCGATTGAAAGGGA > SEQ ID NO:1004 259033 *Arabidopsis thaliana*
gcagcatgcggatgttgtgcgatgcttgcaaaaacgcagccgcaatcatcttttgcgccgccgatgaagctgcccttg
tcgcCCCTgctatGAAAacgttCATATGTgcgacaaGCTacctagtcggcATGTACGtGttgGtTTAGCTGAACCAAGC
AATGCCCCATGCTGTGATATATGcgaaaATGCACCTgccTTCTtataCTGTGagaTagacggtagttcTCttagtCTgc
caTGTGACatGGTAGtacATGttgGTGGCAagagaccacacGGGCggtttcttttgCTGagaCagagaATCGAGtttcC
AGgggAtaatgcTaaagaaaacaaTAcgaGGGACAATTTGCAGAACCAAAGAGTCTCTACAAATGGAAATGGTGAAGCC
AATGGGAAGaTtGATGACaaaatGAtggATCTAattGCTAATCCacaaatagtacatGAACCATCATCaAataacAACG
GGattgATGTatataaCgagaacaaTcacgaacctgcaggCCtagtaccagtTGGACCCTtgaaacgAaagtctg > SEQ ID NO:1005 259045 *Arabidopsis thaliana*
gcagcatggagtggtcaacaacgagcaacgtagaaaacgtgagagtagctttcatgctaccgccatggccggagtctag
tTCCTTTAACTCGCTCCACAGCTTCAACTTTGATCCTTACGCAGCAGGAAATTCATATACGCCTGGCGATACACAAACC
GGACCGGTTATCTCTGTACCGGAATCAGAAAAGATCATGAATGCGTACCGATTTCCGAACAACAACAATGAGATGATAA
AAAAGAAGAGACTAACGAGTGGACAATTAGCTTCACTTGAGCGAAGTTTTCAAGAAGAGATCAAATTAGATTCAGACAG
GAAGGTGAAGCTGTCGAGAGAGCTCGGTCTGCAGCCACGTCAGATAGCAGTTTGGTTCCAAAACCGCCGTGCACGGTGG
AAGGCGAAGCAGCTTGAGCAGTTGTACGACTCGCTTAGACAAGAGTACGACGTCGTTTCTAGGGAGAAACAAATGTTAC
ACGATGAGGTGAAGAAGCTGAGAGCTTTACTAAGAGACCAGGGTTTGATCAAGAAGCAAATCTCTGCCGGGACCATCAA
AGTTTCCGGTGAGGAAGACACGGTGGAGATTTCATCGGTGGTGGTAGCTCATCCAAGAACGGAGAATATGAACGCAAAT
CAAATCACCGGAGGGAATCAAGTTTACGGTCAatacaacaatccgatgctggttgcttcctctggctggccgtcatacc
cctgataa > SEQ ID NO:1006 262408 *Arabidopsis thaliana*
TTATTACGTACTTGTACTTGTTGTTTTTTATAAGGATCTAATCCTAGACGGAGCTCAAGATCTATCACGTCTGCACTT
TGAGATAAAGCCTTTTGAAGTATCCTCATATTTTTCTTTTCTTCATCTCCTAAACCTTTTTCGCTTTTATCATCTTCTC
CTTTTCTTCTTGGACCGACCGTATCAACGAAGAAAGGTAACTCAATAAGCTCTTGCCCAAACCGATTTCTCGAAGTGGT
GCAAATGGCATCTTCACTGTCTTCTTCTTTTAGGTTCGCTTGTCGAAGTTTTGCCCTGTCTTTTCTGTGGATGTTCATG
TGCCCTCCTAAAGCTTGTGCGTTGGAAAAACCTCTCTCGCAAAATTCGCATATGTATGGTCTTGCTTGTGATCCGGACC
ATGAATATGATCGACGATCCAAGTATTTTCTATTCATGCTGC > SEQ ID NO:1007 262505 *Arabidopsis thaliana*
gcagcatggacgaggctaccggagaaacagaaactcaagatttcatgaacgtcgaatccttctctcagcttcctttcat
tCGCCGTCCTAAAGATAAGAACCCTAAACCCATTCGTGTCTTCGGAAAAGATTTCACCGGCAGAGATTTCTCTATTACT
ACCGGTCAAGAAGactaCACCGATCCTTACCAGACCAAAAACAAAGAAGAAGAAGAGGAAGAAGACCAAACCGGAGACA
ACAGTACGGACAATAATAGCATCAGCCACAACAGGAGATTCGAGTGTCACTATTGCTTTAGAAATTTTCCTACTTCACA
AGCCCTAGGTGGACACCAAAACGCTCACAAACGCGAACGTCAGCTTGCCAAACGCGGTGTTTCCTCTTACTTTTATCAT
CCTGACAATAACCCTTACAGTTACCGTCATTACCCGTCGTGGACCAATGGTCCGTTAACCGCGGCTAGGTCCTATGGAG
GATTTTCTTCTGGTCCTAAGCCGTCGGGGTATTATACACGACCCAGCTATGGGAGTCAGTTAGGACTATGGCGTCTACC
GCCTCGCGTTCAAGGCGTTTATAACTCAAACGCAGCGTTTACTAGTAATGGCTCTTCTTCTTCTTCTAATTCGACTTTA

FIG. 1 continued

CCGTTGTTGACCCGTTCTCAAACTCAACTATCATCGCAAGTGGGTGGCTCCGCTGCTCagaacagaatgtcatcgtacg
gttacggattgagccctaacgtgcaagatcatgtgagtctcgatcttcatctttaataa > SEQ ID NO:1008 262509 *Arabidopsis thaliana*
gcagcatgactcaaaagctgtttatacagtatagtctacggtcttacatcgtatttggaaatatgaccaaattacccc
tTGGTTTGTCCATAAATATCAAGCTCCAACAATgcaATTCTTCCCTTTTCCCCTTCTAATTTCTCTCATCTCTCTAtta
gaAAAATTATtagcAATTAtgtTgTccactggaCCGgccttTTCATTCTCCGAACCGGGTTTGGTTAATCAATTCTCGG
GTTTCCAAACCGGGTTCACTCCTTGGGAATGGGATTGGTCTGATCTCTTTTCGTGGACCAAATGTCTCTTGAACCGGC
CATCCCTAATCCTTGTTATGGTGAATCCGACACTGGTTCCGTCAAAATTAATTCCGGTTCTCATGACATGAAAACCGGT
TCTGACGAATCTTGTGCCGGTTTCGTCAAAATTAATCCTCGTTGTGACGACGCCGACATATCAAACGATCTACCGTGCT
CTCAAGCAGATGAACCGGACTCGGACGACACAAAACAATTGACAGCCATCACAAATTTCGGTTCGGGAGAGAATAACCA
TAACCGGAAAAAAATGATCCAACCGGAGATGACCGACGAGCGGAAGAGGAAGAGGATGGAGTCAAACCGGGAATCAGCG
AAACGGTCAAGAATGCGTAAACAAAGTCACATTGATAACTTACGAGAGCAAGTAAACCGGTTGGATTTAGAAAACCGTG
AGCTCGGGAACCGACTCCGGTTAGTTTTACACCAGCTTCAACGAGTGAATTCCGACAATAACCGGCTCGTGACAGAACA
AGAGATACTCCGGCTAAGATTGTCGGAGATGCGTCGGATTCTGATCATTAGACAACttcaacaacagcaacaatgggaa
ctacataaccggagaatgatcatgactgaacaaaaccaccctcatcttcaatgataa > SEQ ID NO:1009 262648 Contig A *Arabidopsis thaliana*
GCAGCATGGGTCAAAAGTTTTGGGAGAATCAAGAAGATCGAGCGATGGTTGAATCCACCATAGGCTCTGAAGCTTGCGA
CTTTTTCATCTCAACAGCTTCAGCTTCCAACACTGCCTTGTCCAAGCTTGTCTCACCACCAAGTGATTCCAATCTCCAA
CAAGGGTTACGTCACGTTGTTGAAGGATCTGATTGGGATTATGCTCTTTTCTGGCTAGCGTCCAACGTTAATAGCTCTG
ATGGTTGTGTCTTGATCTGGGGAGATGGTCATTGCCGTGTCAAAAAGGGTGCTTCAGGTGAGGATTACTCTCAGCAAGA
TGAGATCAAAAGACGTGTGCTTCGCAAGCTTCACTTGTCGTTCGTTGGTTCAGATGAAGATCATCGTTTGGTGAAATCA
GGAGCTCTTACTGATCTCGACATGTTTTATCTGGCTTCTTTGTACTTTTCCTTTAGGTGTGATACCAATAAGTACGGTC
CTGCTGGAACCTATGTGTCTGGGAAGCCTCTTTGGGCT > SEQ ID NO:1010 262648 Contig B *Arabidopsis thaliana*
TTATTACTGTGATAGAGAGGCAAGGAGCTTGTCCTTCAACTGCTCAGCGGTGCAGCCACCCTGAGGCCGGAGAGTGAAT
GTGTGAACCACACCCTCCTCTGTGATGGCCACGTTGGAATCATGAGGCATAACTTCATTCTCCCTCAACGTTTGTATCA
CCTTTGAAACTGGATGAGTTTCCAACGGACAGCTTAGCCTTACAACTGCATCATCATGCCTCTGTTGATAATCAACCTC
TGCTGGAGTTATCTGATTACTCTCCCTCCTCTTCATTATCTGCTTCTCTGTTTCATACACCCTGATTTTCTTCTGCATA
TCCGTGATGTAAGTGATTGCGTCTGCAAGGAGCGAAGCCTTGTCCATCTTGGAGATGTTAGGCACCACCGCTCTCAAAG
CGTAGAATCTCTGGTTCAGCTTCTCCCTCCTCTGCCGTTCCGCTTCCACGTGGTTTAGAGCCTCTTCTCTTCCATTTGC
TGGTTTTCTCCCTCTCTTCCTCGGCTTTTGCTCGTCAGTTAGATACAATGTCTCATCTTTCCCTTGCTCATAACCATAC
ACTTGATTAGAGCCTCCGATCGCTTGCACCTCATACGATTCCAAT > SEQ ID NO:1011 262650 *Arabidopsis thaliana*
GCAGCATGGAGAGACGAACGAGACGAGTGAAGTTCACAGAGAATCGTACGGTCACAAACGTAGCAGCTACACCATCTAA
CGGGTCTCCGAGACTGGTCCGTATCACTGTTACTGATCCTTTCGCTACTGACTCGTCTAGCGACGACGACGACAACAAC
AACGTCACGGTGGTTCCAAGAGTGAAACGATACGTGAAGGAGATTAGATTCTGCCAAGGTGAATCTTCTTCCTCCACCG
CGGCGAGGAAAGGTAAGCACAAGGAGGAGGAAAGCGTAGTGGTTGAAGATGACGTGTCGACGTCGGTGAAGCCTAAAAA
GTACAGAGGCGTGAGACAGAGACCTTGGGGAAAATTCGCGGCGGAGATTAGAGATCCGTCGAGCCGTACTCGGATTTGG
CTTGGGACTTTTGTCACGGCGGAGGAAGCTGCTATAGCGTACGATAGAGCCGCGATTCATCTCAAAGGACCTAAAGCGC
TCACGAATTTCCTAACTCCGCCGACGCCAACGCCGGTTATCGATCTCCAAACGGTTTCCGCCTGCGATTACGGTAGAGA
TTCTCGGCAGAGCCTTCATTCACCGACCTCTGTTCTAAGATTCAACGTCAACGA > SEQ ID NO:1012 262658 *Arabidopsis thaliana*
gcagcatggctctcgacactctcaattctcccacctccACCACCACAACCACCGCTCCTCCTCCTTTCCTCCGTTGCCT
CGACGAAACCGAGCCCGAAAACCTCGAATCATGGACCAAAAGAAAACGTACAAAACGTCACCGTATAGATCAACCAAAC
CCTCCTCCTTCTGAAGAAGAGTATCTCGCTCTTTGCCTCCTTATGCTCGCTCGTGGCTCCTCCGATCATCACTCTCCAC
CGTCGGATCATCACTCTCTTTCTCCACTGTCCGATCATCAGAAAGATTACAAGTGTTCCGTCTGTGGCAAATCTTTCCC
GTCTTACCAAGCGTTAGGTGGACACAAAACAAGTCACCGGAAACCGGTTAGTGTCGATGTTAATAATAGTAACGGAACC
GTTACTAATAACGGAAATATTAGTAACGGTTTAGTTGGTCAAAGTGGGAAGACTCATAACTGCTCTATATGTTTTAAGT
CGTTTCCCTCTGGTCAAGCATTGGGTGGTCACAAACGTTGTCACTATGATGGTGGTAACGGTAACAGTAACGGTGACAA

FIG. 1 continued

TAGCCACAAGTTTGACCTAAATTTACCGGCTGATCAAGTTAGTGATGAGACAATTGGAAAAAGTCAACTCTCCGGTGAA
GAAACAAAGTCggTGttGTGATaa

> SEQ ID NO:1013 262715 Contig A *Arabidopsis thaliana*
GCAGCATGCAAGACTCTTCCTCTCACGAATCGCAACGTAACCTCCGGTCACCGGTGCCGGAGAAAACCGGAAAGAGTTC
TAAGACTAAAAATGAGCAAAAAGGTGTTTCTAAACAACCAAATTTTCGTGGGGTCAGAATGAGACAATGGGGAAAATGG
GTGTCTGAAATTAGAGAACCAAGAAAGAAATCAAGAATATGGCTCGGTACTTTCTCTACGCCGGAGATGGCGGCGCGTG
CACACGACGTGGCGGCTTTAGCCATCAAAGGTGGCTCTGCCCACCTTAATTTCCCGGAGCTAGCTTACCATTTGCCGAG
ACCGGCTAGCGCGGACCCTAAAGACATTCAAGAAGCCGCCGCCGCAGCAGCTGCCGTTGACTGGAAAGCACCGGAGTCT
CCGTCTAGCACCGTGACGTCATCTCCAGTCGCCGACGACGCTTTCTCCGATCTTCCTGATCTTTTGCTTGACGTGAATG
ATCACAACAAAAACGATGGATTCTGGGACTCGTTTCCGTACGAAGATCCTTTCTTCTTGGAAAATTACTAGTAA > SEQ ID NO:1014 262715 Contig B *Arabidopsis thaliana*
TTATTATAAATCCATCAAGACAAATGGATATCTCCCTCGAAATCAGAATCATAGTCCAACGGAACCGACGGGAACATTC
ACATCATCCCTTCGATCATGTAATCCAGAAAAATAGACATCCCCAACAGCGCATCTTCATCCATATAAAAAGCATCACT
CCGCTGCTTCCCAGT > SEQ ID NO:1015 262725 *Arabidopsis thaliana*
gcagcatgaatcttgaccaagaactcgccgagatcagagctagcagttccgaccacaccaattacttctacagctcgga
gAGGAGAGAGCACATGTTCGACAAAGTGTTGACACCAAGTGACGTCGGTAAACTAAACCGGCTCGTGATTCCAAAGCAA
CATGCAGAGAACTTCTTCCCTTTAGAGGACAATCAAAACGGCACAGTGTTGGATTTCCAAGACAAAAACGGCAAGATGT
GGAGGTTTCGTTACTCGTATTGGAACAGTAGCCAATGCTACGTGATGACCAAAGGATGGAGCCGTTTCGTCAAGGAGAA
GAAACTCTTCGCCGGAGACACCGTCTCTTTCTACCGTGGCTACATCCCTGACGATAACGCACAACCGGAGAGACGACGG
AAAATAATGTTCATCGATTGGAGGCCTAGAGCCGAGATAAACTTCGTACACAACATTAACAATCATAACTTCGTTTTCG
GGTCTCCGACATATCCAACGGCTAGGTTTTATCCGGTGACGCCGGAATATTCCATGCCATACCGGAGTTTTCCACCGTT
TTATCAGAACCAATTTCAAGAACGGGAATATTTAGGGTATGGTTATGGTAGAGTTGTTAATGGTAATGGAGTGCGTTAC
TACGCAGGATCACCGTTGGATCAACATCATCAGTGGAATCTTGGTCGATCTGAGCCGTTGGTTTATGACTCGGTTCCAG
TTTTTCCAGCGGGGAGGGTACCTCCGTCGGCGCCTCCTCAGCCGTCGACGACGAAGAAGCTGAGGCTGTTTGGGGTTGA
CGTGGAAGAGTCTTCATCTTCAGGGGATACACGTGGCGAAATGGGAGTAGCAGGGTACTCTTCCTCGTCTCCGGTTGTG
ATCAGAGACGATGATCAATCATTTTGGAGGTCGCCACGTGGCGAAAtggcatcgtcttcttcggctatgcagctaagtg
atgatgaagaatataagaggaaagggaaatctttagagctttgataa > SEQ ID NO:1016 262762 *Arabidopsis thaliana*
gcagcatgatgatcggagaaactcgcaggacttatcccactgttgaaatacctccatggccggtacttgaagagcttac
aACGTCGGAGTTTTTTTCTCCGGTGATGAATAGTCCAGATTGTAGCATGCTTGAAGCTTTGGCGGGGTTGCAGCGTTAT
TTGCCGTCTAACGAACCGGATCCGGAGTCATACCCGGATCTATTGGGTCCGGATTCACCAATCGATGCTTACTCATGCG
ACCATTTCCGTATGTACGATTTCAAAGTCAGGAGGTGTGCTCGTGGCCGGAGTCATGATTGGACGGAGTGTCCGTACGC
TCATCCCGGAGAAAAAGCTCGCCGGAGAGATCCGAGGAAGTACCATTACTCTGGTACGGCTTGTCCTGATTTTCGTAAA
GGTGGCTGCAAGAAAGGTGACTCTTGTGAGTTTGCTCATGGTGTTTTCGAGTGTTGGCTTCATCCAGCTCGTTACCGTA
CTCAGCCGTGTAAAGACGGTGGTAACTGTCTCCGGAAAATTTGTTTCTTTGCTCATTCACCGGATCAGCTTAGGTTTTT
ACATACTCGGAGCCCTGACAGAGTTGATTCTTTTGACGTTTCGTCTCCGATTCGTGCTAGAGCATTTCAGCTGTCGATT
TCTCCGGTTTCTGGTTCGCCACCGATGAGTCCAAGAGCTGACTCGGAGTCTTCTCCGATGACTCAGTCACTGAGTCGAT
CTCTCGGGTCTTGTTCGATAAACGACGTCGTTCCTTCGTTTAGGAATTTACAGTTTAATTCGGTAAAATCATTTCCTCG
TAACAATCCTTTATTCGGATTCGGGTCGCCCCGTGGATCGATCTTGGGTCCTGGGTTTCAGTCTCTGCCTACAACACCG
ACCCGACCAGGGAATCTGGATATTTGGGAGTATGGTTTGGAGGAAGAACCCGTAATGGAGCGTGTCGTTGAGTCGGGTC
GTGAGCTACGAGAAAAGATGCGCGAGAAACTGCACAAGGAGAATTGCATGGatcgagttgcccaggatccggatcagaa
tttgggtgaggctcctgatgtcgggtgggtatctgaccagctcatgtaataa > SEQ ID NO:1017 262783 *Arabidopsis thaliana*
gcagcatgaacaacaatcattcctatgatgatcgcagttttcacattccacttcatccttctaacacaagcaaccctaa
tCCAAATCTCCAGTTTGCTTTATCTTCAAGCTACGATCACAGTCCTAAGAAGAAACCGCACCAAAACCGTTGCTTCATCC
TCTAGTTCTTCACCAAAATCCGCGTCAAAACCAAAATACACCAAAAAACCAGACCCAAATGCCCCCAAAATCACACGTC
CATGTACTGAATGTGGCAGAAAGTTTTGGTCTTGGAAGGCTCTCTTTGGTCACATGAGATGTCACCCTGAGCGTCAATG
GCGTGGCATTAATCCTCCTCCTAACTACCGTGTGCCCACCGCGGCTTCTTCAAAACAGTTAAACCAGATATTACCAAAT

FIG. 1 continued

```
TGGGTCTCATTTATGTCCGAGGAAGACCATGAAGTCGCTTCCTGTCTCTTAATGCTGTCTAATGGTACACCATCATCAT
CGAGTATTGAACGGTTCGAGTGTGGAGGATGTAAGAAAGTGTTTGGATCACATCAGGCTTTAGGAGGACACAGAGCGAG
TCATAAAAACGTTAAAGGCTGTTTCGCTATCACAAACGTAACCGATGATCCTATGACGGTTTCTACTTCTAGTGGGCAT
GATCATCAGGGAAAAATCCTTACGTTTTCAGGGCATCATAAGTGTAATATCTGTTTTAGAGTGTTCTCGAGTGGTCAAG
CTTTAGGAGGTCACATGAGATGTCATTGGGAAAAGGAGGAGGAGCCGATGATCAGTGGTGCTTTGGATTTGAatgttcc
tccaacaatacaggatctttctacttcggacacatcagggtgttgtttagatcttaggttaggactctaataa > SEQ ID NO:1018 263004 Arabidopsis thaliana
GCAGCATGAACTCATTTTCTGCTTTTTCTGAAATGTTTGGCTCCGATTACGAGTCTTCGGTTTCCTCAGGCGGTGATTA
TATTCCGACGCTTGCGAGCAGCTGCCCCAAGAAACCGGCGGGTCGTAAGAAGTTTCGTGAGACTCGTCACCCAATATAC
AGAGGAGTTCGTCGGAGAAACTCCGGTAAGTGGGTTTGTGAGGTTAGAGAACCAAACAAGAAAACAAGGATTTGGCTCG
GAACATTTCAAACCGCTGAGATGGCAGCTCGAGCTCACGACGTTGCCGCTTTAGCCCTTCGTGGCCGATCAGCCTGTCT
CAATTTCGCTGACTCGGCTTGGAGACTCCGAATCCCGGAATCAACTTGCGCTAAGGACATCCAAAAGGCGGCGGCTGAA
GCTGCGTTGGCGTTTCAGGATGAGATGTGTGATGCGACGACGGATCATGGCTTCGACATGGAGGAGACGTTGGTGGAGG
CTATTTACACGGCGGAACAGAGCGAAAATGCGTTTTATATGCACGATGAGGCGATGTTTGAGATGCCGAGTTTGTTGGC
TAATATGGCAGAAGGGATGCTTTTGCCGCTTCCGTCCGTACAGTGGAATCATAATCATGAAGTCGACGGCGATGATGAC
GACGTATC > SEQ ID NO:1019 263005 Arabidopsis thaliana
TAGCGTTTGCGTGCAGCGGTTTCTCTTTGTGCGTTAAAGAAGACGGCCGCGACAGGGAGACCAAGATCATACTCGACCG
CAAATTTACGAGTGTTGAAATGATCCCTCGAAGGGATATTAGGAAAGATAACACGTCTTTGCTTCTGCCTGAACAGAAC
AAACACAAACCTATGTATCCCTATGCTTGGCCTTGGCAATTCATAGCTCACCACCTCTTTGCCAAACGTAGCATCTGTT
GTGCCGGGAATGTTTGTAACGATCCAGTGCAGGTGTTCTTTTAGAAAGGGGTCACTAGGACCTGGAACATCTGGGTCTG
TCATCACCAAAGTGAAGAAGGATCTGAGATCACCACCATGGATCTCAACCCTAGGCTTGGAGGAAACAGAAGAAGGAAA
GAGCTCATGGCCATTGGAGACTTGCTTCTTGTTATAACTAACATTCATCTTAGTTGTTGGAGTGAAGAAATCAAGAACA
TCTCCTACCACTCTCCCCATTATCAATGGCTCTATCACTCTAGTTCCCATATTCTCCATGCTGC > SEQ ID NO:1020 263006 Arabidopsis thaliana
gcagcatgtctatgtcgtctatgtcctcccctttcctcagctgtttgttcaccggaccacttctctccttccgaccatct
cTGCTATGTCCAATGCAACTTTTGCCAAACCATCCTTGCGGTTAATGTTCCTTACACAAGCTTGTTCAAGACCGTAACT
GTCCGATGGTTGCTGTACCAATCTCCTTTCGGTGAACATGAGATCATATGTCCTCCCAGCTTCTAACCAGCTCCAGC
TCCAGCTCGGTCCTCACTCTTACTTCAATCCCCAGGATATTCTGGAGGAGCTGAGAGATGCACCGTCTAACATGAATAT
GATGATGATGAATCAACATCCTACTATGAATGACATACCATCTTTCATGGATCTTCATCAACAACATGAGATTCCTAAA
GCACCACCCGTTAACCGCCCTCCAGAGAAAAGACAGAGAGTCCCATCCGCATATAACCGATTCATCAAGGAGGAGATCC
AACGTATCAAAGCTGGTAATCCTGATATAAGCCACAGAGAAGCCTTTAGTGCTGCTGCCAAGAATTGGGCCCACTTCCC
CCACATACACTTCGGGCTCGTGCCAGACAATCAACCCGTGAAGAAAACCAACATGCCCCAACAGGAGGGAGAGGATAAC
ATGGTGATGAAgaagggttctacgctcctgcagctgctaacgttggtgtgactccttattaa > SEQ ID NO:1021 263009 Arabidopsis thaliana
GCAGCATGGCCAAGATGGGCTTGAAACCCGACCCGGCTACTACTAACCAGACCCACAATAATGCCAAGGAGATTCGTTA
CAGAGGCGTTAGGAAGCGTCCTTGGGCCGTTATGCCGCCGAGATCCGAGATCCGGGCAAGAAAACCCGCGTCTGGCTT
GGCACTTTCGATACGGCTGAAGAGGCGGCGCGTGCTTACGATACGGCGGCGCGTGATTTTCGTGGTGCTAAGGCTAAGA
CCAATTTCCCAACTTTTCTCGAGCTGAGTGACCAGAAGGTCCCTACCGGTTTCGCGCGTAGCCCTAGCCAGAGCAGCAC
GCTCGACTGTGCTTCTCCTCCGACGTTAGTTGTGCCTTCAGCGACGGCTGGGAATGTTCCCCCGCAGATCGAGCTTATT
CTCGGCGGAGGAGGCGGCGGCTCGTGTTATCAGATCCCGATGTCGCGTCCTGTCT > SEQ ID NO:1022 263030 Arabidopsis thaliana
gcagcatgatgcatcagatgttgaataagaaagattcagctactcattccactttgccataccttaatactagcatctc
tTGGGGAGTGGTTCCAACTGATTCCGTTGCTAATCGCCGCGGTTCTGCTGAATCACTAAGCTTGAAGGTTGATTCAAGA
CCTGGGCATATACAAACTACAAAGCAAATCAGTTTTCAGGACCAAGATTCATCTTCAACACAGTCCACTGGTCAATCTT
ATACTGAAGTTGCTAGTAGTGGTGATGATAATCCTTCCAGACAAATCTCCTTTTCGGCTAAATCAGGATCTGAAATAAC
TCAACGGAAGGGGTTTGCAAGTAATCCTAAACAAGGCTCGATGACTGGATTTCCGAATATTCACTTTGCTCCTGCACAG
GCTAATTTCTCATTTCACTATGCTGATCCACATTATGGTGGTTTATTAGCTGCAACTTACCTACCACAGGCACCAACAT
GCAATCCTCAAATGGTGAGTATGATTCCTGGTCGTGTTCCTTACCAGCAGAGCTCACAGAAACTGATCCAGTCTTTGT
```

FIG. 1 continued

```
CAATGCGAAGCAATACCACGCAATTATGAGGAGGAGACAGCAACGTGCTAAGCTTGAGGCTCAAAACAAACTAATCAGA
GCCCGTAAGCCCTATCTTCATGAGTCTCGACATGTTCATGCTCTTAAAAGGCCAAGAGGATCTGGTGGAAGATTCCTAA
ACACCAAAAAACTTCTTCAAGAATCCGAACAGGCTGCTGCTAGAGAACAAGAACAGGACAAGTTAGGCCAACAGGTAAA
CAGAAAGACCAACATGTCTAGATTCGAAGCTCATATGCTGCAGAACAACAAAGACCGCAGCTCAACCACTTCTGGCTCA
GACATCACCTCTGTTTCCGACGGTGCTGATATCTTTGGACACACTGAATTCCAGTTTTCAGGTTTCCCAACTCCGATAA
accgagccatgcttgttcatggtcagtctaatgacatgcatggaggtggagacatgcaccatttctctgtccatatctg
a > SEQ ID NO:1023 263033 Arabidopsis thaliana
GCAGCATGATGAAGAGATTAAGTAGTTCAGATTCAGTGGGTGGTCTCATCTCTTTATGTCCTACAACTTCCACAGATGA
GCAGAGTCCGAGGAGATACGGTGGGAGAGAGTTTCAGTCGATGCTTGAAGGATACGAGGAAGAAGAAGAAGCTATAGTA
GAAGAAAGAGGACACGTGGGCTTGTCGGAGAAGAAGAGAAGGTTAAGCATTAACCAAGTTAAAGCTTTGGAGAAGAATT
TTGAGTTAGAGAATAAGCTTGAGCCTGAGAGGAAAGTTAAGTTAGCTCAAGAACTTGGTCTTCAACCTCGTCAAGTTGC
TGTTTGGTTTCAAAACCGTCGTGCTCGGTGGAAGACAAAACAGCTTGAGAAAGATTACGGTGTTCTTAAAACCCAGTAC
GATTCTCTCCGTCATAACTTTGATTCCCTCCGCCGTGACAATGAATCTCTCCTTCAAGAGATTAGTAAACTGAAACGA
AGCTTAATGGAGGAGGAGGAGAAGAAGAAGAAGAAGAGAACAACGCGGCGGTGACAACGGAGAGTGATATTTCGGTCAA
GGAGGAAGAAGTTTCGTTGCCGGAGAAGATTACAGAGGCACCGTCGTCTCCTCCACAGCTTCTTGAACATTCTGATGGT
CTTAATTACCGGAGTTTCACAGATCTACGTGAT > SEQ ID NO:1024 263037 Contig A Arabidopsis thaliana
GCAGCATGTCTGTAGATTTCTCATCTGAGCGTGTTTGCTATGTCCACTGCAGCTTCTGCACCACGATTTTAGCGGTAAG
TGTACCATACGCAAGTTTGTTCACACTTGTGACGGTGAGATGTGGCCATTGTACCAATTTGCTATCCCTCAACATTGGA
GTTTCACTTCATCAAACCTCAGCTCCTCCCATTCACCAAGATCTTCAGCCTCATAGACAGCACACAACCTCTCTGGTGA
CAAGGAAAGATTGTGCATCGTCTTCTAGGAGCACCAACAATTTATCGGAAAACATTGATCGTGAGGCTCCTAGAATGCC
TCCTATTCGCCCACCGGAGAAAAGACAACGTGTTCCTTCGGCCTACAACAGATTCATCAA > SEQ ID NO:1025 263037 Contig B Arabidopsis thaliana
TTAGTAATAGCCATTAGACTTTTGGCCTGCAACTGACTGGTCTAATTGCTTGCCTTTCTTGTTGCCATCCAGCTTTAAT
CCAAAGTGAATGTGAGGAAAATGTGCCCAATTTTTAGCAGCAGTGCTAAATGCCTCACGGTGGCTAATCTCTGGATTGC
AAGCCTTAATCCTTAGGATTTCGTCCTTGATGAATCTGTCGTATGCCGTATGAACACGTGGTCTATTCTCCGGTGTGCT
AATAGGATGAATACTAAGATCCTCAGGATCAATGTTGTCCGATATATAGTAGGTGCTCCTA > SEQ ID NO:1026 263050 Arabidopsis thaliana
taggagccaaagtagTTGAAACCTTGAGGGAAAGAGTCaGAAACCGGAGGCAtTCTGCTGAACATTGGACTATGTACGT
ACTCAGACGAGTAGTCGTCACCGGTCCAGGTCCACTGTGGTTGGCTATAACACGAATTCGACAAGTCGCTCGGGAGAGG
AGGCAGCTCATTACTACTGTCATTAGAATAGCAATAAGAATTCGAAGATTGAGAGCCACCAAACATGTAACTGTCCACT
TGATCACAATGAGGGcTGAAGCATTGGCGAGTCAGTGGATGAGTATTGGTtaaACATCATCATGTAATCGACAGGATCA
TTGgtAGGAGGAgcAGGAGGAGGTGGAGGAGGAGGAGGATCgtCAGGAgaaacaatGGAGGTGAcGGATGAGGAAGGAG
GCATgtctgagtgaacaAAGTTGgttctGgcACgTgtgCCACGCATGGaccgAGCAGCtgtatggtaGgccgagGCAGC
TTCTTCCGCCGTAtcgaaAGTGCCAAGCcaGTGACGCTCCTTCGTAGTTGGGTctctAAtctCaGCTGCGTATCTTcCC
CAAGGCcttgttctcaccccaagaaaccttgtaccaacctgatcgtcttgcttcttcttgctctttgatgatgttgtgt
tcatgctgc > SEQ ID NO:1027 263060 Contig A Arabidopsis thaliana
TCATCCAAAATAGTTATCAATTTCGTCAAACAAGTCTTGACGTTCATAGACCGGCGTCACATCAACGACGTCGTTTTCA
TCCTCGTGAAGAAACCTCGTAAGTTCTTTCATGAACGCAGTGTTTTCAACACAAGACTCCTCCAACATCATGAAATCTT
CATCATTCAGAAATGTGGAGAACCCGATAGTATCCTCATCATCAACGTTGTTATTACCAACGAAATTATCGCAGTACAT
TAGAGGATTGTTAACGGAGGAATCAGAGAACGTGGACGAAGAACACGTCAGATtaaCGttaccATCAACGTCAAAGTTC
GATGaaACt > SEQ ID NO:1028 263060 Contig B Arabidopsis thaliana
GCAGCATGGTGCGGACACCGTGTTGCAAAGCTGAACTAGGGTTAAAGAAAGGAGCTTGGACTCCCGAGGAAGATCAGAA
GCTTCTCTCTTACCTTAACCGCCACGGTGAAGGTGGATGGCGAGCTCTCCCCGAAAAAGCTGGACTCAAGAGATGCGGC
AAAAGCTGCAGACTGAGATGGGCCAATTATCTTAGACCTGACATCAAAAGAGGAGAGTTCACTGAAGACGAAGAACGTT
```

FIG. 1 continued

```
CAATCATCTCTCTTCACGCCCTTCACGGCAACAAATGGTCTGCTATAGCTCGTGGACTACCAGGAAGAACCGATAACGA
GATCAAGAACTACTGGAACACTCATATCAAAAAACGTTTGATCAAGAAAGGTATTGATCCAGTTACACACAAGGGCATA
ACCTCCGGTACCGACAAATCAGAAAACCTCCCGGAGAAACAAAATGTTAATCTGACAACTAGTGACCATGATCTTGATA
ATGACAAGGCGAAGAAGAACAACAAGAATTTTGGATTATCATCGGCTAGTTTCTTGAACAAAGTAGCTAATAGGTTCGG
AAAGAGAATCAATCAGAGTGTTCTGTCTGAGATTATCGGAAGTGGAGGCCCCACTTGCTTCTACTAGTCACACTACTAA
TACTACAACTACAAGTG

> SEQ ID NO:1029 263070 Contig A Arabidopsis thaliana
TCAGTTCGGCTGCTGCATCTGGGAAAACAAGTATTCGTCGAACATTGAGATTGAGCAAGGCAAGGAGCTGCTGCTAGAA
CCAAACCTGGTTTGGTTGGTGTTGTCGTTGTAAGCAGAAGAATCAGGTGGTGGTGCTTCAAAGAATCCATTCATATGAT
ACTCTCTCTGATTCATTGGAATATACACCTGaGCATGCGGAAGAGTAAGAGGAAGAGGAGGAGGAGGCAACGTTTGGTG
ATGATTCATATCATTGTGAAGATTGGGATTGTATGCTGTGATATTATTATTATTAGTGAACTGCTGCTGCGAGCTTGTG
TCCTGtatCagcTGTCCGGTGTTTAGTTCATCAAGAAAGCTTGTTTCTTGACCCGGAATtGTCATTTCAGGAgaTTTCC
CTGtTCCAAagtagccTggATAGCTCCCGAATGAagaACTCGCTGagcACTCGACTTCCCTCTGcGGGAttgAAttgtg
ttccTcggtgacaatGTTGGTGGTgttgcTAttaagaatccaTGACatagattgaagcTGttgttCTaaaggaatctGa
aTCCCATCTTGca > SEQ ID NO:1030 263070 Contig B Arabidopsis thaliana
GCAGCATGGGAAGGGTAAAATTGAAGATAAAGAAGTTAGAGAACACAAATGGACGCCAATCTACATTTGCTAAAAGGAA
AAATGGGATCTTGAAAAAGGCTAATGAGCTATCTATTCTTTGTGACATTGATATTGTTCTTCTTATGTTCTCTCCTACT
GGCAAGGCTGCAATATGTTGCGGTACACGAAGTAGCATGGAAGAGGTGATTGCTAAGTTTTCTCAAGTAACACCGCAGG
AAAGAACGAAAAGGAAGTTCGAGAGTCTTGAAAACTTGAAGAAAACTTTCCAAAAGTTGGATCACGATGTAAATATACG
CGAATTTATAGCCTCAAGTAATTCAACAGTAGAGGACTTGAGTACTCAAGCAAGGATTCTGCAGGCTCGGATTTCTGAG
ATACATGGAAGATTAAGTTATTGGACGGAACCAGATAAGATTAACATGTTGAACACTTGGGACAGCTCGAAATTTCGA
TTAGGCAATCCCTTGATCAATTGCGTGCACACAAGGAACATTTTGGGCAGCAGCAACAGGCAATGCAAATAGAAAACGC
AAACTTTGTTAAGGATTGGTCAACATGCTCGATGCAAGATGGGA > SEQ ID NO:1031 263078 Contig A Arabidopsis thaliana
TACTCAACCTTAGGTGTTATTACTCCACAATCCCTAAAACCACCATTGCCGCCGGATTCGTATAAACCTCCGACGACGA
ATCCACCACTTGTTTTCTGCATTTCCGCCATGTAACTCCTCACTTCAGCTTTTATCATCTCCTGCACCACCGTCATAAA
CTCACCTCTACGTCCTTCTCCTCTCTCCTCTACATTAATCTTCATCTGACTCTCAAATCTCGGAAACATCAACGCGTTG
TTGTTATTGTTATGGCTC > SEQ ID NO:1032 263078 Contig B Arabidopsis thaliana
TTAATAACTCCATAACGATACGTCGTCATCATCGCCGTCGACTTCATGATTATGATTCCACTGTACGGACGGAAGCGGC
AAAAGCATCCCTTCTGCCATATTAGCCAACAAACTCGGCATCTCAAACATCGCCTCATCGTGCATATAAAACGCATTTT
CGCTCTGTTCCGCCGTGTAAATAGCCTCCACCAACGTCTCCTCCATGTCGAAGCCATGATCCGTCGTCGCATCACACAT
CTCATCCTGAAACGCCAACGCAGCTTCAGCCGCCGCCTTTTGGATGTCCTTAGCGCAAGTTGATTCCGGGATTCGGAGT
CTCCAAGCCGAGTCAGCGAAATTGAGACAGGCTGATCGGCCACGAAGGGCTAAAGCGGCAACGTCGTGAGCTCGAGCT > SEQ ID NO:1033 263078 Contig C Arabidopsis thaliana
GCAGCATGGCGGATCGTGTTAAAGGTCCATGGAGTCAAGAAGAAGATGAGCAGCTACGAAGGATGGTTGAGAAATACGG
ACCGAGGAATTGGTCTGCGATTAGCAAATCGATTCCAGGTCGATCTGGTAAATCGTGTAGATTACGTTGGTGTAATCAG
TTATCTCCGGAGGTTGAGCATCGTCCTTTCTCGCCGGAGGAAGATGAGACTATTGTAACCGCCCGTGCTCAGTTTGGTA
ACAAGTGGGCGACGATTGCTCGTCTTCTTAACGGTCGTACGGATAACGCCGTTAAAAATCACTGGAACTCTACGCTTAA
GAGGAAATGCAGCGGAGGTGTGGCGGTTACGACGGTGACGGAGACGGAGGAAGATCAGGATCGGCCGAAGAAGAGGAGA
TCTGTTAGCTTTGATTCTGCTTTTGCTCCGGTGGATACTGGATTGTACATGAGTCCTGAGAGTCCTAACGGAATCGATG
TTAGTGATTCTAGCACGATTCCGTCACCGTCGTCTCCTGTTGCTCAGCTGTTTAAACCAATGCCGATTTCCGGCGGTTT
TACGGTGGTTCCGCAGCCGTTACCGGTTGAAATGTCTTCGTCTTCGGAGGATCCACCTACTTCGTTGAGTTTGTCACTA
CCTGGAGCTGAGAACACGAGTTCGAGCCATAAC > SEQ ID NO:1034 263110 Arabidopsis thaliana
ttaatagctccataaggacacgtcatcatctccctcgaCATCAAAATTATAGTTCCATTGAACCGACGGCGACGGTAAA
AGCATCCCTTCGGCCATGTTATCCAACAAACTAGACATCCCCAACATCGCCTCTTCATCCATATAAAACGCATCTTGGC
```

FIG. 1 continued

```
TCTGTTCCGGCGTATAAATAGCCTCCACCAAGGTCTCCTCCATGTCAAGACCATGAGCATCCGTCGTCATATGACACAT
CTCATCTTGAAAATTCAACGCGGCTTCAGCCGCCGCCTTTTGGATTTCCTTGGCACAGGTTGATTCCGGGATTCGTAGC
CGCCAAGCCGAGTCAGCGAAATTGAGACAGGCAGATCTGCCACGGAGAGCTATGGCGGCGACGTCGTGAGCACGAGCTG
CCATCTCAGCGGTTTGGAAAGTCCCGAGCCAAATCCTCGTTTTCTTGTTTGGCTCTCTCAACTCACACACCCACTTACC
GGAGTTTCTTTGACGAACTCCTCTGTAAATTGGGTGACGAGTCTCACGAAACTTCTTCCTTCCCGCTGGTTTCTTGGGG
CAGCTCGTGGCAAGCTTCGGACTGTAATCACCGCCTGAGGAAACCGGAGACTCGTaatcggagccaaacatttcagaaa
aggcagaaaatgagttcatgctgc > SEQ ID NO:1035 263114 Contig A Arabidopsis thaliana
ATCCGTCGTCATATGACACATCTCATCCTGAAAATCCAACGCGGCTTCAGCCGCCGCCTTTTGGATGTCCTTGGCACAA
GTTGATTCCGGGATTCGGAGTCGCCAAGCCGAGTCAGCGAAATTGAGACAGGCTGATCTGCCACGAAGGGCTATGGCGG
CGACGTCGTGAGCACGAGCTGCCATCTCAGCGGT > SEQ ID NO:1036 263114 Contig B Arabidopsis thaliana
GCAGCATGAACTCATTTTCTGCCTTTTCTGAAATGTTTGGCTCCGATTACGAGTCTCCGGTTTCCTCAGGCGGTGATTA
TATTCCGAAGCTTGCCACCAGCTGCCCCAAGAAACCGGCGGGTCGGAAGAAGTTTCGTGAGACTCGTCACCCAATATAC
AGAGGAGTTCG > SEQ ID NO:1037 263125 Arabidopsis thaliana
TCAAGCGGCGTAACAGCCAAGGTAATTGTAAATGGGTTCAAGAGTCAGATCCAGATTGTTCCTCCTCATCGCCGTTTGG
TCTTCTTCTTGGTACAAACCACCCATATTTAGGAAAGGAGAAGTCTGATGAGCGATCATGTAAAGATGGGGGTGTTGAA
ATGGTTGTGGCTGTGGTACATCGTCGACGCTGCGGTTCAGCTGCTCACATTGGGTTTGTTTTGTCCTTAGGATGTTTTC
CCTCTCCTTTATCTGTTTGGTAAGCATGCTGTTTTCCTCCTGTATCTCCTTCTCCTTTCTTTGGAGGTGGTTGAGGGAC
TCATTCATGAGTTGATTTTTTCTGGAGCGAATGTGCTTAAGAGCAGTCTCAAGCTGCTGCTCCAGATTTTGGAGATCCT
TGAGGCTCATTGGTTCCAACTCTTCTCCCAGATAATGCCTTTGGTTTCTCTCCAAAAGCTCAATCTTGGCCTTAAGCCT
GCTATACTCCATTGACCAGTTCGTCTGTGCATTAACGTGAGAGTCAGGTGCAATCAGCTGTCTCTCGGCGTAAGAATAC
CTCTCGTAGCGTTCTAGTACCTTCTCCATGCAAGATTCAGAGGAGTACTCGAACAATTTGCCCTTATGGGAGAAGACAA
TAAGGGAAACCTCGGCATCACAAAGAACAGAGATCTCCTGAGCTTTCTTCAAAAGACCAGTtcttcttttcgagaatgt
cacttgtctattgatcttgttctctatcctcttcaattcaaccctacccttcccatgctgc > SEQ ID NO:1038 263127 Arabidopsis thaliana
TTAGCTCAAAGCCCTTAAATCTTGTCTCACCATCTGACTTGATACACCATTGTTTACCATTCCACTAAATTTCGAGTGA
GCATACTCACGACGAAACTGATCATCAGCCTTCAAACTCTGTTCAGCTTCCTTCCCACTCCTAATCCAAGCAGTATTGT
TCAGGTCATTTGATATAGAGATCAATTCTTTATCTAACTCTGCAGAAGAATGTTCCTCATAATCCACAAACTCTGATCC
CAGCACCGACGATGATGACAGTGTTGTGCTGTCTTGATGGTTGCAGCAACCGTGACCGCATTTTGAAGGGATAATAGGA
TCATAACAAAGAGACTGAACAAATTTACCAGCCAATGAGTCAGGTCTTGATGCTTGAACCAAAGGTCCCTCACATGGAG
CCATGTATCCTGGTTTACAGACACTGAAAGCACCCATTCGAGCCACTGGACGATAAACACCAGTTTTACTATTTTgCTC
CCGAGGAGGCTCCTTTGCTTCATCATCCATTTTATCATCACTTAATACACCGGTTTCTTCTTCTTGAGGTAGATGTTCT
TTGGGGGATGCGTTTGATATCCTTCTGACCATTGATGGATACAGTTGATATACTATCTCTGTATTAGACATCAATAGAG
GAATCTTCCATTGTTCTGCTGGTTTACGTCTAAGATTAGAGTTCCAATGATTCTTAATGGCATTATCTGTTCTCCCAGG
TAAGAGTTTAGCAATCACAGACCATTTGTTCCCAAGAACCGCCTGTGCAGACATTATCATATGCTCCTCCTCATCAGAG
AAAGGTTTTCGTTTGAGGATAGGATCGAGCTGATTACACCAACGTAATCGGCAAGATTTACCAGAGCGACCTGGGATTC
CACGGGAGATTAGATTCCAGTTCCTCGGCCCACACATTTTCACAAGCCTCGTGAGAGCCTCATCTTGCTCCGGCAACCA
AGGTCCTTTCACTTTACTCTTTCCGCCGCCGTTCGCGTCGCTTTTCGCTAGCTCGGCGAGCTCTGCCTCAACTGCTTTG
TGtattgcattttcaaaactcttgcaaggattccgggacgatattagctccggcggacgagagatttctccgttcatgc
tgc > SEQ ID NO:1039 263136 Contig A Arabidopsis thaliana
TTATTGACCATCTAAAGTGACGAAAGCATCCTTAAGAAGTCCTTGTGTTCTTCTCTCCTCCTCTTAATGTCTTCCACA
GCTTGTTTCCTCTGTTGAATTTGAAGTTCCATAATGTGAATAAGCGTTGCTCTCGCTTGGTGAGGCCTCAAGGAATTGA
GAAGGTGATGCAAGTTCTTGAagaTTgaagaAATtTCACCAATTCTCTTCGCAtATTGagaAGGTCTGTCAACAAGAAC
ATCAGCAAGCTCCAATATATGTAACTGTAGTTCTCTATTCAGTGACCTGAGTTCCTTCTTGTAATCAAGATTAGaATCT
TTTGGATAAAGTTGAGGCACTCCTTGTTCTTCTAagcTTGGAAGAACATCTTCAgtagtATAGTTGCCTCCAAAACAGA
```

FIG. 1 continued

CgTAgGTGccTTCAATCGGAGGAggAggtccaggagcagaatcattgtttcctgagaaatccttgtacagtctgtaata
tggaggaggaggtggatatgtagctgtaggctgc > SEQ ID NO:1040 263136 Contig B *Arabidopsis thaliana*
GGTACCTGCAGCCTACAACTACATATACACCTCCTCCTCCATATTACAGACTGGATCAGGATGTCTCAGACAACACTGA
TCCTGCTCCTGAACCTCCTCCTCCGATGGAAGGCACCTACGTCTGTTTTGCAGGCCACTATACTACTGAAGATGTCCTT
CCAAGCT > SEQ ID NO:1041 263146 *Arabidopsis thaliana*
GCAGCATGGCCAAGATGGGCTTGAAACCCGACCCGGCTACTACTAACCAGACCCACAATAATGCCAAGGAGATTCGTTA
CAGAGGCGTTAGGAAGCGTCCTTGGGGCCGTTATGCCGCCGAGATCCGAGATCCGGGCAAGAAAACCCGCGTCTGGCTT
GGCCCTTTCGATACGGCTGAAGAGGCGGTGCGTGCTTACGATACGGCGGCGCGTGATTTTCGTGGTGCTAAGGCCAAGA
CCAATTTCCCAACTTTTCTCGATCTGAGTGACCACAAGGTCCCTACCGGTTCCGCGCGTAGCCCT > SEQ ID NO:1042 263154 *Arabidopsis thaliana*
TAAATTGTATCAGAAGAAGAGTTTTGTGTGGCGTCAAGATCGTCCTTATGGTTAGAAATGGGAAAGTGGTAATCATCCC
ATAGAGGGCTTCCAGGTCCCCATTCCTCTGGAATTGCATTGAACCATGCCTCAGCCCAACCCGTCTCCTCACTCACCCC
TCCTACTGCCAATGCCGTGCTCGAATCATCCTCTCCTCTTCTGCTTGAGTCTTCACTAGTAGTCCCCGTCTCACATTGT
TTCTGATGCACGGGAGTTGGCTCTTGTTTATTGAGAAAAAGTTCAGGGAAATTGAGCCTAGCGGTCTCTCCCCTCAACT
TGAAGGCCTCGCGGTCGTAGGCCATGgcggcttcttctgctgtatcgaatgtccctacccagagacgTGTCctgtttCg
TGGCTTACGGATCTCGGCAACCCATTTTCCCCAGTGGCGTTGCCTGACACCTCTATATAGCTTGGTGGCGCTGAAGGGT
TGAACCGGTGGCCTCGTCAGTGGCAGATCGCTTTCTTGTCTTAACATGTTCATCATCATCATTCTTCCGCTCGGACTCA
GCTTCAGAATGTCTCTCCAGTACTGCAATAGATGTTGTTGTTGTTGCTGCTGTTGTGCAACATATGGTTGCACCTGTTG
TTGAGGATCAAACGAGATCATTTGTTGCTGTCTTTGTCCTGAAGGGTCATTCGGGTGTAAAAATCGTTGTTGATTTTGA
ATCGCTGGAGGGAGGTAAAAGGGAAAAGAGACAGAGCATGTAGTTGTTGTTGGCGGCTGAGGAGTAGCATAAGAAGATA
CGAGATAGGGATTATGTCGGTCAAAGGTTCTAGTCTTCCTAAGACTTCTTGGAAACGTAGAGGAAGCATCTCCTAACCA
CATGTCCGAGCCAGGACCCGAATCTTTATACTTGCCGCTACTAAACTGGAACTCCTCCTCCAACTCcatctcatcctt
ttctctgcttcactggtaccaaggaccctgattgattttcccttgttcttagcagtagccatgctgc > SEQ ID NO:1043 263157 *Arabidopsis thaliana*
ttagtaactccaaagcgacacgtcaccatctccttCGCCGTCATAATTATGATTCCATTGAACAGACGGCGGCGGTAAA
GGCATGCCTTCAGCCATATTATCCAACGAAGTCGGCATCCCAAACATTGTCTCCTCATCCATATAAAACGCACCTTCGC
TCTGTTCCGGTGTATAAATAGCTTCCACCATCGTCTCCTCCATGTCCAGGCCATGATTCGTGGTCGTCGTATCACACGT
CTCATCTTGAAAAGCCAACGCCGCTTCAGCAGCCGCTTTTTGGATATCCTTGGCGCATGTTGACTCCGGGATTCGTAGC
CGCCGAGCCGAGTCAGCGAAGTTGAGACATGCTGATCGGCCACGGAGGGCTAATGCAGCGACGTCGTGAGCACGAGCTG
CCATCTCAGCGGTTTGGAAAGTCCCGAGCCAAATCCTGGTTTTCTTGTTTGGCTCTCTCACTTCAGAAACCCACTTACC
GGAGTTTCTTTGACGAACTCCTCTGTAAATTGGGTGACGAGTCTCACGAAACTTCTTACGGCCCGCCGGTTTCTTCGGA
CAACTCGTGGCCAACGTCGGACAATAATCTccgccttgaggctcgtaatcggagccaaacatttcagaaaaagctgaaa
atgagttcatgctgc > SEQ ID NO:1044 263177 *Arabidopsis thaliana*
TTAAGTGGAAGAACTCTCATCATTAAGCAGCAAATCCAAACTGCTAAAGTCACTAATTTCCCACAGGCTCATCATATTG
TTCTCTATAATGTTGTCCACACCATTATTATTATCATTATTACTATTACCATAGTCGGACCACTCGAACTCCGGGAACT
GCAAATCCTTCAAGAAACTCGAATCATTAGAAGAATGCGAAGATGTGGACGTGGATGAAGACATTGTTGAATTGCTGCA
GATAAGGTCTAAAGACTCTGTTTCAATAAGAGGGACATCTTCGACACCATACTCAAGATTTATCTCCATGAATTGATCA
TCACCTAAAGACTCTTCAAGTCTTGATATGTTCTTGATGTTGTTCTCTAAAGGACGCTCCATTGTTTCTTGAAAAGGAA
CTGTATTATTCTGTAGCTTCTTTAAGGGTTCTCCGTCTTCTTTTTCGACGATAGAGAGTGGTTTATGTGTAAGAGGATC
AATCCCCATTTTCCTCAACTTCTTCTTGATGTGAGTGTTCCAATGATTCTTGATTTCGTTGTCTGTTCTTCCTGGTAAA
TGAGAAGCTATCTTTGACCACCTGTTTCCAAGCTGGGAATGGAGATCAATGACCATCTTCTCTTCGTAATCAGAGAGAA
GACCTCTCTTAAGGTCTGGTCTAAGATAGTTAGTCCAACGAAGTCTGCAACTCTTGCCACACCTAAGAAGACCAGAAAG
CTTAGGAACAGCTCTCCAACAACATTGTCCATTGGTAAGGATGAAGTTTATgagcttcctatcctcttctgcagtccat
ggtcctttcttcaaccctactttgtcacagcatggttgtctcccatgctgc

FIG. 1 continued

> SEQ ID NO:1045 263180 *Arabidopsis thaliana*
tcgaagAAATTAGTGTTTTCATCCAATAGAATATCACCAATCTGTCCACCAGAATCCTCAAACAACCACTTCTCAAACA
AAGACCATTGACTTTGGTTACTGCAGCATCCAGTTATGTCTGGTTTGGTCTCATGATCAGGTGAAACACCAGCCTGTTG
ATATGAGTGATCAAACTCAGAAAATGACTGAAATGCCCCTGCACACTCCTTCCCATCATCACTCTTGATCACTTCTTTT
ACCTCTGTAGAAGCGATTTGATCCGCGGAGTTTTGAGTCTTCGGCGAGTTTTTCACCCACCCTTtgagcAATttcgCGA
TATTTTCGGTGCTtgaggCATAagttgTagaTGTTTCTTGCGTCCTAagaAaCCCGCTAGCTGAGGAAGTAGAGCGTCT
TGATTCAGCAGAGGAAGACGTTGTTGTCACTGTAGATGTAATGATTGGTGCAACGGCAGGAGATAAAGCCTCAGAGAGA
GCCTTTTTCGCCAAGTGGATATCGGTTTGAAGTCGCCTTTCCCATTGGCCTCTTGAGATGTTTGAGTTGGAATTAgcAG
AAGAAGACGATGGTGAAGATGAGAGCGAGGAACGGTCAAGTTCTTGATGAGAATCTTGATTGACTTTGTTGAGTTTCTT
CTTCAAATGAGTGTTCCAATAGTtctTAATGTCATTGTCTGTCCTTTGTGGAAGATATGACGCAATTGCAGCCCATCTA
TTTCCTAAGAGGGCTTGGAGATGAACAATCATCTTTtctTCATGTTCTGTGAAATTGCCTCTTTTGATTCCTGGCCTTA
AATAGTTTGTCCATCTAAGTCTACAACTCTTGCTGCATCTAAGCAGCCCAGTATTGGTAGGAACAGCTCTCCAATTACC
AGGACCATGTTCTTGGATGTAAGTGACtaaaatgatatcttcttcaggagtccatggcccttcttcactcctcctttg
tcacaacaaggaggcctcaccatgctgc > SEQ ID NO:1046 263181 *Arabidopsis thaliana*
GCAGCATGTCTTTTACAGGAACTCAACAGAAATGCAAGGCTTGTGAGAAGACTGTTTATGCTGTTGAGCTTCTCTCTGC
TGATGGAGTTGGATATCACAAGTCTTGCTTCAAATGCACTCACTGCAAAGCAGGCTTCAGCTGAGTAGTTACTCATCA
ATGGAAGGTGTTTTGTACTGTAAGCCTCATTTTGAGCAGCTCTTTAAGGAGAGTGGTAGTTTCAACAAGAACTTTCAGT
CACCTGCAAAATCGGCTGACAAATCAACTCCTGAGCTGACAAGGACGCCTAGCCGAGTTGCTGGCAGGTTCTCTGGTAC
ACAAGAGAAATGCGCCACTTGTAGTAAAACTGTGTATCCTATTGAAAAGGTAACAGTCGAGAGCCAGACATATCACAAG
TCCTGCTTCAAGTGCTCACATGGAGGTTGCCCAATTTCACCTTCCAACTACGCAGCTCTTGAAGGAATCCTGTACTGCA
AGCACCATTTCGCTCAGCTCTTCAAGGAGAAGGGAAGTTACAACCACTTAAA > SEQ ID NO:1047 263182 *Arabidopsis thaliana*
tcaacttctgttcttcacttttctaatgcccttggagcaagtccgattgctTCCGATCCCTTCATTATTCGTATACGTT
TGCATGAATCAACAAACATCTCCCACGGTACGTCTCCTACAAGCATCCAGTCGCCATCTTTATCTTCATATGTTGGAAC
ATAATCTGATCCGTTTAGAAGATCGATCAATTTACTCTCATTCATGAAATCTTTCATTCCTTGTGGTCCATAGTTGCCT
ATGGTAAAAGAGCTAAACATTTTGCTTAAGGCGTTGGAGAGATCTTGGTAAGTTTTGTAGAGTTTCAAGTCAATTTTCC
GTAGGTACGGTGCACCGTCCATGCTAACCTTCACATAAGCCACGGTGGCACATGCGGAGGCGGATGAGGTGGCTCCACT
GCTGCCAGAAGTCTTATCGTTTCCTTCGGTGGCATCTCCGGTGGTCGGTTTTTGGCCGGACATGACGTTCTTGCGGAAA
GATCGTACCGGTGGCCATCCCACAACTTGTGCCTTGGCTGGTGGTTTTACGACCTTCTCCTTCATATTCTCTAAATCGA
CTTTGGAAACTGAATCCATAGCCGTCGATGAAAGATTCAGTTTGAGATCAACAGtctCAGAAAATCCTCTTTTACCATT
ATTttttccagccatttctcctccgtgattcccacccggtagccctaatctcagctccgtggcctcaaaattaatcatg
ctgc > SEQ ID NO:1048 263184 *Arabidopsis thaliana*
GCAGCATGGGAAGAGGGAGAGTAGAATTGAAGAGGATAGAGAACAAGATCAATAGGCAAGTGACGTTTGCAAAGAGAAG
GAATGGTCTTTTGAAGAAAGCATACGAGCTTTCAGTTCTATGTGATGCAGAAGTTGCTCTCATCATCTTCTCAAATAGA
GGAAAGCTGTACGAGTTTTGCAGTAGTTCGAGCATGCTTCGGACACTGGAGAGGTACCAAAAGTGTAACTATGGAGCAC
CAGAACCCAATGTGCCTTCAAGAGAGGCCTTAGCAGAACTTAGTAGCCAGCAGGAGTATCTCAAGCTTAAGGAGCGTTA
TGACGCCTTACAGAGAACCCAAAGGAATCTGTTGGGAGAAGATCTTGGACCTCTAAGTACAAAGGAGCTTGAGTCACTT
GAGAGACAGCTTGATTCTTCCTTGAAGCAGATCAGAGCTCTCAGGACACAGTTTATGCTTGACCAGCTCAACGATCTTC
AGAGTAAGGAACGCATGCTGACTGAGACAAATAAAACTCTAAGACTAAGGTTAGCTGATGGGTATCAGATGCCACTCCA
GCTGAACCCTAACCAAGAAGAGGTTGATCACTACGGTCGTCATCATCATCAACAACAACAACACTCCCAAGCTT > SEQ ID NO:1049 263186 *Arabidopsis thaliana*
TCACTTCTTCTCACCGAATCCCAAGCCATGGATCATGTTGTGGCCTCCGGAAGTAATGGAAGTAGGAGAGTTGGGTATG
TACTTAGCCCAATTTTTGGCAGCAGCACTGAAAGCTTCACGTGTGGTATTTCCGGATTGGCACTTTTGATGCGTTGGA
TCTCATCCCTCATGAAGCGGTTGTATGCAGATGGGAGCCTCTGCTTCTTCTCAGGAGGTTTGACGACAAAGGGAGGTGA
GGGAGATGGGGCTGGTCGCTGGAGGTGGAGGAAGAGGAAGAAGAAGAGCTTCCCTTCTTATAGTCACTTCCACCAAAG
CTCTGCATCTGAAGGGTGAGGCTAACATGGCCTTGAAGAGGAGGAGTTGTGGTGAGAAACGAGAGGTTACCACAATGGC
CGCATTTCACCGTTACCGTGTCAAGCATTCTCTTCAATGGTATCCCAACCGCGAGGATGGTGTTGCAGATGCTACAccg
gacgtagtagagatgttcggcttgaggggaagcccttgaagccgtcatggttggtttctcttctaggttcatgctgc

FIG. 1 continued

> SEQ ID NO:1050 263187 Contig A *Arabidopsis thaliana*
TCATATGAACTACTTGTCGACATAATCTTGGTTCGCGTCATAATCGAGATCATGATGCCCATGGACATAATGAGACCAA
CCAATCATGTCTTGCATCAT > SEQ ID NO:1051 263187 Contig B *Arabidopsis thaliana*
TCATATGAACTACTTGTCGTCATAATCTTGGCTCGCGTCATAATCGAAATCAGAATGGTCATGGACATAATTAGACCAA
C > SEQ ID NO:1052 263187 Contig C *Arabidopsis thaliana*
GCAGCATGTCAAGAAAGCCATGTTGTGTGGGAGAAGGACTGAAGAAAGGAGCATGGACTGCCGAAGAAGACAAGAAACT
CATCTCTTACATTCATGAACACGGTGAAGGAGGCTGGCGTGACATTCCCCAAAAAGCTGGACTAAAACGATGTGGAAAG
AGTTGTAGATTGCGATGGGCTAACTATTTGAAACCTGACATCAAGAGAGGAGAGTTTAGCTATGAGGAGGAACAGATTA
TCATCATGCTACACGCTTCTCGCGGCAACAAGTGGTCAGTCATAGCGAGACATTTGCCCAAAAGAACAGATAACGAGAT
TAAGAACTACTGGAACACGCATCTCAAAAAGCTCCTGATCGATAAGGGAATCGATCCCGTGACCCACAAGCCACTTGCC
TATGACTCAAACCCGGATGAGCAATCGCAATCGGGTTCCATCTCTCCAAAGTCTCTTCCTCCTTCAAGCTCCAAAAATG
TACCGGATATAACCAGCAGTGAC > SEQ ID NO:1053 263191 Contig A *Arabidopsis thaliana*
TATAGCCACCCCCAAAAAGCCACTGATACACCGAGATGATCGCGCTATATTGAAGAGCAGATCACGAGAACGTTCCCCA
AATAGCTCCGATCATCGGCATGAT > SEQ ID NO:1054 263191 Contig B *Arabidopsis thaliana*
GAGCATGATGAACAGATTAAGTAGTTCAGATTCAGCGGGTGGTCGCGTCTCTTTATGTCCTACAACTTCCACAGATGAC
CAGAGTCCGAGGAGATACGGTGGGAGAGAGTTTCAGTCGATGCTTGAAGGATACGAGGAACAAGAAGAAGCTATAGTAT
AAGAAAGAGGACACGTGGGCTTGTCGGAGAAGAAGAGAAGGTTAAGCATTAACCAAGTTAAAGCTTTGGAGAAGAATTT
TGAGTTAGAGAATAAGCTTGAGCCTGAGAGGAAAGTTAAGTTAGCTCAAGAACTTGGTCTTCAACCTCGTCAAGTTGGT
GTTTGGTTTCAAAACCGTCGTGCTCGGTGGAAGACAAAACAGCTTGAGAAAGATTACGGTGTTCTTAAAACCCAGTACG
ATTCTCTCCGTCATAACTTTGATTCCCTCCGCCGCGACAATGAATCTCTCCTTCAAGAGATTA > SEQ ID NO:1055 263194 *Arabidopsis thaliana*
TAATTGAGCAGCGGGAGAGTCTCCGGTATTTTGTTGCCGGAGCTACTTCCCGGAAACATTCCTCTCTCATCATCTGTTG
CCAGCAACGTATTCTTTCCCATCTGGCTAGCCAGAACCTGGTTCTCTTCTCTCAGCAATTTCTCCTTTTCTTTAAGGGA
CTCGATATACTCCATCATCAGTTCTGCCTTCCTAGCTCTACTTACGGACAGAGCAGTCTCAAGTTGTTCCTCCAGAGAA
ATTAGAGAATCTACACTTACATTATCGACATTTGGTTCTTCAAGCTTGCTTTGGACTGTTTCTAGTAACTCCTTGTGTG
GAAGATAATTCTGAATTTTTTCTTCAAGATCTAAGGCTCTAAGTTCATCAGCATGttGTATTTCATAACGATCAATGAT
CTTGGAAATGTCGTCACCGGAGGAAGAGTCATAGAGTTTTCCGGAGGCAGATACGACGACAACAGCGACGGAGGATTCA
CAGAGAATCGAAAGTTGTCGAGCTTTGTCGATGAGACCATTGCGTCGTTTGGAGAAAGTGACTTGTCGActgctTTTgt
tctcGATTCGCTTGATctcgattttCTTCttcccATGctgcaGtTAATTA > SEQ ID NO:1056 263202 *Arabidopsis thaliana*
GCAGCATGAATAGGGAAAAGTTGATGAAGATGGCTAATACCGTCCGCACTGGCGGAAAGGGTACTGTCAGAACAAAGAA
AAAGGCTGTGCACAAGACCAATACAACTGATGACAAGAGGCTTCAAAGCACTCTTAAGAGAATTGGAGTTAACTCCATT
CCCGCTATTGAAGAAGTTAACATCTTTAAGGATGATGTTGTCATTCAGTTCATCAACCCTAAGGTTCAAGCTTCAATTG
CTGCAAACACATGGGTTGTTAGCGGTTCTCCTCAGACCAAAAAATTGCAAGATATCCTTCCTCAGATCATCAGCCAACT
TGGACCAGACAACATGGACAACCTGAACAAGCTAGCAGAACAGTTCCAGAAACAGGCTTCTGGTGAAGGTAATGCCGCC
TCAGCAACCATACAAGAAGAGGATGATGACGATGTCCCAGAGCTTGTTGGAGAGACATTCGAAACTGCTGCTGAAGAGA
AAACACCAGCTGCTGCTGCTTCTTCTTA > SEQ ID NO:1057 263216 *Arabidopsis thaliana*
TCAGAGCATCCATCCTGGAATGTAACCGTTTCCCTGCTGCGCCTGAGCTTGGGTTGTCGCAGTTATTTGCTCTGAGCAT
ACCGGATTATCATACCCCATTTGCAGAGTTGGATTGCATTCAAGAGGCTGGTATAGTCCCTGAGACTGAGCTTGATGAT
GCGCGTAGGTAACATTCTGTTCACCACCTTCCCATCCTCCTCCTCCTCCCATATGATGACTTCTCACACCAATCATATC
ATCCAGCTTCATTGCCAAAGCTCTATTGGTTTCAAGCAACATTTGCTCTTTATTTTGAAGATCCGAGAGCTGGTCAAGC

FIG. 1 continued

ATGTACTGTGTCTTGATGGACCGAACTTGCTTGAGAGAGCCGTCCAGTTGACGCTCAAGCTGCTCTAACTCCTTTGAAT
TCAAAGGTCCTAAATCCTCCCCAAGAAGATTTCTCTGTTGACGTTGAAGgttctcATAtctACCCTTAaggttcAGATA
TtcTCTGTaGCTGTTCTCAAGTtctTTGGCAGGTTTGTTGTTGACTTCAATGGATCCATAGCTGCATTtctGGTACCGA
TCAAGTGtctTGAGCATGTTTGAGGAGCtgcAAAACTCATAGAGCTTTCCACGGTTGGAGAAGATGATGAGAGCAactT
CAGCATCACAGAGaaCAGACAATTCATAAGCtttgttCAACAAACCgttcgtacgctttgcaaacgttacttgtctgtt
gattttgttctgtatcctcttcagctgtactgttcctcttcccatgctgc > SEQ ID NO:1058 263221 Arabidopsis thaliana
tattgctgtatctttctgaattccgagagcacggggtatatattctcaaaggctttgtaggtctCATCTCTCATCTTGG
CTCCTGTTATTACGATCTTCCCAGAGACAAAGATTAGAAGGACGATTTTTGGGACTTTCATCCTATAAATCAGCCCTGG
GAAGAGCTCGGGCTCATAACTTGAGAAAGCAGCGTGAGAGTAAGCAAGACCTTCAAGTCTTATAGGGAATTTGACATCA
CAAGAACCTACAATATTCTGAATCTTGAAATCCTTGAATTTTGCAGGGAATCCCAATTTCTGCACAATCCTAGCATACT
TTCTAGCAGCCATCTTCGAAAAGTCCTCGCTCTTAGCTCCAGTACAGACCATTTTCCCTGAGGCGAATATTAATGCTGT
AGTCTTCGGTTCTCTGATCCTCATTATCACCGCAGCAAAACGCTTGGGATTATATTCAGCATTCCGAGCCTGCAAAGCT
ATGGCTTTAAGATCTAGCTTGCAGTCTAAGTTCACCGTGGAGACAATGTTTTGaagagtaggaacaatccctgaaggat
gcttgctaagatcaactggattactcccttccaatccttgatcagtcatgctgc > SEQ ID NO:1059 263224 Contig A Arabidopsis thaliana
TCAAGAAGGTTCATGAGAGGAGGTTGGAAGCCATTTGTCTGCAGCCAATTTTGATGAGGAGTAGAAGTAGAATTAAAAA
TCTGATTGTGATGATGAGGAGAGAATCCTGATGATGCTGCAGCATTTGTCAACACTTGGTTCGTCGAGGCCCGACCATC
AAACCGGTGGTTCTCAGCCGCCGGAAACAGTGAGAATCCGCCTCCGCTACCAATGTTGCTGCTGCCCGGAAATTGGTGG
TTTGAATTGGGAGTATGGTTAAGCATTCCGGTTTGACCTAATCCAAGAACTTCATTAGAGTGGAGAGAATCTTGttGTT
GTTGGTTCATCCTGAGCCGCATATCTTGACTTTTATGTTTCGAAttAgccgAATTTCCCAAGCTCAAATCGAGGTTgtg
ATCTTGTGGAGTAgtaggAttcccTGATGACTcggcAtTGAGttccTCATCGTaaatACTCGGATCaAAGttggTCACg
gCGTCTtTgccg > SEQ ID NO:1060 263224 Contig B Arabidopsis thaliana
GCAGCATGTGGGATCTAAACGACGCACCACACCAAACACAAAGAGAAGAAGAATCTGAAGAGTTTTGTTATTCTTCACC
AAGTAAACGGGTTGGATCTTTCTCTAATTCAAGCTCTTCAGCTGTTGTTATCGAAGATGGATCCGATGACGATGAACTT
AACCGGGTCAGACCCAATAACCCACTTGTCACCCATCAGTTCTTCCCTGAGATGGATTCTAACGGCGGTGGTGTTGCTT
CTGGCTTTCCTCGGGCTCACTGGTTTGGTGTTAAGTTTTGTCAGTCGGATCTAACCACCGGATCGTCCGCGGGTAAAGC
TACCAACGTTGCCGCTGCCGTACTGGAGCCGGCACAGCCGTTGAAAAAAGAGTCGGCGTGGA > SEQ ID NO:1061 263234 Arabidopsis thaliana
GCAGCATGATTAATTTTGAGGCCACGGAGCTGAGATTAGGGCTACCGGGTGGGAATCACGGAGGAGAAATGGCTGGAAA
AAATAATGGTAAAAGAGGATTTTCTGAGACTGTTGATCTCAAACTGAATCTTTCATCGACGGCTATGGATTCAGTTTCC
AAAGTCGATTTAGACAATATGAAGGAGAAGGTCGTAAAACCACCAGCCAAGGCACAAGTTGTGGGATGGCCACCGGTAC
GATCTTTCCGCAAGAACGTCATGTCCGGCCAAAAACCGACCACCGGAGATGCCACCGAAGGAAACGATAAAACTTCTGG
CAGCAGTGGAGCCACCTCATCCGCCTCCGTATGTGCCACCGTGGCTTATGTGAATGTTACCATGGCCGGTGCACCGTAC
CTACGGAAAATTGACTTGAAACTCTACAAAACTTACCAAGATCTCTC > SEQ ID NO:1062 263245 Arabidopsis thaliana
GCAGCATGACTGATCAAGGATCGCAAGGGAGTAATCCAGTTGATCTTAACAAGGATCCTTCAGGGATTGTTCCTACTCT
TCAAAACATTGTCTCCACGGTGAACTGATACTGCAAGCTACATCTTAAAGCCATAGCTTTGCAGGCTCGGAATGCTGAA
TATAATCCCA > SEQ ID NO:1063 263246 Arabidopsis thaliana
TAATGAGTTCTAACATCAGAAACCCGACAATTCCGACACGACTCATTACGAAACAACCCAATCCGACAACACAAACACA
CCGCATCACTCTCATGAGCTCCAAACAACTCGGAACCCCACCGTCGAGTCGACTCAGCCGAGTCAACAACACTCACTTT
CCGAGTCGACTCGTACCGATAACTCGGTCCAACAGAGAGTTCCAAATTCAACACCCAATCTTCCTCGTTCCCATAATCC
TTCTCCGACGTCGTTCCACTACTCTCACAATTATTAACCATACAATCTCTTCACGCACCGGTTCCGGTTTAACCGGTC
CAGAGAAATCAAGATGTATAGTCTCAACGACATCGTTTTGAAGACGACGGAGACACGACGGATTCGTTGATCAGACG
GTGAGAGTTTGGATCAATCCCACGGCTGAGAAGCTTCCTCTTGATATGAGTGTTCCAATAGTTCTTGATCTCGTTATCT
GTTCTTCCTGGTAATCTCCCAGCTATTAAAGACCATTTGTTACCGAGCAAGCTATGGAGCTTGATGATGAGTTCATCTT

FIG. 1 continued

CTTCTTCAGTAAAATTGCCTCTTTTGAGATCTGGTCTTAGATAATTCATCCATCTCAATGTACAACTCTTACCACATCT
TTGTAATCCAGCGGCGCGAGGGAGAGATCGCCAgcaaccttcaccgtgtttacggatgtaatcaacaagaagctgatct
tcttctttagtccaagctcctttgttcatgctgc > SEQ ID NO:1064 263249 Arabidopsis thaliana
TTACTCAAATGGAGATTTTCCCCAAATGGAATGCCTCTGAGCCTTTCTCTCTCGGAACCCATTATTGCTTTCTTCATGG
TCCTCAAAAACATTGCATGGTAGTATCGCATTGTTATCTTCCTCACAAAAACATTGATCTGAAGCAGCTCTCTTGTTGT
GAGCTGGAGGAAAATGGGCCCAATTTTTGGCAGCTAAGCTGAAAGCTTCCTTGTGAGCCATGCTTGGATTCTGAGCCTT
TAACCTCCTGATCTCTTCCTTGATGAAGCAATTGTAAGCTGAAGGAGCTCTTTGTCGCTTCTCAGGTGGTTTATTGACA
ACTTGGTAAACACGAGACACATCTTCATCTTCATTGTCTGAAGATGAAACCAAAGTCGTTGGACTGTTCTCCTTCTCCT
GATTCACCTTCCATGCTTCTTCTTCCACACCATCTGTAGCTGCAACCTCCTCTTTCCCGGTCTCATCAAGATGGGAGAG
AGAAGCAAGGAGATGGAGAGGAATGAAGGAAGCCTTCATCAAATTGACAGAGAGAAGGCTTGTGCAATGCCCACATCTC
ACAGTCACCACCATTGACAAGCTTGTAAACGGTACACTCACCAGCAAAATAGTGGTGCAAAAACCACActggacatggc
aaatctgccccggcagatcaaatagatggttgagtgttgtcgtcatgttggggagctttgtcatgctgc > SEQ ID NO:1065 263255 Arabidopsis thaliana
GCAGCATGGATTATTCTTCGATGCATCAGAATGTGATGGGAGTATCTTCATGTTCAACACAAGATTATCAAAACCAGAA
GAAACCATTGTCGGCGACTAGGCCAGCTCCACCACAGCAATCATTAACATGCCCTCGCTGTGACTCCACCAACACAAAG
TTCTGGTACTACAACAACTACAGTCTCTCTCAACCTCGCTACTTCTGCAAATCTTGTAGGAGATACTGGACCAAGGGTG
GAATCCTAAGAAACATCCCAATCGGTGGTGCTTACCGGAAACACAAACGCTCCTCCTCCGCAACCAAAAGCCTCAGAAC
AACCCCT > SEQ ID NO:1066 263262 Arabidopsis thaliana
ttaagcagcgacgactttgtccttggcggcattctctcctcctccttcgagctggctcaagtttcctttctccttGATC
AGCTGAATATGATGATGCTTGCAATATAGCTTACCCTCGTGAGCTATGTAATTCGAAGGGCTTATCGTGCAGCCTCCAT
GTGTACACTTGAAGCAGCTCTTGTGGTACAATGTTCCATTCACCGATACCTTCTCAATTGGATACACGGTTTTGTCGCA
ACCAACGCATTTCTCTCGTGTTCCACCAAACATATTCGAAACTTTGGTTCCAGCAGGTCTCTCTCCCTCCAAAGGCCTA
TCAGGTTTCCCAATCTTTGGTGTCCCTTCGAAGCTTTTCTCAAGACTTCCAGTTCTCTTGAAGTTTTGATCGAAATGTG
GTCTGCAGTAGAGAACTCCTTCAAAGGAGTTGTAATTGCTAAGCTTGAGAGTTCCTTTGCAATGGTGACATCGGAAACA
AGCTTTGTGGTAGACCCGGTTATCggcggttaacttgtcgacaagataaactgttttgtcacatgccatgcatttctgg
gttgttcctgcgaacgccatgctgc > SEQ ID NO:1067 263263 Contig A Arabidopsis thaliana
TCACCATGAAGATCCTCCTGTATTACTGAACATCCCATTCCAATATGTATTATTACCATGACTCTTCTCTTGGGTTGTG
CTTGAAAGCTCTTTCATGTCTGAAAAAGGGAACAAAACCCTACTTGCTCCATTCATGTCATCATTGTTATCTTGAGCTC
TTTGATTACTGtTGATGGTGTTATGTCCAATCCCTTGATGATGATCAATGGAGAATGAAAGGTTGTTATTACTCTGTTT
GTAATCAGGCATTGTTGGAAACCCTAAAGATGAGTACAGGACTGaGTTTGAATCCATCATTTGACCAGGcAaGAACGTG
TTCATGCCTCTTGAAGaGACTCCATTGGATCTTagaagcTCaagAGcATGATGATGATGATCTTGCATGACCGGGAA > SEQ ID NO:1068 263263 Contig B Arabidopsis thaliana
GCAGCATGGAAACTACAAAGTTGAGGCCACAAGAGAAAGTAAATTGTCCAGGATGCAACTCAACAAACACAAAGTCCTG
TCATCACAACAACTACAGTCTCACGCAACCAAGATACTTCTGCAAAGGTTGTCGAAGGTATTGGACCGAACGTGGCTCT
CTTCGTAACGTCCC > SEQ ID NO:1069 263276 Arabidopsis thaliana
TAGGAAAGTTGTAGCCCTAGTCTGATTGATTTTTCTCTAGGAGCTGGTTGTAGTTGTATGAGTTGAAGTTGCGGTGGTG
CATATGTTGTGGTTCCATTGCTTATTGGATCTACACTTGAATTGCCTTCAATCGCATTTGTTCTTCCATGAACCTTCTT
TTGCAATTTAATATTTTCCTTACGCATTATATCTACAATATTTTGTAGCTCGTGATTCTCTTTTTGGATGATTTGTCCC
TTACGATTAAGTTCTCTGATTTCATTTGTCATAAGTTGATCCTTTTGAGACGAACACCTTTTAGACTTGTTACTAGCT
GGTCTTCAAGGTTTTGTAGGTCGTTAGCATTCATTCCAGAAAGTTCCTCTCCCACTAGTTTCCTGTGGCATTCTTGTAG
ATATTGGAGCTGCTGCTGCAAACTTGCAACCTCTCTTTGCCAAAACTTTATCTCTGAGGCATGATTCAGAAGTTGATGC
TGCTCCTCTTTTACTCTGTTGTACCGCTCAATGATTGTTTTCATACTTGAATTGCTTGCGTAGTCGTAGAGCTTTCCGG
TGCTAGAGAATATGATAACACCAACTTCTGCATCACAAAGGATCGTAACTCTTTAGCTTTCTTAAGCAAACCACTcct
tctcttggagaaagtcacttgtctacttgtagagttatcgatccttcgtataactatcttccctctcccatgctgc

FIG. 1 continued

> SEQ ID NO:1070 263320 Contig A *Arabidopsis thaliana*
TTAATAGGACGATGATGGTGCAATCAATTACTTGGCCTCGGTGACGACATGGGCATGCTGC > SEQ ID NO:1071 263320 Contig B *Arabidopsis thaliana*
GAGCTAACTGCAGCATGTCTAGTAATAATGTAATGTCTTTCATCCCTCCAAATTTGATGATCCAAACCTCTCACGACTA
TGATCATCCTCATCAATCTCCATCTCTTGTTCCTCTTCTTCCTTCTTGCTCCCTACCTCAATATCTCCA > SEQ ID NO:1072 263327 Contig A *Arabidopsis thaliana*
tcaattcttctccattctgttcatagctaagtcagtcCACGTGTCATCACTCCTCCGTACCGAACCCAAACCCAAATCC
ATACCTGGTAACCAACGCGACCCGGACTCGTAAACAAGCCCACCCATCTGCATATTCGACGCCAACAACGAACTAAAAC
TCGCACCATTCGGATCTCCAACTGGTAACCCGTATAACATCCGGGTCGGATTCATTTCTTGACCCGAAACTCTCTCTTC
TTTTTCTTCTGACCCGGACCCATGATGATCAGGTTTCTCAGCGACGGTTTGGTTCTTGAGATTACTagaCGGAgaagaA
CCGGATcG > SEQ ID NO:1073 263327 Contig B *Arabidopsis thaliana*
GCAGCATGTCTTATACAGGAACTCAACAGAAATGTAATGATTGTGAGAAGATTGTTAATGCTGTTAAACTTCTCTCTGC
TGATGGACCTTGGATATCACAAGTCTTGCTTCAAATGCACTCACTGCCAAAGCATGCTTCATGTGACTACTTACTCATC
AATGGAACGTGTTCCGTACTGTAAGGCTCATTTTGACCACCTCTTTAAAGAAAGTGGTATTCTCAACAAAAACTTCCAG
TCACCTGCAAAATCGGCTGACAAATCAACTCCTGAGCTGAC > SEQ ID NO:1074 263329 *Arabidopsis thaliana*
GCAGCATGGGGAGACAACCATGCTGTGACAAAGTACGGTTGAAGAAAGGACCATGGACCGCAGAAGAGGATACGAATCT
CATAAACTTCATCCTTACCAATGGACAATGTTGGTGGAGAGCTGTTCCTAAGCTTTCTGGTCTTCTTACGTGTGGCAAG
AGTTGCACACTTCGTTGGACTAACTATCTTAGACCAGATCTTAAGAGAGGTCTTCTCTCTGATTACGAAGAGAAGATGG
TCATTGATCTCCATTCCCAGTTTGGAAACAGGTGGTCAAAGATAGCTTCTCATTTACCAGGAAGAACAGACAACGAAAT
CAAGAATCATTGGAACACTCACAT > SEQ ID NO:1075 263342 Contig A *Arabidopsis thaliana*
GCTACAATAAAGCAACACTATTAATGTATTTGACAGTACAGATCCAAATCTCTCTGGCTGAATCAATCTGATCAACATG
ACCATGACCATGACCACTGCCTTCTGCCATGTGCATCTGACAAGGGAATCGCCATAAGAACCTGTCTGGATCACTTGTC
GCCATCTGCTCCATATCGCCTCCACCATTTCCAAACGCATATCCCGTGTTCTCCATCTGATGGCTCGT > SEQ ID NO:1076 263342 Contig B *Arabidopsis thaliana*
GAGGTTAACTGCAGCATGGATTATTCTTCAATGCATCAGAATGTGATGGGAGTATCTTCATGTGCACCACAAGATTATC
A > SEQ ID NO:1077 263367 *Arabidopsis thaliana*
GCAGCATGGGAAGAAGAAAAATCGAGATCAAGCGAATCGAGAACAAAAGCAGTCGACAAGTCACTTTCTCCAAACGACG
CAATGGTCTCATCGACAAAGCTCGACAACTTTCGATTCTCTGTGAATCCTCCGTCGCTGTTGTCGTCGTATCTGCCTCC
GGAAAACTCTATGACTCTTCCTCCGGTGACGACATTTCCAAGATCATTGATCGTTATGAAATACAACATGCTGATGAAC
TTAGAGCCTTAGATCTTGAAGAAAAAATTCAGAATTATCTTCCACACAAGGAGTTACTAGAAACAGTCCAAAGCAAGCT
TGAAGAACCAAATGTCGATAATGTAAGTGTAGATTCTCTAATTTCTCTGGAGGAACAACTTGAGACTGCTCTGTCCGTA
AGTAGAGCTAGGAAGGCAGAACTGATGATGGAGTATATCGAGTCCCTTAAAGAAAAGGAGAAATTGCTG > SEQ ID NO:1078 263393 Contig A *Arabidopsis thaliana*
TAATAAGCCATGTCTTGCACACCAGTCTCAGCCATCTTCTCCAAATCTTCTTGTGTCAACAGAGTTTTCCTTCCCATTG
TACCCGCCTTATCATACGGTTGAGCCATTTTCCGAAGAAACTCTCGAGCAATGTGAATAGCCATATCAGTGCTTAGATT
CAAGTGTGCATCACGCAGATGCGAAAGTATCCAACCAGGTAGTTTGGACCGCTTATCATGACGGCTGTATCTTTTGTCT
GCAAATATCATCATCCCATAATCAGCCTTTGACCGGATTACTCGCCCTACACATTGAGCTGCTTGCCTCAAGGCATCAA
AAGTTAGGAAATCGCCTTCTTTTATTTGAAATGTATCGCGCAAATACTCCAATCTTGCTCGTAATATCTTGCTTAATGT
ATACTGTAATGGTACTCCGTACATTACAACCAGTCTTCCATAATGACGATCAAA

FIG. 1 continued

> SEQ ID NO:1079 263393 Contig B *Arabidopsis thaliana*
GCAGCATGATCTTTACAATCGAAGACGTAACTGTCTACTTCCCTTATGACAACATATATCCAGAACAATATGAATACAT
GGTTGAATTGAAGCGAGCCCTAGACGCTAAGGGACATTGTCTTCTCGAGATGCCTACCGGAACTGGTAAAACCATTGCT
CTTCTCTCTCTAATCACCAGCTATCGACTCTCTCGTCCTGATTCTCCGATCAAGCTTGTTTACTGTACTCGTACTGTCC
ACTAGATGGAGAAAAC > SEQ ID NO:1080 263514 *Arabidopsis thaliana*
GCAGCATGATGAAGAGATTAAGTAGTTCAGATTCAGTGGGTGGTCTCATCTCTTTATGTCCTACAACTTCCACAGATGA
GCAGAGTCCGAGGAGATACGGTGGGAGAGAGTTTCAGTCGATGCTTGAAGGGTACGAGGAAGAAGAAGAAGCTATAGTA
GAAAAAGAGGGCACGTGGGCTTGGCGGAAAAGAAGAAAAGGGTAAGCATTAACCAAGTTAAAGCTTTGGAGAAGAATT
TTGGGTTAGAGAATAAGCTTGAGCCTGAGAGGAAAGTTAAGTTAGCTCAAGAACTTGGTCTTCAACCTCGTCAAGTTGG
TGGTTGGTTTCAAAACCGGCGTGCTCGGTGGAAGACAAAACAGCTTGAGAAAGATTACGGTGTTCTTAAAACCCAGTAC
GATTCTCTCCGGCATAACTTTGATTCCCTCCGGCGTGACAATGAATCTCTCCTTCAAGAGATTAGTAAACTGGAAACGA
AGCTTAATGGAGGAGGAGGAGAAGAAGAAGAAGAAGAGAACAACGCGGCGGTGACAACGGAGAGTGATATTTCGGTCAA
GGAGGA > SEQ ID NO:1081 263534 *Arabidopsis thaliana*
taaaggcgaccactaccatgttcaaaacttagaggaagctgatcaatagcaaaagaagacatcttactttcatctgcat
cCATGTTCCATATAGATTCCAAGGAACTTTCCCATGttgGAGAAGCCAGAGGAGGGAAATTCAAGTAACAGCTTTGCTC
TGAGTAGTAGTTGTCTTTTACCGGTTTAATAACGTTtgCTCCAGACtgaTTAATCTCTCTCCATATGTCATCCATGGAG
TAGTACCCGTCTTCGCATTCTTGATTCATTTTCCCGTTGGAGCCTCCAGtgtCTTGACTAGTAGTAGTGGTCATagaTG
ATGAGCAacagTtcgaAGATGAGGAagtAgGAGACATaGGTCGCTTCTTCTTGAGCCTTCTTCCTCATATGAGTCCT
CCAGTAGTTcTtttATCTCATTATCTGTTCTCCCCGGTAATTTCCGGGCAATTTTTGACCACCTGTTTCCCCATTTGGCG
TGAAGCTCAAGGACTAAACGCTCTTCTTGTGGAGTCATCTTACCACGTTTGAGACCAGGATGCAGGTAATTAACCCACc
tTAACCtgcaacTCTTTCCTGTTCTGTTTAAaCCTATTCTTATGTTTCTCCCTCCAccTTCAAACCTGAAACTTTCGCT
acaAAATCCCATCTTCGATCTCCGAaCAAGTGgacaaagttgaccaagaggatgtcctcctgttctgtccacggtcctt
tacggtattcttcttgcacaagtttcatgctgc > SEQ ID NO:1082 263550 Contig A *Arabidopsis thaliana*
TCAATCGATGACCAAAGACATAATCTTATCCTGAAGATTTGGCTGAATCGGTTGCACTCTATATCCAAACTGCCCATCA
TGATCTCTCATCATCATTCCTCTTGCGTTGCTTGCTATATCCATCTCCTGTTGTTGCAGCTGGAAAGTGAGTTGCCGTT
GCTCCTCCGCCATCATCTTCTCATTTCTCCTCTTTGATATAAGGATCTCCATCTGGTGGTCTCGGACTTTGTCGAGGCC
ATGTTCAATGGCGTGCTCGACAGCCATCAGATTTTTCAACTTGAGAGACTGTATATCTTCTCCCTTCAAATGCCTGAGC
TCCAGTTGTAAGCTATCATTCTCTTTCTTGATCCTATCAATCTCATTGCTAAGGTTCTCATGCTTAGCATCCCATAGTT
TCTTGCCAGATAACTTCTGGTATTGGTCCAACATAGCACCAAGATCCATGGAAGGACAACAGTAATCAATCATCTTACC
ATTACTT > SEQ ID NO:1083 263550 Contig B *Arabidopsis thaliana*
GCAGCATGGGTAGGGAAAGATCGATATAAAGACGATAGAGAACGCAAACAACAGAGTGGTGACGTTCTCAAACAGGAGG
AATGGAT > SEQ ID NO:1084 263557 Contig A *Arabidopsis thaliana*
GCTACTCAACCTTAGGTGTTATTACTCCACAATCCCTAAAACCACCATTGCCGCCGGATTCGTATAAACCTCCGACGAC
GAATCCACCACTTGTTTTCTGCATTTCCGCCATGTAACTCCTCACTTCAGCTTTTATCATCTCCTGCACCACCGTCATA
AACTCACCTCTACGTCCTTCTCCTCTCTCCTCTACATTAATCTTCATCTGACTCTCAAATCTCGGAAACATCAACGCGT
CGTTGTTATTGTTATGGCTCGAACTCGTGTTCTCAGCTCCAGGTAGTGACAAACTCAACGAAGTAGGTGGATCCTCCGA
AGACGAAGACATTTCAACCGGTAACGGCTGCGGAACCACCGTAAAACCGCCGGAAATCGGCATTGGTTTAAACAGCTGA
GCAACAGGAGACGACGGTGACGGAATCGTGCTAGAATCACTAACATCGATTCCGTTAGGACTCTCAGGACTCATGTACA
ATCCAGTATCCACCGGAGCAAAAGCAGAATCAAAGCTAACAGATCTCCTCTTCTTCGGCCGATCCTGATCTTCCTCCGT
CTCCGTCACCGTCGTAACCGCCACACCTCCGCTGCATTTCCTCTT

FIG. 1 continued

> SEQ ID NO:1085 263557 Contig B *Arabidopsis thaliana*
GCAGCATGGCGGATCGTGTTAAAGGTCCATGGAGTCAACATGAAGATGAGCAGCTACGAAGGATGGTTGAGAAATACTG
ACCGAGGAATAGGTCTGCGATTAGCAAATCGATTCCAGCTCGATCTGGTAAATCGTGTAGATTACGTTGGTGTAATCAG
TTATCTCCGGAAGTTGAGCATCGTCCTTTCTCGCCGGAGGAAGATGACACTATTGTTACCGGCCGTGCTCAATTTGGTA
AACAGTGGGCGACGATTGGTCGTCTTCTTAACGGTCGTACGGATAACGCCGGTAAAAATCACTGGAACTCTACGCTTAA
CAAGAAATGCCCCGGAGGTGTGGCGG > SEQ ID NO:1086 263611 Contig A *Arabidopsis thaliana*
TTAACATAAACCCTGAGAGGCAGAGTTTCCAACAGACAAAAAGTCGAAAAATGGAACACAATTCTCGTTAGGAATTCGG
CTGTTTTGATCGACATCTTCTTCTTCGTCTTTTCTTGAATTACCTATCAATTCGTGTATCTTCGAATCCGTGTTTACTT
GAAGAAAATTGTAGAACTCCATCGGTCGTTTAGTTTGGTCTATTGCTCCTTCTTGTATTGGAGTAGTACTACTTCTGAA
CCCGATCTTTCCGGTCAAGAACTCTTTGAGGACTTGAAAATGA > SEQ ID NO:1087 263611 Contig B *Arabidopsis thaliana*
GCAGCATGATGTGTAGTCGAGGCCATTGGAGACCTGCAGAAGACGAGAAGCTAAGAGAACTCGTCGAACAATTTGGTCC
TCATAATTGGAACGCCATAGCTCAGAAGCTCTCTGGTCGATCTGGTAAGAGTTGTAGATTGAGATGGTTTAATCAATTG
GATCCTAAGATTAACCGAAACCCTTTCACGGAGGAAGAAGAAGAAAGGGTTTTAACGTCTCATCGGATCCATGGGAACA
GATGGTCTGGGATCGCTAAATTTTTTCCCGGTCCAACTGGTAACGCTGTTAAAAACCATTGGGACGTCATCATGGGTCG
TCGTGGGCGAAAACGGTCCAAGCTCCGTCCACGAAGGCTTGGCCATGATG > SEQ ID NO:1088 263617 *Arabidopsis thaliana*
GCAGCATGATAGCTTCAGAGAGTACCAAGAGCTGGGAAGCTAGCGCAGTCAGACAAGAGAATGAAGAAGAGAAGAAGAA
ACCGGTTAAAGATTCCGGTAAGCATCCGGTTTATCGGGGTGTCCGAAAGAGGAACTGGGGAAAATGGGTGTCCGAGATA
CGTGAACCTAAGAAAAAATCCCGAATATGGGTAGGAACGTTTCCTTCCCCGGAGATGGGGGGGCGTGGACACGACGTAA
CCGGTCTTAGCATCAAAGGAGCCTCCGGTATACTCAATTTCCCTGACCTAACCGGGTCTTTCCCACGCCCTAACTCGGT
TAGCCCTCGAGACATCCAGGTCGCGGGTCTCAAAGCCGGACACATGGAGACCTCACAGGCTTTTCTTCTTCTTCTTCT
TTAACGTTTTCATCTTCACAGTCTTCTTCTTCG > SEQ ID NO:1089 263633 *Arabidopsis thaliana*
ttatggtgcaccagaagaattcagggtctcattagagtctgtctcaacttgttcagagcctgatgagttggttgctgaa
cCCCTTTCTCTGTCTCTCCCTCCTGCATCCTCTCCCGCTTCTACCTCACTTTTCTTCGCAAACCGGCCTCCACTCGCTC
GTGCCCTTCTCATTGCATGCTTGTGTCTTGACTCGTGAAGATATGGCTTTCTGTCCCGGATGACTTTCCTCTCTAGCTC
TGCCTTGGCACGTGCTTTTCTTCGCCTTAGAATTCCCTCGTACTGcTTTGCATTCACATAAACGGGCTCTTGTGCCATG
TCAAGTGGCAGAGCTGTTCTTTCACGAGGCATTCCAAGATATGGACGAAAACCCAATTGCTGATGACCATATGCTCCCA
TCAATCCCCCATAATATGGATCCTGATATGGGTTTGGGACACAAGCGATATAGTGTCCAACAAGCTCTGGTGGTTGTAC
AAGTGGCTGATCATGCATGTTACGGATAGAGAGCGCTGGGTCATTTCCTTCCATTCCGTGATTATCTACTGAACGAGAG
GAAGTTGCAGCTTGTGAATCCTTCCAAGTGCCATCGTTTTCACCATTCAACGCACCGTCTTCAGATGCTGAATGAACAT
CGTTTGACTCGGAACCATTGGGGCAATCCAAAGAAGAGGAATTTGATGGAATTCCAGAAGGTCTCGCTTGAGGTACAAC
ACCAAAGGAGTTGTTTTTCCACCAGGGCTCTGCatacatcatcggctgctgaacagcatggtgattattgacttcctct
tcgttttctcttcccggttttgattgcatgctgc > SEQ ID NO:1090 263635 *Arabidopsis thaliana*
GCAGCATGCATAGTTTGAATGAAACAGTAATGACCGAGAGAAATGCGCGATCTAAAGTGTTTGTTTAATAACCCAGCTA
ATAAGGCTAATGACATCATAGATCTGTTGTGGCTTGCCCGGCCAAGAGAGTGA > SEQ ID NO:1091 263636 Contig A *Arabidopsis thaliana*
TTAATACATTAGATCATCAGAAGACTCCATGAGAGGATGGTTCATAATATAATACATGTACATCTGATTCACGAATAAT
TCATCAAAATCCAAATCATGCACATGGTTCTGATACATGCCCATGTAGTGGTAGAAGTTGTCGCTAGTGTCCAGGAACT
CGATCATGTCATTGACATA > SEQ ID NO:1092 263636 Contig B *Arabidopsis thaliana*
GCAGCATGGAATCGACATCGTCGAGAACAAATTCGTCGACTGTTCACATGTCGTCATGATCGAAGGATAGTCTCATGGA
GCAGAGGACACGTAAATGGATGGTCTCAAACCGTGAATCT

FIG. 1 continued

> SEQ ID NO:1093 263679 *Arabidopsis thaliana*
tcactctctgggtcgagcaagccataaggagcttagagcccgtagccgtgagaagtaatcgtgtattgcaagtagagca
cGTGCTGACTGTCTCGTTGTTAATACTCTTATCATCTGTTGCAATGtTtgTAGTCTCAAATTATCAGCCTGGCGGATAA
ATCCTTCGAGTGTACCTAACTTTCCCATTGCCATGGCCATCTGACCCATGTAGCTTGCGACATTCCCTGATGAACTTGA
ACCAAGAGTCCCGCTCGATAAAGTATCAGCTAGTGACTGttGTAAGCTCTCCATCCCTTGAGACAAAGCATCTTCAGCC
TGCTGCGATGTCTGTTGCAGGTTATTTATGCCCATCAACTGTCTCTCTGTCATTGGCTCCAACTGATTCGCCAGAAGCT
TTagaAGTTCGGATGAACGAAATCCACCGAGCCACAAGAAACATCTCTCAgcTGGTGTTTTCCACATGCCAGATAGCAA
GTGAAAGACATCATTCTTAGCTGCATTGCTCTTTATCCTGAAAAGCTCCTCATAGTGAGCCATCACACCATCGACTATT
ATTCGAAGCTCAGAATCACCTGCATGCGCATTCAGagcagacctcagctcGttCaTTTGCtTGTTCTTTtcttcCAACc
accgtgAATGTTCAGCatcAaACGCCAAagcACCATTTCCACCAGtaGAATGGGcctggtctCCTGtgcCTGAAATGAA
GACGCCCTGctgtCTTGCTCTTTgcAGCTCCTGCtCAAGCTGGGTTAGTTTCAAGCGGCTGTTCtctAGCTGCTGAaCA
TAAGCCTtcTTCCTCAATCTGCTTTTCCTTGCTGCCTCACGGTTTTGAGCAAGCCTACGAAGAGTCTTTTGATCCATCT
TTCCCTTCGATCGGTCACTCGAATCAGAAGCAGCAGTATTCACTAGTGCtccctccgacccaagatcaggatgatctgt
gtcgtcatctgttgagacatcagttctcggactggtatcagccatgctgc > SEQ ID NO:1094 263681 *Arabidopsis thaliana*
GCACATGATAGCTTCAGAGAGTACCAAGAGCTGGGAAGCTAGCGCAGTCAGACAAGAGAATGAACAACAGAAGAAGAAA
CCGGTTAAAGATTCCGGTAAGCATCCGGTTTATCGGGGTGTCCGAAAGAGGAACTGGGGAAAATGGGTGTCCGAGATAC
GTGAACCTATGAGACAATCCCGAATATGGCTAGGAACGTGTCCTGCCCCGG > SEQ ID NO:1095 316712 *Arabidopsis thaliana*
GCAGCATGATGTGTAGTCGAGGCCATTGGAGACCTGCAGAAGACGAGAAGCTAAGAGAACTCGTCGAACAATTTGGTCC
TCATAATTGGAACGCCATAGCTCAGAAGCTCTCTGGTCGATCTGGTAAGAGTTGTACATTGAGATGGTTTAATCAATTG
GATCCTACGATTAACCGAAACCCTTTCACGGAGGAAGAACAAGAAAGGCTTTTAGCGTCTCATCGGATCCATGGGAACA
GATGGTCTGTGATCGCTACATTTTTTCCCGGTCGAACTGATAACGCTGTCAAAAACCATTGGCACGTCATCATGGCTC > SEQ ID NO:1096 316731 *Arabidopsis thaliana*
GCAGCATGATGTGTAGTCGAGGCCATTGGAGACCTGCAGAAGACGAGAAGCTAAGAGAACTCGTCGAACAATTTGGTCC
TCATAATTGGAACGCCATAGCTCAGAAGCTCTCTGGTCGATCTGGTAAAACTGACTTTATATTAAAGTCATTTCTTTAA
TTTCTTACAAAGCATATATAAACTAGGGTTTAATATATTTATATAAAAATATATATGTTGGTTTGATTGGATCTTTTGG
TTTCAGGTAAGAGTTGTAGATTGAGATGGTTTAATCAATTGGATCCTACTAGGATTAACCGAAACCCTTTCACGGAGGAAGA
AGAACAAAGGCTTTTGGCGTCTCATCGGATCCATGGGAACAGATGGTCTGTGATCGCTAGATTTTTTCCCGGTCGAACT
GATAACGCTGTTAAAAACCATTGGCACGTCATCATGGCTCGTCGTGGCCGAGAACGGTCCAAGCTCCGTCCACGAGGGC
TTGGCCATGATGGCACGGTGGCTGCGACTGGGATGATTGGTAATT > SEQ ID NO:1097 316741 *Arabidopsis thaliana*
GCAGCATGCCCCTCTCGTCACCAAGGCCAAGGGCCGTAAACTCACGGCTGAGGAACTCTGGTCAGAGCTCGATGCTTCC
GCCGCCGACGACTTCTGGGGTTTCTATTCCACCCCCAAACTCCATCCCACCAACCAAGTTAACGTGAAAGAGGAGGCAG
TGAACAAGGAGCAGGCAACAGAGCCGGGGAAACGGAGGAAGAGGAAGAATGTTTATAGAGGGATACGTAAGCGTCCATG
GGGAAAATGGCGGCTGAGATTCGAGATCCACGAAAAGGTGTGATAGTTTGGCTTGGTACGTTCAACACGGCGGAGGAA
GCTGCCATGGCTTATGATGTCGCGGCCAAGCACATCCGTGGTGATAAAGCCAAGCTCAACTTCCCAGATTGCACCATCC
TCCTCCTCCTAA > SEQ ID NO:1098 316762 *Arabidopsis thaliana*
GCAGCATGTACGGACAGTGCAATATAGAATCCGACTACGCTTTGTTGGAGTCGATAACACGTCACTTGCTAGGAGGAGG
AGGAGAGAACGAGCTGCGACTCAATGAGTCAACACCGAGTTCGTGTTTCACAGAGAGTTGGGGAGGTTTGCCATTGAAA
GAGAATGATTCAGAGGACATGTCGGTGTACGGACTCCTCAAAGATGCCTTCCATTTTGACACGTCATCATCGGACTTGA
GCTGTCTTTTTGATTTTCCGGCGGTTAAAGTCGAGCCAACTGAGAACTTTACGGCGATGGAGGAGAAACCAAAGAAAGC
GATACCGGTTACGGAGACGGCAGTGAAGGCGAACCATTACAGAGGAGTGAGGCAGAGACCGTGGGGGAAATTCG > SEQ ID NO:1099 316804 *Arabidopsis thaliana*
GCAGCATGCAGAGCAGCTTCAAAACCGTTCCTTTCACTCCTGATTTCTACTCTCAGTCTTCTTACTTCTTCAGAGGAGA
TAGTTGTCTTGAGGAGTTCCATCAACCAGTCAATGGTTTTCACCATGAAGAAGCTATCGATTTAAGTCCAAATGTCACT
ATTGCTTCAGCTAACTTACACTACACGACGTTTGATACGGTTATGGATTGTGGTGGTGGTGGTGGTGGCTTGAGGG

FIG. 1 continued

AGAGACTTGAAGGAGGAGAAGAGGAGTGTTTGGACACAGGGCAACTAGTGTACCAGAAAGGGACAAGATTAGTAGGAGG
AGGAGTAGGAGAAGTGAACAGCAGTTGGTGTGATTCGGTTTCAGCTATGGCTGATAACAGTCAACATACTGACACTTCC
ACAGATATTGATACTGATGACAAGACTCAGTTGAATGGAGGTCATCAAGGGA

> SEQ ID NO:1100 316807 Arabidopsis thaliana
ATGGATCCCAGAGAGATCCACCACCACCAACAACAACAACAACAACAGCAGCAGCAGCAACAACAGCCACATCTACAAC
AACAGCAACAACCACCGCCAGGGATGTTAATGAGTCACCACAATTCCTACAATCGAAACCCTAACGCC > SEQ ID NO:1101 316820 Arabidopsis thaliana
GCAGCATGGGGAGACAGCCATGCTGTGACAAGCTACGGGTGAAGAAAGGGCCGTGGACGGTGGAGGAAGATAACAAGCT
TATAAACTTCATACTAACCAATGGCC > SEQ ID NO:1102 316828 Arabidopsis thaliana
GCAGCATGGGAAGAGCACCGTGTTGTGACAAAGCAAACGTGAAGAAAGGGCCTTGGTCTCCTGAGGAAGATGCAAAACT
CAAATCTTACATTGAAATAGTGGCACCGGAGGCAATTGGATCGCTTCGCCTCAAAAGATTGGTTTAAAGAGATGTGGA
AAGAGTTGCACGCTGAGGTGGCTTAACTATCTTACACCAAACATCAAACATGGTGGCTTCTCTGAGGAAGAAAAAACA
TCACTTGTACCCTTTACCTTACACTTGGTAGCAGGTGGTCTATAATCGCTGCTCAATTGCCGGGACGAACATACAACGA
TATAAAACACTATCGCAACACGAGGCTCAAGAAGAAACTCATTAACAAACAACGCAAGGAT > SEQ ID NO:1103 316833 Arabidopsis thaliana
GGAGCATGCCCCTCTCGTCAACAAGGCCAATGTCCGTAAACTCACGGCTGACCAACTCTGGGCAGAGCTCGATGCTTCC
GCCGCCGACGACTTCTGCGGTTTCTATCCCACCTCCAAACTCCATCCCACCAACCAAGTTAACGTG > SEQ ID NO:1104 316834 Arabidopsis thaliana
GCAGCATGGGGAGACAGCCATACTGTGACAAGCTAGGGGTGAAGAAAGGGCCGTGGACGGTGGAGGAAGATAAGAAGCT
TATAAACTTCATACTAACCAATGGCCATTGTTGCTGGCGTGCTTTGCCGAAGCTGGCCGGTCTCCGTCGCTGTGGAAAG
AGCTGCCGCCTCCGGTGGACTAACTATCTCCGGCCTGACTTAAAACGAGGCCTTCTCTCGCATGATGAAGAACAACTTG
TCATAGATCTTCATGCTAATCTCGGCAATAAGTGGTCTAAGATAGCTTCAAGATTACCTGGAAGAACAGATAACGAAAT
AAAAAACCATTGGAATACTCATATCAAGAAGAAACTTCTTAAGATGGGAATCGATCCTATGACCCATCAACCCCTAAAT
CAAGAACCTTCTAATATCGATAATTCCAAAACCATTCCGTCCAATCCAGACGATGTCTCAGTGGAACCAAAGACAACTA
ACACGAAATACGTGGAGATAAGTGTCACGACAACAGAAGAAGAAAGTAGTAGCACGGTTACTGATCAAAACAGTTCGAT
GGATAATGAAAATCATCTAATTGACAACATTTATGATGATGATGAATTGTTTAGTTACTTATGGTCCGACGAAACTACT
AAAGA > SEQ ID NO:1105 316835 Arabidopsis thaliana
GCAGCATGAACTCATTTTCAGCTTTTTCTGAAATGTTTGGCTCCGATTACGAGCCTCAAGGCGGAGATTATTGTCCGAC
GTTGGCCACGAGTTGTCCGAAGAAACCGGCGGGCCGTAAGAAGTTTCGTGAGACTCGTCACCCAATTTACAGAGGAGTT
CGTCAAAGAAACTCCGGTAAGTGGGTTTCTGAAGTGAGAGAGCCAAACAAGAAAACCACGATTTGGCTCGGGACTTTCC
AAAACCGCTGAGATGGCAGCTCGTGCTCACGACGTCGCTGCATTAGCCCTCCGTGGCCGATCAGCATGTCTCAACTTCGC
TGACTCGGCTTGGCGGCTACCAATCCCGGAGTCAACATGCGCCAAGGATATCCAAAAAGCGGCT > SEQ ID NO:1106 316837 Arabidopsis thaliana
GCAGCATGGCTACACCAAACGAAGTATCAGCTCTTTTCCTCATCAAGAAGTATCTCCTCGACGAATTGTCTCCGTTGCC
TACTACTGCCACCACCAATCGATGGATGAACGATTTCACGTCATTTGATCAAACCGGTTTCGAGTTTTCTGAATTTGAA
ACCAAACCGGAAATAATCGATCTCGTCACTCCCAAACCGGAGATTTTTGATTTCGATGTGAAATCTGAAATTCCATCTG
AATCGAACGATTCCTTCACGTTCCAATCGAATCCTCCTCGCGTTACTGTTCAATCCAATCGAAAACCGCCGTTGAAGAT
CGCACCACCGAACCGAACCAAGTGGATTCAATTCGCAACCGGAAATCCTAAACCGGAACTTCCCGTACCGGTTGTAGCA
GCAGAGGAGAAGAGGCATTACAGAGGAGTGAGGATGAGGCCGTGGGGGAAATTCGCGGCGGAGATTCGAGACCCGACTC
GTCGTGGAACTCGT > SEQ ID NO:1107 316847 Arabidopsis thaliana
GCAGCATGATGTGTAGTCGAGGCCATTGGAGACCTGCAGAAAACGAGAAGCTAAGAGAACTCGTCGAACAATTTGGTCC
TCATAATTGGAACGCCATAGCTCAGAAGCTCTCTGGTCGATCTGGTAAGAGTTGTAGATTGAGATGGTTTAATCAATTG
GATCCTAGGATTAACCGAAACCCTTTCACGGAGGAAGAAGAAGAAAGGCTTTTAGCGTCTCATCGGATCCATGGGAACA

FIG. 1 continued

```
GATGGTCTGTGATCGCTAGATTTTTTCCCGGTCGAACTGATAACGCTGTTAAAAACCATTGGCACGTCATCATGGCTCG
TCGTGGCCGAGAACGGTCCAAGCTCCGTCCACGAGGCCTTGGCCATGATGGCACGGTGGCTGCGACTGGGATGATTGGT
AATTATAAAGACTGCGATAAGGAGAGAAGATTGGCAACCACAACCGCTATCAATTTTCCTTATCAATTCTCTCATATTA
ATCATTTTCAAGTCCTCAAAAGAGTTCTTGACCGGAAAGATCGGGTTCAGAATTAGTACTACTCCAATACAAGAAGGAGC
AATAGACCAAACTAAACGACCGATGGAGTTCTACAATTTTCTTCAAGTAAACACGGATTCGAAGATACACGAATTGATA
GATAATTCAAGAAAAGACGAAGAAGAAGATGTCGATCAAAACAACCGA

> SEQ ID NO:1108 316850 Arabidopsis thaliana
GCAGCATGCCCCTCTCGTCACCAAGGCCAAGGGCCGTAGACTCACGGCTGAAGAACTCTGGGTCAGAGATCGATGCTTC
CGCCGGCGACGACTTCTGGCGTTTCTATCCCACCTCCAAACTCCATCCCACCAAACAAGTTAACGTGAAAGAGGAG > SEQ ID NO:1109 316857 Arabidopsis thaliana
GCAGCATGGGAAGAGCACCGTGTTGTGATAAGGCCAACGTGAAGAAAGGGCCTTGGTCTCCTGAGGAAGACGCCAAACT
CAAAGATTACATCGAGAATAGTGGCACAGGAGGCAACTGGATTGCTTTGCCTCAGAAAATTGGTTTAAGGAGATGTGGG
AAGAGTTGCAGGCTAAGGTGGCTCAACTATCTGAGACCAAACATCAAACATGGTGGCTTCTCCGAGGAAGAAGACAACA
TCATTTGTAACCTCTATGTTACTATCGGTAGCAGGTGGTCTATAATTGCTGCACAATTGCCGGGAAGAACCGACAACGA
TAT > SEQ ID NO:1110 316860 Arabidopsis thaliana
GCAGCATGGAGCGAGACGAAGAAGCGGGTGGACCGATGATGGAGATGTGCACTAACGGCGGCGAAGAGACGTCTAATCG
AAGACCTATCATAAGTGGCGAACCGCTCGACATCGAGGCCTACGCGGCTCTCTACAAAGGTCGCACGAAGATCATGCGG
CTTCTCTTCATCGCTAACCACTGCGGAGGAAACCACGCGCTTCAGTTTGACGCGTTGAGGATGGCTTACGATGAGATCA
AAAAGGGTGAGAATACGCAGTTGTTCAGAGAAGTGGTCAATAAGATTGGCAACAGGCTTGGGGAAAAGTATGGGATGGA
TCTTGCTTGGTGTGAGGCCGTCGATCGTCGTGCTGAACAGAAGAAAGTAAAGCTGGAGAATGAGCTCAGTTCTTATCGG
ACAAATTTGATCAAGGAAAGCATCAGAATGGGTTACAATGACTTTGGAGATTTCTATTACGCATGTGGTATGCTCGGAG
ATGCTTTCAAGAACTATATCCGAACACGCGACTACTGCACTACGACAAAGCACATCATTCACATGTGTATGAATGC > SEQ ID NO:1111 316861 Arabidopsis thaliana
GCAGCATGCCCCTCTCGTCACCAAGGCCAAGGGCCGTAAACTCACGGCTGAGGAACTCTGGTCAGAGCTCGATGCTTCC
GCCGCCGACGACTTCTGGGGTTTCTATTCCACCTCCAAACTCCATCCCACCAACCAAGAGGAGGCAGTGAAGAAGGAGC
AGGCAACAGAGCCGGGGAAACGGAGGAAGAGGAAGAATGTTTATAGAGGGATACGTAAGCGTCCATGGGGAAATGGGC
GGCTGAGATTCGAGATCCACGAAAAGGTGTTAGAGTTTGGCTTGGTACGTTCAACACGGCGGAGGAAGCTGCCATGGCT
TATGACGTTGCGGCCAAGCAGATCCGTGGTGATAAAGCCAAGCTCAACTTCCCAGATTGCACCATCCTCCTCCTCCTAA > SEQ ID NO:1112 316870 Arabidopsis thaliana
GCAGCATGGATTCCAGAGAGATCCACCACCAACAACAGCAACAACAACAACAACAACAGCAGCAGCAGCAACAACAGCA
ACATCTACAACAACAGCAACAACCACCGCCAGGGATGTTAATGAGTCACCACAATTCCTACAGTCGAAACCCTAACGCC
GCCGCCGCTGTTTTAATGGGTCACAACACCTCCACATCTCAAGCTATGCATCAAAGATTACCTTTTGGTGGTTCTATGT
CACCGCGTCAGCCTCAACAACATCAGTATCATCATCCTCAGCCTCAGCAACAGATAGATCAGAAGACTCTTGAATCTCT
TGGATTTGATGGATCGCCTTCTTCTGTTGCCGCCACTCAACAACATTCGATGAGATTTGGGATCGACCATCAACAGGTT
AAGAAGAAACGAGGTAGACCTAGGAAGTATGCTGCTGATGGTGGTGGTGGTGGTGGTGGTGGTAGTAACATTGCTCTTG
GTTTGGCTCCTACTTCGCCTCTTCCTTCTGCTT > SEQ ID NO:1113 316883 Arabidopsis thaliana
GCAGCATGAACTCATTTTCAGCTTTTTCTGAAATGTTTGGCTCCGATTACGAGCCTCAAGGCGGAGATTATTGTCCGAC
GTTGGCCACGAGTTGTCCGAAGAAACCGGCGGGCCGTAAGAAGTTTCGTGAGACTCGTCACCCAATTTACAGAGGAGTT
CGTCAAAGAAACTCCGGTAAGTGGGTTTCTGAAGTGAGAGAGCCAAACAAGAAAACCAGGATTTGGCTCGGGACTTTCC
AAACCGCTGAGATGGCAGCTCGTGCTCACGACGTCGCTGCATTAGCCCTCCGTGGCCGATCAGCATGTCTCAACTTCGC
TGACTCGGCTTGGCGGCTACGAATCCCGGAGTCAACATGCGCCAAGGATATCCAAAAAGCGGCTGCTGAAGCGGCGTTG
GCTTTTCAAGATGAGACGTGTGACACGACGACCACGAATCATGGCCTGGACATGGAGGAGACGATGGTGGAAGCTATTT
ATACACCGGAACAGAGCGAAGGTGCGTNTTATATGGATGAGGAGACAATGTTTGGGATGCCGACTTTGTTGGATAATAT
GGCTGAAGGCATGCTTTTACCGCCGCCGTCTGTTCAATGGAATCATAATTATGACGGCGAAGGAGATGGTGACGTGTCG
CTTTGGA
```

> SEQ ID NO:1114 316886 *Arabidopsis thaliana*
GCAGCATGTCAGGATCTGAGACGGGTTTAATGGCGGCGACCAGAGAATCAATGCAATTTACAATGGCTCTCCACCAGCA
GCAGCAACACAGTCAAGCTCAACCTCAGCAGTCTCAGAACAGGCCATTGTCATTCGGTGGAGACGACGGAACTGCTCTT
TACAAGCAGCCGATGAGATCAGTATCACCACCGCAGCAGTACCAACCCAACTCAGCTGGTGAGAATTCTGTCTTGAACA
TGAACTTGCCCGGAGGTGAGTCTGGAGGCATGACTGGAACTGGAAGTGAGCCAGTGAAAAAGAGGAGAGGTAGACCGAG
GAAATATGGGCCTGATAGTGGTGAAATGTCACTTGGTTTGAATCCTGGAGCTCCTTCTTTCACTGTCAGCCAACCTAGT
AGCGGCGGCGATGGAGGAGAGAAGAAGAGAGGAAGACCTCCTGGTTCTTCTAGCAAAAGGCTCAAGCTTCAAGCTTTAG
GCTCGACTGGAATCGGATTTACGCCTCATGTACTTACCGTGCTGGCTGGAGAGGATGTATCATCCAAGATAATGGCGTT
AACTCATAATGGACCCCGTGCTGTGTGTGTCTTGTCTGCAAATGGAGCCATCTCCAATGTGACTCTCCGCCAGTCTGCC
ACATCCGGTGGAACTGTTACATATGAGGGGAGA > SEQ ID NO:1115 316902 *Arabidopsis thaliana*
GCAGCATGATGATGGAGACTAGAGATCCAGCTATTAAGCTTTTCGGTATGAAAATCCCTTTTCCGTCGGTTTTTGAATC
GGCAGTTACGGTGGAGGATGACGAAGAAGATGACTGGAGCGGCGGAGATGACAAATCACCAGAGAAGGTACTGATTGAT
AAAAAGTAACTCCAGAGTTATCAGATAAGAACAACAACAACTGTAACGACAACAGTTTTAACAATTCGAAACCCGAAAC
CTTGGACAAAGAGGAAGCGACATCAACTGATCAGATAGAGAGTAGTGACACGCCTGAGGATAATCAGCAGACGACACCT
GATGGTAAAACCCTAAAGAAACCGACTAAGATTCTACCGTGTCCGACATGCAAAAGCATGGAGACCAAGTTCTGTTATT
ACAACAACTACAACATAAACCAGCCTCGTCATTTCCTGCAAGGCTTGTCAGAGATATTGGACTGCTGGAGGGACTATGA
CGAATGTTCCTGTGGGGGCAGGACGTCGTAAGAACAAAAGCTCATCTTCTCATTACCGTCACATCACTATTTCCGACGC
TCTTGACGCTGCGAGGCTTGACCCGGGCTTACAG > SEQ ID NO:1116 316903 *Arabidopsis thaliana*
GCAGCATGTCGGATGCGTATTGTACGGATTGTAAAAGGAGACGGAGTTGGTTGTCGATCACTCAGCCGGAGATACCCT
TTGCTCCGAGTGTGGTTTGGTTTTGGAATCTCACTCCATTGATGAGACCTCTGAGTGGCGTACCTTCGCTAATGAATCT
TCCAACAGCGATCCCAATCGTGTCGGTGGTCCAACCAACCCGCTTCTCGCTGATAGTGCTTTAACCACTGTTATCGCTA
AGCCCAATGGTTCATCTGGTGATTTCTTGTCTTCTTCTCGGGAGGTGGCAGAATCGTAACTCCAATTCCGATCGTGG
TTTGATTCAAGCTTTTAAAACCATTGCTACCATGTCTGAAAGGTTGGGACTTGTTGCAACTATCAAGGATCGGGCTAAT
GAGTTATATAAGAGGCTGGAGGATCAGAAGTCAAGCAGGGGAAGAAATCAGGATGCACTTTATGCAGCCTGTCTGTACA
TTGCTTGTCGCCAAGAGGACAAGCCACGAACTATTAAGGAAATATGCGTTATTGCCAATGGGGCGACAAAGAAGGAAAT
TGGCCGAGCAAAAGACTACATTGTTAAGACATTGGGACTGGAGCCTGGTCAGTCTGTGGATTTAGGAACTATACACGCT
GGTGATTTCATG > SEQ ID NO:1117 316906 *Arabidopsis thaliana*
GCAGCATGTCAGCCTCTTCCTCACCGCCTCCTCCAACCACCGCCACCTCGAAGTCCAAGAGGGGAACGAAGAAAGAGAT
TCAAGAGTCGCTTCTTACTCCGAGGTTCTACACGACGGACTTCGAGGAAATGGAACAGCTTTTCAACACGGAGATCAAC
AAGAACCTTAACGAAGCAGAGTTCGAGGCTCTGCTTCAAGAGTTCAAGACCGATTACAACCAGACACATTTCGTGAGGA
ACAAGGAGTTTAAAGAAGCTGCAGACAAATTGCAAGGACCTCTCCGACAGATCTTCGTTGAGTTCCTTGAGCGGTCTTG
TACTGCTGAGTTCTCTGGTTTCCTTCTCTACAAGGAGCTTGGTCGAAGACTCAAGAAAACAAACCCTGTTGTGGCTGAG
ATCTTCTCTCTTATGTCTAGAGATGAAGCAAGACATGCCGGGTTCTTGAACAAGGGATTGTCTGATTTCAACTTGGCTC
TTGATTTGGGTTTCCTGACAAAGGCAAGGAAATACACTTTCTTCAAGCCAAAATTCATCTTCTACGCGACTTACTTATC
CGAGAAAATCGGGTACTGGAGATACATCACAATCTACAGACACCTCAAGGAAAACCCTGAGTTCCAATGTTACCCAATC
TTCAAGTACTTTGAGAACTGGTGTC > SEQ ID NO:1118 316924 *Arabidopsis thaliana*
GCAGCATGAATACAACCTCGACACATTTTGTTCCACCGAGAAGGTTTGAAGTTTACGAGCCTCTCAACCAAATCGGTAT
GTGGGAAGAAAGTTTCAAGAACAATGGAGACATGTATACGCCTGGCTCTATCATAATCCCGACTAACGAAAAACCAGAC
AGCTTGTCAGAGGATACTTCTCATGGGACAGAAGGAACTCCTCACAAGTTTGACCAAGAGGCTTCCACATCTAGACATC
CTGATAAGATACAGAGAAGGCTAGCACAGAATCGAGAGGCAGCTAGGAAAAGTCGTTTGCGCAAGAAAGCTTATGTTCA
GCAGCTAGAGACTAGCCGGTTAAAGCTAATTCATTTAGAGCAAGAACTCGATCGTGCTAGACAACAGGGTTTCTATGTG
GGGAACGGAGTAGATACCAATGCTCTTAGTTTCTCAGATAACATGAGCTCAGGGATTGTTGCATTTGAGATGGAATATG
GACATTGGGTGGAAGAACAGAACAGGCAAATATGTGAACTAAGAACGGTTTTACATGGACAAGTTAGTGATATAGAGCT
TCGTTCTCTAGTCGAGAATGCCATGAAACATTACTTTCAACTCTTCCGAATGAAGTCAGCCGCTGCAAAAATCGATG

FIG. 1 continued

> SEQ ID NO:1119 316934 Arabidopsis thaliana
GCAGCATGGATAAAGAGAAATCTCCACTACCTCCTTGTGGAGGTCTTCCTCCTCCATCTGGATCAGGTCGATGCTCTGC
ATTCTCACAAGCTGGTCCCATTGGTCATGGTTCAGATGCTAATCGAATGAGTCATGATATTAGCCGTATGCTTGATAAC
CCACCTAATAAGATTGGAGATCGGCGAGCTCATTCTGAAATACTTACTCTCCCTGATGATTTGACCTTTGATAGTGATC
TTGGTGTGGTTGGTAATGCTGCTGATGGAGCTTCTTTCTCTGATGACACTGAAGAAGATTTGCTCTCTATGTATCTTGA
TATGGATAAGTTCAATTCTTCTGCTACATCTTCTGCCCAACTCGGTGACCCATCACGAACTGC > SEQ ID NO:1120 316938 Arabidopsis thaliana
GCAGCATGGGAAGAGGAAGAGTAGAGCTGAAGAGGATAGAGAACAAAATCAACAGACAAGTAACGTTTGCAAAGCGTAG
GAACGGTTTGTTGAAGAAAGCTTATGAATTGTCTGTTCTCTGTGATGCCGAAGTTGCTCTCATCATCTTCTCCAACCGT
GGAAAGCTCTATGAGTTTTGCAGCTCCTCAAACATGCTCAAGACACTTGATCGGTACCAGAAATGCAGCTATGGGTCCA
TTGAAGTCAACAACAAACCTGCCAAAGAACTTGAGAACAGCTACAGAGAATATCTGAAGCTTAAGGGTAGATATGAGAA
CCTTCAACGTCAACAGAGAAATCTTCTTGGGGAGGATTTAGGACCTTTGAATTCAAAGGAGTTAGAGCAGCTTGAGCGT
CAACTGGACGGCTCTCTCAAGCAAGTTCGGTCCATCAAGCACAGTACATGCTTGACCAGCTCTCGGATCTTCAAAATA
AAGAGCAAATGTTGCTTGAAACCAATAGAGCTTTGGCAATGAAGCTGGATGATATGATTGGTGTGAGAAGTCATCATAT
GGGAGGAGGAGGAGGATGGGAAGGTGGTGAACAGAATGTTACCTACGCGCATCATCAAGCTCAGTCTCAGGGACTATAC
CAGCCTCTTGAATGCAATCCAACTCTGCAAATGGGGTATGATAATCCGGTA > SEQ ID NO:1121 316941 Arabidopsis thaliana
GCAGCATGGGAACGAGCGAAGACAAGATGCCATTTAAGACTACCAAACCAACATCTTCGGCTCAGGAAGTTCCTCCCAC
ACCGTATCCAGATTGGCAAAATTCAATGCAGGCTTATTATGGCGGAGGAGGTACTCCAAATCCTTTTTTCCCATCCCCA
GTTGGATCTCCTAGTCCTCACCCCTATATGTGGGGTGCTCAACACCATATGATGCCGCCTTATGGCACCCCAGTTCCGT
ACCCAGCAATGTATCCCCCGGGGGCAGTCTATGCTCATCCTAGCATGCCCATGCCTCCTAATTCTGGTCCTACCAACAA
GGAGCCTGCGAAGGACCAAGCTTCTGGCAAGAAGTCAAAGGGGAACTCGAAAAAAAAGGCTGAAGGAGGTGATAAAGCG
CTCTCTGGTTCAGGGAACGATGGTGCCTCTCATAGTGATGAAAGTGTCACAGCGGGTTCATCTGATGAAAATGATGAGA
ATGCCAATCAACAGGAACAGGGTTCAATTCGAAAGCCAAGCTTTGGACAGATGCTTGCTGACGCAAGTTCTCAAAGTAC
GACTGGTGAAATCCAAGGTTCGGTGCCCATGAAGCCGGTAGCCCCGGGGACTAATCTGAATATCGGGATGGACTTATGG
TCTTCCCAAGCTGGTGTACCAG > SEQ ID NO:1122 316944 Arabidopsis thaliana
GCAGCATGGGAAGAGGAAGAGTAGAGCTGAAGAGGATAGAGAACAAAATCAACAGACAAGTAACGTTTGCAAAGCGTAG
GAACGGTTTGTTGAAGAAAGCTTATGAATTGTCTGTTCTCTGTGATGCTGAAGTTGCTCTCATCATCTTCTCCAACCGT
GGAAAGCTCTATGAGTTTTGCAGCTCCTCAAACATGCTCAAGACACTTGATCGGTACCAGCTCTCGGATCTTCAAAATA
AAGAGCAAATGTTGCTTGAAACCAATAGAGCTTTGGCAATGAAGCTGGATGATATGATTGGTGTGAGAAGTCATCATAT
GGGAGGAGGAGGAGGATGGGAAGGTGGTGAACAGAATGTTACCTACGCGCATCATCAAGCTCAGTCTCAGGGACTATAC
CAGCCTCTTGAATGCAATCCAACTCTGCAAATGGGGTATGATAATCCGGTATGCTCAGAGCAAATAACTGCGACAACCC
AAGCTCAGGCGCAGCAGGGAAACGGTTACATTCCAGGATGGTGCTCTGA > SEQ ID NO:1123 316947 Arabidopsis thaliana
GCAGCATGGGAACGAGCGAAGACAAGATGCCATTTAAGACTACCAAACCAACATCTTCGGGTCAGGAAGTTCCTCCCAC
ACCGTATCCAGATTGGCAAAATTCAATGCAGGCTTATTATGGCGGAGGAGGTACTCCAAATCCTTTTTTCCCATCCCCA
GTTGGATCTCCTAGTCCTCACCCCTATATGTGGGGTGCTCAACACCATATGATGCCGCCTTATGGCACCCCAGTTCCGT
ACCCAGCAATGTATCCCCCGGGGGCAGTCTATGCTCATCCTAGCATGCCCATGCCTCCTAATTCTGGTCCTACCAACAA
GGAGCCTGCGAAGGACCAAGCTTCTGGCAAGAAGTCAAAGGGGAACTCGAAAAAAAAGGCTGAAGGAGGTGATACAGCG
CTCTCTGGTTCAGGGAACGATGGTGCCTCTCATAGTGATGAAAGTGTCACAGCGGGTTCATCTGATGAAAATGATGAGA
ATGCCAATCAACAGGGTTCAATTCGAAAGCCAAGCTTTGGGCAGATGCTTGCTGACGCAAGTTCTCAAAGTACGACTGG
TGAAATCCAAGGTTCGGTGCCCATGAAGCCGGTAGCCCCGGGGACTAATCTGAATATCGGGATGGACTTATGGTCTTCC
CAAGCTGGTGTACCAGTGA > SEQ ID NO:1124 316970 Arabidopsis thaliana
GCAGCATGGCTCGTGGAAAGATTCAGCTTAAGAGGATTGAGAACCCGGTTCACAGACAAGTGACTTTTTGCAAGAGGAG
AACTGGTCTTCTCAAGAAGGCTAAGGAGCTCTCTGTGCTCTGTGATGCCGAGATCGGTGTTGTGATCTTCTCTCCTCAG
GGCAAGCTCTTTGAGCTCGCTACTAAAAGGAACAATGGAGGGAATGATTGATAAGTACATGAAGTGTACTGGTGGTGGTC
GTGGTTCTTCTTCTGCTACTTTTACTGCTCAAGAACAACTTCAACCACCAAATCTTGATCCGAAAGATGAGATCAACGT

FIG. 1 continued

```
GCTTAAGCAAGAGATTGAGATGCTTCAGAAAGGGATAAGCTATATGTTTGGAGGAGGAGATGGGGCTATGAATCTTGAA
GAACTTCTTTTGCTTGAGAAGCATCTTGAGTATTGGATTTCTCAGATTCGCTCTGCTAAGATGGATGTTATGCTTCAAG
AAATTCAGTCATTGAGGAACAAGGAAGGAGTCCTCAAAAACACCAACAAGTATCTCCTCGAAAAGATAGAGGAAAACAA
CAATAGCATATTAGATGCTAACTTCGCAGTCATGGAGACAAACTATTCCTATCCGCTAACAATGCCAAGTGAAATATTT
CAGTT

> SEQ ID NO:1125 316974 Arabidopsis thaliana
GCAGCATGGGAAGAGGGAGAGTGGAGATGAAGAGGATAGAGAACAAGATTAATAGACAAGTGACCTTCTCAAAAGAAG
AAACGGTTTGCTGAAGAAAGCTTATGAGCTTTCTGTTCTTTGCGATGCCGAAGTTGCTCTCATCATCTTCTCAAGCCGT
GGCAAGCTCTACGAGTTTGGTAGTGTTGGAATTGAAAGCACAATCGAACGGTATAATCGTTGTTACAACTGCTCTCTAA
GCAATAATAAGCCTGAAGAGACTACACAGAGTTGGTGTCAGGAGGTGACAAAGCTTAAATCCAAATACGAATCTCTTGT
TCGTACTAACAGGAATTTGCTTGGAGAAGATCTTGGAGAAATGGGTGTGAAGGAACTGCAAGCGCTCGAGAGGCAGCTC
GAAGCCGCTCTTACCGCGACTCGACAGCGCAAGACACAAGTTATGATGGAAGAAATGGAAGACCTTAGGAAAAGGAGA
GGCAACTAGGAGACATAAACAAACAACTCAAGATTAAGTTTGAAACGGAAGGCCATGCTTTCAAAACCTTTCAAGACTT
ATGGGCAAACTCGGCGGCATCGGTGGCCGGGGATCCAAACAATTCTGAATTTCCGGTAGAGCCTTCTCATCCTAATGTA
TTGGATT > SEQ ID NO:1126 316976 Arabidopsis thaliana
GCAGCATGGGAAGAACACCTTGTTGTGACAAGATTGGTTTGAAGAAAGGTCCTTGGACGCCTGAAGAAGATGAGGTTCT
TGTTGCGCATATCAAGAAAAATGGACATGGAAGCTGGAGAACACTTCCTAAACTTGCTGGTTTACTTCGCTGTGGGAAG
AGTTGCAGGCTGAGATGGACAAACTATCTGAGACCAGACATAAAGAGAGGTCCTTTCACTGCTGATGAAGAGAAACTTG
TTATCCAGCTTCATGCCATTCTCGGCAACAGGTGGGCTGCTATTGCAGCACAGCTTCCAGGAAGAACAGACAACGAGAT
CAAGAACTTATGGAACACTCATTTGAAGAAACGTCTTTTATCTATGGGTCTTGATCCCAGAACTCATGAGCCATTACCT
TCATATGGGTTAGCTAAACAAGCTCCATCTTCACCAACAACTCGCCACATGGCTCAATGGGAAAGTGCTAGGGTTGAAG
CTGAGGCAAGGCTTTCTAGAGAATCAATGCTCTTTAGCCCTTCTTTTTACTCTGGTGTAGTAAAAACTGAATGTGATCA
CTTCTTACGCATTTGGAATTCCGAGATTGGTGAAGCTTTCAGGAATCTCGCTCCATTAGATGAATCAACTATTACTAGT
CAAAGCCCTTGCTCGAGGGCAACATCGACCTCATCTGCACTTCTGAAGAGCTCA > SEQ ID NO:1127 316984 Arabidopsis thaliana
GCAGCATGATGATGGAGACTAGAGATCCAGCTATTAAGCTTTTCGGTATGAAAATCCCTTTTCCGTCGGTTTTTGAATC
GGCAGTTACGGTGGAGGATGACGAAAAATATGACTGGAGCGGCGGAGATGACAAATCACCAGAGACGGTAACTCCAGAG
TTATCAGATAAGAACAACAACAACTGTAACGACAACAGTTTTAACAATTCGAAACCCGAAACCTTGGACAAAGAGGAAG
CGACATCAACTGATCAGATAGAGAGTAGTGACACGCCTGAGGATAATCAGCAGACGACACCTGATGGTAAAACCCTAAA
GAAACCGACTAAGATTCTACCGTGTCCGAGATGCAAAAGCATGGAGACCAAGTTCTGTTATTACAACAACTACAACATA
AACCAGCCTCGTCATTTCTGCAAGGCTTGTCAGAGATATTGGACTGCTGGAGGGACTATGAGGAATGTTCCTGTGGGGG
CAGGACGTCGTAAGAACAAAAGCTCATCTTCTCATTACCGTCACATCACTATTTCCGAGGCTCTTGAGGCTGCGAGGCT
TGACCCGGGCTTACAGGCAAA > SEQ ID NO:1128 316996 Arabidopsis thaliana
GCAGCATGGGAAGAGGGAAAGTTGAGCTGAAGAGGATAGAGAACAAGATCAATAGACAAGTTACTTTTGCAAAGAGAAG
AAATGGTTTGCTCAAGAAGGCTTATGAGCTTTCTGTCCTTTGTGATGCTGAGATTGCTCTTCTCATTTTCTCTAACCGT
GGCAAGCTCTACGAATTCTGCAGCAGCCCTAGTGGTATGGCGAGGACGGTTGATAAGTATAGAAAACATAGTTATGCAA
CAATGGATCCAAATCAATCAGCTAAAGACTTGCAGGATAAGTATCAAGACTACTTGAAGCTTAAATCAAGAGTTGAGAT
CCTTCAACATTCACAAAGGCATTTGCTAGGTGAAGAGCTATCCGAGATGGATGTGAATGAGCTTGAGCATCTCGAACGC
CAAGTAGATGCATCACTAAGACAAATAAGATCTACCAAGGCTCGGTCTATGCTTGATCAACTATCTGACCTCAAAACTA
AGGAGGAAATGTTATTGGAAACCAATAGAGATCTTAGGAGAAAGTTGGAGGACAGTGATGCAG > SEQ ID NO:1129 317014 Arabidopsis thaliana
GCAGCATGAAGTCTTTTTGTGATAATGATGATAATAATCATAGCAACACGACTAATTTGTTAGGGTTCTCATTGTCTTC
AAATATGATGAAAATGGGAGGTAGAGGAGGTAGAGAAGCTATTTACTCATCTTCAACTTCTTCAGCTGCAACTTCTTCT
TCTTCTGTTCCACCTCAACTTGTTGTTGGTGACAACACTAGCAACTTTGGTGTTTGCTATGGATCTAACCCAAATGGAG
GAATCTATTCTCACATGTCTGTGATGCCACTCAGATCTGATGGTTCTCTTTGCTTAATGGAAGCTCTCAACAGATCTTC
TCACTCGAATCACCATCAAGATTCATCTCCAAAGGTGGAGGATTTCTTTGGGACCCAT
```

FIG. 1 continued

> SEQ ID NO:1130 317021 *Arabidopsis thaliana*
GCAGCATGGGAAGAGGAAGAGTGGAGATGAAGAGGATAGAGAACAAGATCAATAGACAAGTGACCTTCGCAAAACGAAG
AAACGGTTTGCTGAAGAAAGCTTATGAACTGTCTGTTCTCTGCGATGCCGAAGTTGCTCTCATCATCTTCTCCAGCCGT
GGCAAGCTCTATGAGTTTGGTAGTGCCGCAATCGTGCTCACAATCCATGGTCATAATCATAGTTGCAAC > SEQ ID NO:1131 317069 *Arabidopsis thaliana*
GCAGCATGGGAACATGAAAATTAAATCTGCTTACGATACAGAACAGTATCAACCAGAGGAGTAACTTCTGCAACACGTA
CCACCGGTATGTTAACGACACCTTATCACTTGTCTGTTCTCTGCGACGCTGACTTCGCACTCATCATCTTCTCCAACCG
TGGAAAGCTCTATGACTCTTGCAGCTCCTCAAACATGCTCAACACACTTGATCGGGACCAGAAATGCAGCTATGGATCC
ATTGAAATCAACAACAAACCTGCCAAAGAACTTGAGAACAGCTACAGAGAATATCTGAAGCTTACGGGTACATATGAGA
ACCTTCAACGTCAA > SEQ ID NO:1132 317079 *Arabidopsis thaliana*
GCAGCATGGCAAATCGCGGAGGTGAATATCTGTACGATGAGTTATGGAAATTATGCGCGGGACCTCTTGTTGATGTTCC
TCAAGCTCAAGAAAGAGTTTATTATTTTCCTCAAGGTCACATGGAACAACTCGAAGCGTCAACGCAACAAGTCGACTTA
AATACGATGAAGCCTCTTTTTGTTCTTCCTCCTAAGATTCTCTGCAATGTTATGAACGTTAGTCTTCAGGCGGAGAAAG
ATACGGATGAGGTCTATGCTCAGATTACTTTGATCCCTGTTGGAACTGAAGTTGATGAACCTATGAGTCCTGATCCCTC
TCCTCCTGAGTTGCAAAGGGCGAAAGTTCACTCTTTCAACAAGGTTTTGACAGCGTCTGATACAAGCACCCATGGTGGC
TTTTCTGTTCTAAGGAAACATGCCACGGAATGTCTTCCTCCGGTGGATATGACTCAACAAACCCCGACCCAGGAGTTAA
TAACCGAAGATGTGCACGGTTATCAGTGGAAATTCAAGCATATTTTTAGAGGCCAACCACGGAGGCATCTATTGACTAC
AGGGTGGAGCACCT > SEQ ID NO:1133 43445 Contig A *Nicotiana benthamiana*
TTGAAAGTAGATATTTTCTCGGACTTCGAAGACATCTTCGGGTAACAATTTGGAGAAAGGAGAATGGCGTTAGTTTCAG
GAGGAAGGTCGACACTGAATCCGAATGCACCTCTTTTCATCCCGTCTTATGTGCGTCAAGTGGAGGATTTTTCACCCGA
ATGGTGGAATTTGGTGACAACTTCGACATGGTTCCATGATTATTGGACGAGCCAGCATCAAGGAGAGGAATATGGCGAT
GATGCTTTTGGTTTTGCTGGGAATGATGTTGCTGACTTGCTTCCTGAAAATATCGATCTTGATGTTGATGAAGATATTT
TGAACATGGAAGCTCAGTTTGAAGAATTCCTCCAATCATCTGAAAGTGAACAACAAGGAATCAAGTCATCGCTCTATGG
TGTCAATGGTTTACCCAAGGGTTCGGAGGCACTCGTACGGACACTGAGCATGCCAAAGGGGCCAAAATCTCCCATTGAG
CCACCAAAGTACTATGAGAAACCAGCAAAGATTGTTAGCCCAAAGAACAGCCTTCGCCGCATCCAGCAGCCTCGCTAAA
TGTAGTTTAGCTTAAGCAAAAGCTCTTGGTTTGTAGTTTGGGAATGTCAGTCCTTAATTTGCAGCTTTTAGTCTTCTT > SEQ ID NO:1134 43445 Contig B *Nicotiana benthamiana*
ATCGCACAGATGGCTGCACCTACTGCTGCTCACTGGTCAGAGAAGTATAATCAACTAGTTGCTGACTTGAAGAAGAAAG
GTTATATTGTTGTCAACTACATTCCTTTGATACCAGTTGAAGAAATCTCAAAGGCATATAAACAGGTTGAGTCTGCTGC
GCATG > SEQ ID NO:1135 48423 *Nicotiana benthamiana*
GCCATTACGGCCGGGGATGGAGCTGCAAGATTGGAAGGAGGCATTGAAGTATTGCAGATTAACTATCCCGGTTTATAAG
AGAGTTTATCCAGAATGTCATCCTTTGCTCGGACTGCAATATTACACTTGTGGAAAACTTGAATGGTGGCTTGGTGAGA
CTGAGGAAGCTTATAGGTCACTAGCCAAGGCAGCAGAGATACTGCGAATTACTCATGGAACAAACACTAAGTTCATGAA
GGAGCTTTTTGTGAAGTTAGAAGAAGCTCATGCAGAGTTCTCATACAAGATTCCTCCAAGGAAGAAGAGGATGATTGA
ACTGCATCCGCAGATGCACATTACCTTTGTAGACAACAGATATAAAATTCCATTTCACCAGTTCGACAAAGGGCGGCCC
CTCTTTCCTAATTATTACAATGAAAAGTTTCTAGTGAGATGCTGATCTCCCTTTCCTACTGTCTACTTTTGATGGAAGT
TGAGGTTACTGTTGTGAGAGAAAATAGGCTATCATGGCAGNTTCTTCTATCTTATATAAGAGACTTAGAGTTTTGATAT
TCGGAAAGGGGTGCAAGGCATGGTTCATTGGAAGCTGTAAATAGCTAGAATTTGTGGCGTTCATTGCATT > SEQ ID NO:1136 49059 *Nicotiana benthamiana*
GGCATTACGGCCGGGGGGTCTTGTGGCTATAGCATTGCGCAGCAGGCTGCTCTTTTCCACAGCATGAAATCACTCTTT
ATGAACAAACCCTTGATGATCGTGTGCAACAAAACGGACTTGCAGCCGTTAGAAGGGATTTCTGAGGAAGACAAGAAGT
TAGTCGCAGAGATGAAAGATGAAGCCATGAAGACAGTGATGGGTCAAGGTGGCGAGGCAACAGATGAAGCAGGTGTGTT
GTTAACTATGAGCACGTTGACCGAAGATGGCGTGATTTCAGTGAAGAATGCAGCTTGTGAAAGGTTACTGAATCAGAGG
GTGGAATTGAAAATGAAGTCGAAAAGTTGAATGACTGCTTGAACCGCTTCCATGTTGCTATGCCAAAACCACGTGACC
AGAAAGAG

FIG. 1 continued

> SEQ ID NO:1137 49145 *Nicotiana benthamiana*
GGCCATTACGGCCGGGAAGCCTAAAGGTGGATTAAAGGAGGCATTGAAAGTTGACCCTAATAAAGTAAGACGACTAAGT
TTAAGTGAACAGGCTCTCGAAAAGGCTGCCGAATCTCATGGGATGGAAATTGTGAGGTTCACGCAAAGAAACATTTTAA
GGGTGTATCCTAAAGGTACTAGGTTTAACTCATCCAACTACAAGCCACTAATTGGTTGGATGCATGGAGCTCAGATGGT
TGCATTTAACATGCAGGGATACGGTAGAGCGCTATGGTTGATGCATGGGATGTTCAGGTCAAATGGAGGCTGTGGTTAT
GTTAAAAAGCCCGATTTCTTGCTGAATGTTGGCCCTAATAGTGAAGTTTTTGATCCTA > SEQ ID NO:1138 49360 *Nicotiana benthamiana*
GGCCATTACGGCCGGGCCAACTCTCACCGACCAGTTCGCTTGATGCAAATTCAAATAGCTTCAGTTTGGAAATTGGTAA
TGGTGAATTTAGTGGAGCTGAATTGAAGAAAATTATGGCAAATGAGAAACTTGCAGAGATAGCCTTAGCAGATCCAAAG
CGGGCCAAAAGGATTTTAGCCAACCGCCAATCTGCTGCTCGTTCAAAAGAGCGAAAGATGAGATACATTGCGGAGTTAG
AACACAAGGTGCAAACACTGCAGACTGAAGCCACCACATTGTCTGCTCAACTGACACTGTTGCAGAGAGATTCTGCTGG
GCTAACGAGCCAAAACCACGAGCTGAAGTTTCGTTTGCAAGCCATGGAGCAGCAAGCTCAACTCCGTGATGCACTAAAT
GAAGCATTAACTGCTGAAGTACAAC > SEQ ID NO:1139 57145 *Nicotiana benthamiana*
CAACAGGCCAGAGAGAAGAAAGAAGAGAAAAATATGGGCGGATTGAGAGGCGGCGCAAATTGTTTTCCAGGAGGATGGG
GTGCGGCGGCAGTAGCAAAACCATGCGAGTATTGCCACTTAGACGCCGCACTCGTGTTCTGTCGAGTAGACAACATGTT
CATGTGCTTGGTCTGCGACACGAGGGTGCACCGAAACGCCCGCCACGAACGTGTATGGATGTGCGAGGTTTGCGAGCAG
GCAGCGGCTAGTGTCACGTGCAAGGCTGAC > SEQ ID NO:1140 57165 *Nicotiana benthamiana*
CGGACGCGTGGGAAAATTTTCTCCTCAGCTCTCTGTTTTGATCCGTCATCAAATCTTCTGAGGAATAATGAGTCGTTCA
AGTAGGACAATTTATGTTGGTAATCTTCCTGGTGATATTCGTGAGCGAGAAGTTGAGGATCTGTTCTACAAGTACGGCC
CGATAGCTCATATTGATCTGAAAGTTCCACCAAGACCCCCGGGTTATGCTTTTGTTGAGTTTGAAGAGGCTCGCGATGC
TGATGATGCTATTCGTGGGCGTGATGGCTATGATTTTGATGGGCATCGCTTGAGGGTTGAACTTGCACATGGTGGGCGT
GGTAACTCATCAGCAAATGATCGTTATAGTGGCAATAGTAGCGGTCGTAATCACAAATTTGGAGCTCCCAAACGTACCG
AGTATCGAGTATTAGTTACCGGATTGCCCCATTCAGCATCCTGGCAGGATCTTAAGGATCACATGCGTCGAGCTGGGGA
TGTTTGTTTCTCACAAGTTTTCCGTGAGGGTGGTGGAACCACTGGGATTGTGGATTATACTAACCGCGACGACATGAAA
TATGCTATCAAAAAACTTGATGAATCTGAGTTCCGGAATGCTTTTTCTCGTTCGACGATTCGCGTG > SEQ ID NO:1141 57292 *Nicotiana benthamiana*
AAATAATGGGAAGAGGAAGAGTTGAACTAAAGAGGATAGAGAACAAAATAAACAGGCAAGTTACTTTTGCAAAGAGAAG
AAATGGACTTCTCAAAAAAGCTTATGAACTTTCAGTTTTATGTGATGCTGAAGTTGCTCTTATCATCTTCTCTAGCCGT
GGCAAACTCTATGAATTTTGCAGCACTTCTAGCATGATGCAAACACTTGAAAAGTATCAACAATGCAGCTACGCCTCTT
TGGACCCAATGCAATCAGCTAGCGATCATACTCGGAACAATTACCATGAGTATCTGAGGCTAAAAGCTAGAGTTGAGCT
TCTTCAACGATCTCAGAGAAATCTTCTTGGGGAGGACTTGGGCACACTAAA > SEQ ID NO:1142 57319 *Nicotiana benthamiana*
caaggccaaaggcagtgtttaacttatggttaatactgcaggataggctgcctaccaaagtTCGAGTGAAACAATGGAA
TTCAAACATTGACAGCATGTGCATTCTGTGTCAACAATGGGAAGAATCAAGAAATCATCTCTTCTATCATTGTCCTTTC
ACTACCATGATGATGCATCAAGCAATGGGTTGGATAGGAGTTACTCAGCCTACATTTCAATCTTGGGATCGATTCATAC
AATGGGTTGTAGCCAAGGCTAAGGGAAGGACTGCACGAGCTCATGCTATGAAGCTGATATTTGCAGAAGTTTGCTACTG
TGTTTGGCTTGAAAGAAACTCCAGAATATTCACAAATATGTCAAAGTGTGTTAGCCAATTGCTTAGAAATACTGCCTAC
ATTTGTCATGTTAGAAGTCATATTGAGTTTAGCCTACAATTTCAACAGGTTCAATGTAATTAGAAATGGAGGTATAGTA
TAGGAGTAGGAGAGGAGCTTCTTATTGATAATTAGCTGTGCTAGCTGATTATGGATTTGTAATGACTTATCATTGGTGA
TTAATAAAAGAAAGTTAATTACc > SEQ ID NO:1143 57374 Contig A *Nicotiana benthamiana*
CCCACGCGTCCGGTGGCAATGTTGGATATTCCTGGCTACCAGGAAGTGCGTGATCCTGCTGATCAGCACGGAGAGATGC
GTATGGACGTAGATCACATGTCTTATGAGGAGCTTCTTGCATTGGGAGAGCAGATTGGAACTGTAAAAACCGGTTTATC
AGAGGAGGTCATTGTTAGCCATTTGAAAACAAGATCATTTTCATCATCGGTAACTCCTTGCAATTTGGAAAGGGCTGCA
TGTTCGGATCACAAGACTGATTTCTGTGTCATATGCCAGTCTGATTACGATGATCAAGAGAGCATTGGGACACTCAAGT

FIG. 1 continued

```
GCGGACATGAGTATCATGCAGATTGCGTAAAGAAATGGTTGATTATGAAGAACAATTGTCCCATCTGCAAGTCCACAGC
ATTGTTGACGGAAGGAAAGGATTTGTGAAAGCAAGTGATAGATGGTCACTGGATCTATCATTAAAAAGAACGATGATTT
TTGTTTTCTTGCTAAGTATTTATTTGCGTTCCTGAAACTGTACTATATGTTTGTACATACTCTACAGGGTATGGCGAAT
GGTCAACCTGTCCAGAAACATCTTTATTGGCGCTATATCTATCGCCTGAAATTGTACAGAAACCTCTAACTTTTGTCTG
TCGCCTGAAGTTG
```

> SEQ ID NO:1144 57374 Contig B Nicotiana benthamiana
```
TCGCCCACGCGTTCGGTGGCAATGTTGGATATTCCTGGCTTCCATGAAGTGCGTGATCCTGCTGATCAGCACGGAGAGA
TG
```

> SEQ ID NO:1145 57506 Nicotiana benthamiana
```
gccattacggccgggGGGCTCTTTCTTTGACCAATgTTCTTCATTTTGCTTCTCCTCTTGAACTGAAAAATTCATTGTA
TTGTGACAATTGGTTGAAGAAGGAGTACCACAGTGGGGTTGGGATGTTTGGGTCTGGAATGAATTTGATAACCACAATA
ATTGGTTTTGGAATGAGTGCAACTTTTATTGTGTTTGTGTGTATAAGACTGATTTGTGGGAGGATAAGCAGGAGACAAT
CAAGGCAAATGTTTGAGATTGAATCAGGGATTGATCTTGAAATGCCAGAGCATCGAATTAATGGGCTTGACTCAGTTGT
GGTTGCTGCAATTCCCACCATGAAATTTCATCGCGATGCTTTCACCTCCTCGGAAGATACACAGTGCAGTATATGTTTA
TCGGAGTACCAGGAGAACGAAGTTCTGAGAATTATGCCCAAATGTGGCCATAATTTTCATCTTTCATGCATTGATATAT
GGCTAaggAAACAGTCTACCTGTCCAGTTTGCCgtCTTTCTGTACCTGAATCCATTGAAAATAAACaaaggcGTCCtcc
aATGCTTGGCAggGATCGaaACtcTGATAGttCTgagatttcAGttgagcATTcaaggcAATggctgctACCTATtgcT
GAaCagtcgcagggTACtgtaaGTaaCAG
```

> SEQ ID NO:1146 103896 Nicotiana benthamiana
```
ATCGAACATAGGTTTCCGATTATCGCCAAACAACTGATATAGGGGATCACACAAAGGTGTATACAGCTTCTTGGTGATA
AACAGACAACATGCCGGCCACAGCAGGTAGGGTTCGCATGCCTGCGAACAACAGTGTTCACAGTACTGCAGCCCTACAG
ACGCACGGCATCTGGCAGAGTGCTATTGGTTATGATCCATATGCTCCTAGCAAGGAGGACGACACGAAATCTACCCAGA
AGGCGTCAGCAGCTGATCCTGAAAATGCTTATGCGAGCTTTCAAGGTTTGCTTGCACTTGCCCGGATCACGGGATCCAA
CGCTGATGAAACTCGAGGAGCGTGCAAGAGGTGTGGGCGGGTAGGCCACCTCACTTTCCAGTGTAAGAATTTTGTGAGT
GTTAAGGATGATAACAAGGATAAGGATCCGGAGGCGATTGAGGCTGCTGTGTTGTCTGGATTGGAGAAGATCAAGGGGT
CTAAGATAAAGGGAAAAGCAGAAAATGAGGAGAGC
```

> SEQ ID NO:1147 104005 Nicotiana benthamiana
```
AATCAATTGACCCATTTGCAACAGTCATGGGACCTGAACATTGAGGTCGCGTAAATTTGTATGGTCGTGGGGTTACAAA
GACTATCTTGAAACAAAAATCTAGAAATTCTAGACCCTCTTCAAAGACTACTGATAATATAATGGAGCAAAAACTAAAG
GAAATGGAAGAGAGAAGGCAACAAAGGATGCAGAAAAATTTCGAGGAACGACAGGAAACTTGGTGGCAAAAAATTACAC
TTAATGTTGTTGCACAACTTCAGCATATTAACCCAGATTTACGAATTGATCCTAATATGCTAGCATTTGGTGATTGTTC
ACTCGGAGAAGCTTCCTATGCACAACAAGATTCAATTCAACTAATCAATCGTCCATCTACGTGCAGTACTAATCAAGGT
GTTTACTTAATTATTGCAAAATATTGCATCTCCTTCTCTTTCTTCTTCTTCTTCTTTTTCTTCTTCACCACTTCTTCTT
CTTCTTCTTCTTCTTCTTCTTCTTCTTCTTCTTCTTCTTCTTC
```

> SEQ ID NO:1148 108274 Nicotiana benthamiana
```
GAGGCCGTTAACAAGATGCGGGAGGTTGAGGGGAAGCTTTTATCTGTGGATACCTATTATTCAGGCGTTGCTTCAGAAG
CAGTCAAGAATGGAGTTCATCTTGTAAACGATGTATCTGGTGGACGGTTGGATTCCAACATGCACAGTGTCATTGCAGC
ACTTCGAGTACCCTTTATAGCAATGCATATGAGAGGTGATCCGTCTTCAATGCAAAATCCCAAGAACTTGCAGTACAAC
GATGTCTATAAGGATGTGGCATTTGAACTTTATGAGAGGCTCAAGGAAGCAGAGTTAGCCGGTATCCCTGCTTGGAGGC
TAATACTTGATCCAGGAATCGGATTCTCCAAAAATACTGAACACAATTTGGATATTCTAACGGGTTTGCCAACAATTCG
AAGTGAGATTGCAAGGAGGAACTTGGCGTTGTCTCGTGCACCTTTCTTGATTGGACCGTCCAGAAAGAGATTCCTAGGC
GAAGTCTGTGCTCGCCCTGCTGCAGATGAACGAGATCCAGCAACTGTTGCAGCTGTGAC
```

> SEQ ID NO:1149 108496 Nicotiana benthamiana
```
GGAAATATTATTGGGAGAGAGGGGAAATTTCACCTTTGGTTTGACCCCACTCAAGCTTACCACAATTATGCTATCCTTT
GGGATCCCAATGAGATCATATTTTTTGTCGACGATGTTCCAATCAGAAGATACCCTAGGAAAAATGATGCTACATTTCC
ACAAAGACCTATGTATGTGTATGGTTCCATTTGGGATGCTTCATCTTGGGCAACAGAGGAAGGAAGAATTAAAGCCGAT
TATCGGTACCAACCATTCGTCGGAAAATATAACAATTTTAAAATTGCTGGTTGCACTGCTAACGAGAACCCTTGGTGCG
GACGCTCGCCCTCCAGCTCTCCGTCTAGAGCTGGTGGGCTGAGCCGCCAGCAGATAGCGGCCATGCTATGGGTGCAGAG
```

FIG. 1 continued

GAACTATAAGGTGTATGATTACTGTCGGGACCCCAGGAGAGACCATACCCACACTCCTGAGTGTTAGTACAATTCGTAA
AAAATGCATTATTTGCATAAAATTTCATACTGTTAGTGAATATAAGCTGAAATCACGAATAAGAGGAATGAAACGTGTA
AAGGAATATTTGGTCATTTCACCAGAATTGACTTTCAATTGTACTTTATCTTTGAGTAAATGTTTTTTGTTTTTTAAT

> SEQ ID NO:1150 109562 Nicotiana benthamiana
TTGAGAAGGAGGTTCCTGCCGATGAAGACGAGTCTAGTGATGAAAAGGAAACATCTGAAACCAGTCCTGAATAATAAGA
TGGAGATGAATATGATTCTGAGACGGCAGAAGATGAAGATGATTCTGAGAAGGCAGAAGATGAGAAGAAGCCTAGAACT
AACAAGGTGAAGGAAACCACTTATGAGTGGGAGCTTTTGAATGATGCGAAAGCTATATGGCTTCGGAATCCAAACGAGG
TGACAGAGGTAGAGTATACACAATTCTATCACTCACTTGCTAAGGACTTGAGTGATGAGAAGCCCCTTGCTTGGAGTCA
CTTTAATGCTGAAGGCGATGTTGAGTTCAAGGCTGTACTATTTGTTCCTCCTAAGGCTCCTCATGATTTATATGAGAGC
TACTACAACTCCAAGAAATCCAACTTGAAGTTATATGTCAGACGGGTCTTTATCTCTGATGAATTTGACGAATTGCTGC
CCAAGTACTTGAGGTTCCTAATGGGTCTTGTTGATTCTGACACCTTACCCCTCAATGTCTCAAGAGAAATGCTTCAGCA
GCACAGCAGCTTGAAGACAATT > SEQ ID NO:1151 111048 Nicotiana benthamiana
CAGGCGTCTCTCTCGTATCTGAGTTCAAGTTCCGGCAGTGGATGCGGCAAATTCAAATTTAGATGTTATGCAATAGCTA
CGCAAGTGTATATACAGCAAGGAGAACGATGATGGTGGATACTGGTGCAACTGCTAAAGGAGGACCTGTCGTTGATGTT
TCACCGGAGAAGGATGATAATAATGGTGGTTTCGCTAGCGGAGGATGGAAGAGTGAAGATGGAAGACTGAGTTGTGGTT
ATTCAAGCTTTAGAGGGAAAAGAGCAACCATGGAGGATTTTTATGGCATTAAAACTTCCAAAGTTGATGGACAAACAGT
TTGCTTATTTGGGATATTTGATGGCCATGGGGTTCCCGAGCAGCTGAGTTTCTGAAGAAACATCTCTTTGAGAATCTAA
TGAAACATCCAGAGTTCCCAACAAACACCAAGTTGGCCATAAGTGAAACATATCAACAAACAGACATGGACTTCTTAGA
TTCTGAAAAAGATACCTTCCGAGATGATGGTTCCACTGCTTCAACAGCAGTTCTAGTTGGTAACCATCTCTATGTTGCC
AATGTTGGAGATTCGCGAACTATAATATCG > SEQ ID NO:1152 111490 Nicotiana benthamiana
TGGAGCTATCTTTCAGGGGGAAAGGGTTTCATATCAGAGGAATGAGTTTCTGTAAATGATGGAATGGGGCGAACTAAAA
ATGGATTTATGGTTTGGGAATTGAAAACCCCTAGCAGCTATGTTATGTGCTCAAGTCAACAAGGTAGTACTAGTAACCA
AGGATTTCCTGAATTGGGTTCTCAAAATTTGATGAGAAAAACTATGTACAGTGACCAAAGTATTTTTGGTTCAGTGGCA
GCTAGTCCTAGTGCAGCATATTCTGGGGAAAATAAATCTAAGTCTAGTTCCAAGTTATCAAGCTCAGTTGTGGAATCAA
ACTCTAAAGATTCATCACTGATTGATTTGAAGCTTGGAAGATTTCCTGATCAAATAGATGCAAATGTTTACAAATCTCC
CAAGATTATGCCTAATGTCTCTTGTGCTGAGTCCATTGTTCCAGCCAAGAGAATGAGAGCAGGAGGTGTGAATTCCTAT
CCATTTTGTCAGGTTCAAGGTTGTGGGAAGGATCTCAGCTCTTGTAAGGATTATCACA > SEQ ID NO:1153 113072 Nicotiana benthamiana
CTTTTTTCTGAATTCTGTTTGTAGCCATGGCAGAAGTAGAGGCTACGAAAGTGGAGACTGAGAAAGTTGTGGACCCTAC
TCCCCCTGCACCTGAGGCTCCTGCACCTGTTAAAGAAGCAGAACCTGTTGTTGAAACTCCTAAAGAAGTGGCTGATGAG
AAAGCTATAGTTGCACCAGCTCTGCCTCCTCCTGAACAAGTCAAAGAAAAATCCGATGATTCTAAAGCACTAGTTGTCG
TTGAAGATAAACCTGCTGAGGAGAAAAAGGAGGGATCTATTGACAGAGATGCTGTGCTTGCTCGAGTTGCAACAGAGAA
GAGACTGTCACTAATCAAAGCATGGAGGAAAGTGAGAAATCAAAAGCCGAAACAAAGCTCAGAAAATGTATCAGCA
ATTGCTGCATGGGAGAATAGTAAGAAAGCAAACCTGGAGGCTGAGCTAAAAAAGATGGAGGAGCAGGTGGAGAAAAAGA
AGGCAGAATATATTGAGAAAATGAAAAACAAATCGCTCTACTCCACAAGGAAGCAGAGGAAAAGAGAGCGATGATTGA
AGCTAAACGTGGAGAAGATCTTCTTAAGGCAGAGGAATTGGCAGCAAAATACCGCGCCACTGGAACTGCTCCAAAGAAA
CTCCTTGGATGTTTTTG > SEQ ID NO:1154 120624 Nicotiana benthamiana
GGAAACTACCTAAGCACAATAATGTATCATGGAGGGGGAGTGGAGGTATGCAAGACGGCAAATCTGATGATTCAACCAT
GTTAAGAATTTGGTTGGTGGCTATTATGATGCAGGAGATGCAATAAAGGTTAACTTCCCTCAATCTTTTGCTCTCACT
ATGTTAAGTTGGAGGGGGATTGAGTATAGGGCAAAATATGAAGCTGCTGGGGAGCTCTCATGTCAAAGATATTATTAAG
GGGGGTACTGATTACCTCCTCAAAACCTTCAATTCCTCTGCTGATACTATTGATCGCATTGTTGCACAGGTGGGGAAAG
GGGATACTTCAGGAGGGCCAGATCCCAAT > SEQ ID NO:1155 20072 Nicotiana benthamiana
CGGACGCGTGGGCGGACGCGTGGGCGAAAATCCTAGCGCCTTCAGCAGCAGTTGGTTTGTGAAATGGCCAAGTCCAAAA
ATCACACAGCTCACAACCAGTCGTACAAGGCCCACAGGAATGGCATCAAGAAGCCAAGAAAGCACCGCCATTCATCTAC

FIG. 1 continued

CAAAGGGATGGATCCTAAGTTCTTGAGGAACCAGAGATATGCTAGGAAGCACAACAACAATAAGAGTGGTGGATCTGCC
GATGAAGAGTAAACAAATCACTTAAAAGTAACCATGGCTAGCACTTCTTTTTGAATTTGGGATTTTTTTTCTT

> SEQ ID NO:1156 42023 Contig A *Nicotiana benthamiana*
GGCGGAAAAAGGAGGAAAAGGGTTTTCTCTACCAAAAAATGGAAAGTCTGCCCTCAAATCTCCTGCATCCAAAGGGAAG
GATGATATCTCAGCAAAATCGAAAAGAGGAAGGAA > SEQ ID NO:1157 42023 Contig B *Nicotiana benthamiana*
GGCGGAAAAAGGAGGAAAAGGGTTTTCTCTACCAAAAAATGGAAAGTCTGCCCTCAAATCTCCTGCATCCAAAGGGAAG
GATGATATCTCAGCAAAATCGAAAAGAGGAAGGAA > SEQ ID NO:1158 43449 Contig A *Nicotiana benthamiana*
CGAGAAACTAGCCGCAGAAAATGTTCAGTCCCTCTTGGAAGAGAAAAACAAACTTATAAATGAGTTGGAGAACTCCAGG
GAGGAGGAAGAGAAAAGTAAGAAGGCGATGGAAAGTTTGGCATCGGCATTACATGAAGTTTCTTCAGAAGCAAGAGAAG
CCAAAGAGAGGTGGTTGTCTAGCCAAGCTGAACATGAACATTACGAAACACAAATAGAAGACTTGAAGTTAGTATTGAA
AGCAACCAATGAAAAGTACGAAAGCCTGCTTGATGAAGCGAAAGAGAAAATTGATGATCTCACTAATTCAGTCGAACAA
TCTAAGAATGAGCACCAAATTTCGAAGGCTGAGTGGGAGGACAAGGAGCTTTATCTGATGAATTATGTAAAGAAAACTG
AAGAAGAAAACTCTTCAATGGAAAAAGAAATAAACCGATTGGTAAATTTGCTAAAAGAGGCTGAGCAAGAAGCTTCTTT
CGAAGAGGAAGCAGTTCAGTTGAAGAATTCCCTGAACGAAGCTGAATCTGAGGTGACCTATCTGAAAGAGGTTCTTGGT
GAAGCAAAGGGTGAGAGCATGAAGTTGAAGGAGTCGCTGTTGGACAAGGAAAATGAAGTGCAGAATATTCTTC > SEQ ID NO:1159 43449 Contig B *Nicotiana benthamiana*
TTACAATGATAATGGCTTTTTAGAAGAACTATTATCTCTAAGAAATGACTCATGGGATACTACTACAACACTTGTTCCT
ATGGAAATGACAGATTTTTACAACTTTGAATCTTTAAACTCTCTTGATATTCCACTTCCTTGTGCTTCTACTACTATTA
CTACCTCTAATTCCTTTGAAGACTACTCATATGAT > SEQ ID NO:1160 44526 *Nicotiana benthamiana*
aaatcccattgagacaacgtataaattacaacaaaaatcatcactggcaacggcaaataaacaaactaattcctacttc
tCTACTTGTTCCAAATTTATCAAAAGCTTTGGAAGGCCAAATCCGCCTCCTTTTTTGGATTGCCAAAACCATGCCACAT
CTAagaGGCAAAACAACATGAATTCGtaCTgTtCAATTTCATGAACAATTTTATACTCTACAAAAGCATCTTACTTCtG
gGGGAATCTATGTAGATGCTTTATCTTGGCCATGTTTTTCTGTGACCACATTTTCTGCGCTTATTAGTTTCTCTGGCTG
ATGCTTCTCAAGAAAAGCTTGTTTCTGCAAGATATTCATCATCTCCTTTGTTCTATTCTCCTCTCCTTCAAGCTGCATT
TTCACTATTGCTTCTGCTTCCTTATTTATTGGTTTGAAGTAGTCATCAACAGCAGCCTCAGTCTCCTCTAGCTTCTTCT
TCAAAGCTTGCATCTCTTCCACCATTCGCCTAACTTCTGACAATATCATCTGTTCAGGAACCTTCCTTATTGCTGCCTT
CCTCTCCTCCGCCTGTTTAAGGCGTTGTTGCATCTGTAATCGATAAGATCGGATTCGACGCTCTTCGTAGCCTGAAAGA
ACCCTAATATAGAACATTGCTTTCCTCCCAAATTCTAGAAGCTTCTTCATCCTAGGTAATCAAGTTTCAGTTTCCAATA
TTATATCCAGAAAGCGTGAAACGATTAGCAGCTTTATTTTCTTCACGTTTGAAGAATTGGATTCATAGTCGAGCTGAAG
CTGAAGAAGCCtcgctttcagttgttgctcggctgcgtttcgtgcctgctccctttcttcgttcttttttttcttcccc
ggccgtaatggc > SEQ ID NO:1161 52817 *Arabidopsis thaliana*
CCCACGCGTCCGAAAATATCCCAAAACCAAAAACAGAGGAAGAAAGAAGAAGAAAAGATGCCTTCAAGCACATTCTCCG
GGACTGTTAGCACGCCGAAGCTGTCGGTGGCAGTGGACATGGGAAACCCTTTTCTCAATCTCACCGTTGATGCCTTCCT
CAAGATCGGAGCTGTTGGAGTCACTAAATCTCTTGCAGAAGACACTTACAAGGCCATCGAGAAAGGGAGTCTCTCCAAG
AGCACTTTGGAGCATGCGCTTAAGAAGTTGTGTAAAGAAGGTGTTTACTGGGGAGCTGCTGGTGGAGTGTACATTGGAA
CAGAATACGGAATCGAACGTATCCGTGGCAGCAGAGATTGGAAAAACGCAATGTTAGCAGGCGCGGCGACAGGAGCAGT
GCTCTCAGCGGTTGGTAAGAAAGGCAAAGACACTATTGTGATCGATGCCATTCTTGGTGGCGCGCTTGCAACCGCTTCT
CAGTTCGTTAACAATCATTATTTCTACTGATTCTCCATCTTCCTTTAGGGACCAATTTGGTTCATATGGTGTGGATTCC
TTTGTTTACTCTTTAAATAATAATAAAAAACAATGTAGTGTTTTTGAAATGAATACATTCGAGTATTGTTGACGTTA > SEQ ID NO:1162 53376 *Arabidopsis thaliana*
cccacgcgtccgcattttcCATCTTCCTCATCACCTTCCCAAGAAGAAGAACACCAAAGAAGAAGAAAGGTTAATAAT
GATGGGCAGTGTCGAGCTGAATCTGAGGGAGACTGAGCTGTGTCTTGGTCTTCCCGGTGGAGATACAGTGGCTCCGGTA
ACCGGAAACAAGAGAGGGTTCTCAGAGACGGTTGATCTGAAGCTAAATCTGAATAATGAGCCTGCAAACAAGGAAGGAT

FIG. 1 continued

```
CTACGACTCATGACGTCGTGACTTTTGATTCCAAGGAGAAGAGTGCTTGTCCTAAAGATCCAGCCAAACCTCCGGCCAA
GGCACAAGTTGTGGGATGGCCACCGGTGAGATCATACCGGAAGAACGTGATGGTTTCCTGCCAAAAATCAAGCGGTGGC
CCGGAGGCGGCGGCGTTCGTGAAGGTATCAATGGACGGAGCACCGTACTTGAGGAAAATCGATTTGAGGATGTATAAAA
GCTACGATGAGCTTTCTAATGCTTTGTCCAACATGTTCAGCTCTTTTACCATGGGCAAACATGGAGGAGAAGAAGGAAT
GATAGACTTCATGAATGAGAGGAAATTGATGGATTTGGTGAATAGCTGGGACTATGTTCCCTCTTATGAAGACAAAGAC
GGTGATTGGATGCTCGTCGGCGACGTTCCTTGGCCAATGTTCGTCGATACATGCAAGCGTTTACGTCTCATGAAAGGAT
CGGATGCCATTGGTCTCGCTCCGAGGGCGATGGAGAAGTGCAAGAGCAGAGCTTGAAGTCAAATTAAAAGGATAAGTGG
TATCGATTATATATTTGATTAACACATTGATTGGTGTTAATTGCTCTTTTTTTTCTTACGATGAAATAcattgTTCAGT
TTCTTTTGATTGTCTGTGTTTTGATC > SEQ ID NO:1163  57142 Contig A  Nicotiana benthamiana
TAGCTTCTCATTTCACCATTTTCTTAACATCCCCTACATTTCAATTAGTTTTTTATATGACTATTTGGGATATAATTAT
ATCAAAATTATAAGCACGGGGCTTGTCAGCACTAGCAATGGCTCATATTAAGATGTTGATATGGGCA > SEQ ID NO:1164  57142 Contig B  Nicotiana benthamiana
TCCGAAGGAAAGGAGGTGTTGTACGACTATGAAGATAAAATTAAGGAGGCAGTCTTTCCTGGACTTCAAGGTGGTCCTC
ACAATCATACAATTACTGGCTTGGCAGTTGCTTTGAAACAGGCAATGACTCCAGAATACAAAGCTTACCAAGAGCAATG
CCTTAGCAACTGCTCAAAATTTGCCCAGGCGTTAGCGGGAATGGGTTATGAACTTGTTTCTGGTGGAACAGAGAATCAC
TTGGTCTTGGTGAACTTGAAAAACAAGGGTATTGATGGCTCTAGGGTTGAAAAAGTTTTGGAAGCGGTACATATTGCAG
CCAATAAGAACACTGTTCCTGGAGATGTATCTGCCATGGTCCCTGGTGGCATCAGAATGGGGACTCCTGCACTCACATC
AAGGGGATTTATTGAGGAAGATTTTGTGAAAGTTGCTGAATTCTTTGATGCTGCTGTGAAGATAGCAGTGAAAATAAAG
GGTGAAGCTCAAGGAACAAAGTTGAAAGACTTTGTGACAACACTGCAGTCTAGTGCTTCCATCCAGTCGGAGATTGCAA
AACTCCGCCATGGTGTGGAGGAGTATGCAAAGCAGTTCCCTACAATTGGGTTTGA > SEQ ID NO:1165  57744  Nicotiana benthamiana
GCCATTACGGCCGGGATAACTAGAGAGAAAAATGGCTTTGAGAATGTGGGCTTCTTCAACAGCCAATGCATTGAGAGTT
TCCACTGCCTCAAGAGCTAATCTTTCCCCTGCTTATTCACTCTCTAGATGCTTTTCCACTGTTCTTGATGGGTTGAAGT
ATGCATCTTCACATGAATGGGTGAAGCATGAGGGCTCAGTGGCAACAGTTGGAATCACTGACCATGCTCAGGGTCATCT
TGGAGAAGTGGTGTTTGTGGATCTACCAGAAACTGGTgCTGCTGTTTCACAAGGAAGCAGTTTTGGTGCTGtTGAAAGT
GTGAAAGCTACCAGTGACATTAACTGTCCAATCTCGGacgacatcggtGaggtCAAtacaaAgctaaCTGaAacACCTG
GTTTGgttaaTTcgagtcCATATGAAGAcggctggaTGATTAAgGCGAAGCCGAGCagtccATCCGaGctagAAtcatT
GATGGGGTccAAagagtaCACaaAATTCTg > SEQ ID NO:3703  213858  Trichoderma harzianum
AGACGGGAAAGCCGCTGGAGGTTGGTACTTCCTTTGATATAGTCGCTTTTTTTTTTCGCTGTAAATCTTTCGGATTACA
CTATATCATCATGAAGTTTCACGCAACTGCCCTTACACTTGCATATTTGGCAAACTATGCTTCGGCAGCAGTGGCCCAG
CCGAGGAGTGAAGCAAACGAGTCTGCTACTCCCGAAGGCAAGACGTTCTCCATCTCTCAAGTATATAACGAACAGTACA
AAGCAACCAATGTCCCCGCCACCTACATTGCAGCTCTGGCAAAATATAGCCCCCAGCTCCCAGAGCACATCAAACATGT
GATCATGGCCAATCCGGATCTGCACCGCAGATTTGGCTCTCTTCTTGATGCTGGTAATCAGACGGGCACTGCCGTTGCC
ACACCATCTCCGGGAGCCGATTCGGAATATGTTATTCCCATCAAGATTGGCACACCCCCTCAAACCGTGCCAATAAACC
TTGATACCGGTTCATCAGACCTTTGGGTCTTCTCGACAGACACGTATCCGTCCCAAGTCCAAGGCCAGGCGATTTACAA
CCCCGGTGCCTCAAACACCAGCTCACGCCAGAACG > SEQ ID NO:3704  213781  Trichoderma harzianum
GCATCATCAAAGCGAACAAGCTCAGTTGATGCCTCGAGACAGCGGCAGAAACCGACAACACGAACCCCAAACTCGAATT
CGAGCGCAAACCAGAGCACAGGAAGAGGGCACATGTCGAACCCAAACAACTGGCAGGAGGAGGCGATGCGGCGTCTGCG
CCAGATGCAGACGCGGGGCGGGTATCCCGGACGAGGAGGACCGCAGATGCCCAGAGGAGCAAACGGCGCCT > SEQ ID NO:3705  200705  Saccharomyces cereviseae
GAATTCCAGCTGACCACCATGGCTTCTAGAGTGGACGAAACTACRGTCCCCTCATACTACTATTACGTGGATCCGGAAA
CTACATATACGTACCAACAACCAAATCCTCTACAGGACTTGATATCGGTGTATGGCTTGGATGACATCTCCAGGCAAGT
GGCAAGAACAAATTTGGACGGCACTAAAGCCGTGAANTANNAAAATCTTACAAGAACCAGATANCAGATCTTTCAGGTA
AATTCTCCACCATACCGACCAGAGAAAATGGTAAAGGTGGTCAAATAGCACATATTCTTTTCCAAAATAACCCAGACAT
GATGATACAACCACCTCAGCAGGGTCAAAACATGTCAGAGCGACAATGGCGCGGACAGCTGCGCAAT
```

FIG. 1 continued

> SEQ ID NO:3706 200704 *Saccharomyces cereviseae*
GAATCCCAGCTGACCACCATGGTCAATAGTAAGAGGCAGCAGAGAGAAGCAAGAAAGTATCGTCATCCTCCAAAGTGCCCC
CCACCAAGGGGAGGACATTTACTGGGCGCTGGGCATGCATATTCAAGAAACGCAGATGCGACGATAATAGACCAATCTG
TTCACTGTGTGCCAAACATGGAGATAATTGTAGTTACTATATCAGACTTATGTGGTTAGTGGAGAACATCTACAAAGTA
CGCAAGCATTCACTGATCAGTTCATTACAGGCTCGCAAATCGAAATCGAAACCATTGTGCCAGAAAATCTCAAAATCAA
GGTTTAAACAAATGACCCATTTTATACAACTATCACCCCCGACAAGTGACTGCGAAGACAGCGTGCACGATGCAAGTAA
GGAAACTACGCTTCCTAACGGTAATACATTCACCATAAT > SEQ ID NO:3707 200709 *Saccharomyces cereviseae*
GAATTCCAGCTGACCACCATGAACTGTATCACTATTGACGTTTTTTTTACTGCTTTTTCCCATCCCTGCAAGCTAAAAA
AAAAGCAAGCTGACTCTTGTATAAACTGCAAGGACTCATTGATTAAAATTAGATTTACATTACATACTAAAGGAAAAGG
CAAACTATACCGGCTATACCACATTCGTTCAAAAATGCCCTCTACCACGCTACTGTTTCCGCAGAAACATATTATGGCC
ATTCCATGCAAGATATACGCGTTCTTCAGAGAGCTCGTCATCGGAGTTATTATATCCAAGCCAGATCTAAGTCATCATT
ATTCTTGTGAAAATGCGACAAAGGAGGAAGGCAAAGGTGCAGCAGATGAACAAAAGACTACCACAAGTTTGTTTCCCGA
ATCAAATAATATAGACCGCTCTTCAAATGGTGGATGCTCTGTGATCCCTTGCTCCATGGATGTCAGCGATTTGAACACG
CCAATATCGATCACACTATCTCCCG > SEQ ID NO:3708 200749 *Saccharomyces cereviseae*
GAATTCCACCTGACCACCATGAATCTTAGATAAGACGACTTGGGCTACGATAATTCTAAAAATATAGAATCATATACTG
GTAGAATTTTTGACGTATATATACAAAAAGATTCGTATTCACAGTCGGCCTTGGATGATATGTTTCCAGAAGCCGTAGT
TTCAACCGCCGCTTGTGTGAAAAATGAAGCGGAGGATAACATCAATCTCATAGACACGCATCCTCAATTCGAACTGGTA
AATACTGGACTGGGTGCTAAATCGGACGATTTGAAATCTCCATCAGCAAAGGCTACGTTCACTGACAAGCAGAGGAAGA
ATGAAGTACCAACTATATCTGTG > SEQ ID NO:3709 200751 *Saccharomyces cereviseae*
GAATTCCAGCTGACCACCATGTTTACTTCGAAGCCTGCTTTCAAAATTAAGAACAAAGCATCCAAATCATACAGAAACA
CAGCGGTTTCAAAAAAGCTGAAAGAAAAACGTCTAGCTGAGCATGTGAGGCCAAGCTGCTTCAATATTATTCGACCACT
CAAGAAAGATATCCAGATTCCTGTTCCTTCCTCTCGATTTTTAAATAAAATCCAAATTCACAGGATAGCGTCTGGAAGT
CAAAATACTCAGTTTCGACAGTTCAATAAGACATCTATAAAATCTTCAAAGAAATATTTAAACTCATTTATGGCTTTTA
GAGCATATTACTTACAGTTTGGCTCCGGTGTAAAACAAAATGTCTTGTCTTCTCTGCTCGCTGAAGAATGGCACGCGGA
CAAAATGCGGCACGGAATATGGGACTACTTCGCGCAACAGTATAATTTTATAAACCCTGGTTTCGGTTTTGTAGAGTGG
TTGACGAATAATTATGCTGAAGTACGTGGTGACGGATATTGGGAAGATGTGTTTGTACATTTGGCCTTATAGCATGGCA
ATTCCCGGGGATC > SEQ ID NO:3710 200759 Contig A *Saccharomyces cereviseae*
GAATTCCAGCTGACCACCATGATGAATGAAGACATATCCATCATTGATGGCCATAATAGTTTTTTAACGGAAAAAAGCA
CCGTGCTATTAACCCAAGCCAAGAGAACACTAGAAGACGAAAAGGAAATGATTACTCCCCCGAGCTCAACTGTGAGAAA
AACAATGAAGGAAGTAAATAAGAGGCCGTCGCATCCCCTCTCACCGGATCACTCGTCCCCAATTGCTCCATCTAAGGCC
AAGCGCCAAAGATCGGACACATGCGCTCGGTCCAATGGTAACCTAACCTTGGAAGAAATTCTTCAATCTTTGGAAAGAA
GAAGAATAAATGGTGAACTCGCCAAGAAACCTCCATATTCGTATGCAACTTTGATTTGCTTGGCCATTTTGCAATCTCA
GGAGGGAAAGCTAACGCTATCCCAGATATATCATTGGATCCACGTTCACTTCCCTTATTACAAGCAGAAAGATGCTAGT
TGGCAAAATTCAATAAGACATAACTTGTCTTTAAATGATGCGTTCATCAAGACTGAAAAGTCCTGCGATGGTAAGGGTC
ATTTCTGGGAGGTCAGACCGGGTGCCGAAACAAAATTTTT > SEQ ID NO:3711 200759 Contig B *Saccharomyces cereviseae*
GTCAGTTGTGCGCTTCCAAACAGAATAAACATCCACGCCAAACAGCCCGCTTGAAGCAAATTTGGAATTCGTTGCTGCT
TGTGAGTGACATCTGGGTGCAGATGGACTTTCTTGTGTGAAATTTTGGGTTTCCAAATGTGCCC

FIG. 1 continued

> SEQ ID NO:3712 200773 Contig A *Saccharomyces cereviseae*
CTACAGGAGCTGTCTAACCAGAGCACTCTGTAAGTCGCGAGCTTTGACTACTATTTTGCAGTCATCTGTACATTTTGCC
TTGATTATTAATTCGCTGCATAAATCATCTATGTCCAACGATGAATATTTTGGTAGGGAGGAGATCTCTTCGAGAATGT
GGTAGCAAGACGCTTTTCCATTCGATATGGCGCTGCTAATGTGTTCAATTGCTTCAGATTGGGTTCGAATTGTTTTAGT
ATGAGAAGCAGCCACCGGAAGCACCGAAGCTAGAGATTTCTGATTCAACAGGTGGCTTGTTATTAAGTCGCATTTGATC
TCCTTATTTGAACATGGTTTGGTCCCGATACACTTGCGGTTGCCAATATTATTACACTGGCTCCCTACAGCAAGGGGAA
GCACGCTGGGGAATAAAGTATCATCTTCTGTCTCGTATGGAAGATACTTTTGGTCAATTTCACATTGACATGCT > SEQ ID NO:3713 200773 Contig B *Saccharomyces cereviseae*
CCAGCTGACCACCATGGGCAATATCCTTCGGAAAGGTCAGCAAATATATTTAGCAGGTGACATGAAGAAGCAAATGTTG
CTAAATAAAGATGGAACACCTAAGAGGAAGGTGGGCAGACCAGGCAGAAAAGGATTGACTCTGAAGCTAAGAGTAGGA
GGACTGCCCAGAATAGGGCAGCTCAACGAGCGTTCCGAGATAGGAAAGAAGCCAAAATGAAGAGTTTGCAAGAGAGGGT
AGAGTTACTAGAACAGAAAGATGCGCAGAATAAGACTACCACGGACTTTTTACTATGTTCTTTAAAAAGTTTACTGTCG
GAAATTACAAAATATAGAGCTAAGAATTCTGATGATGAAAGAATATTAGCCTTCCTCGATGATCTGCAAGAACAACAGA
AAAGGGAAAACGAAAAAGGAACAAGTACAGCAGTTAGCAAGGCTGCAAAGGAATTGCCATCGCCTAATTCAGATGAAAA
CATGACTGTGAACACAAGTATAGAAGTACAGCCGCACACTCAAGAGAATGAGAAAGTTATGT > SEQ ID NO:3714 200788 *Saccharomyces cereviseae*
GAATTCCAGCTGACCACCATGCACGTTTTCTTTCCTTTGCTTTTCCGCCCTTCCCCTGTTCTGTTCATCGCATGTGCAT
ATATATATATAGATATATATATACATTGTACACGGTGCACGGTAGTGAACATAACTATGAGCACGAACATAGTCCCGAA
CCTCGACCCGGACTTGAATTTAAACAAAGAAATCTGGGACCTGTACTCGAGCGCCCAGAAAATATTGCCCGATTCTAAC
CGTATTTTGAACCTTTCTTGGCGTTTGCATAACCGCACGTCTTTCCATCGAATTAACCGCATAATGCAACATTCTAACT
CTATTATGGACTTCTCCCGCCTCGCCCTTTGCCAGCGGCGTGAACGCCGCTGGCCCAGGCAACAACGACCTCGATGACAC
CGATACTGATAACCAGCAATTCTTCCTTTCAGACATGAACCTCAACGGATCTTCTGTTTTTGAAAATGTGTTTGACGAC
GATGACGATGATGATGACGTGGAGACGCACTCCATTGTGCACTCAGACCTGCTCAACGACATGGACAGCGCTTCCC > SEQ ID NO:3715 200806 *Saccharomyces cereviseae*
GAATTCCAGCTGACCACCATGTATGCAACATCGGGATGGACTTTCCAAACATCTTCGAACGTGACATGGCATTAAGGAA
TTCCAGCTGACCACCATGGATGCAACATCGAGGATGGAGCAGCCTGATGTCTTTGTAAGCAAACTCTACCACCTGCTGC
AGGGGAACGCTTACTCGAACATAATACAATGGTCGACTGATGGCAGCAAGCTCGTCATTTGGAATCCGGACCAGTTCAC
CAAAGTCATCCTAGAGCGATTTTTTGGTATTCACACCTTTGCAGCATTCGTTAAGCAATTGAGCAAATATAACTTCCAG
AAGGCGGGCCGCCCGGACTGCGTGGAGTTTTCCAACATTCACTTTCGAAAAGATAACATTAATAGCCTCTCACTGGTTA
AAGCTCATCAGTCTGCCGCCACTCCCAATGTCGCCGCCGTCAATAATATGAATAAGCAGTGTACTTTTCACTGGGACCC
TTTCAAAGTGAACTCCATTCTAAGCAAGGCCATCGGCAAGCCTTCCTTCGAGAAATTAGTGAAAAATGTTGACAGGCTT
CAGGGCAATCTTGATGAGCTTAAGTCGACAAACGCAG > SEQ ID NO:3716 200818 *Saccharomyces cereviseae*
AATAAATGCCATCATCTCTTCACTGACAGCCCCAGATCAGCCAATTACCGTATCATTACAATATTCCAACGACAAGAAC
ATGGCGACGGAAATACAAGCTTATGCTAAACTCTCCGGACCAAACTGGACCTATTATGTGAATTATTTGGAAGTTTCTA
TTGGTATAAATACTGATCCCTTAAACAGTGCACTACAGGAAAATTCAGATGGTGTAAAAAACACATATAGATTGAATAT
TGATCTCGGACCTGTCAAAGTCGTTTCTATAAAGCACGCCATAATAAAATACAACATGAATATCGGCGGTTGGGAATTG
CACATATTGGGCCGTAACGGCGCTAAAGTAAACTTTCAAAGGACTCATAATGGACCCAACAATCCTCCCAT > SEQ ID NO:3717 200884 Contig A *Saccharomyces cereviseae*
GAATTCCAGCTGACCACCATGAGCAACGAAGTTGACAGGATGGATGTTGATGAAGATGAATCGCAAAATATTGCGCAAA
GCTCAAACCAAAGTGCGCCAGTGGAAACCAAAAAGAAGAGATTTGAAATTAAGAAATGGACCGCAGTGGCGTTTTGGTC
ATGGGATATAGCTGTTGACAACTGTGCTATTTGCAGGAACCATATAATGGAACCATGCATTGAATGCCAGCCAAAGGCC
ATGACGGACACTGATAATGAATGTGTAGCAGCCTGGGGTGTCTGTAATCACGCTTTCCATTTGCACTGTATTAATAAAT
GGATCAAGACAAGAGACGCATGCCCATTAGATAACCAACCTTGGCAGTTAGCAAGATGCGGTAGGTGACATGGCAATTC
CCGGGGATC

FIG. 1 continued

> SEQ ID NO:3718 200884 Contig B *Saccharomyces cereviseae*
GAATTCCAGCTGACCACCATGGCCCGCAATAGATGCGCTTCCTTAACATGGCAATTCCCGGGGATC > SEQ ID NO:3719 200713 *Saccharomyces cereviseae*
GAATTCCAGCTGACCACCATGAAGAACAATAACGAAAGTGAGGCTGAGAACCAACGTCTACTGGACGAATTAATGAACC
AGACAAAAGTCCTCCAGGAAACTTTAGATTTTTCGTTAGTGACACCTACTCCACACCACAATGATGATTACAAGATACA
CGGAAGTGCCTACCCAGGTGGTGAGACTCCTGCCCAACAGCATGAAAAACTCTCATACATCAATACGCACAACTCTAAC
GATAATAATAACTTAATGGGCAGTCAAGCGAGGTCCAATTCACAAACTCCTACAGCTTCGACCATATATGAGGAAGCAG
AATCGCAATCGTCTACCTGGATGATATGTTTAGAACAAGCCAAGGCGGTAGACCTGTCACTCAAAATTCCATATCTTCC
ATAGGGCAGGGTCCCTTGAGATCATCTTATTCTATGGCTTACGACTCACCTGTGGATAGAGCAATGAATACTCCATTAC
AGCAACAAGAAGGCTTAAAAGCTGAGTTACCACATGACTTTTTATTTCAGCATGGCACCGATGACACAATGTATAACTT
AACTGATGATTTGAGCTCCTCTTTATCTTCT > SEQ ID NO:3720 200716 *Saccharomyces cereviseae*
GAATTCCAGCTGACCACCATGTCACCGTGTTATGGACAAAACAGTGCCATCGCCAAGGGGTCTTGGAACAGAGAGGTTT
TACAAGAGGTGCAACCGATTTATCATTGGCACGATTTCGGGCAAAACATGAAAGAATATTCGGCATCACCCTTAGAGGG
GGATTCCAGCCTGCCTTCCAGCCTGCCTTCCAGCACTGAGGACTGTTTACTACTATCATTAGAAAACACAATCACAGTT
ATAGCCGGAAATCAGAGACAGGCTTATGACTCTACGTCGTCTACTGAGGAAGGTACAGCACCTCAATTACGGCCGGATG
AAATAGCGGACAGTACACACTGTATCACGTCATTAGTTGATCCGGAGTTCAGAGATCTTATTAATTATGGACGTCAAAA
AGGAGCAAATCCTGTATTTATTGAGAGCAATACAACAGAACAATCCCATTCACAGTGTATTCTAGGCTATCCCCAAAAA
TCGCACGTGGCACAGCTATATCACGACCCCAAAGTACTCAGCATAATTTCCGAAGGGCAAACAAAAAGAGGAAGTTACC
ACTGTTCTCATTGTTCTGAAAAGTTCGCAACGTTAGTTGAGTTTGGCGCGCACTTAGACGAATTCAACCTTGAAAGACC
GTGTAAGTGTCCCATAGAGCAATGTCCCTGGAAAAT > SEQ ID NO:3721 200733 *Saccharomyces cereviseae*
GAATTCCAGCTGACCACCATGAATTACCTGCGAGATAGATTTCCTCCGGATAATGACCAAAGACCCTTCAGATGTGAAA
TTTGTTCACGAGGTTTCCACAGACTTGAACATAAAAAAAGGCACGGAAGAACGCACACTGGCGAGAAGCCTCACAAATG
TACCGTTCAGGGCTGTCCGAAAAGCTTCAGCCGAAGCGATGAACTAAAAAGACATTTGAGGACACATACTAAAGGCGTC
CAAAGGCGCAGAATAAAATCCAAGGGCTCGCGAAAAACCGTTGTGAATACTGCTACCGCCGCCCCTACCACCTTCAATG
AAAACACTGGTGTTTCGCTCACGGGGATAGGTCAATCTAAAGTGCCACCTATTCTTATCTCCGTTGCTCAGAATTGCGA
TGACGTGAATATACGAAATACTGGAAATAATAATGGCATTGTGGAGACACAGGCACCTGCAATTTTAGTGCCTGTGATA
AATATTCCAAATGACCCTCATCCGATTCCAAGTAGCCTCTCCACTACTTCTATCACCTCCATTGCATCAGTATATCCCT
CTACTTCTCCATTCCAGTACCTGAAAAGCG > SEQ ID NO:3722 200748 *Saccharomyces cereviseae*
GAATTCCAGCTGACCACCATGGTCGTAATTAACGGGGTCAAAGTATGCCTGTGAAACGTGTATCAGGGGTCACAGGGCG
GCGCAGTGTACTCACACTGATGGTCCGCTACAGATGATCAGACGCAAGGGAAGACCATCGACCACATGTGGCCATTGTA
AAGAGCTGAGAAGAACCAAGAACTTCAACCCATCCGGTGGGTGCATGTGTGCCTCTGCACGACGGCCAGCTGTNGCAGC
AAGGAAGATGAAACACGATGTCGTTGTGATGAGGGTGAACCTTGTAAATGTCATACCAAGAGGAAAAGCAGCCGGAAAT
CAAAGGGAGGGTCATGCCACAGAAGGGCAAATGATGAAGCAGCGCATGTCAATGGTCTCGGTATTGCAGATCTGGACGT
TCTTTTGGGCCTAAATGGTCGCTCGTCGGATGTAGACATGACAACCACATTGCCGAGTTTGAAGCCACCTCTGCAAAAC
GGAGAAATTAAGGCCGACAGCATTGACAATCTTGATTTGGCTTCCCTCGATCCGCTTGAGCAAAGCCCTAGTATATCTA
TGGAACCTGTTAGTATCAATGAAACAGGAAGCGCATATACAACTACGAACACAGCACTAAGCGATATCGACATTCCATT
CTCCATCAATGAGTTGAACGAGCTATACAACAAGTATCTTCGCATAACTCACATTCA > SEQ ID NO:3723 200786 *Saccharomyces cereviseae*
GAATTCCAGCTGACCACCATGGAGTTTTCTTTCCAAACTTTCCCAAATACGAAAATCAACGACTGCATCAAAAGCCCAA
GTGCAAGATCCATTACCCAAGAAGAATGACGAAGAGTATTCCTTGTTACCCAAAAATTACATAAGAGACGAAGATCCTG
CAGTAAAAAGATTGAAGGAGCTGAGGCGGCAGGAACTGTTAAAGAATGGTGCTTTGGCTAAAAAAAGTGGTGTAAAACG
GAAACGTGGCACCTCATCTGGATCTGAGAAAAAGAAAATAGAAAGGAATGACGATGATGAAGGTGGCCTTGGAATTAGG
TTTAAGAGGTCTATTGGAGCAAGTCATGCGCCACTCAAGCCAGTTGTAAGGAAGAAACCTGAANCTATCAAAAAGATGT

FIG. 1 continued

```
CATTTGAAGAGCTAATGAAACAAGCGGAAAATAATGAGAAACAGCCCCCAAAAGTTAAGTNATCGGAACCCGTAACTAA
GGAACGCCCACATTTTAACAAGCCAGGTTTCAAAAGTTCAAAAAGACCACAAAAGAAAGCATCCCCTGGCGCAACATTG
CGTGGAGTATCTTCTGGAGGC

> SEQ ID NO:3724 200721 Saccharomyces cereviseae
TCATTAATTAATCTAAATTTTGGTAGCGCCATTGAAACATATTTTAGCGATAAAACAGGTCATAACCAAGTCGTCGAAA
AAGCTCCCGTAGCTTTGGATAACATTCTACGAAACCTTAAACTTGGTGAATTTATAACATATTTTGTCCTTAACAGAAA
ATCATTGCAAGTAAATGTACCTCACCACTTGCTGTTCACAAATCAAACGGATTACGGAGAGTTCGCTGTTGAAAAAGGG
GAACATGATAATATAGCTGGCAAATTTGAGACCCTTTTGAAGAAAAAGGAAATTTTAATCAGAAAATTACTAAATATTG
AACAGAAAAATGACCATATTCTAGAAAATTGCTGCAATTCGGATGCTGAAATGAAAAATATCGGAGAGCTAGTCTGCTC
AATGATCACTCTGGTATCAGGCATATTAGATTCAATTACTAATATGAACGCAGAAAACTCTGTTGATTTGGATTCAAAG
CCCCTTCCGAACGCCTATTTTGCTCAGGACAGTGAAGAAGAATTAATGTCGCCAACACAAAGTATTACGTCAAATCTTG
CCAGTGAAGAAAATACACGTTGCACAACCAAAGACTTGATGGGAAC > SEQ ID NO:3725 200741 Saccharomyces cereviseae
CGGAATTCCAGCTGACCACCATGGAGGATCAGGATGCTGCATTTATCAAACAGGCTACAGAAGCAATAGTGGATGTATC
ATTAAATATAGATAACATAGATCCTATAATAAAAGAGTTATTAGAAAGGGTAAGGAATAGGCAAAACAGGTTACAAAAT
AAAAAACCAGCACTCATACCGGCAGAAAATGGTGTTGATATAAATAGTCAAGGCGGTAACATAAAGGTTAAAAAGGAAA
ACGCATTACCAAAACCACCGAAGTCCAGCAAAAGCAAACCCCAAGATCGTAGAAATAGTACTGGTGAAAAAAGATTTAA
ATGTGCGAAATGTTCGTTGGAATTTTCAAGATCATCAGATTTGAGAAGGCACGAAAAGACACACTTCGCCATATTGCCT
AACATTTGTCCTCAATGTGGCAAAGGTTTTGCAAGGAAAGATGCATTGAAAAGACATTATGATACACTGACATGTAGGA
GAAACAGGACTAAATTACTAACTGCGGGTGGTGAGGGTATCAATGAATTACTGAAAAAAGTCAAGCAATCCAACATCGT
TCATCGTCAAGATAACAACCACA > SEQ ID NO:3726 53376FL Arabidopsis thaliana
CTGCAGGTACCGGTCCGGAATTCCCGGGTCGACCCACGCGTCCGCATTTTTCCATCTTCCTCATCACCTTCCCAAGAAG
AAGAACACCAAAGAAGAAGAAAGGTTAATAATGATGGGCAGTGTCGAGCTGAATCTGAGGGAGACTGAGCTGTGTCTTG
GTCTTCCCGGTGGAGATACAGTGGCTCCGGTAACCGGAAACAAGAGAGGGTTCTCAGAGACGGTTGATCTGAAGCTAAA
TCTGAATAATGAGCCTGCAAACAAGGAAGGATCTACGACTCATGACGTCGTGACTTTTGATTCCAAGGAGAAGAGTGCT
TGTCCTAAAGATCCAGACCTCCGGCCAAGGCACAAGTTGTGGGATGGCCACCGGTGAGATCATACCGGAAGAACG
TGATGGTTTCCTGCCAAAAATCAAGCGGTGGCCCGGAGGCGGCGGCGTTCGTGAAGGTATCAATGGACGGAGCACCGTA
CTTGAGGAAAATCGATTTGAGGATGTATAAAAGCTACGATGAGCTTTCTAATGCTTTGTCCAACATGTTCAGCTCTTTT
ACCATGGGCAAACATGGAGGAGAAGAAGGAATGATAGACTTCATGAATGAGAGGAAATTGATGGATTTGGTGAATAGCT
GGGACTATGTTCCCTCTTATGAAGACAAAGACGGTGATTGGATGCTCGTCGGCGACGTTCCTTGGCCAATGTTCGTCGA
TACATGCAAGCGTTTACGTCTCATGAAAGGATCGGATGCCATTGGTCTCGCTCCGAGGGCGATGGAGAAGTGCAAGAGC
AGAGCTTGAAGTCAAATTAAAAGGATAAGTGGTATCGATTATATATTTGATTAACACATTGATTGGTGTTAATTGCTCT
TTTTTTTCTTACGATGAAATACATTGTTCAGTTTCTTTGATGTCTGTGTTTTGATCAAAAAAAAAAAAAAAAAAAAA > SEQ ID NO:3727 104005FL Nicotiana benthamiana
GCGGCCGCCCTTTTTTTTTTTTTTTTTTTTTTAAGATTAAAGAGATATATTTTTATCATTTTCCCATAGGACG
AGCGGTGTTCAAAAGCTAATCACTCCATTAAGCTTAACATTTTTTCCATTTCTTCTCTCTTTTGGCTTCAAAAATAAC
AAACAGAAGTTCATCTAAGGAAGTTCTGTTAAGGTTGTTTCACAGTTTTCTAATAGTTTTGAGATTTAAGCTTCATTT
CCTGATGTATCCCAATTATTATTAATATTCAATCCAGAAATAAAAAAGAACGACACCAACAATGTGTCAACTGTGAAAG
AAGAAGAAGAAGAAGAAGATGAAGAAAAAGAATGACACCAACAATTTGTTAACAAAGAAGAAGAAGAAGAAGAAGAAGA
AGAAGAAGAAAGAAGAAGAAGAAGAAGAAGAAGAAGAAGAAGAAGAAGAAGAAGAAGAAGAAGAAGAAGAAGAAGAAGA
AGTGGTGAAGAAGAAAAAGAAGAAGAAGAAGAAAGAGAAGGAGATGCAATATTTTGCAATAATTAAGTAAACACCTTGA
TTAGTACTGCACGTAGATGGACGATTGATTAGTTGAATTGAATCTTGTTGTGCATAGGAAGCTTCTCCGAGTGAACAAT
CACCAAATGCTAGCATATTAGGATCAATTCGTAAATCTGGGTTAATATGCTGAAGTTGTGCAACAACATTAAGTGTAAT
TTTTTGCCACCAAGTTTCCTGTCGTTCCTCGAAATTTTTCTGCATCCTTTGTTGCCTTCTCTCTTCCATTTCCTTTAGT
TTTTGCTCCATTATATTATCAGTAGTCTTTGAAGAGGGTCTAGAATTTCTAGATTTTTGTTTCAAGATAGTCTTTGTAA
CCCCACGACCATACAAATTTACGCGACCTGAATGTTCAGGTCCCATGACTGTTGCAAATGGGTCAATTGATTCGGACGC
GTGGGTC
```

FIG. 1 continued

> SEQ ID NO:3728 111048FL *Nicotiana benthamiana*
TTTTTTTTTTTTTTTTTTTCAGTAGAACTACCAATTTTTTTTTTTAAACCTTTTAACTACCTTTCACAGTAAAGTTT
ATCCAGACAATACCTCTACAGAAAAGGAGAAAGCAGACGCACAAACACAGAGACCTTAAATACAACAGTTAAACAGGAT
GACGGGGAAAACCAATGCAAAGAAATGAATGAAAAAATGACAGCCCCTGTGATGATATCGTCAGCAACTTGCACCGGCA
TCGTCGCATTGAAGCAGCCTTCCACCAGGAAAAGGCAGATGCAGCATCAACAAATTCTTCAACCTTGCTGGCTCCCCTC
TGGTTCAACCTTCTTGTGGTGAAACTTCACCACTATGCAGGTAATATTGTCAGCACTACCCCGAGTAAATGCAGTCTCT
GTTAGCTTCCTAGCAGCTGCTTCTGGTTCTTCTTCTGCTTGTGCAAGTGAAATAGCATCCTCATTTGGTACCACATCCC
AAAGCCCATCGCTGGCAAGCACGAGTAGTTCTAATTCCTCATCAATCTCTTGATCCTGAATCTCAGGTTCGGCCACAAC
AAATTGCTTCAACATACGGTTGCCAAAAGCACGTGACATTGCTAATACACCACCAACTCTCCAGGTACCAGCCCACATC
ACAACACCTCCGGCACTTTCAATTCTCTTCCTCTCATCAGTTCGATTGGGCTTATGATCCTCAGAAAGAGCAATTGCTT
TTCCGCCCTTCGATATTATAGTTCGCGAATCTCCAACATTGGCAACATAGAGATGGTTACCAACTAGAACTGCTGTTGA
AGCAGTGGAACCATCATCTCGGAAGGTATCTTTTTCAGAATCTAAGAAGTCCATGTCTGTTTGTTGATATGTTTCACTT
ATGGCCAACTTGGTGTTTGTTGGGAACTCTGGATGTTTCATTAGATTCTCAAAGAGATGTTTCTTCAGAAACTCAGCTG
CTCGGGAACCCCATGGCCATCAAATATCCCAAATAAGCAAACTGTTTGTCCATCAACTTTGGAAGTTTTAATGCCATAA
AAATCCTCCATGGTTGCTCTTTTCCCTCTAAAGCTTGAATAACCACAACTCAGTCTTCCATCTTCACTCTTCCATCCTC
CGCTAGCGAAACCACCATTATTATCATCCTTCTCCGGTGAAACATCAACGACAGGTCCTCCTTTAGCAGTTGCACCAGT
ATCCACCATCATCGTTCTCCTTGCTGTATATACACTTGCGTAGCTATTGCATAACATCTAAATTTGAATTTGCCGCATT
AACTGCCGGAACTTGAACTCAGATACGAGAGAGACGCCTGGCCGGACGCGTGGG > SEQ ID NO:3729 120933FL *Oryza sativa*
CTGAAGAGGTACCCAGCTAGGCTGTCAGTTCTATCACTGACCTGCATCTTTGGGCTCCTCCAGTTCCTGGTCATTGCAG
CCTTCACTGAAGAAGACCTGAGCAGATGGAAGGTGAACTCCGGAAGCGAGCTGTTCACAATCCTCTACGCTGGTCTTGT
GGCATCTGGCCGTGGCGTTTGCTCTGCAGATATGGTGCATCGACAGGGGAGGGCCGCTGTTCACCGCCGTGTTCCAGCCG
GTCCAGACCGTCGCCGTCGCCGTCATGGCCGCCATCATTCTCGGAGATCAGCTATACTCAGGAGGGATCATCGGAGCAG
TTCTGATTGTGATCGGGCTGTACTTCGTGCTGTGGGGCAAAAGCGAGGAGAAGGAAGAGCAAGAACAATCTGCAGGACCA
GTCATCGGTGCAGGGAGGAGGAGGAGGAGCGACATCAGGAGGCATCTGCTCGGGCAAGAAGATCGATCTCGCAAGACGAA
GAAGCTGCAGTCACTGATGAACTGGCATGACGATCGATCGAGCTGAGGGGCGTTCTTCACCAGTAATATGCATGATGAT
GTTGGAGTTGGAAAATATATGTTGATGTCAGTGACTGTACTTTTCTTAACTATGTTAATCAAAGAAGAAGATCCAAGCG
TGCCAGTGTAATTAAAAACAGTACTGCTAGCTGGTCCTCACTCACCAGTGATATACTATATATAATTGCTACGAATCAA
AAAAAAAAAAAG > SEQ ID NO:3730 126593FL *Nicotiana benthamiana*
GGCCATTACGGCCGGGGAGCAGTGACCAAATTAAGTCGAAAAAAAAAATGGCAACTCCTGAAGAAAACATTGCACCTGC
AGCTCCACCACCGCCGGCGGCAGAACCATCAGCGGTGGAGGCTTTAGTGACCACTATTGAAACAGCGACCAAACAGGTT
GAAACACCGAAGGAAGTCAAGGAGGAGAAGAAAGGAGGAGCACAGGATCTCAAGTTAACCCTTTTGATTCCAGGGGCTG
TAGTAGCTGTTGTTGGAGTAGTTCTTGCCATTGTCAAGAAGGTGAAAGAGTCGGCTAATTGAATGTAGATCCCTTGTAT
CGTCAACTTTATATTTCTGTACATTTTTCCCCCTTTTGTAAGACGAGCCTAAACTCTTTGTCAGCTTTGAAGGGAAA
TAAATAAATTTCATATGCTTTTATTATAAAAAAAAAAAAAAAAAAAA > SEQ ID NO:3731 127667FL *Nicotiana benthamiana*
GTCCACATAAGATTCAGGGGATTGGTGCTGGTTTCATTCCTGGTGTTTTGGAAGTTGGTCTTATTGATGAAGTAATTCA
AGTTTCAAGTGAAGAAGCCATAGAAACCGCCAAGCTTCTGGCATTGAAGGAAGGTTTGCTTGTGGGCATATCATCTGGT
GCTTCTGCTGCTGCAGCAATCAAACTTGCTAAGCGCCCTGAAAATGCTGGGAAGCTCATTGTTGTTGTTTTCCCAAGCT
TCGGGGAGCGATATCTTTCCTCTGTGCTCTTTGAATCTGTTAGACGGGAAGCAGAGAACATGACCGTGGAGCCTTGAAC
ATTTTGTCCTTCGATTAGCATACCATAGTCTCAAGAGGATTTTCCAATCAAAGCAGAATGTTCTTGTCTGAACCTTTCC
CTTCCTGTTTGATCAAACTGCTAAAAATAAGGCCTTTTCTTTTCTTTAGTGGCCTTTCAAGTATATCTTAGTGCTTTTA
TAATTTTACTGTTTCTACAACACTTGTGACAGTGGACTTGTAACAGGAATTTCAAGAGCTGTTGCTGCTTGTTCGTCAA
AGTTCCTCTAAGCCTTTTATTTTCTTGAAAAAAAAAAAAAAAAAAAA > SEQ ID NO:3732 130426FL *Poppy*
GTCGACGAATTCAAGTGAAGGCAGCCCATTCCTACCTCTGAACCCTGAAACACCATTCTTGTCTGTGTCTGAATTTCAC
TCTAATCTCTGTATAATCATGGCGATTACAACACCATTATCACAATCAAATCTCTATTCAACAAACAATACAATCATCA
AAACACCAAGACTGATTCATCAAATTCAATCCAATTCAATTTCATTGAATTTGAGGAACCCAAGCTTCCAAAACGAGTT
GTGGGGGAATAGGAATTGTTCTCTGGTTGTTCAGAGGGGGGTAGCGGCATCTGTGATTACAGCAACTGCTGCTGCTGAG

FIG. 1 continued

```
AAACAGAAGAAGAGGTATCCTGGTGAAGGGAAAGGGTTTGTGGAAGAAATGAGATTTGTAGCTATGAAATTACATACAA
AAGATCAAGCTAAAGAAGGTGAGAAGGAATCTCAAGCGCAACCTTTGGGGAGATGGGAACCTTCTATTGAGGGGTATAT
TCAATTTCTTGTTGATAGCAAGTGTGTTTATCATACTCTTGAGAGTATTGTTGATAAAGCTGCTGTTCCTTCATATGCT
GAGTTCAGAAATACAGGATTGGAACGGGCAGGAGCATTGGCTAAAGATCTGGAGTGGTTTAAAGAGAGAGGCCATGCTA
TTCCAGAACCCTCTAATTCTGGCCTATCTTATTCCCAGTACCTTGAAGACTTATCAGTGAAGGATCCACAAGCCTTCCT
CTGTCATTTCTACAATGTATACTTTGCTCACACTGCAGGGGGTCGGATGATTGGTAAAAAGGTGGCTGAGATGGTACTG
GAAAAGAAGGAGCTGGAATTTTATAAATGGGACGGTGATCTTAAACAACTGCTGCAGAATGTGAGAGATAAACTCAACA
TAGTTGCTGAAAGCTGGTCTAGGGAAGAGAAAAATCACTGTTTGGAGGAAACTGAAAAATCATTCAAGTACTCAGGGGA
GCTCTTGCGATTGATACTAACGTAAAGATATTGCAAACTATATCAGTTCTGTATATATCTTTAAAACAACTGAACCAAG
TACTTTGTCATCTTTTCAGCTCAAGCTACTTTAATCACCGTTTCGTTTGCTTTCTGCAGCCATGTTTATATTTCCTGCA
TAATAATCTGTTCTTGTTATTATTGAATGGATATTGGTGTAGACGTCTGGAAGGATTTCATTGCTTATTTGCATCTAGA
TGCATTCGAAGTTCAAAAAAAAAAAAAAAAAA

> SEQ ID NO:3733 188837FL Oryza sativa
TGAACGGTGGAACGCGTACTTACCCACAAGTTAGGTGCATGCCATGGCACCATTCATGGCATGCGCCTCGCCACCGGTA
CTCGCGCTGGCCCTGCTCGCGTCGTGCGGTGCCTTTCTCGCCACCTCCATGCTCCCGGCGCGTGCGACGGCGAGCAGCT
GCTTGGACGTCGGCGACATGGTGATGATGGACAGGTTCCGCGCTTGGCAGGGAGCTCACAACCGGTCGTACCCGAGCGC
AGAAGAGGCGCTGCAGCGGTTCGATGTGTACCGCCGCAACGCGGAGTTCATCGACGCCGTCAACCTGCGCGGCGACCTC
ACTTACCAGCTCGCCGAGAACGAGTTCGCAGACCTCACCGAGGAGGAGTTCCTGGCCACGTACACCGGGTACTACATCG
GCGATGGCCCCGTGGACGACTTCGTTTTCACGACGGGTGCCGGAGACGTCGACGCCAGCTTCTCCTACCGCGTGGACGT
TCCGGCCAGTGTCGACTGGAGGGCCCAAGGCGCCGTTGTGCCTCCCAAGTCCCAAACTTCAACATGCACTAACAGCTTG
ATCACTATGTGGATTTTAGTTTCGAGCACGACGACCCAACATATTCAAAATAAGTGATTTCAGATGCTCTGTATAATGC
AGCTCTGGCTTCCTCGAGGCCACAACAACAGCCTACTGTTGAGCAATAGCAATTCTACCAAAACTATGGGTACAGCAGA
TAAGGTATAAGTTTTCAAGAACTCACCTGCGCCGGCCACGACTCTCCTCTTGAAAGCGGTCACCGCTGGCCTCCCGGTG
CCACATCTCCGGGAGCGGCACGTCGTCGGGGTCGCTTACATACTCCTCCTCCTCCTTGTCATCATCCCCGGTCCCCGCC
GTCTCCACCTCCTCCGGCGTCAGCGGCACCACCGGGGGCTTGCCGGCGGCGTGGAAGGAAGGCCAGCAAGATTAAAATA
AGATTAAGTCACTAGAAAATCCTTTGAGATGTACTACTACTGCGAAACCAAAAATCGGAGCTGAAAATTAAGATCAAAA
AAAAAAAAAAAAAAAA > SEQ ID NO:3734 200622FL Saccharomyces cereviseae
GGAATTCCAGCTGACCACCATGCCTAAAGTTTACAGTTACCAAGAAGTTGCCGAACACAATGGCCCAGAAAATTTCTGG
ATTATCATCGATGACAAAGTTTACGATGTTTCTCAATTCAAAGATGAACATCCAGGTGGTGATGAAATTATAATGGGTT
TGGGTGGACAAGATGCTACAGAAAGCTTTGTCGATATCGGTCATTCTGACGAAGCATTGAGACTACTGAAAGGTTTATA
CATTGGTGACGTTGACAAGACCAGTGAGCGCGTTTCTGTGGAAAAGGTATCTACCTCTGAAAACCAAAGTAAAGGTAGT
GGTACATTGGTTGTCATATTGGCCATTTTAATGCTAGGTGTTGCTTATTATTTGTTGAACGAATAACATGGCAATTCCC
GGGGATCGCGGCCGC > SEQ ID NO:3735 200625FL Saccharomyces cereviseae
GGAATTCCAGCTGACCACCATGACAGAGTTTCGTTTATTAAAACGCCTTTCAACATAGGGGCGAAATGGAGATTAGAA
GATGTCTTTTTGCTCATTATCATGATACTTCTTAACTACCCAGTGTATTACCAACAACCGTTCGAACGTCAGTTTTACA
TTAACGATCTCACTATATCGCATCCTTATGCGACAACTGAACGTGTAAATAACAACGTGTTGTTTGTTTATAGTTTTGT
CGTGCCATCTTTAACCATATTGATAATTGGTTCCATTTGGCCGATAGAAGACATTTGATTTTTATTTTGTACACATCT
CTCCTTGGTTTATCACTCGCTTGGTTCAGTACGAGTTTCTTTACAAACTTCATCAAGAATTGGATTGGAAGACTAAGAC
CAGATTTTCTAGATCGTTGCCAACCTGTTGAAGGCTTGCCATTGGACACTTTATTTACTGCAAAAGATGTGTGTACGAC
TAAGAATCACGAACGTCTGTTGGATGGGTTTAGGACAACTCCGTCAGGTCATTCAAGTGAAAGCTTTGCAGGACTGGGT
TATTTGTACTTCTGGCTATGTGGGCAACTTTTGACTGAATCACCGTTGATGCCTTTATGGAGAAAAATGGTGGCCTTTC
TACCACTGTTAGGAGCTGCACTAATTGCTCTATCCAGAACTCAAGATTACAGACATCATTTCGTCGATGTAATTTTAGG
GTCTATGTTGGGTTATATAATGGCACACTTTTTCTACAGAAGAATCTTCCCACCCATTGATGATCCTCTTCCGTTCAAA
CCATTGATGGACGATTCAGATGTCACCCTGGAGGAAGCAGTCACCCATCAGAGGATCCCGGATGAGGAATTACATCCTT
TGTCCGATGAAGGTATGTAACATGGCAATTCCCGGAGATCGCGGCCGC > SEQ ID NO:3736 200671FL Saccharomyces cereviseae
GGAATTCCAGCTGACCACCATGAACGTAACATCGAATGCAACTGCAGCCGGTTCCTTTCCACTAGCATTTGGTCTCAAG
ACCTCATTTGGGTTTATGCACTATGCCAAGGCCCCTGCCATTAATTTACGCCCCAAGGAATCCTTGCTGCCGGAAATGA
```

FIG. 1 continued

```
GTGATGGTGTGCTGGCCTTGGTTGCGCCGGTTGTTGCCTACTGGGCGTTGTCTGGTATATTCCATGTAATAGACACTTT
CCATCTGGCTGAGAAGTACAGAATTCATCCGAGCGAAGAGGTTGCCAAGAGGAACAAGGCGTCGAGAATGCATGCTTTC
CTTGAAGTGATTCTACAACATATCATACAGACCATTGTTGGCCTTATCTTTATGCACTTCGAGCCGATCTACATGACTG
GGTTTGAAGAAAATGCCATGTGGAAGCTTCGTGCAGACCTTCCTCGGATTATTCCAGATGCCGCTATTTATTACGGCTA
TATGTACGGAATGTCCGCTTTGAAGATCTTTGCAGGCTTTTTATTCGTTGATACATGGCAATACTTTTTGCATAGATTG
ATGCATATGAATAAGACCTTATACAAATGGTTCCACTCTGTTCATCATGAACTATACGTGCCATATGCTTACGGTGCTC
TTTTCAACAATCCTGTTGAGGGCTTCTTGTTAGATACTTTGGGAACCGGTATTGCCATGACGTTAACTCATTTGACTCA
CAGAGAGCAAATCATTCTTTTTACCTTTGCCACCATGAAGACTGTCGATGACCACTGTGGGTATGCTTTGCCACTTGAC
CCATTCCAATGGCTTTTCCCTAATAACGCTGTCTATCACGATATCCACCACCAGCAATTTGGTATCAAGACGAACTTTG
CTCAACCATTTTTCACTTTCTGGGACAATTTGTTCCAAACTAACTTTAAAGGGTTTGAAGAATATCAAAAGAAGCAAAG
ACGTGTCACCATCGACAAGTACAAAGAGTTTTTGCAAGAGAGAGAATTGGAAAAGAAGGAGAAACTCAAAAACTTCAAA
GCTATGAATGCTGCTGAAAATGAAGTAAAGAAAGAGAAATAACATGGCAATTCCCGGGGATCGCGGCCGC

> SEQ ID NO:3737  212830FL  Trichoderma harzianum
CATAACCACAACTAAGTCATAAGGAAACAATCACGATTCTGAATATCTATTCGCGTTATATACAAGCTAAAATGAAGCC
GTTTTATCTGATTTCTATTCTATTTACCAGTTTGGGCACTGCTATCCCAGTTATCCCTAGGGATAATAACGGAATCCTC
GATAATTTCCTAGCTATTGTGAAAGACGCGACAGGAATTGATCGGACACCCGTCCACGGGCTCGTCGGCACTGTCCTGA
ATGGTGGCACCAAATCTATCTTGATTAACTCGACTGTCCTGGGTCTTGCAGAGGCAATTTTTGATGAGGTGAAATCCCA
ATTAGGCATTCAAGATCCGCGGTCGCTTGAAGAAACTATTGCGTCTTTGGAAGAGGCGGGTAATGAGACTTTTAACCAA
TTCTGCCAACTACTCGACACGTTCCGCAGAGAGGATAAAGGTCCTGCTGGAGGAACCATTGACTCGCTAGGCGTGGGCA
ATATATCCTCATTAGACTTGGCATCTTCTATCGACTTGATCATAAACTTGGTCGGACTACAATGTCCAAGTGGTGCGGC
CGC > SEQ ID NO:3738  213048FL  Trichoderma harzianum
CATCCACGACAGCTTCGATAGCTTCGACAAAGACGAAAATCATCATGAAGCTTTCGCTGGGGATTGCCGCAGCATTTGT
GAGCTGCGCTGCAGCATCGCAGCCCGCCGCCGACGTTTACGTTCTGCCGAATCGCGAATCCGCATCGCCGCCGTCCATT
CCCAGCAGCGTTGCCCGACTCATCTTGCTGAAGCTGGCGGACTCCAGTTCCTTTTCCTTGGTCCGCGATATTCCTGACG
ACGTCGATGTAGAAGAGGTGGTCTCGTTGATGAATCGATATGGAGGCGTCACTACTCCATTGTTCGATGAGCTCGCTCA
TGAGCCTAAGCAGCTGTTCATTGCGCTTCAGGGCTTGACGGACGAGCAGATGAAAGAGACCAGAGCGAAATTACAGCGG
CAGCCCTCATTCACTATCCCCGATGTGCCTCATATCGACCGTCTGCAATGGGCAACGGGCACTGAACCGCCTCCATCCG
AGTTTGTAAAAGGAAAAGGGATCAGCTGCTCTTATGATGAGATGACCAACCCAGTCGAGTCCCGGTGCTGGAAGGGAAA
GAGCTTGCTGGCTAGTTTTGATATCAAAAGAAGCCCGAATACTTGGACGACGTGATCGACAGCTTCCCACGGCTGACC
TCGCTTGCTGAGATTGGCGAAGTGCAAACGACTTTCCTCTTCTTCACTGGCGTTGGTAAATTGTCGAGCCAGACCAAAG
CACTTCACAAGCGCCAGGCGGAGCGGGTGATTTCCCACTTTCATAAGACTGCGGCCGC > SEQ ID NO:3739  213123FL  Trichoderma harzianum
CTCGAGCTGATTTAACAAATTTTAACAAAATATTAACGCTTACAATTTCCTGATGCGGTATTTTCTCCTTACGCATCTG
TGCGGTATTTCACACCGCATCAGGTGGCACTTTTCGGGGAAATGTGCGCGGAACCCCTATTTGTTTATTTTTCTAAATA
CATTCAAATATGTATCCGCTCATGAGACAATAACCCTGATAAATGCTTCAATAATAGCACGTGAGGAGGGCCACCATGG
CCAAGTTGACCAGTGCCGTTCCGGTGCTCACCGCGCGCGACGTCGCCGGAGCGGTCGAGTTCTGGACCGACCGGCTCGG
GTTCTCCCGGGACTTCGTGGAGGACGACTTCGCCGGTGTGGTCCGGGACGACGTGACCCTGTTCATCAGCGGTCCAG
GACCAGGTGGTGCCGGACAACACCCTGGCCTGGGTGTGGGTGCGCGGCCTGGACGAGCTGTACGCCCGAGTGGTCGGAGG
TCGTGTCCACGAACTTCCGGGACGCCTCCGGGCCGGCCATGACCGAGATCGGCGAGCAGCCGTGGGGGCGGGAGTTCGC
CCTGCGCGACCCGGCCGGCAACTGCGTGCACTTCGTGGCCGAGGAGCAGGACTGACACGTGCGGCCGCGTCGAGGGGTA
GTCAAGATGCATAATAAATAACGGATTGTGTCCGTAATAATGGGGGAAAAAAAAAAAAAAAAAAAAA > SEQ ID NO:3740  213260FL  Trichoderma harzianum
TATCACTACTCCATCTCAGTTCGTGTTCTTGTCATTAATTAAAAGAGATATCTGGGCTTCAACTCTCAATTCATATTTA
CAATAAAAGTAATAAAGATTGAAACCGCCAGCAACTCCRAGTCACAACCACATACATCATGCCTGCGCAAACTACATCT
CCCCACCTGGCCAACCTCGAGCGCGACGGCTTCGTCGTCATCAAATCCATCGTCTCCCCCTCGAAGCTCGAGGCCCTCC
GCACCGCCAGCCTTAAAGCAGAGCAGCTCGCCCGCAGCGKACAATGGCCTCACGT
```

FIG. 1 continued

> SEQ ID NO:3741 213769FL Trichoderma harzianum
GAGGTCCAGAATCTTCCAGGTTGACCTCTGTATTGGCGGAAGTTACCATGGGATGGGCTGCTGTTACACAATGATTCAA
CTTGTGAGCCTCCTTCGATCCTTTGGACATCTGAAGTCACAGATGAGTCAATTATGTGTTGTATCCCTTTCACAAGGAT
CGGAACTTGGGGGAGGGCTTTGTCTTGTTTCGGAATCATAGTTGAGAGGCAATCAACAGCGTTTTGCATAAAAAAAAAA
AAAAA > SEQ ID NO:3742 214787FL Trichoderma harzianum
CAACCACCACTCAGCAAGCAATCATCAAAACAGCCACTCTCACTTTTCTCTCAAAGTAAAACACTTCAAACCGCCAACA
TGCAGGTTACTTCTATGCTCGCTCTCCTCTTTACCGTTGCCACTGGCGCTCTTGCAGCTCCCGGCCACGGAGCTCCTCC
TCCTCCCCATGTTCCTCCCCCTCCCCCTCCTCCTCCCACCAACCAAAACACCAACACCAACAACAATTGGCAATCCAAC
AGCTGTGGCAACGGCGCTTCTCCTTACTGCTGCAGTGCTACAGCTGATGGCCTGGGAGAGAACTACTGGAAGTGCTCTG
ATCTCAATGATGTGTGCAACGACGTCATTGTTTGCTGCAACAACAATAGCAACAACAACAACCAGCAGGGAAAGCAAAA
CAACATCGACACCGGCAACCAGTCTTGCAGTGCCTTCGGACAACAGAAGGTCATCTACCTCTAAGCTTGCCTGCAGAAG
CTCAAAGTCGGCAATGGCTCTCTTATTTGCTTGTATCTTAGTCTTATAAGGCAGTTCATGTCCAAGTTTGTCGGCTAAG
GGCTGCGGTGACGGGTTTGAGAAAATGGGCAGTGGCATGTGGAACGGTGAAAAAATGCTTCTTTTCTATTTGGTTTGTA
GCAGGGTGGCTCTTCTGAGGCAGTCTTTACAACCCGCTCACTTTCCTTAAGCCTATTTAAACCGATATAGTTATTACAA
CCAAAAGCCAAAAATCGGTTGCCTTAAAAAAAAAAAAAAAAAAAAA > SEQ ID NO:3743 214794FL Trichoderma harzianum
GTGGATGATTGATAGGTACATTAGCAGAGTGGTTTTAGTTTTGGAGGAGTTTTACTTTTTATTCTCTTTCATATTCCAA
TTCTGTACTTGTCTCGGAAGCCATATTTACAACTCTCAACACCACAATGGCGGGCTTCAAGAAACTACTCCAGACTCTA
ACTGGGAAAAAGAGCGACGATGCCACTCAACCCGAAGAGCAGCAACGCCAAACTCCTCAGCCCAAACCTTGGTCCGGCA
TCGACAACACCCAACCAGCAGGCTCGAACCCCATCCGCGGCTTCTCCACCGAATATCTCGGCGAGCAAAAGTCCAGCAA
CACGGCCGTCCGCCGGGACCTCGGCTTCGCGGGCCACATCGGCGGCCAGTGGTTCGGCGTGTACGGTGACACGCTGTGG
TGCAGTCCCGGGGTGACGGACCCGGATTTGGAGCCGGATCCGGAAGGGTTCCACGGCATGGTGCGGAACTCGGTGGCGG
TGTTGACGGATGATCCGCTGGTAGTTCGGTTTGTGCATTTGAATGGGGATGAGCCGGTGGCGCATCCGTTGCAGTTTAC
GCCGTTTGAGGAGCGGTGGGGGGAGACGAATTTGTTTGGGTTTGGGGGGACGAGTCTTGTGGAGGTTGATGGCTATGGG
GAGGGTGTTGGGGCGCTGTATTATTTGATTAATGAACATGAAAACTATCGTCACGCTGGCATCGCCCGTGTCGAAGTTA
TAGACGGCGTTCCCACTACCACCAAGCGCCTTGGAGAACATGGCTGGTGGTGGGACTGCTCTACGACAGCAAAGTACGG
CGACATTGCTACCTACAGAGACGTAAACAGCGAGTACATCTATGCTTGGGGCCATCCACCCAAGACCATAACAGAGTGG
CCGGCAACGGAGTATATATACCAGACGCGAGTCAAGGCCACAGAAGCATTTGATCTAGACAAGTATGAATACTGGTGGG
GGAGAGCAAAGGGGTGGCGGAGCGAGATGTTGAACGAGCATAATCCGGAGACGGCGGTGATGTGGGGAGCTGGGCAGGG
GCAGGTTGTGTATAGCGAGTGGTTCAAGTGTTATATCTATGTTCATTTGAATGGCCCAAAGGTAGCACTGAGAACGGCG
GCGAAACTGGAAGGGCCGTGGAGCGAAGATCGAGAAGTTTTTGAAGCAGAGCCGATTGATGGCGGGTTTGTGTACGCTG
GAGTTGCGTATCCGTTTTTGGATGAGACGGGCAAGACGCTGACGATTGCGTATACGAATAATAACCATATTCAGGTAAA
AAAAAAAAAAAAAAAA > SEQ ID NO:3744 214809FL Trichoderma harzianum
AGGCAAAATGTCCACAATGGAGGCTCCAGTTGAGAAGAAGATTGAAAAGACAGCAAAGCCTTATGGCATGCGCAAAAAT
GGAATGCAATGGCATGCTCCGAAGAAGGCGTTTCGCCCGACCAAAGGCCTCTCATCGTATGAGCAGAGGACTAAGGAGC
GAGCTGCAATGGCTCAGATGAAGGCAAAGGAAAAGGAGATGAAGGAGGAGAAGGAGGAAGAGCGCCAGCGTCGGATTCA
AGCCATCAGGGATAAGCGAGCAAAGAAGGAAGAGAGAGAAAGATACGAGAAGATGGCCGAAAAGATGCACCGCAAGCGA
GTGGAGAGATTGAAGCGCAAGGAGAAGCGAAACAAGCTCTTGAACTCTTGAGCCGAGAATCCACGCCGACGAAAGACAC
TGGGATCAGACTGCATCGGCAAACCCCGTGGTGCATTCTACATGTTCGTACTGGCGGTATGCAGAGTTATCATACTTGC
AACGGATGCGCACTGTGGCATCCGGACTTTGACGGCCAGGAAGCAGCATGCACAGCAAGCAGTTGGACGGGGGCTGTA
GCGACAAGCTCTTCACCGCCATGGACTCCAGTCGCTCGCAGTAGTCTGAACTTGGTCTTATTTTCGTTCTGCAGCA
AAACGGGACTACTATCTGTTTGGGTCTGTTTGTGGATTTGCCTGCATCATATGCCCGGTACTTCATGCTAGAATGATCG
ATATTACTTGGTTTCGCCAGACTGTGGGACTTTGCTGGGATTTCTTTGGAGCTGCGTTGGGGCTTGGATACATATGGAC
CTGCATCTTACATCTTGCAACTTCAAGTTACAGCATGGGGCAGTCCTTGCATGCTTAGGTATGGGCGGACGGGTGGTTT
TTGGAGGTCTTGCATTTGCATGGCGTTGGGGAGCACATTGATTAAATGAATAAACAAATATTTGAGAAAAAAAAAAAAA
AAAAAA

FIG. 1 continued

> SEQ ID NO:3745 214837FL *Trichoderma harzianum*
AGAAGTCCAACTACCAATTCACCCACAAGATGCTGGACCAGGAGCCCAAGAAGACGTCCGGTGGTGAGGTGCGCATCAC
TGACTCCAAGAACTTCCCAATCTCCAAGACCGTGGCTGCTGCCCACGCCGTCATCGAGCCCGGCGCGATCCGTGAGATG
CACTGGCACCCCAACGCCGACGAGTGGTCCTTCTTCATCAGCGGCCGC > SEQ ID NO:3746 215716FL *Trichoderma harzianum*
CGGCAGCAAAGGCTGCTGGAGGCGTTGTTTCCATTGCAAAGAAACAAACCCTCCAGTCCACCGGCTTGTGGGAGACCTT
CCGCAAGGCCTTCGCCCTCGACCCCAATCGCTCCAACGGCGTCCCCCTGAACCCTTACTTCCGAAACCCGACGCCCGGA
GCCTTGGACCCCCTCAGCTTCGACGACCCCGTCACTCTTCCCGCTGGCGACATTGCCGACAACGCCTACTGGAAGCGTG
ATGTCCGTCGCGCGTACCCGCAGCTCAGCGTCGTTACGCAGGGCGACGCCGTGTCGTTGTTGACGGTTGGAAGCGCCGC
ACAGCCCAAGGTCGAGCTGATTGGCGAGGCCGGCGAGAAGGCTCTCGTTGCGGCGCAGAAGGAGGGCGAGACGACGGGC
CTGGCCAAGTTCCTGGAGAAGGCGCCCAAGGATGTGGCAAAGGACGTGTTCGTCAATGGATTGCCTCCGCTGCCGAGCG
GACAGGCCCTGGAGGCTGGAGGATGGGATGTGCACAAGTACGAGCTCAATGAGGATCAGACATATGGTGAAGGCTATCC
TACCAGGACGTTCAAATAAGACGGGCAATAGGGTCGACTTGTGTAAATACAGATAAGATGAAGAAAGATTAGAATTTCC
CGAAAAAAAAAAAAAAAAAAAA > SEQ ID NO:3747 216108FL *Trichoderma harzianum*
GTGGTCTGACTGTAGAACAATCTCTCTTTGTCCTGTAGTCTCTTTGACTTATAATCTGCTCTATCCTGCTGTTGCGTGG
AAGCTTCAGAGTCCTCCCTTTGTGTGTGCGCGTGAGCCGAAACAATCACCACAATTGCTGCTCGCACGCCCCGGAAACA
ACAAAGAGCCCGCTGATCCGATCCGCCATCTCCGGCATACAATGCGCCGCTGCTCTTCTTCTTCATCAATCAGCTCTCA
GTGGTCCTCTATAAGCGACGACCAGCTCAACTCCATCGTCCACATCAACAGCATCACCACCGCCGCCACCACAGTCACC
GCCAGCAACTCGTCTGTTGTATCTTCATCTGCCTCTGTTGCACCCTCAATCATGCCTTCAGTCCACACAATGTCTGAGC
GCCGCCCTTCCACCCCCCAGTATGAGCGCAGTCGCCAGGGAAGCACATGCTCCGTACTGAGCTGCGGCGGCATGAGCCC
TGATGCGACCAAGGAGCTGTGGAAGACCATGTTGGAGCTCCAAGAGCGATATGGATGTTACACCTCAGCCAGAATGGAT
ATGGCCGTTGGAGCGGGAGACATGGCTCTCTCTCTAATGCCAAATCCATTTATTCTCGATACGCTAAACGACTCCGTCG
TCGACCTGCCTGACGAGGGCTGGGAGATGCTCAATCGCTGTCTCAGACAGCCCAGGCATTAAATTCTTGGCCTGATACT
ACCTGACACTCGTACAAACTACTACCACCCGCAATCGTTATTTCTTCGAATGAAGCGCGGTAGATGAGGACGATATGAT
GGGTATATTCTTCCTGGAAGGCGTTTTTTTTTTTTTTTTTTTTTTTCCGGAAAAAAAAAAAAAAAAAAAAAAAAA
AAAA > SEQ ID NO:3748 216131FL *Trichoderma harzianum*
CCCACGCGTCCGGAAGCCTGCATCGCCCGCCATGGCCATTACGCCGACCCAATTCGCCAAGAAGACGGCGCAGTCGACC
AGCTGGTCGGATGCGAAGCGTCGAGTCCTTTCTTCGTACCGCGAATGGATCCGAGCTGCGCCTGAGATCCAGACCATGT
ACAATGTCCCTCTCCCCATTTCTACCCTCCGAACACGGATGCGACAAGAGTTCGAGCGACACCGATACACGAACCAGCT
GTCCATAGTTGACGTGCTTCTCTTCAAGTCCCATGCAGAGTACCAGGAAACAATGAACTTCTGGAAGCAGCAGACTCAC
ATCTTGTCTTATTTCGGCGAAAACTTTAGAGGTGACAAGAGGCTTCCGTCCAGCTTCATGGCTGGTTTCCTTGAGGGTC
GAAATTAGAAAGACAATGCAAGAAAGTTTGTTTTGTAAATATCTCTGTATAAAGATTTTGTGCCGAAACCCTCCAATAA
AAAAAAAAAAAAAAAAAA > SEQ ID NO:3749 216156FL *Trichoderma harzianum*
CACATTCACTTCCTGAGGCCGCATCTCATTCAGCTTTTACCCCACCATCTCACAGCCCATCATCTATCTCATCCAACCT
CTCACCACAACAGCACCTACATCTACAAGAGAGAACACTTCCCTCTTGAAAAAGTAAACCTAAATAAACACATCAAATC
AAAATCCTCCATCATGGCCGACAAAGACCGCATCACCTGCCACGTCCTCGACACCACCGCCGGCCGCCCCGCAAAGGGC
ATCCGCGTCCGCCTCGAAGGCCCCGTCCCCAGCTCTCCCAACGCCCACACTGCCGTCAACACCTTCGAGTCCCTCACCA
ACGACGACGGCCGCATCACCGTCTGGCTGCCCTACTCCTCAGAGTCCTCGGCCGGCGAGGTGCCCGTCTACACTCTCGA
GGACGTCCTGGGCGCTATCAAGGGGCCTTCCCGGTGGACGCTGCGTTTCGACACTGCCGGCTACTTTGGCGAGGAAAAA
AACATTCTTCCCAGAAGCCACCATTGTGTTTCGTGTTGAAGAGGGCCAGCATTACCATGTGCCGCTGCTGTTGAGTCCG
TACAGCTACACCACTTACCGGGGAAGCTAAAGGGGGGCATGGAGGACAACGCGGCTTCACAGCCACAGTCGTTTCAGT
TTCAGAGTCAGAGTCAGAGTCAGTATTCAGAGATACATATGACAACAATGATATTGAAAGCGTGCTAGTCGTGGCAATG
TCAACACTGTCACTCTTTTTATTACAAAAAAAAAAAAAAAAAAAA > SEQ ID NO:3750 216268FL *Trichoderma harzianum*
GACACACAGACGCACTCACACACTCAGCTTAAGCGAGCGAGCGAGTGAACGAGAGAGAGAGACAGAGATGGCGAGTGTT
GCCTCCTTCCCGGTGATCAACATGGAGAACCTGGAGACCGAGGAGAGGGGCGCAGCAATGGAGGTCATCCGCGACGCCT

FIG. 1 continued

```
GCGAGAACTGGGGCTTCTTCGAGATGCTGAACCATGGCATCGCGCACGAGCTGATGGACGAGGTGGAGCGGGTGAGCAA
GGCGCACTACGCCAACTGCCGGGAGGAGAAGTTCAAGGAGTTCGCGCGGCGGATGCTGGAGGCCGGCGAGAAGGGCGCC
GACGTGAAGGGCATCGACTGGGAGAGCACCTTCTTCGTCCGCCACCGCCCCGTCTCCAACCTCGCCGACCTCCCCGACG
TCGACGACCACTACAGGCAGGTGATGAAGCAATTTGCGTCGGAGATCGAGAAGCTCTCGGAGAGGGTGCTGGACCTGCT
GTGCGAGAATCTGGGCCTGGAGAAGGGTTACCTGAAGAAGGCCTTCGCCGGGTCGAACGGCCCAACGTTCGGCACCAAG
GTGAGCAGCTACCCGCCGTGCCCGCGCCCCGATCTCGTCGACGGCCTCCGCGCCCACACCGACGCCGGTGGCATCATCC
TGCTGTTCCAGGACGACCAGGTGAGCGGCCTCCAGCTGCTCAAGGACGGGGAGTGGGTGGACGTGCCGCCCATGCGCCA
CGCCATCGTCGCCAACATCGGCGACCAGCTGGAGGTGATCACCAACGGCAGGTACAAGAGCGTCATGCACCGCGTCCTC
ACGCGCCCCGACGGCAACCGCATGTCCATCGCCTCCTTCTACAACCCCGGCGCCGACGCCGTCATCTTCCCGGCGCCCG
CGCTCGCCGCCGCCGACGCGGCGGCGGCCGC

> SEQ ID NO:3751  216339FL  Trichoderma harzianum
CAAACAAGCAAATCAATTCCCGAGCAAGAAAAAAGAAGAAGCCCATCATGAAGATGCTTTCGTTTGCCGCCCTCTCGG
TGCTCGTGTTGGGCGCTTCGGCCCTGGCTGCGCCGCCGGCCCACCCCCGGCCGACAATGGGTGCTGCTGCTGCGACAT
CAACAAGAAGAGAATCGACTGCGACAGGTCGATCCCGGCGTCGGAGTGCATCTGCCCCCAGGTCATCTGCCCCGCCGGC
GCGCCCACGTTCACGCACGGCACGCCGCCGAAAGCCACCCCACCGCCCACGCCGCTGCCGACTTACAAGCAGTGCTGCT
GCTGCAATCCCAACATTAACAAGATTGTGTGCTCGCTGAGGCTCGTGGAGGACTGTATCTGCTTGGCCGTGATGTGTCC
GACGGATGCAAAGACCATCTTTGTCAGGCCAACTGGCGTTCCGACTGTCGCTTAAGAGTATTCGTTGGCGAGCCGACTT
GCCTGAATCCTGGACCGGGGACATGACATGGGGGGAGGGAAAATACAGGGCAAGGCATTGCTGATGGTGAATGCACAAC
ACGCGTGGCAGACTGGCCGAAAATTGATGATTTACTGATGGGCGACTTTGGACTTGAAATGGGGCATGCCGGATGGGTT
ACTTGACAGTATTTACACCATTtCTATTCAACAATAAATGGAATTCTCCAAAAAAAAAAAAAAAAAAAAA > SEQ ID NO:3752  216349FL  Trichoderma harzianum
AAGGGCATTGAACCTCGATACGAGTTCGGCTTTGGACTTGGTTACACGACCTTTGCATATTCCAACATATCCATCAACT
ATATTCAGGGGGCAAACACGTATCCATGGCCGGGCGGCCCTATTGTCAGCGGCGGACAAACGGATCTATGGGATGCAAT
CGCCACCGTCAGCGTAAACATCAAGAATACAGGCAGCGTTGCTGGTGCCGAAGTGGCGCAGCTCTACATTGGTATTCCA
GGGGCTCCGGCGAAGCAGCTTCGCGGCTTTGAAAAGCCCTTTTTGCAGCCTAATGAGTCACAGTCGGTGACATTCCATC
TCACAAGAAGAGATTTGAGCGTATGGAGCGTGGAGAGACAGAAGTGGCAGTTGCAGCAGGGCAACTACAAGTTCTACGT
TGGGAGCAGCAGCAGACGACTGCCCCTGAATGGGACGATGGATTTATAAGAGAACCTCAGCAAGGCCAGCGGACTTTCA
GATGCAGCTCGAGTATGCCAAAATCGTATGCTGCGTGATGAATGGAGCTCTGTATGGGGTACATCATGTGTAGATACAG
CTGCGAGAaGGTTGTTGTTTCCTCCTTCAAGCGAGCTGAGAAGGCAGCAACTAACCGTCTATTGGATAGATCGAAAAA
AAAAAAAAAAAAAA > SEQ ID NO:3753  216463FL  Trichoderma harzianum
CCCACGCGTCCGGCCAATAGGTGGCCTGCAGGCTGTTTCTGATACAAATCCTCGTAATGCACAGACGTGAATAGTGCTG
GCACAAGTCACATTGCTGCTGCCTTGAAGGGTTCCATTTACATTTTGGTGCAGCTCTACCAACCGAAAAAAAAAAAAAA
AAAAAA > SEQ ID NO:3754  219090FL  Trichoderma harzianum
TCCAATTAGGCATTGACAGCAAACCAATTCCCTCCATAACTGGGCCTCTTCACACCCGTACTCAGAATGACCGACAGAA
TATTCCGCATCTTTAACCCGGGAGAACCAAAGGGTGATCCCGTTGAGAAGAGGCGCGCTCAGCTGCGACGTGCCCAACA
ATCTTATCGAGATCGCAAGGACAAGTACACCAAGGCGCTCGAGGCTGAACTAGCACGGTCTCGGAAGAGCGAGGCGGGC
TTGACGTTCCAGATCGAGCAGCTTCGTGTCAAAGTTCAGAAACTGGCCAGTCTCTTGTCCCAAAATGGCATCTCACTTC
CTCCAGATTTTGACAATGAGGAACAACTTCATGATGATGTACCGCGTATAGATTCATCTCCGCTCACAACGCGTGGACA
ACCACAAACCGCTGAAGGCTTCCTATCAAGTACAGATTCAACCTCTCCTGAGTCGGTGACGGACCAAGGAGCTATCTTA
AATAGTGGAAACCGCACTCTACGGCAGTACAGTTCGAGAATCTTTTCCCGACATCATGAACCGCAGGTTCCAGCGCCGA
CGAGGACCGTCCAAGATGAGCCCGGTGACAGGACTCGCCTTGCTGAACTTGATCCCACACAGGTCGGAATGGAATTTGT
GCTCGCACTAGAAAGGCCTTGTCTAAACCATCTTCATGGAAACCCCAAAAAGCCCCTAGAACCACACGGCCATGCCTTG
ACACTAACAGTCCAGCTACAGGCCTCCTTGTCACTTCCTCCGATCGATCCAAAGAACCCTGTACCTCCGTCATACCACA
ACGCTCCCGCAGCCGTACTCGATCGCCTATTGAATCTTGCCCCAAGTGTATCACCAGACGGCGACGTGACGCCGATCCA
AGCGTGGCATTTTATCCGTCGCCAACCGCAATTCGGATATTTCGAGGTGCAGCGCCTCAACAGGCTGGCGGAGAGGTTA
CGGGAAGCAGCAAAGTGTCACGGGTTTGGTGCTGCTGTTCAGACGGGCATCTTTGAATCGGCTGTACGGGAAATCCTCC
ACCCCTTGGCTATAACAGCAGCTTGACATATACCCCAGAAATGGGGCTACCTAACCTACCTTTTCTTCTTCTTACAATT
GTTAAACATTATTTACTCAAGTATCCCATACATGGGTCACTGGCAATATTACATGGAGAATGATCTCACCAGAACGAAA
```

FIG. 1 continued

```
CAATATATACAACTGCATAGAACCGTCATTTTAAACGTGTTCCTTTTTCAAGATTGGTACTCGAGATGAGAAGTTTTAA
TAGATTTTTTAATATCATTCTTCACCATTCAAAAAAAAAAAAAAAAAAAA
```

> SEQ ID NO:3755 219136FL *Trichoderma harzianum*
```
CTCTTCCTCTGTCTGCTATCTTTCCTCCTATCTCAGTCACCCATCCATCCTTTTCCTCCCATCTTTTCACACATTATTA
CAAAATGGGCGCCGCCGACAGAATTTCCCAGATTGGAGGCCAGATCTCCGGCAACCCTACCGCCGGTGGTCGCGACAAG
ATCCTCGAGAAGCGCCCTGACGATGTCGTCGTCACTGCCGCCTGCCGTACCGCCTTCACCAAGGGCGGCAAGGGTGGCT
TCAAGGACACCCCCGCTGGCGACCTTCTCGCTGGTGTCCTAAAGGCCATCATCGAACGCTCCAAGATCAACCCTGCGCT
CGTCGAGGACGTCGCCGTCGGCAACGTGCTTGCGCCGGGTGCCGGTGCCACTGAGTTCCGCGCCGCCGCTTTTGTCGCC
GGCTTCACAGAGGAGACGGCCGTGCGTGCGGTCAACAGACAGTGCTCTTCTGGCCTGCAGGCCTGTGTCGATGTCGCGA
ACCAGATCCAGGCTGGTATGATTGATATCGGTATTGGTGCCGGTGTGGAGAGCATGACCCTGAACTATGGCCCCAACGC
CGTGTCCGAACTCTCCGAAGACTTCCAGAAGGTCAAGGAGGCTGCCAACTGCAAGGTCCACATGGGTGTTCTCTCCGAG
GCCATGGCCGTGGATCTCGGCATCACCCGTGAGACCCAAGATGCCTTCGCCGCCGCCTCATACCAAAAGGCCATCAAGG
CCCAGAAGGAGGGTCTCTTCAAGGACGAGATCGTCCCCCTCAAGGTCCGTGTCCAGGACCCCAAGACGGAGGAGTGGAA
GGAAGTTGTCGTCGACCGCGACGACGGCGTCCGTGACGGCATCACCGCCGAGTCCCTGAGCAAGATCCGCCCTGCCTTT
GCCAAGAACGGCTCCATCCACGCCCGGAAACGCCAGCCAGGTCTCCGACGGCGCCGCCGCCGTGCTGCTCATGCGCCGCT
CCACCGCCGAGAAGCTCGGCCAGACCATCCTCGGCAAGTACGTCGCCGGCGCCATCGTCGGCGTCGCGCCCCTGCTCAT
GGGTCAGGGTCCCTGGAAGGCCATCCCCAAGGCCCTGCAAAAGGCAGGCATCTCCAAGGACGACGTCGACATCTTCGAG
ATCAACGAGGCGTTTGCCAGCCAGTGCCTGTGGTGCGCCAACCAGCTGGGCATCCCCCACGAGAAGATCAACCCCAAGG
GCGGTGCCATTGCCTTTGGCCACCCCCTGGGCTGCACTGGTGCTCGGCAGGTTTCGACGCTGCTGTATGAGCTTAAGAG
GACGGGTAAGAAGGTTGGCAACACATCCATGTGCATTGGCACTGGTATGGGCATGAGCGCCGTCTGGGTTGCCGAGTAA
AGTGGATGATGATTAATAGGTGCGGGTATATATGGGATGAATGTGTACGAATAGAAACGAGTCTCTTGTTTATGTTCT
CGTAAAATGCAGAGAACAATCTAGCATAGAAATATTGAATACCTGATGTTAAAAAAAAAAAAAAAAAAAA
```

> SEQ ID NO:3756 263681FL *Arabidopsis thaliana*
```
CTGCACATGATAGCTTCAGAGAGTACCAAGAGCTGGGAAGCTAGCGCAGTCAGACAAGAGAATGAAGAAGAGAAGAAGA
AACCGGTTAAAGATTCCGGTAAGCATCCGGTTTATCGGGGTGTCCGAAAGAGGAACTGGGGAAAATGGGTGTCCGAGAT
ACGTGAACCTAGGAAAAAATCCCGAATATGGCTAGGAACGTTTCCTTCCCCGGAGATGGCGGCGCGTGCACACGACGTA
GCCGCTCTTAGCATCAAAGGAGCCTCCGCTATACTCAATTTCCCTGACCTAGCCGGCTCTTTCCCACGCCCTAGCTCGC
TTAGCCCTCGAGACATCCAGGTCGCGGCTCTCAAAGCCGCACACATGGAGACCTCACAGTCTTTTTCTTCTTCTTCTTC
TTTAACGTTTTCATCTTCACAGTCTTCTTCTTCGCTAGAGTCTCTCGTGTCTTCCTCCGCGACCGGCTCCGAGGAGCTA
GGGGAGATTGTAGAGCTCCCAAGTTTGGGATCGAGCTATGATGGTTTGACTCAGCTAGGTAACGAGTTTATATTCTCTG
ACTCCGCAGACTTATGGCCTTATCCACCGCAATGGTCAGAAGGTGATTACCAAATGATTCCTGCCTCGTTATCACAAGA
TTGGGATCTTCAAGGACTGTATAATTATTAAGCGGCCGC
```

> SEQ ID NO:3757 213052FL *Trichoderma harzianum*
```
CCCACGCGTCCGGCACCAATTCCCAATTCATCTATATAATCTTCTATATCCCGATCGACACCACATCACATCCCGCCAT
GGCCGCTCCGACAGAAGCGCAGCTCGCGCATATCCAGCTCCTCGAACAGCTCGACATCCACTCCATCCACAAGAACTTC
CGCAACCCCAACTGGAAGCCCAACCAGCGCCGAAACAAGAACCTCAAGGCCATCGTAGGCGACGCGTCGAAACGAGAAG
CCTCTGCCCTTGCGACTCCACAAGACGTCAGCGGCGATGCGACCCCAGCCGCCGACGATGGCCTCTCGACCAGCGGCAC
CTCGACGCCGGCCACAAGCACCAATGGGAACCCGCCGCCGCCGAATCTTGCGCAGGCTTCGCGTAGTTTGTCGAAGCTC
GTGCTGGAAAAGACGTTGAAGCCGCCTGTGGGAGGGCTGGAGCTGTGTCGGCACCAAACGCGACGTACACAAATATTG
AGTCGGCGCCTTCATTAGCACATTCGAAGCACTACTGCGATATTACGGGCCTTCCGGCGCCTTACTTGGATCCCAAGAC
CAGGCTGCGGTATCACAACAAGGAAGTGTTTGGGTTGATCAGAGCATTGCCCCAGAGCTCTGCGGAGCAGTTCCTGGCT
GCTCGTGGCGCGCATACGGTGCTGAAGTGAGCGCGCTGGTGGATGATTATACGAGTTTGAATATCAATAGCACATCAAC
GGCTTTTTTTTCAGGAAGGGGGGAATTCACCAAGCACAAAGGAAGGGTATTTTAAAATCTATCGCAACGGCGCACTGGG
GTTGTTTATATTTTACACTGGCTTTTATATGGGAGAAATCATGTTGGATCCACAAAGTCAAGCCTCAACTATGCACCTC
CCGCCTTTCGGCAAGAGGATGGCAATTGACGCTCCGGCTTAATCGGAATCGCGAGCTTGTTCTTTGCCCTGAACGAGTA
CCGAAAAACGTATGGGGGAACGTCTCAGTTGCCAGAGCTGATATGGCGGTGGCTGTCAGGGCAAGTGGTAGCAATGAA
TAATAGCAAACGTTCAAAAAAAAAAAAAAAAAAAA
```

> SEQ ID NO:3758 214873FL *Trichoderma harzianum*
```
TCATGGTCGGCTCCGCCTCCGAGCGCGACGGCATCGCCAAGCACGGCGCCAAGCTCGTCACCGCCGTCGCTTGTGCTGA
TGTCCCCAAGTTCACCGTCGTCGTTGGTGGCAGCTACGGCGCGGGCAACTACGGCATGTGCGGCCGTGCGTACAGCCCG
```

FIG. 1 continued

CGATTCCTGTGGATGTGGCCCAACGCCCGCGTCGGCGTCATGGGCGGCGAGCAGCTCGCCTCCGTCATGGAGACGGTCG
GCAAGTCGGTCGACCCGGAGCTCAAGGAGCGCATTGAGAAGGAGAGCGAGGCTACTTACTCCTCGGCCCGTCTTTGGGA
CGACGGCATCATCCCTCCCCAGCACACTCGCCAGTATCTCGGTCTCGGCCTGAGAGCCGCCATGGGAGGCCGCAACGAG
GTCAAGGCCGGAGACACCAAATTCGGCGTCTTCCGAATGTAAGCAAACAAAGAAAAGACAAGAGAAAGAAACAAGAAAA
AATGTATCAAAAAAAGATGTAAAAAGTAATATATACTACACACTCATGTAAACATGCAAACAACCCCGTGTCTTTTTGA
TAAAAAAAAAAAAAAAAAAAA

> SEQ ID NO:3759 215033FL *Trichoderma harzianum*
CACCTCGGTCTCTACGCAATCGCGACTGCATCAGAAGCATTCAATTGCTCGTCAACGTCAACATGTCTCTCGCACAGTC
TATCTACAGCACCGTCTTCCGCAAGAACTTCACCATGCTTGCGGCCGTTTTCGGTGCCGGCTTCGCTTGGGAGATCGGT
TTCAATGCCACCATGAACAAAATCTGGGACAGCAACAACCGAGGCCGCCAATGGAAGGACATCCGACACAAGTACATTG
AGGGCGGCGAGGACGAGGAGTAAGATCAACATGCAAATTCCGGTTGCTACGGCTAGAATGGGTGTGGCATGGGACTGCC
TGGGGAAAATGTACAAAACCAACGAGAAATAGAATGATTCAAAAAAAAAAAAAAAAAAAA > SEQ ID NO:3760 215296FL *Trichoderma harzianum*
CCCACGCGTCCGCCCACGCGTCCGCGCAATCGAAAAAGGATTAATCGCAACTCCGAGATCCTGCTGAATCACAATGAGA
CCTACTCAGGTTCGTCTGGGCGGCGGCGCCCCTCAACCCAAGACTGGCCACTGGCTCGGTGACTGGGGCTCCTTTGGTG
GTGCCAAGCAGAAGGGCATTATCGACTACGGCCTGTCTGCCAACCGTCAGAACCCCTTTGCCGGTGCTGCCCACGATGC
CATCTTCAACACCTTCCGCCGCACCAAGTCCCAGATCTTCTACTGGCTCCCTCCTATGCTGGCTGGCTACTACCTGCTG
AGCTGGGCCACCGAGCGAAACCACTACCTCAACTCCAAGGCTGGCCGTGCTGAGTTTGCCGACTCGGAGTAAAATGGTG
CACGAATATGTTGAATTATGGGTGTCCAGGGGACACAGTGTATATCAGCGTCTAGATTAGGAGAAAACAATAGAAACGT
TTGACTCTACGAAAAAAAAAAAAAAAAAAAAA > SEQ ID NO:3761 215667FL *Trichoderma harzianum*
TCGACCCACGCGTCCGCAAACATCTCGACTCCCTACAGCCAAAAGCTTCTCTCATGTCCGACTACGCTCCTCCCACAGG
GCCTCCGCCGCCCAAGGCCCCCGAAGTTCCCGCTGGCTGGGCCGCCCGGTGGAACGACCAATACAAAGAATGGTTCTAC
GTAAATATCTACACCAAAAAGTCCCAATGGGACAAGCCCACCAGTCCTGTCTTCCCTGACGGAGACGCCCCGCCTTCCG
GGCCTCCCCCAGGCTATGACGGCCACAACGCTCCCCGCACGTCCGATGCCAAGACGAACCCCTATGGCGATCAGAGCAA
CAACTTTGGAGGCTCATCATCAAGGCAGACGCAGGAAGACGAGGATGCTCGCCTGGCAGCCAAGATGCAGGCCGAAGAA
AATGCCCGAGCTCGCAGCGCTTCTTCCAACCCTCCCGGATACAACAACTATTCCGGAGGCGCTGCCGATTCGTACCGCC
AGCAGAGCACCAGCCCGTACCCTCCCCCGCAAAGCAGCCCGTACGGTACACCCCAGCCGCAGCAGCAACAGGGCGAATC
GAGAGGTCTTCTGGGTAAGCTGACCAGCAAGATCGCTGGTAAATCTCCCGGCGGCTTCCCCGGTGCCCCCGGCGCTGGC
AGCTACGGGGCTACGGCCCTCCTCAGCAACAATACGGCGCCCCTCCAGCTCCATATGGCCAGGCTCCTTCTCCCTACG
GAGGAGCGCCTGCTGCCTATGGCGGCGGATATGCTCCTGGATACGGTGCTCCTCCTCCTGCCCCTTACGGCCAGCCTGC
TTATGGCTACCAGCAGCCGCAGCAGCAGCCTGCGAAGAAGAGCGGAGGTGGTCTCGGTTTGGCCGGAGGAGCTGCCCTC
GGTCTAGCTGGTGGTGTTGTGGGTGGTCTATTGATAGATGACGCGATTGATCACTTTGAAGACGAGGGATATGAACGCG
GCTATGACCAAGGATATGACAATGGGTTTGACAACGGATATGATGATGGCGGCGGTGACTTTTAATTAGTGGACTAGGC
GAACTAGCTGCATATTTGTTAATGTTCATATATATATGTGATGCGTCGCTGGAGGAAAGAATTAGGAGTGGTAATTTGT
TTGTTTGCCGGATTGGTCTGTTTTTAGCTATTCACAAGACAAAGACTTGATATTGTCGTTTTGGCTAGGATTAGGAGG
ATGGCGTTACGGATTAACGCCAATCGCATGAAGCATGAAGCTGATGATACAACATAAAAAAGCCCTGAGATTTTTCAAA
GGTCCCTAGAGCTCTGCCTTGAAATCAAAAAGGATTATAAAGCATAGATGTACAATCTCCCAAAAAAAAAAAAAAAAAA
AA > SEQ ID NO:3762 215727FL *Trichoderma harzianum*
TCGACCCACGCGTCCGATGCTGCCGACTCGAGCGCTTCTCAAGCGCTCCGTTTGGAAAGGGCCAAACCTCGTCCCCCTC
TCCATCGTCTTCCCCAAGGTCCCCAACGATAAAGTCCCTCCCGTTCGAACACAAGCCCGCTCAGCGACCATCCTGCCCA
ACTTTGTCGGCCTCAACTTTGAGATTCACAATGGCAAGGATTACCACCAGGTGACGATTACAGAGGACATGGTGGGGCA
CAAGCTGGGAGAATTTGCGCCCACGCGGAAACCGAATATTTGGGACAGGAAATAGACAGACTGAAGGGAATGGAGAAGA
GAGGATGAACATGTACAATTACTTGTATCAACGCCGTAATGCCACGACTTATTGCATGCTTTGAATCATTGGCACAAAA
AAAAAAAAAAAAAAA

FIG. 1 continued

> SEQ ID NO:3763 215730FL Trichoderma harzianum
GCAACAAGGATATCCGAAAGTTCTTGGACGGTCTGTACGTTTCCGAGAAGGGCAACGTTGTTGAGGAGGCTTAAATGTA
CCGGACAAGGATCTCTGTTTCTTTTGCGTTTCTGGGACTCCGGAGTGGCGAAGGTTCATCATTGCATGTCACGTAGCAA
CGGGGCTACTCTTTTACAAAAAATACATTAAAAAGTAAAGTGAAAAAAAAAAAAAAAAAAA > SEQ ID NO:3764 215810FL Trichoderma harzianum
CGGCGTCTCCTACAAGAAATCGTTCGTTTCCCTCTGTCATTGCGAGCCTGTTGAGCAACACAACAAAAAGGCGTCAACA
CACAAAGATCCAATCGCCAGATCTAAAGCCTCTGTGCTACTCAGTCCAACAATTGCACAAAGCGACACAACATACCGAA
AAAAAAAAAAAAAAAAAA > SEQ ID NO:3765 215885FL Trichoderma harzianum
TAATTGACTACTATGTGGGCATTCAATAACTCAGTCACATGCCAAAGACCTCCCCATCCATTGCATCTCCCTCAGTGAA
GAACAAAGCAGTTAGTTGTTGGCACTTTGTTCACCCATCAACAAAAAATTTCTTGCTCCAGGAATTGAAAGCCCTAAAG
GGAAAAAAAAAATTCAACAGCCGCGCATATAGCTCGTGACTCGACCACAACGTGAGCTAGTCATACGATAAAGCTGGGG
AACCAACAACGTGGGCAGATTTCCCCCCAGGACTCGGCCCACTTCCCCAGACTCCTCCAGACTCCTCCGCAGAGTGGAA
GATGCATGTTTCTTCCAGGTTCTGTGCCGAAATAAGCCTCTGGTATACTTAATGGCAGATGTCGAGCTCGCACAATGCA
GTAAAGTAATACCGAGCTCGCCAAAGCCCTCCAAAGCGGCATCATTGGGCGAACTCGGCTATATGTCTACGTGTTGGAT
AGAATAGAGTGACAAGTCACGATCAATAGTACTTTTTACAATGCAAAAAAAAAAAAAAAAAAAA > SEQ ID NO:3766 216057FL Trichoderma harzianum
CCTCAATCTCGGCGATTCAATATCTTTCTCTCGACGTGGTTCGATTTCGATTCGACGTATCGGTGGGGGGGCATGAATA
AGGTAATGGTTGTGTTTAGTTGGGCTCGAAACTAATGTTACCCATCAGTAGTATCACCTATTGCTGACGTCGGCTTGAG
GAAGTGGGTTCAATCGTGATACATTCGGCTCGTACAGTGCAATACAGATAAGATGATGCGATCAGAGAGGCAATTGTTA
GGTCATGATTGACGGAGGATTCGAGCCGATGATGACAAGGCGACAAGAGCTGGGCAATCGACCCCAATTGGATGATTCT
GGCACCCCAAGCTGTGAATTCGGCTTGACCTTTGAACATCAACTTGCTGTAGGGTAGTGCAACCTTGGACGTAAAGAGA
AGGCAGCGTCAGCATTTGTTAAAAAAAAAAAAAAAAAAAA > SEQ ID NO:3767 216062FL Trichoderma harzianum
GAACATTCAGCCTTGTGCAGGGGAAGCAGAAGATCATATAGAGCATTTATCAAGCGAATAACAGACCCTGAGACACTGA
ATCAGAGAAGCTTTAGAAGCTCTTCTTCTCTGTCTCCGCGCCTCTTATCGCAAACAGCCCCTCTACTGCTGCTGCTG
CCTTTGTCAGGCCTGTCTTTCAGTGTCGCATGCCCCGCCTCATCTTTCTACCTTGCACAACTCAGCCTTTGCGCTAAT
CAACGACATCTGCGATCTGTGTCGGCAGCAGAAGAGTCCCAGATCACTGTCTCTCTTTTATTCTCCTTCTTCTAAACAG
ATCTGTGTTGCCCCCAAAGCAAGCGAGAATACGTCAAGATGGCTCTTCCGAAACGCATCATCAAAGAAACCGAACGCCT
TATGGCGGAACCAGTTCCCGGAATCAGCGCCGTGCCTCACGAAGATAACCTGCGATACTTTGACGTCGAGATCCACGGC
CCTGCATCGTCACCATACGAAGGCGGCATTTTCAAGCTTGAGCTCTTCCTCCCAGATGACTATCCCATGACTCCGCCCA
AGATTCGATTCCTTACTAAGATTTTCCACCCAAACGTTGACAAGCTGGGCCGCATTTGCCTGGATGTGCTTAAGAACAA
CTGGTCTCCTGCGCTGCAGATCCGGACGATTCTGCTTTCTATCCAGGCCCTCCTCGGTGCTCCCAACCCCGATGATCCT
CTTGCCCCCGATGTTGCTAAGAGCTGGAAAGAAGACGAGGCGGCAGCCATAGCAACGGCAAGAGAGTGGACAGAGAAAT
ATGCAAAGGCCTAGACTTAGAATCGGAAGACGAGAGGCAAGAGGAAGAAAAGAGAGATATATGAAGATATATTTTCAAG
ACCTGCGATAAGTTTTGATATCAAAACGGAAGCTTGCTATGGGGTACGAACATTATTATGGGAGGAGTTGAGAGATTAT
TCTTTTTTTCCATTTTCTTTGGCTTGGTTGCAAATATTTTAGAAGGCTCAAATTTGTTTCGAGATGAGCCGCAAGCGTT
ACTGTCCGCGCTTCTATGGTGTATGTTTTAGATAGTACAAGTGGTCTTGCAGCAGATATACCACTGGCGCAATACATCA
TCACATTACACTTGCTGTTTAGAAATACAAAAAAAAAAAAAAAAAAAA > SEQ ID NO:3768 216079FL Trichoderma harzianum
GTTCTTGTCATTAATTAACTCGACCCACGCGTCCGCTCACATCATGTCCAACACTGGAGGTATCAACTATGCGGCGACG
TTGAATGCCTACCGCCTTGTTCACGATAAGCCGATGCCGCATCACTTGCTGGTTCTCGATTCTACACCTGGAAGCGCCA
TCTTGACCCGCGAGAACTTGGGCCGCTGGTCGCATGCCCATGGCCCTGGGCACTGCAAACTGGTTCCCTTGGCCATTTGC
CGTCACACAGACGCTTTGGGCTGGATTCCTCTGCGGAAACCGCTTCATCGAATGGGTCATTGGCAAGGAGCCCGCGCCG
GTGTTCAGCGTCAAAGCGGTGATTAACCCATACTACGAGACCAAGGATACGCGCACACTTGTATATCTACAGCGAAGATG
ATGATCTCATCCCGTATCAGGAAATTGAAGAGCACATTGCACAAGCACGGAAAAGGGGATACAAGTCTGATAATCACAT
GTTCAAGGGAAGCGGCCATGTGCGCCACATGCAAATGTTTAATGGAGAGTACTGGGGAGCTATCGGAACGTCGTGGAAT

FIG. 1 continued

AGAGCGACGAGCGAGCCTTCTGAGGAGGCGTAATGGGTTGTGCTCAAGGCCAAAAGGGGTCAAGATGGAAATTTGCGTT
GCTTTCTATAGACGAACTCGCGTTGCTTGTTTGCGTTCCTTGCGTTATACATAACATAATCGATCTAGAATGTTGCTGG
TTAAAAAAAAAAAAAAAAAAAA

> SEQ ID NO:3769 216130FL Trichoderma harzianum
AAACAACCATGCCTCACAAACACAAGTCAAAAAAGGGCGAATTTGAAGCAGAATTCGATCTCGCCCCTACAGAGAAAGC
GCGATCTCTTCCAGTAAACAAACGAAAAGCGGCATCAAGTTCTGGAGAGCAAGTCACAAAGAAGCGTGCCAGAAGCTCA
TTAAGAGGCAATGACACTCCGCGAGCATTCAAGAGAATCATGGCTGTGGCAGGGGGGAAGAAAATTAGATCAGGCTTGG
ATGATGGTCAACTCGACAAAACGACTACGAAGGCTACCGATGTAACGAGCGAGAAACTTCAAATTCGTCCCGGTGAAAA
TTTAGGGGCCTTTGCCAGCCCGGGTTGATGCGGCTCTACCAGTATCAGGGCTTGCGAAGAAAACCAGCACGAATGCAGAG
GGCAAAGACGCATTAGGATTGAAAGTGTATCGCACTCGCAAAGAGCGCAAAATGCACAAACTCTACGATCAGTGGAGGG
CAGAGGAATCCAAGATACGAGAAAAGAGGGAGGAGGAGCTAGAGCGCATAGCAGAACGCGACTTGGAAGACGATGCTGC
CGGCATTCTTACTTCAGCTGCCTTCGAAAACGACAATAGCCACACGAAAAAGAGGAAGGGGGCAAGAGGAAGAGAATA
GTAGAGGAAGACCCTTGGCTAGAATTGAAAAAGCGAAGAGGAGAGAAAAAGGCAAAGGTTCATGATGTTGTATTAGCAC
CGCCGGAACTTCATAAAGTAGAATTAAAATAAATAGTAATATTAATATTAATAATATAAGAAAAAAAAAAAAAAAAAA
A > SEQ ID NO:3770 216332FL Trichoderma harzianum
ACAAGACCTTGTGTTGCTTTCTGACCAGCTTGCCGAGAAGCAAAATGAACTCCGTAATGAGATTGAGACCAAGGTGCAG
AATCATCGGAGGTGGAACCAGAATCATATTGATCTCACTCGAGATCCGCTTTCGCCGGTAAAAGCATTGGGTATGGAGC
TCAAGTTCAGACCGGCAAAGACGCAATACTTAATGACGCCGCCGGCGTCAACGTCTTCAGAGTCGATGGATGTCGACGA
CGTACCTGAGCCTATGCAACTGGACAAGCTAGAGCTGCCAGTATTCCAGTTTCGTGGTGCGGACGTCGACGAGACACCG
CAAACTAATCAGCCGGCGTTCCGACGCCGTATCGGCCGACTCCAACGGCTCTGGATCGATCGAAGAGGTCTTTCGACAC
CTTCTAGGGCAGATGCGTACGAGTACTCGGACCGGTGGAAGTATGATTCTGATGATGAAGACGATGAGCCTCCCGTATA
CGAGGTTGATCCCTTTGACACAAGAGCGCTGAAGTTTAGGGCTACTATCCCTCTCAGCCCATACATCTTCCGGGCGAGG
CCAACGGCCCCTACAGAAGCGGTAAACGGCGTAGCAAATGGAAACAGAGTGCTACCGCCGCCGCCACAACCGCAACAGC
AGCCGCAAGTGCCGCACCCTCCTGCAGTCCAACAGGCGCAGGCGGCATCATAAAGAAACCCCCTCTCCCCGATGAATCC
GGTACTGCATCCCTGTATGAGTATGGGTGTGTGGAGGTGTATATAATTTTCAGCTCTCTTTTTTTCTCCAATCACGCTG
GTATTGAAGGGTTCTCAGGAACGGACAGGGCGGGGGGAGGTTTGGGAGGAGGAAGGAGGAAGGATATCTTCGAGGTAGA
TGGAAACGACCGAATGTATAGTACCTTAGCCTTGGTAAGGCATTGCGAGGAGTTGGGGAGTTGGGGTCGGTGCTTTAGG
ATTAGAAGAGGAAGAAGCCCCCCCAACGGGAGCAATGAAGTAAAGAAAAAAAAATCATACGAAACCTCAAAAAAAAAA
AAAAAAAA > SEQ ID NO:3771 212347FL Trichoderma harzianum
CCCACGCGTCCGCCCACGCGTCCGAAACAACCTTCTTCATCAATTCTACTACAACGACCTTCCTACTTAAACAATCTCT
CGATACCAACTCCCCAAGATGAAGTTCACTCTCGTCCTTGCTACCTTTGCCGCCGTCGTCTACGGTCAAACCATCGATG
ACATTCCCGCATGTGCTCGTACTTGCATTGAGAACGCCGTTCTAGCCGCTGGTTGCTCGTCTGGAACTGACGTCGCATG
CGCTTGCGCACATTTCACTGCTGTTCAGAATGGCTCTACTAGCTGTGTCATTGCTGCTTGTGGCGTTTCTGTCGCCATT
AACCAAGTTCTGCCTGCCACCCAGGCTCTTTGTGCCAACCAGTGAACTCATCCATCGAGAGGGAGAAAATGACATGGGA
GAAAATCAGGTACTCTTGTACATTGACAAACAAGTACATAGCTGAATGGTGTGAATGAATAAAACGCATTGCTGCTGGA
TAAAAAAAAAAAAAAAAAAAA > SEQ ID NO:3772 212444FL Trichoderma harzianum
GTGGCGGGTTTACATTGATAAGTGACGGATATGCATCCCGAAAATGACAAATTTGTAAGCATGTCACTGCCGGCAAAGA
ACCCTGAATGCTCTAGATGCTTCCGAAGGATTCTCCATAAGATGATATCCCATGCAGTTTGTGCCAAAATGGGTTAACG
GACGCCCGATTCCGTGGGTGTGCATTTGATTGAGACCCCCATGTTTGCAGTGAATCGGTTGGGTAAGATGCATTGGAGA
GGATGTACGTAGGAGGTTCATTTATTGCCAAAAAAAAAAAAAAAAAAAAA > SEQ ID NO:3773 212646FL Trichoderma harzianum
GATGAGGACGATGTTGAGGATGTGATTGGAGAAGACATGGACGAAGACATTTATGATTAAGCGGATTGATCAATCCAGG
AAACAAAGTTTCACCCAAAAGTTATTTTTCTTTTCTCGTCACGGATATGGCATACGGAGTTTCAGGAGGAAATGGGGAA
ACCGTTTTTGGTTTGAGTAATTACTCATAAATTGGCCCTCTATAATGTATCATAACTAAAAATGAAAATATTGTTCATT
AAAAATGAAAAAAAAAAAAAAAA

FIG. 1 continued

> SEQ ID NO:3774 212755FL  *Trichoderma harzianum*
GAAAGGCGAGCGGTGACACAGAGTTGACTGAAGGACGGACTTATGACATGGATATGATGATTACTTCAAACCTTGAAAA
CCCTTGGTAGCACAGCATTTTTGTAAGTTGGGCTCGTACCTACATTGTATGGGTCTGTTTACTATCTACCGAAGGTATG
ACTATGATGCAAGCAGCGGTTCCGGATATTCGGTCGATACAATGGCGCGAGCTGCTTGGACAATGCCGCTTCGTGTAGT
TACACAATCCGCGCATGCAGGTATTCGTACATTTACCTAAGGTGTTTTATGCTTGATGCGGCGCCGGACTGGTGCTCGT
ACCTGTATGGTGAGAGATTGTGGGGGGTGGATGCGATGCCCGTCCCGAGGCTTCTGAGACAGAGCCTCTGATCTGATGA
TGCGCATCGTTTGAAGAAAGAAAAACCGATGAGTGATAACCAGGGTGTTTTGGTGTGTGTACGCTCGTAAAAAAAAAAA
AAAAAAAAA > SEQ ID NO:3775 212756FL  *Trichoderma harzianum*
CCTCGACCGACGCTCGGCAACAATGGCGACAATTGCAAGCGGCTTGCGGCATGCGAGATGCGCAAGCTCGATTGCTGCA
GCTCAATGGCGGCCGGCAATCTTCCCGCGGTCGAACTTTCAACTCGCCATCCGGTCTATAACCAGCGACTCTCAAAAGC
CTCCCAGTCTTGAACTTGAAGCCGCCGAGTCCGTCCCGATCCCATACCAGGGCGTTACGCATGCGCGAGTTGTTCCGGC
GACACCATCTTATTTCTCAAGAGAACCCCAGTTCAACGATTTATACATTGGAATCTCCAAGCTGCTCACCAAGTACAAC
CACCTGCCCACAGTGCCGCCAAGTGAGGCTCCGCAAATGCCATGGACAAAGCTGGAGGAGATGCGGGCGCAGATGGGAG
AGCCCATCAAGTCATCACACTATGCGAAGGTCATGCGAGTGGCCAAGCGCTTGAACCTCATCGAGCCCAGCCTGCGGCC
GC > SEQ ID NO:3776 212794FL  *Trichoderma harzianum*
GTTGGGTCGTGTTGATGCCTCGTTTTGGATATGCATCGTATACTTGCTTGGAGGAGATGAGGTTTGTGCTGAAGAGAGA
GAGACAGCTTTGAGAGTCTTGCTGTTTGTTATTCCGTGGGGGTATCTCAATTCGAGGATGTATTTATTTACTAGATGCT
AGCATGAATTTTTTTTTGATCCTTGAAAAAAAAAAAAAAAAAAAA > SEQ ID NO:3777 212858FL  *Trichoderma harzianum*
CTCGTGTGGCGCCTTGTCTCAGGGACAACAGACGACGAGCAACTCAAAGACCAGAGCTAAACATGGCTTGGCTAGATGG
CAATAAGCAGAGCACGCTTCAATCGAGAACAGACGCGCTCGACAATAAAGGATGTGCTACGGCACAGCCATTGGGACAG
ATGATGTCGCGGTTCAACGGTAAGTCTTTTGATCTTGTTGATTGAGCATCATAACGTGAGGCCGGCTCTAGTTGTTCAG
GACGATAAATGCCACTTGCAATGACCGAAGCTGTTTGAGTCTCAATACACTCTGTACCAGATGAAAGGGCTTCTATGTC
TGCTAGGTTTTCATAGATTTGTCATAGTTATGACTCCTGAAGAAGTAGTTGTACTGCGAAAAAAAAAAAAAAA > SEQ ID NO:3778 212892FL  *Trichoderma harzianum*
CCCACGCGTCCGCGCATCTTCACCAAGGCGCCGTCATCGCGCGGCATCATCGTCATTGACTTGAGCTTGGAAAGCTCAG
CAAGATGCCAGCAACCATGGCCCCTCCAACGCAGACTTTCAACCTCGATGTTGAGGCAATCTCGGGCATTTGCGGATCT
ATCTCTATAGCCTGTTGGGTGGTCGTGTTCTCTCCGCAAATCATACAAAATTTCCAACGCAGCAGCGCCGACGCTCTTT
CGATTCAATTCATCATTGCTTGGCTCCTAGGAGATGCTTCAATATCCTCGGAGCCGTTTTACAGGGAGTTCTCCCCAC
CATGATCATCCTAGCCATCTACTACACCATTGCCGATCTCGTACTGCTCTGCCAGCTGTTTTACTATCGCGGATTTACG
TGGCGCGACGAGCCGACTCCATCCCCGCCCAAGACAAATGGCCACTCTTCGACATCAGCGGCCGC > SEQ ID NO:3779 213063FL  *Trichoderma harzianum*
ATTGAACGCACAGTAAAAGTGCCACTGGATAGGGACGAGGATGTTCAAATAGCCGACTCAGCAATTGCACTCAAAATGA
TGATTGACCAAGTGAGTAAGAACTGGTGAGTATAGCGAATTGAGAAAAATAAGACAAGGAGGGGGCTATTAGGGACCA
TAACTGTCTCGTAAATTAAGAGTTGTCTAGCTAATACACTACGAATGTGTATGTAATGCAAAATTTGGATGAAAAAAAA
AAAAAAAAAAAAAAAAAAAA > SEQ ID NO:3780 213084FL  *Trichoderma harzianum*
CCCACGCGTCCGCAAAACAACATAAGCCCAACAGTTTAAAATCGATCATCGTCAGGTTGTTCAAAGCCAAGATTTAGAA
TAATCACCTATGCGTGTAATTAGTACGGTTCAGAGAAGATGCAACCAACTCCAAGTCAGGTACAAATTTCAATGATTCA
AAGACTGGTATATATGGCCTTGTTTTGCAGAGCATCAAACTTTCTGCCGGGTCGGTACCTAACAAAAAAAAAAAAAAA > SEQ ID NO:3781 213133FL  *Trichoderma harzianum*
CAGAATACATAAAGGAATCAGCCAAAGCTCGCGCGTTACCCCGGGGGTTTGGTTCTCCATCTGACTGCTTTGTACTGCT
ACTACTGCCCGGAGTGCGAGTAACACCCGCTCGTATTATCGCGACGCCTTTACACTTTTGATTACTCGAGTTGGTCCCT
CCGATCTTCAGGGACCGTTTAATGCGGCTATTCTCCCAAGCGGAGCTTCGTGGTCTTAACGGTTGTTGCGTTGCCGAGC
CAGTCTGTGTATTAGTTGTGTCCCGAGCTTATTGAACCTGCTGCACGCACTTAATCCGCTTCTTTGCCCTTGATACCTA

FIG. 1 continued

CATGCCTGCATTTGGCAGCACACGCCACCTGGTACGTTGTATTTAGTTACTCTTAGTCTATGCAGACAACAACTTCTCT
CTCCCAACCAAAAAAAAAAAAAAAAAAAAA

> SEQ ID NO:3782 213137FL Trichoderma harzianum
CAACTTACAAATTACAACCTACAACTGCCCACAATGTCGCTTTCTGTTGGTGCTTCTCTGCGGCCTGCGGCCTTCCGCT
GCGTTGGTGCGTCTGCCGTGCGCATGCGATGTGCTTTTGGCACAACTGCGTCCAGAAGGAGTGAGAGCTCGACGCCGGG
CGAGCTTGGGGTTGGAGAGCTGCAGGGCGCATCGTTTCGCATTGAGCCTCTCCGGAGGGTTGGGGAGGATGCTTCGACT
ATGCGAGCGAGACTTTTATACCAATCTCGGAAGCGCGGAACCCTCGAGTCGGATCTTTTACTGTCTACGTTTGCCTCAC
AGAACCTGCCCACCATGACGGCCGAAGAACTGCGGCAGTACGACCTCTTCCTCGACGAGAACGACTGGGACATATACTA
CTGGGCGACGCAGCGGGAGCCGAATTCCACGACGAACCCTTCCGTGACGGCGAGTCCGGCGAGTGCTTCGGCGAGCGAA
GGGTTCGAGGCGAGACAGCAGGATGAGTTGCCCAAGAATCCGCCAAAGGGGGAGTGGGCGCAGACGGTGGGCAATTTTA
AGCCTGCGTATAGGCCGGTGCCGCAGAGGTGGAAGGATAGCGAGATTTTGGAGAAGTTGAGGGCGCATGTGAGGAGGAA
GAGTGTGAATGGGGGGAGGGGACGGGGATGGCGTTTATGCCGCCTTTGGAGTCGTGATTTTGACGATGGAGAAGGTGA
AAAGAGATGAAGTAAGGAACGGTAAAAGGATTTTGGGTGGGAATGTTACGATAGGGTTTACGAGATGTGTATAACAGGC
AGGATTAAGTGACGACGGAATGTCGCGGATAGAATCAAGGATCGTGGATCTTGTATGATCAAAAAAAAAAAAAAAAAA > SEQ ID NO:3783 213144FL Trichoderma harzianum
GATCACTCCACCACGAAGCACTTTTCAAACCGAAGACCTACACGCATCTTCATTTTCAACCGCCAAAATGGGTATGATC
GACGCCAAGAACAGGGTGACGGAGCACCAGCGCTTTTACCAGGCTGCGTACAAGGCTCACACCCGCCTGTGGAAGATTA
ACCCCCGAAGCAACTGGTACATGGCCCCCTACCTCGTCGCCCTCTGGGGAGGTTTCGGAGCTACCCTTTACGCTGCCAG
CCGAAAGGTTGCCGGCCACAACACCTGGTTCAGCAAGGATTAAAGTATCGGTATCTATGGGACGAGCCAATTGAGTTAC
CCCAACTTGCGTCAAATGCAAGATTGAGGGTATGTATGAGTTTAAAGTCTTATAGACAGTAAATATAGGATTTGTCAGT
CCGTCTCATACGTCTCGCTGCTAAAAAAAAAAAAAAA > SEQ ID NO:3784 213242FL Trichoderma harzianum
AAGAAACACAAACAAGCAAATCAATTCCCGAGCAAGAAAAAAAGAAGAAGCCCATCATGAAGATGCTTTCGTTTGCCGC
CCTCTCGGTGCTCGTGTTGGGCGCTTCGGCCCTGGCTGCGCCGCCGGCCCACCCCCCGGCCGACAATGGGTGCTGCTGC
TGCGACATCAACAAGAAGAGAATCGACTGCGACAGGTCGATCCCGGCGTCGGAGTGCATCTGCCCCCAGGTCATCTGCC
CCGCCGGCGCGCCCACGTTCACGCACGGCACGCCGCCGAAAGCCACCCCACCGCCCACGCCGCTGCCGACTTACAAGCA
GTGCTGCTGCTGCAATCCCAACATTAACAAGATTGTGTGCTCGCTGAGGCTCGTGGAGGACTGTATCTGCTTGGCCGTG
ATGTGTCCGACGGATGCAAAGACCATCTTTGTCAGGCCAACTGGCGTTCCGACTGTCGCTTAAGAGTATTCGTTGGCGA
GCCGACTTGCCTGAATCCTGGACCGGGGACATGACATGGGGGGAGGGAAAATACAGGGCAAGGCATTGCTGATGGTGAA
TGCACAACACGCGTGGCAGACTGGCCGAAAATTGATGATTTACTGATGGGCGACTTTGGACTTGAAATGGGGCATGCCG
GATGGGTTACTTGACAGTATTTACACCATTTCTATTCAACAATAAATGGAATCTCTAAAAAAAAAAAAAAAAAAAAAAA
AAAA > SEQ ID NO:3785 213287FL Trichoderma harzianum
CGCCAATCGGGAACAAAAAAGGGCTGCGCGTTCTTTTTGCCTCTCCTGACTCCTTACAGATGGGTGGCATTGCTAAGGT
ACAGTGTGGAGTCTGCAGTGGATTCGAGAGCTGCGATTTCAGTTGTTTGGACCTGGACGGAGAATTTTACGGAGCAGCT
CACCCTTGATGCAGTTTAGGTAGGCGGTGTCTCTTGTTGGCGTGTTTTATAAGAGCAACTTTGCTGGTGGTAATAATGA
TGTCCATGCTATTTTCGTATTTCTGGAATAGGTACCTGGTATGGCAAAGAGAATAGAATGATGGTGAATGAGATTACAC
AGTTCGAAAAAAAAAAAAAAAAAAAA > SEQ ID NO:3786 213354FL Trichoderma harzianum
GGAGTTTGTTCGTTTATTTCGTTCTCCCTAAGATGTTGCGGATCATGATGTAGTTGCTCTCCAAGTATACATAAGATAG
CCATAAACATAGCCACAGCAGCGCCCAACAACAACTGTGACCAAGCGTGGGTGGAAGTCTGGCTTCCAGCACAGTACTT
TGCATGATAGAGTCATGACAATGTCATGAAAAGAGAATTGTATGTACATGTCTTATATTTCCTGATACAGCTTGGGCAC
GGAGCGCGTGTGACGAAGGTAGGTGATGGTTGCTAGGTATAGGTAGGTTGGGATTGAAGTCACATGCTTCATCCTCACT
TGTATGAAACCCGTTTCTCAGCCCATACCAGCATATTTGAACCAGTTGGGACGGCAATCTTCTCGGTGGAGGAACGGCT
CACCATCCGTCAGTCGACCAGTAACACAGCCCTTGCATTTGGGAGAGTTGGGGCAGTTGAAGAAGGGGATGTGCTGGTA
GCCAATATCACGGAACCAGTGGATTTTGCTAGAATCCTCAAATAGACCCAGCGCAATGCTATGAACGGGAGCATCGCCC
CATCGCTCGTAAAAGAAGCCTCCCGCACGGTCGAGGTGCTCGAAATAGTCCTCGTAAGCCTTGCTCCTCCAAAACTCCA
TGTCAGCAACCTCAAAGTTGCTCCAGAAGTGGCAGGTGGAGAAGCCCTGGGCCTCTCTGTTGTGCTGCGGCCGC

FIG. 1 continued

> SEQ ID NO:3787 213387FL *Trichoderma harzianum*
CGACAAAACAGGATCTCCTCGTCGTCCAAATCCAACCGTCAAGATGGTCAAGGTTAACAAGAACATTTCCTCCTCCAGG
AGCAAGAGCCGTGCCGCTCACTTCAAGGCCGGCTCCGGCCAGCGCCGTGTCATCATGAGCGCTCCCCTTAGCAAGGAGC
TGCGCGAGAAGTACAACGTCCGCAGCATCCCCATCCGCAAGGACGACGAGGTCACCATTGTCCGTGGCTCCAACAAGGG
CCGTGAGGGCAAGGTCACCTCCGTCTACCGTCTCAAGTACGTGATCCACGTCGAGCGTGTCACCCGCGACAAGGCCAGC
GGCCAGAGCGTCCCCCTGGGCATCCACCCCTCCAACGTCGTCATCACCAAGCTCAAGCTCGACAAGGACCGTGAGAGCA
TCCTGTCTCGCTCCAAGGTCGGCCGTGAGCTCCGTGTCCCCAACAAGATCTCTGCTTAAATTCATAAGCAAATCTTAAC
AATTGGGTGAGACGAGGAGATGAATCTTTTTTTTTTCAACTTAACAGTTTTTCCATGTGATGCATCCATGGCACAATGA
TGGGCAAGGAATGGGCATATATACTCCGGCGTTTTAGCGATACCCGAGACCCCTGCAGGTCCGGCTTTCTCAGCAGGGT
AGATGAATCGAGAATTTTACAATTCTCAATGGCCGTTTCACCAACTTGTTGTGTGAAATGCTCCATGGGAGGTGTTTCC
CGAAAAAAAAAAAAAAAA > SEQ ID NO:3788 213388FL *Trichoderma harzianum*
GCTCAATGTAGGTCCCTGTATCTAATGTACTAAGGACGTGTACTACTGCACCTGTGAATGGGGGCCTGCTTTGTGCTCT
GGCTACCTTAGTGAATGATATCTGACTTTTGTTATTTGATTTAAATTGATTCATGTCTCGATTTGCATTTCTAGAGAAG
CCACAGGCAAAGGCGACAAGCCAAAAAAAAAAAAAAAAAAAAA > SEQ ID NO:3789 213728FL *Trichoderma harzianum*
GGCGTTTGTGGTTGACAGAGGGAGAGGCTGTGTTTGGTTGAAGGAGGAGAAGAAGAAGAAGAAGATGTGAAGAGGAAAT
GCCGAAAAGAAGGATGAAAGATATGTTCTTGTCTCGAGCTCTTTCCAATTGCTCTGGCCTTGTGCATACCATACAGAGG
CAGGCAGTCGCAAGACCAAATAACGAGGCAATTTGCAATGCAAAAAAAAAAAAAAAAAAAA > SEQ ID NO:3790 213738FL *Trichoderma harzianum*
CGCCTGCACAACACCATCCTCGGCGCCGCTGCTCCTGCAACAGCTGCAAGAGAGGTAGTCGTACGGCCGCGCCAAGCTG
CGCCTGAATGTCACCCGCGGCCGTGGCACCATGACGTCCCGTAGAGGCGATCTGCTGTCATACAACCACGTCTCCGAAA
ATAGCACCCTCTCGGGGCGTCTTGTCCCGAAATGTGCCGTCAGCCGCTCTGACACTGCGTCGACAATATCTGTCAATTG
TTTGTCTTCGTCGCGGAGGGCCGCCGAGTCGCGACTCAGCTGGACTCGCTGAGCAATCACAGTCGTCCGCATCACCTTG
CTTTGGCTGCTATATTTGGTGTGCAGCGTCATGCCAGCGCTCTCTGCGTCTGCTTGCAGCTGCTCCAGGCGCGAGAGCG
TCTCTTCTAGGAAGCTCAATAAAGCGGCATCTTGTTCCTTGGTCGAAAAAAAAAAAAAAA > SEQ ID NO:3791 213777FL *Trichoderma harzianum*
GGGGACATTATTCTGTTTTTCACCTCTTTGTCGTTGTCCCTCATACGGCTTTCGTAATTACGCCGTTATGTACCCATGT
CCTGTCTGATGCGTTGGTCACGCTGGTCGACGCTGCGGGGGGAAGGCAAACGAAGGCAACAGAACGGAAAAGGGAAATA
AAAATAAAAGTTGAACCTAGGGGGGTTTGATAATGGCCAGCGTGCGGCAGGCTTACAAAACAACGGGAAGATTTTCACG
TTGGGCGGGATTACGGCTCTGATTTGTTATTCACTCTAGCTACTAGTCATGGCCGAAAACAATAATGCCAAGGTTTTTT
CGGTCAAGCAAGGGAAAGAAAAAGCACAAGCCCAAGCTTTTTGGGGGCCCAGAAGGAGAGGAGAGGGAGAGGCAAACAG
GCAAACAAAGGTGAACGGGCGGGCTTTAGAAAACACCCATTCGGCATGTACCGTGGCTCGGATCTCATAAGCATCACGG
CAAAAAAAAAAAAAAAAAAAAA > SEQ ID NO:3792 213778FL *Trichoderma harzianum*
CCCACGCGTCCGCCCACGCGTCCGCCCACGCGTCCGCACGATAATAGCAACATTAATTGTTCTTCTTTTGTCTTTGTTA
TAGACTTGTCTTCCAAGCGACCTCTATTAGACTCCGTATAGAACTATAGAGCCACACGGAACAAACCCAATAGGCTATT
GCCAGCACACACACCCGGGAAAAAAAAAAAAAAAAAAAA > SEQ ID NO:3793 213803FL *Trichoderma harzianum*
AGACACCATATTAACTCCAAGATTCAGCTCCCTCAGCTCAGCAATAGCCTCAGCCTCAGCCTCAGCCTCAGCCTCAAAA
TAAAATGGCCGTCACTGGCCTTGTTGCAGTCGAGACGCTGCCCCGATTCCTCCTCCCACGGCTCAGCTGGACTGCGCCG
CTCGCCGCATCTCGATCTGCTGCAGCCCAACCCTTTGCCCCTCTACAAGCACGAACGAACCAAAGAGCAGTGCCCGCCT
TCAACACCAATTTCTCGGCCAGAAGATACAACAATGGCCAGATACCGGCGCTGAGGCGAGGGTTTCACGCGACGAGTCG
ACGATCCCGAGAGCATCATTTCGATACGCTCAAGTTTGTCAAGCAGCTCAAGGATGAGGGCTTACCGAGGAGCAATCA
GTCGCCATGATGAAGGTTCTCAACGACGTCATCCAGGAGAGCATCCAAAACCTGACCCGAACCATGGTCCTCCGCGACG
ATGCTGCCAGAACCACATACACGCAAAAGGTGGACTTCGCCAAGCTCCGTTCCGAGCTCACTTCGGCAGCAGCACCGA
GTCCAACACGACGCGCAGTGCGCACGAGCGCCTCACCAACGACATTGCCAAGCTCAGCAGCCGGCTACGAGACGAGATT
GGCCGGACCCAGGCCAGCGTGCGGCTGGACCTCAACCTGGAAAAGGGCCGCATCCGAGAAGAAGCCGTGGGCCAGGAGC

FIG. 1 continued

```
TCAAGATCAAGGAGACGGAGACCAAGATTGAGCAGGAGGTGGCGGCGCTGAGGGAGAAGCTGGAGCAGGTCAAGTTCCA
GACGCTGCAGTGGCTGATGGGTGTGTGTACTGGTTTTGCGGCGCTGCTGCTTGGTGCTTGGAGACTGCTCATGTAAGAG
GCATGATGCGTCCTGGGAGGGGGTGTTTTAGATGACGGGCATTTGTGAATAGTCGTGCATTATACAATCATCATCCGAA
TCGAAAGCGTTTATAAATAGTTTCAATATTGAAAAAAAAAAAAAAA

> SEQ ID NO:3794 213809FL Trichoderma harzianum
CGGACGCGTGGGCGACCCACGCGTCCGGGGGAGGTGAGGAGGGTTTGTATTCATGAAAGGAGATTTGCGCCTAAGCTCA
AGCGCAAAATGAATCCTGGGTCGGAGGTTTACATACAATTGCCTGTAACAGACTGAGCACATATGAGTAGTACCTTAGT
ACTGGATACTCGGTGGTTTGCGGCGCCGCGCTTTGCTGGAGCAAGTAGCTGGATACTTGCCTGCTCCGTTTGAGGACGT
ATTTGCCGGGATTGATTGGACAGGAAACGTCTAGCGGCGAGGCGCCTGGTGGCTTGCAGCAATGACGCAGGGTGGTGGG
ATGAGGGAAAGCGCACACGAATGGTTACCAGGAAAGGTTTAGCGCGGCATGGTTTGGGGAGGATTGTGGGAATGAATTG
ATTTGTCTGGGGGAAGGAGCTGAGAAACCGAAAAAAAAAAAAAAAAAAAA > SEQ ID NO:3795 213812FL Trichoderma harzianum
AGGAACATTACAGCCCATAGAAGGATTACAAGCATCGTGGCGTACTACCGACAAGAGTTCATAGTCATCGAAAATTTGC
GACTATGGCTCGGGTAGTTTCAGTGGCATTATCTCGGAAGGCGGGTTCGATGACTTTGTACGCCACGGGGGATAGCACG
TTGTATCAAGCCTCTTCAAATTGTTAGACACGGCTATGTGCTGTTGGAAGTGGGTGGGCATTAAACGAGGCGAACTTTA
CCTGATGAGACCCGGGGTCTGGAGGAGCCATAAGCGAGATACACTGGGAATGAAATAAATCCCATGTCTCTACAGTTGG
TGGAACTTGGTGGAGGAATATGAATTGAGTTGACTTAGGAAGATGGCTATGCCTGTGGAGAAGCTGAATAGATTGAGTT
TTTGGTTCCATCGAAAAAAAAAAAAAAAAAAAAAAAA > SEQ ID NO:3796 213814FL Trichoderma harzianum
ACAAGTCGAAACGAACCCAATTGGCACGCACACCAGAGGCCATATACAAATACAAATATCCCCCCCCTTGAACCGACTC
TCGCCCACCCGCCCATCATGCATCTCATGTACACCCTCGACGCCAGCGGCAACCGCCTCTACACCCTCAAGAAGGTCGC
CCACGGCCAGGTCACCAAGTCTGCGCACCCGGCGCGCTTCTCTCCCGACGACAAGTGGTCTCGCCAGCGCGTTACGCTG
AAGCGCCGCTTTAACCTGCTCTTGACGCAGCAGAAGGAGGAGGCTATGTAAATTCGCATCATGGAGATACCCTCGAACC
AAAGAAATCCCAAGCGGCGTTAATTGGGAGCGACTTCGGGCATGCTTTTTGAGGTGATAATTGATTCGTCATTGTCCTC
TGTTGGCGATACGGGATAAAGAGAACGGCAAGCTCTTCTTCTAGAGAGTCACAAAGTTGGCCATTCGTCCCAATTCGGG
TAACCGACTGGCTTTGTTTCCTTCGCTTAGGATCGATGGAGGAATACACTTGAGCGAGCAACATTGTTCGTTTGGGGAC
AGCAATGAGAGACTACAGGAGGGGGGGTGAGTGTCTGGCGAGAGCTTGACTAGGTGGATGGGTGGATGGATGACAAGTT
CACCATGTTCTGGAATTGGATCTTTCTCAATGATTGGGGAATGGATTTGGCGTTTCTTAGGCGATTACATGTACTTGGG
CTCATTTGCGCATACGCAAAAAAAAAAAAAAA > SEQ ID NO:3797 213816FL Trichoderma harzianum
GCCCDCGATTCGTTTTAAATAGATCTTACAGTATCACTACTCCATCTCAGTTCGTGTTCTTGTCATTAATTAACTCGAC
CCACGCGTCCGACACTCTCCAGGCTCACACAAAACTCACTACAATAAAAACACAATCTTCAATTCTTTGAACCTTTTTC
AAGTTCGCCAACATGAAGTTCACCACTACTGCCGTTCTTGCCATTGCCGCATTCGTTGAATCGGCCACTGCTCTGGGC
AAGGCCCGTGTCGTCAACAAGTGCCCCTTCAGCGTCACCACCTGGTCCGTTGGCAGCGCCATCTCCAACCCAACAACCC
TTGCTCAAGGCGGTTCCTATGGCGAGACCTTCTCACGAGACCCCGTAACCGGCGGTCGTGCCATCAAGGTCACCGTCCA
GCCCGATGGCCTCTACACTGGCAAGCCCCAGACCAACTTCGCCATCAACCTTGAGGGCAACACCATCGGTACGATCTT
TCAGATGTCTTTGGCGATGCCTTCAACGGCCACAAGGTCGTTGTTTCCAGCGCCAACACTGCTTGCCCCCAGATTGTTT
GGGGCAGCGGAATCCCTCCTGCCGGAAGCCAGGTCAAGAACTGCGGTGCGGATAAGGATGTGACTTTGACTCTGTGTGC
TTAGAGTTAAGGGAGGACGGAATCATGTCAAGGGAAAGGTTTAAATCAAGTTTATGATAGAATTTCAAGTCCTAGCTAT
GTTTAAGACTTATGACAGTATGAATTGATGAGTTTACTTCGAAAAAAAAAAAAAAAAAAAAAAAAAAAA > SEQ ID NO:3798 213817FL Trichoderma harzianum
ACAAGTTCAATTCGCAGCAACAGAAGCGGCGCAGACAGCATGAGCTCATCACTGAGGAGCTGCGTTGCGGCCCGGCCGC
TGGCTCGCATCTCGCAGACGGTCGCTTCACGGAACGGCGTCCAGAGCGTCCGGTGTCTGTCCCAGACAAGCCCACGATG
GGAGGATTCAAAAGATGCAAAGCCAGAACCACCCAAGGCGGTGCCTCCAAAGCCTCGAACCGAGTCGCTCCTCGACAGC
ATCTACAGCATTACCCAGGCGCCAAACAGCCGGTCCGCGCAGTCCAACCCCATGGGCAGCCTCTCCCAGAGCATGGTCT
TCCAGGCCCTCAGCAAATCCAACATCGACACCAGCGTCCTGTCAGGCGGTCCCTCGCAGGCAGCGCAGAAGAAGGAGGA
TGAATTGGAGCCATTCCATTTCCACGTCTACTCGCACAAGCACAACACTCACATTACATGCACAAAGCCCAATCGGGAA
CCCATCATCTCCATGTCATGCGGCAACATTGGCTTCAGGAAATCACGGCGGGGCACCTTCGATTCGGCCTACTCTTTGA
CAAAGTACGTTTTGGAGCGATTGATTCACACGGGATGGCCAATGAAGATTCAGCGTCTCGAGCTGGTTCTGCGAGGGTT
```

FIG. 1 continued

```
CGGCCAGGGCAGAGAGGCTGCCGTCAAGGTGCTGATGAGCCCGGAAGGCAAGGTGCTGCGGGACAAGATTGTGCGGGTT
GCGGATTCAACAAGGATCAAGTTTGCAGGAACAAGGAGCGAGAAGCCAAGGCGCTTGTAGATGCTCGGTTGCATCAGCT
ATATGATGACATGCTGCCGAATGTACCATATCTTGTACAAACTATACCAAAGAAGAATGAACGAAAAAAAAAAAAAAA

> SEQ ID NO:3799  213825FL  Trichoderma harzianum
GTTTCCTCTCGTTCTACTAGCTGGGAAGGGGAAGCCGGCTAGCAGTTAGAGCGGATGGGCATCGTGATGGGCAGTGACG
ATAGTGTACACCCGGAAAAAGTGACTGCGTATCGCTTTGCCCCTCCGTGTCTTCCGACGGGATTGTCTCGATAAAAATG
ACATCAGCACGGGAAGAAGAAGAGCATCTCCACTAACGGCACACACAAACACGCATAGAACAAGACGCTCTCCGACTCC
TCGGAGCCGGTGCTCTCCCTGCAGGGCGTTGGCTACCTGATCCGCAAGGGCATCAGCCTGGCCACCATCACCCTCGAGG
TCGAGCAGTACGAGGGCCCGCCCAAGCCGCCCAACACCGCCGCCGACGTCGTCACGCACATCGACATCAAGCAGTCCGC
GTCGGGCCTGTCGAGCACGCAGGAGAACCGCTGCTTCGACAACTTCCCGCGCGACCACACCGACTGGCTGTTTGGCACC
GTGACGGGCCGCAGCCGCTGGGTGAGCCTGGACGAGGTCACCGACGAGTTCCTCAAGAAGGGCTGGGAGGTCGAGGGTG
AGGGTCAGAGCTTCATCACCAACATTGCTGAGAACAAGGAGAAGGGCTGGGTTGCCGAGCAGGTCTGGGGATTCCAGAT
TGTTGATGGCGAGCGCAGATACTGCAGACATATTGTTGTGACCAAGGGAGCGGAGCGGGCTCAGATCCGACTCGTCTAC
GACTTCAACGAAGAGTAAGGGGGGGTTTGTGTGACAGGTGCTCATTTTGATATCATATAGAAGAGCTGACGGCCTTCA
TGTTTGTTTCTTCAAGAATAAATAAAGAGAGTAGCTATACAGTACCTAAAGTTGGTTATTAAAAAAAAAAAAAA > SEQ ID NO:3800  213827FL  Trichoderma harzianum
GCGGTCGAATAAACACCGACTGCATCTCCATCAGATTGCGCTTGGCGGCCGGGTCTACTGTTGCAGTTGATGCCGCCCA
ACTCTGGCAAAACCTGGCGCTGCGGCTGCGGCTGGAGACCGGGGGAGCGATTCTGGCTGCCCAAACGAGAACCGGGGGG
GATGTCAATGCACAGTTGCATCGAAATTTGGCGATTAATTTTTTTACGAGGGAGGATTAGGATTAGGACTTTGCACGGT
AGTATTACTAGGACCCCTAGGCAGAAAGTTGGATATAGATTGCATTGGATGTTTTGATTGAGTTGCCTTGCTGGGATGT
TGAGAGTCTATCAAGCAAGCAAGGCAGACGAGGATGCCTTGTGCAGAGACGGCATTTCAATTCACTAATTGGATAAAAT
AGATATCAACGTATTATACAGAAATACTGCATGCAAAGTAATAACGAAAAAAAAAAAAAAAAAAA > SEQ ID NO:3801  213832FL  Trichoderma harzianum
GGTGTAGACTATGTGTATACTACTGTACAAGTTTGGAATCAACTAAAATTGTGCAGAATGAAGAGAGAGAAAACAGAGC
TTATTAGGATGGCAATAATGCACCGTCAAAGGGTAGCGCCGTTTCCAATGTGGTGCCCAACAAAGTGGAGGGAAAATAT
GCTCACTTACAAACCCACATGCAAAATCGCTCTCCTCTATACAGGCATCCTCACCTGCAGTTCATGTCCGTTCGATGGT
GAGATGACAAGTGGATTGATTTCTCATCAGTATGTAATCTCCATCTGAGTCGTACATGTAGTTAGTTTACCGATACACG
GCTGCCTACGCAAGAGACCAACAACCAAGACGAGTTAACGAAGTAAGACTTTGGTCAACAGCAGTATTAGTCCAGAGGT
CGACAAAAAAAAAAAAAAAAAAAAAA > SEQ ID NO:3802  213863FL  Trichoderma harzianum
TCCAACCCTCCTTTGTATGGCGCCAGAATCGCTAGCACCGTTCTGAATGACGCCCAGCTCTTCGCCGAGTGGGAGGAGA
ATCTGAAGACCATGTCCGGCCGCATCATCGACATGCGCAAAGCTCTCCGTTCCAAGCTTGAAGAGTTGGAGACTCCAGG
AACCTGGAACCACATCACAGACCAGATCGGCATGTTCAGCTTTACTGGCCTATCAGAACCCCAAGTTCTCAAGCTCCGC
GAGGAGTATCACATCTACATGACCAAGAACGGCCGAATCAGCATGGCCGGGTTAAATACCAACAACATTGACCATGTGG
CTCAGGCCATCCGAAAAGTCGTTGGTGAGACTCAGTAATTTGTATGATAATGGTTTGATAGATGGGCTTCGAGGACGTG
ACGATAATTATCACCGCCGCTGGCCAGGAACTTGCGTTGTTTCGATTAGTGTTCTTTTTTCCTTTGTATTCGATAGCAC
ATGGGTGTGTGGGCATAGATGCAGCTAGACAAATAGCAAATACGGCTTTGAGGGCCTCGGGGAGTTTCATCCCTTGACA
ATGAAAAAAAAAAAAAAAAAAAA > SEQ ID NO:3803  213877FL  Trichoderma harzianum
GCAGTCTCCAGCAGAGTAAGCCCATCAAACTCATCAGGCTGGACAGAATGCCGTCCGAACGCCATCCTCTCCTATCCAA
CCGCGGCGAGTCGGCCGAAGCCGCCCAAGCAAAGGCTGCCTTGCGCTCTTCACGCATCCGCGAGATTGCCTTCTTCGCC
TGGGGCCTGCTCGCCACTGCCGCCTTCATCGTCGCTGCTGTCTGGATCCAGCATGACGCTCAGACCGGCCATGGCGACA
ACAACAATAACAATAATACTGTCGCTCCCAAGCGCAACTTGGTCTTCATGGTGTCCGACGGCATGGGACCGGCGTCGCT
CTCCTTGACTCGAAGCTACCGCCAGTACATCAACAACCTCCCCGAGAACGACACTCTCGTCCTGGACCAGCACTTTTGG
GGCACCAGCCGCACTCGCTCCAGTAACTCCCTCGTCACCGATAGCGCTGCCGGCGCCACGGCCTTTGCCTGCGGCCTCA
AGAGCTACAACGGCGCCATCTCAGTTCTGCCCGACTTTGAGCCATGCGGATCTGTCATGGAGGCGGCAAAGAGGGTCGG
ATACACAACGGGACTTGTCGTCACAACAGACATCACAGATGCCACGCCTGCTACCTTTGCCAGCCACGTCCTGAGGCGA
GAGATGGAGGACTCGATTGCCCTGCAGGAAATCGGAGAGGGCGTGCTAGGCCGTTCAGTTGATCTCATGCTCGGTGGCG
GCCGC
```

FIG. 1 continued

> SEQ ID NO:3804 213882FL *Trichoderma harzianum*
CATGTGGCCACGGGAATGACGCAAAAGGCGCCGAGAGCGGAAATGGAGAGAAAAAAAACCCAATTGCACCTCGTGATGA
TGCCACTCAAATGTCTGTGGTCGAGCCACTGGCTTCTACCTACGCTTACATTACCTAACAAGGAACGAAACATTTTGCG
GCAAGGAGAATTGGATCATTGACTTGGCGAATGGCCTAATGAATGTCGTCAATTGCAGGCCTCGTGGTTTGGCGGTTGG
ATGAGAGGGGGAATTGGAGTGAGTGGGATGGGGAGTTGGAGTCATTGGATTCATTTGACAATTGGTTATTACGAGCGGT
TTAGGTAAGAATGTAACAATGGAACAGCAAAACGTGCACGCAAAAAAAAAAAAAAAA > SEQ ID NO:3805 213889FL *Trichoderma harzianum*
AATCGGACGACGGAGTAATAGATAGGACACGGGCAGAGAAGCAAGGAGGGGGCGGACTGCAGCGTGATATGACAAAAGG
GCAGACCTAGTTTTCGGAGAGGCAAAGAGGAGAAACGACTTACTCATCCTTGGGTCCCGGGGCGAGATACTCTGTGAGA
GCCTGCTTCGTCTGAGCGACAACACCATCCGCCTCAGCCAATGGTTTCAATCCTGGCAGAACCCAATGGCGCCAAAAGG
CAAACTTGGGGTCATCTGGCGTGGGTGCATCGGGATCGACAAGGAGCAACATATACGATGCGTCTCCCGATGAATCCCC
AGCCTATATATATGTGTGTGATGGGAAATCGTCAGGAACTCTAGCTTCAACTCCATAGAACAACTTTAAAAAACCAAAA
AAAAAAAAAAAAAAAA > SEQ ID NO:3806 213896FL *Trichoderma harzianum*
CTCGTAGCACCAGCTGTATACCTTTAGTATGCTTGTGATGCGTGTTCAGATAAAATTGTCTTGAAATGTACATTTGATG
CTTTTGAGGGCTTCTAAAAGTAAATCAACTCTGAGACCAGCGGGGCAAACATGGTCCATAGGCACGCATGCTACGCTGC
CGTAAATAGAGCAAGACACGCAGGGTTATAGGAGCGCGCCCAGGTCTCAACCTAAAAAGCTTCAATCCATGTTCAATCT
GAAGCACAACATGGATGAAATATTCAAACCGAGGAGCTAGAAAAAAAAAAAAAAAAAA > SEQ ID NO:3807 213903FL *Trichoderma harzianum*
CCCACGCGTCCGAAGTAGGGCAGGCTAGCTGGTCCCCTGGAGAAAGATGAGGAAAAGACCCGGAAGGAGAAAAGGGAAT
CGTGTGATTTAATTTGCTATGCCGGATCGTAGCCGTGGATGTGAGATGAGGCGGGAAGGGAGAAGCCGGAGAAGGCGGG
CCTTGACACGGAGCTGAAGAATTTTCTTTTTCTTTGTGTCGCGTGTTGTGTGCTTTGATCGTGATTCTTTTGCCGTAGC
CCTTTTTTTACATACATTTGTGTGCAAAAAAAAAAAAAAAAAAAAA > SEQ ID NO:3808 213922FL *Trichoderma harzianum*
AAGAAAATAGAGAAGGGGGAGAAAAGAAGAGAGCCTCTTAGAGGATGATGCTGAATGACGCTGTGGATGGTGAAATGTG
AGATGAGCAAGGTTTGTGTTACATGTATATTAAGAGGATTTTTTCTTTTTGTGGACGGTTTTTTATATGTGATATTATG
GAGAAACTAGCAAGGATGGAGAAAAGCGGGAGAAAAGGAACGATAAGTTTATCTCTGTTTGGGCATGTATGGGTGTTAA
TATGATTGACTTGTCATATGTGAATGATGAGTAGATGATGAAAAAAAAAAAAAAAAAAAA > SEQ ID NO:3809 213950FL *Trichoderma harzianum*
GCGGCGTCTCCTACAAGAAATCGTTCGTTTCCCTCTGTCATTGCGAGCCTGTTGAGCAACACAACAAAAGGCGTCAAC
ACACAAAGATCCAATCGCCAGATCTAAAGCCTCTGTGCTACTCAGTCCAACAATTGCACAAAGCGACACAACATACCGA
AATCTGCAAACAATGTGTTTCCGCGTGGAGCCAAAGGCCAAATACTACTACCAGGAGGAAATCATTCCCTCACGGCCGT
ACCGCCATCACCATCACCATCACCATTCTTCCCACCACTCGCCGCGAGCGAGCTACTCGGCGGTTGAGCGCTACAGCCC
GCGGGTCAGCACCAGCAGCTACAGACGCAGCGTGCCGTCGAGGGTCGTGTATGAGGAGACAACGCGGAGTCGGTACTGA
ATGGGCTTTTGATTAGGACCAGGAATATCCTGTGATTTCTTACTCTTTGTTTTTTTAACGACTCTATGGTACTGGTTA
TGGGAAATGAGACACATGTTAGAGGCTAGAATAATGGGCGGATTGGGATGGAAACTCGAGGCAGGCGATGGTTTCATGA
GGATATGAGAACCTGGAATGCGGTGACGGCGTTGGTAACATATATTTCGCCTTTACGATTTGAATGAATGAGATACATA
AAACACTAAAAAAAAAAAAAAA > SEQ ID NO:3810 213951FL *Trichoderma harzianum*
CGGACGCGTGGGAACCCGAACAAAATGCTTATGAGCGGGCCGCGGGTACCATGTCAGTGTACGGGTACTCGTACAAGTT
CTCTGGACGAGCAGATGCAACCATCCGGCAGTCAAACTTGATGCTACTTGACCTGTAACATTTGCATTGATGAGCGGCA
GCAGGGCCTGCAACCTGGGTAGTACTCCCAAGTATTGCCCGTACACGTCCTAACATGCGGCAGGCGATCAAGCCGTTC
TCAGGGCGCTAACAAGGGGGGACGAGGCGCACTGGAAGCGCTGAGAACACATGCATCGTGAGGTGATGGAGTCGGTGG
GCTCGGGTAGATGTACCTAAAGGGCACATAACCTTGCCTGGCTCTTTGGTCCTGGAAGGGGTGATGTGATTTACTTTCA
ATGGAAGAAGCCGGATGTTGCGACTGCTTAAAAAAAAAAAAAAAA

FIG. 1 continued

> SEQ ID NO:3811 214001FL *Trichoderma harzianum*
CTCCGTCCAAGCAAGGGAGGCCACGATGGCAAATGCCGCCAGCCCGGAAGAGATGCCTAAAATGCCTCCTCCACGGCTT
CTTCTGGAAGCATCAGTCAAACTCGTTCACTTGCATGCAGAGGCGCTAGCAAGGCCTGGCCGCATGCTGCGCGACTTTT
GCAAGTGAGTTCGAAGGAAAGCGGCCGGCCACGTTTTGGACATGGGGAGAGAAGAGAGAGGAGGGCATGCTAGTTAGTT
GCCAGATTGAGCGTCGGTGTCCAATGTATTCATGTTTCGGAAAGATTTTTGTTCTTCTTCCATAGCTATTGTAACGGCG
AAAAAAAAAAAAAAA > SEQ ID NO:3812 214010FL *Trichoderma harzianum*
GGCAGGCAGACAGCATAGATGAGGAACTTCTTTTCATCCAGGCAGCCAAAAAGGGCAGTGCAAGGCAGGCATCGTCAGT
TGCAGCGCGGGTGATTGGCTCATCCGCCGGGCTCTTTTTTTGCCCTTCGACTTGCTTTGATGCCCGGAGGGATGTGAAT
CCAAAGAGAGGCGACCTGCCCAAAGAGGGAAACAGGGCAACGTGAGCGGGTAGATTCGCAGCTAGGAACAGGACAAGCA
TCACACATGTATGTAAGATGGTCACTCCGGCCCTTGCTCGGAATCAACCGCGGGGACCCGTGTGAGCAAAGATAGATAC
CGTATGAATATATCGTATCCTACGAAAAAAAAAAAAAAAAAAAAAAAAAAAA > SEQ ID NO:3813 214052FL *Trichoderma harzianum*
ATTGAGTTGAATGACGAAAGGAGTTTCACTGCTACAAATGTACTGTACAGAAGGTATACAGATTGACAGTCAGGGTCCA
CGATGCTTCAAGATCAGTCAGATCAGTCTCCCATCTCAGCTCCGCTATGACCTCAGCTGCAGAGCCGGGGTGGAGGCAG
CACTCGACGGCTCGGACTGCTAACAAAATCCCCACCGAAGATCGGCATCGTCTCCGAAGGGTCCCTTGGCCGGATACAG
AGCGAAACGACCGTGTTGGATCGCATTGCCCTAAAAAAAAAAAAAAAAAAAAAAAAAAAA > SEQ ID NO:3814 214105FL *Trichoderma harzianum*
GCGTCGAGGCGTCAACTTCACGGCATCACGAGGTTCCTGGACAAGCCGTCACCATGTCCACTGACGATCTGAGCACCCA
TCTGGCCGACTCCGGCATCACCATGCGGTCCGACAGCGAGCAGTACTCTCCGGGCGATGAGGTCTCATCACCCTCGTCA
TCAAACTCACCGGTTATTCTCTACAAGCCCCCCACAGCATGGAGTCTGATACGGAGCGCCGCCATCAATCTGGTTCTGC
CATTCATCAACGGAATGATGCTGGGATTTGGAGAGTTGTTTGCTCATGAGGCAGCATTCCGGTTAGGATGGGCGGTAC
AAAGGTTTTCCCTCTTTCTCGAAGACGAGCCCACCCCATTGGCCCAGGCATCGAAGTCCGTGAACGACCAGAGCGACCC
GGGCCTTCACTAAGTGATTACGCAAGCTTAGAGTAGAAGGGAAGAATGGAATGAGGACGATAGGGGTATTGTATATGAA
TCAATCATGTCTAAATAAACAGATGCAGGCGCTTTTCCAAAAGACTGTGGCCCATCTGCTGCACTTTCAGAGCTCCCCA
ACCATATAGGCAGCTAGTAGCGGCGGATAAGTGGCCGCGAATTGTACACCAGCAGATTGCACGAAGCTGTAGCCACTGC
ATTAAAATAAATCAATTCAACTTTCAAAAAAAAAAAAAAAAAAAA > SEQ ID NO:3815 213569FL *Oryza sativa*
ATTATTCAAAATGAAGTTCACAACCATCGTCACCGCTGCTGTCTCTTCAGCCATTGCCGTCTCCGGCACTCCCATCCAC
AAGCGCGAGATCGGCGGCGTATGTCTTCTCCCTCTCCTCTCCCTTGCATCTTCTCCATTCCTATCACTCGTCTGATTCA
ATATCATCTCTAACTATTGGTCAATCCCTCACAGGTCCTCTTGTGCACCGGCGTCAATGCAACCGGCACCTGCAGCTAC
AACGTCTACGAACTCAAGACGTGCCACCAGCTTCCCGCGCCTTTCCACCAAAACACCAGCACGTTTGCCCCCGACGGCG
AAGACTTTGAGTGCTTCCCTCGTATTGGCGACTGCGGTTCTATTTGCACCAGCCCGACGGGATGTACCTTTGGCAGCGT
CGACTTTAACTACAAGAACAAGTTCAATCTGGGGGCTATTAAGTGTAACACCTTGATTTCCAGCTTTGACTGTTCGCTG
AAGACGACGACGACTTCAACTGAGTAAAAAGGAAAAAAGACAAAATTATGTTTTACAAAGTGTTGGAGGATCGCATCTT
GTTTTGTTTAATGTACGACTTATACCAACGATGAGGATCCATCTCATCCGTCAAAAACTCGAAGACTGACAGCTGCCCC
TCCATCAGCTTAAAAACTTACATGGATGCCAGGATATGCATCAAGCCAGGGGTGGTTTATTTACACGAGAAACGGCTG
TTTTAATTTTTTTGCTTTTGTTTTGTGCTTGGAAATGGGCGTTTATACTATTACCCGATGCCTTTAATGATTTGCTGCT
TTCGGACATAGTTCGGGCGTCATGATGATGGAAATAGAGAGCTTTCGGAGGGGTGCTTTGGCAGGTCTGGTGGTGGGGT
AAATACGGATCAATGTGTCGATGATTGTTAAATAGCTTCTACCCTTTTACCAATTAATGAGTAGTATCTTGTGCTTCTT
CTTTTTCGAAAAAAAAAAAAAAA > SEQ ID NO:3816 214117FL *Trichoderma harzianum*
GATGAATTGTCCGTCTCCGGGCATTTCTCAATGGCGCTTACTTCAGGACGTGATTGGTTCAGCCCTAAGGACAAGCCAT
GATACATTGCAACCTTTGAGTTGGGCAAATGACAGATCATTTCAACATCTAGATGGATATACAGCAAGTGAAGGAAGTC
GGAAAGAGAGTAACCTCTAAGAAACTGGATCTTTATTCTTCATTCTTTTCACCAGGTGGATTATGACCTACCAAGCTCC
GGCTGACCGAAGACATTGCCGCCCGAGTTAGAATGAAGAACAATCCAAGTCGAATAAATTAGTTGTTATAGCTATCGTA
AAATTATCTCAAAATTAAATACAAGTTGGATTATCTTGAAAAAAAAGAAAAAA

FIG. 1 continued

> SEQ ID NO:3817 214178FL *Trichoderma harzianum*
AGACAAGAGTGAACCACGCATCATCCACGCTGAGATTGAGATGACCAAGGGGGAAAAAAGGGGGGCAAGTTTTCTGTTT
ACGCCACTGGGACGAACTCCCCTTTTTTTTGATGAGAAGAAGAAACGGATGGTTTTAGTGTCTTACGCATATATATGAA
CTGAGCGGCAATGCTTAATACCGTGTAGCTGCTTTGCTTTGCTATTTAGAGAGTGGCGAGGGGGGAGATTGAGGAGGCC
TCTGGAGAAAGCAAAGAGCCTTAATGTCTGTTTTTACCATTGGATGGTTTCTTAGTTCCAAGGTGGCTCTTAATTTGTG
CTTAGTGCTTTGTTGGAACACCGACTGTTGCTTCAGTTAAAGAAAAAAAAAAAAAAA > SEQ ID NO:3818 214194FL *Trichoderma harzianum*
GGCAGAGCTACAACGGCCCTAGCACACAATTGGCCACAATTCACGCCTCACAATCGCCAAGATTGCTCTAATTCTCGGG
CAGTCAAGTCTTGTCAAGTCTTGTCAAGTCTCGAACTCGTATCCTTGAGCATATGCAGGTGGCGTCTGTGTCTCGAGAC
AAGAGAGGGTGAACATGTGCACAGAACAAGGCACCGAAGCCGAAAGGGACAAACCGAAGCCGAGGTGGGAAAAAGGCGC
CACGAACCAGTATCCAAGAGTTTAGCCACTGTGTCCTAATAGAATCCCCCCTTCTTTTTTTTCCTTCAAAAAAAAAAAA
AAA > SEQ ID NO:3819 214276FL *Trichoderma harzianum*
GGCTGGCTGGCCTGAGACGATCTGGCAGACCAACAACGAGACAAGGGCTTTGCCGGCGGTTAGACCCCAGTGATGAGAT
TCGCAAACAGGCGCGCCCGCTGGGAGACGGCCCCCAGCTGATTGATTGATACCTGGTAGTACATGGGCAGTTGGAGTAC
TCGTATGGACAAAGTACCGTACCGGTACTCGGGGCTTGTAAGACGGCTCTCTGGAGGGGAATACGAGCTGGCAAAACAT
TAAAAGGCAAGGCTCAGGGCGGGCTGTAAGCCGCAGCGCAGTGGCTCTTTTTAAGTTGTCGGGGAGATAGATGGCCACA
GCCGTTCTGGGGACCACGACGGCAAAAGGAATTGAGAGAAAATAGTCTAAAAGTATGTCCTCTTCCGTCAAGCACAAAG
TCGATGGACGCCGTCACCCCAAAGAATCTGGGTGTTGCTGCAACGGGATCATCCCCAAGGCTGGATTCAAAAAAAAAAA
AAAA > SEQ ID NO:3820 214309FL *Trichoderma harzianum*
GAGGTGCTTGTTGTCTGTTTCTGTCTAGAGGTATTGGATGTAAATAAGATCAGCACGAGATGAGATGAGATGAGCAGAC
AGACGATCAGATGGCGAGATTGAGAGGCAAATTGCAAGTGAATTTAAATTGCTTCGCTGGCGCCTAAATTGGAAGCATC
CATGGCTCGCCTTTTGCCTCCCCACGTGTGGAAAGTAGAGCCGAGAGCGATCCCTAGCGGCTATTCTATTCTGGCGGTT
TGGAGTCAATCTGGCCCCCCGGAGATTGAGATGGTGGCTGTCGAGGTGCCGGATGGGATGGGATGGGCTTGTCTTTGGA
TACTTCATCTTTTCATCAAAAAAAAAAAAAAAA > SEQ ID NO:3821 214382FL *Trichoderma harzianum*
CACGCGGTGGTGATTGGAGGTGCGGATTTCACGCTTTCTGATGATACTGGCAGCAATTACATTTGCGCGGCTGGCGTTC
TTTGCAAGGATGCCCGGAATGCGGTTGTCTTTACTGTGAGCTACAAGAGCGGGAAGGGATATGCGTTTAACGTCAAGGG
CACGCAAAAGTATCTGTCTATTGGCGGGCGTGGATCGTCCAGTTATGTTTCCTTGACGGGGGGGCTGGGATACTGGCAG
GCTTATAGCGTGAGTTATTGAATGTCTGGGAATATATAGCATGGCTAGTATTTTGAGATGGATTCATTGAGTATGAAAG
GGGTTGGGGTTAGACAAAGAAATTAAAATAGCATTATTCATTTCAGCCAAAAAAAAAAAAAAA > SEQ ID NO:3822 214403FL *Trichoderma harzianum*
AGTATTCCAAGGATAGAAGGCTTCCATAGGGGGCTCGGAGCGTACGAGCCGTCGAATGTTGGGTCTTTTAGGAGAATGC
CGAGAGAGGGGGGTTGAGGTAAGGTGAGGAGCTGACGCGGATCCGAAGCTGCGGCTGGGGATGTGGAGAGCCGGAAAGG
CGGGATATGCACTCGCACGGAGAATATGATGGATCCCAAGGGCGGTGCCCGTGTCGACGAGGTTTATAGGAAAAAAAA
AAAAAAAAAAA > SEQ ID NO:3823 214411FL *Trichoderma harzianum*
CGGATGGATACTTGCAGTAATATGGGGTAAGTGAGTGAGTGAGTGAGTGATATGGATACAGCGGGATGATGATGATGGT
GGTGGTGGTGGTGTTGTCACTGATGTTGTCGAGTGAGTTGTTTGTTTTGTTTACCTTTGGAATTGATtGAAATGAAATG
AAATGAAACAGCCCAATGCACAGCCTAAGTCCAAAGAAAACAAACCAAAAAAAAAAAAAAA > SEQ ID NO:3824 214425FL *Trichoderma harzianum*
ATCATATCCGTAATGGGGGACTCATTCGATTTCCACGGCTAATGTTTTGCACGGCGCATAATGGCAACGGCGGAAAAAG
GGCTGGGTTCGAAAAACAGAAAAAAAGGCCGCAAACTCCTACTTACTCTACTCCTACTGCTTGACCCTGTATTCCAACC
CACTTCATACATCCATCTACGCACTTAAGTACCTTGGGCTATCTGCATGTACGTTCTGTCCTGGACGACTTCATCTACG
TTTGGTTATGTTTTTGGCTGTTCATTAGATTTAGCTATTTTATACGGCGTTGTTTACATACCACAATACATATGTATAG
CCTATCCTGTATAACAAGGCAAAAAATGCAAGAGAATAGACAAAAACTACGCTTCTCAAAAAAAAAAAAAAA

FIG. 1 continued

> SEQ ID NO:3825 214439FL *Trichoderma harzianum*
CGAAGCATATCGGGCTGAAACCCCCACAACGGGAAGACGGGACGATACGAGGCAATGAGGCAATTCAGCGGCCGGTAGC
TGTCGGGATGTTTTTTCCCCGGGGAATTTCGCGGTGGCTGACACTTGGCGTCTCGGGAAATGATTTGACGGATGGATGC
CTAAGAAATGATCCGACTGATCAGGTACGGCTTATCGGCTGTTAATGACGCAGCATAAACAAGTTGCATGTGTATCCTA
AGAGCATGCTCGCCAGATGTAGATGGACAGAGGGCACAAGGATTGGAAGAATACATTGCCAATAGTGGTTCATATAGGG
AGTAACTACATGTATCTTACGCTTGAGCGCCTGCTTTTAAGTAGCTATGTAGTACAGATGGAGGAAGCACCAAAAAAAA
AAAAAAA > SEQ ID NO:3826 214441FL *Trichoderma harzianum*
CAAACCGGCAAAGAAATACCCTGCAGTCCTCGAGACTCGCGATAGAGCAGAAGTACATCAGTCTTATTTACTAGCGAGC
AAGACAGTCAAAATGTCGTGGGCGGGTACGGAGCTTGCGGATGCCCCGCTGAGAGAGAGGGAGAGGGGCTGACGGGATT
CTAGGATTCAAGAAGAATGTGAACCGCGCGACGACGCAGGTGATGATGAAGACGGGTGAGCAGCGTTGGTATTCATTCG
GTTGGGATAGCATTCTGATCTTGTGGTTGCAGGGCATGTGGAAAAGACAAACGATCGAAAAAAAAAAAAAAA > SEQ ID NO:3827 214473FL *Trichoderma harzianum*
GCGAGGGAGAAACGGGTATGGGCTGGGGGGGCCGCACTAGATTCTTTGACGTGTCTTGTACGGAATTCCAGCGCGGTGG
AAGGGTGTGGCTGCTGCACGTTTTCGGGGGCCAGGTTCTTTACACTATTCCCACGGACAAGGTTCCCAAGTGAGGCTGA
TGGAGGGTCCGCGGGCCTTTTGGGGGGGGAGGGTCCAATCGAGTGTTGTTTGTGTGTTCACCAAGTTCAAGTACATGGG
TATGCGTATATTTCGGCCATGTATGCGCGATGGATTCCTGGTGTTCGGCAGCGAGCATGAGAAAAAGGGAAAATAGAC
TGCGAGAGAGAGAGCGACAAAAAGAAGGAAATGCTCCGATCACGATTAGGGGCGGAATTGGAAATCCGAAAAAAAAAAA
AAAA > SEQ ID NO:3828 214529FL *Trichoderma harzianum*
AGGCATATAAGTACTTAGGAGCGAGTGAAAGTTGTTTCTTACGCATTTCACATGGCAATTCATTTCATCCTAGTCAGAC
ACTGAAGTCGTTTCTTCATCTTATCAGAATCACAATTGCGAAATTGCAGATTGAGAGAATATTCATGAATATAAATATC
ACATTATGAATTCCACTACAGACGATTCGTAAGAAGGTCAAAACTAATGAAAACGATAACTCACTTCAGCGACTCTTCC
GTATTCGCGATTTGATAAGGGTACGTGTTAATTCCTCTATAGACTACCTGATGCTTTTTCGAAATTGGCCAATGCAACA
AATTCTAGTACAACTTCAATCAAGGTGTTAATATAGACTACGTAGGTTAACCCTGGCTGGAGACATGAAGCGGCATTCA
ACTGTTCGACTTGATCAATGAACAACTGCCCATCTTGGAATCATAAGAGCAATCAAAGCTCCATCATCATCCCAAAAAA
AAAAAAAAAAAAAA > SEQ ID NO:3829 214533FL *Trichoderma harzianum*
AGAAGATGAAGCCGGCGTTACTGCAACGGCAGTTTGGTAAGATCAAGTATGCTAATACGGTGTTTAGGGTGTGATAGTA
GAGGCATCCGGCGAGGCGGCTGAGACATATGAGGGCGAAACAGGAGTAGAGGAGACAGTGGCAGCAGCAGCAGCGTTAA
TGGCAATAACAATAGATGGCAGAGAACGGCCGGGCCCTCGAGGATTCCCTCTTGAGAGCGAAGGCGAAGGTGAAGGTTCAG
CTGATGGATAAAACCGGGAGACAGCCGAGCGACGCAGAGGATGTCAGGCGTAGGTTGCGTGAGGGTGGCTGCAGAGGCC
GAGAGCAGGTTCAATCAATGGGCGAGAGACGGCTAATCGAGCAGAGCGTGACGAGGAGCGCGGCAATGGCGAGTGCGTG
AAGGGGTGTTGATTCAAGACTGCGCGCGTGAGGGTGTGGGAGAGATGAGGCAGAGGCCAGAGGCAGCTCAAAAGGGTTC
AAAGTTGAAAAAAAAAAAAAAAA > SEQ ID NO:3830 214554FL *Trichoderma harzianum*
GATTTCTTGGCAAGGGTACAACACCCAAAACACGCGGCGATCTGAGGCCATCGTCCGCGCCAAAGATCCCTGCCTCCAG
AAACTCTTTCCACCCCCTGTTGTCTTTGTCGCCTGGTTACGGATACAGTATTTGCTCCTCCGAGTCAGTTTCGCGGGAC
CCTAAATGCTGAtGGGCTCCGTATCAGCGCGACTCCCTCATCGTATCGTAGCTAGTATTCGTGTTGTCCTTAGCCGTTC
CCCTTAAAAAAAAAAAAAAAAAAAA > SEQ ID NO:3831 214575FL *Trichoderma harzianum*
GCGAAAGGGCGAGATTTTGGGTGTGAGGCGGCAGACGGTGATTGGGGCGATTTGGGCAGCTCTGCCAAGGGTTGGGTTC
ATGAAGATACAGTACGTGTTAGTGATGTGAAGCTGCTCCATGATGGGACTCGGAATGGCGGACGGATGCGGTCATGGGC
TTTTGGAGATTGGCTTTTCTTGGTGGGCCGAGACGGCATCTAACTGGAGATTTGATGAAGGGGAATTCGAGCTATCAAT
ACGGATATGCAGGACTGGATGATTCTGATTTGATGGCCCGAGGTGAAACTTGTCTGGAAACTTGATTCGGGGCAGCGA
GAAAGATTGCCCAACGACCGGGTGTCTTTTCTTTCTTCCTCTCTTTGTCTAAGATGTACGAGTACGTCGGCGGCAGGGC
GAGCACAGTTAGCCAGAAGCAAGGGGATGGACTTTTTGACACAGACATACGGAGTAAAAAAAAAAAAAAA

FIG. 1 continued

> SEQ ID NO:3832 214579FL *Trichoderma harzianum*
GGCTGACAGATGCTCTATGACGGAGAGGCGAAGCTGGGTCGAAGCAGACGGGCAAAGCGATTTGAAATGGTGAACAGGG
GAGAATTTGCTCGCTGGCCAAGGGGGAAGAAATGATGAGAGAAAGATGAGAAGAAGAAGAAGAAGAGGGAAGAGAATTG
CTCCAGCGGGATGGGCAGAAGGTGGTGTAGGGACTTATTAGTGACTGAATGGATGGTTCCGGCGCGGTAAATCCAAGTG
GGTGGAAGTGACGTGCGGCTGCTGCGCCTGCAAGAGGCTAGCAGACAGCAGCTAAACAGGACCTGGTAGTGGGTTCAGT
ATGTAATGCGAAAAAAAAAAAAAAAAAAAA > SEQ ID NO:3833 214602FL *Trichoderma harzianum*
GGCGGATAGTTGTGCTATCGTTGTCTTCATGTTTTCATGTTTGCACATAGATACGAGAAGAGTTGTGGGAGTTGGTTGC
GTCATGACATAAGTTGTAATTATAGTATTTGCTGATTATAGCTGATTACGCAGGGTGTGTTTCCTAGTTGTGTGGATGG
ATGTGTGTTGATCTGGCCCCCTGCATATTTCGGAGTAAATCATCCTCCCGATGGCTATAGTCGAGAGGTTAATGGGCTC
TACTCGAGTTCTGTCGTGTAACAGCATCCATAAAGACAGTCATAAAGAAGTTCTTGAGTCATTTCTGATTCTCCCTGTC
AACATCATGATTCATCCAACTGAGGAACCATAATGAGCTTGTATAAACACTCACTAACCTCATTCTAGAGCATCCTTAA
GAGGGTCTCTAAAAAAAAAAAAAAA > SEQ ID NO:3834 214623FL *Trichoderma harzianum*
TGTGAATTCGCGAGCGAATGAAACTCGTCGCATGCTTTGGATCCTGCTTCCGACAAGCTCCCACGACTTGGCTTGGATA
AACCTCTAACCTCCATTTTGGAATCGAGTGTCCTCCATGGCTCGAGAATAAGTCACATATTCAATCAACAGTATACATA
GTTGTAATCGATACACCAATTTCTACTGGAAAAAAAAAAAAAAAA > SEQ ID NO:3835 214637FL *Trichoderma harzianum*
ACGAGAAAAAGGAACAAGCCGCGGGTTCTCAAAGTCTTCCGGTGCCGCCGGCCGTTTGGCTGCGGACCGAAAGGTGGAC
AGGAATCAACTCGTGATGAGATCCGGGAAATGGCGGCCTCCGCCGGGATTTGGATTCCATTCTTTCGTTTTTTGTTGGT
TTCTAACGTTGATGACCATTCAGTGGCGGCGGCTATGAAGGATATGAtGAGAGGTGGTGCTTATGCCGGTGTGTATCAA
GTAACGAGTCCGCCTGGTCCAGGCATCATCATACGATCCATCAATCATAATCAAGGGGAACACAGAGGCAAAAAAAAAA
AAAAA > SEQ ID NO:3836 214666FL *Trichoderma harzianum*
CGACCATTACCATCATACAGCCAACCTCTACATAAGCACAAATACCATTCAAAATGTCTTACGGCGGTGACAACAACGA
CAACTCTCGCCGTAATGACGACAACTTTGGCTCCGGAGGAGATTCTTTCGGCTCTGGTGGAAACCAGCAATATGGCTCC
GGAGGAGACTCATTTGGCTCTGGGGGAGATTCATACGGCTCTGGTGGAAATCAATTCGGCTCCGGCAACCGCCGTAACG
ATGACAGCTCATTTGGTACCAGTGGCCAGGGCGAGTTCGGCTCTGGAGGTAACTATGGCAGCTCTGGCGGTGACTCCTA
TGGGTCTGGAGGAAACACCTATGGCTCCGGCGGCAATGACAACTTTGGCTCTGGGGGCAATGATACGTACGGCTCGTCC
CGTAACCAAGAGTCTTCTTTTGGATCCAGCGGCCGC > SEQ ID NO:3837 214938FL *Trichoderma harzianum*
GCAAACATATTGTGAGTGGATCGAGGGCAACGAGCTCACGACATACACATATTGCGTAATGACAAGTCAAACTGCAAAT
AAGGAAGTTCTGCTCTTTGAGCGTTATAAGGATCTTCCTTCCGTCAAGACCCATGGCCAAACAAATGAGTTCAAGTCTA
TGTTCAAACGAATTTCGCCTTGGATTGAAACAAAGCGTACCGAAATAACTCCATGGAGCGAATTAGACGGTTCTTTCTT
CTCTTCCCTAGACTTAGAAGCCACAGCGAAGCTCTAAAGATAGCTCTATATTCCTTATAATTTTGTATTTTTTCTTCTA
TTCTAAAAAAAAAAAAAAAAAAAA > SEQ ID NO:3838 215055FL *Trichoderma harzianum*
ACGGTGTCCATGGCGGGCGGATGGGCGGGACGAGAGGGGGAAGCTCGGCGCCACCATGCCTTTACAAAAAGTATCATTG
ATGAATAGAGTCGTAAATCCGATTCACGGCTGCGGAGGCAGTGAGCGGAAGATCGACCAACAGATTAGCGATGAGCGAG
AGGGTCAAGGAAACTGACAGGGTGATTCAGATGCCCCCGGAAGTGGAGAGGAAACAAGAAGCCAGGGGTGTTTGTCGT
ACACATGTTGCCAGCCTGCATCTGGCATCTGCTGCCAGCTATTGACAGCTACTTTCATTGGCCAGATGCTGCAAATTGG
AGCTGCACTGCACGGGCACAAGTTCGGATGGGGGATGACGGAAGCAAAACGGCTGCGTATTACCTGCGTTGGTAGAATA
CTAAGGTATTGATGTAATATTTGGGTAGGTACGGATACGGTACTTTCATACAAAGAATCACTTAGTCATGGCAAAGAAA
A

FIG. 1 continued

> SEQ ID NO:3839 215119FL *Trichoderma harzianum*
TGAAGATTTGCTTTGTTTTCTAAGTTCATTTGGTGCAATTGAGTCTTCTAAAGCGTGCTGGTGCAACATTCAAGCTGAC
GTTGGATAAACCTTCAACCGTAACTCTTGTACCTCTCAAGACATCAGAATCAGATGATGGATGGATTGATGAACTGACC
TGCATCTGCCCACTCAACAATTTAATCCAGTCGAGCTTCTACAACGCCAATCTCAAAGCTCACAACTCTGTATTCACTC
ATCTTGACCAATTCTCTTTCAGTTTGACCTCAATCACTCTTTCCCTCATGAAGACCGACGACGCAGTGTCACAAACCAA
AAAAATAAAAAA > SEQ ID NO:3840 215373FL *Trichoderma harzianum*
TGGGGTCGCAAATCTACAGCAAAAATGGCCTCGACAACGACCAAGCAGACCCCGGCGTCCTTTGTCGGGACCAGCAAGG
TCGTCGAGACTGACTATCCGCTCATCGACAACGACCCTCACTTTAAGCGGGTTATCGGATATGCGAGAACGTCAGACTA
CGTAGCTGGTGCAACCTCTGCGGCCTTTGCACCGACTGCTCTCTATGCCCTCGAGAGGCTCGCCCCGTCGCATGTTGGC
CGGGGAGGCTTTGCCAAAGCCATGCGGTTAGCCGGATTCATTGGCTTGGCCGGCGGTTTCCTCTACTTTTACCAGCGAT
CAGCCCTTCGATTCTACGGCGCCACTGAGAACTCAAGGGAAGTCGAGATGGATATGCGAGAGATGGTTTCCAAGGTCAA
GGCGGGACAGCCTCTGTATGGCGAGAGCAAGCTGAGCCCTCACCTGCAGGGAGTTGCGGCCCGACAGAGCAGATACTCT
GCGCTCTTTTTCAGCACAGTACCGTGGTTCAACTTTGTCAACCACAACCAGCACGGCGTGGACACGGCCAAGTACTATC
AGCAGGCCGAGAGGGAACTGGAAGCAGAGCGGGCGGCGGGCAAGAGCTAGACGGGACCAAATGTGTATATTTAGCGGGA
CTACCACTTCTTGCGGAGAAGGAAAAAAATATTGGAAGCTTCAAAAAAAAAAAAAAA > SEQ ID NO:3841 215803FL *Trichoderma harzianum*
AAGAGGGACTGTACTGTACAGTAACTGTACCTTATGCAATTGTGCAGGATTATGTCTCTGCTGTAATGTATCTGCGGAC
GTATCTGCGGATGCCGGGGATGGACTCCGGTGTACTTGGCACGGCTCGCTTCCGTTTGACATAAAAATGCAGTGTAACA
GGTAGATGGACGTACATGTAGATGTAAATGCGGTACTAAAAAAAAAAAAAAAAAAAAA > SEQ ID NO:3842 215981FL *Trichoderma harzianum*
CGACTTGCGGGCTGGGGGATCAAATCACGCCCTGACCTTGTGAGCGGGCGACTTTTCAGCTTGTTCCCCCCCAAGGGAG
TCGGCGCTTGCTGCATGGCAAGTCATGTCTTACGTCTCGCCATTGCAGCCGCCGGCCCTGATGAAACCAGGGAATCGCC
AGCCAGCCTAGCTTCAGATGGGGTTTGAAGTTCAGTCAACTGAACTACGTGGGCGGTTAAAAGGGCCTCGGGGATTGCT
CGCAGCAAGGCCAGAGAGCGATGAGATGGGATGGAGAGAGAGAGAGGGCTGCCGACTACCGGTGCACTGCATGTTAT
CTGCCGTAACATATACATGTACCTACTTAGTTAAGATGTATCACGCACGCGACCATAGTGGCTTTCGAAAAAAAAAAAA
AAA > SEQ ID NO:3843 215982FL *Trichoderma harzianum*
GCCGAGCCTCGCGCAGAACCCAAACCAAACCCGCACAGCAACAACACACACTCCACCTCGAGCTTCTGGTCTTTTAATC
ATAATCGTTACACTCCAAGGCTGCATTTCTTTGCTGAATACTCTATTCAACCAGACTCAACTCAACTCGACTCACCAGG
CTTCCATCTCCTCGCTACTCAAAAAGGCTCAGCCTTACCACTTCCTCCTCCTCCAACCTCATGGCATAAACGACACACC
TCTCTCTCTCCGATTGGTGATGGCAAAGGCGACAACGCCGCCTCCGAGCTACGAGGCCGTGTCCGCCGCTCCTCCTCAC
CCTCCTCATCCTTCACATCCTCCTCACCCTCCTCCGCCTCCCATCTCCGTCGCGACGCCGGGCCTGTCTAAGCGCCGTC
CCGCCTCGTCTCCCTCGTCCCCGACTTCGTCCAGATCATCGTCGTCCAACCCCTGGTCATCGCCCACCAAGTCTTGGTC
ATCGTCGTCATGTCCGCCTCCGCCCGCGCCTGTCCTGCGACGTAACGTCTCGTCTTCTAGCCTCTCGTCCGGACGGCCT
TCGGAACTGACGCCTCTGACCACCAATGGTCCCCTAACCTCGACCTCATCCTCCTCTACTGCTCGCATGCGCTCCGCCT
CCCTCTCCGTCGCCAGAACCGAAAAGCCTCCCGTACCGTCCATGCTGCAGCCCCGCGTCGCCGTCGTGCTCAACGTGCC
TCAGCCATGGCATCCCTGGCTCTTCGCCTTGCGCCTTTGCTCGATCCTGCCGGCTCTGTGGTGGGGCTACCCTCGCTA
CTACGCTTGCTACTTCACTTCTTGCCAGGCCCACCTGATCAGTTTATGCTCGTCAAACAAATTGCCATCTCGGGCAGCA
ATATGGATGCTCTCCAGACATCTCTCTTGTCCTCGTGCTCGCCCGAGGAAGGTAAAGCAGCCGCGGCGGCCGC > SEQ ID NO:3844 216049FL *Trichoderma harzianum*
GATGAGGAGGGGGGTGTTTGTGTTGCGATAGGTAACTTAGTACGAGTAGATTCAAGATGGAGGGGGGGAATGAATCTT
GCTTGCTTGACTGCAGTCTGTAGTGTAATCAGGCAAATAAGGCAAATGAATACCTGCAAAAAAAAAAAAAAAAAAAAA > SEQ ID NO:3845 216240FL *Trichoderma harzianum*
AAACAAGTTATCGTGGCCATGGGTTTACACGAACGACGCTTGCGATTCAACTGGTGCCCATTAGGAAAGAGAAAGGAAA
TCAGTTGAAAATGCTGGCATGAGAACACTTTACAGCGAACGATTGTAAATATCAAAGTGACAAAATCAAGTATCATGGA
GCCAGGAAGCGGCAAATGTCAAAAAAAAAAAAAAAAAAAA

FIG. 1 continued

> SEQ ID NO:3846 216429FL *Trichoderma harzianum*
CACCATCTCGCTCCGGACACGGGAGAGACTGCGCTGTCCATCTGATGGCCTAGATTGGCAGACGCCGGGGCAATTGGCA
CGTACGCTGCCACCGACTTTGCATCCCCGGGGTCCTGTCCTGTCTCTCCAAATCCAAAGACCTCTTCTCCATCGCACAC
GAAGCATCGAGCCAGAGCATCCAGCCCCGCCCAGATCCCAGCCCGAGTACGTTGCGTGAATGAGCGGCCAAGACGGGAC
AAATCTCGAGGTTACGCTGCATCTGTTCTAACCTGCCACGCTGCTACAGTACAAGGACACCCTCAATCACATACGGATC
GGCCCTGCGAATCAGCCCTGCGACTAATAATAGCCCTGTGAATCGGCCCCTGCTGAACCGCCATCCGAAAAAAAAAAA
AAA > SEQ ID NO:3847 214417FL *Trichoderma harzianum*
GTTTGTTAGCCTTTGTGATGCAATAGCATGTTGTAAGATTGTTTGTGTAAGTGAAGTCTATAGCAATGCCTGGAATGTG
ATGGAACATAGGAATACAGGATGGATGACAGAGTTGGTGATGGATATGTACACTTACCCTCGCTGATACGGCACGTCGT
CAACGGTCTGGTATTCTTGTGGCTGGACGATAGACATTGTTGCGGTTTTCGAACGGTTTGTTATGTGCTTCAATGGTTT
CTTGGCTTTGTAAGTTGTCACACGATCCAAATAACCCAAAATCACCAAAAAAAAAAAAAA > SEQ ID NO:3848 214564FL *Trichoderma harzianum*
CCCACGCGTCCGGCTCATCCTATTTTGCCTTCCCTCCTCCCAACTCCTTCCGAAATCTCGGCATCGTGAACTCCGGGCT
CCAATGGCTACCAGAACGGGTTCGACCGGCGTGGCCACCTATGCCGACTGCGTCGATTCGCTGCGCAACTCTCTCAAAT
TCCTCGAGGCCTCCGTGGAGACCATTGACCGTGGCGTATCTGACTTCCCTCGCCTCGTGAACGTCCTCAAGACAGTCCG
ACACTACGAACTCATTCCCCAGCCCACACTCGCTGCTGCTGAGGCTTCCCTGCGCGACGAAATTGGGCCCTACATCGCT
TTTCTCCTCAGCCGCGCTGATGCTCAAGTTGAACGCCAGGAACGCCGCATTGAGACGCTCAAAGCCCGGGCTGAGTTAC
AACAGGGACGGTTAACTAGGCCTGATGAACCGGCACGCAGCGTATCAAGGCCTGCTTCTGCAAGGAGCCGGCAGCTCCG
AGGCGAGGACAAGCTGAGAGCTCGGATTGTGCGCCAGCGTAAGGAAGCTCTACGTTATGGCATTGAGAGGTTGGAGCTA
GAAGTGCTCCAGAAAGAAAGAGAATTAAGAAAGCGACTGGAGAACGATAGTGAGGCGCAGGAGTAGGCAGCTCTGCGT
ACCGTCACGATAGCTCAAAGTTGATCTACTCGTGTAGGGCGGTTACAAGGCAGCCTGTCTCTTGGATAGGTGCACGACT
AGAGACACCCAGAGGCAGCGTCCCTGTGCCCTTGCCTCTCACCCTGCTCAAACACCACAACAACGCCGGCAGGATCGGC
TTTCACGATGCCTTTGTCTCCGCGAAATCTTGCCCGCATACCGGTCTGACGAGCAGCGTCCGCCCTCCGATTGCGCTTG
GGCAAACCTGCCTCTTGCGCGCACGCGTTGAGCGCCATGTCTCGCCCTATCAGCTTTGAGCATTTACCTCCCCGCCAGA
GTTTGAGGCCTGTCTCCCTGGTTTGGTCTGGACCCGCGTTCTGAGCTTCGTATCTCAGTAGCATGTTGTTATGGGCTAT
CATGTTACTACTATTAGCTTTACGAGCACGACTTTTGATGAACATATTTAATCACCACGAAAAAAAAAAAAAAAA > SEQ ID NO:3849 214639FL *Trichoderma harzianum*
ATGCTCCACCATTGCTTGCCTTATCGCATTCAAGGCCAGGTAACGACACTTGCTGCTGAGTCGAACGCAACACCGCCTT
CAACAGCTCCTCTGCAAGTCTCCCGCAAAAGGACAGGCTCAGTCTTGTGTGGGCAGCATGCGCGTCATTGCCCTTTTCT
CGGCCCTGTGTGCCGCAGCTCTGGTCCAGGCCGATTTCCACACGGCGCAAATCTATGTGCAGCCCGTCGAAAACTCCGA
GTCGCCCAGCCTCCTCGCCGAAGTGGCATACGATCCTAGCATCAGCGGGTCGTCCTCTATCATCCTACGAAGCTCCT
GAAATCCCGGAGTCTACACAGCTGGTCCGCGTCGGGTTGTACGACGTCAAGTCTGCGCGATGGATATCTGGCACAACTG
TTGCCCTCGGTGGACAACTTTGGCAAGGGCTACTCGCCCAATTTGATACTCTCAGTCGATGAAAAGGGAGAGCTTCTCAG
TGCTGCTCTCAAGGGCGTAAGGATCGATGCGGTCAGACGAGAGACTTGGCCCGCAAGCGGTGGTGCTGCCGGTGCTCA
AGGGCAAGCAGCCAGAGCTGAACAAGCCAATTGTTCTATCGCCAGAGGGGAAGAAGGTTGAGGAGGTTGAGAAGACGCC
CCTTCAGAAATACTGGTGGGTGATTGCCATTATAGTGTTCCTGGCAGTGAGCGGAGGAGGCGGCGAGAAATAGAGCCGG
CAATTGACACATACTGTACATCAATCTGAATATACGCTTCCGTGATGGGATGACCGCTGGCAAGGGTTGAGCTGTTACA
GCTGTCAGTGATCCCTGTCCTCTCACCACTGTCTAGGTACATGACTATATTGTTTGTCTTTGATACATAATACCCTATA
ATAAGACTATTGCCTGTTCAAAAAAAAAAAAAAAAAA > SEQ ID NO:3850 214401FL *Trichoderma harzianum*
CATTGGCCTCGACGACGGAACTGAACAGCGACGCTTCTCGCTGCGAGGCGCCTTATCTTTTGGCGCGAGACTGAGATTG
GAGTCCGATTCTGGCCGGTGCCCCGCGAGAGGCGCATCCAATTTCCAGCCCGGAGGAGCGCGTTGACATTTGCTCGATCC
TTATCTTCTTTTTGCTGCTTGGGCGGCAGTCAATCACATCGACACGGCACCAAGTTTCCCTGCTGGCCGTTGTGTTTGA
TCCGGTCTTTGCTCGATTGGCATGACTCTGGACGGCGTATCGACAATCTAAACCAATTCGATTTCCCCCTCCGACACCC
AAAAAAAAGCACCCCTGATTACGAAGTCCCTGCTATCACAGATCTGGCCTCTATACTGCCACTGCCACATCTCCACACC
ACATTCGATACGAAGCCTCTGTCATCGTCAGCCACGGCCTGACCTGATTCCTTTTTGCCCGACCGATTTACACGTCGAT
ATTTGGCTTGCTGTTGCTGTTCCTGCCGCATAGGCAGGCTGGTTGCTCGTCGCCATGGACTTGTTCAGGCGATCAAAAT
CGGGTGCGGGACGCCATTCAGAACTTCCGACGTCGGATGAGAAGCGTTCAAGAAACAAGGGGCTGTCGTCCAGTTTGGC
CTTCTTCCAGCGGCCGC

FIG. 1 continued

> SEQ ID NO:3851 214476FL *Trichoderma harzianum*
GCATTTTGGGGTCGCAAATCTACAGCAAAAATGGCCTCGACAACGACCAAGCAGACCCCGGCGTCCTTTGTCGGGACCA
GCAAGGTCGTCGAGACTGACTATCCGCTCATCGACAACGACCCTCACTTTAAGCGGGTTATCGGATATGCGAGAACGTC
AGACTACGTAGCTGGTGCAACCTCTGCGGCCTTTGCACCGACTGCTCTCTATGCCCTCGAGAGGCTCGCCCCGTCGCAT
GTTGGCCGGGGAGGCTTTGCCAAAGCCATGCGGTTAGCCGGATTCATTGGCTTGGCCGGCGGTTTCCTCTACTTTTACC
AGCGATCAGCCCTTCGATTCTACGGCGCCACTGAGAACTCAAGGGAAGTCGAGATGGATATGCGAGAGATGGTTTCCAA
GGTCAAGGCGGGACAGCCTCTGTATGGCGAGAGCAAGCTGAGCCCTCACCTGCAGGGAGTTGCGGCCCGACAGAGCAGA
TACTCTGCGCTCTTTTTCAGCACAGTACCGTGGTTCAACTTTGTCAACCACAACCAGCACGGCGTGGACACGGCCAAGT
ACTATCAGCAGGCCGAGAGGGAACTGGAAGCAGAGCGGGCGGCGGGCAAGAGCTAGACGGGACCAAATGTGTATATTTA
GCGGGACTACCGCTTCTTGCGGAGAAGGAAAAAAATATTGGAAGCTAAAAAAAAAAAAAAA > SEQ ID NO:3852 214572FL *Trichoderma harzianum*
CATATTTGAACAATGAGCGATGAGACAGGGCACCGAATAGGCACAACACGTGCGTCAGCACACTCTGCGAACATCAGTG
GATCTAGTTTTGGGGACAACACCCGAATACAACAAGCATTTCTAAACATCTTCTTCAGAAACCGGAGAAATCCAACGGT
GTCCCCCGAAAACACCCCGTCCCCTGCAGTGCAAGCTCAATTACAAGAGAAAGAGAGAACAGACTGTCGACGCTCTCTC
AGCTTCCGCGATCTTGACGCCCGCCTGCAGAATATCTCACCAGTACAACAAGGCACTTGCGAATGGATTTTTCAAATGC
CGGTGTTTCAGAACTGGTATGAGCATACTGAATGTGATAATGGATTGCTTTGGGTCAAAGGAAGCCCTGGTACTGGGAA
GTCGACATTGATGAAGCATGTTTTACAATACTGCGAAACCAAAGGAAAATATGCTATCGCGGCATACTTCTTTAACGCT
CGAGGGGCCGAACTTGAGCAAACACCTCTGGGTATGCTGCGCTCCTTACTATTTCAACTACTCCGGCATGAACCTCGTT
TATATGACCAGCTTCTTCCAATTTATCGCCAAAAGCAGCAAGATCACAGCTCGGGGGACTGGGAGTGGCGTGAACAAGA
GCTTAAAAGCTTTTTGCTGTCAGAGATACCAAAATGCCAGTCAGGACCGCTCCTTTTAATAATAGACGCGTTAGACGAG
TGCAGTAAAGACGATATGCAGAACGTCGCGGAATTCCTCCAGCATTTGAGTAAGAATGCGACAGATGCTGGTCTTACGC
TCAATATATGTCTCTCAAGCCGTCACTTCCCATCCATCCACTTCGCAGAGTATCAAGAACTGGTTTTAGAAAAGGAAGA
AAAGCACGATGAAGATATTATCAAATATATCTCTTCTAACTTAACGAAAAAGGATAAAGAGATTGAAGAAGCAATCAGA
AAGAAATCGTCTGGTATTTTTATGTGGGTTGTGCTCGTCATCTCGATGTTGAATAGAGCATATGAAGATGGCAAAATCG
AGGTTATGAAACCAAAAAAAAAAAAAAAA > SEQ ID NO:3853 214664FL *Trichoderma harzianum*
ATCTTCTACACGATTGCGGACAAAGTCTATCGCGGTTTCTACTGCTGTTCAATCATTCTTCAACATTATTAGCACAATC
GCCATGCCGTATATGCTAAATAGCGACCAGGCCAACTGGGGAGGTAAGGCGGGCTTTTTGTTCGGAGGGTTCAGTTTCT
TCTGCACCATCTGGTGTCATTTCAGGCTACCTGAAAGCCAGGGAAGGACATTTGAGGAGCTTGATATTCTGTTCCAGAG
AAGAGTGCCACTGAGGCAGTTCAAGACGTATGACCTCTTGCAAGAGGTTGAAGGAGAAAAGACTACGACGGCATAATAC
CTAATAAAGGAAAGAAATTAATGCTTCTACCACTCGTTCGCCGCGAAGTCGGTTCCATAGTATGTGAATAATTATTTAA
TAGGGTTACACCTTTAATAAAAAATAATTCTCGTTTGCTGGAAAAAAAAAAAAAAAA > SEQ ID NO:3854 214746FL *Trichoderma harzianum*
TTTTTTTTTTTTTTTTTTTTTTTTTGGGTTTTTTTTTTTTTTTTTTTTTTTTTTTTTTTTTTTTTTTAAATA
TGTGAATATGATCATGTATTTAAATAATAACATGGAAAATAAGAGCAGCAATAAATGAACCTCCTACGTACATCCTCTC
CAATGCATCTTACCCAACCGATTCACTGCAAACATGGGGTCTCAATCAAATGCACACCCACGGAATCGGGCGTCCGTT
AACCCATTTTGGCACAAACTGCATGGGATATCATCTTATGGAGAATCCTTCGGAAGCATCTAGAGCATTCAGGGTTCTT
TGCCGGCAGTGACATGCTTACAAATTTGTCATTTTCGGGATGCATATCCGTCACTTATCAATGTAAACCCGGACTAGTT
CTAGATCGCGAGCGGCCGC > SEQ ID NO:3855 215595FL *Trichoderma harzianum*
CTCACTACAATAAAAACACAATCTTCAATTCTTTGAACCTTTTTCAAGTTTCGCCAACATGAAGTTCACCACTACTGCC
GTTCTTGCCATTGCCGCATTCGTTGAATCGGCCACTGCTCTGGGCAAGGCCCGTGTCGTCAACAAGTGCCCCTTCAGCG
TCACCACCTGGTCCGTTGGCAGCGCCATCTCCAACCCAACAACCCTTGCTCAAGGCGGTTCCTATGGCGAGACCTTCTC
ACGAGACCCCGTAACCGGCGGTCGTGCCATCAAGGTCACCGTCCAGCCCGATGGCCTCTACACTGGCAAGCCCCAGCC
AACTTCGCCATCAACCTTGAGGGCAACACCATCGGTACGATCTTTCAGATGTCTTTGGCGATGCCTTCAACGGCCACA
AGGTCGTTGTTTCCAGCGCCAACACTGCTTGCCCCCAGATTGTTTGGGGCAGCGGAATCCCTCCTGCCGGAAGCCAGGT
CAAGAACTGCGGTGCGGATAAGGATGTGACTTTGACTCTGTGTGCTTAGAGTTAAGGGAGGACGGAATCATGTCAAGGG
AAAGGTTTAAATCAAGTTTATGATAGAATTTCAAGTCCTAGCTATGTTTAAGACTTATGACAGTATGAATTGATGAGTT
TACTTCGAAAAAAAAAAAAAAAA

FIG. 1 continued

> SEQ ID NO:3856 214307FL *Trichoderma harzianum*
TGATGATGAATAGAATGATGGACCAAGGGAATGGTTGGTAAGATGTTCTGGGAGGAATCTGTGTTTTTCTCAGGGTGAG
AGTGTATAAATGTGTAGCGTGTACATGTGTTGAGGCTCGTCGATACCCGGCAACATGATGACTGTGCGCCACCGGCCAT
TGATTTGTGCTGATCTCTGCTTGATGAACACTGCCCTGTTTACACTGTCGTGTACTGTTAGTATGTCCATCGTGAAATG
GTGGTGTGCGATGTTTGTCGCGGGCTATGAAGATAAAGCAATGAGAAAAAAAAAAAAAAA > SEQ ID NO:3857 214438FL *Trichoderma harzianum*
CCTGGATGGGGTCCGGACTGGTCTCACTGGATTTTCTTCTTCTTCTTTGGCTGTCCTCCGGTTCTTTCGGGCTCGGGCT
CTGGCGGTCTTCGCGGCAAAGGGAGATAAGAGCCCACGTGCGAATTTACGAAAGCCCTAGCGCTGATCGGGTTTAAAGC
AAGTGACGTGATGAATCCGAGTTCATTTGCATAAAAAAAAAACATAAAAATAATAGAGCCAGAGATTTGCCGACCAGGG
CAGGGGGCGCAACCATCTTCATCGTCCATCTTCGAGTGTGTGCCACCCGGAGCAGCAAAGACGGTGCCTCGGCCAAGAG
TCAAATGTCAAAAGATGGAGATGCAATATCACGGAAGCCGAGCTCCACTTGATGCTCGGGCGGCAAGTATTACACAATG
GCAAGAGATCCGGGGTAAACACCGCAGTCCCGGCCGATCCTCGAGGCCTATTGGATGAGCGTTCCGGCACCCAAAGGGA
TTTTTCGGAACCGATGGTCGGGGATTCCCACCCCCAGCTTGCTTTCTCCCATGTGTCTGTGGGCCAGAACCAGAATGCG
GGGAGTAGATACATAGATCTAGAATTGCCTTGAGATCTCCTGATATTTGAAGAATAGGAAATTTTTTAACCTTTAAAAA
AAAAAAAAAAAAAAAAAAAAAAA > SEQ ID NO:3858 214665FL *Trichoderma harzianum*
TCAATTGCAGTTTAGAGACATCTTAGAAATCAGAATGTTTGCCAGATCAGTTTTCCGTGCGGCCCAGCCGCTGAAGATG
CATGCGCGCCGCTATGCCACCGAGTCTGGTGCCAAGGGCAGCTCAAACACTCTCCTGTATGGCGCTGGCGCTGTTGGTG
TAGCTGGTGCCGCCGCCTACTTCCTCAGCGGCTCCAAGGCTGAGAGCAAGGTCAAGGAGGTCGTTGGCGCTGCTCCCAA
GGCGGCGTTTACCGGTGGTGACCAGGGCTGGCTGTCCTTGAAGGTCTCAGAGGTCGAGGATGTGAACCACAACACCAAG
AGAGTTCGATTCGAGCTGCCGGAGAAGGACCAAGTTTCTGGCCTGCACATTGCCAGCGCTGTCCTCACCAAGTTCAAGG
CCCCCGATGCCGAGAAGGCAACTCTCCGTCCTTATACTCCCGTCAGTGATGAGGATGACCGAGGCTTCATCGATCTATT
GGTCAAGAAGTACCCCGATGGACCTATGAGCACCCACATCCACGGCCTCAAGGTTGGCGAGGAGCTTGCCATCAAGGGC
CCTCTCCCCAAGTACCCCTGGTCTGAGAACAAGCACGACCACATTGCCCTCATCGCTGGTGGCACTGGTATCACCCCCA
TGTACCAGCTTGTGCGAGCCATTTTCAAGAACCCCAACGACAAGACCAAGGTCACCCTCATCTTTGGCAACGTCACCAA
GGAGGACATTCTGCTGAAGAGCAAGTTTGACGAGCTCGAGAACACTTACCCGCAGCGCTTCCGCGCATTCTACACCTTG
GACAAGGCCCCCAAGGACTGGGTCGGCGGCGGCGGCTTCATCACCAAGGACCTGCTGAAGCAGGTTCTCCCCGAGCCCA
AGAGCGACAACATCAAGGTCTTTGTTTGTGGCCCTCCTGGATTGATGAAGGCCATTTCCGGCAACAAGGTTAGCCCCAA
GGACCAGGGCGAGCTTACCGGTGCTCTGAAGGACCTTGGCTACACCGCTGAGCAGGTGTACAAGTTCTAGACGGCATGT
TGATGTGATAGAGATGGAGCCTAGGAAGAGACATACACAGGCATCATTTGATCGATAAAAAAAACCAAAGACATAGACC
AATTTGCCACTGGTAGAGAATAGAATCTAGGCGGCTAACAAATGAACATGAGCTACCACAAATGTAAAAAAAAAAAAAA
A > SEQ ID NO:3859 214144FL *Trichoderma harzianum*
AGAGATTGGAGTTTGATAATTTTTACAAACTTGTACATAATACTGATGCATTCAGCCCTTGGTCCTGATGGCATGAGCA
GACATAGCCTCGGCCGACGATTTTGCCCCTGCAATGGTTCTCTGCCGATGTTTCCCGCAGCTTCTTGGCAGTTGGGGTA
ATACGATAATACGACGATGGCATCTTTGGCCTGCACGCCGAATTGGGGTCAAATAGACGGTATTCCGAACATTTCATAT
TTAAGAAGCTGTGCTGCACGCCAACCAACCTTTGGAATGGTGTGAATTGTGAAGGACATGATGCATGGTATAGGCCATG
AGCTAGTCTCAGAGAGATGGAGCCTCCGGTGTAAAAGTTGTACATTAATACGATCAAAGCCCGCTACGAAAAAGAATG
GCAATTGTATTAAAAAAAAAAAAAAAA > SEQ ID NO:3860 214407FL *Trichoderma harzianum*
CAACCTCATAACAACCACAATGGCTGCACAAGAAGGACGAGCTCCATATCCGCCATTCACACTTGAGACAGCTCAAGTC
AAAGTCAAGGCCGCTCAAGATGCTTGGAACACCAGAAACCCAGATGGTGTCAAAATGGCATACACCCCAGACTCAATCT
GGCGCAATCGCGGCACATTTCTACAAGGCCGCGACGAGCATCAAGGCGTTCTTAACCGACAAATGGAGCAAAGAAGACGG
CTACCGACTTCGCAAGGAGCTTTTTGCTTTTACAGACAACAAGATTGCCGTGCAGTTCTGGTACGAGTGGCATGATGAG
GCAGGCCAGTGGTGGCGCACGTACGGGCTTGAGGACTGGACTTTTGCCGAGAATGGGCTGATGAGGAAACGTCAGATGA
GTGGAAATGACGTGAAGATTAGCGATGCGGAGAGATGGTTCAAGGATGGCGTTGATGTGAACACCGTCGACATTTCCGA
GAAGCACTGGTGAGGGAGGCTATTTACTAAACTTTAATGAAGTCTTTTGAATATATAGATAAGCAAAAAAAAAAAAAA
AAAAA

FIG. 1 continued

> SEQ ID NO:3861 214158FL *Trichoderma harzianum*
AGCGATGGAGGACGAGATTCGAGGTCCTTGCTTGGCCCGGGTGGCGTGGCGTGGGTGTGCCCGGGGCTGCGGTCCTGGG
AGCCGGGCCTTGCTGCTGAAGAATTTCAGAAGTTTGGAAACAAGGCACGTTGGGATTTGTGCATGTATGTAGGTACTAA
TGTATGTATGTATGTACATCCAAGTACATGTATACCTATGCGAGGTCGGACCAGCCACCATGTACCTACAAAGGAATCA
GTGCAAGCGTGCATTCAACATGACATGTCAGGTAGCGGACTTGACATGTTTGCTGGTCCCTTGCGCGAGACGAGATTGG
GATGGACAAGGTCGAGGTGGCTTACCACGTGAGTTTAGTGCACAGGGCCGCCTGCAATAATGGGATCAATCTGATTATG
GCCTCAATTCCAATGATTACAGTTGAAAAAAAAAAAAAAAA > SEQ ID NO:3862 214613FL *Trichoderma harzianum*
CGAGAGACTTGCGCTTCGGCCCGGCATTTGCACATTTTGAGAACCGAAACGAAGAAGAAAAAGGATAAAAAAAACATGG
CTTCTAATCAGTTTGATTCCCAGGCCTCGACCAACTACAAGGAGGCTTTTGCCCTGTTCGACAAGCGCGGCAACGGTCG
CTGTGCCGTCGACTCGCTGGGCGACCTGCTGCGAGCATGCGGCCAGAACCCCACGCTGGCTGAGATCCAGGAACTGGAG
AAGGGCCTTGGAGGCGAATTTGATTTCGAGGCCTTCCAGCGCATCCTGAACCGACCCGGCGGATTCCGCGACCCTGGCG
AGCCCGAAGAATACTGCCGTGGCTTCCAAGTGTTTGATAAAGACATGACGGGCTTTATCGGCGTCGGCCAGCTCAAGTA
CATCTTGACCAACCTGGGCGAGAAGATGACGGAGGAGGAGGTCGACGAGCTGCTCAAGGCCGTGGACACCAGCTCTGGC
CAGATCAACTACACAGATCTTGTCCGAACTATCCTCGCCAACTAAGATTCCCCTTGTACGAAGAACCTAACCCCCGGTG
GTATCTAAGTGCATCTGCGAACGGGATGGCGTTGCTATGTGTTTGTTTTGATTATGGCAGTGAAATTGGGCACGCTTGG
GATTGATGAATTTTTCTTTTGTACGGGATGGCCGTAGACTTTGTTTGCTACCAGTGGAATATGAACATGTGTTGGTACT
TGGAGTGCACAATGAAATGAGTCGGCCAAGCACTAAAAAAAAAAAAAAAAAAAAAAAAAAAAA > SEQ ID NO:3863 214676FL *Trichoderma harzianum*
CATTGTGGCCATGACCGTCCTCAACACCGCACAAGCCCTCTGGGCCCGCCTCGTAGCAACCCACGATCCCCATACCATA
GACTTCGTCGGCACCCTCATCATCCAATTCATCTTCTGGTGGATCCCCTGCATCCTCTTTGTCTCTCTCGACTCTATCG
CGCCCTCCTTCTCCGCGAAACACAAGATCCAGCCCGCCCCAAACAACCCTCCGCCAACGACATCCTCCACTCCGTCCT
CGTCTGCATCCGCAACCAAGTCATCGTCTTCGCCCTCCACGCCGTCCTCCTCTATGCCTCCTCTGCCAAGGGCCAGTCC
CCCAGCATCAGAGTCGACGCGAGCTTCCCCACGGTCCAGGAGTTCACCTACCACCTCGCCGTCAGCGTGCTCGCCCGCG
AAGTCCTCTTCTACACCTCCCACCGCATCTTCCACTGGCGGCCCTTGTACAGGCGCTTCCACAAGACGCACCACAAGTT
CACCGCCCCGTGGCCTTCTCCTCGCAGTACGCCCATCCGTGGAGCATCTCATGGCAAACGTCCTGCCAATCTTGCTT
CCGCCGCTGCTGCTGGGGTCTCATATCCTGACCATGTGGGTTTTTGTGGCCTTTCAGCTCATCGAGACATCAACGGTGC
ACAGCGGATACGACTTCTTTGCGGGAGCAGCTAGAAAGCATGATAGACACCACGAACGCTTCGAGGTCTATTATGGCGG
AATCGGGCTCCTAGACTACGTATTTGGGACGGATGAAAGAGAGGGCCCTAGGAGAGATAAAAAAGAATGAGCATGACCA
TTTCACACTCTCTTCATGTCTTCATGATAAGTCATTTGACAAACTGTTTAAGTTTTCTTGTATATAGCTCTCTTCAAAG
TTCAAACATTAAAGTCAAGTGTTGCTTCTCAAAAAAAAAAAAAAA > SEQ ID NO:3864 215961FL *Trichoderma harzianum*
AACAACCACCACCACCACCACTCAACCTACAAACAACGTCACAATGGCCGCCAAGCTCTCCGCCGATCTCCTCTTCCAG
ATGGCCAAGGTCCGCCGCTCCATCTATCCCTTGAACAAGACTCTCCCCATCTCAACCTCTCGCATCCACGAGATCGTCA
AGGAGGCCACCCTCCACACTCCCTCCTCCTTTAACGTCCAGACCAACCGTGCCGTCGTCCTCTTCGGCGCCGAGCACGA
GAAGCTCTGGGACATCACCTCCGAGACCCTCAAGGCCATTGTCCCCGAGGACCAGTTCAAGTCCACCGCCGACAAGCTC
GCCCTCTTCAAGGGCGGCGCCGGCACCGTCCTCTTCTACGAGGACACCGACGCCACCAAGGCCCTCCAGGCCAAGTTCC
CCATCTACGCCGACCGCTTCCCTCCCTGGGCCGTTCAGTCCCTCGGCATGGAGCAGCTGCTCATTTGGACTGCCCTCGA
GGTTGAGGGCCTGGGCGCCAACCTCCAGCACTACAACCCCCTGATTGACCTCAAGGTTGCTGAGACCTGGGGCGTTCCC
GCTCACTGGAGACTCGATGCCCAGCTTGTCTTTGGTGGCAAGGCTGGCGAGGCTGGTCCCAAGGAGTTCCAGGACATTG
ACGAGCGTGTCAAGGTCCACGGTGCTTAAGCGGCATCATCTTTTCTTGATTTGAAATTTTGAATGGGAATGCATCGGCC
GGAGTTTGTTTTTGAAGCTTCTCTTTAGACTTGCAGTCATAGATAGAGATATACACTTGTTTGTTTTCGTTCAAAAAAA
AAAAAAAA > SEQ ID NO:3865 214928FL *Trichoderma harzianum*
ATTCTGGTTTGTTGGGGGCTAAGCCTTTCAACGTTATGCGTGTTACTCCCGGATATTATCTTGCAACATGGGCTTGTCA
TCTCCCGCCAGCCATTCGCTGTGATTCGTCCCGGGATGCTCCGCGGACATTGCTTCCTGGCGTATTTCAGCATCCGGCA
TTGGTGAAGTTCCCACTATGGAGATAGAATCATGGATTTTGCCCCCGCCCCTTTTTTTTTCTTCTTTTCCACCCTTCT
TTATGCTTATCTCTCAGCCCCTAGCAAACGGTGGACGGATATTCTCATCTAGATTGCTGACAACATGCCGTTAGCCCCC
ATCAACCACGAACCCGTCCCGACCCGGGGTCCAATATTCGTTCAGCTCGGCTGTTCACCCGTATACTCGTGCTTGACTT
TTATTTTTGTTTTTAGTTGGGAGATTATTTTGTATTTTGCAGAAGCAATATTTGCCACCTGGGCAATATTCTCTCGAGT

FIG. 1 continued

CAGCCATTGTAGGCAGCTGAAAAGGCTGATCTGTCTTGGCCTTGCTCGTTTCCCCGCGCTGCAATCCATCATGTGAGAA
GCAATGGATGGAGACGAGCCATGCATCAAGATTCTTGTCTGGAGATCTCCTGTGCAGATCACGGATTCTCCCAAAGCCA
ACTTATCAAAAAAAAAAAAAAAA

> SEQ ID NO:3866  215108FL  *Trichoderma harzianum*
ATACGACAAAGTCAACTACATGATGAGCTCCCACAAGAAGAAGAACGACAACAACAACAGCAGCAACATCCCGGAGGCA
CCACTGCCGCCAACATTCAAGGAGCAGCTCGACCAGGAGGCGATCGACAGCCGGGTTCACCAGCATGAGAGCGAAGAAC
ACTCGACAGTGAAGGATATTGTCGATAAGATATCGCATGCCATTCCTGCTGTCGCCCCTCTCATCGGCGGATCAAATCC
AGACAACAAGGTGGAGGAGCATAAAGAGGTGCCTCCGGGGCCTCCTAATCGACCAGAGCATGATACCCAGATTGAAGAG
TTTGTGAGGGAGCAGCATCGAAGCAACGGCATCGAGAATCTGAGCGAGGGAAAGTCGTGATGGATTCATCCACGCTCTC
GGTTCAGCAGAGTTTCTTCATGTACCAATAGCCATCAAGCTTTTACTTTTTCTTGCTTTAATACAGTGAAACCTGCGGC
TACTATGCAGGCTCTTTACAGATAATCCAAAAAAAAAAAAAAAA > SEQ ID NO:3867  218859FL  *Trichoderma harzianum*
CATTCTAAAACAGTCAGCAGGGCTCGAGGCCTTGTGCGGCAGATATGGGGGCCAGCGACTCCAAGATAGGATTTAAGCA
GGGCATCTTCAGATTATCAGAGGAGCGCAACATTGCGGCGCATGATCCTTACTGGACTTCGGTTCGTCATGCCTTTGAT
CCCAGATGGCCGCGGGGATGCTGATGCTGATGGGGTCATAGTTTTGGGAGCTTCCTGAATCGTCGGAAGATGTTTTTAG
TCTTTTAAAAAAAAAAAAAAAAA > SEQ ID NO:3868  215066FL  *Trichoderma harzianum*
CCCACGCGTCCGTCTTCTCCAACTAAACAATAGCTCTTTTCTACTTCTAATTTTTTTTTTATCTCAACTCACCATCTGA
GCTATCAAGCTAGAAAGTAACCACAGCAAATAATCATCATGGAGCTCGTCAACTACAACCACAAGACCTGCCCCAAGTG
CTCTGCCACCATCACCTCCGAGTCCAAGACTTGCTCGAGCTGCGGCGCTACTTGCCCCGTCTAAGCTACCTCAGCTCGA
CCCGCCATCAACCTCAACCATCGCAACAACATGACGAGAATATCGAGGTGTGGCGGGACTGCAAGGACGCGCGGATG
AGTGAATGAATAGATGAATGAAGGAATGATATACCTCAGCAGGACATGGTGCATTAAGACAAGGCGTTGATGGAAGAAG
AGAAGCGATCATGTATGTCTAATATTCTAAGCTATATGCCAGTCCTTGTTACAGACAGGCGGCTAGAATAGTTCCTCGC
AATGGAAGGAATCTAGAATGGCAATGGGCAATGGGCAATGGCAAAAAAAAAAAAAAA > SEQ ID NO:3869  215110FL  *Trichoderma harzianum*
GGATTTGCGAAAGGGCGAGATTTTGGGTGTGAGGCGGCAGACGGTGATTGGGGCGATTTGGGCAGCTCTGCCAAGGGTT
GGGTTCATGAAGATACAGTACGTGTTAGTGATGTGAAGCTGCTCCATGATGGGACTCGGAATGGCGGACGGATGCGGTC
ATGGGCTTTTGGAGATTGGCTTTTCTTGGTGGGCCGAGACGGCATCTAACTGGAGATTTGATGAAGGGGAATTCGAGCT
ATCAATACGGATATGCAGGACTGGATGATTCTGATTTGATGGCCCGAGGTGAAACTTGTCTGGAAACTTGATTCGGGGG
CAGCGAGAAAGATTGCCCAACGACCGGGTGTCTTTTCTTTCTTCCTCTCTTTGTCTAAGATGTACGAGTACGTCGGCGG
CAGGGCGAGCACAGTTAGCCAGAAGCAAGGGGATGGACTTTTTGACACAGACATACGGAGTACAGAAGAAGAAGATGCA
GGGAGCGTCATCCTCCCGCAAGATGTCAAAAAAAAAAAAAA > SEQ ID NO:3870  215176FL  *Trichoderma harzianum*
GTCGAGTTTTCTCGCTGGAAGGTAGTTAGCGGGGACTGCCGAAGATGCATGACCCCGGGAGGCTTGCAAGCAGGCGGAG
AGCATACATAATAAAGCTTGACGAAGCTATCGCGGTCCGCCTGGAGGTCCCCATAGTACTTGCTCGCAAACTGGGCTTT
TGTATCGACAGTCAATATGGCTTAAAGCAGATGCGCGGTAAGAGAGGCACCCTTATGGGCGAGACGCTGGGAGAGGCAC
TCGGAGACATACAGGCAAGCTCGTCGGGCGGTAAGCCTTTTGCGCACATTAGTATATTAGCGCAAGCAAGCAGGGTAGA
CGCAATGGCAATCACTCACTCACTCCATATTGACTTCCTGAAAGTTTGAGCACGGAGCTTGCTTGACACCAAAAGGCGAGG
GTTTTTAGGGGTGAACTCTTGAGGTGAGACAGTGAGTGAGTTGTGAAAAATAGTATGCTAAAGGGAAGTGAGACTATTA
TATAGTAGAATAGGAAGTTTCCTAGTGTTACGACCTAAAAAAAAAAAAAAAA > SEQ ID NO:3871  215303FL  *Trichoderma harzianum*
CCCACGCGTCCGCCCACGCGTCCGCGCAATCGAAAAGGATTAATCGCAACTCCGAGATCCTGCTGAATCACAATGAGA
CCTACTCAGGTTCGTCTGGGCGGCGGCGCCCCTCAACCCAAGACTGGCCACTGGCTCGTGACTGGGGCTCCTTTGGTG
GTGCCAAGCAGAAGGGCATTATCGACTACGGCCTGTCTGCCAACCGTCAGAACCCCTTTGCCGGTGCTGCCCACGATGC
CATCTTCAACACCTTCCGCCGCACCAAGTCCCAGATCTTCTACTGGCTCCCTCCTATGCTGGCTGGCTACTACCTGCTG
AGCTGGGCCACCGAGCGAAACCACTACCTCAACTCCAAGGCTGGCCGTGCTGAGTTTGCCGACTCGGAGTAAAATGGTG
CACGAATATGTTGAATTATGGGTGTCCAGGGGACACAGTGTATATCAGCGTCTAGATTAGGAGAAAACAATAGAAACGT
TTGACTCTACGAAAAAAAAAAAAAAA

FIG. 1 continued

> SEQ ID NO:3872 219027FL Trichoderma harzianum
GTGGTGTCGATCCAAGGGGACGCGTGGCAACCGCTGCACAGCCCGCGTGTGGTGACTAGAGGCGGCTAACAGGTGGTAA
GTAATCGGATCTGCTGTTTCTCTTGTGCAGTCTCACACATGTCGCAGGGGTGGGTTTTGAATGGAGACGAAGCTTGTTG
CGATGAATCAAGTCATGCTAGCTGCATGCCTGACCGAGATGAGGAGGAGAGATGGAGAGATGGAGAAGAGAACGGAGCA
GTGGGAGAAAGAAAAGAGGAAGAGAAAGAGGCTAGGAAGCATTGCCACATTAAGTACAACAGGGGGGTTGATTCAGATC
GAGGAGAGCAGAAGGGGAGAAGTGGATAGAATAGGGCTTTGTGTCTGTGCTGTGGAGGAGGCATGTGGCCGTGCTGATG
AAAGAATTGGAACATGAAGCTTACCTCTATATTAGGACCAAAGTACGGAGTAGACCCTACCAAAAAAAAAAAAAA > SEQ ID NO:3873 215085FL Trichoderma harzianum
CCCACGCGTCCGCCCACGCGTCCGCGATGATAAAGTTGTGGGGTAATTTAGATAGAGATGATTCGGCTGCAACGCTGAA
AAGTGTTGATCAAACTGGTAGGATTCAGTTCATTATTGTTCCTTCGCCCTTCGTGGATCGACGCTTCGCTTAACAGTGG
CAGTGCTCGCGGATGATGATCCGTCTGACGCGATCTGGAGGCGGACCCAGAATGTGGATGAGGGAATCTCCACAAGGCG
TAACTCCTTGGTTTACTCTTGTTCGCACACAGATGTATCTTGAGAGTTGTTAAGGCTATAACGAGTGCGGTTGAGATAC
GTCTACGACTAAGCATCTTGAGCAGAGTGTTAGTTGCGAAACGTTCAATTGACTAAGTAAGAGTAGAGAGTATCAAGCC
TGCAAATCCATCCCCCCGAATCTCCGATTTTATGAGCCACCATAGCTCTTTTCGCCAAATGCAAATGCCGTAGATAGTG
CCCATCCGAAAAAAAAAAAAAAA > SEQ ID NO:3874 215114FL Trichoderma harzianum
GAACAAGCCACATCGGGGAGACGGGAAGATGGTGACACGGATGCGTTTGTGGAGGTGGGTAAGCTTTGCGCAACATGTG
CCAGCCTTATCTTGATATTGGACGCGGCGACGGCGAAATGGTTGGAAGGGTGTGTCTATGTGTACCGACAAACGCATGG
CTGATGAGACGGTGAATAAAACTGCACCAAGAAAGAGATGCATGAGAGATGAATGACCAGTACCTAAGGTCTATGACAT
GTCGCTTTGCACTCGGTCGGACTCATTCACATGTAGTAAATACTACATAACACCCACTTGCTCCAGTAATCATCACTTA
TAATAATACGGCGAGAAGACAAGTTGACACAGGGCGAAACAGGGCGGAACAAGGCAAAAAAAAAAAAAAAA > SEQ ID NO:3875 215194FL Trichoderma harzianum
CTTCAGAGAATCATTTCTATAGTATTCGTCTCTTGCTTTGGTTCCCAAAAGAGCCATCGAATCCACCCTGGTTGATGAT
TGTATATCCTCGATATCCAAGAGTGAATATTTTTGGTCCTCTCGAACCATCCGGAAGGATGGCGGTAGAAGCCTCGTGC
ATCTGCTGTATAGAGAGTTGTTTTTTCTCTTGATGATCTCGACCCCGTCAATGGTCTGCCTTCGGGCGCATTGGCGGGG
TGGATGTCGATGGACGTCTGACAGGCTTTTTTTTTCATTACATTTCTGAGGCTTGCCTTGGATGTGAAGAAGAGTGGAA
TTCACATTCCAATTTTTTCTTTCTTTTCTCCTACGCCGCTGTGTTGGAAAATGTTGCCTCGTCCACAAAGAGTTTCGAT
ACAGGCCTTGGCGATGCTTCTTCATCCAATGGCGTGTCCCTGGCCAGCATTCCCTCGCTTTTTTGATCCATAGAACCTA
TAGAACTAGGTGAATCGCAAGAAGATCAAGCCGATGATCCAAAAAAAAAAAAAAA > SEQ ID NO:3876 215459FL Trichoderma harzianum
CCCACGCGTCCGCACACACAACTCAACCACACTTTCAACTCTCAACTACACCACAACTTACAATCTCATCTCGCGACCA
ACCAACTTTCACAATGGAGACTGTCAAGCAAGCCGTCAACTACGTCGCTGAGTCCGTCCAGGGCGCTGCCTCTGGTATC
AGCAAGGAGACCAACAAGGAGATTGCCAAGGACGCAGCAACGTCGACGTTTCCACTCGTTTGTCCGCTGGCAAGGACGCCC
TTGGTGACAAGATCGACGGACTGGCCACAACAACAAGGCCGAGGCTCACAAGCAGCTGGCTGAGCACAACTAGATTGG
CATAAGGAGCTTCGATTGCTTCACAGGCGTTGAACCGGATCAGAGCGAAGGGAATATATAGCCTCACTAGGCAGGAATT
GATGATTTGAATTCAAAAAAAAAAAAA > SEQ ID NO:3877 215680FL Trichoderma harzianum
AAGCATTCGCCTCTCGTTCAGATCTCAAGACAAAAGCACTCAAACCAATCACTCAACCTCTTCAAGACCACCTTTCAA
AACAAACCTTCAACATGAAGTTCACCGCCGTTGCCTTTGCCGCCCTCGCTACTCTGGCTACAGCCAGCCCTCACCCTCC
TCCTCCTCACGGTTGCAAGCCTGCTACCTACTCTTGCCTTCCCAACGACAGCGGTTGGCAAGTGTGCAGCACTGCCGGT
CAGTGGGTGTTTGCTGGCACCTGCCCTCCCAAGACTGTCTGCAAGTTCGACAGCCAAAATGGCAGCCCCTACTGCGTTC
CCCCCAACTTCACCATCCCATAAATCCATTAAATGGGGATCAACGGGGCTACTTACAAAAGCCTACCGGATGAGCATGA
GATTTAGAGTTTTTGGTTGCTAAGACGTTTCGTGGCCTGTCATTGTCTTGCAGATCAATCCTGGACATAAAGTTTACAC
ATAACATATGGTACACTCCTTTGAATGCGATGTATCTCTATAGCTATATGAATACAATAAATTGAAGTAAAAAAAAAAA
AAAAAA

FIG. 1 continued

> SEQ ID NO:3878 214907FL *Trichoderma harzianum*
CGCATGATATTGAATGGTTGGAAAGTCAGATGGAGGCGTTCAAAGCAATCACAGCGACCCTGCCGCAGCTTTCCTTTCA
TGAGACGAAGCGGTCGGAACATGGCTTTGTCGTCGAACAGCGGCATTCCATGTCTGGCTCGGATGGTGTGCGGATCGGC
CTGTCCGCTACTCATTCGGGTTTGATCCAATTTGAGGGCCGCGATGCAAACTACCAGACGTTTGTAGAAAAGTTCCGCG
AAATGATACATAAAGCCAGGAAAAAAAAAAAAAAAAAAAAAAAAAAAA > SEQ ID NO:3879 215116FL *Trichoderma harzianum*
CCCTTTTTCTCGCAACTCGCTGCTTGGCTCCAGTATCTGGCATTAGCACCTGTTGTGTGCGTTGGCCTGCCGTAGGTTG
ATGCATCTGCAGCTGCAGCGTTTCCGCATCACATCACCTTCATCTTACATGACAAACCCCCTCTTTTTACTCCCTTCGA
TACGGTTATTGGTTCGAAGGCTTTACAATTCAGACGTGCAGGCACTAAGACATCCATCTCGACTGTTAGAGGTTGTCTT
GCTGCAGACGTTATCGTACCAGCACGGCTTATATAGCACCAGACAGACCCCTCCGCTGCAGCTGGTTTACTTCTTTTTA
TTAATCTCAACTATCACCACGGCTACCTATTCTTCACTTCAAAAAAAAAAAAAAA > SEQ ID NO:3880 219108FL *Trichoderma harzianum*
CGCACTACGTGGTCTCTTGGGGTGTAGCAATCAATACTTGTGTACACGTAGATACAGTAGTCTATGTCCGTGTGCTTCT
GGGGGTGGGCATTGATTATCTCCGTGCGGAGGAATATGGGGGTGTTCGTGTGTCTTGGTATCAATCAGGCTATGCGGGA
ATACGATGTAGTTACGACGCCTCCTCTACTGTACATTACTGACATGCCCTGTAAAGACAAGGTGAGCATACGAGACAAT
GCCGCTGTCTCTTTGGGAGGGAATTCGTTAGAGTCAGCCAAGAGCGCCATGTTGAATGAAAGAATCGGACATGGCTTAT
CTTAGTCCCCCGGAAAAAAAAAAAAAAA > SEQ ID NO:3881 215117FL *Trichoderma harzianum*
ATCTTGGGATGTTCTGCAGACGATTGTCAAAGCCGGATTAACCCCGCAGGCATTGATGGCTGTCTCTCATCTCCACTTT
GCATCCTGTTGTTGGGGTAAAAGAATAAGCTCACCGTCATTGCTCAGCTTCTCGAAATCGTGAAGAATGAATCGCCGAA
AATTGATTACATGTACTCACCAGGGACATGTAGGCAGCTTCATATTTCACTCCTCCGACGTCTCGGCTAGACTTAGCCA
TGTCGATCAAGCATGAGCAAATCCCACATTGTTAGCTGTCAATCATTGTCCAGTGTCATCTCCCCACGTGGCAAAGACG
GCGTCAATCAATTTGGACAATCCCTGTGATATCTTAGACGCATCCTTGGCATCTTCTAAATGCTTAGAGTTTTGAGCTG
AAAATCGGTCATTAAAGTAACGCAAAAAAAAAAAAAAA > SEQ ID NO:3882 215331FL *Trichoderma harzianum*
GTGCTCTGCTATCTCAATTATCTCCGATCTTGCTTGCAGAAGAGTCATCTGTACCGCAGGAATCTCACCTAACAATGTT
TCCAACCCTCGTCAGACGGCTGGCCCAATCAGCAAAGGAGCCCCTCACCAAACAGGTTCCCTTGACTATCATAAACAAT
CCCTACAAGGCTCGAAAAGTATGGCCACCTGACTTCAAAGGGTTGACTCATCAACAACAGCTTCGGTTTGAGAAGAAGT
ACAAGCGTCGCATTACCCTCGCACACCATTCACCAAGATGGGAGAAGGGTGTGAAATATGCGCAGCTCATTACAATTGG
AGCCGCGTTGGTATGGTTGCTTTTCTATTCTGAATTCGAGTGGTGGGGACGACAGTATAAGCCATCAGAAGAGTTGCGA
AAACACTACACCAATCTCTTTGGCGTTCTTGATCCTGAAAAGCGATACGAGCGCCGGAAGGACGCCCCAGAAGTAAATC
CATCATCAAAAACCCCAGAGTCGAAATGAGCTGTAGGATAATGGAGCTCTCCGATGCGTGTAATATAGTACTTGTATAT
ATATGGCGTTTGGCGCGATACCCGTGTTGGGCAAGGGAGGAGACAAAGAAATGTATGCATATGCTGGCCATAGTTCTAT
CCAAAAAAAAAAAA > SEQ ID NO:3883 219145FL *Trichoderma harzianum*
GGACAGGGGAAGGGGGTGTTAGTTGCGATAGCCGATGTTTGCATGTGAAGGCCACTACTTTACCAAAAGAGGATGCTGG
GATGGCTGTTGCCGGTCGAGTAATTAATATGCATAATAGTATCCGCAGGTGATGAGGTGATTTTAATGTATAATTGCTA
AAAAAAAAAAAAA > SEQ ID NO:3884 215124FL *Trichoderma harzianum*
AACAAAGACACGCTGCCAGCATTGGGCAAAACAGCTTCAACGAGGGCAATTGCTGGGAGGAAAACGGCGTCAATTGGCA
GCAGGAGAGACTCTTGAGTCTTTTTTTCACAGGGGATGTAAATAGCCGTAGGCGGAATGACGTCAGGGCTAGCGCGGAC
AGTTGCCGAATTTGGAAATCAGGGACACGAACGTTGCAAAGGGAACGGCACCGACCAAAGGGCATTGACAGCTGGTATA
ATTGAGGCATGTGGATGATGTGTTGAGATAAACAGCACGATTTACATGTCATTGTGAGAATTGAGTTGCGTGCATTGTT
TGAAAAAAAAAAAAAA > SEQ ID NO:3885 214920FL *Trichoderma harzianum*
AACCACGGCCACGACGACCGCGTCTGTCCGGGATTGATCCTGTCAACTGCTTTACCAGATATCTAGCCGTGCCACGATA
GAGCGCGCATGTCGGCGAGAGGGGGGCAGAAGAGGAGAAGAGTCAAGAGAAGGGGGGGCACAGCTGATAGACAGAGCGC

FIG. 1 continued

```
CGTCGAGCCTGTAGCATCGCCAAACTCAATGTAGGTACGTCTGATGAGTGTCGCTGCATGCAGATGACAGTCGTGGATG
CATGTCATTGGCACTTGATCAGCTCCATATTTGACAGTGCCCCTCCAACGGCGGCAAGCGAGAGTGAGGGGTTTGCTGT
TGTTATTTGTTGTTGCTGTTGCTTTGCTGTTGCATTTTCCTGAGGCATATGGGCCAAGATGAGAGATGGATGGATGACA
TGGATGAGATTGGTTTTTGTGTATAACAAAGCTTGATAATGGCATTGAACAAAGCTTGTGCCGGCTAGTCGATAAGGAC
GATGTCGATAACGCGTATCGCAGCTATCAGCCCATCTAATCGCAGCACAGCCTAACCCCCGAAAAAAAAAAAAAAAA

> SEQ ID NO:3886 215024FL Trichoderma harzianum
GTGGAGATCATTTTACTGTACTATAACGGTGGTGGCTGGATCGTCATGAGGCAAATCGGGCAATGCGATGCGATACGAT
GGATCACGGCTAACATGACAATATTGATTAGTAGCATGATGATGAACCAACAGCACAGATCTGGATGGCTTTAGCTTTG
ACCACATGCCAAGCAGGCTGCCCAGGTTCACAGACCAGCCAAAAAAAAAAAAAAAAA > SEQ ID NO:3887 215139FL Trichoderma harzianum
GGAATGCTTGAGCCAAGAGATTGCCTAGGTAAGGAAAAAAGAAGAGAGAGAAAAAGGCAATTTGTTAGCGATCCATGGA
TTGATTCCATGACTAGCTAAACGAGGCTAGATGAGATGAGGCAGCGTGAGAGAGATGGATGGGACGAGATCTGGTGGGT
TTGGTTTGGGAGGCGGTTTGGAGGTTTGGGGATCATACAGTAGTACTAGTACTACAAGTGCTGATGATGCATAGATAAT
GTACTTGAGGGGCGATGAGATGCGATGCGACGCGGTGCACGCGTATGTCATCCATCAGCGGTGATGCCCTCTCA
GACGAGTACGGAGTCGGTACCAGACAGCAATCAAAATTGGCGGGTGTTGGCTCTGCTCTGGTTAAAAAAAAAAAAA > SEQ ID NO:3888 215669FL Trichoderma harzianum
AATCAAACTCTTAATCTCTATTCTTAAATACATCTACCTCTCACAATGGATTTCGTCAACAAGGCTATGGGCAAGGAGG
AGCGCTCCACTCAGGGCACCGCTCCCGCTGCTCCCCAAGCAGGCGGCCAGGTCCAGAAGGACGATTACGTCGACAAGGC
TTTCGCCATGGGTGCCAAAAAGAGCGGCCACAACATGGATCGCAACACACAGGAGAAGATTACGGATGCAGGCCGTAAC
ATGTACGAGAAGGTGACAGGAAACAAGGTCGACCCCAAGTGGTCTAATTAATGAACGGACGAGTTATGACTCACAACAA
GACTGTACAATAGTAATAATAACATCTTACCAAAAAAAAAAAAA > SEQ ID NO:3889 215670FL Trichoderma harzianum
ATAAATTCGAGGTGTTTTAGACGCAAGCTTCTCTTTTACACACTGAAGCTGCTGCTGCAACCATCACCAACATACCACA
CGCAACAACACAACACCACCACGTAATAACGAGCAGAACACCCCTCGCTTGAACTTGTTGCAAAAAACACTCTCGCCTC
TATTTCATAAATCAAATTACACACGAACAAAACAATGAATCCAACAGTCAGAGGCTTCTCAACCGCCGCAAGAGTGCAC
CCGCCCTTTTTGCCACATCTCCGCCCATCGCCGCGCCGAGCCCCGATCCGACGCTGGTAAGCACTCAACTCTCTCTCAC
GTCCCCCATCCATAAGGATACCATAGCAGCAAAAAGACACAACCAAAAAAAAAAAAA > SEQ ID NO:3890 44508FL Nicotiana benthamiana
GGCTATTATGTGTTGATTAGGGAACTATGGCTTCAAAACTACCTATAGTGAAAGCAAAGGCTGTTGAAGTTTCAAAATT
CTTGACCAAGCATGGATGTGCATACTACAAGCAGACGTTGGAACAGAACAAGCAATATATTCAAGAGCCACCTACTGTG
GAGAAATGCCAGCATTTGGCAAAACAAGTATTCTACACTCGCTTAGCTAGTATTCCTTGCCGCTATCAAGCATTCTGGA
AGGAACTTGATGTCAAGCACTTGTGGAAGCACAAACAGGAGCTGAAAATCGAGGATGCTGGCATTGCTGCTCTTTTTGG
CCTTGAATGTTTTGCTTGGTTTTGTGCTGGGGAGATCATAGGACGAGGGTTCACGATTACTGGTTATATGTCTGAATG
TCTCCAAGTATTAGGTTCGAAAGGAATGACTTATGTCACTGTTGATGAAAGGTCATTGTCAATCTCTACTTTGAGCGGG
ATAACACGTATCAGCGAGATACAGATTTTCAATTTTCATGTTTAGCAAGTACACAATGTATGCAGAGGATGAGGTCTTC
TGCTAAAGATTTCAAAGGCTGAGTTAGGAGTAATATACGTGCTTCAATAAAAAAAAAAAAAAA > SEQ ID NO:3891 108256FL Nicotiana benthamiana
CACACTTCTATCTTACATATTTAGCCAAAGCATCGTTAAAATGGCGTACATTAAGCAAGCTTTTCTCTTGATTGCTCTC
TTTGTTGCAATTACAGTTAATCTCTCTGGATCTCCTAAGTTGCAAGTGATGGCTTTACGAGACTTACCCGAAGAGGTTG
CAATGATGAAAGATAAATTACTTCCATTAGGTGATATAGTAACTTGCTTGAAATACTGCAATGTCGAAAGCGATTGCAG
TGATGGTTGGATTTGCTCCAATTGTGTTCCATCTGCATTTCAGGGATGGAGATCTCAATGTGACTCGCTTACTGCTACT
GGTGAAGGTTATTTTGGAACTATACTCCGCGCTAAGCACAACAAAATATAAATTATATTGCTGCAATATATGAACTATT
TATAAATGCTTGATCTCGTGTTATATTCAAGCATTTTAAATAATATAATGTTGTGTTTCCTACTTGTCCAAGTTTATGT
AAGAAAATGAATATGTAACCATGTTTCTTGTTGTTGTCATCTTATATGCAGTTATTATGAAATATATGTTCTCTATTAT
CCCAATTAAAGTGGCACGAAACTTAATGGGAGATAATATTTACTATATATGATATGAATAGTGTCATTAACAACTGGTT
TGGATGGTTGTTATGTTGTATTGTTATTTTAAATACAATGTTTGTTTTAAAAAAAAAAAAAAA
```

FIG. 1 continued

> SEQ ID NO:3892 43341FL Nicotiana benthamiana
TTTTTTTTTTTTTTCATAAGAAAAAAATGAAAAAAACGATGTTTCCAGCTTCTGGTCTTTGACATAAAGAAATAAGTA
ATAACGAAGGGGACATTTTCAAATTATCTCCTAGCCAGACCCCACTTGTAGGACCATACTGGGTTGTTGTTGTTCT
TGTTCCAACTCCATTTTAACGGTCAGCAGCTGCTACAATTAAATAGCTACTTAGAATTACAACTCCCACAATTATGTGG
CCACCAACAGTAAATGAATAACAATGACAGAATGTGTAAATCATACTCGTCTTCAAGCGGACGCGTGGGTCGAGGGG > SEQ ID NO:3893 48493FL Nicotiana benthamiana
GGGATCTGCTTCAAGATTGTGCAGCTTGTTGAGTAGCCAGAAATGATTTAAAGCTACCTTAAGCTTGACTTCAATTTTG
GCAATTATTCGTCACACTGCCTAAGAAGAACCTAAACTTATCCAGGCCTCTGGAGTCCAATAAGTAGCTCCATTTAAGA
GGCTTTCTATGTCCAAATAGTTTGAAACAGAGTCAGTTGCTATCTTGTTTATGTTATGCCCCTGCAATTATAGCTTGCT
TATATGAGACTGGCTTAATGATGCGAAAAAAAAAAAAAA > SEQ ID NO:3894 44121FL Nicotiana benthamiana
AAAGCAAGATATGATTCAAGCAAGTGTTGATCTTCAACTTAAAGACCCTCTTCCTTTGGATTGGGAACAATGTCTTGAT
CTTGAATCAGGGAGAATGTATTACCTAAATAGGAAAACATTGAGGAAGACATGGGATTGGCCAAAGGATCAAAAGCTAG
ACCTTGAATTAAACATGTCAAGTTTCAGCCAACAAGAAACAATGGAATATGATCATAACTACTATAATAACTCAAAGAA
GCAGAACAAAAGCAACAACAGCAGCAGCAGTAGTAGCAGTATGATAGCTTTGCCATGTTCAAATTGTCATCTCTTAGTT
ATAGTGTCACAGTCTTCTCCTTCTTGTCCTAACTGCCAAGTTTGTTCATTCTCTACTTTCTAAGAAACATCCTTCTACCG
CAAAATGTTATGACACCTTGAGCCTCTTGAACTGAACTTGGATGTACTGCTGCACTTGCTTCTGTTTGAACAATAGTTG
TCAGTGCAATGGAGATTAAGTAAAAAAAAAAAAAA > SEQ ID NO:3895 48673FL Nicotiana benthamiana
TGTAGGTTTGAATGCTTCCCAGTGTTCCTCTTTTATTATTGAGGGAGAATCGGGGATTATGCAGATGGAATTACGTTGG
GGCAGTAGGCTAATTGTACATAGTAGGAAGAACGTAAAAATTCTTGGAGGTTTTACTGAAGTACCAAGACTCGGATGC
TTCAAATTCCTTATCTTGCTTCTGCCTCGAGGATGAGATGTATCCGACTTATGAAAGGCTACAAGTTATATGTACTTAA
CAGTGTAGACAATATGAGTGTAATTGTTTATTTAGTAGTAGTTTGAAATTGTAGTTCAACATCCCATGTGAATGACGAT
CTGAGTTTGTGAAGCAAACAGCTCTTATGTAAGAGATATTTTGGCTGCATTAAAGGCCAGTTCGGTTACTAAAAAAAAA
AAAA > SEQ ID NO:3896 57374FL Nicotiana benthamiana
TTTTTTTTTTTGGAAGAAAAGAAGATCAAATGACATTCCCATTAGAGGTTTCTGTACAACTTCAGGCGACAGACAAAA
GTTAGAGGTTTCTGTACAATTTCAGGCGATAGATATAGCGCCAATAAAGATGTTTCTGGACAGGTTGACCATTCGCCAT
ACCCTGTAGAGTATGTACAAACATATAGTACAGTTTCAGGAACGCAAATAAATACTTAGCAAGAAAACAAAAATCATCG
TTCTTTTTAATGATAGATCCAGTGACCATCTATCACTTGCTTCACAAATCCTTTCCTTCCGTCAACAATGCTGTGGAC
TTGCAGATGGGACAATTGTTCTTCATAATCAACCATTTCTTTACGCAATCTGCATGATACTCATGTCCGCACTTGAGTG
TCCCAATGCTCTCTTGATCATCGTAATCAGACTGGCATATGACACAGAAATCAGTCTTGTGATCCGAACATGCAGCCCT
TTCCAAATTGCAAGGAGTTACCGATGATGAAAATGATCTTGTTTTCAAATGGCTAACAATGACCTCCTCTGATAAACCG
GTTTTTACAGTTCCAATCTGCTCTCCCAATGCAAGAAGCTCCTCATAAGACATGTGATCTACGTCCATACGCATCTCTC
CGTGCTGATCAGCAGGATCACGCACTTCATGGTAGCCAGGAATATCCAACATTGCCACCGGACGCGTGGGCGGACGCGT
GGGTCGAGGGG > SEQ ID NO:3897 44139FL Nicotiana benthamiana
TCTCTTGGGGAAGAAATTGGCATCCCAATAGAGGTATATGGACCTGAGGCAACCATGACTGGTATCTGCAAACAGGCTA
TTGAGTGCATCACTGCAGCTGCATAGAGGAACCAACTCTGTATTCTTCAAGCTTAATTGCTTTGCTTATTCTTTTCTAG
CTTTGTGTTAGCATGATGTTGTTTGCCAAAGATAAAAGAGATGTGTTTGTATTTTTATGACTTTTTTTTACATAAGAAA
CGAGCCATCAGCAATGGCTTCGTTTCAAATATGGCTCGTTTCAAATCAGTTTAGTAACGCAGAAAATTGCTGCAAAAAA
AAAAAAAAA > SEQ ID NO:3898 126358FL Nicotiana benthamiana
TCTGTTTATAGTCAGAGACTGATCAGTTGTCCTGCCATAACTTTGGCACTTTTGACATTTCTGTAGCAGGGTGCCTGAA
AGAAAAACATTCTCAAGGTGGAAAAGTCGGTTGAAAAGATAAAGCATTTTGCCATGTGAATGTTATACTTCTACTCCTG
CTGATAGACGTGAATTCCTTCTGAGATAACAAGATTAGGTTTACAATTGGTAGTCAGATTTGAAGCTGTATTATTTAGG
GAAAAAGTAGCCCTTTCTTTCAGTTCAGAGTTCTCTTTTGAATCACTTTTGACTTCTCTTTAGTTTTGGTATGTGTACA
GCTTAGGATTGTTATTGTTGCAACAAATATACATAACATTTTGAGGCATCATATCCTTCATTTTGAAAAAAAAAAAAAAA

FIG. 1 continued

> SEQ ID NO:3899 44503FL Nicotiana benthamiana
AATACAGTTTGGATTTTCTTTCTTTGTATTTTTCAAAGCAAAGGCAATGGAAGGGAAGACTATGTTCAAGTTATCTCAT
GTAGTTGCTTTCTTGCTCCTTGCATCGCTTTTTCAACCTCTTACGGCAAGAGATCTAGTATTCGAAGTAAGTGACGGAA
TAGAAGTCTTGCAATTCCCAATGGCAAAAGAAAACCAAGTGGAAACACTTGATGATCCCTCTCTCTCAATAATTTGCCC
AGGAAAGCAATCATGGCCTGAACTTGTGGGAAAGCCAGCGGCGACTGCTAAGAGAATAATTGAGAAAGAAAATCCCATA
GCCAAAGTTCAGTTTTTGTTCCCTGGTATGGTTAGGCCACTTAATTATGTTTGTGGTCGAGTTTTTGTTGTTGTTAACT
GGAAACTCATTGTTCGAGATACTCCCAGCATGGGTTAATTAAATAGTTCTATGGGACTATTATGGAAGATTCAGAATAA
GTTGCCCCAAGAATTAATAAATAGAGTACTGGTGTTCTATAGTGTACTCTTCATGTACTGTACTATTTCAATATAATAA
ATAAAATAAGTGTGGCTTTTTAAATTTGTATTAAAAAAAAAAAAAAA > SEQ ID NO:3900 57707FL Nicotiana benthamiana
CACCAGAATAGCACGGCGTGCAAATAAGAATTCATTTTACAGATGTCAAAGTGAAAGACCCTTCACTGTGTAATCAAAT
CTTGATGTCTTTCTTCCAACCTAATTACCCTGAGTTGGGTAAAAAAAAAAAAAAAAAAAAAAAAAAAAAC > SEQ ID NO:3901 126632FL Nicotiana benthamiana
AGAGATCGGGAAGAAAAGATGCGTAGAATGGTAGAGTATGGTTGGCAAAACACGTCGTCGAATGAGTATCTTGATCATA
TTAAACGAATGGAGAGATCGCCAACGATGCACCCTGATCTTCCTCTCTACCCAAATGTCCACTCCCTCTTCAAAAATGG
AATAGTGAGCAACGGACAAGAAAAGAAATGCACTACACTAACACCACAGTCGCAGAAGAAAGTTCATTTCGTGGAACCT
AAAGCTGAACTTACCATGAATGAAAAGAAGAGTATTGACATGGAGGCTGATGGCTATATAAAGCAGAAGCACGTCAACT
TTGAGCTCCACAAATGGAGAACCTTCAAAGCTTGTTAAAAAGTTTCCAACGTACTTCATACAAGATATACTACATGATA
TCTTAGTATAAATAACATGTAATATATGTCTGTCTTATTAGCTTCTGTTTGTACTCTAAAGGGAAGATATCTCTTATA
TGCGCTGTGACTATATATTTCGTAGATGTGGTGTTTTGATTTCAATTTATCTAATAATAAAGCTATAGGTATGTTTATT
AAAAAAAAAAAAAA > SEQ ID NO:3902 212777FL Trichoderma harzianum
AAAGCCAAGAAACCATTGAAGCACATAACAAACCGTTCGAAAACCGCAACAATGTCTATCGTCCAGCCACAAGAATACC
AGACCGTTGACGACGTGCCGTATCAGCGAGGCCGTCCTCTCCAACAGTCACCCCCGTCTTCCAGAACAAGCTGCCCAA
CTCGCCTGGCAAGACGTCCATCGGCCTCCTCGTCGACTTCCCGCCCAACTCGTCGACGCCCCCCCACACGCACGGCGGC
GCGGCCATCTCCGTCTTCGTCATCAAGGGCACCGTGCTCAACAAGATGAACGATGGCCCGACTCGTGTGATCCCGGCGG
GCGGCACGTGGTTCGAGGCCCCCGGCTGCCACCACCGGACCAGCGACAACTTCAGCACCACGGAGCCGGCGCAGATTCT
GGCGACGATGGTGGTTGACACAAAGACTGTTGAAGAGGGAGGGATGGCGGCTCTTGTTGTGCTCGACCCGGAGTATGCT
GATATCAGACTTGGTTAAATTGATATGGATGCTGCAGTGAAGAGAACCGGAAGCTCGGAAAGGGTGTGGGTGTTGTCAA
TATCAGAAGTGGCCAGCGGAGGCTCGGATTGCTGTTAGTAAACGGGGCATCTCAGCAGGAAGGCAAAATGAATATGTAA
AGCAATCAATGGCAACGAATCGTTTTGAAAAAAAAAAAAAAAAA > SEQ ID NO:3903 212995FL Trichoderma harzianum
TGCCCCTTATGATGTTTTGTGTTTGAGACACGGCTGATGAGGGCTGAGAAGTTGTTCAACATTGCACAACGTCTGGAAA
GACGGCAGTGGGCCATTCGAGTAAGAAAAGAACAACAGACGGATCCAGACTCTTGGTAGTAGCTAGGCAGCAGTTTAAC
AGAAGGAACAAAACGGGTAATGCGGGTGGTTTTGGACGCCATGTGGCGACGTCTCTCCAGCTTTCTCCATCTTCTCCGT
ACTGACTCTGTCTCCATTTGGCGGGTTAGTCTTGTCAGTTTGGGGTTGGTCTTTGTCATGGAGCCATGGCCAGAGCCAG
TGTGGGCGGCCATGCCGAGTTGAATGGCTGACCAAGGACAATGCAGCATTTACGATTATATGAATGTGCTCGTATATAC
GAGTGCTACTCCGTACCATGCTGGTGTACCAAGTGATATATGAACGGCATGCACGCACTGCTCACTTAAAAAAAAAAAA
A > SEQ ID NO:3904 214256FL Trichoderma harzianum
ACTGCTTCGATTCCGCGCTCGCCTGTTCATCTCTCTACGAAACCGCCCCCAACACACGATCCTACAAGAGGAAAAGCG
GATTGATTAAGACCCGCCAAAGAAGAGGCGTCACGCAACATGGCGGAGGAGATCCTGGACAAAGTTCGGGATGTGGTGG
AGGGCCAAATTGACTTTGAGGGCCAGAGACGAGCAGAAGGCCTTGCCACTCTGTTACTTGCCCTGACAGGACTCATCGC
ATTCAACGTCGGATACGTACTACAAGACATCGTCAAATGCCTATATGTTGGACTAGGAGGAACGGTCTTGACATTTCTC
ATTATCATTCCGCCGTGGCCCTTCTATAACAAGAACCCGGTCAAGTGGCTGCCTATCGGATCTGCATTTAACACGGGCG
GGACATGACGACTGGATAACGCCGCTCTGAGTAGGCCCCGGCGTTTTGTCACGTTGTCAAAATCAGCATGTAGCTTAAA
TCTTTTCGAGAAAAAAAAAAAAAAA

FIG. 1 continued

> SEQ ID NO:3905 214888FL *Trichoderma harzianum*
CCCACGCGTCCGCCAGGCAAGGGTGTTCAGTCGAAATCCAACAAGGGCCCTCCATCACCGACATTGGCCAATGTTGCGC
GCCACTTTGCTGTGGACAGCGGCTCAACATTGCTTGCCACGGCGGTAATCACAGTCTTGATATTCGGTGGATGCTGCTC
TAACGTGTATGCTTTAGAGGCCATCATCAACTTCGAGCCGACAAACGGAACCCTCGTAACTTTCGTTCAATTCCTATTC
GTCTCTATAACGGGCTACGTAGCGCAATTCGATAGATCACGCCCGCCGTTCTTCCTGACTCCCAACGTCGTCCCGCTTA
GCCGCTGGCTTGTCAATATCCTGTTGTTCTTTACCATCAACGTCTTGAACAACCATGCCTTCAGCTATGACATATCCGT
ACCGGTTCACATCATTCTACGATCCGGAGGTAGCATAACCACCATGGCTGCCGGATACCTTTACGGCAAGACGTATTCG
CGCCCCCAAATATTTGCAGTGTTTCTGCTGAGTATTGGCGTCAGCCTCGCTGCTTGGTCGGATTCAAAAGACAAGAAAC
CGAGTGACGGTATTTCTGACCCTGTATTCAACCCTGGGCTCTTGATCATCTTTGTCGCCCAAGTACTTTCGGCGATCAT
GGGGCTGTATACCGAAGCAACATATCGAAAGTACGGGCCACAGTGGAAAGAGAATCTTTTCTATTCCCACATCTTGTCA
CTGCCAATGTTTTTGCCCTTTGCGCCCTCCATGTGGCGCAACTTACTCGTGCTTACCAAAACCACTCCTGTTACACTAA
ACATACCATTTACTGCAAAAAAAAAAAAAAA > SEQ ID NO:3906 215880FL *Trichoderma harzianum*
CATCGACAATGGCATCCCTGCTGCGCACGCTCTCTCTGGCCGCAGGGCTTTTGCGCTCTTCTCAGGTTGTCAAGCCGTT
TGCGGCTGGCAGCTTTGCGACGGCAACGAGCAGCCCGGCTTCCTCGTGGATGGGATGGTTGTCCAAGCCCGCAGTTGGA
GGGACCCTGCAGCAGACGCGGGGCATGAAGGTTCACAGCTCGGTCAAGAAGAGGTGTGAGCACTGCAAGGTTGTTCGAC
GAAAGGCCGGCAAGCGACACAACGGATACCTGTACATTATCTGCAAGGCCAACCCTCGACACAAGCAGCGACAGAGCTA
AGGCGACTGCGAGGATGGTTCTTCTCTTTTTTGACGACGATGACGACGATGACACCCGGATGAGTGGGCATTCTGTATA
TTATTGGCGTATAAAGGGTGACGAAAGGGAGCGACGAACAAACACACACAACGGTCTGGCAAAAAGCAATTGATAGACG
ATACTACGGCAATGGGCTTCGAAGACGTGGAGGACATGACACGAGCCCAAGTGCGAGCTTTCTTGCATGCTCGAGAAAT
GACGGTTCAGAGTGCCGTCGTAAAAATGTACAATTTTATGTAGTGTTACATACCCCCGATATACCTCTCCATGCTTTCC
CTAAAAAAAAAAAAAAAAAAAAAAAA > SEQ ID NO:3907 212363FL *Trichoderma harzianum*
TCTTACAGTATCACTACTCCATCTCAGTTCGTGTTCTTGTCATTAATTAACTCGACCCACGCGTCCGCCCACGCGTCCG
CCCACGCGTCCGAAACAACCTTCTTCATCAATTCTACTACAACGACCTTCCTACTTAAACAATCTCTCGATACCAACTC
CCCAAGATGAAGTTCACTCTCGTCCTTGCTACCTTTGCCGCCGTCGTCTACGGTCAAACCATCGATGACATTCCCGCAT
GTGCTCGTACTTGCATTGAGAACGCCGTTCTAGCCGCTGGTTGCTCGTCTGGAACTGACGTCGCATGCGCTTGCGCACA
TTTCACTGCTGTTCAGAATGGCTCTACTAGCTGTGTCATTGCTGCTTGTGGCGTTTCTGTCGCCATTAACCAAGTTCTG
CCTGCCACCCAGGCTCTTTGTGCCAACCAGTGAACTCATCCATCGAGAGGGAGAAAATGACATGGGAGAAATCAGGTA
CTCTTGTACATTGACAAACAAGTACATAGCTGAATGGTGTGAATGAATAAAACGCATTGCTGCTGGAATAAAAAAAAAA
AAAAA > SEQ ID NO:3908 214267FL *Trichoderma harzianum*
AGAGCATCTTCCTGACATGCCGGGGTTGATGCAACGCTTTGACTGTATGGAAACATCCGTATTGCTGACATACATGTCT
TCCATGTTGTCTTACACTGCACTCAGGAGGAGCAGTCATCCACCGAGTTGATTCACATGGCAGCAAAATTGTGCTGGAT
CTACTGCAGCGCAGATCCTCTATTTGGGCATTTCTTCTCGGAGACAGACACAGATCGGCTCGGCGAACCCGAGAGCAAG
TGATAGCAAGACAAGCACAGATATGCTTGGCGAGGCTGTCCTCACCAGGAAACGAAAGAGGAGGTTTCACCAGCAACTC
CATTCCCAGCAGAGGTCAGCCTGTCCTACCTGTCACATTAGAAAAAAAAAAAAAAAAAA > SEQ ID NO:3909 214472FL *Trichoderma harzianum*
GGGAAAATCAGGAGAGATGAAGTGGTATAGAGAAAGGAAAAAGAAGGAAAAGCAAGGAAAAACCCAAGCCAGAGCCGAT
AAAGAGGTGGAAACGCACGACAGCACGCAGAGACCAGACGATCGTTGGGTCTAGGATTCAATGGGCTGACATGCCACGC
GCCAAATTTTCTGCTTGTTCCTTTCGCCTCTGACACACACACGCACTGACAAAGCTGACTGGCTGTGGGCAACTCCCTA
GGCCGCCTCGCTCTCGGTCGTATGGCACCGAGAAAAGGGACCAGACTGATAGCGGCGGGGCCTCGATAAACGCCGCAGC
AAGGGTCTACCGTCAAGAGCCGGAAGTTGTTGGCTCGCAGCTAGTTGCCCGGTTGGTGGATCCGATAATGCGAAGAGAG
TCTTTGGGACCTGCGATCAGATTGCGCAATACTAGGGGGTGGCAAGAGATTTGTTTGTTGGTGGGATGTTGTTGGAGGA
GGGAGGACGAAGGAGGAAGAGAAGAGAAGAAGAAGAAGAGAAGAAGAGAAACAAGAGATGAAGAAAGAAGAAG
AAGTGGAAACTAAGAGAGAAGTAAAAAAAAAAAAAAAAAA > SEQ ID NO:3910 214740FL *Trichoderma harzianum*
CCCACGCGTCCGCCCACGCGTCCGAAGACTACAAAGCTTTTGGTCCAGCAACCATAAATCCAACTCATTGTCCCTCCAC
CACGAAATCTAGCAACCTCTCCTCCTCGCCACACAGCCCGCAATGCTCACACCAGCTTCTTCAAGAATACTCGCCAGCG

FIG. 1 continued

```
GCGCCCGCCGTGCCCTTTCGTCGCGCAGCTTCCACGCTTCGGCTCGGCATCTGAACGACTCTCCCCCCCTGCCCGCGCG
GAAGCCCATGGGCGCCTTCAGAGGAGGTCTTTTCGGCTTCTTGTTTGGCAGCGTCCTGGCCGGCGGTGCCGTCTACAGC
TACGTCCTGCAGGAGTACAAGGCATCCAACGAGTTGCTTACCGAGGATATCTACACTCTTCAAGCCTCCGTCACCCGAC
TGACAAACCACGTCAAGATCCTTGAGGAGAAGATCCAGCAGAAGAGAAAGTAAAGCCCGAAAAGATAAAAAACACAAAT
AGCGCAATGTCATTAGGGATGGTATGATACCAGCGCTTCAACGCTGGTGGAAAATACTGGGCAAACGAACAGCATTATG
GCAATACTTGTGTCCTTGTTTGTAACAACCTAACAAAGCCTCAATTGTAAATTGTACCTTAAGTATCTAGCCTCTGAAA
TATCTAGCACAGGAAACAGCACAAAAGCCCATCATACGTTTCTCCAAAAAAAAAAAAA

> SEQ ID NO:3911 215825FL Trichoderma harzianum
GTAGCATTAGCTGGAATTTTGTTCATGCATCTGGCCCAGCAACAAGGTGAGAAGAGAAAGACACGATACGGATTTGCAA
GTCGGTCTTCGAGATCTACTCTGCTAGGAGACAACATCTTGCTCGGCTTTTAGAATTCTGACATGTCTTGCCGTGGTGA
AACGCTCATCCTCCAGGTTAGGTGCTAGACAATAAACCTCGACGGGATCTTCGAGTCATGATGACGCACGGCAAGGCCT
CCGACCTTCCTATCGAAACCTGGAAGCCTGGTCTTCTTTTGATACGAGCAAGATGTACTGTACATCGTAATCAATATAG
CTGGCAGAGTATGGACCTGGAAAGATTGGCGATGCCTCCAGACTCCAGATCGAATAACCAAATTCTTCGTCAGAAGTTG
CCACAGCTGCACGGTCCCTCGCGCCCTCTAATCAAGAGAGTCAGCTACTCAACTCAGATAGGGCAACATATCCCAATAA
ACCTCTGCAATAGGCAGGAGGAGATGCGTAATATACTAATAATGGAACAAAAAAAAAAAAAAAA > SEQ ID NO:3912 215888FL Trichoderma harzianum
ATGGATTTGAGACACCAGGAAATGCAATGCACCTGTCTCTCGCTACTCTGCTGGTTAATTTCTGACTCTGGCGCTAATA
CACAACGACGATGGCGATGCTTTTTCCATACCCCATAGACCCGCTAGTCCCATCTGACATTACTCGACGATCAGCACAT
GTCGACCATCATATCCGCGCATTTGGGCTGCTACGGGGATATTTAGATGCCAAGGGCGAGCCTAAATGTTGAGCTGGTT
GACCAACGCTGCTTGTGACCAACAAGGAGCATGAGTTGGCCTCGTCAGCATTGCTCCCGCCAGAAATCTTTTACAACAC
AATACTACAGTGTACCTCCTTGGGCTTGACTTTCTACTACTCGTACAGGTCAAGCCATGTCAGATAGTCAGACCGTTGG
TAGTTCCATGTGGAGAGCTGAAAAAAAAAAAAA > SEQ ID NO:3913 212454FL Trichoderma harzianum
AGATACCCTCCCCTTCTTCTTCTCTTCTTTCCCCCCCTTCACATTTGTGTCTTGACGTCGTATTTCGCTTCAGCGTCAT
CCCCCATCACACATACACACATAGCAACTTGCCGACGTCATGGCTGAGCAACTGAGATACGACGGCCAGGTCGTGGTCA
TCACCGGAGCTGGCGGTGGTCTGGGCAAGGCCTATGCCACTTTCTTCGGCTCTCGAGGCGCCAGCGTGGTCGTCAAACG
GAAC > SEQ ID NO:3914 212808FL Trichoderma harzianum
CAGAGGATTAAGGATTGGGAAATAATAAGAGAGTTGTCGAGAGGTCACTGGTGGCAAATGTTTTTGTTATAGGTAGCCC
ATCAACCCGTATCACACAAGACTGAGCAGTATATATAGAATTCTCAGAAAAAAAAAAAAAAAAA > SEQ ID NO:3915 213911FL Trichoderma harzianum
AATAGAGGGAAAACAAGAAGCGCTGCTTAGCCCCGATCATGCGTACAATCTTCACACACTTGTGTCAGCTCATACCAAA
TCGAGCTGGGATTGGTTGCCTCTGATTCGGGGGGTATGGCAAGAAGGCACATGGTCTGGAAGCCCTGAGAATGGCCGCT
GATTTCGTCTGTGGCCAACACGAGTTGGTGCCCGACGTGGAAGGCATTGCCTCGTCGAACCGCAGAGCAACTTTGCTCA
TAAGACAAACTATGAGCGCTGTGTAACATATCCTTTGCGAGATTCGGTGTGTGATCGCTGGCTGGGCGGGGAAAAAAAA
AAAAA > SEQ ID NO:3916 214275FL Trichoderma harzianum
AGATTGTGAGAAATACGAAGATATTAGTGGATTTCTCGTACCAGGAACGAGGACAGACATTGGTGTGTTGATGAAAATA
GAAACTTGAACCGGCGAAACCTTGAACGGTGAGTACGAGATATGGAAGACGAATAGCAGCGTATGAGTCAAGTTGCAGC
ACTAGACTTCTTGGTTAGGCCCTTTTCTCTTCCCATTTTCCCGCCATGAGCGTGGATAGATGCATCTACATGGTGATAG
GCGAGCCGAAATCGAATCATTTCTCACGTCTCCAAAGGCCCAGCCCTACGTTACAGCCGGCCATCGCTAAGCAGATCGC
CTACTCGGTGCTAAATTCTGACTTCTCAGGCAGCACGAGATGCCGTCCAGTCGCTGCTTGTTCACGGGCACAAGGGGGG
GATCTCTCCCTTGATGCCTACTTGTATACGAGAAGAGAGACGACGGACATTAGCCGCATGCAAGATTACGAACGGGTCA
TCTCGCCAAGAGAAAGCTTGTGTTGTATGTTACCGCTTCTTTGGAATTAATCGCTATCGAAAGGAACAGGGCCTAGAAC
TTAGTAGCTTCCCATCGAAATTCTCGTGCTATTGTTTCCTTGATTGTGCCAAATAGTGCAGCTAGCTAGCGCGTAATTG
CGTTTACGAATTGAAGCTATTGGTGCTGGATGGAAAAAAAAAAAA
```

FIG. 1 continued

> SEQ ID NO:3917 214502FL *Trichoderma harzianum*
GTTTTTGCTGGATGGCTCGGTGGTTAGCAAAACGGCACGGCGCGGCACACGGCTGAATGGCATGTCCGCATCTTCGGCT
GTTCGGGAGCTGCGTCACCAGAACAAGGTTGGCCCGATGTCTGGATGTCGCTGCTGATGGGCTGAGAAGTGCTGATGTG
TTCCATTGCGTGCCTGTAAGCTGTCTATCAGTCACACAATCAAGTCATCCTATATGGCTCGTAATGCTGAGGTTTGATC
TCGTTCGCGGGTTTCGGGCCGGGGGGGAGCTGTTTTATTGTACGAGTAGCAGCACGTTAATTAAGGTGGTGCCAGATCG
ACGAGCTGGGACCGAGTACGGGTACATGGAGGAAAAAAAAAAAA > SEQ ID NO:3918 215772FL *Trichoderma harzianum*
CCCACGCGTCCGCCCACGCGTCCGGGGGGGAATTGAACGGGGGTGAGGGCTTTATGAGAGAGGCGAGCTTTCGTACGA
GCCTTCGGATCAGATAAGATCAGGTCGGGCTGGTGACAGGCAGCCACGGCCCACCAGGGTCCGCCATAGGCGTACAACG
ACCCCGTAAGATCCCAGTAATGGCTCATTAATTGCTCCAGCTGTGGCTGGCATGATCATCGTCACATGGCCGGGTTTGG
GCGACTAAAATTAGCGGGCTGTGCCAGCAGGATGAGACCAAGACGGCAGAGGAGCACGGCCGAGAAGGAAAAAAAAAA
AAAA > SEQ ID NO:3919 215827FL *Trichoderma harzianum*
GGCGTGGGAATATGTGCCCCTCGGACCGTTCAACGGAAAGAACTTTGGCTCAACTATCAGCCCTTGGGTTGTTGTCGCG
GATGCGCTGGAGCCCTTCCGAGCCCAGCCGCTGCCGAATGATACCCCTGTTCAGGATTATCTCAAGGAGTCACAGAAGG
AGAGCGTGTTTGACATTCAGCTTGAAGTCGGCCTTACAACTGCGGATGGCGACCATGTCGACCTGTCCAAGACAAGCGG
CCGAAATCTGCTCTGGTCCTTCCCGCAGATGATAACGCACCATACCGTTGGCGGATGTCCTCTCAGGGCCGGAGATTTG
TTGGGCTCGGGAACCATTAGCGGCTCAGAGCCTCGGGAACGTGGTAGCTTGCTTGAAATGACCGAGGGCGGCAAGGTCG
ATGTTCAGCTCGAAAAGGGCGGGGTGCGTCGCTTCATCCAAGACGGTGACAGCCTGAACATGCGAGGATACTGCGAGAA
GAACGGAGTGCGGATCGGGTTTGGCGACTGTGAGGGCACGATTCTGCCTGCTCACGGGCGTAAAATTTGGGAGGGGAC
AACGGCATAATGAGAAATGTAACCAAAATATCCATTAGATGAAATCAAAAACAGAAGCCAAGAGCTCTTTGGGGAAAAA
AAAAAAA > SEQ ID NO:3920 212492FL *Trichoderma harzianum*
GTTTCGGAGGCTGATTCAGTCGGAGGGGCTGCCTTATTGCGGCAGAGGAATAGTGACGTCATGACTATCAAGGACCCTG
GAGGTTACCTAAAAGAAAAGCATCTGGACGAGGTGACGTAGCCATCAATGCGATCGATTGTTTGCTCTATCTCCTCGGG
TCGGCTGTTGATTTAGTATTAAACTAATGGATATGAATAGTGTTAGAGTGTGCGAATGGATCTCATTGTTTGAAAAAAA
AAAAAAA > SEQ ID NO:3921 213813FL *Trichoderma harzianum*
CCCACGCGTCCGCCCACGCGTCCGAGATCAGATTGCAGGCACCCTCAATTGGCATCACATCATGCTGGCGACAAGAGCA
CTCCGAGCGGCCCACGGGCCCAAGCCCAACATCACCGGCTTCAACATGCGAGCCCTCAAAGAGGCCACTGGCCAGCCCC
GATACGACCCTTGGGAGAGAGCCGAGGCATGGCGATACAAGGGCACCTTTTCCAGATGGAACCGATTCCGGAGCGGCTT
CCCTGGCTTGGGAATCGCGTCTGTTGCATTTGCCGGATACTGCGCCTACGAGTACCTCTTCCTCAAGGATGAACACCAC
GGCGAGGGACATGGCGAGGGGCACCACTAGAGCGTTTTTTTTTTGCGAGCGAGAGCAGTCAGGAGTGTGCGAGAGGAGA
AGAGAGAGGAAATGTATATACATCTCTCCAAAGACAAGAAAACTCAGGCCTGGTCTTGCGGCGGGCAAAAAATGAATCC
AACACAAATCAATATAAACTCTATTTAGAGCAAAAAAAAAAAAAAA > SEQ ID NO:3922 214291FL *Trichoderma harzianum*
AATGTCAATGGAATTGAATGATTGCGTCCTGGTAGTACGAGTAGGACTTGTACATCAATGTATGCCGGCGGCTGACAAT
CAAGGTTCTCACAGCGGCCGGTTAGCCGTCAGCATCTGCCCGTCAGAAAGGGAGTTGATAAGATTTGTTGGGTCGAATA
GTAGATCGTTGATATGGCTGTTGTCGATAAATAGGCCTCAGGGCGAGATAGAAAAAAAAAAAAAAAAAAAAAAAAAAAA
AAAAAAAAAAAAAAA > SEQ ID NO:3923 215781FL *Trichoderma harzianum*
ATGAGGCTATGTTTGCCCTACCTGCCATGGGCCAAGGCCCTCTCTTCTCCATGGCCACTGCCGCCGCCCGTGAGAACGA
GAAGACCAACGTCCGCGTTAACGAGGTGTATCTGATGTTCCGCGTTGAGGTTGACGAGGCTGCCAAGGAGCATGGCGTC
TCAAGCAGCTCCGAATTCGCCTCCGTCTACGAAGGAATCCTGAACAACCCTGAGATCCGCAGCTCGCGCGTTCGTGTTG
CCTCGCCTGCTGACTTCACCGACCTGAAGTGGGCTAAGAAGTTCTAAAAAGACTGATGCGTCTTTTTTAAACCTTCGTG
TTTCTCTCCATTAAGCATTTTGAGAAATCATCTCCCTGTTGCTGGCTGATTACACATGGTTCAGTAGTTGACAATACTG
TTAAAAAGAATGAAATGAAATAAATTGAACAAAAAAAAAAAAAAA

FIG. 1 continued

> SEQ ID NO:3924 215830FL *Trichoderma harzianum*
GGAACCGCCCGGAGGTTGTTGCAAGATGCCGCCGCCCAGCAGCGTCACTATCTCCTGACCATGCGGCCACTTTTTGTTT
TATTTCCCGAGAGAGCAAAAGTCGTCCCATCCCATGCGGCCGC > SEQ ID NO:3925 215929FL *Trichoderma harzianum*
CTCTTCCGCCTTCTTGATGACTTTTGTGGACGCGCGCAGTATCTCCTTGATCTTGTGCACTGGCCGCAAATGGGGCTTG
CCTCGTCGCCTGTCAGAAAAGGGGCACATGTCAGTCATTCCAATGACGTGTATAACGAGGGCGAGTGAATATTCTGATA
CTTAAGGGGTGTATAGGCAGCTATGGGGGTCTGACGAGATCCAGTGTTACTCACATTTTACTTTGCGCTGCCTGCACGT
ATCGCTGTTAAGCAGAAGCCGACGGCAGAAGCGATTAGACACTGGCGTCGATAGTCTGAAAGACGAATCATTGCTTACC
AGGCTGTGATACCACAAGGTCAGTAAGAGTAACAGCGGCAGGGTATGGAAGCAGGGGAGTCGATGCAAAGATAACATGT
CCACACACACACGCACGCACGCACCGTTGCATGCGCGACAGTACGCATATCAGGATACATGTATGTACACACTCAGATG
CATAGGAGCAAAGGAATGGGCCGAACCTAGCGTCCTGTTTGACCACCAAGCGCTTACCTGCTATATTCAATGCTCGAGG
CATTGGCTCTCGATGGTATTCACAGAAGTGTTGAATTGACGAGCCCTTACTCTTGAAAAAAAAAAAAAAA > SEQ ID NO:3926 212714FL *Trichoderma harzianum*
AAAGACTGCTACAATAAAAACACAATCTTCAATTCTTTGAACCTTTTTCAAGTTTCGCCAACATGAAGTTCACCACTAC
TGCCGTTCTTGCCATTGCCGCATTCGTTGAATCGGCCACTGCTCTGGGCAAGGCCCGTGTCGTCAACAAGTGCCCCTTC
AGCGTCACCACCTGGTCCGTTGGCAGCGCCATCTCCAACCCAACAACCCTTGCTCAAGGCGGTTCCTATGGCGAGACCT
TCTCACGAGACCCCGTAACCGGCGGTCGTGCCATCAAGGTCACCGTCCAGCCCGATGGCCTCTACACTGGCAAGCCCCA
GACCAACTTCGCCATCAACCTTGAGGGCAACACCATCTGGTACGATCTTTCAGATGTCTTTGGCGATGCCTTCAACGGC
CACAAGGTCGTTGTTTCCAGCGCCAACACTGCTTGCCCCCAGATTGTTTGGGGCAGCGGAATCCCTCCTGCCGGAAGCC
AGGTCAAGAACTGCGGTGCGGATAAGGATGTGACTTTGACTCTGTGTGCTTAGAGTTAAGGGAGGACGGAATCATGTCA
AGGGAAAGGTTTAAATCAAGTTTATGATAGAATTTCAAGTCCTAGCTATGTTTAAGACTTATGACAGTATGAATTGATG
AGTTTACTCCAAAAAAAAAAAAAA > SEQ ID NO:3927 212877FL *Trichoderma harzianum*
CTCGTGTGGCGCCTTGTCTCAGGGACAACAGACGACGAGCAACTCAAAGACCAGAGCTAAACATGGCTTGGCTAGATGG
CAATAAGCAGAGCACGCTTCAATCGAGAACAGACGCGCTCGACAATAAAGGATGTGCTACGGCACAGCCATTGGGACAG
ATGATGTCGCGGTTCAACGGTAAGTCTTTTGATCTTGTTGATTGAGCATCATAACGTGAGGCCGGCTCTAGTTGTTCAG
GACGATAAATGCCACTTGCAATGACCGAAGCTGTTTGAGTCTCAATACACTCTGTACCAGATGAAAGGGCTTCTATGTC
TGCTAGGTTTTCATAGATTTGTCATAGTTATGACTCCTGAAGAAGTAGTTGTACTGCGAATGAAAAAAAAAAAAA > SEQ ID NO:3928 214342FL *Trichoderma harzianum*
AGAGACGACTACGTTTGGGTCACATGTGCTCTGGAGTTTGGTACCTAGTTATTTGAATGGACGACAACGTGGAGGAGGA
AGCTCAGGTAATGAGTGGGATTGGCTTACAGTATGTTGAATAGGATGTCCGTTAGAATGCGGAATGCAAGTAGTTTTCA
ATGCATCTTGATTTAAGCCAAAAAAAAAAAAAAAA > SEQ ID NO:3929 215806FL *Trichoderma harzianum*
CATCAAAGAACAAACGCATCGTTCAAGATGAGAGCCAAATGGAGGAAGAAGCGCGTTCGTCGCCTTAAGCGCAAGAGAA
GAAAGATGAGGGCTCGCTCCAAATAAACGACTCGCTCTACCACTTGACTTGACACATCTTTCACATTTTGAATGAGTTC
ACGATAAAACACGACAAGCAAAGCTGCTGCACCACGGTACCACTCTATGACCGATTACAGCCATCAAGTTGGAATCAGC
ATATTGGTGCGCCTCTCCAATTCAGCTACGGGAGTCAATGGACGAACGCGAGAGATGAGGACTGGACAATTTCAGTCAG
GTGGAGACATCGTTTTGAGGACGCGAAGGCCATGAAGCAAAACGCTGCTGCAAGAAGCACGCTTAGGATCGATACGTTG
CTTGACAAAGATCAAAGGCAGAATTTACTTCATTTCCGAAAAAAAAAAAAAAA > SEQ ID NO:3930 215852FL *Trichoderma harzianum*
CCCACGCGTCCGGCTAATACATGGCTCTTTCCCGCTCAGATACGTTTACAGTAGCAGGTACTGCCTACCAGGACTTTAC
TTGCTTTTGGCAACTTGGGTAGGCCACGGCTGTCATGAAGGCGCATCTAATCCGTACATTAGCGGTGATACCCTGCGCA
CCTGTATTTTGACATCCCGCGTGATGCGGGATTCCAGAGCCGTTTCCAACGGCCTTTTGGGCATTGATATTTAGTTTTC
GATATGAGAGCTAGTACTTGCAGATGAACAACCATGAAGCACTATTGCGGCACTAGCAACAGGATTGCATTGACATCGA
CTCAATATGTAGCAAAGAAAAAAAAAAAA

FIG. 1 continued

> SEQ ID NO:3931 215931FL *Trichoderma harzianum*
AAATTAATCTATCGTGGTGATCAATTGGGAGCTTCATACCACCACTGAGCTCGTTCCGGCTTGCTCGGGCTTCTTCTTC
TCGCCAGGACGAGCCTTCTTGGCTGCTTTCGCCTGCTGAGAGCCTGCTGCTGGCAGACATAGCACCGCGTATGCCACCT
GGACAACGGCGACGACAGGCAGCGCGGATTGCAGCGTCAGCACCGGCTCTGCCACCAGGTCGTTGAATTGAGCGGCCAG
TAGCCCGAGCAGGACAGCTACTCGGCCGAAAGCGATGCCCTTTGACAAGGCATTGTCGAACGTCGGGACCGCGCCCACG
GTGGCCTTTGGCTTGCTGTCGGTAGCCGGAGCTGGAGGAGCTTTTGCCAGTGCTGAGGACATGGTGATTGTGTCTACTG
GCGCATTCCTGTGATTCTTGGAGTTTGAGCTATTTGGACAATTCGAGGTTCCAGAAACATAGTTCGGCCAATGGCGGCA
ATCACGTGACCTTGACCAAGGGAGCTTGTCGACCCAACCCTTGCTTCACTCTGCGTACATGTACGAGTATATACTTGAA
TCTGGAGGTATCACGATCAAATTATTACGGACAGTTGATTGTTGCGAGCAGCATATAAATACAAATGCATGATCAATCT
TTAAGACTTGAGACAAAAAAAAAAAAAAAA > SEQ ID NO:3932 212719FL *Trichoderma harzianum*
CCCCAATCGCCAAATACACAAATCCATTGCGCTACAAAGAACAAGCACCATGGCACGCCAAGCCTGCCACTTTCTCCTT
GGCCGCTGCGCCAGTTGCTTCTCCCGCAGCCTCCGCGAGCGCTTCCAAGCCCAAGCCGTGCTGCGTATGCAAAGAGGAA
AAGTCGAAGCGCGATGAGTGCATGCTCTTCTCAACGGCCAAGGATCCCGCAGCCGACTGCAGATCGCTCGTTGACCAAT
ACAAGAGCTGCATGCAGGGCTTCGGATTCACTGTATAAATCAAAATATCTTCATCTTGGCGCTATGCCTTTGTACATTA
TCACCATATAGACTACTCGGAAAAGTACAGCGCTCGATTATTCTACTAAAAAAAAAAAAAAA > SEQ ID NO:3933 212883FL *Trichoderma harzianum*
CTTTTTCGGCGTTTGGCATCAAAATCCCTTGGTCAGCGAACCCCGAGCCCGTGCGCTTGGGAAAAGTATGGGGGATTGA
CTTTTCGAGGGAGGGTCATGTGATCTTAGTACGTACCGCAGTTTTTAGTAACAGCCTAGAGGTTGCAAGTTTTTTTTTA
GAAATTCCCAACGCCAATGTTGGCTGTGGCAAAAAAAAAAA > SEQ ID NO:3934 213120FL *Trichoderma harzianum*
GTTTGGCTTGCAGTAAGACCGGCTTATGAGAAAGACCATTGTGAGAGATGTAAGGCTGATCCGGAGCTCTACGTCATCT
GAGACATGACATTGGCATGATGAGGGTCCAGTAACTACCTGATGATTGGGGTAATCGAAAGAGATGCAGAGAGAAACAC
GCAACTCTGAGAAAGCGTCCCGTTACACACGGAACACACTGCCTCCGGACAGCGGCTTGTGGCTCATTGCTTGAGTCCC
TTAATCAGCAATCCCCAGGTTCTCTTGACAGCTCAGCGGTGCAGTTTTGCGGGCACAGCTGATCCACCCGTCAACGGGG
CGGGACGCCGGGAAGCCGGGACTCCGGGGCTAAAATGACATCGCCATGACATCCGCACCGTCCGACCAGAACTGCTACT
ACTCAAGACGGTAAGCAAGTGCTAGCAAAAGTGAGTTTTACGAGGTAAGCAAGTAGGAACGTGGCTTATAAAGCCACAG
CTAGCTTGAGGCGAAGGCTGCTAGTAGGAACTAAAGTCAGCTTATACTATTTATAAGCTCACTGCATGGGCTAGTAATA
ATAGCTCAAAAAAAAAAAAAAAAAAAAAAAA > SEQ ID NO:3935 214819FL *Trichoderma harzianum*
CCCACGCGTCCGGGATCACCGAAACTGAGGATGTACGAGTACAGATATTTGCATCATGGATCTGATATTGGGAGAGGAG
AGGAGATGCACGGGCCTTGCTTTTTTGGGGATGCAGGGAGGGGAAAAGCCGTCTGACAAGTCATTTTCGCGTATTGAGA
TGGACAGAGTTCTAGATCCATTACTAGTTGCAAGCACGGTCTGACGGCATGTCGTATGGTGTTACTGCGTCTTGTGTGA
GGCCAAGACAGGACATAAGATTTGGTATTTTCTGTGTTGTTGAATGGATTGATGGAGGTTTTACAATACGAAAAAAAAA
AAAAAA > SEQ ID NO:3936 212902FL *Trichoderma harzianum*
CCCACGCGTCCGCCGTGACTGAAGTTCAACCACATCCCAAACACAATATAAAACCCTCACATTTTCAAAAGAAAATCGA
TTATTATCACACTAGAAATTAAGAAAAATAACAGGAAGCATGTCTGACGAAGAGGGCGGCACAACAAGATGCTGCGCCC
CGTTCCTCGCTCTCACCGAGCCCATTGAAGTCAGCGAACTAGGATGGCCTCGACAAACCATCCGCATTTTTCCAATGGC
CCTGGCCCAGTCCCCTCTTGTTCATCAACGAAAGTAGCGATGCGCGGGATCACTGCGCCAACGAGCGAACTTTCCTTTC
GTACCTCCGCCTGTCGATATACATGGCCATCGTCTCTGTCGCCATCACCGTCTCGTTCCACATCAAGGGTACGCCCAGC
GATCTCGAGCGCCGGGTGGCAAAGCCCCTTGGTGGCATTTTTTGGGTACTGTCTGTTGTGACTTTGGCTTTAGGAGCGG
GAAACTATATCAGGACTGTCAATTTATATGGTAAAAGAGCCGCTATTGTGCAATCGGCTGGAAGACTCAGGTGGTGTT
GGGTATAATAGCTGCTTCAATCATTGGGACGTGCATCATATTGTTAGTCGTAGATAAAGTAGGGCAAAGGTGACGATAT
ACAGCAACTATGCACACCGCAATATCATACGAAAAAAAAAAAAAAA > SEQ ID NO:3937 213839FL *Trichoderma harzianum*
CATGTGGCCACGGGAATGACGCAAAAGGCGCCGAGAGCGGAAATGGAGAGAAAAAAAACCCAATTGCACCTCGTGATGA
TGCCACTCAAATGTCTGTGGTCGAGCCACTGGCTTCTACCTACGCTTACATTACCTAACAAGGAACGAAACATTTTGCG

FIG. 1 continued

```
GCAAGGAGAATTGGATCATTGACTTGGCGAATGGCCTAATGAATGTCGTCAATTGCAGGCCTCGTGGTTTGGCGGTTGG
ATGAGAGGGGGAATTGGAGTGAGTGGGATGGGGAGTTGGAGTCATTGGATTCATTTGACAATTGGTTATTACGAGCGGT
TTAGGTAAGAATGTAACAATGGAACAGCAAAACGTGCACGCAAAAAAAAAAAAAAA
```

> SEQ ID NO:3938 214235FL *Trichoderma harzianum*
```
GAAGCAACCAAGAATCTGCACCTCACTCGATAATAAAAAGAAATCGGTACTCAAGGTTTATAACTCATTCAAAATGCGT
TATACTGCTGTCCTCGCTGTCCTCGGCTTCTCCGGAGTCATGGCCAACAAAAACTTCGGACCCTTCGGATTTTTCGGAC
CCTGGTTCGATGGCGACTTAACTATCGATGACCTCGCTGACTTTCAGTTTCCTGAGAACCCTTGTGAGTTCATTGGTGG
TACTTGCGAGATCGCCACTTCCCTTACATTCTGCGCTGGTCGGGGCGACTTCAGCGTTGATTTGCCTTGTGGCGTTGGC
CTCGGCTGCTGCTGGCACCAGGACACCAGCAATGTTTGGTTTGAGCAATGGAAGGAGTGGCTCGAGCTACACAGCCGCA
TCAACTAAAGCCGCTTTAATGTCTTGACGCTTTGATGGCTTGACGCTTCTATGGCTTGACGCTTCTATGGCTTGATGCT
TTAATGGCTTGACGGAGTCTTCAATTGGCACGGTAGTGGGTGATGGAGAAATTAGCCGTACTGAACTCAATGAGAGATT
GTTAACCCTGAAAAAAAAAAAAAAA
```

> SEQ ID NO:3939 214346FL *Trichoderma harzianum*
```
GCGCGCCAAAAGACTGTACACAGACGTCTTTTGATATATTTTCAAAATGGGTGGCGGTGGAAAAATCCCTTACCCCAAG
CACGTCTGGTCGCCTTCTGGTGGTTGGTACGCCCAGCCTGCCAACTGGCGCGCCAACACGCTCATCGCCGGAGCCGCCA
TGTTCGGCGTCATCGCTATTACGTGGAAGTTCAGCGCCGACAGGGAACGATGGGCGCATAAGCCGGAGCCGTGGGAGTG
GCATCCTAGCCGATACTGGTCAAAGCAGTTGATCGAGTGGGACAAGGAGGACAAGCTGAAGGCAGCAAGCAACAGCAAG
GAGTAGAGTTTTCTTTTTGGGAGAAGGATAATAGACGAAATTGTACAAATTCTATACGAACAAAAGGCAAACATTTCAA
AAAAAAAAAAAAA
```

> SEQ ID NO:3940 215813FL *Trichoderma harzianum*
```
CACACATCCTAAGGTCGAAGTCGACACGCGTGTTTTGGAGTAGTTGCTGAATGCTATGGTTGGTTTATATCAATATGAT
GAGTTTCAGATTAGTTCACAAAGGTTCTTTATGGCTCTTTTAAGGATGGGAAGCCGCAGAGAGTCGTGATCCTTTCAAA
ACCCAAGGCGTCGCACGTCCGACGCTGTGTCTGAGCAAACATTGTTCACCCTTCAAGTTTCCACTACAACCTCGACCGG
TACCACCATGAGCGGCATAGAAAAGCGCATGTGGCTTGGACACCTCAACAAGGACCTGGGGCCCATTCCGAGGCCAGAA
ATCCCATTCGCCCTCGTCTGGCTTGTTTAACGCCTTGCAGGGGGGGAGAGGGGAAGCTGAGCATGGGAGAGGGAGACG
GAAAGAAAAAAAAGCAAACATATTTGATCATCATGCAAAAAAAAAAAAAAAAAA
```

> SEQ ID NO:3941 215935FL *Trichoderma harzianum*
```
CATTCGTGTATATCCGAGGAATGCCATGCGGTTGTTTTGGTGTTTGTTGCTGCTATGGAAGAGAGTCCACCAGAGCTGA
AAACTGCTTGCTCTCTTCCATTGCCATTACTACCACCACTACTGCTAATGCTTACGGGCTTGGCACGGTCAAGCATAAC
TCCAAGCTTGGGCTCGGGAATAAAGTAAAAAAAAAAAAAGACTTAACAACAATGCAATTGTCTCTCCCTGAGTGGCTC
TCGGCTTACAGTACTCCGTATCCCTGGCCTGCCATGACTGCCAACTTGTCGGCTCTCGGCACTATGCCCAAGGGAGCAGC
AAAACCCCTTCAAGGCTTCAAGCATTGCGATATGGGGCTTATTTCCGTACAACAAAGAGAGCTGAAGAAAGATCAGCAT
CAACATCGTACGTTCCTTTCCAGGCGCCTACAGAGGGCACGGGTACGAGGACCGTCTACGGTAAAAAAAAAAAAAAAA
```

> SEQ ID NO:3942 212990FL *Trichoderma harzianum*
```
CCCACGCGTCCGCTGTTCCTCCTCCTAGCTTCAAAAAGACGCCAAACCCTCAAAACTGCTCCCAACCAAAAATAATCCA
CTACAAACGCTTTCGATAAACTTGCTCAAATGCTCTCAGATGGGTAACGCAGATGCGTGTGATTGGCTGGCTGTGCGCC
TGGTCCCTGTTTTAGCCTCCCCGCCATTCGGGATCCGGAAACCGACTGTCTCTTTTGGACTGGGCTGGAAGATTGGAA
GAAAGACGGTACTGTAGGGGAAAGATGATGCTTAATATTTGCTGTAAATTCTTATTGTTACTCATTGCATGTTACGCAA
TCGGGGCCTTCTTTTTGGCTTGGCAGTTGGTTATGTTAGTAATTGGCATGTACAGTACTGTATGACTCTGCAAAAAAAA
AAAA
```

> SEQ ID NO:3943 213845FL *Trichoderma harzianum*
```
CCCACGCGTCCGAGAGCATCAAATCTTTCGCGAGACAAGATCGACGGATACACAAACATGAGCTACGAAGATACTTTAA
TTCGATCGAGAATAACGGGTTTATCCTATATAACCAGGAGAAATTCCACGAGTGACACATCAACAGGAGGCACCAGTCA
TGACTACGTCCCCATAATTGTTATGACTGTTATTGTCGTGGCGATCGTTCTGGTACTCCTTATCCTTGCGTACGTTTCA
AAGGCGCCCAGTCTTGTTCTTCAACCATGCCTGAAAATGCAAATAGCTGATAGCTGTAACAGTCAATACACAAAGGTG
CTTGATCGGAAAAAGCCAGCCAACGGATTTGATGATCCAGAAAGCGCACAGAATGCCGGCAAAAAAAAAAAAA
```

FIG. 1 continued

> SEQ ID NO:3944 214643FL *Trichoderma harzianum*
CAGGAACCTGCGCGGCAAGGGACAAGGAACATACATTGCTTTCGACACAACCGACCCGGCCAGCCTCGTCAAGAAGATG
AAGAGCCTGGGCGTCAACATTGGCACATGCGGCACCCAGACGGTGCGACTCCGTCCCATGCTCATCTTTGAGGAAGCTC
ACATTCCTTTCTTGATTTCCGCATTGGACAAGGCTCTTGGATCCGCATAGATTGAAAAGTTGAAAACATTTTGGGAAGC
ATAGGGGCGTTGTTTAATCAAGAGAAAGCGATATTTCATTTTACTTGGACTTTGTAGTATATATTGGATGGCTTGGTTG
GCATCATAGTTTGGTCCTGAAAATAGGGTTGCAAAAAGAATAATCTTACGAAAAAAAAAAAA > SEQ ID NO:3945 215872FL *Trichoderma harzianum*
CGTTGTTTCTTTTGGTGGCGGGTTTACATTGATAAGTGACGGATATGCATCCCGAAAATGACAAATTTGTAAGCATGTC
ACTGCCGGCAAAGAACCCTGAATGCTCTAGATGCTTCCGAAGGATTCTCCATAAGATGATATCCCATGCAGTTTGTGCC
AAAATGGGTTAACGGACGCCCGATTCCGTGGGTGTGCATTTGATTGAGACCCCCATGTTTGCAGTGAATCGGTTGGGTA
AGATGCATTGGAGAGGATGTACGTAGGAGGTTCATTTATTGCTGCTCTTATTTTCCATGTTAGAAAAAAAAAAAAAAAA
A > SEQ ID NO:3946 215575FL *Trichoderma harzianum*
GGCTCTATCCCCTCATCATGAAGTTTGCAGCTCTTCTGGCCACTCTTGCCCCGGCCGTTCTGGCATTGCCGGCCTCTGA
TGCCGCATTGACCAGACGCCAGACCAGCCTCTCAACCATCACAGACCAATATCTCTTCAGCCTCACTCTCCCTGATTTC
ATTTCCCGCCGCAATGCCAAGAACCCAGCCACCCTTGACTGGACGTCTGACGGCTGCACCAGCTCACCCGATAACCCTT
TTGGATTCCCTTTTGTTCCTGCTTGCTACCGCCACGACTTTGGCTACCAAAACTACCGCATCCAAAACCGATTCACAGA
GAGCGGCAAGCTCAGCATCGATAACAACTTCAAGGCCGATCTATACTTCCAGTGCCAGACATCGAGTGTCCAAAGCGTT
TGCAATGCTCTTGCTGATGTTACTACGCTGCTGTGAGAGCGTTCGGAGGCGGCGATGCTTCTCCTGGAAAGCGCGAAC
AATCACAAGAGGACTTGGTTAAGGTGTATGAAGAGAAGCTGGAGATTTACAACAACGCCGTGAAGGATGCCCAGGACAA
GGGACTGCTGCCCATCTTGGAGTAAGGGGATAAAGCGTACTGCATACTTTTATATGATTGACGATACCAAATATGAAAT
AAAATTCTTCTAAAAAAAAAAAAAAA > SEQ ID NO:3947 214942FL *Trichoderma harzianum*
AGATGTTGATTCCAACGCCAGAGACTAGCTGTGGGACTGCTATTAAAATAGAATAAAGATCTTACTTGGCAGCCGTTTT
CCGGTTCACCAAGCTGCGGAGATTAGATAGAGGGCTACATGCGACCCTTGTACGATCAGCGCATATCATGAGAACAATT
CTGGACTCAGAATTTTGACGAGACCAGTTCCTTAAAAAAAAAAAAAAA > SEQ ID NO:3948 215642FL *Trichoderma harzianum*
CTCATCCTTTTGCTTCCAGCAGCTATCAAGACTTGACTTAAAAAAACCAGTCCTCATAAAGACATCTACAATCAGTCAC
CATGCAGATCACCAAGAGCCTCATCGCTACCCTCTTTGCCGCTTCGACCGCCTTTGCGGCTCCCACTCCTGCGGACAAG
TCCATGATGGCCGCTGTCCCTGAGTGGACAATCACCAACCTGAAGAGAGTGTGCAACTCCGGCAATACCTCCTGCACAT
GGACCTTTGGCGTCGATACACATCTCGCCACTGCCACCTCATGCACATACACCGTCAAGGCTACCGCCAACGCTTCTCA
GGCCACCGGCGGCCCCGTTACTTGCGGCCCTTACACTATCACATCCAGCTGGAGCGGCCAGTTTGGCCCTAACAACGGC
TTCACTACCTTTGCTGTTACCGACTTTTCGAAGAAGCTCATCACCTGGCCTGCCTATACCGATGTTCAAGTTCAGGGCG
GCAAGGTTGTTTCGCCCAACCAGAGCTACGCCCCGACCAACCTGCCATAGATGGAATGAATTTGCTTGGAATTACTATA
CGCAAGGTCAATTTACTCCCAAAGGAACAGCTGGTGATAATTGGAAACGACAATGAATCAGGCGAGGGGGATACGTAC
CACAAAATTTAATGGTAATAGATGATTGACTATGATAATACACTATTGATTAATGTGAAAAAAAAAAAAAAA > SEQ ID NO:3949 218924FL *Trichoderma harzianum*
CATTAAACCGCCCCTACTTGCTTTTGCTCTCTTTGTTGTTCACTCGCAGCTACAACTCTCGCCCACAATGTCTCTCAAG
AATGACGCTTTCCCTTCCTCCGAGGCCTTCGAGGCCATCAACGCCGCTCTCAGCAGCAGCGAAGCCGACCGCAAGGACG
CCATCAAGAATGGCAAGGCCGTCTTCGCCTTCACCCTCAAGAACAAGGCCGGCGAGACGGCCAGCTGGCACATTGACCT
CAAGGAGAAGGGCACAGTGGGCACTGGCGTCGGCGGCGAGAACCCCACCGTCACTCTGTCTCTCTCCGACGAAGACTTTGGC
AAGCTCGTCACCGGCAAGGCCCAGGCCCAGCGCCTCTTCATGTCCGGCAAGCTCAAGGTCAAGGGCGACGTCATGAAGG
CTACCAAGATGGAGCCCATCCTGAAGAAGGCCCAGACCAAGGCCAAGCTGTAAAAAGCGGGCATTGGCAAGTTGGGCTG
TTGATTATGGGAAAACAGGTGGAAACAAACCATTAAACGGCATTTTTTTGTTTTATATGTATCATACCATCGCTGTTT
ACTACCACTGATGTTTACTGTTTTTCTTGTTCCCCGGCCGCAAAAGAGTTCGGCTAGGGACGGTTGGTTATAGTGCC
TTATGAATACTGGCATAGACGAGAATACCATATTCCGGCTGGACATGTTTCCAGTCTGGAGTTCCTTTTTTTACTAAAA
AAAAAAAAAA

FIG. 1 continued

> SEQ ID NO:3950 215091FL *Trichoderma harzianum*
CTCCTCGAGGCAATATTGTTTTCGAATTTCCGCATAGCGAGTGGCTTCGTTGGTGGTTTGAGGGCTGGAGCCCCGGTGC
CCAGACAATGAGATTTGTGGAGTTTTACCCGTGTTGGTTTTCTTTAGTGACGTATTGATGAACAGGTACAACGACTTCA
GGCGATCGGCGGCGACGCTTATTTCTTGCACGCCCCCTTGGATGGGTCCCGCGAGAACCTTGGTAGGTTTAAAGGAGGT
AGCTGTGCTCCGTAACGGGGTTGTTATTTATAGGCTAGTATTAAGGAGCTGAATGACGCGCTCGTGTCGAACCCAGGAA
ATGGAATATTCATTTTTGTGTGGTGATGGCGACAGAGAGTAGGGTTTGGTTACCCCGAAGAAAGCAAGATCGAGATTGA
AGTGTGTATCGGCGATTTATCAGATCTAGGCCGACTTGAGCATGTGAGATGACACGAGCTAACACCAGCATGATACAGC
TGGCAGTCAATAAGAGACAAAGCTTGTTGTACAAAAAAAAAAAAAAA > SEQ ID NO:3951 214918FL *Trichoderma harzianum*
CATTAAACCGCCCCTACTTGCTTTTGCTCTCTTTGTTGTTCACTCGCAGCTACAACTCTCGCCCACAATGTCTCTCAAG
AATGACGCTTTCCCTTCCTCCGAGGCCTTCGAGGCCATCAACGCCGCTCTCAGCAGCAGCGAAGCCGACCGCAAGGACG
CCATCAAGAATGGCAAGGCCGTCTTCGCCTTCACCCTCAAGAACAAGGCCGGCGAGACGGCCAGCTGGCACATTGACCT
CAAGGAGAAGGGCACAGTGGGCACTGGCGTCGGCGAGAACCCCACCGTCACTCTGTCTCTCTCCGACGAAGACTTTGGC
AAGCTCGTCACCGGCAAGGCCCAGGCCCAGCGCCTCTTCATGTCCGGCAAGCTCAAGGTCAAGGGCGACGTCATGAAGG
CTACCAAGATGGAGCCCATCCTGAAGAAGGCCCAGACCAAGGCCAAGCTGTAAAAAGCGGGCATTGGCAAGTTGGGCTG
TTGATTATGGGAAAACAGGTGGAAACAAACCATTAAACGGCATTTTTTTGTTTTTATATGTATCATACCATCGCTGTTT
ACTACCACTGATGTTACTGTTTTTTCTTTGTTCCCCGGCCGCAAAAGAGTTCGGCTAGGGACGGTTGGTTATAGTGCC
TTATGAATACTGGCATAGACGAGAATACCATATTCCGGCTGGACATGTTTCCAGTCTGGAGTTCCTTTTTTAAAAAAA
AAAAAAAA > SEQ ID NO:3952 215241FL *Trichoderma harzianum*
GACGATTCGTAGCGATTCAACACGGCAAATCGTGAGCGACCACTGGCAAATCCGGAAAAGGGAAAAAGAAACAGAACAA
GATGGCGCAGGGCTCGATCAAAAAGTCCAACAAGGCCGCCGCGCCAAAGGCCGTCCACTCGAAGCGCCAGGCCTCCAAG
GTCACCAAACCCAAGAAGAAGGTCAACGCCGACAAGATGCTCAAGAAGTTCACTTCGGGCATGGTAGCCAAGACGGAAG
CGCTCTTGGGCGAGAGAGCGGGCCATCTGGAGTTGATTGGACCCGGAAAGAAGGGGAGCAAGAAGCTGTCGCAGAAGGG
AGGATCAAAGAAGTTTGGCTAAAGAAAGAGCTTGGAAAATGGAGGAATGGGCGCTGGGTGGGATTGGAGGAGAGGGATT
GGGATAAGGCGACATATTCGGACTGCGAGCGATATTGATTTTTTAACAACTATTCTTTTTCTTTTTTTTACGATGACAA
ACATTTCTCGATACCAAAAAAAAAAAAAAA > SEQ ID NO:3953 215048FL *Trichoderma harzianum*
CCGTTAAGCGTCTCTTCATGCGCCAGGACCACTGGCACTCTGCCAGATTTGCCCAAGTGCAGCTGGGGGGGGAGGTTG
TTAGCATGTCGTCTCGGTGCCAATCACCCGGTATGTACCAAAGGGAGATAGCCTCTTTCTTTGCTGGCACGGTACAGAT
GAAGCACAGCAAGGCCGGCGTTACGTATGTGTGACGGCTCATCCCAAGATTTGTGAACGCACACGCTTCCTCCTACCGA
CGATCGAAGCCACCACCGACTAACCTGGAGTGAACCAATCCAGCCAAACAGCTGCGCGAGCTGACCACCAATGCCTCTA
GGGATGTGAGCACGACTGAAAGATGTGTCCATGCCCGCCAAGCAGCATGTGTGTGTTCCAACCGTGCACATATTCTATT
CGTGCAAATCCAATGGGTGCAATTGGAGCATTCATCCTGCTTTTCCAACTGGGCTGTAACAAGTTCGTGCTGTAGACC
AAGTTCATGTTACCAGTCACGGTGTATGCTCTGCACCCAAGGTCACCGACAATACACAGATATCTGCACAAGGCGCCAT
CTGTGGGATCCTGCTGTGCATTAGCGGCCGC > SEQ ID NO:3954 215148FL *Trichoderma harzianum*
GACGAGACGAGTCTGGAGGGATGAGACGAGACTTGGAGCAAATATGGCGTTACCAAATAAGACGCGGAGGATGGTCCTT
GGAACAAGCACTACAAGAGCTCAAGAGCTACTATATAGATGCTATACGCCCATCTCGGAACATTTCTGCTGCAGCTACT
GTTGCTGTTGCTGCTAGTAACACTGCTAGTAACGACGCTCGGCGAAAACCGTGCACCAAAACATATGCTACTAATTACT
CCTTACAGACTACTACAGACATTAGATGACAGAGTAGTTGATTCCGACCAACGACTGGACTGGATTAATCATACGACCA
CACGAGAAACCTTCAACATGGCTTCGATGGATAGATATTGACTGTTTGTTTTTGGGCTCTGACTTGGCTGCTCTCGCTA
ACTCCATCTCAACTTACCCCACAAAAAAAAAAAAAAA > SEQ ID NO:3955 215270FL *Trichoderma harzianum*
CGATAGAGCCGACGAACCGGAATATTTGCCATTCAGGCAAACAAAGATAGCTTCCCCACGCGTTAAGAGATTGCAGCCG
CGCTACCAGGCCCTCCCAAAGCTTGCAAGCACTCCGTAGAGACCCGTAAACGGAGATGGCACCTCCCGCTCCGTGAGCG
ATTTCGGGGAGGGGGAGGGGACCAAAGATCATGGGGGAGGCTTTTTATTCTATCGACTCTCGGGAAGCATCTGCTCTCA
TCATCCCATTATCGGCAGCAAAGCAGCCAAGAGCCCCCACCAGACGGCCAGAAACTCGGGGTCAGCCCTGGCAACCTGG
CTCGATTTCTGTCCTTGTGTGGGCGTGGGCGCGTGGGCGAAGATGTTTTGAGTGATGGATGAGAATTAGGAAGAGACCA

FIG. 1 continued

GGGAGAGCAACCAATAAGAATCTGACGATAAGCAGCCCTGCTGTGTGGCGGCTAGTGTGAGCCTTTTGGGCACATGTTT
GGAGATTCTTGCGCGCCCTTGTACTTGTACTCCGTAGTTTTGAATGGACTCGGGTACAGTACGGAGCTGATGTCGTGAT
GTTTCTAAATTAGATAGGAGACGGGCAGACGGAGTAAAGGAGCGAAATTGGCCTACTGCATCGTGAAAGCGGTTATCAA
GCGCGTTTATCGATAAAAAAAAAAAAAAA

> SEQ ID NO:3956 219188FL *Trichoderma harzianum*
CCTCGACCGACGCTCGGCAACAATGGCGACAATTGCAAGCGGCTTGCGGCATGCGAGATGCGCAAGCTCGATTGCTGCA
GCTCAATGGCGGCCGGCAATCTTCCCGCGGTCGAACTTTCAACTCGCCATCCGGTCTATAACCAGCGACTCTCAAAAGC
CTCCCAGTCTTGAACTTGAAGCCGCCCGAGTCCGTCCCGATCCCATACCAGGGCGTTACGCATGCGCGAGTTGTTCCGGC
GACACCATCTTATTTCTCAAGAGAACCCCAGTTCAACGATTTATACGTTGGAATCTCCAAGCTGCTCACCAAGTACAAC
CACCTGCCCACAGTGCCGCCAAGTGAGGCTCCGCAAATGCCATGGACAAAGCTGGAGGAGATGCGGGCGCAGATGGGAG
AGCCCATCAAGTCATCACACTATGCGAAGGTCATGCGAGTGGCCAAGCGCTTGAACCTCATCGAGCCCAGCCTGCGGCC
GC > SEQ ID NO:3957 181824FL *Poppy*
GCAGATACTTTACAATTTCGCCTGATGCGGTATTTTCTCCTTACGCATCTGTGCGGTATTTCACACCGCATCAGGTGGC
ACTTTTCGGGGAAATGTGCGCGGAACCCCTATTTGTTTATTTTTCTAAATACATTCAAATATGTATCCGCTCATGAGAC
AATAACCCTGATAAATGCTTCAATAATAGCACGTGAGGAGGGCCACCATGGCCAAGTTGACCAGTGCCGTTCCGGTGCT
CACCGCGCGCGACGTCGCCGGAGCGGTCGAGTTCTGGACCGACCGGCTCGGGTTCTCCCGGGACTTCGTGGAGGACGAC
TTTGCCGGTGTGGTCCGGGACGACGTGACCCTGTTCATCAGCGCGGTCCGGGACCAGGTGGTGCCGGACAACACCCTGG
CCTGGGTGTGGGTGCGCGGCCTGGACGAGCGTGTACGCCGAGTGGTCGGAGGTCGTGTCCACGAACTTCCGGGACGCCTC
CGGGCCGGCCATGACCGAGATCGGCGAGCAGCCGTGGGGGCGGGAGTTCGCCCTGCGCGGACCCGGCCGGCAACTGCGTG
CACTTCGTGGCCGAGGAGCAGGACTGACACGTGCTAAAACTTCATTTTTAATTTAAAAGGATCTAGGTGAAGATCCTTT
TTGATATCGCGGCCGC > SEQ ID NO:3958 116461FL *Oryza sativa*
TCTAGATCGCGAGCGCCCCAATCCCACCACCGATCGATCCATTCCTGCTGCTCGCGGCCACCGGAGAAGGAGAGAGAGA
GAGCTCGACCTCGTCGGCGGGTGAAGGATCGCAGCAGCAGCAGCGGCGGTAGAGCAGGAGGAGAGGCGAAGATGTCGTC
GGTGTTCAGCGGCGATGAGACCGCCCCCTTCTTCGGCTTCCTCGGCGCCGCCTCCGCCCTCGTCTTCTCATGCATGGGG
GCGGCGTACGGGACGGCGAAGAGCGGCGTCGGGGTGGCGTCGATGGGGGTGATGCGCCCGGAGCTCGTGATGAAGTCCA
TCGTGCCCGTGGTCATGGCTGGTGTGCTGGGTATCTACGGCCTCATCATCGCAGTCATCATCAGCACGGGGATCAACCC
CAAGGCCAAGCCCTACTACCTCTTCGACGGCTACGCGCACCTCTCATCGGCCTCGCCTGTGGTCTCGCCGGTCTCGCT
GCCGGAATGGCCATTGGCATCGTTGGTGACGCCGGAGTCAGGCAACGCCCAGCAACCAAAGCTGTTCGTGGGTATGA
TCCTCATCCTCATTTTTGCCGAAGCGCTTGCTCTCTATGGGCTCATCGTCGGCATCATTCTGTCATCCCGCGCTGGCCA
ATCTCGTGCGGATTAGGCATGTTTCAACACGCAAACCCTTAGTGGGTTCTTGTTTCATATTCCTGAAACTACAAGCTGA
GCTCTAGGGGTTTATTCTGTCTTAGTTTCTGTTCTTCGTTGGGTCATGAACAAAAAAACATCTGTATCCAAGGGATGT
TTGCCCTTGTGGTGCCATTCTTTTTCGCTATGGTGGTGCTGGCGGCGGTCTGAATCTTATTTATGCACAGTTTTTTGG
GTCGGCTAGACAGTGATGTAATCTGGTGAATAAGCAAATAATTCGTAATGCAATGGGAGCATGAGACTCTTTTGTTCA
AAAAAAAAAAAAAA > SEQ ID NO:3959 127270FL *Nicotiana benthamiana*
AAGTTGTCATCCAAAAAGAAAACGCCATTAGATTGTTTACACGACAGTCTAGACCTAGAGTAGGATCTGTACAGGCATT
AGGTGCAATTTACTCAAAAGGCTTCCTATTTTTTCGGAATGCCGCCTCTTTTGAGCTCTGTATATCTGTCATGTTAGTT
ATTTCATTGTTGTATCTTCCTGCCTTTGAAGTTTTCAAGGCACTTGCCATTTTAGAGATGTAGCCATATTTCCTTTACC
TCCCTAACCATTTCTGTTCCCTGTACAAATGATAGGCTTGTATTTGTTGTACATTTACTGTGAATACCCTTATTTATTT
TGATATTTTGGAAAATTATCGAAAAAAAAAAAAAAAAAAAAAAAAAAAAAAAAAAAAAA > SEQ ID NO:3960 214824FL *Trichoderma harzianum*
CACAAACACCTCTCAACCATCTACCTCTTTATTTATCTCATTAGTTTTCTCATCTCTCAGGACTTGACTGCTTCTACTT
CATATTCATAAGTGAGAAGGAATAGACGCAATGGCTGAGTCCGAGAAGCATGACCTCGAGAAGCGCGAGCTCGAGGACG
TCGGCGTCGATCCGATCCGCGACTCGGAGAGCAATGCCAAGCCCATGACGCTTCAAGACAGCGAAGAGGACTTTGGCTT
CACGCCTGAGGAGCAGCGCAAGATTCTGTGGAAGGTCGACAGACGCTTGGTCGTCACTGTTGGGGCCATGTATTGTGTA
TCATTGATGGATCGCACCAATTTATCTGCCGCGAATATTGCAGGTATGGGTGTTGAACTGAAGCTCATCAACAACCGCT
ACAATATCGCCAATCTCGTCTTTTTCACCACATACATCGTTTCCAACCTCCTTCCACCATCCTCATCCGCAAGATCGG

FIG. 1 continued

ACCTCGTCTGCACCTCGCCTTCATCACGCTGCTCTGGGGCGCCGTCATGATCGGCATGGGCTTTGTCAAGAACTTTGGC
CAGCTTGCGGCCATGAGAACAGTCTTAGGCGTCCTCGAGGCCGGCTTTTTCCCTTCTTGTGTCTACCTTCTGTCTACTT
GGTACACCAGGTACGAGGTTGGAAAGCGATATTCCATGTTTTATCTCCTAGGCTGTGTGGCCTCGGCCTTTGCCGGCAT
TCTCGCCTACGGTCTTATGCAACTCAACGGCCGCGAGAACCTCACCGGCTGGCGTTGGATCTTCATCATCGAAGGCACC
CTGACCTGCGCCCTGGGTATCGCCGGGTACTGGCTCCTCGTCGATTTTCCCGATTCCAAGCGTCTGACGTGGAATTTTC
TTGGCCAGCGTGAGCTCGACTGGATCGTCCACCGCATTCAAAGCGACCGCGGCGACTCAAAGGTCCCAAAGTTCAATCT
GCGAAAGTTCCTTGGCGCTGGAACCGATTGGAAGATTTGGGCGTATGCTCTTATTTTTGGGTTTTCGACCACGATTACC
TATTCTTTGGCCTTCACCCTCCCTTTGATCTTAAGACAAAGCCTCCATTTCTCCATTGGAGCGTCTCAGTGTCTCGTTG
CTCCTCCATATGTATTAGCAGGTATTGTCATGTTCTCAGGTGCATGGGTGGGTGACAAGCTGCGAGTCCGTGGCCCCAT
TGTCATCTTCAACATGGTGCTCTGCCTCATCGGACTACCTATTATGGGTTGGGCTCCGAGTCCTGGCGTTCGATATTTC
GGCGTCTTTCTCGTCACGGCTGGTGCTAATGCCAATATTCCCGCTGCCATGTCGCTGCAGGCGAATAACGTTCGTGGAC
AGTGGAAGCGTGCCTTTTGCAGTGCGACGCTCGTTGGGTTCGGCGGCCTCGGAGGCATTGCTGGCAGTTTGGTTTTTAG
AGAGCAAGACGCCGCTACCGGATATAAGCCAGGCCTATATGCCTCTATTGCTTGTGCTTTATTGAACATCATCCTCGTT
CTCTTACTTGACCTTGGGTTTTGGAGGGCAAACAGCAAAGCAGACAAGGAAGGTCTTCTGCTTGAAGCTCACGATGAGG
ATGCTACGCCTGATTTCAGATACACGTATTGATGAATCTAGAGGAAGATGTGTGAATCAAGGTTTACGTGTATATGACC
AATGATGGCAACAAATAAGTTGCGATGCTACGTATAATAATTCTTTCTTTAAAACGACAGTAATGATGATAAAAATTAC
ATCTTTATACACTACTAAAAAAAAAAAAAAAAAAAAAAAAAAAA

> SEQ ID NO:3961 216242FL Trichoderma harzianum
GCTCGTTATTATCTTTTGTGTTTAATCGGTTGATTGAGAAATCATGGCGACGACTGTGTCGGAGGCGCCCAAGATGGGC
ATTGAGATGATGCTGGAGCGCATCATGGGCGCGATGGAGAAGCAGAACCAAGAATTGACTGAGCTGCGAAAAGAATGCT
CAGATCTTCGTACGTCGAACAAGAGCATGGAGATTATGCTCCAGAACATTGCTCAAGGACGCAGCAATAGCCCTCCGGG
TCTCTCCGCCGGCATGTCTCCCAGCATTGGCCGCGAGCGAGCCCGCTCGCCTTTCTTGCCTCGCCGCTCCACAGCCCCC
CAGGCTGGTCCTTCTCAGGTCTTAATACATCGCCCTCTCACGATATCACCACCCACTCTTTTCCCTTCCCGGATGATC
GTGAGATCCCCGGATTCTACGTCGTCATCCCTGCAGGCGGTGCTGGTACCCGCCTGTGGCCCCTCTCGCGAGAACCA
CCCCAAGTTTCTCCTCGATGTCAACCTTTGCGGCAACAGCTTGCTGCAGTCGACCTGGGAACGACTTCTTCCTCTGGCT
GGCCCTTCACGAATGACTGTCGTCGCGGGACCTGCTCACTCCGAGGGCATTTTGGGCCAGCTGCCCAACCTGGATTCTT
CCAACCTATTCACCGAACCCGGCCCCAAGGATTCCATGGCCGCCATCGGCTTGGCTGCTGCTATCCTGCTCAGACGCGA
CCCCGAGGCAGTGATTGGATCCTTTGCAGCTGATCATATGATCTCTGGCGAGGATGCTTTCCTTGGTGCTGTCACCGAG
GCCGTCGAGGTGGCCAAGGAAGGCTACCTAGTCACAATTGGCATCGCACCCTCTCACCCTGCCACTGGATTCGGTTACA
TCCGACTAGGTGACAAACTTGGACTCAAATCAGCTCCGCACTCACGACTGGTGAGCTCCTTCAAAGAGAAGCCTGATGC
TCACACCGCTGCCAAATACCTTGCCACGGGTCAGTACCGCTGGAACGCAGGCATGTTCGTCACCAAGGCCTCCCTCCTC
ATGGAGCTGATGAAGGAGAACTGCCCCGCTCTCTATGAGGGTTTGATGAACATCTCTGCAGTGTGGGATGATGAGACCG
CACGCAAGACTGCTTTGGAGGAAGTTTGGCCCACTCTGGAGAAGATTCCCATCGATAATGCGGTTGCTGAGCCCGCGGC
TGCCCAAGGAAAGGTGGCAGTTATCCCGTCCACATTTGGTGAGTCATTGATGGATTGATGTCGATTGTTGCACCTGATG
GATAAATTGTACTGACTTGCGCAGGTTGGGACGACGTTGGTGATTTTTCATCTTTGGCCGAGATGCTGCCGGCTGAGTC
TAACAAGCCTCGTGTGCTTGGTGACCAGAGACTGGTGGTATCCGAACAAACTGCTGGAGGAATCGTTGTGCCCGTGTCT
GGCCGGTTGATTACGTGTCTTGGTGTTGACGATATCGTCATTGTCGATGCCCCTGATGCGCTCATGGTCACCACTAGAG
CTCGTTCCCAGGAGGTGAAGTCGCTGGTCAAGAAGTGTCGCGAGGCTGGATGGAAGAATTTGTTGTAATATCAGCTGGG
AATATGCGTTGATTTGCTTTTCTTCTTCTTCGTCTTGTTTTTTTACGGTTTGTTTGGATGGGAGAGACCAGAGTG
GAACTCGACCTTGGCGTATCTAGCCTGATGGGCTTCTTGCCAGCTGCCTTTGCCAGCTGCTAATGTCACGCACATCTA
AGGATATGCTGCTACGACGTATCATGCTTTTAATGTTCAATTCAGTTCAGATTTCAATTTAATCTTTTCCACCGAAAA
AAAAAAAAAA > SEQ ID NO:3962 216246FL Trichoderma harzianum
AAGGAAACGCTCAAAGGTACGTTTATTACTTTGCACAGCTGCGAGACTCCCATCAGCCATAAGAAAACCAAAGAAAAAC
GGGGTTTGTTCATCATGTCACATCCACCACCTCCAGGCACGAATCTCCCTGCGCGCCCGCCCGCCAGCACATCGAGGCC
GGGCTTCAGATCGAGCTTCAACCCGTCGGGCCAGAATTCTGCCGCCCCGGTATCATCGTCGTCGACGTCGTCGTACTCG
AATGCAAACTCCGCGCGAGCAGCCGCCGCCTCGAGCTACCCAGCTGCCCAAACCCACTATGGCTCGTCCTACTCGAGCT
ATCCTAGCCACGGTGCGGGCTCGTCCGTGAACCGCTCTGCTTCGGGATACTCGTACCCTCAAGCAGGCAATCAGCAGCA
ACACTATCCCCAGCAACAACAAGCGCAAAGCTACGCCCCTCATGCCTATTCGCAGCAACAACCGCAGTCGTACCAGGGC
CAGTCATACCAGGCTCAGCCATACCAAGGCCAGCAGTACCAAGCAGCACCGCGTATCCAGAACCCTTTTCCTACGCCGG
GTGCTGCTGCTGCCGCTGGACCCGATTACGACCCGGACATGGCTGCCCAGATTGCCCAATGGCAGAGCGCCTACGGCCC

FIG. 1 continued

```
CCGCGAAACCGACAAGGACGGCAAGCCCGTGCCAGCGCCAGAGTACGCGAAGCCTGAGGTCGTAGACCGACTGCGCAGA
CGGACAAGAAGAAGACTGTCGTTCGAGAGGGCGGCGGCAAGAAGTGGACTGACGACACGTTGTTGGAATGGGACCCGTC
ACACCTGCGCCTCTTTGTTGGAAACTTGGCGGGCGAAACGACGGACGAGTCTCTCCTCAAGGCGTTTGCCCGGTGGAAG
TCGGTGCAAAAGGCCAGAGTCATCCGAGATAAGCGCACGACAAAGTCCAAGGGATACGGCTTCGTCAGCTTCAGCGACG
CCGACGACTTTTTCCAGGCGGCCAAGGAGATGCACGGCAAGTACATCCAGAGCCATCCCGTTGTCGTCAAAAAGGCCAA
TACGGAGATTAAGACGACCAATGTCAAGAATAAGGGACACAACAACAAGAAGAAGGGCGGCAACAGTGGAAATGGTAAT
CGTGGGAACGATTCAGGGGCTGGAGGGTATGAGCCGAATCTTGGTCCTCGATCGGGTTCTGGCGTCACCAAGGCTGGCC
AGAAGACGAAAAATGGTTTACGCCTTTTGGGTTAATGGAGAAAGGGGAGGGATTGGTTCTTTTGATGACATAGAACGCT
GGCTTTTATTGTTCTCGTGGTTTTTCATGTTTGAGTCTACGCATTGGCGTTGGGGAAAGGGAGGAACATTATCAGGACA
TACCCGTACATGGAAATAAAAAAAGGGATTACTTCGATGCGAAAAAAAAAAAAAAAAAAAA

> SEQ ID NO:3963 212682FL Trichoderma harzianum
GGCGCCCAGGAGCAATGTCTCAGGGCCCAACGAATGTGCGGTGAACGAGCTGCTACTGCACCGCCGATTGTCTGATGCA
AGCAAGGGAGTTGTTTGTTTGCTCCATCCTTGATTCACTTTAATGCTTGTTATTAGGTACTTTAAGAGCCAGGTTGAAA
GGGTACTTTGCAAGTGCTTAAATCTCCATTCTGCCTTATACTCCATGCCTGTAATTGTATAGTAGCACCAGGGTAAGCC
AGCAATACCGCAAGCTGGCAGTATCAATCGCCATTTTTCTCTACAAAAAAAGAAAAAAAA > SEQ ID NO:3964 213764FL Trichoderma harzianum
AGCTCCCGGCAGCTTGGTGACACGGAAGGATATATGATTCAATTCCAGGCGGAGCCCGAAAAGTATGATGCAGCCGTGA
ACTGGCTTCGTACCATGATGTTCGATTCCGTCTTTGACCCAGTCCGGATCAAGGCCGCTGTTATGAAGGCATTGGCTGA
CATCCCAGAATCGAAGCGTGACGGGCGCAGCATGGCCGCGGAGGTGGACACAGCTATTCACATGGAAAAGTCTACTCTT
ACCGTTGCCAGACGTGTTGTTGTCAAGGCAGTTTATCTCAAGCGTCTGAAGAAGCTCTTGAAGAAGAATCCCGACCAGG
TTGTGGAGTGGTTCAATGAAATCCGCAACTCTCTTTTCACATTTGAGAACATGAGAGTCCTTGTTACGGCAGACTTGCA
AAGGCTTCCCAACCCCATCGCCACTTGGGATGCGCTCTCAACAGCGCTACAGTCGCAGAATGGTTCTATGGCTCCTATT
CCAAAGCCATCGAGTCTTTTGAACGCTGAAGGAAAAGCCCCCGGTTCTGTGGGTGTCACCATCATCCCCATGACAGCTC
TAGACAGCTCTTTCTCCGTCAGCACCGCCCCTGGCCTCTCTTCGTTTTTAGATCCCAGGCTGCCTGCCATTACTGTTGC
CGGAGGATACCTCGAGTCGGTAGAGGGACCTCTGTGGAATGCCGTTCGCGGTGCCGGATACGCTTACGGAACCTTCTTC
ACGCGCAATGTCGAGAGCGGAGTCATATCCTTTAAAGTGTACCGCTCTCCGGATGCGTCCAAGGCCATCATTGCTTCAC
GGGATGCTATTCAGAAGATTGCCAACGGCGACGTGCCAATTGACAAGCACCTCCTCGAAGGTACCATCAGCCAAATTGT
GGTGGGCTTCGCAGATGAGCAGTCCACTATGCCTAGTGCTGCCCAGCAGAATTTCGTCCAGAGCGTTTTCAAGGGGCTA
CCCAAGGATTGGAACAAGATTATTCTGAAGCGTGTGAGAGAAGTGACTGAGGATGAGATTCGCCAAGCGCTCAAGGATT
TCATCATGCCCTGCTTTGAGCCGGGCAAGAGCAACGTAGTGATTACGTGCGCCAAACTTATGCAAGAGGTATTGTATTA
TTCCATTCACCTCAAGTTTTAACTTGTTATATGTATGAAGCATGCTGACCATTATCTGCTTAGGGTATTGAGACTGCAT
TCAAGGGACTGGGCTACAAGGTTCAGACTCATGAGCTAAGCCACTTCCACGATGACTATGGTTTGGGTGCTGGCGAGGA
CGAAGATGAGGATGAGGATGAGGATGACGACGAAGATGATGATGATGAACTTGATGATGAAGAGGGGAGCGAAGAGGAT
GAAGATGACGATGACGATGAAGACTAGATATCTAGGTTTAGATGGACGCAATGTCTAGAGGATATGTTCGTATAGGATA
ACACAGGCAACTAAATGATTTGACAAGATAGTAAGAAGACACATTTGTGAAAAAAAAAAAAAAAAA > SEQ ID NO:3965 213804FL Trichoderma harzianum
GCTCCTCTCTCATTGCCCCGATGCCCTCCATCGCTTGAGCGTATTTGCTGTCCCCAAAGCTGTCGGTGATGAGGGATCG
TATAATGGCTCCCATCTGCTTTGTCGCCTCTGCAATATGTTCGACCTCTTCTGACGAGTTCAAAGCTCGCTTGAAATCG
GGAATTGCATTCTCAGGACTAATTGAACCCTTCTTTTCTTCCAAAAGAGCATCCACATCCAGCCCCGAGATGGGCT
TGACCGCTTCTCTTTGACGTTTACCTTTAGCCTTGGGTGGTACTAAGGAGACATTAGCACATTAAATTTCCAGTGTCTG
GGATGCTTGTAATAATCACCTTTCTTGACATCTGCAGCCTGGACTAGAGAATCAATCTTGGCCTGCACTGTTTCAATCA
GTTCCGTTGGAGGAGCTGCAAATCTCAGCAAGACTGGGGGGACTTCTGGTATTGGCCTTTCTGGGTGGACTGCTCGCTG
CTTGATGGCATGGGTGATGCGATGTATTGCAGGGTTATATATTTCATCAATGGTGGCGTATTCGGCAGGCTCCCTGACA
AAACGAGCAAGATTAGCGATGGAAACTTATCTGAAGGGGCTATCTCCATATACTCACCCATCCTCGTCAATGCCATAAT
TTGATATAAAAAAAAAAAAAA > SEQ ID NO:3966 214003FL Trichoderma harzianum
GAGGGCCGGACTAACACGGAACGAGACAGGGTGTGGATGAGACGTCGAGCACGTGTACCACCACTTTTGGGCAGCGGAA
GTGCGGGCGCGGGATACGTAAGATTGACGGGGTTTTCGAGGTAGTGGGAATGGTGTGTCTGCCAAGAGAATTGGCGTTT
GAATAGAGGCAAGTGGTTTCTTTTTTCTGGTGACAAATGAGGTGCGGGGTTTTGATATGAAGATGATGAGGATTGTGGT
GATGCCGGAGATGGGCTTGGGATGTGGTGGTTTGATGAGGTACCCTGGATGGTGATATTTGAGATTGGGAGGCTCGAGA
```

FIG. 1 continued

TGGGGGATCTCAGAGGAAGCAAAATAGAAATAGAAACGGACCTCGGCCGAAAGTAACCCAAAACACAATCTATGACGGT
TAAAAAAAAAAAAAAAAAA

> SEQ ID NO:3967 212738FL Trichoderma harzianum
GCAAATTGGACATACACGATAATGCAATCCTCATCCATGGCCAGCGTAGCTTTCTTGACTACTGCAAAAGTAAAGGACG
ATGAGACAAAGGAGGTTGTGAATGGCTTGCAACAACTTAGTGCCCATCTCCAACTCCCCAATACCCCATGTCTAGCCGG
AGCCTGCTTTTTGTCCGCGGCCAAGAAGGAAACGGGTATCAAACTCATCGGTCGCTTGGAAATATTTCCTAGTGAAAGC
GAACTTGCTACTGTTCAAAACTCTCCTGAATATAAGCGTTTCAGCGACTCGGTCACCGGCCAAAAACTTCACGAAGGCA
AGGAGACTGCCACTTTATGGCAGCCCACCGGCGGTTTTCTGACAAGGAAGAACCAAGCCTCGACAACAAAGGCCGGTGT
ACTTGTTTTAGCCAAGTTCATTTGCAATGATAAAGAGAACGCAGTTCAAAATCTCGTGAAAGAGTTGCAAACATATTGT
GAGTGGATCGAGGGCAACGAGCTCACGACATACACATATTGCGTAATGACAAGTCAAACTGCAAATAAGGAAGTTCTGC
TCTTTGAGCGTTATAAGGATCTTCCTTCCGTCAAGACCCATGGCCAAACAAATGAGTTCAAGTCTATGTTCAAACGAAT
TTCGCCTTGGATTGAAACAAAGCGTACCGAAATAACTCCATGGAGCGAATTAGACGGTTCTTTCTTCTCTTCCCTAGAC
TTAGAAGCCACAGCGAAGCTCTAAAGATAGCTCTATATTCCTTATAATTTTGTATTTTTTCTTCTGAAAAAAAAAAAAA > SEQ ID NO:3968 212943FL Trichoderma harzianum
CGCTACGGCTTATTTACTCTTCTGACCGGAGGTCTCGGTATTGACATGACCTTGGAGCCATCGCTGCCGCAACGAAATG
GAGTACTCGTACATGTAGCCGCAGTCTCTTGTCCATGCGAGCGGGCATTTCGTCGGCGTCCCAATGGTCACCGCGAGAC
CTATCATTTGAGATACTGTCTATCTTCCTGCATGTTGGCTGTACGAGACGAACGATATGACGGCTCCCTGCCTTTGATT
TCTATGCAGCAGTAGCCAAAAGAGAAAAGGTGTAATATGCAGCAAGGCCGCTATGTTGCCACCCCACGAGACCTCGACT
GCATGCACGTCCAGCGATACGTCTCCACGAGGCCGCGCATGACCGCTGTGTCGAGAGTGGATGGACTGCGGACACCTCT
CTGCTTGCAACGGCTCAGCAAATTTTGCCGTTGGGCCACCGAAGCCAAACGGCTCACCGTCTACGCAATTGGCACTCTA
AATGCTCCTTTCCGCAGCCGCCTTGCTTTCAATACGCGTCACCAAGCGTTTGTAGCCCTTGTCAGGCCGTTGCGGTTGC
CCGCGTACCACCGCCCAGTGGAGAACAAGCGTTCTCTTGTCATTTTTCTTGTGCCTTGGAGGTCCCACAGTCTGCCGCC
AACCCTGTTCGCGTCGTTGCGGTTTGTTTTGCGCCACTCCGTGAGACGTAACAAATCAGAGGCCTGGCCTAACCAAGT
GCATGAGAAGAACCTGGCAAGGTCTCAGTCTTGTGGAACGTGAGCGGCACGGCGATAGCATTTGGCGCCCCTTGTCGCG
CTACCGGCGTCAGAATGGGGAGACGCTGCACGGAGCGCATGGAGGTTTGTGGAGATGAAGCATCCGATAGTGACGGGGG
ACGGAGTACTCCGGATGCACAAGAGCTCGCTCACTACGCGAGGCCTAGACGGTTCTCCACAGCATCCCGACTCTGCAGA
GAACCAGCGGTGAACAGATGATCGAACGATCTATTCTTGGAGAGAGAGCACTGACTATGATACCAAGCAAGCTACGCCA
TGGAGCGGAGTAGCAGCAATGAGTTCTCCATGCATCTCAAATCTCGTCAATGGCAAGGAAAGCGGAAACGCGGAGGAGC
ACCTTCATGAGCCGGGAAGGGGTCTCGCCGTTTGTTGCCATTGTCTCATCAGCTTCTTATTCCCTGGCCTTATGCACTA
GCCCAAGCATATACGGTTGCAGTGCAGTGTGGCTGGAACTTTGGCAGGCTGAATTCCCTGTTCCAAGGATGAAGGAAAA
GCCAACAAAGTACGAGGACTAATCCGTATCTTCTTGTGCATCATGTAGCGCCCAACTACCTACCCATCAAGGCTTCCCC
TGCAGTTGGCTCCTCTTGTTCTGTGCCAGTCAAAAATAGTACCTACTCAGCTGAATCGAAGACTCGATGAGAGCTTCTG
CTGCAAAAAAAAAAAAAAA > SEQ ID NO:3969 213330FL Trichoderma harzianum
GCTCCTTCTACCAATTTAAGAGAGCGGAGACTTTATGTTGTTGGCGGTGAATGGCTCAACATCGAAGCTCTAGGCGCCG
GAGGTATTGCTCCTGTTGCAAGCTTGGCCGCAAATGGGAAAACTTTTATGCCGGGCTGTTTTTTTCCGGTTTGTCAATG
GGGCCGTGCGATTACCTAAGATGAGGCAGAGCAGCGGCGGCTTCGAGTTTGAATTTACAAGAAACATGGATTGTGCTCG
GAGTACGCCGTGGTATGTAGGATGGTCTGTGGCTGAGGTCGTCCAGCTTCAGGTGTTTATATATGGCTTTACCGGCAGA
TTTCACAAGCTCAATCGACTTTTGGAAAGTGTGTTTCAGGCTATTCTTGAACTTTATACTCGACGTATAAGTCTGGCTA
AGAGATTTTGCTATTTCCTATATCATTATCATAACATGGGCATATATGGGTCAATGGATGGTAAATGAAATTTGATTTG
TACGGGATAAATAACAGACACCGTCCATACGAAATAACGCTATTCATTGGCTTAACACCTTTCGAAAAAAAAAAAAAA > SEQ ID NO:3970 213396FL Trichoderma harzianum
CCCGGATTAGGTTTCTTTCATTCTTTCTTTCTCCCTTCCTCTGCCGAGCTCGACGAATACCCGCCTCGAACCGAATGAC
GCTGGCAATATCCCGTTCTTGATTCCGTTGCCTCTTTGTCCTCCGTTGTGCCCCGCAAAACCTGCCCAACGCGCTTCCT
CATCATCCGTGCTTCGCGATTTTCTACCATCGACGCCTGAGGAGACATAATTTCACCCAAGATGAAATCCATGAAGGGC
CTTTCTATGAATAAGATGCTGGGGAGCATCAGGAAAAAGACCAGTAGCACAGATCGTTCAGCTGCCACGACACCAGGGG
ACACCCCCGAAGTAACGGCCCATAACAGCGTGAAAGCATTTTGCGAATCTGGCGGAACCGCAAAGAGCGAGGAAGTGCT
TTTCCTCCCCCCGATTGTCGATGCCGCCGAGTCTTCACCCACCGCCGCTGCCGAATGCGCACGCATCATCAGGAAATAC
ATGTCCAAGGAGTATTCCTCGCGGCCGTCATGGCAGTACAACGCCATTATGCTGATGCGGATACTGGCCGACAACCCTG
GCGAGACGTTTACGAGGAACCTCGACACCAAGTTTGTAGACACAACGCGGGCGCTGCTCAAGGGCACAAAGGACAGCAG

FIG. 1 continued

```
TGTGCGCCAGATTCTCATGGATACGCTGGACGACTTTGAACGCACCAAGTTTTACGACGAGAACTTGACCCTGATTATT
ACGCTGTGGCAGGAGGAAAAGGAAAAGGCGATCAAGCAGCATGGAGGTCGAGCACCTACACTACCCCAACGCCCTCCGC
AGTCAGCGCCGCCTGATAACGGGTATTCACAAAACTACTTCTCTAGGCATCACAGCAACCACCGGCTGCCCGAACCCGT
CGAGCTGACCAGTCGGCTGGAAGAGGCGCGGTCTTCCGCAAAACTATTGGAGCAGCTTGTCATTAACACACCGGCAGTG
GAGTTGCTTGAGAATGAGCTTATCAGGGAGTTTTCTAACCGATGCCTGAGTGCTTCAAGGAGCATCCAAGGCTACATGG
TGTCGACCGATCCCGCGCCAGACAACGATACCATGGAGAGCCTCATCGACACCAACGAACAGCTGCAGACTGCGCTTAG
CCAGCACCAACGTGCTATACTTAGCGCCCGAAAACAGCTTGGTCTCAACGAGCGATCCGAGAACCCATCACCCGCCCCT
GAGCAGCAATCACTTCACGGTTCTAATGGTGTTCAGGGATGGCAGGTCCCCAATGCATCGTCATCTAGATCCAGCCCCG
CCCCTCCCACTGTCTCAGTTGGCAACGGAAAGGGCAAAGACACCGACCTTTATAGCCCTCCGTCGCATCCTCCACCAAA
CAATGGCAAGCAGGTAGACCCGGGCCGCGGCAGAGCTCCCCCCCCTGAGTCCGAGCCTCTGGTAGATCCATTCAGTGAT
CCGCAACCAGGTGGTGCCAGCCCCAATGGTCATCTAGCCGTCATGGACGAGCCTTTCCACCCTGGCTTTGGGTTGAATA
GCCATCGAGATGGCTCGTCAACACACGGCACCACTGGATCCGGTGTTGCTTCCGAGAATCATTCGACACACAATTTACA
GCCTGACTACCAAGTGTCAGACGACGAGGACCTTTATACTTCTCCTCCGAAGAGCAGCAAGGAGCCCATGTATCGATAC
TGATTAAGCGAATTGAGAGCAAATTTCGAGTAGAAGAACAGGGATTTAAACACGAGTATATTTGCAGATGGGTATACAC
CGAAAATCGCAGGAGCGTTTGGGAGACGGAGGATTCCTTTGTTTTGTTTTTATATATTTCCCAGCACTTTACGGTGCTA
GTTAGGCATCGTTTGGCTATAAGTCTCCGTTTTCCTTCCAAATAACCAGATCCGTTTGCTATTCCCCTTTTTTATGACG
AAATCCCACTTTAACGTTGAGCAAGCGTGAGAGCGATCGATATCTTTTTGTATTTATTACATACAAATTCGCAATTTGG
CAAGTCAAAGTAGCGTCGAGTTGATAGTTTCTTAACATCAAATCACGTTTGTTGCTTGAGCAAAAAAAAAAAA

> SEQ ID NO:3971 213767FL Trichoderma harzianum
GTATGGGGGGCTTCAATCAATCATCACTTTTGGGATTAATGGGCGTTACTGGACACACTACAAGCGCGGTGCACTGATA
GACTTTGCTATTTTATTATTTTTTTACCATCATTTGTTTATTTCTGTATATGTGGTACATATTCTGGAAAGGGGCGGTA
GGGGTGGACCTTGGGTCGGGGATCAATCGATAATGGGAGCGTGACGAAGTTACGGAAACGGAACCGAAGCAAGCAAACA
GAGCTTTtGAAATAGAATGATGGCAACACCAATGCCACTCTTGAAGTAATTCACAAAAAAAAA > SEQ ID NO:3972 213829FL Trichoderma harzianum
TCTACATCTTCCATATTGGGGATTGCTTGCTTACAGGTCATCGGCCATGGCTCTCTTTGGAAACAGAGCTCGCGCTCCT
GCGGGACAGGCCCCAGCAGCCAACACTACGACTACGCCGACGACGACGACAAAACGGAGATGGGGACTCGGCCGTGGTG
GAGGAGGATTTGGCCGTGGTCGTCAACACACTCCGTATGCGATGCACTCGCGTCCTAGCTTTGGGCAATGGCTCAGAGT
CACTTGGTTGGACATCTTGACCATGGTAGCTATGGGAGCCATCGGCCTCGGTGTCTACGAAGCCAAACCAGCGCCTACA
CGCTCGTTCCCCGTCACATTTTCCGATGGAGAAATCGTCTGGCCTGAATTCGGCTACCCTCTTCGAAAGGAGATTGTTC
CCATCTGGCTGGCAGCTTTCCTCGCATCCATCATCCCCATCTTCATCATCCTCGTCATGCAGATCCGCATCCGCTCATT
CTGGGACGTCAACAACGGTGTCATTGGTCTCTTGTACTCTCTCATCTGCGCAGCCGTGTTCCAAGTGTTCTGCAAGTGG
CTCATCGGAGGCCTTCGCCCACACTTTCTTGACGTGTGCAAACCGGATCTGAGCCGCGTCACAACTTCAGGACTCGACA
GAACCGGATTCCAGCAGATCTACTTTACGCGCGACATTTGCACCGGAGACCCAGACCAGATCGACGACAGCTTGGAGTC
GTTCCCCAGCGGCCACACCACCGCGGCTTTTGCTGGCTTCGTCTACCTCTCTCTGTACCTCAACGCGAAGCTCAAGGTG
TTTGCCAACTACCACCCGGCCATGTGGAAGCTCATTGCCGTTTATGCCCCCATCCTCGGCCGCGGTCCTCATCGGCGGTG
CGCTCACTATTGATGAGTTCCACAACTGGTACGACGTCATCGCCGGCGCCATCATTGGTACTGTCATGGCCTTTTCCGC
TTACCGCATGCTGTACGCTTCCATCTGGGACTGGCGATTCAACCACATCCCGCTGAACCGCGGTGTTGCCTTCCCGTAT
ACCGTGGGCAACGGTGACTTGTTCGATTCAACCTTCACGAGGCGTGTTGGATGGGGAACGAGAGCTTTGCTGGAGGCA
CTACTAATGGTGTTGGCAACGGATATGGACACCATCATGGCAAGCATGAATACGGATATAACAACGGCGCTGGATATAC
CAACGGTGCTGGCCACACTAATGGCGCTGGATACACCAATGGTGCTGGTACGGCGGCCAATGGAGAGTATGCGAACCCG
ACGATGCCTCGACGAGCAGTTGGACACCCTCCGGAGCAGATGGTGTAAGATGTTGGCATGGGGGTTTTACACCACTCGT
TTTGTCAATGTCTGCTTCTTGAGAAACGTTTCTTTTCTTTTGTGTTGAATGAGAGATTGAAAACTTGGGCGTACTGAGG
TGTTGTTCGTGTTATTATTGCATCTGGATATGCGTAATGAGCAATGATGCTAATGAGGGCGTGGCTTTTCTTACACGGT
TAATGTTTTATAATACCCGCAGTTGAATAATTAGTATACAGTCCGTTTGTGTAAAAAAGAAAACATTTCTAATGAAAA
AAAAAA > SEQ ID NO:3973 213894FL Trichoderma harzianum
CCCACGCGTCCGGCGTGAAGATAGGAGAGAATAGAGATAGAGAGGCAATTGCACGGAATGTTTAGCCAACAAGTTGCTC
GTGGCGGGCGCCGCATCGGCCAGATGGCTCGAGGCGGCCAATATCCGTCACTCGCTGCGCTCAGAGGAGCTGCTCAACG
ACGATGTTATGCTGAGGCTGCACAGGCAGCCCCCAAGGGACGTATCGGTCGAGGCCTCGGGCTGCTCCTGTATGGCGTT
GCATTTAGCGGCCTCGGAGCAGCAGCAACATTCTATTCGATGGTACAAAAGGGTTTCGCCTCGTTCACCGACGCCGAGT
CAGCCAAACTGTTTGTCCCAGATAGCGACGAGCTGCAACAAATCGAAGAGACAATCAACAAACACCCGCTCGTCCAAGA
```

FIG. 1 continued

GCTTCGATCACGACCAGAGTTCAAGGAGTCACGACCACACCTAAAGATGTCAAGCGAAGTCCGCAGCCGCACCCTCACC
GGCGGCGCTCTACAAGGCGACGGCATGATCATGGTCCCCCCCGTCGCCTTCATCGAGGACGGCGGCAAGTCCATCGTCA
GCGTCACGTACATTGGCGACAAACTATGCGGCCACCCAGGCCTCGTGCACGGGGGCCTGCTGGCGACGATGCTGGACGA
GGGGCTGGCGAGGGGCTGCTTCGACGCGCTGCCGCACAAGATTGCCGTGACGGCGAGCCTGGAGATCAACTACCGCAAG
CCGACGCAGGCCAACAGCTTCCTGGTGCTGCGCGGCAAGACGGTCAAGGTCGAGGGGCGCAAGGCCTGGGCTGAGGGAT
GCATTGAGACGTTGCCTGCGCCGGGCGAGAAGCCGGTCGTTTTGGTTGAGGCGAAGGGATTGTTCATCTCTCCCAAGTA
TGCGGCGCTGATGCCCCGAATTACCTAAATGATACATGCGGTGGAGTATAATGGCGAGATGAGAAGACGAGCGCATAGA
GCTGCGAAGTTTTTGTTTTGCACCCATTTTTCTATGTTTACTTTGCCCTTTTTGACATTTTTTGGAAAGCGACGGCGGG
AATAGATTATACATACTAGAACTGCACATATTTTAACAGCGAGGCAGTAGACGCCGTGCTAGAAAGCAGAGAGGAGATT
GCTTGTTCGTCTTTGCAGCAGATGGAGCTGAGCCAGATGGGCGCTTTACATGATATACCTCTAGTAAAAAAATAAAAAA
AAAAA

> SEQ ID NO:3974 213333FL Trichoderma harzianum
ACAGTAGTAGGTGAGTATGATGATACACTGGGTCAAACGGATGTTGTTAACACTAGTTACCTGTAGTGGCGCTTGCTTT
TTACTTACTTGCAGATATTGTGGTTAAGCAGAATCCCAACTCTCCAGTGCAAGACACTCTGTCAGGTTCAAGCCCAATT
TCCTTCCGCTGCTCATTGGCAAACTCACGAAGCTCGCCACGAATCTCATTTACCACGTCCCACATATGCACTAGAGATT
CGTAAGTCCGATTGTAGATACGATCAGCGCAAAGCGATACAATCTTCATTAGCTTCACCAAGGCCGCCATCATCTTGTC
ATCTGTGGGAACAGGTATATCCAAGCCGAGCTCGGACATAGACGTCTGGCGCCCAAGAATAAAGCAAACCCATCTTGGC
ACACCAGTCAAGTTAGTTATTTCATCAAGATAAAAAGACATTGAGGGGCACTCACACTTCCCCAAAAAAAAAAA > SEQ ID NO:3975 213831FL Trichoderma harzianum
AAATTCTAATCGAACGACGCTGGGGAGATTTCAACCACGGCGTTTTCCCTTCCCACATTTCGCCAATGGCACGAATAAC
GAGGATGCGGAGACTGCAGTCTCTGCAATTGGCCATCCCGTCACAATGCGCCGCTTCCAGACCTTCTTTCGCCGCTGCC
CGCGCCATCTCGACGACCGGCCCCGCGCACAGCAAGAACACGGAATGGATCCGGGGAAAGCTCTGGAAGGGCGAGGCCC
CCGGCCCGGCTGATCCCTATACGCAGAGGATGGAGCCCGAAGCCCAGTCGAATCTGCCCGAGGAGGCACTCGAGAGCCG
GGCGCGCCAGGATAAGACGCCCGCGGCCGTGGAAGAGTCCAGGTTGACTCTGCCCGCGAGGAGGACTGAGGCGACGGCG
GAGAAGGAAGTGCAGGCGGCAGACCCGTCGTATGTGCCCGCTACGGATGCCGAAGGGCTGGAGGAGATTGGGGCGTTGA
ACACGTGGTGGGAGCAGCCAGGACACTGGGGCGACGAGGTGTCTTCAAGGGATTCGGCAGCGCGGACAAGGTTGTGGA
AAGGGAAGTCCTGGAGGTTCACCTGCGACGAGCCGTTGTTGAGGCACTGGCGCTGCAGCAGACGGGAGTCTTTTCAGAA
TGGGCTACGAAGAAGTGGTCTGAGGGAGGATCCAGGGACGAGTTGGACCAGGCATTGGCCGTGCAGGTTGAGGTGCAGG
ATGGCAAGGCTACTTTGAAGGGAGACGCTTCATCGATTGTGGAAGTTTTGACGAGCGAATCTCAAGAGGTCGAATCATC
GACAGTTGTGACTGTCGAAGAGGCAAAAGAGATGATCAAGTCATGGGATTCTTCATGGAAGAACATTACGCTGGATGAC
TCACTACGATTTGCGCTCCGCAAGCGCCTCTATCAACTCACCGGAATCCTCATCCCAGACGCCAAACTCGCCGCCGCCA
ACACCGCCAAGCACATCCTGACCCTTGCGGCCAGAGACCCCAAGCCGCTGAAACTAGCCCAGATGCTCGAGAAGCGCAA
TGCCTTCAACGATCTGGCCAACGTCAGGGTACACGAGCGCAAGATTGGCCCCATCGACAAGGAGGTTGCCGTGGGACGC
TGGAAGGTGATTGAGGAGGAGCTGAAGAAGCGTGACTTGCCGGTGACGGGCTACGGAAACGCGGCAAGGAACAAGGAGA
GGGATTGGTTGACTGGGAAGATATAAAACTCATGATTTTTACGCATAGATGGGGCTGGAGAGGAGGAAAAAAACAATGT
ACGAATATGGCATGTACAACAGCAATGACAAAAAAAAAAAAAAAAAAAAAA > SEQ ID NO:3976 213895FL Trichoderma harzianum
GTGGGTTCTGCGGTGCCACGGCTGCTTCAACATCACCAAGGACATGAACAAGCAGTTCTGCCCCAAGTGCGGCCAACCC
ACCCTCACGAGGACAAGCTGCTCGACGGACCAGCATGGCAACTTCAAGATCCACCTCAAGCAGAACTTTCAGTGGAATA
ACCGCGGAAACGTGTTTAGCGTGCCCAAGCCAGTCCACGGCAGCGCCAACGGAAGACTTCCTAAGAATGTCGGTGGCAA
GAATGGCTGGGGCAGGGACTTGATCCTGGCTGAGGACCAGAAGGAGCACGTCAAGGCGCTGGATGACCAGCGGAGGCAG
AGGAAGAAGGATTTGATGGACGAGGATTTCTTGCCTGGTCTCTTGACGGGTAACAGGTCGGGAGCGGGCGGCAAGATCA
AGGTTGGTGCAGGACGAGCTGTGAACTCTAGGCGGAAGCGGTAGACGGAGAGAGGCTGGTTACGGTTGTTATGAAAAG
AAGATAAAAAGGCAGATATAGAAGTGAATATCCATCATGATTGTATGACTTTAAAGAAAAAAAAAAAAAAAAAAAAAAA
AA > SEQ ID NO:3977 213935FL Trichoderma harzianum
TATAAATAGTAGCTGCTTGTTGTGAAGCACTGCTTTCATCAAAACAAGTACTCTCCAATCACATCTGGTGTTCGAACAA
GGTCACCACCCAACAACATTTCGCATATTCCATCAGGTCGATCGATTCCCAAGTCCGACAATCACCATGGCTGACGAAA
CCGTCAACATCGCTCCCAATGAGAAGGAGACCAACGGTGTCCAGCAGCAGACGGCGGTACCGCGCCAGGGCTTCACACA
CAACCACCACAGCGACTTCAATGAGATGACCATTGGCCAGTATGCTCAGGCTTTTGGTGGTGCTCTCCAACCCGGGGCA

FIG. 1 continued

```
TGGAGGCCATATGAGCACCGCAAGCTCGCCAACCCCGCCCCTCTGGGTCTTTCTGCTTTCGCCTTGACTACCTTTGTCC
TCTCCGCCATCAACATGCACGCTCGAGGAGTCTCGGCCCCAATGTCGTCGTCTCTCTCGCCTTTGGTTATGGCGGTCT
TGTTCAGCTGCTTGCTGGCATGTGGGAGGTTGCTGCCGGTAACACCTTTGGTGCTACTGCTCTGGGTTCATATGGTGGT
TTCTGGATCTCATACGGTATTCTCTTGACCCCCGAATGGGGCATCACGGCTCCTGATGGCCCGTACGAGGGCAACGTTG
CTAGCGTGCTTGGCTTCTTCCTGACTGGCTGGTTCATCTTCACCACTGTGCTTCTGCTCTGCACCCTGCGATCCACTGT
TGCTTTCTTCCTCCTCTTCTTCTTCCTTGACCTGGCCTTTTTCTTCCTCGCCATGGAGCAATACGCTGCCGACTTGGGC
AACGCGACCGCTTCCCTGGCTCTGCAGAAGACCGGTGGTCTCTTTGGTTTCTTGGCTGCTTTCGCGGCTTGGTACAATG
CCTTGGCCGGTATCCAGGACAGCAGCAACTCCTTCTTCCAGGTTCCCGTCATCCACTTCCCCTGGTCCGAGGCCGCTCG
TGAGCGCCGTGCCAGCAAGTCTGAGCGTGCTCAGGCATAAATTTCGTCTTTGGAAGTGTGATCTGTTCTTGGTTATGAT
GAGCGATGTTGGGAAAAGGAATGATACCTGAGTGAAGCGAGCGCGCGGTTCCTAGCGGGCTGGGCTGCGAGTAAGAATG
AATACAACTGGGCCTTTTTCTTTTTTTATCTGGTTAACAAACGTTATTGCGATGTAATACAGGAAGCTGCATACCAGC
TGCTGATATACCTATTAATGAAACTGACGTCTACGTCTTCTGAAAAAAAAAAAAAAAAAAAAAA

> SEQ ID NO:3978 214014FL Trichoderma harzianum
CAATTTACAACAGCAACCTAAGCGCACCTAGATATCATGGCGGACAACACTAACCCCGGAAACTTTGCCAACCGCCCCA
AGGAGGAAGTGCAGTCGATTGCATCCAAGGGTGGACAGGCGAGTCACCAGGGCGGCTTCGCTTCCATGGATCCTGACAA
GCAGCGCGAGATTGCGTCCAAGGGCGGCCAGGCCTCTGGAGGATCTTTTGAGCCCGGAAGCAAGAAAGCTCAAGAGGCG
GGCCGCAAGGGTGGTTTGCAGTAAAGCATGACCGTAACTCTAGTGTCGATTCACTGGTAGACGGTGTGATTATCTCTTA
TTGTAGATAAACATACACTAGCAATTTTGCTCTAATACAAACTAATTGGTCCTAAAAAAAAAAAA > SEQ ID NO:3979 212584FL Trichoderma harzianum
GCTTATCCCCCAGGTTGGTGGCAATGCCCGTAAGACCAACTATGACTACACCAAGGGCAAGCTCAACGAGCTTACCGAC
ATCATCATCGAGTCCGGCGCCAAGCTGTTCGTCTCCGCCGTCGGTGTTCCCCCCAAGGCCATCGTCGACAAGCTGCACA
AGCATGGCATCCTGTACATGAACATGATCGGCCACGTCAAGCACGTCCAGAAGTGCATCGACGTCGGCGTCGACATCAT
CTGCGCCCAGGGCGGTGAGGGCGGTGGCCACACCGGTGATATCCCCACCACCGTCCTCATCCCCGCCGTCGTCGAGATC
TGCAACAAGCACAAGTCGCCCCTGACCGGCGGCCCCGTCCAGGTCATCGCCGCCGGTGGCATCCACAACGGCCAGCTAC
TGGCGGCCTCCCTCATGATGGGCGCCGGCGCCGTATGGGTCGGCACTCGCTTCATCCTGACCGATGAGGCCGGCGCGCC
CAAGTCGCACAAGGAGGCCGTCCGCACCGCCGGCCACGACGACAACGTCCGCACCATCATCTTCACCGGCCGCCCCATG
CGCGTCCGCAACAACTCTTACATCAACGACTGGGAGACCAACCGCCAGCAGGAGATGAAGGAGCTCGCCGCCAAGGGTG
TCATCCCCTACGAGGCCGACCTCGACAAGGTCCTCAACGGCGGCGAGAAGCCCAAGATTGAGGGCATCCAGACCAGTGC
CAACGATGACGACGACGATCCTCTTGAGCAGTTCCGCCCCTTCTTGATGGGCAAGGCTGCCGCCGTTGTCAACGAG
CAGAAGCCCGCCAAGGCTGTTGTCGAAGAGTTCATTACCGATGCCGTTGCCTGGCTGAAAAAGGGCAACTCAATGCTGG
TTGGCCCTTCATCCAAGCTGTAAAAATTTGAGAAACGAAAACTATTTTCCTTGTTTTTTTCTTCGGTCTTGTTTTCACG
AAGCCCTGTCATATCTCCTTAATGTTTTCATGCCACTCCATGTAGACTATTCAGCATATAAATGTTCATAATTAGCCTA
TATGTACCAACAAAGCAAATAACCGTCAAAAAAAAAAAAAAAA > SEQ ID NO:3980 212996FL Trichoderma harzianum
AAGCTTCTGCTACATCGCCAACATTCTGTTTTGATTATAACGATCTGAATGCCTACCTCCTCACCGTTGTGGGTGTTTC
TCGGCCTGAGAGCGATCAAGCCACGCTTTTTCATGACATCATGACCAAGGCTCAAGGGGGAGCTCGTATATCACTTCGC
GAGATCCAGACCTTGTGTTCCAGAGAAGCCATCGTCAAATTGGACTCGGGTGTGAATCTAGCTCAAGCTATAGAAAAGC
TTGGTAGCGGAATACACAGAATCTTGGTTACTGAACAAGCTGGGAATGTTATTGGGATTATAAGCCAACTTCGCATGGT
GGAGTTCTTCTGGAACGAAGGGATCAATTTTCCCACCATTGACCGACTTAATCCAGTCACGCTACAAGAGTTAGGAATT
GGAGTGCGGCCGATAATCTCTGTCCACGCCGACGCTCCTCTTACTGAAGCTTTATCGCTCATGTATGATGAGGGCCTTT
CAAGCGTAGCTATTGTAGACAACGGACAAAATGTGGTGGGCAACATCTCAACAAAGGATGTGCGGCATTTGACAAGCTC
CTCGAGTGCATATTTGCTTGGTAACTCTTGTATGCACTTCATTTCCATCATTCTAAACGAAAAAGGGGTGGAAAGGGGA
CAAGATGTCTATCCCGTTTTCTACGTAAACCCTTACTCAACATTGGCACATACCGTAGCCAAATTGGTAGCAACAAAAT
CGCATCGGATGTGGATTGTGGATGCAGGACCACAATCGTCACCTATGTCAACGCCTACGACACCAATGACCACATCACA
GACTTCTATATCGGCGGGGACAGTTCCAGGACCAATTGCATCTGCTGTGCCTGCAGTCACAGTTCCGGCAGCTTCGATG
GCCGGGGCTCTGTTGTCAGGCAAACTAATCGGCGTGGTCTCGCTAACAGATATTCTCAACATATTTGCCAAATCTACAG
GATTGCACCCCTCTGAGCCATGGGAACAGAGAGTACGCCGCCGACGCAGCTCGAGTAGCTCCGTACGGCCCAGCGTAGA
GTCTTTACGATCCAGTGTGGAAACAAGGAGGTAACTTATGGTGATATTCGAGTTTAATTCGTGGAAGACTTTGAGGCTA
TTCTTGACACAGGCGTTGCACAAATGTTCATAACTCCTGATAATGCTAAATACGATGTAATTCATGAAGAGTGAAGCAA
AAAAAAAAAAAAA
```

FIG. 1 continued

> SEQ ID NO:3981 213149FL *Trichoderma harzianum*
CCCACGCGTCCGAACGATTCTCATCAAAGAACAAACGCATCGTTCAAGATGAGAGCCAAATGGAGGAAGAAGCGCGTTC
GTCGCCTTAAGCGCAAGAGAAGAAAGATGAGGGCTCGCTCCAAATAAACGACTCGCTCTACCACTTGACTTGACACATC
TTTCACATTTTGAATGAGTTCACGATAAAACACGACAAGCAAAGCTGCTGCACCACGGTACCACTCTATGACCGATTAC
AGCCATCAAGTTGGAATCAGCATATTGGTGCGCCTCTCCAATTCAGCTACGGGAGTCAATGGACGAACGCGAGAGATGA
GGACTGGACAATTTCAGTCAGGTGGAGACATCGTTTTGAGGACGCGAAGGCCATGAAGCAAAACGCTGCTGCAAGAAGC
ACGCTTAGGATCGATACGTTGCTTGACAAAGATCAAAGGCAGAATTTACTTCATTTCCAAACCAAAAAAAAAAAA > SEQ ID NO:3982 213340FL *Trichoderma harzianum*
CCTTGCCCAGCCAGAGGCCCTTCCTCGCGTCCACGAGACACGGCCGCCTCCTCAACACGATGCCGTACCCAAGCCGATG
GCCCCACCGCAGGTTGAAGCTCAGTCGCCTTCTCCAACAACCTCCTCAGTTCCTCCATCTCCCAAAGCCGCCGAGACCG
ATGCGCAAAAGACACAGCCTGCTCCCGCTGCTCGACCTCGTTCCAAGCTTCGCGCGCGCAAGGCCGCAATGAAGCTCAC
ACCCGCCGCCGTGGAGCAGCTGCGCGCACTGCTCAACCAGCCCGACCCGAAGCTCATCAAGGTCGGTGTGCGGAACCGA
GGCTGCAGTGGGCTCGCATACCAGCTGGAATACGTCGATAAGCCGGGCGCTTTCGATGAACTGGTGGAGCAAGACGGCG
TCAAGGTCTTGATTGACAGCAAGGCACTCTTCAGCATCATTGGCAGCGAAATGGACTGGGCGGAAGATAAACTGAGTCA
GAAGTTTGTGTTTAAGAACCCTAATATTAAGGAGCAATGCGGCTGCGGAGAGTCATTTATGGTCTAAGGAGCTTGTGAA
GCTACAAAGGAACAAGACAAAGGCCATGGCACATGAGAATACTACCAAGGCCGATGTATGGAGAGATTGTACGATGACG
ACTAGAAAGAAAGAATATTAGGGCGAGGCAAGTCTCTCAAATAGATACGCCTCAGCCCAATCCATGAAATGGTTTGATT
ATAATGGTGCCGATACAAGCACGTTACGAGCACGGAGCAAAGAGGCAATAGCACTATAGGGGCATGATACCGGCGTTAG
GTTAGAGGCACATGCGGCCATTGATCGTATAAATGTTGAATTTACTATTCTGAATAAAAAAAAAAAAAAAAAAA > SEQ ID NO:3983 213734FL *Trichoderma harzianum*
CATCATCGTCCTCTCTCAATCTCGTTCCCAATCAACTCCGTCTGCCTCTCTCGCCCGCATCAACAACATTGCGAGCCACAT
CTCTCCCACAATGGCTTCCACCACCAGTTTCCCGGCAGAAACGGTGCCCCAGGCGCCTGAAGATCCCCTCTTTGGCCTG
GCCCGCGCCTACAAGGCTGACAACAGCCCGCTAAAGGTCGACCTGGGAATCGGCGCCTACCGAGATAACAATGCGAAGC
CATGGGTTCTTCCTGTGGTAAAGAAGGCTGATGAGATTCTCCGAAACAACCCCGAACTGAACCACGAGTATGCCCCGAT
TGCAGGTATCGAGAGCTTCACCAGCAAGGCTGCGGAGCTGATGCTCGGCGCCGATTCGCCCGCTCTCGCGGAGCGCCGC
ACTACGTCTATGCAGACCATCTCGGGAACCGGTGCCGTTCACTTGGGAGCTCTGTTCCTCGCCAAGTTTTACAAAGGCA
GCCAGACCGTCTATGTGTCAAATCCCACATGGGCAAACCACCATCAGATCTTTTCCAATGTCGGCATCAAGGTCGCCCA
GTATCCCTACTTCAGCAAGGAGACCCGGGGGCTGGACTTTGATGGCATGACCGCTGCCATCTCAGCGGCTCCTGAAGGT
TCCATCATCCTGCTCCACCCCTGTGCGCACAACCCAACCGGCGTCGACCCAACACTTGATCAGTGGAAGGAGTTGGCCG
TCATTATCCGAGAGAAGAAGCACTTCCCCTTCTTTGACTGTGCCTACCAGGGCTTTGCCTCTGGCGACCTTGCTCGAGA
CGCCGCCGCTGTGCGTTACTTTGTCGAGCAAGGCTTCGAGCTCGTAGTTGCCCAGAGCTTCGCCAAGAACTTTGGTCTT
TATGGAGAGCGAGCTGGCTGCTTCCACGTTGTGGCTGCTCCTGCCTGATGCCACCACCAATCACCCGCATTGCAT
CTCAGCTTGCCATTCTGCAACGATCAGAGATTTCCAACCCTCCTTTGTATGGCGCCAGAATCGCTAGCACCGTTCTGAA
TGACGCCCAGCTCTTCGCCGAGTGGGAGGAGAATCTGAAGACCATGTCCGGCCGCATCATCGACATGCGCAAAGCTCTC
CGTTCCAAGCTTGAAGAGTTGGAGACTCCAGGAACCTGGAACCACATCACAGACCAGATCGGCATGTTCAGCTTTACTG
GCCTATCAGAACCCCAAGTTCTCAAGCTCCGCGAGGAGTATCACATCTACATGACCAAGAACGGCCGAATCAGCATGGC
CGGGTTAAATACCAACAACATTGACCATGTGGCTCAGGCCATCCGAAAAGTCGTTGGTGAGACTCAGTAATTTGTATGA
TAATGGTTTGATAGATGGGCTTCGAGGACGTGACGATAATTATCACCGCCGCTGGCCAGGAACTTGCGTTGTTTCGATT
AGTGTTCTTTTTTCCTTTGTATTCGATAGCACATGGGTGTGTGGGCATAGATGCAGCTAGACAAATAGCAAATACGGCT
TTGAGGGCCTCGGGGAAAAAAAAAAAAAAA > SEQ ID NO:3984 214023FL *Trichoderma harzianum*
AAAAAGGTTTGACCTTGGTAGACCAAAGATCGCCCACTTCTCGAGATGACATGACGGCAAACCAGGCTCTAGTGGAGTT
TGCTTTTAAGAAACGACGAAGCAAGGCGAAGGTGCAGGCCAGGCAGCATCTGCTTACTTGCCTCCAATTCGCCGCTCGG
GATGGATTGCAGCAAATGGGCTGGAGATGGCTTGCCCCGCTCTTGGACGCGTTGGCACATGCGTGGCACGATAGAAGA
GACTCGCCTTGCAAGGCATTCATGCATTCGGAGGAGAAGAATGTTTCATCTCGATTGGATCCCAGTCGGCTTTCTTTTC
ATTTTGGCGTGATTGCCTTGTGATTTTTGCATCAGCTGGAGTAGTTGAAGCTGCGTCATAGCTTCCCAGTGCTGCTTGG
AGGCTGCCACAACACAACTGGATAATGCCTGCTGTCAGTAATGGGCAGGCAATCGTTGAGGGAAGCTCAAAGGATATCA
GTCGTCAATTGGAGAGGTTGTTAGGGCAAATGATATTCAAAACCGGTGATTAGACAAGCCATGTATAGGCGATGGTTTT
TTGGTCAGTATGTTGGATTTGTTTGGATGTGCCGAAAATCGGCCAAAGGGAAGAATGTGCGGCTGAACGCAACACTGG
TACTTGAACAAGAGCCTAATCTTCAACCTTGTAAAAGGCATACAACTTCACCAAAAAAAAAAAAAAA

FIG. 1 continued

> SEQ ID NO:3985 212616FL *Trichoderma harzianum*
CCCACGCGTCCGCCCACGCGTCCGGGATCTTGGTGGGCACCACGACGTTCTTCTCCATCCTCATCTTCTCGATCAACAC
TGTCTTTGCTCAGGAAACACTCGCGCAGTGGATTGGAGATTACCTGACTCAATCTGCTGGTGTTACGGTTGTCTTCGAA
TCAGCCATAGTGCCCAAGTGGAAGAATGGCGTTATCGCATTTCGTAATGTGTTTATTTCAAGAAGACCCGGGCAGATCG
AATCATCCGTCAGCAAGGGATCGTCTGACGCTGCTGCTGTTGCTGCCGCAGGGCGCCAGGTTCAGCATAACGGGACTGT
TACCGAAGACGATGGCAACTATACGCAATTTGATGTAACGATCGCAAACGTCAATGTCACACTTTCATTCCTCAACTGG
TGGAATGGCAGGGGGCTTCTCAAAGATGTGGAAGTAAATGGTGTTAGAGGAATTGTCGATCGCACCTCTGTCCGTTGGC
CACTGCAGCAAATCGACCCCTTGTCTTACCGCCACAAACACCAACCAGGCGATTTTGAGATTGAATCTTTCAAATTGGA
AGATCTTTTGCTCACCATTCGCCAACCTGATGGCTTCCGCCCCTTCTCAGTGAGCATATACTCCTGCGAACTCCCTCGA
CTGAGAAAACAATGGCTCTTTTATGATTTCCTATCTGCCAGCCATATGTCTGGGTCATTTGATGGCTCTCTCTTTACAA
TTCATCCGCGACAAGTTCACGGTACGGTTTCAAGTCGATACCAGGGAGTCATGATGGGGCTAGAGGAATCCAAGTCGTG
GAAAAAATTCAACCGGCTACGGATTGATGGCTTGAAGATTGACCACCTAAACCGTGGAGTGGAGGGCCCATTTGGCTGG
ATCTATGAAGGAAACGTTGACATCGTTGCTGATGTCATGTTTCCCGAGGATATGGACGACAGCATTACCAAGGTCGTAA
CGGATTTCTACGACCAGCTGGAAGGCACAGTTATTGCTAATCGTTATCGCTTTCTGCCCCGAGCCCCTACACCCGAGAA
ATTCTCAGAGAGCGAGCGCGCAACGAGCGAGAAGAAGGCTCAGAAACAAGCCAACGAGTCTGAGGAGGATAGACGCCTT
GTCATCATGGACTTGCGTATTCATCTCAATGACGTCAAGGCTGCCGTGCCTTTATTCACCCCCGATCTGTCATATGTCA
ACCAGGCGCTTGTTCGCCCCATTGGTGGCCTATATCAATGCTAAGAAGACGTACATTCCCATCTCTAGCCGCATCATCA
AGCCGCTAAGCGACTTTGACGGAAGTTGGACAGTCTTTGATTGCGGGCTCTTGGATGATGCATCTGCCGAGACGTATGA
GGCTTTTGCAAAAGATGTCGAAGATCAGCAAAGCCGCGTCAGGCGATTCCGAAAGGTTGGATTCTGGACTTTGTCGCTG
GCCATTCATGCTCTATTCATGGGAATGGCCGGGAATGTGGTTTAAGGGGAGAAGACATGGAGAAGAAAAAAGGGACGGT
GGTGGATTCCTGTAGAATTGCTGTATATTTACAACGACATGATGGGACGGGCGGTACATGACGGGATTTTTATGATGGC
GTTGCGTTGTTACACGGGTATCACTCCGGGCATTTCTTGGCGATTTTGGGGGTTTTTATGGATCTTTATGAGAAATACT
TGACGCTTCAGGAGAGGCTATCTATATCTGATACCCTGACCTCTTGTCTACTGAAGCAGTGCAATACAAAACAAAACCA
CTCCAAAAAAAAAAAAAA > SEQ ID NO:3986 213783FL *Trichoderma harzianum*
ATTTGTCTGCCGAATAACGCGCTGCCTCATCTCCATCTCCATCCTCCTTCAAAGCGACCCCAAAGCAGGACAGGCGCCG
CAGTTCCAGTGGCATCGAGAGACGATTTGTCCATTGACTTCGTCAAGAGGATGCCGCAGGCCGAGCCTCTAGACCCCGG
CTTGATCCTCGATGATTGGATCAACCGCGTTCAGAATCTCCCCGAGGAGATTCGCTTTATCCAAGAAGAGATTACAGAC
AAGGACCGCCAGTACAATGAGTGTATTCGAATGATTGAGGATCGTGATGGAAAGATTCAAAAGTGGATAAAGACGAATG
GGAGCCATGAGCCCAACCCAAAGGAGGATATGCTACGGGCCCAGATTCGCGAAAACTATGCTCGCGCCGACCAGTTTGC
TCAAGACAAGATCACCTTGATACAAAGGCTACAGCTCGTTATGGACAAACATCTGCGGAATTTGGATGTCCAGATCAAG
CTGCTATACGACCGTGCCGAGCCTGGATTTACAGACCCTGACGAGGTTCCTTCACTCCTCCGCCCAGTGCGACTAATC
ACAGCGCTCCCTCAGCTCGGACTCTAAACCTCTCCAACAACATCCACTCAGCTGGCCCTCTGGCTTCACCTCGGAACCC
GATTGTCAGCTCCGCCAATCCAGCCATGGTTCGGCTGCCCAACCACCCTCAAATTAGAAATACTCAGGCCCAGCAGCAT
GTCGCGCAATACCATCAGCACCCATCCTCCGCACCAGCCACGCCAGCCGCAAGCATAATACTAAATAGACAGCGTGAGA
GCTCAGCGGGCCCGGCCACAAAGAGAGGGCCGCGGTCCATTACAGGGCCCGGAAATCTGCCGACAACGTCAAGCGGCTT
AGCGAGACATTCATCCCTTGGTCCTGGTATACCTAAGAGCGGCTCTGGAGCTAATCTGGGAGCCGGCCGGTGCTGTCCGG
GCAGGAAGTGCTGGACCGAGAGCAGGATCGGTCAAAGGGGTTGTTGGAGTAGCGGGTCGCAGAGGCACCCCGACGATGA
GTGGTCGGAAGAAGCCACCCAACAGATCGTCACTTTCACGGGTGAAGAAGGCCTCAAACAGAAATTCGCGCATCGAC
GGCGGATAGTGATTTGTCGGATGCTGCAAGCGGCAGCGGCGAAGAGGAAGATGGTATGGAATCACGGCCGAGGGCCTCC
ATGGCGGATGGCAAAGATGGGGATGAAGTGCTCGGAGACGCCGATGACGACGAAGACGGTGGTGATGACAAACGATACT
GCCTGTGCCATAACGTGAGCTATGGCGACATGGTGGCTTGCGACAACGACAATTGCCCCTATGAGTGGTTTCATTGGTC
GTGTGTTGGGCTGAAGAGTGAACCCAATGGCACTTGGTATTGTCCCGAGTGTACCGAGAAGTTTCAACGAAAAGGGAAA
TAGAAAACCATGTAATCTTGTTTGCGTGAGTAGTTTAATATTACAAAGCTGCGGCTGACAATCTATTGCCAAAAAAAAA
AAAAAAAA > SEQ ID NO:3987 214047FL *Trichoderma harzianum*
CGTGGATCGTAACAAATAGCCTTGCCATACAACAAAAGGGAAACAATTTTCTTTGATTCAGTGTTCACTGAACCGTTGT
CTGTCGTTCATCTCGCTTGCATTGTGCCATTTTTGAATCTCCAGAACCGCAACACCTTTGTATCGTCATCCACCCAAAC
GTAGGCCTTTCAACCATGGGAAACACGCTATTGAAGCTATTCAGCTTGTCCATGTATAAAACGGAAATCAAGGCCTAGG
TGGAAGGAACATTGGATCTAGTACTCCTGCGAATTATATCATAACGCCACCCGCTGTCCCAAGGATTTACCTGCTAAAT
GAAAGCTAACGTCATGATGAACCGCGCTCTTTCCATCCGCACCAAGAACAAATCTACTCCCTCCAAGGGTCATGGTCGT
GGTCGTGGGTTTACTTTCCGCTCCCTCCGCGAGTCCGTCCAGCCCGAGCTCTCTCGCAAACTGTTCCGTCTGATCAAGC

FIG. 1 continued

```
TTGAGAATGATCTCATTCACACACACGAGGCTGCGGGTCGCGAACGTACGGCCATCGCCACGCAGCTCTCCGAATGGGG
TGAGCAGACCAGCGATGAGGCCGTCAACGACATATCCGACAAGATTGGCGTTATTCTAAGTGAGATGGGTGGATTGGAG
GAAACGTTCGTCACTTCGCTGGACTTGTCGCGCACTCATCTCAAGATGATCCGCGACACCGAGAGGAGCGTTCAACCGA
GCCGCGATGGAAAGAGCAAGCTTTACGACGAGTTCCAGAAGCTCAAGGCGAAGGAGCCTCAGAGTGCCAGGCTAGTCTT
GCTAGAGCAGGAGCTTGTTAGGGCAGAGGCCGAGAATCTAGTCGCCGAGGCGCAGTTGACAAACGTTACTCGGCAAAAG
CTCAAAGAAGCATACGATGTCGAGTTCAGCGCAATCATAGAACGCGCTGAGAAGCAAATTATCTTGGCCAAGCATGGTC
GTCGTCTCCTGGAGCTTCTGGACGATAAGGCGCTGTCGCCGGGAGACGTTCGCATGCCCTATGAAAACGGCGCTCAGGC
TCGCCAGGTGCTGAACGATGCTGAAGATGATCTCAAGGAATGGCAACCAGAGCACCACCATAAGGCTGTAAGCGAAAAC
GGGTCAGAGACATCCAAGGGCAAGAGTCCGGTTGAGCCCAGCGCTTAGGCAGTGCTGTGAGATGAAGCCGCGGGTATTT
CGACCTTGTATGACTTTGACTGAGAAAACGTTCTTGTTTGTGTCTTCTTATCCCCCTTAACAATCATCCTGCTTCTGGT
TGGGAGTTTTGTTAGAGGGTTTGGCGGTTCTTTTCAGGTTTATATATGCGTGCTGTTACGTTTTGATAGCATATCTAGT
TATATCCAATCGATGCGACTGTTGATTTCCGAAAAAAAAAAAAAAAA

> SEQ ID NO:3988 213179FL Trichoderma harzianum
CGCCCCTCCTTCATACGATGATACTCCCGCTCCTGGCGTCCCCACGCGCTCTCCGGCTCCGGCTGGGAAGCCCGTTTTG
GCCCATGCGAGAGCCTTGTACCGCTACGATGCCAGCGATGCCCGCGACCTGAGCCTGGAAAAGGACGATAAGATCGATG
TCTACGAATACATGAACCAGGACTGGTGGATGGGCCGTAACCACCGCACTGGCATGGAGGGCATCTTCCCCCAAAACTA
CGTTTTTGTCGAGCAGGAGCAAAAGGCTCCTATGCCAGCTCCCGTGGCCTACCCCCAGCAGCCGGCATATGGCTACCCG
CAGGGACCTCCGGCGCAGCAGAACCCTTACAATGCCAGTGTGCCACCTATGGCGATAGCAGAGGGCGGCCAGCCGTCTC
AACAGCAAGGCGGAGATGGAAACAGCAAGGTTGGCGAGTACGGAAAGAAGTCTGGCAAGAAGCTTGGTAACGCCGCCAT
CTTCGGTGCGGGTGCATCGATTGGTAGCAACATCGTGAACAGCATCTTCTGAGGGCAATACGCGATCTTCTTCGGCCTC
TATTTTGCTGGCTCTGTTTTATTTTATTGAACTTTCAAGTTTGGCGTTTGGAATGGGTTTGAGGCATCACCTACAGTTC
TCGAAATGAGTGAACTTTTCGTCTTTTATTATGGAGAGTGAATGTCAACGAGTTGATCCTTTGATCTCTAGAGATATTA
ATTGACAATGATACAAAAAAAAAAAAAAAAAAAAAAAAAAAAA > SEQ ID NO:3989 213363FL Trichoderma harzianum
AGAACAACAGACGAGGAATTGCTGTGGTTGTATAAGTTGAAGAGTAGCGGTATGTTTAAGCACCACCAAGTGGTCAGAT
GAAAATTAAGCGCTTCGGTACTTGGCCTGCCAGAGTTCAGTTGAGAGTGAAGATGCTCCGTTTGATCCATAATTGACAT
CAGCCCCGAGGGCCTTTCTTTGAGGGTGGAGCGGCATCCCTGTTGGACTGTGGAACCGATATTGTGGGCGGCCTTGAAG
AGCACAAAGCTCTCGTGACGATGCTGTCTGTAGCTCGAAAAAAAAAAAAA > SEQ ID NO:3990 213742FL Trichoderma harzianum
TGTATAGCTGTAAAATCACAACTCATAAACAGATCTCGTCCTTTACATCTTATTCTCTTCAAGCTCATCACAGCATCGT
ATCATCATAGTCAACATGTCTCTCCAATACTTCCCTTCCGTCAAACCCTCCGCCATCGCCCTCGGCACCTTCTTCAACC
ACGGCGTCGACCTCGTCGTCCTCGCCCCCGTCTTCGGCCAGACCTACCAGCGCGCAAAGGCCTCCAACACAAAGGAGGA
GTTCATCCGCTCCCGCGAGGCCAGCGGCGCCGCCGTCGCCTGGGGCACCTCGTTTGTGGGATCTGCCCTGCAGAGCTAC
GGCGTGGGCGCGCTGCTTAATGCCACGGGCACCCTGAGCCACAAGGGCGCTGCGTATCTCGGCGCCTTGATCTTCGCGG
CGACGTCAGCTCCTGGATTCATCTCTCAGATCTTTAGCGAAAAGAGGCCTCTTGACACCGTCGGCGTCAATGTCGCTGC
TAAGCTGCTCGAGACTATCGGCCTGTCCTTGGTTCTCAACTGGTGGGGAACCAGGACCAATCCCTTTGAGTAAATGGGA
TATCTCTTCGTAATTCTTTCCTGAGGCTGGTTCTGGGAGGAGTTGACAGGGAATGGAAAGGCCCCATCATATATGACGG
CCTTTGTTGTATAACATCACACCTAAATTAGTCAAATTTAATTTGGAATATTAATAACTTCAAATAAAAAAAAAAAAAA
AA > SEQ ID NO:3991 213789FL Trichoderma harzianum
CACCGCGTTGCCGAAGCTCTCGAGGTTGGCATGATTGGTGTCAACACAGGCATCATCTCTGACCCTGCGGCGCCGTTCG
GTGGTGTTAAGGAGAGCGGTTTCGGCCGAGAGGGATCAAAGTACGGTATTGCAGAGTACCAGATCACCAAGATGATTAC
TTACGGCGGCATGGGTAAGCCTCTGCAAAGCTAAGTAGTTAAAAGCGAGATAGAGTAGCCAATGCTTTTTAATGTCCCA
CGATTCAATGAAATAACGATAATTACAAAAAAAAAAAAAAA > SEQ ID NO:3992 213909FL Trichoderma harzianum
AACCTACATCATCTAATTCAACAAACTCAAGTATAACTTATACCTACTATTTATACCTACTCAACAGTATACTCGACCT
TGTCCAACAAAATCAAAACAAAACAACAACCGAGGCAAATCAAATAACAAACTACCTCAAAAATGGACTCTTCACCACC
AACAACCCCAACCAAAACTCAACAATCACAAAACCTCCAGCAATCTTCTCCTCACCCCCAAGACTCCTCCCCCGCCTGC
CAATCCGCCATCAAACACTCCTCATCGTGGAAGCCCAGCTCGCTCGACCGCCGCCTCAGCTGGAGCTCCAGGACCAGA
```

FIG. 1 continued

AGCACGCGCTGCAGATGAGCGGCATTGACGGCGTGCAGTCGGGACACCAGGGCTTTACGGAGCGATGAATGCCTTTCCA
TCCAGTCGGGGTCTTTCTTTCTTTTTTTATTCTATGGAGAGAAGGTGTAGATTGGGAATGAAAGAGGGGGAAAGAAGAT
GAATTCATAAAACTCTATATGAGCGTGGTTTTCTTCTTCTTCTTTCTTTCTCTTTTCAATGATTTGATGAAACAAAAGG
GCTATTGGGAAAATTTGGGAAATTGGGTCACTGGCATTGCATGGCAACGGAGCGAAAAAGAAAAAAACAATAGGCATAA
TGCACGCGACTTTGTGTGTCAAGATTGAGCTGCTGGATTTTGAGAATTGGAGATGTGACGCCAAGTCACGCATCATTGG
GAAATTGGCAGATACCTATAATAGCTCCGTACTGAATGTTGACCTACCTATTAATTGATAAAAAAAAAAAAAAA

> SEQ ID NO:3993 213962FL *Trichoderma harzianum*
CATCACTTTATTATTACTGGTATATATTACTGGTATTTGATGATGTGAGCAGTGGATAAAGCTGGATTACGAACGAGGA
TTGGGAGCATTCAAAATTCACATTGTCAACCACGCATCGCAGCACCTATACGTGCATTTTCGACTATGGCCTCCAACAA
GGATGCGCCAGCTGCGATTAAACGCAAGGACCTCTACGAGGCCCTGAGGCTCTCGCGACTCCCAGATGAGCAGAGCGGC
TCACAGGATCCCATCAAGAGATTCGTCAGTCGTACACCAGCCTGGAGGCCTGGGAATGAGCTGCCATGGGGATCAATCG
ACTCTGAAGGGTATAAGAAGGGCAACACGGTTGACTTTAACCCGGCTGCGTTTGGAGGCCACGTCTTCGCCCAGGCACC
CTTGGCGGCTGCGAGAGCGGTGGAGGAAGAAGAGAATGGCAATGGCAATGGCAATGACAAACTAGGCATTCATTCCATC
CAAGGCGTCTTTACAAAAGCGGGCGCGATTGATCGGCCATTCATCTATGATGTGACAAATGTCCACTCAAGCCGTTCAT
TCACCACCAAGCTGGTCCAGGCACGGCAGCCCACAGAGGCTTCAGATGCTCCGAATGGCCCATTCCCGAGTCTGATGCG
AATCGGCCGCTGGGCCCCGTCAGTTTCACCTGTCTCACAACGTTCAAGCGTCCCATTCCCATGCCATCGCCCGCAGAGC
TGCAGATCAAAGGGTCGGCACAGGAACGCTATGCCGACATCCTTTCGCAACGAGCGCCAGACCAGTGGGAGGCCAGTCC
TCAGGTGGATATCGATGCTGTTACGAGAATGTTCCCCAACGCTGGTCACGGAGGTTTTCCCATCTTGGACATGTACAAG
GTGGACATGAAGGGGTACAATGCTGATAAAGACGTCCCTGAACGGCGCGAACTCATCCTCTACCGACCGTATAAGCCGA
TTAACGAGGACGATCCAAATGCGCATATCGTCGCACACGCGTACGAGGCCGACCGGAACGGGCTCATTATGCTCACCAA
TCATCTTGGTTGGGGCTTCAACCTCGGCTCTGCGGCTAGCTTGTCGTATTCCTTCTATGTGCATGTAAACGCTGACGAG
GCAGTCATGAAGGGAGATGGATGGTGGATTCAAGAGGTTTGGTGGCCGAGAGTCAGTGCAGGGAGAGCAATGATGGAGG
TTAGGATATGGAGTCCAGAGGGGAAGCATGTGGCGAGTGGTTACCAGGACGGAGTAGCATTGCCGTCGAGTGATTTGAC
CAAGAAGAAGAAGAAGATGGGAGAAGCTGTGATGGTGAGTAGAAGGGGGTTGACCCAGGGATTCGCTGTAGAGATAG
ACAACCTTGGGACGTTTATGGGATTTGAGTACTGGCTGTACTACCTAGTATACAGCGTAGGTGTATGGGACACCGGAAT
AAAGCTATAGAGGATGAAAGACTAGAGATATACTGGATGATCAATGCTATTAATTATTTTAAAATAGAAAAAAAAAAA
A > SEQ ID NO:3994 213122FL *Trichoderma harzianum*
GTCATGGAGAACGTCCTCTTCAAGGTCTCCTACCCTGCCGAGTTCCACTCCCAGACCGTGACCACTGCATCCAGTACAT
GGCCTCCGTCATGCTCGTCTTCGGCCGCCTCGAGGCCACCGACTACGTCGACGGCTCTGAGGCTGCTACTTCGGAGCTT
GTCGAGTCTCTGCGCAAGAAGATCAAGTGCGTTGAGGACCCCCAGTACACTCAGGACTACCATGACCCTGCCCTGCGAA
CCATCTCCAACGCCCTGACCGTTGAGCTCAACGACGGCACCGTCCTCGAGGAGGTCGCTGTTGAGGCTCCTCTGGGCCA
CCGTCTTCGTCGTGAGGAGGCCAAGCCCGTCATCCTGGCCAAGTACAAGCGCCACCTGGCTCCTCACTTCCCTGAGGCC
ACCGTCAACGAGCTCGTTGAGCTCAGCCAGGACAGCAAGAAGCTCGAGGCCATGACCGTGGACGAGTACGTTGACAAGT
ACGCTGTCAAGGAGAGCAAGTTTGTTGTTTAAATTGGGGTTGTGCAAAAGTAGAAGAAAATCCTGATGTACCTAGATGT
TTATGATGACGGTCATATAGACCAAACAAAAGTAGCATTATATTAATAAAAAAAAAAAAAAAA > SEQ ID NO:3995 213369FL *Trichoderma harzianum*
ACTTTGTGTACCTCGAGATCGGGTATAAAGTTACCTCGGGGCGCCTCTTAGTGCTGGCGTTCGTGGCTTGTCTGCTAAC
AATCAGGTTATATCCAGAGCTTGGGCACCAGAGCTCTTCTTACACTGCCAATCTCTGCATCATCTCGTAAACAGAGTAT
ACAATTCTGGATACAATTTTTCTTCGCTCCATGGGGTCTCAAGTCCAAGAAGAGCTGACAGTGCTCGTCACTGGATTTC
AGCCTTTCCGGCCAGAATATCCAATCAACCCGTCATGGGAAATCGCGAGAGCCCTCCCAGAATACCTCCCTCCGCTAAG
GGCCAAGGACCCAAACTCTCGAAATGCCGTCGACATCCCGCCTGTGCGCATTCTGGTGCACCCCGACCCCATCCGAGTC
AACTACAAGGTGGTGAGGGAGCTTGTGCCAACACTGTGGGAGGAGACGTACGCGGGCCGCAAGATTGACGTCGTCATTC
ACATGGGCATGGCAGGGCCGCGGCTCATGTATCAGATCGAGAGCCGAGGACATCGTACGGGTTACAAGTCTCTCGATGT
TGACGGGAAGCACCTTGACGAGCTCGATGGGAAACGGGACGAAGAGTGGATCTGGCATGGCCTCCCGGATGTGCTGAAG
ACGGACTTGAATATACAGGACATCTGGCAGAGATGGCAGCAGCACAGCTCGAATGACATGGATCTTCGAATCTCTGACG
ATGCTGGCCGTTATCTCTGTGACTTCATCTACTACTCAAGTTTGGCAACCTGCTATAAGCAGGACAAGGAGAGGAAGGT
CATCTTCTTCCACGTGCCTGCGGATAGCTCTGAAGCCGTGATCAAACAAGGCCAGGAACTGGCTGTTAATCTCATCCGG
TCCATTGTGGAGAGCGAAGTTGCAAAGAAGCAAAAGGCGACGGAGATGGAATCCTAAAATTTCTTTTGAGTAGCTAGGT
ATGCAAGCTTTGGATCAGCATTTAGTGGTGTTGGTATTGGTAATTGGTATTAGTGCAATGGCGCCGAGGACTTGCTGGA
GCGGAGAAAAGAATGCTCTTAGGCTGGGCTTTTTGGTGTTCTGGGAGAAACGAAGGAGAAGGAAGAGTTTAATGTTTAT

FIG. 1 continued

GATGGTAGTGATATGATATCAGAGACTAACTGAGTCGGAAGGGGGGTTTTCGGGGAGGTTTGGCTGAAGCAACAAGGGG
AGATTATGATTGACTATGGTAATTCGGAGGAAATTGAGTAATTGCTGTTAATCATGAATCGAACTTGCCATCACAAAAA
AAAAAAAAAAAAA

> SEQ ID NO:3996 213794FL Trichoderma harzianum
CCCAAAGAAAAGGTCTCCGGCTCTGCAGCAGGCCTGGACCTGGAGAGCCTAAGCAGCAGTAGTGACAGCAGTACTGTCC
TGTACGGAGCAGTGGCGGCTGCAGCAACCAGCACAACTGGACGGAACAGCAGCAGCAAGCAGCAGCAGCAGCACGACCT
GGCCCTCCCTGCCATCTCCCCACCCCTGCCCTGGCCCGTGGCTCGACTACCGCTACGATACCAGAACTGCACTGCACTG
CTTGTGCTCGCTATACCTGCCGCACCGCTGTCTGTGACGTGTGAGGAGGCCCTACAGGGAAGCACAACCACCACCAAGT
ACTGCGCTTTTCCCGCACCAGACACTTGACCTCCAAACCTCTCCACACAACCAACCCGTTTTGCCCGGCGTAGCGAGAA
CACGAGAGCGAAATAGAAGCCGAGGCCAAAGGGGAACGGAGACAAGAAGCAGGAAACAAGACAGAGTGAGAGAGAAAAA
AAAAAAAAAAAAA > SEQ ID NO:3997 213881FL Trichoderma harzianum
AATGGAGTGACACCGCACATCAGCACATCCAAATCGCTGTGCTGAGCTACACCGAACAAGCTGAAAGCAGTGACAACAT
AGCAATAAAGAGACGAAGATCCAGGTCTTTTGATACCAAAGCTGCTCTCTTTGGCGCAACACAACATGTCGACAGCTTC
CTCCAGCGGCCCGCGAAGGCCCCCCAACTCCAGCGCCATCGCCGGCCCATCATCATCCTCATCATCATCCTCACCTCGC
TGGTTCTCCCAAACCCAAGCCGCCTCGCCGCCCTCCGCCCCGTCCGTAGTGACAACCTCCGCCTCCGCCACAGCCATGG
CTTCTCCGGCATTCCATCCCGCTCCTCTTCCAGCCCACGCTGCCCTCGGCCGAAACCCAGCGGCCACGTCTCCGAGGCCCG
CGCCGCCGTGGTCGCCTCCATCGGCAACATGCTCGACTCGGAGCTGCAGTCGCGCGCGGGCATCCTGCACTCCAACGCC
GCCGCGCTGGAGAAGCAGGAGCGCGACGTGCTGCGCGCCACCGACGGCCTGCGCAAGGAGACGGCAAAGCTAAAGGCCG
AGGCGGACAAGGCCGCTAGGAAGGTGAAAGAGCTGGGCAACGTCCAGAACTGGGCCGAGGTGCTGGAGCGCGGGTTCCT
CGTGCTGGAGGAGACGGTGAGGCTGGCCAACGGGGGCGAGGACTCGGACTCGGCAGGCAGTCAATGTACCTGCAGCTGC
AGCGAGTGCGGCAGCGATTCGGACATGGGCGCTGAAGAGGGCGAAGGCCGTGATGATGGCGGTAATGGAAACGGCAACA
GTGGTGCTGAGAACGGCGCTGAGAGGAGGATGGATGTGGATGGCATGTCGGATGCCAGTCGAAGTTTGATGGACCTCGA
CTCGAGTACCGGCACGGGGCGAGCAAAGGGGTCTGAGACGGCGTCTATTTCGACGGGGTGATACCTCTGCCACCTACAT
GTATGGCGACGATAAAGAGACGGAATCAACACAGATAGATACATGAACAGAGGCCAGCTACTGGATAAGATAGGTAGTC
ACATTGCCATGAGATCAGATAGATGTATACGCCATATAGGTATATTAGTAGTATATTATAACCATTGCTATCCGAAAAA
AAAAAAAAAAAAA > SEQ ID NO:3998 213967FL Trichoderma harzianum
AGCAAATACCGCAAAGATGTCTGACGACGGGCTCTCAATATACGATGAGATCGAAATCGAAGATATGACCTTCGACGAG
GTTCTTCAAACATACTTCTACCCGTGTCCCTGCGGCGATCGTTTCCAGATCGCTATCGATGACCTGCGCGACGAGCAGG
ATATTGCTGTGTGCCCCAGCTGTAGCTTGATGATTAGAGTTATTTTCGACCTTGACGACTTACCCAAACCTCCTCCTAC
TGGCAATACTGGTGGCCAGATACCAGTCGCTGCTTAAAGCCATCGCTATATTTGAGCTTCCCTGGGCGAATACTTGATC
TATTCGGCAGACACATCGAGATACTACACTAATTAGGCCCGCATAGCGTACACAGTGCCTCAACGGCCGTTCTGAAGAG
GCTTCTCAGATTGATCCGTCTAACATCGGATGTATTGATAGACGCGGACGAGAAGACGACGATGTACCAGCGACAGACC
AAAGTCATCCCAAGCATCCAAGCTACTGATGCAAAAATATGCGTGCCTTGGGAGTACCACTCTCCGAGGCAAAAATTCA
GTCACTTAAAGAGACAGGCTTCGGGAATGCCATGAAGAATTCAGGCTCACGTGGGGGACATTTGATGAAAGAACACTGC
CGAGGCGTTGGCAATACAGAATGGACCTATGAAGGACGGCCATTTCACTCATATACCGTCAACATAACAAACCAAGATA
CCAAGGGTGTATTACATATTCACCTAAATTCCATGAATGCAAACTGAAAAAAAAAAAAAAA > SEQ ID NO:3999 214087FL Trichoderma harzianum
CAAACAACGAAACAACCGCCCAATCGCCAATCGCCGCCTCGACATGGTGCTCGGCGACTACGAGGAAGCACAATAGGCG
GGACGCGAAGCAAACAAGCGCTGGGCGTCTGAGAAGTAGCCCGAGAGTCACAGCTACAGCTACAGCTACAGTGAACACG
CGATAGAGTGATTCAGGACATCCAGAGACGAGACGAGGCGCCTGAACGAGATACGAAGCAAACAGACACGGGAAAGCAG
ATGCAATGTCGGCAAACGTAACAAAGCCGGCGCCCAATCGGCCGCAGCGGCGCGTAACGGCCGGCCAGATCCTGTCGAT
GCCGCCGAAATGGCTCGGCATGTACGACGAATTCATCACCAAGAACGCCGGCCAGGTGTCGCAGATTGAGAGCGCGCTG
AGGAGCTTGACGTATATCATTCCAGGCCGCTTTCGCGATGCTGAAATCGCCTCCGAGTCGATTCACTCGGGCGTCCAGC
TGCTGTCGCTCTACCACGACGGCATCCTCTCGCAGGCAGTGTCCAAGCTGCCCAGCCGCCTGTCCGGTCGGCTCATGC
GCGCTACACGCGATACTGGACGCAGAAGAGCAAAACGTACCGCAGGATAGCCATGGTGCTGCAGATGGTCGTCTACACG
GAGCTGCTGTGCGAAATGAGCGCCAAGCGGCGCGGCGGCGAAAAGTCCCGGTGGAACGTCATCGTGCTGCTCGAGGCCA
TCAAGGCCTTTTGCCGCCTCATCCTGCTGCGCGTGACGCGGTCGCGCCCGCTCGTCACACCGGTGCTGCCGGAGCGAGA
GCCCATCCCCGAGGACGACGATGTCGACGAGGATCTGATTACGGCCAGGAGCGAGAGCGAGCTGATGGACGAGACTTCG

```
CCCAACGGATCCGCCGTCCTTGTCAGCAGCAGCACGCCGCCGAAGCCTGCGTACGAGAGAGAATGGACGATGCCGCGGA
CGGGAATGAGCTTGCCGTCGTTGCCCAACCCTGGCGATGTTGGCTCGTACCTCTTGGGGCGCGTCTTGACGGCCGACGA
CATCAAGCCTGCCAACAAGCTCCTCAACACTTTGCAAGGAGGCGGCCAGTTTGCCGAGATGCTGCACATTCTGACGCCC
TTGATCTACGCAGTGGCGCTGGCTAGGACAAAGAATAAGAAGTCGTGGACGCCGTGGCTGGTGGGTGTGGCGGTCGAGT
ATGTCGCTCGCCAGCTCCGCCAGCGTAACCTGCGAACCTCGGCTCTGGAGCGAGACGAGTGGAACAAGAGAGGCTGGGC
TATGATCTGGTGGATGATGCGCGGTGCTTTTTACGAGAACGTGACTAAGGGGGCCGTCAACGGGGTGACGAGCAGAATG
CCAGGCTTCATCGGCGGAATCCTACAAGACTACGAATATCTGTGGGAGAATTACTACTTTAGCACGAGTGGCTGATTGA
CTGTCATGCCAGCCGTGGAGCGGTGGCGCTCGTTCCTCTTCTCTCTCGCCATATAACTTATATTGGTGCTACCGAAGCA
CATGCAAAAAAAAAAAAAAA

> SEQ ID NO:4000 212661FL Trichoderma harzianum
GTTCTTGTCATTAATTAAACTCGACCCACGCGTCCGGCCCACGCGTCCGAGTAACGCATTCACAATGTCTGGACCTGGC
GTCGGCTTCGAGTATCCTCCTCAGTCCGTTTCTTGGCTGAAGCGCGATGTGCTTCTCTTCGCCAACTCTATCGGCGCTA
CTGCTGACGAGCTTCACTTCCTCTACGAACTCCACCCCAACTTTGCCGTCTTCCCTACTTACCCTGTCATCCTGCCGTT
CAAGGGCGACACACAGGAAGTGATTGACTTCTACGCCTCCCAGAAGAAGATCAAGGTCCCTGGCGTCCCCGACTTCGAC
TCCCGCCGCGTCGTCGACGGCCAGCGAAAGATTGAGTTCCTCAAGCCCCTGCCCGTCTCCTCCGAGGGCCACAAGTTCG
AGATCCGCCAAAAGGTCCTCGGCGTCTACGACAAGGGCCGTCCCGGCTCCGTCGTCGACACCCAGCTCGAGCTCGTCGA
CGCCAACACCAACGAAGTCTACACCCGTCTCTTCGGCAGCGCCTTCTACGTGGCCCAGGGCAACTGGGGCGGTCCCAAG
GGCCCTGCCACCGAGAACTTCCCCCCTCCCAAGGACAAGAAGCCCGACTGGGTGTTGGAGAACCAGATCTCCAGGGAGG
CTGCTCACCTGTACCGTCTGAATGGCGACTACAACCCCCTGCACGCCACCCCCGAGCCTGGTGTCAAGATGGGCTTCCC
AGGCGCCATCATGCACGGTCTGTATTCGTGGAACTCTACTGCTCACGCCATCCTCAAGGCTGTAGGCGGCAGCGATCCT
GCCAACCTCAAGGAGTACCAGGCCCGTTTCGCCAGCCCCGTGCTGCCCGGTGACAAGCTCATCACCCAGGTCTGGAGGA
CAGGAGAGAAGAAGGGAGAGTTTGAAGAGATTCGGTTTGTTGTTGCTGTCGAGGGCGGAAAAGTGTGCTTGAGCAACGG
ACGTGCCTTGGTCAAGATTCTAGGAGACATCAAGGGAAAGCTGTAAATTGTATAATAATGTGCTATTTTGATGACTGAT
TTTGGAGAGACCCCACGATGGGTCCTTTAGCGAAACAATGAATTTCACACGCTTCCGCGTAGCCTTTGAAAAAAAAAAA
A > SEQ ID NO:4001 213756FL Trichoderma harzianum
GCGAATGATGCTGATGGATTGATGATTTGACGTTCAGTCTTTTTCCCTTCTCGCTCGTCGCCACAATGTCAATTGCAGC
AGCGCCCAATGCGCTTCGAGCCTCATCAGGCTGCGCCTCAAGGCTGGGGCTGTCTCTCCAGAAAGGCCCATCATCAAGC
CTTTTCCTGCGGGTAGCAAGTTTCTCGACAACGGCGCCGCAATGCAAGCGCAAGACAAAGGACAGCAACAAGCGACGAG
GCGTCAGCAGCCTCTACGGATCGGGCCCGCGAGAGCCGCTGTCCATGTCCAACATGCCGCTGCCGAAGCCCGTCGAGTT
CAAGCCCAAGATCGAGGTCGACGAGGCCACGGCCTGTGGGGGTTCTTCCCCGCCGCCGGGGAAGCTCCTGCTGACGCCC
AAAGAGACGGAGGAGCACGGGCGAGCGTGGGAGGTGGAGGAGCTGCGGCGGAAGTCGTGGGAAGATTTACATGCTCTGT
GGTGGAAGTGCTGCAAGGAGAGGAACATGCTTGCTACGGCGAGGGCGGAGCTGTTGAGGGGGAAGCTTGGGTTTGGAGA
GCGGGAGATTGATTCACGGGATGAGGAGGTTACGAAGACGATGAGGGCGATCAAGCATGCTCTTACGGAGCGATTCTAT
ACTTGGCAGGATGCCGTCGAGGTTGCCAGGTCGGACCCCGAGATCAACTTGGAGGGAGGAGAGGGTCAGGTGTACACAC
CGTCTGCATATGAAGAGGGATACGATGATGTTACTGCTATGGAAGAAGCAGACAAGGAGTTGAAGGAGCCTACCAGGTA
GAAGCCAGGCGAGGCTAGGAGATGGACGATCAAAACTAACGAAGAGAATACCGAGGTCAATCTTAGACGAAGAAAAAG
GAAAGGAAAAGGGCAGCGAGGTTAAAGGGGGGAGGTCGGTTCGACGACGGCCAGCATGATATCACGGGGAGGTATTCT
GGCCCGGCCGCGTGTAGTACTAAGTATGGGAATCTGTGTACCTATATCCGACGAAGCAATTGGCATGTATATTACTACC
GGTACGATATGATACTCGTAAAAGAAAAAAAAAAAAAAAA > SEQ ID NO:4002 213919FL Trichoderma harzianum
CGGACGCGTGGGCGGACGCGTGGGGATGGAGGCCCTCCTGCGCAATACCACGCCTCTCCCCCTATGCCAACTTATCAGC
CTCCCTCTGACAAGCCGGCTATTCCTCAGGGATGGATTCCTCTCTTTGACCAGAGTCGCCAGCGATGGTATTATGCCAA
CAAGGAGACCGGGGCGACCCAGTGGGAGGCTCCAGGCTACATTGCCCCTCCACGACCTCCCATGGAGAGCTACCCCAGC
GAGGAATCACGAGGCAGCGGCCCTTCGCCGTATCCCCCAGCAGCCCCATACGGGCCTACGCCTGGAGGCTACGGAGCTC
CTCCTCCAGGACCTCCCCCCTCCGCCTCTTACGGTGCACCCCTACCACCTGCTGGCTACGGGGCTCCGGCAGGAGAGTA
TGGCCATAGTAGCCATGGTAGTTATGGTGGCGAGGGCCGCGGTGAGGGCTACGGTGAAGAGAAGAAGAAGAAGTCATCT
GGAAAGGGTGGCTTGCTTCTCGGTGCCGCCGGTGGTGTTGCTGCCGGTCTTGTAGGTGGTGCCCTCTTGCATCACGCCC
TGGAAGATAGCAGCAGCGACGAAGAAGAGGAGAGACGCGAAGAAGAGACGTGAAGAAGAAAGACGCTACGAGTATGA
ACAGGCACCATCACAGACAATCATTGTCAACGAGTACAACACTACCAACTACAACGACTATAACGATCCCTACGAAGAG
AGTGGTGTGCCGGGTATCCTACCTTCAAGAGATGCAGAGGGTAACTATGTGTCTGAAAGCGATCGGGAGTCTGTTCAAG
```

AAGCACGTGAAGAATACGAGGAGGCTCTTGCAGAAGTTGAGGGCTCTTCAAGTGCAAGCAGCAGCGACTACGAGGAGTT
GGCAGAGGCTAGGGAAGAGTACGAGGAGGAGTACGAGGAAACTTATGACTAGAGACAGGCAGGGTTGAACTTGAAGAAA
AGACTAGCCGTCATCTCGGCAGTCTGATGACTATCTGGACGCTGTTGGCATTATGAAACACTGTCATTTTTTATAGATC
TAGGAGCTAGCTGTCTGTCGTGTGAGTATGTCCAGCACACGCTTGCACAAGACTTTTACTATGAATATATCATATCCTG
CAAGATAAAAAAAAAAA

> SEQ ID NO:4003 214471FL *Trichoderma harzianum*
CTCTCGCCTCAAAATTCATGCGCCTCAAAGAATGGAAGAAAACACAGGCGAATGACGTGAAACGAAAGATAAAAAGACA
GGCGCCTTCATGCGAGGGTTTCGCCAGTCGCCTCTAGCGTGTTTCGAAGCGCAGGGTTGAAACGCGGCTGCATGATGCC
CGGCCGCCCATCTGAGGCATGGCGGCTACCGGAACAGGACGACATCCGAAGACTTGAGGAGGCTCCGTGTTTGTTCGTT
TCGTTTCGTCTTTCGAGTGAAGGGTTGGTTCTTGTTTTCGGCTGTTGTGTGTTTTGGTTGACTTGTGTTTACGGGTTGG
GGGTGAGTTGAATTGAGTGCGAGACTAAAAAAAAAAAAAA > SEQ ID NO:4004 214707FL *Trichoderma harzianum*
TTTTTTTTTTTTGTGGATTTTTACAACGTTCTCTTCGTGAAAAGCCTATCCTTCTTTACTTCTAAGCCTCTCCTTTGCC
GGTCCTTTGAGATATCATTCTTTTATTACACAACCCTCTTTATTGAGCGAAAATGATTTCCAAGACGACTTTTGCCGTG
CTCTTTGCAGCCCTTGCTGCTGCTGGCCCCATCCAATTCCGAGAGGTGGCCTCTCTTGACCCAGCTGCTACCGCTGAGG
CCCATCCCAGAGACGACACTGCTACCCGCGCCTTTTCCAATGTCCAGATCAAGACGCAGGCCTGCTTCAACTTTGACCC
TCGACGTGCAGCCGGAAACCAGGTCCTGCTCTTCGTGCGGTGGACGGGCTGATGGCGGCGGACAAGTGACCAACTCT
CAGCTCTTTGCCTTTACCGGAGGCAATGGCCCGCTGAGCTTCGCCCCTGAGAACGATCCCACAAAGTGTTTTGCTGCCA
AGGGCAATGTCATTGACATTGCTGACTGCAATGCCAATGATGCCACCCAGAAGTTTACCTTTGGTGGTGCTGCTGCCGG
AGGTTCTGGCAATGATAGCAACAACAACAGCTCTGCCGCCGCCAGCTCGGCTGCTGCTACATCTGAGGCTGCTGCCTCT
TCCACCCCGGCCGCCGCCGTGACGACCGCTGCTGCTGTCTTCTGCGGCCCCGGCGAATGACGACAACGCCCAAT
GCTCTGCTCCCAAAATTGTTACCGTCACTGAGGTTACCACTGTCACTGCGGGATCTCCTCCTCCAGCCGATGCCAGTCA
AACTGCGGAGGCTGCTGCTACCACTTCTGCTGCTGCTGCTGCTGCCACAAGTGACGCAGTCGTTGTCAACCCAGGCGAG
GGCAGCTCCCAGACCACTGCAGCTCCTCCTCCTCCCGTCATCACCGGAAACCCAACGACCCCCGTGCCCGTCTCCGGAG
CTGGAGGCACCCTGAACCCTTCTGCCGTGGCCGAGGCCCAGGCATTTGATGCCGGCGCCGTTCGACCCCTGGAGAGTGT
CAACATCCGAGCCGCCGATGGACGCTGCTTCTTTGTCAACCCCACGGCCGGTGATTTCCGCGAGAACCTGATCCCCGTT
GGACTGGCTACCTGCAGCGAAGACGCGAGCCAGAAGTTTGACGTTGTCACCAAGGGAGTCCACGACGACGCTCAGGCCG
GCGAGGCGCTGCTTGTCAGCGTGCTCACCAACGGCTGCATCAACTTTGATGGCCGCAGAGCCGCCAACGACCAGGTCAT
CATGTTTTCTTGCGGTGGACGCGCCGATGGAAGTAAGTCATTGACATCATTTCCCCCCACCCCATCTCGGTGATCTGCT
CGATCCACCCGATCCAAGGGCATGCGAGTTATCGCGTTTGTACCGTTTTAGTTTCACAAGAGATCAAATGCTAACGATG
AACCTCAACAGGTGGCAAAACCGCGACTTCGCAGCTGTTCCCCTTCAAGGCGGGCGACAACAACATCATCCTTACTCCC
GCCTCGGCCACCAACACGACTTGCTTGGTCGCTGGCGCTGCCGACGGGTGGAGTCTGCGCAGTGCAGTGGCCAGAAGGATC
AGACCTTTGAACTGGTGGAGATTCTGTAAGAAAAACATGTGAGAGTGAGAGTGGGAGTGAGAATGAGGGTGAGAGTGAG
AGTGGCTCGTTTCACGCGGACGCGTGGGCGGACGCGTGGGTCGAGTTAATTAATGACAAGAAC > SEQ ID NO:4005 214279FL *Trichoderma harzianum*
CTCCTGCACAAATTCATAGCCGTACGCCTTCAGGCGCGAAGCATGGCGTCTACAAGCAGGACTTACAATGATGCGATTG
ACAAGCTCAATGAGCTGCAGACGCCGTTCGCGGTGATTGAGGCCCGTCGCAAGGCCGGGATTCTGCCTGATTCTGTGCT
TGGCATCGCCAAGATGAGGGCGTATCTCACAAGAATCGGATACACACCCGCGGATCTTGATCGCCTCAACATTGTTCAT
GTCGCGGGCACAAAAGGAAAAGGCAGCACCTGCGCCTTTGTCGATTCCATCTTCTCTCAGTACCAACAGCACCATGGTG
GCCCTCGTAAGACGGGACTCTTCACATCACCTCACCTCATGGCCGTGCGTGAACGCATCCGTATCGATTCCAAGCCCAT
ATCCGAGGAGCTGTTCGCAAAGTACTTTTTCGAGGTATGGGACCGACTCGGAGGAATCGCGAGAGGCTCCCGAAGAGGAC
ACGCCTTTTGGATCAAAGCCCGTGTATGCTCGCTATCTTACGCTCGTGAGCTGGCACGCATTCTTGCAGGAGGGCGTCG
AGGTGGCAGTGTACGAAACCGGAATAGGCGGCGAGTACGACTCAACAAACCTGGTGTCAAGCCCGGTAGCATCGGGCAT
CAGCACCCTTGGAATCGACCACGTCGCTATCCTAGGAGACACGGTTGAGAAGATTGCCTGGCACAAAGCCGGTATCATG
AAGACGGGCAGCCCGGCCGTTCACGATTGAGCAGCTCCCCGGAGCGGCAGAAGTCTTGATGAACCGAGCAAAAGAAAGA
AAGTCAACCTAAAAGCTTTGAAAATCGATCCTCGCCTGGATGGCGTTAAAATCAGGCCAAACGCAGTGTTTCAAAAGAA
GAATGCAACGTTGGCAATTGCACTGGCAGAGACTGTCCTGACAAAGCTGGGTCTCCTGAAAGAAGTTTCCGAGTCAAAG
CTCCCCCAGGAATTCATTGACGGCTTAGAGAAGTGTGTCTTCAGGGGCCGATGCGAAGTCAAGGAGGAGAAGAACGTGA
CCTGGCACCTCGACGGCGCCCACACAGCAGACAGCTTGAAAATGTCATCCAAGTGGTTTGCTAGTGAAATTACTGGCCG
AACCGGCACCAGAGTCATGATCTTCAACCAACAAGGCCGCATCGAAGCAATCGACTTCCTACAGCCCATAAGCACCACC
CTAAAGGGCATCAACAAGGACCAGGACCAGGACCGCCCGGCCTTTGACCACGTCGTCTTCTGCACAAACGTCACGTACT

FIG. 1 continued

CCCAGACGGGCTACAAGCGCGACTTTGTCAACAACACCATCGACCCCGCGGAAATCGACAAGCTCACCGTCCAGAAGGC
TTTTGCGGAGAAGTGGGCGGCGATAGACCCCAAGTCAAAGGTTGTTGTTTTGCCGACTATTGAGGATGCCTTGAATTAC
GCGAGAGGTGTGGCGGCGAGGATTGCCGGAGGGAGAGGTGGTTCAGGCGTATGTTACGGGGAGTTTGCATTTGGTGGCG
GTGCGTTGGGGATTCTTGAGGAGACGGATGCGTTGTGAGGGACGTTGCAAAGATTGCACGATGGAAGAGGATCGGTAAT
GGTAATTCAACAAAAACTTGGGTATAGAGCGATAATGGGATAACGGTAATTCAACAAAACTTGGGTATAGATCAGTATT
TTTAGACTTGCGGACACCAAAAACATACATTGGAGTGCTTTTTCAAAAAAAAAAAAAA

> SEQ ID NO:4006  214421FL  *Trichoderma harzianum*
ATTGAGTCCCTAGGCCAGAACCGCGCGAGTATACATCTATCTGCAACATCTCTTACCTCCATCTTCGCAATGGCTTCTG
ATAAGATGGACCGCGGCCTCGACGAAATCATTGCAGACAAGCGCAGCAATGGATCTCGAACCCGACGCGGTGGCGACCG
CCGTCGTGACCGTCAAGACTATCCCCGTGATGGGGTGAAAAAGTCTCTCCGCAACGAACCTCGAAACTTGGATAGCGAA
TGGGTACATGATCGATACGAAGAGAACACGTATCGCAATAGAGGCCCTGCACCGCGTCGCAGGCGCGAGTCTCCCAGCG
GGGGAGATGCCCGCGGCGCACGACTCCGAGTCGAAAATATCCACTACGATCTCACCGAGGAGGATCTCGATGAACTTTT
CCGAAGAATTGGCCCCATCACAAAATTGCAACTGCGTTATGATCGGTCTGGACGGTCCGAAGGTGTAGCTTTCGTAACG
TATGAGAGCAAAGACGATGCCGCAGAGGCTGTGAGACAATCGATGGTGCCAATGCGAACGGCCAGCCAATTCGTTTGT
CCGTCATGTCAAGTGGGCCTTCTCGAAACCCGTTTGATACTGCTGTGATGCCAGGCAAGCCTTTGTCCGAACGCATTTC
TGCTCCTGGTGGCAGATCTCGATCACTCTCCCCTCGCCGATACGATGAAGAAGATGCCGCTCGCAGAGGCATTGATCGA
TATGTTCCAGGCGGAAGTCGCTCTAGAAGCCCCATGCCCCCCCGCCGTGGAGGGGGGGTGGAGGGCGCCGCCCTGGTG
CCCGACGAGAGGGTGGAAGGGATCAGGATGCCGCTCGTGGCGGCCGGGGAGGCAGAGGAAACGGAGGAAGCGGAGGAAG
CGACCGTGCTGCACGAACAAACACACCGCGACTCAAGAAGACCCAGGAGGAACTGGACGCCGAGATGGAGGACTACTTC
AACGCCAACGGCGGTGCCCCTGAGCCTGCTGCAGAAGCTGCTGCTGCACCCAGCGGAGAGGCTACTGCACCCGTTAACG
CTGATGACATTGACATGATTGAGTAACCTGGATCATTGTGTTTGGTAAAGGGGAATGTGTTTTATGAGGGTATTGGAG
TATTGGACTCGTTTTACAGAAAATGCCATCTGAAGCATGGGAGGACAGTGCATATATATAATTAAGCAGGGTGTGTTGT
CATTACGAATGTATTGCTTTTCGGGCCAAAAAAAAAAAAAAA > SEQ ID NO:4007  214539FL  *Trichoderma harzianum*
AATATACCTTGGTATCCCAAAAGTTGAAAAGATGTCGTCGCCCCTCTAGCCGCCACCAAGACCCCAGACTCCCCACAA
GATAGCAGCATAGAAGAAGCAGAATGCACCTCTGTCAGACAGTCTGCCTCCACTGCTTCTATTCATAAGTGGAGTGATG
AGAATATTGAAGATAGAGGAATGTATCGATTACTGTCTTCACCAAATAGAGACTGCCATGACGAGATCAGAATTTCGAC
ACGTCCTGCAACTCCATCTAAGGCACTAATGTGCCTTATACTTTCAATACATAAAAATAGGATTTTGGATCCAGGAGAC
TGCTATGACGACATTAAATCGATAGGTGCTTTAACTCCATCTATGGCACCTTATATTTTCCTAACAAAAGAAAACCTCG
TGTCTTCAATCCTTCGAGATCGTTTTTTGCGTCGAGGCGAGCCTGATAATTTAACCTGTACCCAAATACTGAAAATGCT
AGAGGAGCCTGCTAACAGCTCACATAAGCAAGAAGGTGGCCTCGACATCTGGAAATGCTGAAGAGCTTAGGACGCGTCG
ACACTGGGATGCCAAAAATGCGAAAAGAGATACGAATATTGACGTTCACTTATTTTCACCAGGTGAAAGTCAGCGACAT
GATGTCTCTAACATAGTTACAGTAACATTGAAGCGACAGCTTTACGAGTCAGATTTACTTCAAAGGAAGACAAGGAAAT
CATGAACCTAAAGGAAGAATGTCGTGGTCAGCCTAATGCATGGGCAAAAATATTTCCAGGCAGATCTCAAAAGTCTATC
CAGCGGCGTTATAATACAAGACTGAACGCTTTTGAAAAGCCAATTACAAAGACATTCAAAGAGACAGAGGACAACCAAT
ACCCAGCGTTTTCCAAAATTTTCGCAGTTATGCCACTGTAGCAGATATTGAACCTCGCTATCTCTGATCCGTGACCTCT
CAACTGTCAATCCTTCAACGAAACCTACATATATCTTGTCGAATTCACCTACTAGCATTGGGTAAATATCCTTCTTTGG
AATCCAATCTCTGGAAGGATACCCGGCCCATGATAAGAGGTAATGATTATGCAACTGCGCAAGTATACGCTCTACTGGG
AGAGTGAGAAATTCATGAGCCTGAATATTCTCCGCAGCATAGCCGATGTATGGATTGCTACTTGAGAGCCCTGTGTTGGA
AGAGGGATTTATTATGCAACTGGCCTGACCAAGTAAGGCTTTTTTATAATTATAGATATATATGATGTGAGTGCGACGA
AAAAAAAAA > SEQ ID NO:4008  214724FL  *Trichoderma harzianum*
TCGGATCGGCCTCTTTTCCTCTCTTCCCTCTCTGCTTTCCATCTGCCCAGCAGACCGAGTTTGGCAGCGCAATGTTGCC
TCTATCGGTGCGGCGCGCGGTGGCCGCTGCTCCTCAGGGGGCAAGTGGGCTGACTTCTCTCGCCGCGTCGGCTCCAAAG
ATCACAGCCTCGAGCTTCATCCTGAATCGTCCTCAGCGGCGCTACTCCTCGTCGAAACCCTCAAGATCCGATGAGCCCA
ACGATATTGCTGCCGGCCAGTCGGTGCCGGCATCTACCTCGCGCGGAGAGAGCAAAGGCAGCAGGAAACGAAAGAGCAA
GGATTCAGCCGACCGAAATGCGGCTTTCAAGAAACTGCCCAGTGTCCCTAGCACTCACCACATGTCTCAAGAGGCCCTG
AGCTTATCGAGCTTCTTCTCACTCCACCGTCCCATTTCCATCACCCAGACCATGCCCAGGACTGTTACCGACGAGCACT
TTGCATCCATATTTGCGCCTCGATCAAAATCGAACAGGATACGAGACACTGTCTCTACAATTTCTGACACCATTGAGCA
GCTGGAAGGCCCCATGGCTCAGGTGACAATAGGATCTCAGGACCAAGGGGCTGGCGATGGTATGCACAGAGTTGATGTC
AAGAACCCTGACGGAACCGAGTCGAGCATCTATCTCCAGGTTGACACCATGTCTGGAGACTTCTTGCCTTTCCGCCCCC

```
CTCCGCTGCCCGAGGCGCAGCAAGGCATTGAGGCTGAAGGAGTTGCGGCTGAGGCTGAAGCTCTGGAAGAGGCAGCTCA
CCACCGAGTTTACAAGGCCATGTTCACCATTGAGGAGTCCACAGAGTCAGACGGCCAAATCAGGATCATCGCCCACAGC
CCTCGAATTATCCAGGACGAGCAGCCCCGGAGCTTCTTGGAGCGTCTGGCAGTCCGCCAACTGCGGGTTGACCAGGCTC
GCGGTCAGCGTGACCTCTATGCCATCAGCGTTAAGCGACAACGGAAACTTAAGATGAAGAAGAAGAAGTATAAGAAGCT
GATGAAGCGAACAAGAAACTTGCGTCGCAAGCTGGATCGAACCTAAGGGGGCTAGGCTTGGGCTGTGTAGAAATTCGCA
TTTATTTCATTTTTCCTCTATTGCGTTGGGATTCGACCGGTTCATGGGTTGGTGTCTGTCTGGCGGTTGACAGCTTTTT
GTCAGCCATGAGTTACGCAACGCGCTCCTGAGACTTTTTCTCTTCCATAGACTCGTGAAGATGACTTGTTGTCATGTGT
TGTGGTGCATGGCTGGGGCATGGCATTTTCCCGTTACATCGATTTTGTAAAATTAGTATGAATAAGACGAACATGTATC
AACACAAAAAAAAAAAAAAA

> SEQ ID NO:4009 215480FL Trichoderma harzianum
CCCACGCGTCCGCCCACGCGTCCGCCCACGCGTCCGCCCACGCGTCCGCGAGCACTTGGACCGCCATGGCCGCATATAT
AAAGTCCATGACGGGGGTTGAGCTGCCCATGCTGGACAAGCTGGTCTCAACCCTCAATTCATTCAACATCTGGCGTTCG
CCCGCAATGGCTCTGCCCCAGGTCAAATCCCTGCAGGACTGCGTCGACTACTCAAAGGTCGTTGAGCCTTTCTTGCCCC
AGCTCTACCAGCTTCCCCACCACATCTGGGAGAGCATCGACAGTCTCGATGCCCTGAGAGAGCTCTATGTCACGACGAA
TCCCCTGATTTCAGGCTTTGCGGCCTCTCTGGTTGTTGGGCTTCTCGCCTTGATCGTGTCCGAGATCAATCGCAACTAT
TCTCAGATCGACCGCCTGTGGAGTATCCTGCCCAATCTATACGTTGTCCACATTGCGCTCTGGGCACGTGTAGCTGGTT
TGCCGCATGGTCGAGTAGATTTGATTGCTGTCTGTACAACATTATGGAGTATTAGATTGACGTACAACTACTGGAGACG
TGGCGGCTACAACATTGGCTCAGAAGACTACAGATGGATGATTGTCAAAGCGCAACTCAACTCAGTTGTCTGGTTCATC
TTCAACGTCACCTTCATTTCGTTTATCCAGAGCATCCTCCTGTACCTCTTCTCGTGTGTGCCGGCATACGTCATCTTGC
TATCATCTCAGTTTGAGCCTGAAGTTCAGGCAGTTGATCTGGTCTTTGCCGGCGTTGAGATTCTTCTTGTCCTGAGCGA
ATGGATTAGCGATGGCCAGCAATGGGCTTTTCAAACCGCCAAATACAATACAAAGGACACTGGGAAACTCACCAGTGGA
TATACATCGGCTGAGCTGGATAGGGGCTTCATCACAACGGGCCTCTGGGCTTATAGCCGACACCCCAACTTCTTTGCTG
AACAAACCATTTGGTTCATGCTCTACCAATGGAGCTGCTTCGCCACCAACACGCCATACAGCTGGGCTGGTATCGGCGC
CGTCCTCTTGGTGTTGCTCTTTCAGGGCTCCACTAACCTTACAGAGAACATCACGTCTGGTAAATATCCAGAGTACAAA
GCCTATCAGAACCACGTTGGCATGTTCATCCCCAAGACACTGATTCCGTATGCGACCCCTGGGCCGAAAGTCATCAGGT
CGAGCGAGCTGGTTAAGCGTGCTGAGCAGAAGCAGAAGCACAAGAAGAAGCAAGGCTGAAAAGAAGAACTCTATAAATA
CCTGCACAACTTTCAATGCTAATGAGCTGCTTCAATGGTGTAATTATAGAACTTTTACGAAAACAATAGTCGCTATATA
CGGATAAACCAAGAGGGGGGATTTAGGATATAGGGAAAATGTTGGAAATGCTTTTTTGGTTAAAAAAAAAAAAAAA > SEQ ID NO:4010 214135FL Trichoderma harzianum
GGAGCAGCTGTCCTTGACTCCAGCTAGGCATGGAGAGATTTTTGGGCGGTTTGCGGTGCCTTTTGCGGTAAGGCTGAGC
AGTGTTTGAGGTCGGGGAGAATGGATGGAACGAAATCGAGTTTGGCTGCGTGGGGGCCGCAGATCGCATGTCAGATCGC
CGGTCGGTCTGCTAAGCGATGCTTAAAGTCGGAATTGCCCGATCGAATCTCCATTCCGATGGCGGAGATAGAAGGCTGT
ATGATGGAGAGCCAGTCTGACGAGAACATGGGAAAAGATGGAAGATGGGGATGGAAAGGAAATGGAGATGGAGATGGCG
ATGGAGATGATAGAGATGGAAAATGGAAGATGAATATCTATTACTCTGGGCTCGAAGAGAGTCAGTAGAGTCAGAACGG
TGGGGGAGAGATACCTTAGGCTTTGATGTGCTGAACGCGCGAAACATCGCGAGACCGAAAAAAAAAAAA > SEQ ID NO:4011 214295FL Trichoderma harzianum
AGCCAGAATGCCGCTGCAAAGGCCAGGGCGGACAGCAGCATGAGCCGCAGCCGCCGGCGCAACAGACTATGGGGGAGCA
ACATATGGCTTATGGTCACAAATCAAATGACCTGCGACGCGCGGGCATACGTCTAGGTTCGTAAAGACGCTGTAACTCC
GAGCACAGCAAACTGGCGATAGTACGGTCCAGGCTCACAAGCACGTGGGCTCAATCGAGTTAGTCCCTTCGCGGGGGGG
AATCCCGACAACTTGCAGCAGAGCAAGCAAGCACGAGATACGAGACAATTTAGACGACTGTCTGTTTTTGACAGGATGA
CACGCACAAACAGTAGCTCTGTTCTGTTCTGGAACAAACCGGCGAGGCTCAGAGGGTGCTTTGACCAAGGCAAGGCAGA
GCACAAGCCACGAGCCAGAGCCCAGAGAGAACAAGGCCAAAATCCAACACGTCGCAGATTCTTACAAGCACCGCCAGAC
ACAAGTAAAATCAGGGGCCAGACTGTGGTTCTCGGCCCTTGTCCGAGCTGGCAGGGGGGCATTCATTCGGCTACTGGC
ACAGGTAAGCCCTGGATCGGTGGCCCGAAGCTGCGGCTGTCGTAGCAACTACAGTAGTTTGGGCGCCAACAGTGGCGCA
GCCGAGCCCGGGCGCTGGAGAAGGAGAAGGCGAAGGACGGGCGGTACTTTGTACGTAAAGATGATGCGGGAATGGCATT
TGGATGGAGTCGTTAGTAGCTGGAAGAGGCGAGGAGGAGGATGAAGAGGGAAAAAGGAAAAAGGAAAAAGGGAAAAGGA
GGAGAGACAAAAACGAGGCACAAACTCGGGTACCTGGGTACCGTACACAGCGCCTGGTACCTTCCGCTGGAAAACTCAG
TCTGCCGCACCCTTCCCTTCGGCCTGGGGCGTCCGCGGGAAGGAGCCTGGATGGCACCTGCGCGATGCCATTTGCTGCG
CGCGGGCTCGCCTAGTCCCGACCAGGCATCGATACGGCAGCTACTAGCTCCTTCCCCCGGCGCAGGCCCAGGCAAGTGC
TAATGTAGTGCTAAGGTAGCACCTCGTGTCAAGTATCCCACAAGGCACTTTCATGCCGAGTCCCGGCAGAGTCTCGACT
TGCGAGTGACTTGTGTGCGAAAAAAAAAAAAAAAA
```

FIG. 1 continued

> SEQ ID NO:4012 216040FL Trichoderma harzianum
GGAATGACCCCTACCAGGATGTCGAATTACACAACTTGAACGAGGGGACGAGCCAAGGGGCACAGCACGGGAATTGATT
CGAGAGTTTTTAAATGATACCCATCTCCCAGCGAGGAGATTGCACTTAGAAAACGTGGCGGAGGCCCTCGAAGGAGAAA
ATGGTCTTTGTTTTGTTCTTCATCTTCTGCCTTGTCGAAGGGTCATGTATATGTCAGGAATAGCTGTGCACTAATATTT
AAACATAAGTTCCGTCTAAAAAAAAAAAAAAAAAAAAAA > SEQ ID NO:4013 214138FL Trichoderma harzianum
GTGAGACTGTTATTGAAAAGACTCTTTGCCTTGGTTGGCAGATTGGTTGTATTAGGCATACTGTTTCGATACGCTTCAA
CGTACTTTTTGAGTCGCAAAGCTACCATGACTGTGGCTCCTGTGATTGCGCTCTCACATGGTGGAGGTCCCCTCCCTAT
CCTTGGTGATCCCTCTCACAAGGACATTGTTTACTCTCTCAAGAACAGAGTGCCCAAGATTCTCAAGCTCGGCACTCCT
GAGCAGCCCCGTGCCATTGTCCTTGTTACGGCGCACTGGTCGACGAAGAACCCGACCATTTCATCTGCGGCTTCTCACG
ACCTCTACTATGACTACTACAACTTTCCCAAGGCGGCCTACTCGCTCAAGTACCCAGCGTCAGGCCAGCCAGAGGTTGC
GCGCGAAGTCAAGGCGGCGCTGGAAGAGCAGGGCCTCGCATCAGTTCTCGACGGCGAGAGAGGATGGGATCACGGCGTC
TTCATTCCCATGCTGCTTGTGAACCCTGACGCCAGCGTGCCCATCGTACAGGTTTCCGTTCTGGAGTCGGAGGATCCAG
AGAAGCACCTACGTATGGGAGCCGCACTGTCGAAGCTTCGCCAGAATAACATCGCCGTTGTCGGATCGGGCTTTGCTTC
CCTGCACAACTTCCAGGCTTACTCTGAGCTGCGATCTGGGTCGCCTGCTAAGGTGAATGAGTGGAAGAATAAGATTAAC
CAGTGGAACGGCGCGCTGACGCAGGCGGTTGGTGCGGAGAGCAAGGAGGAGAGGTGGCGGAGAGTGTCGGGATGGCGAC
AGCTGCCTCATGCGAATGACATGCACCCGCCGATGAGGGGAGAGCACTTCATGCCGTTGATTGTGTGTGCTGGGGCGGC
GCTGGAGGGGGAGAAGGCGGGTGTTTATGAGGATACTTATATGGGGAGCGGGATTAATACGTATTACTGGGGGCGGAG
ACGGTGGCTTAGATTTGAAGAATTGATACATATTTCAGGGAATAGCGATTACACAGATTGAATGAAGGCATTCTATTTT
TATAGAAAAAAAAAAAAAAAA > SEQ ID NO:4014 214478FL Trichoderma harzianum
CTCAATGCCGCCTCCATGAACGACTCGAGCTTCGTCCAAGCCCAACAGCGCGTCGCTGAGCGACGAGCGGCCCGCGAGG
TCGAACAACGGGCCCGAATCGCGGCTCAGCGCGAATCGTCTCGCGTGAACAACCAGCTGCAGCGTCTGCCATACCCCCT
CAATCGCCTCGCCGGTGTCTGGGATGCAGCCGCCTCTATAGAAAACACCCGGCCTGCGTTTCGCGTTGCGCAGGTTGAT
GCCGAGCTGCTGGATGAAGAGCTGCTGGAGCTCCTCAAGGGGCAGGTTGGCGACGCCCTCAGATACTATGCCGGCGGGC
ATCTCAAAGACGACTGGTCTTCCGAGATTCAGCTGGCGCTCAGGGCCATCCTGTTCAAACTGACCGTCTGGGATAACGA
TGCAACGTACGGAGCGGCTCTACAAAACCTCAAATACACCGACGCCAGAAAGGGGGCCCCGTGCTGTCACCCCGACG
AGGCTACAAAAGTCACTATACGGCCTGGTAACGGTCTTTGGAAAATATGCCTGGACCAGATGGGAGGACTGGCTTGTGG
ATCAGGACGATGGATACAGCGACCCGAGCCCTCGAGTCCAGAGGCTATCTCGATTAACAACTGCATTGACAACGGCGCA
CTCGGCTGCGGCATGCGTCTCCTTCCTGGTGTTTCTATTCCGCGGACAGTATCGCACCCTTCTCGACCGTGTTCTACGC
ATGCGGCTGGCACCCCCTACAAGCCATGTCAGCCGCGAGGTTTCCTTTGAATACCTCAACCGACAGCTGGTGTGGCATG
CATTTACCGAATTCCTCTTGTTCGTATTGCCCCTGATTGGGGTCAACCGCTGGCGACGATGGCTGAGCCGCACCTGGCG
AAAAACCACAGACATCATGAACACAACTCAAAAGGGAGATTCTTCAAACGGCGAGCTCGGCTTCTTGCCCGAGAGGACC
TGTGCCATCTGCTATCAGGATCAGAACGCCGCCGCATCATCTGAGTCGGAAATCATGGCAGCGGCAGCATCTAGCGGCG
TCATCGGATCAGCGCAAACCGATGTTACCAACCCCTACGAGGCCATTCCATGCGGGTGCATCTACTGTTTTGTGTGTAT
CGCAACACGCTTAGACCGTGAAGAGGGTGAGGGCTGGACTTGTCTAAGGCGTGTGGAGAGCACGTCAAAGAGTGCAAGCCG
TGGAATGGAGATGTGCTCGAGCCGTCCCGTAAGTCAACATCGACAAAGACAGTGGCATTTTCAGACGATGTGATTGGGG
GCTCTGACGACGGATCTGTCATTTCTATGGAATAAGCCGCGTTGGGGCTGAGGCGCTGAGGTGAGATGCTGAGAGTCAT
GAAAGCATAGAGCTTCTATATCATGCCACGTCTTTCTTGGATAGAGGGAAGACTTGGTCTGCGACTATTTATTCAAAAG
GGTGTGCATCTGTTTTTGGGATTATTTTGTATAGTATAACATGATGTGTTGGGTTGATGGGACATACATTTTTGAAGTT
GGAAAGTTTGGTAACTGGGCGTGGCGCCTTAGAGAATTTGGACACATTTACAGCGTTATTATTGAAAAAAAAAAA > SEQ ID NO:4015 214548FL Trichoderma harzianum
CCCACGCGTCCGACCGAACCGCCAGCGAATCGACGAGGGCATCTGTGTCGGTACCGGATGCTGCCTTTGCGGATGGAGC
GTCTTCATCGAGACGGCAGGTAGAAGGAAAGACATGGCCTTGTTTGTGGCGCCGCGGGCACTGGCAACGTTGGTCCCTC
GGCGGTATCCCCTGGAGAAGCAGTGGCGAGAGAAGTTGATATTCGCAGCGAGCACGGCAGTCGTGTTTACTTGCGCCCT
TGAGAATCCAAAGAGAGTTAGAGGCGTACTAGGGGGATTTTGGGCATGGTGTTGAAGAAATAAACCGGGCATATGGGC
AAATATGATCTCTTTTAGGGAGTTCTGAGACGTGACATGACTAATTTCTTCTTCTTCTTTGGATGTCTTTGGAATAAGC
TACGGTTTTTAGATGATATACACAAACAACCCTGATGCTATAATTGGTAATAAATCAAAAAAAAAAAAAAAAA

FIG. 1 continued

> SEQ ID NO:4016 214847FL *Trichoderma harzianum*
GGAAGGGTTTCAGGGGCTCGGCGCACATGTCCACGACTGGCTAGTAGGCAATGCGTCCTGATCGCTTCTTCAATTTAGC
ATTCGGCTGAGCCCTCGCACCGTGATGAAAACAAACCAGCAGGCGGGTCGGAGCCGCTTTGTTGACTGACCAGGGAAGC
GGCCAAGATGTTCTATACCTAGAAATGCGCGGCCCTGAGGTACAAGTAGCGTTCGCGCCAATGCTAGCAGCCATTCCTG
GATGGGCGGAGGCGAAAACAAAGACCAGAGGAGTTGGCTACTGCACCCATTTCAGGACTAGGTGACATTAACGCGAAGC
ACAAGGGTTGCTCGTATGGGCAAGTTAGGTATGTACGAGTACAATATCACCAACAAAAGTTGTACTTGTATGAGCACAC
AAAAAAAAAAAAAAAAAAA > SEQ ID NO:4017 215729FL *Trichoderma harzianum*
GCGCGCCAAAAGACTGTACACAGACGTCTTTTGATATATTTTCAAAATGGGTGGCGGTGGAAAAATCCCTTACCCCAAG
CACGTCTGGTCGCCTTCTGGTGGTTGGTACGCCCAGCCTGCCAACTGGCGCGCCAACACGCTCATCGCCGGAGCCGCCA
TGTTCGGCGTCATCGCTATTACGTGGAAGTTCAGCGCCGACAGGGAACGATGGGCGCATAAGCCGGAGCCGTGGGAGTG
GCATCCTAGCCGATACTGGTCAAAGCAGTTGATCGAGTGGGACAAGGAGGACAAGCTGAAGGCAGCAAGCAACAGCAAG
GAGTAGAGTTTTCTTTTTGGGAGAAGGATAATAGACGAAATTGTACAAAAAAAAAAAAAAAAAAAA > SEQ ID NO:4018 214201FL *Trichoderma harzianum*
GACCCTTGCTTGAGTACAATAATTTGACAATGGGTAAACCATTCCCGCAAGTTCAGCCTGGAGGGAGCCTGATTCTGGC
TTACCGCGTCAAGGACAAGAATGTCCTGGTGGTAGGCGGTGGTGAGGTCGCGGCTGGCCGCATCCTCAACTGCCTCAAT
GCCGATGCCCAAGTCACCGTCGTCTGCCCTGCGTCAGGCCTCAACGAAGAGGTCGCATTCCGAATTGCCGAGAAGCAGG
TGACACACATCGACCGCCTGTTCGAGCCGTCCGATTTAGACAAAGCAGACATGGTGCTGGTCGCCATTGACGATCCGGC
AGCCTCGACAGCGATATGGAAACTGTGCAAGGAAAAGAGAATCCCGGCCAACATTGCGGACGTGCCCCCTGAGTGCGAC
TTTTACTTTGGCAGCGTCCATCGTGACGGGCCTCTACAGGTCATGGTCAGCACCAACGGCAAGGGACCGCGGCTGGCGG
CATCACTACGGCGGCATATTGCCAGCCAACTACCGCAGAATGTTGGGAATGCTATTGAGACAATTGGAGAGTTGCGGAC
ACGGCTGCGCAAGGTTGCCCCCAATCATGAAGACAGTCAGAAGCGAATGCGATGGATGTCAAAAGTCAGTGATACCTAC
AAGTGGGAAGAGATGAGCGAAATCACGGAAGAGGATATGGACAACCTTTTGCTGTTCTACCCGGTGAACAAGGTTCCGG
ATATCGACATCTTGAAATCGCTGCGCGGCCCGGATAACGACGTGAAGAAGCTCGACATCTTTGACGGGTCCTTTGGCTT
CAGCGTGGGGTCATGATGATGATAAAAAAAATGAAAGTGCCGGCGATATGGGGTTGTTTTGTTTTTGTTTGGGCAGTTA
AAATGGGAATCTCCTAATGATGTGTTTTTGGTGTTGATGTACTATAAGGAGCAAGCACAGAGCTTTTTTGACTACCAGG
TATAGAATGACGTATTTCTTTTCTCACAAAAAAAAAAAAAAAA > SEQ ID NO:4019 214404FL *Trichoderma harzianum*
GAATAAGCAATCACGAGTAACATCCTGTTTCACAGCAAAAAATTGAGAAAATTCAAGATGCCACCTGAAAGATTGATCG
AGACCAAAGCTCAGAAAGCCTGCCGCCACTGCCGTCTCCATAAGCGGAGATGTGACAAGCGTTTACCGAAATGCTCGCG
ATGCTCCTTAAAACTCCTCAGATGCGAATATGATGACGACGCGCCGATTGAGGAGACAGGACCAGATACCAAGCTGCTG
TGGAGCGAGCACCTGGCCATCAAGCGAGACTCTTGCGGCCTCGAATTGACTCCAGCAGGCGAGAAGCAGCTCCTATGGA
TCGCTTGCCAGACTCAAGAGCAGCATTCCGATCAAGCTGACACCAAGTCATTAATGAGTCTGGTCAGCGACATCTTCAA
GTATGGCGACACCTCCGCGGAGCAAGTCTCGAATAGGTACTTGCCACAGCCCATCACTGGATACCCATTGTAGACGAA
CCAAGGTTCAAGTTCACTCTTGGAGTCAATCGAAGCTATACGGAACTCTACCACGATTCCTTCGCATTACTACTGTTGT
GCATGCTCCTGATGAATCAACAACCCTGTCACCACCCCTAATCACACCCCCAACAGCGCGCTCTATCGGACCACAAGGC
GGCTATTCTCTCTCCTCAACACGGCTACCATTGACACATATTCCCTCGCAAGGCTGCAAGCAGGTCTGCTACTGTCTGC
ATACGAGTGTGGGCACGGGATGACCAGAGAGGCTAGCTCAACATTGGCATCGTGTTTTGGCCTCATCAGGCAGCTGGAC
ATGATCGCCGTGCAGAATAAAGCCGAGAATGGGCATGGGTACAAAGACACCCAAGAGCCCGATAGAAGGCTGTGCTGGG
CCAGCATCGTCTTTTTAGATCGCTCCATCGTCCTTTCATGTGCAGACAACACTGCTGCGCTTCTTATTCCGAGCAGTGC
AATCTTGCCTCAGGATGCTGTTCCCTACATGAATAAAGACAAGTACGCTCTTATGAACACGGCGACCAAGTTCCAAACA
AGAGCCTACTCAGCCCTCTTAATCGGCGAGGCTATAAAGGCCGTCCACGGTGATCCAGAGTCTTCGGAGTGCATAGAAG
CAGAGAAGCTACTCCACGATCTCGTCCGGCAGCATGCGGCAACCTCCCAAGGGGAGTCATACCCCGTTTGCGAAGGCGT
AACCATGGCTCTTAGCGCCGTCGTATCAGCCTACAGGAATAGGGCAAAGCGCCTTGGATGGTCTACTGCCCCCGATGCA
AAGCTCAACCTCGACCTCCAATTTGCCTATAACATAGTGTTCGAAATGTGCCGAGTTGAAGGCCTCATTATGTGGAAGA
GGTATACATCCCTCAACAGAATGTGTTTTTCTGGGCTGGGTTGTCTCTACCGCGCAGCAGTAGACCTAGTCGAGGTCTA
CCCCACGACGGCCTTGCCCGAAGACGTCAAACAGCTACGGGAAAATCTAGAGTGGTTCTCGGGCCATTGGAAGGTAGCA
GATGTTTTGCTACAGCGGCTGAATCGGAACGTCAAGATCAGGTCCTTAGAGGTCGCTCTAGTTTTTCATAGGTAACGCT
GGTGTCCATGGATGCAATACTACAAAAAAAAAAAAAAA

FIG. 1 continued

> SEQ ID NO:4020 215744FL Trichoderma harzianum
ACATCACAACACTTACAACTATCAACATCTACCATATTCAAGATGCCTTCTTTCATTGTCACCCTCAAGGACGATGTGT
CAGATGAACAGGTTGCCGCAGCCAAGCAGAATGCCAAGGATGCCGGCGGCACGATCACACACGAGTACACCCTGATCAA
GGGCTTTGCCGTTGAGTACCCTGAGGGCATAGTTCACTCGCTCGCTGAGGACCCCTCAGTGCAGGCCGTCGAGGAGGAT
AAGGATATGAGGACGCAGTAAATGGAGCTCTCTATTCTGTTCTTGTTGCATCTACATCTACATACATCTACATTAGAAA
GACGTAATATAGAGATTGTATCAACAAAAAAAAAAAAAAA > SEQ ID NO:4021 216074FL Trichoderma harzianum
CCTACACCAGACGAAGAAAGCATCCAATCGTTCACCATGAAGCCCCAAACTTTCGTTGTCGCTGCCCTCGGCCTCCTGT
CCGGAGAAGCCATGGCCCAGAGCGTGCCGCCTCTGATCTCGTCTGTGTCTGCCGCCGTCTCCTCTGCCATTGCCTCTGG
CAGTGCCATTGCTTCCAGCATTCGCTCCGAGGCCTCGTCCGTCGCCAGCAGCATCCGCTCAGAAGCTTCTTCCATCGCC
TCCAGCGAGACCAATACCGCAACCACTGGCACTGAGACCACCAGCAGTGAGACCACCTTGACAACTACCATCGCCACCA
CCACCACCCAAACCACTGTCGAGTCTGCCACCACAGAGCCTGCCACTACTATCCCCGGAACCACCAACAGCGAGACTAC
CAGGGCTGCCACCACCATTCCTGCTACTACCCGCTCTGCCACCACTCGCGTCACCACCAGAACCTCTGCTACCACTTCT
ACCTCTACCGGTCTGGCCATTGCTCCCACTGCTGATGCCAAGCTGCTGGCTCCCATCCTCGGTGCTGCCGCCGCCGTCT
TGATGCTGTAAACACCTGTCTCTTGGAACTACTACTATCTATTTCATATGTTGGGCGGAGGACTTGATATGGAGCGGAC
GTCAAGGGAGGAATGAGTCGACAATTACTACGAGAGAAAGGAAGAATTACGCATACACGGGACCTACTAATTAATGTG
CTTGTCTACTCGACACACGACGGCGTTAGTTACTTCTTTTTAAATTGATCTCTCAGTCTCATTACCGTATGCTTCTTCT
CTTTTCCTTTCTCTGTTTCTTTTGCGGTATGGTTCGGTGATTCATGGTCATAATGGATGAAGTGAGGTGCTCAAAAGA
ATTAATAGTTCTTCTTGATTCTTGCTTGCTTTGAATGTTATAGCATATCCATTCTTGTTTGGATTAATCATTGAGTGAC
CTATTTAGAAAAAAAAAAAAAAAA > SEQ ID NO:4022 214146FL Trichoderma harzianum
CCCACGCGTCCGCCCACGCGTCCGCATTGACTTTGAAGCTCTGTAATTTTGTTGGAAATTTCGGGGCGTTTGAGGCTGC
CTTTACCATGGCCGCTCCATTGGCCACCGCCAAGCAGCAGCTTAGGCGTCTCCTTAAGCAGAGGCTCTCCAAAGTCTCT
CAGGATTCCGTTCTCGCCCAAAGCAGCACAATATTCGAAACGCTCAAAACCTTCAAGCCCTACCAAGACGCCAACCGCA
TCAGCGTATACCTCTTCCATGCCCGTCGGAGAGATTCAGACGGACGCAATTGTTCGCCATGCTCTAAACTCGGGAAAGC
AAGTCTTTGTCCCGTATCTACACAAGTCACCCCTAGACGAACCTGGAACTCCAGCTCGCGTAATGGACATGGTTCAACT
GCAGGATGTCCAGGACTACGACGGCCTTCAGAGAGATTCTTGGGGGATTCCTAGCATAGATCCAGCTACCGTTCATCTG
CGGCAGCGCATCCTCGGAGGACCAGATGTGCACAAATCAGATCAGTCCACCTTGGATCTGATCCTTATGCCTGGTGTGG
CTTTTGATACCGATAGCGCGGGAAGTGTGAGACGACTCGGTCACGGCAAAGGCTTCTACGACTTCTTTCTCAACAGGTA
CTTGGCTGCGAAACCTCATGATGAAGCTGGTAATGACGGCCCTGTACTACGCTTCTACGGATTGGCTCTCACGGAGCAG
CTTCTCGACCCAGAGACGGATGATCCGGTGCCCATGGGCCAGTATGACCGGAAGCTGCATGGCTTGATACTGGGCAATG
GCGAGATTAAACTTTCACCTGATATTCAGACAATAAGCGCATCTTGATACCATATCTTGTCATTACGATTCTTGTTCAA
TTTGCAAAAAAAAAAAAAAAA > SEQ ID NO:4023 214242FL Trichoderma harzianum
ACCGCATCTTCAATCTCGTTTGCCGTCTTTGTCTTTGCGCTGACAGAAGCCCTGCCGAACCCGAAGAGCCACCGCCATC
CGTGGAACGAGATTAAAAACCGCGTAAAGATCCGGCCAACAGCGGGAGCAAAAAAGGAACCTGGAAAGGATAAGGGAAC
AAGAGAAAGAGAAGAAGAAAAAAGGGTGCGCTCTGTTACAAAAGCAAAGATGCCGGATCTCAACTCGGTGCCCCCTCG
CCTCACGTCCTGGCCAGCGGAACACCTTCTCGTCGTCAGTCGGCCAACTTGCAGTCCGCATCATCGCCGCCCTCTGCGT
CTGCCTCTGTCAACATCCTGCCTTCCCCCCGCCTCAGTCGCCCATGGGCCTCAGCCGCCGATGCCGCCGTTGGGCCAGGCCCG
GGACCTCTGCGGCACCCGAGGCCTCTGACAGCCTCTGAGCTTCACATACAGCTGGAAAAGGAGCAGGAGGCAGTGGTAA
ATCGTCTGACTCGCGAGCTCTCGATGCTTCGGGTCGCCCACAATGCGTCGGTCGTTTCAAACGCCTCGTCGACGTCGAA
TGCTACTTCTTCCCACGACCCCATTGTCGAGTCGTCGCTCTTGTCCGGCTCCGGATTTTCGATTCCTACCTCTCGCCGC
CACCATAGAACCTCGTCTTCTACATCCCAGACTTTCCCCAATTTTGCCTCGTCGTACGAAGCCCGAGCTCGAACATCCC
ATCCCGCATCGCTTTCACGGCAGAATAGCAGTGCTTCTCGCAGAAGCCAGACTGGATCGCCCGCGCCACCAAGTTCCAT
AGATCCATCGACCTATTTTCATCAGCAGAGGAACCCTGCCGCTGCTAGCTCCGTCATGATGAGCTCCGTGGTGGCTACT
CCCGGTAGCTCCGTTCTGGGTGACCAGATGAGCCCCGGCCTAATGCCCGCGACTTTGCGCTACGAAGAGACAGCTTTTT
ATCGACAGGAGCTAGATAACGCAAAAAAAGAGAACGAGGCCCTCAAGAGGCGTATCCGGGAACTGGAGAGGCTTGTCCG
AGAGAGGCGATCGAGTGATGCGAGCAGGAACAGGAGCGACAGCGCGAGCACAACGGCAAGTGCAAGCGTTGCGCCGGGC
GGCGGCGTTAGTATCGCGGGCCCTCGAGAGAGCATCTATGGTCATGGCCGAGACCGCGAGCGAGCTAGGCAAAGCACCA
CAAGCTTGGCTGGCGGAGTGAGCATTGGGGTTCCTGACGAGGAGGTCAAGGTGGGCGAGAGTGCGGCAAGCGGACGACC
AGGGAACGACAACCAGGGGTAATCATCGACTATAAATGACTAGATTATATTGGCAAGACGGACGGGTATACTAGGTATG

FIG. 1 continued

GAAGATTCGGGCTCCGTTGGTACTAAGTGGAAGATACTATTGGCGTTCTGGTGTTTATTAGCGAGACTCTTGCGTTGAT
TCTCAAAATTGGTTGAGCTTTTCCTTTGTTTTTCTCCTTTTCTCTTTTCCGCTCTACTCATTGTCTTGGGTTTTTGGTA
CTGGATGCGGCAAAAAGACCGATGGCCCTTAGCAAATAGCTTCTTTTGGCCCTTTGCCCTTTCATTTGCAGCACAGACA
AGCTAAAATAGTTTGATGCCGAGTTACATCTCGGCTTCACCATTAAGAAATAATGAATTATGAACCAACAATTATAGTA
TTACCTAGTTCTCACTATAAAAAAAAAAAAAAA

> SEQ ID NO:4024 214326FL Trichoderma harzianum
GGGCGATACGTCGAGATGATTCGTCCGCAGCTTCAGTCCGTGAGATGCTGGTGCTATCAGATGCTAGCAGATGTTATCC
CAAGTTACCCGATGCTACAGACCATCCACGCTGCAGATCAACGGCCGCTTCGTGATGCAAGTCTCACGCAAACTTTACC
CTCTTTCAGTTCTTACGAGATGCAAGGGATTGATCCACTGGAGTCAGAGAATCTGAACCGCGACCGCGACCGCGACGGC
TACGCGCAAAGTTTGGGCCAGTGACTGACGCGGCCGTTGTTTGTCATCAAGAGTCACAGAGTTCAATGGCCCTCAGGAC
AGCGGCATTTGCTGAATACGAAGCGCTGTGCTCATGGCATGGGGCAATGTTCCTGCAGTAGCGCGTGATATGCAAAACC
TCTGTGCGTGCAGCTTGCATGATGCTAGGATGCAAGAGCCACTGCGGTTCACTGGGCTGAGCCCCCAGACTCCTGACAT
GGCTTACAATACAATATGGATGCTGTGCTCGTAAGCAAAAGGCTTCTCCAGTAGGTACCTTGCTGCCCGTTTGGAAAAG
CGCCGAGAGCCCATGAGATATCGCAACACCGGGCGATTAGTCGTTTTCTCGCACAGAACAACAACACATGCGGGATTAC
CACGACATACATGTGTGGGAGTTATTATTTAGCCAACAATAGTGGAGCATATACTTGACAGGCACACCAACTCTTGATG
TTTGTTTTTCTCAGCTTCAGTCGCGGTATGATCACCAAGAGAGCTTGTGAATGCTCAAACCACTACCGCAGATTACCGA
TTTGATTCAAACCCTCGATTTTATGCCGCCGCGTGGCTTGGGCGCGATTGAGCCCTGGTCGCGATCATATGTAAACGCT
TTGGCCGCCGATTGACGAGGCAAGAGGCTACGCGGGTTTCAGTGCGATTCTTTGACCCTGGCCGTCATGGCAAACTAGG
ACGCCCGAGATTCTGATGAAACACCCGCGATGGCCTTGCGCATTTGCTATTTCATACAGAGAGGACGGAACAAGACATG
GCCATCAGCATCGTTATCATCTTGTCCAAAAAAAAAAAAAAAA > SEQ ID NO:4025 2145169FL Trichoderma harzianum
GGAGGATCAGGTGCGATGTGAGGCTGATTTGGGGTGTATGATTCGTGAGCGTGTAAGAGGAGGCAGCCCACGACTTTCT
CTCTGTGTCTGTGCTTGCTCACTTGCTCGCCTCCTTGGATTCGGCCTGTTGATCCGAATCAGAAGTAAATGTGTTTGAG
ACTGAGACTTGGTCTGGTCGAGACGATATGAGATGTGGCATGGAATTAGAAACACGTGTTTGGTATGGCGATTGCGATG
CGATGATCCGCAGAAAGCAAGATCTCAGGGCGACTAACACGGATATACGGAGGTTCGACCAAGACACGAGGAATGATGG
GGAAAGTCTCAGTATGTCACTACGGAATTTATGATTACGTAGCAATGTATAAAAAAAAAAAAAAAA > SEQ ID NO:4026 214557FL Trichoderma harzianum
CAATCGCGCTGATGGCCCTGACGAATCTCCCGGCGCTTTGCCATGGCGGATGACGATCTGCTGGAAAAGGTTCACAGCC
TCAGCGACTTGGAGCTGGCCGTGCTGCTGTGTTTAGTCAATCGAGAGCACGTCCTGATTAGCACTCCGCCGGCAGCCAT
TGATGACTTGGTGCAAGAGCTTCAGCTGATAGCAAGCAAGACATACAGTCTCAAATCCGTCGTCGTCAACTGCCACCCG
TCCACGACACTCGAGGATTTCGCCTCAGCTCTACTTCTCCAGCCTCAGCAGACTCCCCTCAACTCCGCCTCTCCGGCCA
TCTCGCCGTTCACCCGAAACGATTCGTATTTTGCGCTCAACTCGCTTTCGAACCATCGATCCTCTACACCGCTCAGCCC
CCGTACTTTCCTCTCTCCGCAGATCGCGCACTTTGTCATCGCAAAGAACCTCGACCGTGCCCCACGAGTCGTCCAGATC
CAGGCGCTCGAATTACTGCGCACGCGACGCATCTTCACTCGCACATCGGTACAGGCGGCGCCGAAGCAGTTTGTCTTTA
TTCCTGTTTTGGGAGCCGCAAGCGGTGGTGAAGCACACGTGACGGCGCATCTCAATGACTTCTTCTCGGTTGCGCATTG
GCATAACCCAGAAGATGGATATGTCAACCTAGATGAGGCTGAAAGTCGCAACAAGGATGACGACGAGACGGCATCCACG
GAGAGCGTTGTGAAGAAGGCGTCAAATGACACGACGCCATCGACGGCCTTGATATCAGACATTGAAATCAGCCAACTCG
CAAAGCTAAGCCAGGAAGTCCAAATCGACGTCGATATCCTTCGATACCAGATGAACATCATCTCCTTCCTTCGAATGCA
CCGAGCAGTCGCAGGTGGCATCACGCCTGCGGCAACAAAACATCTCCACCAGCTTGTCAAAAGTCTTGCCCCTTTACAT
AAGCTTGATTTCGTGACGCCTGCTTTGATCGGGCTAGCCGTGAGAAAAGTCTATCTCCACCGTATACGCATCACCGAGC
CTGAAAAGGAGAGAAGTATGCAATGGGGGAGCCAACTCGAGGCGGTAGAAGCGCTGCTCGAAGATGTAGGTCCCGAGGA
GGTGATGGAAGAGGTTTTGGAAATGGTTACGGCGCCTCTGTGAAAAAAAATCTTGTATTTTTGCTCCATGTTGATTTCT
TTCAACCCGAGCCAGCTTGTCGCCAAACAAAAAGACAAGCCCCCCTTAATAATTTCCCAAGTATACATAATATAGGTA
GAATCTCAGATTCCAAATGGCAAAAAAAAAAAAAAAAA > SEQ ID NO:4027 214672FL Trichoderma harzianum
ACACAATTCCTCGCTGCGTGTGACTCGTGTCTCCAGCAAATACCGCAAAGATGTCTGACGACGGGCTCTCAATATACGA
TGAGATCGAAATCGAAGATATGACCTTCGACGAGGTTCTTCAAACATACTTCTACCCGTGTCCCTGCGGCGATCGTTTC
CAGATCGCTATCGATGACCTGCGCGACGAGCAGGATATTGCTGTGTGCCCCAGCTGTAGCTTGATGATTAGAGTTATTT
TCGACCTTGACGACTTACCCAAACCTCCTCCTACTGGCAATACTGGTGGCCAGATACCAGTCGCTGCTTAAAGCCATCG
CTATATTTGAGCTTCCCTGGGCGAATACTTGATCTATTCGGCAGACACATCGAGATACTACACTAATTAGGCCCGCATA

```
GCGTACACAGTGCCTCAACGGCCGTTCTGAAGAGGCTTCTCAGATTGATCCGTCTAACATCGGATGTATTGATAGACGC
GGACGAGAAGACGACGATGTACCAGCGACAGACCAAAGTCATCCCAAGCATCCAAGCTACTGATGCAAAAATATGCGTG
CCTTGGGAGTACCACTCTCCGAGGCAAAAATTCAGTCACTTAAAGAGACAGGCTTCGGGAATGCCATGAAGAATTCAGG
CTCACGTGGGGGACATTTGATGAAAGAACACTGCCGAGGCGTTGGCAATACAGAATGGACCTATGAAGGACGGCCATTT
CACTCATATACCGTCAACATAACAAACCAAGATACCAAGGGTGTATTACATATTCACCTAAATTCCATGAATGCAAACT
ACAACTGATGACAAAAAAAAAAAAAAA

> SEQ ID NO:4028  216216FL Trichoderma harzianum
CGGAACCAATGAGTCTACGGCTAGCCACTCGGCGGCTGGCGCTGTCAAGCCCATCTTCTCCAGCCTCATTGCTGGCGCC
GATTAATGGAGTTTCACATGGAACGGTTGGCGTACTGACTCAGCGTCGTCACAAATGGTCGATCAATGTGTTCAAAGGA
TGGGGGAAATCTAGTTCCAAAGAATCTGGCGACAGAGGCCAGGACCCATCCGCCTCTGAATTGGACGATCCCAAGAAGC
GACAGCAGTTCCTGCAAAGGAATATGCGGGGTGGAGTCGAAGACAACATTTTCCAGGACGAGATTGAGGCCGCGAAGCC
GGTAACCGATTCTCCAGCTGCCCAGACGACAGAGGAAAGGACGAAGGAGAGCCTAGCAATGGTGGTCGATCCAGATGCT
CGGAGCCGTATCCGGTGGCAGCGAAGAAAGGTCATCCAATCAGTGCGCCGCAACGGGCAGCTGACGAGAGAGGAGAAGA
TCAAAATGACGGAGCGCGAGCTCATTCACAAGAGCGACTTTTTCCCAACCAGCGTCAAGAAACTGGTCATGTTGGCACG
GCAGATTGCCGGCAAGCCAGTCGACGAGGCTATTCAACAAATGAAATGGTCAAAAAAGAAGTTTGCGGCCGAAGTCAAA
TATCACCTGGAAGAGGCGCGGGACATGGCTGTTGTTCGGCGTGGCATGGGCCTTGGAAAGGTCAATGGTGACATTCTAG
ACAAGCCGCGCAAGGTGCGAACCAAGGATGGCAAATGGATTGAGATTGAAGACCCGACCCGCCTCTATGTTGCTCAGTC
ATGGGTTGGACGCGGCCCCTGGCGTGGAAAGGAAATTGACTATAAGGGACGAGGGAGAATGGGTGTCATCCAGCATCCC
AGCACGAGTTTTACAGTCATTCTGAAAGAGGAAAAGACCAGAATTCGGGAGTATGAAGAGGAGAAGGCTAAGGAGGCAC
AAAAAGGCCCTTGGGTTCACTTACCAAACCGCAAGGTGCATGGCCAGAGACCATACTATTCATGGTAAAGACAAGAGAA
TGAGGATGGTGGGAATTCGGAAGCAATAGAGTTTGCATGACAATGAGCATGTACCTGTATCAAAAAAAAAAAAAAAA > SEQ ID NO:4029  214259FL Trichoderma harzianum
AAAGACCAAGATCAGGACAAGACAATTCGAGAGTGCCAAAAACAGCAAAAGGGCAGAGAGACGTCATCATGGCTCAGGC
CAAGTTCGCCGTTTATCCCAGCCTCGTCGACCGCACCGTCGTCATCACAGGTGGTGCGCAGGGTATCGCCGCCGACATG
GTCGAGCAGTTTTCCCTGCAGGGTTCTCAAGTCATATTTTTCGACGTCGAGGACGAGCTTGCCGCTGATTTAGTCCGAA
AAGTGTCTGATCAGGGCGTCAAACACAAGCCCATATACTACCACTGCGATGTCATCAAGATCGACGAGGAGCTCAAACC
CACAGCGGCCAAGATCCTGAAAGACCATCCCAAGATCGACGGACTCATAAACAGTGCCGCGAGGGCAATGGTGAAGCCC
TCGCAGGATATCACGACTGAGTGGTGGGATGAGAGCGTCGCCGTGAACCTGCGGCATCAGTTCTTCCTGACCCAGGCCT
TGCTGCCGGGGCTTCTCCTTGCTGCTGGAAACGCTTCGGTGATTAACATGGGGAGCATCAACTGGCTCGTCTCTGCGAC
GGGTCAGGCGCCTTACACGACGAGCAAGGCCGCCGTTGTGGGACTGACGAGGACGCTGGCACATGAGTTTGGACCGCAG
GGTATCAGGGTGAATAGTATCATGCCGGGGTCCATTGCGACAGAGAGGGAGAGGACGGTGGTTATGACGCCCGAGTATG
AGGCCAAGGTTCTGGGCAGTCAGGCGATCAAGAGGCTGATTGAGCCGGTGGAGGTGGCGAGGATGGCCATGTGGTTGAT
TGCAGATGATAGTGCTGCGGTGACGAACCAGAGCATGAGGATTGACGGTGGATGGACATAGGATGTGGGCTTTGAATAA
GTGAATAATGTCGGTTTTTAGATACTCTGCTGATGGTTGGAACATTGAGATGGCATGTATAAGAAAAAAAAAAAAAAA > SEQ ID NO:4030  214443FL Trichoderma harzianum
GACGCTATCGAGGGCTGACCTGCATCGTCGTCAGTCGGCAGACGAGCGGATTAACAACATTCTCGAGACGGCTCTGCAA
CGAGCAGAAACGATGGATCCCGCCTCTCTAAGCCTTCTCCAGAAAGGCTCTTCCCACAATTCCTCTCCCAACTATGGAG
CCTCCGGAACGGTGACAAGAGGGATATTGCAAGACTATCAGGCGGTACCGACCAGCGATGAAAGCGATGCCACCCGTCC
GAGAAAGGTTTCATACAGCGATGCGGCGAAGAAGGCCGGGAACCATGCGAAGAGCCAGAGCTCTCTGCGGCAACGAAAC
GGAGTCTCCGGCTCGGAGGATACAAGATCGCCAACAAAAGCAAAGTCATCATGGACGAAGGAAACATTTCGAAAATTTC
AGTCCCTTCAGTTGGAAAACAAGGGAAGCGTGGCTAGAGATCACCTGGCTCTCGAACGCACATTTCTAGCATGGCTTCG
AACCTCTCTCGCTTTTGCATCGATTGGCGTCGCCGTGACGCAGCTATTCCGCCTCAACACTGATAACGCTTCCGCCTCC
GATTTCGACCACACAAGGCTACAAAAGATGGGCCGCCCGTTGGGTGCGACATTCCTCGCCATTAGTATTGTGACCTTGC
TCCTCGGTTGCAGACGATATTTCCATGCCCAGGAATGGATCCTTCAGGGCAAGTTCCCGGCAAGCCGAGGGACCATCAT
TATCATGTCACTGGTGGCATTGGCCCTCATGATTTTGTCTCTAGTGGTGGTCATTGTCATCCGGCCATCATAGAGGCTT
TGGACAGCTATGGAATCACCGACTTTTGACTGTTGATTTTCAGTTGGTTCCTTTTTGGAATGAAGAAGGATCTATGGGC
TTGGTACTTGTGATTTAGGATAGCATTGGGTTTGAAGCATGTGATTAACGGGTTTTGGTGTTTTGGACTTTGCAGGGTA
AATGTTTGGATCATATATGCATCGATGTACATTTGCAATGGATAGAGGATATCTCTTCACTGGTTAAAAAAAAAAAAAA
A
```

FIG. 1 continued

> SEQ ID NO:4031 214558FL *Trichoderma harzianum*
GGAACGTCAAGTGCGAAACGCACTGGTGTCGCCTGACGAAGCAGGACAAGAGTCAATCAATTCCAAACCAGCCGATAGA
TCTCGAACTCTGTTCAAGACCAATACCAAGATGGAAACGAAAATAGGAGAAGAGCCTATACGACATACCGATTTTGCCA
TGACAGATGCTCAGGGAGGGCGAGGCCCGCTGCAGCAACCAGCCACCACGGCACGCACCGGCTTGGCGATGGGACGCAG
GTTACAAAAATTAGCTCGCCCAAAACGCTCGGCAAGTCATGAACAGCAGTACATAGGTGACGAGCTCCGTGGCCAAACT
ACTAGGCCCAGATCATCTTACGACCCGTTGGTCTCAACAGAATATAGTCTAAGACGTCCAAAGCAACATGCGACACACA
ACTCGACTGCAGAACCTACGGTAAATACTGTCATTAAGCCTACTTTACGGCGACGAGGATCCGACTCTAGTGAGAGCAG
TTTCGTACGTAGTAGGTCCATCGGCAGTCCTCGAAGTGGATTTAGGTCATCGATGCGAAGCAGCTCTTTCGATCCGAGG
CCATCATCATCTGGTAATAAGGGTAGAAACAGGTTGACTCTACGCTCGTTATCACCCACAACGTCACATCAGAGGCACC
ATTCTGCTGCGCCAGCTGCTCCTTCTCGGCAAATGGTAGAGAATCCAACTCGTCAGCCGTTCCAGCGACACTCAGTTGC
GCCACGTATCAGCCAGTCTCTATCAAGGAGAGATGAGGATTCGACATACGGCGATCACTTGTCAGATTCTAGTGATGAC
GACATGAACACAACTCCGTTGACAAACGGCTCTATCACGGGTGATGAAAACGAACCCGTTCATTCGAGGTTGAAACAAT
CTATTCTTAACATGTATGCACGCAACAACCTCCCTGACCAAACTTCTAGTGCCAGCGCAGGTATCAACTCCGGTTTGCC
AAAACACGATGCGCCCAAACCGAGAGTTGACCAATACCACAATGAGGAGAACCCGCATCTACCTCTTGATCAGCTACCC
GGCGCCTCGGCTCGCCGACCAGGGCTCATCTCCACACTCAGGCGCAAGAGCCATGCAAACGTCAAAGAATCCAGCGACG
CTGACGGTGCCCGTAATACTCTACCGCATCATCACAGTGAAGACGCAACGTCTACCCGGAACAGCGTCATACCCAACCA
CGCAATAGGCTGGCCATTGCAGAACAGGAAGGGCGAGACGAATGAAGCTTCAATGACGTCACCGCTTGGAGACACAGGA
AGACGATCCGCAGCTAGCGGCTCTATTTTCAAGGACGAGCTGACGTCAGAACCCCGCCATCAACATGAGCTTCAGCTTT
ATGAAGGTAGCTCGGATGCGAACCACGCTAATACTTTCCTATCACAAGAACCTAAGCGAAAGAAGTTTAACAGCCTGAG
GAAAATGTTTAAAATTAATAATTAGGTAATTATAGAATTCGAATAATGAGATAAGATTATATAGCAATTAATGGTGTAA
AAGAATTTAATGGCACGCTAGTTTCGCTACAAAAAAAAAAAAAAA > SEQ ID NO:4032 215922FL *Trichoderma harzianum*
AAGCAATATCATTGTTTGCTCAGGAGGCCAAAGCGAGCTTTTCGATTGATTGTCCTCTTTGTTCTTTGTTACATTTCAT
ATTTATTTGCGTCTTGGGGAGCCATTGCAATTGAATTGCTGCGCTCTGGGCATCGTACACACGCATTTTTCTCGGCAAT
TCCGGCTTGAGCTGCACGGCATACGAAATTGCTGCCGGTGCGGACTCTTGCAGCTCCGAGGCTCCGCTATCTCCATCTC
ACCGGTGATTCCTTGTGCGAGGTTCGGCCGAGAATTCCAGCAATTATTGTCACTCTTTGTCCTTTCACGAACGGAGCGAA
ATATATATAATCAGCTACGCTGGGTAAAGAGAAAGAAGAGGAACCTCTGCACTCGCCGCATCCTACGAAATGATTCGGG
CGGCGTTTCAATCGAGAGCGGCACCGTTTGGAGCGGCCAAGAGCACGACGGTACAATATGGAGCATTGAGGGATGCTTG
GGCAAGGCTATTTTCGTCACAGCCTGTCATGAAGTCCCCGAGCAACAGCAGCAGAACATCATGGACGAGGTTACATTCA
ATTCAGCCCTGGCGGGGAACCACGCGCCACGGCGCTTCGATGCGACCAAATGTCAGGATAGCTGACAGCTTTGCGAGGG
GGGCGCAAAGGCGGAGCTTTATGTTTCGGCATGGAGGCGCAACACTGCGCAAGGAGCTCAGGAGAAGTTGTCGCTGAG
CGGGAGATTCAAGAAGCTCTCCAGGGAATACGGGTGGTCGGCCGTCGGCGTCTACTTCGCGCTCAGCGTGCTGGACTTT
CCGTTCTGCTTCCTCCTGGTGAGAGTGGTCGGGACAGAACGGATAGGTCAAGTTGAACACTACGTCGTGTCTGCAGTCT
CCAAGTTTATCCCCGAATCGGTGCGAACACGATGGAACGAATGGCGAGAGTCTCTGAAGTCTGAAGAGAAGCAGCACCT
GGGCAGCAACGAAATCAGCGACAAGGTGGAAATGGCGGGCTGGGGAGTCGAGAAGGCGCAACAGCGCAACAAGGAAGAA
GCCAGCCTGGCAACGCAGCTGGCACTGGCGTACGCCATCCACAAGAGCTTCATCTTTCTTCCGGGTGCCCTTGACAGCGG
CGGTGACGCCCAAGGTGGTCAAGGTGCTTCGCGGATGGGGTTGGAATATTGGCAAACGGACCCCACGGTCATAAATGAC
AGATAGTCCGAAGGAAGCCGAGATTGGCATTTGAGATCTGCAAGTAAGCATGCTATTCTATCTGGCTGTATGAATTTTG
TAATACTATTATCAACGTTTGTTTGGGGGGAGGGCGCAGTGGTGCAGTTAGACACGGGCGTACGGATCGCACTACTATA
CATCTAGACAGGTTTTGGCAAATATTAGGCTGGAAGAGTACAGACATGACAGACATGACAAAGACAACGAAAAAAAA
AAAAAAA > SEQ ID NO:4033 214162FL *Trichoderma harzianum*
AGCCGAAGCGCTCGTAGTAGCTGATGTTTTCTTTGGAGCTTGACTCGAGTTACTTACCTTGGCAGCCATGTCCATGATG
AGCTTCTTGGCATAGCCTTTGCCTCGGGCGCTCGGCTTGGTGCCGATATAAGCAAGGTAATAATACTCACGATCTCCCA
TGACCTCGTCCATGGTCTCATGCAGAAGAGGCAGGACGTCTTCGTAGTAGCGCTTGCGGCCCTCGGAACCAAGTTGGTA
GTAGAGGCGCCACATGCCGCTTCGGAAGATGGTCCACCAGTCGTCCATATGCATCCCGGAGGCATCCTAAGATGAACA
GACGTCATAGTCAGGACCAATGGTCGTGACAACGCCGTATAGCAATGGGCCGAGACCAGATAGGTCATGATGCGGACG
TGAAGCTTCCACTTGGTCTCGTCCGAGTAGCGGTCCTCGCCGTCGCCGTCGAGAAGATACATGTCAGAGCATCGGCGG
CGAATGCGTGGGCGAGAGAGACTCCCGCCTGCTCGCACTCGGCCAGACCGATCTTACGGACAGACTTCTCCCAGGCCTG
AGGGACGAGAGAGCGACGACGGTCCACAACAACGGCAGAGGAAGCTGTCGTAGCAATGGTATTGATCGCGGTCTTACTT
ATAACATGCGCCATGCTGGGCTAACTGTTGTTCTCGAACTCTTGCTTATTTGTCTTTTTATTCGAGTTCTTGTGGATTC

FIG. 1 continued

```
TTCACTCGATACTGCCTGTATAAGTGGACAACGCAAAAGAGGCGCCTAGTTTAGTGATTGACTCTGGTAAGCTCTATAT
GATCACTCACGTATAAAAAAAAAAAAAA

> SEQ ID NO:4034 214262FL Trichoderma harzianum
GTTCGATGCACTGCCACCATCCTCGGAGAAAGGTGTGTGTAGTGGACAATGTATGTGTGTCATTGAAGAAAGTAGGAGT
AGGTGGCGGCTCCTTGGCAAAGTGGCAATGTTGCTTGGTATTATGGATCGGTGGGTTGTGCCCAGCTGGAATGGCTTGT
CTTGGCGATAGGGGGAATATGGAGTCGTTTTGATGGGAACGGCCTTTTTGGTTTACCGAGGAGGGGTCAACATGTGCGA
GCATGTATGTTCAAAGATGGGAGAGGGAGAGAAGAAGAGAGAAAAATCAAGAATCAGTTGTGCCTAAAAAAAAAAAAAA
A > SEQ ID NO:4035 214370FL Trichoderma harzianum
TGGCTGGGGGAGAAGAAAAGCCAGAAGATGCGATGGGCCGTGAGTTTGAGTGTGAGTATTGCGGCGTTGTCCAGGTA
CAACGGGGGGGACGAAATGCGAAAAGCGCACAAGACAAGGTAAAGGAAACGGCTAAAAGAACAGACAGGGCGTGAGGAT
AGGAAAAGGAAACAAAAACGAAGAGATTCCCAGTATTATATAAAAAAAAAAAAAAAA > SEQ ID NO:4036 214460FL Trichoderma harzianum
TAATTCTATTTCACTCTTCTGCAGACGAGGACGGACCCGATTGACCATGTTGCGACAATCCTTCAGAGCCTTTGCCCGC
ACGGCTGTTGCGAGACCGGCCGCGGCGAGAAGCTACGCTACCTTCAACTGGGAGGATCCCCTCAATGCGAACAACCTCT
TTACCGAGGAAGAGCAGGCCATTGCAGAAACCGCAGAGCGATACTGCCAGGAACGACTACAGCCTAGGGTCTTGCAGGC
CTACCGAGACGAACACTATGACCCCAAGATCCTCGAAGAGATGGGCGAGCTGGGCCTGCTTGGCTCCAGCATCAAGGGC
TACGGATGCGCTGGCGTTTCTTCGGTGGCCGGCGGCCTGATTACACGAGCGGTCGAGCGAGTCGATAGCGGCTACCGGT
CTGGCATGTCGGTGCAGTCGTCCCTCGTCATGGGCGGCATCCACGAGTTCGGCACCGAGGAGCAGAAGGAGAGATTCCT
CCCCGAGATGGCCAGGGGCAAGCTCATTGGCGCCTTTGGTCTGACGGAGCCCAATCACGGCAGCGACCCGGGCAGCATG
GAGAGCGTCGCGAAGCCGCATCCGACCAAGAAGGGATACTACTCACTGAGCGGAGCCAAGACGTGGATCACCAACAGCC
CAATTGCCGACGTGCTGTTGGTCTGGGCCAAGCTGCAAGAGACGGGCAAGATCAGGGGCTTCTTGATTGAGAGGAAGGA
CTGCCCGCCTGGAACACTCGAGACACCCGCCATCAAGGACAAGAACGGGCTCCGAGCTTCCATCACGGGCATGATCCAG
ATGGACGGCGTCCCGGTGCCTGAAGCCAACATGTTCCCCGATGTCGAGGGCCTCAAGGGACCCTTTAGCTGCCTCAACA
GCGCTAGATACGGCATCTCGCTGGGTGTCATGGGCGCCCTGGAGGATGCCATTGCTCGAGCTCGCACCTACTCCCTGGA
GCGCAAGCAATTCAAGGGGAACCCTCTGGCTAGGTACCAGCTCATTCAGAAGAAGCTCGCTGATGCCGCCACAGATGCC
GCCTATGGCACACTGGCCGCGGTGCAGGTCGGCAGGCTCAAGGACGAGGGCAAGATGACTCCCGAAATGATTAGCATGG
TCAAGAGACAGAACTGTGATTCGGCTCTGCGCAACGTCCGCGTGCTGCAGGAGATTTTCGGTGGAAACGCTGTGAGCGA
CGAGTATCACATTGGAAGACATGTGGCGAACCTGTTTGTGACGCAGACGTACGAGGGACAGAGTGATATCCACAGTCTG
ATCTTGGGCAGGGCGATTACCGGCATACAAGCCTTTGTGTAAAATATACTAGCAATATAGATGATGAAATAAAGCATA
TAATCACAAAAAAAAAAAAAAAA > SEQ ID NO:4037 214530FL Trichoderma harzianum
CCCACGCGTCCGAGTATCTCAAAGATGGGCACCAAGATGGATTTCCAACACTTTGCGCCGCAAATCGACAAGATCCCCA
AAGTTACACCGAGGCAAATCGCTTCTACTGCTCTTTGGAATACTGTCCGCGACAACTTCTCCATCTCGACGTGGATGGC
CATTGGAGCCACCCTCCAGGGTCTCTTAGTTTTGTTCGCTCGACCTACATTCGCGATTGCACCGGCAACGCTCATCTTG
CTTTACCGATTCTCCCACACGATGCTCATGCACTACGGCTTTATTCGCAACACGCAGATGGAAGATGTCATCATGGGAA
AGTATACCGTGCAAATTCCCGACAAGGACGGTAAACCGCCAAGTGAGCCGTCGGGGACAGGCATGGCTGTCATCATGCT
GGGCTTCAGAAACAATTCCGCCCTCGGTATGTTTGGAGCAGGCGGGCTGGAGACCTCCCTCAAGTTTCAAGCGATGTTG
AAGGATCTCGAGAATGATCCGGACTCCGGCTTTCTTGGCATGTGTGGGTATAAAGCTGCCAATGAGCGACCGACGGCCA
ACGGTTTCATGTCGGTGCTTTATTTCCGTAGTGTTGAGGATATCAATCGATTCGCTCACGCCCCGCTTCATCGTGAGGC
CTGGGATTGGTTTGTCGAGCTGAGCAAGACGAATAAGCATTTGAGTATTATGCACGAGGTGTACTCAGCGCCAAAGAAG
AACTGGGAGAACATCTTCATCAATTATCACCTCACGGGCATTGGGAAAATACTGAAGCCCGTGATCATCAATGGAAAAG
AGTATACGCCCATTGCCAATGCTCAACGTGGGCCATTAAGCACACACAAGGGACGAGTTGGCAATTCGAGATCAGGTGC
CGATGAAAAGGAGTATCTTGTACATGCTGAAGAGTGAATACAGTTCTTGTGTATTATATTGCCTTTGAAGGCCGGATGG
ACTGAACAACAGCGGTTATCTGTTCTTCGTTTGGCCAAGGCTACTCCATTCTCACAAAGCCACAAGAATTCCGGTTTAC
AACTTTGCAAAAATGGTTCCCAATAAGATATTTTTAATACTTGATGTAATGAAATACCCATTCTAGCTAAAAAAAAAA
AAAA
```

FIG. 1 continued

> SEQ ID NO:4038 214563FL *Trichoderma harzianum*
ATGGCGCTAGAAAGTCGGCACATCGAGCCTCGGGCATTGTCAGTCCATTCTCGCCATGGCGAATCCTCTAATCCCAACA
CAGCACACAAATCTGCCTCTATGAGCGCATCCGTCGACCAGGAAGCGGCTCAGAGGGATGAGGCAGAGGCTTCCACCGT
CCATGTGCGGGCTATGGTAGCAGCCGTGCAGCAGCAGAAGACGCGGCCGCCGCAGAGGATCACTCAGGAAAGTTGCGCTG
CTGGGAAGAGGCGCCCAGCGTGACAGGAGAGACTGGCCGCTGGCCATCGAGACTGACGCGATAGCTGACGCGCCCATCT
CTGAATCTGCTCGTTTTGGTCCGGCCTCTGGTTCTGGAAGCACGGTGCACAACGCTCTTGGCCTCAACATCTCCCCTAT
CTCATCCCCGACAAATGAATATCCTTGCCAGCCCAATCTCAATCTTATTGGTTCGCCAGCTCCTTCAGCCTGTTTTGAT
GCCGGAATGGGCGGGAGCGAGAGACAGGCGGACATGTACAATTTCACAACCGATGAGGAAGACATAATCCAGCTGGGGA
CTCATGCTTCTCAGTCGCTTCGATCTAGCCTCCCCCTGTCATCGGGATCCGAATCTTACTATGCTGGACGGACGGCAAC
TGAACGTCGACAAAAGGCCAAATCCCCGCTCTCCTATTACGCCTCAACTCTGCCTCAGCCAGGTGTAGGCTGGGACTAT
TCCGAGACTGAGTGGTGGGGCTGGGTAGTTCTGACGGTGACCTGGTTTGTCTTTGTTATGGGAATGGGCTCTTGCTTTG
GCGTCTGGAAGTGGGCATGGGATGTAGGTAAGACGCCATATGCACCGCCTGAGCTTGAAGATGACCTTACTCTGCCAAT
TGTGGGTTACTATCCTGCGCTCATTATTTTGACGTGCGTCATGGCTTGGGTATGGGTTGTTGTTGCTTGGGTAGGGATG
AAGTATTTTCGACACGCAAAAATCAGTGGCGATTGAACCCATCTGGTGTTTTTTTGGTTCTCCCAGGCGCATACTCGT
AATTTTTTCAATTATTATCTAGACGGTGTTATTTATACCCTATATAAACTTAATCGATATACATCACAAAAAAAAAAA
AAA > SEQ ID NO:4039 215283FL *Trichoderma harzianum*
CGCAATTATATTATGCTTGACAAGTTGAAACTGACCAAATAACAAAATACAACAACACCATGGCTACCACCAACGGCCC
ATCCAAATTCATCCCAGAACAGCTCTTCCACACTGTTCTCACCATAATCGACTACTCCCACGACGCCTCCGGCGCCAAC
CGCACGCTATTCGTCCTCAAAACCCACGGCACCCTCGCCGCTGCAAAGAAATACGCCAGCCACGCCCTAGAAGCCGTCA
ACTTCACAGCCGAAGACTTTGAAGTCTATCGCATCCGCGCCGACGAAGACCCAGCCAAACCCTGGACCCACGGCGACGG
CGTGCTGGTTTTCGCTCGCTCCTTTGATGGGCAGGAGTTTCTCGTGGGAATCGACACTACTCCGAACAATGAGGCTTTG
ACCGCGACCTCGGATGGAGAGATGGTGCTGCCCGAGGGCGCAAAGTTCTTGCACTACCTTTTGCAGATTACGGTGGACT
ACAACGCCGACCGTAGCGGCAGCTCGCAGACCACGGAAATTGAAGGGACGTATGTCCATCGTGCGGATGCTTGGACGGC
TGCGCATGTCTCTCTCGATCCAACTGAGTATGCAGAGTTTGATCGTCGTGGCGACGCACAATTTGTTGAAGAATGGCCC
TTTGGCGAAGACGTTGCAGTTCATGCCGTTTCTGAGACTGGACAAAACTACTTTATTGCGGTGAAAAGGCCCCCCGAGC
AGAAGCACGAGGTAAAGCATCACTCGCTGAAAAAATAGTTTTCATGTCTATTGCATTCGGTTCGTGGAAGTAAGGACCT
CGTCTGTCGTAATTTGGCTACGCTGTGACTTTCAGATGTTGTTTTAATTAACTCAAAGCTGTACATTACTCTGTCTAAA
GATTTGGGCTACAGATCTAGTAACTATAATTATAACCTCCTCCAAACATCTCTCCAATAAAATGATTCATTATACATTA
TAAAAAAAAAAAAAAA > SEQ ID NO:4040 216430FL *Trichoderma harzianum*
GTACCGGCTAAATACTCGACGAAATGGTGTGAATCGTCGCGTAATGGTTGGACGATGGAGCGATGTCTTTATACTCTGC
TACGCTTACTTATCCACAACTTTATTTCGATTCACCGTGTGCTACAAATAGCACCCCACGGCGGGCTCTCGGAATTATA
GCTACAGTATTAAGCAATTGTATAATAGATTAAGGTTAGTTTTCCGAGTGAGCCGTTGCATCTCGGGCGGCAATCTGGG
GAGCATATTAGCAATAGATGAGCAATAGAAAAAAAAAAAAAAAA > SEQ ID NO:4041 48423FL *Nicotiana benthamiana*
GTTCTTGTCATTAATTAAGGCCATTACGGCCGGGGATGGAGCTGCAAGATTGGAAAGAGGCATTGAAGTATTGCAGATT
AACTATCCCGGTTTATAAGAGAGTTTATCCAGAATGTCATCCTTTGCTCGGACTGCAATATTACACTTGTGGAAAACTT
GAATGGTGGCTTGGTGAGACTGAGGAAGCTTATAGGTCACTAGCCAAGGCAGCAGAGATACTGCGAATTACTCATGGAA
CAAACACTAAGTTCATGAAGGAGCTTTTTGTGAAGTTAGAAGAAGCTCATGCAGAGTTCTCATACAAGATTTCCTCCAA
GGAAGAAGAGGATGATTGAACTGCATCCGCAGATGCACATTACCTTTGTAGACAACAGATATAAAATTCCATTTCACCA
GTTCGACAAAGGGCGGCCCCTCTTTCCTAATTATTACAATGAAAAGTTTCTAGTGAGATGCTGATCTCCCTTTCCTACT
GTCTACTTTTGATGGAAGTTGAGGTTACTGTTGTGAGAGAAAATAGGCTATCATGGCAGTTTCTTCTATCTTATATAAG
AGACTTAGAGTTTTGATATTCGGAAAGGGGTGCAAGGCATGTTCATTGGAAGCTGTAAATAGCTAGAATTTGTGGCGT
TCATTGCATTCCGAGTTCTATTAGGGGCCTGCATAGAAGTGCAGGAATTCTCTATATATAGGAGTAAAATATTTTGTCT
TTTTTGAATATTTCTGTATGAATGTATTAGGGTATGATTTTGAATAAAAAAAAAAAAAAA

FIG. 1 continued

> SEQ ID NO:4042 216433FL *Trichoderma harzianum*
GCCGCCTCCTCACAAGTTTGAAGAAGCGCTCAAGGACGGCATCACGGAGGCAATGAAGCTGTACAAGGTCAGAGAGGTC
ATGGTAAAGAGATGGTCGAGCAATCGAAACCGATGAATGGACTGTTGATGTCTATTTCAATTTCTACATTTTCCTTTGC
AGTGTCTTTTTGTGTAACATTACGGCGATACCTGGGGAATTTATTGAATGTGCAAATGCTATGGGAATACACGTCGGCG
ACAACGTGTGTAATGTATACGAGAAACGATGGAACGAATCTGGATCAAATTACAGATGCATTTTAAACCAAAAAAAAAA
AAAAA > SEQ ID NO:4043 131281FL Poppy
AAAACCTCACTCTCATCGATATAAGCAACACCACCTTGAGCACGAATATCTGCTGGTACACGTTCTAATGCCATGACAG
CACAAGCACCTGCTTCTTCAGCGATTCTGGCTTGTTCTGCATTAACAACATCCATGATTACTCCTCCTCTAAGCATCTG
TGCTAATCCTACTTTAACAGAGAATGGTGAGGTTTTTGCCTCTGTTATTGCTCCATTTCCATATACTGTTACTATTCCT
GTCATGGCTAAAGCTCGAATTGGTCATTTCGTTGAAGCTCAGATTCTTGAAGCGATTGGTGTTGATTATATCGATGAGA
GTGAGGTTTTGACCCTTGCTGATGAAGAACATCATATTAACAAGCATAATTTCAGGATTCCATTTGTTTGTGGTTGTCG
TAATCTTGGGGAAGTCCTAAGGAGGATTCGGGAAGGTGCGGCCATGATTCGAACAAAAGGTGAAGCTGGAACTGGTAAT
GTTGTTGAAGCTGTTAGGCATGTGAGGTCTGTCGATGGGTGATATTAGGCTTTTGCGTAATATGGATGATGATGAGGTGT
TTTCATATGCAAAGAAAATTGCTGCTCCTTATGATTTGGTTATGCAGACTAAACAGCTTGGTAGACTTCCTGTGGTTCA
ATTTGCTGCTGGTGGAGTTGCTACTCCTGCTGATGCTGCTCTGATGATGCAATTGGGTTGTGATGGTGTTTTCGTTGGT
TCCGGTGTTTTTAAGAGTGGTGATCCTGCTAAACGTGCTAGGGCGATTGTGCAAGCTGTGACTCATTATAGCGATCCTG
ACATTCTTGCTGATGTTAGCTCCGGTTTGGGTGAAGCTATGGTTGGAATTAACCTTAATGACAGTAAGGTTGAAAGGTT
TGCTGCTCGGTCTGAATGAATAATCCAAAGGCTTTGATTTGACTGAATTGCACTTGAGGTGAGAATTAGACCTCATTTC
CTTGCTGTTCTTTGGTTATTCATAGAAAAAAAAAAAGAAAATATATGAATGTTTCGTTTTTTATTTGTTTGAATGTGTC
TGGTAGATATAGATAAAATGTTAGGTGTTCTAGTTTTGCTTCTCTTCCGTGTAACTGAAGAAGAAAGGTTGTTGTTTTT
AAGAATCTTATGGAACGATGTTTGGTTCAGATATATTCTATTGAATATTCCCTAATAATGTTATATGTTATCGCAATTG
ATAGAAAAAAAAAAAAAAAAAAAA > SEQ ID NO:4044 219045FL *Trichoderma harzianum*
CGGACGCGTGGGCGGACGCGTGGGTCCGGACGCGTGGGGACTAGATAGGTAGAGATGGTTTGGCGGTCAATGCTGTGCT
CGTTAGATGTCTCACGGGGCCCGCATGTATCTCCATGTAGTTCCTCGCACGCAGCAAGAAAGAGGCAAAACCCGCGCG
GTGTTAGTAGCGTTTGCCATCGGAAGACGATCGCCCAGCACGTCAAAGAGGCCATTTGATCAGTTACTCGATTGGTGCT
CGCACGGGTTGGTTACGAAAAAAAAAAAAAAAAAAAA > SEQ ID NO:4045 129833FL Poppy
AACAGAGGAAGAGAGAGAAAAAAGAGAACTTTTATTTATTTCGCTGCTTCTTCTGTTTCTCCTTGTTTGATTCTTTTCA
AATCTCAAATTCCTCACTTATTCACTTACACACACACACTCTCTCTCTTTCTTGATTGTTGAACTCATCTCTTGTTT
CCTTAGCCGCCATGGATCTAGATCTGTGGATTACAAAGGTTAAAGAAGGTCAACATTTAATGGAGAACGAACTTCAACT
TCTTTGTGAATATGTGAAGGATATCCTCATCGAGGAATCTAATGTTCAACCTGTAAATAGCCCAGTCACTGTTTGCGGT
GACATCCATGGCCAGTTTCATGATCTTATGAAACTCTTCCAGACTGGCGGTCATGTACCAGAAACTAATTATATATTTA
TGGGCGATTTCGTGGATCGTGGATATAACAGTCTTGAAGTCTTCACTATTCTTTTGCTTCTAAAGGCAAGATATCCTGC
ACATATTACTCTATTGCGTGGAAATCATGAAAGCAGGCAATTGACTCAGGTTTACGGTTTTTATGACGAGTGCCAAAGG
AAATATGGTAATGCTAATGCCTGGAGATATTGCACTGATGTATTTGACTATCTCACACTCTCAGCTATTATAGATGGAA
CTGTTCTCTGCGTCCATGGTGGTCTTTCTCCTGATGTTCGAACAATTGACCAGATGAGGGTCATTGAGCGAAATTGTGA
AATTCCTCATGAAGGTCCTTTTTGTGATCTCATGTGGAGTGATCCCGAGGAAATTGAAACATGGGCAGTCAGTCCAAGG
GGAGCAGGTTGGCTTTTCGGTTCTAGGGTTACAACAGAGTTTAATCACATAAACAACCTGGATCTTGTTTGTCGGGCTC
ATCAGCTTGTGCAAGAAGGTCTCAAGTACATGTTTCCGGATAAAGGCCTAGTAACTGTGTGGTCTGCACCGAATTATTG
CTATAGGTGTGGGAATGTAGCTTCGATACTGAGCTTCAATGAGAATATGGAGAGGGAGGTGAAATTCTTTACAGAAACC
GAGGAGAACAATCAGATGAGAGGACCCAGATCAGGAGTCCCTTATTTCTTATGATTTGGGAGCCTGTGTCATCACAGAA
TTATTTATATGATTTTGAGAAGCTTGGCAATCCCACGTCTCCATCTTCGCCTGATGAAGAAAGGAAAGCAAAGTTAACA
CTTGTTACAAGGAAGAGGCGTATAGCACATTGGACATCATCATTCTTATTTCGAGATGCTGAGCTTCACTGACTCATGCGATG
TCACTATTGATAGTGTTGTATATTAGTGAGTTGACCTTTTTAAGTTTTTGATATTTTGGGTTGATGTTAGTTTCATTAA
TATAATGTAATCTAAAACAAAGTTGTGGGTCGTGTTCAGGTTTTTGGATTGTTGATTTGCAATAGCATCTGAAATCTGA
ATGCATGCATTTTCTGTTTAGATAACAAATTGTAAAAGCACATTGGATGATGTTAATGAAAAATTCAATTTTAGTTCTT
TATTCAAAAAAAAAAAAAAAA

FIG. 1 continued

> SEQ ID NO:4046 167332FL Poppy
AGAACCCTCTTCATCATCTTCTTCCTCAGAAATCTCCTGATCTTCTTTCTAAATTCCCAATCTAACCCTCTCCAATGGA
TCCCGTCAATGAATGGGGTAACACACCCTTAAACGTTGCAGATCCAGACATCTTCGATTTAATCGAAAAAGAAAAGAGA
AGACAATGCAGAGGTATCGAATTGATCGCTTCTGAAAACTTCACATCTTTCGCTGTGATTGAAGCACTTGGTAGTGCTT
TAACAAACAAATACTCCGAAGGTATTCCCGGTAACAGATACTACGGAGGTAATGAATTCATCGATGAGATTGAAAATCT
ATGTCGTTCAAGAGCTTTGGAAGCATTCCGATGTGATCCAGCGAAATGGGGTGTGAATGTACAGCCTTACTCTGGTAGT
CCTGCTAATTTTGCAGCGTATACTGCTTTGTTGAATCCACATGATAGAATTATGGGTCTTGATTTGCCATCAGGTGGTC
ATTTGACACATGGTTATTATACATCTGGTGGTAAGAAGATTTCTGCTACTTCAATTTACTTTGAGAGTTTGCCTTATAA
GGTGAATTCTACTACTGGGTATATTGATTATGATAAGTTGGAAGAGAAAGCTTTGGATTTCAGACCTAAATTGATTATC
TGTGGTGGTAGTGCTTATCCTAGAGATTGGGATTATGCTAGATTTAGAGCTGTTGCTGATAAATGTGGTGCTCTTTTGC
TTTGTGACATGGCTCACATTAGTGGTCTTGTTGCTGCTCAGGAAGCTGCCAACCCATTTGAATACTGTGACGTTGTCAC
AACCACAACTCACAAGAGTTTGAGGGGACCTAGGGCTGGTATGATCTTCTTCAGGAAGGGTCCTAAGCCGGCCAAGAAG
GGTCAGCCTGCTGATGCTGAATACGATTTTGAAGACAAAATCAACTTCTCTGTTTTCCCTGCTCTTCAAGGTGGTCCAC
ATAATCACCAGATTGGTGCTTTGGCTGTTGCTTTGAAGCAAGCTATGACTCCCGGATTCAAAGCCTATGCTAAGCAAGT
GAGGGCAAATGCCGTTGCCATTGGAAACTACTTGATGAGCAAGGACTACAAGCTCGTCACTGGCGGGACTGAGAACCAT
CTTGTTCTGTGGGACCTTCGTCCTCTTGGCTTGACTGGAAACAAAGTTGAAAAGCTTTGCGACTTATGTAGCATCACCG
TGAACAAGAATGCCGTCTTTGGTGATAGCAGTGCTTTGGCACCTGGAGGTGTTAGAGTTGGAGCACCTGCCATGACTTC
TAGAAGGTTTGGTGGAGAAGGACTTTGAGCAGATTGGTGAATTCCTTCACCGGGCTGTTCAGCTTACCCTGAAAATCCA
GAAAGAACATGGAAAACTCTTGAAGGATTTCAACAAGGGACTTGTGAACAACAAGGAAATCGAAGACCTCAAAGTAGAC
GTCGAGAAGTTTTCAGCTTCCTACGACATGCCTGGATTCCTTATGTCTGAGATGAAGTACAAGGATTAGATTGAAGTAA
AATCTTAAAATGGATATTACTAGGTAATATAGTCTTCAATGCTACGTGTTTTGAAACCTAAATTTTCAATTCACATCCC
ACTTTACTTCCGTTGCTCTTATTGAAGCAAATTAAGTTCTATCTTTTCTTTTGTTATTCGAGGGTTCTGAATAACTTTA
GGTTTCTGCTTGAACCTGAAATGTTATTTGTTTTATTTTTTCTCTTTTGGTTCTCCGTAAATGTAAAAGTTTCTTTGTC
ATGCTAGATATAATCTACCAATCTTTATTTGGGTTTTGAATTTTTAAAAAAAAAAAAAAA > SEQ ID NO:4047 112105FL Nicotiana benthamiana
TTTTTTTTTTTTTTTAGTTAAGAATCACACCATATCATATACACCAATAACATCATAAAGGATCACTTTATCCATATAA
CACAAATTCCATTACACTCTAAAAATCATACTGGAAAAACACACACACACACAAATTACATACATGCCAAGTAAAAA
CCAGCTCCGGCGACGGCTACTGAAGAAGTTCGCCGCCGGTAATGAACACTGAACAGTGGCAAAGAAAATGAAAGAAGAA
AAACTTGGAAAATAACAGTCATTATTAAAAAGAATCTGATTAAACTAATCACTTCTTGCCTAAGAAGTCACCGGCCATC
TTAAGATAATCTGATCCTCCTTCAGATGCTTTCGCTGATTCATCATCTCCTGATTTCAGAAATCCTTCTGCCATTTTCA
CGTATTGCCATACCTTCTCCTTCTCTTCCGGTGCCGGCGCCGGTGCTGGTGCCGGTGCCGGTGGTTCTTCGGTATCTGC
GGTTGCCGGTGCCTTTGTTTCCTCAGTATCTGCTGCCGCCGGTGCCGGAGCCGATGCCTTTGTTTCTTCAGTATCTGCT
GCCGCAGGAGCCGGTGCCGGTGCCTTTGTTTCATCAGTATCTGCTGCCGCCGGACGGACGCGTGGGTCGAGGGG > SEQ ID NO:4048 214423FL Trichoderma harzianum
AGCAGCGACTCTTCGTCTTCGTCTCCAACCACCACAATGTCTGGCTACACCGTCCGCAAGGTTGCTGCCCAGAACACTC
TGGAGCACCGCGTCTACATCGAGAAGGATGGCGTCCCCGTGTCGCCCTTCCACGACATTCCTCTCTTTGCCAACCAGGA
GCAGACCATCCTGAACATGGTTGTCGAGATTCCTCGATGGACCAATGGCAAGCTCGAGATCTCCAAGGAGGAGCTCCTT
AACCCCATCAAGCAGGACGTCAAGAAGGGCAAGCTTCGCTTCGTCCGCAACTGCTTCCCCCACAAGGGCTACCTCTGGA
ACTACGGTGCCTTCCCCCAGACCTGGGAAGACCCCAACACCGTCCACCCCGAGACCAAGGCCAAGGGTGACAACGACCC
TCTCGATGTCTGCGAGATCGGTGAGCTTGTTGGCTACCCCGGCCAGATCAAGCAGGTCAAGGTCCTCGGTGTCATGGCC
CTTCTCGACGAAGAGGAGACTGACTGGAAGGTCATTGTCATTGACGTCAACGACCCCCTTGCTCCTAAGTTGAACGACG
TTGAGGACGTCGAGCGCCACCTGCCTGGCTGCTCCGTGCCACCAACGAGTGGTTCCGTATCTACAAGATCCCCGACGG
CAAGCCCGAGAACCAGTTTGCCTTCACCGGCGAGTGCAAGAACAAGACCTATGCCATGGACGTCATCCGCGAGTGCGCT
GAGGCCTGGGAGCGCCTCATCACCGGCAAGACCCAGCCCGGCAGCGTCTCCACCACCAACGTGACTGTCCAGCACTCTC
CCAGCCGCGTGGCCCCCGAGTCTCTGCCTCCTCTGCCTCCCCACCAGGACCTCCCCCCTGAGAAGATTGACGCTTCCAT
CGACAAGTGGTTCTTCATCAGCGGTGCTTCTGCTTAGTATGCTTAATTTACGATGAAAGTTTGATGGCGTCAAAAAAAA
AAAAAAA > SEQ ID NO:4049 57708FL Nicotiana benthamiana
CGTTGGAAATAAGAAGCGTAGGGTAATAAAGGAAGAAAAGTATGCTGCTCGAAGGGCTATCTTGCCCATGCTTCAAGCT
GAAGAGGATGAAAGATTCGTTAAAGAGTGGAAGAAGTATCTTGAAGAAGAGGCTAGAATCATGAAGGATGTTCCCGGTT
GGAAAGTTGGTGAAAGTGTTTACAACTCTGGAAAATGGATGCCTCCAGCAACCGGAGAGCTTCGTCCTGATGTCTGGTA

FIG. 1 continued

ATATGTTGGCAGGAGACAACGAAAACTGCTTTGTTTCAGTGGAGTTCATACTTACCTTTGGATTTCTTTCCTCATTGGA
ATAAAATGTATCTGCAAAATCTGTACACATGTTTAGAATGAAGTTACATGATTTGCTTTAACGCGGTTAGCGTTCTCCC
TCCTATCTCATGGAAGTTCAGATAATCAGAGACAATGCTAGTTCCATGTTCTCTTAAAAAAAAAAAAAAAAAAAA

> SEQ ID NO:4050 214633FL *Trichoderma harzianum*
CCCACGCGTCCGCCCTCATATATTGAAGGCATCGCCAACCCGATCACAAACCTTCTTGTCCAGACTTGCAAACCACTCA
ATCGATTCCTTGATACCCCTTGGGACAACTCTACTTGTTCTCTCCAAACTTACCCCTCCAAATACCATCATCACCATCA
CCATGACCAACGACGTCTCTACCAACGGCTCTTCTGCCGCTCCTGCGACCACCTTTGCCCTCAAGGCTGGTCTCGCCCA
GATGCTCAAGGGCGGCGTCATCATGGACGTCACCAACGCCGAGCAGGCCCGCATCGCCGAAGAAGCTGGTGCCTGCGCC
GTCATGGCCCTCGAGCGAGTTCCCGCCGATATCCGCAAGGACGGCGGCGTCGCCCGCATGTCCGACCCGGCTATGATCA
AGGAGATCCAGGACGCCGTCACCATCCCCGTCATGGCAAAGGCCCGTATCGGCCACTTCGTCGAGTGCCAGATCCTCGA
GGCTCTTGGTGTCGACTACATTGACGAGTCCGAGGTCCTGACGCCCGCCGACGACGAGAGCCACGTCGAGAAGAGCCCC
TTTGGCGTGCCCTTTGTCTGCGGCTGCCGCAACCTGGGCGAGGCCCTGCGCCGTATTGCCGAGGGCGCTGCCATGATCC
GAACAAAGGGCGAGGCCGGCACCGGTGACGTTGTCGAGGCCGTCCGCCACATGAAGACTGTCAACAGGGACATTGCGCA
GGCCAAGGCTGCTCTTGCCGAGGGCGGTATTGTTCGTCTCCGCGAGCTTGCTCGTAAGCTCGAGGTTGACGTCGAGCTG
CTGCGCCAGACTGCTGAGCTGGGCCGTCTCCCTGTTGTCAACTTCGCCGCCGGTGGTGTTGCCCACTCCTGCTGATGCTG
CTCTCATGATGCAGCTTGGCTGTGACGGCGTCTTCGTCGGCAGCGGCCATCTTCAAGTCTGGCGACCCTGCCAAGCGAGC
CAAGGCCATTGTCCGCGCTGTCACTCACTTCCGTGACCCCAAGGTCCTTGCTGAGTGCAGCACCGGACTGGGCGAGGCC
ATGGTTGGCATCAACTGCGACGCTATGAAGCCCGAGGAGAAGCTTGCCGGCCGTGGCTGGTAAATACCCCTATTATAT
GATTTTAGCAAGGGAAAGCAAGAGGAGGAAAAGCAAAGTGTGGTATATAAAAACGGAAGAGACAGAGGAGGAAAAAT
GACTGGCACAGAGCCTCAAAATGTATCTATTCTACTGTTGGATTTGGGCGTTGTGGACTTTTTATCGCTTTGGGTGGCA
CTTAGCATGCTGAACATCAAAATTCTGAAGATGCCGTCAGGATATGCAACCTATTGAGGATTATACAGCATAGCACGAA
ATCTACATTTACTTGTTTGCAAAAAAAAAAAAAAAA > SEQ ID NO:4051 168264FL *Poppy*
AGCAAGATTAGTTGCTTCTGGTTTGCCGAATTTCCATGGAGTATCAAGTACTAAAATTGATGGATTAAAGCTGAAAGAC
CAGAGTAATGGAAGCTATGGTGTAATAGAAGCAAAGAAAGGGAACCCACCGAAATACAGCAAGATTAGTTGCTTCTGGT
TTGCCGAATTTCCATGGAGTATCAAGTACTAAAATTGATGGATTAAAGCTGAAAGACCAGAGTAATGGAAGCTATGGTG
TAATAGAAGCAAGGAAAGGGAACCCACCTGTAATGCCAGCTGTGGTGACACCAGGAGGACCTATAGACCCTTTCATCTGT
GTTGTTCAGGAATCGCATAATCTTCATTGGTCAACCAATTAATTCACAAGTTGCTCAACGAGTAATATCACAGCTTGTA
ACACTAGCAGCTATTGATGAGAATGCAGATATTCTGATATACCTGAACTGCCCTGGTGGAAGTACATACTCCGTGTTAG
CAATATATGACTGCATGTCATGGATAAAGCCCAAGGTGGGCACAGTCTGTTTTGGTGTAGCTGCAAGCCAAGGAGCACT
TCTTCTTGCTGGGGGTGAAAAAGGAATGCGCTATTCAATGCCAAATGCACGTATTATGATACATCAACCCCAGAGCGGA
TGTGGGGGTCACGTGGAGGATGTGCGACGTCAAGTTAATGAACGTCGTTCAATCTCGCAATAAAATTGACATGAGTGATG
CTGCTTTTTACTGGCCAACCTATTGAGAAAATAGAGCGGCAAACCGAAAGGGATCGCTTTTTCTCTTCTGCCGAGGCTTT
GGAGTTTGGTCTAATTGACGGTGTGTTGGAAACTGAATACTGAAATTCAAAGACTGGCACAGGATAATTATAATTCTTT
GCGTTGGAATCGCCATGGTACACAGACTGGTTTAGATAACTCGCTATTCCTAAACATTAAACCAAACTTCTAAAGTAGA
AGGATTATTGATCTTGAGCTCTACAAAGTAAAGTTTTACATTTAAATACCAATACTGGAAGTCTTGGGGTTGTAGTTTT
GGCAGTCTGTAAAGAGGCATTTCATGGAAATGCAGCATTATGAATCAAGTAAATTAGTTACAATACTATCTTTTCACA
AAAGACATTGGTGTTTGTTTCGAAAAAAAAAAAAAAAA > SEQ ID NO:4052 119262FL *Nicotiana benthamiana*
TTTTTTTTTTTTTTTAATTCTGAACGAGCTTAATCTTATATAAAATTTAATTTTTTTCCTTTTGCATAAGTATACATA
ATTGAATCTACAGACCTCGTCCTAGATTCAAAATTTTATTCTAACACATAATCTCGAAACTTCATAAAATGTATGCGAA
TCTGTTCATTTGGGAGCGGAAGCAGAAGTTGTAGCAGCTTGAGAACGAGCTCGGAAAAAAGCAAGCAACTCATCTCTTG
GAGGCAGAGATTCCTTGAGTTGGCTGCAGTTAGTGTACTCATCTCTCCACTTAGAAAAATTTGGAAATTTTTCACTTGT
CATTAAAACAATTCCAGAGGCTTCTTCGAAAACTCCTAGCCAAAATGCCACCAAATTTGCTGCAATATCAGCAAACCCA
AATTTGTCACCTACAAGAAACTTCTTATCCTTGAGCTCATTGTCAAGAACTTTCAACATCTCCCAAACTTGCTCTTTAG
CTTTTTCTTGTTCCTCCCCTTTGCTAAGGAAAGTATTCACTATTACAGTCACCTTATCGTCAAGGAACTTAGCCCAGAA
ACGAGCTAAAGATCGATCATAAGGGTCTTAGGCAAAATGGAAGGACCTTCAAAAGTCTCGTCAATGTATTCAAGAATG
ACAAGAGACTCAGAAATGGGTTTGCCATTGTGAATAAGCACTGGTATTTTCTTGTGAACAGGGTTTGATTGAAGAAGCA
GAGGGCTCTTGTTTTGTAAATCTTCTTCTACAAATTCATATTTCACGCCCTTAAGCTTTAGAGCCCACTCAACTCTGTG
ACTAAAAGGGCTATACCAAAGACCAAGCAACTTCACTCCTGCCATATGATATCACTACTTTGGTTCTAAATGTTTTTGC
GGACGCGTGGGCGGACGCGTGGGTCGAGGGG

FIG. 1 continued

> SEQ ID NO:4053 57506FL *Nicotiana benthamiana*
GGCTCTTTCTTTGACCAATGTTCTTCATTTTGCTTCTCCTCTTGAACTGAAAAATTCATTGTATTGTGACAATTGGTTG
AAGAAGGAGTACCACAGTGGGGTTGGGATGTTTGGGTCTGGAATGAATTTGATAACCACAATAATTGGTTTTGGAATGA
GTGCAACTTTTATTGTGTTTGTGTGTATAAGACTGATTTGTGGGAGGATAAGCAGGAGACAATCAAGGCAAATGTTTGA
GATTGAATCAGGGATTGATCTTGAAATGCCAGAGCATCGAATTAATGGGCTTGACTCAGTTGTGGTTGCTGCAATTCCC
ACCATGAAATTTCATCGCGATGCTTTCACCTCCTCGGAAGATACACAGTGCAGTATATGTTTATCGGAGTACCAGGAGA
ACGAAGTTCTGAGAATTATGCCCAAATGTGGCCATAATTTTCATCTTTCATGCATTGATATATGGCTAAGGAAACAGTC
TACCTGTCCAGTTTGCCGTCTTTCTGTACCTGAATCCATTGAAAATAAACAAAGGCGTCCTCCAATGCTTGGCAGGGAT
CGAAACTCTGATAGTTCTGAGATTTCAGTTGAGCATTCAAGGCAATGGCTGCTACCTATTGCTGAACAGTCGCAGGGTA
CTGTAAGTAACAGCAACGAAGCTGTTTCTGTGTCAATAAACCCTGCATCTGCAGTCTCTGCGGAAGCAGAAGCAAGGTC
ATGACAAAAGGCAAACATAGAGGTACCATAAGATATTTGCATTCAGATGTTTCTTGTATCAGACCCATCTTATTGGAG
ACTAAAAAATGAGACTGATTCTGAACAAGGAGAATCTGAAGATAAGGAAGGAGGACACAGCTTCTTCTGTAGTTTAATG
TTGCATATAACCAGTTAGGAGTTGTAGTTGCACTCTTTTAAAGATTTGGAGATTTTGGGCCAAGTTTAAGGTACACTGG
TTATCTTGTCCAAACAAAGTGCATTTTCTTTCATATTGTACAATGCCAATCCGCTGGTAATATTGCTGCAAAAAAAAAA
AAAAA > SEQ ID NO:4054 168151FL Poppy
GTCGACGAATTCCCCACCACTAAAATTATTTTTTAGTGAGAGAAATCTTTTTTTGGGGTTGAGAGGAGAGAGAGAGACA
CACAGAGAGAAAAAATGGCGATGGCAATGGCACTTCGAAGGCTCTCATCTTCTTCAATCAACAAACCTATCCGTCCTCT
CTTCAATGCCGATTCCTACTATTGCATGTCATCTCTTCCAAGTGAAGCTGTTGATGATTCTAAGGATAAATCTCGTGTT
CAATGGCCAAAGCAATTGAATGCACCATTAGCAGAAGTGGATCCAGAGATTGCTGACATTATTGAGCTTGAGAAAGCTA
GGCAATGGAAGGGTCTCGAATTGATTCCTTCAGAGAATTTCACATCTGTGTCGGTCATGGAAGCTGTTGGCTCTATCAT
GACTAACAAATACAGTGAAGGTTATCCTGGTGCTAGATACTATGGAGGAAATGAGTACATTGATATGGCAGAAACCTTG
TGCCAGAAACGTGCCTTGGAGGCCTCCCGTTTGGATCCTGCTAAATGGGGAGTTAACGTGCAATCTTTGTCTGGGTCCC
CTGCCAATTTCCAAGTCTACACTGCACTATTGAAGCCCACGAGAGAATTATGGCACTTGACCTTCCACATGGTGGGCA
TCTTTCTCATGGGTATCAGACTGACACCAAAAAATATCTGCTGTATCTATATTTTTGAGACAATGCCATACCGATTG
GACGAGAGCACTGGTTACATTGATTACGATCAGTTGGAGAAGAGCGCTACACTCTTCAGGCCGAAACTGATAGTTGCTG
GTGCAAGTGCTTATTCACGATTCTACGATTATGCACGCATTCGCCAGGTGTGCGACAAGCAAAAAGCTATATTGTTGGC
AGATATGGCTCACATCAGTGGGCTTGTTGCTGCTGGTGTCATCCCATCTCCATTTGAGTATGCCGATGTGGTGACCACT
ACAACACATAAATCCCTTCGTGGACCACGTGGGGCGATGATATTTTACAGAAAGGGATTGAAGGAAGTCAACAAACAAG
GCAAAGAGGTCATGTATGACTACGAGGACAAAATTAATCAGGCCGTGTTTCCTGGTCTTCAAGGAGGTCCACACAATCA
CACAATTACTGGATTAGCAGTTGCACTGAAACAGGCAACTACCCCAGAATACAAGGCTTATCAAGAACAAGTGCTCAAA
AATTGCTCACAGTTTGCCAAAACCTTGAACGCATTGGGATATGACCTTGTTTCCGGTGGTACTGAAAACCATTAGTCT
TGGTCAATTTGAAAAACAAGGGTATTGATGGCTCAAGAGTTGAGAAAGTAATGGAATTGGTTCATATCGCTGCTAACAA
GAACACTGTTCCCGGGGATGTCTCTGCCATGGTTCCTGGTGGCATTCGAATGGGAACACCTGCTCTCACTTCAAGGGGA
TTCCTTGAGGAAGATTTCGCTAAAGTAGCAGAGTTCTTTGATGCTGCTGTGAATTTGGCCTTGAAAGCCAAAGCTGAAT
GCAAAAAGGTGCAAAATTGAAGGACTTTATGGCCGCGGTTGAAAACAGTGCTAGCATTCAGTCTGAAATTAAACAGCT
CCGTCATGACGTTGAGGAATATGCAAAGCAATTCCCTACAATCGGGTTCTGCAAAACAACAATGAAATACAAGCAATAA
ACTCCACTATTATAAGTGGGCATATATGCTTCGGTAGTGCAGTGGAGTATCTACAAAGGCGAATGAGATGGACACGGGA
AGGGAGCAAACTGCCTTTTAATGTAGGGAATATATGAATGCTTTCAATCAGTGAATGGGATATATTGTTGACACTACAG
GGTTCTAAGCATGAAGAGTACCATTTGGTTCAAATTTCATTCTTCATTCAAGAATTGAATTATATGTATATTATTAA
ACTTGATCAATTATAATGCAACAATATAAAAAAAAAAAAAAA > SEQ ID NO:4055 215951FL *Trichoderma harzianum*
AGATTGCAGGCACCCTCAATTGGCATCACATCATGCTGGCGACAAGAGCACTCCGAGCGGCCCACGGGCCCAAGCCCAA
CATCACCGGCTTCAACATGCGAGCCCTCAAAGAGGCCACTGGCCAGCCCCGATACGACCCTTGGGAGAGAGCCGAGGCA
TGGCGATACAAGGGCACCTTTTCCAGATGGAACCGATTCCGGAGCGGCTTCCCTGGCTTGGGAATCGCGTCTGTTGCAT
TTGCCGGATACTGCGCCTACGAGTACCTCTTCCTCAAGGATGAACACCACGGCGAGGGACATGGCGAGGGGCACCACTA
GAGCGTTTTTTTTTGCGAGCGAGAGCAGTCAGGAGTGTGCGAGAGGAGAAGAGAGAGGAAATGTATATACATCTCTCC
AAAGACAAGAAAACTCAGGCCTGGTCTTGCGGCGGGCAAAAAATGAATCCAACACAAATCAATATAAACTCTATTTAGA
AAAAAAAAAAAAA

FIG. 1 continued

> SEQ ID NO:4056 216043FL *Trichoderma harzianum*
CGGACGCGTGGGCGGACGCGTGGGGATCAATGGAACATGAAGTTGGATGTGCGCAGTACTGTAGCATCACATAGACTAG
AAGCTACATGGAAATGCGACACAGTGTTGCACATCCGAAAAAAAAAAAAAAAAA > SEQ ID NO:4057 216147FL *Trichoderma harzianum*
AAGAGGCAGGAAACTCTCTTTTGGCCCCAGAAAATGCCAGACTAGGTCCGAAGAACTATCGATTCTAACGCCGATGATG
TCGCTTGCCGGCAGTCGAGGGCTCGGAATCGGCAACGCGGTTCCTTGGTAATTGGCCACAAGCTGGGGCACTATCTGGA
GACTATCCGCCCGAGCTGTCCGTTTGGCCTTTCCTAAATTGCCCATTCGAGTTAATGATGTAATGAGGAGAGGGACTCT
TGAAAATGGATATAAGGGCGCAGTCGCGCAAGCTGTTCTGAGCTGAAAAGAAAGGAGAGAGAAGGTCTCTGTACAAGCA
GGAGAACAAATCTTATCTCAATTGCAATTTGAAATTCCATCGCCAAAAAAAAAAAAA > SEQ ID NO:4058 216234FL *Trichoderma harzianum*
TTCACGACCATGGGACTCACCTTGAGGGTGTCAGCAGTTGTAGGCAGTATCTTAAGCTGACACGGACACCGTGCTCGGA
AATTTTGTCAATGGCAGCGTCCGTAATAGACACACCCTCTGTCGTGGCCCGGAGCTTGACAATCTTCTTAATCTCGTCT
GCCGAGTATGGGGAGGTGGGGATGATGAGCATTCGGGCAAGGAAGTCAGGAGGAATGCCATGAGCCGCGACAACGTCGT
CGGTACCTCTTATTGTGGACATTCCACGGTTGGATGCCAAAACCACAATGGGGGCGAGGTGTGATTCCAATGCTCGGTT
TAAATAGGTGAAGCACTCCACGTCAAGCATGTGAGCCTATTGTAGTCCAGTGTTAGTATCTGATACCAGTAGATTAAAA
AAAAAAAAAA > SEQ ID NO:4059 216315FL *Trichoderma harzianum*
CCCAAGTCCAGATAGTCAACAGATCAAACACAAGACAAACCTGCCTGTTCGATTACTTTGCCTCCTTGTAGTACAATTC
GCAATAGTTCACCAAATCACCAGTCATCATGCCTGTCACTGAGTTTGCCATTATCAAGCTGAGGCCCAATTTCGACCCC
CTCGAGTTTCTCGAGACACTCATGGAGTGTCAAGAGATTCAGGACAATTGGATTCGCCGCAATCAGCCATGCAATCTGG
CGCCTGGCATGAACCTGAGCAGCATGTACACGGATGCCACAGACCAATCAACACTTCTCATCACGGCGCCGTGGGATTC
GCCCGAGGGGCATGGGGAATGGATCCAGAGTCTTGAGAACAGGACGGCCAATGGCAACTTAACCGAGTTCAGCGCTCCG
GGTTGCGACTCCGTCTTGCTCTTCCACATGGACCCGGCGGGAGCGAGGCCACAGATGCGGGAAGCCTTTCAGCACAAGG
ATACCAACGACGTATTCGACGTCTGTCGCTTAACATTCAACGGCGATCAGCGGGAGGCAATACAAACCAAATATCAAGC
ACTGGAAAACGAGCTGCGAAAGGAAGGTCTGGACAAGAGCATATGGGCGGGCTGGAGGATTGAAAAGGCAGCTGGTGAG
GAAGACAAGGAAGATTTGATTGTATTCTGGACTGGCGATGTTCCGAAGAAACGACTGGAAGGATTGGCGAGCCTCGCCC
TCAAGAAAGATCATCGCCGCTTCAGGCACGTCGTGTAAATAGGCATCACCGAGTAACCGGGGGGGCTCCCTTTCTTCAG
GTAGCATAGCCGGCACAAGAAAGACATCGGGCTCACCAGATTTTGGTGTGCGATTGTTGAAAAAAAAAAAAA > SEQ ID NO:4060 216406FL *Trichoderma harzianum*
AACCAGACGGAGAGTCTGTTTCATACCTTTTCCCAGTTCTCGACTGGATCCAACATCCCACCTAAGCCATCAGCAGAGG
AGCGTGACATAGAAGCGAGATTGGAGGATGTATTAGACAAGCGCGACAATGTCATCGCCCAGCTCGCCCGACTTCTGGA
TTCTGAAGCATCCCTCAACACATCCGCGCTCAAACAAAACAACCTATCCCTGCTCCGAGAGAAGCTTGCCTCTCATCGC
CGCGACCTGACCCGTCTCAAGTCTACACTGCAGCAAGCTCGCAATCGCGCCAACCTCCTCAGCAACGTGCAGTCCGATA
TTGACGAGTACCGCGCGAACAACCCGGAAGCTGCCGAGGCCGATTACATGTTGGACGAGCGTAATCGCATCGACAGAAG
TAACGATGCGACAGACAGCGTCCTCAGCCAGGCATATGCTATCAACGAAAGTTTTATTATCCAAAGGGAGACCTTGGCG
AGCATCAACCGGAGAATAACCATGGCCGCCAGCAAAGTGCCAGGCATCAACTCAATAATTGGACGTATAAGTACCAGGA
AGAGGAGAGATGGAATCATTATGGGAACTTTTATCGCATTGTGCTTTATCGTCTTCTTCTGGTTCAGGTAAACGGGCCA
TCATACATTCACCGGTGCTGCACATGTCGTTTGGCGTTTAGGGGGGGTATATCAGCGGTTCTTGTCTACTTGTACAATA
TGGCAGGATCCATAAAACATATCTAATCTCTTTGTCGTTTTTAATAATACAGGCGCAGGATTTTGGAGAGA > SEQ ID NO:4061 216461FL *Trichoderma harzianum*
AGCCGAGTTAAGCGGCGATAGAAGCAACAAAGGTGAAGTTGTGCCGGTCTGGTGGTTTATTGGAAAGAAACGAAGAGAA
GAATGTTCCGGTCAAGGGAAGCGGCCTTTGGTCAGTAGCCAAAGGGCAGATCAAGCGCCGCCTTGGAGGATTAAAAGGG
CGGCTGCAGGGGTCCCAAGGCTGGTGCGCCTCATGGAATTGTATCGAAGAAAGTCGATGGTGTGGCGGTGCCCGATAAC
GCAAAAAGCTGGCAACCTTTGTGCTGCCATGCGGGCTAGCAGCGGGTACCGCCGAGTATTTGTTTGTCACTGTACAGAG
GCGAGACGTGAGGCCGAGATTCGCATTGGTTCGGAGTCTGGAGTAGGGAGGACAATATGGTAGCACGATTGTCATTGTG
ATTGCTTTGTTTATTAGTACTTAAAAAAAAAATAAAA

FIG. 1 continued

> SEQ ID NO:4062 215952FL Trichoderma harzianum
GTTCTTGTCATTAATTAACTCGACCCCGCGTCCGTTGATACCCTGTTTTGATATACAACTACTACATGTTGGGCAATGA
TGGCGCAAGATGGGATGGGATGGGACAAGGAGGACTTACAGCAGGGACTCAAAGGTATATCCATCTTACCTCCCTCGGG
CACTTGAAGCATGAAGCTTTGTTTTGTTTTTGCAACACATCTTTGACCGCTTCTGCATGTGGTTCCATGTATAATTATC
ATTTCATTTGTTTGCACGAACTTGGGAGGGAATTTTTCATTTGTATGGATCAAGATGTATGAGGCACGGGCATCTCATG
ACAAGATGGCTTGTTATGTAATATTATTTGATGTCATACGACATGAAGCAAAATATTTTTTACAAAAAAATATTATAAT
GAAAATATCTAAAGATGTAAAAAAAAAAAAA > SEQ ID NO:4063 216050FL Trichoderma harzianum
CCCAGCACCTTGTTGATACAGTACAGAAATGCTGCCAGTCGTACGAGAGCCATGGGTGCTCCGTCGAGCGCCTCTAGCT
TGACGCCAGAAGGATCGAGGCTGATTGACGATGGAGCCCTGGCCCGCTTTTGGTCCTGTGCGCGACAGATGCTGGGATG
AGGAGAATCGTGATGACGAATATGTATTGATATCATATCGTGAGAGAGACATGGTTGGGGCTTACTGGTCTCTGTACGA
GTACGATGCTGTACGTTCGTGTTGAATTATCTTGTACTGTATCGTGTTTTGTCGATCTGGGTGGTCAGTCTAAAAAAAA
AAAAA > SEQ ID NO:4064 216204FL Trichoderma harzianum
ACAAGACATTGATCCTCAGTGGTTTTTGGTGGAATGCGCATCCTTTCTAGCCTTTATTATCTGCTGTGATGTTGAGGGG
CACAAGAGCTGACTGGATTGGCAGAAGATAATGGCAAAAAAGAGATGCGCAAACGTTAGTACAAGCTCGACCAAGAGCA
TCATCTTTACCATCACATCTCATTTTTCAAATACATGAAATGGTCAGATATATTCATACGTGTCCAAGCGTTCAGAAAC
CAGCCAATCTCAGTCTTACATACTTGGAACATTTACATAGTATTGAGTCGCCTATTCATCAGGAAATCCTGGTTCAACA
AAACTCCTCCACTCAAAAAAAAAAAAA > SEQ ID NO:4065 216238FL Trichoderma harzianum
CAACCTCATAACAACCACAATGGCTGCACAAGAAGGACGAGCTCCATATCCGCCATTCACACTTGAGACAGCTCAAGTC
AAAGTCAAGGCCGCTCAAGATGCTTGGAACACCAGAAACCCAGATGGTGTCAAAATGGCATACACCCCAGACTCAATCT
GGCGCAATCGCGGCACATTTCTACAAGGCCGCGACGAGATCAAGGCGTTCTTAACCGACAAATGGAGCAAAGAAGACGG
CTACCGACTTCGCAAGGAGCTTTTTGCTTTTACAGACAACAAGATTGCCGTGCAGTTCTGGTACGAGTGGCATGATGAG
GCAGGCCAGTGGTGGCGCACGTACGGGCTTGAGGACTGGACTTTTGCCGAGAATGGGCTGATGAGGAAACGTCAGATGA
GTGGAAATGACGTGAAGATTAGCGATGCGGAGAGATGGTTCAAGGATGGCGTTGATGTGAACACCGTCGACATTTCCGA
GAAGCACTGGTGAGGGAGGCTATTTACTAAACTTTAATGAAGTCTTTTGAATATATAGATAAGCAAAGTTTGGTTTATG
AAAAAAAAAAAAAAA > SEQ ID NO:4066 216274FL Trichoderma harzianum
CGAATAGTTTAAAGAGCAAGGGTATAAGACTGAATTAGAAAGTCACCTCCAAATAGCAAGAGCTAATGATAGCTCCGTG
TTGACTAAAGGCATTGCAACTCTATACTGTAGGTAGTTTAAAGCTCTCAACACTAAAAAAAAAAA > SEQ ID NO:4067 216318FL Trichoderma harzianum
GTCGTGGATAGCGGATGGATACTTGCAGTAATATGGGGTAAGTGAGTGAGTGAGTGAGTGATATGGATACAGCGGGATG
ATGATGATGGTGGTGGTGGTGGTGTTGTCACTGATGTTGTCGAGTGAGTTGTTTGTTTTGTTTACCTTTGGAATTGATT
GAAATGAAATGAAATGAAACAGGAAAAAAAAAAAAA > SEQ ID NO:4068 215953FL Trichoderma harzianum
GGGAGCTATGATGGGCTTCATGGCGTGGAAATTGGTTTGTTTTCTCTCATTCGTTGACTCTTTTCAATCAATATACACA
AGCAGATGGGTATTGGTTAAAGAGGGCGAGCGAGCAGAGATTCACTTCAACGCAAAGCCTTGAAGAGAGAACAACTACTATA
GCAGTTACATCACCACGTCCAAACTATTTCGTGCATCAGGAATCCTGCTTCTTGGGACGCGCTTGTGGCACCTCTTCAT
CAATGGGCATCAGTGCGTCTGCCGTGGCATCTGCGCGACATCGTCACGGCATAAACTGGCGCTACACCTCGTGTGTCTT
CCTCCAGGGTAGAGCCGGCCAGCTGCGTAGTTATGCAGAGGTAGCTTCTTGAGCCCATTGGCGGTCAGGTCACTTGTCG
CCCAATCCGAGCTCAGGAGGCACTTGCATGGAATTTATGCGGATGACGCTTGCAGAAGCGTTTGGAATACAGTATAGGT
GACTACCTCGAAAAAAAAAAAAAAAA

FIG. 1 continued

> SEQ ID NO:4069 216152FL *Trichoderma harzianum*
AAGACGGATTACTCGCACATATCGCGTGAGAAGAGCCTCCTCGTGGTTATTTGATGCTAGAAACCGCAGGTCCGTGGGT
TGTTTCGGGAGAGGAGGAAACCCAGGGGAAAGGGTCGCTTTGGATGAGGCTGTGCCGTATTAGCCGCGTATATTGCCAA
TGAGTGTGCTGTGTTTGGTGGTTGTGTTGCCTTCAAGATGCAAAGTAATATATTTCCATCTTGGCATAGCATGTATTGC
TACGTACGTAGTAGTATGCAGATGGCTGGGATTGATGCTCTTACATGGAGTATATTCCCAGCTTCCTAAAAAAAAAAAA
AA > SEQ ID NO:4070 216280FL *Trichoderma harzianum*
CGGACGCGTGGGCGGACGCGTGGGCGGACGCGTGGGCGGCATTTGACATCTACAATTGGCTTGGTGAAGGCTGAGCTAA
TAGGAGCTGTGATGCCTCGGTATTCAGACTCAGGAGGCGGCCTTCACACTCTTCGCCACAGCCAACCCGAACTCTATCG
AAATATCCTCCACGTACTTCGTCTGCCACCCGTCGACTGATGCCTTTGAACACGGGGCCGCCCGAAAAGGCCCGAGGCC
CGACAACGAGGAAGGGAAAGAGCCCGCTGGCGCCTCGTTTGATCGAGGCGGCTATGGGCGGAACTGGTACAGTATGGA
AAGAAGAGGACTAGGAGAACTACGAGGAGGGCTAAAGAGGCTCGACGCCGGCGTGGCCGAGCGTGGAGTCATCTCCATT
TGTCCCGTAGAAGGGACTTGTCGTTGTTGGGAGAGTATGTATCCTGTCCAACATGAAATCATCGAGAGAATTTGCCTCT
GTCGAAAAAAAAAAAA > SEQ ID NO:4071 216365FL *Trichoderma harzianum*
ATGAGACCTGTTCGGAAGATTCTGCAAGCGACTCATTTCAAACCCGTAATGAAAGATGGCAAGAGAATGTTGACGCCTT
GCTCTCCAGGAGACCCGGAGAAGATTGAGATGACGTACGACGATGTCAAGCCGGAAGAACTGTCGGCTCCGGACGTGAC
ACTCCAAGATTTTGAGATAGCTTTGGCCGACTCACATCCTACAGTGTCCAAGGATGACATTGAGAAGCAGATTGAATGG
ACGAATGAATTTGGAAGCGAGGGAGCTTAGGCAATGGGGCGTGTCTTTGAGAGTACATGGCACAGCGGCGCTTTGAGGA
GTTAGAGGGGCATCTAGGCACTCTTTGCACATACAATGTTGAATTCGGGAATCGTAATGCATCTGTCTTACTGGAAAAG
AAGAAGAAGCTGTTCATATTCGATTCTTTTTATGGTAGATAGTGGGCCGGCATCTTTGTAGGATGTGATTAATTTTGAG
TCCAAGATGAATTGGTAAAAAAAAAAAAAAA > SEQ ID NO:4072 216425FL *Trichoderma harzianum*
TAATAGATCTTACAGTATCACTACTCCATCTCAGTTCGTGGCCACTGAACTGCGCAGCTTCGGCGAGGAACCATGACTT
TCCTCATACTTGTGATTGGGGACCTGCACATCCCGGACAGGGCGCTGGACATTCCCGCCAAGTTCAAGAAGCTGCTTGT
GCCCGGCAAGATTGGCCAGACTCTATGTCTCGGTAACCTCACCGACAAACACACCTACGAGTATCTCCGGTCCCTGTCG
CCGGACCTTAAGATCGTCAAGGGCCGCACCGATGTCGAAGCCACGTCTCTCCCCTTGACGCAGGTCGTCACTCACGGCG
GCATCCGAATTGGCTTCCTGGAAGGCTTCACGCTTGTTTCTAACGAGCCCGACCTGCTTCTAGCTGAAGCCAACAGACT
GGACGTCGATGTCCTGTGCTGGGGCGGCACTCACCGTTTCGATGCCTTTGAGTACATGGACAAGTTCTTCGTGAACCCG
GGCAGCGCGACAGGAGCCTTCTTGACAGGAGCAAGCCTGGATGCGGAGCCTACGTCTCCAAGCTTTTGCCTGATGGATG
TCCAAGGCATTTCATTGACTCTCTATGTTTACCAACTAAAGACGGATGAAAAGGGAAATGAGAATGTGGCGGTAGAGAA
GGTTACTTATACAAAGCCCGTGGAGCCATCTATGGGTTCATCATGACACACCTGACTTAATTGTAGAGAGAGGATGCTC
AGCTAATAGAAACCATTGTAATTGCCGACGGCAGAGGTAGAGAAGAGTCAATACCCGGGCCAACCCAATTATACATAAC
AACTTGGTGCTTGTCGGTGTACAAGTCTGCCATTACTTTCAAGAACCAGAAAAAGCATAAAGATAAATTCAAATATCAT
TCGTAAAAAAAAAAAAAA > SEQ ID NO:4073 216010FL *Trichoderma harzianum*
GACCATTACTCGCATTTGCGTCCAGAGATTGGAGTTTGATAATTTTTACAAACTTGTACATAATACTGATGCATTCAGC
CCTTGGTCCTGATGGCATGAGCAGACATAGCCTCGGCCGACGATTTTGCCCCTGCAATGGTTCTCTGCCGATGTTTCCC
GCAGCTTCTTGGCAGTTGGGGTAATACGATAATACGACGATGGCATCTTTGGCCTGCACGCCGAATTGGGGTCAAATAG
ACGGTATTCCGAACATTTCATATTTAAGAAGCTGTGCTGCACGCCAACCAACCTTTGGAATGGTGTGAATTGTGAAGGA
CATGATGCATGGTATAGGCCATGAGCTAGTCTCAGAGAGATGGAGCCTCCGGTGTAAAAGTTGTACATTAATACGATCA
AAGCCCGCTACGAAAAAAGAATGGCAATTGTATTACCCACGAAAAAAAAAAAAA > SEQ ID NO:4074 216055FL *Trichoderma harzianum*
GCTGGCGGCAAGTAATACTGTAGCAGGTACCTCGTGGAGCTCCATCGGGATGGGCCGGTTGGGAGTCGGTTGGGCACA
AACAAGGTTTCTAACTGGATCTATTTCTTTCCATGTGTCTTTTAATCATTTTGAATTTTATTTTCCCCGGAGGCCGTGA
CACGTTTTTGACAGATGGGAGGAAGAGGCGGAGGCAGAGAGCAAAAAAACGCTCACACGTGTCAGTCCGTAGCGGTGCC
TTTTTTCTAACTGTCCGTATCTGGTCAGAGGCGGCGGCAGTAAATAAGTGTTGCCTAAAAAAAAAAA

FIG. 1 continued

> SEQ ID NO:4075 216109FL  Trichoderma harzianum
CCCACGCGTCCGGATCTTGCTGGGAGCTGTGATTTTGGCAGCGCGAAGCGTTTCCGGGTGCCAATTCTCACCACTGCAA
TCACAAGTCCCGAGTACTACTCTGTCAACCATGGCCTCGATTGTGCGACCTTCTCTGCTGCGGCAGACTGCGCTGGCGG
CTCGTTGCGCCAAGCCTGCTTTCCGAAACAACGCCATCAAGGCTTCGGCTTTCCACACCTCGACTCAGCTCTCTGCCTT
TCTGCCTCCCGGACCTCAGCGAATTGAGGGCACAGTCAACGACCCTGCCCCTATTCCCCAACCTAACGCCTCGCACGGC
TCCTACCACTGGACCTTTGAGCGCCTCCTCGCCGCCGGCCTCGTACCCCTCTCCATTGCTCCCTTCGCCGCCGGCTCTC
TCAACCCCACCACCGACGCCATCCTGTGCTCTGCCGTCCTCCTGCACTCTCACATTGGCTTCCAGTCCGTCATCATCGA
CTACATCCCCAAGAACCGCTACTCCGGCCTGCGAAAGATCTTCTGGTGGGGCTTGAACCTGGCGACCGTCACCGTCGGC
GTGGGATTGTACGAGTTTGAGACCAACGATATTGGCGTTACCGAGGCTATTAAAAAAATCTGGAAGGCATAAGGATGAT
GCTTAAAGAAGAGAAGGCGAGACGAAAAACTTGATATCTTGTGATTGCTTGCTGGGGAGGGAATTCGTTGGGTTTGGAG
GCAGGCTGTGTAACTGATATTATGCGCTAATTGGGCCAAGAAAGGGCTGTGAGCGCTTGTATAGAAGTACGATCAAAAA
AGAAGAAAACCACATTACTTTCCAAAAAAAAAAA > SEQ ID NO:4076  216212FL  Trichoderma harzianum
GTTGGGACTGCCAACCTCCAATTGGATGCGCATCGTGGTTTGAGGGAACATGCGACAATTACCTTCCTCAAACACCACA
GTCAATCAATCCCGCTGACAGCCGAGGGATTGCCCCCCATGCCGCCGCATCTGCACCCACGGTCACGAATGACCTCGTC
ACTCTTCGCTACGACGGTCCTTGCCAGCTTCTTCGTTGTTGCCCTACCGCACTTATTACCATGCCCGGTCCCGCGGACA
AAGTACGCTGATGGAGAGATTATCGTCGACGAAAACGGCAGACGGAAGAGATGGAAGAGGAGGGATGTCGATACAAAAG
ACGGACTTGTGCAATTCAACCAGACAACAGACGATGAGATTGAGCGTGCAGCGGAGCGAATGACGAGGGAATGTCCCGT
ACCGAAACCCGGAGGGATGTTGGGAGAGTGGCTCGGATTCCACGCCACGGAAGACAAGACAAGGGCAAACAGATGACGA
TTGATACCGCCAAATGAATAAAAAGCAAAGAAAAAAGTTCAAATATGAAGAAAAAAAAAA > SEQ ID NO:4077  216249FL  Trichoderma harzianum
CCCCAATCGCCAAATACACAAATCCATTGCGCTACAAAGAACAAGCACCATGGACGCCAAGCCTGCCACTTTCTCCTTG
GCCGCTGCGCCAGTTGCTTCTCCCGCAGCCTCCGCGAGCGCTTCCAAGCCCAAGCCGTGCTGCGTATGCAAAGAGGAAA
AGTCGAAGCGCGATGAGTGCATGCTCTTCTCAACGGCCAAGGATCCCGCAGCCGACTGCAGATCGCTCGTTGACCAATA
CAAGAGCTGCATGCAGGGCTTCGGATTCACTGTATAAATCAAAATATCTTCATCTTGGCGCTATGCCTTTGTACATTAT
CACCATATAGACTACTCGGAAAAGTACAGCGCTCGATTATTCTACAAAAAAAAAAAA > SEQ ID NO:4078  216283FL  Trichoderma harzianum
GATTTCTCCACCACTCGCTCGGCATTTGTTCTCTCTTCCTCAGCGATTTAAAGGACCTGACCCGTCTCACGAATCAAGA
GGCATAACCGTTACTGCCATCTCAGACCGCTAAGCAGCGATATCGTCATATTCGCGGCGCTGTGAAGGACAAGAACGAG
AACGAGAACTGTTGAAGCTTGGCTCACCCAGTCCCCGCAGCAATGGGCCTGGCCTACAACACCTACCTCACCAGCAACA
AGATCTACGGTTGCAAAACATGCAAGGCGCATCTTGCGAACCACGAGGACATCATCTCTCGGAACTTCCGGGGCCAACA
TGGCAAGGCCTACCTGTTCCATCGTGTCGTCAATATCGACACCGGTGACCCTAATGAGCGTAACATGACCACCGGCCGC
CACATTGTCCGTGACATCGCCTGCCATCAGTGCAAAGAAACGGTGGGTTGGAAGTACGACAAGGCTTTTGAGACTTCTG
AAAAGTACAAGGAGGGCAAGTTCATCCTTGAAGCTGAGCTGCTATGTAACGTCGCTTGATTGTACGAATTTCACCTCTT
TAGCATGATTTCATCAAGATGGGCCCTTCTTTTTTCTCTCATGTTTTTGTTCTTGGCTTCAATAGGCGTTCAACAGATA
GTAGTTTCAGACAAAGCACAGCATCCTTGGGCTGGAGTGATGGTTTCAAGAGCCGAATTTAGACATGTTATGTACTAAA
AAAAAAAA > SEQ ID NO:4079  216329FL  Trichoderma harzianum
GATCGGGATCGAGTGGGGAAATAAGATGGAAGTCGAGAGTGCCTTATGTAAAAACCTGACCACCGGCAGGATGGAATCA
CCAGAATCACCAGACTTGTCTCCGGGTCTTTCCTCTATCCTGCATTTTCCTGCAGGACAGGGAGAGCTGCCTGCACCTG
CACACCGAGGTACCTGGATACTCCGCGTGGTGAGGGGCAGGCAGCGTGCGTCCGAGGTACTGCCAGGCTGCCAGGTACT
TGGGACGGCAGTGCACAAGCTCCGTACTTGGCGCGCCCTGCCCTTTGGTCCAGCTTTGGGAAGAGATCTCCGTTCCGGC
TGCCTATCCTCCGCTTTCGTGCAGCTGGGGGGAGGGTTAAAGACGGCTTTCGGTCAAGAGTCGAATCGGTCCTGATTCA
GAAAAAAAAAAA > SEQ ID NO:4080  216432FL  Trichoderma harzianum
GGTGATCTGAAGAGAATGGGTCGACCAGCGCTACTTGTACAGTATCGAATGCACGATGCGTCTTATGATCAGCGCGTGT
CTTGCACATATGCATACGTCAAACAATGCATCCTCCACAATCTTCATCATCACTCCACAAATAGCTTCCATGTTACTTT
CCGCATTCTAGGTACCGCCTCAGTGTTGGCTGAGGTTTGCCACATGCACACCATTGTTGACGTACCATGTGGCTCAGTT
CAGCCATCGACATCTCCAGACAAGCCTACCAAAGAAAGTCAGCCTCAGCCTTAACTGCTCTCGGAGGGTTTCAGTCATC

FIG. 1 continued

AATTAGCCCTACAGCTCCGCCTTCCCTCGGCCCGTGCGGCAAAAGACGACTGGAGATCTAGATTGTGAGAAATACGAAG
ATATTAGTGGATTTCTCGTACCAGGAACGAGGACAAAAAAAAAAAAA

> SEQ ID NO:4081 216471FL Trichoderma harzianum
GAACAATGCAGCTGGTGACAGGTTTGTCAAGTGGCAGGGGAGAATCGTATTCGTGTGGCGATGGTGATGTCGAATTTCG
AATGAGGGAGCCTTGGCCGCGAAGAAAAAAGAAGAGAGAGAGAGAGCGGAGAGGAGAGGAGAGGAGAGTGAAAGAAGGAG
AAGTAGAGAGGAGAGAGGAGAGAGACGCTGTGGTGCTAAGCAACCACGAGAGAGGAAGATGAATGCGGTTTACAAGGTT
GACATTGGCGAACGAGCTTGGACCGCTTTGACAATGTGATGTGATGCAGGCTGGGTACTCCAAATGTTTCCAATTGAAC
GAATATCCAATCAGACAAGTAGAGATAAAAAAAAAAAAAA > SEQ ID NO:4082 215980FL Trichoderma harzianum
CGATTGTCTTTAGGCCGAGAGGCGTTTGGCGATCTTGACATCATAGGAGCTGCTCTTCGTTGCGGCACCAGAACTTGCG
CGCATCTTTGAACAGAATACTTCGTGGAGCAATTGCTACCCCATGGCTCGGGAGCATCGTGTCAGATACATTAATCACT
CATAGCTGCAAGTACTCTTTGCGCCGGGGGCAGTGCAAGGCCCATGAGCCGCGCAATGTCATCGGTCTTATGCCGGCAT
TCAATCGGAATACGACTCTGGATCCGTCGTGCCGGTCTCGATATCGAAGCTCGGGGCAACACCAACAAGATGTAACGTA
AAATAACA > SEQ ID NO:4083 216112FL Trichoderma harzianum
CGTTAACGAGTCGTTTGTTGAGCTCCTTTTCCCTTCCCAGTCTTTCGCTTTTGGGTCCGCACTTCTCCTGCAGGTCGCC
GTTTCCATACCATTTTCTAATAGTATCACTTCCGCACATCTTCACGAACGCGTCTCCCCGTCGTCGTACTATACAGTCA
ATATGGTGTCTTTCAAATCAGCCGTTGCCGCCGCCACGATGGCCTTTGTCTCGTTGGCCAATGCGAAGAGCTACTACAT
CGACCCTGACAGTGTCCCTCTGGCCACAAGACAGAGCTGGTGCCGTTCTGAGACGTCGACATGCCCCATCATCTGCCAG
CAGACCACCAACAAGCCGACATTGGTCAACGACTGCAGTCCTGATACCTTGAGCTTCGGTTGTCTCTGTGGTGATAACA
AGCAGCCTAACATTTCTGAGTACACCTTGACACTGCCCTTTTTCATTTGCCAGGAGTTTGTGGTCCAGTGCAGGACAGC
TTGTGGCTCGGACAACACTTGTGCGTCTAACTGCGCCGAGGATAACCCTTGTGGTGCCACCGATCCTAAGCGTTACAAC
TCAACTTCGACTGCTACAACAACAACCGCTGCCGCCACCTCTACCACTGCCGGCCCCGACACCATCTTCACCGGCCCTG
CTGGAAGTGGTAGCGGCAGCAGCGGCAAGGGCAAGTCAATGGCAGCTCCTGCGGTTGAGGTTGGACGGGCCTATGGACT
GGCGGTTCTTCTTGGAAGCATGTTTGTCGGCTTTGCTCTGCTATGATAGCTGCCGCAACAACAAGGGGGGTTTCGAAAA
GGAGTCATGCGGTCGAGCAAGTGATAGATTGCTCAATTAAGATCGCCTAATGTTTGATTGGTTGCTGGTTTCATTAGAG
CGTGCGTCTTACACTGGATTATCATTATGCGTACTGCCGGAAGTTTGGTCACGGGAATTACTTAATACTGTTGAATGCC
TTTTCGATACGATACATTGACATGAATATATGC > SEQ ID NO:4084 216213FL Trichoderma harzianum
CAGCAATTGCGCGCCAAAAGACTGTACACAGACGTCTTTTGATATATTTTCAAAATGGGTGGCGGTGGAAAAATCCCTT
ACCCCAAGCACGTCTGGTCGCCTTCTGGTGGTTGGTACGCCCAGCCTGCCAACTGGCGCGCCAACACGCTCATCGCCGG
AGCCGCCATGTTCGGCGTCATCGCTATTACGTGGAAGTTCAGCGCCGACAGGGAACGATGGGCGCATAAGCCGGAGCCG
TGGGAGTGGCATCCTAGCCGATAGTACGTTTATTTTTGATTGTATTGGGTGTGGTTGTGGGAATTTGGTCGTTTTTGCT
AACGTTTTTCTTTTGCTTGAAGCTGGTCAAAGCAGTTGATCGAGTGGGACAAGGAGGACAAGCTGAAGGCAGCAAGCAA
CAGCAAGGAGTAGAGTTTTCTTTTTGGGAGAAGGATAATAGACGAAATTGTACAAATTCTATACGAACAAAAGGCAAAC
ATTTCAAAAAAAAAAAAAA > SEQ ID NO:4085 216256FL Trichoderma harzianum
CAGCGCAGCAACAGCCCACGGGACAGGCGGCAGGACAGTCGCAGTCGGGACAATCTCAGTCGCAGGTTCCCCAGCACAA
GCGCGTCTACCAGGCGTGCATCCCGTGCCGTCGCCGCAAGGTGCGCTGCGACCTGGGCAGCGTCGACAACCCGCACGAC
CCGCCGTGCGTGCGCTGCCGCCGCGAGAGCAAGGAGTGCTTCTTTAGTGCTACGCGCCGCAAGAGAAAGACGGACGAGG
ACGACAGCGATGCCGACGAGTACGTGGTGCGCAACGGCCGCAAGAAGCTGCACGCCGCCGACAGCCCGCCCTTTTCGCG
CTTCGACAAGCGCCAGTACAGCGACACGCCCCTGACCCCCGGGGGATCCCATGGCAGGACCCAGCCGCTGCGCAGGCCG
GACGGCAAGGCTGGCGGCCGCGTCGAGGGG > SEQ ID NO:4086 216338FL Trichoderma harzianum
CGGACGCGTGGGCGGACGCGTGGGCGACCACCAGCGCCGCCAGAATGTTCGCCGCACGATCAAGGGCAGTCTGCGCCGC
CCGCCAGCTGCAGCGGACAACCCGAACCTACGCCTCCGAGTCCCACGGCCACCACTCGCCCGCTCCGGTCAACGAGTCC
TTTGGGGCCGGATCTGTTATTGCCCTGGGCGCTTTCCTGGGCACCGTCCTAGTCTACCAGTTCCGCCCCACGGAGAGCG
ACAACTGGACGCCCTCTGCCCTGCTCAACAAGTATCGATCAAAGGCCGAGGACTGGGAGGCCGTCAACACTCTGCACAC

FIG. 1 continued

AAAGGCCATGGAGCAGGCCGGCTATGACAGGAATCTGTTCGAGAACGGCTCCAACAAGCACCGATTTGTCGACGTCGCA
TACCCCGAAGCTCTCCAATCCCACGCCGCGCGAAACATCCAGGCCGGCCACCTTGCCAACATTGACCATGCTGTGGAAC
ACTACCGACAGCAGCACCTGAAGATGGAGGAGAAGAAGGCGGCCAAGCTGGCGGCTGCCAAGGCAGAGTAGTTGCAGTT
GCTACAGTATATCCAATTTATAGAACAAAGTTTGCAACAAAAAAAAAAAA

> SEQ ID NO:4087 216438FL Trichoderma harzianum
TGTCAGGGAGCTTCCGTGGGCTGGCGCCAGACGCGGTTCGTGAATGCATAGGTGCTCTGCTGGCAACTGACGTCTTGGG
GCTTGGGTTGAGGGATGCGGGCGTGTTGTATGGAGAGGTGCATGATGTGGGAGAGAGGGCCCCTGGTGAGACCCCACCG
GGTGAGCGGTGGCCATATGAGCTAGCAGAAGGCGGGATAGAGATGGAAGACACGAAGAAGCCGGGTCGCGAAGAGGCGC
TGTTCAGCATTGATGTCGCGGATTGAGGGCCCGACGACAGGCGAGGAGTAGGAGAACCGCGGGATGCACCTTGGCCAGA
CATCATGTGTAAGCCAAGGTCGTCCGATGCTGGGCTGGCGGCCCGGCGCTTCTGACCTGCGCCTGCGTATGCATCTTCA
ATGTGAAGTCTCTTGAGAGAGGATGTCTCATCAATCTCCATATCGTCAGCAAAGCTGCCCTGGGTGGAAGTGGCATCAT
CGCTGTTGTTCCGTCTTGACCTGCCTCGGGGTGAACGATCGGTTCTGAGTTGTCATAGGGAGAGCGGTGGTCAATCGG
GGATCGGTGGAAGGGCGTTGAGTTGGGGGAGAAAAAAAAAAAAAA > SEQ ID NO:4088 216474FL Trichoderma harzianum
CCTGCTCACTTGACATGGTTTTGCCGCGTTCTGCGCTCCTCCTCCCTGGTTCCAGACTGTTACCCGTCTCGGAATACAG
CGAGACACGGACGACGGAGATCGGGAATGTGGGGCCGGAGAATCCGATGTTCACACGGATTGAGTCTCTGGAATGTGTT
TGCTACGTTTTTATCGGGCCGGGCGATGTCTGAGCACGTGAAGGGAGACGTGTTTGACGTGTAAGCAAAAGAAGGAAAT
AACTTTACTTCTGGGCTCGTGGGCTTGGGCTTGGATGATCCAACAGCATATGACGTCTAAGTGTTCGAATTGCGTCTAA
ACTACGAACCCCCTTGCAGTTGATGGGTTAGAGCTGAAAGGGGACGCCGTTTGCAATCAATTAATAAGATCATCCGTTC
TGAAGCGCTACAGCGGTTTGAGTTTCGGTAATGCCAAACAAGCTGCTGACATGGAAAAAAAAAAA > SEQ ID NO:4089 215995FL Trichoderma harzianum
AGCCATTCCTGCGCAATCCTGTAGCTGCCCTCACGCACATCCCCCGGCACGGTGTGGCCCGCGCCGTCCACGGCCACAA
ACGCCAGCCGGCCGGAGCTCTTCCACGACCCCGTCGCCGCCATGCTCTCCGGCAGCTCCCGCCACGGCGCGAGGCGATA
GTCGGCCAGCCCGCTCCAGCGCAGGTTCTCGTACGCCCAGATGTTGCCCGGCGTGTTGACGATGTAGTCCTCGTTGCCC
TGCAGGACCAGCACGCGGATGTCGCCCAGGTTGGGGGTTCGGTAGGCGTCGAGGATGCGGGCGACCTCGCGGGTGGTGG
TCCGGAAGGGATCTTTGGAGTGGACGAAGGCGGAGTTGAGGACCATGTCGATGTCTTCGAATATATAATATGGGGGAAG
CTTCAGGGCTTTCTTGATGTGGGCTTGGTTGATGTAGGCTGACATGTTGCCTTTCCTGATGTCTGCGCAGAAGGGCCAG
TTGGGACATGGAATATGGACTGTTTTGCAAATATTAGCAACTACGTTCAGACATTCAGGAGAAAAAAAAAAAAA > SEQ ID NO:4090 216020FL Trichoderma harzianum
TTGCATGTTGCATTTGTCTTTGCTGTTTTTTCTCGGGTTCGGGACGAGAACGAAAAAGAAAAAAAAAGTTGCGCCAGAC
GGGATGAAAGGCGAGACAAGGGGCTGGCTTGGGCTTTGGGCATGCACTGGGACTTTGGGCTGAAGGTTGACCGAACCGA
GTTGCTCAAACTGCGACATCGGTGCTGTATCAGGCTGCTATCTATGTATCCTCGTACAAGGCAAATGCACACACGGCTG
ATCTGAGATTACGGGGGGAAGAAACGCACTCAGTGGCCAATATGGTGGTTCGCACACCCAGCGTTTGCTCTCCTATGT
CGTTTGTATGGCGGGTATGCTCATGCTTGGGCTGAGGTGATGCGCGTCTGATTCCGGCTAGCATACCGAACCCACTAGG
TAGCGAGTTGATAGCAAAAAAAAAAAAAA > SEQ ID NO:4091 216082FL Trichoderma harzianum
GTTGAGAAACGCGAGAACGGCATTGAGAAGAGGTGAAAATTCGTTCGACATAGAGCACAATCATGGCCATGATTGATGT
CTCTCGGCGGAGGAGGTCGCTTCTGAAGGATGCGACTGCATTGGACCATCTGCCCGCTGAATTACTTGAAATTATCAAG
CATCAGTCGTCGACGAAGCTCTTCGATGCTGTATCAGAAGCCGCGCTCATACCATCACTTACAGAGAGGATCTTTGTGC
ATTTCGAAGATGTGTTTTCAGACATTTGCGCACGATGGATTCTCAACGCCGGCAACGGACCACGACGGTTATTAATTGC
GTCAGCTATTGCCAGGATTTTGCCATTTGCGCCGTATCTCTCGACTTTTCTTCAATGTCCCGGCAGAGGTGGAGAGGAA
GCGGCGCAGGGACCTTCGCTTCACTTGGTGCTGCCGACCATTGATGGAGTGAATTTGGGGTTGGATGCAGATGCATTGC
TGCAGGCTTTATTAACATACTGGAGACTTTTCAGCTTCGACCTGAGAACTTTCAGCTCATTAATTCCACCCGAGTACCT
GCAGAGCTTGTTTGCGCATGAGAGCCGG > SEQ ID NO:4092 216114FL Trichoderma harzianum
GGAACACAGCCCAAGCAATAGCACAAAGAGGCGTCTACTCCAACCATATCCAGCCATTATCTAGACAAAATAGAGAAAG
AAACAGAGAAAAGCCACGATATCGGATATCGACCAACTTCAAACTGGCAAAGCTGCAATCAACCCCCGACGTTGGGCTT
GCTCTAGAATCCGCCCAGCTGGCTGAGGAAGCGAATTCCTTCTCCTCGGCCTCCGTTATACTTCCTTTTACGTACCGTG

FIG. 1 continued

ATATTGTGATAGACAGACGCCTCCAAAAAGGAACATCACAACAAAGTATCGCCAAGAATCCTCATCCGCAAGTACACAG
GGGGAAACAACAAAACAAGCTTCCGACTCCTCGACTCCAGTGGGGGGCATCCCAGCCAGTCAATGATAAACACACAATC
AAACAGAGCACGATACAGAGAGAAGAAGCACCTCAAGCCGCCGTCAGTTTCACCCCCCCTTTAAAAGAGATTTGAACCC
GAAAAGGGCCGCTCGCATATTCAAGCCTTTCGCCAATGAGATCCCCCATCCATCCTCTCACATCCCGCACCCTCCACAC
CAAATGCAAAACCCCCAATAAATTCTGTCGACGGGAGAAAAATAAGATATGCAGAGAGGAGCTCACTCAGCTGTGGCCA
CGTAGAAAGCCTCGGCCCGTTCGCAACCCACAGCCTGTATCAAGTCAAAACCATAGAAGGGCCAGCGCCATGCCCAGCC
GGAATAACGTCATGCATTGCTTGAATATGCCTCTTGTGCGTCTTATACCATCAGTATGAGCCACCATTTTCTTGCATCT
AGTCGTATATCTTGCCGTGTCCGTGTCGCAGCCTCGGCAGCCTCAGTTTCAACATCTGAAGAAGAAGGGGAGGAAAAAA
AAAGGAGGCTGGATAGGTAGTTCTGCAGCCGTCATAGTGCAAAATATCCCTCC

> SEQ ID NO:4093 216175FL Trichoderma harzianum
CCCACGCGTCCGCGGACGCGTGGGAATGATTCTCATCAAAGAACAAACGCATCGTTCAAGATGAGAGCCAAATGGAGGA
AGAAGCGCGTTCGTCGCCTTAAGCGCAAGAGAAGAAAGATGAGGGCTCGCTCCAAATAAACGACTCGCTCTACCACTTG
ACTTGACACATCTTTCACATTTTGAATGAGTTCACGATAAAACACGACAAGCAAAGCTGCTGCACCACGGTACCACTCT
ATGACCGATTACAGCCATCAAGTTGGAATCAGCATATTGGTGCGCCTCTCCAATTCAGCTACGGGAGTCAATGGACGAA
CGCGAGAGATGAGGACTGGACAATTTCAGTCAGGTGGAGACATCGTTTTGAGGACGCGAAGGCCATGAAGCAAAACGCT
GCTGCAAGAAGCACGCTTAGGATCGATACGTTGCTTGACAAAGATCAAAGGCAGAATTTACTTCATTTCCAAACCAAAA
AAAAAAAAAA > SEQ ID NO:4094 216219FL Trichoderma harzianum
CCACTCGGCACATCATGAGTTCAGGATACGGCATGCATGGCGGCGTCGGCCGTTGCTTTCCTTTCTGGCAGGAGGTCAT
GGCCTGCTATGTCGTCAACACATCCGCCGCAGACGACTCAGGCAAGAAGAAGTGCTCGCCCGTACTAGAGGATTACTAC
GAGTGTCTGCACCACAAGAAGGAGCATGCGAGAGCGCTGGCCCTACAAGCCGCATATGCCCGAGCTCAATCGGCAACCG
CACGAGACGATGCGCCAAGTGCCAGCCAGATCCGGAATCTAGGACTGCTAGGGAAGACGGAGGACACAAAAGCGGTGCT
TGGACAGGGAAACTGAGGCAATAGACGTGGCGGAGTTCGATTTCTTCTGCGCGAATACAACCCCCTTGGCGCGCATAGA
TAGCGCAGCAAGTTCAATATAGGAAAAGCAGACAGAACTGGAGAGCCTTTTCGGATGCTGATTGTGAATTGGCGGCTAA
TTCTGTCAGTTTGGAGGCTGTAATTCTGTACAAATTCGACGTACATTTTCATCCACCAAAAAAAAAAAAA > SEQ ID NO:4095 216257FL Trichoderma harzianum
AGTGACGGCACTTTTCGACGACGAATTGACGAGCAATTGATCGATACACGCGGTTCCCGCTGCCAGAACAAGTCAAGAT
GGTTTCTCAGACTCCCTTCCGCGCTGCGGAATTCAAGAGCGCCTACGGCCCCAAGTACGCTTTCCAGCCCAACTACCGC
GGCATCACCGTCCGACTGCCCACCCGATATGGCTTCCGACTGCCACCATCGGCGGTGGTCTCGGCGTTGCTCTGATGC
TCTTCGCCTCCAGCCTGCCCCGTGTCCGTTCTGACATCCTCGTAAAAATCCCCTTGGTTGGCGGCTTCTGGGAGAAGCA
GGAGGTTCACCCTGCCGACAACCCTTTCTAAATGCACTTGTTGGATGGTGTTTGTAAAATTGTAACAAGGCTTTGCGCA
GCTTGCCTTTGTATAAGAGATACACAATAGACTTTTCCTAAACCGAAAAAAAAAAAA > SEQ ID NO:4096 216287FL Trichoderma harzianum
CCCACGCGTCCGCCCACGCGTCCGATCCCTCACCATGGCGTCGTCTCTCCCCACCGAGCTCGGCAGCACCATCCAGGCC
GGCCATATCAGAAGACATCCCGACCCTCGACAAGACATTGCGCCATCAACCGCCGCCGACAAGAGGCAGCTGGTGGATT
TCCACAGCGCGAGACGCGGTGATATCGACAACGACGACGACGATATCCCGTACAGCGTCTTGCGTCCTCCAAAGAAGCA
CTACAACCTCCCACCCCTTCCAGACCTGCGATTCGAGCAGAGCTATCTCCACAGCATCGCCTCAGCCGATACGTGGTGG
AAAGTATTACTCATTACAGCTAGGGATCAGGTATTGATGCCCTTGGCTCAGGGTGTCCTCCTCAACTTGGCCTTGGTTG
GGTGGCAGCATTGGAACAAGAATGCCAGAGTACACGGTGACTCAATAGGCATTCGCTTGAGGAGGTGGTGGTATGGGGT
GAATAATTGGAAACTGCCCGCCCCTACTAAGAGACGGGTGTAGAGAATGATGGCGGTTGGTTTCAAAATAAATGTAAAC
ACTCCAGTCGTGAGTATGTATTACTACTATCTTGCCGGATAAGAAAAGAATCTGTCCTTTCGAAAAAAAAAAAAA > SEQ ID NO:4097 216384FL Trichoderma harzianum
GGAAATTGCCCTCCAACCGCAACCATGTCGACCCTCCCCAGGACTCTGGGCAACCTGCGCAAGATTGGCATCAAGGAAT
ACTTCCGCCAGATGCTGTACATCGGTGACACCAAGTACGGTACTCTCATCGGCCAGGATCGCTTCGGCAACAAATACTA
CGAGAACCTCGAGGAACTGCCCCTCCGAACCCGCTGGGTCGACTACGCCAAGCACGACTACGATGCCTCCCACATCGAG
CCCGGCTGGCACGCCTGGATCAGCTACTCCGTCGACAAGCCCCCGACCCAGGACAGCCTCATCGCCACGGGCACCAGAC
ACTTTGAGCCCGCCCTTCCCAAGCCCAACTTTACCGGAACGCGAGGCGCTTACAAGCCGTATAACACAGTGAAATCGAA
GCTTAATGCTTGGGAGCCGGTGGCCAAGGATCGGGTATGAGTGGTTTTACGTTTTCTTTTTTAAACCGTGGGAAATA
TGGTGTACATATTGAAATCGCGCAACAAACGCAAACAAATCAAACAATAGACACAGACATGTGAAAAAAAAAAAA

FIG. 1 continued

> SEQ ID NO:4098 216449FL Trichoderma harzianum
GGAAGATACGCAATTCCACAATCGCCATGGCGAAGCCGTATGTGCCGCATGACGTCCTTGACGAGACGGCCAAGACTTC
ATTGGTCGGCCTGGGCAGCGGCTTCTTCATTGCCGCCATCCAGAATGCCCTGTCGAAGCGCAACGTGGGCGCTATGAGC
GTCTTTACGCGGGGAGCTCCCATCATTGGCATTTGCGCTGCCGGTCCCGGTGCCTACGCCTTCTTCTCCCGGACGATGA
TGAACCTGCGGGAGAAGGATGATGCTTGGGCCGCCGCCTTTGGAGGCTTCATGTGCGGCAGTGTCCTCGGACTTCCTTT
CCGACGCACACCCATCGTGCTGGCTCTTGGTGCTTTCGTTGGCACTGCCCAGGGCCTTTTCCACGTCACCGGAGGAAAA
CTGGACAGCTTCTACAAGGAGGAGGATGAGTTTGAGCGCAAGGAGACTGTTAGACGGACAACCCGGTTGCCCGTTGAGC
AGACTATTGCCGAGCTGGGCGAGGGACGAGGCATCCGTCCTCCTGGATATGAGGAGAGAAGACGAGAGCGCATCAAGGA
AAAGTATGGCTTCGAAGTTAACCCTGTGAGCGCCACCGCTGAGGGTAGCCAATAAAATGATATCAAAAAAAAATATGAA
AGAATTAAAGTCAGCTGCCAGAGATTTTTGAGGTGAGTTCTGCGGGCAGCTTGTACATATATCCCATCGCATTCCAGTG
CGGAAGAGATGCGATGCTAGATAATCGGATTTTTTTTTGTTTCAAAAAAAAAAAAAAAAAA > SEQ ID NO:4099 216488FL Trichoderma harzianum
GGAGGAGTGGCCGCCTTGGTAGCGGGCAAGGATGGCGATGAAACGTCAATCGTGCTTGACCCGGTAGCTTTGGAGCATG
AGTCTGTTCTTGCTGCCTGCTGCGTTGCATATCTACCCAACAGAGATGAGATCACAAATCTGTGGTTCAAAGGTCGGCT
GCCCTCAACAGCATCTCACAATCATCAGTCACTTGTCTCAAGGGCAGTGCACGCGAGTAAAGGAACACATGGGTTGATA
TCGGCGGCTCTCAGCGAAGTTATTGGCAATTCTCAAAACTAAAAGTACACCGCGTTGAGTAATAATGACGATAATAACG
ATAATCTGGATCATGTATGCGCATTGCATACATTCGACATTCGCGTAGGCCAGGTGGGTGTGCTCCAGAGGGGCATCTC
GAACATCTGGTGAGCGAAGAGAGGTCAGCACCGCTGTAAGTGCAACCAATCAAATTCATTACGAATACCATTGGCTATT
GATGGAGACAATCACCAATGTTAGGTGGTATGAGGCATTGCTATAAAATGCTACTTGTTCGTTACCACAATCAGAGAAA
TATCAAGTATATTTATTAAGATCTATCTAAAGCCTTCATTTCCATACCATATCAAAAAAAAAAAA > SEQ ID NO:4100 216036FL Trichoderma harzianum
CACGCGCATCATTATGCCGGCATGGGCCCGGGGTCTGACCCTCACCATTTCCGAGACCAGAGCGTGCCGCATTTCGACA
AGGCGGGCCATACGCGGACGCACGAGCGGGAGGATCACCGGCGGTGGCAGCGGCAGAGAAGGGCTGTGGGGGATGATGG
CATAGAGTTTGAGCCGCAGACGAGCCTGGCCGGGCACTTTTTGATTGTGGCGGGGATATTGGCGGCGACGCTGTTTGTG
CCGGCGGTGTATTTGCAGTTTATGCGCCTGGGGAGGCAGAAGAAGGAGAAGGAGTCGTGAGGCGGGTATGGCGTCTGGA
GTGTGATAGGGAAGGCTGTACAAAGAATAGAGCAGACTTATATAGAAATAGGCAATGGGGGGGCATGAGCGAACAATGC
CGATTTTAACGTTACGAAAAAAAAAAAAAA > SEQ ID NO:4101 216136FL Trichoderma harzianum
GGGGATTCATTCAGCTGGTCAATATTTCACTATAGAGAGAGGGGTTGATTTCAATTCAATTCAATTACAGGAGGGGTAT
TCGTGGGACCACCTCGGCAGATACCAGTAGAGGCAAAGGGAATCCCGCAACTCAACTCAAAACCCGAAGCCTCTCCGCT
CCCTTATCTAGGGCGCGAATTCTGACGTTGCTGATCCGATATCCGTCGCGCGGCACGGCAGTCAGGGACGGGATGCGG
CAAAGATTTGGCAATTCGTCTGGGTTGCTGTTGCAGCCTTCTTCACTAGAAATGGAATCTCGCGGATCAAAAGGGAAGT
GTGGGAAGCTCTCGCGCGGTACTTGGTGCGAGTTGGAGCGAAAGCGAAGGGAGCCGCGGAAAGGGTTCGGGGCCGTGAT
TCCGGGGCAAGCGGCCAGATACCGACCTGGGTCCGAGTTCGCCGGGTCGTAGATCACGAGGCTGGTCCTTAGACTCAAA
ATCCCAAGGGTTTGGTTATGGTGTGAAAAAAAAAAAAAA > SEQ ID NO:4102 216180FL Trichoderma harzianum
CGGACGCGTGGGGGGGACGATGCGGCGCATGTACCAGGTGTGCAAGCTGGTGCACGCCGATCTGAGCGAGTACAACATC
CTCTACCACGACGGCAAGCTGTACATCATCGACGTTTCGCAGAGCGTGGAGCCGGACCACCCGCGGTCGCTCGAGTTCT
TGCGCATGGATATCAAGAACGTGGGCGACTTCTTCCGGCGCAAGGGCGTCGACACGCTGCCTGACCGGGCCATTTTCAA
CTTCATCACCGTGCCTGAGGGGCCGGTCGAGGAGCCTGAGCTGGCGGAGGCGATTGCCAAGTTATACGAGACGAGACTT
CCTGCTGCGAACGAGGAGGAGGCTGCTGCTGAGGAGGTGGACACGGAGGTTTTCCGGAACCAGTACATCCCGCAGACGC
TGGAGCAGGTGTATGACATTGAAAAGGATGTCAAGAAGCTCGGTCTTGGAGAGGGCAATGAGTTGGTGTACAGCAAGTT
GCTGGCTGACCAGGTTGTTGCGCCCAAGGCAGACGGCGAAGGAGAGGATGAGGATGAGGAAGATTCGGACGATGAGTCG
GGCGAGGGAGCTTCCCTTGGCAGTGATGATTCTGAAGATGATGAGAGTCGGTTTGACAAGGGACGGCCGAGAGGTCGCA
AGTTTGAGGACAAGGACGAGAAAAAGCAACATAAGTTGGCCGTCAAGGAGGCCAAGCGAGAGAAGCGAAAGGATAAGAT
GCCCAAGCATCTAAAGAAGAAGCTCGTTTCAAGCACGTCCAGGAGAACGAAAAAATAAACAACGAAAAAAAAAATTAGA
AACATGTAATTTTCAGAATTTCTTTTTGTCTTGTTCATTTTTGTAATACCCGTGCTTCTGCTATTACTCCATATCTTGG
TGATAAATGCATAGTTAGACAGGGAGACATGTTGGATGATGAGCACTGATTGTCGCGATGAAGGCCAAGGATGGCGGTT

FIG. 1 continued

TAACATCTGAGGATGGGTAACCCTGTTCATGGACTTTATTTGCGATCTGAATTTGCGCGAGGGGTGACCCCGCGAGAAT
CTGGATGATCAAAGAGAGCGCTGACAACATGTCTCCTGGCCGTTGACGGTGTGCTTGCTTGCTATACACGGTTGAATAC
ATGATATG

> SEQ ID NO:4103 216227FL Trichoderma harzianum
AAATCTTCAAGCTTCACTACAATCAAAATGCAGTTCTCCCTTGCCATCGCCGCCTCCGTGCTGGCTGCCACCGCCTCGG
CTGCTCCTGCAACCGTCTCCGGCACAAACACCAACGGCTCCATCTTCATGTTCGGAGACCCAGCTCCCGCTCGCAACCT
TCTCAACCAATTTGGTGCTTGCGGCCTCACCACCTACTTCGTCGGCCAGGTCCCCGACGACATGCCCCTGGTTGCTATG
CCCGCCAACATCTTCGACCAATTCGGCTCTGCTCAGCACAACACTCTCTGTGCCAAGATCATCACCCTCACCCGAAACG
GCGTTACTCGCCAGGCTGCTATTGCGGACCGCAACCTCAGCAACACCAACTCCATTGACATGACTCTTGATCTGTGGGA
GGCCTTTGGTGGACACGACAACGACGGCAGCATCATTCCTGGCTTCAGCTGGTCCATTGCCAACTAAGGAGTTGGTGGA
AGTGGCCTGCGGTTGAGTAGACTGCGACCTGTACATATTTCTACTCTCTTTCTGATGTATATATTTATGACTTTTGAGC
CCTCTCAGCAGGAGATTCTTGTATATATATGATCCTGCATGGGAGGCAGATGTTTATATGAAGGCAAATCTATAAATG
GTCATCCATTTAAGTTTTGTGTAAATATACGCTGTTTCTACAAAAAAAAAAAAAAA > SEQ ID NO:4104 216259FL Trichoderma harzianum
GTTGGAAGTATAGAACTTAGCCGGCTACAAACTTAAAGAGCGTTGCCCAAAATGAAGCCCTATCCATTCCAATTCAACA
GCACATCCTCGTCAAAAGATGAACCAACCAGGGATACGGAGCCCAGTCATCTTTGTAGGGGGCGAATACCTTCTGTCCA
AGCATCGCAGCTTCGGGCTATGATTCGCGAAGCATACTCGGACCCAAGCAAGATTCTCGCTACATGCTGCTCTGACGAT
GGACTAGGATCACGTCTGGTGGAAGAAGCTAGGTTCCCGTACATATTTTGGGTGGATTCATGGTCGCGTCTAGCTTTG
GATTACCAGACACTGGATACATTGCCTTCCAAGAAATGGTCAGCCGCATTCAAGAAGTTAAACGACAAACTACGATTCC
TATCATTGCAGATGGAGATACTGGATACGGTTCTCCCGTAAATGTTAGGCGCACAGTCCAAGGTTTCGCCATGGCGGGT
GCAGCGGGTATCATGATCGAAGATCAGACTTGGCCGAAGCGATGTGGCCATACTAAAGGGAAATCTGTAGTGTCCAGGG
AGGAGGCCTTCGCACGAATCCAAGCAGCTGTGGATGCCCGCAATGAAGGAGTCGATATTGTTATCAACGCTCGCACGGA
TTCTTTTATCCTCGATGGGATGAAGCAATTTATCGAGCAAAGAAGTTCGTTGAGATTGGAGCAGACATGGTTTTCCTA
GAGGCTCTCCAGATAGGGAGATGATGAAGAACAATTGACGCCCTTAATTTCCCCGTCATGGCTAACATTATTGAAG
GCGGCTTGACAGATAACCTCTCAGCTGAGGAGCTTGGCAAAATTGGTTTCTCGATAGTTGTATATCCCTTTACAATGGT
GGCAGCTAGAGTCAAGGCTGTGAGGGAGGCATTGGAGTCTTTGAAAGTGAGTTTCACATCTGGGGCACCTCCAAGTATC
ATGTCTGCCGGAGAGGTCTGTGAGGCTGTTGGCTTCAACAAGTACTGGGAGCTGGAAGAGAAGTATAAATATTAGTGGT
ATCAATTTTAGTGGTCTAAATGATAAAAGGGCTAGTTC > SEQ ID NO:4105 216302FL Trichoderma harzianum
GGCAAAGGGATATGTGAATTTGGCGGTATACTTTTCTGTCTGAAGGTCTAGGAGGCGGAAGCCCTGGTCATTGCTTGCA
ATGGCGGCGGCAGGACTGTCAGACCTCCTGGGTTTGTATATCTTGATGTGGTTGGTAATCCCGCTAACGTCGTTGGATA
TCTGTCCCTCCGAGTAGCTCTTCTTATCCTCGGCAGTCAATGACTGCAGGAAGTAGTCGCCATTGAAGGTGCCGGCCAT
CAAGACACCGCAGCCGGCATCAAGGGTTGATATGGCGGGAGACGCCATTCCAGCAAAAGCACGCAGATTCATCGCTAGG
TAAAAAAAAAAAAAAAAAA > SEQ ID NO:4106 216357FL Trichoderma harzianum
CTTACACATATTACAAACTGTCCTCTTACATATTACAAATATCCAACATAGACAGTAGACAGTATCAACGCCATGACCCGA
ATTGCAGAGCCCACGCCACTTCCCCCCTCAGCTCCCATAAACGGCAGTGAGAAACACCAAGACCAACCCCGAGATGAGC
ACAAGGAAAACTTGGGCACCTTCTCCGTGCCAAACATCCAGCTCCAGATCCGGGACCTCAAGCACCCCGGCTCAAAGCG
CTTCCTCGGCGCCGTCAACGCAACCGATCTCCTCACCACAGGCACTCTGAACGTCCTCAAGCTCTTGTACAACACTCCC
CCAAACCCGGAGACGACCGTTCCGCCAACCAGCTCCGTGACGCTCGTCCTCGAGGATATGCCCGGCGTGGCCTACACAG
TCGGCCATAACGACAATAACAACATCAAGGAAATCCACTTTTCGCTCTCGTACATTGCGCAAATCAACGCTTCTCGCGT
GGCCCCCGAAATCAACGGCGTCGTAACCCACGAGCTCGTCCACTGTTTCCAGTACAACGGCTTCGGAGCTGCCCCAGGC
GGGCTCATTGAGGGTATTGCAGACTGGGTGCGTCTTCACTGCAACCTTGCGCCTCCTCACTGGAAGCAGGAGGTCAAAC
CGAATTGGGATGCCGGGTACCAGCACACTGCCTATTTCCTGGAGTATCTTGAGCGGCTCTATGGTCAGGGGACGGTTCG
TCGAATAAACGAGAAACTAAGGGTCAGCAGATATGTCGAGGATACCTTTTGGCCTGGGCTTTTTGGAAGAAAGGTTAAA
GACTTGTTTGCAGACTATACCAAGACATTGCAACATGGCCAAAAAAAAAAAAAAA > SEQ ID NO:4107 216387FL Trichoderma harzianum
CCCACGCGTCCGGCGATGTGAGGCTGATTTGGGGTGTATGATTCGTGAGCGTGTAAGAGGAGGCAGCCCACGACTTTCT
CTCTGTGTCTGTGCTTGCTCACTTGCTCGCCTCCTTGGATTCGGCCTGTTGATCCGAATCAGAAGTAAATGTGTTTGAG

FIG. 1 continued

ACTGAGACTTGGTCTGGTCGAGACGATATGAGATGTGGCATGGAATTAGAAACACGTGTTTGGTATGGCGATTGCGATG
CGATGATCCGCAGAAAGCAAGATCTCAGGGCGACTAACACGGATATACGGAGGTTCGACCAAGACACGAGGAATGATGG
GGAAAGTCTCAGTATGTCACTACGGAATTTATGATTACGTAGCAATGTATGAATTATCATTTCACAAAAAAAAAAAA

> SEQ ID NO:4108 216489FL *Trichoderma harzianum*
CAATTGACACCCAAAGCTTCAATAACCTAACCAACCCTCTTATCCACAATGAAGAAAGCTGCGCCTGCGGCAAACGCTG
CCCGAGATGCCGGATCTCACGATCATATGCTCCAAGGAGGCCATGCCATAATGAAAGACGACCCTGAAGACTTCAACGC
TCCCAAGCTTTCCGAGAACATGTCGAAGCAGACTGGTCTTGGGGGATCCAAGCAGGGCAGCTTGCAAGGCAGCGCCGGC
ACTGGCGATAGTATGAGGCAGCGAGACACTCAAAGCCATGTAGGTCAAACATGCGGTGGTATACAATTGTGCTGACTAG
TATGAGTGATGAATACGGCCACGTAAAAAACGAGAATGCATTGCCGATTCGAAAAGCTGGTATCAGTGGGACATGCACA
CGATGATAGGAGTTGACGAGAATCCCGAGTTTGAAACATGTTGAAATAGGTTGTATAATATCATGGCGAGCAAAACCAA
TATTGAAACTATTTATAAAAAAAAAAAAAAA > SEQ ID NO:4109 216042FL *Trichoderma harzianum*
GGCCCTCGGCGTACGAGTAGCAAAAAGCGTTCGGTCCATCTGGGTCCGGTTGGTAGGATTGGAACGAGAAAGAGGGGAA
TGGGATTCGAGAACGTGGAACTTGCTTGTGCCCTGGCAGTCTTCGGGTAATTGGCCGCGGAGATTAACATGGCGAGAGG
AAGCAAGACGTCAGAACGGATCGAAAAAAGAAGAAGATAAATCCAAAAAAAAAAA > SEQ ID NO:4110 216090FL *Trichoderma harzianum*
CATTGACTACACACATAAATACACCAGCAAAACATCTTCTGCGATTTCTAGTGTTTTTTCACTTACACCAGCGCGACCA
TCGCCAAAGCTACATACAACACAACACACAACACAATACATACACATCCAGACACTACCGTCTAACATAACACAAACCG
CCGAAATGGTCACTCAACCAGCCAAGATCCCCGTTGCCGCCCCAGGCCCCCTCGCTAGAGCTTTCCCAGCCGTCATCGC
CGTCGGCGTCATCTCTGCCGTCGCGCTAAACGTTCGCTCCCAACTCAAGACTCATTCAGCCACTCAGGACCGCTTCTTC
TCCCAGTACAAGAACCCCGAGAGCGAAGCCGTCCGCCAAAAGGTGTTTGAGGGCGCTGTCGAGGACCCCGCAAGAGCT
GGTTCAACGTCCTGGGCTGGTGACTATTTGAGGATTAAGCAGGGGTTTTGAAGACACAATCGCATTGCTGGGCGTTTAT
TTTAATTTTTAGTATCGAGGAGTTGGAAAGGATATTTGTTGGCTGGTGAAGGCGTCGTGCATTGCTGTTTCGATGTGAC
CGCCTGGTGTATAAATGGCGAAAGAAGGGGTTGTTGAGAGGCCCGAGTATTGATACCAGCCTTATTTAGATGGCACTTT
AATCTTCTAAAGAAGTTCAAAAAAATCTTGAGTATTCTCAAAAAAAAAAAA > SEQ ID NO:4111 216142FL *Trichoderma harzianum*
CAATCAATGGGCGAGAGACGGCTAATCGAGCAGAGCGTGACGAGGAGCGCGGCAATGGCGAGTGCGTGAAGGGGTGTTG
ATTCAAGACTGCGCGCGTGAGGGTGTGGGAGAGATGAGGCAGAGGCCAGAGGCAGCTCAAAAGGGTTCAAAGTTGAGAA
TCGACGTCAAGCCGCTTTAGTGGCTGATGGGCACTAAGCCTCAGTGGTCGACGAAAAACCCACAGCCGAGGCAAGCCTG
CAGACGGCCAGCGGGAAAAATTGCTGCAGGGCGGGTAGCACCGCAGCAGAGAATTGATGGCAAAGACGCCACAGGTGGT
ATGACGGCTGTGATTGGAGGCAGAAAATATCGAGATGTCAATTTTGCCGATTGTTTTGTGATCCAAGAAGAGAAGAGGA
GAGGAAGGCAAACAAAGAGGAAAAGCTTGAAATCCTCTCTGATGCAGATCTCTGTGATGCAGATCTGCGGAAATGTCCG
TGGAAGACGGCAAAGTGATTGTGACAAAGAAGAAAGATGAAAAAAAAAAAAA > SEQ ID NO:4112 216187FL *Trichoderma harzianum*
CATTTATCGAGTTTCACAGGGCTTAGCAACTCCTGTCCGGGGGGATTGGCAGATCTTGACAACTGAGGAGGACCGGATG
CCGTGACGTGTAGCTGCTAGGATGAATCTTGGATTGGAGATTTGCCAGTCGATTTGGATGGTGCCTTTCGGGATGGAGG
GGTGGAGGGTGGAGAGATATGACTAGTGTGGAGGTATCACAGCGTCGGGGGGCTGTGGAGAGTTCAGGGTAAGCCATTT
GCGGCTTTCACGCTCAGTAACACTCGGGGGTTTAAAACTGACTGATGGCCCATCTATACCTTGCAGAAAAAATTTAGGT
CCTCGCAAGACTCTCCCTAGAGCCGCGTCCCGTCACTACTGCTGCTTTGGCATCAAATAGTGCTCAATGGCTAGGCCGA
GGGATTTGAAGACGATAGCAATGTAACCCATACGATCTGACTGAACGAAAAAAAAAAAAA > SEQ ID NO:4113 216230FL *Trichoderma harzianum*
CCCACGCGTCCGCGAAAGCATTTGCCATCGCACAATCGTCATTCAGCTACCAGAATTCCAGTTGTTCAATAAGGAGTCG
CAATCATGGGTGGCGGAGATTTAAACTTGAAAAAGTCGTTTCATCCCGGTCTGCGGCGGAACCAGCAGGCCGTCTACGA
AGAAGAACAAAAGGCTCTCGCCGAGCGCAAACGAACCCAGCAGCGCATCAATGAGATCAAGGAGGAGCGCGCAAAGGAG
GAGATCCAGAGACAGCTGGAGGCTGCGGGAGGCACCAAAAGGGTTGATCGCGTCGACTGGATGTACCAGGGCCCTACCG
ATGGCCAGGCTGGGACAACAGAAGAAACAGAGGCCTATTTGCTGGGCAAGCGGAGGATCGACAACCTCATCAAGGGCAC
CGACCACAAGAACCTCGAAAAGGCCGCTGGACAGGAGAGCTTCATTGCGCTGCAGAACGCGAACAGCGCGCGCGACACA
GCCGCCAAGATCCGCGATGATCCTCTGCTGGCCATCAAACGACAGGAACAAGCCGCGTACGAGGCCATGATGAACGACC

FIG. 1 continued

```
CCATCAGACGCCGCCAGCTCCTCTCGTCCATGGGCATCGACGATGGCAAGAAGAAGGACCGAGATGGAGACGGAGACGG
ACATCGGCGGAAGCATCGCAGACGTAGGAGCAGAGATCGTGACGACGACCGGCATTCGCGACGCCGTCGCCGCGAGGAT
TCCAGATCTCGCAGCCCACGAAGACGCCATCATCGAGACGATGATTCAGAATCTGGAGAACGTCGCCACAGCTACCGAG
AAAGACGACGTGATCACTCAAAAGACAGAGATTCCGCACCCAGTCGCCGAAGAGACGCATCACAAGAGCGCGATACAAG
ACCGCATGGAAACGATTCATACCGAAGTCGTCGATGGTAGTCGCGACCGCCGATACCGACACTCCGATTCCAACAGCAGA
GGAGACCGTCCGCGCAGGCGCTCGCCGGCAAACGCTCGCCCCTACAAGGAGCGCGACGACCCTAGGCAAGAGGAACAAC
GAGCGGAAGAACAGGCACGGAAACTGGCTGCTATGCAGTCGGCTGCATCTGAGCTTGACCAAGATCGGGAGACACGACT
GGCAGCTCTAGAGGAGCGAGAACGTGCCGCCAGAGAGTCTGACGATAGAGCTCGGGAGCGCGGAGGAGACCGAGGCTTC
GTCAATGGCCTGCATCGGAAAGCAATGAACATGGACAACCGAAGCAGACGCGGACATGTACGGGATCGAGATTAGGTGA
TGTAACATGATGATATTGGCGCAGGGGCATATGGACGACATGATTCTAATCTGGAGAGAAGCCGCATTGTACTGTATTA
ACTAAAGATTGGATGAGGATATTATCTGGCGTTTTGGATTGGCAAACGGGAATACAAATGGCGAGTCATGAATGATTCC
T

> SEQ ID NO:4114 216262FL Trichoderma harzianum
GTTCGTAGAGAACGCAGATACCTTCAACAGGCTCGAGGCTCCCGTGTCTCGTGTTGCTGGATGGAGTATCCACAACGCT
CTGATATTCGAAAAGTTTCACGTCCCAGATGTTGCAAGAATTTACGACAGTATTAAAAAGACGGTTCAGTACTAAGAAT
GTGGGGAGCGAGTAACGTGTGACTTTATCTTTGAATTTCTAGAGCTTCTTCCTAGCATAAGTGTAAATAATAGAGAATA
AAGCTTTCTGTAACACACAAAAAAAAAAAAAAAAA > SEQ ID NO:4115 216403FL Trichoderma harzianum
GGCTGCAAATCCAGAGGCGAGACATTGTTAGAACCAACTCAGCGGGAGTCCGATTCCATACGAGTACTCGTATGAGGAC
ACTTGCTCACTGTCATATCTGAAGTCTTGAAGTGCTGCAGGGATGTCGGTTCGCAGTAAAGAACAGCAGCAAAAGCAAT
GGAAAAGGCCCCGACCTTTTACGAGAAAACTTCTGTCAACAAGGGCCTATCCTGGCACGTGGCGACCATGGTGAAAGAG
GTTGATTTCAAGCCAAGGGCAGCAAAACATAACCATCAAGAACGAGACTGCGTTATGATCATACTGATTGCTCTCACAG
CTCCGGGCGTGCGGTGACCTTTTTCGCGGAGCATTCGGAACTTACCAGCTGCGAGTACATGCTGTAGAGTCTAAACGAC
TGAGGGGGTTGAGCTCGTGATGTATCCACCTATCTCTTGGCGACAATATGTGTATCTCAAACAAAGATGTGATTATTCC
GTAACTCCTGAACAAAGCAACACTCCCACTCCCAAAAAAAAAAAAAAAA > SEQ ID NO:4116 216455FL Trichoderma harzianum
CTCGTGTGGCGCCTTGTCTCAGGGACAACAGACGACGAGCAACTCAAAGACCAGAGCTAAACATGGCTTGGCTAGATGG
CAATAAGCAGAGCACGCTTCAATCGAGAACAGACGCGCTCGACAATAAAGGATGTGCTACGGCACAGCCATTGGGACAG
ATGATGTCGCGGTTCAACGGTAAGTCTTTTGATCTTGTTGATTGAGCATCATAACGTGAGGCCGGCTCTAGTTGTTCAG
GACGATAAATGCCACTTGCAATGACCGAAGCTGTTTGAGTCTCAATACACTCTGTACCAGATGAAAGGGCTTCTATGTC
TGCTAGGTTTTCATAGATTTGTCATAGTTATGACTCCTGAAGAAGTAGTTGTACTGCGAAAAAAAAAAAAAAA > SEQ ID NO:4117 216492FL Trichoderma harzianum
AACAGCGGGAAGCAAAACAATTCAATTTCTACTTTTCCTTTCAAGTACAACATTGTTTGTAAAATACTCCAAAATCAAT
CGTATCACCAATTCTATCAACTGCATCGCCAAATCGCCATGCCTGAGGGACGTCAATCTCCTCCTCCCGAGCGCCAATC
CGCCGCCCAAGTAGGGAACACTGGATCCGGCAAGGCCTCAGATATCAGCAAGACCAGCCAAAAGGACCCAAAATCCCAG
CTCGACTGTCTCACATCGAACCCCAAGGGACCGATGGACGATGTGCTTAAACACAAGTTTTCCAGGGAGCCTGGAAACT
GTGAGCGCTAATTAGAGCGACTCGGTCTTCCGCAGTTCGCGACTAATGAATTATCATAGACACTCCGTTGAACGCTTAG
GGAGAATAAATCGTCATGTTGTACAATAGTCATTCATAGCATCAATTATTGCATCGCTATACTATAAAAAAAAAAA > SEQ ID NO:4118 57591FL Nicotiana benthamiana
GTTCTTGTCATTAATTAAGGCCATTACGGCCTTTACAATTTCGCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGGACTGACACGTGCTAAAACTTCATTTTTAATTTAA
AAGGATCTAGGTGAAGATCCTTTTTGAGGCCGCCTTGGCCTCGAGGGG
```

FIG. 1 continued

> SEQ ID NO:4119 182229FL Poppy
GTCGACGAATTCAAAAGAAAAGAAATGGCTTCTTCAATGATTTCCTCTGCTGCAGTCGCCTCCGTAAGGAGCTCCGCTC
CCGCTCAAGCTAGCATGGTTGCACCATTCAGCGGCTTGAAATCCGTCTCTGCATTCCCAGTTACCCGCAAATCAAACGA
CATCACCTCTGTTGCCAGCAACGGTGGAAGAGTTAACTGCATGCAGGTATGGCCACCAAGTGGTTTGAAGAAGTTTGAG
ACCCTCTCATACCTTCCCCCATTGACTGTCGAGCAACTATCAAAGGAAGTCGACTACCTTCTCCGTAATGGATGGGTTC
CCTGTTTGGAATTCGACGCCAGAGGATTCGTGTACAGAGAGCACGGTAACACCCCCGGATACTACGATGGTCGTTACTG
GACAATGTGGAAGCTACCCATGTTCGGTTGTACCGACGCTTCCCAGGTTATCAAGGAGCTAGAGGAGGCCAAGGCTGCA
TACCCTGACTCTTTCATCAGAATCATCGGATTCGACAACGTTCGTCAAGTACAATGTGTTAGTTTCATCGCATACAAGC
CCGAGAGCACCAGCTACGAACAGTAAAAGATGAACATAATCCAATTCATTTCTGTGTCTTTTTAATTTTTGTTTTTTGT
TTTAATTTGTTTTCCTAATTCGGTTTTAGCGAGTTATATTATTCGTAATCTTTAAATGGATTCGAGTGTATGAGCAACG
ATAATAATAATATCGTCTAATCCGATGTTTTTATTTGTTTAAAAAAAAAAAAA > SEQ ID NO:4120 109191FL Nicotiana benthamiana
TTTTTTTTTTTTAAACACAAACAAAATCGCATTATATTGTCAGGTAACTCACAACAGCTTTACAAGGCCATCAAACAA
TCAGAATTTTGAGAATGTTTTAAGATTCACTTTCCGGGAACAAAGTTTGTGGCGTAGGCCCACGCATTGTTGTTAACGG
GGTCTGCAAGGTGGTCAGCAAGGTTCTCCAATGGACCTTTTCCGGTAACAATGGCCTGAACAAAGAATCCGAACATAGA
GAACATGGCAAGTCTACCATTCTTGATCTCCTTTACTTTGAGCTCAGCAAATGCCTCTGGGTCATCAGCAAGGCCTAAT
GGGTCAAAGCTGCCACCAGGGTAGAGTGGGTCGACAACTTCACCAAGAGGCCCACCAGCAACGCGGTAACCCTCAACGG
CTCCCATCAAGATAACTTGGCAAGCCCAGATGGCCAAGATGCTTTGTGCATGGACCAAGCTTGGGTTGCCCAAGTAGTC
AAGTCCACCCTCGCTAAAGATTTGGGATCCAGCCTTGAACCAGACAGCTTCGCCAAACTTGACACCGTTACGAGCCAAG
AGCTCAGGGAAGACACATCCAAGAGCACCAAGCATAGCCCACCTGCAGTGGATCACTTCGAGTTCACGGTTCACGGTTCTTGGCAA
AGGTTTCTGGATCTGCTGAAAGTCCAGCAGTATCCCATCCGTAATCACCTGGGAATTCACCGGTCAAGTAGCTTGGGGC
CTCACCGGAGAATGGGCCCAAGTACTTAACACGGTCTGGGCCGTACCATGGGCTGCTAGATGCAACAGGTTTGGTGACA
GTCTTTCTCATGGAGACCCTTCCATTTCCAGTGATTTCTGAGGCAGATGGGGAGAGTTTCACTGCCTGTCCAGCAAAAG
AAGGGGAAGAAAGAGCCATTGAAGAAGCAGCCATGGTGTATGAAAAAGAAAAGTGATTGTTTGATGGTTTGAAATGCCG
CGGACGCGTGGGTCGAGGGG > SEQ ID NO:4121 111751FL Nicotiana benthamiana
TTTTTTTTTTGGTTATGTAAAATATAATATTAGTATTATTTATTACATAGTGGGGATCACTGATCTTACACAATATTC
AACTTGTGAAGCTCACATAGTGTGCATCACTTATATTCTTACTTATTTTTACATACACAACACACCTTCCTTTATTTTT
TTCATAACTTATAGCATATCACCCTTAAGTGTATGTTGTACGACAAACTTTTAGTAATATGGTCGTGATCGATCAGTTG
AAATTAGCATCGTTATTATTGGCTGTTTCATTGGCGAACATGGCGGTGGCACAGCCTTTGTGACAGTTGCTCTGGCAGC
CAGATCCACAGTAGTCACAACTAGTGCCACACCAACCAAACTTGCTACAACACAACTTGTTGGGACACTTGCGCTTATG
GTTTTGTTTACCACATTGTTCTGCATAAGTTGTGGTTAGCAACAAAGCCAACATCACAAAGACAATTACAACTGAAAAT
CTCATCCTTTTGGTTCTTACTTTTTTTCTCTCTATGGAATATTGGGAAACGGACGCGTGGGTCGAGGGG > SEQ ID NO:4122 20072FL Nicotiana benthamiana
TTTTTTTTTTTTTGATTAAAAGAGACTAATAACTGGTTTAGATAACAGAATAACAAACTAAATTAGGTTCCATTCTAG
TAAAAAACAACTATAATTCCATAACAAAAACAAGAAAAAAAATCCCAAATTCAAAAAGAAGTGCTAGCCATGGTTACTT
TTAAGTGATTTGTTTACTCTTCATCGGCAGATCCACCACTCTTATTGTTGTTGTGCTTCCTAGCATATCTCTGGTTCCT
CAAGAACTTAGGATCCATCCCTTTGGTAGATGAATGGCGGTGCTTTCTTGGCTTCTTGATGCCATTCCTGTGGGCCTTG
TACGACTGGTTGTGAGCTGTGTGATTTTTGGACTTGGCCATTTCACAAACCAACTGCTGCTGAAGGCGCTAGGATTTTC
GCCCACGCGTCCGCCCACGCGTCCGCGGACGCGTGGGTCGAGGGG > SEQ ID NO:4123 57744FL Nicotiana benthamiana
ATAACTAGAGAGAAAAATGGCTTTGAGAATGTGGGCTTCTTCAACAGCCAATGCATTGAGAGTTTCCACTGCCTCAAGA
GCTAATCTTTCCCCTGCTTATTCACTCTCTAGATGCTTTTCCACTGTTCTTGATGGGTTGAAGTATGCATCTTCACATG
AATGGGTGAAGCATGAGGGCTCAGTGGCAACAGTTGGAATCACTGACCATGCTCAGGGTCATCTTGGAGAAGTGGTGTT
TGTGGATCTACCAGAAACTGGTGCTGCTGTTTCACAAGGAAGCAGTTTTGGTGCTGTTGAAAGTGTGAAAGCTACCAGT
GACATTAACTGTCCAATCTCGGCGAGATCGTTGAGGTCAATACAAAGCTCACTGAAACACCTGGTTTGGTTAATTCGA
GTCCATATGAAGACGGGTGGATGATTAAGGTGAAGCCGAGCAGTCCATCCGAGCTAGAATCATTGATGGGGTCCAAAGA
GTACACAAAATTCTGTGAAGAAGAGGATAGTCATTAAAACTTGAAGGTTTTTCTTTATTCAACGTGGACTAACTTTGCC

FIG. 1 continued

```
TGGTTAAGGCTGATACTGTGATGAAACTTCCTGTCACTTGTTAAAATTCTACAAAAATCAAAATAACATCCACTTTTCC
TGGTGTTTTCTATGCCTTATGCAGAGTTGTGATGTAGTTTTTGGTTATTAAGATCATCTTGCTCTCTGATTTTTAAAA
AAAAAA
```

> SEQ ID NO:4124 103560FL Nicotiana benthamiana
```
AATTCGTGGTATCAACGCAGAGTGGCCATTACGCCGGGGGTATCATCATCCTAGAACTGCTAAAATGAAGGAGTTCATT
TCTGATCCTAATCTCTTTGGACAAGTCAAAGCAATTCACAGCTCATCATCATATTCACCTGGTCCGGTATTTCTTGAAA
ACAACATCAGAGTAAAGCCAGACTTGGATGCCCTTGGGGCGCTGGGAGATGCGGGTTGGTACTGCATTGGCGCAATATT
ATGGGCTATGAACCAAAACCTGCCAACAACTGTGACAGCACTGCCTACTGTTGCAAGAAACTCGGCTGGCGTTATCTTG
ACATGCAGTGCCTCCCTGCATTGGGAAAAAGAGGAAACTGTCGCTACATTTTACTGCTCTTTCGTTTCACATGAAACGA
TGGACTTGATAGTTTATGGCTCCAACGGTACCTTTTATCTCTACGACTTCATTATCCCCATGGACGAGAACTCTGCTTC
GTTCAGCTTTACTTCTGGTGCCAAGTTCGTGGATCGCCATATCGGATGGAACATGAAACCTCGGGCAGTTGAAGTAACT
TCTAAGTTTCCGCAAGAGGCTTCTATGATTCAAGAATTTTCTAGGCTGGTTAAGGCTATTGAAGTTTCGAGAAGCAAAC
CGGAAAGCAAATGGCCGCATATTAGCAGAGTCACTCAACTTGTGCTGGATGCTGTGAACAAATCTATCGACCTTGGTTT
CCAACCAGTTCATATATAAATGCTTATGTTCATAACAATTGTTACCTGTTGCCCTTAAGAAAACAGTAAATTCTGTTGA
AGTTGCAGTTCTACTGTCCAAGTAGGACTACTTGGCTGAAACAGTAAGTACAGTAATGTATTCCTATAATTGACTTTAA
GAAATTGTGTAGAGACTCTTTATTATCTACTGGAATGAGTTTTAAGAAAAAAAAAAAAAAAAAAAAAAAAA
```

> SEQ ID NO:4125 107421FL Nicotiana benthamiana
```
TTTTTTTTTTTGAAGAATATCTAAGATTAGTTATTACTGTGGTAAAAAGTAAGAATACAATTCAGGTATGTTTCAAATT
GAACATAGTGAAACAACCCAAAGTTGTTTGCATAAGAGCTATATCTAGTAGAAATTGTCAAATTCCCCGGGGCAACAGC
AGTTGCTGAGTTATTTTAGTTCTGTAACCCCACGCCCAATGGAACGATACCAACCCAATTACAGATGTCACGTAAAGTT
AGTAAAAACTATACATGTCATTCCTATTATTGGGTCTGCACAAGAAGAAAATGAGCAGGCTCACATTTTGCTACATGAC
CAAATTTAGATGTATTGTACTTTCTATGTACCCCGGTTAGTTTCCCTGTCGCTGCTTTTTGGTGGAATTCCGTAATCAA
TCTGGAACACTCCAGAAGTTGATCTTCCGAGTATTTAGAGTGCAGCTCGCACGTCTTACTCCATTGTTTAACACCATAA
AGTGTGCACTGAGCTGTATAGATTGCAGCAGCAGCAATAAACGATGGTGGAAATTTAAGCAATTCATATTCCACGAGGC
AAAGTTCGATCAAGAAGAACGAAAGTAGCTCAAGCTTTTTATCTGATTGAGCAGCTTTGAGAAATCTTCTCATAAAAAC
ATATGGAGTTGGAACTGACATATTAAACTGCAGCGTATTGAGCATCAATTTTTCCATTTCAAGAACCTCCTTCCTTGTG
TATGCTTTATCCGAAATGACCACCAAATCATCCACCGCAGGGAGAGAAACTTCCTCATATTTGCACGCTAGTAACATGG
CGACAAGACCAACAAGCTGCAGTTTCTTTCTCACAACGGATTGTTTCTCCAAAAATCTATCTATCAAATTAACAGTTAG
GAATAATGTCTCTTCCCTGAGATCAAACTTGTGGTGTACCTCAATGAGCCAGTCGATTAGTATAGATCTCATCCTCTCG
TTGACGTCAAACTGTTGTGCCATATAGTCTGGCGAGATGCGACTGCAACCCTCCATTTTTGCGGACGCGTGGGTCGAGG
GG
```

> SEQ ID NO:4126 167582FL Poppy
```
GTCGACGAATTCAAAGAAGGACAAGGAAGGGAAGGAGAAAGATGGAAAGGAGAAGAAAGAAAAAGGAAGCTAAGAAGGA
AAAGAAAGACAAAGAAGTTAAAAAAGATAAGAAAGACAAGGAGAAGAAAAATGAAGGTCTAGAAGATGAAGAAGGCGAA
GACAAAAAGAAAGAGAAGAAGAAGAAAAAGAAAGACAAAGATGGCGAACAAGAACTGAAGGAAGGGGACGGCGAAAAGA
AAGAAAAGAAGAAGAAGAAAGACAAGGATGGAGAAGAAGAATTGAAGGAGGGGGAAGACGAAAAGAAAGAAAAGAAGAA
GAAGAAAAACAAAGATGGCCAAGAAGACAGCAAGGATGAAAAGAAGACTAAAGACAAAGATGAAAAATCAAGAAGAAG
GAGAAGGATGAAGGCACTGACATGAAAAGAAAAAAAGAAGGACAAGGAAGGGAAGGAGAAAGATGGAAAGGAGAAGA
AAGGAAAAGAAAAGAAGGACAAGAGCAAAGATGAGAAAGATGGCAGCAGCAAGAAGAAAGAAAAGGATGGGGAATCAAA
GGAAGAGAAGAAGGAGAAGAAGAACAAGGATGAAGATAAAGGAAGAAGAAGAACAAGGAAAGTGAGGAATAG
AAGTGCTTCTGACAAGCCAATATAGACTCACCAGCTGCTACTGAAACTAGTGAACCCAGGTGATTGATGATGCAGTTAG
CAATGTACTGTAATCTTCTTGGACCTTTTCTTTTTTTCATATTTCCTTAAGTTTGTAGTGGTTTTGAGGTTTAGTACGG
TTTAACAGCTTGTATGAGTAAACTGTATCACGGCAATACCCTATCTGAATAACATGAACTTTTTACTGAAAAAAAAAAA
A
```

> SEQ ID NO:4127 111752FL Nicotiana benthamiana
```
TTTTTTTTTTTTGGGACTAAAAGCAAGAATAGCCGCTGATATTACAATCATTTTTTGATGAAGTAAAGTAGTTTCATT
CAAAAGCATCAAGAAAATGTAGCAAAAAACTACAAGAAATTAAAGATAAACATCAGCTCCTATATAACAGATTACACAA
ACTAGAGAGCAGATGCAGTCCAAACATTACTTCTAAGAACGGTAACAGTTAATACAATCTTTAGGGCTCCTTTTTGGCG
ATCTGCTGCCTCTCTAAAAATTTAGCTTTGAATGTATAGCGGTTCCTTTTGATGCATCTAGTTCTCACCTCCGAGCTGG
CAGGAATAGTCAATAACTACACCTCGTTCGAAACAAGTTAGCATTAGCTGGCAGGAATCATCACAAATTTACTTTTACT
```

FIG. 1 continued

```
CTGTAGTCTCATTCTTGTACCCTGATGCTCTCCCACTTTTACCAATTAAAAATGGCTCGGGAAAATTATTGTCAGTATG
AATGTCAAGGCCGTGAAACGACCTAGCTGCGAAGTATTCTGCCCCAGATTTAGCTGTTCCATTCATAAGAGTTTGCGAG
TCCTTGTCACGAACACGCAGAGCTTTCTCTGTGATGTTCACTAAAGCAGAAACTCCATCTTCGACATCTTCTTCAACAT
CTTGCTGTTCAAAATCTTCCACATATCCACCCTGAACGAAAGAAAACCGCGCTTCTGACTGGTCTTTCACTTCCACAGG
GGAAGAAGTAATCAAATCCCGAAATTCTGTCACATAAGCTCCAGTCCATTCACTTCCTCTGCCGAAAGCAATCATTGCT
TCAAAAGGAGTAATAACTGGAGCTAAGAACTCTTTACTATCCAATAGAGCAGTTTGTGCACAAGAAACATAAATGAAGA
CATCGCACTCAGGAAAGTTGGCAAGTTTTGCCGGACGCGTGGGTCGAGGGG

> SEQ ID NO:4128    42023FL Nicotiana benthamiana
ATTCTGCATCAAGTTTTGGCAATGTTTCCAATAGCTACTAGGAAACACAACTTTTAATTTTTTCATCTGTTTGTTGTTT
CTTGGCAGGAAAGAGTCATTCAATTAGAGGGCATTTTCTTTTGGGAATCAAAAGAGAAGAACGACGCGATCAACAGATT
TACACTGCCGCGGAAAATCCTAGCAAATAACCAGAACAAAAGACAGGTAAAATAAGAAAGAAAACTTCTGTTGCTGGTC
GCCTAACTGTCGGACATGCCCTTTAGCGATACATGCAGAACCCTCTGTACATATACCTGACCGCAAACATACCATATAA
TGCTCGTTTTGAGCCCCCTTTACGCTGGCCTTCTAAGTTTGGCTAGTTCACCCAAGACATTCTCGAGGGGAACTCTCAG
CTTGCTCTTTTTAGTCTTAAATGAGGGAACAAGAGAAAATACTTCATCAACAGATTCCACGGCAAAGTTGGCAATCATG
CAGAGCTCCCCATCGGAAACACCGTGCTCTTTTAGAGGTTTGAGTATTTGTTTAACCGTATCGGGATTATCGTAAAGCC
TGTTCCTTTGTGCATACATCAATCCCCTGTCAAATGAAATAGGTAGTTTTATAGCTGGATCTTCAGACAAAACCACCAT
TTGCTCTTGGATTCCTTGCAAAATATCAGCAGCTTCACAGTCCATCAGACATGTTGTATTGTCCGGAAGTTCTTGTTCA
ACTCTAAGCTCCAACGGACCAGGTGCTTTTGCTGTTTGACTTTTACTACCACTGCCAGCTTTTTCTCCTTTCCCGCCTT
TGCCGGAAACATCTTTGGAAGATGGTTGATCAGCTTTTCCATTCGATTTTGTGAGATTGGTATCCAGTGATCCTTCAGG
ATCAAACTGAACTTTCCTTCCTCTTTTCGATTTTGCTGAGATATCATCCTTCCCTTTGGATGCAGGAGATTTGAGGGCA
GACTTTCCATTTTTTGGTAGAGAAAACCCTTTTCCTCCTTTTTCCGCCATTCTTAATGTTCACTGGGAAAGAACAGAAG
GCAGTGAAATTTGGCCGGAGAAAGTGAAACTTTTAACAGAGTGTGAATGCAGGAAAGAGCGGACGCGTGGGTCGAGGGG > SEQ ID NO:4129    44526FL Nicotiana benthamiana
AAGAAAAAAAAGAACGAAGAAAAAGAGCAGGCACGAAACGCAGCCGAGCAACAACTGAAAGCGAGGCTTCTTCAGCTTC
AGCTCGACTATGAATCCAATTCTTCAAACGTGAAGAAAATAAAGCTGCTAATCGTTTCACGCTTTCTGGATATAATATT
GGAAACTGAAACTTGATTACCTAGGATGAAGAAGCTTCTAGAATTTGGGAGGAAAGCAATGTTCTATATTAGGGTTCTT
TCAGGCTACGAAGAGCGTCGAATCCGATCTTATCGATTACAGATGCAACAACGCCTTAAACAGGCGGAGGAGAGGAAGG
CAGCAATAAGGAAGGTTCCTGAACAGATGATATTGTCAGAAGTTAGGCGAATGGTGGAAGAGATGCAAGCTTTGAAGAA
GAAGCTAGAGGAGACTGAGGCTGCTGTTGATGACTACTTCAAACCAATAAATAAGGAAGCAGAAGCAATAGTGAAAATG
CAGCTTGAAGGAGAGGAGAATAGAACAAAGGAGATGATGAATATCTTGCAGAAACAAGCTTTTCTTGAGAAGCATCAGC
CAGAGAAACTAATAAGCGCAGAAAATGTGGTCACAGAAAAACATGGCCAAGATAAAGCATCTACATAGATTCCACCAGA
AGTAAGATGCTTTTGTAGAGTATAAAATTGTTCATGAAATTGAACAGTACGAATTCATGTTGTTTTGCCTCTTAGATGT
GGCATGGTTTTGGCAATCCAAAAAAGGAGGCGGATCTGGCCTTCCAAAGCTTCTGATAAATTTGGAACAAGTAGAGAAG
TAGGAATTAGTTTGTTTATTTGCCGTTGCCAGTGATGATTTCTGTTGTAATTTATACGTTGTCTCAATGGGATTTTCTC
GTTCCCAGCGAAAAAAAAAAA > SEQ ID NO:4130    103718FL Nicotiana benthamiana
GAATTCGTGGTATCAACGCAGAGTGGCCATTACGGCCGGGGACCAAGCAAAAACTCAAAACTTCACATCTTTAGTAGTA
GCATCAATATTCAAGATGGTTCTCCAAACTCAACTTGGGTTGAACAAGCCCCAATCCTACGCTCACGAGCAAAATTATT
ATTCCGACGGCAGCCATGGCGGCTCTATGCAAATGACAAGGCCATCGGGCTATTCCACCATGCCATATGGCCAGTCCAC
TCACAATCACATGATGATGGGTCATGGTGGCCAACATCATGGCGGACACTATGGTGGTCATGGCCATGGCTACGGCGGT
CATGAACATCATGGGGCGCATATGCCCCATGACTCCACTAACTTTTCAAGCAGCACCAATATGGTCCATAGTGATGCTG
GCTATGGCAGTGGAATGCAACAATCTACCCATATGTTGTCAGCCATGGGCATGGGATCGACCAATTATCATGGCCATGG
TTATGGTGGCAGCCACCCTAGTCAGTACAGCCAGAGCCAAAAGTTCAACTGGGCTCTTAAGGATCTGGAGGAATAAATA
TATGATAAATTTTATGCTATCCTGTATGGTGAAAGTATGTGTGTGTTTTGGTAGTGGATTTTGCTAATTATATAGCATG
AAGAAACTACTACCTAAATAAGTAATAATGTACTAAACAGTCTGCTGCTTTACTTGATTATCAATGCATCTACTTATCA
TTACTAAATGATGAATAAAAATAAAAGTATGTTTATAAAAAAAAAAAAAAAAAAAAAAAAAAACATGTCGGCCGCC
TCGGCCTCTAGCGACCCTAGGCCAGTAGTTTGGTTTAAACCCAACTGCGAGGGG > SEQ ID NO:4131    182081FL Poppy
GAATTCAACCCCAACCAAATCAAAAACAGACGATCCGAATTCAGTCATTTTCTCGCTCGCTCTCTTGTTTCGTAAAAAT
TTTCTATCTTGAATTAAGATCTAAAAGATGGCGGACAAAATCAAAGATTAACAGTAGTACCAACAGTCACGATGCTTG
```

FIG. 1 continued

```
GAGTAATGAAAGCACGTTTAATAGGAGCAACAAGAGGTCATGCTTTACTTAAGAAGAAATCTGATGCATTAACTGTTCA
ATTTCGTCAGATCTTAAAAAACATTGTTTCAGCTAAAGAATCAATGGGTGATATTATGAAAACTTCATCATTTGCTTTG
ACTGAAGCTAAATATGTAGCTGGTGAGAATATTAAACATACTGTTCTTGAAAATGTTCATAACGCTTCGTTAAAGGTGA
GATCGCGTACTGAGAATGTTGCTGGAGTTAAATTACCCAAGTTTGAGTATTTCACTGAAGGTGAAACTAAGAATGATTT
GACTGGATTAGCACGAGGTGGACAACAGGTGCAACTTTGTAAGGCTGCTTATGTCAAAGCAATCGAAGTTCTTGTTGAA
CTTGCTTCGCTTCAAACGTCTTTTTTGACTCTTGATGAAGCAATTAAGACTACTAATCGCCGTGTTAATGCTCTAGAGA
ATGTTGTGAAGCCTAGGATTGAGAATACTATTAGTTATATCAAGGGTGAATTGGATGAACTTGAAAGAGAGGATTTCTT
TAGGTTGAAGAAGATTCAAGGGTATAAAAGGAGAGAGATGGAGAGGACACTTGCTGCGTCGAAGATGTTTGCCGAGGAT
TAAGAAGCTGAGAAAGTTTCGTTGCAGAAAGGGATTTCGATGAATGCTGCTCATAACTTATTGTCTGCGGCAAAGGATG
AGGATATTGTTTCTGATTTGGTGGAGGTTAGTGATAAATTTATTTATTCAAGAATTTAGTGTGTTGTGTTTTATTTGC
TTTTGATGTTTGGGTTTATCCGGGAAGGAAGGAAGGAAGAAACAGTTTTTATGATTTTGTGAACCTTGTTATATTGTCT
GAATAAGAGTTCATCTCTCTCTGTTTATTATCAAAAAAAAAAAA

> SEQ ID NO:4132  109411FL Nicotiana benthamiana
TTTTTTTTTTTTTTTTGCTCACAAAGCATTCAAATTTCATTAGAACACAACAGTCTAAACAAACAAACAAAAAAACAA
GCTATTTTGAATCCTCGAAATACAATCAGCCATTTTCATGGGGGGAAAAGATCCCTGATAGGAGGCAATAATGAAAGTT
ACATTAAAAACATACAACTCTTGCTTCGAGTGAGACTCAATGCCTTACAAAACTACTTGTGGTAAATATTCCAAACAAA
TCAGCATAGCATATTTTAAAAATCATGTGCAACGGCTCTGACACTGCCTAGTCAAGCCATCTGGTGATACCATCTTCTC
CAACCGCTGCTAGTACTTCAACACGAACATCCAAAACGGCCAGAGGATTCCTACAGTTCACTAGTCGACATTCTTCCAT
AGTACCTTCAAATGTCCAGCTTTCCCAAACATCAAAACTGTGACTCGCAAATACAAATTCCATCCTCCTATTTATCTGT
AATAACTTCCCACCAGCAGTAAATGATCTCAACCCAATTGTATCCTTGCTTCTAAAAACCACAAGGAACTGTGCTGCTG
GGTCTCTTTTGTAACATCTGACATTGTGTCGAGGAACCAACCACCCCCTTTAACTCTTTGTCTGGAGACATGCAAAGC
AGGGTGATGTCTTGCATGTAAAGCTATAATATAACCATCCTCGGACGCGTGGGTCGAGGGG > SEQ ID NO:4133  111761FL Nicotiana benthamiana
TTTTTTTTTTTTCAATGGTAGGAGAATACGAGTTCTTTTTTACTTGATATATATGTCATTTCCCATTTTCTAATTAAA
CAAGGACAAGAAATAGTAATTCATTTGAGCCTATGGCTCTAAAACTTACTCCTTGATTTCCTTCTTCTTACAAAATTAA
ACTGATAATAACAGAGAGAAAGTTGTATAGGAATTTAAGGGGCGGCAGCTGGGGTGGAACAGCAACATTAGGAACTCC
AGGGATTGGAAAAGTAAATGGGTTATTATCACCAGTACCAGGAATTCCAAAACCAGGCAATCCTCCTGATGATCCAAAG
TCAGGAAATGGAAAATTGAAGGGTATATTTGGAATTCCATCAGAAAATGGTGGAAAATTGAATGGAAAAGGAAATCCAC
CAATGTTTGTTGAATCTGGAGAAGGAGAAGCCGAATCATCCTTTTTTACCTTAAATAACTTCTCATTTTCCTCCCTAAG
CATCCTTTTAGCATCACAAACACAGGAAAAGTGAATTAAACAAAGCAAAGTGACAACACTAACAATCAATTTGAGAGAA
AATGTACAAGTCATTTTCCTTTCTTTTCTTTGATATTAAATCGGACGCGTGGGTCGAGGGG > SEQ ID NO:4134  44558FL Nicotiana benthamiana
CCAAACGTTAGGTAAGATTGTTGGGTGATGAACTGGAACGGCGTTGTCAACTGCAGATGAATTCCAATAACGTCGTCAT
TACTTTTGTCGACCAGCAAAGCCATTAGTTTTTATGGTATTTAATTTGTTGTTTCCTTTTCTTTTCCATCGAATAAACT
GGCCATAGGAATGAATTCAAGTACCGGTTGGATGACATGGAGCCCAAGTTCAGCTTTCCTACCAATATCCATGGGTTCT
AGCTGTAATAATAGCAGGATTTCCTGTCATACACTTTGGAATATGGCGAGAAGGAGAAGGGTGTATATAACGGTGAATA
CCAAGAAGAGAAGCGAACCAGTTTTCAAGCCTTCCGTTGTTGAAAAAGTTTCTTTGGTTGATGAGGCTGAGGATGAGCT
TCTTCTTGAAGATGAGGACCTGGTGGATGATGATGATGGGTCTTTGAAGAGTATTTGAGGAAGACGCCGAGCTTTGT
GTTGGGGATGGATCGGGAGGAGGAGGGATCTCTCTGGCTGGGACATCATGGGACAAAAGAGCATTAGAACTTGCAGAAG
AAGTTGCTCTATCATTTGATGGAGAATTGGAATTTATGCGTTTAAAACATTAAAAAATGCCAACATTCAAGTACGAGT
GGAGAGACTTACAAATAAGTCAGGTACTCCTAATATGATGGATATTGAAGCTTTCTCATTAAGATACAGAGAAAAGCTT
GATGAAGATGAGGTGGCTGGATCTATTCCAAATAACGTATCTCTTGAGGTATCATCACCTGGTGTTGAGAGAGTTATTC
GGATTCCCCAAGATCTCGAACGGTTCAAGGATCGTCCTATGTATGTAAAATATGTTAGTGATGAAGTGGCTGAGGGTGG
ATCATCATCTGAACATGATGGTGTTCTCAGGCTCGTCTCCTACAATTTGGAAACTAATGCTTGTATTTGGGGCATAGCA
GATGTTAGAGTGAATAGAGAAAAAGCAGGGAAAGGTAAACCTCTAAGCAAAAAGCAAAGAGATTGGCGCTTGGAGACAT
CATTTACGTCCTTGCGTTTAGTTCGTTTATATTCTGAATTTTAGAGGTTCCAACATTTATAGTCACTAAGGGTCCTTTT
AGCAAAGAACCTCTTCTGCTAACAAGGTTTACATAAGAAGTGAAAAAAGGACAATACAATTCATTATGGTACAGGTTGT
GAAAGTTTGTATGAAACTGGATTCAGAAGTAACTGGATCATAACATTTTGAAGATTTTGTATTACAAATTTACACGTAT
TGCTACTCATAATACAGATGTCAGCTGTCGCTATGCCCAAAAAAAAAA
```

FIG. 1 continued

> SEQ ID NO:4135 103896FL *Nicotiana benthamiana*
TTTTTTTTTTTTCCGAAGTAGGTTCAACAAAGATGCCCACATTTTGTAATAACTGGCAAAATACTGCAACGTCAGTTAA
ACAATATTCAAGACCATGAAGGGAGACTCAAGCACACGAGTATTTGTTGAGGCAAAAAGATAAAAAGTAAACATAGACA
GATACACATCAAGTGCCTAGAAAAGCAATTCCATAGAAAGGAATGGACCTGCAATTCAAATAGTAGATGGTATATCCTC
CTTGCACGAGTCCATTACTACTATTCATCATCATGACGCTTCCTGCTCCTCTTCTCAGAACGTTTTTTGTCTCTGCCAA
CTCGTGAATCATCAGAATCAGATGCTGAGGCTGTCCTCCTGCTCCTACGCTTGTGCCGTGGAGGAGAATCATCACTTGA
TTCATCAGAACTGTCAGCATGTCTATGACTTCTCCTCCTCCTCCTCTTCTCCTTCCTACTTTTTCTCCTCCTCCTACGA
TCTTCATCCTCGTCTGATGAGTCATCCCTTTTCCTCCTCTTTTCCTTTCTCCTCTTCCTGCAATCCTTATCTTCATCAT
CGTCCTCCGACTCACTGTGTCCCTTCTTCTTCCCACTCCTCCTCCTCTTTGATCTGCCCCTCTTTCTTCCTTTTTCCAG
AGTCTGATTCTCCTCCTCCTCATCATCTGAATCTTTCTTCTTGTGCTTCCTAGATGACTTCAACTTCCTACTCACCTTC
TTCCCATACTTCTCAGCAATTGCCCTCTCCATTTCAGAATCATAATCCGAATCAGAACTCTCACTCTCCTCTTCTTCTT
CGCTGCTCTCCTCATTTTCTGCTTTTCCCTTTATCTTAGACCCCTTGATCTTCTCCAATCCAGACAACACAGCAGCCTC
AATCGCCTCCGGATCCTTATCCTTGTTATCATCCTTAACACTCACAAAATTCCTACACTGGAAAGTGAGGTGGCCTACC
CGCCCACACCTCTTGCACGCTCCACGAGTTTCATCAGCGTTGGATCCCGTGATCCGGGCAAGTGCAAGCAAACCTTGAA
AGCTCGCATAAGCATTTTCAGGATCAGCTGCTGACGCCTTCTGGGTAGATTTCTTGTCGTCCTCCTTGCTAGGAGCATA
TGGATCATAACCAATAGCACTCTGCCAGATGCCGTGCGTCTGTAGGGCTGCACTACTGTGAACACTGTTGTTCGCAGGC
ATGCGAACCCTACCTGCTGTGGCCGGCATGTTGACTGTTTATCACCAAGAAGCTGTATACACCTTTGTGTGATGATTAT
ATCAGTTGTTCGACGATAATCGGAAACCTATGTTCGATCGGACGCGTGGGTCGAGGGG > SEQ ID NO:4136 57145FL *Nicotiana benthamiana*
GTTCTTGTCATTAATTAAGCGGCCGCGTCAGCCTTGCACGTGACACTAGCCGCTGCCTGCTCGCAAACCTCGCACATCC
ATACACGTTCGTGGCGGGCGTTTCGGTGCACCCTCGTGTCGCAGACCAAGCACATGAACATGTTGTCTACTCGACAGAA
CACGAGTGCGGCGTCTAAGTGGCAATACTCGCATGGTTTTGCTACTGCCGCCGCACCCCATCCTCCTGGAAAACAATTT
GCGCCGCCTCTCAATATGCCCATATTTTCTCTTCTTTCTTCTCTCTGGCCTGTTGCGGACGCGTGGGTCGAGGGG > SEQ ID NO:4137 113072FL *Nicotiana benthamiana*
TTTTTTTTTTTTTTTTTTTTTTTTTTTTTCCTTCAAGACTGGTTCATACAATCCCACAAAACTTAATTTTGTCC
AGGTGATATATACACTGGGATACATCACTATGCACACATAATAATAAACAATGACATAATCACACAATGTATCTAATAA
GAGAAAAAAAATTCCAATTGCACAAACTTTACAAAAGCATTTTCAATCATCGTCGATGCAGGCCTAATGCTTGTTGCTT
CAAAAACATCCAAGGAGTTTCTTTGGAGCAGTTCCAGTGGCGCGGTATTTTGCTGCCAATTCCTCTGCCTTAAGAAGAT
CTTCTCCACGTTTAGCTTCAATCATCGCTCTCTTTTCCTCTGCTTCCTTGTGGAGTAGAGCGATTTGTTTTTCATTTT
CTCAATATATTCTGCCTTCTTTTTCTCCACCTGCTCCTCCATCTTTTTTAGCTCAGCCTCCAGGTTTGCTTTCTTACTA
TTCTCCCATGCAGCAATTGCTGATACATTTTTCTGAGCTTTGTTTTCGGCTTTTGATTTCTCACTTTCCTCCCATGCTT
TGATTAGTGACAGTCTCTTCTCTGTTGCAACTCGAGCAAGCACAGCATCTCTGTCAATAGATCCCTCCTTTTTCTCCTC
AGCAGGTTTATCTTCAACGACAACTAGTGCTTTAGAATCATCGGATTTTTCTTTGACTTGTTCAGGAGGAGGCAGAGCT
GGTGCAACTATAGCTTTCTCATCAGCCACTTCTTTAGGAGTTTCAACAACAGGTTCTGCTTCTTTAACAGGTGCAGGAG
CCTCAGGTGCAGGGGGAGTAGGGTCCACAACTTTCTCAGTCTCCACTTTCGTAGCTTCTACTTCTGCCATGGCTACAAA
CAGAATTCAGAAAAAAGCGGACGCGTGGGTCGAGGGG > SEQ ID NO:4138 43449FL *Nicotiana benthamiana*
TTTTTTTTTTGATACAATCTTTTCTTATGTAAACACCTATTTGAGACAAACAAATAACCAAAAAAAAAGAAAAAGAA
AAGAAAAGCAAAGATTTTGAGCAAACACAATTAAGTCCAACATTTACTCTTGAATTTAGTATACCTCTCTACACGTCAG
GCACATGATAGGTGACAACCGGTGGGTCTATTACTTCTGGCTGTTGGTGCCTTTCTTCTTCAGTAGGCTTCCAAATTTA
TGAAGCAAAGGTTTCTTCTTCTTCTGACTTTGTGGCTTTGTAGGAGATGTGCCACCATTCTCAGGATTTTCCACTGAAG
GTAATCCGTTTACCTGGTCAAAGCTCTCTCCAACATCTGTCTTCGACTCTGAATCCTCTTCTTGTACTGTCTCTCTTTG
CGGAGAGAAGTCTTTGTCGCCAATCTTGCAGCTCTCCCACATTTTAAACTCGCCTTCTGCTGAATCATCATCTTCCTTT
TCTTTGTGTTCATTTCCCTTAAGTTCTCCATTTGGCTTCTCAACTTCAGCTAAGGTCTCAACAGCTTCATCATGCGAGA
TGATGTTGACGACTCCTTCAGATTTTCTTCAGCGGATTGCTCAGATTGATGAGGAATAACTTCAATCTTAGGCTTCTC
CAGTATTCCTCCTCCATTTTGTTCAGAGAATTCCACCACCTTTGGAAGCATATCATAATCTTTTCACTTTCAGAAAGC
TCGCCATTTTCTTCAGCTTCCTTTTGGCCAAAGCTTCTTGAGGGACTTAGACAACTCTTCAACTTTCTTTAAAGATT
CGGCTTCTCTACTACGAAGCTCCTCATTCTCCTGAAGAATATTCTGCACTTCATTTCCTTGTCCAACAGCGACTCCTT
CAACTTCATGCTCTCACCCTTTGCTTCACCAAGAACCTCTTTCAGATAGGTCACCTCAGATTCAGCTTCGTTCAGGGAA
TTCTTCAACTGAACTGCTTCCTCTTCGAAAGAAGCTTCTTGCTCAGCCTCTTTTAGCAAATTTACCAATCGGTTTATTT
CTTTTTCCATTGAAGAGTTTTCTTCTTCAGTTTTCTTTACATAATTCATCAGATAAAGCTCCTTGTCCTCCCACTCAGC

FIG. 1 continued

CTTCGAAATTTGGTGCTCATTCTTAGATTGTTCGACTGAATTAGTGAGATCATCAATTTTCTCTTTCGCTTCATCAAGC
AGGCTTTCGTACTTTTCATTGGTTGCTTTCAATACTAACTTCAAGTCTTCTATTTGTGTTTCGTAATGTTCATGTTCAG
CTTGGCTAGACAACCACCTCTCTTTGGCTTCTCTTGCTTCTGAAGAAACTTCATGTAATGCCGATGCCAAACTTTCCAT
CGCCTTCTTACTTTTCTCTTCCTCCTCCCTGGAGTTCTCCAACTCATTTATAAGTTTGTTTTTCTCTTCCAAGAGGGAC
TGAACATTTTCTGCGGCTAGTTTCTCGCGGACGCGTGGGTCGAGGGG

> SEQ ID NO:4139 126117FL *Nicotiana benthamiana*
GGGCATCCTGAGAACAATTTATTTGTTATGTGCTCACGAACTTCGTCAACAAAAACTCACTTGAAATCTCTTTGGAAAG
GCCAATTAGAAACCCCTGATGCGAGCAGACATAGTATACCTATCCTCGTAGCTAACTTTTCGTCTGTTGATCAACGCAT
CTATGAAAGAACCAGTGACAGTTTATCAGTACAGGGGATTTGGTGCAAAGAAGATGGTTGTGTTTTTAAAACTATTTTC
TGCCCCTTTTGTGTAAATTCCAGACATTGTCTTGGTGTACAGGTCATGGCTTCTGATGCAGCTAATGTCCAGTTACTAA
ATAAGGTGCTGTTTTATTGTGATTGCTTGGTGATAAAAGAGCCTGAAGCGTCAAGAAAGGAATTATCTCCGTCCACCAA
TTCAACCTCTGATAGAGGAGTTATTAATTCCATTGAGAGTTTCTCATTTACTCCTCAGCAGCAGAACCTTGGAGGATGG
AGAACTACAAAATCAAAGATGCGGTTACCAAAGAGGAGCATCTCATCTAGTGCACAGACTGATGTAGAATGAGTTGGAG
TCACTAAATAGATGATATACCTCCTGCAGAAGTTACGATATTACAAGACAAGCTTCCAAGAGAGATAACAAGTCAAAT
GGGTCAGAAGTTGCTGGCAAGATGTTAGTTGAGGGATACTCGGAGTTATGTGTGGATGCCTACAATGAACTGTTTGTGC
AGTTCGTTAAAGATAGCAGCAGTCAGTTTTCACTTTTCTAGTCGGCTGAGTGTACATATTAGACAGATATGGGGAAAA
TTTTATATGTAATTTCTACATTATTATAACAAAAATGTTCGAAAAAAAAAAAAAAAA > SEQ ID NO:4140 104065FL *Nicotiana benthamiana*
TTTTTTTTTGGAACTATTCAAATTTAATGTAAATCAAAATAAGATACAAAAACCAATTCCCTTCGTACAGAAAGTTACT
TGCATTTTTAAACCAAAACGAACATTCATATATTACAGGAGCTTGTCAATGCAATGCAGCAAACGGTAAGGCAAACAGC
ACCAAGCCATAATACTAGGGCCAAAACAAATGTGTTCCAATAAAATTTCCAAGAAGAGGTTTCAATCCGTAAATGTAAC
ATAGATGAACCCTGGTGCTCCCGAATTGCGGTCAGCAATGACATCTTTCTTCCTTAGAATCAGTCTGCAGTCCAGCTCT
GCTCCACAACTTCTCTAACTCTGCGGTTGTAATCCCTTTTATTCTCGCTGAACATCCGAGCTGCTTCCGAATTTGCAGG
TGAATTGGGGTTGGGATCGCACAGCAATGACTGAATGGATGTAAGTATAGCTGCAACATCATATATTGGACTCCACTGA
TTTTGAAGAATATCCAAACATATACTTCCATCTGCATAAATGTTAGGATGAAACATGCGAGAAACAAACCGCACTGTTG
GTGGCTTATTGGGGTAATCCTCAGAGAATTGAAGAGTCAGCTTGAACGTACCACCATCCCAAGGAGTGTCATCAGGACC
AAATATCACGGCATTCCAAAGCATAATGTTGTTGTCTTGAGGTGCACCACTAATACCAGCAGGAGGGTCCTGCTGCAAC
CTCTTGAAATCTCTCATCAACCTCTTTCTAGCCGGAGTCGACATTGTAACCACCAATACGGAGGAAACAAGGCGGTGAG
CTAGGGTTTTGGTTTGATTCTGCGTTGAACTCCTGCTTTGTGTTGGAGGAGGTGCCCCGGACGCGTGGGTCGAGGGG > SEQ ID NO:4141 108358FL *Nicotiana benthamiana*
TAGCTCTAGTAATACACACATTAGCCGCACTTCCCACATTTTTAGTCTGAATAAAATGGCCAAGGCTACTGTATCATCC
ATTGTCCTCCTCCTCACTTTGAACATTCTCTTCTTCGCAATGGTTAGTTCAACTTACATCCCATGCCCACCAAAAACAA
AGAATCAACCCCATCCCACTACCCCATCATCCAAGGGTTATAAGAAGTGCCAAAAGGACACACTAAAATTGAAGGTGTG
TGCCAATTTATTGAATGACTTGGTGCATGTTGTTATTGGAAGCTCATCAAAGAGTTCATGCTGCTCTCTCATTGAGAAT
CTTGCTGATGTTGATGCTGCAGTTTGCCTTTGCACTGCCATTAAAGCTAAGCTCTTGGGAACTAACCTTGATACCGCTC
TTTCCCTCAGCTTATTGCTCAACAATTGTGGAAAGACTGTTCCTAAAGACTTCCAATGTGCATAAATGGCCATCTTCCC
ACCCCAACTTGTTTGGTAATGAGGCGTAGTTGTCTGTTTGTGGTGTTTGTTTTCTCCATAAGATTTTCGTCGGAGATTT
CAACTAAAAAATAATCAGTACTGAGTGTGTTTGTGCACGGTTGCTTATTTTCTCAGGAAATATGTGGAATTATTCTAGT
GCTTAGAAGTACTGAGTGTGTTTATTCATGGTTGCTTATTTTCAATGTGTTGTATCCCATATTTATTTGTAATAAGATG
GTTATGTTCTCACTAAGGAAAAAAAAAA > SEQ ID NO:4142 57319FL *Nicotiana benthamiana*
TTTTTTTTGGTAATTAACTTTCTTTTATTAATCACCAATGATAAGTCATTACAAATCCATAATCAGCTAGCACAGCTAA
TTATCAATAAGAAGCTCCTCTCCTACTCCTATACTATACCTCCATTTCTAATTACATTGAACCTGTTGAAATTGTAGGC
TAAACTCAATATGACTTCTAACATGACAAATGTAGGCAGTATTTCTAAGCAATTGGCTAACACACTTTGACATATTTGT
GAATATTCTGGAGTTTCTTTCAAGCCAAACACAGTAGCAAACTTCTGCAAATATCAGCTTCATAGCATGAGCTCGTGCA
GTCCTTCCCTTAGCCTTGGCTACAACCCATTGTATGAATCGATCCCAAGATTGAAATGTAGGCTGAGTAACTCCTATCC
AACCCATTGCTTGATGCATCATCATGGTAGTGAAAGGACAATGATAGAAGAGATGATTTCTTGATTCTTCCCATTGTTG
ACACAGAATGCACATGCTGTCAATGTTTGAATTCCATTGTTTCACTCGAACTTTGGTAGGCAGCCTATCCTGCAGTATT
AACCATAAGTTAAACACTGCCTTTGGCCTTGCGGACGCGTGGGTCGAGGGG

FIG. 1 continued

> SEQ ID NO:4143 113595FL Nicotiana benthamiana
TTTTTTTTTTTTTTTTTTAGAAACAAAGTGGATACTATATAATTTATAAGCACAATGAACTGTAAGGTAAATACATAA
TTTTATTTGGACATTTGCTCAGAATAGAAGAAAATTACATCAAAATCTACTCTACTTCACACAAGCAGATGCCTCTCAT
ACAGAAAATTAACAGTCTGAACTGGCATTGCCATTTGTGTGCATTTATTCAGTTCCTGCAATCTTCTTCTTCAATTGCT
CAATGTCTTCTGCCAATTCTTTTCTACTTGACTTGAATAGAAGATAGCGGTAGACAAACCACCCAGTATATCCAAGGCC
CACCAGCTCCATAATTTTTGGGAGCAAAGGAACTGAGTTGATAGCACCAACAACAATTGAAGACAGCCAAACTGCAACA
ATTGCCCCACCTCCATATACTATAACTGTAGACTTATTTTCAACAGCATCCCACTTTTCTTTTAGATCTGTCAACAATT
CACTGGTATCAACAGCACCGGATTCTTCTGATGAAGAGGCTTTGACCTGGAGTAGCGAAGCCTTCTTGGGTTCAGCAAA
CTGGAAGGAAGTAGAGAACGCGGTAGCAGAAAGGCGGGGTGGAAGGTAAGGCAAAGCGGAGCAGCGAACAGGGGCGGCT
TTGGTGGTGGAGGAAAGTGGGAAACGAGAAGCAAAGACGGCAGTAGCTGCCATTGAAGTAGAAGCTGCTGCTGCCATTT
GGCCGATGCTTAGATTTTTGGGGCTGGCGGTGTATGCTTACGGACGCGTGGGTCGAGGGG > SEQ ID NO:4144 128348FL Nicotiana benthamiana
GACCATCTCAAAATCACTTGCTTTTTCCTCTCATTTTCTAGAGAAAGAAACAACAAGACGTACAGAACGAGAGTTCAA
GAATCTGCAATGGGAGTGGCTCGAGTTAACCAATTCTGGTTGCATCTTGTCATCCTCTTCTCCATCTCCGTTGCTTCCA
TTTCTAGCACTGAACTGAATTGTGTATACACAGCTTATGTTCGGACTGGGACATACTGGGGGTCTGGAACTGACTCAAA
AATTTCCTTGTCTCTTTACGATGCCAATGGCCATGGTCTTAGAATCAATAACCTACAAGCCTGGGGTGGGCTTATGGGC
CCGGGTTATGACTACTTTGAAATGGACCAATTGGATATGTTTACGGGCCGTGGTCCATGTTTGACTGGACCAATCTGTA
AAATGAACTTGACTTCTGATGGATCAGGTGAGCACCACGGATGGTACTGTAACTACGTGGAAGTCACGTCTACAGCAAA
ACACAAACGATGCAGCCAACAGGTGTTCACCGTGGAGACGTGGCTCAGTGCCGGTCAGTACCCAGATGGGTTGACCGCC
ATTAGGAACAACTGTAAGCGTATTTCCAACGAACAACAACCAATTCATGATTCTGATCAATCTTATCATGTTGTGGATG
TAATTTAATTCGAGTTTATTGGACGTTGTATGATTTACGAAGGCCATTTAGGCCAAGGCCTGATATGTACTCTCACGAG
TGCTACATAGTTGGAATGAAAAGTTTTCTTTACCCATAAAAAAAAAAAAAAAGGGCGGCCGCGTCGAGGGG > SEQ ID NO:4145 111429FL Nicotiana benthamiana
TTTTTTTTTTTTTTGTTTAGAGAAGAGAACTTCAATCTTTTAATTAGAAAGTCAGTTCATCAAAGGGATAACAATTT
TAAATTGTACATATGATGACCACAACTCTCATTCTATCACATCATTAACATCCAAAGAAAGCTTATGAAACGTACGTAG
TTAATCCTCAATAATTCTCAGCTATCCCTCTCTCCTCTTCTAACATAAAATTACTAGTACTACTACGTATATAACAAAA
GAAATAAACCCTCTTATTAGCTTTTCGATCATAACTAGGATTAAACGAGAATTTTAGTGACTTTACCTAACGTAATAGT
ACTACTAAAAATTTGAAACACACATATATCTATTACTAGCTAGCAGCCAACACAACCTTTCTCCGAGGATCGGACGCGT
GGGTCGAGGGG > SEQ ID NO:4146 104765FL Nicotiana benthamiana
TTTTTTTTTTAAAGGTAAGAAGATTCACCTTTCAAAATCACAATTACAAAAATTACAGAGGAAAGAATCGCGATACAC
TTGAAACTACACCAGCTAAATTGCTCCAAAATCATGCATTGTATAAAATTGCCAATGATCCTTCGGAACTCATGTATAC
CTTGGATTTTACACCCAAAGAAAATTGTAATTAAAAGAAAAAGATTTACAAAAATATTTCCACGGAGAGCCACCTATAT
TCTGTGCAATGGAGACTTTCACTGAAATACAAACCTCTTACCAAGTGCTCTGACAAGAAATCATGTGTTCTCCCACTTT
AGGGAGAATGCAACCGGAACTGCGTTCCAAAAGAATGGGAATCGAAAATATGGGAGATGTATGAACCTGGGATAACCAA
TGCGAGAAACCCAAATATGTGCTCAATATACGAACAGATGTACAAAATCACTTGGCAGATCATCCATCTTGCATGTTCT
CTTCACATAAATCAGTCTGTGATTTACTGGGAATGATAGACGGTGGTGACCATTGATCTGGGACCATGAGAAAATAGGT
GGTCATGGCCTTGCGAAACCTCTTTTTGTACTGCTTAGGTGAGATTATAGTGGGCGACCGGACGCGTGGGTCGAGGGG > SEQ ID NO:4147 129424FL Poppy
GAATTCAATCAAATGGCTACTGCTAGAGTTTTAGCTGCTAGTATGTTGCATGAATGCAACAACACTCACAGTGCTTCAT
TTCTTTTGAGACAATCTTCTTTCATCTTACCTATTAAACATCAAAGTATTAATTTCAGTAGAAGAGCATCTTCTAGGAG
AGCTTTTACTTGCAAATCTCTTTACAAACCTGAAATTCAAATCAAACAAGAAGGTGAACCTCAAACCCTAGATTACAGA
GTCTTCTTTCATGATAAATCTGGCAAAAAGCTTTCACCTTGGCATGATGTACCATTGCAATTGGGTGATGGAGTGTTCA
ATTTTATCGTGGAAATACCAAAAGAGACAAGTGCAAAGATGGAAGTTGCAACTGATGAGCCATATACTCCCATTAAACA
GGACACCAAGAAGGGAAAACTTAGATTCTACCCCTACAACATCAATTGGAACTATGGATTGCTCCCACAGACATGGGAA
GACCCAACAGTAGCTAATTCTGAAGTTGAAGGGGCATTCGGAGATAATGATCCAGTTGATGTTGTTGAAATTGGGGAGA
GGCAAGGAAAATTGGCGAGATTCTTAAAGTCAAGCCTTTAGGTGCTTTGGCTATGATTGACGAAGGAGAACTCGACTG
GAAAATTGTTGCGATTTCGTTGGATGACCCAAAAGCTTCACTCGTCAATGATGTTGGTGATGTTGAGAAACATTTCCCG
GGCACTCTCACTGCTATAAGAGATTGGTTCAGAGACTACAAGATCCCAGATGGAAAGCCTGCCAATAAGTTTGGACTTG
GGAACAAAGCAGCCAACAAGGATTATGCTCTGAAGGTAATAACTGAAACCAACGAAGCTTGGGCTAAACTTGTCAAGAG

FIG. 1 continued

AACTGTTCCTGCTGGGGAGCTCTCCCTTCTGTAAATTTTGAATTTTTAAAAGTTGAAGATAAGAGGCACTTTGGCCCGC
TCCTATCCCCCTCCTCTCTATTGTTTTCTTTCATGCTGGATTCCAAACAAACTTCCTCCAATTTTTTGGACGAAGTA
TTGATAATTTCTAATCATTGAGCTCCATTTTTCAAAAAAAAAAAA

> SEQ ID NO:4148 114417FL *Nicotiana benthamiana*
TTTTTTTTTTTGCAGTTTCAAAAACAAAAATAAATCTCTTCAAAGTAAATAAACTTCTTCAAAGTTGGAATTGTACATG
AACATTACTCAAGGAAAATGGTAAGTGCCAAATTTTCACATTGCAATAGGCAAGCAGACTATAATAGGACTCTAGCCAT
AGTGCTTGTATAATTAGCAGCTAGATAAAATGAGCTCTAGCCCAAGGAGGAAAATTGAACAAACTTTTACAGCCTGAAT
TTATTCCTTAAAAAGTAGACAAGATACACAAACGTTACAGGATCAGATAGTACTAACACTATCCTGCCTAAAAGAGGCA
GATAGTTTCTTCTAGCTCAAGCTCGAGATAATACAGCAAACGCTTTTACGAAGCACGGGATGGCATACCACGGCCTCTG
CCTCTACCACCATAACCATAAACATACCCATTTCCTCTATTTCCACCGTATCCTCCATATCCTCCTCTTCCATAATACG
AACCTCGAGAACGTCCACCACGTCCAGGACCACGGCCACCGCGGCCACCCCTGTATCTTGAGAAATCTCCAAATGTCTC
AACGTCTATCTTCCTTTGCTCAGAGAACCTGGTCCTTCCATGACTTGGGTCATTATCAAGTGCATTACTTGACAAAGAG
TCGAAAAAATCATCCTTGTTGTAAACAGGCTTCACATCAATCTTAGGAAGATCATCATCATATTTATTGAAAGAGATAT
CTTCATCGCTGCCATTTCCATCTCCTTCTCTGTTACTTTTGCCAAGATGACCCCACACTTCGTCTTTCTTGAACTTCTC
ATTCATGGCCATAAAATCAAAATCCTCTTCAAATTTTGTAACTGGTCTTGAAACCCCCATTCCTCTTCCGCCACGCCCT
CTGTAGTTGTTGTAACGTGCCGGACGCGTGGGTCGAGGGG > SEQ ID NO:4149 44146FL *Nicotiana benthamiana*
TCAAGTATTTGTCAGAGGTAAAGCAGGGGAGCGTTTTGCTGTAAGGAATTCTCTTGCTCAAGCTGTTGTAGAAGGCACT
GGGGACCACTGTTGTGAGTACATGACAGGAGGGTGTGTTGTGGTGCTTGGAAAGGTTGGTAGAAATGTAGCTGCTGGTA
TGACTGGGGGTTTGGCATACATTCTTGATGAGGATGATACCCTTATATCTAAGGTAAACAAGGAGATTGTTAAGATCCA
GAGAGTGGTTGCTCCAGTGGGTCAAATGCAGCTAAAGAGCCTAATCGAAGCCCATGTGGAAAAAACGGGCAGCACGAAA
GGCGCAACTATTCTCAAGGAGTGGGACAAATATTTGCCACTATTTTGGCAATTGGTTCCACCCAGTGAAGAAGACACTC
CGGAGGCCAGTGCTGAATACGAGCAAGCTGCTGCTGGGCAGGTCACTTTGCAGTCTGCAGAGATACCATTGAAGTAAAT
CTCACATTAGCACAGCCTTGACCATGGTTCTAAGCAGGAGACAGTTTGTACAGGAAAGAATGATATCGTCTCCACGGAA
GGACGGTGAAGTCTGAGAGATCAAAACTCTTAAAGGTGCAAGCAACTACCTTTGTTGAACAAAGGGCTGATCTTTGTGA
TGCTTCAGCAGCTGTACAGTGATGCCGTAGAAACTCTAAATTCTTGGTAAATTATGGCATAATATTGCCGTTTCTACTA
TTTGCTTAGCCGAAGAACTTGGAAATTCAGGTACAATGTTTTGGACCTGTTACTAGTTCTTGCCCCTCATTTTTTCTT
TGAGGCAGTTTTCATGCTCGTGCTTAATAAGTTGTAACTTGTATCATGACATTGACAATTTCATGGAATGTGTAATTAG
CAAAAAAAAAA > SEQ ID NO:4150 126534FL *Nicotiana benthamiana*
ACAAAAAACTGACTTCTTGCAGCTATGGCTGGAAGAAAAAGAAGAAAATGAAGTTATTAGCTGCAACAACTCCAACTA
ATGGTGGTCCTTCTACTGAGGAGCGTGAAGGATCTGATGAGCAAAACTCATTGTTTTGTGTACCAATGGAAATTCTAGA
ACTGATTCTCTCCCGGTTAAACTTGAGAGAAAACATCCGTGCTTCTGCTGTTTGCAAGCAATGGCTTGCTGTCTCCATT
TCTGTACGAGTTGCAAATAAACCACCTTGGCTTATGTTTTTCCCAAAATTCGGTGACTTGGTTGAATTCTATGACCCTT
CGGTGAGGCAAACTTATTCAGTTGAGTTACCAGAGTTACGTGGCTCTAGGCTTTGTTACGCGAAGGATGGCTGGTTGCT
GTTATACAAACCGAGAACTTTACGTGTGTTGTTCTTCAATCCTTATACGAAGAGTGTGATCAATTTGCCAAGACTAGAA
TTAACATACCAGATAGTTGCTTTTCTGCAGCTCCTACATCTCCGAACTGTATCGTTTTCACAGTTAAGCATATCAGCC
CCACTTTGGTCGCAATTAGCACATGTCAACCAGGGCAACGGAATGGATAACTGCCAATTACCAAAATCGTTTGCCATT
TGTTAGCAGCATTTGGAATAAGTTAGTTTTCTGCAATGGTCTCTTTTATTGTCTGAGTCTTACTGGTTGGTGGGAGTC
TATAATCCAGAAGAACGTACTTGGCTTGTTCGTGTGGTTCCACCTCCAAGATGCCCTGAAAATTTTTCGTGAAAAATT
GGTGGAAAGGAAAATTTATGGCAGAGCACAATGGAGATATCTATGTGATATACACTTGCTCTACTGCAAATCCGGTGAT
ATATAAGTTAGACCAAATAAATAAAATTTGGGTCGAGATGCAAACTTTAGGTGGTTTGACACTTTTTGCAAGTTTTCTG
TCATCTCAAGCAAGGATAGATGTTCTTGGGGTGATGAGAAATAGTATTTATTTCTCGAAAGTTCGTTTTTATGGAAGGC
GTTGCATATCGTATTCTCTCGATCATGACAGATACTACCCGAGAAAGCAGTGTTATGATTGGGGAGAACAAGATCCTTT
TGAGAGCATTTGGATTGATCCACCGCAGGACCTTTCAGCCTTTGTCTGAAAAAATTTGTGACAAAGGGCTCTAATACAA
GGTCTTGTCTTGAAACGACATCGTCAACCAATTTAAAAGCTGCAGATGACGCTGTCGATGTATCACTAAATGTCGTCAA
AGAAGTTTGGGGGCATGATAAAGAGCAGGTTTCTAATCATGTTATCTGTCAATTTATGGTACTTTATATAAGTAGTCAT
TTAAGATTTTTCTTCAATGAGTAAGAACTGTTCTTCCTTTGTGTAGAAAACTTTTAGATAACTTAACGCTGCAGTTGAG
TTTGTAGAAAGTTTTTATTCAAGATAATGACTGAATAAGAGCACTAGGTATTTCTAAAAAAAAAAAA

FIG. 1 continued

> SEQ ID NO:4151 108404FL Nicotiana benthamiana
ATCTACTTGTCAAAGTTATCTATTGCATTTAATTAGTTTTGCTCTCAGTTAGACAGTTTCTTTTGTAGGGTGGTGCCGC
TGTCTGGTGCATGGGCTTTCAGAAAATTCCGGGCCAAGGATTGACAATTTTAGGAGATCTTGTTCTAAAAGACAAGATT
ATTGTTTACGATTTGGCTGGACAACGGGTTGGATGGGCCAATTACGATTGTTCGCAGGCGGTTAATGTTTCAGCTACCA
CAAGCAGAGGGAAAACTGAGTATGTCAATGCAGGACAGATCGGTAACAACAGTTCGCCGTGTAGCGACTCTTACAAGCT
GTTACTAAGCTTCATTCTAACTTCTGTCTTACATGTATTAGTGCGTGGCACAAACTCAATCTCGTAACGGCTTAGGCAA
ACTGCTCAACTTTTTCTCATTTTTTTCTCTTTTTTTTTTCTGTATAGCTGACTGTCCTGTAGTTATTTATTTACAGGTG
TCGATGAAGATCTGTCTTCAGATCTGGATTGCAAAAATTTTAGGTGCCTTTAATGGTAGCCTTAGATATGTTGTTTGTT
CAAAAAAAAAAAAAAA > SEQ ID NO:4152 20019FL Nicotiana benthamiana
AAGAAAAAAAAGAACGAAGAAAAAGAGCAGGCACGAAACGCAGCCGAGCAACAACTGAAAGCGAGGCTTCTTCAGCTTC
AGCTCGACTATGAATCCAATTCTTCAAACGTGAAGAAAATAAAGCTGCTAATCGTTTCACGCTTTCTGGATATAATATT
GGAAACTGAAACTTGATTACCTAGGATGAAGAAGCTTCTAGAATTTGGGAGGAAAGCAATGTTCTATATTAGGGTTCTT
TCAGGCTACGAAGAGCGTCGAATCCGATCTTATCGATTACAGATGCAACAACGCCTTAAACAGGCGGAGGAGAGGAAGG
CAGCAATAAGGAAGGTTCCTGAACAGATGATATTGTCAGAAGTTAGGCGAATGGTGGAAGAGATGCAAGCTTTGAAGAA
GAAGCTAGAGGAGACTGAGGCTGCTGTTGATGACTACTTCAAACCAATAAATAAGGAAGCAGAAGCAATAGTGAAAATG
CAGCTTGAAGGAGAGGAGAATAGAACAAAGGAGATGATGAATATCTTGCAGAAACAAGCTTTTCTTGAGAAGCATCAGC
CAGAGAAACTAATAAGCGCAGAAAATGTGGTCACAGAAAAACATGGCCAAGATAAAGCATCTACATAGATTCCACCAGA
AGTAAGATGCTTTTGTAGAGTATAAAATTGTTCATGAAATTGAACAGTACGAATTCATGTTGTTTTGCCTCTTAGATGT
GGCATGGTTTTGGCAATCCAAAAAAGGAGGCGGATCTGGGGTTCCAAAGCTTCTGATAAATTTGGAACAAGTAGAGAAG
TAGGAATTAGTTTGTTTATTTGCCGTTGCCAGTGATGATTTCTGTTGTAATTTATACGTTGTCTCAATGGGATTTCTCG
TTCCCAG > SEQ ID NO:4153 105352FL Nicotiana benthamiana
TTTTTTTTTTCGTAGACTGTAAATCTTAATTCACTTCATTCCAGAGAACTTTGTAAATACAGATCCACAAGTAACATC
ACGGTAACAATCTCGCGGTCAAAACGAGGACAGTAACAGGAACCAAAGTAAACCATAACGGAACTTCAACCAAACGTAG
AACCATAAATTTCAAACAAAAAATAAATCTAAAGGCAACGGAAATCTAACTCCTCCAGTTTCCTTCAGAACCACCACC
GTAACCACCTTCACGACGACCACCTCCATAACCGCCGCCACCACCACCATAACCACCTTCACGTCGGCCACCTCCGTAACCA
CCACCACCACCGTATCCACCTTCACGACGGCCACCACCTCCGTAGCCTCCACCGCCACCACCACGGTAACCGCCACCAC
CACCACCGCCTCCGCCGCTACCGCGAGACTGAGCTTCGTTGACGGTGATGTTACGGCCGTCAAGGTCTTGACCGTTCAT
CCCTTCAATAGCGTCCCTCATGGATTTCTCATCCTTGAAGGTAACAAATCCAAATCCTCTAGATCTACCAGTTTCTCTG
TCATTGATGATCTTCGAGTCGAGAATTTCGCCGAACTGAGAAAAAGCATCCCCAAGTGTTTGGTCGGTGGTAGCCCATG
CTAGCCCACCGACGAAGCACCTGTATTCAACTTCTGCCATTCTTTTCTGATTAATAAGAATAAGAAGAAACACGCGTGG
GTCGAGGGG > SEQ ID NO:7389 108496FL Nicotiana benthamiana
GGAAATATTATTGGGAGAGAAATGAAATTTCACCTTTGGTTTGACCCCACTCAAGCTTACCACAATTATGCTATCCTTT
GGGATCCCAATGAGATCATATTTTTTGTCGACGATGTTCCAATCAGAAGATACCCTAGGAAAAATGATGCTACATTTCC
ACAAAGACCTATGTATGTATGGTTCCATTTGGGATGCTTCATCTTGGGCAACAGAGGAAGGAAGAATTAAAGCCGAT
TATCGGTACCAACCATTCGTCGGAAAATATAACAATTTTAAAATTGCTGGTTGCACTGCTAACGAGAACCCTTGGTGCG
GACGCTCGCCCTCCAGCTCTCCGTCTAGAGCTGGTGGGCTGAGCCGCCAGCAGATAGCGGCCATGCTATGGGTGCAGAG
GAACTATAAGGTGTATGATTACTGTCGGGACCCCAGGAGAGACCATACCCACACTCCTGAGTGTTAGTACAATTCGTAA
AAAATGCATTATTTGCATAAAATTTCATACTGTTAGTGAATATAAGCTGAAATCACGAATAAGAGGAATGAAACGTGTA
AAGGAATATTTGGTCATTTCACCAGAATTGACTTTCAATTGTACTTTATCTTTGAGTAAATGTTTTTGTTTTTAATA
AAAAAAAAAAAAAA > SEQ ID NO:7390 200647FL Saccharomyces cereviseae
GGAATTCCAGCTGACCACCATGATCTCTGTCATGGCGGATGAGAAACATAAGGAGTATTTAAGCTATACTACTTTCAG
TACATGATAATTGGTCTATGTACGATATTATTCCTCTATTCGGAGATATCCCTGGTACCTAGGGGCCAAAACATCGAAT
TTAGCCTTGATGACCCCAGTATATCAAAACGTTATGTACCTAACGAACTCGTGGGCCCACTAGAATGTTTGATTTTGAG
TGTTGGACTGAGTAATATGGTCGTCTTCTGGACCTGCATGTTTGACAAGGACTTACTGAAGAAGAATAGAGTAAAGAGA

FIG. 1 continued

CTAAGAGAGAGGCCGGACGGAATCTCGAACGATTTTCACTTCATGCATACTAGCATTCTATGTCTGATGCTGATTATAA
GCATAAATGCTGCCCTAACAGGCGCCTTAAAGTTGATTATAGGAAACTTGAGGCCTGACTTTGTTGATAGATGTATACC
TGACCTCCAAAAGATGAGTGATTCAGATTCTTTGGTTTTTGGCTTGGACATTTGCAAGCAGACTAACAAATGGATTCTA
TACGAAGGCTTAAAAAGCACTCCAAGCGGACATTCAAGTTTCATAGTCAGTACCATGGGCTTTACATATCTTCGGCAAA
GGGTTTTCACCACACGCAATACAAGAAGTTGCATTTGGTGCCCTTTATTAGCTCTAGTAGTAATGGTTTCAAGGGTTAT
CGATCACAGACATCATTGGTACGATGTTGTCTCTGGAGCTGTTCTAGCATTTTTAGTCATTTATTGTTGCTGGAAATGG
ACATTTACAAACTTGGCGAAAAGAGACATACTTCCTTCACCGGTTAGTGTTTAGCATGGCAATTCCCGGGGATCGCGGC
CGC

> SEQ ID NO:7391 213923FL Trichoderma harzianum
CTCGACCCACGCGTCCGCAAAGAATCCGCGGCCGACGTGCCCACCAACGGGCACTATGTTTCCAATGGCATGGGCTCTG
GACAGCAATTCCAGCCCCAGCAGTATCAGCAGTATCCGGGCTATGGACAATTTGTTCCGTTTAGCAACACCCAAGATCC
TCGGGCTGGGCCTCACCAGGCCATGATCTCCCAGGTCTACCAACCTACCCTTGGTAAGATTGGTAACCCAGGTCCTCTT
GGTCTGATCGGTTTCGCTTTGACGACCTTCGTGCTCGGACTTACCAGTGCGGTGCTGGTCTCCCTAATTCCAACCCAT
TGGGCAACGTCGGCCCTGATCAAGCTGTCTTCGGTGTGGCTGTCTTCTTCGGAGGCATGGCTCAGTTTGTTGCTGGTGT
CATGGAATTTGTCCTTGGCAATACCTTCGGTTGTACTCTCCACTGTTCATACGGGGCTTTCTGGCTTGCCTTTGCCATG
TTCTCAGTCCCTACACTGGGCATCCAGGCCGCTTATAACGGAGATCAACGTGCCTTTAGCTTTGCTGTTGGCATTTTCC
TCATCATATGGTGTTTCCTCACAATCATCTTCTTTGTTGCGGCGCTCAAGACAAACTTTACCATCTTGATGGTGCTTGG
CCTGCTTGCGCTGTCTTTCTTCTTCCTCAGCATTGCACAGTTCGTCTCAACGGAGCACACCACTGCGGCGGTGCGATTG
AACCGCGCCGGTGGTGCCTTTGCCGTCTTCTGTGCCATGTTTGCATTCTATGCTGGAGCGGCAGGCCTCATGCTCAAAG
ACACAACCTTTGTCACCTTTCCGCTTGGAGAGATTCCATATCCCTCAGTCAAGCGAGAGAGGGCCGAGCCGCGGCGAA
AAATGTCTAGAGCCACGAATGATGTCAATTCATGGTTGAAATATGTGACTCATTTTATTGAGTACTTCATTCCCGGCTT
TCAATTATTGAGAGAATGTAATGCGCTGAAGGATGAAATGGTCGAAGACGGACAATAAGTTCACCAGGTGGGACGAAGA
GGGGAGTTGAATGTTGTTCGGCTTTGTCTGTGTGCACTGATTATACCCTCGCTTTTGATACCCACCTGCTCATTTGTTT
TTATGTTTTATATAGTCTCTGTGCGAAGTATCTGTGGTGGCAAGGGTAATGGCAGTGGACAAATAATATGGATGGAATA
CTGGAGGGAAAACCCTCCAAGTTCAATAATTATACCCAAATGCTGCAGACGGCAAAACCAACTGTTTGTCATTTTACGT
TTTGATGAAATATTTCCAATTAAACTAATTATCAAAAGCAAAAAAAAAAAAAAA > SEQ ID NO:7392 214394FL Trichoderma harzianum
CTCGACCCACGCGTCCGAGCAGAACGGCTGTATTTGTATGTATCCATCATTGGATGGCGTTTTCTGGAGCGAGTGCGAA
GCATGCGTACTCGTATGTGTATGTCTATGTATGGACTAATGTGCGTGGGGGTTCATGGAATCGCCATGAGTGCTTTCAT
GATTCTGCAATGCCGTTTTGCGTCAGTAATGTGGAGGGAAGATGTACGACTATGGATCATGTATATCGCAAGTTTGATT
TGTCGGAACAGCGTATCATCAGGGAGAAGATAGAATTAGCATTGCACAATTCAATTGCAAAACCAAAAAAAAAAAAAA > SEQ ID NO:7393 57804FL Nicotiana benthamiana
AATAAATTGGTAGTTGGTGTTACTGTTCGCTGAGGGACCAGATCCAGAGTTCAACGACTGCATCGCCCCTCGCCTTTTA
GTGTCAAAATTCTCTATTTTCTGACTGTTGCTGGTCTTTAAGAGTAGTTTGTATTGCATTACCTGCGCATCACAATCCC
CCCATCTTTATTTCGCCTTTTCTATTGTTGTATACTGGGGGTTGGTAAGAGCTAGTTGGATGTGTGTTTTCTCTGTTTT
GTTTTAATTCTTACACGGATAAATATTTGGGTTCTCCATTAAAAAAAAAAAAAAAAAAA > SEQ ID NO:7394 126149FL Nicotiana benthamiana
ACCAAATTAAGTCGAAAAAAAAATGGCAACTCCTGAAGAAAACATTGCACCTGCAGCTCCACCACCGCCGGCGGCAGAA
CCATCAGCGGTGGAGGCTTTAGTGACCACTATTGAAACAGCGACCAAACAGGTTGAAACACCGAAGGAAGTCAAGGAGG
AGAAGAAAGGAGGAGCACAGGATCTCAAGTTAACCCTTTTGATTCCAGGGGCTGTAGTAGCTGTTGTTGGAGTAGTTCT
TGCCATTGTCAAGAAGGTGAAAGAGTCGGCTAATTGAATGTAGATCCCTTGTATCGTCAACTTTATATTTCTGTACATT
TTTTCCCCCTTTTTGTAAGACGAGCCTAAACTCTTTGTCAGCTTTGAAGGGAAATAAATAAATTTCATATGCTTTTAAA
AAAAAAAAAAA > SEQ ID NO:7395 48674FL Nicotiana benthamiana
GGCCATTACGGCCGGGCATCAAATTGGGCCCTGAGAAAGATAAGCGGAAAGAGGCAGTTGAAAAGGCCAAGAAGACTCA
AAGCATAAATGAGTTTCTGAAACCTGCTGAGGGGGAAAATTACTATCGAGGTAGGGGACGTGGTGGCCGTGGAAGAGGT
GGCTATGGGGGTAACGGTGGTAACAACTACAGTGTTGAAGCCCCCAAGATTGAGGATGTTGGCCAGTTCCCATCCTTGG
GTGCCAAGTAAGGCTCCCCAGAACCAGCCGTCTAAGCTCATTCTCTGTTTCGGCCATACTTATATGCTCAATGACGGCA
GATCATCTCCAAGACTCTTTTCGTGGGTTTTCATGTATTAGAATCATCTGAAAACTTTATTGTTCTTTTTAAGAGTGTA

FIG. 1 continued

AATTTAGATGTCTCTTCTGGTATTTTACACCCTTGGTCTTTCTTGACTTTTGACATGCATGAATACCCTTTCTTTCATA
ATTAGGATTTAGGTCCATTTTTGATTTAGTTGTGGGATCATTTTGTTTTTGAATTTTATTAAAAACAATTTTGCTCCGT
TGCAAAAAAAAAAAAAAA

> SEQ ID NO:7396 212987FL *Trichoderma harzianum*
ACTCGACCCACGCGTCCGCAACCACTCGGCACATCATGAGTTCAGGATACGGCATGCATGGCGGCGTCGGCCGTTGCTT
TCCTTTCTGGCAGGAGGTCATGGCCTGCTATGTCGTCAACACATCCGCCGCAGACGACTCAGGCAAGAAGAAGTGCTCG
CCCGTACTAGAGGATTACTACGAGTGTCTGCACCCACAAGAAGGAGCATGCGAGAGCGCTGGCCCTACAAGCCGCATATG
CCCGAGCTCAATCGGCAACCGCACGAGACGATGCGCCAAGTGCCAGCCAGATCCGGAATCTAGGACTGCTAGGGAAGAC
GGAGGACACAAAAGCGGTGCTTGGACAGGGAAACTGAGGCAATAGACGTGGCGGAGTTCGATTTCTTCTGCGCGAATAC
AACCCCCTTGGCGCGCATAGATAGCGCAGCAAGTTCAATATAGGAAAAGCAGAC > SEQ ID NO:7397 213754FL *Trichoderma harzianum*
CTCGACCCACGCGTCCGCAGAGACACACGCACACATGGATTCGAGCGCCTTCGTTTTGACCTACCCAATTGTACGGCCC
TAGCCCACGGTCTTGCAAATGGCGCTCAGACAGCAGCAAAGCAGGCGCAGGCGCAGCCCCCATTCGAGACGAGAAACGG
GCCTTTGATTGGGGGCGTCCGTGTGACCCGAAGTGCTATATCTACTGCAGCCGCTGCCCGCCTCGTCGAAGCTTCTTTT
CCGCATCTCCCCTCAGAAGCATTTTGCACCAGGACTATCCGCCGATAGCATATATTTTTCCCTAAGGCTTACGCGCAA
ATTCCGATTTCTTACGGACCTACACGTACTTCAGTTAAAGTCCAATCGCCCAAAATGAACACCAGCACCGTCAAGAGCC
GCTTCCTTTCTCACCCCGAGGACCTTGGTATTGTCACCGTAGGCTTCTCGGGCGGTCAGCCCAAAGCCGGTGTGGATGC
AGGCCCTACTGCCCTCATCGAGTCTGGTCTCTTGACCCAGATTCGAGATGAGCTTGGTTACAAGCTGCACGGTGATGAG
ACGGTCAAGTTCTACAACGACCTGACTCCCGCGTCCGACCCCGACTACCGCGGCATGAAGAACCCTCTCCTTGTCTCGG
CTGTCACTCAAAAGATTGCATCTGAGACATACGAGCACTCTTCCAAGGGCCGCCTCACGTTGACGCTTGGCGGTGACCA
CAGCATTGCCATTGGCACTATTGCTGGAACTGCCAAGGCTACGCGCGAGCGCCTGAACCGCGAAATCGCCGTCATCTGG
GTTGATGCGCACGCCGATATCAACACCCCCGAGACGGCGACGGCCAACATCCACGGCATGCCCCGTTGCCTTCCTTA
CCGGCATTGCCAAGGAAGAGAAGGAGGAGTACTTTGGCTGGATCCAGGATGACATGCGCCTGAGTGTCCGCAAGCTTGT
GTACATTGGTCTGCGCGATGTCGATGCTGGCGAGAAGCGCATCTTGAGAGAGCATGGTGTCAAGGCTTTCAGCATGTTC
GACATTGACCGCCACGGAATTGGCCGTGTCATGGAGATGGCCCTCGCCCACATTGGCGACGACACTCCCATCCACCTGT
CTTTCGATGTGGATGCTCTCGACCCCATGTGGGCGCCCAGCACTGGTACTCCTGTGCGAGGTGGCCTTACTCTGCGTGA
GGGTGATTACATCTGCGAGGTGGTTCACCAGACCGGCAACCTGGTCGCCATTGACTTGGTAGAGGTGAACCCAAGCCTT
GCAGCCACCGAAGCCGGAGCACAGGAGACTGTCAGAGCCGGTTGCTCTCTGGTGCGCTGTGCACTCGGCGAGACTTGCT
GTAGAGTGGTTTTTTTTTTTTTTG > SEQ ID NO:7398 213124FL *Trichoderma harzianum*
ATTGTCGCCTCGGTTCCACGGCTTCGGATTGGAACACGCGCCCACAGACAGAACGCTCCGTTTCCCATTGAGCGTCAAC
CTCTACTGAGCTTTCATCAATCAGTACGAGGCCATCTTCGACAATTTTCAGAAAAAGAAAAAAGCCTTTCGAGAACATC
AATTCGGAAAGAAGAGCCACTTCTTCACCATGGCTGATGATGAGAAGCACGTTGCGGAGCCTGCCATTTCGGACGTCGC
CCCCGTCGACTCCTATGCGGCTGCCCAGAACGAGTTTCATGACCGGCCTCCCGGATGGATTTACAAGGGCCACAAGATC
TTCGGTAGGGAGATCTACTATGCCTCACCCAGAGTCCAGCTCGTGCTGGTTGCTCTCGTGTGTTCCTCTGCCCCGGCA
TGTACAACTCCTTGACTGGTCTGGGAGGTGGTGGTCAGGTCGACCCCACGGCCCAGGACCACTCCAGTGTCGCCCTCTA
CAGCACCTTCGCCGTCGTTGGTTTCTTCTCTGGTACTTTTGCCAACCGTCTTGGTCTCCGTCTCACTCTCGGCTTTGGT
GGTCTCGGATACTGCATCTACAGCGCCTCTTTCCTCAGCTACAACCACAAGAACATCGGCTTCGTCATCTTCGCCG
GTGCTTTCCTCGGTGTTTGCGCTGGTCTGCTCTGGACCGCCCAGGGTGCTGTCATGATGTCCTACCCTCCTGAGGACAA
GAAGGGTCGCTACATTGCCACCTTCTGGATCATTTTCAACCTGGGTGCCGTCATTGGCTCTCTGATTCCTCTTGCTCAG
AACATCCACAGCCACAGTGGAACTGTCGGCGATGGCACCTACGCTGCTTTCATCGTCCTCATGTTCCTCGGCTTGGTCC
TCTGCTTCTTCCTGCTTGACGCTGACAAGGTCATTCGTGAGGATGGCACCAAGATCGTCCTGATGAAGAACCCCTCGTG
GACCTCTGAGTTCAAGGGTCTTTGGGAGACTCTGTACAACGCTCCCTATGTTCTCCTCCTCTTCCCCATGTTCTTCGCC
TCCAACATCTTCTACACCTACCAGAACAACGACATGAACGCCGCCGCCTTCAACATCCGCACCCGATCCCTCAACAACC
TGTTGTACTGGCTCGCCCAGATCATCGGTGCCGTCATCAACGGCTTTGCTCTGGATTACACTGGGGTCAGCCGTAGCAC
CCGTGCCAAGGCCTCCTTTGTCTTCCTCTTCATCCTCACTTTTGCCATCTGGGGTGGTGGATATGCCTGGCAGAAGATG
CAGCCCCCTCGCTCCGTCGTTTCCCAGCCCGACTACGAATCTCAGAAGGTTGACTGGGAAGATGGTGGCAAGCTCTTCA
TTGGCCCCATGTTCCTGTACTTCTTCTACGGCTTCTACGATGCTATCTGGCAGACCAACATCTACTGGTGGATGGGTTC
ATTGTCCAACTCTGGTCGTAAGACTGCCAACATGGCTGGTTTCTACAAGTCCTTCCAGTCCGTTGGTGCTGCCATTTTC
TGGCGCCTTGACGGTCTTGGCAAGCCTTACATGACCATGTTCGCCGCCACCTGGGGTGTCCTTGCCGGATCTCTCCTTC
TGGCCGCCCTGTGGTCTTCCTGAAGATCAAGGACCACGTCTCCATCGAGGAGGATCTCAAGTTCTCCGACGAGACTAT

FIG. 1 continued

TCAGGATGTCGTTGTTGGTGCCAACAAGGACGTTGATGTTTAGATTTACAGTGGGCGGTTAATGAATGACCCGAAGAGG
TCGAGTGGGGAGTGAATGAATTGTGAAGCGTTTTCGAACGATATGCTCCTGATTTAAATGATTTAATGCAAGGCTTCAT
ACAAGCCTCCTATTCCCCTATTAGATTCAATACGAAGAGCACGTTATTGCTGTGTAACAAAAAAAAAAAA

> SEQ ID NO:7399 214172FL Trichoderma harzianum
CAAGGCGTAATGCCAGGCAGCGTCCACCGCCTTTCGCCAGCTGCCTAATCTCTGCCAATGCCAATCATCATCACCCATT
AGCTGGCTAAACTCTCACAATTCCCACTTCCCCAAAACCCACTGCTGCAGGAGTGCTGTGCCAATTGCTGGCCCACGAG
CTCGAGGACGTCGAACCATGACTGCAGAAGCAAGCGGGCGTCAGGCCCCGGCCGAGTCGGTTGCACCGGCTTCGGAGCG
CACGCCGTTGTTGGGATCCGGCGCGTCAGAGTCACGCACAGACGGCAGTGGATTGACGGGGGCGGCGGCAGCAGCGGCG
GCGATTCTGAGACGGCATCAGCGTAATGAGAGCGAGAATGAGCGGCTGCTGGCCGGAAACGACGACGACGATGATGGCG
ACAATGGCAATGGCCAGGAGGAGGAGACGACGGTGGTGGCCGAGGAAGTGTCCTTCGCCAAGCTGTGCCTCATCATGGG
AACCGCCTACCTAGGTGTCTTCCTCGGGGCAATCGATTCGTCCATCATCGCCACGCTCTCGGCGCCCATCTCGAGTGAA
TTCCAGTCCCTCAGTCTGCTCTCATGGCTCGCAACTGCGTATCTCATCTCTAATGCGGCCTGCCAGCCCATCTCGGGTC
GTCTGACAGACATCTTCGGCCGAGGCCCGGGCTTAGTCGTTAGCAACTTGTTCTTTGCAGCTGGCAATCTCATCTGCGG
CTTGGCGCAAAACTCGAGTGTCATGATTCTCGGCCGTGTTATCGCGGGTATCGGTGGTGGCGGCCTGATGAGCATCTCG
ACATTTTTGGGGTCCGACTTGGTTCCCTTGCGCAATCGTGGTGTTGTCCAAGGCATTGGAAACGTATGCTACGGCTCAG
GGGCCATGATGGGAGGCATCTTTGGCGGATTGATGAACGACCACACCAAAATGGGCTGGAGGCTGGCTTTCCTCATCCA
AGTCCCTCCCGCCATTCTCTCCGCCATAGCCGTGGCTATCCTCGTCAGAGTGCCACCAAAGCAGTCCAACAAATCTTAC
CTTGCACGAATCGACTTTGGCGGCGTCTTCTTCACGGTGTCCTTCCTGGTTCTCCTGCTGCTCGGCGTCAATGCTGGCG
GAAACCTCGTACCTTGGATTCATCCCCTGCCTCTTACGACGATCCCGCTCTCCATTGTGGCATTTGTTGGCTTCATTTG
GTGGGAGAGCAGAGCGATGCAGCCCATCATCCCAGTCAGGCTCCTCCTCGATCGTACCTTATTGTCTGCCTGCTTGTGC
AACTTTCTTGCTACCATGGTTACCTTGTCAGGCATCTTCTACGTTCCTTTATACCTCCAGGTTCGTGGTGACTCACCAA
CCGTTGCAGGCCTGAAATTGCTGCCTTCGCCTGTTGGTATCTCCATTTGCTCTGTTGGAGCGGGCTACATTATGAAGAA
GACTGGTCGGTACATCCGGCTGGGCATTAGTAGCATGCTAATGGTCATTGCTGGAATCCTCTTCTTCACCTCGCAGAAT
GAAACCAGCCCAGGATGGGTGACGATGGTGGCTTTCTTCCTGGTGGGCGGAGGTTATGGTGCTATGTTGACAACAACTC
TGCTGGCGTGCATTGCGGCGGTTGATCACTCACAACAGGCTGTCATCACATCAGCGACCTATCTTGCCCGAAGTCTGGG
TGGTACGATTGGCATCACAGCCAGCTCAGCTGTCTATCAGAACGTGCTCAACGCTCGCTTGTGGCAGCGATTCGGTGAT
GAGCCGCATGCTGCCGAGATCATTCAAAAGATCCGTGATGACCTGAACTTCTTGAAACACCTGCCATCAGGATGGCATG
ATGGGGTGTTGAAGTCGTTCATGGAGGCGTTCAGGGGCGTCTGGCTAACAATGCTCACCTTGGCCATTGGTGCTCTCAT
TTGCGTATCGCTCATGAGGCAGCACACACTCCACGAAACTCTCTCTAGGCGATGAGCGTGACAGGCTGCCACATTTGAC
GGCAAACAAGAATATGCTTGCCAAGCGCCCAGTAGATAGCCCTTTGGGGCTCTTTGGCGCTTGTCAGCTGTGATACTATG
GAACCAGGATTCATTTCACAACTGCTGCATTCGATAGAATTGGATATATGGTTTCGCAAACAGGCAGGCATTCACATAT
TGGGAGTAAGGAGCAATTTGAAGCAGCAATTTTCTCAGAACGCACATCCGCGTGGGCTCCCTTTGGATGAACATGTGAC
ACTTCTCTCTTTGTTCACTCGCAGAGCGCACATCTACGTGTATTTGGCTGAACATTTGGTACTACTGGCTTATTGTTCA
ATGTTCACTCGTTCACTGACCCATTCTTGCCTTTGACGAGCACGATATAGAAATAAAACGGTCGCTCTTGCCCTAGCTC
TAAGAGATGTTATAGTAGTTCTCAAAAAAAACAAAAAA > SEQ ID NO:7400 214188FL Trichoderma harzianum
AAGTTGTGAAAGGGGTTGCAGATCCAATAATGCCACGCCGATCCATATCGAGCAATGTATTTATACCCAAATCGTCCCT
TTACCGAAAATTCCGAGCCTCTCTAGCGCTCGAATTTATCAATTTTTGACGAGTATCCATGAGCTCCGTGAAAATCAAC
AAGAGATTTCAGGACATATAGAAGGGAGGGCTTAACATATATGGATATAAATTTTTCTATTGCTTCATCCAGCAACAAA
CCCTTACTGGAGCTCCTGTCAGCCACCGTCGAGATATTCCTGGAGGCGTCACAAAACTCTATGTCGATCTCATAAGATC
AATCGTCGTTGGCGCCCATACTGTACTCTGAGCTACAAGTTTGAGAAAAATACTTGGGTCAACATACATTTACTACGTA
TCTTGAATTCTCACCAGCATGATTGATGGAATACAGCACCACGTTGAGACATAATAGCTTGGTAGTACTGTACGGGGCC
GCCTCAACTATGGAGACGTCTAACCGATCGCGAGTTTAGCTCTCCCGGTACGAGTAGCCGTCTTCCGGGCCGGTATTTG
GTGCTCGGACCTGTTTGGAATATTTTTACCTAAATTGGAACATGGCAGAAGATGTTTGTTGGCTAGCCTTTGAAAGAGT
GAGTTCCTCTGCTCCTGACGCCGATCTAGATCCCAGATCACAGTTGGTCTGAACTACTGGGTCGCACATGATTATTCT
CGTATAAGAAACAAAGGTCGCCTTCGAGAAGTCTGTTGAAATCCTTTCACGTTACGAAGATGAACTCTAGACAACTTCA
AGGATGAAAATGTCGAAGGAGTATCCGCTTGACATAGACAAGTTTGCGCGGCCCAGTATTGGAGCTTTTCAGTCCTTTA
CGATCATGTCTGCGCCTACCGTTGCTCTTATTGTTGCCGCTCCTCAGTGGTGCACATACGAGCCCAGAAGAAGATTGAT
ATAAAACTTCTGAGCAGCGACATCAACAGAGACAAAATCTTCTCAAGGTCCCTAGTGTCGGCAACTTCTTTGATAGAAT
TCATAGTAACGTCGTCCTAATCAAAACATATGCCAAGCGGCCTTGACTACAGTCGGAATTATTGTCCTAGAAACAATCT
GTTGAGGTTATAAATTACTTTTTGTTCTATTGCTGACCTGTAGAATTAGGGCAATTAATTGGTAGGTTGAGAATGACAA
TACTGCGTAGATGGCAACGACAATTGGCGTCCCTGTGGCACGTATGCGAGGGAGACTACAAGTTTTGGTATGCATGGAT

FIG. 1 continued

```
TTCCACAATTGTGCGTAGGATTCAAGCGGCATGACCACATAACTAAAACCTAGTTCGCAAACCCCTCAATTGTATCGCT
CAACAATCTTCAACATCAAAGCTGGCCATAGAGCCGCTTCATCGACATCAGCCATAATGGCGACTGCTGGTGACAATTC
GGCTTTGTCTGTGGCAACTCTGAGTCCTGCATCCATTGGGGTGGCTGTGATTTCGATCTTGCTGTTGAAAATCCTATAC
GGACTGGGCACCGACCGCCTAGGACACATCCCCGGCCCCTTCATCGCTCGCCTTACTCCAATCTGGTACTGGTATCTTA
CTTGGAAGGGCATTGAATGCACAGTTATTACTGCCATGCACAAGAAATACGGACCTGTGGTTCGCATTGCCCCAAATGA
AATCGACATTTCCGATGGAGCGGCCGTCAATCCCATATATGTCGACAATGGTGGTTTTAGAAAGATCGCCGGGTACAGA
AATTTCGATATCAACGGTTTTCCTACCATATTCTCAGTAACAGATCATACACACAGAGCAGTCCGAGCCAAAGCTGTGT
CGCCCTTGTTTGCGCAGCAAGCAATTACAAACAGCAAACTGGCCATGCAGAAAATTATCGACGCAACGATGGTTGAGCT
AGAGCACCGAAGATCTTTGGCAGCAGATATACCAGTTGATCTACTAAACCTATTTCGCTCCATGGCGATGGATGCCTTA
ACGGAGTATCTGATTGGGGAGTGCTTCAACAGTGTTGGTACTGAAAGACTCAGCGCAACTGCTTTCGTGGATAATTTTG
CTGCGGGCGGTCGCTTCTTTTATCTTCCAAGTTGGTTATTCACTTTTGCTGATAATTGGGCTGCGAAATTTGACAAGAA
TAATCTGGCAATAACCATGAGTACGGATATGGTCCAGGAGTTTGCAGCCAAGGTTGTGGATGACAGTATCGCGCAAGGA
GAGAAAGAAACGTATCAAGGACGGCTGCTGCATGCAAGTCTCTCACGAGAAGAGGCTATAGCACAGGTAATGGATATCA
TGTTTGCAGGTAAAAAAAAAAAAAAA

> SEQ ID NO:7401 214545FL Trichoderma harzianum
CGATTCCTCCTTTCTTCCCCTCCATACTATTTATCCTGCCTCTTCCTCGTCTTCCATCTGTTGCCGGTGTGACTCTTGC
AATTCATTCCCTGCCCGGCTTCCTCGCTTGATTGAATAGCCGTTGCTACTTCCAACTGCAAATCATTATAGCTATACCT
CCCTAGCTTCATATAAGCTCGGCTCTTCTAGGAACGCGCAAGCAAACATCCTCGGCAGTGACCCACGAGCCTTGTCTGG
AGATTTTAAATAGGAAAGCTCATCAACGGCACCTGAGCAGCGTCCAATTGCTCTGTTCAGCTCAATTAAGCTTTCAAGA
TGCCTAGAGACGGCAGTAAACAACCGCCCTCAGCGGCGACAAACCTCATCGCTGGTGGTGGCGCCGGTATGATGGAAGC
CCTCGCCTGCCACCCTCTAGACACAATCAAAGTGCGAATGCAGCTCTCTCGCCGTGCACGAATGCCCGGCGCCCCCGC
CGCGGCTTCATCAAGACTGGTGTAGAGGTTGTGAAAAAGGAAACTCCTCTCGCTCTATACAAGGGCCTCGGCGCCGTCT
TGACGGGCATTGTCCCTAAAATGGCTATCCGATTCACATCATTTGAGTGGTATAAGCAGCTCCTAGCCGATAAAACCAC
CGGCACCGTCTCAGGCCGAGGAACATTTCTGGCTGGTCTCGCTGCCGGTGTGACAGAAGCCGTGGCCGTCGTGACACCC
ATGGAGGTCATCAAAATCCGTCTGCAGGCGCAACATCACTCAATGGCCGATCCGCTGGATATTCCCAAATACAGAAACG
CCGCGCATGCTCTGTATACCGTCGTCAAGGAGGAAGGCTTCGGAGCGCTATACCGTGGAGTCAGCTTAACAGCCTTAAG
ACAAGGCTCCAACCAGGCTGTCAACTTCACGGCCATACTCTTACTTTAAGCAGTGGCTCAAGGACTACCAGCCTCAGTAT
ACCGACGGTAACTTGCCCAGCTGGCAGACAACCATCATTGGTCTCGTGAGTGGCGCCATGGGCCCTCTCAGCAACGCCC
CCATCGACACTATCAAGACTCGTTTGCAAAAGACTCCAGCCGAGTTTGGCACCACCGCTTGGACAAGGATAACCACCAT
CACCAGCGACATGTTCAAGCAGGAAGGTTTCCACGCTTTCTACAAGGGCATCACGCCTCGCATCATGCGCGTTGCACCC
GGCCAGGCCGTCACCTTTACCGTCTACGAGTACCTCAAGTCCAAGCTGGAAAAGAGTAACCTGGCCTTTGTCGGTGGCA
AATATGAGGAGTAAGAAAAAACGGCAGCACGTCGATGCATTTGTTGCGATATATACCCTTGCTTTTTTCGGCCAAAAA
AAAAAAACGAGAGGAAGACATGGTCTGACCTGTATTGTAGTTCTAGAGCAGAAATGCGACAGGGTCAGCCCCAGCATGC
TTAGGGTTTGTGAGCGATGACGGCGATGATAGCGGCGACGGTGATACGATACGGTGGTAAACATGATTGTTTAGAGGTT
TTAATGGCAGCCATGGATTGTGGCGTTGGGTTGTGTTCAGTTTCAAAATAGTAGAGTGGATATATCTTCTTGTATAAAA
AAGTATGGACAATGTCTATTCTAAAAAAAAAA > SEQ ID NO:7402 214329FL Trichoderma harzianum
GGGATCATCGTACATGATACTATTGGCGACTTGGATTTCTAAGAGGGTGTCCAGGCAGGGCTCATTTGTAAGCCGAGCC
GATTTGGGATGACATGTTGCAGTGCATATGCATTTGACAGCGAGGTTAGTAAGTTTCTGTTCAAGTTTAGGGCGTGTAC
TATTTGATGTTGTGAGATGTGAATTTGATTTCCAAGCACTGCGACCTGGGCCTCCTGCGCGATCAGAGGTCTCTATGAG
GAGATGAGCTATTGATTGCACTCAGCGCTAGATGTTTGATGAACCCTCAGGACACAGCATTGGAAGTATTATTGATCAG
AGAAAGGCTCTGGGCTATTCACTCCAGAGTTGCGAGAACTATGATTCACGTTGACATACGTGTCGGGCCTGCAAGACCG
CTGGAGCAGCCAACGTAAACTGCAGCATTTCATCCAACGAAGAAGAGTCATATTTTGTAGTAAGAGTAGCCAATGATGG
CCCATCTATCAAGTACTTGCAAAAAAAAAAAA > SEQ ID NO:7403 214414FL Trichoderma harzianum
CGCCACATTTCCATGATTGCCATTGGTGGTGCGCTCGGCACTGGTCTCATCATTGGTACCGGAAAAGCCCTCGCTCAGG
CTGGTCCCGGCTCGCTGCTCATCTCGTATTGTTTCGTTGGGATTCTCGTCTACGGTGTCATGGCTTCTTTGGGAGAAAT
GGCTGCTTGGTTGCCTATGAGTGCTGGATTTACGGCTATGCGACGCGATACTGCCACCCTTCTCTGGGATTTGCTCTT
GGTTGGACATATTGGTTCAAGTACATCATTACCACCCCGAATCAGTTGACAGCTGCCGCTTTGGTCATCCAGTATTGGT
GTCCTCGAGACAAGGTCAATCCAGGTGTCTTCATTGCCATTTTCCTAGTCACCATTCTTGTTGTGAACTACCTAGGAAT
TGAACTGTTTGGCGAACTTGAGTTCTGGCTGTCCTCTTTCAAAGTCATCATCATCGTTGGTATCATCATCTTCTCCTTG
```

```
TGCATTGCCTGCGGTGGCGGTCCCAACGGCGATGCCCCTGGATTCCGATACTGGCACCACCCCGGTGCCTTTGCCGAAC
TATATTCAACGGGCTCTTTGGGCAAGTTCCTCGGCTTTTGGTCTGTCATGGTCAATGCCACTTTTGCGTACCTCGGAAC
CGAACTGGTCGGTGTCACCGCTGGCGAAGCTCAGAACCCCCGACGAAGCATTCCTAAGGCCATCAAGCTCACCTTCTTC
CGTATCCTCTTCTTCTACTGCCTCAGCGTCTTCCTTGTCGGCATGATTGTCCCTTACAACAGCCCCGAGCTCACCTTCG
CCAACAAGCAGAGCACCGGTGCCAATGCTTCGCCCTTCGTCGTTGCCGCCACCCTCGCCGGCGTCAAGGTCTTGCCGCA
CATCATCAACGCCTGCATCCTGGTCTTTGTCTTTTCCGCCTCCAACTCTGACTTGTACATTGCCAGCCGAACTCTCTAC
GGCCTTGCCTCCGATGACGCTGCTCCCGCCATCTTCAAGCGAACCAACAAGCGTGGTGTTCCCTACCCAGCGCTTTTCC
TTTGCGCAGCGATTGCCTGCTTGGCATTTATGAATGCTTCCACCGCCAGTACGGTGGTCTTTGGCTACTTTGTCAACCT
CGTCACCATCTTCGGTATCTTGACTTGGATCTCCATCCTTGTCACCTACCTCTTCTTCCTCCGTGCTCGTCGCGCCCAA
AACATCCCCGACAGCGCCATGCCCTATGTCGCCCCTCAGGGCTACTGGGGTACCATCGTCTGCTTGTTCTTCACGATCC
TCATCGCCTTGACCAAGAACTACGACGTCTTCGTCCACACCCCCGCCCGCAAGTTTGACTACAAGAACTTCATCACTGG
ATATCTTGGAATCCCTCTCTACCTCATCATGCTCTTCGGCCACATGCTCGTTACCAAGAGCAAGGGTGTCAAGGCCCAC
GAGGCGGACTTTTACGCTGGAAAGGAAATTATTGATGCTCAGGAGAACGAGTACCTCGAGGAACAAGAGGCTAAGCGTA
CGAACAGCCAGGGTATGCACAAGTTTTACGATCGCTACATCTCGTGGCTGTTTTAGATTCGGGGGAATAAGTACTCGGG
CAGGTCGAGATGGTAGACTGGGGCCCTCATTTATGTATTACTACGTGGTATGAACATATGAGTATAATAAAAAACTCAA
TGGATATGTTGAAAAAAAAAAAAAAA

> SEQ ID NO:7404 104711FL Nicotiana benthamiana
TGCATCTTGACTACCCCTCGACCCACGCGTCCGCCCACGCGTCCGCTTCGATTGTGTTGGGAAGATGGAACTCAAGCAA
TGCAAGTCAACCGTCTCCCTCAAACTGAGGGTTTCTTTCAGCCTCTAGGATTGACTTCTTCTCCTCAATTTGGATACAA
TCATGTGGGTACGGATGAGGTGAATGGAGGAGCTTCAGCTCATAATATGAATGGGTTTATTCCAGGGTGGATGCTGTAA
ATCTGATAAATCAAGACAGCTGCTCCATCTTGCTTCAACGAAATAAAATAATAGTATATTGCATTTTCTTTTTGTTTGT
TGCAACTTGTATTTAGAAACTCTTTAAGTATTATTGGGCACGGACAATAATATGCATTCATAAGTTACTATAACATTTG
AATGGTCCTGCTTGATTGGCCATTATGTATTTCTGATTGTATTCCATGTAACTAAATTGAATTGTTGTATTATATTAGT
TGTATCTTTGAATCATATAGATGTGTTGGCTTTGTACGCCATAAATTTC > SEQ ID NO:7405 104081FL Nicotiana benthamiana
CCCCTCGACCCACGCGTCCGAATTCACAGGGACATCAAGGCTTCAAACATTTTGTTGAGTGAGGAATATGAGCCACAGA
TATCAGATTTTGGGCTAGCAAAATGGCTTCCATCACAATGGACCCATCATTCCATTGTTCCAATTGAAGGGACTTTTGG
GCACTTAGCACCAGAATATTTCATGCATGGAGTGGTTGATGAAAAGACACAGATGTTTTTGCATTTGGGGTGTTCTGCTTG
GAGCTCATTTCTGGGAAAAAACCAGTTGACAATTCCCATCAAAGCATACACAGCTGGGCAAAACCTCTTTTGAGCAGAG
GAGTTATAGAAGAAGTAGTAGATCCAAGGCTAGAAGGCAGATTTGATTCGACACAACTTCATAAACTTGCTTTTGCTGC
TTCACTTTGCATTCGTGCTTCTTCTATATGGCGCCCAACCATGAATGAGGTGAGAGCTTCAACAGATTATATACACACT
GTGTGACAATTAATTTCATTGAAATTAACTACAATGTTTTTTCTTTATCTACAACATTCTCGTTTCTCATCGACGTTCA
TGGCATTCATGAACTTGCATTTGATCCAGTCTCAAACTTCTTGATGCTTGGTATCTAGTTTTACAGTGTTCGCGAACAT
AGTTCTGAATTTATATGTGATTGCATGATAATGGTTGGGCTTAAAAAAAAA > SEQ ID NO:7406 113742FL Nicotiana benthamiana
CCCCTCGACCCACGCGTCCGCCTTAGTACGAGAGGATTAGCACCATGGCTTCATCAAACTTTGTCAATTTCACCATGTT
CTTTCTATATCAGTCTTGTTGTTAATGTTCTGCCCAGTGAATTCAACATCAAGGCATGCTCTGATCAACAACCATAAG
GGATTCAAGGTGAGTCTAAAACATGTTGACTCAGGTGGGAATTTCACCAAATTCGAGCGTTTACAACGCGCGATGGCAC
GAGGGAAATCAAGACTTCAAAGGTTAAACCTAATGGCTAATAATTTGGTAGCAACAACAGCCATAGATGACTCTGACAT
TGTAAAGTCTACAATCCATGCAGGAAATGGTGAGTTTCTCATGCAAATATCCATTGGTAGTCCAAATGAAACCTATAAT
GTTATAATGGATACAGGAAGTGACTTAATTTGGACTCAATGCAAGCCTTGTAAAGAGTGTTTTGATCAATCCACACCTA
TTTTTGATCCATCAAAATCATCCACTTTTTCCAAGATTTCATGTTCTAACAAACTTTGTGAAGCATTGCCAATGTCATC
TTGTGGGGATAATAATTGTGAATATATGTACACATATGGTGATTATTCATCAAGTGAAGGTTTTTAGCTAGTGAAACA
TTCAGTTTTGGCAAAAATTCTATCCCAAATGTTGCGTTTGGATGTGGAAATGACAATCAAGGCAGTGGATTTAGTCAAG
GTGCAGGTCTAGTTGGACTAGGGAGAGGTCCATTATCACTTGTTTCTCAACTCCAAATGCCCAAATTTTCCTATTGTTT
AACCTCAATTAATGTTGATGCTAATAGCAAAATTAGCAGCACATTACTTATGGGAACCATAGCAAATGATGATTATTCC
AATATTATCACAACCCCATTAGTGAAAAATCCTTCACAACCATCTTTTTATTATCTTTCCTTACAAGGAATATCAGTTG
GAGATACTCGATTACCTATCAAGAAATCCACATTTTCACTCAACCAAGATGGCAGTGGAGGAGTAATAATAGACTCTGG
GACAACCATAACATACTTAGAAGAAAGTGCATTTAAACTTCTCAAGAAAGAGTTCTCTTCACAGGTAAACCTTCCGGTG
GATGATTCCAGCTCAACAGGACTGGATTTATGCTTCACTTTGCCTTCAAACACAAATAATATATAGGTTCCAAAATTGG
TTTTCCATTTTGAAGGTGCAGACTTGGATTTGCCTACTGACAATTACATGATTGCTGATTCAAGTATGGGAGTTGCTTG
```

FIG. 1 continued

TTTGGCCATGGGAGGTTCAAGTGGAATGTCCATTTTTGGAAATGTTCAGCAACAAAATATGCTTGTCATTCATGATCTG
AATAAAGAGACTTTATCATTTGTACCAACACAATGTGATAAACTGTAGAATATATATATCTCCATTTGTGGTTCAGGTG
TTCATTTATATGTCTGTTTTCTTTTTCTATTATCTTTCTTTAGCAATATAGAATTTTTATCATTTCAATCTAAAAAAAA
AAAAAAA

> SEQ ID NO:7407 114865FL *Nicotiana benthamiana*
CCCCTCGACCCACGCGTCCGCAGAAGAGCAACATTTGAACAAGTATGGAAAAGGAAAACAAACTAAAATCAGAGACTTC
ATTGGAAAATCCGATGTTTTCACAACAGATTCAAACTGAAAAGGATTCTTTAGGTTTTTTAGACAACATGTTTGGTGCT
CATCTTCTTGATTTCAATACTACTATTCCTTCCATTTTCGATTTGCTTCAAACTTCACCACCTCAATCACTGACTAATA
TTCCATCTCCAACTTCCACATTTCAAGAATCATGTGAGGTGGAGGTGGTGAATTCACTGTCGATCTCTTCATCATCAAC
TGAAGCTGCCGAAGATGATCAGCAGAGTAATACAGTAAAGCAACAAGATGAAGATGAAGACAAGTATAAGAAACAGTTA
AAACCTAAAAAGAAGAATGTTCAAAAGAGGCAAAGAGAGCCAAGATTTGCATTCATGACCAAGAGCGAAATTGATCATT
TGGATGATGGTTTTAGATGGAGGAAATATGGCCAAAAAGCAGTGAAAAACAGCCCCTTTCCAAGGTATATATGTTTAAA
ATATGACACATTTTTATATTTGATAATTCATTACGAAGGGAGTACAATTAAAATGTCTCTAGGTTAATTCTTCTACCGT
TTAAACTAATAAAACACGCTGGTGGATGCATATCATTTATAATATGTACATACTGTACTCATGTATAATTAATATATAA
TCTATATATACCGATTAAGAAAAATTGTTAGAGTTACTGATTGCAGCCCATCAGCCCAAGTTCTGGACCAGACTAAGCA
GACCAACTAAGCAGCTAAGTTCTGGCCCACACACACAATACATTTATTTCAGCCCGGAGTGTATATATTCTAGACACGT
CTATATTTTATATTGTGGACTGATATTTCTTGTAAAGAACGACTTATACACAGAAATACATATAGTCAGTTCTCTTTCA
AAAAAAAAAAAAAAA > SEQ ID NO:7408 130866FL *Poppy*
GTTCTTGTCATTAATTAAGTCGACGAATTCAAGAACATGGTTTGCGAAACTTACCACGTCTCTTATTCGAAAAGGTTTT
TTATGTTAATTCTCTTCGTCTTCTTTCTCATCTTTATGATCGGTGGAGATCCAGAAAGTAGACGCTTGTGCAGAAGAGA
ATTTCCAGTTGGTTATGGCCTGCGCCTCTATTTTCATTGCGCTTTATTTTTGTCCTTGTATCTTGTTTTACAGTTGTTT
CATCTACACTTGACAGTGATGAACAACAGATGGTTGTTCCAAATACCCATGTTGTGGTAATAAAGTATCGAATTTCTGG
ATTCTCATTTCAACAAACATGTTCTTGTCACCTTATCAACACAATCAAATTCCAGTACTAGCAAAAACCAGTCAATCTT
GGGCTTCTAGTGTAATGGGCCGTTTAAATTTCTATTTTTTTTTACTTTTTTTTTATAAAGTAAGTGAAGTAACCCTCCT
ACTTCAACAAAATATTCCACTTATGGAACTGTTAAATGCCAGGATACCAAAAGCAGAAGTTGGTTTTTTTTTTTTCTT
ATAAAGTCGTTCCGAAATTATATACCTATAAACTAATTTACTGTTTGTTAACTTTTAGAAGTTAAAAGAACTATTTCA
GGGAGTGTATCAAAAAACGCCATAAAAACAATTCTGGAAGTGTGTCCAAACATGCTATAAATCTAACTATTTTTCCTT
CTTAGCATGATTTGCAGAAGGACGCTGGTACCACAAGATTTGCCACATTGTCAAAAAGGTTTTTGCAACACTCAAATCG
ACTGTCAAGAGACTTTACCTTAGTTTTTTGACACTCAACTTACACCACCCAAATATGACTTTTGGCCAACCCATTGGC
GAAAAAACAAAGAGTTACTAAGACACTAAACTTAGCTCATCACAGCACTTCACATTGCTGCTACATGTTTATTTGAAAA
CACAAAAAGCTGCCAAGGTTATGGTGAAAAAGAACTGTAATTTGACCAAAATACAAGATAGGAGAGGGTTCTTACGTAC
CACATTGGATTAATTCACAAAATCTTAGTCTTAAAACATTGGATTCTAATTTCTAAAGACGTAACCATATTTTTACAAA
ATGAAAAGAATGGCGCTTATCCAAATGCTTCAAGAAAAAAAAAA > SEQ ID NO:7409 49360FL *Nicotiana benthamiana*
CCCCTCGAGGCCATTACGGCCGGGCCAACTCTCACCGACCAGTTCGCTTGATGCAAATTCAAATAGCTTCAGTTTGGAA
ATTGGTAATGGTGAATTTAGTGGAGCTGAATTGAAGAAAATTATGGCAAATGAGAAACTTGCAGAGATAGCCTTAGCAG
ATCCAAAGCGGGCCAAAAGGATTTTAGCCAACCGCCAATCTGCTGCTCGTTCAAAAGAGCGAAAGATGAGATACATTGC
GGAGTTAGAACACAAGGTGCAAACACTGCAGACTGAAGCCACCACATTGTCTGCTCAACTGACACTGTTGCAGAGAGAT
TCTGCTGGGCTAACGAGCCAAAACCACGAGCTGAAGTTTCGTTTGCAAGCCATGGAGCAGCAAGCTCAACTCCGTGATG
CACTAAATGAAGCATTAACTGCTGAAGTACAACGGTTGAAGCTTGCAACCTCTGAGATAAGTGCAGACGCTGCAAAGTT
TCGGCAGCTTTCTCTCAATCCTCAGATGTTCCAGTTGCAGCAACAGCAGCCAACTCAGCTAAACATGCATCAGTTGCAG
CAGCAACAACAACAACATCAACAATCATCTCAGTCTCCACAACATGCACAGCAGCAACTTAACAGCGCAACGCCTTCAA
AGAACGAAACGAAGTAGTATCTTTTGGGAATTTCTGGTCATCGTAATATTTATATTAGTTTCTTGATAGATGTTGCGAG
AAGTACTGTCATTCAATTGCATTCATTCATTAGTTCTGCATTACAAGAAAACACGCTAAAGACATGGTATTTATCTATA
GGACATGCATGCTCGTTGGAGTAATTAAGTCGCATAGAATCTTTTGATGTATACAGTTCGTTTTTCACGTGATAACTCA
TTTTGTTGTTACGCAAGTTAAATGAAA

FIG. 1 continued

> SEQ ID NO:7410 114161FL Nicotiana benthamiana
CCCCTCGACCCACGCGTCCGCTTGTCTCTCAATCTGACCCTTTTGGCCAATTGAAATCTGCATCTGTGGAACACACTGA
GTTGCCAAAGGGGAATGCAACTGAGTTCACTATTTTCTCTGTATCTCCTTCAGGTGATTGGAAATCTTCAGGATATGGG
CAAAACCAATCAAACATTCAGGCTGCTGCTACCTCAGTTAATATGGACTATCGAAGTCACTTTGAGCTAGGGTTTAGTC
AGTCCCTGATTTCTGCAAAATATCCTTACGGAGGACAGCAATCCGTCGGGTTATTTTCAGCTTATGGTCCTCAAATTTC
GGGCCGTGTTATGCTGCCATTGAATTTGGCCTCTGATGAAGGCCCGATATTCGTAAACGCCAAGCAGTATCATGGGATA
CTGAGGCGTCGAAAGTCCCGGGCTAAGGAAATGGAGAAGAAAGCTCTTAAACCACGCAAGCCATACTTGCACCTCTCTC
GCCATCTCCATGCAATGCGCCGACCTAGGGGCTGTGGTGGACGCTTCTTGAACACAAGGAAAATGAATGGAACTATGAA
GGGTGGAAAAACCAACGATACAGTTAAGACTGGTGATGTTCACAGTTTTTACCCAACTGGATCCCAGAATTCTGAAGTG
CTGCAGTCTGATAGTAGCAATTTAAGCTCACCTAAAGAAACGACTGGCAGCAGGTTCTGCCATTCGTCAGAGGTCACTA
ACATGTACTCTAGGGGAAATCTTGATCCATTTCTGTTTCAGGACCTGAGGCCTTCGGTCCAGGCAATACCTGACACGAT
GAATACTGGACACGGTATTCTCATGGCCGGTAAGTGGGTTTCAGCAGCAGATAGCTGCTGCAACCTCAAAGTTTGATAG
CCTTGGATGAGAACGGGGTTAGGTGTCACGAGTTGTGCCTGACCTCGTCTTTGCTGCAACCTAATGCAAATGCATTGGA
ATTTGATCTTACCAGCATTTGGTTGCTTGAAGGCAGTCATCCTTGGCTATCAATGGGGCAGTTCATCCTTGGCTAGCGT
TAAGGCTGCCTCCTATAATTCTATTGCTATCGAGCAACATGGATGGTAAGAGGCGCTCCTTAATGCACTTTAATTTTCA
GCACTTGTAGGATAAATAAACATATTTTGGATAAGATGATGAAGACCCTGTCAATCGGGGCTGTGATGTTGCAGTGTGT
TTGGATTACTGTTGTGATGTTTGTTTGTGAAAATACAGTGATGTATGATTGAACTTGATCCAGATAATGGGCAACTTGG
TGGTTTC > SEQ ID NO:7411 120246FL Nicotiana benthamiana
CCCCTCGACCCACGCGTCCCCACGCGTCCGCTTTCCTTTTTTATTATAGCATTTTTTCTTTACAAATATAAATAAATCA
AATAGCAATCCCAAAAGAGGCATAACAGTTTTGTTTTCCGAAAGAGTTTTCTCTCTATTTCTGTCTAAAGAAGTCATGG
CGGAAAAAGGGCGACCACTTCCTAAGTTTGGAGAGTGGGATGTAAATGACCCAGCTTCAGCTGAGGGATTTACAGTGAT
CTTTAATAAAGCTCGAAATGAGAAGAAAGGTGGTAAGATAGACTCACCACCTAAAGGTGATTCTGCATACAAGAATAAA
GCAATGCTTGGAAAACCTCAATCAAAAAATGGTTTTGCTGTATGCAATCTACTGCGGCCGAATCATGAACTGTTTTAG
CTCCTACATACTGAACTGGAAAGTGATGTTGGTTGGAACCAGACTCTACGAGTGACCTATAACACTGGAGCTGTAGTCA
TGATCTGACGAGGAATACTGGGATTTTTGCTGTTGTATTTGGAATAGTTGCTCAATTTGCAGGCTTTTGCTGCCAAAA
TATTAATGATATATATTTGTTTGAAAAAAAAAAAAAAAAAAAAAAAAAAAA > SEQ ID NO:7412 216006FL Trichoderma harzianum
GTTCTTGTCATTAATTAACTCGACCCACGCGTCCGGCACTCACCCCTCCAACCCCTCCAAAGATCTCACCACCGGCCGA
ACCCTCCTCGATCTCTGCGCCGAGAATCAGCTCCTCCTCTCCGAATCCGTCGCTTCCAAATATGGCTCCAAGCTGCCCT
TCCTCTTCAAGGTCCTGTCCATCAACAAGGCCCTCTCCAATCCAACAAGAAGCTCGCCGAGCAGCTCCA
CGCGCGGGACTCCAAAAACTACCCCGATGACAACCACAAGCCCGAGATGGCCATTGCAATCACCCCCTTTGAGGGACTC
TGCCGGATTCAGGCCTCTGGGAGAGATTGCCCACTTCCTGGAGACGGTAAAGCCATTGAGAACTCTGGTCGGAGAGAGCG
AGGCGTCGCAGTTTGTGCAGGCTGCCAAGCAAGAGGGCGGTGACGAGGCGGCAAAGAAGAAGGCCCTGCAGACGGCATT
CGGAGGATTGATGTCGTCCTCTGCCAAGACGTTGACAGAGAAACTGCTAGCCTCGTTGCACTCGCCGAGTCTGAGGGC
GCCGACTTCGCTGCCGGTGGTGTGTCATCCACCAAGGGCGCTGTCCTCGCCGAGCTTGTCACTCGACTCAACGGCCAGT
TTGGCTCCGACATTGGCATTTTCGTCCTCTTCTTCCTCAACTTTGTCACACTACAGCCCGGAGAGGCGCTGTTCCTCGT
CGCCGATGACATCCACGCCTATGTCTCCGGTGACATTGTCGAATGCATGGCAGCGTCCGACAATGTCGTCCGTGCTGGT
CTTACACCCAAGTTCAAGGACGTATCCACCCTGGTTGACATGCTCACCTACAACTATGCGCCCATCGACGAGCAAAAGA
TGACTCCTACCGAATATCCCTATGCGACTCTGAACCGAAATGCCTACAGCTCCGGATCTTCTGTCATGCTGTACGATCC
TCCGATTGAGGAGTTTAGCGTTGTGCGCACTCTGCTTCGCGGAGAGGGGGCCAAGGCCACTTTCGACCCCTTGGAGGGA
CCCAGCATCGTCATCTGCACCGGTGGCAAGGGTACAATCGCCGTGGGACCGACAAAACAGGAGATTCAGGAGGGTTACG
TGTTTTTCGTCGGATCTACCGCGGAATTGGTCCTGGAATCCGCCGTCGGAAAGGACGAGGAGTTTACCACGTTCAAGGC
ATTCTGTGAGATTGATACATCTGGAAAATAGAGGCTGCAATCATCTTCTTCAAATCCTTTTCCACATTATCGAAAGATG
AACGAATTCATGAGCAATTGGAAATTTTGGTAGGGCATATAATACAAAACAAGCTAGAACTGAAAAAAAAAAAAAAAA
AAAAAAAAAA > SEQ ID NO:7413 216103FL Trichoderma harzianum
GCGGTGACATCCTAACCAAAAGAAACTTGACCCTCATCGTAGCCGCTGTCGAGGCGCAACCTTTACCTGTATTGATTG
CATGGTATACTTTCCCGGCGTCGAATATCGTTCTCATACATCTTGCATGACAGAAGAGCAGAAATACCAAGGCGCATTG
TATAAGCCGAAGCAAAACAACAAGAAGCAGCAGCAACAGCAGCAACATCATCAGCAACAACAGCCCACCATGAACTCGC
ATCGGTTAGGCATGGCCAACACGTTGGCCCTGCAGCCATTTGTCGAAGATGTCAACGAAGACAAGGAATACGAGTCGTG

FIG. 1 continued

```
GCACGAGTACGAAGACAAGTCTCGACCTCCCCCCGAGGCGCCAACCCCTCCATCTGCCGCCGACGATGACCACGTCAAC
GTCTTTGACTTCCTAGACAACTCTCAAACCCCGACTGCCTCAAACGTGAGCCATGCGCGAGACCGAAAAGCTCCTGGTC
CCAGCGACAGCACCTCTCTTGTGCGCTACGAGACAAAGAGCGGAGAGCTCCTGGAGCCGGTTATTATGGACCGAGACGG
AGAGCCGCTTGTACAATACGGAACCGGCCCTGTACCCACAGGTTCTCTCGCCACCCCTCAACCCAAGACCGAGCGACGG
AGGTCAAAGGAACGCGATGCCAAGAAGGACAAGAAGCGGAAGCGCCTGCACGTCGATGTTACTGGCGACCAAATCATGG
CTGATGCACCTCCCGTTCTTCACTCTGGTCTCACTGGTGGCCTGAAGAACATGATGCGGCCTGCCTTCCCACCCTCACC
CGATTACTCTGGAGACAACATTGCCGATCTCTCCCCAACAAGCCCGCTCAAGAAGACGAAGCACTCTCGACACCACAAG
AGCCACCATTCCCACACGATGAGCAACAGCCTCTTTGGCATGATTTCTGGCCCTCCACCCAAGACCAAGTCGAGCAAGC
ACAAGTCGTCTTCCAAGAAGCACTCCTCTCACAGGCATGAGAAGAAGGAGCCCAAGCTCATCGAGTTCCGACCTGGTTC
CAAGGACGGCAAACATGAGAACCTCGACGGGCAGATGATTGTCTTTAAGCCCCGTGCCGATGTCTTCCTCAGCTTCGTC
AACAAGGGACCTGAGAGTGAGCGCGGCTGCAGCATGAACAAGGCCTTGAAGCGATTCCACCGGGAGCGCCAAGCCGCCG
GCTCTAGCTCCCCAAGGGCAAGGAAGAGAAGGAACTGTGGCGATCTCTGCGACTTCGACGCAACGACCGAGGCGAAAT
TGTTCTCTTTTGTGAAGAATAAACAGAAAGAAGAAATCAAACAAAAAAAAAACATAACATAAAAAAAA

> SEQ ID NO:7414 216195FL Trichoderma harzianum
CGGACGCGTGGGCGGACGCGTGGGCGGACGCGTGGGCGACATCAGTCACAATGGCTTTCGGAACTCTCTTCACCACCGC
CGACCAACCTCGTGCCGCCGCCATCAAGGCCGTCGCCAAGGCCAACGGCCTCGAGCTCAACATCTCCAACGTTGAGGCT
GGCAAGCCCACTGCTGAGCACCTCAAGGCTCACCCTCTGGGCAAATACCCTGCTTTCCTCGGCGAGGATGGCTTTGCCC
TGAGCGAGAGCATTGCTATCGCCATCTACGTCACCTCCCAGAACGAGAAGACCACCCTTCTCGGCAAGACCAAGCAGGA
CTACGCTTCCATCCTCCGATGGATGTCCTACTTCAACACCGAGGTTTGCCCCAAGATCGGTGCTTGGATCAAGCCCCTG
ACCGGCGCCTCCCCCTACAACAAGAAGGCTGTCGATGACATCTCCAAGGAGGTTGCCCGTGCTGTTGATGCTGCTGAGG
AGCACCTCACTCACCACACCTACCTCGTTGGTGAGCGCATCACCCTGGCTGATCTCTTCAGCGCTGGCCTCCTCTACCG
CGGCTTCCAGTACTTCTTCGACAAGCAGTGGCGCCAGCAGCACCCCGCTGTTACTCGATGGTACGAGACCATTGTTAAC
CAGCCCATCTACACTGCCGTCGCCGAGAAGCTCCCCTTCCTGGAGACTCCCGTCCTGACCAACACTCCCCCCAAGAAGC
CTGAGCAGCCCAAGGCCGCTCCTAAGGCCGCCCCCGCCCCCAAGGCCGCCGCCGCCGAGGAGGAGGAGCCTGCCGCCCC
CAAGGCTAAGCACCCTCTTGATGCTCTGCCCAAGGCTTCCCTTCCTCTCGATGAGTGGAAGCGCCAGTACTCCAACAGC
GAGACCCCCGCTGCCCTCGCCTGGTTCTGGGAGAACGTCAACTTCGAGGAGTACTCCATCTGGAAGTTTGCCTACAAGT
ACAACGATGAGCTTGCCATGACCTTCATGTCCAACAACCTCATCGGCGGCTTCAACAACCGTCTCGAGGGCTCCCGCAA
GTACCTCTTCGGATGCACCTCCGTCTACGGAACCAACAACGACTCCGTCATTGAGGGTGCTTTCGTCATCCGTGGCCAG
GAGTACGTCCCTGTCTTCGACGTCGCTCCCGACTACGAGAGCTACGAGTTCACCAAGCTTGACCCTACCAAGCCTGAGG
ACCGTGCCTTTGTTGAGGCTCAGTGGTCTTGGGACAAGCCCGTCATTGTCAACGGCAAGGAGTACCCTCACGCCGACGG
CCACGTCTTCAAATAAAGAACGACAGTGGATGGGGGTGATGATAAACTATGAAGTGATGATGGGTTATGGGTAAAAAAA
GGGTTGAAGGGAATGAATGATGATATCTCATGTGCTTGTACACACACACATGCCTACGTAGTCTTATAAATCAAGGCCG
CAGGAAACCAATTCAAAACCGTAAAAAGCGATTAAAAAAAAAAAAAAAA > SEQ ID NO:7415 216272FL Trichoderma harzianum
GCTGCTTCGTAAGATCAAGCAAGTGTACAATCATCTCATTCTCTATCTACTTATTAGTCATGGGGAAAAGAAGCGAAAG
TGAAAGCGGCTCAAAGCCGGAGCGGGAAGAATCTCACGGCGCACCGGCTGAGCTTCCGCAAGAGGTGATCCCTTTCGAC
CCGGTGCCGACATACGAAGAATCGAGGCCAGGGCCATCGGATTCGGCCTCACTTTCCGTCTCCCATTCACTCTCTGCCA
CAGTCTCGGCATCAACACCGCAGCCGCCGGCCGGAACCTCAGCCCTGGCCCCAACCGTTACCTCGCCATTTAATTTCCC
TACCGATGGCAAAGGCAAAGACGGCTCCGTGAATGCTCCTCCACCAGTCTACAAGGTCGGGTCATCCAGTAGCAGCTCC
AGCGCCGCCCGAACCATTGCCTTTCCTCAGATCAAACCAGATCCAGACTCGCCTTTCCTGGTGGCCTATGCCCCTGTTC
TTCTCAGCTATGCCATCACCGAAGAACATGGCGGTCTTTCATGACCACCATCTCGGCTTTCCTGACGGCCACCATCTC
AGATCGTGCCCTATCACATGCCACCGATGTAGCTGCTCACATTGCCCAAAATCCCAAAAACTTGGGCAGAAATGTTGCT
GCCCATGCCAAATCCATCGGCAGGAACCTGTCGGACAATGCCAAACGGGGCAACATCATAGGTGCTGCCATGGGCCTCA
TCGGCGGCACCATCTCTCTACCAATATCAACGGCCCTGGGCGTCGTGGGCACCACTCTTTCGCTCCCTGGCCAGGCCAT
TGGTGCCGTGACCAAGAGGCCGAGAACCCCCAAGAGAGAGCCGCGACGTATGCGGCCGTTGCAAACGAAGAGTGGCTG
CACATGCGCGGCTTGCACGCACATCTGTTTGATTCCGCCGGGTTGGCTCATCATTTGGGAATGCCGCTGGATACTTTGT
TAAGCTTGGCTTGGGAGACTAAAGAGAGCGATGCTGGAAGACAGATGAGGGCACTGGAGCCGCATATTGCTGGGCTCGA
TGTTGACGAGGGGCGATGTTGCAACTGAAGACCCAAACGCTGTGGCTAGTGTTGATGCCTGGAAAGCAACCCTCTTCA
AGTTGAATACGACTGCGGGTGGAGTAATGGTTTTCTTATTAGTAGGGCAAGGGATATGGGTACATGTAGTTGATTCTTT
TCAGGACAGATCAGTGTCCAAAACTTTGGTTATAGAAGCACAAGCAATGAATAATGGAATTTAGAATAAAAAAAAAAAA
AAAA
```

> SEQ ID NO:7416 216360FL *Trichoderma harzianum*
CCCACGCGTCCGAAGCCTCTTCGACCACCCTCTGCCATCGTCAGCCTTCGACTCTCTTCACCAAACCTCAACAAGCGAC
AAATTATCGCCAGGGTGCTCCAACGCTCGCTCCGCCATCGCCAGTATCCTTTGGACCCATACTTTCGCTCTACAACACA
CACAACCCCTCTTACGCCCACATAGCTTCGGCTACGTCAAGTTTCGGCATCATGTCTAGCAGAGATCGCCGTATAATGA
AGGAGCTGCAGGATCTGACCGAGGACAAGGACACTTCCGGCATTCATGCTGCCCTAGAACAAGAGGGCTCGCTGACCGC
TCTCAAGGGCTGGTTCTTTGGCCCTGGAAATACGCCGTACGCTGGTGGCAAATTCGTGATTCACATTCAGCTTCCCACC
GACTACCCCTTCAAGCCACCCAAGATGAAGTTTGAGACCAGGATCTGGCATCCTAATGTCAGCAGTCAGACGGGCGTCA
TTTGTCTCGACACCCTCAACAAGAACTGGTCGCCTGTCCAAACGATCAAGACGGCTCTCCTCTCCGTCCGAATGCTTCT
CGAAAACCCAAACCCCTCAGATCCACAGGACGGCGAAGTTGCACGGATGCTGCTCGACAGTCCCGACTCGTTTGTCCAG
ATGGCTCACGAGTGGGCAGTCAGGCACGCCGGTGCGCCGCGACAGCGAAACCTCGACGTAACTATATTCAGAAGCCTGG
CCAGACCAACAACTGCTGTCGATGCGAGCCGATACCATGGATACAAGCCAGTCTTGGTCGAACAGTTTACGGCAATGGG
ATTTGACCTCGATAACGTGGTGGCGACTCTCGAGTTTTTCCGCATCGACAAATTCCATGAAAACCTACCTCCGTCTCGC
ATGTCGGACGTAACAACTCGACTTCTTGGTGAGCAGCCTTAGGAAGCATAAGGGAAGTTTAGGAGCTACCAACCTGCCC
CCTTCCTAACATCGAGTGGCGAAATGAATTGGAGTTTATTTACATGGACTGAGGGTTGAATCTCTTTTTTCTTGGGTTT
CTGTTTCTTCCCCTGGGGCTCTGTCCTTTGGCTCAGTTGTGCTCCAATGTCCTGTTCCTGAAATTTGTAGACTCGGGAT
GGACGGGACAGTTGCTTACGAGAGCCGAGTCACTTATTGAATGGTGGTGACTAGCTGGACACCTGAATAGTCATTTAGA
AGTTCAGGAGAGACGGGTGTTTAGGGCATCACTGGTGCCCCGGGAGCGCATGCTATCAGGTATACAGCGACTCTGGAGT
TATCAAGGTCGGAATTAGGTAGCATATTACACTCAATATAGCGGAAAAAAAAAAAAAAAAAA > SEQ ID NO:7417 216008FL *Trichoderma harzianum*
AGCACGGAGCACCACCATGGCTTCAAGGTTGAAGATCTGGGGTGCCTGCAGGACTCTGGCGGTCCGGACGCAGCCCGTC
CGCCTTGCGGCTCAGCCATTCCGAAACCAGGTTTCAGCGACTCGATTCTATGCCGACGATGCGACCAACAAACCCTCCA
ATTCTCCGAGCGGTGCAAAGAGAGAAGCTTCTAGATCAGTTTCTAAATCAGAACCAACAAGTTCCAGGGTTACTGAGGG
CACCTCTGGAGAATTGACCCAGAAAGCCGCACAAGAGACATCTTCATCACAAGCCTCACCCATTGAAGCGCTAGACGAT
GCGACCTTGGAACAAATACTATATGGCGGTCGACCCGTAACAAGTCAGCGGGAGGGCGGCTTGACAGAGGCGCAAGAGG
AGGCTCTATATCGCGAGGGTGTCATTCCCCCACCAGAGCAGGCGGAAGCTATCGTTGCTGCCGGGTCACAGTCAATAGT
CCCTGTTGGCTCAGAAGTGCAAAACGCCGGCCATAAGTTTGGTCTTCCTCAGAAGCCCTATCCGGACGGGTTCCATGTC
AAGAAGCGATACCACCCCGTGCTGGAGCAAATCACTAGGCTCCTGATGCGACATGGAGAACTCAGTGTTGCGCAAAGAA
ACATGGCTGCTGTCATGAACTTCTTACGAACGTCGCCCGCCCTATCTACAGCCCGAAATTCCCCCTATTACCAGGGAC
TCCGCCCGCCGCCCACCTCCCTCTTAACCCCGTCCTCTACATCACAATCGCCATCGACTCGGTTGCGCCGCTCCTAAAA
GTGAGGAACATTGCCGGCGCTGGTGGAGGTGGCCGTGCTCTGGAACTCCCCGTCCCCTCGCCGTCAGACAGCGCCGAA
GAATGGCGTTCCAATGGATCCTGGACGTCATCAACAAGAAGCCCTCGAAAGGCAGTGGGCGGAACCAGTTTGCCCATCG
GATAGCTGAGGAGATCATCGCCGTGGTGGAGGGCAGGTCGAGCGTCTGGGAGAAGAGAAAGCTAGTTCACAAGCTTGGC
ACTGCGGCTAGAGCCAACGTGGGGTCCAACAAGCTGAAGACGAAGAAGAAGAAATAAAGGACATGATGCGACGGCGGAT
TTGAATGTATATTAGATGTGTATTCTACGGCAGCGAACTAGATGACAAAAAAAAAAAAA > SEQ ID NO:7418 216105FL *Trichoderma harzianum*
CCCACGCGTCCGCCCACGCGTCCGGGATCTTGGTGGGCACCACGACGTTCTTCTCCATCCTCATCTTCTCGATCAACAC
TGTCTTTGCTCAGGAAACACTCGCGCAGTGGATTGGAGATTACCTGACTCAATCTGCTGGTGTTACGGTTGTCTTCGAA
TCAGCCATAGTGCCCAAGTGGAAGAATGGCGTTATCGCATTTCGTAATGTGTTTATTTCAAGAAGACCCGGGCAGATCG
AATCATCCGTCAGCAAGGGATCGTCTGACGCTGCTGCTGTTGCTGCCGCAGGGCGCCAGGTTCAGCATAACGGGACTGT
TACCGAAGACGATGGCAACTATACGCAATTTGATGTAACGATCGCAAACGTCAATGTCACACTTTCATTCCTCAACTGG
TGGAATGGCAGGGGGCTTCTCAAAGATGTGGAAGTAAATGGTGTTAGAGGAATTGTCGATCGCACCTCTGTCCGTTGCC
CACTGCAGCAAATCGACCCCTTGTCTTACCGCCACAAACACCAACCAGGCGATTTTGAGATTGAATCTTTCAAATTGGA
AGATCTTTTGCTCACCATTCGCCAACCTGATGGCTTCCGCCCCTTCTCAGTGAGCATATACTCCTGCGAACTCCCTCGA
CTGAGAAAACAATGGCTCTTTTATGATTTCCTATCTGCCAGCCATATGTCTGGGTCATTTGATGGCTCTCTCTTTACAA
TTCATCCGCGACAAGTTCACGGTACGGTTTCAAGTCGATACCAGGGAGTCATGATGGGGCTAGAGGAATCCAAGTCGTG
GAAAAAATTCAACCGGCTACGGATTGATGGCTTGAAGATTGACCACCTAAACCGTGGAGTGGAGGGCCCATTTGGCTGG
ATCTATGAAGGAAACGTTGACATCGTTGCTGATGTCATGTTTCCCGAGGATATGGACGACAGCATTACCAAGGTCGTAA
CGGATTTCTACGACCAGCTGGAAGGCACAGTTATTGCTAATCGTTATCGCTTTCTGCCCCGAGCCCTACACCCGAGAA
ATTCTCAGAGAGCGAGCGCGCAACGAGCGAGAAGAAGGCTCAGAAACAAGCCAACGAGTCTGAGGAGGATAGACGCCTT
GTCATCATGGACTTGCGTATTCATCTCAATGACGTCAAGGCTGCCGTGCCTTTATTCACCCCGATCTGTCATATGTCA
ACCAGGCGCTTGTTCGCCCCATTGTGGCCTATATCAATGCTAAGAAGACGTACATTCCCATCTCTAGCCGCATCATCAA
GCCGCTAAGCGACTTTGACGGAAGTTGGACAGTCTTTGATTGCGGGCTCTTGGATGATGCATCTGCCGAGACGTATGAG

FIG. 1 continued

```
GCTTTTGCAAAAGATGTCGAAGATCAGCAAAGCCGCGTCAGGCGATTCCGAAAGGTTGGATTCTGGACTTTGTCGCTGG
CCATTCATGCTCTATTCATGGGAATGGCCGGGAATGTGGTTTAAGGGGAGAAGACATGGAGAAGAAAAAAGGGACGGTG
GTGGATTCCTGTAGAATTGCTGTATATTTACAACGACATGATGGGACGGGCGGTACATGACGGGATTTTTATGATGGCG
TTGCGTTGTTACACGGGTATCACTCCGGGCATTTCTTGGCGATTTTGGGGGTTTTTATGGATCTTTATGAGAAATACTT
GACGCTTCAGGAGAGGCTATCTATATCTGATACCCTGACCTCTTGTCTACTGAAGCAGTGCAATACAAAACAAAACCAC
TCCCAAAAAAAAAAAAAAAAA

> SEQ ID NO:7419 216362FL Trichoderma harzianum
CGCGCTTGCGTTGCGTGTACCTCCGTGAAGCAAAATGCATGCTACATCGGCCCAACATGTGCCAGAGATGCGAACGCC
TTGGCAAAGAATGTGTCTTTCTCGAGTTGTCACAACGGAAGCGCAAGCGCAGCGAGTCTCGGCGCGTGGAAAAGCTTGA
AAACACAGTTAATCAGCTGATTACGCACTTGACAGGCCTGACAGGACAGGATGTAACACCGCTAGCATCACCCTCCCGA
ACAACACAGTCCGTGATTTCTTCTGCCGAGGGCATGTTGGCTATCCAAAGAGATAGTTCTCTTTCACAATCAGGGGACC
TACAAGACCGCAGTCCAGAGCCCGTAATTGGACATGAGAGTGTTTGCTCTATTGTTTTGGAAGCTCTCAATAACGATGA
AACAGAGGCGCTCCTTCAGAAATTCCAACAAAAATTCGTACCTATTTTTCCTTTCGCGGCGATTTCTATATACAAAGGC
TCGTATCACATCAGGCATCTAAACCCTTTTCTGTTCCTGTGCATCATGGCCGTAACTATAGGACCAAAGCATCCTTTAC
GGGCGCATGTGCAACATGAAGTCGTGAATCAGGGCATCCGCCGAATGATGCTCGGATTGGAGAGAAACCTTGACCTCCT
CCGCGGATTTCTTGTCTTAGCCAGCTGGTGTCACCTCTTCCCGTTTTCCCACAGCTCTCGCCCCGATGTCTTGAATCTC
GTTCAGATGTGCATTACACTTTGCTACACGCTCAACCTTGAACATAAAGCAAAATTAACGCCAGAAGAGCAAAGGGCTC
TACTAGGAACCTACTGGATATCGAAATGCGCCGAGAAGGCTTTCAGCAAGCCGATAGGATTGAAGTATGGAGATGCCAT
TAAAAACGCCTGCAAATCCTTAAGTGAATTATCGGAGTATCCACATGATCGCGATATTCAACCGCGAATCGCTTCAAGA
TTCTTAATTGGTCGAATCTGCGAGGCTTTTACATCCCTTCGCAGTAAACAGGCATCGGACATATGGGATGCACCGGTTG
GATTAATGCGCTGCCTCTTTAAGCGAGAATTGGACGTCATCGAGATAGGCGTGAATCAGCAACAGAATCTTACCCAGCC
ACTGGGCAGCCTCAACGGACACTTGGCGAGATTGGATATCCATTATGTGAGCATATGTATGGGAGAATGTGCGGTTCAT
AGCCAACAACCATGGCTGCATTGCATCGATTCTGATCCCCGAGCATTACCGACAATATCACTTTTGGCTGTTCAGCTG
AGAGAATCGCCATAATTTACAAGACGATGAGAGCGTGCAAACTTTTTATCCTGGGCTTTTTAGAAATACCGAGAGCTGA
CCTGACTTATGTTACATTCGTTACGTATTCTCAGCTATGTTTCACTCTGACTACATATGCCAAATTGGTGTTGGCACTT
TTGGAAATCGTTGTTGGTGAAGCAGCATACGATGATCGTACGGCATCGGTAACCCTAACAGATGATCAAAATTCACAAT
GCGCGGCTATAGTTGATGAGGCAGACTATCTTGGATTCCTCGAGTTACTGCTGAAGAAGGTTGGAAAAGCGGCTGAAGA
GAATATGGATGCGCAAGAGCGAGGGACAGACTTTGTCTCGGTCTTTACCTCAAAGTTAAGACTATTCGCTCTCAGTTAT
CCAACTCGAGTCAATGGAATCCTTAGGACTGATTTCCTTGACACACCGCGCGATGCAGAGTATACAGGGGAGATTCCCA
GCCATAAAATAACTCCTTATCAATTTGATCAGGGAGCTGATGATAAACTTGAACACTGGCTACGAAGGAATAATGCTAC
TCAAGAATACCCCAAGCTTCCAGATGATTTGTTATGGAACTCTTTCTTTACTGATTTTGATATAAATAATCTGCTAAAT
AAGTCAGATTATATTAATAATATATAAATCACTTGAAAAAAAAAAAA > SEQ ID NO:7420 216465FL Trichoderma harzianum
TGATAATAGTCAAAGACCAAATCTCTTCTACGGACATTGAGACGATATCAATGAGCCGAGACAAAATGGAAAAGCGGA
AGCACTAACGATTCAACTCTTTCTTCTCCTTGGCGCTGCCCTAGTGTCCATCGGCGGACGATTATACGCCCGATGGCGG
CAGGTCGGAATGAAGAATCTTGGTCTTGATGATGGGCTTGCCATTACAGGAGTGATTCTCTTTGTGCCCAATGTGGTCT
TGGCATACATGATGAACACGCGGACCCATTGGATGGGCAATCATTCTGTCGGCAACAATACTACAACACAGCCGAGCCA
TAACGAAGATCAAATGAGGGAACTGGGATCGAAACTCTATCTATACAGCTGGTTATCCTATTCCGCTGCATTATGGACG
TTCAAGGCAGCCTTTCTCGCAAATGTCCTTCGTCGAATTCCCGAATCCGGCAGACGACAAACCCACCAGTATCTCGGCT
TTGGCTTCCTGGCTGCAACATGGGTAGCAACGACGATGGCTCTCCCTCCAAAGCTGTCGACCGTTGCCCCACATGTGGC
AGGTTTATCCCAGCCCAGGACTGTACTGCCAGCCTGCTACTTCACCGGTGCTGGCGTGGGTTTACTTCAGCTTCGATAT
CGTTACAAACCTCTATCTAGCGTCTGCAGCTACTCCTGTCGCTACTAGAAAAGACAAACCCACATGGGAAAAGCTTCAG
TGGGTCGCAACGCTTGTTTGCGGGCTTCTAGCCACGGCGGCCGCGTCGAGGGG > SEQ ID NO:7421 216211FL Trichoderma harzianum
GCAGAATGTCCCGCGCCGGGTCTGAGGCCAAAATGGGAAGACCTTCGATCAGACTCATCTCGTCATACATCTTCGACTG
GATTGTTCTCATCGTGGTTGCTGGAGTCGGTTATGTCCTCGGTGTTATCACGCCCAACAAGCGGCCCTTTTCTCTGGTG
AATCCAGACATCTCTTTCCCTTTTACAGAACATGAGACCGTCCCAGACTGGCTGCTCTTTGTCTTGAGCTGCGGTGTCC
CTGCCGTCATCATCGTCATTGTCTCCATCATCTTTGTACCTGGAGCAACAGTACCCAAGAACACCCCTGCTTCACTGAT
ATGGAAACGTAAGCTATGGGAGCTTCACACCGGTCTTCTGGGGCTCCTAATGTCCGTTGCCTGTGGCTTCTTCTTCGTC
AGCGGTATCAAGAACATGTGTGGCAAGCCTCGACCTGATCTCCTCGCACGATGCCTGCCAGACCTGGAGAACGCTTCCA
AGTTCCTGATTGGCGGTTTCCAAGGAGAGTCCAAGTTGGGCAACAGCATTGGCCAGCTCTATTCGGCAGACATCTGCCA
```

FIG. 1 continued

```
GCAGACCGACAAGGCGAAGCTCAACGACGGCTTCCGAAGCTATCCCAGTGGCCACTCTGCCGCCTCTGCGGGTGGCCTC
CTCTATCTTTCACTCTTCCTTGCCAGTAAATTTGCCGTAACTATGCCATTTGTGGCGACGAGCACCTCTTCATCCAGCC
ACGACGTACATGCTGCATTCCCTTCTCGCCTGGGATCCGCAGTTGAACAATACGACGACGAGGCATCCGCTCCCATGAC
GGGCAAAGGCGCCAATTCAAGCATCGCATATAACTCCAGCGTCCAGTCCTTGCGTCGTCAGGCAGCAGCTCCCCCCGTC
TATCTCCTGGTCATTACTGTGGCACCATTCTGCCTCGCCATATTCATAGCAGCCTCCCGCTGGTTTGATTTCCGACATC
ACGGTTTTGATATTTTGTTTGGCTTTTGCATTGGTGTTTTTACTGCCATTTTCAGCTTTAGGTTTTATCACCTGCCCAT
TACTGTCGGAGCTGGTTGGGCGTGGGGTCCTCGCAGTCCAGATAGGGCTTTCTGGGCTGGCGTTGGACGACTGGGCTAT
GTGGGTGAAAAGGATGTTGAGCGTGGGATGACCGTTCCCGCCAATTATGGAGCGTCCACGGATGTCGAGGCGCACGGGG
CTTCTCTTTCAGTGCCCGCAGCTATGAGCTACAGGTCGCCGGTTTCGAGGAATGACCCCTACCAGGATGTCGAATTACA
CAACTTGAACGAGGGGACGAGCCAAGGGGCACAGCACGGGAATTGATTCGAGAGTTTTTAAATGATACCCATCTCCCAG
CGAGGAGATTGCACTTAGAAAACGTGGCGGAGGCCCTCGAAGGAGAAAATGGTCTTTGTTTTGTTCTTCATCTTCTGCC
TTGTCGAAGGGTCATGTATATGTCAGGAATAGCTGTGCACTAATATTTAAACATAAGTTCCGTCAAAAAAAAAAAA

> SEQ ID NO:7422 216241FL Trichoderma harzianum
GTTGAACGGAAGGAAGTAGCCAATCCGTCAACTCCAGACACAATCTCTGCCCTCCTCTGGCCTCACAATGTCCGCCATC
TCCCGCAGCATCAGATCAGCATCCAAGCTGCGAGTCCAGTCGCGAGCCGCAAGTGGTCTCTGCTCGGCCTCCATCGGCG
CCGCTCGCTTTGTCTCGTCCGGCTTTGCTGTGCCTTCAACCCCCGCCTCGCGCAGCAACTTCTCGACTTCCATTCCCAA
GCTTTCTGGAGCGCCCATCATGTCTTCCTCGCGCGAGTACGATCCTGAGATCAAGGACATTGCCGACTATGTCGCCAAC
AAGACAATTGACTCTGAGCTAGCTTTTGACACTGCTCGATGGATTCTCCTCGACACCCTCGGCTGCGGTCTTGAGGGCC
TCCGCTTCAAGGAGTGCGCCAAGCTGCTGGGCCCGATTGTCCCTGGCACCGTCGTGCCCAACGGCACAAAGGTTCCCGG
CACTCCCTTTGTGCTGGATCCCGTCAACGGAGCCTTCAACATTGGCGCCATGATCCGATGGCTCGACTTCAACGACTGC
TGGCTGGCCGCCGAATGGGCCACCCCTCTGACAACCTGGGTGCCATCCTGGCTGTTGCTGACTGGATCAACCGCACCA
ACAAGGCCGGCGGCAACCTGGCTGGCGGCAAGATCTTCACCATCCGAGACGTGCTCGAGGGCATGATCAAGGCCCACGA
GATCCAGGGCTGCTTGGCCCTGCTCAACTCGTACAACAAGGTCGGTCTCGACCACGTTGTCCTGGTCAAGGTCGCCTCC
ACCGCCGTGGTCTCCAAGATGCTGGGCCTCAGCGAGAAGCAGATTGCCGATGCCGTGACCCAGGCCTGGGTTGACGGCC
AGAGCCTGCGAACCTACCGCCACAGCCCCAACACCATGTCCCGCAAGTCCTGGGCTGCCGGTGATGCCTGCCAGCGCGC
CGTCAACCTGGCCCTCAAGGTCATGAAGGGCGAGTCTGGTATTCCCACCGTTCTGTCTGCTCCCACCTGGGGTTTCTAC
GATGTCCTGTTCAAGGGCAAGAAGTTTGAGTTCCAGCGCCCCTACGGCAGCTACGTCATGGAGAACGTCCTCTTCAAGG
TCTCCTACCCTGCCGAGTTCCACTCCCAGACCGCCGTCGAGGCCTCTGAGAAGATCCACCACCAGCTCAAGGCCATGGG
CAAGTCCGCCGCCGACATCAAGGCCGTCACCTGCCGAACCCACGAGGCCTGCATCCGCATCATCGACAAGCAGTTCAAG
CCCATGGACAACTTCGCCGACCGTGCACCACTGCATCCAGTACATGGCCTCCGTCATGCTCGTCTTCGGCCGCCTCGAGG
CCACCGACTACGTCGACGGCTCGAGGCTGCTACTTCGGAGCTTGTCGAGTCTCTGCGCAAGAAGATCAAGTGCGTTGA
GGACCCCCAGTACACTCAGGACTACCATGACCCTGCCCTGCGAACCATCTCCAACGCCCTGACCGTTGAGCTCAACGAC
GGCACCGTCCTCGAGGAGGTCGCTGTTGAGGCTCCTCTGGGCCACCGTCTTCGTCGTGAGGAGGCCAAGCCCGTCATCC
TGGCCAAGTACAAGCGCCACCTGGCTCCTCACTTCCCTGAGGCCACCGTCAACGAGCTCGTTGAGCTCAGCCAGGACAG
CAAGAAGCTCGAGGCCATGACCGTGGACGAGTACGTTGACAAGTACGCTGTCAAGGAGAGCAAGTTTGTTGTTTAAATT
GGGGTTGTGCAAAAGTAGAAGAAAATCCTGATGTACCTAGATGTTTATGATGACGGTCATATAGACCAAACAAAAGTAG
CATTATATTAATGAAAGAAAAAAAAAGAGTATAAATGAAAAAAAAAA > SEQ ID NO:7423 215973FL Trichoderma harzianum
CAATCATTCATCCATCCTCCATCCCATCCCATCTTCCAAACCACATCATCAATCTCTAAGCGTTGCCCATTATG
AAGAGCGCTTTGATCGCCGCCGCGGCGCTTGTTGGCTCCGCCCAAGCTGGCGTCCACAAGATGAAGCTGCAGAAGGTCT
CCCTCGAGCAGCCAGCTGGAGGGGTTCAACCATCGAGTCCCAGGTCCAGCAGCTCGGCCAGAAGTACATGGGCATCCGCC
TACTAGCCGTGCCGATGTCATGTTCAATGACAAGGTGCCCAAGGTCCAGGGCGGTCACCCAGTGCCCGTCACCAACTTC
ATGAACGCCCAATACTTCTCCGAGATTACCATCGGTACTCCCCCTCAGACCTTCAAGGTTGTCCTTGACACTGGAAGCT
CCAACCTTTGGGTTCCCTCCCAGTCGTGCAACAGCATTGCCTGCTTCCTGCATTCCACGTACGATTCGTCCTCCTCGAA
GACGTACAAGCAGAATGGATCCGACTTCGAGATCCACTACGGATCAGGCAGCTTGACTGGCTTCATCTCCAATGATGTC
GTCACCATTGGTGACCTCAAGATCGAGAAGCAGGACTTTGCCGAGGCTACCAGCGAGCCCGGCCTTGCCTTTGCTTTCG
GTCGCTTCGACGGCATTCTTGGCCTTGGTTACGATACCATTTCCGTGAATGGCATCGTTCCCCCCTTCTACCAGATGGT
CAAGCAGAAGCTTATTGACGAGCCCGTCTTTGCTTTCTACTTGGGAAGCAGCGACGAGGGTTCCGAGGCCGTCTTCGGT
GGTGTCGATGAATCTCACTACGAGGGAAGATTGAGTACATTCCTCTCCGCCGCAAGGCCTACTGGGAGGTGGACCTCG
ACGCCATTGCTTTCGGTGACCAGGAAGCTGAGCTTGAGAACACTGGTGCCATCCTCGACACCGGTACTTCTCTCAACGT
TCTTCCCTCTGACCTTGCCGAGCTTCTCAATGCCCAGATCGGTGCCAAGAAGGGCTTCGGCGGCCAGTACACTGTCGAC
TGCTCCAAGCGTGATTCCCTTCCCGACATCACCTTCACTCTGGCTGGTTCCAAGTACAGCCTCCCTGCTACCGACTACA
```

FIG. 1 continued

```
TCATCGAGATGCAAGGTAGCTGCATTTCTTCCTTCCAGGGCATGGATTTCCCCGCCCCCGTGGGCCCTCTTGTTATTCT
TGGCGATGCTTTCTTGCGCCGCTACTACTCTGTCTACGATCTCGGCAAGAACGCCGTCGGTCTTGCCAAGGCCAAATAA
ATCAACAGGACGTGCTGGAATTGGGTGTATCTAAGATGAGCACTGCTTGTGTGTTGGCAGAAGCCAGTTTTGGTTATTT
TGGGCAGCTTTGAGTGCAGCAATACAGTATTGCGGGGAGTATGGATCAAGACTGCAACGTCATTTATGTAATATAATGG
ATACTATTAGCTCAAAAAAAAAAAAAAA

> SEQ ID NO:7424  216371FL Trichoderma harzianum
CCCACGCGTCCGCCCACGCGTCCGCCCACGCGTCCGCCCACGCGTCCGATGTATTCAGACGGCCAATCACCGAAACAGC
ACAAATAAGAATATAAGCAATTATTGGTATGATATTGCAAGCTACATGAGTCAAACATCATAAAGCACCTAAGATACAG
AGAGTGAAATTTAAGCTGCCTGCTTCGTCAGAGCTTCGCTAATACGCCAGAGCTTTTCTGCCTGTGCGGGATCAACAGC
CCCAGGCAACAAGCCCTCTTTTGTCAAGACTCCGTCGGCCAAGTAGTAGCCATCCTTGTCTGACAAAATGTGTTAGTAT
TTGATTAGGTTACATGAGTGAAGTTGAGGTATAGGAATGCTGGGATACACTGGGTGTGACGTACTGGACAGTCGAGAGT
CGAAAGCGGCGATAATTCCAGTTGAGGATCCCTCAGCCAAGGTCTTGGCCTTAATCGCCGAGTTCAGGTTACCGTTGTC
ATCGATCCAGCCTATCGCATATTAGCATTGTGACAAATTCAGAAAGACAAGCAATGAACAGTAGGATCAACGCTGAAAG
AGCGCAATCCCCGCTGGCCAAAGTGCTGGACCAAGCCGACTGACAAGAGAACATCGCATGCCTTGGAATTGCTGTAAGC
CGTCCACTTCTCATAGTCTTTGCCGTTGTTGTATGAAAGGTCGTCCAAGAAGGACAGATTGGCGCGGGATTGAGCTTCG
CTTGAGTAAGTCACAACGACGCCGTGCTCCGAGGCGAGCAGCTTCTCAATCAATAAATTGATGAAGAGAAAGTGACCCA
GGTGGTTAACAGCGAATTGCATCTCAATATCGTCCTTGGACTTCTCAAATGATGGCACAGCCATGACGCCGGCGGTACA
GATCATGGCATCAAGAACCGTAACAGAGCTGTTTACCTCGGCGGCAGCCTTGCGGGTGGTTTCCAATGAGGAGAGATCG
AGCACGATGGGCTGCACGACGGTGCCTTTAGGGATGTCTAGGGACTTGATCACCTCTTGTAGCTTGTCTGCCGCTCGAC
TGGCGATGAGAAGTTTGGCCGGCTTCTGAGCCAGGATAGCTCGAGCTGTGTCGGAACCCAGTGAATTCGGGCTGACACC
GGTCACAAGAACTAAATGCTAGAAATTAGCAAAGCAAATGCTGAAGAAGAAAGGGCAAAAATGAAAAAAAAA > SEQ ID NO:7425  216013FL Trichoderma harzianum
CTGCATGTCTTGGACCTGCCTCTCATCATCTCATCTCCCTCTTGTTTGAAGAAGAGAGATCTTGTCTCTTCCCACCTCT
CACAGTTTGAAGCTGTGCATTGTTCAACAGCAACAAAAACATCATGTCAGACGACGGCCACGAAAAGGCGAAACTCGAG
TCTCACATAGACTTTGTTTCCACCGCGCCAGACTCACAAGATGTCAACGCCTTCATCGATGACATGGAGGGCCAGCTCG
AGGCTTCTGGAGGTCTCAAGACGGGCTTCTTCCATGTGCAGTTCAGCGACCCGCGGCACTTTACATGGCTGCTCGTCGC
CTTTGCCAGCATGGGCGGCCTGCTGTCTGGCCTGGACCAGAGCTTGATCTCTGGCGCCAATCTGTTCTTGCCCAAGGAC
TTGGACTTGACGGAGAGGCAGAACAGTTTGGTGAATTCGGGTATGCCGTTGGGTGCTGTGGGAGGCGCCTTGTTGCTGT
CGCCTGCGAATGAGTACTGTGGACGCAAGTGGGCGATTATCATCTCCATCCTGCTGTATACTGTTGGTGCTGCGCTGGA
AGCTGGCTCCATCAGCTTTGGTATGATTGTTTCTGGTCGTGTCATTCTGGGTCTTGGTGTCGGCCTCGAGGGCGGCACT
GTCCCCGTCTATGTCGCCGAGACTGTCGAGCGCCGTATCCGAGGCAACCTCGTCTCGCTCTACCAGTTTAACATTGCGC
TTGGAGAAGTCCTTGGATATGCTGTGGCGGCCATCTTCCTCAAGGTTCCAGGCAACTGGCGCTATATCCTGGGTTCATC
GCTTCTATTCTCCACCATCATGTTTGTTGGAATGCTGTTCCTGCCAGAGAGTCCTCGCTTCCTCATGCACAAGAACAGA
ATTCTAGATTCCTACAAGGTCTGGAAGCGCATCCGTGGCACAGAGTCCCCGAATCTCGCGAGGAGTTTTACATCATGG
CCAATTCCGTCCAGCAGGAGAACACGGAAGTCAGCGAAGGTGCCAAGAACACACGGTTCCCTTGGATGGACTTTTTCAC
TGTTCCTCGCGCTCGCCGTGCTCTCGTTTACGCAAACATGATGATTCTCCTTGGACAGCTGACGGGTGTGAATGCCATC
ATGTACTACATGTCCGTCCTCATGAACCAGATCGGCTTCGACGACGAAAAGGCTACATACATGTCTCTTGTCGGAGGCG
GATCCTTGCTCATCGGAACAATTCCTGCTATTTTCCTGATGGAAACTTGTGGCAGACGATTTTGGGCCATCACAATGCT
TCCGGGCTTCTTTATTGGCCTGGTGTTGATTGGCGTGGCGTATCAAATTCCCATCGATACCAACCTGCAGGCGGCTGAG
GGGCTCTATCTCAGCGGTCTCATCATCTACATGATGTTCTTTGGCTCTTATGCATGCTTAACATGGGTTGTCCCGTCTG
AAGTGTACCCAACCTACCTCCGAAGTTATGGCATGACCACCTCAGATGCTCTCCTCTTCCTCGCCTCCTTTATCGTGAC
ATACAACTTTACAGCCATGGAAGACGCCATGACCCGCACCGGCCTGACGCTGGGCTTCTACGGCGGAATTGCTTTTGTC
GGTGAGATTTACCAAATCTTCTTCATGCCCTGAGACAAAAGGACAAGACTCTTGAAGAGATTGACGCAGTCTTCTCGCGCC
CTACCTCAGAGATTGTGCGTGAGAATTGGGAGGGCGTCAAGGAAACTGTGGCGGATGTGTGCAACCTCCGTTTCCGCAA
GGTGTTTGAGGGACAGATCAGCGGAGGAAGAGCCTTCACGAGCCTGTGACTGCTTAATTGGGATGAGGACTGGGTAAT
AACGACTATTTGGATATGGATATACGGATATAGTGCAGGGCTCTGTATATGAATATGATGAATTGATGTCTGAAAAAAA
AAAAAAAA > SEQ ID NO:7426  216072FL Trichoderma harzianum
CAAAAAGCCCACCAACATGGCGACAATGTCAAATCAGTCGCTGAGGGCGGCTGTTCGGTCGGTTGGACGATTAAATGGA
CGGACGGCTAGGTCTTCGGGCCTTACATCGAGGCAATTCAGCACCTCGCCAGCTCATGGCGTCAGGGCTGTCTTCGCCG
AGACGGACAACACCGAAATGAACAAGATCCTCAACACCATCCAAGAAAACATCATCCTCCCCGCCTACCTCCCCGAAAA
```

FIG. 1 continued

```
GCAGCGCAGGCTCGTCTTTGACCCCAAGATGAAGTCCTACCTCGAGCAAAACCCCATCATCATCGAGGTCGAGGGCCTC
GAACACAAATTCTCCTCCATCGACCACTTCACCGGTATCGAAAACTCAAAGACGATCCTCTCCGAGGCCCTCAGCAGCA
TGAAGAGCCAGGACGACTGGGCCAACCTGGGAACCCTCCTGGCGGGGTACAAGAAGGCGGGGATACGGCTCAAGGCAAA
CCACTGGGGGAAGATTGTGCGCATGGCAGGCAAGAGCGGCAACATTCACGCCGTCATTGAGTGCGCGAAGCAGTCTGAC
AAGACGGGCCTCCTGTTCACCAACCGAGAGACGGTGGTACGGGTGCTCTCTTACATCAATGAAAAGGTCAGCGGCAGCA
ATTGGGACGAGACCGAGACGAAGCAGGCGCAGAAGTGGGCGGATCAGGTCCTTGATCTTATCCAGCGCAGAGAACACAC
AGTCGAGGGCCAGCCTACACGAGAAAGACTACACTTTTCTCGCGTTGTACGTGGAATGACTCTCTTCACGAGGGCATCC
GCCATCAAGGTCAAGCAGGCAGCGGGCGAAGCCGTCGAGCAAGACATTTTGCTCCTCAAGGACGAGGTCGAACTGCTCA
GCTCTCTGTGGAAAGACTCAACGAATGCCAACCTGGAGGAAGTAGCCGAATTCGCAAAGCTCAACCCTACACTGGAGAG
AAACTCCAGCCCCAAGGGCGTCAAGATTCCCACCGCCCTGAACGGAAGCGCATACGTGCAGGTTCTGGCACAGAACATC
AAGGGTATTGCGCTCGCGCGCGAGATTGTTGGGGAGGAGGCCCAGGGCCTTGCGCCGGTGGAAGTCGCTCTGGCCGATC
ACCTGCGGCACTTTGTTCAGACCAGCAAGAGCCCGACGAATGGCTGGGACCAGGAATATTCAAAAATCGTCGGAGAAGC
ACCCAAGTGGTGAACTTTACTGTACAAAAAAAGAGGGGGAAAGGGGGAGAGATGGGAAACAACCGGGGACTACACAAA
AGAGAAGAAAAGAAAGGGATAAAGTCTATATATGTATGATATATACGTGTACCATATAAAACAAAAATAACAATTTCA
AAAAAAAAAA

> SEQ ID NO:7427 216166FL Trichoderma harzianum
AAGAAGGAATACAAGACTCCAAGATGCATCATCAGCTTCTCACTCTCACCGCTGCTGCTGGCCTCCTCGCGACGGCCTC
AGCTACCTACTCGAAGCTTCCCAGTGTCAATGTGCCTTCATGTCCTCGTGTTGGCACGATTAGCTACAGCAAGTCAGTG
CCCGACCTGACGCCCTTCCCGCTCACACAGGTCAACCTGTGCTACACAGACAAGAGCCTCGAGCTCTCATTCATTGCCT
ATGACGAGGTCAATTACTTCTTCAATGCCTCTCAGGGTACAAACGACGACATCTGGGAGTACGAAGTCATGGAGGCTTT
CCTCTACAAGGGCACCGAAGACCCTCAGACATACGTCGAGCTCGAGGTCAACCCCAACAACGTCACATACCAGGCATTT
GTTTACAACCCCTCCAAGAATCGCGCGGTCGGCGCACCCTTCGACCACTTCTTCGTTTCGGATCCCGCCACGGACGGCT
TCAGCTCGAAGACTGTCCTCAACAAGCTCGCAAAGACTTGGAAGAGCACTGTTACCGTCCCTCTGGGCATCTTCAACGT
CGACGTCGGCAAGGCCAAGGGCACATCTTGGAGGATGAACTTCTTCCGAACCGTCGTCAGCCCTGAGATTTACCCTAAT
CAGACTCTTGGTGGATGGTCGCCGCCAGACCAGGCGAGCTTCCATATTACAAAGTTCTTTGGTCATGTCAAGTTTATTT
GATCGGGAGGATTTGGGTTTACGATTGATGTTTGCGAGCCGTAAAGCGGAATTACAAAGCACATGTACATAATGCGGCA
TGCCTGATCTAATGTAATTGTCAATGATGAATGATCTGACAAAAAGAAAAAAAAAA > SEQ ID NO:7428 216286FL Trichoderma harzianum
AGACCATGACCGTGCAAGCCGAGCCCAAGGTGCCCATGGACGCCCTGGCTGCCCACACTCTCAAGCACGGTGTCATTCC
AAAGATTGTCATGGAATTCAAGGGCATCACTGTTGGTGGTGGCTACTCTGGCTTTTCCGGCGAGAGCAGCATGTACCGC
TATGGCCTCTTCAACAATACCGTCTCCGAGATTGAGATTGTGCTTGGCGACGGCACGCTGGAAACGGCCAACCGCGAGC
ACAATGCGGATCTGCTGGAGCACGCTGCTGGCAGCTTGGGCACGTTTGGCATTGTCACCCTGCTCACCATTGAGCTGAT
TCCGGCCACTACCTACGTCAAGCTGGACGTCCAGCTGGTCAACGACGTTGCCACCGCCCACGACTTGTTTGAGGAGGCC
ACCAAGGACGAGTCGATCCACTTCATTGATGGAGTCTACTTCCGCAAGGGCACAATTGCCGTCATGTTTGGCCGTTTTG
TCAACGTCCTCCCCCAGGGCAGGTCTGCTCTTAAGAAGATGGAGGTTCACTGGTTTGCCGATACCATTGAGGACGCTCT
CAAGAAGAAGCCCACCGCCGAGAAACCCATAGACATCTACATGTTCACACCCGACTATCTCTTCCGCTATGACCATGGC
GCCTTCTGGGGTGGCAAGCTCGCCTTTAAGCACTTCCACGTGCCTGAGAATGCCTTCACCAAGCGCCTGGCGGACCCCT
TCCTGGACAGCCGCACGTGCTACCATGCGCTGCACAAGTCCGGCCTTGCCAACGAGTATGTCGTGCAAGATTTTGGCAT
TCCAGCGAGCACGGTCAAGGAATTCATTAGCTTTGTCAATGATACCCTGCCGGAGCTCATGATCTTCTTGGCTCCTTGC
AAGGCCCCCAAGGAGATTGGCCTGACATCTCGTTTCAACGCCCGCGTCGACGAAGTTTCGGACCAACGCATCTTTGCCG
TTGGCGTCTACGGCCGCGGACCTCGTGACCCAAAGGCGTTTTACGAACTCAACCGCAAGCTCGAGCTGCGAAGCGCCGA
GCTCATGGGTGCCAAGCTCCTGTACGCTCGAACTTACTACACCGAGGACGAGTTCTGGCTCATCTACCGCAAGGACGTC
TACGACGAGATGCGCAAGAAGTACAAGGCCGAGACACTGCCTTCCGTCTACGACAAGCTCAAGGCGGACATGGAGACCG
GTGCGGGCAAGCGAAGGCCTGTGCGTGGCATCATCGAAACAATGTGGGACAAGGCCATGGGCAACAAGGCCTACATCCC
TGTGAAGAAATGAAGCTTTCTCATAATGCCAAGGGGACGATTGATTGCGTGACATGTTGGATATGTCTACCTACCTAAT
TACAGCGCTTTGTCAGCCTGTGTGATAGATACCCCTGACTTTCTTCCTTTGAGCTCTCCAAGTAAGAGCGTTTTTTTTT
CTTTCTCTAATTTAGTTTTCCGATGGAATACTTTTCAATGATACCAAGACAGTTCTCGTCTATTGCATTCCATAGAATA
AAGACCTAAATTTACATTTGCCTCTTTGTTAAAAAAAAAAA > SEQ ID NO:7429 216345FL Trichoderma harzianum
ACGGGACGAGCGATCGATCAAGTCAGAGACAACAAATACCGAGTGGCGATGCCTTCATCCGATAGTCTTGGGAGGCGGG
CCTCACACGGCGCTGCCAGCCTGGCGACGTCGGCATCTTCTATACACGGCGCAGCAGTTGGGTTTCGAGAAGGCCTGGG
```

FIG. 1 continued

```
CTTGGCTGGAGTTGCGAGGAGGACGTTGGGAATCTGCTTTCTGCTATTGACGGTGTTTCTATGGACGCTGTCCAACTTT
CTCGCCAGCTTTATCTTTTCCGATGCAACCTACGATAAGCCCTTCTTCCTCGTCTACTTCAACACCTCCATGTTCGCCA
TCTCTTTAATACCCATGTTTGTACGATATCTGCTCCAGAAAGGATTCCATGGCCTACGAAGCGACGTCAGGCGCATGTG
GGCGGAGCATCGATACCAAGCCGCCCCAGGCAGTCCCGCGATAGATGAAGAAGATCACCTAGCTCAAGAACGCTTGCTA
GTAGACGAACGAGACCCCATGGCACCAACCTCGACTCCTTCAAAAGAGAAGCTCAGCTTCCGAGAAACCGCAGTACTGA
GCCTTGAGTTCTGCATGTTGTGGTTCCTCGCAAACTATTTTGCGTCTGCATGTCTCGAGTATACCAGCGTCGCCAGCGT
CACGATTCTCACGTCCACGAGCAGCGTCTGGACACTAGTGTTTGGCTCCATGTTCGGCGTCGAGACCTTTCCCTGCGT
AAGCTGGTTGGAGTTGTGGCGTCTCTTACCGGCATCATACTCATCTCCATGGTGGACCTCTCAGGCAAGAGTGACGAGA
ACAGAGGATCGTTCCCGCACAAGACTCCCGGGCAGATCGCGCTCGGAGATGCCATGGCGTTTTTGAGCGCTGTGGTTTA
CGGCATATATGTCACTGTTATGAAGCGACGAGTGGGTGATGAGGACAAGGTCAACATGCAGCTATTCTTTGGGTTGGTA
GGAGTGTTTAATCTGGCCCTACTATGGCCGCTCTTCTTCATCCTCCACTGGACGGGTCTCGAACCGTTCGAGCTACCCC
CTACGAGCCAGATTTGGACCATCATTATAGTAAACGCAATTGCGTCCTTTGTCAGTGATATATCCTGGGCACTGGCCAT
GCTCCTGACGACGCCGTTGGTCGTCACCGTGGGCCTGTCTCTGACCATCCCGCTCTCCCTCATTGGCGAGATGATCCAG
TACCAGCAGTACTCCAGCGGCGTTTACTGGGTCGGCGCGGCCGTTGTCTTTGTCTCATTTGTTTTTGTTAATCACGAGA
CAAAGGAGGAGGACACGAGCAAGGCGGTAAACGTCACAGCAGGTCTCAGTTCGGCTTCCGACCCTGATGGTGCCGACGG
AGGTGCGGGCTATGGACGATTGTAATGAATTGCATGTAGATTTGGAGGGTTTTTCATCACCTTTTTGCGCTTCTTCAAC
AGGCGCGTCGTAACATCTCTCTTATTAGAATGAATTCCAATAGATGTTTCGTAAAAAAAAAAAAAA

> SEQ ID NO:7430 216004FL Trichoderma harzianum
ACAGAAGCAGTTAACTACTTATACAGCTACTATATAAGCTTTCCAACCAACCCCTCACCTGTCGCCTCAACCTCATACG
ACTCATCATCCTATTCCTCCTTCAACAATTTCAATTCATTTCACAACTCTCAGTCAAGATGCAACTCTTCGCCGTCTTT
GCCGCTGCCACTACACTTATTGCCGGCTCCAACGCCCTCTTCATCCCCCGCAACATCCACGTCGCAGACTTCCGCCTCT
ACAGCGCCGAGGGCTGCCACGACGGCAACCTCGGCGTCTGGACCGTCATTGATGACGACTTCAAGAATGGCGAATGCAA
GGGCCTCAACGATAGTGAGCCCAAGTCTCTGAGCCTGACAGACATTAACAAGGGCTGCACATTCACGGCTTACACCGAC
GACAAGTGCACCAAGGGCAAGAAGGATTTCACAAAGGGACATTGCTTCGACAACAAGGCCGGCTGGAAAGCCTGGAGCA
TGAAGTGCGACTACAAGGACTAAAAGGGTCCTCCCTACCTTCTTTTTTTTCCTCACCGCCAACTTTGCCAGCACCATTTA
TTTTCATCACTTTTTTTTCCATTCCTTACATCATGGTGGAGTTTCACGTTTTTTTGAATCAGGATTACACTGGACTGAT
TTGTGGGAACCGGGACATGAACACAACAAGCATATTGATTGACACGGAACGCATTATGGGGTTATCGGGCTGGCCATTT
TCCAGGATCACGGCTTTTGGGTAATAATGGGTAACGGTTGTTATGACACGGTCCTTTTATGATGATGCATGCATGTACA
CATACATTATACAATATTGATGGCCAATCCATCAATAATAATTAGTTAATGAGATAATAACAGCGCCAGCGAGGCAAAA
TAACCATTGATAAAAAAAAAAAAAAAA > SEQ ID NO:7431 216450FL Trichoderma harzianum
GGCCAAATGAGATTCTTTTCTATTTCGAGCCCCAAGCAGAGCTCATTCGTTAGCATCTTGCTACCTACACCCTGCATGC
GCATACGCGATGAATGGGCACCCGGTCTGTCTGCACTCTCGTACCCTCTGCTCAAACAAGCGAGAAACAGACGCCTCTG
TCGTCTCACTCGCTGCGCCAGCGCCTTGGCCTGGGTAAAGCGGCTGGGTAATGCAATCCGGCGCAACGGCCTTTGCCAT
GTCTGGAACGCAATGCTACGCAAGTAACAGTAATGCCTGCGTTTGGTGCAGGTCGTCGCTCGCCACCGCTGGCTGGCTG
ACAGCCGGCAGTGCCGCAGACACGTATAATGATCCCACTCCAATACGTACAGAGACAACTGGCACACACCCCAGGCCT
GAACGAGAGACTTGGATCTGGGAGCGAGCAAATTGATCTGATGCTGGCTAGCACGTACTACCCGACTTGACTTGCTACC
ATGTTGATACTGTATGCCTCGCCTCGCCTTGCACGAACCATCTCATCGCAAGTCTGATCCGACGTGGAGCTAAGCCTAC
CATGGCAACCGCGGCCACACATACAACACGTTAGGCTTGTGACGATGCAAGGGAGATGGCTCTGCCACGGTTGGCCATG
TATCAACGTTAGCACGTTCTGTGAGTGACGAGCATCTCCCTTGCCCGAGACACCTGGTTCGACACTGCCGTGAGGTACG
CAGTCTGTTCCAGATTGATCTCCCGCGGCTACATAATCCCTAGCGAAGGTGGCCCCCCCCCACCACTTGGCGCTGCTGC
TCACTGCCAATCCAATAAGGCAGCTCTCACGCTGAGGCATCTTGCACACACAAAAACCGGATGAATCATCTGACCAGTG
CCACCGGAATGGGGGAGATGCAACAGTCGTGCGGCCAGAAAATAAGGGCCCCAAAGCAGACTCTTTTGTTGTTTGGA
GGCTGGCTGGCCTGAGACGATCTGGCAGACCAACAACGAGACAAGGGCTTGCCGGCGGTTAGACCCCAGTGATGAGAT
TCGCAAACAGGCGCGCCCGCTGGGAGACGGCCCCCAGCTGATTGATTGATACCTGGTAGTACATGGGCAGTTGGAGTAC
TCGTATGGACAAAGTACCGTACCGGTACTCGGGGCTTGTAAGACGGCTCTCTGGAGGGGAATACGAGCTGGCAAAACAT
TAAAAGGCAAGGCTCAGGGCGGGCTGTAAGCCGCAGCGCAGTGGCTCTTTTTAAGTTGTCGGGGAGATAGATGGCCACA
GCCGTTCTGGGGACCACGACGGCAAAGGAATTGAGAGAAAATAGTCTAAAAAAAAAAAAAAAAAAAA
```

FIG. 1 continued

> SEQ ID NO:7432 216005FL *Trichoderma harzianum*
ACTCACAATATTGGTTTAGCATTTCAAAACCGGCATCATGGCGGACGCAGATTTCAATCCTGACTCTGTCAACCTCACA
GCTATTGTTGATCAAGATGGAGACATCAGAGACATCATCTGCTTTCTCAATGCTGGCGACAACGACTACAATGGACAGC
TTGGTGCACGTGTTTCGGCTCTATTCGTCATCCTTGTCATTTCATCGGCAGCCACCCTGTTCCCCGTCCTGGCCACTCG
TGTCCGGCGTCTACGAATCCCGCTCTATGTCTATCTCTTTGCCCGATACTTTGGCTCCGGAGTCATCATTGCTACTGCC
TTCATCCATCTCCTCGACCCTGCCTATGAGGAGATTGGACCGGCTAGCTGCGTCGGCTTGACTAGTGGCTGGGCTGAAT
ACACATGGCCCCCTGCACTGGCTCTGACTTCGGCCATGCTCATCTTCCTGCTGGATTTCTTGGCCGAGTACTACGTCGA
GAGGAAGTACAAGCTGGCACATGTCGAAGTCGAAGGCACAATTACATCGGATCCTACTGTCCCTCATACTCATCAAGGA
CTTCACTCGGCTGACCAGGATGGTGCAATTCCCCCTTTCAACCAGAAGCCTGAAGAGCACAGCCACGCTTCTAGCGATA
AGCTCGCTTCAAGCGATAATCTCGATGTGGAAGAGCTCAAGCACCTCGATGGCGAGTCCAAGGAATCTGCCATGGGCTT
CGAGTCTCAGATCGCTGCATTCTTGATTCTCGAATTCGGTGCTCATCTTCCACAGTGTCATCATCGGCCTCAACCTCGGC
GTCGTCGGTGAAGAATTCAAGACCCTGTACCCTGTCATCGTCTTCCACCAAGCCTTCGAGGGCCTGGGTATTGGCGCTC
GCCTGAGTGTCATTCCCTTCCCCAAGCGCTTCAGATGGATGCCCTGGGCTCTCTGCCTGGCCTACGGCTTGACAACCCC
CATCGCTATTGCCATTGGCCTCGGTGTGCGAACTACCTACAACAGTGGTTCCTTCACTGCCAATGTCGTGTCTGGTGTC
CTCGACGCTATTTCTGCCGGTATCCTCATCTACACCGGTTTCGTCGAGATGATTGCGCGCGACTTCCTCTTCAACCCTC
ACCGCACACAGGATAAGAAGCGACTGACATTTATGCTGGTCTCTCTCTACCTCGGAATCATCATCATGGCCCTGCTGGG
TAAGTGGGCCTAAGGACGACATGTAGGGGAACGTGTAGGATACGGGTTTGAGATATATAAAAAAAGGGAACAAGGAAAC
GGAAAAGATACCCGGGCGGACCATTAGAATGCGCACATGCGCATAATCATGCAGAATCTGTGAGATACACATCTACATA
GGAATGCATTCTTAGAATGCAACAGGACATTACGAACTTTAAAAAAAAAAAA > SEQ ID NO:7433 216304FL *Trichoderma harzianum*
CCCACGCGTCCGAAAGGAGAGCAAGACAAAACAAAGTAAATCAAATCTGTCGTGGTTACATTGCATGGTTTACTTTGTA
CGCACTGTCGGATCGGCTGGATGCTTGGCAGCTTTTGCGGCGCGGCGTCATCAATGAAATATTCATCTCTCAATCCAGG
CACGCGAGCTCTTTTCGAGATTTCCCTGGAAAAGCCACACAAAGAAAGGCAATCTAGGTGTTGACTAAGCTTCTAGATA
AGAGCTTCACTTCATCTTCTACGTCTTACACAATATCGCATCCCACCTCTTCTATCACCATGCCGATGCATAAGGGCTT
CCTGCCGCGTGAAGGTCTGTGTGCCGACGTGATTCTCAAGCTCATTCGCAGAACACTTCTGAACCCGAACCTCCTGCTG
CCTTTGCTTCTGCTTGCCCGCTACACCAAGAAGGGCCGGGACCTCTCGATCCTGCATCCCAAGGCAGCACGGAGGCTTA
GGCTGCTCTTCTACGTTGCCGTGGCTCGTGGCTTCAGCGGTTGGCTCTCAGACAAAGTCCGCAACAACTGGGTCAGCGA
CAGGTATGAGTGGTCCAAGGAGATTGTGCTCATCACGGGCGGCGCGTCAGGGATCGGCGCCTCGATAGTGAAGCTGCTG
GACGAGCTCAAGGTCAGGGTGGTGGTGCTGGATGTCCAGCGAATGACATATACGGCCTCCTCCAGAGTCCACCACTTCT
ACTGCGACATTAGGTCGCCAGCAAACGTGGCCGCCGTCGCCGAAAAGGTAATCGGCCAAATCGGGCATCCCACGGTTGT
AATCAACAACGCCGGCGTCGTCCGCGGAAAGACCATTCTAGATGCCACGCCCGAGGATGTGAGGTTCACGTTTGACGTC
AACGCCTTGGCCCCTTTCTGGGTGACCAAGGCCTTCCTGCCGCACATGGTAGCTCAGAACCACGGCATGGTTGTGACGG
TGACATCCTTTGCCTCATGGGTCACGGTCCCCAACTTGGTAGACTACGCCGCGTCCAAGGCTGCAGCCATGTCGTTCCA
TGAAGGGCTTTCAGCTGAGCTCAAGACGCGATACAACGCCCCAAAGTCCGCACCGTGGTGGTCCATCCTGGAGCTTCC
AAGACGGCGCTGTTCACCGGTTTCAACCAGGGTGCGCCCTTCCTGCTGCCGTCACAGGAGCCCGACTCCATTGCCGAGG
CAGTCGTGAAGCAAATCCTCAGCGGGCGGAGCGGTCAGGTCATCATGCCAGAAGCTGGAGGGATGCTCCCCGCCTTACG
AGTGTACCCGGATTGGCATTCGTTCCGGGTTCGAAGCAGAGGCCAGAGATCCATGCTGAACTATAACGGACGACAGGTC
ATTGAGGATCCAGCCGCACCCTTTGAGGCCAACGACAGCACAGTGCTCGTCCCCACGGCATGAATGAGGAAGCCGGCTG
ATGCAAATATGGCCGAAACACGGTGTTGATGGCCTAGGAGGGCGATTCAAACCCCTTTCGGCCAGGTCTTACTTGA
GAATGCCGGAAAGCTAGGTTTATACACCTGAAACTCGTCCCACAATGGCCAGAGGTGAACGACTAGCGGCCCAGCAGT
GTTACTCTGTAATATGCAAAGGATTTATTATCCATTATTATTCTGGGGATTTGCCAGCTAGCACTCCAAGTTGGTTATC
TTGCATCCTAGTGACTGGATGTTCAAGTATATGCAGCTATCGTTACTTTTTTCTTAATATGTTACCCTGCTGCGTTTTT
CTTAGTACATACTACTATTGCTACTTTCTCCTATTTCTATTATATGCCATCTGCAAAAAAAAAA > SEQ ID NO:7434 216358FL *Trichoderma harzianum*
CCCACGCGTCCGGGCCAACATTGCGACGCAACCACAAAGGGGAGGCTTTGACACTCAACTTTCTTTGAGCTCCACCCGG
CACTAGGCGGAAGAGGCGCGTCTAACTGAAAAAGAAAAAAGCTTTTTTTCTCCGAGCAGGTTCCCTCTCGCTTTCTCT
CTCTCGCGCGGACAACGGAACGAATCGAAACAGCCTCGTCTTTGTCCAAGCTCCAAGCTCCAAGCTCCAAAGCTCAGCC
TCGCATCCGCCCGCCATGGACGCCGTCCGGTCTCTCGTCCAGCCCATCACACACAACCTGCCGGCCCCATCCGGGACC
TAGGCGTGTCGATCGTGGGCGAAACCTGCTACAAGGCGCTGCTACTCGACGTCGACGTCGAAAACACGGAATGCATCAA
GCTGGCCATCAGCAAGGGCCTGGGCATCGGCATCGTCGGCGCATCGGCCGTCGTCAAGGTGCCCCAGATCCTCAAGCTG
CTGCGGTCCAAGTCCGCCGAGGGCGTGTCCTTTTTGTCGTACCTGCTGGAGACGAGCGCGTACCTCATCTCGCTGGCCT
ACAACGTGCGCAACGGCTTCCCCCTTTAGCACCTTTGGCGAGACCGCCTTTATCATGGGCCAGAACGTCGTCATCGCCAT

FIG. 1 continued

```
GCTCGTCCTCAACTACAGCGGCCGGCCCGCCACGGCTGCGCTGTTTGTCGCCGCGCTGGCTGTCAGTGCGGCGGCGCTG
TTTGCGGACAACATTGTGGATATGCAGGCTTTGAGTTACCTGCAGGCTGGTGCTGGTGTCCTCGGCGTTGCCAGCAAGG
TTCCTCAGATCCTGGCCATCTGGCAAGAGGGAGGCACTGGCCAGCTCAGCGCCTTTGCGGTCTTCAACTACTTGGCCGG
CTCGCTGACTCGCATCTTTACCACGCTCCAGGAGGTCGACGACAAGCTTATACTGTACGGCTTCATCTCTGGCTTTGCC
CTCAACGCCATCCTCGCTCTGCAGATGGTGTACTACTGGAACGCTCCGTCGGCCAAGGCCAGGGGCAAGCAGAAGGAGG
TGATTTCTATCGGAGCTCTGTCCGAGGGAAGTTCATCAGCCGTTCCAAAGAAGGGTCCCACTACCCGCCGCCGTGGCTA
GACGGGTCTCTCTGGAGGTTCTTTTTTCTTCTTGGTCTTTATCTGGATGCTGGTGTACAGGTCGGAATCAGGGAATATG
CTAATGGGAATGAAGTGGAAGTGCCCAACTTGCCCGTGGCGTGTTCGTCATTTGGTATACTTGGGCTTACTATGTATTT
AATAAGGGATATAGCCATTCATCAGCATTACTATTCTACTTACAAAAAAAAAAAAAAA

> SEQ ID NO:7435 216150FL Trichoderma harzianum
CCCAGCAGGGTGGTGGCTTCAGCAACTACAGCGGAGGGTCTCAGGGAGGCTCTGGCTATGGCGGCGGCGGCGGCTACGG
AGGCGGTTACGGCAACGGTGGCAGCTACGGCAACCCCGGCGGTGCTGGAGCCCAGTCCTCGTGGTGGTAAATACTCACG
CTCTCTCGTGATGGGCATATCACTGTGTCTATCATTGTGGCTCAAGTTTCAGCCACTACTCTTTTTTTTTTTCTCGTCT
TCACTTTTCCCTTATCGTCATTTATTCTATTTGCGCATCAATTTTGCTTTGATAAAATCGGTTATTTCACATTTACGCA
TCATGTCATTTGTTTTCGACGACACGGCGGCATCATGACCTGCGAAGGCGGAAGAGTGCCTTTTTTTATTTGCTGCAA
AGGGCAGTAACGGTCAGGGGCATTTCACGACGCATGTGATAGATTGCATTTCTTTTGATTTCAGCATCCTCCCTCGCTT
GATACCCTTAGACCGAGAATAGAGGAACTTAACGACGCTGGCAGACGTGGTGTTGAGAGATCTACGGTTGTTAGAT
CTGGACTAGGACATCACGGTTTTTTTCATGTTTCTGCTGTCTACGAGGGTTTCCTCCCCCCGCAGGGCATTTTCTCGCT
TTTCATGATAGAGGGTCATGCTATCGCCGTGGCATACATAGACCAAAGTGGATTTACTCGGTTCTCTGGTCGGAATTAC
TCGACGGTCTCCCACGGATTGGGACGGAAGAGAGAGCTATATGAGCATAGACTGGGAATACAGATGGCCTATGGGTCGG
TTTCTCTATTTCATTCGAGAGCAAGAACTGGGCCTCTCGACACTAGTTATGGATTTTGGTTGGGAGGGCATGGATCAAA
GGCTCTCGGCTCTTTGACCGTCATTAGCACAATGGAACGCTTCGACTCGGCCGATAGGGGTGCCGAGTACGCAGCCTTG
AAGGAACAGGGTCTTTGGGGAGTTTTTGGTTCCCGTGATAGACAGACACCAGAGTGGACTGAGGAGTCCCAAGTAAAAA
AATAAAAGGTTTTGCGATATAAAAAAAAAA > SEQ ID NO:7436 216053FL Trichoderma harzianum
GGCATGATGATTGTTGAACAGGTACGGAGGTTGGGAGACAGGAGACTAACACACCTTATTGTGCAAACTGTACAGCACA
GCAGAAAGTGGTTACATCGCCAGAATAAGCTTGTGATTATGGCCTCACCTTTTCCACAGCCCGCAGGTGACAGGCCACA
TGCAATCTTGGCATACTGTTCCTCTCTCTACAACAGCTGAACTCAGCCCAGTCGCCAAGGTTTCCTTCACGCTGGCT
TTCACTCTTATCATGGAGCATTGACGAGAGCCGGCACCAACGAGCATACCAAGGTGAAAAAAAGTTCTCCACAACACTC
CGTCCAATGTCCACCTTACATCCTACAGTACGCAAGGGCCCCGTAAGGCTATTCAGCTTCAAGCACAATCAAGCCATCC
AGGCAAGCCGACAAAAGCCGTCGGCCGAATCTCTCCTCGTATCGTCCTAAAAAGGGCGCGCGTGAGCCGCTTTGACCAC
AAGCCTTCACGTATCAAACTTGCGCATGGTGACGAGGGAGAAGAAAAAAAAAACGGTCCTCAGCCACTGAGATCCCGTT
TGCCACCATCATGGTCCACTTGGGTTTGTTCTTTAGTTGGGGAAAGATTCCAGAAGCTGGCACTAGCCTGTGGTTCGAC
CGCCTCCAAAGCCCCTCATTCCCCCAGGTTTCCCCAAGTCCATCATCTCCAAACATATCTGGGCCAGAAGACGGGGCAA
GCGAGAGCTGGGGTATGTTGAAATCAGCCCATGAGAGATTGAGCTGAAAGCATGTGGTCATATGGTTCCCTTTACGCGA
GGAACTAGAAGATCACAAATGCCCTCACGTCTCGAGTGCGGGCCTTTACGATCTAACAGTGTCTAGATGTTCATAGTGTT
CATAGTCCAGCTTATGCTCTCGGCCAGTACCTTAGCGAGTCACGCAATCCGGACGGCGAAAAAAAAAAAAAA > SEQ ID NO:7437 216009FL Trichoderma harzianum
GCACTCACCCCTCCAACCCCTCCAAAGATCTCACCACCGGCCGAACCCTCCTCGATCTCTGCGCCGAGAATCAGCTCCT
CCTCTCCGAATCCGTCGCTTCCAAATATGGCTCCAAGCTGCCCTTCCTCTTCAAGGTCCTGTCCATCAACAAGGCCCTC
TCCATCCAGGCCCATCCCAACAAGAAGCTCGCCGAGCAGCTCCACGCGCGGGACTCCAAAAACTACCCCGATGACAACC
ACAAGCCCGAGATGGCCATTGCAATCACCCCCTTTGAGGGACTCTGCGGATTCAGGCCTCTGGGAGAGATTGCCCACTT
CCTGGAGACGGTAAAGCCATTGAGAACTCTGGTCGGAGAGAGCCAGGCGTCGCAGTTTGTGCAGGCTGCCAAGCAAGAG
GGCGGTGACGAGGCGGCAAAGAAGAAGGCCCTGCAGACGGCATTCGGAGGATTGATGTCGTCCTCTGCCGAAGACGTTG
ACAGAGAAACTGCTAGCCTCGTTGCACTCGCCGAGTCTGAGGGCGCCGACTTCGCTGCCGGTGGTGTGTCATCCACCAA
GGGCGCTGTCCTCGCCGAGCTTGTCACTCGACTCAACGCCCAGTTTGGCTCCGACATTGGCATTTTCGTCCTCTTCTTC
CTCAACTTTGTCACACTACAGCCCGGAGAGGCGCTGTTCCTCGTCGCCGATGACATCCACGCCTATGTCTCCGGTGACA
TTGTCGAATGCATGGCAGCGTCCGACAATGTCGTCCGTGCTGGTCTTACACCCAAGTTCAAGGACGTATCCACCCTGGT
TGACATGCTCACCTACAACTATGCGCCCATCGACGAGCAAAAGATGACTCCTACCGAATATCCCTATGCGACTCTGAAC
CGAAATGCCTACAGCTCCGGATCTTCTGTCATGCTGTACGATCCTCCGATTGAGGAGTTTAGCGTTGTGCGCACTCTGC
TTCGCGGAGAGGGGGCCAAGGCCACTTTCGACCCCTTGGAGGGACCCAGCATCGTCATCTGCACCGGTGGCAAGGGTAC
```

FIG. 1 continued

AATCGCCGTGGGACCGACAAAACAGGAGATTCAGGAGGGTTACGTGTTTTTCGTCGGATCTACCGCGGAATTGGTCCTG
GAATCCGCCGTCGGAAAGGACGAGGAGTTTACCACGTTCAAGGCATTCTGTGAGATTGATACATCTGGAAAATAGAGGC
TGCAATCATCTTCTTCAAATCCTTTTCCACATTATCGAAAGATGAACGAATTCATGAGCAATTGGAAATTTTGGTAGGG
CATATAATACAAAACAAGCTAGAACTGAAAAAAAAAAAAAAAAAAAAAAAAAAA

> SEQ ID NO:7438 109369FL Nicotiana benthamiana
GGAATTCTCAAGATTACAATATAACAAATATTCTCCAAAAAGAATCTCTATTTCTGCAGAAAGGGGAAAAATAAAAAAT
AAAAAACCTTTTAAGCTTTTGTTCTATCATTTTTTCTTCTTCTTATATAAATTGGCCCCTAATAATCTTTGCTAAAATG
TAAATACTAAAAGGGGGCATATGGAATTTTTTTTTTCCACCTAAAAATTCCAAATGGAATCATGATTCTGTTGCATTTC
ATCCCACTCCCCAACCTCAGCAATGTCTTCACACAATACCATAGGATCGGTAAAAGAATACGAGGGACAAGTGTATTCT
CTAACTGGATCTCGTAATAACAATGCCCCAGCTAGCTCCATCCACATTTTAGGTGAGTCCAATGGCGACTCATTAATCG
CCTGAATTTGACTCGACGATAGACCTACCCTCACCGGAACCACCGTGCCACCACCGCCACAGCCACCCCCCTCGGGTGG
CTCTGGAGTTTGTCTTTTGAACCTCATTGCTGCTTCATGAGCTGACATTTGCACATCTTCAGGCTTAGAACTTGAGGGT
TTTGGAAAACTATGGATTAATTCGGGGAAATTGAGTCTTGCTCTCTCGCCTTTTAGATGAAATGCAGCAACATCATAGG
CTGCAGCAGCCATCTCCGGTGTCTCATAACTCCCTAGCCATATTCGTGTTTTCTTCCCCGGTTCGCGTATCTCCGACAC
CCATTTCCCCCATTTTCTCTTCCTTACTCCTCTATACATATGAATATTGCTTTTTTCTTGAGGATCTTCCATTAGCAAG
TTTTTTTCTTTCTTGGTTGTGTTAGTTTTTTTAAGATGTCCGGACGCGTGGGTCGAGGGG > SEQ ID NO:7439 120557FL Nicotiana benthamiana
TTTTTTTTTTTTTTTTGAAGAATAGTGCAAATATTCATTAACAAGTGAAGTTAACAGTCGTACATCTTTTGGAAATCTG
TCAAAACTTAGTAGCGTAAGATTTTGTTTTTCCTCATCATGCAACAAACTATCTTATCTTCTTGCTTCAACCACGTCAT
TGCCCAAATTTTCCTCCAAGCTTTACACATGAAAATCATCAGCTATTCAAGTCTTTACAGTATTTCTACCCTAGACAAG
TGCCTTCTCAATATTCACGCGCACTCCTAAATAGAGGTACCTACCATATCATCTCAATGTGGAAATATGTCCACAGTAT
GGTTAATGAACAATATGGTTAGAAGATGAAATCCACACCACCGCTTCTAGGTTAGATTAAATAGTCTACTATCTCCGTA
GGGATGACATCCCTTTAGATTGATGATGTGGTCGCTTTCCATTCATCCCACTGTCGCTCATACTCCCTTCAACGAGATC
ATCATGTACTTCAGAGAACTCATTTGTCCATGAGTTAAGTGGAACAAGATAACTGTCATCCTTCGAGTTCCTCCTCCTC
TCTTCATACCGTTTTACATTTTCTGATATCTGATGGAAAGTCCTATTTAGTTTGCAATTCCCTTCAACTGGTTCCGC
AACATGAGATACTGTGAACCTCATATCATCAATTATTATTTCACCACTTCCAACAACTACATCACGAACACTCTGGTGG
AATTTTAAACGCTTCTCTCTCTCTTCAGGCCGAGAAATGCGTATACGGGTAGACCTTTCACAATCCTGAACTTCCTCTG
GGTCTGGTGGGGTGTTCAGAGCTGCATAATCTGACAGCACAGCAACATTCCTGACACATCTTTCTCCGCGCTTGTAAGG
CACTGCTGGGAAAACATAAAGATGCACCACAGCAGCAATACCCATCTCAAGACAGATGATATAGTCCTGGATTCGTGTC
TTCAATAGTTGTGCCAAAGAACCTTTGAATGCTCCAAATGACAAAAGAAAGGCAACAGCTATACCTTGCCACCACGTCA
AGAATACAATCGACTTGAATACAAGAAACTTCGCCAATGGCTTAATCGGTGCTAATTTATTCTTGGTGACTGAATAAAA
CTGCACAAGGCAATATAGAGCCCAGGTCTGGCTAAAATTAAGAACAACTGCCAAATAAGGATAGGCATATCTCCACTCA
AATTTGCCTTCACCATAGATGCCAAAAATTTGAAAAACCATAGCCAGTAAAGCACATATCATCTTAAGTATCATATATT
GCACTATCCCAATTTTTACTGCTTGATAAAAGTCAGGGCCAAGATGCCACTCCCTGATCATGCAATTCAATGGAAAAAG
GATGTTCAACAACTCCATATGCATAGGCATCATCCAATAGAGGCAAGCTGGAACTTACAACACTTTGACTTTCCATAAA
TTCGATTGTGTTTTTCTCTCCACCTAAGCAGGCTATCAGATACCTCTCGAAGCAATATAATGCAAAAGCCTCGTAACAA
TCACGTATGATCTCACAGTTGAATGCGGCATTTGAGTCCAGTAAGGATAAGAACGATTCCAGTGCATAAACAGGAACCA
TCAAGATTAGTCCAATCAAAAACTTCTGCTCCTCAGGCTGATGGTATGCAGCTAGATGCTCGACGATTAGATACATAGA
CAGGACTACAGCCACCAGTACAGAAAAACCAGCACTGTACAAAGCCCAGCTATAAAGTGGAGATGATCCTGAGACTACG
TTTAGCGACCACATTTTTTCAGCATTTCTTGATGATTCGACCAAAGTGATGGAGAATAGTAACGGAACCAAAATTCCCC
CCCATCCCATTCCACTTTTTAAAACACTGCTTCTCAGGATCTCCAGGAAATATGGCCTACAATCAGGATGATTCAAAAC
TCAACAAGAAGCTTCCATGTCACCTCAGATAGAATTAATCACTTTAGCTTCTTTTCTGGAAGAACTTTCCAATACTTTA
ATAAAGCAGGTTGCCTGAGTCTCTTGACAAGTTATCTCCACCAGAACCATGAATTAGAAGCCTGGCATCAGAAGGATCC
TGCATAATACTTCATACCCATAAAAACACTGATGCTGAATGGGGACGATCAAATTCTCAATGTTCCGGACGCGTGGGTC
GAGGGG > SEQ ID NO:7440 133405FL Nicotiana benthamiana
TTTTTTTTTTTTCTTTTTAGAAGATCTAATTGCTCACACCAACTGATCATACACAGAATGATATCTCACCTTTTGACA
TAAACTTTTCCTCTTTTTTCTTCCCAAGCAACTAAATTTTAGTATTAATAATAGAACAAAGTTGCATGCTTCAACAGTA
CATCCCCTAAACTAAACCATTGTTTCTTGAAGTTTAGCCAAGTGCTTCCTTCCTTTAAGATGCGCAGCCATATCAATCT
CGCTAAGGCACTTAACGTTACAAAAGCGACACCACAGCTTAGAACTATGAGTAACACCAACAGCATTCTTCACTTCATG
TTGTCGAGTAGCTCCTAGTTTGACCTTTTCGTTTGGCTTTTCATTAGTACTGCGCATTGTTTGTGCTGAGCGTGCATGT

FIG. 1 continued

```
TTTACTTGCTCCTGCTTGTCTGGCTTACTTGAAATAAAAGGTGTATTTCTTTCAGTTTTCGCCTTTTTCTTGCAAGTTT
TCAGCTCTTCACACTTTTCCCTATGTTTCCTTCCTAGAAGATGGCACTTCAAGTCATGCTCTGAGGTGGTTGTCACTTG
ACATACTGCACAAGTCCACTCTTTCTGAACGCTCTTTAAAGAATTAGTCTCCCGGTGTTTAATCTCTTTGGGATTATCT
GTTGGAAGCGTTGTTTCCTTGATCGGCACACTTGTTGTTTCTTCCCAGCCTGAACTAGATTTTCCTTCTCACTTTTAA
CCTGTTTGGGCTCAGCTAATTCATTAGTACTGTGCTCTGATTGTGCTGCAGCAGGATGTTTTACTTGCGCCTGTTTAAG
CTGATTTGACTTTGTTGTAACAGATGAGATTCCTTCACTTTTGGCCACTTGCTTGCAAGTTTTCAGCTCTTCACACTTT
GCCGTATGTTTACGGCCGTTAAGATGGGATTTCAAGTTTTGCTCTGATGTAGTTGTCACTTGGCATACTGCACAAGTCC
ACTCTGTCTGAACTTGCTTTACAGAAGTAATCTCTGGAAGTTTAATCTCCTCAGCATATGCTGGAACTACCATTTCCTC
GACCTGCATTCCTATCGTTTTCTTCTCAATCTGAATTTGATTTTCCTTCACACTTTCGACCTGTTTGGGCTCAGCTACT
TCATGTTTTGCCATGAGCTCCATCACTTTGATATCTTCCCAAACAGGACCACTCCCTTCACATGCTGTCTGATTAGTGC
GCCACTTGTTTGAAATAAGTTTCACCAGAGCATCAGATCCATTTCTTCAAGATACCTTTTCCCCCACAGACAGAAATGT
TTCATTCTTGAGAGATGGATCCTCCATTGGCTTGTTAAACCAGTCAATAAAAGTTTGAAGATTGACAAACGAGCACAAA
TATGCAAAGTATTGGTAAACATAACAAGAACCATAAAACTGAGCAATAACATTGTGCAGTTTCAAAGGCAAACATGGAT
GAACAAGATGTTGATATGAATAACATGCGCCGTTAAACTCAGGTATTACCAACCAACATATAGTAATTAATTTTATATA
AGGCCACAGAGGAACCCATTCAATAAGGTTCTCAAATACGTGCTCGAACAGAGAAATAAAGGAAAAGATGGTCCAATAT
GTTACTAGCTTCCTCATGTGATACTTGGAGCCAGTCTCAATCGCTCGGATTGAAGCACATATAGGATAGCCCAGAGCAA
GTACCGGCCAAGCGAGGAAATCGATCAACTGAAGCGTAAAACTGAGAAAACCCATTTGAGAAAATCTTTTTTTTTTCTT
TCCTTTTGTAGCAATTTCCTCAGCTTGAATTCAGTCAAGTTCTTCGGACGCGTGGGTCGAGGGG

> SEQ ID NO:7441 130646FL Poppy
GTTCTTGTCATTAATTAAGTCGACGAATTCAGGAGAAAAACCAGAAACTGGTTTCATCATAGTGATGGCAAACATGATC
ATGGCTTCCTCATCTAAAACCCTAATCACATCTCCTTCAATCCAATCAACACCAAAATTCCAACTTCCCCAATTCACAA
CCCTAAGAATCAGAAGCCAAGCCAATCAAACCAGCACCAGCAGCAACAAAATCAAACTCCCAACTCTAAACCTAAACTC
ACTCAAATCAACAGCAGCAATTGCAGCAGCAGTTCTAACAATGGCTCCACCATCACTAGCAGCAGAAATTGAGAAAGCA
GCATTGTTTGATTTCAATCTTACTCTACCACTAATCATGGCAGAATTTCTCATACTTATGTTTGCCTTAGACAAGATTT
ACTACACTCCATTGGGTAACTTTATGGATGCAAGAGATGCAGATATTAGAGGGAAATTGAACAGTGTTAAAGATACGTC
TAGTGAAGTCAAGGAATTGGATGAACAAGCTGCTGCTATCATGAGAGCAGCTAGAGCTGAAATTGCTGCTGCTTTGAAC
CAGATGAAGAAAGAAACAACTGTGGAAGTTGAAGCACAGATGGCTGAAGGAAGGAAGAAATTGGAAGCTGAATTGGCTG
AAGCTCTTGGTAATTTGGAGAACCAGAAGGAGGAAACTATTAAAGCTCTTGATTCTCAAATTGCTGCTCTTAGTGATGA
AATCGTTAAGAAGGTTCTTCCAGTCTAAGTTCTATTCTATCTCTTACTTTTCAATTATTGATTAATGTTTGTATGTCAT
AATCAAATACAATTTAGTCTGTGTAATAATGGATTACTGCTTTTGAATTTCTTGTTTATATATCAATATAAGCTTTTTG
CTTCTTCATTTTAAAAAAAAAA > SEQ ID NO:7442 213811FL Trichoderma harzianum
AAAGCGACCACGAGCGCATGCGCAGATGACTGACTAAGCGGCCCGTTGGCGAACAAATAGTGAGGAGTTTCGCTGCGTC
ACCGCCTGCGCATCCGCATCTGCATCCGCCCGCCCTGGACAAGAACAAGCGAGTGCGACGATACAATGGACAAGGACAA
GCCGGGGGACAACAAGCCGGTGGACACCTCGGGCAAACATGGTCACGACGAAACATCGCCTATCGCAACACCGACCAAG
AAGCCTCGCACCGCCAGTCCAGCTGAGCCAGCCGCAGCGTCAACGAGGCTTGAGCCGCTCCAGGCGCCGCTCGTCACAG
ACCCGACGTTGGATGCGGGCATCGAAGCAGACGACACGGCCAGCGATGGCGGCTACGAGTCCGATTTGGCGTCGCGAGC
GTCTACGTCGGTATGCAGCGCCGTGCGCGACTACGAATTCGAGAACAACAGGCGCTACCATCGCTTTCAAGAGGGCCGG
TATCAGTTCCCCAACGACGAGCCGGAGCAGGAGAGGGAGGACATGAAGCATGCCATGGTGTTGCATCTCTGTCAAGGCA
AACTCCACTTTGCGCCGTTGGAGAACCCACAGAATGTTTTGGACATAGGGACGGGGACAGGTATCTGGGCCATCGACAT
GGGAGATGAATATCCAGGAGCCGAGATCACGGGCATCGACCTGAGTCCCATCCAGCCGCAGTGGGTACCGCCAAACGTC
CGGTTCATAGTTGACGATGCCGAAGCAGAGTGGGTAATTCCGGAAGCCTCTCTGGACTACATCCATATACGGCATATGA
CTTCTTCAATACGCGATTGGCCTCTATTGTTATCGCGCGCATACAAAGCGTTAAAACCTGGTGGATGGATCGAACTGCA
AGAACTTCAATTCCAAGTCAAGTGCGACGATGGAACGGTGCGCGAAGGCAACAAAGTCCAAGACTTCTTCGAGACGATG
AAGCGCGCACTTGGGAATTTCAACGTCGACTTGCTAGCGATGCGACACAACAAAAAGAACGTCACCGACGGAGGCTTTG
TCGATGTCGACGAAATACCCTTCAAAATACCCATTGGCACATGGCCCAAAGACATCAATATGAAGAATGCGGGCTCTA
CAACAGGAGCATGATTCACGATGCCCTCTACGGTGTTGCCGTGAGGCCTTTTACGCGTGGCCTCGGATGGACAATAGAA
GAACTGGAGCTGTATTTTAATAGACGTGCGAAGAGAGCTAACAGACAACAGTCAGCACGGCTATACACCATTTAATGTG
GTGATAGGCCGAAAACCTGGATAAAAATATCAAACATTTCGATGATAAAAAAAAAAAAA
```

FIG. 1 continued

> SEQ ID NO:7443 213377FL *Trichoderma harzianum*
AAGTCTGCCCTCCAATAAACGCTTCTTCCCCCTCGAGTCCAGACTCTCTGTTCTGCCACTGGCTCTGGCTCTGGCTCTA
AGCGATCTCCGCCCCGGTCCGTCCAAGCTTGCCCCCCGAAGATGACGGCCGATGCCATCTCCGGCTCCGGGCCCGCATC
CGGCTCTCCCCAGCCTCTCCGGCTGCTCATCCTCGAGGCCGATACGCCGCAGCCCATCACAAACGCCAAATATGGTGGT
TACCGCGGAGTCTTCACTGCTCTGTTGACGGCGGCGGCGGAAATCATGGTTCCGCCACGGCAGCTCTCCGACGTGGCCA
CAATCACGGCGCACAACATTGTGGAAGACATGCAGTCATACCCGCCGCTGGACGACGTCGACGCCGTTCTAATTACTGG
CTCGCGTCACACGGCATATGAGGATGACCCCTGGATCCTGAAGCTGGTGGAGTATGCAAGGCAGGCCATCGACACCGGT
CGCATCAAGGTCGTGGGCGTGTGCTTTGGCCACCAAATCATTGGCAGGGCCATGGGTGCGCGGCTCGGCAGGAGTGATA
AGGGCTGGGAGGTGGCCGTCACCGAGGTTGACTTGACCGACAAGGGCAAGGCCATTTTCCAGCTTGACAAGATGCGGAT
TCATCAGATGCATCGCGACGTTGTTCTAGAATTTCCCAAGGGTGCCGTTCCCCTCGGCGGAAACGACATGTGCCCAGTC
CAGGCTATGTACAGCCCTGGTCGGTACATCTCCGTCCAAGGCCACCCCGAGTTTACGGGCGACATCGTGACGGAAGTCC
TCACCAACCGACACAAGGCTGGTATCTTTAGCGACGACATGTTCGACGACGGCATGAAACGTACGCCCATCGAGCACGA
CGGTGTCGCCATCGCAAAGGCGTTTCTCAACTTCATGAGGAGCGGTTAATGTACATCGACAAGACACGATAGCTGAGGC
GGAATAGAGGCACACATATGCAAGCGCTGATTCGACTGCCTCGTGCCCATATCATCAGTAGGAGTCAAGGCTGGCACAC
TTTTTTTTATGTACAAATACTCTTTTATGCATTCCTACTTCCGATTATAGACGAATCACATTTGCCAAAGTGCGGTGAG
CTCTCACCTGCAGTGGGAGTTGGCTAAAATCCTATTCAAAAAAAAAAAAA > SEQ ID NO:7444 214388FL *Trichoderma harzianum*
AATGAACCCAAAGACCATTGAAGTGGCCTCAATATTGATCTATCAACTTTCACCTACTCTCGAACGTTTATTCTCGAGG
TAATAGCTTTTGAAGTTTTCATCATGTCCAAAAAGGTGGTCATAGTCGGCGGTGTTGGCGGAGGCATGTCCGCTGCCAC
CCGCTTGCGTCGTCTGGACGAATCAGCAACGATCACCGTGTTTGAGAAAGGAGCTTACGCTGGCTACGCGAATTGCGGT
ATACCTTATGCTCTGGGTAAGGTGATCAAAGATGACGAAGCTCTGATTTTACACACACCAAAGTATTTCAAGGAATATT
TCAACATCGATGTTTACCTCAACACCGAAGTTATTGAGATTGACCGCACGAACGAGCAAGTGTGCACACGAACCGTTGG
AGAGACTGAGATTCGGCGAGTCGGCTATGACAAGCTCATCCTTTCCCAAGGCGCAGAAGCTGTGCAGCCGCAGATTGTT
GGAGTAGATCAGAGCCATGTGATCACTCTACGGACCATCTCGGATCTACAAGCTATTCGATCTATCATGGTCGAACGAT
GCGTGAGAGATGTTTGTATCATTGGAGGCGGATTCATTAGCCTTGAAGCGGCCGAAAACTTGCGAAAGATGAAGTTTGG
AGTCTCAATTGTCGAGCAATGGACCCATGTCTTGCCGTCAATAGACGCCGATATCGCACAGTTTCTTCACACCGAACTG
AAGCACAACGGGGTGAAGTTATACCTGAATGATACTGCAAGAAGAATCGAAGACTCTCATGTCGTCTTGGCTAGTAATG
GAAGAGAGATCCCTGCCGAATTGGTCATTCTAGCTGTGGGAGTAAGGGCAAGAACATCACTGGCAAAGATGCGGGCCT
CGAAGTGGGAACACAGGGAGTCAAGGTTGAATCACACATGGAAACATCCGACGAAGACATCTACGCTGTAGGTGATATG
GTTGAGACGAAGCATGTCATTCAACAACAGCCAAGGGTAGTTGCTTTAGGGGGCCCAGCAAATCGACAGGGTCGACTCG
CCGCAGATGATATAGCCGGCAGACCAGTGCACTATCGCGGCAACATCGGCACAATCATCTGTCAGGTCTTCGATTTAAC
CGTCGGTTTAGCTGGCCTGTCCGTCTCGGCGCTGCGTGACTTGGGACAGGAGCCGCTCTGGGTTACAGTGCATCCTCCA
CACCATGCGAGGTATTATCCTAACGCTCGTCCAATCACGATCAAGACCGCGTTCGAAAAGGGCACAGGCCGTATTCTGG
GGGTGCAGGCAGTGGGAATGGCTGGCGTGGACAAACGCATAGACGTCCTGGCAACAGCGATGCAAGCTAGGATGACAGT
CAATGACCTGGAACATCTCGAACTGAGCTACGCACCACCCTATAGCTCGGCCAAAGATCCTGTGAACATGGTCGGATTT
GTTGGCTCGAACTTGCTCCGCGGGGACTATCAGATCGTACACGCCGAAGACATTAACATCAAGAATCTTCATGCCTGGC
AAGTCGTGGATGTTCGCACACCCGAGGAGTTTGCGACTGGCCACCTCCCGGGGGCAATCAACTTGCCAATTGCAACACT
GCGCAATCAGAAATTGGAGCTTGACCAATCCATGCCAATTCTTGTGTACTGTTATGTGGGCTATCGGGGATACTTGGCC
TACCGCATCCTCAGTCAGAGAGGATTCAGCGTAGTAAACCTTGATGGCGGACTGAAGACAGTAGTCGAGGGGGGAACCA
GGCTTTGGAAGAAATTTGTTCTTCAGAAAATTTGTTCTTCATAACCTAACATATTTAAGTGATATCTAAGTAATATAAT
C > SEQ ID NO:7445 214715FL *Trichoderma harzianum*
GCTTCAATCACCCTTGAATAATGAACGAGGAAAAGCTCGGCCACAGTAATCATGAGGACATTGTGCCTCCAGAATCCTC
TACTGGAGATGAATTACAGACACCATCTACGGATTCCAAGGGCAAACAGAAGGCAGGCCTGGAGTTAGCAGCATCTCAA
CTTGGGGCCTCTACAAAGCTGGTCGTCAATGCCATCACAACGTTTCGGGAAATGCCAGCTTTGGCATCAGAATCAAAGT
CCTCTCATGGTTCAAGTAGCATGGGCTCGTTTTCATCTATCGCTGGCGAGTACTCGTCATACAAACCACTCCAGAATCC
GTTGCTTGACGAGACTACTCATGAGGGCCAGGATGATTTGTTTGAGACGTTTATCAAGAGTTCAACGGATGCGTTGGTA
AATGATGGCTATCAAGTAGACGTTTCAGGATCCTCATTTGCAGATCAAGAAGCATCGGATGGCTTGCCCGTTTTGAAT
TTCTCTCACAGCCAGGAAATGAATCGATCGAGACGGCCATTTCTAGGGAAAATGATTTTCAGATCTCAGGCGAGGATGA
ATCATGGAGTGAAGCTGTGGCTGGAACACTCATCGATGAGAACGACCAACTTGATTTACTCCTGATTTTATCACTAAT
CCCGAACTGTCTTCTCAAGCAGCGCCGTACCTTGGAACAACGAACATTGAAGAAACAAGTAGTACTTGGTTTGGGTATT
GGGGTAATGTGTTTACAGCGTACAATGCCCGGATATGGGGTAATTCGCATCCAATACCCACTTCGGAAACATCGGATCA GGAACTCGAACAAGAGCAGGATAGCAGGGAGTCGACGACCATAAATCGGGCGCTCGATCGGTTGAAACTCATATTCTAT
CACTTGAGAGGATGAGAATGTAGCGCCGGAACAAGAAGTCAAGTTTTTAATGTTGTTGTAGCAGTATGTCACGATTTAT
TACGACAGAACCAGAAAAAATGTACCATATACGTCAAGGGTTAATTATAATATATATCCATATTATAATTTGTTGTCAC
ATCGAATAAAAAAAAAAAAA > SEQ ID NO:7446 215823FL Trichoderma harzianum
CAGCAATCATGAATAATGACCAATTCCGAAAGTTGATGCTGGCCAAGTCGGGCAAAGCGTCAAAAGATGGCGCTTCATC
CAAAGGCACGAGCTCCGGTGCGAACACGGGCTCCTTGGGATCTCGGCAGCGGAGCAGCATACCTATGACTCCGCGATCT
TTGGGAGGTGCCCAGGCCGATTTCGCGAGACAGCTGGCTGAGCGCAACCAAGCTCTAAACCCTCCAAAGAAGTTTAAGA
CATCTGTACCAAAGGGTGTGAAACTAGGGGAAGGATACATCGATAGATCGCAAGTTCGAGAGAGCGAAGAGGACGACCG
AGAAGAGAGACTAAAGGCGTTGGAAAAAGCTTTCAAAGACGAAGAAATTGACGAGGCAACATACGAAAAGCTACGGTTT
CAGATTGCAGGCGGAGATCTGGCAAGCACTCATCTAGTCAAAGGGCTTGATTTTAAACTCCTCGAAAGGATACGAAAAG
GAGAGGATGTCTACGGAAATAAGGGAGTAGAAAAGGATAGCGCCGAAGAAGCACCCATAGAGGACGACGTGGATGACGA
ATTCGATCGACTCGAAGAACAAGACGTACAAGCCATTACGAAAGAAAAAGCGGAAAAGAAGAAGGGCACTCTTTCAACA
GTGTCTCTGGCACCTGGGAAAAAGAGAACACGCGATCAAATTTTAGCAGAGCTCAAGGCAGCCCGATTAGCAGCCCAGC
AGCAGCAAGAATCAGCTCTCGGAGACCGATTTAAAAAGATTGGGGCAAAACAGAAACCAGGAACCCGGATTGAGAGAGA
TAGTAAGGGCAGGGAAGTTTTAATCATTGTGGACGAGGATGGGCATGAGAAACGGAAAGTCCGCAAGGTACAGCCTGAA
GAAGAGGATGCGCCGGAACGGTCTTCTCATGCCAGATAAGAACGCCAAGCCATTAGGGATGGAGGTTCCTGAGCAATATC
GGAAGAAAGAGGAGCCAGAGGAAGATGACGGCGATGTCGATATTTTTGAGGATGCTGGCGATGATTACGATCCACTAGC
CGGAATGGGGGGTTCAGACTCTGAGTCGGACGAAGAGGAGAAGGGCAGCAGCAGTAACCAGGAGGCAGACAAGGAGGCA
GACGCCAACAAGGCGATGCCGCCTCCACCAAAACCATCTGTTTCACAACCAGAACGACGCAATTATTTCAAGGACTCAA
GAACGGCGCTCATCTCCGAGGAAGCAAGCAGAGGGCCATCCATGTCTGATCCCGCCATATTGGCAGCCATCAAGAAAGC
AGCATCCCTCAGGCCTCTTGAGCAAGATGCCGAAGACGATAAAGCTAAAGAAGCAGCCAAGGCACTGGAAGAACGGCGA
AAGAAGCTTCTTCAGATGCAGAGCCGGGATGATGATGATATCGATATGGGCTTCGGCACCAGCAGGTTTGAAGATGAGG
AGGACTTTGAGGATAAGAAAGTGAAGCTATCGAGGTGGGGCGAAGACACCGGGGAGGAAGGGTCCAGTAGGGGCGACAA
GTCAAAGCGGAAGAGAGGGCCAAAGAAGCGAAAGGGTGATGTCAACAGCGCAGCTGATGTGATGCGGGTCGTCGAGCAG
CGCAAGAAGTCAGAGTAAGGTCCGCCTTGGGAGGCCGACAAGCCCAACTTTGTTGGCGCAATCGGCGGGCACAATATGC
ATTTCGATTCCCCCAGAGTATCCATATACCGCTGGATAAACAAGCAATATACGTACTAGATACC > SEQ ID NO:7447 213758FL Trichoderma harzianum
CGCAAGCAAAAGATGCGAGGCAGTGTCGTGGCTAGCAGGCCCTTGAGCCGGATAAGCTGCTCGGCGTGTTGCGCGCGGA
GCCGGCAGTTTAGCAGGTCGTTTCGGGTGCAGTCGGCACAACCAGTGGTCGTGCGAGCGGGATTGAGTGGCGGCGTTGG
AAGATATCTCGATGCTCGAGCCAAGCGTGGTACATATCAGGTTTCATTGGCGACGACGAGATCTTTGGCGACAGTTTCA
GATCGTCCGGTGGTTGGACTGGGTCCGTTGGAGGAGTATGACCGGCGGGTGGACGCTGGGATTCTGCGGAACGACGAGC
ATCAACGAGGCATCATCGAGAACCTGCAACATCTTCACAATGAGCTTCGCAACTACCATGCACCGCCCGTTGTCCATCC
CAGCTTCGATCTCCTCAAGCCCGCCAAGAAATCCGTCTTCTCATCGTTATTCGGCAATGGAGGCGCCGCAAAGGCTACA
ATTAAGGATATCCCCGAGAACTTACCTCGGGGATTGTATCTATTTGGTGATGTGGGCAGTGGCAAGACGATGCTCATGG
ACCTATTCTACGATACACTACCCAGCACGGTCAAGACAAAGACGAGAATACATTTCCACAACTTTATGCAGGATGTCCA
CAAGAGGCTGCACAAGCTGAAGATACAGCATGGTAGTGATGTTGATGCCGTGCCGTTTGTTGCGGCGGACATTGCGGAG
CAGGGCAATGTCCTTTGCTTTGATGAGTTTCAGTGCACCGATGTGGCGGACGCCATGATTCTGCGGAGAAAGCCTCATG
TCTCACGGCGTGGTTCTGGTAACGACGTCGAACCGACATCCTGATGACCTCTACAAGAATGGCATCCAGCGAGAGTCAT
TTATCCCGGCAATTAAGCTGCTCAAGAACCGACTACACGTCATCAATCTCGATTCGCCAACCGACTACCGCAAGATCCC
TCGGCCACCCTCGGGGGTATACCACACCGCCCTGGACCAGCACGCCGAGTCGCACGCAGAGAAATGGTTCCGGTTCCTC
GGCGACTCGGAGAACTTTGCGCCCACGCTCCGAGACGCAGAGGGTCTGGGGGCGCGACATTTTCGTCCCGCGTCAGCG
GGCGGTGCGCCTGGTTCACATTTGACGAGCTTATCAAGAAGCCCAAGTCGGCGGCGGACTATCTCGAGCTGGTCGCGCAA
GTACGATGCCTTTATTGTCACCGAGGTGCCCGGCATGACGATCCGCGAGCGGGACCTTGCGCGGCGCTTCATCACCTTT
ATCGACGCTGTTTATGAGGGGAATGCTAAGCTTGTGCTTACTACTGAGAAGCCCCTGGCCGAATTGTTTGTCTCGCGCG
ATGAAATTGCTGAGACACTACTGCAAAGTAACCCGACAGCCGAGACTACAAAGGCCGCTACGGAAAACGTGATGGAGAA
CCTCGAATCTAGCGTCGTCGATAAGCTCAAGAACTCGAACCTATTCGCCGGTGAGGAAGAGGCCTTTGCGTTTGCCAGA
GCCCTGAGTCGGTTGAGCCACATGGAGAGCAAAGAGTGGGTAGAAAGAGGACTTGGGCTGGAAAGCAGGGAGGCAAAG
AGGACAAGGACAGCTGGACGAAGACGCGAAGTCGACAGATGGAGGATTCGATGTGATTTCATATTGTTTTTGGTACGTC
ATTTTGTTAACGGGGATTTGGGTCCCCCAGGGCGGTTCATTGTTTGCTGCTTTACAATACCCTGAGCGGATTTACACTA
GAGATACTATTTGCCTAGACGGACGGATGGACAGGGCAGCATCTTGGGATGGATACAGATACGTCCATGCATGTTTTCC
TTATGTGTACCATATGTTTACTATTTAAAAAAAAAAAAAAA

FIG. 1 continued

> SEQ ID NO:7448 213868FL *Trichoderma harzianum*
ACTCTACACTATTGATTGGGATAACATGCCTCTGCCCCAAGCCTTGGTGAGAGCTGACCGTGAGGCACTGCTTAAGCTT
CGCCATACCTCGTTGACCACGCCGATATATGCCGACGACTCTTTCAATCCCAGAAAGCGCAAGTCGAATGATTTTCCAA
ACAATGATGCATCCGTGCCGCCTTGGCACTCTACTAACTCAGGCCGATCCCTCGAGGATCGCATTTCGTATTCCCCCGA
TAAGCGGGTAGCCCTCGATGACAGTAAGTTCCAGAAAGAAGCCAACAAGCGAAAGCGCCGTTTCGAAAACGAATACAAG
GCGGCCAACGTAGCGTCGCTCAGCCCAACTCCGCCATCATCCGGCCCCATCGTCGGCACCTCTGAAACCCTTGAAAAGA
AGTATCTCCGCCTCACTGCCCCCCCTATTCCGTCCAATGTGCGACCCGAGAGAGTTCTCCGTCAAACGTTAGATTTGTT
GAAGAAGAAGTGGCGAAAGGAGAGCAACTATTCGTACATCTGCGACCAATTTAAATCTATGCGTCAAGATCTTACGGTG
CAGCGCATCAAGAACGAGTTTACTGTTTCCGTCTATGAAATTCATGCCCGGATTGCCTTGGAGAAGGGGGACATCGGTG
AGTATAATCAGTGCCAGACCCAGTTGCGATCGTTGTATGCAATGGGCCTGAAGGGAAACCCCATTGAGTTCAAGGCATA
TCGTATTCTCTATTTCATTCACACGGCCAATCGCACCGGCCTGAACGACACCCTGGCAGATCTAACAGCAGCGGAGAAG
GAAGAGAAGCCCATCAAGCACGCGCTCGACGTGCGGTCGGCGCTGGCACTGGGCAACTACCACAAGTTTTTCCAGCTAT
ATCTTGACACACCCAACATGGGTGCATATCTCATGGATATGTTTGTCGCCAGGGAGCGCCTTGCAGCTCTGTGCAATAT
TTGTAAAGGATACAAACCTGACATCAAGCTGCGCTTCATCACTGAGGAACTCGGGTTCGAATCAGATGCTGATGCTGCT
CAGTTCATTATTGATTACCAGGGGCAACATCTTCTTGAAGACCGCACAGAGTACATTGCGTTCCTGACCGGTAAAGCCA
ATAACCTCTTTGAGAACTCTAGAGCGTCGGCTTTCCGGAAAGTGGACATCAAAGGGCAGATTTAACTTGGTTGTTGCTC
CTTGTCACGTTGTTCCTGCGCCTCTTCCTCTCCGCGCCTGTTTTTCCTGCATGTGGCTCGCATTCGCCAGCGTTTTTC
TGTTGCATTTCCTCTTCTCTATCTCTTTAAAGATTGCAACCTACCCCTGATACCTAACGATAGCATCTTGCCGATTGCG
GCGAGGATTCAAAAAGTCTTTTTATTTCTTTGGACCTGTTCCTTTGGACCTGTTTCTTTGGACCTGTTTCTTTGGACCG
CATCTGTTGAGAACCCAATTTCGCACGACGAGTCGTTTCATTCTCCTCTGCACGGTTCAGTACTGAGCAACCAATACTC
TGTTCCCGCTCGGGGAACGGGGCAGGCTTTTGCCAGTCACCTTGATTACGGCGATGCCCTCTTCAAACGATTTTGTCTT
CTAACTTGGCGCGCCAGATCTCTGCTTCCGTTATAAGCAGAATATCACTCGATCCATAGTAGCAACTCCAACCAGTTGG
ATGTTGAAAGGAATTTGGAGGATATGTGACAAGATGTTTGCGCCGAACTGCTCCCTTGGCGAGAGCGGATATGGCGTTT
TGGCTTCATCATCATCACGGTCGGACTACAGCTTGGGAAGTTTAAGATGGTGTTTGGCGTTGGTAGTAGTTTTATTCT
TGCAGGGTGTGTTGGGCTGGGACAGTC > SEQ ID NO:7449 215751FL *Trichoderma harzianum*
CGCCATGCTGTGAGTTGTCTCTCCTCTGTCTTGTATCCAACGAACCTGGTCCTGGAAGGCTGCAGCCTCACTGCCTCAC
GTTCTCGTACGCCGCCAGCCAGTGCTAGCATCCGCATCTCCCGTGGCTCGTCGCGGTGCAGCAAGCCCCCGTCACTCCT
TGGTCACAGAGCGCCATCATCATGCCAGCGTCGTTGTCACCAAGCCCTCAGTCCTCTCAGTCATCCCTGATGGAGACCA
TTCCAGATGACAAGGGTCCTGATTTGACCCTGGATAAGCCTTTGCCCCAACGCCCCAGGACGCCCGCTAAGCTCTTGCG
TCTTGGGGTGCGGAATCGCCGCCACGAGTACCTGGTGAAAACTCGGTCGTATTTGACAATCTGGAACATGAACTTGCT
GGTATGATATCGCATCTCATTTTTTTCAATCTCTCTCCTGTTGTCGGCTGATGGGTCATGTCGACGATCCTGTAGCCTC
GAGAGAGACCTCATCATCCCTTTCCAAACCTGACTTGACCTGAAAACCAACCATTGCGGTGTCGTGTAGATCCTGTCTT
GTATGAGCGTCTTGTCAAGAGATTTCAAACTCCAGCCGAACGAGAGGCAGAAGGAAAAGCCAAGGGCTATAGTCGCACT
CTCGAAGCAGATCTCGTTAGAGGCGAGACAAATCTCTCAAATCTCTAATCCTGAACGAGAGCAGGGTAGCCGAACACCAC
AAGATTCAAAAGTGCTAGGCGACGGAGGCGCGGGCACCAATGCATGGGACGCCGATGCAGAGGACAAAGAGCACGGCAA
ACAGCTTTGGCATGCGTACCTCGAAGTCCGCTTCGTGGAGGGACTGGATGAAGACTTCGACTATGAAAAGGTTGATGAC
AATTATAAATACGACACCATGGCCATTCAGGACGCCGAGGATGCTTGGTTCGATGACGAAGAGCCCAGCTGGGTAGATG
GGGGAACGCAGTTTCCTGTTCGGCTAGGAGAGACGGGCATCCAGGATTTTTGAGTCTCATCGATAGACGCTCTGGTGGT
CTTGAACTTTTTCATTCCATAGATTGTCTCGGCTGAGGGCTGAAAAAGTGAACAACCCTCTGAGTTGCCGAGTATATGA
CATTGCTAGGCGTTGTATCGCAGAGGACACGGCCTCTGCAAACATCTGGGTCACTATTCTCTTGCGCCGGCGCTAGTGA
GGACCTGTGTCATGAAGATTGCTTGGTAAACTTTCGTGTCTGTAAACTCCCGATCCATAGAATTTGTCTCCGTAAAAGT
CTGTCTTCGTACCCACGAAAAAAAAAAA > SEQ ID NO:7450 213013FL *Trichoderma harzianum*
CTTTCCTCCAAATCAAGTCATCCGATTCATCCACAGCATGACACTTCCCCAAACGAGATTATTTCCCCCTCAAGCACTA
CTCCGGAATACCCAAAGCCAGAAGTTTATCCGAACGATTGCTTCAATGGCTACTGATGCACCTAATTTCCCATTTCGGC
GAGCTTCTGGCATGGAGCCACCAGCCGAGTTCGCACGGTTAAGGGCTGTTGATCCAGTATCCAGAGTTAAGCTTTTTGA
TGGAAGCTTGGCTTGGCTGGTGACTAAATACAAGGACGTAATTACTGTTGCAACCGATGAAAGGCTCTCCAAGGTCCGG
ACACGCCCTGGCTTCCCCGAGTTGGGTGCTGGTGGCAAAGAGGCCGCCAAAGCGAAGCCAACATTCGTTGACATGGACC
CTCCAGACCATATGCATCAAAGGAGCATGGTTGAGTCGATATTCTCTGCTGACCATATCAAGGAGCTGCAGCCATATAT
TCAGAAGACGGTGGATGATCTCCTTGGTTCTCTGAAAGCTAAGGGTTGCGCTGATGGCCCTGTTGATTTGATTAAAGAG

FIG. 1 continued

```
TTTGCATTGCCAGTTCCATCATACATTATCTATACCATCCTTGGCGTGCCGTTCCACGATCTCGAATATCTTACCCAGC
AGAATGCCATACGAACCAACGGAAGCTCTACGGCGCGCGAGGCATCTGCCGCAAACCAGGGGTTACTCGATTATCTTGC
CAAATTAGTGGATCAGAGGATCCAAGAGCCTAAGGATGACCTCATTAGTAAACTCGTTGTGGAACAAGTAAAACCTGGG
AACATTGAAAGGGCAGATGCCGTGCAAATAGCTTTTTTGCTGCTCGTGGCAGGAAATGCTACTATGGTCAACATGATTG
CATTGGGAGTTGTGACTTTGTTCCAGCATCCTGACCAGCTTGCGCAATTGAAAGCTGATCCTTCACTCGCCCCTGCATT
TGTGGAAGAGCTATGCCGATATCACACAGCTTCAGCACTGGCGATTAAACGAACAGCAAAAGTTGATATCGAGATTGGC
GGCAAGCTTATTAAAGCCAATGAGGGCATCATTGCTTCCAATCAATCCGCGAACCGTGACGCCGACATCTTCGCAAATC
CAGACGAATTTAATATGAACCGCAAATGGCCTAATGAAGATGCTCTTGGATTTGGATACGGCGACCATCGATGCATCGC
TGAGACTCTTGCAAAAACCGAATTGGCAACCGTCTTCTCTACACTTTTTAAAGAACTGCCCAATCTTGAGCTTTCAGTG
CCAATCAGCAAAATCGACTTTACGCCATTGCATAAAGACGTTGGAATCGAGAATTTGCCGGTAGTTTTCTAAGGTGGAA
GTCGTTAGAGCTCAGCATCGAAGCAACAATTCAGACCAGCAACATACTCCAAAAAAAAAAAAA

> SEQ ID NO:7451 213806FL Trichoderma harzianum
AAGTTAAATAAGGGCCAATGGACGGCGATCATGGGAGCCCGTCTTCAACTCACTTTTGCCAATCTGCAGGCTCTCAACC
GACAGTTCAATCACCGCGGCGCAATGGCTGAAAACATCCTCGTTCTGGGTGCTGGCGAGCTTGGCCTCGCCGTTCTGGA
GGCGCTCTCCAGACACCCCAAGCGCAACCACAGCAAGATTACCGTCATGATGCGGCAGGCCACGCTGGACTCTGCCGCA
CCCGATAAGAAGAAGCTGATTCAGCAAATCAGGGCGCTGGGCGTCGACTTTGAGGCGGCTGATGTGGTGCAGGCTTCGG
TGTCGGAGCTCGCCGCCATCTTCACCAGATACGACACTGTGGTGTCCTGCAACGGCATGGGCCTGCCGTCAGGAACGCA
GACCAAGCTCTCCCAGGCGGCGCTCGAGGCAAAGGTGCGGTGGTTTCCCTGGCAGTTTGGCATGGACTACGATGCCATC
GGCCTGGGCAGCTCGCAGGACCTATTTGACGAGCAGCTGGGCGTGCAGCGATGCTTCGCGCCCAAGCACTACGGAAT
GGATCATCGTGTCAACCGGCCTCTTCATGAGCTTCCTCTTCGTTGCCGAGTTTGGCATCGTCGACTTCAGCACCCGGAC
GGTGCGCGGGCTCGGCTCGTGGGACAACAGCATCACGCTCACAACGCCCGTGGACATTGGCCGGGCCACCGCGGAGCTG
GTTCTGGATCCGCAGGGCCTCAAGAACCAGTGCGTCTACGTGGCGGGCGACACTCTCACGTACGCGCAGGTGGGCGATC
TATTGGACGAGCGCTTTGGCACTCGCTTCCGGCGCGAGCTCTGGGACTTGGACGAGCTGGCCAAGCAGATGCGCGAGGA
TCCGGACAACACAATGGTCAAGTACAGGGATACGTTTGCTCAGGCCAGGGGGGTGGCTTGGGGCCAGGACAAGACGGTG
AATTCGGCGCGGGGATGAAGATGACGGATGTGAAGGCGTATCTGGCGGCGATGGACGTCCAACTGGACGAGGCACTGT
GATTGATTGATTGCGCTGTAATGGGTCGATGTCATGTATTATCATCATCTTTTATCTTACTTGTCTGTTAATAATAGAA
TAGAATTGAATGAAACGAAAAAAAAAAA > SEQ ID NO:7452 214756FL Trichoderma harzianum
CTCTCATCTTCTCTCCAATCCCCAATCCTCAATAACCTACGCCGTGTCAGTCAAGCAGCTGTACATCATCGCATATCGA
CCGACGACGACCTTGTCCTGCGTCTTCCATCTCCAATTCTCACCCACCACTTACACCATCACACATCACAATGCCTGCT
CCTCAGGTTAACGGCGAGGTCACCAGCCATGTCAATTCCGCCTTCCTCCAGCACCTCTTCTCCTATCCTCTAGTTAGCG
ACGGCATTCACACTGTGACCACCAACGAATACGCACAGCGGCCTATCAAGCTGGGCGAATCTGCCTATAAAACTTTTGC
CGCCCCTGTTCTTCCCTACTTTTCCAAGCCCTATGGTATTGTCTCTCCCTACGTCCAGAGGGCCGACTCCTTTGGCGAC
AAGACCCTGGACCGCATTGACGAGCGTTTTCCCATTGTCAAGAAGCCCACTGGTGATCTCTACAACGAGACCCGTGGTC
TGATTCTGTTCCCCTACCAGAAGGGACTCGAGGGCAAGGAGCACGTTTTCAAGATCTATGCTTCCGAGCTTAAGAAGCT
TGAGCAGGAGGGCGTCGTGGCCCAGGGCAAGGCTGCCGTTTCCACCGCCTTCGTCATTAGCAACGAAACGCTGGCCTGG
CTGAGCAGCTGGGTCGCTGTCAAGAAGGCCGACGCCTCTGAGGCTACCAAGGAGAAGATCAACCAGTAGACGATTTCCG
GAGTGGATTACAAGCGAAACAGCGCATCATTTCCTTTCTTGACCGGCCCTCTCTCTCTTCTTTGTCTTTCTCTTCTTAC
CCTTTTGTTGGCATTGAGTCGACTTTCTCTGTCACTGGATCTCATTTGCTTTGTTGATGCCAGTTCGCTTTTGTGATGA
ACAGCACCTAGAGAAAAGGGGGAAGAAGGGCAGGCTGCTTCGTCCGCTGCGACTAGGCGTCTACGTCTGGCATCATGAT
CGCCACTACTAGCTAGTGGCCAAGCTCTGACGCATCTCGTTTCGATTTCATCTCTCTTTGATTCCTTGTTTCGGCGGAC
TATGGCTCCACCACCCGCAGTTTCAACGCTCGTCACGTTGCTCGAGAAGTGCAATCATGAGTATTGATGGGATGTGG
GCAAATCTGTATCGGCAGCAACCTTTGACGACGAGAGGGCTTTCAACACGGGACACTTAACTTTTCTTTGTTTTGATGT
ATGGGCAATTATATGGAAGGACGTAAAAAGGGTAGAATACCAATGGGAGTTTGCTTTCAATGCTAATAAAGACCTCGAC
ACTATCCAAAAAAAAAA > SEQ ID NO:7453 215926FL Trichoderma harzianum
CCCACGCGTCCGCCCGCCTCAGCATGGAGGATATGGACCACCTCAGCCTCAATACGGCGGCCACCAGAACCAATATCCT
CCTCCCGGCGGCCCTCCCCCGAGCCACTACGCACCTCCTGCGCACCATCCTCCTCCGGGTCTAGATGCTTACGGCTATC
CTCTCAACCCTCCGACTGCCATGCACGCAAAGGCCGGCCCCCGCCTCCCTCGGCCCCTCAGCAGTTTGGCCACGGTGC
TCCGGGCGGCTACACCTTCCAGTACTCCAACTGCACAGGAAAGCGAAAGGCGCTGTTGATTGGAATCAACTATTTTGGC
ACAAAGGCCGAGCTCAAGGGATGCATCAACGATGTCCACAACGTGTCGGCATTCTTGGTTGAGCGATATGGCTATAAGC
```

FIG. 1 continued

GCGAGGACATGGTCATCCTGACAGATGACCAAAGCAACCCTGTCATGCGCCCAACCAAGGCCAACATCGTCCGTGCCAT
GGGATGGCTTGTTAATGGCGCCCAGCCCAACGATGCCTTGTTCCTTCACTATTCTGGCCACGGCGGCCAGACCGAGGAC
AAGGACGGCGACGAAGACGACGGCTACGATGAAGTTATATACCCCGTTGACTTTGAACAAGCTGGACATCTTGTAGATG
ATGAGATCCACTTCCATGTTGTCAAGCCTCTGCAGCAGGGAGTGCGCCTCACAGCCATTTTCGATTCATGTCACTCGGC
AACCGTCATGGACTTGCCCTATGTCTACTCCACCAAGGGTGTCCTCAAGGAGCCCAATTTGGCCAAGGAAGCTGGTCAG
GGTCTCTTGGGCGCCATCTCCTCCTATGCTTCGGGCGATATGGCCGGCGTTACGAGTAGCATCATGGGCTTCGCTAAGC
AGGCATTCGGCGGTGACGGGGCTTACAAGAAGACTGTGGCTACACGCACATCGGCAGCAGATGTCATCATGTGGTCTGG
CAGCAAAGATGACCAAACTTCTGCCGACGCCACGATTGGAGCGCAAGCTACTGGTGCCATGTCGTGGGCCTTCATCTCC
GCTCTGAAGAAGAATCCCAAGCAGAGCTACGTCGAGCTTCTCAACAGTATCCGAGAAGTCCTCGAGACCAAGTATACTC
AGAAGCCACAGCTTTCTTGCAGTCACCCCCTAGATACCAATCTTCTATTTGTCATGTAAACTTAACAAAAAGAATGATA
TCCATTGAATACAAAAAAAAAAA

> SEQ ID NO:7454 212871FL *Trichoderma harzianum*
GCCGGACTTGGGTGAAAAGACTTCGGTGCCTTCGACTTCCATCCGCTGGTCCGTCGCAAGCTCGACGGGATCCGGGGCG
GATGACGGGGACCTGACTGTGCCTGCATCGGTCACGGCGCCGGAGGGCGTGACGGAAGAGACCATTGTCCAGCGATTCG
CCTGGGCTTGCTGCGGTGACAACTGCGTATTGGCCATGGGGATGTCGCCCGGGGCGGCACCGCTTGCGCCTCCGGATTG
TAGGGAGGCGTCGTTGTATACGCGGCGCTCTGCAGCATTTCTCCGCTTTGTGAGATAGAACCACACGGCTGCCGCGACG
AGGAGGCCGCCGCCCACCACTGCACCGACGGCGATACCCGCTTCCGCCCCGGGAGAGAGACCCCCGGACGACGAGGACC
CGGAGTTGTTGGAGTCGCCGCCCGCCTCGAGGGTGCTGGTCGGGCCCCGGTTGCGGTGGAGCAGTAAGCCGATCCGGC
GAACGAAGTACATGCCTGGCCGTTGTTGCAGCAGCCGTTACCGTCAGAGCACCGGAACTGACCGGTAGTACATCCGTCA
GCAACGGGAGTGAGACCGGGAGGCGGGCTCGTCTTCGTCGAGACGCAGTGCCCGCCGGCCTGGCAGTTGGAGTCAAAGG
GGCAGCAGTTGCCGCCGAGGTCGGGGCGCAGAGGTAGAAGCTCGTCTGGGGACAGGCGCGGCCGC > SEQ ID NO:7455 214547FL *Trichoderma harzianum*
GTTTCGATTAGCATTACACCAGTAACCCTCCAGGCAGCTAGCGAAGAGAGCAGGCCCAGTTCCGGGTGACAGGTCGGGC
AACGCCGCGACGGCTGCGATTCCGAGCGAACGGCGCTGGCGTTCCAGACGGCACAGCAGCAAGCACAGCAACAGCACAG
CACAGCTACGAACATCGAGGATCCCGCTCCAGGAACCGGTGCTATCCAGAACAAGGCCCCGGCGCTAGGACCCGCGGTT
GGCAGTGGTGGATCGCAAGGCTCCAGTCATGCCATGCAAGCGAGGGAAAAACGCTTGCATGCTCATGCTTTGCTCTGGC
TCTAGATGAGTCTGAATCTCATCCATCCTCGACCTGCTGCTGTGTCTCCCCGTCCCGCACGAGGCTTCGGTCGGCGAGA
GCCGGGATCGAGGCGTTGGGGGATGGCGTCTGTGAGCCAGACATGACCTGTCACTGCCGTGGGTATCAGCAAGGCGCAA
TGGCGAATTGCAGGTGGGCAGCGAGAAAAATTCGAAGGGATAGCCTTTTACCAGCGCTGCGTCGATGATGAAAATGGCC
TGATTTCTTGCTCGCGGAGCTATGCCGGGACCCTGCAACCGCGAAATGGGCTGCCACCGGCCACAGAGAAACAGAGGC
CACAGAGGCGCCGGGCGGTCTCGAAGGGCTTTTGGGGACCCTCTGAGGCGCTGGAGGGGTCCCTGCGCCATGGATGCCA
TGCATGTGGGAAGAAGAGAAAAATTGCTGCTCGAATATCGTATGATTCGCAAGGTTGCTGAAGGGCCCAAAGGAGCCAC
GTCGGCGCTGATTGGCCAGGCCGCTTCCTGCTGTCGGCGCCTCGGTATCGAGCTTATTGCTACCCCGTTAGGCAAGGGG
CGGCCGC > SEQ ID NO:7456 214762FL *Trichoderma harzianum*
ATTCTCCGTGACATTTGCGACGACGCACAGCCCAGCGAGCCGCGTCACCGCCTGAAACGCTTTGCCTAAGCTATTGTCT
TCATTTCCCACATAGTGGCGGGAATCCTGTGGAAAGGCGCCACTCCAACAGCGGAAGCTGTGGGTGGCTCCAGTAAACC
GGACTCCATCATGTCGCAGCCTCCCGGACAGCCTCGCCTTTCACCCCAGTTCTGCTTCTCCTTTGGCACGCTTCGTGAT
TTCCTGCGGCTGTCTCGATCATCAATAGACGACTCCATCACTCAGAATCTCAATGCTCTGGTAACACCGGCTCGGACGG
GCTTCGACCCGAACTCAACTTCAAAACGTGCCCCGCGATCCTTTGCCGAGCCGATCGGCCCTGAAGCATGTCAGTCTTT
CAAAGAGAAAGTCTTGTTTCCGTCGTGGAAGGCTAGAGCCGAAGTGCTCAGCTATTGCGGCATCGTTGCCACCAGCCCG
GACCCCGATGACCCCGAGGCTACCGTTTTAGAACTGGAAAAGCAGAGAGACCGCGAGCGGATTGTTGATGAAAGGCTGG
ATCCGTATTCAGGACGCTTCTTCCCCCGAGAAGCTCGTACGCAGTCCCTTGCCCTCCTGATGCGACAGGAACGAGCCGT
AGAGAACATTGTCCGCAGCAGGACTTGGGACGTCATCCAGGGAAGATGCGGTACATCTAGTCAGAGTTGGCAAGATGCT
ATGAGCAATTGGGAGGCTGCACAGAATCTCAGCAAAGGTGATGGCAACCCGACTTCATCATGACACAGGATGGGACAGG
AACCAACACCACCTCGGTAGTATGGACTAATGATGCAGCATGTGCTTGTACGATTTTGAATGTGAAAACGAATATAGGG
ATTGGAATATAGACGCCAAGCTTGTATATAAAACAACAGTGTACTCAGACTACTTACAATGTGCACTCTGTACAATATG
AACCCCCCTTACCTTTTTAAAAAAAAAAAAA

FIG. 1 continued

> SEQ ID NO:7457 213119FL *Trichoderma harzianum*
CGCAAACGCACGCACTCGCGCACAAGGCAGCTGATAATCCAAATCTACCTACGCATAATAATCTTCAACAACCTGCATC
CAACGAAGCGAAACCCAAAAACAACATACATGAGTGTAACACCACCAAACGTCCCTCGCATCGAAGACAAGCAAAGCAA
TACGATGCCCTCACAACGTCCCTTCTTCCTCTCCTCCTTCTTCAACTCTTTCCGCCAGCAAGCGCCCTCCCTCACCCAG
CAGGCGGCCAGCAAACACACCTCGCAAGCTGCTGCATCTGCATCTGCCGTCGCCTCCACAACAGCCGCAGCAGCAGCAG
CAGCTTCTTCAACCGCCTCCACCGCCCGCGCAATCTCCACAAACGCTGCTACCACATCATCCACCAACGTCGCCATCCA
CACGCCTCGCGGATCTCCCGGCGGCGCCATCCCCATTCCTGGCGGGCGCAGAAGAGGCAGCGATAGCAGTAGTGAAGGC
TTTCGCGATGCCCTCGGCGCCGACAAGTGGTATATCGGCGGCAGGACGGCGACTGGAGAGGAGAAGTTCTTTAAGCTTG
GCGTGATACGCCGAGTAAGGAGTAATGATGGCCTGAGTCTCGATCGCCTAAGCTTATAGGTGATGACCACATCACTGAA
CGACTCGAGAATGACTGGTTTTGATTTTTTTCCCCCTCTCTCCTTCTCACCTCTTCCTGCTTGGCCACCAGCAACGAG
AAAAAACGTATATACATGATTAGAGCGACTTTGGAATTTGGGCAACAAGGCTGCAAAACATCAAAACAACGCCGACGGG
AAGGCATTCATTTGGGACTTTTGGGTTTGGGATTTCGAGACATGGGCGCGGCGTTTTGGCAACCGGTTGGGAATTTTTT
GACGAACGAAACTTTGCATTCGTATTCTATTCTATCTAGCATAAGAAGAATGAGGCTGCTCAAGGACCTCTTAACAATA
CAATATTCTATCTTAAAAAAAAAAAAAAA > SEQ ID NO:7458 213237FL *Trichoderma harzianum*
GCGTTTTGCATTGGCCAATATAGCCTGGAACTTTATTTTGGGGCAAAAGCAAGAAGCCTGGAACAAGCTTGTTGTGTTT
GTTAGCGACCAAAAAAAAGGTACCTGCGACTACAACTGAGGGTCCCCCAGTGGCTGAACGACGACTTACACCCGTTGGC
AGCAGAGCTTTTGTCTTTTCACCACAACAATTTTGACATTCGTCTATACAAAACTTGCACGGTTTCTTTCACCTGGCAG
GTAGCATCTCGACATTCACCATGTCCAAACTCCAGATTTGGGCCTCGTGGCCCGAAGCCCACCTCTTCAACTTCCCTCC
TGCCAACCCTCCGGCCCAATCCCACCGGCACATGTCCCTGCCACTATTCTGAGGCCCTTCAACATCCCAGATGATCTC
TATGTGTCTGCTCTGGATGCTCGAGTTCCGTTGACGATTGCTGCTCTTTATGCCATCTCGGCCAAGCTGCTCAACAAGT
ACAACAAGGCGCGCAACAAGAAGCCCTGGGGCATCAGCAAACACGCCCCTTCTTCGTCTTTGTCGTCCTGCACAACAT
CTTCCTCGCCGTCTACTCTGCCTGGACCTTCTGGGGCATGGTCGGCGTCATGCAGAGGAGTTTCGTCAGCCCCTTTGGC
CCTGGCGGCGTCGCAGCTACTGCGGATGGCTTCTGCCGCCCCACGGACCTCGTGGCCTGGGCAACTCCATCTACTTCA
ACGAGACCACTTTGAGCTGGGACAGTGCTTCACCGAGCTCCGTTGCGCATCTGCTTGCTTCCAATGGCATGCCTAGCAC
CACCGAGCCCGGCCGGATGTGGAACGAGGGTCTCAACTTTTACGGCTGGATCTTCTACCTGAGCAAGTTCTACGAGGTC
CTCGACACCTTCATCATCCTGGCCAAGGGCAAGTACAGCTCTACTCTGCAGACTTACCACCACGCCGGTGCCATGATGT
GCATGTGGGCTGGCATGCGGTATATGGCCATCCCCATCTGGATCTTCTGCCTCTTTAACTCCTTCATCCACTCTTTGAT
GTACACCTACTACACTCTCTCGGCCTTCTCTGTCAGAGTCCCCACGGCCCTGAAGCGTTCCCTGACCTCCATGCAAATC
ACCCAATTCATCATTGGAGCTACATTCGCCATGGTCCCATCTTTCGTCACATACGTTTCCCCCATCACCTCTACCCACG
TCGTCACCGAAGAGTCTCCCGTCACCAGGAGCGCCCGATCGACTACATCATCCCGACTGCCGTCAGTGCCCTGGATTC
GCTCAAGCAGCTCATCTTTGGATCTGCCGAGGTCGCTGGCGCCGC > SEQ ID NO:7459 213826FL *Trichoderma harzianum*
CCTTCATTCTCATTGTCGACATCCATCGTGATTCCCCTGAAACTGCGTCTTTCAGTTGACTCTGGTGATTCTCTGAGGC
GCCGAGGCTCTGTGTGAGCATCCCGATCCAACATCATGGCGATACGCGAGGAAATCGTGGCGTCTGCAGCGCAATTTCT
ACAAGATCCCAGCGTTGCCACCTCGTCCGTCGAGAACAAAATCTCGTTTCTTCGAACCAAGAATCTGACACAGGAAGAG
ATTGATGCCGCCATTGCCAGAGCTGGGGGCGGTAGCGGCGCGGTAGCTCCTAGGGCTCCCTATGCTGGCGCGCCTCAGG
GTCCTCCTCAGGGTCCTCCTCAACAGTATTACCAATCCTACCCCCAGTATGCGTGGCAGCCGCCTGCGTCAACACAACG
GGATTGGAGAGATTGGTTCATCATGGCAACCGTGGTTGGAGGGGTCAGCTATGGCCTGTACTCATTGGGCAAGCGTTAT
GTATACCCCCTTGTAGCGCCACCTACCCCTGAAAAGCTGGAGCAGGACAGGAAGAAGTCGATCGAGGAGCAGTTTGACAAGG
CCTTTGCTCTGGTTGAGCAGCTGTCCAAGGACACAGAGGCACTAAAGGATGCCGAGAAGCAGCGGACAGAACGACTGGA
CATTACACTGGCAGACCTGGACACGATCATGACGGAGCTGAAATCAGCAAACAAGCGCCGGGAAGACGACGCGCAGCGC
ATTCGCGACGAAGTACAGAGCCTCAAGGACGCCATCCCAAGGGCCATGAACAACCAAAAGGAGCTCACCGACAACCGAC
TTGCCGAAATCAACACTGAACTTGCCAGCCTCAAGACTCTTGTGTCACAGAGGATGAATGCTAACTCAAATAACTCTAT
GTCGAGCGGCTACTTCCGAGGCAACAATGGAGTCAACGGTGTCAACGGATCGAATGGCGTCAACGGAACTAGCGGGGCG
GCTTCACCCACGACAGCACCCGGGCAATCAGTAACTGCCCCACCCATCGACAGTGCTACGGAGGCGAGCGGCACTCCCA
AGCCTGATGCTGGCAAGGGCCCGGCTCAGAACAGATTTAACAGAGCGTCTGGCCTGTCCGTTGGCTCCGGAGCCAAGGC
GTCAATCCCAGCATGGCAGATGGCCATGGCCAACCAAAATGCCGGATCAGCAGGCTCTTCGTCGGGCAAGGAGCCCGAA
AAGGCCGCCACCGAGGCCGCGGCCAGCAGCTCGTAAATAATTGCTTGCTTGACTTGAGATTCTCCATGCATTGTACGAT
TTTGATCAACTTGCGGTTATTGTTGCGCTACGTACGTACGGATAAAGGGACAATGCAGACATCGATTGGATAACGGCCG
GAGCGTTGGTTGCTCTATCAAAGTTTTTTATGTATTTAATATCAAATGGACCACATATACTTTTTTATCTATTTTCCGG
TTGGATTACATGTTATTATTATTAGAAGAAAAAGAAAAAGAAGAAGCTACCTACACAAAAAAAAAAA

FIG. 1 continued

> SEQ ID NO:7460 213983FL *Trichoderma harzianum*
AGACTCCAAGATGCATCATCAGCTTCTCACTCTCACCGCTGCTGCTGGCCTCCTCGCGACGGCCTCAGCTACCTACTCG
AAGCTTCCCAGTGTCAATGTGCCTTCATGTCCTCGTGTTGGCACGATTAGCTACAGCAAGTCAGTGCCCGACCTGACGC
CCTTCCCGCTCACACAGGTCAACCTGTGCTACACAGACAAGAGCCTCGAGCTCTCATTCATTGCCTATGACGAGGTCAA
TTACTTCTTCAATGCCTCTCAGGGTACAAACGACGACATCTGGGAGTACGAAGTCATGGAGGCTTTCCTCTACAAGGGC
ACCGAAGACCCTCAGACATACGTCGAGCTCGAGGTCAACCCCAACAACGTCACATACCAGGCATTTGTTTACAACCCCT
CCAAGAATCGCGCGGTCGGCGCACCCTTCGACCACTTCTTCGTTTCGGATCCCGCCACGGACGGCTTCAGCTCGAAGAC
TGTCCTCAACAAGCTCGCAAAGACTTGGAAGAGCACTGTTACCGTCCCTCTGGGCATCTTCAACGTCGACGTCGGCAGG
CCAAGGGCACATCTTGGAGGATGAACTTCTTCCGAACCGTCGTCAGCCCTGAGATTTACCCTAATCAGACTCTTGGTGG
ATGGTCGCCGCCAGACCAGGCGAGCTTCCATATTACAAAGTTCTTTGGTCATGTCAAGTTTATTTGATCGGGAGGATTT
GGGTTTACGATTGATGTTTGCGAGCCGTAAAGCGGAATTACAAAGCACATGTACATAATGCGGCATGCCTGATCTAATG
TAATTGTCAATGATGAATGATCTGACACAAAAAAAAAAAAAAAA > SEQ ID NO:7461 214771FL *Trichoderma harzianum*
GACCCACGCGTCCGCCCACGCGTCCGCGCCCATAACCAGCAATCATGTTCTGTCTCCGAAGCTGGCTCCCGCTCCTCTT
CATCCCGACAAACGCCTCGCCCGCCTTCATCCTCCTCTTCTTCATCTGCACCTACTTCCTCAACCGCCCCTGCGTCTAC
TGCTCCGTCCTCCTCCTCATCCTCTTCCTCACCTCGTGCAACTGGTCCGACCGCTGCTTCTTCGACCTCAGCAGCAACT
GGTTCCTCCCTCGACCTCCTTCGTCCCTCCAGCTCCCCGTCGACGATCAAGACTCGCACGCCCTCGCCCTCGCCTTCAA
CGACACCCTCGTCGACATGGTCAATTCTACAGCCAAAGCCGCTGCCCGCGCCGCTGCGGAGGAGGTCGCTGTGCTGCGC
AACGAGTGGACTGGCTTGGGCGTCGAGTGGCTGCGTAATTTGCTGGGCAAGCGGGAGTGGAGGATCGACTGCATGGACA
TTTACATCAGGTTGTAAAACGAAGGGGAATTACATACATGGAGCTTTTATGAGGGGAAGAAAACAAATATTGTAATGAA
AAACTTCATCTACCTTTGTGCATTGGATAGGCTTTAGAACGGCGGGACTGTTGAGAAATCATCTTGGGCTCTTCATCAT
TTTTTTTTACAGCGGCATGGGGTTTGAACATGTGGATATAGCGCTTGTCTTTCTGTCGATTTTCTCTAATAATATACAT
CCATATATATACTAAAAAAAAAA > SEQ ID NO:7462 213243FL *Trichoderma harzianum*
AAGCATTCGCCTCTCGTTCAGATCTCAAGACAAAAAGCACTCAAACCAATCACTCAACCTCTTCAAGACCACCTTTCAA
AACAAACCTTCAACATGAAGTTCACCGCCGTTGCCTTTGCCGCCCTCGCTACTCTGGCTACAGCCAGCCCTCACCCTCC
TCCTCCTCACGGTTGCAAGCCTGCTACCTACTCTTGCCTTCCCAACGACAGCGGTTGGCAAGTGTGCAGCACTGCCGGT
CAGTGGGTGTTTGCTGGCACCTGCCCTCCCAAGACTGTCTGCAAGTTCGACAGCCAAAATGGCAGCCCCTACTGCGTTC
CCCCCAACTTCACCATCCCATAAATCCATTAAATGGGGATCAACGGGGCTACTTACAAAAGCCTACCGGATGAGCATGA
GATTTAGAGTTTTTGGTTGCTAAGACGTTTCGTGGCCTGTCATTGTCTTGCAGATCAATCCTGGACATAAAGTTTACAC
ATAACATATGGTACACTCCTTTGAATGCGATGTATCTCTATAGCTATATGAATACAATAAATTGAAGCAAAAAAAAAAA
AAA > SEQ ID NO:7463 213836FL *Trichoderma harzianum*
AGGTAACCACCAGCACACGCAAACGATACGAAAAACCGAGAACAAGTATACCTTCAGCTCCGCGGACAACAATCATCAC
CGCGGACAACAATCGTCACTGCACGTCTGCCTAGTTGAGAGTTCCAAGTGTAAAAACATCAGCAGTTGCCTTGCTGCGT
GGTTCCCAAGTCCAGATAGTCAACAGATCAAACACAAGACAAACCTGCCTGTTCGATTACTTTGCCTCCTTGTAGTACA
ATTCGCAATAGTTCACCAAATCACCAGTCATCATGCCTGTCACTGAGTTTGCCATTATCAAGCTGAGGCCCAATTTCGA
CCCCCTCGAGTTTCTCGAGACACTCATGGAGTGTCAAGAGATTCAGGACAATTGGATTCGCCGCAATCAGCCATGCAAT
CTGGCGCCTGGCATGAACCTGAGCAGCATGTACACGGATGCCACAGACCAATCAACACTTCTCATCACGGCGCCGTGGG
ATTCGCCCGAGGGGCATGGGGAATGGATCCAGAGTCTTGAGAACAGGACGGCCAATGGCAACTTAACCGAGTTCAGCGC
TCCGGGTTGCGACTCCGTCTTGCTCTTCCACATGGACCCGGCGGGAGCGAGGCCACAGATGCGGGAAGCCTTTCAGCAC
AAGGATACCAACGACGTATTCGACGTCTGTCGCTTAACATTCAACGGCGATCAGCGGGAGGCAATACAAACCAAATATC
AAGCACTGGAAAACGAGCTGCGAAAGGAAGGTCTGGAGAAGAGCATATGGGCGGGCTGGAGGATTGAAAAGGCAGCTGG
TGAGGAAGACAAGGAAGATTTGATTGTATTCTGGACTGGCGATGTTCCGAAGAAACGACTGGAAGGATTGGCGAGCCTC
GCCCTCAAGAAAGATCATCGCCGCTTCAGGCACGTCGTGTAAATAGGCATCACCGAGTAACCGGGGGGGGCTCCCTTTCT
TCAGGTAGCATAGCCGGCACAAGAAAGACATCGGGCTCACCAGATTTTGGTGTGCGATTGTTGCTTTTTGTGTCTCAAA
TCGTTATTTTTGAAAAAAAAAAAAAAA

FIG. 1 continued

> SEQ ID NO:7464 214017FL Trichoderma harzianum
GGCGGCTGCGTCTTCTCACAGCGCATAATTCCGTCGCAGAAAATACAAGCTACCTACCTAGGTATTGTGAGGAATGTGC
AATGGTAAGTCCCTAAGTACTAACAGAGGTTGAATTGCTACTAATAAGGGAGTGGCTATTCCACATCCCCGGATGGAGT
ATCCTCAGTCGCATATACTATTCTCACATAACAGTGGATGCCTAGATACCTATAGTATTACACTCTTTCAGCCAGCTCT
TCGCCAGCATTATATCCTGAAAAAAAGGAGCTATAGCATATATGCATGCACCAGCAGAAATCATCATCACACCAATCTC
CGTCTTAGCCCCCACCACCTGTCCTCTTCATCGTCAATGACATGTAGCAGAATGCTCAGCCTCATGTCGGCATCGAGTC
CGGCCTGGCGCCGCTTCTCACTTTCTTCATTATACCTTTCGACCGCATGAATGATCGCCATCTTGCTTCGTCTCGGCCC
CAACCACTCAAGCGCGGCCCTACCTGAAATATATGTGTCGTCCTCACATACCCCCTTGTAAGTGCCAGTGTGGAGGAAC
GCGTCGTTGTCATGCTCATGCTCGGGAGTTGGAGCTGTACTTTCCATCTCCATGAATGATTCCAGAGTCGTCTCTTGCG
GTACATCTTGTGGCACCTCTTGAGATGGGGCGTCCTGTGGATTGTCCTCTTCCGCGTCCTCATCATCCTCTGTATCCAG
CATTTCATTTGTCGGACAGACAGTGTACAATTCCTTTAGCCCGCTGAACCACCGACTGATGGCATCTTGAGTCTCATGT
ATGTAACCGGGACCCCAGTCGAGGGCCAACTTTTGAACATTATGCATCCAACTGGTCCTGGCCACCGCTTTTTCGTACA
TATGAGGATGAGCTGTTTTCAAGGATTGCAGACGAGTCCAGCTACTCATGTCACTGCTTGGCCAACCGACATAGATCAT
GTCTCTGGCGGCCTTGTATCTCACGACACAGGTGGGCTATAGGGACAACCCCGGAATGAGTTATAGCCCCATATGGTG
ATCTCATTGGGCAGGATATTCTCTAGAATCAAGGCTCGATGTGCTCGGCTGACAGAGACGGCAGCTCGACCTGCAGCCG
TTGACCGGGCGAGAGCAGGAGTAACCACTACCCTGCCGTGATTCCGGGTTGTGACTCGTAAGACCCTGTGGGTTCCGAT
GACGCTCTCCCATATTTTAATAAGGGGTTCGGTAGGGAGGTTGTTGAATGACGGCACAAGTCTATCTTGCCCTGTCGAC
ATTAAGTTGTCGTGTGCCCTTTCTGGATTGAGATACACAGTATAGTGATGAGTCGTAGGACCGTGATATCTAGCCAGGG
CGGTGCTCTGTCTGGATTAGGACAGACAGTGTGGCGGCGAGTCATAGGGCAGCGGCATCTAGACGGGGGCGCCATGGAG
CATGAATTTCGAAGTTGTCTATATGGTAGTGAGAGTTGGGAAGAGTAGATGAGAGAGAAGAAGGGGCACGGGGGAAACA
AGATGACCATTTAAATATATAGGCCCCTATTATAATGCACATTGTCTGGAAAGCTTCGAGTCTACGGCAGTTTTATAGT
TTCAAGTCATATAGATATATAATTAACAACTGCTCTGACGAAAAAAAAAAA > SEQ ID NO:7465 214345FL Trichoderma harzianum
GACGCTCAACGCAAAAATGTCGGATCTCAGCAACAAGAAGAGAAAGCGAGACGGGGAAAAGGCCGGTTCTGCGAAGAAA
AAGGTCGTTATTGACGCACCGGCTTCAATTGCAACCGTCTCCTCTGTTCTCCGGCCGAAATCATGCCCTCCTGTGATTG
CAAACACTCCAGGAATGGAAATGCCCTCGAATCTGGTCTTTAACTCATATATTCCCAAGAATGCCTCTTCAAAGTCCAA
AAAGGCAGCCGACAAGGCACTCCTGCTGCACTCCACGACGCACCGGAATCTGGACTATACGGCAAGAGAAGAAGAGTCG
CGCGACTCAAAGCCGCTCCTGAACCACTTCATCGGCATCTACGATCCCAAGACTGCCAAATTGCAAGTTGTCGAAGCGA
AAAAGATGGTCGTACGAGGCGCCGTCCGCTCTAAGCAAGTGCCGACTTCTGCAGATCAGACGGAAGCCAAGAAGAGCAT
CATGGACCAGAGGACAGACCTTGGACAGACTTTTGGAACGAAGAAGGCCAAGAAGGTTATCCAAGATAAGGTGTTGAAC
GCCATCGCTCCGCAGAAAAAACCTGGCGACTTCAGCACACCCAAGTTGGATGACGCCTCCAAGGCCATTCTCAACTCCA
TCGGCGCAGTCACATCCACAATGGCCTCAAGAGAAGAGCTGCAGGCAGTCATCGACGAAGCCAAGCCAGTACCCAAGGC
GAATCTCGACGCAGAAGACATTTACGACGTATACCGCCCCGAGGAAATCATCGGAGCAGATATCCTCAATCTGGTTCCT
ATTCGAGAATGGCAAGAGAAGGCTAAACATGGCGAGAGCATCCAGTTCCGCTCCCGATATGTCGTCTCTCGCGTGCAAG
CCATTGCCTCCAACGAAGATGCCGAGATGCGGCTGCGTGTGCTAAGATACCTCTCTATCGTCCTCCTGTTCTATCTCTA
CTCAAAACCCGGTCGCCAAAAGGGCACTCGGCAGTTGCCGCCCCGAGAGAAGCTCCGGGAGCTGCTTGCTCCAGCCCCT
GAGGCGGTCGTTGAAAATATTCGTCGCAAGTTTTCGGATAACGGCCAACTGAGGAAATTCCACATTGACCTGCTTATTG
CACACTGCTGCGCACTTGCCTGCATCGTGGATAACTTTGAGGTGGACACGCAGAACCTGAGAGACGACCTGAGGATAGA
GCAAAAGGTGATTAACCAGTACTTCCACGAGATCGGAGCCAGGGTGAAGCCTGTAAAGGACAAGGCGGAGGATCGAATG
CTGCACATCGCAAAGCTTGCGCTACCGTTAGACTTTCCGAAACAGCGACAGATCAGAGCGCGTCGATAATGGATATAAT
TTGCACGAAGGATCTGGAAAAGTAATTAAAAGACAGAGATGTGAAGGGTTTTTACAAATGGGGAGGAGTTTTGATTCTA
CGAGCGGGCGCTGTGAGATATATATACATATTTCCCATTGTTCGACTTCTCTCACTGCATAGAGGCGTCGTTTTTTTCA
GAAATACACACAGTTTCGCATTCCAAAAAAAAAA > SEQ ID NO:7466 214593FL Trichoderma harzianum
GGAGCGAGATTCACCACGGGACACCGAGTAGGAAAGGGTGATGACGGTGTTGCGGAGACTGAGGGTGGTATTCTCTTGC
CCGAGTATCACAGGAGAATTCCCGCGGATGGACTGTCGGTGTACACAGAGGGCATCTGGGATCAAATCGTGAACAACAA
GGACCTGGATCTGCCGACGCAACAAGAGCTTCTAGCTCAGTTCCGATGTGACGAGATCTCTCGAGAAGTCCTGGTTGCC
TTTGACCTACTTCTGACCCCACTTGAGGAGCAGCAGGCCCAAGCCTCTAAGCTCGGCAAGGCCATTGTGCTTCCCGATC
TGGGCACCACAGCTAGCCAGGCCCGTGAAAATGCTTCAGAGCTTTTGAGGTGCAGGCTAGTCGATACCACAAAGGCGT
CTACACCCGCAAGAAGCAGGAGCTGGAGAGCAAGGTTGACGGTCGACTCAAGACCCTATTCCAAGGACAGATTGCAGCA

FIG. 1 continued

```
GCTCACAAAGCCGGAGTCACGGCCTTTAGCGAAGCCGTTTCAAACAAGGTAAAGGCCGGGCAAAAGGCCGGTGGAGCTT
ATGAATTTGCCGAAATCGTCTCCAACGAGAAGAAGAAGACTACGGAAATTTTCAAGGCAGAGGTAGACAGCCTTGCGAT
TGAGGGCGTCGAGTGGACCAACTTTGTGTCCCAGAACCAGCTCTTTGAGGCTGAACTCGATGAGGTTAGCAGCAAGCTG
CGCAAGGACGAAATCCGCCGGTTAGCCACGCGGGTGGAGCGTTGGGTCAAGTCCGGTTGGGCGATGCCGTCGGCCTAGA
GTTCAACAAGCTAGGATCCGGCAGAGGAGGCTCGGGAGCGCCCGAGGAAGGCCAAAAGCCGGCGACGGAAAAGGATCTC
TGGGACCGAATCTGGAAAGTCTTTACCCGAATAGTCAGCGAAGCCGAGACCCGGTTTGCTGACCGAGCCAAGAGCTTCG
ATGCCAGCGATTCTGAAGTCGAAGTTGGCCTGTGGCGCCTCCGACGTAAGAGCTGGACGGCTCTCCGAGAGAAGATTGA
GGAGGAGGTCATGGAGGGCAACATCCTCTTGAAGCTTAGGGAGAACTTCGAGGACAAGTTCCGATACGACGATGCTGGT
GTGCCGCGCATCTGGAGGCCAACGGACGACATCGAGGGTATCTATACAAAAGCGCGAGAGTCTACGCTCACATTAATAC
CCCTTCTTTCCAAGTTCAAGCTGCTGTCTAACAACGCTTCTCCGGATCTAATTGGATTCATTGGCGTGCAGCCTGCCGG
AGTTGAAGCTGGCGACGAAGAGGATCTCGCTCCTATCGGCGGCGTCGATGAAGAAGAGGGTAAGAGCCTTGAGGAGGAG
ATGACAGTGCTAAGTGAGAATAAGCGACAAGACCTAGTCGTGCGCTTCAAGAAGACAGCCGATGGCGTCTATGTCGAGG
CCAAGCGAAGCGCCATTGGCGGCATGACCCAAGTGCCATGGTACTTTTATGTGCTGCTCCTCGTTCTCGGCTGGAACGA
AATCTGGATGGTTCTGCGCAATCCGCTCATGTTTATTCTTCTCATCTTGCTTGGTGGAGGAACTTACACTGCCTGGTAC
CTCAACCTGCTGGGCCCTATGATGCAAATGGGCAACGCCGCTGTCACTCAGGGCATGGATATTGCTAAGCAGCAGCTGC
GCGAGTTTGTCAACAACTCAGACACTGCCCGACAGGCTCTGGCCATGCCCGCGAGGCAAGACAGCGACATCAGCATGGA
CACGCTGGATAGCCGTGGAAAGAAGAAGACTGAGTCTGAAAGCCTGGATGACATTTAGATGTGAAACGGAAAACATAAA
AGGAACCCGGAGGCGACACATGAGAAGAATAAAAGCGCCCTTTGTATAAATTCTCGAGACATTGTCGGACATTGGCGGA
CACAAGAGCGAATAGCATTGATGAGCGAACAGGATACGAATAATGTCTACACAAGATAAATAAAGCTGATTTATCCAA
AAAAAAA

> SEQ ID NO:7467 215807FL Trichoderma harzianum
CAAAAAGGCTCCAGGCATCGTCTTTGACAAGGAGGACTACACTGCTCGCTACAACTGGTCAATTCCGCTACGTTCATAC
GCGGAAGAAAAAGAACATGTCGCTAACAGCAATCGCAACAACAATGCAGACGGCTCTGCAACGAGCAGAAACGATGGAT
CCCGCCTCTCTAAGCCTTCTCCAGAAAGGCTCTTCCCACAATTCCTCTCCCAACTATGGAGCCTCCGGAACGGTGACAA
GAGGGATATTGCAAGACTATCAGGCGGTACCGACCAGCGATGAAAGCGATGCCACCCGTCCGAGAAAGGTTTCATACAG
CGATGCGGCGAAGAAGGCCGGGAACCATGCGAAGAGCCAGAGCTCTCTGCGGCAACGAAACGGAGTCTCCGGCTCGGAG
GATACAAGATCGCCAACAAAAGCAAAGTCATCATGGACGAAGGAAACATTTCGAAAATTTCAGTCCCTTCAGTTGGAAA
ACAAGGGAAGCGTGGCTAGAGATCACCTGGCTCTCGAACGCACATTTCTAGCATGGCTTCGAACCTCTCTCGCTTTTGC
ATCGATTGGCGTCGCCGTGACGCAGCTATTCCGCCTCAACACTGATAACGCTTCCGCCTCCGATTTCGACCACACAAGG
CTACAAAAGATGGGCCGCCCGTTGGGTGCGACATTCCTCGCCATTAGTATTGTGACCTTGCTCCTCGGTTGCAGACGAT
ATTTCCATGCCCAGGAATGGATCCTTCAGGGCAAGTTCCCGGCAAGCCGAGGGACCATCATTATCATGTCACTGGTGGC
ATTGGCCCTCATGATTTTGTCTCTAGTGGTGGTCATTGTCATCCGGCCATCATAGAGGCTTTGGACAGCTATGGAATCA
CCGACTTTTGACTGTTGATTTTCAGTTGGTTCCTTTTTGGAATGAAGAAGGATCTATGGGCTTGGTACTTGTGATTTAG
GATAGCATTGGGTTTGAAGCATGTGATTAACGGGTTTTGGTGTTTTGGACTTTGCAGGGTAAATGTTTGGATCATATAT
GCATCGATGTACATTTGCAATGGATAGAGGATATCTCTTCACTGATAAAAAAAAAAAAAA > SEQ ID NO:7468 215859FL Trichoderma harzianum
GATTGTCCTTCTTCCAGCTGCCAAAATGTTGAATCCGCTCAAGGCCAACTCGCGCGTCCTTCGCAGGGCCTCCATCCGG
AGACTGGCTCAGCCGTCCGTCTCCGTCATCTCCAATCCCATCCGGAGCGCGGGAAGCCTCTCGCAACGGCCCAATTCGG
GATTTGTGTCGTTCCCCGGCGCTCTCAAGAGCTCCTTCACCAGCTCTCTCAAGTTTGAGACGCCCGAATCATACACAGC
CCTGCCGACGTACAGAGTCGTGGACCAGAATGGCCAAGTGGTTGACCCCTCCTTCACCCCTGACATCAGCGATGAGGCC
GTCATCAAGCTGTACAAGGATATGCTGTACATCTCCATCATGGATCTCATCATGTTTGATGCTCAGAGACAGGGCCGAC
TAAGCTTTTACATGGTAAGCGCTGGCGAGGAAGCCGTGAGCGTTGGCACCTCGAGTGTGCTGGACAAGGATGATCCCGT
CTTCTGCCAGTATCGAGAGCAGGGGCTGTTCAAGGAGAGGGCTTCACGACGGAACAATTCATGTCACAGCTGTTTGCC
AACAGAAACGACAACGGCCGGGGCAGGAACATGCCCATTCACTACGGATGCAAGCCGTTGAACATTCACACTGTCTCCT
CGCCATTGGCTACACAACTTCCGCAGGATTCGGGGGCGGCTTATGCCTTGAAGCTACAGAGACTACAAGACCCCAGCTC
GAAGCCAAGAGTAGCGGCAGTCTTTTTCGGAGAGGGAGCTGCCAGTGAGGGCGATTTCCATGCCGCGCTGAACATTGCC
GCCACACGCTCTTGTCCCGTTGTCTTCATCTGCCGCAACAACGGATTCGCCATTTCCACACCCACTCTCGATCAGTACC
GAGGAGACGGCATTGCGAGCAGAGGAATTGGCTATGAATTGATACCATTCGAATTGACGGAAACGACATCTGGGCAGT
CAGAGAAGCCACAAAGAAGGCACGAGAAATGGCACTGCAGGACGGTGGCAAGCCGGTGCTTATTGAAGCCATGACCTAT
CGTGTCTCTCATCACAGTACTTCCGACGACTCGTTTGCATACCGAGCCCGTGTCGAAGTCGAGGACTGGAAGCGACGAG
ACAATCCTATTACTCGACTAAGGAAGTGGATGGAGGCCAAAGGATGCTGGGACGAGGCCAAGGAAAAGGAGGCCAGACA
CAGCCTGAGGAAGGAAATCCTCAAGGGATTCAGCGAAGCAGAGCGAGAGAAGAAGCCGCCCATTGGCTCCATGTTTGAG
```

FIG. 1 continued

GACGTTTATGAAAGTCTGACGCCCGACCTCAAGGAGCAGATGGGACAGCTCAAGGAATTGCTAGAAACATACCCCGAGG
AGTATGATGTTGCCTCGTACGAGGGCGGAGTAGCGAGCTTGGATGTACCAAAGGACAATTAAGCTATTGATAGATGAGC
GTTTCTGTGTTTTTAAATAGTTTGAAGA

> SEQ ID NO:7469 215934FL *Trichoderma harzianum*
GCTGGGTTGAGCCTTTTTGCGCATCTTGACCTATATTTACACCTTAGAACGACGCATATACATATTCCTAAACATTACG
CTTATGGCGGTTGATACCGAGGGGTCCGCCATCAACATTCCTGCTCCCGCAGCTGCCATGGGACTCACCCAAACGCCTG
GAAAAGGCGCTGCGAGCCACGATCTTCACCCGTCGGGCAAGCGGGCTCACGGCCGAGGAGTGCAGATACTTCGAGGCCT
GGCTCTCGCTGTGTACTTTTTAATCTGCTGTGTGACTATTGTCGCTTCGCAAGTTCTTGGGTGTTGGCTGTATTTCGTG
AACCGCGAGATATACTACGATTACATGGCCTTGACCAAACGGTGGTTTGCCATAGTCGTAACTTGGATGACACAGATTT
GGGGCCCGGTAATCATCCGAATCAGCGGCGATGAGTCAGTCGCGGGAGAGATCCGTCCCACGGACGGTGGCGGAGTGCA
GTTCAACTTTCCTGAGCGGTTGGTGATGATAGCGAACCACCAGATTTATACCGACTGGTTGTACCTCTGGTGGGTTGGC
TACGTCAACCGAGCTTCGGCGCACGGCCACATTTACATCATTCTGAAGCAGTCACTGCAGTATATTCCCATCATCGGCT
GGGGCATGACTTTTTACAGCTTCATCTTCATGTCTCGCAAAATGGCAACAGATCAGCCCCGGCTGGCCTACCGACTGAA
GAAGCTGAAGCAGACCAGGACCGATCCCAGTGGGAAGGAGTATCGCATACCCATGTGGCTACTGCTGTTCCCTGAAGGC
ACCAACATTTCTGGAAATGGTCGACGAAAGTCTGCTAGCTGGGCAGAAAAGAAAGGGTGGAAAGACCCTGAGCACGTGC
TGCTCCCTCGTAGCACTGGCAGCTTCTTTTGTCTCAACGAACTCAGAGGAACGGTCGAATACGTCTACGACTGTACAGT
GGCGTATGAAGGTGTTGGGCGAGGCAAATACGGCGAGAACATCTTCACACTCTCTAGTACCTACCTCCAGGGCCGACCA
CCCAAGTCCGTCAACTTCTACTGGCGAAAATTCAAGCTTTCAGATATTCCACTTGATGACGCAGACGAATTCGATGCCT
GGCTGCGTGCAGAGTGGTACAAGAAGGACGCATTGATGGAACAGTACCTGACCACAGGACGATTCCCTACCATGGCCGG
ATCCAAGATCGACTTTATCGAGACCAAGGTCCAAACGAAGACTCCATTGGAGATCCTCCAGGTTTTCTCCGTTGTCGGC
ATTGCTGGTCTCGTCTGGCACAATTTGCAGCGATTTGGAGGTGCGGTCGGAAGAAGGTTCGGCTTCTTTGTAGAATG
AAGGTTTGTCGGTTTGAGGTTGTCGAATGGAGAAGGTTTTTTCCATTGGCACCTCACCTTTAACCCCTTTCCTAAGAG
CGTTTGGCGATGTTTGTGGATTTCATTAGCGCTAGTATGGTATGCTTTCTGGCACGGATTTAGTATTTTCTTCTTGGAT
AACCAATGGGGCAGGATAATCAAGACGGCGAGTACAGAAGATTAACTGCAGACTTTTGGGCGTCTTCTGCTGCTGGTGC
GGAGTTTTGAGGAGGGACTTTGCCTTGGGTGAATCATGAATTACCGAGGCATCGCGTATCATGGTGAACGGAAGGAATC
GGGTTTGACTGGGCTTGGCTTGTTTGGCTTGGGTTGATTGGATTCTATTGGATTTAGTACCACTTTACAAGTGGCAATA
GTAGATAATGAAGCGTTCTTCATTGGAAAAAAAAAA > SEQ ID NO:7470 213279FL *Trichoderma harzianum*
ATCATCAGCTACAAAGACATCTACTCATCTACACACAAACAAACATTCAAAAAGCATCATCACACAAAGCTTCCAAAGC
TCCAGCTTCTCAACAATCCACTATTCTCTACACTTCAAACCACAACAACCACAACCAAAACCTTCAAAATGTTCGTCGG
TGACCTCGTCCACTTCCGCGCTGCTCTCAGCAACGGCATCACCCACGAGATGATTCTCTGCCCCTCAGCCGCCACTTCT
CCCGCCACCTCCGCCGCAAACACCCCAGACAACCGCTCCCTCGCCTCGGAGAAGAAGAAGAAGCGTTTCTCCTCTTTCT
TCTCCCGCCCTCGCCCTTCTGTCAAGGCCGCCAACGTCGGTGCTGGCATGAAGCTGCCCATGAACATTGCCTAAATAAA
ACCAATCTTTCACACCAACAAAACAACTACAACAATGTGCTCCTGAACTGCGGATATAAAGAGGAATGGATGAACCGGT
CTATGCCCAGCACGATGGAATAAAATACACAAAACACACAAACACAAAAAACACACTCCTTTAAGAGACGACGACCAAC
GAAACAACAACACCTAAAAGTTTTTTGCTTTTTCCGACACTACTTTTTTCTTTCTCTTTTGTCACAAGTTTTTTTGGG
CATGGATTTTTTTTACACACAGGGCAGGCTGGGAGCACAAAAAAGTTTTTATGAGTATTAGATTCTATACCCATTTGAT
TCGAGAAAACGCAATGATACAAAAGGGGGAGAGGTATCAGGGAAGAAGAGGGGTGGATTAAGACATAGACACACTACAT
TTTAATAATATATAATCTCATTCCCCAAAAAAAAAAA > SEQ ID NO:7471 214620FL *Trichoderma harzianum*
ATTACAACATATATACCCATCATGACTATGTGGGGTTGGATTCACGCGATAGCAGACTATTTGCTGTCCTGGGTGAAAC
TCGAGCAAAATGCGGAAATTGGGTGGCGTTCGTTCAATCGAAAGACCGGAAAGTTAGAGCGCGAACAACAGACACTGTG
GAAGAAGCTCAAGCTTCTCGTCTTATTTAACCCACTCATGGAATGGATTGATAGGAGTCAACTCATGCGTTTATACATG
CATGAAGAGTCAATTGCAGAAGGGCGAAGAGAAAGAACAACGAGTTCCAGGAGGCGCATCAAGGCTTTCGTTGACGCCT
ATGGAATAAACATGCATGATTTCGAGCCCTCTGATATCAGTCGCTATCCTACCTTTGAAGATTTCTTCACTCGTTCACT
CAAAACAGAGTCGCGTCCCATTTGTAATGTTGACGACCCTTCCCATGCCGTCGTGGTGGCTGACTCGAGAGTCGTCGTC
TTCAATTCCATTGGGGAAGCAAAAGCGTTGTGGATCAAAGGCAAGAACTTTAGCCTCAATGATCTAGTCATGAGCAATG
AAGTAGGTGATAAGTTTAGAGACGCTGCCATTGCGAGCTTTCGGCTTTCACCGCAGGACTACCACCGGTACCACTCACC
TGTCCAGGGTACAATCCAAAGCTTCCAGAGCTTACCGGGCGATTACTACCAGGTCGATCCTATAGCTTTACAAAGCAAG
GTGGATATATTAACACGCAATAGACGGGATTTCGTTGTAATTGAGACGAAGGAGTTTGGGAAGTTCTATTTGTGGCGA
TTGGTGCGACGGACGTCGGAAGCGTGCGTATCCACGAGAAATATCAGAGGGCCGGGCAAACAGTTAAGAAAGGAGATGA

FIG. 1 continued

ACTGGGCGTTTTTCAGTTTGGAGGCTCATCTATTATTGTTGCTTTTCAACGTGGCAGTATCAAATTTGACGATGATCTG
TTGGGACTGAGTGAGCAGAAAATCCAGACGTCTGTGGAGGTTGGTATGAGCCTGGGGTGTTCTACGTGAGAGGTTTCAG
ACAGGGTCTTACATGAATATATGAGAAACTTTGCAAAAAAAAAA

> SEQ ID NO:7472 214828FL *Trichoderma harzianum*
CATTCGCCCATCATGTCGGCTAGAATCCCAGCTCTTGTTTCAGCACACGTCAGCGAGGCGGCGCGACAGAAGATTGACA
TTGTCGCCAAGTTTGTCGAGGAAGAATGCATCCCCGCCGATCCCGTACTTGAAGCCCAGGTTGGCGAAGGCGATAACCG
CTGGGAGAACCACCCGTCCATCATCGAGGAGCTCAAGGACAAGGCACGCAAGCTGGGCTTGTGGAACATGTTCCTGCCC
AAGGGCTTCTACGCCGAGTCTCCCGGCTGGACCAACCTCGAGTATGCCCTCATGGCAGAGTGGCTGGGCCGCTCGCGCA
GCGCCTCGGAGGCGTGCAACTGCGCTGCTCCCGATACAGGCAACATGGAGGTGGTGGCCAAGTACGGCAATGCCGCGCA
GAAGGAGGAGTGGTTGAAGCCCCTGATGGAGGGCAAGATTCGCTCGGCTTTCCTGATGACTGAGCCCGAAGTCGCGTCA
TCGGATGCCACCAACATTCAGCTCCAGATCACTCGCGACGGCGACCACTACGTCCTCAATGGCTCCAAGTGGTGGTCCA
GCGGTGCCGGCGACCCGCGATGCAAACTCTACATCGTCATGGGCAAGACTGATCCCAACAACAAGGATCCTTACAAGCA
GCAGTCAGTCATCCTGGTCCCTGCTGGTCTGCCTGGCATCACCATCAAGAGAATGCTCAAGGTCTACGGCTACGACGAC
GCTCCCCACGGCCACGGCCACATCACCTTCAACAACGTGCGCGTTCCGGCCAAGAACCTGGTGCTCGGCGAGGGCCGCG
GATTCGAGATTATCCAGGGCCGACTGGGACCTGGACGTATCCACCACGCTATGCGTAGCATTGGCGCTGCTGAGCAAGC
TCTCGACTGGATGCTCACGCGCGTCAACGACGAAAACAAGAAGCCTTTTGGCAAGCTCCTGCGCGAACACGGCGTTATC
CTCGAATGGATTGCCAAGTCGCGTATTGAGATCGATGCAGCACGCCTCATCGTCCTCAACGCCGCCGTCAAGATGGACC
AAGAGGGCCCCAAGAAGGCTCTCACGGAGATTGCCGAGGCCAAGGTCCTCATTCCCCAGACCGCCCTGAACGTCATTGA
CCGCGCCGTCCAGGCATACGGCGGTGCCGGTGTCTCTCAGGAGACTCCCCTGGCCAACATGTGGGCTGGCATCCGAACG
CTTCGTCTGGCCGACGGCCCTGATGAGGTGCATCTGCAGCAGATGGGCCGCAACGAGAACAAGCGCGGCAAGGAGACGG
CGGCCAAGCTCAAGTGGCAGAAGGCCAAGACGGCGGAGCTGTTGAACGAGATACGGCGTTGAGCTTGCCGAGCCTGGCAC
CAAAATCAAGCACGCTGCCAAGTTGTAATGAAAGAATGGCTGGTCTGTTTAGATTGTCTTGTTTTGAACTGTCATTGGT
TTGTAAAATACGGGAACTAGGGTAATCTCGAGATGTTGCATTGCAAATAGCGTATATATATTATAACTCACTTCATGAA
AAAAAAAAAA > SEQ ID NO:7473 215863FL *Trichoderma harzianum*
CCCGGAACAAGGCCTTTTTGGTCATCGCTTCATTTCGCATATCGGCGCCATTCGTTCTTTCCACCTACTGACATACAAA
CGCACCTTATTTTCTTTCATTCTTACTCTTTTCGTCCAGCCATCCGCTCTCTTTGTCTTGGCCTCATCACCGGTAGCTT
CCTGACAGTAATTCGCCCGTCTAGCCTGCCGTCTTGCCCATCAAAAGACAAAGCGCCAGGAGGGGAGAACCCCAGTATC
GCGTCTACCAGCCCTGCGGCTTCGATTCGGCTCAACCATCCATCTATCTCGGCGGCGTCAAAGACAAGCTCCGACGAAT
CCAACTAACCAGAGCACCGAGTCTTTGCTCTGCGTCAACTTGAACTCAGCTCTCTCCTTCGTCTATCTTACGCTTCGAG
ATATTCATCATGTATTCTTCAAGGCTTATTTCGGTACTGGTCGTGGTGGTGTCCATCCTCTGCATGGCCCAGGCCACTT
GGTGGGACAACCAAAAAGTTCACCACCGAGGATTGATTCGACGAGCGGATTCCATTTCCGAGGCTCTGAATGGCTTGAC
CGGCTCTTCAAGCCCGAGTAGTCCACCCCCAGAATCCTCAACTCCATCGCCGCCACCGGCCCAAAGTTCCAGCTCTCCG
TCTGCTGATCCTACATCCTCCGATGAAGGACAATCAAGCACCTCTGCTCCTCCATCTTCTACGCCACCTCCCGACTCAT
CTTCTTCTACAACTCCTGCCCCTGGCGGCACAACCAGTTCTCCTTCTTCCACCTCGGCTGGCTCTACAAGTGCTCCTTC
TGACTCGACCACACCGTCCGCCTCTGCTCCATCCACAACACCTCCCCCCAAAGCACCTCGTCAGCGATAAGGGGAGC
AGCGAGAACACGACCAGCGCTGGAGGAGACAACAAGGATGGATCTTCTAATAAGTCGGAACAGCAAACTACCTATGTCT
CAACCAAGGTCGAAGTTGTTGTCAAGACCAACTCTGATGGCTCTAAGCAAACCCAAACTACCACGACAAGGACCACCGA
GACTGCAGCCCTTAACGCCGAGAACTCTAAAGCTACTGGCATGTCGGTTCAGACCCGTAACACTATTATCGGTGTCGTC
GTCGGTGTTGGCGGTGCCATCATCCTCGGCACCCTCATTCTGGTCGCCTTCCGAGTCTGGGGCCGCAAGAAGCATGCCG
AGGAAGCCGATGGCCTCATGGCTTACAACGCCGACATCGTTGCCGCCGAGAAGTCTCCCCGAGGTAGTTCATCGGGTGG
CCAGCGGAATCCGTTCCAGTCGACGCTGGAGAACTACCACCAGCCAGTAAATGCGTCGGCCAACTTTTAAGATTTTTTT
GGGCGGTGAGATTTCTTTTGCAGCTGTTGCGGCATGCGGATATGGTCCACCCCAAAGCATGGGTTACGATGTATGTCGA
AAAGATTTGACAGGCGATGCTGCAGACTTTTGGAAGAGAGCGAGAAGAAGGATTAAAAAAGGAAGAATTCTGAGCGAGG
CTACTGCATAGCGAGCCCTTTTATTTTTCTGTTGCTTTGCATATAGAATTGATACTGTTTATAAGGAAAGAAAGCGTGA
TACCTACCTAATTACTTGGAACACTGAATATACACATTTTTTTACTAAAAAAAAAAAAAAA > SEQ ID NO:7474 212767FL *Trichoderma harzianum*
CAGCAAACACCCAAGCAACAACAAAAGCAAAGCACTCCAGCAACAAACATCTACCCACCTCACAACAACATCAACCAAC
CTGACAACTTCTTCACAACTCCACAAACAACAACACTCAACCATCACAATGGCTTTCTTCCCTCGCACTTTCTACCACC
CCACCGAGGCCTCTTTCACGCCTCTCTTCCGTCTCCTTGACACTTTGACAGCTACAGCCGACAGAATGGCAAAAGCCG
CTCTGTTCGCCGCCAGCAAGTTCCCCAGTGGCAGCCCAAGTTTGACGTGCGCGAGACCACCGAGGCCTACGAGCTCCAC

FIG. 1 continued

```
GGCGAACTTCCTGGCATAAGCAAGGAGAACATCCAGATCGAATTCTCTGACGCCCAGACCTTGGTTGTTCGCGGCAAGA
CTGAGCGCACATACACTGCGGGCACATCACCCTCTGCTTCCGTCGAAAACACTCCTTCTACAGAGACTGTCGCTGAAAA
GGCCGAGTCTGAACGCAGGAACTCGCACCAGGCGACTGTTGAGGACGAAGACGAGGCCAGCGAGCGCGAGTCGGGCTAT
GAAGTCGTGACCACCGAGGAAGAGAAGAAGCCTGAGGCCAAGACTCCCCAACAGCCCGCCGACAAGGCCAAGTACTGGC
TCACCGAGCGCAGCATTGGCCAGTTCTCGCGCAGCTTCCACTTCCCTGGTCTGGTTGAGCACGACGCTGTCAGTGCCAG
CTTCCAGGACGGCATTCTGAGCATCACCGTTCCCAAGGCGAAGCACGAAGCCCACCGAATCTTCATCCAGTAAACCATT
TCACAAATCGGAAAAGACACTATCTCACAACAATGTAATACTACTACAATCTACCTTGGGATTAGCTTTGCTGTCTGCC
TTTCTCGATTGCATCAATGGGAGTTGGGGGGATTTGGGATCAACGGATAATTTTCAACGTGTGCACTTTTTTTCTGGAA
CTGGCTTGCTTTTGGTAACTAGCATATAGAGCATTTACTGCAATAATACACTCTTTTTCGTATTAAAAAAAAAAAAAAA

> SEQ ID NO:7475 214250FL Trichoderma harzianum
ATCCTTTTTCTTTCTTCAATATCGCCTCAAATCTCACTGCAACTCTCTCCCCTCTGCGGCATCTTCACCATGGCTGAAC
CAACCCCCGGCCTCACTCCCGAGCAGCTCTCGGCCTTCCAAAAAGACGGCTATCTCATCATCCGCAACGCCCTCAAGCC
AGAAACCGTCTCATCGCTCCTTAGCGAAACAAAGGGCCTGCTCGAGGGCTTCTCCCTCAAGGACCACCCGCTGACTCGC
TTCTCCACGGGCGAGAAGTCGGACCACGTGGGCGACGACTACTTCCTCACGTCGGGCGACAAGATCCGCTTCTTCTTCG
AGGAGGACGCCTTTGACGACGCGGGCAACCTGACCAAGCCCAAGGAGCGCGCCGTCAACAAAATCGGACACGGCCTGCA
CGTGCACTCGCCGCCGTTTGCGCGGCTCATTGACGAGGCGTCGACGCGGGCCGCGGGCGAAGTGAGTCCTGCGGCTGTG
GCTCGTGATCTCGGGTTCAAGGATGCGCGGTGTCTGCAGAGCATGGTGATTTGCAAGCAGCCCGAGATCGGGGCGCGG
TGCCGCCGCACCAGGACTCGACGTTTTTGTACACGAGCGCGCCGTCGGCCGTGGGCTTCTGGTATGCGCTGGAGGACGC
GACGCTGGAGAATGGGTGCTTGAGTTTCTTGCCGGGGTCGCATCGCTGGGCGCCCGTGGAGAAGAGGCTGGTGCGCAAG
GCGGGAGGTACGGGCACAGAGATTGTTGACAATGATGGGCTCAAGTTTCCTCCTGGAGAGGAGTATGCGGGGAGCAGC
TGGATGGGGAGTATATCCCCGGTGAGGTCAAGGCGGGTGATCTGGTTTTGATTCATGGTAACATGCTGCATAAGAGCGA
GAGGAACACGAGTCAGAAAGGTCGTATCATTTACACGTTTCACATCATTGAGGGCGAGGGAAGGACGTATGATGAGAGG
AATTGGCTGCAGCCGCCGAAGGAGGGCTTCACCAAGTTGTATGCCTAGAATCAGCCTGCTGGGGGAAAGGAATTTATCA
GATCAATGCTTCCTTTTTTTGTTAAAAAAAAAAAAAAA > SEQ ID NO:7476 214367FL Trichoderma harzianum
ACCCACGCGTCCGCGACCTGTAACTGGGTACGTGCCTACATGTATATCCGGCATGCCCTCATGTAGGTGACATCTAAAC
CATGTTCATGCGGAGCATCTCGACGGCGCCTATCTGCTCCTATGAACGGCCAACCCTATACACATCGTACTCTGTACAC
AGTACATGTACGCAACTACAGTAAAACGACATGGTAGTATCCCGTGGTGGCCATCCATGGGCTACTCTCTGTATGCTTT
ATAGGCCCGGAATAGGATCCCGCGGAGCCGGAAACCGTGGGGATGGAAGGCTGTGCAAAGACTACATGTATAGTTTACG
GCTCAGAATTGTTGGCCGGAAGCTTGTTGTCGTTACGGGAGAGAGACCGATGTGACAAGCTCCCCTCGAGTCAAGACCT
CTTCATTTCATATTCACCAACGCTGGATAAGGTACTGTAAATGAACTCAGGTGTGCTCTCAGGTTCACATTTACAGGAA
TCATGCCCTCCACACTCTCGGGGCATTTACACGGCCCGAAGAGAATGAAGAAGGAGTGTGTGCTCTCCTATCTGGATAA
CGGGGTTTCATTGTGGGCATCTTATGCCTGCATGGATAGCATATGATGCCCCAGCCTCTGCAAGAAAGACAACCGTAGC
TTTCGCGCGCGGGTTCTTTACCGTTTTGATTCTTCAACGGCGGCGCCACTCTGAAGCCAGCGCTTCCTTGCCGAAGTAC
GGAGACACACTCTCTGCCGGGCTGAAAGCACACCCCTTCGATTCTGGCTAAAGCAAACATTATGACCAACCAACAGCCC
AAATCCAGCAACACTTTGTGATGAGGACCATGAACGACAAATCTCCGGCCCAGAAAAACTCGTGTGGTACCCTTAAAGC
CGGCTGGTCCGACGACACTGTCGTCACCTCGAGGCTCCCAGCAAACACACACCTTCAAGATACACATCAGCTAGCCAAA
CAAACATATTCCTCTAAAAAAAAAAAAAAAAA > SEQ ID NO:7477 214840FL Trichoderma harzianum
AGGAGCGATTGGTCTCCGAGACCAAGAAGCTCACTCAGGGCGTCCCCTGGGACCACTCCAACTTCATGGGCCCCGTGAT
TCACGAGGCTTCCTTCAAGAAGCTCTCGGGTGCCATTGACGAGGCCAAGAGCGACAAGGACCTCGAGCTCGTCTTTGGC
GGCACCTACGACTCGTCCAAGGGCTACTTTGTCGACGGCCATCTACCAGGCCATCAGCCCTTCCCACAAGTTCCTCT
CCACCGAGTTCTTCGGCCCCATCCTCACCGTGCACGTCTACGACGATGCCGCGCCCGATGCCTTTGCCAAGGTCTGCGA
GCTGGTCGATGGCACCTCCGAGTATGGCCTCACCGGATCCGTCTTTGCCAACGACCGCGAGGCCGTGCGCTTTGCCGAG
GAGAAGCTGCGCAACGCGGCGGGCAACTTTTACATCAACTGCAAGAGCACCGGTGCTGTTGTCGGACAGCAGCCGTTTG
GTGGTGCCAGGGCCAGCGGCACAGACGACAAGGCCGGTAGTCCCAACCTGCTGACGAGGTTCGTCAACATCCGGTCAAT
TAAGGAGGAGTTTGCGGCCACGACACAGGTATCATATCCTAGCAACGAGGTTTAAACCAATCCGCCGACACCTGCATGA
TGGACTGGGAGGAATGTGTAAGAGGGGTGTAAGGTTGATGATGTATGGCGTTGATGTTTCTCCATTTTGAGTCTGTAAT
TTCTTTGCATCTAGGGTAGGATGCTGGCGTTGAGCGACGGGAATCGTCGACATGCATAATCTCCCGTATTGGGAGAAAC
CCATCAAAACCACATTGATGATATTGATGTTAAATTGAAACCAATTGAAACCAATTGATGAAAAAAAAAAAAAAAAAA
```

FIG. 1 continued

> SEQ ID NO:7478 215938FL  Trichoderma harzianum
CTTTGTCATGTTGTAATGCAGGATCACGATTAATCTTTTCTTCTTCTCTCAACACACGGCCATGCGGCGTGAGAGGGAT
GACTCAGACGATGAAGACATTCCGCTGCATCACAAACGCCCGTTTGGCGCTGGGCTGAAGCGCAAGAAAATTGAGTTTG
TCAAAGCCACAGACGCAGACGCAAGCAACACGATCAAGAATCTGGGCAAGGAAACCGCCTCTATCGGAGATGTCTACGC
CAGCATAGTCCTAGGCGGCAGCTCCAGGGATTCATCATCAAAACCTGAAGGCACCAGCGATGAAAAGGACGACCAAAAG
GAGGACGCTGTTGAAAAAGAGCCGGAACCTCCAATATGTCCCGTCTGCTCTCTTCCCATCACAACGACGCTGCAGCAAC
ACGAGGCCTCGCTTGCCCATCAAGTCAGCCTGGAACACTCCCACCCTCCATCTGCACTAGATCGATCGCGCATGGGTTT
GAAAGCCCTGGAATCTCAGGGCTGGGATCCCGATTCCCGTCTTGGCCTGGGCCGAGAAGGCGAGGGCACCCGGTTCCCC
ATCAAGGTAGCCAGGAAAGAGGACACGCTGGGAATCGGGGCTACTCGTACGCAGCCAAAGCAGGCGGTCCAAGAGAAGC
CTCGGGCTCTGACTGGCAAGGAAATGCGCGCTCTGGCGGACAAGGAGAGACGAAAAGGGGAGAGGCTACAGGCTGAGAT
CTATGGACGGGTGGATGTGGAGAAGTATCTCAGGGGGAATGGAGGTGAGGATGGCTTATGAGAAGTACAAAGAGCACAA
CGAGACGAATGATAGACTGCAGATGGCCTGGGATATAGATGTGGTTGGAGGAAAAAAAAAAAAAA > SEQ ID NO:7479 215059FL  Trichoderma harzianum
GGAATAGAAAGACGATACACAAGACAAGGAATCAGACAGGACTTGCACAAGACATAGATCACAAGAAACGCGACCTCAC
CTCATCCTCGACGATGCCTTTCAACACAGAGCTCACCCGCCGCCTGGGCATTCGCGTCCCCGTCATCCAGGGCGGCCTC
ATGCACGTCGGCACCGCAGACCTCGCGTCCGCAGTCTCCAACGGCGGCGGCCTGGGCATCATCACCGCCCTCATCTCCC
CCACGCCCGAAGCCCTGCGCGCCGAGATCCAGCGCTGCCGCACCCTCACCGACAAGCCCTTTGGCGTCAACCTGACCCT
CCTCCCGTCCCTCCTCCCGCCCGACTACCCGGCCTACGCCCAGGCCGCCATCATCGACGAGGGCGTCAAGATTGTCGAGACG
GCCGGAAACTCGCCCGGCCCGGTGATTCGCCAGCTCAAGGCCGCGGGCATCACGGTGCTGCACAAGTGTACGACGATTC
GTCATGCCCAGAGCGCGATCAAGTTGGGCGTCGACTTTTTGAGCATTGATGGGTTTGAGTGCGCGGGACATGTTGGCGA
GAGCGACATTACGAATTTTATCTTGTTGAGCAGGGCGAGGCAGACGCTGAATATTCCGTTTATTGCTTCGGGAGGGTTT
GCTGATGGCCAGGGACTTGCGGCGGCGCTGGTGTTGGGAGCCTGCGGTATCAACATGGGAACCCGTTTCGTAGCCACCC
AGGAAGCACCTGTACATAATAATATCAAGGAGGCCATCGTCAAGGGCCAGGAGACGGACACGACGCTGTTGTTGAGACG
CTGGACGAACACCACGAGGCTGTACAAGAACAAGGTGGCGACGGATGCGCTAAAGATTGAGAGGGAGAGCAAGTCAGGC
GAATTCTCGGAAGTAGCACCTTATGTCAGCGGAAAGAGAGGGAAGGAGGTCTTCATTAACGGCGACCCTGAATACGGCG
TCTGGACGACGGGCCAGGTCATGGGCCTTATTCACGACATCCCGACCTGCGGCGAACTGGTTGCTCGTATTGAAAAGGA
GGCGGAGACTGCGCTGAGGGAGAAGCTGGCTTTGATTGTGTCTGATTCGAAGCTATAAGGAATGAAGTAACGGCATGGG
TTCAGTCGATAATAATGAATGAAATACGGTTCCTTTTTAAAATAAAAAAAAAAA > SEQ ID NO:7480 215163FL  Trichoderma harzianum
CCCACGCGTCCGCAGATGGTGGCGCTCAACCATCCCACTCTTGTTCGCAAGCTTATTCTAGCTGGAACTGGGCCTAGTG
CCGGTGAAGGTATTGAAGGTGGTGATCCGGTCATTTTTGGGCGTCTTGCTTCAGCTTCAAACGATGCAGAAGAAAAGAG
CGGCTTTTTGGAGGGCTTTTACTCCCTGACTGCCAAGAAGCAATCTCAAGGCGGGAACTGGTGGAAGCGTATGACAACG
GCTCGCCAGAATAGGTCTGATTACCTTGGACCTGAAGGCACCAAGGCTCAGATCGACGCAGTTCTTCGCTGGTCGAACC
CTGAATATGTCTCTGAGGGCTCATACAACCGTCTGAGCGAGATCAAGATCCCCGTCCTCGTGGCCAACGGCACCCACAG
TCACAGCTGGGTCATGTTCAAGAGACTGACCAACGCTGATGCCCATCTCCACTTATACCCGGATGTGGGACATGGGTTC
TTGAACGAGTATGCAGGCCAGTTCTCTGGCCTTGTCAACCAGTTCCTAGACGCTTAAGTGGGAATCAGGGGTTCTTTAA
AGGCGCGAGTCTATCTATTTATGGGTTGTGTGGTTTCTATTGGGTCTGGGTTATATATAGGCTTCGTAACTAAATTTAC
TTACAACTGCATATGCTTCTATAAAAAAAAAAAAAG > SEQ ID NO:7481 215293FL  Trichoderma harzianum
AAAACCCAAAAAAATCGCCATCAATTGCGCCCCGGCCAGCGATTCCCTGCCACCGAGACGAGCCTCCTCGAAACCCGCC
GCTTCTCCCTAGAGCCGACCCGGTTTCCTCTCTCTCACTCTCTCCTCCCTCTCCGGTCCAACCGCCAGACTTTCGCTCC
ATAACCCATCATGGCCCCCTCATCGCTTGCTCGCCCCATGCTCCGCTCGCCGGCCCTGCGCCAGCTTGCCTTCCGCCGC
TTCGAGAGCTCTGCCGCCAGCAAGGCCACCGACGCCGCCAAAGATGCTGCCGGCAAGGCCAAGGAGTACCAGGCAAAGG
CTGCGCAGGGGCTGTCGCGCGTCGCGGGTGCTGCCGGCCCTGCCATTGCCCGAGCTGCTCGTGGCCTCACCAACGCGCT
CGGCAAGGTCGGTGGACGCACCGGCAAGCTCATCAGCTTCGTTGAGAAGCAAACCCCTCAGGTCGTCTACTACGGCAAG
GTTGCCGTCGAGACTAGCAAGATTGTCTTCCACGCCCAGAAAATGAGCCCTCCTTCCGTTGCCACCTTCCAGAACTTCT
ACCAGTCCCTGTGGAAGTCCATCCAGAGCGGCGCCATTCTCAAGTCTCCCCAGAACCTTCTCCAGCAGGCCCGCAGCCT
GACTCCTGGCCAGCTGGCTGCTGGTGGTGTCATCTTCGCCGAGTGCCTGGGTTTCTTCACCGTTGGCGAGATGATTGGC
CGATTCAAGCTGATTGGCTACCGCGGAGAGACTGCTTCGCACCACTAAACGTGTCTGCGAATGTCTAATTCCTTTTAAT

FIG. 1 continued

```
GTTTTTAAAGGAGGTCAAAAATATCAATAACCCAAGCCTGGTCCCACCCGGCCAAACTTGGTTGATGCTCGAAGAATGA
GAACTGTCTGCGATAGAGGAAGAAAGAAAAAAAATCTGGAGAGTGAATGAAGAATGATGGCAAGCACACACACATCACA
CGCATACCATATAGGAAAAAAAACATGAAAATCGGCATGTACGGATAGACAAAGAGGAACGGAATAGAGGGAAACATGGC
CGGGTGTGACAACCCCCGACTGACGAAGCGAGGGATATCTGGTGTGACCAATTGGTTGGCAGAGAAAAAAAAGAAGAG
CGAGAGAATGCGTGGCGGGCGAGACGAGGCGAGGAACGGGAGGGATTAGGAAGAGGTTTGGGCTTGGACATCTGGAGAA
TCCCTCTTTTTGCCTCGTGTGTATACGTGTGAGCAACTTGGTTTTTACCTTTTTATCTTTTTCTTTGTTACACCCCCTT
TGTCACGCATACACCCAGCTACAACCATGTACATCAGAGACTTGCTTGATGCCATAGCAGCAGAAGCAGCAATTTAATC
CATGACGAAATTCTTCGGATGTTCAAGGAAAAAAAAAAAA

> SEQ ID NO:7482   215405FL  Trichoderma harzianum
ACGGTCACCGCTCAAGGGCTTCCTCGCCGCAGTCACGATGAAGAACGGGCTATTACCACCCTTGCGATTCCTTCGCAGC
ACCAGCTTCCTGGGCGCAAACCAGGCACGATGGCTTCACAAGACGAGGCCGGCTCCGACAATCCCACAGCCTAGACCAT
TCGTCCCCGACGTCCAGACCTTCCTCACGCTCATTGGCCGCGGCCTCAACAAGCACGCCTCCAAGTTCCCGTCATGGGA
GTCTCTCTTCTCCCTCACCTCGCCACAACTCAAGGAGCTTGGAATCGAGCCTCCCCGCAGCCGCAGATACCTGCTGCAG
TGGATGCAGCGATACCGAAAGGGTGCGCTGGGACCTGGCGGAGACTTCAAATACGTCACAGACGGCCAAGCTCTGCTGA
AAGTAGCAACACCACCGGCCTCTGTTGTCAGCGATGCGAAATATGTGGTCAATGTGCCTCAAGACCAGGAGGCAGGTCT
GGGGGATTCTGAAATCCTTCCTCGACCCAATGGCTACACAGTTAGAGGACTCAAGTCAATAGCGGGGCCGTTTGCGACA
CCCTTGCCGCAACAGGCCGGTGCAGTCGTCAAAGTTACGGAGGGCATGTGGGAGCAACGCCAAGGACGCAAGATTGATG
GTGGTGAGAGAAGAAGGGCGGAGATTCGCTTCAAGAGACGGTCGGTAGAGCGGAGAGCTGAGCGCGAGGCGGAAGCGTT
GTCCGGCTTCTAAACAGGAGGACGCTTGATGGCTAGCGTATTGTATATTACGAAAACTCTGTAACCAATTGTTGTTATT
CTAGTGCTAGCAATCGAAGCATTGCCGTCTCGAAAAAAAAAAAAAA > SEQ ID NO:7483   215678FL  Trichoderma harzianum
CAGCAAACAACAATACAATCCATAGAGGATTACCTCTCAACTCAACCACCTTTACGACAATCGCAACTCAATAAGATTC
TTTCAGTGTATTATCACTCAAGATTTGAATTTCGATTCGACCAAGAAAACTCCAATCAAATTTATTACACCATATAATA
TTTTCAACTTCAAACATTTTTCTCAATATGTCTGCTGCTACCGTCACCCGCGCTGCTGCCAGCACTGTTCGCAAGCCTA
TTTCCTTCTACACTCAAGTCCGAAGAATGGGCCGTGTCTTTGAGAGCCACCCATACGAGAGATTTGCAACCACCATGAA
GCCTGCAAAGCCCGACTACTACAAGAACATTTCTTTCACTGCTGGCAAGGTTGTCACTTATTTCCCCATCATCGGCGCC
ATGCTTGGCTGGCCCGTCCTTTGCAAATGGGCTTTGGACGGACAGATCGGTCGCCTGTAAAGAGGTGATAGAGGCAATG
GTATAGAGTGGGACAGCAAAAAGAATATAGAGATGTCCATCTTTCGACTGTATATATACACTTTTGGGCGTTTGGATGG
GACTATGGGTGCGAAGCATATTTCGGCGCAACACAGATTAATTCAATTTGGATTCTCTTTGTTAATTTAAAAAAAAAAA
AAAA > SEQ ID NO:7484   219193FL  Trichoderma harzianum
GTCAGCAATCCGTTCCCAGAGACCGACAAATACCTTTCGACAGGTTGCCATCTCTTCTACCCATCGCATCGCCATGGCA
CCGCCTAAACGCAACAGCAGCTCGCTGCCTGCCGGCTATGTCGAGGACAAGTCGAAGGGCGCAATGCTCAGATTCCAAG
ACTCGCTTCCTCGCCTCCCAGTCCCGACCCTCGAAGAGACCGCCAAGCGGTATCTCAAGAGCTTACACCCCATAATCTC
CGCCAGTGAACTCGAGAAGAGCACAGCGGCCGTCACCGAGTTCATCAAGCCCGGCGGAGTTGGCAGCAAACTCCAGCAG
AAGCTCGTTGCCAAGGCCCAAGACCCCAAGACAAAGAACTGGATGTACGAGTGGTGGAACGATGCTGCGTACCTGAGTT
ACCGCGACCCGGTAGTGCCGTATGTCAGCTACTTCTACTCGCACAGAGATGATCCCAAGCGACGCAACCCTGCCAAGCG
GGCTGCGGCGCTCACCAGCGCTGTCCTCGAGTTCAAGAAGCTTGTCGACAGCGGCAGCCTCGAGCCGGAGTACATGAAG
AAACTGCCCATTTGCATGGACAGCTACAAGTGGATGTTCAACGCGAGCCGTGTTGCCGCCAAGCCCGCGGATTATCCCA
TCAAGTTCTCCCACGAGGAAAACAAGCACATTGTTGTGATTCGCAAGAACCAGTTCTTCAAGATCCCCCATGAAGTTGC
TGGTAAGCAGCTCAATGCCTCAGAGCTTGAGGCTCAACCGTGTCTACCAAATCGCAAAGCGAGTTTCGCCCGTG
GGAGCGTTGACGTCAGAAAACCGAGATGTCTGGACAGATGCGCGTGAGCTGCTGATTTCAGCCAGCCCCAAGAACAAGG
CAGCCCTGGAGGCCATTGAGTCCTCCTCTTTCGTGGTCTGCCTGGACGATGCGTCCCCTGTTACCTTGGAGGAGCGCGC
CCACCAGTACTGGCATGGCGATGGCGCCAACCGCTGGTATGACAAGCCTCTCCAGTTCATTGTCAACGACAACGGCACA
TCGGGCTTCATGGGCGAGCACTCAATGATGGATGGCACGCCGACACATCGCCTGAACGACTACATCAATGATCTCATCT
TCAGAAACAAGATTGATCTTTCAGACCCTAGCGTCCGATCTGACTTGCCCGAACCTCAGCCCATCAACTTTGACATTAC
GCCCGAAATCCAAAGCGAAATCGACCGTGCCGTTACCGACTTCAACAACGTCATTGGACAGCACCAGCTTGCTGTTCAG
GCGTACCAGGCCTACGGCAAGGGCCTCATTAAGCAATTCAAGTGCTCACCAGACGCATACGTACAGATGATCATCCAGC
TTGCCTACTTCAAGATGTACGGCAAGAACCGACCAACATATGAATCTGCTGCCACTCGACGCTTCCAGCTGGGTCGTAC
CGAGACGTGCCGTAGTGTTTCTGACGAGTCAGTCGCTTGGTGCAAATCAATGGCAGACCACTCAGTCGATGACAAGTCG
CGAGTCGACCTGTTCCGAAAAGCCATTGCGGCTCACATCGAGTACATCTCCGCCGCCTCAGATGGAAAGGGCGTTGACA
```

FIG. 1 continued

```
GGCACCTCTTTGGACTCAAGAAGCTCCTTGAGCCTGGTGAGGAAGTCCCGGCCATCTACAAGGATCCCGCATACGGCTA
CTCTTCGTCGTGGTATCTATCTACTTCGCAGCTCAGCTCCGAGTTCTTCAACGGCTACGGATGGAGTCAGGTGATTGAT
GGAGGATTTGGAATTGCCTACATGATCAATGAGAACAGCATCAACTTCAACGTTGTATCAAAGGGTCTTGGAAGCGAGC
GGATGAGCTACTATCTTAACGAGGCAGCGGGCGAGATGCGAGATTTGCTGGTTCCTACACTGGAGCCCCCCAAGGCCAA
GCTATAAAGGTCTTTGTTATACATACACATACATTACTGTATAGACTCTTCCTTTATTAGGCGCTGCACGTTTGGTATA
AATGTAGATATAATACACCATTGCGATGCAAAAAAAAAAA

> SEQ ID NO:7485   214902FL   Trichoderma harzianum
CCACCCACCATTGAGATTCTATCGCCCACCAAGCCTACAACACACAGCACAAGTATTATCGCCCATCATGCCTCAGCCT
ATTCCCGCAGCCAGCCGTCTCACCGACCTCTTCAGCTTGAAGGGCAAGGTCGTTGTCGTCACCGGAGCTTCCGGGCCCC
GAGGCATGGGAATTGAAGCTGCGCGTGGTTGCGCCGAGATGGGCGCCGACCTCGCCATCACATATTCGTCTCGCAAGGA
GGGTGCAGAGAAAAACGCTGCAGAACTGGAGAAAGAGTACGGCGTCAAGGTCAAGGTGTACAAGATCAATGTGAGCGAG
TACAAAGACGTCGAAAAGTTCGTCGATCAAGTGGTTTCCGATTTTGGCAAGATTGATGCCTTCATTGCCAACGCCGGTG
CGACAGCAAACAGCGGAGTTGTTGATGGCAGTTCTGACGACTGGGATCATGTTATCCAGATCGATCTGAGCGGCACCGC
GTATTGCGCAAAGGCCGTCGGCGCTCACTTCAAGAAGCAGGGTCGCGGATCCTTTGTCATAACAGCTTCAATGTCTGGC
CATGTCGCAAACTACCCTCAGGAACAGACCTCATACAACGTTGCCAAGGCTGGCTGCATACATCTGGCGCGCTCTCTGG
CCAACGAATGGCGCGACTTCGCCCGAGTCAACAGTATCTCGCCCGGCTATATTGACACCGGCCTGTCCGACTTTATCGA
TTCCAAGACACAAGAACTATGGAGGAGCATGATCCCAATGGGACGCAATGGCGACGCTAAGGAACTAAAGGGCGCGTAT
GTCTATCTCGTCAGCGATGCCAGTTCATATACGACCGGAGCCGATATTGTGATTGACGGAGGATACACTACCCGATAGA
AAACCAATTCTTCTTTCCTCTGTTGTTTTAAATTTCCTCTGTACTATAATTATAACCTTGTTCGTACCAACAGAGATGA
GATTCTGATCAAAAAAAAAAAAAAAA > SEQ ID NO:7486   214931FL   Trichoderma harzianum
CTGAAAGCTTCCATATCGCATTCTCATGGCGACTGTTGGGAATGCGGCCCGGCAGATACGAGATCGGGCACTGCGCGAA
AGATCGATCCGCGTGCTCGTATCGCCAACGCCAATCTCCTTCGCCGAGCGTCGCTCAGTTCTGCAGGTGCTGGAGCAAT
ATGGCCCTGTCGAGTTCTTCAAGATGACTCCCGGCTACTACGCCAACTTTGTTTCTATAACGAGAGAGCCCTCGACCGC
CGAAAGATTGATAGCTAGCAGCCCTCTAACATACAAGATCACGGAGCCTGTCCGCAGCGCGGTGGAAGACATTTACGTT
GCAGATCTAAACGAACCAGAGAGCTTTAGCACCATGCAGCCGACAATAACTGGGCAACAGACGAGCGGCGCGAACTCTT
GGTCCGACGGCACGGAACAGGGACAGGAACAGGAACAAGGACGAGAGGCGGAACTAAAGCAAGGGGAGAGAGAGTTCAA
ACTGGAAATCTTCCCTGCGCCCGAGTACAATCATAGATTTGCCATGGCCGGTTCACCGCTGCACGGCATCTGGAACGAT
GGCTACGAACAGGATCAATCCTTCGTTGCGACGACACTAAGGCAATCGCTGCCCAAGAGCATCGCTAGCGAGGGGCTTG
TGCACTGGATGGTGAGCGGCATGAAGACGCGAGGAGGGCGGCGGATGAAGAGGCTGCAGATCAAGGAATGGCTTCCCAG
CTACATGAAGAAGGCTCGACTGAGTAAGACTGAGTAAGTCAACGAGACGATGCCGCGCTATTACGAGATACGCGGAGA
GCTGCGACAGGTGCTACGACAATGAGGAGGACGATGCTGGCCCTTGTCCCGCAATGAATGCGACATGACTGAGACGGAC
GGCCTGAATTTTGCCGGCGACAATGGATGCAAGGCGGTATTGCAAATTGCAAGAGGCTGGTGGTCGCACAAGATGTCAC
TGCATTCAACAAGTCGTTGTCTCAAAGGTGACGCCAATTAATTTCCAAAGCCAAGGCAGGAAAACAAACAAACACCAGC
CAAGCGCGATTGGGCAATTGAGGGTTCCCAAAAATGGAACAAGAGCCGCTGGAAAACCAACATTGAAGACAGTTTTGAG
GGATGAACCATAACCTAATTCAGAAGTTGATGATGATGGATCTGCGCACGCTTTGCAACTTTCCTTGTTCTGGCTCCGT
CCCGACACAGCAATACAAGAAAGCGCGGGCTGGTGCTACAACTACAGCTACAGCTACTGTAGGTACTTCATCATCATGT
GCGCATAAACATGTGTAATCTAGAACGTACGAGTAAAAAAAAAAAAA > SEQ ID NO:7487   215420FL   Trichoderma harzianum
CCCACACACATCAAGATGGCCTCTTCCGCCCGTCAGTTTGCCCGCGTGGCAACCCGCACAACCACCCGCTCCTTCGCTG
CCGTCCCCCGACAGGCTTTCCGCCAGCAGGGTCGCCGCTTCTACTCTTCTGAGCCCGAGAAGAAGTCATCCTCCTCTCT
CCTGTACCTTGGTGCTGCCGCCGCCGCCGGTGGTCTCGGTATCTGGTTCTTCACCTCTGGTGCCTCTGCCTCTTCCAAG
ACCTTTGTCCCCACCCAGGCCGATTACCAGAAGGTCTACAACGACATCGCCGAGCGTCTCGATGCCGATTATGATGATG
GCAGCTACGGCCCCGTCCTGGTCCGTCTTGCATGGCACTGCAGCGGTACCTACGACAAGGAGACCAAGACTGGTGGCAG
TAACGGTGCTACCATGCGATTCGCTCCCGAGAGCGGCCACGGTGCCAACGCCGGTCTGATTGCTGCTCGTGACTTCCTC
GAGCCTATCAAGGCCAAGTATCCCTGGATCTCCTACTCTGATCTCTGGATCCTCGGTGGTGTTTGCGCCATCCAGGAGA
TGCACGGTCCCATTGTCCCTTACCGACCTGGCCGCCGTGATGGTGACGCTGCTGCTTGCACCCCCGATGGCCGTCTCCC
CGACGCCAGCCAGGGCGCCAAGCACCTGCGTGACATCTTCTACCGCATGGGCTTCAACGATCAGGAGATTGTCGCCCTC
AGCGGTGGCCACGCCATTGGCCGATGCCACTCCAACCGATCCGGTTACGAGGGCCCTTGGACCTTCTCTCCCACCATGC
TGACCAACGACTTCTACAAGCTCCGTTGGAGGAGAAGTGGCAGTACAAGAAGTGGGACGGCCCCAAGCAGCTCGAGGA
CAAGACCACCAAGACTCTGATGATGCTGCCCACCGACCACGTCCTGACCACCGACAAGGCCTTCAGGCCTTGGGTTGAG
```

FIG. 1 continued

```
AAGTACGCTGCCGACAACGACCTGTTCTTTAAGGACTTCTCCGCCGTCGTTCTCCGCCTGTTCGAGCTCGGTGTTCCCT
TTGCTGAGGGCAGCGAGAACAGTCGATGGACCTTCAAGCCCACCCACGCTTAAACTCCCAAATTCACATATATGATGAA
TCAGGTGATGTAGGACGGTGCATATAAGAAGACTAGCGTTGTCAATAAGGAAATTGATAGACTTGTGAATATTTTAGAC
ATGTAAGGCCCTCTTACGGTATGAAGCCGTTGAGCCGGCTAGGGTTCGAAAAAAAAAAAGATGACTGGACGACAAGTTC
GGAAGCTTGGGATGGATTTTATCGCGCTTTCTTCGCAAACTGCTTTTTGAGGGTTGGTTTGTCTGGGTTTTCTTTTGTA
ATGTTCTATACCTCAGCCAACACCCCGTACTCTAACAAAGAAGATGAGCTTTCCAAAAAAAAAAAAAAAA

> SEQ ID NO:7488 215586FL Trichoderma harzianum
CCCACGCGTCCGCCCACGCGTCCGTCACAGCCTTGCCTTGGCAAATAGACAACAGAAACCCTGTTTCAAGCCCGTTGAC
TCTGTGAAGCCAGATCTGGATTTGGCTTCCATGCGTGCGTCTTATACTTTCAGGAGAACGCCGCAGTAGACTACTTAAA
GACTTACTCTCCCCACGTCAAGACGTTCCTCTTCATCCATCTTTTCCAAGCACGACACCATGACTACCCGCTCCCTTCC
TAGCAATGGCAGCTCTGCCTTTGACTACATCATCGTTGGTGGAGGCACCGCAGGCTGTGTGATTGCCTCGAGACTCTCC
AGCTATCTGCCCGAGCTCCGCGTTCTTCTCATCGAGGCTGGTCCCTCCGACTTTAACCTCAACCACGTCCTCAATCTGA
GAGAATGGCTGAGCCTGCTGGGCGGCGAGCTAGACTACGACTACGGCACGACAGAGCAGCCCATGGGTAACAGCCATAT
CCGCCATTCTCGTGCCAAGGTCTTGGAGGATGCTCGTCACACAACACGCTCATTTCCTTCCGTCCTTTCCGCCACGAC
ATGGACCGCTGGGTTGCTCAGGGCTGCAAAGGCTGGACCTTTGAGAATGTCACTCGTCACATTGACAACCTTCGCAACA
CATTCCAGCCTGTCCACGCCCGTCACCGCAACCAGCTGTGCAAGGATTGGGTCCAGGCCTGTGCCGATGCTCTCGATAT
TCCTGTCATTGACGACTTCAACACCGAGATCCGTGAAAAGGGTCAGCTCACACAGGGCGCAGGCTTCTTCAACGTCTCG
TACAACCCAGACAACGGTCGCCGAAGCAGCGCCTCTGTCGCTTATATCCACCCCATCCTGCGTGGTGAGGAGCGGCGAC
CAAACCTGACTATCTTGACCGAGGCTCACGTTTCCAAGATCCTGGTGGAGAATGATGTTGCCAGTGGTATCGTTCTGCA
CTTGGCATCAGGTGAGAAAACGGTGCTGAAGCCCCGCAAGGAGATTGTTCTTTGCGCTGGTGCTGTTGACACTCCTCGC
CTGATGCTTCACTCAGGCCTTGGACCTCGCTCACAGCTCGAGGGTCTGGGACTCCCCGTTGTAAAGGATATTCCCGGTG
TTGGCGAGAACCTGCTTGATCACCCTGAAACCATCATCATGTGGGAGCTCAAGACGCCAGTTCCTGCCAACCAGACCAC
CATGGATTCGGATGCCGGTGTCTTTATCCGCCGAGAACCCACCAATGCTGCTGGCAAGGACGGAGATGCCGCCGACATC
ATGATGCACTGCTACCAGATTCCCTTCACACTCAACACGGAGCGGCTGGGCTATCCAAAGATTCGCGACGGCTATGCAT
TCTGCATGACTCCCAACATTCCTCGGCCTCGATCCCGCGGCCGC > SEQ ID NO:7489 215679FL Trichoderma harzianum
GCGCTCCGCCGTGCCCGCAGTCTCCATGCGCAAGCGGCCCAGCGACAAGACCACCGATGGAGTCGTTCCCGCCAAGCGC
CAGCGCACAGATTGGGTTTCCCACAAGGACCTGGCCCGTTTAAAGAAGGTTGCCGATGGACATCACGAGAATACCGTTG
CCGTCAAAGACGCCACGTTTGACCTATGGGATGCCCGTGCGCCGGTGACCCAAGATCCTACAGATTTCCTGCCTGAAAA
GATTGAGGCCAAGGTTCCAAAGTCCATGAAGCTGAAGCCCCTCTCTCTTCTCGCCAACGGCAAACAAGCTCCCGCAGTG
CCAAAGCCCACGGGAGGATACAGTTACAACCCTTCTTTCCCAGAGTACGAGAGTCGACTCGCCGAAGAGAGCACCAAGG
CTCTTGAAGCCGAGCAGAAGCGTCTCGAAGCTGAAGCCGCCGAGGCCGCGAAATTAGAGGCCGCAGCAAAGTCTGCCGC
GGAAGCAGATGCCGCTGAAGAACGAGCCAACATGTCGGAGTGGGAGGAAGATTCTGAGTGGGAGGGCTTCCAATCCGGC
GTAGAGGACGAGAGGCCCAGCGCAAAACAGCCCAAGCGCAAGACGCAAGCCCAGCGGAACCGCATCAAGCGCAGAAAGG
AGGAAGAGCAGCTCGCACAGCACAAGGCCAACATGAAAGCCCGCCGCGCGCAGGAGCAGCGCATCAAGGAAATCGCGGC
GGAAGTCGCAGAAAAGGAGAAGGAAAAGGCCCTCGAGCTGGCCAAGGCCGCCGAGCAAGACTCGGATGCCGACAGCGAG
ATTGGCGAGGAAAAGCTGCGGAGAAGGCAGCTGGGCAAGTACAAGCTCCCGGAGAAGGATCTGGAGCTTGTTTTGCCGG
ATGAGCTGCAGGAATCGCTGCGACTGCTCAAGCCCGAGGGAAACCTGCTCAAAGACCGATACAGAAGCTTGCTGCTTAG
AGGAAAGGTGGAGAGCCGAAGACATATTCCATTCAAGAAGCAGGCCAAGACCAAGGTTACGGAAAAGTGGACGCACAAA
GACTTTGTTTCTGTAGACGGACGGATGATGAATTTTTCCTTTTTCTTTTCTTTTTCCTTCATTCCTTCGTTCGCATATCC
CTTTGAATTTTGTTTCCTTAAATAAACAGACATTAGATCATGGCGTCGTAATATTTTCTTCAATAAAAACGGCTAGGAA
TGAAAAAAAAAAAAAAAAAAA > SEQ ID NO:7490 215308FL Trichoderma harzianum
ACAACATCAACGAAACGGTCCTAGACACAGCTCACAGGGTGTTTCACAATGCCGATTGCACCTATAATCACATTCAAGG
CCGGCCAGTGTGACGTCGACACATCGTCGAAGCCATACAAGGTCACGCCACAGCCTGAACCTGGTTATATCTATCTATA
CTCCGAAGATGATCTGGTGCATTTCTGCTGGCGACGACGGGACCAGCCTCTGGATGACCCCGAACTCGACCTCGTCATG
GTTCCCACAGACGGTAGCTTCCTCCCATACGAATACAAGACCACCCCTCAGCCCACAGCGAAGACCAACGGCCGCATAT
TCGCCCTGAAATTTGCCTCTTCCTCTCAGCGCCACCTCTTCTGGATGCAGTCTAAGCCCCAGGGACGAAGTGGCGACGC
GAGCTACTTCAGCCCCCGGGATCGCAAGATCGGCGACATTGTTCACAGACTCTTGCAGGGCGAAGAGGTTAACGTGACA
CGGGAGCTGGCCGCTGTTCGAAACAATAACGATCACCAAGACGACGAAGATGAAGCTATGGAGGACATCGAGGGCCACG
GCCACCAGGATCACCACGCGGGAGGCAGCGGCGGTGCTGGCCCCGATGCGACGGGAGGCGATATAAGAGAGGAGGGCGA
```

FIG. 1 continued

```
GGGCTCGAGAGAAGGCGGAGCTGATGGAGCAAGAGCGTAGGTAACCCCCCCTTATTCTTCAAGGCTGGTCTCGACACGG
CCCGCGCAAGGTTGTCTGGTTCCAATCACTGGTCTCCGAGGGTCAAGAACATGTTTTTGGCATCAAAATGAAGGCCAA
TTAATGTACTAAGAAACTTCCTTGTACCTTTGAACAGAGCTACGCCAAAAAAAAAAAAAA
```

> SEQ ID NO:7491 215608FL *Trichoderma harzianum*
```
CCCACGCGTCCGCCACGCGTCCGCCCACGCGTCCGCCCACGCGTCCGCGCTCGCTAAGCACCTGCAAAACTTACCTTGA
CACTTTTGTCAATTTCATTCTTTAAGAACAACCGCATCAATAATCTTAATCAAGCTCCCTCGAGTTTAATTCCTAATAC
CGACAAAATGAAGTTCACCGCTGCTGTCGCTCTCGCCGCCGTTGGCGTTTCTGCCGTCTACGTTCCTCCTAGCAACGTC
ACCGTTGTTACCGATGTCGTTGACCAATACGTCACCTACTGCCCCTACGCTACCCAGATCACCCACGGCAGCAAGACCT
ACACCGTCACTGAGCCCACCACTCTGACCATCACCGACTGCCCCTGCACCATCACCCGCCCCGTTACCGTCACCAGCAG
CGTTGTCTGCAACACCTGCGGTAACGCCGCCCCTACTGGTGCTCCCTCCGGTGGCAACGGCGGTGGTTACACTCCTCCT
GCCTTCACCAACTCCACCATCACCACCCCTACCCAGGCCCCTCCCCCCAGCGGCCCTGCCAGCACTGGTGGTGTTGTTC
CTACTGCTCCTCCCGCCGTCCCCACTGGCGGTGCCAGCAAGGCCGTCCTCTCCGGCGCCGGCCTTGCCGGTATCGTCGG
TCTGGCCGCCTTCGTCCTGTAAATCTTGTAAATTTCGACACCTCGCCAATTTACCGGCTACGATTTCTTGGTTCTACGA
TTCTTGGAAGTCGTCGGTTCGGCCTCCGTTCATGATTTTGATATAAGGGGGGAAAAACACAAAGTGTTGGGGTTTATTA
TTGGTTTACGTTGACGGGATACCTTAAGGGAGTGGATTATTTTTTGGGATGTATAGAGAAGGGTTCTCTTGGGTTAACG
GGACATGCAAGCTCGGTGTTTCAAGGGAACTCGATTTTTTTGATCGCCCACGGAAAGATGCGCTACAATATCAAACTGT
GTGCGGTCGAAAAAAAAAAAA
```

> SEQ ID NO:7492 219269FL *Trichoderma harzianum*
```
CAAAACATCACAGTGCACATCATGGCGCGAGTACTTCGCAATAGAGCGGTTGCGTCACCGAAAACCACCGACGCCGTAA
AGCCTGACAGCACCCCAAAGGGCAAGAGAAAGGCCGCCGAAGAGTCTTCTCCCGTTGTGCTGAAGAAGCAGAAATCCGC
CAAGAAGGAAGATGTCGAGACCAAGGCAGCCAAGTCACCCAAGGCAGCCAAGTCACCAAAGACTAAGAAGGAGGAAAAG
AAGAAAGAAGAAGAAAAGAAGCAAGATGTGATTGACATGGAGGAAGATTCCGAGTCTGAGGGACAAGAAGATGAGGGAA
ATCTTCAGGCTTTGGCCGTCAACATTGACCCGGAAGAAGAGGCCCCCGTGAACGACGAAGAATTCCAGCCCGGTCAGGA
CGTTGGCAAGATCCCCAAGGTCTCGAAAGACGTCCAGAAGTCGATCAAGGCATCGAAGGAAGAACCTGGCGTCGTTTAC
ATTGGCCGAATACCCCATGGTTTCTACGAATACGAAATGAGGCAGTACCTGTCTCAATTCGGCCCCATCTCCCGGCTGC
GTCTATCACGCAACAAGAAGACTGGCGCCAGCAAGCACTTTGCCTTTGTCGAATTTAACGAAGCCAGCACTGCCGAGAT
TGTCTCAAAGACCATGGACAACTATTTGTTGTTTGGACACATTTTGAAATGCAAGGTTCTCTCCAAGGACCAGGTACAC
GACGACTTGTTCAAGGGAGCGAACAGAAGATTCAAGAAGGTGCCGTGGAATAAGATGGCTGGTATCCAGTTGGAAAAGC
CTCTGACCGAGTCGGCCTGGGAAGCCAAGGTTGCCAAGGAGCGAGGTAACCGGGCGAAGAAGGCTGCCAAGCTCAAGGA
GCTGGGTTACGAGTTTGAGGCTCCAGAGCTCAAGAAGGTCCCTGCACCTATTGCCGCAGCGATTGAGAATGGAGAGGAG
GTCAAGGCGATTGAGGCTGCTCCAGAGGTAGCCCCGGAGGAAGAAAAGCCGGCTGAAGAGACGGAGGCTGCTGATTCAA
CAGAAAACGCCCCGGCGAAGACAAAATCGGCTGCCACTCCCAAGAAGGCCGCCAAGGCCAAGGCCACCAAGTCGACGAC
GACAAGGACGAGGAAGACCAAGGCTTGAGTCCAATGATTGGTGATTGTTATACATATATTTGATTTCACACTCGGCAGG
TTCATTACGCGCAGTGGTTTAATAAAATACAAGTGCACTTCAAAAAAAAAAAAAAAAAA
```

> SEQ ID NO:7493 214953FL *Trichoderma harzianum*
```
CGCTACGGCTTATTTACTCTTCTGACCGGAGGTCTCGGTATTGACATGACCTTGGAGCCATCGCTGCCGCAACGAAATG
GAGTACTCGTACATGTAGCCGCAGTCTCTTGTCCATGCGAGCGGGCATTTCGTCGGCGTCCCAATGGTCACCGCGAGAC
CTATCATTTGAGATACTGTCTATCTTCCTGCATGTTGGCTGTACGAGACGAACGATATGACGGCTCCCTGCCTTTGATT
TCTATGCAGCAGTAGCCAAAAGAGAAAAGGTGTAATATGCAGCAAGGCCGCTATGTTGCCACCCCACGAGACCTCGACT
GCATGCACGTCCAGCGATACGTCTCCACGAGGCCGCGCATGACCGCTGTGTCGAGAGTGGATGGACTGCGGACACCTCT
CTGCTTGCAACGGCTCAGCAAATTTTGCCGTTGGGCCACCGAAGCCAAACGGCTCACCGTCTACGCAATTGGCACTCTA
AATGCTCCTTTCCGCAGCCGCCTTGCTTTCAATACGCGTCCACAAGCGTTTGTAGCCCTTGTCAGGCCGTTGCGGTTGC
CCGCGTACCACCGCCCAGTGGAGAACAAGCGTTCTCTTGTCATTTTTCTTGTGCCTTGGAGGTCCCACAGTCTGCCGCC
AACCCTGTTCGCGTCTGTTGCGGTTTGTTTTGCGCCACTCCGTGAGACGTAACAAATCAGAGGCCTGGCCTAACCAAGT
GCATGAGAAGAACCTGGCAAGGTCTCAGTCTTGTGGAACGTGAGCGGCACGGCGATAGCATTTGGCGCCCCTTGTCGCG
CTACCGGCGTCAGAATGGGGAGACGCTGCACGGAGCGCATGGAGGTTTGTGGAGATGAAGCATCCGATAGTGACGGGGG
ACGGAGTACTCCGGATGCACAAGAGCTCGCTCACTACGCGAGGCCTAGACGGTTCTCCACAGCATCCCGACTCTGCAGA
GAACCAGCGGTGAACAGATGATCGAACGATCTATTCTTGGAGAGAGCACTGACTATGATACCAAGCAAGCTACGCCA
TGGAGCGGAGTAGCAGCAATGAGTTCTCCATGCATCTCAAATCTCGTCAATGGCAAGGAAAGCGGAAACGCGGAGGAGC
ACCTTCATGAGCCGGGAAGGGGTCTCGCCGTTTGTTGCCATTGTCTCATCAGCTTCTTATTCCCTGGCCTTATGCACTA
GCCCAAGCATATACCGGTTGCAGTGCAGTGTGGCTGGAACTTTGGCAGGCTGAATTCCCTGTTCCAAGGATGAAGGAAAA
```

FIG. 1 continued

GCCAACAAAGTACGAGGACTAATCCGTATCTTCTTGTGCATCATGTAGCGCCCAACTACCTACCCATCAAGGCTTCCCC
TGCAGTTGGCTCCTCTTGTTCTGTGCCAGTCAAAAATAGTACCTACTCAGCTTGAATCGAAGACTCGATGAGGAGCTTC
TGCTGCAAAAAAAAAAAAA

> SEQ ID NO:7494 215090FL *Trichoderma harzianum*
CCCACGCGTCCGCCCACGCGTCCGAGACCAGCCATCAATCACAACTCCGTACTCGCTGCAGACAGACACTCTTGCACCT
TGAGCAAGTTCAATTGGCGCTGAGAGGGCGAAAGAGTGCAAAAGTTATCTTGCTGCCACCAGTTATCTGCCTGCAACCC
GCAAAGTGGCCCAAACCAAAGGCTCAGCCCAACGCTGATCACGGCTTTCGTATTCGGCAGCGATGGACAGGCACCACAA
TCGCACTCCCTTTCATCTGCTTCTTCTCTCGAGCTTCTTTTTTTTCCTTTGCTCGCCTCACATTTCTTCTAGTGGATGAC
GCAACTGGCCGCGGGGATCGTCGACGCCAATCTATCTCTCTCATTCTCTCTCTCTCTTTTTCTGAGGGTTAATTTCGTA
TCTACCTACTTACAGCCACAGTCACAGCTCGACAAGTATTGGCAGTATTGCCTACTAGTATTCCCACCGCTCGCTTAGG
CGGCCAAGGCATTCCCTGTCGAATGACACGAATCTCATCTTACAGTAGACAGACCCGGAAAAGCGGGGATGGACATGAC
ATGTGTGTGTGCTTCATGGCGGCCTGAGAGCCTGGCCATGCGTGAAATGCCATGCCGTGCGTCAACAAGCGTCGAGCAG
CGCTGGCTGGCTGGTGATACGCCATGGCCTCGTTCGTTCTCTGGTCTGGGGAACCCGGGAGGGGAGAAGACGGAAGAGG
AGAGAGGAGAGAGGGAACAAACAGAGACGAGAGGCCAGCCAGCCTTATCGAGCACCGTCCGTCTGCCTCTTCTGCCTCT
TCTGCCTCATTCTCGATGCCCAGCACCGTGGCATCGCACAGCACCGCACAGCACGCAACAACAGCAACCACATCACCAG
AACATCATGCACCTTGTGCTCCCGTCCTTCCAGAACCTCTCCAATTCGCTCCCCCCTGCAACCTCCCTCGCGCGAACT
GCAAATCGCCATGCCATTGATGGCACAAGTGCAAGCAAGCATCATGTACTCTGACACTCTGTGCATGTCTACCGCATAC
TCGTACCTCGCGGCCAAGTACTCGATACCTTTGCTGAGCTTCGAGGCTAGGGCCGCATCGCATCGCGGCTCCACCTTGT
ACTGTACATTACATGTGTACATTACATGTGCACATTACATGGCTTGTCCAGATCCAGCGTCTGGGACCTCTTTGAAGAC
CTGGGTGACTTGTGAACATTGTACCTGTGGAGGATGCCATGTTTTGGCATTTAATGTGGCCACTGTTGCAGTGGAATAT
AATCCGATTCGCTCTAGTGTTTTCGACGACAGAAGCTCTCGTTACTGCTCATGGAGAAACTCGCGATGGAGTCGGACCT
TTGTACCACTCACCGGCAGCTTTGCTTGATAACCTGCAGAACAGAGGCGTGCTGAGATGATCTCGCTCCCCAACCTCCG
CTTTATTGCCAGAGACGAGCTGCGTACAGTGTAAATGTGTATGCGATATCTACTCAGGGGTGGGCGGTGTGTGCCATTG
CATTTCATCTCTTTTTAACACCACTTCAGGCTTACTATTGATCATCTCGTACATACAATCACCTGTAGGCTGTTGGATA
CCTAAAAAAAAAAAAAAAAA > SEQ ID NO:7495 215208FL *Trichoderma harzianum*
CGAACAGCCCTCACCGTCGGAGGAGAAGGGCCACTGGCCGCGCAGATACCTTTCGTCGCGAGAATCGTCAGACAGCTCT
GGCGAGATTGAGCAATTTTCTATTTCTCGAGAGTCGTTTGACTCGTACCGACGCTCATTTGATATCTCGGCACGATCCC
CCATTTCTGCGTACGACGTTCCCGCTCGCATGAGTCTCGACTCAGCTCGATTCGCTCGAATGCCTAGGTCGGCAATCAA
CCGTAACATAGAGCAACTGCCCACCGCTGAGGAGAACTTTGAGGACGTCGGACTCGAGGACCAGAAGCAGCCGCCCCGC
AAACGAGGTTTCTTTTCCAAACTGACAGAGACCCAAGAGAAGGACTCCACTGCTCAGACAGGAGTCTCGAGATTCCTCA
TGCCCGGTCGGAAGAGGGCTCAAAGCGGCCAAGGGGCCAGGTTAGCGGCAATGGACCAGCCGACGGTGACTTCATCAAA
CTGAGAAATGCCTGCCACGGGAAGCAACGACGACAACGACTCTGCAACTTGAAATAATTTATCGTACATACCTTTTCAA
AAGTGTATCAGGCGCCCATGTTTTTTTTTCTGGACTATGGATATGTTTTATTTCTGCAACGACGGCGTTTGGGACGGCG
TAAACGGTGGACGCACATTTGCCGCCGTCACATCTTGCAAGGACAACTGTATAATGGGGAGTTTGTATTTCGCATCCAA
CGATGCTTGCTGGTACGCCCACGATTCAAGGGCTGGCAGACTTGGAGAGTTTATAAAGGCGAGGGACTATTCAAGCAAG
GAAAAGCAAGACGACTTAATGATAATCACTTATGTCGGCGATCACATACTTGATCGCTAATACAGCACATCTTACGTTT
GAACAAAAAAAAAAAAAA > SEQ ID NO:7496 215474FL *Trichoderma harzianum*
CCCCACTGTCGCTATCATGGCCCGCGGAAATCAGCGTGATTTGGCGCGCGCAAAAAATCAGAAGAATGCGTCCAAACAT
GTGAGTCGGTTTTGCATATAAAATCCTCAACAGGAACCAGGGTTGACTAATTCGGTGTCGTGTCTTTGCAGAAAGGCGG
CAATACCGAGAACGGATATGAGCAAGCAAATCCAAGTTGAGTAACGCCGAGATTATGAGGCAGAAGCAAGCCAAAGGT
CCGAACAACCAAGTCTACCCAATACCTCTTACGAACCAGTCAACTTACCAAGGCAACAGCCAATGCCGAGAGAGACCTA
GCGGCAGCAAAGGCATTACAAGAGAAAAGGGACGCAAAGGCGAAGAAACCGACTGAATTGGGCGCTTCAGCTGTGGAGG
TTACTGGACATGCAAATAACCCAAGAGGATAGCAAGAGATGGGAGAAAACACGGCACGGCGAAATCAGGCGCTCCTTGA
GACTTTCACAATACGGCGCAAATTTGGGACAATCTAGGTGAAGAGGGGGAAGCGTTTTTTGGCTTAATACCAGGTATAG
CCATGGATAATAGCGAAATGGATATTTTGTTGCGGTATTGCTATTATTATTCTACCAAAAAAAGTTCGACCTTTGTGTC
CCTTTTTTTCCCCTCGAAAAAAAAAAAAAAAAAA

FIG. 1 continued

> SEQ ID NO:7497 215685FL *Trichoderma harzianum*
CATCACCAATTGCACCCCGCCATGGCTTCACCAATGGCTGCCTCTCGCCATGTCCAGCGCGTGGCTACACAGATCCGTC
TGCGCTCAGCGCGGGTTCCCAGAGGCCAATTGACCTTCAATCGATGGGCATCGTCCGCTTCGGGCAGTCGGCGAGCTCC
CGCCAGCTTCGGAACTTCATCCTCGGCAGCCGTTTGGCTTGCAGCCGCCGCCATTGGCATCACGGCTCCCTTGGCCTAC
AGCTTGACAACAGCAGAACCTGCAAAGCTCGACGTCACATCCCTTGCCGAAAAGGATGAGCAGAAGAAGAGAGAGGCGG
TTGTCACCGAAGAGTCGCCCATGCGCCTGCGGATGGAAAAGTTCATCAAGGAGCAGCAGCAAATAATTGTCAAGGAACT
CGAGCGCATCGACGGCAAGAAGTTTCGCAAAGACGAGTGGACGCGACCCAATGGCGGCGGCGGCATAACCTGTGTGCTG
CAGGAGGGCAACGTATTCGAAAAGGCCGGTCTCGGCGTCAGCGTCGTCTACGGAACGCTTCCCAAGCCCGCCATCTTGA
AGATGCGCGAAAATCACAAGAACCTCGACCCCGACGTCGAGTCGCTGGAATTCTTCGCTGCTGGCCTGAGCATGGTGCT
CCATCCGTACAACCCCATGGCTCCCACCGTGCACCTGAATTACCGATACTTCGAAACGGCCAATCCCGACGGTACCTCT
CAGGCGTGGTGGTTTGGAGGCGGTTGCGACTTGACGCCCTCATACCTCTTTGACGAAGACGCCATCCACTTCCACAAGA
CCATCAAGGCTGCCTGCGACAATCACGACAAGACATACTACCCTCGATTCAAGAAATGGTGCGACAAGTACTTTTACAA
CAAGCATCGTGGTGAGTGCCGAGGCGTGGGTGGTATCTTCTTTGACGATCTAGACGAGTCCGAACGAGACCAGGAGAAC
ACTTTTGCATTCATCCAGGACTGCCTGAAGTCCTTCCTGCCGTCCTACGTCCCCATTCTCGAGAAGCGAAAGGACATGC
CTTACGATGACAAGGAAAAGATGTGGCAGCAAATCCGTAGAGGCAAGTATGTCGAGTTCAACCTGGTTCACGACCGAGG
CACCGCCTTTGGACTGAACACGCCTGGATCACGAGTCGAGAGTATTCTCATGAGCTTGCCATTGACGGCAAGCTGGAAG
TACATGTATGAGCCAGAGCCCAAGAGCAGGGAGCAGAGACTGGTGGACGTCTTGAAGGAGCCCAAGGAGTGGGTTTGAT
TTGGTATATTTCCGTGTAATAATGCATAAAACAGTATATTTTGTAGTGTAGCGGCATAGATTAAAAAAGACAATAGCAT
CATGAGTTCCAAAAAAAAAAAAAAA > SEQ ID NO:7498 219290FL *Trichoderma harzianum*
GCAGCCTAAAAGCAAACCGTCTCATCTTACATGGCCTTGTTCCTTTCCATACTCCATTCTTCCCCAACCCCAACACCCC
GCCAGCCGTTCTGTCAGCGCCCACAGCGCATTAGCCTCATCACCTCATTGCTCACTGGTCTGCAAACATTGCGCAAGGCG
GTGAATTTTTCATGTCGAGAATTGACATTATATAACAGCACGTATTCTAAGATTCATGTATTAAGTGCCGAGGAAATTC
ATTTCTTCCCCATCCGTCAAAGTCCTAGGTAAGTAACAATGCATTAATCGTAATGTCCAACTCGGAGAGTTTTCAATAC
TCCTTATCGATAAGTCATTATGTAATCAATCCTGCCGGGAAGGGAAATTTTGCTCCTCTCCCAAACCTCAAATCGCATC
TCCAAAGCCCTGTGACGACATACAACACCCGAACAGCAATATCAAACCCCCAAACACCAAGGAACAAGCCCTCACCCCG
TATTTTACCTCCCAGTTTACAAAAACAAAACACAAGAATAAAACAACAACCATGTCTTTCCTCGGAATCGGTCGTCCCC
AGCCCACCTCGGAGCAAAAGATTGCTGCCGTCGAGGGCGAGATGCGCATGATGGCTGATACCTACAACCGCCTGCAAAA
GACTTGCCAGAAAAAGTGCGTCCCCACCGACTACCGCGAGGGCGAGCTCAACAAGGGCGAGTCCGTCTGCCTCGACCGC
TGCACCGCAAAGTTCCTCGACACGTCCATGAAGATTAGCGAAATCATGCAGCAGCAGGGCCAGGCCATGGGCGCCGGAG
GACCTCAGGGCGGACTGTTCTAAAAAGGGAACAGTCCCCCAGTGTAAAGCTATAGAATACCGAAGATTAAAGAAAAGAG
AAAACAAGAGGGAGGCAATTGATATCGAACAATGTCTTCTTCCTGGCCGTGAAACATGGAACGTCATGGGAATTTTTGT
ACGATTATATGGGGAGTTAGTTGTCTGCGTTCAAAGGGAGGGCTTTGATGATATGATGGGATCATGGGATATACATATG
TCATGTCAAAGATGTATAAAGCTATCAAAGACTATACCAAAAAAAAAAAA > SEQ ID NO:7499 214908FL *Trichoderma harzianum*
CTGGCGTGGCGCCTCAGCCAGAAGCGTTGCTGATGACACCCGACCTCGCATTTGTGTACTAGTATGTACACAACACAGC
CGTGTGTCAGAGTATCATATCAGAGCTAAGGTTAGGTAGACAGACAGACGGCTTCGTTTGGCAACTCGCTGGATGCCAG
ATGGCAGAGCTTAGATGGTCAGCTTGGATGGTTGAGCACAGATGTGAATAGGCACCTGCGAGGACCAGCAGTGAGCAAT
ATTGGAGCAGTAAGAGTAAGGTAGCTGTCGGGATAGAGACTTGAGGACGGGCTGCTCCGTCCGGTCCCCATCTCGTGGA
ACCCGTAATCCAGTCAATGGATACCATAATCAATCCATAACTCCTCATAAAAAAAAAAAAAAAAA > SEQ ID NO:7500 215021FL *Trichoderma harzianum*
AAGCCCTCACCTCACATAAACACGGGAGAACTACATTCAAGATGGATTTCTCTAAATTCAGCAAGGGTTTCTCTGATTT
CAGTGCGCAGATTACTCCGTTTGCGTCACGGACCTTCCAGTTTACCAAGGAGCAGTTGGGCCAAGCAGATGATCGAACT
GAGCTTCCTGCCGATTACATCGACCTCGAGAAAAGGTCGATGCGCTGAAACAAGCCCACCAGAAGATGCTTGCGGTGA
CTTCGCAATATACCAACGAAGCCTATGACTATCCTCCCAACATCAAGGAGACATTTCAAGATCTTGGCCGAACCGTGAG
TGAGAAGGTCAGCCTTCTATCTTCGGCTACATCTACTTCAGAGGCCCAAGCAGCTCTTGTGGCTCCAGCATCTGCGAAG
CCGCAACCAAAGACTTTCAACCATGCCATCTCTCGTGCGAGCTTATCCAGCAGCCAGCTCCTGCACCAGCACCACACTG
GTGCTGGCGAAGATCCTCTGGCAACAGCTCTCGAGAAATATGCACTCGCGATGGAACGAGTGGGCGACGCGCGCCTTGC
TCAAGATTCACAAATCCAAAGCCGATTCCTAGCAGGATGGAACACAACCCTCAATACCAATCTTACCTTTTGCGGCGCG
TGCTAGAAAGAATGTTGAAAATTCAAGATTGACCCTCGATGCTGTCAAAGCTCGTGGTAAAGGGAACGACCTTTAAACT

FIG. 1 continued

TGGCGGCGGCCACGCTCGAGCTGATCGTCCCGACGAAGCAGAGCTCAGCGCTGACGCTCAAGAAGAAATCGAGAAAGCA
GAGGACGAGTTCGTGACCCAGACCGAGGAAGCGGTTGGTGTGATGAAGAACGTTTTGGACACCCCTGAACCACTTCGTA
ACCTCGCCGAACTTGTTGCTGCCCAAATGGAATATCACAAGAAGGCATACGAGATTCTAAGTGAACTCGCTCCGGTCCT
CGAGACCCTGCAGACGGAGCAAGAAGCCAGCTACCGAAGAAATCGTGATATGGCTTGAGGAATATCTAATGCTTTAGTT
GCGTGATGCAAGTAGGATTTTCAACATTAGTTGATGAATGCCGCATAATATATACCTTGCTTGTTAGTTCTGAAGCTTG
AACACGACCCAATTATGAATAAAAAGATGCAATAAAAAAAAAAA

> SEQ ID NO:7501 215211FL Trichoderma harzianum
CTGCCCACAATGTCGCTTTCTGTTGGTGCTTCTCTGCGGCCTGCGGCCTTCCGCTGCGTTGGTGCGTCTGCCGTGCGCA
TGCGATGTGCTTTTGGCACAACTGCGTCCAGAAGGAGTGAGAGCTCGACGCCGGGCGAGCTTGGGGTTGGAGAGCTGCA
GGGCGCATCGTTTCGCATTGAGCCTCTCCGGAGGGTTGGGGAGGATGCTTCGACTATGCGAGCGAGACTTTTATACCAA
TCTCGGAAGCGCGGAACCCTCGAGTCGGATCTTTTACTGTCTACGTTTGCCTCACAGAACCTGCCCACCATGACGGCCG
AAGAACTGCGGCAGTACGACCTCTTCCTCGACGAGAACGACTGGGACATATACTACTGGGCGACGCAGCGGGAGCCGAA
TTCCACGACGAACCCTTCCGTGACGGCGAGTCCGGCGAGTGCTTCGGCGAGCGAAGGGTTCGAGGCGAGACAGCAGGAT
GAGTTGCCCAAGAATCCGCCAAAGGGGGAGTGGGCGCAGACGGTGGGCAATTTTAAGCCTGCGTATAGGCCGGTGCCGC
AGAGGTGGAAGGATAGCGAGATTTTGGAGAAGTTGAGGGCGCATGTGAGGAGGAAGAGTGTGAATGGGGGGGAGGGGAC
GGGGATGGCGTTTATGCCGCCTTTGGAGTCGTGATTTTGACGATGGAGAAGGTGAAAAGAGATGAAGTAAGGAACGGTA
AAAGGATTTTGGGTGGGAATGTTACGATAGGGTTTACGAGATGTGTATAACAGGCAGGATTAAGTGACGACGCAAAAAA
AAAAAAA > SEQ ID NO:7502 215516FL Trichoderma harzianum
CTTCTCATCACATTCCAACCATCTTCATCCATCGTCTTTGATTCATCAAACAGCTCTTGGATCCGTTCTGATCCAGCCA
ACCAACCATCGCCATGTCTGAACCTCTCACCAAGGTCGACTCCGCCGTTCAAGGCCTGTCATCATCACCGCCCAAAGAG
AAGGGCCATAGGAGAACAAGCTCTAGCGCGGCTGGTGTTATGACCATTGCGGAAATCAATGAAAGCCATGCTCCTCTAG
AACTCGCAATAGAGACACAGCAGACAGCGTGGAAAATAAATCAGCGGCCCAAGGATCTCGACAATGATCAGCTGCTACA
GGTTCCCCTCACCAAGCCTCCCATCAAGAGCATAACATTGAGGTTCCCTCATGGCAAAGAAGTCGTGGCTCGCAACCTG
AAGGGCCTGACAATAGGTGACGCCCTGTCGGCCATTCACAAGGCAAACAAGAACCGAGCTGATGATGAGCTTGATAATC
CATACCTCAAGGGCTTCGCATGGGATCAGGGCGAGAACTACTTTGAAGTACATCTCCAGAGCCAGCCGGCGACGGGCTC
GTCAAGCGGCGGTGGCGGTGGCAAGAAGAAGAAGAAGTCCAAGGACAATGACGAGTAAATGAATATCCACCCATCCTAA
TGTCTGTTCAATAGTTCCTTCAATTGTTTTTTGTTTGGCTTCGCCTGGTTCGTGCGAGTCGGCGCCCGGGATATTGCA
ACTAGATGTTGTTGGTCGGATATGATGACGCGATTGCTGGATGCATCGCTTATGTACTCAATTTACTTTCACGGAAAC
GGAGTGTTTTACGCTCTTAATGTATAACTTGAAATTCTGAAAAAAAAAAAAAAAA > SEQ ID NO:7503 215655FL Trichoderma harzianum
AAACAAGCTTCTCCATCTTTTTTCAGACTCCTTGAGAAGAGAACTCGGACTTAGACTTGACTTAACTGTCTATTACACA
CACAGCTCTCCACTAAAAGCATCGAGCTCTTACACAACAACACACAAACAACTTTGTCAACACTCACAAACCCTTATCC
GGTTTCACTCAACTCTTTTCTCTCTCAACAACAAACTCACTCACAATCACTATGCCTTCTTCTCAAGGACAAAGCTGGT
GGGCCCGCCACTGCACCCCCCGACCCCCGATCAACAAGGTCGTCGCCTGCCCCTGCCACTACTGCTACAACAAGCCCGC
CTGCCGAGCTCGACTACCCCGAGTCGTCCAACTGCTCCGAGACGAACACCCCTGCTCAGTCGAGGCCTGTCAGCCCCGA
GGCCGCACCAGCTCGTCTTCGTCTTTTCACGTTGAGAAGGCCGAGAAGCAGTAAACGACACATTCGATCATCGAAATCA
TTCAAATCACAAAAGCGAGTACATCTTTGAAGATCCTTGGATACTATAGGATATACACACACTTTCGGTTTCAACATT
TTCCTTTGTTTCATTCTCTCTACTGAGCGAGCGAATACAAATATAAAACGGGCGCGAAAAAAAAGCACCAACGGCGC
TTCTCCCGATCAGTTCGGGTTCGGCGTCCGGCCCCACTTGGAGCGGCCAGGCCGGACAAAATACACACACACACACAAT
AAGGAAGGGGAAAAGGATTTTGGCAAAGGAGGGAGGAATACATAATACGAGCGGATATTGGGTCTTAGCGATGGAATTT
TTGTTGGAATACCCCCCTTGATGGAATTTTAGAGCCTTTTCATATGTTTATGTTTATTTTTACTTAAATCAATACCTTA
TTTACAAATAAAAAAAAAAAAAAA > SEQ ID NO:7504 215691FL Trichoderma harzianum
AGAACCACAGAATTCATGGGCCGCCGCTATGCAGATGGGCACATCGAGCAGATCATGGGGCTTCATTTAGCGAAGCGAA
GCATCCTCGAGGCTTGGATTCGTCCAAGCCAAACTAGCGCAGATAGCAGGTATCACGATACCTTGTCTCTCATTTACTC
ATGACGAATTATCTTGTTGAGAAAAAAGAAAAGAAAAGAGTCGGCAACGCGCGTTTTGGCGAGCATGGCTTGTCGGGAT
CTTTTGTCGAATCTCGGCGGACGGTTGATACCCAGCATCAAGGGGGTTTGGGCGCGCATAGCGACGATTTGGTTCTGT
GCCGTTTGCCATCTCATATCGAGCCTGGAGTTTTGGACGGCTGATATTTTCACCCTCGTGGAATTTTCCTTTGTCGTC
TAGTTCACGCTGACAAGTTGTTTTTTCCTTGGTTTATTTTGTCTCCTTGCGCGCAAGTTGTTGCACCTCGAGCCGGCGT

FIG. 1 continued

```
TTTGGAGGCTTCTTAGCTGGATGCGCGTGCATCCGTGTATAATAGTATGAATGAGTCGTTGTTTTTGTTGTATTTTTG
CGTTTTTTTTTTTTTTTTTCGGGTTTCGGAGACGCAAGGGGAGGACACGATGTTGAGGGTCTGGCATGGCTGAGACAA
AAACCCCCAGACTTTTGAAAAGGGCAAACGTTGGAGTTGTTGGAACTTGAGCAGAAAAATACGTTATCGAGCATTTCCT
GCACTATATCTGGGAAGGCGGCAGGCTGGAGTTTGGATGGCAGGGACGGACGAGGCAATTGTCATGCAGATGGTAGACC
AGATCGTCCTTCTGGGAAGGCACGATAGTAACCTGATTTCTCATCGCACCTTCTTTTCTACTTGACTTGCCGTTAGTAT
TAAAATCTTGGTAATGAATAAAGACATGATGACAAAAAAAAAAAAAAAAAA

> SEQ ID NO:7505 218926FL Trichoderma harzianum
GCTTCTCCAAGACGAAAATGGAAGACTACAGCAACGACCCCAAACATGACCTCACCCCAGAGGCTGCCGCCCTGGCACA
ACTGGGTCACAAGCAGGAACTCAAGCGAAATTTCTCCCTGATTTCTATGCTGGGTCTTGCCTTTGCCATCCTCAACACA
TGGACGGCCTTGGCAGCTTCAATTACACTCGCTCTCCCCTCTGGCGGCGCTAGTTCCGTTATCTGGGGTCTGATCGTGG
CCGGTATCTGCAATCTGTGCCAGGCTGCTTCTCTCGCCGAGTTCCTTTCCGCCTACCCCACAGCCGGAGGTCAGTATCA
CTGGGCCGCCATTGTTTCATGGAAGCGATGGAGCCGCGGTATTAGCTATGTTACTGGGTGGATCAATGTATCCGGCTGG
GTTGCTCTTAGTGCCACCGGTGGTTTGCTTGGCAGCACATTCATCGTGAACATCATTTCGCTGCTTCACCCCGACTATG
AGCCTAAGGCTTGGCATCAATTCCTGATTTACATCGGCTTCGCTCTCATTGCCTTGGTCATCAATGCTTTCATGACCAG
AATTCTGCCTCTCTTCACCAAGGCCGCGTTCTTCTGGTCGGTTGCCGGCTTCGTCATCATCAGCATTACGGTCTTGGCC
ACCGCGTCCCCGGATTACCAGTCTGGCGAGTTTGTCTACGGCAACTTCATCAATGAGGTTGGCTGGCCCGATGGTATGG
CTTGGCTGCTCGGATTGCTGCAGGGAGCATTTGCCCTGACAGGTTTCGATGCGGTTGCCCACATGATTGAGGAAATTCC
AGAGCCACATAAGGAGGGCCCCAAGATCATGCTTTACTGCATCGGCATTGGCATGTTCACTGGATTCATCTTCCTCACC
GCGCTGCTCTTCTGCATCAAGGACGTCGACGACGTCATCAGTGCTGCTTACGGTCCGCTGCTGCAGATCTTCATGGACG
CAACCAACAGCAAGGCTGGCAGTGTGTGCCTCCTCATGTTCCCCCTCGTCTGCATGCTTTTCACCACCGTCACCCTGGT
CGCCACCAGCACCCGAATGAGCTACGCTTTCGCTCGTCGACAAGGGAATGCCCTTCAGCAGTGTCTTCGCTCAGGTGCAC
CCCACTCTCGACGTCCCTATCAACGCTCTGCTCTGGACTGTGCTTGGGTCATCATCTTTGGCTGCATCTTCCTGGGCT
CTAGCAGCACCTTCAACGCCATTACATCGGCATCCGTTGTGGCTCTTGGTGTCACCTATGCCATTCCTCCGGCGATCAA
CGTCCTCCGCGGCCGAAAGATGCTTCCGGAGAATCGCTCCTTCAGGATTCCCGAGCCTTTCGGCTGGATTATGAACATT
GTTGGAATCCTTTGGGCTATCTTGACCACCGTCTTGTTCGTGTTCCCTCCGGAACTTCCCGTCACCCCCGCCAACATGA
ACTACTGCATTGTCGCCTTTGGCGTCATTCTCCTCATTTCGGGCGGTACTTGGATTTTCGGCGGCCGAAAGACGTACAC
GGGACCTGTCGTGGACATCCAGGGCATGTTCCACGGCACTGTTGACGGCTTGGATGGCCTGGAAGGCCTGGACGCTGCG
CAGTCGGACAGCGTTCGTGAGGATCACGCTGCGGAAAAGAAATAAATTTCCTTGTCGTAGATCTAGCG > SEQ ID NO:7506 167347FL Poppy
GTTCTTGTCATTAATTAAGTCGACGAATTCGCAGAGAAAAAAGAGAGAAACATGTGGAGATCATTTGGAAATGGTGGGT
TGGGAGGAGGCGCAAGTGGTAGTGGTGGCATGTTAAGAGCAGTAAGGATTAGGGCAACTGTTGGTGGAGGATTGCAAGA
TCCTGTAACCATAAAAAAACCTAACTCAACAAAACCCACAACACCAAACTCTTACAATACTAATGTGTTAACCCTATCA
ACACATACTCGCGGTGGTTCATCAGTTAATAATAATCAAGTTTTATTATCATCACCAACATCATCAGCTTCAGTTTCTA
ATGCTTCTTCGTCTAGATATTCATCATCTTGTTCATATTTATATGATTCTACTGATGAATGGGAGTGGGAAACTGTTGA
CAAAGATGGTGAGGAAAACAAAGATGATTTGGTTTTATCAAATGGATATTATGATATCTTTGGCGCTGTTCCTTCTATG
GATGAAGTTAGAGATGCGGTTTCTAATCTTCAACAATTTTCTTCGGCTGCATCAGACGAGGATTGGGTCGAACCTGCTT
TACAGGTTAATAATCCAAGAACATTGAGGTCTCATGGATATGAAAGGGTTTATACTGCTTTCCATTTATTGCAGACAGA
TCCAAGTGTTCAGAGAATGGTAGTTTCTTTATCTACCGATAAAGCTCTATGGGATGCTGTTTTAAATAATGAAGCTGTT
CAGGAGCTTAGAGAGTCCTTTCGCTCAGCTGAAAGTGGCGAGGAGCTGTGCAGTTCTGAGGAAGGCTTGCCTCTGGATG
AACCTAAGAACATGTTGAAGTGGATGTTGGAGGAAACAAAAGGGAAATTTATAGAATTTGTTGAAAAATAACATCACT
TTTAAGTGCCATGTTTCAACCTCAAGAGAAGGAACCAGAAGTAGCCAATGATATGTTTGAAGATACTCTGAGGTCATCT
TTATTCCTCTCGGTCATGGTCCTCATGGTTGTGGTCATCACTCGTGCTCAAAGGACTTGATCGATCATTCGTTGACATT
GCAGTGGAATAAGTTCCAATAATTAGGTGAAATTACAGTAGAAAGTAGATTTTGTAATTAGAACAAAAGGCTACAAATA
CTCCTGCACAGTTGGGGTTTGAAAAAAACAATCTTTTGTGCATAGTTTTTAGTTTTTAGTTTTTACCGACAGGTAACCT
CTGTTTTGATAACTCATCATGTTGGATGGTGACCTGAAGTCATGTTTGGATGACTAGTACAATTTCGATATGTTTATTT
ACTCTTGCTTGTTCCCAAAAAAAAAAAAAA > SEQ ID NO:7507 215023FL Trichoderma harzianum
TGAAAGAGAAGGACTTTATCACACAAGCCGTTTCGGTTTCTACTTCTCCTTATTGTTATTATTACATCTCGGTGCACCG
CTGCATATGGGCATGGAATGGAGGCTTTTTCTTTTTCTTTTTCTTCTTGTTGGTCAGTCTTTTACGAAATACGCAAC
AAGACCTTGGGTGGAGTTCTATGGATACGAATATGAGGCGTTTGCAGTGGATACGTGAATGTGGAACGAGAAACGTACG
CAAGACGAGTATGAGTCTCTTGCATGAAATAGCATGATGGGTGGTTTGGAGAAGGACTAAGCAAGTGGTTGCTGTCCTG
```

FIG. 1 continued

AGCCTTTGGCCGTCTGCGACTTGGGGTTGTTGGAACAGGCCTTGCATGTCTTTATGACTGACAGAGGTGAGCTTGGAGT
TAGCGCTTTTGAAGGCAGCTCTTTTCAACAAGTTGCAAATTTCCATTTTATCATTCTATAAGCTGTTCCATCTCCTTAT
TTCCACTAAAAAAAAAAAAAA

> SEQ ID NO:7508 215095FL *Trichoderma harzianum*
CCTCGCATCGCGCCGTTCCGCGCTAAAACGCCCCCTCCGTTGCCTTCTTCTATTTTCTACTGGAACGGAGGAGTCCGTC
CTGGTTCCTGGACTGGACTGGACTTGGAACAAGCAGATGCAGTTAGAGAGGGGGGGAAGAGTGAAAATGCCATTGCCAG
GGAAGAAGCTGTTTGGCGAGGAGGGGGAAAAGCTGCTGGGCTGGGCGGGAATGTCGTCATGGCTCCATTCTAGGCCTGT
CGCTTCCAAGCAGCCCACTAAATCCAACCCAGTAGGTCAGTTTATGCACAGAATAGCTGCATGTCTGGCACCATCATCA
AGGCATCCCCGAAAGGAAGAAAAAAAAAAGGAAAAAATCACCGCCAAGTGCCGCATTGACTCGTAGAGTCTCTTTCGGC
CATTGCCGGTATGCCTCCGAATCAGCCTGCCAACTTGACTGTGCGCTACCGGAGCTTGCGCCCTACCAGTATTACTGCC
CGTATTCCATCTTAGGTTCTATTCGTAGCCGCCTTATATTGCCCTGAAAGGTGTCATTCAGCCTACCGGAAAGCCGACG
GATGAGCCCAATGGCGCTTACTAGTATGCCAGAGACTGCCGTCCCTTACAATGAAAGCCGAAAAAGCCTCCTAGAAGCC
GGCGCTGGCTCCGAAATGCCATTCTGCAGCCGTTCATTGGTTACAAGGTGAAGAATCCTGGATATCCGATTTCTATGTC
TGTATGTAAGGTACAAAAAAAAAAAAAAAAAAAAAAAAAA > SEQ ID NO:7509 215347FL *Trichoderma harzianum*
CCGACTACGTACCTCCCCCCTACGGCGCCTATCCCCAAACCCCGGTAGCGACACCCACCGGCCAGCCTAAACACGAACC
CTATTTCCCGCCGCCAACTCGACCCCAGCGAGCGCAAGGCTTCGAGGCTCCAAATCAAAACGCCGCACCTCCCGTATCG
TACAGGCCCGACGGACGGAGTTTCAGACCGTCGCTGCCTCCATTATCCACGTCGACCGACCCCTACCAATCTTTTGGAA
GCGCTGGCCTTCCATCGTCCTCATCCTCAGATATGCCGCCACGAAAGGTAGTGGCGCCTCCGCCCCTACCCCAGCCGT
CGAGCCGTCTCCTGTCCGGACAAAATTCCCGACGGCCCGGATCAAGCGGATCATGCAGGCCGACGAGGAGGTAGGCAAG
GTCGCTCAGCAAACGCCCATTGCTGTGGGCAAGGCATTAGAGCTGTTTATGATCCAGCTCGTCACAAAGAGCGCAGATG
TTGCCAAGGACAAGGGTTCCAAGAGAGTGACGGCGTCCATGTTGAAGCAGGTGGTGGAGGCGGACGAGCAGTGGGACTT
TCTTAGAGAGATTGTCGGCCGCGTGGAGAATGAGAAGGAGGGTAGCAAGTCCAAGGCCAAGGCCGAGAGCGAAACCGAC
GAAGAGATGATGGAGGAGCCCAAGAAGCGAGGCAGAGGTGGCCGTCGTAAGAAGGTACAATGACCTCGAACATGCACGC
TTGATGATGGGTACGAAGATTGGGATGACTGGCGTTTTACTGGCAAAAAACATACCATTTGTTATTTTCATACAACGG
CGTTGGGGACGGACACATTCGGGAGGGGGTGGAACTCTAGACGGCCGTGTAGTTGTGAGGCTCTCTATCTAGATGCGCA
CGACAACTACGTGAGGTGTCTTGGTGCTGTAACCATTTTGTTCTCTTTTATTGCCACATGTCCACTATTATAATAGCTT
TCATCCTAAAAAAAAAAAAAAA > SEQ ID NO:7510 215528FL *Trichoderma harzianum*
CCCACGCGTCCGAGATCTCTTTCGATATCTCATCCTTGCAACTCGTCTGTCTCCTGCAGCACCGAATATCGTTTCCTGG
AAACTTTAAATCTATCAAAACAACAACTTCCTTTTACACATCCACCATGAAGTTCTCTAGCTTTGCTGTCCTTGCCGTT
GCCGCCCTTGTTCAGGCCAACCCAGCTCCCTCTCCCGCCCCATCTCCTGCTCCCGGCCTGGGCGACTTCATCGACGACG
CTTCCACCTGGCTCACTGGCAAGGCCGGCGAGGTCAAGACCTGGCTCTCCGACAAGGCTGGCGAGGCCTCCTCCTTCGC
CAGCCACGTCCAGTCCAAAGTCGACGCCAACGAGTCCAAGGCCAGCGCGGCAGCCAGCGCCATCAAATCCATCTTCGAC
GATGCGCCCTCCAGCGTCATCGCCAGCCTGACCTCCGAAGCCGGCTCCAAGTTCAGCTCCCTCAGCAGCGTTGCCGCCA
CTGCCACCGGTGCAGCTGCCTCCTCGGTCAACGCCGACATTTCCAAGCTCAGCGCCTCCCTTGCCAGTGCGACCACGTG
AGGCTGCCGCTGCCGCGTCCACAAAGTCCCACGACGCTGCTCCTGTCCAGACTGCCTATATTGCAATTGGAGCCCTGAT
GGGCGGAGCTGCTGTCCTGGCCAACATGTAAGGTAGCGAATGCTATCATCGGAGAATCAAGCCTGCTGAAATGGAGAGA
AATGGGTGGAATATATACTAGAGTGTACTTCTATCTGGGAGGCATGGAAACAGAAAACATGAGAATGGATGGATAACGA
AATACCCCTAAGTTCGCGAGAGCACACATGGCACACCTTGGTTGAGAGAGCTTTTCTTTTTCTTTTTTCCTAGCTGTTT
TGTATTATCTTGGCTCTTTGTTGAGATGAGTCTTTATGAATAACGGTCTGAGGCTGCATTAGTTGGCGAATCTACTACA
CTGTCATTTCTTGATTCAGAAAAAAAAAAAAAAA > SEQ ID NO:7511 215692FL *Trichoderma harzianum*
CCCACGCGTCCGCCCACGCGTCCGCTGTCTTGCTTACTCTGTTACTGAACTCATTGTTCTTTGAATTGAACCTTACGAT
ATCAATTACAACCCATTGAGCTGCTGCACCACCAAGCTACCACACTTACATACAAACACACACACACAAATCACCAC
TACAATAACCACACAAATCAACAACACCAAAACAACAACAACAACCGTCACAATGCCCGTCAACTACGTCTTCACAGAG
TCCGCCCCCTCCCAAAACAACTACATCAGATCCGGCCGCGGCGGCGCTGGCAACATTGTCCGCTCCTCAGCCCTCCCTC
CCACATCATCATCCTCCGCCTCCTCCTCAGCCTCCCGCCAGCTCCCCAACCAGCGCTTCTTCTCTGGCATCGGCGGCGC
CGGCAACGTCCACCAGGCCGACAAGCTCCAGCCCGCTCTGCTGCACTCCCTCGAGACCCCCGCCAACCAGAACCCATCG
CGAGGCCACGTCGGCCGCGGCGGTGCGGGCAACGTCTACAACCGCAAGCCTAGCGATGCCAGCAGTGTGTCGAGCGCGG

FIG. 1 continued

GCAGCACTGCTAGCTCGGTTGGCGAGAAGGCCAAGATGTGGGCGTCTCGCGTGAGCGGCTCATTCTCACGAAAGTAGAT
GAGATGTCTACATATCCATCTCCATCTATATACCTACTACTGGTTGAGGATATAACTGGACTTGAAAATGAAAGAAAGA
AACAAAATATAATCAACAAAAACTGGCGTTGAGGATACAACACGGTACTGGATGACATTTGGGGAGAGCGATTTTGATA
CACAACAACACAAAAAAATACACACATAAACCTGTGTGATGGATTTACGATTACGAATATACCCGCCTGGTTTATAGGC
TATCTGGGAATTGAATTGAATTGGAGTTTTTGGGAGCAGAATCAAGCGGCACGGAATGGATGCTGCTTTGAGAGAATAT
AGGCGGAAAAGTTACCTGAGAGATACACTAGTTGATAATGCTAAATCAATGCAAACACATTCTACTCGCTAAAAAAAAA
AAAAAAA

> SEQ ID NO:7512 218947FL *Trichoderma harzianum*
CTCGACCCACGCGTCCGCAGCTCTGCTCTGTTGTGTCTGTATATTAAGACGTCGTTCCTGCCATCTCTTCCCCCTTATC
CTCCCTCTTCTTCTCTTTCTCGCCACCCTATACTTACCCCTCCTTGGCCTTGTTCGTACAACAGGACCAACAACTTGTG
AATGCTCTCATCCTTTTCCAAAAGACTCAAGAGCAAGAGATTCAGAAAGTCCAAAGCCATGATCCGACCCACCTTCGTC
GGAGCCATAGACCAGGGCACCACAAGCTCTCGGTTCCTCATCTTCAACCAGAGGGGCGAGGTGGTTGCCACGCATCAGT
TAGAGTTTGCACAGCACTATCCTCATCCTGGATGGCATGAGCATGATCCTGAAGAGCTTGTTTCGTCTGTGGAGACTTG
CGTTGATGGTGCTGTTGTTGAGTTTGAGAAGCAGGGTCACAACCGTGAGCAGATTGTTGCCGTCGGTATCACCAATCAG
CGTGAGACAACTGTCGTTTGGGACAAGACGACGGGCAAGGCGCTGCACAATGCCATTGTCTGGACCGATGCTCGATCCC
AGGAGCTGGTTCGCAAGCTGAAGCATCGTATTGGAGCTAGCGAGCTCATCAGCCGATGTGGTCTCCCTCTATCAACGTA
TCCCTCTGTTAGCAAGCTGTTGTGGCTCCTTGAGAATGTAACTGAGGTCAAGGAGGCCTATGAGCGTGGAACTCTTGCG
TTTGGCACAGTCGACTCTTGGTTGACGTACAAGCTCAACGGTGGAACAGCCCGCAACATCCATGTCACAGATCCTTCCA
ACGCCTCACGGACCATGTTCATGAATCTTGAGTCGCTCAGCTACGACGCTGATCTCATTGATTGGTTCCGCCTTGACCG
AAGCAAGGTCAACCTTCCAAAGATTGTGCCCTCTTCAGACACTGAGGCGTACGGCTCTCTGGCAACCACTTCGCTCAAG
GGCACCAAAATCACCGGATGCTTGGGCGACCAGTCGGCTGCATTGGTTGGCCAGAAGGGTTTTACCGCCGGCCTTGCCA
AGAACACTTATGGCACCGGGTGTTTCTTGCTGTACAACGTAGGCCCCAAGCCTGTCATTTCGACCCACGGTCTCCTGAC
CACTGTTGCCTTTGATTTTGGTGAGGGTAAGAGAATGTATGCTCTCGAGGGTAGTATTGCCGTGGCTGGATCCAGTGTC
AAATTTTTGGTTGACAACTTTGGCTTCATCGAGTCGTCATCCAAGCTTAGTGCTCTTGCCGAAGAGGTCGAGGACAATG
GAGGCTGCACTTTCGTCACTGCTTTCAGCGGTCTCTTTGCCCCTTACTGGATCGACGATGCCCGAGGAACCATCTTTGG
CATCACTGCCTACACCCAGCGTGGTCACATTGCTCGCGCCACGCTCGAGGCCACATGCTTCCAGACACAAGCCATCCTT
CGAGCCATGGAGAAGGACAGCGGAAAGCCGCTCACTGAACTCCTCGTCGATGGTGGCATGTGCAACTCAGATCTTATTA
TGCAGACTCAATCTGATTTCACTGGCATCAAGGTCAACAGACCAGGAATGCGAGAAACCACGGCGCTGGGTGCCGCCAT
CGCGGCTGGGTTGGCAGTGGGTGTTTGGAACAGCTTCGAGGACCTTGAGAACGTAAACAACGAGGGTCGCACCTTTTC
AAGCCTCAGATCTCAGAGCAGGAGGCGAGCAAGAAGTTTGCTCGATGGGAGAAGGCGGTTCAGATGAGCAAGGGCTGGT
TGAACGACGAGTAATGAAGTACTTTGCGAGAAAGAAAGCATGTAATGAAATCTTGTTAGTCTAGCAATAATTAATACCA
CGAGCGATTGGCTGTCAAAAAAAAAAAAAAA > SEQ ID NO:7513 219159FL *Trichoderma harzianum*
CCCACGCGTCCGCGAGACCAAGGAGTGGCTCTCTGAGGTTGCTGAGCATGCGCAGGCGCTCAAGGTCGATGGTGGCTTC
GAGGAGGGTGCCGATCTGGGCCCCGTCATCTCCCCCAGAGCAAGGAGCGCATCTTGAGCATCATTGACAGCGCCGAGA
AGGAGGGTGCTACGATCCTGCTCGACGGCCGTGGCTTCAAGTCTGAAAAGTACCCCAACGGCAACTTCATCGGACCCAC
CATCATCTCCAACGTCACTCCCGACATGACCTGCTACAAGCAGGAGATCTTCGGCCCCGTGCTGGTGTGCCTCAACGTC
GAGACCATCGACGACGCCATTGAGCTCATCAACAAGAACGAGTACGGCAACGGCGTTGCCATCTTCACAAAGTCGGGCG
CCACCGCCGAGACGTTCCGCAAGAACATCGAGGCCGGCCAGGTGGGCATCAACGTGCCCATCCCCGTGCCGCTGCCCAT
GTTCTCCTTCACCGGCAACAAGAAGTCGATTGCCGGAGGCGGTGCCAACACCTTCTACGGCCGACCTGGTATCAACTTT
TACACGCAGCTCAAGACGGTGACGGCGTTATGGCAGAGCGCCGATGCCGTGGCCAAAAAGGCCGCGGTGCACATGCCCA
CGCTGCAGTAGAAGATGAAATTGGGTTGAGCGGTTTAGGATTGTTTGTGTGCGGAATATGACGGAATGGTGGGAAAAAT
TGATGATGCCTTGATGAAATGAAGGGTGGTTGTCTCACAGAACATGCATGTACTGTACATAATATAGCCACGAGCAGAT
GGGCTGGACAGCATGGGAATTGCTTTTTTTAAGCAGAATGAAATAAATCTACGTTAAATCCAAAAAAAAAAAAAAAA > SEQ ID NO:7514 181039FL Poppy
GTCGACGAATTCATGACCAAAAGATTTTAGAGACAGAGGATGGGTAACTTTTGGTCATAAACCTTTAAATCAGAAAAAA
TGGTGAAAGGTCCAGGACTTTACACTAATCTCGGAAAGACAGCTAGAGATCTTCTTTACAAGGATTATCAAAGTGACCA
GAAGTTTAGTGTTACTACATACTCTGAAAACGGGATGGCGATTTGTTCATCTGGACAAAAAAAGGTGAGGTATTCTTA
GCAGACGTGAACACCCAGCTGAAACAGAAGAACATCACAGCTGATATCAAAGTGGACACAAATTCTAGGCTCTCTACGA
TTGTTACTATTGATGAACCTGCACCAGGTGTCAAGGCTATAATTAGCTTCATTGCTCCCAAATTGCTGCTGGAACTGAT
GTGTCCTTTGACACAACATCGGGGAATTTTGTGAAGTACAATGCTGGGTTGAGCTTGGCTCGCCCTGACCTGGTTGCTT

FIG. 1 continued

```
CGTTGACTTTGAATGACAAAGGTGACAGCTTGAACGCCTCTTACTATCAGACATTGACTGACCTGAGCAACGCATCTGC
TGGTGCTGAACTGAGCTATAGCTTTTCCCGTGCCCAGAGTACACTTACTATTGGTGCCCAACATGCATTGGATCAGCAA
ACTGCAGTGAAGGCTAAGTTGAACAATTTAGGCATAATGAATGCCTTAATCCAGCATGAAATTTACCCCAAGTCATATT
TCACCATCTCCGGAGAAGTTGACACCAAAGCCATCGAGAAGAGCGCAAAATTTGGTTTGGCTCTTGCTTTGAAGCCATA
GATGATCAAAATCTCTTGAAAATGCAAAGGGTAGGTAGTAGAACAGTGCACAGTAGTAGTTGAGTATGTTTTTGAACAT
GTAAAACTACACGTTTCCTTTGGTTGCATTTTCCATCCCATTTCATTGTTTGAAGATGAAACACTCTTTTTTCTAGCAG
TTTGTGAGGTTCATTTTGGAACGTTGTTCTGTTCCAATTTGATGAAAATCTTTTTTATTTTTGTGGAGCTGGAACTTAT
TTTTATAATCAGTATTTTGTAGGAAGCACCTCCACATTAAAAGTTCTCTAACGTTTTTTCTTTAGGGTCCATGTGTTGT
TTTTGCTAAAAAAAAAAAAAA

> SEQ ID NO:7515 215106FL Trichoderma harzianum
CGTGTTTTGGTGCCCTCGTCCGCTTCCGCTCGCTCACCTCAGATGGCCGCGCCGACCCGAGCTGTGGCCGGTGTGGCAA
GCGGCCTGTCCCGGCTGGTGCCTCGTTCTCGTCCACGGCTGCCAATTGCCTCTGTTTCTATTACAGCAAAGACGACGGC
ATCATCGCGATGGCACTCGGGCTTCTCGTCGGTCAACCCCAACGAGGTCTCACACTTCAATGCCCTCGCCGCTGAGTGG
TGGGAGCCGCACGGATCGTCGCGCCTACTACACCTCATGAACCCGCTGCGCCACGACTTCATCCGCTCCTGTCGCGAGT
CCTCCGACGACCTCAATTCCATCACATACCTCGACATTGGCTGCGGCGGCGGCATCTTCGCTGAGAGCGCCGCCCGCCT
AGCCACCACCAAGCACGTCACCGCCATCGATCCCACACCGTCCGTCCTCAACGTCGCAAAAGCACATGCCCGCAAAGAC
CCTTCTTTGGCGGGGAAGCTGTCCTACCGACAGTCTTCGGTCGAGCAGCTCGAGGTCCCTGCCGAGGGCCAGGGCTACG
ACGTCGTGACTCTCTTTGAAGTTATTGAGCACATTGACGATCCGGGAGCGTTTCTAGACCGCGTGCGCCCGCTCGTCAA
GCCTGGCGGGTGGCTCATCATGAGCACCATTGCGCGGACGTGGGTCAGCTGGTTGACGACGAACCTCATTGCCGAGGAC
ATCTTGCGCATCGTGCCGCCCGGGGACGCACGACTGGAATAAATACATCAACGAGGGCGAGCTGAGGGGGTATCTTGCCG
GCAAGGGCTGGGACAGCGCAAAGGTAATGGGCGTTGTCTATGTCCCTGGGTTTGGGTGGAGGGAGGTCAAGGGCAGCGA
AAAGGTGGGCAACTATTTCTTTGCTGTGCGCAAGGCATAGAGAAGAGAGGGAAACAAAAAATTGGTGAGAAAGTCGCCA
CGGGCGAAGCATCACAGGCTACCTGCTTGTAAAAAAAGAACACATGTGTATTAATATGGCTTTGGGAGATTTGATACCC
CTTTGATGTCTTACGAAGTTCACGATGGGACATGGGCGGTGCAAAAGCCACTGTACGATAGTTGATGGAACCGGAAATA
AGCTCATTGCATTAGAGAGAGGTCTGAAAAAATGGTGAGAAGCTTTCTCGATCATCTAGCTCCAAAATTTTTATTTCTT
GCTGGGTATCATTTTGTATAGAATCTTCATTTCTACCAACTGGAGCACCATAAATCAATCTCATTTGATGGCCACCATT
GGGGTCTTTCAAAAAAAAAAAAAA > SEQ ID NO:7516 215259FL Trichoderma harzianum
CAAGCCAACCAGCAACAACAAAACCCCCTCAACTTACAACCCAACACAATCTCTTCAATTACATCCCACTTATATACTA
CCTTTAAAGAAAACATCCAATCAAAATGACCAAAGTCCTCATCCTTGGCGCTACTGGTTATGTCGGCAAGAGACTAGCT
GAGACTCTAGTTCGAAGCGGCCAGCACCAGGTATACGGCATTGCTCGAACTGAGGCCAAGGCCAAAACATTGGCTCTCG
CAGAGGTCACGCCCATCATCTGCGCTGATCCAGTAAATGAACCTAAATCCTATATGAAGGCTGTCCGCGACTACCACAT
CGATGTTATTGTCGACATTGCTGGCGCCAATCAAGAGTCGGCCAAGTTCCTCAGCCATGCCAAGGAGATCAGCCAAGAG
CGACTGAACAGCTATGCCGCTTCTGGCATTAAGGGCCCTAAGCTTGGATTCATCTATTGTTCGGGCACTTGGGTTCATG
GATCTAGTGATAAAGCAGTCAACGATCTCAACATCGCTGGGCCCAGCGGTGTCACCCCTCCAAGAGCTCTTGTAGCGTG
GAGAGTTGGCCTCGAGAATTCCATCTTGGCATCTTCCGATGTCTTGGACGTTGCTGTCCTAAGACCAGCATTGATCTAT
GGCTACGAAAACACCATTTTGGACCTCTTTTATCCTTCCACTCCTTCAAGCAGCTCGAAGTGGCTCCTCGGAACCTGTC
AACGTTCCTCTGCAAGCTGACGCCAGGCCGGCGCTCATTCACGTTGACGATGTGGCTACTGGTTTCCAAAAGGCGATTG
AGAATCTGTCCCTGATCAACAGCGGCTCTGTATACCCGGTATTTGATCTGCTCACTAGTCAAGAGTCAATGACTGAGAT
CTTCAACGCCATGGCCTCTGCTTGGGGTTACAAGGGAGAATGCAAGCTGGTTGGGTCTGGCGATAATTTGTTTGCCGAA
GCTATGAGCACAACTTTGCGCGGATCTTCATCGCGTGCCAAACAATTGCTTGGATGGGAGCCAACACGAACCAATGGGT
TTGTTGCCGACATGGATTTGTATGCGGCTGCTTTTGCCTCTCAGCATTGATGATATATGTGGATATAGTGGGGTGTGGA
TGTACTAAAGAGCGTTGAGAATATCATGATTACTGTTTGGTTGCGTTGAATAGCTTTGGAATTAGATCTGATGAGATTT
GAGATAATATATAGATTGAACAAGAGAAATGACCCAAAAAAAAAAAAAA > SEQ ID NO:7517 215369FL Trichoderma harzianum
CCCACGCGTCCGCCCACGCGTCCGCCCACGCGTCCGCCCACGCGTCCGCGCTTTCTAGGCCCTTGTTTCATTTGAGTTC
AAACGCTTCTTCTCGTCTCTCGTTCAGAATTTATTTCGCGTCCTTCAAACAACTCAAAATGAAGTACTCTGTCGCTGCC
GTCTCGGCCTTTGCCGCCGTCGTTCTCGCCAAGCCCGAGTTCCTCAACTCTGCTTTCCAGGTCCAGGAGGGCAAGCCTT
TTACCCTCGAGTACTCTGGCTGCTCTTCTGGCTGCGAGATTGTTCTCCAGACTGGTGCTAGCACCAACCTGAAGGACGT
CAAGGTTCTTGCTTCTTCTGCCACCGGCTCCTCCACTCGTCACCCTGGAGGACATTCCCTCTGGCATCTACAGCTTC
AAGATCACCGACAAGAGCGGCGAGAGCAACTACAGCCAGCAGTTCTCCTACCAGGGCAGCGGCAAGGCCATCTCCAGCG
```

FIG. 1 continued

```
CCTCATCTGCCACCAGCGCTGCTGAGTCCAACACGGCTGCTCCCACCTCCGAGACCACCACGGCTGAGCCCACCAGCAC
CAAGGCTTCCTCCACCAAGGAGCACTCCACCACGCTGGTCAAGTCAACCACTGCTCACTCCACCACCGAGGAGGCCTCG
AGCACCACCGCCCACTCTTCCATTCCCCCCAAGCACAACTCCACCACGATTGCTCCCACACACGCGGCTACAACCACCA
CTGGAAGGCAAACCACTGCTGCTTCTACTTCCTCAAACCCCGCCATTACCACCGTTCCTCCCGGAAGCGCCGCTGGCCG
CCTCTCTTCTCCCCTCGCCCTCGTTGCCGGCGTTGCCCTCGCCATTGCCTTCTTCTCTTAAATTTGTGGATAGGAGGCA
TGGGGGGGAGCGGGAGTCCCCTCCTTATTTTTTGCGCATTAAGGATTTTTTCTCTGGTACACGGTTAAATTTAATATCT
TGAGGCAAGATTACGTTGTTGTGTTGCTTTTTTCTTCATACAGCAGGGCCAGGTTGTTGGGAAATGGATGGAAGAAGGG
GAGGGTGACGTATTCCCGGCGTCTGTCAACTCTTTTCCTATTTTATTGACGATTGCATGGAATACCTACCTACTCTTCT
TTTGACGATAATGTCAGCCCCTGCATGTACTCTAGTGGTATACTAATGCATTATATCCCCGTTTTTTCTTTAAAAAA
AAAAAAA

> SEQ ID NO:7518 181759FL Poppy
GTCGACGAATTCATGTGAGGTTGTTTCAGGGTAGCGGCCAGTATGACGGTTGCTTATATTTATACCCTAACCTCGAGGA
CGTTGAAACGTTCACCTTCATTGACTGGAAAAAGGTCGGTCTGTTGCCCGACTATATCCGGATCAAGGGCGACAACGGA
AATCACCTCAAGGCTGGCGGTGACGGGTATATGGGCTGCCATCACAAAGCCGATAATTACCCACCAGTGTTTGATTTCG
AGGTGTCCCCGAGTCGCGACGGAGGCGTCCGCCTCAAGAGTGCTTACTATGACAAGTATTGGACGGATATGGATGATAG
TGAATGGGTATTGTTAAAGGAGGCTTCCACCACAACCCATGAAACCAACACCGTATTTATACCCACGGGAAATGTTGGC
GGCGCAATCCAAATCCGAAGTCTGAAGAGCGGTAAGTTTTGCAAGATATTGACAAGTCATGGTAAAGAGTTGTGCCTCG
CCACACAGAGATCCTATATAGATGATTGGGCCAATATGAAGATTGAAGAGCCAGTTAACTCAAGGGTGATGACCGACTA
CAAATATGATTTTGAAGATGCAAGGGCATACGATGACAGAGTAACTGCACTCGTCACTGGTGATGTGAAAAACAAAGGT
AGAGAAACTTCCATGACCGATGTGATAAAACTCGGGCACTCAGTGACCAATACAACTAATTGGAACGTCAGTCACGCAG
TGAAAGTGGGTTTCGAGGTAACTGCTAGTCCTAAAATCCCAGTTGTAGGTAGCACTGGTTTCACTTTTTCCACAGATTA
TACTTTCACTAAGGAAAACGGAGGAGTCAAGGAAGAAACACAGGAAATCGCGAGGGAGGAAACAGTGATTGTGCCGCCT
ATGACTAGGAAGGTGGGGACTCTGGTGGAAAGACGATGTTCATACGACATACCTTACACGTACACTCAGACTGACTCCT
TAAAAACTGGGAGAACAAAAGGTTACGTAAAGCACGGCATTTGTAAACTCGACTACGGATACAAATATGATATAGAGGT
TGTCGACCTTCCTTTCGAGTAAAGATCGCTTCGTCCCTGGCATCGTCTTGCACAGCATGATCCTTTAATTTGTTTGCAG
TATGTTTGTTTCTCGTTGTTCCTTGTTTGTGGTGTGTTCGTATTTATGTTTATGTTTGATGTTGTCCAGTCCATGTCTG
TTTTCTTTATTTATTTGTAATTTCGTACAATCATGAATAAAATAATTTCAAAAATAAAAAAAAAAA > SEQ ID NO:7519 214922FL Trichoderma harzianum
GATACCCAGTATACAGCAGACCGTCCCGAATATCCCAAGTATATCAAGTGCAAGACTGGGTTTATAACAATCGTTTTTG
ATAAACTGCAATTTTTCTCATTTCATACGCGTATTGGAAGACACTTTATTCGTATATTTACGATCTGTTCCTTTGCCTG
TCGAGTACACCACTACACCACTCAACGACACCTACATATTTCCTTTCACCATGGCACCAACCGCTATCGTTGATCTCGG
CGAGACCTTTTCCGTCGGCCAGAAGCTGGAAAATGTCTCCGACGCCATCGACGACGTAAACTGCATCAAGTACGATTCC
GAGTCCAAGTTCGACGCCAACAAAGACAAGGCAAACTTCCGCCAGTACGAGGATGCCTGCGACAGGGTCAAGAACTTTT
ACAAGGAGCAGCACGAAAAGCAGACTGTCGCCTACAACCTTGCTGCTCGCAACAGGTTCAAGAGCGCTTCACGGGTGCG
CCCGGAGATGACCGTCTGGGAGGCCATAGAGAAGCTCAACACTCTCGTTGATGAATCTGACCCAGACACGTCGCTGTCT
CAGATCGAGCACTTGCTCCAGTCTGCTGAGGCGATTCGCCGCGATGGCAAGCCACGATGGATGCAGGTAACAGGTCTGA
TCCATGACCTTGGCAAGCTCATGCTCTTCTTCGACGAGCTCGAAACACAGGGTCAATGGGATGTCGTTGGCGATACTTT
CCCCGTTGGCTGTGCCTTTGACAAGCGAATCATCCTGCCTGATACCTTTGTCAACAACCCCGACACGAAGGATCCCGTT
TACTCAACCAAGTATGGCATCTATTCACCCGGCTGTGGCCTGGACAACGTGATGCTCAGCTGGGGCCACGACGAGTATC
TCTACCATGTCGTGCGCGATCAGTCGCTTCTGCCGGATGAGGCGCTTGCCATGATCCGCTACCACTCATTCTACCCCTG
GCACCGCGAGGGAGCCTACAGGGAGTTTATGGTTGAGAAAGACTGGGAGATGATGAAGGCAGTTCAGGCCTTTAACCCG
TACGACTTGTACAGCAAGAGTGACGATGTACCCAGCGTGGAGGAGCTCAAGCCCTACTATATGGAGCTGATTGACGAGT
TTTTCCCTCAAAAGGTCGTCAAATGGTAAAAAAAAAAAAAAAA > SEQ ID NO:7520 215107FL Trichoderma harzianum
GATTGATTGCTCAAACATCACAACATCAGTCAATCTCTCCAAATGGCTCGGTCAGCCGCCACAACGGCCACCAAAGAGG
CCAAGCCTCAGGCTACTGCTGCTGCTGCTGCTCCTCCAGCTCCAGCTCCAACCGACGGCGATAATAAGCTGCACGACTT
CTTCTGGACTTACACCGAAGAGCCGCACCGCACACGCCGTCTGGCCATCATCAAGGCCCATCCCGAGGTCCTCAAGCTA
TGCGGCCCTGAGCCTCTGACCAAATATGTCGTTGCCGGCGTCGTCGGGCTCCAGATCGTCCTGGCCTACCTCCTGCCGT
CAACGCCCTTCTGGTCCTGGAAGTTCTGGGCCGTCGCCTACGTCTTTGGCGCCACTGCCAACCAGAACCTGTTCCTGGC
CATCCACGAAATCTCGCATAACCTCGCCTTCAGGAGCCCGCTTGCCAACCGGCTCATCGCCATCATTGCTAACCTGCCC
ATTGGCATCCCTTATAGTGCTTCATTCAGGCCGTATCACCTCACTCACCACAAGTCCCTCGGCGTGGATGGCCTCGACA
```

FIG. 1 continued

```
CCGATCTCCCCACTGCCCTAGAAGCCTTCGTCCTCGACTCCATCTTCGGCAAGGCCTTCTTCTGCACGTTCCAAATCTT
CTTCTACGCCATCCGCCCCATGGCCGTCTACCGCATCCCCATGACCTGGATCCACCTCCCTCAACGTCGTCACCCAATT
CGCCTTTGACGTCCTCCTCTTCCGCTTCGCTTCTATCAACGCCCTCCTCTACCTGCTGCTCTCCTCCTTCCTCGCCGGC
AGCCTGCACCCCCTGGCCGGCCACTTCATCGCCGAGCACTACGTCTACGAGACCGTCACCCCTACGCAGCGGAACCCGG
ACAACAAGGTCCCCGTCCCAGAGACCTTTTCCTACTACGGCCCTCTCAACATCCTGACATACAATGTCGGGCTGCACAA
CGAACACCACGACTTCCCGGCCATTCCCTGGACCAGACTCCACGCCGTGTATGACATTGCCAAGGAGTTTTACGAGCCT
CTTCCCCGCCACGAGAGCTGGGTGTATGCCATTTGGCGTTTCATCTTTGACGAAACGTGGGTATTAGCTGCCGTGTCAA
GAGAAAGGAGGGCGGCCGTATCGTTGGCGGCGCCGTCAAATGGAAGCAGTCGGAAATCGAGGCTTAAAAAAAAAGAATA
CACCATCAAAGGGGGGTGGGTTTCATGTCGTTTTGTGGGTAGAGTACGCAACACACAGCCATTGTTCAGGTTAGGAGGG
CTAGAATCTTGTAATAAGCGTTTCTTTGCGATATATATATATATATAAAAGCACCTCACTCTAAAAAAAAAAAA

> SEQ ID NO:7521 215372FL Trichoderma harzianum
GATGCCCGGAAGACAAGACGCTTATTCCGTTTCCATGCCCACAAACTCTCCTCCTCCCCCACAGAGCATCTCCAGCTAC
TCTCGCTTCATCCACGACCACACAAAACGCCAAATGCAGGCCTTTGGAGCTGCTCTATCGCCTACAAGTTCCGGTGCTT
CGGGTCGATCATCAGTCGGTACATCCATGACCAACGGCACAGCACCTGCCATGTAACCATCTTGCATTTCCGCGGGTGT
CCAAAAGCGAAAACTCGCTGCTTGAATTTGCGCATGTTTAGCTTTAGCGGTGCTTCTCTTTTTTCCAGTAGCTTGCCAT
TATGGCAGCTACATTGGTAATCTGGACGGGACTTGGAAAAAAATGAATTTCGGGACAGTCTAATATGGAATAACGCCCC
CGGTGTAACATGGCGAATCCAAGATTGGAACGCCTGCATAGAGCAAAGCAGCTTCTTTTTACCGATCACGCATTTACA
CTACAGCAAAAGCAACTCTTGCGTCACATCGAAAACGAGCCGACTTGGTGCCACTCGCTAATTTGTCGCTTCGTTTCTA
TTTATTATTGATTTTATGACTATATGATACACGCACGGCGTTTTTGGGGGGGATCTTTATGGCAGGATACTAATCGGTT
GGGGATTCGGATTCCCTTTGGCGCAGTACATACGTGGGAACATTGGACAGTTGGAAGGACGAGGGGGCTATATCCAGGC
TGGAAAGCCACCGTACATGATAATGATAATAGCAATCGACGATAAAAAAAAAAAAAAA > SEQ ID NO:7522 218821FL Trichoderma harzianum
CCCACGCGTCCGGGAATACAAGACTCCAAGATGCATCATCAGCTTCTCACTCTCACCGCTGCTGCTGGCCTCCTCGCGA
CGGCCTCAGCTACCTACTCGAAGCTTCCCAGTGTCAATGTGCCTTCATGTCCTCGTGTTGGCACGATTAGCTACAGCAA
GTCAGTGCCCGACCTGACGCCCTTCCCGCTCACACAGGTCAACCTGTGCTACACAGACAAGAGCCTCGAGCTCTCATTC
ATTGCCTATGACGAGGTCAATTACTTCTTCAATGCCTCTCAGGGTACAAACGACGACATCTGGGAGTACGAAGTCATGG
AGGCTTTCCTCTACAAGGGCACCGAAGACCCTCAGACATACGTCGAGCTCGAGGTCAACCCCAACAACGTCACATACCA
GGCATTTGTTTACAACCCCTCCAAGAATCGCGCGGTCGGCGCACCCTTCGACCACTTCTTCGTTTCGGATCCCGCCACG
GACGGCTTCAGCTCGAAGACTGTCCTCAACAAGCTCGCAAAGACTTGGAAGAGCACTGTTACCGTCCCTCTGGGCATCT
TCAACGTCGACGTCGGCAAGGCCAAGGGCACATCTTGGAGGATGAACTTCTTCCGAACCGTCGTCAGCCCTGAGATTTA
CCCTAATCAGACTCTTGGTGGATGGTCGCCGCCAGACCAGGCGAGCTTCCATATTACAAAGTTCTTTGGTCATGTCAAG
TTTATTTGATCGGGAGGATTTGGGTTTACGATTGATGTTTGCGAGCCGTAAAGCGGAATTACAAAGCACATGTACATAA
TGCGGCATGCCTGATCTAATGTAATTGTCAATGATGAATGATCTTAAAAAAAAAAAAAAAA > SEQ ID NO:7523 218985FL Trichoderma harzianum
CTGATGAGCAAATCATCTCATCAAGCTGGCTTTTATCAGTTGTTGATGCTGAATTAGGTGGTTTTCATTTAAATAATTC
CAATTCTTTCAACATTCACTTGACGAAATGGCAAACCTTGCTACTGGGATTCACAAATTCCAAGGGCCGGACATTGAAC
TAACTTATACGGTGCGAGGATCCGGACCATATCTTATTATTCAGGCAGCAGGATGGGGAATTTCTTCTCAGTATCTTCA
AATTGGGCTTTCGCCTCTTGAGGCTCAATTTACCCTAATATACATGGAGCCCCGCGGCTCAGGCCCCTCCGAGCGACCA
CAAGAAGACATAATGACACTTCCGATATGACTGACGACCTCGACCTTTTACGAAAACACTTGGAATTTGAACAAATTA
ATTTGCTTGGTCATTCTAATTGAGGCACCATCGCCTTAGCGTATGCTGAGCGGTACCCCGCCTCAGTCCGAAACTTGAT
CCTCCTCACACATTGGCCCGAAGGATACGATGACAGTCGCACTTGGCAACGATTTCTAGATGAGAGAAAGGGCAATCCA
GCATTTTCAAAAGCCCTTGCGGTGCTTGAGATAGCCGAAACTCAAAAATTCCGGTCGCAAGACCAGTGGTTTCAAAACT
TACGCGTGAGGTTGTCTTTCTATCCGGCCAACCCAGACAAAGATTATTACCCCGCCTTCGAGAAGGCAATAGGTGAGCC
TTTCATGGTGGGTTTACAAAGCTCAGGGTGCAGCCGACAAGATCAAGACCCTTGATCTCTATGCCGGGCTCGATAAAGT
CAAGGCCCGTACGCTATGTTGGGGTGTTCTGAGGATCCAATATGCACTGAGAATGTCACTCGTATTACAGCAGAGCAC
ATAGCCGGCTCGCAGCTCATCATTATTCCCGAGTGTAAGCATTTTCCTTGGATTGAACAGCCAGATCAATTCTTCGAGG
CGGTCATTGAGTTTCTGAGGTGAACATTAGAAGTCAGTGCTACCACAACGTCTTCATGAGAATACATCGCGTCCACAGA
AACCGTCGCAAGTTCAGGCAGCTTCGGTTTTGGAGGAATCTGAGGCCGTGGAGGACATGAAAGGACCAGAATTAGCTTA
TTCACAAGGTACAAGCAGCTGCAGAGTCCCACATCAATCGACATAGCGTCCTAGAGCACACAAATGGCCGCCAGACGCG
GGGTTGCAAGATGTTAGAGAATAGACTTTATTTTCTAAGCTTAAGATACACCCTGGTTGACAAAGATATCCTCTTAAAG
TAAATGCCAAAAAAAAAAAAAA
```

FIG. 1 continued

> SEQ ID NO:7524 213861P *Trichoderma harzianum*
GACCTGGATGCTCGAGCTCGGAGATGTGCGAAACGCCTCGCTCTTCTACCGTGACCCCAAGTCCCTCCCCGACCGCAAG
CCCGGCCTGCCCCATCCCGAGGCCGATACCACCAAGCAGTATGCCGCACTCCATACTCCCCGGTCGAGAAGCTCATTG
CCAACTATGGTGATGCTTCCAACACCTCTTGGCTCGACGAGCGATTCGAGATTTGGCGACACAAGTCTGGCGCCGCCAT
TGGATATGTCAAGCAGGAGAAGTTTGCCATGATCACTGGCGATCCTCTCTGCGATAAGTCGCAGTACAAGGACGTCATC
TCGTCGTTTGTCAAGTACGTTGTGACCGAGCTGCGGCTCGTCCCCATGTGGATGCTTGTCTCGTACGACGTGCAGAGGA
TTCTAGCACACGACTTGGGCTGGCGAACCCTCCTGTACCGAGGAGCAGCGTGTCGATACCGCGAGACACCAGAGCCC
GGCTGGCGGACCCAAGGCCCGCAGAGTCGAGCGTGAAGGCGTCAAGATTCACGAAGTCAAGCCCGACGAGGACTTTATC
TCGCGCGCCAACCCCGGCCATTGAGGCCTGGAAGGCCAACCGCAAGGGCAAGCAGGTGCACTTGACTGAGGTGCGCCCCT
GGGTCGACCCGGAGCACCGCCGCTACTTTGCCGCCGAGAAGGACGACAAGGTGCACGCCATGGTTGTCTTGGCCAAGCT
GTCGCCTCGCCACGGCTGGCAGGTCAAGTGGGCTCTGGACTTCCCCGGAGCCGTCAACGGCGCCNTCGAGGTCCTCATT
GAGCACGCCCTGTCGTGCGTCACCGGACAGGTGACGTTTGGTGTCGGTGTGTCGGAGAAGCTGACTCCTGGCGAGCACC
TTCACGGCATCCGGGCCAAGTTCCTTGCCACCACCTACCGTTCGATTGTCGAGAGTCTTGGCCTGCGCAGAAAGGCTGG
TTTCCGATCCAAGTTTGGTGCCCTCGGTGAAGAGGTGTACATTTGCTACCCCAAGCACGGCGTCGGCTTGAGAGATTTG
CAGCAAGTCATCAAGTTTTTCCAGGATTAAGGGATGCTCGCATGAAATAAATGATACCAAATGATACCACCGAAAGCTC
ACAATGATAAACTCAACTCGGAAAAAAAAAAAACAAAGAAGCATACCTAAAAACAAAGAAGCATACCTAAAAACAAAGT
TACCATGTCTTTTTGAGACCCTTGGAGTTTGAATGATGGCTGGCTGCTTTGCATGGCATACGGG > SEQ ID NO:7525 213171P_A *Trichoderma harzianum*
CCATGTACCTCTGGGATCCTTCACAAGGCACAAAGCCGGTTGCACGGCTTCTGGGACACCAAAAGGCCATTAACCACGT
GACATTTTCCCCTGATGGCAGTCTCATCGCGAGTGCCGGATGGGACAATCATACCAAAATCTGGAGCGCAAGGGATGGC
AAATTCATCAACACACTCCGTGGCCATGTCGCGCCCATATACCAGTGTGCCTTTTCTGCCGATAGTCGGCTCCTTGTGA
CGGCATCCAAAGATACCACATTGAAAGTGTGGTCGATGGCTACGTGTAAGCTGGCCGTTGATCTACCGGGACACCAAGA
TGAAGTTTTTGCCGTATGTTTGCCCCCTTGCCCTTCCAATTTTGTTAACCCCCGAGCCTGTGGCTGACAGCGTGCTAGG
TTGATTGGAGTCCTGATGGACAACGAGTAGGCAGCGGAGGAAAAGACAAGGCCGTACGCCTTTGGATGAACTGATGACG
ATGATGGGAGCGAATCAAAAAAGGATAAATCATGTGTGTTATCGGCGTCCAGTCAGGGATTGATTACGTGTATGTTCTA
GGTCTAGACTCTGTAGAGCTGTTTGTGCAGCATCCGCTAATGATAGAGAGCAAATGTGGCATTTGCCCAAGGGCACGGG
CTG > SEQ ID NO:7526 213171P_B *Trichoderma harzianum*
ATAGTAGATCTGCTATATGTAAATGCAATCAAGACCCCGTAACTTCAANCCCATGCGAATATGATGCAGTGTATCCCAC
CACCTCAAAGTCWAACCCCAGTTCGTCAACAATCGCTTCAAASTCAACCTCCTCTTCTCCGAGCTCCTTCTTCTCTTCC
TTGGGTGTTTCSGCTGACAGAAACGGTTCCGCATTCCCTTCCACAGGCCTTTCTACCAASTCTG > SEQ ID NO:7527 213208P *Trichoderma harzianum*
CTCTTGTTCATCTTGCTACCGCTCACAAATCACCAGCCAAGCGGAGACTTAACAAGGGCTTATGTACATGTAGGATTGG
GCCGTGTCCGGGAATTACCTGTTAGGTACTAAGGCATGTAAGAGATGATGCAATCACAAAGCAAAACCCTTTTGATGGT
ATCAAAGTAAGGCATCAACATCAATTAATGTCTCCGAAACTACATGCAATCCGTAGCTCCAAGCCCCTCTCATTCTTCA
ACTTATCATCATCTTTACTCCTTTTATACAAACCGGAGCCCACAAGCCTTGCCGATTCTAACTAAACTAAACCCTCACT
CCCCGCTTCCAAACTACCGGCGACTTTACAACCAACAAATCTTCACCATGAGTGCCTCACAGCAACACGACGAGGAGTC
CAAAGCCCTCGCCTCAATCATCCCAACCTTCACTCCTTCCGAATCTTCCGAATCCACTGCCGTCAAATCAATCATCAGC
TCCCTCTCCCTCATCGAGCACGTCGAAGGAGGCTATTTCGCAGTCACAGACGTCAGCAACATCAAGATCCCTTCCCCGT
ACCCAGCCACGCCCCTCTCACAGCGCACCATCGACCTCGTCAATGGCCTCCCCGAAGATTTCGACTACGCGCTCCGCCG
CCTTTCGACTACGATCTTTTACTATCTGACGCCTAACCGGCCTCAAGGCTCATTCCACAGGAACCGAAGCCGCATCATT
CATAGTCTCCACCGAGGCCGTGGCCGCTATGTTCTTATCCATCCAGATGGCCGTATCGAATCTTTCGTTGTTGGTCCCA
ACATTGAGCGCGGCGAGAAGCTACAGTGGGTCGTGGAGGGTGGCGTGTTCAAGGCAAGCTTCCTTCTCCCTGACACTGA
TGGTCAGTCTGGCAGTGATGGTCTGCTCATTTCGGAAACGGTTGTGCCTGGTTTCGAGTACGCTGATCACGAGTTTCTG
TCTCACGAACGGGTGGTGGAAGTTCTTCCAGAGGCCAAGGCCAAGGCGCTGGAGTGGCTTGTCAAGCACTGAT

FIG. 1 continued

> SEQ ID NO:7528 213963P *Trichoderma harzianum*
GTCCTTTACCCACCAAGTGATCTTATCATGATCAATTAAGTGCCGGTCGAAAATACGAATATCCGGAATCGCTCAAGAC
TTGATAACCGCAGCATTCATGGGGCGATTGTGCTCAAGCCACACACAATGAGTCCAAACACCAGCGGGAGCAAGAATGG
CGAGAGGAAACGATCCGCCCCCTCAGATGATGCTGCTCCTCAGCAAACCTTTTTCAAGCGTCAGAGAACAGCACTAGCT
TGTAATAGTTGCCGCTCCCGAAAAACACGGTGTGACGGCTCGCGTCCCCGATGCACGATGTGTGTTGAGATGGGCCTAG
AGTGCTTCTATCAGCAGCCAGCAGGGCGCCGGGGAAACAATACTCTACAGAGCTCGAGGGAAGGCTACACTCTATCGA
AGAGACTCTGCGTCTACTGGTGGGGAGACAAGAAGCAGCTGCCCCCCTTCATTAAACGCCAGAAGTGTACTGGATTCA
GAAGATGCTGAAGAGTCAATTAGAGATGACTCTCAAGCTCAAATCCAGTTTGAGGACACAGTGGACGGCATGGGGGGCC
ATTACCTTTGCAGATGAGCAGGAATCTGGTTTCTTCGGACCTTCTTCCAATATTGCTTTCATTGGACAGATCACACACG
CCATGGCTACCGCCGCAAACGCGGACCCCACACGAGCTCTCCCAGTTGATGCAAGGATGGAGGGCGCAATGATGAGCAT
CTCTCGACCAGCATCACCAATCGCCGGAGCACAAAGTCTAGACCATAGTCTTTCGGCGGCAGTGGATGTTTACACTCTT
CCACCCGAAGCAGACATGTTACATCTTATCCGACTGTTCTTTGCCGACACAGGGATGCTATTTCCATACGTGCACGAGG
GCTCTCTGCTGGAAGAGTTTGTCGCAGCAAAACAAAATAATTTCACATCAATTAGACGCTCATGGTTATGTCTAGTAAA
CATGATCCTAGCGTTTGCCACTTGTGTCAGCGCCCGACCCGATTTGCCTGTCGAACGAAATGCGGCAGAGTCAGATGTC
TTCTTCAAGCGCGCCCAAGCTTTGTCTGGGAAAATGGCATTCAGAACCGCAAATGTTGAGATTGTTCAATACCTATTGT
TGATGACGCAATTCCTTCAAGGAACCCAGCGCTCTGCTCAAACATGGAACCTACATGGGCTTACAGTAAAAGCGGCACT
CCAGCTGGGACTCCATACCTCTAGTTCGTACACCAAGTTTTCACCGCTTGAGAGGGAGATAAGGAAACGCACTTGGTAT
GGCTGTGTAGTTCTTGATAGGACGCTGAGCATGACATTTGGCCGTCCCCCAGCGATACCGGTTGAGTACGTTCAGATGG
CACTTCCTTTAGATATAGAATTTGATGGAATCAATGCCATCACTGGCCCACACATGGNAAATGCTGGGCAGCCCATCAC
CAGTATCATTTTATAT > SEQ ID NO:7529 214553P_A *Trichoderma harzianum*
GCGCCTCAAGCACAGTCCCGTTGCCTGACACCCAAAAGTCCATTCCTCTCTCTGTTCGCCTTGCCGCTCCACGACTCTC
CGTCCGTCCGTCTGTGCTCTGCGGATCCAACCAAGCACCGGCCCAAGCACCGGCATCAGCGCGAGATTCAGCTCCAGCT
CCATCCAGCCCCAGCCAGCTCGCTCTAGCCTAGCCTCACTTGCCTGGCTGCCAGCATGTCCTCGGCGTCTCAGCGGCGG
CGACGAGATGAAGACGACTATATTCCATTTGGACCCCCATCACTCCCCAGCACACAGACGCACCTCGACAACATGTCGT
CGGAACTTGGCTGGCCACCGCCGGTGACCATGTCCGACTCGAGCGACGAGGAATTTCGAGACCACCGGACGAATGCGCG
ACGCATTTCGCGCCGAAACCACATGCCGCATGGCATTGACGGACTGATGAACAATGGCCGATACTCGCCCGACGTGTAT
TCAGTCACCTCCGATCCTCCAAGCCAGACGCCCATGCTCGACGCCGGCATGCAATCTCAATACGCCGGCATACACTCGC
AATACTACGCCACGAGAACGCCCAACCCAGGGCCACAGATCAAGCCGCACCTGTCATCCCTAGATATACCAAGACGCTA
CGGCAGCAATGCCATCCTCGACATGTATGCGCTCACCTACGTCACCGACCCTGACCCGAATCTACTATGTCCCATCTGC
CATGACCCCCTCGTCGACCCTGTGACGACTCCGTCGACCATACCTTTTGCTATCGATGCCTACGCAGAAGCATGGCGT
CGAGCCCCGCGGGCGGTGCCTGTCCCATCGACAGAGAGGCTCTGCTGTGGACAGACTGTTCCAGCTCCATACGACTGAT
TCGAACACAGCTCAACAACCTGATTGTTAAATGCCCTCATCACGGGAGAGGCTGTGAGGAGGAAATGAGGAGAGAGGTG
GTGGAGCGACACGCAACCATGGAGTGCAGTTTCCGAGAATACCCTTGTCCTGATGCCGAATGCTCCAAGACAATCCGCT
ATAAGGCGACAGATGACAAGTGCCAGCATCAAGAGAACAGCTGCACGTTCTGCGACGCCATCATCGAGGACGCTGATCT
TGATATTCATCTGCTGCAGTGTCCAAAGAGCAAGACGCGGTGCGCGGGCTGCTGGATGTTAATTCTTCGCGAGCAAGAG
GACAGCCATAAAAACCTGGACTGCGATGCCATTGAAGTGGGGTGCCGCTTTCAAGCTGCTGGCTGCCCAGTGAGGGTTA
TACGGCAACACCAAGAGCTTCATGCCCTTTCCTGCCCTTTCCA > SEQ ID NO:7530 216419P *Trichoderma harzianum*
CCCACGCGTCCGAAAGGGGGTGATATTGGAATACCTAGGGACGCCTCTCAAACCGGCCTGTTCCATGAAGGAAACCCTG
CAGCAGCGCCGTTAGACTGACCTGACTTGACGAAAGCACCGGTCGAGACAGGATGAATTTGCGCAGCCGGGCATCGCAG
CCGCACCCGCAGCGCATCGCATCGCATCGCATCGCAGCGCATCCAAGACAAGGCCGGTCCGGGTCCGGCCCAGC
CAGCTGCTTTTTTTCATCATCTTCTTTTGTTTCGGCGCCCCTCATGATATCAGTCCAGTGACGCTAGAGCAGGTGTCA
CATGGCCGATGACAACAACGTGGTGGTGCAGCTAAGCTCCGGCTAGCTGTTATCTGGCGACGGAATGTGTGTGATGCCA
TTGGGTGGTGTTGCGAATGGCTGCTGGTTCGCGCGGGCTCACACTCACACCATCCATCACCAACAGCCCAATGACCTGT
TCAACGTCCCTTGCCCCATACCGGTACTGTACATACATGTACTCGTGCAGTCCAGTCCAGACAATCTCGCTGACGGAGGG
GCGCGCCACAAGTGGAATCAATGGAGTGATCCAATGTGAAGGCATTTCTGTCTTCTTGGACAGGCAGGGGTAGCAGTA
CCTGCACGCACTGCAGCGCATTTTAGCGCCGCTCCGTACTTGTACATGAGAAGGGGGTCCAGCGCGCCACTTTTGTGCA
GCCAAGTGCCATCTCGGTACTTGATTGCGAGAGGCTACTTTTGGTTGGTTCCCTGCCAGCCCAGCGTCGTGCGAAATGT
GCTCCATCCCCATCCCATACGCAATGTTGCCGCATCGCAAGCAACCCTCATCGCCTGTCCTGGTGCGTTTTCAGCAGGT
AGTACTCCGTAGTTGCACTGTACTGTAGCGGTCGTCAATCATTTCACCCTCAATCTCATGCTCGTGCTCATGCTCAATC
TCACTCACTCACTCTCACGTGGTAATTTGCGTGTACTTACACGGTACGGTAGGGAGGAGCCGCGGGAGGAGGAGCATCG

FIG. 1 continued

TGATGTTCCCCTCGCTGCGTCGAAAGAGGCAAACAGGGCCAGAGTGAATCGAGATGGCCCTTCGTCCCACACTGCTCCA
TCCAGTCCAGTCAAGTCCAGCATTCTTATGGGTGGCCACGACTGACTGACACGGCATACGGTGCTGCGCTCGTACTTGT
ACCTGTTTTGCTCTGCTGCTGCTGGTTTGCGAGCATGTGCTCCGTATGGCTGGATCGCCCTCCAATTAATGCTGCGCTG
GAGTTTCACCGCCACTCATCAGGGCGGCTTCTTGTTACAGGAGAATCAGGAGGTCGAATCACGGCCCCCTTTGATTGAT
GGGCGCTCAAACAAGACCTTTTCGTTCTTCTGCCCCCCCTGGCCACCCCCCTGCCCTGCTTCTGCTTTGGCTGCTTTCT
TCTGCGACGTC

> SEQ ID NO:7531 216107P *Trichoderma harzianum*
CGCAGAAACTCGCTGCGGAATCAACCACTGCAATATGTCTTATCAAGGATATGGCCAGCCCTACGGCCAACCACCGCCT
CCCCAGGGCTATGGCCAGTATCCCCCTCCTCAACAGGGCCAATATCCTCCTCAACAGCAGGGCCAGTACCCTCCTCCTC
ATGGGCAATATCCTCCGGCCCAGCAAGGGCAATACGGCCAGCATCCTCCCCCTCAGCAGGGAGGTTATTACCAGTCTCC
CCCGCCCCTCCAGGCCAGTATCCCCCACCACAAGCGCCCTACGGACAGCCGCCGCCTCAGCAATACGGGGCTCCTCCT
CCTCAACACCAACAGCCTTACGGAGCTCCCCCAGTGCAGCCTACGCCGCCGTCTATTGGCTATGGCGCACCCCAGATCA
TTCAATGGGACGGCACCCCAGATGCCCAGGCTTTGCGCGGCGCCATGAAGGGCTTTGGAACGGACGAGAAGACACTGAT
TAATGTTCTCTCGCGAAAAGACCCGCTACAGATCGAGGTGATTCGATCCACTTACGAGCGCACCTTCAAGCGCAGGCTG
GTGGAGGATATAAAGAGCGAGACAAGGAGTTGGTTCGAATTTGGTCTGGTGCAGCTTGCTCGTGGTCCACTGCTGGCTG
ACATCCATAACCTGTTCGATGCCATGGCGGGCCCGGGAACTAAGGAGGTTGTCATGAATGACATTCTACTGTCAAGATC
CAACGCCGACCTGAGAGCTATCAAGAGCGCGTATCAGCAAACATTCCGACGAAGCTTGGAGAACGATGTCAAGGGTGAA
CTGAGCTTCAAGACGGAGAGGCACTTCTTGATAGTGCTGGCTGCTAATCGAGCTGAGGACTCAGCGCCAGTAAATCCAC
AGCAGGTGGAGGAGGACGTCATGAACATCTACAGGGCGACCGAGGGCAAGGCTGGCACCGACGAGATTCTGGTGTGCAG
CATTCTCAGCAACAGAAACGACAACCAGATCCGAGCCGTCGCCCATACCTACAAGCAAAAGTTCAACCGCGACTTGGAT
ACCGTAATTCAGAGCGAATTCTCCGGCCCATATGCGAGAGGCTCTCCTATTCCAGCTTCGTCATGCTGTTGATAAATATA
TGCACGCTGCACAGCTTTTGGAAGATTCCATGGCTGGCTTGGGCACCAAAGACCATCTCCTCATTTCTCGGACTATCCG
ATTCCACTGGGATCGGAACGAGCTTGCAAACGTCAAGGGAGCCTATCAGCATCGTTACAAGAAGCCATTGGCCACTCGT
ATCAGGGGAGAGACGTCTGGTGATTACCAGAAGCTGATGGTTGCCTGTGTTGGAGAGTAAATCATATAAATTCTTGGGC
CGGCAGCTGCATTGGTGGAATCCCAACACGGTTACACCCTAATGGAAACTTACACCTAGATTCTTTAATGATGGCTGGA
GATCATGAGGCGTTTGGAAACCCTTTTTTTTACATTGTATTAACAAAATTTTGGCGAGGTACTACCAGGACATCAAGT > SEQ ID NO:7532 216160P *Trichoderma harzianum*
GTTCGTGCTGAAGATTTGCAATGCGCGCGCACATCTGAGTATCCTGAGACGGCTGCAGTCTACTGCAACTTGTACTCTA
CTTGGGGTACCAGATGCTCCCTTCGGAGCAGGATCACGATTCAAACGCGCATCAATCACAGGAAATCCCTGTCGTCTGT
GTTTTGTTCCAACCCGGAACTGCTCAAATTGGGAACCCGAATGACATACTGTTTACCGCCATGTGTGGTTGGTTCTC
TTGAGAATCCGAGACATATTGTCTGTGACAATCGCATTGTCGACAAATCAACAAATCAAAAATGCGCCGTTGCGCTGTT
TGCCAAAGTTGGTGGGTGGGATGCTCTTTTATTCATTTTGCTCGCCTTTTTTTCTTCTTGCGCTCTAGCACGCCAACCT
GGATTCCAACCTTCTGGGACCACCCGATCGATCGTGGCAGAATTGAACGCACGAATAGGGCTTTTGTGTAACGCTGGAA
AGGACCACGGTGGCCGCTGGTATCCATTCTGTCCGCACACTTACTTCGGCATTGGGGCCAACGTTCCTGGCGATGCAGC
GGGACTGGTGGCATGAGTGGGTAGTTGACATGTTGGCTGCCCGTTCCGAACTTCTCCATCGGCCCCATTTCCACTGCGT
TGCCAGATCCGTTGGGATCAAGATTTAGGACGCTGGTGGCCTACCAACGCCCGCATCCGAGGAGAACCACAGCGGACGT
CCTCCGTACTTTTCTCCCCGTCCGTTGACGATATGCTACCAGCACATGCGCCCTGAACATGCACCATGTTGGACTCCAT
AGTAAGATTGGGCTGATATACCACGCGCGTGCGACCGAGTAGAGCTTCGTGCTTCCCATGCAACGGGCGGACGCCGGCG
GCTGTTTATTTTAGGCATGGAATTGCCAACGCGTTTGCCAGTACCACTCATGTGCGCCTCTCACCATGGTTCGAGGCCT
TGCGCATAGA > SEQ ID NO:7533 216373P *Trichoderma harzianum*
ATTCCAAACGCGCATCACGACCAGCGATTCTTACTTCCTCGAACGGACCAAACGAATACTCTGGACGAGCTTAAAATCC
CTCAAACTCATTCTTTTATACGCCATAGATCCCCTAATTCTACGGACGTTGCGTCCAGTCCGCAGAGCCCATCATGCCT
TCTGCGACCGGTCAAAACTGGGAGAAATACACCAAGAAATTCGCCGACGATGAGATAGAGGAGAAGAAGATCACACCTC
TCACCGATGAGGATATTCAAGTGCTCAAGACATACGGTGCTGCCCCATATGCATCGACCATCTCAAAGCTCGAGAAGCA
AATCAAAGAGAAACAACAGAGCGTAGATGAGAAGATTGGCATCAAGGTATGAGTCGGCGCAACTGCGATGCGTCTACGG
CTATCTAACGTGTTGACGTAGGAGTCCGATACTGGTCTCGCACCGCCGCATTTATGGGATGTGGCCGCCGACCGACAGC
GAATGTCTGAAGAGCAGCCTTTCCAGGTGGCACGTTGCACGAAGATTATTGCGGACGATAAGGGCGACGAGTCGAAGAG
CAAGTATGTCATCAACGTCAAGCAGATTGCCAAGTTTGTCGTCCAGCTTGGCGACCGAGTCAGCCCTACGGATATTGAG
GAGGGCATGCGAGTAGGTGTCGACCGCAACAAGTACCAGATCATGCTGCCGCTGCCACCCAAGATCGATGCCAGTGTTA
CCATGATGACGGTCGAGGAGAAGCCAGACGTTACGTACGGTGATGTTGGTGGCTGCAAAGAGCAGGTTGAGAAGCTGCG

FIG. 1 continued

AGAGGTTGTCGAGATGCCCCTGCTCTCCCCAGAGAGATTTTCAAACCTCGGTATCGACCCCCCCAAGGGCGCATTGCTC
TACGGCCCTCCCGGAACCGGAAAGACGCTTTGTGCCAGAGCTGTTGCAAACAGAACAGATGCCACCTTTATCCGAGTCA
TTGGTAGCGAGCTTGTTCAAAAGTACGTCGGCGAGGGTGCCAGAATGGTCCGAGAGCTGTTCGAGATGGCCCGGACAAA
GAAGGCATGCATCATCTTCTTTGACGAAATCGATGCTGTCGGCGGTGCTCGATTCGACGATGGTGCCGGTGGTGACAAC
GAAGTCCAGCGAACCATGTTGGAGCTCATTACTCAGCTGGATGGCTTCAACGCCCGAGGAAACATCAAAGTCATGTTCG
CCACCAACAGACCGTCCACATTAGATCCCGCTCTGATGCGACCTGGACGTATCGACCGCAAGATTGAGTTCTCGCTGCC
CGACCTCGAGGGCCGTGCCAACATTCTCCGAATCCATGCCAAGAGCATGTCAGTTGAGCGAGACATCCGATGGGAGCTC
ATCTCCCGTCTCTGCCCCAACGCTACCGGTGCCGAGCTGA

> SEQ ID NO:7534 216087P Trichoderma harzianum
CGCGATGATCCCCGCAGCAGCAAAAACGGCCGAAATCCATCCCGGCTGCCACTAAGAATCTCCCTTTGGGGCAGCCGCT
AGTGTCGGGAGCTGTTCTTCCCGAACACTTCTGCGACGTGCCTTGCCCTGTTTCAGACAAGCTGATGATGATGATGGGC
TTGCACGACCACGCGCCCGTCTGTGCTACACGCCCGGATCTGCCTTTTCGCAGGTTTGCTTGCGGGGGCTGAGGACAGA
GGCCAGAGGACAGGATGCGGTGAGTAGGCTACTCTGGAGGACGGGGTTGAATGAAACGTTGATTTGGTTTGTTGTTCGC
GCCTCACGCCCTCTCTATTATCGCGCTTTCAACATCTGCATCTGTCTTTGTGATATATTCGTTTACAGCTCGCGGACAC
GAATTTTTCTCCATTATCAGTCAACTAAGACTCACTGCTCTGGTGCACTTCTCTCCTAGGGCTTTCAACGAATGCTCCA
GCGTAATACTGGACTGCTGGTGCCTCCTATTCGTTGCCGCCTACAGTCTACAGTCTGCACACTTGAGACAAGAGAGACA
GAGAGAGAAATGCCAGCACCGCTACTCTAGACAATATCCCTTGCTCTCCCTACAGGAGAGATATCTCCCTCCCTTGCAT
GCCCTTTTCAGCAAACAACTCTTATCACCCGAAGCTGAGGAGAATACTTTCTTACTGCGGCGCATGACGAAGCCTCGCT
GGCCTTCAAATACTCTGCCGGCTGGCAGCTATTTTTTGCCCTTACTATCACCATCTCAACTTAACGAAATTTCTATGCT
ATAGCACACAATCGCCATGTACCGTCAATCCAACTCGACGCCGTTCCCGTCGGCGGTCGAGGCAACGTTTCTCTTTACA
TCCTGGACGCCCCGGACCAGCTACTATGCAGCTGTCCTCGCTTTGCTACTGGCCGCATGGCTTTTGAAGCCAAAGTCTC
AGTGCAACAAGCTCAGTGTGCCCTTCTATGGAGCTTCGAAATTGAAGTGGATTTTCGATGCCGAGTCACAGATTGTTGC
CAGCTACAGCAAGTTTCGAGACCAGGTTTATCAAATCAAGGCGACAGAGGGAATCCAAGCCATGATCCCTCCAAAGTTT
GTCGCCGAGCTCAAGGGATTGCCCGAGGATATTCTTAGTGCTACGGAAGCCGTAGCCGACGCTCTTCAAACAAAATACA
CCAAATTCTCGCCGGGTCATAATGGGGACATGCTCTCACTTCTCGTCAGAACCAGATTAACTCAGAATCTTGTCGAGTT
GATCCCTCAGCTTAAGGTCGAACTGGAGCACTATATCGGTACCGAATTCCCTTCTTGCGAAGACTGGACACCTGTAAAA
TGGCAGCCGTTCGCTTTGCGTGGAATTGCCCCGACTCAGTGGCCGAGCCTTCGTCGGACCCTTTCTGAACCGAGACGAG
C > SEQ ID NO:7535 215293P Trichoderma harzianum
AAAACCCAAAAAAATCGCCATCAATTGCGCCCCGGCCAGCGATTCCCTGCCACCGAGACGAGCCTCCTCGAAACCCGCC
GCTTCTCCCTAGAGCCGACCCGGTTTCCTCTCTCTCACTCTCTCCTCCCTCTCCGGTCCAACCGCCAGACTTTCGCTCC
ATAACCCATCATGGCCCCCTCATCGCTTGCTCGCCCCATGCTCCGCTCGCCGGCCCTGCGCCAGCTTGCCTTCCGCCGC
TTCGAGAGCTCTGCCGCCAGCAAGGCCACCGACGCCGCCCAAAGATGCTGCCGGCAAGGCCAAGGAGTACCAGGCAAGG
CTGCGCAGGGGCTGTCGCGCGTCGCGGGTGCTGCCGGCCCTGCCATTGCCCGAGCTGCTCGTGGCCTCACCAACGCGCT
CGGCAAGGTCGGTGGACGCACCGGCAAGCTCATCAGCTTCGTTGAGAAGCAAACCCCTCAGGTCGTCTACTACGGCAAG
GTTGCCGTCGAGACTAGCAAGATTGTCTTCCACGCCCAGAAAATGAGCCCTCCTTCCGTTGCCACCTTCCAGAACTTCT
ACCAGTCCCTGTGGAAGTCCATCCAGAGCGGCGCCATTCTCAAGTCTCCCCAGAACCTTCTCCAGCAGGCCCGCAGCCT
GACTCCTGGCCAGCTGGCTGCTGGTGGTGTCATCTTCGCCGAGTGCCTGGGTTTCTTCACCGTTGGCGAGATGATTGGC
CGATTCAAGCTGATTGGCTACCGCGGAGAGACTGCTTCGCACCACTAAACGTGTCTGCGAATGTCTAATTCCTTTTAAT
GTTTTTAAAGGAGGTCAAAAATATCAATAACCCAAGCCTGGTCCCACCCGGCCAAACTTGGTTGATGCTCGAAGAATGA
GAACTGTCTGCGATAGAGGAAGAAAGAAAAAAAATCTGGAGAGTGAATGAAGAATGATGGCAAGCACACACACATCACA
CGCATACCATATAGGAAAAAAACATGAAAATCGGCATGTACGGATAGACAAAGAGGAACGGAATAGAGGGAAACATGGC
CGGGTGTGACAACCCCCGACTGACGAAGCGAGGGATATCTGGTGTGACCAATTGGTTGGCAGAGAAAAAAAAAGAAGAG
CGAGAGAATGCGTGGCGGGCGAGACGAGGCGAGGAACGGGAGGGATTAGGAAGAGGTTTGGGCTTGGACATCTGGAGAA
TCCCTCTTTTTGCCTCGTGTGTATACGTGTGAGCAACTTGGTTTTTACCTTTTATCTTTTCTTTGTTACACCCCCTT
TGTCACGCATACACCCAGCTACAACCATGTACATCAGAGACTTGCTTGATGCCATAGCAGCAGAAGCAGCAATTTAATC
CATGACGAAATTCTTCGGATGTTCAAGGAAAAAAAAAAAA > SEQ ID NO:7536 218986P_A Trichoderma harzianum
TTTTTTTTTTCTTGGATTTAACGTAGATTTATTTCATTCTGCTTAAAAAAGCAATTCCCATGCTGTCCAGCCCATCTGC
TCGTGGCTATATTATGTACAGTACATGCATGTTCTGTGAGACAACCACCCTTCATTTCATCAAGGCATCATCAATTTTT
CCCACCATTCCGTCATATTCCGCACACAAACAATCCTAAACCGCTCAACCCAATTTCATCTTCTACTGCAGCGTGGGCA

FIG. 1 continued

```
TGTGCACCGCGGCCTTTTTGGCCACGGCATCGGCGCTCTGCCATAACGCCGTCACCGTCTTGAGCTGCGTGTAAAAGTT
GATACCAGGTCGGCCGTAGAAGGTGTTGGCACCGCCTCCGGCAATCGACTTCTTGTTGCCGGTGAAGGAGAACATGGGC
AGCGGCACGGGGATGGGCACGTTGATGCCCACCTGGCCGGCCTCGATGTTCTTGCGGAACGTCTCGGCGGTGGCGCCNC
GACTTTGTGAAGATGGCAACGCCGTTGCCCGTACTCGTTCTTGTTGATGAGCTCAATGGCGTCGTCGATGGTCTCGACG
TTGAGGCACACCAGCACGGGGCCGAAGATCTCCTGCTTGTAGCAGGTCATGTCGGGAGTGACGTTGGAGATGATGGTGG
GTCCGATGAAGTTGCCGTTGGGGTACTTTTCAGACTTGAAGCCACGGCCGTCGAGCAGGATCGTAGCACCCTCCTTCTC
GGCGCTGTCAATGATGCTCAAGATGCGCTCCTTGCTCTGGGGGGAGATGACGGGGCCCAGATCGGCACCCTCCTCGAAG
CCACCATCGACCTTGAGCGCCTGCGCATGCTCAGCAACCTCAGAGAGCCACTCCTTGGTCTCGCCAACCATGACCAGTG
TGCTCAGGGCCATGCAGCGCTGACCGGCAGCTCCAAAGGCAGCTCCCACGACACTGTTGATGAAGTGGTTCTTGTTGCA
GTCGGGGAGGACGGCGGCGTGGTTCTTGGCTCCCAGGTTGGCCTGGACACGCTTGCCGTTGGCAGAGGCCCGAGTGTAG
ATGTACTCGCCAGCCTTGTTGCCACCGACGAAGCTCACGGCCTTGATGGCGGGCTCGTCAAGGATGAAGTTGACGGTGT
CGTGGGCGCCGTGGATGACGCTGACAACGCCGGGAGGGAAGCCAGCCTTTTCAGCCAGTTCGACGAGGATCATGGCGGC
ACCGGGATCACGTTCTGAGGGCTTAATGACGACGGTGTTTCCGGTGATGGTGGCAATGGGGATAGACCAGAGGGGAATC
ATGGCAGGGAAG

> SEQ ID NO:7537 218986P_B Trichoderma harzianum
CCCACGCGTCCGGGCAGTAGTACACAGTCTTTGTCTTGTCTTTGTCTTGTTTCTTCGTTGATATACCGCCGCCTATCAT
GCGCCGTCTCCTCTCCGTCAGCGCCTCTGCCAGTGCCCGCGGATTGACTGCCGCTTCCCCTCGGTCTACCATTGCCCTT
GCCAAGATGGCCTCCAAGGCTCAGGCTGCCACAGCCGTCAGGAGGATTCATGCCACGGCTCAGCAGCTCAAGCCAATGG
ACGCCCTGTCGTCCACGGCCACCAGCTTCCCCACGACGCACGAGCAGATCGAGAATGTGCAGAACACGCCCTACTTCAT
CAACAACAAGTTTGTCCAGTCGACGACGGACAAGTTCATCGACCTGCCCGACCCGGCCACCAACAACCTGGTGACCCGC
GTGCCGCAGATGACGCAGGCCGAGATGAAGGCCGTCATCGAGAGCTCCGAGAAGGCCTTCCAGTCGTGGAAGAACACCA
CCGTGCTGTTCCGCCAGCAGATCATGTTCCGCTACGTGCAGCTGATCAAGGACAACTGGGACAGACTGGCCGCCAGTAT
CACGCTCGAGCAGGGCAAGACCTTTGCTGATGCCCAAGGGCGATGGTGCTCCGTGGACTGCAGGTCGCCGAGGCTGCCG
TTGGCGCCCCCGAGCTGCTCAAGGRCGAGGTTCTTGNAGGTGTCCAAGGACATGCCAGACGAGGACCTACCGTGTAGCC
TCTGGSRCGTCACTGMCGACMATCTGCCCCTTTAAYTWCCCTGCCATGTATYTCACTCTGCATCTATCCGCATTTGNCA
MGCATCACCGAT > SEQ ID NO:7538 218904P Trichoderma harzianum
GTCCTCTCAATCTCGTTCCCAATCAACTCCGTCTGCCTCTCTCGCCCGCATCAACAACATTGCGAGCCACATCTCTCCC
ACAATGGCTTCCACCACCAGTTTCCCGGCAGAAACGGTGCCCCAGGCGCCTGAAGATCCCCTCTTTGGCCTGGCCCGCG
CCTACAAGGCTGACAACAGCCCGCTAAAGGTCGACCTGGTATGTCGCAAGCTGCTTGTTGCTGATAATGTTTTTATTTC
ATCTGGATTCACATCCAACCCCTTTTGTCCTTGCTGTCCTTATCCTCCCAAACCCTTCCCGTCGCAGCCGTGACAAGAC
TCTGGCGCAATCCTTTACGATTGCGACGTCGGAGCCGGCGAACCCACAAATATCCCATCGCTTGACTAATAGCTACCGT
GTCTAATGAACTCTATGACTGATGATATTCTTACTTACAGGGAATCGGCGCCTACCGAGATAACAATGCGAAGCCATGG
GTTCTTCCTGTGGTAAAGAAGGTACGGTGTCTTCTTTTTTGCTGGCGTCCCATTTGGAGAGCTCGGCGCCGCGAATGCG
ACGCATGCAAGCTAGCTTGTGATGCCAATAATAAGCTCAATTGGCGCACCAATTATTGGTCCAGCCCACTTGCTGCTAG
ACATATTCATACATCACAACATCGCTGACCCACTGCTTTATACAACAGGGCTGATGAGATTCTCCGAAACAACCCCGAA
CTGAACCACGAGTATGCCCCGATTGCAGGGTATCGAGAGCTTCACCAGCA > SEQ ID NO:7539 214904P Trichoderma harzianum
GGCTTCTCACGGGTAGTTGTATGAAGAGGAGATATCTTGCAGGTTTTTTTATCTACCTGTTTTCACCCCTTGGACGTAT
TATTTCTTATTAGTTTTGTTTGTTTGCCAAGAAATTCTATTCGCCATGGCTGTAAGACGAATGGTGTTTGCCGCGGCTC
TTGCTGGTCTGGCGATGGCCAAGCCCATCAAGCCCATCAAGCCAACAGGCACATTCTGTGGCATCATCTGCATAAGCGC
GATTAGCGATTGCGGCGTACCATATGGAGGTTGCTACGATCCTTGTGTTGACCCAGCCCCTACACCTCTTCCTTGTGAC
GTGGAAGGTCCAGTTCCGGAGAGTCCAGTCGTTGTGAGCCCAGTCCCAGCAACGCCAACCAGCGAAAATCCGTTCTCAG
TCACGCCTGGTTCGACCTCAGTCACTCCCACCGTGGAGAGTCCGAGTTCAGTCACTCCAGCCTCACAGACCCCAGTCGT
TGTGGTGAGCCCAGTCCCAGCGACGACAACCGGTGAGAACCCGAGTTCAGTCACTCCAGCCTCGGACACTCCAGAAGAT
GAGGAAACTCGAGAAGATTCTGAAGATCCAGAAGACGAGGAAACTCCAGAAGATTCTGAAGATCCAGAAGACGAGGAAA
CTCCAGNACTTAGAGTCGNCCNATAGCAAAGGGATCCAGTTCCAGCTGGGGCCGACCGGCAAAA > SEQ ID NO:7540 218922P Trichoderma harzianum
TACCGCATTGCATTCCATTTGATTGCTTCATTTTCAGTCCATTTGTTGGTCTTTTCTGAAATACCCATATACCGGTGTA
CACCCGTATATATACAGCTGGTTGAACTGCACTCCGCTCGCATTCAATCTTCCCCACTACATCATCACATTTCTTCTTT
```

FIG. 1 continued

```
CTCCCACAAACAACATCACACACAACCGTCATCATGGCCAACCGAGAAATTCTGTCGTCTCGAACCGAGACTCTCAACA
AGTACCTGAAGCTCGACCAGAAGGGCAAGATCATGGCCGAGTATGTCTGGATCGATTCTACCGGCGAGACTCGATCAAA
ATCCAGGACGCTCCCTGAGCTCAAGGACAAGGAATACACCCCCGAGGATCTGCCCGTCTGGAACTTTGACGGCTCTTCA
ACTGGCCAGGCTCCTGGTCACGATTCCGATGTCTACCTGCGCCCTGCCGCCGTCTACCCCGATCCTTTCCGTGGCTCTC
CCAACATCATCGTCCTCGCCGAGTGCTGGAACGCCGACGGCACTCCCAACAAGTACAACTACCGCCATGAGTGCGCCAA
GGTCATGGAGGCCAACGCTGCTCTCGAGCCCCTGGTTCGGTCTCGAGCAGGAGTACACTTTCCTCGACCACGATGACAG
GCCCTATGGCTGGCCCCGTTGGCGGTTTCCCTGCTCCTCAGGGTCCCTACTACTGCGGTGTAGGTAGCGGCAAGGTCGT
CCTCCGTGACGTCGTCGAGGCCCACTACAAGGCCTGTCTGTATGCTGGCATCAACATCTCCGGTACCAACGCCGAGGTT
CTCTCAAGTCAGTGGGAGTTCCAGGTCGGCCCTTGCGTCGGCATCAACATGGGTGACGAGCTCTGGATCGCCCGTTTCT
TCCTTGCCCGCATCGCCGAGGACTTTGGCGTCAAGATCTCCCTGCACCCCAAGCCCATCAAGGGTGCTTGGAACGGCAG
CGGTCTGCACTCCAACTTCTCCACCAACCAGATGCGTGAGGAGGGTGGCATGAAGTACATCGAGGAGGCCCTCAAGGCC
CTCGAGCCCCACCACGCCGAGTGTATCARGGAGTACGGTGAGGACAACGATCTCCGTCTCACCGGTGACTGCGAGACTG
GCTCCATCGAGAAGTTCAGCTGGGGTGTTGCCAACCGTGGCACATCCATCCGTGTTCCTCGCGAGACTGCTGCCCGTGG
CTGCGGTTACTTCCAAGGATCGCCGCCCTGCCTCCAACGCTGACCCTTACCGTGTCACCCCAGATCCTGATGACTTCAA
TTTTTCGGGGAAGGCCTAAGTCTTCTTTGNGGATGGCTTGTGGNGAGTTGAGAGGATGATGTGGTACCGAAGGAAAAAT
TCTACATTATGGGGATGTAACATTAACGG

> SEQ ID NO:7541 219066P Trichoderma harzianum
CCCACGCGTCCGCCCACGCGTCCGCCCACGCGTCCGAACGAATCGTCCACTCAGCTCGGCTCAATCATCATCACAATGG
CTCTCAACCTCACCACGTCGGCTCGAGCCCTGCGCTCCTTCAAGCCCTACACCCGTGCTGCTCTCCTTGCCAACGCCGC
GCGATGCTACTCTACCGCTGAGCCCGATCTCAAGACAACCCTCAAGGAGGTCATTCCCGCCAAGCGCGAGCTGCTCAAG
AAGGTCAAGGCCCATGGCAGCAAGGTCATTGGCGAGGTCAAGGTCGAGAACACCCTCGGCGGCATGCGTGGCCTCAAGG
CCATGGTCTGGGAGGGATCCGTCCTCGATGCCAACGAGGGCATTCGCTTCCACGGCCGCACCATCAAGGACTGCCAAAA
GGAGCTCCCCAAGGGCAAGACGGGAACTGAGATGCTCCCCGAGTCCATGTTCTGGCTGCTTCTCACCGGCCAGGTCCCC
TCCGTCAACCAGGTCCGCGAGTTCTCCCGTGAGCTCGCCTCCAAGGCCCAGATCCCCGCCTTCGTCAACAAGATGGCTC
GACGAGTTCCCCAAGGATCTGCACCCCAATGAACCCAGTTTTGCCATTGCCGTCTCGGCCCTCAACTACGAGTCCAAGT
TCGCCAAGGCCTACGAGCAGGGTCTCAACAAGGCTGACTACTGGGAGCCCACCTTTGACGATTGCATTTCTCTGCTCGC
CAAGCTGCCCACCATTGCCGCCAAGATCTACCAGAACGCCTACAGGGGCGGCGGTGCTCTCCCTGCTGAGGTTGACCTT
GAGCAGGATTGGTCTTACAACTTTGCCGCCATGCTCGGCAAGGCGGCAAGGAGAACGAGGACTTCCAGGACCTCCTCC
GACTTTACCTTGCTCTCCACGGTGACCACGAGGGTGGCAATGTGTCTGCTCACGCCACTCACCTGGTCGGCAGTGCTCT
CAGTGACCCCTTCCTTTCTTACAGTGCTGGTCTCCAGGGTCTGGCCGGTCCTCTTCACGGTCTTGCCGCCCAGGAGGTT
CTTCGCTGGATTCTCCAGATGAAGGAGGCTATCCCCGCCAACTACACCGAGCAGGATGTCCACGACTACCTCTGGTCTA
CTCTCAACTCCGGCCGTGTCGTGCCTGGTTACGGCCACGCCGTTCTGCGTAAGCCTGATCCTCGATTCGAGGCTCTCAT
GGACTACGCCGCTTCACGCCCCACCATTGCCAAGGACCCCGTCTTCCAGCTGGTTGAGAAGAACAGCCGCATCGCTCCC
GAGGTCCTCAAGAAGCACGGCAAGACCAAGAACCCCTACCCCAACGTCGACGGCAGCTCCGGTGTCCTGTTCCACCACT
ACGGCTTCCACGAGACCCTGTACTACACCG > SEQ ID NO:7542 215665P Trichoderma harzianum
ATCACCACTACATCTTCCCAAGATACTTTGCTTCCCCCGCCAGCTCTGGGAAGCTATCCATCCATCGACACCATGGATA
ATATCGGCGGCACCATCAAGCGCCGTTCGACGGAGGTATGGCAAGCTGCGCAGAACAACATGCCCACCATGCCCTCTAT
GCCTGCCATGCCTTCTTTGCCCGCTCTCCCTTCTCTGCCGGCCATGCCACAATTCTCGTTTGATTCTTTCCGGAGGCAA
CCCCAGCAGGAAGGCCTGAAAGGCACCTGGGAGCGCATTGACTTGCCCCCGGTTCCTCGTTCCTCCCACTCTCTTGACA
TCATCTCTGGCTGCGCCTACATCTTTGGTGGCGAGATCACCCCCCACGAACCCGTTGACAATGACATTGTTGTCATTCG
CCTTCCCTTTAGCAGCGCTCCCGCCGACTACTTCAAGATCCCGGCCAAACCAGACCATACGATCCCTGTGCCGGCACCG
ATTCAGGATAAGGGCAAAAAGATGGATTGGATAAGCCTTCCAAAAGGGCCAAGGCCAAGCTGAAGACCTTGGTGAAG
AACTCGAAGAGGAAGAGAGTGACAGCGACAACAATGATCCCACTGAAGAGAGTGACCAAGGAGAATCCACGCCGACAAC
AGCGGATAAGGGCAAGGGACGGGCTGACAAGTTGGGCGATGTCCCGTCACCACGAGTTGGGCATGCAACAGCCGTCATT
GGGTCCCGCATCTTCTTGTACGGCGGCCGTGGTGGGCCGGATATGAGGCCTTTGGATGAAGGGGCCGTGTCTGGATCT
TTGACACCCGCACTCGACTTTGGACCTATCTTGACCCCGTCCCGGCTGTCAAGGGCGGATCCATCGTGCCTCATCCAGC
TCCGCGAAGCTATCACAGTGCTACCGCGACGGATCGGCCCCGCGACTTTGCCCCTCCCCGCCAACCCAGCCTCAGACC
TGGCAGGAGTGGGCGCTTGGTGATACCTCCAAGACGGGCATCCCCCAGGATCCCATTGTTGGCAACGTTGCCGAGAATG
CAATTGACGAGGAGACGAGCGGCTACGGCACCTTCTTCGTGCATGCCGGTGTTCTGGCCAACGGCGACCGCACTAGTGA
CCTTTGGGCTTTTGACGTCCATTCACGCATGTGGACTGAGCTGCCTGCAGCGCCAGGACCTGCCCGTAGCGGCACTTCC
ATCTGCATCAGCAAGAGTCGAATCTTCCGTTTTGGTGGATACGACGGACAGAATGAGATTGGAGGCCAGCTCGACTTTT
```

TGAACCTCGAGGTCGAAATGTTTGATGACCGTGTCACTCGGGGTGAGGTGGCTGTTCGAGCCCGTGGTAGCTGGCAGTC
TATCCTGGAGGCCATGCCCGAGGCTTCCTCGCATGAGATTCCGTCCGAGAATGTCCAGGTCTGGCCCGCACCGCGAAGT
GTGTCTTCTCTTGAAGCCATCACCTTTGGCGGCGGCACCGAGTATCTCGTCCTGACCATGGGTGAAGCCAGCCCGAGCG
CAGACGGCTACAACGGCGCCGGCAATCTCACAACGAACGTGGGGGGTAT

> SEQ ID NO:7543 215538P *Trichoderma harzianum*
CCCACGCGTCCGGTAGGTTGTCGATAGCCTCAAATATCTAGAGAGCAGCGATAGCCACAAGACACTCGACAAGACTCGA
TTCGAGAGCTCGCGACAAGCGCACCATAGAAAATGCCAGCTCGGCGGAACAGGCGCTTCTTCTCGCGAGAGCCATTCCA
CAATGACGACCGGCTAACATTGCAGCACGCCGAGGGGCCTTTTGGCTTTCTCAATCCAACAAGAGCTCATTTCGACCAC
TCAGCACTGGCTCCGAAGCCGACGCCTGACGAGATAGCGGAACCACATGAGAGCGGCGATGATGCGGAAACCAAGCACC
AACAGACAAAACAAGCCGCCGATTCGAACGTCCCCGCCAAGAACGTCAAGTTCCTATGGCGGTCTCGAGACAATCGAAA
GGGTCGGCATCCCTTGCTCGTTCAAAAGCCGCTCCCGGGAGAGGAAGCGCCTTTCGTGACACCAAGGTGCACGTCGCAT
CCCCGGGAGATTTTGAAGACGGTGATTAAGACTTTCACGTACTACCCCATCTGGGAACATTTTCGGTGGCTGGTGGCCT
TCATATTCACATGGGGAAGCATTAGTCTGGGTTCTAAATAGTTTCTTCGTCTGGCTTCCGCTCGTGGCTCCCTCTACCG
AGTTCGACGGCGAAGTCTACTGGGCCGGTGGCATAACCGCCTTCATCGGCGCCATCGTCTTTTTCGAATTCGGTTCCAT
CCTTCTCATATTCGAAGCCATAAACGCCAACAGGTCGGGCTGTTTCGGTTGGGCCGTCGAGCAATTGGTCGACAATGGG
AGAAGCGGCAAGCCGAGGCTTGGGGTGGTCGCAAGCCGCCATCATTGCCACCACCATCACCAAAATCGACGCAACTTTG
TGGGCAAGCCCTCAGCTACCACTTCGATTGAAGCTCAGCCGGATCCTAGCGGGGCTAAGGATGAGAGGCAATGGCAATG
GTTCCCTTCGTGGCACGACCTGCGCACACATTACATTCACGAGTTGGGATTTCTCGCCGGTTGTGCACAGCTCTTCGGC
GCGACTGTCTTTGGTGTGTCTGGGTTTACTGCGCTGCCGGGGATTAACAATCATCTCACGCCCCAATGGCGACTCAACG
CTGCGTACTGGATCCCTCAGGTCGTTGGAGGCAGTGGCTTCATTGTCAGCAGCACGTTGTACATGCTAGAAACACAGCA
GAAATGGTGGAAGCCCGCACCTCACCTTTTGGGTTGGCACATTGCATTTTTGGAATCTCGTGGGAGCGTTTGGGTTCAC
GCTCTGCGGTGCCCTGGGAATGGCATATAACAATTCTGGGGCGCAATTTGAAGCTGGACTGGCTA > SEQ ID NO:7544 215552P *Trichoderma harzianum*
CTCGTTCCCAATCAACTCCGTCTGCCTCTCTCGCCCGCATCAACAACATTGCGAGCCACATCTCTCCCACAATGGCTTC
CACCACCAGTTTCCCGGCAGAAACGGTGCCCCAGGCGCCTGAAGATCCCCTCTTTGGCCTGGCCCGCGCCTACAAGGCT
GACAACAGCCCGCTAAAGGTCGACCTGGGAATCGGCGCCTACCGAGATAACAATGCGAAGCCATGGGTTCTTCCTGTGG
TAAAGAAGGCTGATGAGATTCTCCGAAACAACCCCGAACTGAACCACGAGTATGCCCCGATTGCAGGTATCGAGAGCTT
CACCGACAAGGCTGCGGAGCTGATGCTCGGCGCCGATTCGCCCGCTCTCGCGGAGCGCCGCACTACGTCTATGCAGACC
ATCTCGGGAACCGGTGCCGTTCACTTGGGAGCTCTGTTCCTCGCCAAGTTTTACAAAGGCAGCCAGACCGTCTATGTGT
CAAATCCCACATGGGCAAACCACCATCAGATCTTTTCCAATGTCGGCATCAAGGTCGCCCAGTATCCCTACTTCAGCAA
GGAGACCCGGGGGCTGGACTTTGATGGCATGACCGCTGCCATCTCAGCGGCTCCTGAAGGTTCCATCATCCTGCTCCAC
CCCTGTGCGCACAACCCAACCGGCGTCGACCCAACACTTGATCAGTGGAAGGAGTTGGCCGTCATTATCCGAGAGAAGA
AGCACTTCCCTTCTTTGACTGTGCCTACCAGGGCTTTGCCTCTGGCGACCTTGCTCGAGACGCCGCCGCTGTGCGTTAC
TTTGTCGAGCAAGGCTTCGAGCTCGTAGTTGCCCAGAGCTTCGCCAAGAACTTTGGTCTTTATGGAGAGCGAGCTGGCT
GCTTCCACGTTGTGGCTGCTCCTGCCGCTGATGCCACCACCACAATCACCCGCATTGCATCTCAGCTTGCCATTCTGCA
ACGATCAGAGATTTCCAACCCTCCTTTGTATGGCGCCAGAATCGCTAGCACCGTTCTGAATGACGCCCAGCTCTTCGCC
GAGTGGGAGGAGAATCTGAAGACCATGTCCGGCCGCATCATCGACATGCGCAAAGCTCTCCGTTCCAAGCTTGAAGAGT
TGGAGACTCCAGGAACCTGGAACCACATCACAGACCAGATCGGCATGTTCAGCTTTACTGGCCTATCAGAACCCCAAGT
TCTCAAGCTCCGCGAGGAGTATCACATCTACATGACCAAGAACGGCCGAATCAGCATGGCCGGTTAAATACCAACAAC
ATTGACCATGTGGCTCAGGCCATCCGAAAAGTCGTTGGTGAGACTCAGTAATTTGTATGATAATGGTTTGATAGATGGG
CTTCGAGGACGTGACGATATTATCACCGCCGCTGGCCAGGAACTTGCGTTGTTTCGATTAGTGTTCTTTTTTCCTTTGT
ATTCGATAGCACATG > SEQ ID NO:7545 109274P_A *Nicotiana benthamiana*
TTTTTTTTTTTGGAGAGATTTATATTCATTTATACCATACACTGCTACTATCTGATTGTTTGATACTGGTACAACCAT
TTGACATTGAGTACTTTTCGCAGACCTGTGCATAATAGTTGTAAACCCCTATACTTCACACAGCTCAAACAAGGTTTTT
ACAATACGTGCTTTGTCCCAGTTACATTATACCGGCACAGACCAAGTAACCAGCAACTTTGTTCCTCGAAACTATAAGG
GAGCAACAGTTGTTCCTGAAAGTTTGGGACCATTACCGCTCTTCCAGTCACCTGAAGCCAGATGGAGCAGCCTGAGCGT
AGCAACTAGAAGAGGAGTGCTCCACAAGACAATGATATTACCAGCTATTGAGTACAAGAACATGGACAACCATCCGTAC
TCGGACTCGCGGAAAGATTCAATTCTCTTGTTAAAATGTTCTTCCCATGCCTGGAACTTTATAACACGCATATAATTAA
GCATCTCATTTGTTGCCTTCATTCTGGAATCACGATTCTTCATGATGTTAAATTGAAACCTGTTGTTTCTTTTAGTTCC
AAACACCACAAATACCATCACTGCTGCAAGTCCAGCTAGTGTTACAACAGTTGAAGCACCGAGGTAAGTATAAAAGGAT

FIG. 1 continued

GGCTAAAGCCACAGAAACTTGCAATGGCATGAGCCAAATGGAATGTAGCTGTAGCATCATATCGGACAGCTGCTGAGCA
TCTACGGCCATATAATTTACAATCTGTCCAACACCATGAGCCTGTCTAGCTGAGCATGACAACCTTAAGCCCTTCTTAT
ACAAAGAAGTGACAAGTGTCGATCGAATAAGCATTCCAAGCTTTTGGGAGTTAAAATTGAACTGATGAGAGGTTAGGAC
TTCCACAAATTTGGCTATTAGGAGAGTTCCTATAAGGTAGTATCCTTCATAAGGAGATGTCCTAATTCCAGCTGTGTAA
TCAACAAATCTTTGTATGAGTGTTGGCCCTACATACATAACACAGACCCTAATTACTGCAAGAATGGCAGTAAAAACAA
CTTCCTTCCAAAAGCAACGCAGCAATGTTGTTCTCACAGGATGCTTCGAGTTTTCTTCAGGTTTAGGCCAATTCCTTTC
GAAAAGTTGAGACATTTTCTCTGCTCTATGCAGTGGGGAAAGTGAAGGAACTTCATCAATCTTGAGAGGTGACTTGTAA
CCTTTTTGCAGTAAAGGGTTCATCCAATCCAAAAGGCTTTCGATATTAGAGAAGCTGAAGCAAAGCCACTCACACTGGA
TTTATCCAGAAGAGGTTCATAACCATTGGTTGCATCACTTAAGTGAGATTCAGAATCACTAATTACAGCAACTCCGGTC
GAACCTTTAATGGAACAATGAAGAGAACACAGAAATAGGAAAGGAAACTAATGAACTTATATCATCCATTCT

> SEQ ID NO:7546 109274P_B Nicotiana benthamiana
TCCGAAATAGGCTGCTTTGAATACCAGCAGAAGAAGAACTGGCTGCTTCTAGTGTTAGTGAAMCAGCAAGGAAACTGCA
AAATAGATTTCTTGAGCTGAGATATGTGAATTTTTCTCAAGAAATTCTATCTCTTTGGCTTTCTGTAGTGGGTATATAA
AGACATAAAGGTTGAATCTTTTATGGTTTAACATGGATATAAGGAACAATCTCTCCACAGAATCTTGGTTAGCATCAGT
TTCTTGTTCTGCCTCCACACTACAATCTTCAGCAGTGGTTAAATGGTTAAGATTCATCTTCCTCTCTCCATGTCCACAA
AGGACTCTTCTATCTTCCATTGATGTGCTGCTTTTGCTTACTTTCATTGTGTTTGCCGTACAAAAGTTTTACTCAAAGT
TGAGGTCCAATGAGCACTCTAATTCTGGCATTGATAAGCCTCTTATTGCACACAACAGGACTTCTGTTAAAACCAATCT
ATGGTTTAAGCTGTCTCTGATTTTGTCAGCTATWTTAGCCTTATCTTCTATAGTTTTATGCATTTTGGTTATTGTGGGG
AAATCCCCAGTCGTCTTGGAAAGTCATCGATGGGCTGTATTGGTTGTTT > SEQ ID NO:7547 111108P Nicotiana benthamiana
TTTTTTTTTTTTGGACAAAGACGGTACAATGCACTAACAAAGGTTTAATATTACAGTTGATCGCGAAGACGCAGGAAAA
AAGAATGTGTAAAACATGAATGGACAACAATAAAAGAATGTTTAATGAATAAAACATTAACCAGTGTGATGATTCTGCA
ACAAGATTTGTGGATCCGTTGTTTGAATATCTGTCAATTTTAAGCAGAGATGAGCTTTCACTGGCTTATGATCAGAGCT
GCGGATGCTTTCAATTGCTTCATATGAATGTAAAGTTGCATTGATTTTGTTACTGTCTATCTTGAACAATACTCTGTCT
GTCCACGATGGTACTCTAACCAACCAATTAATGTCAAATCAAGAGAAGGAAATATTTCTTATATCCTAATTTATATGAC
ACACTTTTCTTTATTCAATTTAGTCATATATCACTATACATTTGAAGCTACTAGCCCGACTAAGTCGGTCAAAGTAAGG
cCCACTAACTATTACATCACATCCCTTACTCTTTGGNGATTAATATGAGATTCTTTTTACTTTTAGACGTTTAAAATGT
CTGACGACACTTCTCGCTTATGTATTATTTTAAACAATTTTTGTAAGTTCAAAATCTCCTAGCTTTTTTTTAATTCTTT
TAACTTTTTCATATTAAACCAATCACCCAGGCTTTCATCTCCTGTGGTGTTGGGGTTTGGCTCGGACCCCTAGCTACCT
CGTCGATTATATTAACAAAAGAGTACAACCTTTAATTAATCATGTATAGYATTTTAATTTGACGTTTTTTCTCTATTTA
ATCAACTTTTTCAACTAGTAGTTTAACCTTTTTTTCACAACTACGCAAGTTAAATTAACATTTTAAACGYGGCGCCTCA
AATGATTAAATAAAAGGAGCAATAAGATTAGACTAATTAATTACCTTGTGACAGGTATCATAGCTGCTGCTTCCAATAT
CATATTTGTAAGTTGGTTTGAAAGCTAATGCACCCTCGCAABACCCATTAAAAATCTCTCCTCTTTCTGCTTCTTGTAA
TAGTTGATCCYTGCTAGTTAGAATCT > SEQ ID NO:7548 128843P Nicotiana benthamiana
GTAATCACAAACAACAGAGAGTGATGTYTACCTATCCCCTACTATTGCCCCCANANACTTTTCCATGAACTTATTAGC
TTAGCAGCTGGCTGTAGACTTAGCCCCCCAATTGTCTTCTCAAACGTAGGGCTCATTTCCTGTACAAGTTTGATCGATT
CTGATAGTCGATTAAGGAGGTTTACCAGAGCAATCACTTCATTTCTTTGCAACTGCAGATGTTTATCATGGCGATATTC
ACCATCAACAGAGNTTTTTTCTTTAGTGCAGTTCCAAGACCAAGAACCTGGAGCTTTCCCCACAGTCGGCATTTCTCA
CATCCTACACAATCCATGATAGCGCTGATATTCCTGAATTGCTTTTGAATCTGCTGCTTTAGCTCAGGTCCACTTTGGC
CTTTCCACAGTTTAGCTTCGTCAAAAGGAACTGGACATGCAGCCTGCAGTTTGGGGCTGTATAGTAGCTGTCGCATAAG
GGACTGTGCTTTAAGATCTTCCTCAGGATTACCAGTATCATACTCAGCCTGCTCCAAGTAATCTTTTGCTTTTGTTACA
GCTCGGAGAACAAAGA > SEQ ID NO:7549 111490P_A Nicotiana benthamiana
TTTTTTTTTTCCTACGAATCAGGGTTGTTTTTGTCAATTATCCGAAAGAAAAACAGATTATTATTGAATAAGACAGTG
TCGGGAGGAACAGTTGTCCATATCAAAATGAGAAAGAGATGAACAACAATGAAGAAATGAACATCAAGATTCCAAAGAC
TTGCTTCTCAACGCTCCCATCTTTGGTAGCTGGAAAAGCTGGCTGCTTCTTGCCTGAGTTGCTGCACATTTTAGCTGTT
CAGCAGCCAACCATTTTCACGTCAATCCAGATATTTGAATCTGCTCAAGTGATTCTGAGACCGGGAAAAGTGTTGCTGC
CCTGCTTCACTTGCATGGAAAGCCTTTGATGCTCCACACGCTGAAGCTGCGATGACAACTGGAGCAAATCGATAGTGGG
TCCATCTTCACAAGAAAGTTGATCCTTGTGGTTCACAAAATTTGGACCTTGAATGATCCCATTGACGCCACAAGTGTTG CTAGGAAATAGTATCTGGTCCAGTCCACCTTCTGCAGAATTGACCCCAGAGAATGAATGGTTGGACATTCCTACCTGCT
GAATCCTGAGGACTAAGTCCCGGACTTCTTTAGATGCTTGAGTCAGACTGTAACGTGAATTATTGCTTGGGGATATCAG
GGGATGAGCGGCACGAAAAACAGTGGAATGATTTGACGAGTCCCGTGATTGAGATGACAGAAGAGAGAGAGCATTGCTG
GAGTTTGATATCCCCGATAGCCCATGAATAGTACAAGATGTGTCCAAGACATGCAAGACTTCAGATCCAGTTGAGGTGG
TGTGGAACAATGAAGGGGAAACAAAATCTGATCCTCGCATATCTTGCAGAGATGAGATGATATTCTCATTAATTCTGCT
CGTTGTTACAGCAGGTTGTCCTTCATCATGGAGAGGTTGACATTGTTTCTTGGCATGATATAACGTAAAAACAGATTTT
GGTTGCAACTGTTCATTTGAAAAGGGTATGGCAAGTTGGGGGCTACGTTCAACACCATCTTCAACTTTTACATTCTTAT
ACCAGTCATTCATCTCAAATTTTGGCTGATGCAGAAA > SEQ ID NO:7550 111490P_B *Nicotiana benthamiana*
TTCCTTCGGCGCTCATTATGACCAGCAAGGACGTTTCCTGCAGGCTTCGTTTGCCATCATCAAATTCAGGNTAGCAGAT
GGAACCTGGCTACATTGCTGACAAACCCTTTGCTCGATGCCGTTTACGATACCCTTAGCTGTCTTTGAGTGAACCTCAC
AAACTTTATGCCTCTTGTGATAATCCTTACAAGAGCTGAGATCCTTCCCACAACCTTGAACCTGACAAAATGGATAGGA
ATTCACACCTCCTGCTCTCATTCTCTTGGCTGGAACAATGGACTCAGCACAAGAGACATTAGGCATAATCTTGGGAGAT
TTGTAAACATTTGCATCTATTTGATCAGGAAATCTTCCAAGCTTCAAATCAATCAGTGATGAATCTTTAGAGTTTGATT
CCACAACTGAGCTTGATAACTTGGAACTAGACTTAGATTTATTTTCCCCAGAATATGCTGCACTAGGACTAGCTGCCAC
TGAACCAAAATACTTTGGTCACTGTACATAGTTTTTCTCATCAAATTTTGAGAACCCAATTCAGGAAATCCTTGGTTA
CTAGTACTACCTTGTTGACTTGAGCACATAACATAGCTGCTAGGGGTTTTCAATTCCCAAACCATAAATCCATTTTTAG
TTCGCCCCATTCCATCATTTACAGAAACTGATTCCTCTGATATGAAACCCTTTCCCCCTG > SEQ ID NO:7551 111312P *Nicotiana benthamiana*
CAAAAACAACCAGCCCCATTTTCTTCTTCACTCTGCTTCTCCTTACTTTCACTCCAACCCCATCTTTCTCCATTGAAAA
TGATATCAAATGTCTTGAAGGAATCAAATCTGCACTTTCTGACCCTTTCAATAAGCTCTCATCTTGGTCTTTTTCAAAC
ACATCTGTTGCTGCTTCAATTTGCAAACTTGTTGGTGTTTCTTGTTGGAATGAGAAAGAAAACCGGCTCATTTCTCTTC
AGCTCCCTTCTATGTCTCTCTCCGGTTCTCTACCTCCTTCTCTTCAGTATTGTACCTCTCTTCAATCCCTTGATCTCTC
TGGTAACTCCCTTTCCGGTTCACTCCCGGTTCAACTCTGTTCTTGGTTGCCTTATCTTGTTAATCTTGATTTATCTGGT
AACTCTTTCTCTGGTTCCATACCTCCTGAGTTTATTTACTGCAAATTCTTGAATACCCTTTTGCTAAATGACAATAAAC
TTACTGGTTCGATCCCTTTTGAGATTGGCCGGCTTGACCGGTTGAAACGGTTCAGTGTGTCAAACAATGGTCTTACAGG
TCCGGGTCCTGATGATTTAGACCGGTTCTTGAAAGATGATTTTGAAGGGAAT > SEQ ID NO:7552 43445P *Nicotiana benthamiana*
GTTGAAAGTAGATATTTTCTCGGACTTCGAAGACATCTTCAGGTAACAATTTGGAGAAAGGAGAATGGCGTTAGTTTCA
GGAGGAAGGTCGACACTGAATCCGAATGCACCTCTTTTCATCCCGTCTTATGTGCGTCAAGTGGAGGATTTTTCACCCG
AATGGTGGAATTTGGTGACAACTTCGACATGGTTCCATGATTATTGGACGAGCCAGCATCAAGGAGAGGAATATGGCGA
TGATGCTTTTGGTTTTGCTGGGAATGATGTTGCTGACTTGCTTCCTGAAAATATCGATCTTGATGTTGATGAAGATATT
TTGAACATGGAAGCTCAGTTTGAAGAATTCCTCCAATCATCTGAAAGTGAACAACAAGGAATCAAGTCATCGCTCTATG
GTGTCAATGGTTTACCCAAGGGTTCGGAGGCACTCGTACGGACACTGAGCATGCCAAAGGGGCCAAAATCTCCCATTGA
GCCACCAAAGTACTATGAGAAACCAGCAAAGATTGTTAGCCCAAAGAACAGCCTTCGCCGCATCCAGCAGCCTCGCTAA
ATGTAGTTTAGCTTAAGCAAAAGCTCTTGGTTTGTAGTTTGGGAATGTCAGTCCTTAATTTGCAGCTTTTAGTCTTCTT
CACAAaGCATCAGTTGAGAGTCTGAGGAGTGNTTAGTTTCTGGTAGCCTTTTGTATAGAG > SEQ ID NO:7553 130430P *Poppy*
GTCGACGAATTCAGGAGAGAGAAACTAAAACCCCCCCAAAAAAAAACAAGAAAAAAAAAAATGGCCGTCTCAGCAGGA
TGTGCTAGGGTTCTACCGGTTTTTGAATGTAGATCAGATCCAGATTTCTCTACAAACCAGAACCAGCAGAAATCAAGTT
CCAGATTCATTTCTGGATCTTTCAATGGTGGTGGTGGGTTATATTCATCATTGATTCTGCGGTTTCCTCCTAATTTCGT
GAGGCAATTGAGTATTAAAGCAAGAAGGAATTGTAGCAATATTGGTGTAGCACAAGTTGTTGCTGCTTCCTGGTCAAAC
AATGACAATACCAACAAGAAGGTTCCTAATGTATCTGCTGTCGATTCTGCTTCTGCTGCTTCTGAGATTGAAGAAATTC
CTTTGATTGATGATGAAGTTGTGGATGCTGGGGTTGATGGTGGTGATATTTGTAATAATAATGGTGTACAGTTGTCTGG
TTTGGCCGCTTTAAAGGCCTCATTTTTACGCTCCGATGGGAGCATCACAGTTCATGCAGGAGAATGATTAGGTCGTGGA
ATTGCTACAGATGGAATCACTACCCCAGTCGTCAATACTTCTGCTTATTGGTTCAAGAACTCCAATGAACTCATTGATT
TCAAGGAGGGACGCCATAAAAGTTTTGAGTATGGGCGCTATGGGAACCCAACCACAGTAGTTGCAGAAAACAAAATAAG
TGCACTTGAGGGGGCAGAATCAACTATTTTGATGTCATCTGGCATGTGTGCTAGTACGGTCATGATGTTTGCATTGGTA
AAGAAGGGTGGGCATATAATAACAACTACAGATTGCTACAGGAAGACGAGAATTTTCATTGATGATTTTCTTGTTCCCA
ACATGAATATAACGGTCCATGTCATTGACCCTGCCGATATGGATGGCCTGAAATCTGCATTGGAGAATAATAATGTAAC

FIG. 1 continued

ACTTTTCTTTACAGAATCACCCACGAACCCTTACCTCCGGTGCGTTGACATTGATTTGGTTTCAAAGCTTTGCCACAGC
AAGGGCACACCGGTTTGTGTTGATGGTACTTTTGCTACACCATTGAACCAAAAGGCACTTGCACTTGGTGCAGATCTTG
TTCTGCACTCGGCAACTAAGTTTATTGGAGGACACAATGATGTTCTTGCTGGTTGCATTAGTGGTTCTGAGGAAGTGAT
TGCTAAGATTCGCAAGTTGCATCATGTTTGGGTGGTACTCTTAACCCGAATGCCGCTTACCTAATCATTCGAGGCATG
AAGACACTGCATCTTCGTGTACAGCAGCAAAACACAACAGGACAGAGGATAGCCGAAGTTTTAGAGGCACATCCTAAGG
TGAAACGTGTTCATTATCCCGGTCTGCCCAGTCACCCGGAACACAAAATTGCCATGAAGCAAATGACAGGGTTTGGAGG
AGTCGTCAGTTTTGAGATTGATGGAGATTTAGAAACCACCAAGACATTCATCGATGCACTGAAAATCCCATACATCGCT
CCTTCCTTTGGAGGATGTGAGAGCATTGTGGATCAGCCTGCAATTATGTCTTACTGGGATCTTAGCAAGTCTGGTAGAG
AAATGTTTGGAATAAAGGATAACCTCGTTAGGTTTAGTTTCGGAGTTGAAGACTTTGAAGACCTGAAAGATGATATCCT
TCAGGCTTTGGAAGTTATATAGATAGGAGGCAAATGCTGAGGGCCATGAATATCATGTTCTCTAATCGAGTGTCCTAAA
TCATCGGATTATTTTGATTGAGCATTGCTTTTATTTATGCATGTGTTGGTTATTTGATTGAATTAGTAATGACAGTTAT
GACGGATTTTGATAATGAAGATGAGGGTTGGTAACTTCT

> SEQ ID NO:7554 115121P Nicotiana benthamiana
GGCGACGGCGAAAAGGATAAGGATAGAGATAAAGATAGAGATAGGGAAAGGGAAAGATCTTCGAGGCATCGGAGCAGGG
AGCGAGAATCGGAGAGAGACAGAGAGAGAAGCTCAAAGGACCGAGACCGAGAACGTGACAGAGAGAAGAGGGAGAAGGA
GAAAGAGAGGGAGAAGGAGAAGGAACGAGAGAGGGAGAGGAAGAGTAGAGATCGGGATAGGGAGAGAGATAAGGAACGG
GAGAAGGAGAAGGATAGAGAGAGGGAGAGGTCAAGGAGGAGCCGGAGTCGCTCCAGGATTGAACGAGAGCGAGAGCGAG
AGAAGGAGCTGTCAAGAGAAGTCGAGCGTGAACGTGACTTTGAATCACGAGACAGCAGGAGATTCAAGGAGAAGAAAGA
AAAAATTGAACCAGAAGCTGATCCAGAACGGGACCAGAGAACTGTTTTGCTTACCAGATGCCCCTGAAGGCAACTGAA
AGGGATGTGTATGAGTTCTTCTCACAAGCAGGAAAGGTGAGGGATGTGCGGTTAATCATGGACCGGAATTCAAAGCGAT
CGAAAGGAGTTGGGTACATTGAGTTTTATGATGCTATGTCTGTGCCAATGGCTATTGCTTTATCTGGTCGCTTGCTTTT
TGGCCAACCAGTCATGGTAAAACCTTCTGAAGCTGAAAAAAACCTTGTTCAGTCAACTGCGTCTGGTGGTGGATCAGGG
TTGGCAGGGCCAAATGCTGCCTCAGAGAGAAAACTTTATGTAGGAAATCTTCATTTCAACATGACAGAGTTACAGCTTA
GACAGATTTTTGAAGCTTTTGGGCCTGTAGAGCTTGTACAATTACCTACAGATCCTGAAACAGGGCATTGCAAGGGTTT
TGGATTTGTCCAATTTGCTCAGCTAGAACATGCAAAGGCAGCTCAAAGCTTGAATGGCAAGCTTGAAATTGCGGGTCGC
ACCATCAAGGTTTCATCTGTTACTGAACATGTTGGAGTACAAGATGCTGGAGCTAAAACTGCAGATTTTGATGATGATG
AAGGAGGTGGCTTGGCCTTAAATGCTCAGTCAAGGGCCATGCTTATGGCGAAGTTGGACCGAAGCGGTGTTGCTTCAAG
TGTTGCGGGTACACTTGGAGTTCCTGCACTTAATGGAGCAGCTCCAGCTCAGATGAGCATGCCCATAGGTGGGGCAACA
GCTTTTCCGAATATGCTCCCAACGCAAGTCATTGCTGCCATGGCTCCTGAACCCATTGGAATTCCCAGCGAGTGTTTGC
TATTAAAAAATATGTTTGATCCTGCAACCGAGACGGATCCCGAATTTGATTTGGATATTAAAGATGATGTGAAGGAGGA
GTGTTCCAAGTATGGCAGGGTCAAGCACATCCATGTGGACAAGAATAGCTCTGGTTATGTATACTTGCGGTTTGATAGC
GTCGAAGGTGCATCTCGTGCTCAACAAGCTATGCACAAGAGATGGTTTGCTGGCAGATCGATTTCAGCCATCTTCTTGC
AACCTTATGAATATGATGCAAAGTTCAAAGGTACAGGCTGAAAGGTTTCAGACGGGGGGGGATATGTATGACGTCTGAAG
ACTGCTGATTTGTTGATGAGTAATTGCAAAAACTGCAGCCTGTTTTTGTATTTAAGTTCAGATCTTAGTGATACCAAAA
ACTCCTAAAAGGTACTGTATAAGCCGACATATGAGGTTATACATGTTATTGAGGGAAGGTTGTGTAATTTTAATATTCT
CATTTTTAGTCAACCATGATACTTGGGGCCCCATCTTGTTTTCAATTAATGGAGCTCAACTAATTGTGTGCAAAAAAAA
AAAAAAAAA

FIG. 1 continued

> SEQ ID NO:1166 103535 245756_301571_1
acgcgtcgCGATTCTAACGGAGGAACAGTGGCGGCCCTGTGATTGTGATTAGGGTTCTAGCGATCGATCGATTGAGGGT
GCTGTAGCGCGCTGGTCGCGGCAACGATTGTTCTTCGCCTTTGCCGCTATGGCGGAAAAGAAGAAGGCCAAGACCGACA
CCGAAGAGGTGGCGGAGGACAATGAGCTGGTTAGCGCCATCGAGAAGTTGCAGGATGTACAGGACGAGTTAGAGAAGGT
GAATGAAGAGGCTAGCGACAAAGTTCTGGAAGTAGAGCAGAAGTATAACGAAATCCGGCGGCCAGTCTATAACAAGAGA
AACGAGATCATCCAAAGTATACCGGACTTCTGGCTCACTGCTGTAATTCTTGAGCCATCCAGTTCTATGCGAACTTCTA
ACCGAGGAGGACCAAAAGGTGTTCAAGCATCTCCAGTCATTAGACGTAGAGGATTTCAAAGACGTGAAGTCGGGATACT
GCATCACTTTCTCGTTCAAACCAAACCCATACTTCGAAGATACTAAACTAGTGAAGGTGTTCCGGTTCTCCGACGAAGG
CACAACCTCGATCTCGGGGACGACGATTCGGTGGAAAGACGGAATGGATTTAACAAATGGACCAGAGGCGGAAAAGGAA
GGCAACAAAAGGCCTTTAGTGGAAGAGAGCTTCTTCAAGTGGTTTAACGATAGCCAACAGAAAGAAACTGCCGAAGGCC
TCCAAGACGAGGTCGCGGATGTCATCAAGAGGATTTGTGGCCGAATCCcttgaaGTACTTCAACAATGAAGGGGATTC
GGAATACGAAGAGGACGAAGATGAAGAAGATGACGGACaggggacGAAGCGGCCCGCCGATGGTTTTgAAGAGGATGAG
GAAGAGCCCGACGACGACGATGGTGAATGCTGAAAGCcttgttTATAGCAGAGAAACCAAAAGTTCCAGTTCCTTCCAG
CTCGTTTCCAGATGACCGTATTAACACAGTACGTTTTTCGTGAGAGAAGATATTAGTCTTTTGAAAGCAAACGAAGGAT
TTTTCCGTGTAGCGCTCTCGCTCGAGATGTTttttTTTTCTAGTTCTTTTATAttaactttTAGttgAAGATAGttGATG
TTTc > SEQ ID NO:1167 103535 51808_300089_1
AGAATGTACCTATTGGTAGTAAATAAACTAAATATTCCAAAAGAGAAAGCTTACTCTCATCATTGCTAAAATTGAGAAC
CTCATAACACAAACTTTACACATCTGTTATAGAAGCAAGCCAGCAATGTGTTATCTTTGGGCTCCCATCATTCCTCACC
ATCTTCCTCCTCTTCATCGTCATCGTCTTCTTCTCCCTCTTCGTCCACCATCATCATCTCCATCAAAATCCTCTTCATCA
GCATCATTGTTGAAGTAGGTGAGAGGGTTGGACCAGAGATCTTCCTTGATAATATCAGCAACCTCATCATGAATCTCAT
CCCCAGCATCTTCCTTATGTTGAGCATCAGTAAACCAAGTAAAGAAACTCTCCTCTGGCAATGCACGTTTATTTCCTTT
CTTATCATCATGGTTCACTCCATTTGGCAAGCCCTTGCCCTCCTTCCATTTGATAGGAGTTGCAGTGATTTTGTTGTT
CCTTCTTCAAGGAAAGTAAATGTCTTGGTAAGCTTGGCATCCTCAAAGAACGGGTTTGAAGTGAAGTGAAAAGTTATAG
AGTATCCAGATTTCACATCTTTGGCATCCTCCACTTCCAGAGAGTTCAAGTACTTAAAAATCTTTTGGTCTTCTTCA > SEQ ID NO:1168 103535 119252_300024_1
agtAGCACTCCAACAAAGAGCACTTCTGCACTTGCAAGCTCTGTTGCCTATTTTTCCAGAGAAGAGAAAAATATGGGTG
CTGACAAAGGGAAGAAGCAAAAAGTTGATGAAGAGAACAACATCATTGATGGTGAGCTCGTTTTTTCCATTGAGAAATT
GCAAGAAATACAAGACGAGCTTGAGAAGATCAATGAGGAAGCAAGTGATAAAGTATTGGAAGTGGAACAGAAGTACAAT
GAGATCCGCAAGCCTGTCTATGACAAACGAAATGACATCATTAAAGCTATCCCGGACTTCTGGTTGACTGCTTTTTTGA
GTCATCCTGTCCTAGGTGAGCTTCTAACTGAAGAAGACCAAAAGATCTTCAAGTTTCTAAGTTCTATTGAAGTTGAAGA
CTCTAAAGATGTGAAGTCGGGCTACTCGATAACCTTTAACTTCAATGCGAATCCTTATTTTGAAAATACAAAGCTGGCA
AAGACCTATACCTTCCTTGAAGATGGACCCACAAAGATTTCTGCTACAACAATAAAATGGAAAGAAGGCATGGCCATTC
CTAATGGAGTTGCACATGAGAAGAAAGGAAACAAGCGATCTCATGCTGAGGAAAGCTTCTTCACATGGTTCAGTGAAGT
CAATCAAAAGATGAGGATGAGGATGAGGCCCTagagaTTCaggaTGaggtcGCTGACATAATTAaggaTGACttgtgg
cCGAACCCTCTCACCTATTTTAATAAc > SEQ ID NO:1169 103535 154993_200017_1
ATAGCACTTTTGTACTTGCAAGCTCTGTTGCCTATTTTTGCATATAAGAGAAAAATATGGGTGCTGACAAAGTGGAAGA
AGACAAAAAGTTGATGAATAGAACAACATCATTGATGGTGAGCTCGTTATTTCCATTGCAAAATGGTAAGAAATACAAT
ACTATCTTGAGAAGATCAATGAGGAAGCATGTGATAAAGTATTGGAAGTGGAACAGATGTACAATGAGATCCGGAAGCC
TGTATATGACAAACGAAATGACATGATTAAAGCTATACCGGACTTCTG > SEQ ID NO:1170 103535 187767_300680_1
aggaaGGAAGGCTAAAACCCTAGCGAGCGCGCGAGCGAGCGAGGGCTCTCTGCTTCCTTGCGATGACGGCGCCGGCGGA
CAAGGGGAAGAAGGCCAAGACCGACGCCGACGGCGGCGCCGCCGAGGAGAACGAGCAGATCGACGGCGCCCTCGTCCTC
TCCATCGAGAAGCTCCAGGAGATCCAGGACGAGCTCGAGAAGGTCAATGAGGAAGCTAGTGACAAGGTTTTGGAGGTCG
AGCAGAAATACAGTGAGATTCGCAGACCTGTCTATCTCCGAAGGAGTGACATTATCCAAACAATCCCTGACTTCTGGCT
GACAGCGTTTCTGAGTCATCCTCTACTTAGTGAGCTTTTGACCGAAGAGGATCAAAAGATGTTCAAGTACCTGGAGTCT
GTCGATGTGGATGATTCTAAAGATGTCAAGTCAGGCTACTCCATAACTCTTACCTTCTCCGAGAACCCGTACTTTGAAG
ACAAAGAGCTCACGAAGACATATGCCTTCGCTGATGACGGAACAACCACAATAAATGCTACTTGCATTAAGTGGAAGgA
AGGAATGGAAATTGCAAATGGGAATGCcAaGaaGaaAGGGAGCaaGcg > SEQ ID NO:1171 103541 1044119_301886_1
TGCTAGTGGTGCTATCGTTGTAAAGGGAAGATGGCTCAAGCAGTAGCGATGGCCGGGCTTTGCTCATCCCTCTCCTCGG
CCGCTTCCTCGCTCGACGGGGCCGGCTCTCGCCTCTTGGCCTCCTCCCCTTCTTCCTCTGCCCCCTCTAAACCATCCCT

FIG. 2

TCGCCTCCCTTTAATCCGCGCTAGCTCGTCGAATCCCTCAGAAGACGCTTCTGCTAAATCTAGTACTAGACGCCAAATC
TTGTCCCTCGTTGCTGTCTCTGCTTTGCTTGTCTCTAAACAAGCCCTCGCCGACCCTAGCCCTATCAAGCTCTTTGGCC
CTCCCGCCCCTTCTGGTGGCCTCCCTGGGACTGAAAATGCCGACGAAGCTCGAGATCTAGACTTGCCATTGAAGAATAG
ATTTTACCTGCAACCTCTTCCTCCCGTGGAAGCGATCGCCAGGGCGAAGGAATCTGCCAAAGAGATTGTGAATGTGAAG
GCATTGATCGACAAGAAGGCTTGGCCCTATGTCCAGAACGGGCTCCGATCACAGGCTTCCTACCTGCGCTTTGACCTCA
ACACTGTTATCGCTTCCAAGCCGAAGGATGAAAAGAAAGCTCTCAAAAGCCTTAGCACTAAGCTCTTTAACACTATCAA
TAATCTGGACTATGCTGCTAGAAGCAAAAGTACCACCCAGGCGGAGAAATATtatggaGAAACTg > SEQ ID NO:1172 103541 127727_300472_1
GTACCACAACATTAACTTATAATTTCCCCCACGCTACTTCTATCACCCTGCCTAAAACAAATTTCAGAAGGTTCACCAA
AATGGCTCATGCTATGGCTTCAATGGGTGGCCTAATTGGTTCTTCTCAAACTGTGTTGGATGGTCAGCTCTGTGGTTCA
GCCCGTTTGAGCACTGTTAGCACCAGCAGAATTGCCTTGGCTAGACCAGGTCTCAGCATTAGAGCCCAACAGGGGTCTG
CTGACACTGAAACTAGCCGTAGAGCCGTCATCGGTCTTGTTGCTGCTGGCCTTGCTGGTTCCTTTGCTCAAGCAGCCTT
TGCTGCAGCTAAATCAATCAAGATTGGGGGCGCTCCTCCTCCCTCGTGGATTACCTGGACTTTGAACTCGGATGAG
GCAAGGGACTTTGGTCTACCATTGAAGAAGAGGTTTTACCTTCAACCATTGACTCCAGCTGAAGCAGCCCAGAGAGTTA
AGGATTCAGCCAAGGAGATTGTTAGCGTCAAGAATTTCATCGACAAGAAGGCCTGGCCATATGTCCAGAATGACCTTCG
TCTCAGAGCAGAATACCTTCGCTATGACCTTAAAACCGTCATCTCTGCTAAGCCAAAAGAAGAAAGGGAAAACTCCAG
GACCTGACTGGAAAGCTCTTCAAGACCATTAGTGATCTGGACCATGCAGCAAAGACCAAGAACAGCCCTGAAGCAGAGA
AGTACTATGCTGAAACTGTATCTACCTTAAATGATGTTTTGGCCAAACTTGGTTAAAAAGCTTTTCTGAACTAGTATGT
TATTACTTCCTGTAACTTATCGAATACTTCTTGAATCCAATTGTGAAGAATGATTTTGGAAAAATTGTTTAAAAATCCG > SEQ ID NO:1173 103541 11894_300290_1
tggtatcaacgcagatggccattacgccgggggcctgaaacaaatttcagaaagttcaccaAAATGGCTCATGCTATGG
CTTCAATGGGTGGCCTAATTGGTTCTTCTCAAACTGTGTTGGATGGTCAGCTCAGTGGCTCAGCCCGTTTGAGCACTGT
TAGCACCAGCAGAATTGCCTTGGCTAGACCAGGACTCAGCATTAGAGCCCAACAGGGGTCTGCTGACACTGAAACTagC
CGTAGAGCCGTCATCGGTCTTGTTGCTGCTGGCCTTGCTGGTTCCTTTGCTCAAGCagccTTTGCTGCAGCTAAATCAA
TCAAGATTGGGGGCGCTccTCCTccCTCtggtgGATTACc > SEQ ID NO:1174 103541 55612_300134_1
CGGACGCGTGGGTGCCACCAACAGATTCTGCAGCTAGAGTTTTAAGAATCTGCAAAGGATATCATAAATGTGAAGCCAT
TGATCGACAGGAAAGCTTGGCCATATGTTCAAAACGATCTTCGTTCCAAGGCTTCTTATCTTCGTTATGATCTTAACAC
AATCATTTCCTCCAAACCCAAGGATGAGAAGAAGTCACTCAAGGATCTCACCACCAAGCTCTTCGATACCATCGACAAT
CTGGATTATGCGGCGAAGAAGAAGAGTCCTTCGCAGGCTGAGAAGTACTATGCTGAGATAGTCTCTGCTTTGAACGAAG
TTCTTGCCAAGCTTGGTTAAGCATTTTAATTTCTGCATTTTTCTTGTAAATTATTATTCTTGGTTTTTGGTCTTGAGTA
CTTTAGACTCAAATTCGTG > SEQ ID NO:1175 103560 275042_200153_1
ATTTTGGTTGCTGAAAAAAGAAGCATTTGCTGTTGGAAAAACCTACTGCTTTGAATGTAAGTGAACTGGATAAGATTG
TTGAAGCTTGTGAAAGAAATGGTGTTCAGTTTATGGATGCTAGTATGTGGTATCATCATCCTAGAACTGCTAAAATGAA
GGAGTTCATTTCTGATCCTAATCTCTTTGGACAAGTCAAAGCAATTCACAGCTCATCATCATATTCACCTGGTCCGGTA
TTTCTTGAAAACAACATCAGAGTAAAGCCAGACTTGGATGCCCTTGGGGCGCTGGGAGATGCGGGTTGGTACTGCATTG
GCGCAATATTATGGGCTATGAACCAAAACCTGCCAACAACTGTGACAGCACTGCCTACTGTTGCAAGAAACTCGGCTGG
CGTTATCTTGACATGCAGTGCCTCCCTGCATTGGGAAAAAGAGGAAACTGTCGCTACATTTTACTGCTCTTTCGTTTCA
CATGAAACGATGGACTTTGATAGTTTATGGCTCCAACGGTACCTTTTATCTCTACGACTTCATTATCCCCATGGACGAGA
ACTCTGCTTCGTTCAGCTTTACTTCTGGTGCCAAGTTCGTGGATCGCCATATCGGTGGAACATGAAACCTCGGGCAGT
TGAAGTAACTTCTAAGTTTCCGCAAGAGGCTTCTATGATTCAAGAATTTTCT > SEQ ID NO:1176 103560 11580_300292_1
TGGTATCAACGCAGAGTGGCCATACGCCGGGGGTATCATCATCCTAGAACTGCTAAAATGAAGGAGTTCATTTCTGATC
CTAATCTCTTTGGACAAGTCAAAGCAATTCACAGCTCATCATCATATTCACCTGGTCCGGTATTTCTTGAAAACAACAT
CAGAGTAAAGCCAGACTTGGATGCCCTTGGGGCGCTGGGAGATGCGGGTTGGTACTGCATTGGCGCAATATTATGGGCT
TTGAACCAAAACCTGCCAACAACTGTGACAGCACTGCCTACTGTTGCAAGAAACTCG > SEQ ID NO:1177 103560 156583_301367_1
atactaggttgcgctaacatagctcggaaactatcacgctgccatcgcgcttgctccaaacgccactatctccgccgtc
gGGAGCCGTACGATCGAAAAAGCAACAGCGTTTGCTAAGGAAAACGGctATCCGTCGACTACAAAGTTATACGGCAGTT
ATGAGGCTGTTCTGGATGATACGGAAATTGATGCCGTTTACATACCTCTTCCGACAAGCCTCGCATGTGAAGTGGGCTGT
TTTGGCGGCcCaGAAAAAGAAGCACGtttagctGGAAAAGCCCGTCGCTTTAAACGTGAaggAGCTGGATACGattttg
GaGGCGTGTGaattgaATGGGGTGCAGTACATGGATGCTACCATGTGGATGCATCATCCTcgtagtgTtAAGATGAAGG

FIG. 2 continued

```
AGTTCCTCTATGATTCTCAGCGTTTTGGCCAACTCAAATCGGTACACAGCACTTTTGCTTATCTTGGTGACCAAGAGTT
TCTAAAGAATGACATTCGTGTGAAAGCCGACCTTGATGCTCTAGGTGCTCTAGGCGATGCTGGTTGGTACAGTATTCGT
GCGATCTTGTGGACTACTGATTATGAATTGCCCAAAACTGTGACGGCTCTGCCTGATCCAGAATTAAATGAAGCTGGAG
TTATCCTATCCTGTGGTGCTTCTTTGAGTTGGAAAGACGGAAGGGTAGCAACTTTCTATTGTTCGTTTTTAGCCAATTT
GGTCATGGATATCGCTGCTAATGGATCCAAAGGAAATTTGCGGGTGCATGACTTTGTAATTCCGTTTCAAGAAAATGTT
GCTCCATTTTACACGGTGGAAAGTTCGAGGTTTGGTGAACTTTCTATATCGATTCATCCTGCACCAAATGAGCAAATAG
TAAGCACTGATCTCCCACAAGAggCTCTCATGGTAAAGGAGTTCTCTAATCTGGTCCGAAGTATCAAAGGGGAAGGTTG
TAAACCTGAGaaGAAGtggccaacaATTAGTAGAAAAACACaaCTTGTGGTGGATGCTGTCaagGCGTCAATTGACAag
gGTTTTGAGCcTgttga > SEQ ID NO:1178 103619 137932_300687_1
GTAGATTGACAATGGCCTCTTGTCTGTCAGTCCTGTTGCTCTTGTGTCTAGCACTTGCAGGTTCAGTCTCCGGGCAACA
ACTGTCGGCTACATTCTATTCGAGGTCGTGCCCGAGAGCTCTGGCCATCATCAGGGCCGGCGTGAGAGCTGCGGTGGCG
CAGGAGCCCTCGCATGGGGGCGTCACTGCTCAGGCTTCACTGGCTGCTTTGTCCAAGGGTGCGACGCGTCCGTAC
TGGTGAACGACACGGCCAACTTCACCGGCGAGCAGGGGGCGAACCCCAACGTCGGATCCATCAGAGGATTCAACGTCGT
CGACAACATCAAGGCGCAGGTCGAGGCCGCGTGCAAGCAGACCGTCTCCTGCGCCGACATCCTCGCCGTCGCCGCCCGC
GACTCCGTCGTCGCCTTGGGTGGGCCGTCATGGAGGGTTCTTCTCGGGAGGCGTGACTCGACGACGGCGAGCTTGGCGC
TGGCGAACAGCGACCTGCCACCTCCGTCCTTCGACGTCGCCAACCTCACCGGCTCGTTCGCCGCCAAGGGGCTGAGCCA
AGCCGACATGGTGGCGCTCTCCGGCGCGCACACGGTCGGGCAGGCGCAGTGCCAAAACTT > SEQ ID NO:1179 103619 138090_300688_1
GGCCTGCCCGGGGACCGTCTCCTGCGCCGACATCCTCGCGCTGGCGGCGCGCGACCTCGTGGGCATCCTCGGCGGGCCC
CGGTTCCCCGTCGCGCTGGGCCGCCGCGACGCGCGCCGGTCCGACGCGCGCGACGTCGAGGGGAACCTCCCGCGCACCA
ACATGTCCGCGCGCGCCATGGCGGTGCTGTTCGCGCGCAAGGGGTTCACGCCGCGGGAGCTCGTGGCGCTCGCCGGCGC
GCACACCGTGGGGTTCTCCCACTGCGGCGAGTTCGCGCACAGGCTGTACAGCTTCAGGAGCGCCGACGGGTACGACCCG
TCGCTGAACCCGGCCGTTCGCGCGCGCGCTGCAGAGCTCCTGCGCCAACTACAGGAGCGACCCGACCATCTCCATCTTCA
ACGACATCATGACACCGGGCAAGTTCGACGAGGTCTACTTCAAGAACCTGCCGCGCGGGCTCGGCCTGCTCGCCTCCGA
CGCCGCGCTGTGGGAGTACCGGCGACGAGGGTGTTCGTCCAGCGCTACGCCGACAACCGGACGGGCTTCTTCGAGGAC
TTCGCCGCGGCGATGCAAAAGCTCG > SEQ ID NO:1180 103619 271792_200037_1
AATTATATAGGGTTGTGATGCATCACTACTTCTGGACAGTAGTGGAACCCTAATAAGTGAAAAGATATCAAACACCAAC
AGGAATTCAGCTCGTGGATTTGAAGTAATTGACGAGATTAAATCAGCAGTTGAAAAAGAGTGCCCTCAAACTGTTTCTT
GTGCTGATATCTTGGCTCTTGCTGCAAGGGATTCTACAGTTTTAGCTGGTGGACCAAGCTGGGAAGTTCCATTGGGAAG
AAGAGACTCCAGAGATGCTAGTATAAGTGGCTCCAACAATAACATTCCTGCTCCAAACAACACCTTCAATACCATTCTC
ACAAAATTCAAGTTGAAAGGACTTGATCTTGTTGACCTTGTTGCTTTATCGGGGAGCCACACAATTGGAAATGCAAGAT
GTACCAGCTTCAGGCAAAGGCTCTACAATCAATCAGGCAACAGTTTACCAGACTATACATTGGATCATTGGATCTGCTGC
TCAATTGCGGACAAGATGCCCTAAATCTGGTGGTGACCAAAACTTATTTTTCATGGATTTTGTTTCCCCTACAAAATTT
GACAACTACTACTTCAAGAACTTGTTGGCTTCAAGGGGCTTGTTTAATTCAGACCAAGTTCTTGTGACTAAAAATCAGG
CAACATTAGCCTTGGTGAAACTGTATGCAGAAAACAATGACA > SEQ ID NO:1181 103619 286376_200108_1
GAAGCCTCTGTTTCTTTGGCAGGTGGTCCTACGTGGAATGTTTCATTAGGGAGAAGAGACAGTAGAACAGCAAACCAGG
GAGGAGCCAATACTTCTATTCCTTCTCCTTTTGAAGGCTTAAGCAACATTACAACAAAGTTTTCTGCTGTTGGCCTTAA
CGTTACCGATCTAGTTGCCTTATCTGGTGCACACACCTTTGGACGTGCCCAATGTCGCGCATTCAGTGCCCGTCTTAAC
AATTTTTAATGGCACAGGAAATCCTGACCCAACCTTAAACACAACTTTTTTGGCCAACCTAAGGCAAATATGTCCTCAAA
ATGGAAATGCCTCAGCCTTGGCTAACCTTGATCCTACAACCCCGGATACTTTTGACAATAATTATTTCACAAATTTGCA
GAATAATCAAGGGCTTCTGCAATCAGATCAAGAGTTATTCTCCACACCTGGTGCAGCAACTGTCTCAATTGTCAACACA
TTTAGCAGTAACCAAAATACATTTTTTCAAAGCTTCGTTCAGTCAATGATTAATATGGGAAATATTAGCCCATTAACTG
GGACCAGTGGCGAGATTCGGTCAGATTGTAAAAGAGTCAATTGAAGCAAAAGTTTTGGCTAAATGTATTTTTGTTTCTG
AAGCAAAGTTTGGTAAGCCAAGTCTGCACGTTTTGTTATGAACAAAGTTCTTAATTTGC > SEQ ID NO:1182 103718 103757_300027_1
tggtatgaacgcagagtggcattacggccggggaaaacaAAAACTCAAAACTTCACATCTTTAGTAGTAGCATCAATAT
TCAAGATGGTTCTCCAAACTCAACTTGGGCTGAACAAGCACCAATCCTACGCTCACGAACAAAACTACTATTGCGATAG
CAGCCATGGCGGCTCTATGCAAATGACAAGGCCTTCGGGCTATTCGACCTTGCCATATGGTCAGTCCACTCACAACCAC
ATGATGATGGGTCATGGTGGCCAACACCATGGCGGACCCTATGGCGGTCATGGCCATGGCCATGGCGGACACTATGGTA
GTCATGGACATCATGGGGCGCATATGCCCCATGACTCCACCAACTTTTCAAGCAGCACCAATATGGTCCATAGTGATGG
TGGCTATGGAAGTGGAATGGAACAATCTACCCATATGGGCATGGGGTCGACCAATTATCAAGGCCATGGTTATGGTGGC
```

FIG. 2 continued

```
AGCCACCCTAGTCAGTACAGCCAGAGCCAGAAGCTCAACTGGGCACTTAAGGATTTGGAGGAATAAATTTATGATAAAT
TTTATGCTATCCTGTATGGTGGAAGTATGTGTGTGTGTTTTGGTAGTGGATTTGCCTATATATGTAGCATAAAGAACTA
CTACCTGAAGAAATAATGTACTAAGCAGTCTGCTGGTTTGCTTGTTTATCTATGTATCTACTTTATCATTACTAAATGA
TGAATAATTATAAGTATGTTTATAacT

> SEQ ID NO:1183 103718 11730_300294_1
tggtatcaacgcagagtggccattacggccggggaccaagCAAAAACTCAAAACTTCACATCTTTAGTAGTAGCATCAA
TATTCAAGATGGTTCTCCAAACTCAACTTGGGTTGAACAAGCCCCAATCCTACGCTCACGAGCAAAATTATTATTCCGA
CGGCAGCCATGGCGGCTCTATGCAAATGACAAGGCCATCGGGCTATTCCACCATGCCATATGgccAgTCCACTCACAAT
CACATGATGATGGGTCATGgtggccAACATCATGgcgGACACTAtggtggtcAtggccatGgctAcggcggtcATGaaC
ATCATGGGgcgcATATGCCCCATg > SEQ ID NO:1184 103718 109541_300051_1
AAAACTCAAAACTTCACATCTTTAGTAGTAGCATCAATATTCAAGATGGTTCTCCAAACTCAACTTGGGTTGAACAAGC
CCCAATCCTACGCTCACGAGCAAAATTATTATTCCGACGGCAGCCATGGCGGCTCTATGCAAATGACAAGGCCATCGGG
CTATTCCACCATGCCATATGGCCAGTCCACTCACAATCACATGATGATGGGTCATGGTGGCCAACATCATGGCGGACAC
TATGGTGGTCATGGCCATGGCTACGGCGGTCATGAACATCATGGGGCGCATATGCCCCATGACTCCACTAACTTTTCAA
GCAGCACCAATATGGTCCATAGTGATGCTGGCTATGGCAGTGGAATGCAACAATCTACCCATATGTTGTCAGCCATGGG
CATGGGATCGACCAATTATCATGGCCATGGTTATGGTGGCAGCCACCCTAGTCAGTACAGCCAGAGCCAAAAGTTCAAC
TGGGCTCTTAAGGATCTGGAGGAATAAATATATGATAAATTTTATGCTATCCTGTATGGTGAAAGTATGTGTGTGTTTT
GGTAGTGGATTTTGCTAATTATATAGCATGAAGAAACTACTACCTAAATAAGTAATAATGTACTAAACAGTCTGCTGCT
TTACTTGATTATCAATGCATCTACTTATCATTACTAAATGATGAATAAAAAATAAAAGTATGTTTATaacGaa > SEQ ID NO:1185 103752 142619_300500_1
taaatcttgctgcgatctgcacgccagctgattataatgctcgtccacttgacacaatctacagcaacttcattgacgc
tTTACCAGTGGTTAAATACTGCTCAGAAAATGGAAAGCGTCTCATTCACTTTTCAACTTGTGAAGTTTATGGGAAAACC
ATAGGTGCCTTTTTACCCGAAGACAGCCCATTGCGACAGGATCCTGCTTACTACGTCCTTAAGGAAGATGTCTCTCCTT
GTATTTTTGGATCTATTGAGAAGCAAAGGTGGTCCTACGCATGTGCAAAGCAATTGATTGAGAGGTTGATCTATGCTGA
GGGTGCTGAGAATGGCTTAGAATTCACCATTGTTAGGCCCTTCAACTGGATTGGTCCGAGGATGGATTTCATACCTGGG
ATCGATGGTCCTAGCGAAGGTGTTCCGAGAGTGTTGGCTTGCTTTAGTAATAATCTTTTAAGACATGAACCACTAAAGC
TAGTGGACGGTGGACACTCACAAAGAACCTTCATATATATTAAGGATGCTATTGAAGCTGTTCTCCTGATGATTGAAAA
TCCTACACGGGCTAATGGGCAGATCTTTAATGTCGGCAATCCCAATAATGAAGTTACAGTTAGGCAGCTTGCTGAAATG
ATGACTCAGATGTATTCAAAGGTGAGTGGAGAATCTCCTCCTGaaacaCCCACCATTGATGTAAGTTCTAAAGAATTTT
ACGGCGAGGGGTACGATGACAGTGACAAGCGAATTCCAGACATGACCATAATTAACAGACAGCTCGGTTGGAACCCGAA
GACATCCCTATGGGACTTGCTTGAATCCACGCTGACAtaccaACATAGgACTTATGCTGAGGCTGTCAAGCAGGCAatg
TcacagacaacTGGAAAttgAatttgaaaTCAGagcagTGGTTagtGTGTgc > SEQ ID NO:1186 103752 152895_200052_1
ATAGCCCATTGCGGCAGGATCCTGCTTACTATGTGCTTAAGGAAGATGCCTCCCCTTGCATTTTTGGATCTATTGAGAA
GCAGAGGTGGTCATATGCCTGTGCAAAGCAATTGATTGAGAGATTGATATATGCCGAGGGTGCTGAGAATGGCTTAGAA
TTCACAATTGTAAGGCCGTTCAATTGGATTGGTCCCAGGATGGATTTCATACCTGGCATTGATGGTCCTAGTGAGGGTG
TTCCAAGAGTGTTAGCTTGCTTTAGTAATAACCTTTTAAGACGTGAACCACTGAAACTAGTCGACGGTGGGGAATCACA
GAGAACTTTTATATATATCAAGGATGCTATTGAAGCTGTTCTCTTGATGATTGAAAATCCTGCAAGGGCAAATGGCCAC
ATTTTTAATGTGGGCAATCCTAACAATGAAGTTACTGTGCGGCAGCTGGCTGAAATGATGACTCAGGTTTATTCGAAGG
TGAGTGGAGAATCTTCTCTTGAAACGCCCACCGTTGATGTAAGTTCTAAAGAATTTTATGGAGAGGGGTACGATGACAG
TGACAAGAGAATTCCGGATATGACAATAATCAACAAACAGCTTGGCTGGAATCCAAAGACATCCCTATGGGACTTGCTT
GAATCCACACTCACCTACCAACACAGGACATATGCTGAGGTTATCAAGCAGGCCATGTCAAAGACGACTGCAAATTG > SEQ ID NO:1187 103752 279336_200061_1
actcgaccacttgatacaatttacagcaatttcattgatgctctaccagtggttaagTACTGCTCAGAAAATGGAAAGC
GTCTCATTCACTTTTCAACTTGTGAAGTTTATGGGAAAACCATAGGTGCATTTTTACCCAAAGACAGTCCATTGCGGCA
GGATCCTGCCTGCTATGTGCTTAAGGAAGATACCTCCCCTTGCATATTTGGATCAATTGAGAAGCAGAAGATGGTCCTAC
GCATGTGCAAAGCAATTGATTGAGAGGCTGGTCTTTGCTGAGGGTGCTGAAAATGGCTTAGAGTTCACCATTGTGAGGC
CCTTTAACTGGATTGGTCCTAGGATGGATTTCATTCCTGGCATTGATGGTCCTAGTGAAGGTGTTCCCAGAGTATTGGC
TTGCTTTAGTAATAATCTTTTTAGACGTGAACCGTTGAAACTTGTGGATGGAGGAGAATCACAAGGACGTTCATATAT
ATAAAAGATGCTATTGAAGCTGTTCTTCTAATGATCGAAAATCCTGCAAGGGCCAATGGCCATATCTTTAACGTTGGTA
ATCCTAACAATGAAGTTACTGTCAGGCAGCTGGCTGAAATGATGACTCAGgTCTACTCAAAGgtTAGTGGAGAGTCTTC
TATTGAAACACCCACCATTGATGTAAgttCtaaAGaattTTATGGCgaggGGTATGATGA
```

FIG. 2 continued

> SEQ ID NO:1188 104067 233146_301087_1
GCTCGTGGAAATGGCTTGCTGTGTGTGCATCGATCAGGCTAGCGTCGGGATCCTGGAGAAATGGGGCAAGTTCGTGCGC
GTGCTGGAGCCCGGATTCAGCTGCGTCGTGCCGTGCTTTGGCCAGTTCGTGGCTGGGACGCTGTCCCTCAAGGTGCAGT
ACTTGGATGTGCGGTGCGAGACCAAGACAAAGGACAACGTGTTTGTGTCCCTCGAGTGCTCCATCCAGTACCGCGTGGT
GCGGGAGAACGCGGACGATGCTTTCTACGAGCTGCAAAGCCCCGAGCAACAGATACGTTCCTACGTCTTCGATGTGATC
CGGGCGTCTGTTCCCAAGATGTCGCTGGACGAGGTCTTTGAGCAGAAGAGCGACATTGCGAAGGCGGTTTCGGATGAGC
TAGAGAAGGTGATGAGCGCGTATGGTTACTCGATTGAGCAGATACTCATCATCGATATTCTCCCTGATGCTGCGGTTCG
GAAAGCCATGAACGAGATCAACGCAGCCCAGAGAATGAGAATGGCGGCAGTCGAGAAAGGAGAGGCTGAGAAGATCCTG
CAAGTCAAGAGGGCCGAAGCCGAGGCCGAGTCCAAGTATTTGTCGGGGCTGGGAGTGGCCAGGCAGCGGCAGGCTATCA
CCGACGGGCTGAGGGAGAGCGTGCTGACCTTCTCGCAGGATGTTCCcGGGACTTCTGCCAAGGAGGTGATGGACCTTGT
CATGATCACTCAGTACTTCGATACCCTTAAAGACATTGGTGccagctcCAAAAAcactgctATGTTCATACCTCACGga
cccgcGCACGTCAACGACATCGCCCAGCAGCTCCGGGACgggttctgcaaGccAacactgctGcgtccttgatggatt
gaatggaATCTCATGCTTAT > SEQ ID NO:1189 104067 236058_301283_1
ggGAGCAAATGGGTCAGTCGCTTTGCTGCTTCCAGGTCCCCCAGTCCAAGGTGGCGATCAAGGAACGATGGGGCAAATT
CGACGAGGTTCTAGATCCTGGATGCCACTTCGTCCCCTGGTGCTTTGGCAGCAACATTGCCGGCTCTCTCAACCTCCGC
ATCCAGCAGCTGGATGTGCGCTGCGAGACCAAGTCCAAGGATAACGTATTCGTCACGGTTGTAGCTTCGGTCCAGTATA
CTGTTGTCCAGGCCGACGCCATGGATGCATACTACAAGCTGTCTAACCCGAGGGAACAAATCCAAGCTTATGTCTTTGA
TGTCGTTCGTGCTTGCGTTCCAAAGATGAACTTGGACGATGTGTTTGAACAGAAGAACGAAGTAGCCAAGGCTGTCGAG
GACGAGCTCGAAAAGGCAATGGCTACATACCGATATCGCATCGTCCAGACTTTGATTGTCGACGTTGAGCCGGACAAAC
ATGTTCGCAACGCGATGAACGAGATCAATGCAGCTGCGAGGATGAGGGTGGCGGCCAACGAGAAGGCCGAGGCCGAGAA
GATCCTCCAGGTGAAGCGAGCCGAGGCCGAGGCCGAGTCCAAGTACCTCTCGGGAGTTGGTGTTGCGAGGCAGCGGCAG
GCGATCGTAGATGGCCTCCGCGAGAGCGTCTTGGCGTTCTCGCACAATGTTCCAGGGACGAGtGCCAAAGACGTGATGG
ACATGGTGCTACTGACGCAGTATTTCGACACCATGAAggAGATtggCGCTGcttccaAGTCTTCCAccGTCTTccTCCC
GCAtggAccaggCGCTGttCGTGACGTCGCGGa > SEQ ID NO:1190 104067 243216_301337_2
GGCTTGCTGTGTGTGCATCGATCAGGCTAGCGTCGGGATCCTGGAGAAATGGGGCAAGTTCGTGCGCGTGCTGGAGCCC
GGATTCAGCTGCGTCGTGCCGTGCTTTGGCCAGTTCGTGGCTGGGACGCTGTCCCTCAAGGTGCAGTACTTGGATGTGC
GGTGCGAGACCAAGACAAAGGACAACGTGTTTGTGTCCCTCGAGTGCTCCATCCAGTACCGCGTGGTGCGGGAGAACGC
GGACGATGCTTTCTACGAGCTGCAAAGCCCCGAGCAACAGATACGTTCCTACGTCTTCGATGGTCAGTATCTCATATAC
GTCGGTAGTCTAGGCCCATTGTGATATGTTACTGGCAGTGATCCGGGCGTCTGTTCCCAAGATGTCGCTGGACGAGGTC
TTTGAGCAGAAGAGCGACATTGCGAAGGCGGTTTCGGATGAGCTAGAGAAGGTGATGAGCGCGTATGGTTACTCGATTG
AGCAGATACTCATCATCGATATTCTCCCTGATGCTGCGGTTCGGAAAGCCATGAACGAGATCAACGCAGCCCagaGAAT
GAGAATGGCGGCAGTCGagaagggagAGGCTGagAAGATCCTGCAAGTCAAGAgggccgAAGCCGAGGCCGagtCCAAG
TatttgtcGGGGCTGGGAGtggccaGGCagcgacAGGCTATCaCCGACGGGCTGAGGGAGAGCGTgc > SEQ ID NO:1191 104067 284622_200100_1
CaAAGGACAATGTATTTGTCAATGTTGTCGCATCAATTCAGTATCGTGCCCTGGCGGACAAAGCAAATGATGCTTTCTA
CAAACTAAGTAACACTAAGGGTCAAATTCAGGCTTATGTTTTTGATGTCATAAGAGCAAGTGTTCCAAAACTCAATCTG
GATAATGTCTTTGAGCAAAAAAATGAAATTGCTAAGGCTGTTGAAGAGGAACTTGAGAAAGCTATGTCAGCTTATGGAT
ATGAAATTGTTCAGACACTTATAGTTGATATAGTACCAGATGAGCATGTGAAGAGGGCTATGAATGAAATCAACGCTGC
TGCTAGGTTGAGGGTGGCTGCTAATGAGAAGGCAGAAGCTGAGAAGATTTTGCAAATTAAGAGGGCTGAAGGGGAGGCC
GAGTCTAAGTATCTCGCAGGCTTAGGTATTGCACGACAACGTCAAGCAATTGTGGATGGTCTGAGAGaCaGTGTGCTag
gATTTTCAGTCAATGTGCCTGGAACTagTGCaaAggATGTTATGGACATGGTCCTCGTAACCCagTACTTTGACACAAT
GAA > SEQ ID NO:1192 104067 3995_300330_1
CCCACGCGTCCGAGCATATCTAATCGGAGCTCGGAGAAATTTCGGTTGTGAAGAGAAGAAAGATGGGGAATTTGTTTTG
TTGTGTGCAAGTGGATCAATCAACGGTAGCGATAAAGGAAACATTCGGGAAATTCGAAGATGTTCTTGAGCCTGGTTGC
CATTTTCTTCCATGGTGTCTTGGTAGTCAAGTTGCTGGTTACCTCTCTAAGGGTTCAGCAATTGGACGTTCGTTGCG
AGACAAAGACTAAGGACAATGTGTTTgtTAATGTTGTTGCATCGATTCAGTACCGTGCTTTAGCTAATAAGGCAAATGA
TGCGTACTACAAGCTCAGTAACACAAGGGGTCAGATTCaagCTTATGTGtttgATgttattagagCGAGt

FIG. 2 continued

> SEQ ID NO:1193 104067 250765_301651_1
GGAAATGGCTTGCTGTGTGTGCATCGATCAGGCTAGCGTCGGGATCCTGGAGAAATGGGGCAAGTTCGTGCGCGTGCTG
GAGCCCGGATTCAGCTGCGTCGTGCCGTGCTTTGGCCAGTTCGTGGCTGGGACGCTGTCCCTCAAGGTGCAGTACTTGG
ATGTGCGGTGCGAGACCAAGACAAAGGACAACGTGTTTGTGTCCCTCGAGTGCTCCATCCAGTACCGCGTGGTGCGGGA
GAACGCGGACGATGCTTTCTACGAGCTGCAAAGCCCCGAGCAACAGATACGTTCCTACGTCTTCGATGGTCAGTATCTC
ATATACGTCGGTAGTCTAGGCCCATTGTGATATGTTACTGGCAGTGATCCGGGCGTCTGTTCCCAAGATGTCGCTGGAC
GAGGTCTTTGAGCAGAAGAGCGACATTGCGAAGGCGGTTTCGGATGAGCTAGAGAAGGTTGTAAAAAGGTTTCCTATAT
TGCTCTCGCTCACAATTGTCAAACAGGTGATGAGCGCGTATGGTTACTCGATTGAGCAGATACTCATCATCGATAttCT
cCCTGATGCTGCGGTTCGGAAAGCCATGAACGAGATCAACGCAGGTAAGCttcTGATGtACGaAGtttccgCaaCTttc
ctcTCTTTttctttcaaAACAGccCAgagaatg > SEQ ID NO:1194 104067 128537_300476_1
GAATTAGTCCCCAGGAAAATATAGAGGCATAGGTCAAAAATATTACCCCTTTTCGGATTGTGAACTTGGGGTGTTCAAG
TGTAATTTTTTAACTTGGAGTGTTCCAGTCAGATTCATACGACAAATTTTCTTGACTAAGGGTGTGTTTGGTATGAAGG
AAAATGTTTTCATTGGAAAATGTTTTCTTTGAAAATGAATGGTGTCGAGAAAATTTGTCATATTAATCTGAGATAGTCT
AGGTTGCTGGTTGATAACGACAAGTTCCTTAGGTTTAATGTTTCATGGGTTACTTTTGTGGATCATCTTTCTTTTAATG
CGATATTTACAGAGCATGGGCAACATGTTGTGCTGCGTAAAAGTTGATCAATCCACGGTTGCAATTACGGAGCAGTTCG
GCAAGTATCAAAATGTGCTTCAGCCTCGGTTGCCACTGTCTCCCTTCGTTCCTGGGATTTAAGGTAGCTGGTCATCTCTC
CCTCAGGGTACAGCAACTGGATGTTCGCTGCGATACCAAGACAAAGGATAATGTATTTGTCAATGTAGTGGCATCAGTT
CAGTACCGTGCTCTTGCAAACAAAGCAAATGATGCTTTCTACAGACTAACCAACACTAAGGGTCAAATTC > SEQ ID NO:1195 104067 155996_301361_1
GTAAAAACCCGCCAAGCGGTCTTCGTCTGTAAGAGGCAATAGAAAAACGCGCTAATCAGCAACATCAAATTTACTCAAA
CCCTAATTGGCAATACGAAGCGATGGGAAATGCTAACTGTGTATTTTGTGGATGCATAGAACAAGCGAGCGTTGGTCTG
GTTGAGAAATGGGGACGTTTTGACAGGCTTGCAGAACCGGGGCTTAACTTCTTCAATCCTTTAGCCGGCGAATGCCTCT
CTGGTATTCTCTCCACCAGGATCAGTTCTCTCGATGTCAAATCGAGACTAAAACCAAGGACAATGTCTTTGTTCATTT
AGTGTGCTCGATCCAATATAGAGTGATCAGGCAAATGCTGATGATGCTTTCTATGAGTTGCAAAATCCGAAGGAGCAG
ATTCAGGCTTATGTATTTGATGTTGTTCGAGCCCATGTCCCCAAAATGAATTTGGATGAACTTTTCGAGCAAAAGGATG
AAGTTGCTAAGGCTGTGTTGGAGGAACTTGAGAAGGTGATGGGTGCGTATGGATATAACATCGAGCACATACTGATGGT
TGACATTATTCCTGATGCTTCTGTACGAAAGGCAATGAACGAGATAAATGCAGCTCAAAGGATGCAGCTTGCTAGTGTA
TACAAGGGAGAAGCAGAAAAGATTCTCCAAGTTAAGAAAGCAGAAGCTGAGGCTGAAGCCAAGTA > SEQ ID NO:1196 104067 138842_300706_1
cccacgcgtccggctaccttcccttcctgataaacaacaccaccctgtcatagtgtctcatttaggcatatcctgatac
cAGCTGGCTATTCTCTCttgCCCTTCCACGTTCAAGTTTCCGCCCAGGTACGGCCGGAAGCTATCTAAGGACTGCAGCT
ATGGGCAATTTGTTCTGCTGTGTTCAAGTTGATCAGTCTACAGTGGCCATTAGAGAACAGTTCGGGAAGTTTGATGCTG
TGCTTGAGCCAGGATGTCACTGCCTGCCTTGGTTTGCTGGGAAGCGTATAGCTGGCCATCTCACACTCAGGTTGCAGCA
ACTGGATGTGCGCTGTGAAACCAAGACAAAGGACAATGTGTTTGTCAATGTTGTGGCATCGATCCAGTACAGAGCTTTG
GCTGGCAAGGCAAATGATGCTTTCTACAAGCTGAGCAACACAAGATCTCAGATCCAAGCTTATGTCTTCGATGTGATCa
gggcaAGTGTTCCGAAGCTGAACCTGGACGACGCATTTGAGCAGAAGAACGACATAGCAAAGGCAGTGGAGGATGAGCT
GGAGAAGGCTATGTCTGCTTACGGGTTTGAGATTGTTCAGACGCTCATCGTTGACATTGAGCCAGAcGaGcacGTgaag
cgagcgatgaaTGAAatcaatgcagcT > SEQ ID NO:1197 104081 160035_200028_1
TTGAAAAGTGGAAGCGGAAAGGGGAACGTGAGTTCAGAGCAGAGGTTGAGATTATCAGCCGTGTACACCATCGTCATTT
GGTTTCACTCGTTGGTTATTGTATCTCAGAGCAACAAAGGTTACTTGTCTATGACTATGTGCCGAACGACACACTTGAC
TATCATCTTCACGGTAAAGGCGGGACTATGGATTGGGCTACCCGAGTAAAAGTAGCTGCTGGTGCAGCACGTGGACTTG
CTTATCTGCATGAAGATTGCCATCCCCGCATTATCCATAGGGATATCAAATCATCAAACATTCTCTTGGATATCAACTT
TGAAGCACAGGTTGCAGATTTTGGGCTTGCAAGGTTAGCAGGTGATGTCAATACACATCGTGTCCACTCGTGTGATGGA
ACCTTTGGATACTTGGCACCAGAGTATGCATCTAGTGGAAAATTAACGGAGAAATCTGATGTTTACTCATTTGGCGTTG
TGCTTTTGGAGCTTATTACGGGGCGGAAACCTGTTGACCAATCTCAGCCCTTANGTGATGAAAGCCTGGTTGAATGGGC
TCGACCTTTGCTTACTCAAGCACTTGAGACTGAAAATTTTGAAGATATAGTAGATCCTAGGCTTGAAAAGAACTTTGTT
GCGAGTGAGATGTTCCGGATGATTGAAGCAGCTGCAGCTTGTGTACGTCATTC > SEQ ID NO:1198 104081 188133_300684_1
GCGGTATTTGCATGAAGAATGCAGAGTTGGTTGTATAATCCATCGTGACATGAGACCAAACAACATCCTTGTTACACAT
GATTATGAGCCACTGGTTGGAGATTTTGGGTTGGCACGATGGCAACCTGATGGTGACATGGGTTTGACACGAGAGTAAT
TGGAACATTCGGTTATCTGGCACCAGAATATGCACAGAGTGGACAAATAACAGAGAAAGCTGATGTATACTCTTTTGGG
GTTGTGTTAGTTGAACTTGTCACTGGGCGCAAGGCTGTTGACATCAACCGACCCAAGGGCCAGCAATTTTTGACTGAAT

FIG. 2 continued

GGGCACGCCCTTTCTTGGAGGAGTATGCAATTGATGAGCTCATAGATCCACGCTTGGGTGACCGCTATTGTGAAAATGA
GGTCTATTGCATGTTGCATGCAGCAAAACTTTGCATACGACGTGATCCTCATTCTAGGCCCCGCATGTCTCATGTTCTA
CGCATACTAGAGGGCGACATGGTTGTCGATTCTGGCTCTGTTTCAGCCCCAAGTAGTGATTCTGGGAGCAGGAGCTGGC
GAATGCTGAATGAACAACAGAACTGtAgagaCTGGAGCCCagcTcGACAagATtCACATCGAGTGg > SEQ ID NO:1199 104081 251219_301655_1
GGGTGGGAAAGATTGCCCGATATTAAGCTGGAAGACACGGCTTGGGATTGCTTTAGATGCTGCTCAAGGATTGGAATAC
TTACACACGTCATGCAATAGACACATAATTCACCGGGATGTCAAAACGGCAAACATACTTCTCAGTTCGGCAATGGTTG
CCAAAGTTAGTGACTTTGGCTTGTCCAAAACTTTCGATAAGAAAGGAACATCACATATCACCACAATTGTCAAGGGAAC
CCCTGGATATCTCGATCCAGAATACCATTCCTATAACAGGCTGACGGAAAAATCAGACGTCTATAGTTTTGGAGTGGTA
ATTTTCGAGATTGTTTGTGGTCGCAAGCCAATCGACACATCACTTCCAGAAAATGAAGTGAACCTTTCAAGATGGGCAT
GTCAGGAACTTCAGAAAGGCAACATGAAAGGAATTATGGATCCCCGCATGGCGGACTACA > SEQ ID NO:1200 104081 35565_300077_1
CCCACGCGTCCGACTTATGGGACGCTCTTCACAAAGGCTTTGTTCATCTTGAGTGGCGTACTCGTCATCAAATCGCGGT
TGGAGTAGCTCAAGGATTGGCTTACCTTCACCATGATCTCTCCCCACCAATCATTCATCGCGATATCAAATCGACAAAC
ATCTTGTTGGATGTTAACTATCAGCCTAAAGTTGCGGACTTTGGCATTGCAAAGGTGTTACAAGCTAGAGGCAAAGATT
CAACCACAACCGTTATGGCTGGCACCTATGGTTACTTGGCCCCAGAATATGCGTACTCGTCCAAAGCAACGATCAAATG
CGACGTGTACAGTTTCGGGGTTGTGTTGATGGAGCTGATCACGGGGAAGAAACCGGTGGATTCGTGTTTCGGGGAGAAC
AAAAACATAGTGAACTGGGTGTCAACAAAGATTGACACAAAAGAAGGATTGATTGAGACACTAGACAAGAGATTATCAG
AATCATCGAAAGCAGACATGATCAACGCCTTGCGTGTGGCTATCCGCTGTACAAGTAGAACTCCAACAATCCGTCCTAC
CATGAACGAAGTTGTTCAGCTTCTGATCGACGCAACGCCTCAAGGAGGACCCGACATGACCTCCAAACCTACGACCAAG
ATTAAGGATTCAATAGTGTCAGATCATCTCACGC > SEQ ID NO:1201 104254 228450_301021_1
ACAGCTCCACTCCACACATTAACATCATCATCAACACACACAACTACCATGGCCCGCACCAAGCAGACCGCCCGTAAGT
CCACTGGTGGCAAGGCTCCCCGTAAGCAGCTCGCCTCCAAGGCTGCTCGCAAGTCCGCCCCCTCAACCGGCGGTGTCAA
GAAGCCCCACAGGTACAAGCCTGGTACCGTCGCTCTCCGTGAGATCCGTCGTTACCAGAAGTCTACCGAGCTTCTCATC
CGCAAGCTGCCCTTCCAGCGTCTTGTCCGTGAGATCGCTCAGGACTTCAAGTCGGATCTCCGCTTCCAGTCCTCTGCCA
TCGGCGCTCTCCAGGAGTCCGTTGAGGCCTACCTCGTCTCCCTCTTCGAGGACACCAACCTTTGCGCCATCCACGCCAA
GCGTGTCACCATCCAGTCCAAGGACATCCAGCTGGCCCGCCGTCTCCGTGGTGAGCGCGGTTAAGCTTGTCACTTCATG
ATGCCGACCTCACGACAACTTTCTGGTCGGTGATGGATCTTTGGTTACTTTCTTAGGCGTTTTTACGGAATTCATGGTC
ACGGTCTTCAACTCGGGTTTATGGGTGCACTGGAGCGGTGCTGAGCATGTAGTATATCCAGCTA > SEQ ID NO:1202 104254 55680_300134_1
CAGAGAGCAGTTAGCAGAGAGAAGTTTGAAGAAGAAGGAGAACAAGAAAAAAGAGAAAATGGCTCGTACCAAGCAAACT
GCTCGTAAGTCTACTGGAGGAAAGGCACCTAGGAAGCAACTTGCTACTAAGGCTGCTCGTAAGTCTGCTCCTACTACTG
GTGGAGTAAAGAAACCTCACAGATACCGCCCTGGTACTGTTGCTCTTCGTGAAATCCGTAAGTACCAGAAGAGTACTGA
GCTCCTGATCAGGAAGCTCCCATTCCAGAGGCTTGTTCGTGAAATTGCTCAGGATTTCAAGACTGATCTGCGTTTCCAG
AGTCATGCTGTGTTGGCTCTGC > SEQ ID NO:1203 104254 6576_300328_1
cccacgcgtccgCAAAACTCGCTTCCTGATAATCAAATCAAAAGCTTCTCTATCAAGCTTATCGAAAAGTCACATCTTT
TGGAAGAAACAATGGCTCGTACCAAGCAAACCGCTAGGAAATCCACCGGAGGTAAAGCTCCCAGGAAGCAGCTTGCCAC
CAAGGCGGCGAGGAAATCAGCACCAACCACCGGAGGAGTCAAGAAGCCTCACCgttACCGTCCAGGAACCGTCGCTCTT
CGTGAGATTCGTAAGTACCagAAGAGTACTGAAttgttgATCCGCaaGCTTCccttccagCgtctc > SEQ ID NO:1204 104254 235081_301223_1
GGGGAAAGATTTCGTCGCGCTAGGGTTTTCTGATTCGTCGTCCATGGCGCGTACTAAGCAGACTGCTCGCAAGTCCACG
GGAGGCAAGGCGCCGAGGAAGCAGCTCGCGACCAAGGCCGCCAGGAAGTCGGCTCCCACCACCGGTGGAGTGAAGAAGC
CCCATCGCTACCGCCCGGGAACAGTCGCTCTTCGTGAAATCCGCAAGTACCAGAAGAGTACCGAGCTGCTCATCCGCAA
GCTGCCCTTCCAGAGGCTTGTGCGTGAGATTGCTCAGGACTTCAAGACGGATCTGAGGTTCCAGAGCCACGCGGTGCTG
GCGCTGCAGGAGGCGGCGGAGGCATACCTGGTGGGTCTTTTCGAGGACACGAACTTGTGCGCGATCCATGCCAAGCGGG
TGACCATCATGCCCAAGGACATCCAGTTGGCTCGCCGCATTCGTGGAGAGGGGCGTAAGCCACAGGGTGCTATTCATG
ACCCGTTCGCTGCTACTGATGAAGGACATAGAAAAGTCTTAGAAGGATCACTTTGTTTTGTAATATACTATTAGAACAG
CAATTCAAGTTGCTTTTGCTGTGATTTAGTCAAATAAATTTCGTGGTGTATGATTGCATTAGCTCAATcgttatatTTG
TCACACTACTAAACTTCTATTTAATCCaagttcacaccc

FIG. 2 continued

> SEQ ID NO:1205 104254 252735_301604_1
TGATCTAAGAGTAGTTGAGTTGAAAATGGCTCGCACGAAGCAAACCGCAAGGAAGTCGACGGGAGGGAAGGCCCCTCGT
AAGCAGCTGGCCACGAAGGCTGCTCGCAAGAGTGCCCCTGCCACAGGTGGAGTCAAGAAGCCCCACAGGTTCAGGCCTG
GAACTGTTGCCCTTCGTGAGATCCGAAAGTATCAGAAGAGTACTGATCTCTTGATCAGAAAGTTGCCCTTCCAACGGTT
GGTGCGTGAAATCGCTCAAGATTTCAAGACTGACCTCCGTTTCCAGAGCTCTGCTGTGTTGGCACTGCAAGAGGCTGCA
GACGCCTACCTTGTTGGGCTCTTTGAGGACACAAATCTCTGCGCTATCCATGCCAAGCGAGTCACCATCATGCCCAACG
ACATCCAACTTGCCACACGCACTTAGGGGGGACCGTGCCTAAGCTCTTT

> SEQ ID NO:1206 104254 211225_300897_1
ACCAAGTCTTTTTTCAAGCATCTTCACAGTCAACACATCACAACAACTCATCATGGCCCGCACCAAGCAGACCGCCCGT
AAGTCCACTGGTGGCAAGGCTCCCCGCAAGCAGCTCGCTTCCAAGGCTGCCCGCAAGAGCGCTCCCTCCACCGGAGGTG
TCAAGAAGCCTCACCGTTATAAGCCTGGTACCGTCGCTCTCCGTGAGATTCGACGATACCAGAAGTCGACTGAGCTCCT
GATCCGCAAGCTCCCCTTCCAGCGTCTGGTCCGTGAAATCGCTCAGGACTTCAAGAGCGATCTCCGCTTCCAGTCTTCT
GCCATCGGCGCCCTCCAGGAGTCCGTCGAGTCTTACCTCGTCTCCCTCTTCGAGGACACCAACCTTTGCGCCATCCACG
CAAAGCGTGTCACCATCCAGAGCAAGGACATCCAGCTCGCCCGCCGCCTCCGTGGTGAGCGCAACTAAGTTGGAGAGAC
TTTGGGAGGAACGTTGCAGACATGACTTTTGCTTTTCACACGAGTGTTTCTGGGGTCAAGGGATAATCAGGCGTTACAA
ATGAGAGTTTTTATTCCCCTTTATGGTTCGGAATGTATATTACCAGTGCGTCAGGGAAAAAGCACTGCATAAATGCAAA
CGAGGTTCACGGCCTCACGGGTTAACGAACTATAATAACTGCATCACTCTAAAAAAa

> SEQ ID NO:1207 104254 1007894_301404_1
TCTGCTTCCGTGCCTTTCTCTTCCTCCGCTTCAGGTAAGAGAGATTGAGGATGGCCCGTACTAAGCAGACTGCTCGCAAAT
CTACTGGAGGCAAGGCTCCAAGGAAGCAATTAGCAACCAAGGCTGCTAGGAAATCTGCACCTACCACTGGAGGGGTGAA
GAAGCCACACAGATACAAGCCAGGAACTGTTGCACTCCGTGAGATTCGAAAGTATCAAAAGAGCACTGAGCTCCTTATT
AGGAAACTGCCCTTCCAAAGGTTGGTCCGTGAGATTGCCCAGGATTTCAAGACGGACTTGCGTTTCCAGAGCCACGCTG
TGCTTGCACTTCAGGAGGCAGCTGAGGCTTACCTTGTGGGCTTATTTGAGGACACCAACTTGTGTGCTATTCATGCCAA
GAGAGTCACCATCATGCCTAAGGATATCCAACTTGCCAGGAGGATCCGTGGGGAAAGGGCTTAGCAACTTTTCCTTAAA
AATTTGGACAACTGCACCAATGGTTTTAATAACAATAAGATATCTATTGACATAGATCCCCCACTATCTATTGGTCTT
TTGAACTTGGATTTTAGTTCAAATATTGCATTGAAAACATTGTGTTTATGCCTACTATGTGttgctCTCAATATAGTTT
TGAgAATATGGACCCTTTGAagTaaTAattt > SEQ ID NO:1208 104254 201507_300717_1
ctgcccacgcctcaattcaaaaaatccattcgaatttcgcagcaaagagatcgagagagagatccatcaatccatcatc
cATGGCGCGCACGAAGCAGACGGCGAGGAAGTCGACCGGCGGGAAGGCGCCTCGGAAGCAGCTGGCGACGAAGGcgGCG
CGGAAGTCGGCGCCGGCGACCGGCGGCGTGAAGAAGCCGCACCGGTTCCGGCCGGGCACGgtgGCACTCCGGGAGATCC
GCAAGTACCAGAAGAGCACGGAGCTGCTGATCCGGAAGCTCCCGTTCCAGCGGCTGGTGCGGGAGATCGCGCAGGACTT
CAAGACGGACCTCCGGTTCCAGTCGTCCGCCGTCGCCGCTGCAGGAGGccGCCGAGGCCTACCTCGTCGGCCTCTTC
GAGGACACCAACCTCTGgGCCATCCACGCCAAGCGCGTCACCATCATGCCCAAGGACATCCAGCTCGCCGCCGCATCc
gcggcgagCGCGCGTAAGCCgccgcCTTCGACGCGGTTgcgTTgCgtagcgCCGAAGCGATCTGGGGGGATCAACGACG
ACGACGTGACGTGGTCaaCTTgttgattcccCTCTCGCttccgcgttttagatcTCGttTTCATtagcAGCTttgtaat
agggtttggtcggttaattAGtgtaaAAACAgggttcggTTaaagactcaaaATcaaa > SEQ ID NO:1209 104254 187042_301704_1
GAGTCTTTAACCGAACCCTGTTTTTACACTAATTAACCGACCAAACCCTATTACAAAGCTGCTAATGAAAACGAGATCT
AAAACGCGGAAGCGAGAGGGGAATCAACAAGTTGACCACGTCACGTCGTCGTCGTTGATCCCCCCAGATCGCTTCGGCG
CTACGCAACGCAACCGCGTCGAAGGCGGCGGCTTACGCGCGCTCGCCGCGGATCGGCGGGCGAGCTGGATGTCCTTGG
GCATGATGGTGACACGCTTGGCGTGGATGGCGCAGAGGTTGGTGTCCTCGAAGAGCCCGACGAGGTAGGCCTCGGCGGC
CTCCTGGAGGGCGAGCACCGCGTGGCTCTGGAAGCGGAGGTCGGTCTTGAAGTCCTGCGCGATCTCGCGGACGAGGCGC
TGGAAGGGGAGCTTGCGGATCAGGAGCTCCGTGCTCTTCTGGTACTTGCGGATCTCGCGGAGCGCCACCGTCCCCGGCC
TGTAGCGGTGGGGCTTCTTCACGCCGCCGGTGGTCGGAGCAGACTTCCTCGCCGCCTTGGTGGCGAGCTGCTTCCTCGG
GGCCTTGCCGCCGGTGGACTTGCGGGCGG > SEQ ID NO:1210 104254 156572_301367_1
cccacgcgtcCGCACAAAAGCAGATAGAAGAAAGAAGAAGGAGAAAAGAAAAAAGAGAAGATGGCTCGTACCAAGCAAA
CTGCTCGTAAGTCTACCGGAGGAAAGGCACCTAGGAAGCAACTTGCTACTAAGGCTGCTCGTAAGTCTGCTCCTACTAC
TGGTGGAGTAAAGAAACCTCACAGATACCGCCCTGGTACTGTTGCTCTTCGTGAAATCCGTAAGTACCAGAAGAGTACT
GAGCTCCTGATCAGGAAGCTCCCATTCCAGAGGCTTGTTCGTGAAATTGCTCAGGATTTCAAGACTGATCTGCGTTTCC
AGAGTCATGCTGTGTTGGCTCTTCAGGAGGCTGCTGAGGCATACTTGGTTGGTCTCTTTGAGGACACAAATCTTTGTGC
CATTCATGCCAAGCGAGTCACCATTATGCCAAAGGACATTCAGCTTGCTAGGCGTATCAGGGGCGAGCGTGCTTAATTT
GATAAAGTGTGGTAGCTTTGTTGGTGCTTTTAGATCTTTTTGTTAAAAGACTGATGGTATTAAAATTTAGTAGTAGGGA

```
TGATATGCTATGTTGATCTTATAGTGTGGTGGATGGAGGTGGTGAAACATAGTATATGTTGGATCTTTCTAATGTTTTG
TTGTCACACCGCTGGTGTTGAACAAGTTTCAGAATTTGCATCTAATGTTTAGTTCAACTCTATGGT

> SEQ ID NO:1211  104254  155514_301357_1
TCTTCTACTTTTGCAGTTTCCTCTCTAATTTCAAGCCATCCTCATCAGCCTTCAAAATCAAGCAATCCTAAGGAAATCA
GATGGCTCGTACGAAACAAACTGCCCGTAAATCTACTGGAGGCAAGGCTCCAAGGAAGCAGCTTGCAACCAAGGCTGCC
CGTAAATCTGCCCCAACAACAGGAGGAGTTAAGAAGCCTCACAGATACAGACCTGGAACCGTTGCTCTTCGTGAAATTC
GCAAGTACCAGAAGAGCACTGAGCTGTTGATCAGGAAATTGCCATTTCAAAGGCTTGTTCGTGAAATTGCACAGGACTT
CAAGACTGACTTGCGTTTTCAGAGTCACGCTGTGTTGGCCTTGCAAGAAGCAGCTGAGGCATACCTTGTTGGATTGTTT
GAGGACACTAATCTGTCGCCATTCACGCCAAGCGTGTGACTATCATGCCTAAGGATATCCAGTTGGCCAGAAGAATTA
GGGGAGAACGAGCTTAGAATGATTTTTTCTGCTTTCTCTTGCTTAGATTATTGAAGTTTTTTCTTTAGCGTTTTCTGTT
TTTTTCTTCTTCATATAGGTAGTTTTACTAGATATGAATGGATGTGGAGTACTGGAAATTTGATACTCTATTAAATAGT
CGATTTTCAGCTTTAGCCAAAAAAAAAC

> SEQ ID NO:1212  104254  146168_200014_1
gccattacggccggggaaccaaagcaatttccaatctacaaaactctttcttatggctcgtaccaagcaaactgctcgc
aAATCAACAGGTGGAAAGGCTCCAAGGAAGCAGCTAGCAACCAAGGCTGCAAGAAAGTCAGCTCCGGCGACCGGAGGAG
TGAAGAAGCCTCACCGTTTCCGTCCGGGAACTGTTGCTCTCAGGGAAATCAGGAAGTACCAGAAGTCTACTGAATTGTT
GATAAGGAAGCTGCCATTTCAGAGGCTGGTGAGGGAAATAGCACAGGATTTCAAGACAGATCTGAGGTTCCAAAGCAGT
GCTGTTGCTGCCCTACAAGAGGCTGCAGAGGCTTACCTTGtTGGCCTCTTTGAAGATACAAATCTCTGTGCCATTCACG
CCAAGAGGGTCACTATCATGCCAAAGGACATTCAGCTTGCTAGGAGGATTCGCGGCGAAAGGGCTTAGAATGAAGCTTG
TTATGCTTATGGTTATGGTTAATTCGTGTTCTCTGATCTAGGGCATTGTTTTTgTGTGTTTTtgCTGAATGtTAGGGTT
AGTGATGTAAATCAAGCGACTTGtTCCAATCAAAATCAAAATATATGTAAAACCTCTGGTTTATTAGTATTTTGAAATC
TTATTaaTGAAATTTGTACTCATTTtgccG > SEQ ID NO:1213  104254  144294_200133_1
AAAATCCTTCAAAGATCCAATTACTCTTTCATCCAAATCCTACAAGACCTAAGTCCCTAATGGCTCGTACAAAGCAAAC
TGCCCGAAAATCCACCGGAGGGAAAGCTCCGAGAAAGCAATTAGCCACAAAAGCTGCCAGAAAGTCAGCTCCGGCCACC
GGGGGAGTGAAGAAGCCTCACAGATTCAGGCCAGGGACTGTTGCGCTTCGTGAAATCCGCAAGTACCAGAAATCAACTG
AGCTTTTGATCCGTAAGCTCCCGTTTCCAGCGTTTGGTTCGGGAGATAGCTCAGGACTTCAAGACCGATCTCCGTTTCA
GAGTTCGGCTGTGGCTGCGCTCCAGGAAGCTGCTGAGGCTTATCTCGTCGGTTTGTTTGAGGACACAAACTTGTGTGCT
ATTCATGCTAAGAGGGTTACTATTATGCCTAAGGATATTCAGCTTGCTAGGAGAATTAGGGGTGAGAGGGCATAAGTGT
GAACCTACGGTAGCTATGGGAGCTTGTAACTGAGCATATGGTAGATGAGTTTCTAGGCTTTTACTGTATTTTGGTCCAA
AATTTTCTCAATTCTGGATATGTAGTCGTATTAAAAGTATTTTAATGAAATATCAGTTCTTCTTtgcc > SEQ ID NO:1214  104254  13203_300271_1
CCCACGCGTCCGCCGTACACGCGTGAAGACTGACAATATTATCTTTTTCGAATTCGGAGCTCAAGTTTGAAATTCGGAG
AAGCTAGAGAGTTTTCTGAGATGGCTCGTACTAAGCAAACAGCTCGTAAGTCTACTGGAGGAAAGGCTCCTAGGAAGCA
GCTTGCTACAAAGGCTGCACGTAAGTCTGCACCAACCACTGGAGGAGTCAAGAAGCCCCATCGTTACCGTCCAGGAACT
GTTGCACTACGTGAAATTCGTAAGTACCAGAAGAGTACCGAGTTGCTGATCAGGAAGCTCCCTTTCCagaggctAGTTC
GTGAGATtgccCaggATTTCAAGACTGACt > SEQ ID NO:1215  104254  127804_300473_1
cTCCACAAAAGCAGAGAGCAGAGAGCAGAGAGAAGAAAGAAGAAGAAGGAGAACAAGAAAAAAGAGAAGATGGCTCGTA
CCAAGCAAACTGCTCGTAAGTCTACTGGAGGAAAGGCACCTAGGAAGCAACTTGCTACTAAGGCTGCTCGTAAGTCTGC
TCCTACTACTGGTGGAGTAAAGAAACCTCACAGATACCGCCCTGGTACTGTTGCTCTTCGTGAAATCCGTAAGTACCAG
AAGAGTACTGAGCTCCTGATCAGGAAGCTCCCATTCCAGAGGCTTGTTCGTGAAATTGCTCAGGATTTCAAGACTGATC
TGCGTTTCCAGAGTCATGCTGTGTTGGCTCTGCAGGAGGCTGCTGAGGCTTACTTGGTTGGTCTCTTTGAGGACACAAA
TCTTTGTGCCATTCATGCCAAGCGTGTCACTATCATGCCAAAGGACATTCAGCTCGCTAGGCGTATCAGGGGCGAGCGT
GCTTAATTTGATCAAGTGTGGTAGCTTTGTTGGTGCTTTTAGATCTTTTCTTAAAAGACTGATGGTATTAAAAAATAGT
GGTAGGAACGATGTTCTATGTTGATCTTATTTTGTGGTGGATGGAGGTGTGCTGTAATTGTTGTTCTGTTTGGGGAAGT
GGAGAAACATAGTACTTGTTGAATCTTTCTAATGTTTTATTgtCACACCACTGGTGTTGAACAAGTTTCAGAATTTGCA
TCTAATGTTTagtTcAaCTgTTTgg > SEQ ID NO:1216  104254  126587_300464_1
gccattacggccggggacactcaaatctgtaattaacatttgaaagcagaaaaccctacaagtccgaaagttctctGAA
TTTTTCAAATTTCTCAATGGCACGTACCAAGCAAACTGCTCGTAAGTCCACTGGTGGCAAAGCACCAAGGAAGCAACTC
GCCACAAAAGCTGCTCGGAAATCAGCTCCGGCGACCGGTGGAGTGAAGAAGCCACACAGATTCAGGCCTGGAACTGTTG
CGCTTCGTGAAATCAGAAAGTACCAGAAATCAACTGAGCTCCTGATCCGTAAACTTCCGTTCCAGCGTTTGGTTCGTGA
```

```
GATAGCTCAGGATTTTAAGACCGATCTGAGGTTCCAGAGCTCTGCTGTTGCAGCTCTTCAAGAGGCGGCTGAAGCATAC
CTTGTTGGTTTGTTTGAGGACACTAACCTTTGTGCTATCCACGCTAAGAGGGTTACCATTATGCCTAAAGACATTCAGC
TTGCCAGAAGAATTAGGGGCGAGAGAGCTTAAATTAGTTTTTGGGTGTATAGTGGATTGTTTGTTAAGGGTTTTGAGCC
TTTTGTGTTTTGGTGTAGTACTTTCTCAGTTCTGGCTATGTAGTTCAATGAAGTGCATTTTAATGAAATATCAGTACTA
TTTTATCca

> SEQ ID NO:1217 104254 191076_300738_1
CTTCTTCTTCTTCCTCCTCCTCGCGCTCCCCCGATTCGAAGCGTGAAGAGAGGGAACGGCGCTTGCGAGAGGAGAGAGAT
GGCCCGTACCAAGCAGACCGCTCGTAAGTCCACAGGAGGAAAGGCTCCCAGGAAGCAGCTTGCCACCAAGGCTGCTCGT
AAGTCTGCTCCCACCACTGGAGGAGTTAAGAAGCCCCACCGTTACCGCCCTGGAACTGTTGCCCTCCGTGAGATTCGCA
AGTACCAGAAGAGTACTGAGCTTTTGATCAGGAAGCTGCCCTTCCAGAGGCTTGTTAGGGAAATTGCACAGGACTTCAA
GACCGATCTGCGTTTCCAGAGCCATGCTGTCCTTGCCCTCCAGGAGGCTGCGGAGGCATACCTTGTTGGTCTCTTCGAG
GACACCAACCTGTGCGCCATTCATGCCAAGCGTGTGACCATCATGCCTAAGGACATTCAGCTGGCTAGGAGGATTCGTG
GTGAGAGGGCTTAAATTCCCCTCGGCGATTCCTTTGACAAATGAAGCATGCGTCGTAGTGTTAGTAGTGGGTTTTAATC
TTTTGCTTATAAGAACAATCTGAGTAGGGTGTATTTTgtGGAACAATATGTTTCTCATGATGGTGCTGTATTCGTCTTA
TTGgTGGATCTgtcaAAAataCTCAGCATAttgtcaGTgtgTCTGGTGACTCTTa > SEQ ID NO:1218 104254 1170870_302038_1
GTTTGCGGAGTTCTTCTCTTCTTCCCGCCCTTTCGTATTTCTCAGTCTGGTTCAAAGATGGCTCGTACTAAGCAGACCG
CCCGTAAATCCACCGGAGGGAAGGCCCCTAGGAAGCAGCTTGCCACAAAGGCTGCAAGGAAGTCTGCCCCTACCACAGG
TGGAGTTAAGAAGCCTCACCGATACAGGCCTGGAACTGTTGCTCTGCGTGAGATCCGTAAGTACCAGAAGAGTACTGAG
CTTTTGATAAGGAAGTTGCCATTTCAGAGGCTTGTTCGGGAGATTGCACAGGATTTCAAGACTGATCTAAGGTTTCAGA
GCCATGCTGTCTTGGCTCTGCAAGAGGCTGCTGAGGCCTACCTTGTTGGCCTGTTTGAGGATACCAATCTCTGTGCTAT
CCATGCCAAGAGGGTTACAATTATGCCCAAGGACATCCAACTTGCGAGGAGGATCCGAGGGGAGAGGGCTTGATTTCTT
CTTTTGCTCCTCTTTAAACTAATATGACCTTCATTCGAACACTTCTTTTGTTTTGAATCTGAAAGCTCTAGCAATAGAC
GCTAATTGCACCCTTTTAACAATGTATTGCTTCAAATGCCTATAATAGACCTATGTTGCCCTTtgtgTtctgtaaata
attggcAGcttgattCaaaTGTGGGATGAttTtttcTGACTAa > SEQ ID NO:1219 104254 111226_300053_1
ATAAAGTTCCTCTTCTCCTTCTGTAGTTTCCTCTCTAATTTCAAGGTTTCCTCACACCCTTCAAACTCGAGCAATCTTA
AGGAACTCAGATGGCTCGTACGAAGCAAACGGCTCGTAAATCTACTGGAGGCAAGGCTCCAAGGAAGCAACTTGCAACA
AAGGCTGCCCGTAAGTCTGCCCCAACAACAGGAGGAGTTAAGAAGCCTCACAGATACAGACCTGGAACCGTTGCTCTTC
GTGAAATTCGCAAGTACCAGAAGAGTACTGAGCTGTTGATCAGGAAATTGCCATTCCAAAGGCTTGTTCGTGAAATTGC
ACAGGACTTCAAGACTGATTTGCGTTTCCAGAGTCACGCTGTATTGGCTTTGCAAGAAGCAGCTGAGGCCTACCTTGTT
GGATTGTTTGAGGACACAAATCTGTGCGCCATTCACGCCAAGCGTGTCACTATCATGCCCAAGGATATCCAGTTGGCCC
GAAGAATTAGGGGAGAAAGAGCTTAGAATGATCTGTTCTGCCGTATCGTGCTTAGATTGTTGATTTTTTTTTGAATTG
CCGTCTTTCTGCATTTTTCTTCTTCTTTGGTCTTCATATAGGTAGTTTTTACTAGATATGAATGGCTGTGGCATACTGG
AAATTTGATACTCTCTATTATATAGTCGAATTTTATTGGT > SEQ ID NO:1220 104254 1110811_301539_1
GAAGAGAGGAGAGAGAGGAGGAGAGAGAAGAGGGGATATGGCTCGAACGAAGCAGACGGCTCACAAATCGACGGGAGGA
AAGGCTCCCCGCAAGCAGCTAGCTACCAAGGTTGCTCGTAAGTCGGCTCCAACAACCGGAGGAGTGAAAAAGCCTCATC
GATATCGTCCTGCAACTGTGGCTCTTCGTGAGATTCGGAAGTACCAGAAGAGCACAGAACTGTTAATTCGCAAATTGCC
GTTTCAAAGGCTCGTACGTGAGATAGCTCAAGATTTGCAACAACGGATCTTCGATTTCAGAGTCACGCTGTTCTTGCTCTT
CAGGAAGCAGCTGAAGCCTACTTGGTAGGTTTGTTTGAAGATACTAATCTCTGTGCAATTCATGCAAAAAGAGTGACAA
TCATGCCCAAGGACATTCAACTTGCGAGACGCATTCGCGGGGAGAGAGCTTAGACTTGTGCTAGATGTCCTCACAAGAT
TGGAATTCTTAGAAATACTTCTTTGTTAAAGGATGTTCAATTCAACATGTGTCATATACATTTTAGGTGATGGA > SEQ ID NO:1221 104407 28833_300151_1
cgacccacgcgtccgcggacgcgtgggCAAAACTTTCTTTCTACTATATTAAAGAAGAAAATATGGGTGTGAAAGGCAA
GTTGATTGCTTCAGTAGAGGTGAAGTGTGGAGGACACCCAATTCATGATATTTTTCACACCAATACTCATCACATATGC
AACATAAGTCCTCGTAAGATCCAAAAATTTGACATTCACGAAGGTGAAACAGTAAAAGTTGGTTCGGTTGTTAACTGCA
AATATAACGACGATGGAAAAGATAAGATCTGTAAGCAAAAGATTGAAGCCGTGGATCATGTGAAGAAATCAATTACTTG
GAAAGTAATTGGAGGAGATCTGTTAGAGTTGTACAATTCCTTCACAATTACCACATCCCACGACCACCAGTGGACTACA
TGGACATTTGTGTACGAGAAGAAAACTGAAGACACCCCAGAGCCTCTCGTTCTCTTGGGTTTTGTCCTACATGTGACCA
AAGATATAGAGGGTCACCTTCTCAAGTAATATAATCTATGCTATTCAATGGCTTATAGCCATTTATACGTATGTCAATA
CACATATATATCTATGTGTTTGATGAGTATTTGGCAATATTGGCAAGCTCTAGCTAGCTACGTGTGAAATAAAGACTGT
TGTGTTTGAAGATATATATTATATATGCACTCTCCTTCTATGGATGTATTTCTAATGGTGAATATATGTAAGATATT
TTGAATTTTGagAAATAGggtTAATAATAAAAAAATAAATA
```

FIG. 2 continued

> SEQ ID NO:1222 104702 56729_300142_1
ATGGCGGCTTCGTTCTCACTCACGAGCTTCATCTCCTTCATCTCACCATTCAAATCTCAAACTAAACCTACACCACCAC
CAAATCTCACTCTTCCTTCTCCAACAATCTCCCAAAGGCGAAGAAATGATCTCGCTATCGAATCAATGGCGGTCGAAGA
AACTTCCTCAACCGCTTATTCACTTTCCTCTGAGCTTGCTTCCGTGATTAGTCCCTCGCTTGCTTACTCCAACACACTC
TTCTTCAGTTCTGGATACAATGTGCAAGTGTTTGTTGAAGATAATGAGTCAGAGGAGAGGCTTGTGAATCGATTTAGGA
GAGAAGTGATGAGAACTGGTGTTATACAGGAATGTAAGAGGAGAAGATACTTTGAGAATAAACAAGATGAGAAGAAACG
TAGGACTCGTGATGCTGCTAATCGTAATAAGAAAA

> SEQ ID NO:1223 104702 107768_300258_1
AATTTCTCAAATGGCAGTCTCATCCATAGCCAATCTCTTCTCCTTCTTCACCCCCTCCAAACCCCCACCCCCCAGAGCT
TCCCCCCTCCAATTCTCTCTTCCTGCTGTTGATTCCCTCTCTTCTTCAACACCTATCAACAATCACAAATACCCATTAT
CACTATCGTGTTCTAATTCTGATGTTACGGCCGTCGTTTACCCCTCACTTGCAAATGCAAACACTCTTTACTTCAGGTC
GGGATACAATGTT

> SEQ ID NO:1224 104702 182072_300628_1
gaattCCCAACTGCGCGCTAACCTAGAACCCacagagGGTGTTGGTCGATTAAGACAGCAGGACGGTGGTCATGGAAGT
CGAAACCCTAAAACCACCATCTCAACTCGCTCCTCCATCATCATCAATATCATCACCCTCTACTTTATCTTATCAAGAA
AAGAACAGAAATGGGTTTGTTCCAGTAATGTCATCGAATTCTGTTGTTAATGACGAATTACTATCAGTAGTATGCCCAT
CACTGGCTTATTCAAATACCCTTTTCTTTAAAACTGCTTATAATGTTCAAGTAGTTGTTGATGAGGATGAACCTGAAGA
AGTTTCACTAAGAAGGTTCAAAAGAGAAGTATTTAGAGCTGGTGTTATTAATGAGTGCAAAAGAAGAAGGTTTTTTGAA
AATAAGCAAGAAGAAAAGAAAAGGAAGCATAAAGAAGCTGCTAAGAGGAATCGAAGAAGACGTCCTTTTGTACAAAGGC
CAGATAAACAAGAAATGGCTTCTAGCGAAAAGGAAAAGAGGGCGAAGGAAGATGATGAAGATAACTGGGAACTTCCTAA
AGGAAACATTCCGTACTGATAAAAGAACATCTGGGAATGTAATGTAATACCTTTTgttTTCCTCTCTGtagaagaaagg
ggATGTGATGTATTTAATCAGTTGATGAgtAGTAAGattTtcaggcTgggatcaatgggtgccttgaactgACTAAt > SEQ ID NO:1225 104765 104766_300367_1
TCGCCCACTATAATCTCACCTAAGCAGTACAAAAAGAGGTGTCGCAAGGCCATGACCACCTATTTTCTCATGGTCCCAG
ATCAATGGTCACCACCGTCTATCATTCCCAGTAAATCACAGACTGATTTATGTGAAGAGAACATGCAAGATGGATGATC
TGCCAAGTGATTTTGTACATCTGTTCGTATATTGAGCACATATTTGGGTTTCTCGCATTGGTTATCCCAGGTTCATACA
TCTCCCATATTTTCGATTCCCATTCTTTTGGAACGCAGTTCCGGTTGCATTCTCCCTAAAGTGGGAGAACACATGATTT
CTTGTCAGAGCACTTGGTAAGAGGTTTGTATTTCAGTGAAAGTCTCCATTGCACAGAATATAGGTGGCTCTCCGTGGAA
ATATTTTGTAAATCTTTTTCTTTTAATTACAATTTCTTTGGGTGTAAAATCCAAGGTATACATGAGTTCCGAAGGAT
CATTGGCAATTTTATACAATGCATGATTTTGGAGCAATTTAGCTGGTGTAGTTTCAAGTGTATCGCGATTCTTTCCTCT
GTAATTTTTGTAATTGTGATTTTGAAAGGTGAATCTTCTTACCTTTA > SEQ ID NO:1226 104768 267359_200117_1
ACCTTTTGAACCTGTAATGCCTGGAGTTACCTTCCTGGAGTATGGCGATATTCAAGCAGCCACAGAGTTAATTCAGAGT
GGTAAAATAGCTGCTGTGTTTGTTGAACCAATCCAAGGTGAAGGTGGAATATATAGTGCAACAAAAGAATTTNTTATTT
CTCTGCGAACTTCCTGTGATAGTGTTGGTTCTCTTCTTGTCTTTGATGAGGTTCAATGTGGCCTAGGACGAACTGGTCA
TCTTTGGGCACATGATGCTTATGGCATATACCCAGATATTATGACTCTTGCAAAGCCACTTGCGGGAGGTCTACCTATT
GGGGCGGTGTTAGTGACTGAAAGAGTTGCTGCTGCCATAAATTATGGAGATCATGGTAGCACCTTTGCTGGCGGTCCTC
TTGTTTGCAATGCTGCAGTTGCTGTGCTGAACAAGATTGCCGAACCAAGTTTCCTTGCCAGTGTCACCATGAAGGTCA
ATATTTCAGGGAATTGCTTGTTAAGAAATTAGGAGGAAACTCACATGTGAAAGAAGTACGAGGCGTGGGGCTTATATC
GGGATAGACCTTGATGTACCAGCATCTCCACTGGTTGATGCATGTCAACAATCTGGCCTTCTTGTATTAACGGCTGGAA
AAGGAAATG > SEQ ID NO:1227 104790 125384_300630_1
GGAAAAAATTGGGAACACCTGATTCGATTAGGCAAAGCAAAAATGCAAAGGGTTGGGAAGGCTCGCCAGCTCGTTAGGG
TTTTGAGAAACTCGTCATCTCCTATTCTGCTCAACTCAGTGTCACGAATTCAATCTCATTGTACCTATGAATCTACTGA
ATCATGCCTCAATTTTTCTTTACGGCGTGGTTACTTTACCTCTGGTACTGCAATTTGTGGAAATTATATTCAAACAAAA
CACAATATTCAGAGAAATGTATGTCAATGTGAAAAATGCTCTATGATGCTCAAGGCATCATTTTCTACAGAAGCAGGGA
CAGTTGAAAGTAGTGTGGCAACAGAGTCTGTGAAGGAATTGTATGATAAGATGCTGAAATCTGTCGTGGAACAAAGATC
TGCTCCGCCAAATGCTTGGTTGTGGTCCCTAATACAAAGTTGTGCAAACCGTGAAGATGTTAATTTTTTACACGACATT
TTGCAGAGACTTCGGATATTTAGACTTTCAAATCTCCGTATCCATGAGAACTTCAATTGTGCCCTCTGCCAGGACATTA
CAAAGGCTTGTGTACGTGTTGGCGCCATTGACTTGGGTAAGAAGGTGTTGTGGAAGCATAATGTGTACGGATTGACTCC
TAATATTGGATCTGCTCACCATTTACTGTTGTTTGCTAAACAGCATAATGATGTTAAACTG

FIG. 2 continued

> SEQ ID NO:1228 105019 1112730_301793_1
TCTCAACATTGGAAAACTATGCATGAAGGGTAGAGATCCTCTCTTTGTTCCTTGTACTCCCAAGGGCTGTATTGAATTA
CTGGTTCAGTCAGGCATTCCAATAGCGGGGAAGAAAGCGGTGGTTGTTGGGCGGAGCAACATCGTAGGTCTTCCAGTTG
CAATGCTTTTGAATAAGCTTGATGCAACAGTTACGATTGCGCATTCACGGACGAAAGATACAATGAGTATGGTTAAGCA
GGCCGACATTGTTATTGCAGCTTCTGGCCAAGCACAAATGATCAAGGGTGAATGGATTAAGCCAGGGGCAGCAGTGATT
GATGTGGGAACGAATGCAATCCCGGATCCAACAAGAAAATCTGGCACCCGACTTGTGGGCGATGTTGATTTTGCGGAAG
CTAAGAAGGTGGCAGGCTGGATAACCCCTGTTCCGGGAGGTGTCGGACCTATGACGATAGCAATGCTCTTAAAGAACAC
TTTGGAGGGTGCCAAACGCACATTTTCCCAACATGACGAATAGCTGTATACTCCACTTTCACCTTAACTGGTATGCATT
TCACATTTGTGGCCACTTGATTAACATTATTCCTCTATTGGTGCATGCTGTTTTCTATTCTGGAAAGATACGTGTAAAA
TCGCTGGATCTTTCTCAATTCGAAAATAATTCAGGAACCG

> SEQ ID NO:1229 105019 228424_301021_1
AAGCATATTAATGAGGAAAAGATATTGAACGATATCAGCTTAGAGAAAGATGTTGATGGGTTCCATCCTCTGAATATTG
GCAAGCTTGCAATGAAAGGCAGAAACCCACTGTTCCTACCATGCACGCCGAAGGGATGCATGGAGCTCCTAACACGGAT
CGGAGTTACCATCAATGGGAACCGAGCGGTCGTGGTTGGCCGGAGCAACATTGTCGGGCTACCTGTATCCCTGCTTCTG
CTGAAGGCGGATGCGACCGTATCCATTGTTCACTCCCGGACCCCAAAACCTGAAAGTATTGTCCGTGAAGCATACATTG
TCATTGCAGCGGGTGGCCAGTCTATGATGATCAAAGGAGAGTGGATCAAACCAGGCGCTGCTGTCATCGACGTAGGGAC
GAACTCCATCAGGGAGCCAACCAGGAAATCGGGGTACAGACTCGTCGGTGATGTGGATTTCGCAGAGGTGAGCAAGGTT
GCTGGTCACCTGACTCCAATCCCAGGTGGGGTTGGACCCATGACGGTGGCGATGTTGCTGAAGAACACGGTGGATGGAG
CGAACTGTGGTATATTTCACTAAAGTTTCCATCTTGTATGCTGTAACTG

> SEQ ID NO:1230 105019 6295_300336_1
CCCACGCGTCCGCGGATTTCATCCGCTAAATATTGGACGGCTTGCCATGCGTGGAAGAGAACCCTTATTCGTTCCTTGT
ACTCCAAAAGGATGCATTGAGTTGTTGCATAGATACAACATTGAAATCAAAGGAAAGAGAGCGGTTGTTATCGGAAGGA
GTAACATTGTCGGTATGCCAGCTGCTCTTTTACTGCAGAGGGAGGATGCAACCGTTAGCATTATCCATTCAAGAACCAA
GAACCCTGAAGAAATCACAAGAGAAGCTGATATTATAATCTCAGCTGTTGGACAGCCAAACATGGTCAGAGGAAGCTGG
ATAAAACCGGCGCAGTCCTCATCGATGTTGGGATTAATC

> SEQ ID NO:1231 105019 254011_301631_1
GCGTCGATTTGTTTGAAGGATGATGCTCAGGGTGGCACTGTTAGGGCGAGGAGACACTCTCCCCTTCGTCTTACCCCGT
CACGAGTTCAAGTCCTCCCTCCGCCTCCGGTGCTCCTTCGCGACATCCCTTCCATGCCGCTCGAAAGCTTCTCTCGGAT
GGGGATCCCACAAGCCTCCGCATGCTACCTTGCAGCAGCAGCAACAAGAACAAGTAGACATGAGTGAGCCAACTGCAGC
TATTATTGATGGGAAGGCCATAGCCCAGAAAATTAGATTGGAAATAGCAGAGGAAGTTGCAAAGATGAAAGATGAGACT
GGAAAGGTTCCTGGCTTGGCTGTGGTGCTTGTGGGATGCCGTAAAGATTCTGAAACGTATGTTAGAAGCAAAAAGAAGG
CCTGCCAGGAGGCTGGAATCACTTCATTAGGCACAACTTTGCCGGAAGATTCGAGCGAAGAGGAAGTTTTGACTTGTGT
GCAGCAATTTAACAATGATCCTGCAGTTCATGGAGTGCTCGTGCAACTACCACTACCTAAGCATATAAGCGAGGAGAAG
ATCCTTGCAGCTGTTAGTGTGGAGAAGGACGTTGATGGTTTTCATCCAATCAACTTGGGGAAATTAGCCATGCGAGGAA
GAAAGCCTCTTTTTGTGC

> SEQ ID NO:1232 105143 232859_301218_1
CGTCCCACGCGTCGCCCACGCGTCCGAGTCTTGCGAGGAGAAGGGCAGCGAAGAAGATGAAAGAAGAGTATCGATGCTT
CATCGGCGGCTTGGCCTGAGCACCACCGATCGCGGCTTGGAGACCGCTTTCGAGCCCTATGGATCCATCGTCGAAGCCA
AGGTGGTGTATGATCGAGAACAGAGCCGGTCCCGGGGCTTCGGCTTTGTGACCTTCGTTTTCGAGGAGGCGATGGAAAA
CGCCATCCGGAAGATGCACAACCAGGAGCTGGACGGCCGATCCATCACTGTCAGCAAGGCGCAGCCAAAAACTGGCGGC
GGCGGCGGCGGCGGCGGTGGCCGTGGAGGAGAC

> SEQ ID NO:1233 105143 255158_301642_1
GCCTTCTCAGTTCCGGTTCGTTTCTTGGTCTGTTTTTTGTGTTCTGATACTGCAATGGCCGCTGCCGTAGAGTATCGCT
GCTTCGTCGGAGGTCTGTCATGGGGCACAGACGACCGCGCCCTCGAGCGCGCCTTCAGCACCTTTGGGGAGGTCATCGA
TTCGAAGGTTGTTAACGATCGTGAATCGGGGAGATCTCGTGGGTTCGGATTCGTGACATTCACTCAAGAACAGTCTATG
CTTGACGCGATTGAGGGGATGAACGGGAAAGAGCTCGACGGGAGGAACATCACTGTGAATCAAGCACAAGAACGGAACT
CCGGAGGTGGTGGAGGCGGGTTTCGAAGGTCCGAAGGCCGTTACGGCGGGGGCGGGGGATACGGCGGGGGCGGTTA
CAGATCCGGCGGTGGAGGCAGTGGCGGATACGGCGGAGGCAGCGGTGGCTATGGCGGTGGTGGCCAAAGAAGGGACTCC
GGCGGCTACAACGGCGGAGGTGGTGGTGGCTATGGCGGTGGAGGCCGCTACGAGTGAGAACGGATACCAGTCGGGATTC
GAACTACCGGCCTCGCTGCCAGTGGGAAATTAACTCTGTCGGGTCTCGAACTCCCGACCGGTTTCTTTTTCCTGCCTTT
TTCTTTGGAC

FIG. 2 continued

> SEQ ID NO:1234 105143 254954_301640_1
GTTCCGTCGGCAAGAGCTCTTGGCTCCTATAGTGGTCGTTCGGTTTTAGGGTTAAGGGTTTTGGTTTTCGGAAGGCTAA
CAACAATGGCGGAAGGGGAGTACCCGATGCTTCGTGGGAGGTCTGGCCTGGGTTACAGATGATAGGGCTCTCGAAGATGC
CTTCCGGTCCTACGGGAGGGTCACTGATTCCAAGGTCATCAGTGACAGAGAGACCGGGCGCTCCCGCGGATTTGGATTC
GTGACGTTTGAAGACGAACAGTCGATGCTTGATGCGATCGAGGGGATGAATGGGAAGGAGCTTGACGGGCGGAGCATTA
CTGTGAACCAAGCGCAAAGCCGCTCAGGTGGAGGGGGTGGTGGCGGCGGTGGCTATCGCAGGTCTGAGGGTAGATACGG
GGGTGGGGCGGAGGATATGATGGAGAGAGGAAAGGATACGAAGGAGGAGGGGCAGATCTGGTGGCGGTTATGGGGGC
GGCGGTGGTGGGCAGAGGTACAGCTCTGGCTATGGCGAGGGTGACTACAATGCGGGAGGTGGTGGCGGTGGAAGCCGAT
GGAGGAATTGAGTAGTGCTTAAAAAGTTTTCACACATTTGTTCTATCCATCCTTTTAAAGTTCAGTTGGTTACTCTAAT
ATTATATATTGTTATCATTATTATATTTTAGTTTATCCTT

> SEQ ID NO:1235 105143 3045_300344_1
CCCACGCGTCCGCTCTCTTACATTTTGAAACCCTAATTTCTCTTCTTTTCCCCAAAAAAAAATGTCTGAAGTTGAGTAC
CGGTGCTTTGTCGGCGGCCTTGCCTGGGCCACCAATGATGAAGATCTTCAAAGGACGTTCTCACAGTTCGGCGACGTTA
TCGATTCTAAGATCATTAACGACCGCGAGAGTGGAAGATCAAGGGGATTCGGATTCGTCACCTTCAAGGACGAGAAAGC
CATGAGGGATGCGATTGAAGAGATGAACGGTAAAGAGCTCGATGGACGTGTCATCACCGTGAACGAGGCT

> SEQ ID NO:1236 105143 46978_300175_1
CAGCTTCTCCTCTTCTCAGAAATTAGGGTTCCGTCTCAAATTACGAGCAGATCTCGTACTCTCTGAAGATGTCTGAAGA
TCCGGAGTACCGTTGCTTCATTGGTGGGCTTGCTTGGACAACGTCTGATCGTGGTCTCAGAGATGCCTTTGAGAAGTAT
GGTCACCTCGTTGAGGCCAAGGTGGTTCTTGACAAGTTTTCTGGTCGCTCCCGTGGTTTTGGATTCATCACTTTCGATG
AGAAAAAAGCTATGGATGAAGCTATTGCAGCAATGAATGGAATGGATTTGGATGGGCGAACTATCACTGTTGATAAAGC
TC

> SEQ ID NO:1237 105143 286441_200109_1
ttcgttttaGGGTTTCTTCTTATTCTTATTAATCAGAAAAGAATGGCAGAAGTTGAATACAGGTGCTTCGTCGGTGGG
CTAGCATGGCTACCACCGACCAAACACTTGGGGATGCTTTTCTCAGTTCGGCGAAATTCTCGACTCGAAGATCATCA
ATGACAGAGAAACTGGTAGATCTAGAGGATTTGGATTTGTTACCTTCAAGGATGAGAAATCCATGAGGGACGCTATTGA
AGGGATGAACGGTCAAGACCTTGACGGCCGTAACATCACCGTCAACGAAGCTCAGTCTCGCGGTAGCGGCGGAGGCGGT
GGTGGTGGTGGCGGTTACCGTGGTGGTGGCGGTGGAGGCTACGGAGGTGGTGGCCGTCGTGAAGGTGGATACGGTGGTG
GTGGTGGTTACGGAGGTGGCCGACCTGAAGGTGGTTATGGTGGTGGCGGCGGTTATGGAGGTGGTCGTCGTGAAGGTGG
TTACGGTGGTGGTTCTGAAGGAAACTGGAGGAGTTAGATTTCCGTTGCCTTTAGATTTATTTTTTTGTTTGAAATTTAT
GGTTCTACGTTTGGTTGAAGTTCCGTTATGGTTTACTTTGGTTCCTGTTACTGTCCTCGTTTTGACCGCGAGATTGTTA
CCGTGATGTTACTTGTGGATCTGTATTTACAAAGTTCTCTGGAATGAAGTGAATTAAGATTTACAGTCT > SEQ ID NO:1238 105143 104446_300410_1
GCCATTACGGCCGGGGGTTACGGTGGTGGTTCTGAAGGAGACTGGAGGAGTTAGATTTCCGTTGCCTTTAGATTTATTT
TTTTGTTTGAAATTTATGGTTCTACGTTTGGTTGAAGTTCCGTTATGGTTTACTTTGGTTCCTGTTACTGTCCTCGTTT
TGACCGCGAGATTGTTACCGTGATGTTACTTGTGGATCTGTATTTACAAAGTTCTCTGGAATGAAGTGAATTAAGATTT
ACAGTC > SEQ ID NO:1239 105143 109190_300043_1
GGGTTTTTTTTTTTTTTTTTTTTTTTTTTTTTTTTTTGGGAAACGGGAAATTTTAATTCACTTCTTTCCAAAA
AACTTTGGAAATACAGACCCCCAAGAAACATCCCGGGAACAATTTGGGGGGCAAAACGGGGACGGTACCGGGAACCAAA
GTAAACCATAACGGAACTTCAACCAAACGGAAAACCATAAATTTCAAACAAAAAAATAAATTTAAGGGGACGGGAAATT
TAACTCCTCCAGTTTCCTTAAAAACCACCACCGAAACCACCTTTACGAAGACCACCTCCATAACCGCCGCCACCACCAT
AACCTCCGCCGTTACCGGGAAACTGAGCTTTGTTGACGGGATGTTACGGCCGTAAAGGGCTTGACCGTTCATCCCTTC
AATAGCGGCCCTAAGGGATTTCTCATCCTGGAAGGGAACAAATCCAAATCCTTTAAATCTACCAGTT > SEQ ID NO:1240 105143 119921_300361_1
cgagtatagtaaaatggctgctgaaggagaatacagttgtttcgtcggtgggctcgcatgggcaaccaccgacagaacc
tTAGCTGACGCATTCGGTACATACGGCGAAGTTCTCGACTCGAAGGTCCGTTTGCGCAGAGCAGAAATTGAATCCGGGC
CCATTTTTTGGCTTTGTTGATGATCTTCTGTTACTGATTACTGTTTATTACTCTCTGGTTTACTTGATTCATCTGTTAC
TGTTACTGTTATTACTGTTATACCCTTGAAACGGTACGTTCCGTCTTTTTCTCTTTTGTCAAGAGATGAAGATAGAT
CGATTAATTATTTTGCTTGTAAACGTTGTAGATATGTTAGATCTGAGATTTTTTTGTTTTATTTTTATTTTTTTCAGA
TCATTAACGACAGAGAAACTGGCAGATCTAGAGGATTTGGCTTTGTTACCTTTAAGGATGAGAAATGCATGAGGGATGC

FIG. 2 continued

TATCGAAGGGATGAACGGTCAGGAACTTGACGGCCGTAACATTACCGTTAACGAAGCTCAAGCTCGTGGAAGTGGAGGC
GGCGGCGGTGGTGGTTACGGAgGTGgCCGACGtgaAggaggaggCGGTGGTtacggAGgtggtgGTGGTggttAcGgt > SEQ ID NO:1241 105143 121242_300355_1
CCCCCCCTGAAGAAGCTGGTGCTGCCGTCGAACAATTCAATGGATACACATTCCAAGGAAGACCTCTGAGGGTAAACTC
AGGGCCGCCTCCGCCTCGGGATGATTTCGCGCCAAGATCACCTAGGGGTGGTGGGAGCAACTTTGATTCATCCAACAAG
CTCTATGTAGGGAACCTTGCTTGGGGTGTCGACAACTCGACACTCGAGAACCTGTTCAGTGAGCAGGGAACCGTGCTCG
ATGCCAAGGTCATCTACGACAGGGAGAGCGGCAGGTCGAGGGGTTTTGGTTTTGTCACCTATGGCTCCGCTGAAGAAGT
CAACAATGCCATATCAAATCTTGACGGCGTTGACCTGGACGGCAGGCAGATCCGAGTTACAGTTGCAGAATCAAAGCCA
AGGCGCCAATTTTGAGATTTTTTTTTGGTTATGTTGATTTAGAGGTTGATGATGTGCTTCCAAGATGTTAGTTTGTAG
CTTCTACTATTGTACACCAATATGGCGAAAAGGAAAATTGATGCGGTTGATGAGAGACTGAAAGTCTGAA > SEQ ID NO:1242 105143 176028_300524_1
CGGCTTGACAAGCAGTGCCTCGGCCGGCTCTTCCCCTGCCATGTACAATGCTGCTCGTCTGATGTCCACCAAGCTTTTC
GTTGGTGGTCTTTCTTGGAATACTAATGACGATTCGCTGAAAGAGGCATTCACCAGCTTCGGGGATGTGACTGAAGCTC
GGGTGATCAATGACAGAGAATCTGGAAGGTCAAGAGGGTTTGGCTTTGTTAGCTTTGCCAATGGCGATGATGCCAAGAG
TGCCATGGATGCCATGGACGGTAAGGAACTTGAGGGACGGAGTATCCGCGTGAACTTCGCGAATGAGAGACCTCCAGGG
AACCGAGGTGGCGGCGGGTATGGTGGTGGTGGCGGTGGTTATGGCAACCAAGGAGGCTATGGTGATGGCAACCGAGGCT
ATGGAGGGCAGTACTAAAGTGGGCACTGACTTGCTTAAATAATGAGCTTAGGACCTGATGTGGCTTATGTGAAGCC > SEQ ID NO:1243 105143 201132_300713_1
cccggtggtctCTCAGAGGTGGGTTGGCTTCTCCTCCCCCTCCCGGTTCGGTTCGGTTCGGTTCGGGTCCGGTTCGATT
TCGGTTTTTCCTTCGGTTCGGGGGTTGGTGGGAAAGCATGGCGGCGCCGGATGTTGAGTACCGCTGCTTCGTCGGCGGC
CTCGCCTGGGCCACCGACGACCGCTCCCTCGAAGCCGCCTTCTCCACCTACGGCGAGATCCTCGAGTCCAAGATCATCA
ACGATCGGGAGACGGGGAGGTCGCGCGGGTTCGGTTCGTGACGTTCTCGAGCGAGCAGGCCATGCGCGACGCCATCGA
GGGGATGAACGGCAAGGAGCTCGACGGCCGCAACATCACCGTCAACGAGGCCCAGTCGCGCCGCTCCGGAGGCGGAGGC
GGCGGTGGCTACGGCCAGCGCGGCGGAGGCGGAGGCTACGGTGGCGGCGGCTACGGTGGTGGTGGCGGCGGCGGTGGCT
ACGGCCAGCGCCGTGAAGGCGGCTACGGCGGTGGCGGTGGCTACGGTGGCGGCCGTGGTGGCGGCGGCTACGGCGGCGG
CTACGGCGGCGGCTACGGAAGCCGCGGCGGCGGCaACTCCGACGGGAACTGGAGGAACTGAGCGGTGGGCCCTCATGG
CcaaGTTATCTATCTATCTAATCGAGCTACCATCATCATCATCCGATCGTTATCATCGttagtttt > SEQ ID NO:1244 105143 120785_300516_1
cCCCCCCGGTGCTCTCTTTGAGGTGGGTTGGCTTCTCCTCCCCCTCTTTACCTTTTCCTCCTCCTCGGTTCGGTTCCGT
GGTTCGTCTAGGGTTTAGTGGGTTGAGATGGCGGCGCCGGATGTCGAGTACCGCTGCTTCGTCGGCGGCCTCGCCTGGG
CCACCGACGACCGCTCCCTCGAGGCCGCCTTCTCCACCTACGGCGAGATCCTCGACTCCAAGATCATCAACGACAGGGA
GACGGGGAGGTCACGTGGGTTTGGCTTCGTCACCTTCTCCTCCGAGCAGTCGATGCGCGACGCCATCGAGGGCATGAAC
GGCAAGGAGCTCGACGGCCGCAACATCACCGTCAACGAGGCCCAGTCCCGCCGCTCCGGCGGCGGCGGCGGAGGCGGGG
GCTACGGCGGCGGCGGTGGCGGCTACGGCGGCGGTCGTGGAGGCGGCGGCTACGGAGGAGGTGGCGGCGGCGGCTACGG
GCGCCGTGAGGGCGGCTAcGGTGGCGGCGGCGGCTACGGCGGCGGCCGTGGCGGCGGCGGCGGctAcg > SEQ ID NO:1245 105154 113096_300021_1
TTACTAATCCAATAGAAATGGCTATATTCTCAATTTCCGAGTTTTCACTTCTAGTCCTCTTTTCTATCTTCCTCCTGGC
CTGCACCACATTCGCTCGCGATCATTCGATCGTGGGATATTCTTCAGATGACTTGACTTGCATTGATAAGCTCATTAAT
CTTTTTGAGCATTGGATGGATAAACATGGCAAGATTTATAAGAGCATTGAAGAGAAATTGCATAGGTTTGAGATTTTTA
AGGATAATTTGAAGCATATTGATGAGACGAATAAGATAGTTAGTAACTATTGGCTTGGTCTAAATGAGCTTGCTGATTT
GAGCCATGATGAATTCAAGAAAATATATTTAGGACTCAAAGTTGATAATGAATTGCTTATCAAAAAAGAAAAATCCCAA
CAAGAATTTGCATACAGAGATTTTGTGGATTTGCCGAAGTCTGTTGATTGGAGAAAGAAAGGTGCTGTCACTCCTGTCA
AGAACCAGGGTCAATGTGGTAGTTGTTGGGCATTCTCAACGGTAGCTGCAGTAGAGGGAATTAATCAAATAAAGACAGG
GAATTTGACATCGTTGTCGGAACAAGAGCTCATAGACTGTGACACAACATACAACAATG > SEQ ID NO:1246 105154 268638_200121_1
CCACAAAGCAGGAAAAACACCCAATCATGGCAAATCATAGCTCCACTCTCACCATATCCCTACTTCTCCTCCTCTTCTT
CTTCTCCACCTTATCTTCCGCTTCCGACATGTCCATCTTAACCTACGACGAAAACCAACACTTTCGAACAGACGCTGAA
GTCATCTCCTTGTACGAGTCATGGCTAGTCGAACATGGAAAATCCTACAACGCCTTAGACGAAAAAGACAAGCGGTTTC
AGATCTTTAAAGATAACCTAAGATACATAGATGAACAAAACTCTGTTCCAAACAAGAGTTACAAGCTTGGTTTAACAAA
ATTTGCTGATCTGACTAACGACGAGTACAGGTCCATGTACTTAGGTACTAAGACCACTGATCGTCGCAGGTTGTTGAAA
AACAAAAGCGATCGGTATCTTCCTAAAGTTGGGGATAGCTTGCCTGACTCAGTTGACTGGAGAGAGAAAGGTGTTCTTG
TTGGAGTTAAGGATCAAGGAAGCTGTGGGAGTTGTTGGGCATTCTCTGCAATTGCTTCCGTTGAAGCAGTGAACTCGAT
AGTCACTGGAGATGTGATTTCACTATCGGAGCAAGAGCTGGTTGATTGTGATACTTC

FIG. 2 continued

> SEQ ID NO:1247 105154 51745_300395_1
CCCACGCGTCCGCAAAAGAAAAACAAACGTACTCAAATGGCTCTTTCTTCACCTTCAAGAATCCTCTGTTTTGCTCTTG
CCTTATCCGCTGCTTCTCTCTCCCTCTCTTTCGCTTCTTCCCACGATTACTCCATCGTTGGATACTCCCCGAGGATTT
GGAATCTCATGACAAACTCATAGAACTCTTCGAAAACTGGATCTCAAATTTTGAGAAAGCTTATGAAACCGTTGAAGAG
AAGTTTCTTAGGTTCGAAGTTTTCAAGGATAATCTAAAGCACATCGATGAGACTAACAAGAAAGGGAAAAGCTACTGGC
TCGGGCTCAACGAGTTTGCGGATTTGAGCCATGAGGAGTTCAAGAAAATGTATTTAGGGCTCAAGACTGATATAGTGAG
ACGCGATGAAGAAAGATCTTACGCAGAGTTCGCTTACAGGGACGTCGAAGCTGTTCCTAAGTCTGTTGACTGGAGAAAG
AAAGGAGCTGTGGCGGAAGTTAAGAACCAGGGCTCTTGTGGAAGTTGTTGGGCGTTTTCGACAGTAGCAGCTGTCGAAG
GTATAAACAAGATTGTGACAGGAAACTTGACAACATTGTCAGAACAAGAACTCATAGACTGTGACACGACCTACAACAA
TGGCTGCAACGGTGGTCTCATGGACTATGCCTTTGAGTACATTGNTAAGAACGGAGGTCTACGCAAGGAAGAAGATTAT
CCTTACTCTATGGAAGAAGGAACTTGCGAGATGCAAAAGGATGAATCTGAAAC

> SEQ ID NO:1248 105187 245433_301568_1
gGCATCGCGCGGAGGTCTGGATCGGCAGCGCTAATGGCGGCGGGGAGAGCGCGGGCGGACTATGACTACCTCATCAAAT
TGCTGCTCATCGGCGACAGCGGTGTGGGGAAGAGCTGCCTTTTGCTGCGGTTCTCGGACGATTCCTTCACGACGAGCTT
CATCACGACGATAGGCATTGACTTCAAAATCAGGACCGTTGACCTGGAtggcaAGAGGATCAAGCTTCAAATTTGGGAC
ACTGCTGGGCAAGAACGCTTCCGGACGATCACAACTGCATACTACCGAGGAGCTATGGGCATTCTTCTCGTCTACGATG
TGACGGATGAATCATCGTTCAACAGTATCCTCTTTCCAACGAGTTTTGTTTAGTTGTTTCACTCCTTTCGTTGTTGTGT
GTGCAATATCCTTGATCGAGCTCCACTAAAGACATCCGGAACTGGATCAGGAATATCGAGCAGCACGCGTCGGACAATG
TGAACAAGATCCTGGTCGGCAACAAGGCCGACATGGACGAAAGcaaGAGGGCCGTATCAACAGAAAGAGGGCAAGCTCT
TGCGAACGAgtttggtATCAAgTtCTTCGAAACCAGCGCGAAGACgaacATGAACGTGGAgaaCGTCTTCTTCACAATC
GCGGGAGACATCAAGCGGAGACTAGCGGAAACAGACTCCa > SEQ ID NO:1249 105187 273944_200055_1
TCTCTCTCTTCTCTCTCTCTTCCAACCCCGTCCCCATGAAGAGACATGCTTTCTCTCTCTTCTCTCTCTATTCCTCGAA
GCTAAGAATAGCATCGTTTTACCTACTTTTCTTGGTCATTCTGAAAGTTAAAAGTCTAAATTGACACAATAAACCCTTT
AATACAATTATTATACAAACAAGTCATAAACACCCGACACTTAATTACCCGATTGATTTTTCTAGGATATGGGTTGCGC
ATCTTCAGTTGCAGATAGGAATTCAGGACGGGCTGCTGGCCTTAATCCGGATAATGGTGGAGCACTTGACCCTAAAAAT
CTTAAAGTGAAGCTGGTACTCTTGGGTGATTCTGGTGTTGGTAAAAGCTGTATTGTTTTGCGCTTTGACCGTGGCTAAT
TTGATCCAACATCTAAGGTGACTGTAGGAGCTTCTTTTTTGTCTCAAACAATAGCGTTGCAGGACTCAACTACAGTTAA
ATTTGAAATATGGGATACAGCGGGTCAGGAGAGGTACGCAGCTCTTGCACCCCTGTACTACCGAGGTGCTGAAGTTGCA
TTTGTTGTGTATGATATTACTAATCCCGAGTCTTTTGCCAAAGCGCAATACTGGGTCAAGGAATTACAAAAACATGGAA
GCCCTGATATT > SEQ ID NO:1250 105187 258548_301697_1
AATACAACATGGCCACCCCAAGAACGTCTTGTCAAGAGCGATTTGCACAGTTCAAACTCGTGTTATTAGGTGAGTGAGA
GAGGGTCTATGCTACTCTCTTCTGGCTTCTTTCAGCGACTCCACCACAAGAAGAAAATGGGAATGGAGCAAAGCATCTT
TGGTGTGATCTTTGGGTACAAGAAAGGGTGCAAGCTAGGTCAGATTCGTATCAGAACCGCTTTGCCTGTCACTTGCTTG
ATGTTACTAACACAGGTGAATCGTTTGTGGGTAAATCCTCGCTGGTGACCCGGTTCGTCAAGGACGAGTTTCTCGAGCA
GAGAGAATCAACTATCGGAGCAGCCTTCCTGACCCAGACTGTCTCTCTGGAAGACAACAAGACAGTCCGGTTCGAGATT
TGGGATACTGCCGGACAGGAGCGATACAAGTCGCTGGCCCCCATGTACTACCGGAACGCCAATTGTGCTGTGGTGGTCT
ATGACATTACACAGGCCTCGTCATTGGAGCGATCTAAGGCATGGGTCAAGGAGCTCCAGCACCGAGCTGCTGACGGAAT
CATTATTGGCCTTGCCGGAAA > SEQ ID NO:1251 105187 8095_300316_1
AGCTCTGGAAACAAGAACATCAACGCCAAATTGGTATTACTAGGAGATGTTGGAGCTGGAAAATCAAGTCTTGTGCTAC
GGTTTGTGAAAGATCAGTTTGTTGAATTTCAGGAATCAACCATTGGTGCAGCTTTTTTCTCTCAAACATTGGCTGTGAA
TGATGCGACTGTGAAGTTTGAGATATGGGATACAGCTGGTCAGGAACGATACCACAGTTTGGCTCCAATGTACTACAGG
GGTGCAGCTGCTGCTATTATTGTCTTTGACATTACTAATCAAGCCTCATTTGAGAGGGCGAAGAAATGGGTTCAGGAAC
T > SEQ ID NO:1252 105187 103459_300026_1
TGGTTCAACGCAGAGTGGCCATTACGGCCGGGGGGATTAGAGTAATTTGTAGTAAAATACCTCAAAATATAGTAACTT
TTTTAAAAAGAATTTTGAGTCCAAGTTTACATCATTTGGGTTTGACTCGTTTCTCAAAGAAGATACCTTGCTTAAATA
CGTCTCCTCCAGAAATCTCTAAACAAAATCTGGACGTCACCCTTTAAATTACTTTAGTGTTATCCATTTGCCCTTTATA
TTTCTTCTGTATAGTTTCTCCGGCGAGATAACTCAGTTCCGGCGATAATCATCTTCATCGGAAAATGTCTTACGACTAT
CTCTTCAAGTACATAATCATCGGGGATACAGGAGTGGGGAAATCGTGTTTGCTGCTGCAATTCACTGACAAGAGGTTTC
AACCGGTGCATGATCTCACTATTGGAGTCGAGTTCGGGGCTCGTATGGTCACCATTGATAGCCGGCCAATTAAACTCCA
AATTTGGGACACTGCTGGACAGGAATC

FIG. 2 continued

> SEQ ID NO:1253 105187 12175_300279_1
CCCACGCGTCCGCGTAGATCTCGAGAGAGAGCCTTAAGGAAATTAAAAAAGGTTGGATTTTGATCGATGGGTTCTTCGT
CAGGACAACCCGAATTTGATTACTTGTTTAAGGTTTTATTGATCGGAGATTCTGGTGTTGGAAAGAGCTCTCTTTTGTT
GAGTTTCACATCTAATACCTTTGATGATCTTTCTCCAACGATTGGTGTGGATTTTAAGGTTAAGTATCTGACAATTGGA
GAAAAGAAACTCAAGCTTGCGATTTGGGATACAGCTGGGCAAGAGAGATTTAGGACGCTAACAAGTTCGTATTACAG

> SEQ ID NO:1254 105187 1119671_301899_1
GCCTTGTTGTTGACGAGAAGAACAAGAACAAGGAGAATGAGGTGGAGAGTAAGGATCGATGGCCGCCTCTGGAGCATCT
CGAGCTCGTGACCATGACTACCTCGTCAAGCTGCTCCTCATCGTGGATATGGGCGTCGGCAAAAGTTGCTGGCTTCTCC
GATTTTCTGATGACACGTTCACTACAAGTTGCATCACGACCATAGCAATTGATTTTACGATCAGAACTATAGAGATGGA
TGGAAAATGACTAGAGCTCCAAATATGGGACACTGCCGGACA

> SEQ ID NO:1255 105187 202370_300732_1
CCCCCCGCGGCGTGGGGAAGTCGAACCTGCTGTCGCGGTTCGCGCGGGACGAGTTCAGCCTGGAGACCAGGTCCACCAT
CGGCGTCGAGTTCGCCACCAAGACCGTCCGCGTCGACGACAGGCTCGTCAAGGCCCAGATCTGGGACACCGCCGGCCAA
GAGAGGTACCGCGCCATCACGAGCGCCTACTACCGCGGCGCGGTGGGCTGCTGCTGGTGGTGTACGACGTGACGCGCCG
CATCACGTTCGAGAACGCGGAGCGGTGGCTCAAGGAGCTCCGCGACCACACGGACGCCAACATCGTCGTCATGCTCGTG
GGCAACAAGGCCGACCTGCGCCACCTCCGCGCCGTCCCCGCGGAGGACGCCAGGGCGTTCGCCGAGGCGCACGGGACCT
TCTCCATGGAGACGTCGGCGCTGGAGGCCACCAACGTGGAGGGCGCCTTCACCGAGGTGCTCGCGCAGATCTACCGCGT
CGTCAGCCGGAACGCGCTCGACATCGGCGACGACCCCGCCGCGCCGCCCCGGGGGCGGACCATCGACGTCAGCGCCAAG
GATGACGCCGTCACCCCCGTGAACAGCTCAGGGTGCTGCTCGTCTTGACTTTGACTCGCTCAAACTCATCGTCGTCGAG
CTATGCAAATTGCCACCGTTCACAGCTTTG

> SEQ ID NO:1256 105187 201174_300713_1
GTCTTCCTCTCTCTCCCCCGTCTTCGCCTCGCGCTCGCGTCTCCCTCCCTCCCTCCTTCCGTCCAGATCCGCGTGGGCT
CGAAGAAGCGGCGGGCGATCCACGGCGAGCGTCCCGCGGTCACTCCCCCCGTCTCCGTCCGGCATGAATCCCGAGTAC
GACTACCTTTTCAAACTTCTCCTCATTGGTGATTCTGGTGTTGGGAAATCGTGCTTGCTTCTCAGATTTGCGGATGATT
CATACCTGGACAGCTACATCAGCACAATTGGAGTTGATTTAAAATACGGACAGTAGAGCAGGATGGGAAGACCATCAA
GCTTCAAATCTGGGATACTGCTGGACAAGAACGTTTCAGGACAATTACAAGCAGCTATTACCGGGGAGCTCATGGAATT
ATTATTGTATATGATGTGACAGACCAAGAAAGCTTCAACAATGTGAAGCAGTGGTTGAATGAAATTGATCGTTATGCAA
GTGACAATGTTAACAAGCTCCTCGTTGGGAACAAGAGCGACCTAACTGCCAACAAAGTTGTGTCATCTGAAACAGCT

> SEQ ID NO:1257 105187 187377_300676_1
GGAGGGCAAAACAATAAAGGCTCAGATCTGGGACACAGCAGGACAGGAGAGATATCGTGCCATCACAAGTGCTTACTAC
CGTGGCGCTGTTGGGGCTCTCCTTGTTTACGACATCACAAAGAGGCAGAGCTTCGACAATGTCCACAGGTGGCTTCGTG
AGCTCCGCGACCATGCCGACTCGAGCATTGTTATCATGATGGTCGGTAATAAGTCTGATTTGATTCATCTAAGGGCTGT
CTCCGAGGATGAAGGTAAGGCATTGGCTGAAAAGGAGGGGCTGTTTTTTCTTGAGACATCAGCTATGGAGGCCGTGAAT
GTGGAGGAAGCCTTTCAGACTATCATCACAGAGGTCTATGGCATTGTTAACAGGAAAGCACTGGCCGCCAAAGAAGCAG
CTGCTGCTTCTGCTCGCCTTCCCAGGGTAAAACTATCAGCATTGACAGCGCTGCAGGAAACACAAAGAGGGCATG
CTGCTCTGCTTGATATGTACAATGGAGCGTTCAACATCATATTGTAGAGAGCCAGGTGTGAGATTCGCGGGTAGACTG
GAGCATAGTGATCTTAAATGGTTTGGAGGCAAGTCCTACTTTTTTTTTTCAGTTGCGTGAACATTCCAGAGTGCCTAG
CTGCAGTTGCAGTTTGTTCAGTGTTTCCTAATCAAAAGTTAGATGTGTGTA

> SEQ ID NO:1258 105187 156705_301369_1
cacgcgtccgaaaagcaaattctcctctcaatttcctcgccatctttacgtgtcttcatcacacgtgctctctcattc
cATATCCTTTTGCTTCTTAATTCACCCGCGAAGATTCCGATTCAGATCCCGGTCAATTTTCGCCGGTAAATCCCTCAGA
CACCGGCGAATTTCATCTTCCCTCGATCGCAATGAATCCCGAGTATGACTacctctTTAAGCTTTTgctCAttggtgat
tctgtgcgtgggAAATCATGTCTTCTTCTGAGGTTTACAGACGACACATAcCtggaAAGTtacataagcacTAttggag
ttgATTTTAAAATCCGGACAgTagaGCAAgatGGGAAGACTAtaaAACttcagattTGggATACAGCTGGACAAGAACG
CTTtaggaCcATCACTaGTAGCTACTATcGtggAGCCcatggcATAATAGTTGTGTATGATGTGACAGATCAAGAGAGC
TTCAATAATGTAAAACAGTGGCTGAGTGAAATTGATCGTTATGCTAGTGACAATGTTAACAAAATTCTTGTCGGGAACA
AGTCCGATCTTACTGCAAATAGAGTCGTCTCATATGAAACAGCTAAGGCATTTGCTGATGAAATTGGTATTCCATTCTT
GGAGACCAGTGCTAAAGATGCTACGAATGTAGAACAGGCTTTTATGGCTATGACTTCTGCTATCAAAAATAGGATGGCA
AGCCAACCAACCAATAATTCCGCTAAGCCTCCAACGGTGAATATCCGTGGACAGCCGGTGACACAGAGTGGTGGCTGtt
gCTCATCTTAGAGTACAAAAAATTGTTTGCTACTGTAATATTTGCTTTgCTGTCTCCTCCTTGTCATGTCTATTgTGGT
CTGATTAAACATTGGTAAAGTTTgCtTAGTTGCAATATTTTTTTTTT

FIG. 2 continued

> SEQ ID NO:1259 105187 138754_300727_1
AAAGATCCCTCCAAAAAAAAACGCCTTTTTTTTTCTTGAGCACACAAGAGACGCCAATCCCAAAGCAAAGAGAAGCGCA
AAGATCATCTCTTTGCTTCTCGCCTTCTCCTCCTCCTCCTCTTCTCCCTCCTCGTGCTCCGCCCGATCCGTCCGCCGCC
TCCAGATCCGCGCCCATGGCGTCGCGCAGGCGAATGCTCCTCAAGGTCATCATCCTCGGTGACAGCGGGGTCGGGAAGA
CGTCTCTGATGAACCAGTACGTGAACAAGAAGTTCAGCAATCAGTACAAAGCGACGATCGGCGCGGATTTCCTGACCAA
GGAGGTGCAGATCGACGACCGGCTCTTCACATTGCAGATTTGGGACACAGCGGGACAGGAGCGATTTCAGAGTCTTGGT
GTGGCATTTTACCGGGGAGCTGACTGCTGTGTTCTTGTATATGATGTCAATGTTACCAAGTCATTTGAAAGGCTCAACA
GCTGGCGTGAGGAATTCCTAATTCAAGCTAGCCCATCAGATCCAGAGAATTTCCCTTTTGTTGTACTTGGAAACAAAAT
TGATGTTGATGGTGGTAATAGCCGGACTGTTTCTGAGAAGAAAGCTAAAGCTTGGTGTGCTTCTAAGGGAAACATCCCT
TATTTTGAGACATCTGCTAAAGA

> SEQ ID NO:1260 105187 131361_300513_1
GAATTCAGATTCTGGTGTTGGGAAATCATGCCTGCGTGCTGAGATTTGCTGACGATTCATATCTTGAAAGTTACATCAG
CACTATTGGCGTTGACTTTAAAATACGCACTGTGGAGCAGGACGGGAAGACTATTAAACTTCAGATTTGGGACACTGCC
GGGCAAGAGCGTTTCAGGACAATCACTAGCAGCTACTACCGCGGAGCACATGGGATTATTATTGTTTATGATGTCACAG
ACCAAGAAAGCTTTAACAACGTGAAGCAGTGGTTGAGCGAGATTGATCGGTTATGCGAGTGATAATGTTAACAAGCTTCT
GGTTGGGAACAAGAGTGATCTCACCGCAAATAAAGTCGTGTCAACTGAAACTGCTAAGGCATTTGCTGATGAGATAGGG
ATCCCATTCCTTGAAACCAGTGCAAAAATGCGACTAATGTTGAGCAAGCCTTTATGGCCATGGCTGCTGAAATAAAAA
ACAGGATGGCAAGCCAACCTGCTATGAACAGCGCTAAGCCTCCAACCGTTCAGATCCGAGGACAACCCGTTACTCAGAA
TAGTGGTTGCTGCTCCTCTTCTTAAGGATAAGACTTTAGCTCGGACTTTTTATCTCTCTGACAATCTTTGTCCCTCCAT
CCTTGTAAAACTAGTCTCTCTCTGGCACACTTATTCATCAGCCATCT

> SEQ ID NO:1261 105187 1111080_301537_1
tcttttttttagcgcgggtttggacggGATCTCTCTCCTCTTTCGGCAGAAGAAGAAGAAGAAGAGGAGGAGCCATCTCG
CTTCCGGGGATCCAAGATCAACCTTTCTTCTTCCAAAATGAATCCTGAATATGATTATCTTTTCAAGCTTCTATTGATC
GGGGATTCTGGTGTTGGCAAGTCTTCGCTTCTTCTGCGATTTGCTGATGACACCTATGTAGAGAGCTACATAAGCACTA
TTGGGGTTGACTTTAAAATTCGAACTGTGGAACTTGATGGGAAGACAATCAAGCTTCAAATTTGGGATACTGCTGGACA
AGAGAGGTTCAGAACAATCACAAGTAGCTATTACCGCGGAGCACATGGGATCATTATTGTCTATGATGTGACTGATGAG
GAGAGCTTCAACAATGTGAAACAATGGTTGAATGAAATTGAGAGATATGCAGGCGACAATGTGAATAAACTTCTTGTGG
GTAATAAATGTGAcCTCACAGAAAAGAAggTGGTTGAATAccAGACtGTGAAGTCATTTGCTGATGcaaTgGGAATCCC
TTTccTGgAGAcaaGtgccAAGaGtgcaaCTaatgtGGAGCAGGCTTTtAtGacaaTGActgccgAAATaagaacAgg
AtggtatctCagccAGccAtg > SEQ ID NO:1262 105271 119330_300025_1
cccacgcgtccgcccacgcgtccgtctgaattatatttatgctgtttagtatttttgagttttgtttgaataaatatgg
aTGGAAACAAGGATGAAGCTAAAAAATGCTTGAAAATAGCGGAAGATTCGATCCAATCTGGGAATCAAGAACGTGCCTT
GAAATTCTTGAATAAAGCCCGTCGTTTAGACCCTTCACTTGAAATTGATCATCTTTTATCCCAAACTGAATCATCCCAA
TCTGAAAACCCTAGTTCTAAGGTACCAACACCTGATTTTTCATCTGAAAATGGGCCCGCCATAGGGTTTCGGGTAGTG
GTGGGTCATCGGTGGCGTATAGTGAGGAGCAAGTGACAGTTGTGAAAGAAATTAAGAGGCAAAAAGGATTACTATGAGAT
TCTCGGGTTGGAGAAAAGTAGTTGTAGTGTTGAGGATGTACGCAAGGCGTATAGGAAGTTGTCGTTGAAAGTCCATCCT
GATAAGAATAAAGCACCGGGAGCTGAGGATGCTTTTAAGATGGTGTCTAAggCGTTTCAATGTTTGAGCGACGAGGAGA
GTCGAAGTAGGTATGATCTTGTTGGATCTGAGGAATCTGtttACGAAAGACGCGCTCATAGGCATGCAGGTGGTGCTAG
AATGAATACATTTAATGGGTTCTATGATGACGGTAATGTTGACGCGGAAGAGATTTTCAGGAATTTCTTCTTTGGTGGA
ATGCGTCCGGCAACGACTACTACACATTTTAGCTTTGGCCCTAGAGTGGATGTGAGATATCAAGGACCGACTGGGTGGC
TGAGGACTTTGATTCAGTTGTTGCCTGTGATATTGATTTTGTTGTTGAACTTTCTGCCATCTTCGGACCCGGTCTATTC
CTTTTCGAAGTCTTTTCCATATGATCATAGGTTAACCACGCAAAGAGGTGTGAATTACTATGTGAAGACTGGGAAATTT
GAGCAGGAGTATCCTATTAATAGCCCAAAGCATGTGGCGCTTGAAGAAAAGGTTGATAATGATTATCACTCGATCCTTT
CTCACAATTGCAGACTTGAATTGCAGCAGCTTCATTGGGGTTATCGAAGAGAAACTCCAAATTGTGACTCTCTGAAGCA
GTTCCAAGCAGCAGCCTGATTGATTggTTCAAGGTCCAGTTTTCTCCTTGTAATACCTTAAATTTTTggCTTTCTggtt
gTAACTACTTATATTCATTTTgttCT > SEQ ID NO:1263 105271 25147_300074_1
CCCACGCGTCCGAAGATTTGAGGAAATCTTATCGGAAACTCTCGGTGAAAGTTCATCCTGATAAGAACAAAGCTCCTGG
TTCTGAAGAAGCTTTTAAATCCGTCTCTAAAGCTTTTCAATGCCTAAGCAACGAAGACACTAGAAGAAAGTACGACGGC
AGTGGTTCCGATGAGCCTGCTTATCAACCACGCCGAGATGCGAGAAGAAACAACGGATTCAATGGATTCTACGACGATG
AATTTGATGCTGATGAGATTTTCAGAAGCTTCTTTGGTGGTGGTGAAATGAATCCTGCTACTACTCAGTTCCGATCATT
CAATTTTGGTGGAGGAACTAGAACAGCTAATCAAGCTTCTGATACAGGATTCAATCCTCGTGTACTTCTTCAAATACTT
CCTGTTGTGTTCATACTACTACTCAACTTTTTGCCTTCTCCTCAACCAATTTACTCGCTTTCTCATCGTATAACTACGA GCTCAAATTCACCACGCATAGGGGCGTCACTTACTTTGTGAGATCAGCCAAGTTCGAGCAGGAATATCCGATAAGTAGC
TTCGAGAGACAGAGGGTTGAAGAGCAAGTTGATAGAGATTACTTGTCTATACTTGGCCAGAATTGTCGCCATGAGCTTC
AGAGACAACAATGGGGATATATCCGCGAAACGCCACGTTGCGACATGATGAAGAGGTTTGATGCAGCTGCTGCATAAAC
CATCCAGGTCAGAGAGAGACTGAAGCACCAAGTTAGTAAACTCAAAT > SEQ ID NO:1264 105272 249588_301593_1
AAGTTTGAGGAAGCTGGCATCTGGTACGAGCATCGCCTCATTGATGACATGGTTGCGTATGCTCTCAAGAGCGACGGCG
GATATGTCTGGGCATGCAAAAACTACGATGGAGATGTCCAGAGTGATTTCCTGGCCCAAGGATTTGGTTCCCTTGGACT
GATGACTTCTGTACTGGTCTGTCCGGATGGAAAGACTATTGAGGCAGAAGCTGCTCATGGAACCGTCACCCGGCACTAC
AGAGTACACCAGAAAGGCGGCGAAACCAGCACGAACTCCATCGCCTCCATCTTCGCTTGGTCTCGAGGACTTGCTCACA
GGGCCGACTTGGATGGCAATGCGAGACTGAGCGACTACGCAGAGAAGCTCGAGGCGGCTTGCGTTGGATGTGTGGAGTC
TGGAAAGATGACGAAGGACCTCGCATTGCTCATCCACGGAACAAAGGTGTCAAAGAAAGATTATCTCAACACTGAGGAG
TTTATCGATGCGGTCGCTGCCGATCTCAAGCACAGGCTCACCTCCTCTTCCAAACTGTAAAGCCGGATCCCGattcctC
AGgAtGcGTGAAgaacAccg > SEQ ID NO:1265 105272 283014_200091_1
ataccgggctactgatacagttattcaaggacctggaaaactcaagttggtgtttgtgccagaggggacagacgagaag
aCTGAATTCGAAGTTTACAACTTTACTGGTGCTGGTGGAGTAGCTTTATCCATGTACAACACAGATGAGTCAGTTCGCT
CATTTGCTGAGGCTTCAATGAACATGGCATACCAAAAGAAATGGCCACTCTATCTTAGTACAAAGAATACCATTCTTAA
GAAATATGATGGGAGGTTCAAGGATATTTTCCAAGAAGTTTATGAAGCAAATTGGAAATCCAAGTATGAGGAAGCAGGA
ATTTGGTACGAACACCGTCTTATCGACGATATGGTTGCTTATGCTTTAAAGAGTGAAGGTGGTTATGTATGGGCCTGCA
AGAACTATGATGGGGATGTACAGAGTGATTTCTTAGCACAAGGTTTTGGATCCCTTGGGTTGATGACATCTGTCCTGGT
GTGTCCTGATGGAAAGACCATTGAGGCTGAAGCAGCCCATGGAACTGTCACCCGCCACTACAGGGTTCACCAGAAAGGA
GGTGAAACCAGCACAAACAGTATTGCGTCAATCTTTGCCTGGACTCGTGGACTTGCACACAGGGCAACGTTAGACAAGA
ATGAAAGGCTGTTGGATTTTACTGAGAAACTAGAGGCAGCATGCATTGGTGCAGTGGAATCTGGAAAGATGACCAAAGA
TCTTGCACTCATCATCCATGGATCCAAGCTCTCAAGAGAACATTATCTCAACACTGAAGAGTTCATCGACACTGTGGCG
GATGAGCTCAAAGCAAGACTTCTGAAAGCCAAGGCCTAAATGTCTGGGATGACGAGAGGACAGTCTTTTTTCTGGGGCA
GTTGAGGGATATTGAAGAGAAATAAAAGGATTAGGGCCTGATGGTATACTACATCTCAAGAGGTTTTATTTTATAGGAG
GCAGTGATGTTTGAACCATTTAAATCTGAATTTCTATTTGCTGAAACTGCTGCAAGTTATTTTACTGATTTGCAATTGT
ACACTTGGCTTATTGTTTGATCAGTTTGCTAAAAGAAGACCCTCTTCACT > SEQ ID NO:1266 105272 213121_300847_1
AGGAGTTTAACCTCAAGCAGATGTGGCTCGCTCCCAACGGCACCATCCGAAACGCTCTCGGCGGCACCGTCTTCCGCGA
GCCCATCGTCATCCCCCGCGTCCCCCGTCTCGTCCCCGGCTGGAAGCAGCCCATCATCATCGGCCGTCACGCCTTTGGC
GACCAGTACCGCGCCAAGGACCGAGTCATCCCCGGCCCGGGCAAGCTGAGCATGGTCTTCACCCCCGAGGGCGGCAAGC
CCGAGGAGATTGAGGTCTTCCAGTTCAAGGAGGGCGGCGGCGTCTCCCAGACCCAGTACAACACTGACGAGTCCATCAC
CGGCTTCGCCCACGCCTCGTTCAAGCTGGCCTTGGACAAGAAGCTGCCCCTGTACATGAGCACCAAGAACACCATCCTC
AAGAAGTACGACGGCCGCTTCAAGGACATCTTCCAGGAGATTTACGACACCAAGTACAAGTCTGAGTTCGAGGCCAAGG
GAATCTGGTACGAGCACCGTCTGATTGACGACATGGTCGCCCAGATGATCAAGAGCTCTGGCGGCTACATCATGGCTCT
CAAGAACTACGACGGTGATGTCCAGTCCGACATTGTCGCCCAGGGCTTCGGCTCCCTCGGCCTTATGACCTCCGTCCTC
ATCACCCCCG > SEQ ID NO:1267 105272 11976_300283_1
TGGTATCAACGCAGAGTGGTCATTCGGCCGGGGTGGTTATGTATGGGCATGCAAAAACTATGACGGGGATGTACAGAGT
GATTTCTTATCACAAGGATTTGGATCCCTTGGATTGATGACATCGATTCTGATATGTCCAGATGGAAAGACCATAGAGT
CAGAAGCAGCACATGGAACTGTGACACGGCACTACAGGGTTCATCAGAAAGGTGGTGAAACCAGCACGAACAGCATCGA
CTCAATTTTTGCTTGGACTCGTGGACTTGCACATAGAGCAAAGTTGGACAACAATGCTGCACTCTTGGATTTTACCAAG
AAATTAGAGGGAGCTTGCATCGGCGCGGTGGAGAATGGGAAAATGACCAAAGACCTGGCACTTATCGCCCACGGATCCA
GGGTCGCTAGACATCAATATGTGAACACCGAAGAGTTCATCGACGCTGTGGCTGATGAGCTG > SEQ ID NO:1268 105272 171255_300535_1
cccacgcgtccgtgatgaggcaatccgagcttttgctgaagcttctatgacaactgcttatgagaagaaatggccgctt
tATCTTAGCACCAAAAACACAATCCTGAAGAAATATGATGGAAGGTTCAAGGATATTTTCCAGGAGGTCTATGAAGCTG
GGTGGAAATCCAAGTTTGAGGCTGCCGGAATATGGTATGAGCATCGTCTCATCGATGACATGGTTGCTTATGCACTTAA
GAGTGAAGGGGGCTATGTGTGGCTTGCAAGAATTACGATGGAGATGTGCAGAGTGATTTCTTAGCTCAAGGCTTTGGT
TCATTGGGTTTGATGACATCAGTATTGGTGTGCCCTGATGGAAAAACAATTGAAGCTGAAGCTGCCCATGGCACGGTTA
CCCGTCATTTCCGTGTTCACCAGAAGGGAGGTGAAACCAGCACAAACAGCATTGCTTCAATCTTTGCTTGGACCAGAGG
ACTTGCACACAGGGCAAAGCTTGACGACAATGCTAGACTTCTTGACTTTGCACTAAAACTTGAAGCTGCTTGCGTTGGA
ACCGTGGAATCTGGGAAGATGACCAAAGACCTTGCTCTTCTTATTCACGGGTCTTCAAACGTCACAAGAAGCCATTACC

FIG. 2 continued

```
TGAACACTGAAGAGTTCATTGATGCGGTTGCTGCGGAGCTCCGGTCAAGACTGGCAGCCAACTGAGCTTTTTACAAGAT
ACTCTTGCCAACTTCAGTgCTTCATTTCCCTTCTTTTAAAGTCATTTTGGCTGTATCACCATTACCATTCGAGTTCTCA
TTCTGGACTGaATGAACATTtACAGCATCGgtacaaAttgttgtcgatccaagcagtCcATaGATGCtgaTATCAC > SEQ ID NO:1269    105272  182059_300628_1
GAATTCAAGAAGTGTACGAAGCTCAATGGAAATCCAAGTATGAAGCTGCCGGGATATGGTATGAACACCGTCTCATTGA
TGATATGGTAGCCTATGCACTCAAGAGTGATGGTGGTTACGTCTGGGCATGTAAGAACTATGATGGTGATGTACAGAGT
GATTTCTTAGCCCAAGGTTTCGGATCCCTTGGATTGATGACGTCAGTGTTGGTATGCCCAGATGGAAAGACCATTGAAG
CTGAAGCAGCCCATGGCACAGTGACACGTCACTACCGGGTTCACCAGAAAGGAGGTGAAACCAGTACTAACAGCATAGC
TTCAATCTTTGCTTGGTCAAGAGGTCTTGCTCACAGAGCAAAGTTAGACGACAGTGCTAGACTTTTGGATTTCACCGAG
AAGCTGGAAGCAGCTTGTATTGGAACTGTTGAATCAGGAAAGATGACCAAAGATCTTGCTCTTCTCATTCATGGATCCA
AGGTTTCCAGGGACCAGTATCTCAACACTGAAGAGTTCATTGATGCCGTGGCGGAGGAGCTGAAAGCAAGACTTGCTGG
CAAATCAAAGCCTGAATAAAGCACCATGAAAGGCTAAGGGGGGG > SEQ ID NO:1270    105377  104746_300367_1
CAATAATCCGTCATGCAGATCTTCGTGAAAACCCTAACGGGAAAGACCATAACCCTCGAAGTCGAGAGCAGCGACACCA
TCGACAATGTCAAGGCCAAAATTCAGGACAAAGAAGGGATACCTCCTGATCAGCAGAGGTTGATTTTTGCTGGAAAACA
GTTGGAAGATGGTCGAACTCTGGCTGATTACAATATCCAGAAAGAATCAACACTTCACCTGGTTTTGAGGCTCAGGGGA
GGAACTATGATTAAGGTGAAGACTCTCACTGGAAAGGAAATTGAGATTGATATTGAACCCACAGACACCATTGATCGAA
TTAAGGAACGAGTTGAGGAAAAAGAAGGAATACCTCCTGTGCAGCAAAGGCTTATTTATGCTGGAAAGCAGCTAGCTGA
TGACAAGACCGCTAAGGATTACAATATTGAAGGAGGTTCTGTTCTTCATCTCGTTCTTGCATTGATGGGTGGTAGTCTT
TAGAATGCTCCGAATTTGGGTAAAAATGTGCAACCTTTATCCACGAATTTATCATGACAGTTCTCTTTTGTTTTCTTTT
TACCTTTTCTCATGTAAAACATGAAAACTTGGTTAAAGCTGACTAGCTGAGATTGATTTCCCCTC > SEQ ID NO:1271    105377  14687_300266_1
CCCACGCGTCCGCTCAAAATCTTAAAAACTTTCTCTCAATTCTCTCTACCGTGATCAAGATGCAGATCTTTGTTAAGAC
TCTCACCGGAAAGACAATCACCCTCGAGGTGGAAAGCTCCGACACCATCGACAACGTTAAGGCCAAGATCCAGGATAAG
GAGGGCATTCCTCCGGATCAGCAGAGGCTTATTTTCGCCGGCAAGCAGCTAGAGGATGGCCGTACGTTGGCTGATTACA
ATATCCAGAAGGAATCCACCCTCCACTTGGTCCTCAGGCTCC > SEQ ID NO:1272    105377  135552_300415_1
cggcaagactatcaccctcgaggtggagtcctctgacaccatcgataatgtcaaggctaagatccaagatAAGGAGGGC
ATCCCCCCGGACCAGCAGCGTCTCATCTTCGCTGGCAAGCAGCTGGAGGATGGCAGGACCCTTGCTGACTACAACATCC
AGAAGGAGTCGACCCTTCACCTTGTCCTCCGCCTCCGTGGTGGCATGCAGATCTTTGTCAAGACTCTGACCGGCAAGAC
TATCACCCTTGAGGTGGAGTCTTCTGACACCATCGACAACGTCAAGGCCAAGATCCAGGACAAAGAGGGCATCCCCCCA
GACCAGCAGCGTCTCATCTTCGCCGGCAAGCAGCTGGAGGATGGCAGGACCCTTGCTGACTACAACATCCAGAAGGAGT
CCACCCTCCACCTTGTCCTCCGCCTCCGTGGTGGCATGCAGATCTTTGTCAAGACACTGACCGGCAAGACCATCACCCT
CGAGGTGGAATCTTCTGACACCATCGACAACGTCAAGGCCAAGATCCAGGACAAGGAGGGCATTCCCCCGGACCAGCAG
CGTCTCATCTTTGCCGGCAAGCAGCTTGAGGACGGCAGGACCCTTGCTGACTACAACATCCAGAAGGAGTCAACGCTTC
ACCTTGTCCTCCGTCTCAGGGGAGGCATGCAAATCTTCGTGAAGACTCTGACCGGCAAGACCATCACCCTCGAGGTGGA
GTCTTCTGATACCATCGACAATGTCAAGGCCAAGATCCAGGACAAggAGGGCATTCCCCCGGACCAGCAGCGCCTCATC
TTTGCTGGCAAGCAGCTGGAGGATGGCaGGAcCCTTGCTGACTACAACATCCAGAAGgagTCCACCCTCCACCTTGTGC
TCCGCCTTCGTGGTGGTATGcagaTCTTTgtcaagaccCTCACAggc > SEQ ID NO:1273    105377  11857_300290_1
TGGTATCAACGCAGAGGGGCCATTACGGCGGGGCCAGCAAAGGTTGATTTTTGCTGGTAAGCAATTGGAAGATGGCCGT
ACCCTAGCTGATTACAACATTCAAAAGGAGTCGACTTTGCACCTTGTGCTCCGTCTTCGTGGTGGGATGCAGATTTTCG
TGAAGACATTGACCGGGAAAACCATCACTCTTGAGGTGGAAAGCTCTGACACTATTGACAACGTTAAGGCCAAAATCCA
GGATAAGGAGGGAATCCCACCAGACCAGCAGAGATTGATTTTT > SEQ ID NO:1274    105377  12262_300277_1
CCCACGCGTCCGAGAAAATGCAGATCTTCGTGAAAACCCTAACGGGGAAGACAATAACCTTAGAGGTAGAATCATCAGA
CACAATCGACAATGTGAAAGCGAAGATCCAAGACAAGGAAGGAATCCCACCGGATCAGCAACGGTTGATCTTCGCCGGA
AAACAATTGGAAGATGGAAGAACACTAGCTGATTACAACATCCAGAAAGAGTCGACGCTTCATTTgTTCTACGTCTGA
GaGGAGGTGCGAAGAAGAGGAAGAAGAAGACGTACACGAAACCTAAGAAGATTAAGCATACGCACAAGAAAGTgaaGCT
Agcagtt
```

FIG. 2 continued

> SEQ ID NO:1275 105377 135205_300412_1
CCCAGACCAGCAAAGGCTGATTTTCGCAGGGAAGCAACTGGAAGATGGACGTACATTAGCTGATTACAACATTCAGAAA
GAGTCAACGCTCCATTTGGTCCTGAGGCTCAGGGGTGGAACCATGATCAAGGTGAAGACACTCACTGGGAAGGAAATCG
AGATCGACATCGAGCCCACTGATACCATTGATAGAATCAAGGAGCGTGTTGAGGAGAAAGAGGGTATTCCACCTGTTCA
GCAGAGGCTCATTTATGCTGGGAAGCAACTTGCTGATGATAAAACTGCCAAGGATTACAACATTGAAGGTGGCTCAGTG
CTCCATCTCGTGCTTGCTCTGAGGGGTGGTCAGTAGATGTAGTTTCCATGCCCGCATTATCTCTAAAGGGAGAAGCATA
TTTGCTATTCCATTTCTATCTGTAGTTGCTGCAGACTTATAGCTATATTTGGTAGGATTATTGAAGTACTATGCGATTG
GCGCATTGTGTATTGGAATCAATTGTCATCTGTACTGGAAAGGAAATATTGGAACTAAGTTAAGCAGTAGTTTATCAAT
TGCC

> SEQ ID NO:1276 105377 120879_300517_1
CCACCCTCCACCTTGTGCTCAGGCTCAGGGGAGGTATGCAGATCTTCGTCAAGACCCTGACCGGCAAGACCATCACCCT
CGAGGTCGAGTCCTCGGACACGATCGACAACGTGAAGGCCAAGATCCAGGACAAGGAGGGCATCCCCCCGGACCAGCAG
CGTCTCATCTTTGCTGGCAAGCAGCTGGAGGATGGCCGCACCCTTGCCGACTACAACATCCAGAAGGAGTCCACCCTCC
ACCTTGTGCTCAGGCTCAGGGGTGGTATGCAGATCTTCGTCAAGACCCTGACCGGCAAGACCATCACGCTTGAGGTCGA
GTCCTCGGACACGATCGACAATGTGAAGGCCAAGATCCAGGACAAGGAGGGTATCCCCCGGACCAGCAGCGTCTCATC
TTCGCCGGCAAGCAGCTGGAGGATGGCCGCACCTTGGCTGACTACAACATCCAGAAGGAGTCCACCCTTCACCTGGTTC
TCAGGCTCAGGGGTGGGATGCAGATCTTCGTGAACACCCTGACTGGCAAGACCATTACCCTTGAGGTTGAGTCGTCCGA
CACTATTGACAACGTGAAGGCGAAGATCCAGGACAAggAggGCATCCCCCCGGaccagcAGCGTCTGATCTTTGCTggt
aagcagct > SEQ ID NO:1277 105377 207525_300806_1
gcagatcttcgtcaagaccttgactggcaagaccatcacccttgaggtcgagtcgtctgacaccattgacaatgtcaag
ggcAAGATCCAGGaCAAGgagGGCATCCCCCCAGACCAGCAGCGTCTCATCTTCGCCGGCAAGCAGCTGGAGGATGgcc
GCACCCTTggtGaCTACAACATCCAGAaggagTCCACCCTCCACCTTgtgctCAGgctCAGGGGAGGTaTGCAgaTCTT
CGTCAagagccTGACCGgcaAgaCCATCACCCTCGAGgtcgaGTCCTCGGACaCgatCGACAACGTGAaGgcAAgaTC
CAGGacaAGgagGgcaTCCCCCCGgaccagcagcgtcTCATCTTCGCCGGCAAGCAgcTGGAGgacggccGCACCCTTg
gcgactACAACATCcagaaggaaTCCACCCTCCACCTTgtgcttagGCTCAGgGagGTATgcagaTCTTCGTCaagac
cCTgacTGgcaagACCATCACACTTgaggtcgagtcctcgGAcA > SEQ ID NO:1278 105377 228182_301018_1
CGCGAGGCTCTCGTCGTCGAATCGAATCTCTCGCGTCCTCAAGATGCAGATCTTTGTGAAGACATTGACCGGCAAGAC
TATCACCCTCGAGGTGGAGTCCTCTGACACCATCGATAATGTCAAGGCTAAGATCCAAGATAAGGAGGGCATCCCCCCG
GACCAGCAGCGTCTCATCTTCGCTGGCAAGCAGCTGGAGGATGGCAGGACCCTTGCTGACTACAACATCCAGAAGGAGT
CGACCCTTCACCTTGTCCTCCGCCTCCGTGGTGGCATGCAGATCTTTGTCAAGACTCTGACCGGCAAGACTATCACCCT
TGAGGTGGAGTCTTCTGACACCATCGACAACGTCAAGGCCAAGATCCAGGACAAAGAGGGCATCCCCCCAGACCAGCAG
CGTCTCATCTTCGCCGGCAAGCAGCTGGAGGATGGCAGGACCCTTGCTGACTACAACATCCAGAAGGAGTCCACCCTCC
ACCTTGTCCTCCGCCTCCGTGGTGGCATGCAGATCTTTGTCAAGACACTGACCGGCAAGACCATCACCCTCGAGGTGGA
ATCTTCTGACACCATCGACAACGTCAAGGCCAAGATCCAGGACAAGGAGGGCATTCCCCCGGACCAGCAGCGTCTCATC
TTTGCCGGCAAGCAGCTTGAGGACGGCAGGACCCTTGCTGACTACAACATCCAGAAGGAGTCAACGCTTCACCTTGTCC
TCCGTCTCAGGGGAGGCATGCAAATCTTCGTGAAGACTCTGACCGGCAAGACCATCACCCTCGAGGTGGAGTCTTCTGA
TACCATCGACAATGTCAAGGCCAAGATCCAGGACAAGGAGGGCATTCCCCCGGACCAGCAGCGCCTCATCTTTGCTGGC
AAGCAGCTGGAGGATGGCAGGACCCTTGCTGACTACAACATCCAGAAGGAGTCCACCCTCCACCTTGTGCTCCGCCTTC
GTGGTGGTATGCAGATCTTTGTCAAGACCCTCACAGGCAAGACCATCACCCTGGAGGTTGAGAGCTCGGACACCATCGA
CAACGTCAAGGCCAAGATCCAGGACAAGGAGGGCATCCCCCCAGACCAGCAGCGTCTCATCTTCGCCGGCAAGCAGCTC
GAGGATGGCCGCACCCTCGCCGACTACAACATCCAGAAGGAGTCTACCCTCCACCTGGTGCTTCGTCTCCGTGGTGGTA
TGCAGATCTTCGTGAAGACCTTGACTGGAAGACCATCACTTTGGAGGTTGAGAGCTCCGACACCATTGATAATGTGAA
GGCCAAGATCCAGGACAAGGAGGGGATTCCCCCAGACCAGCAGCGTCTGATCTTCGCTGGCAAGCAGCTGGAGGATGGA
CGCACCCTCGCCGACTACAACATCCAGAAGGAGTCCACCCTCCACCTGGTGCTCCGCCTCCGTGGTGGTCAGTAATCAG
CCAGTTTGGTGGAGCTGCCGATGTGCCTGGTCGTCCCGAGCCTCTGTTCGTCAAGTATTTGTGGTGCTGATGTCTACTT
GTGTCTGGTTTAATGGACCATCGAGTCCGTATGATATGTTAGTTTTATGAAACAGTTTCCTGTGGGACAGCAGTATGCT
TTATGAATAAGTTGGATTTGAACCTAAATatgtgctcaatttgct > SEQ ID NO:1279 105377 34406_301003_1
GGACAAGGAAGGAATCCCTCCGGATCAGCAGAGACTTATCTTTGCCGGTAAGCAGCTTGAAGACGGAAGAACTCTTGCT
GACTACAACATTCAAAAGGAGTCGACCCTTCATTTGGTGCTTCGTCTCAGAGGTGGTATGCAAATCTTTGTCAAGACCC
TCACTGGTAAAACAATCACCCTTGAGGTTGAGAGTTCAGACACCATTGACAATGTCAAAGCTAAGATCCAAGATAAAGA

FIG. 2 continued

GGGAATTCCTCCGGATCAGCAGAGGCTTATCTTTGCCGGTAAGCAGCTCGAAGATGGACGCACCCTTGCAGATTACAAC
ATCCAAAAGGAGTCGACACTTCATCTTGTGCTTCGTCTCCGTGGTGGTATGCAGATCTTTGTGAAGACCCTTACCGAA
AGACCATTACTCTGGAGGTTGAAAGCTCAGACACCATCGATAATGTCAAGGCTAAGATTCAGGACAAGGAAGGGATCCC
ACCAGACCAACAGAGACTCATCTTCGCTGGAAAACAGCTTGAGGATGGTCGCACACTTGCAGATTACAACATCCAGAAG
GAGTCGACTCTTCACTTGGTTCTTCGTCTTCGTGGTGGAAGCTTCTAAGCTTTTTGTGATCTGATGATAAGTGGTTGGT
TCGTGTCTCATGCACTTGGGAGGTGATCTATTTCACCTGGTGTAGTTTGTGTTTCCGTCAGTTGGAAAAACTTATCCCT
ATCGATTTCGTTTTCATTTTCTGCTTTTCTTTTATGTACCTTCGTTTGGGCTTGTAACGGGCCTTTGTATTTCAACTCT
CAATAATAATccaagtgcatgtttacc > SEQ ID NO:1280 105377 44358_300112_1
GCCATTACGGCCGGGAATCAGAAAAAGCAAAGCGGGTGGGCTGAAGAGTGCGCCGCAAAAGGCAGATCTTCGTGAAAAC
CCTAACCGGGAAGACAATCACGCTCGAGGTTGAATCGAGCGACACCATTGATAATGTCAAGGCTAAGATTCAAGACAAA
GAAGGTATTCCACCGGACCAGCAGCGGTTGATATTCGCCGGAAAGCAGCTCGAAGATGGACGTACTCTTGCTGATTATA
ACATCCAGAAAGAGTCAACTTTGCATTTGGTTTTGAGGCTTCGTGGAGGGATTATTGAGCCTTCTCTGATGGCTTTGGC
TAGGAAGTACAACCAGGATAAGATGATTTGTCGCAAGTGCTATGCTCGCCTGCA > SEQ ID NO:1281 105377 48451_300376_1
GCCATTACGGCCGGGGATAGAAGAGGAGTAGAAGATCGCTGGTGAGGGGCGGAGAAAATGCAGATCTTCGTGAAAACTC
TGACGGGTAAAACTATAACCCTTGAGGTTGAATCCAGTGACACAATTGACAATGTCAAGGCCAAAATTCAAGACAAGGA
AGGAATTCCACCGGACCAACAAAGGCTGATTTTTGCTGGTAAGCAGCTTGAAGATGGCCGCACCCTTGCTGACTATAAC
ATTCAGAAAGAGTCGACTCTGCATTTGGTACTGAGGCTTCGTGGTGGAATTATTGAACCATCTTTGATGGCTTTGGCTA
GGAAGTACAATCAGACAAAATGATTTGCCGCAAGTGCTATGCTCGTTTGCATCCCCGTGCTGTCAATTGCCGCAAAAA
GAAGTGTGGCCACAGCAATCAGTTGAGGCCCAAGAAGAAGATTAAGTAGATGGTGATTTTGAAGTCCCGGCAACATGTA
GCTGCTAATGTTGAGATCCTTAAGAAATTATTAGATATGTTGTTGGGTTGCCTGTTCAATTTACTCTGAAACATTGAAG
GATTTGTGTTTGAGCTACTTCAATATTTCTTAATGAGCTagaTTCTGTtggttaCATTACATAAGtTTTGCTCGATGTG
TAGttCTATGTGCTTTTATccagc > SEQ ID NO:1282 105377 50491_300171_1
AAAAAGATGCAGATCTTCGTGAAAACCCTAACGGGGAAGACGATCACTCTCGAGGTCGAGTCCTCTGACACCATCGACA
ATGTCAAGGCCAAGATCCAAGACAAGGAAGGAATCCCACCGGACCAGCAGCGATTGATTTTCGCCGGAAAGCAGCTCGA
AGACGGACGTACCTTAGCCGATTACAACATCCAGAAGGAATCAACGCTTCACCTTGTCCTTCGTCTCCGTGGAGGTGCT
AAGAAGAGGAAGAAGAAGACCTACACCAAGCCTAAGAAGATCAAGCACAAGCACAAG > SEQ ID NO:1283 105377 4655_300310_1
CGCGGTATGCAGATCTTCGTGAAGACTCTCACCGGAAAGACTATCACTTTGGAGGTAGAGAGCTCTGACACCATTGACA
ACGTGAAGGCCAAGATCCAGGATAAGGAAGGAATCCCTCCGGACCAGCAGAGGTTGATCTTTGCCGGAAAACAATTGGA
GGATGGTcgtaCTTTGGCGGATTACAACATCCAGAAGGAgacgACCCTTCaCTTGgtgTTGCGTCTgcgagGAGGTATG
cagaaattcgTCAAgACtTtgaccggaAAgaccaTCACCCTTGAAGtggaaAgctccgacaCCATTgac > SEQ ID NO:1284 105377 38919_301003_1
TAACGGAAACATAGTCGATCAATTATTTATCAGAGGCTGTACATGGCCCCAAAACATAAACCACCAAAGTACTAGATGA
AACGATACATGAACTTGGTTCAGTAACCATAAGAGAGAGAGACAAGGTTTAGAAACCACCACGGAGACGGAGGACCAAG
TGAAGAGTAGACTCCTTCTGGATGTTGTAGTCGGCCAAAGTACGTCCATCCTCAAGCTGCTTTCCAGCGAAGATGAGAC
GCTGCTGGTCCGGAGGAATGCCTTCCTTGTCCTGGATCTTAGCCTTCACGTTATCAATGGTGTCGGAGCTCTCAACTTC
AAGAGTGATGGTCTTTCCGGTCAAAGTCTTTACGAAGATCTGCATACCTCCACGCAGACGCAAGACCAAATGAAGCGTA
GACTCCTTCTGGATGTTGTAATCCGCCAAAGTTCTGCCGTCCTCAAGTTGCTTTCCGGCGAAGATCAACCTCTGCTGGT
CCGGAGGAATACCCTCCTTATCTTGGATCTTGGCCTTGACGatGTCAATGgtgTCAGagcTCTccACCTCAagaGTAat
cgtctTtaCCGTTAGGGTTTTAACGAAAATCtGCATACCACCACGGAGCCTGAGGACCAAGTGGAGGGTGGATTCCTTC
TGGATATTGTAATCAGCCAACGTACGGcCATCCtCTAGCTGCTtgcCGGCGAAAATAagcCTCTGCTGATCCGGAGGAA
TGCCCTCctTAtcctGGATCTTGGCcttaacgTtgtcGATGGTGTCGGAGCTTTCCACCTCGAGGGTGATTGTCtttcc
ggtgagagtcttaacaaagatctgcatcttgatcacggtagagagaattgagagaaacttttttcaccattttgag > SEQ ID NO:1285 105377 285518_200105_1
AAAAGCTTATCCTTCTCCGGCAAGCATCTTGAGGACGGACGTACTATCGCCTGTTACAACATCCACAACGAATCTACTC
TTCACTTGGTCCTCCGCCTCCGAGGTGGGATGCATATCTTAGTCAAAACCCTCACCGGCAAAACAATCACTCTTGAGGC
CGAAAGCTCCCACACCATTGATAGATGTCAAGGCTCAAAA

FIG. 2 continued

> SEQ ID NO:1286 105377 254507_301633_1
TTGCTTTCTCTCTCTCTGTCTCTCTCTTTCTGTCTACCCTTTCTCTCTCTGTCCTCTGTTTGAGCCAAGAAGAAGATGC
AGATCTTCGTGAAGACCCTGACCGGCAAGACCATCACCCTCGAGGTCGAAAGCTCTGACACCATCGACAACGTCAAGGC
CAAGATCCAGGACAAGGAGGGTATCCCCCCTGACCAGCAGCGCCTCATCTTTGCTGGTAAACAGCTTGAAGATGGCCGC
ACCCTTGCTGATTACAACATACAGAAGGAGTCTACCCTCCACCTTGTCCTTCGCCTCAGGGGCGGTATGCAAATCTTCG
TCAAAACCCTCACTGGCAAGACCATTACCCTTGAAGTCGAGAGTTCTGATACCATCGATAATGTGAAAGCCAAGATCCA
AGATAAGGAGGGAATTCCCCCTGACCAGCAGCGCCTTATCTTTGCTGGTAAACAGCTTGAAGATGGCCGCACCCTCGCT
GATTACAACATACAGAAGGAGTCTACCCTCCACCTTGTCCTTCGCCTCAGGGGTGGTATGCAAATCTTCGTCAAAACCC
TCACCGGCAAGACCATTACTCTTGAAGTCGAGAGTTCTGACACA

> SEQ ID NO:1287 105377 283409_200093_1
AGCGTCCGAAGACATTGACCGGGAAAACCTCACTCTTGAGGTGGAAAGCTCTGACACTATTGACAACGTTAAGGCCAAA
ATCCAGGATAAGGAGGGAATCCCACCAGACCAGCAGAGATTGATTTTTGCTGGTAAGCAGCTGGAGGATGGCCGAACCC
TCGCTGATTACAACATTCAGAAGGAGTCTACCCTTCACTTGGTTCTCCGTCTCCGCGGTGGGATGCAGATCTTCGTCAA
AACACTCACTGGGAAGACAATCACCCTCGAAGTTGAAAGCTCCGATACTATCGACAATGTTAAGGCTAAGATTCAGGAC
AAGGAAGGTATTCCACCGGACCAGCAGAGATTGATTTTTGCTGGTAAGCAGTTGGAAGATGGGAGAACTTTAGCTGATT
ATAATATCCAGAAGGAATCCACACTGCATTTGGTGCTCCGTCTTCGTGGTGGGATGCAGATTTTTGTGAAGACGTTGAC
CGGGAAAACCATCACTTTGGAGGTAGAGAGTTCTGATACGATCGACAATGTGAAGGCTAAGATTAGGACAAGGAGGGT
ATCCCGCCAGATCAGCAGAGGCTGATTTTTGCTGGGAAGCAGTTGGAAGATGGAAGGACTCTGGCTGATTATAATATTC

> SEQ ID NO:1288 105405 234473_301201_1
gaggttttagggttttttccgGGCGCGATGTATGGTGGAGATGAGGTATCCGCCATTGTCGTCGATCTGGGATCGCATTC
TTGTAAAGCGGGCTATGCCGGAGAGGATGCGCCAAAGGCAGTgtTCCATCGGTTGTAGGAGCTGTGGGGGAAAAGCCC
AACAGCACTTACTATGTTGGAAATCAGGCAATACAATATAGGCGTGATTTTATGGAGGTTgCCCTGCATTGAAAGATG
GTCTCGTAGCAGATTGGGACATAGTTgAGGGCATCTGGGATCACGCTTTCAAGGAACGGCTCCTGATTgacCCCAAAGA
GCATCCAATGCTTCTCGCTGAGGCATCATTCAATCCTCAGCAACACAGGGAAAAGACTGTAGAGCTCATGTTTgacaAA
TATGGTGTACCTGCGGTCTTTCTCGCTAagAATGCTGTGCTTACGTCGTTTGCGTCTGGACGAGCTACATCTCTGGTTG
CCGACTGTGGTGGTGGCTCAACTACTGTTGCTGCAGTCCATGATGGCTATGTTTTGCACAAGGCTGttTTCAGGTCTCC
CATCGgaggcgaAGTccTCACTg > SEQ ID NO:1289 105405 235924_301282_1
AACAATGCAAGACGAAGTTCAAGCTTTAGTTATTGACAATGGATCTGGAATGTGCAAGGCTGGATTTGCCGGAGATGAT
GCTCCTCGAGCTGTCTTCCCTTCCATCGTTGGACGACCTCGACACGCTGGAGTCATGGTTGGTATGGGACAGAAGGATT
CATACGTTGGAGATGAGGCTCAATCCAAGAGAGGTATCTGACCCTTAAGTACCCCATTGAGCACGGAATTGTCACTAA
CTGGGATGATATGGAGAAGATCTGGCATCACACTTTCTATAACGAACTTCGAGTTGCCCCTGAGGAACACCCTGTCCTT
TTGACTGAGGCTCCTTTGAACCCTAAGGCTAACCGAGAGAAGATGACTCAAATCATGTTCGAGACCTTCAACACTCCCG
CCATGTACGTTGCCATCCAAGCTGTCCTTTCCCTCTATGCTTCTGGACGAACCACCGGAATTGTCTTGACTCTGGTGA
TGGTGTTACCCACACTGTCCCTATCTATGAAGGATATGCCCTTCCCCACGCTATTCTTCGACTTGACTTGGCTGGACGA
GATTTGACTGACTACATGATGAAGATCTTGACCGAGAGAGGATACTCTTTCACCACCACTGCTGAGCGTGAAATCGTCc
GagacaTCAAGGAGAAGCTCGcttacgTtg > SEQ ID NO:1290 105405 50271_300165_1
TGCCGCTGTTGATTCTCCTCCATTTCTCTATCTTTCTCTCTCGCTGCTTCTCGAATCTTCTGTATCATCTTCTTCTTCT
TCAAGTGAAAAATGGCCGATGGTGAGGATATTCAGCCACTTGTCTGTGACAATGGAACTGGAATGGTGAAGGCTGGTTT
TGCTGGTGATGATGCCCCGAGAGCAGTGTTCCCAAGTATTGTTGGTCGTCCTAGGCACACTGGTGTCATGGTTGGTATG
GGTCAGAAAGATGCTTACGTTGGTGATGA > SEQ ID NO:1291 105405 38613_300209_1
CCCACGCGTCCGTATGGAAAAGATCTGGCATCACACTTTCTACAATGAGCTTCGTATTGCTCCTGAAGAGCACCCTGTT
CTTCTTACCGAGGCTCCTCTTAACCCAAAGGCCAACAGAGAGAAGATGACTCAAATCATGTTTGAGACCTTTAACTCTC
CCGATATGTATGTCGCCATCCAAGCTGTTCTCTCCTTGTACGCCAGTGGTCGTACAACCGGTATTGTGCTGGATTCTGG
TGATGGTGTGTCTCACACTGTGCCAATCTACGAGGGTTTCTCTCTTCCTCATGCCATCCTCCGTCTTGACCTTGCTGGA
CGTGACCTTACTGATTACCTCATGaagatcctTAcagagaGag > SEQ ID NO:1292 105405 284413_200098_1
gttgaaactctttctcacattctctacggttttcaaaagaaaagatcagcaacaaaGAAAATGGCTGATGTTGAGGACA
TTCAACCTCTTGTTTGTGACAATGGAACTGGAATGGTTAAGGCTGGATTTGCGGGAGATGATGCACCAAGGGCTGTTTT
TCCTAGCATTGTTGGTCGTCCCCGTCACACCGGGGTAATGTAGGCATGGGACAGAAGGATGCATATGTTGGAGATGAA
GCACAGTCGAAACGTGGTATTCTCACGCTGAAGTATCCTATTGAACATGGGATAGTAAATAACTGGGATGATATGGAAA

FIG. 2 continued

AGATTTGGCATCATACTTTCTACAACGAACTTCGAGTTGCTCCTGAAGAACATCCTGTTCTGCTCACTGAAGCACCTCT
TAACCCGAAGGCTAATCGTGAGAAAATGACTCAGATAATGTTTGAAACATTCAATGCGCCAGCAATGTATGTTGCAATT
CAAGCTGTTCTGTCTTTGTATGCTAGTGGACGTACAACTGGTATTGTCCTGGATTCTGGAGATGGTGTCAGCCACACAG
TTCCTATTTATGAAGGTTATGCACTTCCTCATGCTATCCTACGTCTCGacCTTGCTGGTCGTGATCTCACTGAGTACAT
GgCaAAAATTCTCaCTGAACGTGGATATTCCTTCACTACAACTGCTG

> SEQ ID NO:1293 105405 280155_200066_1
tccttacagcgtttcaacagagtgttgtagagagagaaagcgagccggccttCGTCTTTGGTTGGCTTTGCTTCTCGGA
TCGATCTTCCTCTCTTTTTTCCTCTTTTGTTTTCAGGTGAATTAAGATGGCCGACGGCGAGGATATTCAGCCCCTTGTT
TGTGACAATGGAACCGGAATGGTTAAGGCTGGATTTGCTGGTGATGATGCTCCTCGAGCAGTGTTTCCCAGTATTGTGG
GTCGTCCTCGGCACACTGGTGTTATGGTCGGAATGGGACAGAAGGATGCTTATGTGGGTGATGAAGCTCAATCCAAGAG
AGGTATCTTAACCTTGAAATATCCTATTGAGCATGGTATAGTCAGCAACTGGGATGATATGGAGAAAATATGGCATCAT
ACTTTCTACAATGAGCTTCGAGTTGCTCCTGAAGAACACCCTGTTCTCCTGACTGAGGCACCCCTTAATCCTAAGGCCA
ACAGAGAGAAGATGACCCAGATTATGTTTGAGACATTTAACGTTCCAGCTATGTATGTTGCTATTCAGGCCGTGCTCTC
ATTGTATGCTAGTGGTCGTACCACTGGTATTGTGTTGGACTCTGGTGATGGTGTGAGTCACACTGTCCCTATCTATGAA
GGTTATGCTTTGCCCCATGCCATTCTTCGTTTGGATCTTGCTGGCCGAGACCTTACTGATAGCCTGATGAAGATCCTCA
CCGAGAGAGGATACATGTTCACCACCACCGCTGAACGGGAAATTGTCcGTGATATGAAAGAAAAGCTtgcctATGTGgc
tctTgACTacgagcaggAACTTGaaact > SEQ ID NO:1294 105405 267728_200118_1
TTTCACTCGTACGCAAATTCTAGGAGCAAAGTTGTAAGAAATGGCAGACGTTGATGACATTCAACCACTTGTTTGTGAT
AATGGAACCGGGATGGTCAAGGCTGGTTTTGCTGGAGATGATGCCCCAAGGGCTGTTTTTCCGAGCATTGTTGTTTTTA
TCTCGTCACACTGGAGTGATGGTTGGGATGGGCAGAAGGATGCCTATGTTGGGGACGAGGCCCAGTCAAAACGTGGTA
TTCTGTCGTTGAAGTATCCTATTGAACATGGTATAGTGAATAACTGGGATGACATGGAGAAGATTTGGCACCACACCTT
CTACAATGAGCTTCGAGTTGCTCCAGAAGAGCATCCTGTTCTGCTCACTGAAGCACCTCTCAACCCAAAGGCCAATCGT
GAGAAGATGACTCAAATAATGTTCGAAACCTTCAACTGTCCTGCAATGTATGTTGCAATTCAAGCTGTTCTGTCTTTAT
ATGCTAGTGGTCGTACTACTGGTATTGTTTGGATTCCGGAGATGGTGTTAGCCACACAGTTCCTATCTATGAAGGTTA
TGCACTTCCACATGCGATCCTACGTCTTGACCTTGCTGGCCGTGACCTCACAGAGCATTTGGCAAAAATCCTCACTGAA
CGTGGATACTCATTCACCACCAGTGCTGAGAAGGAAATTGTTAGGGACATG > SEQ ID NO:1295 105405 258880_301700_1
AAATCTCTTTGCTACCAACAACCACACAAATTAAAAATGGAAGACGAAACTGTTGCCCTCGTTATCGATAACGGATCCG
GTATGTGCAAGGCCGGTTTCGCCGGTGATGACGCTCCCCGAGCTGTTTTCCCCTCCATCGTCGGTCGACCCCGACATCA
GGGTGTCATGGTCGGCATGGGCCAGAAGGACTCCTATGTTGGTGATGAGGCCCAGTCCAAGCGAGGTATCCTGACCCTC
CGATACCCCATCGAGCACGGTATTGTTACCAACTGGGATGACATGGAGAAGATCTGGCACCACACCTTCTACAACGAGC
TCCGAGTTGCTCCTGAGGAGCACCCCGTCCTGCTCACCGAGGCCCCCATCAACCCCAAGTCCAACCGAGAGAAGATGAC
CCAGATCTTCTTCGAGACTTTCAACGCTCCCGCTTTCTACGTCTCTATCCAGGCCGTCCTCTCCCTGTACGCCTCTGGT
CGAGTCACCGGTATCGTTCTTGACTCTGGTGATGGTGTCACCCACGTTGTGCCCATCTACTCTGGTTTCTCTCTCCCCC
ACGCCATCATGCGACTCGATATGGCTGgccGAGATCTTACCGACTACCTCATGaagattCTCTccgagcgaggttactc
TTtCAccAaCTccgccgagcgagaaaTcGtccgagacaTCaaggag > SEQ ID NO:1296 105405 254026_301631_1
ggccattcgttggtttgccttcctcctcctcctattcgccttcGCCTTCTTCTTCTTCCACCAAGGTTAACCTGCCATC
GATTTCATCAATCTCTTCCCTGGTGAATACAATTGATAAATCATGCAGATGTTGAGGAAGTGTCACCACTTGTCTGCG
ACAATGGAACCGGAATGGTGAAGGCTGGGTTTGCTGGAGATGATGCGCCACGTGCGGTTTTCCCCAGCATTGTTGGAAG
GCCTAGGCATACCGGTGTCATGGTGGGCATGGGACAGAAGGATGCTTATGTTGGGGATGAGGCACAATCCAAACGTGGT
ATTCTCACCTTGAAGTATCCCATCGAACATGGTATTGTCACCAATTGGGATGACATGGAAAAGATTTGGCACCACACAT
TTTACAATGAGTTGCGAGTTgCTCCAGAAGAGCACCCTGTGCTCCTTACAGAGGCCCCCATGAACCCAAAGGCTAACCG
TGAAAAAATGACCCAAATTATGTTTGACACCTTCAACGCTGCCGGCCATGTATGTTGCCATCCAGGCTGTTCTCTCCTTG
TATGCTAGTGGAAGGACCACCGGTATCGTGCTTGACTCTGGTGATGGTGTCTCCCACACTGTGCCCATTTATGAAGGTT
ATGCTTTGCCCCATGCCATTCTTAGGCTGGATCTGGCTGGGCGTGATTTGACTGATGCCCTCATGAAGatcctCACGGA
ACGCGGTTattcctTCaccactactgctgagCGAg > SEQ ID NO:1297 105405 253837_301630_1
CTCTTCCTCCGTCGCGGAAGGCCATCGCTCATCAGTCTCATAGCGAGCTATGGCGGACGGGGAAGAGGTCCAGCCCCTT
GTTTGTGACAATGGAACCGGAATGGTGAAGGCTGGGTTTGCGGGAGATGATGCACCCCGTGCCGTGTTCCCGAGCATAG
TGGGGCGGCCTAGGCATACGGGGGTCATGGTGGGCATGGGCAAAAGGATGCTTACGTCGGCGATGAGGCCCAATCGAA
ACGTGGTATCTTGACTCTGAAGTATCCGATCGAGCACGGCATTGTGACCAACTGGGATGACATGGAGAAGATATGGCAC
CACACTTTCTACAATGAGCTCCGAGTAGCACCTGAGGAACACCCCGTGCTTCTCACAGAGGCACCCATGAACCCCAAGG

FIG. 2 continued

CCAATCGAGAGAAGATGACCCAGATCATGTTTGATACCTTTAACGTTCCGGCCATGTATGTCGCTATTCAAGCTGTTCT
TTCTCTCTATGCTAGCGGAAGAACAACCGGTATAGTGATGGATTCGGGTGATGGTGTCACTCATACGGTCCCCATCTAT
GAAGGCTACGCGCTTCCGCATGCGATTCTCCGTCTTGACCTTGCGGGGCGAGACCTAACTGACGCTCTAATGAAGAT

> SEQ ID NO:1298 105405 249747_301595_1
gcgtggacagggcgcaagggcggcggcggtcatcgcgcggcggcccggatctttaccgaaatccattctttctccgcgc
tAAGAGGCAGCCATGTCGGAAACCGAGGATGTCCAGCCGCTCGTCTGCGACAATGGATCCGGAATGGTCAAGGCCGGAT
TTGCCGGAGACGATGCCCCCCGTGCGGTGTTTCCAAGCATCGTGGGTCGCCCACGGCACACTGGGGTCATGGTTGGAAT
GGGTCAGAAGGATGCCTATGTTGGAGACGAGGCCCAGTCCAAGCGTGGAATCTTGACCCTAAAGTACCCGATCGAGCAT
GGCATTGTTACCAACTGGGACGATATGGAGAAGATATGGCACCCATACCTTCTACAATGAGCTCCGTGTCGCCCCGAGG
AGCACCCGGTTCTCCTCACCGAGGCACCGCTCAACCCCAAGGCCAACCGCGAGAAGATGACGCAGATCATGTTCGAGAC
CTTCAACGTTCCCGCAATGTACGTTGCGATCCAGGCGGTGTTGTCGCTCTACGCCAGCGGTCGGACAACTGGTATTGTG
CTCGATTCTGGTGATGGTGTTACGCACACTGTGCCTATCTACGAGGGATAtgctTtgccGCAtgccatTTta > SEQ ID NO:1299 105405 239949_301309_1
gggCGAGAGCAAGCTCTTGATCGACGAGAGTCTTGAGCGATCGGTCAAAGAAGGCGGCGTCTTCCTCGCGAATCGATCG
AGGCATGGCGGAGGAAGAAATCCAGCCGCTGGTGTGCGACAATGGATCCGGGATGGTCAAGGCTGGATTCGCCGGCGAC
GATGCCCCAAGGGCCGTGTTTCCAAGCATCGTGGGGCGGCCGAAGCACACAGGGGTCATGGTTGGAATGGGGCAGAAGG
ATGCGTACGTGGGGGACGAGGCGCAGTCCAAGCGAGGAATTCTAGCGCTGAAGTACCCGATCGAGCACGGGATCGTGAC
CAACTGGGATGATATGGAGAAGATTTGGCACCACACCTTCTACAACGAGCTTCGAATCACCCCGGAAGAACACCCTGTT
CTTCTCACAGAGGCGCCGCTCAACCCAAAGGCCAATCGCGAGAAGATGACCCAGATCATGTTTGAGACGTTCAATGTCC
CGGCCATGTATGTATCGATCCAAGCCGTGTTGTCGCTCTACGCCAGTGGACGCACCACAGGTATCGTTCTGGATTCGGG
TGATGGTGTCACGCACACTGTCCCAATCTACGAAGGATATGCACTGCCGCATGCAATCCTCCGGCTGGATCTTGCCGGc
cgcgaCTTGACCGACTCTCTCATGAAGATCCTGACCGAAAGaggtacActtttcaCCACCACGgCCGAGCGCGAgaTCGt
gaGa > SEQ ID NO:1300 105405 1046009_301921_1
GTTCTTCTTCTTCTCTGTTTTGTCCTGCAGGAAGAGAAGAAGATCTTGGTGAGCTCTATCCTCACTCACCTCTACACAG
TACAGGAACTACCTGGTGAGCAATATATACTGGTTTCGTCATGGCAGATGTTGAAGAAGTAACACCCCTCGTCTGTGAC
AATGGATCTGGAATGGTCAAGGCTGGATTTGCTGGAGATGATGCTCCACGTGCGGTATTCCCTAGTATCGTTGGACGGC
CCCGACATACTGGGGTTATGGTTGGTATGGGCAAAAGGATGCTTATGTTGGGGATGAGGCACAGTCGAAACGTGGCAT
ACTTACCTTGAAGTATCCGATAGAACATGGTATTGTGACAAATTGGGATGACATGGAAAAGATATGGCACCACACCTTC
TACAATGAACTTCGTATCGCTCCTGAGGAGCATCCCGTTCTCCTCACTGAAGCACCTATGAACCCAAAGGCCAACCGTG
AGAAAATGACCCAAATCATGTTCGACACCTTCAATGTCCCTGGCATGTATGTTGCCATACAAGCTGTCCTCTCTCTCTA
TGCTAGTGGTAGAACTACTGGTATAGTGCTCGATTCGGGTGATGGTGTCACCCACACTGTGCCCATCTATG > SEQ ID NO:1301 105405 196502_300704_1
ACCATCGCCATTGCCACCACCTCTCCTATATCTCGCCCTCCCCCAATTTCCCACCACCATCGCCATTGCCACCACCTCT
CCTATATCTCGCCCTCCCCCTCCTCCCTCCCACGCCATTCGCCTCCTTCTTGCTGCAGCCGCCATCCCCGGTTCGGTTC
TCTCCTCTTCTTTAGATCAGTTAAAATAAATGGCTGACGCAGAGGACATTCAGCCCCTTGTCTGTGACAATGGAACCGG
AATGGTCAAGGCTGGGTTTGCTGGAGATGATGCTCCCCGTGCTGTTTTCCCGAGTATTGTTGGCCGTCCGCGACATACA
GGCGTTATGGTTGGGATGGGACAAAAAGATGCTTATGTCGGTGATGAGGCCCAATCCAAGAGGGGTATCCTAACCTTGA
AATACCCCATTGAGCATGGAATTGTAAGCAACTGGGATGACATGGAGAAAATTTGGCACCACACATTCTACAATGAGCT
TCGTGTAGCACCAGAAGAGCATCCAATTCTTCTTACGGAGGCTCCACTTAACCCTAAGGCCAACAGGGAGAAGATGACA
CAAATTATGTTTGAGACATTCAGCGTTCCAGCCATGTATGTCGCTATTCAAGCCGTGCTTTCCCTCTATGCTAGTGGAC
GTACTAC > SEQ ID NO:1302 105405 183321_300621_1
CCCACGCGTCCGCCACTCTCGCCTCCTCGCGACTCGGAGTTCACCGCCGCCACCGCCTCCGCCGCCGATCTCCCCGTCC
CGCCGCGCCGCCGCCACCGTCCTCCCTCCTCCGGCCGCATCCCCGGAATTCAGAACCAGTAGGAGGAAATGGCTGACGG
CGAGGACATCCAGCCCCTTGTGTGTGACAATGGAACTGGCATGGTCAAGGCTGGGTTTGCTGGGGACGATGCCCAGG
GCTGTTTTCCCTAGTATCGTGGGGCGCCCCCGTCACACCGGTGTGATGGTTGGTATGGGGCAGAAGGATGCCTATGTTG
GTGATGAGGCGCAGTCCAAGAGAGGTATCCTCACCTTGAAGTACCCGATCGAGCATGGTATTGTTAGCAACTGGGATGA
CATGGAGAAGATCTGGCATCACACCTTCTACAACGAGCTCCGTGTCGCGCCCGAGGAGCACCCTGTGTTGCTGACTGAG
GCCCCGCTCAACCCCAAGGCTAACAGGGAGAAGATGACCCAGATCATGTTTGAGACTTTCAATGTGCCAGCTATGTATG
TCGCCATCCAGGCCGTGCTCTCCCTGTATGccAGTGGACGTACAACTGgTatcGTG

FIG. 2 continued

> SEQ ID NO:1303 105405 182385_300660_1
GAATTCGGTTACAGACTCACAAACGCACAATCTAGGGTTTCGTTGCAGGCTATAGAAGATGGCAGACTCTGAGGATATT
CAGCCCCTCGTCTGTGATAATGGAACAGGAATGGTTAAGGCCGGATTTGCTGGAGATGACGCTCCAAGGGCTGTTTTCC
CTAGTATTGTGGGTCGCCCTCGCCACACCGGTGTGATGGTTGGTGTGGGACAGAAAGATGCGTATGTTGGGGATGAAGC
TCAATCAAAGAGGGGTATCTTAACTTTAAAATACCCAATTGAGCACGGTATTGTGAGCAACTGGGATGACATGGAGAAA
ATCTGGCATCACACTTTCTACAATGAGCTCCGTGTGGCCCCAGAAGAGCACCCAGTTCTCCTCACTGAAGCACCTCTCA
ACCCAAAGGCTAATCGTGAGAAGATGACTCAAATCATGTTCGAGACCTTCAACACTCCTGCCATGTATGTTGCCATCCA
GGCTGTTCTGTCCCTATATGCCAGTGGTCGTACTACTGGTATTGTCTTGGATTCCGGGGATGGTGTCAGCCATACAGTT
CCCATCTATGAAGGTTACGCCCTACCACACGCCATCCTGCGTCTTGACCTCGCAGGACGTGATCTCACTGATGCGTNGA
TGAAAATCTTGACGGAGCGCGGTTACTCTTTCACCACCACAGCCGAGCGGGAAA

> SEQ ID NO:1304 105405 168242_300554_1
GAATTCGACCAAACCTTTTCACTCTATATGGTCTTGTGTTTCTTCTTCTCTTTCAGTAGAGAGAAGAGAAAACCCAGTG
GAGAAATCACAATTTCAGTCTCTCACTCTATAACTCTAAAAGGCGCGCATTAAGCAATGGCAGATGGTGAGGATATCCA
GCCCCTTGTATGTGACAATGGAACAGGAATGGTGAAGGCTGGATTTGCTGGAGATGATGCTCCAAGAGCCGTATTCCCT
AGTATCGTTGGTCGACCTAGACATACTGGTGTTATGGTTGGAATGGGACAGAAAGATGCATATGTTGGTGACGAGGCTC
AGTCTAAAAGAGGTATTCTTACGTTAAAATACCCAATTGAGCATGGTATTGTAAGCAACTGGGATGATATGGAAAAGAT
CTGGCATCACACCTTTTACAACGAGCTTCGGGTGGCTCCCGAAGAACATCCAGTTCTCCTTACTGAAGCCCCTCTCAAT
CCTAAAGCCAACAGAGAGAAGATGACACAGATTATGTTTGAAACTTTCAATGTCCCTGCCATGTACGTTGCCATTCAAG
CTGTGCTTTCTCTTTATGCCAGTGGTCGTACCACAGGTATT

> SEQ ID NO:1305 105405 157954_301744_1
ATGATAACCAACGAATTCCTCCTCAACAGAAATTGAATTTGAGGCTCATTTAAGCTCATATTCATTTCCTGTTTAGAGG
AGTTATACTTTCAAAGCAAGAACGCGGCTAGCACAATAGGCCATCACCAACAATAACCATATTGGCAAAATCCATTTAA
GCACATAAAAGATGGCAGAAGGTGAGGAAATTCAGCCTCTTGTCTGTGATAATGGAACTGGAATGGTTAAGGCTGGATT
CGCTGGAGATGATGCTCCAAGAGCTGTGTTCCCTAGCATTGTTGGACGCCCTCGTCACACTGGTGTGATGGTTGGCATG
GGCCAGAAGGATGCTTATGTTGGTGATGAGGCTCAATCCAAAAGGGGTATTTTGACTTTGAAGTATCCAATTGAACACG
GAATCGTTAGCAATTGGGATGATATGGAGAAAATTTGGCATCACACCTTCTACAATGAACTTCGTGTGGCTCCAGAAGA
ACACCCTGTTCTCCTCACAGAAGCTCCTCTTAATCCAAAGGCCAATCGAGAAAGATGACTCAGATCATGTTTGAGACC
TTCAACGCCCCTGCCATGTATGTCGCCATTCAGGCTGTTCTTTCCCTCTATGCCAGTGGACGTACAACTGGTATTGTGC
TGGACTCTGGTGATGGTGTCAGCCACACAGTTCCCATCTATGAAGGTTATGCTCTCCCACACGCAATCCTGCGTCTTGA
TCTGGCAGGGCGTGATCTCACAGATCACCTCATGAAGATTCTCACAGAAAGAGGCTACTCTTTTACCACCACGGCCGAG
CGGGAAATTGTTAGGGATGTGAAGGAGAAGTTGGCTTACATTGCTCTTGACTATGAACAAGAACTTGAAACAGCAAAGA
CCAGCTCATCCGTGGAGAAGAGCTACGAGCTGCCTGATGGACAAGTCATCACCATTGGTGCTGAGAGATTCCGCTGCCC
AGAAGTTCTGTTCCAACCATCAATGATCGGAATGGAAGCTGCTGGCATTCaTGAAACCACATACAATTccATCATGAAG
TGTGACGTTGACAtCaGaaaggaTCTGTACggaaACATTGTccTCAGTggTGGTACCACCATGtTcccgggCAttGCTG
ATAggATGAGcAaggaaattaCTGCa > SEQ ID NO:1306 105405 146560_301066_1
ctaaactcttttctctctacaatttcgaaggaagtagcatgagatggcagatggagaggatattcagccacttgtctg
tCACAATGGAACAGGAATGGTCAAGGCTGGGTTTGCTGGAGATGATGCTCCACGAGCTGTATTCCCTAGTATTGTTGGC
CGGCCCCGCCATACTGGTGTGATGGTGGGTATGGGTCAGAAAGATGCCTACGTGGGAGATGAAGCTCAATCAAAAAGAG
GTATTTTAACTCTTAAATACCCAATTGAGCATGGTGAATTGTCAGCAACTGGGATGATATGGAGAAGATCTGGCATCAC
ATACTTTCTACAATGAGCTTCGTGTTGCGCCCGAGGAGCATCCAGTCCTCTTAACTGAAGCGCCTCTTAACCCAAAGGCTAAT
CGTGAAAAGATGACCCAGATTATGTTTGAGACTTTTAATACCCCAGCTATGTATGTTGCTATTCAGGCTGTCCTCTCAC
TGTATGCCAGTGGTCGTACCACCGGTATTGTGTTGGACTCTGGTGATGGTGTCAGCCACACCGTCCCAATTTATGAGGG
GTATGCCCTCCCACATGCCATTCTCCGTCTTGACTTGGCAGGCCGTGACCTCACTGATAGTTTGATGAAGATCCTTACC
GAGCGTGGTTACATGTTCACCACCTCAGCTGAGCGGGAAATTGTCAGGGACGTGAAaGaAAAGCTTGCTTACATAGCTC
TTGAatATgaacaggAaCTCGAGACTgcaaaGACCAGCTCTTCTGtagagaagaaCTATGagcTACCGGATGggcagGT
GATCACCAttGGTGCTg > SEQ ID NO:1307 105405 137183_300502_1
CCCGGTCGACTCCACTCTCGCCTCCTCGCGGGTCGGAGTTCACCGCCGCCACCGCCGATCTCCCCGTCCCGCCGCCC
GCCGCCGCCGTCCTCCCTCCTCCCGCCGCATCCCGGAATTCAGAACCAGTAGGAGGAAATGGCTGACGGCGAGGACATC
CAGCCCCTTGTGTGTGACAATGGAACTGGCATGGTCAAGGCTGGGTTTGCTGGGGACGATGCGCCCAGGGCTGTTTTCC
CTAGTATCGTGGGGCGCCCCCGTCACACCGGTGTGATGGTTGGTATGGGGCAGAAGGATGCCTATGTTGGTGATGAGGC
GCAGTCCAAGAGAGGTATCCTCACCTTGAAGTACCCGATCGAGCATGGTATTGTTAGCAACTGGGATGACATGGAGAAG

FIG. 2 continued

ATCTGGCATCACACCTTCTACAACGAGCTCCGTGTCGCGCCCGAGGAGCACCCTGTGTTGCTGACTGAGGCCCCGCTCA
ACCCCAAGGCTAACAGGGAGAAGATGACCCAGATCATGTTTGAGACTTTCAATGTGCCAGCTATGTATGTCGCCATCCA
GGCCGTGCTCTCCCTGTATGCCAGTGGACGTACAACTGGTATCGTGTTGGACTCTGGTGATG

> SEQ ID NO:1308 105405 127823_300473_1
ttcacccGCTATTCAGTCAAACAGCAAAAAGGGTTTGATTTCAATCAAGTCCTTAGAAGATGGCTGAAGGTGAGGACAT
TCAACCACTCGTTGTTGACAATGGAACTGGAATGGTTAAGGCTGGCTTTGCTGGAGACGATGCTCCAAGGGCTGTATTT
CCTAGTATAGTTGGTCGTCCTAGACACCAAGGAGTAATGGTCGGGATGGGGCAAAAAGATGCCTATGTTGGTGATGAAG
CTCAGTCTAAAAGAGGTATTCTGACTTTGAAATATCCGATTGAACATGGTATTGTCAGCAACTGGGATGACATGGAGAA
AATTTGGCATCATACATTTTACAATGAGCTTCGTGTTGCTCCCGAGGAGCATCCTGTTCTTCTTACTGAGGCACCACTT
AACCCCAAGGCAAACCGAGAGAAAATGACCCAGATCATGTTTGAGACCTTCAATGTGCCAGCCATGTATGTTGCAATCC
AGGCCGTTCTTTCTCTGTATGCTAGTGGTCGTACTACTGGTATTGTGCTTGATTCTGGTGATGGTGTGAGCCACACTGT
CCCCATCTATGAGGGATATGCACTTCCCCATGCCATCTTGAGGTTAGATCTTGCTGGTCGTGATCTTACTGATTATCTC
ATGAAGATTCTCACTGAGAGAGGTTATATGTTTACCACATCTGCTGAACGGGAAATCGTTCGTGATGTGAAGGAGAAGC
TTGCCTATGTCGCATTGGATTTTGAACAGGAGCTTGAGACAGCAAAGAGTAGCTCATCAGTTGAGAAGAGCTATGAGCT
TCCTGATGGACAAGTAATTACTATTGGTGCTGAGAGGTTCCGTTGCCCTGAAGTCCTCTTCCAGCCATCATTGATTggA
ATGGAAGCAGCAGGAATTCATGAAACAACCTATAACTCAATCATGAAATGTGATGTGGACAttaggaaGGAtTTATATG
GAAAtattGTActcagTggTggaTcaaCTAtg > SEQ ID NO:1309 105405 119919_300361_1
cggacgcgtgggTTTCCAAATACTCTCGAGAAAGCCGCCGGCCATCATCTCCGGTTGCTTTGCTACTTTCCGGTGTCTT
CTTTCCGATCTCCTTAGTTTTGGTTGAATAGAAAATGGCTGACGGTGAGGATATTCAGCCCCTTGTTTGTGACAATG
GAACTGGAATGGTGAAGGCTGGATTTGCTGGTGATGATGCTCCTAGAGCTGTGTTTCCTAGCATTGTGGGTCGTCCCCG
CCACACTGGTGTTATGGTTGGAATGGGACAGAAAGATGCCTATGTGGGTGACGAAGCTCAATCCAAGAGGGGTATCTTG
ACCCTGAAGTACCCAATTGAGCACGGTATTGTCAGCAACTGGGATGACATGGAGAAGATATGGCATCATACCTTCTACA
ACGAGCTTCGTGTTGCCCCCGAGGAGCACCCTGTTCTTCTCACTGAAGCACCTCTCAACCCAAAGGCCAACAGAGAGAA
AATGACCCAGATTATGTTTGAGACATTCAACGTTCCGGCTATGTATGTTGCTATTCAGGCTGTCCTTTCCTTGTATGCT
AGTGGTCGTACAACTGGTATTGTCTTGGATTCTGGTGATGGTGTGAGCCACACTGTCCCCATCTACGAGGGTTATGCTT
TGCCTCATGCCATTCTTCGTTTGGACCTTGCTGGCCGTGACCTAACTGATAACCTGATGAAGATCCTCACTGAGAGAGG
TTACATGTTCACCACCACTGCTGAACGGGAAATTGTCCGTGACATGAAGGAGAAGCTTGCTTATGTGGCTCTTGACTAC
GAGCAGGAGCTTGACACTGCCAAGAGCAGCTCCTCCGTCGAGAAGAACTATGAATTGCCTGATGGACAAGTTATTACCA
TTGGTGCTGAGAGGTTCCGTTGCCCAGAAGTCCTCTTCCAGCCATCCATGATCGGAATGGAAGCTGCAGGTATCCATGA
GACTACCTACAACTCCATTATGAAGTGTGATGTTGATATCAGGAAGGACCTCTACGGTAACATTGTGCTCAGTGGTGGC
TCAACCATGTTCCCCGGCATTGCTGATCGTATGAGCAAGGAAATCACTGCTTTGGCTCCTAgCAGCATGAagattaagg
ttgttGCtccaCCggagagaaagtAcagTGTCTggATaggaggatccatccTCGCATCCCttagcACATtccagcAgat
gtggATTTCaaagggtGAG > SEQ ID NO:1310 105405 11955_300070_1
TGGTATCAACGCAGAGTGGCCGTTACGGCCGGGGGGTTTCATTTGAATTTTTCTTGTTTTTGCATTTGGAACTCATAG
CCAACCGTGGACACCACTAATTTACTCCTCCTAAAGCTCCCTCTTTTTTACACAAAGTAGATAAAACATGGCAGACGGT
GAGGATATTCAGCCACTCGTCTGCGATAATGGGACTGGAATGGTCAAGGCAGGGTTTGCTGGAGATGATGCTCCAAGAG
CAGTATTTCCGAGTATTGTTGGTCGCCCACGCCACACAGGTGTGATGGTTGGCATGGGGCAAAAAGATGCATATGTTGG
TGATGAAGCTCAATCCAAACGTGGTATTCTAACTTTGAAATATCCAATTGAACATGGTATTGTTAGCAACTGGGATGAT
ATGGAGAAAATCTGGCATCACACGTTCTACAACGAACTTCGTGTTGCACCAGAGGAGCATCCTGTACTACTCACTGAAG
CACCTCTTAACCCGAAGGCTAATCGCGAAAAAATGACTCAAATCATGTTTGAGACATTTAATGCTCCTTCTATGTATGT
CGCCATTCAAGCCGTTCTGTCCCTTTATGCTAGTGGTCGTACAACAGGTATTGTCCTCGATTCTGGTGATGGTGTTAGC
CACACTGTTCCAATCTATGAGGGATATGCTTTGCCACATGCTATCCTTCGTCTTGATTTAGCCGGTCGTGACTTGACCG
ATCACCTAATGAAAATC > SEQ ID NO:1311 105405 1171777_302057_1
GCTCTCTTCCTCCGTCGCGGAAGGCCATCGCTCATCAGTCTCATAGCGAGCTATGGCGGACGGGGAAGAGGTCCAGCCC
CTTGTTTGTGACAATGGAACCGGAATGGTGAAGGCTGGGTTTGCGGGAGATGATGCACCCCGTGCCGTGTTCCCGAGCA
TAGTGGGGCGGCCTAGGCATACGGGGTCATGGTGGGCATGGGGCAAAAGGATGCTTACGTCGGCGATGAGGCCCAATC
GAAACGTGGTATCTTGACTCTGAAGTATCCGATCGAGCACGGCATTGTGACCAACTGGGATGACATGGAGAAGATATGG
CACCACACTTTCTACAATGAGCTCCGAGTAGCACCTGAGGAACACCCCGTGCTTCTCACAGAGGCACCCATGAACCCCA
AGGCCAATCGAGAGAAGATGACCCAGATCATGTTTGATACCTTTAACGTTCCGGCCATGTATGTCGCTATTCAAGCTGT
TCTTTCTCTCTATGCTAGCGGAAGAACAACCGGTATAGTGATGGATTCGGGTGATGGTGTCACTCATACGGTCCCCATC
TATGAAGGCTACGCGCTTCCGCATGCGATTCTCCGTCTTGACCTTGCGGGGCGAGACCTAACTGACGCTCTAATGAAGA
TCTTGACTGAGCGTGGGTACGCCTT

FIG. 2 continued

> SEQ ID NO:1312 105405 1170771_302037_1
TCGAGCTCAAGCAGATCCAACAAGCCATACCTCTCCCTGGTGAACACTTGACAAATCATGGCGGATCTCGAGGAAGTGT
CACCCCTTGTCTGTGATAATGGAACTGGGATGGTGAAGGCTGGGTTTGCTGGCGATGATGCGCCTCGTGCAGTTTTTCC
AAGTATTGTTGGAAGGCCACGGCATACAGGTGTTATGGTTGGTATGGGGCAGAAGGATGCATATGTTGGGGATGAGGCA
CAATCTAAGCGTGGTATTCTTACTTTGAAGTATCCTATTGAACATGGAATTGTGACCAATTGGGATGACATGGAGAAAA
TTTGGCACCACACTTTTTACAATGAGCTCCGCGTTGCTCCAGAGGAGCACCCTGTACTTCTTACTGAGGCTCCTATGAA
CCCCAAGGCCAACCGCGAAAAAATGACTCAAATCATGTTTGATACCTTCAACGTACCAGCTATGTACGTGGCCATTCAG
GCAGTTCTCTCCTTGTATGCCAGTGGAAGAACTACCGGCATTGTGCTTGATTCTGGTGATGGTGTCTCTCATACTGTGC
CAATTTATGAGGGCTATGCATTGCCACACGCCATTCTTCGGCTGGATCTGGCTGGGCGTGATTTGACGGATGCACTCAT
GAAAATCCTAACAGAGCGTGGCTATTCCTTCACAACAACCGCAGAAAGAGAAATTGTGAGGGACATGAAG

> SEQ ID NO:1313 105405 111416_300055_1
cctcattctccctcagcttttccttttctggttctataatatgggaataagttccagcctgctgtcccaggacctccac
cTAAGCCCCCAAAAACTGTTTTAGGAAAAAATGGCAGATGGTGAGGATATCCAGCCACTTGTCTGTGATAATGGGACTG
GAATGGTTAAGGCTGGATTTGCTGGAGATGATGCTCCAAGAGCAGTGTTCCCTAGCATTGTCGGTCGCCCTCGTCACAC
AGGAGTAATGGTAGGAATGGGACAGAAAGATGCATATGTAGGAGATGAAGCTCAATCCAAACGTGGTATTCTCACATTA
AAATACCCAATTGAGCATGGTATCGTTAGCAATTGGGATGACATGGAGAAAATTTGGCATCATACTTTTTACAACGAAC
TTCGTGTAGCTCCAGaggAGCACCCTGTTCTACTCACTGAAGCACCTCTTAACCCGAAGGCTAATCGCGAAAAGATGAC
TCAAATCATGTTTGAGACATTTAATACTCCTGCTATGTATGTCGCCATTCAAGCCGTTCTATCCCTCTATGCCAGTGGT
CGTACAACAGGTATTGTCCTGGATTCTGGTGATGGTGTTAGCCACACTGTCCCAATCTATGAGGGATATGCTTTGCCAC
ATGCTATCCTCCGTCTTGATTTAGCCGGTCGTGACCTGACCGATCACCTAATGAAAATCTTAACAGAGCGCGGTTACTC
GTTCACTACTAGTGCTGAACGAGAAATTGTGAGGGATGTGAAGGAAAAACTCTCCTACATTGCGCTTGACTTTGAGCAG
GAAATGGACACGTCGAAAACTAGCTCTTCTGTTGAGAAGAGCTACGAGTTGCCCGATGGTCAAGTGATTACCATCGGTG
CTGAGCGTTTCCGATGCCCTGAAGTCCTTTTCcAACCTTCAATGATTGGAATGGAAGCTGCAGGCATTCACGAAACGAC
TTACAACTCGATCATGAAGTGCGACGTgGaTAtcagaaaggaTCTGTATgggaacAttGTACTCAgtg > SEQ ID NO:1314 105405 111360_300054_1
cccttcctcttctctacttctccttccttagctccaccgtaatgtttaactggtttttaagagatggctgattcagaaga
tATTCAACCCCTTGTCTGTGATAACGGAACAGGAATGGTTAAGGCTGGATTTGCTGGTGATGATGCTCCGAGGGCTGTT
TTTCCTAGTATTGTTGGTCGACCTCGACACACCGGTGTTATGGTTGGTATGGGTCAAAAGGATGCATATGTTGGTGACG
AAGCTCAGTCCAAAAGGGGTATTCTCACCTTGAAGTATCCCATTGAGCATGGAATAGTAAGCAACTGGGACGATATGGA
GAAGATCTGGCATCATACCTTTTACAATGAGTTACGTGTTGCTCCTGATGAGCATCCTGTGCTACTTACTGAAGCACCC
TTGAATCCAAAGGCCAATAGAGAGAAGATGACGCAGATCATGTTTGAGACTTTCAATGTGCCTGCCATGTATGTTGCTA
TTCAAGCTGTGTTGTCTCTATACGCCAGTGGCCGTACAACAGGTATTGTGTTGGATTCTGGCGATGGTGTCTCACATAC
TGTACCAATTTATGAAGGTTACGCCCTTCCTCATGCAATTCTTCGGTTGGATCTTGCTGGTCGTGATCTTACTGATTGT
TTGATGAAAATCTTGACGGAAAGAGGTTATTCATTCACCACTAGTGCTGAACGGGAAATTGTCCGCGATGTTAAAGAGA
AACTGGCATATGTTGCACTTGACTATGAGCAAGAGTTGGAGACTGCAAAGAGTAGCTCTTCTGTTGAGAAAAGCTATGA
GTTACCAGATGGGCAGGTGATTACCATTGGCTCAGAGAGGTTCAGATGTCCGGAAGTTTTATTCCAGCCATCACTTGTT
GGAATGGAAGCTGCTGGAATTCACGAAACAACTTACAATTCCATCATGAAAATGTGATGTAGATATAAGAAAAGATCTTT
ATGGAAACATCGTCCTTAGTGGTGGAACAACAATGTTTCCTGGTATTGCagaTCGTATGCAGCAAGGAAATTACTGCTCT
CGCTCCCAGCAGCATGAAGatcAAGGTGGTgGCGCCTCcagaaCGCAAGTACAGTGTCTGGATTGgAGGatCTATCTta
gcttcccTCagcaccTtccaaCAGATGTGGATaacaaaaggtgaaTATGATg > SEQ ID NO:1315 105405 11095_300288_1
CTCGAGCTTGCGGCCGCAGGAGATGATGCTCCCAGGGCTGTTTTTCCCAGTGTTGTTGGTAGGCCAAGACATCATGGTG
TCATGGTTGGGATGAACCAGAAGGATGCATATGTTGGTGATGAAGCACATCCAAGAGAGAGGTATTTCTTACCTTGAAGTA
TCCTATTGAGCATGGTGTTGTTAGCAACTGGGATGATATGGAAAAGATCTGGCATCACACTTTCTACAATGAGCTTCGT
ATTGCTCCTGAAGAGCACCCTGTTCTTCTTACCGAGGCTCCTCTTAACCCAAAGGCCAACAGAGAGAAGATGACTCAAA
TCATGTTTGAGACCTTTAACTCTCCCGCTATGTATGTCGCCATCCAAGCTGTTCTCTCCTTGTACGCCAGTGGTCGTAC
AACCGGTATTGTGCTGGATTCTGGTGATGGTGTGTCTCACACTGtgCCAATCTACGAgggttTCTCTCTTCCTCATGCC
ATCCTCCGTCTTGACCTTGCTGGACGTGACCTTACTGATTACCTCATGAAGATccTTACAGAGAGggttACATGTTCA
CCACAACAGCAGAGCGGGAAATTGTAAGAGACATCAAGgAGAAGCTCTCctttgttgctgttgaCtacgagcaggaGAt
ggaaACCTCAaagaccagctcttccatCGAGaagaaCTATGaATtAcccgATgggCaaGTCATcAcGa > SEQ ID NO:1316 105405 187706_300680_1
AGAGCATCCAATTCTTCTTACGGAGGCTCCACTTAACCCTAAGGCCAACAGGGAGAAGATGACACAAATTATGTTTGAG
ACATTCAGCGTTCCAGCCATGTATGTCGCTATTCAAGCCGTGCTTTCCCTCTATGCTAGTGGACGTACTACTGGTATTG
TCTTGGATTCTGGAGATGGTGTCAGTCACACAGTCCCAATCTACGAAGGTTATGCCCTTCCGCATGCCATTCTCCGTCT

FIG. 2 continued

```
TGATCTTGCTGGTAGGGATCTGACTGATTCCCTCATGAAGATCCTGACTGAGAGGGGTTACTCATTCACCACCTCTGCC
GAGCGGGAAATTGTCCGTGACATCAAGGAAAAGCTTGCATACGTCGCTCTTGACTACGAGCAGGAGCTTGAGACTGCAA
AGAGCAGCTCATCAGTTGAGAAGAGCTATGAGCTGCCCGATGGACAGGTGATCACCATTGGCGCGGAGCGCTTCAGATG
CCCAGAGGTCATGTTCCAGCCTTCTCTCATCGGCATGGAAGCTCCAGGCATCCACGAGACGACATACAACTCCATCATG
AAGTGCGATGTTGATATCAGAAAGGACCTGTATGGTAACATTGTTCTCAGTGGTGGATC

> SEQ ID NO:1317 105405 1098727_301486_1
attccgaaaaacagaaagagcgccgccctcagatccgcagaatacatacagatacagataatacagataatacagatat
aCTCATAATACAGATTGAGCTACAGGTACAGGCAAGGTTTTCTCATAGCAAGTGATGGCGGATTCAGAAGAGGTGCAGC
CTCTTGTCTGCGACAATGGAACTGGAATGGTTAAGGCAGGGTTTGCGGGAGATGATGCACCTCGTGCTGTATTTCCTAG
TATTGTGGGCCGTCCAAGACACACGGGTGTTATGGTTGGTATGGGGCAGAAGGATGCATATGTCGGGGATGAGGCTCAA
TCAAAGCGTGGGATTCTTACCTTGAAGTACCCCATCGAACACGGCGTTGTCACCAACTGGGATGACATGGAGAAGATTT
ggCACCACACATTCTACAATGAGCTTCGTGTCTCCCCAGATGAGCATCCTGTCCTCCTCACAGAAGCCCCCATGAaCCC
TAAGGCCAATCGTGAAAAAATgacTCAGAtAatgtttgacaCTTTCAAtgtgcctggcatGTACgttgcCATTCAGGCC
GTTCTCTCCCTTTATgccaGtggaagaaCTACtggtatAGTACTTgatTCCgg > SEQ ID NO:1318 107101 129393_300405_1
CCCCCCCCCGAAGCCGAGCAGAGCAGATGGGTAGCGCAGCGCAGCCCAGCAAGCAGCCTCGCTAGCTCTCGCAAACCTT
CGCCACCAAGAACCCGGAAACCCCCTCTTCCAGAAGCTTCTGGAATCAATCTCCGGTCGAGCAACATGCAGGAGTTCCA
CCCCGTCCCCGGGCTGGCCGGCCGCTGTTCGGCGGCCGGCCGGCCGGCCGGCCGCCGGTGCCGGCGGTGGAGGAGGTGCGG
TGCCCGCGGTGCGACTCGTCGAACACCAAGTTCTGCTACTACAACAACTACAACCTCTCCCAGCCCCGCCACTTCTGCA
AGGCGTGCCGCCGCTACTGGACCAAGGGCGGGCTCCTCCGCAACGTCCCCGTCGGCGGCGGCTGCCGCAAGCCCAAGCG
CCCGGCGCCGCCGCCGTCGTCCTCCTTCACCGGC > SEQ ID NO:1319 107101 201267_300714_1
GTCGCCTGCACGGCACCGACGAGAGAGCGCGCGCGCGTGTTCGTCCGAGCTTTTCTGCGGTCGCGCGGTGCAGGAGGCG
GGGCGACGGCCGGCCGCCGCAGTTCGCCGGCGTGGACCTCCGCCGCCGAAGGGGTACCCGGCGGCGGGGCAGCTGACGC
CGGCGGCGGAGGAGGCGGTAGCCGGGGTGGGCGACCCGTGCCCGCGGTGCGAGTCGCGGGACACCAAGTTCTGCTACTA
CAACAACTACAACACGTCGCAGCCGCGGCACTTCTGCAAGTCGTGCCGCCGCTACTGGACCAAGGGCGGCTCCCTCCGC
AACGTCCCCGTCGGCGGCGGGTCCCGCAAGAGCTCGACTTCCTCCTCCTCCGCCGGCGCCGCCGCCGCCTCATCGTCGT
CGTCGCCTTCTTCGCCAGGCAATAGCCCCAAGCGCTCCAAGAACTCCAAGCGCCGGCGCGTCTCTCCGCCCCCTCAGGC
CGGGGCCTGCGC > SEQ ID NO:1320 107101 282216_200073_1
AAAACATGTAAATTTAATTTCTTTTAAGTTCAAATATCCGTACGAACATTCTAGCTAGGTATTTCAAATTTTGTTTACT
AGTGATTAGGAGTATATATATGTAGTGTTGTAAGGGTTCATCGGAAATTAATTAGTTTTACGATAATTTGTTAACCTAC
TACAGTCCTCCTTATATTTTAGTTAAGCTTGCGATCAACAATGTAAGTAAGTTTAATTAGACTCTAATCTCTCTTTTT
TATTTGTGATTTTACAGGAAATGTCATCCCAAACACTAGAAAGCATGTTGGTATGCACAAAGCAAGATCAAGAAAAGAA
AACAAGACCAGCTGCAGAACAAGCACAAAAATGTCCAAGATGTGACTCAACCAACACAAAATTCTGCTACTACAACAAC
TACAGTCTAACTCAACCTAGATACTTTTGCAAATCATGTAGAAGGTATTGGACCAAAGGTGGTACACTAAGAAATGTTC
CAGTTGGTGGTGGCTGTAGAAAAAACAAAAGAATATCCTCAAAGAGAAGTCAAGATCAGTCTTTGACTAATAGCCCTAA
TAATGCTATATCTTCTATCACACCAACTTCTTATGATTCTTCAAGTGATTTAAGTCTAGCATTTGCT > SEQ ID NO:1321 107594 234073_301096_1
ATTTGAGGAGGCTGTTCTTCCCGGCTGTGAAGGCGCTGCTTCTCAAAGGCAATCGAAGATGCGTGAGATTCTCCACATC
CAGGGTGGACAATGCGGCAACCAGATCGGTGCCAAGTTCTGGGAGGTGATCTGCGACGAGCACGGGATCGATCCCACCG
GGAACTACCACGGTGACTCGGATCTCCAGCTCGAGAGGATCAATGTCTACTACAATGAGGCCACTGGTGGGCGCTTCGT
TCCCCGCGCCGTGCTCATGGATCTGGAGCCGGGCACCATGGACAGCGTGAGATCTGGGGTTTTTGGGCAGATCTTCCGG
CCGGATAACTTCGTGTTTGGTCAAACCGGGGCTGGCAACAACTGGGCCACGGGGCATTACACTGAAGGGCCGAGCTCA
TCGATTCCGTGCTGGATGT > SEQ ID NO:1322 107594 274632_200058_1
gggcggacgcgtgggCTGAGAACCACATTCACAATTCGAATTTCGAAAACTCATCTCTTTCTGTTTAAACGGCGTCTTG
ATAAACGCCGCTTTTTCTCCTCTTTGAAATTTGAATTTTTAGGGTTTCGGTGAAAATGAGAGAGTGCATTTCGATCCAC
ATTGGTCAGGCTGGTATTCAGGTCGGAAATGCCTGCTGGGAACTTTACTGCCTGGAGCACGGCATTCAGCCTGATGGCC
AGATGCCAGGTGACAAGACTGTTGGAGGGGGTGATGATGCATTCAACACCTTCTTCAGTGAAACTGGAGCTGGAAAGCA
TGTCCCTCGGGCTGTCTTTGTAGATCTTGAGCCCACTGTCATTGATGAAGTGAGGACAGGAACATACCGACAGCTCTTT
CACCCTGAACAGCTCATAAGTGGCAAGGAAGATGCAGCCAATAACTTTGCCCGTGGTCACTATACCATTGGGAAAGAGA
TTGTTGATCTTTGCTTGGATCGCATCCGAAAGCTTGCAGACAACTGTACTGGTCTTCAAGGGTTCCTGGTTTTCAATGC
```

FIG. 2 continued

```
TGTTGGTGGTGGTACTGGTTCAGGTCTGGGGTCGCTTCTTCTGGAGCGTCTCTCTGTTGACTACGGAAAGAAGTCAAAA
CTTGGTTTCACAATTTACCCTTCACCACAGGTCTCAACTTCTGTTGTTGAGCCTTACAACAGTGTCCTGTCAACTCATT
CCCTCCTTGAGCACACTGATGTTTCCATTCTTCTGGACAATGAAGCCATTTATGACATTTGCAGGCGCTCTCTGGACAT
TGAGCGCCCTACTTACACCAACCTTAACCGCCTTATCTCACAGGTTATCTCTTCACTCACAGCGTCTTTGAGGTTTGAT
GGTGCTTTGAATGTTGATGTGAATGAATTCCAGACCAATCTTGTGCCATATCCCAGGATCCATTTTATGCTTTCCTCAT
ATGCTCCTGTCATTTCTGCTGAGAAGGCCTACCATGAGCAGCTCTCAGTTGCAGAGATCACCAACAGTGCTTTTGAGCC
ATCTTCCATGATGGTTAAGTGTGACCCTCGTCATGGCAAGTACATGGCTTGCTGTCTCATGTTCCGTGGTGATGTGGTG
CCCAAGGATGTTAATGCTGCTGTGGCCACCATCAAGACTAAGCGCACCATCCAATTTGTTGACTGGTGCCCTACTGGAT
TCAAGTGTGGTATTAACTATcagccaccaacTgttgttcctGGTGGCGAccttgctaAggTGCAGAGGGCTGTTTGCAT
GatttcCAACTCAACCAGTGTTGCTGAGGTCTTCTCACGCattg > SEQ ID NO:1323 107594 271510_200035_1
CTCTTCTCTGCCGCCTCTCATTTCTGAGATCTACGCATTTTTCTTCAAATTTCTGCATCTTCTTTTCCAGATCTCAGTT
TAAAAAATGCGTGAAATCCTTCACATTCAAGGTGGACAATGCGGCAACCAAATCGGTGCCAAGTTCTGGGAAGTTGTTT
GTGCCGAACACGGCATTGACTCCACCGGCCGTTACAACGGCGATTCAGATCTCCAGCTTGAGAGAATCAATGTCTATTA
CAATGAGGCAACCTGTGGAAGGTTTGTTCCTAGGGCTGTTCTTATGGATCTGGAACCTGGTACTATGGATAGCATCAGA
TCTGGTCCGTACGGTCAGATCTTTAGGCCTGATAACTTCGTGTTTGGTCAGTCTGGTGCTGGCAACAATTGGGCTAAAG
GACATTACACTGAAGGCGCTGAATTGATTGATGCTGTCCTTGATGTTGTTCGTAAGGAAGCTGAAAATTGTGACTGCCT
TCAAGGATTTCAAGTGTGCCACTCATTGGGTGGAGGTACGGGATCTGGAATGGGAACCCTTCTGATATCAAAGATCAGA
GAAGAATATCCCGATAGAATGATGCTTACGTTCTCAGTtttcccgTCTCctaaggttTCTGACAcTgttGttTGAGcctt
AtAATGCTACtttGTCGgtgCatCagtTGGTtGa > SEQ ID NO:1324 107594 8481_300295_1
aattcggcacgagatctcttctgtttaaacggcgtcttgataaacgccgcttttctcctctttgaaatttgaatttt
tAGGGTTTCGGTGAAAATGAGAGAGTGCATTTCGATCCACATTGGTCAGGCTGGTATTCAGGTCGGAAATGCCTGCTGG
GAACTTTACTgcCTCGAGCACGGCATTCAGCCCGATGGCCAGATGCCAGGTGACAAGACTGTTGGAGGGGGTGATGATG
CATTCAACACCTTCTTCAGTgAAACTggAGCTGGAAAGCATGTCCCTCGGGCTGTCTTTgtagATCTTGAGCCCACTgt
cATTGATGAAGtgaggACAggaACATACCGACAgctcttCAccCTGaacagctcat > SEQ ID NO:1325 107594 6719_300347_1
GACCCACGCGTCCGCCCAATCTCGCCGGGATTCTCCTCTGCACCATAAAATAGAAGATGAGAGAAATCCTTCACATTCA
AGGTGGTCAATGTGGGAACCAGATTGGTTCCAAGTTCTGGGAAGTTGTATGTGATGAGCATGGTATTGATCCCACTGGT
CGTTACGTTGGAAACTCTGATCTGCAGTTGGAGCGTGTCAATGTTTACTATAACGAGGCATCCTGCGGAAGATATGTTC
CCCGTGCAATTCTCATGGATCTTGAGCCTGGTACTATGGACAGTGTCAGAACTGGACCTTATGGTCAAATCTTCAAGCC
TGACAACTTTGTTTTCGGGCAATCTGGTGCTGGAAACAACTGGGCTAAAGGGCATTACACTGAAGGAGCTGAGCTTATT
GATGCTGTACTCGATGTTGTACGCAAAGAGGCTGAGAATTGCGACT > SEQ ID NO:1326 107594 57188_300378_1
aaatatctcaaatccccacccctctaaattcacacattctgtttctctcttaccctaGTTCCATTTGCCATTTCAGTTT
TTCAAATTCCTCCAAAAAAGAGAGAAAATGAGAGAAATCTTACACATTCAAGGCGGCCAATGCGGTAACCAAATCGGTT
CCAAATTCTGGGAAGTTATCTGTGATGAGCACGGCGTTGATCCTACAGGCCGTTACAAAGGCACCGCCGCTGAGTCGGA
TCTTCAACTTGAACGTATTAATGTGTATTTCAACGAAGCTTCTGGTGGACGTTATGTTCCTAGGGCTGTTCTTATGGAT
CTGGAGCCTGGTACTATGGATAGTATCAGATCTGGTCCGTATGGTCAGATCTTTCGACCTGATAACTTCGTTTTTGGTC
AGTCCGGTGCTGGTAATAATTGGGCTAAAGGTCATTACACTGAAGGAGCGGAGTTGATTGATGCTGTTCTCGATGTTGT
TCGTAAAGAGGCTGAGAATTGTGATTGCTTGCAAGGATTCCAGGTTTGTCACTCACTCGGTGGTGGGACTGGATCTGGC
ATGGGAACTCTATTGATTTCCAAGATAAGGGAGGAGTATCCAGACAGAATGATGCTCACATTCTCTGTTTTCCCATCTC
caaaggTGTCTGACACTGTTGTAGAaccATAcAaTGCTACACTGTCTGTGcatcaACTGGTGGAGaAcGCTGATGAgtG
TATGgTccttGataatGAagccttATAtGaTatttg > SEQ ID NO:1327 107594 41903_300032_1
aaaaccttcactttcctcactcctattaaatttagcacagaaAAATTCAAAATCACTTAAAAAATGCGTGAGATTTTG
CACATTCAAGGAGGCCAATGCGGGAACCAAATCGGAGCCAAGTTTTGGGAAGTTATCTGTGCCGAACATGGCATTGATT
CCACTGGAAGGTATGCAGGAGACAATGATCTTCAACTGGAGCGGTTGAATGTTTACTATAACGAAGCGAGTTGTGGAAG
GTTTGTTCCACGCGCTGTCCTCATGGATTTGGAGCCTGGAACTATGGATAGTGTCAGATCTGGGCCATATGGTCAGATT
TTCCGGCCCGATAATTTTGTTTTGGACAGTCTGGTGCTGGTAATAACTGGGCCAAGGGTCACTACACTGAGGGAGCCG
AGCTTATTGATTCGGTTCTCGATGTTGTGAGGAAGGAGGCTGAAAACTGTGACTGTCTACAAGGTTTCCAGGTTTGTCA
CTCTTTGGGAGGTGGAACTGGATCAGGAATGGGAACTCTCCTTATTTCAAAGATCAGGGAGGAGTACCCAGATAGAATG
ATGCTTACCTTCTCTGtTTTCCCTTCCCCcaaggttTCAGacaCAGTTgttGagcccTATaATGCTAc
```

FIG. 2 continued

> SEQ ID NO:1328 107594 248173_301580_1
GGTTGGGGTTTGGAATCGAGGGCGTCTTCGCAAACGCTCTAGGGTTTCATCGATCAAGCTCTAGATTCTCGTCGATTGT
CTCGCGCCGCTCCATCCACGATGAGGGAATGCATCTCGATCCACATCGGCCAGGCCGGGATCCAGGTCGGGAACGCTTG
CTGGGAGCTCTACTGCCTCGAGCATGGCATCCAGCCCGATGGGCAAATGCCCAGTGACAAGACGGTCGGAGGAGGAGAC
GATGCGTTCAACACCTTCTTTAGCGAGACTGGCGCTGGGAAGCACGTCCCCCGTGCCGTCTTCTTGGATCTGGAACCCA
CCGTCATCGACGAGGTCCGGACTGGGACCTATCGCCAGCTCTTCCACCCTGAGCAGCTCATCAGCGGAAAAGAAGACGC
TGCTAACAACTTTGCTCGCGGCCACTATACCATCGGGAAGGAGATCGTGGACCTTTGCCTTTGATCGCATCAGGAAGTT
GGCGGACAATTGTACCGGCTTGCAAGGCTTCCTCGTCTTCCATGCTGTGGGCGGTGGGCACCGGCTCGGGTCTTGGTTC
CTTACTGCTAGAGAGGCTGTCCGTGGACTACGGGAAGAAGTCCAAGCTCGGCTTCACTGTCTATCCCTCTCCCCAGGTG
TCGAC

> SEQ ID NO:1329 107594 251881_301661_1
AGCCAACACACAATGAGAGAAATTGTACACATCCAAGCAGGTCAATGTGGTAACCAAATCGGAGCCAAGTTCTGGGAGG
TCATCTCTGACGAGCACGGCATTGACCCCACCGGTTCTTACCACGGTGATAGCGACCTTCAACTCGAAAGAATTAATGT
ATACTACAATGAGGCAACCGGAGGAAAATATGTACCCCGCGCTGTCCTTGTTGATCTCGAGCCTGGTACAATGGACTCT
GTGAGAGCCGGACCTTTCGGACAAATCTTCAGACCTGACAACTTCGTCTTTGGTCAGACTGGTGCTGGTAACAACTGGG
CCAAGGGTCACTACACAGAGGGTGCTGAATTAATCGACTCTGTTTTGGATGTTGTTAGAAAAGAGGCAGAGAGCTGCGA
CTGCCTTCAAGGTTTCCAAATTGCACACTCCCTCGGAGGAGGTACAG

> SEQ ID NO:1330 107594 267343_200117_1
ttttcctctctcattctcctttctctccgttcattttctccgctcctatttcAAAATGCGTGAAATCCTTCACATTCA
AGGTGGACAATGTGGCAACCAAATCGGTGCCAAGTTTTGGGAAGTTGTCTGTGCCGAACACGGCATTGATTCTACCGGC
CGATATGACGGAGATGCAGATCTCCAACTTGAGAGAATCAATGTCTATTACAATGAGGCAACATGTGGAAGGTTTGTTC
CTAGGGCTGTTCTTATGGATCTGGAACCTGGTACCATGGACAGTATCAGATCTGGTCCCTACGGTCAGATCTTTAGGCC
TGATAACTTTGTTTTTGGCCAATCTGGTGCCGGTAATAACTGGGCTAAAGGTCACTACACTGAGGGCGCGGAATTAATT
GATTCCGTTCTTGATGTCGTTCGTAAGGAAGCTGAAAACTGTGATTGCCTACAAGGATTTCAAGTGTGCCATTCATTGG
GTGGAGGAACAGGGTCGGGTATGGGAACCCTTTTGATTTCAAAAATCAGAGAGGAATACCCAGATCGAATGATGCTGAC
GTTCTCGGTTTTCCCTTCCCCTAAAGTTTCTGACACTGTTGTTGAACCATACAATGCTACTCTGTCAGTTCATCAacTa
gttGAAAATGCagaTGAATGTATGGgTcCTTGAcaatg > SEQ ID NO:1331 107594 271388_200033_1
cgttatttattatgcatcttgactaccccTcgaccacgcgtccgcccacgcgtccgcccacgcgtccgcccacgcgtcc
gAAAAGAGGCTGGTTGTTCATTAGGTTTTTATTGTGAAGAGAATTATTGAAATTGGGGACAATGAGAGAAATAATAAGC
ATACACATAGGGCAAGCTGGGATTCAGGTGGGAAATTCATGTTGGGAGCTCTATTGCCTTGAACATGACATCCACCCTG
ATGGCATGATGCCTAGTGACAACTCTCCTGGTGTAGGACATGATGCTTTCAATACCTTCTTTAGTGAAACCAGTGCAGG
GAAACATGTCCCAAGAGCTATATTTGTCGATCTCGAACCCACTGTTATTGATGAGGTGAGAACTGGGACTTATCGCCAG
CTTTTCCATCCCGAGCAGCTCATTTCAGGAAAGGAAGATGCTGCAAATAATTTTGCGAGAGGGCATTATACAGTTGGGA
AGGAGATTGTCGATCTATGCCTTGATCGGGTAAGGAAATTGGCTGACAATTGCACGGGTTTGCAAGGGTTTTTGGTGTT
TAATGCCGTTGGTGGTGGTACTGGTTCTGGATTGGGGTCATTGTTGCTGGAACGTCTATCTGTGGATTATGGAAAAAAG
TCTAAGCTTGGATTTACTATCTATCCTTCTCCCCAGGTATCTACTGCTGTTGTTGAGCCTTATAACAGTGTTCTTTCAA
CTCATTCCCTTCTTGAACACACCGATGTTGTTGTCATGTTGGACAATGAAGCCATTTATGATATCTGTAGGAGATCCCT
AGaCATTGAGaggccTACATATACCAATTTGAATAGACTGATCTCTCAAATCATTTCAtccTTGACCACTTCATTACGG
TTTGATGGAGccaTTaaTGTGGATATTACTGAGttccagacaaacCTgGTACCATATCCTCGCAtccactttatGCTTT
CATcctATGCCCCAGTGATCtCaGC > SEQ ID NO:1332 107594 260674_301716_1
GGAGAGGGTTTCTCTTCCTCATCTTCGAGAGAGAGAGAGAGCTCGCCGGATTATCGCCAGCTCCACAGCGTCATCGC
CTCGATCTACAAGCGAAGATGAGAGAAATCTTGCACATCCAGGGCGGACAGTGCGGCAACCAGATCGGCGCCAAGTTCT
GGGAGGTGATCTGCGACGAGCATGGGATCGATCCCACCGGGACGTATCACGGCGACTCGGATCTTCAGCTGGAGAGGAT
CAACGTCTACTACAACGAGGCCAGCGGTGGCCGCTTTGTTCCGCGGCGGTCCTCATGGATCTGGAGCCGGGCACCATG
GACAGCGTGAGGGCCGGCCCGTTTGGGCAGATTTTCCGGCCGGACAACTTCGTGTTTGGCCAGACTGGCGCCGGCAACA
ACTGGGCCAAGGGACACTACACCGAAGGTGCCGAGCTCATCGATTCCGTCCTTGATGTCGTTCGCAAAGAGGCCGAGAG
CTGTGACTGCCTACAAGGTTTCCAAGTCTGCCATTCCCTTGGTGGTGGCACCGGATC > SEQ ID NO:1333 107594 255663_301644_1
AAGGAAAAAAACCAAACAAGGAAGGAAAAAAAAGAAAAAAAAGGCTTTCTTCTTCTTCTTCTTCTTCTGCTTCTTCCCTC
TGCTTGTGGTGTCCTTGATACCCCTCAACGCAGAGCTTAGGAGAGAGAGAGAGAGAGAGAAAGACAGGCAGAGACAGAG
AGACAGGAGCAGTAACTAGAAGAGATACAGAGACAGAGAGAGAGAGAGAGTGGGCTGCTTGTGTAGACAGACAGAGAG
AGAAAATGAGGGAAATCATTAGTATCCACATCGGTCAGGCCGGTATCCAGGTCGGTAACTCGTGCTGGGAACTCTATTG

FIG. 2 continued

```
CCTCGAGCATGGAATCCAGCCTGACGGCCGCATGCCCAGTGACAAGACTGTAGGAGAGGGGAATGATGCGTTCAACACG
TTCTTCAGCGAGACAGGTGCTGGCAAGCACGTGCCGAGGGCCATCTTTGTGGATCTTGAGCCAACTGTTATTGATGAGG
TCCGAACAGGAAAATACAGGCAACTTTTTCACCCGGAGCAGCTCATCTCAGGAAAAGAGGATGCTGCCAACAACTTTGC
CCGTGGTCATTACACCGTGGGGAAGGAGATTGTGGACCTCTGCCTCGACCGAGTGAGGAAGCTGGCGGATAACTGTACG
G

> SEQ ID NO:1334 107594 224444_300972_1
gaatttccagctatagagctagatttcctggcgatcgatcgaCCGATTGGGCGCCATAGCAAGGAGAATGAGAGAGATC
ATCAGCATCCACGTCGGGCAGGCGGGGATCCAGCTAGGGAATTCGTGCTGGGAGCTCTTCTGCCTGGAGCACGGCATCC
AGCCGGATGGGAAGTCGATCGATCGCGGGGATGATCAAGAAGCCATGGCCGGGGCTGGGAAGGAATCGTTTGGCACCTT
CTTTAGCGAGGCAGCGTCGGCGACAAAGCACGTCCCAAGGGCGGTGATGCTGGATTTAGAGCCGACGGTGATCGACGAG
ATTAGAAGTGGTCGGTACAGGGCGCTCTTCCATCCGGAGCAGCTCATCGCGGGGAAAGAGGACGCTGCCAATAACTTTG
CCAGAGGTCACTATACTGTTGGAAGGGAGATCTTGGAGCAATGCCTGGATAGAATACGAAGGCTGGCAGACAATTGCTC
AGGACTTCAGGGAttCTTGGTTTTCAATGCTGTGGGAGGCGGAACCGGCTCAGGATTGGGATCAttgctCTTGGAGAGA
CTGacTTGTGACTATGgccgAAAATCCaagctcggctTttcTATATATccATccCCAAAGatctcT > SEQ ID NO:1335 107594 1044910_301919_1
GCGAATTGCAGAGCGGAATCTGGAACCTCGAACTCTCGACCTCGGACCTTTCAGAGCAGAAGAAGAAAAATGAGGGAGA
TAATCAGCATACACATCGGGCAGGCCGGGATCCAGGTCGGCAATGCCTGCTGGGAGCTCTACTGCCTCGAGCATGGTAT
CCAGCCCGATGGCCGCATGCCTAGTGATAAATCGGTGGGGGTGGCGGATGATGCTTTCAACACGTTCTTCAGTGAGACG
GGGGCAGGAAAGCATGTCCCTCGGGCCATCTTTGTGGATCTGGAGCCGACAGTGATTGACGAGGTCCGCACAGGCACCT
ACAGGCAGCTCTTCCACCCGGAGCAACTCATCTCCGGCAAGGAGGATGCTGCCAACAACTTTGCCCGTGGCCATTACAC
CGTGGGCAAAGAGATTGTGGATCTGTGCCTGGATCGAGTGAGGAAGCTTGCAGATAATTGCACGGGTCTGCAGGGTTTC
CTTGTGTTCAATGCGGTGGGAGGCGGTACCGGATCCGGTCTTGGCTCCCTCTTGCTTGAACGACTCTCTGTTGACTACG
GCAAGAAATCAAAGCTCGGTTTCACCATCTACCCTTCTCCTCAAGTCT > SEQ ID NO:1336 107594 1114827_301805_1
GCGTCTTCGTTAACGCCATCGCTAAAGCTCCCAAGCTTTGTCCGATCCCCTTCTTCTTCTCTTCCCTTCTTCGCCTTCT
CAAGCAGATATGAGGGAGTGCATTTCCGTCCACATTGGCCAGGCTGGTATCCAGGTCGGCAATGCCTGCTGGGAGCTTT
ACTGCTTAGAACATGGCATCAAGCCTGATGGACAAATGCCCAGTGACAAGACGGTCGGTGGTGGAGATGATGCCTTCAA
CACCTTCTTCAGTGAGACTGGAGCCGGGAAGCATGTCCCGAGGGCTGTTTTCGTCGATCTGGAGCCTACTGTCATCGAC
GAGGTTCGAACTGGAACCTACCGTCAGCTCTTCCACCCTGAGCAGCTCATCAGCGGCAAGGAAGATGCTGCTAACAATT
TCGCAAGGGGGCACTATACAATTGGTAAAGAGATAGTGGACCTCTGCCTGGACCGGATCCGGAAGCTTGCGGATAACTG
CACGGGCCTGCAGGGTTTTCTGGTTTTCCACGCTGTAGGTGGACGCACTGGATCTGGTCTTGGATCCCTGCTCCTTGAG
CGCCTTTCTGTTGATTATGGGAAGAAGTCCAAGCTCGGA > SEQ ID NO:1337 107594 1172003_302059_1
GTCGGCAAAGATAAAACCAAGACCCCCCCCTAGTAGTAGTACTACTGCCCATCACTCTCCCTCCTTTCCTTGTTGTTTG
TAGTGCTTGTGTTGGGGCACCATAAACCCTAGGAATTTGCTGAGCCTTGTGGGAAGCAAAGATGAGGGAGATAATCAGT
GTGCACATAGGGCAGGCCGGAATCCAGGTGGGGAATGCATGCTGGGAGCTGTATTGGCTCGAACACGGGATCCAGCCTG
ATGGTCGTATGCCCAGTGACAAGTCCGTGGGGGTTGCGGATGACGCGTTCAACACGTTCTTCAGTGAGACGGGAGGCGG
GAAGCACGTGCCCAGTGCCATCTTTGTGGATCTGGAGCCCACCGTGATTGATGAAGTCCGCACTGGGACTTACCGCCAG
CTCTTTCACCCGGAGCAGCTCATCTCCGGCAAGGAGGATGCTGCCAACAACTTTTGCCCGGGGCCATTACACGGTGGGC
AAAGAGATTGTTGATCTATGCCTGGACCGAGTTGAGGAAGCTGGCGGACAATTTGTACTGGCTTGCAAGGCTTCTTGGT
CTTCAATGCTGTGGGAGGCGGCACTGGATCCGGTCTTGGTTCCCTCTTACTAGAACGCCTCTCTGTTGACTATGGCAAA
AAATCGAAGCTTGGATTCACAATCTATCCCTCCCCTCAAGT > SEQ ID NO:1338 107594 137660_300726_1
cccacgcgtccGCGTCTTCGTACTCGCCTCTCTCCGCGCCCTCCTCCGCCGCCGCTCGCCGCCGTTCGTCTCCGCCGCC
ACCGCCGCCGCCATGAGGGAGTGCATCTCGATCCACATCGGGCAGGCCGGTATCCAGGTCGGGAACGCGTGCTGGGAGC
TCTATTGCCTCGAGCATGGCATCCAGCCTGATGGACAGATGCCCGGTGACAAGACCGTTGGGGGAGGTGATGATGCTTT
TAACACCTTCTTCAGTGAGACTGGTGCTGGGAAGCATGTCCCCCGTGCTGTCTTCGTCGATCTTGAGCCTACCGTGATT
GATGAGGTGAGGACTGGTGACTACCGCCAGCTCTTCCACCCTGAGCAGCTCATCAGTGGCAAGGAGGATGCAGCCAACA
ACTTTGCCCGTGGTCACTACACCATTGGCAAGGAGATTGTGATCTGTGCCTTGACCGCATCAGGAAGCTTGCCGACAA
CTGCACTGGTCTCCAGGGCTTCCTTGTGTTCAACGCTGTTGGAGGAGGAACGGGCTCCGGTCTCGGTTCCCTTCTCCTT
GAGCGTCTCTCTGTGGActatggCAAGAAGTCCAAGCTCGGgttcaccgTGTACCcgtCCCCTCAGGTCTccacCTCTG
TGGTTGAGccatacAACAGTgtcctcT
```

FIG. 2 continued

> SEQ ID NO:1339 107594 145907_200138_1
AACTACTCTCTCGATCGAGTGAGTAGTTCTACTTCTCTCTCGATCAATTTCTAGATTTCTTCAGTTGCCTTCCCGATTT
TAAAGAAAAAATGAGAGAAATCCTTCACATTCAAGGTGGACAATGTGGAAACCAGATCGGATCAAAGTTCTGGGAAGTT
GTCTGTGATGAACACGGAATTGATCCTACTGGACGCTATGTTGGAACCTCAGATCTGCAGTTGGAACGTGTTAATGTGT
ATTACAATGAAGCGTCATGTGGGAGGTTTGTTCCCCGTGCAGTGCTCATGGATCTTGAGCCTGGCACGATGGACAGCGT
GAGGACTGGTCCTTATGGCCAGATCTTTAGGCCTGATAACTTTGTTTTCGGTCAATCCGGTGCTGGAAACAATTGGGCT
AAGGGGCATTACACTGAGGGTGCTGAGCTTATTGATTCTGTTTTAGATGTTGTCAGGAAGGAGGCTGAGAATTGCGACT
GTCTTCAAGGATTCCAGGTGTGTCACTCACTTGGTGGAGGAACAGGTTCTGGAATGGGAACCTTGCTGATCTCAAAGAT
CAGGGAGGAATACCCTGACCGCATGATGCTCACATTCTCTGTGTTCCCATCACCGAAGGTTTCAGATACAGTGGTTGAG
CCATATAATGCTACCCTTTCAGTGCATCAGCTTGTTGAAAATGCTGATGAGTGTATGGTTCTTGACAATGAAGCTTTAT
ATGACATCTGTTTCAGGACTCTCAAGCTTACCACACCCAGCTTTGGAGATTTGAACCACTTGATTTCTGCTACTATGAG
TGGGGTCACTTGCTGCCTCAGGTTCCCGGGTCAATTGAACTCTGATCTTCGGAAGCTAGCTGTTAACCTGATCCCCTTC
CCTCGTTTACACTTCTTCATGGTTGGATTTGCTCCTCTCActtCTCGTGGttcACAGCAATACCGTGcaCTaaCagTCC
CggagCTGACTCagcaaATGTGGGATgccaagaacATGATGTGTGCTGCTGAtccacgcCAtggtCGttacctcact > SEQ ID NO:1340 107594 175943_300523_1
cccccagagagagagaaagaGAGAGAGAGGCCGCTTCTCTAGTCTAGACCAAAGGAAGGAAACCAACCGAGAGGCGAGG
CGAGGAGAGGAGAGGAGAGGAGAGGAGAGGCGGAGGAGGAGGGAGGAGAAGATGAGAGAGATCATCAGCATCCACATCG
GCCAGGCCGGGATCCAGGTCGGCAACGCGTGCTGGGAGCTCTACTGCCTCGAGCACGGCATCGAGCCCGATGGCACCAT
GCCCAGTGATACAACGGTTGGCGTCGCACACGATGCGTTCAACACTTCTTCAGCGAGACGGGCGCTGGCAAGCATGTG
CCCAGGGCCATctTTGTCGACCTGGAGCCCACTGTCATCGACGAGGTGCGCACTGGGTCGTACCGTCAGCTCTTCCACC
CTGAGCAGCTCATCTCTGGGAAGGAGGATGCCGCTAACAACTTTGCCCGTGGCCATTACACTGTTGGAAAGGAGATCGT
AGATCTATGCCTGGACCGTGTGCGCAAGTTGGCAGACAACTGCACTGGGCTGCAGGGATTCTTGGTGTTCAATGCTGTT
GGTGGTGGAACTGGATCAGGACTTGGTTCTCTTCTGTTGGAGCGTCTCTCTGTTGATTATGGAAAGAAGTCCAAGCTTG
GCTTCACAATTTACCCTTCCCCCCAGGTCTCAACAGCTGtTGtagaacCatacaacAGt > SEQ ID NO:1341 107594 144440_200135_1
AACTATCCTTTTTCTTTCTCCTCCCTCCCTCGAACGAAACCCTAATAAAATGCGTGAAATCCTACATATCCAAGGTGGC
CAATGTGGCAACCAAATTGGGGCCAAGTTCTGGGAGGTTGTGTGCGCGGAGCACGGGATCGATTCCACCGGCGCGTACC
ATGGGGAATCGGATATTCAACTTGAGAGGGTAAATGTTTATTATAATGATGCGAGTTGCGGGCGTTTCGTACCTCGTGC
TGCTCTTATGGATTTAGAGCCTGGTACTATGGACAGTGTTACATCTGGTCCTTATGGACATATTTTTATGCCTGATAAC
TGTGTTTTTGGCCAGTCTGGTGCGGTGAATAATTGGGCCAAGGGATCATTACACCGAGGGCGCTGAGTTGATTGATTCG
GTTCTAGATGTTGTTCTTAAAGAAGCTGAGAATTGAGATTGCCTACAAGGGTTTCAGGTGTGCCATTCCCT > SEQ ID NO:1342 107594 201404_300716_1
CGGACGCGTGGGCCAATCCCGAACTCTGAACTCTGAAGGCTGCAGAGACAGGCAGAGAGATATGAGGGAGATAATAAGC
ATCCACATAGGGCAGGCGGGCATCCAGGTGGGGAATTCTTGCTGGGAACTATACTGCCTCGAGCATGGCATCCAGCCGG
ACGGCCTCATGCCCAGCGACACAACTCCTGGAATTGCAAGGGATGCATTCAACACGTTCTTCAGCGAGACGAGTTCAGG
CAAGCACGTCCCAAGGGCGTTGTTCGTCGACCTGGAGCCCACGGTGATTGATGAGGTGAAGACCGGGCCATACCGCCAG
CTCTTCCACCCAGAGCAGCTCATCTCCTACAAGGAAGACGCTGCTAACAACTTTGCTCGTGGGCACTACACAGTTGGAA
GAGAGGTGGTAGATCTTTGCCTTGATCGACTAAGAAAACTGGCAGATAACTGCACTGGTCTCCAAGGTTTTCTGGTTTT
CAATGCTGTTGGTGGAGGAACCGGCTCTGGACTTGGTTCATTACTTTTGGAGCGCCTATCAGTAGATTACGGTAGGAAG
TCGAAGCTCGGGTTCACAATATATCCTTCACCACAGATCTCAACGGCCGTGGTGGAGCCTTACAACAGCGTGCTCTCGA
CCCACTCCCTGATCGAGCACACCGACGTCGTCGTCCCTCCTGGACAACGA > SEQ ID NO:1343 107594 188352_300776_1
cTAAGCCGAGACAACGCAGAGAAAGGCGTCTTCGTACTCGCCTCTCTCCGCGCCTCCGCGCTTTTCCTCCTCTCCCCTC
TCTCCCTTCTCCGCCGCCGTCGCAGCATCAACCCAATCCGCCGCCATGAGGGAGTGCATCTCGATCCACATCGGCCAGG
CCGGTATCCAGGTCGGGAACGCGTGCTGGGAGCTCTACTGCCTCGAGCATGGCATCCAGGCTGATGGTCAGATGCCCAG
TGACAGGACTGTTGGTGGAGGTGATGATGCTTTCAACACCTTCTTCAGTGAGACTGGTGCTGGGAAGCATGTTCCCCGT
GCTGTATTTGTTGATCTTGAGCCTACTGTGATTGATGAGGTGAGGACTGGTTGCTACCGCCAGCTCTTCCACCCTGAGC
AGCTCATCAATGGCAAGGAGGATGCAGCTAACAACTTTGCCCGTGGTCACTACACCATTGGCAAGGAGATTGTTGATCT
GTGCCTTGACCGCATCAGGAAGCTTGCTGACAACTGCACTGGTCTCCAAGGTTTCCTTGTGTTCAACGCTGTTGGAGGT
GGAACGGGCTCTGGTCTTGGTTCCCTTCTCCTGGAGCGCCTTTCTGTGGACTATGGCAAGAAGTCcaaGCTTg > SEQ ID NO:1344 107594 183569_300623_1
GCATTCTCAACAAGCTGGTGCACAGAGAGGGTAGCATTGTAGGGCTCGACGACAGTGTCGGACACCTTGGGCGATGGGA
AGACCGAGAACGTGAGCATCATCCGGTCAGGGTACTCCTCCCTGATCTTGGAGATGAGCAGGGTTCCCATCCCGGAGCC
AGTTCCTCCTCCCAGCGAGTGGCAAACCTGGAACCCTTGGAGGCAGTCGCAGTTCTCGGCCTCCTTGCGGACGACGTCG

FIG. 2 continued

AGGACGGAGTCGATGAGCTCGGCGCCCTCGGTGTAGTGGCCCTTGGCCCAGTTGTTGCCGGCGCCGGACTGGCCGAAGA
CGAAGTTGTCGGGGCGGAAGATCTGGCCATAGGGGCCGGAGCGGACGGAGTCCATGGTGCCGGGCTCGAGGTCCATGAG
CACGGCGCGGGGCACGTA

> SEQ ID NO:1345 107594 182949_300664_1
gaattcataaacgctcatctttcttctagtTggcttcTtcaatcttgttcttcattTTTGTTCAATTTTCGTTTGATAA
TCTTCGAAAATGAGAGAGTGCATTTCAATTCACATTGGTCAAGCTGGTATTCAAGTTGGAAATGCGTGCTGGGAACTTT
ACTGCCTCGAGCATGGCATCCAGCCTGATGGCCAGATGCCTAGTGACAAGACTGTTGGTGGAGGAGATGATGCATTCAA
CACCTTTTTCAGTGAAACTGGTGCTGGAAAGCATGTCCCTCGTGCAATTTTTGTAGATCTTGAACCCACTGTCATTGAT
GAAGTAAGAACTGGAACATACCGTCAACTCTTCCACCCTGAACAACTCATTAGCGGCAAAGAAGATGCTGCCAACAACT
TTGCCCGTGGACACTACACAATTGGGAAAGAGATTGTTGATCTCTGCTTGGACCGTATTCGTAAGCTCGCTGACAACTG
CACCGGTCTTCAAggtTTCCTagtCTTTAATGCagTTGGTGGaggTACTGGTTCTGGATTGGGATCACTTCTTTTGGAA
CGTCTTTCAGTTGATTATGGAAAgaagtcaAAGCTtggttTCACTGTcTACCCATCACC > SEQ ID NO:1346 107594 136924_300440_1
cccccgctaccacaccgcagagaaaggcgggtcgtACTCGCCTCTCTCCGCGCCCTCCTCCGCCGCCGCTCGCCGCCG
TTCGTCTCCGCCGCCACCGCCGCCGCCATGAGGGAGTGCATCTCGATCCACATCGGGCAGGCCGGTATCCAGGTCGGGA
ACGCGTGCTGGGAGCTCTATTGCCTCGAGCATGGCATCCAGCCTGATGGACAGATGCCTGGTGACAAGACCGTTGGGGG
AGGTGATGATGCTTTTAACACCTTCTTCAGTGAGACTGGTGCTGGGAAGCATGTCCCCCGTGCTGTCTTCGTCGATCTT
GAGCCTACCGTGATTGATGAGGTGAGGACTGGTGACTACCGCCAGCTCTTCCACCCTGAGCAGCTCATCAGTGGCAAGG
AGGATGCAGCCAACAACTTTGCCCGTGGTCACTACACCATTGGCAAGGAGATTGTTGATCTGTGCCTTGACCGCATCAG
GAAGCTTGCCGACAACTGCACTGGTCTTCCAGGGCTTCCTTGTGTTCAACGCTGTTGGAGGAGGAACGGGCTCCGGTCTC
GGTTCCCTTCTCCTTGAGCGTCTCTCTGGACTATGGCAAGAAGTCCAAGCTCGGGTTCACCGGTGTACCCGTCCCCTC
AGGTCTCCACCTCTGTGGTTGAGCCATACAACAGTGTCCTCTCCACCCACTCCCTCCTTGAGCACACCGATGTCGCTGT
CCTGCTCGACAATGAGGCCATCTATGACATCTGCCGCCGCTCCCTCGACATTGAGCGCCCAACCTACACCAACCTCAAC
AGGCTTGTGTCCCAGGTCATCTCCTCACTGACTGCCTCCCTGAGGTTCGATGGTGCTCTGAATGTGGATGTCAACGAGT
TCCAGACCAACCTGGTGCCCTACCCGAGGATCCACTTCATGCTTTCCTCCTACGCCCCGGTGATCTCGGCCGAGAAGGC
CTACCACGAGCAGCTCTCCGTGGCGGAGATCACCAACAGCGCCTTCGAGCCGTCCTCCATGATGGCCAAGTGCGACCCG
CGCCACGGCAAGTACATGGCGTGCTGCCTGATGTACCGCGGCGACGTGGTCCCc > SEQ ID NO:1347 107594 128822_300478_1
cgcctctcttattcaattcactcctgtcatgaattttcatctattATAATCACTATTCTACAACGGTCTCTGCAATTTCT
TTGAAAAATAAAAAATGAGAGAGTGCATCTCGATCCACATTGGTCAGGCAGGAATCCAAGTCGGAAACGCTTGTTGGGA
GCTTTACTGCCTCGAACATGGCATTAAGCCGGATGGACAAATGCCTGGTGATGTAACTGTTGGCGGAGGAGACGACGCC
TTCAATACTTTCTTTAGCGAAACTGGTGCTGGAAAGCACGTACCTCGTGCTGTTTTCGTAGATCTGGAACCCACTGTCA
TTGATGAGGTGAGAACTGGAACTTACCGACAGTTGTTCCATCCTGAGCAGCTCATTAGCGGCAAAGAAGACGCTGCAAA
CAACTTTGCTAGAGGCCATTATACAATTGGTAAGGAGATAGTGGATCTGTGTCTTGATAGGATCAGGAAGTTAGCGGAC
AACTGCACTGGGCTTCAAGGATTTTTGGTGTTCCATGCTGTTGGTGGTGGAACTGGTTCAGGGCTTGGTTCTCTGCTTC
TTGAGAGGCTTTCTGTTGACTACGGAAAGAAATCCAAGCTTGGATTTACCATTTACCCTTCACCTCAAGTCTCTACTGC
TGTTGTTGAACCCTACAACTCCGTGCTTTCGACACACTCCCTTCTTGAGCACACTGATGTTGCTATCCTGTTGGACAAT
GAAGCAATCTATGACATTTGCCGAAAGTCTCTggATATCGAGaGaccaaCATACACCAATCTCAACAggCTCATCTCtc > SEQ ID NO:1348 107594 1171601_302055_1
GGAGGGCACATAGTCAGAGTTCTGTCGGCTCGCCGCTATTTTATCTGAGTGTTGTTGAAAGCTTATCAGCGAGGATGAG
GGAAATTCTTCACATCCAGGGAGGCCAATGCGGCAACCAGATCGGTGCCAAGTTTTGGGAGGTAGTCTGCGCTGAGCAT
GGGATCGACCCGACTGGCAACTACGAGGGAAACTCTGATCTCCAATTGGAGCGGGTTAATGTATACTACAATGAGGCTA
GTGGAGGTCGGTATGTCCCCAGGGCAGTGCTCATGGACCTTGAGCCCGGAACCATGGACAGTGTAAGGAGTGGATCCTA
TGGGCAGATATTCAGGCCTGACAACTTTGTCTTCGGGCAGAGTGGTGCAGGGAACAACTGGGCCAAGGGGCATTACACA
GAGGGGGCTGAGTTAATTGACTCTGTTCTCGATGTTGTTAGAAAGGAAGCTGAGAATTGTGATTGCCTTCAAGGTTTCC
AAGTGTGTCACTCTCTTGGAGGCGGTACCGGCTCAGGCATGGGTACGCTCTTGATCTCGAAGATCCGGGAGGAGTATCC
TGACCGGATGATGCTCACCTTCTCTGTGTTCCCTTCGCCGAAGGTGTCGGACACAGTTGTGGAGCCCTACAATGCTACT
CTCTCT > SEQ ID NO:1349 107594 111248_300053_1
CGGACGCGTGGGTGAACAAACTACAAGAGAAATGAGGGAGTGCATTTCCATTCACATTGGCCAGGCCGGTATTCAGGT
CGGCAATGCTTGCTGGGAACTTTACTGCCTCGAACATGGCATTCAGCCTGATGGGCAGATGCCAAGTGATAAGACTGTT
GGGGGAGGTGATGATGCCTTCAATACATTTTTCAGCGAAACCAGTTCAGGGAAGCACGTTCCTCGAGCCGTCTTTGTTG
ATCTTGAGCCCACTGTTATTGATGAGGTGAGAACTGGAGCATATCGCCAGTTATTTCACCCTGAACAATTGATCAGTGG
CAAAGAAGATGCTGCCAACAACTTTGCCCGAGGCCACTATACAATTGGAAGGGAGATAGTTGATCTTTGCTTGGATCGT

FIG. 2 continued

ATCAGAAAGCTCACAGACAACTGCACTGGTCTGCAGGGTTTTCTGGTCTTTAATGCCGTTGGTGGAGGCACTGGTTCTG
GTTTGGGTTCACTTCTGTTAGAACGCTTGTCAGTGGACTACGGAAAAAAATCCAAGCTTGGCTTTACTGTGTATCCCTC
TCCTCAGGTTTCAACCTCTGTGGTGGAGCCATACAATAGTGTTCTCTCAACCCACTCCCTCCTTGAACACACAGATGTT
TCTATCTTGCTTGA

> SEQ ID NO:1350 107642 155220_301354_1
GATCATGCTTAGTTCCTTCTACTCCTGAAATTTCCATCAATTTTCAAGATAATCACAATATTCCTTCCACCTCTCCTAA
AGTTTTTCCTTCTCCTTGTAATATTCCTCATCAAGACTTCAATGGTATATCATCAATGTTAATGAGGAGATCGATGTCG
TTTTCGGGTGTGGAGAGGTGCGATAATCATCAAGATTTGAGAGTGGACGATAATGAAATGTCTGATGATGATGGATCTT
CGCAATTGCTAGGGGAGAAGAAGCGGAGGCTTAATTTGGAGCAAGTGAAAGCACTGGAGAGAAGTTTTGAAGTGGCTAA
CAAGCTTGAACCTGAGAGGAAAATTCAGTTGGCTAGAGCTTTAGGGTTGCAGCCTAGACAGATTGCAATTTGGTTTCAG
AATAGAAGAGCAAGGTGGAAGACTAAGCAATTGGAGAGAGATTATGAGATCTTGAAGAGACAATATGATGCACTTAAGT
CTGATAATGATGCACTCAAGACTCAAAATAATAATCTTCATTCAGAGCTACAGTCATTAACTCTGAGGAACAGAGAATC
AGGCGGCGGAGGTGCACCAATGATTAATCTAAACAAAGAAAACGAGGGATCTTGGAGTAATGGAAGTGAAGAGAATAAC
AGTATCGACGTAAATTTTGGAACCACCACAGCAACAAGGACATCATCAGGT

> SEQ ID NO:1351 107642 252668_301603_1
GCCTTGCATGGCTCAACCCCACCTCTACTACGATAGCCGGGAGCTATGGCTTCACCCGCCCTCTTGCAAGGACCATCGC
TTCGAGCCTGGAACGATCAAGAGGGCGTTCGATTTTTACCGTGGCGGTGGCACCGGTTTCGAGGACGCCGCAACTGAAT
ACAAAGAATACGAAGAAGGGTATGGGGATGGAGAAGAGGAAGATGAAATGATGGTGCAGCTAGTAGGAGAAGAAGGAGA
AGAAGGTGCTGCCGGTGGGAAGTCGAGGAAGAAGGCGAGGAGGCTCAGCTCGCAGCAGGTCAAAGCTTTGGAAATGGCC
TTCGATGCCAACAACAAGCTCGAAGCGGAGCGGAAGGTGGCGCTAGCTGGCAAGGTTGGATTAGAACCGCGCCAAGTTG
CCGTCTGGTTTCAGAATAGGCGTGCTCGTTGGAAGACCAAACAGATGGAAGGAGACTTCACCGCCTTGAAGACCCGATT
CCAATCCTTGAAGGCCAACGCGATGCTCTTCTCAAAGACAAACAACTACTTGAAGATCAGGTGGCTTGCTTAAAGAAC
CAGAGCGGCAGTAAAAAGC

> SEQ ID NO:1352 108256 127547_300470_1
cgaccaatattcaCACACTTCTATCTTACATATTTAGCCAAAGCATCGTTAAAATGGCGTACATTAAGCAAGCTTTTCT
CTTGATTGCTCTCTTTGTTGCAATTACAGTTAATCTCTCTGGATCTCCTAAGTTGCAAGTGATGGCTTTACGAGACTTA
CCCGAAGAGGTTGCAATGATGAAAGATAAATTACTTCCATTAGGTGATATAGTAACTTGCTTGAAATACTGCAATGTCG
AAAGCGATTGCAGTGATGGTTGGATTTGCTCCAATTGTGTTCCATCTGCATTTCAGGGATGGAGATCTCAATGTGACTC
GCTTACTGCTACTGGTGAAGGTTATTTTGGAACTATACTCCGCGCTAAGCACAACAAAATATAAATTATATTGCTGCAA
TATATGAACTATTTATAAATGCTTGATCTCGTGTTATATTCAAGCATTTTAAATAATATAATGTTGTGTTTCCTACTTG
TCCAAGTTTATGTAAGAAATGAATATGTAACCATGTTCTTGTTGTTGTCATCTTATATGCAGTTATTATGAAATATA
TGTTCTCTATTATCCCAATTAAAGTGGCACGAAACTTAATGGGAGATAATATTTACTATATATGATATGAATAGTGTCA
TTAACAACTGGTTTGGATGGTTGTTATGTTGTATTGTTATTTTAAATACAATGTTTGTTTTAATTGTTATTTAAATATT
GTTGTATCGTATCGTAACGATAAAAAGTGTCACTTTATAGAACAATAGATTTGGTGTGGGTCTCGTTACTTTGCTTTAA
TTTATTCTCTCGTTTTGCACTTTTTATTATTAAATAATTATATTTTATCCTTTACCCTACTTTTATGTATAGTATTTTC
TACTATGTATCCTATTTTTTCTTAGT > SEQ ID NO:1353 108358 104075_300058_1
acatttTAGTCTGAATAAAATGGCCAAGGCTACTGTATCATCCATTGTCCTCCTCCTCACTTTGAACATTCTCTTCTT
CGCAATGGTTAGTTCAACTTACATCCCATGCCCACCAAAAACAAAGAATCAACCCCATCCCACTACCCCATCATCCAAG
GGTTATAAGAAGTGCCAAAAGGACACACTAAAATTGAAGGTGTGTGCCAATTTATTGAATGACTTGGTGCATGTTGTTA
TTGGAAGCTCATCAAAGAGTTCATGCTGCTCTCTCATTGAGAATCTTGCTGATGTTGATGCTGCAGTTTGCCTTTGCAC
TGCCATTAAAGCTAAGCTCTTGGGAACTAACCTTGATACCGCTCTTTCCCTCAGCTTATTGCTCAACAATTGTGGAAAG
ACTGTCCCTAAAGACTTCCAGTGTGCATAAATGGCCATCATCTATTTTCATCCTATCCCGACTTGTTTGGGAATGAGGC
GTAGTTGTCTGTTTGTGTTGTTTGTTTTCTCTACAAGATATTCGTTGGAGAAATACTATCAGTAATAAGTGTGTGATG
CATGGTTGCTTATTTTCAATGTGTTGTATCCCATATTTATTTGTAATATGATGGTTATCTtctcattaaggaattatat
gatgtttatctcgggaaatcaattattgacaaggtattgatattaagttgttttttttcc > SEQ ID NO:1354 108404 9335_300298_1
CCCACGCGTCCGCGGTTTTCTAAGGATACAGAATCAAGGGATAACGATCCTTGGAGATTTGGTTCTTAAAGACAAGACC
TTTGTCTATGATCTGGACGGTCAGAGAATCGGATGGGCGAACTACGACTGCTCTAACTCTGTAAATGTCTCAACGACTA
GCATCAGCGGAAGAAGCGAATATGTGAACGCAGGACAGTTTACTGAGAATGCTGCAGCACC > SEQ ID NO:1355 109024 236595_301248_1
AAAGAGGAAGAGCTGATGAGCGACGCCGGGGATGACGGCGACGACTACGGCCCCGCCGCCGCCGGCGGCAGTGGCGAGA
CCGACATCGACGAGCTGGAGAAGCGGATATGGATGGACAAGCTCCGCCTCAAGCAGCTCAAGGCTAGGGCTGCTGCCGC

FIG. 2 continued

CGCTGCCGCCGCCGCCGGCAATGGCAGGGATCGATCCAAGCACCAGAAGCAATCTCCAGAGCAGGCGAGAAGGAAGAAG
ATGGCGAGGGCACAAGATGGGATTCTAAAGTATATGCTCAAGATGGTGGAGGTATGCCATGCACAGGGATTCGTCTATG
GCATTGTTCCAGAGAAGGGCAAGCCGGTGAGTGGATCGTCGGACAATCTACGTGCATGGTGGAAGGACAAGGTAAGGTT
CGATAAGAATGGTCCCGTGGCCATCTCCAAGTTCCAGATGGAGAACTTTGGAGACGAGGACGAGGACGAGGAGAGGTCT
GGAAAGTTGGTGAGTTTCACGGGGAAGAACTGGAGTGTTCCTCGGGCACTTCTAGAGCTCCAGGACACGACGCTGGGAT
CGCTGTTGTCGGCGTTGATGC

> SEQ ID NO:1356 109024 282212_200073_1
GATGAAGCTGAAAAGGCTGAAGGAAATGACTAAAAGTAAGGGAGGTGTCGATCCTGCAAAACATCGTCAGTCGCAGGAG
CAGGCGAGGAGGAAGAAGATGTCAAGGGCACAGGACGGGATCTTGAAGTACATGTTGAAAATGATGGAAGTATGTAAAG
CTCAGGGCTTTGTTTATGGAATCATTCCGGAAAAAGGCAAACCGGTCGGTGGGGCATCTGATAATCTTAGGGAGTGGTG
GAAGGATAAGGTGAGGTTTGATCGAAATGGCCCTGCGGCCATAGCCAAATACCAAGCTGATCATGGCATCCCAGGGATG
CAGGAGGAATCTAATCCAGTGGGTCCTACCCCTCACACCTTGCAAGGGCTGCAAGATACCACCCTTGGTTCGTTATTGT
CAGCTCTGATGCACACTGTGATCCTCCTCAGAGAAGATTCCCACTGGAGAAAGGTGTTTCACCCCCATGGTGGCCCAC
TGGTCAGGAGGATTGGTGGCCTCAGTTGGGTTTGCAGAAGGAACAAGGTCCTCCGCCTTATAAGAAGCCTCATGATCTG
AAAAAGGCGTGGAAGGTTGGTGTCCTCACAGCGGTGATCAAGCACATGTTCCCCGATATTGCTAAAATCCGTAAGCTGG
TAAGGCAGTCGAAGTGCTTGCAGGATAAGATGGCAG

> SEQ ID NO:1357 109146 239739_301307_1
ggttatgtCCTTGTTGTTTGTGCTCTCGCTAGAGGGCGGCTGCTCATCTGTGCATCGTCGCGGCGGATTCGCGATGGCC
TTGCCCGGTCAAGTGACACCTGGAGATGTGGTTTCGTTCAAGCTTGTCATCGTCGGCGATGGCGGCACGGGGAAGACGA
CGTTTGTGAAGCGCCACTTGACTGGTGAATTCGAGAAGAAATACGAACCGACTATGGGTGTCGAGGTTCATCCTCTCGA
TTTCTTTACGAACTGTGGCCGTCTACGCTTTTATTGCTGGGACACGGCCGGTCAAGAGAAGTTTGGTGGTCTTCGCGAC
GGCTACTATATCCATGGGCAGTGCGCTATCATCATGTTTGATGTTACTGCCCGCCTGACGTACAAGAACGTCCCAACCT
GGCACCGGGACCTTTGCAGGGTTTGCGAGAACATCCCCATTGTTCTGTGCGGCAACAAGGTCGACGTGAAGAACAGGCA
GGTCAAGGCCAAGCAGGTCACCTTCCATAGAAGAAGAACCTGCAGTACTACGAGATCTCTGCCAAGAGCAACTACAAC
TTCGAAAAGCCCTTCCTTTACCTCGCCAGGAAGCTTGCCGGAGACCCGAATCTCCACTTTGTCGAGACCCCTGCGCTGG
CACCGCCCGAGGTGCACATCGATCTTGCTGCTCAGCAACTGAATGAGCAGGAGATGCACAATGCGGCTGCTCAGCCTCT
ACCAGACGACGAGGACGACGCattcgaTTAAATC > SEQ ID NO:1358 109146 45466_300075_1
GGTTTTCACTTTCATAGCGACAGTTAAAAACTTAAAAATGAAAATTACTAATGTCATCGATTCATTTCAAAGTACGGAC
ACATAAAAATAGCACCATGAACAAAAAAAAGTTCAGACAAGCCCTAACGGGTAATCAGTGACAGATCACATCTCTCTTT
CTCTACTCGAAGGTGTCATCATCGTCATCAGGAAGTGGCTGACTTGCTGCTGCTGCAAGCTCCGCCTCATGCTGCTGCT
GAGCAGCCAAGTCGATTTGAACTTCCGGGGGAGCAAGGGCAGGTGATTCCACAAAGTGAAGATTAGCGTCCCCGGCGAG
CTTTCTAGCAAGGTACAAGAATGGCTTCTCGAAGTTGTAGTTGCTCTTGGCAGATATCTCGTAATACTGGAGGTTCTTC
TTCCTGTGGAATGTTACCTGCTTGGCCTTGACTTGCCTGTTCTTCACATCAACTTTATTCCCACAAAGAACAATTGGGA
TGTTTTCACAAACCCTGCAAAGATCACGTGCCATGTTGGAACATTCTTGTATGTCAGTCGTGCTGTGACATCAAACAT
GATGATAGCACATTGTCCATGGATGTAGTAACCATCCCTAAGACCACCAAATTTCTCTTGGCCAGCAGTATCCCAACAG
TAGAAACGGATCTTGCCACAGTTAGTGAAGAAATCAAGAGGATGAACCTCAACACCAATAGT > SEQ ID NO:1359 109146 1117948_301851_1
GCTATTCATGGCACTCCCTGGTCAGCAGGCAGGCAGATTGCCCTAGCTTCAAGTTGGTCATTGTTGGGGATGGAGGAACA
GGAAAGACGACCTTCGTGAAACGACACTTGACAGGAGAATTCGAGAAGAAATATGAGCCCACTATTGGGGTTGAAGTTC
ATCCTCTGGATTTCTTCACCAACTGCGGGAAAATCCGCTTCTATTGCTGGGATACTGCTGGACAAGAGAAGTTTGGTGG
GCTTCGTGATGGCTATTACATTCATGGGCAATGTGCTATAATCATGTTTGATGTGACGTCGCGGCTGACTTACAAAAAT
GTCCCAACTTGGCACCGAGATCTCTGCAGGGTTTGTGAAAACATACCGATCGTGCTCTGTGGAAACAAGGTTGATGTGA
AGAACCGGCAAGTGAAAGCGAAGCAGGTGACATTCCACCGGAAGAAGAATCTCCAATACTACGAGATCTCTGCGAAGAG
CAATTACAATTTTGAGAAGCCATATCTATACCTTGCAAGGAAACTGGCTGGAGATCAAAATCTTCATTTTGTGGAGTCC
CCTGCCCTTGCACCCCGGAAGTCCAGATCGACTTGGTACAACAGCAACAGTATGAAGCAG > SEQ ID NO:1360 109146 11911_300070_1
ACGGTCTCAACCCATAGTGGCCATTACGGCCGGGGGCAAAATTCTCCTAAAAACACACATGGCTCTTCCAGGACAGGAA
GCCGTGGATTATCCCAGTTTTAAACTTGTTATTGTTGGCGATGGTGGGACTGGAAAAACTACATTTGTGAAGAGGCATC
TTACTGGTGAATTTGAAAAGAAATATGAACCCACCATTGGAGTGGAGGTGCATCCATTGGATTTCTTCACAAATTGTGG
GAAGATTAGGTTTTACTGCTGGGATACAGCTGGTCAGGAGAAATTTGGTGGCCTTAGGGATGGATACTACATTCATGGT
CAGTGTGCTATCATCATGTTTGATGTGACAGCTCGATTGACATATAAGAATGTCCCCACATGGCATAGGGATCTTTGCC
GTGTCTGTGAAAATATTCCCATTGTTCTTTGCGGAAACAAGGTTGATGTGAAGAACCGTCAAGTTAAGGCTAAGCAGGT
TACTTTCCACCGGAAGAAGAATCTGCAATACTATGAGATATCAGCAAAGAGTAACTACAACTTTGAGAAGCCTTTCCTT

FIG. 2 continued

TACCTTGCCAGGAAACTTGCTGGGGATCCGAACTTGCACTTTGTGGAGTCTCCTGCCCTTGCTCCTCCTGAAGTACAGA
TCGACTTGGCTGCACAACAACAACATGAAGCTGAGCTTGCTGCTGCTGCCAGTCAACCCCTCCCAGATGATGATGATGA
GACCTTTGATTAAGAGAGTAATCAGCCTTCTCGGACAGCATTTGTGGATGCTATGATTTTTCTTTTTTCCTA

> SEQ ID NO:1361 109146 187673_300679_1
CTGTGGTAAGATCCGCTTCTACTGCTGGGACACTGGTGGACAAGAGAAGTTTGGTGGACTTAGGGATGGATACTATATC
CATGGTCAATGTGCGATAATTATGTTTGATGTCACTTCAAGGCTGACTTACAAGAATGTTCCAACATGGCATAGGGACT
TGTGCAGGGTGTGTGAAAACATCCCCATTGTCCTGTGTGGTAACAAGGTTGATGTGAAGAACAGGCAGGTTAAAGCCAA
GCAGGTCACATTCCACAGGAAGAAGAATCTGCAGTACTATGAAATTTCTGCCAAGAGCAACTACAACTTTGAGAAGCCC
TTCCTTTATCTTGCAAGGAAGCTTGCTGGTGACCCGAACCTGCATTTCGTTGAAGCTGTTGCTCTTAAACCTCCGGAAG
TTCCCATTGACCTGGCAATGCAGCAACAGCATGAGGCTGGCTTGCGGCTGCAGCAGCACAACCTCTCCCAGATGACGA
TGACGATCTGATCGAGTAGAGAGGATCATGAGTCTATCATGCTTCAGCCTGAGTCTCTTCATAAGAGTCTGAATTAGGC
CAATGCATGCTAGTGTTAGCTTGTCTGTGGAATGTGGACGTTTCCTGCGTGCCTGATGGGTTGAAAACTTTTGATGTGT
GGTGTTACATGTTGCTGCC

> SEQ ID NO:1362 109146 147330_301252_1
atTCTCCTCAAATCAAACATGGCTCTTCCAGGTCAGCAAGCCGTGGATTATCCCAGTTTTAAACTTGTTATTGTTGGCG
ATGGTGGAACTGGAAAAACTACATTTGTGAAGAGGCATCTTACTGGTGAATTTGAAAAGAAATATGAACCTACCATTGG
AGTGGAGGTGCATCCATTGGATTTCTTCACAAATTGTGGGAAGATTAGGTTTTACTGCTGGGATACAGCTGGTCAAGAG
AAATTTGGTGGCCTTAGGGATGGATACTACATTCATGGTCAATGTGCTATCATGTGTTTGATGTGACAGCTCGATTGA
CATACAAAAATGTCCCCACATGGCATAGGGATCTTTGCCGTGTCTGTGAAAATATTCCCATTGTTCTTTGCGGAAACAA
GGTTGATGTGAAGAACCGTCAAGTTAAGGCTAAGCAGGTTACTTTCCACCGGAAGAAGAATCTGCAATACTATGAGATA
TCAGCAAAGAGTAACTACAACTTTGAGAAGCCTTTCCTTTACCTTGCCAGGAAACTTGCTGGGGATCCGAACTTGCACT
TTGTGGAGTCTCCTGCCCTCGCTCCTCCTGAAGTACAGATCGACTTGGCTGCACAACAACAACATGAAGCTGAGCTTGC
TGCTGCTgccAGTCAACCCCTCCCAGATGATGATGATGAGACcTTTGATTaagagaGtaatcaggcttCtcggacAGca
tttgtgg > SEQ ID NO:1363 109191 145816_301062_1
atttagtctttctgacagaaaaagtacaacatttactaatggcatcatcggagattgtggattccggtaggttcgcgg
cCTCCGCCGGTGGTCAGAAATCACATTTCTCACAGACATGTAATTTGTTGAGCCAATACTTGAAAGAGAAGAAAGGTTC
ATTTGGAGATCTCAGCCTTGGTATTCACCGCGCCGGTACTACTACTACTATGGATTTATTCCCAATGATTGAGAAATCT
GGTGAGTCAAATCCTCAGAAACCAATGAATCTGTTTCCTCAAACTGAAGCAAAATCTGAACCGGAGAAAGCACAGATGA
CGATATTCTATGGCGGTCAAGTTATTGTGTTTAACGATTTTCCGGCAGATAAAGCTAAGGAAATCATGCTTATGGCTAC
TTGTACCAAAGGAAACAACAACAGTACTACTCAGATTCAAAAAACAGCTGAATCTGCTTCAGATTTGGTACCTCAGCCT
ATTATTTCTGGAGATTTACCAATTGCGAGACGAGCTTCACTTACTAGGTTTTTGGAGAAAAGAAAAGATAGGCTGACTG
CAAAAGCACCGTATCATTAAGCAACCCAAATAAACAAGCAGCAGTTTCTGAAAACAAGGCGTGGCTTGGATTGGGTGC
TCAATTTCCAGTGAAAGCTGAGCAATTCTAGTACTCTACTTAATTGTTTTGGCTTTCATTACTTGTTATTAGGCCTAAA
TATAaTACTACTACTACTTAATCCTTTATCTAAaccaAAAaCTTAttagatcTGACTACTctggattcattACTAGTAG
Ta > SEQ ID NO:1364 109329 1118432_301856_1
GTAGAGGAAGGAGGGTAGAAAGGAGGAGAAGGAGATGGCGCCAAAAGCACCGAAATCAGGCATTGCAGCGGGTCTCAAC
CGAGGCCATGTCGTTACCAACAGGGACCTCGCCCCTAAGCCTTCTGCTAGGAAAGGGAAGCTTGGAAAGAGGACGGCCT
TAGTGCGAAGCTTGATCAGGGAAGTAGTAGGGTTTGCTCCTTACGAGAAGAGAATCACTGAGCTGCTGAAGGTTGGAAA
AGACAAGAGGGCATTGAAAGTGGCCAAGAGAAAGCTTGGCACCCACTTGCGAGCCAAGAAGAAGAAGAGAAGAAATGGCC
AATGTCTTGCGGAAGATGAGGTCTGGGGGAGGAGCAGAGAAGAAAAGTGACAGGCTCGTATGATTTACCAGATTTTGT
CTCAATCTTTGGATTATATGGTGGCTCTATTTATATCTTTGGTTCTTTGCTAAGCATAGGTTAATATCAGCAAGACATT
CTCAAGTAGAATTGAATTCTTACATACAAATTCCCAACGGAAATTTTCTTATAATGGATCTTGGTGTTATGTGAACCGT
TGGATATCAAAATCTTATCAAATTTTACATC > SEQ ID NO:1365 109329 147171_301205_1
CTAATTGAAGAGGTGATGGCTCCGAAGCAGCCTAATACAGGCTATCCGTTGGGCTAAACAAAGGACATGTTGTAACCAA
GAAGGAATTAGCTCCACGTCCTTCTGACAGAAAAGGGAAAACAAGCAAAAGAGTCCACTTTGTGAGGAGCCTTATCGA
GAAGTCGCTGGATTTGCTCCATATGAGAAAAGGATTACTGAGCTTCTTAAAGTTGGAAAGGACAAGCGTGCCTTGAAGG
TAGCCAAGAGGAAGTTGGGCACTCACAAGAGGGCAAAGAAGAAGAGAGAAGAGATGTCTAGTGTTCTCCGTAAGATGAG
GGCTACTGGAGGTGGTGAAAAGAAGAAATGAAACCTGTATGGTTGATGATTGAAGAACCCAGTTAGTTAATTCACTTGC
TTTTATGTTTGCAATGTATTTTGGTTTTCAAGAAAGAAGACTTGTGATTAAAAGCTCCCGGTTTATGTCCCATGAAGAA
TTTGAAATTA

FIG. 2 continued

> SEQ ID NO:1366 109329 128732_300477_1
aacttttcttccaaaGGAATGGCTCCGAAGCAGCCAAATACAGGCCTTTCTGTGGGCCTTAACAAAGGACATGTCGTT
ACTAAGAAAGAGTTAGCGCCCCGTCCTTCTGATAGGAAAGGGAAAACCAGCAAAAGAGTACATTTTGTTAGAAGCCTTA
TCAGGGAGGTAGCTGGTTTTGCACCGTATGAGAAGAGAATTACCGAACTTCTTAAAGTTGGAAAGGACAAACGTGCTCT
TAAAGTAGCCAAGAGGAAGCTGGGCACTCACAAGAGAGCAAAGAAGAAGCGTGAAGAGATGTCTAATGTTCTCCGTAAA
ATGAGGTCTGCTGGAGGTGGTGAAAAGAAGAAATGAGTTGCATGTTAAGACCTCTTCATTAAATTTTAGGTCCAAAAAA
CTGCTTGGCAAAGATTTATTTTAGTTTCTCTTTTGAACTGAAAATTTTGATTTGATCCTTTTTTTTAATTGGATGTTGA
AGCACCCTAACTCTGTGCTTTTTGTAATTTGTTGTTTCAGAAAGAGAATGGTTCGAAATTTCC > SEQ ID NO:1367 109329 18770_300241_1
GGTATCAACGCAGAGTGGCCATTACGGCCGGGGTCAAGCTCCCTATGAGAAGAGGATCACTGAGCTTTTGAAGGTTGG
TAAAGACAAGAGAGCTCTTAAAGTTGCCAAGCGAAAGTTGGGAACTCACAAGAGAGCTAAACGAAAGAGAGAGGAGATG
TCCAGTGTTCTCCGCAAGATGAGGTCTGGTGGTGCTGGTGCATCCGAGAAGAAGAAGTGATGCGCTGACTCTGGTTCAG
CGCTCTGTTTTTTCTAAACCAGTTTTCTGTTTTTTGAATTTTTTGCAGTACCTTGTGTTTCCTTTGGATATTTTGTAGC
AGAGATAATTAAATGTTAAAACGAAACCATTATGACTTTTGAGCCAGTTGTCTTCGGGTGTG > SEQ ID NO:1368 109329 207430_300805_1
ACCAAGAGGGTGACCTTTGTCAGGAACTTGATCAGGGAGGTTGCTGGATTTGCTCCCTATGAGAAGCGTATCACTGAGC
TTCTCAAAGTTGGCAAGGACAAGCGTGCACTGAAGGTGGCAAAGAGAAAGCTTGGCACCCACAAGAGGGCCAAGAAGAA
GAGAGAGGAGATGGCTGGTGTCCTCAGGAAGATGAGGTCTGGTGGCGGTCACGCTCACACCGAGAAGAAGAAATAGAGT
ATCTCCAAGTTCATGAAGTCCATGGCAATATTGTCTTGTTGAGTTTACTCTTGTAGAACCCTACTACTAGAATTGGACT
CTATTATCCAGCTAAACATCATGGTGTTAGTTCTGTGTTAAAAACCTCCTGTCTTGTGTTTTTGATCCTTTCAATGCAT
GGTTTGCCACCTTAAATTTGCTTGATTAAN > SEQ ID NO:1369 109329 215611_300883_1
TCGATCAGTCGACAATTCATTCAAGATGggtAAGGAAACGCCTGCAAAGACCGGTCTGGCCGTTGGCCTGAACAAGGGC
CACGTACGTCAATACAACTCGCGATCTCACCTCGTGGAGGATCTCTGCCCCCAACCTTGATCTCGGCAGACGATGGACG
CTGACGTTTTATGGTTTGTGTTTGCCTGAATATAGAAGACCACTGCTCGTGTCGTCAAGCCCCGTGTTTCTCGCACCAA
GGGCCACCTGAGCAAGCGAACCGCTTTCGTGCGTGAGGTCGTCAAGGAGGTTGCTGGCCTCGCCCCCTACGAGCGTCGT
GTCATCGAACTGCTCCGAAACAGCAAGGACAAGCGTCCCGTAAGCTGGCCCAAGAAGAGGCTCGGTACCTTTGGCCGTG
CCAAGAGAAAGGTCGATGAGCTCCAGCGCGTCATCGCCGAGTCTCGTCGTGCTCACTAAACGATTTCTTCTTTAAGCGA
GCGGGAGAGATTCATCTTGGTAATGGGGAAAAACAAAAATTATTTCAACAGGGAAATGAATTAAAAAAAACACTACGGGT
TTCGCATGGATTTGGCGTGGTCATGAATTTTGATTGAATTCAAATGGGGCTCTTTGATGCGGGCGCAGCAGCGTTTATA
TAGCTGCGATTTCGTTCATCGAATTTCTTAAACTCTTCAAGCATGCCGTCTTTATGACCCAACCTAGAAAATTTTCTT
CTTCTaggaaAaaaAaaaggaaaAaggaa > SEQ ID NO:1370 109329 224324_300971_1
GGGCGCCCAACGTTGCGAGCAGCGGGATCGCGATCGGGCTCAACAAGGGGCATGTCGTCACCAAGCGGACGCCGGCGAA
GCGGCCGATCGCCATGAAAGGGAAAGGGCAGAAGAGGACGCTATTCGTGAGGAAGCTGATCCGGGAGGTGGTGGGATTC
GCACCCTACGAGAAGAGGATCACTGAGCTGCTCAAGGTTGGGAAAGACAAGCGCGCGCTCAAGGTTGCCAAGCGAAGGC
TCGGGACTCATCTTAGAGCCAAGAAGAAACGCGAGGAGATGTCTACGGTTCTAAGGAAGATGAGGTCTGCGAAGTAGGA
TAAGCTCTTTTGTATTGGTTCTTTTAAAATCAAATTGATACGTATTTCAACCCTTT > SEQ ID NO:1371 109369 127237_300469_1
CCCTTGGTGAGCCCAATTTGTATACTGATTTGTGTACAATCCCATCTTTGAGTTTTAACCCTATGGGCCATGTAGCTGA
AACAGGTTCAATTGGACTTAACCATCTTACCCCTTCTCAGATCTTCCAAATCCAAGCCCAGATCGAATTCCAAAACCAA
CAACAACAACAACAACTTTTACTACAACAACAACAGAGCTTAGGTTTATTACCAACAACTCCAACATATTCTAAGA
ATTTGAATTCAATGAACTATCTTGGTCTTAAACCAGTCCCAATGAAGCAAAGTGGTGGTGCTATACAGAAGGCTACAAA
GCTTTATAGAGGAGTGAGACAACGTCATTGGGTAAATGGGTAGCTGAAATTAGACTTCCTAAGAATAGAACTAGGCTT
TGGCTTGGCACTTTTGATACAGCTGAAGAAGCTGCTTTGGCTTATGACAAAGCTGCTTATAAGCTAAGAGGAGAGTTTG
CTAGGCTTAATTTTCCACATCTAAGGCATCAATTAAACAATGAATTATCTGATTTTAAGCCTTTGCATTCCTCTGTTGA
TGCTAAACTTCAAGCCATTTGCCAAAACCTAGCAAATTCTGATGGCTTGTCTTGTAATAATAATACTGATTCCAAGCCA
AGAAAGTCCAAAAAAGCAGCATCCAAATTGGATGC > SEQ ID NO:1372 109391 273714_200145_1
gggattatgagtgctgatgccgaaatttggaatggaagatttgccatgctgggattagttgctttagcgtttactgaat
aTGTTAAAGGAGGTGGCATCTTCCAAGTCTGAAATGTAACTTTTATACTAGTACGTTCTTTTATATCTGATGTAAACAA
TGTTATATTGCCATGTAACCACAGCTTATAATTTCAATTATAACTTATATGATATAAAAATATGTCTGTTAATCTGGTT

FIG. 2 continued

> SEQ ID NO:1373 109411 137953_300687_1
GTACGAAAAGAGGAGAGCCATATCCCAGCATAAAGAGCCTCAAGCATCTGCTAGATCTCAACATATTGTCCCCCGATCA
GAAGGAAGGCGCAGCCGTTCTGGAAAGAAAGGGAAAAAGAGACCTGCTCGCCGCAGATCTCAACAGAAAACAGATGAAT
TATCTGCTGTAGAGAGTGGCAGTAATTATTCCTCACGCAGAGATGATGATACTGCAATGAGTGGAAGGGACCAGGTATT
GAGTTCCAGTTCACGATTTGCGTCTCCTGAGGACTCAAAATACAAGCAGAAATCTCCTGCTGAATCCCCAATGGAAATA
ACTTCTGAGACGAAGTTGCCTACAGTTCTCAGAAGGAAATATCCTGATACACTCAAAGATGGTTTTGTTGTAGCCTTGA
GAACAAAAGATAATTCAGGGTTCCATGTTGCAAGACAGAGACTTGCTGGTGGTGGTTGGATCCTTGATATCGTGTC
AAATGCTACAAACAGGGACCCTGCTGCTCAGTTCCTAGTCACTTTCAAAAACAAGGATACCATGGGATTACGTTCCTTC
GTCGCTGGTGGTAAACTATTGCAGATTAATAGGAGGATGGAGTTTGTGTTTGCAAGTCATACATTTGATGTTTGGGAGA
GCTGGATGCTGGAGGGGTCCTTGTTGGAG

> SEQ ID NO:1374 109420 127269_300469_1
CGACAGTGGCCATGGCTACTCAACGAAGGGCAAACCCTAGCTCTCTCCATCTAATTACTGTATTCTCTCTGCTTGTCGC
TGTCGTCTCCGCTGAGGTCTTCTTCGAGGAGAGTTTCAACGATGGTTGGGAAAGCAGGTGGGTGAAATCTGAATGGAAG
AAAGATGAAAACATGGCTGGAGAGTGGAATCACACATCTGGCAAGTGGAATGGAGACGCTAATGACAAAGGTATCCAAA
CCAGTGAGGACTACAGGTTCTATGCCATTTCAGCTGAGTTCCCTGAATTTAGCAACAAGGGAAAAAAACTTAGTGTTCCA
GTTCTCTGTGAAGCATGAGCAGAAGCTTGACTGTGGTGGTGGGTACATGAAGTTGCTTAGTGGGGATGTTGACCAAAAG
AAATTCGGTGGTGACACTCCCTACAGCATCATGTTTGGCCCAGACATCTGTGGCTACAGCACCAAGAAGGTCCATGCTA
TTCTCACTTATAATGACACAAACCACTTGATCAAGAAGGAAGTACCTTGTGAGACTGATCAACTGACCCATGTTTACAC
TTTCATCCTCCACCCTGATGCTACATACAGCATTCTCATTGATAATGTGGAGAAACAGTCTGGTAGCTTGTACTCTGAC
TGGGACCTTCTCCCACCAAAAGACAATCAAGGATCCAAGTGCCAAGAAGCCTGAAGATTGGGATGAGAAGGAATTCATTG
ATGATCCTGAGGATAAGAAGCCAGAGGGCTATGATGACATTCCAGAAGAGATAACTGATCCTGATGCCAAGAAGCCAGA
GGACTGGGATGATGAagaagATGGTGAATGGACAGCCCCAACCATTCCCAACCCCGAGTACAAGGGCCCATGGAAGCCA
AAGAAAATTAAGAACCCCAACTACAAGGGGAAGTGGAAGGCTCCTTTGATTGACAACCCAgaCttcAAGGATGACCCAg
aTCTCTATGTTTCCCAAATCTGaagtatgtGGGagtTGAACTgtggcAAGTGAAATCt > SEQ ID NO:1375 109420 183295_300620_1
CGCGCTTCCGCCGCTGCAGCCGATACGGGAGATTGGATCGGAAGCTTCTAGAAGTTTCCGTGGGCGATGGCGATCCGCG
CGAGGTCCTCCTCCTACGCCGCCGGCGGTCGGCTGGCGCTCGCGCTGGCGTCCGTCGCCGCTGTCGCCGGCGAGGT
CTTCTTCCAGGAGAAGTTCGAAGATGGATGGGAAAGTCGGTGGGTCAAGTCAGAATGGAAGAAGGATGAGAACATGGCT
GGTGAATGGAACCACACATCTGGGAAGTGGAATGGAGATCCTGAGGACAAAGGTATCCAAACCTCTGAGGACTACAGGT
TCTACGCTATTTCAGCGGAGTACCCAGAATTCAGCAACAAGGATAAAACCCTGGTGCTGCAGTTCTCTGTAAAGCATGA
GCAAAAGCTTGACTGTGGTGGTGGATATGTCAAGTTGCTTGGTGGTGATGTTGACCAGAAGAAATTTGGTGGGACACA
CCGTACAGCATTATGTTTGGACCAGACATCTGTGGGTACAGCACCAAGAAGGTCCATACTATCTTTACTAAGAATGACA
AGAACCATTTGATCAAGAAGGATGTCCCCTGCGAGACTGATCAGCTGTCCCATGTGTACACTTTGATCATCCATCCTGA
TGCTACATACACCATACTTATTGACAATGTTGAGAAGCATCTGGCAGCATCTACGAGCACTGGGATATTCTGCCTCCG
AAGCAAATCAAGGACCCAGAAGCTAAGaAGCCAGAGGACTGGGATGACAAGGAGTACATTCCTGACCCTGAGGACAAGA
AGCCTGAGGGATAcGaTGATATTCCCAAGGAAATCCCTGACCCTGATGCTAagaAGCCTGAGGACTGGGATGATGAGga
acatGGTGAGTGGACTgcaCCAACCATTCCTAACCCTGAGTACAAggGAcCATGGAaGCAAAAgaAAATCAAGAAcCCT
AACTAccAaggcaAATGGAaggcaccGATGATCGACAACCCAGACTTCAaggatGATcCATACATCTATGCttTTgacA
gcctgaagtacAttgg > SEQ ID NO:1376 109513 188267_300697_1
cgagggagggggGGTCGGCGGGGAACAAGTTCCGGATGTCGCTGGGTCTGCCGGTGGCGGCGACGGTGAACTGCGCGG
ACAACACCGGGGCCAAGAACCTCTACATCATCTCCGTGAAGGGCATCAAGGGCCGCCTCAACCGCCTCCCGTCCGCCTG
CGTCGGCGACATGGTCATGGCCACCGTCAAGAAGGGCAAGCCCGATCTCCGTAAGAAGGTCATGCCCGCCGTCATCGTC
CGCCAGCGCAAGCCGTGGCGCCGCAAGGACGGTGTGTACATGTACTTCGAAGATAATGCTGGAGTGATTGTGAATCCTA
AGGGTGAGATGAAAGGTTCTGCTATCACTGGACCCATCGGGAAGGAGTGTGCTGACCTTTGGCCTAGGATAGCTAGTGC
AGCAAATGCTATTGTCTGAGCTTGTTTGAATGAATTGTAAGACAGCTATATGACCTCAGGATCGTCTGCAAATGGTTTA
CTAGGACAACTGTGGAACTTTGTGATGCTATCGTTTGTTTGCCCGTTTCAGTTTTGTAGTGAACAGAAGTTGCCATCCA
TATGATATTTTATTTGCc > SEQ ID NO:1377 109513 191583_300786_1
cccccGgggtcctcgtCTCCTCGCGCCGCCGCCGCCGCCGCGGACGCCGCCATGTCGaagCGAGGGAGGGGTGGGTCG
GCGGGGAACAAGTTCCGGATGTCGCTGGGTCTGCCGGTGGCGGCGACGGTGAACTGCGCCGACAACACCGGCGCCAAGA
ACCTCTACATCATCTCCGTGAAGGGCATCAAGGGCCGCCTCAACCTCCTCCCGTCCGCCTGCGTCGGCGACATGGTCAT
GGCCACCGTCAAGAAGGGCAAGCCCGATCTCCGGAAGAAGGTCATGCCCGCCGTCATCGTCCGCCAGCGCAAGCCGTGG

FIG. 2 continued

CGCCGCAAGGACGGTGTCTACATGTACTTCGAAGATAATGCTGGGGTGATTGTGAATCCTAAGGGTGAGATGAAAGGTT
CTGCTATCACTGGACCCATCGGGAAGGAGTGTGCTGACCTTTGGCCTAGGATAGCTAGTGCAGCAAATGCTATTGTCTG
AGCTTGTTTGAATGAATTGTAAGACAGCTATATGACCTCAGGATCGTCTGCAAATGGTTTACTAGGACAACTGTGGAAC
TTTGTGATGCTATCGTTTGTttgcccGTTGCAGTTTTGTAGTGAACAGAAGttgccaTCCATATGATAttTTAtttgcc
ATCTAA > SEQ ID NO:1378 109513 241252_301346_1
TCGGGCAGCGGCGGCGATGTCGAACCGAGCGAGAGGAGCGGCGTCGGGCAACAAGTTCCGGATGTCCCTGGGTCTCCCC
GTGGGCGCCGTCGTCAACTGCGCCGACAATACCGGGGCCAAGAACCTGTACATCATCTCCGTCAAGGGCGTCAAGGGGC
GGCTGAACCGCCTCCCGGCGGCGGCGATTGGCGACATGGTGATGGCAACGGTCAAGAAGGGCAAGCCCGACCTGAGGAA
CAAGGTGATGCCGGCTGTGATCGTGCGGCAG > SEQ ID NO:1379 109513 254848_301639_1
ACGCGTCGATCCGTCGGGACGCGAAGAAGTTCTGAAGCCATGTCGAAGCGAGGACGAGGAGGGTCCTCCGGGAACAAGT
TCCGGATGTCTCTGGCTCTTCCAGTGGCCGCTGTTATGAACTGCGCGGACAACACCGGAGCCAAGAATCTCTACATCAT
CTCGGTCAAGGGCGTTAAGGGAAGACTCAACCGTCTCCCTGCGGCTTGCGTTGGTGATATGGTCATGGCCACCGTCAAG
AAGGGAAAGCCTGACCTCAGGAAGAAGGTTATGCCGGCTGTCGTCGTTAGGCAGCGCAAACCCTGGAGGCGAAAGGACG
GCGTCTTCATGTACTTCGAAGACAATGCCGGAGTCATAGTGAATCCCAAGGGGGAAATGAAAGGCTCGGCCATTACAGG
ACCCATTGGGAAAGAGTGCGCTGATTTGTGGCCCAGGATTGCTAGCGCAGCCAATGCAATAGTCTAACCCTGCACTTGC
GCATCAGTTTTTGTCATTAGGGTCAATGCGGATCTTTAGTAATACAAAGTGGGCTACT > SEQ ID NO:1380 109513 4662_300310_1
CGCTTGTCAAAATAGCCAAATCATTTGAATGTCAGATACATATTGTCAGAAAATAAAAATATCTTGCTACCAAAATTCT
CAAATTTGTATCTAGACATATCCATCAAATACAAGCAATTGATTGATCTGATCATTAGACAATGGCATTGGCAGCACTA
GCAATCCTTGGCCAAAGATCAGCACACTCTTTCCCAATAGGACCAGTAATTGCAGAACCTTTCATTTCTCCCTTGGGGT
TGACAATGACTCCAGCATTATCTTCGAAGTACATGAAAACACCATCCTTTCGGCGCCATGGTTTGCGTTGCCTAACGAT
GACGGCAGGAAGAACCTTTTTCCTGAGATCAGGCTTACCCTTTTTGAC > SEQ ID NO:1381 109513 41839_300145_1
TGTCTAATCGAGGACGAGGCGGTTCCCCTGGGAACAAGTTCATAATGTCCTTGGGTCTGCCGGTGGCGTCGACGGTGAT
CTGCGCCGATAACACAGGTGCTAAGAACCTGTGCATCATTTCAGGGAAAGGGATCAAAGGAAGGCTT > SEQ ID NO:1382 109513 274495_200057_1
agAGAGGGAGCAGCAGAGCAAGACCGTCAACAATGTCGAAGAGAGGTCGCGGAGGTTCCGCGGGTAACAAATTCAGGAT
GTCACTAGGTTTGCCGGTGGCAGCTACCATTAACTGCGCCGATAACACTGGTGCAAAGAACCTTTACATCATTTCGGTG
AAAGGTATCAAAGGAAGGCTTAACAGGTTGCCATCAGCTTGTGTGGGTGACATGGTCATGGCCACAGTGAAGAAGGGTA
AGCCTGATCTCAGGAAAAAGGTTATGCCAGCTGTCGTTGTTCGTCAGCGCAAGCCGTGGCGCCGAAAGGACGGTGTCTT
CATGTACTTCGAAGATAATGCTGGTGTAATTGTGAATCCCAAAAGGCGAAATGAAAGGATCTGCAATTACAGGGCCAATC
GGGAAAGAGTGTGCTGATCTGTGGCCTAGGATTGCAAGTGCTGCTAATGCTATCGTATAGGAGAGCCTTTGAATAGTTT
GAGATTCTCGTTTTGATGGTTGATTTAAGTTTTTGGATATCAGATAGCTGTCTTATTAAGAGTTACAGAGTATTAGTTT
TGCTAGCTGTAAGAATTTTGCATCAAGAATACAGAACTAGTATCTGTTTCTACTGTTTGTTATTTACTTTTTCAGGTGA
ATGCTTTGaccaaaaAaa > SEQ ID NO:1383 109523 235963_301276_1
gcaaaaaaggtgtcTCGAGAGGTCGCCAAGACAAGGAAGCCCGGCGGAGGAGGAGCAGCAGCAGCATTAGCAGCAACAG
GAGGGACAGGAGGAAGCTCAATGGGGACCGTCGCAAACAACTGGAAGCTGGAAGCCCATCCAAACATGCCTAAAGGGAA
GATTGTGGCTTTGATTGTTTTGGATGGATGGGGCGAGCAGATCAAGGACGAGTACAACGCCATCCATGTCGCCCCTACC
CCCTGCATGGACTCGTTCCGAGAGACTGCCCCCGACAGGTGGAGACTTGTCAAAGCCCACGGACCTGCCGTCGGACTTC
CAACCGAGGACGATATGGGAAATAGTGAGGTTGGTCACAATGCTTTGGGAGCGGGACGTATTTTTGCTCAAGGTGCGAA
GCTGGTCGATGCGGCTATTGCATCCGGGAAGTTgtttAAAGGAGAGGGAtttaatTACATCAAGGAGGCTTTTGGTACT
ggCACTCTCCACCTTATTGGATTGTCgagtGATGGTGGtgtccattCGAGATACGaccagCTTCAGgGTTTCATGAAAG
GAGCTgt > SEQ ID NO:1384 109523 57101_300378_1
atttgttcaacaagtgtaggcttccgattttttcagctcaggaatccaataaaccccccccccccccccaatcactcgtt
cATTAGTTTCTCCACTACAACACTTTTTGCTCCCTCTTCTCCTCTACTATATCGCCTCATCTGTATTAAGGTGAAGAAA
ATTTTAAGATCTGAGATATGGGAAGTTCAGGAGATGCATGGAAATTGAAAGACCACCCTAAACTTCCAAAGGGAAAGAC
AGTAGCTGTGATTGTTTTGGATGGTTGGGGTGAGGCTAAACCTAATGAGTTTAATGCTATCCACGTTGCTGAAACTCCT
GTTATGGACTCCCTCAAGAATGGTGCTCCTGAAAAATGGAGATTGATTAAGGCACATGGTAATGCTGTGGGACTGCCCA

```
CAGAGGATGATATGGGTAACAGTGAGGTTGGTCACAATGCTCTTGGTGCTGGAAGGATCTTTGCTCAAGGTGCAAAGCT
TGTTGATCTGGCCCTTGCCTCTGGTAAAATATATGAGGGAGCAGGTTTCAAGTACGTTAAAGAATGCTTTGAAAAAGGA
ACTTTACACCTTATTGGGCTCTTGAGTGATggngggTGTCCACTCCAGGCTTGACCAAGTGCAGTTGTTGCTGAAAggt
GCTGCTGAGCATGGTGCCAAAAGAATTCGTGTCCATGCCCTCACTGATGGACGTGATGTTCTagaTGGTTCTAGTGTGG
GcTTCATGGAGACTCTTGAGAATTCTCTTGCACAATTACGTGAAAAAGGTATTGATGCCCAGGTTGCATCTGGCGGAGG
TCGTATGTATGTTACCATGGATCGATATGAGAATGACTGGGATGTCGTAAAAAGAGGTTGGGATGCTCAAGTTCTTGGT
GAGGCTCCACACAAGTTCAAGGATCCCGTTGAAGCAGTTAAAAAGTTGAGGCAGGAACCCAACGCCAATGACCAGTACT
TAGCCCCTTTTGTTATTGTTGACGATAATGGAAAGCCCGTTGGGCCTATTTTAGCAGGTGATGCTGTTGTGACTTTCAA
CTTCAGAGCAGATCGTATGGTCATGCTTGCAAAGGCCCTTGAATACGAGAACTTTGATAAATTTGATCGTGTACGAGTC
CCTAAAATCcgttATGCTGGTATGCTCCAATATGATGgtgAGTTGCAGCTtccaaGACACTACCTtgtttCTccTccag
aAATTGACAGGACATCTGgGGAGTATCTAGTGCGCaatggtgttaggACtTTtGCttGCagTgagactgttaaATTtgg
tcATGt > SEQ ID NO:1385 109523 141871_300429_1
CCCCACAACTGCATCCATGTCGCCCAGACGCCCGTCATGGATTCGCTCAAGAATGGTGGTCCCGAGAGGTGGAGATTAG
TGAAGGCTCATGGAACAGCTGTTGGTCTTCCTAGCGAAGATGACATGGGCAACAGCGAAGTGGGTCACAATGCTCTTGG
TGCTGGTCGCATTTTTGCTCAGGGTGCTAAGCTTGTGGACCTTGCTCTTGCCTCTGGGAAAATTTATGATGGAGAGGGG
TTCAATTACATCAAAGAATGTTTTGACAAGGGTACCCTGCACCTTATTGGTTTGTTGAGTGATGGAGGCGTTCACTCCC
GTCTTGATCAAGTGCAGCTGCTTCTGAAAGGTGCCAGTGAGAGGGGAGCAAAAAGAATTCGTGTTCACATTCTTACTGA
TGGACGCGATGTTTTGGATGGCAGCAGTGTTGGTTTTGTAGAGACACTAGAGAGTGATCTTTCTCAGCTTCGTGACAAG
GGTATTGATGCACAGATTGCATCTGGTGGTGGAAGGATGTATGTTACCATGGACCGCTATGAGAATGACTGGGATGTGG
TCAAACGTGGGTGGGATGCCCAGGTGCTTGGCGAAGCACCCTACAAATTCCAAAATGCA > SEQ ID NO:1386 109523 182905_300664_1
GAATTCGCGAAAACTCAAACACCAACAAACAAAGATGGGAAGTGCTGAAGTTTCATTCAAATTGGCGGATCATCCAAAG
CTTCCTAAAGGGAAGGTAGTAGCTCAGATTGTATTGGATGGATGGGGAGAAGCTAGTCCTGACCAGTTTAACTGTATCC
ATGTTGCTCAAACACCAACCATGGATTCTCTAAAACAGGGTGCACCTGANAAGTGGAGATTGGTAAGAGCTCATGGTAA
GGCAGTTGGTCTCCCAACTGAAGATGACATGGGTAACAGTGAAGTTGGACATAATGCCCTTGGTGCTGGAAGAATTTTT
GCTCAAGGTGCCAAGCTTGTTGACATTGCACTTGCCTCGGGAAAGATCTTTGATGGAGAAGGCTTTCAGTACATCAAGG
AATCCTTTAAGGATGGCACCCTCCACCTAATTGGGTTATTGAGTGATGGAGGTGTCCACTCTCGAATTGAT > SEQ ID NO:1387 110965 1119616_301899_1
GAATGTTGGGAGTAGTGTGATTGAAAAAGGTGGTGGTGGTATTGGGTTTCAGCTTGACTACGGTGAAAAAGATAGTAGC
TACAACCGTATCAAGAGTCTTGTCAACGAGGAACTCAAGCAGTATTTCAGACCAGAGTTTTTGAATCGTCTTGATGAGA
TTATTGTCTTCAGGCAATTGACGAAGATTGAGGTTAAGGATATTGCTGATATTATGTTGAAAGAGGTGTTTGAGCGTTT
AATGAAGAAATCTATCGACCTTCAAGTAACTGAAGCGCTTTAGAGACAGAGTTGTGGATGAGGGGTACAGTCCGAGCTAT
GGTGCAAGGCCGCTACGGAGGGCTATTATGCGCTCTATTAAAAGACAGTATGGCAGAGAAGATGCTGGCAGGTGAAATCA
AGGAAGGCGATTCTGCTATCATTGATGTTGATTCTGATGGAAATGTGACTGTTCTAAATGGAACTACTGGAACCATGTC
AAGTAAGGAGATTGAAGCCCCAGCTGGAATTGCTTGATTGGTAATTATAACTGGTTGAAGGTCTTGTTTGGGTTGC > SEQ ID NO:1388 110965 181685_300626_1
GAATTCAGAACACACTTCTCATAATGACTTCTAATGTCGGAGGCGATGTGATTGACAAGGGAGGTACGACAATTGGTTT
TGATTTACACTATGATGATAAAGACAGCAGCTACAACAGGATCAACAGTCTCGTGCAACAGGAGCTGAAACAGTATTTT
AGACCACAATTCTTGACTACATTAGATGAGATGATTGTTTTCAGACAGCTGACGAAGTTGGAAGTCAAGGAGATTGCAG
ACATAATGCTCAAGGAGGTGTTTGAAAGACTGCGTAACAAGGAAATAGAGCTTCAGGTTACTGAAAGGTTTAGAGACAG
AGTGGTTGATGAAGGATACAACCCAAGCTATGGTGCGAGGCCGCTGAGGAGAGCGATTATGAGACTTTTGGAGGACAGC
ATGGCAGAGAAGATGCTGGGAGGAGAGATTAAAGAGGGAGATTCAGTCATCGTAGACGTAGATGGTGATGGAAATGTCA
CAGTGCTCAACGGTACATCACCACAACTGGTG > SEQ ID NO:1389 110965 11534_300292_1
GGAGATAGGGTGGTTGACTAATGATACAACCCAAGCTACGGGCACGGCCTCTGAGAAGAGCTATCATGGACTGCTAGA
GGACAGCAGGGCCGAGAAAATGCTTGCAGGTGAGATCAAAGAAGGCGACTCCGTTATTGTGGACGTGGATTCAAACGGC
AATGTGACTGCTCTCAATGGCAGTAGGGATACTCCCTCAAACCCCACTCCGGAGCCTATCCCTGTGTAGATCAA > SEQ ID NO:1390 110965 272317_200043_1
GCAAGGGCAGAACTGTGGACTTCAAGAATACACTTCTCATCATGACATCGAATGTCGGAAGCAGTGTGATAGAGAAGG
AGGCCGTCGTATAGGTTTTGATCTAGATTATGACGAGAAGGATGCAGTTACAACCGTATCAAAAGCTATCAAACCTTGGTGACTGAG
GAGTTGAAACAGTACTTCAGGCCAGAGTTCTTGAACAGATTGGATGAGATGATTGTATTCCGTCAGCTAACTAAGTTAG
AGGTGAAGGAGATAGCTGATATCATGCTTAAGGAGGTCTTTGAGAGGTTGAAAAATAAGGAGATAGAACTTCAAGTGAC
```

AGAGAGGTTTAGAGACAGGGTGGTTGATGAAGGGTACAACCCAAGCTACGGAGCAAGACCGTTGAGGAGAGCTATTATG
AGACTGCTGGAAGACAGCATGGCTGAGAAGATGCTTGCCGGTGAGATCAAAGAAGGTGATTCAGTAATTGTGGACGTGG
ACTCTGATGGTAAT

> SEQ ID NO:1391 111075 248583_301584_1
GAGAGAGAGAGAGAAAGAAATGGCCGAGGTCGATGTGGAGTACCGTTGCTTCGTCGGCGGCCTCGCTTGGGCGACGGAC
GACATGAGCCTCGGCAACGCATTCAAATCCTTCGGCGATGTCGTCGAATCCAAGGTGATCAACGACCGCGAGACGGGCA
GATCCCGCGGCTTTGGATTCGTCACTTTCCGGGACGAGAAATCCATGAACGACGCCATCGAATCGATGAACGGCAAGGA
TCTGGATGGCCGCAACATCACCGTCCACCAGGCACAGCAAAGGCCGACCATGACCAGCCCGCTATAGTGGATCTAACCA
AGAC

> SEQ ID NO:1392 111075 272607_200131_1
TTTTTTAGGGTTTCTTCTTATTAAtcagAAAAAAATGGCAGAAGGTGAATACAGGTGCTTCGTCGGTGGGTTAGCATGG
GCTACTACCGACCAAACACTTGGGGAGGCTTTTTCTCAGTTCGGCGAAATTCTTGACTCGAAGGTCTGTGGCAAAACAG
AGCAGAGATCGGATTCGAGCCGATTTGAATCGGCTTCGTTGACCCTCTGTTACTGGAAAAATTGATCTGTTACTACTCT
CTCTGTTACTGTTACTACTCTCTGGTTTATCTGTTACTGTTACTATTTGATACTAATATTCCACTTTCCCCGAAACGGT
ACGTTCCGTCTTCCTCTGTTTATACAAGAGATGAAGATAGATCGATTTTATGTTTCTCCCCTATTTTTTTTGATTTTTG
ATTTTATGGATTTTCCCCATTTTGGATGTTACGTTGTAGATCCGTTTAGATCTGATGTGGTTTTATGATATTTGAAAA
TTTCAGATTATCAATGACAGAGAAACTGGTCGATCTAGAggGTTTGGATTTGTtACATTCAAGgACGAGaAATCTATGa
gggACGCTATTGaaggGATGAACggccaggaccttgacggTCGTAaCATCACCGTCaacgaagctcaatctCGcggaag
cggTgGAggCGGTGGCggttaccgtGgTGGTggcggtGG > SEQ ID NO:1393 111075 265593_200112_1
aaaaaaatcAATGGCTGAAGTTGAATACCGTTGCTTCGTCGGTGGGCTCGCATGGGCTACCACTGATCGAACCCTAGGC
GAAGCTTTCTCTCAGTATGGCGAGGTGCTTGAATCGAAGATCATCAACGACCGTGAAACCGGTAGATCTAGAGGATTTG
GCTTTGTTACTTTTGGCGATGAGAAATCCATGAGGGACGCTATCGAAGGGATGAACGGCCAAGACCTTGATGGTCGTAA
CATAACCGTTAACGAAGCTCAATCACGCGGAACGCGGTGGAGGCGGCGGCGGCGGCGGTGGTTTCCGCGGTGGACGTCGT
GAGGGAGGCGGCGGATACGGAGGGGGAGGATATGGAGGTGGAAGACGCGAGGGCGGCGGCGGTTACGGCGGAGGCG
GCGGCGGTTATGGCGGTGGCCGTGACCGTGGATATGGCGGTGGTGGTGACCGTGGATACGGTGGTGATGGAGGATCACG
CTACTCAAGGGGTGGTGGTGACTCTGATGGAAACTGGAGGAATTAGATAATTGAGAAGATGTGGATTTTAGTTATTTTG
ATCGCAGTTTAAGTTGGTTATATCTTAATGTTAGTGTGACTCTTTTTTGACCGTTATTTGGCTCGTTACGTTACTGTGT
TTTTCTATTAACTGAGTTCTTATGGAATGAATTAAATTAAGgTCTACAAATTAAATCTTTCTTTTGCAT > SEQ ID NO:1394 111075 1111371_301534_1
TGGTTCTTAAGGAGGAGACTCCTCCGACATTTTCCCCTTCGTTCTGGTTCGTTTTTCTCTGTTTGGTTTCTCTGTTCGG
GGTTCGGAAACATGGGGTCTGAGTACCGTTGCTTCGTCGGGGGTCTGGCTTGGTCCACTAATGACCAGGCTTTGGAATC
CGCTTTCAGTCAATTCGGAACTGTCATCGAATCGAAGGTTATCAATGACCGTGAGACTGGAAGGTCTCGTGGATTCGGG
TTTGTTACATTCGAGGATGAGCAAGCCATGAGGGATGCAATTGAAGGGATGAATGGAAAGGATCTAGATGGCAGGAACA
TTACTGTAAATCAGGCTCAGGACAGGTCATCAAGTGGTGGTGGTGGTGGCGGCTACCGAGGAGGTGGTGGTGGTGGTGG
TGGTTACCGTGGTGGTGGTGGCGGTGGTTACAGTGGCGGTGGCAGTGGATACCGCTCAGGTGGTGGTGGATATGGTGGT
GGTGGCCAACGTAGGGATTCTGGGTACGGTGGAGAAGGTGGTGGCTACTCTGGCGGTGGGGGCTACGGTGGTGGTGGTG
GTGGATACGGTGGAAGTGGTGG > SEQ ID NO:1395 111075 170360_300532_1
cccccctggtggtctctcagAGGTGGGTTGggTTCTCCTCCCCCTCCCGGTTCGGTTCGGGTCCGGTTCGATTTCGGTT
TTTTCTTCGGTTCGGGGGTTGGTGGGAAAGCATGGCGGCGCCGGATGTTGAGTACCGCTGCTTCGTCGGCGGCCTCGCC
TGGGCCACCGACGACCGCTCCCTCGAAGCCGCCTTCTCCACCTACGGCGAGATCCTCGAGTCCAAGATCATCAACGATC
GGGAGACGGGGAGGTCGCGCGGGTTCGGGTTCGTGACGTTCTCGAGCGAGCAGGCCATGCGCGACGCCATCGAGGGGAT
GAACGGCAAGGAGCTCGACGGCCGCAACATCACCGTTAACGAGGCCCAGTCGCGCCGCTCCGGAGGCGGAGGCGGCGGT
GGCTACGGCCAGCGCGGCGGAGGCGGAGGCTACGGTGGCGGCGGCTACGGTGGTGGTGGCGGCGGCGGTGGCTACGGCC
AGCGCCGTGAAGGCGGCTACGGCGGTGGCGGTGGCTACGGTGGCGGCGTGGTGGCGGCAGCTACGGTGGTGGCTACGG
CAGCCGCGGCGGCGGCAACTCCGACGGGAACTGGAGGAACTGAGCGGTGGGGCCCTCATGGCCAAGTTATCTATCTATC
TAATCGAGCTACCATCATCATCAtccgATCGttATCATCgttagttttgtgtggaacTATCTagtTTgt > SEQ ID NO:1396 111075 160167_200029_1
gcgtccgttcTTTTTTAGGGTTTCTTCTTATTaatcagaAAAAAATGGCAGAAGGTGaatcagGTGCTTCGTCGGTGGG
TTAGCATGGGCTACTACCGACCaAACACTTGGGGAGGCTTTTTCTCAGTTCGGCGAAATTCTTGACTCGAAGATTATCA
ATGACAGAGAAACTGGTCGATCTAGAGGGTTTGGATTTGTTACATTCAAGGACGAGAAATCTATGAGGGACGCTATTGA
AGGGATGAACGGCCAGGACCTTGACGGTCGTAACATCACCGTCAACGAAGCTCAGTCTCGCGGAAGCGGTGGAGGCGGT

```
GGCGGTTACCGTGGTGGTGGCGGTGGAGGCTACGGAGGCGGTGGCCGTCGTGAAGGTGGTTATGGCGGCGGTGGTGGTT
ACGGAGGTGGCCGTCGTGAAGGTGGTTATGGCGGCGGTGGCGGCTATGGAGGTGGCCGCCGTGAAggTGGTTACgGTGG
TGGCTCTGAAggAAACTggaggaGTTAGATTTTCCGgttCCTTTaGaTTTAATTTTTTGTtTGaaTTTTATGGTtCTAA
GTTTGGTTGAAGttccgTTATGgtttactgtggttcctGTTActgttctTGttTTtGAccgcgagattgttaccgtgAT
GTTACcTagtggaTCTGTAtttACaaagttctctggaatcaagTGaaTta > SEQ ID NO:1397  111075  111364_300054_1
CTTTTTCTCAGTTCGGCGAAATTCTTGACTCGAAGGTCTGTgggaaaACAGAGCAGAGATCGGATTCGAGCCGATTTGA
ATCGGCTTCGTTGACCCTCTGTTACTGGAAAAATTGATCTGTTACTACTCTCTCTGTTACTGTTACTACTCTCTGGTTT
ATCTGTTACTGTTACTATTTGATACTAATATTCCACTTTCCCCGAAACGATTATCAATGACAGAGAAACTGGTCGATCT
AGAGGGTTTGGATTTGTTACATTCAAGGACGAGAAATCTATGAGGGACGCTATTGAAGGGATGAACGGCCAGGACCTTG
ACGGTCGTAACATCACCGTCAACGAAGCTCAGTCTCGCGGAAGCGGTGGAGGCGGTGGCGGTTACCGTGGTGGTGGCGG
TGGAGGCTACGGAGGCGGTGGCCGTCGTGAAGGTGGTTATGGCGGCGGTGGTGGTTACGGAGGTGGCCgtCGTGAAggT
GGTTATGGCGGCGGTGGCGGCTATGGAGGTGGCCGccgtgAaggtGGTtAcggtggtGGCTCTGaaggaAACTggagga
gtTAGaTtTtccggttccTttagattTAATTTTTTgttTGAATTTTATG > SEQ ID NO:1398  111075  118795_300067_1
gtttccatctctcttataaattaaaaaaaataaTGGCTGAAGTTGAATACCGGTGCTTCGTCGGTGGGCTCGCATGGGCT
ACCACTGATCGAACCCTAGGCGAAGCTTTCTCTCAGTACGGCGAGGTGCTTGAATCGAAGATCATCAATGACCGTGAAA
CCGGTAGATCTAGAGGATTTGGCTTTGTTACCTTCGGTGACGACAAATCCATGAGGGACGCTATTGAGGGGATGAACGG
CCAAGACCTTGACGGTCGTAACATCACCGTTAACGAAGCTCAATCACGCGGAAGCGGCGGCAGCGGTGGCGGCGGCGGC
GGTTTCCGCGGTGGACGTCGTGAGGGAGGCGGCGGATACGGTGGTGGAGGATATGGAGGTGGAAGACGCGAGGGAGGCG
GCGGTGGTTACGGTGGCGGCGGCGGTGGTTACGGTGGTGGCCGTGACCGTGGATATGGCGGTGGTGGTGACCGTGGATA
TGGTGGTGATGGAGGATCACGCTACTCAAGGGGTGGTGGTGACTCCGATGGAAACTGGAGGAATTAGATAATTGAGAAG
ATGTGGATTTTAGTTATTTGATCGCATTTTAAGTTGgTTATATCTTAATGttAGTGTGACTgtcTTTTTTGacc > SEQ ID NO:1399  111139  231346_301083_1
gtttctctacttgcttagatcgtggacaATGGGAGGAGTACGCGGCGGATCATCGTCGCTGCCATCCTCTCCTTCGAGT
TCGGCGTCTTCGCCATCCAATTCTTGCACTTGCTGCGCGTGAATCGCAGCTGCGGCGGGGGCCATGGACGTCGGAGGAG
GATGCGCTGCTGCTGCGGCATATGAGAGTGCATGGGGATCGAGGGAATTGGCGCAAGGTCCCAAAGGCAGCAGGCCTGAT
GCGCTGCGGGAAGAGCTGCCGGTTGCGATGGCTCAATTATCTTCGTCCTGATCTCAAGCGAGGAGGTTTCACCGAGGAT
GAGGACGCGTTGATCATCAAGCTGCATTCTCTGCTAGGAAACAGGTGGTCGCTTATAGCGGGTCGAATTCCCGGTCGCA
GCGACAACGAGATCAAGAACTACTGGAATTTCCATCTGGGAAAGAAGCTCCTGAAGGTGGGCATCAAtccaaAGACACA
CAAGCCACtGagcagCAgcccagtgcCtgcCAAGaccgaGaTGCCatcCaggAgaacttcCAAGTTCTg > SEQ ID NO:1400  111223  241163_301320_1
ggagaaagagggtcatggcggcggcccggcgctctctcttctatcgtcttcttggggcgcgttctacgctactggcaca
gGATGGCTCAGCTGCCGCGAGCAGGAGCGCTGGGGTTCTAGCGTCGTCCTCCCAGGTCAAGGACGAAGAAAGAGGCCAT
AATCTCCGGAATGGCCTGGCGATGCTGGGAGCTGCGGCGACGACCGTGTTCGCCACTGCCGGCTATGTCTATGCCGACG
AGGCCGACCACGGGCTACCTCCGCCTTCGTACCCGTGGCCTTACAATGGAATCTTCGAGGCTGCCGATCACGCAGCAAT
TCGTCGCGGCCATCAAGTCTACACACAAGTTTGCGCTGCATGCCACAGCATGCAATACTTGTCGTTCCGCCACCTTGTC
GGTGTGGCCTACACCGAAGAGGAGGTAAAGGCTATGGCGGCGGAGATCGAGGTGGAGGATGGTCCCAATGACGAAGGCG
AGAAGTTTACTCGCCCCGGACGAATGAATGACTTCTTCCCGGCTCCATATGCGAATGAACAAGCTGCTCGAGCTGCAAA
TGGAGGGGCGTATCCTCCAGACTTGAGCCTGATAACTAAGGCAAGGCATCATGGAGATGATTATGTCTTCTCCTTGCTC
ACCGGCTATCGCGACCCTCCGGCTGGCGTGAAAATCaGaGaAGGGCTGTACTACAATCCATACTTCCCCGGCGGTGCCA
TTGGGATGCCGCAGGTTATAATGGACGGGGCCGtagaGTACGAGgATGgAACTCCTGCCACTGCCTCTCAGATGGCGAa
AGATGCTGTGTGCTTCCTGGCCTGGGCAGCGGAaCCAGAAATGGACGAACGCAAACTGCACGGAGCtAAcgccgttgCT
ttgcatcgtCctgATGgggt > SEQ ID NO:1401  111223  268827_200122_1
ctccactattcatctgcaccgcgttgcctctctctctctcgccttgaataatgaGTTTGGGAAAGAAGATCGGGATAGG
GCTCGCAGGATTCGGAAGAATTAATCGTTTTATTACGAGGGCAGCTCGCCACAGAGACGAAACCAAGCTTTCGAATGCC
CCTGATGTGCTTAAGACCTCAACTACTAAGTATGACTCGGATGGGTTTGGATCCGCTGGCTTAAAGTCTTTCAGAGCAT
TAGCAGTCATTGGTGCTGGAGTCTCTGGGCTCCTTAGCTTCACAAGTGTTGCTTATTCTGATGAAGCAGAACATGGGTT
AGAGTGTCCCAGCTATCCTTGGCCTCACGAAGGCATCCTCAGTTCTTATGATCATGCTTCGATACGTCGAGGTCACCAG
GTTTACCAGCAAGTGTGTGCGTCGTGCCACTCGATGTCACTAATTTCATACCGTGATCTTGTCGGTGTGGCATACACTG
AAGAAGAAACTAAGGCCATGGCAGCAGAAATTGAGGTGGTTGATGGACCTAATGACGAGGGTGAGATGTTCACCCGCCC
TGGGAAGTTGAGTGATCGTTTTccACAGCCTTATGCAAATGAAGCAGCTGCaaggttTgCTAAtggtggAGCCTAtcct
ccTgatcTaagtctta
```

FIG. 2 continued

> SEQ ID NO:1402 111223 9772_300303_1
CCCACGCGTCCGCGAAGGCCATGGCAGCTGAAATCGAGGTTGTTGATGGACCAAATGATGAGGGTGAGATGTTCACCCG
ACCTGGTAAACTCAGTGATCGGCTTCCTGAACCATACTCAAATGAATCGGCTGCTAGGTTCGCCAATGGAGGAGCGTAT
CCACCGGATCTAAGTCTTGTAACTAAGGCACGTCACAATGGCCAAAATTATGTCTTTGCTCTGTTGACTGGTTATCGTG
ATCCTCCTGCTGGAATTTCAGTAAATTTCTCTCCTATTTTTGCTTTAGACTTGTTATTACAACTTCAAATTGTTGGAAG
TTAGAAATAATCCTGTGACTAACGGGTACAGATCAGAGAGGGGCTACACTACAATCCTTATTtcccTGgTGGAGCAATC
GCTATGCCaaAAATGCTCAACGATGAAGCTGTGGAATATGaaGATgGAaCtcctgcaaCAGaaGcACAGAtgggtaaaG
Atg > SEQ ID NO:1403 111223 266875_200031_1
TGGTTTTCCGGATCTCGCAGGACCTGTTGTCCTATCGCCGTCGATCAATTCTCTCTACAATCCCTGTCCGAGGGCTTGA
CTAAAAATGTTGGGAGGTAGAGCAATCCATCGGTTATTAGGCAGGAAATTTCAATCTGAATCCTCGGCCTCTCCAATTT
TATCATCCATTGTTTCCAAACAAGCCCAAGAAGAATTTGGATCTTTTGGCATGAAGTCCCTCAGATCATTGGCACTCAT
TGGAGCAGGTGTATCTGGACTCTTAGGTTTTGCGACAGTAGCATCTGCTGATGAAGCTGAACACGGATTGGAATGTCCA
AGCTATCCTTGGCCTCACGCAGGCATTCTTAGTTCATATGATCACGCTTCGATTCGTCGTGGTCACCAGGTTTATCAAC
AAGTATGTGCTTCTTGTCATTCAATGTCACTTGTTTCATATCGTGACTTGGTTGGGGTAGCATATACAGAGGAGGAAGT
AAAGGCCATGGCAGCTGAGATTGAGGTGGTTGATGGGCCTAATGATGAGGGTGAAATGTTCACTCGTCCTGGTAAACTG
AGTGATCGTTTTCCTCAGCCATATTCAAATGAAGCAGCTGCTAGATTTGCTAATGGGGGAGCCTACCCTCCGGATTTAA
GTCTTGTTACAAAAGCACGTCATAATGGTCAAAACTATGTGTTtGccCTTCTAACTGGCTATCGTGATCCTCCTgcTGG
TGTttcgattcgcgAAGgacTTCACTacaatcctta

> SEQ ID NO:1404 111223 1113819_301841_1
GCACGCAGAGCGATAGGTGTGGTGTGGAGAGGTAGATGGCCATGttGAGTCGGGTGCTGAGGCGAGTGCCTGCTTCCTT
CACTGGGAGATCTCCGCGGCAGCCTCTCGAGGAGGTTTCTAAGCGCCTCGAGGAGGCCCTAGACGCCCAGACTCCGTCC
AAGGCTGCCTCCATTGTGGGGTCACAAAGCCGGGACTATTCAAGAGAAACAGCAGGGTCAAAGAGTATCAGAGCTTTGG
CATTAGCTGGAGCTGGTGTTACCGGTTTACTTGGGTTGACAGGCTTagcGTATGCCGATGAAGCTGAGCACGGATTagC
TTGTCCAGATTATCCTTGGCCTCATTCTGGAGTCCTCAGCTCTTATGATCATGCATCAATTCGACGGGGCCATCAAGTG
TATCAGCAAGTTTGTGCTGCTTGCCACAGCATGCAGTATGTGAAATATCGGGATTtgAttggtgtttcgtaCACagaag
aagaggTGaaggcTCTggCAGCCGAaattgaAgTcgaagATGGACCCaacgacgaagGGGAAATGTACTCACgcccagg
caaGCCagcgatgccttcccgagcccctata > SEQ ID NO:1405 111223 179664_300562_1
ggctcccctgcggcttcgctacagcttgccaattatgtTGGCAAGGTCGTCTTTGCGCCCGGCGCGCCTCCTCAATGG
GCTTCGAAATGGCGCCGTCAACGTCCCCAAGCGTGCTGCCTCGACGAGCTCGGAAGCTCCCACCGCGCGCATGAACCTC
GCCGCTATTGCTTCCACCACCCTCGCCGCCGGCTCCATGGCCTGGTACTACCATCTCTACGGACCCGTCGCTTTTGCTT
CGTCCCCTGCTGAGGAGGGTCTCCACGCTACTCAGTACCCTTGGGTTCACCAGCAGTTCTTCAAGACTTTTGACCACCA
GGCTCTCCGACGTGGTTTCCAGGTCTACCGTGAGGTCTGCGCCAGCTGCCACTCCCTGTCCCGAGTCCCCTACCGAGCT
CTCGTCGGTACTGTCCTGACCGTCGACGAGGCCAAGGCCCTGGCTGAGGAGAACGAATACCCCGATGAGCCCGATGAGC
AGGGTGAGATCCCCATGCGACCCGGAAAGCTGGCCGACTACATTCCTCCTCCCTACAAGAACGACGAGGCTGCTCGATT
TGCCAACAACGGTGCTCTTCCCCCGGATCTGAGCTTGATCGTTAAGGCTCGCCACGGTGGCTGCGACTACATCTTCAGC
TTGTTGACTGGTTACCCTGAGGAGCCCCGGCTGGTGTCCAGGTCGCCCCGGCATGAACTTCAACCCCTACTTCCCCG
GCACTGGTATTGGTATGGCTCGTGTTCTGTACGACGGCCTCGTCGAGTATGAGGATGGCACTCCCGCCAGCACCTCCCA
GATGGCCAAGGACGTTGTCGAGTTCCTCAACTGGGCCGCCGAGCCCGAGATGGACGACCGCAAgaagaTGGGCATGAag
gTCTTGGTTgccACCACCgctCTGTgggccATCAGCgtcTacgTAAAGCGAtACaaGTgGGCTtg > SEQ ID NO:1406 111277 1007240_301398_1
GCAATTTGCCAATCGCCGGAGTTTGCTCTAATTTCATCCACTGGTTGCATCATGGCAGCGGCTACTGGTCTTGCATCAC
TGCAATCTCTCTCTCAGTTCTGTAGGACTAAGAGAGAAGAAGATTGTGTCACTTCCTGCATCCACCTCTGCATTTCT
CGGCCATCAGATTGGAAGCTTTGCTTTATCAGCTACGAAGCCCATTTCGAAGGGTATTAGAGCCCAGACTGTAGCAGCT
CCACCCCCAGCAGCACCAGTGGAGGTTGCCGAGTCTTCTGAGGCTAAAAAGATTTCCACAAAGAGCATCGTGGTGATCA
CTGGAGCATCATCTGGTCTTGGGCTGGCCACAGCCAAGGCATTAGCGGATAGTGGTGAGTGGTATGTTGTAATGGCATG
CAGGGACTTCTTGAAGGCGGAGAGGGCAGCCAGATCCGTGGGATTACCAAAGGACAGCTACCGGGTCATGCATTTAGAC
TTGGCATCCCTTGAAAGTGTCAGACA

FIG. 2 continued

> SEQ ID NO:1407 111277 201524_300717_1
AGGACACCAGAAACATAGTACACTTGAGCTCACTCCAAACTCAAACACTCACACCAATGGCTCTCCAAGTTCAGGCCGC
ACTCCTGCCCTCTGCTCTCTCTGTCCCCAAGAAGGGTAACTTGAGCGCGGTGGTGAAGGAGCCGGGGTTCCTTAGCGTG
AGCCAGAAGGCCAAGAAGCCGTCGCTGGTGGTGAGGGCGGTGGCGACGCCGGCGGCGCCGGTGGCGAGCCCCGGCGCGG
GCACGTCGAAGGCGGACGGGAAGAAGACGCTGCGGCAGGGGGTGGTGGTGATCACCGGCGCGTCGTCGGGGCTCGGGCT
CGCGGCGGCGAAGGCGCTGGCGGAGACGGGGAAGTGGCACGTGGTGATGGCGTGCCGCGACTTCCTGAAGGCGGCGACG
GCGGCGAAGGCGGCGGGGATGGCGGCGGGGAGCTACACCGTCATGCACCTGGACCTCGCCTCCCTCGACAGCGTCCGCC
AGTTCGTGGACAACTTCCGGCGCTCCGGCATGCCGCTCGACGCGCTGGTGTGCAACGCCGCCATCTACCGGCCGACGGC
GCGGCAGCCGACGTTCACCGCCGACGGGTACGAGATGAGCGTCGGGGTGAACCACCTGGGCCACTTCCTCCTCGCCCGC
CTCATGCTCGACGACCTcaa > SEQ ID NO:1408 111277 188425_300691_1
cccccccccgggtcaccaacacgaagcaaaaggacaccagaaacatagtacacttgagCTCACTCCAAACTCAAACACT
CACACCAATGGCTCTCCAAGTTCAGGCCGCACTCCTGCCCTCTGCTCTCTCTGTCCCCAAGAAGGGTAACTTGAgcGCG
GTGGTGAAGGAGCCGGGGTTCCTTAgcGTGAGCACAcaAGGCCAaGAAGCCGTcccTGGTGGTGAGGGCGGTGGCGAcG
CCGGCGGCGCCGGTGGCGaGCCCCGGCGCGGGCACGTCCAAGGCGGACGGGAAAAaAAcgCTGCGGCAGGGGGTGGTGG
TGATCACCGGCGCGTCGTCGGGGCTCGGGCTcgcGGCGGCGAaGgCGCTGGCGGagacGGGGAAATGGCACGTGGTGAT
GGCGTGCCGCGACTTCCTGAAGGcggcgacggcggcgaaggcgGCGGGGATGgcgGCGGGgagcTacaCCgtcATGCAC
CTggACCTcgccTCCCTCGacagcgtcCggcagttCGtggacaactTCCGgcgCTCCGGCaTgccgctcgacgcGCTgg
TgtgcaacgccgccatCtac > SEQ ID NO:1409 111277 158310_200003_1
attatttaattctttagctgacaatttagatagtaaaactcaattccttatattcatggctcttcaggctgctgcacta
cTTCCTTCTGCTTTCTCTATTCCCAAGGAGGGCAAAGCTGGTGCAATTTTGAAGGATTCTAATCTCTTTGGAATTTCCC
TCTCAGACCATATTAAATCTGATTTTCGCTCCTCTTCATTTAAAGTGAAGAGCCAAAGAAGGTTGTCCCATGGATCTAT
TAGAGCCGAGACAATGGTTGCAACTCCAGGTGTTACCAACGCCACAGTATCAGGAAAGAAAACTTTAAGAAAAGGGTAT
GTAGTAGTTACTGGAGCCTCTTCAGGATTAGGCCTAGCCACAGCAAAAGCTCTAGCTGAGACAGGAAAATGGCATGTGA
TTATGGCATGTAGAGACTTTCTAAAAACTGAAAGAGCAGCAAAATCCGCAGGCATGCCTAAGGAGAACTACACAATAAT
GCACTTAGACCTTGCGTCGCTCGACAGTGTTCGCCAGTTTGTCGATAACTTCCGGAGATCAGGTCGCCCTCTTGATGTA
TTGGTTTGCAATGCAGCAGTTTATCAACCAACTGCTAAAGAGCCTTCTTTCACTGCTGATGGATTTGAGCTCAGTGTTG
GGACTAACCACCTTGGTCATTTCCTTCTTTCAAGATTGTTGCTTGATGATTTGAAGCAGTCTGATTACCCTTCAAAGAG
ACTCATCATTGTTGGTTCCATTACAGGAAACACAAATACTTTGGCCGGAAATGTGCCTCCAAAAGCAAACCTTGGGGAC
TTGAGGGGCTTGGCAAGGGGACTCGACGGGCTGAACAGCTCGGCCATGATCGATGGTGGAGACTTTGATGGTGCAAAAG
CATACAAAGACAGCAAAGTTTGCAATATGCTCACTATGCAGGAGTTCCACAGGCGATACCACGAGGAAACTGGCATTAC
ATTTGCCTCTTTATACCCTGGCTGCATAGCAACAACAGGGCTTTTCAGGGAGCATATCcCATgtttagaCtccTtTtC
cCtccaTTccagaagTATATTACCaagggAttCGT > SEQ ID NO:1410 111277 113766_300005_1
tcaaactacaaaaatcaacgcccccccccccccccagcgcacacacgcacaccaacaccttcataatagagttgtaa
cAAGTGAAAAAACATTGAATAGTAGGTTCGAAAATGGCTCTCCAAGCAGCATCTCTGCTTCCTTCTGCATTATCTATCC
ACAAAGATGTAGGCTGCACATTTTCCAGCTCTTTAACACTTAGCTCTTTTAAATACTCACCTGAAATTTTAACAAGATC
GTCCAATTGTGGCAGGGTAAATCATGTGCTACTCTCAAGGACAGTAGCCTCTTTGGAGTTGCATTATCTTACAGTCAAA
AATCTAAGTTCATTCCTCCAGCTGCATGGAACAAGGAATTGACAAAGAAAATAGCAGCTGTACCTGTTAGAGCACAAAC
AGCTGCTGCCACACCAGCAGTCAACCAGTCTACCTTAGAACAGAAGAAAACCCTCAGGAAAGGCAATGTAATAATTACC
GGAGCCTCCTCTGGTTTAGGACTAGCTACTGCAAAGGCTATAGGTGAAACAGGAGAGTGGCACGTTATAATGGCCTGCA
GGGACTTCCTTAAGGCTGAGAAAGCAGCAAAATCTGTGGGCATTCCAAAGGAAAACTACACAGTCATGCATCTGGATCT
CGCTTCCCTTGAAAGTGTCCGCCAATTTGTAGATACTTTCCGACGTTCAGGGAGGCACTTGATGCGCTAGTCTGCAAT
GCTGCAGTGTACTTGCCGACTGCTAAAGAGCCAACTTTTACTGCTGACGGGTTTGAGCTTAGTGTGGGTACCAACCATC
TTGGACATTTCCTGCTTTCAAGGTTGCTGCTAGATGACCTCAAGCAATCGGATTACCCACAAAAGCGCCTTATAATTGT
TGGCTCCATTACAGGAAACACAAACACTTTGGCTGGAAACGTACCGCCAAAGGCTAATCTTGGAGATCTACGAGGACTA
TCAGGAGGATTGAATAGTTTAAACTGCTCACCCATGATTGATGGAGGAGAATTTGACGGCGCCAAGCCTACAAAGACAG
CAAAGTCTGTAACATGCTTACCATGCAAGAGTTCCATAGGCGTTTCcACGAGGAGAATGGCATTGCCTTTGCGTCCCTC
TATCCCGGCTGCATTGCTGAAACTGGTTTGTTTAGGAATCACATTCCCTTGTtCAGGGCTCTCTTCCCACCATTTCAGA
AGTACATTACCaaaggctAtGTATCTGAAGCAGAAGCAggAAAAAGACTtGCACAGGTTGTACGTGATCcaaGccTtTC
AaAaTCtggtGTCtAc > SEQ ID NO:1411 111277 240302_301313_1
AGAGATTCTTCTTCCTTCTTCCCGGGGAGCTGGCTATGGCTGCCATCGTCGCAGCAGCAGCATCGTCCTCGGGCCTCGC
GGCGAAGAAGAGATTCTAGCCACATCCTCGAGCAATGCGGGTGTTTCTTCTTCTTTTCTCGGGTCCAAGCTGCGCTGT

FIG. 2 continued

AGCCCAGCAATCCAGGGTGTAAGGCAATGCAATGCTTCGACCACGACGACGAGCATCAGAGCTGTTGCTGCGCCGGTGG
AGACGGCCCGAGCGAAGGAGGGGAAGAAGACGGCCAGGCAGTCGACGGTGGTGATCACCGGTGCCTCTTCCGGCCTCGG
ACTCGCCACGGCCAAAGTCCTGGCCGACACCGGGGAGTGGCACGTCGTCATGGCTTGTAGAGACTTTCTCAAGGCCGAG
AAGGCTGCCCGGTCGGCTGGAATTCCCAAAGGAAGCTACACCGTCATGCACCTCGACCTGGCTTCGTTCGACAGCGTGA
GGCAGTTCGCGGAGAACTTCCGGCGATCCGGGAGGCCTCTCGATTGCCTGGTCTGCAATGCGGCGGTCTACTTCCCGAC
AGCGAAAGAGCCCACGTATAGCGCGGAGGGGTTCGAGCTCAGCGTGGCGACGAATCACTTGGGACACTTCCTgctgTCC
CGGTTGCTTCTCGAGGATATGGAGAAGTCAgaTCAtgCGTCGAGacgCATGAtaatc > SEQ ID NO:1412  111277  284113_200158_1
attttttgctgactttagaccaaccccttttcttttcttgaacattttcatggctcttcaggctgttgctttggttcct
tCTGCTTTATCCATTTCCAAAGAGGTAATATTTTCCGTCCAGAAAATATATTGCTCGTGAGACAAAAAGGGTTGCTACG
ATGGTAAGCAAACTCCACTTCCAACCAAGAGGTGGTGAGTTTACCAAGAGGTGGTGAGTTTGAGTAACAGCCTCCCTAC
CTTAGGGGCAAAGCTAGTGCAAACTTGAAGAATTCTAGTCTTTTTGGAGTCTCTCTCTCTGACTATACTAAATCTGATT
TCCGCTCCTCTTCATTCAAAGTCAAGAGCCAAAGAAGATTGTCCAATGGAGCAGTAAGGGCAACAATGGTTGCATCTCC
AGATGTAACCACTAATTCTCCAGCAGGAAAGAAAACTTTAAGAAAAGGGTGTGTAATAGTCACTGGAGCCTCTTCAGGA
TTAGGCCTAGCCACAGCAAAAGCACTATCCGAGACCGGAAAATGGCATGTAATTATGGCTTGTAGGGACTTTCTAAAAG
CTGAGAAAGCTGCAAAATCAGTAGGCATGCCTAAGGAGAATTACACCATCATGCATTTAGACCTCGCGTCGCTTGACAG
TGTTCGCCAGTTTGTCGATAACTTCAGGAGGTCCGGTCGCCCTCTTGATGTGTTGGTTGCTAATGCAGCTGTGTATCAA
CCTACTGCTAAAGAGCCTTCATTTACAGCTGAAGGATTTGAGCTTAGTGTTGGCACAAATCATCTTGGACATTTCCTTC
TTTCaagattgttgCTTGATGACttGaagcaaTCTGATTACCCttCTaaaagaCtCATAATTgttGgttCaATTAcagg
gaaCACaaATActttggctggaAatgtacc > SEQ ID NO:1413  111277  217010_300904_1
AAAAGGACACCAGAAACATAGTACACTTGGGCTCACTCCAAACTCAAACACTCACACCAATGGCTCTCCAATTTCAGGC
CGCACTCCTGCCCTCTGCTCTCTCTGTCCCCAAGAAGGGTAACTTGAGCGCGGTGGTGAAGGAGCCGGGGTTCCTTAGC
GTGAGCCAGAAGGCCAAGAAGCCGTCGCTGGTGGTGAGGGCGGTGGCGACGCCGGCGGCGCCGGTGGCGAGCCCCGGCG
CGGGCACGTCGAAGGCGGACGGGAAGAAGACGCTGCGGCAGGGGTGGTGGTGATCACCGGCGCGTCGTCGGGGCTCGG
GCTCGCGGCGGCGAAGGCGCTGGCGGAGACGGGGAAGTGGCACGTGGTGATGGCGTGCCGCGACTTCCTGAAGGCGGCG
ACGGCGGCGAAGGCGGCGGGGATGGCGGCGGGGAGCTACACCGTCATGCACCTGGACCTCGCCTCCCTCGACAGCGTCC
GCCAGTTCGTGGACAACTTCCGGCGCTCCGGCCATGCCGCTCGACGCGCTGGTGTGCAACGCCGCCATCTACCGGCCGA
C > SEQ ID NO:1414  111312  155582_301357_1
CACATGTTTGGGGTGCAAACTAGTCTAAAGAGATCTTAAATGTCATTCAACGGCATAAATAGGCCCTTCGATTGATGCA
ATTATGACCAAGATGGCATTGGATAACAGAGCTCTTACCGCTCTTGCTTCTTTTTTGATCTACTTGGTCTTGAGTCTCG
ATGTTTGCTGTGCTGTTCAAAGCGACATTGACTGTCTGAAATCTGTAAAAGAGTCTATTAGAAGATCCATTAAATTACTT
GGGGTCAACATGGAACTTCGAAAATCAGACCGAAGGTTTCATCTGCAAATTTACTGNGATTCAGTGTTGGCATCCGGAT
GAAAGCAAGGTTCTGAGTATCACTCTTCCTGACATGGGTCTTAAGGGCAGGTTTCCACGTGGTATTCAGAATTGTACCT
CTATGACATCATTAGATCTTTCGAGTAACGAGCTCAATGGAAGTATTCCACGTGATATCTCCAAAATTATAAGTTTTGT
GGTAATCCTGGATCTCTCATCCAACAACCTATCAGGGGAAATCCCAGTGGATCTCGCAAACTGCTCTTTTTTGAATGAC
ATTAAACTTGACAACAACCTGTTGACGGGTCAAATTCCTCCACAAATTGGCCTGCTTGGTCGGCTCAAGACTTTTAATG
TAGCAAACAATCGATTGACCGGACCAGTT > SEQ ID NO:1415  111358  120179_300359_1
ATTCGCTAGCTGTTTCGGTATCTCTTGAGCTTCTCACTACCAATCCCAGCCGAAGCCATGTCGAGGAGAAAGACTAGGG
AGCCAAAGGAAGAGACTGTAACACTTGGACCAGCTACAAGGGAGGGTGAATTGGTGTTCGGTGTTGCTCACATTTTTGC
CTCTTTCAACGATACTTTTATTCATGTGACTGATTTGTCTGGAAGAGAAACTATGGTTCGCATTACTGGTGGAATGAAG
GTGAAGGCTGATAGAGATGAATCTTCTCCATATGCTGCCATGCTTGCAGCTCAGGATGTGTCACAGCGATGCAAGGAAC
TTGGAATTAATGCTCTTCACATTAAGCTTCGGGCTACAGGAGGCAACAAGACTAAGACTCCTGGTCCTGGTGCCCAGTC
TGCTCTTAGGGCCTTAGCTCGATCTGGCATGAAAATCGGACGTATAGAGGATGTGACTCCAATTCCCACAGATAGCACT
CGCAGAAAGGGTGGTAGAAGGGGAAGGAGGCTGTGAAGATGGTTCGTTTCTGCAGCATAATGCACCTTGGAGGATTTTG
TTGTTGAGGATGCTCCTTTCAATTTCTTTTTACAATTGATATCTAAATACTTTGTAGCTGAGACTTTTGGTTTCAAACC
ACTTTCATTTTGATCTGGCCAGCTTTGCGACATAATGAAGTTTTCTTgAatttggCTTCgttgatGttaGTAggtcgaa
TGGTCAAACATATCCTTTCtt > SEQ ID NO:1416  111358  158234_200002_1
agattGCGTTTTTCAAGCTTCAGTAGCAGCTCAGCCGTCTCATCAGCAATTCAACCGAAGCCATGTCTAAGAGAAGGAC
CAGGGAGCCCAAGGAAGAGACTGTAACCCTAGGACCAGCTACCAGGGAGGGTGAATTGGTCTTTGGTGTTGCCCACATT
TTCGCCTCTTTCAACGATACTTTCATTCATGTGACTGATTTGTCTGGACGGGAAACAATGGTCCGCATTACTGGTGGTA

FIG. 2 continued

TGAAGGTGAAGGCCGACAGAGATGAATCTTCTCCTTATGCTGCTATGCTTGCTGCACAAGATGTTTCTCAACGATGCAA
GGAGCTTGGAATTAATGCTCTTCACATTAAGCTTCGGGCTACTGGAGGGAACAAAACTAAGACTCCTGGTCCTGGTGCC
CAGTCTGCTCTTCGAGCCCTTGCTCGATCTGGAATGAAAATTGGACGCATAGAGGATGTTACTCCTATTCCCACAGACA
GCACTCGCAGAAGGGTGGTAGAAGGGGAAGGAGGCTGTGAATTCTTCTCAGCAACATACTTGCTGCATGGCAAGAATA
TTTTGGTTTCGGGTCGCATCTTTCATTgtgttTTTACATGTTAGATTTAAACATTTAGTAGaCTCAGTACaaGgTCATT
TTGACTTATGATCAGTTGGAGTTTTGCAAGCTTGt > SEQ ID NO:1417  111358  12315_300278_1
CCCACGCGTCCGAAAAGGCGGAACAACAAAAGAAACCCTAGCTTCCCTTTGTACCTCTCTCTGTTCCAAACCATGTCGA
AGAGAAAGACCAAAGAGCCAAAGGTTGAGAATGTGACTCTTGGACCAGCTGTTCGTGAAGGAGAGCAAGTCTTTGGAGT
TGTTCACGTCTTTGCTTCATTCAACGACACTTTCATTCACGTGACTGATTTGTCTGGACGGGAAACACTTGTTCGCATC
ACTGGTGGAATGAAGGTGAAAGCCGACAGAGATGAGTCCTCACCTTATGCT > SEQ ID NO:1418  111358  258551_301697_1
AAGATGGCCCCCAAGTCAGACAACGTTAGCCTCGGCCCCAGGCCCGAGAGGGAGAGCTCGTTTTCGGCGTTGCCCGAA
TCTTTGCATCCTTCAACGATACTTTCGTCCACATCACCGATCTGACCGGCCGAGAGACCATCTCTCGAGTCACCGGCGG
TATGAAGGTCAAGGCTGACCGAGACGAGAACACCCCCTACGCCGCCATGCTGGCTGCCCAGGATGCCGTCGAGAAGGCT
AAGGAGGTTGGTATCAACGCTCTGCACATCCGAATCCGAGCCACCGGAGGTACTTCCACCAAGACCCCCGGCCCCGGCT
GCCAGTCTGCCGTCCGAGCTCTTGCCCGAGCCGGTATGCGAATTGGTCGAATCGAGGACGTGACCCCCGTTCCCTCCGA
CTCTACCCGACGAAAGGGTGGTCGACGAGGTCGACGACTGTAAGCGGTTTCTTTGGGGACTTGCTGGCAGTATTTATGC
CGTGTTTTCATGGTGTATGTAAAAATATAAAAGCGTAAGCG > SEQ ID NO:1419  111437  238226_301293_1
GAGAAGGAAGCGAGCGTGATGGCGGGACTGCTACTCCATGCGAATCCCGGCAACAAGAATGCGCTCAAATCGCTCATCG
CGGCGGAGATTGTGGGCGTCAAGGTCGATCTTGTGCCCGATTTCCAGATGGGCGTCAGCAATAAGACGCCCGAGTTCTT
GAAGCTGAATCCGATGGGAAAGGTTCCAGTGCTTGAGACACCAGACGGGCCAATCTCCGAGAGCAATGCCATTGCCAGA
TACGTGGCGAATCTCAAAGGAAAACTGACCGGATCGACATTGTACGAGACTGCCCTGATCGATCAGTGGATTGACTTCG
CCACCACTGAGATCGACGCCTCTCTGGGAAGGTGGACTCATCCGCGCTTCGGTTATATTCCGTACGCACCAGAGGTTGA
AGAGCATGCAATTCAGGTGCTCCAGCGTGCTTTCGGCGCTCTCAACGCTTACCTCGCCTCTCGGACGTACCTCGCGGGG
CACTTCGTCACGCTGGCCGACGTGATCACAATCTGCAACATGTCCTTCGGCTACCGGACTGGAGCCTTCTCGGAGGAGT
TCATGTCCGCATTCCCTCACGTCGAGAGATACTTCTGGACGCTCTGCAACCAGCCAGCATTcAAGAAGCActtgggAGA
GGtcgtccggGGCTCGGTCGAAGTCcctggccccgGtgcCAAGCCAGCagctgctcaggcgCCCCGGGCA > SEQ ID NO:1420  111437  279352_200061_1
cacatatatagataccccactaccaaaccctaaacctcttttctcgcatctactgaagaggctctcacttctctctct
cTTCTTTGCTCAGAGTTATCGCCGTTACAAGCTTGGAGGGAGCAAGTTCCAACTGTGCAGCCATGGCTCTGGTTTTGC
ACTCTGGAAGTAACAACAAAAATGCCTCAAAGGCACTCATTGCTGCTGAGTACACAGGTGTAAAGGTTGAACTTGCAAA
GAATTTCGAGATGGGTGTATCAAACAAGGCACCTGAGTTTATCAAGATGAATCCAATTGGAAAGGTTCCTGTGCTTGAA
ACACCTGATGGACCTGTTTTTGAGAGCAATGCTATTGCACGATATGTAACTAAATTGAAGCCCGACAATCCTCTCTTTG
GCTCTTCGTTGATTGAATATGCTCAAATCGAGCAATGGAATGATTTTTCTGCTACTGAGATTGATGCAAACATTGCACG
ATGGCTGTACCCGCGCCTTGGCTATGGTGCATATATTCCTCCAGCCGAGGAAGCTGCAGTAGCTGCATTAAAGAGAGCT
CTTGATGCTTTGAACACCCATCTGGCATCTAACACTTACTTGGTTGGACAATCAATTACATTGGCTGACATCATAATGG
GCTGCAACTTGAGCATTGGTTTTAGGATGATAATGACTAAGAGCTTTACCGAGGAATTCCCACATGTAGAGCGATACTT
CTGGACTGTGGTTAATCAGCCAAATTTCTGCAAGATATTGGGTGAGGTGAAACAAGCTGAATCTGTCCCAGCTCCCTCA
TCCAAGAAGCCTGCACCGGCAAAGGAAGCTGCGAAACCCAAAGCGAAGGAGGAGCCAAAGAAAGAGCTTAAGAAGGAAG
AACCAAAGTTTGAAGAGGAGGAAGAAGCACCCAAGCCTAAGGCAAAGAATCCTCTTGATCTCTTGCCTCCAAGTAAGAT
GATTCTGGATGAGTGGAAGAGGCTCTACTCCAACACCAAGACCAACTTCCGCGAGGTTGCCATTAAAGGTTTCTGGGAC
ATGTATGATCCCGAAGGATATTCTCTCTGGTTCTGTGATTACAAGTACCAGGACGAGAACACAGTTTCCTTTGTAACCT
TGAACAAGGTTGGTGGTTTTCTGCAGAGAATGGATCTGGCACGCAAGTATGCTTTTGGTAAGATGTTGGTAATTGGTTC
TGAGGCACCGTACAAGGTGAAGGGCTTGTGGCTTTTCCGTGGAAAAGAAATTCCCAAGTTTGTTATGGATGAATGCTAT
GACATGGAGCTCTATGAATGGAAGGAAGTAGACATCAACGATgaaGcACAgaa > SEQ ID NO:1421  111437  187332_300676_1
CGCTTGAAGGACAACAGCTCTCTTTGTGGTTCTTCTCTTATCGACTATTCTCACATTGAACAATGGATGGACTTCTCAG
CAACAGAGGTTGATGCCAATATTGGAAGGTGGTTGTACCCAAGGCTTGGTTTTGGCCCTTATGTTCCTGCACTTGAGGA
ATTGCTATTACTTCATTGAAGAGGTCATTGGGTGCTCTGAACACACACCTTGCTTCAAACACATACCTTGTTGGGCAT
TCAGTTACTCTAGCTGATATTGTGATGACATGTAACCTATATTATGGGTTTGTTCGGATCTTGATCAAGAGTTTCACCT
CCGAGTTCCCTCATGTTGAGCGGTACTTCTGGACAATGGTTAACCAGCCCAACTTCAAGAAGGTCATTGGTGATTTCAA
GCAAGCAGAGTCTGTGCCTCCCGTTCAGAAAAGGCTGCTCCCCCTAAGGAATCAAAAGCAAAGGAGGCCAAGAAGGAG

FIG. 2 continued

```
GCTCCGAAGGAGGCCCCTAAACCAAAGGTTGAGGCTTCAGAGGAAGAGGAGGCACCAAAGCCAAAGCCAAAGAATCCTC
TTGATCTACTGCCACCAAGCAAGATGATTCTTGATGAGTGGAAGAGGCTATACTCAAACACAAAAACCAACTTCCGTGA
AATT

> SEQ ID NO:1422 111469 114842_300374_1
ttCACTCGCCGATCCCGGCGAACTCGACTCGGTGGCGCCGCCACCGAGTTTTGATGACTTCCAGCGCCAAACTTCCTTA
ATGACAAGCTGCACTCTCCTCTGGAAAGAGCTCTCCGATCACTTCAATTCACTCGAACAAGACATCCTCAAGAAATCCG
AAGCCTTAAAAGCTAAAATCCAAACCCTAGATTCCGAAACCAAAGCTTCCCTCGACGCCCTCGAAAAACGCGAGATTTC
AATGAATGTTTCACTCTCAATTTCTCTTCAGAAGGTTCTCGAAAACAAGCAAGCTGCTATTTTAGCTCTAGATGAGGGT
GCAGAACAACCCGAAGTCGATGACTCTACTGGATTGTATCTAAAATTGAAGAGCTTTTGTGTTAAGATGGATTCTAGAA
GCTTCTGGAGGTTTTTAATTGTGAAAAAGAAGGATTTGGATTCACTTAGGGTTGAGATACCGAAAGCATTAGGAGACTG
CGTGGATCCGCCGAGGTTCGTGTTGGAATCGATATCCGAGGTGTTTCCAGAGGATAAAAGGCCCAACCCAACCCTTGAT
TTGGGCTGGGCCTGTCTTTTGATGTTGGAGTCTTTGATTTCCAGTTATGATGGACCCTGTTTTGGGAAATGAGAGGAAAT
TGGTGACGCCGAGTGTTAAGGATAAGGCCAATGATATAGCGGAGATATGGAAGAGGAGCTTGGATGAAAGAGGAGGGAT
TGAGAATGTGAAGACGCCAGATGTGCATACTTTCTTGCAGCATTTGGTAACTTTTGGGATAGTGAAGGATGAGGATTTT
GATTTGTACAGGAAACTTGTTGTTGGGTCTGCTTGGAGGAAACAGATGCCTAAATTGGCTGTCTCTCTTGGACTTGGTG
ATAAAATgcctGAAATGAtTgaagaATTAatCagccGAGgaCagcaaGtTgatg > SEQ ID NO:1423 111758 111716_300059_1
ATCCCACCTACTATATTTGTATAATATGGAAGTTGCCAAAGTTCTTCACCTGAATGAAGGAATTGGAAAGGCTAGCTAT
GCCAAAAATTCTCTGTTTCAGCAAAAGGTGATCCTAATGACAAAGTCAATAAGAGATGAAGCCATATATGCACTATACC
GCAGCCTTTCCCCAGAAGCCATTTGTATTGCAGACTTAGGATGTTCCTCTGGACCTAATACTTTCCTTACTATTTCCGA
ACTCATTAAAACTATTTATGAAGAAAGCAAAATCAATGGCAAAAAACAGTCGCCGGAATTCCAAGTTTTCTTGAATGAT
CTTCCCGGAAATGATTTCAATACCATTTTCCGGTCGTTGCCAGAGTTCTACGAAGATTTGAGGAAACATATGGGAGATG
GATTTGGTACAAATTGCTTTGTTGCAGGAGTTGCTGGTTCATTTTATAATAGACTTTTCCCTTCCAACAGTGTGCACTT
TGTCCACTCCTCATACAGTCTCCACTGGCTTTCTCGAGTACCTCATGGAATAGAGAATAACAAAGGAAATATTCACGTG
GCAAGTACAAGCCCACAAGATGTGGTTGAAGCATACTACGAGCAATATGAAAGAGATTTTGTGAATTTTCTCAAGTTAC
GCTCA > SEQ ID NO:1424 111761 274012_200147_1
tttctATTTTATATCAAAGAAAAGAAAGGAAAATGACTTCTACATTTTCTCTTAAGTTGATTATTAGTGTTGTCACTTT
GCTTTGCTTAATTCAGTTTTCCAGTATTTGTAATGCTAAAAGGATGCTTAGGGAGTCTAATATAGGAAAGGAAATGAG
AATATATTTAAGGAGAAAAAGGATGATTCAACAAACATTGGTGGATTTCCTTTTCCATTCAATTTTCCACCATTTTCTG
ATGGAATTCCAAATATACCCTTCAATTTTCCATTTCCTGACTTTGGATCGTCAGGAGGATTGCCTGGTTTTGGAATTCC
TGGGACCGGTGGTAGTGGTACTGGTGATAATAATCCATTTTCGTTTCCGATCCCTGGAGTTCCTAATGTTGCTGTTCCA
CCCCCAGCTGCCGCCCCTTAAATTCCTATACAAGTTTCTCTCTGTTATTAGCAGTTTAGCCTTTTGGCTGGGGTCATGT
AAAACATTAAAAAAAAAATGATAAAGAAGAAGGAAATCAAGGAGTAAGTTTTAGAGCCATAGGCTCAAATGAATTACTA
TTTCTTGGCCTTgGTTCTGATGTAATTAATTAGAAAATGGGAAATGACATGGATGTCAAGTAAAAAgaAcTcGTATTT
TTCTAcccgattAACAagggtatcaCcTtcaAACTTGACTTCAGCACGCGtgtTGTAGTTCCCgtcATCTTTGAAAGAT
ATAGtgCGTTCCTGTACATAACCTTCGGGCATGGCACTCTTGAAaaAGTCAtgcCgtttcaTATGATCCggataAcGgg
aaaagcatTg > SEQ ID NO:1425 112105 144833_200137_1
AGAAAATATCATGAATTTCCTCTCATCTTTGGCTAAGAGCGCCGGCGGTCAATCCGACGACGAGCCCAAGAAAACCGCC
GGTGAGGAAGCTTCAACTACTGATCTTTTTTCTAGTGCAAAAGTTGTTAGCAGAAGCAGCTCAAAGTCAATTCAACAAA
GATTCCAGCGAGGTCGATAACAAAAAGGTGGCTGCTGCTGCTGCTGATGTTCTTGATGCTGCACAGAAATACGGAAAGT
TAGATGAAACTCAAGGTGTTGGACAGTATGTTGAAAAGCTGAAACTTATCTCCACCAGTACGGTTCTGCTAACCCATC
CACCACCACCGATGCCGCCGCTGCAAAGGCCCCGGCAGCCACACCAGATACCAAAGATACAAAGGCACCTACACCGGCT
CCGGCGGCAGCAGATACTGATGAAACAAAGGCACCGGCACCGGCTCCTGCGGCAGCAGATACTGAAGAAACAAAGGCAT
CGGCTCCGGCACCGGCGGCAGCAGATACTGAGGAAACAAAGGCACCGGCAACCGCAGATACCGAAGAACCACCGGCACC
GGCACCAGCACCGGCCGGCACCGGAAGAGAAGGGAGAAGGGTATGGGCAATACGTGAAAATGCAGAAGGATTTCTG
AAATCAGGAGATGATGAATCAGCGAAAGCATCTGAAGGAGGATCAGATTATCTTAAGATGGCCGGTGACTTCTTAGGCA
AGAAGTGATTAGTTTAATCAGATTCTTTTTAATAATGACTGTTATTTTCCAAGTTTTTCTTCTTTCATTTTCTTTGCCA
CTGTTCAGTGTTCATTACCGGCGGCGAACTTCTTCAGTAGCCGTCGCCGGAGCTGGTTTTTACTTGGCATGTATGTAAT
TTGTGTGTGTGTGTGTTTTTCCAGTATGATTTTAGAGTGTAATGGAATTTGTGTTATATGGATAAAgTGATCCTTT
ATgatgtTATTGGTGtaTATGATATGGTCgtgAtTCTTAATTATAtTcgtcTTCCTTCTAttC
```

FIG. 2 continued

> SEQ ID NO:1426 112381 103404_300026_1
tggtatcaacgcagagtggccattacggccggggagataGAGAGGGTGCCTTTTTTGTTTCTTTAATCTCAATATCAA
AGCAGGTTAGATATAAGAAGGCAGAAGAGCTTTGTTCATAAAAGTAAATTTTTCTCTGCCATATTTCTAACTCTGACTA
GTTATTGAGATTGAAGATTTTCAGGCTTCTGTAAGTAATAATAATAATAATAAGGAGAAAAAAAGTAAATAAAAGATAA
AAATGGCATTCACAGGAACTTTGGATAAATGCTCAGCTTGTGATAAGACTGTTTATTTTGTTGATTTGTTGTCTGCGGA
TGGTGTTACTTATCATAAATCCTGCTTCAAATGTAGCCATTGCAAAGGCACTCTTGTGATGAGCAACTACTCTTCCATG
GAAGGAGTCCTCTACTGCAAGGCTCATTTCGAACAGCTTTTTAAGGAATCTGGAAACTTTACCAAGAATTTTCAGAATT
CTAAGGCTGAGAGGCAAAATTCACTGACAAGGCTCCAAGCAAACTATCTGCTATGTTTTCTGGAACCCAAGATAAATG
TGCTGCTTGCGACAAAACTGTTTATCCACTTGAAAAGGTGACAATGGAAGGAGAATCATTCCACAAGTCATGTTTCAAG
TGTGCACATGGAGGGTGTCCACTTACCCATGCAACATATGCTTCCCTTGATGGAAATCTCTATTGCAAACACCATTTTG
CTCAGCTCTTCATGGAAAAAGGAAATTACCAACATGTCCTCAAAGCTGCTAATAATAAGAAGACTAGTGCTGCTGTGAC
ACCAATAAATGACACTGAAGAAAATGCAGCTGAAGAAGAGAACAATAATAAGGAGCCCGAAAATGCAGAGGAACCACAA
CAACAATCATAAAACAAACGTCCCCTCGATTTCTCCCCTTATGTATATCAAACAATTGATCCTTTCTATCTATTTTGAT
CCaATATCTTTgtgttTCTGCTATgttTTTTc > SEQ ID NO:1427 112381 155671_301358_1
ATTAGAAAAGTATGTCTTTTATTGGGACACAACAGAAATGCAAGGCCTGTGAAAAGACAGTTTACCCGGTGGAGCTGTT
GTCAGCTGATGGGGTTAATTATCACAAGTCTTGTTTCAAATGCAGCCATTGCAAAGGAACACTTAAGCTGAGCAATTTC
TCCTCAATGGAAGGTGTTCTGTATTGCAAGTCCCATTTTGAGCAGCTTTTCAAGGAGTCGGGCAACTTCAGTAAGAACT
TTCAGTCACCTGCGAAGTCAGCTGAGAAGTTAACTCCTGAGCTGACAAGGTCGCCTAGTAAAGCTGCTGGCATGTTTTC
TGGCACGCAGGAAAAATGTGCAACTTGTGGTAAAACAGCTTACCCACTTGAGAAGGTGACAGTGGAGAACCAAAGTTAT
CATAAGACATGTTTCAAGTGTTCTCATGGTGGATGCTCTTTATCTCCTTCGAATTATGCCGCCCTAAATGGGATTTTAT
ACTGCAAACCTCATTTTTCACAGCTTTTCAAGGAAAAAGGCAGCTACAATCATTTGATCAAGTCTGCCTCGATGAAACG
TCCAGCTGCTGCAACCGTTCCAGATTCTTAAACTCCATGTTTCAGTCAACTACTGTATCCATTCACATGGACTTGATAT
TTCTTGAGTGTGTTTCTTGCTTTTTCTCTGTTCATTGGCTGGTAACCTC > SEQ ID NO:1428 113024 156082_301362_1
TACCCTCGACCACGCGTCCGTCACTCTCTACTCTTACTCTCCAACAATCTTTCCTCCATTTTCTTGTTCTGAAGCTTGT
GTGTCAGCAGTTCAGAATTCTAACTCAGTTCTCTACAAAGTACACTATCTTGTTTTTTGTATTTTAGGGGAAAAGAATC
CCATTTTGATCAAGAATGATAGAAACAGATTCATAAAGTTTGAGTCTTTGACTAACTTCAACAACATATTCTGCCCTGT
TTCTTTTTTGTTCACTTTTACAGGTACTTTTTATACTGATGTAGAAGCCTAAGAAAAGAACATATATAGCATAAGCAAT
TCGAATGGCAGATTCGGACAATGAATCAGGAGGGCAGAGAGAGAGCGAGAGTTCACTAAGAGAGCAAGACAGGTTCCTT
CCAATAGCAAATGTGAGCAGAATCATGAAGAAAGCTTTACCAGCAAACGCGAAAATATCAAAGGACGCTAAAGAGATAG
TTCAAGAATGTGTTTCTGAATTCATCAGTTTCATTACTGGGGAAGCATCAGATAAGTGTCAGCGTGAGAAGAGGAAGAC
CATCAACGGTGATGATTTGTTGTGGGCAATGACAACACTTGGTTTTGAAGAATACATTGAGCCCCTTAAGATTTATCTG
CAGAGGTTCAGGGACTTAGAAGGGCAAAAGAGCACCATGACTGGACGACAAGACAAAGAGAATAGTGGATCAATGAATA
TGGGTAG > SEQ ID NO:1429 113024 206484_300822_1
GGGACAAATGAATGATAACCAGGAACCCCACTCGGCCGGAGGGACTGGCTATGAGTTTGAAGGTGTCAAAGAGCAAGAC
CGGTGGTTACCTATAGCCAATGTCGCCCGAATCATGAAGAATGCACTACCTGACAATGCCAAGATAGCGAAGGAGGCTA
AGGAGTGCATGCAAGAGTGTGTGAGCGAGTTCATCTCCTTCATAACTAGCGAAGCCTCGGAGAAATGCCAGCAAGAGAA
ACGCAAGACAGTCAACGGAGAAGACATTTTGTTTGCCATGACTTCACTGGGTTTCAGAACTATGCAGAGGCCCTCAAG
GTCTATCTCTCAAAGTACCGTGAGCAACAAAATCAGTCGAACCGTGATCGCGTCCTAGAGAACAACAACTGGGCGGCC
AAATGATACCGGGTGCTGAAAAGACTGAGCCGGGCACAACGAGTGCCGATTATGCACCCCCCGAAGGAACGAATCCTGC
TGAAGGGGGGCCGATCCGAACTACATGTATACTTCTCATGCTGGCCACAACGGAACTGGTGCTGGAGAGGGTTATTAA
GAGGG > SEQ ID NO:1430 113024 242138_301326_1
GGTTACCCTAGTCTCGGCGAGGCGATGCGCCATAGCTCGTCTTCGTCTTCCCCCTGGCGATTCCTCGACGATGCCTTGG
TTGCCTTGGCCAGCGAGAGAGGGGAGGGGGCGAGAGGGGGGAGAATCTTGTCTGGATTCTCCATGGTTATAGCTGGA
ATGCCTTGGGCCCGTGGGCAATGCGGGTTCTACTTGTGGAGTTTGAGCTTGAGCTTTGAGGAGAAAAGATGGCGGACGT
TGGAAGTCCCAGGAGCCAAGACAGTCCACACCCGGACGAGGCTGGTGGCCATGGGGAGCGCGACAACGCCAATGTAAGG
GAGCAGGACAGGTTCCTCCCCATCGCCAACATCAGCCGGATAATGAAGAAGGCGCTGCCGGCCAATGCGAAGATCGCCA
AGGACGCCAAAGAAACGGTGCAAGAATGCGTCTCAGAGTTCATCAGCTTCATCACCAGCGAAGCCAGTGATAAATGCCA
AAGGGAGAAGAGAAAGACGATCAACGGCGACGACTTGCTATGGGCGATGAGCACGCTAGGTTCGAGGAGTACCTGGAA
CCTTTGAAGATCTACTTGCAAAAGTATAGAGAGGTGGAGGGTGACAAAGGCTCGGCTGCCAAAGGAGA

FIG. 2 continued

> SEQ ID NO:1431 113024 262488_301749_1
GCAGCATGGCGGATTCGGACAACGATTCAGGAGGACACAAAGACGGTGGAAATGCTTCGACACGTGAGCAAGATAGGTT
TCTACCGATCGCTAACGTTAGCAGGATCATGAAGAAAGCACTTCCTGCGAACGCAAAAATCTCTAAGGATGCTAAAGAA
ACGGTTCAAGAGTGTGTATCGGAATTCATAAGTTTCATCACCGGTGAGGCTTCTGACAAGTGTCAGAGAGAGAAGAGGA
AGACAATCAACGGTGACGATCTTCTTTGGGCGATGACTACGCTAGGGTTTGAGGACTACGTGGAGCCTCTCAAGGTTTA
TCTGCAAAAGTATAGGGAGGTGGAAGGAGAGAAGACTACTACGGCAGGGAGACAAGGCGATAAGGAAGGTGGAGGAGGA
GGCGGTGGAGCTGGAAGTGGAAGTGGAGGAGCTCCGATGTACGGTGGTGGCATGGTGACTacGATGGGACATCAATTTT
CCCATCATTTTTcTtAataaa > SEQ ID NO:1432 113024 280809_200069_1
GTTGCAGAGAGACAACACTGTCTATAGTTAGATAGCTCAAGAGATGGATAATCTTGGGGGAGGAAATGGTAATGGAGGA
TTTCATGGCTACCGCAGATTCCCTCAACCAACCCCTGCTACGGACATGAGCATGGGACTGTCTGCTCATCTCAACCAGG
CCATTGCTGCCAATACAAACAATAATGCCACCAACAACTCAGAACAAGATTCTGAATGCACCATTCGGGAGCAAGACCG
ATTCATGCCAATAGCAAACGTGATCAGAATCATGCGCAGAATCCTTCCTCCGCATGCCAAGATATCGGATGACTCTAAA
GAGACCATCCAAGAATGTGTATCTGAGTTCATAAGCTTCATCACGGGCGAAGCCAACGAGCGTTGCCAACGTGAGCAGC
GGAAGACCATCACTGCTGAGGACGTTCTTTGGGCCATGAGCAAGCTTGGTTTTGATGACTACATTGAGCCCTTGACTNT
ATACTTGCATCGTTATCGTGAGTTTGACGGTGGTGAGCGTGGATCTTTGAGAGGGGAGCCTTTGCTGATGAAG > SEQ ID NO:1433 113124 109070_300042_1
TCTACATCCATCGCGCACTTGATGGAAGCCTTCAGGACTACGTGTTTGAGGAGAGCGTTTGCCTTCTCCTTAGGGCATC
ATGGTTTAAACCTTTGATTGTGGAGGAAAGGGCGGAGGTTGATGATGATATGGATGACTTATACATGTATGATTACGAA
GAAGAAGATTTAGCAGAAGATTATTTCGTTAGTAGTTCATCAAGACTCCGTATCGGCAATAGACGATGGGGTGATAATG
GATATGTTAGTGCAGGAAGGCAAGAAGCAAGGCCTGTTTATCGACCTAACTCTCAGGAATCGGTGCTGGCCCCTCTCG
TGAGCCGAAGAAGAAGGAGGATGCTGTTCCTAAAGAACTTGTTGGCCGGCGTGCAAAGAGGGCACTGAAGCGTGAAGCT
GCTGATAA > SEQ ID NO:1434 113170 1100820_301464_1
GGCATGGCGGGAGCGGCGGCAGTGGAATGGCATCTCCGGCAGCAGAATGCGAAGAACCCAATCGTGTTCTTCGACGTGA
CAATCGGGACCCTCCCTGCCGGAAGAATCAAAATGGAACTCTTTGCCGACATTGCCCCTCGCACTGCTGAAAACTTCAG
ACAGTTTTGCACTGGAGAATACAGGAAGTCTGGCATTCCTATTGGATACAAGGGTAGTGCATTTCATAGGGTCATCAAA
GATTTCATGATTCAAGCTGGTGACTTTGTAAAGGGAGATGGAAGTGGATGTACTAGCATATATGGAAGCAAGTTTGACG
ATGAAAATTTTATTGCCAAGCATACTGGACCTGGGCTTCTTTCAATGGCTAACAGTGGACCGAGTACAAATGGTTGTCA
GTTCTTTATCACCTGTGCCAAGTGCGATTGTTGGATGAAAGCATGTCGTTTTTGGGAGAGTGCTAGGAGATAGCCTT
TTGGTTGTAAGGAAGATAGAGAATGTCCAGACGGGTCCCAACAATCGACCTAAGCTCCCCTGTATTGTCTCTGAATGTG
GTGAAATGTGACAGGATTAAAAGGTGTTCCCTTTTTCTTCAACATATGGTTTCATATTTCTTTTCTTTTCCATATTACA
TAGAAAAGGGAG > SEQ ID NO:1435 113170 159723_200141_1
tccgacgtagacagcggttctctaacagtgaatgcgaacaaagatggcaaagaattcatttgttttgctgctcttcagt
tTAGTCATTTTCGGAACTCTAACGTCTGCTCAGGGCAAAAAGTCCCAGGAAAGTCTAAAAGAAATAACTCACAAGGTTT
TCTTTGATGTTGAGATTGATGGTAAACCTGCAGGTCGTATTGTTATGGGTCTCTTTGGTAAAACAGTTCCTAAAACAGC
AGAAAATTTCAGAGCATTGTGCACAGGGGAGAAAGGTATCGGAAAGAGTGGCAAGCCTCTTCATTACAAGGGGAGCACA
TTCCATAGAATAATCCCCAGCTTCATGCTTCAAGGTGGTGATTTCACTCTTGGTGACGGGCGTGGAGGTGAATCTATTT
ATGGTGAAAAATTTGCTGATGAAAATTTCAAGATCAAGCACACTGGACCAGGGCTTTTGTCAATGGCAAATGCTGGTCC
CGACACCAATGGTTCACAATTCTTCATCACAACCGTCACAACTAGCTGGTTGGATGGccGGCATGtTGTCTTTGGGAAG
GTGTTGTCTGGAATGGATGTcGTTTAcaagattGAAGCTGAAggAaGACaaAGtggaaCAcCAAAAAGCaaAGTTGTCA
TTgcagaC > SEQ ID NO:1436 113170 14031_300245_1
CCCACGCGTCCGATCTTCTTCATCGATTTCTCTCTTCCAAATCTCCCAAAAGATGTCGAACCCTAGAGTTTTCTTCGAC
ATGAGTCTCAGCGGTACTCCCATCGGACGGATCGAGATGGAGCTTTTCGCTGATACAACCCCAAACACGGCGGAGAATT
TCCGTGCTCTCTGTACCGGCGAGAAAGGAATGGGAAAGCTAGGTAAGCCACTTCACTTCAAAGGATCGATCTTCCACCG
TGTGATTCCCGGATTCATGTGTCAAGGAGGTGATTTCACCGCCAAGAACGGAACCGGTGGTGAATCGATCTACGGTGCT
AAGTTCAAGGACGAGAACTTTATCAAGAAGCATACAGGAGCTGGGATTCTCTCAATG > SEQ ID NO:1437 113170 128338_300475_1
CCCAACCCCCCCGAGTCAGCTCTAATAGGGCCAAAGACTCTAGCAGCAAAACATGTCAGTGACGCTTCATACAAACCT
AGGCGACATCAAGTGCGAAATCTTCTGTGACGAAGTCCCTAGAACTGCTGAGAACTTCTTGGCATTATGCGCAAGTGGT
TATTATGATGGGACAATATTTCACAGAAACATAAAGGGTTTCATGATCCAAGGGGTGACCCAACAGGTACAGGAAAAG

FIG. 2 continued

GCGGGACAAGTATTAGGGGAAAAAAATTCAATGACGAGATAAGGGAGTCTCTCAAGCACAATGCAAGAGGAATATTGTC
AATGGCCAACAGTGGCCCTAATACCAACGGGAGCCAGTTTTTCATGACATATGCCAAGCAACCACATCTTAATGGATTG
TACACCATTTTCGGAAAAGTGATACATGGATTTGAGGTTCTTGATATCATGGAAAAGACTCCAACAGGACCAGGTGATA
GGCCCCTTGCCGAAATCAGACTCAACCGGGTGACAATACATGCTAATCCACTTGCTGGTTGACGTTATTTCGAACTCAT
GCTACGGCAGTATGTTTAATCTCATTATTG

> SEQ ID NO:1438 113170 1101394_301475_1
ggatcttcgtCTTTGGAATTGGCTATGGCAATGGCTTCGCTTCCCTTGCTTCTCCTGGCTGCCCTTTTCCTCATTTCTT
CTGCTACTGTCCAGGCAAAGAAAAAGGATCTAGAGGAGATAACTCACAAGGTTTACTTCGATATAGAAATTGGTGGCAA
ACCGGCTGGTCGAGTAGTTATTGGTCTTTTTGGAAAGACTGTGCCGAAGACTGTAGAAAATTTTCGGGCTCTTTGCACA
GGTGAAAAGGGTGTTGGCAAGAGTGGAAAACCACTTCATTACAAGGGCTCCAAGTTTCATCGCATAATCCCAAGCTTTA
TGATTCAAGGTGGGGATTTCACTTTGGGAGATGGACGAGGCGGAGAATCTATTTATGGGGTGAAATTTGCAGATGAAAA
CTTCAAAATCAAGCATACCGGAGCAGGTATACTTTCGATGGCAAATGCGGGCCAAGACACCAATGGCTCTCAGTTTTTT
ATCACTACCGTTCAAACAAGCTGGTTGGATGGAAAGCATGTTGTTTTTGGCAAGGTTATCAGTGGAATGGATCTCATCT
ACAAGGTGGAAGCCGAAGGTACCCAAAGTGGTACTCCAAAGAAAACTGTCTCCGTTGTTGATAGTGGGGAGCTTCCCTT
GTAGTAAGCCTTTACTAGAGTAGCACTCACACTGGAAACATACACTAAAGAGATGGGGAAAAAAAGGgtctc > SEQ ID NO:1439 113170 268720_200053_1
gggAAAAATTCCACAGAAATTTCTAGAAGAGAGTGAGAGATGGCAAATCCTAAGGTTTTCTTCGACCTTACCATCGGCG
GTCAACCGACCGGCCGTGTGGTGATGGAGTTGTTCAACGATGTAGTTCCGAAAACCGCGGATAACTTCCGAGCACTCTG
TACCGGAGAGAAAGGCGTCGGAAAGTCCGGCAAGCCGTTACACTACAAAGGATCATCATTTCACCGTGTGATTCCTGGA
TTTATGTGTCAAGGAGGTGATTTCACTGCTGGAAACGGTACCGGCGGTGAATCGATCTACGGCGCCAAATTCGCCGACG
AAAATTTCGTTAAAAAGCATACTGGACCGGGAATTCTCTCCATGGCTAATGCTGGCCCTGGAACTAACGGATCGCAGTT
TTTCATTTGTACGGCCAAAACCGAGTGGCTCGATGGAAAACACGTGGTTTTTGGTCAAGTTATTGAAGGAATGGACGTG
ATTAAGAAAGTGGAAGCTGTTGGATCTAGCTCCGGCAGGTGCTCGAAGCCCGTTGTGATTGCTGACTGTGGTCAACTCT
CTTAGATTATTAATGGTATCAACTAATGTTAATGATGATCTAAACTAGTTAaCTATGGGATCGCAGTGTACTGATCTGC
TggtTTTCgttTttttattT > SEQ ID NO:1440 113170 33313_300457_1
TCGATTTCTCTCTTCCAAATCTCCCAAAAGATGTCGAACCCTAGAGTTTTCTTCGACATGAGTCTCAGCGGTACTCCCA
TCGGACGGATCGAGATGGAGCTTTTCGCTGATACAACCCCAAACACGGCGGAGAATTTCCGTGCTCTCTGTACCGGCGA
GAAAGGAATGGGAAAGCTAGGTAAGCCACTTCACTTCAAAGGATCGATCTTCCACCGTGTGATTCCCGGATTCATGTGT
CAAGGAGGTGATTTCACCGCCAAGAACGGAACCGGTGGTGAATCGATCTACGGTGCTAAGTTCAAGGACGAGAACTTTA
TCAAGAAGCATACAGGAGCTGGGATTCTCTCAATGGCTAACTCTGGTCCTAACACTAACGGATC > SEQ ID NO:1441 113170 55539_300128_1
AGGTTTACTTTGATGTGGAAATTGGTGGTGAAGTTGCTGGCAGAATTGTGATGGGTCTCTTTGGAGAAGTTGTGCCTAA
AACCGTTGAAAACTTCCGTGCCTTGTGTACTGGTGAGAAGAAATACGGGTACAAGGGTTCCTCTTTCCATCGTATTATT
AAGGATTTCATGATCCAAGGAGGTGATTTCACCGAGGGAAATGGTACTGGAGGTATTAGTATTTACGGTGCCAAGTTCG
AAGATGAAAACTTTACCCTGAAGCATACTGGACCTGGAATCTTGAGCATGGCAAACGCTGGTCCTAATACTAATGGAAG
CCAGTTTTTCATTTGTACCGTCAAGACTTCAT > SEQ ID NO:1442 113170 43473_300031_1
GCGAATCCTAGAAACAAATTGTCTCCTTACCTTCTTATCGGGGTCTTGGTTTTATTCGGAACCCTAATTTTCATTCTGA
ACCGATTGGGTGATACCGGAGTCACGTCGGATAAAGACATTAAAATCGAGCAAATGATGAGGCGAAACCATCAGAGGA
TTTGGAGCACGTGACGCATAAAGTGTACTTTGATGTCGAAATTAATGGAAAGCCTACAGGTCGTATTGTCATGGGCCTC
TTTGGAAAAATTGTCCCGAAGACAGCAGAAAACTTCAGAGCTCTTTGCACGGGGAAAAAGGAACTGGGAAGGCTGGAA
AGCCTCTCCATTACAAAGGTAGCACTTTCCACAGGATCATACCGAGCTTCATGATCCAGGGAGGCGATTTCACTCGTGG
TGATGGGCGAGGTGGAGAATCTATATATGGTGAAAGCTTTGCAGATGAAAACTTTTATCTAAAACACACTGTACCTGGT
ATTCTGTCAATGGCAAATGCTGGACCGGACACCAATGGGTCTCAATTCTTTATCACAACTGTAACCACTGGCTGGTTGG
ATGGGCATCATGTTGTCTTTGGCAAGGTGCTGTCTGGCATGGATGTTGTCTACAAAATCGAAGCA > SEQ ID NO:1443 113170 221295_300969_1
GCCAAAATGCCTAACACCAAGGTTTTCTTCGACATTGCCTGGAAGGGCCCCGTCTTCAAGGACGGCCGTCCTACCTCCG
AGATCAAGGAGCAGACCGGTCGCATCAACTTCAACCTCTATGACGACGTTGTCCCCAAGACCGCTGAGAACTTCCGTGC
TCTCTGCACCGGCGAGAAGGGCTTCGGCTACCAGGGCTCTTCTTTCCACCGAATCATCCCCAACTTCATGCTCCAGGGT
GGTGACTTCACCCGCGGTAACGGCACTGGCGGCAAGTCCATCTACGGCGAGAAGTTTGCCGATGAGAACTTCCAGCTGA
AGCACGACCGCCCCGGTCTGCTGTCCATGGCCAACGCCGGCCCCAACACCAACGGCTCTCAGTTCTTCATCACCACCGT
CGTCACCTCTTGGTTGAACGGCCGCCACGTCGTCTTCGGCGAGGTCGCTGACCAGGAGTCCATGGCCATTGTTGCTGCT

FIG. 2 continued

CTTGAGGCCACCGGCCGTGATGACGGCAAGGTCAAGTACGAGCCCCGCCCCACCATCACCGNCTCCGGTGTCCTGTAAA
CTTGTTGAAAAGAAGCAACATGCTCTGCATGTCCATTTGGTGG

> SEQ ID NO:1444 113595 246455_301613_1
gcggacgcgtgggggGAGATTTTAGGGCGAATTCCGGGGCGCGATGGCGGCATCTATCGCGGCATTCACGGCCGCTCCA
TCTTCTTGCTGCGTGGCGGCGGCGGCGTCGGCATCGGCCTCGTCGTCATCGATTCGGCCGCTTCCACTGAAAAGATCGG
TCCTCATGCTCCACAGCGCGGCAATGCCGGGGTCTTTGAAGTTCTCTCCGCTCACAGTGATGGCTACGACCTCGTCCGA
GGAGAAGACGACTGGGACGACGACGTCGACGGAAGACGTGAGCAAGCAAGTGGAGGACAtngTGTCGGATTTGAAGGAA
AAGTGGGATGGTGTGGAGAACAAGACTACTGTCTTGATTTACGGTGGTGGAGCGCTGGTCACGCTATGGTTCTCGGCAA
CAATCGTTGGAGCTATCAACTCGGTTCCATTGCTTCCAAAGGTAATGGAGCTTATTGGACTGGGATACACTGGCTGGTT
CGTCTACCGGTATCTTCTCTTCAAGTCGAGTAGAAAGGAGCTGCTGGAAGACGTGGAAGAGCTCAAGAAGAAGATCACG
GGCGCAACCGAGTAAGAAGACGAGTAGAGCGAGCTGTTTgATGATGTCCGAAAGAAGAAACTCTGACGTGCCTGGATGG
AACCAGGCC > SEQ ID NO:1445 113595 254831_301639_1
GACAGAAGAGAGAGAGAGATAGAGAGAGAGAGAAGCGATGGCCGCCACTGCCGCCCTCTCTCTGCATGCACCCCCTTCG
TTGGCGAATGCCGCCCCCTCCCCTTCTTCTCTCTCTCTCCTCTGCCCCTTTCCCCAGAATGGCCTTCTCCGCTAGAC
CTTCCCTCCGCCTCTCAGGTAACCTAAGATTTTCACCTCTGCCCATCAAGGCGATATCAACCGAGGAAAAACAAGCATC
CGTAGAAACTGAAGCCCCAGTAGAAGATGTATTGGCGGACTTGAAGGAAAAGTGGGACAAGATTGAGAACAAGTCAACT
GTGTTCATTTATGGTGGAGGTGCTCTGGCTTCCATTTGGGTGTCATCAATAGTCGTGGGAGCTATTAACACAGTTCCAT
TGCTTCCTAAGGTAATGGAACTGGTTGGACTAGGCTACACTGTATGGTTTGTGTACAGGTACCTCCTTTTTAAGGAACA
GCAGGAAAGAGCTAGTCTCTGATATTGAGGATATCAAGGCAAAGATAGTCGGTGTCGGTAAGG > SEQ ID NO:1446 113595 1100332_301459_1
ggagggagacagaagagagagaGAGATAGAGAGAGAGAGAAGCGATGGCCGCCACTGCCGCCCTCTCTCTGCATGCACC
CCCTTCGTTGGCGAATGCCGCCCCCTCCCCTTCTTCTCTCTCTCTCCTCTGCCCCTTTCCCCAGAATGGCCTTCTCC
GCTAGACCTTCCCTCCGCCTCTCAGGTAACCTAAGATTTTCACCTCTGCCCATCAAGGCAATATCAACCGAGGAAAAAC
AAGCATCCGTAGAAACTGAAGCCCCAGTAGAAGATGTATTGGCGGACTTGAAGGAAAAGTGGGACAAAATTGAGAACAA
GTCAACTGTGTTCATTTATGGTGGAGGTGCTCTGGCTTCCATTTGGGTGTCATCAATAGTCGTGGGAGCTATTAACACA
GTTCCATTGCTTCCTAAGGTAATGGAACTGGTTGGACTaggCTACACTGTtTGGTTTGTGTACAGGTACCTCCTTTTTA
agGAAAGCAGGAAAGAGCTAGTCTCTGATATtGAGGATATCAAGGCaAAGATAGTcggtgttggtaacgaacagtGAAC
t > SEQ ID NO:1447 113595 170256_300531_1
ccccgagctGCTGCCTCTAGCTTACTTGGTGATAAGGAGGAGGAGGAGGAGGGCACCGACATGGCCGCAGCCACGGCGT
ACACCGTGGCGCTCCTCGGCGCCACCGGCGCGCGTCCCCGCCGCTCCACGCTCCGCCGCACTTCTGCCGCGCCGCGG
CGGCGTGCTCCAACCGCTGCGCCTCCAGGACGCCGCGACTGTCCCTGCTCCGCGTCAGGGCCGCCTCCGACGACACC
TCCACCTCGGCCAGCGGCGACGAGCTCGTCGCCGACCTCAAGGCAAAGTGGGAGGCGATCGAGGACAAGCCGACGTTCC
TCCTCTACAGCGGCGGCGCCGTCGTCGCCCTCTGGCTCACCACCGTCGTCGTCGGCGCCATCAACTCCGTGCCGCTGCT
CCCCAAGATCCTGGAGCTCGTCGGCCTCGGCTACACCGGCTGGTTCGTCTACCGCTACCTCCTCTTCAAGGAGAGCAGG
AAAGAGTTGGCGACCGACATCGAGACCTTGAAGAagaAgaTCGCTGGAACGGAGTAATTAAGCAGCTGCATTTGTCCGG
GGAAGTTTTGGGGGgtgACtCtctagagtgCtTGcTgctgctTCCTCTATgtgatgttTgtaTATCTCtAcgagaatAT
gttcTGCTcccAtgtgCagt > SEQ ID NO:1448 113595 181164_300654_1
GAATTCAAGAGAAAAACAAGTACAGAGAGAGTGAGTTTAGTGAAGAAGTAATGGCAACTATGTATGCAGCAGCAAGTGC
ATCTTCAATGCTAGTGGCAAGACCTCGTTTGCCAAAAACCATTAGCTGCTCAGCAGGTTTACCTTATCTTCCACCTCGT
CCATCCGTTTCTTCATTCTCTACCTCCATCAAAAACTACCCAGTGTCAAGCAGCAGATTTTCAACTCTCCGAGTCAAAG
CTGAGGAGACATCATCTGTTGAGGTTAATGATATAATTGAAGACTTAAAAGAGAAGTGGGATGGACTTGAAAACAAGTC
TACCGTTCTTATCTACGGTGGTGGTGGTTTGGTTGCACTTTGGCTATCTACAGTTGTGGTTGGCGCCATCAATTCAGTT
CCTTTGCTTCCAAAGATCATGGAACTAGTAGGACTCGGTTACACTGGATGGTTTGTCTACCGATACCTTCTCTTCAAGT
CAAGCAGAAAAGAACTAGCAAGTGATATCGAATCCTTGAAGAAAAAGATTGCAGGAACCACCGAATAGAGTCAGACATA
AGATGGTCTTGCAGTGGGGCTGTCTTGTCTATTGTCCTTAGATTTATTTGAGAATCATTATATGGCT > SEQ ID NO:1449 113595 191336_300740_1
cccccccccctccggtagccaaggaaaagaaagcagaggcggagggaagagccacgtaaagccGAAGAGGGTCCACGA
CTGACATGGCCGCCACGGCGTGCTCCACGCGCGCCTCTTCTCGGTGGAGCTCGCCTCCCCGCCGTCGGCGCCGCCTTGCC
GCCGCCCTCCGTTCTCCTCCTCCCCCAGCGCAattTCCCCTCTCCTCTCCGCCTCCATGaCGCACCGAGGCTATCTCTG
ctCCGGGCGAGGGCGTCGTCCGACGAcaCCTCGTCCTCCGCCGGGACCGGCGACGAGCTCATCGAAGACCTGAAAGCTA

FIG. 2 continued

AGTGGGACGCCGTTGAGAACAAGTCCACCGTCCTCACGTACGCCGGCGGCGCCATCATCGCCCTCTGGCTGTCGTCCGT
CATCGTCGGCGCCGTCAACTCCGTGCCTCTGCTTCCCAAGTTCATGGAGCTCGTCGGGCTCGGGTACACAGGCTGGTTT
GTGTACCGCTACCTCCTCTTCAAGGAAAGCAGGAAGGAATTGGCcGACGACGTCGATTCTTTGAAGAAGAGGATTGCTG
GGACAGAGTAAAAAATGCCGTCGTCTGCACCAATTTTTTGGAACGATTC

> SEQ ID NO:1450  113595  186836_300667_1
GACGAGCTCATCGAAGACCTGAAAGCTAAGTGGGACGCCGTTGAGAACAAGTCCACCGTCCTCACGTACGCCGGCGGCG
CCATCGTCGCCCTCTGGCTGTCGTCCGTCATCGTCGGCGCCGTCAATTCCGTGCCTCTGCTTCCCAAGTTCATGGAGCT
CGTCGGGCTCGGGTACACAGGCTGGTTTGTGTACCGCTACCTCCTCTTCAAGGAAAGCAGGAAGGAATTGGCCGACGAC
GTCGATTCTTTGAAGAAGAGGATTGCTGGGACAGAGTAAAAAATGCCGTCGTCTGCACCAATTTTTTGGAACGATTCTT
TGGATCGCACATTGCAGAGACCAAAACCCGTTGTTTAGAGTACTAGTGTTTGGTACCGCGAAGCTTTGTTTTGTTCCTT
TCCTTGATGGGCAATAACAGTGTCTTCACGTGTAGATCGAATTAATAATAATTACGAATTGCGTCTCGACT

> SEQ ID NO:1451  113595  197207_300700_1
agctgaaaaaaaagagaggccacgaagagagctcagctgctgcctctagcttacttggtgataaggaggagGAGGAGG
AGGAGGGCACCGACATGGCCGCAGCCACGGCGTACACCGTGGCGCTCCTCGGCGCCACCGGCGCGCGCGTCCCCGCCGC
TCCACGCTCCGCCGCGCTTCTGCCGCGCCGCGGCGGCGTGCTCCAACCGCTGCGCCTCCAGGACGCGCCGCGACTGTCC
CTGCTCCGCGTCAGGGCCGCCTCCGACGACACCTCCACCTCGGCCAGCGGCGACGAGCTCGTCGCCGACCTCAAGGCAA
AGTGGGAGGCGATCGAGGACAAGCCGACGTTCCTCCTCTACAGCGGCGGCGCCGTCGTCGCCCTCTGGCTCACCACCGT
CGTCGTCGGCGCCATCAACTCCGTGCCGCTGCTCCCCAAGATCCTGGAGCTCGTCGGCCTCGGCTACACCGGCTGGTTC
GTCTACCGCTACCTCCTCTTCAAGGAGAGCAGGAAAGAGTTGGCGACCGACATCGAGACCTTGAAGAAGAAGATCGCTG
GAACGGAGTAATTAAGCAGCTGCATTTGTCCGGGGAAGTTTTGGGGGGTGacTCTCTAGAGTgctTGCTgcTGCTTccT
CTGTGTGATGttTgtaTATCTCTAcgagaaTATgttctgctCCCATGTGCAgtaACAgcgTaGTGCAAAAACtgtatCa
AACCTACTATCAGTTgtttcTTCG > SEQ ID NO:1452  113595  1114243_301844_1
GGCGGCGGCAGTAGCAGTAGCAGCCTCTTCCTCCCTCTCTCTTTCCCGGCACTCTGCCGCCACGGCACCAGTGTCGCCC
CTGCGTAGGGCCCTCCCCCCGTCGCTGCCTTTCCCGCCTCCCAAGCTCTCAAGCTCTCTACTTCGCCTTTCGTCCCAG
CCACTCTAAGATTTTTGCCCTTATCTGTCAATGCGGTTTCAACTGAGGAAAAAACGTCATCATCGGTTGAAGCCGAAGT
ACCGGCCGAGGATTTAGTGGCCGACTTAAAGGAAAATGGGATAAGCTGGAGAACAAGTCGACAGTCTTAACCTACGGC
GGAGGTGCTTTGCTTGCCATTTGGTTCTCTTCGATAGTTGTTTCTGCCATTAACGCAGTTCCCCTGCTTCCGAAGCTTA
TGGAGTTTGTGGGCCTTGGATATACTGGTTGGTTTGTCTATAGGTACCTTCTTTTCAAGGAAAGTAGGAAAGAGCTAGT
CTTGGATATTGAGGATTTGAAGTCAAAGATAACCGGGTCTGGAAAGGAAGATTAGGCAAGGAGGGACTTATTCTATCCA
TGGCAAGTAAGGTGGTTTGTCTGTGTGTGTTTaGGTAggATAAATtt > SEQ ID NO:1453  113595  118050_300063_1
cccacgcgtccggAAGAAAATATACTACTTTTTGGGGATATCAAGAAACCAAAAAAGGAGATTTGAGATAGACAAGAAA
GAGAGGCCAAAGTTAAGCAATAAGCATACACCGCCAGCCCCAAAAATCTAAGCATCGGCCAAATGGCAGCAGCAGCTTC
TACTTCAATGGCAGCTACTGCCGTCTTTGCTTCTCGTTTCCCACTTTCCTCCACCACCAAAGCCGCCCCTGTTCGCTGC
TCCGCCTTGCCTTACCTCCCACCCTGTCTTTCTGCTACTGCCTTCTCATCTTCTCTCAAGTTTGCTGAACCCAAGAGGG
CTTCGCTACTCCAGGTCAAAGCCTCTTCATCAGAAGAATCCGGTGCTGTTGATACCAGTGAATTGTTGACAGATCTAAA
AGAAAAGTGGGATGCTGTTGAAAACAAGTCTACAGTTATAGTATATGGAGGTGGGGCAATTGTTGCAGTTTGGCTGTCT
TCAATTGTTGTTGGTGCTATCAACTCAGTTCCTTTGCTCCCGAAAATAATGGAGCTGGTGGGCCTTGGATACACCGGGT
GGTTTGTCTACCGCTATCTTCTATTCAAGTCAAGTAGAAAAGAATTGGCAGAAGACATTGAGCAATTGAAGAAGAAGAT
TGCAGGAACTGAATAAATGCACATAAATGCAATGCCAGTTCAGACTGTTAAATTTTCTGTACAAGAGGCATCTGCTCG
TGTGAAGTAGAGTAGATTTTGTTGTAATTTTCTTCTATTCTGAGCAAATCTTCAAATAAAATAATGTATTTACCTTACA
GTTCATTGTGCTTATAAATTATATAGCAGTATCCACTCTGTTTCTAC > SEQ ID NO:1454  113595  120131_300359_1
cccccccccgaaaatcaaagcaatggcctcaactagCTCCCCTTCACTTTCTCTTTCCTCTTCATCGACTTTTGTCGA
TGGCAAGACAACTCGTAAGTCAGCTGCTGCTGCGTCCTCCCAATGTGTCACCCTACCCACCCTCCCTCCCCCTCCAGCC
GTCCAAAGCCGCGCTGCCAGAACCACTGCCTACTGTCGTAAGATTGCAAGGAACGTGGTCGCAATGGCAACGTCTACTG
GAGAGGTTGCAACTACCACAGAGGCTTCATCAGCTGATATGGCAACCACTGAGCTACCATCTGAGCTTCTCCAAAAAAT
TCAAGAAGCTTGGGACAAACTTGACGATAAGTACGCAGTCAGCTCACTCGGTGTTGCTGCACTACTTCTACTATGGAGC
TCCACTGGAGTTATCTCGGCAATTGACAGGCTTCCTCTGATTCCTGGTGTTCTTGAGCTTGTAGGAATTGGTTACACCG
GTTGGTTTGCTTACAAGAACTTGGTCTTCAAACCAGACAGAGAAGCTTTGATATCAAAGATCAAAGACTTGTACAAGGA
AGTAATTGGGAGCAGCTGAAAAGAAATAGAGGGTCCTGATGCTGCCGCAGAGACATGATCGAAATAGATTTCAGTTGAG
CAATCTTGCAGCTTTGCTCTTCGAAATGTAAACTCTGCTTTGTTCTTTTGCtgtctaaatattctaacagaataaaact
caaaatgaactatctatatattgcttatttgtacatcgccctttattctctc

FIG. 2 continued

> SEQ ID NO:1455 113595 1119330_301896_1
ACTCGCACGGAGAGAGAGAGAGAGAAAGGAAGAGGAGATAGATAGATAGATAGATAGATAGAGAGAGAGAGAAGAGCCA
TGGCCACAGCTTCCATGGTTTCATTGCAGGCCACAGCCATGGCCTTCCCCTTTTCACCTTCAACATCTCGCCACTCCCA
CTCCCATTCCCCTTCACTTGCCTTCACAAGAATGCCCCCCCCCGCCAACCCTCTCAAGCCCTCCCTCTTCATCCCGTCA
GGCAGTGTAAGATTTTTACCGCTATCTATAAAAGCGGTATCGACGGAGGAAAAACAGTCAATGTCGGAAACTACAGCCC
CAGCAGAGGATTTTTTGGCGGACTTACAAGAAAAGTGGGATAAATTGGAGAACAAGTCGACTGCTTTTATCTATGGCGG
AGGTGCTTTGGCCACCATATGGATATCATCAATAGTCACTAGTGCTGTTAATTCGGTTCCATTGCTTCCTAAGGTCCTT
GAACTCGTTGGTCTTGGCTACACTGCATGGTTTGTGTATAAGTACCTTCTGtTTAAGGAAAACAGGAAAGAGCTAGTCT
CTGACATTGAGGatntgaaGTCaaAAATAATCggTgggtcccGTaAAGAggAGTaagcCGAAAAGatttagt > SEQ ID NO:1456 113742 109475_300038_1
CGGACGCGTGGGCGGACGCGTGGGATTTCAGGGACGAGTCAAGGAAGCGGCGAGTATTTCTCACGAATTGGCATCGGTC
ACCCGCCGAGTCAAGTTTACATGGTGCTCGATACTGGAAGTGACGTGAATTGGATCCAATGTGCGCCTTGTGCCGATTG
TTACCAGCAAGCCGATCCGATTTTTGAGCCGGCTTCGTCTTCTACATTCTCGCCGCTCACTTGTGAAACGCAACAGTGT
AAATCGCTTGATGTTTCTGAATGTAGGAACGGCACATGCCTTTATGAGGTCTCCTACGGCGATGGCTCGTATACCGTCG
GCGATTTTGTGACGGAGAGAGTTACCCTTGGAGGCTCTTCTTCGGTTGAGAATGTAGCTATCGGATGTGGACATAATAA
CGAAGGTTTATTCGTCGGCGCCGCTGGATTGCTAGGTCTGGGCGGCGGCGCGTTATCATTTCCTTCACAAATTAATGCT
TCTTCTTTCTCCTATTGCCTCGTGGATCGTGACTCGGACTCGACATCAACTCTCGAGTTTGGCGGAGTGATATCGCCTG
ACGCCATTACT > SEQ ID NO:1457 113742 201621_300718_1
CGGACGCGTGGGCCGGCGCAGAGGGGCATCTCCCTCGGCACCGGCAACTACGTCGTGTCCGTCGGGCTCGGGACGCCGG
CGAAGCAGTACGCCGTGATCTTCGACACCGGCAGCGACCTGTCGTGGGTGCAGTGCAAGCCCTGCGCCGACTGCTACGA
GCAGCAGGACCCGCTGTTCGACCCGTCGCTGTCGTCGACGTACGCCGCCGTGGCGTGCGGCGCGCCGGAGTGCCAGGAG
CTCGACGCGTCGGGCTGCTCGTCGGACAGCAGGTGCCGGTACGAGGTCCAGTACGGCGACCAGTCGCAGACCGACGGCA
ACCTCGTGCGCGACACGCTGACGCTCTCGGCGTCGGACACGCTCCCGGGCTTCGTCTTCGGGTGCGGCGACCAGAACGC
CGGGCTGTTCGGCCAGGTCGACGGGCTGTTCGGCCTCGGCAGGGAGAAGGTGTCGCTGCCGTCGCAGGGCGCGCCGAGC
TACGGCCCCGGATTCACCTACTGCCTACCGTCGTCGTCGAGCGGCAGGGGCTACCTGTCCCTCGGCGGCGCCCCGCCGG
CGAACGCGCAGTTCACGGCGCTGGCCGACGGCGCGACGCCGTCGTTCTACTACATCGACCTCGTCGGC > SEQ ID NO:1458 113742 181926_300658_1
GAATTCGGTCAATGGCGAAATCAGCTTTTTGGTTTTGTGTTCTTTTCTTCGTTTCGTTTGCTACCTGTGTTTGCTGTAG
AGTTATTTTACCGGAAAATGAAAACCATGAAGTTACAGTTCTTGATATCTCGGCTTCAATTCAGAAAACTCTCGACATT
CTCTCTTTTGATCCTGATGAAATTCTCTTAGAAGAAGAAAGTGTTTCTGATGATTGCTCATCATTATCTTCATCTTCTT
TCACTGTCAAACTTCAATCTAGAGATACCATTCTGAAATCGACACACAAAGATTACAAAGCTTTAACTCTTGACAGACT
CAAACGTGATTCAGCTCGAGTTGATTCAATCGTTACTAAATTAGATCTCGCCACGAAAGGAATTTCGAAATCAGATCTT
AAACCTTTATCAGTTGAGAAAGAGTTTGATACATTGAAATCACAAGATCAAAATAATATAGTAGGTCCAATTACATCAG
GACTGAGTCATGGAAGTGGTGAGTATTTCTCACGAGTCGGAGTCGGTCATCCTCCTAAACCGCAATACTTAGTTCTCGA
CACAGGAAGTGATGTCACTTGGGTACAGTGCGCGCCTTGTCAGGAGTGTTACCAACAAACCGATCCGATATTCGAACCG
TCTTCTTCTTCGTCGTTTGCACACATTTCATGCGGCGCACAACAGTGCAAATCCCTTGATATTTCGGCTTGTGCTAACG
AATCGTGCCTTTATCAAGTTTCTTATGGTGA > SEQ ID NO:1459 113742 284724_200101_1
GTTAAGCCACGTCATAAGGACTATGCATCACTCACTCTCTCTCGACTCGAACGTGACTCGGCCCGAGTTTCCTCACTGA
CCATGAAGCTCACCCTCTCACTCTCCAACTTTACCCATTCGGATCTCAAGCCGGTTCAAACCATTTTGCAACCCTGATT
ACCTCCAAACTCCTATTACTTCAGGAGCTAGTCAGGGGAGCGGCGAGTATTTCACTCGGCTCGGGTTGGGCCAACCGCC
TAAAGAATTCTACATGGTTTTAGACACTGGTAGTGACATCACGTGGCTTCAATGTGAGCCGTGTTCGGATTGTTATCAG
CAGTCGGATCCAGTTTTCAACCCGTCGGGTTCTTCCACTTACAGTCGGGTCTCTTGTGATGATGCTCACTGCTCGGCTC
TTGACGTCTCCGCTTGTGGTACTAACGCGTGTCTCTACCAGGTCTCGTACGGTGACGGCTCGTTCACTGTAGGAGAGTT
TGCTACTGAAACGGTGTCGTTTGGAAACTCTGGTTCGTTCTCTAAAGTTGCTATAGGCTGTGGCCATGATAATGAAGGA
CTCTTCGTCGGCGCTGCTGGTTTGATTGCTCT > SEQ ID NO:1460 114370 231805_301209_1
GGACAAGAAGAAGCGCAAGATGAAGAAGAGCGTGGAGACGTACAAGATGTACATCTACAAGGTGCTCAAGCAGGTGCAC
CCGGAGACGGGCATCTCGTCCAAGGCCATGGGCATCATGAACAGCTTCATCAACGACATCTTCGAGAAGCTGGCGCAGG
AGGCGTCCAGGTAGGCCCGCTACAACAAGAAGCCCACCATCACGTCGCGGGAGATCCAGACGGCCGTCCGCCTCATCCT
CCCCGGGGAGCTCGACAAGCACGCCGTGTCCGAGGGCACCAAG

FIG. 2 continued

> SEQ ID NO:1461 114370 291675_200080_1
ccctcgaccacgcgtccgCTTTTTCGCTCTAAAAAGCTCCTTGTATTTTCTCCATCTTACTAACAATGGCACCAAAAGC
TGAGAAAAAGCCCGCCGAGAAGAAACCAGCAGCAGAAAAAATCCCCGCCGCAGAGAAAGCTCCGAAGCCAAAGGCCGGC
AAAAAACTACCTAAGGACGGCGGAGCTGCCGCTGCCGGAGACAAAAAGAAGAAGAGAGCCAAAAAATCGGTTGAAACTT
ACAAGATCTACATCTTCAAGGTGCTGAAACAAGTACATCCTGATATAGGTATCTCAAGTAAAGCTATGGGTATAATGAA
CAGTTTCATCAACGATATCTTCGAGAAGCTTGCTCAAGAATCTTCCAGACTTGCCAGGTACAACAAGAAGCCAACCATT
ACTTCTCGGGAAATTCAGACTGCTGTGAGACTTGTACTTCCTGGTGAATTGGCTAAGCACGCCGTTTCTGAAGGCACTA
AGGCTGTTACGAAATTCACTAGCTCTTGAATGTTGTTAGGGTTTGCGTTCTCTTTTCATGTCTTAATCAAGGGTTTTAT
GGATGTAAAAATAGTTTAATTAGTTTGTTTAAGTAAATCTTTTGTATTCGACTGCCAGTTATGAATGGAATTGCCAAG
TTTTCT > SEQ ID NO:1462 114370 27937_300089_1
CCCACGCGTCCGCAGCAAAAAAAACTCACTCCCTAgaAAAGTTTGAAAATGGCGAAGGCAGATAAGAAACCAGCGGAGA
AGAAACCGGCAGAGAAAACTCCGGCAGCCGAACCAGCAGCAGCGGCAGAGAAGAAACCAAAAGCCGGAAAGAAACTCCC
GAAGGAACCAGCCGGCGCCGGAGACAAGAAGAAGAAGAGATCAAAGAAGAACGTTGAGACATACAAGATCTACATCTTC
AAGGTGTTGAAGCAAGTTCATCCAGATATCGGAATCTCCAGCAAAGCCATGGGAATCATGAACAGTTTCATCAATGATA
TCTTTGAGAAACTTGCTGGTGAGTCTTCGAAGCTTGCGAGGTACAACAAGAAGCCGACGATTACTTCTAGGGAGATTCA
GACTGCGGTGAGACTTGTGTTGCCTGGAGAGTTGGCGAAACATGCTGTTTCTGAAGGGACTAAGGCGGTTACGAAGTTT
ACGAGTTCTTAGATTTGGAATGTGGTTTTGTAATGGAGGAGAAGTAGTAGTAGTAGTTGGAATGTGAAATAGGGTTTAT
GCTTTTGGGTATCTTTGAGGGTTATGTAATATGGGAATTAGGGTTTTAATTTATGGCACGGCTATGAAATCTACTTAAT
Tt > SEQ ID NO:1463 114370 285770_200106_1
caaatctctaaattttactctttctcttTAAAATTTTCAATGGCTCCTAAGGCAGAGAAGAAGCCCACCGAGAAGAAGC
CGGCTGAGGAGAAAGCTCCGGCGGAGAAGAAGCCAAAGGCCGGGAAGAAGCTTCCGGCGAAGGATGGCGCCAGTGGTGC
AGACAAGAAGAAAAGAAGGCTAAAAAGAGTGTTGAAACCTACAAGATCTATATCTTTAAGGTGCTCAAGCAAGTTCAT
CCAGACATTGGGATCTCGAGCAAGGCTATGGGGATTATGAACAGTTTTATCAATGATATTTTTGAGAAATTGGCTCAGG
AATCTTCTAGACTTGCTAGGTATAATAAGAAGCCGACTATTACTTCCAGGGAAATTCAGACCGCGGTCAGATTGGTGCT
GCCCGGTGAATTGGCTAAGCATGCTGTTTCTGAAGGAACCAAGGCTGTGACTAAGTTTACCAGTTCTTAATTTTTTAG
CTTATGTTGGGTAATTCGAAAAATTAGGGTTTATTTTTGGGAAATTAGAGTAAGGGTTATCTGGTGAAATTCCGAAAGCT
AGTTTCTTTCTTTCTTTTGTGTTCTGATTTTCTATtgtaactaaactgttgttgctaagtgaatgaacaaatctacctc
tgggaaaaaaaa > SEQ ID NO:1464 114370 6214_300255_1
CCCACGCGTCCGCCAAGAGCCGAGAAGAAGCCCGCCGAGAAAAAAACCGCCGCTGAGAAACCGGTGGAAGAGAACAAGG
CTGCTGAAAAGGCTCCGGCGGAGAAGAAACCCAAGGCGGGGAAGAAATTGCCACCAAAGGAAGCCGGTGACAAGAAGAA
GAAGCGATCTAAGAAAAACGTCGAAACCTACAAGATCTACATCTTCAAGGTTCTGAAGCAGGTTCATCCAGATATCGGA
ATTTCAAGCAAAGCCATGGGGATTATGAACAGTTTCATCAACGACATATTCGAGAAGCTAGCTCAGGAATCTTCGAAAC
TCGCTAGGTACAACAAGAAGCCGACCATTACATCTCGCGAGATCCAGACGGCTGTGAGACTCGTCCTCCCCGGTGAACT
CGCTAAACACGCCGTCTCTGAAGGTACCAAGGCggttACCAAGTTTACTAGCTCTTGAAGAGACCCGgttAGGgttTTT
AGGGATTTCAATTTCGgttTGgttTTTAGTACTTgtaGgAAATTAGATGCATTATTCGCTTAACTTCGTATTTTgtggc
tTTGtaaCTCTAggaaGTAGAGAAGattgttccTTccTtTTATGaaTTTCAAtgttGGATTATATATTTTTAACGATTT
TTTTTtccatTTCAATTTCATtTACCTaaTCACTATAtTGaaAT > SEQ ID NO:1465 114370 219507_300946_1
GCACCCTGACACCGGTATTTCCAACCGTGCCATGTCCATCCTCAACTCGTTCGTCAACGATATCTTCGAGCGCGTTGCT
ACCGAGGCTTCCAAGCTGGCTGCCTACAACAAGAAGTCCACAATCTCTTCCCGAGAGATCCAGACATCTGTCCGATTGA
TCCTGCCGGGTGAATTGGCCAAGCACGCCGTCTCTGAGGGCACCAAGGCCGTCACCAAGTACTCTTCATCCACGAAATA
AAGGGTCAAGATGGCTGGTTCTGATTTCAAATCTGAAAACTTGGGTTTTTGTTTGCGTGACTTTAGTGTCTTTACTCGA
GACGATGGGTGACTGTGTTTCGCCTTTGGGATCTCTTAATGCGTTACGGATGGTTTGCTTTATGGGGCAATGTCTTCA
CGGTCAATGGGGTTCGCGGTTGTACAATAGCTATCGAGGATATCTCGAAGCAATGGTTTCTGCACATTATGCTATTAT > SEQ ID NO:1466 114370 104460_300410_1
gccattacgccggggacacaaattcacattcaagtcctcacatttctcctactctctctcatatttcatttctctctc
tAGTGTTTCCACAATGGCACCAAAAGCCGAGAAGAAACCCGCCGAAGAAGCCAGCAGCTGAGAAGGCACCAGTAGCA
GCAGCTGCAGCGGAGAAGCCAAAGGCTGGGAAGAAGCTTCCCAAGGACGGCGCCGGAGCAGCTGCAGGAGACAAGA
AGAAGAAGAGGTTAAAGAAGTCTGTTGAAACTAACAAGATCTACATCTTCAAGGTGTTGAAACAGGTTCATCCTGATAT
TGGTATCTCTAGTAAGGCTATGGGGATCATGAACAGTTTTATTAATGACATTTTCGAGAAGCTGGCTCAGGAATCTTCT
AGATTGGCCCGTTACAACAAGAAGCCTACTATCACTTCTCGGGAGATTCAGACTGCTGTGAGGCTTGTGCTTCCTGGTG

FIG. 2 continued

AATTGGCTAAGCATGCTGTTTCTGAGGGTACCAAGGCTGTTACTAAATTTACTAGCTCTTAATCAATTTTAGAGTTTGT
GTTTTGATTAGGGTTTGTAGATGTAAAGAATTGTCCAATTAGGGTTGCATTTGACATTTGTGGCATGTAATGGACATCT
ATATTATGAATGAAGAGTTTTCTGTTTTCTCTGACAAAAagaaacaagaaagaaaaaaaaaaaccatgtcggccgcct
tggcc > SEQ ID NO:1467 114370 159841_200026_1
TTCAAAATTACTCCAAACCTTCTCTTAACCTAAAATCTCCATTTCTCTCCTCAAATGGCACCAAAAGCTGAGAAGAAAC
ACGCCGAGAAAAAGCCGGCCGCTGAGAAAACCCCGGTCGCCGAGAAAGCACCAGCAGAGAAGAAGCCCAAGGCCGGAAA
GAAGCTCCCAAAGGACGCTGGTGCTGCCGGAGACAAGAAGAAGAAGAGGGCAAAGAAGTCAGTTGAGACCTACAAGATT
TACATCTTCAAGGTTCTGAAGCAGGTTCACCCCGATATCGGTATTTCAAGCAAAGCCATGGGTATCATGAACAGTTTCA
TCAACGATATCTTTGAGAAGCTTGCTCAGGAATCTTCTAGACTCGCTCGGTACAACAAGAAGCCAACTATCACTTCTCG
GGAGATTCAGACTGCTGTGAGACTTGTACTTCCTGGTGAATTGGCTAAGCATGCTGTCTCTGAAGGAACTAAGGCTGTT
ACCAAATTCACTAGCTCTTGAACAATTTTATGGTTTCAATGTTTAATTTTACTGTCTTTAGGGTTTGTGTTAGGTGTAA
AAACAGTTGCTTTTAATTAATTAGTGTCTAGTTTCCTTTGATCTGTAACGCTTGTTATGTAATCGATAGCTAAACATCT
ATGAAATTCATAAGCTtt > SEQ ID NO:1468 114370 158085_200000_1
AAAATCTTTAAATCTTCTTTTTCTCCATTACTAAACCCGGATTTCGGTTGTAAAATTCAGTTTCAATGGCACCAAAATC
AGAGAAAAAGCCAGCGGAGAAGAAACCAGTAGCAGCGGAGGAGAAAAAGGCCGAAAAAGCACCAGCAGAGAAGAAACCA
AAGGCAGGAAAGAAGCTTCCAGAAGCAGGCGCATCTGGTGCTGACAAAAAGAAGAAGATATTAAAGAAGAGTGTTGAGA
CTTACAAGATCTACATTTTCAAGGTGCTGAAACAAGTTCACCCTGATATTGGGATTTCAAGTAAGGCAATGGGGATAAT
GAATAGTTTTATTAATGACATATTTGAGAAACTTGCTCAGGAATCTTCTAGATTGGCTAGGTATAATAAGAAGCCGACA
ATTACATCTAGGGAAATTCAGACTGCGGTTAGGCTTGTTTTGCCTGGTGAGTTGGCTAAACATGCTGTTTCTGAAGGTA
CTAAGGCTGTCACCAAGTTTACTAGTTCTTAGATTTGGGATTTGGGCGTCTTTAGGGAATGTAAAGGTTGGGTACTGTT
GTGGGGGTTGAAAAATGTtAggTTgttAAGTTTTTGCtTgttCAATGATGTATTGAATATGAATATGAATGAACCGTTT
TGATgaaattTCTG > SEQ ID NO:1469 114370 156430_301366_1
tttctcatacTCAAGTATCTAATCCACTTTCTGTGAAATCTCACAACAATGGCACCAAAGGCAGAGAAAAAGCCAGCTG
AGAAAAAACCAGTAGCAACAGAAGAGAAAAAGGCAGAGAAAGCCCCAGCAGAGAAGAAGGCCAAAGCCGGGAAGAAGCT
CCCAAAGGAAGGCGGAGCAGCAGGAGCTGACAAGAAGAAAAAGAGGGGAAAGAAGAGCGTTGAAACCTACAAGATTTAC
ATCTTCAAAGTGCTGAAGCAAGTGCACCCTGATATTGGTATTTCTAGTAAGGCAATGGGGATAATGAACAGTTTTATTA
ACGATATTTTTGAGAAACTTGCTCAAGAATCATCTAAATTGGCTAGGTATAATAAGAAGCCTACTATTACTTCAAGGGA
AATTCAGACTGCTGTGAGGCTTGTGTTGCCTGGGGAGTTAGCTAAACATGCTGTTTCTGAAGGGACTAAGGCTGTTACA
AAGTTTACTAGCTCTTAGGTTCTCATTTTGGGAATTTTGGATGATTGTAAAGCTTCTTTTAATGATGTGTCTGATTTGT
GTTTGTCCTTGTACGAATGAAGTAATGCAAATGAATGAATGGTTTTGTCCAACT > SEQ ID NO:1470 114370 156101_301363_1
AAAAAGCAGCATTCAAATTTCCTTCACATTTTTCTCTTTGTAAACACATTTTGTTTCAATGGCACCAAAGGCAGAGAAG
AAGCCAGCAGAAAAGAAGCCGGTGGAGGAGAAGAAAACCACCGTCGCCGAGAAAACTCCGGCGGAGAAGAAGCCAAAGG
CCGGGAAGAAACTCCCAAAGGACGGCGGTGCCGCTGCCGGAGATAAGAAGAAGAAGAAGGCCAAGAAGAGCGTTGAGAC
TTACAAGATCTACATTTTCAAGGTGCTCAAACAGGTTCATCCTGACATTGGGATTTCAAGCAAGGCCATGGGTATCATG
AACAGTTTCATTAACGATATCTTTGAGAAGTTGGCCCAGGAATCTTCTAGATTGGCCCGTTACAACAAAAAGCCCACAA
TCACTTCTCGGGAGATCCAGACTGCTGTGAGACTTGTACTTCCTGGAGAATTGGCTAAGCATGCTGTTTCTGAGGGTAC
TAAGGCTGTTACCAAGTTCACTAGCTCTTGAAATTCGTCCTGATGGGTTGTTGTGAGAGTAGATTATGAGTTTATGGTT
ATTTTTGCCAAGGATTAAGGTTCAGTTAAATCGGGTGGTACTTTACTGTATTTTCTTTTGTTTTTGCGGGGTTCCCATG
GATCTTCTCGATCCAGTTTGTAGTTCATATTTGGAATACAATCctatTAAAGttAtTtCaattTCG > SEQ ID NO:1471 114370 153121_200159_1
TCTGCACTATATTCCATGGCTCCAAAGGCAGAAAAGAAACCCGCCGAGAAGAATCCGGCACCGGAAAAACCTGAAGTTC
CGGCGGAGAAGAAGCAAAAAGCCGGTAAAAAACTCCCTAAAGACGTCGGTCCCATAGCCGGTGAAAAGAAGAAGAAAAA
GGTGAAGAAGAGTTCGGAGACGTACAAGATCTATATATTCAAAGTGCTAAAACAAGTGCATCCTGATATAGGAATTTCG
AGCAAAGCGATGGGAATAATGAACAGTTTTATTAACGATATATTTGAGAAACTTGCTCAAGAAGCTTCTAAATTAGCGC
GATACAATAAGAAGCCTACAATTACGTCTAGGGAAATTCAGACGGCGGTTAGATTGGTGTTACCTGGTGAATTAGCGAA
GCATGCTGTTTCTGAAGGGACTAAAGCTGTTACCAAGTTTACTAGCTCTTGAATTTTTAAGGATTGATTAGGTTGTAT
TGGGAATTGGGAATTGAGAATTGGGGTTAGGGGTTTCGTTCAATAGTATTAGTCGGTTAATTTTTGTTGGTTGATTTCA
TGTATGTTGGCGTTTCGATGGGATAATGTAAAGTACAATGCTGTTGCTTAGCAATGAAATCTACTTTTTATGTATTCTT
ATTGATTCTGTTTATTATTCATGAATGCGATATTGATTACTGTTTCCA

FIG. 2 continued

> SEQ ID NO:1472 114370 146512_301066_1
ATCATATCTCTAATTTTTACTCTTTCTCTTCAAAATTGACAATGGCTCCTAGGGCAGAGAACAGTCCCAGCGAGTCTAA
GCCGGCTGACGAGAAAGCTCCGTCGGAGATGAAGCCATAGGCCGGGAATAAGCTTCCGGCGAAGGATGGCGCCAGTGGT
GCAGACGATAGGAATGAGAACGGTAAAAAAAGTGTTGAAACCTACAGGATCTATATCTTTAACGTGCTCAAGCAAGTGC
ATCCAGACGTTGGTATCTCTGGCAATGCTATGGGGATTATGGACAGTTATATCAATGATATTTCTGAGAAATTGGCTCA
TGAATCTTCTACACTTGCTAGGTATAATAAGAATCCGAATATTACTTCC

> SEQ ID NO:1473 114370 129372_300405_1
cccccgaactccacgcgaagggaaaagggcttcctcctcctcacgaatcccgcctctctctctctctctctctctc
tCTCTCTCTCTCTCTCCATTTGAGCCGATCCCTCGAGAGGCAGCTCCGATGGCGCCCAAGGCAGAGAAGAAGCCGGCGG
AGAAGAAGCCCGCAGCCGGCGAGGAGAAGTCGGCGGAGAAGGCGCCGGCGGGGAAGAAGCCCAAGGCGGAGAAGCGGCT
GCCGGCGTCGAAGGCGTCGTCCAAGGAGGGCGGCGCCGGCGACAAGAAGGGGAGGAAGAAGGCGAAGAAGAGCGTCGAG
ACCTACAAGATCTACATCTTCAAGGTCCTGAAGCAGGtgCACCCGGACATCGGAATCTCCTCCAAGGCCATGTCGATCA
TGAACTCCTTCATCAACGACATCTTCGaGAAGCTCGCGCAGGAGGCCGCCCGCCTCGCCCGCTACAACAAGAAGCCCAC
CATCACCTCCCGCGAGATCCAGACCTCCGTCCGCCTCGTCCTCCCCGGCGAGCTCGCCAAGCACGCCGTCTCCGAGGGC
ACCAAGGCCGTCACCAAGTTCACCAGCTCtTaggCGCTCTAGTGTAGTAggtgTtTGgtgATTTTCTCTTCGTCTTCGT
CGTAgcGAGTccATGGCAGCGgTGGTAgttgCCctgtcGATCTCTGATtTCTTTCTCtt > SEQ ID NO:1474 114370 126668_300465_1
ATTTCTCCTACTCTCTCTCATATTTCATTTCTCTCTCTAGTGTTTCCACAATGGCACCAAAAGCCGAGAAGAAACCCGC
CGAGAAGAAGCCAGCAGCTGAGAAGGCACCAGTTGCAGCAGGTGCAGCGGAGAAGAAGCCAAAGGCTGGGAAGAAGCTT
CCCAAGGACGGTGCCGGAGCAGCTGCAGGAGACAAGAAGAAGAAGAGGTTAAAGAAGTCTGTTGAAACTTACAAGATCT
ACATCTTCAAGGTGTTGAAACAGGTTCATCCTGATATTGGTATCTCTAGTAAGGCTATGGGGATCATGAACAGTTTTAT
TAATGACATTTTCGAGAAGCTGGCTCAGGAATCTTCTAGATTGGCCCGTTACAACAAGAAGCCTACTATCACTTCTCGG
GAGATTCAGACTGCTGTGAGGCTTGTGCTTCCTGGTGAATTGGCTAAGCATGCTGTTTCTGAGGGTACCAAGGCTGTTA
CTAAATTTACTAGCTCTTAATCAATTTTAGAGTTTGTGTTTTGATTAGGGTTTGTAGATGTAAAGAATTGTCCAATTAG
GGTTGCATTTGACATTTGTGGCATGTAATGGACATCTATATTATGAATGAAGAGTTTTCTGTTTTCTTTgttaaaTtTG
CTTGgttaTg > SEQ ID NO:1475 114370 168405_300556_1
GAATTCAGCAGAGAAGAAACCAGCAGAGAAGGGGCCAGCAGAGAAGAAGCCCGCCGAAGAGAAGAAGGCAGAAAAAACA
CCAGCAGCGAAGAAACCCAGAGCTGAGAAGAAATTACCAAGCAAAGATGCTTCAACAGCAGACAAGAAGAAGAAGAAAT
CAAAGAAATCAGTTGAGACTTACAAGATCTACATCTTCAAGGTTTTGAAACAAGTTCATCCTGATATCGGGATCTCTAG
CAAAGCTATGGGTATCATGAACAGTTTCATTAATGATATCTTTGAGAAACTTGCTGCTGAATCGTCTAGATTGGCAAGG
TACAATAAGAAGCCTACTATCACTTCACGAGAGATTCAGACTGCTGTTCGTCTTGTTCTTCCCGGTGAATTGGCCAAGC
ATGCTGTTTCTGAGGGTACCAAAGCTGTTACTAAATTTACCAGTTCTTAGGGTTTCTTTGTGGAACTGAAATTTCAGAA
ATTTGTGTTTTGGTTTGTTGCTTTTGGGGATTTGGGTGTTTTCAGATATGTGTAATATAGATGCTTTGAAATCTATCCA
GTTTCCGATTGAAAAACCAATTGAATGCTATTTTGAAATTG > SEQ ID NO:1476 114370 121868_300003_1
cccccgaactccacgcgaagggaaaaggggcttcctcctcctcacgaatcccgcctctctctctctctctctctct
cTCTCTCTCTCTCTCTCCATTTGAGCCGATCCCTCGAGAGGCAGCTCCGATGGCGCCCAAGGCAGAGAAGAAGCCGGCG
GAGAAGAAGCCCGCAGCCGGCGAGGAGAAGTCGGCGGAGAAGGCGCCGGCGGGGAAGaagAAGCCCAAGGCGGaGAAGCGGC
TGCCGGCGTCGAAGGCGTCGTCCAAGGAGGGCGGCGCCGGCGACAAGAAGGGGAGGAAGAAGGCGAAGAAGAGCGTCGA
GACCTACAAGATCTACATCTTCAAGgtgCTCAAGCAGGTCCACCCCGACATCGGCATCTCCTCCAAGGCCATGTCCATC
ATGAACTCCTTCATCAACGACATCTTCGAGAAGCTCGCGCAGGAGGccgccCgcctCGCCCgctACAACAAGAAGCCCA
CCATCACCtcCCgcgaGATCCAGACCTCCGTCCGCCTCGtcCTCCCCGGCGAGCTCGCCAAGCACGcCGTCt > SEQ ID NO:1477 114370 1109018_301543_1
gtgtcaTCTCTATTTTTCTGCATCCGACGGAATTGTCCTCGATTAGCTGTAGTAGCTATGGCGCCCAAAGCTCCCGCAG
CGGCTGAGCCCGAGAAGGCGGCCCCGTCGAAGGCCGAGAAGAAGCCCGCCGAGAAGAAGCCCAAGATCGAGAAGAAGCC
AAAGCCTGCAGGGAAGAAGCCCAAGGATTCCACCCCTAAAGACAAGGACCCGTCAAAGAAGAAGCATAAGAAGAAGAAG
AGCACTGAGACCTACAAGATCTACATCTTCAAGGTCCTGAAGCAGGTCCATCCTGACACTGGCATCTCCTCCAAGGCCA
TGGGCATCATGAACTCTTTCATCAATGACATCTTTGAGAAGATTGCGCAGGAGTCTGCGCGCCTTGCCCGTTACAACAA
GAAGCCTACAATTACATCCCGGGAAATTCAAACAGCAGTGAGGTTAATCCTGCCTGGAGAATtggccAAACATGCTGTC
TCTGAGGGCACCAAGGCtgtcACCAAATTCACTagtgcctagggTAccCCCtgccttcTgcttACATGCGAtg

FIG. 2 continued

> SEQ ID NO:1478 114380 209218_300813_1
ccTCCTCATCCCCCTCGCGATTACCTCTCCTCTCCTCCTCCCCCATTCATCGTCCCCCTCCGCCGCCGCCGCTGCAG
GCCCGCCGCTCCGCTGCTGGTCCTGCTGCTGCCATGATGGGGGCAAAGCTTTTGCTCTTACTGGTGGCCTCATCTCTAT
GTCTATCTGCTGCGATCGCTACGCAGCAAACCTGTCCGGCCGACCTCGATAGCAAGTGTGGTGATGCTGCTTCAGGGGA
TTGGGAAGGGGAGTTCTTCCCTGGCATCCCCAAGATCAAGTATGAGGGTCCAAGCAGCAAGAACCCGCTTGCTTACAAG
TGGTACAATGCTGAGGAAGTGATTCTTGGGAAGAAGATGAAGGATTGGATGCGGTTCAGCGTGGCCTTTTGGCATACGT
TCCGTGGTACTGGAGGAGATCCTTTTGGTGCCCCTACAAAGTCTTGGCCTTGGGAGGATGGCACAAATTCGTTGGACAT
GGCTAacagAAGAATGAGAGCTCACTTTGAGTTCATGGAGAAGCTTGGAGTTGACAgGTGGTGCTTCCATGACAGGGAT
ATTgcCCCTGATggcaaAACActcacggaaa > SEQ ID NO:1479 114380 268611_200121_1
aaacctttaccccatctctaaatctatatttgtttgacaaagatgatagaaaggaatcttggaaaatgtttgttgctcc
tTCTTTGtTTAAACGTTGTCTCAAATATAGTgGCTGCTGGGGCTCCACCAACTTGTCCTGCTGATATTGGTAGTGATTg
tgGAAGTGATTCAggtGAATGGGAAGGGGAGTTCTTCCCTGGAATTCCAAAAATTAAGTATGAGGGTCCATCTAGTAAG
AATCCACTTTCCTTCAAATGGTACAATGCTGAAGAGGAAATTCTTGGCAAAAAGATGAAGGATTGGATGCGATtTACCg
TTGCGTTCTGGCATACGTTCCGTGGCACAGGAGCTGATCCATTTGGTGCTCCTACAAAGTTGTGGccGTGGGAAGATGG
TACCAATTCCCTGGCTATGGCCAAGACAAGATTGAGAGCAAACTTTGAGTTCCTGGAGAAACTTGGAGTAGatAGATGG
TGTTTCCATGATCGGGACATtgCTcCGGAGgGCAAAACCCTTGAggAAACAAATGCaaACTTGGACgAAGTGGTGGCTC
TTGCCAAAGAGCTTCAGGGAAATAAAATTCATCTTTTGTGGGGTACCGCTCAGTTGTTCCTCCAACCTCGGTACATGCA
TGGTGCTGCCACTAGCCCTGAATTAGGTGTATATGCATATGCTGCCGCTCAGGTCAAGAAAGCTCTGGAGGTTACACAT
TATCTTGGGGGAGAAAATTATGTGTTTTGGGGTGGTCGAGAAGGTTACCAAAGCCTCCTAAACACAGATATGGAAAGAG
AGCTTGACCATATGGCAAGATTCATGGAAGTTGCTGTCGCTTACAAAAAGAAGATTGGCTTCAATGGAACATTACTTAT
TGAACCAAAGCCTCAGGAGCCAACAAAACACCAGTATGATTGGGATGCTGCAACATCTGCTAATTTCTTGCGCAAATAT
GGACTTATAGGAGAGTTCAAATTAAACATCGAGTGCAACCATGCTACTTTGGCTGgTCACAGCTGTCATCATGAGCTTG
AAACAGCAAGAATTAAtgGTttGCtTGGAAACATTGATGCAaATACTGGCGATccncaaGTCGGTTGgGACACaGATCa
gttttTGATGGATGTTGCTGAaGcaaCACTggTGATGC > SEQ ID NO:1480 114404 246565_301614_1
agtgttgttcttggAGAAGAATGGCCGCGGCGGCAGCAGCAGCAGCAGCGACGAGCTTCGTCCAGGCGCCATCCAG
CGCCAGGCAATGCGGCGGATCTCCAGCGACCTCCACCAGGCCGGCGTTCCAGAGCTTCGTCGGCATGAAATCCGGCGGA
GAGTGCCGCCAGGCCGCATTCTTCCGGGGCGATCTGACGCTGCGGGATGGCAAGCCCCTTGCTAGAGCTGCGAGGAACG
GCGATGTTCGTCCGCGGGCTGCGGCGAGCTACAAGGCGGCTATGCTTGGAGCTGCCGGGGGGATTGGGCAGCCGCTGTC
GCTGCTGCTCAAGATGTCGCCGCTGCTCTCGCACCTAAATCTCTACGATATTGCCAACGTCAAGGGTGTGGCTGCCGAT
CTGAGTCACTGTAACACCCCATCACTGGTGACACCTTATACCGGAGCTGAGGAGCTTGCCGAGTCACTTAAAGGCGTCG
ATCTTATTATCATTCCTGCTGGAGTTCCTCGGAAGCCAGGAATGACAAGGGATGATCTTTTCAACATCAATGCCGGTAT
CGTCAAGACACTTGTCGAGGCAGCAGCGGATTATGCACCAAAAGCATGGATTAACATCATCAGCaATCCCGTCAACTCC
ACCGTGCCAATtgcggccgagGTCCTCAAGAa > SEQ ID NO:1481 114404 265942_200082_1
TCCATTTCAATTCATTAACTATTCCGAATGACTTTATCCATGTTGAGATCTGTCGTCCGGAGGACCACAACTTCAGGCG
CGTCTCGCCTCACGCGCCGCCAATTCTCATCGAGGGCCGCACCGGAGAGGAAAGTCGCAATTTTGGGAGCAGCGGGAGG
AATCGGACAGCCTCTTTCACTTCTGATGAAGTTGAATCCTTTGGTATCAACGCTTTCACTCTACGATATTGCCGGCACT
CCTGGTGTTGCCG > SEQ ID NO:1482 114404 226626_301035_1
cactaacaaatcaaaatggttaAAGCTGTCGTTGCCGGAGCCGCTGGTGGTATTGGCCAGCCCCTTTCTCTTCTCCTCA
AACTCTCTCCTTACGTGACCGAGCTTGCTCTCTACGATGTCGTCAACTCCCCCGGTGTTGCCGCTGACCTCTCCCACAT
CTCCACCAAGGCTAAGGTCACTGGCTACCTTCCCAAGGATGACGGTCTCAAGAACGCTCTGACCGGCGCCAACATTGTC
GTTATCCCCGCCGGTATCCCCCGAAAGCCCGGTATGACCCGAGACGATCTGTTCAAGATCAACGCTGGTATCGTCCGAG
ATCTCGTCACCGGTGTCGCCCAGTACGCCCCTGATGCCTTTGTGCTCATCATCTCCAACCCCGTCAACTCTACCGTCCC
TATTGCTGCCGAGGTCCTCAAGAAGCACAACGTCTTCAACCCTAAGAAGCTCTTCGGTGTCACCACCCTTGACGTTGTC
CGAGCCCAGACCTTCACCGCCGCTGTTGTTGGCGAGTCTGACCCCACCAAGCTCAACATCCCCGTCGTTGGTGGCCACT
CCGGAGACACCATTGTCCCTCTCCTGTCTCTGACCAAGCCt > SEQ ID NO:1483 114417 137759_300686_1
TGATCCACCGTCACGTGCTCTTCCTGAAAATAATGAGCCTATATTGCCATTGCCGAAACAAACACCTCAAAAGTACAAT
GGAGCTGGTTCACACAGCAATCACCACTACAGGGGCCGTGGAAGAGGTAGAGGCAGCGCGTTTTCGCAGTCAGTAACAA
ATTTTACTGAAGAATTTGATTTCATGGCCATGAATGAGAAGTTTAACAAAGATGAAGTCTGGGGTCATCTTGGTAAGAA

FIG. 2 continued

ATCCCATTCAAGGGACAAAGATGGTGAGCTGGGCGATGATGTGTTTGATGAAGACCTGGAGGATGAGGAAACAGAAAAT
CCTGAGCTAGCTGCTAAGCCTGTTTATGTCAAGGATGACTTTTTTGATTCCCTCACTAGTGGAACATTTGGACGTGGAG
GGCAAAACGGGAGGTCAAGATTTTCCGAACAGCGCAAACTAGATACAGAGACTTTTGGTGATTTCCCAAGGCATCGCCA
GCCCTATCGTGGTGGGGGGCGTGGTTACCGTGGCGGCGGTCGCGCCCGTGGGTCATACTACGGTGGCAGAGGGTATGGA
AGCATGGGAGCAAGGGGTGGGCAGGGTAATTCTTACCCTCA

> SEQ ID NO:1484 114417 156528_301367_1
CCAATTGATGTTCCATCAACTCAATCTACACAGACAGCTCAAAAAGATGTTGAAGTGGTACAAGTATTGCCTGCACCAT
CTTCAGAAACTCCAGCTCCGGTTAAAACAGAAGCTCAGCCACCAATATTACCATTACCACCTCAGACACGTGTGCAGAA
GACAAATGGAGCTCCATATCAGGCACGTTACAACAACTACAGAGGGCGCGGTGGAAGAGGAATGGGGGTTTCAAGACCG
GTAACAAAATTCGAAGAGGATTTTGATTTTATGGCCATGAATGAGAAGTTCAAGAAAGACGAAGTGTGGGGTCATCTTG
GCAAAAGTAACAGAGAAGGAGATGGAAATGGCAGCGACGACGAAGATGTCTCTTTCAATGAATATGATGATGTTCTTCCTAA
GATTGATGTCAAGGTGGTTATTTAAATTCTCTTTGACCTCAATTCTTATGCATACCCTTGTCCACGTATCTTGGACCTA
GCTTTGTATTTATGTCAGTGTTGTCAAAAGCGCGCATAAAGCGCACTCAAGCCCCGATTCGAGGTCCAAAACATGTTGA
GCGCTTTGCTTCGCTTTGTGTGCGCTGTAGTGTCACATCAAAGCTCTAAAGCATACTTTTCCTCGTCAATGAGTGTAAT
CCTGAAAAGGCTACATTAAACAATTAATATTTCACTCTCGTAAATTTTT

> SEQ ID NO:1485 114926 168173_300553_1
GAATTCTCGAGTTTTTTTTCATTTCCATTGTGGAGATTTTCTTAGGGTTTTAGAAACAATCAAGATTATTGGAGAAAGA
TGCAGAGATTTGCAAGAAGTAGAGCCCCTAAACAAGCTATTAATTGGCTATGTTCATCACTCAACCAATCGAGATCTTT
CCAAACACCATCATTTGCTACCGTAGATGCTGAAGGGATCTCAGGCTCCCAACCTGCTGAAGTAAGCAATTTGGTCCAG
GGTAGCTGGACAAAGACATCTAATTGGAGTACAGTATTGGATCCGCTAAATGGAGAACCATTCATTAAAGTTTCAGATG
TAGATGAAACTGGGCTGCAGCCATTTGTGGAGAGCTTATCCAAGTGTGCGAAACATGGCCTTCACAATCCATTTAAATC
TCCAGAAAGATATCTTATGTTTGGAGACATATCAACAAAAGTGGCTCACATGCTTTCACAACCTGATGTTTCGAATTTC
TTCATAAGGTTGATACAACGGGTTTCTCCAAAGAGCTATCACCAAGCCCATGGCGGGGGTTTCGTAACCCAGAAATTCT
TTGAGAACTTTTGTG

> SEQ ID NO:1486 114926 228850_301037_1
gaagcttagggcgatcgatcaatcagcAATCGAGCATGGCAGGGAGAATGCGGCGGCTTCTTTCTCGCGAATTTGCAAT
CCATGCGAGAGCATTCTCTGCTCGATCGTCTGTGCCGGCTATGGATGCATCGTCTCCGGAGCTGGCGGCGCTTGCATTT
GCGACGGTCGACCCCGATGATCTCTCCAAGGCTCATCCTTATCAAGTCCAAAACCTTGTGCGTGGGAAATGGAGCAAGA
GCGTGAGATCCAGCATGTTGCCGGACCCTCTCAATGGGGGAGAATTTATCACAGTGCCAGAGACAACAGGAGACGAGTT
GCCGGACTATATCCAAAGCTTGCGGTCGTGTCCAAAGTCTGGGCTCCACAACCCTTTGAAGGATCCCGAGAGATATCTC
TTGTATGGCGATATATCAGCCAAGGCAGCGTCTATGTTGAGGCAGCGAGAGGTTGCACATTTCTTCACCAGGTTGATTC
ACAGAGTTTCTCCAAGAGCTACCAACAAGCTCAGACGGAAGTGACCGTGACACAAAAGTTTTCGAGAATTTCTCCAg
tgaccaggtccgCttttCTCGCGaagtcATTTGCt > SEQ ID NO:1487 115121 107884_300526_1
ccttctccctcttctctctgtcacgtgctcggtctcggtcctttgagcttctctctctgtctctctccgattctcgctc
cCTGCTCCGATGCCTCGACGACCTTTCCCTTTCCTTATCTCTATCTCTATCTCTCTCCTTATCCTTTTCGCCGTCGCCG
CGAGACCTTTTGCTGCTACGACGATCTCTATTGTCGTCCTCGGCGGCGTATTCCTCGCTCCCGTCTCTCTCCCTTCGGC
GATAGGCTTTCTCGCTCTTCTCCTTCTCGGCGCTGCTGTTGTTGTGTCTTTGCTCTTTGTAGAAGGACCACCGTTGGG
CTCTTCTACAGTCATTTCCAGATAATCGTACTCATCGAAGTCCATTTGAGgtgACTTTCTCTGCCGGACGGCCGAAGGT
TCGTTGTTCCGCCTGTGAAGAAGTGCTGGTTAGGTTTTGACAGAAACCTTAGATCAAAAAATCAgtgtaTTCCTCTCAG
AAAAAAACTaaGCAGCAAAAACATTTCAAGAAAATAGCCTAAGCCATGGCCAACATGATCATGGCTTCCTCCAAAGCCC
TAATCACTTCTTCCATTCCTTCATCACCAAGAACCAAACTTTCCCTGCCGCAAATCCCAATTCCAAAACTACCCATCCC
CAAATTACCCAAATCCCCACTAACCCTTTCCCTCCCATCAAATCTCAAGTCCATTTCAGTCATTCTTGCTAGCTCATTA
GCCTTTGCACCTCCTTCACTTGCTGAAGAAATTGAAAAAGCTTCACTCTTTGACTTCAATTTAACTCTCCCTATCATAA
TGGCTGAGTTCCTTTTCCTCATGTTTGCTTTAGACAAACTTTACTTTTCCCATTAGGGAAATTCATGGATGAAAGAGA
TTCTGCCATTAAAGAGAAATTAAACAGTGTGAAGGACACCTTCAGCTGAAGTGAAGCAATTGGAAGATCAAGCAGCAGCA
ATAATGAAAGCTGCAAGAGCTGAGGTATCCGCTGCATTGAACAAAATGAAGAAAGAGACTCAGTTGGAAGTGGAACAGA
AGATTGCTGAAGGAAGGAAGAAAGTTGAAGTTGAGTTGCAAGACGCTTTAGCTAGTTTGGACAAGCAAAAGGACGAGAC
TATTAAGTCTCTTGATTCTCAGATTGCTGCTCTTAGTGATGAAATTGTcAAGaaggttCttcctgttaGTaactaatgT
ATTTCTTGAAATtt > SEQ ID NO:1488 116435 129305_300405_1
CCCCCCGTTCACTTCAAGCTCTGCAAGAGGGACAACACTAAGCAGTTCCACAACTCGAATATCAAGTTCCCGCTCGTGT
ACCGCAAGGTCAGGCCGCCCACCAGGAAGCTGAAGACCACCTTCAAGGCATCTAGGCCGAACTTGTTCATGTGATCTAC
CAGTGTGTACCCATGTTCTGCAATTTAGCCCAAGGAATCAAAAGATTTTGTCTGTGGAAGTTTTGGTGCCCTGCTGGTTA

FIG. 2 continued

GGCATTTCCAGTTTCATATCCAAATGATGCTTAGGCATTTCCAGTTACCCTTCCAAATGATGCTTTGCAAACCCTTGAA
TTTCCTCGTATTAGTAATCAGCAGACTTCTTGTTACTTCAACCTGGCTCACTTGGAAGTGTTGATCCCTGATGTGCTAT
TATTTATCTCTGTAATTTGTGATGGC

> SEQ ID NO:1489 116461 108386_300381_1
agatccatacacaaataCTCGATAAAACTCTCCTTGTATCTGAATCTAATCAACTTCTCAGATCCAAACTCCGATCGGA
ACAATGTCCTCGACTTTCAGCGGCGATGAAACTGCTCCTTTCTTCGGCTTCCTCGGCGCCGCTGCGGCTCTCGTCTTCT
CCTGCATGGGAGCAGCGTACGGAACAGCAAAGAGCGGTGTAGGAGTGGCGTCTATGGGAGTGATGAGACCAGAGCTGGT
GATGAAATCCATTGTTCCGGTGGTTATGGCTGGTGTGTTGGGTATTTATGGTCTGATTATTGCTGTTATTATTAGTACT
GGTATTAATCCCAAAACAAAGTCGTATTACCTGTTTGATGGATATGCTCATCTCTCCTCTGGTCTCGCTTGTGGTCTTG
CTGGACTTTCTGCTGGAATGGCTATTGGTATTGTTGGTGATGCCGGTGTTAGGGCTAATGCTCAACAGCCAAAGCTTTT
TGTTGGGATGATCCTCATTCTCATTTTTGCTGAAGCTTTGGCTCTTTATGGGCTTATTGTTGGAATTATATTGTCTTCA
CGAGCTGGGCAGTCCAGAGCAGAGTGAAGTTGGCTTATTAATACTATTCTTACTATGATGTATGTGAGACTCAGTAAAC
CCTGGCAAAACTTGATCCTTGCTAAAGTCAAAAAGTTATCTATGTCTATGTTTgttATTCATGTTGGCACGGTtgcTAC
TGGTGCTGCTATGTGCTGTTTgtanaAAAATaggagTGagtAtTTATTTTAATAATAACTTAaGAaGttttcgtATtTg
acc > SEQ ID NO:1490 116461 201454_301226_1
agcaatccaatacattagagtgaagggatgaacataatatattgtaatgattttattttgctacaatgccgtgtttttt
aTTCACCACGAATGAGATTAAATCCGTTTGCTCAGGAGCAGCAAATCCAGCCTAACCCAAAAAACTTTGCATGAACCAC
CACAAAAGAAACAAAAAGGACTGGAAGTGCCACCTTCCTTAAGCTACAAATCGATCTTTTAATACATTAAACTAGAGCT
CCCAAGTAAGTTTCAGGTTTTCTCAAGAATATAGCCAGTGGAATAACAGCGGTATGGTACCGCAAAGTGCCTAATCTGC
ACGAGATTGGCCGGCACGGGATGAGAGGATGATGCCCACAATGAGACCATACAGGGCAAGCGCTTCTGCGAAAATGAGG
ATGAGGATCATGCCCACGAAAAGCTTTGGTTGCTGTGCATTTGCCCTGACACCAGCATCACCGACGATGCCGATGGCCA
TTCCGGCAGCGAGACCGGCGAGGCCACAGGCGAGCCCGGACGACAGATGCGCGTAGCCGTCAAAGAGGTAGTACGGCTT
AGCCTTGGGGTTGATCCCTGTACTGATGATGACGGCGATGAGGCCGTAGATACCGAGCACACCAGCCATGACCACG
GGCACGATGGACTTCATCACGAGCTCCGGGCGCATCACGCCCATGGACGCCACGCCGACGCCGCTCTTCGCCGTCCCGT
ACGCCGCACCCATGCATGAGAAGATGAGGGCGGAGGCGGCGCCGAGGAAGCCGAAGAAGGGCGCCGTCTCATCGCCGCT
GAACACCGACGACATCTTtgctcctcttccttctccggcgagatcggttgatcgatcgatcgatctctt > SEQ ID NO:1491 116461 174801_300527_1
CCCACGCGTCCGCCAAGGGCAAGCCCTACTTCCTCTTCGACGGTTACGCCCACCTCTCCTCCGGTCTCGCCTGCGGCCT
CGCCGGTCTCGCCGCCGGCATGGCCATCGGCATCGTCGGCGACGCCGGAGTCAGGGCCAATGCGCAGCAGCCAAAGTTG
TTCGTGGGCATGATCCTCATCCTTATCTTTGCAGAAGCTCTTGCTCTGTATGGCCTGATTGTTGGTATCATCCTCTCGT
CTCGTGCGGGCCAATCTCGAGCGGATTAGAGGGTTTTGGAAGAACAAGACACGGTTCACCATTGTATTCTATTCCAAGT
GTTAATTTCTTCTTATAGACTGCTTGGTCTTGTCTGTGTTTATACTCATTGTCTGTATTCAAGCTATTGTGGGTTGTTG
TATTTATTATTTGAATTTTTGAAGTAATAATCGGTACCAGGCCGTCCGAGATGTGATTAATAATGAATGAATAAATAAA
TAAGC > SEQ ID NO:1492 116461 144875_200137_1
agcgaaaggctaCAATAATCTCTCTCTCTCTTTCTCTCTCTCTAGAAGATTTTGAGAAGTATCTCAGATCCAAATCA
ATAACACACTTCTGAGATCCAATCAGAAACAATGTCTTCGACTTTCAGCGGCGATGAAACTGCTCCCTTCTTCGGCTTT
CTCGGCGCTGCTGCGGCCTTGGTCTTCTCCTGTATGGGAGCAGCTTATGGTACAGCAAAGAGTGGCGTAGGGGTGGCAT
CAATGGGTGTGATGAGGCCGGAGTTGGTGATGAAGTCAATTGTGCCGGTTGTTATGGCTGGTGTTTTGGGTATTTATGG
ATTGATTATAGCTGTGATTATTAGTACAGGGATTAACCCGAAAACCAAGTCTTACTATCTTTTTGATGGATATGCTCAC
CTTTCTTCTGGTCTTGCTTGTGGTCTTGCTGGCCTTTCTGCTGGTATGGCCATTGGAATCGTTGGTGACGCTGGTGTGA
GAGCCAATGCACAACAGCCAAAGCTTTTTGTCGGGATGATTTTGATTCTTATTTTTGCTGAAGCCCTGGCTTTGTATGG
CCTTATTGTTGGAATCATCCTCTCTTCTCGTGCTGGTCAGTCTAGGGCAGAGTAGAAGAAGAGAATGTTGTGCACCATT
ACTGTGAATTATCTTTGTGTTTTTCATGGGTGAGTCTGGCTGCTGAAttacatTTTCCTTTTTCTGTGGGCTCcaagat
tct > SEQ ID NO:1493 116461 14327_300244_1
CCCACGCGTCCGCAGATACAAAACTCCGACATGTCTACGTTCAGCGGCGATGAAACAGCTCCCTTCTTCGGCTTCCTCG
GCGCTGCAGCCGCACTCGTTTTCTCCTGTATGGGAGCTGCTTATGGAACCGCAAAGAGTGGTGTTGGTGTGGCTTCTAT
GGGAGTTATGAGACCTGAGTTGGTGATGAAATCTATTGTCCCTGTTGTTATGGCTGGAGTGTTGGGTATCTATGGATTG
ATCATTGCTGTTATCATCAGTACCGGGATTAACCCCAAGGCTAAGTCTTACTACCTCTTTGATGGATACGCACATCTCT
CGTCTG

FIG. 2 continued

> SEQ ID NO:1494 116461 1099603_301449_1
atTTGTGTGGATCGATCTGATCGAAGGACAACAATGGCCGACTCAGACTTCAATGGCGACACCACTGCCCCCTTCTTCG
GCTTCTTGGGAGCCGCCTTTGCCCTCATCTTCTCTTGTATGGGTGCGGCATATGGAACAGCAAAGAGTGGAGTTGGGGT
TGCTTCAATGGGTGTTATGAGGCCTGAGCTTGTGATGAAGTCCATAGTTCCAGTGGTTATGGCTGGTGTCTTGGGTATT
TATGGTTTGATCATAGCTGTCATTATCAGCACAGGAATCAACCCCAAAAGCAAGGCATATTACTTGTTTGATGGATACG
CCCATCTCTCGTCAGGCCTAGCTTGTGGCTTTCTGGTCTTTCAGCTGGAATGGCAATCGGGATTGTTGGTGATGCCGG
TGTCAGGGCAAATGCACAGCAGCCAAAGCTTTTTGTTGGCATGATTCTGATTCTTATTTTGCGGAGGCTCTTGCTTTG
TACGGCTTGATCGTCGGCATTATTCTCTCTTCTCGTGCAGGTCAATCAAGGGAATGATTCTTCCATGCCCTTTGATTCT
ACCCATTCCAACTATCCAAATTATATTGTCCTATGgt

> SEQ ID NO:1495 116461 259106_301666_1
TCGGCATAATCCGGAACATCATACGGATAAGCGGCCGCCCTTTTTTCTTTTTCTTTAGTGAACAAAACACTCTCATGCT
CCCATTGCATTACGAATCATTTGCTTATCCACCACCATCACATCACCTGTCTAGCCAGACCCACAAAAACCGTGCATAA
ATAATATTCAGACCGCCGCCAGCACCACCATAGCGAAAAAGAATGGCCCCACAAG

> SEQ ID NO:1496 116525 23922_300219_1
cccacgcgtccgatccatttactccacagagaaagattcagagaaaacagaagAAACTATGGCAACTCAAGCCGCCGGA
ATCTTCAGCCCCGCCATAACAACCACTACTTCCGCCGTCAAGAAACTCCACCTCTTCTCATCAAGCCACCGTCCCAAGT
CTCTCTCCTTCACCAAAACCGCCATCCGCGCCGAGAAAACAGAGTCCTCCTCTGCTGCCCCAGCCGTGAAAGAAGCTCC
AGTTGGATTCACTCCCCCGCAGCTAGACCCAAACACACCATCACCAATCTTCGCCGGAAGCACAGGAGGTCTCCTCCGT
AAAGCACAAGTAGAGGAATTTTACGTGATCACATGGAACTCACCGAAAGAACAAATCTTTGAGATGCCAACAGGAGGAG
CTgcgAtaatGAGagaaggaccgaatCTAttgaaaCtggcga > SEQ ID NO:1497 116525 245554_301569_1
GGACTTCGATTTTCAGTGGTTGTTTCTCAGGCCCAGCATTTGATACATCAAAGATGCAGGCCTTGGCAATGCAAGCGTC
TCCAATGAGCCTGCGCTCCACGAGCAGCGCCGGCAGCAGCACCAGCAGCTTCTTCCAAGGTCAGTCCAAGATCTCCATG
GCGGCGGCTCCTGCGCGAGTGAGCATGATGGCGACGGCAGATAAGGCAGATAAGGCAGATAAGGCAGCTAAGGCAGATA
AGGCAGATAAAGCAGCACCTGCACCCGCGGGATTTACCCCACCAGAGCTCAAGGCCGATACCCCGTCCCCAATCTTTGG
TGGCAGCACGGGCGGACTGCTGCGCAAGGCACAGATCGAGGAGTTCTACGTCATCACCTGGGAATCACCCAAGGAGCAG
ATATTTGAGATGCCAACCGGAGGTGCTGCAATCATGCGCTCCGGCCCGAACTTGCTCAAGCTGGCTCGTAAGGAGCAGT
GCATGGCGCTGGGCACGCAGCTGCGCTCCAAGCTCAAGATCAACTACCAGTTCTATAGGGTGTTCCCCAACGGTGAGGT
GCAATACTTGCATCCCAAGGACGGAGTCTACCCCGAGAAGGTTAACCCCGGGCGGAAGGGCGTGGGTGTCACTCTCAGG
TCCATTGgcAAGAATTGCAACCCCGTCGATCTCAAGTTCACAGGCAAGGCTGCATATGATGTGTAACGCTTTTgcgcct
ttGGtGA > SEQ ID NO:1498 116525 274201_200149_1
tcccacttttctaagccaataattcttCAATGGCCATGGCAACTCAAGCTTCTCTCTTCACTCCAGCTCTCTCTGCCCC
AAAATCCTCTTCCCCATGGAAACAATCCCTCGCTTCCTTCTCTCCTAAGCAACTCAAATCCACTGTTTCCACACACCGT
CCCATTAGGGCCATGGCCGAAGAGGCAGCCGCCGCCACAAAAGAAGCAGGAGGCTCCAGTGGGCTTCACCCCACCACAAT
TGGACCCAAACACACCTTCCCCAATCTTCGGCGGGAGCACCGGTGGGCTTCTCCGCAAGGCCCAAGTTGAGGAATTCTA
CGTAATCACTTGGGAATCACCTAAAGAACAGATCTTTGAGATGCCAACTGGTGGTGCGGCTATTATGAGGGAAGGTGCT
AATTTGCTGAAATTGGCGAGGAAAGAGCAgTGTTTGGCACTTGGTACTAGGCTGAGGTCAAAgTACAAGATTAACTaCA
GGTTTtAcAgGgtgtttccTAATGGTGAAGTTcaatACTTGCAtCCtaaggaTGGTgt > SEQ ID NO:1499 116525 50501_300167_1
ATAACAACCGCCGCAACCTCCGGCGTCAAGAAACTCCACTTTTTCTCAACAACCCACCGTCCCAAATCCCTCTCCTTCA
CCAAAACCGCAATCCGCGCCGAGAAAACAGATTCCTCCGCCGCCGCTGCTGCAGCCCCGCCACGAAAGAAGCTCCCGT
GGGATTCACGCCACCGCAGCTAGACCCAAACACACCGTCTCCGATCTTCGCTGGAAGCACCGGTGGTCTTCTACGTAAA
GCGCAAGTGGAAGAGTTCTACGTTATCACGTGGAACTCACCGAAAGAACAGATCTTTGAGATGCCGA > SEQ ID NO:1500 116525 255851_301645_1
gctCTCAGAGCAGTGTGCTCGCGTGTGCCCACCACGAGCCTGTAGCGATTCCCTCAGCAGCAGCAGCGATGGCCATGTC
TGCGCACGCCTCCCAGGCGGCAGTCATTGCAGCAACCGCCAAAGCAGTGCCATCAGCATCAGCTTACCCCGCCTCTACT
GCCACGGTATCCCTTCGCCAATCCTCGATGCGCGGCATGAAGCTTGTTACCCCTTCTCTCTTGTCGTTGTCTTCTTCCT
CTCCTCGCATCCTCGCATGGCAGCAGCTGATGCTCCTGCTGCGCCAGCAGAGGAGGCACCTGCTGGGTTCACCCCCCCGA
GCTCAAAGCCGACACCCCATCCCCCATCTTCGGCGGTAGCACTGGGGGCCTCCTCCGCAAGGCGCAGGTGGAGGAGTTC
TACGTCATCACCTGGGAATCCCCAAAGGAGCAGATCTTCGAGATGCCCACGGGGGCGCTGCCATCATGCGGCAGGGCC

FIG. 2 continued

```
CGAACCTCCTGAAGCTGGCTCGCAAGGAGCAGTGTCTCGCACTGGGATCCAGGCTGCGGTCCAAGTTCAAGATCCAGTA
TCAGTTCTACCGTGTGTTCCCGAATGGGGAGGTTCAATACCTGCACCCAAAGGATGGCGTGTACCCGGAGAAGGTGAAT
GCTGGCAGGAAGGGCGTCGGGGTGAACTTACGGTCGATCGGCAAGAACAAGAATCCGGTGGAGGTCAAGTTCACTGGGA
ATTCTGCCTTCAATCTCTGag
```

> SEQ ID NO:1501  116525  226822_301005_1
```
ACTCGAATCGAATCCACCACACGGTACCCTCCTCTCTCCTCCTCCGACCACCATGGCCATGGCCACgcaAGCCTCCGCC
GCCAAGTGCCACCTCCTCGCCGCGGCGGCGACGGAGGAGAAGAAGCCAGCCCCCGCGGGGTTCGTGCCGCCGCAGCTGG
ACCCCAACACGCCGTCCCCGATCTTCGGCGGGAGCACGGGGGGACTCCTCCGGAAGGCGCAGGTGGAGGAGTTCTACGT
CATCACATGGACGTCGCCCAAGGAGCAGGTGTTCGAGATGCCCACGGGCGGCGCCGCCATCATGCGCGAGGGCCCCAAC
CTGCTGAAGCTGGCCAGGAAGGAGCAGTGCCTGGCCCTGGGCACCAGGCTCCGCTCCAAGTACAAGATCAACTACCAGT
TCTACCGCGTCTTCCCCAATGGCGAGGTGCAGTACCTCCACCCCAAGGACGGCGTCTACCCGGAGAAGGTCAACGCCGG
CAGGCAGGGCGTCGGccAGAACTTCCGCAGCATCGGCAAGAACGTCAGCCCCATCGAGGTCAAGTTCACCGGcaAGAAC
GTCTTCGACATCTAgacTTCTTCTTCTTCTTCTTCTCTCATAATCGACCTATTAATTACTTGTGTTTTgGGTGGAT
GgACAtGTaATTTTAaTCATCTGTCAggctgCtctccaA
```

> SEQ ID NO:1502  116525  1100211_301458_1
```
acCctagttcgaggtctCTCAGAGCAGTGTGCTCGCGTGTGCCCACCACGAGCCTGTAGCGATTCCCTCAGCAGCAGCA
GCGATGGCCATGTCTGCGCACGCCTCCCAGGCGGCAGTCATTGCAGCAACCGCCAAAGCAGTGCCATCAGCATCAGCTT
ACCCCGCCTCTACTGCCACGGTATCCCTTCGCCAATCCTCGATGCGCGGCATGAAGCTTGTTACCCCTTCTCTCTTGTC
GTTGTCTTCTTCCTCTCCTCGCATCCGCATGGCAGCAGCTGATGCTCCTGCTGCGCCAGCAGGAGGCACCTGCTGGG
TTCACCCCCCCGAGCTCAAAGCCGACACCCCATCCCCCATCTTCGGCGGTAGCACTGGGGGCCTCCTCCGCAAGGCGC
AGGTGGAGGAGTTCTACGTCATCACCTGGGAATCCCCAAAGGAGCAGATCTTCGAGATGCCCACGGGGGGCGCTGCCAT
CATGCGGCAGGGCCCGAACCTCCTGAAGCTGGCTCGCAAGGAGCAGTGTCTCGCACTGGGATCCAGGCTGCGGTCCAAG
TTCAAGATCCAGTATCAGTTCTACCgTGTGTtCCCGAATGGGGAGGTTCAataCctGCacCCAAAGgaTGGCGTGTACC
CGGAgaagGTGAATGCTGGcaggaaggGCGTcggggtgaACTtacggtcGATCggcaagaaCaagaatccggT
```

> SEQ ID NO:1503  116525  1119024_301893_1
```
AACTATTATTACTACTACTCTTCATCTCTACTGATTGATAGAGGAACCTCAGCTATGGCCATCCAGGCATCCTCCCAGT
CAGTCATGGCAAGAGCAGTAGCCCCGTCCATGGCCTCCACCCTCCCCCTCTCGCCCCCTCTGTGCGCTTGTCGGCGTG
GAGTAGCTCCGCCGTCCATGGCATCCAGCTCCGCCTCCCCCGCCCTGCTTGCCGTGTCCGCATGGCTTCTGAAATCCCT
GCCCCGGCACCCAAAGAAGAGGAGAAAGATGAGGCGCCCAAAGGTTTCACCCCGCCTACTCTCAACCCGGAGACGCCCT
CGCCAATCTTCGGGGGTAGCACAGGTGGCCTCCTCCGTAAGGCCCAAGTCGAGGAATTCTACGTGATCACGTGGGAGTC
CCCGAAAGAGCAGATATTTGAGATGCCCACCGGCGGCGCCGCCATCATGAGGGAGGGACCTAACCTCCTCAAGCTCGCG
CGCAAGGAGCAATGCCTTGCACTTGGCTCCCGCCTCCGATCCAAGTTCAAAATCACCTACCAATTCTACCGCGTCTTCC
CGAATGGGGAAGTGC
```

> SEQ ID NO:1504  116525  16253_300230_1
```
CCCACGCGTCCGATCCATTTACTCCACAGAGAAAGATTCAGAGAAAACAGAAGAAACTATGGCAACTCAAGCCGCCGGA
ATCTTCAGCCCCGCCATAACAACCACTACTTCCGCCGTCAAGAAACTCCACCTCTTCTCATCAAGCCACCGTCCCAAGT
CTCTCTCCTTCACCAAAACCGCCATCCGCGCCGAGAAAACAGAGTCCTCCTCTGCTGCCCCAGCCGTGAAAGAAGCTCC
AGTTGGATTCACTCCCCCGCAGCTAGACCCAAACACACCATCACCAATCTTCGCCGGAAGCACAGGAGGTCTCCTCCGT
AAAGCACAAGTAGAGGAATTTTACGTGATCACATGGAACTCACCGAAAGAACAAATCTTTGAGATgccaaCAggAggAG
ctgcgATAATGAGAGaAggaccgaATCTA
```

> SEQ ID NO:1505  116525  18813_300241_1
```
GGTATCAACGCAGAGTGCCATTACGGCCGGGTAAAGCGCAAGTGGAAGAGTTCTACGTTATCACGTGGAACTCACCGA
AAGAACAGATCTTTGAGATGCCGACAGGAGGAGCAGCGATCATGAGAGAAGGTCCGAATCTTCTGAAGCTAGCGAGGAA
AGAGCAGTGTTTAGCTTTGGGGACAAGGCTTAGATCCAAGTACAAGATCACTTACCAGTTTTACAGAGTGTTTCCTAAC
GGTGAGGTTCAATATCTTCATCCTAAAGATGGTGTTTATCCAGAGAAGGCGAATCCAGGAAGAGAAGGTGTTGGTCTCA
ACATGAGATCTATTGGGAAAAATGTTAGTCCCATTGAAGTTAAGTTTACTGGCAAACAAAGTTATGATTTGTAAGATCT
GTAAACTAAAAAAACCAAAAACTATGTGCATGTGGTGATGATTATGACTATGTTTCATGTTAATTTTTAATGGATTTTG
T
```

> SEQ ID NO:1506  116525  126718_300466_1
```
ATTCTGCACAAATACATCTCCATTTCCTCCACTTTTGTAAGCCAATAATTCTACAATGGCCATGGCAACTCAAGCTTCT
CTCTTCACTCCAGCTCTCTCTGCCTCAAAATCTTCAGCCCCATGGAAACAATCCCTTGCTTCCTTCTCTCCTAAGCAAC
TCAAATCCACTGCTTCCACTCCCCGTCCCATTAGAGCCATGGCCGAAGAAGCCGCCGCCGCCGCCACAACAAAAGCAGA
GGCTCCAGTGGGCTTTACCCCACCACAATTGGACCCAAACACACCTTCCCCAATCTTCGGTGGCAGCACCGGCGGGCTT
```

FIG. 2 continued

CTCCGCAAGGCCCAAGTTGAGGAGTTTTACGTAATTACTTGGGAATCACCTAAAGAACAGATCTTTGAGATGCCAACTG
GTGGTGCAGCTATTATGAGGGAAGGTGCTAATTTGCTGAAATTGGCGAGGAAAGAGCAGTGTTTAGCACTTGGTACTAG
GCTTAGGTCAAAGTACAAGATTAACTACAGGTTTTACAGGGTGTTTCCTAATGGTGAGGTTCAATACCTGCACCCTAAG
GATGGTGTGTACCCAGAAAAGGTGAACGCTGGCCGTGAAGGAGTTGGACAGAACTTCAGATCCATTGGTAGGAACAAGA
GCCCAATTGAGGTCAAGTTCACTGGCAAACAAGTGTATGATTTGTAAGCTCATTATGTTGTGCCTTTTTATGTAATGAT
TTTGTGATTATTCAGGCCATCGTTTCATGTAATTTTATTTGCCACTACAAAATACAGCACGGGATTCTATC

> SEQ ID NO:1507 116525 191511_300702_1
CCCCCCGATCTCTCTCCTCCACACCACACCACTCGAATCGAATCCACCACACGGTACCCTCCTCTCTCCTCCTCCGACC
ACCATGGCCATGGCCACGCAAGCCTCCGCCGCCAAGTGCCACCTCCTCGCCGCCTGGGCACCGGCGAAGCCGCGCTCAT
CCACCCTCTCCATGCCCACCTCGAGGGCACCCACCTCCCTCAGAGCGGCGGCGGAGGATCAGCCCGCCGCGGCGGCGAC
GGAGGAGAAGAAGCCAGCCCCCGCGGGGTTCGTGCCGCCGCAGCTGGACCCCAACACGCCGTCCCCGATCTTCGGCGGG
AGCACGGGGGGACTCCTCCGGAAGGCGCAGGTGGAGGAGTTCTACGTCATCACATGGACGTCGCCCAAGGAGCAGGTGT
TCGAGATGCCCACGGGCGGCGCCGCCATCATGCGCGAGGGCCCCAACCTGCTGAAGCTGGCCAGGAAGGAGCAGTGCCT
GGCCCTGGGCACCAGGCTCCGCTCCAAGTACAAGATCAACTACCAGTTCTACCGCGTCTTCCCCAATGGCGAGGTGCAG
TACCTCCACCCCAAGGACGGCGTCTACCCGGAGAAGGTCAACGCCGGCAGGCAGGGCGTCGGCCAGAACTTCCGCAGCA
TCGGCAAGAACGTCAGCCCCATCGAGGTCAAGTTCACCGGCAAGAACGTCTTCGACATCTAGACTTCTTCTTCTTCTTC
TTCTTCTCTCATAATCGACCTATTAATTACTTGTGTTTTGGGTGGATGGACATGTAATTTTAATCATCTGTCAGGCTGC
TCTTCAGTTATTGATGATGGTGTAATCGATCGATGGTGGGATATAATCTCTTCTTATAATATTGTAGTATATGTTTGGt
gaaTTTTGATGCgtgttC > SEQ ID NO:1508 116525 142417_300435_1
TGGAGGATCAGCCCGCCGCGGGGGCGACGGAGGAAAAAAACCCACCCCCCGCGGGGTTCGTGCCGCCGCAATTGGACCC
CAACACGCCGTCCCCGATTTTTGGTGGAAGCACGGGGGGACTTTTCCGGAAGGCGCAGGTGGAGGAGTTTT > SEQ ID NO:1509 116525 129891_300482_1
ttttttttttttgggggggaaattatacagtaatccacatgtttaatggtacctttggaacaggaaaatacaaattaagtt
cAAACAATAATTTCATTACATAACCACACAACCTACTGCAGcTcGAGGAAATCAACTACCCCTTGAATATTCCATGGCT
ATGGCAACTCAAGCAGCTCTTTTTACCCCAACTCTTTCCACCTCAAAATCAAGCAATTTAGCATGGAAACAATCCTCAA
CTGTGTCATTCGCCAGCCCTAAACCATTCAACTTTGCTGCACCACAACGTTCCATTAAGGCCTCAGCTGCTGAAGGAAA
GACAGAAGCTCCAGCGAAAGAAGCCCCAGCAGGTTTCACCCCACCAGAATTGGACCCAAACACACCATCTCCAATATTC
GGAGGTAGTACTGGTGGATTGTTGCGTAAAGCTCAAGTAGAGGAGTTTTACGTGATCACTTGGGATTCTCCTAAAGAAC
AAGTATTTGAAATGCCAACTGGAGGTGCagctATCATGagaCAAGGACCTAACTTGCTTAAGTTGGCAaggaaagaACA
GTgttTagctCTTGGAACCagaTTgaggTCCAAGtAcAagaTcaAGtaccaGTTTTACAGggTtTtcccAAATGgTgaa
gtTCAATATCTTCATCCTAA > SEQ ID NO:1510 116525 116523_300078_1
cgGAATCGAATCCACCACACGGTACCCTCCTCTCTCCTCCTCCGACCACCATGGCCATGGCCACGCAAGCCTCCGCCGC
CAAGTGCCACCTCCTCGCCGCCTGGGCACCGGCGAAGCCGCGCTCATCCACCCTCTCCATGCCCACCTCGAGGGCACCC
ACCTCCCTCAGAGCGGCGGCGGAGGATCAGCCCGCCGCGGCGGCGACGGAGGAGAAGAAGCCAGCCCCCGCGGGGTTCG
TGCCGCCGCAGCTGGACCCCAACACGCCGTCCCCGATCTTCGGCGGGAGCACGGGGGGACTCCTCCGGAAGGCGCAGGT
GGAGGAGTTCTACGTCATCACATGGACGTCGCCCAAGGAGCAGGTGTTCGAGATGCCCACGGGCGGCGCCGCCATCATG
CGCGAGGGCCCCAACCTGCTGAAGCTGGCCAGGAAGGAGCAGTGCCTGGCCCTGGGCACCAGGCTCCGCTCCAAGTACA
AGATCAACTACCAGTTCTACCGCGTCTTCCCCAATGGCGAGGTGCAGTACCTCCACCCCAAGGACGGCGTCTACCCGGA
GAAGGTCAACGCCGGCAGGCAGGGCGTCGGCCAGAACTTCCGCAGCATCGGCAAGAACGTCAGCCCCATCGAGGTCAAG
TTCACCGGCAAGAACGTCTTCGACATCTAGACTTCTTCTTCTTCTTCTCTCATAATCGacctattaattaCttgtg
ttTTGGGTggatggaCATGTaattTTAaTCATcT > SEQ ID NO:1511 116686 286351_200108_1
AAATTTTGCTCTCGAGCTTTTACATTTCCACATCTAAAAATGGCTGCAAATGGCATCAATTCCTTCTTCCGCGTCAAAA
AGCTCTCAGATAATGCTGTTTTGCCCTCCAGAGGCTCCTCTCTTTCTGCTGGCTATGATCTGTCCAGTGCAACGAAGAC
TAAAGTGCCTGCTAGGGGAAAGGCTTTAGTGCCCACAGATCTTAGTATTGCCGTTCCTGAAGGAACCTATGCCCGTATA
GCTCCAAGATCAGGATTGACATGGAAGCATTCAATAGATGTTGGGGCAGGTGTGATTGATGCAGACTATAGGGGTCCAG
TTGGGGTTATTCTTTTCAACCATTCTGATGTTGATTTTGAAGTGAAAATTGGTGACAGAATAGCTCAATTGATCATAGA
GAAAATCATAGTGCCGGATGTCGAGGAGGTTGATGATCTGGACTCGACAGTTAGGGGCTCTGGAGGCTTTGGATCAACA
GGAGTTTGAAATCTATGGCTTGAATTAGAACTTTGATGCGTAAATTTTTGTTGCTTAGTACGTTTAGTCATGATAATT
TGGTCACGTTTTTAGAGATTGGAACATTTTGGAAACTGCAAGATGAAGTAAGTTTTTATGCTTCGGCAATGTTGAGCAC
TGTGTTTTTAT

FIG. 2 continued

> SEQ ID NO:1512 116692 171871_300624_1
CCCACGGCGGCGACGCGGCGGCGGCCGACGATGACGGGAGCAACGACGCCGAGGCCGCGTCGTGGCTCCTCCCCGAGCC
CGACCACGGGCAGAAAGATGGCGCCGTCGGTGCAACCGACGAGCTCTACGCCGACTCCGACCCTTACCTCGACCTCGAC
TTCGCGCGCTCCATGGACGACATCAAGGCCATCGGCGTCCAGAACGGTCCGCCCGAGCTCGACATCACCGGCGGCAAGC
TCTTCTACTCCGACCACTCCATGAACCACAGCGTATCATCCTCGGAGGCGGCGGTGGTGCCGGACGCGGCGGCGGGCGG
CGGCGCTCCGATGCCGGTGGTGAGCAGGGGCGGGAGCGGGAGGCGCGGCTGATGCGGTACAGGGAGAAGCGCAAGAGT
CGGCGGTTCGAGAAGACCATCCGGTACGCGTCCCGCAAGGCGTACGCGGAGAC

> SEQ ID NO:1513 116692 186907_300672_1
CGACTTCACGAGGCCGAAGCCTCAACCCTACATGCCGTACACGGCGACTCCTCCTCCGAGCCACAGCGTAGTAAGCGCG
CAGATGTCGTCGTCGGTGGTCGACGTGGGCGTGGTGCCGGAGCGGGCGGCGGCGATGGGGGAAGGGAGGGAGGCGACGC
TGATGAGGTACAGGGAGAAGCGGAAGAACCGGCGGTTCTAGAAGACGATCCGGTACGCGTCGCGCAAGGCCTACGCCGA
GACGCGCCCCGGATCAAGGGCCGCTTCTCCAAGCGCGCCGACCACGACGCCGACGACTCCGACGCCGACGCCGACGAC
CCCGGCGGCGTCCCATCCTCCTACATGCTCGACTTCGGCTACGGGGTCGTCCCGTCCTTCTGATCGCCGCCC

> SEQ ID NO:1514 118051 233148_301087_1
ATCAGTGCCCCAGCCGCCCCAGTGGTTTGTCCGCGATTCAAGCTTCCATCGATCGATCGAGAGATGTCTGATGACGAGA
GCAAGGAGGAGAAAGAGCTGGATTTGTCGTCGCCTGATGTGGTGACCAAGTATAAGCTCGCCGCGGAGATTGCCAACAA
GGCTTTGCAAGCTGTGGTGACTGAGTGTAAGTCGGGAGCTAAAGTTGCGGACCTTTGCTCCATAGGTGACACATACATC
AAGACCCACACCGCGAACGTCTACAAGAATGCCAAGAAGAAGATCGACAAAGGAGTGGCATTTCCGACATGCGTCTCCG
TAAACAACACTGTGTGCCATTTCTCGCCGCTGAATGGAGACAAGACGGCTCTCGTTGACGGGGACATCGTAAAGATCGA
TCTCGGCTGTCATATCGACGGCTTTgCggcCGTAGTCGCTCACACACACGTCCTTCAGACGGGTCCGGTGACTGgAAGA
GCAGCGGACGTCCTggCAGCTGCaAACAcCgCAGCAGAAGTTgcgCTCAGGCTCGTGAGACcAGGAAAGAAGAGCAG > SEQ ID NO:1515 118051 240248_301312_1
atccATCAGTGCCCCAGCCGCCCCAGTGGTttgtcCGCGATTCAAGCTTCCATCGATCGATCGAGAGATGTCTGATGAC
GAGAGCAAGGAGGAGAAAGAGCTGGATTTGTCGTCGCCTGATGTGGTGACCAAGTATAAGCTCGCCGCGGAGATTGCCA
ACAAGGCTTTGCAAGCTGTGGTGACTGAGTGTAAGTCGGGAGCTAAAGTTGCGGACCTTTGCTCCATAGGTGACACATA
CATCAAGACCCACACCGCGAACGTCTACAAGAATGCCAAGAAGAAGATCGACAAAGGCGTGGCATTTCCGACATGCGTC
TCCGTAAACAACACTGTGTGCCATTTCTCGCCGCTGACTGGAgaACAAGACGGCTCTCGtTGACGGGGACATCGTAAAGA
TTCGtTTGGCAGCGATCTCGGCTGTCATATCGACGGCTTTGCGGCCGTAGTCGCTCACACACACGTCCTTCAGACGGGT
CCGGTAACTGGAAGAGCAGCAGACGTCCTGGCAGCTGCAAACACCGCAGCAGAAGTTGCGCTCAGGCTCGTGAGACCAG
GAAAGAAGAGCAGGGATGTTTCCGAAGCGATCCAAAAGGTTGCTGCGGCTTACGACTgcaagatcgccgAaggcgtttt
gagccACCagatgaaGCAATTcgt > SEQ ID NO:1516 119262 243449_301339_1
ttcagCATGCGAGTCAAGTTGGCACTCACACTCAAAGGCATCGAGCATGAAGATCTTCCACAGGATCTCAGCAACAAGA
GCAAGCTGCTGCTCGACTCCAATCCCATCCACAAGAAGATCCCGGTCCTCATCCACAAGGGGAGGCCACTGCTCGAGTC
AGTCATCATTGTCCAGTACATTGACGAGGTATGGCCCGGAAAGTCCCCGCTGCTGCCTCAGGATCCATTCCTTCGTGCC
GAGCACCGCTTCTGGGCCGACTTCATCGACAAGAAGATCGGCGACTGCTTGATCCGCTTCCTGAAAACTGAGGATAATG
CCgacATCAACGAAgaATTCGTCGAGaatcggaTGCATCTCGAGGGGCCgctAgAGAAGCTCGGACGCGAGGAGGGGCc
gTTCTTCGGCGGCgagAGCATGTCGTTCCTggacGTGATTCTTGCCCCTTTCATCGTCTGGATTcctGCcgttggcaat
gtcctGGGCCTCaagacgccacatGAGAAATGCTCGCATCTAcgcaagTGgtttgctgccatCTCTGAGCATCCCGacg
CTAa > SEQ ID NO:1517 119262 44079_300028_1
GCCATTACGGCCGGGGAAAACATAGCACATATACTACGGTAGTATTATCTTGCAATTGTGTATAACAATCCTTAATTGT
TCATCTATAATGGCGATGAAGGGTCCTTCTGGATACCTATGTAACCATGATTGGGATGATAGTTAGGTGAGCCTTGGCT
GAGACTGGCATACAGTATGAATACAAGGAGCAGGATTTGCTGAACAAAACCCCTCTTCTCCTACAAATGAACCCAATTC
ACATGAAAATCCCAGTCTTGATTCACAATGGAAAACCAATATGTGAATCTCTCATTATTGTTCATTACATAAATGAAGT
TTGGAAGGACAACTCCCCTTTGATGCCTTCTGATCCTTATGAGAGAGCTCATGCTAGGGTCTGGGCTGATTATGTTGAT
AAAAAGATTTATGATACTGGAAGGATAATGTGGACATCAAAAAAGGAGGATCAAGAAGCAGCCAATAAGGAATTCATAG
AATGCTTGAAGTTATTGGAAGAGGAGTTAGGAGACAAGCCATACTTTGGAGGGGAAAGTTTTGGGTTTGAGGATATGGC
CCTTATTCCTTACTATACATG > SEQ ID NO:1518 119262 39233_300206_1
CCCACGCGTCCGGGGAAAGCCAAACCGGTATATTTTCTTTAAACAGGATATATAGATGAACCAAGAAGAGCACGTAAAG
CTTCTGGGCTTATGGGGAAGTCCTTTTAGCAAAAGAGTAGAGATGGTCCTAAAACTTAAGGGCATACCTTATGAGTACA

FIG. 2 continued

TTGAAGAAGATGTTTATGGAAACAGGAGCCCTATGCTTCTCAAGTACAACCCTATACACAAGAAGGTCCCTGTCCTCAT
CCACAATGGTAGATCGATAGCCGAATCATTGGTGATTGTCGAATACATCGAAGATACGTGGAAGACAACTCACACGATC

> SEQ ID NO:1519  119262 243587_301340_1
atggcggatcaggtgactctcctctcgctgcCCGCGAGCCCGTTCGCAATGAGCGTTAAGATGGCGCTGATTGAGAAGG
GTGTCGACTTCAAGACGGTGGAGGAGAACTACAGGGCAAACGGCAAGAGCGAGATGCTGCTCAAGGTGAATCCCGTGAC
TAAACAGGTGCCTGTTCTGCTCCACGGTGACAAACCCGTCTACGAGTCGCTCGTCATTCTCGAGTACATTGAGGACATT
TGGAAGGGTCAGGGCACTCGGCTCCTGCCCGAGGATGGATACCAGCGGTCGCTTGCTCGGTTCTGGGCCAACTTTGGCA
ACACCAAGTTTTGGGAGACTGGACTGCTGATAATGAAGAGGATCGGAGAGGGGCAGATGAAAGCTAGAGATGACGTCGT
CGAGATGATCCATCTGATGGAACAGGAGTGGAGCAAACCTGAGTATGGAAAGCCGTTCCTGTTTGGTGACAAGCTCAGC
CTGGCTGACTTGGTTTTGGCTCCTATTGCGTCGTGGAAGCTGACATTCGAGACCCTGGGGAAGTTCAAGTTTCCGGACG
CTCAGACATGTCCACGGATGCCCAGTGGCTGGATGCAATTGAGAATCACCCCACGGTGAAGTCGGCCATCCTGGCACC
GGATATGAATCTGGATAATGCCAATTTCTACCAGGACTTcataaaaCgcagCA > SEQ ID NO:1520  119262 280782_200068_1
GGTGATTCTGTTGGATTTCTGGCCTAGTATGTTTGGGATGAGGCTGAGGATTGCATTAGCTGAAAAGGAGATAAAGTAT
GAGTACAAAGAAGAGGACTTGAGGAACAAAAGCCCTTTGCTTTTACAAATGAATCCTATCCACAAGAAAATCCCATTTT
TGATTCACAATGGAAAACCCATTTGTGAGTCTATTATTGCAGTTGAGTACATTGAAGAAGTTTGGAAAGACAAAGCCCC
TAATTTGCTTCCTTCTGATCCTTATGACAGAGCTCAAGCTAGGTTCTGGGCTGACTACATTGACAAGAAGTTGTATGAT
GTTGGGAGGAAGTTATGGGCAACAAAAGGAGAAGAGCAGGAGGCAGCTAAGAAAGATTTCATAGAATGCCTCAAGGTGC
TGGAGGGAGCATTAGGAGACAAGCCTTACTTTGGAGGGGAAAGTTTTGGGTTTGTGGATATTGCTCTGATTGGATACTA
CAGCTGGTTTTATGCCTATGAGACTTTTGGCAACTTCAGCACAGAGGCCGAGTGCCCAAAGTTTGTGGCTTGGGCCAAA
AGGTGCATGCAGAGGGAGAGTGTTGCTAAGTCTTTACCTGACCAATCTAAAGTCCTTGAGTTTGTAAAAGTTCTTAGGC
AGAAGTTTGGACTTGAGTAAACATATGCATATTTGGTTATGCACCATAATGTA > SEQ ID NO:1521  119262 252913_301610_1
AGAGAGAGAGAGTGTGGTGGAAGCAGCAGCTGAGACTGAAAGAGAGTGAGTGGTGGTAGCAGCAGTTAAGAGAGAGAGA
GAGAGAGTAGTAGTAGTAGTAGGCAAGGAAGAAGGTATGGCAACTGTGACTGAAAGTGAAAGTGAGGTGAAGGTGCTGT
CCACATGGGCTAGCATGTTCGGCATGCGCGTGCTCATCGCCCTCAACGAGAAGGGCGTCCCTTATGAGCTCACCCAGGA
GGACCTTCGCAACAAGGGCCAGCTCTTGCTTCAGTCCAATCCCATCCACAAGAAGGTACCCGTCCTCCTCCACCATGGG
AAACCCATCTGTGAATCCAACATCATTGTCCAATACATCGACGAAACGTGGGCTTCCCCTCCCTTCTTTCAACCCCCTA
CCCCTTATAACCGTGCCATGCACCTCTTCTGGGCTGACTTCGTCGATAAAAAGTTTTATGCAGAGACGGGCTCGAAGGT
TCTAAGAAGCATGCCTGGGAAGACCGCGACAAAGCAGTGGAGGAGTTTCAGAACAGCTACAAAATGATGGAAAAGGCA
TTGGGGGATATGGCATGTGGGAAGCCTTTCTTTGGTGGAGACTCCATTGGCTTTCTTGACATTGCCTTTGCTCCTTTCG
TTTGTTGGTTCAAGGCTTTTGAGACA > SEQ ID NO:1522  119262 1097143_301437_1
gAGGACACGCCAAGCATGGAGGAGGGACAACAGAGGGCGGGgtgAAGTGAAGGTGTTGGGGAATTGGGCCAGCATGTTT
TCTATGCGAGTCTGCATTGCTCTCGATGAGAAGGCCGTCCCATACGAAGCCACAAACGAGGACCTACGAAACAAGGGCC
AGCTCTTGCTACAATCCAACCCTGTCCACAAGAGTGTCCCCGTCCTCCTTCACAAtGgCAACCCCATCTGTGAGTCTTC
CATCATCGTCGAATACATCGATCAGACATGGCCTTCCCCTCCCCTTTTCAACCCCGCCACCCCTTACAACCGAGCCATG
CATCGCTTCTGGGTTGATTTCATTGACAAAAAGTTTAGTGAAGCGGGTGCAAGGATTTTTAGAAGTCCACCAGGAGAAG
TTCAAGATGGTGGATCAAAGGACTTGGTTGAGAGTTACAAGACGCTAGAGAAGGCATTGAAGGAGATGGCTTGTGGGAA
GCCTTTCTTTGGTGGAGAATCCATTGGGTTTGTGGATGTTGCCTTAGCTCCATTTATATCTTGGTTCAAGACATATGAG
ACACTGGGAAAATTCAAGTTACCAGggaAGAAGAATGCCCTTTGTTAAGTGCATGGGTGAAGAAAGTGTCCGAAGTGC
CTAGTGTGAAAAaAACCTTGCCAGACCCCGACAAGGTCcttgacTTTGTCTAtggcCTCAGAAgcatactTCTTCagta
gTGAATGc > SEQ ID NO:1523  119262 1098364_301484_1
gagagagagatagagagagagagagagcgagagtggtggtagcaGCAGCAGCTGAGAGTGAAAGAGAGAGAGAGA
GCGTGGGGGTAGCAGCAGTTGAGAGAGAGAGAGAGAGACAGAGAGTAGTAGTAGTAGTAGGCAAGGAAGAAGGTATGGC
AACTGTGAGTGAAAGTGAAAGTGAGGTGAAGGTGCTGTCCACATGGGCTAGCATGTTCGGCATGCGCGTGCTCATCGCC
CTCAACGAGAAGGGCGTCCCTATGAGCTCACGGAGGAGGACCTTCGCAACAAGGGCCAGCTCTTGCTTCAGTCCAATC
CCATCCACAAGAAGGTACCCGTCCTCCTCCACCATGGGAAACCCATCTGTGAATCCAACATCATTGTTCAATACATCGA
CGAAACGTGGCCTTCCCCTCCCTTCTTTCAACCCCCTACCCCTTATAACCGTGCCATGCACCTCTTCTGGGCCGACTTC
GTTGACAAAAAGTTTTATGCAGAGACGGGCTTGAAGGTTCTAGGAAGCATGCCTGGGAAGACCGCGACAAAGCGGTGG
AGGAGTTTCAGAACAACTACAAATGATGGAAAAGGCAtTGGGGGATATGGCATGTGGGAAGccTTTCTTTGGTGgAGA
CTccatTgGCTTTCTTGACAttgcctTTGCTCCTTTCGTTt

FIG. 2 continued

> SEQ ID NO:1524 119262 125287_300629_1
GGCAAAGAATTGAGAACCAAGGTTGTGAGATGGCAGAAGTGAAGTTGCTAGGTTGGGGGTATAGCCCATTTAGTCGCAG
AGTTGAGTGGGCTCTAAAGATAAAGGGCGTGAAATATGAATATATAGAAGAAGATCGAGCTAACAAGAGCTCTCTACTT
CTTCAATCCAATCCTGTTTACAAAAAAGTCCCTGTTTTCATGCACAATGGAAAACCCGTTGTTGAGTCAATGGTCATTC
TTGAATACATTGATGAGACTTTTGAAGGCCCTTCCATTTTGCCTAAAGACCCTTATGATCGATCTTTAGCTCGTTTCTG
GGCTAAGTTCCTTGACGATAAGGTGCCTGCAGTAGTGAAGACTTTCTTGCGCAAAGGGGAGGATCAAGAGAAAGATAAA
GAGGAAGTTTGTGAGATGCTGAAAGTTCTTGACAATGAGCTCAAGAATAAGTTGTTCTTTGTGGGTGACAAATTTGGGT
TTGCTGATATTGCTGCAAATTTGGTGGCATTTTGGCTAGGAGTTTTTGAAGAAGCCTCTGGAGTTGTTTTAGTGACAAG
TGAGAAATTTCCAAATTTTTGTAGGTGGAGAGATGAGTATATTAACTGCAGCCAAATCAAGGAATCTCTACCTCCAAGA
GATGAGTTGCTTGCTTTTTACCAAGCTCGCTGTCAAGCTGCTG

> SEQ ID NO:1525 119350 160184_200029_1
accctattcgagcgaGCGACGCAGAGAACTCCGGAGAAAAATGTCGCACTTCGGAAGAACTGGACCTCCGGACATCACC
GATACTTACTCTCTTCGTCCTCAACATTACATTCCGTACCACAGCCGATGATCTGTATCCTCTTTTCGACAAGTACG
GGAAGGTTGTCGATATCTTCATTCCGCGAGACAGAAGGACTGGTGAGTCACGTGGGTTTGCATTTGTTCGTTACAAGTA
TGCAGATGAAGCACAGAAGGCTGTGGATAGGCTGGATGGAAGAGTGGTTGATGGACGGGAAATGGCAGTTCAATTTGCC
AAGTATGGGCCAAATGCAGAACGGATTCAGCAAGGGAGGATCATTGAGAAGGTTTCAAGAATCAAAGGAAGCTCGAGAA
GCAGAAGCCCTGGGAGAAGATACCGGGATGATCACTATAGAGATAGAGAATACAGGAGAAGTAGGAGCAGAAGTGTTGA
TCGTTATGAGCGTGATAGGTATAAGAGGAGAGAACGGGATTATCGCCGTCGAAGTAGGAGCCGCAGCTTAAGTCCAGAC
TATGATCGAGATCGTGGCAGGGGACGTGACAAAAAACACCATAGGAGGAGTCCATTTGACAGTGCCTCTCACCTCGGCG
TAGCCCCAGTCCTTACAGGAAAGAGTCTCCTCGCGGAAGCTtATCACCTAAAaaaggaaGCTCTGaGaaGCGCAGTcAC
ATTGaaCGCTCTCCAACTcctCgAagccaatcccctccTGttCGagcaaTggAttcacg > SEQ ID NO:1526 119350 256680_301674_1
GCAATGTCGCACTTTGGGCGATCGGGGCCGCCGGACATCCGCGACACCTATTCGCTCCTCGTCCTCAACATCACCTTTC
GGACCAGTGCCGACGATTTGTTTCCCTTGTTCGATAGATATGGAAAAGTGGTTGATATTTTTATTCCCAGGGACCGAAG
AACTGGTGACTCGCGGGGATTTGCTTTTGTGCGCTACAAGCATGCCGATGAAGCTCAAAAGGCAATCGAGAGGCTTGAC
GGTAAGAATGTAGATGGAAGAAATATCGTTGTGCAATTTGCCAAATATGGTCGGAACGATGAGTCAATTCAGCGTGGGA
AAATAACATCTTCCAGTCCTATCTGGCGCAGCCGATCTAGGAGCCGGAGTCCTAGGAGAGGAAGAAGAGATTATGACGA
CCACCGAGAGAGAGATAGAGACCGACGACGTAGCCGAAGCCGAGAGAGATACGAGCGTGAAAGATACCGCGGGCGTGAC
AGTAGAGATTACCGCAGGCGTAGCCTTAGCCGCAGTCGCAGTCGCAGCAGAAGCAGAGGCCGTGGCGGCcATGACTATC
CCGCTCGTGACGGCCGAGATGGTCGTGATGCTCGCGATGGACgcgAtGtccgcgACGGGCGAAGgcgATCTCGGAGCAA
ATc > SEQ ID NO:1527 119915 243271_301337_2
AGAACCGGTCGGATAAGCGAGGCCGAGGTTCTACTCGGGGCCATGCCGGACCCGGACACTTACGCATACAACTGCTGCA
TGAACGGTCTCTCCAAGGTCGGGGACGTCTCGAGAGCTCTCCAGATCTATGACAGGATGCTGGAGCTAAAGCTGGTCCC
GGACAAGGTGACTTTCAACATCCTCATTGCCGGGGCTTGCAAGGCCGGCAACTTCGAGCAGGCGGCCAAGCTCTTCGAG
GAGATGGTGGCCAAGAACTTCCACCCCGACGTCATGACTTACGGGTCGCTCATTGATGGCCTGTGCAAGGCCGGACAAG
TTGACGCTGCCCGGGACATCCTGGAACTCATGAGGAAGCTTGGAGTTCCTCCAAACGTGGTGACTTACAACGCTCTCGT
TCATGGCCTCTGCAAGTCGGGCCGGATCGACGAAGCTTGCGAGTTCTTGGAGGAGATGGTGACCTCTGGATGTGTTCCG
GACTCGATCACGTATGGATCGCTTGTTTATGCGCTGTGCCGGGCTTCGAGGACCGACGACGCTCTCCAGCTCGTGTCCG
AGCTCACGGGCTTTGGCTGGGATCGTCGGACACTGTCACGTATAATATACTCGTGGACGGGCTCTGGAAGGCGGGGAAGAA
CGACCAGGCCATCGGTGTTCTTGAGGAGATGGTCGGGAAGGGACACCAG > SEQ ID NO:1528 119915 105139_300371_1
AGTCACCCCAAAATTAGGGCACATCGAGATAGAGAAGAGCTGACTCATCCTCAGCCAAATTGAAGATGACTGACAAATC
CTCTTCTGCGTTACTCTTCCAATGGTATTTCCTTTGCTCTTTCCCGTACTGCTTCGGCATTTACTACCAGAAATTATTC
TTCTTCTCATACCAATATTGAAGAATGTCAAGTGTTTGGATGATGCTCTTAGCCTCTTCCGTCGGATGATCAGAACGCAG
CCTCTTCCTTCTGTTATTAGCTTCTCCAAATTATTAAAGACTATGGTAAATATGAAGCATTACTCTTCTGTTGTTTCCC
TTTTTCGACAAATGCTGAAATCTAATATCCCAATTGATGGTTTCATCTTGAGTATTGCGATCAACAGTTTTTGCCTAAT
GCATCGTTCTGACTGCGGATTTTCAGTGTTAGCCATTTACTTGAAGAGTGGCATTCCATTTAATGTTGTCACCTTTAGC
ACCTTACTAAGGGGACTCTTTGCTGAAAATAAAATCAA

FIG. 2 continued

> SEQ ID NO:1529 119938 158385_200003_1
CGGAAAAAAAGAGCAAAAGCTTCATTCATAATCAATGGCTTCCACCATTAAGAAAGGGAACATGATTACTCAAATCGTA
AGGCTAAAACAAGTCGTCAAACGCTGGAAAAACAAGTCCCTTACGCGCCGCGGTGTCGTCTCGTACTCCTCATCCTATT
TATATGAACCGGCATTATCCGGTTCGGACCGTCGTACGCCCTCAGGATCGTTGGCGGTTTACGTGGGGCCAGAACGCCG
CCGGTTCGTTATCCCGACCCGGTTCCTGAACCTTCCCGTGTTCATCTCGCTGCTCGATAAGGCAGAGGAGGAATTTGGG
TACCAGAGGACAGGTGGGTTAGTTTTGCCCTGTGAAGTCGAGTACTTTTCGGAGATTTTAAGGTTACTGGACCGGGATG
AGGAGCGATTCGGTCATTTGGCTTTGGATGAGCTTGTTAAGCTGATTTCTGAAGTAGGTTTTGAATCCTTAGATCAGTC
TTGCAAAGAAGCTGCTTCCCGTGGCTTTGCTCCTCTTCTGCAGAATGCTAGGGTTTAAACGGTTTTTACTGACAATGCC
CGGTTCAGTTCGTTTTCTTCCCGGTTCGGTTCCTGA

> SEQ ID NO:1530 120147 1097142_301437_1
TTCTTTTAAAGTAGCACAGGTCCTTCGTCTTTTCGGTTTCGTCCTATTTTCTTTCAGCTCATCGCTATGGTGAAGGAAA
AGTCAGCTGGTAGGCAGAAAAGGCAGGTCAAGAAAGACCCGAACAAGCCGAAGAGGCCGGCTTCTGCATTCTTCGTCTT
CATGGAAGATTTCCGGAAAACTTACAAGGAGGCTCACCCTGATGTGAAGGGTGTTTCCGAGATTGGTAAAGCGTGCGGT
GAGAAATGGAGGGAAATGACCGATCAGGAGAAAGTACCTTTCGTTACCAAAGCGGCACAGAGGAAAGCTGATTACGACA
AAGCAATGACGGCCTTCACTAACGGCGTGCAGGCTAAGTCAGCGGGATCAAACGGAAGCGCAGAGAGCGGCGAGGAGGA
ATCTGAATAGGGAGCCCGGGGAGGAAATCATGTTGGCGTCTCTGATAGAGTCTGTCTTGAATCTAATGGTAGTTTTTCC
TTCGTTAGTACCACCCCTCTGGCGTGGAGGAGTCTCTGTCCAGTTTTGCCCCATCCAATGAATTTCTTCTCATTGCTGG
TTTTGTCCCAGACTACGTCTTGTTGACATGTAGGCGtTGTACAGGACTATCCCTTGTGGATTCTCTTTAATTCAACTCT
GTTTCTATTTCGAaaa > SEQ ID NO:1531 120147 1101628_301528_1
cccacgcgtccggacccacgcgtccgcTCTACTCCCTCTTTCATCCTCAGCAGCCCTTTCCCTAACTTGCCTTCTTCCC
CAACACTAATCAAAGCGTTGATATGGCAAAGGAGAAGTCTGGGGGAAGGCAAAAGAGGCAACAAGCGAAGAAAGATCCA
AATAAGCCCAAGAGGCCTGCATCTGCATTCTTCATCTTTATGGAGGATTTCAGGAAATCATATAAGGAAGCCCATCCTG
ACGTCAAAGGGGTTTCAGAGATAGGAAGAGCATGTGGCGAGAAATGGAGAGAGATGACAGACGAGGAAAAGGCTCCATA
TGCAACTAAAGCTGCTTCAAGGAAGGCCGATTATGATAGAGCAATGTCAGCTTTCAACAATGGAGAGGTGGCAGGCAAG
AGCAATGGGCAAGTGCTCTTGCTGAGAGTGAGGGGGAGTCTGAGTAGACCAAATGATGGAATAAGTGAGGCTCTACCA
GAACCCAGGAAATGTTGAATGGTTGGTTGTGCCTTTTTTACTCCCTTCAAAACTGTCCTCTTTCATGTATCACACACCA
TCCCTTGCTTAATTTGCTTTGGCAATCTTTACAACCTCCTagaAAATCCATGTTTCTCCTCTTTAGAGAGGATTAGTTT
GGACTTCATGTATTTCTCTGGGAAACAATTGCAGCAGCTCaTAaTCTGTgggAaACTATCTTGTGATcattc > SEQ ID NO:1532 120147 113129_300022_1
cccacgcgtccgcagtccctcacttggaaccttcttatcggtcgcccttcgcttaccgaattcatcacaacgcaccaa
aGGAATATACATCTCTTTGTTTTCTCTCTAGAGGTTTCGCTATGAAAGGAGTTAAATCTAAGGCTGGAGCTGATTCC
AAGCTTGGAGTAAGGAAGAAGGCTACGGAGACGAAGAAAGCGAAAAAAGCCACGAAGGATCCAAACAAGCCTAAGAGGC
CTCCAAGTGCATTCTTCGTTTTCATGGAGGAGTTCAGGAAGACGTACAAGGAAAAGCACCCAAGCAACAGATCTGTTGC
CACTGTTGGTAAAGCTGGCGGAGATGCGTGGAAAAAATTGTCAGATGCTGAGAAAGCACTTTACCAGGAAAAGGCTGAT
AAAAGAAAGGCGGAATACCAAAAGAACATGGATGCCTATAACAGAAAACAGGCTGGTGATGCTGAAGAGGAGGAATCAG
ACAAGTCAAAGTCTGAGGTTCATGATGATGACGAGGATGATGATGGAAGTGAAGAGGAGGAGGATGATGATTAAAAACT
GAATAGCTGTTGAATTGCCGAAAATTATGGCAAAGTTGATGTAGGGAATCCCTTTCAGCCCTTTCCTTGATAAATAGAT
GCCCTCTTTTTGATGTTTCCTTTCTTTTTGTTTTGGTATTTTTCGGGGTTTAGTTGGGACGGGATAAGGGAAATTTAGA
TGAGCTGACTTGATAGCTCGAATGGCTTATGTATTTTTATTTTGGTGGTGTTTAATGAAAAATTCAGCTACGGATTACC
CTTTGTTGGTAGTattatgaatttcatctaatccgtttcgtgatgatgcaagtttgatgccagatatatttt > SEQ ID NO:1533 120147 1109873_301525_1
ttcttttttctactcgaatccaagcttttttttatctccgttcttctccggcagacagacatttcCTCCGTTGTTCTCC
GTCGTCCTCGACATTTCCACCTCTCGTCTCGCTTAATCGGTAAAACAAGAGAACAAAGAAAAGGGAAGTATGGCGAAGG
AGAAATCTACCGGTAAGCAGAAACGCCAGGCGAAGAAGGACACCAATAAGCCTAAACGGCCTGCCTCTGCTTTTTTTG
TATTCATGGAGGAGTTCAGGAAATCATACAAGGAAGCTCATCCTGATGTCAAAGGAGTTTCCGAGATTGGAAGAGCCTG
TGGTGAAAAGTGGAGAGAGATGACAGATGAGGAAAAAGTTCCTTATGTATCTCGGGCTGCTGTGAGAAAGGCGGACTAT
GACAAGGCAATGTCAGCTTACAACAACGAAGAGATGAATAGGTCTGCCCAAGCGAAGACCAGTGCATCAAATGGGCACG
CTGGGAGTGAGGATGAGTCCGAATAGCCTGCCTAAGGGAGTAAATGCAGGCGATACTCTATATATGCTGTCTCACTGTT
GACCAGCTAATGTGCTTGTGGATATAGTTTACTTAACTCGTTTTTTAGTTCTCTCAAAAGAttTCTGCTGtTAAACACA
AAAAACtgtcaaGCCTCAGAttTTCGAGCAAAGTTtgagtagccttTtTaAcAttttGaAACAGCtccacTtTTCTtGc
ctgcccaaGaaaattgACAtggaaAAGAggTAca

FIG. 2 continued

> SEQ ID NO:1534 120147 1101312_301475_1
AGTAGTAGCAGTACTGGTTAACAGTTCTTGTTTATAATTTGAACGACTTTGCAGGGAAGGGATGGGGAATATAGCTATT
ACACCTAATCACTTACCTTCAACGGGGCTTGCCATCTCCCGGAGGCACAGTGAAGGGAGCAAAATGGTCAGCTCTTCCT
GCCAAGAAGGACAACAAAGGCCTGTCAAAGAAGGCTGAAGAAACTAACTTGAAGAGAAAGAAGTCAGTTGCAACAGAAG
GGAAAGTCGAAGAGGCAGTCCAAGAAACCTGCCAAGGATCCCAACATGCCTAGGAGAGCTCCTGGTGCTTTCTTCGTCT
TCATGGAGGAGTCTAGGAAGACCTACATGGCTGATCATCCTGGAACTAAATCCGTGTCTGCGGTGGGCGAGGCTGCTGG
GGACAAGTGGAAGTCATTGTCTGAAGCGGAGAAAGCCCCGTACTCTGGCATGGCTTGGAAGAACAAGGGCGAGTACGAT
AAGTCCAT

> SEQ ID NO:1535 120147 136745_300438_1
tggtgtGGGTGTGTCCCTGTCTCCCCTCCTTCCTCCTCTCCTTTCCCCTCCTCTCTTCCCCCCTCTCACAAGAGAGAGA
GAGCGCCAGACTCTCCCCAGGTGAGGATTCAGCCATGAAGGGGGCCAAATCCAAGGGCGCCGCCAAGCCCGACGCCAAG
TTGGCTGTGAAGAGTAAGGCGCGGAGAAGCCCGCCGCCAAGGGCAGGAAGGGGAAGGCCGGCAAGGACCCCAACAAGC
CCAAGAGGGCTCCCTCCGCTTTCTTCGTTTTTATGGAGGAGTTCCGTAAGGAGTTCAAGGAGAAGAACCCCAAGAATAA
ATCTGTCGCTGCTGTAGGAAAAGCAGCCGGTGATAGGTGGAAATCCCTGACCGAAGCGGACAAGGCTCCCTATGTAGCC
AAGGCCAACAAGCTCAAGGCCGAGTACAACAAGGCCATTGCTGCCTACAACAAGGGCGAGAGCACTGCCAAGAAGGCAC
CCGCCAAGGAGGAAGAGGAGGACGACGAGGAGGAATCTGACAAGTCCAAGTCCGAGGTCAATGATGAGGATGACGACGA
GGGCAGCGAAgaGGATGAAGaCGATGACGAGTGAGCCttccAGTgGACaaGaTGGGAGCAGCAagacgc > SEQ ID NO:1536 120147 1098148_301483_1
TTCGTTGTGTTGTGTGCTGGGGTCTTTCTCTCTCTCTCTCTCTCTCTCTTTCTTCGTATTTCTCGTAATACGAAGGG
AAACTCTCTATAGTTTTTAGTAGTTACGTTTTTATTACTAACAACTAGTAGTACTACTACTACAACGAGGCGAAGCTCG
CCATCTTTACGACGATCTCCAGGCACAATGAAGGGAGCAAAAGGATCTGCCATACCTGCCAAGAAAGATAACAAAAGCC
TCTCAAAGAAGGCTGAAGAAACGAACCTGAAGAAGAAGAAATCAGTGGCCAAGGAAGCAAAGCCAAAGAGGCAGTCAAA
GAAAGCTGCCAAAGACCCTGACATGCCTAAGAGGCCGCCTAGTGCTTTCTTTGTCTTTATGGAGGGCTTTCGGAAGACA
TACATGGCCGAACACCCTGGTGTTAAATCTGTCTCAATAGTGGGTAAGGCTGCTGGAGACAAGTGGAAGTCACTATCTG
AAGCGGAGAAAGCCCCATATGCTTCCAAGGCTCTGAAAAAGAAGGCTGAATATGAGAAGTTGATGCAAGCGTATAAACA
AAAAAAGGTTGCAACTCGAAGCTAACAAGTCTGCGGTCCATGAAGATGATGAGGAAGAGGAGGAGGAAGAGGAAGAGGAA
GAGGAAGAGGAAGATGATG > SEQ ID NO:1537 120147 191190_300739_1
GTGGTGTGGGTGTGTCCCTGTCTCCCCTCCTTCCTCCTCTCCTTTCCCCTCCTCTCTTCCCCCCTCTCACAAGAGAGAG
AGAGCGCCAGACTCTCCCCAGGTGAGGATTCAGCCATGAAGGGGGCCAAATCCAAGGGCGCCGCCAAGCCCGACGCCAA
GTTGGCTGTGAAGAGTAAGGCGCGGAGAAGCCCGCCGCCAAGGGCAGGAAGGGGAAGGCCGGCAAGGACCCCAACAAG
CCCAAGAGGGCTCCCTCCGCTTTCTTCGTTTTTATGGAGGAGTTCCGTAAGGAGTTCAAGGAGAAGAACCCCAAGAATA
AATCTGTCGCTGCTGTAGGAAAAGCAGCCGGTGATAGGTGGAAATCCCTGACCGAAGCGGACAAGGCTCCCTATGTAGC
CAAGGCCAACAAGCTCAAGGCCGAGTACAACAAGGCCATTGCTGCCTACAACAAGGGCGAGAGCACTGCCAAGAAGGCA
CCCGCCAAGGAGGAAGAGGAGGACGACGAGGAGGAATCTGACAAGTCCAAGTCCGAGGTCAATGATGAGGATGACGACG
AGgGCAGCGAAGAGGATGAAGACGATGACGAGTGAGCCTTCc > SEQ ID NO:1538 120147 156219_301364_1
gctaaccaaagcccctTcTtaTcTcTtcccCTTTCAGCCCACAACACACACACACAACCACCCAACGGGCATATAACTC
TGTTTTTTCCTCTCTTGTTGTCAATACCATATTATTATTCTCAACCCTAAAGGTTTAATCATGAAAGGAGGTAAATCAA
AGGCTAAATCTGACAATAAGCTCGGCGTTAAGAAGGCTGCTCCTCAGACTAAAAAGGAGAAGCAGGCTGCCAAGGATCC
CAACAAGCCTAAGAGGCCAGCAAGTGCTTTCTTTGTTTTCATGGAGGACTTCAGGAAGCAGTATAAGGAAAAACACCCA
AACAACAAATCTGTTGCTGCTGTTGGTAAAGCTGGCGGTGACAAGTGGAAACATTTGTCAGAGGCTGAGAAAGCTCCAT
ATATAGCAAAGGCAGAGAAAAGGAAGGCTGAATATGAAAAGAACATGGATGCTTATAACAGGCGACAGCTGGTGAGGC
TGAAGAGGAGGAATCTGACAAGTCAAAGTCTGAGGTTGACGAGGAAGACGGAAGTGACGAGGAGGAAGAGGATGACTAA
ATGAAGTCTTAGGGGATGAAGAAAATGTGGAGGAATTGTGTAATATCTTAGAGATTTCCATATGACTTCCTCTTTTTCC
TATTAAATACTTGTCTTTTGGTTTATCTTTTGGGGGTATCTTGGGGCATGGAAAAAGATGAAATTAGAAAAGTGCTGCC
TTTAAAGCTCAAATGACTATTGTACTTTATAATTTGATGCTGCAGCTTATTGTTAATTCCGATGGGCCTCAGTTCTTTC
TAGGCCAGTATATGGAAGTCATGTgttTTgctAAaTgtagcTAGCT > SEQ ID NO:1539 120147 156120_301363_1
ctcTTGTTTTTTCCTCTTGTTGTCTATACCATATCATTATTCTCAACCCTAAAGGTTCTATCATGAAAGGAGGTAAATC
AAAGGCTAAATCTGATAACAAGCTCGGCGTTAAGAAGGCTGCTCCTCAGACTAAAAAGGAGAAGCAGGCTGCCAAGGAT
CCCAACAAGCCTAAGAGGCCAGCAAGTGCTTTCTTTGTTTTCATGGAGGACTTCAGGAAGCAGTATAAGGAAAAACACC
CAAACAACAAATCTGTAGCTGCTGTTGGTAAAGCTGGTGGTGACAAGTGGAAACATTTGTCAGATGCTGAGAAAGCTCC

FIG. 2 continued

TTACATAGCGAAGGCAGAGAAAAGGAAGGCTGAATACGAAAAGAACATGGATGCTTATAACAGGCGACAGGCTGGTGAA
GCTGAAGAGGAGGAATCTGACAAGTCAAAGTCTGAGGTTGACGATGAAGAAGAAAGTGACGAGGAGGAGGAAGATGATG
ACTAAATGAAGTGTTAGAGGATGAAGAAAATGGTGGAGGAGCTGTGTAATATCTTAGAGATTTCCATATAATGACTTCC
TCTTTTCCCTATTTAATACTTGTCTTTTGTTTATCTTTTGGGGTATCTTAGGGTATGGAAAAAGATGAAATTAGAAAAG
TGCTGTCTTAAAGCCCAAGTGACTGTGCTTTTCAATTTGATACTGCaACTTAATGTTAATTCGGATAggcctTaGTTCT
TTCtTggccagTAtATGGAaatcag > SEQ ID NO:1540 120147 145354_301059_1
TTCTCTTTTGGCTTTTGCTCTGTTTTCTTCACTTTCCCTTCAGCCCATTACTTCTTAGCTTCCTGGCAGTTCTAAGTTA
CAATGAAGGGTGGAAAAGGAAAAGGGGCGTTGAGAAAAGAAACAAGGTCTGCACTGAAGCCTGTTGAGGACCGAAAGAT
GGGGAAGAGAAAAGGCCGCATTGAAGGATGATAAACGGAAGGCCAAGAAGGACAAAAAGGCCAAGAAAGATCCTAATAAG
CCTAAGAGGCCTCCCAGTGCCTTCTTCGTATTTCTTGAAGAATTCAGGAAGACATTTAAAAAGGAAAATCCTAACGTGA
AGGCCGTATCAGCTGTAGGGAAAGCTGGAGGAGAGAAGTGGAAATCTATGAGCGCAGCTGAAAAAGCACCCATATGAAGC
CAAAGCAGCAAAAAGGAAGTCCGAGTATGAAAAGCTCATGCATGCGTACAACAACAAGCAGCCGGAAAGCTCAGACGAT
GATGGCGAAGAAGAATCTGAGAGGTCAAAATCTGAGGTACATGATGATGATGCAGAGTGCAGTGGACAGGGTGAAGAAG
AAGAGGAAGAGGAAGAGGAAGATGATGAAAACGAGGACGATGATTGAAGCTATGTGCTTCAATCACTTGGTT > SEQ ID NO:1541 120147 254944_301640_1
TCTCTCTCATTTTCTAATACAAAGAAAGAGAGAGAGAGAGAAGTGTAATAACGAGATTACTACTACTACAACATAAAAG
AAAGAGAGAGAGAGAGAGATTTGCAAGCTTTTTTTACGACGATTGCCAACCCACCCAGGTTTCTTCGTCCTCAGGCAGC
ACAATGAAGGGAGCAAAAGGATCAGTTGCAGCACTGCCACCACCTACCAAGAAAGACAACAAAGGCATATCAAAGAAAG
CGGAAGAAACAAATTTAAAGAAAAGGAAATCCGCAGCGAAGGAAGTGAAGCCCAAGAGACAGCCTGTAAAAGCTGTGAA
GGACCCAAATAGGCCCAAGAAGCCTGCTACTGCTTTCTTTGTCTTTTTGGAGGAGTTCAGGAAGACCTTCATGGCTGAG
CACCCTGCGGTCAAAGCTGTCTCTGTAGTTGGCAAAGCTGGTGGAGAAAAGTGGAAGTCGCTAACAGAGGCGGAAAAAA
CTCCATATGTCGCCAAGGCAGCAAAAAGAAAGACTGATTATGAGAAAACTATGCAGGCATATAACCAGAAAAAGGATGT
AGCAGAAGCCGAGAAGCCCAAGATAGAAACCCACAAGAGGAAGAAGAGGAAGATGATGACGATTACGAAGAGGATGAT
GAGAATGAAGATGATGAGTAACAGGATCAATTCCAGATTCCTAGCAAGATGGTACCATATTTAAGGTAACAAACTAAGA
AGATGGATGCTATGGACTATCTC > SEQ ID NO:1542 120147 6691_300347_1
TTCCCGGGTCGACCCACGCGTCCGTATTTTACAAGCCTTTCTCCACTAAGCCCTTCTCTCTTCTTCTCTTGGCCTCTCA
CTTGAATCTCCCACAAAGCGATCAATCACAAATTCCTTCTTCTCTCTCTTTCTTTTCGTCCCCAAGAATCAATTATGAA
AGGAGCTAAATCAAAGACTGAAACCAGGAGCTCCAAGCTCTCTGTGACCAAGAAGCCGGCTAAAGGAGCAGGACGTGGC
AAAGCCGCTGCGAAGGACCCCAACAAACCAAAGAGGCCAGCCAGTGCCTTTCTTCGTGTTCATGGAAGATTTCCGTGAGA
CTTTCAAGAAGGAAAACCCCAAGAACAAGTCTGTAGCTACTGTTGGAAAAGCTGCAGGAGACAAGTGGAAGTCCTTGTC
TGATTCTGAGAAAGCTCCATATGTTGCTAAGGCTGAGAAACGCAAGGTTGAATATGAGAAGAACATTAAAGCTTACAAC
AAG > SEQ ID NO:1543 120246 275058_200153_1
TCCGGACAGAGATAAAAAGTAAGAGAAAATTATCCCTTCTCTTCCAATAATAATAAACAAATAAATCCAATCACAAAAT
TCACAAAACAAAAGTTGTAAGAAGGAATTTTCTCTGTTTGTTTTTTCTCTTTCTCTGTCCAAAACCTTAAAACTCATGG
CGGATAAAGGTCGTCCACTTCCAAAATTTGGAGAGTGGGATGTCAACGACCCAGCTTCTGCTGAGGGTTTCACGGTCAT
CTTTAACAAAGCTCGAAATGAGAAGAGAAGCGGAGGCAATACAAACTCACCACCAAAGGGTGACCCTGCATATAATAAG
CATGGAGCAACTCTTGGAAAGCCTCAATCAAAAAATGGTTCTGCTGTATGCATTCTGCTGCTGCGGAATCATGAATTC
GCTTTGCTCCTATACGTCACATTGGGGAGTGTTTGATCTGAAATGTAAAGTGTTCCTCAAGTCTTGAGCTGTAGTCAAG
CCTGGAATTTGTTCTATTGTGTTTTAGAATTTACTCAAAATTTCGCCATTGAAAGATATTCTGCTATCTATTTATTTAT
TTATTTTTTGATCT > SEQ ID NO:1544 120246 29226_300160_1
TCTCTCTTGCTGCACAGCACCAGTCATATTCTCTGAAGAACATTTCTGACTTATTCCCGGATTCATGTCGGAAAAGGGT
CAACCATTGCCTAAGTTTGGTGAATGGGATGTCAATGACCCAGCGTCGGCAGAGGGATTCACGGTGATCTTCAACAAGG
CCCGAAATGAGAAAAAACAGGTGGCAATCCAGAATCACCTTCAAAGGCTGATTCCAATGCAAAGCAAGCAGAGTT
CAAGCCTCAAGCTAAAAAA > SEQ ID NO:1545 120246 191478_300785_1
CCCCCTTCCTCCCTCTCCTCTCCTCTCCGCCGCTGCCGGTGCTGCTGCGTGCTCCTCTCATCCCCGTCTCTTCCCCCTC
CGCGCGCGCCGCCCACTCGCTGGGAGGAGGAGGAAGAGGGAGACCTTCCCCGGAATTCGTGCTCGCCGGATCGGGCTCGC
CGCAATCCATGTCGGAGGAAGCAGGTCGACCCTTGCCCAAGTTTGGTGAATGGGATGTCAACGACCCAGCTTCTGCTGA
TGGATTCACAGTGATATTCAACAAAGCCAGAGATGAGAAAAAGGGTGGGAATGGGCAAGATACTGATTCACCCTGCAAA

FIG. 2 continued

```
GAGACTAGGACTGAGAGGGTGGAATCATATGCCCCCAAAACAAACTCGAACAAATGGTTTTGCTGTGTGACATCCAGTC
CTACACAATCTTGATGAAAACGAGTTCCATGGGTTGCAAAATTACTATCCTTTAATTTTGCTATATACATACTATCCAT
AAGACCTTGTAGAGATGCCCACACTCTGCTGTGGTGCTTGATTGGGCATCTCTTAAAACTCTGAGGTGTGTG

> SEQ ID NO:1546    120859 114431_300008_1
cttccactcctctccatatctgCTAAAATTCATAATTCAGAGGGGGGAAGGAGGTAGAAAAAGAGAGGGTCAAGCATGG
AGGTGAACGGTGAAACAACAAGATGGAATTTTAAAGAGAACGAGAATTTCTTGGCTGCGTCTGGTATTTCCATAAGAGG
GGTTCTTAACAAGTTAATGCAGAGCCTTGACCCGTCTGATACCCGACCCGTTATCCCTCTCGGACACGGCGATCCTTCT
GCTTTCCCCTGCTTTCGGACCACTCCCGTTGCTGTAGACGCTATTTCTGATTCCGTTCGCTCTGCTAAGTTCAATGGTT
ATTCATCCACCGTCGGCATTCTTCCTGCTAGAAAGGCTGTAGCGGAATACTTATCCCAAGATCTTCCAAACAAGCTGTC
CCCTGATGATGTTTACCTGACAATTGGATGTACTCAAGCAATTGAAGTAATTTTGAATGTTCTTGCTCGCCCAACTGCA
AATATTCTACTTCCGAGGCCTGGTTTTCCTTATTATGAAGCACGTGCTGTTTTTAGCAATCTTGAAATGCGTCACTTTG
ATCTTCTCCcagaAAGTGAGTGGGaggTGGACCTTAATGCAGTTGAGTCTTTGGCAGATGAAAATACTgtgGCTAtTGt
cA > SEQ ID NO:1547    120859 120363_300384_1
AAACAGGGCAATTGCAGATTATTTGTCGCGTGACCTTCCAGAGGAATTATGTGCAGATGATGTTTATGTCACAGCTGGT
TGCACTCAAGCCATTGAAATAGCCTTGTCAATTCTGGCTCGCCCCTCTGCTAACATATTACTACCAAGGCCTGGTTTCC
CAATTTATGCACTTTGTGCTGCCTTTAGACACATCGAAGTTCGATACTTTGATCTTGTTCCGGACAAAGGCTGGGAGAT
TGATCTCAATGCTGTCGAAGCTCTAGCTGATCGTAACATATTGGCATAGTTGTTATAAATCCGGGGAATCCTTGTGGA
AACGTTTATAGTTACCAGCATCTTCAAGAGGTTACTCTTAGTACTCTTTTTAAATGCAACGATTACTTCCTCAGTTTTA
TTTCATGCCTTAGTTTGCCCGAGCATGAAGTTTAAGAATGCAAAGAAATTTTCTGCAGCTTATCGTCTTAAACTAAAGG
TGTGTATAACATACCAAAATACCCTTTGAATTTTGTGGTCTTAGACATAGTAGTGTCATTAGGGTAAAATGAGAATGTT
GAAATTAAGAGTCTACTAAATATAGAAAGGCGACATTCCTTTTGAAACAGATTAAAAAAGGAAAGTAAGACATAGAAAT
TAAAACGTGTGGAATACTATTCTTTTCCTTTCTTTTTGCAGTTTGCATTAGTTCTAAGAA > SEQ ID NO:1548    120859 235892_301230_1
aGGAAAAAAAGGAGAGAAAATGCCGTGCTTACTCACAGTTCGATGCGAGATCGCCACTCACAGTCCGCATGAATCCGCT
GTTCCAGCTGTGAACCAGAAGCGATGGCCGACTCGATTGAATCCGGCAGCATTGCGCTCCATCAATCCGATCCGGAGAG
CGATGGAGTCCATGCCTGATCTTCGCGGCCGTGGAAAGCAGCCAATCTCGCTCACCCTCGGCGATCCCTCCGCCTTCAA
CGAGATCAAAGCTCCACAGGTAGCTGTCCAAGCAATCACCGATGCCATCGCCAGCTTCCATTACAATGGCTACAGCCAA
GCCGCTGGAATCCTCGACTGCCGCAGAGCGGTGGCCGAGTATCTCTCCAAGGATCTATCGTACTCCCTGTCGGCCGACG
ATATCTTCATGACGGCCGGGTGCTCACAGGCAATCCAGTTCTGCATCGCGGTCCTGGCCAGGAAGTCGTCCAACATCCT
GCTCCCGCGGCCGGATTCCCGTTGTATCAATCCTTTTGCAGCTTCTACGGCGTTGAAGTCCGAGAGTATGATCTGCTC
CCGAGCAACGACTGGCAAGTTGATCTCGAGTGCGTTGAGAAGCTGGCGGATTCGGATACTGTTGCCATAGTCGTGTGCA
ATCCCGGTAACCCCTGCGGATCCGTGTACTCGCAGCATCATCTGACGCAggttgC > SEQ ID NO:1549    120870 256085_301646_1
ggAAATTTTCTGCCCTTGCAAGCGCTCGTCTTTCTCCGTCGTCGTTTTCCGGTGAACAGCTGTTTAGGAATGGCGAACC
CCCGTGTGTTTTTTGACATCACCATCGGCGGCAACCCTGCAGGCCGCATCATAATGGAGTTGTATGCGGACAAGGTTCC
AAGGACAGCGGAGAACTTCCGTGCCCTCTGCACAGGGGAGAAGGGAATTGGAAAGAGTGGGAAGCCACTCCACTACAAG
GGTAGCTCCTTCCACAGGGTTATCAACGACTTCATGTGCcaggntggTGATTTCACGCGGGGGGATGGAACAGGTGGAG
AGTCCATCTACGGGGCCAAGTTTGCCGATGAGAACTTTTCGTGCAAGCACACTGGTCcAGGCATCCTCTCCATGGCCAA
TGCAGGACCAAACACCAATGGCTCCCAGttCTTCCTTTGCACCGTCCCTGTGCATGGCTTGATGGAAAGCATGtTGTC
TTCGGCAAGGTCGAAAATGGAATGgacgttgtcaagACTATTGAGAAATACGGATCTGGGAGCGGcaagacGAAagccc
CtgttgTCGTTGCTGACTGtggccagCTCTCTTGAAGTATGGttgGtGGCTCCCCTTAGAAGAAtaacTcTt > SEQ ID NO:1550    120870 53163_300091_1
TTCTGGTAGTTAATATTAAAGGGGCAAGTTTATATATGGGCCCATGAGAACACACACCAAACTTATGACTACAAATTTT
AAAACGACTCCATAACAAAAGCAAAAGCATAAAGAGACACCACAATGACGACGATGATGCTAAATTAAGGATGATGATA
GGAAGATCCTAAGAGAGCTGACCACAATCGGCAACAACCACAGGCTTCGTCGGCTTTCCAGATGATGATCCAACCTTCT
CGATGGCCTTTACCACGTCTAAGCCTTCCACGACCTGCCCAAACACCACGTGCTTCCCATCAAGCCAATCGGTCTTCAC
GGTGCAGATGAAGAACTGAGATCCGTTCGTGTTTGCACCGGCGTTCGCCATCGACAGGATCCCCGGTCCGGTGTGCTTC
CTCTCGAAATTCTCGTCCTCGAACTTGCTCCCGTAGATCGACTCACCGCCTGTTCCGTTCCCGGCGGTGAAATCTCCTC
CCTGGCACATGAAGTTAGGGATCACACG > SEQ ID NO:1551    120870 46867_300192_1
TTTAATGGCGAATCCTAAATTCTTCTTCGACATCTTGATTGGTAAGATGAAGGCAGGGCGTGTTGTAATGGAGTTATTT
GCAGATGTGACTCCGAGAACAGCTAATAATTTCCGTGCTTTGTGCACTGGGGAGAATGGTATTGGGAAAGCAGGGAAGG
```

FIG. 2 continued

```
CTTTACACTACAAAGGCTCAGCCTTTCACCGTATAATCCCAGGGTTCATGTGTCAAGGTGGAGATTTCACTCGTGGGAA
TGGAACTGGAGGAGAATCTATTTACGGGTCTAAATTTGAAGATGAGAACTTCAAGTTGAAGCACACTGGTCCAGGGATT
TTGTCTATGGCTAACTCTGGTCCCAACAC

> SEQ ID NO:1552 120870 1171314_302052_1
AGCGCTCGTCTTTCTCCGTCGTCGTTTTCCGGTGAACAGCTGTTTAGGAATGGCGAACCCCCGTGTGTTTTTGACATC
ACCATCGGCGGCAACCCTGCAGGCCGCATCATAATGGAGTTGTATGCGGACAAGGTTCCAAGGACAGCGGAGAACTTCC
GTGCCCTCTGCACAGGTGAGAAGGGAATTGGAAAGAGTGGGAAGCCACTCCACTACAAGGGTAGCTCCTTCCACAGGGT
TATCAACGACTTCATGTGCCAGTGTGGTGATTTCACGCGGGGGGATGGAACAGGTGGAGAGTCCATCTACGGGGCAAG
TTTGCCGATGAGAACTTTTCGTGCAAGCACACTGGTCCAGGCATCCTCTCCATGGCCAATGCAGGACCAAACACCAATG
GCTCCCAGTTCTTCCTTTGCACCGTCCCCTGTGCATGGCTTGATGGAAAGCATGTTGTCTTCGGCAAGGTCGAAAATGG
AATGGACGTTGTCAAGACTATTGAGAAATACGGATCTGGGAGCGGCAAGACGAAAGCCCCTGTTGTCGTTGCTGACTGT
GGCCAGCTCTCTTGAAGTATGGTTGGTGGCTCCCCTTAGAAGAATAACCTCTTCCCCCCCTCTAATAAGTTTTGGAGCC
TATTCTTCGCTAAGCTTTATA

> SEQ ID NO:1553 120870 16699_300229_1
CCCACGCGTCCGACAGAACCTAATCTTCTTCTCCAATCAATCTCAGAGAAAAAAAGAAATGGCAACAAACCCTAAAGTC
TACTTCGACATGACCGTCGGTGGCAAATCCGCCGGTCGTATCGTGATGGAGCTTTACGCCGACACAACACCAGAAACCG
CCGAGAATTTCAGAGCACTCTGTACCGGAGAGAGAGGAATCGGTAAACAAGGTAAGCCATTACACTACAAAGGATCAAG
CTTTCACCG

> SEQ ID NO:1554 120870 187783_300680_1
CCCACGCGTCCGGGCCAATGCTGGGAGAGACACAAACGGGTCCCAGTTTTTCATCACCACTGTAACCACCAGCTGGTTG
GACGGGAAGCACGTCGTGTTCGGTAAGGTGCTGTCTGGAATGGATGTGGTTTACAAGATTGAAGCTGAGGGCCAGCAGA
GTGGGTCACCGAAGAGCAAAGTTGTCATCGCGGACAGCGGCGAACTGCCGATGTAATGAGCTGAAATGATGTTTCACTG
AAGCTACTGCTACTGCTTCTCGTTGTAGAACTGTTATTAGCTGCTCTGTTTTGCTATGCTTCTACCCCGAATCTGGTTG
GAGTAAATTTCTGTTAGACTATAACAGCGTGCTT

> SEQ ID NO:1555 120870 127733_300472_1
CAGCGAAAACCTCACTGAAAAATCTAGAGAGATGGCAAACCCAAAGGTGTTCTTTGACCTTACTATCGGCGGCACACCA
GCTGGCCGTGTGGTGATGGAGCTCTTTGCCGACACCGTACCCAAGACGGCGGAGAACTTCCGTGCTCTCTGCACCGGCG
AGAAAGGCGTCGGAAGGATGGGCAAGCCTTTGCACTACAAAGGTTCAACCTTCCACCGTGTGATCCCAGGGTTCATGTG
TCAAGGAGGTGATTTCACCGCCGGAAACGGTACCGGAGGTGAATCAATCTACGGCGCCAAATTCGCCGACGAGAACTTC
AAAAGGAAGCACACCGGCCCTGGAGTCCTCTCCATGGCTAATGCTGGACCTGGAACCAACGGTTCTCAGTTCTTTATCT
GTACCGCTAAGACAGAGTGGCTCGACGGCAAGCACGTTGTGTTCGGTCAAGTTGTTGAAGGCTATGATGCGATTAAGAA
GGCTGAGGCTGTTGGATCTGGATCTGGCAGGTGCTCCAAGCCTGTTGTGATTGCTGACTGTGGTCAACTCTGCTAAATC
TGAGGACGTTGATGATGATCTAGTTTATCTATATTTAAGTCGCCGTTTTTGGCTTTGTTTTAATTTAAATCTATCAGT
TACTGCTTGCTTACTGTGGTTCTAGTTCTAGGGTTGTGCTGTAATTGGTATTGGTTCTACTTCTACCAGTTTATGTTTA
ATCTTAAGACTATGGTTTAAATAAGATAATACTCTTGTTTTCTCTg

> SEQ ID NO:1556 120925 1171641_302057_1
TTGATCCTAACCCTGATCCTAACCTTCATTCTAGCTCTAAACCTGTGCTCGAATGGCGGATCCGGGTGCTAGTCGAATG
CAGTACCGGAGCTTGGGCCGAACTGCGCTGAAGGTTAGCGCTCTCTCTTACGGAGCTTGGGTTAGCTTCGGAAACCAAG
TCGACGTGGATGGGGCGAAGACTCTCCTCTCAGCTTGCCGTGCGCACGGTGTGAACTTCTTCGACAATGCGGAGGTGTA
CGCGGAGGGGCGTGCGGAGGAGATCATGGGGCAGGCCATAAAGGGAGCTTGGGTGGAAGCGCTCGGACTTCGTCATCTC
TACCAAGCTCTTCTGGGGCGGAACCCGGACCCAATGACAAAGGTCTCTCCCGAAAACACATCATTGAGGGTGTTAAGGC
CTCCTTAGCCCGNCTCAAAATGGACTACGTTGACGTCCTCTTCTGCCAACGACCCGATCCCTCCAACCCGATTGAGGAA
ACCGTCCGTGCTATGAACTTCGTT

> SEQ ID NO:1557 120925 136824_300439_1
CCGATTCTCGATCTCTCTCTCGCTGCAGAGGCAAACCAACCTCACCGTCGACGAGGAAGAAGGCGGCGGCGGCGGCGGA
GGCGGAGGCGGAGGCGGCGAAGATGCAGTACAAGAACCTTGGGAGGTCGGGGCTGCGGGTGAGCCAGCTGTCGTACGGG
GCGTGGGTGACGTTCGGCAACCAGCTGGACGTGAAGGAGGCGAAGGCGCTGCTCCAGGCGTGCCGCGACGCCGGCGTGA
ACTTCTTCGACAACGCCGAGGTGTACGCGAACGGGCGCGCCGAGGAGATCATGGGGCAGGCGATGCGGGACCTCGGGTG
GCGCCGCTCCGACGTCGTCGTCTCCACCAAGCTCTTCTGGGGAGGGCAGGGCCCCAACGACAAGGGCCTCTCCCGGAAG
CACATCGTCGAGGGCCTCCGCGGCTCGCTCAAGCGCCTCGACATGGACTACGTCGACGTCGTCTACTGCCACCGCCCCG
ACGCCACCACCCCCGTCGAGGAGACCGTGCGCGCCATGAACTGGGTCATCGACCACGGCATGGCCTTCTACTGGGGCAC
CTCCGAGTGGTCCGCCCAGCAGATCACCGAGGCGTGGAGCGTCGCCAACCGCCTCGACC
```

FIG. 2 continued

> SEQ ID NO:1558 120925 183256_300620_1
CCCACGCGTCCGCCCACGCGTCCGCCCACGGGTCCGCCCACGCGTCCGCCCACGCGTCCGGCGAAGGCGGCGAAGATGC
AGTACAAGAACCTGGGGAGGTCGGGGCTGCGGGTGAGCCAGCTGTCGTACGGGGCGTGGGTGACGTTCGGCAACCAGCT
GGACGTGAAGGAGGCGAAGGCGCTGCTCCAGGCGTGCCGCGACGCCGGCGTGAACTTCTTCGACAACGCCGAGGTGTAC
GCGAACGGGCGCGCCGAGGAGATCATGGGGCAGGCGATGCGGGACCTCGGGTGGCGCCGCTCCGACGTCGTCGTCTCCA
CCAAGCTCTTCTGGGGAGGGCAGGGCCCCAACGACAAGGGCCTCTCCCGGAAGCACATCGTCGAGGGCCTCCGCGGCTC
GCTCAAGCGCCTCGACATGGACTACGTCGACGTCGTCTACTGCCACCGCCCCGACGCCACCACCCCCGTCGAGGAGACC
GTGCGCGCCATGAACTGGGTCATCGACCACGCATGGCCTTCTACTGGGGCACCTCCGAGTGGTCCGCCCAGCAGATCA
CCGAGGCGTGGAGCGTCGCCAACCGCCTCGACCTCGTCGGACCCATCGTCGAACAGCCTGAGTACAACCTCTTCTCGCG
CCAC

> SEQ ID NO:1559 120925 120575_300411_1
tccatcccaaattctcatattccccacttttactcctttctcctTCCCGTTTCTTCCTTTTAAAACAACAAATCTTCAT
TTCCTCTTTTTTCTTCTTGATTTGCCCCCCAAAAAACGAAAAAAAGTGCAAATGCAGTACAAGAATTTAGGCAGATCAG
GCCTAAAAGTATCTCAACTTTCATACGGAGCATGGGTCACTTTCGGCAATCAACTCGATGTCAAAGAAGCTAAATCCCT
CTTACAAAAATGTCGTGACCACGGTGTCAATTTCTTCGATAACGCCGAGGTTTACGCTAATGGAAGAGCAGAAGAAATT
ATGGGTCAAGCAATTCGTGAATTAGGTTGGAAAAGATCAGATATTGTTATATCTACTAAGATTTTCTGGGGCGGGTCGG
GTCCAAATGATAAGGGTTTATCGAGGAAACATATAATCGAAGGGACGAAAGCTAGTTTGAAAAGACTGGATATGGCTTA
TGTGGATTTGATTTATTGTCATAGGCCTGATGCTAGTACACCTATTGAAGAAACTGTTAGGGCTATGAATTATGTGATT
GATAAAGGTTGGGCTTTTTATTGGGGACAAGTGAATGGTCAGCTCAACAGATTACTGAAGCTTGGGGTGTTGCTCAAA
GATTGGATCTTGTGGGTCCCATTGTTGAACAGCCTGAGTACAACTTGTTGTCTAGGCACAAGGTTGAATCTGAGTACCT
CCCTCTGTATAGCAACTATGGCATTGGTCTTACCACATGGAGTCCTTCTTGCTTCAGGCGTTCTGACTGGAAAATATAAT
GCAGGGAACATTCCAGCGGACAGTCGATTTGCACTGGAAAATTACAAGAATTTAGCCAACAGATCTTTGGTGGATGATG
TGTTGAGGAAAGTAgaTGGATTGAAACCAATTGCTGAATCACTAGGTGTACCTCTGCCTCAACTGGCAATTGCCTGGTG
TGCTGCAAATCCTAATGTCTCATCCGTTATTACTGgTGccAcCAAAGAGTATCagAtTGAAGAGAACATGAAAGCTATC
AATGTCATTccAATGTttaaCACCTGCTGTGATGGagaggAtTgaggctgttg > SEQ ID NO:1560 120925 50235_300165_1
CCCATCGTCCGTATGGGTCAAGCGATTCGTGAACTGGGTTGGCGTCGATCCGATATCGTCATCTCTACCAAGATCTTCT
GGGGTGGTCCTGGTCCTAACGATAAGGGTTTATCTAGGAAACATATCGTTGAAGGCACTAAAGCTTCTCTCAAACGACT
TGATATGGATTACGTTGATGTGCTCTATTGCCACAGGCCGGATGCTTCAACTCCTATCGAAGAGACTGTGAGGGCGATG
AACTACGTGATTGATAAGGGTTGGGCCTTCTATTGGGGAACCAGTGAATGGTCAGCTCAACAAATTACGGAGGCATGGG
GAG > SEQ ID NO:1561 120933 143382_200009_1
TCTTTAGTGTCTTTTATGCTGGAGTGGTGGCCTCAGGGATAGCATTCGCTGTACAGATATGGTGCATTGACAGAGGTGG
CCCAGTTTTCGTTGCTGTTTATCAACCTGTTCAGACTCTTGTAGTTGCTATTATGGCTTCCGTCGCTTTGGGTGAAGAG
TTCTACTTGGGAGGGATCATTGGAGCAGTGTTGATCATAACAGGATTGTACTTTGTGCTATGGGGCAAAAACGAAGAAT
CCAAATTTGCAAAGGCAGCAGCTGCTGCAATTCAGTCTCCAGTGGATCATTGTAACAACAACAGGCCAACTAGCCATAT
CAAGTCCTCTTTGGCTCAGCCACTGCTTGCTTCTTCAACTGAAAATGCTTAAACAAGAAAAGTTTACTGCAAACCAGAA
AATAAGATCTGCTATCCTAAATATTAAGGAAGAAAAGAAAAAGG > SEQ ID NO:1562 120952 103509_300363_1
cCAAAACAGAGGGAGAGAAAAAAAAAGAAGGAAAAATAAGGCAAAAATCATGTCTGATGAAGAACACCATTTTGAGTC
AAAAGCAGATGCTGGTGCCTCTAAAACTTACCCTCAACAAGCTGGTACCATTCGTAAAAATGGTTATATAGTTATTAAA
GGCAGACCCTGCAAGGTTGTTGAGGTCTCCACTTCAAAAACTGGCAAGCACGGACATGCAAAATGTCACTTTGTAGCAA
TTGATATTTTCAATGGAAAGAAGCTTGAAGATATCGTTCCTTCCTCCCACAACTGTGATGTGCCCCATGTTAATCGTAC
CGACTATCAGCTGATAGACATCTCTGAAGATGGTTTTGTGTCTCTTCTTACTGAAAATGGAAACACTAAAGATGACCTC
AGGCTTCCCACCGATGAAGCCCTGCTGAGCCAGGTTAAAGGTGGATTTGAGGAAGGAAAGGATCTTGTGTTGTCTGTGA
TGTCTGCAATGGGTGAAGAGCAGATTAACGCTGTTAAGGACATTGGTACCAAAAACTAGTTTGCGCTTTCTGCAACATA
AATAATCTGCTTTAGCCAAGACTTTTTATATCTTAATCGTTGTCGTACTTTGATGTCCATTGATTATGAACTCGACTTA
TATCCTATTGGCATGGCTTGAATAGTTGGACTTTATAgtttgtctggtaagacaaagaattggatttgatagcaaagtg
agatctacatgaatgtcacttatccccggtttctatc > SEQ ID NO:1563 120952 209333_300814_1
GCGCCTCCCTCTCTCTCGCTCACCGCCTCCTTCTCCTCGCGATCTATCCAAACAAGGGGCTCGCTAAGATCGGCATGTC
GGACTCTGAGGAGCACCATTTCGAGTCGAAGGCCGACGCTGGGGCGTCCAAGACCTATCCCCAGCAGGCCGGAACCATC
CGCAAGAATGGGTATATTGTTATCAAGAACCGCCCCTGCAAGGTGGTGGAGGTTTCTACCTCGAAGACTGGTAAGCACG
GTCATGCCAAGTGTCACTTTGTTGCCATAGATATATTCAATGGTAAAAAGCTTGAGGATATTGTTCCTTCGTCCCACAA

FIG. 2 continued

```
CTGTGATGTTCCACATGTGAACCGCACAGAGTACCAGCTGATTGACATATCAGAGGATGGATTCGTGAGCCTTCTTACT
GagAGTGGTAACACTAAGGATGATCTTAGACTCCCAACTGATGACAGTCTCCTGGGTCAGATCAAGACTGGATTTGGTG
AAGGCaAGgATCTTGTTGTGACTgtCATGTCCGCCATGGGGGAGGAgCAGATCTGTGCGCTGAaGgacATTGGCCCCAA
GTAACTCCCTCAAGTGGAa > SEQ ID NO:1564 120952 201116_300713_1
gcgatcgcgtcTCTCCCATCCTCTCGCGCATCCTCCTCCGACTACCTCGGTTGGGTTTTGGGGGCGGCTGGAGATGTCG
GACTCCGAGGAGCACCACTTCGAGTCGAAGGCCGACGCCGGCGCGTCCAAGACCTACCCGCAGCAGGCTGGTACTATTC
GCAAGAACGGTCATATTGTCATCAAGAACCGCCCATGCAAGGTTGTTGAGGTCTCCACCTCCAAGACTGGGAAGCATGG
ACATGCAAAATGCCACTTTGTGGCCATTGACATCTTCAATGGGAAGAAGCTTGAAGATATTGTGCCCTCCTCCCACAAC
TGTGACGTCCCCCACGTGAACCGTACTGATTATCAGCTGATTGACATTTCTGAAGATGGATTTGTATGTTTCTTTAGTC
CTTTtaGCTATCTCTTGATTATTTCTCTTTTAGCTATCTCTTGATTATTTCTgAaGATGgatTTGTATGTTTCTTTAGT
CCTTTTAAGATGGATTTgtaTGttTCTTTAGTCCTTTTaAGATGGAttTGTATGttTCTTTAGTCCTTTTAGCTATCTC
TTGAtTATTTCTGAAGATGGAtTTgtaTGttTCTTTAGTCCTTTTagcTATCTCttgattTGgCTCTTGGTATtATtta
gTCTggaatgcaCGTCTCACACattCCACAGGGtcag > SEQ ID NO:1565 120952 188337_300698_1
CGGGAACCCTAGTCGCCGGATCGCGTCTCTCCCATCCTCTCGCGCATCCTCCTCCGACTACCTCGGTTGGGTTTTGGGG
GCGGCTGGAGATGTCGGACTCCGAGGAGCACCACTTCGAGTCGAAGGCCGACGCCGGCGCGTCCAAGACCTACCCGCAG
CAGGCTGGTACTATTCGCAAGAACGGTCATATTGTCATCAAGAACCGCCCATGCAAGGTTGTTGAGGTCTCCACCTCCA
AGACTGGAAAGCATGGACATGCAAAATGCCACTTTGTGGCCATTGACATCTTCAATGGGAAGAAGCTTGAAGATATTGT
GCCCTCCTCCCACAACTGTGACGTCCCCCACGTGAACCGTACTGACTATCAGCTGATTGACATTTCTGAAGATGGATTT
GTCAGCCTCCTGACTGAAAGTGGAGGCACTAAGGATGACCTGAGGCTCCCTAGTGATGGGCTCTGCTTACTCAGATCA
AGGATGGATTCGCCGAGGGGAAGGATCTGATTGTTACCGTGATGTCTGCCATGGGTGAGGAGCAGATCTGCGCTCTGAA
GGATAttggccCCAAGAACTagaaTacctTGttAccGtgttt > SEQ ID NO:1566 120952 188256_300689_1
CTCTCTCTCGCTCACCGCCTCCTTCTCCTCGCGAGGTATCCAAACAAGGGGCTCGCTAAGATCGCCATGTCGGACTCTG
AGGAGCACCATTTCGAGTCGAAGGCCGACGCTGGGGCGTCCAAGACCTATCCCCAGCAGGCCGGAACCATCCGCAAGAA
TGGGTATATTGTTATCAAGAACCGCCCCTGCAAGGTGGTGGAGGTTTCTACCTCGAAGACTGGTAAGCACGGTCATGCC
AAGTGTCACTTTGTTGCCATAGATATATTCAATGGTAAAAAGCTTGAGGATATTGTTCCTTCGTCCCACAACTGTGATG
TTCCACATGTGAACCGCACAGAGTACCAGCTGATTGACATATCAGAGGATGGATTCGTGAGCCTTCTTACTGAGAGCGG
TAACACTAAGGATGATCTTAGACTCCCAACTGATGACAGTCTCCTGGGTCAGATCAAGACTGGATTTGGTGAAGGCAAG
GATCTTGTTGTGACTGTCATGTCTGCCATGGGGG > SEQ ID NO:1567 120952 160004_200028_1
gatcctcctctcccTAAACTTCTCTCCGGTGAAGTGTAAACAAAGAATAGTACATCAAATCAACCATGTCGGACGAAGA
GCACCACTTTGAATCAAAGGCCGACGCCGGAGCTTCAAAGACGTATCCTCAACAAGCTGGTACTATTCGTAAGAATGGT
CATATCGTCATCAAAAACCGCCCTTGCAAGGTTGTTGAAGTTTCCACTTCCAAGACAGGCAAGCACGGTCATGCTAAAT
GCCACTTTGTGGCTATTGACATTTTTACTGGAAAGAAGCTTGAAGATATTGTTCCCTCTTCTCACAACTGTGATGTTCC
TCATGTGAATAGGACTGACTATCAGCTTATTGATATCTCTGAGGATGGATTTGTGAGTCTGTTGACCGAAAATGGTAAC
ACCAAGGATGACTTGAGGCTCCCAACTGATGATAATCTTCTGGCCCTGATCAAAGATGGTTTTGCTGAGGGGAAGGACC
TGGTTCTGTCAGTGATGTCTGCCATGGGAGAGGAGCAGATTTGGTATCAAGGACGTTGGCCCCAAGTAGCTGCAGGA
GGTGGTGGTGTATGTTATAAAGTTTCAAAAAAAGCTGTATCAAAGCTATGTAGAAGTACCAAAACTTCTTTACTTTTTG
TTATTCCAGATAACTGTTATTCAACCATATGGTATGACTGGATTCTTGTGTCCACTACGTGTTTCCTGTTTTCTGATAT
TGCTACCTGTTAGTCTGTCTGCGTGAAAAGCTCTGTTTCTGCATtataaagATAGATTTCTggTtt > SEQ ID NO:1568 120952 157253_301736_1
TCTGACTCCTCTGCATTACACTACTACTTTCGAATCTCTAGCTCCCCCCTTAAATCAAAAAAGTTTAATCAAAAAATTT
TCAATTTCCAGTGATGTCGGACGAGGAGCACCACTTTGAGTCAAAGGCAGATGCCGGTGCATCTAAAACTTACCCTCAA
CAAGCTGGTACTATCCGTAAGAACGGTCATATCGTCATCAAAAGCCGTCCCTGCAAGGTTGTGGAAGTCTCGACATCCA
AAACCGGAAAGCATGGTCATGCAAAATGTCATTTTGTCGCTATTGACATCTTCACTGGAAAGAAGCTTGAGGATATTGT
TCCCTCTTCACACAATTGTGATGTGCCCCATGTTAATCGTACAGATTATCAGCTTATTGACATCTCTGAAGATGGATTT
GTGAGTCTGCTCACTGAGAATGGTAACACCAAGGATGATCTTAGGCTTCCTACTGATGACAACCTCCTTACACAGATCA
AGGATGGTTTTGCTGAGGGAAAAGACCTTGTTGTGTCTGTCATGTCAGCCATGGGCGAGGAGCAGATTTGTGCCCTGAA
GGATATTGGTCCCAAGTAAATCTCTCGATTGGAGATTGTTCGATGCGAAGTTCTTTACAACCTTAAGTTTGATAGATAT
TATAGTCATGGAAAAGGTATGGTCTTATGGACCAACTTGtTCAaGAaTattcttcaggattctcggaCCattgcgAGTT
agattttggtattttgttattttaacttgtgTTCGTCTGAAtttgttcTACCttaaaaGCtTtttcaaaaAAAAaaa
g
```

FIG. 2 continued

> SEQ ID NO:1569 120952 146733_301067_1
gaGAAAGAGAGAGAGAAAGATGTCGGACGAAGAGCACCATTTTGAGTCAAAGGCAGATGCAGGTGCCTCCAAAACTTAC
CCTCAACAAGCTGGTACTATTCGCAAAAATGGTTATATAGTCATCAAAGGCCGCCCCTGCAAGGTTGTTGAGGTCTCCA
CTTCAAAGACTGGCAAGCACGGACATGCTAAGTGTCACTTTGTGGCAATTGACATTTTCAATGGAAAAAAACTTGAAGA
TATCGTTCCTTCGTCCCACAACTGTGATGTGCCACATGTCAATCGTACGGACTATCAGCTGATTGACATCTCTGAAGAT
GGTTTTGTCTCCCTTCTTACTGAAAGTGGAAACACCAAGGATGACCTCCGGCTTCCTACTGATGAAGCTCTGCTGAAGC
AGGTTAAAGATGGGTTTCAGGAAGGAAAGGATCTTGTGGTGTCTGTTATGTCAGCAATGGGGGAAGAGCAGATTAATGC
CGTTAAGGACATTGGTACCAAGAACTAGTTGTCTCTGCAAACTTAAATCGATTGCtAttGTtAagacattAttATATCC
TAATGTCGtaCttCGataTCACttGa > SEQ ID NO:1570 120952 137151_300502_1
cccccggcgcgtggtcaacgagggggcgcggggcaacgggcggtaggcggcgtccagcagcgggcggcgggcggcggc
ggctcggCttcCTCGGCTCGGCGGCCGACAaccacGacggCAGCGgtgGGAGCGCCGCCGCCGCCGACGCCGCCGCGAC
CACCTctcgCAAGGGGATTTTGTAGGGGTTTCTGATCCGAGGAGCGGGCGATGTCGGACTCCGAGGAGCACCACTTCGA
GTCGAAGGCCGACGCCGGCGCCTCCAAGACCTACCCGCAGCAGGCTGGGACCATCCGCAAAAATGGCTACATAGTCATC
AAGAACCGCCCCTGCAAGGTTGTTGAGGTTTCAACCTCTAAAACTGGGAAGCACGGTCACGCCAAGTGCCACTTTGTTG
CAATTGACATCTTTACTGCCAAGAAGCTCGAAGATATTGTGCCATCTTCTCACAACTGtGATGTCCCGCATGTGAACCG
TACGGAGTACCAGCTCATTGATATATCTGAGGATGGATTTGTGAGTCTgttAACTGAAAATGGCAACACCAAGGATGAC
CTCAGGCTCCCTACTGATGATAACCTACTTAGTCAGATCAAGGATGGATTTGGAGaAgGGAaGgacCTGGTGGTGACTg
ttATGTCTGCCATGGGAGAGGAgCAGATCTgcgCGCTGAAGgacATCGGCCCgaagTAAACCTCACCTgttcCATgTga
tTACTACTGAaCTTTCAGTTaTGATCGGTTTgggTATGTAGgAACaaggattctcTTAAAACAtacagagtcaCAACcA > SEQ ID NO:1571 120952 130261_300486_1
GAATTCAAAAAGCTCTGTGAATCTCATTCATCTTGGTCATCATGTCTGACGAAGAGCATCATTTCGAATCAAAGGCCGA
TTCAGGAGCTTCAAAGACTTACCCTCAACAAGCTGGTACCATCCGTAAGAACGGACATATCGTTATCAAGGGCAGAGCC
TGCAAGGTTGTTGAAGTTTCAACCTCCAAAACCGGCAAGCACGGTCATGCTAAGTGTCACTTTGTTGCAATTGATATTT
TCAATGGCAAGAAGCTTGAAGATATTGTGCCATCTTCCCACAATTGTGATATTCCACATGTCAACCGTACTGATTACCA
GTTGATTGATATCTCTGAGGATGGATTTGTGAGTCTCCTCACTGATAATGGTGGCACCAAGGATGATTTGAAGCTACCC
ACTGATGATGTTGTTCTTACCCAGATCAAAGAAGGTTTTGCAGAGGGAAAAGACCTTGTGTTGTCTGTTATGTCTGCCA
TGGGAGAGGAGCAGATCTGTGCTGTCAAGGACATTTCTGGATCCAAATAGAGAAGAACTCTTAGACTTTATTACTGCAG
TCTCTGTTTGTTACTTCATATGGGGAGAAGATGTGAGCTTTAAGTTAATGAGTGGCTATTATTACTGCTATCTTTCTGT
TTTAGGCAGACAAGATCATATAATTATTAGTTTTTCATGGGATGCTTTCTTTTCTTTATTTTAATTTTGGTGGGTTTGG
TTTGCTTGAGACACACATTATCACAAGTATACCTTTTATTAATA > SEQ ID NO:1572 120952 1114482_301845_1
gccttgttTGTCTTTCTCTGGAGTAGTAATGTCTGACGAGGAGCACCAGTTTGAGCACAAGGCCGACGCTGGGGCGTCT
AAGACTTTTCCTCAGCAGGCTGGTACCATCCGTAAGAACTCCCACATCGTCATCAAATCTAGACCTTGCAAGGTTGTTG
AGGTATCCACCTCGAAGACTGGAAAGCACGGGCATGCAAAGTGTCACTTTGTCGCGATTGATATTTTTACCGGCAAGAA
GCTAGAAGATATTGTTCCATCTTCTCACAATTGTGATGTTCCAGAGGTCGTCCGCACTGATTATCAGCTTATTGACATT
TCAGAAGATGGATTTGTGAGCCTTCTCACTGACAATGGCAGCACGAAGGATGACTTACGCCTTCCCTcagATGAGCAGC
TTCTTACGCAGATCAAGgaaggttTTgcagaGGGcaaagatattgtGGTGACTgttaTGTCt > SEQ ID NO:1573 120952 1099824_301451_1
gcggtgttggtGGTGGAGGGGGGTTCGGGGTTCGAGATGTCGGATGAGGAGCACCAGTTCGAGCACAAGGCAGACGCAG
GGGCCTCCAAGACCTTCCCCCAGCAGGCCGGTACCATCCGTAAGAATGCTTACATCGTCATCAAAAATCGCCCTTGCAA
GGTTGTAGAAGTGTCGACCTCTAAGACTGGAAAGCATGGCCATGCCAAATGTCACTTTGTGGCGATTGACATCTTCACT
GGCAAGAAGCTCGAAGATATTGTCCCTTCCTCTCACAATTGTGATGTTCCGGAGGTGACTCGCACTGATTATCAGCTCA
TTGACATTTCTGAAGATGGATTTGTGAGTCTTCTCAAGAGAATGGCAGCACAAAAGGATGATCTGCGTGTTCCAACTGA
TGAAACTCTCCTGGTGCAGATGAAGGAGGGTTTTgCagaAGGTAAAGATCTTGTGGTTACTgtGATGTcGGCCATGGGA
GAAGATCAAATCTGTGCCTTGAAGGACATTGGACCAAAATAGGTCTGTTCAAACCTTGACTAAGATCCCGTGTGgTGCT
CCTTGTGTGGTAGAGGGTGTGTAGGATGAACTCTTTCAACTCTTAGTTgctTTAAtgTggataagaccAAttggcctCT
CAAATAaaagagAaggaTATactggtttagaAATAT > SEQ ID NO:1574 120952 1044239_301916_1
gatttcTTCTGTGCTATAATTGGGCGAGTTCTCGGGGTCTCTTTCTTCCTCTTCTCCCTCTCTCTCTCTCTCTCTCTGA
TCACGAGTGGTTCTCTCTCTCTCTGATCAGGAGTGGTCCCTTGCCTGCCTGTCTGTCTCTCTCTCCCAGAGTGAAGA
TGTCTGATGAGGAGCACCAATTCGAGCACAAGGCAGATGCCGGTGCCTCAAAGACCTTCCCCCAGCAGGCTGGTACCAT
CCGTAAGAACTCCCATATCGTTATCAAAAATCGCCCCTGTAAGGTTGTAGAAGTTTCCACCTCAAAGACTGGGAAGCAC

FIG. 2 continued

```
GGGCATGCTAAGTGTCACTTTGTTGCAATCGACATCTTTACTGGCAAGAAGTTAGAAGATATTGTGCCATCCTCTCACA
ATTGTGATGTCCCAGAGGTTGTTCGTACTGATTATCAGCTTATTGACATTTCAGAGGATGGATTTGTGAGCCTTCTTAC
TGACAATGGAAGCACCAAGGACGACTTACGTCTGCCCTCTGATGAACAGCTTCTTGCACAGTTGAAGGAAGGTTTTGCT
GAAGGCAAGGATCTTGTGGTGTCTGTCATGTCTGCCATGGGAGAAGATCAAATTTGTGGACTGAAGGATGTTGGTCCTA
AATAGTTATTTAGCTCAGTTAATCTAAGGTCATACATACATACATACCTCATCTTGTTTAATGTGTGGCATTAATTGAT
AAGTTGGAGAGCTTAAAAGtgtagtaagaccgctgcctcTTTGAATTcgtataaTct > SEQ ID NO:1575   120952 23509_300390_1
ttaagaataacatctcataagaaactttgaatgtttcaacacaaacttttccaacaatccaaaaccaatagatatggtt
gTCTTGCAACAAGAAACACACACAAAGGGTCTAAATTAGGAAAAAGAAAAACATCTTTTGGTTCTTATAACATTGACGT
CCGTTGTCAAACTGGTAATAATATATCGAATGATACTTGTTTACTTGCCACCACCAACTTCCTTGACGGCACAGATCTG
CTCCTCTCCCATGGAAGACATGACAGACACCACAATATCCTTTCCCTCATCGAATCCAAGCCTCATCTGGGCGGTGAGA
CCATCATCGGTGGGAAGCTTGAGATCATCCTTGGTGCCACCACTGTCAGTGAGAAGGCTCACGAAGCCATCCTCAGTGA
TATCAATCAACTGGTAATCAACACGGTTCACATGTGGAACATCACAATTGTGGGAAGATGGAACAATATCTTCAAGCTT
CTTAGCAGTGAAGATATCAATAGCAACAAAGTGACATTTGGCGTGACCGTGCTTGCCAGTTTTGGAAGTCGAAACCTCA
ACAACCTTGCAGGGACGGTTTTTGATGACGATGTGACCACCTTTACGGATGTTACCGGCTGATTGAGGATAGGTCTTGG
AAGCTCCGGATTCGCTGGCCTCAAAGTGGTGCTCGTCGTCAGACATGTTTTCACAGAAATTTGagagaagaaaggtttt
cggagaagatgagattgggagaagggaaaaaaaacccggacgcgtggg > SEQ ID NO:1576   120952 25875_300495_1
CCCACGCGTCCGCTTTCTCTCTGAAATCTCAAATTCATCTCTTCTCTTCCGATTTCGCTGAATCATGTCAGACGACGAG
CATCACTTCGAATCCAGCGACGCCGGAGCTTCTAAGACTTATCCTCAACAAGCCGGTAACATTCGTAAAGGTGGTCACA
TCGTCATCAAGGGACGTCCCTGCAAGGTGGTTGAGGTATCGACTTCGAAGACTGGGAAGCATGGTCACGCCAAGTGTCA
CTTTGTTGCCATTGATATCTTTACTTCTAAGAAGCTTGAAGATATCGTTCCTTCTTCCCACAATTGTGATGTTCCACAT
GTGAATCGTGTTGATTATCAGTTGATTGATATCTCTGAAGATGGCTTTGTTAGTCTTCTTACTGATAATGGTAGCACTA
AGGATGATCTGAAGCTGCCAACAGATGAAGCTTTACTCACACAGCTCAAGAATGGATTTGAGGAGGGTAAGGATATTGT
TGTGTCTGTCATGTCTGCAATGGGAGAGGAGCAGATGTGTGCTCTCAAGGAAGTTGGTCCCAAGTAATAATAATAAGTA
AGCATTCTCTCTTTTACAGAGGCTATGTATTATCAAGTTTGACAGAGTCAAATGTTATAaag > SEQ ID NO:1577   120952 258413_301696_1
aagaaaAAATGGCTGACGAAGAACACACCTTTGATACCGTTAACGCCGGTGCTTCCCAGACCTACCCCATCCAGTGCTC
CGCTCTGCGAAAGAACGGTCACGTCGTGATCAAGGGCCGACCCTGCAAGATCATTGACATGTCCACCTCCAAGACTGGT
AAGCACGGTCACGCCAAGGTCCACCTTGTCGCCACCGATATCTTCACCAACAAGAAGCTTGAGGATCTGTCCCCCTCCA
CCCACAACATGGAGGTCCCCAACGTCAAGCGAGAGGAGTTCCAGCTCATCGACATTGATGATGGTTTCCTGTCTCTCTT
CACCGCCGACGGTTCCACCAAGGACGATGTTCCTCTTCCCGAGGGTGAGATCGGAGACAAGATCCAGACCGAGTTCGAC
GAGGGCAAGGATCTCATTGTCACTGTCATCTCTGCCATGGGCGAGGAGGCCGTCATCTCCTACAAGGAGGCCCCCAAGG
GTAACTAATCGCATCTCTGACTTGTTTTTACTATAAAAAGTTGTTGGTTTTGAGATTATATATATGCTGTCCACTGAGC
TGTTGGTGACGGTAGTTGTACCTTAGTAGTCATGTAGTAATGAagcTAtgtAcc > SEQ ID NO:1578   120952 243647_301341_1
AGTTAGGGTTGGGGCCAGCAGCGGCGACAATGTCGGACGAGGAGCATCACTTCGACAACAAGGCGGATGCCGGCGCCTC
CAAGACCTATCCCCAGCAGGCGGGCACCATCCGCAAGAATGCCTATATAGTGATCAAGCAGCGCCCCTGCAAGGTCGTT
GAGGTGTCGACTTCCAAGACGGGCAAGCACGGCCACGCTAAATGCCACTTCGTGGGGATTGACATCTTCACCGGGAAGA
AGCTCGAGGATATCGTCCCGTCATCCCACAACTGTGATGTCCCGGAAGTCACCCGCACCGACTACCAGCTGATCGATAT
CTCGGAAGACGGATTTGTGAGCCTGCTCACTGAGAATGGTGACACCAAGGATGACCTCCGTCTTCCCACCGATGACCAG
CTCAACGGGCAGATCTCCTCCGGGTTTTCGGAAGGCAAGGACCTGGTCGTGACCGTCATGTCTGCTCTGGGAGAGGAGC
AGATCTGCGCCATCAAGGACATCGGGCCCAAGTAGCCCAGCGCGCAGCATCAAAAGCCGAGGACCACTGGTTTTGTACC
TGCCTTTTTAAGTCATTTTACTCTATAGTTCGTTCGTTTTCCTTGcaacCTTgttgtaAccAGTgGGGGAcgttcTTTT > SEQ ID NO:1579   120952 227046_301025_1
ACGCGTCCGCGGACGCGTGGGTCTCTCCCACTCCTCCGGATTCTTTCTGTTCTTGGTTGATTGCCGGAGATGTCGGATT
CGGAGGAGCATCACTTCGAGTCCAAGGCCACGCCGGCGCCTCCAAGACCTACCCACAGCAGGCCGGCACCATCCGGAA
GAACGGATATATTGTCATTAAGAACCGCCCCTGCAAGGTGGTTGAGGTCTCTACTTCCAAGACTGGGAAGCATGGTCAC
GCCAAATGCCACTTTGTTGGTATTGACATTTTCAATGGAAAGAAGCTTGAAGATATTGTCCCCTCATCCCACAACTGTG
ACGTTCCTCATGTTGATCGTACTGATTACCAGCTGATTGACATTTCGGAAGATGGATTTGTGAGCCTTTTGACTGAGAG
CGGCAACACTAAGGATGACTTGAGGCTTCCCACTGATGATACTCTGACTAACCAGATCAAGAACGGGTTTGGTGAAGAA
GGCAAGGATATGATCTTGACTGTGATGTCCGCCATGGGTGAAGAACAGATCTGTGCCGTCAAGGAGATTGGGGCCAAAA
ACTAAGCGGCTTTGCTCGATTGCCTGCCTGCCTACGATACTTTGCTATCTTAGTGTTGAGAGCTGAGACACATAAATAG
AAGTTTTTTTATGCTACCTGTGGATGAAATGACATCAAAACCTTCATCGATTTTA
```

FIG. 2 continued

> SEQ ID NO:1580 120979 50493_300171_1
caaaacgttacaatggcttctaaggctcttgcagttacagctcttcttattacacttaatcttcttttcttcacctttg
tAACCTCCACAAAATGTCCACCAACTACTCCTAAACCCCAAAAACCCCGAAATCGCCTAAGAAGGCTCCTGCCGTGAA
ACCCACTTGTCCTACCGACACACTTAAGCTTGGTGTTTGCGCAGACTTATTGGGCCTAGTTAACGTTGTTGTTGGTTCT
CCACCAAAGACTCCTTGTTGTACACTTCTTCAAGGTCTTGCTAATCTTGAAGCTGCGGTTTGTCTCTGCACCGCTCTTA
AAGCCAATGTCTTGGGGATTAATCTCAATGTTCCTATTGATCTAACCTTGCTgttGAACTATTGTGGCAAGAAAGTTCC
TCATGGTTTCCAATGTTCTTGAAGATTTGAGACTTTAAAAGAGAAAAATCTCTTTGGTTTgCTATGTTTTTATATgttt
gttTCTACTgttATCTAttggttTTgtgagaAAAAGCTttgttcTgtcACtgttGaGtTTGATGTAATgcttgAGCttg
ttcATGATagaacctttgttctCTCAATATTGAGTttGATgtaat > SEQ ID NO:1581 120979 107980_300260_1
acttcataaaatcaattttttgttaattaaAAAAATGGCTTCTAACAAGGTTTTCTCTACTCTTGCTATTTTCCTTACTT
TTAACCTAATTTTTTTCACATTTGTTTCTGGTTGTGGAACTTGTCCTAAACCAAAACCGCCACCAAAACCTAAGCCTTC
TTGTCCTCCTCCTCCATATGTTCCAAAAAAGGAAACTTGCCCAATTGATACATTAAAATTAGGTGTTTGTGCTAATGTT
CTTGGATTAGTTAATGTTGTTGTTGGTTCACCACCAGTGAAACCTTGTTGTAGTCTTATTTCAGGACTTGCCGATGTTG
AAGCTGCTCTTTGTCTTTGTACTGCTATTAAGGCTAATGTTTTAGGCATTAATCTTAATGTACCTGTCTCATTGAGTTT
GCTTCTTAATGTTTGCTCCAAGAATGTCCCTTCTGGCTTCCAATGTCCTACTTAATTGAATTAAACGACAGTTCAGTGC
ACAAAGTATCTCGCGCTGACTCAGAAGTCAGATAAGAGTTAAAAATTCAAAGTTTATCTCATTGTTTGTATTTTCTTTG
AGGGTTTTCTATTTTTCATGTCAATTTTTCTTTTTGGAGTTTGGGGTGgggGTgG > SEQ ID NO:1582 120979 124502_301024_1
gtcacAGTAGTGAGTGCATGCAGTACTTGCCCAGGCCCTAAACCTAAACCTAAACCAAAGCCAAAGCCAAAGCCATGCC
CCCCTCCTCCTTCTTCTCATGGTGGCAAATGCCCAACTGATGCCTTAAAACTAGGCGTTTGCGCTAATGTGCTTAACGG
TTTGCTGAATGTTACCCTGGGAACTCCTCCAGTAAAACCATGCTGCAGTCTTATTGGAAATCTTGTGGATTTGGAGGCT
GCTGTCTGCCTTTGCACTGCCCTTAAGGCTAACATTTTGGGCATCAACCTTAATCTCCCTATTTCTCTTAACTTACTGC
TCAATGTTTGTAGTAAGAAGGCTCCAAAGGGATTCACTTGTCCCTAAATGGTTCTCTCGCTTTTCGTTTTTCTTCTGAA
GTTGGTTTTTGATTTTCATTTGTTTAGCAGTTTGTGATGTTCGATTTATCTCCTGCATTAAACTTCTTGTTAGGTGCAA
GGTTGTGGTTTGTTTTGGATTGATCATTGTTGGAAAGCGCTTTTGTAAGGCCAATTGTTTGTGTACCCTTTGGAAATAA
ATATATTTCTTGGATGATTCTCTCT > SEQ ID NO:1583 120979 116840_300515_1
gtagccctgtgtgcaACGGCGCAAGTGCTTGTACGCTTTCAGCTAGCGTAGCCATGGCTTCCAGGGCATTCCTCCTCCT
GGCTCTAAATCTGGTCCTCTTCTTCACCGTGGCCAGCGCCTGCGGCAAGTACTGCCCGACGCCTTCGACGCCGTCGACG
ACGCCATCGACGCCGTCCTACAACACCAAGTGCCCCAAGAACGCGCTCAAGTTCGCGGCGTGCGCCGACGTGCTGGGCC
TCGTCAGCGCCGAGGTCGGCCAGCCGCCGTACGAGCCGTGCTGCGGCGTCCTCGGCGGCCTCGCCGACCTTGAGGCCGC
CGTCTGTCTCTGCACCGCCATCAAGGCCAACGTGCTCGGCATCACCCTCGACATCCCCGTCAAGCTCAGCCTCCTCGTC
AACTACTGCGGCAAGAACGTCCCTAGTGGCTTCATCTGTGCTTAAGCTACGTAACGCGCGTACGGTGTAACGACGTGCT
AGCTTTGCATGCATGCAGCACGCATGCACGAACACATCGTTCGTTCTTGAGTGCCTGCATGCATATCGGTCGAGTCTTT
ACTTACTCTgttaTTAgTTCTGAatgtagaACTgctTCagataTcaat > SEQ ID NO:1584 120979 127691_300471_1
CAACATTTCACTAATTAGCCACATTCAATTGTTGAGAGTGCTAACTATTTAACTCTTAGAAATGGCTAAGTTTGCAATA
TCCTCCATTGCCCTTCTTCTCACTTTGAACATTGTCTTCTTAACTATGGTTAGTTCCACTAATGTCCCATGCCCACCCA
CCCCATCAAAGGGTCATTCCAAGCCCCACCCTAAGCCTACCCCTACCCCCTCTATCCCATCCACCCCATCAACTCCATC
ATCAAAAGGTAAGTGCCCAAAGGACACACTTAAGCTAAAAGTGTGTGCCAACTTATTGAATGACTTGGTGCACCTTGTT
ATTGGAAGTGATCCAGCCAAGACTCCTTGTTGTTCTCTAATTCATGGACTTGCTGATCTTGATGCTGCTGTTTGCCTTT
GCACTGCAATTAAAGCCAATTTATTGGGAATTAACCTCAACGTACCTCTTTCCCTCAGTTTGTTGCTCAACAACTGTGG
AAAGTATGTTCCTAAGGATTTCCAATGCGCATAAACTAGCTAGCCAATAACTTTCTCCCTGCAGAAAATTTCCACTTCA
TATATTTATTTTTCAGTGTGTTTAATTTGGTATTTTGTATGCTTATAGTTTGCTTATGTTTCAAAGGaAGATATATTg
tATTCTAATt > SEQ ID NO:1585 120979 198873_300685_1
aGCAAATATCAAAAAGCAGCTCCAGCTTCTTCTGATCGATCGATCGAGCTGAGCTATAGGCAGTAGCTGCTAATTAAGC
TAATTAATTGCTAAGCAGTAGTAGAGCTAGCTAATTAATTAAGATGGCCGGCAAGAAGGTGCAGGTTTGTGCGCTGTTC
CTTGCCCTCAATGTGCTCTTCACCATGCAGATGGGTGCAGTAGTGCAGGCATGCGAGCCCTACTGCCCCACACCGACGC

FIG. 2 continued

CGCCGGTGACGCCGCCTCCGTCGCCGCCGTCGGGTGGAGGGAATAAGTGCCCGATCGACGCGCTGAAGCTGAGCGTGTG
CGCCAACGTGCTCAACCTGCTGAAGCTGAAGATCGGCGTGCCGGAGAGCGAGCAGTGCTGCCCGTTGCTGGGTGGCCTC
GTCGACCTCGACGCCGCCGTCTGCCTCTGCACCGCCATCAAGGCCAACATCCTCGGCATCAATCTCAACATCCCCGTCG
ATCTCTCTCTCCTTCTCAACTACTGCCACAAGACCTGCCCCTCCGACTTCACCTGCCCTCTCTAAATTAATCGATCCTC
CGATCCCTTAATTACCATACCATTACACCATGCATCAATATCCATATATATATAAACCCTTTCGCACGTACTTATACTA
TGTTTTGTCATACATATATATGTGTCGAACGATCGATCTATCACTGATATGATATGATTGATCCATCAGCCTGATCTCT
GTATCTTGTTATTTGTATACCGTCAAATAAAAGTTTCTTCCACTTGTGTT

> SEQ ID NO:1586 120979 175459_300542_1
CCCCCCCGACCTCTCTCTAGTTGCAGACCATCACTTACGTAGCCCTGTGTGCAACGGCGCAAGTGCTTGTACGCTTTCA
GCTAGCGTAGCCATGGCTTCCAGGGCATTCCTCCTCGTGGCTCTAAACCTGGTCCTCTTCTTCACCGTGGCCAGCGCCT
GCGGCAAGTACTGCCCGACGCCTTCGACGCCGTCGACGACGCCATCGACGCCGTCCTACAACACCAAGTGCCCCAAGAA
CGCGCTCAAGTTCGCGGCGTGCGCCGACGTGCTGGGCCTCGTCAGCGCCGAGGTCGGCCAGCCGCCGTACGAGCCGTGC
TGCCGGCGTCCTCGGCGGCCTCGCCGACCTTGAGGCCGCCGTCTGTCTCTGCACCGCCATCAAGGCCAACGTGCTCGGCA
TCACCCTCGACATCCCCGTCAAGCTCAGCCTCCTCGTCAACTACTGCGGCAAGAACGTCCCTAGTGGCTTCATCTGTGC
TTAAGCTACGTAACGCGCGTACGGTGTAACGACGTGCTAGCTTTGCATGCATGCAGCACGCATGCACGAACACATCGTT
CGTTCTTGAGTGCCTGCATGCATATCGGTCGAGTCTTTACTTACTCt

> SEQ ID NO:1587 120979 175095_300529_1
gctgaagctgggcgtgtgcgccaacgtgctcaacctgctcaagctcaaggtgggggtgcCGGCGAGCGAGGAGTGCTGC
CCGCTGCTGGGGGGGCTCGTCGACCTCGACGCCGCCGTCTGCCTCTGCACCGCCATCAAGGCCAACGTCCTCGGCATCA
ACATCAACGTCCCCGTCGACCTCGTCCTCCTCCTCAACTACTGCCACAAGACCTGCCCTTCCGACTTCTCCTGCCCACT
CATCTGATTCTTAATCTTCATTACCACCACAACCCTAGCTACCTAATTAAGGCTTAAGCTTTGCATGGCTTAGTCTGTG
TGTTGCAGTTGTGTCATACATATATACTTATCTCGATCTATCAGTGTGATTATTGATGATCAGATCTATCATCTAATAT
ATGTATCTTGTTATTTTAATGCGTACTGTCAAATAAAAGTTTCCTCCAGTGTACGTACGTTCTATCT > SEQ ID NO:1588 120979 159618_200050_1
AAAAATCTACTTATAACAACTAAAGTTAGTAGCTATATCATTCATTAAGAAATGGCTTCTAAAAAAACTACTTCTCTTG
CTCTCTTTATTCTTGTCAACCTTCTATTTTTCTCCCTTGTGAGTGCATGTGGCACTTGCCCTAGTCCTAAACCAAAGCC
AAAGCCGAAACCAAAACCAGGTCCTAGCCCATCCAAAGGCAAGTGCCCAATTGATACTCTAAAATTAGGTGTTTGTGCT
AATGTTTTAGGCAATTTGCTTGGACTTTTGATTGGTAATCCTCCAAAAAAACCTTGTTGCACTCTCATTCAAGGTGTTG
CGGACCTTGAGGCTGCTGTTTGCCTATGCACTGCTATTAAAGCCAACATTCTTGGGATTAACCTTAATGTCCCTCTTTC
TCTAAGCCTTCTTCTTAATGTTTGTGGAAAAAAGGTTCCATCTGGCTTCCAGTGTCCTTGAACAGTACAACGTCCACAT
ATTTTGATTTGGGTTTTGGATT > SEQ ID NO:1589 120979 144879_200137_1
TCAGTATTAATACAAAACATAAATCCTCTGCTTCGTTATGGATTCAAAGAGATACTTAGTTACTCTCTTTTTATTCTTT
AACATTCTTTTCTTTACCCTTGTAAGTGGCTGCTGGAGTGGCTGCAATAATCCACCAACTCCAAAACCAAATTCGAACC
CGAACCCAAATCCTAACCCTAGCCCATCAAAGGGACACTGCCCTAGAGATGCCCTAAAACTAGGTGTTTGTGCCAAGGT
GCTGAACGGACCTGTCGGAGCCGTCATCGGAACTCCACCGGACATGCCTTGTTGTTCCGTACTAGGTGGACTTTTGGAT
CTTGAAGCTGCAGTTTGCCTTTGCACTGCACTGAAAGCCAACATTCTTGGAATAAACATTGATATTCCCATTGCATTAA
GCTTGCTTATTAATACTTGTGGGAAAAGTCTACCATCTGACTTCACTTGTGCCTAAGCTATAATGCTTCTCTTTTAAAG
TTCATGTTGTATTTTAGTTCTTCGTTGTTAGGACTTAGGAATGAGCACTTGATAATTTGTACGAAGCTAGGGAATGTTC
TTCCATCTCCTTTGTAATTCACTAGTGCTTTCTCTATTGACTTGATGAATTTCTAATTC > SEQ ID NO:1590 120979 133464_300449_1
CCCACGCGTCCGCCCACGCGTCCGAATTACTTCTCTTTACAATTGTTCTAGGAAGTACATTCTGCCTTAACTTCCTTAT
AATATGGCTTCCAAAACAAGAGCCTCAATTGCCCTTTTCCTCTCCTTCAATCTCCTTTTCTTTGCCATAGCCAGTGGAA
CAGATTGTATCTCATGTCATTATAATTCTCCTAGCACCGGTAATGGTGGTGGCAATAGTGGTAATACTGGTGGCTCGGG
CAATGGCGGCGGAGGTGGCAATGGACAAGGCACGTGCCCGAGAGATGCTCTGAAGTTGGGTGTATGCACAAATTTAGTT
GGTGGATTGGTGGGCGCGGTAGTTGGGAGTCCTCCAACGATGCCATGCTGCAGCTTGATCGCGGGGCTGGCGGATTTAG
AGGCGGCAGTCTGCTTGTGCACAGCCATAAGGGCGAACATGTTGGGAATAAATCTGAATGTGCCACTCTCTCTTAGCCT
TGTCCTCAACAACTGCGGAAGGAATCCTCCTAATGGCTTCACCTGCTAATCCAACGTCCCCAAATGCGTATTTCAGCCT
TTTGCTATGTCAGTCATGTACTCATGTTGTGTTTGCATCAATTTTCCTTTATGATCATTTGTTTGCTATGTTGTGCCAA
TTGTTATTACAATAAGCGATCGAGCTTGCAAAA > SEQ ID NO:1591 121144 197288_300700_1
agaagtaagaaagCAGCTACGTTTACAAGCAGAGATGGAGGCATCCAAGCTAGCAATCTGCAGCTTGTTCGTGCTCGCC
GTGGTAGCCGCTACAATGTTTCACTGCTCCGATGCCCAGAACTCGCCGCAGGACTACCTGTCGCCGCAGAACGCGGCCC

FIG. 2 continued

```
GGTCCGCCGTCGGCGTGGGTCCGATGAGCTGGAGCACGAAGCTGCAGGGGTTCGCGGAGGACTACGCGAGGCAGCGGAA
GGGCGACTGCCGGCTGCAGCACTCGGGCGGGCCGTACGGTGAGAACATCTTCTGGGGCTCCGCCGGCGCCGACTGGACG
GCCGCGGACGCGGTGCGGTCGTGGGTGGACGAGAAGAAGTACTACAACTACGCCAGCAACAGCTGCGCCGCCGGGAAGG
TGTGCGGCCACTACACGCAGGTGGTGTGGCGCGACTCCACCAACGTCGGCTGCGCCCGCGTGCGGTGCGACGCCAACCG
CGGCATCTTCATCATCTGCAACTACGAGCCCCGTGGCAACATCGTTGGCCGCAGGCCCTACTGATCATACGACGTTGTT
GCAACAAGCTATATATATGTGTCTAGCACGCATGCATCGtcCctcgctcgttaCATGCACGCGCTGTGtgtttgTGtta
tGTCTTAATTAgagggAGTAATAAtaacattA > SEQ ID NO:1592 121144 202021_300722_1
GTCGAGCCACGCGTCCGCAACACGAGACAGAAAATGGCACCTTCCAATGTCAGTCTCGCCGGGCGTGCTCGCCGTGGGC
ATCTCTCTGGCCATGGCGGCCACCATCACCACCTCGGCGCAGAACACGCCGGAGGACTACGTCAACCTGCACA > SEQ ID NO:1593 121144 226941_301006_1
cttcgggatcggagtaatgattaatagggacagtcgggggcattcgtatggcatagtcagaggtgaaattcttggattt
aTGAAAGACGAACAACTGCgAAAGCATTTGCCAAGGATGTTTTCATTAATCAAGAACGAAAGTTGGGGGCTCGAAGACG
ATCAGATACCGTCCTAGTCTCAACCATAAACGATGCCGACCAGGgATCGGCGGATGTTGCTTATAGGACTCCGCCGGCA
CCTTATGAGAAATCAAAGTCTTTGGGTTCCGGGGGGAGTATGGTCGCAAGGCTGAAACAACACGAGACAGAAAATGGCA
CCTTCCAAGGTCAGCCTCGCCGCCGTGCTCGCCGTGGCCATCTCGCTGGCCATGGCGGCCACCACCACCACCTCGGCGC
AGAACACGCCGCAGGACTACGTCAACCTGCACAACAGCGCGCGGCGCGCGGACG > SEQ ID NO:1594 122182 129123_300403_1
CCCCCGATCTCAAAGCAAGCAAGACGTCCGGCAAGGATGAAGCGCACCATGGCTGCTACTTCCATCCTGTTCTTCTTCCT
CGCCGGCCTCGCCGCCGCCCACGGCGACAGCGGACGACACCACGACCACCACCACCAACACCATACGCCTCCCGATC
GACGGAGCAGTGGCGGCGCGAAGGAGGACGAGGCCGTGGAAGTGCTGCGACAACATCGTGAGGCTGCCGGAGAGGATCA
ACCCGCCGTTCTGGCAGTGCGACGACGAGCTGGAGCCCGGGCAGTGCTTCCGCCAGTGCGAGGCGTGCCGGGATCCGCC
GGGGCGGCCGTTCCCCGGCCGGCCGCTCATCTGCGACGACGTCTTCTGGGGCGACGACCCGGGCACCTCGTGCGCGCCG
TCGTCGGAGTGGCCGTGGGGCCCGTGCTGCGACATCGCCGTCTGCACCAAGTCGCTCCCTCCCATCTGCCACTGCTCC > SEQ ID NO:1595 122182 198807_300685_1
ccatggcTATTTCCACCATCCTTCTCTTCCTCCTCGCCGGCCTCGTCGCCGCCCACGGCGACGGCGACACCATGATCCG
TCTCCCAAGCGACGGCGCCGAAGCACCACCACGCCCGCCCAAACCCTGGGACTGCTGCGACAACATCGAGATGTCCCCG
CTCGAGATCTTCCCGCCGCTGTACCGCTGCAACGACGAGGTGAAGCAGTGCTCCGCCGCCTGCAAGGAGTGCGTGGAGG
CGCCCGGCGACTTCCCCCGCGGCGCCTTCGTGTGCCGCGACTGGTACTCGACGGTGGACCCGGGCCACATGTGCACGGC
GCCGGATCAGCCGACGACGAAGAGGCCGTGGAAGTGCTGTGACAGCATCGTGCAGCTGCCGCAGAGGATCTTCCCGCCG
TTCTGGCGCTGCGACGACGAGCTGGAGCCCGGCAAGTGCACCGCCGCGTGCAAGTCGTGCAGGGAGGCGCCGGGGCCGT
TCCCGGGGCCGCTCATCTGCGAGGACGTCTACTGGGGCGCCGACCCGGGCCCCTTGTGCACGCCGCGGCCATGGGGGAA
ATGCTGCGACAAGGCCTTCTGCAACAAGATGAACCCGCCGACCTGCCGCTGCATGGACGAGGTGAACAAGTGCGCCGCc
GCGTGc > SEQ ID NO:1596 124883 155851_301360_1
tcttagcaactgctgctcatgatggtgttaaacttgggatttacgcaaatgaagaattccgaaatttctctctttatga
tGAAAATACACCGACTCAATCAGTGCAATTTGACCATAGTGGAAGTTAtctggccTTAGGAGGCTCAGATATACGAGTT
TTCCAAGTCGCCAGTGTTAAGGCTGAATGGAATCACATCAAAACCCtccccttctTATCAGGCACAGGTAAAGCAACAT
GTCTGAAATttgGTCCAGATGCAAAATACATAGCTGTAGGATCTATGGACCGTAATTtaagaATATTTGGGCTGCCTGG
CGAGGATCAAATGGAGAGTTAGGCTCATTTCCAGCATGAAAGCAAACAGTCAGCGCCACAGCTTCGAATCTGCTGAGAC
CACTGTATTATCTCTAGGGGAGAGGTTGATGGGTCCTGTTTTATTATGTAATTCTTCTGGTTTTTGCTAGATCTTTGGG
TGGTCTGGCAAATAGACATACCACCAACTTGGGATAATATCCGAAGTGCaGGGTTTATTTGGTCGTCTCAATACCATCC
TTGGGCAGTCTATTgtATCATt > SEQ ID NO:1597 126117 126125_300460_1
GCCATTACGGCCGGGGATATGGGCTGATATTTCTCTTGGGTTGTATAGGCCAATGTATTTGTTCTGCAGTTTAGTGTTA
ATTAGTTTGGACCAAAGTGCTTATGTATAAATAGTACATAGACCCGACTCATTAGATAGGGAACTATTATTTTCTTTTT
TCAATTAAAATATTTGGAAGCTTC > SEQ ID NO:1598 126149 126247_300461_1
gccattacggccggggaagatggcacttttTatcctttgattatctacaccacaggaaaagcaaagaccaaaattaat
tTATAAAATCTATTTAAAGTACCAAAAATATCTTTAGCAGTGACCAAATTAAGTCGAAAAAAAAATGGCAACTCCTGAA
GAAAACATTGCACCTGCAGCTCCACCACCGCCGGCGGCAGAACCATCAGCGGTGGAGGCTTTAGTGACCACTATTGAAA
CAGCGACCAAACAGGTTGAAACACCGAAGGAAGTCAAGGAGGAGAAGAAAGGAGGAGCACAGGATCTCAAGTTAACCCT
```

FIG. 2 continued

```
TTTGATTCCAGGGGCTGTAGTAGCTGTTGTTGGAGTAGTTCTTGCCATTGTCAAGAAGGTGAAAGAGTCGGCTAATTGA
ATGTAGATCCCTTGTATCGTCAACTTTATATTTCTGTACATTTTTTCCCCCTTTTTGTAAGACGAGCCTAAACTCTTTG
TCAGCTTTGAAGGGAAATAAATAAATTTCATATGCTTTTATTATAATGACTTCTACTTGTATAAATATATGAGCTCTCT
AGCTTTTATTATAATGACTTCTACTTGTATAAATGTATGAGCTCTCTTAGCTTATATCCTCCTCTCTACAGGGTATTTA
TTAGAACTAAAATGCGATTA

> SEQ ID NO:1599  126157 1113075_301794_1
AAAGAATCAAAGGGAGAAAAAAGAGATGGCTGCTAGTTCAACCTGCCTTGGCATTATTAGCACAAGTGGGTTAATTAAC
CCAAGCCTTGGGTCACCCATCAACACCACCAGGGATCGAATCGCCCTGGGGCTAGGCCGTCGCCCTCTACTCATTGTAG
CAGGAAGTGGCAAGAAAAAAATCCAAACCAAGCAGCCCTTTGGGCCATCCGGAGGTACCAATTTCAAGGATGGGTTGGA
TGCATCTGGCCGGAAAATGACGGGCAAGGGGGTGTACCAGTTTAGCAACAAATATGGAGCTAATGTGGATGGATATAGC
CCAATTTACGACTCTGATGATTGGTCACCATCTGGAGATGTTTATGTGGGGGGTACTGGTGGCTTATTGATATGGGCTA
TAACATTAGGAGCAATCCTCCTTGGTGGAGCTCTTCTTGTGTACAACACAAGTGCTCTTGCTCAATAGAAAGGATTTCA
TAATGTTAACTTTCATGAGCTAGTCTTGGAATGGGAATGCACTTGTTGTAAATATGATATCTCCTACTATGTATCTTAT
ATGCTTCTCTAGTGTAATAAAATACCTAATGTGCATTCTTTTAGAAGCCTTTTTTAGAAC

> SEQ ID NO:1600  126157 126679_300465_1
GCCATTACGGCCGGGGACATTTACAGGAAGAAAAGAGAGTATAGGAAATGGCAAGCACAGTAATGAGCCTCAAACCTGC
AGCTTTCAGTGTTGAGAAGACAGCAGTGAAAGGACTGCCATCACTTGCTAGGTCTTCTTCTTCCTTCAGAGTTCAAGCT
AGTGGTGTCAAGAAGCTTAAGACCGACAAGCCTTACGGAATTAATGGAAGCATGAGCTTGAGAGACGGCGTTGATGCCT
CAGGCAGGAAGCCCAAGGGAAAGGGTGTTTACCAATTCGTTGACAAATATGGAGCAAATGTTGATGGATACAGCCCCAT
CTACAACACAGATGCTGGTCTCCAAGCGGTGATGTCTATGTTGGAGGCACCACTGGCTTAGCCATATGGGCAGTCACC
TTGGTTGGCATTCTGGCTGGAGGTGCTCTCCTTGTTTTCAACACAAGTGCTTTGGCACAGTAGATCATTATCCTTGTAC
TCCTATTTCAGTTGTATTCCAGCTCGCACCCATGTATCTTTTCAAGAATACTTTGTATTTGCTGGCATCTTGATTAATCT
GTAATTGCTGTGGATATTACACATAATGTTGATTATTTAAGGTATTTGTGATC

> SEQ ID NO:1601  126157 181877_300657_1
gaattcaggcaacaactccattccaagagaaagttgctagcagtattcaaggccttccatccctagcaaggtcggccac
tTCACTCAGAATTTCTGCCAATCAAGTTAAGAAGATCAAGACTGACACACCTATATGGAACTGGTGGTGGCATGAACTTG
AGGGGTGGTGTTGACGCATCTGGAAGAAAGCCCACGGGAAAGGTGTCTACCAATACACCGACAAATACGGTGCTAACG
TTGATGGATACAGTCCAATCTACACCCCAGAGGAATGGTCCGAAAGTGGTGATAGGTACGCTGGAGGTGTAACTGGTCT
AGCAATTTGGGCAGCAACTCTTGGTGGTATTCTACTTGGAGGAGCTCTCCTTGTTTACAACACCAGTGCTCTAGCTTCT
TAGATGTCAATCAAATTGTTGTAATCCCATGTGGTAGTTCCTGTGTATGTTTTCAACAAGATTTCCTAAGTAAATGGTT
GTCTAATACTCTCTTGTACACCCAAAACTTATTCGTAATTTGTATGAATTTGGTTGATGATA > SEQ ID NO:1602  126157 191562_300702_1
cccccgACCAAAGGTTTTTGGCGCCACAATTATATTGAGCTGCCATTGCTTCTCACCTCTGCTTTGCATCCATCCATC
CATCAGAGATCAGGTAGAACAGTGAGAGTGAGGTGCAGAAAAATTTGAGCTGAAGCTGAGGATGGCAACATCCATGATC
ACCTCGCCGCTGGTGGCGCCGGCCCGGGCCAAGGGCCTTCCGTCCATCTCCCGCCGGGGATCCTCCTTCGCCATCGTCT
GCAGCGGTGGGAAGAAGATCAAGACCGACAAGCCCTACGGGATTGGAGGTGGCATGTCAGTCGATATTGATGCATCTGG
CAGGAAGAGCACGGGGAAGGGTGTGTACCAATTCGTTGACAAGTACGGCGCAAACGTCGACGGCTACAGCCCAATCTAC
TCGCCGGAGGAATGGTCTCCCACCGGTGACACCTACGTTGGTGGAACCACCGGGCTTCTGATCTGGGCCGTGACCCTCG
CCGGGCTCCTCGGCGGCGGCGCCCTCCTCGTCTACAACACCAGCGCCCTCGCCGGCTAAATTTCACCCAAATCCAGTCT
ATGTATGTAACACCAAGCTGGGTGTCTGCATATTCATCTGTAATCTAAGATAGCCTTCCTCTGAATGCGATGTGATGAT
GCCCACTGcTTAATCAAACtgcattgtgattaaTCTATGTaACACtgtaCTTgcatgatgAtgatATACTACACTTGAT
ACttg > SEQ ID NO:1603  126157 170291_300531_1
ccccaaaaaaaggttttggcgccacaatggtattgagctgccattgcttctcacctctgctttgCATCCATCCATCCA
TCAGAGATCAGGTAGAACAGTGAGAGTGAGGTGCAGAAAAATTTGAACTGAAGCTGAGGATGGCAACATCCATGATCAC
CTCGCCGCTGGTGGCGCCGGCCCGGGCCAAGGGCCTTCCGTCCATCTCCCGCCGGGGATCCTCCTTCGCCATCGTCTGC
AGCGGTGGGAAGAAGATCAAGACCGACAAGCCCTACGGGATTGGAGGTGGCATGTCAGTCGATATTGATGCATCTGGCA
GGAAGAGCACGGGGAAGGGTGTGTACCAATTCGTTGACAAGTACGGCGCAAACGTCGACGGCTACAGCCCAATCTACTC
GCCGGAGGAATGGTCTCCCACCGGTGACACCTACGTTGGTGGAACCACCGGGCTTCTGATCTGGGCCGTGACCCTCGCC
GGGCTCCTCGGCGGCGGCGCCCTCCTCGTCTACAACACCAGCGCCCTCGCCGGCTAAATTTCACCCAAATCCAGTCTAT
GTATGTAACACCAAGCTGGGTGTCTGCATATTCATCTGTAATCTAAGATAGCCTTCCTCTGAATGCGATGTGATGATGC
CCACTGCTTAATCAAACTGCATTGTGATTAATCTATGTAACACTGTACTTGCATGATGATGATATACTACACTTgatac
t
```

FIG. 2 continued

> SEQ ID NO:1604 126157 255862_301645_1
tcggGGAGAAAAAAGAGATGGCTGCTAGTTCAACCTGCCTTGGCATTATTAGCACAAGTGGGTTAATTAACCCAAGCCT
TGGGTCACCCATCAACACCACCAgggatcGAATCGCCCTGGGGCTAGGCCGTCGCCCTCTACTCATTGTAGCAGGAAGT
GGCAAGAAAAAAATCCAAACCAAGCAGCCCTTTGGGCCATCCGGAGGTACCAATTTCAAGGATGGGTTGGATGCATCTG
GCCGGAAAATGACGGGCAAGGGGGTGTACCAGTTTAGCAACAAATATGGAGCTAATGTGGATGGATATAGCCCAATTTA
CGACTCTGATGATTGGTCACCATCTGGAGATGTTTATGTGGGGGGTACTGGTGGCTTATTGATATGGGCTATAACATTA
GGAGCAATCCTCCTTGGTGGAGCTCTTCTTGTGTACAACACAAGTGCTCTTGCTCAATAGAAAGGATTTCATAATGTTA
ACTTTCATGAGCTAGTCTTGGAATGGGAATGCACTTGTTGTAAATATGATATCTCCTACTATGTATCTTATATGCTTCT
CTAGTGTAATAAAATACCTAATGTGCATTCTTTC > SEQ ID NO:1605 126157 39330_300198_1
CCCACGCGTCCGGAGAGAAGAATAGTTTGATCATCTTGTGAGAAAAATAATGGCTGCTTCAGTGATGCTATCTTCGGTG
ACATTGAAACCAGCTGGTTTCACGGTGGAGAAGACGGCGGCTAGAGGATTACCGTCGCTCACAAGAGCTCGTCCCTCCT
TCAAAATTGTCGCCAGTGGCGTCAAGAAGATCAAGACCGACAAGCCCTTCGGAATTAACGGCAGCATGGACTTGAGGGA
CGGCGTCGACGCCTCCGGCAGAAAGGGCAAGGGATACGGTGTTTACAAGTACGTCGACAAGTATGGAGCTAACGTCGAT
GGATACAGTCCTATTTACAACGAGAACGAGTGGTCAGCGAGTGGTGACGTGTACAAGGGAGGAGTCACCGGATTGGCAA
TTTGGGCGGTAACTCTCGCCGGAATTCTTGCCGGAGGTGCTCTTCTTGTGTACAACACAAgtGCttTggctCagtAAAT
CTTAAagtTGTTagcGCATGTGTAATCAtgtttCTATAAATg > SEQ ID NO:1606 126157 8234_300304_1
cggccgCAGTGATGCTATCTTCGGTGACATTGAAACCAGCTGGTTTCACGGTGGAGAAGACGGCGGCTAGAGGATTACC
GTCGCTCACAAGAGCTCGTCCCTCCTTCAAAATTGTCGCCAGTGGCGTCAAGAAGATCAAGACCGACAAGCCCTTCGGA
ATTAACGGCAGCATGGACTTGAGGGACGGCGTCGACGCCTCCGGCAGAAAGGGCAAGGGATACGGTGTTTACAAGTACG
TCGACAAGTATGGAGCTAACGTCGATGGATACAGTCCTATTTACAACGAGAACGAGTGGTCAGCGAGTGGTGACGTGTA
CAAGGGAGGAGTCACCGGATTGGCAATTTGGGCggtaacTCTCGCCGGAATTCTTGCCGgAggtGCTCTTCTTGtgtAC
AACacaagTGCTTTggctcaGTAAaTCttaaagttgtTAGCGCAT > SEQ ID NO:1607 126157 44835_300133_1
gccattacggccgggCAGGAAGAAAAGAGAGTATAGGAAATGGCAAGCACAGTAATGAGCCTCAAACCTGCAGCTTTCA
GTGTTGAgaagacagcagTgAAAGGACTGCCatCACTTGCTagggcTtCTTCTTCCTtCAGagttCAATCTAGtggtgc
tTTGGCAcagtagaTCgtTATccttgtactCCTaGTTAGttgtaTTCcagctcGcacCatgtatCTTTTcaaGaatAct
ttgtaTTAATctgtaATTgctgtgGATATTACAcatAatgttgattATttaaggtaTTTgcgata > SEQ ID NO:1608 126157 259831_301709_1
GAAAGAGAGTGAGAGAGCTCGAGCAATGGCGGCAGTGTTGGAGAGCTCGGCCTTCTGCGGCTCGGCCCTGGCAGCAGCA
GCACCAGCTCGGGGCCTCCCCGCATTGAGCAGCAGCAGGCTCACCGTGAGAGCCAGCGGCGGCAAGAAGATCTCGACGA
AAACACCTCTAGGACCTTCTGGGGACCTCAGTTTTAAGTCTGACGCGATGCTTCTGGACGTGGCACCACGGGAAAGGG
CGTGTATCAATTCACAAAGAAATACGGAGCTAACGTGGATGGATACAGTCCGATCTATACTCCGGACGAATGGTCGCCT
TCGGGAGACGTTTACACGGGTGGCCAGACTGGGCTTTTGCTATGGGCAGTAACGCTGGGAGGTATACTACTGGCCGGTG
TGTTCCTCGTATACAGTACTAGTGCTCTCGCAAGCTAAATCGTGTAAACGTTATATTGTCAAAAGCGAGCAAAAGGA
TTATTTCCATACCTTGTCCATAGCTTGGACACGACTTCAATGTAGATAAAGGTTGTATTAATATTTACAAATATATCGT
ATTTTCTTACCaaaaaac > SEQ ID NO:1609 126335 254830_301639_1
ACGCGTCGAGCTGAAGGTTACCATGAGTTGTCAAGGATGTGTTGGGGCTGTTAAAAGGGTGCTTGATAAGATGGAAGGA
GTGGAATCGTATGATATTGACTTGAAGGAGCAAAAAGTAGTGGTGAAGGGCAATGCGAAACCAGAGGATGTGTTCAACA
CGGTCTCCAAGACGGGGAAGGCCACATCATACTGGCCTACAGAACAAGTGGTAGCAGCATGATATGTGTGTAGACCCTT
TTAAGAAGTTGCTAGATTCTAGTAGCTTATAACCTACATGGCCTAAATGCTTCTATTGTATTGATAAGGTATAAATAAT
ATAATTATGCAAATCTTTGTC > SEQ ID NO:1610 126335 271492_200034_1
gtttcttcccacgaaagtaaaaatctccctcattttTCCCCCTACTACTTTTCATCATCATGTCTCAGACCGTTGTTCT
CAAGGTTGGCATGTCATGCCAAGGCTGTGTAGGAGCTGTGAACAGAGTTTTGGGGAAAATGGAAGGTGTTGAATCTTAT
GACATTGATATTAAGGAGCAAAAAGTGACTGTAAAAGGAAATGTGGAGCCAGAAGCTGTTTTCCAGACTGTTTCAAAGA
CTGGAAAGAAGACTTCTTTCTGGGAAGCAGAAACACCAGCACCAGCACCAGCACCAACTGAACCCGAAACAAAGCCCGT
TGAAGTAAAGCCCACAGAAGAAAAGCCTGCAGATACACCAGCTGAACCCGAAGCTAAGCCCGCAGACGAAAGCCAGCA
GAAGCTGTTGCTTGATGATACTGATATATATATCAAGCTTAAAGCAGAATGTGATATGTAACAGTTAATCAGCTCTTAA
ATAACGTGTTACTAATTTTTGCGTTTGGTTTTTATTGTAATAATATAGATAAGAAGTCCTGTTATCTACTGAAAAGAAC

FIG. 2 continued

TACTTCAGTATACTGGAGTGTATTGttTaACTAGTCTACTGGATTTGCAGACTCTTGATTGTTTTTACGGAGTGATGAT
TTTActaatcaaaTGGAGAttAcggAcCcTAttATAtGgt > SEQ ID NO:1611 126335 279235_200060_1
CTCAAGGTTGGCATGTCATGCCAAGGCTGCGTAGGAACTGTGAACAGAGTTTTCGGGGAAAATGGAAGGTGTTGAATCT
TATTACATTCGATATTAAGGAGCATGAAGTGTCTGTAAAAGGAAATGTAGAGCCAGAAGCTGTTTTCCAGACTGACTCAA
ACACTGCAAAGAAGACTTCTTTCTGGGAA > SEQ ID NO:1612 126335 1097596_301445_1
GCAAGAATTCGCTACACAAGAATCATGGCTAACGAGATAGTGGAGCTAAAGGTTCATACAATAGTGGAGTTAAAGGTTG
AGATGAGTTGTCAAGGATGTGTTGGGGCAGTCAAAAGGGTCATTGAAAAGATGGAAGGAGTTGAAAGTTATGATATCGA
CTTAAAGGAGAATAAGGTTGTCATCAAGGGTACCGTAAAACCAGAGGATGTGTTCAACACAATCTATAAGACAGGAAAG
ACCACAACCTTTTGGCCTAAAGAAGAATAAGAAGAGCATGGCATTATATTGTAACTCCAACTCTTGGGAACTAAATATT
CTATTACATTTTGATAGAAATAATGTAAAACCAATGCTAGTACTATATTGCATCGATTATGTTAAATGACCTTAAATTG
TCTTTACTATGCTAAATTTATGTG > SEQ ID NO:1613 126335 1100561_301461_1
GAAGAAGCACTAAGCAAGAGTCCATCCATATACAATGGCTACTCAGACTGTGGAGCTGAAGGTTACCATGAGTTGTCAA
GGATGTGTTGGGGCTGTTAAAAGGGTGCTTGATAAGATGGAAGGAGTGGAATCGTATGATATTGACTTGAAGGAGCAAA
AAGTAGTGGTGAAGGGCAATGCGAAACCAGAGGATGTGTTCAACACGGTCTCCAAGACGGGGAAGGCCACATCATACTG
GCCTACAGAACAAGTGGTAGCAGCATGATATGTGTGTAGCACCCTTTTAAGAAGTTGCTAGATTCTAGTAGCTTATAACC
TACATGGCCTAAATGCTTCTATTGTATTGATAAGGTATAAATAATATAATTATGCAAATCTTTGTCAAAATAATTGTCT
TACACTATGAAAACAATCATTCTAGTTTTCCATAATTAATTTCAAAG > SEQ ID NO:1614 126335 1102023_301478_1
GCACCACCAAGCTTTGGATATGGCCACGGAGACTGTGGAACTGAAGGTTGAGATGACTTGTGAAGGCTGTGTTGGAGCA
GTCAAAAGAGTCTTAAACAAAATGCAAGGGGTGGAATCTTATGAAGTGGATTTGAAAGAGAAAAAGGTAATTGTGAAGG
GGAATGTTAAGCCTGAAGATGTCCTCAAAACAGTTTCCAAAACTGGCAAGGCTACTCAGTATTGGCCAAAAGAGTAGGG
AGGAAGCAAATGTCTAAAGCATAGCCTATTCTTATTTATAAATAGACTATATGCCTGAACTAAATGGAAATCTCAATTA
AGTCTTTGAATAAATTTTCTGTCGTTAATTATAAACATATAACCTAAAAGTTTGGGATTTTCTTTGATTTGGCTAACAA
AAAACCACAAC > SEQ ID NO:1615 126335 147156_301205_1
ATACACTAGTTTCTTCCCAAAAAAAGCAAAAGCTCCCTCAGTTTTTTCTCCTTCGTACATTTCATCATTATGTCTCAGA
CCGTGTTCTCAAAGTTGGCATGTCATGTCAAGGCTGTGTAGGAGCCGTGAACAGGGTTTTAGGGAAAATGGAAGGTGTT
GAATCTTATGACATCGATATTAAGGAGCAAAAAGTGACAGTGAAGGGAAATGTGGAGCCAGAAGCTGTTTTCCAAACTG
TTTCTAAGACTGGAAAGAAGACTTCTTTTTGGGAAGCAGCAGCACCAGCACCAGAAGCAGCACCAGCACCAGCACCATC
ACCAGAAGCCGCACCAGCACCAGCTGAACCTGAAGTAAAGCCTGCTGAAGTAAAGCCTGTGGATACACCAGCTGAACCC
GAAGCAAAGCCCGCAGATGAAAAAACTACCGAAGCTGTTGCTGCAGCCTGATGATACTAAAATATATATCACGCTTATG
ATTTATGCAACTTTAATATGTAACAGTTAATCAGAGCTTAAATGATG > SEQ ID NO:1616 126335 128888_300478_1
cccccccctggcaccattcaaaggtccaagttttctctCTTGACTTTTTGTATCAAACCATTTTCTTCTTCAAAAACCT
CTCAAGTTTCTTCTCATCATCATGTCTCAAACTGTTGTTCTCAAGGTTGGCATGTCATGCCAAGGCTGTGTAGGGGCTG
TAAAAAGGGTGTTGGGCAAAATGGAAGGTGTAAAAAACTTTGACATTGATCTGAAGGAGCAAAAAGTGACAGTAAAGGG
AAATGTTCAACCAGAAGCTGTTCTCCAGACTGTTTCAAAGACTGGAAAGCCAATATCTTTCTGGGAAGCAGGGGAACCG
GCTCAAACAGAAGAAAAACCTGCAGAAGCTGTTGGTACAGCTTAATTATGTCTAATGGCGTGGAATTGTATGTTAAGGC
TTGTGCTTTATACGACTTTATCAAGAATTCCTTTGTGTAATATGAGGCTTGAACAGTTAAAATCTAAATTGCAATAAGT
TCTTGAGC > SEQ ID NO:1617 126367 119053_300066_1
tATTTTTATTCCGTCAGCTGTTTAGCAAGAGAAGAGAGCAAAAAATGGTGTCAGTTTCAGGGATCTCCGCAAGGAGGGT
GGTGGTTGACGCTCGCCACCATATGTTGGGACGATTAGCTTCAATTTTGGCTAAGGAATTGTTGAATGGACAGAGAGTT
GTGGTTGTTAGGTGTGAAGAGATTTGTTTATCAGGGGGACTTGTGAGACAGAAAATGAAGTATTTGAGGTTTCTTCGTA
AGAGGATGAATACTAAGCCTTCTCATGGTCCTATTCACTTTCGTGCTCCTTCTAAGATCCTCTGGCGTACCATCCGTGG
GATGATTCCCCACAAAACTAAGCGTGGAGCTGCTGCACTTGCCCGCTTGAAAGTGTATGAAGGTGTTCCACCACCATAT
GACAAAGTCAAGAGAATGGTCATTCCTGATGCTCTTAAGGTATTGAGGCTCCAAGCAGGACATAAATACTGTCTCTTGG
GCAAGCTTTCATCAGAGGTTGGGTGGAACCATTATGACACTATTAAGGAACTTGAGAACAAGAGAAAGGAGAGAGCCCA
AGTTGCATATGAGAGGAGAAAGCAGTTGGCTAAACTGAGAGTTAAGGCCGAGAAAGCTGCCGAGGAGAAGCTCGGTCCA

```
CAGCTTGCTGTTATTGAACCTATCAAGTATTAGAGTGCAAATTTAGTAGTTATCTGAGGTGAAATTTTGCTGGAGATTG
AGATTTCAGCTTATCTGTTTTTTTAAAAGTTGTACCGCATGGTTTGGTATTTTGCTTCTAGCAATATTTGAGCAGACTT
TAAATTGTTTTAACTATCTTTTTGAAGTTACAATTCTCTCATGGTTTTATTGGTACAGCTTTGTTTTCTACTCCTTGAT
AGTTTGCATCTATAAGATGAATGACTCCATTGAGCTGAGTCTCTATTAGAAAT

> SEQ ID NO:1618 126375 104488_300364_1
gaggtactaatggtaattttctaatcttgcaaattgttaaatatacatgaaaattaacacaactaaaagcaggtaaTAA
GGAGATGAAAGTTGCTATGCTAAGCAAATCAAAGTCATTGACTAGAAGTTGCAACATGGCATCTTTTATGAGAACAAAA
GAGTTACATATGAAAATAAATGCTCATCAAACTTTTTTGAAATAATGAGATTGAGGAGTTTAGGCAGTGAGCTCCTCCT
CCTTGTGTGTCTCAATAGTAACATCAGACTGTGGGTAAGCAACACAAGTTAGAACAAATCCATCAGCCATTTGGTCATC
ATCAAGAAAGTTTCCATCAGACTGATCAACATTTCCAGCTGTAACTTTTCCAGCACAAGAAGAGCAAGAACCAGCTCTG
CATGAGTAAGGAAGATCATGTCCCATTTCCTCAGCTTGATCAAGAATGTAAACATCATCGGGACAATCAAACTCAACAG
CTCCTTCTGGTGTAATAAGCTTCACTTTGTAACTGGCCATGCAAGTAATCCTACCACCCCTCTGAGATTTAAGACCAAA
GAGAGCTTGCCCAACATTTGGTATGGCTTTCAGGCTAGTCACTGCTGGTTTCCTTGGGAGGAAAGAGGTgctaaccatg
gtacctgaaatactggccattttttacaaaccttttctttgttttgctttgctctccccggccgtaatggc > SEQ ID NO:1619 126375 1099121_301488_1
GTGTCGGCCACCGCACCCACTCGCGCACGCTCGCTAAGTGAAACCAAGCTCGTAAACCACGCCGCCATCCATGGCTTCC
CTCGCCTTCGCATCCCTGCATCCACCGCCACCTCCGCGCCCGCACCGTTCAAGATGGCCGGTTTCGCCTCTGGCCCTC
GTAGCCTCCCATGCCCCACCCCCGCCTTCGTTTCGTGGCCCTCCCCCGCCGTCCGTATAAACGTCGCGATGGCTTACAA
GACCGTTCTGAAGACCCCCTCCGGCGAGTTCACCCTCGACGTCCCCGAGGGTACCACCATCCTCGATGCCGCTGAGGAG
GCCGGCTACGACCTTCCCTTCTCCTGCCGTGCCGGCGCGTGCTCCTCCTGCCTGGGCAAGGTTGTATCGGGCTCTGTCG
ACCAGTCCGAGGGCTCCTTCCTCGACGACGGCCAGATGGAGGAAGGGTTCGTCCTGACCTGCATTGCCATCCCTGAGTC
CGACCTCGTGATCGAGACCCACAAAGAGGAAGAGCTCTTTTAAGCCCCCACACCCACATCCAAACCCACACACTCATA
CCCATTGTTTAGGACTATG > SEQ ID NO:1620 126375 116544_300078_1
CCTCCTCGTCTACCTTACCTAGCAGCAGCAGCTAGCTAGCTGAATTAGCTATAGCAGCCATGGCGGCGACGGCACTGAG
CAGCCAGGTCCGGTTGCCGATGTCCCTGCGGGTGGCGACGGCGCCGGCGCCGGCGCGCGTGTCGGTGCTGCCGGCGAGC
AACAAGCTGGGAGACAGGCTGCGGATGCAGGCGACGTACAACGTGAAGCTGATCACACCGGACGGCGAGGTGGAGCTGC
AGGTGCCGGACGACGTGTACATCCTGGACCAGGCGGAGGAGCGGAAGGGATCGACCTGCCTTACTCCTGCCGCGCGGGCTC
CTGCTCCTCCTGCGCCGGCAAGGTGGTCTCCGGCGAGATCGACCAGTCCGACCAGAGCTTCCTCGACGACGACCAGGTT
GCCGCCGGCTGGGTCCTCACCTGCCACGCCTACCCCAAGTCCGACGTCGTCATCGAGACCCACAAGGAGGACGACCTCA
TCTAATCAATCAAGCAAGCTCCATATTTATAAATCTCTCGATCCATCTCCATGCGTTCTTGAGTTTATCAATTAAGAAT
ATAATGTCGTCGTCCCTATGCTATGCAAGCAAAGTATTACGTACGTATATGTTGAGCGAGATAACAAAACAACAGCGTG
CCCGAGGGTTAATTGTTGTTGTTTAATTAATGTACGTTTTGCTGCACCTGCTTAATCATATCCATATCACATTTT > SEQ ID NO:1621 126375 126479_300463_1
GCCATTACGGCCGGGAAAGAAAAATCTTGAAAAAATGGCGGGGATTTTATGTACCATGGTTAGCACCTCTTTCCTACCA
AGGAAACCATTAGTGACTATCCTGAAAGCCATACCAAATGTTGGGCAAGCTCTCTGTGGTCTTAAATCTCATAGGGGTG
GAAGGATTACTT > SEQ ID NO:1622 126375 155843_301360_1
AAAACACATAGCTCTGTTTGGACTCATCTTGAGCCTCTCCTCGATAACTCCGCTTAATCCTCAAACTGTAAACATGTCA
ACTGTCAGACTTCCTGCCACCTGTGTGGTAAAAATTGTTCCTCAGACCCAAAGAAAGAGCGTTTTTATAAAGAGCCCAT
CGTCTCTAGGGTCTGCGAGGAGCATTTCTAAAGCCTTTGGATTGAAAGCTAACTGTGCCTTTAGAGCATCAGCATCAGC
AGTGTACAAGGTCAAGTTGGTTTGTCCAGATGGTGTAGAGCATGAATTCGTGGCACCTTCGGATGCTTACATCCTCGAT
GCAGCTGAGAATGCTgGAGTCGAACTCCCTTATTCTTGCAGGGCAGGTGCTTGCTCAACATGCGCTGGGAAGATTGTAT
CGGGATCTGTTGATCAATCTGATGGTTCTTTTCTGgATGATAATCAAATTGAGGAAGGCTATTTGCTCACCTGTGTTTC
TTACCCAACATCAgaTtGTGTGATTCATACTCACAAGGAATCTGATCTTTACTAGTTATTTTtaTGTCAAATAATGTCT
ATGGTCTTGCTTAAGGTGAAGCAGTTGGAAAattgctcTGTTctTGAGAATGGGGTCAGCTGTAGAGTTCAATCAATCG
GGAACA > SEQ ID NO:1623 126375 131040_300510_1
gaattCACAACCTCAAACTTGTTAGCTACAACTTCTCCATTTCTCTCATCTTATTAGAAAAATGGCAGCAACACTTTCA
GGTCCCATGGTTAGTACCTCATTCATCAGAAAACAACCCGTAACAAGTCTTCGTTCAATCTCTAACGTAAGCCAAGCTA
TGTTCGGGCTAAAATCCAGCCGTGGTGGTAGAATAACCGCAATGGCTACATACAAAGTGACCCTAGTTACACCCGAGGG
AAAACAAGAATTCGACTGTCCAGATGATGTCTACATTCTTGACCATGCTGAAGAAGTTGGAATCGATCTTCCTTACTCA
TGCCGTGCAGGTTCCTGTTCTTCATGCGCCGGGAAAGTCACTGGAGGAACACTCGACCAATCTGATGGTAGTTTCCTTG
```

FIG. 2 continued

```
ATGATGAGCAGATTGAAGAGGGTTGGGTGTTGACTTGTGTCGCATACCCAACATCCGATGTCACCATTGAGACTCACAA
GGAGGAAGAACTAACTGCTTAATTAGTTGTCCCTTCTTCAATTAATTCATGACATTTTTCATTATGTTTCATTTTAAGA
CAATATGTGGTTGTGGTGGTgttcTgAATCCTATcTAAATtttttctatttGTCTTGAttGATTGTCTTATGAGaaCATG
ag
```

> SEQ ID NO:1624   126375 207519_300806_1
```
cttgacccaaccCAACCTACCTCGCGATCCCCCCCTCCTCCGCCGCCGTCTCGTCGAGAGAGAGAGAGAGAGAAGGACT
ATCGAGATGGCAACTGCAACTGCTCCGAGATTGTGCTTTCCTAAACCCGGCGCGGCCATTGCTCCGGCGACCAAGAGCC
CTTCCTTCATTGGTTACGCAAAGCAAACATTGAACATGTCAGGCCTAAGGATCTCCAACAAGTTCAGGGTGTCCGCGAC
AGCGGTGCACAAGGTAAAGCTTATAGGCCCGGACGGTGTCGAGCACGAGTTTGAAGCCCCTGAAGATACCTACATTCTC
GAGGCCGCTGAAACTGCCGGGGTGGAGCTGCCATTCTCATGCCGTGCTGGATCATGCTCCACATGTGCGGGTAAGATGT
CATCGGGAGAAGTTGATCAGTCGGAAGGATCCTTCCTCGACGAGAACCAGATGGGCGAGGGATACGTTCTGACATGCAT
TTCGTACCCTAAGGCGGATTGCGTCATTCACACCCACAAGGAGGAAGAACTCTACTAGGTCGCTCTTTTTATGCTTCTG
TGGGCACATTTGCTGATTTCAAAGTGGACTCGCTGTTcagTTAGTTTTCGCTATCcAAAAAAtggccaTATCttTGTAT
TAgtcttttgATg
```

> SEQ ID NO:1625   126375 202061_300722_1
```
ctagctCACTCCTCTCCTCCTCGTCTACCTTACCTAGCAGCAgcagCTAGCTAGCTTAATTAGCTATAGCAGCCATGGC
GGCGACGGCACTGAGCAGCCAGGTCCGGTTGCCGATGTCCCTGCGGGTGGCGACGGCGCCGGCGCCGGCGCGCGTGTCG
GTGCTGCCGGCGAGCAACAAGCTGGGAGACAGGCTGCGGATGCAGGCGACGTACAACGTGAAGCTGATCACACCGGACG
GCGAGGTGGAGCTGCAGGTGCCGGACGACGTGTACATCCTGGACCAGGCGGAGGAGGAAGGGATCGACCTGCCTTACTC
CTGCCGCGCGGGCTCCTGCTCCTCCTGCGCCGGCAAGGTGGTCTCCGGCGAGATCGACCAGTCCGACCAGAGCTTCCTC
GACGACCTCATCTAATCAATCAAGCAAGCTCCATATTTATAAATCTCTCGATCCATCTCCATGCGTTCTTGAGTTTATC
AATTAAGAATATAATGTCGTCGTCCCTATGCTATGCAAGCAAAGTATTACGTACGTATATGttgagCGagATAACAAAA
CACAGGCgtgcccGagggttAAttgttgttGTTTAATTAatGTACG
```

> SEQ ID NO:1626   126375 188854_300610_1
```
CACTCCTCTCCTCCTCGTCTACCTTACCTAGCAGCAGCAGCTAGCTAGCTTAATTAGCTATAGCAGCCATGGCGGCGAC
GGCACTGAGCAGCCAGGTCCGGTTGCCGATGTCCCTGCGGGTGGCGACGGCGCCGGCGCCGGCGCGCGTGTCGGTGCTG
CCGGCGAGCAACAAGCTGGGAGACAGGCTGCGGATGCAGGCGACGTACAACGTGAAGCTGATCACACCGGACGGCGAGG
TGGAGCTGCAGGTGCCGGACGACGTGTACATCCTGGACCAGGCGGAGGAGGAAGGGATCGACCTGCCTTACTCCTGCCG
CGCGGGCTCCTGCTCCTCCTGCGCCGGCAAGGTGGTCTCCGGCGAGATCGACCAGTCCGACCAGAGCTTCCTCGACGAC
GACCAGGTTGCCGCCGGCTGGGTCCTCACCTGCCACGCCTACCCCAAGTCCGACGTCGTCATCGAGACCCACAAGGAGG
ACGACCTCATCTAATCAATCAAGCAAGCTCCATATTTATAAATCTCTCGATCCATCTCCATGCGTTCTTGAGTTTATCA
ATTAAGAATATAATGTCGTCGTCCCTATGCTATGCAAGCAAAGTATTACGTACGTATATGTTGagCGagATAACAAAAC
ACAGGCGTgcccGa
```

> SEQ ID NO:1627   126375 118319_300065_1
```
gCCATTACGGCCGGGGAGGAGAGCAAAGCAAAACAAAGAAAAAAATTTGTAAAAATGGCCAGTATTTCAGGTACCATGGTTAG
CACCTCTTTCCTCCCAAGGAAACCAGTAGTGACTAGCCTGAAAGCCATACCAAATGTTGGGCAAGCTCTCTTTGGTCTT
AAATCTCAGAGGGGTGGTAGGATTACTTGCATGGCCAGTTACAAAGTGAAGCTTATTACACCAGAGGGAGCTGTTGAAT
TGATTGTCCAGATGATGTTTACATTCTTGATCAAGCTGAGGAAATGGGACATGATCTTCCTTACTCATGCAGAGCTGG
TTCTTGCTCTTCTTGTGCTGGAAAAGTTACAGCTGGAAATGTTGATCAGTCTGATGGAAACTTTCTTGATGATGACCAA
ATGGCTGATGGATTTGTGCTAACCTGTGTTGCTTACCCACAGTCTGATGTTACTATTGAGACTCACAAGGAGGAGGAGC
TCACTGCCTAAGCCCCTCCATCTCATTATTTCAAAAAAGTTTGATGAGCATTTATTTTCATATGTAGCTCTTTTGTTCT
CATAAAAGATGCCATGTTGCAACTTCTAGTCAATGACTTTGATTTGCTTAGCATAGCAACTTTCATCTCCTTATTACCT
GCTTTTAGTTGTGTTAATTTTCATGTATATTTAACAATTTGCAAGAttAGAAAATTACcAttagtaac
```

> SEQ ID NO:1628   126375 44586_300375_1
```
ATTAGGCTGCATTACATAAAAGCATTTATGAAACAGAAGATGTTCTTGATTTAACTCTAGTCCTGACACTCAAGAGTAC
AAGAGCATTATATAGCTGCTTTACCTTAAACCAAGATCTGAAGCATAACTAAAAGTTGGATACCTAGTAAAGGTCACCC
TCCTTGTGAGTGTAGATCACACAATCAGAGGTTGGGTAAGAAACACACGTAAGCAGATAACCCTCCTTCATTTGGTTGT
CGTCCAAAAACGATCCGTCAGACTGATCAACAGGGCCCGATTCTATCTTCCCAGCACAAGTCGAGCAAGCACCGGCCCT
GCACGAAAAAGGGAGTTCGACTCCAGCTTCCTCAGCTGCATCGAGGATGTAAGTATCAGATGGTGCTTCGAACTCATGT
TCTGTACCATCTGGACAAACCAACTTGACCTTGTACACATTTGCTGATGCTCTAAAACCAGAGTCAGCTTTCAAGCCAA
AGGACATCGAAATGCTCCTCACAGATCCCAGAGAAGACGGGATTTTCACAAATGCACTCTTTTTCTGAGTCTGAGGAGC
AGCTTTGAACATGCAGGTGGAAGGAAGTCTCACGGTCGACATGTTTTACC
```

FIG. 2 continued

> SEQ ID NO:1629 126534 115033_300011_1
ATCAATTTGCCAAGGCTAGAATTAACATACCAGATAGTGGCTTTTTCTGCAGCTCCTACATCTCCGAACTGTATCGTTT
TCACAGTTAAGCATATCAGCCCCACTTTAGTCGCAATTAGCACATGTCAACCGGGGGCAACGGAATGGACAACTGCCAA
TTACCAAAATCGTTTGCCATTTGTTAGCAGCATTTGGAATAAGTTAGTTTTCTGCAATGGTCTCTTTTATTGTCTGAGT
CTTACTGGTTGGTTGGGAGTCTATAATCCAGAAGAACGTACTTGGCTTGTTCGTGTGGTTCCACCTCCGAGATGCCCTG
AAAATTTTTCGTGAAAAATTGGTGGAAAGGAAAATTTATGGCAGAGTACAATGGAGATATCTATGTGATATACACTTG
CTCTACTGCAAATCCGGTGATATATAAGTTAGACCAAATAAATAAAATTTGGGTTGAGATGCAAACTTTAGGTGGTTTG
ACACTTTTTGCAAGCTTTCTGTCATCCCAAGCAAGGACAGACGTTCTTGGGGTGATGAGAAATAGTATTTATTTCTCGA
AAGTTCGTTTTTATGGAAGGCGTTGCATATCCTATTCCCTCTATC

> SEQ ID NO:1630 126534 155282_301354_1
CTTAGAAAAGAACCACAAAAAACTGACTTCTTGCAGCTATGGCTGCAAGCAAAAAGAAGAAAAATGAAGTTATTAGCTG
CAACAACTCCAACTAATGGTGGTCCTTCTACTGAGGAGCGTGAAGGATCTGATGAGCAAAACTCATTGTCTTGTGTACC
AATGGAAATTCTAGAACTGATTCTCTCCCGGTTAAACTTGAGAGAAAACATCCGTGCTTCTGCTGTTTGCAAGCAATGG
CTTGCTGTCTCCATTTCTGTACGAGTTGCAAATAAACCAC

> SEQ ID NO:1631 126593 119247_300024_1
ATACAAGTAGAACATTATGAAATTTATTTATTTCCCTTCAAGAGTTTAGGCTCGTCTTACAAAAAATGTAGAACATGAA
GTTAAAGATACAAAGGATCTACATTCAATTAGCTGACTCTTTCACCTTCTTAAGAATAGCAACAAGTGCTCCAACCACA
GCTACTACAGCCCCTGAAATCAAAAGGGTTGACTTGAGATCCTGTGCTCCTCCTTTCTTCTCCTCCTTGACTTCCTTAG
ATGTTTCAACCTGTTTGGTCGCTGTTTCAACAGC

> SEQ ID NO:1632 126611 126514_300464_1
GCCATTACGGCCGGGGGCCTACAACAAATCTCAGAACGTTGACCTATGTGGCTCATGCTATGGCTTCAATGGCCGGCCT
AATAGGCTCTTCTCAAACTGTGTAGGATGGTCAGGTCTGTGGTTCAACCCGTTTGATCACTGTTAGCACCACCATAATA
GCCTTGGCTATACCACTTCTCAGGATTACAGCCCAACAGGGGTCTGCTGACACTGAAACTACCCGTAAAGCCGTCATCG
GTCTTGATGCTGCTGGCCTTGCTGGATCCTTTGCTCAAGCACCCTTTGCTGCAACTAAATCAATCAGGATTGGAGGCTG
CTCCTCCTCCCTGCGGAGGATTACCTGAAACTTTGAACTCT

> SEQ ID NO:1633 126611 201193_300713_1
GCCACCGGGATCGCCGGCGGCGCCCTCGCGCAGGCGGCGCTCGCCGAGGCCGCCAAGCCCATCAAGGTCGGCCCCCCGC
CACCGCCCTCCGGTGGACTCCCTGGGACGCTGAACTCGGACCAGGCGAGGGACACGGACCTGCCGCTGAGGGAGAGGTT
CTACCTGCAGCCGCTGCCGCCGGCGGAGGCGGCGGCGAGGGCGAAGGAGTCGGCCCAGGACATCATCAACCTCAAGCCG
CTCATCGAGAAGAAGCAGTGGCCGTTCGTCAGGGACGACCTCCGCCTCAGGGCCTCCTACCTGCGCTACGACCTCAAAA
CCGTCATCAACTCCAAGCCCAAGGCCGAGAAGAAGGCCCTCAAGGACCTCACCGGCAAGCTCTTCGCCACCATTGACGG
GCTTGACCATGCAGCCAAGATCAAGAGCCCCGAAGAGGCGGGAGAAGTACTACACGTTGACCAAATCTGCTCTTGGCGAT
GTCCTCGCCAAGCTAGGCTAGGATCGGCATAATGGCCATATGGGGTTTCGGTGTTTTTATGTTTGTTCATATGGAACCG
GCAATGTACCCTCCATGTTGATATTGTATCAGCAAGCACTTACGTATGATTCAATCTTGAGTTGTTGTTGACGGCTAAA
TCTCCAAGCAGGCGCGATTA

> SEQ ID NO:1634 126611 130039_300484_1
GAATTCAGTAGCTCACAAGCTGTCTTGGAAGGGAGCCTTCAACTCAACAGCTCTACCCGCTTGAGTGGAGTTAGTAACA
ACCGAGTAAGCGTGATCAGTCGATCTAGTTTCACAGTTAAAGCTCAGTCATCGGACAATGAAGCCGTAGCTCAGAGTAG
TCGCAGAGCTGTCTTGGGACTAGTAGCTACCGGATTGGTAAGTGGCTCATTCATTCAGCGTGTGCTTGCTGAAGCAAGG
CCAATTAAGGTCGGATCACCTCCCAAGCCATCCGGTGGATTGCCTGGAACTCTTAACTCAGACCAGGCTAGAGACCTTG
ATCTACCATTGAAGGAGAGGTTCTTCCTTCAACCACTGTCTCCAACAGAGGCTACACAAAGAGCTAAAGAAGCTGCTAA
AGAGATTCTTAACGTGAAGAGTAACATAGACAAGAAGGCATGGCCTTACGTTCAGAACGATCTTCGTTCCCAGGCTGGA
TATCTTCGTTATGACCTCAAAACTATAATTTCTTCAAAGTCCAACGATGAGAAGGCTTCGCTTACAGATCTCACCAACA
AACTCTTTATTTCCCTTGACAAACTGGACAATGCAGCAAAGATCAAAAGCAGTGAAGCAGCAGCAAAGAGTTATGCCGA
TGCTGTAGTGTCTTTG

> SEQ ID NO:1635 126611 252978_301610_1
GGAAGATGGCTCAGCAGTAGCGATGGCCGGGCTTGCTCATCCCTCTCCTCGGCCGCTTCCTCGCTCGACGGGGCCGGCT
CTCGCCTCTTGGCCTCCTCCCCTTCTTCCTCTGCCCCCTCTAAACCATCCCTTCGCCTCCCTTTAATCCGCGCTAGCTC
GTCGAATCCCTCAGAAGACGCTTCTGCTAAATCTAGTACTAGACGCCAAATCTTGTCCCTCGTTGCTGTCTCTGCTTTG
CTTGTCTCTAAACAAGCCCTCGCCGACCCTAGCCCTATCAAGCTCTTTGGCCCTCCCGCCCCTTCTGGTGGCCTCCCTG
GGACTGAAAATGCCGACGAAGCTCGAGATCTAGACTTGCCATTGAAGAATAGATTTTACCTGCAACCTCTTCCTCCCGT

FIG. 2 continued

```
GGAAGCGATCGCCAGGGCGAAGGAATCTGCCAAAGAGATTGTGAATGTGAAGGCATTGATCGACAAGAAGGCTTGGCCC
TATGTCCAGAACGGGCTCCGATCACAGGCTTCCTACCTGCGCTTTGACCTCAACACTGTTATCGCTTCCAAGCCGAAGG
ATGAAAAGAAAGCTCTCAAAAGCCTTAGCACTAAGCTCTTTAACACTATCAATAATCTGGACTATGCTGCTAGAAGCAA
AA
```

> SEQ ID NO:1636  126611 2815_300392_1
```
CCCACGCGTCCGAAAAAAAATGGCTCAAGCAGTGACTTCGATGGCTGGCTTACGTGGAGCATCTCAGGCTGTCCTTGAA
GGAAGTTTACAGATCAACGGCTCAAACCGTTTGAACATCTCAAGAGTCTCGGTTGGGTCTCAGAGAACCGGACTTGTGA
TCAGGGCTCAGCAGAACGTGTCAGTACCAGAAAGTAGTCGCCGGTCAGTGATTGGACTCGTGGCGGCTGGTTTAGCCGG
TGGTTCATTCGTTAAAGCTGTTTTCGCCGAAGCTATTCCGATCAAAGTTGGTGGTCCTCCACTTCCTTCCGGTGGCCTA
CCTGGAACAGATAACTCAGACCAAGCAAGAGACTTTTCATTGGCATTGAAAGATAGATTTTACATACAACCATTGTCAC
CAACAGAAGCTGCAGCTAGAGCCAAAGATTCTGCTAAAGAGATCATCAACGTTAAGTCATTTATCGACAAAAAAGCTTG
GCCCTATGTTCAGAACGATCTCCGTTTAAGAGCATCGTACCTCCGTTACGATCTCAACACCGTTATCTCCGCTAAGCCT
AAGGAAGAGAAGCAAAGCCTTAAAGATCTCACCGCAAAGCTTTTCCAAACCATTGACAACTTGGACTATGCGGCGAGAT
CAAAGAGTAGCCCAGATGCTGAGAAGTATTACTCAGAAACTGTCTCGAGTTTGAACAATGTTCTTGCCAAGCTCGGTTA
ATGAagaAagacTTGCGTTGTAATCTGTTGATGTCGATGTTATTATAATTACTGCTATCCAAGTACTTTGTCTTTCTCC
TTCTCTTCTTGTCTGATCAAATCGGTTATCTCTAATTTCagtttcaagttttaaccaatatattggctggctctttagc
aaaacattatatattcgtcctcgagctgacccctttgtac
```

> SEQ ID NO:1637  126611 55916_300129_1
```
TGTTGGATGGTCAGCTCTGTGGTTCAGCCCGTTTGAGCACTGTTAGCACCAGCAGAATTGCCTTGGCTAGACCAGGTCT
CAGCATTAGAGCCCAACAGGGGTCTGCTGACACTGAAACTAGCCGTAGAGCCGTCATCGGTCTTGTTGCTGCTGGCCTT
GCTGGTTCCTTTGCTCAAGCAGCCTTTGCTGCAGCTAAATCAATCAAGATTGGTGGCGCTCCTCCTCCCTCCGGTGGAT
TACCTGGAACTTTGAACTCGGATGAGGCAAGGGACTTTGGTCTACCAC
```

> SEQ ID NO:1638  126611 27215_300394_1
```
ccggggGCGTCCGAAAAAAAATGGCTCAAGCAGTGACTTCGATGGCTGGCTTACGTGGAGCATCTCAGGCTGTCCTTGA
AGGAAGTTTACAGATCAACGGCTCAAACCGTTTGAACATCTCAAGAGTCTCGGTTGGGTCTCAGAGAACCGGACTTGTG
ATCAGGGCTCAGCAGAACGTGTCAGTACCAGAAAGTAGTCGCCGGTCAGTGATTGGACTCGTGGCGGCTGGTTTAGCCG
GTGGTTCATTCGTTAAAGCTGTTTTCGCCGAAGCTATTCCGATCAAAGTTGGTGGTCCTCCACTTCCTTCCGGTGGCCT
ACCTGGAACAGATAACTCAGACCAAGCAAGAGACTTTTCATTGGCATTGAAAGATAGATTTTACATACAACCATTGTCA
CCAACAGAAGCTGCAGCTAGAGCCAAAGATTCTGCTAAAGAGATCATCAACGTTAAGTCATTTATCGACAAAAAAGCTT
GGCCCTATGTtcagaaCGATCTCCGTTTAAgagcAtcgTACCTcCGTTAcgaTCTCAACACCGTTATCTCCGCTAAGCC
taaGGAag
```

> SEQ ID NO:1639  126611 257565_301683_1
```
gGGTGGAAGAAGAGGAGGCAGAAGAAGAAAAGAAGAAAGAGAGATGGCGGCAATCTCGTCGTCTCTGGGCCTCAGCAAG
GCACAGTTCGTCGGCTCATTCGATGCTAGCGATGCGGCGAGAGGCTCTTCTTCTCGCGTTGGAATCGCGAGATCGAAGT
GTGTGATCCGCGCGATGCAGCAAGAACACGATCCGTCGAGACGAGCAGCAGTGTTTGGCCTGGTCGCAGTGGCCGCGGG
CGTACTGGCCGTGGAGGAATCGCGAGCAGTGAGTGGAATCAAGATCAATGGGCCACCTCCACCATCCGGAGGACTTCCT
GGGACGGAGAACGCCGATCAGCCGCGCGACTTGGATCTGCCACTCAAAGAGCGATTTTTCATCCAGCCGCTGTCGCCAG
CCGAGGCAGTGGATAGAATCAAGGACGCGTCGAAGGACATTGTGGGAGTAAAGGAGCTGATCGAGAAGAAGAGCTGGCC
GTATGTCCGCAACGATCTTCGCAGCAAGGCGACTTACTTGAGGTATGACATCAAAACCATCCTGGATGCCAAGCCCAAG
GCCCAGCGCAAAGAGCTCAAGAAATACACGGACAGTCTCTTCGACACAATTGACAAGCTTGACTATGCAGCTCGAGCAA
AGGATCCCGCAGCCGCGAGCAAGTGCTACAGCGACACtGTAGCTGCATTGGACACTGTTAtt
```

> SEQ ID NO:1640  126632 44645_300107_1
```
GCCATTACGGCCGGGGGCAGAGATCGGGAAGAAAAGATGCGTAGAATGGTAGAGTATGGTTGGCAAAACACGTCGTCGA
ATGAGTATCTTGATCATATTAAACGAATGGAGAGATCGCCAACGATGCACCCTGATCTTCCTCTCTACCCAAATGTCCA
CTCCCTCTTCAAAAATGGAATAGTGAGCAACGGACAAGAAAAGAAATGCACTACACTAACACCACAGTCGCAGAAGAAA
GTTCATTTCGTGGAACCTAAAGCTGAACTTACCAAGAATGAAAAGAAGAGTATTGACATGGAGGCTGATGGCTATATAA
AGCAGAAGCACGTCAACTTTGAGCTCCACAAATGGAGAACCTTCAAAGCTTGTTAAAAAGTTTCCAACGTACTTCATAC
AAGATATACTACATGATATCTTAGTATAAATAACATGTAATATATGTCTGTCTTATTAGCTTCTGTTTGTACTCTAAAG
GGAAAGATATCTCTTATATGCGCTGTGACTATATATTTCGTAGATGTGGTGTTTTGATTTCAATTTATCTAATAATAAA
GCTATAAGTATGTTTATTACG
```

FIG. 2 continued

> SEQ ID NO:1641 126840 242134_301326_1
GTCAGTACATCATCATCGGCGACACGGGTGTAGGGAAATCGTGCCTGCTGCTCCAGTTCACGGACAAGCGATTCCAGCC
GGTCCACGACTTGACGATTGGCGTCGAGTTTGGGGCGCGGATGATCACAATCGATAACAAGCCCATCAAGCTCCAAATC
TGGGACACAGCAGGCCACGAGTCTTTCAGATCGATCACGAGGTCGTACTACCGCGGTGCCGCCGGTGCCTTGCTTGTGT
ACGACATTACCAGGCGAGAGACTTTCAGTCATCTGGCAAGTTGGCTGGACGACGCTCGGCAGCACGCGAACTCCAACAT
GACGATCATGCTCATTGGGAACAAGGCCGATCTGGCTCACAGGCGAGCAGTGAGCACGGAAGAAGGCGAGCAATTCGCC
AAGGAACACGGGCTCATCTTTATGGAGACGTCGGCCAAGACCGCTCAAAACGTCGAGGAGGCTTTCATTAACACAGCAT
CGAAGATCCACCAGAAGATTGAAGAGGGCGTGTTCGACGTTTCAAACGAGGCGTCGGGAATCAAGATCGGAGTTCTACC
AAATAATCCCCACAGAGGTGATTACCCGGGTCCTCAAGGTGGTGGCTGCTGCAGCTAGAAGGCGGGTATAAGTTCTCAT
TAAAAAATGATTTACCATGTCGTGAATAATTTTCCCTCCTGTACAAAGCTATCGTG

> SEQ ID NO:1642 126840 242533_301330_1
ACGCGTCGGCGATCACCAGCGCCTACTACCGCGGCGCCGTTGGCGCTCTCCTCGTCTACGACATCACCCGGCCGGTGAC
GTTCGAGAACGTGGAGCGGTGGCTCAAGGAGCTCAAGGACCACACCGATTCCAACATCGTGGTGATGCTGGTGGGGAAT
AAGTCCGACCTGCGCCACCTCCGGGCCGTGTCCACCGAGGACGGCCAGGCCTTCTTCGAGCGCGAGGGGCTCTACTTCA
TGGAGACGTCGGCCCTCGAGTCGACCAACGTGGAGAATGCGTTCAAGCAGATACTGACGCAGATTTACCGGGTGGTGAG
CAAGAAGGCCCTGGATGTCGGCGAGGACCCCTCCGCCGCCCCGGCTAAAGGACAGACTATCAACGTTGGCGGCAAGGAC
GATGTCACGGCTACCAAGAAGGTTGGGTGCTGCTCCACCTGAATCATGGTCGACGTTTTAGCTGGTTTCGATTGATCTG
GTAGCTACAGGTGGGAAGTTTAGATCAGACAGCTGGTTCTTGATAGCTACGAATTCTTTTGCTCTACTAGGTAGCAAAT
TCTTTAAATACTTTTTCTTAACTT

> SEQ ID NO:1643 126840 7863_300306_1
acccacgcgtccgcTACAATTCCTCTGTCGCTCTCACCAGTTAACAGCTACAGCACAAAACTGTAACCACGCTTCCGAT
CTCTAAAACCTGAGAGAGAGAGAGAGAGAGAGAGAGAGACAGAGAGAAGTGTTTCAATAGTTTGGCGTGAAGATGGCCGGA
GGAGGCGGATACGGCGGCGCATCGGGGAAAGTTGATTACGTCTTCAAAGTTGTTCTAATCGGAGATTCGGCTGTTGGGA
AATCGCAACTACTTGCTCGATTCGCTAGAGACGAATTCAGCATGGATTCTAAAGCCACCATCGGCGTCGAGTTCCAAAC
TCGTACCCTCTCCATTGAACAAAAAAGCATTAAGGCTCAGATCTGGGATACCGCTGGTCAGGAAAGATACAGagccgtt
acAAGCGCATACTAC > SEQ ID NO:1644 126840 265945_200082_1
TCCGATCCCGTATGGTTGGAGATATTCCCCTTCATCATTTTTTCCTGAGAAAATTCAAATGGCCGTTCCACCCGCTAGA
GCTCGAGCCGATTATGATTACCTAATCAAGCTCCTCTTGATCGGCGACAGCGGTGTGGGTAAGAGTTGCCTTCTTTTAC
GTTTCTCAGATGGCTCCTTCACGACCAGTTTTATTACAACTATTGGCATTGACTTCAAGATAAGGACCATAGAGCTTGA
TAGCAAACGAATCAANNACTACAAATCTTGGGATACCTGGNCTGNNGTCAGGAGCGGTTCCGAACAATTACAACTGCTT
ACTACCGTGGAGCCATGGGTATATTGCTGGTGTATGACGTGACTGATGAGTCATCTTTTAACAACATCAGGAACTGGAT
AAGAAACATTGAGCAGCATGCTTCCGACAATGTCAACAAAATTCTGGTCGGCAACAAGGCTGACATGGACGAAAGCAAA
AGGGCTGTTCCTACATCAAAAGGTCAAGCACTAGCCGACGAATATGGCATTAAATTCTTTGAGACAAGTGCCAAGACAA
ATATGAATGTGGAAGAGGTTTTCTTTTCCATAGCTCGGGATATAAAACAAAGACTTGCTGAATCTGATTCAAAGGCTGA
GCCACAGACTATCAGGATAAATCAACCAGACCAGGCAGCAGGAGCTGCTCAAAGCGCTCAAAAATCAGCTTGCTGTGGC
TCTTGAAATATTGACAGCAACGACGACAGGATGAT > SEQ ID NO:1645 126840 260892_301718_1
aggcgagaatcaaatggcgCTGTCTTCCTCCTCCGTCAGCGGCAACGAGTTTGATCACCTCTTCAAGATACTGCTCGTC
GGGGACTCGGGTGTCGGCAAGAGCAGCCTGTTGCTGCGATTCACCGCCGACACTTTCGACGATCTCTCCCCCACAATCG
GTGTGGATTTCAAGCTCAAGCTTATGACGCTGGAAGGCAAGAGGCTCAAGCTCACCATCTGGGACACAGCCGGGCAGGA
AAGGTTTAGAACGCTTACGAGCTCGTACTACCGAGGGGCACAAGGCGTCATTCTTGTTTACGATGTTACAAGAAGAGAT
ACGTTCACGAATCTCTCGGAAGTTTGGCTCAAGGAGGTCGAGCTCTACTCCACCAACCAGGACTGCGTCAAGCTCTTGG
TGGGAAACAAAGTCGACagggaTTCCGAGCGTGCGGTGACGAAGCACGAAGGCATGGCTTTCGCCCGGAAGTATGGCTG
CCTGTTCCTGGAGAGCAGTGCCAAGACGAAGATCAACGTCCAACAATGCTTTGAAGAGCTGGTCAGGAAGATtTTGAA
ACTCCCAGCTTGGTAGCCGAGGCCaaGTCGGTGAAGAAaaacatCATCAgaccaagcaacgaTGAGgagccgcctgcag
ctggcgataactcTGGTAGctgcgCGTGTTGATAgagaG > SEQ ID NO:1646 126840 251026_301653_1
GGATCGAGCAGAGGGGGACGGACTCTTCCTGGATACGAGGTCATGGCGAACGGCTTCGTGGATTTCAATCAGAAGATCG
ACTATGTCTTCAAGGTGGTGCTGATTGGGGACTCGGCGGTGGGGAAGTCACAGCTGCTTGCCAGGTTCTCCAGGAACGA
GTTCACTCTGGAATCCAAGGCAACCATCGGCGTCGAGTTTCAGACCCGGACCATGGTGGTGGATCACAAGAACGATCAA
GGCACAGATCTGGGACACCGCCGGTC

FIG. 2 continued

> SEQ ID NO:1647 126840 225819_301050_1
cgggagggaagatcatcgtGCATCGCGCGGAGGTCTGGATCGGCAGCGCTAATGGCGGCGggGAGAGCGCGGGCGGACT
ATGACTACCTCATCAAATTGCTGCTCATCGGCGACAGCGGTGTGGGGAAGAGCTGCCTTTTGCTGCGCTTCtcggaCGA
TTCCTTCACGACGAGCTTCATCACGACGATAGGCATTGACTTCAAAATCAGGACCGTTGACCTggATGGCAAGAGGATC
AAGCTTCAAATTTGGGACACTGCTGGGCAAGAACGCTTCCGGACGATCACAACTGCATACTACCGAGGAGCTATGGGCA
TTCTCCTCGTCTACGATGTGACGGATGAATCATCGTTCAACAACATCCGGAACTGGATCAGGAATATCGAGCAGCACGC
GTCGGACAATGTGAACAAGATCCTGGTCGGCAACAAGGCCGACATGGACGAAAGCAAGAGGGCCGTAtcaacaGAAAGA
GGGCAAGCTCTTGCGAACGAGTTTGGTATCAaGTTCTTCGAAACCAGCGCGAAGACGAACATGAACGTGGAGAACGTCT
TCTTCACAATCGCGGGAGACATCAAGCGGAGACTAGCGGAAACAGACTCCAGACCCGAGCCTCCCAGGATCAACAACGT
AATactagaCCCGTCGaAggatcaGAACAAcaacaaAgacaagtcATCATGTTGCACCTGAGagcaag > SEQ ID NO:1648 126840 227206_301009_1
AAAGCCAGCCAGCCAGCCACCTCTGCATCATCCCGCCTGTCTGCCTGCGCGCGCCGGCCAGGCGGCCGCCGCCTCGTCT
GCTCCGCCGGTCCAGGTTGGGTCCCCCTCTTGACGAGGGGCGGGAGGGAGGGGAGCGAATCTGAGGTGGTGGCTATGGGG
TCGCCGGGGCGGGGAGCAGCGGCGGCGGTGGAGGTGGGCATGAGTGCAGCTTCAAGATCCTGCTCATCGGGGACTCCG
GCGTCGGCAAGAGCAGCCTCCTCGTCAGCTTCGTCGTCGCCGCCGCCGCCCACCTCGACGACGACATCGCTCCCAC
CATCGGAGTGGATTTTAAGATCAAGTTCCTTACGATTGGTGGAAAGAAATTGAAGCTGACAATATGGGATACTGCTGGC
CAGGAGAGGTTTAGGACAATTACTAGTTCTTACTACAGAGGTGCTCAAGGCATTATTCTAGTATATGACGTCACGAAGA
GAGAAAGCTTCACAAATCTGGCTGAAGTATGGAGTAAGGAAATAGAGTCACACTCATCAAACAAAGACTGCATAAAAAT
GCTTGTTGGAAACAAAATTGACAAGGAGGATGAAAGAACTGTCACAAGAGAAGAAGGGCTTGCCTTTGCAGAAGAATCT
GGATGCCTATTTCTTGAGAGTAGTGCGAAAACA > SEQ ID NO:1649 126840 1108745_301520_1
TATTTGAAAGTAGAGAGAGACAGAGAGATTCCGATGGCAGGTGCACCCGGCTCTGCCAGTCTCCAAGCCAAATTGGTGC
TTCTCGGGGATATGGGAGCAGGAAAATCCAGCTTGGTTTTGCGGTTTGTGAAAGATCAGTTTCACGAGTATCAGGAGTC
AACAATTGGTGCGGCTTTCTTTTCACAAACCATTGTTGTGAACAACACAACAGTGAAATTTGAAATTTGGGACACAGCA
GGTCAAGAAAGGTATCACAGTTTGGCTCCTATGTACTACCGTGGGGCTGCTGCAGCTATCATAGTATTTGACATTACAA
ATCCTGATTCATTTAATCGAGCAAAAAAGTGGGTACAAGAGCTTCAGGGACAAGGAAATCTGAATTTGGTCATGGCACT
TGCAGGAAACAAATCTGATTTAGCATCCAAAAGAAAAATTGAAGCAGAGGAAGCTCAATCCTACGCTGATGAAAATGGA
TTGTTTTTAATGGAAACATCAGCGAAGACTGCACAGAATGTTAGTGAAATTTTTCAAGAGATCGCAAAGAGACTACCTA
GAGCTCAATCTGCTCAAAATCCTGCCGGGGTTTCACTTACTGATAGGCCTGTGGACAGAGCATCAAGTCTCTCCTCATG
TTGCTCTT > SEQ ID NO:1650 126840 211571_300900_1
TTTCAACTCTCAAGCCTTCCGCTTTTATTTCTCCCGTTCCAACACAAAGCACCAACAACCGCCATCATGAACCCCGAAT
ACGACTATCTCTTCAAGCTCCTCCTCATCGGTGATTCCGGTGTTGGAAAGTCTTGCTTGTCTGCTGCGATTTGCCGATG
ACACCTACACCGAGTCTTACATCTCCACCATCGGTGTCTTTTNCTCGAACGATAGAACTCGATGGCAAGACCGT
GAAGCTGCAGATCTGGGATACCGCCGGCCAGGAGCGTTTCCGAACCATCACCTCGTCTTACTACCGCGGTGCTCACGGC
ATCTGCGTCGTCTACGATGTCACTGATATGGACTCCTTCAACAACGTCAAGCAGTGGCTCCAGGAGATTGACCGGTATG
CCACCGAGGGCGTCAACAAGTTGCTCGTAGGCAACAAGAGCGATATGTCCGATAAGAAGGTTGTCGAGTACACCGTTGC
CAAGGAATTCGCTGACAGCCTGGGCATCCCATTCCTCGAGACTTCCGCCAAGAACGCCAGCAACGTTGAGCAGGCTTTC
CTCACCATGGCTCGCCAGATCAAGGAGCGCATGGGCACCACGACTGCCAACAACACGAAACCCAGCGTGCACGT > SEQ ID NO:1651 126840 138707_300727_1
CCTCCGATCTCGCCGCGTCCGTGTCCCCTCGCCGCGCAGCCAGCGTCAGGGCTCGGCGACCGGAGGAGGAGAGGCCGGA
ACCCGCCGCCGCCGCCGCCGCCTCCGCCTGTAGCGAGATCGCTCGATCCGGTTCGCCTCCCGCGCGCCAGTCCGCCAGC
CCAGTTTGTATCCGTTGAGGGGGAGGGGACGCTCTAGTGTGGGGATTGGGGGAATCGATGGCGGCGCCGCCGGCGAGGG
CTCGGGCCGACTACGATTACCTCATCAAGCTGCTCCTCATCGGCGACAGCGGTGTTGGGAAAAGTTGTCTCCTCCTACG
GTTCTCTGATGGTTCCTTCACCACCAGTTTTATTACCACCATCGGGATTGATTTCAAAATAAGAACAATCGAACTGGAT
GGTAAACGGATTAAACTTCAAATCTGGGATACAGTGGTCAAGAACGTTTCCGAACTATTACAACTGCCTACTACAGGGG
AGCAATGGGTATTTTGCTTGTTTATGATGTCACCGACGAGTCATCATTTAATAATATAAGAAACTGGATTAGGAACATA
GAGCAACATGCTTCCGATAATGTGAACAAGATTTTGGTAGGCAACAAAGCTGACATGGATGAAAGCAAAAGGGCCGTAC > SEQ ID NO:1652 126840 126260_300461_1
gccattacggccggggttctgaccattttccccttcagcccaatgttgccgacgactttctgaccttctcaaaaacc
tCTGTGTTTCTCTCACATTTCTGGTGCCAATCTCTTGGGTTTTGCATTTGCTGATTCAGATATTTATTGGAGAAGACGA
TGGCAGCTCCACCAGCGAGGGCTCGAGCAGATTATGATTATCTTATCAAGCTCCTCCTCATTGGTGATAGCGGTGTGGG
AAAGAGTTGTTTGCTGCTGAGGTTCTCAGATGGTTCCTTTACAACAAGTTTCATCACCACTATTGGAATTGACTTTAAG
ATAAGAACAATTGAACTTGATGGCAAGCGGATTAAATTACAAATTTGGGATACAGCTGGTCAGGAGCGTTTCCGCACTA

FIG. 2 continued

TCACGACAGCATATTATCGAGGAGCCATGGGTATTCTGCTGGTGTACGATGTCACGGACGAGTCATCTTTCAATAACAT
CAGGAACTGGATTCGCAACATAGAGCAGCATGCTTCTGACAATGTCAATAAGATTTTGGTTGGGAACAAGGCTGATATG
GACGAAAGCAAAAGGGCTGTGCCAACTTCCAAGGGTCAAGCTCTTGCTGATGAATATGGCATTAAGTTCTTCGAAACAA
GTGCAAAGACAAACATGAATGTGGAAGAAGTTTTCTTTTCAATTGCTAGGGATATCAAACAAAGGCTTTCAGAATCTGA
TTCCAAGACTGAGCCTCAGGCAATCAAGATCAACCAATCGGATCAGGCAGGAACTTCTGGTCAAGCTGTACAAAAGTCA
TCTTGCTGTGGTTCGTGAATGGAGCCAATCGTGTGGGAAGAACATTCGTTAGTTGCATTTGGATGTAAAAATTGATTGG
GATGAAAAACTGATTCCTGTTAACTTCATTACCAAATATttatttgccatctgatggcaagcttgatgtgtcaaaggtt
ttactgctttcgttttgaatctattgtcatacagttaact > SEQ ID NO:1653 126840 1171567_302055_1
GCCACGCGTCGCCCACGCGTCGGAAGGAAGGAAGGAAAGGATGTCCATCGCCGCCTGACCTGCCGTTCCCTGCTATGGC
GACCGTCGTCTGATCTACCCCTTTCCTTTCCCTCCTCGCCGATATGGCGTCCCGCCCCGTGCAGACTATGACTTCCTC
GTCAAGCTCCTTCTCATCTGGGACAGCGGTGTTGGAAAAAGTTGCCTTCTTCTCCGATTCTCTGATGATTCTTTCACC
ACAAGCTTTATTACTACAATTGGCATTGATTTCAAGATTAGAACGGTGGAGATAGATGGGAAACGGATCAAATTGCAAA
TCTGGGACACAGCTGGGCAGGAACGCTTTCGAACAATAACCACAGCATACTACAGGGGTGCCATGGGGATTATCCTTGT
GTACGATGTTACAGACGAGTCTTCATTTAACAACATTG > SEQ ID NO:1654 127269 1044203_301916_1
GTGAGTTGATGATGGGCTCTCTGAGCTCCCTCTCTCTCTTCCTCCTCCACTTGGCCTTAGCTTGCCTTGCCTTCTCCGT
AGCTGAGATCATCTTCGAGGAACGTTTTGAAGATGGATGGGATAGTCATTGGGTCAAATCTGGATGGAAGAAGAGTGAA
GGACTTGCTGGAAGCTGGCGACATACAGCTGGCAAATGGTTTTCTGACCCAGATGATAAAGGTATACAGACTTACCCTG
ATGCCCGATTTTTCGCTATCTCTGCACAACTCCCTGAGTTCAGCAATAAGAACCGAACCCTTGTGCTTCAATACTCGGT
AAAGATCGAGCAGAAGATTGAATGTGGCGGAGCTTATGTAAAACTCATGAGTGGTTATGTGAACCAGAAAAGGTTTAGC
AAGGACACCCCTTACAGTATCATGTTCGGACCGGATCTATGTGGTACTGATACAAAAAAGCTTCACACAATTATCTCCT
ACAAGGGTCAGAATTATCCCATCAAGAAAGAGCTACAGTGTGAGACTGATCAGCTCACGCATTTTTACACGCTAATCAT
A > SEQ ID NO:1655 127269 129196_300403_1
CCCCCGGGGAAAGTCGGTGGGTCAAGTCAGAATGGAAGAAGGATGAGAACATGGCTGGTGAATGGAACCACACATCTGG
GAAGTGGAATGGAGATCCTGAGGACAAAGGTATCCAAACCTCTGAGGACTACAGGTTCTACGCTATTTCAGCGGAGTAC
CCAGAATTCAGCAACAAGGATAAAACCCTGGTGCTCTCTGTAAAGCATGAGCAAAAGCTTGACTGTGGTGGTG
GATATGTCAAGTTGCTTGGTGGTGATGTTGACCAGAAGAAATTTGGTGGGGACACACCGTACAGCATTATGTTTGGACC
AGACATCTGTGGGTACAGCACCAAGAAGGTCCATACTATCTTTACTAAGAATGACAAGAACCATTTGATCAAGAAGGAT
GTCCCCTGTGAGACTGATCAGCTGTCCCATGTGTACACTTTGATCATCCGTCCTGATGCTACATACACCATACTCATTG
ACAATGTTGAGAAGCAATCTGGCAGCATCTACGAGCACTGGGATATTCTGCCTCCGAAGCAAATCAAGGACCCAGAAGC
TAAGAAGCCAGAGGACTGGGATGACAAGGAG > SEQ ID NO:1656 127269 284326_200097_1
TAAAACTAGTCTTCTCAGCTGAATCATTTCTACTAGTTTTGTTACTTTTCTCACTTCTCAGCTCTTCATTCTCTGAGAT
CTTTTTTGCAGAACAGTTCGATGATGATTGGCGGAGCAGATGGGTGAAGTCTGACTGGAAAAGGAGTGAAGGGAAAGCA
GGTTCATTTAAGCATACAGCTGGAAAATGGGCTGGTGATCCTGATGATAAAGGTATTCAGACATCAAGCGATGCCAAAC
ATTTCGCCATTTCTGCTAAGGTACCAGAATTTAGCAACAAGAACAGAACTTTCGTTGTACAATATTCTATAAAGTTTGA
GCAAGACATTGAGTGTGGTGGAGGTTACATAAAGCTTCTCTCTGGATATGTCAACCAGAAGAAATTTGGGGGAGACACC
CCTTACAGTATGATGTTTGGACCGGATATCTGTGGTACACAGACAAAGAAACTTCATGTTATGCTTTCCTATCAAGGCC
AGAATTATCCCATCAAAAGGATCTACAATGTGAAACAGACAAATTAACCCATTTCTACACATTCATTCTTAGACCTGA
TGCATCATACAGCATCTGGATTGATGGTCGAGAAAGGGATTCTGGAAGCATGTATA > SEQ ID NO:1657 127269 49891_300187_1
ccgatctgagttttttttagcaatggcgagaatgattcctagcctcgtctctctaATTCTTATCGGTCTTgtTGCGATC
GCCTCCGCCGCAGTTATTTTCGAGGAGCGCTTTGATGATGGCTGGGAGAACAGATGGGTTAAATCTGAGTGGAAGAAGG
ATGATAACACTGCTGGGGAGTGGAAGCACACTGCGGGAAATTGGTCTGGTGACGCTAACGATAAAGGTATCCAGACCAG
TGAAGACTACAGATTCTACGCCATTTCAGCTGAGTTCCCTGAATTCAGTAACAAGGACAAGACCTTAGTCTtccaATTC
TCAGTCAAGCACGAGCAAAAGCTTGACt > SEQ ID NO:1658 127645 120551_300411_1
CAACACTCTGTTCGAAAGAGGGCACAACTGTAATTGTAACTGATCTAAATACCAATAACCAGACGGATTTTGTGATCAG
TAGCCGAGCTTTTATGGCCATGGCCAATAAGGGAAAAGCTAAAGACGTTCTCAAATTGGGAATTGCTGATGTTGAATAT
AAAAGAGTTCCATGTGATTACAAAAGCAAGAATTTGGCCATTCGTGTGGAAGAATCAAGTCAAAAACCAAATTATCTAG
CAATCAGCTTCTTGTACCAAGGTGGTCAAACTGAAATTGTCGCTGTCGACGTAGCTCAGGTTGGATCATCGACCTGGAA

FIG. 2 continued

TTTCCTGAGCCGAAATCACGGAGCAATTTGGGACACAAGTAGAGTGCCAACAGGGGCATTGCAATTTAGGTTTGTGGTG
ACAGCAGGGTATGATGGCAAATGGTATTGGGCAAAATCAGTGTTGCCAGCAGATTGGAAAAATGGGGTAATTTATGACA
CTGGACTTCAGATCACTGACATTGCTCAAGAGGCTTGTTCTCCATGTGATGATGGAAACTGGAAACTTCATTAGTGTTA
AAAATAAAAAATTATTTTAGCTATAATAATCTATGTGAATACACGTGGTAAAAGTAAAAGAGATCCTAAATTAATAAA
ATTGTAGATTGATGCAGT

> SEQ ID NO:1659  127645 20013_300163_1
GCTTGATTGATATATATTCCTTTTGGATATTTGTCTAATTAGGCTTTAACTTTAGCATTAGATATGAGTTTAATAACAC
TCAAAAACCACTGCATTATTCTACTAGTGACACTGATTTTTCCTGCAATTTGCTATTGTGAAGAAGCCAATTCTCTTTA
CACTAGAGCAACTTATTATGGCAGCCCTGATTGCTATGGAACCCCTAGTGGAGCATGTGGATTTGGTGAATATGGGAGG
AAAATTTATGATGGGAAAGTGAGTGGAGTTTCTAGGCTCTACAAAAATGGAACT

> SEQ ID NO:1660  127667 156829_301732_1
GGAGAGAAGAAAAGCTTAGTACTGTTATGTCTACTTTGTGAGAGATTCCACAATTTCTTATCCTCCAAATTTTAGAAGA
ATGAGTTCATATACTAGCATAAAATGCCCTACTGCTGTTAGAAACTCCACAACTCAATTCCCTCATCCAAGAACACCAA
CATCTAGGAATGAAAAAGCTTCTTATCCTTTCAGTAAAACTAAACCCCTCATCTCCCAGATTTCACTCTCTACTAGCTG
CTCATCCTTCAGTCACCAAAGTAAAGCAGATAATCTCAACCAATGTCTAGCCGAAACAAGAACCTATAGTGCTAGTTCT
GAAGACAAATATCCCACTATGTCAGAAATAATGGAAGCATCAAGAGCCCAAAATCTTGATCTTCACCTTCAAAAATTGG
GACCCTTTTTAGAATAACAGCTAGGAGCTTAAAACCCAAAGGGAACTTGGAAAAGCTGAGGGTTTGTTAAGGGTCTG
GTTTCAAGGTAAAATTCTACACTTGGACTCCATAAGACTAAAGAGAGAGACTTTGGGGATGGAAAAATCAATATTTGGG
ATTGGATTGTTTATTGGAGCAGTTGCAATTAGGCATGGTTACGATTCTGGTTGTGGAAAAGCTGAGTTGCTCGCCATTT
ATGACAATGAGCTTTATCACTCCAAGCTTGTGAGTTTCTACACAAGGATTGGTTTCAAGTCAGTACACCAAAG

> SEQ ID NO:1661  127679 273338_200143_1
TTTCAATCTCTCTCTCCGCCGCTACGTTCACTTCAAACCCTTCACCGGCGTTCGAAAACCCTAGGCCCTAATTTCTTCC
ATGTCCTATCAATCGTTTAGGTAGCTCCGTAAGATCGTTATTTATTCTTATCCGTCAATTTATCTGATAAAAGTTGGAT
TCGGAGGAATGGCGAGTTCGACTACGAGCAATGTTTACATCCACGTCATCGAAGATGTCATCAGCAAGGTCCGTGATGA
GTTCATCAACAACGGTGGTCCCGGAGAGAGTATCCTCAACGAGCTCCAAGGAACTCCATTGCAGACTCCGTTGCCTGGT
ACCGCCCAGACACCGCTACCTGGAACAGTGCGGACACCCCTCCCGGGAACTGCCCAAACACCTCTTCCTGGAACAGCAG
ATAGCAGCTCAATGTATAATATTCCTACAGGTGGCAGTACTCCCTTTACACCGAATGAGTACTCTTCTTTGAATGATAC
TGGTGGTGCAACTGAGATGAAAGGCGGTCCAGGGAGACCTAGCCCATTTATGCAACCACCCTCCCCTTGGTTGAATCAA
AGGCCTCCCCTTGATGTTAATGTTGCTTATGTTGAAGGGCGAGAAGAAGTTGATCGCGGAGCTTCTCAGCAACCCATGA
CTC

> SEQ ID NO:1662  127750 43484_300031_1
TCCACATTCTCTCAACTTTCTCTTTCTAAAAACTCTTCCTATCTCTTTCTCTAGCACACAGACCATCAATGGCATCGCC
GCGCGAGGAGAACGTGTACCTGGCGAAGCTGGCTGAGCAAGCCGAGCGCTACGAGGAGATGGTAGAGTTCATGGAGAAA
GTCGTCGGCGCCGGCGACGACGAACTCACCGTCGAGGAACGCAACCTTCTCTCCGTCGCGTACAAAAACGTGATCGGAG
CGAGGAGAGCGTCGTGGCGCATAATTTCATCGATCGAGCAGAAAGAAGAGAGTCGCGGTAATGAAGATCATGTTGCCTC
TATTAAAACCTACAGATCTAAGATCGAATCTGAATTGACTTCGATCTGTAACGGTATCCTTAAGTTGCTCGATTCAAAA
CTCATCGGCACCGCTGCTACCGGTGACTCTAAGGTTTTTTATTTGAAAATGAAGGGAGATTATTACAGGTACTTGGCTG
AGTTCAAAACCGGAGCTGAGAGAAAAGAAGCCGCCGAGAATACTCTTTCGGCTTACAAGTCGGCTCAGGATATTGCTAA
TGTCGAATTAGCCCCTACACATCCAATCCGATTGGGGCTAGCTCTCAATTTCTCAGTGTTTTACTATGAGATATTGAAT
TCTCCTGACCGTGCTTGTAATCTTGCCAAACAGGCATTTGATGAGGCAATTGCGGAGCTTGACACCCTTGGAGAGGAGT
CTTACAAGGATAGCACCTTGATTATGCAGCTTCTTCGtgAtaaCCttacgttgtggacctcggatatGCAgGATGATGG
aactgaTGAGATCa > SEQ ID NO:1663  127750 6618_300328_1
CCCACGCGTCCGTAGAGGAAAGAAGAGAGCAAAGGGAACGAAGATCATGTTGCTATTATCAAGGATTACAGAGGAAAGA
TTGAATCCGAGCTTAGCAAAATCTGTGATGGGATTTTGAATGTTCTTGAAGCTCATCTTATTCCTTCTGCTTCACCAGC
TGAATCTAAAGTGTTTTATCTTAAGATGAAGGGTGATTATCATAGGTATCTTGCTGAGTTTAAGGCTGGTGCTGAAAGG
AAAGAAGCTGCTGAAAGCACTTTGGTTGCTTACAAGTCTGCTTCCGACATTGCCACTGCTGAGTTAGCTCCTACTCACC
CGATAAGGCTTGGTCTTGCACTCAACTTCTCTGTGTTTACTATGAAATCCTCAACTCGCCTGATCGTGCTTGC > SEQ ID NO:1664  127750 112166_300040_1
tacaaaactccctctctcatttcctctctcatAGCAACATCAATGGCGTCGCCACGCGAGGAGAACGTGTACATGGCAA
AGCTTGCCGAGCAAGCCGAGCGTTACGAGGAGATGGTTGAATTCATGGAGAAAGTCATCGCCGCCGCCGACGGCGCCGA
GGAACTTACCGTCGAAGAACGGAACCTCCTCTCCGTCGCATACAAAAATGTTATCGGAGCACGGCGAGCCTCGTGGCGT
ATCATCTCCTCCATTGAGCAAAAAGAGGAGAGCCGCGGCAACGAAGATCACGTTGCCTCCATCAAGGAGTACAGATCTA

FIG. 2 continued

AGATCGAGATCGAACTTACCTCGATCTGTAACGGCATTCTCAAGCTCCTCGATTCTAAGCTCATTGGCGCCGCTGCTAC
CGGTGACTCTAAGGTGTTTTACTTGAAAATGAAAGGAGATTATCATCGCTATTTGGCTGAGTTTAAAACCGGCGCGGAG
CGAAAGGAAGCCGCCGAAAATACTCTCTCGGCTTACAAATCCGCTCAGGATATTGCAAATACCGAGCTTGCTCCTACAC
ATCCAATCCGATTGGGACTTGCTCTCAATTTCTCTGTATTTTACTACGAAATTTTGAATTCTCCTGATCGTGCTTGTAA
TCTCGCCAAACAGGCCTTTGACGAGGCAATTGCCGAGCTGGACACATTGGGCGAAGAGTCCTACAAGGATAGCACTCTG
ATCATGCAGCTTCTTCGCGATAACCTCACTTTATGGACTTCAGATATGCAGGATGATGGAACTGATGagaTCAAAGAAG
CAGCAAAACCAGATaATGagCAGCAGTAAACCGGTGACATtTCTttaggattGAAAtTCATGttgTaacTTTTTATTTT
TCAatT > SEQ ID NO:1665 127750 126766_300466_1
GCCATTACGGCCGGGGATATGCAGGATGATGGAACTGATGAGATCAAAGAACCATCAAAAGCAGAGGAGCAGCAGTAA
TGTGAGTGAAGCCTCTTTGCTTAGGATTGAAATCCTATGGACTTTGCTCATTGATCGAAATTTGCTGTTTGTGTAGTTC
TGAATTCCCTGAATTGTAATACCTAAAAGTACTGTTTCTTGCCATTTGTTGTTTTCAGCAAAGATTACTTTTTTCTCAG
TATCTCCCTTGTATTTGGATGCTCCATTCGTGGAAATGAATTCTTGTTTTTACGGAGCAAATGATCATTTTGTATTTCC
ATTTTCTCTAAGGAATGGGGGCATTGCTGATTTGATCTCCCTTTTAATTCT > SEQ ID NO:1666 127750 14133_300269_1
CCCACGCGTCCGCTTCAGACAAAGCTTGTAACATGGCCAAACAGGCTTTTGAGGAGGCCATAGCTGAGCTTGACACTCT
GGGAGAGGAATCCTACAAAGACAGCACTCTCATAATGCAGTTGCTGAGGGACAATTTAACCCTTTGGACCTCCGATATG
CAGGAGCAGATGGACGAGGCCTGAGGATCTAGATGAAGGGGGGAGGGTTGTTACGCGATGTTTCTGCCACCAAATCGA
TCTCAAAATCCCCATAACCTTTGCTCAAAAACTGTGAAAAAGATTGAAGTGTTTATGATGATTATGATTGTGCACAGC
TTGATGATTTATCTACTCTACT > SEQ ID NO:1667 127750 14371_300244_1
CCCACGCGTCCGGTAACGATGACCACGTCACGGCGATCCGTGAATATAGGTCTAAGATCGAGACGGAACTCTCCGGAAT
CTGCGACGGAATCCTTAAGTTGCTTGACTCTAGACTCATCCCTGCCGCTGCTTCTGGTGATTCCAAGGTCTTTTACCTT
AAGATGAAGGGAGATTATCACAGGTACTTGGCTGAGTTTAAGACTGGTCAAGAGAGGAAAGACGCCGCCGAACATACAC
TCGCCGCTTACAAATCTGCTCAGGATATTGCTAATGCAGAGCTTGCTCCAACACACCCAATTCGTCTTGGTCTTGCATT
GAACTTCTCTGTGTTCTATTACGAGATCCTCAATTCTCCTGATC > SEQ ID NO:1668 127750 175041_300529_1
GTCAGGAGCTGAGAGGAAGGAAGCAGCTGAGAACACTCTTGTGGCATACAAGTCTGCCCAGGATATTGCACTCGCTGAC
CTGCCTACAACTCACCCAATAAGGCTTGGACTTGCACTGAACTTCTCAGTGTTCTACTATGAGATCCTGAACTCACCAG
ACCGTGCTTGCAACCTTGCAAAGCAGGCGTTCGACGATGCTATTGCTGAACTGGACACTCTTGGCGAGGAGTCTTACAA
GGACAGCACCTTGATCATGCAACTTCTTCGTGACAATCTGACTCTCTGGACCTCTGACAATGCGGAGGATGGTGGTGAC
GAGATCAAGGAAGCAGCGAAGCCTGAAGGAGAGGGCCACTAATCTGTCCTGAAGTCTATTTCTGAGTCCATTTACTCAG
CTACCTGCTGTATTACTGGATCATAAGATGTACTAGGATCAATTGCTATGTGGAATCATAAGATTAGGGCTGCGTATGT
CAAAATGTGTCGAGCTGAAGTACCCAGTGGACACAGTTTATGTGCACTACATTGCTTCCGTGACTTATTTACTAGTTAA
TTAGCAACTTTCAACCACTTCCTGTATTTGCAGCACATT > SEQ ID NO:1669 127750 130213_300486_1
GAATTCATATGAAGAAATGGTTGAATTTATGGGGGAGTAACAACAAATGTTGAATCAGAGGAACTTTCAGTTGAAGAG
AGAAATTTATTGTCAGTTGCTTACAAAAATGTGATTGGTGCACGCAGGACATCATGGAGAATTATTTCATCAATTGAAC
AGAAAGAAGAAAGCCGTGGTAACGAAGAGAATGTATTGACCATTCGTGATTATAGATCTAAGATTGAAACTGAACTTTC
AGGCATCTGTGATGGGATTTTGAAGTTGCTTGATACTAGATTGATTCCATCTGCATCTTCTGGTGATTCTAAAGTGTTT
TATTTGAAAATGAAAGGTGATTATCATCGTTATTTGGCTGAGTTTAAAACTGGTACCGAAAGGAAGAAGCTGCTGAAA
GTACCCTTTCTGCTTATAAATCTGCTCAGGATATCGCAACTGCTGAACTTGCACCCACTCACCCAATCAGGCTGGGACT
TGCTCTTAACTTCTCCGTCTTTTACTACGAGATCTTGAATTCTCCTGACCGTGCTTGTAATCTCGCCAAACAGGCATTT
GATGAGGCTATCGCGGAGCTGGATACCCTTGGTGAAGAATCATACAAAGACAGCACTCTAATCATGCAGCTCCTTCGTG
ACAATCTTACTCTGTGGACCTCCGACATGCAGGATGATGGTGCAGATGAAATTAAAGAAGCA > SEQ ID NO:1670 128348 103712_300027_1
TGTATGGCGCAGAGTGGCCATTCGGCCGGGGAAGCCAAGTTTGGGAAAATCTTAAAAGAAAGAAAGAAATGATGACGA
ATCGCCACTTCCTCTTCGCTCTTCTTTTCACTTTCTTTCTTTCAGCTGTTGCTGCAGATTCTTCTGAAGAGTGTGTATA
CACATTGTATGTTAAAACTGGATCAATCATAAAGGGTGGAACAGACTCCAAAATCAGCGTTACACTTGGCGATGCTAAA
GGAAAATCAGTATATATTCCAGATCTAGAGAAATGGGGTTTAATGGGCCCAAATTATGATTACTACGAAAGGGGTAATG
TGGATATCTTCACTGGTAGAGGCCAATGTTTAAGCCCACCAATTTGCAGGCTTAATGTTACTTCCGATGGATCAGGTGA
CCACCACGGTTGGTTTCTTGATTTGTTGAGACTACTTTTACTGGGCCACACAAAACTTGTAGCCAATCCATATTCTAT
GTCGAACAATGGTTGGCTTCTGATGCTCCTCCTTATGAGTTATCAGTTTCTCTTGATG

FIG. 2 continued

> SEQ ID NO:1671 128348 128356_300475_1
TCATTTTCTAGAGAAAGAAACAACAAGACGTACAGAACGAGAGTTCAAGAATCTGCAATGGGAGTGGCTCGAGTTAACC
AATTCTGGTTGCATCTTCTCATCCTCTTCTCCATCTCCGTTTCTTCCATTTCTGGCACTGAACTGAATTGTGTATACAC
AGCTTATGTTCGGACTGGGACATACTGGGGATCTGGAACTGACTCAAAAATTTCCTTGTCTCTTTATGATGCCACTGGC
CATGGACTTAGAATCAATAACCTACAAGCCTGGGCGGGCTTATGGGCCCGGGTTATGACTACTTTGAAATGGACCAAT
TGGATATGTTTACGGGCCGTGGTCCATGTTTGACTGGGCCAATCTGTAAAATGAACTTGACTTCTGATGGATCAGGTGA
GCACCACGGATGGTACTGTAACTACGGGGAAATCACGTCTACAGCAGAACACAAACGATGCAGCCAACAGGCGTTCACC
GTGGAGGCGTGGCTCAGTGCCGGTCAGTACCCAGATGGGTTGACCGCCATTAAGGAACAACTGTAAGCGTATTTCCAAC
GAACAACAACCAATTCATGATTCTGATCAATCTTATCATGTTGTGGATGTAATTTAATTCGAGTTTATTGGACGTTGTA
TGATTTACGAAGGCCATTTAGGCCAAGGCCTGATATGTACTCTCACGAGTGCTACATAGTTGGAATG

> SEQ ID NO:1672 128348 171733_300536_1
ccccgatctccaccaccactttcccggggaccgcggcgggaaAGGGCCTTCGAGACTTGGGAGGTTGGAGCGAGCAAGC
TCGGCCATGGCGAAGCTCTCCTGCCTTCTCATCGTCTCCTTCGCCGTCGTCGCGGCGTTGGCGGCCACGGACGACGACG
CGGCGGCGGCGGCTGAGGGGATCACGGTGGCGGAGGCGTCGTCGGACCCGGAGAACAAGTGCGTGTACACGATATACGT
GCGGACGGGGACGATCTGGAAGGGCGGGACGGACTCGGTGATCGGCGTGACGCTGCTGGGCGCCGACGGCTCCGGGGTG
CGGATCCGCGACCTGGAGCGGTGGGGCGGCCTCATGGGCGACGGCCACGACTACTACGAGCGGCGGCAACCTCGACATCT
TCAGCGGCCTCGGCCCCTGCATGCGCCAGGCGCCGTGCCGGATGAACCTCACCTCCGACGGCACCGGCCCGCACCACGG
CTGGTACTGCAACTACCTCGAGGCCACCGTCACGGGTCCCCACCTCGGCTGCGCGCAGCAGCTCTTCACCGTCGAGCAG
TGGCTCGCCACCGACGCATCGCCCTACCGCCTCTACGCCGTCGTCGACAACTGCAACAAGGCCAaggaCGCCGCCG > SEQ ID NO:1673 128348 157312_301737_1
tttgcctttattcgttctcATTTTTCTAGAGAAAGAGAGTTCAAGAAACCATGGGAGTAGCTCAAGTTAACCAAATATG
GTTCCATTTCATGATAATCCTCTTCTTCATCTCCATATCTTCTAGTTCTGCATCAGAAGATGATTGTGTGTACACAGCT
TACGTTCGAACTGGATCAATCATAAAGGCTGGAACTGACTCAAACATTAGTTTGACTCTCTACGATGCCGCTGGCTATG
GGATAAGAATCAAGAACTTAGAGGCATGGGGTGGGCTTATGGGCCCAGGTTACAACTATTTCGAAAGAGGAAACTTGGA
TATATTCAGTGGACGTGGTCCATGTTTGACTGGGCCGATCTGCAAAATGAATCTGACTTCTGATGGATCAGGCCCACAT
GCCGGATGGTACTGTAACTACGTCGAAGTTACCGTTACTGGAGCCCACCAACAATGCAACCAGCAGCTTTTCACCGTGG
AGCAGTGGCTCGGCACTGACGTTTCGCCGTATGAGCTGACGgccGTCAGGAACAACTGTAAGAAGCCAAAGTTTGAgaa
ACAACAGGCCTTTTATGATTCTGAATCTTATCCAgttgttGATGTaaTttaatgggggTAg > SEQ ID NO:1674 128348 147510_301253_1
AGAGAGTTCAAGAAACCATGGGAGTAGCTCAAGTTAACCAAATATGGTTCCATTTCATGATCATCCTCTTTTTCATATC
TTCTATTTCGGCATCTGAAGATGATTGTGTGTACACAGCTTACGTTCGAACTGGATCAATCATAAAGGCTGGAACTGAC
TCAAACATTAGTTTGACTCTCTACGATGCCGATGGCTATGGGATAAGAATCAAGAACTTAGAGGCATGGGGTGGGCTTA
TGGGCCCAGGTTACAACTATTTTGAAAGAGGAAACTTGGATATATTCAGTGGACGTGGTCCATGTTTGAATGGGCCGAT
CTGCAAAATGAATCTGACATCTGATGGATCGGCCCACATGCCGGATGGTACTGTAACTACGTCGAAGTTACAGTTACT
GGAGCCCACCAACAATGCAACCAGCAGCTTTTCACCGTGGAGCAGTGGCTCGGCACTAACGTTTCGCCATATGAGCTGA
CGGCCGTCAGGAACAACTGtAAGAAGTCCAAGTCCACAGTTTATGATTCTGAATCTTATCCAGTTGTTGATGTAATTTA
ATGGGGGcagccCCACATAttGTCTCTGTGGttttttctttagaGtGagaaGAattaacgTGAtgc > SEQ ID NO:1675 128348 1119517_301898_1
aagtgaagaagcagtagcagtagaaggagatAGAAGGGAACCTCTCTCTCTCTCTCTCTTTGCTGATGATGAAGA
CGACTATGGCTGTTTTCGCCCTTCTCTCTCTCTTCCTTCTTCTCCTCGCCCCTTTTCCTTCATCAGCTGATGATCCTTG
TGTATACTCAATCTATGTACGAACGGGGTCAATATTCAAGGGGGAACGGATTCGAAGATGAGTGTGGAGCTCTACGAT
GCGAATGGGTACTACATTACGATCAACAATTTGGAGGAGTGGGGGGGGGTTAATGGGTCCAGACCACGACTACTATGAGA
GGGGCAATCTTGACATCTTTAGTGGTTTGGGGGACTGCCTGACCGGACCCATCTGCGCTCTCAACCTCACCTCGGACGG
CACGGGGGCCCACCATGGGTGGTATTGCAACTACCTGGAAGTTACTGCCACGGGTGCCCACATCCCTTGCTCCCAACAG
CTCTTTACCATAGAGCAATGGCTTGCCACTGATACCTCTCCTTACTCCCTCACTGCCCTTCGATATAATTGCCCTGATG
CTTTGTCCTCGCCTCGCTTCCCTCGCATgcCTTCCAATTCGCAACCGAAGAATGGTCAACTAATGTCCCATTAGTACTC
TATCACcCTGctTCGTAATaaAaagatagcccctttcttGTGtACTATggAgggagggGggtatctCTCTca > SEQ ID NO:1676 128348 252626_301603_1
GATGTCGACGGGGAAAGGCTTAGCTCTAATCCTGGCATTTGCTGCCATCGCCACCTGCATCACCTCTGCTACGAACCAA
TGCGTATACACTATTTATGTGAGGACGGGAAAGGTGATAAAAGGGGGGACAGATTCAAACATTTCGGCACGATTCTATG
ATGCCAACGGATACTATATCAATTTGGAAAATTTGGCAGAATGGGGTGGTTTGGGAGGTCCTGGCTACAACTACTTTGA
GAGAGGCAATTTGGATGTGTTCACAGGCCTTGGGCAGTGCCTCACGGCCCCATTTGCGCGCTCAACCTGACCTCAGAC
GGCACTGGAGACCAACACGGGTGGTACTGCAACTATGTCGAGGTCACCTCCACCGGGCCCCACATCCCTTGCAGCCAAC

FIG. 2 continued

ACCAATTCACCATCGAGCAATGGCTTGCCACTGACACCTACCCTTTCGAGCTCAATGCCACCCGTGACGATTGCCTGGT
CGAGGGCAAAACCAGCGCCTCCAAGGCAATTTCATCAGAGTCGAGCTAGAGTTCCAGCTGGGCCTTTTTGGCTTCCGT
TTTTGATGAATAAGCAAGCTCCTTCT

> SEQ ID NO:1677 128348 274067_200147_1
GGGCGGACGCGTGGGCGGACGCGTGGGCGGACGCGTGGGCCTTTTATCCTCTCATTTCTAGAGAAAGAAAAAATTTCT
CTTGCACAACTAGCTGCCATGGGAGTAGCTCATCAAGTTAACCAATTCTGGTTCCCTCTCATTATCATCCTCTTCTCCA
TCACCATTTCTTCTACTTCTGGAACTGAATCAAATTGTGTGTACACAGCTTACATTCGGACTGGGCCATTCATGGAGGA
TGCAACTGACTCAAAAATAAGCTTGACTCTCTACGATGCGAGTGGCTATGGAATTAGAATCAAGAACCTAGTGGCTTGG
GGTGGGCTTATGGGATCAGGGTACAACTACTTTGAAACGGACCACTCGGATATGTTCAGTGGCCATGGACCATGTTTGA
CTGGGCCGATCTGCAAAATGGTCTTGACTTCTGATGGTACAGGCCGACACTCAGCATGGTACTGTAACTACGTGGAAGT
CACCCTCAACAGGAGACCACAAACAATGCAGTCAACAGCTGTTCAAAGTGGATCAGTGGCTTAGCACAGATCGTTCGCCG
TATCAGTTGACTGCCACAAGAAACAACTGTAGGCGTATATCCGGTGACCAACAACCCATTGTTGTTGATGTAATTTAAT
TCGAGTTCATCATATTGGGCTACTTACAAACTAC

> SEQ ID NO:1678 128843 129405_300479_1
GAATTCACTTGAAAACAAAATCATTGATGAAGCGAGCTTCTTTACAATCCTAAACTACAAGCTGCATGCCCTATCCCAT
TCGACGAAGCCAAGTTATGGCAAGGCCAAAGTGGACCTGAGCTGAAGCAGCAGATACAGAAGCAGTTCAGAAATATCAG
TGCATTGATGGATTGCGTGGGTTGTGAAAAATGTCGACTTTGGGGTAAACTTCAGGTTCTTGGACTAGGAACTGCATTG
AAAATCCTTTTCTCTGTTGATGGCCAGGATCATGTGGACCAGCATCCGCAACTGCAAAGGAATGAAGTGATTGCCTTGG
CGAATCTTCTGAATAGACTCTCAGAATCTGTCAAATTGGTTCGTCAAATGGGACCGTCAGCTGAAAAGATCATGGAGGG
ACAGGTGTTTGCACATGCTGACCAAACTAGCACATGGCGAAGAATATCGACTTTTTATCTAAATTGCGGTAGTAGGCT
TTACCTACTTCTATTGATTATCAACCTTTCTTAGTTCACATCTGCGTGCCTTCGGCAGTATTATGGAGGGTTAGGTTAA
CTAGAAACAACTAACATGGAATTTACTTTTGGCTTCCATGTAGATGGGAAAGTGACAAACACATAATTTGATATCTTTC
AGATGGTCATGAACCAAATTCTGAAGTTAAGGCTGGAAATTCAGTGTTTCGGCTGTTCATATCTTTGAATACTCAAATT
TCAT

> SEQ ID NO:1679 129204 16618_300229_1
CCCACGCGTCCGAGTAGTTGGTGCTGGACAAATGGGTTCAGGAATCGCGCAACTCGCCGCCACGAGTGGCCTCGACGTT
TGGCTCATGGACGCTGATCGAGATGCCCTCTCTCGAGCCACCGCAGCTATCTCCTCCTCCGTCAAACGATTCGTCTCCA
AAGGTCTAATCTCCAAGGAAGTTGGTGATGATGCTATGCATCGTCTACGATTAACATCGAATCTTGAAGATTTGTGTTC
TGCTGATATCATCGTTGAAGCCATTGTGGAATCAGAAGACATTAAGAAGAAGCTGTTTAAGGATCTAGATGGTATAGCT
AAGAGTTCTGCGATTTTAGCTTCTAACACAAGTTCTATATCCATTACTCGTCTTGCATCTGCTA

> SEQ ID NO:1680 129204 183210_300620_1
GCGACGGCGAGAGAAATTGCGGTGGTGGGAGTGATCGGCGCGGGGCAGATGGGCTCGGGCATCGCCCAGCTCGCCGCCG
CCGCCGGCTGCGGCGTCCTCCTCCTCGACTCCGACACCGCCGCCCTCTCCCGCGCCGTCGACTCCATCTCCTCCTCCCT
CCGCCGCCTCGTCGCCAAGGGCCAGCTTTCTCAGGCCTCCTGTGAGCATTCCATCGAGCAGATTAAGTGCGTCTCCAGT
GTGCAAGAGCTTAGGGATGCGGATCTTGTGATTGAGGCTATCGTGGAGTCAGAAGACATAAAAAAGAAGCTGTTTGTTG
AGCTGGATAAGATCACTAAACCTTCTGCTATTCTTGCCTCCAATACTAGCTCAATCTCTATAACCCGATTGGCTTCAGC
CACTAATCGCCCCTGTCAGGTGATTGGTATGCACTTTTTTAACCCTCCTCCGATAATGAAATTGATTGAAATCATACGT
GGGGCTGATACATCAGAAGAGGTTTTCACTAAAGTCAAATCTTTTTCTGAAAGGCTTGGGAAGACGGTAATATGCTCAC
AAGACTACCCTGGTTTCATCGTGAACCGCATCCTCATGCCAATGATCAACGAGGCGTTCTGGGCACTTTACACTGGAG

> SEQ ID NO:1681 129204 265625_200113_1
tttcGCGTGGGTGCAACTGCACtgtTGCTTAGTGGGTATCCAGTGATCTTGAAAGAGGTTAATGACAAATTCCTCCAGG
CCGGGATGGGTAGAGTAAAAGCCAATTTGCAAAGCAGCGTCAAGAAAGGGAAAATGAGTCCAGAGAAGTTTGAAAAGAC
TCTCTCCCTACTCAAGGGTTCTCTCGATTATGAAAGTTTTAGGGATGTAGACATGGTCATTGAGGCTGTCATCGAGAAT
GTATCATTAAAGCAGCAAATATTTTCTGATCTTGAGAAGTATTGCCCTTCACATTGCATTCTAGCAAGTAACACTTCCA
CGATTGACTTAAATTTGATTGGCGAAAAGACCAAATCTCAAGATCGTATTATCGGAGCTCACTTTTTCAGTCCGGCTCA
TGTGATGCCACTCTTGGAAATTGTCCGCACCCAGAAGACATCGCCCCAAGTAATTGTAGACTTGCTTGATGTTGGCAAG
AAGATAAGGAAAACCCCTGTGGTAGTTGGGAACTGCACTGGGTTTGCTGTCAACAGAATGTTCTTTCCTTACACCCAAG
CTGCTCTTTTGCTAGTTGAACGTGGAACAGATGTCTACCGCATCGATAACGCCATCACTaaATTTGGCATGccAATGGg
T > SEQ ID NO:1682 129329 266732_200115_1
ctctctcttcaacactattgttccagCATAGCATTACCAACTTAGTTGGTTAGGTGAAGATGGCTCAGATCTTGGCTCC
ATCTGCGCAATGGCAGATGAGAATGACAAAGAGCTCAACAGATGCTAATCCCTTGACTTCAAAGATGTGGAGTTCTGTG
GTGTTGAAGCAGAATAAAAGACTTGCTGTTAAAAGCTCTGCCAAATTTAGAGTCTTTGCTCTCCAATCTGATAGTGGCA

FIG. 2 continued

CTGTGAACAGAGTGGAACAGCTGCTAAACTTGGACGTAACTCCATATACTGACAAGATCATTGCTGAATATATTTGGAT
AGGAGGATCTGGAATTGACATGCGCAGTAAATCAAGGACTATTTCAAAGCCAGTCAAGCATGCTTCTGAGCTCCCAAAG
TGGAACTACGATGGATCAAGTACTGGACAAGCACCTGGAGAAGACAGTGAAGTCATTCTATACCCTCAGGCAATATTTA
AAGACCCTTTCCGTGGTGGTaaCAACATCTTGgTTATCTGTGATGCCTACACACCAGCTGGAGAGCCAATTCCAACAAA
CAAACGCCATAAAGCTGCTcaAattTTtagcgaCTC > SEQ ID NO:1683 129329 33334_300457_1
TAAGATAATGTTTATTCATAAATAATACACAGAAATGTTTTCAATAGGATGTGAAGTAAATAAAAAGCAGAATAAGCAG
AGCAAATCTTTGACTTATCCTAAGACATTGCTTGATAGAGAACACAAACTTTGAATCTTGCAAGAAACACAAATTTGAG
TGACATTCAAGATTTTTTCTTGATCTGATGATCATCAAGGATTCCAGAGGATGGTGGTCTCTGCAATCATGGAAGTAAC
AATGTAAGGATCCATGTTCGAAGCTGGCCTCCTGTCCTCAAAGTATCCTTTCCCTTCTTTCTCCGTATCACGTCCTACT
CGGATCGATGCTCCACGGTTCGCAACACCCTACATACAACATTCCAACACACAAAAGAATCACAAAATGTATCGTAATT
CGG > SEQ ID NO:1684 129329 39244_300098_-1
CCCACGCGTCCGCTTTCCCTAAACACACTGATTATTTTCTCTCCGACGCCGCCATGTCTCTGCTCTCAGATCTCGTTAA
CCTCAACCTCACCGATGCCACCGGGAAAATCATCGCCGAATACATATGGATCGGTGGATCTGGAATGGATATCAGAAGC
AAAGCCAGGACACTACCAGGACCAGTGACTGATCCATCAAAGCTTCCCAAGTGGAACTACGACGGATCCAGCACCGGTC
AGGCTGCTGGAGAAGACAGTGAAGTCATTCTATACCCTCAGGCAATATTCAAGGATCCCTTCAGGAAAGGCAACAACAT
CCTGGTGATGTGTGATGCTTACACACCAGCTTGTCCTATTCCAACCAACAAGAGGCACagcGCTGttAAGATCTTC
AgccACCCCGACGTTgccaAGGAGGAGCCTTGGTATGGGATTGAgCAAGAAtacActgtgATGcacaagGatgTGAAct
gcccaAtcgggtGGcctgtgggtggCTACCCTGGCcctcaggGACCTTACTActGtggtgtgGGagcTGACAaagcCat
tggtcgtgaCATTgtgGATGCTCACTACaaggcCtgtcttTACGCCgg > SEQ ID NO:1685 129329 223875_300976_1
ACATTATTGTTCTGGCCGAGTGCTGGAACAACGACGGAACCCCCAACAAGTTCAACCACCGACACGAGTGCGCCAAGCT
CATGAGCGCCCACGAGAAGGAGGTCATCTGGTTCGGAATCGAGCAGGAGTACACCATGTTCGACGAGAGCGATAACCCC
GTCGGATGGCCTAAGGGCGGTTTCCCCGCTCCCCAGGGCCCCTACTACTGTGGTGTCGGAACCGGCAAGGTCTTTGCTC
GAGACGTTGTTGAGGCCCACTACCGAGCCTGTCTCTACTCCGGAATCAACATCTCCGGTATCAACGCCGAGGTCATGCC
TTCCCAGTGGGAGTACCAGGTTGGTCCCTGCGAGGGTATCTCCATGGCCGATGAGCTGTGGATGTCCCGATACCTGCTG
CACCGAGTTGCCGAGGAGTTTGGCATCAAGATCTCCTTCCACCCCAAGCCCCTGCAGGGAGACTGGAACGGAGCCGGCT
GTCACACCAACGTGTCCACCAAGTCGATGCGAGAGCCCGGTGGAATGAAGCACATTGAGGCTGCCATCGAGAAGCTTGC
TGCCCGACACAAGGAGCACATTGCCGTCTACGGCGAGGACAACGACATGCGACTCACCGGCCGACACGAGACCGGCTCC
ATCGGCTCTTTCTCTTCCGGAGTTGCCAACCGAGGCTGCTCCATCCGA > SEQ ID NO:1686 129329 127609_300471_1
cttGATCCAAaaccAATTGAGGGTGATTGGAATGGTGCCGGATGCCACACTAACTACAGTACACTAAGTATGAGAGAAG
AGGGAGGATTTGAAGTAATAAAGAAAGCAATTCTGAATCTCTCACTTCGTCACAAGGAGCATATAAGTGCTTATGGAGA
AGGAAATGAGAGAAGGTTGACTGGAAAGCATGAAACTGCAAGTATTGACAAATTTTCATGGGGAGTTGCCAACCGTGGT
GCCTCAATCCGTGTGGGCGTGACACCGAGAAGCAAGGCAAAGGTTATTTGGAAGACCGCCGCCCAGCTTCAAACATGG
ACCCTTATGTTGTGACCGGATTACTTGCTGAAACTACTATTCTGTGGGAGCCAACCCTTGAGGCTGAAGCTCTTGCTGC
TCAAAAGCTCGCATTGAATGTTTAGATTATTTAAGGGCAGAATTATCCGTAATAATCTTCTTAGAGTTCATGAGCTGCT
AAGTGAAGAAATTTGTACCTTgtttagattccctttagggaaaatcttgtaaaggaaccacagtttatcagttcttcc
tataaaagaggttccttaagac > SEQ ID NO:1687 129329 145582_301060_1
TGAGATTGCTGGAGTTGTGGTGTCATTTGACCCCAAACCTATTCCGGGTGATTGGAATGGTGCTGGAGCTCATACAAAC
TACAGCACAAAGTCTATGAGGAATGAGGGAGGCTATGAAGTCATTAAGAAGGCAATTCAGAAGCTTGGACTGAGGCACA
AGGAGCATATTGCAGCATATGGTGAAGGCAACAGCGTCGTCTCACTGGAAGACACGAAACAGCAGACATCAACACATT
CAAATGGGGAGTTGCGAACCGTGGTGCATCTATTCGTGTGGGAAGAGACACGGAGAAGGAAGGCAAGGGATACTTCGAG
GATAGGAGGCCTGCTTCAAACATGGATCCATACGTCGTGACTTCCATGATTGCCGAGACCACCATTCTATACGAGCTTT
GAGTGTAGAGTCGTCTTTTAAGTATTTGATGACTAAAAATTGGGAGAAAGAATTGAATTTCGGAACAACCCTTTCCTTA
CATGTTCTTAGGGTATAGTTAGTT > SEQ ID NO:1688 129329 188264_300689_1
GAGGATTTGAGGTGATCAACAAGGCAATCCTAAACCTATCACTTCGCCATGACTTGCATATAAGTGCATATGGTGAAGG
AAATGAAAGGAGGTTGACAGGTTTACACGAGACAGCTAGCATTGACAATTTCTCATGGGGTGTGCAAACCGTGGATGC
TCTATTCGGGTGGGGAGAGACACCGAGGCGAAGGGAAAAGGCTACTTGGAAGACCGTCGCCCGGCGCATCAAACATGGACC
CGTACGTCGTGACAGCGCTATTGGCTGAAACCACAATTCTTTGGGAGCCAACCCTCGAAGCGGAGGTTCTTGCTGCTAA

FIG. 2 continued

```
GAAGTTGGCCCTGAAGGTATGAAGAACTTGGACGATGAATCGGGGCAAATAAATCCCAGCAAAATTTGTTTGCTGCCCA
CCAGTCTTgATCTTgtaTTTCTTCTGTCTGGGGAtTGGTCTGTACAAATCTGCAGTTTCTAGAAAACCACGCCACCTTC
CATTCGCCAGTTAACATTTTGGTTGAACACCACACTTGAtCTGGGTCTGTATTTTGAGTCCATTTGTGAGTGACAGAAC
GGATGATGAAACACATcagggacACTTT > SEQ ID NO:1689 129329 201988_300721_1
GCAACGAGCGCCGCCTCACCGGCCGCCACGAGACCGCCGACATCAAGACCTTCAAATGGGGCGTGGCGAACCGCGGCGC
GTCCATCCGCGTGGGGCGCGACACGGAGAAGGAGGGCAAGGGGTACTTCGAGGACAGGAGGCCGGCGTCCAACATGGAC
CCATACGTCGTCACCGGCATGATCGCCGAGACCACGCTGCTGTGGAAGCAGAACTAAGCCGTCCGGCGGGCCTCTCCCG
TGCATTTCTGCGCCCAAAAAAAACAAAAAAAAGAAACGTACGCGTGCGTGCATCAGCCGTGATGTGTCAACGTTGGATT
TCGGTCTCGGTCTATCCTTGGCGTCGACAAGGCCCTTTGAATTTTATTACTAGTCTGTCCTGTTCACCGAGTGTCATTT
TGTGTACTCTGAATAATAATGCTTTGTAAAACGGATTTGCTTTTTCCGTAGGGACGGATGTTCTTGATTTTCCTATATC
GTGATTTATATATATGGAAAACCGCTGTCTTTTTTTGTTC > SEQ ID NO:1690 129329 202022_300722_1
CCCACGCGTCCGGGGCTGCACAAGTATTCAGTGATCCAAAGGTGGTCAGCCAAGTGCCATGGTTTGGAATAGAACAGGA
GTACACTTTGCTCCAGAGAGACGTAAACTGGCCTCTTGGCTGGCCCGTTGGAGGCTACCCTGGGCCCCAGGGTCCATAC
TACTGCGCTGTAGGATCGGACAAATCGTTTGGCCGTGACATATCAGATGCTCACTACAAGGCATGTCTTTATGCTGGAA
TTAACATTAGTGGAACAAATGGAGAGGTCATGCCTGCTCAGTGGGAGTACCAGGTTGGACCTAGTGTCGGTATTG > SEQ ID NO:1691 129329 182333_300660_1
gaattcagaaaaaGTAGAGTGAACAAAAAAAGAAAAAAAAAAGTAATGGCTTCTTCAGTGATCTCCTCTGCTGCAGTCG
CCTCTGTAAGGAGCGCTGCCCCAGCTCAAGCTAGCATGGTTGCACCATTCAGCGGCTTGAAATCCGTTGCTGCATTCCC
AGTTACCCGAAAATCAAACGACATCCACCTCCGTTGCCAGCAATGGTGGAAGAGTTAACTGCATGCAGGTATGCCACCA
AGTGGTTTGAAGAAGTTTGAGACCCTCTCATACCTTCCCCCATTGACCGTCGAGCAACTATCAAAGGAAGTAGTGACAA
TAAATAACAATACCGGGCTCTTCGAGTCTGGTAATTGGAATGAGTACAATCTAAATCCCTTAACGAGGATCCATTGGAG
GGCAAGTCTGGTGCCAGCAGCCGCGGTAATTCCAGCTCCAATAGCGTATATTTAAGTTGTTGCAGTTAAAAAGCTCGTA
GTTGGACTTTGGGTTGGGTCGTCCGGTCCGCCCTTTGGGTGTGCACCGGTCGTCTCGTCCCTTCTACCGGCGATGCGTT
CCTAGCCTTAATTGGCCGGGTCGTGCCTCCGGTGCTGTTACTTTGAAGAAATTAGAGTGCTCAAAGCAAGCCCAAGCTC
TGGATACATTAGCATGGGATAACATCATAGGATTTCGGTCCTATTGCGTTGGCCTTCGGGATCGGAGTAATGATTAACA
GGGACAGTCGGGGGCATTCGTATTTCATAGTCAGAGGTGAAATTCTTGGATTTATGAAAGACGAACAACTGCGAAAGCA
TTTGCCAAGGATGTTTTCATTAATCAAGAGCGAAAGTTGGGGGCTCGAAGACGATCAGATACCGTCCTAGTCTCAACCA
TAAACGATGCCGACCAGGGATCGGCGGATGTTGCTTTTAGGACTCCGCCGGCACCTTATGGGAAATCAAAGTTTACGAT
GGTCCCTGCGGATGCTAACGCAATGTGATTTCTGCCCAGTGCTCTGAATGTCAAAGTGAAGAAATTCAACCAAGCGCGG
GTAAACGGCGGGAGTAACTATGACTCTCTTAAGGTAGCCAAATGCCTCGTCATCTAATTAGTGACGCGCATGAATGGAT
TAACGAGATTCCCACTGTCCCTGTCTACTATCCAGCGAAACCACAGCCAAGGGAACGGGCTTGGCAGAATCAGCGGGGA
AAGAAGACCCTGTTGAGCTTGACTCTAGTCCGACTTTGTGAAATGACTTGAGAGGTGTAGGATAAGTGGGAGCCGTCTT
TGGCGGCGAAGGTGAAATACCACTACTTTTAACGT > SEQ ID NO:1692 129329 14118_300269_1
cccacgcgtccgaaacacactgattattttctctccgacgccgccatgtctctgctctcagatctcgttaacctcaacc
tCACCGATGCCACCGGGAAAATCATCGCCGAATACATATGGATCGGTGGATCTGGAATGGATATCAGAAGCAAAGCCAG
GACACTACCAGGACCAGTGACTGATCCATCAAAGCTTCCCAAGTGGAACTACGACGGATCCAGCACCGGTCAGGCTGCT
GGAGAAGaCAgTgAAGTCATTCTATACCCTCAggCAATATTCAAGGATCCCTTCAGgAAAGGCAACAACATCctggtgA
TgtgtGATGCTTACACACCAgctggtgatCCTATtccaaCcaaCAagaggcacaACGCtgctAagaTCTtcagccacCC
CGACGttgccaaggaggagCCTtggTATGGGATTGAGcaagaATACACTTTGATGCAAAggaTgtGAACt > SEQ ID NO:1693 129410 14673_300266_1
cccacgcgtccggcgggacggattcaaagtCATATCTGAGCTGCCTTCAGATTGTTTTGGAGCTTATATTATCTCTATG
GCAACTTCACCTAGTGATGTGCTTGCGGTTGAGCTTTTACAGCGCGAATGCCATGTGAAAAATCCACTTAGAGTTGTTC
CACTCTTTGAGAAGCTAGCTGATCTTGAAGCAGCTCCTGCCGCTGTTGCAAGACTCTTTTCTATAGACTGGTACAAAAA
CCGTATTAACGGTAAACAAGAGgTTATGATTGGTTACTCAGATTCAGGGAAAGATGCAGGGCGTCTCtCagctgctTGG
GAGCTATACAAAGCTcaag > SEQ ID NO:1694 129424 127868_300473_1
CCCCCCGAGTTCCCCATTTCAGCAGCAAAGGCAACAATGGCGGCTGCAAGAGTAATGATATCAGCCAACAACACTCTAA
CAACTTCTCTTTTATCCAAAATTCCTCTCCAAAAGCCCAATAGTTTCAACCTTTGTTTCCGCAATAGGTCTGCTGCTGC
ACACAGGAGCCAACTTTTCACTTGCACTGCTATTTACAATCCCCAGATTCAAATCAAAGAACAAGGCCAGCCCGAAACT
TTAGATTACCGTGTCTTTTTCGTTGATGATTCCGGCAAAAAGGTGTCCCCTTGGCATGACATACCACTGCATTTAGGTG
```

FIG. 2 continued

ATGGTGTTTTCAATTTTATTGCTGAAATTCCTAAAGAATCGAGTGCAAAGATGGAAGTTGCTACAGATGAGCTGTACAC
ACCAATAAAGCAAGACACAAAGAAGGGGAAACTTAGATACTACCCATATAATATTCATTGGAACTATGGATTGCTTCCT
CAAACCTGGGAAGACCCCTCATTTGCAAATGCTGAAGTTGAGGGGGCATTCGGAGATAATGACCCTGTTGATGTTGTCC
AGATTGGGGAAAGTCGTGCTAAAATTGGCC

> SEQ ID NO:1695 129725 145365_301059_1
TTTTTCCTCTCCCCTCACCAAACCCCCTTCTTCTCCATCTGCACAATCAACCATTCCCATCACACAACTTACACAACAA
TTCAACCATCAAAATGGCTTTATCCACAAATCGGACGGTTAACCACCTTCTAAAGCCATTATCAGCCGCCATCTGGGCC
ACGCGCCGCCTATCGTCCGACACCATCACCGTCGAGACTAGCCTCCCATTTACCGGCCACAACATCGATCCTCCTTCAC
GCGCCGTCGAGACAAGCGCCAATGAACTAATGACTTTCTTCAAAGACATGGCGGAGATGCGGCGTATGGAGATCGCCGC
TGATTCGCTCTACAAGGCGAAACTCATTCGTGGATTCTGCCACCTCTACGACGGCCAGGAGGCCGTTGCCATAGGCATG
GAAGCTGCAATTACCAAAAAGGACTGTATCATTACGGCTTATAGGGATCACTGTTTATTCCTAGGGCGTGGTGGAGGGT
TATACGAGTCATTTGCGGAGTTAATGGGGAGAAAAGATGGGTGTTCGAAAGGGAAAGGAGGGTCGATGCATTTTTATAA
GAAGGAGAGTGGATTTTATGGAGGTCATGGGATTGTAGGTGCTCAAGTTCCT

> SEQ ID NO:1696 129725 182386_300660_1
GAATTCAGAATCACAGAGAAACCCAGTGAAGCACTTGGGAAACAAACACAATGTCTTTTTCGACAATCAAAATCATTCA
ACCTGTCCCAGTTACTAGATCTCATGAAAAATCCATTCTTGACCCTTTAAAATCAAACAACAATTCCTTCTTGGGCACT
ACTAATAATCTTCGTTCAATCTCATCCAAATCGAATTTCCCTTCATTTATTCGTCGATCTTCTTCAATTTCAGCTGTTT
CTGATGTCGTTAAGGAGAAAAAACTCAAATCTAACTCCGCCATCTCCAATTTGTTGATAACTAAAGAGGAAGGACTGGT
ATTATATGAAGATATGGTATTAGGGAGAGCATTTGAAGATATGTGTGCTCAGATGTATTACAGAGGTAAAATGTTTGGA
TTTGTTCATCTTTACAATGGACAAGAAGCTGTTTCAACTGGATTTATTAAGCTATTGAAAAAGGAAGATTCTGTAGTTA
GTACTTACCGTGATCATGTTCATGCACTAAGTAAGGGTGTACCTGCTCGTCAAGTTATGAGTGAGCTCTTTGGTAAGGC
TACTGGATGTTGTCGTGGACAAGGAGGATCTATGCATATG

> SEQ ID NO:1697 129725 158106_200001_1
TAGCACTCACCAAACGCTCTCTCCAGATTCTCTCTTACAGAGATCGAAAATGGCGCTATCTACAGGCCGAAGAACCGTC
AATCACCTCTTGAAACCTCTAACGGCGGCGGTGTCCGCCACGCGCCACGTATCGTCGGACTCGACCGCCACAATCACGG
TAGAAACCAGCCTCCCATTCACCGGCCACAAGATCGATCCTCCATCCCGCACCGTCGAAACAAGCGCTAATGAACTCAT
GACTTTTTTCAAGGACATGGTGGAGATGCGGCGGATGGAGATCGCCGCGGATTCGCTCTACAAAGCAAAACTCATCCGT
GGCTTCTGCCATCTCTACGATGGACAAGAAGCCGTCGCTATTGGCATGGAAGCCGCAATTACCAAAAAGGATTGTATTA
TTACAGCTTATAGAGACCATTGCATCTTCCTTGCCCGCGGCGGAGGGTTATATGAATCATTTGCGGAGCTTATGGGAAG
GAAAGATGGATGTTCGAAAGGTAAAGGAGGATCCATGCATTTTTATAGGAAGGATAGTGGATTTTATGGAGGTCATGGT
ATTGTTGGTGCTC

> SEQ ID NO:1698 129725 236076_301283_1
acgcgtcGAGAAGAACAGCTAGGAAGAGCTCCTCGTCTCTCCATGGCGTCGCGAGCTATGGCGTCGATCAGCCCATCTT
CCATCTCCGCCGGCGCCTGCCGCGACGTCGGATCTTCCAGTGTAGTAGGCTTCCATAATAGAAGCGGCAACAGCAG
CGCATTTACCGGCCGCGGCATCCGGGTCTCGACCAGATCGCTGTCCATCGCCAGCGCCAAGAAGAGGAGCTGCGCCGTC
GCCGCCACCGCCGCGCCGGTCAAGGAATCCCCGCCAAAGATCGCCGACACGCTCGTCACGCGGGAGGAAGGCCTGGAGC
TCTACGAGGACATGGTTCTTGGTCGATCCTTCGAGGATATGTGCGCCCAGATGTACTACCGCAGCAAGATGTTTGGATT
CGTCCACCTCTACAACGGCCATGAAGCCGTCTCCACGGGATTCATCAAGGCGCTCAAGAAGGACGACTACATCTGTAGC
ACGTATCGAGACCACGTCCATGCGCTGAGCAAGGGCGTCCCCGCCAGGCAAGTCATGAGCGAGCTCTTCGGGAAGTCCA
CGGGATGCTGCCGCGGCCAGGGCGGATCCATGCATATGTTCTCCAAAGAGCACCGCCTGCTCGGTGGATTCGCCTTCAT
CGGCGAGGGGATCCCCGTCGCCACCGGCGCGGCATTCACCACCAAGTACTCGCGGGAGGTTCTCAAGGACCAGAGCGTT
GATGCGGTGAc > SEQ ID NO:1699 129725 246382_301612_1
AGCATGCTATGCGTTTCCGTGTCAAGGATTTCTGGAAATGGATACAGCTTTGGTCTTCCAACAAGCCCGGCCCGTCTCC
CTCTCCGGCGCCGGACGTGATCCATGTCGACATTCCGGTCCCATTCCAGCTCCATCTCCTCAAGGAAGGCCCGCGTCGC
GAGTCCGAGACCACCAAGGAGGACCTCGTCAGGATGTACAGGGATATGTTCCGCATTCGCCGGATGGAGATCACTGCTG
ATAAGCTCTTCAAGTCCCAGCTAGTTCGCGGTTTCTGCCACCTTTACGATGGCCAAGAAGCGGTCGCGATCGGCATGGA
AGCCGCATTGACGTTTGAAGACTCGGTGATCACGGCGTACAGAGATCACGGTACATTCCTTGGACGAGGAGGAACAGTG
CATGAATGTTTCGCCGAGCTCATGGGAAAATCCACCGGATGTGCTCGAGGGAAAGGAGGCTCCATGCATCTCTACAAGC
CTTCGAATAACCTCTACGGTGGATGGGGAATTGTGGGAACCTCGGGACCTCTCGGTACCGGATTGGCATTTGCGAACAA
GTACCAGAAGAAGGACAACGTCACAGTAGCAATCTATGGTGATGGTGCTGGCAatcagggacaattgtttgacgcgAAA
AATatggcggcGCTGTGGGATCTGCCggtTATttttctcGTCGAGAACAAtcac

FIG. 2 continued

> SEQ ID NO:1700 129725 259406_301705_1
tcgaccacgcgtcgGAAGGAAGAGCGATGGCGATAGCGATGGCTCGGCGGCGGCTTCTCTCCTCCTCCTCCTCCAC
GTCCTCGGCAGCGGCAGCCGCGGCGCCGCTTCTCCGGCGGGCGGCGGCGCTCAATCCATCCAGGTACTTCGCGTCGTCG
GGGATGGACGACACGACGCCGTTCGTGGTGGACATCCCCGTGCCCTACGCCGGGCATCGATGCGACCCCCGGAGCAGA
AGGTGGAGACTTCGGCCAAAGAGCTGGTGGACTACTTCAAGGTGATGTACGTGATGAGGCGGATGGAGATCGCCGCGGA
CAGCCTCTACAAGGCCAAGTTTATACGTGGTTTCTGCCACCTTTACGACGGCCAAGAGGCCGTGTGCGTCGGGATGGAG
GCGGCGCTCACCAAAGAGGACGCTATCATCACCGCGTATCGAGACCACTGCACGCATCTTGGACGTGGTGGAACTGTGC
TCGAGGTGATGGCCGAGTTGATGGGGAGGAAGGATGGATGCTCGCTGGGAAAGGGTGGATCGATGCATATGTACAAGAA
GGATGCCAACTTCTATGGAGGGAATGGGATCGTTGGTGCACAAACTGCTCTCGGTGCTGGCCTGGCCTTCGCGCAGAAG
TATAACAAGCAGGGCGCGGTGTCGCTGGCGCTGTATGGAGATGGTGcggccacaccagggcaGCTGTTTGaggcgatga
atatCGCGGCgCTgtgggacttgccggCGATCTTCGt > SEQ ID NO:1701 129725 274171_200148_1
tttggtttctcctctctatttctcgttttctccgcacttttcacttattaaaccattgattatataattcaacacattt
cATCTGTTTGTTAGACACAGCAATTCCATTTTTTGATTTTTCCTGTAATTCCTTCATCTGTGTCTCCAAAAACATGGCG
ACGGCTTTTTCTGCAACAAAAGTTTTGCAACCTTTGCCCTTTAATTCTACTAGATCTGCTGAAAACCCCCTTTTGATCC
AAAGTTCATCTTTTCTTGGATCATCATTTTCTCATAAGCTTTCTCTCAAGAAGCCTTTTTTGCCTCCTAATTCCCAGCG
TCGATCCAATGCAGCGGTTGTTGCTGTTTCTGATGTTGTTAAGGAAAAGAAGTCTAAGTCCAAATCGTCTCTCTCCAAT
CTGTTGATTACTAAAGAGGAAGGGTTGGTACTGTATGAGGACATGGTGCTGGGAAGAGCTTTTGAGGACATGTGCGCCC
AAATGTATTACAGGGGAAAAATGTTTGGTTTTGTGCATTTGTACAACGGCCAAGAAGCTGTCTCGACTGGTTTCATTAA
GCTCTTGAAGAAGGAAGACTCTGTAGTTAGCACTTACCGTGACCATGTCCATGCATTGAGTAAAGGTGTCCCAGCTCGT
CAAGTGATGAGTGAGCTATTTGGAAAGACCACGGGCTGTTGTAGAGGCCAGGGTGGATCCATGCACATGTTCTCCAAAG
AGCACAATGTTCTTGGTGGTTTCGCTTTTATCGGTGAGGGAATCCCGGTGGCTGCAGGTGCTGCATTCACTAGCAAGTA
CAGAAGGGAGGTCTTGAAGGAGGCTGATTGTGATCATGTCACTCTAGCCTTCTTTGGTGATGGAACTTGCAACAATGGC
CAATTCTACGAGTGCTTGAACATGGCCGCATTGTGGAAATTGCCCATTATCTTTGttGttgAGAACAATCTGTGGGCAA
TTGGGATGTCTCACTTGAggTCTACTTCTGATCCTGAAATTTGGAaGaaaggTcCTGCTTTTGGGATGCCTgGGGTtCA
TGTTGATGGCATggATGTGTTAAaggtgagggaggtaGc > SEQ ID NO:1702 129748 265074_301442_1
cccacgcgtccgAGCACTGCTACTGGACATACTCTACTACTACTAGCCAGTAAGCTAGCTAACTAACTACGTGGCTATG
GCCCCCACCGTGATGGCCTCCTCGGCCACCTCCGTGGCTCCATTCCAAGGGCTCAAGTCCACCGCCGGCCTCCCCGTCA
GCCGCCGCTCCACCAACTCGGGCTTCGGCAACGTCAGCAATGGCGGAAGGATCAAGTGCATGCAGGTGTGGCCAATTGA
GGGCATCAAGAAGTTCGAGACCCTATCGTACCTGCCACCACTCACCGTGGAGGATCTTTTGAAGCAGATCGAGTACCTG
CTTCGATCCAAGTGGGTGCCTTGTCTCGAGTTCAGCAAGGTTGGGTTCGTCTACCGTGAGAACCACAGGTCTCCCGGAT
ACTACGATGGCAGGTATTGGACCATGTGGAAGCTGCCCATGTTCGGCTGCACCGATGCCACCCAGGTGCTCAAGGAGCT
CGAGGAGGCCAAGAAGGCCTACCCTGATGCCTTTGTCCGTATCATCGGCTTCGACAACGTCAGGCAGGTGCAGTTGATT
AGCTTCATCGCCTACAAGCCCCCAGGTTGCGAGGAGTCTGGTGGCAACTAAGCTAAGATCAAGCATCGCGCTGGTGGAT
TGCTGCCTATAATAATAGTATGCAGCTTTGTTTTGGGCTATGTTGATGATATATCAATATATAATATGCTATATATtt > SEQ ID NO:1703 129748 284226_200096_1
cccccccgAATATTCAGCAATGGCTTCCTCAGTTATGTCCTCAGCTGCCGCTGTTGCCACCGGCGCCAATGCTGCTCA
AGCCAGTATGGTTGCACCTTTCACTGGCCTCAAGTCCGCAACCTCCTTCCCTGTTTCCAGAAAACAAAACCTTGACATT
ACTTCCATTGCTAGCAACGGCGGAAGAGTTCAATGCATGCAGGTGTGGCCACCAATTAACAAGAAGAAGTACGAGACAC
TCTCATACCTTCCCGATTTGAGCCAGGAGCAATTGCTTAGTGAAGTTGAGTACCTGTTGAAAAATGGATGGGTTCCTTG
CTTGGAATTCGAGACTGAGCGTGGATTCGTCTACCGTGAACACACCAGCTCACCAGGATATTATGATGGCAGATACTGG
ACCATGTGGAAGTTGCCCATGTTCGGGTGCACTGATGCCACTCAGGTGTTGGCTGAGGTCGAGGAGGCAAAGAAGGCTT
ACCCACAAGCCTGGGTTAGAATCATTGGATTCGACAATGTCCGTCAAGTGCAATGCATCAGTTTCATCGCCTACAAGCC
AGAAGGCTACTAGAATCTCCATTTTTAAGGCAACTTATCGTATGTGTTCCCCGGAGAAACTGTTTTGGTTTTTCCTGCT
TCATTATATTATTCAATGTATGTTTTTGAAttccAaTcaaggttatGagaaCTaaTAATGACAtttaATTtgttTCTTT
TCT > SEQ ID NO:1704 129748 118122_300064_1
ggTAAAGGAAAAAAAAGGAAAAGAGAGAAAGAGAAATCTTTCTGTCTTAAGTGTAATTAACAATGGCTTCCTCAGTTCT
TTCCTCAGCAGCAGTTGCCACCCGCAGCAATGTTGCTCAAGCTAACATGGTTGCACCTTTCACTGGTCTTAAGTCAGCT
GCCTCGTTCCCTGTTTCAAGGAAGCAAAACCTTGACATCACTTCCATTGCCAGCAACGGCGGAAGAGTGCAATGCATGC
AGGTGTGGCCACCAATTAACAAGAAGAAGTACGAGACTCTCTCATACCTTCCTGATTTGAGCGTGGAGCAATTGCTTAG
CGAAATTGAGTACCTCTTGAAAAATGGATGGGTTCCTTGCTTGGAATTCGAGACTGAGCACGGATTTGTCTACCGTGAA
CACCACAAGTCACCGGGATACTATGACGGCAGATACTGGACCATGTGGAAGTTGCCTATGTTCGGATGCACTGATGCCA
CCCAAGTGTTGGCCGAGGTGGAAGAGGCGAAGAAGGCATACCCACAAGCCTGGATCCGTATTATTGGATTCGACAACGT

FIG. 2 continued

```
GCGTCAAGTGCAGTGCATCAGTTTCATTGCCTACAAGCCAGAAGGCTACTAAGTTTCATATTAGGACAACTTACCCTAT
TGTCCGACTTTAGGGGCAATTTGTTTGAAATGTTACTTGGCTTCTTTTTTTTTAATTTTCCCACAAAAACTGTTTATG
TTTCCTACTTTCTATTCGGTGTATg

> SEQ ID NO:1705 129748 167344_300546_1
gaattcaagtatgaactaattcagactgtgggacTGCGAATGGCTCATTAAATCAGTTATAGTTTGTTTGATGGTACTT
GCTACTCGGATAACCGTAGTAATTCTAGAGCTAATACGTGCAACAAACCCCGACTTCTGGAAGGGATGCATTTATTAGA
TAAAAGGTCGACGCGGGCTTTGCCCGTTGCTCAGATGATTCATGATAACTTGACGGATCGCACGGCCTTTGTGCTGGCG
ACGCATCATTCAAATTTCTGCCCTATCAACTTTCGATGGTAGGATAGTGGCCTACTATGGTGGTGACGGGTGACGGAGA
ATTAGGGTTCGATTCCGGAGAGGGAGCCTGAGAAACGGCTACCACATCCAAGGAAGGCAGCAGGCGCGCAAATTACCCA
ATCCTAACACGGGGAGGTAGTGACAATAAATAACAATACCGGGCTCTTCGAGTCTGGTAATTGGAAGAGTTAACTGCAT
GCAGGTATGGCCACCAAGTGGTTTGAAGAAGTTTGAGACCCTCTCATACCTTCCTcCATTGACCGTCGAGCAATTGTCA
aaggaagtCGACTAccttctccgtaatggATGGgTtccctgtTTGgaattcgacgCCa > SEQ ID NO:1706 129748 167675_300549_1
GAATTCATGACCACCATCCGGTTTGAAGAAGGTTGACACCCTCTCATACTTTCCTGCATTGACCGCGGACTAATTATCA
AAGGAAGGTGACTACCTTCTCCGTAATGGATGGGTTCCCTGCCTGAAATTCGACGCCAGAAGATTACTGTACAGATAAC
ACAGCAACACCCCTGGATACTATGAGTGGTGCGGTACTGGACAATGCGGAAGTTACCCATGTTCGGGTGTACCGACTCT
TTCCACGTTATCAAGGAGCTACAAGAGGCCAAGGCTGCTTACCCACACTCATTCAT > SEQ ID NO:1707 129748 175551_300545_1
CAAGAAGTACTCGAGCAAAGAAGGACAGAGCTTGGTGAGCTGCAGAGATGGCCCCCTCCGTGATGGCGTCGTCGGCCAC
CACCGTCGCTCCCTTCCAGGGGCTCAAGTCCACCGCCGGCATGCCCGTCGCCCGCCGCTCCGGCAACTCCAGCTTCGGC
AACGTCAGCAATGGCGGCAGGATCAGGTGCATGCAGGTGTGGCCGATTGAGGGCATCAAGAAGTTCGAGACCCTCTCCT
ACCTGCCACCGCTCACCGTGGAGGACCTCCTGAAGCAGATCGAGTACCTGCTCCGTTCCAAGTGGGTGCCCTGCCTCGA
GTTCAGCAAGGTCGGATTTGTCTACCGTGAGAACCACAGGTCCCCTGGATACTACGACGGCAGGTACTGGACCATGTGG
AAGCTGCCCATGTTCGGGTGCACCGACGCCACCCAGGTGCTCAAGGAGCTCGAGGAGGCCAAGAAGGCGTACCCTGATG
CATTCGTCCGTATCATCGGCTTCGACAACGTTAGGCAGGTGCAGCTCATCAGCTTCATCGCCTACAAGCCCCCGGGCTG
CGAGGAGTCTGGTGGCAACTAAGCCGTCATCGTCATATATAGCCTCGTTTAATTGTTCATCTCTGATTCGATGATGTCT
CCCACCTTGTTTCGTGTgttcccagtttgttcatCGTCTTTtgattTACCGgc > SEQ ID NO:1708 129748 181821_300657_1
gaattcaggcGTAGTAATTCTAGAGCTAATACGTGCAACAAACCCCGACTTCTGGAAGGGATGCATTTATTAGataAAA
GGTCGACGCGGGCTTTGCCCGTTGCTCAGATGATTCATGATAACTTGACGGATCGCACGGCCTTTGTGCTGGCGACGCA
TCATTCAAATTTCTGCCCTATCAACTTTCGATGGTAGGATAGTGGCCTACTATGGTGGTGACGGGTGACGGAGAATTAG
GGTTCGATTCCGGAGAGGGAGCCTGAGAAACGGCTACCACATCCAAGGAAGGCAGCAGGCGCGCAAATTACCCAATCCT
AACACGGGGAGGTAGTGACAATAAATAACAATACCGGGCTCTTCGAGTCTGGTAATTGGAATGAGTACAATCTAAATCC
CTTAACGAGGATCCATTGGAGGGCAAGTCTGGTGCCAGCAGCCGCGGTAATTCCAGCAACGGTGGGAGAGTTAACTGCA
TGCAGGTATGGCCACCATCCGGTTTGAAGAAGTTTGAGAccCTCTCATACCTTCCTCCATTGACCGTGGAGCAATTATC
AAAGgAAGtTGACTAccTTCTCCGTAATggATGGgttccCTGCCtggAATttGACGccagaggattcgtGTACAGAGaa
cAcggtaacAccCctggatACTATGATG > SEQ ID NO:1709 129748 181705_300627_1
gaattcAAGTATGAACTAATTCAGACTGTGAAACTGCgaatGGCTCATTAAATCAGTTATAGTTTGTTTGATGGTACTT
GCTACTCGGATAACCGTAGTAATTCTAGAGCTAATACGTGCAACAAACCCCGACTTCTGGAAGGGATGCATTTATTAGA
TAAAAGGTCGACGCGGGCTTTGCCCGTTGCTCAGATGATTCATGATAACTTGACGGATCGCACGGCCTTTGTGCTGGCG
ACGCATCATTCAAATTTCTGCCCTATCAACTTTCGATGGTAGGATAGTGGCCTACTATGGTGGTGACGGGTGACGGAGA
ATTAGGGTTCGATTCCGGAGAGGGAGCCTGAGAAACGGCTACCACATCCAAGGAAGGCAGCAGGCGCGCAAATTACCCA
ATCCTAACACGGGGAGGTAGTGACAATAAATAACAATACCGGGCTCTTCGAGTCTGGTAATTGGAAAGAGGATTCGTCT
ACAGAGAACACGGTAACACCCCGGATACTACGATGGTCGTtaCTGGACAATGTGGAAGCTAcCCATGTTCGGTTGTAC
CGATGCTTccCAGGTTATCAAggagCT > SEQ ID NO:1710 129748 184657_300671_1
gaattcaaaggaaaaaatggcttcttcagtgatttcctctgccgcagtcgcctccgtaaggagtgccgccccgctcaA
GCTaGCATGGTTGCACCATTCAGTGGTTTGAAATCAGTTGCCGCTTTCCCTGTTACCCGCAAATCAAACGATATCACCT
CAGTTGCCAGCAACGGTGGAAGAGTTAACTGCATGCAGGTATGGCCACCATCCGGTTTGAagaagTTTgagacCCTCTC
ATACCTTCCTCCATTGACCGTGGAGCAATTATCAAAGGTaGTGACAATAAATAACAATACCGGGCTCTTCGAGTCTGGT
AATTggaattTGACGCCAGaggATTCGTGTACAGagaACAcGGTAACAccCCTGGATACTATGATGGTCGTTACTGGAC
AatgtggaaGttAcccATGttCgGTTgta
```

FIG. 2 continued

> SEQ ID NO:1711 129748 168174_300553_1
gaattcTAATTAAAACAAAGCATTGCGATgggcccTGCGGATGCTAACGCAATGTGATTTCTGCCCAGTGCTCTGAATG
TCAAAGTGAataAATTCAACCAAGCGCGGGTAAACGGCGGGAGTAACTATGACTCTCTTAAGGTAGCCAAATGCCTCGT
CATCTAATTAGTGACGCGCATGAATGGATTAACGAGATTCCCACTGTCCCTGTCTACTATCCAGCGAAACCACAGCCAA
GGGAACGGGCTTGGCAGAATCAGCGGGGAAAGAAGaCCCTGTTGAGCTTGACTCTagTCCGACTTTGTGAAATGACTTG
AGaGGTgTAGGATAAGTGGGAGCCGTCTTTGGCGGCGAAggTGAAATACCACTACTTTTAACGTTATTTTACTTATTCC
gtgagGCGGAAGCGGGGCATCGCCCCTCTTTttatatcCAaggctagcTTGCTATGCCGATCCGTTgCTGCaTTCCCAG
TTACCCGAAAATCAAaCGACATCACCtccgTTGCCagCAATGgtgGAagagtTAACTgcatgcaggTAtggccacCAag
tgGTTTGa > SEQ ID NO:1712 129748 167558_300548_1
gaattcAGGCCAAGGCTGCATACCCAGACtctttCATCAGAATCATCGGATTCGACAACGTTCGTCAAGTACAATGTGT
TAGTTTCATCGCATACAAGCCAGACAGTACTGCCTACTGAAAACCTTTGATGAATTAGTTCATACTTACATATGCTTGT
CTCAAAGATTAAGCCATGCATGTGTAAGTATGAACTAATTCAGACTGTGAAACTGCGAATGGCTCATTAAATCAGTTAT
AGTTTGTTTGATGGTACTTGCTACTCGGATAACCGTAGTAATTCTAGAGCTAATACGTGCAACAAACCCCGACTTCTGG
AAGGGATGCATTTATTAGATAAAAGGTCGACGCGGGCTTTGCCCGTTGCTCAGATGATTCATGATAACTTGACGGATCG
CACGGCCTTTGTGCTGGCGACGCATCATTCAAATTTCTGCCCTATCAACTTTCGATGGTAGGATAGTGGCCTACTATGG
TGGTGACGGGTGACGGAGAATTAGGGTTCGATTCCGGAGAGGGAGCCTGAGAAACGGCTACCACATCCAAGGAAGGCAG
CAGGCGCGCAAATTACCCAATCCTAACACGGGGAGGTAGTGACAATAAATAACAATACCGGGCTCTTCGAGTCTGGTAA
TTGGAATGAGTACAATCTAAATCCCTTAACGAGGATTCGTCTACAGAGAACACGGTAACACCCCTGGATACTATGATGG
CCGTTACTgGACAATGTGGAAGCTACCCATGTTCggtTGTACCGACGCttc > SEQ ID NO:1713 129748 126182_300460_1
ccCACGCGTCCGGCAAAAGCTAAATAATTAATTGCAACAATGGCTTCCTCTGTGATTTCCTCAGCTGCTGCCGTTGCCA
CCGGCGCTAATGCTGCTCAAGCCAGCATGGTTGCACCCTTCACTGGCCTCAAATCTGCTTCCTCCTTCCCTGTTACCAG
AAAACAAAACCTTGACATTACATCCATTGCTAGCAATGGTGGAAGAGTCCAATGCATGCAGGTGTGGCCACCAATTAAC
ATGAAGAAGTACGAGACACTCTCATACCTTCCTGATTTGAGCCAGGACAATTGCTTAGTGAAGTTGAGTATCTTTTGA
AAAATGGATGGGTTCCTTGCTTGGAATTCGAGACTGAGCGTGGATTTGTCTACCGTGAACATCACAGCTCACCAGGATA
CTACGATGGCAGATACTGGACCATGTGGAAGTTGCCCATGTTCGGGTGCACTGATGCCACTCAGGTGTTGGCTGAGGTC
GAGGAGGCAAAGAAGGCTTACCCACAAGCCTGGGTTAGAATCATTGGATTCGACAACGTCCGTCAAGTGCAATGCATCA
GTTTTATCGCCTCCAAGCCAGAAGGCTACTAAAATCTCCATTTTTAAGGCAACTTATCGTATGTGTTCCCCGGAGAAAC
TGTTTTGGTTTTCCTGCTTCATTATATTATTCAATGTATGTTTTTGAATtc > SEQ ID NO:1714 129748 128913_300401_1
TGGACATACTCTACTACTACTAGCCAGTAAGCTAGCTAACTAACTACGTGCTATGGCCCCCACCGTGATGGCCTCCTCG
GCCACCTCCGTGGCTCCATTCCAAGGGCTCAAGTCCACCGCCGGCCTCCCCGTCAGCCGCCGCTCCACCAACTCGGGCT
TCGGCAACGTCAGCAATGGCGGAAGGATCAAGTGCATGCAGGTGTGGCCAATTGAGGGCATCAAGAAGTTCGAGACCCT
ATCGTACCTGCCACCACTCACCGTGGAGGATCTTTTGAAGCAGATCGAGTACCTGCTTCGATCCAAGTGGGTGCCTTGT
CTCGAGTTCAGCAAGGTTGGGTTCGTCTACCGTGAGAACCACAGGTCTCCCGGATACTACGATGGCAGGTATTGGACCA
TGTGGAAGCTGCCCATGTTCGGCTGCACCGATGCCACCCAGGTGCTCAAGGAGCTCGAGGAGGCCAAGAAGGCGTACCC
TGATGCATTCGTCCGTATCATCGGCTTCGACAACGTTAGGCAGGTGCAGCTTATCAGCTTCATCGCCTACAAGCCCCCG
GGCTGCGAGGAGTCTGGTGGCAACTAAGCCGTCATCGTCATATATAGCCTCGTTTAATTGttCATCTCTGATTCGATGA
TGTCTCCCACCTTgtttCgtgtgttCCCAgTttgttcATCGTCTTTTGATTTtACcggccgtgcTCTgcTTTTgttTTT
gtttCAccTGATCTCTCTCTGACTTGATGTaagagtggtaTCTGCtacgactATATGttgttgggtgaggCATATGTGa
aTGAAATCTATGaaAGCTccggctatatatAtTTA > SEQ ID NO:1715 129748 141829_300429_1
ccgctcAAGCCACTGCTGCAGCGTGACTCTGCTCTAGCACCTCACCAAGCAGAAAGCTAGAGAGCTAGCAATGGCGCCC
ACCGTGATGGCCTCGTCGGCCACCTCCGTTGCTCCCTTCCAGGGGCTCAAATCCACCGCCGGGCTCCCCGTCAGCCGCC
GCTCCAACAGCGCCGGCCTCGGCAGCGTCAGCAACGGTGGAAGGATCAGCTGTATGCAGGTGTGGCCGATTGAAGGCAT
CAAGAAGTTTGAGACCCTGTCGTACCTGCCACCGCTCACGGTCGAGGACCTCTTGAAGCAGATCGAGTACCTGCTCCGG
TCCAAATGGGTGCCTTGCCTCGAGTTTAGTAAGGTCGGGTTCGTCTACCGTGAGAACCACAGGTCTCCTGGGTACTATG
ATGGCAGGTACTGGACCATGTGGAAGCTGCCTATGTTCGGATGCACTGATGCCACCCAGGTGCTCAAGGAGCTCGAGGA
GGCCAAGAAGGCATATCCAGATGCATTTGTTCGCATCATCGGCTTCGACAACGTCAGGCAGGTGCAGTTGATTAGCTTC
ATCGCCTACAAGCCCCCGGGTTGCGAGGAGTCCGGCGGAAACTAAGCTAGTTGGCAAGCCAGCAAGCTCACTCGTGAGC
TCTATACAGAGGAGACTCGATTGATCTATTCGGTTTTGGcagctttGaacgttC

FIG. 2 continued

> SEQ ID NO:1716 129748 127824_300473_1
cccgctcttgaaagcAAAGGTCAAGGGTAGCAATAGCTTTAAGCTTAGAAATTATTTTCAGAAATGGCTTCCTCAGTTA
TGTCCTCAGCAGCTGCTGTTGCGACCGGCGCCAATGCTGCTCAAGCCAACATGGTTGCACCCTTCACTGGCCTCAAGTC
CGCCTCCTCCTTCCCTGTTACCAGGAAACAAAACCTTGACATTACCTCCATTGCTAGCAATGGTGGAAGAGTTCAATGC
ATGCAGGTGTGGCCACCAATTAACATGAAGAAGTACGAGACACTCTCATACCTTCCTGATTTGAGCCAGGAGCAATTGC
TTAGTGAAGTTGAGTACCTTTTGAAAAATGGATGGGTTCCTTGCTTGGAATTCGAGACTGAGCGTGGATTCGTCTACCG
TGAACACCACAACTCACCAGGATACTACGATGGCAGATACTGGACCATGTGGAAGTTGCCCATGTTCGGGTGCACTGAT
GCCACTCAGGTGTTGGCTGAGGTCGAGGAGGCAAAGAAGGCTTACCCACAAGCCTGGGTTAGAATCATTGGATTCGACA
ACGTCCGTCAAGTGCAATGCATCAGTTTTATCGCCTCCAAGCCAGAAGGCTACTAAAATCTCCATTTTTAAGGCAACTT
ATCGTATGTGTTCCCCGGAGAAACTGTTTTGGTTTTCCTGCTTCATTATATTATTCAATGTATGTTTTTGAATTCCAat
CAaggttATGAgaactaaTaATGACAt > SEQ ID NO:1717 129753 108316_300381_1
gttttcaccaacttttcatatgcttgagatccagaggaaaaaaaaaacagagaacacagtagtaggcacaaccctcgtc
aCACTCACCCACCCACTCATCAGCCGACACCATTTTGAAATATTCCTACATAACCACTTCGATACCCATTGTTAATATT
GCACTTACCTTAGATCTGAACTTTTTCCTCAGCTGCAGAAAACAAAATATCAAAACAATGGAGTACAAGGGAATTCTTT
TGGGCATGGGAAATCCATTGCTCGACATCTCAGCTGTTGTAGATCAAGATTTCTTGAACAAGTATGACATCAGGCCGAA
CAATGCAATTCTTGCTGAGGAGAAGCACTTGCCTATGTATGATGAACTGGCATCCAAGAGCAATGTTGAATACATTGCT
GGAGGTGCAACACAAAATTCTATCAGAGTGGCTCAGTGGATGCTACCATTTCCAGGTGCAACAAGTTACATGGGCTCGA
TTGGAAAGGACAAGTTTGGGGAGAAAATGAAGAACAATGCAAAGGATGCTGGCGTCAATGTTCATTACTATGAGGATGA
TGCTCCAACAGGGACTTGCGCTGTTTGTGTACTCGATGGTGAGAGGTCATTGGTAGCCAACTTATCAGCTGCAAACTGC
TACAAGGTTGACCATTTGAAGCGACCAGAGAACTGGGCTTTGGTTGAGAAGGCCAAGTTTTACTACATTGCTGGATTCT
TTCTCACTGTTTCCCCAGAATCTATTCAGCTTGTTGCTGAGCATGCCGCTGCCAATAACAAGATATTCTCGATGAACCT
TTCTGCACCATTCATCTGCGAGTTCTTCaggGATCCACAAGAGaAAGCcTTGCCgtataaTGGATTTTgtaTTCGGAAA
TGagaccgaagcaaGaaccttctCAaaagtACATGgatG > SEQ ID NO:1718 129753 188306_300698_1
GCCCTCCTCCTCACCTTCACCCATCGTGCGGTAAACTCTAGCCAGATCTCGCTCGCTCGCCGCTCGCCGCCGCCGCCGC
GTTCCACCGAGCGGAGAGTAGAGGGAATGGCGTCCGAGGGCGTGCTCCTGGGGATGGGCAACCCCCTCCTCGACATCTC
CGCCGTCGTCGACGACGCCTTCCTCACCAAGTATGACGTCAAGCTGAACAATGCAATTCTCGCTGAGGAAAAGCACTTG
CCTATGTATGATGAGTTGGCCAGCAAGGGCAATGTTGAATATATTGCCGGAGGAGCCACCCAGAACTCTATCAGGGTTG
CTCAATGGATGCTTCAAACTCCTGGTGCAACAAGTTACATGGGTTGCATTGGAAAGGATAAGTTTGGTGAGGAGATGAA
GAAGAATGCCCAAGCTGCTGGTGTTACTGCTCATTACTACGAGGATGAGGCTGCTCCCACGGGCACATGTGCTGTCTGT
GTTGTTGGTGGTGAAAGATCACTGGTTGCAAACTTATCAGCAGCAAACTGCTACAAATCTGAGCATCTGAAGAAACCGG
AGAACTGGGCACTAGTGGAGAAAGCAAAATACATCTACATTGCTGGCTTTTTCCTTACGGTCTCCCCAGATTCTATTCA
GCTTGTTGCTGAGCATGCTGCCGCTAACAACAAGGTGttCCTGATGAACCTCTCTGCACCCTTTATCTGTGAGTTTTC
CGTGATGCCCAGGAGAAGGTTCTTCCGTTTGTGGACTACATCTTCGGTAACGAAACAGAaqCAAGAATCTTTGCTAAAG
TCCGTGGATGGGAGACTGagaATGTTgagGAGATCGCGTTgAagatTTCCCAGCTTCCATTGGccTCTGGAAAACAAAA
GaGgattgccgtgaTTACTCAAggtgctGATccagtagttgTCGCTGAggatggaCAGGTGAaAACAtTCCCTgtgATC
CTACTggcaaAgGagaagCTTGttgacaccaacggcgctGGTGATGccTTTGttGG > SEQ ID NO:1719 129753 167955_300552_1
GAATTCACGACATCAAGTTGAACAATGCAAGGCTTGCAGAGGAAAAGCATGTGCCTATGTACGATGAATTGGCTGCTAA
AGACAATGTTGAGTACATTGCTGGAGGTGCAACTCAAAATTCTATCAGAGTTGCTCAGTGGATGCTACAAACTCCTGGT
GCCACTAGTTTCATTGGTTGCATCGGAAAGGATAAATATGGTGAAGAGATGACGAAAAACTCAAAGCTTGCTGGTCTTA
ACGTTCACTACTACGAGGATGAGACCGCAGCTACTGGTACGTGCGCTGTTTGTGTTGTTGGTGGCGAGAGGTCTCTCAT
TGCCAACCTGGCCGCAGCAAATTGCTACAAATCCGAACATTTACAGAAACCAGAAAACTGGGCTTTGGTTGAGAAGGCT
AAATACTATTACATTGCTGGATTTTTCCTCACTGTTTCCCCGACTCCATTCAGCTTGTAGCAGAGCATGCCGCTAAAA
ACAACAAGGTCTTCTGTCACAACCTTTCTGCTCCTTTCATCTGCGAGTTTTTCAAGGGTGTCCAGGAGAATGTTCTTCC
GTACGTGGATTATCTTTTCGGAAACGAGTCAGAAGCAAGAACTTTCTCAAAGGTTCACGGCTGGG > SEQ ID NO:1720 129753 127219_300469_1
cccccccggcacctaccttaagatctaaacgtccattttcaacagcaaaacaaattcacagaaatatcaaaaaatgga
tTCTGAGGGTATTCTTTTGGGTATGGGCAATCCATTGCTCGATATCTCTGCTGTTATCGATCAAGATTTCCTCAACAAG
TATGACATTAAGCCAAACAATGCAATTCTTGCTGAGGAAAGCACTTGTCTATGTATGACGAAATGACATCCAAGTTTA
ATGTTGAATACATTGCTGGAGGCGCAACACAAAATTCAATCAGAGTAGCTCAGTGGATGCTTCAAATTCCAGGTGCAAC
AAGTTACATGGGCTCTATTGGAAGGACAAATATGGGGAGGAAATGAAGAAAAATGCAAAAGATGCTGGTGTCAATGTT
TGCTATTATGAGGATGAGAGTCCAACGGGTACTTGTGCTGTCTGTGTCCTTGATGGCGAAAGGTCGCTGGTTGCAAACT
TATCAGCTGCAAACTGCTACAAGGTTGACCATTTGAAAAAACCAGAGAACTGGGCTTTGGTGGAGAAGGCCAAGTACTA

FIG. 2 continued

TTACATTGCTGGATTTTTTCTCACTGTTTCTCCAGAATCTATTCAGCTTGTTGCTGAGCATGCAGCTGCCAAACACAAG
GTTTTTTCAATGAACCTTTCAGCACCATTTATCTGTGAGTTCTTCAAGGATCAACAGGAGAAAGTCTTGCCATATATGG
ACTTTGTCTTTGGTAATGAGACAGAAGCAAGAACCTTCTCTAGagtCcACAGCTGGGagactGATAATGTagaagaaaT
AGCtTTgaagatctccCagtGGGCAAaggcAtcaggaacac > SEQ ID NO:1721 129764 265978_200082_1
ttgtagttatacaaaaacaggggctgagaccaagagagaagttctacctcaagcaacctgtacatggcgctgtatctac
tGTACGAGTCGGCGTCTGGGTACGCGTTGTTCTTGGCTCATGGAATTGATGAAATTGGGCAGAACACGGAGGCGGTTCG
CAACTCCATCACTGATCTCAATCGGTTCGGGAAGGTCGTAAAGATTGAAGCTTTTAACCCTTTTGAGTCAGCCCTTGAC
GCCCTCAATCAATGCAatngctGTTtcctagaagggnnnaaatgcactgnagagagCTAAggAACTTCTTGGAGCGTA
GTCTCCCAAAAGTCAAgGAGGGTaaGAAGgCTAAGTTCAGTTTAggATTGGCAGAGCCTAAGCTTGGTTCTCATATCCA
TGAAGTAACTAAGATTCCCTGCCAAAGTAATGAGTTTATTCTTGAGCTTCTGCGTGGAGTACGCTTGCATTTTGAGAAG
TTCATTGAAAACCTAAAGCCTGGAGATCTGGAGAAAGCCCAACTTGGTCTGAGTCACAGTTACAGCAGAGCAAAGGTCA
AGTTCAACGTTAATCGTGTTGACAATATGGTTACTCAGGCAATTGTCCTACTTGATACTCTTGATAAAGATATTAATAC
CTTTGCCATGAGAGTCAGAGAATGGTACTCTTGGCATTTCCCAGAGTTGGTGAATATTGTCAATGACAATTATCTATAT
GCCAAAGTAGCAAAATTTGTTGATGACAAATCCCAATTGTGTGAAAACAAAATTCCAGACTTAATAGAAATAGTTGGAG
ATGAAGATAAAGCAAAAGAAATTgtagaAGCTGCAAAAGCATCCATGGGCCAGGATTTGTCGCCAGTTGACTTGATTAA
TGTCAAGATGTTTGCACAGAGGGTAATGGACCTTGTcGAATACAGGAAGGATCTTTATGATTATCTTGTTGCTAAAATG
CATGACATAGCACCAAATTTGGCTTCGCTGATTgGTGAAGTTGttggTGCTCGTTTAATTTCTCATGCTGgTAGtctca
cAAATTTGGCAaagtgcCCTTCTTCtACCCt > SEQ ID NO:1722 129833 236002_301283_1
ACAGCGCAGTGGCGGGCATGGACTTGGATCAGTGGATCGAAAAGGTCAAGTCGGGGCAGCACCTCCTCGAGGACGAGCT
CAAGCAGCTGTGTGAATATGTCAAGGAGATTTTGGTAGAGGAGTCGAATGTGCAGCCAGTAGACAGCCCGGTCACGGTT
TGCGGAGATATTCATGGCCAGTTCCACGACTTGATGAAGCTCTTCCACACCGGCGGCCATGTCCCCCACACGAATTACA
TCTTTATGGGAGATtttgtgGATCGTGGATATAACAGTCTCGAGGttTttaCTATTCTTCTTCTTCTCAAAGCGAGGTA
TCCTGCGCATATGACTCTCTTGAGAGTGAATCACGAGAGTAGGCAAATTACGCAGGTGTATGGTTTCTATGACGAATGC
GAGCGGAAGTATGGAAATCCAAACGCTtggcgtTACTGTACTGACGTTTttgACTATCTGACTATTTCGGCGATCATCG
aCGGAAGAGTGCTTTGCGTGcaaggaGGTCTATcgactgacAtcagaTCCATt > SEQ ID NO:1723 129833 6426_300320_1
CCCACGCGTCCGAATTCACAATTTCTCTTCTTCTAAATCCATGGAGTGATGATGATGATAGATAGATTGAATCCAAACA
CAAACCGGATCCGAGATTAAAAACAATCCGGATTGTTTATATTTACTTTAGATCGGAGAAAGATGCCGCCGGCGACCGG
AGATATCGATCGTCAGATCGAGCAGCTTATGGAGTGTAAAGCGTTATCTGAAACGGAGGTGAAGATGTTGTGTGAGCAC
GCAAAGACGATTCTTGTGGAAGAGTATAATGTTCAACCGGTTAAATGTCCGGTTACCGTCTGCGGTGATATCCACGGCC
AATTTTACGATCTAATCGAGCTTTTTCGTATCGGTGGTTCTTCTCCTGATACTAATTATCTTTTCATGGGTGATTATGT
TGATCGAGGGTATTATTC > SEQ ID NO:1724 129833 286381_200108_1
AAGAAAACTTTTGGATAGACAAATGTCTGTCAACAGTGTTCCCAAAAAGGTGATTGCCCATCTTTTGAAACCTCGAGGA
TGGAAGCCGCCTGTCAGACGGCAATTTTTCTTGGATTGCAATGAGATAGCTGATCTCTGTGATAGTGCAGAAAGAATAT
TTTCCAGTGAACCTAGTGTGTTACAGCTAAGGGCTCCTATTAAGATATTTGGTGACTTGCATGGGCAATTTGGGGATCT
CATGCGCCTTTTTGATGAGTATGGTTCCCCATCAACTGCTGGGGACATAGCCGTACATCGATTATCTCTTCTTAGGAGAT
TATGTTGATAGGGGCCAGCACAGCTTGGAGACCATGACTCTTCTCCTTGCTTTAAAGGTGGAGTATCCACACAACGTTC
ATTTAATTCGAGGGAACCATGAAGCGGCAGATATTAATGCTCTTTTTGGCTTCCGAATTGAGTGCATTGAACGAATGGG
TGAGAGAGATGGAATCTGGGCTTGGCATCGGATCAATAGGTTGTTCAATTGGCTTCCTCTGGCAGCACTAATTGAGAAA
AAAATAATCTGTATGCACGGTGGTATTGGAAGGTCAATTAATCATGTAGAACAGATAGAGAATATACAGCGTCCTATCA
CCATGGAAGCAGGGTCGATCA > SEQ ID NO:1725 129833 251763_301660_1
GGAAACCATGAAAGCAGGCAGATCACTCAAGTGTATGGATTCTATGATGAGTGTCTTAGGAAATATGGAAATGCGAACG
TGTGGAAGTACTTCACCGATTTGTTCGACTACTTACCACTCACGGCGCTCATTGAGAACCAAATTTTCTGTCTCCATGG
CGGTCTTTCGCCGTCTCTGGATACTTTAGACCACGTCCGTGCTCTGGATCGCATTCAGGAAGTACCGCATGAAGGACCG
ATGTGTGATCTGCTTTGGTCCGACCCGGATGATCGGTGTGGGTGGGAATCTCGCCAAGGGGTGCGGGGTACACATTCG
GTCAAGACATCGCAGAGCAGTTCAACCACACTAATGGCCTGAGCTTGGTGGCCCGTGCACACCAGCTTGTGATGGAAGG
ATACAACTGGTGCCAGGACAAGAACGTTGTGACGGTGTTTAGTGCTCCCAACTACTGTTACCGGTGCGGAAACATGGCG
GCAATAATGGAGATCGACGAGACGATGGGGCGGACTTTCCTCCAATTCGAGCCGGCTCCTCGACAGAGTGAGCCCGACG
TTACTCGCAAGACACCCGACTACTTTTGTAAGAGGCAAGTCCTTTCTTGTTCCTTGGCGAGCTTGAGTTTG

FIG. 2 continued

> SEQ ID NO:1726 129833 26116_300076_1
GATATTATTCGTGGTTTGGTTGAGTTTCGGAACACAAGACCTGGATCGGGGAATCAAGTTCATCTCAGTGAAGGTGAAA
TTCTTCAGCTTTGTGCTGTCTCCAAAGAAATATTTCTTCAACAGCCCAATCTGCTTGAATTGGAAGCTCCCATCAAGAT
CTGCGGTGATATTCATGGGCAGTATTCAGATCTATTGAGGCTTTTTGAGTATGGAGGGTTCCCTCCCGAAGCTAATTAT
TTGTTCTTGGGTGATTATGTTGACCGTGGCAAGCAAAGCTTGGAAACAATATGTCTTCTTCTAGCTTACAAAATCAAGT
ACCCTGAGAACTTCTTCTTGTTGAGAGGGAATCATGAATCTGCTTCCATTAATCGTATTTACGGTTTCTATGATGAGTG
CAAACGCAGGTTCAATGTCAGACTCTGGAAAATATTCACCGATTGCTTTAACTGTCTTCCTGTGGCCGCCTTAATTGAT
GACAGAATACTATGTATGCATGGTGGGATTTCCCCAGAGCTGAAAAGTTTGGACCAGATTAGAAATATTGCACGGCCGA
TGGATATTCCGGAGTCTGGTTTGGTATGTGATTTACTATGGTCGGATCCTAGTGGAGACGTAGGCTGGGGCATGAATGA
TCGTGGTGTTTCATACACTTTTGGAGCTGACAAAGTCCCAGAGTTCTTGGAGAAACATGACATGGAC

> SEQ ID NO:1727 129833 258891_301700_1
ATTCGTCACTGCTTCACCTCGCTTGCCATTGAAAACGCCAGCTACGTCAACACCGAAAGAAGGGGTTACATCGACAATT
TAAATATTACGACAACGACAACGACAATGGACGTGGAAATGACAGACGTCAAGGAGCCTGCGTCTACCTTGTACACTGG
CACTCTCGACCAATGGATTGAACAGCTGAAGGAATGCAAACCGCTGACCGAAGCCGAAGTTGCCACCATGTGTGACATG
GCTCAAGAAATTCTTCAGCAAGAATCTAACGTCCAGGGTGTGCACACCCTGTCACAGTGTGCGGTGATGTACACGGGC
AGTTCCATGACCTTATGGAGCTATTCTGTATTGGAGGACCCTGTCCAGATACGAATTACCTGTTCATGGGAGACTATGT
TGACCGAGGATACTACTCGGTCGAGACTATCTCCTTGCTGGTTGCCATGAAGATCCGGTATCCCAACAGAATCACCATC
TTGCGAGGAAACCACGAATCTCGACAAATCACACAAGTCTATGGCTTCTACGACGAGTGCCTGCGGAAATACGGCCATG
CCAACGTTTGGAAGCGATTCACAGACCTCTTCGACTACTTGCCTCTCACAGCTCTCATAGAAAACAAAATATTCTGTCT
GCACGGAGGA

> SEQ ID NO:1728 129833 251724_301660_1
GGCTATGGCGGCGCATCGCGACGAGGGCTGGTTCGCTATCGATCGAGAGGAGGGATGCGCGGTGGTGCCCGGCATCTAG
ATGTGGCGACGCCGCGATTCTTCTTCTTCTTCTTGTCCCAGCTTCTCCGGGCGTGGAGATTTTCGGATTTCCGGCCTCA
AGCAACTGGAGCTAGGGCGCATTGGCTGTGGGTGATCTACCGCCGGGGCAGGGTTGCACGGATCTGATTGTTCCAGCAG
CGCTAGGGTTTGTGGATTTTGGGGAGATTTCTTCTCCAAATCGTCGTCTTCTTGGATCGATCGATCCCTCTTGCTTCGT
CCATCCGCCATGCCTTCCCACGGTGATCTTGATCGGCAGATCGAGCAGCTATGGGAGTGTAAGCCGCTCTCGGAGATGG
AGGTGAAGAATCTGTGCGAGCAAGCCAGGGCCATCCTCGTCGAGGAATGGAACGTCCAGCCGGTCAAGTGCCCGGTGAC
GGTGTGCGGCGACATCCACGGCCAGTTCCACGATCTGATCGAGCTCTTTCGGATCGGCGGCAAGGCGCCCGACACGAAT
TATCTCTTCATGGGCGACTATGTCGATCGCGGGTACTACTCT

> SEQ ID NO:1729 129833 1007775_301403_1
GGCAGGTGTCAACCAGTGGACTGCACAAAAGGATAATTTCGACTTTGTTGAAACCTCGAGGGTGGAAACCTCCAGCTAG
AAGACAGTTTTTCTTGGATTTCAATGACATTGCTGAACTTTGCGACACTGCTCAGCAAATTTTCACACAAGAGCCGAAT
GTTCTTAAGCTAAAAGCTCCTGTGAAGATTTTCGGTGACCTGCATGGTCAATTTGGAGACCTGATGCGGTTGTTTGATG
AATACGGTTTCCCTTCAACTGCCGGAGACATAACGTATATCGACTACCTTTTCCTTGGCGACTATGTTGACAGAGGACA
ACATAGCTTGGAAACTATCATTTTGCTGCTGGCATTAAAGGTAGAGTATCCTGAACATATACATCTAATCCGTGGGAAT
CACGAGGCCGCGGACATCAATGCTCTCTTTGGGTTCC

> SEQ ID NO:1730 129833 110948_300048_1
ttcgctttcccttccacagtagaaaaatcaacccttcatgcgtacagatTATAGAGACCCAGAAAAAGGGGATACCCA
CTTTCTCAATGGACGCTGCAGCAGTTGATAGGATCATTGAGAAGCTAATAGAAGTCCGATCATCGAAGCCTGGAAAGTT
GGTGCAGCTGTCCGAGTCTGAAATCAAGCAACTGTGTGTTGCCTCTCGTGATATCTTCCTCAAACAGCCCAATCTCCTT
GAACTTGAAGCACCCATCAAAATTTGCGGTGACATTCATGGGCAGTACAGTGACCTGTTGAGGCTTTTCGAATATGGTG
GTTTTCCTCCGAAGGCTAACTACTTATTTTAGGTGATTATGTAGATCGTGGCAGGCAGAGCCTGGAAACAATATGCCT
CTTGCTTGCCTACAAGATTAAGTATCCTGAGAACTTTTTCTGCTTAGAGGAAACCATGAATGTGCTTCAATAAATAGG
ATATATGGGTTCTATGACGAATGTAAGCGCCGGTTCAACGTGAAACTGTGGAAATCCTTTACAGACTGTTTCAATTGTC
TTCCTGTGGCAGCACTTATTGATGAGAAGATACTATGCATGCATGGGGTCTCTCGCCTGATCTCTCTAGCTTGGATCA
GATAAGAAACTTACCACGTCCAACTGCCATACCCGATACTGGTTTGCTTTgTGATTTACTTTGGTCAGATCCTGGTAAA
GATGtGAAggGGTGGGGGATGaaCGATA > SEQ ID NO:1731 129833 111221_300053_1
CCCACGCGTCCGGCCACCTGTTCGGCGACAATTTTTCTTGGACTGCAATGAGATGGCGGATCTTTGTGACAGTGCCGAA
AGGATATTTGCGAGTGAACCTAGCGTTTTACAGCTTAGGGCTCCTATTAAGATATTCGGTGACCTGCATGGGCAATTTG
GGATCTTATGCGTCTTTTCGAAGAGTATGGTTCCCCATCGACTGCTGGGGATATATCGTATATTGACTACCTTTTCTT
AGGAGATTATGTTGACAGGGGCCAGCACAGTTTGGAAACGATAACTCTTCTTCTTGCTTTAAAGGTTGAGTATCCCCTC
AATGTACATCTAATTCGTGGGAACCATGAAGCTACAGATATTAATGCGCTTTTCGGCTTTCGAATTGAGTGCATTGAAC

FIG. 2 continued

GGATGGGTGAGCGAGATGGAATTTGGGCATGGCATCGATTTAATAGATTGTTCAACTGGCTTCCTCTGGCAGCATTAAT
CGAGAAAAAGATAATCTGTATGCATGGTGGTATTGGAAGGTCAATTAATCATGTTGAACAAATAGAAAATATCCAGCGT
CCTATCACTATGGATGCTGGCTCAATTGTTCTTATGGATTTATTGTGGTCTGACCCAACAGAAATGATAGCGTTG

> SEQ ID NO:1732 129833 113755_300005_1
atttctctctactttctgtattctcctttcgggttttggggcagattctgagagattcacttcgttgtaaagaactgct
cTATCAGTCGACTCTGCATTTGGGCAAATAATTGCATTCAGAAACAAATAATTAGTTAATTGGCAGAGCTGTAGATTTA
GAAAAGGGGCAGATGGATTTGGATCAGTGGATAACGAAGGTGAAAGACGGGCAGCACTTGGCCGAGGACGAGCTTCAGC
TCCTTTGTGAATATGTTAAGGAAATCCTGATAGAGGAGTCAAATGTGCAACCCGTTAATAGTCCAGTTACTGTTTGTGG
AGACATCCATGGCCAGTTTCATGATCTAATGAAACTTTTTCAGACTGGAGGTCATGTACCCGAGACGAATTACATTTTC
ATGGGAGATTTTGTTGATCGTGGATACAATAGTCTAGAAGTATTTACAATTTTGTTGCTCCTTAAAGCAAGGTACCCAG
CCAACATTACTCTGTTACGTGGAAATCACGAGAGCAGGCAACTAACACAGGTTTATGGATTCTATGATGAATGCCAAAG
GAAGTATGGAAATGCAAATGCTTGGCGGTATTGCACCGATGTTTTTGACTAtCTTACTCTCTCggccatcATAGACgGA
ACAGTATTATGTGTccAcggTGGACTTTCTCCTGATGTTAGAATTATTGATCagATCAGAGTCATTGAACGAAATTGCG
AAATTCCCCATGAAgggccctttcttgcgacccttatGTGGAGTGACcCCGaagatattGAAaCATGgGCagTaAGTcc
tcGaggAgcaggtTGGCTTTTTGGAt > SEQ ID NO:1733 129833 114363_300007_1
CGACGGCGCAGCAGGGGAGTGAAGAGAGCAATTCTCTTCAGCTGCAATTGCCCTACCCTATGCTATTCAATCGGAGAAG
ATATTAGTAGTAGATTTTGGTTACAGAGCTCGCCGGTGACTTGAAGAAGTTTGACGAAGAAGTCAGAAAGATGTCAGAC
CTAGACAGGCAAATAGAACAGCTCAAGAGATGCGAACCGTTAAATGAATCGGAAGTGAAGGCTATTTGTCTTAAAGCTA
TGGAAATCCTCGTTGAAGAAAGCAATGTGCAGAGAGTGGACGCCCCTATCACTATATGTGGTGATATCCACGGGCAATT
TTACGACATGAAAGAGCTATTCAAAGTGGGAGGTGATTGTCCAAAGACAAATTACTTGTTTCTCGGAGATTTTGTTGAT
AGAGGATTTTATTCCGTTGAGACATTTCTTCTTCTACTAGCTCTGAAGGTGAGATATCCAGATCGAATCACTCTTATCA
GAGGTAACCATGAGAGCCGCCAGATCACACAGGTGTATGGATTCTATGATGAGTGCCTGCGGAAGTATGGTTCAGTAAA
TGTTTGGAGATATTGCACGGATATCTTTGACTACTT > SEQ ID NO:1734 129833 1113227_301796_1
TCCATTTTTTACGGCTTATTCTGATTTCTGTTGCCTCATCCATCTCCGTCTCCGTCGCCATCGCCAGGAGGAGGAGGA
GGAGGCCTCGAGCCCCCCCCCTGCCACCTAACTGTAACTGTTTATTATCCGTCTCCGCCACCTCTAATGGACCAAGCCT
TGCTGGATGATATCATTGCACGCTTGTTGGACGTGCGGGAGCAGCCGGCCAGGGAAACTGGTGCAGCTTTCTGAGGCAGA
AATCAGGCAGCTATGTACCACTGCCAAGACTATCTTCATGGAGCAGCCTAACCTGATTGAGCTTGAAGCACCCATGAAG
ATTTGCGGTGACATTCATGGACAATACTCTGATCTATTACGTCTTTTTGAGTATGGTGGGTTTCCACCAAATGCCAACT
ATCTCTTTCTAGGAGATTATGTGGACCGGGGGAAACAAAGCCTTGAAACAATCTGGCTACTCCTTGCATACAAAATCAA
GTATCCTGAAAACTTCTTCTTACTTAGGGGAAACCATGAGTGCGCTTCAATAAATAGAATATATGGCTTCTACGATGAA
TGCCAAAGGAGAT > SEQ ID NO:1735 129833 121394_300356_1
CCCGCTCTCCTCCTCGGCCGCGTAAAACACCTCCCACCGCCTCCTCCACCCCCTCCTCCTCCCCCCGCAGAGCCGAAAC
CCTAACTCCGCCGATCTCTCCAGGTGCCCAAGGGGAGGGAGGGGATGGCGGCGGCACCGGGGGCGGGAGGGCAGGGCGG
CGGCGGGATGGACGCCGTCCTCCTCGACGATATCATCCGCCGCCTGCTCGAGGTGCGGACGGCGCGCCCGGGGAAGCAG
GTGCAGCTCTCCGAGTCGGAGATCCGCCAGCTCTGCACTGTATCCCGAGAAATCTTCCTCAGCCAGCCCAATCTCCTCG
AGCTCGAGGCGCCCATCAAGATCTGCCGGTGACATCCATGGTCAGTACAGTGACCTTCTAAGGCTTTTTGAGTATGGTGG
TTTTCCCCCAGAAGCCAATTATCTATTCTTAGGTGATTATGTTGATCGAGGCAAACAAAGTTTGGAAACAATATGCCTC
CTCCTTGCATACAAAATCAAGTACCCGGAGAATTTTTTTCTTCTCAGAGGCAATCATGAGTGTGCATCAATAAACAGGA
TATATGGATTTTATGATGAATGCAAACGCCGATTTAAT > SEQ ID NO:1736 129833 121149_300525_1
CGGACGCGTGGGGCCAATTGTCCGACCTGCTCCGGCTGTTCGAGTTCGGCGGGCTGCCGCCGACGGCGAACTACCTGTT
CCTCGGCGACTACGTGGACCGCGGGAAGCAGAGCATCGAGACGATCTGCCTCCTGCTGGCATACAAGATCAAGTACCCG
GACAACTTCTTCCTGCTGCGAGGCAACCACGAGTGCGCGTCGATCAACCGAATCTACGGGTTCTACGACGAGTGCAAGC
GCCGGTTCAGCGTCCGCCTCTGGAAGCTCTTCACCGACTGCTTCAACTGCCTCCCCGTCGCCGCCGTCATCGACGACAA
GATCCTCTGCATGCACGGCGGCCTCTCGCCGGACCTCGACAGCCTCGACCGGATCAGGGAGATCGCCCGACCCGTCGAC
GTCCCCGACCAGGCCTCCTCTGCGACCTCCTCTGGTCCGACCCCGACCGCGAGAGCTCCGGCTGGGCGAGAACGACC
GCGGCGTCTCCTTCACCTTCGGCGCCGACAAGGTCACCGAGTTCCTCAACAAGCACGACCTCGACCT

FIG. 2 continued

> SEQ ID NO:1737 129833 154810_200016_1
tcctctctctctctctcctctctcctctctctctgtagagctgagagaaaatcaaatcaaatcaaaccccctttgat
tTGACCCCCTTTTCCTCTAGGGTTTCTGCACAAATTTCCCTCCAGAAGCAGTAAAAAAGAAGATCAATCAGCAATGGAT
CCGGTGCCATCGAGCGCATCTCATGGAAATCTTGACGAACAAATTGCTCAGCTTATGCAGTGCAAACCCTTGTCTGAAC
AGGAGGTAAGAGGGCTATGTGAGAAAGCAAAGGAGATTCTAATGGAAGAGAGCAACGTGCAGCCTGTGAAAAGCCCTGT
GACTATATGTGGTGATATTCATGGTCAGTTCCATGATCTTGCTGAGCTTTTTCGAATTGGTGGAAAGTGTCCTGACACT
AATTATTTGTTCATGGGAGATTATGTGGATCGTGGATACTATTCTGTTGAAACAGTAACGCTTTTAGTGGCTCTCAAAG
TGCGATATCCCCAGCGAATTACAATCCTAAGGGGTAATCATGAGAGTCGCCAGATTACTCAGGTTTATGGGTTTTATGA
TGAATGCCTGCGGAAATATGGTAATGCCAATGTGTGGAAGACTTTCACAGATCTGTTCGACTACTTTCCTCTGACTGCT
TTGGTTGAGTCAGAGaTTTTTTGCctcCATGGTGGTCTGTCTCCATCTATTGAAACTCTTGATAATATTCGCAATTTTg
accgTGTACaagaaGTTccACATgagggTGCTATGTGTGATCTTTTATggTCTGATCcTGATGATcGaTGtggttGGGG
TATCtc > SEQ ID NO:1738 129833 153073_200044_1
GGGCTCAAGGATTGCATAAGAAGATCATATCCACTTTGCTTAGGCCGCGAAATTGGAAAGCACCTGTTAATAGAAAGTT
CTTTCTCGATTCATATGAAGTGGGTGAGCTTTGTTATGCAGCTGAGCAGATCTTCATGCATGAGCCTACAGTTCTTCAA
TTGAAAGCTCCTGTCAAAGTTTTTGGTGATCTTCATGGACAGTTTGGTGATTTGATGCGGCTATTTGATGAATATGGAT
TTCCTTCAACAGCTGGAGACATTACTTACATTGACTATTTGTTTCTGGGTGATTACGTTGATCGAGGACAGCACAGCTT
GGAGACAATCACTTTACTCCTAGCTCTGAAGATTGAATATCCAGGAGTACATTTGATAAGGGGGAATCATGAAGCT
GCTGATATAAATGCACTTTTTGGCTTCCGTATTGAATGCATCGAGAGAATGGGAGAGAGTGATGGGATCTGGGCATGGA
CGCGTTTCAATCAACTTTNTAACTATCTTCCATTGGCTGCCCTCGTCGAAAAGAAAATCATCTGCATGCATGGTGGGAT
AGGGAGGTCAATTAATTCA > SEQ ID NO:1739 129833 127721_300472_1
CCCCCCCCCCCCGATTGAATGAATCAATCAGGGGATAATCTTCTTATACCAAGTCGCTCACATCTACACCCTCAAAACT
CAAACCCCATTTGCAGTAGGTAAAAAATTGTTAGAGAAAACTGAAAAAAATGGACCAAAATGTGTTAGATGATATTATA
AGTTGGCTTCTTGAAGTAAAGGGTAAACCAGGGAAACAAGTAGTGTTAACAGAGGCTGAAATCAAACAGCTGTGTTTGA
TTTCTAAAGAGATTTTCTTGAAACAGCCTAATTTATTGGAACTTGAAGCACCCATCAAGATTGGTGGTGACATTCATGG
TCAATATTCTGATCTTCTGCGGCTCTTTGAGTATGGTGGATTGCCACCTCAATCAAACTACTTATTTTTAGGGGATTAT
GTTGATCGCGGCAAGCAGAGCCTAGAGACTATATGTCTTTTACTTGCATACAAGATAAAATATCCGGAAAACTTTTTCT
TGCTAAGGGGAAATCATGAGTGTGCTTCCATAAACCGTATATATGGATTTTATGACGAATGTAAGAGAAGATTTAATGT
TAGATTATGGAAAATCT > SEQ ID NO:1740 129848 240236_301312_1
GCCCTAAACCACTGGAGCAGCAGCATTGCCCTTATCCTCGCGGCGAATCTCTTCCCGGTACGTGATTCCTCGTCTAGAT
TCTAGCGGCGGCGCCGCTTCTCGCTATCGATTGATTGAGCCGCCGCTGCTCCGCGAAGATGGGAAGCATAAAGGAATGG
TCGGGCATCAACCAGTTCCCCGTCGCTACACAGACCGCTCTCCACGGGCTGCTTGGCAAGGTCCGGCAACAGAATGTGG
ATAGTATGACTGTTCTTGTTCTCGGTAAAGGAGGAGTTGGGAAAAGCTCTACCGTTAATTCTGTAATTGGTGAAAGAGT
AGCGGCTGTCAGTGCCTTCCAGTCTGAAACCTTGAGGCCGCTCTGCGTTTCCCGATCCAGAGCTGGATTTACTTTGAAC
ATCATTGATACACCGGGTTTGATCGAAGGTGGATGGGTGAATGACCAAGCTCTAGAGATTATCAAGAGGTTTCTCTTGG
ACAGAACTATTGATGTGGTTTTGTATGTCGATCGGCTGGACGGCTATCGAGTTGATAGCCTGGACAAGCAAGTGATCAA
GGCCATTAGTCGTGGCTTTGGTCCTCAGATCTGGAAAATTTGTCTGCTCGTTTTGACTCACGCACAGCTTCCTCCACCC
GACGGTACAAGTTACGAC > SEQ ID NO:1741 129848 282895_200090_1
gaccaaaatacgaagacgataaggcggtccgaaacttttttttcaaagctaaaaaagctgaagagaggcttcccttaaac
cCTTTCTCTCTTCCTCCACACCCCCACAATCTGTCATCTGTGGTAGATTTCGCAAGGATAATTCTCACAATCAACTGCA
TTTCTCTCTACCCATTTGCTATCCATGGCATCTCAACTAATTAGAGAATGGGCCGGAATACAGCAGTTTCCTGCTGCCA
CTCAGTCCAAGTTGCTTGAATTACTGGGGAAACTGAAACAGGAGAATGTTTGTACCCTGACGATCCTAGTAATGGGGAA
AGGCGGTGTTGGAAAATCTTCAACAGTGAACTCAATTATCGGGGAAAGAGCAGTTGCTGTTAGTGCATTTCAGTCAGAA
ACACCAAGACCAGTGATGGTTTCGCGTTCTCGAGCTGGGTTTACATTAAACATAATTGACACCCCAGGGCTTGTTGAAG
GAGGATACGTCAATGACCAggCTCTTGATCTCATTAAGAAGTTCCTCTTGAACAAGACaATTGATGTTTTGCTCTATGT
GGATCGTCTGGATGCATATAGAGTGGATAACTTGGACaAACAGATTGTGAAggCTATTACTGAAa > SEQ ID NO:1742 129932 238516_301295_1
AGAGGAAGGATTGGGTGGTacaGGCGGCCATGGCGGCAGCGTCCATCACGCCGGCTTGTGCGCGATGCAATGCCGCTGC
TAGCAAGGGCTTTTCGGATTTCTCCGGCCTCAAGAGCAAGAATGCTGTCACATTCGGTCGCGGAGCCGAGGATTTGGCG
ACCAGAGTAGCTTCCCAAACTTGCAAGGTTTGAATTATTTGATTGCTATGGATGGAAGTTCGTTCTTATGTACAAGTTA
GAGAGTGTAGATCTCCAGCTCCGGTGGAGCAAAGCGCGCGGTTGCCGAGGCCAAGATCAAGGTTGCGATCAATGGATTT

FIG. 2 continued

```
GGAAGAATTGGCCGGAACTTCATCCGCTGCTGGCACGGAAGAAAGGACTCGCCATTGGACGTGATTGTCATCAACGACA
CCGGCGGCGTCAAGCAAGCCTCTCACCTCCTCAAGTATGATTCCATGCTTGGAACTTTCGATGCAGACGTCAAGGTCTC
TGGAGACAGCGCGATCTCGGTCGATGGCAAGGTCATCAAGGTTGTCTCCAACCGAGATCCTCTCAAGTTGCCATGGGGA
GAGCTTGGAGTAGACCTTGTGATCGAGGGAACTGGAGTTTTCGTGgATCAaGATGgAGCTGGGaagcacTTGAAAGcCG
gTGc
```

> SEQ ID NO:1743 129932 28823_300151_1
```
ATAAGATCCATCCATTTAGCAGCACCTTAGGATGGCATAGCCTTAAAAGTGAAGGGCGAGGTTCAAACGAGGAAAGGCT
TACGGTGGATACCTAGGCACCCAGAGACGAGGAAGGGCGTAGTAATCGACGAAATGCTTCGGGGAGTTGAAAATAAGCA
TAGATCCGGAGATTCCCGAATAGGGCAACCTTTCGAACTGCTGCTGAATCCATGGGCAGGCAAGAGACAACCTGGCGAA
CTGAAACATCTTAGTAGCCAGAGGAAAAGAAAGCAAAAGCGATTCCCGTAGTAGCGGCGAGCGAAATGGGAGCAGCCTA
AACCGTGAAAACGGGGTTGTGGGAGAGCAATACAAGCGTCGTGCTGCTAGGCGAAGCAGCCCGAATGCTGCACCCTAGA
TGGCGAAAGTCCAGTAGCCGAAAGCATCACTAGCTTATGCTCTGACCCGAGTAGCATGGGGCACGTGGAATCCCGTGTG
AATCAGCAAGGACCACCTTGCAAGGCTAAATACTCCTGGGTGACCGATAGCGAAGTAGTACCGTGAGGGAAGGGAGCTC
AGgTCAGACTATAAGATGATTGCAAGAGCTCTGACTCGAAAGGGAACTGCCCTGGTAAAGATGGCAAAAACTTCAAAGG
ATTTTGAACCTGCAATTGAGACtTTccAGaAAGCCCTTACTGAACATCGCAACCCGGATACACTGAAAAAACTGAATGA
TGCTGAAAAggCGAAGAAAGAAttagAGCagcaaGaGtattTCGAtccacaaATAGCagat
```

> SEQ ID NO:1744 129932 47115_300174_1
```
CTTACGGTGGATACCTAGGCACCCAGAGACGAGGAAGGGCGTAGTAAGCGACGAAATGCTTCGGGGAGTTGAAAATAAG
CGTAGATCCGGAGATTCCCGAATAGGTTAACCTTTTGAACTGCTGCTGAATCCATGGGCAGGCAAGAGACAACCTGGCG
AACTGAAACATCTTAGTAGCCAGAGGAAAAGAAAGCAAAAGCGATTCCCGTAGTAGCGGCGAGCGAAATGGGAGCAGCC
TAAACCGTGAAAACGGGGTTGTGGGAGAGCAAAAAAAGCGTCGTGCTGcTAGgCgAagcGgtgGagtgccGCACCCTag
aTGgcgagagtccagtAGCCGAAAGcAtCACTAGCTTATGCTCtGAccCGAGTAGCATGGGGCACGTGGAATCCcgtgt
gAAtcagcAaggaccaCCTTgcaaggctaaATActccTgGGGc
```

> SEQ ID NO:1745 129932 3298_300341_1
```
CCCACGCGTCCGGGCTTACGGTGGATACCTAGGCACCCAGAGACGAGGAAGGGCGTATTAAGCGACGAAATGCTTCGGT
GTCTTACTCGGTGGTAACATCACTCTCCTCCGTGGTATTCTCTACTGGATTGCTCAGCTTCTTGGCTCCGTCGCCGCTT
GTTTCCTCCTTAGCTTTGCCACCGGTGGCGAGCCAATCCCAGCGTTCGGTCTCTCTGCCGGAGTCAGATCATTAAACGC
TCTCGTCTTCGAGATCGTGATGACCTTCGGGCTCGTCTACACCGTCTACGCCACAGCCGTTGATCCCAAGAACGGTAGT
CTCGGAACAATCGCACCAATCGCCAT
```

> SEQ ID NO:1746 129932 286303_200108_1
```
GGGCGGACGCGTGGGCACAGACGATGAATGGCGTAGTAATCGACAAAATGCTTCGGGGAGTTGAAAATAAGCATAGATG
CGGAGATTCCCGAGTAGGGCAACCTTTCTAACTGCTGCTGAATGCATGGGCATGCAAGACACAACCTGGCAAACTGAAA
CATCTTATTAGCCAAAGGAAAAGAAAGCAAAAGTCGATTCCCGTAGTAACGGGGAGCGAAATGGGAGCACTCTAAACCG
TGAAAACGGGGCTGTGGGAGAGCAATACAAGCATGGTGCTGATATGCGAACCAGCCCGAATGCTGCACCCTAGATGGGG
AAAGTTCACTACCCGAAAGCATCACTAACTCATGCTCTGACCCGAGTAGCATGGGGCACGTGGAATC
```

> SEQ ID NO:1747 129932 240685_301316_1
```
ggcttGCGGTGGAGACCTAGGCACCCAGGCACGAAGAAGGGCGTAGCAAGCGACAATGCTTCGGGAAGCCAGAGATAAG
CATAGATCCGGAGATCCCCGAATGGGTTAACCCCTAGAACTGCCAAATCCGTGGGATGGGCAAGAGACGACCTGGCAA
ACCGAAACATCCAAGTAGCCGGGGGAAGAGAAAGCAAAAGCGATTCCCGTAGTAGCGGCGAGCGAAGAGGGAGTAGCCT
AAACCGTGGGAACGGGGTTGTGGGAGAGCAATAAGTATAAGGTTGTGCTGCTAGGTGAAGCGGTCGAGTCCCGCATCCC
AGACGGTTAGAGTCCGGTAGCCGGAAGCAGCACAGGCTGACGCTCCGACCCGAGTAGCATGGGGCACGTGGAATCCCGT
GCGAATCAGCGAGGACCACCTCGTAAGGCTAAATACTTCTGGGTGACCGATAGCGAAATAGTACCGTGAGGGAAGGTG
AAAAGAACCCCCACCAGGgagTGAAATAGAACATGAAACCGTAAGCTCCCGAGCAGTGGGAGGATAATTGGAGATCTGA
CCGCGTGCCTGTTGAAGAATGAGCCGGCGACTTATAGGCGGcggcctGGTTAAGGAAACCCACcgGAGCCGTAGCGAAA
GCGAGTCttcccagggcAACTgT
```

> SEQ ID NO:1748 129932 56630_300127_1
```
AAATTGCGGACAGTGAAACTATTAGTGTTGATGGTAAGCTCATCAAAGTTGTCTCCAACAGAGACCCTCTTAAGCTTCC
ATGGGCTGAGCTCGGCATTGACATTGTTATCGAGGGAACAGGAGTGTTTGTTGATGGGCCAGGAGCAGGGAAGCATATC
CAAGCCGGAGCCTCGAAAGTTATCATCACTGCACCAGCCAAAGGTGCTGATATCCCTACCTATGTTATGGGAGTCAATG
AGCAAGACTATGGTCACGATGTCGCTAACATTATT
```

FIG. 2 continued

> SEQ ID NO:1749 129932 167342_300546_1
GAATTCAAAGGCTTACGGTGGATACCTAGGGACCCAGAGACGAGGAAGGGCGTAGCAAGCGACGAAATGCTTCAGGGAG
ACAAGAAATCTGTAGTGCGAAGATGTTTTGCTACTGAAGCTGCTGAGCTGAAGAAGACAGCTCTTTACGATTTCCATGT
TGCCCATGGAGGAAAAATGGTTCCTTTTGCTGGTTGGAGCATGCCAATCCAGTACAAGGATTCAATTATGGATTCCACT
CTCAATTGCAGATCCAATGGTAGTCTTTTTGATGTTTCCCACATGTGTGGACTTAGCCTCAAGGGTAAAGACTGCATTC
CGTTCCTTGAGAAGCTTGTGATTGCTGATGTTGCTTCACTTGCTCCTGGGACTGGTAGTCTTACTGTCTTTACCAATGA
GAAGGGTGGAGCTATTGATGATTCTGTGATCACAAAAGTCACAGATGATCATATATACCTGGTTGTGAATGCCGGTTGT
AGGGATAAGGATTTAGCTCACATTGGAGCACATATGGAGGCATTCAAAGCCAAGGGTGGAGATGTCTCATGGCATATCC
ATGATGAGAGATCCCTTATAGCTCTCCAGGGCCCTCTTGCTGCACCAGTTCTTCAGCATCTAACTAAAGATGATTTGAG
CAAGTTCTACTTTGGGG

> SEQ ID NO:1750 129932 170409_300533_1
CTTGCGGTGGATACCTAGGggCCCAGAGACGAGGAAGGGCGTAGCAAGCGACGAAATGCTTCGGGGAGTTGAAAATAAG
CATAGATCCGGAGATTCCCAAATAGGTCAACCTTTTGAACTGCCTGCTGAATCCATGAGCAGGCAAGAGACAACCTGGC
GAACTGAAACATCTTAGTAGCCAGAGGAAAAGAAAGCAAAAGCGATTCCCGTAGTAGCGGCGAGCGAAATGGGAGCAGC
CTAAACCGTGAAAACGGGGTTGTGGGAGAGCAATACAAGCGTTGTGCTGCTAGGCGAAGCGGTTGAGTGCCGCACCCTA
GATGGCTAAAGTCCAGTAGCCGAAAGCATCACTAGCTTACGCTCTGACCCGAGTAGCATGGGGCACGTGGAATCCCGTG
TGAATCAGCAAGGACCACCTTGCAAGGCTAAATACTCCTGGGTGACCGATAGCGAACTAGCCCCGCTTGAAGGGAAAGT
AAGAAAGAAGGC

> SEQ ID NO:1751 129932 183032_300665_1
gaattcggggcccagagacgaggaagggcgTAGCAAGCGACGAAATGCTTCGGGGAGTTGAAAATAAGCATAgatgcgG
AGATTCCCGAATAGGTCAACCTTTCGAACTGCTGCTGAATCCATGGGCAGGCAAGAGACAACCTGGCGAACTGAAACAT
CTTAGTAGCCAGAGGAAAAGAAAGCAAAAGCGATTCCCGTAGTAGCGGCGAGCGAAATGGGAGCAGCCTAACACGGGGA
GGTAGTGACAATAAATAACAATACCGGGCTCTTCGAGTCTGGTAATTGGAATGAGTACAATCTAAATCCCTTAACGAGG
ATCCATTGGAGGGCAAGTCTGGTGCCAGCAGCCGCGGTAATTCCAGCTCCAATAGCGTATATTTAAGTTGTTGCAGTTA
AAAAGCTCGTAGTTGGACTTTGGGTTGGGTCGTCCGGTCCGCCCTTTGGGTGTGCACCGGTCGTCTCGTCCCTTCTACC
GGCGATGCGttccTAGCCTTAATTGGCCGGGTCGTGCCTCCGGTGCTGTTACTTTGAAGAAATtAGAGTGCTCAAAGCA
AGCCCAAGCTCTCCagcaACGgtgGAAgagTTAACTGCATGCAGGTATGGCCACCAagtGGTTTgaacaagtgtgagAc
cCTCTCATaccTTCCTCCatcgaccgtcGagcaATtgTCAAAGgAaGt > SEQ ID NO:1752 129932 191488_300785_1
CCCGGCTGCATTCTTCTTGATCTGATCGTCGGACATGGGGTCGCCCATGCTCTCCGCCGCCACCGTGCCACTCCAGGGA
GGCGGCTTGTCGGAGTTCTCCGGCCTGAGGAGCTCGTCGTCGCTGCCGCTGCGGCGGAATGCCACCTCCGACGACTTCA
TGAACGCGGTCTCCTTCAGGACCCACGCGGTTGGCACGACCGGCGGGGCGCGGCGGGCGCCGACGGAGGCGAAGCTGAA
GGTGGCGATCAACGGGTTCGGCCGCATCGGGCGCAACTTCCTGCGGTGCTGGCACGGCGCGGCGACAGCTCGCCCCTC
GACGTCATCGCCATCAACGACACCGGAGGCGTGAAGCAGGCGTCGCACCTCCTCAAGTACGACTCCACGCTCGGCATCT
TCGACGCCGACGTCAAGCCCGTGGGCGACAACGCCATCTCCGTCGACGGGAAGGTGATCAAGGTCGTCTCCGACCGCAA
CCCGTCCAACCTGCCGTGGGGCGAGCTCGGCATCGACCTCGTCATCGAGGGCACCGGTGTGTTCGTCGA > SEQ ID NO:1753 129932 202039_300722_1
cggacgcgtggggaaaGGCTTGCGGTGGATACCTAGGTACCCAGAGACGAGGAAGGGCGTAGCAAGCGACGAAATGCTT
CGGGGAGTTGAAAATAAGCATAGATCCGGAGATTCCCAAATAGGTCAACCTTTTGAACTGCCTGCTGAATCCATGAGCA
GGCAAGAGACAACCTGGCGAACTGAAACATCTTAGTAGCCAGAGGAAAAGAAAGCAAAAGCGATTCCCGTAGTAGCGGC
GAGCGAAATGGGAGCAGCCTAAACCGTGAAAACGGGGTTGTGGGAGAGCAATACAAGCGTTGTGCTGCTAGGCGAAGCG
GTTGAGTGCCGCACCCTAGATGGCTAAAGTCCAGTAGCCGAAAGCATCACTAGCTTACGCTCTGACCCGAGTAGCATGG
GGCACGTGGAATCCCGTGTGAATCAGCAAGGACCACCTTGCAAGGCTAAATACTCCTGGGTGACCGATAGCGAAGTAGT
AccgtgAGGGAAAGgTGAAAAGaaccCCCAgtggGTAGTgaaatagaaCGTGAAAccgTGCTGAGctcCcaagcAGTgG
gagggGAaaGTGATctcTGA > SEQ ID NO:1754 129932 184528_300670_1
gaattcaaggcttacggtggatacctaggcacccagagacgaggaagggcgtancAAGCGACGAAATGCTTCGGGGAGT
TGAAAATAAGCATAGATCCGGAGATTCCCGAATAGGTCAACCTTTCGAACTGCTGCTGAATCCATGGGCAGGCAAGAGA
CAACCTGGCGAACTGAAACATCTTAGTAGCCAGAGGAAAAGAAAGCAAAAGCGATTCCCGTagtaGCGGCGAGCGAAAT
GGGAGCAATACAAGCGTCGTGCTGCTAGGCGAAGCGGTGGAGTGCTGCACCCTAGATGGTGAGAGTCCAGTAGCCAAAA
GCTTGGTTTATATACTTATTCATTGGTGTCGGAGCAATTCTATTTGTCATATCATGTTTCGGCTGTATTGGTACTCTTG
CCAGGAGTGGATGCTGccTCACTTGTtaTtCTCTATTGGTCATCTTGTTGATCATGGCAGAGCTGGGATGTGCGGctTT
CATATTCTTTGAcaagaGCTGGAAAGatgcaatacccgGATGACAAAACTggAGAttTTGATATGATATACAGTtttcct
AGaaCATaaCTggaaAAtcgcaaAAt

FIG. 2 continued

> SEQ ID NO:1755 129932 181571_300656_1
gaattcagggaggaatggcgtagtatcggcgagcGAAATGCTTCGGGGAGtTgAAAATAagcATagaTCCGgagagccc
GAataggtCAACCTTTCGAACtgtgcTGAATCCATGGGCaGgCaataggcaACCTGGCGAACTGAAACATCTtattag
cCagaGGAAAAGAAAGCAAAAGCGATTCCCGCGTgccTGTTGAagaATgatccGGcgACTCATAGGCAGTGGCTTGGTT
AAGGGAACCCACCGGAGCcgtaGcGAAAGCGAGTCTTCATAGGGCAATTGTCACTgctTATGGACCCGAACCTGGGTGA
TCTATCCATGaccAggaTGAagcTTGGGTGAAACTAAGTGGaggTCCGAaacGACTGATGTTgAagaAtCAGCGGAtga
cttgtgGTTACgGGTGAAATgccACTCGAACc > SEQ ID NO:1756 129932 167420_300547_1
gaattcaggagtcttatttctactccttccgtgctagcttgcagagcattctctcttgaaagctcatcatggcttctgc
aTTTCTCTCAGTAGCCAAGCCTTCTACTCTCCAGGTTGCAAAGGGACTCGGCGAATTCTCTGGTCTCCGCAATTCCTCT
GCTTCTTCCCTTCCCTTTGCTTCAAGGAAATCCAACGAGGATTTTCTCTCCCTCGTGGCCTTCCAGACATCTGCTGTTG
CTGTTGGAAGCGGTTACAGGAGAGGAGTAACAGAAGCAAAGTTAAAGGTTGCAATCAACGGGTTTGGAAGGATCGGAAG
GAATTTCTTGAGGTGTTGGCACGGTAGGAAGGATTCCCCCTTGGATATCATCGCCATCAACGACACCGGCGGTGTCAAG
CAAGCTTCTCATCTTCTCAAGTACGATTCTACCCTCGGCATTTTTGATGCTGATGTCAAGCCTGTTGGTGACGATGCTA
TCTCTGTTGATGGCAAGATCATCAAGGTAGTCTCCAGCCGTAACCCCCTCGACCTCCCCTGGGGGGATATGGAGGTGGA
TCTAGTTATTGAAGGGACAGGAGTGTTTGTGGACAGAGAAGGTGCAGGGAAACACATACAGGCAGGTGCTAAGAAGGTG
TTGATCACAGCACCTGGTAAAGGTGACATTCCCACTTACGTTATTGGTGTCAACCAAGAACTTTACACCCACGCCGATA
CAATCATCAGCAATGCTTCTTGca > SEQ ID NO:1757 130172 103792_300027_1
tggtatcaacgcaggtggcattacggccgggggtgctgcgacTGCTATTCTAAATCCGTAGGACCATTTTTCAGAACAT
CAAAGAAGCGAAAATGGAGCAGACTTTCATCATGATCAAGCCTGATGGTGTCCAACGTGGCCTGGTTGGTGAGATTATC
GGAAGATTTGAGAAGAAAGGATTCTCTTTGAAAGGCTTGAAGCTCATCACTGTGGATCGTGCCTTTGCTGAAAAGCATT
ACGCAGACTTGTCTGCTAAGCCTTTCTTTAGTGGTCTTGTTGATTATATTATCTCTGGCCCCGTTGTTGCAATGGTCTG
GGAAGGTAAGTGTGTAGTTACCACTGGCAGGAAGATCATTGGAGCAACAAACCCATTGGAGTCTGCTCCTGGTACAATC
CGTGGTGATTATGCTATTGACATTGGCAGGAACGTTATTCATGGAAGTGATGCAGTCGAGAGTGCAAGGAAGGAAATTG
CTCTTTGGTTCCCCGAAGGAGTTGCAGAGTGGCAGAGCAGCCTTCACTCTTGGATCTATGAGTAGAAATGTTTTGTTTA
CTTTAGAACTCTATTAATGGCCTGCCTGTTTGGGTGTAACTTATGAATTTTGGATGTGATTTGAGTCTAGAAGTTTATT
GTTTGAGGTTTTCTGTTATTCCCTATTTCAAGAATATTTAATGTGATCAGTATTACTTTCGTGATAt > SEQ ID NO:1758 130172 1170724_302038_1
tacagttgctggttgcccttccgccctccctctctccaccgaagatggcgtcgaggttcgcctccgagcatctcgag
cCCTTCGCTCTGCCCTcgcCCCAGAAGGGCGAACCTTTGCAACTGCTGCCTTTAACaggggccACTCAGCTGTGTCCCA
GTTATTGCAAACTTCTACAGGATCGGATAAATTCTTTAAAGCTGGGGCTATCCTCTTACCTATGGCAGTGCTTGCAGCA
ACCACTGATGAGAAATTCCACGCTGCTGAGGCTGAGAGAACATTCATTGCGATCAAGCCAGATGGTGTGCAAAGAGGAC
TGATTTCGGAGATTGTTGGTCGCTTTGAGCGAAAGGGCTATAAACTTGTAGCGATCAAGCTTATTGTGCCAACTAAAGG
GTTTGCAGAGAAGCACTATGACGATTTGAGAGGCAGGCCATTTTTTAATGGGCTTTGTGAATTCCTGAGTTCTGGTCCT
GTTGTCGCTATGGTGTGGGAAGGCCAAGGTGTGATCAAGTATGGAAGGAAGCTGATTGGTGCCACAGTCCACATAATT
CAGAGCCTGGAACTATCAGAGGAGATCTTGCTATCTCTGTGGGAAGGAACATCATACATGGTAGTGACGGCCCTGAAAC
AGCAAAAGCAGAGATCGGGCTTTGGTTCAAGCCAGAGGAGCTTGTAAATTATTCGACCATTTCTGAgaaGtggTTATAT
GAGCCTTGAAGAAAGCTGtagatcTGATCATCATGCtTtTCACAcctggggtTTTTCTGAAgggCTAttgaaTCTaATC
TAACTTccAATATATATATATgcttaCaatTGAAATa > SEQ ID NO:1759 130172 120191_300359_1
GCGAAAGAGATAGAAAGGGAGATGGAGGGTCTTAGCGTTGTAGGAGCAAGTCCTTGCGTTTCTTCTTCTGTACTACCAT
CTTCACTTTCTTCGCCTACCAGCCGCTTATCCTGCGCACCCTCTTGCAAACTTATCCTTAACCCCATCAAGAAGCACCA
CCATTTGGCTGCATTTCAACCTGCATTTCATCTTTTTGCAAGTAACCGTGACCAATCTCGTTCCCATGCCTCCAAAAGG
AACCATACAGCTCGTATATTCCTTCCCCACTTGGTTGCTTCCATGGAAGAAGTGGAGGAGACATACATTATGATTAAGC
CTGATGGTGTTCAAAGAGGACTTGTTGGGGAGATTATTTCAAGATTTGAGAAAAAAGGGTTTAAGCTAACTGGTTTGAA
GCTTTTTGAATGCCCCAAAGAATTGGCAGAGGAGCATTACAAGGACCTACAGTCCAAATCATTCTTCCCCAAGCTGATC
GATTACATTACCTCTGGTCCTGTTGTCTGTATGGCCTGGGAGGGTGTTGGTGTTGTAGCATCTGCCCGTAAGCTAATAG
GAGCAACTAATCCACTTAATGCGGAGCCCGGCACAATCAGAGGAGACCTTGCTGTTCAAACTGGAAGAAATGTGGTGCA
TGGAAGTGATAGCCCTGACAATGGCAAGCGTGAAATAGCACTTTGGTTTAGAGAAGGTGAACTGTGCTCATg > SEQ ID NO:1760 130172 125071_300567_1
cttttttttagggccaactgatctttcctctggtaacagaaagaaaaaatccaagaaaaatgaggttcagtatggtag
aGGTAAAGTTGCTACCAGCCTAAGGAAAAATGGCATCCGATTTATTCGTGATAAATTATGAGTATGCTACTCTTCATGC

```
CGATTTAATGGCAATTCagaTTAAGGTAGAATAGGTTCGCTCAGTTGTCACCATATACCCACCTCTCTGAATTGCTTgt
gTAGTTAACCAACTCTTCTGGTTTAAACCATAGGTTGATCTCATCCTTGGCAGTCTCTGGTCCATCGCTACCATGGATG
ATGTTCCTTCCGACTACAACAGCTAAGTCACCTCTGATGGTTCCTGGTTCGGATTTCTGTGGATCTGTGGCTCCGATAA
GCTTCCTTCCATATCTGATTACTCCTTCACCTTCCCAAACCATTGCTAGGACAGGGCCAGAGCTAAGGAAATCACATAG
GCCATTAAAGAATGGTCTCGCCGACAAGTCATGATAGTGCTTCTGTGCGAATTCCTTGGAAGGAATCACAACTTTGATT
GCAACCAGCTTGAAACCCTTGCGCTCAAAGCGTGCTATGATTTCTGAAATCAGGCCCCTCTGCACTCCATCTGGCTTGA
TGGCAATAAAGGTGCGCTCCATCTGAGCAGCATGTGCTTCTTGCTCTTGGAGCATGTAAGCTGCTGCAGGAAGGGCAAG
GACACCAGAAATCCAAGCTCTAGATGCGTTTCCAGAATCTGTCCTGCCATATGAGGCTAGAGAAGGCACCACTCCTCTC
AAAGAAACTGTGGCTGCTGCAGCTGCTGCTCGCCCCCCAGAAAAAGCACGAGAACTCTGTTTGGAGGcagaaacgagag
acttagcagctcgtgaagcagatctgtaaatctgagaattcatctcttagacttttacaagaaaaaga > SEQ ID NO:1761 130172 216818_300902_1
AGCACATCCCGCCAGTCCAACCAGTATGCTATACCCCTCCTTCCACTCCAAAAACAGTCGCCATGGCTTCCACCGAGCA
GACCTTCATTGCCATCAAGCCTGATGGTGTCCAGCGTGGCCTGATCGGCCCCATCATCAGCCGCTTCGAGAGCCGTGGC
TTCAAGCTGGTTGCTATCAAGCTCACCCAGCCCGGAAAGGAGCACCTCGAGGCCCACTACGCCGACCTCAAGGGCAAGG
GCTTCTTCGATGGCCTCATCAGCTACATGAACTCCGGCCCCATCTGCGCCATGGTCTGGGAGGGCCGTGATGCCGTCAA
GACCGGCCGCACCATCCTCGGTGCCACCAACCCTCTTGCCTCCGCCCTGGCACCATCCGTGGCGACTACGCCATCGAT
GTCGGCCGCAACGTCTGCCACGGCTCCGACTCCGTCGAGAACGCCAAGAAGGAGATTGCCCTCTGGTTCAAGGACGGTG
AGGCCGTTTCCTACAAGGCTTCCCAGTTCGACTGGATCTACGAGAAGGAGTAAACTGTCTTTTATGACAATATGACAGA
GCTCTGAAGC > SEQ ID NO:1762 130172 193904_300777_1
cccccgccttCTCCCTCAACCTACGGCGCCGACCACCTCCAAAACCAGACCCCGAAATCTCGAGGAGCTTGTCTTTTTT
CGGTAGCAATGGCGTTGGAGCAGACCTTCATCATGATCAAGCCCGACGGCGTCCAGAGGGGCCTCATTGG > SEQ ID NO:1763 130172 129361_300405_1
CCCCGACGACCCACTCCGCCTCGCCTCCGGTCCTCTCCTCTCCGCATCCTCCTCATCGCCTCCGCTTCTGCTTTTTTTT
TTCTTTTTTCTCGTTGATCGGTTTGTTCGATCAGATCGGTTCTTTGGAGAGATGGAGCAGTCCTTCATCATGATCAAGC
CTGACGGCGTCCAGAGGCCTGATTGGAGACATCATCAGCAGGTTCGAGAAGAAAGGATTCTACCTGAGGGGGATGAA
GTTCATGAATGTGGAGAGGTCCTTTGCACAGCAGCACTATGCCGACCTTTCCGACAAGCCCTTCTTCCCTGGGTTGGTG
GAGTACATCATCTCTGGCCCCGTCGTTGCGATGGTTTGGGAAGGGAAGGATGTTGTTGCCACTGGCCGCAGGATCATTG
GGGCCACCAGGCCCTGGGAGGCAGCCCCGGCACCATCCGTGCTGACTATGCCGTGGAAGTTGGCAGGAATGTCATCCA
TGGGAGCGACTCCGTGGACAACGGGAAGAAGGAGATCGCTCTCTGGTTCCCTGAAGGTTTAGCTGAGTGGAGGAGCAAC
CTTCACCCTTGGATCTATGAGTCTTAGAGCTTCGCGCCTATAATCGATCACCTCTTGGTGGCTAGTTCTCGTTAAATAT
TTGAG > SEQ ID NO:1764 130172 121586_300358_1
CCCCAGAGATGGAGCGCACCTTTATCGCCATCAAGCCTGACGGCGTCCAAAGGGGCCTGATTTCTGAGATACTGTCCCG
ATTTGAAAGAAAAGGATTCAAGCTTGTTGCCATCAAGCTGGTGGTTCCATCCAAAGAATTTGCTCAGAAGCACTATCAT
GATTTGAAAGACAGACCTTTCTTCAATGGATTGTGTGACTTCCTTAGCTCTGGCCCTGTGCTTGCCATGGTTTGGGAAG
GAGAGGGTGTTATCAAGTACGGGAGAAAACTGATTGGTGCTACAGACCCACAGAAGTCTGAACCAGGAACCATCAGGGG
TGACCTTGCTGTTGTTGTTGGCAGGAACATCATCCATGGAAGCGATGGCCCAGAGACTGCAAAGGCTGAGATTGGTCTC
TGGTTTGAGCCCAGGGAGCTGGTCTCTTACACCAGCAACGAAGAGAAGTGGATCTACGGGGTCAACTAACCGGCGAATC
ATCTCCCCTGTTTGTTTTGGTTTTTTTTCATTTTCTCTCAC > SEQ ID NO:1765 130172 232736_301217_1
gactgcgacGGAGATGGCGAACATGGAGCAGAGCTTCATCATGATCAAGCCGGATGGCGTTCAGCGTGGACTGGTTGGG
GATATCATCTCGAGATTCGAAAAGAAGGGATACACTCTCAAAGGGCTCAAGCTCATGCAAATTGAGAAGTCCTTCGCCG
AGAAGCACTACGCAGACCTCTCGGCCAAGCCATTCTTCGGCGGTCTCGTCGAGTACGTGACTTCGGGCCCGGTTGTGGC
GATGGTTTGGGAAGGCAAGGCCGTGGTGGAAACCGGGCGAAAGATAATCGGGGCCACGAATCCGCTCGCTTCCGCACCC
GGAACTATTCGTGGAGACTTCGCCATCGACGTCGGAAGGAATGTGATCCATGGCAGCGACTCGGTCGACAACGCCAAGA
AGGGAGATCGCTCTGTGGTTCCCGGATGGTGTCACGGATTGGCAGCAGTCTGTGCACCCGTGGATCTACGAATGAATCCA
AGAGATCTCCGCATTTAAATTCCTTTAAAGTTTTGCTTTCGTGTATCCATTCAATTAATATGGCAAAGTTCCTCTAAAA
Ctgttttaatacaaaaaaaacaaaa > SEQ ID NO:1766 130172 317230_301455_1
aAatcttacaaagACTTTAaggtgcTTGATGCTTTGGATAAGGCTTTAGTGGATAGATATCGATCCCCTTATAGTGCTA
TTTCTGCTTTGGTTTCTTTATGTTATCATATCTTTGACTTTAATAAGTTTAAGTTGCTGTTTAATTGTGAAGGGAAATT
TGTGGATAAGAAGCTGAGAAAAGACTTCGAGTGGTGAACTCTAGGTCCTGATGTTTAAATCTACTGTATTTACCTTCGC
```

FIG. 2 continued

ATTAATTAAGCATGGAGCAGTCCTTCATCATGATCAAGCCTGACGGCGTCCAGAGAGGCCTGATTGGAGACATCATCAG
CAGGTTCGAGAAGAAAGGATTCTACCTGAGGGGGATGAAGTTCATGAATGTGGAGAGGTCCTTTGCACAGCAGCACTAT
GCCGACCTTTCCGACAAGCCCTTCTTCCCTGGGTTGGTGGAGTACATCATCTCTGGCCCCGTCGTTGCGATGGTTTGGG
AAGGGAAGGATGTTGTTGCCACTGGCCGCAGGATCATTGGGGCCACCAGGCCCTGGGAGGCAGCCCCCGGCACCATCCG
TGCTGACTATGCCGTGGAAGTTGGCAGGAATGTCATCCATGGGAGCGACTCCGTGGACAACGGGAAGAAGGAGATCGCT
CTCTGGTTCCCTGAAGGTTTAGCTGAGTGGAGGAGCAACCTTCACCCTTGGATCTATGAGTCTGCGGCCGCTTATCCGT
ATGATGTTCCGGATTATGCCGAGCTCTACAAACAGCTGTTGAATTTTGATTTGCTGAAGTTGGCGGGTGACGTGGAATC
TAACCCTGGTCCTAGGTCTAGAATGGCTACTTTCTCTTGTGTGTGTTGTGGTACCTTAACTACAAGTACTTACTGTGGT
AAGAGATGTGAGCGAAAGCATGTATATTCTGAAACAAGAAATAAGAGATTGGAACTTTACAAGAAGTATCTATTGGAAC
CGCAAAAATGCGCCCTGAATGGAATCGTTGGACACAGTTGTGGAATGCCATGCTCCATTGCGGAAGAGGCttgTGatca
act > SEQ ID NO:1767  130172  274473_200057_1
ccacacataacttaacaacccaacggaatacttaaacgtagcattccctcaaaacagagtatcactttggatcaattaa
gGCtttctaAAATTGTTACCTTGTTAGAAGGGAAAAGGTCCAAATTCACTTTTGTACTTTGCAAAAATAGCCACATCCC
CACATTGTAGAAACACAGCATAATTCAGAACCGAAAAAATGGAGCAGACCTTCATCATGATCAAGCCTGATGGTGTCCA
ACGTGGCCTGGTTTACTTCGATTCAATTTCGTTTAATTTTGTTTTTGTGTTTGTTGAGCTACACTTTTATTAATTCGCT
TTTTTTTTTTTCTGTTAGCTGATCTATGCTTTAATTGACTAATTTTGGATCAATGGTTTGATTTTATGTTTCAGGTTG
GTGAGATTATTGGAAGATTCGAGAAGAAAGGTTTCTCTTTACAAGGCTTGAAGCTCATCACCGTGGATCGTGCTTTTGC
TGAAAAGCACTATGCAGACTTGTCTGCAAAGCCGTTCTTCAATGGGCTCGTTGAATACATTGTTTCTGGCCCCGTTGTT
GCAATGGTGTGGGCAGGTAAGGGTGTAGTTACTACCGgTAGGAAGaTAATTGGCGCAACCAGCCCATTGGAGTCTGCTG
CtggCACCATccgtggtgaTTATGCTATCGACATTGGGaggaaCGttATTCATGGaaGtGATTCGTttg > SEQ ID NO:1768  130172  254678_301634_1
cttgtatacagttGCTGGTTGCCCTTCCGCCCTCCCCTCTCTCCACCGAAGATGGCGTCGAGGTTCGCCCTCCGAGCAT
CTCGAGCCCTTCGCTCTGCCCTCGCCCCAGAAGGGCGAACCTTTGCAACTGCTGCCTTTAACAGGGGCCACTCAGCTGT
GTCCCAGTTATTGCAAACTTCTACAGGATCGGATAAATTCTTTAAAGCTGGGGCTATCCTCTTACCTATGGCAGTGCTT
GCAGCAACCACTGATGAGAAATTCCACGCTGCTGAGGCTGAGAGAACATTCATTGCGATCAAGCCAGATGGTGTGCAAA
GAGGACTGATTTCGGAGATTGTTGGTCGCTTTGAGCGAAAGGGCTATAAACTTGTAGCGATCAAGCTTATTGTGCCAAC
TAAAGGGTTTGCAGAGAAGCACTATGATGATTTGAGAGGCAGGCCATTTTTTAATGGGCTTTGTGAATTCCTGAGTTCT
GGTCCTGTTGTCGCTATGGTGTGGGAAGGCCAAGGTGTGATCAAGTATGGAAGGAAGCTGATTGGTGCCACAAGTCCAC
ATAATTCAGAGCCTGGAACTATCAGAGGAGATCTTGCTATCTCTGTGGGAAGGAACATCATACATGGTAGTGACGGCCC
TGAAACAGCAAAAGCAGAGATCGGGCTttggttcaagcCAGAGgAgcttgtaaATTATTCGaccATTTCTGagaagTGg > SEQ ID NO:1769  130172  30310_301725_1
AATTGAACAATATAAATTCAAATACTAGTCATCCCATACTTATTGGTTATGCTCTGATTACTGAGTTCACCGGGGAAAA
ATCAAAACCCGGAATGTGTTTGTATCCGTAACAACTGTTTCTTGTTTTTATTGTATGGGTAAGAAAAAGAAAAGAAAAAC
CAATGTGATTTGATTTCAAAAGACAAGAGGAAGAGGGATTTAGTTGTCACCATAAAGCCACTTCTCAAAGTTACTAGTG
TAAAAAACAAGTTCTTGAGGCTTAAACCACAGACTGATCTCATCCTTTGCAGTCTCTGGTCCATCACTTCCATGGATTA
TGTTCCTGCCAACAGTAACTGGAAAATCTCCTCGGATTGTTCCAGGCTCAAATTTCTGAGGATCAGTGGCTCCAATCAG
TTTACGTCCGTATCTGATCACACCATCTCCTTCCCAGACCATGGCAATAACAGGACCAGAGCTAAGGAAGTCACACAAA
CCATTGAAGAAAGGTCTTTCCTTAAAATCATGGTAATGCTTTTGTGCGAAATCTT > SEQ ID NO:1770  130172  256496_301672_1
TTAATGCTGTAGCGTCCTCTTCGTCGGCTCTAGTTCAAATTCTAGGGCAGCATTGCGGGAGACCTACTAGGGCCGATG
GCGCCGCATCTCCAGGAAGAAATCGCGTCTCCACCACAGTGGCATTCCGCAGCCACCGGATCCGCTGGCGCCCTAGCTC
CATTTGCCATCGCATCCATCGCGTCGATTCCAAAGCTGTTGTTAGCGACGAGGAGACGCGCGTCGTAGCTAAGCCTAGA
GCAGAGGGAGGACTGGAGCAGACTTATGTAATGGTAAAACCCGATGGCGTCCAGCGCGGCCTGGTTGGAGAGATTATCT
CTAGATTTGAGAAGAAAGGATTTCGTCTCGCGGGATTAAAAATGTTCCAATGTCCTGAGGGACTTGCAAAGAAACACTA
CGAGGAGCTTAAAGAGAAGCCTTTCTTTCCCAAGCTGGTGAAGTACATTACCTCCGGTCCCGTCGTTTGCATGGCGTGG
GAAGGTCCAGGGGTCGTCGCTTCCGCACGAAAACTTATTGGATCGACAAATCCTTTGCTGGCCGAGCCAGGAACTATTC
GTGGTGATCTCGCTGTTGCCGTTGGAAGGAACGTCATTCATGGCAGCGATAGCGTTGCGAATGGAGAGCGCGAAATTGG
CCTAT > SEQ ID NO:1771  130212  266075_200083_1
CCCTCGACCACGCGTCCGGCTATGGCTCTTCGTAAACTCTCTTATGGTTCCTCCATTAAGCTTCTTCGTCCTCTCTCCA
TGGCCCTTCCCTCTATTACATGTCGTCTTTGCCTAGTCAAGCAATTCGTGAAAGGGAGGATCCGCGTGTTACGTGGATA
AAGCAGCTGATTGTGCTACTTGAGGATATCGATCCAGAGATCGCCGACATCATTGAGCATGAGAAAGCTAGACAATGGA
AGGGTCTTGAGCTTATCCCTTCAGAGAATTTTACGTCATTGTCGGTGATGCAAGCAGTTGGATCAGTAATGACCAACAA

FIG. 2 continued

```
GTACAGTGAAGGGTATCCGGGTGCTAGATACTATGGAGGAAACGAGTACATTGACATGGCAGAGAGATTGTGTCAAAAA
CGTGCATTAGAAGTTTTTAACTTGGATCCTGCCAAATGGGGAGTCAACGTTCAGTCGTTGTCTGGATCCCCTTCAAACT
TTCAAGTGTACACTGCTTTATTAAAGCCTCATGAGAGAATTATGGCCCTCGATCTTCCTCATGGTGGACATCTCTCACA
TGGTTATCAGACCGACACAAAGAAAATTTCTGCTGTATCTATCTTTTTCGAGACCATGCCATACAGATTGGATGAGAGC
ACAGGTTATATTGACTATGATCAGCTGGAGAAAAGTGCAGTACT

> SEQ ID NO:1772  130212  128325_300475_1
CAGGGGAGAAGCTGACAATAATTATGGCCATGGCAACGGCTCTTCGAAGACTCTCCTCTTCTGTTGACAAACCAATTAA
GCGTCTCTATAATGGCGGCTCTCTCTATTACATGTCATCGTTGCCTAATGAAGCTGTTTACGAGAAGGAAAAAAATGGT
GTCACGTGGCCAAAGCAACTGAATGCTCCTCTAGAGGAGGTTGATCCTGAAATTGCTGACATTATTGAGCTTGAGAAAG
CACGCCAGTGGAAGGGACTTGAACTCATTCCTTCAGAAAATTTCACTTCTGTGTCTGTAATGCAAGCTGTTGGATCCAT
TATGACAAACAAGTACAGTGAAGGATATCCTGGGGCTAGATACTATGGAGGAAATGAGTATATTGACATGGCGGAAACA
TTATGCCAGAAACGTGCTTTAGAAGCATTCCGGTTGGATCCTGCAAAATGGGGAGTGAATGTGCAGCCTCTATCAGGAT
CACCTGCTAATTTTCATGTTTACACTGCACTTTTAAAACCTCATGAAAGAATCATGGCCCTTGATCTTCCCCACGGTGG
ACATCTTTCTCATGGATATCAGACTGATACAAAGAAGATATCTGCCGTCTCTATATTTTTTGAGACCATGCCATACAGA
CTGAATGAGAGCACTGGCTACATTGACTATGACCAGCTTGAGAAAAGTGCCACACTCTTTAGGCCAAAGTTAATTGTCG
CTGGTGCTAGTGCTTATGCACGTCTTTATGACTATGCACGTATCCGAAAGGTTTGTGACAAACAGAAGGCTGTCATGTT
GGCAGATATGGCTCATATTAGTGGGTTAGTTGCAGCTGGAGTCATCCCATCACCATTTGATTATGCagaTgttgtgact
accACAaCccacaaatcccttCGCGGGCCTCGTggTgccATGa > SEQ ID NO:1773  130212  132542_300447_1
CTGAGAATTGTTGGATTGTGTGATTGTTTTTTCAATTACAATGGATTTGAGCCAATCGCAATCGAGTAATCTCTCGCTA
GGGTTTATTGCTCATGCGTCCCCGGCGGGAAGCGCACCTAGTCGTGCTCATATCGCCGACGACTCGATCACTTTTCAGA
TCGATTCTAGGGTTAAGGACCAATCGCATCTGATTCCGCCTGTTCCACTTCAATTGATGGACAAGCAAACGGAGGAGAA
CGAAAAGAACGGGGGAGAGAGTGGGGATGAAGAGAGGGAAGTTGAAGAATTTCGTATTCTAGGACATTCCATGTGTATA
AAACGGAGGAGAGATATTGATAGCACGTCGTCTTCTTCGTCTTCAAAGTGCTTTAGGGTTACGAGTTCCAATGAGCATA
TGCTAGGGCTAGAATCGCGAATAAGCGCTGTTAGAGCTTGGGGTAATCAGGGTTTACAGGTAGCTGACCCGGATATATT
TGAGATAATGGAGAAGGAGAAGCAGAGACAGTACAAAGGGATTGAACTGATTGCCTCTGAGAATTTTGTATGCAAGGCT
GTGATGGAGGCATTAGGGAGCCATTTAACAAACAAGTATTCTGAAGGAGCACCGGGGGCAAGGTACTATGGTGGTAATC
AGTTTATAGATGAGATTGAAACTCTATGTTGTAAGCGTGCA > SEQ ID NO:1774  130426  109256_300044_1
caaaatcagttttgctcaataccctttttcaagattcactcagagttcaaaactttcattgaaaaaatcaagaatggttg
tTGTTTCAGCTACAACTGCTGCTGAGAAATCCAATAAAAGGTATCCTGGTGAAGCTAAAGGGTTTGTTGAGGAGATGAG
ATTTGTGGCTATGAAATTGCATACTAAGGATCAATCTAAGGAAGGTGAAAAAGAACCTGAAGGTCAGCCTATGGCTAAA
TGGGAACCTAGTGTTGAAGGGTATTTGAAGTTTTTGGTGGATAGTAAATTGGTTTATGATACTTTGGAAAAGATTATGG
AAAAGGCTCCCTTTTTCTGAGTATGCTGAGTTCAGGAACACGGGATTAGAAAGGTCAGAGGCCTTAGCAAAAGATTTGGA
ATGGTTTAGGCTGCAAGGTTATGCCATCCCAGAACCATCAGCTCCTGGTCTCAACTATGCTCGTTACCTAGAGGAGCTA
TCAGAAAAGGATCCTCAAGCATTTATTTGCCACTTTTACAACACATACTTTGCGCATTCAGCTGGTGGTCGCATGATAG
GGAGAAAGGTGGCTGAAAAGATACTCAATAAGAAAGAGCTGGAATTCTACAAATGGGACGGTGACCTTTCTCAGCTGCT
GCAGAATGTTAGAGAGAAGCTGAATAAAGTTGCAGAAAATTGGActagaGAGGAGAAGAATCAttGTTTGGAAGAGacg
gAGAAGTCATTCAAGTTCTCAggGGAAATccTccGATTaaTATTGTCTTGATGCGCggCTTTGCATTTGTACGTTGGAT
ggcctaaAGCTCaAATTACTgtgAatagTCGTGttCAtTTTc > SEQ ID NO:1775  130426  237081_301250_1
gcggcggcGGCATCCACGGCATCGACGATTGGGAGCACGCTACCGCGGCCGGGTCTCCGGCGACGTAAGCATGAATCCT
CTCCCTTCTCGCCGTGCTCGTCGTGCTCTTTCTCCAAGTCGGCAGCGGCAGAGCCTCTGGATCGAAGAGCGACGATTTG
GTGCCCTGGATCGCAGAGAATGGCGGGCGTGCAGGAATCGAGGGGGAGGATGGCGGCATTCGCGGCGACGACGGTCTCC
GAGAGCTCGGATATCCGGCCGCGGCGGCCTGGGGAGAAAAAAGGGTTTGTGGAGGAGATGAGGTTTGTGGCGATGAAGC
TCCACACCAAAGATCAGGCCAAGCAAGGCGAGAAGGAGGCCGATGTGGAGCCGGTTGGAAGCTGGAAGCCGAGCATTCG
TGGTTATATCCAGTTCCtTGTGGATAACAAGCTTGCTTCAGACAGCGCTAGAGGCTGTCGTGAACAGAGGATCGCATCCA
GCTTATGGCCAgtttcgAGAAACGGGATTAGAGAGATCGGAAGCGCTGGCGAaagatttggaatGGTTCAAGGAGCAgG
GAcACGAGATCCCAGagcCGAGCTTGGAGGGTAAATCCTACTCAGAGCTCCtagaaaCGCtTGCCgagGATGAtccgcc
AgcttTTATATGTc > SEQ ID NO:1776  130430  270544_200126_1
GAGAAGGCAGGCCTTTGCCGTACATCATCGGAACCCTATGGCGGTCTCAAGCTGTGCTAGGGCTTTTCCATCCTTTGAA
TGTCGTTCGGATGCCGAATTCTCTGGCGGTATTCCCCGCCACGACATTCCTAACTCCGGCAAGGCCAGCATTTTGAGTC
ACGGATCGTCCATTCACGGTCTGTCTTCTCTTATTTATAGGTTTCCTCCGAACTTTGTTAGGCAGTTGAGCATTAAGGC
```

FIG. 2 continued

```
TCGGAGGAACTGCAGCAACATCGGTGTGGCTCAAGTTGTGGCGGCTTCGTGGTCTAACAATAACTCATCTCCTGATTTC
ACTCCGGTGGCTAAGGCCGTCGATGCCGCCGCCATTGCTCCTGTTGATACCACGGTAGTTAATGAGGACGTGGCGCTGG
TGGAAAATGAGACTTGTAATGATCAAAATGTACTGTTTGACAGTTTGCCAAGTGTGAAATACGCTTCGTTTTTGAATTC
TGATGGGAGTGTCGCTATTCATGCCGGTGAAAGGTTGGGACGTGGCATTGTTACGGATGCAATTACTACCCCAGTAGTT
AACACATCTGCCTATTTCTTCAACAAGACTTCTGAGCTCATTGATTTTAAGGAGAAAAGACGTGCAAGTTTTGAATATG
GGCGCTATGGGAACCCAACTACT

> SEQ ID NO:1777 130430 115380_300013_1
ACAGATTCTCTGAGCTAAAATTTCCTGTCTCAGCTTCTTGTAGGGAAGGCAGAGGGCGCCGCCGGTGAAATCACACTTT
TAACCCTCAAATTCATCACAAATCCAATGGCCGTTTCAAGCTGTTCAGCTGCAGCTAGGGCATTTCCATCCTTCGAATG
CCGTTCCGATGCCGACTTCTCCGCCGGCGGCGTTCCACGTCACAACGACGTTCCAAAAAGCTCCTCCGGCGTTCGTTTC
TCCGGTAAGGCAAGCTCGTTAAATCACGGATCGCCGATTCACGGTGGCATGTCTTCTCTGATCCTTAGGTTTCCGCCAA
ACTTCGTGCGGCAACTGAGCGTCAAAGCTCGTCGGAACTGCAGCAACATCGGCGTTGCACAAGTCGTTGCGGCTTCCTG
GTCAAACAACCTCGGTTCCCCTGACTTCACTCC

> SEQ ID NO:1778 130430 130441_300487_1
gaattcgagaaactaaaaccccccaccaaaaAAAAACAAGAAAAAAAAAAATGGCCGTCTCAGCAGGATGTGCTAGGGTT
CTACCGGTTTTTGAATGTAGATCAGATCCAGATTTCTCTACAAACCAGAACCAGCAGAAATCAAGTTCCAGATTCATTT
CTGGATCTTTCAATGGTGGTGGTGGGTTATATTCATCATTGATTCTGCGGTTTCCTCCTAATTTCGTAAGGCAATTGAG
TATTAAAGCAAGAAGGAATTGTAGCAATATTGGTGTAGCACAAGTTGTTGCTGCTTCCTGGTCAAACAATGACAATACC
AACAAGAAGGTTCCTAATGTATCTGCTGTCGATTCTGCTTCTGCTGCTTCTGAGATTGAAGAAATTCCTTTGATTGATG
ATGAAGTTGTGGATGCTGGGGTTGATGGTGGTGATATTGTAATAATAATGGTGTACAGTTGTCTGGTTTGGCCGCTTT
AAAGGCCTCATTTTTACGCTCCGATGGGAGCATCACAGTTCATGCAGGAGAAAGATTAGGTCGTGGAATTGCTACAGAT
GGAATCACTACCCCAGTCGTCAATACTTCTGCTTATTGGTTCAAGAACTCCAATGAACTCATTGATTTCAAGGAGGGAC
tccataaaagcttTGAGtatGGgcgCtATGgcaacCCaaccacagtagttgcaaaaaACAAaataagcgcacTtgaggg
ggcaaaatcaaCTATtttGaTgtcgtctGGCatgtgtgctactacggtcaTGATgtttgcattggtaaagaagggtggc
cAtataataaCAACTACAgattgctacaggaagacgacaatTttcattgaTGATTttcttgttCCCAAcatgaATATAA
cggtccatgtcaTTGacCCTgccgatatGGATGGCCtgaaaTCTGCatt > SEQ ID NO:1779 130438 181187_300654_1
gaattcatgggtagtcttccaattggtaatcttgaaagcctatcaatatcttcacaaaatccactcgacccagatgaat
tCAGAAGGCAAGGTCACATGATTATTGATTTTCTTGCTGATTACTACAAAAACGTCGAGAGTTACCCTGTTAGGAGCCA
AGTTGAACCCGGGTACTTGCGTAAACGATTACCAGAATCAGCTCCAAACAATTCTGAATCCATTGAAACAATTCTTCAA
GATGTCACAAATGATATCATCCCGGGTCTAACTCATTGGCAGAGTCCAAATTACTTTGCTTACTTTCCATCAAGTGGTT
CCATTGCTGGATTTCTTGGAGAAATGCTTAGTACTGGGTTTAATGTTGTGGGATTCAATTGGATGTCTTCACCAGCTGC
AACTGAGTTAGAGAGTATTGTTATGAATTGGCTCGGCCAAATGCTTACACTTCCCAAATCTTTTCTCTTCTCGTCAGAT
GGGAGTTCAGGAGGAGGCGGGGTTTTGCAGGGGACTACCTGTGAAGCTATTTTATGTACGCTAACTGCAGCAAGAGATA
AAATGTTGAACAAAATTGGCCGAGAAAATATCAATAAGCTAGTTGTTTATGCTTCTGATCAAACTCATTGTGCACTACA
AAAAGCTGCTCAGATAGCTGGTATAAACCCAAAGAACTTCCGTGCAATCGCCACATCAAAggCTACAAACTTCGGGCTC
TCTCCCAATTCACTTCAATCAACAATCCTTGCTGATATCGAATCcggCTTagtTcCATTATTtc > SEQ ID NO:1780 130438 249025_301589_1
GTTAATAGTTCTGTGGAGATGGGGGAGGCAAGCGGTGGTCTGAAGCCAATGGACCCGGAAGAGTTTCGAAAGCATGCTC
ACGAGATGGTGGACTTCATTGCCGATTATTATCGCGATATCGAGAGCTTCCCTGTTCGCAGCCAAGTTTCTCCAGGATA
CTTGAGAACTCTGCTTCCCCGGACTGCACCAGAAGATCCCGAAAGCTTGGACGACGTTTTTGCTGATATTCAGAGCAAG
ATAATGCCGGGTGTCACACACTGGCAAAGTCCGAATTTTTTCGGGTACTATCCTTCTAACAGTAGCACGGCAGGACTCC
TGGGGGAAATGTTGAGTGCTGGACTCAACATTGTTGGATTCAGCTGGATAACTTCGCCTGCAGCAACAGAACTGGAAGC
CATTGTTCTTGACTGGCTTGCAAAGTTGCTCAAACTTCCCGAGGAGTTTTTATCTGGAGGCAAAGGTGGTGGAGTCATC
CAAGGGACTGCTAGTGAAGCAGTTGCCGTGGTGCTACTCGCTGCTAGGACTCGAGCCATTTCGGAAAACAAGAGGAAAG
GCCTGT > SEQ ID NO:1781 130492 244411_301558_1
GAGTGATTGAATGGCTGGGAACGCGACGCTGGCCGTGGCCGCTCCGGGCAGCAAATCGAGCTGCCAGAGCTCGTTCTGG
GGGCGGAATCAGGAATTTGGTCGGGTTTCTAGCGCGAGACCATCGACGAGCCAGGGGAGAGCTATCAGCTTGCAAGTCA
ATGCAACTTCAAGAGTGGATAAATTCTCGAAGAAGGATGTGATCGTGTCGCCATCTATTCTATCAGCGAATTTCTCTAA
GTTGGGAGAACAGGTGAAAGCAGTAGAAACAGCAGGCTGTGATTGGATACATGTCGATGTTATGGATGGACGGTTTGTT
CCAAATATCACAATTGGTCCTCTCGTTGTGGATGCTTTGAGACCAGTGACTGATCTTCCCCTGGACGTTCACTTGATGA
TCGTGGAGCCCGAGCAAAGAGTTCCCGATTTTGTGAAAGCGGGTGCTGATATCCTCAGTGTGCATTGTGAGAATGCGTC
CACGATTCATTTACATCGTACCATCAATCAAATTAAAGACCTTGGCTGTAAAGCTGGCGTTGTCTTGAATCCGGCCACG
```

FIG. 2 continued

CCACTGGCGGCTATCGAATACGTGCTCGAAGTTGTGGATTTGGTGCTGATCATGTCTGTGAATCCCGGCTTTGGAGGAC
AGAGCTTCATTGAGAGTCAAGTAAAGAAGATCTCTGACTTGAAGAAGTTGTGCTCTGAGaAGGGAGTTGATCCGtggat
cgaGGTTGatggtgGAGtc > SEQ ID NO:1782 130492 282224_200073_1
TTCAGAGGTTAAAAATATCGAAAATGCACGCCTCTTTTTCTCTCTCTCGACATCAGGCTATTTCTTCTAAAACCCATAA
CAAATTTCATCCTTCACACGTCGGATCAAGCAGCCGCCGAATCTATTTCTGGATTCAGACGTCTTAATCCTAAGAAAAA
CAAACGAGGCCTTAGTATTACTACTCCGAAATAAAGAGAGAGAAGCTACTTACGCCGGCACCGGACTTTAGATTGAATG
GAGAATTTAACGGCCGATAGGGAGGAGGAGAAGATGGTGAAAGCAATCATAGCACCGTCGATGTTGTCATCAGACTTCG
CTAATTTGGCATCTGAAGCACAACGCATGCTCAATTGCGGTGCTGATTGGCTTCACATGGACATCATGGACGGGTAGGT
CAGATAGTCACGTCAAGCTGGTTGTTTACAACATGTTAAAATGATGGGTGGATACCAATTGAATAATACTTTCTTTCTT
TTTTCTTTTTTCCCCCACTTGTCTCTTTTGCAGACACTTTGTACCAAACCTTACCCTTGGTGCTCCAGTTATCGAGAGT
CTGCGAAAG > SEQ ID NO:1783 130492 254083_301631_1
GAGTTATCACCTTCCTCCGGCAGTTAAGCAAGAATCTGCAGAAGGAGGTCTCTGTGTGGGTATATCCATGGCAGCAGTT
TCATCCACAGCATTGCTGAAGAGTAGCCTCTTTGGTGTCAAACCATCCCTACGCACTACTTCTCGATGCGCAACTCCAT
CTTCAAGCAAGGTGTTCATTCCAGTGGTGAAGGCATCATCCCGTGTGGACAAGTTCTCAAAGACAGATATCATTGTTTC
ACCATCTATTTTATCGGCTAACTTTGCCAAGTTAGGAGAGCAGGTGAAAGCTGTAGAAGAAGCAGGTTGTGATTGGATC
CATGTTGATGTGATGGATGGCCGTTTTGTGCCAAATATTACTATCGGCCCACTCGTGGTGGATGCATTGAGGCCGGTGA
CTGATTTGCCACTTGATGTGCACTTGATGATCGTCGAGCCCGAGCAACGTGTTCCGGACTTTATTAAGGCCGGCGCTGA
CATTGTTAGTGTGCATTGTGAGCAGTCATCCACGATTCATCTTCATCGAACAGTAAATCAGATTAAGAGCCTAGGAGCC
AAAGCAGGAGTGGTCTTGAATCCTGCCACACCCCTCAGCACTATTGAATATGTCCTAGATGTGGTTGAACTAGTCTTAA
TCATGTCAGTCAATCCTGGCTTTGGTGGGCAAAGCTTCATTGAGAGTCAAGTGAAGAAAATCTTAGACTTGAGG > SEQ ID NO:1784 130492 245105_301565_1
gaaagatggccaagattgcgccatccatggtgtcCTCGGACTTCGCCAATCTCGCAGCCGAGGCACAGCGAATGCTGGA
TTGTGGAGCGGACTGGCTACACATGGACATCATGGATTGGGTGAGGAAGGGATAGaTGCTTTGAAAACCTCTGATCTCGT
GTGATCCCGCAGGCATTTTGTTCCAAACTTGACTATTGGAGCTCCGGTGGTAAGTTCGCTGCGAAAGCATACAAGTGCT
TATTTGGATTGCCACCTTATGGTGACGAATCCACTCGACTACGTAGAGCCTCTTGCCAAGGCCGGGGCGTCTGGCTTCA
CTTTCCACATTGAAGCTTCTCGAGATAATTGGACACAAATATCAAAGAAGGTCAAGGAATGCGGCATGAAAGTTGGAAT
TTGCCTCAAGCCTGGAACTCCAGTCGAAGAGGTGTACCCTCTAGTTGACAGTGGTGATATTGATTTAGTGTTGATCATG
ACTGTCGAGCCAGGATTTGGAGGTCAGAAGTTCATGCCGGAAACAATGAGCAAGGTGAAAGCTCTTCGAGCTCGCTATC
CAAAACTAGACATCGAGGTTGATGGCGGTCTtggcCCTTCGACGATCCAGCaagccgccgatgctgGAGCAAACTGcat
cgtcgctggaagcTCGGTTtttGgaGCTCCAGaTccgg > SEQ ID NO:1785 130492 106126_300458_1
aagagggtggtTGAAATTTTAAGCTCGCTTTCAAATTGACAAAGCACCAACCTTTTCTCCTCCTCAATTCCCCAAACAA
GAGAAAGTTTGCTGCAAGAGAAAAAGAAGTAAATTTCAATGGCAACAACTGCTTCTTGTGTGGGTTCATCAACTCTGTT
ACAATCCCAAATTAATGGATTTGGCGGGAGTGTTAAGCTTCAGAAGCCCAATTCACTCACTTTCACCAGGAGGAGAGTT
CAAACAGTGGTGAAGGCTTCTTCTCGGGTGGATAAGTTTTCGAAAAGCGATATTATTGTTTCTCCATCCATCCTTTCTT
CTAACTTTTCTAAATTAGGAGAGCAGGTAAAAGCAGTTGAGCAGGCAGGCTGCGACTGGATTCATGTAGATGTGATGGA
TGGTCGATTTGTTCCAAATATAACTATTGGACCCCTTGTAGTTGATTCCTTGCGTCCTATCACTGATCTTCCATTGGAT
GTGCATCTGATGATTGTCGAACCTGACCAGAGATGACCTGATTTCATAAAAGCAGGTGCTGATATCATCAGTGTTCACT
GTGAGCAATCTTCTACCATCCACTTGCATCGTACAATAAATCagaTTAAAAGTTTGGGagcTAAAGCTGGGGTtgtccT
CAATCCTGGaaCCCCTTTaaccgcaAtTgAATATg > SEQ ID NO:1786 130492 167661_301343_1
gaattcaagaaaaacacccaccaaacttccccctgacCAACACCAAAACACCGTACAGTGAGAGAAGGAAGAATGTCTG
CAACAACAGCTTCTTTGTGTTCATCGGCAGCTACTAATCTTAAATCCCAAATCAATGGATTTGGTCTCCAGAAACTATC
TTTCTCTCCTTCCCCTACTTCTTTTACCCCCACAAGGAGGACGATGAGAACTGCTGTTAAAGCTATGTCTCGTGTTGAT
AAGTTCTCAAAAAGCGATATTATTGTCTCCCCATCTATTCTATCAGCTAACTTTGCCAAGTTGGGAGAGCAGGTGAAAG
CAGTTGAATTGGCTGGATGTGATTGGATCCATGTTGATGTGATGGATGGCCGTTTTGTGCCTAATATTACAATCGGACC
CCTTGTGGTTGATGCACTGCGCCCAGTGACCGATCTCCCACTGGATGTACATCTGATGATTGTGGAACCTGATCTACGA
GTGCCTGATTTATCAAAGCCGGAGCAGACATTATCAGTGTTCACTGCGAGCAATCTTCCACCATCCATTTGCATAGAG
CTGTTAATCAAATTAAAAGTCTTGGAGCTAAAGCCGGAGTAGTTCTGAACCCAGGCACCCCACTGGCTGCCATTGAATA
CGTACTTGATTCGGTTGATCTGGTCTTGATTATGTCTGTGAACCCTGGATTTggTgGACAGAGCTTTATAGAAAGCcaA
GTTAAAAGATCTCTGACTtgagaAAAATGTGTCttg

FIG. 2 continued

> SEQ ID NO:1787 130492 135226_300412_1
cgcgacgcctcctagccgccaccgcttcaccaaatcaaaagctctcgctgctcctcgagagggagttggtggagagaga
aAGAGAGAGAGAGAGATGGCGTCGCCGTCGTCGTCGTCGTCGCTGTGCTCGACCTTCGCCTCGCCGCGCGCCGCCTCCC
TCGGCCGCCGCCTCGCCTTCTCCTCGCCCAGGAAAGCATTCCGAGTGAGGGCATCATCCAGGGTTGACAAGTTCTCGAA
GAATGACATCATCGTGTCCCCTTCCATTCTTTCTGCAAACTTTTCCAAGCTTGGCGAGCAGGTAAAAGCTGTGGAGGTG
GCAGGATGTGACTGGATTCATGTTGATGTCATGGATGGACGTTTTGTGCCAAATATCACAATCGGACCTTTGGTTGTTG
ATGCTCTGCGGCCAGTCACTGATCTTCCGTTGGATGTGCATCTGATGATTGTGGAACCTGAGCAACGAGTTCCAGATTT
TATCAAGGCAGGTGCTGATATTGTTAGCGTTCACTGTGAGCAATCGTCAACCATCCATCTACACCGAACAGTCAATCAG
ATTAAAAGTCTTGGAGCAAAGGCTGGAGTTGTTTTGAATCCTGCAACCCCTCTCACTGCGATAGATTATGTACTTGATG
TTGctgatcTaGtaTTGATTAT > SEQ ID NO:1788 130492 122223_300017_1
CCCCCGAAATCAAAAGCTCTCGCTGCTCCTCGAGAGGGAGTTGGTGGAGAGAGAAAGAGAGAGAGAGAGAGATGGCGTCGC
CGTCGTCGTCGTCGTCGCTGTGCTCGACCTTCGCCTCGCCGCGCGCCGCCTCCCTCGGCCGCCGCCTCGCCTTCTCCTC
GCCCAGGAAAGCATTCCGAGTGAGGGCATCATCCAGGGTTGACAAGTTCTCGAAGAATGACATCATCGTGTCCCCTTCC
ATTCTTTCTGCAAACTTTTCCAAGCTTGGCGAGCAGGTAAAAGCTGTGGATGTGGCAGGATGTGACTGGATTCATGTTG
ATGTCATGGATGGACGTTTTGTGCCAAATATCACAATCGGACCTTTGGTTGTTGATGCTCTGCGGCCAGTCACTGATCT
TCCGTTGGATGTGCATCTGATGATTGTGGAACCTGAGCAACGAGTTCCAGATTTTATCAAGGCAGGTGCTGATATTGTT
AGCGTTCACTGTGAGCAATCGTCAACCATCCATCTACACCGAACAGTCAATCAGATCAAAAGTCTTGGAGCAAAGGCTG
GAGTTGTTTTGAATCCTGCAACCCCTCTCACTGCGATAGATTATGTACTTGATGTT > SEQ ID NO:1789 130492 1097847_301448_1
tctctctctctctctctctctcatccccaAGTTATCACCTTCCTCCGGCAGTTAAGCAAGAATCTGCAGAAGGAGGT
CTCTGTGTGGGTATATCCATGGCAGCAGTTTCATCCACAGCATTGCTGAAGAGTAGCCTCTTTGGTGTCAAACCATCCC
TACGCACTACTTCTCGATGCGCAACTCCATCTTCAAGCAAGGTGTTCATTCCAGTGGTGAAGGCATCATCCCGTGTGGA
CAAGTTCTCAAAGACAGATATCATTGTTTCACCATCTATTTTATCGGCTAACTTTGCCAAGTTAGGAGAGCAGGTGAAA
GCTGTAGAAGAAGCAGGTTGTGATTGGATCCATGTTGATGTGATGGATGGCCGTTTTGTGCCAAATATTACTATCGGCC
CACTCGTGGTGGATGCATTGAGGCCGGTGACTGATTGCCACTTGATGTGCACTTGATGATCGTCGAGCCCGAGCAACG
TGTTCCGGACTTTATTAAGGCCGGCGCTGACATTGTTAGTGTGCATTGTGAGCAGTCATCCACAATTCATCTTCATCGA
ACAGTAAATCAGATTAAGAGCCTACGAGCCAAAGCAGGAGTGGTCTTGAATCCTGCCACACCCCTCAGCACTATTGAAT
ATGTCctacatgtggTTGACcTagtcttaaTCATGTc > SEQ ID NO:1790 130504 168135_300553_1
TCGCTAATTTTAATAACGCCTTTAATAATGTCGCGTTTGTTGTTAACTGACTCTTCAAATGCCTGTTGTACATCCCGAT
AATCGTAAATATGCGTCACCATCGATTTCACATCGAATCGCCCTGAAGAAATAGCTTCAATCGTGACCGGATAACGATT
GGCATAGCGGAATACCGTCTGGATAGTGACTTCGCGATTGATTTTGAGGAAATTGATTGCCGAATCGCCGGGTACAGTA
CCAACAATCATAATTTTACCGCCGCGCATTACCAGATAAGGTGCCTGTTTAACGGTGACCGCAGAACCCGCTGTTTCGA
AAACAATATCTGCGCCCATGTCTTCGGTAAATTGCTGACAGCGTGCAATAGTGTCTTCTTTTGCGCCGTTAATAACCAC
TGTCGCACCAAGCTGTTCCGCCATTGCCAGACGTTTTTCCAGCACATCAACGACGGCAATTTCCGTTGCTCCCAGGCAT
TTGCACGCTTGCAACGTCATCAAACCAATACAACCTGCTCCCAGAATAATTATCTTCTTACCCGGTTTAACATCTGCCA
GCATCGCGGCATGCATCCCGACTGCGGCAGGCTCCACCAGCGCCCCTTCCATCGTGTCCATAttgTcGGGCAGTTTgta
agtaaAGctctcCGGATGAcACAGatagt > SEQ ID NO:1791 130504 263963_301376_1
gcgtttgttgttaactgactcttcaAATGCCTGTTGTACATCCCGATAATCGTAAATATGCGTCACCATCGATTTCACA
TCGAATCGCCCTGAAGAAATAGCTTCAATCGTGACCGGATAACGATTGGCATAGCGGAATACCGTCTGGATAGTGACTT
CGCGATTGATTTTGAGGAAATTGATTGCCGAATCGCCGGGTACAGTACCAACAATCATAATTTTACCGCCGCGCATTAC
CAGATAAGGTGCCTGTTTAACGGTGACCGCAGAACCCGCTGTTTCGAAAACAATATCTGCGCCCATGTCTTCGGTAAAT
TGCTGACAGCGTGCAATAGTGTCTTCTTTTGCGCCGTTAATAACCACTGTCGCACCAAGCTGTTCCGCCATTGCCAGAC
GTTTTTCCAGCACATCAACGACGGCAATTTCCGTTGCTCCCAGGCATTTGCACGCTTGCAACGTCATCAAACCAATACA
ACCTGCTCCCAGAATAATTATCTTCTTACCCGGTTTAACATCTGCCAGCATCGCGGCATGCATCCCGACTGCGGCAGGC
TCCACCAGCGCCCCTTCCATCGTGTCCATATcgtcgggCagttcgtAAGTAaagCTCTCCggaTgACACAGATAGTGCG
TTAATGCGCCGCGGTAGTTgggttGTGTCgccaTAAAatCAAcgtccgggcagaTGtt > SEQ ID NO:1792 130569 130094_300484_1
gaattcagaccacaaggaaaaatgacattgccgtaaatttacaagattccatttccatttattcatcaaaagagtactt
cCCTTTGAAGCCAGAATTGATTTTCCTTGATATCTGACATAATGCATAAAAGGATCCTTGAACAACCATAGGAAGGTCT
GAAAATCATTACTAAACACTACTACAGGATGCTCCATTTTTCCATAGAAATTTATTCGCTCAAGAAGGATTCTAAAAGA
TGTTGATCGTAAACGAAAGATTGTTTACGGAGAAAAACTAATATGGATTCGCATTCATATACATGAGAATTATATAGG

FIG. 2 continued

```
AAGAAGAAAAAGCGTTGATTCTCCTTTGAAAAAAGGGAAATTGCTTTATTTTGAGTAATAAGACTATAGCAATTACGAT
ACTCATGGAGAAAGAATCGCAATAAATGCAAAGAGGGAACATCTTGTATCCAAGAGCGTAGGATTTGAACCAAGATTTC
CAGATGGACAGGGTAGGGTATTAGTATATCTGACACATGAGTTAAATGTGATAATTTATCCTCTAAAAAAGGAAATATT
GAATGAATAGATCGTAAATTATGAGATTTTTTTATATCCTTTCCTTCTAGAAAAGATACTAATCGTAGTGAAAATGGAA
TTTCTACTATGACTGAAAGCCCCTCAGATATTATTTGATAATAAACATTTGGGTTGTGCGCAAAAAATTTTTTTTGTTT
AGCAACATTTGTCGAAATCATCAAATTAAAATGTTTCTGTTGATACATTTGAGTAATTAAACGTTTCACAAGCAGTGAA
CTGAATTTATTATCATAACCTACATTTTTCACGGATTCATAAAGAATTGATCCATTTAAACCATGATCATGAGCAAGTG
CATAAATATACTCCTGAAAAAGAAGTGGAtataggaagtcttgttgccgagatctatctattttgaatatgcccccaa
ttccttcatttaaaattcgatttggaattc > SEQ ID NO:1793 130646 170495_300533_1
cccacgcgtccgcgttcggggtagatagcccgcttcctcctctctctcagatcaccacacctcgagtcgccgccgcc
gCCGCCGCTGCTGCTGCTTACCTCCTCCGCGCCGCGCACTCCTTGCACTAGCCCATGGCGACGGCTATGATGGCTGCGA
CCGCCACCTCGTGCTCCCCTCGCCGCGCGCCGGTCGTCGCGTCGTCGTCCGTGCAGCCGCCCAGGCGGCAGCAGCAGCA
GCAACCGCGGAGGGGATTGAAGCAGCTGCCGGGGCTCGTGGCGACGGCGGCCGTGGCCGTGGCCGGCGCCGCTACCG
GCGCTGGCGGAGCAGATGGAGAAGGCGGCGCTGTTCGACTTCAACCTGACGCTCCCGCTGATCGCGACCGAGTTCCTGC
TGCTGATGGTGGCGCTGGACAAGCTCTACTTCACGCCGCTGGGCAAGTTCATGGACGAGCGCGACGCCAAGATCCGTGC
CGAGCTCGGCGGCGTCAAGGACGCGTCCGAGGAGGTGCGGcagCTGGAGGAGCAGGCCGCCGCCGTGCTGAAGGCGGCA
CGCGCCGAGATCGCCGCGGCGCtcaacaaGATGAAgaaggaGACCACccaggagctggagg > SEQ ID NO:1794 130646 182402_300710_1
gaattcGAAGGAGAAAAACCAGAAACTGGTTTCATCATAGTGATGGCAAACATGATCATGGCTTCCTCATCCAAAACCC
TAATCACATCTCCTTCAATCCAATCAACACCAAAATTCCAACTTCCCCAATTCACAACCCTAAGAATCAGAAGCCAAGC
CAATCAAACCAGCACCAGCAGCAACAAAATCAAACTCCCAACTCTAAACCTAAACTCACTCAAATCAACAGCAGCAATT
GCAGCAGCAGTTCTAACAATGGCTCCACCATCACTAGCAGCAGAAATTGAGAAAGCAGCATTGTTTGATTTCAATCTCA
CTCTACCACTAATCATGGCAGAATTTCTCATACTTATGTTTGCTCTAGACAAGATTTACTACACTCCATTGGGTAACTT
TATGGATGCAAGAGATGCAGATATTAGAGGGAAATTGAACAGTGTTAAAGATACATCTAGTGAAGTCAAGGAATTGGAT
GAACAAGCTGCTGCTATCATGAGAGCAGCTAGAGCTGAAATTGCAGCCGCTTTGAACCAGATGAAGAAAGAAACAACTG
TGGAGGTTGAAGCACAGATGGCAGAaggAAGGAAGAAATTGGAAGCTGAATTGGCTGAAGCTCTTGGTAATTTGGAGAa
CcagaaggaggAAACTATTAAAGCTCTtgattCTCaa > SEQ ID NO:1795 130646 198996_300647_1
GTCGAGGCACGCGTCCGCGGACGCGTGGGCCGCCGCCGCCGCTGCTGCTGCTTACCTCCTCCGCGCCGCGCACTCCTTG
CACTAGCCCATGGCGACGGCTATGATGGCTGCGACCGCCACCTCGTGCTCCCCTCGCCGCGCGCCGGTCGTCGCGTCGT
CGTCCGTGCAGCCGCCCAGGCGGCAGCAGCAGCAGCAACCGCGGAGGGGATTGAAGCAGCTGCCGGGGCTCGTGGCGAC
GGCGGCCGTGGCCGTGGCCGCGGCGCCGCTACCGGCGCTGGCGGANCANATGGAGAAGGCGGCGCTGTTCGATTTCAAC
CTGACGCTCCCGCTGATCGCGACCGAGTTCCTGCTGCTGATGGTGGCGCTGGACAAGCTCTACTTCACGCCGCTGGGCA
AGTTCATGGACGAGCGCGACGCCAAGATCCGTGCCGAGCTCGGCGGCGTCAAGGACGCGTCCGAGGAGGTGCGGCAGCT
GGAGGAGCAGGCCGCCGCCGTGCTGAAGGCGGCACGCGCCGAGATCGCCGCGGCGCTCAACAAGATG > SEQ ID NO:1796 130646 243419_301339_1
ACCAGTGGATGGCGGCGGCTATGGCGACTTGCAGTGCCGGAGCTCTGGTCGTGCGCTCGGCATCACTTCCATGCAAGGG
GGGGTTGCCGTCGAGCAGCAAAGCCAAGGTTGGTTTTCTCACTAAACTGGGGAGAGCCCTGGACAGTGGTGCGTTGCGG
AACGCAGCATTCGGGGCGCTGAACCTGGCGACGCTGAGCTTGCCCGCAGCTTTGGCACTGGCTGCCGAGGAGGAGAAGA
AGGAGCCCGGGAAGCTGTTCGACTTCGACGCCACCTTGCCCATAATTGTGGCCGAGTTCCTGTTTCTCATGGTCGCTCT
GGACAAGATCTGGTTCACGCCTGTCGGCAAGATCATGGACGAGCAGCGGGACGAGATGATCCGGAACAAGCTCGAGAGCGTC
AAGGACAACTCGGAGGAGATAAAGAAGCTCCAGGACGAGGCCGAGGCGCTGATTCAGGCGGCTCGAGCCGAGACCACCG
CCGCGTTGAACAAGATGAAGAAGGAGACGGCCGCGGAGCTGGAGGCAAAGTTGCAACAGTCGAGGGAGAGGATcGAGCA
GGAGCTGGCCCAAGCGCTTGCCAACTTGgAAGAGCAAAAtcaggaGACGCTCaagagcCTggAGc > SEQ ID NO:1797 130653 167394_300546_1
GAATTCCACCAGAAAAATGAACTCCCAACTGAGAGAATCATATGCTTGAGTGATATCAATCTTTAAACCCATATTGCCC
CCTCTTCTCTTGTAATCAAGCTCATTGACTAACTCAGAAGCCATAACAATTTTTTCCTGAATATTTCCCCCCTTAATAA
AAGCACCTTGATTTGGGGACACCACTTTCTTAATCATTTCAGTCAATCTTAATGTTATAATCTTTGTGAAAACTTTAAA
ACTAAAATTCATCAAGCCAATGGGTCTAAATTGTTTTGCTTTTCTTGCATTCTTAACTTTAGGCAGTAAAAGAAGAAAA
TTAGCATTCAAACCATTAGGAATGAAACCTTTACTCCACCAAAATTAAATTGCTCTGATGAAGTCAAAGCTAATTATAT
CCCAAACTTCTCTATAAAACCATCCATCAAAACCATCTGGACCAGGAGCACTCTCTGGATTCAAGTCAAATACAGCTTC
TTTAATTTCCTCTGCACTTGGAGTAGCTTCAAGAAGAATATTATCCTCCTCAGAAATTACATTAGGGATATCTTGAAAC
AAATTTTCTTCAA
```

FIG. 2 continued

> SEQ ID NO:1798 130653 181263_300695_1
GAATTCTCACCCCGTGGACGTAGGTAATCATGTTGAACCACGTAAATCCTTGTGTTCATGTTTGATTCTATTACTTTTG
TTTAGTGTTTGCATGTTCTTTACCTTTGGATGTAGTTTGTAGATTTTTGCAACTACATAAAGCACCGGGGCCAGATGGT
TTTACTGCTGAATTTTTCAAGAGTTGCTGGAGCACTTTAAAGGAAGATTTCATGGGGTTAGTTAATGACTTCCACAGGT
TTGGTTCAATAGATTGGCGCTTTAATTGTTCTTTCATCACTCTCATCCCAAAAAAGGAGGACCCTTGCACTCCAAAAGA
CTATAGGCCATTAAGTATTATTGGTATGGTGTATAAGATTATCTCAAAGCTTCTCGCAGTTTGGTTGAAGACGATGATT
CCAAGGTTGGTATCTGATTTTCAGGGGGCTTTTATTCATGGCAAGCAAATCCTAGAATAATTGCAAACGAATGTGTCGA
TAGCAGACTGAGGGCTAGGAAGCCTGGTATATTGTGCAAGATTGATATGGAGAAAGCTTTTGATAATGTTAAATTGGGA
ATGCTTTGTGCACAATCTTGCAGAAGCATGACTTTGGA

> SEQ ID NO:1799 130680 135058_300421_1
GCACCTGCACGTACTAGGGGACGACGGCCGCCGGTGTGGACTGCGGCGGCGGCCACCGCAGCAGCGCCGGCGGACACGG
CGGCGTCGGCGCGGCGGGAGCAGGTGGAGATCGCCCGGTCGCTGAACGCGTGGGTGGAGGAGAACATGCTCCCGCTGCT
CACCCCCGTCGACTCCGCGTGGCAGCCGCACGACTTCCTTCCCTGCTCGGCCGCGGGCGGCGGCGAGGCGCTGGCGGCG
TTCACGGAGGGCGTGGCCGAGCTGCGCGCGGGCGCCGCCGGCGTGCCGGACGAGGTGCTGGTCTGCCTCGTGGGGAACA
TGGTGACGGAGGAGGCGCTCCCGACGTACCAGAGCATGGGCAACCGCGCCGAGGGCCTCGCCGACGGCACCGGCGTGAG
CCCCCTCCCCTGGGCGCGCTGGCTCCGCGGCTGGACCGCCGAGGAGAACCGCCACGGCGACCTCCTCAACCGCTACCTC
TACCTCTCCGGCCGCGTCGACATGCGCCAGGTCGAGGCCACCGTGCACCGCCTCCTCCGCAACGGCATGGAGATGCTGG
CGCCGGCGAGCCCGTACCAC

> SEQ ID NO:1800 130680 197815_300701_1
AAAGAAAGCCAATGGCGTCTTCAGGCCTCGCAGTTGCAGCAACAGCCTCGTCAGCCTGGCTCTGCTGCCCCAATCATCA
CATCCATACCAGCAGCAGCAGATCTCGCAAGCATCTTCTTCTCCATGGCCTGTACGGGGACGACGGCCGCCGGTGTGG
ACTGCGGCGGCGGCCACCGCAGCAGCGCCGGCGGACACGGCGGCGTCGGCGCGGCGGGAGCAGGTGGAGATCGCCCGGT
CGCTGAACGCGTGGGTGGAGGAGAACATGCTCCCGCTGCTCACCCCCGTCGACTCCGCGTGGCAGCCGCACGACTTCCT
TCCCTGCTCGGCCGCGGGCGGCGGCGAGGCGCTGGCGGCGTTCACGGAGGGCGTGGCCGAGCTGCGCGCGGGCGCCGCC
GGCGTGCCGGACGAGGTGCTGGTCTGCCTCGTGGGGAACATGGTGACGGAGGAGGCGCTCCCGACGTACCAGAGCATGG
GCAACCGCGCCGAGGGCCTCGCCGACGGCACCGGCGTGAGCCCCCTCCCCTGGGCGCGCTGGCTCCGCGGCTGGACCGC
CGAGGAGAACCGCCACGGCGACCTCCTCAACCGCTACCTCTACCTCTCCGGACGCGTCGACATGCGC

> SEQ ID NO:1801 130680 257645_301684_1
gggtgggcttcggatCGCTCGACCTCCTCGCAGCTCTCCAGCAATGGCCGCCGTCGCCAACGTTTGCGGGATGCCTATG
AGGAGCGCATTCGTTCCATGCCACGAAATCCACCTCGTCAAGCCGCCGGTTGTCTCCATCACTTCGGTGAGGAGCTCCA
GATTTCCCGGAATCGCCATGACTGCTACGGCTCCAGCAACGGAGAACATTGCAAAGCAAGTCAGCAAGCCTTCCCAAAT
CATGCATTCTCTTTCTCCGGAGAAGGTCGAGATGTTTAAGTCTCTCGAGAGCTGGGCCGAGGAAGCGATCCTTCCATTC
CTGCGGCCAGTGGAGAAATGCTGGCAACCTCAGGACTACCTCCCGGAGCCGTCCTCGGAGAGCTTCTACGACGAGGTTC
GCGAGCTGAGGAAGCGGGCCGAGTGCCTGCCCGACGACTACTTCGTCTGCCTCGTCGGGGACATGATCACCGAGGAAGC
TCTGCCGACTTACTTGACAATGCTCAACACTCTGGACGGCTCCCGAGACGAGACCGGCGCGAGTCAGAGTCCCTGGGCC
GTCTggGGACGTGCTTGGACGGCAGAGGAgaaccgTCATGGCGACCTGCTCAACAAGTATCTCTACCTCACTGGACGCG
TCGAT > SEQ ID NO:1802 130712 258070_301688_1
GCGTTTGCGCTATTATAGTCAGTGTCGCCAAAGTTTGTGCGATCTCTCCTCCTCAGGCGCCGGAACAATGTCGAACCTC
AACGATTTGCTCAACCTCGACATCACTGACACCAAAGAGATCATCGCCGAGTACATATGGATTGGGGGGTCGGGTATGG
ACCTCCGGAGCAAGGGCCGGACTCTGAAGGGCCCAATTACCGATCCCTAGAAGCTCCCGAAATGGAACTATGATGGTTC
CAGCACTGGACAGGCTCCTGGCGAGGATAGCGAGGTCATACTATATCCGCAGGCAATTTTCAGGGATCCGTTCAGGAAA
GGAGACAACATATTGGTTATCTGCGACACTTACACTCCAAAGGGAGAGCCACTCCCCTCGAACAAGCGAGCCAAAGCCG
AGGCGATTTTCAGTCAGAAGGCAGTGAGTGACGAAGTTCCCTGGTATGGAATCGAGCAAGAGTACACATTGCTCCAGCG
GGAGGTCAAGTGGCCTCTGGGATGGCCGATTGGTGGCTATCCCGGCCCCAGGGACCGTACTATTGCGGAACCGGAGCT
GAGAAAGCTTGGGGAGAGATATTGTGAATGCTCACTACAAAGCATGCATCTATGCCGGCGTCCAGATCAGTGGTATCA
ACGGCGAAGTCATGCCAGGCCAGTGGGAATACCAAGTCGGTCCCGCTGTTGGAATTTCCGCTGGTGACC > SEQ ID NO:1803 130712 263909_301376_1
CTTCTCTCACCGATCTCGTCAACCTCACTCTCCGACACCACGGAGAAGATCATCGCCGAGTACATATGGATCGGTGGAT
CTGGCATGGATCTCAGGAGCAAGGCTAGGACTCTCTCCGGCCCTGTGACTGATCCCAGCAAGCTGCCCAAGTGGAACTA
CGATGGCTCCAGCACCGGCCAGGCCCCCGGCGAGGACAGTGAGGTCATCCTGTACCCACAGGCTATCTTCAAGGACCCA
TTCAGGAAGGGAAACAACATCCTTGTCATGTGCGATTGCTACACGCCAGCCGGAGAACCGATCCCCACCAACAAGAGGC
ACAATGCTGCCAAGATCTTCAGCTCCCCTGAGGTTGCTTCTGAGGAGCCCTGGTACGGTATTGAGCAAGAGTACACCCT

FIG. 2 continued

CCTCCAGAAGGACATCAACTGGCCCCTTGGCTGGCCTGTTGGTGGCTTCCCTGGTCCTCAGGGTCCTTACTACTGTGGT
ATCGGTGCTGACAAGTCTTTTGGGCGTGATATTGTTGACTCCCACTACAAGGCTTGCCTCTATGCCGGCATCAACATCA
GTGGAATCAACGGCGAGGTCATGCCAGGACAGTGGGAGTTCCAAGTTGGCCCGTCTGTCGGCATTTCTGCCGGTGATCA
GGTGTGGGTTGCTCGCTACATTCTTGAGAGGATCACCGAGATCGCCGGAGTCGTCGTCTCATTTGACCCCAAGCCCATC
CCGGGAGACTGGAACGGTGCTGGTGCTCACACCAACTACAGCACCAAGTCGATGAGGAACGATGGTGGCTACGAGATCA
TCAAGTCCGCCATTGAGAAGCTCAAGCTCAGGCACAAGGAGCACATCTCCGCCTACGGCGAGGGCAACGAGCGCCGGCT
CACCGGCAGGCACGAGACCGCCGACATCAACACCTTCAGCTGGGGAGTTGCCAACCGCGGCGCCTCGGTCCGCGTCGGC
CGGGAGACGGAGCAGAACGGCAAGGGCTACTTCGAGGATCGCCGGCCGGCGTCCAACATGGACCCTTACGTCGTCACCT
CCATGATCGCCGAGACCACCATCATCTGGAAGCCCTGAAGCGGCTTTTTGACGCCACGACATCCTCGTCATCGTCCTCC
CCAGCTCGCCGTGTCGCTCCGGTTGCTCCATTGATCGGACGATCTGGTGAAttgCATtggtgctGGGagaagTAAAAAA
AAAAAAgggaaggagAAAAAAAAAAa > SEQ ID NO:1804 130712 275356_200155_1
ATTGatcagAGAATTGTTAGGCTTCTATTTTCATTATGTCTCTGCTTTCAGATCTTATCAACCTCAATCTCTCTGATTC
TACCAAGAAAATCATCGCTGAATACATATGGATCGGTGGATCAGGCATGGACATAAGGAGCAAGGCCAGGACTCTTGAT
GGTCCTGTTACTGATCCTTCAGAACTACCCAAATGGAACTATGATGGATCTAGCACAGGTCAAGCTCCCGGAGAACGATA
GTGAAGTGATCTTATACCCACAAGCTATCTTTAAGGATCCATTCAGAAGAGGCAACAATATCTTGGTCATGTGTGATGC
GTATACTCCTTCTGGTGAGCCTATCCCAACAAACAAGAGGCATGCTGCTGCCAAGATCTTCAGCAACCCTGATGTTGTT
GCTGAGGAACCATGGTATGGTATTGAGCAAGAATACACCTTGTTGCAAAGGGATATTAACTGGCCTCTGGGCTGGCCTA
TTGGAGGCTTCCCTGGACCTCAGGGACCCATACTACTGTGGAACCGGAGCTGATAAGGCCTTTGGACGTGATATTGTGA
CTCCCATTACAAGGCTTGTCTTTATGCTGGGATTAACATCAGTGGTATCAATGGAGAAGTCATGCCCGGACAGTGGGAA
TTCCAAGTTGGACCTTCTGTTGGCATTTCAGCCGGTGATGAAGTGTGGGTAGCTCGTTACATTCTTGAGAGGATTGCGG
AGATTGCTGGAGTGGTTGTGTCATTTGACCCCAAGCCTATTCCGGGCGATTGGAACGGTGCAGGTGCTCACACAAACTA
CAGCACCAAGTCGATGAGGGAAGATGGAGGCTATGAAGTCATTTTGAAGGCTATTGAGAAGCTTGGCCTGAAGCACAAA
GAGCACATTGCTGCATATGGTGAAGGCAATGAGCGTCGTCTCACTGGAAAGCACGAAACAGCCAACATCAGCACCTTCA
ATGGGGGGTTGCAAACCGCGGTGCATCTGTCCGTGTAGGACGGGACACAGAGAAGGCGGGCAAGGGATACTTTGAGGA
CAGAAGGCCAGCTTCAAATATGGACCCATACGTCGTTACTgcCATGATCGCAGACACCACGATCATCGGGAAACCTTGA
AGCTTTTTAGTATGAATTGCTTGTTTCTGGTTTGCACAATTTGGGATAGAAAAGGATTGATTTATGAAACAGCCCTTTC
GCTTCGCCTGTGTCTTTAGTTAGgGtagttTGgtcTTttggtaTTTTTCTTTTaTtccagttGaagttgtaTTTTCATA
caGCaaggctGatttCAttgcctATGattTggCaatggtatta > SEQ ID NO:1805 130712 137754_300686_1
CCCGGCGAGGACAGCGAAGTGATCCTCTACCCTCAAGCCATTTTCAAGGACCCGTTCAGGAGGGGCGACAACATCCTTG
TGATGTGCGACTGCTACACGCCACAAGGTGAGCCAATCCCCACTAACAAGAGGCACAGTGCCGCCAAGATCTTCAGCCA
CCCTGATGTTGTTGCTGAGGTGCCATGGTACGGTATTGAGCAGGAGTACACACTCCTTCAAAAGGATGTGAACTGGCCC
CTTGGCTGGCCAGTTGGTGGCTTCCCTGGCCCACAGGGACCATACTACTGCGCTGCCGGTGCCGAAAAGGCGTTCGGCC
GCGACATCGTGGACGCCCACTACAAGGCCTGCATCTACGCCGGGATCAACATCAGTGGCATCAACGGGGAAGTCATGCC
CGGCCAGTGGGAGTTCCAAGTTGGCCCGTCAGTTGGCATCGCCGCTGCTGACCAAGTGTGGGTTGCCCGCTACATCCTC
GAGAGGGTCACAGAGGTGGCCGGAGTCGTGCTCTCCCTTGACCCGAAGCCGATCCCGGGTGACTGGAATGGCGCTGGTG
CCCACACCAACTTCAGCACCAAGTCGATGAGGGAGCCGGGAGGCTA > SEQ ID NO:1806 130712 200237_300757_1
gcATTGCATTCCATTTGATTGCTTCATTTTCAGTCCATTTGTTGGTCTTTTCTGAAATACCCATATACCGGTGTACACC
CGTATATATACAGCTGGTTGAACTGCACTCCGCTCGCATTCAATCTTCCCCACTACATCATCACATTTCTTCTTTCTCC
CACAAACAACATCACACACAACCGTCATCATGGCCAACCGAGAAATTCTGTCGTCTCGAACCGAGACTCTCAACAAGTA
CCTGAAGCTCGACCAGAAGGGCAAGATCATGGCCGAGTATGTCTGGATCGATTCTACCGGCGAGACTCGATCAAAATCC
AGGACGCTCCCTGAGCTCAAGGACAAGGAATACACCCCCGAGGATCTGCCCGTCTGGAACTTTGACGGCTCTTCAACTG
GCCAGGCTCCTGGTCACGATTCCGATGTCTACCTGCGCCCTGCCGCCGTCTACCCCGATCCTTTCCGTGGCTCTCCCAA
CATCATCGTCCTCGCCGAGTGCTGGAACGCCGACGGCACTCCCAACAAGTACAACTACCGCCATGAGTGCGCCAAGGTC
ATGGAGGCCAACGCTGCTCTCGAGCCCTGGTTCGGTCTCGAGCAGGAGTACACTTTCCTCGACCACGATGACAGGCCCT
ATGGCTGGCCCGTTGGCGGTTTCCCTGCTCCTCAGGGTCCCTACTACTGCGGTGTAGGTAGCGGCAAGGTCGTCCTCCG
TGACGTCGTCGAGGCCCACTACAAGGCCTGCATGTATGCTGGCATCAACATCTCCGGTACCAACGCCGAGGTTCTCTCA
AGTCAGTGGGAGTTCCAGGTCGGCCCTTGCGTCGGCATCAACATGGGTGACGAGCTCTGGATCGCCCGTTTCTTCCTTG
CCCGCATCGCCGAGGACTTTGGCGTCAAGATCTCCCTGCACCCCAAGCCCATCAAGgGTGCTTGGAACGGCAGCGGTCT
GCACTCCAACTTCTCCACCAACCAGATGCGTGAGgAg > SEQ ID NO:1807 130712 167987_300552_1
gaattcaaacagagagctagatagataattggcattgttaattCATCATATTCATTCGTCAAATATGTCTCTTCTAACA
GATCTTATCAACTTAGATCTCTCAGACAAAACTGAGAAGATCATCGCTGAATACATATGGATCGGTGGATCTGGTATGG

FIG. 2 continued

ACCTTCGAAGCAAAGGAAGGACATTACCTGGACCTGTTAGTGATCCTTCAAAGCTACCAAAATGGAACTACGATGGTTC
TAGCACTGGACAAGCTCCAGGAGAAGATAGTGAAGTCATCCTATATCCTCAGGCTATCTTCAAAGACCCATTCAGGAGG
GGAAACAACATTCTTGTTATGTGTGATGCTTACACTCCACAAGGAGAACCAATCCCAACTAACAAGAGATGCGCTGCTG
CAAAGATCTTCAGCAATCCTATTGTTGAGAAGAAGTTCCATGGTACGGAATTGAGCAAGAATACACCCTCTTGCAGAA
GGATATTAACTGGCCTCTTGGATGGCCCCAGGGAGGCTTTCCTGGACCACAGGGACCTTACTACTGCgGTACTGGTGCG
GACAAGGCATTCGGACGTGACATTGTTGATGCCCATTACAAAGCCTGTCTCTATGca

> SEQ ID NO:1808  130722 167865_300551_1
GAATTCAACAACGCAACAATGGCGTCCTCAGGGGGAGCTCCAAGAGCCACAACTTTTTCCTCAAAAACTCTAATTAATC
TCTGCAGAAGAGTACCAATTTTCCTTCCACGTAGATCATTTCATTCCTCTACTCAATTCCAAACCCTAAAATTCATTCC
CAATACTTACAGAGAACGTCGTTTCAGTGTAAGAGCTGAGACTCCATCAGAAAACGGTGGTGTAAATTACGATTATGAC
CTATTTACAATCGGTGCTGGTAGTGGTGGTGTTCGTGCTTCTCGTTTCGCTTCTAATTTTGGTGCTTCTGTTGCTGTCT
GTGAGCTCCCTTTTAACACTATCTCTTCTGATACTGCTGGTGGCGTTGGTGGAACGTGTGTACTTCGTGGGTGTGTACC
AAAGAAATTGCTCGTCTACGCCTCCAAATATTCACATGATTTTGATGATAGTTGTGGGTTTGGTTGGAAGTATGAAACG
GACCCAGTTCATGATTGGGGAACATTGATGGCTAATAAGAATGCTGAGTTACAGCGTCTTACAGGGATCTACAAGAATA
TCTTGAAAAATGCTAAT

> SEQ ID NO:1809  130792 1115755_301911_1
TCTTGCTTTGGATATACACTTTGTGGAGTTAATCTGTTTCTCATAGAATAGAAGAAGATGGATCAATCCTCATCAATGG
TTCGCCTGGCTCGCTTTGCTGCCCATCTGGCTCCTCCCTTGAATGAAGGCGGAAGAGCAGTTCATATGGAGAGTTGCCG
AGCGAAGGGTGCAGCACCTGGCTTCAAGGTTGCTGTGCTTGGGGCTTCGGGTGGCATTGGGCAGCCTCTTTCCCTTTTG
CTCAAGATGAACCCCTTAGTTTCTGTGCTCCATCTTTATGATGTTGTCAATACACTCGGAGTGACTGCCGATATAAGCC
ACATGGATACTAGCACAGTGGTACGTGGCTTTGTTGGGAAAGATCAATTGGAGGCTGCTTTAGAGGGCATGGAGCTTGT
TGTAATTCCAGCTGGTATTCCACGGAAACCAGGGATGACTAGAGATGATCTATTCAAGATCAATGCGGGCATTGTGCGC
ACACTTTGTGAAGGAATTGCCAAATGTTGCCCGAATGCTATAGTGCATATCATTAGTAATCCGGTAAATTCCACAGTTC
CAATTGCAGCTGAGGTTTTCAAGAAGGCTGGAACATACAATCCAAGACGGCTTATGGGTGTTACCCATCTTGATGTGGT
GCGAGCAAACACCTTTGCGGCAGaGGTTATGGgagTTGATCCAAAACTTGTCACTGTTCCTGTCGTTGGAggACATGCT
GGCATAACcAtTTTGCCACTCCTTTCTCagaTTaagCCTGCTTTTTCCTTTACcaagGAGgagaCTGAAtTTTTAACAA
ACAGGAtTcagaatGGAgGGAcGGAGgTagTTGAGGCAAAaGCAGGCACAGGCTCagCGACATTGTCAATGGCCTATGg
agcTGCTAagtTTgcagagtattGTTtacaTGCCATGTGTGGtgaagcCGGTAtTTTgGTCTCTGcccAtGttGCTTca
cagGtGac > SEQ ID NO:1810  130792 114404_300008_1
CTTTTCCTAATTCTTCCGACCCCTCCATTTCCCTTTCCAGCTCCGCCGTATTTTTCTATTAGGGTGCGACATGGCAGC
AACATCAGCAACTACTTTCTCAGTTGGCTCAGCCACATCTCTGGGCTGCAAAGGAAGCTCAGTATCGCAATCAAAAGCC
ATTGGTGTGAAATTCAACTCCAAAAACAACCTTAGAAGTTTCAGCGGTTTGAAGGCTGCCACAACTGTAAGCTGTGAAT
CAGAATCGTCCTTTTTAGGAAAAGAAAGTGTTGCCGTCCTTAAACAATCTATTACTCCAAAGGCTCAAAAAGAAAACAA
GGTATGTGGGAACTGTGTTCAGCCTCAAGCATCTTACAAAGTAGCCGTTCTTGGAGCGAGCGGCCGGTATAGGCCAGCCC
CTGTCTCTTCTGGTCAAGATGTCACCGTTAGTTTCAGAGCTGAACCTTTATGATATAGCTAATGTTAAAGGAGTTGCGG
CTGATCTCAGTCACTGCAACACTCCCTCCAAGGTTTCAGATTTCACTGGAGCTTCTGAATTGGCCAACTGTTTGAAAGG
TGTAAATGTGGTGGTCATACCTGCTGGTGTTCCAAGAAAGCCAGGTATGACACGTGATGACCTGTTCAACA > SEQ ID NO:1811  130792 14391_300244_1
cccacgcgtccgaaaccagggatgacccgcgatgatctgtttaaaatcaatgctgggattgttaaaacactatgtgaag
gTGTAGCAAAATGTTGTCCTAATGCTATTGTCAACTTGATCAGCAACCCTGTGAACTCTACTGTCCCCATTGCCGCTGA
GGTTTTCAAGAAAGCTGGAACTTATGATCCTAAGAAGCTCCTTGGAGTTACTACACTCGATGTTGCTCGTGCCAACACA
TTTGTGGCAGAAGTTCTTggCCTTGATCCAAGAGAAGTCGATGTGCCAGTAGTTGGGGGACACGCCGGAGTCACAATCt
t > SEQ ID NO:1812  130792 1905_300334_1
AATTCGGCACCAGCAGACTTTCTCCATTTCAATTCATTAACTATTCCGAATGACTTTATCCATGTTGAGATCTGTCGTC
CGGAGGACCAACTTCAGGCGCGTCTCGCCTCACGCGCCGCCAATTCTCATCGAGGGCCGCACCGGAGAGGAAAGTCG
CAATTTTGGGAGCAGCGGGAGGAATCGGACAGCCTCTTTCACTTCTGATGAAGTTGAATCCTTTGGTATCAACGCTTTC
ACTCTACGATATTGCCGACACTCCTGGTGTTGCCGCTGATGTTAGCCACATCAATACCAGATCTCAGGTTGCTGGGTTT
GCAGGAGAAGACCAGCTAGGGAAGGCTCTGGAAGGGTCTGACGTGGTCATCATTCCTGCTGGTGTGCCCCGCAAACCGG
GTATGACCCGTGATGATCTGTTCAACATTAACGCTGGTATTGTTAAATCATTATGCACAGCTATCACAAAGTATTGCCC
CAATGCCCTTGTCAATATGATCAGCAACCCT

FIG. 2 continued

> SEQ ID NO:1813 130792 195716_300637_1
CCTGCTCTCCACCAACCGCCCCAATCGCCTCTGTCCTTGGATCAATTCCTCGCATCTCTCTTTAGATCATCATGTTGGC
TTCCAGAATCCAGCGCAGGGCCTTCTCTGCCTCTGCCCGCAACCTGTCCAAGGTTGCCGTCCTCGGTGCTGCCGGTGGC
ATTGGCCAGCCTCTCTCTCTCCTCCTCAAGCTCAACACCCGTGTCACCGAGCTTGCTCTGTACGATATCCGTGGCGGAC
CTGGTGTCGCCGCTGACATCTCCCACGTCAACACCAAGTCCACCGTCAAGGGCTATGAGGCCACCCCCAGCGGCCTTGC
TGCCGCCCTCAAGGGCTCCGACATCGTCCTGATTCCCGCTGGTGTCCCCCGTAAGCCCGGCATGACCCGTGACGATCTC
TTCAACACCAACGCCTCCATCGTCCGCGACCTGGCCAAGGCTGTTGCCGAGTCCGCCCCCGAGGCCAAGCTCCTCATCA
TCTCCAACCCCGTCAACTCCACCGTCCCCATCTGCGCCGAGGTCTTCAAGGCCCGCGGTGTCTACAACCCCAAGAAGCT
CTTCGGTGTCACCACCCTCGACGTTGTCCGA

> SEQ ID NO:1814 130792 193680_300741_1
cccccgaccgagtcagatctcgagcgccgcagaggagagcggcAATGAGGCCGTCGCTGATGAGATCCGCCTCGCAGG
TCCTCCGCCGCCGCCGGCTACTCCTCCGCCTCCGGCCAGCCGGAGCGGAAGGTCGCCATCCTCGGCGCGGCCGGGGG
CaTCGGGCAGCCGCTCTCCCTCCTCATGAAGCTGAACCCGCTCGTCTCCTCCCTCTCCCTCTACGATATCGCCGGCACC
CCCGGCGTCGCCGCCGACGTCTCCCACATCAACGCCCCGGCCCAGGTGAAGGGGTTCATGGGGGATGACCAGCTCGGGG
AGGCgTTGGAGGGGTCggACATCgtgatCATCCCGgccGgCGTGCCGAGgAAGCCCGGCaTgacCAGGGacGACCTCTT
CAACATCAACgCCGgcaTCgttaAGAACCCTCTGCaccgccattgccaagtaCTgccCGAATgctCtTGTCAACaTGATC
AgcaacccagtgAAttcaacGgtcCCaa > SEQ ID NO:1815 130792 157311_301737_1
aactcctcgaaactcacgaatctatcgccaataaatgctctcctcatcttcccctctttgaacattttcattttcgact
cACATTTTCTCCGCCGTAGCATTTTCCTTTTCCTTTTCTTTGTTCATCACAAACCAACCAATTATTCAACCATGTTGAG
ATCTATTGCCCGCAGAACCTCGACCACCGGTGCATATCTCACGCGCCGCGGATTCGCGTCGGAGTCCGCTGCTGACCGG
AAAGTAGCAATTTTAGGGGCAGCTGGTGGGATCGGGCAGCCTCTATCACTTCTTATGAAGTTGAATCCTTTAGTATCAC
AACTCTCACTTTACGATATTGCCGGTACCCCTGGTGTTGCCGCTGATGTCAGCCACATCAACACCAGGTCTCAGGTTTC
TGGGTTTGCAGGAGACGAACAGCTAGGACAGGCTTTGGAGGGAGCTGATGTTGTCATCATTCCTGCTGGTGTGCCACGA
AAGCCTGGTATGACCCGTGATGATCTGTTCAACATTAATGCTGGTATTGTTAAATCTCTTTGCACAGCCATCGCAAAGT
ATTGCCCTCATGCGCTTGTCAATATGATCAGCAACCCTGTTAACTCCACTGTCCCAATTGCCGCTGAGGTTTTCAAGAA
GGCTGGAACCTATGATGAAAAGAGACTCTTTGGAGTGACCACACTTGATGTTGTTAGGGCAAAGACTTTCTATGCAGGA
AAAGCTAAAGTTAATGTTGCTGACGTCATTGTCCCCGTTGTTGGTGgTCATGCTGGCATAaccATCcTCCCACTATtTT
cccAAG > SEQ ID NO:1816 130792 167662_300549_1
gaattcactgtaagccaggAATAATCTAgaAACAGATTCTTCTTATTAAAGCCAATAATTCTCCTCTACTACAGATAGT
AAGATGGCTGCAACAGCGGCAACTACTTTTTCGGTTGCATCTGTTTCTTATGGAAGCCAAGGATCAAAATCTAAATCCT
TGAACTTTAGATTCAACTCCCCAAACTATCTTAAGAGTTTCAGTGGTCTAAAGGCTGCAGGATCTGTTAAATGTGAATC
TGAAGCGTCTTTCGTTGGCCAAGATAGTGGTGCTGCTCTTCGTGCCTCTGTCGCAGTAAGAGCTGTGAAACAGAACAAG
GAGGGTCTTGAGAAATGTTTCCAGCCTCAGGCTTCTTTTAAAGTGGCAATTCTCGGAGCAGCTGGAGGAATTGGTCAAC
CCCTTTCACTTTTGATCAAGATGTCGCCATTGGTCTCGGCCCTTCATCTCTATGATATTGCTAACGTGAAAGGAGTTGC
TGCTGATCTCAGTCACTGCAATACTCCTTCCCAGGTTCTACAGCTTCACTGGCCAAGCAGAATTAGGAAATTCGTTGAAA
GGTGTCGATGTGGTTGTCATACCAGCTGGTGTTCCAAGAAAACCAGGAATGACACGTGATGATCTCTTCAACATCAACG
CTAGCATTGTGAAAACCCTGATtgaaGCCgtagcCgaTAAttgtcctGATGCATTCATccACATCATCAGCaaCccTgt
caaCTCTAcagtaCcaattgcagc > SEQ ID NO:1817 130792 157915_301744_1
GACACACAATTCTTTTGTGCTCCAAAGTATCAGAAGATGCAGCCATTCAGTGCAGAAGTTCACCAACGTATTGCTAGAA
TTTCTGCTCATCTCAACCCCCCAAATCTCCAGATGGGAGAGGGGTCTGTGTTGGAAAGATCAAGCTGCAGAGCAAAAGG
TGGGGCTCCTGGATTTAAAGTTGCTATATTGGGTGCTGCTGGAGGTATTGGCCAACCACTTGCAATGTTGATGAAGATG
AACCCTTTAGTCTCAGTTCTTCATCTCTATGATGTTGTTAATGCTCCTGGTGTTACTGCTGATGTTAGCCACATGGACA
CGGGTGCTGTTGTGAGGGGTTTTCTTGGCAAAGTCAGCTTGAGGCTGCACTTACAGGAATGGACCTTGTGATCATACC
TGCTGGTATTCCAAGAAAACCAGGAATGACAAGAGATGATCTTTTAAGATTAATGCTGGGATTGTGAGGACCCTCTGT
GAAGGAATTGCAAAGTGTTGTCCTAATGCTATTGTTAATTTGATTAGCAATCCAGTGAATTCCACAGTTCCTATTGCAG
CTGAAGTTTTCAAGAAAGCAGGTATTTATGATCCAAAGAAGCTTCTTGGAGTTACCTCACTAGATGTTGTCAGAGCCAA
TACTTTTGTGGCAGAAGTTTTGGGACTAGATCCTAGGGAAGTAGATGTTCCTGTTGTTGGAGGTCACGCCGGGGTGACA
ATTTTGCCTCTTCTCTCACAGGTCAAGCCTCCTTGCTCCTTCACACAggaggaAACAGAATATTTGACTAagCGCATTC
AAGATgGagggACagaaGttgttgaggccaaAAAaggagCTggATCTgcaaCtctatcaaTgGCATATGcagCTgTaAA
attTGcagatgCt

FIG. 2 continued

> SEQ ID NO:1818 130792 14038_300245_1
CCCACGCGTCCGCCTAACGAGAGGAAACTGAGGAACACAACAATGGAGTTTCGTGGAGATGCCAACCAGAGGATTGCTA
GGATTTCAGCTCATCTCACTCCTCAGATGGAGGCCAAGAACTCTGTAATCGGACGGGAAAACTGCAGAGCTAAAGGTGG
TAATCCAGGATTCAAAGTAGCAATTCTTGGAGCTGCAGGTGGAATTGGACAATCTTTATCTTTGCTGATGAAGATGAAC
CCTCTTGTCTCTTTACTTCATCTCTACGATGTTGTCAATGCTCCTGGCGTCACTGCTGACGTCAGTCATATGGACACTG
GAGCT

> SEQ ID NO:1819 130792 135582_300415_1
GTCTCCTTGGAGTGACAACACTGGATGTAGCAAGGGCAAACACCTTTGTGGCTGAAGTACTTGGAATTGACCCAAAAGA
TGTCAATGTTCCAGTTGTTGGTGGGCATGCTGGAGTGACTATATTACCCCTCCTCTCCCAGGTCCACCCCCCATGCTCA
TTTACCCCAGATGAAATCAGCTATTTGACTAAACGCATACAGAATGGTGGCACAGAAGTTGTTGAGGCAAAGGCAGGAG
CAGGCTCTGCAACTTTGTCAATGGCTTTTGCTGCAGCAAAATTTGGTGATGCATGCTTGCGAGCAATGCGTGGTGATGC
TGGCGTTGTGGAATGTTCATATGTTGCATCTGCGGTGACCGAGTTGCCGTTCTTTGCAACAAAAGTGAGGTTAGGTCGT
GCTGGAGCCGAAGAGGTTCTCCCTCTTGGGCCGTTGAATGATTTTGAGAGAGCTGGCTTGGAGATGGCAAGAAAGAGC
TGATGGAGAGCATTCAGAAGGGCATCGATTTCATGAACAAGTGAGGTGTATGAAGGGACAAAGTTATGCATACATGTAA
AGAGTGTCCTATATATAGTGCTCATATACATGTAAAATTTTCGCCGGGCTCATATACATGTAAAATCACTTCTGTAAA

> SEQ ID NO:1820 130792 240704_301317_2
gcgaggtgaTTATTAGGGCAATGGGTTTAGAGATGGCCCAGGATCGGGCGAGGGAGCGGATGGGCCGAATCTCATCACA
CCTGAAGCGCAGTGATGTGTGTATGGAGGTGTGCCGTGCTAAGGGGGCCGCCACGGGGTTCAGGGTGGCTATACTGGGG
GCGGCAGGAGGCATCGGGCAGCCTCTATCGCTGCTAATGAAAATGAATCCGCTGGTTTCCACGTTGAACCTGTATGATG
TGGTCAACACTCCGGGTGTTACCGCGGACTTGAGCCACATAGACTCAACAGCAGTGGTG > SEQ ID NO:1821 130792 240800_301317_1
GGCAATGGGTTTAGAGATGCCCAGGATCGGGCGAGGGAGCGGATGGGCCGAATCTCATCACACCTGAAGCGCAGTGATG
TGTGTATGGAGGTGTGCCGTGCTAAGGGGGCCGCACGGGGTTCAGGGTGGCTATACTGGGGCGGCAGGAGGCATCGGG
CAGCCTCTATCGCTGCTAATGAAAATGAATCCGCTGGTTTCCACGTTGAACCTGTATGATGTGGTCAACACTCCGGGTG
GTTACCGGCGGAACTTGAGCCACATAAAACTCAACAGCAGTGGTGCGAAGCTTCCTGGGGAAAGACGCGCTCCATTCGG
CATTGGAAGGGGTGGATCTGGTCATAATTCCGGCAGGTATTCCCCGAAAGCCAGTGATGAGCCGGGATGACTTGTTCAA
GATAAACGCGGGCATTGTGCGAACACTTTGTGAGGGCGTTGCACGGGCATGCCCGCGGGCACTTATCAACATTATCAGC
AACCCGGTGAACTCCACCGTGCCTATAGCAGCTGAGGTTTTCAAGAAGTCTGGCACGTACGACCCACGACGGTTGTTTG
GTGTCACCACCCTTGATGTTGTTCGAGGCAACACATTTGTGGGCGAGGTCGTGGGAGTGGATCCAAAGCTCATCAA > SEQ ID NO:1822 130792 56691_300127_1
GAGTTTCGTGGAGATGTCTTCCATTGTTGCTAGGATTTCAGCTTCTCACTCCTCAGATGGAGGCCAAGAACTCTGTA
ATCGGACGGGAAAACTGCAGAGCTAAAGGTGGTAATCCAGGATTCAAAGTAGCAATTCTTGGAGCTGCAGGTGGAATTG
GACAATCTTTATCTTTGCTGATGAAGATGAACCCTCTTGTCTCTTTACTTCATCTCTACGATGTTGTCAATGCTCCTGG
CGTCACTGCTGACGTCAGTCATATGGACACTGGAGCTGTTGTCCGCGGGTTCTTGGGAGCG > SEQ ID NO:1823 130792 247471_301620_1
ggatcgatcgatcgatcgaggatgtcgtcgaagcagcgggcagcgatgatcttcaagcgggctatggcgacagtgcccg
gGGGAAAGCCGCTGCCCGTGAGGAAGCCTCTGCCTTATCGTAGGGTCGCGGTTCTGGGGGCGGCCGGCCGGCATTGGGCA
GCCGCTGAGCATGCTTCTCAAGCTCAATCCCCTCGTCTCCAAGCTCTCGCTCTACGATATCGCTGGAACACCCGGCGTG
TCCACTGATCTATCGCACATCAACACGAGGACAGAGGTGCATGGATTTGCTGGGGATGATCAGCTCAAGGACGCTCTAA
AAGACGCGGATCTCGTTATCATTCCTGCCGGTGTTCCCCGCAAGCCCGGGATGACGAGGGACGAGCTTTTCGATATCAA
TGCGGGGATTGTGAAGAAGCTGTGCCAAGCCATCGCGAAGCACTGCCCTCTTGCATTGATTAACATGATCAGCAATCCC
GTGAATTCCACCGTGCCAATCGCGGCAGAGATGCTCAAGGCCGAGGGAACTTACGACCACACGAGGCTTTTCGGCGTCA
CCACCCTGGACGTTGTGCGAGCGAGGACTTTCTACGCCAAAGCCAAGAACCTGCCCATCGAAGaTGTGGACGTCCCTGT
CGTTGGTGGACATGccGgCaagaccattCTTccACTgttCTCACAGGcaaccCCACAAGTAccCCTCaccc > SEQ ID NO:1824 130792 221033_300941_1
GGAATATCTTCCTTTTGAGCCTTCTTCTTCTCCCCTTTTATTCCTCCCACATATTCCCCCTATAACCGCTACCATGGTC
AAAGCAGTTGTTGCTGGTGCCTCCGGAGGCATTGGACAGCCCCTCTCCCTCCTCCTCAAGGGCAGCCCTCTCATCGACG
AGCTGGCTCTGTACGATGTTGTCAACACCCCTGGCGTTGCTGCCGACCTTTCTCACATCTCCTCCCCGGCGAAAGTGAC
TGGCTACCTGCCCGCCAATGACGGCGCAAAGGCCGCTTTCAAGGATGCCGACATCATCGTCATCCCCGCTGGCATTCCC
CGCAAGCCTGGTATGACCCGTGACGATCTCTTCAACATCAACGCCGGCATCGTCAAGGGCCTCATCGAGGTCATTGCTG
ATGTTGCCCCCAAGGCCTTCATCCTGGTCATCTCCAAACCCGTCAACTCCACCGTCCCCATTTCCGCCGAGGTCCTCAA
GGCCAAGAAGGTCTTTGACCCCAAGCGCCTCTTTGGTGTCACCACTCTGGACGTCGTCCGTGCCGAGACTTTTGTTGCC
GAGATTGTTGGCG

FIG. 2 continued

> SEQ ID NO:1825 130792 227388_301027_1
CGTCGGGCGCTTCCGTTCTTCCGGTCGGCGGCATGGAGGACGCAGCAGCAAGGCGGATGGAGAGGCTCGCCTCCCACCT
CCGCCCGCCCGCTTCTCAGATGGAGGAATCACCCCTCCTGAGGGGCTCCAATTCCCGGGCAAAAGGTGCCGCTCCGGGT
TTCAAGGTCGCCATCTTGGGAGCGTCTGGTGGGATTGGCCAGCCTCTTGCATTGCTCATGAAGATAAACCCTCTTGTTT
CTGTGCTCCATCTGTACGATGTTGTCAACACTCCCGGTGTCACAGCTGACATTAGCCACATGAACACTGGTGCTGTGGT
GCGTGGTTTCTTGGGCCAGCCACAGTTGGAAAATGCCCTTACTGGAATGGATCTTGTGATCATTCCTGCTGGTGTTCCT
CGTAAGCCTGGGATGACAAGGGATGATTTGTTCAACATCAATGCCGGAATCGTCCGGACTCTTTGTGAAGGAATTGCAA
AATGCTGCCCCAATGCAATTGTGAATGTGATCAGCAACCCTGTCAATTCTACTGTTCCGATTGCTGCTGAGGTTTTTAA
GAAAGCTGGGACATATGACCCTAAGCGCCTTTTGGGTGTGACGACACTTGATGTAGTGAGAGCCAATACTTTTGTGGCA
GAAGTTCTTGGGCTTGATCCCAGAGATGTAAATGTTCCTGTCATTGGTGGGCATG

> SEQ ID NO:1826 130792 226307_300996_1
ATCTTCAAAAATGTTCCGAACCCGAGTTACCGGCTCCACCCTGCGATCCTTCTCCACCTCCGCTGCCCGACAGCACAAG
GTTGTCGTCCTTGGCGCCAACGGAGGCATTGGCCAGCCCCTGTCTCTGCTGCTCAAGCTCAACAAGAACGTGACCGACC
TCGGTCTGTACGATCTGCGAGGCGCCCCCGGCGTTGCTGCCGATGTCTCCCACATCCCCACCAACTCCACCGTGGCCGG
CTACTCTCCCGACAACAACGGCATTGCCGAGCCCTCAAGGGCGCCAAGCTGGTGCTGATCCCCGCCGGTGTCCCCCGA
AAGCCCGGCATGACCCGAGACGATCTGTTCAACACCAACGCCTCCATTGTGCGAGACCTGGCCAAGGCCGTCGGTGAGC
ACGCCCCCGACGCCTTTGTCGGAGTCATTGCTAACCCCGTCAACTCCACCGTCCCCATTGTCGCCGAGGTGCTCAAGTC
CAAGGGCAAGTACGACCCCAAGAAGCTCTTCGGTGTCACCACCCTCGACGTCATCCGAGCCGAGCGATTCGTCTCCCAG
CTCGAGCACACCAACCCCACCAAGGAGTACTTccCCGTTGttggCgGccACTCCGGtgtCacca > SEQ ID NO:1827 130826 254607_301634_1
ACGCGTCGGTCCCTACTGGGGAGGGTATCGCCTAATAGACGTTCCCATGAGCAACTGCATCAACAGTGGGATCAACAA
AATCTTCATCCTCACACAGTTCAACTCCACCTCCCTCAACCGCCATCTTGCCAACACCTACAATTTTGGCAACGGTGTC
AATTTTGGAAATGGATTCGTCGAGGCCTTGTCTGCAACTCAGACACCGGGGAAGGACGGAAAGAACTGGTTCCANGGGA
CTGCGGATGCTGTCAGACAGTTCACATGGCTCTTCGAGGAGAACAAGAATAAAGACCTCGAGCACGTGCTAATTCTTTC
CGGAGATCACCTCTATCGCATGGATTACATGGATTTCATTCAGAAACATCAGGAAACCGGCGCCGACATAACCATCTCC
TGTGTCCCCATTGATGAAAGCCGAGCATCCGACTATGGCCTGATGAAGATCGATAACACAGGCCAAATTCTCTACTTCA
AGGAGAAGCCAAAGGGGGCTGATTTAAAGGCAATGCAAGTGGACACATCTTCATTGGGGCTTTCACCAGAAGAGGCACG
TGCAAAGCCATATATAGCTTCAATGGGCATTTATGTTTTCAGGAAGGATGTTCTACTGAATCTTCTCAGGTCGAAATTC
CCTACCTCAAATGATTTTGGATCAGAAATTATACCGGCAGCA > SEQ ID NO:1828 130826 130873_300491_1
GAATTCACATCCGGTGGAAGAAGAAGAATTCCgtgggttGTTTCTCCCAAAGCTGTTTCTGATTCCAAGAATTCACAAA
CTTGTCTTGATCCAGATGCTAGCAGAAGTGTTTTGGGAATTATACTTGGGGGTGGAGCTGGGACACGGTTATACCCTCT
TACAAAGAAGAGAGCAAAGCCTGCTGTTCCACTGGGAGCAAATTACAGGCTGATTGATATCCCTGTTAGCAACTGCTTG
AACAGTAACATATCGAAAATATATGTTCTTACGCAATTCAATTCTGCCTCGCTGAATCGTCATCTTTCTCGGGCATATG
CTAGTAACATGGGTGGATATAAAAATGAAGGTTTTGTTGAAGTCCTTGCTGCTCAGCAGAGTCCAGAGAATCCGAATTG
GTTTCAAGGCACAGCTGATGCTGTGAGGCAGTATTTATGGTTGTTTGAGGAACACAATGTTATGGTACCTTATTCTA
GCTGGTGACCATCTATACCGTATGGATTATGAAAAATTTATCCAAGCACACAGAGAGACTGACGCCGATATTACTGTTG
CTGCACTCCCGATGGATGAAAAACGTGCAACCGCGTTTGGTCTCATGAAGATCGATGAggAGGGACGGATTATTGAAtt
tgcTGAAAAACCaa > SEQ ID NO:1829 130826 167379_300546_1
GAATTCCATTACGGTATCTCTACTTGTGCGTGCATTAAAAAATGGCATTGTTTTCGGCCGATGGTCGGATTTGTTTCTC
AGCTGCCGCTGGTAACTTACGCGGCAACACAGGGCTGGCTGGGAACAAGCTGTGCAGCAATGGAGGAGAGCTGATGGGA
GTGAAGCTAATGAAGTTGAATAACCAGAGAGTACCTCTTAACTCTAAAACTTCCAAGTCTTTTGCTTGCAAGGCTGTGG
CTACTAACAATGTAGTTGGTGAGAGTAAGTTGAGAGACTTGGACCAGGAAAAAAGGAATCCCAAGACTGTCGTAGCCAT
TGTTTTGGGTGGAGGTGCTGGTACTCGTCTATTCCCTCTTACCAAGCGCAGAGCCAAACCCGCAGTGCCAATTGGAGGT
GCCTACAGGCTCATTGATGTGCCAATGAGCAATTGTATAAACAGTGGAATCAACAAAGTTTACATTCTCACGCAATACA
ACTCTGCTTCACTTAATCGACATCTTGCTCGTGCGTATAACTTTGGTAACGGTAGTTTTGGAGATGGTTTTGTTGAGGC
TCTTGCAGCCACCCAGACTCCTGGTGAATCAGGGAATAAGTGGTTT

FIG. 2 continued

> SEQ ID NO:1830 130826 159866_200026_1
AAAGTTTGAAACTTGAGAAGAAGGAAAGCAAGATCAAACCTGGGGTTGCTTTCTCTGTTATCACTACTGACAATGGCAA
AGAGACTCTGACTGTGGAGGCTCCACGTTTTGACAGACGACGGGCAAAACCAAAGAATGTAGCTTCAGTCATACTAGGA
GGAGGTGCTGGAACCAAGTTATTCCCGCTGACAAGTAGAGCTGCCACCCCTGCTGTACCGGTTGGGGGATGCTACAGGC
TAATAGACATCCCAATGAGCAACTGTATCAACAGCGGTATTAACAAGATATTTGTGCTGACCCAGTACAATTCTGCTCC
CTTGAATCGTCACATTGCTCGAACATATTTTGGCAATGGTGTGAGCTTTGGAGATGGATTTGTTGAGGTGTTGGCTGCA
ACTCAGACACCTGGGGAAACAGGGAAAAAATGGTTTCAAGGAACTGCAGATGCTGTTAGACAATTTATATGGGTTTTTT
GAGGAGGCCAAGAACAAAGATGTCGATAATATCCTTATATTATCAGGAGATCATCTTTATAGGATG

> SEQ ID NO:1831 130826 155564_301357_1
agaaatAGCTGAGTAGAGCAGAGCAGAACATATCCATGGCTTCTATTGGAGCCTTAAAATCTTCGCCTTCTCCCCAAAA
TTGCATTAATGAGAGAAAAAATGACGCTACTCGTGCAATGTCCTTTCGAAACCTTTCCTTTTCATCGTCTCATCTCTCT
GGAGACAAGCTAATGTCTATGGCAACCTTACATTCTCAGCAGCGCCATTCCAGCGAGAGGAGGAGTCCACTGATCGTGT
CGCCTAAGGCTGTTTCTGATTCACAGAATTCGCAGACATGTCTCGATCCTGATGCTAGCCGAAGTGTTTTGGGAATTAT
TCTTGGAGGTGGAGCTGGGACCCGACTTTATCCTCTAACTAAAAAAAGAGCAAAGCCAGCAGTTCCTCTTGGAGCAAAT
TATCGTCTGATTGACATTCCTGTAAGCAATTGCTTGAACAGTAACATATCCAAGATCTATGTTCTCACACAATTCAACT
CCGCGTCTCTGAATCGTCACCTTTCACGGGCATATGCTAGCAACATGGGGGGATACAAAAATGAGGGTTTTGTGGAAGT
TCTTGCTGCTCAACAAAGTCCAGAGAACCCCAATTGGTTCCAGGGAACTGCTGATGCTGTCAGGCAGTATCTATGGTTG
TttgAGGAGCATAATGTTCTTgaatTCCtcgtacttGCTGGAGATCATCTATATCGAATgGAttacgaaaagTTCattc
aagcccacagagaaacagATGCTGATA > SEQ ID NO:1832 130864 1099606_301449_1
tctctctctctccgtttcgcGTTGCCGATCGCAGTCCTTCCGCTATGGCTCTCCCTGGACAGCAGGTAGCTGATTGCCC
AAACTTTAAGCTGGTCATTGTAGGCGATGGAGGAACAGGGAAGACCACATTCGTGAAAGGCATTTGACAGGAGAGTTT
GAGAAGAAATATGAACCTACCATTGGAGTTGAAGTTCATCCTCTTGATTTCTTCACCAACTGCGGGAAGATTCGATTCT
ATTGCTGGGATACAGCTGGTCAAGAAAAATTCGGAGGGCTCCGAGATGGTTACTACATTCATGGGCAGTGTGCTATCAT
AATGTTTGATGTGACATCGCGATTGACCTATAAAAATGTCCCAACATGGCATAGGGATCTCTGCAGGGTTTGTGAAAAC
ATACCAATTGTCCTATGTGGAAATAAGGTCGATGTGAAGAACAGGCAAGTGAAAGCAAAGCAGGTTACATTCCATAGGA
AGAAGAATCTCCAGTACTACGAGATCTCAGCCAAAAGCAATTACAATTTTGAGAAGCCTTACCTATACCTTGCGAGGAA
ATTGGCAGGTGATCAGAATCTGCACTTTGTGGAATCTCCTGCTCTTGCACCTCCGGAAGTGCAAATCGACCTGGCACAA
CAGCAACAGTATGAAGCTGAACTGGCTGCTGCTGCAGCTCAgcCATTgccAGATGATGATGATGAggcttttTGAgtgac
ctttGagtga > SEQ ID NO:1833 130864 1171517_302055_1
AGCAATAGCAATAGTGATAATAGTAATAGTAATAATCAGTTGGCCTTCTTTTCTTCCATCTGCAAGATCATTTCTGTTC
TTCTCCTCGTTGTTGCTCAATTCGATTCCCCTCGTTTTTGTTTTGCGATGGCTCTTCCTGGTCAACAGCAGGTGGACTG
TCCAAGCTTTAAGCTTGTAATTGTGGGTGATGGCGGAACAGGCAAGACAACTTTTGTGAAGCGACATTTGACAGGGGAG
TTTGAGAAGAAATATGAACCCACAATTGGAGTGGAAGTTCATCCTCTTGATTTCTTCACAAACTGTGGGAAAGTCCGCT
ATTATTGTTGGGACACTGCAGGGCAGGAGAAATTTGGTGGACTTCGGGATGGCTACTATATACATGGGCAATGCGCAAT
TATCATGTTCGACGTGACGTCCCGTTTGACGTACAAAAATGTCCCAACGTGGCATCGGGATCTTTGCAGGGTGTGTGAG
AACATCCCCGTCGTTCTTTGCGGGAACAAGGTGGATGTCAAGAACAGGCAAGTGAAGGCGAAGCAGGTCACTTTCCACA
GGAAGAAAAACCTGCAGTACTACGAGATCTCTGNCAAAAGCAACTACAATTTCGAGAAGCATTCCTTTATCTCGCAAG > SEQ ID NO:1834 130864 196656_300729_1
GGCCCCCATTCCTCCCCCACCCCGGTGTCCTCCCCTCCGCCGCTCGCGTCGCCGCCTTTTTCCCCTATGGCGCTGCCGA
ATCAGGGGACCGTGGATTACCCCAGCTTCAAGCTGGTCATCGTCGGCGATGGCGGGACTGGTAAAACTACATTTGTGAA
GAGGCATCTCACTGGAGAGTTTGAAAAGAAATATGAGCCAACCATTGGTGTCGAAGTTCACCCTCTAGATTTACCACC
AACTGTGGTAAGATCCGCTTCTACTGCTGGGACACTGCTGGACAAGAGAAGTTTGGTGGACTTAGGGATGGATACTATA
TCCATGGTCAATGTGCGATAATTATGTTTGATGTCACTTCAAGGCTGACTTACAAGAATGTTCCAACATGGCATAGGGA
CTTGTGCAGGGTGTGTGAAAACATCCCCATTGTCCTGTGTGGTAACAAGGTTGATGTGAAGAACAGGCAGGTTAAAGCC
AAGCAGGTCACATTCCACAGGAAGAAGAATCTCCAGTACTATGAAATTTCTGCCAAGAGCAACTACAACTTTGAGAAGC
CCTTCCTTTATCTTGCAAGGAAGCTTGCTGGTGACCCGAACCTGCATTTCGTTGAAGCTGTTGCTCTTAAACCTCCGGA
AGTTCCCATTGAGCTGGCAATGCAGCAACAGCATGAGGCTGAG > SEQ ID NO:1835 130864 217609_300910_1
GGACCCCGCCTGTTTACATCACCTCACGCTCGTCGCTAATCACTCGAGCCGTCAATATGGCTGAGCAACAGACTCCTAC
CTTCAAGCTTGTGCTTGTCGGCGATGGTGGTACCGGCAAGACCACCTTTGTCAAGCGTCACTTGACTGGTGAATTTGAG
AAGAAGTACATGGCCACCCTCGGTGTCGAGGTTCACCCCCTTGGCTTCACCACCAACTACGGTCAGATCCAGTTCGATG
TGTGGGATACCGCCGGTCAGGAGAAGTTTGGTGGTCTCCGTGATGGTTACTACATCAACGGCCAGTGCGGTATCATCAT

FIG. 2 continued

```
GTTCGATGTGACATCCCGTATCACATACAAGAACGTCCCCAACTGGCATCGTGATCTTGTCCGCGTTTGCGAGAACATC
CCCATCGTCCTGTGCGGTAACAAGGTTGATGTGAAGGAGCGAAAGGTTAAGGCCAAGACCATCACCTTCCACCGAAAGA
AGAACCTCCAGTACTACGACATCTCCGCCAAGTCCAACTACAACTTCGAGAAGCCCTTCCTGTGGCTGGCCCGCAAGCT
GGTTGGCAACCCCGcCCTGGAGTTCGTTGCTGCCCCCGCcctggCTCCTCCCACCGCCCAGGTCGACGAGGCTCTCTTG
GAGCAGTACAAGAAGGagatgGaCgaggcCGCcgccATGCCTCTtcctggtgagctgTCTGACGATGATCTGTAAacga
atCgCaCGAcggcgA > SEQ ID NO:1836 130864 253102_301628_1
GGCCGACTTTGGCGAGGTCGTGACGGAGACTCTGGATGGCTGTACACGCCGATTGAAGCACACTCCTCACAAGACGACT
GATGTCCATCGCCGCCCTGATGCCAGGTGTCACTTGAACACATCCAGGTTCTTGTCCTCCCCGTTTTCTCCCCACTTCT
TTTGACTAACACAGACCACCTTCGTTAAGCGACACGAGACCGGTGAGTTCGTGAACCGATACAACGCCACCCTCGGAGT
GGAGGTGCACCCCCTCAACTTCGCCACCGACTGCGGAAACATCCGATTCCACGTGTGGGATACCGCTGGACAGGAGAAG
TTCGGAGGTCTCCGACACGGCTACTACATCAAC > SEQ ID NO:1837 130864 270301_200125_1
aaaaccctagcttgctcgctctctctctctagaatcttactgctttttttcttctctttcaatatggctctccctaacc
aACAAACTGTAGATTATCCAAGCTTCAAGCTTGTAATTGTGGGTGATGGAGGAACTGGGAAAACAACTTTTGTCAAGAG
GCATCTTACTGGCGAATTCGAGAAGAAATATGAACCCACTATTGGTGGTGAGGTTCATCCATTAGACTTCTTCACAAAT
TGCGGGAAAATTCGCTTTTATTGCTGGGATACTGCTGGACAAGAGAAGTTTGGAGGTCTACGGGATGGTTACTACATTC
ATGGACAATGCGCAATTATCATGTTTGATGTTACAGCCCGTCTGACCTACAAGAATGTTCCTACATGGCATCGAGATCT
CTGCAGGGTTTGTGAAAACATCCCCATTGTTCTTTGTGGAAACAAAGTTGATGTCAAGAACAGGCAGGTTAAGGCAAAG
CAAGTTACCTTCCACAGGAAGAAAAATTTGCAATATTATGAGATCTCAGCAAAGAGTAACTACAACTTCGAGAAGCCTT
TTCTGTACCTTGCcAGaAAGcttgCTGGGGATGCTAATCTtCACtttgtggaatCAcccgcacttgct > SEQ ID NO:1838 130864 45843_300075_1
aattcgcggccgcctgacttcgcttctcctctcagatggctctacctaaccaacaaaccgtagattatcctagcttcaa
gCTCGTCATCGTTGGTGATGGAGGCACAGGGAAAACGACCTTTGTGAAGAGACATCTTACTGGGGAGTTTGAGAAGAAG
TATGAACCTACTATTGGTGTGGAGGTTCATCCTTTGGATTTCTTCACAAACTGCGGAAAGATCCGTTTTTACTGCTGGG
ATACTGCTGGACAAGAGAAATTTGGTGGCCTTAGGGATGGATACTACATCCATGGTCAATgtgCGATAATAATGTTTGA
CGTCACAGCAAGGCTCACATACAaGAATGTTCCGACATGGCATCGTGATCTTTGCAGGGTgtgTGAAAACATCCCGATT
gttCTGTGTGGAAACAaAGTCGATGTGAAGAACAGGCAAGTGAAggCAAAGCAAGTCACATTCCACAGGAAGAAGAATC
TGCAGTACTATGAGATATCagCAAAGAGCAACTacaaCTTCGaGaaGCCTTTCttgtaCCTTGctaggAAACTggCTGG
AGaccagaacCTtCACTTTgtgGAgtcACcagctcttgct > SEQ ID NO:1839 130864 253619_301629_2
TGAAGTTCATCCTCTTGATTTCTTCACCAACTGCGGGAAGATTCGATTCTATTGCTGGGATACAGCTGGTCAAGAAAAA
TTCGGAGGGCTCCGAGATGGTTACTACATTCATGGGCAGTGTGCTATCATAATGTTTGATGTGACATCGCGATTGACCT
ATAAAAATGTCCCAACATGGCATAGGGATCTCTGCAGGGTTTGTGAAAACATACCAATTGTCCTATGTGGAAATACGGT
CGATGTGAAGAACAGGCAAGTGAAAGCAAAGCAGGTTACATTCCATAGGAAGAAGAATCTCCAGTACTACGAGATCTCA
GCCAAAAGCAATTACAATTTTGAGAAGCCTTACCTATACCTTGCGAGGAAATTGGCAGGTGATCAGAATCTGCACTTTG
TGGAATCTCCTGCTCTTGCACCTCCGGAAGTGCAAATCGACCTGGCACAACAGCAACAGTATGAAGCTGAACTGGCTGC
TGCTGCAGCTCAGCCATTGCCAGATGATGAT > SEQ ID NO:1840 130870 168271_300554_1
GAATTCATTTCTTCTCCTACGTGCTTCAGCTGGCAAACTTTCACCATTCTGTTCATGATTGGGCACCAAAATGAATCGA
TTTTCTTGGTTTCTTTCTCCTACATCTTGTGTTTGATTTTGAATAGTATTTCCATTCATAGGAGAAACTCGTCCTTCCC
TTTCTGATCTAGCATTTGATCTTGTGATACTCTGTGATCTTCTGTTCTGTAACATCTCATTTTCCATCCTCAACTCATG
ATTCTCCCTGGTAAGATTTGCACGTGCTTCCGCTTCCAACCTTCGTTCTTCTTGAAAATTCTGTCTTTGTGCTTGCAGT
GTCTCTATTTCTCTGTTGCGAGTTATTCTTCCCAACAATCTCCCATTTTCATCTATCTGTACTTATTTTTCCTCTCTTG
AAGGTGAATCTGATCTCCAGGTGTGTATACTTACTCGATCATACTCCATCTCTTCTCTTGGTATTAATTCTTGTTCACC
TGACTGTCGAGTTTGTTTCCTTTGACTGTTTCTTCTTTTACTAGTTTCTCCAATCTCATTCACCTCTTCTCCTGCGAGT
CTTGCACTCCTTCTTACTGCAGTTGATGGTTCTGTTAGATTTCCTCTTCTTGT > SEQ ID NO:1841 130930 130877_300491_1
GAATTCAAGGGACTTTACTGATCGAGCCAAAGCCTCAGGAACCAACTAAGCACCAGTATGACTGGGATGCCGGCAACTAC
AGCTGCATTTCTACTAAAATATGGACTTTCTGGTGAATTCAAACTCAACATTGAGTGCAACCATCGTACACTTTCTGGT
CACAGCTGCCACCATGAGCTTGAGACCGCCAGAAATTTTGGGATGCTTGGAAACATTGATGCAAACACTGGAGATCCTC
AGATTGGATGGGATACTGATCAGTTCCTTACTGACATTGGAGAAGCAACTCTGGTTATGCTCAGCGTTGTCAGGAATGG
AGGACTAGCACCAGGAGGATTCAACTTCGACGCAAAATTACGACGAGAGAGTACCGATGTCGAAGACTTGTTCATCGCT
```

FIG. 2 continued

```
CATATCTCAGGAATGGATACATTGGCCCGCGGACTTCGAAATGTTGCCAAGCTGCTTGAGGACGGATCACTAACTGAGC
TTGTTCGTAAACGGTATGAGAGCTTCGACACAGAAATTGGTGCCCAGATAGAGGCTGGAAAGGCTGATTTTGAAGCACT
TGAGAAGAAGGCAATGGAATGGGGAGAACCAAAGGTTGGCTCTGCAAAACAGGAATTGGCTGAAATGCTTTTCCAATCA
CCACTATAGAAAGTAGCTTATGTTGAGTACAG

> SEQ ID NO:1842 130930 131091_300510_1
GAATTCAACATCAAAGTTTCTCTCTTTCTACAAACGAGGGCATTGCTACATATATAAAATGAAGATTGAGGATATTATT
TTGGGTTTGGTGTGCTTAAAATGTGATCACACTTGCAGTTATTGCTAGTAGTCCCCCTACTTGTCCTGCTGATCTTGGA
AAGGAATGTGCCAGTGATGGTGAATGGAAGGGGGAATTCTTCCCTGGCATTCCTGAAATCAAGTATGAGGGTCCTTCCA
GCAAGAACCCACTTTCGTTTAAATGGTACAATGCGGAGGAAGAGATTCTTGGAAAGAAAATGAAGGATTGGATGAGATT
TAGTGTTGCCTTTTGGCACACTTTCCGTGGAACTGGAGGGAGACCCTTTTGGTGCACCTACCAAGGTCTGGCCATGGGAA
GACGGTACTAATTCATTGGCAATGGCCAAAAGAAGAATGAGAGCAAACTTTGAATTTATTCGGAAGCTTGGTGTAGATT
TATGGTGCTTTCATGATAGGGACATTGCCCCAGATGGAAAAACCTTGGAGGAGTCCAATGCGAATTTGGATGAAGTGGT
CGCTTTGGCAAAAGAGCTTCAGGGAAACAAAATCCATCCTTTGTGGGGCACAAATGAGTTGTTCATGCATCCTCGCTAC
ATGCATGGTGCTGCTACTAGCTCCGATGTAGGTGTCTATGCTTATGCCGCAGCC

> SEQ ID NO:1843 130930 241865_301323_1
TTTCTCTGGCTAAGCAACTTCAGGAAGGCACAGACATCAGGCCTCTCTGGGGGACTGCGCAGCTCTTCAAGCACCCGAG
ATACATGCATGGAGCTGCGACAAGTCCCGACGCTCGAATCTATGCCTATGCCGCTGCTCAAGTGAAAAAGGCTATGGAG
GTGACCGAAGAGCTCGGGGGAGAAAATTACGTTTTCTGGGGTGGCCGGGAAGGATATCAGTCTCTTTTGAATACTGATC
TCGATAAGGAGCTGAATCACACGGCACAGTTTCTAAAATCCGCTGCGGAGTGGAAAAGAAGATTGGTTTCGACGGAGT
TCTCCTCATTGAACCAAAGCCCCAGGAACCAACAAAGCACCAATATGATTGGGATGCTGCAACTACAATTGGCTTCCTG
CTGAAATACGGTCTGAAAGACGATTTCAAGCTTAACATTGAATGCAATCACGCAACACTCTCTGGACACAGCTGCTATC
ACGAGCTGGAAGTAGCTCGAATCAACGGGGTCTTGGGAAACATCGATGCGAACACTGGCGATGCTCAGACAGGCTGGGA
TACCGACCAGTTCCTCATGGATATTGCGGAAACCACACAAATCAT

> SEQ ID NO:1844 131046 271667_200036_1
TCTCTCTCTCTCTCCTAGCGCATAAACGAGATCAATGGCGGCACTACAACAAACTCCGATTGCTTTCCAGTCCAGATCA
CCCCCGACAACTCAAATCATCAGCGGACCGACGGCGAAGCTCTCCTTTTCCGGCGGCCTCAAGCTCCCGAAACTCACCA
TCAAGCTCCGCTGTAATCGCACCTCGCGCCGCGGCGGCGGTGCTGCCGGAGCAAAAATGGTGGCTTCCGCTGCCGGAAG
TTACGCGAACGCACTCGCCGACGTAGCCAAGTCGAACGGAACTCTAGAACAAACCGTCGCCGACCTCGAAAAAATCGAA
AAATCTTCGACGACGAAGCAGTGTACAACTTCTTCGTGAGCCCTATCGTCGGCGAAGAGAAGAAACGCGAACTCGTGG
ACGAGATCGTTTCATCCTCGAGCATCCAGCCGCACGTGGCGAATTTCCTGAACATTTTAGTAGACATGAAGCGAGTGGA
GCTAATCAAAGAAATTGTAAAAGAGTTCGAGAAAGTATACAATACGATTACGGACACGGAACTTGCTGTGGTCACTTCT
GTTGTGAAATTGGAATCGCAGCATTTGGCGCAGATAGCGAAAGGAGTGCAGCGATTGACAGGTTCGAAAAATGTGAGGA
TTAAAACGGCTATTGATGAATCGCTAGTAGCTGGAt

> SEQ ID NO:1845 131046 1099933_301489_1
AAGGAAGTGAGTCGCAGAAGTATCAAGCGATGGAGACTGTGCGGCAAACCCTGTCTTCCCTCAATGCTCCTAGCTCCGC
TGCCGTGTCTCCTTCAGCTCGCCAGCCCTTGACCGCATCCCGCCTCCGCTCTTCCTCGAAACCGTGCGTCGTCGCCGCC
ACTCTCCGTATCCAAGGATTGCCTACACGGCGTCAAACCCTAATGCCGAAGCCTTCCTCTGGCCACCGTATCGTGATGA
AGGAAAGCCCTGCTAGAGGCTACGCCGGCGCCCTTGCCGAAGCTGGCCAGGCTGGGAAGAACCTAGAAGCTATCGCCAC
TGACGTCACCAAGTTCGGGTCTTACCTCAACGACCCCCAGTTCTACCAATTCATGGTTAACCCTGTCATGTCCGCGGAG
AACAAGAAGAAGGTTATCGAGGATGTGGGTGCCAGTGCCGGATTCCAGCCGTTTACTGTCAACCTCCTGAACATCCTCA
TTGACAGAAGGAGAGCTGATCTCATGACGGAGGTTGTCAAAGAATTCGAGGCTATCTACAATGAAATGACCGAGGT

> SEQ ID NO:1846 131046 124791_300437_1
tcgcgaggaagcagggcctcacgaagtactcacctgtggagagcaaaaagcttttaacccatccactacccTCCTCTCT
CTCTCTCTTCTCTCTCTCCTTGCGCATAAACGAAATCAATGGCCGCACTACAACAAACTCCGACAGCTTTACAGTGC
AGGTCACCGCCGCCGACTCAAATCATCACCGGACCTACGGCGAAGCTCTCATTTTCCGGCGGCCTCAAGCTCCCGAAAC
TCACAATCAAGCTCCGCTCTAATCGCACCTCCCGCCGCGGAGGCGGTGCTGCCGGAGCAAAAATGGTGGCTTCCGCTGC
CGGAAGTTACGCGAACGCACTCGCCGACGTAGCCAAGTCGAATGGAACCCTAGAACAAACCACCGCCGACCTCGAAAAA
ATCGAAAAAATCTTCGACGACGAAGCAGTGTACAACTTCTTCGTGAGCCCTATCGTCGGAGAAGAGAAGAAACGCGAAC
TCGTGGACGAGATCGTTTCATCCTCGAGCATCCAGCCGCACGTGGCGAATTTCCTCAACATTCTGGTAGACATGAAGCG
CGTGGAGCTAATCAAAGAAATCGTGAAGGAGTTCGAGAAAGTCTACAATACACTTACGGACACGGAACTTGCTGTGGTC
ACTTCTGTTGTGAAATTGGAATCGCAGCATTTGGCGCAGATAGCGAAAGGAGTGCAGCGATTGACAGGTTCGAAAAACG
TGAGAAtAAAACGgCtATCGATGAATCGCTAGTAGCTgg
```

FIG. 2 continued

> SEQ ID NO:1847 131046 121453_300357_1
CCGAGCGCAAAGCCAAGCCAAGCCAAGCCGCACTCCTCGAGTCCACCACTCCGCCGCGCACCACTCCCCACCTCCCGAC
GAGATGGCCACCCTCCGCCTCACCTCCGTCACCCTCCGCCCCGCCGCCTCCCCCTCGTCCGCCGCCGCCGCGGTCCG
CCAACTTCGCCCGCGCCGCGGCGCGCGGGTTCCCCTCGCTCCGCCTCGCGCCGCCGCGCCGCCGCGGGGACCTCGCCAG
GCGCAGGGCCGCCGCCGACGCCGCGGCGGAGGGGTACGCGACGGCGCTGTCCGAGGTGGCCTCGGAGAACGGCACGCTC
GAGGCGACCGTGTCGGACCTGGAGAAGCTGGAGAAGATCTTCGCGGAGGAGGCCATCGCCGAGTTCTTCGACAACCCGA
CGGTGCCGCGCGACGAGAAGGCCCAGCTCATCGACGAGATCGCCAAGTCGTCGGAGCTCCAGGCGCACGTCGTCAACTT
CCTCAACGTCGTGGTGGACAACGGCCGCGCGGGCCTCATGACGCAGATCGTGCGG

> SEQ ID NO:1848 131046 130295_300486_1
gaattcaaggaactgctgctgctgaagcaatggcgatgtgtaataatatccagaaagggaagaaaaagacttttattat
tGCTAGTAATTGTCATCCACAGACAATTGATATTTGCAAGACTAGAGCTGATGGGTTCGATTTGAAAGTCGTTACTTCG
GATCTTAAGGATATCGATTATTCGTCTGGTGATGTGTGTGGGGTTTTAGTTCAGTATCCTGGTACTGAAGGTGAGGTTT
TGGATTATGGAGAGTTTGTGAAGAAGGCACAATCAGCAAACTCAAATGGAACATTAGAAGCAACACAACAAGACATTGA
AAAGATTGAAAAAATCTTCACATCACCAGAAGTTTATGATTTCTTTGTCAATCCAACAGTTGCTGTGGAGAAGAAATAC
TCATTGATCGATGAAATTGCAAAATCATCAAACCTCAAAACAACTACAATCAATTTCTTGAATATCTTAGTTGATGTCA
AGAGAATTGATTTGATTAGAGAAGTTGTGAAGGAATTTGAGTTGGTTTTTAATGCAATGACTGATACTGAATTGGCTGT
TGTTACATCTGTTGTGAAGCTGGAAGCTAATCATTTAGCACAGATTGCTAAAGGAGTCCAGAGATTGACAAATTCTAAG
AATGTTAGGATTAAGACTGTGATTGATCCTTCTCTTgttgcTGGGTtTACAATCAGGTATGGGaattctgGgTCTaaat
tgatTgatATGa > SEQ ID NO:1849 131104 130748_300490_1
gaattcaagcaatgacggtatctggggaacaacaggtggaaacggctgctaataccccgtaggctgaggagcaaaaGGA
AGACATTGTCAGGTGGGGAGTTTGGCTGGGCTGGGGCGGCACATCTGTTAAAAGATAACGCAGGTGTCCTAAGATGAGCTCAAC
GAGAACAGAAATCTCGTGTGGAACAAAAGGGTAAAAGCTCGTTTGAAAGAGTTAACTGCATGCAGGTATGGCCACCAAG
TGGTTTGAAGAAGTTTGAGACCCTCTCATACCTTCCTCCATTGACCGTCGAGCAACTATCAAAGGAAGTTGACTACCTT
CTCCGTAATGGCTGGGTTCCCTGTTTGGAATTCGACGCCAGAGGATTCGTCTACAGAGAACACGGTAACACCCCTGGAT
ACTACGATGGTCGTTACTGGACAATGTGGAAGCTACCCATGTTCGGTTGTACCGATGCTTCCCAGGTTATCAAGGAGCT
AGAAGAGGCCAAGGCTGCATACCCTGACTCTTTCATCAGAATCATCGGATTCGACAACGTTCGTCAAGTCCAATGTGTT
AGTTTCATTGCATACAAgccctgagAGTTcagcctActggagaTGTTTAATTTGATGGATTagtagcggtGCACAgagC
aAAATCCTATCCATATA > SEQ ID NO:1850 131104 134777_300418_1
GCCCCTGAACAGACTTCCCCACCTGACAATGTCTTCCGCCCGGATCGGCCCGAGGGACTCGGGCCTTAGAGCCAAAAGG
AGGGGCCAGGCCCCGCTTCCGACTCACGGAATAAGTAAAATAACGTTAAAAGTAGTGGTATTTCACTTGCGCCCGAGGG
CTCCCACTTATCCTACACCTCTCAAGTCATTTCACAAAGTCGGACTAGAGTCAAGCTCAACAGGGTCTTCTTTCCCCGC
TGATTCCGCCAAGCCCGTTCCCTTGGCTGTGGTTTCGCTGGATAGTAGACAGGGACAGTGGGAATCTCGTTAATCCATT
CATGCGCGTCACTAATTAGATGACGAGGCATTTGGCTACCTTAAGAGAGTCATAGTTACTCCCGCCGTTTACCCGCGCT
TGGTTGAATTTCTTCACTTTGACATTCAGAGCACTGGGCAGAAATCACATTGCGTCAGCATCCGCGAGGACCATCGCAA
TGCTTTGTTTTAATTAAACAGTCGGATTCCCCTTGTCCGTACCAGTTCTGAGTCGGCTGTTCGACGCCCGGGGAAGGCC
CCCGAGGGGGCCGTTCCCGGTCCGTCCCCCGGCC > SEQ ID NO:1851 131104 167835_300551_1
aacaaagcattgcgatggtccctgcggatgctaacgcggtGTGATTTCTGCCCAGTGCTCTGAATGCCAAAGTGAAGAA
ATTCAACCAAGCGCGGGTAAACGGCGGAGTAACTATGACTCTCTTAAGGTAGCTAGGCCAAATGCCTCGTCATCTAATTAGTG
ACGCGCATGAATGGATTAACGAGATTCCCACTGTCCCTGTCTACTATCCAGCGAAACCACAGCCAAGGGAACGGGCTTG
GCAGAATCAGCGGGGAAAGAAGACCCTGTTGAGCTTGACTCTAGTCCGACTTTGTGAAATGACTTGAGAGGTGTAGGAT
AAGTGGGAGCCGTCTTTGGCGGCGAAGGTGAAATACCACTACTTTTAACGTTATTTTACTTATTCCGTGAGGCGGAAGC
GGGGCATCGCCCCTCTTTTTAGATCCAAGGCTAGCTTGCTATGCCGATCCGGGCGGAAGACATTGTCAGGTGGGGAGTT
TGGCTGGGGCGGCACATCTGTTAAAAGATAACGCAGGTGTCCTAAGATGAGCTCAACGAGAACAGAAATCTCGTGTGGA
ACAAAAGGGTAAAAGCTCGTTTGATTCTGATTTCCAGTACGAATACGAACCGCTCaAGCTAGCATGGTTGCACCATTCa
gcGGCTTGAAATccgTCTCTGCATTCcCagttaCCCGCAAATCAAACGACATCAcct > SEQ ID NO:1852 131104 181150_300654_1
gaattcAAgaaGACCCTGTTGAGCTTGACTCTattCCGACTTTGTGAAATGACTTGAGAGGTGTAGGATAAGTGGGAGC
CGTCTTTGGCGGCGAAGGTGAAATACCACTACTTTTAACGTTATTTTACTTATTCCGTGAGGCGGAAGCGGGGCATCGC
CCCTCTTTTTAGATCCAAGGCTAGCTTGCTATGCCGATCCGGGCGGAAGACATTGTCAGGTGGGGAGTTTGGCTGGGGC
GGCACATCTGTTAAAAGATAACGCAGGTGTCCTAAGATGAGCTCAACGAGAACAGAAATCTCGTGTGGAACAAAAGGGT

FIG. 2 continued

```
AAAAGCTCAAGCTAGCATGGTTGCACCATTCAGCGGCTTGAAATCCGTTGCTGCATTCCCAGTTACCCGAAAATCAAAC
GACATCACCTCCGTTGCCAGCAATGGTGGAAGAGTTAACTGCATGCAGGTATGGCCACCAAGTGGTTTGAAGAAGTTTG
AGACCCTCTCATACCTTCCTCCATTGACCGTCGAGCAACTATCaaaggaa > SEQ ID NO:1853  131104  198439_300648_1
GAATTCCAGCTGACCACCATGGATATAAACTCAAATGCCTCGTCATCGAATTAGTGACGCGCATGAATGGATTAACGAG
ATTCCCACTGTCCCTATCTACTATCTAGCGAAACCACAGCCAAGGGAACGGGCTTGGCAGAATCAGCGGGGAAAGAAGA
CTGAACAAACTACTTAACATGGCAATTCCCGGGGATC > SEQ ID NO:1854  131104  1875_300334_1
aattcggcaccagagctgttcccgcggcgagagcgggtcgccgcgtgccggccgggggacggactgggaacggctcctt
cGGGGGCCTTCCCCGGGCGTCGAACAGCCAACTCAGAACTGGTACGGACAAGGGGAATCCGACTGTTTAATTAAAACAA
AGCATTGCGATGGTCCCTGCGGATGCTAACGCAATGTGATTTCTGCCCAGTGCTCTGAATGTCAAAGTGAAGAAATTCA
ACCAAGCGCGGGTAAACGGCGGGAGTAACTATGACTCTCTTAAGGTAGCCAAATGCCTCGTCATCTAATTAGTGACGCG
CATGAATGGATTAACGAGATTCCCACTGTCCCTGTCTACTATCCAGCGAAACCACAGCCAAGGGAACGGGCTTGGCAGA
ATCAGCGGGGAAAGAAGACCCTGTTGAGCTTGACTCTAGTCCGACTTTGTGAAATGACTTGAGaggtgTAGGATAAGTG
GGAGCTTCGGCGCaagtgAAATACCACTACTTTTAAcgttATTTTACTTACTCCGTGAATCGGAGGCGGGGTACAACCC
CtgttTTTGGTCCCAAGGCTCGcttcGGCGGGTCGATCCGGGCGGAGGACATTGTCAGgtgGGGagtttggCTggGGcG
gcaCATctgttAAAAGATAACgcaggtgtcctaAGATGAGCTCaaCGAGaaCAgAaaTCtc > SEQ ID NO:1855  131104  23730_301001_1
gggttccacacgatatctctgtgctcgttgagctcatcttaggacacctgcgtgatctgttaacagatgtgccgCCCCA
GCCAAACTCCCCACCTGACAATGTCCTCCGCCCGGATCGACCCGCCGAAGCGAGCCTTGGGACCAAAAACAGGGGTTGT
ACCCCGCCTCCGATTCACGGAGTAAGTAAAATAACGTTAAAAGTAGTGGTATTTCACTTGCGCCGAAGCTCCCACTTAT
CCTACACCTCTCAAGTCATTTCACAAAGTCGGACTAGAGTCAAGCTCAACAGGGTCTTCTTTCCCCGCTGATTCTGCCA
AGCCCGTTCCCTTGGCTGTGGTTTCGCTGGATAGTAGACAGGGACAGTGGGAATCTCGTTAATCCATTCATGCGCGTCA
CTAATTAGATGACGAGGCATTTGGCTACCTTAAGAGAGTCATAGTTACTCCCGCCGTTTACCCGCGCTTGGTTGAATTT
CTTCACTTTGACATTCAGAGCACTGGGCAGAAATCACATTGCGTTAGCATCCGCAGGGACCATCGCAATGCTTTGTTTT
AATTAAACAGTCGGATTCCCCTTGTCCGTACCAGTTCTGAGCTGACTGTTCGACGCCCGGGGAAAGCTCCCGAGAGAGC
CGTTCCCAGTCCGTCCCCCGGCCGGCACGCGGCGACCCGCTCTCGCCGCGGAAGCAGCTCGAGCAGTCCGCTGACAGCC
GACGGGTTCGGAACTGGGACCCCCGAGCCCAGCCCTCAGAGCAAATCCTTT > SEQ ID NO:1856  131281  247585_301621_1
gctaccattgctttaatcgggatcgcggaggcggaggaagaaagagtagcgacgatggatgcgAACGGCGTGGTGGCCG
TGTACGGCAACGGCGCCATAGCGGAGCCCAAGAAGGCGTCGTACGCGGTCAAGGTCGGTCTCGCCCAGATGCTCCGCGG
CGGCGTCATCATGGACGTGGTCAACGCCGAGCAGGCCCGCATGCGCCGaGGAGGCCGGCGCGGTGGCGGTCATGGCCCTG
GAGCGCGTCCCGGCGGACATCCGCGCCCAgggtggcgtcGCACGgatgagcGACCCGGGCATGATCAAGGACATCAAGA
aGGCGGTCACCATTCCGGTCATGGCAAAAGCCCGCATTGGGCAtTtTGTCGAGGGGCAGGTGCTCGAGTCCATCGGCGT
CGACTTCGTGGACGagtCCGAGGTGCTCaCcCCCGCCGACGACGCCAACCACATCAACAAGCACAACTTCCACGTCCCG
ttcGTGTGCGGCTGccgcaACCTGGGCGAGGCGCTGCGGCGGAtcaccgagggcGcggtcatgaTCCggacccaagggc
gcacgcggcaccgGgaacgtGATCGAGGCGGTGCGCCACGTCCGGTCGCTCATGGGGGACATCCGGCggctgcgcagcC
TGgacgaggAcgaggtg > SEQ ID NO:1857  131281  223816_300976_1
ACAACACACACACAACACAATGTCTACCGTCGAGAAGTCTTTTGAGGAGCAGTTCAAGCTGCAGGCCGGTCTGGCCCAG
ATGCTCAAGGGTGGCGTCATCATGGACGTTGTCAACGCCGAGCAGGCCAAGATTGCCCAGGAGGCCGGAGCCGTGGCCG
TTATGGCCCTTGAGAAGATCCCCGCCGACATTCGAGCCGACGGAGGAGTCGCCCGAATGTCCGACCCCGCTATGATCAA
GGAGATCATGGCTGCCGTGTCCATCCCCGTTATGGCCAAGTGCCGAATCGGTCACTTTGTCGAGGCCCAGATCATTGAG
GAGATTGGTGTCGACTACATTGACGAGTCTGAGGTTCTGACCCCCGCTGACAGTTCCACCACATCAACAAGCGAGACT
TCAAGGTCCCCTTCGTTTGCGGTGCCAAGAACCTGGGTGAGGCTCCGACGAATCCACGAGGGAGCTGCCTTCATCCG
AACCAAGGGTGAGGCCGGTACTGGTGATGTCACCGAGGCCGTCAAGCACATGCGAACCATCCAGTCCGAGATCAACAAG
ACCCGACACATGTCTGAGATTGAGCTCTACACCTACGCCAAGGAGATTGGTG > SEQ ID NO:1858  131313  225349_300986_1
TTAGTAGTAGACGGCCGCCATTCTTCCTCTTCGGTTCTATCGATCGATCGATCCATCAGCCATGGCCGCCGCAACAGCC
GCCGCATCGTCGCAGCTCCTCTCGCCGGCGGCGTCGCTGGGCTCGGCGGCGTCGCCGTCGTCGTCGTCGTCGCCTTCCG
GCAATCGCGCCGGGTTCAGGTCATTGGGGAGGCAATGCTTCGCGGGACTCGTCGCCGGGGCGCCGGGAGGTGCGGCGGCT
GGGGGGATTTCGAGCGGCAGCAGCCGGATTTCGCGGCGGCAGTGGCGGCGGCGGTGAGGTCGTCGGGGGGCAATGGGCGC
GGCAGCCGCGGCGTGGTGTGCATGGCCAAGAAGAGTGTGGGGGATCTCAAGGAGGCGGACTTGAAAGGCAAGCGTGTCT
```

```
TTGTCAGGCCTGATCTCAACGTTCCACTGGATGCCGATCTAAACATCACCGACGATACGAGGATTCGTGCTGCCGTGCC
GACGATCCAGTATCTCATTGGCAATGGGGCTAAGGTCATCCTCAGCAGCCATCTGGGGCGTCCCAAAGGAGTGACCGAG
AAGTATCGACTTACACCTCTTGTTGGAAGGCTCTCAGAGCTCTTGGGAACCAAGGTTGAGAAGGCTGACGA

> SEQ ID NO:1859   131313  226223_300995_1
GTTTATTCAGAATGTCTCTTACCAACAAGCTCTCCCATCAAGGATCTCGATCTCAAGAACAAGCGAGTCTTCATCCGAG
TCGACTTTAACGTTCCTCTCGATGGCACCACCATCACCAACAACCAGCGAATTGTTGCTGCCCTGCCCTCCATCAAGTA
TGCCATTGATCAGGGTGCCAAGGCTGTGATCCTTGCTTCTCATCTCGGCCGGCCCAACGGCCAGCGAGTCGAGAAGTAC
TCTCTCAAGCCCGTCCAGGCCGAGCTTTCAAAGCTCCTTGGCAAGCCCGTCACCTTCCTTGACGACTGCGTCGGCCCCA
AGGTTGAGGAGGAGGTCTCCAAGGCCAAGGACGGTGAGGTCATTCTCCTCGAGAACCTGCGATTCCACCCCGAGGAGGA
GGGATCCCACAAGGACGCCGACGGCAAGAAGATCAAGGCTGACCCCGCCAAGGTTGAGGAGTTCCGAAAGTCTCTGACT
TCTCTCGCCGATGTCTACGTCAACGACGCTTTCGGAACCGCCCACCGAGCCCACTCCTCCATGGTCGGCATTGAGCTTC
CCCAGCGAGCCGCTGGTTTCCTTGTCGCCAAGGAGCTCGAGTTCTTCGCCAAGGCTCTGGA

> SEQ ID NO:1860   131313  279787_200064_1
gtgttcttcttctcgacaacgtgagattctacaaggaggaacagaagaatGAACCTGAGTTTGCAAAGAAACTTGCATC
ATTGGCAGATCTTTACGTAAACGATGCATTTGGTACAGCTCACAGAGCACATGCCTCTACAGAGGGAGTTACTAAATTT
TTGAAGCCTTCTGTTGCAGGTTTCCTCTTACAAAAGGAATTGGACTATTTAGTCGGGGCAGTTTCAAATCCAAAGAGGC
CATTTGCTGCTATTGTGGGTGGTTCAAAAGTTTCATCCAAGATTGGAGTGATCGAATCACTTTTAGAGAAATGTGATAT
ATTGCTTTTGGGTGGAGGAATGATCTTTACCTTCTACAAGGCTCAGGGTCTTTCAGTTGGTTCCTCCTTGGTTGAGGAA
GACAAACTAGAACTCGCTACATCACTCCTAGAGAAGGCCAAGGAGAAAGGAGTCAGTCTCTTGTTACCATCTGATGTTG
TGATTGCAGATAAATTTGCTCCTGATGCAAACAGCAAGATTGTGCCGTCATCTGCTATCCCAGACGGTTGGATGGGGTT
GGACATTGGACCagaCTCTGTCAAGACTTTCAATGATGCCTTGGATACCACAAAGacagtgATCTGGAATGGACCTATG
GgggtgttTGAATTTGACaagtttgct > SEQ ID NO:1861   131313  104214_300060_1
cttcactctgtcttcacacTCTCTGCTTTTGCCGTAGGACAGAATCGTCGAGTTTAGTGACGAAGACTGTAATCAATGG
CATCAGCTACAGCTTCTCACACTTTGTGCGGCATCCCCGCCACCTCATCCTCTACTACCAACAAGTCTATTGCCCCTTC
ATCTGCTCGCTTCCTCTCTAAAACTCCTCCCCGCGGCCTCGGCTTCGCTGGCGCCGCCGCTGATTCTCTCTTCACCAAC
CACGTGGCAACCAAGCTCCGATCCCTCAAGAGCTCCTCCAAGCCTGTTAGGGGCGTTGCTTCTATGGCCAAGAAAAGCG
TCGGAGACCTCACCGCTGCCGAGTTGAAGGGCAAGAAAGTCTTCGTCAGGGCCGATTTGAATGTCCCACTTGATGATAG
CCAGAACATTACTGATGACACTAGAATTAGAGCTGCCGTCCCTACTATCAAGCACTTGATGGCCAATGGTGCTAAAGTT
ATTCTCTCCACTCACTTGGGACGGCCAAAAGGAGTCACTCCTAAATACAGCTTGGCACCCCTAGTCCCCAGGCTATCCG
AACTGCTTGGAATCCAGGTTGTGAAGGCTGAGGACTGCATTGGTCCGGAAGTCGAgaagTTGGTTGCTTCACTTCCCga
gggtggtgttCTTCTTCTcgagaacGtgagatTCTACaaggAgg > SEQ ID NO:1862   131313  116635_300079_1
gccatccccaccatccagtaccttatcaagaacggtgccaaggtcatcctctccagccacctgggtcgcccaaagggtg
tTACTCCCAAGTTTAGCTTGGCTCCCCTTGTACCGCGATTGTCTGAACTTCTCGGCATACAGGTGACTAAGGCAGAAGA
TGTTATTGGACCAGATGTTGAGAAATTGGTATCTGAATTGCCAAATGGTAGTGTTTTGCTCCTTGAAAATGTTAGATTT
TACAAGGAAGAGGAGAAGAATGACCCAGAGTTTGCCAAGAAGCTTGCCTCCTTAGCAGATCTCTATGTCAATGATGCAT
TCGGAACAGCCCACAGAGCACATGCATCAACTGAGGGAGTTACCAAGTTTTTAAAGCCTTCTGTCGCAGGGTTCCTTTT
GCAGAAGGAGCTTGACTACCTTGTTGGAGCTGTTTCAAGCCCTAAACGCCCATTTGCTGCCATCGTGGGTGGTTCAAAG
GTGTCATCCAAGATTGGGGTTATCGAATCCCTTTTGGAGAAATGTGATATCCTTCTTTTAGGTGGTGGTATGATCTTCA
CATTTTACAAGGCACAAGGACTCTCTGTTGGTTCTTCCTTGGTTGAggAAGACAAACTTGAGCTTGCAACATCTCTCcT
tgcAAAGGCAAAAGaaAAggGTGTCTCCCTTCTGTTGCCATCTGACGTTATCATTGCTGATAAGtttgCTCCTGATGCT
AACAgccaggttgttccagCATCTGCTATTCCTGATGGTTggATGggtCTgGATa > SEQ ID NO:1863   131313  133413_300449_1
aacgaatatcacatcatttgagttttccattctcacgaaatggcggtgaagaagagtgtgggatcactgaaagaagcag
aTCTGAAAGGGAGGAGAGTATTCGTGAGAGTTGATCTGAATGTTCCATTGGATGACAGCTTCAATATTACTGATGACAC
CAGAATCCGAGCTGCTGTTCCTACCATTAAGTATTTGATGCAACATGGATCTCATGTTATTCTTGCCTCTCATCTTGGT
CGTCCAAAAGGTGTCACTCCAAAATACAGCTTGAAGCCACTTGTACCAAGACTGTCAGAGCTATTGGGACTTGAGGTCA
AGATGGCAGATGATTGCATTGGTCCAGAAGTTGAGAAGTTGGTTGTCGAAATACCAGAAGGAGGAGTTCTGCTCGTGGA
AAATGTGAGATTCTATAAAGAAGAGGAGAAGAATGAGCCCGAGTTTGCAAAGAAGCTGGCGTCTCTTGCAGATTTGTAT
GTCAATGATGCCTTTGGGACTGCACACAGAGCACATGCTTCCACAGAAGGGGTTGCTAAGTACTTGAAACCGGCAGTTG
CTGGATTCCTTATGCAAAAGGAACTTGACTATCTTGTCGGAGCTGTATCAAATCCACAGAAGCCATTTGCTGCCATTGT
TGGTGGTTCAAAGGTTTCAAGTAAGATTGGCGTGATAGAGTCACTTTTGGAGAAGGTTAACGTGTTATTGCTTGGTGGA
GGTATGATCTTTACTTTCTACAAGGCCCAAGGATACTCTGTTGGATCCTCACTTGTAGAGGAGGACAAGCTTGATCTAG
```

FIG. 2 continued

CAACATCACTTATTGAAAAGGCAAAGGCAAAAGGTGTATCTCTGTTGCTTCCTGCTGATGTAGTGATAGCAGACAAGTT
TGCTGCTGATGCCAACAGCAAGATTGTTCCAGCATCTGAAATTCCTTGGCTGGATGGGGTTAGATATTGGACCTGATGC
TATCAAGTCTTTTGGCGAAGCTTTGGATGCCACCAAAACTATCATATGGAATGGACCTATGGGAGTATTTGAGTTTGAA
AAATTTGCTGCTGGAACAgaggcTATTGCAAAAAAACTGGCAGaGCttAGTGGAAAAggAGTAaCaaCaaTCATaggGG
g > SEQ ID NO:1864 131313 168518_300557_1
GAATTCAGCACTACAAGATGGAGGTGTTCTATGGCTTGAAAATCTGAGGATGCACAACGAGGAAACTGAGAACAGCCTT
GAGTTTGCTAAGAAGTTAGCTTCCCTGGCTGACCTGTATGTTAATGATGCATTTCAAAGTACTATGTTTGCACATGCTT
CCACGGTTGGAGTCCCTAATATCTTAAAGCCTGCTGTGGCTGGACTCACAATGGAGAAGGAACTCAACTATCTTTGCGG
AGCTGTCTTACATCCTAAGAGGCCATTTGCTGCCATTGTTTCTGGCTCTAAGCTGTCATCCAACAGAAGTCTTATTGAG
GCCTTGTTGGATAAAGTTGATATCCTCGTTTTAGGTGGAGAAATGATATTCACGATTTACAGGGCCCAAGGCCGCAGTG
TTGGGTCATGCCTCGTTGAGGAACACATGTTTGGCTTTGCATTGTCAATCCTTAAGAAGGCTCTAGATAATAAAGTCGA
ACTTGTCTTACCCAAGGATGCTGTTATTAGTAAAATAGATTCTCCTGGCACTGAAGACAAGCATGTAGCACTTGCTGGT
ATCTCAAAGGGTTGGAGGGCAGTGGACATCGGTCCCTTGACCATCTTTATGTACAATTCATC > SEQ ID NO:1865 131313 168321_300555_1
gaattcagaaaacaAAAACAACAATGGCTTCAACAGCTTCACACACTACTCTATCTCTACTCAGAACAACAGCATCATC
TTCATCTGCTCGCAACAACCGTGTATCATCAACATTACAAGTTGCAGCAGCATCTCGATTAAGAAACATCGGATTACAA
GTTAGAAACCCAAAAAGTCTTGGGTTTTCTGGTGTTGCAGTAGATCCTCTTCTTTCATCACACGTTTCTTCACAAATTG
GAGCTGTTAGTGGTAAAGGGGTGAGAGGTGTTGTTTCAATGGCTAAGAAAAGTGTTGGGGATTTGAGTGCATCTGAATT
GAAAGGTAAAAGGGTTTTTGTTAGGGCTGATTTGAATGTCCCGTTGGATGACAATCAGAACATTACTGATGATACTAGA
ATCCGTGCTGCTATTCCAACTATCAAACATTTGATGGCCAATGGTGCTAAAGTCATTCTTACCAGTCATTTGGGAAGAC
CAAAGGGTGTTACTCCAAAATTCAGCTTGGCCCCTCTTGTCCCTAGGCTCTCCGAGCTTCTTGGCATCACTGTTGAGAA
AGCTGATGATTGTATTGGCCCTGACGTTGAGAAATTGGTTGCTGCACTACCAGAAGGTGGTGTTCTCCTTCTTGAAAAT
GTGAGATTCTACAAAGAGGAAGAGAAGAACGAACCAGAATTCGCAAAGAAACTTGCTTCCCTCGCAGACCTATATGTCA
ACGATGCCTTTGGAACAGCACACAGAGCTCATGCTTCAACTGAGGGAGTTACCAAATACTTAAAGCCATCTGTTGCTGG
TTTCCTCTTGCAGAAGGAACTGGACTATCTTGTTGGGGCAGTTTCATCCCCAAAGAGACCATTTGCTGCCATCGTTGGT
GGTTCCAAGGTGTCATCTAAGATTGGTGTGATTGAGTCGTTGCTAGAGAAGTGTGATATTCTACTTTTGGGTGGAGGTA
TGATCTTCACATTCTACAAGGCACAGGGGCTATCAGTAGGTTCTTCTCTTGTGGAGGAAGACAAGCTTGAACTTGCAAC
CTCCCTCCTTGAGAAGGCCAAGGCAAAGGGTGTGTCACTTTTGTTACCCAGTGACGTAGTTATTGCCGATAAATTTGCT
GCTGATGCAAACAGCAAGATTGTACCCGCATCTGAGATCCCAGATGGTTGGATGGGATTGGATATTGGCCCAGATTCTA
TCAAGACATTCAATGATGCCTTGGACACCACCAaGAccGttATCTGGAATGGACCTATGGGAGTTTTTGAAAT > SEQ ID NO:1866 131313 200047_300755_1
AGCAGCGCGACTCCTGTTTCGCTCTACTCGCCAATTTCCCGCCAAAATGTCTCTCTCCAGCAAGCTGTCCATCACTGAC
GTCGACGTCAAGGGCAAGAGGGTCCTGATCCGGGTTGACTTCAACGTCCCCCTCGACGAGAACAAGAAGATCACCAACA
ACCAGCGCATTGTCGGTGCCATTCCCACCATCAAGCACGCTCTCGACAATGGGGCCAAGTCCGTCATCCTGATGTCCCA
CCTTGGACGCCCCAATGGTGCCGTCAACGCAAAGTACTCCCTCCAGCCCGTTGTTCCCGAGCTCGAGCGCCTCCTGGGC
AAGTCCGTCACCTTTGCCCCCGACTGCGTCGGCCCCGAGGTCGAGGCCATCGTCAACGGTGCCGACAACGGTGCCGTCA
TCCTGCTGGAGAACCTCCGATTCCACATTGAGGAGGAGGGCAGCGCCAAGGACAAGGAGGGCAACAAGACCAAGGCTGA
CAAGGCCAAGGTTGAGGAgttccgCAAgGgccTGACCGCTCTGGGTGACATTTACGTCAACGATGCTTTCGGCACTGCC
CACCGTGCTCaTTCTTccATGGTtggCGTtg > SEQ ID NO:1867 131313 156703_301369_1
tgctcatgtcattcttgcctctcatcttggtcgccctaaaggtgttactccaaagtacagcttaaagccgcttgtgcct
aGACTATCAGAACTAtTGGGAGTTGAGGTCAAGATAGCAAATGATTCAATTGGTCCAGAAGTTGAGAAATTGGTCGCTG
AAATACCAGAAGGAGGAGTTCTGTTGCTGGAGAATGTCAGATTCTATAAAGAAGAGGAGAAGAATGAGCCCGAATTTGC
CAAGAAATTGGCATCTCTTGCAGATTTGTACGTCAATGATGCATTTGGGACTGCTCATAGAGCCCATGCTTCCACAGAA
GGGGTGGCTAAGTACTTGAAACCAGCTGTTGCGGGATTTCTTATGCAAAAGGAACTTGACTATTTAGTAGGAGCTGTGG
CAAATCCCCAGAAGCCATTTGCTGCCATTGTTGGTGGTTCAAAAGTATCATCTAAGATTGGTGTTATAGAGTCTCTCTT
GGAGAAGGTTGACGTGTTATTACTTGGCGGAGGAATGATCTTTACTTTCTACAAGGCGCAAGGGTACGCTGTTGGATCA
TCACTAGTGGAGGAGGACAAGCTTGATTTGGCAACATCTCTCATGGAGAAGGCAAAGGCAAAAGGGGTATCTCTATTGC
TTCCCACTGATGTAGTGATTGCCGACAAGTTTGCTGCTGATGCGAACAGTAAGGTTGTTCCAGCATCTGAAATTCCTGA
TGGCTGGATGGGATTGGATATCGGACCTGATGCAATCAAGTCATTTGGCAGCGCCTTGGATACCACCAAGACTGTCATT
TGGAATGGACCAATGGGTGTGTTTGAGTTTGACAAGTTTGCTGCTGGAACAgagGCTATTGCAAAGAAACTggCAGagc
TTagtgGAAAggGAGTGACAACCAtCa

FIG. 2 continued

> SEQ ID NO:1868 131378 1109983_301526_1
ttcGAGGGGTTAAGGTTTGTCTTTTCACAGCCAATTACTTGAGAATGGCCAACCCACATGTCTTCTTTGACATGGCCAT
CGGCGGCGTCAGCGCTGGTCGCATTGTGATGGAGCTGTACAGTGACACAACCCCAAGGACTGCGGAGAATTTCCGGGCC
CTGTGCACGGGGGAGAAGGGCACTGGGAGCAGCGGGAAGCCCCTCCACTTCAAGGGCTCCTCTTTCCACAGGGTCATCC
CCAACTTCATGTGCCAGGGTGGCGACTTCACCCGTGGCAATGGGACTGGTGGGGAGTCCATCTATGGCACTAAGTTTGC
CGATGAGAACTTCTCCAGGAAGCACACAGGTGAGGGTGTCCTCTCCATGGCCAACTCTGGGCCCAACACCAATGGGTCC
CAGTTTTTCATCTGCACTGTCCCCTGCAACTGGCTCGACGGGAAGCATGTTGTGTTTGGCCGTGTTGTCAATGGGATGG
ACGTAGTGAAGACCATTGAGAAGGTTGGTTCGAGCTCTGGAAAGACCAGCAAGCCTGTTGTAGTAGCTGACTGTGGTCA
GCTCTAAGCACTAGTTAGTAATATTGATGATAAAGCTTAATAAAGTT > SEQ ID NO:1869 131378 152839_200052_1
GAAGAACATAGCAGAAATTTCTGAAATTTTTTAATTTTTATTTAGAGGAGATGGGTAGAGCGATCTCAGTTTTATTGCAG
CCACGGTGGCTTCTGATCTTTCTTGCTGTTTTAGTTCTTATCTTTCTTGCTTCCTCCTTCTCCCAAAAGGAATATGAAA
AGGTGGAAGAGGTGTATGATATTACCCACAGAGTATTCTTGGATGTTGATATAGATAAACAACGTGTAGGAAGAATTGT
GATTGGATTATATGGGCAAGTTGTACCAAAAACTGTTGAGAATTTCAGGGCTTTGTGCACAGGGGAAATGGGCAAGACC
GCTGATGGAATATCTCTTCACTACAAGGGAAAGCCATTTCATCGTGTAATACCTGGATTCATGATTCAAGGTGGAGATA
TTGTGTCGGGTGATGGAAGGGGAAACATTTCCATTTATGGTGGTACCTTTCGTGACGAGAATTTGAAGATAAAGCATTC
TCATGCAGGTGTTATTTCCATGGTGAACACAGGACCCAACTCCAACGGCTGTCAGTTCTTTATACCGACAGTGAAGGCT
AGCTGGTTGGACGGNGAGCATGTTGTATTTGGCAAAGTTATTGAAGGTATGGACACGGTATATGCAATAGAGGGGGAG
CAGGAACGTACAGTGGAAAACCGAGAAAAAGGTTATTATTGCAGACTCTGGGGAAATACCT > SEQ ID NO:1870 131378 174902_300528_1
CCCCCTGAGGCCACGCAGCGATCTGGAGTGAAACAGCAAAAAAAATCAAACAAAAAGAAAAAAAATTCCCCATCTGTGA
AATTCGCAAAACCCTAGCGCGGCGGCGATGTCGAACACGAGGGTGTTCTTCGACATGACCGTCGGCGGAGCTCCGGCGG
GGCGGATCGTGATGGAGCTGTACGCGAAGGACGTGCCGCGGACGGCGGAGAACTTCCGCGCGCTCTGCACCGGCGAGAA
GGGCGTGGGCAAGAGCGGCAAGCCGCTGCACTACAAGGGGAGCACCTTCCACCGCGTGATCCCGGAGTTCATGTGCCAG
GGCGGCGACTTCACCCGCGGCAACGGCACGGGAGGGGAGTCGATCTACGGCGAGAAGTTCGCCGACGAGGTGTTCAAGT
TCAAGCACGACAGCCCCGGCATCCTGTCCATGGCGAACGCCGGGCCCAACACTAACGGGTCCCAGTTCTTCATCTGCAC
CGTGCCCTGCAGCTGGCTGGACGGGAAGCACGTCGTGTTCGGCCGCGTCGTCGAGGGCATGGACGTCGTC > SEQ ID NO:1871 131378 211106_300896_1
AGCCATTCGTCATGTTGAGCTTCCGGCGGCTCTTTACCACGCCATCTTGTTGGTGGTGGGATTGCTCTTCTTCGTCAA
GTCGGCCGAGGCTGCCAAGGGCCCCAAGATCACCCACAAGGTCTACTTTGACATTGAGCACGGCGACGAGAAGCTGGGC
CGAATTGTCATGGGTCTGTATGGAAAGACTGTCCCCGAGACCGCTGAGAACTTCCGCGCTCTTGCCACTGGCGAGAAGG
GCTTCGGCTATGAGGGCTCTACCTTCCACCGTGTTATCAAGCAGTTCATGATCCAGGGTGGTGACTTTACCAAGGGCGA
CGGCACCGGTGGCAAGTCGATCTACGGCAACAAGTTCAAGGATGAGAACTTCAAGCTGAAGCACACCAAGAAGGGTATC
CTGTCCATGGCCAACGCCGGACCTGACACCAACGGCTCCCAATTCTTCATCACCACTGTTATCACCTCATGGCTCGACG
GCCGCCACGTCGTTTTCGGCGAAGTCCTCGAGGGTTACGACATTGTCGAGAAGATTGAAAACGTCCCGACCGCCGCCGG
TGACCGCCCAGTGAAGACTGTCAAGATCGCCAAGAGTGGCGAGCTGGAGGTCCCTCCCGAAGgtattCACGTCGAGCTC
TAAATTTATCTTACATGATTCAGAGCCCTCCGGcacggctaTCgcaCCcggagccgttggtg > SEQ ID NO:1872 131378 197284_300700_1
TGTGAAGGGAAATTTGTGGataagaAGCTGAGAAAAGACTTCGAGTGGTGAACTCTAGGTCCTGATGTTTAAATCTACT
GTATTTACCTTCGCATTAATTAAGCATGTCGAACACGAGGGTGTTCTTCGACATGACCGTCGGCGGAGCTCCGGCGGGG
CGGATCGTGATGGAGCTGTACGCGAAGGACGTGCCGCGGACGGCGGAGAACTTCCGCGCGCTCTGCACCGGCGAGAAGG
GCGTGGGCAAGAGCGGCAAGCCGCTGCACTACAAGGGGAGCACCTTCCACCGCGTGATCCCGGAGTTCATGTGCCAGGG
CGGCGACTTCACCCGCGGCAACGGCACGGGAGGGGAGTCGATCTACGGCGAGAAGTTCGCCGACGAGGTGTTCAAGTTC
AAGCACGACAGCCCCGGCATCCTGTCCATGGCGAACGCCGGGCCCAACACTAACGGGTCCCAGTTCTTCATCTGCACCG
TGCCCTGCAGCTGGCTGGACGGGAAGCACGTCGTGTTCGGCCGCGTCGTCGAGGGCATGGACGTCGTCAAGGCCATCGA
GAAGGTGGGATCCCGCGGCGGGAGCACCGCCAAGCCGGTCGTCATCGCCGACTGCGGCCAGCTCTCCGCGGCCGCTTAT
CCGTATGATGTTCCGGATTATGCCGAGCTCTACAAAC > SEQ ID NO:1873 131378 233478_301090_1
GGCGGGAGAGAGATGGAGGGAATGTGGCGGCGCTGCTGTTGCTGCTGGCGCTGGTGGTGGCGGGGATCTCGCTCTCCG
CCGCCGCGAAGAAGCCGGAGAAGAACCTGGAGGAGATCACGCACAAGGTGTTCTTCGACGTGGAGATCGGCGGCAAGCC
GGCGGGCCGGGTCGTGATGGGGCTCTACGGCAATGCGGTGCCCAAGACGGCGGAGAATTTCCGGGCGCTGTGCACGGGC

FIG. 2 continued

```
GAGAAGGGGACTGGATCCCAGGGCAAGGCGCTCCACTTCAAGGGCTCGTCCTTCCACCGGATCATCCCCAGCTTCATGA
TCCAGGGCGGGGATTTCACCCACGGCAACGGCATGGGCGGGGAATCGATCTACGGCGCCAAGTTCGCCGACGAGAATTT
CAAGCTCAAGCACACCGGCCCCGGGGTCTTGTCCATGGCCAATGCCGGATCCAACACGAACGGATCCCAGTTCTTCATC
ACCACCGTCAAGACGAGCTGGCTGGACGGCAAGCACGTCGTGTTTGGGAAGGTGATCAGCGGCATGGACGTGGTGTACA
AGGTCGAGGCGGAGGGGTCGCAAAGTGGCTCACCCAAGTCCAAGGTCACCATAGCCGACAGTGGCGAGCTTCCACTATA
GTAATTCTTATTTATATTGTACCCGTTTTCCCCCttgtttaattgAAGAgatTGggTCca > SEQ ID NO:1874  131378 6471_300394_1
cccacgcgtccgcttcttcagtcttttagagatctcacgtttcaaacaacAAGAATGGCGTTCCCTAAGGTATACTTCG
ACATGACCATCGACGGCCAGCCCGCGGGAAGGATCGTGATGGAGCTGTACACCGATAAGACTCCCAGGACTGCCGAGAA
TTTCAGAGCTCTCTGCACCGGAGAGAAAGGTGTTGGCGGTACCGGAAAACCCCTTCACTTCAAGGGATCTAAGTTTCAC
CGTGTGATCCCTAACTTCATGTGCCAGGGAGGAGATTTCACCGCCGGGAACGGAACAGGCGGTGAGTCGATCTACGGGA
GCAAGTTCGAGGACGAGAATTTCGAGAGGAAGCACACCGGACCGGGGATCCTGTCGATGGCGAACGCCGGTGCAAACAC
GAACGGATCTCAGTTCTTCATCTGCACCGTGAAGACCGATTGGCTTGATGGAAGCACGTGGTGTTTGGGCAGGTCGTG
GAAGGCTTAGACGTGGTAAAGGCCATCGAGAAGGTTGGATCATCATCTGGAAAGCCGACGAAGCCTGTGGTTGTTGCCG
ATTGTGGTCAGCTCTCTTAGGATCTTCCTATCATCATCCTTAATTTAGCATCATCGTCGTCATTGTGGTGTCTCTTTAT
GCTTTTGCTTTTGTTATGGAGTCGTTTTAAAATTTGTAGTCATAAGTTTGGTGTGTGTtctCATGGGAACATATataaa
cttgccccttaatattaactccccc > SEQ ID NO:1875  131378 258239_301690_1
GCTCCGGTAGTAAGGTATGGCTAATCCCAGAGTGTTCTTCGACATCACCATCGGCGGCAACCCCGCGGGGCGCATCATC
ATGGAGCTGTTTGCGGACACTGTGCCCAAGACGGCGGAGAACTTCCGGGCGCTGTGCACCGGCGAGAAAGGAATCGGCA
AGAGCGGCAAGCCGCTGCACTACAAGGGATCCAAGTTCCACCGCGTCATCCCCGACTTTATGTGCCAGGGCGGCGACTT
CACCGCCGGCAACGGCACCGGCGGCGAGTCCATCTACGGCATGAAGTTCGCGGACGAGAACTTCCAGAGGAAGCACGCG
GGGCCGGGCGTCCTGTCCATGGCCAACGCCGGGGCCAACACCAACGGATCCCAGTTCTTCCTGTGCACTGTTCCCTGCT
CCTGGCTCGACGGCAAGCATGTCGTCTTCGGCAACGTGGTTGAAGGCATGAACGTTGTCAAGGACATCGAGAAGGTGGG
CAGCCCCTCGGGCAGGACGAGCAAGCCCGTTGTCGTTGCCGACTGCGGCCAGCTCTCTTAGATCTATGTGTTTGTCTGT
CGCTCCCGTTGGGGATGGCGaggTTTCGTTTCTCCTTCAAATCAATGAAAA > SEQ ID NO:1876  131378 254824_301639_1
GTCTTCTTCAGTTTGCCGGAGTCATTTTCCCTTCGAGGGGTTAAGGTTGTCTTTTCACAGCCAATTACTTGAGAATGGC
CAACCCACATGTCTTCTTTGACATGGCCATCGGCGGCGTCAGCGCTGGTCGCATTGTGATGGAGCTGTACAGTGACACA
ACCCCAAGGACTGCGGAGAATTTCCGGGCCCTGTGCACGGGGAGAAGGGCACTGGGAGCAGCGGGAAGCCCCTCCACT
TCAAGGGCTCCTCTTTCCACAGGGTCATCCCCAACTTCATGTGCCAGGGTGGCGACTTCACCCGTGGCAATGGGACTGG
TGGGGAGTCCATCTATGGCACTAAGTTTGCCGATGAGAACTTCTCCAGGAAGCACACAGGTGAGGGTGTCCTCTCCATG
GCCAACTCTGGGCCCAACACCAATGGGTCCCAGTTTTTCATCTGCACTGTCCCCTGCAACTGGCTCGACGGGAAGCATG
TTGTGTTTGGCCGTGTTGTCAATGGGATGGACGTAGTGAAGACCATTGAGAAGGTTGGTTCGAGCTCTGGAAAGACCAG
CAAGCCTGTTGTAGTAGCTGACTGTGGTCAGCTCTAAGCACTAGTTAGTAATATTGATGATAAAGCTTAATAAAGTTTG
CCTGGAGTTGTAATTGGACTAGTTTGGATGG > SEQ ID NO:1877  131378 234453_301201_1
CCAATCCTCCCGTCTTCTTCGATGTCTCCATCGCCGGCGATCCCGCCGGAAGAATCGTCATGGAGCTCTATGCCGATAA
CGTGCCACTCACAGCGGACAACTTCCGTGCACTGTGCACAGGAGGAAAGGTGCTGGCAAAGACACAGGAAACCCACTG
TATTACAAAGGCTCCATCTTTCACCGAGTGATCAAAGGGTTCATGGCTCACGGCGGCGACTTCACCAAGCGGGATGAA
CTGGTGGCGACAGTATATACGGCGGCACCTTCAGTGATGACTCTTTTGTTTTCGCTCATGACTCACCTGGAGTTCTATC
CATGGCCAATGCTGGACCAAATACCAACAAGTCGCAGTTTTCCCTGACGTTTGCTCCAGCCCCGCATCTTAATGGGAAA
CATGTCGT > SEQ ID NO:1878  131378 226296_300995_1
CAATCTCTTTTTCTCCAAATGTCCAACCAGGTTTACTTTGACGTGTCCGCCGACGGCCAGCCCCTGGGCCGAATCGAGT
TCAAGCTGTACAACGACATTGTGCCCAAGACCGCCGAGAACTTCCGAGCTCTGTGCACCGGCGAGCAGGGCTTTGGCTA
CGCCAACTCCATCTTCCACCGAGTCATCCCCCAGTTCATGCTGCATTGTTGGAGACTTCACCCGACACAACGGAACCGG
AGGCAAGTCCATCTACGGCGCCAAGTTCCCCGACGAGAACTTTGAGGCCAAGCACACCCGACCCGGTCTCCTGTCCATG
GCCAACTCCGGCCCCAACACCAACGGCTCCCAGTTCTTCGTGACCACCGTCCCTGCCCTGGCTCGACGGCAAGCACG
TTGTCTTCGGTGAGGTCACCAACGGTATGGACGTTGTCAAGAAGATCGAGTCCTTCGGCTCTTCTTCCGGCGCCACCCG
AGCCAAGATCTCCATCGACAAGTCCGGTGAGCTCTAAGCGGCCAGTACGATACAATCAGTGCTTAGTTAAATATTATTG
TCCCGGTTAATCCGGAAT
```

FIG. 2 continued

> SEQ ID NO:1879 132564 241819_301323_1
CCCACGCGTCGGGAATGCCGTCCGCACTACAGACTCGGACGATGATGGACACGGCAATGCGAATGTATCGTCTACTGCA
TCGTCTCGTGATTGTGCAGCGGCAGCAGCCGGATCTCCGCCTCCCTTCCTCACCAAGGCATACGATATGATTGACGACA
TTTCCTCGGACCCAGTTGTGTCTTGGAGCAACAGAGGCACCAGCTTCGTGGTCTGGAATCCACCAGAGTTTGCACGGGA
TCTGTTGCCCCAGTATTTCAAGCACAGCAACTTCTCCAGTTTCGTGCGTCAGCTCAACACCTATGGTTTCCGAAAAGTC
GACCCGGACCGATGGGAGTTTGCGAACGAGGAGTTCGTCCGAGGCAAGAAGAGCCTGCTCAGAAACATATCTAGGAAGA
AGCCCTCCTCGCAGCAACAGCAGCAGAAAGCAGCCACATGTGAGTCAAAGCTTGGTTTGGAAGCGGAGGTTGACAGACT
CAATCGGGATAAGAACGTGTTAATGCTGGAGCTCGTGAGGCTGAGGCAGCAGCAGCAGCAGGCGGAGAGAGAGCTGCTG
ATATTGGGCCAACGTGTGCA

> SEQ ID NO:1880 132564 272836_200132_1
AAATCCCCTTTAGAAGAAGAGAAAAAAGCCTCTCAAATCTCATCTCAAACCACCTAATTTCTCTCATACTCGCTCGACC
CATGGCTCTATTAGTCGAGAAGACCACCTCTGGCCGCGAGTACAAGGTCAAGGACATGTCTCAGGCCGATTTCGGCCGG
CTCGAAATCGAGCTGGCCGAAGTTGAAATGCCTGGTCTCATGGCTTGTCGTACTGAATTTGGCCCATCACAACCATTTA
AAGGTGCTAAAATTACTGGATCTTTACATATGACCATTCAAACTGCAGTTTTGATTGAAACCCTTACTGCTTTGGGTGC
TGAAGTTAGATGGTGTTCTTGTAACATCTTCTCCACTCAAGATCACGCCGCTGCTGCCATTGCACGTGACAGCGCTGCC
GTGTTCGCGTGGAAGGGTGAAACTTTGCAGGAGTACTGGTGGTGCACTGAGAGGGCACTTGATTGGGGTCCAGGAGGTG
GTCCCGACTTGATTGTCGATGATGGTGGTGATGCTACACTCTTGATTCATGAGGGTGTTAAGGCAGAAGAAGAGTTTGC
TAAGAATGGGACAATCCCAGATCCTAACTCTACCGATAATGCTGAGTTTCAGCTTGTGCTTACTATTATTAAGGAAAGT
TTAAAGACTGATCCTTTAAAGTATACTAAGATGAAGGAAAGACTCGTCGGTGTTTCTGAGGAAACTACCACTGGGGTTA
AGAGGCTTTATCAGATGCAAGCTAATGGAACTTTGCTCTTCCCCGCTATTAACGTTAACGACTCTGTTACCAAGAGCAA
GTTCGACAACTTGTACGGATGCCGCCACTCACTGCCCGATGGTCTCATGAGGGCTACTGATGTTATGATTGCCGGAAAG
GTTGCCCTTGTTGCGGGTTACGGAGATGTCGGAAAGGGATGTGCTGctgccttgaacaaGCTggTGcccgtGTGATTGT
GAccGagattGAcccgaTCTGTgCtc > SEQ ID NO:1881 132564 30880_301001_1
CAAGAACATTCTCAGCTTCTAGAAGGTTTTCTCACCAACCCCCAAATTATGAGAAAATTACGAAATTGGCTAACCAACT
ACAAAAGAATGATTCAATTCACCAAACGAATTAAATGAAGCATTAAATTGAGAGTAAATGAGTTTTCGTTAGAGTGAAA
CTCACGTAAGTGTTGAGCTGACGAATGAAGCTTGAGAAATTATTATGCTTGAAGTATTGAGGAAGAAGATCTTTAGCAA
ACTCTGCTGTTTTCCACACGACAAAAGCTGTTCCTTCTTCGTTCCATGAAACGACGTCGTCTGTGCTATGATCATCAAC
TAGCTGATACGTTTTGCTTAAAAACGGCGCCGGAACTGATCTTTGCGCCGCCGTCACAGCCGTCATCTCCGGCGAACTT
TTTTTATTTTACCACAGAAAAATAAAACTAAAAATAATCTAATACACAAAGAGAAGAAGAAAGATTGGAAATAGAAAGT
CGAAGGAAAAGAATCAGCAACTAAAAAGCAAGAGAGCGGTGAGAAATTCCCAATCCCAGCAATAAAAGCCAGAGAGGA
AAACACGAGAACGGAGAaGaTCGGagtttcg > SEQ ID NO:1882 132564 1117813_301850_1
GTAAACCCCTCTCTCTTTCCACTCTCTCTCTCTGTCCCATTTCCGTCGTCTTTGTTGCAGCTCACTGCAAGTCTTCTTC
CTTCAGGGTGAAGAGGAACTTCTAGAGCTTTGCAACCTTAGCTCGACGGAAATGGCAGCCATGGAACTATCAGTACAGA
AGACCTCTAGCGGTCGGGAGTACAAGGTCAAGGACATGTCCCAGGCTGACTTTGGCCGTCTTGAGCTTGACTTGGCCGA
GGTGGAGATGCCGGGTCTCATGTCCTGCCGAACCGAGTTCGGGCCAAGCCAACCCTTCAAGGGGGCCCAGATCACAGGA
TCCCTCCACATGACCATCCAAACTGCAGTGCTGATTGAGACCCTGACGGCATTGGGTGCTGAAGTCCGCTGGTGCTCAT
GCAACATCTTCTCCACCCAGGACCATGCGGCGGCTGCGATTGCTCGCGACAGCGCTGCCGTTTTGCGTGGAAGGGCAT
GTCCCTCCAGGAGTACTGGTGGTGCACCGAGCGGGCCCTTGaCtggGGtgttggAAGCGgccCTgaccTcATTGTcgat
gacgGAGGa > SEQ ID NO:1883 132564 114975_300010_1
TATATCACTCGGCTCTCACTCTCTTTCATTAATCCCCACAAAACCCACCTTTCAAAACCGTTAATCTTAAGTGTAACTG
AAAAAGTAAAAGGAAATGGAGGATGGAGTGAGAGTGAAGCGGGAGGAAGACGGCGTTGCCACCGCCGTGACGGCGGCGC
CGCTACCAATGGAGGGGCTGCATGACGTGGGTCCACCACCGTTCTTGAGCAAGACTTATGAAATGGTGGAAGACCCTTC
AACGGATGCAGTGATTTCATGCACCAGAGCAAGGAATAGCTTTATTGTTGGGATTCTCATAAGTTTTCAACCACTTTG
CTGCCTAAGCATTTCAAGCACAGTAATTTCTCCAGTTTCATTCGCCAGCTTAACACATATCTTTAGACAGAAGTTCAGA
TAGTCTCTGCAGCTCGATGGTTGGTGGTTCTGATGAATTCTACTGCTTGTGTTTGATGGTTGTACGATGAATACTCGAAG
AAAAGAAGCACGTTAGGGTTTTAGAAAAGTGGATCCGGATAGATGGGAATTTGCGAATGAAGGTTTTCTAGGCGGACAG
AAGCATCTCTTGAAGACCATAAAGAGGAGGAGGAATGTTGGTCAAAGCATGAAC > SEQ ID NO:1884 133405 116682_300079_1
AAGATAAAAAGGGGAAAAGGTCGCCCAGCGGCTGAAACCGGGCTGCATTGCTCCTCGCTGCTTTGGATTCGCACTTCGC
AGCTTGAGACCGGGAGCAGAACGAGCGGCGGAATGGGTTCCGGATCCGGATCTTTCCTCAAGGTGGTGGTAAAGAACTT
GGATGTTCTTGCGGGGCCTATAGTTTCACTTGCTTATCCACTATATGCATCTGTTCGAGCGATAGAAACAAAATCTGCT

FIG. 2 continued

GTAGATGATCAGCAATGGCTCACATACTGGGTGTTGTACTCGTTTATCACTCTATTTGAGCTCACTTTTTCTCCGGTAC
TTGAATGGCTTCCTTTATGGTCTTATGCTAAATTGTTTTTCAATTGCTGGTTGGTCTTGCCCTACTTCAATGGTGCTGC
ACATGTCTATGAACACTTTGTGAGGCCAATGGTTGTCAACCAGCAAATAGTTAATATCTGGTACATCCCAAGAAAGGAT
GAGTCAGATAGACCCGATGATGTGATATCAGCTGCGCAGAGATACATTGAACAAAATGGATCAAAAGCGTTTGAAAGTC
TGGTTAACAAGTTTAAGGCTTCAAACACAAGGCGCTCCATTCTGGAGGAGGTAGAGGCTGAAAGAAGAGCCAAGGCTGA
ACTAGAAGCAGAAGCAAGGGATGAGAATCCTTTCTTCAATCAAAATTATCGGTACTAGAAGTCAGGGTTCATAGGATCA
AATTTATGCTCATGGGGTATGTGTTCAAACGATCATGGATTAGTGTAAATAGGGTCAAGGA

> SEQ ID NO:1885 133405 256510_301673_1
ACGCGTCGATCGGTTCGAAGAAGAAGAAAGAAGAGTTCGAAATTTTTAGAATGGGTGCAGTCTGGGCTGTGATCATCAG
GCTTCATGCCTTCGCAGGGCCGATCCTCTCGGTTCTCTATCCCATGCTTGCTTCCGTCAAGGCGATCGAGAGTCCACGC
AAGGAAGATGATGAGCAGTGGTTAACTTACTGGATCCTCTACTCGCTCATGACACTGTTTGAGGCAGCCGCGTCTCCAG
CTCTGGCCTGGTTTCCTTTGTGGTACCCGCTGAAGCTGGTGCTTCTTTGCTGGCTTGTTCTTCCACAGTTCAAGGGTGC
GAGCTTTGTCTACAACGAGGTCGTCCGCAAGTACGTGGTTAAAAACAGTGGGATGATCAAGGAGAAGGTAGACGAAGTA
ATGGGACCCGAGACGAGGTCGTCCGTGGAGAGGTTCATCAACGAGAATGGACTGGACGCACTAGACAAGCTACTCGCTG
ACGCGAAGAACAAAAAGGAGCCTTTGCCCACTCCCAAGCAAGAATCACAGGAGAGATACTGAAGAAGGCAAGGAACTTT
AGTTCCTTTGTAGCCACCCCATGTACATTCTAACGCATTCTTCATGTCGGTGGGAGTTTAATTAAGCGCTATATTTTCT
TAAAAAAAAAA

> SEQ ID NO:1886 133507 233993_301095_1
AGCGCCTCCATTTCCAGGGATTTGGAACAATGGCCTTCATCCTTCTCCATGGCACTCTCCATGCCACGATCTACGAGGC
CGCCGAGCTGCAGCACGACCATAGCGCTGGGGGTTTCTTCAATAAGATAATTGGTGGCTTCTCGGGTGATGGAGCACAC
AAGCTCTACGCGACGGTCGATCTGGAAAAGACTCGAGTCGGCCGGACACGCATGATCGGCAAAGACGAGACATGGAACG
AGTGCTTCCACATCTACTGCGCACACCACGTCTCCAAAGTGGTGATCACGATCAAGGACGACAAGGCCATCGGGGCCGT
ACTGCTGGGACGAGCAAGCATCGAGGTGTCGGACCTCCTCAGCGGCGAGGTCGTGGAGAACTGGTACAATCTCTACAAC
GACGAAGGTGAGCAGCGTGGCGACTCCAAAGTCCGGGTCCGGCTCCAGTTCCACGACGTAGCCAAAGATCCTCGATTCG
GCAGAGGTCTCCTGGATGGAAGAAAGTTCCAGGGCGTGCCTTTCACGTACTGCCAGCAGCGCAAGGGATGTAAGGTGAC
GCTCTACCAGGACGCTCATATGACCGAGAACTTTCTCCCGGATATC

> SEQ ID NO:1887 133507 1008659_301417_1
AGTTTCCGGAAGGCCATAGCTGCTGTCAGATCGTTCCACTCTCTAGGAGTTCATGGCTCTACATTTGTTACATGGGACC
TTCCACATCACTATCTGCGAGGCTTCAGGGCTACCGAAGCACCATGCTGGGTTCTTACATAGAATCGTGGGACTTGGAG
GGTCGCAACAACTATATGCGACCATAGATATGGAGAGGGCGAGGGTGGGTCGGACAAGGATGATTGATCACGAGCCTAC
AAATCCCTCCTGGAACGAAAGCTTCCACGTCTACTGCGCCTACCATGTGTCCCATGTAGTGGTGAGTATCAAGGATGAC
AATGCAGTGGGTGCGGCAATCGTGGGAAGAGCAAAGATCCCCGTGGAAGATATTTTAGGCGGGGAGGAGATTGACCAGA
CCTATGGCCTCGTCAAAGACAATGGGGA

> SEQ ID NO:1888 133547 114163_300265_1
CAGTTTGGAGCTCTTCCTGTTATGCCAATCCAGGCAATGACACAGCAGGCTACCAGGCATGCTCGGCGAGTTTATGTTG
GTGGACTACCAGCTCATGCAAATGAACAGTCTGTTGCGACTTTCTTTAGTCACGTTATGTCTGCAATTGGAGGAAACAC
AGCTGGTCCAGGGGATGCTGTTGTCAATGTCTATATAAACTATGAAAAGAAGTTTGCTTTTGTTGAAATGAGATCAGTA
GAGGAAGCTAGTAATGCCATGGCATTGGATGGCATCATATTTGAGGGCGCACCCTGTAAGGTCAGAAGACCGAGTGATT
ACAATCCTTCTCTGGCTGCTACTCTTGGTCCTAGCCAACCAAACCCAAACCTCAACCTGGCAGCTGTTGGATTGAGCCC
AGGTTCTGCTGGAGGGCTGGAAGGTCCTGATCGTATTTTTGTTGGTGGTTTGCCCTACTATTTCACAGAGCACAGATT
AGAGAGCTGTTAGAGTCTTTTGGTCCACTTAGAGGATTTGATTTGGTCAAAGATAGAGAAACTGGGAACTCAAAAGGCT
ATGCCTTCTGTGTCTATCAGGATGTCTCTGTTACTGATATTGCTTGTGCAGCTCTTAATGGTATT

> SEQ ID NO:1889 133547 225846_301050_1
GGCGATGCCAGCTCAAGCAATGACTCAACAGGCTACAAGGCATGCGCGCCGTGTGTATGTAGGCGGATTACCTCCCTTG
GCGAATGAGCAGACCATCGCCACATTTTTCAGCCAAGTTATGTCTGCTATTGGAGGGAACACAGCTGGTCCTGGCGACG
CGGTTGTGAATGTGTACATTAATCAAGAAAAGAAGTTCGCTTTTGTGGAAATGCGGACTGTTGAAGAAGCCAGCAATGC
AATGGCTTTGGATGGAATTATATTTGAGGGTGTTTCTGTCCGCGTGAGAAGACCGAGTGACTATAACCCCTCCATGGCT
GCTACACTAGGTCCTAGTCAACCGAGTCCTCACCTAAACCTTTCAGCTGTCGGCCTGACCCCTGGTGCTGCCGGTGGAG
CTGATGGCCCCGACCGCATCTTTGTTGGCGGTCTTC

> SEQ ID NO:1890 134744 1007359_301399_1
CTTCTTCTTCTTTCTCTCTCTCTCTTTGTGTTGGTGTTGGTGTATAGTGGAGATGGCAATGGAAGGGGGGACAAGG
GAGGAATCCAAAGGCTTCTTGCAGCAGAGCAGGAGGCTCAACATATCGTTGCAGCTGCAAGATTAGCAAAGGCAACGAG
GTTAAAACAAGCGAAAGAGGAGGCTGAAAGAGAAGTTGCTGCTTATCGAGCTCAGCGAGAAAGTGAATTCAGAAAAAGG

FIG. 2 continued

CTTGCTGATACAAGTGGAGATTCTGGTTTAAACATCAAGAGATTAGAAGCAGAAACCCACTCAAAGATAGAACAGCTTA
AAGAGGAAGCAGCGAATGTTTCACCTGAGGTTGTGGAAATGATGATAAAATATGTAACAAATGTCAGAAATTGATTTGA
CCTTGGCTTCAGTTTACCCTAAAGTTTAAAGCTTTTAGCAGGAAGTTCAATAGGTATAATGGGTATTNGTTTNGTATCA
GTGTTTATGAATATGCACCATAAGGTTGAAACTAGAAGTTGGTGGACCTGCTAGAGAACTATTTTTGTCTACCATCGAA
CTCGAGTTTCTGCTATGTCCGATTGTAAAGGAGATCATTGATTTGAAGTTTGTGACGAGCACTTCGATGTACACTATTT
ATTGTCATGTAAGTGAATGACTATGGTTTAGTATAGTTATGTAATG

> SEQ ID NO:1891 134744 190552_300693_1
cccccccgacgaaggaagatagattttccccatcgaaatctcgtcgcttccccgggttcgattcgagtcttctctctcg
cAGCACAAAGATGGACGCAAACAGACGCCAAAGTGGAATCCAGCAATTGTTGGCTGCAGAGCAAGAGGCTCAGCAAATA
GTAAATGCTGCTAGGGCTGCAAAATCGGCAAGGCTTAGGCAAGCAAAAGAGGAGGCTGAGAGGGAAATAGCTGAATACC
GTGCCCAGATGGAGGCTGAATTTCAGAGGAAGGTTGCAGAGAGTAGCCGTGACTCTGGTGCAAATGTCAAGCGTCTTGA
GCAGGAGACAGCGGAAAAAATCGCACAACTCAAGCAGCAGGCTGCAAGTATCTCCCCTGAAGTGATTCAGATGCTTCTG
AGGCATGTCACCACTGTGAAGAACTAAGGGTTGATGGCTTGCTGCTAGGCGATTTGCCATACATCTGATGGCAAACTTG
TACTGTTTATTTTTGAGAGGGTGGTAAGAATAACTTCGTCTCTTCTAGCTGTAATTCCGtGTTCCGAATAACGGAATA
AACTGCTTCTGTTCATCAGCAGCCATGTTTCGTACTTTGAAAACCTCGGTTCCTGTCTGGTAAATATTATCCTTTCATG
TATCATTTGAATAAAATAATGGGAGATTCTTTTTGTTT > SEQ ID NO:1892 134744 1119338_301896_1
GAGAGGGATAGGGAGAGGGAGAGGCAGAGAGAGAGAGAGAGAGAGAGAGAGTGGCGATGGCTTCTGACCAGGGAGGAAT
CCAGAAGCTTTTGGCTGCAGAGCAGGAAGCCCAGCAGATCATTTCCTCTGCTACATCAGCTAAGGCAACTAGACTGAAA
CAAGCAAAATAAGAAGCTGAGAGAGAAGTTGGTGCTTATCGTGCACAACGTGAAAGTGAATTTCGAAAAAGATTGGCTG
AGACAAGTGGAGATTCTGGTTCCAACATCAAGAGGCTATAAGCTGAAACGCATACAAAAATTCATCATCTTAAGCATGA
ATCGGCACATATATCTCCTGAGGTGGTGCCGATGCTTATTACCTACGTCACGACTGTAAAAAATTGAGGGAGGGAATAT
TTTGAGGCGGAGG > SEQ ID NO:1893 134744 119830_300360_1
cccccgatacAAAATCCAATTCCAGAAAGGCCTCAACTTTCGCAGCAACCGATTCTCAACTCCGATTCCACAGAGTTG
TCTTAGTGTTATAGACGAGTATGGCATCTAGCAGTGGCCAGAATGGAATTCAACTCCTTTTAGCTGCCGAACAGGAAGC
CCAACACATTGTAAATACCGCCAGGACTGCTAAACAGGCTAGATTGAAGCAGGCCAAGGAAGAAGCTGAGAAGGAGATA
GCTGAATTTCGTGCTTACATGGAAGCTGAGTTTCAGCGAAAGCTTGAACAGACTAGTGGTGACTCTGGCGCTAATGTCA
AACGTCTTGAGCTAGAAACAGATGCAAAGATCGAGCACCTGAAAACTGAAGCAGAAAGAGTCTCCCCTGATGTTGTCCA
GATGCTCCTGAGGCACGTAACCACAGTGAAGAACTAAGATCTTCTGTGCGTGTAGTGGGTCAGGCTTAATGTTCATTTT
GCAGATTTATGAACCACCCTTGTTTGATCAGTCCAATGGTGCTCTCCATTTGTATTTTATGTTTATTATCATTATTTTA
TTgtCTTGTCTGTTGAATAAAACAACTCACTCGAGCTCGTTTCAACCCGTGTGTTGTAAACTTAGATGAGAAACcaagg
TCAgaTGAGTAGGCATGGCTGCTCCTTATTTATCTAGAACTgaggagTCTTTGATTCTCaAAAatAGCTg > SEQ ID NO:1894 134962 136893_300439_1
ccccccggatcgatctcgtcgtcggcgatggagaagttgctttcctcctccggcgccgccgccgcgtggcgtcgcag
gGCCAGCTCCCGGACTGCTTCGTGTTCCCGGCCGACCGGCGCCCACCGGCCTCCACCGCGGCCGTGTCGCTCCCCGTCA
TCGACCTCTCCGGCCCCCGCGACGCCGTCCGCCGCGCCGTCCTCGACGCCGGCAAGGAGCTCGGCTTCTTCCAGGTGGT
GAACCACGGCGTGCCGCCGGAGACGATGCGGGAGATGGCGGCGGTGTGCGAGGAGTTCTTCCGGCTGCCGGCGGAGGAC
AAGGCGGCGTTCTACTCCGACGCGGAGGAGAACCCCAACCGCCTCTTCTCCAGCACCATCTACGAGGTCGGCGACCAGC
GCTACTGGCGCGACTGCCTCCGCCTCGCCTTCCCCGTCGCCGACGACACCAACACCCACTggCCCGACAAGCC
CCACCATCTCCGGGATGTCACGGAGAAGTTCTTCGTGGCGACGAGGGGATTGGGGATCGAGCTGCTGCGGCTGCTGTGC
GAGGGGATGGGGCTCAGGCCGGACTACTTCGAGCGCGACCTCACCGCCGGCGATGTCATCATCAACGTCAACCACTACC
CTCCATGCCCGGATCCGAGCCTGACGCTGGGCTTGCCGCCGCACTGCGACCGCAACCTCATCACCCTGCTCCTCCAGGG
CGACGTCTTCGGCCTCCAGGTCTCCTACAATGGCGACTGGATCAACGTCGACCCCGTCCCCGACGCCTTCGTCGTCAAC
TTTGGCCACCTCCTCGAGATTGCGACGAACGGAGTGCTGAAGAGCATCGAGCACAGGGCGATGACGAACTCGGCGGTGG
CGAGGACGTCGGTGGCGACGTTCATGATGCCGCCGATGGACTGCCTCGTCGGACCGGCGAagGAGCTCGTCGGagacgG
CGGCCagCCGCAGTATCGCACCGTCACGTTCcGCgagttCATGCGCAtctAcaagaccgtCgGCGCGCGccgcgacaGC
GTc > SEQ ID NO:1895 134962 209306_300814_1
GATCGATCTCGTCGTCGGCGATGGAGAAGTTGCTTTCCTCCTCCGGCGCCGCCGCCGCCGTGGCGTCGCAGGGCCAGCT
CCCGGACTGCTTCGTGTTCCCGGCCGACCGGCGCCCACCGGCCTCCACCGCGGCCGTGTCGCTCCCCGTCATCGACCTC
TCCGGCCCCCGCGACGCCGTCCGCCGCGCCGTCCTCGACGCCGGCAAGGAGCTCGGCTTCTTCCAGGTGGTGAACCACG
GCGTGCCGCCGGAGACGATGCGGGAGATGGCGGCGGTGTGCGAGGAGTTCTTCCGGCTGCCGGCGGAGGACAAGGCGGC
GTTCTACTCCGACGCGGAGGAGAACCCCAACCGCCTCTTCTCCAGCACCATCTACGAGGTCGGCGACCAGCGCTACTGG

FIG. 2 continued

```
CGCGACTGCCTCCGCCTCGCCTGCGGCTTCCCCGTCGCCGACGACACCAACACCCACTGGCCCGACAAGCCCCACCATC
TCCGGGATGTCACGGAGAAGTTCTTCGTGGCGACGAGGGGATTGGGGATCGAGCTGCTGCGGCTGCTGTGCGAGGGGAT
GGGGCTCAGGCCGGACTACTTCGAGCG

> SEQ ID NO:1896 134962 233070_301275_1
AGTTCTTCCGCGGCAGAGTGACTCAGGCGTAAAAAACCTGGTAAATTCTGGCATTGACAAGCTCCCCGATGCATACGTC
CAACCAAAAGGCGAGCGTCCAGATGCAGTTCATCACGAAGCAAGCTTCCCCGTTCTGGATATTGCATCGGCTTTGGATT
CCAGCCATGGCCGGGCAGCACTTGTCTCACAAATCCGCGAGGCTTGCAAGAAATGGGGCTTCTTCCAGGTGATCAATCA
TGGCGTTCCAAACTCTGTGATTGATGAGATGACATCGGTGGCTCGTGAGTTTCATGCTCTACCAAACGAGGAGAAAATG
CGCTACTTCTCCACGCATACCAAATCTCCAATGCGATTTGGAACCAGCTTCAATATCATGCAGGACGAGGTTCTTAACT
GGAGAGACTATCTCCGCCATAGCTGCCTTCCACTGTCCGAGATGCAAAAGCTCTGGCCAGAAAAGCCAGAATCATACAG
GAAAATTACGGGTGACTATGCAACTCGCCTTCTAGATCTTGGCAAGCTCCTTCTGGAGCTTGTCTCGGAGAGCTTGGGT
CTCCCAAGTGACTACATAGACAATGCTTTCCAAGGCTGCTCGCAAATCATGGTTCTCAATTACTATCCCGCTTGTCTGG
AGCCAGATCTGGTG

> SEQ ID NO:1897 134962 241157_301320_1
GATAGTTTTAGGAACAATGCCGACTCAGGGAGTCAAGGAGCTAGTGGAGAATTCTCAAGATCATATACCAGATAAGTAT
ATCAAGCCCGAGCGTGCCCGTGTTAGATACAACAGTTCCACAGCAGGGATTCCCCTCATTGACCTCGCTGAAATCCATG
GACAAGGAAGAAGTGATGTTCTTCGTGCCATAAGAGATGCGGCAGGAGAGTGGGGATTCTTCCAGGTGATCAATCACAG
CGTTCCACCAGCTTTGATGGAGGCTATGATGAAGGCTGCTCGTGAGTTCTTCGACCTGCCTCTAGAGGAAAAAATGGCA
TATTTTTCTGAAGATTTTGAGGAGAGAATTCGTTTCTGCACCAGCTTTGTTCCTTCAACGGAAGAACGCTGGGACTGGC
AAGACAACCTCTCGCATACTTTTCCACCTTACGGAGACGATCACCCCTGGCCAAAGAAGCCACACTTGTACGAGGAAGT
TGCGAAGGAGTATCTCCACCAGGTTTTGGAGCTGGGGAACGCAATCGCAGGTGCAATCTCTGAAAGCTTGGGCTTAGAA
AAAGACTTTCTCCTAAAGGCGTTCGGAGAGGGCAGGCACAACATGCGTCTAAACTATTATGCACCTTGTCCAAGACCCG
ATCTTGCAGTGGGCTTCAGTCCTCACTCCGACTTCGGAGGTTTTACCATCCTGATGCAAGAccAAGTAGGAgggcttca
gGTGAAAAGgacgacgACTGGTACTttgTcaaACCAGTCaaGCACTCCTTCGTggTcaatatcAGTgATCaa > SEQ ID NO:1898 135016 136901_300440_1
ccaaaaaaaaaggaaaaaaaaaagCCAAAACACACCAAGCCAAATAAAAGCGACAATGGGATCGCTCACCACCAACATC
GTCCTCGCCGTCGCCGTGGTGGCCGCGCTGGTCGGCGGCGGGTCGTGCGGCCCGCCCAAGGTGCCACCCGGCCCGAACA
TCACGACCAACTACAACGCCCCGTGGCTCCCCGCCAGGGCCACCTGGTACGGCCAGTCCTACGGCTCCGGCCCCGCTGA
CAATGGTGGCGCGTGCGGGATCAAGAACGTCAACCTGCCTCCCTACAACGGCATGATCTCCTGCGGCAACGTCCCAATC
TTCAAGGACGGCAGGGGATGCGGCTCATGCTACGAGGTGAAGTGTGAGCAGCCGGCGGCGTGCTCGAAGCAGCCGGTGA
CGGTGTTCATCACGGACATGAACTACGAGCCCATCTCGGCGTACCACTTCGACTTCTCCGGCAAGGCGTTCGGCGCCAT
GGCTTGCCCGGGGAAGGAGACCGAGCTCCGCAAGGCCGGCATCATCGACATGCAGTTCAggaGGGTGCGCTGCAAGTAC
CCCGGCGGCCAgaaggtCACCTTCCACGTCgagaagggCTCCAACCCCAACTACCTCGCCGTGCTCGTcaagtTCGTCG
Cc > SEQ ID NO:1899 135016 197879_300701_1
AAAAAAAAAAGGAAAAAAAAAACAAAACACACCAAGCCAAATAAAAGCGACAATGGGATCGCTCACCACCAACATCGTCC
TCGCCGTCGCCGTGGTGGCAGCGCTGGTCGGCGGCGGGTCGTGCGGCCCGCCCAAGGTGCCACCCGGCCCGAACATCAC
GACCAACTACAACGCCCCGTGGCTCCCCGCCAGTGCCACCTGGTACGGCCAGCCCTACGGCTCCGGCTCCACCGACAAT
GGTGGCGCGTGCGGGATCAAGAACGTCAACCTGCCTCCCTACAACGGCATGATCTCCTGCGGCAACGTCCCAATCTTCA
AGGACGGCAGGGGATGCGGCTCATGCTACGAGGTGAAGTGTGAGCAGCCGGCGGCGTGCTCGAAGCAGCCGGTGACGGT
GTTCATCACGGACATGAACTACGAGCCCATCTCGGCGTACCACTTCGACTTCTCCGGCAAGGCGTTCGGCGCCATGGCT
TGCCCGGGGAAGGAGACCGAGCTCCGCAAGGCCGGCATCATCGACATGCAGTTCAGGAGGGTGCGCTGCAAGTACCCCG
GCGGCCAGAAGGTCACCTTCCACGTCGAGAAGGGCTCCAACCCCA > SEQ ID NO:1900 135016 189151_300613_1
attcaCAAATAACTAACACCCATCAGCAACAATGGCATCCTCTTGTCTCCTTCTGGCCTGTGTCGTGGCAGCGGCCATG
GTGTCTGCAGTGTCATGTGGGCCGCCCAAGGTGCCGCCTGGCCCCAACATCACTGCGGCCTACGGCAAACAGTGGCTGG
AAGCTAGGGGTACCTGGTACGGCAAGCCAAAGGGTGCCGCCCGACGACAACGGCGGCGCTTGTGGGTACAAGGACAT
TGACAAGGCTCCCTTCCTCGGCATGAACTCATGTGGCAATGACCCTATCTTCAAGGATGGCAAGGGCTGCGGCTCCTGC
TTTGAGGTCAAGTGTTCCAAGCCAGAGGCCTGCTCCGACAAGCCCGTCATCATCCACATCACCGACATGAACACTGAGC
CTATCGCCGCCTACCACTTCGACCTCTCCGGCCATGCTTTTGGTGCCATGGCTAAGGAAGGCAAGGATGAGGAACTCCG
CAAGGCGGGAATTATCGATATGCAGTTTCGTCGCGTCCGCTGCAAGTACCCTGGTGAGACTAAGGTCACCTTCCACGTT
GAGAAGGGCTCCAACCCCAACTACTTTGCAGTGCttTgtcaaGtACGTCggTGgt
```

> SEQ ID NO:1901 135016 196563_300704_1
TCCACCAGCAATAACATTATATTGCAGCAATGGCATCCTCCTCCCTTCTACTCGCCTGTGTTGTGGTGGCGGCTATGGT
GTCCGCCGTCTCCTGCGGGCCACCCAAGGTGCCACCGGGCCCCAACATCACGACAAGCTACGGCGACAAGTGGCTGGAA
GCCAAGGCCACCTGGTATGGTGCGCCCAAGGGTGCTGGCCCCAAGGACAACGGCGGCGCCTGCGGGTACAAGGATGTCG
ACAAGGCTCCCTTCCTCGGCATGAACTCCTGCGGCAACGACCCCATCTTCAAGGACGGCAAGGGCTGCGGCTCATGCTT
CGAGATCAAGTGCTCCAAGCCGGAGGCCTGCTCCGACAAGCCCGCCCTTATCCACGTCACCGACATGAACGACGAGCCC
ATCGCTGCCTACCACTTTGACCTCTCCGGCCTTGCCTTCGGCGCCATGGCTAAAGGATGGCAAGGACGAAGAGCTCCGT
AAGGCCGGCATCATCGACACGC

> SEQ ID NO:1902 135016 194491_300763_1
CCCCCCCCCGAAAAACAAAACCCCCACTCATCTCAGTGCGGGCTCTTTCTCTTCTCTTCAGTTCACCACCGGCACCTCT
CTCATCGGATCCCTGCAGAGGAGGAAAGGGCAGTGGCGGCGAAAGGCGACATGGGCTCCCTGTCCTCTCTCGCCGCCGC
GGCGGTGTTTCTCTCCCTCCTCGCCGTCGGCCACTGGGCCGCCGCCGATTTCAACGCCACCGACGCCGACGCCGACTTC
GCCGGCAACGGCGTGGACTTCAACTCCAGCGACGCCGCCGTCTACTGGGGCCCCTGGACCAAGGCCAGGGCCACCTGGT
ACGGCCAGCCCAAGGGCGCCGGCCCCGACGAAAACGGCGGTGCGTGCGGGTTCAAGCACACCAACCAGTACCCGTTCAT
GTCGATGACCTCCTGGGGGAACCAGCCATTGTTCAAGGACGGCAAGGGAT

> SEQ ID NO:1903 135042 120360_300384_1
CTCTTAGATAATTTAGCATGCAAAAAAGAAAAAGATCATTCAAAAGATTATAGTCATAAACGACATAGAGAAACAAATA
TTCTACAATGAAGTACTACTATATCAACTTCTTTCTCTGCTTTTGAGATCCTTCTTATGTCCTTTCAAGATTTTGGGTG
CTTTTGAAGCTGTGAACGAGCAGCAAAAATAGAAAACAGAGAAGTACTTAAGCAATGGAGAAATTTTCTGGGCTTAGCC
ACCTATTTATGACAGTATTTCTGAGTTGCTTCTCTACATTTATGGTGATTCCACCTATGACTGATATCACTTTATCAGC
CATTTGTCCAGGCAAAGATGAATGCTCCCTTGCTATTTACCTCACTGGAATTCAACAAGCGATTGTAGGAATGGGATCA
CTAGTGATGATGCCAGTATTGGGGAATTTGTCAGACACTTGCGGTAGAAAAATCATACTAACTGTTCCCATGACCCTTT
CCATCTTCCCTCTAGCGATATTAGCGTACAGCAGGACAAAGTACTTCTTCTACGCTTACTACGTGCTAAGAACTCTCAT
TGCCATGATTTGCGAAGGAAGCGTTCAGTGTCTTGCTCTTGCCTATGTGGCTGATAATGTTCCAGAAAGTCGACGAGCC
TCCGTTTTTG

> SEQ ID NO:1904 135085 108013_300057_1
TACTCTTCAACTCAATTTTTATGAACATTGAAAAAAGAAATCTAATTAAGTAATGGCAGTGTCAGCGGTAGCAACTCTTC
TATTTCTTCTTGTTGCTTCTCCGGTTGCTTTTGCCGCCAACCATGTCGTTGGAGGCAGTGGCGGGTGGAGCCAGACCGT
AGATTACTCCACTTGGGCTGCTGGTGAAACCTTCAACGTTGGTGACACCCTTGAGTTCAACTATGGTGCAAGCCACAGC
GTGGATGTAATAAGCAAAGATGACTATGAAAATTGCAACACCGGAAACGCCCTCGAGTCTCACAGCGACGGCAAAACCA
CCATCAAACTTTCCAAGGCCGGTCCAATGTACTTCACTTGTTCCACATTTGGTCACTGTCAATCTGGCATGAAATTAAC
CGTCGATGTCAAAGATAGCTCCTCCACTCCGTCAACTCCGTCAACTCCTTCAACTCCTTCAACCACTCCTTCAACTCCG
TCAACCACTCCTTCAACTCCTTCTGACTCACCCACCACACCCACCCCTGAGGTTGGCAACTCGCCGTCGAAGTCGACAC
CTGTAGCACCTAACGGAGCAGCCGGAGTTATGGGCAAAACTGTAGTCGGATTTTCAGTTGTGTTGGGAGCTATG

> SEQ ID NO:1905 135085 201111_300713_1
CGCCCATTCGTCTCAAACACACATTCTTTGATTCTTCCTTCAATTTCCCCTTTTCAACTCTGTCATCAACTTAATTGTT
AGAAGCGACCTAAAGATTTTGCGGCCGATCGAGCATGGCGTCCCCTTCGGCTCTGATCGCAATGCTCCTCGTCATGGTC
GTCGGCTGCGCCGCCGTGGCCTCGGCGATGGAGCTGAGTTTCATTGTCGGAGATGCGCAGGGTTGGAACACCGGCGTCG
ACTACACCGCTTGGGCGAAGGGCAAAACCTTCGAGGCTAACGACACGCTTGTATTCAGATACGCCAGGAAGCAGCACAC
GGTGACAGAGGTGACCAAGAGCGACTACGACGCCTGCACCGTCAGCGGCAAACCGATCAGTGATTTCGAAGGAGGCGCG
CTTGTGACATTCATAGCGCTCAGCCCCGGCGAGCACTACTTCATCTGCAAAATCGGCAACCATTGCGCCAGCGGCATGA
AGCTCGCCGTCACCGTCTCCAACTCCAGCGACACCCCGAGGCCGCAACCTTGGATTGGGCCTTACTCCACGCCAGCCAG
CGCGTCCGCACACCTGCACGCCGGTGGCGCCGTCGTCGCGGCGGCCGTTGGGATCCTCCTCAATCTCGCCCTCTTCTGA
GATCGCATTGACGC

> SEQ ID NO:1906 135085 201162_300713_1
ATCGATTTCTAGCTTAGCTTCTACTGCCAATTGCTTGGAGATCGATCGACCATCATCTCCATCGAGCCTCAAAGTCGAT
ATATAGCTAATTGGACCATATTCCATGGCGATCATGGCAGCCAGAGCTCTCCTCGTCGTCGCCATGGCGGCGGCGGTGC
TCGGAACGGCGCTCGGCGCCACCTACACCGTCGGAGCTCCGAGCGGCTCATGGGACTTGAGGACTAACTATGACCAGTG
GGTTTCCAACATCAACTTTCGTGCCGGAGACCAGATAGTGTTCAAGTATTCTCCAGCGGCTCATGATGTGGTGGAGGTG
AACAAGGCCGACTACGACTCATGCTCCAGCTCCAGCCCTATCGCCACCTTCAACTCCGGCGATGACACCATCCCTCTCA
CCGCTGCCGGCACCCGCTACTTCATATGTGGCTTCAATGGCCATTGCACCGGAGGGATGAAGGTCGCTGTCAAGGTTGA
GGCCGCCACCGGCAGCAACCCGGCCCCATCACCGATGACCCCTCGACCACGCACACCGACAGCAATGGCACCGAACGCA
ATGCCGCCAACGGCTGGTGGCCGGCCCGTGCCTCCATCTAACTCAGCAAGCCAGCCCACTGGTGTTGCATCTCTAGTTG
GTCTTAGTTTGGGTGCCATAGTTGTTGGTCTCATGGCCTTCTAAATTAGAGTAAGAAGATACT

FIG. 2 continued

> SEQ ID NO:1907 135085 187790_300680_1
GGCAATGGCAATGGCCATGAACAGTGTGCTGGTGGTGATGCTCGGGCTCGCAATGGCGGCGACATCGTCGGCGGCGGTC
TACAAGGTCGGCGACACCTCCGGCTGGACCATCCTCGGCAATGTCAATTACACTGACTGGGCTGTCAAGAAGACCTTCC
ATGTTGGGGACACCATAGAGTTCAAGTACCCGCAGGGGATTCACAACGTGGTGGAGGTGAAGAAGGCGGACTACGACAG
CTGCACCAACTCGTCGCCGATCGCCACGCACACCTCCGGCGACGACAAGATCGCCATCAAGGCCGCCGGCCACCGCTTC
TTCATCTGCGGCGTCCCCGGCCACTGCGCCGCCGGCCAGAAGGTCAACATCCGCGTCCTCAAGCCACAGCGCTCCTCCT
CCTCTGACGCCCCTTCCCGGCGCCCGCCGCCTCCAAGCGCGGCGCCGCCGCCGCGCCGTCCCCGCCGTCTCGTCGTC
GCCGCCGGAGTCCTCCTCCCCCACCACGGACAGCTCGTCCTCCTCCACGACCACCGCTCCGGCGCCCAACGCCAGCGCC
GCCGCCGGCGGCGGCGGCGCTAAGGCGGCCTTCGCTGCCGTGGCGTTGGCGCTGGTCGCCGCCACGGCGATGCTACAGT
AA

> SEQ ID NO:1908 135085 25166_300389_1
ATAGAAAATTAGATCAGAAATGCAAATATCCGAACTATATAAAATACAACAACAAGTACGAATTAATAATTCCAAAAAT
ATTTATTCTCTCCCCACCAAATATATTCGATACATTACAAAAAAGCCCTAGACAATTATTAGTAAGCCCAAATAAGACC
AATAACCAACGATCCAACAACGAACATGTACCCAATGGAAGCACGTAGCCCATCACCCGAACTAGATTTAGAACCCGAC
CCTGAATCTGAACCCGAACCCGAACCTGAAGGAGAGGAACCGGATTTGGAGTCAACAACGTTGACTTTGATCTTCATGC
CTTGTTCGCAATGTCCAACGGTTCCACAAACGAAGTAACGAGTACCGGTTTTGGAAAGCTTAACGACGTCGTTTCCAGA
GCTTAAGGAGTTAACTGATGTTCCCAGGTCACAACTCTTGTATGCCGTTTCACTTCCTAGCTCCACAACGCTGTGTAGT
CCTGAATACTTAAAAACAATTTGGTCGCCGACTTTGAAAGATTGATCAGAAGACCAAGAATCAAAATCAACGGATTGTT
CCCAGCCTTGGCTACCGCCGATCACATGTTGTGCTGCTAACGCTGTCTTAACCGAAAGTAAACCGGAGAAAACCAAGAT
AACAAGAACTGCTTGCATTTTCATTGGTTTAGTGAATTGAACTCGGACGCGTGGG

> SEQ ID NO:1909 135085 255205_301647_1
GGATCTGCTAGAGCTACTGAGCACATTGTGGGAAGCTCTGCGGGATGGCTTGTTCCGTCTGCGAACGTAAATTACACCA
CCTGGTCTTCCACAAATATCTTTCATGTCGGAGATACCCTCTTGTTTAAGTACAGCAATATCAGTCACAATGTGGAAGA
AGTGACTGAAGCCAACTACAACGGATCGCAACACGGTAAGCCCCATATCTACTTACACGGATGGAAACACGACAATCGAA
CTCACCAAGACAGGCATGCATTACTTTCTATGTGGTTTCCCGAGCCACTGCCTGGGGGGTCAAAAGGTCTCTGTAAATG
TAGTTGCGGAGGGCACAACATCCAACTCAACATCCAACTCAACTGGGTCCTCAAGTGGGGTTTCGCTATTGGATTTTAA
TC

> SEQ ID NO:1910 135224 247843_301577_1
AGCATCTCCTCGGCGGCGGCGGCATCGGCGCCTAGATCTAGCTCCATCTCCCGGCAGCAACAAGGATAGAAATGGCTCT
CTCCGTGGAGAAGACCGCCGCTGGCCGCGAGTACAAGGTCAAGGACATGTCCCAGGCCGACTTTGGACGGCTGGAGATC
GAGCTAGCGGAGGTGGAGATGCCCGGCCTCATGGCCTGCCGGACCGAGTTTGGCCCGTCCCAGCCGTTCAAGGGTGCCC
GAATCACCGGCTCTCTCCACATGACCATCCAGACGGCCGTGTTGATCGAGACCCTGACCGCTCTAGGGGCCGAGGTACG
CTGGTGCTCGTGTAACATCTTCTCCACCCAGGACCACGCCGCCGCCGCCATCGCCCGCGACAGCGCCGCGGTCTTCGCC
TGGAAAGGCGAGAACTTGCAAGAGTATTGGTGGTGTACCGAGCGAGCTCTCGACTGGGGAGTTGGCGGCGGTCCGGATC
TTATCGTGGACGATGGCGGCGACGCGACTTTGCTCATCCATGAGGGTGTCAAGGCCGAGAAGGAGTACGAGAAGAATGG
GACGCTGCCGGATCCGAGCTCGACGGCCAACCAGGAGTTCCAGATCGTGCTGGGGATACTCAAGGATGGTATGCAGGCT
GACCCGAAGAAGTACCATAAGATGATGga

> SEQ ID NO:1911 135224 255190_301642_1
ACGCGTCGGTAATCTAAACCTCTCCCCTCTCTCTCTCTCTCTCCTTCGGTTCTATTTCCGTCGTCTGTGTTGCAGCT
CCCTGCAAGACTTCTTCCTTCAGGTGAAGAGGAACTTCTAGAGCTACGCAAACCTTAGCTTGACGGAAATGGCAGCCAT
GGAACTATCAGTACAGAAGACCTCTAGCGGTCGGGAGTACAAGGTCAAGGACATGTCTCAGGCTGACTTTGGCCGACTT
GAGCTTGATTTGGCTGAGGTGGAGATGCCGGGGCTCATGTCCTGCCGAACTGAGTTTGGGCCAAGCCAACCCTTCAAGG
GGGCCCAGATCACAGGATCCCTCCACATGACCATCCAAACCGCAGTGCTGATCGAGACCCTGACAGCGTTGGGTGCCGA
GGTCCGCTGGTGCTCGTGCAATATCTTCTCCACCCAGGACCACGCA

> SEQ ID NO:1912 135224 41510_300204_1
ctcgagcttgcggccgctctagcTCAACCATGGCGTTGCTCGTCGAGAAGACCTCAAGTGGCCGTGAATACAAGGTCAA
AGACATGTCTCAAGCCGATTTCGGTCGTCTCGAACTCGAGCTCGCCGAAGTTGAGATGCCTGGACTCATGGCTTGTCGT
ACCGAATTCGGACCTTCTCAGCCATTCAAAGGCGCTAGAATCACCGGATCTCTTCACATGACCATCCAAACCGCCGTAC
TCATCGAAACCCTAACTGCTCTCGGTGCTGAAGTCAGATGGTGTTCCTGCAACATCTTTTCCACTCAAgaccacgcCgc
cgca

FIG. 2 continued

> SEQ ID NO:1913 135224 11120_300288_1
CTCGAGCTTGCGGCCGCCTCAGATCTAGCTCAACCATGGCGTTGCTCGTCGAGAAGACCTCAAGTGGCCGTGAATACAA
GGTCAAAGACATGTCTCAAGCCGATTTCGGTCGTCTCGAACTCGAGCTCGCCGAAGTTGAGATGCCTGGACTCATGGCT
TGTCGTACCGAATTCGGACCTTCTCAGCCATTCAAAGGCGCTAGAATCACCGGATCTCTTCACATGACCATCCAAACCG
CCGTACTCATCGAAACCCTAACTGCTCTCGGTGCTGAAGTCAGATGGTGTTCCTGCAACATCTTTTCCACTCAAGACCA
CGCCGCCGCAGCCATCGCTCGTGACTCCGCCGCTGTTTTCGCCTGGAAAGGTGAGACTCTTCAGGAGTACTGGTGGTGT
ACCGAGcgtgCtCTagaTTGgGGTccaggtggtggtccTGATCTGAttgttgATGATggtggtgacGctactctTTTGA
TTCAtg > SEQ ID NO:1914 135224 183535_300623_1
CCACCCTCTCGCCGTCGCAGATCCGATCCAGGAAGAGCTCGCCGCCGCCGCTGCCATGGCGCTCTCCGTGGAGAAGACC
TCGTCGGGGAGGGAGTACAAGGTGAAGGACCTCTCCCAGGCGGACTTCGGCCGCCTCGAGATCGAGCTCGCCGAGGTCG
AGATGCCGGGGCTCATGGCGTGCCGCGCCGAGTTCGGCCCCTCCCAGCCGTTCAAGGGCGCCCGGATCTCCGGGTCCCT
CCACATGACCATCCAGACCGCCGTCCTCATCGAGACCCTCACCGCCCTTGGCGCCGAGGTCCGCTGGTGCTCCTGCAAC
ATCTTCTCCACGCAGGACCACGCCGCCGCCGCCATCGCCAGGGACTCCGCCGCCGTGTTCGCCTGGAAGGGGGAGACCC
TCGAGGAGTACTGGTGGTGCACCGAGCGCTGCCTCGACTGGGGCGTCGGCGGCGGCCCCGACCTCATCGTCGACGACGG
CGGCGACGCCACGCTGCTCATCCACGAGGGCGTCAAGGCCGAGGAGGAGTTCGAGAAGTCAGGCAAGGTCCCCGACCCG
GAGTCCACCGACAACGCCGAGTTCAAGATCGTGCTCACCAT > SEQ ID NO:1915 135224 111526_300039_1
cggacgcgtgggcggacgcgtgggcAAAAACTCCATTGAAGAGAGGCCTACATTTCCTCTTTCTCTCTCTCCTATTTTA
CTCTCTCTCTCTCTAGCCATGGCTTTGCTCGTTGAGAAAACCACCTCTGGCCGTGAGTACAAGGTCAAGGACATGTC
TCAGGCTGACTTCGGTAGGCTCGAAATCGAGCTTGCCGAAGTCGAAATGCCTGGTCTTATGGCTTGCCGTACCGAATTT
GGTCCGTCACAGCCATTTAAAGGCGCTAAAATTACCGGATCTCTACACATGACCATTCAAACCGCTGTCCTTATCGAAA
CCCTAACTGCTTTAGGCGCTGAAGTTAGATGGTGCTCTTGCAACATTTTCTCTACCCAGGACCACGCCGCCGCTGCCAT
TGCCGCGTGACAGCGCTGCCGTGTTTGCGTGGAAGGGCGAGACGTTGCAAGAGTACTGGTGGTGTACTGAACGCGCCTT
GATTGGGGCCCGGGTGGTGGACCAGATTTGATTGTTGATGATGGTGGTGATGCTACACTTTTGATTCATGAAGGTGTAA
AAGCTGAAGAGGAATATGCTAAATCTGGTAAATTACCAGATCCAAGTTCTACTGATAATGCTGAGTTTCAGCTTGTGCT
TACTATTATTAGGGATGGGTTGAAAACTGATCCTTTaaaATACACTAAAATGAAGGAGCGAc > SEQ ID NO:1916 135281 138595_300709_1
cccccccccgatcgagtcgccggattggtaGCCGCCCTGCTCGTGCTGCATTCGCTAGCCACGCCGTCCGCTCAGGCCG
AGGCGCATCGCGCAGGGGGAGAAGGGGAGGAGGAAGAtgtcgAGCGACGGAGGGCCGGTGCTTGGCGGCGTCGAGCCGGT
GGGGAACGAGAACGACCTCCACCTCGTCGACCTCGCCCGCTTCGCTGTCACCGAGCACAACAAGAAGGCCAATTCTCTG
CTGGAGTTCGAGAAGCTTGTGAGTGTGAAGCAGCAAGTTGTCGCTGGCACTTTGTACTATTTCACAATTGAGGTGAAGG
AAGGGGATGCCAAGAAGCTCTATGAAGCTAAGGTCTGGGAGAAACCATGGATGGACTTCAAGGAGCTCCAGGAGTTCAA
GCCTGTCGATGCCAGTGCAAATGCCTAAGGCCCATCTCGTATCCTATGTGTATCAAGTTATCAAGAAGATGGGGAATAA
TATGGTGTGGATATAGCTATTGGACATGTTAATTATCCACATGATAATATGGCTTGGATATAAGGATCTCACACGATAA
TATGGCTTGGATATATAGCTATTAAAGATTTTACCTATGGCATATTTCAATGTGTATTAGTACTAAGTAAGAATGATTG
CAAGGTGTATTAACTACAAATATTGCAATAAAAGTCCCTgttACTAc > SEQ ID NO:1917 135281 144257_200133_1
TTACTTTTACTCTCTCTGTATTTGTTCTTCTTAAAAATCCCTTTTACAGAAAACCCAAAAGTAGTGCAAAAATTGAGAA
TTAATGGCAAATCTAGGAGGAATTCGTGAGGCAGGAGGATCTGAGAACAGCCTTGAGATCAATGATCTTGCTCGCTTTG
CTGTTGATGAACACAACAAGAAACAGAATGCACTTCTGGAGTTCGGAAAGGTTGTTAATGTGAAGGAACAAGTGGTTGC
TGGAACCATGTACTACATAACACTGGAGGCAACTGAAGGTGGTAAGAAGAAAAGCATACGAAGCCAAGGTCTGGGTGAAG
CCGTGGCAGAACTTCAAGCAATTGGAAGACTTCAAGCTTATTGGGGATGCCGCTAGTGCTTAACAAGTGCTAAATGAAT
GCATCTTATGCTTGTGAAAATAAAGGTAACATAGTTTCGCTTGCGAGTATTTGAATATCGTAAAGTAAGCTTTAAACTA
TGTCGTAGTGTTAAGTTACAAGTAACTGTAACTTTACAATGTTCCATATTTCATATTATATGGTCCTCCATATGATAGT
TCTATGAT > SEQ ID NO:1918 135281 286382_200108_1
GCAGTCTGTCCACAGATGAGAGTATTTGGAAACACCACACTGCTATTTGCTTTAATTTTGTTATTAAGTTTTCTGTTCT
CTGCGTTTGGGTTAAGCGAAACCGGAGGAGGATTTTGCGGTGAAGAGGAAGAGAAAGAAAGTAATCTGATTGAGATGGC
TACTCTTGGTGGGATCCGTGATTCGCATGCTTCGTCCCACAACAGCGACGAGATCCATAGCCTTGCCCAAATTTGCTGTC
GACGAGCACAACAAGAAGGAGAATGCGATGATTGAATTTGCCAGAGTTGTGAAGGCGCAAGAGCAAGTTGTTGCTGGTA
CACTGCACCATCTGACTCTTGAGGTCATAGATGCTGGAAAAAAGAAACTCTATGAGGCTAAGGTCTGGGTCAAACCATG
GTTGAATTTCAAGGAACTTCAAGAGTTCACTCATGTTGAAGATGTTCCTACCTTAACATCCTCAGATCTAGGTGTTAAG

FIG. 2 continued

CAAGAGGAAGGCTCTGGATTGAAATCAGTGCCTGTGCATGATCCGGTGGTTCAGGAAGCTGCAGACCATGCAATTAAGA
CCATCCAGCAGCGATCCAACTCACTACTTCCATATGAACTGCAAGAGATTGTTCATGCAAATGCTGAGGTCATTGCGGA
GGACAATATGAAGCTTCATATGCTCATC

> SEQ ID NO:1919 135281 317344_301481_1
ttcgcattattatgcatgtcgaGCGACGGAGGGCCGGTGCTTGGCGGCGTCGAGCCGGTGGGGAACGAGAACGACCTCC
ACCTCGTCGACCTCGCCCGCTTCGCCGTCACCGAGCACAACAAGAAGGCCAATTCTCTGCTGGAGTTCGAGAAGCTTGT
GAGTGTGAAGCAGCAAGTTGTCGCTGGCACTTTGTACTATTTCACAATTGAGGTGAAGGAAGGGGATGCCAAGAAGCTC
TATGAAGCTAAGGTCTGGGAGAAACCATGGATGGACTTCAAGGAGCTCCAGGAGTTCAAGCCTGTCGATGCCAGTGCAA
ATGCCGCGGCCGCTTATCCGTATGATGTTCCGGATTATGCCGAGCTCTACAAACAGCTGTTGAATTTTGATTTGCTGAA
GTTGGCGGGTGACGTGGAATCTAACCCTGGTCCTAGGTCTAGAATGGCTACTTTCTCTTGTGTGTGTTGTGGTACCTTA
ACTACAAGTACTTACTGTGGTAAGAGATGTGAGCGAAAGCATGTATATTCTGAAACAAGAAATAAGAGATTGGAACTTT
ACAAGAAGTATCTATTGGAACCGCAAAAATGCGCC > SEQ ID NO:1920 135281 317472_301482_1
cggcataatccggaacatcatacggatagcggcgcgGGCGGTGGCGTCGTCGAGGGGCTTGAAATCCTGGAGCTGCTTG
AAGTTCTCCCACGCCCTCTCCCACACCTTGGCCTCGTACAGCTTATTGGCGCCGCCGGGTTCCTTCACCTCGACGGTGA
GGTAGTGCATGAACCCGCCCACCACCTGCTGCCTCACCTTCACCACCCTCTCCAACTCCAACATCGCGTTGGCCTTGCT
GTTGTGCTCGGCGACGGCGAACCGGGCGAGCTCGACGGTGGTGAGGTCGTTCTCGCGCCCGGCCGGCGCGTCGTGGATG
CCGCCCACCTTCACGCCGCGTGGCTCTGCGCCTCCTCGGCCATGCTTAATTAATGCGAAGGTAAATACAGTAGATTTAA
ACATCAGGACCTAGAGTTCACCACTCGAAGTCTTTTCTCAGCTTCTTATCCACAAATTTCCCTTCACAATTAAACAGCA
ACTTAAACTTATTAAAGTCAAAGATATGATAACATAAAGAAACCAAAGCAGAAATAGCACTATAAGGGGATCGATATCT
ATCCACTAAAGCCTTATCCAAAGCATCAAGCACCTTAAAGTCTTTGTAAGATTTGTAATTGTCATTGATAGAGATATAA
ATCTCACTCAAAACTTCTACATCTCTCACATCAGTTCTACctaattTTGTGATAAATTTTGCCGCatctggaacaaatt
gATATTTTCCATCTATGCACAGCAGAaattaccACAAAATGCGGGtacttgaagTCGAACac > SEQ ID NO:1921 135357 251319_301656_1
AGCGCTACTGCCGCGTTGATGTCTTTGCTGTGTGCAGCGGCATCGAGCGCTAGGGTGTCTTTGCGGTGCTTGGCGACGA
AGGGCCAGGGCGAGCAGCTACCGATGGCGCAGCTCAAAGAAATCGCCAAGAACAAGATGTTTGATGGATTTAATCGCCG
GTTCCAGCACCAGAGCAGCTCCTGTGGTTGTAACATGAATTTCACGTCTATTTCCCTCCAGCTGCGGATCATAAAAAA
GTTCCAGTTCTTTACTGGCTTTCGGGACTTACATGCACAGATGATAACTTTATCCAAAAATCTGGAGCACAGCGTGTTG
CTGCTGCCGAGGGAGTAGCAATTGTTTGTCCTGATACTTCTCCTCGTGGATTAGGAGTTCCAGGAGAAAGTGATAGCTG
GGATTTTGGTGTACGAGCCGGTTTTTATCTCAATGCAACTCAAGAGAAATGGAAGAACTGGCGAATGTACGACTACTGC
ACCAAGGAGCTTCCGGAACTCCTCAGCGCCAATTTCGATCAGCTTGACACCAAGAAGGCGTCAATTTTCGGGCACTCAA
TGGGAGGTCACGGGGCCTTAACTATCTTCTTGAAGAACCCG > SEQ ID NO:1922 135357 1118509_301857_1
AGGACCCCCCCCTAGAGGTTGCACACTGCGCATCATCACCCTCCTCGTCTCTCCATCTCAGAGAAAATTTGCATATATTT
CTGAAGCGAAGGCCATGGATGCCCCGGAGGAGATTAGTAAGATAAAGATGTTTGGTGGATACATTAAACGCTACAAACA
TCAGAGCTCTACACTTGGCTGTGCTATGAATTTCACGATATATTTCCCTCCTGCTGCACAAGAGAAGAAAGTTCCTGTT
TTATACTGGCTGTCGGGGCTTACATGCACGGATGAAAACTTTGTGCAAAAAGTGGAGCTCAAAGAGCAGCTGCAGCTT
GTGGCATAGCTTTGGTAGCTCCAGATACATCACCAAGAGGTCTTAACGTGGAAGGAGAATCAGAAAGTTGGGATTTTGG
TGTAGGGGCTGGTTTCTATCTTAACGCTGCACAGGAGAAATGGAAGAACTGGCGAATGTATGACTATGTGACGGTAGAG
ATACCGAGGCTCCTTAGTGCTAACTTTGGTGAGCTTGATACAGCATGCGCTTCTCTCTCTGG > SEQ ID NO:1923 135416 175344_300541_1
CCCCCCCCCCTTTCGCCTAAAGGAAAATGTCGCGTCTCGTCTCCCCTCCTTGCGCCATCTCGCGGCTGACAGGGTAGGG
GCGCCGATCTCCATCTGGCGAGCAGAGCAGAGCAGGCGAGGGGAGGGGATCCTGGTGCATAATTCTTGAATCCATTTTA
AGTGCAGCAATTCTGAGTACCAAAAAATCCATTCAAAATGGTGGTTCTTGCTGCTTCCATCATTTCAAAGTCCGGGAAA
GCGCTTGTTTCAAGACAGTTTGTTGACATGTCTCGCATAAGGATTGAAGGATTACTTGCAGCTTTCCCCAAACTGGTTG
GAACTGGGAAGCAGCACACTTATGTTGAGACTGAAAATGTTCGCTATGTTTATCAGCCAATAGAAGGCCTGTACTTGCT
ACTTATCACTAACAAGCAGAGCAATATTCTTGAAGATCTGGACACCTTGAGGCTGCTCTCTAAGCTTGTG > SEQ ID NO:1924 135416 1911_300334_1
AATTCGGCACCAGAAGTGTTCTTCACTCTGGTGGTATACGATCTATTGCCTAAGATCTGATTCAGCAAAATCTACTAAG
CAGCGAAGATGGTTGTTCTTGCGGCTTCGATAATTTCTAAATCTGGCAAAGCACTTGTCTCGAGGCAGTTTGTTGATAT
GTCTCGTATAAGAATTGAAGGGTATCTTGCAGCTTTCCCCAAATTGGTTGGTACAGGAAAGCAGCATACATATATTGAG
ACTGACAATGTGCGATATGTTTATCAACCGATAGAGTCTTTGTACTTGCTACTTGTGACCAACAAACAGAGCAACATTC
TTGAAGATCTTGAGACACTG

FIG. 2 continued

> SEQ ID NO:1925 135416 205886_300802_1
GAACCATCTGGACATCCCACCAAAGCCTCCCCCAGATTGCTCTTCAGTGCACGACACGTCATTGCCAAAATGGTTGTTC
TCGCGGCCTCCATCTGCACCCGAGGCGGGAAAGCTGTCCTCTCGAGACAGTTTCGAGAGATGCCCAGATCCCGCATTGA
GGCTCTCCTTGCGTCGTTCCCCAAGCTGGCCGACAGCGGCACTCAGCACACAATCGTCGAGCAGGACAATGTTCGATTC
GTCTACCAGCCTCTCGACGAGCTCTACATGGTGCTCATCACCAACCGACAGTCCAACATTCTGCAAGACATCGACTCCC
TGCACCTGTTCGCCCAGGTCGTCTCCAGCACTTGCAAGACGCTAGACGAGAGAGAAATTGTCCGAAATGCTTACGAGCT
TCTCAGCGCATTTGACGAACTGGTCACACTGGGCTACCGAGAGAACCTGACCATCAGCCAGATCAGGACCTTTTTGGAA
ATGGAGAGTCATGAGGAGCGCATCCAGGAAATCATTGCACGGAACAAAGAGCTTGAGGCTACTGAGGAGCGGAAACGCA
AGGCGAAGCAGCTGGAGATGCAGCGCAAGGAGTCC

> SEQ ID NO:1926 135668 105064_300046_1
CCCACGCGTCCGGCAAAAAATTGAGAACCAAAGTTGTGATGGGGCACAAGTGAAGTTGCTAGGCTTTTGGTATAGTCCA
TTTACTCACAGAGTTAAGTGGGCTCTAAAGATAAAGGGTGTGAAATATGAATATATAGAAGAAGATCGAGATAATAAGA
GCTCTCTACTTCTTCAATCCAATCCTATTCACAAAAAAGTCCCTGTTCTCATTCACAATGGAAAACCCATTGTTGAGTC
TCTGGTCATTCTTGAGTACATTGATGAGACATTTGAAGGCCCTTCCATTTTTCCTAAAGACCCTTATGATCGAGCTTTA
GCTCGTTTTTGGGCTAAGTTCCTTGACGACAAGGTGACTGCAGTACCGAATATTTTCCGTCGCAAAGGGGAGGAGAAAG
AGAAAGCTAAAGAGGAAGTATGTGAGATGTATAAAGTTCTTGACAATGAGTTCAAGGATAAGAAGTTTTTTGTGGGTGA
GAAATTTGGGTTTGCTGATATTGCTGCAACTTTGGTGGCATTTTGGCTTGGAGTTTTTGAAGAAACCTCTGGAATTGTT
TTAGTGACAAGTGAAAAATTTCCAAATTTTTGTAAGTGGAGAGGCGAATACATTAACTGCAGCCAAATCA

> SEQ ID NO:1927 135668 175403_300542_1
CCCCCCCCAAGTGCATCAGCAGCGAGTTGCAGCCATGGCAGCAGACAAGGGAGTGAAGGTGTTCGGCATGTGGGCGAGC
CCCATGGCGATCCGTGTGGAGTGGGCGCTCCGGCTCAAGGGCGTCGACTACGAGTACGTCGACGAGGACCTCGCCAACA
AGAGCGAGGCGCTGCTCCCGGCACAACCCGGTGACCAAGAAGGTGCCCGTGCTGGTCCACGACGGCAAGCCTCTCGCCGA
GTCCACCGTCATCGTCGAGTACATCGACGAGGCCTGGAAGCACGGCTACCCCATCATGCCCTCCGACCCCTTCGACCGT
GCTCAGGCGAGGTTCTGGGCCAGGTTCGCTGAAGAGAAGTGCAACGCTGCTCTGTACCCGATCTTCATGACGACCGGAG
AGGAGCAGAGAAAGCTGGTGCACGAGGC

> SEQ ID NO:1928 135668 194057_300743_1
CCCCCGAACCACCAAACAGAACAGAGCTCGCAACTCACAAGCTGATACAGAGCAGAGACCATCGGAGTTCAGAGTTCAG
ACACGAGAAAGCCATGGCCGGAGGAGGAGGACGAGCTGAAGCTGCTGGGCATGTGGGCGAGCCCGTACGTTCTGCGAGTG
AAGCTCGCGCTCAGTCTCAAGGGCCTCGACTACGAGTACGTCGAGGAGGATCTCAAGAACAAGAGCGAGCTCCTCCTCA
GCTCCAACCCGGTGAACAAGAAGGTGCCCGTCCTCATCCACAATGGCAAGCCAGTCTGCGAGTCGCAGATCATCCTGCA
GTACCTCGACGAGGCGTTCCCCGATGCCGGCGCCACCCTGCTCCCCGCCGACCCCCACGAACGCGCCGTCGCTCGCTTC
TGGGCCGCATTCTGCGACGACACGATCGCGAAGGCGTCGCAGCAGGCGTCGTCGGGAAAGACGGAGGA

> SEQ ID NO:1929 135668 201384_300715_1
AAAGATGGGTGAAAGGGTGAAGCTCATCGGTGCTTTCGCCAGTGCATACGGCCACCGCGCAGAGGTGGCGCTTCGCCTG
AAAGGCGTGCGATACGAGCTCATCCTGGAAGACCTCCGCAACAAGAGCGACCTGCTGCTCAACCACAACCCCGTCCACA
AGCTCGTCCCCGTCCTCCTCCATGGCGACCGCTCCTTGAGCGAGTCCCTCGTCATCCTCGAGTACATCGACGAGAGCTT
CCATGGTCCACCCCATCCTCCCCAACCGATCCGTACGATCGAGCCGTGGCGCGTTTCTGGGCGCAGTTCATCGATCAGAAG
TTTGGTAGGTTCAATTTCTGGATCCCGTTCGTGCAAATGGAGGGCAACATGCAGGATTGTTTCGTGAGGGAAGCAAAGG
AGAATCTGGCGCTTCTTGAAGGGCAGCTCAAGGGGAGGAGATTCTTCGGAGGCGACGCCATCGGGTTCTTGGACATAGC
AGCGTGCTTGATAGCTCACTGGCTTGGTGCGTTCGAGGAGGTATGTGGGGGTGACCTTGGCCACGGATGAGGAGTTCCC
TGCTTTGTGCGAGTGGAGGAGACGCTACGTCAACGATGAGGCCGTGAAGCCGTGCCTGCCGAATAGGGACGAACTCGTT
GCGTATTACCGTGAACGCA

> SEQ ID NO:1930 135668 182721_300663_1
GAATTCAAGTCCTCTTCTTCTCAAAATGAACCCACTTCATAAAAAAATCCCTGTTCTGATTCATAATGAAAAACCAATT
TCCGAATCCTTACTAATCGTCCAATACATTGATGAAATTTGGAAAGATAAATCTCCACTTTTACCTAATGATCCATATG
AAAGAGCTTCAGAGAGATTATGGGCTGATTATGTTGACAAAAAGGTATTTGAAATCGGGAGGAAGTTATGGATGACTAA
AGGAGAAGAACATGAGAAAGCTAAGAATGATTTCATTGAATGTATGAAGGTATTAGAAGGAGAGCTTGGAGATAAGATT
TACTATGGAGGTGACAAAATGGGGTTTTTAGATGTGGCTTTTGTTCCTTACTACAGTTGGTTTTACTCTTATGAAACTT
GTGGCAAGTTTAGTATGGAAGAAATTTGTCCTAAATTGATGGAATGGGCAAAGAAATGTATGGAGAAAGATAGTGTCTC
TGAATCACTTCCCGAATCACAAAAGATTTATCAATTCGTTTTGAAACTCAAGCAGAGGTATGGAATTGTTGA

FIG. 2 continued

> SEQ ID NO:1931 135668 142962_300474_1
CAAAAACTCTCAGAACCAAAGTAGTGATATGGCAGAAGTGAAGGTGCTTGGTCTTTGGTATAGCCCTTTTAGTCACAGA
GTTGAGTGGGCACTGAAGATTAAGGGCGTTGAGTATGAATATATAGAAGAAGATCTAAAAAACAAGAGCTCTCTGCTTC
TTCAATCCAATCCTGTTCACAAGAAAATCCCTGTTCTCATTCACAATGGAAAGCCAATAGCTGAGTCAATGGTCATTCT
TGAATACATAGATGAGGCTTTTGAAGGTCCTTCCATCTTGCCTAAAGACCCTTATGACCGTGCTGTAGCTCGTTTCTGG
GCTACGTTTTTGAAGAAAAGGCGATATCAGTGGGGGATTCGTTCTATGAAAAAGGAGAGGAGCAAGAGAAAGCTAAAG
TGCAAGTTTTGGAAATGTTGAAAGTTCTTGATAATGAGCTTAAGAATAAGAAGTTCTTTGTGGGTGATAAATTTGGGTT
CGCTGATATTGCTGCAAATGCTGCGGCACTTTGGCTGGGAGTTCTTG

> SEQ ID NO:1932 135668 244902_301563_1
agagggcATTGAAGCATTAGCAGCACAGCAACAATGGCGAGCGACAGCGTGAAGGTCCTCAACTTCTGGCCGAGCATG
TTCGGCTTGCGCGTCCACTACGCTCTGGACCTCAAAGGTGTGCCTTACGAGTACAAGGAGGAGGACTTGGCGGACAAGA
GCGAAGAGCTCCTCAAGGCGAATCCCATCTACACCAAGATCCCGGTTCTCATCCACAATGGCAAGCCCATCTCCGAATC
CCTCATCATCCTTGACTACATCGATAGCGTCTGGCCCAGTTCTCCCAAGCTGCTCCCAAAAGATCCATACGACAAGGCC
GTGGCTCTCTTCTGGGCGGATTTCGTCGATAAAAAGGTGTATGATGCTGGACATTGGATCATCAGAGCTACTGGAGAGC
AGCACAAGAAAGCCGGCGAGGATTTCAAGTGGGCGCTGATGAAGATCGATGAAGCTCTCGGCACTGTTGCTCCAGGCAA
GCCTTTCTTTGGCGGTGACGCCATGAACATTGCGGATGTGAGCCTTGCACCGTTTATATGCTGGTTCGAGGGGTACCAG
AAGGTGGGAGGATTCCAGCTTCCAGGTCCCGAGGAGTGGCCTCGTCTCTACAAGTGGATTGATGCTGTCAATTCCGTGG
AAGCGATCAAGAAATCTACTCCAAGTCGGGAGAAGATGGTTGAGTTTATCGAGCTCTATAGGAAACGAATGGcaggcgC
TGCATAaGAGAAATATCACTGATCGGTGA > SEQ ID NO:1933 135668 245861_301572_1
gGAAGAGGGAGTGAAACTCttgaGCTTCTGGTCGAGTCCTTATGCTTGTCGAGTGAGGCTAGCTCTGGGTCTCAAGGGC
ATCGAGTTTGAGCTCCAGGAGGAAGATCTGTACAATGCAAAGAGTGAGCTGCTGCTGAATTCcaATCCCGTTCACAAGA
AGATCCCAGTTCTCATCCACAATGGCAAGGCCATCTGCGAGTCCGTCAACATCATTGAGTAcgttgacGAAGtctggGC
GGATCgAAGCCCCAATTTTCTCCctcgggATGATGCGTTTGCTCGAGCTACTGCTCGGTTTTGGGCTGATTTCGTCGAC
AAAAAGTTTATGAGCAGGACGGCGGCATCCTACCGAGCAGCCTATTCCAGCGCAGGTGAGGAaAAAGAGCGAGCAAACA
ATGAGATGATTCAAGATTTCATGGCACTGGAGGAGTTTCTTGCGAGACAGGAGATCGCGCGGCTCCGCGTGCCCGGCCC
CGatacctGTCCTCGTCTCTGCCGCTGGATGGATGCAGTCAAAGGCAATCCTTTTGCCAGAGCTGCCTATCCTGACCAG
AGAGAACTTAtggcctcCACTAAagtccgAtttgaGAAACGTTTTGTGAATGCAAATAGg > SEQ ID NO:1934 135668 39447_300196_1
cccacgcgtccgaCGAACACTTACAAAAAAAATCTCTTTGTGAGCTTTAGCGATCGTAACAATGGCGAACGAGGTGAT
TCTTCTTGATTTCTGGCCGAGTATGTTCGGGATGAGGACAAGGATCGCATTGAGGGAGAAAGGTGTTGAATTTGAGTAC
AGAGAAGAAGATCTAAGGAACAAGAGTCCTTTGCTTCTCCAGATGAATCCGATTCACAAGAAGATTCCTGTTCTCATCC
ACAATGGTAAACCGGTTAACGAATCTATCATCCAGGTTCAGTACATTGACGAGGTCTGGTCTCACAAGAACCCTATCCT
TCCTTCTGATCCTTACCTGAGAGCTCAAGCTaggttcTgggctgAttTCATTGa > SEQ ID NO:1935 135668 4736_300317_1
gtgaacttcagagatcctatagcaatggcgaacctaccgattcttttggattactggccaagtatgttcgggatgaggg
cTAGAGTTGCGTTGCGAGAGAAAGGTGTTGAGTTTGAATACAGAGAGGAAGATTTCTCGAACAAGAGCCCTTTACTCCT
CCAGAGTAATCCCATTCACAAGAAAATCCCGGTTCTGGTCCACAACGGTAAACCGGTATGTGAATCTCTTAACGTTGTC
CAGTACGTCGACGAGGCTTGGCCCGAGAAGAACCCGTTCTTCCCTTCCGATCCTTACGGGAGAGCTCaggCTCGATTCT
GGGCTGATTTCGTGGACAAGAAGTTCACCGACGCCCAATTCAAGGTATGGGGGAAGAAAggtgaggAACAaGaAGcagg
caAgaaggaaTTTATTGa > SEQ ID NO:1936 135668 56676_300127_1
TAACGTTGTCCAGTACGTTTACGAGTCTTGGCCCGAGAAGAACCCGTTCTTCCCTTCCGATCCTTACGGGAGAGCTCAG
GCTCGATTCTGGGCTGATTTCGTGGACAAGAATTTCACCGACGCCCAATTCAAGGTATGGGGGAAGAAAGGTGAGGAAC
AAGAAGCAGGCAAGAAGGAATTTATTGAGGCAGTGAAGATTCTTGAATCTGAGCTAGGAGATAAACCTTACTTTGGTGG
AGATAGCTTTGGGTATGTAGACATTTCCTTGATTACATTCTCGAGTTGGTTCCAAGCCTATGAGAAGTTT > SEQ ID NO:1937 135668 29117_300184_1
ATTCTGTTGGATTGTTGGTGCAGTATGTATGGGATGAGGGCAAGAATAGCACTTGCAGAAAAGGTGTGAAGTATGAGT
ACAAAGAAGAGGATTTGAACAATAAAAGCCCACTGCTTTTGGAAATGAACCCTATTCACAAGAAAGTCCCAGTCTTAAT
TCACAATGGGAAATCAATTTGTGAGTCACTTGTTATAGTCCAATATATTGATGAAGTTTGGAAAGGAAA

FIG. 2 continued

> SEQ ID NO:1938 135668 254943_301640_1
GCAGAGAGAGAGTTGAGGCAAGAACTATGGCGGAGGGAGAGGGAGATGTGAAGGTATTGAGCAGTTGGTTGAGCATGTT
TGGCATGCGAGTTCTTATCGCCCTTCATGAGAAGAATGTGCCATTTCAACTCATTGAGGAGGATCTCTCTAACAAGAGT
GAACTCTTGTTGCAGTCGAATCCCATCCACAAGAAGATCCCCGTGCTGGTTCACAAGGGGAAAGCCATCTGTGAGTCAA
GCATCATCGTTGAATACATAAACGAGACATGGCCTTCCCCTCCCCTCTTCAATCCTTCCACCCCCTACAACACTTCCCT
TCATCGATTTTGGGCTGATTACATTGACAAGAAGTTCTATGATGCAGGGGCAAGGGTTATTAAAAGTCCAACAGGAGAA
GCCCAGGAGTGTGCAGTTAAGGATTTGGTGGAGAGTTACAAGATGATGGAGAACGCATTCGCTGAGATGAGTTGTGGGA
TTAAGCCTTTCTTTGGTGGAGACTCCATGGGGTTAGTGGATGTCGTGTTTGCTCCCTATGTATCTTGGTTCTGTGTATA
TGAGAGCATAGGGGGATTCAAGCTCCCAGGGGAGGATGAATGCCCACTACTAAGTGCATGGACCAAGAGAGTGTTGAAA
GTGC

> SEQ ID NO:1939 135668 225732_300990_1
aaaagagaaatgggGGAAGAGGGAGTGAAACTCTTGAGCTTCTGGTCGAGTCCTTATGCTTGTCGAGTGAGGCTAGCTC
TGGGTCTCAAGGGCATCGAGTTTGAGCTCCAGGAGGAAGATCTGTTCAATGCAAAGAGCGAGCTGCTGTTGAATTCCAA
TCCCGTTCACAAGAAGATCCCAGTTCTCATCCACAATGGCAAGGCCATCTGCGAGTCCGTCAACATCATTGAGTATGTT
GACGAAGTCTGGGCGGATCGGAGCCCCAGTTTTCTCCCTCGGGATGATGCGTTTGCTCGAGCTACTGCTCGGTTTTGGG
CTGATTTCGTCGACAAAAAGTTTTTGAGCTTGACGgcGGCATCCTTCCGAGCAGCCATTTCCAGCGAAGGTGAGGAAAA
AGAGCGAGCAAATGATGAGATGATTCAAGATTTCATGGCACTGGAGGAGTTTCTTGCGAGACAGGGAACAGTGTTTTTC
AGCGGAAGCGACACGGACATGGGCTTTGTCGATATTGTTGCCTCTTTCATGCCATGGTGGACGCCCGCATACGTAGAGA
TCGCTCGGCTCCGCGTGCCCGGCCCCGATACCTGTCCTCGTCTCTCCCGCTGGATGGATGCAGTCAAAGGCAATCTTTt
tgccaGAGcc > SEQ ID NO:1940 136763 4690_300392_1
CGCGGAGATTTAGAGGAGTGTTTGGTTCTTTGGATAACAATATCCCAAACTGAAAATGGCTAAGTCATATGGAGCTATC
TTCCTCTTGACCCTCATTGTCCTCTTCATGCTTCAAACCATGGTTATGGCCTCAAGTGGATCTAATGTGAAGTGGAGCC
AGAAACGTTATGGACCAGGAAGCCTGAAACGTACCCAATGCCCATCGGAATGTGATAGGAGGTGTAAAAAGACACAGTA
CCACAAGGCTTGCATTACGTTCTGCAACAAATGCTGCAGGAAGTGTCTCTGTGTGCCTCCGGGTTACTATGGGAACAAA
CAAGTTTGCTCCTGCTACAACAACTGGAAAACTCAAGAGGGTGGACCAAAATGCCCTTGAAAAAATCTCCCTTCGTTCC
CTTTTTATAATAAAAATTTTCAACTATAACTAAATTTCCTTTGATCAATGTTTTATCTACTTTATTCCTAATGTTGTAA
TGTTATGTCACTCCTTTTCGGATTTTGCGGCCGCAATTCTCGAGC > SEQ ID NO:1941 136763 1109880_301525_1
GAGAGATCGCAGATGATGTCCAGGCAGATTTGGAATCCATTAATGCCAATCATCCACAACGAAATTTGCTTCAAGCCAT
AGACTGTGGAAATGCATGTGGGCAGAGGTGTATCAAGTCAGGGTTAGTGAAGAGATGCATCTACTTTTGCAATCTATGC
TGCCAGAAATGCAAGTGTGTGCCACCTGGCACCTACGGGAACAAGGAGAGTTGCCCTTGTTATGCCTCCCTCAAGAACT
CCAAGGGAAAGGACAAATGCCCATGATTATTATTATTAGCTAAACCCATGTCATTTAGATTAGATTAAATCTTAAACTA
AACCCAACTTAGTTTAACTGTGGTTTTGGGTTGTAAATGAATAGATTATCATATGTCTTGCCCAGTTTTGATCCTTGTG
CTCTTCTTTAATTACTGTGTATAGATCCTTAATTTTGTATTATAAAAAAGCACATGAAAGCAATCG > SEQ ID NO:1942 136763 1114227_301844_1
GTAAGAGTAGTAAGCATAGACAGCATAGCATTGCCCACCACCTCTACCTCAGCTTTGGAGCAGTGGGCACTTGCTCTCT
CTTCCTCTCTCTCTCAGTTATGGCTCGCCTTCATGCAATTCTCCTACTGTTGCTTGTTCTACTCATCGCTGTAACTATG
GGATCCCAGGGGGTGAATTTGAATAGTGGTGTGACCTCATCTGCAATTGGAGATATTAAGGCTCAGGCAAGGAACCCAT
ATAGAGTGCCCCTCTCAGGGTGCCCAAATGCTTGCAACAAAAGATGCTCAGGCACATCCAAACGCAAGCCATGCATGTT
CTTCTGCACCAAGTGTTGTGCAACGTGCCTCTGTGTACCCCCTGGTACATATGGCAACAAGCAAGTATGCCCTTGCTAC
AACAATTGGAAGACCCAACAAGGAGGACCCAAGTGCCCTTAATTAGGATCACCAATCACCTCCTCACCATCCATGTCAA
GCATTCTCATGTGGATGGTACATGTGATATGGCTGAGAAGATTATTGCTTTTTCCACACAGGTGGAACCCTATAACTAC
TTTATAATAGCTCCCCTCTCAAGTTAG > SEQ ID NO:1943 136763 157427_301738_1
tctttagacaaattatagcaatggctgcgaaactgagcattgtcttgtttgttattttggtagttttttggcccaaaa
tCAGGTTTCAAGGGCCAACCTAGTGCTTGATGGGAAGCAACAAATGCAGAGAAATAACCAAATGTATGGTGTTAGTCAG
GGAAGCCTCCATCCTCAAGATTGTCTCCCGAAATGCACATATCGCTGCTCACAGACTTCATTCAAGAAACCCTGCATGT
TTTTCTGCCAGAAATGTTGCTCGAAGTGTCTGTGTGTGCCCCCTGGCACCTATGGCAACAAACAAACCTGCCCTTGCTA
CAATAACTGGAAAACCAAGGAAGGTGGCCCCAAGTGTCCCTGATTGTACCCTTCCTTCCACTATTATCTATATATCCAT
CTATATATTGTGTGACAGACACCCAACTTCTGTCAGTTTTCATCTATCTGTCAAGTCTATTAGTAACTAGCACTTGGTT

FIG. 2 continued

```
CAAGTGGTCTGTGTTAGCTAGCAAATGATCAATTTAAGCTCCAATATAACCACTTTTTGGCAAAGCCAGGAAGATGAGT
TATAATGCAATGACAGTAACTATGCGCTAGCAATTGCTCCTAGAAATCTGTATTCTCGTCATACTCCATGCTTGTATGC
AGCCTATTGACGAGCTATGTTTATGAGTAGTAGTAGTTCTTATGCTATTTAATGCAATTTCTTAAGAACTTGTATTTTA
AGATATGTAATCCATATTCTATTTGGTGttccttaccaatatgtgaatgatgccctatattaaagc > SEQ ID NO:1944 136763 157434_301738_1
aaaacactaacaggcttatttgttctcaagaaaatcagcaatggccaaactcgtttcattttcctttggCCCTTGTT
GCCATATCCATGGTTGCAACCACTGTTTTGGCTGCAGATGCCCAGTACCACCTTGATACTTCAAGGTACGGTCCAGGGA
GCTTGAAGCCATCACAATGCCTGCCACAATGCACGAGGAGATGTAGCAAGACACAGTACCACAAACCATGCATGTTCTT
CTGCCAAAAATGCTGCAAAACATGTCTGTGTGTCCCCCCTGGTTTCTATGGAAACAAAGGTGTTTGCCCTTGCTACAAC
AACTGGAAGACCCAGCAAGGAGGACCCAAGTGCCCTTAATTTTACTTTATGGAATTCGTTCCCCAATTTAATTTATGTT
GTTGTTTGTCGGTATTGTTATTAAATTTGTCTTGAATCAAAGGTCATAAGTTGTACGACCTTGATTCTAATTAAGTTAC
TTTTACTGTATTGCTCCTTTGGGCCGAATACTTTTTGTGttGCCCGATGTGAGAGCTCTTTGACCAATTCTTTTTGGTC
TATTGTACGTTTTAATTACTCTTATCTAATATAACAAAATGttCTTC > SEQ ID NO:1945 136767 110871_300047_1
TGTGCTCCGCCTTCCTCTCAAAATGAAAATTAGGGTTTTCTTCGTCCTGGCTCTTCTCCTCTTCTCTTCATCATTTCTC
CAAGTTGCTAGAGCTCAATCCGACCCTGAAGCAGAAGTGGTTGAGAGTACCGAGGAAGGAGGGGATCTTGGAATTGTTG
GTGAGGATGTCCAAGATTTTAGCAGTGAGAGTTATAGTCCTGCACCTGGGATTGAAACAATTTGTGTTTTCCCTAAAAA
CCCTTCTAAAGTAGTGGCAGCTGGTGAGGAGAGTGAGCTTTGGTTGGAATGAAAATGATGGGGAATCAAATCTGAATA
TCATTGCCATCCAAGCCAGTGTTCACCTACCCTTTGATCATCGCTATTTGGTTCAAAATCTTTCTGTTCAGGCTTTTAA
CAACGCAACAGTTCCTCCTTCTGCTCAGGCTACCTTTCCATATATATTTGCTGTCAGCAAATTTATGCAGCCTGGAAGT
TTTGATCTCGTGGGCACAATTATTTACGAGATAGACCAGAACGCTTATCAAAATGTGTTCTACAATGGAACTATTGAAG
TGACTGAACCTGGTGGTCTTCTCAGTGTTGAGTCTGTTTTCCTGTTTTGTCTTGGAGTTGCCCTCCTTGGTCTTCTCGG
GTTCTGGATAC > SEQ ID NO:1946 136767 190912_300737_1
CGACTGCGAGCCACACGCAGCCACCGCGCAAAACCCACGCGACCCCTTCCTCCTCCGGCTCGACCCGATCCGATCTGAG
CCAGAGCCAACCATGGCGGCGACTAGGGTTTGGCTCTCCGCCCTCCTCCTCGCCTTCCTCCTCGCCGCCGCCCCGTCG
TCCAAGTTGCCAGAGCTCAGTCCGAGGAAGAAGTCGTACAGCTGAAGTTGTTGATGGGGCTGATCTAGGAATCGTCAG
TGATGATACACAAGTTTCCAGCGATGGGCCTCTAAGTCCGGCTCCTGGTGTGGAGACAGTATGTGTTTTTCCCAAAAAC
GCTGGCAAAATTGTGCTAGCAGGTGAAGAAACTGAACTACTGGTTGGCCTGCAAAACGAGGGTGAATCAACTTTGAATG
TTGTTGCTATCCATTCAACTCTCCATCTTCCTTTTGACCATAAGATGTATGGACAAAACCTTACTGTTCAGAACTTCTT
CAATGCATCAGTTCCTGTCTCTGTACAAGCAACCTTTCCGGATACATTCGCCGTGAGCAAGTTCTTGCAGCCTGGAGCA
TATGATCTAGTGGGTTACATAGTGTATG > SEQ ID NO:1947 136767 181643_300626_1
GAATTCAGACAAACCTCAAAAGAGAAAAAGAAGAAAAACATTGGTTCTCTTTTACCATCGATCTAATCATCTTCACCAT
TCCTATCAGGTGTGAGGTGTCAAGCTGATTCAGAGGCTGATTTGGATGATGTTGTGGCTGATGTTATCAAAGGACATGA
GGAAGCTGAAACTGTTGATGAAGATATTCCTGATTTCAAGAGTTGGCCTTCAGCTCCAGGAGTTGATACTGTCTGTATC
TTCCCTAAGAATTTTGCCAAACTTATTCCAGCTGGTGAAGAGAGTGAAGTACTAGTTGGATTGAAGAATGAGGGTGAAT
CAAAATTGACTGTCATTGCCCTTAGAGCTAGTCTGCATCTTCCCTTCGATCATAATCTGCTGGTGCAAAATCTCACTGT
TCAGCAATTTTACAACGGTTCTGTACCAGTTTCAGCTCAGGCTACCTTCCCCTACCTTTTCTCTGTTAGCAAGTACTTG
CAGCCTGGAACATTTGACCTTGTAGGAACCATTATCTACGAGATTAATCAGAAACCCTACCAGAGCACTTTCTATAACG
GCACTGTTGAAGTTGTTGAGGCTGGTGGCCTTCTCAGCATCGAGTCTGTTTTCCTTATCTGCCTTGGACTGGGTCTTCT
CGCTCTTTCTGGCCTGTGGGTTTAT > SEQ ID NO:1948 137131 104664_300369_1
CAATTCCTGAAAAGTCCAAAAGATGGCACAATGTGAGAAAAATTTGGAAGCAGAACTGGAAGTACTGAGAGAGACATTT
AAATCTGAGAAAACAAGAGAAGAATGTTGGAGAAGATCACAGTTACAAAATTTGCTCAGACTTCTTGAAGAGAAAGAAG
ATGATATATACAAAGCCCTTAAACAAGACTTGGGAAAACACCACGTTGAAGCTTACAGAGATGAGATTGGAACATTAAT
AAAATCTGTGAATTATGCACTGGATGGCTTAAAGCAATGGATGTGTGGCAAGAAGGCCAAATTGCCAATTGCTGCATTT
CCTGCTTCAGCGGAGTTGGTTCCTGAGCCTCTTGGTCTAGTCCTCATTATTCCTCTTGGAATTTTCCTTTTGGGATAT
CATTGGAACCACTAATTGGAGCAATAGCAGCTGGAAATGTGGTTGTTTTGAAACCCTCAGAACAGGCTCCTGCATCATC
ATCAGTGTTAGCTAAGACAATCTCCACTTACTTGGATAATAAAGCTATTAAAGTCATTGAAGgTGATAATTCCGTTGGT
GACAAACTGTTGCAACAAAAATGGGACAAGATTTtctTtacAggGAgtACaa
```

FIG. 2 continued

> SEQ ID NO:1949 137131 170330_301609_1
ATTCACCTCATGTTCTGCTTGCAAAGTTTCAATACACTGGAGTGAGTCAGTGAGGTTGGTGAAGCAGAGTGAGGAAAGG
AGGATGGGAAGGGTGGCGCCTAGCGTCGAGGAGGTCGGGGGCGAGCAGCCGCCGCCCGCGCTTGGGCCCGGCGAGACCG
TGAGCGGGACGGTGGCCGAGCTGAGGGCGGCGTACGAGAGCGGCAGGACGCGGAGCCTGGAGTGGAGGCAGTCGCAGCT
CCGGGGGCTCCTCCGGCTCTTGGCGGAGGAGGAGGCCGCCGCGTTCCGGGCGCTCCGCGAGGACCTCGGCAAGCACCAA
GCCGAGGCCTACAGAGACGAGATCGGCGTGCTTGTCAAGTCGGCGAACGCCGCGCTGCGTGAGGTCGGGAAATGGATGG
CGCCGGAGAAGGTCTGGGTGCCGCTAATCGCGTTCCCGGCAAGGGCGCAGCTGGAGCCGCAGCCGCTCGGGGTCATCCT
CGCCTTCTCTTGCTGGAATG

> SEQ ID NO:1950 137131 196522_300704_1
ATTCACCTCATGTTCTGCTTGCAAAGTTTCAATACACTGGAGTGAGTCAGTGAGGTTGGTGAAGCAGAGTGAGGAAAGG
AGGATGGGAAGGGTGGCGCCTAGCGTCGAGGAGGTCGGGGGCGAGCAGCCGCCGCCCGCGCTTGGGCCCGGCGAGACCG
TGAGCGGGACGGTGGCCGAGCTGAGGGCGGCGTACGAGAGCGGCAGGACGCGGAGCCTGGAGTGGAGGCAGTCGCAGCT
CCGGGGGCTCCTCCGGCTCTTGGCGGAGGAGGAGGCCGCCGCGTTCCGGGCGCTCCGCGAGGACCTCGGCAAGCACCAA
GCCGAGGCCTACAGAGACGAGATCGGCGTGCTTGTCAAGTCGGCGAACGCCGCGCTGCGTGAGGTCGGGAAATGGATGG
CGCCGGAGAAGGTCTGGGTGCCGCTAATCGCGTTCCCGGCAAGGGCGCAGCTGGAGCCGCAGCCGCTCGGGGTCATCCT
CGTCTTCTCTTGCTGGAATGTCCCGTTGGGCCTCTCTCTGGAGCCTCTCGTTGGAGCATTGGCGGCCGGCAATGCGGTC
GCGCTGAAGCCATCGGAGCTGGCGCCGGCCACCGCTAAGTTCCTCGGCGACAACGTCGGCAAATACATGGACGCCACgg
ccGTgaaggTcAT > SEQ ID NO:1951 138578 202133_300781_1
GGTAGCTAACTACTCCATCTAGCTAAGACCCGTAGTGTATAGTAGTCAAGATCAATGGCGTCCCGACGCCTTGCCCCGC
TGCTGGTCCTACTGCTCTCGTCCAGCCTCGCCGCCGGCCGGCCCAGAGCACCGGCGACACCGTCGTGTTCTGGGGCCGGAACAC
GGACCAGCTCGAGGGGTCCCTCCGTGAGGCGTGCGACACCGGCCTCTACACCACCGTCATCATCTCCTTCCTCAGCGCC
TTCGGCTACATCCCGGGCACCTACAAGCTGGACATCTCCGGCCACACCGTCTCCGCCGTCGGCCCCGACATCAAGCACT
GCCAGTCCAGGGGCATCCTCGTCCTCCTCGCCATCGGCGGCCAGGGCGGCGAGTACTCCCTGCCGACCTCCCAGGCGGC
CGTCGACCTCGAGGACTACCTCTGGAACGCCTTCCTCGGCG > SEQ ID NO:1952 138578 227060_301025_1
CCAATTAAGCGTAAGATCGATCATGGCGCCGCGATGCCTGGCTGCTCTTGCACCCCTGGCCGTGCTGCTGCTGCTCTCC
TCCTGCCTCGCCGCCGCTCCGGCGACGGCGCAGCAGCAGCAGCATCGGCGACACCGTGGTGTTCTGGGGCCGGAACA
AGGCCGAGGGCTCCCTCCGTGAGGCCTGCGACACCGGCCTCTACAACACCGTCATCATCTCCTTCCTCAGCGCGTTCGG
CCGCGGCAGCTACAAGCTCGACCTCTCCGGCCACCCCGTCGTCCCCGTCGGCGGCGACATCAAGTACTGCCAGTCCAAG
GGCAAGACAGTCCTCCTCGCCATCGGCGGGCAGGGCGGCGAGTACTACCTCCCGTCCTCCCAGGCCGCCGCCGACCTGG
ACGACTACCTCTGGAACGCCTTCCTCGGCG > SEQ ID NO:1953 138843 228105_301018_1
gtcgagccacgcgtccgAAGTTCACAACCCAACACCCAAAAGCAAAAGAAAAGCAGCAACCAAAGATGTGCGGCGGAGC
GATCCTTGCGGAGCTCATACCGAGCGCGCCGGCGGCGAGGCGCGTCACGGCGGGCCACGTCTGGCCGGGCGACGCCAAC
AAGGCCAAGAAGAAGGGCGCGCGCGCCGACGACTTCGAGGCCGCGTTCCGCGACTTCGACAACGACTCCGATGACGAGG
AGATGATGGTGGAGGAGGCGGAGGAGGAGGAGGCGACCTCCGAGCACAAGCCGTTCGTCTTCCGCGCCAAGAAGGCGGC
GGCGGCGGCGTCGAGCAGGCGCAGGAAGCCGGCGCAGTACAGGGGCGTGCGGCGCCGGCCGTGGGGGAAGTGGGCGGCG
GAGATCCGCGACCCCGTCAAGGGCATCCGcgTCTGGCTCGGCACCTTCACCAACGCCGAGGCCGCCGCGCTCGCCTACG
ACGACGCCGCGCGCGCCATCCGcgGGGACAGGGCCAAGCTCAACTTCCCTTCCGCTACCACCCCTGACACCCGCAAGC > SEQ ID NO:1954 138843 174859_300527_1
CCCGATCACAAGCTCACAAGTTCAGGGCCCAACACCCAAAAGCAAAAGAAAAGCAGCAACCAAAGATGTGCGGCGGAGC
GATCCTTGCGGAGCTCATACCGAGCGCGCCGGCGGCGAGGCGCGTCACGGCGGGCCACGTCTGGCCGGGCGACGCCAAC
AATGCCAAGAAGAAGGGCGCGCGCGCCGACGACTTCGAGGCCGCGTTCCGCGACTTCGACAACGACTCCGATGACGAGG
AGATGATGCTGGAGGAGGCGGAGGAGGAGGAGGCGACCTCCGAGCACAAGCCGTTCGTCTTCCGCGCCAAGAAGGCGAG
GAAGGCGGCGGCGGCGGCGTCGAGCAGGCGCAGGAAGCCGGCGCAGTACAGGGGCGTGCGGCGCCGGCCGTGGGGG
AAGTGGGCGGCGGAGATCCGCGACCCCGTCAAGGGCATCCGCGTCTGGCTCGGCACCTTCACCAACGCCGAGGCCGCCG
CGCTCGCCTACGACGACGCCGCGCGCGCCATCCGCGGGGACAGGGCCAAGCTCAACTTCCCTTCCGCTACCACCCCTGA
CACCCGC > SEQ ID NO:1955 139222 111028_300049_1
ctcactttccaccaaccactccccttctctctatctctataattacagttaattcttcgtagagtcactccgacaagt
aTAGAAATTACCGGATAAAAGAAATCGGCAACAATGGCAGCTACATTTGCTACAGTGTCGAATTTAGGCTCACTCTCAG
CTCCTCGAGCTACTGTGAACCCTACATATGCTTCTCCTAAGTTGGTGAAATCTTCATTCTCATCGTCAAGTTTCTTTTC

FIG. 2 continued

```
TGGCTCGTTGCGCCTTTCTACTTCATCCAACCGTTTGGTTCACAAAAAAACCAGCGGTTTATCCGGCTCCATTCATGCC
GCAGTGCAGGTGGCCGAGGTGCAATCCAAAGTGACACACAAAGTTTATTTTGATATTAGCATTGGGAATCCTGTTGGAA
AGCTTGCTGGACGAATTGTAATTGGATTATATGGTGATGATGTGCCACAAACAGCAGAAAATTTCCGTGCACTCTGCAC
AGGTGAGAAGGGCTTTGGCTACAAGGATTCTGCATTTCATCGTgTTATTAAAGATTTCATGATTCaaggaggtgATTTC
GATaAagqAAATGqAACcggtggtaAAAGCATATATggtcgtaCCTTtaaggatGAAAACttCaaGttgaCTCATACTG
gAc > SEQ ID NO:1956 139222 193737_300742_1
cccccccggagcgagagagagagaAAGGGTCTCCTCCTCAACATCAACAATGGCGGTCGCAACCTCCTTCGCCACACTC
GCCATCGCGCGGCCGGCGGCGGAGCGGGCCCTCCTCGCCTCCAAAACCCCCTCGCCGCTCCTCTCCATCCGCACCGGCA
CCGGCACCGCACGCCTCCCCTCATCGGCCGTCTTTGGAGGTTTCACTCCTGCGCTTTCCGCTGCTCACAGCCGCGCGCG
CTTCGTCTCCTCCGCCACCGCTGACCCCAAGGAAGTGGACCTCCAGTCCAAAATCACAAACAAGGTGTACTTTGACATA
AGCATCGGAAACCCTGTTGGGAAGAACGTTGGGAGGGTCGTTATTGGCCTATACGGGGATGATGTTCCCCAGACCGCAG
AGAACTTCCGTGCTCTTTGCACTGGAGAAAAAGGGTTTGGTTACAAGGGGTCCAGTTTCCACCGTGTCATTAAGGACTT
CATGATTCAGGGAGGAGACTTTGACAAGGGCAACGGTACTGGAGGGAAAAGCATATATGGCCGGACCTTCAAAGACGAG
AACTTCAAATTGGTTCATACTGGACCTGGAGTGGTCAGCATGGCCAATGCTGGGCCAAACACCAATGGCAGCCAGTTCT
TCATCTGCACTGTCAAGACACCTTGGTTGGATGGGAGGCACGTCGTGTTTGGGCAGGTTATTGAAGgcaTGGACATCGT
TAAGATGATCGAATCGcaggagaCTGacAGAGGGGAccgccCGA > SEQ ID NO:1957 139222 135590_300415_1
AGGGTCTCCTCCTCAACATCAACAATGGCGGTCGCAACCTCCTTCGCCACACTCGCCATCGCGCGGCCGGCGGCGGAGC
GAGCCCTCCTCGCCTCCAAAACCCCCTCGCCGCTCCTCTCCATCCGCACCGGCACCGGCACCGCACGCCTCCCCTCATC
GGCCGTCTTTGGAGGTTTCACTCCTGCGCTTTCCGCTGCTCACAGCCGCGCGCGCTTCGTCTCCTCCGCCACCGCTGAC
CCCAAGGAAGTGGACCTCCAGTCCAAAATCACAAACAAGGTGTACTTTGACATAAGCATCGGAAACCCTGTTGGGAAGA
ACGTTGGGAGGGTCGTTATTGGCCTATACGGGGATGATGTTCCCCAGACCGCAGAGAACTTCCGTGCTCTTTGCACTGG
AGAAAAAGGGTTTGGTTACAAGGGGTCCAGTTTCCACCGTGTCATTAAGGACTTCATGATTCAGGGAGGAGACTTTGAC
AAGGGCAACGGTACTGGAGGGAAAAGCATATATGGCCGGACCTTCAAAGACGAGAACTTCAAATTGGTTCATACTGGAC
CTGGAGTGGTCAGCATGGCCAATGCTGGGCCAAACACCA > SEQ ID NO:1958 139281 1097833_301448_1
AGAAAGGTTTGAGGAAAAAGAAGAGGGAGGGAAGAAAGGGGAGGTTCTTCTTGCTATTGTAATGGCGACTATCCCCGTG
AACCCGAAGCCCTTCCTGAATAACCTTACCGGCAAGCCTGTTATCGTTAAGCTTAAATGGGGCATGGAGTACAAAGGTT
ATCTTGTCTCAATCGACTCATACATGAACTTACAGCTTGCGAGCACTGAGGAATATATCGATGGAAAACTGACAGGCAA
CCTTGGAGAAGTGCTAATCAGGTGCAACAATGTGCTCTATTTACGAGGTGTTCCTGAAGATGAAGATATCGATGAAGCG
GAATAACAAGATGTAATTCTTGATCAGCAGCTGAGTTGGGAATGATCTGGAGTGTTCCGGAACTTTGTGTACGATGCAA
AACAATTTGGGATGCGGTTGTGAAAACCCCTATTTTAGGAGTTGGACTTAGAAAAAGACCCATTAACATACACATAAGA
GTAGTGCTACCACATGAAAAGACACTTTTTGAAATTTAAGTCTTTTTTATTG > SEQ ID NO:1959 139281 191424_300785_1
CACGCATCCCCGACCAGCACCGGCACCGGCGGCGGCGGGGGCTACCCCCCTTCAATGGCGACTGTGCCAGTTAACCCGA
AGCCTTTCTTGAACAACCTGACAGGGAAGCCTGTCATTGTCAAACTTAAGTGGGGTATGGAATACAAAGGATATCTTGT
TTCTGTCGACTCTTATATGAATCTGCAGCTGGCTAATACAGAGGAGTATATTGATGGGCAATTCTCTGGAAACTTGGGT
GAGATACTGATAAGGTGCAACAACGTTTTGTATCTCCGAGGCGTTCCAGAGGATACCGAGATAGAGGATGCGGAATGAG
ATAGCCCGGGCCATGTCCAGATTGATTATTGTAATATGCTGCTGACATGAACAATTAAGTGTCATGTACAACTGATGCA
GATTGACCTGGATCTTTAACTATGCCATGATATGGTAATGTTATGCGTTGAAACTGTCGTTGCTCGGAATGTGTGAGAT
CATATTTCGTAAGAAAATACCATTTGCCTGTCATGATTAGCCAAATTAGATAAGCT > SEQ ID NO:1960 139321 104610_300369_1
GGGCTCTCGTGTTCTCTCACTAGATCCCTCTTTCCAAAGCTTTCTTCAGGGATCCTTAAGAAGAAAGAGAAATGGGGCT
GACATTCACCAAGCTTTTCAGCCGGCTATTTGCCAAGAAGGAAATGCGTATTCTCATGGTTGGTCTTGACGCTGCTGGT
AAGACCACCATATTGTACAAGCTCAAGTTGGGCGAGATCGTCACCACTATTCCTACTATTGGTTTCAATGTGGAGACTG
TTGAGTACAAAAACATCAGCTTCACAGTTTGGGATGTTGGGGGTCAGGACAAGATCCGGCCATTGTGGAGGCACTATTT
CCAGAACACTCAGGGTCTCATTTTTGTGGTTGATAGCAATGACAGAGACCGTGTTGGAGGCAAGAGATGAATTGCAC
CGGATGTTGAACGAGGATGAGCTTCGGGATGCTGTGCTGCTTGTTTTGCTAACAAACAAGATCTTCCTAATGCAATGA
ATGCTGCTGAAATAACTGATAAGCTTGGACTCCACTCCCTCAGGCAGCTGTCACTGGTACATCCAGAGCACTTGTGCAA
CTTCTGGAGAGGGACTTTATGAGGGGCTTGATTGGCTTTCTAACAATATTGCTAACAAGGCCTAAACCAACGTAGAGTT
GTTGCGGGTTGATCCTGGATGCAGTCGGGTTTTTATCTAGTTCTTTTTCcTtTttccccattCTCagaatCTGTGTgg
ttaTGAatatccctTGAAagtgATttg
```

FIG. 2 continued

> SEQ ID NO:1961 139321 1097274_301438_1
agcctttctctttctcttgcgcagaaggaAAAAAAGGGGAGCGAGGCCAACAAACGACCCTCACCTTTCTCTCTGCTC
TGCCGGATCGCCGGATCGAATCCGCCCCCAACCCCCCCAGATCGCCGATCCTCGTTGCGCGGATCTGTGGAGAATCGTC
ATTGTCGGCCTTCTCTTCCTTTCTCTCTTGCCCTTGCCCCTGCCCTTCTCCTGCCGGAGGAGAAGAAGCCGTCGCCATG
GGCCTCAGCTTTGGGAAGCTCTTCCAACGCCTCTTCGCTAAGAAGGAGATGCGGATTCTGATGGTGGGACTCGATGCCG
CCGGAAAAACCACCATCCTCTACAAGCTCAAGCTGGGGGAGATCGTCACCACCATCCCCACCATTGGTTTCAATGTTGA
GACTGTGGAGTACAAGAACATCAGCTTCACTGTGTGGGATGTCGGGGGTCAAGATAAGATCCGACCTTTGTGGAGACAC
TACTTTCAAAACACCCAAGGGTTGATTTTTGTGGTAGACAGCAATGATAGGGACCGTGCCATCGAAGCACGAGATGAAT
TACACAGAATGCTGAATGAGGACGAGCTTCGGGATGCCGTGCTTCTTGTCTTTGCCAACAAGCAGGATCTACCAAATGC
TATGAGTGCTGCCGAGATTACTGATAAGCTCGGcctTCATTCTTTACGACAGCGCCACTGGTACaTTCAGAGCAcatGT
GCAACATCAGGAGAGGgAttatacgaaGGTCTGGActggctCtCa > SEQ ID NO:1962 139321 1113031_301794_1
ggcataggcagctttcggccccctttccctgtgaagagaagagaagagatggtggtgatatgatataggcctgggatcg
aTTCCTGttCCCGCCTGCCCATCCGGATCCGATCTCCCCGATCTGTGTGTGCTGTTGGTGAAGAAGAAAAGATGGGT
CTCTCCTTCGGTAAGCTGTTCCAGCGCCTCTTTGCCAAGAAGGAGATGCGCATCCTGATGGTGGGCCTTGATGCCGCTG
GTAAAACCACCATTCTTTACAAGCTCAAGCTCGGGGAGATCGTCACTACTATCCCTACTATCGGTTTCAATGTTGAAAC
TGTGGAGTACAAGAACATCAGCTTCACTGTGTGGGATGTTGGAGGTCAAGATAAGATCCGACCCTTATGGAGGCACTAT
TTTCAAAACACTCAAGGTTTGATTTTCGTGATAGACAGCAATGATAGGGACCGTGCTGTTGAGGCACGagaTGAATTAC
ACAGAATGCTGAATGAGGATGAGCTTCGGGATGCAGTGCTGCTTGTCtttgcaaaTAAGCAGGATCTACCGAaTGCCAT
GAGTGctgctGAGATCACTgataaacttggcCTTCATTCTCTACGACAGCGCCACTGGTAcattcagAGTACttgtGCA
ACATCAGGAGAGGGCTTGTACGAAGGtctggAC > SEQ ID NO:1963 139321 1119987_301860_1
AGAGCTCGAAGCACAACAGGGGGAAGGAAGATGGGGCTGAGCTTCACGAAGCTGTTCCAGAGGCTGTTTGCGAAGAAGG
AGATGCGCATCCTGATGGTGGGTCTCGACGCTGCTGGAAAGACCACCATCCTTTACAAACTCAAGCTCGGCGAGATCGT
CACCACCATCCCCACCATTGGTTTTAATGTGGAGACTGTGGAGTACAAGAACATCTCTTTCACTGTTTGGGACGTGGGG
GGCCAGGACAAAATAAGACCCTTGTGGAGGCATTACTTTCAGAATACCCAAGGCTTGATATTCGTAGTGGATAGCAACG
ACAGAGATCGTGCCGTGGAGGCACGTGATGAGCTACATAGGATGTTAAATGAGGATGAGCTTCGGGATGCAGTTCTTCT
TGTATTTGCCAACAAACAGGATCTTCCAAATGCCATGAGTGCTGCAGAAATCACAGACAAGCTTGGCCTTCACTCTCTA
CGCCAAAGGCACTGGTATATTCAAAGCACTTGTGCCACATCTGGAGAAGGCTTATACGAAGGCTTGGACTGGCTCTCCA
ACAACATTGCTAGCAAGGTATAGAAGATGTTATATCTCG > SEQ ID NO:1964 139321 124669_300424_1
ctttccgatcactacatattttccagcgttaatctcaggtttgtcCTCTCATTAGATCCCTCCTCCAAAAGCTCTTTTC
AGGGATCATCAACAAGGAAGCTAAATGGGGCTGACATTCACCAAGCTCTTCAGTCGGCTTTTTGCCAAGAAGGAAATGC
GCATTCTAATGGTTGGTCTTGATGCAGCTGGTAAGACTACCATATTGTACAAGTTGAAGTTGGGAGAGATCGTCACTAC
CATTCCCACCATTGGTTTCAATGTGGAGACTGTTGAGTACAAGAACATCAGCTTCACTGTTTGGGATGTCGGGGGTCAG
GACAAGATCCGTCCATTGTGGAGGCACTACTTCCAGAACACTCAGGGTCTCATCTTTGTGGTTGATAGTAATGATAGAG
ATCGTGTCGTAGAAGCAAGAGATGAATTGCATAGGATGTTGAATGAGGATGAACTTCGGGATGCTGTGCTGCTAGTTTT
TGCTAACAAACAAGATCTTCCTAATGCAATGAATGCTGCTGAAATAACTGATAAGCTTGGACTGCACTCTCTCAGGCAG
CGTCACTGGTACATCCAGAgcACTTGTGCAACATCTGGAGAggGCTTTATGaggGACTTGATTGgCTTtctaaCAACA
tcgc > SEQ ID NO:1965 139321 120653_300428_1
cagtatttGGCGTTAATCTCAGGCTTCCATTTCTCTCATTCTCTCTCTACATTTTCTCCTTCTCTCTTCGTTAGATCCC
TCTTTCAAAAGCTTCTTTCAGGGATCATCAACAAGAAGGGGAAATGGGGCTAACATTCACCAAGCTTTTCAGCCGGCTT
TTCGCCAAGAAGGAAATGCGAATTCTCATGGTTGGACTTGACGCAGCTGGTAAGACCACCATATTGTACAAGCTCAAGC
TGGGGGAGATCGTCACTACTATTCCTACCATTGGTTTCAATGTGGAAACTGTTGAGTACAAGAATATCAGCTTCACTGT
TTGGGATGTTGGGGGTCAGGACAAGATTCGTCCATTGTGGAGGCACTATTTCCAGAACACTCAGGGTCTCATTTTCGTG
GTTGATAGCAATGACAGAGACCGTGTTGTTGAGGCAAGAGATGAGTTGCACAGGATGTTGAATGAGGATGAGCTTCGGG
ATGCTGTGCTGCTTGTTTTTGCTAACAAACAAGATCTTCCTAATGCAATGAACGCTGCTGAAATAACTGATAAGCTTGG
ACTGCATTCCCTCAGGCAGCGTCACTGGTACATTCAGAGCACGTGTGCAACATCTGGAGAGGGCTTTACGAGGGTCTT
GATTGGCTTTCTAACAACATTGCCAACAAGTCCTAAggCGACGGAGAGtTTTTGCGGGTTGATCCTGGATGCAGGCGTA
TTTTTATCTAGTttCTTTTCcCaagTCTGgctatgaacCattgtcTtGACAgGCAttttGCATCTtgttagggCTTAAT
GAAATggCTC

FIG. 2 continued

> SEQ ID NO:1966 139321 129924_300483_1
GAATTCAGAAGAAGAAGAAGAAGAAAGAAGATCTCTGTCTTTCTCTCCATCCCCCTGTATACACCTCTTTCCCTGCAAA
GATGGGGCTGTCATTCACCAAGTTATTTAGTAGGCTGTTTGCCAAGAAGGAGATGAGAATTCTTATGGTAGGTCTAGAT
GCGGCTGGTAAGACTACAATATTGTATAAGCTCAAGTTGGGAGAGATTGTTACCACCATTCCTACCATTGGATTTAATG
TGGAGACTGTAGAGTACAAGAACATCAGTTTCACTGTGTGGGATGTTGGAGGTCAAGACAAGATCCGACCCTTGTGGAG
ACATTACTTCCAAAACACCCAAGGTCTTATCTTCGTGGTTGACAGCAACGATCGTGATCGTGTTGTTGAAGCTAGAGAT
GAACTGCATAGGATGTTGAATGAGGATGAGTTGAGAGATGCTGTGCTTCTAGTGTTTGCTAACAAACAGGATCTTCCAA
ATGCAATGAATGCTGCTGAGATCACTGATAAGCTTGGTCTTCACTCTCTTCGTCAACGACACTGGTACATCCAGAGTAC
ATGTGCAACTTCAGGAGAAGGGTTGTATGAAGGTCTTGACTGGCTCTCCAACAACATTGCTAACAAGGCATAGAAGTCT
CAACATTGATATTTTGGCCTATGTTGGTTGAATGTTGAATTATTTAGTATTTTCGTCATCATAAATGTCGTTACTGTAT
GTGTCTTCTTGTTCGTATATTTCTCTCCCCCTGTTAATTGTTGAGAAAGGAATTGTTCTTAATACCTTTCTTAtgtgaa
tgatttctatgttacagactacatttgtttctctttagatccataataattgcagagcatattaaaaaaaaaaa > SEQ ID NO:1967 139321 1113924_301907_1
TCTCTCTCTCTCTCTTCTTCTTCTTTAATACACAGAGAGAGAGAGAGACAGACACTCAGAGAGAGAGAGGATGGGGCTGAC
CTTCACGAAGCTCTTCCAGCGCCTCTTTGCCAAGAAGGAGATGCGGATCCTCATGGTGGGCCTCGACGCCGCCGGAAAG
ACCACCATCCTCTACAAGCTCAAGCTCGGAGAGATTGTTACCACCATCCCCACCATTGGGTTCAACGTGGAGACAGTGG
AGTACAAGAACATCAGCTTCACGGTGTGGGATGTGGGGGGCCAAAACAAGATCCGACCGCTCTGGAGACACTACTTCCA
GAACACGCAGGGTCTTATCTTTGTGGTTGATAGTAATGACAGACACCGCGCCATTGAGGCCCGTGAGGAGCTGCACAGA
ATGCTCAACGAGGATGAGCTCCGTGATGCTGGCCTCCTC > SEQ ID NO:1968 139321 174909_300528_1
cccacgcgtccgatccctgctcctcccCAACCCATCGCTTCCCCCCTCCACCCGTCTCCTCCGTCTCCGGCGCCGGCGC
CGGCGAGCTCGCCCCCCGCGATTCGTGCCCTCCGATCAGAGGCGAGGCGGGAGAAGAGATGGGGCTCACGTTCACCAAG
CTGTTCAGCCGGCTATTCGCCAAGAAGGAGATGCGGATCCTGATGGTGGGTCTTGACGCGGCCGGAAAGACCACAATCC
TCTACAAGCTCAAGCTCGGCGAGATCGTCACCACCATCCCCACCATCGGATTCAATGTTGAAACCGTGGAGTACAAGAA
CATCAGCTTCACCGTCTGGGATGTGGGGGGTCAGGACAAGATCAGGCCTCTGTGGAGGCATTATTTCCAGAACACCCAG
GGTCTCATCTTTGTTGTGGACAGCAATGATAGGGACCGTGTTGTCGAAGCCAGGGATGAGCTCCACAGGATGCTGAACG
AGGATGAGCTACGTGATGCTGTGCTGCTTGTCTTTGCTAACAAGCAAGATCTGCCAAACGCTATGAATGCTGCTGAGAT
CACTGATAAGCTTGGACTGCACTCCCTTCGCCAGCGACACTGGTATATCCAGAGCACTTGTGCTACAACAGGTGAGGGA
TTGTACGagggCCTggACTggCTGtccag > SEQ ID NO:1969 139321 156765_301369_1
ATTTTTATTCTCTAAATCCCTTTCCTTCGTCAAAAAGGCAGTTCTCAGATCAAAGATCAATTATTCAACTTTATTTCCT
CACCAATCAAATTATTGATCTTCGACTCTAATTCTGATAATCGCGATCTGGATTTTTAATCAATTTTTTGGATCAGATC
TATAAATTATGGGAGGTTTCATATCGAGATTCTGGTTCATGATGTTCCCAGCGAAAGAGTACAAGATCGTTGTAGTTGG
ATTGGATAACGCTGGTAAAACGACGACGCTTTACAAGTTGCATTTAGGAGAGGTCGTTACTACAAATCCTACTGTTGGT
AGTAATGTTGAGGAGCTTGTTTACAAGAACATACGATTTGAGGTCTGGGATCTTGGTGGGCAAGAAAGACTGAGAACAT
CATGGGCAACATACTATCGTGGAACTCATGCTGTCATTGCAGTTATCGATAGTACTGACAGAGCCCGTATCTCCATTAT
GAAAGATGAGCTGTTCAGGTTGCTCCCACACGAGGATCTTCAAAGTGCAGTTCTACTAGTCTTTGCGAACAAACAGGAC
CTTAAAGATGCCATGACCCCTGCAGAGATAACCGATGCGCTTTCCCTTCATAGCATCAAGAACCATGATTGGCATATTC
AAGCCTGCAGTGCACTGACTGGTGACGGTTTATACGATGGTTTAGGGTGGATT > SEQ ID NO:1970 139321 137885_300705_1
GTCTCCTCCGTCTCCGGCGCCGGCGCCGGCGAGCTCGCCCCCCGCGATTCGTGCCCTCCGATCAGAGGCGAGGCGGGAG
AAGAGATGGGGCTCACGTTCACCAAGCTGTTCAGCCGGCTCTTCGCCAAGAAGGAGATGCGGATCCTGATGGTGGGTCT
TGACGCGGCCGGAAAGACCACAATCCTCTACAAGCTCAAGCTCGGCGAGATCGTCACCACCATCCCCACCATCGGATTC
AATGTTGAAACCGTGGAGTACAAGAACATCAGCTTCACCGTCTGGGATGTGGGGGGTCAGGACAAGATCAGGCCTCTGT
GGAGGCATTATTTCCAGAACACCCAGGGTCTCATCTTTGTTGTGGACAGCAATGATAGGGACCGTGTTGTCGAAGCCAG
GGATGAGCTCCACAGGATGCTGAACGAGGATGAGCTACGTGATGCTGTGCTGCTTGTCTTTGCTAACAAGCAAGATCTG
CCAAACGCTATGAATGCTGcTGAGATCACTGATAAGCTTGGACTGCACTCCCTTCGCCAGCGACACTGGTATATCCAGA
GCACTTGTGCTACAACAGGtgAGGGAtt > SEQ ID NO:1971 139321 134729_300418_1
CTATCTCCTCTCCCTCTCCGCCCATTTCTCCTCTCCACCTGCGATCCATCCGCGCCCGCGAGGAGGAGGGAGCCGGACG
CCGCCGCGGGAGAGCAGGGAGGAGAAGGAGAGGAGGAGGAGATCGCCGTCGCCGTCGCCGTCGTCGATCTCGAGCGGGAGC
GGAGATGGGGCTCACGTTCACGAAGCTGTTCAGCCGCCTCTTCGCCAAGAAGGAGATGAGGATCCTCATGGTCGGTCTC
GATGCGGCCGGTAAAACCACCATCCTCTACAAGCTCAAGCTCGGCGAGATCGTCACCATATCCCCACCATCGGTTTTA
ATGTCGAAACTGTTGAGTACAAGAACATTAGCTTCACCGTTTGGGATGTTGGTGGTCAGGACAAGATCAGGCCCCTGTG

FIG. 2 continued

GAGGCACTATTTCCAGAACACCCAGGGCCTCATTTTTGTTGTGGACAGCAATGACAGAGAGCGTGTTGTTGAGGCCAGG
GATGAGCTCCACCGTATGCTGAATGAGGATGAGCTACGTGATGCTGTGCTGCTGGTGTTTGCAAACAAACAAGATCTTC
CTAATGCCATGAACGCTGCTGAGATCACCGAcaaGCTTGGTCTgcaCtccttGCGCCAGc > SEQ ID NO:1972 139321 130834_300491_1
GATCCAAACCAAACCCTCCAATTTCCAGATCTCCACATCGCGCTTGAAAAAACTCTACCTATAACTATTACTAAAGAAG
ATATATTAGGGAGATCGAAAGATCTCAATATAGATTCTACCGGGGAGAAAGAAGGGGAGCAATTACCACCGTTGGATCT
GTCTCTGAATTTCATGCTCATCTGATTACTTGTTTGCCTCTAACTGAAACAAACAATGGGCATTCTGGTTACTAAAATG
TCCTCTTCTGTTTTTGGTAACAAAGAAGCTCGGATCCTTGTTCTTGGCCTTGGCAATGCTGGGAAAACTACCATTCTCT
ATCGTCTTCGAATGGGAGAAGTAGTATCAACAATTCCAACAATTGGGTTTAATGTGGAAACAGTTCAATATAACAATAT
CGAATTTCAAGTCTGGGATCTTGGTGGTCAGACAAGTATTAGACCCTATTGGAGATGCTATTTCCCAAATACTCGAGCA
ATTATCTATGTGATAGATGCCAGTGACACTGATAGGATTGCAATAGCAAAAGAAGAATTTCACGCTATATTGGAGGAGG
ATGAGTTAAAAGGTGCAGTTGT > SEQ ID NO:1973 139321 1109085_301543_1
AGGCTTTTTCTTCCACATAGATCAGATCCAATATTGCCAAAAGAGGACTGAGATTCCAGATCCCATTCTCTCTCTCCTT
GTCTGTGTGAAGCAGGGGAGAGACTGAGCCTAGCCATCATGGGGCTCACCTTCACCAAGCTCTTCCAGCGCCTCTTCGC
CAAGAAGGAGATGCGCATCCTCATGGTCGGCCTCGACGCTGCCGGAAAGACAACGATCCTTTACAAGCTCAAGCTTGGC
GAGATCGTCACCACCATTCCCACCATTGGTTTTAATGTTGAAACTGTTGAGTACAAGAACATCAGCTTCACGGTGTGGG
ATGTTGGGGGCCAAGATAAGATCCGTCCATTGTGGAGGCATTATTTCCAGAATACCCAAGGCCTCATATTTGTGGTGGA
TAGCAATGACAGGGATCGTGCCATCGAAGCTCGAGATGAACTGCACCGGATGCTCAATGAGGATGAGCTTCGGGATGCA
GTGCTCCTTGTTTTTGCGAATAAGCAAGATTTGCCGAATGCAATGATGCCGCAGAGATCACTGACAAACTAGGCTTGC
ACTCTCTTCGTCAACGCCACTGGTACATTCAGAGTACCTGCGCAACTTCAGGGGAAG > SEQ ID NO:1974 139321 225543_300988_1
AAGAGGATGGGGCTGCTGACGATCATCCGCAAGGTAAAGCGGAAGGAGAAGGAGATGCGCATTCTCATGGTGTAAGATC
TCTGCTTTGATCTGTCGCTCGACCTCTCTTTCTTCTCGCTGTGCGGCAGAGGATTGGACAATGCGGGCAAGACGACCAT
TGTCAAGCGAATGAATGGCGAGGACATCAGCGATATCAGCCCTACTCTTGGATTTAACATCAAGACGATGCGTTATGGC
AAACTGAACATATGGGACGTTGGTGGCCAAAAGACTTTAAGATCGTACTGGAGGAACTACTATGAGCAAACAGATGGTT
TAGTGTGGGTGGTGGATAGCGCTGATTTGCGTCGCCTCGACGACTGCAAGAAGGAGCTACACAATCTTCTCAAAGAGGA
GCGTCTTGCCGGAGCTTCCCTACTGATCATGGCAAACAAGCAGGACATAGATGGTGCTTTGAACGTCGACGAGATCTCA
AAGGTACTGCGGCTCGATTTGATGGACAAAAGCAGGCATTCTCGAACTGTCGGGTGCAGTGCAGTCACTGGTGATGGAT
TACTCGAAGCATTCGACTGGCTGGTCTCGGACATAGGCTCGCGTATTTATCTCCTGGACTAGGTGGATGCTTGCACGAA
GGAAAG > SEQ ID NO:1975 139321 1099103_301488_1
GAGAGAGAGAGAGAGAGAGAGAGCGCATTTGCATTTCCGTTTGCGTTTGCATTTGGATTTGGATTTGGATTTGTGAG
ATTCGTTTGTGGCCTTCCCCCTTCTCCCTCTGCAGGATTTGAGCTTCCCTTCTCTCAAGCAAGTGATTATTCACACTTA
CATCTGTATTGCAAAACGGCCCCATCTCAACCGATCTTGATTTAGAGCAGATTCCTGGACAGATCTTTCTGACGAATTT
CTGAGAATGGGGGCTATTATGTCCCGCCTCTGGTTCCTTCTGTTTCCGTCGAAAGAGTATAAAATGGTCGTGGTAGGAT
TGGACAATGCTGGGAAGACAACCACTCTCTACAAGCTGCACTTAGGGGAAGTGGTGGTCACTCAGGCCACTGTGGGAAG
CAATGTCGAGGAGATCATCTATAAGAATATCAAGTTTGAGGTATGGGATTTAGGTGGCCAAGAACGTCTTCGGAGATCT
TGGGTGACGTATTACAAAGGGACTCATGCGGTCGTGATGGTGATCGACAGCACGGATCGTGCTCGTATCTCTATCGTGA
AAGACGAGCTGTTCCGGCTTCTCCAGCACGAGGACCTC > SEQ ID NO:1976 139321 1097933_301456_1
TTCCAGGCCAGTCTAGGAGAGACAGACAGACAGAGAGAGAGAGCGATACCAGGAGAGAGAGACAGAGATAGAGAGATAG
AGAGAAGGTGAGGCCAGGAGAGAGAGAGAAAGAGACAGAGAGAAAGATGGGGATCACCTTCGGGAGGCTGTTCGAGCGG
TTGTTTGCAAAGAAGGAGATGCGGATCCTGATGGTGGGCCTCGACGCTGCCGGAAAAACCACCGTCCTCTACAAGCTTA
AGCTTGGCGAAGTTGTCACCACCATCCCTACCATTGGTTTCAACGTGGAGACGGTCGAGTACAAAAACATAAGCTTTAC
TGTGTGGGATGTTGGGGGTCAGGACAAGATCAGACCTTTGTGGAGGCATTACTTTCAGAACACACAGGGGTTGATATCC
GTTGTGGATAGCAATGACCGAGACCGTGCAGTGGAGGCCCGTGATGAGCTTCATAGGAT > SEQ ID NO:1977 139321 20076_300163_1
gcgaAACAGAACATCCATAGCTTTCGCATTTTATTGTCATTTCTAAAGGGCAGAGTCTTTTCTAGATCTGCCCCTCTT
TCTCGCTCTCTCCTGATTCGTTGTTCATCACTGCATTGAGAAAGATGGGTTTATCATTCGGGAAGCTTTTCAGTCGGC
TGTTTGCCAAGAAGGAGATGCGTATTCTGATGGTCGGTCTTGATGCAGCTGGTAAAACCACCATATTGTACAAGCTCAA
GCTGGGAGAGATTGTTACCACCATTCCTACCATTGGATTCAATGTGGAGACTGTTGAATACAAGAACATAAGCTTCACT
GTCTGGGATGTTGGTGGTCAGGACAAGATCCGACCATTGTGGAGGCATTACTTCCAAAACACACAAGGACTTATCTTTG

FIG. 2 continued

TGGTCGATAGTAATGATCGTGATCGTGTTGTTGAGGCTAGAGATGAGCTGCACCGAATGTTGAATGAGGATGAACTGAG
GGATGCTGTGCTGCTTGTGTTTGCTAACAAGCAAGATCTTCCAAATGCTATGAATGCTGCTGAGATTACTGACAAGCTT
GGTCTTCACTCTCTCCGCCAACGTCACTGGTACATTCAGAGCACTTGCGCTacctctggAgaagggttGTATGAGGGGC
ttgactggcTCTCAaacaca > SEQ ID NO:1978 139321 190593_300693_1
cccCACCGCACCCGCAAGCGCAAGCCCAGCCGCCTCGTCGTGTTCGCGTTCGTCGCGCGGCTCCGACCTCCAAAGCCGC
CGCTACCCTTCCCGTCTTCGTCGTCGCCGCGCACGCAGATCGCGAACCAGCCCGCGCGCCGCGCAGCAGCGCCGCGGAG
AGGAAAGGAGAGCTCCGCCGCGCACCCCCCGCCACCATCTCGTAGGGAGAGATGGGGCTCACGTTCACGAAGCTGTTCA
GCCGCCTCTTCGCGAAGAAAGAGATGAGGATTCTCATGGTCGGGCTCGATGCAGCCGGTAAGACCACCATCCTCTACAA
GCTCAAGCTTGGCGAGATCGTCACGACCATCCCCACCATCGGATTTAATGTTGAAACCGTGGAATACAAGAACATCAGC
TTCACTGTTTGGGATGTCGGTGGCCAGGACAAGATCAGGCCCCTGTGGAGGCACTATTTCCAGAACACACAGGGACTCA
TCTTTGTTGTGGACAGCAATGATAGGGAGCGTGTTGTTGAGGCCAGAGACGAGCTTCACAGGATGCTGAACGAGGATGA
GCTGCGTGATGCTGTGCTGCTTGTATTTgcaAACAAACAAGATCTTCCTAATgccATGAATgcaGCTGAAATCACTGAc
aaGCTTggTtt > SEQ ID NO:1979 139321 190555_300693_1
ccectctCTCTCCCCATCTATCTCCTCTCCCTCTCCGCCCATTTCTCCTCTCCACCTGCGATCCATCCGCGCCCGCGAG
GAGGAGGGAGCCGGACGCCGCCGCGGGGAGAGCAGGGGAGAGAAGGAGAGGAGGAGATCGCCGTCGCCGTCGCCGTCGC
CGTCGCCGATCTCGAGCGGGAGCGGAGATGGGGCTCACGTTCACGAAGCTGTTCAGCCGCCTCTTCGCCAAGAAGGAGA
TGAGGATCCTCATGGTCGGTCTCGATGCGGCCGGTAAAACCACCATCCTCTACAAGCTCAAGCTCGGCGAGATCGTCAC
CACTATCCCCACCATCGGTTTTAATGTCGAAACTGTTGAGTACAAGAACATTAGCTTCACCGTTTGGGATGTTGGTGGT
CAGGACAAGATCAGGCCCCTGTGGAGGCACTATTTCCAGAACACCCAGGGCCTCATTTTTGTTGTGGACAGCAATGACA
GAGAGCGTGTTGTTGAGGCCAGGGATGAGCTCCACCGTATGCTGAATGAGGATGAGCTACGTGATGCTGTGCTGCTGGT
GTTTGCAAACAAACAAGATCTTCCTAATGCCATGAACGCTGCTGAGATCACCGACAAGCTTGGTCTGCACTCCTTGCGC
CAGCGGCACTGGTACATCCAGAGCACATGTGCTACCTCTGGTGAgGGGTTGTATG > SEQ ID NO:1980 139321 179542_300561_1
actaccccaaatcctgttgacgccatcgtcgctccatttacatcttttgcacaccacctgagaaagataataaaattcg
cCTCACTGCTTTTTTTCTCCGTTTCAACTTGACTTTGCCTGCTTACGCGTAGCATCAAACAGGACCTTTTTTTTCTCT
TCTATTCACATATTCGACGTTTGTTAGGCCGCGTCGCCGCCAGTCGCAATCATGGGTCTCGCCTTTTCTAAGATTTTCG
ACAAGCTGTGGGGGAAGAAGGAGATGAGAATTCTCATGGTCGGTCTCGATGCCGCCGGTAAAACCACCATTCTGTACAA
GCTGAAGCTTGGTGAAATCGTCACCACCATCCCCACTATTGGCTTCAACGTCGAGACTGTTGAGTACAAGAACATCCAG
TTCACCGTGTGGGATGTCGGTGGTCAGGACAAGATCCGTCCTCTGTGGAGACACTACTTCcaGAACACCCAGGGCATCA
TCTTCGTCGTCGACAGCAACGATCGGGATCGTATCGTCGAGGCCCGAGAGGAACTTCAGCGTATGCTGAACGAGGATGA
GCTGCGAGATGCCATCCTGCTCTTCGCCAACAAGCAGATCTGCCCAACGCCATGAACGCTGCCGAGATCACTGAC
AAGCTCGGCCTTCACAGCCTGAGGCAACGTGCCTGGTACATCCAGTcgaCTTGTGCCACATCCGGAGATGGTCTGTAcg
agggtCTCGAATGGCTCGCCACCACTCTCCGAAAggCTggtcaCCaGTaAACAGACTACCCcaggacCCtctacCggta
gagcctcCCGCTCt > SEQ ID NO:1981 139321 230754_301071_1
acGcGTCGGTTCTTGGCTGTCTAGGGCGATCGATCTCTCCATCGCCGCTGCGGATCGAAGCTCGCCGCCATGGGGCTCA
CCTTCACCAAGCTCTTCCAGCGCCTCTTCGCCAAGAAGGAGATGGAATCCTCATGGTGGGTCTGGATGCCGCGGGTAA
GACCACCATCCTCTACAAGCTCAAGCTGGGCGAGATCGTGACGACCATTCCCACCATCGGGTTTAATGTGGAGACTGTC
GAGTATAAGAACATCAGCTTCACCGTGTGGGATGTCGGAGGTCAAGACAAGATCCGGCCATTGTGGAGACACTATTTCC
AGAACACTCAAGGTCTGATTTTCGTGGTGGACAGCAACGATAGAGACCGTGTTGTGGAGGCCAGGGATGAGCTCCACAG
GATGCTCAACGAGGACGAGCTGAGAGATGCGGTGTTGTTGGTGTTCGCCAACAAGCAAGATCTTCCCAACGCCATGAAC
GCGGCCGAGATCACCGACAAGCTCGGCTTGCATTCTCTCCGCCAGCGCCACTGGTACATCCAGAGCACTTGCGCCACCT
CTGGAGAGGGTCTCTACGAAGGACTCGACTGGCTGTCGAACAACATCGCGAACAAGGGCTGAGTGATCAGTACCGATCG
ATCCATTTGAAGTTTTGCGCTTTCATCATCATGACTATCTACAATATATAGATTACAAAAATGTGGCTTTTGTTCTCTT
AGGTCTAGATATAAATTTgtg > SEQ ID NO:1982 139321 238053_301291_2
CACCCACACCATCACCAGCACGCACAGGCTCTCTTGAATATCGCCCGTTCGAGAGTCTTTTCACCGCCTCTACACCTTC
CTCCCTACACACCACACACCCGCCAATATGGGTCTCACATTCTCGAAGCTTTTCGATAAGCTATGGGGCAAGAAGGAGA
TGCGCATTCTCATGGTCGGTCTCGACGCTGCCGGAAAGACCACAATTCTCTACAAGCTCAAGCTCGGTGAAATCGTCAC
CACCATCCCCACCATTGGTTTCAACGTCGAGACAGTCGAGTACAAGAACATCTCCTTCACCGTGTGGGATGTCGGTGGT
CAGGACAAGATCCGTCCTCTCTGGAGGCATTACTTCCAGAACACCCAGGGTATCATCTTCGTTGTCGACAGCAACGATC
GCGACCGTGTTGTTGAGGCCCGTGAGGAGCTCCAGAGGATGTTGAACGAGGACGAGCTGAGGGACGCCCTTCTCCTGGT

FIG. 2 continued

```
CTTCGCCAACAAGCAGGATTTGCCCAACGCCATGAACGCTGCTGAGATCACTGACAAGCTTGGCCTTCACAGCCTCCGA
CAACGCGCCTGGTACATCCAGTCGACCTGCGCTACATCCGGTGACGGTCTGTACGAGGGTCTCGAGTGGTTGTCCAACT
CCCTCCGCAAGGCCGGTCACAACTAAGCTCCTCTACCCCGTACGT

> SEQ ID NO:1983  139321 252849_301605_1
GGCTTTTTCTTCCACATAGATCAGATCCAATATTGCCAAAAGAGGACTGAGATTCCAGATCCCATTCTCTCTCTCCTTG
TCTGTGTGAAGCAGGGGAGAGACTGAGCCTAGCCATCATGGGGCTCACCTTCACCAAGCTCTTCCAGCGCCTCTTCGCC
AAGAAGGAGATGCGCATCCTCATGGTCGGCCTCGACGCTGCCGGAAAGACAACGATCCTTTACAAGCTCAAGCTTGGCG
AGATCGTCACCACCATTCCCACCATTGGTTTTAATGTTGAAACTGTTGAGTACAAGAACATCAGCTTCACGGTGTGGGA
TGTTGGGGGCCAAGATAAGATCCGTCCATTGTGGAGGCATTATTTCCAGAATACCCAAGGCCTCATATTTGTGGTGGAT
AGCAATGACAGGGATCGTGCCATCGAAGCTCGAGATGAACTGCACCGGATGCTCAATGAGGATGAGCTTCGGGATGCAG
TGCTCCTTGTTTTTGCGAATAAGCAAGATTTGCCGAATGCAATGAATGCCGGAGAGATCACTGACAAACTAGGCTTGCA
CTCTCTTCGTCAACGCCACTGGTA

> SEQ ID NO:1984  139321 2681_300345_1
cccacgcgtccgattgcTCTTTCAAATTTCTTCGAGTCTCTCTCGCTCTCTCCGTTTCTTCGCgggcTCTCTCTCTCAG
ATCTCTCCGAAACATTCTTCGTAGTGAAGCAAAATGGGGTTGAGTTTCGCCAAGCTGTTTAGCAGGCTTTTTGCCAAGA
AGGAGATGAGAATTCTGATGGTTGGTCTTGATGCTGCTGGTAAGACCACAATCTTGTACAAGCTCAAGCTCGGAGAGAT
TGTcACCACCATCCCTACTATTGgtttCAATGtGGAAACTgtggaATACAAGaacATTAGTTTCACCgtgTGGGATGTC
GGGGGtcAggACAAGATCCgtcCCTTGTGGAGACACTAct > SEQ ID NO:1985  139321 279465_200062_1
aagcagacccttgagctttctctgaagtaaagcaaaaggggggcaaatgggattagtgttttcgcgattgttctcatcg
tTATTTGGGAATAAGGAAGCTCGGATCTTAGTTCTTGGACTCGACAATGCTGGAAAAACAACCATTCTCTATCGGCTTC
AGATGGGTGAAGTAGTTTCAACTATTCCAACAATTGGATTTAATGTTGAGACGGTGCAGTATAACAATATAAAGTTTCA
AGTTTGGGATCTAGGGGGTCAGACTAGTATCAGGCCATACTGGAGATGCTATTTTCCTAATACGCAAGCTATAATCTAC
GTTGTTGACTCAAGTGACACTGATAGGCTCGTGGTTGCTAAGGAGGAGTTCCATGCCATATTGGAGGAGGAAGAGTTAA
AAGGCGCTGTTGTTCTCGTATATGCTAACAAGCAGGATCTTCCTGGTGCACTTGATGATGCTGCAGTGACCGAGGCCTT
AGAGTTGCACAAGATTAAAAATAGGCAATGGGCTATTTTTAAGACTTCTGCCATCAAAGGAGAGGGCCTTTTTGAGGGT
TTGGACTGGTTGAGTAATACACTCAAATCCGGAGGTAGATGCAGCTAATTTTAAGACAAGACAGACAAACGCGAACTT
GGTATAATGTGTGAAGAGATACCggctcCGacaTTTTCTAATTGTCATAGTTTCTGAAGTGAACTGCTCTGATATAGTG
TTAATACTTGTCACAGATAATGAGAATACGATGTTTTATTTTTGCCTCTCTTCATAGATTACAGCTATTCCGTTTCTC > SEQ ID NO:1986  139321 272331_200043_1
cctaatttatctctctttccgtgccagagcagagggaaacgcggctaacgacagctccattcctagatctacatactca
aTTTTCCGATCGTCGATCTCCGTTATACAGAGATGGGGCTGTCTTTCGGTAAACTTTTCAGTCGCCTCTTTGCTAAGAA
AGAAATGCGTATTCTTATGGTTGGTCTTGATGCTGCTGGTAAAACCACAATTCTTTACAAGCTCAAGTTGGGGGAAATT
GTTACCACTATCCCTACTATTGGCTTCAACGTGGAGACTGTTGAATACAAGAACATCAGCTTTACTGTGTGGGATGTTG
GAGGTCAAGACAAGATTCGACCACTATGGAGGCATTATTTCCAGAACACACAAGGCCTCATCTTTGTGGTTGATAGCAA
TGACCGAGATCGTGTAGTTGAGGCTAGGGATGAGCTTCATAGGATGTTAAATGAGGATGAATTGAGAGAGGCTGTGCTG
CTTGTTTTGCAAACAAACAAGATCTTCCAAATGCAATGAATGCAGCTGAAATCACCGATAAGCTTGGCCTTCATTCTC
TTCGACAACGACACTGGTATATCCAAAGTACGTGTGCCACTTCTGGAGAAGGATTGTACGAAGGACTAGATTGGCTTTC
GAACAATATTTCAAACAAGGCATAGGTCATCCCATGAGGTTGCACTCCAGCCCACGTTCCTTAATTTGGAGTACAAATG
TTAAACACCATAGCTTTTATCATTATCTCTTAGTTTGGTGGTTTAGACTTCTGTTTCATATCTTCTGTGGTCATAGAAG
TGATTAAACTCTGAAAATCACCCGCCTTTCTTTCATTTTTGGTTTTCTTATTAATGAAATCTCATTGTCAACAATACTT
GTGGGTCAGCTACCACATTGCTGGATGTGCACATTTGTAATGTGAACACACTTTAGTACAATACTGGCTTTCGTAtcc > SEQ ID NO:1987  139321 239957_301309_1
GGGTGGCTAGGTCGTGATCTGGCGCGGATCGAATTTCCGGCGGCGATGTTCTCGCTGTTGTATGGGCTGTTCAAGTCC
ATACAATATCTCTTCAGCAAGGCGGAGTTCCACGTTTTGATCCTCGGCATTGACAAGGCGGGGAAGACTACGCTGCTGG
AGAAGCTCAAAACGATCTACTCGGATTTCGAGGGCCTGCCGCCGGATCGAATCGTTCCCACTGTCGGCCTCAATATTGG
CCGCGTCCAAGCTTACCAGTCGAAGCTTATTTTCTGGGATCTAGGAGGACAGCTAAGCCTGAGGACGATCTGGGAGAAA
TATTTCGAAGAAGCTCATGCTATTGTCTTTCGGTTGATGCCACAAACCATGCTCGATTTGACGATGCAAAGTCGGCCC
TTGAGAAAGCTCTGAGACACAAGGATTTGCAAGACGCTCCATTGCTCATCTTTGCTAACAAGCAG > SEQ ID NO:1988  139357 129367_300405_1
cccccccgacggatccattctttattggtggcatcatcattatccaattctcaccgatccatcgaacgaacgatccaac
aactaaatcaacagtacatagctaggaagcatggcccgtgcacagttgagagttggacgcccctggtggcagaatctgct
cctcgccgcccacgcacgccgacgtggccatacacCTGCggccaggtcaACTCCGccgtcGGGCCCTGCCTGACCTacg
```

FIG. 2 continued cCCGcggcggcgCCGGGCCCGTCGGCGGCCTGCTGCAGCGGCGTGAGGAGCCTCAAGGCgGgAGCAAGCACGACCGCaga
CCGGggCACCGCCTGCAACTGCCACCTagtagATTCTGCCTGGGTCGATgtgtgGAGCCGAATTcTgTATCCAgcacta
gtagtaTCATATcTgCATTCTGGAATAAAAGatgaGCTAGCTAAGGTCTCGATCAATcacCATGCAtG > SEQ ID NO:1989 139357 167913_300552_1
GAATTCAGAGATAACAGATAACAAAAGAAAGGGTCGGTTTACTAAGAAATGGCAAACTCCAGCAACAATGCAGTCAAGG
TTGTGAGTACTTTGGTGTTGATGTGCATGTTAATCAGTGCACCATATATGGCTGAAGCTATAACTTGCGGTGAAGTTGT
TTCGTCTCTGGCTCCTTGTATTATGTACTTGACCGGAAAAGGTGCCTTAACATCAGGATGCTGCGGAGGAGTAAAAAGT
TTAAACAGCGCAGCCAAATCAACACCCGACAGAAAGACTGCTTGTAATTGTTTGAAATCTTCAGCCGGTAGTATTAAGG
GAATTAACTACGGTCTTGCTGGTAGCCTCCCAGGCAAATGCGGTGTTAGCATTCCTTACAAGATCAGCCCTTCTACCGA
CTGTACCAAGGTGGTGTAAGAAGCTTGATGAGACTTGTACGCAATATCCCACCGTCTGATATATGGATCGCGTGGATGA
GAATAAGCAACGGAGCTTCCTTGATCGTTGAATGCTCCTGCATTAGAGCATCTTAGAGTTTCTTTGAGTTTGAACTACT
TATATTCTGTTGTGTAATGTCATGTTGTCGATTTTCCTATTATGGATATATTGATGGCAAAGTTTT > SEQ ID NO:1990 139357 170429_300533_1
cccacgcgtccgcccacgggtccgCTCACCTGCAGCAGCAAACGAGCACCACACACCAGCAGCAGCAGCAAGTCGATCG
ATCGTCAGCACACACGACCAAGATCGAGATGGCCCGTGCACAGCTGGTGTTGGTCGCCCTCGTGGCAGCGGCTCTGCTC
CTGGCGGGCCCACACACCACCATGGCCGCCATCAGCTGCGGCCAGGTCAACTCCGCCGTGTCGCCCTGCCTCAGCTACG
CCCGCGGCGGCTCCGGCCCGTCGGCGGCCTGCTGCAGCGGCGTCAGGAGCCTCAACTCCGCCGCCAGCACCACCGCCGA
CCGCCGCACCGCCTGCAACTGCCTCAAGAACGTGGCCGGCAGCATCAGCGGCCTCAACGCCGGCAATGCCGCCAGCATC
CCCTCCAAGTGCGGCGTCAGCATCCCCTACACCATCAGCCCCTCCATCGACTGCTCCAGCGTGAACTAATCTGATCGAT
CGATCGCTACCGGCCGGAGGGTGTGACATCGCAGGCCGTACATGCACCTGTCGTCGTCTCACGCTTTGTATCTTGTgTT
ATCTGTGTTTATGCTGAATAAAATGAGAGCTAGCTAGCTAGGTcG > SEQ ID NO:1991 139357 135679_300416_1
cccacgcgtccgatctcatggtcagcaACCAATTCGCACCGATCGATCGATCGATCGATCCAGCAACTAGATCAACAGT
ACTAGCTAGGAAGCATGGCCCGTGCACAGTTGGTGTTGGTCGCCCTGGTGGCAGCTCTGCTCCTCGCCGCCCCGCACGC
CGCCGTGGCCATCACCTGCGGCCAGGTCAACTCCGCCGTCGGGCCCTGCCTGACCTACGCCCGCGGCGGCGCCGGGCCG
TCGGCGGCCTGCTGCAGCGGCGTGAGGAGCCTCAAGGCGGCAGCAAGCACGACCGCAGACCGGCGCACCGCCTGCAACT
GCCTCAAGAACGCGGCCCGCGGCATCAAGGGGCTCAACGCCGGCAACGCCGCCAGCATCCCCTCCAAGTGCGGCGTCAG
CGTCCCCTACACCATCAGCGCTTCCATCGACTGCTCCAGGGTGAGCTGAGCCATCGATCAGAGACGGATCATATATA
TACAGCAGCGCGCCGGTTGCCACCTAGTAGATTCTGCCTGGGTCGATGTGTGGAGCCGAATTCTGTATCCAGTACTAGT
AGTATCATATCTGTATTCTGGAATAAAAGATGAGCTAGCTAaggtCTCGATCAATCACCATGCATGCATGTGTgtgCAT
ccATg > SEQ ID NO:1992 139357 190853_300736_1
CGATCCATCCATCATCCATCTCATCATCAGCAACCAATTCGCACCGATCGATCGATCGATCCAGCAACTAGATCAACAG
TACTAGCTAGGAAGCATGGCCCGTGCACAGTTGGTGTTGGTCGCCCTGGTGGCAGCTCTGCTCCTCGCCGCCCCGCACG
CCGCCGTGGCCATCACCTGCGGCCAGGTCAACTCCGCCGTCGGGCCCTGCCTGACCTACGCCCGCGGCGGCGCCGGGCC
GTCGGCGGCCTGCTGCAGCGGCGTGAGGAGCCTCAAGGCGGCAGCAAGCACGACCGCAGACCGGCGCACCGCCTGCAAC
TGCCTCAAGAACGCGGCCCGCGGCATCAAGGGGCTCAACGCCGGCAACGCCGCCAGCATCCCCTCCAAGTGCGGGGTCA
GCGTCCCCTACACCATCAGCGCTTCCATCGACTGCTCCAGGGTGAGCTGAGCCATCGATCAGAGACGGATCATATATAT
ACAGCAGCGCGCCGGTTGCCACCTAGTAGATTCTGCCTGGGTCGATGTGTGGAGCCGAATTCTGTATCCAGTACTAGTA
GTATCATATCTGTATTCTGGAATAAAAGATGAGCTAGCTAaggtcTcgaTcaaTCACCATGcatccATGGTTgatcggg
ccggtca > SEQ ID NO:1993 139357 175572_300545_1
ccCCCCGATCCATCTCATCAGCAACGAACCAATTCACACCGATCGATCGAGCAACAGTAGTAGGAACCATGGCCCGTGC
ACAGTTGGTGTTGGTCGCCGTTGTGGCAGCTCTGCTCCTCGCCGCCCCGCACGCCGCCGTGGCCATCACCTGCGGCCAG
GTCAACTCCGCCGTTGGGCCCTGCCTCACCTACGCCCGCGGCGGCGCCGGCCCGTCGGCGGCCTGCTGCAGCGGCGTGA
GGAGCCTCAAGGCCGCAGCCAGCAGCACCGCTGACAGGCGCACCGCCTGCAACTGCCTCAAGAACGCGGCCCGCGGCAT
CAAGGGGCTCAACGCCGGCAACGCCGCCAGCATCCCCTCTAAGTGCGGCGTCAGCGTCCCCTACACCATCAGCGCTTCC
ATCGACTGCTCCAGGGTGAGCTGAGCTATCGATCGGATGGATCATTTATATGCATACAGAAGCGCGACGGTGGGTCGAT
GTGTGGAGCCGATCGAATTCTGTATCCAATATTAGTAGTATCTGTACGTATTCTGGAATAAAAGATGAGCTAGCTAAG
GTCGATCAATCACCATGCATGCATGTGTGTGCATCCATGGTTGATcggcccGGCCGgtcAGGCTagcTAGCTTTCTtCT
TCTTGTGTgttcatCTCGTACGTTTTGCTCCTTCTCGaggTGTACGTGTACCAGAGAgagctag

FIG. 2 continued

> SEQ ID NO:1994 139357 175546_300545_1
CCCGATCGATCGATCTCACCTGCAGCAGCAAACGAGCACCACACACCAGCAGCAGCAGCAAAGTCGATCGATCGTCAGC
ACACACGACCAAGATCGAGATGGCCCGTGCACAGCTGGTGTTGGTCGCCCTCGTGGCAGCTCTGCTCCTGGCGGGCCCA
CACACCACCATGGCCGCCATCAGCTGCGGCCAGGTCAACTCCGCCGTGTCGCCCTGCCTCAGCTACGCCCGCGGCGGCT
CCGGCCCGTCGGCGGCCTGCTGCAGCGGCGTCAGGAGCCTCAACTCCGCCGCCACCACCACCGCCGACCGCCGCACCGC
CTGCAACTGCCTCAAGAACGTGGCCGGCAGCATCAGCGGCCTCAACGCCGGCAATGCCGCCAGCATCCCCTCCAAGTGC
GGCGTCAGCATCCCCTACACCATCAGCCCCTCCATCGACTGCTCCAGCGTGAACTAATCTGATCGATCGATCGCTACCG
GCCGGAGGGTGTGACATCGCAGGCCGTACATGCACCTGTCGTCGTCTCACGCTTTGTATCTTGTGTTATCTGTGTTTAT
GCTGAATAAAATGAGAGCTAGCTAGCTAGGTCGATCGATCGATCGCCATGCATGACGAGACTAGCTAGCATTGCTGCTA
GATCGATGCATGCATATGGTTGATCGCCCGGTCACTACGCTATCTGTTTCCTTAATTTATTCGTCGATCGACTACGTAC
GTACCTGAGAGCTAGACATCAGTTTTTGTACCATGCATATGCATATGAACTTCTGCATGTACATGCAGTACTACTTGTA
CTACGTGCGTGTacgttgtgGATTATACATTATATAGACAGCTTCTTTTgGTATAC > SEQ ID NO:1995 141821 208692_300807_1
ATTCATCACATAGCACCTGTCAACGGCTGGGCAGCATGATTGCTACCCGCCTGATACCCCGAAGTGCCATCCGCACGCT
GCCCAGCAGGCAATTGACCCTGTCACGATGGAGTCGAGGATTTGCCTCTGCTTCTGAGGAGAAGGACCTGATCATCATC
GGTGGTGGTGTTGCCGGATATGTGGCCGCCATCAAGGCCGGACAGGAGGGCATGAAGGTGGCCTGCATTGAAAAGCGTG
GCACCCTCGGCGGTACCTGCTTGAACGTTGGCTGCATTCCCTCAAAATCGCTGCTCAACAACTCCCACCTGTACCACCA
GATTCTCCATGACTCAAAAAACCGCGGTACCGAGGTCGGAGGCGTTAAACTCAACCTCGGACTTTCATGAAGGCCAAG
GAAACCGCCGTTACCGGCCTGACCAAGGGTGTCGAGTTCCTCCTGAAAAAGAACGGCGCCGAGTACATCAAGGGCACCG
GTTCCTTCATCAACGAGAACGAAATCAAGGTCGAACTCAATGACGGCGGCGAATCCGTCATCCGCGGCAAGAACATTCT
CATCGCCACCGGCTCTGAAGCCACTCCCTTCCCCGGCCTCA > SEQ ID NO:1996 141821 267022_200088_1
tgaagttctcttccGTTGAGGTAGATCTTCCTGCCATGATGGGCCAAAAAGATAAAGCTGTGGCTAACTTAACACGAGG
TATTGAGGGTCTATTCAAGAAGAACAAAGTGAACTATGTTAAGGGCTATGGCAAATTCCTTTCTCCTTCTGAAGTTTCT
GTCGACACTGTGGAAGGTGGTAATACTGTTGTTAAGGGGAAGAATATTATAATTGCCACTGGTTCTGATGTCAAAAGTC
TACCTGGGCTAACTATTGATGAGAAGAGAATTGTATCATCCACTGGAGCTTTAGCTTTGACCGAAGTTCCAAAAAAGCT
GGTTGTTATTGGTGCTGGCTACATAGGCCTTGAAATGGGATCTGTCTGGGGCCGTCTTGGCTCAGAGGTGACTGTTGTT
GAATTTGGACCTGATATTGTTCCATCCATGGATGGTGAAGTTCGCAAGCAATTCCAACGTTCTCTTGAGAAGCAAAAGA
TGAAGTTCATACTTAAAACTAAGGTAGTATCAGTTGAGACTGTTGGCGATGGTGTGAAGTTGACCCTTGAACCTGCAGC
TGGTGGTGATCAAACTACTCTTGAGGCTGATGTTGTTCTTGTTTCTGCTGGTAGAATTCCGTTCACTTCAGGGCTTGGA
TTGGACAAGATAGGTGTTGAAACTGACAAGGCTGGTCGATCTTGTCAATGAACGTTTTGCAACTAATGTCCCGGGGG
TACATGCAATTGGTGATGTCATTCCTGGGCCAATGCTGGCTCACAAGGCAGAGGAGGATGGTGTTGCTTGTGTGGAATT
CATTGCAGGCAAGGAGGGTCATGTGGACTACGATTTGGTCCCTGGTGTTGTTTACACGCACCCAGAGGTGGCTTCTGTT
GGGAAAACTGAAGAACAAGTTAAGGCACTTGGCGTTGATTATCGTGTAGGAAAATTTCCCTTCCTTGCAAACAGTAGGG
CCAAGGCAATTGATGATGCTGAGGGAATTGTAAAAGTACTTGCTGAGAAGGAGACTGACAAAATCTTGGGTGTTCATAT
TATGTCACCAAATGCAGGGGAGCTTATTCACGAGGCTGTCCTGGCTTTGCATTATGGAGCATCAAGTGAGGACATTGCT
CGTACATGCCATGCACATCCAACAATGAGTGAGGCTCTGAAAGAAGCAGCCATGGCCACTTACGACAAGCCCATTCACA
TATAAAAATAGTGTCATATATTTGTTTTTCCTCTGAGTATCTTGAATACTTAGAGCATATTTTCTAATTGCCA
CCTCATCACTCAAGTATCTCTTGAACAGATATTTCCTCCCTCTTCTCTAATTATCCAAAGTACTTCCAACTTAATGTTT
CTGTTCTGCATATTCATATCTGTAATAAAGTCAGGAGCTGTATGTCAAAGTTTAAATGCCATCGATTTGAGTTTCATTG
AGTTTTGATCAGCGTTGAGCACaaaacaaaAAacaaAAAAAAAAaAGGGGGg > SEQ ID NO:1997 142731 268858_200122_1
AAGCAAGTAAAGATTGGGGACCCTTTAGAAAAAGGTACCTTACTTGGGCCACTGCATACTCGCACTTCTAGGGAAAACT
TTCAAAAGGGAATCCAAAATATCAAGTCCCAGGGTGGAAAGATCCTCACAGGGGGTTCAGTCATAGAATCTGAGGGTAA
CTTTGTGCATCCAACAATTGTCGAAATATCTTCAAAAGCTGAAGTTGTGAAGGAAGAATTGTTTGCTCCAGTTCTTTAT
GTAATAAAGTTTAAGACTTTCGAAGAAGCAGTTGAAATTAACAACTCTGTCCCTCAAGGTTTAAGTAGTTCCATCTTCA
CCCGAAATCCACAAATTATGTTTAAGTGGATTGGAGCTCAAGGAAGTGACTGTGGCATTGTCAATATAAACATACCAAC
AAATGGAGCTGAAATTGGTGGTGCATTTGGAGGTGAAAAAGGTACTGGTGGTGGTCGTGAGGCAGGAAGTGACTCTTGG
AAACAATATATGAGGCGCTCAACTTGTACAATCAATTATGGGAATGAACTACCATTGGCTCAAGGAATCAACTTTGGCT
AACGAAATTGATGCAGAACTTCGCGGTCTGCCCTTGGACTATCGTGCTTTTAAGTGCGTCCATGGTTTGATACTTCAAG
TACACTTGTAATTCGTCCCGAATCACTTAAATGTACTTCCCTACTTCAAGAGTTGTTAACCTAATCTCATAACTAGAAA
ACAACACTTGCATTAT > SEQ ID NO:1998 142731 55669_300134_1
ttGAGTgtaaacaAtgcaatcaTAGTCATGGAcgaTGCTGATATACAGttaGCGGCTCGATCTGTTCTATTCGCTGCGG
TTGGAACTGCTGGTCAACGTTGCACAACTTGCCGTagGCTGCTTTTGCATGAGAGTGTCTATGACAAAGTACTCGAGCA

FIG. 2 continued

```
ACTGCTTACCTCATACAAACAAGTCAAAATCGGCAATCCTCTTGAGAAAGGGACATTGTTAGGACCATTACATACTCCT
GAATCAAAAAAGAACTTTGAGAAAGGAATTGAAGTCATCAAATCCCAGGGTGGTAAAATACTAACGGGAGGTAAAGCAG
TCGAAGGTGAAGGAAACTTTGTGGAGCCTACGATAATCGAGATATCAGCAGaTgCTGCTGTCGTCAAAGAAGAGCTATt
tgatcaagttctatatgttaaaaagtttaagt > SEQ ID NO:1999  142731 193773_300742_1
CCCCCCCTTATACCGAACATTTCTTGATCAACTTGTTGAGGTTTATAAACAAGTCCGAATTGGGGATCCTTTGGAGAAT
GGTACGTTACTGGGGCCATTGCACACTCCTGGTTCAAGAGACGCCTTCTTGAAAGGCATCCAAACCATCAGATCTCAGG
GGGGAAAAATTCTTTATGGAGGATCTGCAATTGAATCTGAGGGAAACTTTGTTCAGCCAACAATTGTGGAAATTTCACC
CTCTGCACCGGTTGTGAGAAAAAAACTCTTTGGTCCTGTTCTTTATGTGATGAAAGTTCAAAATCTGAAGGAAGCAGTT
GAAATCAACAATTCTGTTCCTCAAGGATTGAGCAGTTCTATATTTACAAAGAGACCAGATATTATTTTCAAGTGGATTG
GGCCTCATGGTAGTGACTGTGGCATTGTTAATGTAAATATTCCCACAAATGGTGCTGAAATTGGTGGAGCTTTTGGTGG
AGAAAAAGCTACTGGTGGTGGACGAAAACCAGGGAGTGATTCGTGGAAGCAGTACATGAGGGAGGGCCACTTGTACGAT
CAACTATG > SEQ ID NO:2000  167332 130609_300489_1
gaattcagaggagagagagagacacacagagaaagggtgGCGATGGCAATGGCACTTCGTAGGCTCTCATCTTCTTCAA
TCAACAAACCTATCCGTCCTCTCTTCAATGCCGATTCCTACTATTGCATGTCATCTCTTCCAAGTGAAGCTGTTGGTTA
TCCTGGTGCTAGATACTATGGAGGAAACGAGTACATTGATATGGCAGAAACTTTGTGCCAGAAACGTGCCTTGGAGGCT
TTCCGTTTGGATCCTGCTAAATGGGGAGTTAACGTGCAATCTTTGTCTGGGTCCCCTGCCAATTTCCAAGTCTACACTG
CACTATTGAAGCCCCACGAGAGAATTATGGCACTTGACCTTCCACATGGTGGGCATCTTTCTCATGGGTATCAGACTGA
CACCAAAAAGATATCTGCTGTATCTATATTTTTTGAGACAATGCCATACCGATTGGATGAGAGCACTGGTTACATTGAT
TACGATCAGTTGGAGAAGaGCGCTACACTCTTCAggCCGAAACTGATTGTTGCTGGTGCAAGTGCTTATTCACGCTTCT
ACGATTATGCACGCATTCGccaggtGTGCGACaAGCAAAAAGCTATATtgttggCagataTggCTCACAtcagtggGCt
tgttgctgctggTGTCATcccATCt > SEQ ID NO:2001  167332 226285_300995_1
GAACACATCTCCACCATGTCTTCATACGCCCTTTCCAACAACCATAAGGATCTCATTGAAGCCTCCCTCCACGACCTCG
ACCCCGAGGTCGAGGGCATCATGAAGGACGAGATTGACCGACGAGGACACTCCATCGTCCTCATTGCCTCCGAAAACTT
CACCTCCAAGTCTGTTTTCGACGCCCTTGGATCTCCCATGTGCAACAAGTACTCCGAGGGATACCCCGCGCCCGATAC
TACGGTGGTAACCAGCACATTGACCGAATCGAGACTCTGTGCCAGAACCGAGCCCTCAAGGCCTTCGGCGTCACCCCCG
ACAAGTGGGGCGTCAACGTCCAGACCCTGTCTGGCTCTCCCGCAAACCTCCAGGTCTATCAGGCCATCATGAAGCCCCA
CGATCGACTCATGGGTCTTGATCTGCCCCACGGAGGCCATCTTTCTCACGGTTACCAGACCGACAACCGAAAGATCTCC
GCCGTCTCCACCTACTTCGAGACCATGCCCTACCGAGTCGACCTCGAGACCGGCATCATCGACTACGACATGCTCGAGA
AGACTGCCATCCTCTATCGACCCAAGGTTCTGGTTGCCGGAACCTCCGCTTACTGCCGACTCATTGACTACAAGCGAAT
GCGAGAGATTGCCGACAAGGT > SEQ ID NO:2002  167332 242160_301326_1
gGGAAGATCGATCGATGGCGCTAGCTTCGGCGGCGGTGCTGCGGCGATTGTCGAGGTTTCGCGCGTCCACAGCGCTCGC
GATCAGCGTGAACAGGGCTCTCGGTGACGCCGGATCGATCTTCTCGCGCAATGCGTCGACTGCGGTGGCCAATGAGGAG
GTTTACTCGCGATTCGAGAGCTCAAAGGACAAGTCCCGTGTCACTTGGCCAAAACAACTCAACTCTCCACTGGCAGATG
TCGACCCCGAAATTGCTGATATTATTGAGCTAGAGAAAAATCGTCAATGGAAGGGACTTGAGCTCATTCCCTCGGAAAA
TTTTACCTCGACTTCGGTCATGCAAGCCGTGGGATCGATAATGACGAACAAGTATAGTGAGGGGTATCCAGGAGTCGT
TACTACGGTGGAAATGAGTAGGTTCATTGATATGGCCGAGAGTTTGTGCCAGAAGCGAGCGCTAGAGGCCTTTCGACTC
AACCCGGAAGAATGGGGAGTCAACGTGCAGTCTTTATCTGGATCTCCGGCAAACTTTCAAGTATATACAGCTCTGCTTA
AACCGCATGACAGAATTATGGCTCTAGATTTACCACACGGAGGCCATTTGTCGCATGGATATCAGACagacactaAGAA
gATCtcgggcgttTcGaTCTTCTTTGagacaatgccgtaTAGa > SEQ ID NO:2003  167347 129772_300481_1
GAATTCATGTTAAGAGCAGTAAGGATTAGGGCGACTGTTGGTGGAGGATTGCAAGATCCTGTAACCATAAAAAAAACCTA
ACTCAACAAACCCACAACACCAAACTCTTACAATACTAATGTGTTAACCCTATCAACACATACTCGCGGTGGTTCATC
AGTTAATAATAATCAAGTTTTATTATCATCACCAACATCATCAGCTTCAGTTTCTAATGCTTCTTCGTCTAGATATTCA
TCATCTTGTTCATATTTATATGATTCTACTGATGAATGGGAGTGGGAAACTGTTGACAAAGATGGTGAGGAAAACAAAG
ATGATTTGGTTTTATCAAATGGATATTTATGATATCTTTGGCCTGTTCCTTCTATGGATGAAGTTAGAGATGCGGTTTC
TAATCTTCAACAATTTTCTTCGGCTGCATCAGACGAGGATTGGGTCGAACCTGCTTTACAGGTTAATAATCCAAGAACA
TTGAGGTCTCATGGATATGAAAGGGTTTATACTGCTTTCCATTTATTGCAGACAGATCCGAGTGTTCAGAGAATGGTAG
TTTCTTTATCTACCGATAAAGCTCTATGGGATGCTGTTTTAAATAATGAAGCTGTTC
```

FIG. 2 continued

> SEQ ID NO:2004 167403 128579_300476_1
cccccccccccgatattatatcaagaagggctttgatccctccttcttctctgtttgttcccttgccctttcttcctct
gCATCTACAACTACATAAACTGCACCATATTACACAGATCTGTcACTTACCAAATTATGTCACTTGAATGTTGAGTCAC
ATTTTCTGagTtgggctttGTTTTTTTGTTTTTCCTTGAAAATATAcgatgGGTGTTGAATATCATGAGGAATATATAA
GGAATTCAAGAGGTGTTCAGCTTTTTACTTGtagaTGGTTGCCTTTTTCTTCTCCAAAGGCCCTTGTTTTCCTTTGCCA
TGGCTATGGTATGGAGTGCagtgGATTCATGagaGGCGTTGGGACAAAGCTTGCGAATCATGGATATGCGGTGTTTGGA
ATagaTTATGAAGGCCATGGACGGTcATTGGGTTCCCGCTGTTATATCAAAAGGTTTGACAACATTGTCAATGACTGCA
GTGACTTTTTCAAGTCCGTTGTGCGCGGGAGGAGTACAGAGAGAAAACAAGGTTTTTGTATGGGGAGTCGATGGGTGG
GGCTGTGGCTCTTTTAATACACAAGAAGGATCCTTCCTTTTGGCATGGTGCTCTTCTGGTTGCACCTATGTGTAAGATA
tcacagaAAGTGAagCCACAtCcAATGGTTAtaagcTTACTAACtaaagtggAGGATGTCAtaCcaagATGGA > SEQ ID NO:2005 167403 201649_300718_1
GTCGACCGACGCGTCCGAGCCTCCTCCGGTCCTCCTCTTCTTCTTCCTCATTCTCCTCCTCCGTGGCGAGGCCGGCCGA
GATATCAATGGAAGTCGAATACCACGAGGAGTACGTGCGGAACTCGAGAGGGGTGCAGCTCTTCACCTGGGGCTGGCTG
CCCGCCAAAACGTCGCCCAAGGCCCTCGTCTTCCTCTGGCACGGCTATGCCATGGAGTGCAGCGGCTACATGAGAGAGT
GTGGGATGCGGCTGGCGGCGGCGGGGTACGGGGTGTTCGGCATGGACTACGAGGGGCACGGGAAGTCGATGGGCGCCCG
CTGCTACATCCGCAGCTTCCGCCGTCTCGTCGACGACTGCCACCGCTTCTTCAAGTCCATCTGCGACATGGAGGAGTAC
AGGAGCAAGAGCCGGTTCCTGTACGGCGAGTCCATGGGCG > SEQ ID NO:2006 167403 180843_300625_1
gaattcaaagcgaagaaagcgagggtgtatgggacaaaaaatgaatccacttggttttagacttggtacaacccaaaag
cACCATTCCCTTTGGTTTGCACAACCAAAAAGTTATTCTGAGGGTCTACAGGAAGATCAAAAAATAAGGGATTGTATCA
AGAATTATGTACAAAAAAATATGAGAATATCTTCGGGTGTacaGGGAATTGCGCGTatacagATTAAAAAAAGAATCGA
CCTGGTCCAGGTCATAATCTATATGGGATTTCCAAAATGGTTAATAGAGGGTAAACCGAGAGGAATTGAAGAATTACAG
ATCAATGTACAAAAAGGTTTTAATTCTGTGAACCGAAAACTCAACATTGCTATTACACGAATTGCAAAACCCTATGGAG
ACCCTAATATTCTTACGGAGTTTATGGAATAGATTATGAAGGTCATGGAAAATCTTCAGGACTACAAGGTTTCGTCCCT
AGTTTCGACAGAGTTGTCGACGATTGTTCTGACCATTACTCAAGCATTTGCGAAAAGAAAGAAAACAAAAGAAAGTTAA
GATATCTACTGGGAGAATCCATGGGAGGTGCAGTTCTTCTTCTTTTACACAGGAAGAAACCACAGTACTGGGATGGTGC
TATCTTAGTTGCTCCCATGTGTAAGCTTGCAGATGATATGAAACCACCAGCACTGGTTgtgAgTGTTTTATCAATGCTC
ACCCATGtcaTACCGACATGGAGAATTGTcccAACAACTGATATTATCGATATCgccTtCAAACTACCTtccAAAAGa > SEQ ID NO:2007 167403 237429_301287_1
GGAAGCGTGTTTCGCGTGGTCGTGCCATAACTCCAGTATCCAAGCTGCAGAGCTATGGCCCCGGCAACTTCTCTGGACA
AGCCCGCCTACTACTGGGGCGACGACATCTCCCCAGACGACTTCTACAAGCAGCAAGGCGTCCGCCACTCCGAGTCCTA
CTTCACCACACCGCACGGTACGCTCTTCACTCAGTCCTTCCTCCCGCTGGACGAGTCCGCCACCCCGCGAGCTCTCGTC
TGCCTCACCCACGGCTACGGCAGCGACGGCTGGCTCTTCCAGCTCCATCGCCATGGCCTTCGCGCAGTGGGGATGCG
CCGCATACTGCGTGGATCTCCTCGGCCACGGCCGCTCCGACGAGTCCACCGGCTACGTCTGGGACGTGAACGCTTTCGC
CGATGCGAATCTCCGCTTCTTCCAGTCGGTCCGGGACAAGCCCGAGTACTCGGGCATCAAGAAGTTCCTGTTTGGCGAG
TCCATGGGTGGCGGACTCACTCTGCTGATGTGCTTGAGGGATCCCAAAGGATGGGATGGAGTCATGGTGACTGCGCCGC
TGATCGTCATCCCGGAGCTCATGCAGCCGTCGAGGATCCATCTGTTTGGATACGGTCTCCTTCTCGGGCTGGCCGAGTC
GTGGGC > SEQ ID NO:2008 167403 260659_301716_1
GATGCAGGTGTGGAACCCTAATTTCCGTCAAAGGATATAAATTCTAGGCGAGAGGGATAGACTGGAGAGAGATCGATTG
ATCAATCGGTTCTACGAGGAGGAATCGCATGCGCCAGCGGTATGATCGTCACGGTGATGCACGGTTTTGTAGCAATGAT
CGTCCATGGGCGGCTGACGTCTCCGCCCGGGCCAGGTCGTGGAGCACTGCCGGGGCGCTGCTTTTCTTCGCGTGGATC
GCCCTAGCGGTGCTGCTGCCGCCAATCTTGAGGAGGATCGAGGGCGATTCGGTGGTGTTGGAGGATGGGCGGCGGCTGC
GGCATCTGGACTGGGCGGCGGACAGGAGGAATATCTTTGCCGAGTATGAGAAAGTGAGGAGGAGCTTCAACATAGCTGG
ACCCGCTGCCGGCGTTGTAACATCAGAAGAGTTTAAGGTAAATTCGCGCGGTGTTGAGCTATTTACAAAGAGCTGGCTG
CCGGAAACTGGGAAGCCGAAAGGACTGATCTTTTACTGCCATGGATATGGTGATACAATCTCCTATTTTTTCGAAGGAA
TTGCTCGAAAGCTTGCTCGAGCTCAATACGCGGTGTTTGGAATGGACTATGAGGGATTCGGTCTCTCATCCGGCCTACA
CGGCTACATTGAGAACTTTGATGTTCTTGTGGATGATGTAATCGAGCACTACTCATCGATTCGAGCCAaGGCTtTAtCT
AAAagaccgaatcACTTGTACGtggcagaACGGatagagttcg > SEQ ID NO:2009 167403 282137_200072_1
AAGCATCCAGTTGCAGAAGCGAACGAGGTGAGCCCATTCGGGTCATTGAACCCCGACGAGTTCTATTCTCACCACTCAG
TGAGTCAAGGCTCCGAGTTCATCGCTAATTCTCGAGGTCTCAAACTCTTCACCCAGTGGTGGACCCCACTCCCTCCCGC
TAACCCCATCGGCGTCGTCTGCGTTGTTCACGGATTCACCGGCGAGTCCAGTTGGTTCGTTCAACTCACCTCCGTTCAC
TTCGCCAAGCACGGTTTCGCCCGTCTGTGCAATCGATCACCAAGGCCATGGCTTCTCCGATGGCCTCGTGGCTCATATAC

FIG. 2 continued

```
CCGACATTAATCCCGTCGTCGATGACTGTATCTCCTTCTTCGATTCTTTCCGTCAGCGCCACGCGCCGCCGTATCTCCC
GTCATTTCTCTACGCTGAATCTCTCGGCGGCGCAATTGCACTTCTCATCACTCTCCGGCAGGGAGATTCTGCTCTTAAT
AGGCCTTTTGACGGCGTCGTTTTGAATGGGGCCATGTGCGGTATCAGCGCTAAGTTCAAGCCACCGTGGCCATTGGAGC
ATCTTCTGGACATTGCAGCATTTCTCATTCCCACATGTCGCGTTGTACCCACTCGCGGCTCTATTCCTGAAATCTCATT
C
```

> SEQ ID NO:2010  167403 241224_301346_1
```
ACGAGCGCCTCGTCTCGCGTCTCGTCCACATCGCCGCCGCCGCGAGCGCCGCGGCGCAATTCATCGCGCACGGATCCGG
CGGGGCCAGCAAGCGGCGATGGATCGCGTCAGCTACGCCGAGGAATTCGTCTATAATTCCAGAGGAACCAGGCTGTTCA
CTTGCCGATGGATCCCTCTCCGCCAGGACGTGAAGGGATTGGTCTTCCTCTGCCACGGTATGGCGATAATCTTTGCTGC
TGTGTCGAGATCTCGCTTGAAATGCGTGTCCTTGGATGTGTGTTCATGGACCGCGAAGGCTATGGGATGGAATGTACCC
AGTTCATGAGAGGAACTGGTCAGCGCCTTTCAAGAGCTGGATACGCGGTGTTTGGCATCGACTACCAAGGCCATGGAAA
GTCTGACGGCCGGCGATGCTATATT
```

> SEQ ID NO:2011  167406 273960_200055_1
```
tacccattacccacctcgtcttttcatactCATTCTCTCCTTCTTCCATTTCTAGCTCCGCCCTCTCTCTTTCTCTCT
GTCAAAGTAAATAGTTCTTGGCAGGAATAAGGAATTAGATTACATTGATCAGGAAAATGGATTCTGCGGCCCTGACTAG
CGTTTGTGGCAAATCTGCTCTTCGCTCCACTCCGGGTTTATTTCTGGGGAGAACGAATGGTATTAGGAGCTCGCAGTGT
AGCTTTATGGCAGGAAACAAGATAAACTTTCCGCGGCAGAGAGCTCAAGCATATAGAGTTAGTACTAAATCTAGCAAAT
GTGGCGGTGCTCTTGCTGCAACATGTCGCGCCGAGAAGATTCTGGTGGCAAATCGAGGAGAGATTGCTGTTCGTGTGAT
TCGAACTGCCCATGAGATGGGAATTCCTTGTGTTGCTGTTTATTCGACCATAGACAAAGATGCCTTACATGTGAAGCTA
GCTGATGAATCTGTTTGCATTGGTGAAGCACCAAGCAATCAATCATATTTAGTGATCCCAAATGTCTTATCTGCTGCTA
TCAGTCGTGGATGTAcaaTgttGCATCCTGGATATGgttTCCTTGCTGAAAATGC
```

> SEQ ID NO:2012  167420 47373_300170_1
```
CCCACGCGTCCGGTAGCCATGGCTTCGGCTACTTTCTCTGTGGCCAAACCATCTCTTCAGGGTTTTTCTGAGTTCTCAG
GACTTCGAAACTCCTCTGCTCTTCCCTTTGCCAAGAGATCTTCTTCCGATGAGTTTGTTTCCTTCGTCAGTTTCCAAAC
TTCTGCAATGAGAAGCAATGGTGGATACAGGAAAGGGGTGACCGAGGCCAAGATAAAGGTAGCCATCAATGGGTTCGGT
AGGATTGGTAGGAACTTCTTGAGGTGTTGGCATGGTCGTAAGGACTCTCCTCTTGATGTCGTTGTCATTAACGACACTG
GTGGTGTTAAACAAGCATCACATCTCCTCAAATACGACTCAACTCTTGGAATCTTTGACGCTGATGTC
```

> SEQ ID NO:2013  167420 50961_300164_1
```
CCCACGCGTCCGCAAACCTTAACTTGGATTCTTTCTGGTCACCATGGCTTCGGGTACTTTCTCTGTCCCCAAGGGTTTC
ACTGAATTCTCAGGATTGCGAAGCTCCTCTGCTTCTCTTCCCTTCGGCAAGAAACTTTCTTCCGATGAGTTCGTTTCCA
TCGTCTCCTTCCAGACTTCTGCAATGGGAAGCAGTGGTGGATACAGGAAAGGTGTGACTGAGGCCAAGCTTAAGGTGGC
CATTAATGGATTCGGTAGGATCGGCAGGAACTTCCTGAGATGTTGGCATGGTCGCAAGGACTCTCCTCTTGATATCATT
GCCATTAATGACACTGGTGGCGTCAAGCAGGCTTCGCATTTACTTAAATA
```

> SEQ ID NO:2014  167420 1008019_301406_1
```
GATTTGAACCCTGAGACCAGTGCCTGAGCTAGTGCCAGCCATGGCTGACTGCTTCCCTTGCTTCCTCTCCTAAGCCCAC
CCCTCTTTCCCAGGTTTCTGGTAAGGGGCTTTCTGAGTACTCTGGATTGAAGAGCTCCAGCTGTGTCCCCTTTGGAAGG
AAGAATGATGACCTCCTTTCCAGAGTTGCACTTCTCACCACTGCTGTTTCTAGCTCTGGTGCAAAGAGGGGAGTAGCTG
AGGCCAAGATCAAGGTGGCCATCAACGGGTTCGGGAAGAATTGGACGAAACTTTCTCAGGTGTTGGCATGGTCGGAAGGA
TTCTCCCCTCGATGTCGTCATCAACGACACCGGCGGTGTGAAACAGGCCTCCCACCTCCTCAAGTATGACTCTATG
TTGGGCACCTTTGAAGCCGACGTCCAAGTTGCCGGCGAAGATGGAATTTCGGTTGATGGAAAGGTCATCAAGATCGTTT
CTGATAGGAACCCAGCAAACCTACCATGGGAGGCCTATGGAA
```

> SEQ ID NO:2015  167420 128726_300477_1
```
atggcttctcatgcagctttggctccttcaagagttcccacaagcacaaggcttcctttcaagaactcacactctttcc
cTACTCAATGCTTCTCCGAGAAATTTGAAGTAGCCGAGTTCTCTGGTCTTCGATCAAGTGGATGTGTGACATTTCGAA
CAAGGAGTCGTCCTTCTTTGATGTTGTCTGCTCAACTCACTCCCAAGACCACAGGATCAGCTCCTGTGAAGGGAGAA
ACTGTTGCAAAATTGAAGGTTGCTATCAATGGTTTTGGACGCATTGGCAGGAATTTCCTCCGTTGTTGGCATGGCCGCA
AAGATTCACCACTGGATGTCATCGTCGTCAATGACAGTGGTGGTGTCAAGAATGCATCTCACTTGCTTAAGTACGATTC
CATGCTCGGAACATTCAAAGCTGATGTGAAAATAGTGGATAATGAAACAATTAGCGTTGATGGAAAGCACATTAAGGTT
GTTCTAGCAGGGACCCCCTTAAGCTTCCTTGGGCTGAACTTGGCATTGACATTGTTATTGAGGGAACCGGTGTGTTCG
TTGATGGTcCaggTGCTGGGAAGCACAttcaaGCTGgTgccaagaaagttATTATCACTGctccagcaaaaggtgCTGA
TATTCcgacctACGttgttggAGTGAATGAacaagactacTCTca
```

FIG. 2 continued

> SEQ ID NO:2016 167420 118046_300063_1
caccttatacCTTCCATATTTCTTTAACTTTCCACACCAAATACCACATTCTTCTGCTGCATTTCTAAAAAGAACAATG
GCTTCGGCTGCTCTCTCAGTAGCCAACTCTTCTCTTCAGGTCAGCAACAGAGGATTCTCTGAATTCTCAGGGCTGCGCA
CCTCATCAGCAATTCCATTCGGAAGGAAAACCAACGATGACTTGCTCTCTGTTGTTGCCTTTCAAACCTCTGTTATTGG
AGGAGGGAACAACAAGAGGGGAGTAGTGGAGGCCAAGTTGAAAGTGGCCATCAATGGATTTGGAAGAATTGGAAGGAAT
TTCTTGAGGTGTTGGCATGGTAGGAAAGACTCTCCCCTTGATGTCATTGCCATCAATGACACTGGTGGTGTCAAGCAAG
CCTCTCACCTTCTCAAATATGACTCCACCCTTGGCATCTTTGATGCTGATGTCAAGCCCGTCGGCACTGACGGCATCTC
CGTCGACGGAAAAGTCATCCAAGTCGTCTCCGACCGCAACCCCGTCAACCTCCCATGGGGAGATCTTGGGATTGACTTG
GTGATAGAAGGTACCGGAGTGTTTGTTGACAGAGAAGGCGCCGGAAAACACATCCAGGCCGGAGCCAAGAAGGTGCTCA
TCACCGCTCCCGGAAAAGGTGACATCCCCACATATGTTGTTGGTGTCAATGCTGATCTCTACAACCCTGATGAACCTAT
CATCAGCAATGCCTCTTGCACCACCAACTGCCTTGCTCCTTTTGTCaaggttCTTGaccaaaaATTcggaatTATCaag
ggaaccATGACaaCTACTCACTCttaCActgttgac > SEQ ID NO:2017 167420 1171206_302052_1
GCGGATTGGGCGCAATTTCATCCGGTGCTGGCACGGGCGCAAAGACTCCCCCCTTGACGTTGTCGTCGTGAATGATACT
GGCGGTGTCAAGCAGGCCTCCCACCTCCTTAAATATGACTCCATGCTTGGTACTTTTGACGCCAATGTTGCGGCTGCCG
GTGATGATGGTATCTCCATCGACGGCAAGGTTATCAAGGTTGTCTCTTTTCGCAACCCCTTGGACCTCCCATGGAAGGA
ACTTGGCATAGACCTAGTGATTGAGGGCACAGGTGTGTTTGTGGACCAAGAAGGAGCCGGGAAGCATATCACTGCGGGA
GCAAAGAAAGTGTTGATTACTGCCCCTGGGAAAGGTGCGATCCCTACTTATGTTGTGGGTGTGAACGAGCAACTATATA
GCCATGATGATGTCATCATCAGCAACGCATCATGCACCACCAACTGCCTGGCACCATTCGTCAAGGTTCTCGACGAGAA
ATTCGGAATTGTGAAGGGCACCATGACAANCACCCACTCATACACTGGAGACCAACGTTTGCTTGATGCAAGCCACCGC
GATTTACGGA > SEQ ID NO:2018 167515 108104_300259_1
cacacaccctaatatccatgccccaaatttaatagtcaaacctctcaaccccatcgatccatttccgatcaatggcgaa
aCGAGCCCTACCCGTTCTCAAGCACCTCCTCAAGTCCTCATCCCCATCCCCATCCCCATCCCATGGGGTTTCCCATTCA
TTAACGTCAGCCCGATCGGTCACCTACATGCCCCGACCCGGTGATGGCACACCACGCGCCGTCACTCTCATCCCTGGTG
ACGGGATCGGGCCGCTTGTCACCGGCGCCGTCGAACAAGTCATGGATGCGATGCACGCTCCTGTGTATTTCGAGCGATA
TGAGGTTCACGGCGACATGAAGAGTGTGCCTCCGGAGGTTATGGAATCGATCCGGAAGAATAAGGTTTGTTTAAAAGGA
GGGTTGAAAACTCCGGTGGGGGGTGGTGTTAGTTCCCTTAATGTTCAGCTTAGGAAAGAGCTTGATCTATATGCTTCCC
TTGTTCACTGCTTCAACTTGCAAGGATTACCGACTCGCCATGAGAACGTTGATATTGTTGTCATTAggGAAAACACGGA
GGGTGAATATTCCGGCCTCGAGCATGAggTTGTTCCCggtgtccgtgGAGAGccTAAAggTGATGACAAagtTTTGCTC
GgaacgAattgcaAAATATGCCtttgaatatGcatACctcaacaaTCGCAAGgtagtgaCTgCTGTG > SEQ ID NO:2019 167515 208685_300807_1
ACTCATCGTCACAATGCTGGCCATTCGGGCTCTCTCCAACCCTGCCAGGCACTGCCTGCGAGCAGCTCCCCGCGCTGCC
GCCACCTGGTCCGTTTCGAACAAGCGATTCTACTCCCAGGAGCGTGTTGCAAAGTATGAGGGAACCAAGGACTCCAACG
GCAACTTCCTCGTCAGCTTAATCGAGGGTGACGGTATCGGTCCTGAGATTGCCCAGTCCGTCAAGGACATCTTCTCCGC
TGCCAAGACCCCAATTGCTTGGGAGCCCATCGATGTCACCCCCATCATCAAGGACGGCAGGACCGCCATCCCCGACGCC
GCCATTGAGAACATCAACAAGAACAAGATTGCTCTCAAGGGTCCTCTGGCTACCCCGTTGGCAAGGGCCACGTTTCCC
TCAACCTGACTCTGCGACGAACCTTTAACCTGTTCGCCAACCTGCGACCTTGCCGATCCGTCGCCGGCTTCAAGACCCC
CTACGACGGTGTCGACACTGTCCTGATCCGAGAGAACACCGAGGGCGGAGTACTCTGGCATTGAGCACGTTGTCGTCGA
CGGTGTTGTCCAGAGCATCAAGCTCATCACCG > SEQ ID NO:2020 167515 218739_300921_1
TGCACCTCTACTTGCTTAGCATCAGGCTGAAACTATCGTCTCTTTTGTCACGATGCTGTCACGAAGCTCTCTCCGGACC
GCCCAGGTCCTTCGCGCCGCTGCCCAGCCCCAGCAGCTCAGCCGATCCTTCGCCACCGTCCAGTCCGACATCTTCAAGC
CTGCCAAGTTCGGCGGCAAGTACACCGTCACCCTGATCCCCGGAGACGGTATCGGTGGAGAGGTTGCCGAGTCCGTCAA
GACCATCTTCAAGGCCGACAATGTCCCCGTCGAGTGGGAGCAGATCGAGGTGTCCGGTGTCGAGGAGAGCGCCCTGCGA
ACCGAGGAGGCCTTCCGCGAGAGCGTGGCCTCGCTCAAGCGCAACAAGCTCGGCCTCAAGGGTATCCTGCACACGCCCG
TCAGCCGCTCCGGCCACCAGAGCTTCAACGTGGCCATGCGCCAGGAGCTGGACATCTACGCCAGCATCTCCCTGATCAA
GAACATCCCCGGCTACGAGACCCGCCACAAGGACGTCGACCTGTGCATCATCCGTGAGAACACCGAGGGCGAGTACTCT
GGCCTCGAGCAccAGAGCGtcccCGGCGTCGTCGAgtccCTCAAGATCATCAccCgcgCcAAGTctgagCg > SEQ ID NO:2021 167515 181516_300656_1
gaattcaggaatggcaagaagaagcttaccgatcttaaagcaacttttgcagagatcatcatcagaatcttcatcggct
tCATCTTTGTTGAATCCTAGTATTGTTGGAGGAGGATTATTAGGTACAAGATATGAACCAAAGAGATCTGTAACGTATA
TGCCAAGACCAGGTGATGGAACACCAAGAGCAGTAACCCTAATACCAGGAGATGGAATCGGACCATTAGTAACAGGTGC
GGTTGAACAAGTAATGGAAGCGATGCACGCACCTATTTACTTTGAGAAATTTGAAGTACATGGTGATATGCCAAAAGTA

FIG. 2 continued

```
CCTGATGAAGTTATGGAATCGATTAAGAAAAACAAAGTTTGTTTGAAAGGTGGATTAGCAACACCAGTTGGTGGTGGTG
TTAGTTCTTTGAATGTTGAATTGAGGAAAGAACTTGATCTTTTTGCTTCTCTTGTTAATTGTTTTAATCTTCCTGGTTT
GGCTACTAGACATGAGAATGTTGATATTGTTGTCATTCGTGAGAATACTGAAGGTGAATATGCTGGTCTTGAGCATGAA
GTCGTTGATGGTGTTGTTGAAAGTCTTAAGGTAATCACAAAGCTCTGTTCAGAACGTATTGCAAAGTATGCCTTCGAAT
ATGCTTATCTTAACAACAGAAAGAAGgTAACAGCTGTCCACAAAGCCAACATTATGAAGCTTGCCGATGGATTgttCTT
agagtCTTGCCGtgaggttGCCAAGaaGTATccTGGAATACAATATAATGAGATTAttgtgGaCaaTTGctgcATGCAa
Cttgtctc > SEQ ID NO:2022   167515  138519_300774_1
TCTCTCTCTCTCTCCTCCTCCTCGCCGCCGACCGCCGCCGCCGCCGCGAGTCGCCTTCGCCGTCCGGGTAGCAGCAGGA
AGAGGGAGGAAGGGGGGGCATGGCGCTACGGAGGCTGCTCCAGGGGAGCGTCCTGCCGCGGATGGCGGGCAGAGCCGCC
GCGGCGCCGTTCTCGACGGCGTCCGGGGAGACCGTCCGCGCCACGCTCTTCCCAGGCGACGGCATCGGGCCGGAGATCG
CCGAGTCGGTCAAGCAGGTATTCAATGTTGCAGGGGTACCAATAGAATGGGAAGAACACTATGTTGGTACAGAAGTTGA
TCCCAGAACAGAGAGTTTTCTGACTTGGGAAAGCTTGGAGTCGGTGCGGAGAAACAAAGTTGGCTTGAAAGGTCCTATG
GCTACGCCTATTGGAAAAGGCCACCGTTCATTGAATCTTACACTAAGGAAAGAGCTTGGTCTTTATGCAAATGTTAGAC
CTTGCAACAGCCTCCCAGGATACAAGACTCGATATGATGATGTGAACCTTGTGACTATTCGTGAAAATACCGAGGGAGA
ATATAGTG > SEQ ID NO:2023   167515  16565_300240_1
CCCACGCGTCCGTCTTCTTCTTCTCTTTCGATCAAATCTTTTCAGATTCAACCCAAAATTGAAGACAAAAATGTCTCGC
AGATCGCTAACTCTCCTCAAGAATCTAGCTAGAAACGCGAATGGATCAGGTATTCAAACCCGATCCGTGACTTACATGC
CCAGACCCGGTGACGGAGCACCACGCGCAGTGACGCTGATCCCCGGAGATGGAATCGGTCCTCTGGTGACGAACGCCGT
GGAACAGGTGATGGAAGCGATGCACGCTCCGATCTTCTTCGAGAAGTACGATGTTCACGGAGAAATGAGCCGTgtgccg
cCgGaaGTGATGGAGTCGAtaaggaaGaATa > SEQ ID NO:2024   167515  253355_301625_1
GCAACATCTTGTCGTCTAATCGAAAACATATCCACATCCACAATGCTTCGAACCGCCTACCTGGCTAAGGCCGCCTCGG
CTCTCCCCAAGCGAACCCTCGCTACCAACGCTCAACCATGTTCCAGCCCAAGGAGTACGGATCCAAGTACACCGTCAC
CCTCATCCCCGGTGATGGTATCGGTAACGAGATTACTGACGCTGTCAAGACCATCTTCAAGACTATCTCCGTCCCCATT
GACTGGGAGGTTGTCAATGTCACCGGTGTTGGCGAGAACCATCTCGACGGCTACGAGGAGGCCATTCGATCCATCAACC
GAAACAAGGTTGCCATCAAGGGTATCCTCCACACCCCCGTTGAGAAGCACGGTCACACTTCTTTCAACGTTGCCCTGCG
ACGAGAGCTCGACATTTTGGCTTCTCTCGTTCTCATCAAGAACATCCCCGGTGTCCAGACCCGACTCGACGGCATTGAC
ATGGCTCTGATCCGAGAGAACACTGAGGGTGAGTACTCCG > SEQ ID NO:2025   167515  258284_301690_1
GGCGATCCATGGCACCACCACGGCGCTGCCGCCGCTAATTCGGATCAGGGCTGTGCGCATTGCGGCTGGACAAGAGTGT
GAGCGTGTGAGAGAGAGAGAGAGAGAGAGAAGGGTGCGATCGCGATCGCGATCGCGATGCTCCGACGAGGTGTGGTACC
GCTGCTGCGGCGGGCGGCGGGACAGCGACAATTGCAGCAGCAGCAGCAGCAGTGTTTTGCGAGCAATGATGGGTCGGTT
GTTCCTCCGCATGGTGAATTAGGGTTTTGTGGATCGCATCGTAATATCACGTACATGCCCAGGCCTGGCGACGGTGCCC
CGCGTGCGGTCACGCTCCTGCCCGGCGACGGGATCGGGCCCCTCGTCACCGGAGCTGTGGTGGAGGTGATGAAGGCGCT
GCACGCGCCCGTCTACTTCGAGGCGTACAGGTGACGGGCAAGATGGACAAGGTGCCGCGCGAGGTGATGGACTCCATC
CGTAAGAACAAGGTGTGCCTCAAAGGCGGGCTCGCCACCCCCGTCGGCGGAGGTGTCAGCTCCCTCAACGTGCAGCTGC
GCAAGGAGCTGGATCTCTTTGCCTCGCTGGTTCACTGCTTCAACCTCCCGGGCCTCAAGACCCGCCACGACAACGTCAA
CATTGTGGTCATCagggagaacaccgAGGGGGAGTACGCCGGCttggaGCacgaggtcGTCCCCGgcgttgtcgagAGC
TTGaaggtGAtcaccaagttcTGc > SEQ ID NO:2026   1675753005481        234459_301201_1
AGAAGAAGGAAGCGCATCGTAAATCGAGGGGGTGTGGAGTTTTTTGAAAGAAAAATTATAGATGGGAGACGGAGATGAT
GCTCCAGATACCAGTGCGATTCCCGCTGTGATTGCTTCGAGCACCACTGAAGTGTCTGTGGTGGTTCCATGCTCGA
TCCAAGACGGTCAAAAGGACTCGCCTTTGGTGGTTCCTTGTGCTATTCCAGCACGCCAAGAAGCTGTGCAAGACAGGGA
CTATAAGTTCCTCTCCAAGGCTGTGGACGAGGCCTACAAAGGCGTCCATTGCGGCGATGGCGGTCCATTTGGAGCTGTG
GTCGTCCAAAACAATGAGATCGTCGTCAGCTGCCACAACATGGTGCTCAGGCACACTGATCCCACGGCTCATGCCGAAG
TCACGGCTGTTCGAGAGGCATGCAAGAAGCTGAACCGATTCGAGCTGTCCGACTGCGAGATATTTGCCTCTTGTGAACC
ATGTCCAATGTGCTTCGGAGCAATTCACTTAGCACGAATCAAACGCCTGGTGTATGGTGCCAAAGCCGAGGCCGCCATC
GCGATTGGCTTCGACGACTTCATCGCCGAC > SEQ ID NO:2027   1675753005481        12917_300253_1
cccacgcgtccggcaTAATAACGAGGTTGTCGCTAGCTGCCACAATATGGTTTTGAAATATACTGACCCAACTGCACAT
GCTGAAGTCACTGCCATTAGAGAGGCATGTAAGAAACTTAACAAAATCGAGTTATCAGAATGCGAGATTTACGCATCTT
```

FIG. 2 continued

```
GTGAGCCATGTCCGATGTGCTTCGGAGCCATCCATCTCTCGAGACTCAAGAGGTTGGTTTATGGAGCCAAAGCCGAAGC
AGCTATAGCCATCGGGTTTGATGACTTCATAGCTGATGCTTTGAGaGGCACGGggGTTTACCagaAATctaatctGGAG
ATCAagaaagcagACgGGAATGGCGCtgcgatTGCggAGc > SEQ ID NO:2028   1675753005481         167575_300548_1
GAATTCGGAAGCTATACAAGACAAGGACCATGAATTCGTAACAAAAGCAGTTGAAGAAGCATACAAAGGAGTGGATAAT
GGAGATGGAGGCCCTTTCGGTGCAGTCGTTGTTCGCAATAATGAAGTAGTTGTGAGCTGTCACAACATGGTTTTGAAGC
ATACTGATCCTACTGCCCATGCTGAGGTGACTGCAATAAGAGAGGCATGCAAGAAGCTCAACCAAATCGAGCTATCTGA
CTGTGAAATATATACATCTTGCGAGCCTTGTCCAATGTGTTTTGGTGCAATCCACCTTTCACGTATCAAGAGGTTGGTA
TATGGAGCCAAAGCGGAAGCAGCCATAGCAATTGGATTTGATGACTTCATCGCAGATGCCCTGAGGGGTACTGGCTTCT
ATCAAAAGGCTAGCATGGAGATCAAGATGGCTGACGGGAATGGTGCCATCGCTGCAGAACAGGTCTTCGAGAAAACAAA
AGCTAAGTTCCAAATGTACTGATCATCACTACATTTATCATCTGAATTCCCGTCATTTCTGCGCATCTGCAAAGGAAAG
CACCTCGCCAGGAATTCACTAATCTGCTTTCAACAGCTTACCAAGAAGGAAAAAGGAAAAATCTGTGAATACATTTCTG
AAAATAAAAATGTTCCCAGAAAAGACATCTAAAACTATTATTGGTTTCATTTTACATGCACTTTCTAATAGTCAGCAAA
AAATTACAAAACTGATCATCACTTTGT > SEQ ID NO:2029   1675753005481         188903_300611_1
AGCCCATCCATCCCTGCAAGCGACGAACACATCTCATCACACCCGTCACCTCTCCTCTCCCCCAAATCTCGCGCTCCGC
TCCTGCTCCTGCTCCTGCCATGGAGGAGGCTCAGGTTGTGGAATCCAAGGACGGAACGATCTCAGTTGCTTCAGCATTT
GCTGGTCATCAGGAAGCCGTACAAGACAGGGATCACAAATTTTGTCTAAAGCAGTTGAAGAAGCTTACCAAGGAGTAG
ATTGTGGCCATGGAGGTCCATTTGGTGCAGTTGTTGTCCGTAATGATGAGATAGTAGTTAGTTGCCATAACATGGTTTT
GGATTACACTGATCCAACTGCGCATGCTGAAGTAACTGCAATAAGAGAGGCTTGCAAAAAGCTTGGAAAAATTGAGTTG
TCAGACTGTGAAATGTATGCATCATGTGAACCTTGCCCAATGTGTTTCGGCGCTGTGCATCTATCACGGATTAAGAGGC
TGGTGTATGGAGCCAAGGCAGAAGCTGCTATTGCCATTGGATTCGATGACTTCATTGCTGATGCTTTGAGGGGAACTGC
TTACTACCAGAAGGCCAACTTGGAGATAAGGCGGGCAGATGGCAATGGAGCCCTGATTGCTGAACAAGTCTTCGAGAAC
ACTAAGGACAAGTTTCGGATGTACTAATTGTAAGTAAATACATT > SEQ ID NO:2030   1675823005481         167582_300548_1
gaattcaaagaaggacaaggaagggaaggagagagatggaaggagaagaaagaaaaaggaagctaagaaggaaaagaa
aGACAAAGAAGTTAAAAAGATAAGAAAGACAAGGAGAAGAAAAATGAAGGTCTAGAAGATGAAGAAGGCGAAGACAAA
AAGAAAGAAGAAGAAGAAAAAGAAAGACAAAGATGGCGAAGAAGAACTGAAGGAAGGGGACGGCGAAAAGAAAGAAA
AGAAGAAGAAGAAAGACAAGGATGGAGAAGAAGAATTGAAGGAGGGGGAAGACGAAAAGAAAGAAAAGAAGAAGAAGAA
AAACAAAGATGGCCAAGAAGACAGCAAGGATGAAAAGAAGACTAAAGACAAAGATGAAAAATCAAAGAAGAAGGAGAAG
GATGAAGGCACTGACATGAAAGAAGAAAAAAAGAAGGACAAGGAAGGGAAGGAGAAAGATGGAAAGGAGAAGAAAGAAA
AAGAAAAGAAGGACAAGAGCAAAGATGAGAAAGATGGCAGCAGCAAGAAGAAAGAAAAGGATGGGGAATCAAAGGAAGA
GAAgaaggaGAAGAAGAACaaggATGAAGATAAAGAGaaGaaGaagaaCaaGaacaaggaAAGTgAggAa > SEQ ID NO:2031   1678743005511         184522_300670_1
GAATTCAGAGGAAACCTCTGACTTCGTAAAGTAACCAAAATATAAAATCCCACACAGAACGTTCAGTTTTTACCGAGAA
ATAGTTTATTGGAAAAAAAAGAAGAAGAAGAAAAAATGGATCATGCTGCTGAGGCTCATATGACTGATTTGATGACCA
TTACTCGGTTTGTTCTTAACGAACAATCGAAGCATCCTGAATCACGTGGAGATTTTCTATCTTGCTTAGTCATATTGT
TCTGGGTTGCAAATTCGTTTGTGCTGCTGTTAACAAAGCTGGGCTCGCAAAACTCATCGGACTTGCTGGGGAGACCAAT
GTTCAGGGCGAAGAGCAAAAGAAACTGGATGTTCTTTCAAATGATGTGTTTGTTAAGGCTCTCGTAAGCAGTGGAAGAA
CGTCTATTCTAGTATCGGAAGAGGATGAAGAAGCAACTTTTGTGGATCCAGCATTGCTGGAAGATACTGTGTGGTTTT
TGATCCCTTGGATGGTTCTTCTAACATTGACTGTGGTGTTTCCATCGGAACTATATTCGGAATTTATATGATGAAAGCA
AACGAGGAACCACATCT > SEQ ID NO:2032   1678743005511         184580_300670_1
gaattcaacatcagttgattcagactagctaggggGGATCAATTGCAGCAACGGCTTCTCATCAGCTTCTATTCTCTA
GCACTACTACCTCTGCTCACCGCTCCTCATCATCATATGCATCATCCTCTGCTCGAGTACTCTTTGATGTCTCTAAGCA
GTCGACAAACCCAATAACCAGGAAATTATCACTCAGTAATGAAGTCAGGTGTGCCGCAGTTGGGACAACAACACCTGAG
ACTGCAACGGTAACCCCCAAAAGGAGCAAGTATGACATAGTTGACTTTGACAAGTTGGTTATTGGACCAAGAGAAGTCTG
GGAATATCGATGCAGAACTTACCGTTGTGCTGTCTAGTATTTCCATGGCTTGTAAACAGATTGCTTCTTTGGTACAGAG
AGCCAGCATTTCTAACCTCACTGGAGGTCAAGGTGCCGTTAACATTCAAGGTGAAGACCAGAAGAAGCTCGATGTTATC
TCCAATGAGGTGTTCTCAAGCTGTTTGAGATCAAGTGGAAGAACAGGGATCATAGCTTCAGaggAAgaggaTGTACCTG
TTGCAGTGGaggAAAGTTACTCAggGAACTACATTgttgtATTTGATCCCCTTGACggCTCATccAACATTGACGCTGC
TGTATCAACCggatccATCTTTGGGATATACCATCCTaacGATGaatgtcttgCTGaTtTtggccgatgATgtgtccgc
TCT
```

FIG. 2 continued

> SEQ ID NO:2033 1678743005511     258449_301696_1
AACAAGTCCATCACATTTCACAATGGAAGCCAACCCCGAAATCCAGACCGATATCATCACGCTGACCCGGTTCATTCTG
CAGGAACAGAACAAGGTGGGCGCGTCGTCCGCAATCCCCACCGGAGACTTCACTCTGCTGCTCAACTCGCTGCAGTTTG
CCTTCAAGTTCATTGCCCACAACATCCGACGATCGACCCTGGTCAACCTGATTGGCCTGTCGGGAACCGCAAACTCCAC
CGGCGACGACCAGAAGAAGCTGGACGTGATCGGAGACGAGATCTTCATCAACGCCATGAAGGCCTCCGGTAAGGTCAAG
CTGGTGGTGTCCGAGGAGCAGGAGGACCTCATTGTGTTTGAGGGCGACGGCCGATACGCCGTGGTCTGCGACCCCATCG
ACGGATCCTCCAACCTCGACGCCGGCGTCTCCGTCGGCACCATTTTCGGCGTCTACAAGCTCCCCGAGGGCTCCTCCGG
ATCCATCAAGGACGTGCTCCGACCCGGAAAGGAGATGGTTGCCGCCGGCTACACCATGTACGGTGCCTCCGCCAACCTG
GTGC

> SEQ ID NO:2034 1678743005511     6547_300328_1
AGAGGATCAGAAGAAGCTTGACGTCATCTCTAATGAGGTGTTTTCCAACTGTTTGAGATCAAGTGGAAGAACGGGAATC
ATAGCCTCGGAGGAAGAGGACGTGCCACTTGCGGTGGAGGAGAGTTACTCCGGCAACTACGTCGTCGTGTTTGACCCTC
TTGATGGTTCCTCCAACATTGACGCTGCCGTCTCTACTGGTTCTATCTTCGGTATCTATAGCCCCAATGACGAATGCAT
TGTCGACGACTCCGACGATATCTCAGCTCTTGGGTC

> SEQ ID NO:2035 1678743005511     279358_200061_1
GAAAATCACAATGGCAGCATCATCAGCAACAGCAACAACTTCATTTCTATGTGCTTTAGATAAAAAGACTCCATTTTTA
TGTACTCTAGACAAAAAGGGAACTCAATTTCTATGCCCAAAAGGCAACAGCACAAAGAGAAGGTCATTTAATGGAGGAG
TGAAGTGCATGGCAATAGAGACAGCAGCAGGGGCTACAGAGACAAGGAAAAGAAGTGGCTATGAGTTGCAAACTTTAAC
AAGCTGGCTATTACGGCAAGAACAAGCTGGGACTATTGATGCTGAACTTACCATTGTGATTTCAAGCATTTCTATGGCT
TGTAAGCAGATTGCTTCTTTTGGTCCAAAGAGCTGGAATTTCTAACCTTACTGGAGTTCAAGGTGCTGTCAATGTTCAA
GAGAAGACCAAAAGAAACTTGATGTTGTCTCTAATGAGGTATTCTCGAATTGTCTAAGGTCAAGTGGAAGGACAGGGAT
TATAGCATCAGAGGAAGAGGATGTACCAGTGGCAGTGGAAGAGAGTTACTCAGGCAACTACATTGTGGTGTTTGACCCT
CTTGATGGATCATCAAACATTGATGCTGCTGTTTCTACTGGTTCTATTTTTGGAATATACagcccaaacgATGAGTGCC
TCGCagatctTggagatgATTccacgcttGacaatGTTgaacagaggtGTAttgtgaATGTATGCcAACc > SEQ ID NO:2036 1678743005511     272661_200131_1
AAAAGTAAAGCAAAACTACCAATGGCAGTTTCAACTACCACAGTACCAACTTCAAACCTGAGCTTCTCTAGCTTTCATT
CCATTTCTCGCCTCTCTCTTTTTCAATTATGTGCTTTACACAAAAAGACTTCATTTTTGTACACCAAAAACAGTATATA
AAAATGGTGTGGAGATGGGGGATTGAGGTGCATGATGATTGAGAGAGGTGCAACAGAGGCTATAAAAACCAAGAAACAG
AATGGATATAAGCTGCAGACATTGACTAGCTGGTTGTTGATGCAAGAACAAGATGGGGTTATTGATTCTGAACTTACTA
TTGTTATTTCAAGTATTTCTTTGGCTTGTAAGCAGATTGCTTCTCTGGTTCAGAGAGCTGGCATTTCAAAACTTGCTGA
GGTCAAGGTGCTGTTAATGTTCGAGGAGAGGACCAAAAGAAGCTTGATGTTGTTTCTAACGAGGTATTCTCTAATTGTC
TAAGGTAAAGTGGACGGATAGGGATTATAGCATCAGAGGAAGAAGATGTACCAGTGGCAGTAGAGGAGAGTTATTATGG
AAACTACATTGTCGTGTTTGATCCTCTTGACGGATCATCAAATATTGATGCTGCTTTATCTTCTGGCGCTATCTTTGCA
ATATACAGCCCAAATGATGATTGCCTCGTCGATCTTGA > SEQ ID NO:2037 1681513005531     114319_300007_1
AATTTTCTCTCTTTCATTTCTTCCTCTCAATTTTCTTCTTCTGCCACTTTTAATTTTCCTCTAATGGATCCCGTTTCAG
TTTGGGCAACGAACCTCTCTCCGCCGTAGATCCCGAAATCCATGACCTAATCGAAAAGGAAAAACGCCGCCAAAGCCG
CGGAATCGAACTAATCGCATCGGAAAATTTCACATCATTCGCCGTAATTGAAGCTCTCGGCAGTGCTTTAACCAACAAA
TACTCCGAAGGAATTCCCGGTAACCGTTACTACGGTGGAAATGAATACATTGACATAATCGAAAACTTGACCAGAAGCC
GTGCTTTAACGGCTTTTCATTTAGATCCAACAAAATGGGGAGTAAATGTTCAACCCTATTCTGGTAGCCCAGCGAATTT
CGCTGCGTATACAGCTGTTTTGAATCCACATGATAGGATTATGGGATTGGATTTACCATCTGGTGGACATTTAACTCAT
GGTTATTATACTTCTGGAGGGAAGAAAATTTCTGCTACTTCGATTTATTTTGAGAGTTTGCCTTATAAGGTGAATTCAA
CAAATGGATATATTGATTATGATAGGTTGGAAGAGAAGGCTTTGGATTTTAGGCCTAAATTGATTATTTGTGGAGGTAG
TGCTTATCCTaGAGATTGGGATTATAAGAGATTTAGAGAAATTGCTGATAAATGTGGAGCCCTTTTGCTTTGTGATATG
GCTCACATTAGTGGCCTTGTTGCTGCTcaggaaGccgccGATCCCTtTGAATATtgtgACTtggtcACTACCACCACTC
ACaaGagcttGAgGGGt > SEQ ID NO:2038 1681513005531     183188_300619_1
ccccgaccgagcgagccgcatacgcattccgtcgaacacctcacccgcacccaccaccaccaacctcccacccccacaac
cCACATCCATGTGCACGCGCGCCCTCCTCTCCTCCTCCGCTATATATCCCCTCCTCTCCACCCCTCCCCACCACTCCCC
TCTCCTCCCGCCTCGCCGCCGCAACCACCGCCGCCTCGCCGCAGCATCACCCGCAGCCGCCGCCGCCGCCGCCATGGAC
TCCGTCGCGTCGTGGGGGCTGACCCCGCTCGCCGCGGCCGACCCGCTCGTCCACGACCTCCTCGAGCGGGAGAAGCGGC

FIG. 2 continued

```
GGCAGCGGAGCGGCATCGAGCTCATCGCCTCGGAGAACTTCACCTCCTTCGCCGTCATGGAGGCCCTCGGCTCCGCGCT
CACCAACAAGTACTCCGAGGGGATGCCCGGGGCGCGCTACTACGGCGGGAACGACGTCATCGACGAGATCGAGAACCTG
TGCCGCGACCGCGCCCTCGCCGCGTTCCGCCTCGACGCCGCGTCGTGGGGCGTCAACGTGCAGCCCTACTCCGGCTCGC
CGGCCAACTTCGCCGCCTACACGGCGCTCCTCAACCCgcaCGACCGCATCATGGGGCTCgagctCCCCTCCGGTGgccA
CCTCACCCATGGCTACTACACCGCGGGCGGGAAGAAGATCTCCGCGacgtcgATCTACTTcgagagCCTCCCCTACAAg
gTGAGCGCCGccaCGGGGTAc > SEQ ID NO:2039 1681513005531      130212_300486_1
GAATTCGAGAGAAATCTTTTTTTGGGGTTGAGAGGAGAGAGAGAGACACACAGAGAGAAAAAATGGCGATGGCAATGGC
ACTTCGTAGGCTCTCATCTTCTTCAATCAACAAACCTATCCGTCCTCTCTTCAATGCCGATTCCTACTATTGCATGTCA
TCTCTTCCAAGTGAAGCTGTTGATGATTCTAAGGATAAATCTCGTGTTCAATGGCCAAAGCAATTGAATGCACCATTAG
CAGAAGTGGATCCAGAGATTGCTGACATTATTGAGCTTGAGAAAGCTAGGCAATGGAAGGGTCTGGAATTGATTCCTTC
AGAGAATTTCACATCTGTGTCGGTCATGGAAGCTGTTGGTTCTATCATGACTAACAAATACAGTGAAGGTTATCCTGGT
GCTAGATACTATGGAGGAAATGAGTACATTGATATGGCAGAAACTTTGTGCCAGAAACGTGCCTTGGAGGCTTTCCGTT
TGGATCCTGCTAAATGGGGAGTTAACGTGCAATCTTTGTCTGGGTCCCCTGCCAATTTCCAAGTCTACACTGCACTATT
GAAGCCCCACGAGAGAATTATGGCACTTGACCTTCCACATGGTGGGCATCTTTCTCATGGGTATCAGACTGACACCAAA
AAGATATCTGCTGTATCTATATTTTTTGAGACAATGCCATACCGATTGGATGAGAGCACTGGTTACATTGATTACGATC
AGTTGGCGAAGAGCGCTACACTCTTCAGGCCGAAACTGATTGTTGCTGGTGCAAGTGCTTATTCACGCTTCTACGATTA
TGCACGCATTCGCCAGGTGTGCGACAAGCAAAAAGCTATATTGTTGGCAGATATGGCTCACATCAGTGGGCTTGTTGCT
GCTGGTGTCATCCCATCTCCGTTTGAGTATGCCGATGTGGTGACCACTACAACACATAAATCCCTTCGTGGGACCACGTG
GGGCGATGATATTTTACAGAAAGGGATTGAAggAAGTCAACAAACAAggCAAAGAGATCATGTACGACTATGAggACAA
AATTAATCAAGCTGTCTTTCCTGGGCTTcaaggaggtCCACATAATCATACAATTACTGGATTAgcAGttGCACTGAAa > SEQ ID NO:2040 168244 130465_300487_1
gaattcaaggggtgcagcgagttagattgagattggagtgttgctggttgtgtatgcttgctgggacttaagctggagta
aTGCATTGACAGTGGCTGGTGGAAATGAGCAGAAGAACAAGGTTATGGAAGTGAAGCTGAACTGCAATTGGTCGTGGTT
TGGCACGGCAATGAACGGAATGGCAGCTGAAGCAATGAGTTGAAGCTGCGGGAGAAGTTGCAGTTCAGAAGATTGAGCT
GAATGGCCGCGGACAAGGAGTTATTATAGGATAATAATCTGAAGGTTGCAATGTTTCCTGGAGTTAAAGCAATGACAGT
TGATGGAAATGGCAGGATAAGAGTTCGAGCAGTGAAGTGATGTTGGCTGAGTCGTAGAAACGAGTGTTGCAAGCATGCT
ACAATGCAGCTGGAAAAGGATTGATACTGGACTTGAAATGTATTGTTACAGGGAAGTGAGCagGAAAAGGAAAATGATG
GAATTGGTTAGTAGAACAATGCTGTTACCATAAAATCTCAAGTTACTACTACTGAAGCTGCTGCACCTGTAAAGAAGGT
AGAAAAGATCTCCAAGAAGGATGAGGAAGGAATTGTTGTAAACAAATTCAAACCAAAGAATCCTTACATTGGTAGATGC
CTTCTTAACACTAAGATTACTGGTGATGATGCCCCTGGAGAAACATGGCATATGGTTTTCACCACTGAGGGTGAAGTTC
CTTACAGAGAAGGACAATCCATTGGGATTATTCCTGATGGAGTTGACAAGAATGGGAAGCCACATAAACTCAGGTTGTA
CTCAATTGCTAGCAGTGCTATTGGTGATTTTGGAGACTCCAAAACTGTTTCATTGTGTGTGAAGCGACTAGTTTACACC
AATGATCAAGGTGAAGAAGTTAAGGGAGTTTGTTCAAATTTCCTATGTGACTTGAAACCTGGATCTGAAGTGACAATCA
CAGGGCCAATTGGAAAAGAAATGCTTATGCCTAAAGATCCAAATGCCACAATCATAATGCTTGGAACTGGAACTGGAAT
TGCTCCTTTCCGTTCCTTCCTGTGGAAAATGTTCTTTGAAAAACACGAAAACTACAAGTTCAACGGGTTGGCTTGGCTC
TTTTTGGGAGTTCCCACAAGTAGCTCATTACTGTACAAGGAGGAATTTGAGCTGATGAAGGAGAAAGCACCTGAAAACT
TCAGGCTCGACTTCGCAGTGAGCAGAGAACAAACAAATGACAAGGGAGAAAAGATGTACATACAAACCCGTATGGCTCA
ATACGCAGAGGAGCTATGGGAATTACTCAAGAAAGACAACACTTTCGTATACATGTGTGGGTTGAAAGGAATGGAGAAA
GGAATTGATGACATTATGGTTTCTTTAGCGGCTAAAGACGGTATTGATTGGCTTGAATA > SEQ ID NO:2041 168244 182760_300663_1
TAGTCATGGCAGGTGCACTCACTGCTGCTGTATCTATTCCAGCATCCAATTCATCGTCTCTCCAAACCAGAACTTCTAt
gtcTTCCTCGGAACGAGTCAGCTTCAACAAGAGCTGTTTGTATTCTAGGAATGGCTGTGCCAGCAGAAGGGTGTTTTCT
GTCAAAGCCGAGGTTACTACAGACACTACTCCACCTCCTAAAGTAGAGAAGATTTCAAAGAAGTATGAAGAAGGTGTTG
TTGTCAACAAGTTCAAACCCAAGAACCCTTACACTGGCAAAGTTCTTCTCAACACCAAGATCACAGCTGATGACGCTCC
TGGAGAAACCTGGCACATGGTCTTCCACACAGACGGTGAGGTTCCATACAGAGAAGGACAATCGATTGGTATTATTCCA
GAGGGCATTGACAAAAACGGAAAGCCACACAAGCTGAGATTATACTCAATTGCCAGTAGTGCTCTTGGGGATCTGGGAG
ACTCCAAAACTGTTTCTCTTTGTGTCAAAAGGCTGGTGTACACCAACGACCAAGGCGAAGAAGTCAAGGGAGTCTGCTC
TAATTTCCTATGTGATTTGCAACCAGGGAGTGAGGTGACGATTACTGGACCTGTTGGAAAAGAAATGCTTATGCCCAAA
GACCCCAATGCCACCATTATCATGCTTGCAACAggTACAggTATTGCtccTTTccgttCATTCTTgtgGaAAATGTTCT > SEQ ID NO:2042 168244 228232_301019_1
AATCCTCTCCTCTCCTCTCCTCTCCTTCCTTTGTCGCGAGTCACAGGCACACAGACATGGCCGCCGTGAACACA
GTGTCGTCGCTGCCCTGTAGCAAAGCTGGCGCCGCCGTAGCCGGGGGAGCTCCGAGGCCGTCGACCTGCTCCGTATTCT
ACCCTCCTCGTTGCTGGTCCAAGCGAAGCAGCGGTAATGGCGTGCGGGCGCAGGCGTCGACGACGGAGACGACCGCAGC
GCCGGCTGCGGAGGTGACTACTAAGGTGGAGAAGGTGTCGAAGAAGCAGGTGGATGGCGTGGTGACGAACAAGTACAGG
```

FIG. 2 continued

CCCAAGGAGCCGTACACGGGGCGGTGCCTCCTGAACACGAGGATCACCGGCGACGACGCCCCGGTGAGACGTGGCACA
TGGTGTTCAGCACCGACGGCGAGATCCCCTACCGCGAGGGGCAGTCCATCGGCGTCATCCCCGACGGCATCGACAAGAA
CGGCAAGCCCCACAAGCTCCGCCTCTACTCCATCGCCAGCAGCGCCATCGGGGACTTCGCCGACTCCAAGACGGTATCG
CTGTGCGTGAAGAGGCTGGTGTACACCAACGATCAGGGAGAGATCGTCAAAG

> SEQ ID NO:2043 168244 50573_300167_1
TGCTGCTATAAGTGCTGCAGTCTCTTTACCTTCCTCCAAGTCATCCTCTCTCCTCACCAAAATCTCCTCTGTATCCCCT
CAAAGGATTTTCCTCAAGAAGAGCACAGTGTGTTACAGAAGAGTTGTGTCAGTGAAGGCTCAGGTGACAACAGATACTA
CCGAGGCACCACCAGTTAAAGTAGTCAAGGAGTCTAAGAAACAGGAAGAAGGGATTGTTGTCAACAAATTCAAACCTAA
GAACCCTTACACTGGTCGCTGCCTTTTGAACACCAAGATCACCGGTGATGACGCTCCCGGTGAGACTTGGCACATTGTC
TTCACCACCG

> SEQ ID NO:2044 168244 246005_301574_1
TATAGGCAAGCGCAGCTTGTCCCTCAACCGGCAGATATGGCGGCGGTGGCGGCGATTCATTCATCGCATTCGCTGGGGC
AATTGCCACTGGCAGAGCGAAGTGATCGACTTCCTGCCGCCATTGCAACCAAGTCATCCTTTCATGGAGGCAAGATCGC
ATTATCAGATCTAACGTATAGCTACAGGCCACTGAATGGCAAGGTCTCCGTGAGAGCATCGGCAGTGTCCACCGAGACT
GTGGAGAAGGTGAAGAAGAAAGCCGAAGAAGGTGTCGTCACAAACTTGTTTAGGCCAAAAGAACCTTATATTGGTCGTT
GCCTCCTCAATACCAAAATCGTCGGAGATGATGCACCAGGAGAGACTTGGCATATGGTTTTCAGCACTGAAGGGAAAAT
TCCATACAAAGAAGGCCAATCCATCGGAATTATCCACCAGGAGTGGATGCGAAAGGAAAGCCTCAGAAGCTCCGGCTT
TATTCCATTGCGAGCAGTGCCCCCGGGGACTTTGGTGATTATAAAACTGTCTCTCTGTGTGTGAAGCGGCTCGTCTACT
TGAATGATAAAGGAGAGGAAGTCAAGGGCGTCTGCTCGAACTTTCTCTGTGATCTAAAGCCAGGAGAGGAAGTGAGCAT
AACTGGACCTGTTGGAAAGGAAATGCTCATGCCAGTTGATCCAAACGCGACCATTATCATGCTCGGTACTGGTACTGGT
ATCGCACCTTTCAGAGGCTTCTTGtggcGGATGTTCTTCGAGAAGCACGAAGATTACAAGTTTAACGGGCTTGCTTGGT
TgttCCTGGGAGTTCCAACCAGCAGCTCACTGCTGTACAAAGAGGAGTcgaGAAGATGAAAGAAAAgttcccAGACAA
CTTCAAGCTCGACTTCGCAGTGAGCCGCGAGCAAACCAACGCCAAAGGCGAGAAGATGTACATCCAGACGAGAATGGCC
gAGTatgccgACCAGCTCTGGGAGCTGCTCAAGAAGGACAACACCTTCGTTTATATGTGCGGATTGAAAGGAATGGAGA
AAGGAATCGACGACATCATGACcgGcCTCGCAGCGAAAGACGGGATTGACTGGATGGAGTAcAAGAGACAGCTAAAGAA
GGCGGAGCAGTGGAATGTTgaaGTCTACtaaaaaCAGTGCTCGCATTTGTCGAAAGCTCGCAATGTAAACTACACCGTA
CAACGTAa > SEQ ID NO:2045 168264 120559_300411_1
cggacgcgtgggttttttaccagaatcctcgtgggataactcttaactccgccggcgaacactctgcctctattactccg
tCACTGAATCTCGCCGGAGCAATAAAATGGTAACGTCTGCCATCACCGGAACGTCAATTATTCCAGTCTCTTTCCGGCA
GCAAACGTCTTCTTCGTCTCTGTTTTCATCTAGATGCTTAAGGAAGCAGATAGTTTCTGTTCTCCGAAGTCCGTATTCT
GATTCATCAGCTATTGGATTGTCTCACAAGACTCTGAAAACCCCGTTAAAGCTCAATGAGCACGAATCCAGCGGTCTTA
CCAATTCAAGCTATGGTGTTATCGAAGCAAAAAAGGGGAATCCACCCGTCATGCCTGCTGTGATGACACCAGGGGGGCC
TTTGGATCTCTCTACTGTGTTATTCAGGAATCGAATTATCTTCATTGGACAACCAATCAACTCCGCAGTTGCTCAGAGA
GTTATATCACAACTTGTGACCCTCGCAACTATCGATGAAAATGCAGATATTTTGATCTATCTTAATTGtcCTgGTGGAA
GTACCTATTCTGTCTTGGCAATATATGACTGCATGTCATGGATAAAGCc > SEQ ID NO:2046 168353 1008437_301415_1
TCTCCACAGGCAGTCCCGTCGATCACATGGCAATGGCTGACGTGAAGGAGAACGATACGTACCAAGATGACCTCCTCGA
CTATGAAGAAGAAGAAGAGGTTGCCCCTGATGCTGGTGCTGCAAAGGTTGCAGCGGAAGCGGTCAGGCGGGGCTATGTT
GGAATTCACAGTTCGGGCTTCAGAGATTTCCTCCTCAAACCAGAGCTGCTTCGAGCCATTGTCGATTGTGGGTTTGAAC
ATCCCTCTGAAGTGCAACACGAATGTATTCCTCAGGCTATGTTATGGATGGACGTGATATGTCAGGCAAAGTCTGGAAT
GGGAAAAACTGCTCTGTTCGTTCTGTCAACATTGCAACAAATTGAGCCAGTTGCAGGGCAAGTGGCTGCACTAGTGCTT
AGTCATACTCGAGAGCTTGCATACCAGATTTGTAATGAGTTTGAAAGGTGCATTACATACCTTCCTGACATCAAGGTGG
CAGTGTCCTATGGTGGTGTTACTATAAAGACGCACAAGGAGTTGTTGAAGAATGAATGCCCCCA > SEQ ID NO:2047 168353 224047_300978_1
AACAATGTCCCACGAAGGCGAAGAAGAACTCCTCGACTACTCCGATAGCGAAGAAATCGCTCTCCCCTCCACCACCGTG
GAGTCTGGCTCCAACGGCGATGCCAAGGCCGAGACCACCACCGTCAAGGAGGAGAACACCGAGCAGAAGGGCTCCTACG
TCGGAATCCACTCCACCGGTTTCCGAGACTTCTTGCTCAAGCCCGAGCTCCTGCAGCCATTGTCGACTGTGGTTTCGA
GCATCCCTCTGAGGTCCAGCAAGTGTGTATCCCCCAGTCCATTCTTGGAACTGACGTTCTCTGTCAGGCCAAGGCCGGT
GTGGGTAAGACCGCCGTTTTCGTTCTCTCCACCCTGCAGCAGCTGGAGCCCGTGCCCGGCGAGTGCTCCGTTGTCGTTC
TGTGTCACACCCGAGAGCTGGCCTACCAGATCATGAACGAGTACGCCCGATTCTCCAAGTACCTGCCCGACGTCAAGAC
CGCCGTCTTCTATGGAGGTTCCCCCATCCAGAAGGACATTGAGCTGATCCAGAACAAGGAGACCTCCCCCCACGTCATT
GTCGCTACCCCCGGGCGACTGCACGCCCT

FIG. 2 continued

> SEQ ID NO:2048 168353 171048_300534_1
ATCCCTTCTAACTTCTTCCAAACCTACTTTTAACTCCAAATGGCAGAAAATAACGAAGATTTGATTGCCTACTCCGACG
ATGATGACCATAACGACGTCAAAGTCAAAAAGGGTGACGGAAACAAGAACGCCACCGGCGGTGGTATTTCAACTCTCCA
CGCTACTGGATTCAAAGACTTCTTGCTCAAGTCCGAGCTCATTCGAGCCATCTCCGAAGCCGGCTTCGAACATCCATCT
GAAGTTCAGATTAATTGCATTCCTCGTGCTATTGAAGGAAAGGATATCCTCTGCCAGGCTAAATCTGGAATGGGAAAGA
CTGCTGTATTCGTGCTTTCACTTCTACAGCTATTGGACAGCAAGAACCCAGAGCCACTCGCTGCACTTGTTCTTTGCCA
CACCAAAGAGCTTGCCCACCAGATTAACCGAGAGATCGTCAGATTAGGAAAGTACCTTCCTAGCATCAAGTCCGCATCA
ATCGTTGGTGGTGACTCGATTGAAGACCAAATCAAAATGTTGAAGACCAATCCACCAAACATCGTTGTAGGAACTCCTG
GAAGAATCTTGGATCTCGTaggCAAGAAGCACCTCGATATCTC > SEQ ID NO:2049 168353 105218_300372_1
CGGACGCGTGGGTGGCACCAGAGGGTTCTCAATTTGATGCTCGTCAGTATGACGCCAAAATGACAGAGCTGCTTGGTAC
TGAACAGCAAGAATTCTTCACATCATACGATGAGGTTCACGAAAGTTTTGATGCCATGGGTTTGCAAGAAAACCTTCTG
AGGGGCATTTATGCCTATGGTTTTGAGAAGCCATCTGCTATTCAGCAAAGGGGCATTGTTCCCTTTTGCAAGGGCCTTG
ACGTTATCCAGCAGGCACAATCTGGGACTGGAAAGACTGCAACTTTCTGCTCTGGAATTCTCCAGCAGCTTGATTACAG
TTTAGTTGAATGTCAGGCTCTGGTTCTTGCACCCAACCCGTGAGCTAGCTCAACAGATTGAGAAGGTTATGCGGGCACTT
GGTGACTATCTAGGTGTGAAGGTTCATGCTTGTGTTGGGGGTACCAGTGTCCGTGAGGATCAGCGTATCCTTCAGAGCG
GTGTTCATGTTGTGGTTGGTACTCCAGGCCGTGTCTTTGACATGCTGCGCAGGCAGTCTCTTCGCCCTGACAACATCAA
GATGTTTGTTTTGGATGAAGCCGATGAAATGCTCTCTAGAGGTTTCAAGGATCAGATTTATGATATAT > SEQ ID NO:2050 168353 237358_301286_1
gcatggctaggtttttacagatcaggtttttctctctTCTTCTTCTTGCACAAAATCATGGCTGGAATGGCAAACGAGGGC
ACGCAGTTCGATCCGAGCCAGTACGACAAGAAAATGGAATTCGCCTTGGAATCCGGCGAAGAGGCCATCTCAAGCTGGG
AAGAGGTTAACGAATCGTTCGATTCGATGGGCCTCCACGAAAACCTCCTGCGAGGAATCTATGCCTATGGTTTCGAGAA
GCCATCGGCGATCCAGCAGCGAGGAATCGTTCCCTTCTGCAAGGGCCTGGACGTGATCCAGCAAGCCCAATCAGGAACC
GGAAAGACCGCCACCTTCTGCGCTGGTATCCTCCAGCAGCTCGAGTTCAACCTCAACGAATGCCAGGCTCTCGTCCTTG
CCCCGACTCGCGAGCTCGCGCAGCAGATCGAGAAGGTGATGCGAGCTCTCGGCGACTACTTACAGACCAAAGTTCACGC
CTGCGTCGGCGGCACCGACGTCCGCCAGGACCAGAAGATCTTGCAGGCTGGCGTCCACGTCGTGGTTGGAACTCCAGGC
CGCGTCTATGACATGCTTCGCCGCCGCGCTCTCCGCGCCGACTACATCAAGATGTTCGTCCTGGACGAGGCCGATGAGA
TGCTCTCGCGTGGATTCAaggaccAGATCTACGATATtttccaGCTGCTGCCtTccaaggtcaagtcgggctcTTctcc > SEQ ID NO:2051 168353 263953_301376_1
attactcgaccacgcgtcgatccttctacttcttccaaacctacttttaactccaaATGGCAGAAAATAACGAAGATTT
GATTGCCTACTCCGACGATGATGACCATAACGACGTCAAAGTCAAAAAGGGTGACGGAAACAAGAACGCCACCGGCGGT
GGTATTTCAACTCTCCACGCTACTGGATTCAAAGACTTCTTGCTCAAGTCCGAGCTCATTCGAGCCATCTCCGAAGCCG
GCTTCGAACATCCATCTGAAGTTCAGATTAATTGCATTCCTCGTGCTATTGAAGGAAAGGATATCCTCTGCCAGGCTAA
ATCTGGAATGGGAAAGACTGCTGTATTCGTGCTTTCACTTCTACAGCTATTGGACAGCAAGAACCCAGAGCCACTCGCT
GCACTTGTTCTTTGCCACACCAAAGAGCTTGCCCACCAGATTAACCGAGAGATCGTCAGATTAGGAAAGTACCTTCCTA
GCATCAAGTCCGCATCAATCGTTGGTGGTGACTCGATTGAAGACCAAATCAAAATGTTGAAGACCAATCCACCAAACAT
CGTTGTAGGAACTCCTGGAAGAATCTTGGATCTCGTAGGCAAGAAGCACCTCGATATCTCCAAGCTGAAATTCTTCGTC
CTGGACGAATGCGATGTCATCCTCGAACAAATTGATATGAGAAAGGACATACAGAAGATCTTCACAGAGACTCCTCAAG
ACAAACAAGTCATGATGTTCTCAGCAACTATGTCCGGCGACACAAAGAAAgtctGCAGAAAGTTCATGCAAAACCAAGa
agacattttcatcgaTGAcgAGGCTAAGCTGACacttcaCGGtctg > SEQ ID NO:2052 168353 284246_200096_1
ggggttttcctattttgtcctaacattttttctgcagacgcttccgaaacctagccctaatttccccgaccaagat
cCAACTTTTCTCTGAGATTTTGTAAGTAATAGTTCGTAGCAAAAGAATGGAGATAACAAGGAGAACGATGCATATGAA
GAGGAACTACTCGACTATGAAGAAGATGATGAAAAACTCCCTGATTCCGTCACCGGAAAAGTCAATGGCGAGTCCGCCA
AGAAGGGTTATGTTGGTATTCATAGTTCGGGTTTCAGAGATTTTCTTCTAAAGCCAGAGCTATTGCGGGCTATTGTGGA
CTCTGGGTTTGAGCATCCTTCCGAAGTGCAACATGAGTGTATTCCACAAGCTATTCTTGGAATGGATGTGATTTGCCAA
GCTAAATCTGGAATGGGGAAAACCGCTGTTTTGTTCTTTCAACTCTGCAACAGATTGAACCTGTTGCTGGTCAGGTTG
CTGCCCTGGTTCTCTGTCACACTAGGGAATTAGCTTATCAGATCTGTCATGAGTTTGAGAGGTTCAGCACATATCTGCC
TGATATCAAGGTTGCTGTTTTCTACGGTGGTGTCAACATCAAACTCCACAAAGAGCTGCTGAAGAATGAGTGTCCGCAT
ATTGTCGTTGGAACTCCTGGAAGAGTACTTGCATTGGCAAGAGACAaGGACCTGTCTTTGAGGAATGTGAGGCATTTTA
TActagaTGAATGTGACaAGATGCTTGAaTcaCttGACATGAGGAGAGATGTGCAGGAAATCttCaAAATGACTcctcA
TGAcaaGCAaGTCATGa

FIG. 2 continued

> SEQ ID NO:2053 168353 280485_200067_1
tgcagacgctacaaaccctaaccctatttcgccgcaagaactcagcttttccgataggctccagctgagttaagtagca
aAAATGGGAGAGAACAAAGAGAACGATGCTTACGAGGAAGAGCTTCTCGACTACGAAGAAGATGATGAGAAGGCCCCCG
ATTCCGTCAACGGAAAAGTTAACGGCGAGTCCGCCAAGAAGGGTTATGTTGGAATTCACAGCTCCGGATTCAGAGACTT
TCTTTTAAAGCCAGAGCTACTGAGGGCTATTGTGGATTCAGGGTTTGAGCATCCCTCTGAAGTGCAACATGAGTGTATT
CCACAAGCTATTCTGGGTATGGATGTTATTTGTCAAGCCAAATCTGGAATGGGCAAAACGGCTGTTTTTGTTCTTTCTA
CTCTGCAACAGATTGAACCTGTTGCTGGTCAGGTTGCTGCCTTGGTTCTATGTCATACAAGGGAATTAGCTTATCAGAT
CTGTCATGAATTCGAAAGGTTCAGCACATATTTGCCCGATATCAAGGTTGCTGTTTTCTATGGTGGTGTGAACATCAAA
CTTCACAAGGAGCTTCTGAAGAATGAATGCCCTCACATTGTTGTTGGAACTCCTGGGAGAGTACTTTCATTAGCTAGAG
ATAAGGACCTATCCCTAAGGAATGTGAGGCATTTTGTtCTGGAtGAATGcgaTAagaTGCTTGAATCACTTGACAtgag
gagagatgTCcaggaaattttcaagatgACTCCCCATGACAAGcaactAatgatg > SEQ ID NO:2054 168353 258623_301698_1
ACAAGGTATATTTGATAAAAAACACCAATTGAAAACAAAATGGCCGACGGACTCACCGACATCGATTCTTCCCAGATCA
CCACCAACTACGACGAGGTTGTTACCTCTTTCGACGACCTTGGACTCAAGGACGAGCTGCTCCGAGGTATCTACGGTTA
CGGTTTTGAGAACCCTTCCTCCATTCAGCAGCGAGCCATCCTGCCCGTCATCAAGGGTAACGATGTCCTTGCCCAGGCC
CAGTCTGGTACTGGTAAGACTGCCACCTTCTCTATCTCTGCTCTGCAGAACATTGACGAGAAGATTAAGAAGCCCCAGG
CTCTGATCATTGCCCCCACTCGAGAGCTGGCCCACCAGATCCAGAAGGTTGTCCTTGCCTTTGGCGAGTACATGAAGAT
TGAGTGCCACGCCTGCATTGGTGGTACCTCCGTCGCCGAGGACATCCGAGTCATCCAGGAGGGTGTCCACGTCATTGTC
GGAACCCCCGGTCGAATCCACGATATGATTGAGCGACGAATCCTCAAGACCGACCTCATCAAGATGTtCATCCTTGATG
AGgccGAtgagatgctttCTCGAGAgttcaaGGACCCCATCTACGATATCTtCaccACCCTCCCcg > SEQ ID NO:2055 168353 246510_301614_1
AGAGGAAGAGATTTGCAGCGTTAGGGTAGCGGCAGCTCTAAATCTCTCTCTCGCGAAGACAAGGGCCACCGCATCTCCG
GTCGCGAATCTGGAAATGGGAGAAGCCAAGGAGAACGACACCTATCAAGAGGAGCTTTTGGACTACGAGGAGGAAGAAG
AGGCGGCCCCCGACGCCGTTGCAGCTAAGGCTGCCACAGAGACTGTCAAAAAGGGATATGTTGGTATTCACAGCTCCGG
TTTTAGAGATTTCCTGCTCAAACCAGAACTTGTTCGGGCTATCGTTGATTGCGGGTTTGAGCATCCATCCGAAGTGCAA
TTTGAGTGCATCCCGCAAGCCATACTTGGAATGGACGTCATCTGCCAAGCGAAGTCCGGAATGGGAAAGACCGCCGTGT
TCGTGCTTTCGACACTGCAGCAGATAGAACCACTCAAGGGGCAAGTTGCTGCTCTGGTCCTGTGCCACACTCGAGAGCT
AGCATATCAGATTTGCCACGAGTTCGAAAGATTTAGTACATACCTTCCCGATATCAAGGTTGCGGTTTTCTACGGTGGT
GTCAACATCAAGACCCACAAGGAcCTGCTGAAAAATGaatgcccgCACATCGTggt > SEQ ID NO:2056 168479 241613_301350_1
ACAGGGCGTAGGGTTTGGAGATTCTCCGCCGCGGGATCGCTACTCCGGAAGTGGAGAATGGGAGGGATTTGCTGGGCCT
TCAGAATGTGGCGTGATTCCAGTGAGATCTAGAGCTCGAGAGGCACGATTAGATGCGGACTTTGTGCGATGTCTGCGAA
TCAGCCCCGGCGAAGCTCTTTTGTGCGGCGGACGAGGCCCCTGTGCACGAAGTGTGATGAAAAGGTTCATGGATGTA
ACAAGCTAGCTAGCCGTCATGTCCGCCTCCAGCTCGCGGAAGCCAGAGCTGTGCCTCGATGTGATATCTGCGAGAATGC
TCCTGCATTTTTCTACTGCGGCATTGATGGGACCTCACTCTGCTTACAATGTGACATGGATGTACATACGGGAGGAAAG
AAAACTCACGAGAGATATCTCATGCTGGGACAAAGAGTAGAGCTTCGTACTTGTAACTCTCAGCCAGAAGATACCGGTG
TACAATCAAACGATCACCGCGGACGTAACCATTACCACCCGCCAAAGCGGGTGGCCGTGACCAAATCCAACAACAGTGA
CGCCCCCGCTGTTGCCATCGCTGTTGGTGATGCCGAAGCGCAGCAGTCCAAGAGCGATCAAGCCGTCTCAAACA > SEQ ID NO:2057 168479 107058_300262_1
AGAAAAGCTCAAGCTACTGTAATTTGCTGTGCTGATGAGGCTGCTTTGTGTGCTAAATGTGATATTGAAGTTCATGCTGC
AAATAAACTGGCAAGTAAGCATCAGAGGCTTCATCTTCACTGCCTCTCCAACAAGCTTCCTCCTTGTGATATTTGCCAA
GATAAAGCAGCCTTCATCTTCTGTGTTGAGGATAGAGCTCTCTTTTGCAAGGATTGTGACGAAGCAATTCATTCAGCTA
GCAGCCTTGCTGCTAACCACCAGCGCTTCCTAGCCACTGGAATTCGAGTAGCTTTGAGCTCAAGCTGCAATAAGGAAGC
AGTAAAAACCCAATTGGAGCCACCACAACCACCTCAGCAGAACTCCCAACAAGTTGGTTTGAAAATGCCTCCACATCAA
TTGTCCGGTATCACGTCACCGTCTTGGCCTGTTGATGATTTACTAGGATTTCCGGATTATGATTCGACTGACAAGAAGG
AACTACTTGAACTTGGTGAACTGGAGTGGTTGGGGGACATTGATCTCTTTGGTGAACAAACAGCAGCTGAAGTACCCGA
GCTATCAGTATCTCAGTCGAGCAACACACATAATATTTACAAGCAAACCAGATATCAAATGTCTTACAAG > SEQ ID NO:2058 168479 143268_200008_1
TTTCCTTCTTAAAAACTCTCCTCCATTTCTGATCTTTTCTCTCTATTCTCATTTCTTCTAAAAACTTCTTCTTCAATCT
TACAATCTTGATATATAGGAACAAGAATAACATATCTGAAAAATCAAATGAAGATCCAGTGTGATGTTTGTAACCAAAA
CCAAGCCTCAGTTTTTTGTGTTGCAGATGAAGCTGCCCTTTGTGATTCTTGTGACCATCGTGTTCATCATGCCAATAAA

FIG. 2 continued

CTTGCTGGCAAACACCAACGTTTTTCTCTTCTCCAACCTTCTCCTAAACAAGTCCCTCTTTGTGATATTTGTCAGGAAA
GAAGGGCCTTTTTATTTTGTCAACAAGACAGGGCAATTCTATGCAGAGAGTGTGATACTTCAATACACAAAGCTAATGA
ACATACACAGAAGCATAATAGATTTCTTCTTACTGGTGTCAAGCTTTCAGCAAACTCTGCCCTTCACTCTTCAACAGAA
TCTCAATCAACAACTTCCTCTACCAAT

> SEQ ID NO:2059 168479 121841_300003_1
ccccccggttttcactcatccgccgctgagctctatctatctactagttagtttacccgccttgagggtaaatcgagct
ttggggcggctttgAgGGGagtacATCGGCATGAGGATCcagggCGACgcgtgCGAGGCCgcggcggccacggtGGTG
TGCTgcgcGgacgaggcggtgCtGtgcGCGCGCTGCGacgtctagATCCACGcCgccaacaagcTCGCCAGCAAGCACC
agCGCCtcccGcttgACGCCgtgCTCCCCGccgtcCTCCCGCGCTGcgaCGTCTGCCaggagaAGGCGGCGTTCATCTT
CTGCGTGGAGGACAGGGCGCTCTTCTGCCGGGACTGCGACGAGCCCATCCAcGTCCCGGGGACGCTCTCCGGCAACCAC
CAGCGCTACCTCACCACCGGCATCCGCGTCGGGTTCAGCTCCGTCTGTAGCGCCAACGCCGACCACCTCCCGCCGCCAG
CGCCCAAGGGGAACTCCAAGCCGCCGGCAAGCGGCATCGCTGCTGCTGCTCCCAAGCCGGCCGTGTCCGCGGCGGC
GCAGGAGGTGCCGTCGTCACCGTTCTTGCCGCCGTCGGGCTGGGCCGTCGAGGATCTCCTGCAGCTCTCCGACTACGAG
TCCAGCGACAAGAAGGGCTCTCCTATTGGGTTCAAGGATCTGGAGTGGCTCGATGACATCGACCTgTTCCATGTCCAGT
CGCCGGCCAAGGGAGGCaGCACGGCGgcgGAGGTGCCTGagcTCTTCGCCTCGCCGCAGCCAGCGAGCAACATGGGGCT
CTACAAGgcgagCGgtgCACGCCAAAGCAAGAagcCACGGGTGgagataccCGATGACGAcgaggacTTCTTCATCGTT
CCTGATCTTGGATGagaTGttGTTATGTaacAGtaaTgctATGCaagtgatgtaaTTttggatGTATgcaaAGAACACT > SEQ ID NO:2060 168524 1171077_302053_1
GAGAAGTTCCGTGTGCTGCATACTCCGACTGCCTTCGGAAACCATCCTGACATATTCTAGCGAGCAACAGTTTAGAAGT
AGGAGTAGGACTGCTGGTATTGCCAAGATAGCGTAAAGAGAGAGAAAAAGCTATTGTAGGAAGGAAGATATAGTATAGG
TGGGGAAGTTAGAGGTGGGACTTTTGAGGTGGTGGGGGGGAGAATCTTTGCCTTAGTAGAAATGGGGATACCTTTACCAT
ACGAATCCGATGGTGACGTTGAAGAGAACAAGCTTGGCCATTTCGAGGGGTTTGAGAAGCGGCTGGAAGTGGAATTTTA
CCCCTGCTTATCTACTTGCGAAGTAGGCCAAGGATTGAGGGATTTAACCCGGGAGCAGCTCGATGAAATGCTCGATGCT
GCGCAATGCACCATTGTGGCACAGTTGAGCAATGATCATTTTGACTCGTATGTGCTTTCTGAGTCAAGCCTATTTGTTT
ACCCTAATTACATGGTCATCAAGACATGCGGAACTACAAACCCCCTAAACGCTATACCTTTGCTGCTATGCTATGCTTC
GGGGTTGGGCCTGAAGGTGCGGCGGTGCAAGTACACCCGGGGGGCGTACCTTTTCCCTGAGGATCA > SEQ ID NO:2061 168524 130278_300486_1
GAATTCAAATCAAAAGGTTTCTAATCTGTTCTTGGGGCTGTTCAAAGTTCGATAGCATCTTATTTACCCAGTTTCTAGG
GTTTGTTTCTTTTGAAGAAAAGGAGGATTTGCCAAAGGTCTTCGTTTCGATCAGAAATCTTTTTAGCGTTGAAAAAGAC
TGAATGATATTACCCAACTAATGGAGGCTAAAGGTGGTGAAGATTCTAGTAGTAAATCCTTAGTTTATGAAGCTCCTCT
AGGTTACAGCATCGAAGACATCCGACCAGCTGGTGGAATCAAGAAATTCAAGTCTGCTGCTTACTGCAACTGCTCCAGG
AAACCATCCTGATATCTTTTAAGCCGTCTTTCGACCACTTTCAGTGGAATTTTCTTTAGGTGTTCAGTTTCCTTCATTG
TTTTTTAATACTCTTTCCCAACCTCAAATTTTCACCTCATTTGTCAACAACCTACTTCTTTTTAAGAAATGGCCTCACC
AACCTCTGCAATCGGTTTCGAAGGTTTCGAGAAAAGACTCGAAATCTCATTCTTTGAGCCTGGGGTATTTGCTGACCCA
GCAGGCAATGGCCTTAGGGCTCTAACAAAATCTCAACTGGACGAGATACTAGAACCAGCTGAGTGCACTATTGTAGGGT
CCATGTCCAATGCTGATCTCGACTCCTACATACTCTCTGAGTCTAGCTTCTTTGTCTACCCATACAAGATGATCATC > SEQ ID NO:2062 168524 226877_301005_1
gttcgacctgccggaggcgtgaagaagttccagtctgctgcttactccaactgcgcgaagaagccatcctgatagccct
tTCGGCTTCTCCATCCTAGTAGTTTAGGATTTCTGCAATTCCATTTTGGCACTTTTCTTCTGACCTATTTCTCTGGCT
GCTGCTTCCTGATAATCGACCAGTTCTCTAGTCTTGCTCCCTGCACTCCTCCCTCCTCCATCTCCGGCACAGTGTTCTG
ACCAACCTGCTCCAATGGGTGTCTTGTCTGCTGCTGACCCTCCCCCAGTCTCAGCAATTGGGTTTGAGGGCTATGAGAA
GCGCCTTGAGATCACTTTCTCTGAGGCACCTGTCTTTGCTGACCCTGATGGTCGGGGTTTGCGCGCCCTCTCCAGGGCC
CAGATTGACTCTGTTCTGGATCTTGCACGGTGCACCATTGTGTCCGAGCTGTCCAACAAGGACTTTGACTCCTATGTCC
TCTCTGAGTCCAGCCTGTTTATCTATTCTGATAAGATTGTGATTAAGACCTGTGGGACTACAAAGCTCCTGCTCACAAT
TCCAAGGATTCTTGAGCTTGCTGAAGGGCTTTCTATGCACTTGCTGCTGTGAAGTACTCCCGCGGGATGTTCATCTTC
CCCAGTGCACAGCCTGCTCCCCACAGGAGCTTCTCTGAGGAAGTTGCTGTCCTCAACCGCTACTTTGGCCATCTGAAAT
CTGGTGGTAaTGCTTATGTGATTggAgAtccagCAAAGCCTGgCcagAAGTGgCATATCTACTATGCtacTCAgcaccC
GgAGcaacctaTGgttacccttgaaaTgtgcatGaccgGA > SEQ ID NO:2063 168524 187733_300680_1
GACCAGTTCTCTAGTCTTGCTCCCTGCACTCCTCCCTCCTCCATCTCCGGCACAGTGTTCTGACCAACCTGCTCCAATG
GGTGTCTTGTCTGCTGCTGACCCTCCCCCAGTCTCAGCAATTGGGTTTGAGGGCTATGAGAAGCGCCTTGAGATCACTT
TCTCTGAGGCACCTGTCTTTGCTGACCCTGATGGTCGGGGTTTGCGCGCCCTCTCCAGGGCCCAGATTGACTCTGTTCT
GGATCTTGCACGGTGCACCATTGTGTCCGAGCTGTCCAACAAGGACTTTGACTCCTATGTCCTCTCTGAGTCCAGCCTG
TTTATCTATTCTGATAAGATTGTGATTAAGACCTGTGGGACTACAAAGCTCCTGCTCACAATTCCAAGGATTCTTGAGC

FIG. 2 continued

TTGCTGAAGGGCTGTCTATGCCACTTGCTGCTGTGAAGTACTCCCGTGGGATGTTCATCTTCCCCAGTGCACAGCCTGC
TCCCCACAGGAGCTTCTCTGAGGAAGTTGCTGTCCTCAACCGCTACTTTGGCCATCTGAAATCTGGTGGTAATGCTTAT
GTGATTGGAGATCCAGCAAAGCCTGGCCAGAAGTGGCATATCTACTATGCTACTCAGCACCCGGAGCAACCTATGGTTA
CCCTTGAAATGTGCATGACCGGACTGGAC

> SEQ ID NO:2064  168524  131259_300512_1
GAATTCAAGCAAAAGAAATATCTAAGTGAAGGCAAACCGGAGTCATCTTGAACCCAGTTACATCCTCAAAAATACATAT
TTGAATCATCGTGAATGTTTTAATGGAGTCGAAAGGTGGTAAAAAGTCTAGTAGTAGTAGTTCTTTACAATACGAAGCA
CCCCTCGGATACTGCATTGAAGACATTCGACCAAACGGAGGAATTGAAAAGTTCAGATCTGCTGCATACTCAAACTGCG
TGAGGAAACCATCCTGATAGGACCTTATATGTTTTCAAACGTAGAGTAGGATTTCCCTATTTCCAGTTTAATCTTAAAT
CCTGCAAAATATAATCTTACAAATCAATTTCTCTGGCTTTCTTATTTTCTTCTTTTTCTTCAATAATCACACCAAGAAA
CAGTCTTTCTTCTTCCTCCACTTAATCTTTCTAAAAGCTTTCAATTTCAATCACAATGGGTGTCTACGCTAACCCACCA
TCTCCAATTGGTTTCGAAGGATTTGAAAAACGTCTTGAGATTACTTTCTCTGAAGCTCCAATTTTTGTTGATCCACAAG
GACTCGGTCTCCGAGCCTTGACTCGTCCTCAGATTGATACAATCCTTGATGCTGCTAAGTGCACTATTGTCGATCAACT
ATCTAACTCAGAGTTTGACTCGTATGTTCTGTCTG

> SEQ ID NO:2065  168524  271980_200039_1
tgatattccctaagctttcatccttaacgcgtcaatagacgcgacccaaaaaaaacaaaaaaaaatttctgctttcatt
tTATTTTGCGCCCTCACTCCTTTTCTTCCTCTTTTACTACTTTCTGCTTTTGTGCTCATTGCTCGGAACATTTTCCTC
TTTAACTTGTTTTGCTGCCGTGAACCATTTTCATCATGGATATGGCCTTGCCAGTCTCTGCCATTGGTTTTGAAGGTTT
TGAGAAGAGGCTTGAAATTTCTTTCTTCGAGCCTGGTCTGTTTGCTGATCCTAACGGAAAAGGACTTCGATCTCTCTCA
AAGGCACAATTGGATGAAATTCTCGGACCTGCTGAGTGCACCATTGTTGATTCCCTATCAAATGACGATGTTGATTCCT
ATGTCCTCTCCGAGTCGAGCCTCTTTGTTTATTCTTACAAGATAATCATCAAAACCTGTGGCACCACAAAGTTGCTTCT
CGCAATTCCGCCCATCCTAAAGTTGGCTGAGACCCTGTCTCTCAAAGTACAAGACGTGAGGTATACCCGTGGGAGCTTC
ATTTTCCCTGGTGCTCAGTCTTTTCCTCACCGTCACTTTTCTGAAGAAGTTGCTGTACTCGATGGCTATTTTGGAAAGC
TTGCTGCCGGTAGCAAGGCTGTGATTATGGGCAGTCCTGATAAAGCACAGAAATGGCATGTTACTCTGCCTCTGCAGG
ACCTATTCAGTCTAATGACCCTGTTTACACTCTTGAGATGTGTATGACTGGTTTGGACAGGGAGAAGGCATCTGTCTTT
TACAAGACTGAAGGAAGCTCGTCTGCTCATATGACCGTTCAATCTGGAATAAGGAAGATCCTCCCCAATTCTGAGATAT
GCGATTTTGAGTTTGAACCCTGTGGTTATTCCATGAATTCGATTGAAGGAGCTGCACTCTCAACCATTCACATTACCCC
AgaAGATGGCTTTAGCTATGCTAGCtttgaagcagttGgGTATGATATGAAAACCAt > SEQ ID NO:2066  168524  279872_200065_1
TGGCATGTCTATTCTGCTTCAGCTGAATCTGCTAATGCCAATAACCCGAATCCAGTTTATACACTGGAGATGTGCATGA
CTAATCTGGACAAGAATAAGGCATCCGTATTTGTCAAGACTCAATCAAGCACTGCCGCTGAGATGACTGAAGTTTCAGG
CATTCGGAAGATCCTTCCTGAATCAAACATATGCGACTTTGACTTTGACCCTTGCGGTTACTCAATGAACGCTATCGAG
GGGCCAGCAATCTCTACAATTCACGTCACGCCTGAGGATGGGATTCAGCTATGCAAGTTTTGAAGCAGTAGGTTATGATT
TCAAAGCCGTAAACTTGACTGCCCATGATTGAGAGGGTGTTGTCCTGCTTCGGACCTGCTGAGTTTTCTGTATCACTACA
CTGTGACACTCCTGGGAAGGAACTTTATACTGAGTCCGGCCTGGACATTATTGGATACGCCTCTGGAGAAAAGACTACT
GAAGTGCTTTGTGAGGGAGGATCACTTACGTACCTCACATTCAGTAGCAATGGTAGCTGTGGATCCCCCAGGTCGATCT
TCCATTGCAGTTGGAGCGAGAGCGAGGATGAGGAAATGGAGAAGATATATTAATGAGAAATTGGTTTATTCTCCGTTTT
AGTATGCAATACTATAGCTGGTATAGATCCAGCCATGCTTTTCTTATTGGTTTATGAATTATGAGTCTA > SEQ ID NO:2067  171033  116419_300068_1
gaaagatgcagttaggaacacctttggtgcatttcttgatcctgtggctgacaagcttatggtagctgcaacattagt
gTTGCTGTGCACCAAACCTTTGGAAATTTCACTGCTCAGAGATGGGCCATGGCTTCTAACGGTTCCTGCCATTGCTATT
ATTGGGAGAGAGATCACAATGTCAGCTGTGAGAGAATGGGCTGCGTCTCAGAATACCAAAGTTCTTGAGGCTGTGGCAG
TTAACAATTTGGGGAAGTGGAAGACCGCAACGCAGATGACAGCATTGACTATCCTCCTTGCGAGCAGAGACAAAAGTCT
TCCTGCACAAGATGCTCTGGTTACTTCCGGCATCGCATTGCTTTATGTATCAGCTGGACTTGCCATATGGTCCCTAGTG
GTGTACATGAGAAAGATATGGCGGATACTTCTAAAATAGCCGTAGCACATAGTGTAATAGAAGGAACAGGAGCAAGCCA
GCAAGGTGATATTACATTTCAAGAGCATACAATTTTTGAACTGCGGAGTTGATTGATGGACCTAGAATTGGTTGAGATC
CTCAGCTACTTACGCATTGTCTCAGTTTGGCGGATTAGTTGCTAAGTTGCTGTGCCTGCAAGATCTCCGTAGAAACAAA
AAACATAGTAGCAAGTAGTATGTTGCCCGGGTGATTACTTCTTCGAAAGCTATTTTCAGAGCCTATCACGGCTCGAGTG
TTGGACACTGGGTGTAATGATCTGCAAAACTGAAAAATGCAGAAGATTGTAACCGTATACGAATACAAAACCATGAGGT
TTGAGTGTGTGACTCTGGGGTTTCTATAGTTTCTAcCATTGTAAGTTTACCCATATGATATGTCAGAAG > SEQ ID NO:2068  171051  105438_300368_1
ATTCTCTGTATTTTTGTACCACAAACAAACTACACACCATTGCTCTCTGCTAAATATGAAAGCAGAATTTTCGTACCGT
TCATCGAGTTTGTACTCTTCTTCTTGTTATTAGGAGTATTATTATATTACTATTGTAATTCAGCAACTGGCTTTGATCA
AATAGAATAAAAGGAAATTGATCTTTTTATTCAAAGTTAATGGAGAGTACAGATTCATCAAGCGGCTCTCATCAGCAGC

FIG. 2 continued

CTCACCTTCCACCTGGCTTCCGTTTTCACCCTACAGATGAAGAACTCGTCGTTCACTACCTAAAGAAGAAAGCTGCTTC
TGTTCCTCTTCCCGTTGCTATTATTGCTGAAGTTGATCTTTACAAATTTGATCCCTGGGAACTCCCTGCTAAGGCAACG
TTTGGAGAACAAGAATGGTATTTTTTCAGTCCAAGGGATAGGAAGTATCCAAATGGGGCGAGGCCAAACAGAGCGGCAA
CTTCTGGTTACTGGAAAGCTACAGGAACAGATAAGCCGGTGCTCACCGCCGGTGGAACTCAAAAAGTGGGCGTTAAAAA
AGCACTGGTTTTCTATGGAGGTAAACCTCCTAAAGGGGTGAAAACCAATTGGATCATGCATGAATATAGAC

> SEQ ID NO:2069 171051 129338_300405_1
CCCCCCCCCCGATTCGAGAAATCCCTCACAGGCCACAACATTTTCAAACAACGCAAAGCAGTAGCAGCAGCGAGAAGCA
AGCAAGAAGCGATGGGGATGAGGAGGGAGAGGGACGCGGAGGCGGAGCTGAACCTGCCGCCGGGGTTCAGGTTCCACCC
CACGGACGACGAGCTGGTGGAGCACTACCTGTGCAGGAAGGCGGCGGGGCAGCGCCTGCCGGTGCCGATCATCGCCGAG
GTGGATCTCTACAAGTTCGACCCGTGGGATCTGCCCGAGCGCGCGCTGTTCGGCGCCAGGGAGTGGTACTTCTTCACCC
CGCGGGATCGCAAGTATCCCAATGGGTCACGCCCCAACCGCGCCGCCGGCAACGGGTACTGGAAGGCCACCGGCGCCGA
CAAGCCCGTCGCGCCGCGTGGGCGCACGCTTGGGATCAAGAAGGCGCTCGTGTTCTACGCCGGCAAGGCGCCGCGAGGG
GTCAAGACTGATTGGATCATGCATGAGTACCGGCTCGCCGATGCTGGCCGCGCCGCCGCGGGCGCCAAGAAGGGATCTC
TCAGGTTGGATGATTGGGTGCT

> SEQ ID NO:2070 171051 201165_300713_1
CCCGCACACCCGCGACAAGCTCAGCTCGGCTAGGCCAAGACGGTGGCGAGCGGCGGCGATCTGGTGGTCTGCTTGGGTT
GAGTTCTTGATTTTGCCGAGGTGTATCGATGGAGACGACGGCGGCGAATAAGCTGCCGCCGGGGTTCAGGTTCAGGCCC
ACCGACGAGGAGCTTGTGGTGCACTACCTCCGCCGCCGCGCGCTCGGCTCCCCTCTCCCACCCGCCGTCGACATCCCCG
ATGTCCGCCTCCTCGCGCATGACCCCTCCGACCTGCTTCCTCCAGGTGAGTCATGAGCCAGCTCGCCGCCGTCGCGCGG
CGTCGTCGGAGCGTGGCCGGCCGGCGCTGACGAGGTCCCGTGCGTGCAGGGTGGAGTGAGCAGGAGAGGTACTTCTTCA
CGTGCAAGGAGGCCAAGTATGTCAAGGGGCGCCGCGCCAACCGCGCCACGGGCGCCGGGTACTGGAAGGCGACGGGGAA
GGAGAAGCCGGTGGCGGTGTCCGTGGCGGCGGCGCCGAGGAGCCAGGCCCGCCGCCGTCGTCGTCGGCATGAAGCGCTC
CCTCGTGTTCTA

> SEQ ID NO:2071 171051 197816_300701_1
CTCCTCTCCTCTTCCCAACACTAGTAGGATAAAGCCACAGAGAGAGCAGTAGTAGTAGCGAGCTCGCCGGAGAACGGGA
CGATCACCNGGAGAAGGGGGAGAGAGATGAGCGGCGGTCAGGACCTGCAGCTGCCGCCGGGGTTCCGGTTCCACCCGAC
GGACGAGGAGCTGGTGATGCACTACCTCTGCCGCCGCTGCCGCCGGCCTCCCCATCGCCGTCCCCATCATCGCCGAGATC
GACCTCTACAAGTTCGATCCATGGCAGCTTCCCCGGATGGCGCTGTACGGAGAGAAGGAGTGGTACTTCTTCTCCCCGC
GAGACCGCAAGTACCCGAACGGGTCGCGGCCGAACCGCGCCGCCGGGTCGGGGTACTGGAAGGCGACCGGCGCCGACAA
GCCGGTGGGCTCGCCGAAGCCGGTGGCGATCAAGAAGGCCCTCGTCTTCTACGCCGGCAAGGCGCCCAAGGGCGAGAAG

> SEQ ID NO:2072 171051 191561_300702_1
AACCCACAACATTTTCAAACAACGCAAAGCAGTAGCAGCAGCGAGAAGCAAGCAAGAAGCGATGGGGATGGGGATGAGG
AGGGAGAGGGACGCGGAGGCGGAGCTGAACCTGCCGCCGGGGTTCAGGTTCCACCCCACGGACGACGAGCTGGTGGAGC
ACTACCTGTGCAGGAAGGCGGCGGGGCAGCGCCTGCCGGTGCCGATCATCGCCGAGGTGGATCTCTACAAGTTCGACCC
GTGGGATCTGCCCGAGCGCGCGCTGTTCGGCGCCAGGGAGTGGTACTTCTTCACCCCGCGGGATCGCAAGTATCCTAAT
GGGTCACGCCCCAACCGCGCCGCCGGCAACGGGTACTGGAAGGCCACCGGCGCCGACAAGCCCGTCGCGCCGCGGGGC
GCACGCTTGGGATCAAGAAGGCGCTCGTGTTCTACGCCGGCAAGGCGCCGCGAGGGGTCAAGACTGATTGGATCATGCA
TGAGTACCGGCTCGCCGATGCTGGCCGCGCCGCGGGCGCCAAGAAGGGATCTCTCAGGTTGGATGATTGGGTGCTG
TGTCGGCTGTACAACAAGAAGAACGAGTGGGAGAAGATGCAGCAGGGGAAGGAGGTGAAGgAggAggcgtccgACATGG
TTACGTCGCAGTCGCACTCGCAcacccactcGtggGgcgagaCGCGCACGCC > SEQ ID NO:2073 171051 129334_300405_1
CCGCCTCTACTCCCCGCACACCCGCGACGGGCTCAGCTCGGCTAGGCCAAGACGGTGGCGAGCGGCGGCGATCTGGTGC
TCTGCTTGAGTTGAGTTCTTGATTTTGCCGAGGTGTATCGATGGAGACGACGGCGGCGAAGAAGCTGCCGCCGGGGTTC
AGGTTCAGGCCCACCGACGAGGAGCTTGTGGTGCACTACCTCCGCCGCCGCGCGCTCGGCTCCCCTCTCCCGCCCGCCG
TCGACATCCCCGATGTCCGCCTCCTCGCGCATGACCCCTCCGACCTGCTTCCTCCAGGGTGGAGTGAGCAGGAGAGGTA
CTTCTTCACGTGCAAGGAGGCCAAGTATGTCAAGGGGCGCCGCGCCAACCGCGCCACGGGCGCCGGGTACTGGAAGGCG
ACGGGGAAGGAGAAGCCGGTGGCGGTGTCCGTGG > SEQ ID NO:2074 171051 109057_300042_1
CCCACGCGTCCGGTATTTAGACATCCCAGCAAAAAAAAAAAGTTTAAAAAAAAAAAAGAGGCAAGGGAGAGTAAATTGA
TTGCGAAAAAAAAATAAAAAAAAATCACAGCAGCAGAGTTGCAATTACCTCCAGGTTTCAGATTTCACCCAACTGATGA
AGAGCTTGTGATGCACTATCTATGCCGAAAGTGCGCCTCCCAGCCAATTGCCGTACCAATTATTACTGAAATTGACCTC
TACAAGTATGACCCTTGGGATCTTCCTCATTTGGCATTGTATGGGCAGAAAGAATGGTACTTCTTTTCACCTCGAGATC
GAAAGTATCCGAACGGTTCACGCCCAAATCGAGCTGCTGGAACTGGTTATTGGAAAGCGACTGGTGCCGATAAGCCGAT

FIG. 2 continued

TGGACATCCGAAGCCAATGGGAATTAAGAAAGCATTGGTGTTTTACGCCGGCAAGGCTCCCAAAGGAGAGAAGACTAAT
TGGATCATGCACGAATATAGACTTGCTGATGTTGATCGATCTGCTCGTAAGAATAACAATAGCTTAAGGCTGGATGATT
GGGTTTTATGCCGAATATACAACAAAAAGGGCTCGATTGAAAAGAATCAACTCAGTAACCGGAAAATGAACAC

> SEQ ID NO:2075 171278 130002_300484_1
GAATTCAAGAACATCACCAGCATAATTCTTCGGGTCAAAAAGCAGTTTCGTCGGTTTCACAAAACAGATAAATATTGAT
AGATTTGAGATATAAATATAGATTTATTGTGAGATTTACTAAAAACATACAGTTGAGAGATAGAGATTTAGAGAAACAG
AAAAAAAAAACAGAGGATAATTAATACAGTTTCATTATTGTTAGAGAGACAGAGAGTCCGAGAGAAGGAAGGAAAACAG
AGGTAGAAGAGAGTATCTTGATGGTGAAAGAAGTGGAGAAATTGGGAATGCGACTTGGAAAATACGAGCTTGGTAAAAC
TCTTGGTGAAGGAAATTTCGCGAAAGTTAAATACGCTCAGAATCTTGAATCTGGACAGATTTTTGCTGTCAAGATTTTG
GAGAAGAAGAAAATCATTAACCTCAAAGTTAACGATCAGATTAAGAATGAGATTGGAACATTGAAACTGTTGAAGCATC
CAAATGTTGTCAGATTACATGAAGTCTTAGCAAGTAAGACAAAGATATACATGGTGCTTGAATATGTAGGAGGAGGTGA
ATTGTTTGACAGAATTGCAACAAAAGGGAGGGTTTCGGAAGCTGTTGGTCGGAAGCTTTTCCAACAGTTGATTGATGGT
GTGAGTTACTGTCATA

> SEQ ID NO:2076 171278 155978_301361_1
CCTGCATTCCATGAATCTAGTTACAATCTTTACATTAACCCAAATGCCGAACTAATCCCTTAATTTTCCCAATCCTTTC
TTCTTCAATTTCATACCACCGCTTCTCTGCATAGCTCTTCTCTTTACGTTGCTTTTCAACGCAGCTTCATCGCTCCACG
CCGGAAAATGGATGGATCAACAGTCCAAGGTGGGAGCAGCGTGGAGTCATTTCTGCGGAACTATAAGCTTGGGAAAACT
CTTGGCATTGGATCATTCGGAAAAGTTAAAATAGCTGAACATACCTTAACAGGGCATAAAGTTGCTGTCAAGATTCTCA
ATCGTCGGAAAATCAAGAACATGGATATGGAAGAAAAAGTGAGAAGGGAAATTACAATATTGAGATTGTTCATGCATCC
TCACATCATTCGGCTGTATGAGGTTGTAGAGACACCATCAGATATATATGTTGTGATGGAGTATGTGAAATCTGGTGAG
CTGTTTGATTACATTGTGGAGAAGGGCAGGCTACAAGAGGATGAAGCTCGTAAATTCTTCCAGCAGATAATCTCTGGTG
TGGAGTACTGCCACAGGAACATGGTGGTTCATAGAGATCTTAAGCCTGAGAACCTCCTTTTG

> SEQ ID NO:2077 171278 186819_300667_1
GTTCAACAAAGTTCAGAGAGGAAGACTAAAGGAAGATGCAGCAAGGAAGTACTTCCAACAACTGATTTGCGCTGTTGAC
TTTTGCCACAGCAGGGGTGTTTATCACCGTGATTTGAAGCCAGAAAATCTTCTTCTTGATGAGAACAGCAATCTGAAGG
TTTCAGATTTTGGCCTAAGTGCTCTTGCTGATTGCAAAAGACAGGATGGGCTGCTCCACACAACCTGTGGCACACCTGC
TTATGTTGCTCCAGAAGTGATCAACAGAAGAGGCTATGACGGTGCTAAGGCTGACATATGGTCTTGTGGAGTGATACTC
TTTGTGCTATTGGCCGGCTATCTACCTTTCCATGATAAGAACTTGATGGATATGTATAAGAAGATTGGGAAAGCAGAAT
TCAAATGTCCAAGTTGGTTTAATACCGATGTTCGAAGGCTCTTGCTCAGGATACTTGATCCTAACCCAAGTACAAGGAT
CTCAATGGACAAAATCATGGAAAATCCTTGGTTTAGGAAGGGTCTCGATGCAAAGCTGCTCAGATATAATCTACAACCA
AAGGATGCAATTCCTGTTGATATGAGCACAGATTTTGACTCCTTCAATAGCGCTCCA

> SEQ ID NO:2078 171278 175570_300545_1
CCCCCCGGCTCCTCCAACCTGGCTCAGTGGCCTCCTGTTCTTGAGAGAACTGAATCTGCTGTCCAGCTGCTGCTCCGGC
TGGTCTCTGAGTTGAAGGTACTTGAATAACTTGAAGGTTCCTAGGAACCTTCATTTGTTGGAAGATGTATAGGGCTAAG
AGGGCTGCATTATCTCCAAAGGTGAAGCGCCGTGTAGGGAAGTATGAGCTCGGGCGCACCATTGGAGAAGGAACCTTTG
CAAAGGTCCGGTTTGCGAAGAACACTGAAAATGACGAACCAGTTGCTATCAAAATCCTTGACAAGGAGAAGGTTCAGAA
GCACAGATTGGTTGAACAGGCGTGAAATTTGTACTATGAAGTTAGTAAAGCATCCTAATGTTGTTCGGCTGTTCGAGGT
CATGGGAAGTAAAGCAAGAATTTTCATTGTTCTGGAATATGTTACTGGAGGAGAGCTCTTTGAAATCATTGCAACTAAT
GGAAGGTTGAAGGAGGAGGAAGCACGAAAATACTTTCAACAACTTATCAATGCAGTTGACTACTGCCACAGTAGGGGTG
TGTACCACAGAGACTTGAAGTTAGAAAATTTGCTGCTTGATGCTTCTGGAAACCTGAAAGTATCTGACTTTGGTTTGAG
TGCTTTAAC

> SEQ ID NO:2079 171278 133451_300449_1
ATTGATTCTCTGGTTTCTTTCTGTAAACCCTAGCTAAAATACCCTAATTCTCTTTCGGGAATGCAGAGAGATGAGAGG
TTATCGGTTTTCTGATCCCCTTTTGACTGCCGGAAAAATCCAAAAACCAGTCGCCGGCGGCAGGAATTGCCACCGGAAA
CACGTAGAAGACGGGTGAATCAATCACCCATTTCGCCCCTTTCTGTCAACCATTTCCTTTTTTCTTTACAGAAACAGAC
ACCGTTTTCATTCTTTAGCCTCTTTTTTACAAATTTAACCAAAATCTTTTCCTTTTCCAAAAAATGGCACCTGAGGAGA
AATGCATGGCTTTGTACGGAAAATACGAGCTCGGCCGCCTTTTAGGCCATGGAACTTTTGCCAAAGTTTTCCATGCACG
TAACGTGCAAAATGGCAAAAGTGTGGCTATGAAAGTTGTGGGCAAAGAAAAAGTGATTAAAATTGGTATGATGGATCAA
ATCAAACGAGAAATCTCTGTTATGAAAATGGTAAAACACCCAAATATCGTTGAGCTTAACGAAGTCATGGCGAGTAAAA
CAAAGATTTACTTCGCCATGGAGTTCGTTAGAGGGGGTGAATTATTTGCAAAAATAGCCAAAGGCAGGTTAAGGGAAGA
TGTGGCT

FIG. 2 continued

> SEQ ID NO:2080 171278 239407_301304_1
ATCGTTTAGCTGGGGCTTGGAGAGGCGATGGATCAGGAGCAGCAGCTGGCGCAGCAGCAGCCGGCGAGGAGGAATGAAT
TCCTGCACTACAAGCTCGGCAAAACTCTGGGCATTGGATCGTTTGGCAAGGTGAAGATCGCGGAGCATATACTCACCGG
GCACAAGGTCGCGATCAAGATCCTCAACCGGAGGAAGATCAAAGCCATGGAAATGGAAGAGAAAGTTCGCAGAGAGATT
AAAATCCTGAGGTTGTTTATGCATCCACACATCATAAGGTTGTATGAAGTTGTGGAGACGAGCACAGACATTTACGTGG
TCATGGAGTACGTCAAGTCGGGAGAGCTCTTCGACTACATTGTTGAGAATGGGCGGCTTCATGAAGATCAAGCTCGACG
TTTCTTTCAGCAGATTATATCAGGCGT

> SEQ ID NO:2081 171278 241487_301348_1
GCAAAGTGTTAGAACCAGAGTCGGTAAGTATGAGATCGGCAGGACACTCGGGGAGGGTACTTTTGCGAAAGTCAAGTTC
GCCAAGCACATCAAAACTGGACATGGTGTGGCTATCAAGATTTTGGACAGAGATAGGGTTCTCAAGCACAAGATGGTCG
AGCAGATCAAGCGAGAAATTTCGACAATGAAACTTGTGAGACATCCGAATATTGTTCAAATAAAGGAGGTTATGGCCAG
CAAGTCGAAAATCTATATTGTCTTGGAGCTTGTCACAGGCGGTGAACTCTTTGATAAGATCGTCCATCAAGGCAGGCTC
AAGGACGACGAAGCAAGGAAATATTTTCAGCAGCTGATCAACGCGGTGGACTACTGCCACAGTCGTGGAGTATACCACC
GTGATTTGAAGCCTGAGAATCTGCTGCTAGACTCAAGCGGGAATCTTAAAATATCGGATTTTGGTCTGAGCGCTCTTCC
TCAGCAACTCCGGGCCGACGGCTTGCTGCATACTACTTGTGGAACTCCAAACTACGTGTCGCCCGAGGTGATCAATGAC
AAAGGTTACGACGGAGCGAAAGCAGACTTATGGTCCTGCGGGGTTATCCCTTTTGTCCTCATGGCT

> SEQ ID NO:2082 171278 270976_200129_1
ctcaaacatagcctttcgtattcagcttctcatatactcttcgatctgaatagtttattataatatttgagttctcttt
aATCTTTTTAATCTTTTTATTTTGGAAAAGTTTAAGATGAGTGTATCCAAGTCCCAGGTTTGGCAACCTTGTAAAAAG
AAGAGGATTTAGCTTAAGGCTTAATCCAGAAGTAAAAAAAATAAAAGAAGATTTTTTTATAGGGAAGAAAAAAAAGAGG
ATGGTCTTTGTATTGATTTAGGGTAGGGATTTAATAAGATTGTAGGATCTGTAAGAAATAGAAAGTTTGGAGATAGATG
GGTTCAAGATCAAATAATGGAAGTGGGAGGACTacaGTGGGAAGGTATGAGATAGGGAGGACAGTTGGGGAGGGTACTT
TTGCAAAGGTCAAATTTGCAAGGAATGTTGAGACTGGTGATAATGTTGCCATTAAGATTCTTGATAAAGAGAAGGTCAT
GAAGCACAAGATGATCGGTCAGATTAAACGGGAAATATCAACGATGAAACTTATAAGACACCCCAATGTTATCCGAATG
TATGAGGTCATGGCCAGCAAGTCGAAGATATATATTGTTTTGGAATTTGTTACTGGTGGCGAACTGTTTGACAAAATTT
CTAGTAGAGGTAGGCTCAAAGAAGATGAAGCAAGAAAATACTTTCAGCAACTTATAAATGCAGTTGACTACTGTCATAG
TAGAGGTGTATTCCACAGAGACCTCAAGCCTGAAAACTTGTTGCTGGATGCAAATGGTGTTCTTAAAGTTTCGGATTTT
GGACTGAGTGCACTGCCTCAGCAAGTTCGCGAAGATGGACTACTACATACAACATGTGGAACACCAAATTATGTGGCTC
CCGAGGTGATCAACAATAAAGGTTATGATGGAGCTAAGGCTGACCTGTGGTCATGTGGTGTAATCCTTTTTGTACTTAT
GGCTggTTATttgcCtTttgAaGagtcaaatctcaTGGCACTAtAtaagaagataccaTAAAGCTGAATtttacatGtc
cacCC > SEQ ID NO:2083 171278 255867_301645_1
GTAAAACGTAGAAAGGTGCTGTAGCATAGTCTGTGCTTTCCCCTCTTTTCCCTTCCTTCCTTCCTTCCAAGTGCG
AAGAACGGAGAAGGAGTTTGCCTTTCATCTTGGTGAAAACCCGGTGCTGTAAGAACAACGAGTGATGAGTCTGCAGAGT
GTGCGGACGAGGGTTGGGAAGTATGAGCTGGGGCGAACCCTGGGGGAGGGGACCTTCGCAAAGGTCAAGTTTGCACGGA
ATATGGAGACAGACGAAAGTGTGGCCATCAAGGTCATTCTCAAGGATAAGATCCTCAAACACAAGATTGCCGAACAGAT
AAAGCGTGAAATATCAATCATGAAGCTGATAAACCATCCAAATGTTGTTAATTTGCACGAGGTGATGGCGAGTAAAACA
AAAATCTATATTGTTCTTGAGTTTGTTAATGGAGGCGAATTGTTCGATAAAATTGTCCATCAAGGGAAACTCAAAGAAG
ATGAAGCCAGAAGGTATTTCCAACAACTTATAAATGCGGTGGATTTTTGCCACAGCAGAGGAGTTTGTCATAGAGATTT
GAAGCCAGAAAACCTGCTTCTAGATGCACGAGGCACTCTTAAGATTTCAGACTTTGGT > SEQ ID NO:2084 171917 284591_200099_1
GAACAATGTCGGGAGCAGAAGAAGACAAGAAGCCCGCCGGCGATCAGGCTGGTCACATCAATCTCAAAGTCAAAGGCCA
GGATGGCAATGAAGTATTCTTTAGGATCAAAAGAAGCACCCAGCTGAAGAAGCTGATGAATGCTTATTGCGACGATAGN
TGGTGGATTTCAATTCAATTGCTTTCTTGTTTGATGGCCGTCGTCTTAGAGCAGAACAGACACCAGATGAGCTGGAGAT
GGAAGATGGTGATGAAATTGATGCGATGTTGCATCAAACTGGAGGCACAATTCTTTGAGTCTTCTCTTCCGTTTGTGGA
CCTAGACTTTATGCGTGTTTCAAGGTGGTATGGACTCGGTGAAAATGTAGGTTGTTCAACTTTAGGGCCTGTAGTGTGT
AATGAATGTCATCATGTTTGCTTCATGTGACTAGCTCGGCTGAACTTCATCGCTACTGTAACTTGATATGAAAGTCAT
TACTTCCTTAACCGTTTAGTTTTCTAAAGATGACATGAATTCAAAGTCTTGGTTTGTTTCAAATAACCCCCTCCCCCAA
CCTTCATGAAATAAGAAGCTTGGCAACACGAAGTAGCTCCAGTGTACCCTGCTGGGCACCTCGTATATCACAGTTTGGT
TC > SEQ ID NO:2085 171917 46095_300173_1
CACGCGTCCGCGCGAATCTCTCTTATGGCTTCGCTTATATCGCAGATCGAAGTTCTTGTTTCCAATCGCCGACCGTATA
ATCTGATAATAAAGTAAGATGTCTGCTACTCCGGAAGAAGACAAGAAGCCTGACCAAGGAGCTCACATCAATCTCAAAG
TCAAGGGACAGGATGGTAATGAAGTCTTCTTTAGGATCAAGAGAAGCACTCAGCTCAAAAAACTGATGAATGCTTACTG
TGACCGTCAGTCTGTGGATTTCAACTCAATTGCTTTCTTGTTTGATGGTCGTCGTCTTCGTGCCGAGCAGACTCCAGAT
GAGCTTGAAATGGAAGATGGAGATGAGATCGATGCAATGCTTCATCAGACT > SEQ ID NO:2086 171917 1108232_301545_1
tgcgaattacagaGAGAGAGAGAGAGGAAGAGAGAGAGAAGAATTCCGGCAGCTATGGCGGAGGCCACGAACAACTATG
CCGGAGCTCCGAAGGCTGAGGAGGAAAAGAAGCCTCTCGACCAGCACCTCAACCTCAAGGTCAAGGGTCAGGATGGCAA
CGAGGTCTTTTTCCGGATTAAGCATTCAACTCAGCTACGGAAGTTGATGCATGCTTATTGTGAGAGGCAATCTATCGAC
TTCAATGCAATCGCTTTTCTATTTGATGGCCGCCGCTTGCGAGCAGAGCAGACTCCGGCAGAGTTGGAAATGGAAGATG
GTGATGAAATCGATGCGATGCTTCATCAGACTGGTGGGGCCTGCTGATAATAATCTCCACCTTGCCAGTGGTTCTCTCT
TATGTATTTTTAACTCGTATAACTGCTGCTCCTTTTGAAATCTTAATCAACGTGGTGTACTTGTACCAAGGATTTCTT
TGTTTACTTGGGGGGCACACCAGGTCTGAAGAAAAACACTGCATTTTTCTTCTACAGTCATGATATATATTTGTGCC
CAAGAGTTGAACTAAAGTTAGgAAATCCAAAGATGTACCTATGATTTAACTTGTGCACGTAAAAGattc > SEQ ID NO:2087 171917 206740_300825_1
aagcaAAGGAATCGGAATCACCAACCTCTCGAAACCGCATCTGTAAAAAGATACGCACGCGCGCATATAAAAACCACAC
AGAAAACATGTCCGAAAACGATACCAACCAGTCCCCAGGCGATCGCCAGGACCCTCCCCCCAACACCGAGCACCTCAAC
ATCAAGGTCACCGACAACAACAACGAGGTCTTCTTCAAGATCAAGCGCAGCACCAAGCTCGAGAAGCTCATGACGGCCT
TTTGCGAGCGCCAGGGCAAGTCCCTCAACTCGGTGCGGTTCCTGTTCGACGGCACGCGAGTGCAGCCGACGGATACCCC
GGACGCGCTCGAGATGGCAGACGGCGACACTCTCGAAGTGCATCAAGAACAGGTCGGAGGATGTCTGCGAGGATGACGC
TACAAAAAGACCAAGGGCGGACGGGAGATGATGATACCAAGTCGGAGAGGAGAGAAGCAGAAAGATAGAAGATGGAGGG
ACATGTGCGTCAGAACTGGGTAATTTGGGTCGCATTCTACCTCCCACACTATCTACCGTGgTTTGTGTAATACATTAGA
GCAGAGCAGAGAGAGAGAGAGTCAGAGAGGGAACCcGCTattctacgaCGTCgatcccaagagccaaaacggcTCTTTC
tttacgCCCTTtcggccTTTCTTgttttccttctCTCTtCCATAATACggcagcggcGca > SEQ ID NO:2088 171917 194068_300743_1
cccgaccAGCACAGGGTCGTCGTCGTCTCCTTCCTCTCGCCAGTGCCACCACAGCTCAAGCGTGATCCAGCGTCGGGCC
GCGCGTGCGAGCGAGCGAGCGTGCGAGATGTCGGCCGCCGGGGAGGAGGACAAGAAGCCGGCGGGGGGAGAGGGCGGCG
GCGCCCACATCAACCTCAAGGTCAAGGGACAGGATGGGAACGAGGTATTCTTCCGCATCAAGAGATCTACGCAGCTGAA
GAAGCTGATGAACGCCTATTGTGACCGTCAGTCTGTGGATATGAATGCTATTGCATTCCTATTTGATGGTCGTAGGCTC
CGTGGCGAGCAGACCCCTGACGAGCTCGAGATGGAAGACGGGGACGAGATCGACGCCATGCTCCACCAGACTGGAGGCT
GCCTGCCTGCCTAGAAGCTTAGGAGTTCTTGCAGCCTCGTAAAATTGTGCCTTTAGTAGGCTCAATATCTAGAAGTACA
TGAAAAAAAGAAGCCTAAAAGAACTTGTGAGGCTTTGGTCCTGTGCCATAGCTGAAGGACATTAGAAGAGCTTTGTTT
ggcaaAAATATTTTGGTACTTCGgctgttaTGACTCGTTTatccATACCCTAATATGTccATCGt > SEQ ID NO:2089 171917 187461_300677_1
GCGGCGGCGCCCACATCAACCTCAAGGTCAAGGGACAGGATGGGAACGAGGTATTCTTCCGCATCAAGAGATCTACGCA
GCTGAAGAAGCTGATGAACGCCTATTGTGACCGTCAGTCTGTGGATATGAATGCTATTGCATTCCTATTTGATGGTCGT
AGGCTCCGTGGCGAGCAGACCCCTGACGAGCTCGAGATGGAAGACGGGGACGAGATCGACGCCATGCTCCACCAGACTG
GAGGCTGCCTGCCTGCCTAGAAGCTTAGGAGTTCTTGCAGCCTCGTAAAATTGTGCCTTTAGTAGGCTCAATATCTAGA
AGTACATGAAAAAAAGAAGCCTAAAAGAACTTGTGAGGCTTTGGTCCTGTGCCATAGCTGAAGGACATTAGAAGAGCT
TTGTTTGGCAAAAATATTTTGGTACTTCGGCTGTTATGACTCGTTTATCCATACCCTAATATGTCCATCGTTGCTGGTG
CTTGGCATGTTTTCTTTTGCATC > SEQ ID NO:2090 171917 1109264_301530_1
GAAAGAGAAAGAGAAGAAATCGATGGCAGATGGGACGAAGAGTGAAGGGAGTCACCAACGCAGCTGATGACAAGAAACC
CCTCGACCAGCACCTCAACCTCAAAGTCAAAGGACAGGATGGGAATGAGGTATTCTTCCGGATCAAACGCAGTACACAG
TTGAAAAAACTTATGAATGCCTATTGTGAAAGGCAGTCGATTGACCTCAACTCGATTGCTTTCCTCTTTGATGGTCGTC
GCTTACGTGGGGAGCAGACTCCTGATGAGCTGGAGATGGAGGATGGTGACGAAATAGATGCTATGCTGCATCAGACAGG
TGGTTGTGTAAGACAACTAAATTACTAAGGTGCTTAAACAGTGACTCGCTCATCCGAATCCTGTTCTAATTGTTTGCGT
TTGACTTTATTGGGTTTCTAAAGAATTGGAAATCCAGGGACTCGACATAGTAGCCGCTAGAACTCTAATCTTATTATGA
TGGAACCAAAATGCTTGTTATCTAAAATTCCTGGTAAGATTGAAGTGAAAAAGGATCTGCCCCCTATGAAATGTTTTGT
TTGCCTATATATTGGATCGTAGGTGCTCCTTTTGTGGATGAAGTTGACATCGTAAATATACACTTTGTACTCGGTTTTA
TGGCAGTTGTTTATG

FIG. 2 continued

> SEQ ID NO:2091 174874 1046554_301924_1
GAGCAATAGAGGGGTGGAATGATGGCTAGTGTTTCTTCTGTACCAATTCCGGCTTCTTCTCTCTCAAGCTCGTTTAGGG
TATCCCGGCCACTGTCCTTCATGGTTCCCTCTTCCGCCTCCTCGTGCCCCCTTTGCCCTCGATAACCTGCGCATTGGC
TTCTGAAGGCGCTGTCCGCATCCAGAACCTTCCTCGCCCTGATTCCTCTGGTCGCTTCGGCAAGTTTGGAGGCAAATAT
GTCCCTGAAACCCTCATCGCTGCCCTCGATCAACTCGAGAAGGCTTACTCTGAAGTCACTAATGATTCTTCGTTCCAGC
AACAACTTTCTAGTATTCTCAAGGATTATGTTGGACGAGAGTCACCTCTTTATTTCGCCGAAAGATTAACGGAACATTA
CAAAAATAGCTCTGGTGAAGGTCCTCTCATATATCTGAAGCGAGAAGATCTGAACCACACAGGTGCTCACAAGATCAAT
AATGCTGTTGGGCAAGCTTTACTAGCAAAGTGGATTGGGAAGAAACGCATCATTGCAGAGACAGGCGCCGGGCAGCACG
GTGTAGCAACTGCAACAGTTTGTGCTCGCTTTGGCTTGAATTGCGTCATTTATATGGGTGCCCGAGATATGGAGAGGCA
ATCCTTGAA

> SEQ ID NO:2092 174874 156478_301366_1
TCCACTGCTCAAACAACTTCACCTCTATCCTCCAAACATTGTTGCCGCCTATCTTCCTCCGCCTCCTCCTCCGCTTCGT
ACTTCCCTAAATTCCAAATACCCTTCAAATTCAACAAAATTACATCTGGCCCTTCCTCTATTTCCTGTGTCCTTACCAA
ACAGAAATCAATGGCAGCTCAAGAGGCTGCTGAACCGGTGGTTCCCCTGCGTCCTGATTCGTTTGGCCGGTTTGGTAAA
TTTGGCGGGAAATACGTACCTGAAACCCTAATGCACGCTCTTGACGAGCTCGAGACCGCCTTCAAATTGCTCGCTACAG
ACGAAGCTTTTCAGAAAGAGTTAGATGGAATACTGAAAGATTATGTAGGCAGAGAGAGCCCTCTTTATTTTGCAGAGCG
CCTTACTGAGCACTACAAACGTCCAGACGGCGAAGGTCCTCTGATCTACCTGAAAAGGGAAGATCTTAATCACACTGGA
GCCCACAAATCAATAATGCCGTCGCCCAAGCTTTGCTTGCCAAGCGCTTGGGCAAGaaGCGCATCATTGCTGAGACAg
GGGCAGGTCAGCATGGTGTTGCTACTGCTACTGTTTGTGCTCGCTTTGGTTTGGAATGTATTATCTACATGGGTGCTCA
AgatatgGag > SEQ ID NO:2093 174874 245978_301573_1
GGCGATGCTTGGCACGGCGGCGGCGTCACGGCGATTCATTGCTTCTCCTCCTTCCGATCAGCTCGGCACGGAGGTGGAG
TTGCCGGCGAGGATCAATCTACCGCGGCGTAGCGTTCGGGCAGCGATCTCGTCCCAGGGCGCCGTGGCGCCGGCGGAGG
AGGAGGAGGTGTTGCATGCTGAGTATGGAGGGTTCCAGCGGCCGGATGCGTTTGGAAGGTTTGGGAAATTCGGTGGTAA
GTATGTTCCGGAGACGCTAATGGCGGCGCTGGCGGATCTGGAGGCCGCGTATCGATTGCTTGTTGGCAAGCCCGAATTT
CAGCAAGAATTGGCTGGTATTCTCAAAGACTACGTTGGACGAGAGTCTCCACTCTACTTTGCCGAGCGCTTGACGCAGT
ACTACAAGAACGCCAATGGCAGTGGACCTGATATATATCTCAAGCGAGAAGATCTAAACCACACCGGTGCTCACAAGAT
CAACAATGCCGTCGGCCAAGCCTTGCTCGCCAAGCACATTGGCAAGAAGCGCATCATCGCCGAAACTGGAGCCGGCCAG
CACGGAGTTGCCACGGCCACTGTCTGTGCTCGCTTTGGACTGGAATGCGTCGTTTACATGGGTGCACAAGACATGGAAA
GGCAAGCTCTCAACGTGTATCGTATGCGGCTTCTCG > SEQ ID NO:2094 174878 243454_301339_1
gATGGCAGGAGGTAGGGTTTCCGGGATTCTCGTCCTTCTCGCGGTATGGGGCTTGATTGCTGTGGCTGCGCCGGCGATG
GCGCGGGTCGCGGTGCCGCTCAAGAAGAAGCCGCTGTCGACAGAGCGCTTGAGGCTTGCGGTGAGAGATATTCCTCGTA
GGGCGCAGGCGCTAGGCTACCCGGATGTCCGGGACGCGAATTCTCGCGCTGGAAATGGCAGCGTTCCGGATTACGAGCC
CCTCAAGAACTACCTCGACGCGCAGTACTATGGCGAGATTGGGATTGGAACCCCTCCGCAGCTCTTCACGGTCATCTTC
GATACCGGGAGCTCCAATCTATGGGTTCCCTCGTCACGATGCATTTTCTCGCCTGCTTGCTGGTTCCACCACGCTACA
AGTCCAAGAGGTCTACCACATACCAGCCGGATGGTACTTCTATCGCTATCAAGTATGGAACAGGCCAGATGGCTGGATT
TTTGAGCACCGATTCCGTTACTATTGGCGACATTGTGGTCAAAGATCAGACGTTTGCTGAAGCGACAAGGGAGCCAGGA
CTTGTTTTCGTTATTGGCAAGTTTGATGGCATTCTCGGGCTCGGATTCAAGGCCATCTCCCAGGGACAAGTTACTCCCG
TCTGGTATAATATGTTGTCCCAGAAATTGATATCAGAACCAGTGTTTTCCTTCTGGCTtaaccGAGATGCTTCGGACGA
CGAGGATGGTGGTGAAATCGTCTTCGGAGGAGTgaacaaGaAGCGTTTTAAGGGag > SEQ ID NO:2095 174878 279457_200062_1
AAAACCGTTCTTCCTTTTTCTCCCGTATCGATCCTCTGTGCTAAGCATGGGTACTACATATGGAACCTGTTTAATTGCA
TTGTGTTTGTTGCTTCTTTTATCCCCTATGGCGTTTTCTGTATCAAATGATGGACTGATCAGAGTTGGAATTAAGAAGA
GGAAGTTGGATCAGATCAGCCAGGCTTTTGGGGGTATTGATTCTAATGGAGCAAATTCTGCAAGAACTTATCATCTTGG
CGGAAATATAGGAGATGCAGATACTGATATTGTTGCACTAAAGAACTACTTGGATGCTCAGTATTTTGGTGAGATTTGC
GTTGGATCACCACCTCAAAAGTTCACTGTGATCTTTGATACCGGAAGTTCTAATCTTTGGGTGCCCTCTGCAAGATGTT
ATTTTTCACTTGCTTGTTATTTGCACCCCAAGTACAAGTCAAGTCATTCCAGTACCTACAAAAGGAATGGCACATCTGC
TGCAATTCGCTATGGAACTGGATCTATTTCTGGATACTTTAGCAATGACAATGTGAGAGTTGGTGATCTTATTGTCAAA
GATCAGGACTTTATTGAGGCAACTCGAGAACCAGGCATCACCTTTTGGCAGCCAAGTTTGATGGTATTCTTGGTCTTG
GATTTCAAGAGATATCTGTGGGGAAAGCCGTCCCCGTCTGGTACAATATGGTAA > SEQ ID NO:2096 174878 271429_200034_1
GTTTTCTTGCTTCATCAAACTGGTCAATATGGGAGCAAAAGCTTTTCTTGTCACCATTTTACTCTCATCGCTGTTATTT
CCTTTGGCCTTGTCTACATCAAATGATGGCTTGGTTAGAATTGGACTGAAAAAGATAAAATTTGATCAAAACAATCGAC

FIG. 2 continued

```
TTGCTGCGCGAGTCGAGTCCAAGGAGGGGGAGGCTTTGAGGGCCTCCATTAGGACGTATAATAACTTCCGTGGTAATCT
TGGGGCCTCTAAGGATACAGACATTGTAGCACTGAAGAACTATATGGATGCTCAGTACTTTGGGGAGATTGGTATAGGC
ACTCCCCCTCAGAAGTTCACTGTCATCTTTGATACTGGTAGCTCTAATTTGTGGGTGCCTTCATCAAAGTGCTACTTCT
CAGTTCCCTGTTTTTTCCATTCCAAGTATAAGTCGAGCCAATCAAGCACTTATAAGAAAAATGGGAAGTCTGCTGCCAT
ACGTTATGGTACTGGAGCAATATCTGGATTTTTCAGTCAAGATAGCGTTAAAGTTGGTGATCTGGTTGTGAAAAATCAG
GAGTTCATTGAGGCAACCAGAGAACCCAGTGTGACTTTTTTGGTAGCCAAGTTTGATGGTATATTGGGTCTTGG
```

> SEQ ID NO:2097 174878 253832_301630_1
```
GGTCGCCCTTCTCCTGCTGGTTTCCTCCGTCTCTTCCTTGCCTTCCCCGCAGCTCCGTCGCGTCGGCCTCAAGAAGAAG
CCTGTCGATGAGGACACCCTCCGTGCCGCCAAGATGCGGCTCCGCTCCAAGTACGCTCACCGAGACAGCGCCCTCCTCC
GTAGCCCTCTCCTCAAGGAGCAGGATGTCGAGCTCGTCAACTACCTTGACGCCCAGTACTATGGCGAGATCGGCATTGG
AACCCCCCCGCAGAACTTCACGGTCATCTTTGACACTGGGAGCTCCCAACCTCTGGGGTCCCTCCGCCAAGTGCTACTT
CTCGCTGTCATGTTATTTCCATCCGAAATTCAAGGGGAGCAAGTCAGAGACATACAAAGTGAATGGACAAGAATGTGAC
ATTCAATACGGAAGTGGGGCTGTGGCTGGGTTTCTTTCCGAGGATACTG
```

> SEQ ID NO:2098 174878 115362_300013_1
```
cgagcgtgggggcaaatagcagtatccatccattctcctgagtactactcttctccatacctgttaattactgctttct
aCTCTCTAAAAGTTTCTCCTACATTTCTGGGGTTTCATCATTAAGACACTCCGCGAATATGGAAAGGAAACATCTCTGG
GCTGCTCTCCTTTTATGGACCATTGCGTGCTTTGTACTTCCTGTTTACTCTGATAATTTGCTTAGAGTTGGTTTGAAGA
AGCAACCCCTGGACATTAATAGCATAAATGCTGCAAGAGTAGCCAGACTACAGGACAGATATGGGAAGAATGTGAATGG
CATAGAAAAGAAATTGGGTGACTCAGATTTGGATATAGTCTCCTTAAAGAACTACTTGGATGCCCAATACTATGGAGAG
ATTGGTGTTGGTTCACCTCCTCAGAAATTCAAAGTTATCTTTGATACAGGAAGTTCTAACCTCTGGGTTCCATCATCAA
GATGCTATTTCTCTATTGCATGCTGGATCCACTCCAAGTACAAGGCGGGCAAGTCCAGTACATATACAAGAAATGGGGA
ATCTTGTTCAATCCGCTATGGAACTGGATCAATCTCTGgCCATTTCAGTCAAGACAATGttcAAGTggtGATCTCGTA
GttAAAGATCaggTGTTttatTGAAGCGACGagagaaccaagtATTACATTTATaattgcaaagttTGATGGTATACTa
```

> SEQ ID NO:2099 174878 201134_300713_1
```
cccccccGCTTTCCTCTACCTTGACTTTGGCTTCCCCACTCTCTCTTCTTCTTGGGAGGCTGGGAGCTACCAGCACAA
CACACCAAGGAAGCTGAGGTGCGTTGATTTCTTGATATCATGGCCAAGAGGCACCTCTTGTTGGTGACAACTTGTTTGT
GGGCTCTGTCATGTGCCTTGCTGCTTCATGCTTCCTCTGATGGGTTCCTGAGAGTCAACCTCAACAAGAAGAGATTGGA
CAAGGAAGATCTCACTGCCGCCCAAGTTGGCGCGACAGGGCAACCGTCTTCTGAAGACCGGCAGTTCAGACAGTGATCCT
GTCCCTCTGGTGGACTACCTCAACACCCAGTACTATGGGGTGATTGGCCTCGGCTCACCGCCGCAGAACTTCACGGTGA
TATTTGACACTGGAAGCTCCAACCTGTGGGTTCCTTCAGCAAAATGCTATTTTTCGATAGCATGCTACCTCCACAGCAG
ATACAACTCGAAAAAGTCGAGCTCTTACAAAGCAGATGGAGAAACTTGCAAAATTACATACGGTTCTGGGCAATTTCT
GGAttCTTCAGTAaggataaTGTGTTGGTTGGagaccttgtaGTgaaAAAccagaagttCAtTGaggcaacACGcgaaa
caaGCGt
```

> SEQ ID NO:2100 174878 137979_300687_1
```
GCTGTTGCTGCTGCTGCTCCTCCCGTTTTCCGATCGCAGCCATGGGAACCCGCAGCGTGGCCTTGGTGCTCCTCGCGGC
CGTGCTGCTCCAAGCCCTCCTCCCCGCTTCGGCGGCGGAGGGTTTGGTGCGGATCGCGCTGAAGAAGCGCCCGATCGAC
GAGAACAGCCGCGTCGCCGCGCGACTCTCCGGCGAGGAAGGGGCGCGCCGGCTGGGCCTCCGCGGCGCCAACTCCCTTG
GCGGCGGCGGGGGTGAGGGCGACATCGTGGCGCTGAAGAACTACATGAACGCGCAGTACTTCGGGGAGATTGGCGTCGG
CACTCCGCCGCAGAAATTCACCGTCATCTTCGACACTGGCAGCTCCAACCTCTGGGTGCCGTCGGCCAAGTGCTACTTC
TCGATTGCGTGCTTCTTCCACTCTCGCTACAAGTCCGGACAGTCGAGCACTTATCAGAAGAATGGAAACCAGCTGCCA
TTCAGTATGGCACTGGTTCAATTGCTGGGTTTTTCAGCGAGGATAGTGTTACGTAGGTGATCTGGTTGTGAAAGATCA
GGAATTCATTGAAGCTACCAAGGAGCCAGGTCTTACTTTCATGGTTGCAAAATTTGATG
```

> SEQ ID NO:2101 174878 136715_300438_1
```
CCCCAACTTGTTTGTGGGCTCTGTCATGTGGGTTGCTGCTTCATGCTTCCTCTGATGGGTTCCTGAGAGTCAACCTCAA
CAAGAAGAGATTGGACAAGGAAGATCTCACTGCCGCCAAGTTGGCGCAGCAGGGCAACCGTCTTCTGAAGACCGGCAGT
TCAGACAGTGATCCTGTCCCTCTGGTGGACTACCTCAACACCCAGTACTATGGGGTGATTGGCCTCGGCTCACCGCCGC
AGAACTTCACGGTGATATTTGACACTGGAAGCTCCAACCTGTGGGTTCCTTCAGCAAAATGCTATTTTTCGATAGCATG
CTACCTCCACAGCAGATACAACTCGAAAAAGTCGAGCTCTTACAAAGCAGATGGAGAAACTTGCAAAATTACATACGGT
TCTGGGGCAATTTCTGGATTCTTCAGTAAGGATAATGTGTTGGTTGGAGACCTTGTAGTGAAAAACCAGAAGTTCATTG
AGGCAACACGCGAAACAAGCGTTACCTTTATCATCGGAAAGTTTGATGGAATTCTTGGTCTTGGCTACCCTGAAATCTC
TGTTGGGAAAGCTCCTCCGATTTGGCAGAGCATGCAGGAGCAGGAACTGCTTGCAGATGATGTCTTCTCATTTTGGCTG
```

FIG. 2 continued

> SEQ ID NO:2102 174917 12754_300251_1
CCCACGCGTCCGCGCGGAGTTTCTTGGAACCTACTTTTTGGTATTCACCGGTTGTGCATCGGTGGTTGTAAACATGCAA
AACGACAATGTCGTGACTCTTCCAGGGATCGCTATCGTTTGGGGACTCACCATCATGGTCCTCATTTACTCTCTTGGTC
ACATCTCTGGTGCTCATATCAATCCT

> SEQ ID NO:2103 174917 145956_200138_1
AAAAAAAAATGAAAAAGAAGTTGTCCCATCTTCCTTTCTTTTTCTCTTTCTTTATTAACTTTTTCAAAATTAATTTTG
TATAAATAGGATAAATCCTGCTCTTTGTTGTCTCATATTCTTATGTGCTCTTCTTTTCTTGAGCATATCATTTACAGCT
TAATAAAACTAAGGATTTTCTATGGCTGATCAGATAGCAGGAGGGGCTAATGGGAATCATGTTGTAACTTTGAATAGTA
AAGAAGATGATGATTCTTCTTCAAGTTGCAGCTTTCTTACTGTTCCTTTCATTCAAAAGGTTATAGCAGAAATGTTAGG
AACATATTTCTTGATATTGGCTGGCTGTGGATCAGTGGTGGTAAATGCAGATAAAGGAATGGTAACATTTCCAGGAATA
GCAATAACTTGGGGACTGGTTGTAATGGTCATGGTTTACTCAGTTGGCCACATTTCTGGTGCACATTTTAATCCTTCTG
TTACTATTGCCTTTGCCACAGTCAAAAGGTTCCCTTGGAAACAGGTACCAGCTTATGTAGCAGCACAAGTTCTTGGAGC
AACCCTAGCAAGTGGAACTTTTACGACTAATATTTAATGGAAAACACGATCATTTCGCTGGAACTCTACCTACAGGGAC
TGAATTTCAATCGTTCGTAGT

> SEQ ID NO:2104 175484 108166_300259_1
CCAAATATTCCTCGGACACGGTCACTTTTTTTTCATCTCGGTTTCTTGCTCACTTTTTATTCATCTTAATCTTCAATAT
TAGCTACAATGTATCAAGCAGCAGAGTCATCTTGGGCTGGAAATTACCACAACAACATAGCGACAAGGCGTGGATCGTC
ATCGTCGTCAGACCCGTTGGAGAGGGTTGTGAGGCTGGCGTCAGGAAGCGCTGTGGTGATATTCAGCGTGAGCACATGT
TGCATGTGTCATGCAGTGAAGAGGCTGTTTTGTGGAATGGGAGTGCACCCTACGGTGTACAATTGGACCAAGACCCCA
AAGGCAAAGAAATGGAGAGAGCACTCTCTAGGCTTTTAGGCAACGCTCCTGCAGTCCCTGTTGTCTTCATTGGTGGAAA
ACTAATTGGAGCAATGGATAGAGTTATGGCTTCTCATATTAATGGCACTCTTGTCCCACTTCTCAAGGAAGCCGGCGCT
CTCTGGCTTTGATTTGACTAAAGAATAGCAGGATTAGGTTGATGGATGGATTATTCCTCCATTTTTATTTTTGGTTTC
TTTAATTAATGTGCTTTAAGTTTTGTAGCTAAGTATGTTATAGTTGATATAATGCGTCAATTTAACTAGTAACTGTTTA
ATTTCATGGCAACCTTGTAGTTGATGCGCTGATGCATGTATTTGATGATTAACTATCTC

> SEQ ID NO:2105 175535 191084_300738_1
CCCCCCCCGGATGAGAATGGCCGCGCCGCAGCAAGTGGGTGTGCGTGCCGCCCCGCTCGCGCGCGCGCTCCGAACTCGC
GTCGCCGCCGCCGCGTCTGCGAGCTCTCCCGAACGCGCGCTCCTCGGCCTCTCCGAACCAGATCTCCGGCAGCTCG
CCGTCGACCTCGGCCAGCAAAGTTACAGGGGGAAGCAGCTTCACGACCTCCTCTACAAGTCCAGGGCCAAGCAAATCCA
AGAATTTAGCCACGTACCAAAAGGTGTTCCGTGAGGCCTTGGTGCGGCTGGCTGGAAGGTTGGCCGCTCGCCAGTGCAC
CATGCTGTGACGGCCTCCGATGGCACTACCAAGATACTTCTCAAGTTGGAGGATAACAGATTGATCGAAACAGTAGGGA
TCCCTGTCGATGATGACAAAGGCCCGTCAAGACTCACTGCCTGCGTTTCATCACAGGTTGGCTGCCCCTTGCGTTGCTC
ATTTTGTGCCACTGGCAAGGGAGGGTTTGCAAGAAACCTTCATGCACATGAGATTGTGGAGCAGGTTTTGGGCATAGAG
GAGACGTTCCAACACAGGGT

> SEQ ID NO:2106 175706 106172_300458_1
TTTTTGAGTTTCCTCACCACAAAATGATTCCAAGAAAGCATTGGTTTTTATTTATTACATTATAGCCATATTTATTCCA
AAATTAATGTTGGCTCAAAACTGTGGGTGTGCAGAAGGTTTATGCTGCAGCAGATGGGGTTACTGTGGCACTGGAAATG
AATATTGTGGTCAAGGCTGCAAAGGAGGGCCTTGTTTTATTTCAGCAAATTATGGAATTTCATCAGTTTCTGAAATTGT
TTCTGAACCATTTTTCAATGGAATTGCTAATGAAGCGGCTCCAAACTGTGAAGGCAAAGGATTTTACACAAGATCTGCT
TTTCTTGAAGCTCTCAGGTCTTATCCTACATTTGGAACTGATGCTTCTTCTGATGATAATAAGCGTGAAATTGCTGCTT
TCTTTGCTCATGTTACCCATGAGACTGGACAAATGTGCTACAGAAATGAGATAAATGGTGCATCTAGGGACTATTGTGA
CGAGACAAATGCAGAGTACCCATGTGTTCTCGGCAAGAAATATTACGGTCGAGGACCGATACAATTGTCATGGAATTTC
AACTATGGACCGGCGGGGAAAGACAATGGATTCGACGGCCTGAACGACCCTGATATCGTTGCTAGAGACAGTCTGATAT
CATTCAAAACTGCCCTGTGGTACTGGATGAACAATTGCCATGCTCTCATAACTTCTGGACAA

> SEQ ID NO:2107 175706 137832_300705_1
GCCAGAGCCAGTGCTCCGGCAGCTGCGGCGGCGGCGGCCCGACCCCGCCCTCCGGCGGTGGCGGCAGCGGCGTCGCCTC
CATCGTGTCGCGCTCGCTCTTCGACCAGATGCTTCTCCACCGCAACGCGCGGCGTGCCCGGCCAAGAACTTGTACACC
TACGACGCCTTCGTCGCCGCCGCCAACGCCTTCCCGAGCTTCGCCACAACCGGCGACGCCGCCACCCGCAAGCGCGAGG
TCGCCGCGTTCCTGGCGCAGACGTCGCACGAGACCACGGGCGGGTGGGCGACGGCGCCCGATGGCCCCTACTCGTGGGG
CTACTGCTTCAAGGAGGAGAACAACGGCAACGTTGGGTCCGACTACTGTGTCCAGAGCTCGCAGTGGCCGTGCGCCGCC
GGCAAGAAGTACTACGGCCGGGACCCATCCAGATCTCCTACAACTACAACTACGGCCCGGCGGGGCAGGCCATCGGCT
CCAACCTGCTGAGCAACCCGGACCTGGTGGCGTCGGACGCCACCGTCTCCTTCAAGACGGCGTTCTGG

FIG. 2 continued

> SEQ ID NO:2108 175706 21621_300070_1
CACCCACGCCTCCGCAAAGCGGTGCTTTCACAAAAATCTCCTTAGTCCTTCTTCTCTGCCTCTTAGGTTTCTTTTCTGA
AACTGTCAAGTCTCAAAACTGCGGTTGCGCTCCAAACCTCTGTTGCAGTCAGTTCGGTTACTGTGGTACCGACCATGCA
TACTGCGGTGTTGGATGCCGATCAGGTCCTTGTAGAGGTAGTGGAACCCCTACCGGAGGGTCGGTCGGTAGCATTGTGA
CACAAGGTTTCTTTAACAATATTATCAACCAAGCTGGTAATGGTTGCGCGGGAAAAGATTCTACACCCGTGACTCTTT
CGTTAACGCCGCTAATACTTTCCCCAACTTTGCCAATTCTGTTACCAGACGTGAAATTGCTACCATGTTTGCTCATTTC
ACTCACGAGACCGGACATTTCTGCTACATAGAAGAGATTAACGGAGAAACACGTAACTACTGCCATAGCAGCAACACAC
AATACCCATGTGCACCGGGAAAAGGCTACTTCGGTCGTGGTCCGATCCAACTATCATGGAACTACAACTACGGAGCGTG
TGGTCAAAGTCTCGGTCTTGACCTTCTACGCCAGCCCTAACTTGTGGGTAGCAACCCAACTGTAGCTTTCAGGACGGGT
TTGTGGTTTTGGATGAAT

> SEQ ID NO:2109 175706 239217_301302_1
tcttcagcTCCGAGTTCTCTTCCTCCTGCTCGCGATCTTAGCTGCCGCTGCCGAAGACTGCGGACGACAAGGCGGCGGA
AGAAGTTGTCCGCCTGGAAACTGCTGCAGCAGGTGGGGATGGTGCGGTGACACTCCCGACCACTGCGGCGAAGGCTGCC
AGAGTCAGTGCGGTGGAGTAACACCGCCGCCTGGTGACGGTGTCGGATCTATCATCACGAGTTCCATCTTCGAGAGCCT
GCTCAAGCACCGCAGAGACTCGGGATGTGCCGGTGGCTTCTACACGTACAGTGCGTTCCTCACGGCTGCCAGATCTTTC
CCGCGGTTTGGAAACGAAGGCTCGCTGGAGCAGAGGAAGCGAGAGCTCGCTGCCTTCCTGGCACAGACATCCAAGGAGA
CCACAGGTGGATGGCCGACTGCTCCTGACGGGCCTTATCGATGGGGCTATTGCTTCGTTGAGGAACAAAATAAGGACAT
CTACTGCAGCGCTTCGGCGACATGGCCATGTAATGGCAGCAAAAGATACTTTGGTCGTGGTCCCATTCAGCTTACATGG
AACTACAACTATGGCCTGGCAGGATCACAAGTCGGCTTCGACGGCATCAACGATCCGGACATCGTTTCGCGAGACGCGG
TGGTGTCGTTcaagacagCGATCTGGTTCTGGATGACGCCACAGAACCCGaagccTTCGTGTCACGACGTAATTCTGGG
GAAATGGaggccatccagtgccgacttagcagcGggaaggACTGCGAGctat > SEQ ID NO:2110 175736 257216_301680_1
gcacccccgtgctatagatcttacatcgcagcagctgcaacagtaggaaaagaaaaacaatggccgctcagatcccgca
gCTCTCGCTGGGACTACAGCAGCAGCGGCAAAATCTGTTTTGGGGGATAAGCCCCAGTGCTTGAATTTCAAGAGAAAC
AGTAGCTCTGCCTCGAATTGTCTCTCGTCATCAAATCAAGGACATGTGAGCAGTGCGAGAGCGATGGATATGGCGAGGG
ATACGAGCTCCAATCTGGTGGTGTGTTTCGGAGAGATGCTTATAGACTTTGTTCCCACAGTCGGGGGTGTCTCCCTGGC
GGAGGCTCCGGCGTTTAAGAAAGCTCCCGGTGGAGCTCCGACAAATGTTGCGGTCGGGATCTCTCGCCTTGATGGAAAC
TCCGCATTCATCGGTAAGCTTGGTGAGGATGAATTCGGCTTCATGCTTCTGGACATCCTGAAGGACAACAATGTAGAGA
GCAAAGGCATGCGTTTTGATCCCGGTGCCCGTACTGCTCTCGCGTTTGTGACGCTCCGCAAGGACGGCGAGCGTGAGTT
TATGTTTTACCGCAATCCAAGTGCCGACATGCTGCTAAAGCCGGACGAACTGGACGAAGACCTTATCAAACAGGCCTCC
ATTTTCCACTACGGTTCCATCAGCCTCATCGCAGAGCCCTGCAGATCGGCCCACTTGGCCGCGATGAAAATCGCCAGAG
AAGCCGGGGCGATCCTTTCGTATGATCCCAACtTGAGGCTTCCATTGTGGAGCTCGGCAGAGGCAGCCCGGAGCgggat
CAAAAGCATCTGgaacgAAGCCGACATCATcAAGAtaagtgAGgaggagATCACTTTCCTGACTg > SEQ ID NO:2111 175736 45808_301003_1
GCAACATACGTCTTTTCTAAATCATTACATTTGAAGAAGAGAAACAAAAACAGAGCGGAATGCCGAATTTGTTTCTCTT
CTCGATTCAACCATCCGAAAACAAGAATACAAAAAGAGAAGATAATCGCGGAAACAGATTACGTAATAGAAGCTTGAGT
TGTTTTGTTTCTATTTCTTTTCGAGAAAGCTCCGAACTTCAGCATCTGAGGGAAGAGCTGGAATGGCTCCTTTTTTGGT
CGTTGTGATTGCTCCACAAGCATTTGCGAATCTCAGCACTTTCCTCAATCTCTCTTCGTCCTCGAGAACGGATCGATCA
TCGACAATCTGGTTTAGAAGAGCACCGACAAAGGAATCTCCAGCTCCGGTTGTGTCCACAGCGTTCACATGGAAAGGGT
CAACGGCTCCTTTGAAAGTCTTGGTGTAATACCGACAGCCCTTTTCACCAAGAGTGACTAACAACAGCTTCAAGTTGGG
ATGCCACAAGGTCAACGCGGTCTCATCATCAATCTTGTTGCTTCCAGTTAGAAACTCAAGCTCAACATCGCTCACCTTG
ATGATCTCAGCTTTGTcCCAAATGCTCATGATCTGTGttTTGGCTTCTTCTTTTGATggccacagaggctcCTGaggt
ttgGGTCATAggAAAgaagagctcctgcgcg > SEQ ID NO:2112 175736 268759_200053_1
gttgtttccctgttatccttgaccgatccatgaaaagcagcttcaagctatccaagagttcttcttctgataagctcaa
tAAAAGCAAGAGCTTTATCTGTTCACCAACATCTCTATCAACGAAGAAAAGGGAGCAGGAAAACAATCACCTGGTTGTA
TGTTTCGGGGAGTTGTTGATTGACTTCGTTCCTACTGTATCTGGAGTTTCACTTGCAGAAGCGCCTGGATTTGAGAAAG
CTCCTGGTGGAGCTCCAGCTAACGTTGCAGTTGGTATAGCAAGATTAGGAGGTTCTTCCGCCTTTATTGGCAAGGTGGG
TGCAGATGAATTTGGTTATATGTTATCTGATATATTAAAACAGAACCATGTCGACAATTCTGGCATGCGTTTCGATACC
CATGCAAGGACAGCATTAGCATTTGTCACTTTGAGAGCAGATGGCGAGAGAGAATTCATGTTTTTCCGCAATCCAAGTG
CTGATATGCTTCTTACAAAGGAAGAGCTGGACAAAGATCTCATTCAGAAGGCAAGAATATTTCACTATGGGTCAATCTC
TTTAATCGCGGAACCGTGTAGGTCAGCTCATCTTGCAGCCATGGAGATTGCCAAAAAAGCTGGCTGCATTCTCTCTTAT
GACCCAAATCTAAGGTTGCCCTTATGGCCATCCGCAGATGCTGCTCGTAAAGGCATCTTGAGCATTTGGGACCAAGCCG

FIG. 2 continued

ACGTTATTAAGGTAAGCGAAGACGAAATCACATTCTTGACAGACGGTGAAGACgcctACGATGACAATGTGGTGATGAC
TAAgctTTTCCACCCAAACCTTAAGCTTTTGctGGTTACCGAAGGGGGAGAAGGTTGCAGATACTATACTAAGAATTTT
CACGGGAGAGTGAATGGCATTAAAGTaaCAGCAGTTGATACCACAGGAGCAGGtgATGCATTTGTTGGCGGACTtctca
aCAGTATGGCCACAGATCCAGACATTTATCAGGATGAGAAGAAACTAAGGAATGCACTCCTTTTTGCCAATGGTTGTGG
AGCTATAACTGTGACAGAAAAAGGAGCAATTCCTGCATTGCCAACAAAAGCAGCAGTGCTTAAAATCtTGGATGGTGCC
ACAGCTAACTGATCCAATCAAATTCCCCCCACCCACAGAaaagcctcctaatctccaccccttgtaagacactacacta
gtacttcgtgtacaaattatcatatatactggaatttact > SEQ ID NO:2113 175736 109167_300043_1
ATACTTTACATTTATACATATATTCTCTCTATTCATCGTCGCTATGGCAGCTAACGGCGTTAGTTCTGGTTTAATTGTG
AGCTTCGGCGAGATGTTGATCGATTTCGTGCCGACGGTCTCCGGTGTATCCCTTGCCGAGGCTCCGGGTTTCTTGAAGG
CTCCCGGAGGTGCACCGGCAAACGTCGCCATCGCAGTGACTAGGCTTGGGGGAAAGTCGGCGTTCGTCGGGAAACTCGG
CGACGATGAGTTTGGCCACATGCTCGCCGGGATACTAAAACAAAACGGCGTCCAAGCGGACGGGATCAACTTTGACAAG
GGCGCGAGAACGGCGTTGGCATTCGTGACCCTACGCGCCGACGGAGAGCGTGAGTTCATGTTCTACAGGAATCCCAGTG
CCGATATGTTGCTCACTCCCGGCGAGTTGAATCTTGATGTTATTAGATCTGCTAAGGTGTTCCACTACGGTTCGATAAG
TTTGATAGTGGAGCCATGCAGATCAGCACATTTGAAGGCGATGGAAGTGGCAAAGGAGGCAGGGGCGCTGCTCTCTTAT
GACCCAAACCTCCGATTGCCGCTGTGGCCGTCGGCA > SEQ ID NO:2114 175736 137105_301003_1
aacgAGGAgaagcTgagGGAGGCGctcaAGTtttTCGAACGCGTGCGGAGCCATCTGCACCACCAAGAAGGGTGCCATCC
CGGCGCTGCCCACCGTCGCCGTCGCGCATGAGCTCATCAGCAAGGCAGCCAACTAGAGCTCCTCGGTTTCGTCGTCGAT
CGCCGCCATTGGGGGCCTCGGAATTTTAGGTCGATTTAATTTAGTTGCTGCTTCGTTTTAGACAAGGAAGAGGAGGGGC
TTGGGTGTGTTCATGTCTGTCTTTTGTGTGCTAAGTTAGTTGCTTCCGTGTGAGAACTTTTGGCGTTTATTTTTACTAT
TATTATTAATAAGAAGCTCTTGGATTTGCGGTGGATATTTTGGTCTGAATTTGTGTAATGAGGCAGCTACTTGGCGAAA
TTTATTGTGTCATGTCTTTGTTCAGAGGAAAAGAAAATCTTTTCGTGTGCTCTGTTTCAAATCAGTTA > SEQ ID NO:2115 175736 183116_301003_1
GCCGCCAAGTAGCTGCCTCATTACACAAATTCAGACCAAAATATCCACCGCAAATCCAAGAGCTTCTTATTAATAATAA
TAGTAAAAATAAACGCCAAAAGTTCTCACACGGAAGCAACTAACTTAGCACACAAAAGACAGACATGAACACACCCAAG
CCCCTCCTCTTCCTTGTCTAAAACGAAGCAGCAACTAAATTAAATCGACCTAAAATTCCGAGGCCCCCAATGGCGGCGA
TCGACGACGAAACCGAGGAGCTCTATTTGGCTGCCTTGCTGATGAGCTCCTGCGCGACGGCGACGGTGGGCAGCGCCGG
GATGGCACCCTTCTTGGTGGTGCAGATGGCTCCGCACGCGTTCGAGAACTTGAGCGCCTCCCTCAGCTTCTCCTCGTTG
TGGAAGATGGAGTCGTCCTTGGCGACGTTGACGAGGAGGGAGCCGACGAAGGCGTCGCCGGCGCCGGTGGTGTCGACGG
TGTTGACGGAGAAGCCGGGGACGGAGCCCTTGAAGTCCTTGGTGAAGTACCTGCATCCCTTCTCGCCGTCG > SEQ ID NO:2116 175736 190868_300736_1
cccccccccgatcgcttctcatcgcAAATCGCATCGACTTCgatgcgCTTCGTTTCGTTCTCGCTGTTGATTTGTTCGTG
AGATTTGAATTCTAGCAATGGCTCCTCTCGGTGACGGAGCGGCGGCGGCGGCGGCGGAGCCCAACCTGGTGGTGTC
GTTCGGGGAGATGCTGATCGACTTCGTCCCCGACGTCTCCGGCGTCTCGCTGGCCGAGTCCGGCGGCTTCGTCAAGGCT
CCCGGCGGCGCCCCCGCCAACGTCGCCTGCGCCATCTCCAAGCTCGGTGGCTCCTCCGCCTTCGTCGGCAAGTTTGGTG
ATGATGAGTTCGGGCACATGCTGGTGGACATCCTGAAGAAGAACGGGGTGAACGCGGAGGGGTGCCTGTTCGACGAGCA
CGCGCGCACGGCGCTGGCGTTCGTGACCTTGAAAAGCAACGGCGAGCGCGAGTTCATGTTCTACCGGAACCCGAGCGCC
GACATGCTCCTGACGGAGGCGGAGCTCAACCTGGACCTGATCCGGCGCGCCAAGATCTTCCACTACGGCTCCATCTCCC
TCATCACCGAGCCGTGCCGCTCcgccCACGTCGCCGCCATGCGCGCCGcca > SEQ ID NO:2117 175736 137105_300502_1
ccccccgatcgcttctcatcgcaaatcgcatggacttcgattcgcttcgtttcgttctcGCTGTTGATTTGTTCGTGAGA
TTTGAATTCTAGCAATGGCTCCTCTCGGTGACGGAGCGGCGGCGGCGGCGGCGGCGGAGCCCAACCTGGTGGTGTCGTTCGG
GGAGATGCTGATCGACTTCGTCCCCGACGTCGCCGGCGTCTCGCTGGCCGAGTCCGGCGGCTTCGTCAAGGCTCCCGGC
GGCGCCCCCGCCAACGTCGCCTGCGCCATCTCCAAGCTCGGCGGCTCCTCCGCCTTCGTCGGCAAGTTTGGTGATGATG
AGTTCGGGCACATGCTGGTGGACATCCTGAAGAAGAACGGGGTGAACGCGGAGGGGTGCCTGTTCGACGAGCACGCGCG
CACGGCGCTGGCGTTCGTGACCTTGAAAAGCAACGGCGAGCGCGAGTTCATGTTCTACCGGAACCCGAGCGCCGACATG
CTCCTGACGGAGGCGGAGCTCAACCTGGACCTGATCCGGCGCGCCAAGATCTTCCACTACGGCTCCATCTCCCTCATCA
CCGAGCCGTGCCGCTCCGCCCACGTCGCCGCCAtGcgcgCCGccaaGTCggccGGCAT > SEQ ID NO:2118 175912 11223_300280_1
CTCGAGCTTGCGGCCGCTCCAAACTCACCCCCACAACTTTCATTTCTATCAACCAAACCCAAATGGGTCCAAGTTCGAG
CCTCACCACCATCGTGGCGACTGTTCTTCTTGTGACATTGTTCGGTTCGGCCTACGCAAGCAACTTCTTCGACGAGTTT
GACCTCACTTGGGGTGACCACAGAGGCAAAATCTTCAACGGAGGAAATATGCTGTCTTTGTCGCTGGACCAGGTTTCCG

FIG. 2 continued

```
GGTCAGGTTTCAAATCCAAAAAAGAGTATTTGTTCGGTCGGATCGATATGCAGCTCAAACTTGTCGCCGGAAACTCGgC
CGGCACCGTCACTGCTTACTACTTGTCTTCACAAGGAGCAACACATGACGAGATAGaCTTTGAGTTTCTaggTAACGAG
aCaGGGAAGCCTTATgttCTTCACACCAaTGTCTTTGCTCAagggaaaggagacaGAGAGCaacagttttAtC
```

> SEQ ID NO:2119 175912 157354_301737_1
```
ttatctaaacCATTCTCATTCTTTACAGTTGTGAAAAATGGTTTCTTTTTCTATGGCGTTTAGTTGTGTTGTCTTTGGT
ATTTCTCTAATGATGATGGGTTTGGTTAGCTCTTCAAGATTTGAGGAGCTGTATCAGCCCAGTTGGGCTACGGATCATT
TGACAAATGAAGGAGAAATTCTCAGGATGAAATTGGACAACCTTTCTGGTGCTGGATTTTCATCAAAGAATAAGTATAT
GTTTGGGAAAGTTACTGTTCAGATTAAGCTTGTAGAAGGTGACTCTGCTGGAACTGTCACTGCTTTCTACATGTCATCA
GAGGGACCAACCCATAATGAGTTCGATTTTGAGTTTCTAGGTAACACAACTGGTGAACCATACTCCGTACAGACCAATG
TTTACGTAAATGGTGTGGGTAACAGAGAACAACGACTGAACCTTTGGTTCGACCCATCCAAGGAATTCCATTCCTATTC
CATCTTGTGGAACCAACGCCAAGTTGTATTCTTAGTAGACGACACCCCAGTTCGTGTACACTCAAATTTGGAGCACAAG
GGAATTCCATTTCCAAAGGACCAagcncatGGGTGTGTACAGTTCAATATGGAATGCAGATGATTGGGCTACACAAGGC
GGAAGGGTCAAGACTGATTGGTCACATGCACCCTTTGTTGCATCCTACAGAGgATTTGAGATTGATGGCTGTGAATGTc
cagCAACTGTTGCAGCTGCTGAGAaTTCtaaGCGGTGCagCAGCACTGCTGagaaAAg
```

> SEQ ID NO:2120 175912 202195_300781_1
```
CCCCCCCCGATCCCATTCCAGTGACCAATCCACACTGATCCCAGTAGCTCTCATTGTCCTCACGCTTCGACTCGCTTGC
TAGATCTTGGGGTTCTTGTGTGTTGTGATCGCGCAATGAGGACGGCGGCGCTTGGCATTGTGGCGATGGCCTGCCTGGT
GGCCATTGCCCATGGAGGCAACTTCTTCCAGGACGCGGAGGTGTCGTGGGGCAGGGCGCGGCAAAATCGTCGATGGT
GGCCGTGGGCTCGACCTCACGCTTGACAGGAGCTCCGGCTCTGGGTTCCAGTCCAAGAGCGAGTACCTCTTCGGCAAGA
TCGACATGCAGATCAAGCTCGTCCCCGGCAACTCCGGCGGCACCGTCACCACCTTCTACTTGTCGTCGCAGGGTTCGAC
CCACGATGAGATCGACTTCGAGTTCCTGGGGAACGTGACCGGCGAGCCGTACACGCTGCACACCAACGTGTTCACGCAG
GGCAGGGGCAGCGCGAGCACCAGTTCCGCCTCTGGTTCGACCCCACCCAGTCCTTCCACACCTACTCCATCATCTGGA
ACCCACAGCACGTCAT
```

> SEQ ID NO:2121 175912 157744_301742_1
```
GGGGTGCCCATCATTCTTGGATGCAAGGAAATGATCTTCAGCTTGTCCTTGATCAATCCGCAGGTTCAGGTGTACAATC
AAAAGGAGCATTTCTTTTTGGAAGCATAGAAATGCAAATCAAATTAGTATCTGGAAATTCTGCTGGAACAGTCACAGCA
TACTATTTGTCATCTACAGGTGACAAGCACGACGAGATCGACTTCGAGTTTTTAGGAAATGTATCAGGGCACCCATATA
TTATCCACACAAATATTTTTACTCAAGGTGCAGGAGGCAGGGAACAACAATTCTATCCATGGTTTGATCCAACTGCTGA
TTACCATAACTATACCATTCATTGGAACCCCAGTGCAGTTGTATGGTACGTTGACGGTATACCAATC
```

> SEQ ID NO:2122 175912 147145_301205_1
```
tataaaaggactccttacgcaacctaaagaattatatatcatctactcatactcttatcTTCTCTTCATCATTTCAATG
GCTTCTTattgcTTCTAATTTCCATTCTAATGGGCAGCCTAGTCGCTGCATCAGCTAATTTTAATAATCTTGCAGAGAT
CACTTGGGGCGAAGGACGTGGTAAAATAACAGAAGGAGGCAAAGGTCTTTCTCTGTCCCTTGACAAACTTTCTGGTTCA
GGTTTTCAATCCAAGAATGAGTATTTATTCGGGAAATTTGACATGCAACTCAAACTTGTACCTGGAAACTCTGCTGGCA
CTGTCACCACCTTCTTTTTATCTTCACAAGGAGAAGGACATGATGAGATCGACTTCGAGTTCTTGGGTAATACGACTGG
CGAGCCCTACACTGTCCACACCAACGTGTATTCTCAAGGAAAGGGAAACAAAGAACAACAATTCCACCTTTGGTTCGAC
CCAACTGCAGCATTTCACACCTACACCATTGTGTGGAACGCTAAACGTATAGTGTTCTTGGTAGATAACATCCCACTTA
GAGTATACAACAACCATGAAAGCAATGGCATTCCATTCCCAAAGAGCCAACCAATGAAAGTGTACTGCAGCTTATGAA
TGCAGATGATTGGGCTACACAaggaggcagagTCAAGacTGATTGGACACAtgctccTTtCactgcttactacagaaac
ttCATAT
```

> SEQ ID NO:2123 175912 1171393_302053_1
```
TCTAGCAGTAGTAGTGTGAAGGTGATCTAGCCTCTATTATTAGCTATGGCTACATATTTAGCTTCTCAATGCATTATTG
CTCTCATCTTAGTAATGGCCTCATCCTCATCCTCAATACTAAAAGTAGCTATGGCCAACTTTCATACTGACTTCTTTAT
CACATGGTCTCCTTCCAAAGTCAAGCTCCTAAATAATGGCCAAGACCTTCAACTAACCTTAGATAGTAGCTCAGGGTCA
GGGTTCGCATCTGCAAACGGTTTTATGTATGGCAACATTGATATGCAGATTAAGCTTGTGTCAGGAAACTCAGCGGGAA
CAGTCACTGCCTATTATCTATCATCAGAAGGGGTGAGCAGGGACGAGCTGGATTTCGAGTTTTTGGGAAATGCGTCAGG
TGAGCCGTACATAGTGCAGACGAATGTGTATTCTTCAGGAGTGGGCAATCGAGAGCAGCGAATATTTCTTGGGTTTGAC
CCCACTGCAGATTTCCACACTTACTCAATTTCATGGAACAAACAACGCATCATCTTCCTTGTTGATGGAACACCGATTC
GCGCTTATTCCAACAACGAAGCA
```

> SEQ ID NO:2124 175912 134951_300420_1
```
aactagtagcccatcattcattcgcatcactataactgacaaaatggcaaggcctggtagtggtaacatcccaggatca
gCATGCATTCCTCTTCTGATTCTGCTGCTGCTGCTGCTGCTACTGCATCCATCAGAAGCTCAGCCTTCTCCTGGCT
ACTACCCAAGCAAGATGTTCAGGTCGATGGCCTTCTATGAAGGGTACAGCACCCTGTGGGCCCACAGCACCAGACCCT
```

FIG. 2 continued

```
GTCCCAGGATCAGAAGTCTCTCACCCTGTGGATGGACCGTAGCTCAGGGAGCGGGTTCAAGTCGACACGGTCGTACCGG
AACGGCTACTTCGGGGCGTCGATCAGGGTGCAGCCGGGCTACACCGCCGGCGTCAACACGGCCTTCTACCTGTCGAACA
CGGAGCAGTACCCGGGGCGCCACGACGAGATCGACATGGAGCTGCTGGGGACGGTGCCGGGGGAGCCGTACACGCTGCA
GACGAACGTCTACGTGCGCGGCTCCGGCGACGGCAACATCGTCGGCCGCGAGATGCGCTTCCACCTCTGGTTCGACCCC
ACCGCCGGCTTCCACCACTACGCCATCCTCTGGAACCCCGACCAAATCTTGTTCTTGGTGGACGACGTGCCGATCAGGA
GGTACGAGAAGAAGGTGGAGGGGACGTTCCCGGAGCGGGAGATGTGGGCGTACGGATCCATCTGGGACGCCTCCGACTG
GGCCACCGAC

> SEQ ID NO:2125 175912 256024_301646_1
tTTACTTAAGTTAAGAGGGGGGGGGGAAGTGTGCTCTCAAGGATTAACACTGCAAGGCCGAAATGAAGAAGAAGAAGAC
CGCGTCGATGCTGGGTTTGGCGTTTGGGATGTTGGTGATCATGCTGGCGTCTCCAAAATTAGCAATGGCAGGTTTCTAT
GGGGACTTTGATGTAGAAACGGCTCCCGACCACGTGATAATCCAAAGCGATAGCCTCCTCCAACTCACCATGGATAAGA
ACTCTGGTAGCTCAGTTGTCTCCACCGGTAAATATCTGTTTGGCTACTTCAACATGAAGATGAAGCTCATATCAGGCAA
CTCTGCAGGGACAGTAACCACATTCTATATCTTCTCTGAGGAAGCAAACCATGATGAGATAGACTTTGAGTTCCttggc
AACTATTCaggggaTCCTTATCTTTTGCATACTAATATTTTTGCAAGTGGTGttggaAATAGAGAACAACAATTTTTTC
TGTGGTTTGACCCTACAGCTGACTTCCATGATTATACAATAATTTGGAACCCTCAACAAATattgtttctTgtTGATGG
AAGGGCTGTTAGATCTTTTCCGAATAATGAGGCTATAGGTGTCCCTTACTTAAAAAGTcaatgGATGAATGTACATTTA
AGTCTTTGGAATGGCGAGActtgggCCACActaggaggGTTGAgaAGGAta > SEQ ID NO:2126 175912 47345_300170_1
CTCATCTTCTTTTAGTTTCCAAACTCACCCCCACAACTTTCATTTCTATCAACCAAACCCAAATGGGTCCAAGTTCGAG
CCTCACCACCATCGTGGCGACTGTTCTTCTTGTGACATTGTTCGGTTCGGCCTACGCAAGCAACTTCTTCGACGAGTTT
GACCTCACTTGGGGTGACCACAGAGGCAAAATCTTCAACGGAGGAAATATGCTGTCTTTGTCGCTGGACCAGGTTTCCG
GGTCAGGTTTCAAATCCAAAAAGAGTATTTGTTCGGTCGGATCGATATGCAGCTCAAACTTGTCGCCGGAAACTCGGC
CGGCACCGTCACTGCTTACTACTTGTCTTCACAAGGAGCAACACATGACGAGATAGACTTTGAGTTTCTAGGTAACGAG
ACAGGGAAGCCTTATGTTCTTCACAC > SEQ ID NO:2127 175912 44510_300427_1
gccattacggccggggacacaaacaaacatcaaacattctaaTTACTACAAGTAAAATTTTATATAAGCTAAGGGCTAA
AATGGGGTCAAGAATTTTCTTGATTTTAGCACTTGTGTTTAGTTCTTGCATGGTTTGTTTTGGTGGAAATTTTTTTCAA
GAATTTGACTTTACTTGGGGTGGAAATAGGGCTAAGATTTTCAATGGAGGTCAGCTTATGTCTTTGTCTTTGGACAAAG
TTTCTGGTTCTGGTTTTCAATCTAAGAAAGAGTATCTCTTTGGGAGAATTGATATGCAAATCAAACTTGTTACTGGAAA
TTCTGCTGGAACTGTCACTACATACTATTTATCTTCTCAGGGACCCACGCATGATGAAATTGACTTTGAATTCTTGGGA
AATGTTACTGGTGAACCTTATATTCTCCACACAAATATTTATGCTCAAGGCAAAGGAAACAAAGAGCAGCAATTCTATC
TTTGGTTTGATCCTACCAAAAATTTTCACACCTACTCAATTATTTGGAAACCCCAACACATTATTTTCTTGGTCGACAA
CACACCGATAAGAGTTTACAAAAATGCTGAATCAATTGGTGTGCCATTTCCCAAGAATCAGCCCATGAGAATTTACTCT
AGCCTTTGGAATGCTGATGACTGGGCAACAagaGGAGGCCTAGTGAAAACTGATTGGtctAAAGcacCATTTACAGCCT
ACTATAGAAATTTCAATTCTCAAACTTTTGGCAGTTcacAGTTTTCAAATGAAAAATGGCAAAATCAAGAACTTGATGC
TAATGGTAGAAGAAGACTCAGATGGGTTCAGAGGAATTTCATGATTTATAATTATTGTACTGATTTTAAAAGATTTCCT
CAGGGTTTTCCTCCAGAATGCAAAAGATtctGAGTGATATTAGTTTGTTTtgtgaaattcttttatgtgtttgtggtt
ttattttgttagtttatagcgatcaaaataaatattgtatctttcccctttt > SEQ ID NO:2128 175912 276152_200157_1
tttgttttatacaaaaaatgatttcctcttccttaaaatattcaactgtcattgtaatattgctatatgccttgacatt
tTCATTTTCAGTGAGTGCACGACCCGCCACTTTTTTACAGGACTTTAAAGTGGCATGGGCTGACTCGCACATCAAGCAA
ATCGATGGCGGCAAGGCTATTCAGCTTATACTCGACCAAAACTCAGGATGTGGGTTTGCTTCCAAAAGTAAATACCTCT
TTGGACGTGTTAGCATGAAGATCAAGCTCGTTCCTGGTGACTCTGCTGGAACTGTCACAGCCTTTTACATGAACTCGGA
CACAGATAATGTAAGGGACGAGCTAGACTTCGAGTTCTTGGGAAACAGGTCAGGCCAGCCGTACACTGTCCAAACGAAT
GTTTATGTTCATGGAAAGGGTGACAAGGAACAAAGGATCAACCTTTGGTTCGATCCATCCGCTGATTTTCATACCTACA
CAATTCTTTGGAACCACCATCACACTGTATTCTACGTGGACCAAGTACCCATTAGAGTGTACAAAAATAACGAAGCAAA
AGGAATCCCATTCCCTAAATTCcAACCCATGGGGGTGTACTCAACATTGTGGGAAGCCGATGACTGGGCAACAaGaggt
gGattagagaAAATaaATTGGAGCAaATCTccat > SEQ ID NO:2129 175912 263806_301746_1
ccCACGCGTCCGGACAAAGCAAGCAAGTACAGTAGCCATGGCGAAGCATCTCGCGCTGTCCGTGGCCGCCGCGGTGGCC
GTGTCGTGGCTGGCGGCGTCGTCGGCGGCGGCGGCGGGGTTCTACGAGAAGTTCGACGTGGTGGGCGCCGGCGACCACG
TGAGGGTGGTGAGCGACGACGGGAAGACGCAGCAGGTGGCGCTGACGCTGGACCGGAGCTCCGGGTCCGGGTTCACCTC
CAAGGACACCTACCTGTTCGGCGAGTTCAGCGTCCAGATGAAGCTCGTCGGCGGCAACTCCGCCGGCACCGTCACCTCC
TTCTACCTCTCCTCCGGCGAGGGCGACGGCCACGACGAGATCGACATCGAGTTCATGGGCAACCTCAGCGGCAACCCCT
```

FIG. 2 continued

ACGTCATGAACACCAACGTCTGGGCTAATGGCGACGGCAAGAAGGAGCACCAGTTCTACCTCTGGTTCGACCCCACCGC
CGACTTCCACACCTACAAGATCATCTGGAATCCCCAAAACATCATATTCCAGGTGGACGATGTGCCGGTGAGGACGTTC
AAGAAGTACGACGACCTGGCGTACCCGCAGAGCAAGCCGATGAGGCTGCACGCGACGCTGTGGGACGGCAGCTACTGGG
CGACGAGGCACGGCGACGTCAAGATCGACTGGAGCGGCGCGCCGTTCGTGGTGTCGTACCGCGGGTACAGCGCCAACGC
GTGCGTCAACAACAACCCCGCCGGCGGGTGGTCGTCGTCGTCGTGCCCCGAGGGCACGTCGGCGTGGATCCACCGCGAG
CTCGACGGCGCCGAGCTCGGCACCGTCGCGTGGGCCGAGCGCAACTACATGTCCTACAACTACTGCGCCGACGGCTGGC
GCTTCCCCCAGGGCTTCCCCGCCGAGTGCTACCGCAAGTGATGATGAACAAATCCTCCATTGATGAGTTCTTGAATGAT
TTGTAATTGCTTCTTGTTCTTGttCGTCTTCGTCTTCGTCTTCTTCTTCTTCTTGATCCATGTACATtttgCCATCCAT
TCGTTCTCCATTCGTTACAGTTACAGAGAcagGTTGATGGT > SEQ ID NO:2130 175912 272272_200042_1
GTTGAAACAAAAGATGGATTTCATGAGAAAGAAGATATGTCTGTCTGTCTTCTTGTTTTTCCATGTCTGCTTTATTACA
GCTGATGCTGCCCTTAATGTCTCCACCATACCTTTTAGCGATGGCTTCAGCCATCTCTTTGGCGAAGGAAACATTCTTC
ATGCTACTGATGATAAGAGCCTTCAACTTCATCTCAACCAACGCACAGGTTCAGGGTTCAAGTCTTCTGACCTCTACAA
CCACGGTTTGTTCAGTGCTAAGATAAAATTACCATCAGATTATACTGCAGGGATCGTTGTTGCTTTCTATACGACGAAT
GGTGATTTATTTACAAAAACACATGATGAACTGGATTTTGAGTTTCTGGGAAATATAAGAGGAAAAGCATGGAGATTTC
AGACAAATATGTATGGAAATGGAAGCACAAGTAGAGGAAGAGAAGAACGATATTATCTTTGGTTTGACCCTTCTAAAGA
ATTTCATCGTTACAGTATCCTGTGGACCAGCAAAAACATCATATTTTATATAGATGATGTTCCAATTAGAGAAATTGTA
CGTAATGATGCAATGGGAGGAGACTATCCATCAAAACCAATGGGATTATATGCAACAATATGGGATGCTTCAGA > SEQ ID NO:2131 175912 274183_200148_1
tctgctgtagagacTGAGACCTCTCTCAGTTGTCTCATTTGCTTATGCATTACAACTCCATACAAATACTCCACAAACA
CAACTCAATTTTGTGTTCATAACTGATCAAAGAATACTAAACCCCTCAATAAAGGGGCAAAAATATTAAGAAAATGGTG
AACTATTATCTTGTTATTGTCATATTTTCTCCGTTGTTGAATTGGTTTATGGGTCTTCAAGAAATTTGCCAATTTTAG
CGTTTGATGAAGGCTACTCCCATCTCTTTGGTGATAATAACCTTATGATCCTTAAAGATGGAAAATCTGCTCATATTTC
TCTAGATGAAAGAACAGGGGCTGGATTTGTGTCTCAAGACCTATATCTTCATGGATTCTTCAGTGCTTCTATTAAGCTT
CCTGCTGATTACACTGCTGGTGTGGTTGTTGCATTTTATATGTCTAATGTGGACATGTTTGAGAAGAACCATGATGAAA
TTGACTTTGAGTTCTTGGGAAATATTGAGGTAAAGACTGGAGAATTCAGACCAATATTTATGGGAATGGTAGCACTAA
TGTTGGTAGAGAAGAAAGATATGGACTCCGGTTTGACCCTTCTGAAGATTTCCATCAGTACAGTATCCTTTGGACTGAG
AATTTTATCATCTTTTATGTAGATAATGTCCCCATAAGAGAGATCAAGAGGACAGAGGCTATGGGTGGGGACTTcCCAT
CTAAgccaaTGTCTTTGTATGCTACaATATGGGATGGTTCTGgttGGgCTaccaatgGTGGAAAATAcaaAGTCAAtta
caaaTATGccCcGTATAttgccaagtTCTCTGATtTcgtcctccacggaTGTGcagTtGATCCGATTGaattATCAtcc
aaaTgtgacAttgcaccaaAaACTGCATCAATCCCtgc > SEQ ID NO:2132 175977 246921_301615_1
tGGGGAAAGAATGGCGGGCGGTGGCGGCGTCGAAGAATCTCGCCCCGGCGAGGAGGTCGCGGCGCAGGCAGCGTCGATT
TTCAAGGATACGGCAGCCCCGACGATATTCGACAAGCTCATATCGAAGGAGATCCCTTCCAAGATCGTCTACGAGGACG
ATAAGGTTTTGGCGTTTAGAGACTTAAACCCCACAGGCACCGACGCATATCTTGCTCATTCCCAAGCACAGGGATGGATT
AACGCAGCTTTCCAAGGCTGAAGAGAGACACAAGCGATTTTGGGTGAACTACTCTATGTTTCGTCTGTGGTTGCCAAA
CAAGAGAAattgGACGATGGCTACAGGATTGTTATAAACGATGGCCCTCAAGGATGCCAATCTGTGTACCACCTTCATG
TCCATCTCGTTGGAGGACGCCAGATGAAATGGCCCCCTGGCTAGACCAGTAAACGTTCAATTTTACAAAGAAtgcccag
gaatggaaagtttcttTTCTCTATGAACTTGGgGCAGTGGAATCCTGTGCTGCGAAATCCGGgtacctTTTCTTCGTCA
AGCCGTGAAGccaccgAGCAAACACTCCCTCACTGGATTCCGTGGAAGCAATGTGGGGGTAGATCACCtCGGCcttgAA
CTCGGCAATCTCCTTCTCGaacAACTTGAGCGacacctCGTCGtgactTCCGcaaaccTCTGGTTgTAAGCGGTGTAC
AAGC > SEQ ID NO:2133 175977 1115046_301806_1
GCCCTGGAGAAAGGACGGGAAAGGTTGGAGGTGCTGAGCTCTCATCTGGCACTGCCAATGGCACAAGAGGAGGCCGCTG
CCAAGCTTGCTGCCCCTCTTCACTCCCAAGAAGATTCCGAATATACACCTACCATCTTTGACAAGATTCTCAAGAAAGA
AATCCCATCAAATTCAGTCTATGAGGATGAACTAGTATATGCATTCCGAGACATAGCTCCTCAGGCTCCTACCCACATA
GTGATAATTCCCAAGAACAGGGATGGATTGACACAGTTATCAAAGGCTGAAGAGAAGCATAAGGAGATACTCGGACATC
TTCTCTATTCTGCAAAGCTGATCGCTAGTCAAGAGGGGCTCTCAAATGGCTATAGGGTGGTAATAAATGATGGACCAGA
TGGATGTCAATCGGTGTATCATATCCACCTTCATCTCATCGGAGGCAGACGAATGACCTGGCCACCGGGCTAGTGAGAC
TGTGGGGTGTATCGGTTATTGTTTTTGATGCTTCCGGACTGGACAATAAAACTAGACTTTAAGCACTTAAATCAAATAT
TAGgATGCTTGAAGtggcattttgccCATACTCTGttgtcTCttatattgcttTtTagaGAGATGCTAT > SEQ ID NO:2134 175977 194859_300767_1
CCCCCCCCCGGGGGAAGTTCGATCGATCCCTCACCATGGCGTCGGAGAAGGAGGCGGCGCTCGCCGCCGTGCCCAACGA
CAACCCCACCATATTTGACAAGATCATCAAGAAGGAAATACCTTCCACTGTGGTATTTGACGATGAGAAGGTTCTGGCT

FIG. 2 continued

TTCAGAGACATAAATCCTCAAGCTCCGACCCACATTGTGATCATTCCCAAAGTGAAGGATGGATTAACTGGCCTATCAA
AGGCAGAAGAGAGGCATGTAGAAATACTCGGTTACCTCCTCTATGTTGCCAAAGTTGTTGCAAAGCAGGAGGGACTTGA
AGATGGCTACCGTATTGTCATCAATGATGGCCCCAGTGGATGCCAATCTGTTTACCACATACATGTACATCTCCTCGGA
GGCAGGCAGATGAACTGGCCGCCGGGCTAACGAGTGCCCGTCTGTTGAACTGCCTTCATGGCAAGGATGTCACACTGCC
TCTCCGTTGAATAATTCCTGTAACTGGCATAACAATTGGTGCCCTGAACTTATGCTATATGTTTGTGGATGTTACCAGG
ACAGGACATGACCATCCTGCTATGATTTATGGACAAgaTACATTGCGTTCTCACTAGTTATTactGCTTTTtTtttcaa
aaAa > SEQ ID NO:2135 176047 1044914_301919_1
GAGACTTGAGTATCGAGTGAAGAAGAAGATGGCGAGCAAAGACGTGGAATTGGTGAGTCATGGGAGTGGGAAGGATTAC
ACAGATCCTCCTCCGGCTCCGCTTTTCGACACCAGTGAATTCGCCAAGTGGTCGTTTTACAGAGCTTGCATAGCGGAAT
TCGTAGCTACTCTGCTCTTTCTCTACATCACAGTAGCTACTGTCATAGGGGATCAAAACAATGTAGCGAATTGCGGGAA
CGTAGGGGTTCTCGGCATAGCCTGGGCTTTCGGTGGAATGATCTTCATTCTCGTTTACTGCACTGCCGGAATCTCAGGT
GGGCATATCAACCCTGCTGTCACTTTTGGGTTGTTCCTCGCACGCAAGGTTTCGCTCCTTCGTGCCGTCGCCTACATCG
TGGCGCAGTGCCTTGGTGCCATTTGTGGCGCTGGTCTCGTTAAGGGGTTCCAGCAGGGTTACTATGTCCGATATGGTGG
CGGTGCTAACTCTGTGGCTGAAGGTtACAGCAAAGGTGttggccttGCTGCTGAAATtattggaaCttttgtcCttgtt
taCAcCgtcttctcTgCcCACTGACCCCaaACGAaGtgcccGTGACTCAcatgtgccgata > SEQ ID NO:2136 176047 14089_300245_1
CCCACGCGTCCGAAGAAGAAAAAAAGCAAAGAACACTTGACGTTTTCTAGATAGAGATGGAAGGGAAAGAAGAGGATGT
TCGAGTGGGAGCTAACAAGTTCCCGGAGAGGCAACCGATAGGTACATCGGCTCAGACGGACAAAGACTACAAGGAGCCA
CCACCAGCTCCATTTTTCGAGCCAGGCGAGCTGAGTTCGTGGTCCTTCTACAGAGCCGGAATCGCCGAGTTCATAGCCA
CCTTCCTGTTTCTATACATAACAGTATTGACAGTGATGGGAGTGAAGAGAGCACCAAACATGT > SEQ ID NO:2137 176047 137136_300502_1
cccccgaagctctccgctcagctaagctctgcaccattgcttgcaaagctggtcgtgtcactcctcccgttaagcttc
cCGCGGCGGCGAGAGCAAGCTAAGCTAGGTCGGGCATGGGGAAGGACGAGGTGATGGAGAGCGGCGGCGCCGCCGGCGA
GTTCGCGGCCAAGGACTACACGGACCCGCCGCCGGCGCCGCTGATCGACGCGGCGGAGCTGGGGTCGTGGTCGCTGTAC
CGCGCCGTCATCGCCGAGTTCATCGCCACGCTGCTGTTCCTGTACATCACCGTGGCCACGGTGATCGGGTACAAGCACC
AGACGGACGCGTCGGCCTCCGGCGCCGACGCGGCGTGCGGCGGCGTGGGCGTGCTCGGCATCGCGTGGGCGTTCGGCGG
CATGATCTTCATCCTCGTCTACTGCACCGCCGGCGTGTCCGGCGGGCACATCAACCCGGCGGTGACGTTCGGGCTCTTC
CTGGCGCGCAAGGTGTCGCTGGTGCGCGCGGTGCTCTACATCGTAGCGCAGAGCCTCGGCGCCATCTGCGGCGTCGGGC
TCGTCAAGGGGTTCCAGAGCGCCTTCTACGTGCGCTATGGCGGCGGCGCCAACGAGCTCAGCGACGGCTACTCCAAGGG
CACCGGCCTCGCCGCCGAGATCATCGGCACCTTCGTGCTCGTCTACACCGTCTTCTcCGCCACCGACCCCAAGCGCAAC
GCCCGCGACTCCCACGTCCCCGTGCTTGCTCCTCTTccAATTGGGTTCgcGgtgTTCATGGttcacTtggccacgaTCC
CGATCACCggcacCgGCATCAAc > SEQ ID NO:2138 176047 130075_300484_1
gaattcaagaaacagaagaaatggaaggcaaaggagaagatgtgaggttgggagctaacaagtactcagagagacaacc
aATCGGAACAGCAGCTCAGATGACTGAGGACAAAGATTACAGAGAGCCACCACCAGCTCCTTTCTTTGAACCAGGAGAA
TTAGGTTCATGGTCTTTCTACAGGGCTGGTATTGCTGAATTCATAGCTACTTTTCTGTTCCTATACATCTCCGTCTTGA
CTGTTATGGGTGTTGCTGGTGCCAAAAACAAGTGCCAGTCAGTTGGTATTCAAGGTATCGCTTGGGCTTTTGGTGGTAT
GATCTTTGCCCTTGTCTACTGTACCGCCGGTATCTCAGGAGGACATATCAACCCCGCAGTTACATTCGGTTTGTTGTTG
GCAAGAAAATTGTCAGTGACAAGAGCAGTGTTCTACATGATCATGCAATGTCTTGGTGCCATCTGCGGTGCCGGTGTTG
TCAAAGGTTTCCAACCAAGTAAATACCAGATGCTGAACGGTGGTGCCAACTTTGTAGCTCCTGGTTACACCAAGGGAGA
TGGTCTTGGTGCTGAAATTGtTGGTACTTTTgttCTTgttTACACcgttTTCTCCGCTACTGATGCCAAACGTAACGCC
AgAGACTCCCAt > SEQ ID NO:2139 176047 128867_300478_1
cTCATCTTCTTCAGAAAATCAGAAGAAAGGAAAAATGTCAAAGGACGTGATAGAAGAAGGACAAGTTCATCAACAACAT
GGGAAAGATTACGTGGACCCACCACCAGCTCCTTTGCTTGATTTGCAGAACTCAAGCTCTGGTCTTTTACAGAGCTC
TTATTGCTGAGTTCATTGCTACTCTTCTTTTCCTTTACGTTACTGTCGCCACTGTAATTGGTCACAAGAAGTTGAATGG
TGCTGATCAATGTGATGGGGTTGGTATTCTTGGTATTTCTGGGCTTTTGGTGGCATGATATTTGTTCTTGTTTACTGC
ACTGCCGGTATCTCTGGTGGACACATTAACCCAGCAGTGACATTTGGGTTATTCTTAGCAAGAAAAGTGTCATTATTAA
GGGCAGTGGGATATATTATTGCACAATCTTTAGGTGCAATTTGTGGTGTTGGTTTGGTGAAAGGTTTCATGAAACATTA
CTACAACACGTTAGGTGGTGGTGCTAATTTTGTGCAACCTGGTTATAACAAGGGCACAGCTTTGGGTGCTGAGATTATT
GGAACTTTTGTTCTTGTTTACACTGTTTTCTCTGCTACTGACCCTAAAAgaagtgccC

FIG. 2 continued

> SEQ ID NO:2140 176047 124725_300437_1
agtcctctcttttctcccataaatacctatccatttttcactgacttctcatcatccatatcccctgtttaaAAGCTTC
TTTCCTTTTGGTTAGCCATGACTAAAGAAGTTGAGGTCGCAACAGAGCAACCAACAGAGTTTTCAGCAAAAGACTATAC
TGACCCTCCACCAGCTCCTTTAGTAGACTTCGAGGAGCTGACACAATGGTCACTTTACAGAGCTGTTATAGCTGAGTTT
ATTGCCACTTTGCTTTTCCTTTATGTTACTGTTTTGACTGTGATTGGGTATAAGGTACAGTCAGATGTCAAAGCCGACG
GTGATATCTGTGGCGGCGTTGGTATTCTTGGTATTGCTTGGGCTTTTGGTGGCATGATTTTCATTCTTGTTTACTGCAC
CGCCGGTATCTCCGGAGGACACATAAACCCAGCAGTGACATTTGGGCTGTTTTTGGCAAGGAAAGTATCATTGATCAGA
GCAGTATTGTACATGGTGGCACAGTGTTTGGGTGCAATATGTGGTGTGGGTTTTGTGAAGGCATTCCAGAGTGCTTATT
ATGTTAGGTATGGTGGAGGTGCTAATGTCATGGCTCCTGGCCATACCAAAGGTGTTGGATTAGCTGCTGAAATTATTGG
TACTTTTGTTTTGGTTTACACTGTCTTCTCTGCTACTGACCCTAagagaAATGCTAGAGACTCCCATGTCCCtgtgttG
gcACCACttccaattGGAtttGc > SEQ ID NO:2141 176047 121970_300014_1
ACAGTCTCCACTCACACGCATTGCAGAGGAGAGGCGACAATGGAGGGGAAGGAGGAGGACGTGCGGCTGGGGGCGAACA
GGTACTCGGAGAGGCAGCCGATAGGGACGGCGGCGCAGGGCGCCGGGGACGACAAGGACTACAAGGAGCCGCCGCCGGC
GCCGCTGTTCGAGCCAGGGGAGCTCAAGTCGTGGTCTTTCTACCGGGCCGGGATCGCCGAGTTCGTCGCCACCTTCCTC
TTCCTCTACATCACCATCCTCACCGTCATGGGGGTCTCCAAGTCCTCCTCCAAGTGCGCCACCGTCGGCATCCAGGGCA
TCGCCTGGTCCTTCGGAGGCATGATCTTCGCGCTCGTCTACTGCACCGCCGGCATCTCCGGAGGACACATCAACCCAGC
AGTTACTTTTGGGCTGTTCTTGGCCAGGAAGCTGTCCCTGACCCGGGCCATCTTCTACATAGTGATGCAATGCCTAGGG
GCCATCTGCGGAGCTGGAGTTGTGAAGGGCTTCCAGCAGGGTCTGTACATGGGCAATGGCGGTGGTGCCAATGTagttg
CCagTGGCTACACCAAGGGTGACGGTCTTGGTGCTGagatTGTtGGCACCTTCATCCTGGTCTAc > SEQ ID NO:2142 176047 120275_300383_1
cccacgcgtccgagcacacACAAAAAAAAAAAAACAGCAAACCAAAAACTCAAAACTCTTCTCCTTCACTGCCAACTTCT
AAACAGAAGTACTTTTACTTTCATCAAAAAAAACATGTCAAAGGACGTAATTGAAGAAGGACAAACTCATCAACATGGA
AAAGACTATGTTGACCCTCCACCAGCTCCTCTTCTTGACATGGCTGAGCTTACCAAATGGTCCTTTTACAGAGCTGTTA
TTGCTGAGTTTATTGCTACTCTTCTCTTCCTTTACGTCACCGTCGCCACTGTCATTGGCCACAAGAAGTTGAACGCTGC
TGACCATTGTGATGGTGTTGGCATTCTTGGTATTGCATGGGCTTTTGGTGGCATGATTTTCGTTCTTGTTTACTGCACT
GCTGGTATTTCTGGTGGTCATATTAACCCAGCGGTGACATTTGGGTTGTTCTTGGCAAGGAAAGTGTCATTAATAAGAG
CTGTTGCATACATAATAGCACAGTCACTTGGTGCTATTTGTGGTGTTGGTTTTGTTAAAGCTTTTATGAAACATTACTA
CAACTTAGAAGGTGGAGGTGCTAACTTTGTACAACCTGGTTACAACAAGGGTACAGCTTTAggTGCTGAGATTATTGGA
ACCTTTgttCTTGttTaCACTGttTTCTCTGCTACTGACCCt > SEQ ID NO:2143 176047 120083_300083_1
cccacgcgtcCGAAACAAGAAAAATCCTTCTAGTGTGTGTCTGTGTGTGTGAAAAAAATGGCAGAAAACAAAGAAGAAG
ATGTGAATCTTGGAGCAAACAAATACAGAGAAACACAACCCTTAGGAACAGCAGCACAAACAGAAAATAAAGATTATGT
TGAACCACCAGCAGCACCATTATTTGAACCTGGTGAATTATCATCTTGGTCATTTTACAGAGCTGGGATTGCTGAATTT
ATGGCCACTTTCTTGTTTTTGTATATTACAATCTTGACTGTAATGGGACTTAAGAGATCAGATAGTTTGTGTTCTTCTG
TTGGTATTCAAGGTGTTGCTTGGGCTTTTGGTGGTATGATCTTTGCTCTTGTTTACTGCACTGCTGGTATCTCAGGAGG
CCACATTAATCCAGCTGTGACATTTGGTCTGTTCTTAGCAAGGAAACTTTCCTTAACCAGAGCAGTTTTCTACATGGTA
ATGCAATGCCTTGGTGCTATATGTGGTGCTGGTGTTGTTAAAGGTTTTATGAAAGGTCCATACCAAAGACTTGGTGGTG
GTGCTAATGTGGTTAACCCTGGCTATACTAAAGGTGATGGACTTGGTGCTGAAATTATTGGTACTTTTGTTCTTGTTTA
CACTGTTTTCTCTGCTACTGATGCCAAGAGAAATGCCAGAGATTCACATGTTCCTATTTTGGCACCTCTTCCTATTGGA
TTTGCTGTGTTCTTGGTTCATTTGGCCACAATCCCAATTACCGGAACTGGCATCAACCCTGCCAGGAGTCTTGGAGCTG
CTATTATCTTCAACAAAAACAGGCATGGGATGACCATTGGATCTTTTGGGTTGGACCATTCATTGGAGCTGCTCTTGC
TGCAGTTTATCACCAAATTATTATCAGAGCCATTcCATTCAag > SEQ ID NO:2144 176047 120028_300083_1
ATTTACAGAGAGAGAAAACTTAGTTGAGTGACTGAAGAAACAAAAAATGGCAGAGAACAAGGAAGAAGATGTTAAGCTA
GGAGCAAACAAGTACAGAGAAACTCAACCCTTGGGCACAGCAGCTCAAACAGACAAGGACTATAAGGAGCCACCACCAG
CTCCTTTGTTTGAGCCAGGGGAGTTGTCGTCATGGTCTTTTTACAGAGCTGGAATTGCAGAATTCATGGCTACTTTCTT
GTTCTTGTACATCACTATCTTGACTGTTATGGGTCTCAAAAGGTCAGATAGTTTGTGTTCTTCTGTTGGTATTCAAGGA
GTTGCTTGGGCTTTTGGTGGTATGATCTTTGCTCTTGTCTACTGCACTGCTGGTATCTCAGGAGGACACATTAACCCAG
CAGTGACATTTGGTCTGTTCTTGGCAAGAAAGTTGTCTTTAACAAGGGCTCTGTTCTACATGGTGATGCAGTGCCTTGG
TGCAATCTGTGGTGCTGGTGTTGTTAAAGGTTTTATGGTGGGTCCATATCAGAGACTTGGTGGTGGGCCAACGTGGTT
CAACCTGGCTACACCAAAGGTGATGGACTTGGTGCTGAGATTATTGGCACCTTTGTCCTTGTCTACACTGTTTTCTCTG
CCACTGATGCCAAGAGAAATGCTAGAGATTCTCATGTTCCTATTTTGGCACCTCTTCCTATTGGATTCGCGGTGTTCTT
GGTTCATTTGGCCACCATCCCAATCACTGGAACCGGCATCAACCCCGCCCGGAGCCTTGGAGCTgcTATCATCTTCAAC
CACGACCAGGCATGGGATGATC

FIG. 2 continued

> SEQ ID NO:2145 176047 1113035_301794_1
aaggttccaagttcgaggctctctatgacctctcccatctgtcggaaagtTTCTTGTCCTAGAGAGACCCTCCTCCTCT
CTCCCTCTTAGGTCGCCTACCCCTCAGAGCCATCATGGCCAGCAAGGATATGGACACGCCGGAGCCGCGGACTGGGAAG
GACTACACGGAGCCCCCCCCTGTCGCCCTCTTTGACGCTGCTGAGTTCAGTCTCTGGTCCTTCTACCGTGCCTGCATCG
CTGAGTTCATTGCGACTCTGCTCTTCCTCTACATCACTATTGCCGCTGTCATCGGTAACAACCACAATATCACTGGCTG
CAACAACATCGGTGTGCTTGGCATCGCCTGGGCCTTCGGTGGAATGATCTTCATCCTTGTCTACTGCACTGCTGGAATC
TCAGGAGGGCACATAAACCCAGCAGTGACCTTCGGGCTGTTTCTTGGACGGAAAGTGTCACTGCCCCGGGCTATCTGCT
ACATGGTAGCGCAGTGCCTTGGGGCCATCTGTGGTGGCCTGGCCAAGGGTTTCCAGACTTCATACTATGTGCGATA
TGGAGGAGGTGCCAACATGGTTGCCCCTGGCTACACCAAGGGGGTTGGTCTTGCCGCTGAGATCATTGGCACCtTTGTT
CTTGTCTATACCGTCTTCTCTGCCACAGACCCTAAGAGGAACGCCAGAGATTCTCATGTCCCTGTGCTGGCTCCACTGC
CaatAG > SEQ ID NO:2146 176047 194294_300745_1
cccccgacaAGCTCTCCGCTCAGCTAAGCTCTCCACCATTGCTTGCAAAGCTGGTCGTGTCACTCCTCCCGTTAAGCT
TCCCGCGGCGGCGAGAGCAAGCTAAGCTAGGTCGGGCATGGGGAAGGACGAGGTGATGGAGAGCGGCGGCGCCGCCGGC
GAGTTCGCGGCCAAGGACTACACGACCCGCCGCCGGCGCCGCTGATCGACGCGGCGGAGCTGGGGTCGTGGTCGCTGT
ACCGCGCCGTCATCGCCGAGTTCATCGCCACGCTGCTGTTCCTGTACATCACCGTGGCCACGGTGATCGGGTACAAGCA
CCAGACGGACGCGTCGGCCTCCGGCGCCGACGCGGCGTGCGGCGGCGTGGGCGTGCTCGGCATCGCGTGGGCGTTCGGC
GGCATGATCTTCATCCTGGTCTACTGCACCGCCGGCATCTCCGGCGGGCACATCAACCCGGCGGTGACGTTCGGGCTCT
TCCTGGCGCGCAAGGTGTCCCTGGTCCGCGCCATCCTCTACATCGTGGCGCAGTGCCTCGGCGCCATCTGCGGCGTCGG
CCTCGTCAAGGCgTTCCAGAGCGCCTACTTCAACAGGTACGgcggcggcGCCAACACCCTCGCCGCCGGCTACTCCAAG
GGCACCGGCCTCGCCGCCGagaTCATCGGCACCTTCGTGCTCGTCTAcaccgTCTTCTCCg > SEQ ID NO:2147 176047 191432_300785_1
AGAGAAGAGAGAGGTAGAGAAGAGAGAGCAGAGCTAAGCTAGCTCAGAGTGAGTAGCGTGTTGAGCTTGCTGAAGGGAG
CGGCAATGTCGAAGGAGGTGAGCGAGGAGCCGGAGCACGTGCGGCCCAAGGACTACACCGACCCGCCGCCGGCGCCGCT
GTTCGACGTCGGCGAGCTCCGGCTGTGGTCCTTCTACCGGGCGCTCATTGCGGAGTTCATCGCCACGCTCCTGTTCCTA
TACATCACCGTCGCCACCGTCATTGGGTACAAGGTGCAGTCGTCCGCCGACCAGTGCGGCGGCGTCGGCACCCTCGGCA
TCGCCTGGGCCTTCGGTGGCATGATCTTCATCCTCGTCTACTGCACCGCCGGCATCTCCGGAGGGCACATTAACCCCGC
GGTGACGTTCGGGCTGCTGCTGGCGAGGAAGGTGTCGGTGATTCGCGCGGTGATGTACATCGTGGCGCAGTGCCTGGGC
GGCATCGTGGGCGTGGGCATCGTGAAGGGCATCATGAAGCACCAGTACAACGCCAACGGTggggcgccAACatgGtgg
ccaggggggtACTCCAccggcaccGCCCTCgcgccgaaatcatCGGc > SEQ ID NO:2148 176047 186961_300672_1
aaagtagagagatggaggggaaggaggaggatgtccggctgggagccaacaagttctcggagaggcagccgatcggcac
GGCGGCGCAGGGCTCCGACGACAAGGACTACAAGGAGCCGCCGCCGGCGCCGCTGTTCGAGCCAGGGGAGCTCAAGTCG
TGGTCCTTCTACCGCGCAGGGATCGCCGAGTTCATGGCCACCTTCCTCTTCCTCTACATCACCGTCCTCACCGTCATGG
GGGTCAACAACTCCACCTCCAAGTGCGCCACCGTCGGCATCCAGGGCATCGCCTGGTCCTTCGGCGGCATGATCTTCGC
CCTCGTCTACTGCACCGCCGGCATCTCCGGCGGCCACATCAACCCGGCCGTCACCTTCGGCCTCTTCCTCGCCAGGAAG
CTGTCCCTCACCAGGGCCCTCTTCTACATGGTCGATGCAGTGCCTCGGCGCCATCTGTGGCGCCGGCGTCGTCAAGGGCT
TCCAGAAGGGCCTGTACGAGACCACCGGCGGCGGCGCCAACGTCGTCGCGCCCGGCTACACCAAGGGCGACGGCCTCGG
CGCCGAGATCGTCGGCACCTTCATCCTCGTCTACACCGTCTTCTCCGCCACCGACGCCAgaggaACGCCAggGACTCC
CACGTTCCGATCCTTGCCCCACTGCCAATCGGGTtTgcggtgttcTtggttcaCCTggCCACCATccCCAtcaCCggCA
CCggcatcaacccagcgaggagcCTTGgCGCtgccatcatctacaacagggGCcATg > SEQ ID NO:2149 176047 186887_300667_1
agctcactcacacaGTCTCCACTCACACGCATTGCAGAGGAGAGGCGACAATGGAGGGGAAGGAGGAGGACGTGCGGCT
GGGGGCGAACAGGTACTCGGAGAGGCAGCCGATAGGGACGGCGGCGCAGGGCGCCGGGGACGACAAGGACTACAAGGAG
CCGCCGCCGGCGCCGCTGTTCGAGCCAGGGGAGCTCAAGTCGTGGTCTTTCTACCGGGCCGGGATCGCCGAGTTCGTCG
CCACCTTCCTCTTCCTCTACATCACCATCCTCACCGTCATGGGGGTCTCCAAGTCCTCCTCCAAGTGCGCCACCGTCGG
CATCCAGGGCATCGCCTGGTCCTTCGGAGGCATGATCTTCGCGCTCGTCTACTGCACCGCCGGCATCTCCGGAGGACAC
ATCAACCCAGCAGTTACTTTTGGGCTGTTCTTGGCCAGGAAGCTGTCCCTGACCCGGGCCATCTTCTACATAGTGATGC
AATGCCTAGGGGCCATCTGCGGAGCTGGAGTTGTGAAGGGCTTCCAGCAGGGTCTGTACATGGGCAATGGCGGTGGTGC
CAATGTAgTTGCCAGTGGCTACACCAAGGGTGACGGTCTTGGTGCtg

FIG. 2 continued

> SEQ ID NO:2150 176047 180840_300625_1
gaattcgaaaccaaagaaaattttcatttcttgacagaaatggtgttgaaatggagggcaaataagaggatgttaagtt
gGGAGCAAACAAGTTCTCAGAGAGACAACCAATAGGAACTTCAGCACAGAACACAGATAAAGATTACAAGGAACCACCA
CCAGCTCCATTTTTTGAGCCTGGTGAACTAAAATCATGGTCATTCTGGAGAGCAGGAATTGCAGAGTTCATGGCTACTT
TCTTGTTTCTTTACATCACTGTTTTGACTGTCATGGGTGTTGCTGGTAACAAGAATAAGTGTGCAACTGTTGGTATCCA
AGGTATTGCTTGGGCTTTTGGTGGTATGATCTTTGCTCTTGTCTACTGTACTGCTGGTATCTCTGGTGGTCACATCAAC
CCTGCTGttACCTTTGGACTTCTATTGgcAAGGAaATTGTCTCTAACAAgagCTGTTTTCTACatGATAATGCAatgTC
TTGgagcAATc > SEQ ID NO:2151 176047 175974_300523_1
CCACCCAGCCAGCTCGAGCGAGCGAAGCCAGCAGCAGAAGCAGTAGAGAGAAAGTAGAGAGATGGAGGGGAAGGAGGAG
GATGTCCGGCTGGGAGCCAACAAGTTCTCGGAGAGGCAGCCGATCGGCACGGCGGCGCAGGGCTCCGACGACAAGGACT
ACAAGGAGCCGCCGCCGGCGCCGCTGTTCGAGCCAGGGGAGCTCAAGTCGTGGTCCTTCTACCGCGCAGGGATCGCCGA
GTTCATGGCCACCTTCCTCTTCCTTTACATCACCGTCCTCACCGTCATGGGGGTCAACAACTCCACCTCCAAGTGCGCC
ACCGTCGGCATCCAGGGCATCGCCTGGTCCTTCGGCGGCATGATCTTCGCCCTCGTCTACTGCACCGCCGGCATCTCCG
GCGGCCACATCAACCCGGCCGTCACCTTCGGCCTCTTCCTCGCCAGGAAGCTGTCCCTCACCAGGGCCCTCTTCTACAT
GGTGATGCAGTGCCTCGGCGCCATCTGTGGCGCCGGCGTCGTCAAGGGCTTCCAGAAGGGCCTGTACGAGACCACCGGC
GGCGGCGCCAACGTCGTCGCGCCCGGCTACACCAAGGGCGACGGCCTCGGCGCCGAGATCGTCGGCACCTTCATCCTCG
TCTACACCGtCttctCCGCCACCGACGCCaagaggaACgcCAGGGACTCCCACGTTCCGATCCTTGCCCCACTgccAAT
CGGgtttgcggtgttcTTggttcACCTggccACCATccCCAtcaCcggcaCCGgcAtcaa > SEQ ID NO:2152 176047 167390_300546_1
GAATTCAGAGCTCAGAAACACAAACACAGGGGAGAGATTTGAAAAATTAGGGTTTGGTTACTGAGAGATGACGAAAGAT
GTGGCTCACCACGAGGAAGGAGTTCATCATAGCGGAAGAGACTATGTAGATCCACCACCAGCTCCATTGTTTGACATGG
GTGAACTTAAACTCTGGTCATTTTACAGAGCTTTGATTGCTGAGTTCATTGCAACTCTTCTCTTCCTTTACGTTACTGT
TGCTACAGTTATTGGTCACAAGAAACAAACTGTTGAGTGTGCTGGTGTTGGTCTTTTGGGTATTGCTTGGGCTTTTGGT
GGTATGATCTTTGTTCTTGTTTACTGCACCGCCGGTATCTCAGGAGGACATATCAATCCAGCAGTGACATTTGGTTTGT
TCTTGGCTCGTAAAGTCTCATTGTTGAGAGCTGTTTTCTACATGATAGCTCAATGTTTGGGAGCTATTTGTGGAGTTGG
GCTTGTAAAAGCATTCATGAAGCATGACTACGTTGCTCAAGGAGGTGGTGCTAACTCAATTGCACCAGGTTACTCTAAA
GGTGCAGCTCTTGGTGCTGAGATTATTGGAACTTTTGTTCTTGTCTACACAGTCTTCTCAGCTACCGACCCT > SEQ ID NO:2153 176047 159061_200139_1
cgACCAAACTTGGTTTTTGCACTATCCACTTAGCACAAAAAAAGAGAAAAACAAGCTAAGTTTAGTGAGTGTTCAAAT
GGCAGAAAACAAAGAAGAAGATGTTAAGCTTGGAGCTAACAAATTCAGAGAAACACAGCCATTAGGAACAGCTGCTCAA
ACAGACAAAGATTACAAAGAACCACCACCAGCTCCATTGTTTGAACCAGGGGAGTTATCATCATGGTCTTTTTACAGAG
CTGGAATTGCAGAATTTATGGCTACTTTCTTGTTTTTGTACACTACTTGACTGTTATGGGTGTCGAAAAGATCTGA
TAGTCTGTGTAGTTCAGTTGGTATTCAAGGTGTTGCTGGGCTTTTGGTGGTATGATCTTTGCTTTGGTTTACTGCACT
GCTGGTATCTCAGGAGGACACATCAACCCAGCTGTGACCTTTGGATTGTTCTTGGCAAGGAAACTGTCCTTAACCAGGG
CTATTTTCTACATGGTGATGCAATGCCTTGGTGCAATTTGTGGTGCTGGTGTTGTGAAGGGATTCATGGTTGGTCCATA
CCAGAGACTTGGTGGTGGTGCTAATGTTGTTAACCCTGGTTACACCAAAGGTGATGGCCTTGGTGCTGAAATTATTGGC
ACTTTTGTCCTTGTTTACACTGTTTTCTCTGCTACTGATGCTAAGAGAAATGCCAGAGACTCACATGTTCCTATTTTGG
CACCACTTCCCATCGGATTCGCCGGTGTTCTTGGTTCATTTGGCCACCATTCCCATCACCGGAACTGGCATCAACCCCGC
TAGGAGTCTTGGAGCTGCGATCATCCACAACAACGACCATGCATGGGACGACCACTGGATCTTTTGGGTTGGACCATTC
ATTGGAGCTGCACTTGCTGCAGTTTaccacCAAATaAT > SEQ ID NO:2154 176047 146379_301065_1
tctctctctctcatagtattagtcaagaaaatagtaatctaaatttagaatagtgagaaaatggcaaagaacgttggta
gTGAAGGGTCGTTCACGACGAAAGACTACCAAGATCCGCCGCCAGCACCGCTGATTGACCCAGAAGAGCTAACCCAATG
GTCTTTTTACAGAGCACTCATTGCTGAATTCATAGCCACTCTTCTCTTCCTTTACATAACGGTTCTGACCGTCATTGGT
TACAAGAGCCAAAGTGCTACGGCAACGGATCCTTGTGCTGGTGTTGGGATCCTTGGTATTGCTTGGGCATTTGGTGGCA
TGATTTTCGTTCTTGTCTACTGCACCGCTGGTATTTCTGGTGGTCATATAAATCCAGCAGTCACATTTGGACTATTCCT
GGCGAGGAAAGTATCGCTAATAAGGGCAGTTATGTATATGGTGGCTCAGTGTTTGGGAGCAATTTGTGGGGTTGGATTA
GTTAAGGCTTTACAATCAGCTTACTACCACCGCTATGACGGCGGAGCCAATATGCTCTCCGACGGATACAGTCACGGCG
TCGGGTTGTCGGCGGAGATCATCGGAACTTTTgttcTtgttTACACTgttTTCTCTgccACTGATCCTaagaggaaTGC
tAGagaTTCTCATGTccCCGTgttggCACCACTCCCCATTGg

FIG. 2 continued

> SEQ ID NO:2155 176047 105207_300372_1
AAAAGCTGCATTCTGTTGCATTCTCTTGAAGAAAGCTAGaAgCTAAGAATGGAGGGGAAAGAAGAGGATGTGAAGGTAG
GAGCAAACAAGTATTCAGAAAAGCAGCCATTAGGGACCTCAGCACAGAGCAAGGACTATAAGGAACCACCACCAGCACC
ATTGTTTGAGCATGGTGAGCTCCATTCTTGGTCCTTTTGGAGAGCTGGGATTGCTGAATTCATGGCTACTTTCTTGTTC
CTTTACATCACTGTCTTGACTGTCATGGGTTACTCTAGGGCTAACAGCAAATGTAGTACTGTTGGTGTTCAAGGTATTG
CTTGGGCTTTTGGTGGTATGATTTTTGCCCTTGTTTACTGCACTGCTGGAATCTCAGGTGGACACATTAACCCTGCTGT
GACATTTGGTCTCTTTCTGGCAAGGAAATTGTCCCTAACCAGGGCAGTTTTCTACATTGTGATGCAATGCCTTGGTGCA
ATCTGTGGTGCTGGTGTTGTCAAAGGGTTCCAACCATCTTTGTATCAGGTTAAggGTGGAGGTGCCAATATTgtgAATC
ATGgttACACCaaaggagATGGCCTtggtgCTGagattgttGGCACTTTTgttCTTgtcTATACAGTCtt > SEQ ID NO:2156 176047 104612_300369_1
cccacgcgtccgAAAAAACAGAGCATCCTCTGTTTCTTTCTACAGAGTATTTTACTTTTTTCTTTTCTAAGTTATGACT
AAAGAAGTAGAGGCAGTATCTGAGCAGCCTGCGGAGTATTCCGCTAAGGATTACACTGATCCGCCACCAACTCCTCTTG
TTGATTTTGAGGAGTTAACTAAATGGTCACTTTACAGAGCTTGTATTGCTGAGTTTATTGCTACTTTGTTGTTTCTTTA
TGTAACTGTTTTGACTGTAATTGGGTACAAGCATCAGTCGGATACTAAAGATGGAGGCGATATATGTGGCGGCGTTGGT
ATTCTTGGTATTGCTTGGGCTTTTGGTGGCATGATCTTTGTTCTTGTTTACTGCACTGCCGGTATATCTGGTGGACACA
TCAACCCTGCTGTGACATTTGGGCTATTTTGGCAAGGAAAGTATCATTGATGAGGGCATTATTGTACATGGTATCACA
GTGCTTGGGTGCAATATGTGGTGTGGGTTTTGTGAAGGCTTTCCAGAAAGCTTACTACCATAGATATGGTGGTGGTGTT
AATGTTATGGCAGGAGGCCACAACAAAGGTGTTGGTTTGGGTGCTGAGATTATTGGTACCTTTGTTTTGGTCTACACTG
TCTTCTCTGCTACTGACCCTAAGAGGAGTGCTAGAGACTCCCATGTCCCTGtattggaccaCTTCCAatcggATTcgct
gtcttcatGgt > SEQ ID NO:2157 176047 1170842_302040_1
CGTCGGGTTCGAACCCTCCTATCTGTCAATCTCTCTCTCCCCTTATACACTACAAGAAGGCCATGGAGTCGAAGGAGGA
GGATGTGAGACTAGGTGCGAACAAGTACCCAGAGAGGCAGCCACTGGGCACGGCAGCGCAGACACGGAACTACAGTGAG
CCCAGCCCGGCCCCCCTCATTGAGCCCTCGGAGTTCTCCTCCTGGTCCTTCTGGAGAGCCGGCATCGCCGAGTTCATCG
CCACCCTCCTCTTCCTCTACATCTCCATCCAGACCGTTATGGGATGGAAGCGCTCAGTCGAGGCCGAGACCGCCAAATT
CCCCAACGACCAGAACATCTGTCCTCAGGGTGTCGGCGATCCAGGCATTGCCTGGGCCTTTGGCGGCATGATCTTTGCC
CTCGTCTACTGCACCGCCGGCATTTCAGGTGGGCACATAAACCCGGCAGTGACATTTGGACTATTCCTGGCTCGGAAGC
TGTCTCTACCGCGGGCGTTGCTATACATAATAGCACAGTGCCCTGGGAGCCATCTGCGGGCGGGCATCGTGAAGGGGT
TCCAGGAGGCAGACTACCAGCGCTTTGGAGGTGGTGCTAACTCAGTGGCCCATGGCTACACCAAAGGGGATGGCTTGGG
GGCTGAGATCATTGGCACTTTTGTCCTCGTCTACACCGTCTTCTCTG > SEQ ID NO:2158 176047 1100769_301463_1
TTCTTCATCTTCTTCTTCTTCCTCCTTGGTCCATATATACACACCAAGCTAGGTGTGGTTGGCTTGGTTGTCTGAG
TTGTGTGTTGGGTGGGTTGGTACCATAGTGTGTGTTGGTTGGTTAGTTGTGGTGTTGGCAGGAGGGGGATTATTATGGA
GTCCAAGGATGAGGATGTTAGACTCGGGGCCAACAAGTACCCCGAGCGGCAGCCCATTGGTACCGCTGCCCAGACCCGC
GATTACACCGAGCCCCGCGCTGCCCCTTTCGTTGAGTTCTCGGAATTCTCCTCCTGGTCCTTCTGGAGAGCTGGTATCG
CTGAGTTCGTCGCCACCCTCCTCTTCCTCTACATCTCCGTCCAAACCGTCATGGGATGAAACGCTCCGTTGCGGCCTC
CAACCTGAAATTCCCCGGTGATGTCAACATTTGCCCGCAAGGTGTTGGGGTCCAAGGCATCGCTTGGGCCTTTGGTGGC
ATGATCTTCGCCCTCGTCTATTGTACCGCTGGTATATCAGGTGGACATATTAACCCAGCGGTCACCTTCGGGCTCTTCC
T > SEQ ID NO:2159 176047 233693_301092_1
agtggggccaacctctacgttaaaagatggagcttctctttaactttgcttaggcagcttatccagcagcagcatcttc
cTTTTCTCTCTCTCTTTCCCTTCTCTCTCTCTCATCCCTTTCCAGACACTTCTCGGGGTTTAATCAGGGCACGCGAGAG
ATATCGAGAGGTAGAGAGTTAAGTTCTTCCTGTGTTCCAAAGCTTGGAAGCTAGACTAGATCGATCATCCGATGGAAGG
CAACAGGGAGGATGTTCATGTTGGTGTGGCAAAGTATCACGAGCGAGAGCTGGGAACCGCGGCACAGGCCGAGAAGGAC
TACGTTGAGCCGGCCCCGACCCGACTGATCGAGCCGTCCGAGTTCTCGTCCTGGTCCTTCTGGCGAGCCGGAATAGCGG
AGTTCTTCGCAACCTTCCTCTTCCTCTACATCACCATTCTCACGGTTGTGGGGAACGTTAACCGTACTAGCTGCAACGG
GGTGGGGATCCAAGGCATAGCCTGGGCCTTTGGAGGCATGATCTTTGCTCTCGTCTACTGCACCGCTGGAATCTCTGGT
GGACACATCAATCCTGCGGTGACTTTCGGCCTCTTCTTGGCTCGAAAGGTGTCTCTGCCTCGAACCATTCTCTACATGG
TTGCACAGTGCCTGGGGGCGATTTGCGGTGCCGGCGTCGTCAAAGGCTTCCAGAGGGCATGTTCAACGCTGCTGGAGG
AGGAGCGAACTTCGTCCAGCATGGTTACACACTTGGAGATGGTCTAGGAGCTGAGATTGTTGGAACTTTTGTTCTCGTC
TACACCGTCTTCTCGGCTACTGATGCTAAGAGAAttgccaGAG > SEQ ID NO:2160 176047 238238_301293_1
GTAGTTTTCCTTTTGGAACTCATCCAATTCACGAGGGAGAGGTAGAACTGATCAAGAGAAAGAGATGGCGAAGGATGCA
GGAAAAGAGTCCGAAGCCTTCGTCACCGCCAAGGACTACGAAGATCCACCGCCGGTGCGGCTCGTAGATCCAAAAGAGT TTGCTTCCTGGTCCTTCTACAGGGCCGGCATTGCCGAGTTCGTCGCCACGCTCTTGTTCCTCTACATCACCGTTCAGAC
GGTCATCGGCCACTCGCGAAACCAGGCAAACTGCGGTGGCGTTGGGTTGCTAGGAATCGCATGGGCCTTTGGGGCATG
ATCTTCGTTCTCGTCTACTGCACTGCCGGAATCTCAGGAGGACATATCAACCCGGCTGTGACTTTCGGACTCCTCGTGG
CTCGCAAGGTCTCCCTGCCTCGCGCGATCTTCTACATGATCGCGCAGTGCCTGGGAGCGATCGTCGGCTGCGGCCTCGC
CAAGGGGTTCCAGA > SEQ ID NO:2161 176047 50892_300186_1
CAACAAACTAAAGTTGGTGGTGATAGAGTGAGAGAGAAACATGGAAGGCAAAGAAGAAGACGTCAATGTTGGAGCCAAC
AAGTTCCCAGAGAGACAGCCGATCGGTACGGCGGCTCAGACGGAGAGCAAGGACTATAAGGAACCACCACCGGCGCCGT
TTTTCGAACCCGGCGAGCTCAAATCTTGGTCTTTCTACAGAGCAGGGATAGCTGAGTTCATAGCCACTTTCCTTTTCCT
CTACGTCACCGTTTTGACAGTCATGGGTGTTAAGAGAGCTCCCAATATGTGTGCCTCTGTTGGAATCCAAGGCATCGCT
TGGGCTTTTGGTGGCATGATCTTTGCTCTTGTTTACTGTACTGCTGGAATCTCAGGAGGACATATTAATC > SEQ ID NO:2162 176047 50570_300167_1
CCCACGCGTCCGTAACCACTCTACTTTCTCAAATCCCACACTCAGAGAAGAAGAAGAAGAAAAAAAACAGAGCTTTACA
ATTTCTCTCTACAGAGATCGAAGATATGGAAGGCAAGGAAGAAGACGTTAGAGTTGGAGCTAACAAGTTCCCGGAGAGA
CAACCAATCGGAACATCAGCTCAGAGTGACAAGGACTACAAGGAACCACCACCAGCTCCGTTTTCGAACCTGGTGAGC
TTTCTTCATGGTCTTTTTGGAGAGCTGGGATCGCTGAGTTCATCGCTACTTTTCTCTTTCTCTACATCACTGTCTTGAC
TGTTATGGGAGTGAAAAGGTCACCGAACATGTGTG > SEQ ID NO:2163 176047 50027_300166_1
AAAGAAGAAAAAAAGCAAAGAACACTTGAACGTTTTCTAGATAGAGATGGAAGGGAAAGAAGAGGATGTTCGAGTGGGA
GCTAACAAGTTCCCGGAGAGGCAACCGATAGGTACATCGGCTCAGACGGACAAAGACTACAAGGAGCCACCACCAGCTC
CATTTTTCGAGCCAGGCGAGCTGAGTTCGTGGTCCTTCTACAGAGCCGGAATCGCCGAGTTCATAGCCACCTTCCTGTT
TCTATACATAACAGTATTGACAGTGATGGGAGTGAAGAGAGCACCAAACATGTGTGCCTCTGTTGGAATCCAAGGCATT
GCTTGGGCTTTCGGTGGCATGATCTTTGCCCTTGTCTACTGTACTGCTGGAATCTCTGGTGGGCACATAAACCCAGCGG
TGACATTT > SEQ ID NO:2164 176047 46176_300176_1
CACAGAAAAAACCTAGAAAGCTCTAGAGAGAAAGAGAGAGAGAGATGGAAGGTAAAGAAGAAGATGTTAGAGTCGGAGCT
AACAAGTTTCCGGAGAGGCAACCGATCGGAACTTCGGCTCAGAGTGACAAGGACTACAAAGAGCCACCACCTGCGCCGT
TGTTCGAGCCCGGCGAGCTAGCTTCATGGTCCTTCTGGAGAGCTGGGATTGCTGAGTTTATAGCTACGTTTTGTTCCT
GTACATCACTGTTTTGACTGTTATGGGTGTGAAGAGGTCACCGAACATGTGTGCTTCCGTCGGAATCCAAGGTATCGCT
TGGGCTTTCGGTGGTATGATCTTCGCTCTCGTCTACT > SEQ ID NO:2165 176047 254344_301632_1
GGTTCGAACCCTCCTATCTGTCAATCTCTCTCTCCCCTTATACAATACAAGTAGAAGGCCATGGAGTCGAAGGAGGAGG
ATGTGAGACTAGGTGCGAACAAGTACCCAGAGAGGCAGCCACTGGGCACGGCAGCGCAGACGCGGAACTACAGTGAGCC
CAGCCCGGCCCCCCTCATCGAGCCCTCGGAGTTCTCCTCCTGGTCCTTCTGGAGAGCCGGCATCGCCGAGTTCATCGCC
ACCCTCCTCTTCCTCTACAATCTCCATCCAGACTGTCATGGGATGGAAGCGCTCAGTCGAGGCCGAGACCGCCAAATTC
CCCAATGACCAGAACATCTGTCCTCAGGGTGTCGGCGTCCACGGCATTGCCTGGGCCTTTGGCGGCATGATCTTTGNCC
TCGTCTACTGCACCGCCGGCATTTCAGGTGGGCACATAAACCCGGCAGTGACGTTTGGACTATTCCTGGCTCGGAAGCT
GTCTCTACCGCGGGCGTTGCTATACATAATAGCACAGTGCCTGGGAGCCATCTGTGG > SEQ ID NO:2166 176047 254020_301631_1
GTCGGAAAGTTCTTGTCCTAGAGAGACCCTCCTCCTCTCTCCCTCTTAGGTCGCCTACCCCTCAGAGCCATCATGGCCA
GCAAGGATATGGACACGCCGGAGCCGCCGACTGGAAGGACTACACGGAGCCCCCCCCTGTCGCCCTCTTTGACGCTGC
TGAGTTCAGTCTCTGGTCCTTCTACCGTGCCTGCATCGCTGAGTTCATTGCGACTCTGCTCTTCCTCTACATCACTATT
GCCGCTGTCATCGGTAACAACCACAATATCACTGGCTGCAACAACATCGGTGTGCTTGGCATCGCCTGGGCCTTCGGTG
GAATGATCTTCATCCTTGTCTACTGCACTGCTGGAATCTCAGGAGGGCACATAAACCCAGCAGTGACCTTCGGGCTGTT
TCTTGGACGGAAAGTGTCACTGCCCCGGCTATCTGCTACATGGTAGCGCAGTGCCTTGGGGCCATCTGTGGTGCTGGC
CTGGCCAAGGGGTTTCCAGACTTCATACTATGTCGATATGGAGGAGGTGCCAACATGGTTGCCCCTGGCTACACCAAGG
GGGTTGGTCTTGCCGCTGAGATCATTGCACCTTTGTTCTTGTCTATACCGTCTTCTCTGCCACAGACCCTAAGAGGAA
CGCCAGAGATTCTCATGTCCCTGTGCTGGCTCCACTGCCAATAGGGTTTGCAGTGTTCATGGTCCATCTGGCCACAATC
CCCATCACTGGGACAGGCAT > SEQ ID NO:2167 17661 286457_200109_1
AACCGTCAAAACCAAATCTAAGATCGTCGGAACGCAGAGTGAGAGCAGTAGGTAGCCCATCTCGCCGGCGCCGGTCAGC
AGATTCACCGGCGATCAAATTCCCCGTTGCTGCTAGAAATACAGGTGGATTAAGTGGAAAAAGAGGAAACCAGATATAA

FIG. 2 continued

ATTATGGTGTTCTCTATGGTGATGAGTTGTTCACCTCATATCTGTCTTCCAAAAAGCCGCATGGTTATGCAGAAAACAA
TCCAGTGCTCTGCTTCTGTTTTGACGGCGTCTGAGTCCATCCAATTTGATCTTAAGAATTATTGGACAACTCTAATTTG
TGATATCAACCAGAAGCTTGACGAGGCGGTCCCAGTTAAGTACCCAAATCAGATTTATGAGGCCATGCGCTACTCCGTT
CTGGCCAAGGGTGCTAAAAGATCCCCGCCCATCATGTGTGTTGCCGCTTGTGAGCTTTTCGGTGGAAATCGCCTCGCTG
CCTTTCCCACTGCCTGTGCTTTAGAGATGGTTCATGCTGCTTCGTTGATTCATGATGATCTACCTTGCATGGATGATGA
CCCAACTCGACGAGGACTGCCTGCAAACCACACAGTTTTTGGTGTAGATATGGCAATTTTAGCTGGGGATGCCttGTTC
CCTCtTggattccAGCATAtTgtgTCTcaCACTCCaaGCGATCTCGTtcc > SEQ ID NO:2168  17661  47320_300170_1
GATCCCATTAAGCAGCTTCTGCTCTCTTACGGAGAAACCCCACACTCTTCCTATGAAACTCTCTCCCGCTGCAATCCGA
TCTTCATCCTCATCTGCCCCGGGGTCGTTGAACTTCGATCTGAGGACGTATTGGACGACTCTGATCACCGAGATCAACC
AGAAGCTGGATGAGGCCATACCGGTCAAGCACCCTGCGGGGATCTACGAGGCTATGAGATACTCTGTACTCGCACAAGG
CGCCAAGCGTGCCCCTCCTGTGATGTGTGTGGC > SEQ ID NO:2169  17661  119095_300066_1
CTTCTTCTTCTCTCTCTAAATCTCTCTTTTCAGAAGACCTAATTTTTTGCTGCTTTTGCATAGTGGTTTATTATTAAGG
TCAGCTTCATTTCCGGTAGAATGGATTTTTTCTTTAGGAATGTAAATGATGATTCTTCAACTATCCAGCAAGATATTAT
TAGGTGCCCATTTTTGCGGAACATCAATGAGCCAACAAACTTTTCCTTCTCAAGCTCCATGGCTTTCCCACTTCCCGTA
CGTGAGGGGAAAGGTCCTATCTTTGAGGATGGTCCTAATTTTGACATGGCGTTCAGGCTTTTCCACGGGCAGAATGGTG
TTGTTCCACTTTCAGGGAGACCATCCATGAAGCCAGATGCTGCACCTGCATCACCTAATTTCAACCCTCTGGCAGCAAA
AGCAGCAACCATAAGCCTCTCGGCTTTTGGATCTGGAGGTCCTTTTGGTTTTGATGCATTCTCAGAGAAGTGGAAGAAA
TTGAACTCCAAATCAAATAAAAAAGACTCTTCTTCCAAGGGAGGAGACTCAAAACATGAAGCGCTAAGCAATGAGTGGT
TGCAGAGTGGGAATTGTCCTATTGCGAAGTCCTACCGTGCAGTGAGTAATGTCCTTCCTCTTGTGGCAAAGGCTTTTCA
GCCCCCACCTGGTATGAACCTCAGGTGCCCCCCTGCGATAGTTGCTGCGCGTGCTGCTCTAGC > SEQ ID NO:2170  17661  224273_300970_1
GTAGAGACTTAGGGTTCTTTGATTCCAGCAGCAGCCAGCGGCAGAAGAAAATGGAGTGCGACAGCAGCATCATCGCCGA
GGGCGTGGAGCGATGCCCATTCTTGCGGACAATTGGCGAGCCAACTTCCTTTAACTTCGGCAGCTTCCCCCCCATCAAG
TTCCCCAGCCCGCTTCGTGGATCCAGAGGACCGATTTTCGAGGATGGCCCCGGATTTGAGACCGCATTTCGGTTGTTCC
ATGGGCAAGACGGTGTGATTCCACTGTCCCAGAAGAAGGCTGAGGATGGAAGCGAGAGTGTGGAAGCGGCCCCCAAAAT
GAGCTTCCATCCACTGGCAGCATCCGCGGCTACGATAAGTCTCTCTACGTTTGGGGCCGGCCAGTTTAACTTTGACGCG
TTTATGGCGAATCAAGAGAAGAAGAAGCAACAGCAAAAGAAGAAGGAAGCAGAGTCTAACCACAGACAGGACCATCTCC
ATGAAGCGCTCGGCTCCGAATGGCTGGCCACTGGAAACTGTCCGATAGCACGCTCCTGTCGAGCAGTAAGCGGAGTGCT
ACCGCTCGTCGCAAAGTGGCTCAAACCACCTGCGGGAATGAAGTACCGGTGTCCTCCGGCCATCGTCGCTGCTCGAGCT
GCGCTGGCGAGAACTGCCTTCGCGAAGAACTTGAGGCCTCAACCATTGCCATCCAAACTCTTGGCAATCGGTT > SEQ ID NO:2171  17661  144229_200133_1
GCAGCCCATCTCGCCGGCGCCGATCTGCAGATTCACCGGCGAATCAAATTCCCCGTTGCTGTTAGGTGGATTAAGTGGA
AAGAGAGGAACCAGAGATAAATTATGGTGTTCTCTACGGTGATGAGTTGTTCACCTCATATGTGTCTTCCAAAGAGCCG
CATGGTTATGCAGAAAACACTCCGGTGCTCTGCTTCTGTTTCAACAGCGTCTGAGTCCATCCAATTTGATCTTAAGAAT
TATTGGACAACTCTAATTCGTGATATCAACCAGAAGCTTGACGAGGCAGTTCCTGTTAAGTACCCCAATCAGATTTATG
AGGCCATGCGCTACTCCGTTCTGGCCAAGGGTGCTAAAAGGTCCCCGCCAATCATGTGTGTCGCGGCTTGTGAGCTTTT
CGGTGGAAATCGCCAGGCTGCCTTTCCCACTGCCTGTGCCTTAGAGATGGTTCATGCTGCTTCATTGATTCATGATGAT
CTGCCTTGCATGGATGATGACCCAACTCGTCGAGGGCTGCCTGCAAATCACACAGTTTTTGGTGTaGaTATGGCAATTT
TGGCCGgGGATGCCTTATTCCCGCTTGggTTccAGCATATTgtgTCTCACACTCCcaagtGATCTcgttc > SEQ ID NO:2172  17661  16275_300230_1
CCCACGCGTCCGGTCAGATTCATCCAAAAATAAGGGAGGAAACCACGAAGCCATGGGCGACGAATGGCTTAAAACAGGA
AACTGCCCAATAGCAAAATCATATCGAGCTGTAAGTGGTGTGGCACCACTTGTGGCAAAGATCCTGCAACCCCCTCCAG
GCATGAAATTTAAATGCCCTCAAGCAATAGTCACAGCTCGAGCAGCGATATCAAAAACACCTTTCGCCAAGAACCTCCG
TCCACAACCTTTACCAGCTAAAGTACTAGTGATCGGGATGCTGGGCATggcgTTAAATGTGCCTTTAGgGGTCTGGAGa
GAGCACACTGAAAgttTTCggcATCTtggtttATAgcTcTTCACGc > SEQ ID NO:2173  17884  1114890_301805_1
tcttctgtttcccTCTATTACAGGCGACATTTCCTGTGGCTACTCAAGCAAGTAGCTGGTAGAGAAGGGCTTTCTCTCT
TTCATCTCTTTGCTGCAAAATGGAGGGGAGGCGGATTGGGGTGGCTATGGACTTCTCGCCCAGCAGCAGGCACGCCCTC
AAATGGGCTCTCTGCAACATCGCCCGAAAGCACGACCATTTGATCATCATCATCGTCAACAAGAAGGAGATGGAATCGG
GTGACATGCTCCTCTGGGAGCAATCTGGTTCTCCATTGATACCCTTCTGTGATTACGCTGAACCGGCCGTCACCCACAA
GTATGGAATTCAGCATGATGTTGACCTCTTCTCACTTGTTGAAGACGAGAAAAATATGAAGGAACTCACTGTAGTTTTC

FIG. 2 continued

AAAGCGTATTGGGGTGATCCCCGCGAGAAGATATGCGACGCTTCTGTAGACCTTCCCCTTGATTGCCTTGTGATGGGAA
GTCGAGGACTTGgAaCcTtGAAAAGAGCCCTTCtagggAGTGTCAGTAACTATGTAGTCaACAATTGcccATGCCCGGT
CACTGTCGTAAAGtttccagccGACGAtgTGCAttccTCTtgaccaaTtccaacataCAAGGAGGAAATAagaaCtgaG
GTACATCaaCATATAAATAaa > SEQ ID NO:2174 17884 174820_300527_1
ACCCCGACTACGAGCAGGGCGAGACCCTCCTCTGGGAGGCCACCGGCTCTCCATTGATTCCTCTCTCGGATTTCTCTGA
ACCTACAATTGCAAAGAAATATGGAGCAAAGCCTGATGCCGAAACATTGGACATGCTTAATACTGTGGCCAGGCAGAAG
GAGGTTGTGGTGGTTTTCAAAGTCCTTTGGGGAGATCCCCGTGAGAAGCTATGCCAAGCCATCAACGAAATCCCCATGA
GCTGCTTGGTTATTGGAAGCAGGGGTCTTGGCAAACTCAAGAGGGTGCTGTTAGGTAGCGTCAGCGACTATGTCGTGAA
CAACGCCACTTGCCCAGTCACAGTTGTCAAGACAGCCGATGGCTGATCCTATTGTCAAAAATATCCATATATGTGTTAT
ATAGTCTGCTTAAATCTTTGTTCACCTATTTGAAACATATTGAACCACCATGCAGTGTAATTGTAATAATAAACAAAGT
CAGCTGAAGACGCTCAGTTGTACTTTGTGCTTGCACTCTCTCAGCCTGAGTATGAATTGGATCCAGCTGTTTTTCTT > SEQ ID NO:2175 17884 137739_300686_1
cggacgcgtgggcggacgcgtgggTTCGCCGCGCGCGTCACACGAGCAAGGGAGCAAGCGAGGAGAGAGGAGAGGCTTA
GCGAGAGAGGTGAGGAGAGGAGAGGATTTGGAACTTTTGATCTTTGGGATCGCGAGACGACGGAGATGGCCGGTGGCGG
CAGGGCCGATGACGAGCGAAGGATCGGGGTGGCGATGGACTACTCGGCGAGCAGCAAGAGGGCGCTGGACTGGGCCATC
GCCAACCTGCTCCGCCGGGGCGACCACCTCGTCGTCCTCCACGTCCTGCATCACGGCGGGGAGGAGGCCAAGCACGCCC
TGTGGGGCAAGTCCGGATCCCCGCTGATCCCTCTCTCCGAGTTCCGGGATCCGACGGCGATGCAGCAGTACGGCGTGCA
CTGCGACGCCGAGGTGCTCGACATGCTCGACACGGCGGCGCGCCAGTTGGAGCTTACCGTAGTGGCGAAGCTGTACTGG
GGCGACGCCAGGGAGAAGCTCTGCGACGCCGTCGAGGAgCAGAAGATCGACACGCTCGTCATGGGCAGCCGcggCCTCG
GCTCGATCCAGAGGAttCTTCTGGGGAGTgtgacaAACTACGTGCTgtcAAACGCATCATGccCTGTAAcagTCGTCAA
GgGGGAagT > SEQ ID NO:2176 17884 142721_300445_1
ATTTCTCAGCATGCAGCAAGAAAGCTCTGAAATGGGCCATTGGCAACATCCTTCGTAAAGGGGATCACCTTATTCTGGT
CACTGTTCGTCCTGAAGGTCACTATGAAGAAGGCGAGATGCAGCTCTGGGAGGCCACTGGTTCTCCTTTAATTCCTTTA
TCCGAGTTTTGCGATGCCCACACAATGAAGAAGTATGGGGTTAACCCTGACCCAGAAACATTGGATATGGTAACCCTTG
CTGCTAGACAGAAGGAGATAATGGTAGTGCTGAAAATTTACTGGGGAGATGCTCGAGAGAAGTTATGTGAAGCAATCGA
CAAAACTCCCTTGAGCTGTCTGGTCATAGGGAACAGAGGGCTTGGAAAGCTCAAGAGGGCTATCATGGGCAGCGTTAGC
AACTATGTTGTGAATAACGCTACGTGTCCTGTTACTGTTGTGAAGCATGCAGATGACTAATTGCGGGTTTATTTTGTCA
TTGAAATCTAAGTTTATATTAAAATAATCTTGTTTGTTTTCTAAGCTTGATGTTGGATCAAGCATCTATATTTGTGTGT
ATTTTGAACATGTCGATGCTGTGTGTGTATTATGTACCCTCATGTTGAACCTCTGTAATTCCGATCACCACGAGTTGCT
GCAGTAAATAAACATTTTGGAACTCTACAAAAA > SEQ ID NO:2177 17884 135342_300413_1
ATAGTTCCTATCATAATGAGCAAGGTGCAGTTCAACTGTGGGAACAGAGTGGTTCACCGCTCATCCCTCTGGCAGAGTT
CTCAGATCCCCATGTCGCCAAGACATATGCTGTGTCACCCGACAAGGAAACACTAGAAATCCTGAATCAAATGTCGAAT
CAGAGAGGGGTTGAAGTCCTTGCAAAGATACTCTACGGTGACCCTGCAAAGAAGCTGTATGAAGCAGTTGACCTGGTTC
CCCTCAACTGCTTGGTGGTTGGAAACAGAGGGCTAAGCACACTCAAGAGGGCTCTGATGGGAAGCGTCAGCTCCTACAT
CGTGAATAACGCGACCTGCCCAGTTACGGTCGTCAAGGAGAACATATAGCTCCTCAATAGTTAACTGCTCTGATAGGAA
GCAGTAAACTGCAAGAACAGACAGCATCAGTATCTAAGTATCTAACATATACAACAGTATAGCAGATTGAATAAATTGT
GCTTGACATGCACTGGCAGTCACTCAGCTCAGCTGCCCTTGCCTCTTTACCTGGAAAGATCTTTCTTGATGTAAACCGT
TCAGTATTTATTATGCATGTAATAATATAAGCGGGAACCATACGTGTGTTTCAGT > SEQ ID NO:2178 17884 252818_301605_1
ATTTCCTGTGGCTACTCAAGCAAGTAGCTGGTAGAGAAGGGCATTCTCTCTTTCATCTCTTTGCTGCAAAATGGAGGGG
AGGCGGATTGGGGTGGCTATGGACTTCTCGCCCAGCAGCAGGCACGCCCTCAAATGGGCTCTCTGCAACATCGCCCGAA
AGCACGACCATTTGATCATCATCATCGTCAACAAGAAGGAGATGGAATCGGGTGACATGCTCCTCTGGGAGCAATCTGG
TTCTCCATTGATACCCTTCTGTGATTACGCTGAACCGGCCGTCACCCACAAGTATGGAATTCAGCATGATGTTGACCTC
TTCTCACTTGTTGAAGACGAGAAAAATATGAAGGAACTCACTGTAGTTTTCAAAGCGTATTGGGGTGATCCCCGCGAGA
AGATATGCGACGCTTCTGTAGACCTTCCCCTTGATTGCCTTGTGATGGGAAGTCGAGGACTTGGAACCTTGAAAAGAGC
CCTTCTAGGGAGTGTCAGTAACTATGTAGTCAACAATTGCCCATGCCCGGTCACTGTCGTAAAGTTTCCAGCCGACGAT
GTGCATTCCTCTTGACCAATTCCAACATAC > SEQ ID NO:2179 17884 266963_200087_1
gttcttttgttttcagttttcacacgcaagaaagttctctgcatctcttttaaagaagaaaaaacaaagaagaagaaa
tAAGTAAGCGAAAATGGTGAAAGACAGAACGATTGGTGTAGCAATGGATTTCTCAAAGAGCAGTAAAACTGCTCTAAAA

FIG. 2 continued

TGGGCCATTGATAACTTAGCTGACAAAGGCGACACCTTTTACATCATCCATATCAAGACTCATTCTTCTGATGAGTCAC
TTAACAAGCTCTGGGCCAAATCTGGTTCTCCTTTAATTCCGTTGGTGGAGTTTAGGGAGCCTGAAGTGATGAAGAAATA
TGATGTGGAGACTGATATTGATGTTCTTGATTTGCTTGATACTGCTACTAGGCAGAAAGAGATAAATGTTGTCACCAAA
CTGTACTGGGGAGATGCTAGGGAGAAACTATGTGATGCTATTGAAGATCTGAAGTTGGATTCTTTGGTTATGGGTAGCA
GAGGCCTTACTACCATCCAACGGATATTCTTGGGGAGTGTGACCAACTATGTAATGTCTCATGCGACCTGCCCTGTGAC
TGTAGTCAAGGATCCAGATTTCCACAAGCACTGATCAACAACTTTGGGTTGAATGCGAGTAACTAATTGCGACTTATGA
TGCCCGTTGAATAAGATGAAAAGCTTTAAATGTATATTTATTTTCTCTTTTGATAAGATCTTGTTTCTGGTTCcAATAA
GCAGAGAGAGATTGATGATTTTCTCTTa

> SEQ ID NO:2180 17884   50142_300169_1
GAATATCGGAATCGCCATGGATTTCTCAGAGAGCAGCAAGAACGCTCTGAAATGGGCGATCGAGAACTTAGCAGACAAA
GGAGACACGATTTACATCATCCACACTCTACCACTCTCTGGCGATGAATCTCGTAACTCCCTCTGGTTCAAATCCGGTT
CTCCTCTCATACCGTTGGCAGAGTTTAGGGAACCGGAGATTATGGAGAAATACGGTGTCAAAACCGACATCGCATGTCT
TGATATGCTCGACACTGGTTCGAGGCAGAAAGAGGTGCATGTAGTGACCAAGTTATACTGGGGAGATGCAAGAGAGAAG
CTTGTTGATGCTGTTAAAGATCTTAAACTCGATTCTATTGTCATGGGAAGCAGAGGACTCAGTGCTCTTCAAAGGATAA
TAATGGGAAGCGTGAGCAG

> SEQ ID NO:2181 17884   46838_300192_1
agagaatcagctttcagagattaaagtatacctacagatagagttatggcggagagtggtggacgaaggatcggagtgg
cGGTGGATTTCTCGGACTGCAGTAAGAAGGCTCTGAGCTGGGCGATCGATAACGTGGTTCGCGACGGAGATCATCTGAT
CCTAATCACTATTGCTCACGATATGAATTACGAGGAAGGCGAGATGCAGCTCTGGGAGACCGTTGGATCACCTTTTATT
CCTATGAGTGAATTCTCTGACGCTGCTGTGATGAAAAAGTATGCATTGAAGCCAGATGCTGAAACCCTTGACATTGTCA
ATACTGCCGATAGGAAGAAAACGATTACAGTAGTGATGAAGATATATTGGGGAGATCCTCGTGAGAAGATTTGTGCAGC
AGCTGAACAGATTCCTCTCTCAAGCCTTGTGATGGGTAACAGAGGCCTTGGTGGTCTTAAGAGGATGATTATGGGAAGT
GTAagc > SEQ ID NO:2182 17884   27488_300076_1
TTGAAGACGGCGACACCGTCCTCTTGATTCACGTCCAACCACAAAACGCCGATCATACCCGCAAAATCCTCTTCGAGGA
AACCGGTTCACCGCTAATTCCTTTGGAGGAATTTAGAGAGGTTAATTTGCCTAAACAGTATGGACTTGCTTACGATCCT
GAGGTTCTTGATGTTCTTGATACTCTCTAGGGCTAAAAAGGTGAAGGTTGTACCAAAGGTGTATTGGGGAGATCCAA
GGGAGAAACTTTGTGATGCTGTCCAAAATCTAAAACTCGATTCCATTGTTCTTGGCAGTCGAGGTTTGGGTTCTCTCAA
AAGGATCTTGCTGGGTAGTGTGAGCAATCATGTGGTGACAAAATGCAACATGTCCTGTCACAGTTGTTAAGGCTAATTA
AAGTGTCTCTTGTTCTTTAATTGGACCCAGCTAATAACATTAGTAGTTACGTGTGTCACTCATGCATTGTTTTGACATT
TATACGTTTGTTGCCTTCTACAAATTT > SEQ ID NO:2183 181743 254619_301634_1
ACGCGTCGCTCTTCCTCCCACTCCTCTTCTGTCCACGGTAGCCACTTGGCCTTGCCTTCCCGGAACGTACCTAGGCCCC
GCCTTTCATCCCCTTCCTCCGCTGTCGCTTCCCTCTACTCTGACCCTTCCTATGACCTCTCCGACTTCACCTTCTCCCC
CATCAAGGAGTCCATCGTCTCCCCGCGAAATGACTCGACATACATGACTGATATGATCAGCTATGCCGATACCGACGTC
GTCATTGTCGGCGCTGGCTCGGCTGGACTCTCCTGTGCCTACGAGCTCAGCAAGAACCCAGATGTGCGGGTTGCCATCA
TCGAGCAGTCCGTTAGCCCCGGCGGCGGCGCGTGGCTCGGAGGTCAGCTCTTCTCGGCGATGATCGTGCGGAAACCTGC
CCACCTGTTCCTAGATGAGATTGGCGTGCCATACGATGAGCAAGAGAACTACGTCGTCATCAAGCACGCAGCACTGTTC
ACCTCCACCATCATGAGCAAGCTCCTAGCGAAGCCGAACGTGAAGCTTTTCAACGCAGTTGCCGCCGAGGATTTGATCA
TAAAGGAGGGGAGAGTTGGAGGCGTGGTGACCAACTGGGCTCTTGTGTCGATGAACCACGACACACAGAGCTGCATGGA
TCCTAATGTTATGGAGTCGCGCATCGTGGTGAGCTCATGCGGGCACGAT > SEQ ID NO:2184 181743 268779_200053_1
aaaaaactcatctctcaagatctcaagctttgtctatggcaaccatggcatcaaccttggcatcctctgttgttaccaa
gACCAATTTCTTGGACACCCACAAATCATCTTTCTCTGGTGTCCCTCTTTTTTCACAAGCTAGACTTAAACCTGTTAAA
TCTGCCCAGCAAAACATGACCATTTCCATGTCTGCTGATTCCTCTCCTCCACCTTATGATCTTAACGCTTTCAGTTTTA
ACCCAATTAAGGAATCCATCGTTTCTCGCGAGATGACACGTAGGTACATGACTGACATGATCACCTATGCTGACACTGA
TGTCGTCATCGTTGGCGCTGGCTCTGCTGGTCTCTCTTGTGCTTATGAGATCAGCAAGAACCCTAACGTCCAGGTTGCC
ATACTTGAGCAATCAGTGAGCCCTGGTGGAGGTGCCTGGCTAGGTGGACAACTCTTCTCAGCCATGGTTGTGAGGAAGC
CAGCACATCTCTTCTTGAACGAGCTCGGCATAGACTATGACGAGCAAGATAACTACGTGGTCATCAAGCACGCTGCCTT
GTTCACCTCAACCATCATGAGCAAGCTTTTGGCCAGGCCAAACGTGAAACTCTTCAATGCTGTTGCAACAGAGGACCTT
ATTGTGAAGAACGGAAGAGTTGGTGGTGTTGTCACGAACTGGTCTTTGGTTTCTCAGAACCACGACACACAATCCTGCA
TGGACCCCAATGTTATGGAGGCTAAGATTGTGGTCAGCTCTTGTGGCCACGACGGTCCCATGGGTGCCACTGGTGTTAA
GAGGCTTAAGAGCATTGGCATGATCAATCATGTTCCTGGGATGAAAGCTTTGGACATGAACGCCGCTGAGGATGCTATT
GTTAGACTTACAAGAGAGGTTGTACCTGGAATGATTGTCACAGGGATGGAAGTTGCTGAAATTGACGGAGCACCAAGAA

FIG. 2 continued

> SEQ ID NO:2184 181743 104455_300410_1
TGGGGCCAACTTTTGGAGCTATGATGATATCAGGGCAGAAGGCGGCCCACCTTGCGCTAAGGGCATTGGGATTGCCCAA
TGCACTCGACGGGACAGCAGAGTCGACCATTCATCCGGAGCTTATCTTGGCTGCAGCGGATAATGCTGAGACAGCAGAT
GCTTAAAATCTTGAATGTATAATATTTCTCTTAAAAAAAGATTAGTTTTTCCTAGATGAGCGTGGTTTGTGGTTGGGAG
AAATTGGCAAGGGGGATGAATAAAAGTCTGCAGGATGAATGTCAATGTGTACCTTTGGCTGTTTCATGTCTATTCTTC
TTTTCTTTTGATTTACTTCTACTTCAAAACTTTGATGTGAAAAAGTTGTAGATTGTAGTTTTCATTGAATAATCCTATG
GGCTTTTTGGCGtcgttTTGGTAAaaaaa > SEQ ID NO:2185 181743 104455_300410_1
GCCATTACGGCCGGGGAAAACAATCTTTCATTCTTCTAAGGTCTCAAAACAAAATCTCCTTTCTCAGAACCATGACACA
CAATCTTGCATGGACCCCAATGTTATGGAGGCTAAGATTGTGGTCAGCTCTTGTGGCCACGACGGTCCCATGGGTGCCA
CTGGTGTTAAGAGGCTTAAGAGCATTGGCATGATCAATCATGTTCCTGGGATGAAAGCTTTGGACATGAACGCCGCTGA
GGATGCTATTGTTAGACTTACAAGAGAGGTTGTACCTGGAATGATTGTCACAGGGATGGAAGTTGCTGAAATTGACGGA
GCACCAAGAATGGGGCCAACTTTTGGAGCTATGATGATATCAGGGCAGAAGGCGGCCCACCTTGCGCTAAGGGCATTGG
GATTGCCCAATGCACTCGACGGGACAGCAGAGTCGACCATTCATCCGGAGCTTATCTTGGCTGCAGCGGATAATGCTGA
GACAGCAGATGCTTAAAATCTTGAATGTATAATATTTCTCTTAAAAAAAGATTAGTTTTTCCTAGATGAGCGTGGTTTG
TGGTTGGGAGAAATTGGCAAAGGGGGATGAATAAAAGTCTGCAGGATGAATGTCAATGTGTACCTTTGGCTGT > SEQ ID NO:2186 181743 223856_300976_1
ACCTACAATTAACATGGCCCCACCTCCTGCTGTCGTTGCCCACCCCCTCTCCTCTCAGGCTACTGGTCTTGATATGGTC
CATGAGTTCAACCAGAAGCTCACTAAGTCTGATGAGCACACTTGGGAGTCTTTCAAGTTCGCCCCCATCCGTGAGTCCA
CTGTCTCTCGAGCTATGACTCGACGATACTTTGAGGATCTTGACAAGTACGCTGAGTCTGATGTTGTTATCATTGGAGC
TGGCTCCTGTGGTCTCTCTGCTGCCTATGTTCTTGCCAAGAGCCGACCCGACCTCAAGATTGCCATCGTTGAGGCTGGT
GTTGCTCCCGGAGGAGGTGCTTGGCTTGGAGGACAGCTCTTCTCTGCCATGGTTATGCGAAAGCCTGCCGAGCAGTTCC
TTGAAGAGATCGGTGTCCCTTACGAAGATGAGGGAGACTACGTCGTTGTTAAGCACGCTGCCCTTTTCACCTCTACTCT
CATGAGCCAGGTGCTCAAGTTCCCCAATGTTAAGCTCTTCAACGCTACTGCCGTTGAGGACCTCATTACCCGAAAGGAT
GCCCANGGCAACCTTCGAATTGCAGGTGTCGTCACCAACTGGACCCTAGTTTCCATGCACCATGATGACCAGTCCTGTA
TGGACCCCAACACCATCAATGCTCCTATCATCATCTCCACCACTGGTCATGA > SEQ ID NO:2187 181743 167320_300546_1
gaattccagatcccatcaagactccaacccggcCGATCAACTTCCCAAAACAACACTACATCATCAATCTCTATGTCAT
CAACTTTTCTCTGCTATGATTGTTCGTAAACCAGCTCACAAATTCCTCGATGAACTCGAAATCGAGTACGATGAGCAAG
ACACCTATGTTGTCATCAAGCATGCTGCCTTGTTCACTTCCACCATCATGTCAAAGTTGTTGGCCAGACCAAACGTCAA
GTTGTTCAATGCTGTTGCAGCAGAGGATTTGATCGTTAAGAACAATAAAGTTGCCGGAGTTGTCACCAACTGGGCGTTA
GTCTCAATGAACCATGACACACAATCTTGCATGGACCCTAATGTCACGGAAGCCAAGATTGTTGTCAGTTCATGTGGTC
ATGATGGTCCTTTTGGTGCTACTGGTGTTAAAAGGTTGAAGAGTATTGGTTTAATCGACTCAGTTCCTGGAATGAAAGC
TCTTGACATGAACGCCGCTGAAGATGCCATTGTTAAACTCACTagagaAATTGTTCCTGGTATGATTGTTACTGGAATG
GAAGTGGCTGAAATTGATGgtgccC > SEQ ID NO:2188 181743 135619_300416_1
GTCGGCGCCGGCTCCGCGGGGCTCTCCTGCGCGTACGAGCTCTCCAAGGACCCCTCCGTCAGCGTCGCCGTCATCGAGC
AGTCGGTGTCCCCCGGCGGCGGCGCGTGGCTCGGCGGGCAGCTGTTCTCCGCCATGGTGGTGCGCAAGCCGGCGCACCT
GTTCCTCGACGAGCTCGGCGTCGCGTACGACGAGCAGGAGGACTACGTCGTCATCAAGCACGCCGCGCTCTTCACCTCC
ACCGTCATGAGCCGCCTCCTGGCGCGCCCCAACGTGAAGCTGTTCAACGCCGTCGCCGTCGAGGACCTCATCGTCAAGG
AGGGCCGCGTCGGCGGCGTGGTCACCAACTGGGCGCTGGTCGATGAACCACGACACGCAGTCGTGCATGGACCCCAA
CGTGATGGAGTCCAGGGTGGTGGTGAGCTCCTGCGGCCACGACGGGCCGTTCGGCGCCACGGGCGTCAAGCGGCTGCAG
GACATCGGCATGATCGACGCCGTGCCCGGCATGCGCGCCCTCGACATGAACACCGCCGAGGACGAGATCGTCCGCCTCA
CCCGCGAGGTCGTCCCCGGCATGATCGTCACCGGCATGGAGGTCGCCGAGATCGACGGCGCCCCGAGAATGGGCCCGAC
GTTCGGAGCCATGATGATCTCCGGCCAGAAGGCGGCGCACCTGGCGCTGAAGGCGCTCGGCCGGCCGAACGCCATCGAC
GGCACGATCAAGAAGGCGGCGGCGGCGGCGGCGCACCCGGAGCTGATCCTGGCGTCGAAGGACGACGGCGAGATCG
TGGACGCCTGAGCGAATAGAACAGGGTAAAAAAAATCCGCAAGACGTGGTGGTGACACGGAGGCGTTGGGGACGAGAA
GAAGATGTGGACTTTCCCCTGTGTTTTTTTTTCGGGATTTGCTTTGATCCCCTTGTTTGTTTTAGCTCTGGATGTTGA
TTAgcgtCTTGTTCATAGCAATTCCACTgccaCCgtgtgtgTGTgCtctgcttgCCTGATGagGGCAAGAAAACTTCCA
TGGATccgTctctctggGaggA > SEQ ID NO:2189 181743 130017_301704_1
CTTTTTTTTTTGAGAACTTAAACCCTAAATCCAAGCAAAACCAAACCACATAAAAACATCCTTCACATAAGAAAGAA
AAAACAAAAGAACAACCATGAACAGCAGACAGACTATTTGATTGACGGATTTCTCTTAACCTACAGTACTCATCAACAT
CATCATCATATCCTTGCTCTGCTCTCTTTTTATTAATTTATGCAATTTTAGATGATAATTTCCTTATCATCAACAGTCT
CAACATTACTTTATTTCTTAAGCTTCAGCAGTCTCAGCTGATTCAGCAGCTGCAAGGATAAGCTCTGGTACA

FIG. 2 continued

> SEQ ID NO:2190 181743 129985_300483_1
gaattcgcaGAACCTAAGAAATCTTCTTTCTAATGGCAACCATGGCAATGACCCTTTCTTCACCCCTTTCTAAAACACC
TTTCCTAGAAACTCAATCTTCTTTCCATGGGATCCAGATCCCATCAAGATTCCAACCCATCCGATCAACTTCCCAAAAC
AACACTACATCATCAATCTCTATGTCATCAACTTCCGGTTATGATCTTACAGATTTCAAGTTTGCACCAATCAGAGAAT
CAATAGTTTCTCGTGAAATGACCCGTCGTTACATGATGGATATGATTACTTACGCCGATACCGATGTTGTTGTCGTTGG
TGCTGGTTCAGCTGGTTTATCATGTGCTTATGAAATCAGTAAGAACCCTAACGTTAATGTTGCACTTATTGAACAATCA
GTTTCTCCAGGTGGTGGTGCTTGGTTAGGTGGACAACTTTTCTCTGCTATGATTGTTCGTAAACCAGCTCACAAATTCC
TCGATGAACTCGAAATCGAGTACGATGAGCAAGACACCTATGTTGTCATCAAGCATGCTGCCTTGTTCACTTCCACCAT
CATGTCAAAGTTGTTGGCCAGACCAAACGTCAAGTTGTTCAATGCTGTTGCAGCAGAGGATTTGATCGTTAAGAACAAT
AAAGTTGCCGGAGTTGTCACCAACTGGGCGTTAGTCTCAATGAACCATGACACACAATCTTGCATGGACCCTAATGTCA
TGGAAGCCAAGATTGTTGTCAGTTCATGTGGTCATGATGGTCCTTTTGGTGCTACTGGTGTTAAAGGTTGAAGAGTAT
TGGTTTAATCGACTCAGTTCCTGGAATGAAAGCTCTTGACATGAACGCCGCTGAAGATGCCATTGTTAAACTTTTCTCT
GCTATGATtgttCGTAAACCAGCTCACAAATTCCTCGATGaACTCGaaatcgAGTACGATGAGCaagacaccTATGttg
TCAtcaagcaTGCTGccttgttcaCttccaccaTCAt > SEQ ID NO:2191 181759 122295_300017_1
CCCCCCGAACAAAAACAAAAGCACTCGAGTCGACTCGTGCGCCGCCGCGCGCGCGCACGCACGCACACTCCGGCCTCGC
TCGCATGGCGGCGTCCACGGCATCCGCCCCGTTCACGCCGCTCCTCCACCGGCGGCGAGCGAGCGTCCACGGCCGGCGC
GGGAGCGGGAGGGCGTTCGTCGCCGTCGTCGTCGCGGCGGCGGCGGGGGGCGCGCCGGAGACGGAGCCGTCCCCGGCTA
CGGCGGCCGGGGCGGCGGCGCAGGGGAAGAAGAAGACGGTGGACACGAGGATACACTGGTCGGACCCGGACGAAGGGTG
GGTCGGCGGGAACGCCAAGAAGGACGGCGGCGGCCGGAAGAAGGAGCCGCTCGGTGGGAGGTTCGCCGACCTCATCAAC
AACCCGTCCGAGTCTCACTACCAGTTCTTGGGGGTGGAACCGAAGGCGGACATCGAGGAGATAAAGGCGGCGTACCGGC
GGCTGTCCAAGGAGTACCACCCGGACACGACGTCGCTGCCGCTGCG > SEQ ID NO:2192 181971 105455_300368_1
tctcccttctCTTTTTGCAAGACTTAATAATTCTCCAGCTTCCTCCCATCATCACCCCACTTTGAGAGAGAAGACATGG
CAAAGGGAAGTTACGAGAAGGCCATTGTTTCACTCCAGAACCTCCTCAGTGAGAAGGGAGAACTGGAACCGATTGTAGC
AGAAAGAATTGATGAAATCACAGCTGAATTACAAACGTCAGGCTTCCAATCAGTCCACCCTGTTGACAGAATCAAGACT
GGCTTTGATTATTTCAAAAAAGAGATATATGACAAAAATCCAGAACTGATTGATGAACTCAAGAAAGGACAGGAACCCA
AGTTTCTGGTGTTTGCATGCTCCGATTCACGAGTGAGCCCATCTCATGTGCTGAATTTTCAGCTCGGTGAGGCTTTTAT
GGTTCGAAACATTGCCAACATGGTCCCTCCTTATGACAAGACAAAATACTCGGGAGTAGGAGCTATAATCGAATATGCT
GTTCTCTTTCTTAAGGTAGAAAATATTTTAGTCATTGGCCATAGTGCATGTGGAGGTATTAAGGCTCTCATGGATCTCC
CAGAAAATGGTTCTGAATCAACCGATTTTATTGAGAATTGGGTGAAAATTGGACTACCAGCCAAGGCAAAGGTACTAGC
TGAACATGGGGACAAAACTTATGAAGAGAAACTCAAATACTgtgAAATGGAAGCTgtgAATGTATCACTAGCTaaTtTG
CTGACATACCCatttgtgagTGATGCtttg > SEQ ID NO:2193 181971 1110829_301539_1
ATTACTCGCTTTCTTCCTTATCTCTTTTGCTTTTGCTTTGCCTTAGAAGGGTGATTAGAGATGGGCCATGACGATGCTG
AATGCTGCTACGAGGAGGCTGTTGAGGAGCTCAACATCGTGCTTATGAAATGCCCACAGCTCAAAGAGAAGGCTTGCAA
AGAGATTGAGTCACTAACAAAGAAGTTGGCTTTGGAGGCCAAATTAGTGGAAGAAGCTCATGAATTGAAGGATCATCTT
AAACTTGTTGCCCATGAGCTCAATCCCATTGATAAGATCAAAGATGGCTTCCTCAAGTTCAAAACCCATTTTAAGAAAG
AGCATGAGTTGTTCCAAAACATGGTGGAGTCTGAACGTGCAAAGATTATGATCATTTGTTGCTCAGACTCACGGGTAGA
TCCTTGCGCTATCCTCGGCTTGAAGGTTGGAGAAGCGCATGTCCTCCGTAATATAATCAATTGCATACCCACATGGTGG
GATGAGAAATACAAATCAGGGGTAGCATCCATTGAATATGCGGTTGCCCATTTGAAGGTGGATCACATTTTTATTATTG
GACACAACAAATGTGAGGGTTTGAAAAAGCTATTGCAGTCTGCTCAGGAAGAAGTGAAGCAAGATACTCACAAGATGAA
AGGTCCCTTCCACGAATGGTTGCTTACCATTTCCAAACATAAGCACAAGCAT > SEQ ID NO:2194 181971 170270_300531_1
cctggtgtgtagctactgctataaggagggcgccgtgcaccgcctctcacaatgtcgaccgccgccgccgccgccgctg
cCCAGAGCTGGTGCTTCGCCACTGTCACCCCGCGCTCCCGCGCCACAGTCGTCGCCAGCCTCGCCTCCCCATCACCGTC
CTCCTCCTCCTCCTCCTCCAACAGCAGCAACCTCCCGGCCCCCTTCCGCCCCCGCCTCATCCGCAACACCCCGTC
TTCGCCGCCCCCGTCGCCCCCGCCGCGATGGACGCCGCCGTCGACCGCCTCAAGGATGGGTTCGCCAAGTTCAAGACCG
AGTTCTATGACAAGAAGCCGGAGCTCTTCGAGCCGCTCAAGGCCGGCCAGGCACCCAAGTACATGGTGTTCTCGTGCGC
CGACTCTCGCGTGTGCCCGTCGGTGACCATGGGCCTGGAGCCCGGCGAGGCCTTCACCGTCCGCAACATCGCCAACATG
GTCCCAGCTTACTGCAAGATCAAGCACGCTGGCGTCGGGTCGGCCATCGAGTACGCCGTCTGCGCCCTCAAGGTCGAAC
TCATCGTGGTGATTGGCCACAGCCGCTGCGGTGGAATCAAGGCCCTCCTCTCACTCAAGGATGGAGCACCAGACTCCTT

```
CCACTTCGTCGAGGACTGGGTCAGGACCGGTTTCCCCGCCAAGAAGAAGGTTCAGACCGAGCACGCCTCGCTGCCTTTC
GATGACCAATGCGCCATCTTGGAGAAGGAGGCCGTGAACCAATCCCTGGAGAACCTCAAGACCTACCCGTTCGTCAAGG
AGGGGATCGCCAACGGCACCCTCAAGCTCGTCGGCGgcCACTACGACTTCGTCTCCGGCAACTTGGACTTATGGGAGCC
CTAAATccGA
```

> SEQ ID NO:2195 181971 1119602_301899_1
```
GGGCTACCCCGACACAGATCTTGAGTCCGCCATTCAAGCCCTAACCCAGCTCTTGCAGCAATCTCCGGGGTTGAAAGCA
GAAGCAGTGAAGAAGATTGAGGAAATCACGTCAGAGCTTTCCCTTGTTGAAGAACATAAGAACGGGAAGGAGATCGACC
CCGTGCTCAAGCTCAAGCATGGCTTCTCCAAGTTCAAATCCTTCTTCAAGAAAGAAGCTGAATTGTTCAAGAGTCTTGC
GGAGTCACAACACCCTAAGTTTATGATCATTGCATGCTCGGATTCAAGAGTAGATCCTGCTGTCATCCTTAATTTGGGT
CTAGGAGAAGCCTTCATTGTTCGCAATGTCGCCAATATGGTGCCACCTTACTGGGAGAGTGCTGGATCTTCCACTGCTT
CTGCCCTAGAGTACGCAGTTTTGCACTTGAAGATTGAACACCTGATGGTGATCGGGCATAGTAGGTGTGGGGGCATCAA
AGCCCTCATGTCATCCAAGGAAGATGGGTCAAACAAATTCAGTGACTATATTGAAGACTGGGTCAAcCATGGAAGAGGT
GCTGCTAaGAAggTGCAAAAGTCCCTCCCCAACAACAATTTTgacGACCAATg
```

> SEQ ID NO:2196 181971 200928_300711_1
```
cccccccctcgccgggatggacgccgccgtcgaccgcctcaaggatgggttcgccagggtcaagaccgagttctatgac
aAGAAGCCGGAGCTCTTCGAGCCGCTCAAGGCCGGCCAGGCACCCAAGTACATGGTGTTCTCGTGCGCCGACTCTCGCG
TGTGCCCGTCGGTGACCATGGGCCTGGAGCCCGGCGAGGCCTTCACCGTCCGCAACATCGCCAACATGGTCCCAGCTTA
CTGCAAGATCAAGCACGCTGGCGTCGGGTCGGCCATCGAGTACGCCGTCTCGCGCCCTCAAGGTCGAACTCATCGTGGTG
ATTGGCCACAGCCGCTGCGGTGGAATCAAGGCCCTCCTCTCACTCAAGGATGGAGCACCAGACTCCTTCCACTTCGTCG
AGGACTGGGTCAGGACCGGTTTCCCCGCCAAGAAGAAGGTTCAGACCGAGCACGCCTCGCTGCCTTTCGATGACCAATG
CGCCATCTTGGAGAAGGAGGCCGTGAACCAATCCCTGGAGAACCTCAAGACCTACCCGTTCGTCAAGGAGGGGATCGCC
AACGGCACCCTCAAGCTCTTCGGCGGCCACTACGACTTCGTCTCCGGCAACTTGGACTTATGGGAGCCCTAAATCCGAC
CGTCCGTCCGTTCAGTTCGTCAGTTTACGCCAACGCTTTTGCATAAGTACTACCTGAGGATATCGTCCCCGATCATCGA
TGTGAACGCGTGGAGTACTACTACGTACGTACCGGATGGTTCGATATATGTGAATGCTGTATTAAGTAATAACAAGAAA
TATATCTCCTCTACTTTTTCCTGACGCGGAGTTGTACt
```

> SEQ ID NO:2197 181971 126630_300465_1
```
CAAAAGCTAAAAAGGAAGTTGTTGAGCCAAATGTCAACTGCTTCCATTAACAGTTGCCTTACTATTTCCCCAGCTCAAG
CTTCCCTTAAAAAACCAACTCGTCCTGTTGCTTTTGCTAGGGTTAGCAACTCTTCTTCTTCTCCTTTTGTTCCCAGTCT
CATCAGAAACGAGCCCGTCTTCGCCGCCCCTACTCCCATCATCAACCCCATTTTGAGAGAAGAAATGGCAAATGAATCC
TACGAGCAGGCCATTGCTGCACTCGAGAAACTCCTCAGCGAGAAAGGAGAACTTGGACCAATTGCTGCAGCAAGAGTTG
ACCAGATTACAGCTGAATTGCAATCATCAGATGGCAGCAAACCATTTGACCCTGTTGAGCACATGAAAGCTGGCTTTAT
TCACTTCAAAACTGAGAAATATGAGAAAAACCCAGCCTTATATGGAGAACTATCAAAAGGCCAGAGCCCCAAGTACATG
GTCTTTGCCTGCTCTGACTCACGAGTGTGCCCATCCCATATCCTGAACTTCCAACCTGGTGAAGCTTTCGTGGTTCGGA
ACATTGCCAACATGGTCCCTGCTTATGACAAGACCAGATACTCTGGAGTCGGAGCAGCTATCGAATACGCTGTTCTCCA
CCTTAAGGTAGAAAACATTGTTGTCATTGGCCACAGCGCTTGTGGAGGTATCAAAGGTCTCATGTCTCTACCCGCAGAT
GGTTCTGAATCAACTGCCTTTATTGAGGATTGGGTGAAAATTGGTTTACCTGCCAAGGCCAAGGTGCAGGGCGATCACG
TGGATAAATGTTTTGCAGATCAATGCACAGCTTGTGAGAAGGAAGCTGTGAATGTGTCACTTGGAAATTTGTTGACCTA
TCCATTTGTGAGAGaaggATTGgTGAAGaAAACAcTaGCAtTgaagggAGgTCACTATGAt
```

> SEQ ID NO:2198 181971 1171116_302052_1
```
TCTCTGTTCTCTCTCTCATCCCCAAGCAAGGCTTCTCTCTCATGGTCATCAGCTAGCCCATTGCCTGCCCCAACAATGG
ACCTCCATGTATAGAAAATTGGCCACTCTACCACCTTCTTCTACCTCATCCTCCTCTCGATTGCCCAAGATTAGTGCAG
TACAAGAGGCTCTTCACCCAATTGAGAAAATAAAGCAAGGATGTGTTACTTTCAAGCAAACCAACCTTTTGACAAGGCC
AGAAGTGCATGAACCACTGAAGTCTGNCCAAACCCCAAAGGTGATGGTGATCTCGTGCTCCCGATTCAAGAGTATGCCC
AACCCAAGTATTTGCATTGGATGCAGGTGAAGCATTTGTGGTTCGAAGTGTCGCCAACTTGATTCACCTTTTGGAGAG
GAAGGCTTCCCTGGCACTAGTGCAGCTCTAGAGTACGGTGTTCTCCATCTCAAGGTAGAACATATCTTTGTTGTTGGAC
ACAGCATGTGTGGAGGAATCAAAGCTCTCATGTCAATTCCAGATGATGCACCTAAATCCACATGGTTCATCGAAGATTG
GATCAAGATCGGAAAGCCAGCTCGAAATGCAGTGCTAAGCCGCTTCGCCTCCTCCCCCTTGGATCAACAATGTAGACAT
GGTGAAAAGGAAGCCGTGAATATGTCACTTGCAAACCTTATGAGCTTCCTTTCA
```

> SEQ ID NO:2199 181971 1118735_301858_1
```
GGGTTCGAACCGGAGCACCGCCAATATGAAATAGCTTTTGCGCTTCTGCAAATACTATTATGATAAACGACACGAGGTT
CGCGCAGTCTATAAATGGAGGCTGAACCCAGGAAGGCTTCAGGAATGTGGAGTTGCTGCCTTCCCTTGAAATCTTCTCG
AGAAATCAAACCCTCCACTGCAGTCTCAGCTCTCCCTGCTCAGCAGAATAAGATGGGTCAATTCGATAGCAGTGATTCT
GAATACACTTCCGCCATTGAAGCCCTCTCCACCCTCTTGAAGAAATCCCCCAGCTTGAAGGCAACAGCAGTCCAGAAGA
TTGAAGAGTTGACTAGCGAGCTAAGCCAGAGCGAACGCAGAGACCTGCAAGGACGATTTAGTCGATCCCTTGCATAAACTCAA
```

FIG. 2 continued

```
GCTCGGCTTCTCCAAGTTCAAATCTTTCTACAAGAAAGAGGCGGAGATGTTCAAGAGTTTGGCAGAATCCCAGCACCCT
AAGTTCATGATAATAGCGTGCTCAGATTCGAGAGTCGATCCTGCCGTTATATTGAACCTGGGTTTGGGAGAAGCCTTCA
TAGTTCGCAATGTGGCCAATATTGTGCCACCCTTCTGGGAGAGTTCTGGATCATCCACAGCGTCTGCCCTTGAATACGC
CGTCCTCCATCTGAAGGTGGAGCATCTCATGGTCA

> SEQ ID NO:2200 181971 232568_301216_1
attcaccacgcgtccgggtttcttccaTGCCTTCGATGCAGCGGTCCCAGgCCTCCCCAGCCCCGAATTTcCGTCCTGG
GATCGTTCTTCCGGTAGCTACGCGTCTCGGCTCTGGAATGcggcggccgGATTGGGGAGAAGGACCTGTTTCTTGCAGC
AGGTTGTTCATCAGGATGGTCACCAGGTTGTTcATCATCAGGATGGtcaccaggttgttcaTCATCAGGATGGTCACCA
GGTTGTTCATCACCAGAAGACGCTGGCAGCGGAAAGGATTAAGCGGGGTTTTCAAGGGTTTAAGCAAGACACATACCGT
CAAAAACCGGAGCTCTTCGGTCGATTAGCTATCGggaCAGCATCCcaagTTcATGGTGATTgctttgCTCTGACTCTAG
AgtttgTCCCACGACGATCCTGAGGTTCCAGCCAGGAGAGGCatttgTCATCCGCAACATTGCAAACATGGTGCCTCCT
CCGGAAAAGGTACACTGACcttgctttgtGCTCGTTCGCTCAgCtCAAAGGCAAGGCTTTcAgGCTggCTATCCAGGAA
CcaGTGCAGCTCTCGAGTACGCAGTCATGGTTCTCAAGGTCGAGAACATTCTAgtgAtTGgaCATAGTCGCTGCGCCGG
TATCGAAGCTCTGATGACACgcAanaccaAGTGGAgGTCAGTCTTAcgaAGCTACGTACCaaGGActCGGGCTCTTTCt > SEQ ID NO:2201 181971 237077_301250_1
GGTCCAGATAGCTTCTTCGTGACCCCGGGAGCTATACTTGACCCCTTGTCTGGTCGATTCATCGAGAGAACGAAGTCGC
TGTCCAATTCAATCGGTCTTGAAAGAATGGCGCCAGAGAAAACGTTCGAGGAGGCGCAGGAGATTCTTCTCCACAAGAT
CAAGATCTCTCCGAATCTAAAGCCGATTGCCGCAAAGAAGCTGCTGGATCTCGCCAAGGAGCTGGATGGTGGAGAGGAA
GAAGAGAAGGTGGCGGATTTATCCCTGGTCGATGTTCCAGCGGCAGAGAGAATCAAGCAGGGATTTACAAAGTTTAAAA
ACGGGTTCTGGCTCAAAAATCAGAAGCTTTACGAGAAGCTTTCAACTGGCCAGTCACCGAAGTTCATGATCTTCGCTTG
CTCCGATTCGCGAGTTTCTCCAACGACGATCTTGGGTCTACAACCCGGCGAAGCATTCGTTGTTCGCAACATTGCGAGC
ATGATTCCAGCTTGTGGTGAGACTGGATTTCCAAGCACTAGCGCTGCTCTCGAGTATGGAGTCTTACACCTCAAGGTGG
AACATATTCTAGTGATCGGTCACAGTCGCTGTGGAGGAATCAAAGCTTTGCTCACCACTGACCCCGAGAACAAATGGAG
TGACTTCATCCAAGACTGGaTcAaaATct > SEQ ID NO:2202 181971 236336_301249_1
gccatcgccatcgtcgccatggcttcctctttgcgctgctgccaagcgttGCCTGCCTCTGATTTCCTGGCCAGGAACC
AGATCTCCACCGAAGCTCTCCCGGTGAGGCTGCCGCAGCCGAGCAACGCAGCTGCCAGGCGAAAGATCTGCTGCTCGCA
GCGGCCACATTTTGTTGTCGACACCAAGGTGACCGCGCGGAGAGGATCAAGCAAGGCTTCCAGAAGTTCAAGGAGGAG
ACATACACGAAGAATCCGGAGCTCTTCAATGCGCTCTCTGACGGACAATATCCCAAGTTCATGGTGATTGCTTGCTCCG
ACTCGAGAGTGTGCCCGTCCACAGTTCTTGGCTTCCAGCCGGGAGAGGCTTTCGTCGTTCGCAACGTTGCAAACATGGT
GCCTCCTCCAGAACAGGCCGGCTACCCTGGAACAAGTGCCGCTCTCGAGTACGCAGTCACAGCTCTCAAGGTGGAGAAC
ATCTTGGTGATCGGACACAGCAGATGTGGAGGAATCAAAGCTCTCATGACTCAGAAAGACAATGCAGCGAAATGGAGTG
CGTTCATCGAGGACTGGATCGAGATCGGTCGCCCCGCCCGTTCCTCAACTCTCAAATCTGATGCTGAGCAAAAGATCGA
GTCTCAGTGCACGAAATGcgAGAAGGAATCTGTGAACGTTTCCTTGTCCAATCTTCTCGCGTTCCCGTTCGTCAAAGAG
GCAGTGACCAGTGGCAAAGTCGCTCTTCACGGTGgctACTACAATTTTgTcgaCGgctCGTTCGAGTACTGGACGTATG
GAGCTGATGGAAAGCcCAGCGAGATCACCAAGTTCTAAAACAGAACAAGAGAGAAACAGAAattatACATCCATaaACc
TGtaagaaCTCAcc > SEQ ID NO:2203 181971 233988_301095_1
tttCATGCCTTCGATGCAGCGGTCCCAGGGCCTCCCCAGCCCCGAATTTCCGTCCTGGGATCGTTCTTCCGGTAGCTAC
GCATCTCGGCTCTGGAATGCGGCGGCCGGATTGGGGAGAAGGACCTGTTTCTTGCAGCAGGTTGTTCATCAGGATGGTC
ATCAGGATGGTCACCAGGTTGTTCATCACCAGAAGACGCTGGCAGCGGAAAGGATTAAGCGGGGTTTTCAAGGGTTTAA
GCAAGACACATACCGTCAAAAACCGGAGCTCTTCGGTCGATTAGCTATCGGACAGCATCCCAAGTTCATGGTGATTGCT
TGCTCTGACTCTAGAGTTTgTCCCACGACGATCCTGAGGTTCCAGCCAGGAGAGGCATTTGTCATCCGCAACATTGcaA
ACATGGTGCCTCCTCCGGAAAAGgctGGCTATCCAGGAACCAGTGCaGctcTCGAGTACGCAGTCATGGTTCTCAAGgT
cGAGAACATTCTAgTGATCGGACATAgTCGCTGTgccGGTATCgaagctcTGATGacAcgcAACAccaagtggagttCg
tTccTTgaagac > SEQ ID NO:2204 181971 56246_300126_1
ACGCTTATCCGTAACGAGCCAGTTTTTGCCGCTCCTGCTCCTATCATTGCCCCTTATTGGAGTGAAGAGATGGGAACCG
AAGCATACGACGAGGCTATTGAAGCTCTCAAGAAGCTTCTCATCGAGAAGGAAGAGCTAAAGACGGTTGCAGCGGCAAA
GGTGGAGCAGATCACAGCGGCTCTTCAGACAGGTACTTCATCCGACAAGAAAGCTTTCGACCCCGTCGAAACCATTAAG
CAGGGCTTCATCAAATTCAAGAAGGAGAAATACGAAACCAACCCTGCTTTGTACGGTGAGCTCGCAAAGGGTCAAAGTC
CTAAGTACATG
```

FIG. 2 continued

> SEQ ID NO:2205 181971 52674_300090_1
CCCACGCGTCCGCTCTGGCTCATCATCTTCAAACTGTTACCACGTCCATAGGGTTGTCGAAGAGCTAGGAAGAGCCTTA
CCAAGAGCTTCTTCTTCCCCTAACATTTAGGTTGGTAGGAGAAGCAAAGGAAGAGATCATTTATAATGGCTCCTGCATT
CGGAAAATGTTTCATGTTCTGCTGCGCTAAAACCTCCCCGGAAAAAGACGAAATGGCAACGGAATCGTACGAAGCCGCC
ATTAAAGGACTCAATGATCTTCTCAGTACGAAAGCGGATCTCGGAAACGTCGCCGCCGCGAAGATCAAAGCGTTGACGG
CGGAGCTAAAGGAGCTTGACTCAAGCAATTCAGACGCAATTGAACGAATCAAGACCGGTTTTACTCAATTCAAAACCGA
GAAATATTTGAAGAATAGTACTTTGTTCAATCATCTTGCCAAGACTCAGACCCCAAAGTTTCTGGTGTTTGCTTGCTCT
GATTCTCGAGTTTGTCCATCTCACATCTTGAATTTCCAACCTGGTGAGGCTTTTGTTGTCAGAAACATAGCCAATATGG
TTCCACCTTTTGACCAGAAGAGACACTCTGGAGTTGGCGCCGCCGTTGAATACGCAGTTGTACATCTCAAGGTGGAGAA
CATTTTGGTGATAGGCCATAGCTGCTGTGGTGGTATTAAGGGACTCATGTCCATTGAAGATGATGC

> SEQ ID NO:2206 181971 291672_200080_1
TTAAAAGGAAATTCTTGAGccaAATGTCAACTGCTTCCATTAACAGTTGCCTTACTATCTCCCCTGCTCAAGCTTCCCT
TAAAAAACCAACTCGTCCTGTTGCTTTTGCTAGGGTTAGCAACTCTTCTTCTTCTCCTTCTGTTCCCAGTCTCATCCGA
AACGAGCCCGTCTTCGCCGCCCCTACTCCCATCATCAACCCCATTTTGAGAGAAGAAATGGCAAACGAATCCTACCAGC
AGGCCATTGCTGCACTCGAGAAACTCCTCAGCGAGAAAGGAGAACTTGGACCAATTGCTGCAGCAAGAGTTGACCAGAT
TACAGCTGAATTGCAATCATCAGATGGCAGCAAACCATTCGACCCTGTTGAGCACATGAAAGCTGGCTTTATTCACTTC
AAAACTGAGAAATATGAGAAAAACCCAGCCTTATATGGAGAACTATCAAAAGGCCagAGCCCCAAGACCagATACTCTG
GAGTTGGAGCAGCTATTGAATACGCTGTTCTCCACCTTAAGgTAGAGAACATTATCGTCATTGGCCAcAGTGCATGTGG
AGGTATCAAggTCTCATGTCTCTACCTGCAGATGGTTCTGAATCAACTGCCTTTATTGAggAttgGGTGAAAATTGGt
ttACCTgccaaggccaaggtGCAgggCGAACATGTGGATaAATGTTTTGCagatcaaTGCacagCtTGTGagaaggaag
CTGTgAATGTATCACtTGGa > SEQ ID NO:2207 181971 254610_301634_1
AACTCGACAGCGTCGCCACGCGTCGCCACGCGTCGAGCCCTTTCCTCTATCTCTCTCTCTCATCCTCTCTGTTCTCTCT
CTCTCATCCCCAAGCAATGGCTTCTCTCATGGTCATCAGCTAGCCCATTTGCCTTGCCCCAACAATGGACCTCCATG
TATAGAAAATTGGCCACTCTACCACCTTCTTCTACCTCATCCTCCTCTCCATTGCCTAAGATTAGTGCAGTACAAGAGG
CTCTTCACCCAATTGAGAAAATAAAGCAAGGATTTGAGACTTTCAAGCAAACCAACCTTTTGACAAGGCCAGAAGTGCA
TGAACCACTGAAGTCTGGCCAAACCCCAAAGGTGATGGTGATCTCGTGCTCCGATTCAAGAGTATGCCCAACCCAAGTA
TTTGGATTGGATGCAGGTGAAGCATTTGTGGTTCGAAGTGTCGCCAACTTGATTCCACCTTTTGGAGAGGAAGGCTTCC
CTGGCACTAGTGCAGCTCTAGAGTACGGTGTTCTCCATCTCAAGGTGGAACATATCTTTGTTGTTGGACACAGCATGTG
TGGAGGAATCAAAGCTCTCATGTCAATTCCAGATGATGCACCTAAATCCACATTGTTCATCGAAGA > SEQ ID NO:2208 182002 232875_301218_1
GGTGAAGTCTGTGGGGAAGAAATCTAGGGTTAGAAGGCCGTGCGCCAGGAAGCGGCCCAAGGGTAGTTAGAACCAGCAC
TTCGCGGCGCACCACTGACGAGTTCTTCGCGACTTTTTTGGTAGCGTATTGGAATTTGGGGCGATTCTAGTTCTGGCAA
TGGCGGCAACGCCCAGTGGCCTCCAGACCAGGGTCGGGAAGTATGAGCTGGGAAAGACGATTGGCGAGGGCAATTTCGC
CAAGGTTCGGCGAGCCAGGAATCTCGACACTGGCGAGATCGTGGCGATCAAGGTCCTCAACAAAGAGGAGGTGATGAAG
CACAAAATGGTCGAGCAGCTCAAGCGGGAGATTTCGACCATGAAGCTAGTAAAGCATCCAAACATTGTCCAGCTCCACG
AGGTTCTGGCCAGCAAAACTAAAGTTTACATCGTTTTAGAGTACGTCACTGGTGGAGAACTTTTTGACAAGATCGTGAA
ACAAACCCGCTTGAAAGAAGACGAGGCAAGGAAGTATTTCCAGCAGCTCATCAATGCAGTTGACTATTGCCACAGCAGG
GGTGTGTATCACCGCGACTTGAAGCCGGAGAATTTGCTTCTCGATAAAAATGGAAACTTGAAGATCTCTGACTTCGGTT
TGAGTGCGCTTCCGCAACATCTTCGGCCGGATGGTCTACTTCACACT > SEQ ID NO:2209 182002 242159_301326_1
TTTGAAGAGATGAGCTTCCAAAGCAAAGTGATGAGAACTCGCGTCGGGAAGTACGAGCTGGGAAGAACTCTTGGAGAGG
GGACGTTGGCAAAGTTAAGTATGCCAGGAACTTTGAGAGCAACGAGAGTTTTGCGATCAAGATTCTGGACAAGGAGAAG
ATCTTGAAGCACAAGATGGTCGAGCAGATCAAGCGAGAAATCTCCACCATGAAGCTGGTGAAACATCCCAACATCATCC
AGCTCTTTGAGGTCATAGGCAGCAAAACAAAAATTTATATGGTGATGGAGTATGTCACAGGTGGAGAAATGTTTGACAA
AATTGCACGCGAGGGAAAGCTAGATGAACATAAAGCTCGAAAGTATTTCCAGCAATTGATTGATGCCGTGGATTATTGT
CACAGCAGAGGTGTTTGTCACCGTGACTTAAAGCCGGAGAATTTGCTCTTGGATTCAGATGGAAATCTGAAAATCTCGG
ACTTCGGATTGAGTGCTCTTCCTGAGCAGTGCCGAAAAGACGGCCTTCTTCATACAACTTGTGGAACACCGAATTATGT
AGCACCCGAGGTCGTCAGTGACAAAGGCTACGACGGTTTCAAAGCGGATATCTGGTCTTGCGGCATCGTCTTGTACGTT
ATCCTGGCTGGATATTTGCCATTTGACGAGCCTAATCTGGTTGCATTGTACAAAAAGATGCATCGAG > SEQ ID NO:2210 182007 254574_301633_1
GGGCCAAACGGGCTTTTTCTCTCTCTCTCCGCATTTTCGAAGAACTCTGCTTCTTCAACACAGGGCTTGGCCTCTCCTT
CTCTCTCCTCCGCCATCCAAGGACCCCTTCCTGTACAAGTGAAGCGATGGCGGACGGGGCAGAAACAGACAAGAACATT
GAGATATGGAAGATCAAGAAGCTGATAAAGGCTCTGGAGTCTGCCCGTGGCAATGGTACCAGCATGATCTCTCTCATCA

FIG. 2 continued

```
TGCCCCCTCGTGACCAGATCTCCCGTGTGGCTAAGATGCTCGGCGATGAGTATGGTACTGCCTCCAACATCAAGAGCAG
GGTCAACAGACAATCGGTATTGGGTGCCATCACCTCTGCCCAACAACGTCTCAAGCTCTACAACAAGGTCCCCCCGAAC
GGTCTTGTCCTCTACACAGGTACGATTGTTACAGACGACGGCAAGGAGAAGAAGGTTACAATCGACTTCGAGCCCTTCA
AACCCATCAACGCATCTCTCTATCTTTGCGACAACAAGTTCCACACGGAGGCCCTCAATGCGCTCCTAGAGTCGGACGA
GAAGTTNGGGTTCATTGTTATGGACGGAAATGGAACACTTTTTGGAACCTTGAGTGGTAACACCCGTGAGGTCCTCCAC
AAGTTCACGGTCGATCTACCAAAGAAGCACGGGAGAGGAGGGCAATCTGCGCTTCG

> SEQ ID NO:2211  182007_104287_300060_1
CTTTTTTCTCTCTCGCGTTCTTCTCTAAGGTATGTTCCAAAGGTCTGTATACAATGTCGGATGGTCAGGAGAGTGATAA
GAACATTGAAATATGGAAGATAAAAAAACTTATCAAGGCACTGGAAGCTGCTAGAGGTAATGGCACCAGCATGATTTCA
CTTATCATGCCTCCACGTGATCAGGTATCTCGTGTTACCAAGATGCTTGGAGATGAATTTGGAACTGCATCAAACATTA
AGAGCAGAGTGAATCGGCAATCTGTGCTTGGTGCAATCACATCTGCTCAGCAGAGGCTTAAACTCTACAACAAGGTACC
GCCGAATGGACTTGTCCTTTACACTGGAACAATTGTGACTGATGATGGGAAAGAGAAGAAGGTGACAATTGATTTTGAG
CCCTTCAAGCCCATAAATGCATCACTCTATCTTTGTGATAATAAGTTCCACACAGAAGCTTTGAATGAACTTTTGGAAT
CTGATGACAAATTTGGATTTATAGTAATGGACGGGAATGGTACTCTTTTTGGGACATTGAGTGGAAACACCCGAGAGGT
CCTTCATAAGTTTAGCGTTGATTTACCCAAAAAGCACGGAAGAGGAGGACAATCAGCCTTGCGTTTCGCTCGTCTCCGA
ATGGAGAAACGGCACAACTATG

> SEQ ID NO:2212  182007_135661_300416_1
CGCACACGAACATCACCTCAGGCGCTCGCTCGCCGCGCCGCGGCGCCCGGCCATCTCGCTCGTTCACGCAGGCGAAGAG
AGCTGTAAACACTAGCCAAGATGGGCGAGGGACATGAAACCGACAAGAACATTGAAGTATGGAAGGTCAAGAAATTGAT
CAAGGCACTTGATGCTGCCAGGGGCAACGGAACGAGCATGATTTCGCTTATCATGCCACCTCGTGATCAGGTCTCCCGA
GTCACCAAGATGCTGGGTGATGAGTATGGAACTGCCTCTAACATCAAGAGCAGAGTCAACCGTCAGTCCGTGTTGGCCG
CCATAACTTCTGCCCAACAGAGGCTGAAGCTGTATAGTCGAGTTCCGCGAATGGATTAGTGCTCTATACTGGGACCAT
TGTCACCGATGACGGCAAAGAGAAGAAGGTCACCTTCGACTTTGAGCCGTTCAGGCCGATTAACGCTTCGCTGTATCTG
TGTGACAACAAGTTCCACACAGAGGCACTGAATGAGCTTCTGGAGTCTGATGACAAGTTTGGTTTCATAATCATGGATG
GCAACGGAACACTGTATGGTACACTTAGTGGCAACAG

> SEQ ID NO:2213  182007_182092_300598_1
GAATTCAGAGAGAGTTTTCCTCCTCCTCTTTCTCTCTTTACTTTCAGTTCTTCTTCATCCAAGAAGGAGAAGAAGAAAG
CTTAGACAGGTTAGTGTTCTTCGTGCTTGGATATATTTCAAATCTCTTGCAATGTCAGACAGTCAGGATACTGATAAGA
ATATCGAGATATGGAAGATCAAGAAATTGAATAAAGCGCTAGAAGCTGCTAGAGGTAATGGTACCAGCATGATTTCTCT
CATCATGCCACCACGAGATCAGGTTGCTCGGGTCACTAAGATGTTGGGTGATGAATTTGGTACTGCCTCAAACATCAAG
AGTAGAGTTAACCGTCAGTCAGTATTGGGTGCGATTACCTCTGCTCAACAGAGATTGAAACTTTACAATAAGGTCCCTC
CAAATGGTTTAGTTTTGTACACAGGAACTATCATGACAGATGATGGGAAGGAGAAGAAGGTTACAATTGATTTGAGCC
TTTCAAGGCAATTAATGCATCATTGTACCTTTGTAATAATAAGTTTCATACGGAGGCTCTAAATGAACTTTTGGAATCT
GATGACAAGTTTGGTTTCATAGTCATGGATGGAAATGGTACAcTttTTggGAcactaagTGGgaACAcacgTgaagtGC
TTCATAAgttcacA > SEQ ID NO:2214  182007_155462_301356_1
CGCGTCGCGAATAACAAGGATGTGGCAGAAGAATATGGTACTGCGTCCAATATTAAGAGCAGAGTAAATCGTCAGTCCG
TCCTTGGTGCAATAACGTCCGCCCAGCAGAGGCTTAAGCTGTATAATAAGGTACCTCCTAATGGGTTGGTCCTTTATAC
TGGAACTATAATGACCGACGATGGGAAGGAAAAGAAGGTAACCTTTGACCTTACACCTTTTAAGCCAATAAATGCGTCT
CTGTACCTATGTGACAACAAGTTTCACACGGAGCCTCTGGGCGAGCTGTTGGAATCAGATGAGAAGTTTGGTTTCATTG
TCATGGACGGTAATGGCACTCTTTTCGGAACCTTAAGTGGCAACACTAGGGAAGTCCTTCATAAATTCACTGTTGACCT
TCCCAAGAAGCACGGAAGAGGAGGTCAATCAGCTTTGCGATTTGCTCGTCTTCGAATGGAAAAACGGCATAACTATGTG
AGGAAGACAGCAGAGCTTGCTACTCAATTCTTCATTAATCCAGCCACTAGCCAGCCAAATGTATCTGGACTAATACTTG
CTGGGTCAGCTGATTTCAAGACAGAGCTGAGCCAGTCTGATATGTTTGATCAACGCCTACAAACAAGATACTTAATGT
GGTTGATGTGTCCTATGGTGGGGAAAATGGATTCAATCAGGCTATTGAGCTATCTGCTGAGATTCTCGCGAATGTGAAG
TTATACAAGAA > SEQ ID NO:2215  182081_1120184_301862_1
CCTCTCCCATTCGTGGATTGGCTCTTGGAGAAGAAGGGTTTCGAGGTTTCTTGGCCAGTCTATATTCTGGCAAGCGGTT
GTGAAGGTGGGCATTGCTGTCTCTGAAGGGTCTTTACATCATCATCAGGGTAGGTAACAATGTCAGGAGCAGGGCAACG
TCTAAATGTAGTCCCGACAGTAACAGTTCTAGGTGTGATTAAAACTCGTTTGGTGGGTGCAACGAAGGGGCATCAGCTA
CTAAAGAAGAAGAGCGATGCATTAACAGTACAGTTCCGTCAAATCCTAAGGCACATCGTACAGACTACAGAGGCCATGG
GGGACTCTATGAAAGCCGCTGCTTTT
```

FIG. 2 continued

> SEQ ID NO:2216 182081 181992_300658_1
gaattccgaattcagtcattttctcgctcgctctcttgtttcgtaaaaattttctatcttgaattaagatctggggatg
gCGGGACAAAATCAAAGATTAACAGTAGTACCAACAGTCACAATGCTTGGAGTAATGAAAGCACGTTTAATAGGAGCAA
CAAGAGGTCATGCTTTACTTAAGAAGAAATCTGATGCATTAACTGTTCAATTTCGTCAGATCTTAAAAAACATTGTTTC
AGCTAAAGAATCAATGGGTGATATTATGAAAACTTCATCATTTGCTTTGACTGAAGCTAAATATGTAGCTGGTGAGAAT
ATTAAACATACTGTTCTTGAAAATGTTCATAACGCTTCGTTAAAGGTGAGATCGCGTACTGAGAATGTTGCTGGAGTTA
AATTACCCAAGTTTGAGTATTTCACTGAAGGTGAAACTAAGAATGATTTGACTGGATTAGCACGAGGTGGACAACAGGT
GCAACTTTGTAAGGCTGCTTATGTCAAAGCAATTGAAGTTCTTGTTGAACTTGCTTCGCTTCAAACGTCTTTTTTGACT
CTTGATGAAGCAATTAAGACTACTAATCGCCGTGTTAATGCTCTAGaGAATGTTGTGAAGCCTaggATTGAGAATACTA
TTAGTTATATCAAGGGTGAATTGGATGAACTTGAAAgagaggATTTCTTtaggtTGAAgaagaTtcaagggTATAAAAg
gagagagaTGGa > SEQ ID NO:2217 182081 156062_301362_1
aaatcctcgcgatctttctctcccttaccgacgaatacgacttctaaagtagcttggcataatgtccggccaaagccag
cGTTTGAATGTCGTTCCTACAGTAACAATGCTTGGTGTGATCAAAGCTCGCcttgttGGTGCTACAAGAGGCCATGCTC
TGCTTAAGAAGAAGAGTGATGCTTTGACTGTGCAGTTCCGTCAGATTCTAAAGGACATCGTGTCAACGAAGGAATCAAT
GGGAGATGTCATGAAAACTTCCTCCTTCGCTCTGACAGAGGCAAAATATGCTTCTGGCGAGAACATTAAGCATGTTGTC
CTTGAAAATGTCCAGAATGCAACCATTAAAGTTAGATCTCGCCAAGACAATATTGcaGGTGTAAAGCTCCCGAAATTTG
AGCATTTCTCTGAAGGAGAGACAAAGAATGACCTGACTGGATTAGCTAGAGGGGGGCAACAGGTGCAAGCTTGCCGTGC
TGCTTACGTGAAATCTATTGAGTTGCTTGTTGAGCTTGCCTCTCTACAGACATCATTCTTGACGCTTGATGAGGCGATC
AAGACCACAAATCGCAGGGTTAATGCATTGGAGAATGTTGTGAAGCCACCGGTTGGAGAACACAGTGCTTTACATCAAAG
GAGAACTTGATGAACTGGAAAGGGAAGATTTCTTTCGTCTAAAGAAGATACAAGGTTACAAGAAGAGGGAGGTAGAGAG
ACAGATGCTGGCTTCCAAGCAATACGCAGAGGAGAAGGCTGCaGAAGAAATTTCCTTGAAGAGAGGTATTTCGCTAGGT
ACAGCCCATAACTTGCTATCCCATGCTTCACAGAAAGACGAGGACATTATTTTCTGATAAGGAGGTCAAATGATTTATT
TAAATTGCATTGCGTGGCTTGttTTTATGTGTCCTTTATTACGAAtGGATAATTGATTagatgGAGAGTCTTTTCGCAT
TTAATAaGagctcTATGCAtGttTgtatttaaAGttaaTTTATagacaatAtGggtggttacctctta > SEQ ID NO:2218 182081 232517_301216_1
AAAGAGGAGGAGAGAGATCCGGCGATGTCGGGGCAGCAGCAGCGCCTCAATGTGGTGCCGACGGTCACGGTGTTGGGCG
CGATCAAGGCGCGGCTGATCGGCGCCACGAAAGGTCACCAGCTCCTCAAGAAGAAGAGCGATGCCCTGACGATGCAGTT
CCGGCAGATCCTCAAGCGCATCGTCCAGACCAAGGAAGCGATGGGCGACACCATGAAGTCGGCATCGTTCGCCCTCACA
GAGGTAAAGTATACAGCCGGCGACAGCATCAAGCACATAGTTCTAGAGAATGTGGACGTGGCGACGATCAAGGTACGAG
CAAAGCAAGACAATGTAGCCGGTGTCAAGCTTCCAAAATTCGAGCACTACGTCGAGGCCGTGGGAGACGAAGAACGATCT
AACCGGCTTGGCCAGAGGTGGCCGACAGGTCCAGCTCTGTAAGTCGTCGTTCATCAAGGCGGTGGAGCTGCTGGTGGAG
CTGGCGTCGCTGCAGACATCTTTCCTGACGCTGGACGAGGCGATCAAGACGACCAACCGGAGAGTGAACGCTCTGGAGA
ACGTCGTCAAGCCGAGGATCGAGAACACCATTCTCTACATCAAGGGCGAGCTGGACGAGCTCGAGAGAAGAGTTCTT
CCGGCTGAAGAAGATCCAGGGATTCAAGAAGAAGGAGGTCgagag > SEQ ID NO:2219 182081 267072_200088_1
GTTCTTGGCACAGTTGACCCAACTCTCTTCTTCTGCCGAGTTTATCTAATCAATCTCCTCCTGATCTCCTTCTTCTCCG
TGCGAAATCTACTTAGTAGTTTAGCAAAATGTCCGGGCAAAGTCAGCGTTTGAATGTTGTACCCACAGTTCCANGTTGG
GGGTATTAAAGCTCGCCTTGTTGGAGCAACAAGAGGCCATGCTTTGCTGAAAAGAAAAGTGATGCTTTGACTGTGCAA
TTCCGTCAGATTCTAAAGAATATAGTGTCAACAAAGGAATCAATGGGAGAAGTCATGAAAGACTCCTCCTTTGCTCTGA
CTGAGGCAAAATATGCTGCTGGTGAACATCAAGCACGTTGTCCTTGAAAATGTCCAGAATGCAACTCTTAAAGTTCG
ATCTCGGCAGGAAAATATTGCTGGGGTGAAGCTTCCCAAGTTTGAACATTTCTCTGAAGGGGAGACCAAGAATGACCTG
ACTGGATTAGCTAGAGGTGGGCAACAGGTACAAGCCTGTCGTGCTGCTTATGTGAAATCTATTGAGTTACTTGTTGAGC
TTGCATCGCTGCAAACATCATTCTTGACTCTTGATGAGGCAATCAAGACCACAAATCGGAGGGTCAATGCCTTGGAGAA
TGTTGTAAAGCCTCGGCTGGAGAATACAGTTCTTTACATCAAGGGGGAACTTGATG > SEQ ID NO:2220 182081 56186_300140_1
CTTACACTCTAATTTCAGTGATTTACTTGTTAATAACTCACCTTTTGAGAGGCCCAGTGGTGATATATGGCTGGCCAAA
ATGCGCGTCAGAATGTGGTTCCCACTGTTACTATGCTCGAGGTTATGAAAGCTCGTCTTGGTGGCGCTACAAGAGGCCA
TGCTCCTCCTCAAGAAAAAGAGAGATGCTTTAACTGTTCAGGTTAGGGCACTTCTCAAGAAAATCGACACAGCTAAGGAG
TCTATGGGAGATATGATGAAGACATCGTCTTTTGCTCTTACCGA > SEQ ID NO:2221 182081 254033_301631_1
TCTCCTCTCCCATTCGTGGATTGGCTCTTGGAGAAGAAGGGTTTCGAGGTTTCTTGGCCAGTCTATATTCTGGCAAGCG
GTTGTGAAGGTGGGCATTGCTGTCTCTGAAGGGTCTTTACATCATCATCAGGGTAGGTAACAATGTCAGGAGCAGGGCA
ACGTCTAAATGTAGTCCCGACAGTAACAGTTCTAGGTGTGATTAAAACTCGTTTGGTGGGTGCAACGAAGGGGCATCAG

FIG. 2 continued

```
CTACTAAAGAAGAAGAGCGATGCATTAACAGTACAGTTCCGTCAAATCCTAAGGCACATCGTACAGACTAAAGAGGCCA
TGGGGGACTCTATGAAAGCCGCTGCTTTTGCCCTCACAGAGGCCAAATACACCGCTGGCGACAACATCAAACACGTTGT
CCTTGAAAATGTTGACTCCGCCACAGTCAAAGTCCGGTCAAAGCAGGACAACGTGGCAGGAGTCAAACTTCCCCGTTTT
GAGTTCGTGACAGAGGCAGGGGAGTCAAAGAATGATTTGACTGGTCTTGCTCGAGGAGGTCAGCAGATCCACCTCTGTA
AATCGGCGTTTATCAAATCAGTTGAGGTTCTTGTTGAGTTGGCCTCTCTGCAGACATCGTTTCTTACCCTTGATGTGGC
CATTAAGACCACTAACCGGAGGGTCAACGCTTTAGAGAATGTGGTCAAACCCAAGTTGGAGAACACCATAAG

> SEQ ID NO:2222 182229 111293_300053_1
GGGAACCCCGACAGATAGCGCGTTTCGCGCGTACTCCGAAAGGGAATCGGGTTAAAATTCCTGAACCGGGACGTGGCGG
TTGACGGCAACGTTAGGAAGTCCGGAGACGTCGGCGGGGGCCTCGGGAAGAGTTATCTTTTCTGTTTAACAGCCTGCCC
ACCCTGGAAACGACTCAGTCGGAGGTAGGGTCCAGCGGCTGGAAGAGCACCGCACGTCGCGTGGTGTCCGGTGCGCCCC
CGGCGGCCCTTGAAAATCCGGAGGACCGAGTGCCGTCCACGCCCGGTCGTACTCATAACCGCATCAGGTCTCCAAGGTG
AACAGCCTCTGGTCGATGGAACAATGTAGGCAAGGGAAGTCGGCAAAATGGATCCGTAACTTCGGGAAAAGGATTGGCT
CTGAGGGCTGGGCACGGGGGTCCCATTCCCGAACCCGTCGGCTGCGGTGGACTGCTCGAGCTGCTCCCGCGCGAGAG
CGGGTCGCCGCGTGCCGGCCGGGGGACGGACTGGGAACGGTTCCTTCGGGGGCCTTCCCCGGGCGTCGAACAGCCAACT
CAGAACTGGTACGGACAAGGGGAATCCGACTGTTTAATTAAAACAAAGCATTGCGATGGTCCCTGCGGATGTTTACGCA
ATGTGATTTCTGCCCAGTGCTCTGAATGTCAAAGTGAAGaAATTCAACCAAGCGCGGGTAAACGGCGGGAGTAACTATG
ACTCTCTTAaggTAGCCAAATGCCTCGTCATCTAATTAGTGACGCGCATGaATGGATTaaCGAGattcccACTGtccc > SEQ ID NO:2223 182274 107111_300263_1
CATTTCTTTTTTTTGGTACGAGGAACTTATCATGAATCCGCTGATTTCTGCCGCTTCCGTTATTGCTGCTGGATTGGCC
GTAGGGCTTGCTTCTATTGGACCCGGAGTTGGTCAAGGGACTGCTGCGGGTCAAGCTGTAGAGGGTATCGCGAGACAGC
CTGAGGCAGAGGGAAAAATACGAGGTACGCTATTGCTTAGTCTAGCTTTTATGGAAGCTTTAACAATTTATGGACTGGT
TGTAGCATTAGCACTTTTATTTGCGAATCCTTTTGTTTAATCTTAGCTTAGAAATATGAAAAATAAATACATTTTTCAT
ATTTTATTGCCTTCGACTTGTCGTTTGCTTTTTCAAATTCTATCAAGATTTCCCTCCTCCAATTCTTTATTATTTGAGA
AAAGAACCTACGGGAAGGGCTGATTTGCGGATGAGGAATTAGCATACTGACTCGCTTTCATCCTTCCCGTTCATAGACC
AAGGGAAACTCTTTTTAGTAAGTGTTAGTGTTCCAATAACCAATAAAAGGGCTAGTTCATTATAATTTATAACTAACTC
GAATATTTTTCTTTTTTGACTCAATTTCATAAAAAATAAAAGAATAAATAAAAAGAGGGGTGAAGTGCTACAAAAAGA
ACTCTGTTCGATTTTTAGTCTATCTATA > SEQ ID NO:2224 182274 180842_300625_1
gaattcaacatatgtatatgtgatattagatattggctaggggggtatgaactatccatagatcttatttcctttacga
tCCCACTATGAATTTAGATGAGGATTCCAATAGAAGTCCTTCCATTTCGTCTGTGACGAATGAATAAACACATGAAACC
AAGAGCATATAGAAGAGAAAAATAACGAAGAATTGAAAGGATGCTTTGGAACTAAAAAATGGAAGAACTTGGGCCTATG
GATTGATAATTGATAAAGACTCGATGGATGGGAACGAAAAACGAGAAATCGAAGTAGTTCTGACGATTCAATAATATAA
TTACTTCAATTGGATATATCTTAGTAATGGAATCATAAGGCATTATTTATTGGTTTTGATTGTATCATTAACCATTTAT
TTATTTTGGTGCGAGGAGCTTACCATGAATCCACTGATTTCTGCCGCTTCCGTTATTGCTGCTGGATTGGCCGTAGGGC
TTGCTTCTATTGGACCCGGAGTTGGTCAAGGTACTGCTGCGGGACAAGCCGTAGAAGGTATTGCGAGACAACCAGAGGC
AGAGGGTAAAATACGAGGTACTTTATTGCTGAGTCTGGCTTTTATGCAAGCTTTAACAATTTATGGGTTGGTTGTGGCA
TTAGCACTTTTATTTGCAAATCCTTTTGTTTAATCCTAAGAATAGAAAGTTTTTTTCTAAATTTTATTGCCCTGGATTT
CCCACCTGCTTTTTTGAATTCTATCAAGATTTTACTCCTACAATCACTTTTTGATTGAGACAATATCCGTGGGAAGGAC
TGATTTGAGGATGAGGAATTAGCAGACCTACTCGCTTTCTTCCTTCCCGTTCTTAGTCCAACGAAACCCTTTTTTTAG
AAAGCGTTGCAAAAGATGAGGTATTTCACGACTGACATGAGATCTGGACCTAATTCTAATAAGTGTGTTTCTGAGTAGG
AACTTCAATTGAAATATCAAAAAAATTTCAAAATGGAAAAAAATAATAAATCAAACAATAAAAAAAGGACGAATTGATA
CAAACTCTGTTTGATTTTGTTAGTCCTATCTATAAGAGGAGATCATATGAAAAATGTAACCGATTCTTTCGTTTCTTTG
GGTCACTGGCCATCCGCCGGGAGTTTCGGGTTTAATACCGATATTTTAGCAACAAATCTAATAAATCTAAGTGTAGTAC
TTGgTGTATTGATCTTTTTTggAAAGggAGTGTtAAGTGATTTAtTAGATAATCGaaAACAGAggatcttgAgtACTAt
TCGaaAttCAg > SEQ ID NO:2225 182358 1007914_301405_1
aaccGGTGGAAGCACATTCGGCTTGTTGGTGACCATTAGAGAGGGGACAAGCATGTCTTCGACAGGGACAGAGACAGAA
ACACTACAGAAAGGGTTGCGTTTGGGTTTAAAGAAGAGCCCCTAGTGAAAAGCCTCCATTCACCTTATTGCAGCTCAAGA
AGGCAGTCCCAGCTCACTGTTTCCAGCGCTCGCTGCTACGCTCTGGATCCTATCTGGCCTTTGATTTACTCATTGCAGG
TGTCCTTTTCTACCTAACCCGATTCCTTGTGGGTGATATTGGGGTATTAGGTTGGGTCCTCTGGCCTGCCTATTGGATT
GCACAGGGGTGTATCCTAACCGGGGTTTGGGTAATTGCCCATGAATGTGGTCATCATGCCTTTAGCGATTATACCTGGG
TTGATGATCTGGTTGGGCTAGTCCTTCATTCATGGCTTCTTGTACCTTAtctttcATGGAAATACAGCCACAGAAGGCA
TCATAGTAATACTGGTAGTattgaTCGTGATGAGGTTTTCgtCCCAAAGCTTCTCGAAGACATCCCTCTTACTgccacT
CGACTGATGAATAACcCcttGggaacaa
```

FIG. 2 continued

> SEQ ID NO:2226 182358 115106_300012_1
CAACTTCAAAACCCACTTTTACACTTGGTGATATAAAAAGGGCCATACCTTCTCACTGCTTTCGTCGATCTCTTATTCG
CTCATTTTCTTATCTTGTTCAAGATCTCGTACTTATCTCCATCTTTTACTACATTGCCACTTTTTTCGACCTCTCTCCT
TTCCCTTATAATTATATTGCATGGATTTCTTATTGGATCGTCCAAGGTTTAGCTTTTTCTGCAATATGGGTCATTGCCC
ATGAATGTGGCCACAATGCGTTTAGTGATTACCAATGGGTAAATGACACTATTGGTTTAATCCTCCATTCTGCACTTTT
AGTCCCATATTTCTCATGGAGAAATGGACATCACCGTCATCACTCTAACACTGGTTCCCTTGAACGTGACACTTTTTC
GTGCCAAAGCTTACATCCGAACTAAGGTGGTACTATAAATACTTGTACAATCCATTAGGACAAGTAGTCACACTTGCCT
TCATAATCATTCTTGGCGAGCCTTTGCACATGGCATTCAATGTCTACGGCAAACCCAGTGATCTCTTTGCATGTCATTT
TGATCCATATGCTCCTATGTATAATGACCGTGAGAGAAAACAAATTTACATTTCTAATGCAGGTCTGATTGCAGCT

> SEQ ID NO:2227 182358 130244_300486_1
gaattcatacttgtgtgtgtgtttcttctctctgagCCCTCCCTTCATCTTTGGGAGTTTGGATCTCGTATCCAATAAT
GGCGAGTTGGTTCTCACCAAAATATGGTCTTAGATCCATTCTTCGTCTTCCCAGAACCTTGTTCTCCTCAGCTTCAGCA
AACAGAGTGCACAAGAACAATGAATATGCAAAGATAAATGAGGTTCAAAATGAAGCGGAGGATGATGGGTTTAATCCAG
GTGCACCACCTCCATTTAAGATTGCTGAGATCCGTAATGCCATTCCTAAACACTGTTGGATCAAGAATCCATGGAGGTC
CATGAGTTATGTTCTCAGAGATATTCTTGTGGTTGCTGCATTAGCTGCTTCTGCTGAGTATTTTAATAACTGGGTTTTC
TGGATTTTCTATTGGGCTGCTCAAGGAACCATGTTCTGGGCTATCTTTGTTCTTGGCCATGACTGCGGCCATGGGAGCT
TTTCAAACAGTCAGAAACTTAACAGTATTGTTGGACATCTTCTTCATTCCTTCATTCTTGTACCTTACAATGGATGGAG
AATCAGTCATAGAACTCATCACCAGAATCATGGACACGCTGAGAATGATGAATCATGGCACCCGTTGCCTGAGAAGGTT
TACAGAAACATGGATGATACTAGTCGAAGCCTTCGATTCACCGTTCCGTTCCCCATGTTTGCATACCCAATTTATCTGT
GGCGCAGAAGTCCCGGAAAGAAGGGTTCTCATTTCGACCCAAACAGTGATTTGTTTGCACCAAATGAGaGGAGTTGTGT
GGTTATCTCTACCCTTTGCTGGATGACAATGGCTGCATCACTTGTAGTATGTTCTTGTATAGTAGGTCCAATCCGAGTC
ATCAAGTTATACGgCATTCCATATTGGATCTTTGTAATGtggttGGATATGGTTACCTACTTGCATCACca > SEQ ID NO:2228 182358 227964_301032_1
GACCCACGCTCGGGGCGCCGCCGCCGTTCGGGCTCGCGGAGATCCGCGCGGCCATCCCCAAGCACTGCTGGGTGAAGGA
CCCCTGGAGGTCCATGAGCTACGTGCTGCGCGACGTCGTCGTGGTGCTCGGCCTCGCCGCCGCCGCCGCGCGCGTCGAC
AGCTGGCTCGTCTGGCCGCTCTACTGGGCCGCGCAGGGCACCATGTTCTGGGCGCTCTTCGTGCTGGGTCACGACTGTG
GCCATGGGAGCTTCTCAAGCAACGCCAAGTTGAACAGCGTGGTTGGACACATACTCCACTCCTCCATCCTTGTCCCATA
CCACGGCTGGAGGATTAGCCACAGGACGCACCACCAGAACCACGGTCATGTCGAGAAAGACGAGTCCTGGCAACCGCTG
TCTGAGAGGCTGTACAATAGCCTGGACTATATGACGAAGAAATTGAGGTTCACCATGCCGTTTCCCATGCTGGCATTCC
CATTATACTTGTTTGCAAGGAGTCCAGGGAAAAAAGGTTCACACTTCAACCCAAGCAGTGATCTGTTCCAAC > SEQ ID NO:2229 182358 183314_300621_1
cagaccactcgtttcctccacaaagagggagggaacaagggaagggtgtcgcccgcccccaccccgatctgcctccgc
cGCTCCGCTCCTCCGCGCCTGCGAAATCTACCAACGCTAACTCAGCAAGATGGGTGCCGGCGGCAGGATGACGGAGAAG
GAGCGGGAGGAGCAGCAGAAGCTGCTCGGCCGCGACGGCCGCGGCCGTGCAGCGGTCGCCGACGGACAAGCCGC
CGTTCACGCTGGGGCAGATCAAGAAGGCCATCCCGCCTCACTGCTTCCAGCGCTCGGTGATCAAGTCCTTCTCCTACGT
GGTCCATGACCTCGTGATCGTCGCCGCGCTGCTCTACTTCGCGCTGGTCATGATCCCCGTGCTGCCGAGCGGGATGGAG
TTCGCGGCATGGCCGCTCTACTGGATCGCGCAGGGCTGCGTGCTCACCGGCGTGTGGGTCATCGCGCACGAGTGCGGCC
ACCATGCCTTCTCCGACTACTCGGTGCTCGACGACATCGTCGGCCTCGTGCTGCACTCGTCGCTGCTCGTCCCCTACTT
CTCGTGGAAGTACAGCCACCGGCGCCACCACTCCAACACCGGGTCGCTGGAGCGCGACGAGGTGTTCGTCCCGAAGCAG
AAGTCGGCGATGGCGTGGTACACCCCGTACGTGTACCACAACCCGATCGGCCGGCTGGTGCACATCTTCGTGCAGCTCA
CCCTCGGGTGGCCGCTGTACCTGGCGTTCAACGTGTCCGGCCGCCCGTACCCGCGCTTCGCGTGCCACTTCGACCCCTA
CGGCCCGATCTACAACGACCGGGAGCGcgtccagaTCTTCATCTCCgaCGT > SEQ ID NO:2230 182358 139119_300407_1
CCCCCCCTTTTTTGTTCGTGTGGGGTTTCCGTATTATTGCATTATAATATTGCTCAAATTGCACCTTCTGATCCCACTA
CAATATTGCAATCGATTCTCCTTTCTCATCACCTGCGATTGTGATTGTTGTTGTAAGCAGCAAGATGGGTGCCGGCGGC
AGGATGACGGAGAAGGAGCGGGAGGAGCAGCAGAAGCTGCTCGGCCGCGCCGGCAATGGCGCGGCCGTGCAGCGGTCGC
CGACGGACAAGCCGCCGTTCACGCTGGGGCAGATCAAGAAGGCCATCCCGCCTCACTGCTTCCAGCGCTCGGTGATCAA
GTCCTTCTCCTACGTGGTCCATGACCTCGTGATCGTCGCCGCGCTGCTCTACTTCGCGCTGGTCATGATCCCCGTGCTG
CCGAGCGGGATGGAGTTCGCGGCATGGCCGCTCTACTGGATCGCGCAGGGCTGCGTGCTCACCGGCGTGTGGGTCATCG
CGCACGAGTGCGGCCACCATGCCTTCTCCGACTACTCGGTGCTCGACGACATCGTCGGCCTCGTGCTGCACTCGTCGCT
GCTCGTCCCCTACTTCTCGTGGAAGTACAGCCACCGGCGCCACCACTCCAACACCGGGTCGCt > SEQ ID NO:2231 182358 155729_301359_1
ctacccctcgaccagcgtccggaaagctccaatccATTGGAGCCTCTCAACAAATAACATTTACATAGGGAGAGAATTG
GAACAATTTAAGGAAGAAAGAGTTAAGCTGTGTCAGGTTACTGAACAATGGGTGCTGGAGGTCGAATGTCGGTTCCATC

FIG. 2 continued

TGAGGGCAAGAAGTCCCAGTCTGATGTCTTCCAAAGAGTACCCCATTCGAAACCACCCTTCACTGTTGGCGAGATCAAG
AAAGCCATCCCACCCCATTGTTTCAAGCGATCTGTCCTACACTCTTTCTCCTATGTTGTTTATGACCTTACAATAGCCT
TTCTCCTCTACTATGCCGCGACCAACTATTTCCATCTCCTGCCTTACAATCTTTCCTACATAGCTTGGCTGCTTTACTG
GATCTGCCAAGGCTGTAATCTAACAGGAGTTTGGGTCATTGCCCATGAATGTGGTCACCATGCCTTCAGTGACTATCAA
TGGCTTGATGATACTGTTGGCCTTGTCCTACATTCTACTCTCCTTGTCCCCTATTTCTCTTGGAAATACAGTCATCGTC
GCCACCATTCTAATACAGGTTCTATGGATCGCGATGAAGTATTTGTACCAAAGGTGAAGTCGCGTATTAGTTGGTTCTC
CACTTATCTTAACAATCCACCGGGCAGAATCCTTATACTTCTTGTCCAGCTCACTCTAGGCTGGCCTCTATACTTGATG
TTCAATGTTTCAGGCCGACCCTATGACCGGTTCGCCTgccACTTTGATCCGAATAGCCCTATCTACACAGACCGTGAGC
GCCTTcagaTCTTTGTTTCTg > SEQ ID NO:2232 182358 111288_300053_1
ATGGGGTCTCTTGGATTGAATTCTAAAAAGGGAAATGAAGAAATGGAATTGGAATTTGATCCAAGTGCACCACCTCCAT
TTAAATTATCTGAAATTCGAGCTGCTATTCCTAAGCACTGTTGGGTTAAAAATCCATGGAAATCTCTAAGTTATGTTCT
TAGAGATTTTACTATTGTTGTTGCATTTGTATCCATAGCCATTTATTTGGACAGTTGGAAATTTTGGCCACTTTATTGG
GTTGTTCAAGGTACTATGTTTTGGGCAATCTTTGTTCTTGGACATGACTGTGGACATGGAAGCTTTTCAGGTAGTGCAT
TTCTGAATAGTGTGGTTGGACATATTCTTCATTCTTCTATCCTTGTACCCTATCATGGATGGAGAATCAGCCATAAAAC
TCACCATCAAAACCATGGAAATGTTGAAGCTGACGAATCTTGGGTGCCTATGCCAGAAAAGCTATATAAAGAACTGGAT
TTTGCTACCAAATTTTTTAGATTCAAGATTCCTTTTCCCTTATTAGCATACCCTATGTACTTGATAAGCAGAAGTCCAG
GGAAAAAAGGTTCTCATTTTAATCCATACAGTGATTTGTTTCAACCTAATGAGAGAAAATATGCCATAACATCAACATT
ATGCTGGACAATAATGG > SEQ ID NO:2233 182358 1111716_301800_1
TCTAAACCGCCCCCCTTCACAATAGCAGAAATCCGGGCGGCCATTCCTAAGCATTGCTGGGTCAAGGATTCATGGCGTT
CCTTGAGCTTTGTTTTTCGAGACATTGCCATTGTAGCTCTCCTGGCTGTCGTTGCTGCCTGCTTTGATAGTTGGATACT
CTGGCCCCTCTATTGGTTCTCGCAAGGGACCATGTTTTGGGCCCTCTTTGTTCTCGGCCATGACTGTGGCCATGGAAGT
TTCTCTAATAGTAAGAAGCTTAATGACTTCGTTGGTCATTTAACCCACACGTTTATTTTGGTTCCCTTCCATGGATGGA
GAATAAGCCACAGAACTCATCACCAGAATCATGGCCATGCTGAAAATGATGAATCCTGGCATCCGCTTAATGAGAGCAC
CTACCGAGAATTGGATCCCTTCTCTATGTTCGGCAGATTCACTCCCCTGTCTACGCTGGTGTATCCTCTGTATTTGTGG
AGAAGAAGCCCTGGAAAATCGGGATCTCACTTTGACCCAGATAGCCCATTGTTCCTCCCATCAGAGCGGAAGGATGTCA
TCACCTCTACTACATGCTGGTTTGCGATGCTTGCCATCCTTATTGGAtttAGTAttAttGTGGGTCCATTATggAtgtt
gAAGCt > SEQ ID NO:2234 182358 271966_200039_1
aaatacccaaaaAAATAATTAGCCTCTTCTCTTTCCTTAATAGAAAGAGAGAGAGAGTGTGGGGGTGAAGGCTAAAGGT
AAGGAGGTTCGGGATTGAAGAGGTAAAAGGAAGCGAAAATGGGAGCTGGTGGTAATATGTCTCTTGTAACCAGCAAGAC
TGGCGAAAAGAAGAATCCTCTTGAAAAGGTACCAACCTCAAAGCCTCCTTTCACAGTTGGTGATATCAAGAAGGCCATC
CCACCTCACTGCTTTCAGCGGTCTCTCGTTCGTTCGTTCTCCTATGTTGTGTATGACCTTTTACTGGTGTCCGTCTTCT
ACTACATTGCCACCACTTACTTCCACCTCCTCCCGTCCCCATATTGCTACCTTGCATGGCCTATTTACTGGATTTGTCA
GGGTTGTGTTTGCACTGGTATTTGGGTTATTGCGCACGAATGTGGCCACCATGCCTTTAGTGACTACCAGTGGGTTGAT
GACACTGTCGGGCTTATCCTCCACTCTGCTCTGATGGTGCCCTACTTCTCTTGGAAATATAGTCATCGTCGccACCACT
CCAACACTGGCTCACTCGAGCGCGATGAGGTTTTGTGCCTAaGcCGAAATCACAACTCggATGGTATtccaAGTACTT
GAACAaTc > SEQ ID NO:2235 186849 124605_300424_1
GAGTCACCGTCCATAAGCAAAGCCCGAGGCAGAAATGCGCGAGTGACGAGGCAGTGAACGGAATCTATTCAATTGACAG
CAACATCCAACAAATTTCAAAATCTGTCCCTATCGTTTCAGTTTTGGCCACATCTGCTGCACCATTAGCACTAGTTCCG
TGTGAGATTCTCATTTCCCCCTATTTCTTTCCTCTCCTCTAGAATCAACCAAGTTACTCTCCTAACAAATGCGGATTG
GGGACCAGTGTTAATAGCGGTGGTGCTGTTCGTGCTGTTATCACCAGGGCTGCTGTTCCAGTTACCCGGCCGTGGAAAA
GTGGTGGAGTTCGGTGGTATGCAAACGAGCGGTGTAGCCATTTTGGTCCACACCGTCATTTACTTCGGCCTTATCACCA
TCCTCCTCATTGCCGTTGGCGTCCATGTCTACACCGGCTAAGTATACCCCAACTTCACTTGACTAAGCTCTACTATAAG
TGTCTGCTCGGATCAGAAATTTTTATTTTGTTGTTCTCTAATTAAGGTGTACTTTTTCTTTGTTCAAGAATTGTTAAAG
TATGGTGATGGTTCATCGATATTTGCTTTTTAATTTTCAAATTTGCTAAGCAGATTATACTAGTAAAGATAATCTGGTT
GTTGATTTTCTTCGATTAGTTGTATATGGGGTATTTTGCGTT > SEQ ID NO:2236 186860 129087_300402_1
CCCCCCCCCCGGGCATGTTGGAAGAAGCCCTTGAGATAGCAACAGACTCTAATTACAGATTTGACTTGGCCGTGCAGCT
TGGTCGGCTTGAAGTTGCAAAGGCAATTGCCATTGAGGCACAAAGTGAGTCCAAGTGGAGGCAGTTAGGAGAGTTAGCT
ATGTCAACCGGAAAGCTTGATATGGCAGAGGAGTGTCTTCTACATGCTATGGACCTCAGTGGTTTATTACTTCTGTATT
CATCCCTTGGTGATGCTGAAGGGCTAACAAAATTAACATCTATGGCTAAAGAACAAGGGAAGAACAATGTTGCTTTCCT

FIG. 2 continued

TTGTTTCTTCATGCTAGGAAAACTTGAAGAATGCCTTCAGTTGTTAATCGAAAGTAATCGTATACCAGAAGCAGCATTG
ATGTCGAGATCTTATCTTCCGAGCAAAGTCCCTGAGATTGTAACATTATGGAAAAAGGATCTCCAAAAGGTAAACCCCA
AAGCAGCAGAATCATTGGCAGATCCTGACGAGTACCCAAACTTGTTTGAAGACTGGCAAATTGCTCTCAATGTAGAAGC
TAATGTCGCGCCCAAAAGGGGTATTTATCCACCAGCTGAGGAGTACATTATCCATGCTG

> SEQ ID NO:2237 186860 142016_300431_1
CCCCCCTTGCTAACCAAAGCCGTGTCTATCTTATTGACAAGCAATTTAATGTTGTGGGGGATACTTTACTCCTTACCAT
GATTGAGTATAAAACACTTGTAATGCGTGGAGACTTCGATCGTGCAAACGCTCTTTTACCATCTATACCAAAAGAACAA
CATGACAGGGTGGCACGTTTCTTGGAATCACAGGGCATGTTGGAACGAAGCCCTTGAGATAGCAACAGACTCTAATTACA
GATTTGACTTGGCCGTGCAGCTTGGTCGGCTTGAAGTTGCAAAGGCAATTGCCATTGAGGCACAAAGTGAGTCCAAGTG
GAGGCAGTTAGGAGAGTTAGCTATGTCAACCGGAAAGCTTGATATGGCAGAGGAGTGTCTTCTACATGCTATGGACCTC
AGTGGTTTATTACTTCTGTATTCATCCCTTGGTGATGCTGAAGGGCTAACAAAATTAACATCTATGGCTAAAGAACAAG
GGAAGAACAATGTTGCTTTCCTTTGTTTCTTCATGCTAGGAAAACTTGAAGAATGCCTTCAGTTGTTAATCGAAAGTAA
TCGTATACCAGAAGCAGCATTGATGTCGAGATCTTATCTTCCGAGCAAAGTCCCTGAGATTGTAACATTATGGAAAA

> SEQ ID NO:2238 186963 104409_300410_1
GCCATTACGGCCGGGGGAGGCAAGGCTCCAAGGAAGCAGGTTGCAACAAAGGCTGCCCGTAAGTCTGCCCCAACAACAG
GAGGAGTTAAGAAGCCTCACAGATACAGACCTGGAACCGTTGCTCTTCGTGAAATTCGCAAGTACCAGAGGAGTACTGA
GCTGTTGATCAGGAAATTGCCATTCCAAAGGCTTGTTCGTGAAATTGCACAGGACTTCAAGACTGATTTGCGTTTCCAG
AGTCACGCTGTATTGGCTTTGCAAGAAGCAGCTGAGGCCTACCTTGTTGGATTGTTTGAGGACACAAATCTGTGCGCCA
TTCACGCCAAGCGTGTCACTATCATGCCCAAGGATATCCAGTTGGCCCGAAGAATTAGGGGAGAAAGAGCTTAGAATGA
TCTGTTCTGCCGTATCGTGCTTAGATTGTTGATTTTTTTTTGAATTGCCGTCTTTCTGCATTTTTCTTCTTCTTTGTT
CTTCATATAGGTAGTTTTTACTAGATATGAATGGCTGTGGCATACTGGAAATTTGATACTCTCTATTATATAGTCGAAT
TTTATT

> SEQ ID NO:2239 186963 171876_300624_1
cccacgcgtccgtctTCTTCTTCCTCCTCCTCGCGCTCCCCCGATTCGAAGCGTGAAGAGAGGAGCGGCGCTTGCGAGA
GGAGAGAGATGGCCCGTACCAAGCAGACCGCTCGTAAGTCCACAGGAGGAAAGGCTCCCAGGAAGCAGCTTGCAACCAA
GGCTGCTCGTAAGTCTGCTCCCACCACTGGAGGAGTTAAGAAGCCCCACCGTTACCGCCCTGGAACTGTTGCCCTCCGT
GAGATTCGCAAGTACCAGAAGAGTACTGAGCTTTTGATCAGGAAGCTGCCCTTCCAGAGGCTTGTTAGGGAAATTGCAC
AGGACTTCAAGACCGATCTGCGTTTCCAGAGCCATGCTGTCCTTGCCCTCCAGGAGGCTGCGGAGGCATACCTTGTTGG
TCTCTTCGAGGACACCAACCTGTGCGCTATTCATGCCAAGCGTGTGACCATCATGCCTAAGGACATTCAGCTGGCTAGG
AGGATTCGTGGTGAGAGGGCTTAAAATTCCCCTCGGCGACTCCTTTGACAAATGAAGCATGCGTCGTAGTGTTAGTAGTG
GGTTTAATCTTTTGCTTATAAGAACAATCTGAGTAGGGTGTATTTTGTGGAACAATATGTTTCTCTCTGTGACATGATG
GTGCTGTATTCGTCTTATTGGTGGATCTGTCAAAAATACTCacaatAtTgtcagTgt > SEQ ID NO:2240 186963 126687_300465_1
acaaatacaaaaagagagaagaagaagaagatttcataggaaaTGGCTCGTACCAAGCAAACTGCTCGTAAGTCTACAG
GAGGAAAAGCTCCAAGGAAGCAACTTGCTACTAAGGCTGCACGCAAGTCTGCTCCTACCACTGGTGGTGTGAAGAAGCC
ACATAGATACCGCCCTGGTACTGTTGCTCTTCGTGAAATCCGTAAGTACCAGAAGAGTACTGAGCTCTTGATCAGGAAG
CTTCCTTTCCAGAGGCTTGTGCGTGAAATTGCCCAGGACTTTAAGACTGATCTGCGTTTCCAGAGTCATGCAGTGCTGG
CTCTGCAGGAGGCTGCTGAGGCCTATCTGGTGGGTCTCTTTGAGGACACTAACCTTTGTGCCATTCACGCCAAGCGTGT
GACAATTATGCCTAAGGACATTCAGCTTGCCAGGCGAATCAGGGGCGAGCGTGCTTAATTTGATCTACTAGCTTGTAGC
GTTGGTGTGATCCTTGTCTTTCTTTTCTTTGTAAGACGTAAAGACAGTAACTAAATCTAGTAGTAGGGCTTGTTGCTTT
TAATTTGCTGGTGGCTGGTGGTGTGCTGTAATTTCTTGGTGTTTTCTTTTGGAGAAGGGGGAAAACATGCTATTTTGTT
TGGATCTCTAATgttttgttgtcacactactggtgtcgaacaatgttttcatctagtgattagttgaagttattgtcga
t > SEQ ID NO:2241 186963 256509_301673_1
GCGGACGCGTGGGGGCGCGTACCAAGCAGACCGCTCGCAAATCCACGGGAGGCAAGGCGCCCAGGAAGCAGCTCGCAAC
CAAGGCTGCCAGGAAATCCGCTCCCACCACCGGAGGAGTGAAGAAGCCCCATCGCTACCGCCCAGGAACAGTCGCTCTT
CGTGAAATTCGCAAGTACCAGAAGAGCACTGAGCTCCTCATCCGAAAGCTTCCCTTCCAGAGGCTTGTTCGCGAGATCG
CTCAGGACTTCAAGACCGATTTGAGGTTCCAGAGCCATGCGGTGCTGGCCCTCCAGGAGGCGGCGGAGGCGTACCTGGT
GGGACTGTTCGAGGACACCAATCTGTGCGCGATTCATGCCAAGAGGGTGACCATCATGCCCAAGGACATCCAATTGGCT
CGCCGGATCCGTGGAGAGAGGGCTTAAGAGATTCATCAATCTTAAGAAAACTAGCTTCACCAATGTAGATACTACTACT
ACTACTACTAATCCCTCTGTtTgATTTGATTTCAGTGCAAATGCAAAGTCTTCTGGTTGTTTGT

FIG. 2 continued

> SEQ ID NO:2242 186963 51555_300088_1
CCCACGCGTCCGCAACTTTCTCTCATCTTCAAATTAAAATCAAACAGTTTCTTAATAACATTTTACCTCATGGCTCGTA
CCAAGCAGACGGCTAGGAAATCAACCGGAGGAAAGGCTCCAAGGAAGCAGCTGGCGACAAAAGCGGCGAGGAAATCTGC
TCCGGCCACCGGAGGAGTGAAGAAGCCACACAGATTCAGACCCGGAACTGTTGCTTTAAGAGAAATCAGGAAGTACCAG
AAGAGCACTGAGCTTCTTATCCGTAAACTCCCTTTCCAGAGGCTTGTCAGAGAGATCGCTCAGGACTTCAAAACCGATC
TTCGTTTCCAGAGCAGTGCCGTCGCCGCTCTTCAGGAAGCTGCTGAAGCTTACCTCGTCGGACTCTTCGAAGACACCAA
TCTCTGCGCCATTCACGCCAAGAGGGTCACGATCATGCCCAAGGACATCCAGCTCGCGAGAAGAATCAGAGGAGAACGA
GCTTAGATCTAAGTATTCTGGTTACTCTTGTGTTTTGATTAGAACCATAAGATTGTAAAATTTCAAGTTAAATCCAAGG
GTTATAATATTAATTCCAAGCAAA

> SEQ ID NO:2243 186963 280727_200068_1
ATTCTCTCTCTAGAAACTGTACTCTTTCTTTCTCTAGAAGATCTGAAGCAATGGCAAGAACAAAGCAAACAGCCCGA
AAATCCACAGGAGGAAAGGCACCAAGGAAGCAATTAGCCACAAAAGCCGCAAGGAAATCAGCACCAGCAACAGGAGGAG
TGAAGAAGCCTCACCGTTTCCGCCCTGGTACAGTGGCTCTTCGTGAGATCCGAAAGTACCAGAAGAGCACTGAGCTTTT
AATCCGAAAATTACCTTTTCAAAGACTGGTCAGAGAAATTGCACAGGATTTCAAGACGGATCTTAGGTTCCAGAGCAGT
GCTGTAGCTGCACTACAAGAAGCTGCTGAGGCTTACTTGGTGGGTCTCTTTGAGGATACAAATCTGTGTGCTATTCACG
CTAAAAGGGTGACTATTATGCCTAAGGATATTCAGTTGGCTAGGCGTATTAGGGGTGAAAGGGCTTAATGTTTCATTGT
TGTGTTTTTTGTGTTTAGGGTTATGGTGAATGTGGTATG

> SEQ ID NO:2244 186963 27819_301000_1
GTTTTTTTTTGAAAATGTGGAGGGAGTTTTCAAACTTTGCTAAGGAAGGAAAGATTTTGATCCGTTAAATATCGAACA
ACATAAACGCAAAACCTAATCCAACCCTAAAACACGAAATTAGGGAAAACGAAAGATATACATAACCATAACGATCACA
GTCTAAAGTACTTCAATCTCCTTCTTAAGCCCTACTCGCCTCTAATTCTCCTCGCCAATTGAATATCCTTAGGCATGATA
GTGACTCTCTTAGCATGAATCGCGCAAAGATTGGTGTCTTCAAACAATCCAACGAGGTATGCTTCAGCCGCTTCCTGAA
GTGCTGCGACGGCGCTGCTCTGGAAACGCAAATCTGTTTTGAAATCCTGAGCGATCTCACAAACCAAACGCTGGAACGG
AAGCTTGGGGATCAAAAGCTCAGGGCTCTTCTGATACTTCCTGATTTCTCTTAGGGCAACAGTTCCAGGACGGAATCTG
TGTGGCTTCTTTACTCCTCCGGTCGCCGGAGCTGATTTCCTCGCCGCCTTTGTTGCGAGTTGTCTCCTTGGGCTTTTC
CTCCGGTGGATTTCCTTGCGGTTTGCTTG

> SEQ ID NO:2245 188836 264911_301440_2
gAAcTgATGTGAGAGATGTAGAagttttgaGTGAGATTTATATCTCTATCAaTGACAATtacgaatCTTACAAAGACTT
TAAGGTGCTTGATGCTTTGGATAAGGCTTTAGTGGATAGATATCGATCCCCTTATAGTGCTATTTCTGCTTTGGTTTCT
TTATGTTATCATATCTTTGACTTTAATAAGTTTAAGTTGCTGTTTAATTGTGAAGGGAAATTTGTGGATAAGAAGCTGA
GAAAAGACTTCGAGTGGTGAACTCTAGGTCCTGATGTTTAAATCTACTGTATTTACCTTCGCATTAATTAAGCATGGCA
GCATACACCAGCAAGATCTTTGCCCTGTTTGCCTTAATTGCTCTTTCTGCAAGTGCCACTACTGCAATCACCACTATGC
AGTATTTCCCACCAACATTAGCCATGGGCACCATGGATCCGTGTAGGCAGTACATGATGCAAACGTTGGGCATGGGTAG
CTCCACAGCCATGTTCATGTCGCAGCCAATGGCGCTCCTGCAGCAGCAATGTTGCATGCAGCTACAAGGCATGATGCCT
CAGTGCCACTGTGCCACCAGTTGCCAGATGATGCAGAGCATGCAACAAGTTATTTGTGCTGGACTCGGGCAGCAGCAGA
TGATGAAGATGGCGATGCAGATGCCATACATGTGCAACATGGCCCCTGTCAACTTCCAACTCTCTTCCTGTGGTTGTTG
TGCGGCCGCTTATCCGTATGATGTTCCGGATTATGCCGAGCTCTACAAACAGCTGTTGAATTTTGATTTGCTGAAGTTG
GCGGGTGACGTGGAATCTAACCCTGGTCCTAGGTCTAGAATGGCTACTTTCTCTTGTGTGTTGTGGTACCTTAACTA
CAAGTACTTACTGTGGTAAGAGATGTGAGCGAAAGCATGTATATTCTGAAACAAGAAATAAGAGATTGGAACTTTAATT
AAGCATGGAGAAGGCGATCAACAGGCAGAGGGTGCTTCTCGCCCACCTGGAGCCCGCCGCGAGTCCCGCCGCCGCCGCG
CCGGCCATCACCGCGAGCGCGTGCGCCGCGGGGACAGCGCCGCGTACCACCGCGGGGCGTGCTTCGCAGACGACGTCG
TCATCGTCGCTGCCTATAGGACAGCAATTTGCAAGTCCAAGAGAGGTGGTTTCAAGGATACTCCCGCAGAGGACCTCTT
GGTTCCAGTATTCAAGGCTTTGATAGATAAAACGAAGTTGAACCCAAGTGAAGTTGGTGATATTGTTGTTGGTACTGTT
TTAGCTCCTGGGTCCCAAAGGGCAATTGAATGCAGAATGGCTGCATTTTATGCTGGATTCCCTGATACCGTTCCTCTTA
TGACTGTAAACAGGCAATGTTCGTCTGGGCTTCAAGCAGTTGCAAATGTTGCTTCTAACATTAAAGCAGGACTTTATGA
CATTGGTATTGCTGCTGGCCTAGAGTCCATGACAGTGAACCAAGTTCGCCttGATGGGCaaGTGaacCCCAAAGttgag
ctgttttcTCaaGCACGCGATtgcctTCTCCCAaT > SEQ ID NO:2246 188836 197809_300701_1
AGCATAATAACACTGTAGTGCCAACAATGGCAGCATACAAGATCTTGGCCCTCTTTGCGTTACTTGCTCTTTCTGCAAG
CGCCGCTACTACAATCACCACCATGCCATATCTCCAACCAACAATAGCAATGGGCAATATGGATCCGAGTACGCAGTAC
ATGATGCAAACGACGGGCACAGATAGCTACGCAACAATGTTCATGCCACAACCAATTGCTCTCCTGCAACAATAGTGTT
GCATGCAGCTACAAGGCATGATGCCACAGTGCCAGTGTGGGTATGGTACTAGTTGCCAGATGATACAGAACATGCAATA
TGCTATCTGTGGTGGCACTTGGCCAACAACAAATGATGATGAAGATGGCGATGCAACTTCCAAACATGTGTATCATGGC
CCCTGCCTACTTCCAGCTCTCTCCCTATGGTTGTTG

FIG. 2 continued

> SEQ ID NO:2247 188836 218344_300917_1
ACACCATCTGGAATCTTGTTTAACACTAGTATTGTAGAATCAGCAATGGCAGCATACACCAGCAAGATCTTTGCCCTGT
TTGCCTTAATTGCTCTTTCTGCAAGTGCCACTACTGCAATCACCACTATGCAGTATTTCCCACCAACATTAGCCATGGG
CACCATGGATCCGTGTAGGCAGTACATGATGCAAACGTTGGGCATGGGTAGCTCCACAGCCATGTTCATGTCGCAGCCA
ATGGCGCTCCTGCAGCAGCAATGTTGCATGCAGCTACAAGGCATGATGCCTCAGTGCCACTGTGGCACCAGTTGCCAGA
TGATGCAGAGCATGCAACAAGTTATTTGTGCTGGACTCGGGCAGCAGCAGATGATGAAGATGGCGATGCAGATGCCATA
CATGTGCAACATGGCCCCTGTCAACTTCCAACTCTCTTCCTGTGGTTGTTGTTGATCAAACGTTGGTTACATGTACTCT
AGTAATAAGGTGTTGCATACTATCGTGTGCAAACACTAGAAATAAGAACCATTGAATAAAATATCAATCATTTTCAGAC
TTG

> SEQ ID NO:2248 188873 189186_300613_1
agatgagcgccgttaaagtaaatctataccagaatgcactcctttcaccgttctggaacATCAACGCTCACATATTCAT
GGCATCAGCTTCAGACAAGCTCGTCCTCTCGGCCATCGTGCTCGCCGTCCTCGCCGCCGTGGTGGCAGCGGCGTCGGGC
TACGGCGACGTCGGCGAGTACTGCCGCGTGGGGAAGGCGGTGTCCCGGAACCCGGTCCCGTCGTGCCGGAACTACATCG
CGCGGTGGTGCGCCGCCGCCGGGGCCGCATGGACTCCCGCAAGCAGCCGCCGCGGGAGTTCCTGGAGCCGTGCTGCCG
GGAGCTCGCCGCCGTGCCGATGCAGTGCCGGTGCGACGCGCTGAGCGTGCTGGTGCGCGGCGTGGTCACGGAGGAGGGC
GACCGCGTCTCCGGGATGATCTCCCAGCACGCGGCACCGGGGTGCGACGCCGCGACGATCGCCGGGATGGCGAGCGCGC
TGACGGACTACGGCCGGTGCAACCTGCAGCACACGGCCGGTTCCTTTGCCTGCCTCATGTTTGGTGGTGGCATGGATTA
GATTAATTATTTCATTAGTGATTAATTAATTAATTAGGCCTTTGCTTAATTAATTATCGATGTTTGCTAGTACTAGCTA
GCAGTATCATGTTTGGATGCTGCTTCTCTATGTTTGTGATAATGATAATAAAagaaataaaatgaggaacggatgttc
ctctttgttgttattc > SEQ ID NO:2249 188873 196205_300770_1
aaattttctAAATTACAAGCAAATCAAAGCTCATCGAAGTATAGCTATGGCATTGGCATCAGACAAGTTCGTCCTCTCC
GCCATCGTGCTCGCCGTCCTCACCGTCGCGGCAGCGGCGGCGGGCTACGGCGGCTACGGCGACGTCGGCGAGTACTGCC
GCGTGGGGAAGGCGGTGTCCCGGAACCCGGTCCCATCGTGCCGGAACTACATCGCGCGGTGGTGCGCCGTCGCCGGGGG
CCGCCTGGACTCCGGCAAGCAGCCGCCGCGGCAGCTCCTGGAGCCGTGCTGCCGGGAGCTCGCCGCAGTGCCGATGCAG
TGCCGGTGCGACGCGTTGAGCGTGCTGGTGCGTGGCGTGGTCACGGAGGAGGGCGACCGCGTCGCCGGGATGATCTCGC
AGCACGCGGCGCCCGGGTGCGACGCCGCGACGATCGCCGGGATGGCGAGCGCGCTGACGGACTACGGCCGGTGCAACCT
GCAGCACACTGGTTTCTTTGGCTGCCCCATGTTTGGGGGTGGCATGGATTAACTTCCTTAGTAATTAATTAATTAGGCC
TTTGCTTAATTAATTATTTAATTAGTTATCCGGGTTACTGGATAATTAATTATCGATATTTGCTAGTAGCATCTATCAT
GTTTGGATGCTGCTTTCTCCGTGAATGTGATGATAATAATAATCAGAagaaaTaaATaagaagagtTGgaTTca > SEQ ID NO:2250 188876 1112052_301801_1
GTTGTTTAGTTCGGGTTTCCTGTTTCGTTCTTTGTGGGCCGGGGATCTAGCGGAAGACACCCCGCCGTTCTCGAGCTTC
GAACAGCCGACGTTGCCTAGCTGGGATACATGGCGGCAGTGGAGTATTCCTGTTTCGTCGGAGGCCTGGCATGGGCCAC
CGACGACCGCAGCCTCGAGACCGCCTTCCGCCCCTTCGGAAATGTCACAGACTCCAAGATTATCAATGATCGTGAAACT
GGAAGGTCTCGTGGCTTTGGGTTTGTTACCTTCTCTGAGGAGCAATCCATGCTGGATGCGATAGAGGGTATGAATGGGA
AGGAGCTCGATGGAAGAAACATTACTGTAAACCAAGCTCAGAGCCGTGGTTCTGGAGGTGGAGGTGGTGGTGGCGGTGG
TGGATTCCGCAGATCTGAAGGTGGCCGATCAGGAGGAGGAGGGGGATATGGAGGAGGAGGGTATGGAGGAGGAGGAG > SEQ ID NO:2251 188876 194845_300767_1
ggGCTTTGAGGTGGGTTGGCTTCTCCTCCCCCTCTTTACCTTTTCCTCCTCGGTTCGGTTCCGTGGTTCGTCTAGGGTT
TAGTGGGTTGAGATGGCGGCGCCGGATGTCGAGTACCGCTGCTTCGTCGGCGGCCTCGCCTGGGCCACCGACGACCGCT
CCCTCGAGGCCGCCTTCTCCACCTACGGCGAGATCCTCGACTCCAAGATCATCAACGACAGGGAGACGGGGAGGTCACG
TGGGTTTGGCTTCGTCACCTTCTCCTCCAGCAGTCGATGCGCGACGCCATCGAGGGCATGAACGGCAAGGAGCTCGAC
GGCCGCAACATCACCGTCAATGAGGCCCAGTCCCGCCGCTCCGGCGGCGGAGGCGGGGGCTACGGCGGCGGCGGTGGCG
GCTACGGCGGCGGTCGTGGAGGCGGCGGCTACGGAGGAGGTGGCGGCGGCGGCTACGGGCGCCGTGAGGGCGGCTACGG
TGGCGGCGGCGGCTACGGCGGCGGCCGTGGCGGCGGCGGCTACGGTGGCAGCCGTGGCGGCGGCTACGGCGGC
GACTCCGGCGGGAACTGGAGGAACTGATTGGTGGGGCCCATCGTGGCCAGTTATCCTTAGCTATCCGTGTCAGAATCAT
CTTATCATCGAGTCGAGTCGTTATCGTGTCCAGTGGCTCTCTcgagtcGAGAAGCCCTCTAtCCAtcCAtccagtGtta
GGTGTTCTTCGTCCg > SEQ ID NO:2252 188876 255783_301643_1
TGGTTCTTAAGGAGGAGACTCCTCCGACATTTTCCCCTTCGTTCTGGTTCGTTTTTCTCTGTTTGGTTTCTCTGTTCGG
GGTTCGGAAACATGGGGTCTGAGTACCGTTGCTTCGTCGGGGGTCTGGCTTGGTCCACTAATGACCAGGCTTTGGAATC
CGCTTTCAGTCAATTCGGAACTGTCATCGAATCGAAGGTTATCAATGACCGTGAGACTGGAAGGTCTCGTGGATTCGGG
TTTGTTACATTCGAGGATGAGCAAGCCATGAGGGATGCAATTGAAGGGATGAATGGAAAGGATCTAGATGGCAGGAACA
TTACTGTAAATCAGGCTCAGGACAGGTCATCAAGTGGTGGTGGTGGTGGCGGCTACCGAGGAGGTGGTGGTGGTGG

FIG. 2 continued

```
TGGTTACCGTGGTGGTGGTGGCGGTGGTTACAGTGGCGGTGGCAGTGGATACCGCTCAGGTGGTGGTGGATATGGTGGT
GGTGGCCAACGTAGGGATTCTGGGTACGGTGGAGAAGGTGGTGGCTACTCTGGCGGTGGGGGCTACGGTGGTGGTGGTG
GTGGATACGGTGGAAGTGGTGGTGGTGGTAACAACAGGTGGAGGGACAATTAACCAACCTATCAAAGGATGTGTAA
CTAGCTATT

> SEQ ID NO:2253 188876 291272_200077_1
GACAATGTCTACGAAAGAGGAAGTTGAAGCTGCTGAACAACAATTCAATGGATATGAAATTGACGGGAGGGCAATAAGG
GTGAACGCAGGGCCAGCACCAGCCAAAAGGGAGAATTCTTCGTTTGGAGGTGGAAGGGGTGGAAATTCTTCATATGGAG
GTGGAAGGGACAGGAATTCTTCTTTTGGAGGTGCACGGGGTGGGAGAAGTGTTGACAGAAGCAATAGAGTATACGTAGG
AAACCTCTCGTGGGGTGTCGATGACCTGGCACTTAAAGAATTGTTCAGTGAGCAAGGCAATGTTGTGGATGCCAAAGTA
GTCTATGATAGAGATAGTGGTAGATCAAGGGGCTTTGGATTTGTAACATACAGTTCGTCCAAAGAGGTCAACAATGCAA
TTGATAGCTTGAACGGCGTTGACCTTGATGGCAGGTCCATACGCGTAAGCGCTGCTGAAGAACAGCCCAGGCGTCAATT
TTGAATGTGTTAAACTACATCTTTTTGACTGAGGAAAAGCTTGAGGGCTTCGTGGCGACACGAAAACTGCAGCAAAGCT
CATGAATTTTTTGCACCTTCGACACCTGCTACTTTTACACCAAAGTTGGTACAAAATTTTGTATCTGCATCTAGACTAA
TGAGAACTCACAAGTATATTACCTTTTACAGTGTATGTTCTAAAATTGCCTCGGGGAAAGATTCTGATCTGTAATATTA
TA

> SEQ ID NO:2254 188876 284561_200099_1
ggcTTAAACCCTAGCCGCTCCTCATTTGTTTCTCTCTCTCCTTAAACCCTCAAAGATTCTCCTTCCTCAGATTTGTCAA
TTTATCTGTACAAATGGCTTTCTACAACAAACTCGGTGGTCTTTTGAGGCAGAACATTTCTGGAAATGCagtaattgca
acAACACCAATGCCGTCAATGCTTGATGCCTTCCGGTGCATGTCGACAAAGCTTTTCGTTGGTGGTCTTTCATGGGGAA
CTGATGATCAGTCACTGAGAGATGCCTTTGCTACCTTTGGTGATGTTGTTGATGCAAGGGTAATCGTTGACAGAGATTC
TGGCAGATCAAGGGGATTTGGATTTGTGAACTTCTCAGATGATGAAAGTGCCAATGAGGCTATTAAAGCAATGGATGGT
CAGGAACTCCAAGGAAGGAATATTCGTGTTAGTATTGCCCAAGAGAGAGCTCCTCGAAGTGGTGGTTTTGGTGGCTCTG
GTGGTGGATTTGGTGGCGGCTATGGTCAAGCTAGAGACAATGATGGATACTAAGTCACTTTTATTTTTGATAAGCTGTC
AATGTGTGCATGATAACTTTTATCTAAGTAGaggACTTTGGTGGGATAGCTTTGTTGAGTTTATCTATATTAAGaCTTC
TTTTCGTGCAAGgttTTGGTATCAATAATTTTTCCTGATTTATGGGTAAAaa > SEQ ID NO:2255 188943 266374_200030_1
ttttCTTCTTATTTTTTGCTAACAATTATAATCATGGCTACTACATGGTTTTCTTTTTTCTTGAGTTTCCTTTTGCTT
TTGCATGGTAATTTTGCTCAACAAAGGTCTCAGCAGCAATATGGCCAGCAGTGTCAAATTAACAGACTCAATCCACAAG
AGCCTTCCTTTAGAATGGAAGCAGAAGCTGGAGTTACTGAGTTTTTTGACAGAAATAATGAGCAATTTCAATGTGCTGG
AGTTTCACTATTTCGCCATGTTATTCAGTCCAGAGGCCTTCTCTTGCCTTCTTATACTAATTCTCCACTGCTTGCCTAT
GTTGTTCAAGGTCGAGGATTTTATGGGATCATGAACTCGGCTTGCCCCGAGACATTCCAATCATCTCAACAAACTCAAC
AGAGAATTAGAGGCAGAAGATTTCTAGATCGTCATCAAAAGATTGAACAATTTAGGCAGGGTGATATTATGGCATTTCC
TGCAGGTGCTGCACATTGGCTCTATAATGAAGGAAATGAAGAAGTTGTTCTTGTTGTTCTTGAAGATGCCTCTAACAAT
GCCAATCAATTGGATCAAACCTCTCGGAGGTTCTTTATTGCTGGAAACCCGCAACAAGGACAACAACAGCAAGGAAGAC
AATATGGTGGCAGCACAACGCGGAGGGAGCAATTTCGATCAGGCAATGTTTTCAATGGCTTTGACTTAGAAATTCTATC
AGAAACATTTGGTGTTGACAGGGAAACGGCAAGGAGGCTACAAGGACAAGATGACATGAGAGGTCACATTgttAGTGTT
CAAGaggGCTTAGAGTGATTAGGCCACCTTTTTCACaagAACAagaGGAACAaCaAGaacaaggacaaTATGGtcgtg
gtcCTATGACTAATGGAATTGaagaGACaatttgtactgctAaggttAaAGAAAACAtTgAcaatcccgctcgtgcTGA
TATATa > SEQ ID NO:2256 188943 266814_200031_1
AACAAATCAATCCTAATTAGCCATGGCGGTCACTACTAGACTCCTCTTAGCTTTACTCCTCTCTGCTTTTCTCTTGTCT
GCAACAAATGCAGTTAGAGACTATCAGGGCCAGCAAGGCCGTCAGGAGGGTCTGAGAGGCACTCGTCTCACTGTAGCTC
AACAATGCCGTTTAACAAGGCTCACTGCTAGCCAACCCACTAACCGAATTGAGTCAGAGGGCGGCGTCACTGAACTGTG
GGATGAGAATGAGGAGCAATTCCAGTGCGCTGGAGTTGCTCCCATGAGGAATGTCATCCGTCGCAACTCTCTTTCTCTT
CCCAATTTCCATCCCATGCCTCGCTTGGTTTACATTGAGCGCGGCCAGGGATTGATTGGCATTACTTACCCTGGCTGTG
CTGAGACTTTCCAGTCTCAGTCCCAGACCTTCCAGGCTGGCCGAGAGCCAAGGGAAGAGAGGGGCCAAGGCCGCAGAAG
TGACCAACACCAGAAGATCCACCGCATTCGTCAAGGAGATGTCGTGGCACTTCCAGCTGGCGCTGCTCATTGGTGCTAT
AATGATGGTGAGGAGAGCTTGTCGCCGTCTCTATCAACGACCTCAACCACCGGTCCAACCAGCTTGATCAGAACTTGA
GGGCATTCTACTTGGCTGGTGGAGTACCAGAAAGTGGAAGGCAACAAACCCAAGCAGGTCAAAGACTACAGAGCAGGCA
GAGGTTCCAGAACATTTTCCGTGCTTTCGACACAGAACTGATGGCTGAGGCCTTCAACATACCAGCCGAGATTGTAAGG
AGGATGCAAGAAGGTCAGAGCGAGCGTGGGCtaatTGTGAATGTGAGGGAAGGAATGACAATGATTAggcccGACGAAG
AAGAAGGAGAATtcgaAgaaGagcAAGGGCGACcAcgaCgAggacagCAATGGTGGGAGGAaGCAaccggaaatgGGTT
GGAaGaaaacatttgCAcaATGAAaa
```

FIG. 2 continued

> SEQ ID NO:2257 188943 286639_200111_1
ATGGCAGTCACTACTAGACTCCTCTTAGCTTTTACTCCTCTCTGCTTTTCTCTTGTCTGCAACAAATGCAGTCAGAGATT
TTCAGGGTCGGCAAGCTGGCCAGCGGGGTGAGAGAGGCACTCGTCTGACTGAAGCTCAACAATGCCGTTTAACAAGGCT
CACTGCCACTCAGCCCACTAACCGAATTGAGTCCGAGGGCGGTGTCACTGAGCTGTGGGACGAGAACGAGGAACAATTC
CAGTGCGCTGGAGTTGCTCCCATAAGGAGTGTCATCCGCCGCAACTCCCTTTCTCTGCCTAATTTCCATCCCATGCCGC
GCTTAGTTTACATTGAGCGTGGCCAGGGAATGATTGGCATTACTTACCCTGGCTGTGCTGAGACTTTCCAGTCTCAGTC
CCAGACCTTCCAGGCTGGCCGAGAGCCATGGGAAGAGAGGGGCCAAGGCCGCAGAAGTGACCAACACCAGAAGGTTCAC
CGCATTCGTCAAGGTGATGTCGTGGCACTTCCAGCTGGCGCAGCTCATTGGTGCTATAATGATGGTGAGGAAGAGCTTG
TTGCCATCTCTGTCAACGACCTCAACCATCGCTCCAACCAACTTGATCAGAACTTGAGGGCATTCTACTTGGCTGGTGG
AGTACcagaaAGTGGAAGGCAACAAACTCAAGCAGgccAAAGACTAcAGAGTAGgCAGCGGTtccAGaaCATTTTCCGT
GCTTTCGATAcagaacTAATGGCTGaggccttCaaCAtcccTGccGaGattgtaAGGAGGATGCaagaagagcagaGCG
AACGtggccTaATTgtcaaTGTGAGGGAaGaaATGagaatGA > SEQ ID NO:2258 188943 283454_200093_1
CAAACAATGGCTACTTTCTCCTCAGTCCTCTCTCTCAGCCTTTGCTTCCTCGTTCTCTCCCACAGCTGTTTTGCTCAGC
TCTTAGAGCAACAGCAACAGAACGTATGGCAGAGACTTCAACAGCAGCAACAACACCGCGCTCTCAGGTCAAAAACCGA
GTGCCAAATTGAGCGTTTGAACGCTCAAGAACCAACCCGGAGATTTGAGTCTGAGGCCGGTGTTATTGAGTTCTGGGAT
GCTACCCAAGAGCAGTTTGAGTGTGCCGGAGTTCAAGCCGTTCGCCATCAAATTAGGCGAAATGGACTTTTGCTTCCTT
ACTATACCAACACTCCTCTGCTCATGTACATTATTCAAGGACGCGGTATTCACTCGACTGTGATACCGGGATGTGCTGA
GACATACGAAACAGAATCTGGAGAATCCAGAACCGGAGAAAGACGCCGGAGTTTCAATGATAGGCACCAGAAACTCAGA
CGTTTCAGAGCCGGTGATGTTCTTGCTTTGCCGGCGGGAGTCACTTTCTGGATGTACAATGATGCTGAGGAACCAATTG
TCACTGTCTCACTTCTTGACACTTCTAACCACGCTAATCAACTTGATCTCACTTTCAGGAGCTTCTTCCTAGCTGGAAA
CCCACAGCGTGGAGTACAACAACAATCT > SEQ ID NO:2259 188943 268851_200122_1
atggcttcTAACTCCTCTCTCATTTGTTTTAGCCTTTGTTTCTTCTTTCTTTTCCATGGCACTTTGGCTCAGATCTTTG
AGCACCAGCAAGTCTGGCAGAGGCTTCAACAGCAGCAACATCGGGCGCTCAGGTCCAGAACTGAGTGTCGGATCGA
GCGCCTGAATGCTCAGGAACCTACTCGTAGGTTTGAGTCTGAGGCTGGTGTCACTGAGTTCTGGGATCATACTCAGGAA
CAATTTGAGTGCGCCGGAGTTCAAGCAGTTAGGCATGAAATCCGACGAAATGGGCTTTTGTTGCCTTACTACAGCAACA
CTCCCCAGCTCATCTACATAATTCAAGGAAGTGGAGTGCATTCGGCTGTGTTCCCGGGTTGTGCTGAGACATTTGAGAC
AGAGTCAGCACAATCGAGGAGGGGAGAAAGGGGAGAAAGAGGAGAAGCAGGACAAAGATTCAATGACCGTCACCAGAAA
GTTAGACGTTTTAGAGCTGGTGATATTCTTGCTTTGCCTGCTGGTGTTACACACTGGACTTACAATGATGGTGAAGAAC
CAATTATCAGTGTCTCTCTTATTGACACTTCTAACCAGGCCAATCAACTTGATCTCACCTTCAGGAAATTTTTCCTTGC
TGGAAATCCTCAACGTGGTGTACAACAACAAATGTTAGGAAGGCAACAGGAGGGAGCTCCTGGCCTAGGAAGAAGAGGT
AGTGAACAAGAGAGGAGGCAACATCTTGAGCGGGATTCGACGCTCAACTTTTGTCAGATGCTTTCAATGTCGATCCTG
AAATAATTAGGAGACTACAAGAACAAGTCCCGGAAAGGGGAGTGATCGTTCGGCGGAGAACCTTCGGTTTCTCCAACC
CGAAGAATCAGAGGAAGAAGAAGAACAATGGCAACAAGGTAGAaGaGGAGGAAGCTGGCCTTTGAATGGGTTGGAAGaA
ACATTTTGCa > SEQ ID NO:2260 188943 271613_200036_1
CTCAATAATAATAATCATGGGTTTTAGCTGGCTCTCTTTCTCCTTGAGTTTCCTTCTGGTGTTGCACGGTACCTTTGCT
CAGCAGAGATACCAACAGCAGCAAGGCGAGTGCCAACTCAATAGACTTAGTCCTCAGGAACCCACCGTCCGCATTCAAG
CCGAAGCTGGAGTCACTGAGTTATGGGATCCAAATAACCAGCAGTTCCAATGTGCTGGTGTCTCCCTAATTCGCCACGT
CATCCAGTCTAGGGGAATGCTGTTGCCTTCCTATGTTAACACACCCCTACTTGCCTATGTTGAACGAGGTCAGGGATTT
TATGGCATCATGCAATCTGGATGCCCGGAAACATTCCAGTCATCCCAGCAATTGCAGCAAGGTGAAAGGGGTGCCGGTT
CAAGATTTCAAGATCGCCACCAGAGGATTGGACAGTTTAGGCAGGGTGACATTATTGCCTTCCTGCTGGAGCTGCTCA
CTGGGTTTATAACGAAGGAAATGAGGAGCTTGTTCTTGTTGTTCTTGAAGATAGCAGTAACAATGCCAACCAGCTTGGT
CGAACTTCAAGGAGGTTCTTCATAGCTGGAAACCCACAACAAGGACAGCAACAACAGCAACAAGGACAATACGGTGGCC
GCAGCTTGCGCAGGGAACAATTCCAATCTGGAAATGTTTTCAATGGCTTTGACGTACAGGTCTTGGCTGAGGCATTTGG
CGTAGaCCagGAGACAGCCAGGAGACTTCAggGACAGGAAGACCagAGaggCCACATTGTAAACATTCAGaAAGGACTC
AGaGtTGTGAggccACCATTCTCACAggGAAcaagaggAGCGCGAGGAGAgacaaGAGCAaggACAATAcGgTCCTCGCA
TGAACGGAATtGangaaACCATCTGCTccgCtaaagtCaggCagaaCATtGAcaaccCtTcacgTGCTGAtatctAcaa
cccacaTgccg > SEQ ID NO:2261 188943 267271_200116_1
ACCACTCAAATATCACTAATATGGAATTGCGTTCTCTTCTTCCTCTTGCCCTTTGCTTTTTTCTCCTCTTTAATGGTTG
TTTTGCTCAAATAGAGCAACAGCAACGATTCTTATGGCAGAAACTTCAGCAACAGCAACAACACAGTCGTGGCCGAGCT
AGAACTGAGTGTCGGATCCAGAGCCTTAACGCTCGGGAACCGACTTATAAATTTGAATCGGAGGCTGGAACCACTGAGT
TTTGGGACCGTAATAATGAGGAATTCGAATGTGCTGGAGTTGCTGCTGTTAGAAATGTTATTCAACCTCAGGGCTTGCT

FIG. 2 continued

CTTGCCTCATTACAATAATGCTCCTCAACTCCTCTACATTGTCCAAGGGAGTGGACTTCTGGGTACTGTAATACCTGGA
TGTGCTGAAACATATGAATCACCACGAAGAGAGAGAGGCATGAGGGGAGAAGAGAGCAGAGAGGGAGAAAGCCAGTTCA
GAAGTGGTGGTGATCAACATCAGAAAGTCAGGCAATTTAGACAAGGTGATGTATTAGCATTACCAGCAGGTCTTACTCT
TTGGTTTTATAACAATGGTCAAGAACGTCTTGTTACTGTCGCCTTGCTTGATACCAGCAATCCTGCTAACCAGCTTGAT
CTCCAATTCAGGCATTTCTTCCTAGCTGGAAACCCAAACCCTAGaGGACAAAGTGGAAGCAGGTACGAAGaagaaATCC
GAggaAGaaGAGaaCaaGaaCaaggcGAaca > SEQ ID NO:2262 188943 107472_300264_1
ctttAATATCTTCTCTACACAACAATAATAATCATGGGTTCTAGCTGGCTCTCTTTCTCCTTGAGTTTCCTACTGGTGT
TGCACGGTACCTTTGCTCAGCAGAGATACCAGCAGCGGCAAGGCGAATGCCAACTCAATAGACTTAGCCCTCAGGAACC
CACCACCCGCATTCAAGCCGAAGCTGGAGTCACCGAGTTGTGGGACCAAAACAACCAGCAGTTCCAATGTGCTGGCGTC
TCGCTAATTCGCCACGTCATCCAGTCTAGAGGCATGCTGTTGCCTTCTTATGTCAACACTCCCCTACTTGCCTATGTTG
AACGAGGTCGGGGATTTTATGGCATCATGCAATCTGGATGCCCTGAAACATTCCAGTCGTCCTTGCAAATGCAGCAAGG
TGAAAGGGGTGCAGGCTCAAGATTCCAAGATCGCCATCAGAGGATTGGACAGTTCAGACAGGGTGACATTATTGCCTTC
CCTGCTGGAGCTGCTCACTGGGCCTATAACGAAGGAAATGAGGAGCTTGTTCTTGTTGTTTAGAAGACAGCAGTAACA
ATGCCAACCAACTTGGTCAATTTTCAAGGAGATTCTTCATAGCTGGAAACCCACAACAAGGACAGCAACAACAGGGACA
ATACGGTGGCAAAAGCTTGCGCAGGGAACGATTCGAATCTGGAAATGTTTTCAATGGCTTTGACGTAGaggTCTTGGCC
GAGGCATTTGGTGTAGACAGGGAGATAGCAAGGAGACTTcaaggACAGGACGACcagCGAggccACATTGTaaacATTG
AGcaaGGACTCagagtTGTGAggccaccattCTcacaaGaacaagaggaTCGCGAGGAGAgacaaGagcaaggAcaata
cggtcctCGCATGaacggaaTtg > SEQ ID NO:2263 188943 196254_300707_1
ggttcgttagcccaacttcttagccaaagtacTAGTCAATGGCAAAGTTCTCGCCGTGGAAGTCCAAGAGAGTGCAGAT
TTGATCGGTTGCAAGCATTTGAGCCGATTCGCACTGTAAGGTCCCAAGCTGGTACAACTGAGTTTTTTGATGTCTCTAA
TGAGTTGTTTCAATGTACTGGAGTATTTGTTGTCCGTCGAGTTATCGAACCTAGAGGTCTTCTGTTACCTCACTACTCC
AATGGAGCAACTTTGGTATATGTCATCCAAGGCAGAGGTATAACAGGACCAACTTTCCCAGGATGTCCTGAGACCTATC
AACAACAGTTTCAGCAATCCGAGCAAGACCAACAATTGGAAGGCCAAAGCCAAAGCCATAAATTTAGAGATGAACATCA
AAAGATCCACCGTTTTCAACAGGGGGATGTAGTTGCATTGCCTGCTGGTGTTGCTCATTGGTGCTACAATGATGGTGAT
GCACCAATTGTtgccATATATGTCACTGATATATACAATAGTGCTAACCAACTTGATCcTagaCACAGGGAttTCTTTT
TAGCTggCaaCAATAaGAtaggtcaaCAAtTgTat > SEQ ID NO:2264 188943 197833_300701_1
ATTCAAGGGAGGGGTTCTATGGGTTTAACCTTCCCCGGTTGCCCAGCGACTTATCAGCAACAATATCCAACAATTTTCG
TCTCAAGGCCAAAGTCAAACCAAAAGTTTAGGGATGAGCATCAAAAGATCCATCAATTTAGACAAGGAGATGTTGTTG
CACTCCCAGCTGGTGTTGCACATTGGTTCTACAATGATGGTGATGCATCGGTTGTTGCCATATATGTTTATGACATAAA
CAACAGTGCAAATCAACTTGAACCAAGGCAAAAGGAGTTCCTATTAGCTGGTAACAACAATAGGGTTCAACAAGTATAT
GGCAGCTCAATTGAGCAACACTCTAGCCAAAACATATTCAACGGATTCGGTACTGAGCTACTAAGTGAGGCTTTAGGCA
TCAACACAGTAGCAGCAAAGAGGCTGCAGAGCCAACATGATCAGAGAGGAGAGCATCGTACATGTGAAAAATGGCCTTC
AATTGTTGAAACCGACTTTGACACAACAACAAG > SEQ ID NO:2265 188943 196591_300704_1
aaaaagcattcagttcattagtcctacaacaacatGGCATCCATAAATCGCCCCATAGTTTTCTTCACAGTTTGCTTGT
TCCTCTTGTGCAATGGCTCCCTAGCCCAGCAGCTATTAGGCCAGAGCACTAGTCAATGGCAGAGTTCTCGTCGTGGAAG
TCCAAGAGAATGCAGGTTCGATAGGTTGCAAGCATTTGAGCCAATTCGGAGTGTGAGGTCTCAAGCTGGCACAACTGAG
TTCTTCGATGTCTCTAATGAGCAATTTCAATGTACCGGAGTATCTGTTGTCCGTCGAGTTATTGAACCTAGAGGCCTTC
TACTACCCCATTACACTAATGGTGCATCTCTAGTATATATCATCCAAGGGAGAGGTATAACAGGGCCAACTTTCCCAGG
CTGTCCTGAGTCCTACCAACACAGTTCCAACAATCAGGCCAAGCCCAATTGACCGAAAGTCAAAGCCAAAGTCAAAAG
TTCAAGGATGAACATCAAAAGATTCACCGTTTCAGACAAGGAGATGTTATCGCGTTGCCTGCTGGTGTAGCTCATTGGT
GCTACAATGATGGTGAAGTGCCGGTTGTTGCCATATATGTCACTGATCTCAACAACGGTGCTAATCAACTTGACCCTAG
GCAAAGGGATTTCTTGTTAGCTGGAAATAAGAGAAACCCTCAAGCATACAGGCGTGAGGTTGAGGAGCGGTCACAGAAC
ATATtcactGGCTTTAGCACTGAACTACTTAgcGAGGCTCTTGGCGTAAGCAGCCAAGTGGCAAGGCAGCTCCAATGTC
AAAATGACCAAAGAGGAGaAATTGTCCGTGTCGAACACGGGCTCagtTGCTGCagcCATATGCATCATTGCAGGAGCA
GGAACaacgacAAGTGCAATCAagAGAGCGtTATCAAGAaggACAATATCAGCAAAGTCAATATGGAaGtGgctGcTcT
AACGGTTTGGaTgagacctTTTGCACCCTgaggGtAaggcaaAACATcgataAtCctaacCGTGCtGATACATACAATC
Ca > SEQ ID NO:2266 188943 196239_300707_1
GAAGAATGAACAATTCCAGTGCACAGGTACATTTGTCATCCGACGTGTCATTGAGCCTCAAGGCCTTCTGGTACCTCGA
TACAGCAATACTCCTGGCATGGTCTACATCATCCAAGGGAGAGGTTCTATGGGATTAACTTTCCCCGGCTGCCCAGCAA

FIG. 2 continued

CCTACCAACAACAATTCCAACAATTCTTGCCTGAAGGCCAAAGTCAGAGCCAAAAATTTAGGGATGAGCACCAAAAGAT
CCACCAATTTAGACAAGGAGATATCGTTGCACTGCCAGCTGGTGTTGCGCATTGGTTCTACAATGAAGGCGAT

> SEQ ID NO:2267 188959 1110603_301541_1
AAAAGAACGTCGTCCTATAGATCTCTCCCAGGGGATACCGGCAAAGAGGACGAACCTACCCCTGCGCAGTCATGATTCA
TTTTGTGGTACTCATTAGCCGGCAGGGGAAAGTGCGATTAACCAAGTGGTACTCTCCTTATGCTCAAAAGGAAAGGACA
AAGATCATTCGAGAACTTAGTGGAGTGATATTATCAAGAGGTCCGAAACTTTGCAATTTTGTGGAATGGCGAGGCTTCA
AAGTAGTCTATAAGCGGTATGCTAGCTTATATTTCTGCATGTGCATTGATGGGGACGACAATGAATTAGAATGCCTTGA
GATAATTCACCACTACGTCGAGATTCTCGATCGCTACTTTGGAAATGTTTGTGAGCTAGACCTTATTTTCAATTTTCAC
AAGGCTTACTACATACTAGATGAGGTTTTACTTGCTGGGGAGCTTCAAGAAACTAGCAAGAAGTCCGTCGCCCGTGTCA
TCGCTGCACAGGACACGCTAGTTGAAAATGCCAAGGAGGAGGCGAGCTCTCTCTCTAACATCATTGCACAAGCCACAAA
GTGAGAAA

> SEQ ID NO:2268 188959 145211_301058_1
AGAAGTATAACCTTGTTCTCTCACATTCACCTTAGCAGAAGCAGAAGAAGGAAGAGGAGGAGGTGTTTGTTCTTTGGAT
CACCAATCATGATTCACTTTGTGCTGCTCATTAGCCGGCAGGGAAAAGTGAGGCTAACCAAGTGGTATTCACCATATAC
ACAAAAAGAGAGAACCAAGGTAATCCGTGAACTAAGTGGTATGATTCTCTCCCGAGGACCGAAGCTTTGCAATTTTGTT
GAGTGGAGAGGATATAAAGTTGTTTATAAAAGATATGCAAGCCTGTACTTCTGTATGTGCATAGACCAAGACGACAATG
AGTTGGAGGTCCTGGAAATCATACACCATTATGTTGAGATTCTGGACCGTTACTTCGGAAGTGTCTGTGAGCTGGATTT
AATCTTCAATTTTCACAAGGCATACTATATATTGGATGAACTTGTGATTGCTGGTGAACTCCAAGAGTCGAGCAAGAAA
ACTGTTGCACGTCTAATTGCTGCACAGGATTCTTTGGTTGAGGCTGCCAAAGAAGAGGCAAGTTCTATTAGCAACATCA
TTGCACAGGCCACAAAATGAAAGATGGAGTGCATTACTGTTTTATGGTTCTCATTCATTGCTGTAATCAGATCTTG

> SEQ ID NO:2269 188959 8156_300316_1
TTCTGGAGATCTCTTCTGGGAATCGAGCTTCACTGTTAAAGATTTTCCTTCAATCGGCTAAAAATGATACATTTCGTGT
TACTAGTCAGTCGACAAGGGAAAGTAAGGCTCACCAAGTGGTATTCGCCGTATACGCAGAAGGAAAGATCTAAGGTCAT
ACGTGAACTCAGTGGAGTGATTCTGAACCGAGGTCCCAAGCTCTGCAATTTTATTGAATGGAGAGGATACAAGGTTGTC
TACAAAAGATATGCAAGCTTGTACTTCTGCATGTGCATTGATGAGGCGGATAACGAGTTAGAGGTACTGGAGATAATTC
ATCACTACGTCGAGATTCTTGACCGCTACTTTGGCA

> SEQ ID NO:2270 188984 264916_301440_2
agAActgatgTGAGAgatgtagaagttTTgaGtGAGATTTATATCtCTatcaatgacaattacaaATCTTACAAAGACT
TTAaGGTGCTTGATGCTTTGGATAAGGCTTTAGTGGATAGATATCGATCCCCTTATAGTGCTATTTCTGCTTTGGTTTC
TTTATGTTATCATATCTTTGACTTTAATAAGTTTAAGTTGCTGTTTAATTGTGAAGGGAAATTTGTGGATAAGAAGCTG
AGAAAAGACTTCGAGTGGTGAACTCTAGGTCCTGATGTTTAAATCTACTGTATTTACCTTCGCATTAATTAAGCATGAA
GATCATTTTCGTCTTTGCTCTCCTTGCTATTGCTGCATGCAGCGCCTCTGCGCAGTTTGATGTTTTAGGTCAAAGTTAT
AGGCAATATCAGCTGCAGTCGCCTGTCCTGCTACAGCAACAGGTGCTTAGCCCATATAATGAGTTCGTAAGGCAGCAGT
ATGGCATAGCGGCAAGCCCCTTCTTGCAATCAGCTGCGTTTCAATTGAGAAACAACCAAGTCTGGCAACAACTCGGGCT
GGTGGTGCAACAATCTCACTATCAGGACATTAACATTGTTCAGGCCATAGCACAACAGCTACAACTCCAGCAGTTTGGT
GATCTCTACTTTGATCGGAATCTGGCTCAAGCTCAAGCTCTGTTGGCTTTTAACGTGCCATCTAGATATGGTATCTACC
CTAGGTACTATGGTGCACCCAGTACCATTACCACCCTTGGCGGTGTCTTGGCGGCCGCTTATCCGTATGATGTTCCGGA
TTATGCCGAGCTCTACAAACAGCTGTTGAATTTTGATTTGCTGAAGTTGGCGGGTGACGTGGAATCTAACCCTGGTCCT
AGGTCTAGAATGGCTACTTTCTCTTGTGTGTGTTGTGGTACCTTAACTACAAGTACTTACTGTGGTAAGAGATGTGAGC
GAAAGCATGTATATTCTGAAACAAGAAATAAGAGattggaaCTTTACaaGAAGTATCTATTGGAACCgcaaaaatg > SEQ ID NO:2271 188984 196126_300724_1
CAATTCAAATATTATAGTTGAAGCATAGTAGTAGAATCCAACAACAATGAAGATCATTTTCGTATTTGCTCTCCTTGCT
ATTGTTGCATGCAATGCCTCTGCGCGGTTTGATCCTCTTAGTCAAAGTTATAGGCAATATCAACTACAGTCGCATCTCC
TACTACAGCAACAAGTGCTCAGCCCATGCAGTGAGTTCGTAAGGCAACAGTATAGCATAGTGGCAACCCCCTTCTGGCA
ACCAGCTACGTTTCAATTGATAAACAACCAAGTCATGCAGCAGCAGTGTTGCCAACAGCTCAGGCTGGTAGCACAACAA
TCTCACTACCAGGCCATTAGTATTGTTCAAGCGATTGTGCAACAGCTACAACTGCAGCAATTTAGTGGTGTCTACTTTG
ATCAGACTCAAGCTCAAGCCCAAACTCTGTTGACCTTCAACTTGCCATCCATATGTGGTATCTACCCTAACTACTATAG
TGCTCCCAGGAGCATTGCCACTGTTGGTGGTGTCTGGTACTGAATTGTAACAATATAATAGTTCGTATGTTAAAAATAA
AGTCATACATCATCATGTGTGACTGTTGAAACTTAGGGTCATATAAATCTAAATAAAATCATCTTACCTAAAAAAAaa > SEQ ID NO:2272 188984 196601_300729_1
CAAACATTATAGTTGAAGCATAGTAGTAGAATCCACAAAAATGAAGATCATTTTCGTATTTGCTCTCCTTGCTATTGT
TGCATGCAACGCTTCTGCACGGTTTGATGCTCTTAGTCAAAGTTATAGACAATATCAACTACAATCGCATCTCCTGCTA
CAGCAACAAGTGCTCAGCCCATGCAGTGAGTTCGTAAGGCAACAGCATAGCATAGTGGCAACCCCCTTCTGGCAACCAG

FIG. 2 continued

> SEQ ID NO:2273 188984 196556_300704_1
CTACGTTTCAATTGATAAACAACCAAGTCATGCAGCAACAGTGTTGCCAACAGCTCAGGCTGGTAGCGCAACAATCTCA
CTACCAGGCCATTAGTAGCGTTCAGGCGATTGTGCAGCAACTACAGCTGCAGCAGGTCGGTGTTGTCTACTTTGATCAG
ACTCAAGCTCAAGCTCAAGCTTTGCTGGCCTTAAACTTGCCATCCATATGTGGTATCTATCCTAACTACTACATTGCTC
CGAGGAGCATTCCCACCGTTGGTGGTGTCTGGTACTGAATTGTAATAGTATAATGGTTCAAATGTTAAAAATAAAGTCA
TGCATCATCATGCGTGACAGTTGAAACTTGATGTCATATAAATCTAAATAAAATCACCTATTTAAATAGCAaa

> SEQ ID NO:2273 188984 196556_300704_1
GAACTAGTGTCCTGCAACAATGAAGATCATTTTCGTCTTTGCTCTCCTTGCTATTGCTGCATGCAGCGCCACAGCGCAG
TTTGATGTTTTAGGTCAAAATATTAGGCAATATCAGGTGCAGTCGCCTCTCCTGCTACAGCAACAGGTGCTTAGCCTAT
ATAATGAGTTCGTAAGGCAGCAGTATAGCATTGCGGCAAGCCCCTTCTTGCAATCAGCTGTGTTTCAACTGAGAAACAA
CCAAGTCTTGCAACAGCTCAGGCTGGTGGCGCAACAATCTCACTACCAGGACATTAACGTTGTCCAGGCCATAGCGCAG
CAGCTACACCTCCAGCAGTTTGGCGATCTCTACATTGACCGGAATCTGGCTCAAGCGCAAGCACTGTTGGCTTTTAACT
TGCCATCTACATATGGTATCTACCCTAGGTACTATAGTGCACCGGGTAGTATTACCACCCTTGGCGGTGTCTTGTACTG
AATTTTCACAATATTGTAGTTCGGAAGTGAAAATATAAGCTCAGGTATCATCGGATGTGACATGTGAAACTTAAGGTGA
TATAAATAGAAATAAAATTATCTTTCATATTTAAAAAAa

> SEQ ID NO:2274 188984 197209_300700_1
gcattatacagcaaaaaagaaagatctagtgtcccgtagcaATGAAGATCATTTTCGTCTTTGCTCTTCTTGCTATTGC
TGCTTGCAGCGCCTCTGCGCAGTTTGATGTTTTAGGTCAAAGTTATAGGCAATATCAGCTGCAGTCGCCTCTCCTGCTA
CAGCAACAGGTTCTTAGCCCATATAATGAGTTCGTAAGGCAGGAGTATGGCATAGCGGCAAGCCCCTTATTGCAATCAG
CTGCGTTTCAACTGAGAAACAACCAAGTCTGGCAACAGCTCAGGCTGGTGGTGGCGCAACAGTCTCACTATCAGGATATTAA
AATTGTTCAGGCCATAGCGCAGCAGCTGCAACTCCAGCAGTTTGATGATCTCTACTTTGATCGGAATCTGGCTCAAGCT
CAAGCTCAAGCTCTGTTGGCTTTGAACTTGCCATCTAGATATGGTATCTACCATAGGTACTATAGTGCACCTAGTAGCA
TTACCACCCTTGGCAGTGTATTGTACTGAGTTTTAACAATATAGTGGTTCGGAAGTTGAAAATAGGCTCAGATATCATC
ATATTCGACATGTGGAACTcaggttgaTATATCCTAGTACATCATCGTAACTAATTACCATCGTTGGTACTCT > SEQ ID NO:2275 188984 197218_300700_1
aTCACAACTCAAACATTACAGCGAAAGCATAACAACTAGAATCCCACCACAATGAAGATCATTTTCTTCTTTGCTCTCC
TTGCTATTGCTGCATGTAGCGCCTCTGCGCAGTTTGATGCTGTTACTCAAGTTTACAGGCAATATCAGCTGCAGCCGCA
TCTCATGCTGCAGCAACAGATGCTTAGCCCATGCGGTGAGTTCGTAAGGCAGCAGTGCAGCACAGTGGCAACCCCCTTC
TTCCAATCACCCGTGTTTCAACTGAGAAACTGCCAAGTCATGCAGCAGCAGTGCTGCCAACAGCTCAGGATGATCGCGC
AACAGTCTCACTGCCAGGCCATTAGCAGTGTTCAGGCGATTGTGCAGCAGCTACAGCTACAACAGTTTGCTGGCGTCTA
CTTCGATCAGGCTCAAGCTCAAGCCCAAGCTATGTTGGCCCTAAACTTGCCGTCAATATGCGGTATCTACCCAAGCTAC
AACACTGCTCCCTGTAGCATTCCTACCGTCGGTGGTATCTGGTATTGAATTGTAGCAGTATAGTAGTACAGGACACAAA
AATAAAGTCATGCATCATCGTGTGTGACAAGTTGAAACATCGGGGTGATACAAATCTGAATAAAAATGTCATGCAAGTT
TAAAcataatgCCTCTGt > SEQ ID NO:2276 194652 110750_300041_1
CTCCATTTCACTAAATACTTATTGTCTTCTCTCTTCTTTGCGTTTACTTACTTTCTGTCTCCTGCTTCTAGGGTTACTC
TCTCAAAATCCAACTACAAAAATTTTTTAATTCATTTTTACTTCTATTAAAGATCCTATATAGCTATGATGTTGCAAGA
ATCAAGGTACATAGCTTGAAAGACTTTGCACTACAAAAGGAAATTTTAAGGAAATTATGGCTTCTTCCAGCAGCTACTC
CAACCCACCATGTGCTGCATGCAAATTCTTGAGAAGAAAATGTTTGCCAGGTAATTGCATATTTGCACCCTATTTTCCT
CCAGAAGAGCCAACAAAATTCGCCAATGTACACAAAATATTTGGTGCGAGCAACGTAAGTAAACTCTTAAATGAAATCC
AACCTCACCAGAGAGAAGATGCAGTAAATTCTCTTGCTTATGAAGCTGAAGCACGTATGAAAGATCCAGTTTATGGTTG
TGTTGGAGCAATTTCAGTTCTACAACGACAAGTTATTCGTCTTCAGAAAGAACTTGATGCTACGAATGCTGACTTAATG
CGATATATTAATCCGTCTGGAGGAAGCATTAATAATCAGATTACGGTAAATCAACAA > SEQ ID NO:2277 20019 267218_200116_1
atctaccaacacagaaagggtagccatgtcttccttaacaaccagacaacttttccacagaacaagtagtaattcccaa
gTGCAAATTTGTCCTTCTAGGTGTATTCCTGTTTTCATCACCAACAAGACCAACAACAGTAATAGATTCTTTAACATCA
GTAAGTTTTCAGGTTTCAAGAATTTGAGTGTTGTGGTAAAGGCAGCTGCTGGGGATGGAGGAATTTCACCTAAGAATCA
AGATGATGAAGATGGTGTCTTTGGGAACCATGAAATTGCCTCTGGATATTGATGTTGCAAGATTTGAAACTCTACTT
TTTCAGTGGGCTAACAGTCTTTGTCAAGGAGCTATGCTGCCACTTCCAGTGCCTCTAAAGGTTGACAAAATTCCTCGCG
GAGCCAGACTTGGTTTTATTACAGTTGAAGATGCACAAACTGAAGTACTTGTATATATAGATTGTATGGTTTTTCCTGC
TACGGATAACTCACCTCCGATATTTCGAGCTATAAGAAATGGACCATCGAGAGATAAGGCGCCTCCGGGGAGCCAAGA
ATCATGAGAAGTCTTTTAGGTGCTCTTCAGAAATCTGTTGAGATTGCTAGAGTTTGAAAATTGAAACATTTTTTCTATT
CCAATTGTTCTGTATTTCAACACTCTTTTATGTATAAAAGCATTTCCACATTTTCTGTAATAACTTCCTGATTTTATTA
TCAATATTAAACAGCTTCGTa

FIG. 2 continued

> SEQ ID NO:2278 200621 246066_301574_1
gcatggagcacgtggtggcacggccgagctaggtgggtttggtgctgtgcagcagtgtgcatatatgggcagtcggccg
cGGGTCAAGAGGCTGGCAAGCCAGGCAATGGGCGAGGAGGATGCCACCACATACGAGGACGCCACCGACGAGGAGCAAG
AGTTTGAGGAATTGCAAGAGCCAGTGAATGGCGACGCTGTGAGCAGCACTAGTGGTGCTGATGACGGTGAGGAGGAGGA
CGAGGAGGAGGACGAGGAGGACGACGAGGAAGACGAGGACGAGGACGAGGAGGACGAGGAGGACAAGGATGCAAATCGT
CGCCGGCGTTACCAGCCTCACCCATCGCCGCCACCGGACGCGAGCAGTCGCCCCATAAGGGTATACGCGGACGGCATCT
ACGATCTCTTCCATTTCGGCCATGCTCGATCCCTTGAGCAGGCCAAGAAGCTATTCCCCAACACCTACTTGCTCGTCGG
CTGCTGCAGCGACGCTCTTACCCACAAGTATAAAGGCAAGACTGTGATGAGCGAAGCGGAACGATACGAGTCGTTGCGT
CATTGCAGGTGGGTGGACGAGGTGATCGAGGACGCACCGTGGGTTATCAACCAGGAGTTTCTGGACAAGCACCGCATTG
ATTATGTGGCCCATGACGCGCTGCCGTACGCTGATGCGAGTGGAGCAAGCAAGGACGTTTATCACTTCGTTAAAGCCGC
GGGGAAGTTCATGGAaaccaAGCGGACCGATGGGGTCTCGACTTCGGACCTCATCATGCGGATCATCAaggactacaaT
GAATATGTCATGCGCAATCTCGCCCGCggcTACTCGAGAAagagCTggGCGTGAGCTACGTCAAGGAaaagcAGCTGC
aAgTcaacatGGGGATGCGgAaGCTgcgtcagaaagtCaaagaacagcAGGAACGTgttggaCAgAGGCT > SEQ ID NO:2279 200621 6883_300313_1
CCCACGCGTCCGGCCAAATTAGCGTTTCCAAACAACACTTACCTTCTTGTTGGATGTTGCAATGATGAGACTACCCATA
AGTACAAGGGAAGGACTGTAATGACTGCAGAAGAGCGATATGAATCACTTCGACATTGCAAGTGGGTGGATGAAGTCAT
CCCTGATGCACCATGGGTGGTCAACCAGGAGTTTCTTGACAAGCACCAGATTGACTATGTTGCCCACGATTCTCTTCCC
TATGCTGATTCAAGCGGAGCTGGAAAGGATGTCTATGAATT > SEQ ID NO:2280 200621 158055_200000_1
AAACACTTATCTTCTTGTTGGATGCTGCAATGATGAAATCACCCACATGTACAAGGGAAAAACGGTTATGAATGATAAG
GAGCGCTATGAATCTCTGCGCCACTGCAAATGGGTTGATGAAGTTATTCCAGATGCGCCTTGGGTTGTTACTCCGGAGT
TCATTGAGAAACATCAGATTGACTATGTGGCACATGATGCTCTTCCTTATGCAGATGCAAGTGGAGCTGGAAATGATGT
TTACGAGTATGTCAAGTCCATTGGTAAGTTTTTGGTGACCAAGCGGACTGATGGAAT > SEQ ID NO:2281 200621 167780_300550_1
GAATTCCGGAAGAGGAGAAGAAGATGTCGAGGGGCGATCCACCTGTTCGTGTTTACGCCGATGGAATCTACGATCTCTT
CCACTTCGGTCATGCTCGCTCTCTCGAACAAGCCAAGAAATCGTTCCCAAACACGTATCTTCTGGTTGGATGCTGCAGC
GATGAAGTTACACATAGATATAAAGGCAAAACTGTCATGACCGAATCCGAACGATATGAATCTCTTCGCCATTGCAAGT
GGGTTGACGAAGTCATTCCGGATGCACCATGGGTTATCTCACAGGAGTTCCTTGATAAGCATAATATCGACTATGTTGC
TCACGATTCTCTCCCTTATGCTGATACGAGTGGAGCTGGAAAAGATGTATATGAATTTGTTAAAAAGGTTGGAAAATTT
AAGGAGACGCAACGTACTGATGGGATTTCTACCTCAGATATTATTATGAGGATTCTTAAAGATTATAACCAATATGTGA
TGCGTAACCTGGATCGTGGGTATTCACGGAAAGAACTTAATGTCAGCTATGTGAAGGAAAAGCGTCTTCGAGTCAACAT
GGGTTTGAGGAAATTACGTGACAAAGCCAAGGAACACCAAGAAAAAGTGGGAGAGAGGATACAAACAGTCGCAAAAACT
GCTGAACT > SEQ ID NO:2282 200622 1099683_301449_1
aatgaaatcttgttgaacttttcccctcttcttcttccttcagttgagagaGACGGTGGTTCTTCTTGGGTTCGGGTTC
AGGTGTGTAGATAGATCGTGGGAGAGCAATGGGCGCCAAAAGGTGTTCAGTTTCGAGCAGGTCTCGAACCACGCCCAA
TCCAAGGATTGCTGGATCATTGTCAGTGGAAAGGTTTACAATGTAACGCGGTTTCTGGATGAGCATCCTGGAGGAGATG
AAGTCATATTGTCATCCACAGGGAAAGATGCGACAGACGATTTCGAAGATGTGGGGCACAGCAAGACCGCGCGGCGAT
GATGGAGGAGTACTACATCGGAGAGGTTGACCTTTCCACCGTCCCTTCCAAGCCATCCTATGCACCCGCCAAACAAGCC
CATTACAACCCCGACAAAAGCTCAGAGTTCATCATTAGGATTCTCCAGTTTCTTGTCCCACTTGCCATTCTGGGTTTAG
CGATTGCTGTCCGTGTTTTCACTAAGAAAACCGAATGATTGCATGCACCCTTTAAAAAGTAGTGGGTGGGGATAAGGGG
AATGGAAGAAGAAGAAAAAAAGGTGCGTCCTAAAATGTGTTATCTATCGTAGAAGCTAATGTAGATGCgGTGTTTTCC
CtagtTTTATCCCTAGgttgctTattCatCCTgtttaaattGtggGATACCTACACTGTTACAACTATGGaggcccctttG
GATCTGTTgcaagaAGGagGTTCcttgtttactTCCAtgTAATGAATattggcagt > SEQ ID NO:2283 200622 1117383_301820_1
TGACATATATTATATAGGACTCATTTAGAGGGTTAGTTGTTGCTGGTAGTAGTCGATAGTCGATAGTCGAGGGCCATGT
CGAAGAAGGTGTTCAGTCTGGAAGAGGTCTCTCAGCACAACTCCTCCAAGGATTGCTGGATCATCGTTCACAATAAGGT
TTATGATGTCACATCATACTTGGAAGATCACCCTGGGGGAGACGATGTTATTTTGCAAGCAACAGCTAAAGATGCCACT
GACGACTTTGAAGATGCCGGGCATGGCTCAGATGCACGGACATTGATGGAGAAGTATTACGTCGGGGATGTCGATCTTA
ATGGTAATCAAGGAAAACAACCCAACAAGTTCTATAGCCTTTCCAAGGAATCCGATCTCTTGATAAAGGTTTTGCCAGC
TGTTGCGGTACCACTCATTATTCTTGGATTGGTTATCGTTGTTCGAAATCTAAGAACTCTAAAAAACTCCCATGACTAG
ACCTCTTCTTTAAAGACTATCAAATTATTCTT

FIG. 2 continued

> SEQ ID NO:2284 200622 201905_300721_1
cggacgcgtgggttgtttcagtggctcagaaattttcttcttttcgtattattgttttcctttatttaaggaaggagtt
gGGCTCTCTCTCTAAGTCTGAATCCCCACGAGACGAGAAACCTAGCAAAAATCTCGTCTTTCGCCGCTCTCTCCCTCCT
CTGATTCCTGCTGTTCTTGATCTTGGATCTCAATTCCCAACCAAGAACACACAGACAGAGAAAGGAAGGAGAAGAAGAT
GTCAACGACAACAAGAAGGTGTATACCCTGGAGGAGGTCGCCAAGCACAACTCCAAGGACGACTGCTGGCTCATCATC
GGCGGAAAGGTATACAATGTGTCGAAATTCCTTGAGGACCATCCAGGAGGTGATGATGTCTTGCTATCTTCAACTGGCA
AGGACGCGACTGACGATTTTGAGGATGTCGGGCACAGCACGACTGCTCGTGCGATGATGGATGAGTATTACGTTGGCGA
CATCGACACATCCACAATACCCGCGAGGACGAAGTACGTTCCCCCAAAGCAACCACACTACAACCAGGACAAGACCCCG
GAGTTCATCATCAAGATCCTCCAGTTCTTGGTTCCCCTCGCCATATTGGGCCTGGCTGTTGCAATTAGGATCTACAcca
agtCGGAGt > SEQ ID NO:2285 200622 194119_300761_1
CCGGCGGGGTTTCCGGCGCCGCCGAGAGAGCGGAGCGTGTCCAGATCGCGTGACTCCCCCACACTCCGCTCCGCTCCCC
CCGCGGCCACGCGCTCCTCGTCGGCTTCCGCTTCCTCCCACCACCTCGCAGCGTTGCAGGGCGTGGGCGTGGGCGGCGG
ACATGGCCGGCGAGAAGAAGGTGTTCGGGTTCGAGGAGGTGGCCGGCCACAACGTCACCAAGGATTGCTGGCTCATCAT
CGCCGGGAAGGTATATGATGTTACTTCTTTTATGGATGAGCACCCTGGTGGCGATGAAGTGTTGCTAGCAGTAACTGGC
AAAGACGCAACCAATGATTTTGAAGACATTGGCCACAGTGAATCAGCAAGGCGAGATGATGGAGAAGTATCTCATTGGGG
AGATTGATGCTTCAACCATCCCAGTAAAGCGTACTCATGTCACTCCCCAGCAAGCGCCCGGCAACCCAGACAAGGGCGA
TGACATGCTCATTAAGATCTTGCAGTTTCTTGTCCCCATCTTGATCTTGGGGCTTGCATTTGCTATCCGGCAGTACACC
AAATCTGAGTAGATCTGTTATTACAATGTTGATAATCAATATGGTCCATGAAGCTATATTAGGTGAAATGATTTGGATC
AAAAGAACTAAATAATGATATTTGTTGAGGGGAACGGTATGT > SEQ ID NO:2286 200622 171742_300536_1
agatcgcgtgacTCCCCCACACTCCGCTCCGCTCCCCCCGCGGCCACGCGCTCCTCGTCGGCTTCCGCTTCCTCCCACC
ACCTCGCAGCGTTGCAGGGCGTGGGCGTGGGCGGCGGACATGGCCGGCGAGAAGAAGGTGTTCGGGTTCGAGGAGGTGG
CCGGCCACAACGTCACCAAGGATTGCTGGCTCATCATCGCCGGGAAGGTATATGATGTTACTTCTTTTATGGATGAGCA
CCCTGGTGGCGATGAAGTGTTGCTAGCAGTAACTGGCAAAGACGCAACCAATGATTTTGAAGACATTGGCCACAGTGAA
TCAGCAAGGGAGATGATGGAGAAGTATCTCATTGGGGAGATTGATGCTTCAACCATCCCAGTAAAGCGTACTCATGTCA
CTCCCCAGCAAGCGCCCGGCAACCCAGACAAGGGCGATGACATGCTCATTAAGATCTTGCAGTTTCTTGTCCCCATCTT
GATCTTGGGGCTTGCATTTGCTATCCGGCAGTACACCAAATCTGAGTAGATCTgttATTACAATgttGATAATCAATAT
GGTCCATGAAGCTATATTAGGTGAAATGATTTGGATCAAAAGAACTAAATAATGATATtt > SEQ ID NO:2287 200622 158558_200019_1
CCCTTTCTTCTCTTCACTCTTCAATTCTTGTGTTAGTAGTCTTGACACCCAATTCAAGATTCATTACATCTTTCATTTC
TCCATTCCAATTGAGGAGTAATTTTTTTGCTGTGTCCATAAATGGGTGGTGAAACTAAGGTTTATACGTTGGCTGAAGT
TGCCCCTCACAACAATAACAAAGATTGTTGGCTTGTTATTAGTGGCAAGGTGTACGATGTGACAAAATTCTTGGACGAC
CACCCAGGTGGCGATGAGGTTTTGTTGGCTGCTACGGGAAAGGATGCAACTGATGATTTTGAGGATGTCGGGCCACAGCA
CCAGTGCTCGAGCAATGTTGGATGAGTATTACGTAGGCAATATTGATTCAGCAACCATCCCTACAAAAACCAAGTACAC
TCCTCCTAATCAGCCTCATTACAACCAGGACAAAACATCCGAGTTTGTAATTAAGCTCCTCCAGTTCTTAGTTCCCCTG
ATAATATTGGGTGTAGCTGTTGGCATCCGCTTCTACACCAAACAACAATCAGCTTGAAGATTGAGTACGCGATGAATTC
ATAATAAGTGTCCACATTTCCGAAATGTGACCCTTACCCACCCCCAA > SEQ ID NO:2288 200622 156828_301732_1
GAATAATGGGGGGTGAAACTAACGTCTTTACTTTGGCTGAGGTCTCCCAGCACAACAACGCCAAGGATTGTTGGTTGGT
TATTAGTGGCAAGGTATATGATGTGACAAAATTCTTGGATGACCACCCAGGAGGTGATGAGGTTTTGTTGTCTGCAACT
GGAAAGGATGCAACAGATGATTTTGAGGACGTTGGCCACAGCAGCAGTGCTCGAGCGATGTTGGATGAGTATTACGTAG
GTGATATTGATTCAGCGACCATCCCCACCAAGACCAAGTACACTCCTCCCAATCAGCCACATTACAACCAGGACAAAAC
ATCAGAGTTTGTCGTCAAGCTCCTCCAATTCTTAGTTCCCCTGATTATTTTGGGTGTTGCTTTTGGCATCCGCTTCTAT
ATCAAACAGTCATCAGCTTGAAGATGGAGTTCGTGGTGAAGTCATAAGAAGTGTCCAGAAGAAAGGTTGTGTGTGTGTG
TGTGGGGGGGGG > SEQ ID NO:2289 200622 12752_300251_1
CCCACGCGTCCGAGCGGTTGGTGTAAGATCCCAAACTCACAGATTCCCAAATAATAGTAATACTCTTCCTCTTCTCAAC
TCTCACCAGTCACCAGCAGATCATCGGAGATGGGCGGAGACGGAAAAGTTTTCACCTTGTCCGAGGTTTCTCAGCACAG
TAGCGCCAAGGATTGTTGGATCGTCATCGACGGCAAGGTTTATGATGTGACAAAGTTCTTGGATGATCATCCTGGTGGT
GATGAGGTTATCTTGACTTCTACAGGGAAAGATGCGACCGATGATTTCGAGGATGTGGGACATAGTTCGACTGCGAAAG
CCATGCTAGATGAGTACTATGTGGGTGA

> SEQ ID NO:2290 200622 253307_301625_1

FIG. 2 continued

AATCATCAAAATGTCTGACACCGCCGCCATTCCTACTGATACTGCCGAGAAGAAGATCTTCACCCTCAAGCAGGTCGCC
GAGCACAAGGACCGAAATGATCTGTGGATGATCATCAACGGCAAGGTCTACGACATCTCCAGCTTCGTTGACGAGCATC
CCGGTGGAGAGGAGGTTCTTCTTGATGCCGGTGGAACTGAGGCCACCAACGCTTTCGACGACGTTGGACACTCTGAGGA
CGCTTACGGCATCCTTAACGACCTCTATGTCGGTGAGGTTGACCCCAGCGAGGACGTTATCCGAAAGACTCACACTGTC
AAGACTTCTTACGAGGACGGCGAGTCTGTTGGTGATGACCACGGATCTTCTTCCATGATCTTCCTCATTGTTGCTGCTG
CTGTTGCCGCCGCTGCTTTCTTCTACCTCCAGGGTCAGAAATAAGTATGTTAAATCATTTGGATATTGGTAGTTAATCA
TTTTTATT

> SEQ ID NO:2291 200622 8227_300304_1
ATTCGGCACCAGGAGCTTCGGAGCTATCGAAAATTCTGAATCTGAAAGGTTTGAGTGAAGATGTCTTCAAATCGGAAGG
TTCTAAGTTTTGAAGAAGTTTCAAAGCACAACAAAACTAAGGATTGTTGGCTTATTATTTCCGGCAAGGTGTATGATGT
GACTCCATTCATGGATGATCATCCTGGAGGCGATGAAGTCTTGTTGTCCTCAACAGGGAAAGATGCTACAAATGATTTT
GAAGACGTTGGTCACAGCGACACTGCAAGGGACATGATGGACAAATATTTCATTGGTGAGATTGATTCGTCTAGTGTTC
CAGCAACTAGGACATACGTTGCACCACAGCAACCAGCCTACAACCAAGACAAGACACCAGAATTCATTATCAAGATTCT
TCAGTTCCTTGTTCCGATCTTGATCTTGGGATTGGC

> SEQ ID NO:2292 200622 55896_300130_1
TTTCTCAGCACAGTAGCGCCAAGGATTGTTGGATCGTCATCGACGGCAAGGTTTATGATGTGACAAAGTTCTTGGATGA
TCATCCTGGTGGTGATGAGGTTATCTTGACTTCTACAGGGAAAGATGCGACCGATGATTTCGAGGATGTGGGACATAGT
TCGACTGCGAAAGCCATGCTAGATGAGTACTATGTGGGTGATATTGACACAGCTACTGTGCCGGTTAAAGCTAAGTTTG
TGCCTCCTACGTCGACGAAAGCCGTGGCTACTCAGGATAAGAGCTCGGATTTTGTTATTAAGCTCCTTCAGTTCCTTGT
TCCACTTCTAATCTTAGGCTTGGCTTTCGGCATTCGGTACTACACTA

> SEQ ID NO:2293 200622 50844_300186_1
CCCACGCGTACGGGCGAATCTAATTTCGTTTCACGATGTGGCTAAACATAAGTGCAAGAACGATTGTTGGATTCTCATC
CATGGAAAGGTCTATGACATCAGCACTTTCATGGACGAACATCCCGGAGGTGACAATGTTCTCCTCGCCGTCACCGGGA
AAGACGCGTCGATCGATTTCGAAGATGTGAACCATAGCAAAGATGCCAAGGAGCTAATGAAGAAATACTGTATCGGTGA
CGTTGACCAGTCAACGGTTCCGGTGACGCAACAGTATATTCCGCCGTGGGAGAAGGAATCTACGGCGGCGGAAACAACT
AAAGAAGAATCTGGAAAGAAGCTGCTTATCTACTTAATTCCTCTCTTGATACT

> SEQ ID NO:2294 200622 274377_200056_1
TCGTTTCCTCCTCTAAAATCATAATCTAATTTATCTTTCAGTTTTATTTTTCTTAGAAAAATTGTGTAATAAATGGGTG
GTCAATCTAAGGTCTACACTTTAGCTGAGGTTTCTAATCACAACAATGTCAAAGATTGTTGGCTTATTATCAGTGGCAA
GGTGTATAATGTGACGAAGTTCTTGGAAGATCACCCAGGTGGGGATGAGGTTTTATTGTCCGCAACAGGAAAGGATGCT
ACTGATGATTTTGAGGATGTTGGTCACAGCACTAGTGCTCGAGCAATGTTGAACGAGTATTATGTAGGTGATATTGATT
CTTCCACCATACCAACAAAGGTCAAGTACACTCCTCCAAAGCAACCTCATTACAACCAGGACAAAACACCAGAGTTCAT
CGTCAAGCTCCTCCAATTCTTGGTTCCTCTGATTATTCTAGGTGTGGCTTTTGGCGTTCGCTTCTACACTAAACAGTCA
GCTTGAAGATTGATTATGGTGATCTCATAATAAGGATCCAAATTACCGCAACGTTAGAAGAACAAAAAAAAGAAAATAA
AAAGAAAAGAAAAAGAGCTTTTACTTTGTTAACCAGGCAAATTATCTTGTTTA

> SEQ ID NO:2295 200631 239440_301304_1
gacagagaaaTGGATGCGTTGATCCGGCATCCCGGGGAGCTGCCCGCCCTCTTGCGGATGAAGATCGCAGCTGCCCGCG
CTGCTCATGCATTGCCGCCGGATCCACACTTGGCCTACTGCTACCGCATCTTGCTCCTCGTCTCGCGGAGCTTCGCCGT
CGTCATCCAGCAGCTGGATCAAGAGCTTCGCGATGCGGTGTGTGTATTTTATGTCGTTTTACGCGCATTGGACACTGTT
GAGGATGATATGAGCATTCCCGTGGAAACGAAGACTGCAGTGCTGGAGGAGTTCTACAAGCACTTAGATGATCCATCAT
GGCGATTTGTTTGTGGAGATAAGCACTACAAGGAGCTCATGAAGAATTTTGATCAGCTTTCGCTTGCGTTCCTTCGGCT
TTCCAAAAACTACCAGTCTGTTATCAGCGATATCACGAAAAGAATGGGCTACGGAATGGCAGAATTTATTCGGAAGGAG
GTTGTGACTGTATCGGACTATGACAAGTATTGCTACTATGTCGCCGGTTTGGTTGGAGTTGGATTGTCACATCTCTTCA
ACTCGTCCGGACTTGAAAGACTGGAAGAGAGGCTGATCGAACCGGATCCGAAGAGATCATTCGTACTCGACAGTCCTGC
AATCTCTATGGGACGATTCTTACAGAAAATCaacatAATCagggattAtctGGAAGACATCAacGagcttcCAGCtcCT
CGAATGTTTTGGCCCCgCGAAatctggggaaaatatgctccaAaCtCtCtgctctcggaC > SEQ ID NO:2296 200646 255835_301645_1
CCCACGCGTCCGGGAGGAAATCATGGATCCTCTCCAAAAGCGCCTCATGTTTGAAGATGAGTGCATTNTGGTTGATGAA
GATGATAAGGTTGTGGGTCATGATTCAAAGTACAATTGTCATCTGATGGAGACAATAGTTAAAGGAAAAGCACTGCACC
GGGCATTCAGTGTCTTCCTTTTCAACACCAAGCATGAGTTGTTACTACAGAAGCGGTCGGCTACCAAGGTAACTTTTCC
TTTGGTGTGGACAAATACATGCTGCAGTCATCCTTTGTATCGAGAATCCGAATTGATTTCGGACAACTGCTTAGGGGTA
AGAAATGCCGCTCAAAGGAAGCTTTTCGACGAGCTTGGGATTGTAGCCTCCGAGGTTCCTGTTGATGACTTCACCATCC
TTGGCCGCATTTTGTACAAGGCTCCTTCAGATGGGAAGTGGGGCGAACATGAACTGGATTACCTTCTCTTTATTGTCGG

FIG. 2 continued

TGATGTGACGACGCATCCTAACCCTGAGGAGGTTGACGACATTCGGTATGTTACCAAGGAGCAACTTAAGGAGTTGCTC
GACCAAGCCGAGGCACCAGGCCAAGACAGTGTCAAGTTTTCGCCTTGGTTCAAATTAGTGGTTGAGAATTTCCTTTTTG
ATTGGTGGAGGAAAGTTGAGGAGA

> SEQ ID NO:2297 200646 104260_300060_1
gctttctgcaaaatgggTGATGTTGAAGCTGATGCCAATATGGACGCTGTCCAACGCCGTCTCATGTTTGAAGACGAAT
GTATTTTGGTGGACGAGAATGACCAGGTTGTTGGTCATGACACCAAGTATAATTGTCATTTGATGGAAAAGATTGAATC
TTTGAATTTGCTGCACAGAGCTTTCAGTGTATTTCTTTTCAACTCGAAGTACGAACTTCTTCTTCAGCAACGATCAGCA
ACAAAGGTAACCTTTCCTTTGGTGTGGACGAATACATGCTGCAGCCATCCACTCTACCGAGTGTCTGAGCTAATTGAGG
AGAATGCTCTTGGTGTAAGAAACGCTGCGCAAAGGAAGCTGCTTGATGAATTGGGTATTCCAGCTGAAGATGTCCCTGT
TGACCAGTTCACGCCATTGGGCCGTATGCTTTACAAGGCACCATCTGATGGAAAGTGGGGAGAGCATGAACTTGATTAT
CTTCTATTCATCGTCCGTGATGTTAATGTGAACCCGAACCCAGATGAAGTTGCTGATATCAAATATGTGAACCAAGAAC
AACTGAAAGATCTTTTGAGGAAAGCAGATGCAGgtGaggaaggttTGAAGCTATCCCCttggttcagactTgtCGtcgA
caaCttc > SEQ ID NO:2298 200646 196529_300704_1
GCCCAAATCCATCCAGCCCGTCGCCGCCCGCCGCCCGCCGCGCGCGCGCGCACCCGAGCTCCCGCTCCCTCCCCTCCGA
TGGCGGCGGCGGCGCGCTCCCTCGCGCTGCTCTCGACCGCCTCCGCGTCCCTCGGCCTCGGCGTCGCGCGCTCCTCCGC
CCGCCCTCGGTCCCCGTTTGGGCGGGGCCTCGCCCTCCGCGGCCTGTCGTCGTCCTCGTCCTCCTTCGCCGCCACCGCC
GCGGTGATGGGGAAGGCCGGCACCGCGGAAGCCGCCGACGCCGGGATGGACGCCGTCCAGCAGCGGCTCATGTTCGAGG
ACGAGTGTATTTTAGTGGACGAACAGGACAACGTCATTGGCCATGATTCCAAGTATAACTGCCATCTCATGGAAAAGAT
AAATTCTGGTCATGTCCTCCACAGAGCGTTCAGTGTTTTCTTTTCAACTCCAAATATGAATTGTTACTTCAGCAAAGG
TCTGCTACAAAAGTGACATTTCCACTTGTCTGGACAAACACTTGCTGTAGCCACCCTCTATACCGCGAGTCCGAGCTCA
TTGAAGATAAAAGCCTAGGGGTCAGAAATGCAGCACAGCGGAAGCTATTCGATGAACTGGGAATACAAGCT > SEQ ID NO:2299 200646 107783_300258_1
cccagatgtcgctgacaACTACGCCTTCTTTTCAAATCTGGCGGAGGTTCATCGCAGCCTCCCCTATAACTTGTCCTTC
ATCCCTCTCACTTGTATCCGTATCCAAATCCCCTCTTCTTAAAAGCCATAGAAGAGCTGCCTCTCTCCGCTGCTATTGT
GCTACAAGAATGGGTGACGCCATTGCTGATGCTAACATGCAGCCTCTTCAGCGCCGTCTCATGTTTGAAGACGAATGTA
TTCTGGTGGATGAGAATGACCGTGTTGTTGGTCATGACACAAAGTATAATTGTCATTTAATGGAAAAGATCGAAGCTGA
AAATTTGCTGCATAGAGCTTTCAGTGTATTTCTATTTAACTCAAAATATGAATTGCTTCTTCAGCAACGATCAGCAACA
AAGGTAACCTTTCCTTTGGTATGGACTAACACCTGCTGCAGCCATCCACTCTACCGGGACTATGAGCTCATTGAGGAGA
ATGCTCTTGGGGTAAGAAATGCTGCACAAAGGAAGCTTCTTGACGAATTGGGCATTCCTGCTAAAGATGTCCCAGTTGA
CCAGTTCACCCCATTAGGTCGTATACTTTATAAAGCTCCATCTGATGGAAAGTGGGGAGAACATGAACTTGATTATCTT
CTATTCACCGTCCGTGAAGTGAACATGAAACCAAACCCAGATGAAGTTGCTGATGTTAAATACGTGAACCGAGAACAAC
TGAAAGAGCTTTTGAGGAAAGCAGATGCTGGCGAGgGAGGTCTGAAGCTGTCCCCTTGGTTCAGaCTTGTCGTTGACAA
CTTCTTgTTtaaGTggTGGGATCAtct > SEQ ID NO:2300 200649 204962_300794_1
CGTTCTTCTCTCGCTTGTGATTGTGAGCATTCTATCGCCTTTCTTACTCTCTCTCTTCTGGATTTCCATCCGGATTGT
TTACTTTCTTCCTTCCAGTCCGCCAAAATACCTAGACACACGTAGCCCGCAATGGCGTCATCATTCAACGTTGCCGACC
TGGCCGAGTATATCGATCTGGACAAGCAGAGCCTATTGATCTCGGCCGGGTCAATCATCTTCAACCCGCTCTTCTGGAA
CATTGTCGCTCGTCAAGAATACCACAACAAGATCCTGACAAGGCTGTTCGGGGGCAGACCCTACCCGGCCTGCTATGCC
CTCGCCATAACCATCTTCTCGCTGGGCCTTCTCCGCGATTGGCTGTACAAGACGGCCCTGTCCGAGCAGCCATCGCACC
CGCTCCTGNAGACGCTGTATTCGCAGGCTGCCGGATACACCCTGTTCATCATCGGCAACATCCTTGTCGTCTCGTCGAC
GTGGCGCCTGGGCATCACGGGCACCTTCCTGGGCGACTACTTTGGCATCCTGATGGACGAGATGGTGACGGGCTTCCCC
TTCAACGTGACATCGGCCCCGATGTACTGGGGCTCGACGATGAACTTTCTGGGAACCGCGCTCGTCTTTGGCAAGCCCG
CTGGTCTTGCGCTGACCGTCGGCGTGCTCGTCGTGTACATCATCGC > SEQ ID NO:2301 200649 250709_301651_1
TACCTGTGTGTTCTTGCGTTTGAAGACTCGCAACTCGTCTGGACTTGCTCTTGACCATGGCTTCTTACATCGACTTCAG
TCAGCCCAGTTTGTGGGTATCTGCTGCAAGCATTGTATTCAACCCTACTTTCTGGAACATCGCTGCGCAGCAAGAATAC
CATAACAAGGTCATTACCAAGCTGTTTGGGGGTAACTCTCGACTTGGGTGCTATGCGCTTGCCGTAACCATTTTCTCAC
TGGGTATCTTTCGAGACTACCTTTACAATGAAGCTCTCGCCGATCAGCCCACCCATCCGACTCTCCTCTCCCCTGCTAT
CAAATACTCCGCGATCCCTCTGTTCCTAACAGGGAACACCCTCGTCCTGACCTCGATGTGGGCTCTTGGTGTCACTGGC
ACCTACCTTGGTGACTACTTCGGCATCCTCATGGACGAGCCTGTGACGACATTCCCATTTAACGTCTCGGGTTCGCCCA
TGTATCACGGCTCTGCCATGTCTTTCCTGGCCACGGCTATTTGGTACGGAAAACCAGCTGGTATACTTCTTACTGCACT
GGTCCACACTGCATACTCTATTGCGTGCAGGTGGGAGGatCcATTCACTGGTATGATCTACcagaagagagacGAggag
a

FIG. 2 continued

> SEQ ID NO:2302 200672 244202_301556_1
GGCTGGAGCAATGGATCTAGCTTCCGGACTTGGAGGAAACTTGAGCCGTCGAGATCTGCCGTCTGCCGTCGATCAATAC
GAGAAGTATCATTCCTATTATGGAGGCGAGGAAGACCAGAGGAAATTCAACTACACGGATATGGTCAACAAGTACTACG
ATCTGGCGACGAGTTTCTACGAATATGGCTGGGGTCAATCTTTTCACTTCGCCAACAGTCTTGTGGTTTTGTTTCTATT
TGTCGCAGATACCAGGACGAGACACTACAGGAGAGCATCAAGCGACACGAACATTTCCTGGCGCTACGTCTCCAGTTGA
AGCCGGGAGCGAAGGTGCTGGATGTTGGCTGTGGAATCGGTGGACCCTTGAGGGAGATAGCGAGATTCAGTGGTGCATC
TATTACGGGTTTGAATAATAATGGCTATCAAATTTCGCGAGGAACCGAACTCAACAAAAAGTATGGACTGGGACAAACA
TGCGATTTCGTCAAG

> SEQ ID NO:2303 200672 286318_200108_1
AAGAGAGCATTAAGAGGCACGAGCACTTTCTTGCCTTGCAACTGGGATTGAAACCAGGACAAAAGGTCTTGGACGTAGG
ATGTGGCATTGGTGGGCCGTTAAGAGAAATTGCTCGATTCAGCTCTACATCAGTTACAGGCCTCAACAATAATGAATAT
CAGATATCAAGGGGACAGGTGTTGAACCGCAAAGTAGGATTGGATCAGACTTGCAACTTTGTAAAGGGTGATTTCATGA
AAATGCCATTCCCTGACAATAGCTTTGATGCAGTGTACGCAATAGAAGCTACCTGCCATGCACCAGATCCAGTTGGATG
CTATAAAGAGATTTACCGGGTGCTGAAGCCTGGTCAATGTTTCGCTGTGTATGAGTGGTGCATGACCGATTCTTACAAC
CCCAATAACGAAGAGCACAAGAGGATCAAGGCCGAAATTGAGCTCGGAAATGGCCTCCCTGAGGTTAGATTGACAACAC
AGTGCCTCGAAGCAGCCAAACAAGCTGGTTTTGAAGTTGTATGGGACAAGGATCTGGCTGATGACTCACCTGTTCCATG
GTACTTGCCTTTGGATACGAGTCACTTCTCGCTCAGTAGTTACCGCCTAACAGCAGTTGGCAGACTTTTCACCAGAAAT
CTGGTTTCGGCACTTGAATATGTGGGACTTGCTCCTAAAGGTAGTCAAAGGGTTCAAGC

> SEQ ID NO:2304 200672 271843_200038_1
TCACTTTCCTCTTTTCTCACTCCCACAGTCCCACTAATGGACTCTCTCACTCTCATTTGTACCGCCGCTCTTCTAGCTG
CCGGTGGACTTTACTGGTTCGTTTGCATCCTTGGCTCCGCCGAGGTTAAAGGGAAACGCGCCGTCCAACTTTCCGGCGG
GTCAATCGAGAAAGAGAATGTCCAAGACAATTATAAACAATACTGGTCTTTCTTCCGCCGCCCTAAAGAAATCGAAACC
GCCGATAAAGTTCCGGCCTTCGTCGATACGTTCTATAATCTCGTCACTGATATTTACGAATGGGGTTGGGGTCAGTCTT
TTCACTTTTCCCCTTCTATCCCTGGGAAATCTCACCGTGAAGCCACACGTATTCACGAAGAAATGGCTGTAGATCTAAT
AGGTGTTAAGCCCGGGGCTCGCATTCTGGATGCAGGTTGTGGCGTTGGCGGGCCGATGCGGGCTATTGCGGCCCATTCA
CAGGCTAAAGTTGTTGGCATCACAATTAATGAGTATCAGGTGAAACGAGCCCGGATGCACAACAAAAAGCTGGCCTCG
ATTCCTTGTGTGAAGTTGTTTGCGGCAATTTCCTGCAAATGCCCTTTCCGGACAACAGTTTCGACGGAGCTTATTCAAT
TGAAGCTACATGTCACGCCCCTAAG

> SEQ ID NO:2305 200672 159529_200025_1
CTGTATCTTGTGATTTAGGAAAAAGATGTCAAAACAAGGAGCATTATTTGATTTGGCATCTGGGGTTGGTGGCAAAATT
AATAAGGAGAAAGTTGTGTCTGCTGTTGACAAGTATGAGAAATACCATGGTTATTATGGAGGTGAAGAAGAAGAGAGAA
AGAATAACTACACTGACATGGTTAACAAATACTATGATCTTTCCACTAGCTTCTATGAATATGGCTGGGGAGAATCATT
CCATTTTGCACCCAGGTGGAAAGGAGAATCACTACAGGAGAGTATTAAGAGGAACGAGCATTTCCTTGCCTTGCAACTA
GGATTAAAACCAGGACAAAAAGTTTTGGACGTAGGATGTGGAATTGGTGGACCATTAAGAGAAATAGCTCGATTCAGCT
CTACATCAATTACAGGCCTAAACAACAATGAATATCAGATAAGTAGGGGACAAGAGTTGAACAACAACCTTGATTCAAC
ATTGAATCAAACTTGCAACTTTGTAAAAGGCGATTTCATGAAAATGTCGTTTCCTGACAATAGCTTTGATGCAGTATAC
GCAATAGCAGCAACTTGCcATGCACCAgaTGTAGTTGGATGTTATaaAGAAATTtatagAGTGTTGAAACCTgGTcggt
gttTTGCTGTatacgaaTggtGCATGaccgATGcA > SEQ ID NO:2306 200673 254605_301634_1
AGATTGTAGAGGATGGCAATGCTTTCCATCGCAGCTCTTCGACGGATCCAGTCCGTTGCTCGAGCAGGAGGAATCCGTT
TGTCTTCGTCTGCTGCAGCAGTTGCCAATGAAGAGTCATACCTCCGCCTCAAAGACAAATCACATGTCACGTGGCCAAA
AGTACTAAATACATCTTTGGAAGAGATAGACCCAGAAGTCACAAATATAATTGAACTGGAGAAGAATCGCCAATGGAAG
GGTCTGGAGCTCATTCCTTCAGAGAACTTTACATCACTCTCAGTGATGCAGGCTGTTGGTTCTGTCATGACAAATAAAT
ACAGTGAAGGCTATCCGGGAGCCAGATATTATGGAGGAAATGAGTTTATCGATATGGCAGAGTCACTATGTCAAAAACG
GGCACTTGAGGCTTTTCGCTTGGACCCGGCAAAGTGGGGAGTGAATGTGCAGCCATTGTCGGGTTCACCAGCGAACTTC
CATGTTTACACTGCTCTCTTGAAACCACATGACAGAATTATGGCTCTTGATCTTCCTCATGGTGGCCACCTTTCCCATG
GATACCAGACTGATACTAAGAAGATATCGGCTGTTTCAATATACTTTGAGACGATGCCATACCGACTGAACGAAACCAC
AGGCTTCATCGACTATGAT > SEQ ID NO:2307 200677 200676_301343_1
GAATTCCAGCTGACCACCATGGCTCTCAATAAACTAAAGAATATACCTTCTTTAACAAACAGTTCTCATAGCTCAATTA
ACGGCATTGCATCCAATGCTGCAAATTCCAAACCAAGCGGAGCAGACACGGATGATATCGATGAGAATGATGAATCTGG
GCAAAGTATTCTATTAAATATTATTTCCCAGCTGAAGCCAGGTTGTGATTTATCTAGAATCACACTTCCGACATTTATT
CTGGAAAAAAAATCGATGTTGGAGAGAATCACTAATCAATTACAATTCCCAGATGTTCTTTTAGAAGCACACTCCAATA

FIG. 2 continued

```
AAGACGGGCTGCAAAGGTTCGTTAAAGTGGTAGCATGGTACCTAGCAGGTTGGCACATTGGGCCCAGGGCTGTGAAGAA
GCCCCGAAATCCCATTCTTGGAGAACACTTTACAGCTTATTGGGATTTGCCTAACAAGCAACAAGCCTTTTACATTGCA
GAACAAACGAGTCACCATCCTCCTGAATCTGCGTATTTTTACATGATTCCAGAATCGAATATTAGAGTTGATGGAGTTG
TTGTGCCAAAATCGAATTTTTAGGAAACTCAAGTGCTGCAATGATGGAGGGGTTAACTG

> SEQ ID NO:2308 200680 195624_300636_1
CGCTATCCCTTCAATTGCATCGATAGATTTGATTCTCGACTCGACCATCCTATCCCGAACGAGCATTTGCAAGATCCTT
CTTCTCTTTCACCTGGTACATATACAATTGCAACTCAATGTCGGAAACATTGATTTCAGAAACCCACACGCGCGAGCGG
CGTGACCTCTACCATGAGGCCGATGTTGTCGTCGTCGGCGCCGGTGTCTTTGGTTGTGCAGCTGCTTTCGCTCTGGCAA
ACCAGGGACGCTCCGTGCTTCTTCTCGAGAGGTGGATGCATGAACCTGACCGGATTGTGGGCGAGCTGCTGCAGCCAGG
CGGCTTGACGGCCCTCAGAAAGCTGGGCTTGGGTCACTGCGTTGAGGACATCGACGCAATCCCTTGCTACGGCTACAAC
GTCATCTACCACGGAGAGCCATGCGCCATTCCCTATCCCAGGCTCAACGAAAAGGGCGAAGTGACACATGCGTGGGGAG
GAAGAGGGACGGGCGGAACAAAGCAAGAGGGATGCGGCTTCCACCACGGCAAATTCATCTCGCAGCTCCGCAAGGCGTG
TCTGGGCCACAAGAACATCACAGTCGTCG

> SEQ ID NO:2309 200680 249549_301593_1
GCCCCGTCGAAAGCGAAGACTTAGGGTTACTCGCAACGCAATGCATGGATAGAAGGGCTGGAATGGCGCAAGGAGATCT
AGTGCGCCATCTCTATCTCCTGCCGCCGCTCAGCCTGGCTATCGCGCTGCTGGCGCTGGTGATCTCGCTCGCCATCACA
GCGCGAAAGGTGAGATCTTCTTCCTACGGCAATGCTGCTGCAGCAATTGCGGCGGCGGACAAGGAGGACGGCAAATCCG
CCAGAACTTCCGGGGACGATGCCGTGGATTGCATCGTGGTTGGAGCAGGCATCGCCGGGGCCGCGCTAGCTTATGCTCT
AGGCAAGGATTCGAGGAGAGTTCTGTTGATCGAGAGAGATTGCTCTGAGCCGGATAGAATTGTTGGAGAGCTGCTGCAA
CCTGGTGGATACCTCAAGCTTGTGGAGCTTGGCATGAAAGACTGCGTGGACGAGATAGAGGCACAAAGAGTCCATGGTT
ATGCCTTGTTTAAGGACGGTCGAGATGCCAAAGTCGGGTATCCTCTAAAAGGTCGTTCGGCGGACGTTGCCGGGAGAAG
CTTCCACCACGGGAGATT

> SEQ ID NO:2310 200680 286205_200076_1
AAACAGTGTCCGCAAAGAAAAAAAATGACCCCGACACCACCAGCACCACTACCACAACGGTGTATGATGGAGAATGCAG
ATCAAAGGACGCAAACGACGACGCTGACATCATCATCGTCGGTGCTGGCGTTGCTGGTGCCGCTCTTGCTCACACCCTT
GGCAAAGAGGGGCGTCATGTAAAAGTGATTGAAAGAGATTTGACAGAGCCTGATCGAATTGTTGGAGAACTCCTACAAC
CAGGTGGCTTCCTCAAATTGCAGGAGTTGGGCTTGGAGATTGTGTGGAGAACATTGATGCTCAGCGAGTGTTCGGGTA
TGCTCTTTTCAAGGATGGAAAGAGCACTCGTCTTTCTTATCCCCTGGAGAAGTTTCACACTGATGTATCTGGGAGGAGC
TTTCATAATGGGCGTTTCATTCAAAGAATGAGAGAGAAAGCTGCATCTCTTCCCAATGTGAAACTGGAGCAAGGCACTG
TTACTTCTCTGCTAGAAGAAAACGGGACCATTAGAGGTGTTCAGTACAAAAACAAATCTGGTGAAGAGTTGAAAGCCTA
TGCACCATTGACCATAGTGTGTGATGGTTGTTTCTCGAATCTACGGCGTACCCTTTGTGAC

> SEQ ID NO:2311 200680 258406_301696_1
GAACAACATACCCACGCTCTCTCGCCCGCACATTCGTTCCGACGCATTTACAAACCGCCAGTCTCTCGCTCAACGCTCA
CATAAATTAATCACACAACAGCCCACACTCACACTCACACAAAATGGTCACCCAACAGTCTGCAGCAGAGACCAGCGCC
ACCCAGACCAACGAGTACGACGTGGTCATTGTCGGAGCTGGTATTGCCGGGCCCGCTCTGGCCGTGGCTCTTGGAAATC
AGGGCAGAAACGTTCTTGTTGTGGAACGAGATCTCTCCGAACCGGACCGAATCGTGGGAGAGCTGCTTCAGCCCGGAGG
AGTCGCTGCTCTCAAGACTCTGGGTCTCGGCTCTTGTATCGAGGATATCGACGCGATCCCCTGCCAGGGATACAACGTG
ATCTACTCTGGAGAAGAGTGCGTTCTCAAATACCCCAAGGTCCCCCGAGACATCCAGCAGGACTACAACGAGCTGTACA
GAAGCGGAAAGTCTGCCGACATCTCCAACGAGGCTCCCCGAGGAGTATCCTTCCACCACGGCCGATTTGTCATGAACTT
GCGAAGGGCCGCACGAGACACACCCAATGTGACTCTGCTGGAGGCCACAGTCACCGAGGTGGTCAAGAACCCTTACACC

> SEQ ID NO:2312 212301 214746_300864_1
tcgcgatctagaactAGTCCGGGTTTACATTGATAAGTGACGGATATGCATCCCGAAAATGACAAATTTGTAAGCATGT
CACTGCCGGCAAAGAACCCTGAATGCTCTAGATGCTTCCGAAGGATTCTCCATAAGATGATATCCCATGCAGTTTGTGC
CAAAATGGGTTAACGGACGCCCGATTCCGTGGGTGTGCATTTGATTGAGACCCCCATGTTTGCAGTGAATCGGTTGGGT
AAGATGCATTGGAGAGGATGTACGTAGGAGGTTCATTTATTGCTGCTCTTATTTTCCATGTTATTATTTAAATACATGA
TCATATTCACATATTTACATTTGAGTTGAGTGCATCTGCTATGAATGTTTCTAGAACCATCCTTAGCAGCTACATCATT
ACGACATATAGTGGTGGTccctctgattcactttcatacacaccctgaacgacacatcttctacacttattaggaaaca
aaaaagcggacgcgtggg > SEQ ID NO:2313 212347 200466_300759_1
GTTTCTCAAAACACCAAATGCACCTGAATCTCAGCTGAGCCTCGCCCGCCCGCCAAAGTCAGTTTTTTATGCTTCACGC
AATTTAGAACAAACAAGGGGAATCCGAAACCAAAACCTTCCTGAATCGCCAATCATGGGCTCCTCAAGCCTGCTTGACC
AGTACGGCGACGCCGTCAGCCAGAGTGGCCGCTCGTCTCGTCACCACGCGAAGAGCAGCCGCCACAAGAAGCGCCGCTC
GCACTCGCACTCGCCGTCGCGATCCCGGTCCCGGGACCGATCTCGAGATCGTGATCGTGAACGTGAACGGGACAGAGAC
```

FIG. 2 continued

AGAGACAGGTCGCGCTCCCGGAACCGCGGCGGGATCTTTGGCGGCGAGAGCGGCCACCGCAGGCACAGCGGCTCCAAGG
GCTCGTTCTTTGGCCTGGGTGGCGGTAATAACAGCCGCTCCAGCCTGTTTGGAAGCAGCCGTCCCTCGTACTACAAACG
CTCTCCTCGCGAGGGCTTCGTCCAGCGCTGCATCAAGCAGCTCAAGCGACTCCTCCGcgaccttCAgcactacgCCAAG
C > SEQ ID NO:2314 212356 200187_300815_1
gctatggagccagtatcAAACGGTGCCGGGACAAGCAGCCCGAGTCTTTCTTCTCCCAGAGCGCTGTTTCTTGAATCTT
TGTTTCCGCCACATCCTCCGTGAAGCCCGAGAAAAAAACATCTCTAGCATCAGAAGATCCTATAAAAGATAAAAAAGAC
TTATACAAAAAATCCTTCCTCGCAAGGGAAGCGCCGGAGCAACAACATGCCCATAGCACTGTCCCCTCCCTTCCGGCCA
AGAAATGGCTTGACCAAGTTCACCAACTGCCGCCTCCTGCGCGGCGATAAGCTGGTCGAGGAGGATCTCTGGGTCAGCT
CGCTGTCTGGCAAGGTTGTCAACAGCCAGGCTGCCTTTTTCGATGACCTCGTTCTCCCTGACCAGACCATCGACCTCGA
CGGCCGCATCATCTCGCCGGGCATGATTGATGTGCAGCTCAACGGCGCGTTCGGCTTCAACTTCTCGACGCTGCTCGAT
GACATGTCACAGTACGGCAAAAAGGTCAAGGAGGTGCAGAAGTTGCTGGTGCAGACGGGCGTCACATCGTACAATCCCA
CCATCACCAGCCAGAGGCCAGAACTATACCAGAAGGCTCTTCCGTTCCTAGGACCGTCAGGGCACTTGCAGGAGGCCGA
AGATGGGGCCGAGTCGCTCGGCGCTCACTGCGAGGGGCCGttcctcagcccgacCAAGAA > SEQ ID NO:2315 212356 218891_300925_1
GTGCCGGGACAAGCACCCCGAGTCTTGCGGCTCCCAGAGCGCTGTTTCTTGAATCTTTGTTCCCGACACATCCTCCGGG
AACCCCGAGAAAAAAACATCTCTAGCATCAAAAGATCCTATAAAATATAAAAAAGACTTATACAAAAAATCCTTCCTCG
TAAGGG > SEQ ID NO:2316 212363 205432_300798_1
CAAGAAACAAACAACCTTCTTCATCAATTCTACTACAACGACCTTCCTACTTAAACAATCTCTCGATACCAACTCCCCA
AGATGAAGTTCACTCTCGTCCTTGCTACCTTTGCCGCCGTCGTCTACGGTCAAACCATCGATGACATTCCCGCATGTGC
TCGTACTTGCATTGAGAACGCCGTTCTAGCCGCTGGTTGCTCGTCTGGAACTGACGTCGCATGCGCTTGCGCACATTTC
ACTGCTGTTCAGAATGGCTCTACTAGCTGTGTCATTGCTGCTTGTGGCGTTTCTGTCGCCATTAACCAAGTTCTGCCTG
CCACCCAGGCTCTTTGTGCCAACCAGTGAACTCATCCATCGAGAGGGAGAAAATGACATGGGAGAAAATCAGGTACTCT
TGTACATTGACAAACAAGTACATAGCTGAATGGTGTGAATGAATAAAACGCATTGCTGCTGGACACCGCTCTGTTCATT
TCtgcaAAAa > SEQ ID NO:2317 212363 208329_300959_1
GCGCTTGCGCACATTGCATTGCTGTTCAGAATGGCTCTACTACCTGTGTCATTGCTGCTTGTGGCGTATCTGTCGCCAT > SEQ ID NO:2318 212363 215381_300880_1
GCTTTCACAGTCCAGCTACATTCGTTGTCTGAACACTAAACCAAAAAACTCCAAAAAAAACAACTTAATACACACCCCC
CCAACAACACTTAATACCGACAAGATGAAGGCCGCTTTCGTTGCTGTTGCTCTCGCCGCTCTGGCCCAGGCTCAGACCC
GCGCTGATATCCCATCCTGCGCTCTGCCCTGCCTCGACGACGCCGTCAAGGCCAACACCAAGTGCTCCACCACCGACTA
CGCCTGTATCTGCAAGGACTTCAACGCTGTTCAGGGCGCTGCCACCGGCTGTGTCGTTGAGAAGTGCGGTACCGACGTT
GCCATCAACAAGGTCCTCCCCGCCACTCAGGCTCTCTGCGCCGCCAACTCTGGATCCGGCTCTGGCTCTTCTTCTGCTG
CCAACACCACTCCCGCCCAGCAGACCACCTCTGCCGCCCAGTCTTCTTCTGCTGCCCAGTCTTCCTCTGCTGCTCAGTC
CTCTGTCGCCAGCGCTCCCCCCAGCTCTGCCCCCGCCCAGACCACCTCTGCTGCCCAGACCACTCCCGTCATTCCCGTT
GGCACTGGCACTGGCGTTCCCCCCGCTGGCAACAAGACCACCACCGGTGCTCCCACCGCCCCTACCAGCGGCGCTTCCA
CCATCCTGCCCGGCCTTGCCTTCATCGCCGCTCTCTGCGCCTTTGCCCTGTAagggGTTTGACAATGAACGACga > SEQ ID NO:2319 212363 220353_300954_1
AAACAACCTTCTTCATCAATTCTACTACAACGACCTTCCTACTTAAACAATCTCTCGATACCAACTCCCCAAGATGAAG
TTCACTCTCGTCCTTGCTACCTTTGCCGCCGTCGTCTACGGTCAAACCATCGATGACATTCCCGCATGTGCTCGTACTT
GCATTGAGAACGCCGTTCTAGCCGCTGGTTGCTCGTCTGGAACTGACGTCGCATGCGCTTGCGCACATTTCACTGCTGT
TCAGAATGGCTCTACTAGCTGTGTCATTGCTGCTTGTGGCGTTTCTGTCGCCATTAGTATGTGCTCCCCTCTCATTTTG
GTCGAGGATATTTACGTCTCAAATGCTTATGTATATTTATAGACCAAGTTCTGCCTGCCACCCAGGCTCTTTGTGCCAA
CCAGTGAACTCATCCATCGAGAGGGAGAAAATGACATGGGAGAAAATCAGGTACTCTTGTACATTGACAAACAAGTACA
TAGCTGAATGGTGTGAATGAATAAAACGCATTGCTGCTGGACACCGCTCTGTTCATTTCTGTAtTtCAATGAGTAttCA
TGCGATATGTAGCTTGA > SEQ ID NO:2320 212412 125272_300629_1
ggagctcatttctctcttttaaattcaatttctatttctctctctcaaactatggaaaaatgtctggacgtggcaagg
gAGGTAAGGGATTGGGCAAAGGAGGAGCAAAGAGGCACAGGAAAGTGCTGAGAGATAACATACAGGGAATTACAAAGCC
AGCTATTCGTAGGCTTGCTCGTAGGGGTGGTGTGTGTGACCTACACTGAGCACGCAAGAAGGAAGACTGTAACTGCTATGG

FIG. 2 continued

ATGTTGTGTACGCTCTCAAGAGGCAGGGAAGGACCTTGTACGGATTTGGAGGTTAAATATTGGGGGTTAGGGTTCATAG
TATTTTGTTGTTAGTGATTGTGGATTTCATGTTTGTGCTTTCTGGTTGAGCTAGTGGTCAGTTTAAGGTAGGTTAGTTT
AATTTCTGTTGTTAAGGTCTGGATATTGTAATTCCGCGTTATACAATCAAGTAAAACAGACCATTTTACCCTATTG

> SEQ ID NO:2321 212412 126777_300466_1
gccattacggccgggggaatccgaatcaaccacattttttcgtcATTTCAAATTCAAAAATCCCCAAAAATCTAGTTTCA
CAATGTCAAGAGGAAAGGGTGGAAAAGGATTGGGCAAAGGAGGAGCTAAACGACACCGTAAGGTGCTTCGTGATAACAT
CCAGGGAATCACGAAACCTGCAATTCGGCGTTTGGCTCGTAGAGGAGGAGTGAAACGTATTTCTGGTTTGATTTACGAG
GAGACACGAGGTGTATTGAAGATATTTTTGGAGAATGTGATTCGTGATGCTGTGACTTACACCGAACATGCCAGGAGAA
AGACTGTTACTGCTATGGATGTTGTTTATGCCCTCAAGAGGCAGGGAAGGACTCTCTACGGATTTGGGGGTTAGATTTG
TCTAATTAGAGTTTTTGTGGGGTAATGATTGTAGATTTGTTCTTTACTATCTGATGTATTAGGGTTGGTTAGTTTTTGT
TGAGATTTTATAATGTAATTCTCTATTACATACTCAGGAATAGTAATTGCCCAAAAAAATCTAACAAGCTTCTAGTAGT
AT > SEQ ID NO:2322 212412 205217_300797_1
GGTTTACCATCTGCATCTCTTTTTGATATCTCAAAACTCCCCAAACAACCCACATCAATCATCATGACTGGACGCGGCA
AAGGTGGCAAGGGCCTCGGCAAGGGTGGTGCCAAGCGTCACCGCAAGATTCTTCGTGACAACATCCAGGGTATTACCAA
GCCCGCTATCCGACGTCTCGCTCGTCGTGGTGGTGTCAAGCGTATCTCTGCCATGATCTACGAGGAGACCCGTGGTGTC
CTCAAGTCCTTCCTCGAGGGTGTCATCCGTGATGCCGTCACATACACTGAGCACGCCAAGCGCAAGACCGTCACATCAC
TAGACGTTGTCTATGCTCTGAAACGACAGGGCCGCACCCTGTACGGTTTCGGTGGTTAAGCGATCTGCCACTAGGTCGG
GTCGACATAATGTGTTATTCGCGTGTTTGTTACGATTGGGCTTTTCACTATGGCGCGGGTCATTGCTTTTTGAGATTT
TGTACTGTACAACGTACTGGGAAATGGGTGACCCCCGAAAGGGGGTAATTGAGACTTATTCAGTGGTGACCTTGAAATA
AAGCATCACATATACTCTACAAGTAAAATCTTTCTGCCTGATTGTGAAT > SEQ ID NO:2323 212412 223702_300975_1
gggcccacgcgtccgcCCACGCGTCCGAAACAATGTCTGGCCGAGGAAAAGGTGGTAAAGGACTTGGAAAGGGTGGCGC
TAAGCGACACCGAAAGATTCTTCGAGATAACATTCAGGGTATCACTAAGCCCGCCATCCGACGTCTTGCGCGACGAGGT
GGTGTGAAGCGAATTTCCGCCCAGATCTACGAGGAGACCCGAAACGTTCTCAAGTCTTTCCTTGAGTCTGTTATTCGAG
ACGCCGTCACCTACACTGAGCACGCCAAGCGAAAGACTGTCACTTCTCTTGATGTTGTCTACGCTCTCAAGCGACAGGG
CCGAACCCTTTACGGTTTCGGTGGTTAATTATTTATATTATATATGATATTGGAATGGATTTATTATACTG > SEQ ID NO:2324 212412 219791_300948_1
TGGTGCGAAAAACGTCATTTTGCAAAGTGACGCGTTTATAACGGATTTCTATATCTTCCGACTTTTTCACATTTTAATA
CATTCATCATGACTGGCCGTGGAAAGGGTGGCAAGGGCCTGGGCAAGGGCGGTGCCAAGCGTCACCGAAAGATTCTTCG
TGACAACATTCAGGGCATCACCAAGCCTGCTATCCGACGTCTCGCTCGTCGTGGTGGTGTCAAGCGTATCTCTGCCATG
ATCTACGAGGAGACCCGCGGTGTTCTCAAGTCCTTCCTCGAGGGCGTCATCCGCGATGCCGTCACCTACACTGAGCACG
CCAAGCGCAAGACCGTCACCTCGCTGGACGTTGTCTACGCTCTCAAGCGACAGGGCCGCACCCTCTACGGTTTCGGTGG
TTAGAGCGTTGGACGCGTTGTTTTCTGCTGTCTGCGCGGTGGCGATGTGGAGCTGGGGTTATCTGTGCAAATAACATGG
ACTCTTCTGTACTTTGATCGATTGGCGTTGGGGGAATGGGCTTACGAGGAGGCGTCATGGTAGACGACCTTATAAATGA
GAATACCACATGAATACAAATACGATAATCATTTG > SEQ ID NO:2325 212412 126411_300463_1
gccattacggccggggatctcaaatcaaaattcatattcttctCAGTTTAATTACGCTACCTACAAAATGTCAGGCCGT
GGAAAGGGAGGCAAGGGTTTGGGAAAAGGAGGAGCTAAACGACACCGTAAGGTGCTCCGTGATAACATTCAGGGAATCA
CAAAGCCAGCTATTAGGAGATTAGCGAGAAGAGGTGGAGTGAAGAGAATCAGCGGGCTGATTTATGAAGAGACAAGAGG
AGTGTTGAAGATATTTTTGGAGAATGTGATTCGTGATGCTGTGACTTACACAGAGCATGCTAGGAGAAAGACTGTGACT
GCAATGGATGTTGTTTATTCTCTCAAGAGACAAGGCAGGACCCTTTATGGATTTGGTGGTTAATTTATGTATTTTTATT
TGTTTTAGGGGAGATGGAGTTTAGTTGGTGTTTAATTAGTGTTTGTTGATGAATGTTATGAGGTTGCTGTAATTGAGTT
CTTTGTGTTAATGAAATGGATCTCATTACTATTtctGATAAaa > SEQ ID NO:2326 212412 193633_300741_1
cccccccccctgAAACCAAAAAAATCCCCAAATCTCAAATCCTCCTCCGTCTCCAAGCTCTCGTCGTCGTCGTCAGACA
TGTCGGGCCGTGGCAAGGGAGGCAAGGGGCTGGGCAAGGGAGGCGCGAAGAGGCACAGGAAGGTGCTGCGCGACAACAT
CCAGGGGATCACGAAGCCCGCGATCCGGAGGCTGGCGAGGAGGGGCGGCGTGAAGCGCATCTCCGGGCTGATCTACGAG
GAGACCCGCGGCGTGCTCAAGATCTTCCTCGAGAACGTCATCCGCGACGCCGTCACCTACACCGAGCACGCCCGCCGCA
AGACCGTCACCGCCATGGACGTCGTCTACGCGCTCAAGCGCCAGGGCCGCACCCTCTACGGCTTCGGCGGCTGATTCCT
TCCTTCCTTCCTTCCTGGTGGCGTGCGGGTGGTGGTGGTGGTGTAGGAGCTAGGGTTTCGATGGGATTCGGGGGGAATT
TCTGCTTTGTGTTGGCTTCTGTGTAGCGACTCTTCTGTTTAAATGAATTCGATGAATCTGAACTGAAGATTTGGTTCCC
C

FIG. 2 continued

> SEQ ID NO:2327 212412 126458_300463_1
gccattacggccggggATCTCAAATCAAATTCTATTTTCTTTTCAGTTCAATTACTTTACCAACAAAATGTCAGGCCGT
GGAAAGGGAGGCAAGGGTTTGGGAAAGGGCGGAGCAAAACGACACCGAAAGGTTCTCCGTGATAATATTCAGGGAATCA
CTAAGCCAGCTATTCGTCGATTGGCTCGTAGGGGTGGAGTGAAGAGAATCAGCGGGCTGATTTATGAAGAAACAAGAGG
AGTTCTGAAGATTTTTTTGGAGAATGTGATTCGTGATGCTGTGACTTACACTGAGCACGCCAGAAGAAAGACTGTTACT
GCAATGGATGTTGTTTATTCATTGAAGAGACAAGGCAGGACCCTCTACGGATTTGGTGGTTGATTTATGTATTTTAGGT
TTTTTAAGGGGAAATGGAGCTCAGTTGGTGTTTAAAAGTTGTATTGTTAATGAAGGTTATTAGGTCATTGTAACGAGTT
ATTTGTGTTAATGTAATGGATCTCATTAGTATTTCAGATG > SEQ ID NO:2328 212412 252057_301668_1
gggtgctagagcaACAGCAGCTAGGAAATCTCTCGTCGTCGCGGCAATGTCTGGAAGAGGCAAGGGAGGTAAGGGATTG
GGCAAGGGCGGCGCCAAGCGCCACCGCAAGCATCTCCGCGATAACATCCAGGGCATCACCAAGCCGGCGATCCGGCGCC
TTGCCCGGCGTGGCGGCGTCAAGCGTATCAGCGGCTTGATCTACGAGGAGACCCGAGGCGTCCTCAAGATCTTCCTGGA
GAACGTCATCAGGGATGCGGTCACCTACACCGAGCACGCCAGAAGGAAGACCGTCACCGCCATGGACGTCGTCTATGCG
CTCAAGAGGCAAGGCAGGACGCTCTACGGATTTGGCGGCTAGAAGAAGAAAATTAGAAGCTCTCCATCTCCTTGGAAAA
TTTCTAGTTTTCCTCGATTTCTAACTGGTAGACAAGgAAGAAATATTTTCCTTTGCATTCcATCCAcCactTtgtaATA
TTcgaATCTAATgtagaaTCTTAAATc > SEQ ID NO:2329 212412 57715_300036_1
GCCATTACGGCCGGGGACAATATTCCGAATCAAGAACATATCTTCCCATATCGagcTCAAATTTCAAAATCCCCATAAT
CGTTTCACAAAATGTCAGGAAGAGGCAAGGGAGGTAAAGGATTGGGTAAAGGAGGAGCAAAGAGGCACAGAAAAGTATT
AAGGGACAACATTCAGGGAATCACTAAGCCTGCAATTCGGCGTTTGGCTCGTAGGGGTGGAGTAAAGCGTATTTCTGGT
TTAATTTACGAGGAGACTCGTGGGGTGTTGAAGATATTTTTGGAGAATGTTATTCGAGATGCTGTGACCTACACTGAAC
ACGCTAGGAGAAAGACAGTTACTGCGATGGATGTTGTTTATGCGCTCAAAAGGCAGGGCAGGACTCTTTACGGATTTGG
GGGTTAAATTTTTCAAATTAGGGTTTTTGTGGGTAACTTTTATTATAGATTTGTACTTTTGCTGCCGTTGTGTTTTAGG
GTTGCTTAGATTTTGGTAAGGTCGATGATGTAATTCTCGTTACATATTCAAggAATAGTAATTGCTTGGTCCTCaaA > SEQ ID NO:2330 212412 57631_300109_1
ccccccccccGTCGAATACATTTCATTTCTGATTTCAATTCAAACCAAAAACCCTAGGTCAAAGTTCTGTGTGAAAATG
TCTGGCCGTGGAAAGGGTGGCAAGGGATTGGGCAAGGGAGGAGCTAAGAGGCACCGGAAGGTGCTAAGGGATAACATCC
AGGGAATTACGAAGCCAGCAATTCGTCGGTTGGCTCGTAGGGGAGGAGTGAAGCGTATATCTGGTCTGATCTACGAAGA
GACACGTGGAGTGATGAAGATCTTTCTAGAGAATGTGATCCGTGATGCTGTTACCTACACCGAGCACGCCAGGAGAAAG
ACTGTTACTGCTATGGATGTTGTTTACGCACTCAAGAGGCAGGGCAGGACTCTCTATGGATTTGGTGGTTAGGTTGTTT
AGTTTGTGATTTAGGTTGGTGTACTTGTGGTAATTGTAGATTTTCTGGAAATTTCTGTTGTTTCGGTGTTGGTTTCTCA
GCAGCTTTGTTCTAGTTGTCGTTCTTAAGGTCTTGATATTGTAATTTCTCATTGCAAATTCAAGGAACAAAGTTCATTT
TCTAGAAATTACAATGGTTAAATTGATTGTTTGAAACGACCa > SEQ ID NO:2331 212412 53476_300091_1
AAATTCATTCATGGTTAAACGGAAAAATTACAAATTTGAAATCCCTAAATGCTGAAATTGAAAAGTTTACAAAATCCGA
ATTTGCAATCCGAACGATTTACCCGCCGAATCCATACAAAGTTCGTCCTTGTTTTTTGAAAGCGAAAACAACGTCCTTC
GCCGAAACAGTTTTCCGGGGAGCGTGCTCCGGGTAAGTAACGGGGTCACAAATCACGTTTTCAAAAAAAATTTTGAAAA
CCCCGGGAGTTTTTTAATAAATAAAACCATTGATACGTTTAACGCCTCCTTTTTGGGGAGACAACAAATCGCAGGTTG
GGAAATCCCTGGGAGGTGGTCTTTGAGTACTTTCCGAGGTCTTTGGGCTCCTCCTTTTCCTAATCCTTTTCCTCCTTTT
CCTGGGCCGGACATTTTTTTTGGGGAAATTAATTTCGAACTAAAAAAAAAATTTTTTGATCGGACCCGGGGGTCA > SEQ ID NO:2332 212412 53464_300090_1
GCAGCATGTCAGGCCGAGGAAAAGGGAGGAAAAGGATTAGGAAAGGGAGGAGCCAAGAGACATCGGAAAGTACTCAGAGA
CAACATCCAAGGGATTACCAAACCTGCGATTCGTCGTCTCGCGAGAAGAGGAGGCGTGAAGCGTATCAGTGGTTTGATC
TATGAAGAGACTCGCGGCGTTCTCAAGATCTTTCTCGAGAACGTGATTCGTGACGCCGTTACTTACACGGAGCACGCTC
GCCGGAAAACTGTTACGGCGATGGACGTCGTTTACGCTCTCAAGAGACAAGGACGAACTTTGTATGGATTCGGCGGCTA
AATCGTTCGGATTGCAATTTCGGATTTTGTAAACTCTTCAATTTCAGCATCTAGGGATTTCAGaTTTGTAATTTCTCAG
TTAAACGATGAATGAATTG > SEQ ID NO:2333 212412 48634_300033_1
GCCATTACGGCCGGGGATCGCCCTAATCATTATCTCTCGCACAATTTTTCAGCTTCAGGGTCTTTAATTTGCAGAGAAA
CTAAAGGTTGATTGAAAATGTCTGGACGTGGAAAGGGAGGAAAAGGATTAGGAAAGGGAGGAGCAAAACGACACCGTAA
AGTCCTCCGCGATAACATCCAAGGTATCACAAAGCCAGCAATCAGGCGTTTAGCTCGTAGAGGAGGAGTGAAGCGTATC
AGTGGACTCATCTATGAAGAGACACGTGGCGTGCTTAAGATCTTTTTGGAGAATGTCATTCGTGATGCTGTAACTTACA

FIG. 2 continued

```
CTGAGCACGCTAGGAGAAAGACTGTGACTGCTATGGATGTTGTGTACGCGCTCAAGAGACAAGGAAGGACTTTGTATGG
TTTTGGAGGTTAATGTGAAACTTTTATTTTTTCTGCAAGAGTCTTGCTGTCAAGAAAACAACAAGAACGGTTACCATAT
GGTATATGAGGTTTGTTTTGCTTTTGATTAGGGATCTGATTCGGTGTAATTAGTTTGGTTACCTATTGGTGATAGGTTT
CTTTTTT

> SEQ ID NO:2334 212444 218944_300926_1
ACTGAATGAGACAAGAGACAAGAGACAGAAGAGATCGGGACCGGCATTCGGGGGGGACACCCTGGCCGAACTAAATCAA
TCCGTGCTACTGTACGTCTTACACGATTTCGGCTCTGCTAGGGGCCCCGAATGGCCACGGAGCCCATGGACAGAGAGAG
AAAAGTGGCGGATCAGGATGAGGCTGATGGTGATGGATGATGCCATGCTGCTTTTCGTCTGAAACGACTTACTTTTATG
TAGCTTGTGAGGCCATAATCTCGCAGATAAATAACACGAATATTTCCTCACC

> SEQ ID NO:2335 212454 205913_300803_1
aacATTTGGCAATTCCTCAAGCTCACCCATTTGTTGACTCTGGCAGTGTAGCACACAGTCTGCTCAACAAACCACATCA
CCATGTCCGCCGAAGAGAAGACCACGGTGGCGACCGACGTCGCAAATCCCCCAGTCGCGAGCATGAAGTTGTCCACGG
CGACGAGAGCAATGTCGACGTGCCTCTAGATTTGCCCGCAGGATGGAAGTACAGGCAGATTAGCCTTTTCGGCTACAAG
ATGCCTTGGTACGCGTCGCCCCGTGTCCAGCTCCTCATGGTTGCTTTTGTCTGCTTCATGTGTCCTGGCATGTTCAACG
CGCTTGGTGGTTTGGGAGGTGGTGGTCGTGCCAGCGCGACCTTGGCTGACAACATGAACACCGCCCTCTACAGCGCATT
TGCTGTCTTCGGATTCTTTGGTGGCACCATCGTTAACAAACTCGGTGTTAAATGGACACTCGCTTTCGGCGGCATCGGC
TATGGTATTTACGCCATCAGCCTGCTGGTTTCCCTCCATAAGACCGAACAGGGTTTCAGCATTTTCGCTGGTACCTTCC
TTGGTATCTGTGCCGGTCTTCTATGGACTGCTCAGGGCACCATCATGATCTCCTACCCAACCGAGAAAGAGAAGGGCCG
ATACtttgcctgGTTCTGGGCTATc > SEQ ID NO:2336 212475 179991_300565_1
AAGATGCTGCGCTCTATGggtCTACGAGGCAATGCCTTGACGCAGACCACCCGACTGGCTGCATCCAGGGCCATGTCGA
GCCAGGCGCTCTCCAACCCGACCCTGTCCAACATCGAGAAACGCTGGGAGGGAATGCCTCTCCAGGAGCAGGCCGACCT
GTGGATGGCCCTGCGTGACCGCATGAAGGGCAGCTGGAACGACCTGACCCTGCAGGAGAAGAAGGCCGGTAGGTGGTGC
ACCTTGAGTTTTTCTTACTGGATCGCCTTCGGCCCTCACGGCCCCGCACCGTTGACGCTCCCGGAGCCGGTGCCCGTG
TTGCCTGGGGAGTTGCCGTTGGCCTTGCCGCCTCTCTCGCTCTCTTCGCTGCCATCCGAGTTGCCGCCAAGCCTGCGCC
TTACACCATGAACAAGGAGTACCAGGAGGCCACTAACGAGCTTCTCAAGGCTCAAGGTGCTGATCCCCTCACTGGTATC
TCTTCTCCCGGCTATACTGGCAAGGGTGTTGTTCAGTCTCCTCCCAAAAACTAAAATAAAACACGATAATATCGCTTCA
AGCTTCGCACAATTGGGGCGGGCATGGGAGaagttTTATCAAAACGACATTTGTACATGTATAGCTtTagtCCTagaga
gtATGCAagacagggttCTCGc > SEQ ID NO:2337 212475 208268_300833_1
acaAGATGCTGCGCTCTATGGTTCTACGAGGCAATGCCTTGACGCAGACCACCCGACTGGCTGCATCCAgggccaTGTC
GAGCCAGGCGCTCTCCAACCCGACCCTGTCCAACATCGAGAAACGCTGGGAGGGAATGCCTCTCCAGGAGCAGGCCGAC
CTGTGGATGGCCCTGCGTGACCGCATGAAGGGCAGCTGGAACGACCTGACCCTGCAGGAGAAGAAGGCCGGTAGGTGGT
GCACCTTGAGTTTTTGTGAAAATCCCTCCCGGGAGAGCTGGCTTGAGCTTCCTGCCTCGATCCGGAGCTGCAGACTCTT
TTCTTCTCTCTTTATTCTCTCTCGAGGACCTACAACAGCTCGTATGACAACGATCCCGGCAATCCGCTCTTAATTGGCA
TGGAAACTGTTCACCAAATCGAGGCGGGCCAAGGTGCTCGGTGTCATCAATTCCTGGACCGAGTGGGCTGGGAATTTTA
TGCCAATCAAGAAAGAGCTTTTGCCAATACACATAAAACATATGTTCAACACGTCATTACCACTGCTACTAGCACTTAT
TATCATCTTCTTCAGCTGCTAACTTCATGTCATGACAATAGCTTACTGGATCGCCTTCGGCCCTCACGGCCCCGCACC
GTTGACGCTCCCGGAGCCGGTGCCCGTGTTGCCTGGGGAGTTGCCGTTGGCCTTGCCGCCTCTCTCGCTCTCTTCGCTG
CCATCCGAGTTGCCGCCAAGCCTGCGCCTTACACCATGAACAAGGAGTACCAGGAGGCCACTAACGAGCTTCTCAAGGC
TCAAGGTGCTGATCCCCTCACTGGTATCTCTTCTCCCGGCTATACTGGCAAGGGTGTTGTTCAGTCTCCTCCCAAAAAC
TAAAATAAAACACGATAATATCGCTTCAAGCTTCGCACAATTGGGGCGGGCATGGGAGAAGTTTTATCAAAACGACATT
TGTACATGTATAGCTTAGTCCTAGAGAGTATGCAAGACAGGGTTCTCGC > SEQ ID NO:2338 212492 200281_300757_1
gattatattgtttggcaGGTTTCGGAGGCTGATTGAGTCGGAGGGGCTGCCTTATTGCGGCAGAGGAATAGTGACGTCA
TGACTATCAAGGACCCTGGAGGTTACCTAAAAGAAAAGCATCTGGACGAGTGTTAGAGTGTGCGAATGGATCTCATTGT
TTGAATTGATGAATCTCGGAAGATCTGAGCTAGCTGCAAGATGCCTCAAGCCATGCGCAAGGCACGTGTGGATGGAGGC
AAGATTGGATGGAGATTTACTGTAAATCTTCCAACTTTAACTATAGAAGGGAAAGGGGGAAAGAGGCGATCGCTATACC
GCTGGTTGGGATTCAGCTCCagggacaGATTTCATCAAAACAAGCGATGAACTGTGTGGTGACATATATATACGAGTACG
GGTTTGATCAT > SEQ ID NO:2339 212584 219084_300927_1
AATCTCTTTGTATATCTGCCCTTTTTCATCATCGTAATATTGACGCACTTTGAGTAAGATTTTCACTCACCTCAAAAG
GAGCACTTTCACTGCTGGAAACCAAAATCTCTTGGGATCCCCAAATTAAGCCAGACGTACTCCGTACCTACAGGACCCA
```

FIG. 2 continued

GTTACAACCGTAGAGAATCCTCTCTCCAATCGCCTCCAATCGTCTCCAACTTTGGCGTCAGATAGTACATCGAGCCGCC
AATTTTTTTTTCTCTTTTGAGTCATTCTCCATTCGACGTTTGACCCGCCATCGGAGCCTTGTCTTGCCGACTTTCCTC
TTAACTCCCGGGCTTCCCTTCCAAACTTTTAATCTTCCACCGCAACATCTTTTCTTCCTTTCTTCTTCTTTTTCCTTTC
TTCACTGAAAAGGAAATTCAATCATTCATCATCCTTCTCACCTCTACATCATCCTCATCCGTCACAATGGCTCCCTCTG
CTATCCCAACCCAGGACGTCGACCTGACCGCCGCCAATATCCAGGTCAAGGAGGCCACTCAGCCCGTCAAGCCCAGCAA
TGGCACTACTCCTGCTCCCCTCGATGCCTCCAAGCTCACCTACACCTACACTAAGAACCCTCAGC

> SEQ ID NO:2340 212616 206879_300826_1
CCCACGCGTCCGGGATCTTGGTGGGCACCACGACGTTCTTCTCCATCCTCATCTTCTCGATCAACACTGTCTTTGCTCA
GGAAACACTCGCGCAGTGGATTGGAGATTACCTGACTCAATCTGCTGGTGTTACGGTTGTCTTCGAATCAGCCATAGTG
CCCAAGTGGAAGAATGGCGTTATCGCATTTCGTAATGTGTTTATTTCAAGAAGACCCGGGCAGATCGAATCATCCGTCA
GCAAGGGATCGTCTGACGCTGCTGCTGTTGCTGCCGCAGGGCGCCAGGTTCAGCATAACGGGACTGTTACCGAAGACGA
TGGCAACTATACGCAATTTGATGTAACGATCGCAAACGTCAATGTCACACTTTCATTCCTCAACTGGTGGAATGGCAGG
GGGCTTCTCAAAGATGTGGAAGTAAATGGTGTTAGAGGAATTGTCGATCGCACCTCTGTCCGTTGGCCACTGCAGCAAA
TCGACCCCTTGTCTTACCgccACAAACACCAACCAGGCGATTTTGAGATTGAATCTTTCAAATTGGAAGATCTTTTGCT
CACCATTCGCCAACCTGATggcttccgccccTTCTCAGTGAGCATATACTCCTGCgaactCCCTCGACTGAG > SEQ ID NO:2341 212623 207909_300830_1
GGCGCCCAGGAGCAATGTCTCAGGGCCCAACGAATGTGCGGTGAACGAGCTGCTACTGCACCGCCGATTGTCTGATGCA
AGCAAGGGAGTTGTTTGTTTGCTCCATCCTTGATTCACTTTAATGCTTGTTATTAGGTACTTTAAGAGCCAGGTTGAAA
GGGTACTTTGCAAGTGCTTAAATCTCCATTCTGCCTTATACTCCATGCCTGTAATTGTATAGTAGCACCAGGGTAAGCC
AGCAATACCGCAAGCTGGCAGTATCAATCGCCATTTTTCTCTACAAAAAAAGAAagaAAAAAAAAac > SEQ ID NO:2342 212646 207732_300828_1
GATGAGGACGATGTTGAGGATGTGATTGGAGAAGACATGGACGAAGACATTTATGATTAAGCGGATTGATCAATCCAGG
AAACAAAGTTTCACCCAAAAGTTATTTTTCTTTTCTCGTCACGGATATGGCATACGGAGTTTCAGGAGGAAATGGGGAA
ACCGTTTTTGGTTTGAGTAATTACTCATAAATTGGCCCTCTATAATGTATCATAACTAAAAATGAAAATATTGTTCATT
AAAAATG > SEQ ID NO:2343 212714 1096723_301433_1
GAGAGAGAGAGAGAGAGAGAGAGAGAGAGAGCACCTGCACCATGAGATTCCAGGTCCAGTGTAAAGCTGGTTTGTTTCG
ATTCCCAAATTAGAAAATCTAAGGTCTTTTATCCAAGAGCACGAAGGAAGAGATATAGATATGGGCAGGCTGTACTTGC
TACGCCTAGATGGCAAAATTTATAGCTGTCGCTACTGCAGGAGCCACTTGGCCAGCTGTAGTGAGTTAATCTCAAAGAC
TTTTCACTGCAGACTTGGGAAGGCTTACCTTTTCAACACAGTAGTCAATGTCTCAGCAGAGCCTGAGGAAGACCGGGTG
ATGACGACAGGCTTGCACAAGGTTTCTGACATTTTTTGCAAAGGATGTCATCAGATTGTTGGCTGGAAATATGAAGAAG
CATATGAAGAGAGCCAGAAATACAAAGAAGGCAAATTTGTTCTGGAGAGAGCAAGGATAATAGACGGTAATGGCGATAG
CAGTGGATTCTACTTGGAATCCAATCAAGCCTGCAGTGATGAAGAGGAGGCTTGATAGTAATAATATATCCCACTTGCA
ATATGTTAAATGTGCTATTTACATACGCTAATATAATATATATAGTAATGTAGGCGCATGTGGAATGGTAT > SEQ ID NO:2344 212714 195977_300639_1
GATTTCTCCACCACTCGCTCGGCATTTGTTCTCTCTTCCTCAGCGATTTAAAGGACCTGACCCGTCTCACGAATCAAGA
GGCATAACCGTTACTGCCATCTCAGACCGCTAAGCAGCGATATCGTCATATTCGCGGCGCTGTGAAGGACAAGAACGAG
AACGAGAACTGTTGAAGCTTGGCTCACCCAGTCCCCGCAGCAATGGGCCTGGCCTACAACACCTACCTCACCAGCAACA
AGATCTACGGTTGCAAAACATGCAAGGCGCATCTTGCGAACCACGAGGACATCATCTCTCGGAACTTCCGGGGCCAACA
TGGCAAGGCCTACCTGTTCCATCGTGTCGTCAATATCGACACCGGTGACCCTAATGAGCGTAACATGACCACCGGCCGC
CACATTGTCCGTGACATCGCCTGCCATCAGTGCAAAGAAACGGTGGGTTGGAAGTACGACAAGGCTTTTGAGACTTCTG
AAAAGTACAAGGAGGGCAAGTTCATCCTTGAAGCTGAGCTGCTATGTAACGTCGCTTGATTGTACGAATTTCACCTCTT
TAGCATGATTTCATCAAGATGGGCCCTTCTTTTTTCTCTCATGTTTTTGTTCTTGGCTTCAATAGGCGttCaACAGATA
GTAGTTTCAGACAAAGCACAGCaTCcttgggCTGGAGTGAt > SEQ ID NO:2345 212714 193933_300777_1
ccccgatctctctctctctttcactgtttcttcctcctctgcacttggcgcaGCACAAAGTCGATTCCTTTCCGCCTC
AGCGGCGCCGCTTGTTTCGATCGAAGCATCGCGAGAGGCAGCCCGCCGCCTGGGTTTCGTGCCGATTTTGATTTCCTTT
TTCTTGGCCGCCTCTGCCTCTCTCTCTCTCTCTCTCCCTTTCTTGGTTCGATTGTTCCTGGTTCTTGGCCTGATT
GGTTGAACCTGCTTCTTCTGGAATCAATTAGGGGAGAAATATTTGCAGGAGAGGGCGGTGGCGATGGCGGAGTTGGTT
GGGCCGCGGGTGTACAGCTGCTGCCATTGCCGGAACCACGTCTGCCTCCACGACGACATCATCTCCAAGGCCTTTCAGG
GGAGGAACGGCCGTGCGTTTCTTTTCTCTCATGCTATGAACATATCTATGGGTCCAAAGGAGGACAGGCAGCTTATGAC
AGGGCTTCACACAGTTGCTGATATCTACTGCCGTGATTGCCGTGAGGTATTGGGTTGGAAGTATGAAGAGCATTTGAA
GAATCCCagaAGTACAAGGAAGGAAAATTCATATTTGag

FIG. 2 continued

> SEQ ID NO:2346 212714 1108938_301544_1
ggagtggAGTAGGAGTAGTTGGGGATATGGGGTTGTTGTTCCGGGAGCACCTGAGCGGACCTCGCATCTACTGCTGCAG
CAACTGCCGGATGCACGCCGCCAACCAGGACCGGGTCTACGTCAAAAGCTACCAGGGCCGCTTTGGTTATGCCTATATC
TTCAATTCCATGGTGAATGTGTGCCTTTCTTCTAAAGAACGTGTGCACATGACTGGCTTGCACACCATCACCGATATTC
ATTGCAGCTCGTGCCATCAAATCCTTGGTTGGAGATATGAAAAAGCTTATGAGCAGAGAGAGAAGTACATGGAGGGGAA
GTATATCATGGAGAGATCTAgaATGGTCAAGGAGACTCACTAGCTTCATTTTaTTTTTTTCCCAACTtTGTATACTCAC
AACATGAAAATTAAAAGAGAACAAAGGCTATTTACATATATTTgCAGCCCTTTTtaGGCCattaattgcaaAtTTAGCT
ATTTTTcaaaattaggagattcttttttTGGCCACCCAAaaccacTTTTtggaccaaaaAAATAgaaagcaatagtCTaaa
tttgattaATGTAATGTCATTTATgaggattaatTgCCTAAaAATGTAta > SEQ ID NO:2347 212714 1097550_301445_1
GAGAGAGAGAGAGAGACACACACACACACACCATTCTTATTACTTGCACAGATTACCTATGGCTTTCTCTCTCTCTCTG
GAGGAGAAAGCTTTTGGAGCTGGTTTTTGCCTCCGCCCAATTTAGCACATCTGTGGTTTTGGTGGGTCAAGGTCTCCTT
TTTTCTTTCAAAGTGAGGAAAAGGAATAAAACACACATATGGGAAGACTGTACTTAGTGCAGCTGGATGGCAGAATTTA
TCAATGTTGTTACTGCCGGAGTCACTTGGCCAGCTGCGGCGAGTTAGTCTCAAAGCGTTTTCATTGCCGACTCGGGCAG
GCTTACCTTTTCAACACAGTAGTCAATGTTTTGGAGGGGCCTCCAGAAGATCGAATGATGTCGACTGGCCTACACAAGG
TGGTTGACATCTTTTGCAAAGGCTGCCATCAGATTGTTGGTTGGAAATATGAAGTAGCATATGAAGAGAGTCAGAAGTA
CAAAGAAGGGAAATTCATATTGGAGAGAGCGAGGATGATAGATGGGGAAAGTAGAGAATCCTATTTGGAAGTCAATCAG
GCTGGAAATTATGGAGACGAGGTTCAATAGTTGTCTACTCTTGTTTCAAGTGCAATATTTTAATGGACATATATGTGTA
CATAT > SEQ ID NO:2348 212714 1097148_301437_1
CGTCGAGATAGATAGATAGATAGATAGATAGAGAGACAGCATAACCAAACCAAGCCAAGAGAGAGAGAGAGAGGAGCAT
AGCAAAGCAAAGCCAAGCCTCCTTCATGGGTTTCCCTGNATTTAAGATCTATCATTTGAGAGCTCTAAAATCTGCAGAA
TAACGCTACAAAAAACAGATTCTAGGACCGTGAAAGGTATCCATTTTTTTCCTAGAGTGGGGGAGATATCATAATTATA
CATATGGGAAGGCTGTACTTAGTGCAGCTGGAAGGCAAAGTCTATGGCTGCCGCTTCTGCAAGAGTCACTTGGCCAGCT
CTAGCGAGTTAGTCTCAAAGAGTTTTCATTGTAAGAATGGGAAGGCATACCTTTTCAATACAGTAGTCAATATTTCCCA
GGGGCCTCAGGAAGACCGGATGATGGCAACAGGACTACACCGGGTTTCTGACATCTTTTGCAAAGGCTGCCATCAGCTT
GTTGGCTGGAAATATGAAGCTGCATATGAAGAGTGTCAGAAGTATAAGGAAGGGAAGTTTATTTCAGAGAGCAAGGA
CAATAGATGGAGATGGTACTCAATTCTTCTTGGATGTGAGTCAAGGCAGCAGTGATGGAGAGGAGGCCTGATACTTCCT
TTCTTCAATATACATCTTTCAACACACCTTGGTATGTAGTATATATATA > SEQ ID NO:2349 212714 238585_301295_1
GCAATCTCCAGCGCGGGTCGATGATCGCCGCGGCGCGATTGGCGGGCGAGATTCCGGTCGATTGAATCCATTGATCGAT
CGGTTGATTGATTGATTGTCGCCTTGGATTTTGGCTGGTCCCAAGAAAGGGGGCTTTGGCGAAATTCGCGTGTTCTTGG
CGGATTTCCACCACCGGCGCTGCCCCCGGTCTCTCCAATGCAAGGATTTTGAGACAGGTCGACTGATTCGTATCGATCA
AGGGAGATGGGGAGGCTGTGCCTGATTGAATTGGACGGACGATTCTATAGCTGCCATTCGTGCCGGACACATCTCGCAA
ACTTCGATCAATTGATGTCAAAGGCCTTTCACTGCAAACACGGAAAGGCTTATCTTTTCAACACAGTTGTTAATGTGTT
TGAGGGACCATTGGAGGAGCGGGTGATGACCACTGGTATCCACACGGTGGCTGACATCTACTGCAAAGGCTGCCAGCAG
AACGTTGGATGGAAATACGAAGCCGCGCAGCACAAGTCCCAGAAGTACAAGGAAGGGAAATTCATTCTAGAGAGAAGTA
GAGTTGTAGGCTGTGAGAGAGGCGATTTCTATCTGGAAACCCAGGCGATTGGAAGTGACCCGGACGA > SEQ ID NO:2350 212714 265956_200082_1
TTTTGATCCTATCTTTCTTTACTGAGTTGTTTTAGTTGTCAACCTTAATTCCGAGTCTTCAATTTAATACTGATCCAAA
AGTCTTCTAAGGCAAAGATGGGGAGACTATTTTGTGTTGACTCTTGAAGGCAAGATCTATAGCTGCAAACACTGTGGAAC
TCATCTTGCTCTTTCTGAAAGCATCGTTTCTAAGTCTTTCCACTGCCGACATGGGAAGGCTTATCTCTTCAGTAAGGTA
GTGAATGTCACTTCTGGCGAGATAGATGAATCAGAATGGNATGATTGAACTGNNNGTATGCACCACTGTGGCCGATATT
TTCTGCGTCTGTTGTGGGTCAATTGTTGGATGGAAATATGAGACCGCCCATGAGAAGAGCCAAAAGTACAAAGAAGGAA
AATCCGTGCTTGAGCGGTTTAAGATTTCTGGCCCTGATGGAAGCCATTACTGGGCCAGTCATGAAACGCATGTTGCAGG
AAGTGATGCTGATGATGTTTGATCACCTCATCTCACCGTCAGATAAATAATTCTATCCCAAATGTACATTCTTTAACTC
ACCACCCCATTGTATTGGATTCTTGA > SEQ ID NO:2351 212714 255176_301642_1
GAGAGAGAGAGAGAGCACCTGCACCATGAGATTCCAGGTCCAGGTAAAGCTGGTTGTTTCGATTCCCAAATTAGAAAAT
CTAAGGTCTTTTATCCAAGAGCACGAAGGAAGAGATATAGATATGGGCAGGCTGTACTTGCTACGCCTAGATGGCAAAA
TTTATAGCTGTCGCTACTGCAGGAGCCACTTGGCCAGCTGTAGTGAGTTAATCTCAAAGACTTTTCACTGCAGACTTGG
GAAGGCTTACCTTTTCAACACAGTAGTCAATGTCTCAGCAGAGCCTGAGGAAGACCGGGTGATGACGACAGGCTTGCAC
AAGGTTTCTGACATTTTTTGCAAAGGATGTCATCAGATTGTTGGCTGGAAATATGAAGAAGCATATGAAGAGAGCCAGA
AATACAAAGAAGGCAAATTTGTTCTGGAGAGAGCAAGGATAATAGACGGTAATGGCGATAGCAGTGGATTCTACTTGGA

FIG. 2 continued

```
ATCCAATCAAGCCTGCAGTGATGAAGAGGAGGCTTGATAGTAATAATATATCCCACTTGCAATATGTTAAATGTGCTAT
TTACATACGCTAATATAATATATATAGTAATGTAGGCGCATGTGGAATGGTATTTTTTCTTTTTTCATTCCATTTTGAA
TGCATCTA

> SEQ ID NO:2352  212738  211632_300901_2
GGCTTCTGGAAATATTCTAGCCTCCGCCCTGCATTAGATACCCGAAGACTCGGGCAGGCTGTATTCTGCGCCCAAGATC
TCCAAGTGCCGGCACCAACCCGCGCGCTACGGGCTTTTTTGTTTTTGTGTGTGAATACCCCAATTTCTGGAAAATCTCC
AAAAAGAGCAACGAAACAGCCCCAAAATGTCCCAGCGGGCTAGTTCGGGAGACTCACCGTCTGTGGGAGCAGAGGAGAA
GGGAAACGCAGGCAAGGCCGTGCAGGACACTGCTGTGGTGCAGCAATCAGACGCTGCCTTCACAAATTCATACGATGAG
GAGGATTTCTGGACGAGGAACGCCTTGAATGCCAAGTCATTCCAGAAGAAACACTATGGATTGGGACTGGTGGAACTGG
ACCGAGCGATGAAGACAAGGCACTTACAGATGATTGCCATTGGAGGCTCCATTGGTGCTGGGTTTTTCGTTGGCTCTGG
TGGTGCTTTGGCCAAAGGTGGTCCCGCCTCGGTTCTTATTTGCTTCCTCGTCGTCGGTTTCATGGTCTTCAACGTCGTC
TTTGCCCTTGGTGAACTTGCCATCATGTACCCAGTTTCCGGTGGTTTCTACACATACGCAACTCGCTTCATCGACCCCT
CGTTTGGCTTTgcagtcggAtgaaaTtattctTCCTctg > SEQ ID NO:2353  212744  212795_300843_1
cccacgcgtccgcccacgcgtccgGGCAAAGAGATTCTACATCCATAATTCCATCACATGCCGCTTGCCTCGTCATCAT
TATTTCTCAAGCAGCACATTCCGTCAAAACCTTGTGTTGAGCCGTGGCAATAGCCAGAAAGTATCTTGCTCAACCCTCA
CTCAGCTTGCCTTGTCGTTTCCTAATCTACCAACATGGGATGCCTAgAAGTCTGGGCCTTCCGTCCATTTACCGTGGCG
TCGGGGACTTGACTGATTCCGAGGAGTTCTGGTGACACAGCACGCAAGGCAGCCATTCCTCCTGGTTAAGCATATCTCT
TTGCCATCGGATTCCGAAGaGGCCGAAATTTGGAACCGCAATGACAGATCCCGTTGATAACGGCATGCCGGGGAGTGTC
ATTCCAGTATTACGCAGCGTAGGGGCGGCGGTTCGGTTTCGAGCTACGGGCATGCTATGCATTTGGAAGAACCTTTTTG
TTTTCGTTTACTCCGGTTACGCGGAAAAAGGAAAGgagACGGGAagcTgagttGttcATCGGGATCCgtTTGGCTCCgT
GATgatGAGTTTtgccttggagatgg > SEQ ID NO:2354  212744  213303_300852_1
AAGGCAAAACTCATCATCACGGAGCCAAACGGATCCCGATGAACAACTCA > SEQ ID NO:2355  212755  214355_300857_1
gacgaagcatgtcattcaacaACAGCCAAGGGTAGTTGCTTTAGGGGGCCCAGCAAATCGACAGGGTCGACTCGCCGCA
GATGATATAGCCGGCAGACCAGTGCACTATCGCGGCAACATCGGCACAATCATCTGTCAGGTCTTCGATTTAACCGTCG
GTTTAGCTGGCCTGTCCGTCTCGGCGCTGCGTGACTTGGGACAGGAGCCGCTCTGGGTTACAGTGCATCCTCCACACCA
TGCGAGGTATTATCCTAACGCTCGTCCAATCACGATCAAGACCGCGTTCGAAAAGGGCACAGGCCGTATTCTGGGGGTG
CAGGCAGTGGGAATGGCTGGCGTGGACAAACGCATAGACGTCCTGGCAACAGCGATGCAAGCTAGGATGACAGTCAATG
ACCTGGAACATCTCGAACTGAGCTACGCACCACCCTATAGCTCGGCCAAAGATCCTGTGAACATGGTCGGATTTGTTGG
CTCGAACTTGCTCCGCGGGGACTATCAGATCGTACACGCCGAAGACATTAACATCAAGAATCTTCATGCCTGGCAAGTC
GTGGATGTTCGCACACCCGAGGAGTTTGCGACTGGCCACCTCCCGGGGGCAATCAACTTGCCAATTGCAACACTGCGCA
ATCAGAAATTGGAGCTTGACCAATCCATGCCAATTCTTGTGTACTGTTATGTGGGCTATCGGGGATACTTGGCCTACCG
CATCCTCAGTCAGAGAGGATTCAGCGTAGTAAACCTTGATGGCGGACTGAAGACAGTAGTCGAGGGGGGAACCAGGCTT
TGAAAATTTGTTCTTCAGAAAATTTGTTCTTCATGTTTCTAACATATTTAAGTGATATCTAAGTAATATAATCTCAGTC
TTACGcaaAaAaaaAAaagagcgc > SEQ ID NO:2356  212756  215854_300885_1
GCAGTTAGCTCAAAGGGGGCATTTCGATGGGAACGAAGCAATCTGGAACGTGGTAACCAAGGAGTGTAGAGGTAGTTTC
GATGTATACTCGCCACATCGTATCTTGAGCGAGTTCCTCGTCAGTTTCGATGTGTCAACGCTCCGTGATTGGAACAAAA
CAGCCAATGCTTGACCTCGCGTAATCTGTATCTTGCACAACATTGCGGGGATGATCTTTAGCCGATATCTTGGAAGGCA
GCGGCGCGAATGACCATCTACTACGTCCAAACCGGGCGATAAGAGAGgccGCCACGTACGCGATTCGCGCGGTCCTCGG
TCGTTCGGAGTGGTGTTGTGGAGAGTGCCAGGC > SEQ ID NO:2357  212767  206827_300826_1
ACAAATCCATTGCGCTACAAAGAACAAGCACCATGGACGCCAAGCCTGCCACTTTCTCCTTGGCCGCTGCGC > SEQ ID NO:2358  212767  220081_300951_1
CTAACCCCAATCGCCAAATACACAAATCCATTGCGCTACAAAGAACAAGCACCATGGACGCCAAGCCTGCCACTTTCTC
CTTGGCCGCTGCGCCAGTTGCTTCTCCCGCAGCCTCCGCGAGCGCTTCCAAGCCCAAGCCGTGCTGCGTATGCAAAGAG
GAAAAGTCGAAGCGCGATGAGTGCATGCTCTTCTCAACGGCCAAGGATCCCGCAGCCGACTGCAGATCGCTCGTTGACC
AATACAAGAGCTGCATGCAGGGCTTCGGATTCACTGTATAAATCAAAATATCTTCATCTTGGCGCTATGCCTTTGTACA
TTATCACCATATAGACTACTCGGAAAAGTACAGCGCTCGATTATTCTCCATTCTAGaGTAACGATCCCATCCCctgata
aAAAAAAAcaaAa
```

FIG. 2 continued

> SEQ ID NO:2359 212777 209023_300811_1
tccaactcaactcaacCATGCTATCTGTGGACCACAACTACAACTCATCACAACAATATCAGCGCTTTCAACAACAGCA
ACAGCACCAGTATAACAACAACATCACCAACAACAACAACAACCTGAACAACCATCATCAGACAAAGCTGGACGACTTC
ACCTTTGGCAACTCGACCGACTTTGACTTCTCGACCTCGACCTTCCCCTCAACCGAGCTCTCTGTGTCCAATCTCGAGT
ATCTCAACGCCGCAATCGCCTCTGCGTTTTCGTCTGACTCGATGCGGCCCGAATCCTGGGACGCCGCCGCTCGCTTCTC
AACTCCCAAGTTTGGTCGTCTTCCCCATCAACGAGAATCCTCTCTGTCTTCTCTGGGATCTACGGGGCCGGCGTCGCCC
TTCAACTCGCACATCGCGAACCCCCACATCGCCGTCACTGACGCCAATGGTGACGGCTTCATGGACATGCACTCGCACG
ACATGACCATGAGCTCAGGCCCTTACTACCAGCTGGCCGCCAAGACGATGCCTCCCTACTCAAACTTCCATCATCTCGA
CAACGCCTCTGTCAGCGAGATGGCATATCCAGTCTCCATCCCGACCAACAGCCACCACAAGCTGCGACaGgATCGCAac
CTCCTCCc > SEQ ID NO:2360 212785 205828_300802_1
cggacgcgtgggcAAACATCGACGAATTCGAATCGCCCACGATGTTTGCCGCCCGACAGGTTACCCGCAACGCCCCGCG
CTTTGCTGCGCAGCTGCGCACTCCCATGCAGCGCCGCTTCGCCAGCACCGCCGAGAACGAGTTCATCGCTGAGCGCCAG
CACATCAAGGAACACGCCAAGGGCACCACTGAGCTTTGGAAGAAGATTTCCATCTACGCCGTTGTTCCTGCGCTGGCTA
TCGCCGGTGCCAATGCCTACTGGCTGTGGACTGAGCACTGGGAGCACTGGAGCCATCTTCCTCCTCTGCCCGAGCGCAC
CGAGTACCCCTACCAGAACATCCGCACCAAGAACTACCAGTGGGGTGATGGTGACAAGACTATCTTCTGGAACGACAAC
GTCAACTACCACAACAAGGACAAGACCAAATAAGCTGGAACAATGGCTCCCGGAGGAAAACTGCTGGTATTTGTAGATT
ACCCTTTTTGGGACCCCTCTGTATATTTCCCTTGGAGCTTCAATCGATTACACTGTGGCTGAGGAGAGACTTCCATGCT
GTGTGTGACATGGCGACTGAGCTTGAACCGTTTTTTCAATGTACAtTATTCcccTgtgtCcctaccttagta > SEQ ID NO:2361 212792 195561_300635_1
GTTTGCTGGCAGGACGACATCTCCACCATAGAGTCGACTCATTGCTGGCATACGGAGCATTCCAATCTTACTCGTAGTA
GTGTTATTGCCATCGCTCATCATGCTGCCCAAGGCGATCATCGCGATTGCCGCATTGGCTTTCAGCCCAGCAAATGCGC
TGTGGCCCATTCCTCAGAAGATCTCGACCGGAGACAGCGTGCTCTTTATTGACCAGGCTGTCAGGGTAACTTACAATGG
AGTGCCGATCATCCCTATCGGCTATAACCCACCGGCCAGCTCCAACTTCGACAGCAGGCAAATCGTCCAAGGCGCTGTC
TCGCGTGCCTTTCAATCCATCTTCAACACCAACTATGTGCCATGGAAGCTTCACCCGCGTAACAGCAACTTTGAGCCGA
AGGTGGCCCCTCTGAACCGAATCCAGTCCATCTCAATTCAGCAGACTGGAAAGGACACTTCCAAGACGTTCAAGCCGCG
CGCCGGAGATGTTGATGAGTCGTACTCTCTGACCATTTCCAAGAATGGACAGGTCAACATCAGTGCCAAGTCCTCCACT
GGTGTGCTGCACGCCCTCGAGACCTTCTCGCAGCTTTTCTACAAGCACTCTGCTGGACCTTTCTACTACACGACACAGG
CACCCGTGTCCATCACAGACGCACCCAAATACCCCCACCGTGGCATCATGCTTGACCTTGCCCGTAACTATCAAACCAT
CGATGACat > SEQ ID NO:2362 212792 219145_300928_1
GGACAGGGGAAGGGGGTGTTAGTTGCGATAGCCGATGTTTGCATGTGAAGGCCACTACTTTACCAAAAGAGGATGCTGG
GATGGCTGTTGCCGGTCGAGTAATTAATATGCATAATAGTATCCGCAGGTGATGAGGTGATTTTAATGTATAATTGCTA
AAAAAAAAAcaaaa > SEQ ID NO:2363 212794 219143_300928_1
AAGTAGCAAATTGTTTTCTTCTTGCACGGACTTTTTACGGAGTATTTGTTGTCACTCTGGCCCGAGCCTTTTGACCGTT
TGGCCGTTTTCATTACTAGCTCCGTCCAGCATCAAGGATCCCCATCGATACGACGTCGAGATACCTACCTAGTAGTACC
TAGCTGCTTGAAGTTACGAGTTGCGAGTTGTCGATATTGACTTCAGCTGCCCTGTCCTATCATACAGCCCAGGGGAACA
ACGCCCCTGATAAGAAAAACAAGCTCCAGTCCCGCCGTCTCCAGCTTTTGGACCCCGTTTGCCTCCGTACAGCACGCAT
TGGATCCCGTGGCCCTCAAAAACTCAACTCAGGGCTAGGTCTGGTGACGTGCATAGGCGGCCTTTTCAGGCGTCGAAT
CGCACGTAGCGGGTTTCTCCAGGCGCCTCTCCAGGCCCCCTCTAGGCCCTGTCCAAAGGCGCAGCGACAGCCTAGGCcG
CAATCAATTGATCCTTTCCCCGCGGATTTAcccgTCAACCCCACCATCagaccAC > SEQ ID NO:2364 212808 219282_300929_1
agaggattaaggattgggaaataataagaGAGTTGTCGAGAGGTCACTGGTGGCAAATGTTTTTGTTATAGGTAGCCCA
TCAACCCGTATCACACAAGACTGAGCAGTATATATAGAATTCTCAGCTCTCTCCTCGGTGTCCCTCTTGTTATCCCAAG
TATACGATACTCACCAaggacgTCCATCACCCACTCCTTATACAGGTATAGCACTGCGAGAACCTGCCCAGCATGCATC
GTCAATACGCCCCTccgcgcgaACCTATCCGCAATGAGATTGTCGTCGTCTTTGGCGAGTTCTGCGGTACCTtcatgtT
CCTCctgAtGTCCTTCATCGGCACCCAGGCCGCCATCGAAAACAACGATCCAACAAACCCCAACGCGCCTctattTCCC
TTTTCGCTCttgtatgTTGCTTCTTCTTTCGgaGCtgcACTGGCCGTCAACGTATGgGTCTTTTacagaGTGACGGGCG
GCAtG

FIG. 2 continued

> SEQ ID NO:2365 212824 219221_300929_1
attcttccccCCGTTAAAATCGAATCCTTCAGCGCTCGCCGCTACAAAAAACCGCTTCCACTCATTCCCACGCGACAAT
CTCGAGCATCATAACCCTTTTGACCGCTTCGCCACATCACATACATCATGTCTAACCAGGACTGGGATTCTGCCACCAA
GATTGGAAGCCGCGTTCGCGGTCCCGGTGCTTCGGACCGCGAAACCGTCATCCGAGGAAAGAGTGCGTTGAACGCTGCC
CAGAGATCTGGTGCTGCCATTAGCACGGAGAAGAAGTACGCCAGCGCCAACACGGCCAGCGGTACTGAGGGTCAGCGTC
TCACCAAGGTCGACCGCTCCGACGACATCATCAAGCCCAAGACTGTCGGAAAGGAAGTCGGAAAGGCCATTGAGCAGGG
CCGACAGAAGTTCGAGCCTACCATGACCCAGGCTGCTCTGGGCAAGCAGATCGGAGAGACAGCTGCAACTGTCGCCGCT
TACGAACGCGGTACTGCTACGCCCGACCAGACCATTCTCTCCAAGATGGAGCGGGTGCTCAACGTCAAGCTGAGGGGCG
CCAACATTGGTGCTCCCCGCTTGGGCCCCAAGAAGAAATAAATAAGGAAGAAAAAAATATGACATTAGATTTTGGAGCA
TAATGGAAGAGGCAGGAAACAAGTAATTTgcaaTTGGACAAggGCGATgAACTGcGtggCTCTC > SEQ ID NO:2366 212824 226220_300995_1
tcattacacacagttagcgtttgcatccccggctactgtaataccccgcaccgagtctaccaccatccacactaacca
cCACCATTAGATCagggtaaCTCTAGAAGGTTCCATTGCTCACACGAACGTCAAAAACGCAGTCGACTAAAACCCACTC
TACTTCTCACACCACACACCTTTTAAACCACACATTCACAACTAAACATGTCTGACGATTGGGAATCCAAAACTGTTAT
TGGCTCTCGAGCCCGAGTTGGCGGAGGAGGTCCTCGAGCCACTGTCGCTAAGACCCAGGCAGAAATCAACGCTGCCATG
CGATCCGGTAACGTTCTGTCTACTGACAAGAAGTACGCTTCTGCCAACTCCAAGGACGGAGGAGACGGACAGCGATTGA
CCAAGATTGACCGATCTGACGATATCATTGCCCCTCCTAAGGTTGAGGCTTCTGTTGGTAAGGCCATCATCAAGGGCCG
ATCCGAAAAGGGTCTGACCCAGAAGGAGCTTGCCGTCAAGATCAACGAGAAGCCCCAGGTGGTCAACGACTACGAGTCT
GGACGAGCCCAGCCCAACCAGCAGGTTCTCAGCAAGATGGAGCGAGTCCTTGGTATCAAGCTTCGAGGTAAGGACATTG
GTCTTCCTCTTGGCCCCAAGGGAAAGAAATAGAGAATGATATTTATg > SEQ ID NO:2367 212830 214926_300876_1
gagaaCATAACCACAACTAAGTCATAAGGAAACAATCACGATTCTGAATATCTATTCGCGTTATATACAAGCTAAAATG
AAGCCGTTTTATCTGATTTCTATTCTATTTACCAGTTTGGGCACTGCTATCCCAGTTATCCCTAGGGATAATAACGGAA
TCCTCGATAATTTCCTAGCTATTGTGAAAGACGCGACAGGAATTGATCGGACACCCGTCCACGGGCTCGTCGGCACTGT
CCTGAATGGTGGCACCAAATCTATCTTGATTAACTCGACTGTCCTGGGTCTTGCAGAGGCAATTTTTGATGAGGTGAAA
TCCCAATTAGGCATTCAAGATCCGCGGTCGCTTGAAGAAACTATTGCGTCTTTGGAAGAGGCGGGTAATGAGACTTTTA
ACCAATTCTGCCAACTACTCGACACGTTCCGCAGAGAGGATAAAGGTCCTGCTGGAGGAACCATTGACTCGCTAGGCGT
GGGCAATATATCCTCATTAGACTTGGCATCTTCTATCGACTTGATCATAAACTTGGTCGGACTACAATGTCCAAGTGGT > SEQ ID NO:2368 212833 219230_300929_1
gcctagaACTCGCGATTCCTTGGAGATAACGCGAAGGAATCGGGTACAGTAAACGAACCCCGCTGGGACAATTCATTGA
TAATCTCACGCAATCGCCCATCTCGTTCAAGAGATTCGTCATTTGCTTCAATGGGAGCGAGCATTTGTAGTTGATTGGG
GAAATACAGCAGAAGACAGACGAATTGACCAAGAGTGGGGAGTTCATTTACAACTCCAACCCTCGACTTCACCATGATC
ATCTCCAACAGCGTCATTGCTTCGGGCATTTTGCTCGCTGGCAGCACGACAGCTCATTTACGGCTTCCCCCGTTCTTTA
CGGCCAAGCAGCAGGCTCTGGGCCCGTCTGCCCGATCCCAATTCCAAAGCTTCGGGTTCGGTGAGCAGCAGCAGCCATT
GACCAGCTCCAACATTGGAACAGCGACAACATCCTCTTCAACAGATGATATCCCCGCCTTCAAGGCTGGCCAGTTCACT
CTTACGCCGCAAGATGATTCTACGTGTGCTACGTATGGCGAGTCGCAATGGACCGgcACCATCGACGTGACAGACTCGC
ATCGCCTCTTCTTCTGGTTCTTCGACAGCCGCAACGACCCcgTCAACGACCCCATCATCATCTGGATGAACGGAGGgcc
tGGCGGCAGCTCAATG > SEQ ID NO:2369 212871 219268_300929_1
GCCGGACTTGGGTGAAAAGACTTCGGTGCCTTCGACTTCCATCCGCTGGTCCGTCGCAAGCTCGACGGGATCCGGGGCG
GATGACGGGGACCTGACTGTGCCTGCATCGGTCACGGCGCCGGAGGGCGTGACGGAAGAGACCATTGTCCAGCGATTCG
CCTGGGCTTGCTGCGGTGACAACTGCGTATTGGCCATGGGGATGTCGCCCGGGGCGGCACCGCTTGCGCCTCCGGATTG
TAGGGAGGCGTCGTTGTATACGCGGCGCTCTGCAGCATTTCTCCGCTTTGTGAGATAGAACCACACGGCTGCCGCGACG
AGGAGGCCGCCGCCCACCACTGCACCGACGGCGATACCCGCTTCCGCCCCGGGAGAGAGACCCCCGGACGACGAGGACC
CGGAGTTGTTGGAGTCGCCGCCCGCCTCGAGGGTGCTGGTCGGGCCCCCGGTTGCGgTGGagcagtaagCCCGatcCgg
CgaacgaagtACATg > SEQ ID NO:2370 212877 219568_300946_1
AAACATACGCCTCGTGTGGCGCCTTGTCTCAGGGACAACAGACGACGAGCAACTCAAAGACCAGAGCTAAACATGGCT
TGGCTAGATGGCAATAAGCAGAGCACGCTTCAATCGAGAACAGACGCGCTCGACAATAAAGGATGTGCTACGGCACAGC
CATTGGGACAGATGATGTCGCGGTTCAACGGTAAGTCTTTTGATCTTGTTGATTGAGCATCATAACGTGAGGCCGGCTC
TAGTTGTTCAGGACGATAAATGCCACTTGCAATGACCGAAGCTGTTTGAGTCTCAATACACTCTGTACCAGATGAAAGG
GCTTCTATGTCTGCTAGGTTTTCATAGATTTGTCATAGTTATGACTCCTGAAGAAGTAGTTGTACTGCTAAATGAGAGC
CACTGTGTTTGCTTTGCCCCTGGCTAGCTAGTAGaAT

FIG. 2 continued

> SEQ ID NO:2371 212883 219280_300929_1
tttttcggcgtttggcatcaaAATCCCTTGGTCAGCGAACCCCGAGCCCGTGCGCTTGGGAAAAGTATGGGGGATTGAC
TTTTCGAGGGAGGGTCATGTGATCTTAGTACGTACCGCAGTTTTTAGTAACAGCCTAGAGGTTGCAAGTTTTTTTTAG
AAATTCCCAACGCCAATGTTGGCTGTGGC > SEQ ID NO:2372 212892 219245_300929_1
cgcatcttcggCaAGGCGCCGTCATCGCGCGGCATCATCGTCATTGACTTGAGCTTGGAAAGCTCAGCAAGATGCCAGC
AACCATGGCCCCTCCAACGCAGACTTTCAACCTCGATGTTGAGGCAATCTCGGGCATTTGCGGATCTATCTCTATAGCC
TGTTGGGTGGTCGTGTTCTCTCCGCAAATCATACAAAATTTCCAACGCAGCAGCGCCGACGCTCTTTCGATTCAATTCA
TCATTGCTTGGCTCCTAGGAGATGTCTTCAATATCCTCGGAGCCGTTTTACAGGGAGTTCTCCCCACCATGATCATCCT
AGCCATCTACTACACCATTGCCGATCTCGTACTGCTCTGCCAGCTGTTTTACTATCGCGGATTTACGTGGCGCGACGAG
CCGACTCCATCCCCGCCCAAGACAAATGgccACTCTTCGACATCA > SEQ ID NO:2373 212902 212913_300845_1
cccacgcgtccgccgtgactgaagttcaaccaCATCCCAAACACAATATAAAACCCTCACATTTTCAAAAGAAAATCGA
TTATTATCACACTAGAAATTAAGAAAAATAACAGGAAGCATGTCTGACGAAGAGGGCGGCACAACAAGATGCTGCGCCC
CGTTCCTCGCTCTCACCGAGCCCATTGAAGTCAGCGAACTAGGATGGCCTCGACAAACCATCCGCATTTTTCCAATGGC
CCTGGCCCAGTCCCCTCTTGTTCATCAACGAAAGTAGCGATGCGCGGGATCACTGCGCCAACGAGCGAACTTTCCTTTC
GTACCTCCGCCTGTCGATATACATGGCCATCGTCTCTGTCGCCATCACCGTCTCGTTCCACATCAAGGGTACGCCCAGC
GATCTCGAGCGCCGGGTGGCAAAGCCCCTTGGTGGCATTTTTTGGGTACTGTCTGTTGTGACTTTGGCTTTAGGAGCGG
GAAACTATATCAGGACTGTCAATTTATATGGTAAAAGAGCCGCTATTGTGCAATCTGGCTGGAAGACTCAGGTGGTGtt
GGGTATAATAGCTgctTCAATCATTGGGACGTGCATCATAT > SEQ ID NO:2374 212987 219457_300945_1
ATACACGAGGGGATATCCCCAACTCCAGTCTTCTTGCTTTCTTGCTCTCGTCGGGAAAACGAGGAGAGGGCTAGAGAAA
AAGAAAGTCAATTCTCGCAAAAAAGCTTTGCCACACTTTGATTTGTCTGCTCCGGCAAACGCCTCATTTCGTCAGCGCG
CCAGAATATGTCACCGGACGTTTACGAAAGAAGAGAGACATTTTGGAAAAAAGGTTGGATATTAGCCGAGTGGGCTGGC
AGAAGATGACGCCAACCCGGGCAGCGAGCGGTTTTCGTTTCGCCTGAGCTCCGCCTTTTTTTTTTCTCTTTCCAATGGC
ACAGCGGGCGACACAGCAAGGCAAGGCACATGTACCGTATTGGTTCTCGGGGCTCGAATGCAACAGTGCCTCATGGCGA
TTGATTGCAGCGTGCAATAAATTGCCTATCTGCGGAAAAAAAAAAAACAAA > SEQ ID NO:2375 212990 212948_300845_1
cccacgcgtccgCTGTTCCTCCTCCTAGCTTCAAAAAGACGCCAAACCCTCAAAACTGCTCCCAACCAAAAATAATCCA
CTACAAACGCTTTCGATAAACTTGCTCAAATGCTCTCAGATGGGTAACGCAGATGCGTGTGATTGGCTGGCTGTGCGCC
TGGTCCCTGTTTTAGCCTCCCCGCCATTCGGGATCCGGAAACCGACTGTCTCTTTTGGACTGGGCTGGAAGATTTGGAA
GAAAGACGGTACTGTAGGGGAAAGATGATGCTTAATATTTGCTGTAAATTCTTATTGTTACTCATTGCATGTTACGCAA
TCGGGGCCTTCTTTTTGGCTTGGCAGTTGGTTATGTTAGTAATTGGCATGTACAGTACTGTATGACTCTGC > SEQ ID NO:2376 212995 219352_300944_1
GACCCACGCGTCGTGCCCCTTATGATGTTTGTGTTTGAGACACGGCTGATGAGGGCTGAGAAGTTGTTCAACATTGCAC
AACGTCTGGAAAGACGGCAGTGGGCCATTCGAGTAAGAAAAGAACAACAGACGGATCCAGACTCTTGGTAGTAGCTAGG
CAGCAGTTTAACAGAAGGAACAAAACGGGTAATGCGGGTGGTTTTGGACGCCATGTGTTGACGTCTCTCCAGCTTTCTC
CATCTTCTCCGTACTGACTCTGTCTCCATTTGGCCGGGTTAGTCTTGTCAGTTTGGGGTTGGTCTTTGTCATGGAGCCA > SEQ ID NO:2377 212996 219484_300945_1
AAGCTTCTGCTACATCGCCAACATTCTGTTTTGATTATAACGATCTGAATGCCTACCTCCTCACCGTTGTGGGTGTTTC
TCGGCCTGAGAGCGATCAAGCCACGCTTTTTCATGACATCATGACCAAGGCTCAAGGGGGAGCTCGTATATCACTTCGC
GAGATCCAGACCTTGTGTTCCAGAGAAGCCATCGTCAAATTGGACTCGGGTGTGAATCTAGCTCAAGCTATAGAAAAGC
TTGGTAGCGGAATACACAGAATCTTGGTTACTGAACAAGCTGGGAATGTTATTGGGATTATAAGCCAACTTCGCATGGT
GGAGTTCTTCTGCAACAAGGGATCAATTTTCCCACCATTGACCGACTTAATCCAGTCACGCTACAAGAGTTAGGAATT
GGAGTGCGGCCGATAATCTCTGTCCACGCCGACGCTCCTCTTACTGAAGCTTTATCGCTCATGTATGATGAGGCCTTT
CAAGCGTAGCTATTGTAGACAACGGACAAAATGTGGTGGGCAACATCTCAACAAAGGATGTGCGGCATTTGACAAGCTC
CTCGAGTGCATATTTGCTTGGTAACTCTTGTATGCACTTCATTTCCATCATT

FIG. 2 continued

> SEQ ID NO:2378 213005 218590_300967_1
CCCACGCGTCCGACGATCCTCAACTCTCCAGCAATCCATTGATTCCCGCCCGTTCCTCCCGTCCACCCCTTCGACGCAT
ATTCCGAGGTCAAAATGGCTGGTGTCGCTACCTACACTATTGCTGGTCGACAGATCGGCGGCCACTACCTTGCCATGGG
CTGGTTGGCTACCCTCTTCGGTGGTGCCTACTATGCTGCTTCCGGCCCCAAGAAGCCTGCGTCTGCTGTGTCGCTACTCCC
CCGATCAACGCTTCCAGCTCTGACGAGGCCGACTTCATCAAGAAATTCCTTGAGGAGCAGGACAAGAAGCACTAAAGGG
CGAAACTCGAAAACGACCGGCATGGAGGGGGATAGTGTATTGTTGTCTTGTACATAATAGATGCCCAGAGAGCGAATGT
GTCTCGAGATAGAAAAAAACGATGCGATTTACTCTCCCCGACACGGCCAGTGCACTAGTTTGATCACGCCTACGTTTGA
CGGCTTGAATATGTCTCCTTTGCATAGTCTATGTTGAGCTACAGTATATCATGTTGATGGGCAAGGCGATGCTACGACT
GTTAGTCCAGCGGAGTCAGGTGACGCCTCCACCATATTCATTGTTTt

> SEQ ID NO:2379 213013 206626_300824_1
CCTCCAAATCAAGTCATCCGATTCATCCACAGCATGACACTTCCCCAAACGAGATTATTTCCCCCTCAAGCACTACTCC
GGAATACCCAAAGCCAGAAGTTTATCCGAACGATTGCTTCAATGGCTACTGATGCACCTAATTTCCCATTTCGGCGAGC
TTCTGGCATGGAGCCACCAGCCGAGTTCGCACGGTTAAGGGCTGTTGATCCAGTATCCAGAGTTAAGCTTTTTGATGGA
AGCTTGGCTTGGCTGGTGACTAAATACAAGGACGTAATTACTGTTGCAACCGATGAAAGGCTCTCCAAGGTCCGGACAC
GCCCTGGCTTCCCCGAGTTGGGTGCTGGTGGCAAAGAGGCCGCCAAAGCGAAGCCAACATTCGTTGACATGGACCCTCC
AGACCATATGCATCAAAGGAGCATGGTTGAGTCGATATTCTCTGCTGACCATATCAAGGAGCTGCAGCCATATATTCAG
AAGACGGTGGATGATCTCCTTGGTTCTCTGAAAGCTAAGGGTTGCGCTGATGGCCCTGTTGATTTGATTAAAGAGTTTG
CATTGCCAGTTCCATCATACATTATCTATACCATCCTTGGCGTGCCGTTCCACGATCTCGAATATCTTACCCAGCAGAA
TGCCATAcgaaccaACGgaagctctacggcgCG > SEQ ID NO:2380 213037 147215_301251_1
agcATTTGTATAGAAACAAACTTGTATCCACTAAACAAAAAATTGAGTTCTAGCCATGGCTGCATCTTTCTCAGTTCC
ATCAATGATAATGGAAGAGGAAAGGAGATTTGAATCAGAGGTAGCAGAGGTGCAAGCATGGTGGAACTCAGAGAGGTTC
CAGCTAACCAAGAGGCCATATTCAGCTAGGGATGTGGTGGCACTAAGAGGTACTATGAGACAAAGCTATGCATCCAATG
AGTTAGCCAAGAAACTGTGGAGAACACTCAAAACTCACCAAGTCAATGGCACTGCCTCTAGAACTTTTGGTGCACTTGA
CCCTGTTCAAGTCACTATGATGGCCAAACATTTGGACTCTATCTATGTTTCTGGCTGGCAGTGTTCTTCCACTCACACC
ACATCCAATGAACCAGGCCCTGATCTTGCTGATTACCCTTATGACACTGTTCCAAACAAAGTGGAACATCTGTTCATGG
CTCAACAGTATCATGATAGGAAACAAAGGGAAGCAAGAATGAGCATGAGCAGAGAAGAGAGGGCTAGAACTCCATTTAT
TGATTATTTGAAGCCAATTATTGCTGATGGTGATACTGGATTTGGTGGTGCTACTGCTACTGTGAAGCTTTGCAAGCTT
TTCGTCGAGCGTGGTGCTGCTGGTGTCCACATTGAGGATCAGTCATCTGTGACCAAGAAATGTGGTCATATGGCTGGTA
AAGTTCTTGTTGCTATTAGTGAACACATTAACAGGTTGGTGGCTGCAAGATTGCAGTTTGATGTGATGGGAACGGAGAC
GGTTCTCGTCGCTCGTACTGATGCAGTAGCAGCAACCCTGATCCAAACCAATGTGGATAcGAGGgatCaCCAGTTTATC
TTGGGGGTATCGAACCCGAATCTGAAGGGGAAAAGTTTGGCTACTCTTATGTCCGAAGCCATGGCAGCGGGCAAAACCG
GGCCTGAACTTCAAGCCCTTGagGATAAATGGCTGGCAATGGCTGAACTCAAGACATTCTCTCAATGCGTTAtTgATGC
AATCAAGAAAATGAACGTTACGGAGTCCGAAAAGcagAGga > SEQ ID NO:2381 213037 19274_300214_1
CTCGAGCTTGCGGCCGCGCTGCATCTTTCTCTGTCCCCTCTATGATAATGGAAGAAGAAGGGAGATTCGAAGCGGAGGT
TGCGGAAGTGCAGACTTGGTGGAGCTCAGAGAGGTTCAAGCTAACAAGGCGCCCTTACACTGCCCGTGACGTGGTGGCT
CTACGTGGCCATCTCAAGCAAGGCTATGCTTCGAACGAGATGGCTAAGAAGCTGTGGAGAACGCTCAAAAGCCATCAAG
CCAACGGTACGGCCTCTCGCACCTTCGGAGCGTTGGACCCTGTTCAGGTGACCATGATGGCTAAACATTTGGACACCAT
CTATGTCTCTGGTTGGCAGTGCTCGTCCACTCACACATCCACTAATGAGCCTGGTCCTGATCTTGCTGATTATC > SEQ ID NO:2382 213037 218886_300925_1
TTGATAGTGGCAGCGACAGTACATATCAAAAGATGATGCGAATAGCTTCACGAGCTCCCCAGCGGGCGTGCTCTCTGGC
CTCCTCTTCTGCATCCGCCGTTCTTCGTCGATCCATCCCGCGCTCTGTTGCCATCCGCGCCATTGCAACAACCGCTCGC
ATGGCTGCTCCCACTCAGACCATCGCTCACGCAGCGCCGGCCGACGCCTATCAGCTGCTGCCCGAGTCGCAAAAGGCCG
GCCAGGCCGAGGATGCTCTCTACGAGGCCCAGGTCAAGGAGATTGAGGAGTGGTGGGCATCGCCTCGTTATGCCGGCAT
TCGACGCCCGTACAGCGCCGCAGATGTCGCATCCAAGCGCGGCACGCAGTTGATCAAGTACCCCAGCTCCGTCATGGCC
ACCAAGCTGTTTAACCTGATCCGCGAGCGCGAGGCCAAGGGCGAGCCTATTCACACAATGGGCGCCATCGATCCCGTGC
AAATGACCCAGCAGGCCCCTCACCAGGAAGTCCTCTACATCTCCGGCTGGGCTTGCTCCTCCGTCCTGACCAGCACCAA
CGAAGTGTCTCCCGACT > SEQ ID NO:2383 213037 205080_300795_1
GATTAGTCTTCTGGATCTCCTTGTTTCTTCATCCTCTATTCAATTGACTTGATTCACTCTTGTCTAACAAGCAGTGACC
ACTTGCATCATTCATCATGGCCTCCAACAACATGGTGACGCTGGCTGTGAATCCAGACAAAGAAGACGACCTCTTCCTC
CAAGAAGTCCAGCAGGTCAAAGATTGGTGGCGCGATTCACGATGGAGGCACACCAAGCGTCCCTTCACTGCTGAGCAGA
TCGTTTCTAAGAGAGGCCATCTGAAAATTGAGTATCCCAGCAATGCCCAGGCCAAGAAGCTATGGAACATCCTGGAGAA CCGTTTTCAGAACAAAGATGCTAGCTATACCTATGGCTGCTTAGAGCCTACAATGGTCACTCAGATGGCCAAGTACCTC
GACACCGTCTATGTCTCTGGCTGGCAGTCGTCTTCAACCGCCTCTGCGTCAGACGAGCCCGGCCCTGACTTGGCAGACT
ACCCCATACACCACTGTGCCCAACAAAGTTGGCCACCTCTTCACGGCCCAGCTCTTCCATGATCGAAAGCAACGCCAGGA
ACGCTTGAGCACCCCCAAGGCTCAGCGTGCCAATGTGGCCAATATTGACTATCTACGACCCATCATCGCCGATGCCGAT
ACTggcCATGGCGGTTTAACTGCCgtcATGAAG > SEQ ID NO:2384 213048 213090_300846_1
catcCACGACAGCTTCGATAGCTTCGACaaaGACGAAAATCATCATGAAGCTTTCGCTGGGGATTGCCGCAGCATTTGT
GAGCTGCGCTGCAGCATCGCAGCCCGCCGCCGACGTTTACGTTCTGCCGAATCGCGAATCCGCATCGCCGCCGTCCATT
CCCAGCAGCGTTGCCCGACTCATCTTGCTGAAGCTGGCGGACTCCAGTTCCTTTTCCTTGGTCCGCGATATTCCTGACG
ACGTCGATGTAGAAGAGGTGGTCTCGTTGATGAATCGATATGGAGGCGTCACTACTCCATTGTTCGATGAGCTCGCTCA
TGAGCCTAAGCAGCTGTTCATTGCGCTTCAGGGCTTGACGGACGAGCAGATGAAAGAGACCAGAGCGAAATTACAGCGG
CAGCCCTCATTCACTATCCCCGATGTGCCTCATATCGACCGTCTGCAATGGGCAACGGGCACTGAACCGCCTCCATCCG
AGTTTGTAAAAGGAAAAGGGATCAGCTGCTCTTATGATGAGATGACCAACCCAGTCGAGTCCCGGTGCTGGAAGGGAAA
GAGCTTGCTGGCTAGTTTTGATATCCAAAAGAAGCCCGAATACTTGGACGACGTGATCGACAGCTTCCCACGGCTGACC
TCGCTTGCTGAGATTGGCGAAGTGCAAACGACTTTCCTCTTCTTCACTGgCGTTGGTAAATTGTCGAGCCAGACCAAAG
CACTTCACAAGCGCCAGGCGGAGCGGGTGATTTCCCACTTTCATAAGACT > SEQ ID NO:2385 213063 220266_300953_1
CGGAGCTGAGAAATATTAATGATACTATTAGGTCGCAGCGAAATCGATTGATCTATTCGTATTGGGGGTGCAGGGGGAA
TCCCAGGTGACGGCGTGGTCTGCCGCAACAGTTGGCGGTGTACCCATCGACAAATGTCTCTCAGCGGACAATGCCATCA
ATCGCGCCGAACTTTCCAGCGAGTGTAAGAATCGATCGCAAAGTATAGTTCGAGCCAAAGGAGCAACTCCTTTCGGTAT
TGGTTCCATCGTGTCCAGCATTTGCTCTGCCATTGTCTTTGACAAGCGGACCGTTCATCCTCTAAGCCACTTCCAGCCG
TCATTTGGATGCTGTTTCAGCTTACCCGTGGTGCTCGGCATAAAAGGAATTGAACGCACAGTAAAAGTGCCACTGGATA
GGGACGAGGATGTTCAAATAGCCGACTCAGCAATTGCACTCAAAATGATGATTGACCAAGTGAGTAAGAACTGGTGAGT
ATAGCGAATTGAGAAAAATAAGACAAGGAGGGGGGCTATTAGGGACCATAACTGTCTCGTAAATTAAGAGTTGTCTAGC
TAATACACTACGAATGTGTATGTAATGCAAAATTTGGATGTGTAAAT > SEQ ID NO:2386 213084 217877_300912_1
aggcatttggctagaggacaaaacaacatgagcccaacagtttaaAATCGATCATCGTCAGGTTGTTCAAAGCCAAGAT
TTAGAATAATCACCTATGCGTGTAATTAGTACGGTTCAGAGAAGATGCAACCAACTCCAAGTCAGGTACAAATTTCAAT
GATTCAAAGACTGGTATATATGGCCTTGTTTTGCAGAGCATCAAACTTTCTGCCGGGTCGGTACCTACATTAATGGGC > SEQ ID NO:2387 213112 207965_300830_1
GTGAGGTCAAGAACGGAGTACAGATCGGTACCTGCACCAACCGTTGGTACGACAAGCTTCAGATCATTGTCTGTAAGAA
CGGCAGTGCTGGAATCAACTTTGAGCATACGGGCGTGGACGGCCACACAGTGCTCCGGTTCGCAAGTGACGTCTATACC
GACACCATTCTTCGCTTCGCACGCACCATTAACGGACAGGCGCCGACCCTCTGGACCTCTACCAGCCCTGACCCGTCCA
AGCGAGAGATTGATAGTTTCGGAGACGTCAACACCACCCCTCGAAAGCTCGGGTGGGATATGATTCCCGAGCTAAGTAT
CGCGGTGCGGTTCGCCGAAACCAGGCTGGCAGATTTGATTGAACAAAACGAATTCCAATGCCTCGATTTCTCCACCTAT
GGCAAGCACTTTATTACATCGATGGGATTCTCGCCCGATGCCTTTGTCCAAATGGCATTCCAGGCGGCATATTACGGTC
TATATGGAAGGGTTGAGTGCACTTATGAGCCTGCCATGACCAAGACCTTCTTGCACGGCCGTACAGAGGCCATCAGACC
CGTAACAAAGGAATCTGTGGATTTTGTCC > SEQ ID NO:2388 213119 200451_300759_1
tcttcattaaccaactgcgtctctcctgagtgaatctcgttcgtgttcttcctatcatcgcgagATTGCTCTTTATCTG
CTCTCCCTCTCTCGCGACTTCTCTGCGTCTCCCTTGGGCTCTCCCTCTCGATCGCCCAGGAACACGACTCTCGACTTCA
ATCTCACTCTTGCGCTTCCGGCTCCGCAAAAAAACACCGCCAGGCCTCACCGCATCACGGCCCAGCCGCGACGAACGTT
CCTCATTCGATAGACTGTGAGCAGCTGCAGGCATTTTCGCATAAATCTGCACGCCTGGGACACCCCATAGGCCGACTC
TCGGGACCTTCTCCCTCGCAAAACCCTACGCAAACGCACGCACTCGCGCACAAGGCAGCTGATAATCCAAATCTACCTA
CGCATAATAATCTTCAACAACCTGCATCCAACGAAGCGAAACCCAAAAACAACATACATGAGTGTAACACCACCAAACG
TCCCTCGCATCGAAGACAAGCAAAGCAATACGATGCCCTCACAACGTCCCTTCTTCCTCTCCTCCTTCTTCAACTCTTT
CCGCCAGCAAGCGCCCTCCCTCACCCAGCAGGCGGCCAGCAAACACACCTCGCAAGCTGCTGCATCTGCATCTGCCGTC
GCCTCCACAACAGCCGCAGCAGCAGCAGCTTCTTCAACCGCCTCCACCGCCCGCGCAATCTCCACAAACGCTGCTA
CCACATCATCCACCAACGTCGCCATCCACACGCCTCGCGGATCTCCCGGCGGCGCCATCCCCATTCCTGGCGGGCGCAG
AAGAGGCAGCGATAGCAGTAGTGAAGGCTTTCGCGATGCCCTCGGCGCCGACAAGTGGTATATCGGCGGCAGGACGGCG
ACTGGAGAGGAGAAGTTCTTTAAGCTTGGCGTGATACGCCGAGTAAggAGTAATGATGgccTGAGTCTCGATCGCCTaA
GCTTATaggtGATGAccaCATCACTGAACGACTCGAGaaTGACTgGTT

FIG. 2 continued

> SEQ ID NO:2389 213120 213158_300847_1
GTTTGGCTTGCAGTAAGACCGGCTTATGAGAAAGACCATTGTGAGAGATGTAAGGCTGATCCGGAGCTCTACGTCATCT
GAGACATGACATTGGCATGATGAGGGTCCAGTAACTACCTGATGATTGGGGTAATCGAAAGAGATGCAGAGAGAAACAC
GCAACTCTGAGAAAGCGTCCCGTTACACACGGAACACACTGCCTCCGGACAGCGGCTTGTGGCTCATTGCTTGAGTCCC
TTAATCAGCAATCCCCAGGTTCTCTTGACAGCTCAGCGGTGCAGTTTTGCGGGCACAGCTGATCCACCCGTCAACGGGG
CGGGACGCCGGGAAGCCGGGACTCCGGGGCTAAAATGACATCGCCATGACATCCGCACCGTCCGACCAGAACTGCTACT
ACTCAAGACGGTAAGCAAGTGCTAGCAAAAGTGAGTTTTACGAGGTAAGCAAGTAGGAACGTGGCTTATAAAGCCACAG
CTAGCTTGAGGCGAAGGCTGCTAGTAGGAACTAAAGTCAGCTTATACTATTTATAAGCTCACTGCATGGGCTAGTAATA
ATAGCTC

> SEQ ID NO:2390 213122 220748_300938_1
GTCATGGAGAACGTCCTCTTCAAGGTCTCCTACCCTGCCGAGTTCCACTCCCAGACCGTGACCACTGCATCCAGTACAT
GGCCTNCCGTCATGCTCGTCTTCGGCCGCCTCGAGGCCACCGACTACGTCGACGGCTCTGAGGCTGCTACTTCGGAGCT
TGTCGAGTCTCTGCGCAAGAAGATCAAGTGCGTTGAGGACCCCCAGTACACTCAGGACTACCATGACCCTGCCCTGCGA
ACCATCTCCAACGCCCCTGACCGTTGAG

> SEQ ID NO:2391 213123 1120067_301861_1
gggTCGAGCTGATTTAACAAATTTTAACAAAATATTAACGCTTACAATTTCCTGATGCGGTATTTTCTCCTTACGCATC
TGTGCGGTATTTCACACCGCATCAGGTGGCACTTTTCGGGGAAATGTGCGCGGAACCCCTATTTGTTTATTTTTCTAAA
TACATTCAAATATGTATCCGCTCATGAGACAATAACCCTGATAAATGCTTCAATAATAGCACGTGAGGAGGGCCACCAT
GGCCAAGTTGACCAGTGCCGTTCCGGTGCTCACCGCGCGCGACGTCGCCGGAGCGGTCGAGTTCTGGACCGACCGGCTC
GGGTTCTCCCGGGACTTCGTGGAGGACGACTTCGCCGGTGTGGTCCGGGACGACGTGACCCTGTTCATCAGCGCGGTCC
AGGACCAGGTGGTGCCGGACAACACCCTGGCCTGGGTGTGGGTGCGCGGCCTGGACGAGCTGTACGCCGAGTGGTCGGA
GGTCGTGTCCACGAACTTCCGGGACGCCTCCGGGCCGGCCATGACCGAGATCGGCGAGCAGCCGTGGGGCGGGAGTTC
GCCCTGCGCGACCCGGCCGGCAACTGCGTGCACTTCGTGGCCGAGGAGCAGGACTGACACGT > SEQ ID NO:2392 213123 204067_300788_1
GCTGATTTAACAAATTTTAACAAAATATTAACGCTTACAATTTCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGGACTGACACGTGCg > SEQ ID NO:2393 213123 226621_300999_1
GCTGATTTAACAAATTTTAACAAAATATTAACGCTTACAATTTCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGGACTGACACGT > SEQ ID NO:2394 213123 211013_300895_1
taTTACTCGAGCTGATTTAACAAATTTTAACAAAATATTAACGCTTACAATTTCCTGATGCGGTATTTTCTCCTTACGC
ATCTGTGCGGTATTTCACACCGCATCAGGTGGCACTTTTCGGGGAAATGTGCGCGGAACCCCTATTTGTTTATTTTTCT
AAATACATTCAAATATGTATCCGCTCATGAGACAATAACCCTGATAAATGCTTCAATAATAGCACGTGAGGAGGGCCAC
CATGGCCAAGTTGACCAGTGCCGTTCCGGTGCTCACCGCGCGCGACGTCGCCGGAGCGGTCGAGTTCTGGACCGACCGG
CTCGGGTTCTCCCGGGACTTCGTGGAGGACGACTTCGCCGGTGTGGTCCGGGACGACGTGACCCTGTTCATCAGCGCGG
TCCAGGACCAGGTGGTGCCGGACAACACCCTGGCCTGGGTGTGGGTGCGCGGCCTGGACGAGCTGTACGCCGAGTGGTC
GGAGGTCGTGTCCACGAACTTCCGGGACGCCTCCGGGCCGGCCATGACCGAGATCGGCGAGCAGCCGTGGGGCGGGAG
TTCGCCCTGCGCGACCCGGCCGGCAACTGCGTGCACTTCGTGGCCGAGGAGCAGGACTGACACGTG

FIG. 2 continued

> SEQ ID NO:2395 213123 188112_300696_2
taTACTCGAGCTGATTTAACAAATTTTAACAAAATATTAACGCTTACAATTTCCTGATGCGGTATTTTCTCCTTACGCA
TCTGTGCGGTATTTCACACCGCATCAGGTGGCACTTTTCGGGGAAATGTGCGCGGAACCCCTATTTGTTTATTTTTCTA
AATACATTCAAATATGTATCCGCTCATGAGACAATAACCCTGATAAATGCTTCAATAATAGCACGTGAGGAGGGCCACC
ATGGCCAAGTTGACCAGTGCCGTTCCGGTGCTCACCGCGCGCGACGTCGCCGGAGCGGTCGAGTTCTGGACCGACCGGC
TCGGGTTCTCCCGGGACTTCGTGGAGGACGACTTCGCCGGTGTGGTCCGGGACGACGTGACCCTGTTCATCAGCGCGGT
CCAGGACCAGGTGGTGCCGGACAACACCCTGGCCTGGGTGTGGGTGCGCGGCCTGGACGAGCTGTACGCCGAGTGGTCG
GAGGTCGTGTCCACGAACTTCCGGGACGCCTCCGGGCCGGCCATGACCGAGATCGGCGAGCAGCCGTGGGGCGGGAGT
TCGCCCTGCGCGACCCGGCCGGCAACTGCGTGCACTTCGTGGCCGAGGAGCaGGACTGACACGTGcg

> SEQ ID NO:2396 213123 254923_301640_1
GCTGATTTAACAAATTTTAACAAAATATTAACGCTTACAATTTCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGGACTGACACGT

> SEQ ID NO:2397 213123·264884_301408_1
AGCTAGCTGATTAATTAAGTCGACGAGCTGATTTAACAAATTTTAACAAAATATTAACGCTTACAATTTCCTGATGCGG
TATTTTCTCCTTACGCATCTGTGCGGTATTTCACACCGCATCAGGTGGCACTTTTCGGGGAAATGTGCGCGGAACCCCT
ATTTGTTTATTTTTCTAAATACATTCAAATATGTATCCGCTCATGAGACAATAACCCTGATAAATGCTTCAATAATAGC
ACGTGAGGAGGGCCACCATGGCCAAGTTGACCAGTGCCGTTCCGGTGCTCACCGCGCGCGACGTCGCCGGAGCGGTCGA
GTTCTGGACCGACCGGCTCGGGTTCTCCCGGGACTTCGTGGAGGACGACTTCGCCGGTGTGGTCCGGGACGACGTGACC
CTG

> SEQ ID NO:2398 213123 258926_301701_1
GCTGATTTAACAAATTTTAACAAAATATTAACGCTTACAATTTCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGgACTGACAcGt

> SEQ ID NO:2399 213123 259641_301707_1
tcGAGCTGATTTAACAAATTTTAACAAAATATTAACGCTTACAATTTCCTGATGCGGTATTTTCTCCTTACGCATCTGT
GCGGTATTTCACACCGCATCAGGTGGCACTTTTCGGGGAAATGTGCGCGGAACCCCTATTTGTTTATTTTTCTAAATAC
ATTCAAATATGTATCCGCTCATGAGACAATAACCCTGATAAATGCTTCAATAATAGCACGTGAGGAGGGCCACCATGGC
CAAGTTGACCAGTGCCGTTCCGGTGCTCACCGCGCGCGACGTCGCCGGAGCGGTCGAGTTCTGGACCGACCGGCTCGGG
TTCTCCCGGGACTTCGTGGAGGACGACTTCGCCGGTGTGGTCCGGGACGACGTGACCCTGTTCATCAGCGCGGTCCAGG
ACCAGGTGGTGCCGGACAACACCCTGGCCTGGGTGTGGGTGCGCGGCCTGGACGAGCTGTACGCCGAGTGGTCGGAGGT
CGTGTCCACGAACTTCCGGGACGCCTCCGGGCCGGCCATGACCGAGATCGGCGAGCAGCCGTGGGGCGGGAGTTCGCC
CTGCGCGACCCGGCCGGCAACTGCGTGCACTTCGTGGCCGAGGAGCAGGACTGACACGTGCGGCCGCGTCGAGGGGTAG

> SEQ ID NO:2400 213124 212388_300848_1
AATTCTGGATCTGCTTGAGCCTTCTTTCTTCACTGTCCGCTCCCAATTGTCGCCTCGGTTCCACGGCTTCGGATTGGAA
CACGCGCCCACAGACAGAACGCTCCGTTTCCCATTGAGCGTCAACCTCTACTGAGCTTTCATCAATCAGTACGAGGCCA
TCTTCGACAATTTTCAGAAAAAGAAAAAAGCCTTTCGAGAACATCAATTCGGAAAGAAGAGCCACTTCTTCACC

> SEQ ID NO:2401 213126 179784_300563_1
gttctgtGTCTTCTCACCTTTTTGCGTCAGCTCGACTTTCGTTTTGCACCGGTCGACCTTTTACCCTCTCTTCTCTTCT
ACTCTAGAGACATCGACCAGTTCGCTCGTTGTCAACCCCTCCGCCTGACGGAATCCCCCACCGATAAACAGACAAACAA
ACAAAACAAATCCAAAAAAATCAGCCAGAAACAAGACACCATGGGTGCCGGTCGGTTTTTCTGCGTGGCTCTGCCGCTA
CTCCTCACAATTGCCTCCATCGGCACTCTGCTCTACGCAGTTCGCTGGCGTTGCCCACGAGAACGTCAAGCTCATCC
AGGTGGACCTCAGCAACCTGAGCATCAGCCCGCTGAGCTTAAAGACCCTCACCTCCCGAGCCGAATTCAATATGAAGGA

FIG. 2 continued

GACCCAGACGGATAACATCACCGCCGAAGCCCTCGGCCTCCACAAGTACTATGACCTCACGCTCTGGGGATCTTGCTCC
TCCGATGACAACAAGAAGTGGACTTGCACCAAGAGCCAGTTCGACTGGGCCAGCAAGCAGATCAATGCCGACGATATCA
AGGAGGGTAGCACCACTATCGAGTTGCCCAAGGATATCAAGGACGCCCTCAAGGTCTTCCAGAAACTCATCAAGTGGTC
TGAGGTTGCCTTTATCATCGCTCTTGTc

> SEQ ID NO:2402 213128 128866_300478_1
CCCGATCCCTAGCCACTTTACTCCTATTCGCCTCCACCACCTTTTCATTTCCTATCTCCTCCTCTTTTCTCTTCTGCTC
AGTTCCTCTCTTTCACATACACACTCACAAAAAAATTCGATTATGGCCGGAAGCGGTGTGGTAACACTTTACGGAAAT
GGTGCACTCACCGAGACTACAAAGCAATCCCCTTTCTCAGTGAAAGTGGGTCTCGCTCAGATGCTTCGCGGCGGCGTTA
TCATGGACGTCGTCAATCCCGAGCAGGCCCGTATAGCCGAGGAGGCAGGCGCGTGTGCCGTCATGGCCCTTGAGCGCGT
CCCCGCTGATATACGCGCTCAGGGCGGCGTAGCCCGCATGTCGGATCCCCAGCTTATCAAAGAAATCAAACAGGCTGTT
ACCATCCCCGTTATGGCCAAGGCCCGTATCGGTCACTTCGTCGAGGCCCAAATCCTCGAGGCTATCGGAATCGATTACG
TGGATGAATCAGAAGTCCTCACTCTCGCCGACGATGAGAACCACATCAACAAGCACAATTTCCGCATTCCTTTTGTCTG
TGGCTGCCGTAACCTCGGCGAAGCCCTCCGCCGTATCAGGGAGGGAGCCGCCATGATACGCACCAAGGGGGAAGCCGGT
ACCGGCAACATCATCG

> SEQ ID NO:2403 213128 213127_300847_1
cTCAGATAAACCACTCAATCGATTCCTTGATACCCCTTGGGACAACTCTACTTGTTCTCTCCAAACTTACCCCTCCAAA
TACCATCATCACCATCACCAT

> SEQ ID NO:2404 213137 220540_300956_1
aacttacaAATTACAACCTACAACTGCCCACAATGTCGCTTTCTGTTGGTGCTTCTCTGCGGCCTGCGGCCTTCCGCTG
CGTTGGTGCGTCTGCCGTGCGCATGCGATGTGCTTTTGGCACAACTGCGTCCAGAAGGAGTGAGAGCTCGACGCCGGGC
GAGCTTGGGGTTGGAGAGCTGCagggcgcATCGTTTCGCATTGAGCCTCTCCGGAGGGTTGGGGAGGATGCTTCGACTA
TGCGAGCGAGACTTTTATACCAATCTCGGAAGCGCGGAACCCTCGAGTCGGATCTTTTACTGTCTACGTTTGCCTCACA
GAACCTGCCCACCATGACGGCCGAAGAACTGCGGCAGTACGACCTCTTCCTCGACGAGAACGACTGGGACATATACTAC
TGGGCGACGCAGCGGGAGCCGAATTCCACGACGAACCCTTCCGTGACGGCGAGTCCGGCGAGTGCTTCGGCGAGCGAAG
GGTTCGAGGCGAGACAGCAGGATGAGTTGCCCAAGAATCCGCCAAAGGGGAGTGGGCGCAGACGGTGGGCAATTTTAA
GCCTGCGTATAGGCCGGTGCCGcagagGTGGAAGGATAGCGAGATTTTGgAGAAGTgagggcGcatgtgagGAGGAAG
AGTGTGAA > SEQ ID NO:2405 213144 211502_300900_1
agatcacTCCACCACGAAGCACTTTTCAAACCGAAGACCTACACGCATCTTCATTTTCAACCGCCAAAATGGGTATGAT
CGACGCCAAGAACAGGGTGACGGAGCACCAGCGCTTTTACCAGGCTGCGTACAAGGCTCACACCCGCCTGTGGAAGATT
AACCCCCGAAGCAACTGGTACATGGCCCCCTACCTCGTCGCCCTCTGGGGAGGTTTCGGAGCTACCCTTTACGCTGCCA
GCCGAAAGGTTGCCGGCCACAACACCTGGTTCAGCAAGGATTAAAGTATCGGTATCTATGGGACGAGCCAATTGAGTTA
CCCCAACTTGCGTCAAATGCAAGATTGAGGGTATGTATGAGTTTAAAGTCTTATAGACAGTAAATATAGGATTTGTCAG
TCCGTCTCATACGTCTCGCTGCT > SEQ ID NO:2406 213149 205769_300801_1
actctcaACCACTGACCTTTTCCTCCGGCTCAGCAGACTGACAATAACCAGCAGCCCGCAATATCCGCTGGGGGCCTCG
TCTCGTTTCTTACCGCGACCAAAGCCCACTGAAAATAATCCCGCTCTACCGCTACCGGGCCATCAGCGCAGGCGGATCT
CCAGTCCCCCAGCAGTGCAGCCCGCTCGGAGGTTTTCTGTTGGCGCAAACCGGGCCTGGTGTCGTCATCGAGCCAACTC
CAGATCCACTTGGCAACATTGCCGATAAAGCGACTCTCGCCTCTGCGTGAGCGTTTCTTGTTTGATCTCCCTTTTCTGGC
ATCATGACCTGGGAACTCAACCGCCGACGGTTTGTCCGTGCGTCAATAGCAAATTCATCTATGGACGTTTGCCTCTAC
TCCACACCATCATCCTCCTCATCGAAATGGCCCTCGTTGCTCGGCTGACGGCGCGATTCAATTCGTACTACAATGAACG
ACCACTATTGACCATGATGGTCACCAATTCGATCCTTGGTGGCATCGCCGATACCGTCGCGCAAACCATCACCTCGGTG
CGTGAGCGAGCGCTTAGAAAGCCGGGCGGAGTCACc > SEQ ID NO:2407 213169 218544_300919_1
GTGCAGCTGATAAATTCCATCGATTGGTTTCTTTGGGAGCATTAATCGACCTTTCTCATTCTTCATACCATCGGCGTCG
TTGGCATTTATACGGCATCTCGTCTTGTTTCCTTCGTACTCGAGGTACGGTACCCTGACCGCGTCGTCATACGAATTTG
CAGCATCGGCGAATTGACAGTATAAGGCAGACATCATGGCTGGGTGGCAGTCCTGGAACCCCTTCAGTAAGAGGGAGAC
GCACAGCAATGGCTCCATCGTCGCATACAAGATTTTAACCTTGCTCTCATGGCTTTTGTCCGTCGTCGTCACTGTCTAC
TATGCCGTTGACGAGCCTCACGATGGCTTCCACATCCGCCGGCGCATATGGGATCAGAACTATCTGTATCCCAGCGCCT
TTACCATGAACCACATCCTCGCTGATATCTACTGGATTGTTCTCTTCATCCTCCAGTTTGGATACGTCACATCGCTCTT
CTCCAGCAGTGCCGACGTCGTTGCCGCAGCTGCTGGTGTCGGCAGCCACTTCATCCTCAACAACTTGCTTCACTCTGCA
TTCGTCATGCTCTTTGTGAACTCGCACTTCCACATCGCCGAGGTCATACTGATTCTCAACTTCTTCAACCTCAGCTCAC
TGtatttccgccacAACACGGtc

FIG. 2 continued

> SEQ ID NO:2408 213169 220485_300955_1
AGCTGATAAATTCCATCGATTGGTTTCTTTGGGAGCATTAATCGACCTTTCTCATTCTTCATACCATCGGCGTCGTTGG
CATTTATACGGCATCTCGTCTTGTTTCCTTCGTACTCGAGGTACGGTACCCTGACCGCGTCGTCATACGAATTTGCAGC
ATCGGCGAATTGACAGTATAAGGCAGACATCATGGCTGGGTGGCAGTCCTGTAAGAGACAACGATCCCAACAATTCCCA
TTCTTCACAGCTTGCTAAAATCCGCATCACAGGGAACCCCTTCAGTAAGAGGGAGACGCACAGCAATGGCTCCATCGTC
GCATACAAGATTTTAACCTTGCTCTCATGGCTTTTGTCCGTCGTCGTCACTGTCTACTATGCCGTTGACGAGCCTCACG
ATGGCTTCCACATCCGCCGGCGCATATGGGATCAGAACTATCTGTATCCCAGCGCCTTTACCATGAACCACATCCTCGC
TGATATCTACTGGTAAATTCGCCATGACTCCATCAATTCTCGCTCAAGCTTTCTGACACTTGAAAACCAGGAttgttct
cTTCATCCTCCAGTTTGGATACGTCACATCgctCTTCTCcAgcagtg > SEQ ID NO:2409 213171 1099184_301488_1
AAATCAGTCAAGCTTTGGAATGGCTACACAGGAGAATTTGTCACAACTTTTCGTGGCCATGTTGGTCCAGTGTATCAAA
TAAGCTGGTCAGCAGATAATAGACTCTTGCTTAGCGGGAGCAAAGATTCGACACTTAAGATGTGGGATATGCGAACGCG
GAAGCTTCGAGAGGATTTACCTGGGCATGCTGATGAGGTATTTGCTGTCGACTGGAGTCCAGATGGAGAAAAGGTAGCG
TCCGGGGGAAAGGATCGTATGCTGAAATTATGGATGAATTAAAAGAAAAATATTTTCACAGTGAACAGGCTATGCATTA
GCAGGCTTTATTCATGTTTGCTATGAGGTAAATCCTCCTCATCAGTGGTTATAGTTATTCCACATATGTTCTTCCTTCT
AATTTCATATTAGTACATTGACAAATAGATTGAAAAAACAGTTAGCAAATTGATTAATTAAATCTCATCGATTAATCTA
GATTCTAAATATGAAAGGTGCATCTAGAAGCCTTGCATTGTGTTTCTATCACTTGTTTTTGGTCTGATTTCTACATGAA
ATCATGAATACTTGTTT > SEQ ID NO:2410 213171 217003_300904_1
aaacaatccatggtgttgcttcgcttttcgaacctgatctcgtgcttacacaggacGACTTTACCATGTACCTCTGGGA
TCCTTCACAAGGCACAAAGCCGGTTGCACGGCTTCTGGGACACCAAAAGGCCATTAACCACGTGACATTTTCCCCTGAT
GGCAGTCTCATCGCGAGTGCCGGATGGGACAATCATACCAAAATCTGGAGCGCAAGGGATGGCAAATTCATCAACACAC
TCCGTGGCCATGTCGCGCCCATATACCAGTGTGCCTTTTCTGCCGATAGTCGGCTCCTTGTGACGGCATCCAAAGATAC
CACATTGAAAGTGTGGTCGATGGCTACGTGTAAGCTGGCCGTTGATCTACCGGGACACCAAGATGAAGTTTTTGCCGTT
GATTGGAGTCCTGATGGACAACGAGTAGGCAGCGGAGGAAAAGACAAGGCCGTACGCCTTTGGATGAACTGATGACGAT
GATGGGAGCGAATCAAAAAAGGATAAATCATGTGTGTTATCGGCGTCCAGTCAGGGATTGATTACGTGTATGTTCTAGG
TCTAGACTCTGTagaGCTGTTTGTGCAGCATCCGCTAATGATAGAGAGCAAATGTgGCATtTgccCaagggCAcggctG
ATGc > SEQ ID NO:2411 213171 220902_300940_1
gccaTGTACCTCTGGGATCCTTCACAAGGCACAAAGCCGGTTGCACGGCTTCTGGGACACCAAAAGGCCATTAACCACG
TGACATTTTCCCCTGATGGCAGTCTCATCGCGAGTgccgGATGGGACAATCATACCAAAAtctggagCGCAaGGGATGG
CAAATTCATCAACACACTCCGTGGCCATGTCGCGCCCATATACCAGTGTGCCTTTTCTGCCGATAGTCGGCTCCTTGTG
ACGGCaTCCAAAGATACCACATTGAAAGTGTGGTCGATGGCTACGTGTAAGCTGGCCGTTGATCTACCGGGACACCAAG
ATGAAGTTTTTGCCGTATGTTTGCCCCCCTTGCCCTTCCAATTTTGTTAACCCCCGAGCCTCGTGGCTGACAGCGTGCTAG
GTTGATTGGAGTCCTGATGGACAACGAGTAGGCAGCGGAGGAAAAGACAAGCCCGTACGCCTTTGGATGAACTGATGAC
GATGATGGGAGCGAATCAAAAAAGGATAAATCATGTGTGTTATCGGCGTCCAGTCAGGGATTGATTACGTGTATGTTCT
AGGTCTAGACTCTGTAGAGCTGTTTGTGCAGCATCCGCTAATGATAGAGAGCAAATGTGGCATTTGCCCAAGGGCACGG
CTGAtgcaatttacatgaagcacttgtgaacaaggctcaatggac > SEQ ID NO:2412 213177 214538_300859_1
AATCTGTTGAGACACCCGGTTTGCCTTTGACTGCACCAGCTGCCACGCGCGACAAGGCTCAAGGCACAAGGCACAAAGC
CTCTCCTCCTCCTTTGTATCGCATAAACCGCCATGGCTGACTCCGGCGATAACTACCGACCGCGTGAGAGGTCTCGATC
ACCTCGGCGACGATCTAGGAGTCCAGGCCGACAGTCTCGTCGGAGGTCTTATTCGCCTCGCAGCAGATCAAATAGTCGG
GACGACTATCGACGGGGCCGCGATCGCTCCCCAATGACTGGAACAGGAGCTGCACCAGCCGGTGGTCCCACTGGCAATT
ATGCGGGACAGCAATCCCATCGATCATACGAAGAACGGGCCGCAGCCCGAGAGCAGATGATGAGCAACATTCGAGAGAC
GTCCCAGCAGGACCGCCGCGTCTATGTCGGCAACCTCTCATACGACGTCAAGTGGCATCATCTCAAGGATTTTATGAGA
CAGGCTGGAGAGGTACTCTTCGCCGATGTACTATTGCTTCCAAATGGAATGTCGAAGGGATGCGGAATCGTGGAATATG
CTACAAGGGA > SEQ ID NO:2413 213179 209162_300812_1
tggagtcccggtgctcgacgtagtatttgccttttttcgagcgctccatccttcgttgtcattgccggctcttataaac
aAGGCTTCAGGCTCTTCCATAACCAAAAACTAACACGCGAAAGCGgctGTTGATCTCCCAGCCTTATTCCGCGCATTCC
TCTGCCACCAATACCATGGACCGCCAGACCATCATGGAGACCAACCGGTCTCTTCGAACCATTAAGAATGAGCTCGAAA
GCCTCCTCGAGAAAGGCGTCATCGACGAAGCCGCTTTCGACACTATTCATGCCGCCCTGCCCGCCGAAACTCCTCTTCG
TGGAGCCGCTCCCGGAAGCGCTGCTCGTTCTGCAAACCAAACACCTCTTCAGCCTGTGGCGGCTGCAACTCCTCCGGTC
CAGGCCCCTGTCCAGGCCTTTCAGAACCTCAACGTCAACGGAACCTCTCCCGCCCCTCCTTCATACGATGATACTCCCG

FIG. 2 continued

```
CTCCTGGCGTCCCACGCGCTCTCCGGCTCCGGCTGGGAAGCCCGTTTTGGCCCATGCGAGAGCCTTGTACCGCTACGAT
GCCAGCGATGCCCGCGACCTGAGCCTGGAAAAGGACGATAAGATCGATGTCTACGAATACATGAACCAGGactggtgga
ntgggcgtAAccaccgcACTGGCATGGAGGGCATCTTCCCCCAAAACTACGTTtttgtcgAGCAGGagcaaaAggCTcc
TAtgCcagctCCcgTGGCctaaccccAGCAgccggcatatggctacccgcagggGACctccggcgCAGCAgaacccTTA
CAATGCCAGTgtgccacctATGGCGATagcagaGGg > SEQ ID NO:2414 213206 12787_300275_1
cccacgcgtccgagaagaaacagatctgaagatggagtgtgtatttggtctagtTGGGAATGGATTCGCTATCGTGGCG
GCGGATACATCAGCAGTTCACAGTATTCTTCTTCACAAGAACAAAGAGGACAAGATCATGACTCTTGACTCTCACAAGC
TCGTCGCCGCTAGTGGTGAGCCTGGTGACCGGGTTCAGTTTACGGAGTATGTTCAGAAGAATGTGTCACTGTATCAGTT
TCGTAATGGGATTCCTTTGAGTACTGCTGCTGCTGCTAACTTCACTCgtGGAGAACTTGCCACTGCTTTGaGAAAGaAT
CCATATTCGgTgAACATCCTGAtGgctggctaTGaCaAagaagccggctcATCTctACTACATTGACTACAttgcaAcc
ctccacaaggttgATaagggAGCAtTtggatac > SEQ ID NO:2415 213206 145794_301061_1
aactctgcttaacgctgcttgttctccaagacagacgccttcaaagctcttatTCGAAACCAAACCTCAGATTTGTGTG
TGAGAAATCCTCAGAACTTTTTCCTAGAAGAAGATGGAGTGCGTGTTCGGGATGGTGGGCAATGGATTTGCACTGGTGG
TGGCGGATTCATCCGCGGTGCATAGTATACTGGTTCACAAATCCAACGAAGATAAAATCATGATCCTCGATTCGCACAA
GCTCATGGGAGCGAGCGGTGAAGCCGGCGACAGCTCAGTTCACGGAGTATGTACAGAAAAATGTGGCGTTGTACCAG
TTCCGTAATGGTATTCCGTTGACTACGCGCTGCTGCCGCGAATTTTACAAGAGGCGAGCTTGCTACGGCCTTACGAAAGA
ATCCTTACATGGTGAACATTATCCTGGCTGGCTATGACAAAGAGACAGGCCCTTCTCTTTATTACGTTGATTATATCGC
TACTCTTCACAAAGTGGACAAGGCAGCATTTGGTTATGGTTCCTATTTCTCTCTCGCCATGATGGATAGGCACTAtCGG
AAGGACATGACAGTTGAAGAAGCTGTTGATTTAGCTGATaaGTGCatCTtgGAGATcCGATCt > SEQ ID NO:2416 213206 220931_300940_1
GATACATCATACCCAACACACAACACAGTCATCATGGAGGTTCTTCTGGGAATTACAGGCAAGGACTTTACTCTCATCG
GCGCCTCCAAAGCTGCCATGAGGGGAGCCACCATCCTCAAGGCATCCGACGACAAGACAAGAGCGTTGAACAAGCACAC
TCTGCTGGCTTTCTCTGGAGAAGCTGGCGATACAGTACAATTCGCCGAATACATCCAACGAAATGCCCAACTCTACTCC
ATGCGCAACG > SEQ ID NO:2417 213208 215162_300878_1
TCTTGTTCATCTTGCTACCGCTCACAAATCACCAGCCAAGCGGAGACTTAACAAGGGCTTATGTACATGTAGGATTGGG
CCGTGTCCGGGAATTACCTGTTAGGTACTAAGGCATGTAAGAGATGATGCAATCACAAAGCAAACCCTTTTGATGGTA
TCAAAGTAAGGCATCAACATCAATTAATGTCTCCGAAACTACATGCAATCCGTAGCTCCAAGCCCCTCTCATTCTTCAA
CTTATCATCATCTTTACTCCTTTTATACAAACCGGAGCCCACAAGCCTTGCCGATTCTAACTAAACTAAACCCTCACTC
CCCGCTTCCAAACTACCGGCGACTTTACAACCAACAAATCTTCACCATGAGTGCCTCACAGCAACACGACGAGGAGTCC
AAAGCCCTCGCCTCAATCATCCCAACCTTCACTCCTTCCGAATCTTCCGAATCCACTGCCGTCAAATCAATCATCAGCT
CCCTCTCCCTCATCGAGCACGTCGAAGGAGGCTATTTCGCAGTCACAGACGTCAGCAACATCAAGATCCCTTCCCCGTA
CCCAGCCACGCCCCTCTCACAGCGCACCATCGACC > SEQ ID NO:2418 213226 111561_300039_1
TGTTAGGGTTTGTTAATCTGGTCAGCAATTCAGAATTCCTGTTTCCTCAAAGATGAAGATGATCGTGCTAAGGAGTTCC
GACGGCGAGACTTTCGAGGTAGAAGAGTCAGTTGCCCTAGAGTCGCAGACAATCAAGCATATGATCGAAGACGACTGCG
CCGACACCAGCATCCCTTTACCTAACGTGACGAGCAAGATCTTAGCTAAGGTGATTGAGTACTGCAAGCGCCACGTAGA
CGCCGCCTCTAAGACTGAAGATAAGGCCGTCGAGGACGATCTCAAGGCTTTCGATGCTGATTTTGTCAAAGTTGACCAG
AGTACCCTCTTCGATCTCATCCTGGCTGCCAACTATTTGAACATAAAGAGATTGCTTGATCTGACATGCCAGACAGTTG
CAGACATGATCAAAGGGAAGACCCCGGAGGAGATCGTAAGACATTTAACATTAAAAATGACTTCACTCCTGAGGAAGA
GGAAGAAGTCAGGAGGGAGAACGCCTGGGCCTTCGAGTGAATTTGAGTCTGTTAAGCGTCAATATTGTGCTGATAGATT
TGCAATATCTTAGTAGATGTTATAAACAATCTTGTATATTAGTAAATAT > SEQ ID NO:2419 213226 195888_300638_1
acCTCAGCTGCAAGCTTACCGCCCCCTGTGCAAGCCTTTCGCATCGATCTCTAATATCGTTCCGTCTCGCCGACGAAGC
TTCTACTCAACCAAAGCATCATCGTCCCATCATCACAATGGCGGAAGCAAAGCCTGCGTCCCAGAAGATCTGGTTGGTC
TCCAACGACAACGCGACCATGGAAGTCGACCGTGCCGTGGTTGAGCGATCCATGCTCTTGAAGAACATGTTGGAGGATC
TGGGCGGTGCCGACGTCAGCCCTGAGAACCCGATTCCCATCCCCAACGTCAACGAAGCAGTGCTGCGAAAGGTGGTCGA
GTGGTGCGAGCACCACCGCAACGACCCCGTCGCCGCTCCCGATGACGAGTCGGATGCCCGCAAGAAGACCACTGATATC
GAGGAGTGGGACCAGAAGTTTATGCAGGTCGCCAAGAAATGCTTTTCGAGATCATCTTGGCCTCAAACTTCCTCGACA
TTAAGCCGCTCTTGGATGTGGGCTGTAAGACTGTGGCCAACATGATCAAGGGCAAGTCCCCCGAAGAGATCCgcAAGAC
ATTCAACATCACAAACGATTTCTCAGCCGAGGaggaggagCA
```

> SEQ ID NO:2420 213226 145395_301059_1
attatcTCTCTCTCTCTCTCTCTCAATATATCTCAAAAAATCTCAATTCTAGGGTTAGTGTTGCTACGATGTCGTCC
TCTAAGATGATCGTATTGAAGAGCTCGAACGGCGAGACTTTCGAGGTGGAGGAAGCGGTGGCTTTGGAATCTCAGACGA
TAAAGCATATGATTGAAGATGATTGCGCCGACACCAGCATCCCCCTTCCTAATGTGACCAGCAAGATCTTGGCTAAGGT
TATCGAGTATTGCAAGCGCCATGTTGATGCTACCAAAACTGAGGATAAGGCTTCTGAGGATGAGCTTAAGGCCTTTGAT
TCTGATTTTGTTAAAGTTGACCAGGCCACCCTCTTTGATCTCATCTTGGCTGCCAACTACTTGAACATCAAGAGCCTGC
TTGATCTCACATGTCAAACTGTGGCTGACATGATTAAAGGGAAGACACCAGAGGAGATCCGGAAGACCTTTAACATCAA
GAATGACTTCACTCCAGAGGAAGAAGAGGAGGTTAGGAGGGAGAATGCTTGGGCATTTGAGTGAGCTTTAAATCTCATA
ATCTGGGGATAAATTTGGAATATATCTTACTAGATCGTATGAAAAATCTTTTGTGTTAGTAAATATGTGAGTACGgtaT
TTGCTTTGGATCCCTGACTtTgttATTCAATGAagtggCTTGAACCTCCTTTTGCTAtTATGAACTCT > SEQ ID NO:2421 213237 221296_300969_1
gcgttttgcattggccaatatagcctggaactttatttTgggGcaaaagcaagaagcctggaacaagcttgttgtgttt
gTTAGCGACCAAAAAAAAGGTACCTGCGACtAcAACTGAGGGTCCCCCAGTGGCTGAACGAcgacTTACACCCGTTGGC
AGCAGAGCTTTTGTCTTTTCACCACAACAATTTTGACATTCGTCTATACAAAACTTGCACGGTTTCTTTCACCTGGCAG
GTAGCATCTCGACATTCACCATGTCCAAACTCCAGATTTGGGCCTCGTGGCCCGAAGCCCACCTCTTCAACTTCCCTCC
TGCCAACCCTCCGGCCCCAATCCCACCGGCACATGTCCCTGCCACTATTCTGAGGCCCTTCAACATCCCAGATGATCTC
TATGTGTCTGCTCTGGATGCTCGAGTTCCGTTGACGATTGCTGCTCTTTATGCCATCTCGGCCAAGCTGCTCAACAAGT
ACAACAAGGCGCGCAACAAGAAGCCCTGGGGCATCAGCAAAACACGCCCCTTCTTCGTCTTTGTCGTCCTGCACAACAT
CTTCCTCGCCGTCTACTCTGCCTGGACCTTCTGGGGCATGGTCGGCGTCATGCAGAGGAGTTTCGTCAGCCCCTTTGGC
CCTGGCGGCGTCGCAGCTACTGCGGATGGCTTCTGCCGCCCCACGGACCTCGTGGCCTGGGCAACTCCATCTACTTCA
ACGAGACCACTTTGAGCTGGGACAGTGCTTCACCGAGCTCCGTTGCGCATCTGCTTGCTTccAATGGCATGCcTAG > SEQ ID NO:2422 213242 200469_300759_1
gcttttcTCCTGGGATTTTCGAGTGCAAACATCTGCCCTTGTTTGCGTCTTTCCGCCTGCGCAAACCAGAACACCGCAC
TTCCTCCCGAGACAGAAACGAGTGTTGGTTGCCCCAGACTGTCTTTGATTCTGAGACATTTGGCCTCCCTTGCAGGTAA
CTGACGGTGAGAATAAAAGCCGACGGGCCGCCGCTGCAGCAAACGAAACCAGCGACATACAAAAAGAAACACAAACAA
GCAAATCAATTCCCGAGCAAGAAAAAAAGAAGAAGCCCATCATGAAGATGCTTTCGTTTGCCGCCCTCTCGGTGCTCGT
GTTGGGCGCTTCGGCCCTGGCTGCGCCGCCGGCCCACCCCCCGGCCGACAATGGGTGCTGCTGCTGCGACATCAACAAG
AAGAGAATCGACTGCGACAGGTCGATCCCGGCGTCGGAGTGCATCTGCCCCAGGTCATCTGCCCCGCCGGCGCGCCCA
CGTTCACGCACGGCACGCCGCCGAAAGCCACCCCACCGCCCACGCCGCTGCCGACTTACAAGCAGTGCTGCTGCTGCAA
TCCCAACATTAACAAGATTGTGTGCTCGCTGAGGCTCGTGGAGGACTGTATCTGCTTGGCCGTGATGTGTCCGACGGAT
GCAAAGACCATCTTTGTCAGGCCAACTGGCGTTCCGACTGTCGCTTAAGAGTATTCGTTGGCGAGCCGACTTGCCTGAA
TCCTGGACCGGGGACATGACATGGGGGAGGGAAAATACAGGCAAGGCATTGCTGATGGTGAATGCACAACACGCGTG
GCAGACTGGCCGAAAATTGATGATTTACTGATGGGCGACTTTGGACTTGAAATGGGGCATGCCGGATGGGTTACTTGAC
AGTATTTACACCATTTCTATTCAACAATAAATGGAATTCTCTaGataaaAAAAa > SEQ ID NO:2423 213243 211825_300871_1
gatcctcaatgggcagatctgtgtgagagttgggGtatataaagacatctgtctctgccccggatcctgacttttctc
cAGCATCACCCCAGCAAGCATTCGCCTCTCGTTCAGATCTCAAGACAAAAAGCACTCAAACCAATCACTCAACCTCTTC
AAGACCACCTTTCAAAACAAACCTTCAACATGAAGTTCACCGCCGTTGCCTTTGCCGCCCTCGCTACTCTGGCTACAGC
CAGCCCTCACCCTCCTCCTCACGGTTGCAAGCCTGCTACCTACTCTTGCCTTCCCAACGACAGCGGTTGGCAAGTG
TGCAGCACTGCCGGTCAGTGGGTGTTTGCTGGCACCTGCCCTCCCAAGACTGTCTGCAAGTTCGACAGCCAAAATGGCA
GCCCCTACTGCGTTCCCCCCAACTTCACCATCCCATAAATCCATTAAATGGGGATCAACGGGGCTACTTACAAAAGCCT
ACCGGATGAGCATGAGATTTAGAGTTTTTGGTTGCTAAGACGTTTCGTGG > SEQ ID NO:2424 213246 211406_300899_1
aCCACGCGtcGCCATCTCGAAAACCCCCCTTCTGAGCATTTTGTGCTGAGGAGGTGTAATTACTATTGATAATTATTTG
ATTGGAGTCTTCATTTTTTTTTTTGGAATAACGAGATACGAAGTGACTGCGCTCTCCCCCTTTATCTACCTATCCAT
CTTTGATATCCGAGTAAAATCTACACACACACACACAACAACACAAAACCATGTCCAGCAACCCGCCCATCCACTCCG
GCGCCGACGCGGCCCAAACCGCCTCAACCTGCGCAAGTCTCAACATCACCACCGCCGAGTTCGCCGAGCTGCAGCGCCG
CGCCACGGCGGCAAAGGCCACCGCGTACTGCCGCTACAGCCGGTTCCGCGTGGGCGCGACGCTGCTCTGCCGCGACGAC
GCCGGCGAGACGGTTTATGTGGCCGGGGCCAACGTGGAGAACGCGTCGTATCCCGTCGGGACGTGCGCCGAGAGGGTGG
CCTTTGGGACGGCGGTGACGAGCGGGATTAGGAACTTTCGGGCGATTGCTGTGGCGACGGATATTAGTCCGCCGGCGAG
CCCTTGCGGGATGTGCAGGCAGTTCATCCGCGAGTTTTGCTCCCTGCAGACTCCCGTCATCATGTTTGACAAAAACTCC
GACTACGTTGTCATGACAATCGAACAACTCCTCCCCATGTCGTTCGGCCCCGAGGCTCTCCCGCCTCCTGGcgcctcgg
GATATTgA

FIG. 2 continued

> SEQ ID NO:2425 213257 139353_300409_1
tctagatcgcgagcGCCCCAATCCCACCACCGATCGATCCATTCCTGCTGCTCGCGGCCACCGGAGAAGGAGAGAGAGA
GAGCTCGACCTCGTCGGCGGGTGAAGGATCGCAGCAGCAGCAGCGGCGGTAGAGCAGGAGGAGAGGCGAAGATGTCGTC
GGTGTTCAGCGGCGATGAGACCGCCCCCTTCTTCGGCTTCCTCGGCGCCGCCTCCGCCCTCGTCTTCTCATGCATGGGG
GCGGCGTACGGGACGGCGAAGAGCGGCGTCGGGGTGGCGTCGATGGGGGTGATGCGCCCGGAGCTCGTGATGAAGTCCA
TCGTGCCCGTGGTCATGGCTGGTGTGCTGGGTATCTACGGCCTCATCATCGCAGTCATCATCAGCACGGGGATCAACCC
CAAGGCCAAGCCCTACTACCTCTTCGACGGCTACGCGCACCTCTCATCTGGCCTCGCCTGTGGTCTCGCCGGTCTCGCT
GCCGGAATGGCCATTGGCATCGTTGGTGACGCCGGAGTCAGGGCGAACGCCCAGCAACCAAAGCTGTTCGTGGGTATGA
TCCTCATCCTCATTTTTGCCGAAGCGCTTGCTCTCTATGGGCTCATCGTCGGCATCATTCTGTCATCCCGCGCTGGCCA
ATCTCGTGCGGATTAGGCATGTTTCAACACGCAAACCCTTAGTGGGTTCTTGTTTCATATTCCTGAAACTACAAGCTGA
GCTCTAGGGGTTTATTCTGTCTTAGTTTCTGttCTTCTGttGGGTCATGAACAAAAAAACATCTGTATCcaaGGGATGT
ttgccCTTgtggtgccatTCTTTTTCGCTATGGTGGTGCTGGCGGCGGTCTgAATCtTATTTATGCACAGTTTTTTTGg
gTCT > SEQ ID NO:2426 213257 175949_300523_1
ctgaatcCCCAAATCGAAGCACTCCTCTCCTCTCCTCTCCTCAGATCGGATCGCGAGAGCCCCAATCCCACCACCGATC
GATCCATTCCTGCTGCTCGCGGCCACCGGAGAAGGAGAGAGAGAGAGCTCGACCTCGTCGGCGGGTGAAGGATCGCA
GCAGCAGCAGCGGCGGTAGAGCAGGAGGAGAGGCGAAGATGTCGTCGGTGTTCAGCGGCGATGAGACCGCCCCCTTCTT
CGGCTTCCTCGGCGCCGCCTCCGCCCTCGTCTTCTCATGCATGGGGCGGCGTACGGGACGGCGAAGAGCGGCGTCGGG
GTGGCGTCGATGGGGGTGATGCGCCCGGAGCTCGTGATGAAGTCCATCGTGCCCGTGGTCATGGCTGGTGTGCTGGGTA
TCTACGGCCTCATCATCGCAGTCATCATCAGCACGGGGATCAACCCCAAGGCCAAGCCCTACTACCTCTTCGACGGCTA
CGCCCACCTCTCATCTGGCCTCGCCTGTGGTCTCGCCGGTCTCGCTGCCGGAATGGCCATTGGCATCGTTGGTGACGCC
GGAGTCAGGGCGAACGCCCAGCAACCAAAGCTGTTCGTGGGTATGATCCTCATCCTCATTTTTGCCGAAGCGCTTGCTC
TCTATGGGCTCATCGTCGGCATCATCCTGTCATCCCGCGCTGGCCAATCTCGTGCGGATGCGGCCGCTTATCCGTATGA
TGTTCCGGATTATGCCGAGCTCTACAAACAGCTGTTGAATTTTGATTTGCTGAAGTTGGCGGGTGACGTGGAATCTAAC
CCTGGTCCTAGGTCT > SEQ ID NO:2427 213257 213269_300851_1
ACATATTAAAGCCCCAGCAGGCCAAGTCATCGACAGCGTCCCTCGCGCATCTGCCAGACTTCGGAAGCTTCGCACGAGC
ACCAGAAACCACTCCTCCCTACGCCTCTTTAAAATCTTTATCGCTTCGATAACCCATCGTCGTCACAATGGCCACCGAA
CTTTGCCCGTCTACGCGCCCTTCTTTGGTGCCATGGGCTGCACCTGCGCCATCGTCTTCACCTGCCTGGGTGCCTCAT
ACGGTACTGCCAAGTCTGGTGTTGGTATTGCCGCCATGGGTGTCCTCCGCCCTGACCTTATCGTCAAGAACATTGTCCC
CGTTATTATGGCTGGTATCATTGGTaTTTACGGCCTCGTCGTTTCCGTCCTGATCTCCGATGGTCTCAAGCAGGACCTC
CCTCTCTACACTGGCTTCATTCAGTTTGGTGCTGGTCTCTCTGTCGGTCTCGCTGGTCTCGCTGCTGGTTTTGCCATCG
GTATTGTTGGTGATGCTGGTGTCCGAGGAACTGCCCAACAGCCCCGTCTCTTCGTCGGAATGATTCTGAttcttATTtt
tgCTGAAgtcttgggtctTTACGGtctcatTgttgctcTgttgaTGAAc > SEQ ID NO:2428 213257 158173_200001_1
GGAACTTTTAGATCCGATCATTACACTTCTTCTCTCTCCAAAAACAACTTCGCAGAAACAATGGCGTCGACTTTCAGCG
GCGATGAAACAGCTCCCTTCTTCGGCTTCCTCGGCGCTGCCGCTGCCTTAGTCTTCTCCTGTATGGGGGCAGCTTATGG
TACTGCTAAGAGTGGGGTAGGAGTGGCATCTATGGGTGTGATGAGGCCAGAGCTAGTGATGAAGTCTATTGTGCCCGTG
GTTATGGCTGGAGTTTTGGGTATTTATGGATTGATTATAGCTGTGATAATCAGTACTGGCATTAACCCAAAAACCAAGT
CTTATTATCTTTTTGATGGCTATGCTCACCTTTCTTCTGGTATTGCTTGTGGCCTTGCTGGACTTTCTGCTGGTATGGC
CATCGGAATCGTTGGTGATGCTGGTGTTAGAGCTAATGCGCAACAGCCAAAGCTCTTTGTTGGGATGATTCTGATTCTT
ATTTTCGCTGAAGCCCTGGCTCTTTATGGCCTTATTGTTGGCATCATTCTCTCTTCTCGTGCTGGCCAGTCCAGAGCAG
AGTAGAAGATGAGCATGTTATGCTCCGTAACTGTGAATTATCTNTTTGTTCTTCCGCATTGGATGAGATAGTCTGGCTG
CTGAATTATGTTA > SEQ ID NO:2429 213257 157054_301734_1
ACCGATCAGAAAAATTGTCATCAAAATTCCGATCGGTCACTGGCGAAATCTCTGATAAACTGAAAAAAATGTCATCAAC
TTTCAGCGGCGATGAAACGGCGCCCTTCTTCGGTTTCCTCGGAGCAGCTGCAGCTCTCGTTTTCTCCTGTATGGGAGCT
GCTTATGGAACGGCGAAGAGTGGGGTGGGGGTAGCCTCAATGGGAGTAATGAGGCCCAGAGCTTGTGATGAAGTCAATTG
TGCCGGTTGTTATGGCCGGAGTGTTAGGTATTTATGGTTTGATTATTGCGGTAATTATCAGTACGGGAATTAACCCTAA
GACCAAATCATATTACCTTTTGATGGATATGCGCATCTTTCTTCTGGTTTGGCTTGTGGTCTGGCTGGCCTTTCCGCT
GGAATGGCTATTGGAATTGTTGGTGATGCTGGTGTTANAGCAAATGCACAACAACCAAAACTGTTTGTTGGTATGATCC
TGATTCTCATCTTGGCCGAGGCATTGGCTTTATACGGACTGA

FIG. 2 continued

> SEQ ID NO:2430 213260 195559_300635_1
gTCGTGGTTCGTCCCCCCCTCTAAAAAACCTGCCCTCTGAAACTCTCTCCAAAACCCCACGATATACCCCGCGTCATCG
CTTGTATTGCCGAGCTGTACCAGTGCTAGCCGTTGCCTCACTACAGCTCTACCCGTCTTCTCCAAATAGAATCCCCCAA
CTCTTTATCTCAACCTCAATTCGATTCATTTCTGTCCAATTGCCTCTCATAACACCCGCGTCGCCGAGATCTACATCCA
GGGACACGGAATTTCACCACTACCAGCAAGCTCCTCTGCTGTATAACTAAAACCAAGCTTCCCCCGAATTACATCATCG
CCTCAAACCGCCACCATGAGCGCAGACACGGGCGAAAAAGTCAACACCCACATCATCACACTCACGCGCTTCCTCACCG
AAGAGCAGATTAAGCACAAAGAAGCCACTGGTGATTTCACATTGCTCTGCCATGCTCTCCAATACTCCTTCAAGTCCAT
CGCCTACTACATCCGTCGCGCCACCCTCGTCAACCTGACGGGTCTGGCCGGTTCCTCCAACACCACCGGCGACGAGCAG
AAGAAGCTCGACGTCATCTCCAACGACCTCTTCATCGAGGCCATGCGCTCCTGCGGCAAAGTCGCCATGCTCGTGTCCG
AGGAGGAAGAGACGGAGATTCACTTCCCCCAGGCCGCCGGCGCCCGCTACATCGTCTCCTGCGACCCCATCGACGGCTC
CTCCAACTTGGACGCCGGAGTGTCTGTCGGCACAATCTTCGCCATCCACAAGATCCCCGACGGCGTCAATGTCGCTAGC
AAGGAGGACATCCTCAAACCGGGCACTGAGCTCGTTGCTGCTGGCTTCACAATGTACGGCGCCTCcgccC > SEQ ID NO:2431 213279 211609_300901_2
CACGCGTCCGCAGCTACAAAGACATCTACTCATCTACACACAAACAAACATTCAAAAAGCATCATCACACAAAGCTTCC
AAAGCTCCAGCTTCTCAACAATCCACTATTCTCTACACTTCAAACCACAACAACCACAACCAAAACCTTCAAAATGTTC
GTCGGTGACCTCGTCCACTTCCGCGCTGCTCTCAGCAACGGCATCACCCACGAGATGATTCTCTGCCCCTCAGCCGCCA
CTTCTCCCGCCACCTCCGCCGCAAACACCCCAGACAACCGCTCCCTCGCCTCGGAGAAGAAGAAGAAGCGTTTCTCCTC
TTTCTTCTCCCGCCCTCGCCCTTCTGTCAAGGCCGCCAACGTCGGTGCTGGCATGAAGCTGCCCATGAACATTGCCTAA
ATAAAACCAATCTTTCACACCAACAAAACAACTACAACAATGTGCTCCTGAACTGCGGATATAAAGAGGAATGGATGAA
CCGGTCTATGCCCAGCACGATGGAATAAAATACACAAAACACACAAACACAAAAAACACACTCCTTTAAGAGACGACGA
CCAACGAAACAACAACACCTAAAAGTTTTTTTGCTTTTTCCGACACTACTTTTTTCTTTCTCTTTTGTCACAAGTTTTT
TTGGGCATGGATTTTTTTTACACACAGGGgcaGGCTGGGAGCACAAAAcagtttttatgaGTATTAGattctaTACCCA
tTTGATTCGAGAAAACGCAATgatac > SEQ ID NO:2432 213287 215161_300878_1
GCCAATCGGGAACAAAAAGGGCTGCGCGTTCTTTTTGCCTCTCCTGACTCCTTACAGATGGGTGGCATTGCTAAGGTA
CAGTGTGGAGTCTGCAGTGGATTCGAGAGCTGCGATTTCAGTTGTTTGGACCTGGACGGAGAATTTTACGGAGCAGCTC
ACCCTTGATGCAGTTTAGGTAGGCGGTGTCTCTTGTTGGCGTGTTTTATAAGAGCAACTTTGCTGGTGGTAATAATGAT
GTCCATGCTATTTTCGTATTTCTGGAATAGGTACCTGGTATGGCAAAGAGAATAGAATGATGGTGAATGAGATTACACA
GTTCG > SEQ ID NO:2433 213315 211207_300897_1
AGGGGAAGTAATACCATGGCATCGCTAAACATGCACAGAGCAGCGTCGCGATTCGTCGCCGCTTCAATCTCGAGGCCAC
TGCCGGCATGTCGAATCGCAGTAGCCTCTCAGCGGCATCTCAGCACCGGCATGCGGATCCCAGTCATTGCCGCATCACG
GCCTCACGCAAGGAAGACACAGCGCCCTATTCCGAGCGGCGTAGCGACAATCTTCATCCAGACTGAAAATACACCAAAC
CCGGATGCCCTCAAATTCTTACCGAACCACCGCATCATCCCGCCAGACATGAGCACCCCGTTTATAGAGTATCTCAACC
CGCGAGCTACGATTTCTCCGCCGCATCCCTCGCCCTTGGCTGCGAAGCTCATGAACATTGACGGCATTACCTCAGTCTT
CTACGGAGCCGACTTTATCACTGTAACCAAGGCTGGAGATGCCAACTGGGCTCATGTGCGACCCGAGATCTTTGCTCTC
ATAACCGAGGCTATCACTTCCGGCGAGACTATAGTCAATGTCGCGGAGCGCAAGGGGGATGAGTCCGCGGCTGTGGAAG
AAGACAGTCTGGCTTACAACGAAAACGACAGTGAGGTGGTGGGCATGATCAAGGAGCTGCTGGAAACGAGAATCCGCCC
AGCCATCCAGGAGGACGGTGGCGACATTGaattccgtGGCTTcgaggatgggcagGTGCTGctaaagctgcgCGGAGct
tgccggaCATGTGAC > SEQ ID NO:2434 213330 207739_300828_1
AGACTTTATGTTGTTGGCGGTGAATGGCTCAACATCGAAGCTCTAGGCGCCGGAGGTATTGCTCCTGTTGCAAGCTTGG
CCGCAAATGGGAAAACTTTTATGCCGGGCTGTTTTTTTTCCGGTTTGTCAATGGGGCCGTGCGATTACCTAAGATGAGG
CAGAGCAGCGGCGGCTTCGAGTTTGAATTTACAAGAAACATGGATTGTGCTCGGAGTACGCCGTGGTATGTAGGATGGT
CTGTGGCTGAGGTCGTCCAGCTTCAGGTGTTTATATATGGCTTTACCGGCAGATTTCACAAGCTCAATCGACTTTTGGA
AAGTGTGTTTCAGGCTATTCTTGAACTTTATACTCGACGTATAAGTCTGGCTAAgAGATTTTGCTATTTCCTATATCAT
TATCATAACATGGGCATATATGGGTCAATGGATGGTAAATGAAATTTGATTTGTACGGGAC > SEQ ID NO:2435 213331 213351_300852_1
CGCCTCTTACGTGTCAATGGCCTAAAGGCGCCAGTAGTATACTCCGTACTGGTAGTATATCGTGGAATCATTAGGTAGC
TTTCCTCATACGGCCTGGCGCTCCCTGTAAACGACCTGTGACCAAACTTCGAACACGAGTATCGTCGTAGCTTCATTTC
ATCGAGTTTTTCAGAATTTCGAAAACAATCAATTCAGTTTGGTGAAGGATGACAATGTGTACAGAATACTACACGCCAC
GTGTTGATTGCATCTACCTCCGCCGGCGTCTCTTGTGCAATAACTCATCCTCCACATC

FIG. 2 continued

> SEQ ID NO:2436 213340 1107807_301547_1
ATTGAGCATAGAGAAGACAACTTTGCAAACTCTATAGAGTTTTATAATGCAACCTGGCCTCGTGAGCTTTGCATAAATT
TTCCCCTAGAGGCTATAATTCAGAAGCATGCAGAGAATATTTAGTTCTTGTTGAATATAACAAGGCCCCCTACCCAAAA
AAGCGCACAAACTAGATAATGTCTACAACAACTTTGACTAAGGTGGGGCAGAGAATTGCTTCAAATGCTCGTCGTCAAG
CCCTCACTTTGACAGATGCCGCAGCAAAGAGAGTTCAAGATCTTCTGAATAAAAGACATAAACCCTTTTTGCGACTCGG
TGTGAAGGCTCGTGGATGCAATGGACTCAGTTACACCCTTAATTATGCAGACGAGCAAGGAAAGTTTGAGGAATTAGTG
GAAGATAAAGGAGTCAAAATCTTGATTGATCCTAAGGCCTTGATGCATCTTGTCGGAACAAAGATGGATTTCATTGAGG
GCAAGCTCAAGTCTGAGTTTGTCTTTATAAATCCAAACTCCAAGGGTCAATGTGGGTGTGGAGAGTCATTTATGACGTG
ACCAAGGAGATTCATATCGTTACATTCACCCAAAATCCAAGGGTGTACGAGGTTAGGGAGACTCATTAATGTTTTCCTC
AATCAAATTTATAGCTTTGCCTATAACATGCTGTGCTATTTTCTTTAACAAGCA

> SEQ ID NO:2437 213340 218693_300920_1
gcacgtttgggcAGCATCTTTATGATACAATGATGAACGTCTCCTTCTCTACCGGCCGCGCTGCGCTGCGCCTCAGCCG
CTCGTCCTTCCGCCACCTGTGCGCATCCAGAGTCGCCGGCTTTGCTTACCACTCCTATCCGCTGCCGTCCAAAATCCCC
GAGCCTCCCACAAGCGACAACCTCTCCAAGTCATCCCTTGCCCAGCCAGAGGCCCTTCCTCGCGTCCACGAGACACGGC
CGCCTCCTCAACACGATGCCGTACCCAAGCCGATGGCCCCACCGCAGGTTGAAGCTCAGTCGCCTTCTCCAACAACCTC
CTCAGTTCCTCCATCTCCCAAAGCCGCCGAGACCGATGCGCAAAAGACACAGCCTGCTCCCGCTGCTCGACCTCGTTCC
AAGCTTCGCGCGCGCAAGGCCGCAATGAAGCTCACACCCGCCGCCGTGGAGCAGCTGCGCGCACTGCTCAACCAGCCCG
ACCCGAAGCTCATCAAGGTCGGTGTGCGGAACCGAGGCTGCAGTGGGCTCGCATACCAGCTGGAATACGTCGATAAGCC
GGGCGCTTTCGATGAACTGGTGGAGCAAGACGGCGTCAAGGTCTTGATTGACAGCAAGGCACTCTTCAGCATCATTGGC
AGCGAAATGGACTGGGCCGGAaGATAAACTGAGTCAGAAGTTTGTGTTTAAGAACCCTAATAttAAGGAGCAATGCGGCT
GCGGagAgtcATTTATGGTCTAAGGAGCTTGTGAagcTACAAAGGaaCAAGACAAAGGCCATGgCACatgagaaTACTA
CCAaggccgATGTATggagAGAttgtaCgaTgAcgacTa > SEQ ID NO:2438 213340 230982_301073_1
GGAACGAGGATGATGCGGAGGCTATGTTCAGCGCAGGTTAGGAAGAAGAATGGCAGCGGTGTGTGCCGTCAAGGAAGGC
CTGAGGCAAGCTTCATCGGCCAGGAAGCAGGCGCTTGCATTAAGCGATACGGCTGCAACGAGGATTCGGCACTTGCTTG
ATATGAGGAGCAAGAATTTCTTACGCTTGGGAGTGAGAGTTCGAGGTTGCAATGGCCTCACCTACACCATGAACTACGC
AGACGAGGCTGGAAAATACGATGAGCTCGTCGAAGACAAAGGTGTCAAGGCTGTTGGTCGATCCGCGGCATTGATACAC
ATCGTCGGCACCAAGATGGATTTCGTAGAAGACCGTCTCAAGTCGGAGTTCGTGTTTATAAATCCCAATGCCACCGCCA
AATGTGGCTGCGGCGAATCCTTCACGACCGGCTCACAAACTACACGGCCGCAAAGTCAGTAGGAGAACTTCTTGATATG
ATTGGTCAGACTTGGCCAAATTTCAACGGTAGAATGAATAAATNGGTCGGTTGTTCAAGCTTGCCAATTTTTGAATCTG
AAAAAA > SEQ ID NO:2439 213354 215223_300879_1
GGAGTTTGTTCGTTTATTTCGTTCTCCCTAAGATGTTGCGGATCATGATGTAGTTGCTCTCCAAGTATACATAAGATAG
CCATAAACATAGCCACAGCAGCGCCCAACAACAACTGGGACCAAGGGTGGGTGGAAGTCTGGCTTCCAGCACAGTACTT
TGCATGATAGAGTCATGACAATGTCATGAAAAGAGAATTGTATGTACATGTCTTATATTTCCTGATACAGCTTGGGCAC
GGAGCGCGTGTGACGAAGGTAGGTGATGGTTGCTACGTATAGGTAGGTTGGGATTGAAGTCACATGCTTCATCCTCACT
TGTATGAAACCCGTTTCTCAGCCCATACCAGCATATTTGAACCAGTTGGGACGGCAATCTTCTCGGTGGAGGAACGGCT
CACCATCCGTCAGTCGACCAGTAACACAGCCCTTGCATTTGGGAGAGTTGGGGCAGTTGAAAAAGGGGATGTGCTGGTA
GCCAATATCACGGAACCAGTGGATTTTGCTAGAATCCTCAAATAGACCCAGGGCAAT > SEQ ID NO:2440 213369 213370_300924_1
actttgtgtacctcgagatcgggtataaagttacctcggggcgcctcttagtgctggcgttcgtggcttgtctgctaac
aATCAGGTTATATCCAGAGCTTGGGCACCAGAGCTCTTCTTACACTGCCAATCTCTGCATCATCTCGTAAACAGAGTAT
ACAATTCTGGATACAATTTTCTTCGCTCCATGGGGTCTCAAGTCCAAGAAGAGCTGACAGTGCTCGTCACTGGATTTC
AGCCTTTCCGGCCAGAATATCCAATCAACCCGTCATGGGAAATCGCGAGAGCCCTCCCAGAATACCTCCCTCCGCTAAG
GGCCAAGGACCCAAACTCTCGAAATGCCGTCGACATCCCGCCTGTGCGCATTCTGGTGCACCCCGACCCCATCCGAGTC
AACTACAAGGTGGTGAGGGAGCTTGTGCCAACACTGTGGGAGGAGACGTACGCGGGCCGCAAGATTGACGTCGTCATTC
ACATGGGCATGGCAGGGCCGCGGCTCATGTATCAGATCGAGAGCCGAGGACATCGTACGGGTTACAAGTCTCTCGATGT
TGACGGGAAGCACCCTTGACGAGCTCGATGGGAAACGGGACGAAGAGTGGATCTCGGCATGGCCTCCCGGATGTGCTGAaG
ACGGACTTGAATATACAGGACATCTGGCAGAGATGGCAGCAGCACAGCTCGAATGACAtGGAtcttcGAATCTCTGACG
AT > SEQ ID NO:2441 213377 208367_300959_1
ACGATGCTCCACGATTCGGAAACCCAAGGCACAAGCCATTATCGCGGTCCGGATGCTAGTTGGCCTGGACCCCTCCTCG
TATCTCCTTCATCCGTTTTGCCGTCAGCTTTGTCGCTCTGGCTTGACGCATCTCCATCACCCAAGTCTGCCCTCCAATA
AACGCTTCTTCCCCCTCGAGTCCAGACTCTCTGTTCTGCCACTGGCTCTGGCTCTGGCTCTAAGCGATCTCCGCCCCGG

FIG. 2 continued

```
TCCGTCCAAGCTTGCCCCCCGAAGATGACGGCCGATGCCATCTCCGGCTCCGGGCCCGCATCCGGCTCTCCCCAGCCTC
TCCGGCTGCTCATCCTCGAGGCCGATACGCCGCAGCCCATCACAAACGCCAAATATGGTGGTTACCGCGGAGTCTTCAC
TGCTCTGTTGACGGCGGCGGCGGAAATCATGGTTCCGCCACGGCAGCTCTCCGACGTGGCCACAATCACGGCGCACAAC
ATTGTGGAAGACATGCAGTCATACCCGCCGCTGGACGACGTCGACGCCGTTCTAATTACTGGCTCGCGTCACACGGCAT
ATGAGGATGACCCCTGGATCCTGAAGCTGGTGGAGTATGCAAGGCAGGCCATCGACACCGGTCGCATCAAGGTCGTGGG
CGTGTGCTTT

> SEQ ID NO:2442 213387 213324_300924_1
GGGGGGGGGGGATGATATCCCGGGTGTATTTgTACTAGCTATCAAACCAAAAACTCTTTCTGTCATCTAAAAAAGAAGAG
AGAACAGAGATGCTATGCTCATTGCTATATGCGAAACAATCTATATCAGGGGGGGGGAAATAATACGCCAAAACCGTCAA
CTCAAACTCATGTGCCAGAGTGAAACAACCAAGAAGAAAAGAGAGCAAAGCCATCTATCTAGCTTTCTACTCTAAACAA
CCAAAACCAAAAACAACGTTCGTAAAATCTCTAAACTCAAATCTCTTGCGCATGATAGTGCTCTACGCCGCTCATCTGT
TCGACTgccATATTCTGCACAGCCTCGCCGGGCTTCTCCGTCTTCGCCCTCAACTCCTTGGTAATCTCCTCAACCTCCC
CCTCAACATCGAGATAGCGCCTCAGAAACTTGCCGACATCGGTGTTCTCGACGTTTCCACGAATCTTTTCCGTGCCGGG
CCCTCCAGACGAGTAAATATTGACGTCGACGGCGGTGTGTCCgTGAgTGCTCCATCCGACGTGGGCGCGcagggaAATC
ATCgcagaGAGGATCTCgAGGGaagcCTCggcgttGt > SEQ ID NO:2443 213728 213725_300860_1
GGCGTTTGTGGTTGACAGAGGGAGAGGCTGTGTTTGGTTGAAGGAGGAGAAGAAGAAGAAGAAGATGTGAAGAGGAAAT
GCCGAAAAGAAGGATGAAAGATATGTTCTTGTCTCGAGCTCTTTCCAATTGCTCTGGCCTTGTGCATACCATACAGAGG
CAGGCAGTCGCAAGAACAAATAACGAGGCAATTTGCAATGCAAAAAAAAAAAACAA > SEQ ID NO:2444 213734 124824_300426_1
CCCACGCGTCCGCTCCCTCAACAAATATCACACTTCCATTACATCTTTGAAGTTCTTTTCATTCATTTTATCAAAATGA
CAAATTCCTCCAATTCTGTTTTTGCCCATGTTGTTCGTGCTCCTGAAGATCCCATCTTAGGAGTCACAGTTGCTTATAA
CAAAGATACCAGCCCACTGAAGTTGAATTTGGGTGTTGGCGCATATCGCACTGAGGAAGGAAAGCCCCTTGTTCTTAAT
GTGGTGAGACGGGCTGAACAAATGCTCGTCAATGACACGTCTCGGGTGAAGGAGTATCTCTCAATTACTGGACTAGCGG
ATTTTAACAAGCTGAGTGCAAAGCTTATATTTGGTGCTGACAGCCTGCCATTCAAGAGAACAGGGTGACTACTGTTCA
ATGCTTGTCGGGCACAGGTTCTTTGAGGGTTGGGGCTGAGTTTCTGGCTAAGCATTATCATGAACGTACTATATATATA
CCACAGCCAACATGGGGAAACCATCCGAAGGTTTTCACTTTAGCCGGGCTTTTAGTAAAATATTACCGTTACTACGACC
CAGCAACACGAGGCCTGGATTTCCAAGGACTTTTGGATGATCTTGCTGCTGCACCCGCTGGAGCAATAGTTCTTCTCCA
TGCATGTGCTCATAACCCAACTGGCGTTGATCCAACAAATGACCAGTGGGAGAAAA > SEQ ID NO:2445 213734 216942_300903_1
tcatcatcGTCCTCTCAATCTCGTTCCCAATCAACTCCGTCTGCCTCTCTCGCCCGCATCAACAACATTGCGAGCCACA
TCTCTCCCACAATGGCTTCCACCACCAGTTTCCCGGCAGAAACGGTGCCCCAGGCGCCTGAAGATCCCCTCTTTGGCCT
GGCCCGCGCCTACAAGGCTGACAACAGCCCGCTAAAGGTCGACCTGGGAATCGGCGCCTACCGAGATAACAATGCGAAG
CCATGGGTTCTTCCTGTGGTAAAGAAGGCTGATGAGATTCTCCGAAACAACCCCGAACTGAACCACGAGTATGCCCCGA
TTGCAGGTATCGAGAGCTTCACCAGCAAGGCTGCGGAGCTGATGCTCGGCGCCGATTCGCCCGCTCTCGCGGAGCGCCG
CACTACGTCTATGCAGACCATCTCGGGAACCGGTGCCGTTCACTGGGAGCTCTGTTCCTCGCCAAGTTTTACAAAGGC
AGCCAGACCGTCTATGTGTCAAATCCCACATGGGCAACCACCATCGATTCTTTTCCAATGTCGGCATCAAGGTCGCCC
AGTATCCCTACTTCAGCAAGGAGACCCGGGGGCTGGACTTTGATGGCATGACCGCTGCCATCTCAGCGGCTCCTGAAGG
TTCCATCATCCTGCTCCACCCCTGTGCGCACAACCCAACCGGCGTCGACCCAACACTTGATCAGTGGAAGGAgTtGGCC
GTCATTATCCGAGAGAAGAAGCACTTCCCCTTCTTTGACTGTGCCTACCagggCTTTGCCTCTGGCGACCTTGCTCGAG
ACGCCGCCGCTGTGCGTTACTTTGTCGAGCAAGGCTTCGAGCTCGTAGTTGCCCAGAGCTTCGCCAAGAACTTTGGTCT
TTATGGAGAGCGAGCTGGCTGCTTCCACGTTGTGGCTGCTCCTGCCGCTGATGCCACCACCACAATCACCCGCATTGCA
TCTCAGCTTGCCATTCTGCAACGATCAGAGATTTCCAACCCTCCTTTGTATGGCGCCAGAATCGCTAGCACCGTTCTGA
ATGACGCCCAGCTCTTCGCCGAGTGGGAGGAGAATCTGAAGACCATGTCCGGCCGCATCATCGACATGCCGAAAGCTCT
CCGTTCCAAGCTTGAAGAGTTGGGAGACTCCAGGAACCTGGAACCACATCACAGACCAGATCGGCATGTTCAGCTTTACT
GGCCTATCAGAACCCCAAGTTCTCAAGCTCCGCGAGGAGTAT > SEQ ID NO:2446 213734 226694_300999_1
TCCCCTCCTCACAACTCCACCAGACTCTCAAAACGATGCTCCGAACCATCGCCCGAACCCACGCTGTGGCCGCCACCAA
GGTCGTGCGAGCCTCCACTTTTTCTGCCACCCCCGCCGCCTCTTTTGTGCGATTCCAGTCCGTCTGGGCCAAGGTCCCC
CAGGGTCCCCCCGACGCCATTCTCGGAATCACCGAGGCGTTCAAGAAGGACGCCTTTGAGCAGAAGATCAACCTCGGTG
TTGGCGCCTACCGAGATGACGGCGGAAAGCCCTTCGTTCTTCCCTCCGTCCGAGAGGCCGAGAAGGAGGTGGTGAACAA
GGCCCTCGACAAGGAGTACGCCCCCATCACCGGAGTCCCCGCCTTCACCAAGGCTGCTGCCGAGCTCGCTTACGGCGCC
GACTCCCCCGCCGTCCTCGAGGACCGAATTGCCATCACCCAGACCATCTCCGGTACCGGTGCTCTGCGAATCGGAGCCG
AGTTCCTCAACAAGTTCTACTCCTCCAagaaGATTCTGCTCCCCcagcctTCTTGGGC
```

FIG. 2 continued

> SEQ ID NO:2447 213734 234369_301099_1
GCTAGCGGGCTTGTCAGGAACGCGGGGAAGCGATTCATGTCTACTGCGGCGGCGGCTTCGGCATCGTCGGCTCCAGCTG
GAGCTCGATCCGGATGGTGGGAAGCCGTGCAGCCGGCGCCGCGGGATCCGATCCTCGGCGTCACTGAGGCTTTTCTCGC
CGATTCCGATCCCAAAAAGGTCAATGTTGGCGTGGGCGCGTATAGGAACGATGAGGGCAAGCCGGTCGTGCTGGAATGC
GTCCGCAAGGCCGAGCAAATCATTGCTGGCAAGCAAAATATGGAATATCTTCCAATGGGAGGCCTTGTGAAGTTTAATG
ATCTCTCCGTCAAGCTTGCCTATGGCGACTCCGCTCCAGTTCTTGAGGAGAAGCGAGTGGCCGCGGTCCAGACGCTCTC
TGGAACTGGTGCTTGCAGACTTTTCGCTGATTCCAGAAGCGATTCAAGCCAGACTCACGCATTTACATCCCGGTTCCT
ACCTGGGCCAACCATCATAACATTTGGAGGGATGCCCGAGTCGAGGCTCACACTTTCCGCTACTACAAGCCAAGTACGC
GGGGATTGGACTTCGAAGGGTTTGTGGAAGATCTGAAAAAAGCGCCGGAGGGATCTTTCGTCCTGCTGCATGCTTGCGC
TCACAACCCCACCGGAGTtggacccACCgCCGAGCAGTGGAAGGAAAtttctCAGCTTTTCAAGAGCAATGGACTCTTC
ccgttcTTCGACATGGC > SEQ ID NO:2448 213734 244591_301559_1
tgATCAGCTATGGAGAGCGTGGCGCTCAAGCGAGTTTCTGCTGTAGCCAACCATCTCAATCCCGAGCAGCAGCAGCAGC
AGCAGCAGCAACTCTCCATGGCTGTCGCCGCCAGCGCCGGCGCCTCTTCGGTGTTTGATCATCTGGAGCAGGCGCCCGA
GGATCCCATTCTGGGAATAACTGTGGCATACAACAAGGACCCTCATCCCGGGAAAGTGAACCTTGGAGTCGGAGCTTAC
CGCACAGAGGAAGGGAAACCCCTTATTTTGCATGTGGTTCATCGTGCTGAGGAACGTCTTCTAGCTGATCGCTCCAGAA
ACAAGGAATACTTGTCAATCACTGGGCTGGCAGACTTTAACAAGCGAAGCGCGACGCTCATTCTTGGGAGCGATAGCCC
TGCTATCGTGGAGAAGAGATTGGTAACTGCGCAGTGCCTTTCTGGAACGGGTTCCTTGCGTGTAGGAGCCGAGTTTCTT
TCAAGACATTATGGTGTGAAGCTGGTTTTCCTTCCTACCCCGACGTGGGGAAATCACTTCAAGGTTTTCATGAATGCTG
GACTTGGTGTTAAGACGTATCGTTACTATGACAGCAAAACTCGTGGTCTTGACTATGAGGGTATGCTCGAGGACATAAG
TGCAGCTCCGACCGGATCGGTTATTCTCTTGCATGCATGTGCTCATAATCCCACTGGCGTGGatc > SEQ ID NO:2449 213742 253007_301648_1
GTCTCTCCACTACTTCCCCCCCATCAAGCCCTCCGCCCTTGCCGTCGGCACCATCTTCTCCCACTTCTCCTCTTTGATT
GGTTTCGCCCCCGTCATTGGCGACACCATCAAGCGAGCCAAGGCCGCTGACACCCCCGAGGAGTTTGCCCGACAGAAGG
AGAACAACGGCGTCCTCGCCCTCTACGGATCTTCTCTGCTCGGCTCCGGTCTGCAGTCTTACGCCGTGTCGGCCCTGAT
TGTCCTCACCGGCACCACCACCACTAAGGGTGCTGCCTACCTCGGAGGTCTCATCTTCGCCGTCAACTCCATCCCCACC
CTCGTCACCGGAATCTTCCAGGAGAACCGACCCGTCGAGTACCTCGTTGGCAAGACCCTCTCTGCTCTGCTGGAGACCG
TTGGTCTTACTCTCACTCTGAACTGGTGGGGAACCCGAAACGAGACTCTTTCTCTCGCCAAGTAAGCTGTATATTAATG
CATTATGATGATTCAN > SEQ ID NO:2450 213742 204942_300794_1
aCGGACATCATTGTATAGCTGTAAAATCACAACTCATAAACAGATCTCGTCCTTTACATCTTATTCTCTTCAAGCTCAT
CACAGCATCGTATCATCATAGTCAACATGTCTCTCCAATACTTCCCTTCCGTCAAACCCTCCGCCATCGCCCTCGGCAC
CTTCTTCAACCACGGCGTCGACCTCGTCGTCCTCGCCCCCGTCTTCGGCCAGACCTACCAGCGCGCAAAGGCCTCCAAC
ACAAAGGAGGAGTTCATCCGCTCCCGCGAGGCCAGCGGCGCCGCCGTCGCCTGGGGCACCTCGTTTGTGGGATCTGCCC
TGCAGAGCTACGGCGTGGGCGCGCTGCTTAATGCCACGGGCACCCTGAGCCACAAGGGCGCTGCGTATCTCGGCGCCTT
GATCTTCGCGGCGACGTCAGCTCCTGGATTCATCTCTCAGATCTTTAGCGAAAAGAGGCCTCTTGACACCGTCGGCGTC
AATGTCGCTGCTAAGCTGCTCGAGACTATCGGCCTGTCCTTGGTTCTCAACTGGTGGGGAACCAGGACCAATCCCTTTG
AGTAAATGGGATATCTCTTCGTAATTCTTTCCTGAGGCTGGTTCTGGGAGGAGTTGACAGGGAATGGAAAGGCCCCATC
ATATATGAcggccTTTGttGTATAACATCACACCTAAATtAGtc > SEQ ID NO:2451 213749 210363_300888_1
ACACAAGCAAATCAACAACACACACAACACAACAAACACTCTTACAACGCGCTCACACAACCGAGTCTCAAAAGACTAC
ATCTCTTTCTAAGCCAATCATCAGCCATCAAACAAACAAACAATCACCAAACCTCTCATCTCATCATCCAAAATGGCCT
TTCTTCAGCGCAACTTTTACACTCCCGAGACCTCTTTCACTCCCCTCTTCCGCCTTCTTGAGGACTTCGACAACTACTC
CCGCCAAGGCAACGACAACCAGCGTACCAGCCGCCGCACTATCGCTCACTGGCAGCCCAAGTTTGATGTCCGCGAGACG
GGCGAAGCTTACGAACTCCATGGCGAGCTCCCTGGAATGAAGAAGCAGGATGTGCACATCGAGTTTACCGACCCGCAAT
CGATTGTCATCCGCGGCAAAGTCGAGCGCACCTACACGGCTGGCACTCCTCCTTCTGGTGCTCTCGAAGACTCTTCCAA
GAGCGGCGCCATCACTGAGTCTGGCGAGCACGAGCGCCCCAAGTCTCCTCACAAGGCTACTGTCGAGGACGAAAACGAG
ACTGGAAACACCACCGCCCCTGCCGAAGGCGAGGTGGTCAAGGCCGACTCCTCCAAGAAGCAACCTACCGACTCCGCCA
AATATTGGCTCACCGAGCGAAGCATCGGAGAGTTTTCTCGCACTTTCAACTTTCCCGCTCGTGTTAACCAGGATGGTGT
GACGGCTAGCTTTACAGACGGCATCCTCAACGTGGTCGTTCCCAAGGCGGCCAAACACGAGCCTCGCCGAATCAACGTG
CTCTAAAGCACTACCAAAACAAATTATTTCTCTAATACTATtttcTAttttcctTTGTTATCCACGc

> SEQ ID NO:2452 213754 206092_300804_1

FIG. 2 continued

```
cctttacctctAAGTTACTAGCCCGATCCGCCAGTCAGAGACACACGCACACATGGATTCGAGCGCCTTCGTTTTGACC
TACCCAATTGTACGGCCCTAGCCCACGGTCTTGCAAATGGCGCTCAGACAGCAGCAAAGCAGGCGCAGGCGCAGCCCCC
ATTCGAGACGAGAAACGGGCCTTTGATTGGGGGCGTCCGTGTGACCCGAAGTGCTATATCTACTGCAGCCGCTGCCCGC
CTCGTCGAAGCTTCTTTTCCGCATCTCCCCTCAGAAGCATTTTGCACCAGGACTATCCGCCGATAGCATATATTTTTTC
CCTAAGGCTTACGCGCAAATTCCGATTTCTTACGGACCTACACGTACTTCAGTTAAAGTCCAATCGCCCAAAATGAACA
CCAGCACCGTCAAGAGCCGCTTCCTTTCTCACCCGAGGACCTTGGTATTGTCACCGTAGGCTTCTCGGGCGGTCAGCC
CAAAGCCGGTGTGGATGCAGGCCCTACTGCCCTCATCGAGTCTGGTCTCTTGACCCAGATTCGAGATGAGCTTGGTTAC
AAGCTGCACGGTGATGAGACGGTCAAGTTCTACAACGACCTGACTCCCGCGTCCGACCCCGACTACCGCGGCATGAAGA
ACCCTCTCCTTGTCTCGGCTGTCACTCAAAAGATTGCATCTGAGACATACGAGCACTCTTCCAAGGGCCGCCTCACGTT
GACGCTTGGCGGTGACCACAGCATTGCCATTGGCACTATTGCTGGAACTGCCAAGGCTACGCGCGAGCGCCTGAACCGC
GAAATCGCCGTCATCTGGGTTGATGCGCACGCCGATATCAACACCCCCGAGACGAGCGACAGCGGCAACATCCACGGCA
TGCCCGTTGCCTTCCTTACCGGCATTGCCAAGGAAGAGAAGGAGGAGTACTTTGGCTGGATCCAGGATGACATGCGCCT
GAGTGTCCGCAAGCTTGTGTACATTGGTCTGCGCGATGTCGATGCTGGCGAGAAGCGCATCTTGAGAGAGCATGGTGTC
AAGGCTTTCAGCATGTTCGACATTGACCGCACGGAATTGGCCGTGTCATGGAGATGGCCCTCGCCCACATTGGCGACG
ACACTCCCATCCACCTGTCTTTCGATGTGGATGCTCTCGaCCCcatgtGGGCGCCCAgcaCTGGTACTCCTGTGcGagg
tggccttac > SEQ ID NO:2453  213756  215257_300879_1
GCGAATGATGCTGATGGATTGATGATTTGGGGTTCAGGCTTTTTCCCTTCTCGCTCGTCGCCACAATGTCAATTGCATC
AGCGCCCAATGCGCTTCGAGCCTCATCAGGGTGCGCCTCAAGGCTGGGGCTGTCTCTCCATAAAGGCCCATCATCAAGC
CTTCTCCTGCGGGTAGCAAGTGTCTCGACAACTGCGCCGCAATGCAAGCGCAAGACAAAGGACAGCAACAAGCGACTAG
GCGTCAGGATCCTCTACGGATCGGGCCCGCGAGAGCCGGTGTCCATGTCCAACATGCCGCTGCCG > SEQ ID NO:2454  213758  200535_300853_1
cgacccacgcgtcgccCCGAGACGCAAGCAAAAGATGCGAGGCAGTGTCGTGGCTAGCAGGCCCTTGAGCCGGATAAGC
TGCTCGGCGTGTTGCGCGCGGAGCCGGCAGTTTAGCAGGTCGTTTCGGGTGCAGTCGGCACAACCAGTGGTCGTGCGAG
CGGGATTGAGTGGCGGCGTTGGAAGATATCTCGATGCTCGAGCCAAGCGTGGTACATATCAGGTTTCATTGGCGACGAC
GAGATCTTTGGCGACAGTTTCAGATCGTCCGGTGGTTGGACTGGGTCCGTTGGAGGAGTATGACCGGCGGGTGGACGCT
GGGATTCTGCGGAACGACGAGCATCAACGAGGCATCATCGAGAACCTGCAACATCTTCACAATGAGCTTCGCAACTACC
ATGCACCGCCCGTTGTCCATCCCAGCTTCGATCTCCTCAAGCCCGCCAAGAAATCCGTCTTCTCATCGTTATTCGGCAA
TGGAGGCGCCGCAAAGGCTACAATTAAGGATATCCCCGAGAACTTACCTCGGGGATTGTATCTATTTGGTGATGTGGGC
AGTgGCaagAcgatgCTCATGGAcCTAttCTacgata > SEQ ID NO:2455  213777  219650_300947_1
TCTCCTTCCAAGATGGGAGAGTTTCACGTGGGGTAGGGGGACATTATTCTGTTTTTCACCTCTTTGTCGTTGTCCCTCA
TACGGCTTTCGTAATTACGCCGTTATGTACCCATGTCCTGTCTGATGCGTTGGTCACGCTGGTCGACGCTGCGGGGGGA
AGGCAAACGAAGGCAACAGAACGGAAAAGGGAAATAAAAATAAAAGTTGAACCTAGGGGGGTTTGATAATGGCCAGCGT
GCGGCAGGCTTACAAAACAACGGGAAGATTTTCACGTTGGGCGGGATTACGGCTCTGATTTGTTATTCACTCTAGCTAC
TAGTCATGGCCGAAAACAATAATGCCAAGGTTTTTTCGG > SEQ ID NO:2456  213778  217536_300909_1
AGCAACATTAATTGTTCTTTTGTCTGGGTGATAGACTTGTCTTCCAAGCGACCTCTATTAGACTCCGTATAGAACT
ATAGAGCCACACGGAACAAACCCAATAGGCTATTGCCAGCACACACACCCGGGAAAAAAAAAGGAACGACAAAAAACC
TTGGAAATAATAATCAGAAACCCAAAAGTGAGACACACGGAAGACAAGGCAGACATCAATTCACACCCGTCCCGTGTCT
CTCAAGTATAAAACAAAACTCCAGCAACTAAACCACACATCCACCGCAACACCAAAAAACAACTATCACCATCACCATG
GCCGCCCTCAGCCCGGAGCAGATCGCCATCATCAAGTCCACTGTGCCCATCATCCGCGAGCACGGCACCACCGTCACCA
CCACCTTCTACGCCAACATGCTCGCCGCCCATCCGGAGCTCAAGAACTACTTCTCCTTGCGCAACCAGCAGACCGGCGC
CCAGCAGGCCGCCCTCGCCAACTCCGTCCTCGCCGCCGCCACCCACATCGACAACCTGGGCGTCATCGCGGGAGCCGTC
GAGAAGATCGCCCACAAGCAC > SEQ ID NO:2457  213803  217661_300910_1
tgaaactGAAGAGACACCATATTAACTCCAAGATTCAGCTCCCTCAGCTCAGCAATAGCCTCAGCCTCAGCCTCAGCCT
CAGCCTCAAAATAAAATGGCCGTCACTGGCCTTGTTGCAGTCGAGACGCTGCCCCGATTCCTCCTCCCACGGCTCAGCT
GGACTGCGCCGCTCGCCGCATCTCGATCTGCTGCAGCCCAACCCTTTGCCCCTCTACAAGCACGAACGAACCAAAGAGC
AGTGCCCGCCTTCAACACCAATTTCTCGGCCAGAAGATACAACAATGGCCAGATACCGGCGCTGAGGCGAGGGTTTCAC
GCGACGAGTCGACGATCCCGAGAGCATCATTTCGATACGCTCAAGTTTGTCAAGCAGCTCAAGGATGAGGCTTTACCG
AGGAGCAATCAGTCGCCATGATGAAGGTTCTCAACGACGTCATCCAGGAGAGGTTTGTGTTTGCAATCCTCAAGGGCTC
CTAACGAGCATGccATTGCTAGTGCTAATACCAACACTTCAATTGCAGCATCCAAAACcTGACCCTAACCATGGTCCTC
CGCGACGATGCTgccagAac
```

FIG. 2 continued

> SEQ ID NO:2458 213806 220884_300939_1
agcccgtcttcaactcacttttgccaatctgcatgctctcaaccgacagttcaatcaccgcggcgcaatggctgaaaac
aTCCTCGTTCTGGGTGCTGGCGAGCTTGGCCTCGCCGTTCTGGAGGCGCTCTCCAGacactccaAGCGCAACCACAGCA
AGATTACCGTCATGATGCGGCAGGCCACGCTGGACTCTGccgtattcnataagaagAAGCTGATTCAGCAAATCagggc
gcTGGGCGTCGACTTTGAGGCGGCTGATGTGGTGCAGGCTTCGGTGTCGGAGCTCGCCGCCATCTTCACCAGATACGAC
ACTGTGGTGTCCTGCAACGGCATGGGCCTGCCGTCAGGAACGCAGACCAAGCTCTCCCagGcGgCGCTCGaggcaaaGG
TGCGGTGGTTTccctGGCAGTTTGGCATGGACtacgatGCCAtcggcctgggcagCTCGCAGGACCtatttgacGagca
gCTGGgcgtgcgagcGATg > SEQ ID NO:2459 213813 199605_300751_1
gattagatcAGATTGCAGGCACCCTCAATTGGCATCACATCATGCTGGCGACAAGAGCACTCCGAGCGGCCCACGGGCC
CAAGCCCAACATCACCGGCTTCAACATGCGAGCCCTCAAAGAGGCCACTGGCCAGCCCGATACGACCCTTGGGAGAGA
GCCGAGGCATGGCGATACAAGGGCACCTTTTCCAGATGGAACCGATTCCGGAGCGGCTTCCCTGGCTTGGGAATCGCGT
CTGTTGCATTTGCCGGATACTGCGCCTACGAGTACCTCTTCCTCAAGGATGAACACCACGGCGAGGGACATGGCGAGGG
GCACCACTAGAGCGTTTTTTTTTTGCGAGCGAGAGCAGTCAGGAGTGTGCGAGAGGAGAAGAGAGAGGAAATGTATATA
CATCTCTCCAAAGACAAGAAAACTCAGGCCTGGTCTTGCGGCGGGCAAAAAATGAATCCAACACAAATCAATATAAACT
CTATTTAG > SEQ ID NO:2460 213814 216451_300869_1
gatccaaatcccacaaGTCGAAACGAACCCAATTGGCACGCACACCAGAGGCCATATACAAATACAAATATCCCCCCCC
TTGAACCGACTCTCGCCCACCCGCCCATCATGCATCTCATGTACACCCTCGACGCCAGCGGCAACCGCCTCTACACCCT
CAAGAAGGTCGCCCACGGCCAGGTCACCAAGTCTGCGCACCCGGCGCGCTTCTCTCCCGACGACAAGTGGTCTCGCCAG
CGCGTTACGCTGAAGCGCCGCTTTAACCTGCTCTTGACGCAGCAGAAGGAGGAGGCTATGTAAATTCGCATCATGGAGA
TACCCTCGAACCAAAGAAATCCCAAGCGGCGTTAATTGGGAGCGACTTCGGGCATGCTTTTTGAGGTGATAATTGATTC
GTCATTGTCCTCTGTTGGCGATACGGGATAAAGAGAACGGCAAGCTCTTCTTCTAGAGAGTCACAAAGTTGGCCATTCG
TCCCAATTCGGGTAACCGACTGGCTTTGTTTCCTTCGCTTAGGATCGATGGAGGAATACACTTGAGCGAGCAACATTGT
TCGTTTGGGGACAGCAATGAGAGACTACAgGaGGGGGGGTGAGTGTCTGGCGAGaGCTTGACtaagTgGATGGGTGGAT
GGATGAcaag > SEQ ID NO:2461 213816 211010_300895_1
agctCACACTCTCCAGGCTCACACAAAACTCACTACAATAAAAACACAATCTTCAATTCTTTGAACCTTTTTCAAGTTT
CGCCAACATGAAGTTCACCACTACTGCCGTTCTTGCCATTGCCGCATTCGTTGAATCGGCCACTGCTCTGGGCAAGGCC
CGTGTCGTCAACAAGTGCCCCTTCAGCGTCACCACCTGGTCCGTTGGCAGCGCCATCTCCAACCCAACAACCCTTGCTC
AAGGCGGTTCCTATGGCGAGACCTTCTCACGAGACCCCGTAACCGGCGGTCGTGCCATCAAGGTCACCGTCCAGCCCGA
TGGCCTCTACACTGGCAAGCCCCAGACCAACTTCGCCATCAACCTTGAGGGCAACACCATCTGGTACGATCTTTCAGAT
GTCTTTGGCGATGCCTTCAACGGCCACAAGGTCGTTGTTTCCAGCGCCAACACTGCTTGCCCCCAGATTGTTTGGGGCA
GCGGAATCCCTCCTGCCGGAAGCCAGGTCAAGAACTGCGGTGCGGATAAGGATGTGACTTTGACTCTGTGTGCTTAGAG
TTAAGGGAGGACGGAATCATGTCAAGGGAAAGGTTTAAATCAAGTTTATGATAGAATTTCAAGTCCTAGCTATGTTTAA
GACTTATGACAGTATGAATTGATGAGTTTACTCC > SEQ ID NO:2462 213817 219451_300945_1
GACAAGTTCAATTCGCAGCAACAGAAGCGGCGCAGACAGCATGAGCTCATCACTGAGGAGCTGCGTTGCGGCCCGGCCG
CTGGCTCGCATCTCGCAGACGGTCGCTTCACGGAACGGCGTCCAGAGCGTCCGGTGTCTGTCCCAGACAAGCCCACGAT
GGGAGGATTCAAAAGATGCAAAGCCAGAACCACCCAAGGCGGTGCCTCCAAAGCCTCGAACCGAGTCGCTCCTCGACAG
CATCTACAGCATTACCCAGGCGCCAAACAGCCGGTCCGCGCAGTCCAACCCCATGGGCAGCCTCTCCCAGAGCATGGTC
TTCCAGGCCCTCAGCAAATCCAACATCGACACCAGCGTCCTGTCAGGCGGTCCCTCGCAGGCAGCGCAGAAGAAGGAGG
ATGAATTGGAGCCATTCCATTTCCACGTCTACTCGCACAAGCACAACACTCACATTACATGCACAAAGCCCAATCGGGA
ACCCATCATCTCCATGTCATGCGGCAACATTGGCTTCAGGAAATCACGGCGGGGCACCTTCGATTCGGCCTACTCTTTG
ACAAAGTACGTTTTggAgc > SEQ ID NO:2463 213825 199660_300751_1
GCCGGCTAGCAGTATAGAGCGGATGGGCATCGTAGATGGGCAGTGACGATAGTGTACACCCGGAAAAAGTGACTGCGTA
TCGCTTTGCCCCTCCGTGTCTTCCGACGGGATTGTCTCGATAAAAATGACATCAGCACGGGAAGAAGAAGAGCATCTCC
ACTAACGGCACACACAAACACGCATAGAACAAGACGCTCTCCGTACTCCTCGGAGCCGGTGCTCTCCCTGCAGGG > SEQ ID NO:2464 213825 220306_300954_1
gagcccCAACTCTTTTTTGTTTTCTGTATTTCTCTCTCTCACTTTCACTCTCTCTTCTCTCTTGTTTCTTCTCCTTCTT
TCTCTTGGTTACCCAGCTAAGTGAAGCTCAACAACCGCAAACATGGCTGCCCCCTCGAGCAAGACCACCAAGAACCTCA
ATGGCAAATGGACCATGAACAAGACGCTCTCCGACTCCTCGGAGCCGGTGCTCTCCCTGCAGGGCGTTGGCTACCTGAT

FIG. 2 continued

```
CCGCAAGGGCATCAGCCTGGCCACCATCACCCTCGAGGTCGAGCAGTACGAGGGCCCGCCCAAGCCGCCCAACACCGCC
GCCGACGTCGTCACGCACATCGACATCAAGCAGTCCGCGTCGGGCCTGTCGAGCACGCAGGAGAACCGCTGCTTCGACA
ACTTCCCGCGCGACCACACCGACTGGCTGTTTGGCACCGTGACGGGCCGCAGCCGCTGGGTGAGCCTGGACGAGGTCAC
CGACGAGTTCCTCAAGAAGGGCTGGGAGGTCGAGGGTGAGGGTCAGAGCTTCATCACCAACATTGCTGAGAACA

> SEQ ID NO:2465 213826 195546_300635_1
TGAAACTGCGTCTTTCAGTTGACTCTGGTGATTCTCTGAGGCGCCGAGGCTCTGTGTGAGCATCCCGATCCAACATCAT
GGCGATACGCGAGGAAATCGTGGCGTCTGCAGCGCAATTTCTACAAGATCCCAGCGTTGCCACCTCGTCCGTCGAGAAC
AAAATCTCGTTTCTTCGAACCAAGAATCTGACACAGGAAGAGATTGATGCCGCCATTGCCAGAGCTGGGGGCGGTAGCG
GCGCGGTAGCTCCTAGGGCTCCCTATGCTGGCGCGCCTCAGGGTCCTCCTCAGGGTCCTCCTCAACAGTATTACCAATC
CTACCCCCAGTATGCGTGGCAGCCGCCTGCGTCAACACAACGGGATTGGAGAGATTGGTTCATCATGGCAACCGTGGTT
GGAGGGGTCAGCTATGGCCTGTACTCATTGGGCAAGCGTTATGTATACCCCCTTGTAGCGCCACCTACCCCTGAAAAGC
TGGAGCAGGACAAGAAGTCGATCGAGGAGCAGTTTGACAAGGCCTTTGCTCTGGTTGAGCAGCTGTCCAAGGACACAGA
GGCACTAAAGGATGCCGAGAAGCAGCGGACAGAACGACTGGACATTACACTGGCAGACCTGGACACGATCATGACGGAG
CTGaa

> SEQ ID NO:2466 213827 199626_300751_1
aaacgaagtactgtaatcgtacgtactcaattgacgggctttcgacccctgttttgcatctgcggtcgaataaacaccg
aCTGCATCTCCATCAGATTGCGCTTGGCGGCCGGGTCTACTGTTGCAGTTGATGCCGCCCAACTCTGGCAAAACCTGGC
GCTGCGGCTGCGGCTGGAGACCGGGGAGCGATTCTGGCTGCCCAAACGAGAACCGGGGGGGATGTCAATGCACAGTTG
CATCGAAATTTGGCGATTAATTTTTTTACGAGGGAGGATTAGgATTAGGACTTTGCACGGTAGG > SEQ ID NO:2467 213836 217480_300908_1
tcTAGGTAACCACCAGCACACGCAAACGATACGAAAAACCGAGAACAAGTATACCTTCAGCTCCGCGGACAACAATCAT
CACCGCGGACAACAATCGTCACTGCACGTCTGCCTAGTTGAGAGTTCCAAGTGTAAAAACATCAGCAGTTGCCTTGCTG
CGTGGTTCCCAAGTCCAGATAGTCAACAGATCAAACACAAGACAAACCTGCCTGTTCGATTACTTTGCCTCCTTGTAGT
ACAATTCGCAATAGTTCACCAAATCACCAGTCATCATGCCTGTCACTGAGTTTGCCATTATCAAGCTGAGGCCCAATTT
CGACCCCCTCGAGTTTCTCGAGACACTCATGGAGTGTCAAGAGATTCAGGACAATTGGATTCGCCGCAATCAGCCATGC > SEQ ID NO:2468 213845 208217_300833_1
gggcaatcttaacggaatgaagctttcctggtcgccatgagagacatatgcggagaaaccgaaatgtgcaattgtccag
cAATTGCTTTTATTCTAGGGTCTACGAGAGCCTGGGTCAACGCCACCGTCAGGATTTGTGGCGGCGCCTCAGCAGTTAC
GAACCAGTCTTCTGCTCATGCTCCCGCCTGGGGTCGCCCTTCACAACTGCAGTAGCATTGGCGTCCGGATAGAGCATCA
AATCTTTCGCGAGACAAGATCGACGGATACACAAACATGAGCTACGAAGATACTTTAATTCGATCGAGAATAACGGGTT
TATCCTATATAACCAGGAGAAATTCCACGAGTGACACATCAACAGGAGGCACCAGTCATGACTACGTCCCCATAATTGT
TATGACTGTTATTGTCGTGGCGATCGTTCTGGTACTCCTTATCCTTGCTCAATACACAAAGGTGCTTGATCGGAAAAAG
CCAGCCAACGGATTTGATCCAGAAAGCGCACAGAATGCCGCCAAAATCGAGAAACTGAACCAAAAAGCTCCGACTC
AATCCTACAAGAGCTGGAAGGAGAAGAGCGAGGAAGCGACTGGTTCCGTTAAACAAAGTACTACTCATGTCGTATGTGC
AATATGTTTGGAGACCCTACAAGAAGACGATACAATTCGCCTGCTATCATGCGCGCACATTTTCCACTCTCTTTGTTTG
GCAAAATGGTTTTTGAAGAGGCATAATACTTGTCCGCTTTGTAAGGCGTGCTTCATGTCTTCGTCGGAGAAATCCTCGA
TACCTGTACAGGTTCCAGAAAGAACACATGCCCGATGAGAAATCTCAaacaatAAT > SEQ ID NO:2469 213894 219319_300944_1
ggtacgttattgttttttttgttggccttttcactttggtttgttttttaatttcttcgtttttgttttctgttgcagagg
aGAAGCGTGAAGATAGGAGAGAATAGAGATAGAGGCAATTGCACGGAATGTTTAGCCAACAAGTTGCTCGTGGCGG
CGCCGCATCGGCCAGATGGCTCGAGGCGGCCAATATCCGTCACTCGCTGCGCTCAGAGGAGCTGCTCAACGACGATGTT
ATGCTGAGGCTGCACAGGCAGCCCCCAAGGGACGTATCGGTCGAGGCCTCGGGCTGCTCCTGTATGGCGTTGCATTTAG
CGGCCTCGGAGCAGCAGCAACATTCTATTCGATGGTACAAAAGGGTTTCGCCTCGTTCACCGACGCCGAGTCAGCCAAA
CTGTTTGTCCCAGATAGCGACGAGCTGCAACAAATCGAAGAGACAATCAACAAACACCCGCTCGTCCAAGAGCTTCGAT
CACGACCAGAGTTCAAGGAGTCACGACCACACCTAAAGATGTCAAGCGAAGTCCGCAGCCGCACCCTCACCGGCGGCGC
TCTACAAGGCGACGGCATGATCATGGTCCCCCCCGTCGCCTTCATCGAGGACGGCGGCAAGTCCATCGTCAGCGTCACG
TACATTGGCGACAAACTATGCGGCCACCCAGGCCTCGTGCACGGGGCCTGCTGGCGACGATGCTGGACGAGGGGCTGG
CGAGGGGCTGCTTCGACGCGCTGCCGCACAAGATTGCCGTGACGGCgagcctggagaTCAACtACCGCAAgccgac > SEQ ID NO:2470 213903 211903_300872_1
AGCTGGTCCCCTGGAGAAAGATGAGGAAAAGACCCGGAAGGAGAAAAGGGAATCGTGTGATTTAATTTGCTATGCCGGA
TCGTAGCCGTGGATGTGAGATGAGGCGGGAAGGGAGAAGCCGGAGAAGGCGGGCCTTGACACGGAGCTGAAGAATTTTC
TTTTTCTTTGTGTCGCGTGTTGTGTGCTTTGATCGTGATTCTTTTGCCGTAGCCCTTTTTTTACATACATTTGTGTGCA
TAACTATTACC
```

FIG. 2 continued

> SEQ ID NO:2471 213909 212092_300873_1
atcatctaattcaagtatgtcatatcccgcggtgtgtgatgcgatgtgatgtgattgactgatgctgatctttgtcgat
tGTTTTACTTGTAGCAAACTCAAGTATAACTTATACCTACTATTTATACCTACTCAACAGTATACTCGACCTTGTCCAA
CAAAATCAAAACAAAACAACAACCGAGGCAAATCAAATAACAAACTACCTCAAAAATGGACTCTTCACCACCAACAACC
CCAACCAAAACTCAACAATCACAAAACCTCCAGCAATCTTCTCCTCACCCCCAAGACTCCTCCCCCGCCTGCCAATCCG
CCATCAAACACTCCTCATCGTGGAAGCCCAGCTCGCTCGACCGCCGCCTCAGCTGGAGCTCCCAGGACCAGAAGCACGC
GCTGCAGATGAGCGGCATTGACGGCGTGCAGTCGGGACACCAGGGCTTTACGGAGCGATGAATGCCTTTCCATCCAGTC
GGGGTCTTTCTTTCTTTTTTTATTCTATGGAGAGAAGGTGTAGaTTGGGAATGAAAGAGGGGGAAAGAAGATGAATTCA
TAAAAACTCTATATGAGCGTGGTTTTCTTCTTCTTCTTTCTTTCTCTTTTCAATGATTTGATGAAACAAAAGGGCTATTg > SEQ ID NO:2472 213914 133475_300449_1
CGGACGCGTGGGTAACGATCACTCCGTCGTCGTCACAAATCTCAACTTCAGCTATGGAGGCACTAACCGCAAAATTTTA
TCAAATGTTAACTTCACAATAACAAAAGGGTCTCGATGTTTGCTGTTGGGGATCAATGGAACGGGAAAAACAACTTTAT
TGAGGATTTTAGCTGGAAAGCATTATCTCCCCGGTGACGAAGTGATTGTGCTCGGAAAAAATGTTTACCATCATACACC
AATGGGATTAACTTTTTTAGGTGGAGACTGGGCCACGAATCCAAATGTCCGAAAAGACATTACGGTTCAACAACTCATG
AATTCCGCTAATGGAAGCCTGCATCCCGAAAGAAGAGACCATCTTATCCAGATTCTTGATATAGATCCAACCTGGAGAA
TGCACCAAGTCTCTGATGGTGAAAGAAGACGAGTCCAAATCATGCTTGGTTTGATCGAGCCATTTGAAGTGATGCTCAT
GGACGAAGTGACTGTCGATCTTGACATATTAGTTCGACAAGATTTGCTGAATTTCTTGAAACAAGAAACTGAAACAAGA
AATGCAACTATTATTTATGCCACTCATATCTTGGATGGACTTAATGAGTGGCCTACTCATATCTCACATTTGTCCAACG
GAACTTTTACGAAAATCGTCCCTATTGAACA > SEQ ID NO:2473 213922 208006_300831_1
GAGAAAAAGAAAATAGAGAAGGGGGAGAAAAGAAGAGAGCCTCTTAGAGGATGATGCTGAATGACGCTGTGGATGGTGA
AATGTGAGATGAGCAAGGTTTGTGTTACATGTATATTAAGAGGATTTTTTCTTTTTGTGGACGGTTTTTTATATGTGAT
ATTATGGAGAAACTAGCAAGGATGGAGAAAAGGGGGAGAAAAGGAACGATAAGTTTATCTCTGTTTGGGCATGTATGGG
TGTTAATATGATTGACTTGTC > SEQ ID NO:2474 213923 207604_300827_3
tcgacccacgcgtcgcttgcattaagtagacatcattgtgtctactcccagtcatcgtcgacaACTTCTTTGATACAAG
ATTGCAAGACTCTATCCAAGTATGGCTACCCCAGGTACCGACCCCATCGAGGGACAATACAACAAAGAATCCGCGGCCG
ACGTGCCCACCAACGGGCACTATGTTTCCAATGGCATGGGCTCTGGACAGCAATTCCAGCCCCAGCAGTATCAGCAGTA
TCCGGGCTATGGACAATTTGTTCCGTTTAGCAACACCCAAGATCCTCGGGCTGGGCCTCACCAGGCCATGATCTCCCAG
GTCTACCAACCTACCCTTGGTAAGATTGGTAACCCAGGTCCTCTTGGTCTGATCGGTTTCGCTTTGACGACCTTCGTGC
TCGGACTTTACCAGTGCGGTGCTGGTCTCCCTAATTCCAACCCATTGGGCAACGTCGGCCCTGATCAAGCTGTCTTCGG
TGTGGCTGTCTTCTTCGGAGGCATGGCTCAGTTTGTTGCTGGTGTCATGGAATTTGTCCTTGGCAATACCTTCGGTTGT
ACTCTCCACTGTTCATACGGGGCTTTCTGGCTTGCCTTTGCCATGTTCTCAGTCCCTACACTGGGCATCCAGGCCGCTT
ATAACGGAGATCAACGTGCCTTtAGcTTTGCTGTTGGCAttttccTCATCATATG > SEQ ID NO:2475 213935 200372_300758_1
TCTCGACCACGCGTCGAGTAGCTGCTGTTGTGAAGCACTGCTTTCATCAAAACAAGTACTCTCCAATCACATCTGGGGT
TGGGTCCGAACAAGGTCACCACCCAACAACATTTCGCATATTCCATC > SEQ ID NO:2476 213942 220773_300938_1
GCCTTGATGGTATGATTCTTCTTGTTTTATCAATCTGAAGCAACATTGATCAGCATAATCTAATCACGATGCCCAAGTT
CTTTTGCGACTACTGCGATGTCTACCTCACGCACGACTCCATGTCGGTGCGCAAGGCCCACAACAGCGGCCGAAACCAC
CTGCGCAACGTCGTAGACTATTACCAGCAAATCGGCCACGAAAAGGCCCAGTCCGTTATTGACTCGATTACTTCTTCGT
ACGCTGCCGAGGGCCAGGCCCATGCGAACCCGATGCTTCTTCAGAACCAGCCCGGCCANGGATTTCCGGCCTTTGGCTT
CCCCGGCGGCATCCCTCCGCCATTCCCCGGTATGCCTGNAGCTCCTCCCGGCCAATTTCCCCAAGGCCTTCCACCACCT
CCCCGGCGGTCGCGGTATGCCCTCCATGC > SEQ ID NO:2477 213951 195839_300638_1
ACAAAATGCTTATGAGCGGGCCGCGGGTACCATGTCAGTGTACGGGTACTCGTACAAGTTCTCTGGACGAGCAGATGCA
ACCATCCGGCAGTCAAACTTGATGCTACTTGACCTGTAACATTTGCATTGATGAGCGGCAGCAGGGCCTGGCAACCTGG
GTAGTACTCCCAAGTATTGCCCGTACACGTCCTAACATGCGGCAGGCGATCAAGCCGTTCTCAGGGCGCTAACAAGGGG
GGGACGAGGCGCACTGGAAGCGCTGAGAACACATGCATCGTGAGGTGATGGAGTCGGTGGGCTCGGGTAGATGTACCTA
AAGGGCACATAACCTTGCCTGGCTCTTTGGTCCTGGAAGGGGTGATGTGATTTACTTTCAATGGAAGAAGCCGGATGTT
GCGACTGCTGGACCCATGTACTTGTACTTGTACGAGTATGCCAATGAGAAGAGATCAAGATGAACAAAAAGAACGATGC
CAAGAAACAAGGTCCTGAaAA

FIG. 2 continued

> SEQ ID NO:2478 213958 1008629_301417_1
GACATGGGCATCGAGAAGGAGCGAGAGAGCCTTGTCTACCTATCCAAGCTCTCCGAGCAGGCAGAACGCTATGACGAAA
TGGTGGAGTCGATGAAGAAAGTAGCTAAGTTGGATGTAGAGCTTACGATTGAGGAGAGGAATTTGCTCTCAGTGGGGTA
TAAGAATGTGATCGGAGCGCGAAGGGCCTCGTGGCGAATTCTCTCCTCCATTGAGCAGAAAGAAGAGAGCAAGGGCAAT
GAGACCAATGTAAAACGCATCAAGGAGTACCGCAACAAAGTGGAGGAAGAGCTTTCCAAGATTTGCAGTGACATCCTAA
CTATCATCGATGAGCATCTTATCCCCTCATCTGGCACAGCAGAATCTACCGTTTTCTATTACAAAATGAAAGGGGATTA
TTATCGCTACCTTGCTGAGTTCAAGACAGGACATGAGAGAAAGGAAGCTGCAGATCAATCTCTGAAAGCTTATCAGACT
GCAAGTGACACG

> SEQ ID NO:2479 213958 1096679_301432_1
GCTGTGTTTATCTTCTTCGCCTTCGTGTTCGTCGGTGGTGTTGGTAGTGGGAAGATGGGTGTGGAGAAGGAGCGTGAGA
GTGATGTGTACATGGCTAAGCTCGCTGAGCAGGCGGAACGTTATGATGAGATGGTGGAATTCATGAAAAAGGTGGCAAA
CTTGGATGTGGAGCTATCTGTAGAGGAGAGGAATCTGATGTCAGTTGGGTACAAGAATGTGATTGGGGCACGGAGGGCC
TCTTGGCGCATCCTCTCCTCCATCGAGCAGAAGGAGGAGGGAAAAGGCAATGAAGTGAATGCCAAGCGCATCAAAGAAT
ACAAGCACAAGGTCGAGGAAGAGCTTTCAAACATCTGCAACGATGTCCTCTCCGTTATTGAGGATCATCTCATCCCTGC
GTCTAGCACGGGGGAATCTTCTGTCTTCTATTACAAAATGAAAGGGGATTACTTCCGATAtntggCAGAGTTTAAATCT
GGAAAtgagaaGaaggAAGccggAgAGCAGTCtttGAAAGCAtaccaggCtgctAtggACATAgcGAcAtct > SEQ ID NO:2480 213958 1096683_301432_1
GTATGCTCACAGCTCACCTCACTCCTCTTTATTTTTAGGGTTCATTGGAAGGAAGAGAGAGAGAGAGAGAGAGAGAGAG
AGAGTCTTGCTGCACCAACCCAACCCAAGGAGCTCTTCTTTGTGTTCTACTCCCATGGGTATTGAGAAGGAGAGAGAGA
GCCATGTCTACATGGCCAAGCTTGCTGAGCAGGCAGAGAGATATGATGAAATGGTGGATTCCATGAAAAAGATTGCCAA
GTTGGACGTCGAGCTGACCATTGAGGAGAGAAATCTGCTTTCCGTGGGCTATAAAAATGTGATTGGGGCTCGGAGGGCC
TCGTGGCGAATCCTCTCCTCAATTGAGCAGAAAGAGGAGAGCAAGGGCAATGAAACAAATGCCAAGCGCATTGAGAGTT
ACCGACATAAGGTTGAGGAAGAACTCTCTGGAATCTGCAAGGACATCCTGACTACCATCGATGAGTATCTCATCCCCTC
GTCTGGCACGGCGGAATCCACCGTT > SEQ ID NO:2481 213958 215392_300880_1
gaaccGCGTCTCATCGCACCTGCCATAAAACTCCAAAAAATCTCAAAAACCAACCGTCAAAATGGGTCACGAAGATGCT
GTTTATCTGGCCAAGCTCGCCGAGCAGGCCGAGCGATATGAGGAGATGGTCGAGAACATGAAGATCGTCGCCTCCGAGG
ACCGCGACCTGACCGTCGAGGAGCGCAACCTCCTCTCCGTCGCCTACAAGAACGTCATTGGTGCCCGCCGTGCCTCTTG
GAGAATAGTCACTTCCATCGAGCAGAAGGAGGAGTCTAAGGGCAACTCTTCCCAGGTTACCCTTATCAAGGAGTACCGC
CAGAAGATTGAGGCCGAGCTTGCCAAGATCTGCGATGACATTCTCGATGTTCTTGACAAGCACCTGATTCCTTCTGCCA
AGTCTGGAGAGTCCAAGGTCTTCTACCACAAGATGAAGGGTGACTACCACCGTTACCTTGCCGAGTTCGCCATTGGCGA
CCGCCGCAAGGACTCCGCCGACAAGTCTCTCGAGGCTTACAAGGCTGCTACCGAGGTTGCCCAGACCGAGCTGCCTCCT
ACCCACCCTATCCGCCTGGGTCTTGCGCTCAACTTCTCCGTCTTCTACTACGAGATCcTcaaCgccCCtgaccaggCTt
gccacctcgctaagcaggCatTTGACGATGCTAtt > SEQ ID NO:2482 213958 207425_300805_1
AGCCGAATTTGAACTCCACCTGAGCACAGGAGAAGCCGCAGCCACTGAGATTTGACCTTCTGTTTCTACCAGAAAAACA
CAAACAGTGAAGATGTCGCAGCCTGCTGAGCTTTCCCGTGAGGAGAATGTGTACATGGCTAAGCTTGCAGAGCAGGCCG
AGAGGTATGAGGAGATGGTTGAGTTCATGGAGAAGGTTGCTAAGACAGTTGACTCTGAGGAGCTCACTGTTGAGGAGCG
CAACCTTCTATCAGTTGCTTACAAGAATGTTATTGGTGCTCGCCGTGCGTCATGGCGGCATCATATCATCCATTGAACAG
AAGGAAGAGAGCCGTGGTAATGAGGATCGTTGCACGCTCATCAAGGAATACAGGGGAAAGATTGAAACTGAGCTCTCCA
AGATCTGTGATGGCATCCTCAAGCTTCTTGACTCCCACCTTGTGCCTTCATCCACTGGTCCAGAGTCCAAGGTCTTCTA
CCTCAAGATGAAAGGCGACTACTACAGGTACCTCGCAGAGTTTA > SEQ ID NO:2483 213958 207414_300805_1
GTACGAGACCACTCGAACCCGACCCGCCTCGCCGCCGCCGCCACCGAAGTAATCCCTTAATTGGTCAAAATGTCTCGGG
AGGAGAATGTCTACATGGCCAAGCTGGCCGAGCAGGCTGAAAGGTATGAGGAGATGGTTGAGTACATGGAGAAGGTTGC
AAAGACTGTAGATGTGGAAGAGCTCACTGTTGAGGAGCGCAACCTCTTGTCTGTTGCTTACAAGAATGTGATTGGTGCC
CGCCGTGCCTCCTGGCGTATTGTCTCATCCATTGAACAGAAGGAGGAGGGTCGTGGCAATGAGGAACATGTTACTCTGA
TCAAGGAGTACCGTGGCAAGATTGAGCTGAGCTGAGCAAGATTTGCGATGGTATCCTGAAGTTGCTTGACTCACACCT
TGTGCCCTCATCTACTGCTGCAGAATCTAAGGTGTTTTACCTCAAGATGAAGGGTGATTACCACAGGTACCTTGCGGAA
TTTAAGACTGGTGCCGAGAGAAAGGAAGCTGCTGAGAGCACAATGGTGGCTTACAAGGCTGCTCAGGATATTGCTCTGG
CGGATCTTGCTCCCACCCATCCCATA

FIG. 2 continued

> SEQ ID NO:2484 213958 202218_300731_1
CAAAATTTCCGACGCCAGAGCGCGAGGAGACGCACACAGAGACTTGGCATTTGTAGAGTTTTTAGATTTATAGATAGCA
AAGATGTCGGCACAGGCGGAGCTTTCCCGTGAGGAGAATGTGTACATGGCCAAGCTCGCTGAGCAAGCCGAGAGGTACG
AGGAGATGGTCGAATTCATGGAGAAGGTGGCCAAGACGGTTGACTCTGAGGAGCTCACCGTGGAGGAGCGCAACCTCCT
GTCTGTTGCATACAAGAATGTGATTGGAGCCCGCCGTGCGTCATGGCGCATTATCTCCTCCATTGAGCAGAAGGAGGAA
AGCCGTGGTAACGAGGACCGTGTCACACTCATCAAGGACTACCGTGGCAAGATCGAGACTGAGCTCACCAAGATTTGCG
ACGGCATTCTCAAGCTGCTTGAATCCCACCTTGTCCCCTCTTCCACTGCCCCTGAGTCCAAGGTCTTCTACCTCAAAAT
GAAGGGTGACTACTACAGGTACCTTTGCCGAATTTAAGACCGGGGGCTGAGAGGAAGGATGCTGCTGAGAATACCATGG
TGGCATACAAGGCTGCTCAGGACATTGCTTTGGCTGAGCTGCCTCCTACTCATCCAATTAGGCTTGGGCTTAGCTCTTA
ACTTCTCAGTGTTCTACTATGAGATCCTCAA

> SEQ ID NO:2485 213958 182045_300628_1
GAATTCAAGATCATGTTTCTATTATTAAAGAATATAGGGGAAAGATTGAATCTGAACTTCATAAGATTTGTCAAGCGGAT
TTTAGGGCTTTTGGATTCCCATCTTATTCCTTCATCAACTGCTGCTGAATCTAAGGTGTTTTACCTTAAGATGAAGGGT
GATTACCACAGGTATTTGGCTAAGTTAGCTGAACAAGCTGAACGATATGAAGAGATGGTTGAATTTATGGAGAACGTTG
CAAAAACTGTTGATTCTGATGAATTATCAGTTGAGGAACGAAACCTGTTGTCTGTTGCTTATAAGAATGTGATTGGAGC
TAGGAGAGCTTCATGGAGGATTATTTCAAGTATTGAACAAAAGGAAGAAAGCCGTGGGAATGAAGATCATGTTTCTATT
ATTAAAGAATATAGGGGAAAGATTGAATCTGAACTTCATAAGATTTGTCAAGGGATTTTAGGGCTTTTGGATTCCCATC
TTATTCCTTCATCAACTGCTGCTGAATCTAAGGTGTTTTACCTTAAGATGAAGGGTGATTACCACAGGTATTTGGCTGA
GTTTAAATCTGGTAGTGACAGGAAAGAAGCTGCTGAGAGTACATTG

> SEQ ID NO:2486 213958 158868_200020_1
gttataaatccttatctttttcaacacacagattaaaatcttcagaaagagagagagagatcccaaaatgggtgaacgt
gAGAACTtcgTaTACAtagcTAAGCTtgCCGAGCAAGCTGAACGCTATGATGAGATGgctgatGcGatGAAGAATCTTG
CAAATATGGATGTTGAATTGACAGcGGAAGAGAGGAATTTGTTTTCTGTTGGTTATAAGAATGTGGTTGGAGCTAGGAG
AGCATCGTGGAGGATCTTGTCTTCCATCGAGCAgaaggAAGAGTCTAGAGGAAATGAGCAGAACGTGAAGCGGATTAAG
GAGTACCAgcaaAAAgTGGAGTCAGAGCTCACCGACATTTGCAATAATATCatGACCgcgat > SEQ ID NO:2487 213958 157176_301735_1
agccaagtgaaagcaAAAAGGGAGAGGAAAAGCGCAAAATCTCCCTTCGATTATCAGTACAAAACCTCTGATTTGAGAG
ATCGGAAATGGCTTCCTCCAAAGAACGCGAGAACTTCGTCTACGTCGCTAAGCTTGCTGAGCAAGCTGAACGCTACGAT
GAAATGGTTGATGCGATGAAGAGTATAGCAAATATGGATGTTGAATTGACTGTTGAGGAAAGGAATCTGCTTTCTGTTG
GTTATAAGAATGTGGTAGGTTCTAGGAGAGCATCTTGGAGGATCTTATCCTCTATTGAGCAGAAGGAAGAATCTAGAGG
AAATGAGCAAAATGTCAAGCGAATTAAGGAGTACCGACAAAAGGTGGAGACAGAGCTCACCAGCATTTGCAACGATATC
ATGGTGGTCATTGATCAGCATCTAATTCCTTCATGCACTGCAGGCGAATCAACTGTGTTTACCACAAGATGAAGGGAG
ACTATTATCGTTATCTTGCAGAATTTAAATCTGGCAATGACAAGAAAGaggttGCAGAGCTTTCACTGAAAGCATATCA
GTCAGCTACAACTGCTGCAGAggCGGAATTACCACCCACTCATccTAttaggttGGGATtGgCtttTGAatttCTCTgtg
ttcTACtacgaGatcATGAAttcgcctG > SEQ ID NO:2488 213958 154702_301351_1
AAAATTAAAAATAAAAAATACCCGGCGAATCTCCGACGATGGCTTTGCCGGAAAATTTAACCAGAGAGCAGTGCCTATA
CTTAGCAAAGCTCGCCGAGCAAGCCGAGCGTTACGAGGAGATGGTAAAATTCATGGACCGACTCGTAGCTGTCTCGGCT
TCCTCTGAACTAACCGTAGAAGAGCGAAACCTCCTCGGTACGCTTATAAGAACGTCATCGGTTCACTTCGAGCCGCGT
GGAGGATAGTATCGTCAATTGAGCAAAAGGAAGAAGGTAGGAAGAACGAGGAACACGTGGTTCTAGTGAAGGATTATAG
ATCTAAGGTTGAATCTGAGCTTAGTGATGTATGTGCTGGAATTTCGAAGATTTCGGATCAGTATTTGATTCCTTCGGCT
TCGGCTGGTGAATCGAAGGTGTATCACTTGAAGATGAAGGGAGATTATTATCGTTATTTGGCTGAATTTAAAGTTAGTA
ATGAACGTAAGGAGGCTGCTGAGGCCACTATGCTTGCCTACAAAGCTGCTCAGGACATTGCG > SEQ ID NO:2489 213958 147127_301205_1
atactccccagatctcaaaaattcaaacattacaaccaaaaagaaaAGAGATCCCTAATTATGGCGCGTGAGGAGAACG
TGTACATGGCGAAGCTTGCCGAGCAAGCTGAGAGATACGAGGAAATGGTGTCGTTCATGGAGAAAGTTTCTACTTCCCT
AGGGACGTCAGAGGAACTCACGGTAGAGGAGAGAAATCTCCTCTCGGTGGCGTACAAAAATGTTATCGGGCTCGTAGA
GCCTCGTGGCGTATAATCTCCTCCATCGAACAGAAGGAGGAGTCGAGGGGAAACGAGGACCATGTGAAATGCATTCAGG
AGTACAGATCTAAGATTGAATCTGAACTCTCCAATATCTGTGATGGCATTCTCAAGCTCCTTGATTCTTGTCTTATTCC
TTCTGCTTCAGCTGGTGATTCTAAGGTGTTTTACCTTAAAATGAAGGGTGATTATCATCGTTATTTGGCTGAGTTTAAG
ACTGGTGCTGAACGTAAGGAAGCCGCTGAGAGTACTCTCTCCGCCTACAAAGCCGCTCAGGATATTGCAAATGCTGAAC
TTGCCCCAACTCACCCAATCCGACTTGGACTGGCTCTCAACTTCTCTGTGTTTATTATGAGATTTGAACTCTCCTGA
TCGTGCCTGCAATCTTGCTAAACAGGCCTTTGACGAAGCAATTGCTGAATTGGACACACTGGGAGAGGAGTCTTACAAG
GATAGCACTTTGATCATGCAACTGCTTCGTGACAATCTTACTCTCTGGACCTCTGATATGCAGGATGATGGCGCTGATG

FIG. 2 continued

AAATCAAGGAAACCAAAGCTGACAATGAACAACAGTGAGGAAACTGCCCCTCATATTGTCTTTTGACTTCTTCCTGTTG
GTTTTTATTGGGAGAAGCTGTTTCCTTTTATTTCCTTTTTAATGTGGTTTCCCTTcagcgTTCTCTTATCCGTCGCAAT
AACAACTTTGACAATTGATGTTCAATGATTTTATCTTTATTTT > SEQ ID NO:2490 213958 142802_300444_1
CAGCTCTCTCTCTCTCCCTTCAAACATCGATGGCGTCGTCGCGCGATGAGTTCGTGTACATGGCGAAGCTTGCGGAGCA
AGCTGAGCGGTACGAGGAGATGGTAGAGTTTATGGAGAAGGTCGTAACCGCCTCGGACGGCGGCGAGGAACTCACCATC
GAAGAACGTAATCTTCTATCCGTAGCATACAAAAACGTGATCGGAGCACGACGAGCCTCGTGGCGAATCATTTCCTCAA
TCGAGCAAAAAGAAGAGAGCCGAGGCAATGAGGAGCACGTGACCTCTATTAAAACTTACAGATCTAAGATCGAGTCGGA
GTTGACCTCGATCTGTGACGGTATCCTCAAGCTGCTCGATTCGAATCTCATTGGCGCTGCGTCAATCGGAGATTCTAAG
GTGTTTTATTTGAAAATGAAAGGAGATTATCACCGGTATTTGGCTGAGTTTAAGACCGGAGCTGAGAGAAAGGAAGCTG
CTGAGAATACTCTTTCGTCTTATAAGTCCGCTCAGGATATTGCAAATGCGGAACTGGCACCTACACATCCTATTCGATT
GGGGCTAGTTCTCAATTTCTCTGTATTTTACTATGAGATATTGAATTCACCTGATCGTGCTTGTAATCTG > SEQ ID NO:2491 213958 13783_300270_1
CCCACGCGTCCGAGAAGAAGAAGAAGAAGAAGAAAAAACTATGGAGAATGAGAGGGAAAAGCAGGTTTACTTGGCTAAG
CTCTCCGAGCAAACCGAAAGATACGATGAAATGGTGGAGGCGATGAAGAAAGTTGCTCAGCTTGATGTGGAGCTAACTG
TGGAAGAGAGGAATCTTGTATCTGTAGGGTACAAGAATGTGATTGGTGCAAGGAGAGCATCATGGAGAATACTATCTTC
CATTGAGCAGAAGGAAGAGTCCAAGGGAAATGATGAAAATGTCAAGAGGCTTAAGAATTATCGTAAGAGAGTTGAAGAT
GAGCTTGCTAAAGT > SEQ ID NO:2492 213958 1171669_302055_1
GAACAATGGGTGCCGAGAAGGAGAGGGAGGGTCATGTCTACCTGGCCAAGCTTGCAGAGCAGGCTGAGCGTTACGATGA
GATGGTCGAGTTCATGAAGAAGGTAGCCAAGCTTGACATTGAGCTGACTGTGGAGGAGCGCAATCTTCTCTCAGTGGCC
TATAAGAATGTGATTGGAGCACGTAGGGCCTCTTGGCGTATTCTCTCCTCCATTGAGCAGAAGGAGGAGAGCAAAGGGA
ATGAGGTTAACGTGAAGCGTATAAAGGATTACAGGCAAAAGGTCGATGAGGAACTCTCGAAGATCTGCCATGACATTTT
GACTATCATAGATGAGCATCTCATCCCCTCTTCTGGGACTGGCGAATCGTCTGTCTTCTACTACAAAATGAAGGGAGAT
TACTACCGCTACCTCGCAGAGTTCAAAGCTGGTCCGCAGAAAAAGGAAGACGCAGATGAGTCCTTCAAAGCCTACCAAG
CTGCGTCGAGCA > SEQ ID NO:2493 213958 114419_300008_1
caaaagtccaaatttcccccacaaaagctctcctctctgaattattaaatccccattcAGAAAATCGAAAAACTCCCT
CATTCAGATCTCCCAAAAAATACAGAGAAACAAATCTAAACATGGCGGTGGCACCGACGGCGCGTGAGGAGAACGTGT
ACATGGCAAAGCTTGCAGAGCAAGCTGAGAGGTACGAAGAAATGGTTGAATTCATGGAAAAGGTCTCCAACTCCCTCGG
CTCAGAAGAACTCACCGTGGAAGAACGAAACCTCCTTTCCGTGGCGTACAAGAACGTGATCGGAGCGCGTAGGGCATCG
TGGCGTATTATCTCATCGATTGAGCAAAAGGAAGAGTCCAGAGGGAACGAGGAACACGTGAACTCTATCCGCGAGTACA
GATCTAAGATTGAGAATGAGCTCTCTAAGATCTGTGATGGCATTCTGAAATTGCTCGATGCAAAGCTTATCCCATCTGC
AGCATCTGGTGATTCTAAGGTGTTTTACCTGAAAATGAAAGGAGATTACCACCGCTATTTGGCTGAGTTCAAGACCGGT
GCTGAACGTAAGGAGGCTGCTGAGAGTACACTCACTGCCTACAAAGCTGCTCAGGACATTGCAACTACTGAACTTGCCC
CAACACATCCCATCCGACTTGGACTGGCTCTTAACTTCTCTGTGTTTTACTATGAGATCTTGAACTCTCCTGACCGTGC
TTGCAATCTTGCTAAACAGGCCTTTGATGAAGCAATTGCTGAGCTGGATACATTGGGCGAGGAGTCTTACAAGGATAGC
ACTTTGATCATGCAACTTCTTCGTGACAATCTCACTCTCTGGACTTCTGATATGCAGGATGATGGGGCTGATGAAATCA
AgGAAGATCCCAAACCTGATGAAGCCAAAAATTGAAGGAAATGAAACTCTCTAATTTGCTTTTCACTTCTTCCTGGTTG
TTTTTATTGGAAGAAGCTGATTATCGTAATTTCCTTACTATTATGGTTCTCcACTAGGGGTTGTCATCTTATTGGAAA
TGAACAACTTTTAATATTGATGTttcagagttccATCTTTGATttaaTgtggttttTCTGgtgattagttttTCttCT > SEQ ID NO:2494 213958 1119703_301900_1
AAAAAATCAGAGAAGTGAAGAGAAGAGATCAAGGGATCGATCCTTGAGAAGGCAATGGGAATCGAGAAGGAACGTGAGA
CCCTCGTCTACCTCTCTAAGCTCGCTGAGCAAGCTGAGCGCTATGACGAAATGGTGGAGTCAATGAAGAAAGTGGCTAA
GTTGGACATTGAGTTGAGTGTGGAGGAAAGAAATCTGCTCTCCGTTGGATACAAGAATGTGATCGGAGCACGCAGGGCC
TCCTGGCGCATCCTCCTTCGAGCAGAAGGAAGAGCAGCAAGGGCAATGAGACAAATGTGAAGCGCATTAAGGACT
ATCGCTTCAAGGTGGAGGAAGAGCTCTCCAAGATATGCAGCGACATCCTAACCATCATCGATGAGCACCTCATCCCCTC
ATCCAACACCGCTGAATCCACTGTTTTCTATTACAAAATGAAAGGGGATTATTATCGATACCTTGCGGAGTTCAAGTCT
GGGCA > SEQ ID NO:2495 213958 1117183_301818_1
TACAAATCCTCGACTGTGAAAGGAGCTTTCGCCATCTCTCTCCATGGGAATCGAGATGGACCGCGATGGGAATGTCTAC
ATGGCCAAGCTCGCTGAGCAAGCCGAACGCTATGATGAGATGGTGGAGTTCATGAAGAATGTGGCGAATATGGATACGG
AACTGACTGTGGAGGAGCGCAACCTATTCTCCATAGGATATAAAAATGTGATCGGAGCTCGTCGGGCTTCCTGGCGCAT

FIG. 2 continued

TCTCTCCTCCATTGAGCAGAGAGAGGAGAGCAAGGGCAACGAGGTGAATGCGAATCGCATCAAGGAGTACCGTAACAGA
GTCGACGAAGAGCTCTCCAAGATCTGCAAAGATGTCCTGAGCATCATCGATGATCATCTCATCCCCTCTTCCACAACCA
AAGAATCTGAGGTCTTCTATTACAAAATGAAGGGTGATTATTACCGCTATTTGGCTGAGTTTAAGGCTGGTAGCGAGAG
GAAGGATGCGGCAGATCACTCCCT

> SEQ ID NO:2496 213958 2003_300335_1
AATTCGGCACCAGAATCCATCCTCTTTCGCTTAAACTTTCTCTCTCTACAACAACAATGTCGGCTCTGCTCACAGAAAA
TCTCAGCCACGAACAATACCTCTACTTAGCCAAGCTCGCCGAACAAGCCGAACGCTATGAAGAAATGGTCCAGTACATG
GACAAACTAGTCCTCAGTTCCACTCCGGCCGCCGAACTCACCGTCGAGGAACGAAACCTCCTTTCCGTCGCTTACAAAA
ACGTGATCGGCTCTCTTCGTGCCGCGTGGCGTATCGTATCCTCCATTGAGCAGAAAGAGGAATCGCGCAAGAACGAAGA
ACACGTGTCGCTCGTTAAGGAGTACAGAGGTAAAGTCGAGAATGAGTTAACGGAG

> SEQ ID NO:2497 213958 187967_300682_1
CCCACGCGTCCGCTCCACCTGAGCACAGGAGAAGCCGCAGCCACTGAGAAAAACACAAACAGTGAAGATGTCGCAGCCT
GCTGAGCTTTCCCGTGAGGAGAATGTGTACATGGCTAAGCTTGCAGAGCAGGCCGAGAGGTATGAGGAGATGGTTGAGT
TCATGGAGAAGGTTGCTAAGACAGTTGACTCTGAGGAGCTCACTGTTGAGGAGCGCAACCTTCTATCGGTTGCTTACAA
GAATGTTATTGGTGCTCGCCGTGCGTCATGGCGCATCATATCATCCATTGAACAGAAGGAAGAGAGCCGTGGTAATGAG
GATCGTTGCACGCTCATCAAGGAATACAGGGGAAAGATTGAAACTGAGCTCTCCAAGATCTGTGATGGCATCCTCAAGC
TTCTTGACTCCCACCTTGTGCCTTCATCCACTGCTCCAGAGTCCAAGGTCTTCTACCTCAAGATGAAAGGCGACTACTA
CAGGTACCTCGCAGAGTTTAAGACTGGAGCTGAAAGGAAGGATGCTGCTGAGAACACCATGGTGGCATACAAAGCCGCT
C

> SEQ ID NO:2498 213958 1107094_301504_1
GGTGAAAGAAGCTTGCAGGCCATGGGGACGGAGAAAGAGCGCGAGAAAAATGTGTACATGGCCAAGCTTGCTGAGCAGG
CAGAGCGTTATCAAGAGATGGTTGAATACATGGAAACAGTGGCCAAGCTTGATCTTGAGCTAACTGTGGAGGAGCGCAA
CCTTCTGTCTGTTGGCTACAAAAATGTTATTGGAGCCCACAGAGCCTCTTGGCGTATCCTTTCTTCCATTGAACAGAAA
GAAGAGAACAAGGGCAATGAGACTAATGTGAAGCGTACCAGGGATTATAGGCATAAAGTTGAGACAGAACTTACCAAGA
TTAGCAGTGAAATTTCGACTATCCTTGATGAGCATCTCATCCCCTCATCGGGAACTGGCGAATCATCTGTCTTCTACTA
TAAAATGAAGGGCGACTACTACCGTTAC

> SEQ ID NO:2499 213958 1099978_301489_1
GAAGAAGAGGAGGGAGAAGGCATGGGTGTGGAGAAGGATCGCGATGGCCATATCTACATGGCCAAGCTCGCTGAGCAGG
CCGAACGATACGATGAGATGGTCGATTTATGAAAAAGGTGGCAAACATGGATGTGGAGCTCACTGTGGAGGAGCGGAA
TCTTTTATCAGTAGGCTACAAAAATGTGATTGGGGCCCGCAGGGCTTCGTGGCGTATTCTCTCCTCAATTGAGCAAAAG
GAGGAAGCCAAAGGCAATGAGCAGAATGTGGGGCGTATCAAAGACTACAAGGAAAAGGTTGAGGAAGAGCTCTCAAAGA
TCTGCATTGACATCTTGTCGACTATCGATGATCATCTTATCCCTGCATCCAGCACTGACGAGTCTTCTGTGTTTTATTA
CAAAATGAAAGGGGATTACTTCCGCTATTTAGCAGAGTTCAAAGCCTCAAGCGAGAAAAAAGATGCTGCAGAGCAGTCT
CTGAAAGCATACCAGGTTGCAGCAGATAAAGCAGCCAAGAGTCTTCCAACAACTAATCCGATCAGGCTTGGGCTTGCTT
TgAACTTTTCAGTTTTCTACTATGAAaTCATGaactcCCCTGAAAA > SEQ ID NO:2500 213958 232468_301215_1
tcgacccacgcgtccgggcggcagcgcacggcgaGGAACAGGTGAGTGCCCGTGGATGTGATCTAGATCTACCCTCCAA
GCCCCAAAATCTCAGTAGAAATCCTCCAAATCGCGCCGCCGGAAGAGAGATCCAATCCACCACTGTCCCCATTTCTCGG
CTTGTTCCAGGGATGTCGAATCTTCGCGAGGAGAATGTCTACATGGCCAAGCTCGCGGAGCAGGCCGAGCGCTACGACG
AGATGGTGGAATTCATGGAGAAGGTGGTCAAGGCCGTGGACGTGGAGGAGCTGACGGTCGAGGAGCGGAATCTCCTGTC
GGTGGCCTACAAGAACGTGATCGGCGCCCGCCGGGCATCGTGGAGGATAATCTCCTCCATCGAGCAAAAGGAGGAATCC
AAGGGCAACGACGACCACGTCTCGATGATCAAGGAGTACCGTGCCAAGGTGGAGTCGGAGCTGAGCACCATTTGCGACA
GCATCCTCAAGCTGCTGGACAGCCATCTCATCCCCTCATCGTCCAGTGGCGAGTCCAAGGTCTTCTACTTGAAGATGAA
GGGTGACTACCACCGATACTTGGCCGAGTTTAAGACCGGGGCCGAGAGGAAAGAGGCCGCGGAGAACACTCTCCTCGCC
TACAAGTCGGCCCAGGACATCGCTCTCACACAGCTGCCGCCGACGCACCCCATCCGGCTGGGTCTCGCTCTCAATTTTT
CGGTCTTCTACTACGAGATTTTGAATTCGCCCGATCGAGCTTGTACg > SEQ ID NO:2501 213958 50603_300172_1
AGATATACATACTCGGATCAGTCGTCAAAAGCTTTGGAATTTGATACTTTTGATTTTTCGAGAATCTTGAAAATCAGTC
ATGGGTTCTGGAAAAGAGCGTGACACTTTCGTCTACCTCGCTAAGCTCTCTGAGCAAGCTGAGCGTTATGAAGAAATGG
TGGAATCAATGAAAAGTGTTGCGAAATTGAATGTTGATCTGACGGTGGAAGAGAGGAACTTACTCTCTGTGGGTTACAA
GAACGTGATTGGTTCAAGGAGAGCTTCGTGGAGGATCTTCTCGTCGATT

FIG. 2 continued

> SEQ ID NO:2502 213958 252933_301610_1
TGGTTGTTATTGTTGTTGCTGTGTTTATCTTCTTCGCCTTCGTGTTCGTCGGTGGTGTTGGTAGTGGGAAGATGGGTGT
GGAGAAGGAGCGTGAGAGTGATGTGTACATGGCTAAGCTCGCTGAGCAGGCGGAACGTTATGATGAGATGGTGGAATTC
ATGAAAAAGGTGGCAAACTTGGATGTGGAGCTATCTGTAGAGGAGAGGAATCTGATGTCAGTTGGGTACAAGAATGTGA
TTGGGGCACGGAGGGCCTCTTGGCGCATCCTCTCCTCCATCGAGCAGAAGGAGCGAGGGAAAAGGCAATGAAGTGAATG
CCAAGCGCATCAAAGAATACAAGCACAAGGTCGAGGAAGAGCTTTCAAACATCTGCAACGATGTCCTCTCCGTTATTGA
GGATCATCTCATCCCTGCGTCTAGCACGGGGGAATCTTCTGTCTTCTATTACAAAATGAAAGGGGATTACTTCCGATAT
TCGGCAGAGTTTAAATCTGGAAATGAGAAGAAGGAAGCCGGAGAGCAGTCTTTGAAAGCATACCAGGCTGCTATGGACA
TAGCGACATCTAGCCTTCCGACGACTCATCCGATCAGGCTTGGTCTTGCTCTCAACTTCTC

> SEQ ID NO:2503 213958 279316_200061_1
GAGAATGCATTCTATTTCGCCTAAACTTTCCTCTCTCTACAACAACAACAATGGCGGCTCTGCTCACAGACAATCTCAA
CCGCGAACAATACCTCTACTTAGCCAAACTCGCCGAACAAGCCGAACGCTATGAAGAAATGGTCCAGTACATGGACAAA
CTAGTACTCAGTTCCACTCCCGCCGCCGAACTCACCGTCGAGGAACGAAACCTCCTTTCCGTCGCTTACAAAAACGTGA
TCGGCTCTCTTCGTGCCGCGTGGCGTATCGTATCCTCCATTGAGCAGAAAGAGGAATCGCGTAAGAACGAAGAACACGT
TTCGCTCGTTAAGGAGTACAGAGGTAAAGTTGACAATGAGTTAACGGAGGTTTGTGCTGGTATCCTCAAGTTGCTTGAG
TCAAATCTCGAGCCGGCTGCTTCTACAGGTGAATCGAGGGTGTTCTACCCTCAAAATGAAAG

> SEQ ID NO:2504 213958 258777_301699_1
AAATCCTGAATTGCACCAACTAGTACAACGACAACAATGTCTTCTGAGAGAGAAACCAAGACCTTCCTTGCCCGGCTCT
GTGAGCAGGCTGACCGATACGACGAGATGGTCAACTACATGAAGGACGTCGCTAAGTCCGGTGAGGAGCTTACTGTCGA
CGAGCGAAATCTGGTTTCCGTCGCTTACAAGAACGTTATCGGCGCTCGACGAGCCAGCTGGAGAGTCATTTTCCCCATA
GAGCAGAAGGAGGAGGCCAAGGGTGGCACCCACCATCCGAGCTTCTCAAGACCTACAGAGCCCAGATTGAGGGAGAGC
TCGAAGACATCTGGAGCGATGTTCTTGATATTCTCAACAAACAACTCCTCCCCAAAGGCGAGAACGCCGAGTCTAAGGT
CTTCTACTACAAGATGAAGGGTGACTACCATCGATACCTTGGCGAGTTCACCTCCG

> SEQ ID NO:2505 213962 210926_300963_1
AGCTGGATTACGAACGAGGATTGGGAGCATTCAAAATTCACATTGTCAACCACGCATCGCAGCACCTATACGTGCATTT
TCGACTATGGCCTCCAACAAGGATGCGCCAGCTGCGATTAAACGCAAGGACCTCTACGAGGCCCTGAGGCTCTCGCGAC
TCCCAGATGAGCAGAGCGGCTCACAGGATCCCATCAAGAGATTCGTCAGTCGTACACCAGCCTGGAGGCCTGGGAATGA
GCTGCCATGGGGATCAATCGACTCTGAAGGGTATAAGAAGGCAACACGGTTGACTTTAACCCGGCTGCGTTTGGAGGC
CACGTCTTCGCCCAGGCACCCTTGGCGGCTGCGAGAGCGGTGGAGGAAGAAGAGAATGGCAATGGCAATGGCAATGACA
AACTAGGCATTCATTCCATCCAAGGCGTCTTTACAAAAGCGGGCGCGATTGATCGGCCATTCATCTATGATGTGACAAA
TGTCCACTCAAGCCGTTCATTCACCACCAAGCTGGTCCAGGCACGGCAGCCCACAGAGGCTTCAGATGCTCCGAATGgc
cCATTCCCCGAGTCTGATGCGAATCGGCCGCTGGGCCCCGTCAGTTTcacctGTCTCACAACGTTCAAGCGTCCCATTC
CCATGCCatcgcCCGCAGAGCTGCAGATCaaagggTcggCAcaggaaCGCTat > SEQ ID NO:2506 213981 206006_300804_1
GTATGTAGATGAATTTGAATTATATACAGTTAATAATATACCGCCCCAAGCCGGATACCCACCCAGCTCCTCTTAAGCC
ATACCTGTTTTAACCACTGTACACTAATGATAATACGTGAAAAATAGAAAAAACCCTGCCCAATAAAAGAAAAAAGTCA
TCCTAGACTTAAAACAGCGTGCAAGCAGTGGCGTTGAGCTGAGTGCAGTAAGTCATCTGGATGGGGAACGCGCTGACCC
CACGGGCAAGCAAGCGTTCTCGGAACTCGTTCAGACGAGGAACAACGTCCAGCTGGCTGCGCTGTTGGCCAGAGGCATC
GGTATTGCCGGACCACCAAACCTCACCGGCGGCGCTGCCACGAGGCCAGATGATGTTGTCCAGGTTGCTGGCGTCAATC
ATCTCGCTCCATATGGCAAGCTCTCCTCCCAGGACGTTCTTGGCAGCCGAAGCGGACACGTTGGCTGCAGGGTCGTGAG
AGTAGATGAGCCTCCAGTTCTTGGTGGGCTGGCACCAGTCGTTGAATGGGTAGTAGGTGTTGTAGGAGTCTCCTGGAGG
GAAGTTGACCCATTGACCgcgg > SEQ ID NO:2507 213983 205220_300797_1
GAGGAATAAGACAAGAAGGAATACAAGACTCCAAGATGCATCATCAGCTTCTCACTCTCACCGCTGCTGCTGGCCTCCT
CGCGACGGCCTCAGCTACCTACTCGAAGCTTCCCAGTGTCAATGTGCCTTCATGTCCTCGTGTTGGCACGATTAGCTAC
AGCAAGTCAGTGCCCGACCTGACGCCCTTCCCGCTCACA > SEQ ID NO:2508 214010 217129_300905_1
GAACTTCTTTTCATCCAGGCAGCCAAAAAGGGCAGTGCAAGGCAGGCATCGTCAGTTGCAGCGCGGGTGATTGGCTCAT
CCGCCGGGCTCTTTTTTTGCCCTTCGACTTGCTTTGATGCCCGGAGGGATGTGAATCCAAAGAGAGGCGACCTGCCCAA
AGAGGGAAACAGGGCAACGTGAGCGGGTAGATTCGCAGCTAGGAACAGGACAAGCATCACACATGTATGTAAGATGGTC
ACTCCGGCCCTTGCTCGGAATCAACCGCGGGGACCCGTGTGAGCAAAGATAGATACCGTATGAATATATCGTATCCTAG
GAT

FIG. 2 continued

> SEQ ID NO:2509 214014 206406_300822_1
atcaactcattgaatacAATTTACAACAGCAACCTAAGCGCACCTAGATATCATGGCGGACAACACTAACCCCGGAAAC
TTTGCCAACCGGTATGATATCAACAGCGGTTTTAAAAGTAAATCATTGACCAATTGTTGTTAGCCCCAAGGAGGAAGTG
CAGTCGATTGCATCCAAGGGTGGACAGGCGAGTCACCAGGGCGGCTTCGCTTCCATGGATCCTGACAAGCAGCGCGAGA
TTGCGTCCAAGGGCGGCCAGGCCTCTGGAGGATCTTTTGAGCCCGGAAGCAAGAAAGCTCAAGAGGCGGGCCGCAAGGG
TGGTTTGCAGTAAAGCATGACCGTAACTCTAGTGTCGATTCACTGGTAGACGGTGTGATTATCTCTTATTGTAGATAAA
CATACACTAGCAATTTTGCTCTAATACAAACTAATTGGTCCTAC > SEQ ID NO:2510 214067 205905_300803_1
cttgtcattattactcgatcccacgcgtccgtcgACCCACGCGtCGCAGATACACAGCAAACACCCAAGCAACAACAAA
AGCAAAGCACTCCAGCAACAAACATCTACCCACCTCACAACAACATCAACCAACCTGACAACTTCTTCACAACTCCACA
AACAACAACACTCAACCATCACAATGGCTTTCTTCCCTCGCACTTTCTACCACCCCACCGAGGCCTCTTTCACGCCTCT
CTTCCGTCTCCTTGACGACTTTGACAGCTACAGCCGACAGAATGGCAAAAGCCGCTCTGTTCGCCGCCAGCAAGTTCCC
CAGTGGCAGCCCAAGTTTGACGTGCGCGAGACCACCGAGGCCTACGAGCTCCACGGCGAACTTCCTGGCATAAGCAAGG
AGAACATCCAGATCGAATTCTCTGACGCCCAGACCTTGGTTGTTCGCGGCAAGACTGAGCGCACATACACTGCGGGCAC
ATCACCCTCTGCTTCCGTCGAAAACACTCCTTCTACAGAGACTGTCGCTGAAAAGGCCGAGTCTGAACGCAGGAACTCG
CACCAGGCGACTGTTGAGGACGAAGACGAGGCCAGCGAGCGCGAGTCGGGCTATGAAGTCGTGACCACCGAGGAAGAGA
AGAAGCCTGAGGCCAAGACTCCCCAACAGCCCGCCGACAAGGCCAAGTACTGGCTCACCGAGCGCAGCATTGGCCAGTT
CTCGCGCAGCTTCCACTTCCCTGGTCTGGTTGAGCACGACGCTGTCAGTGCCAGCTTCCAGGACGGCATTCTGAGCATC
ACCGTTCCCAAGGCGAAGCACGAAGCCCACCGAATCTTCATCCAGTAAACCATTTCACAAATCGGAAAAGACACTATCT
CACAACAATGTAATACTACTACAATCTACCTTGGGATTAGCTTTGCTGTCTGCCTTTCTCGATTGCaTCAATGGGAGTT
GGGGGGATTTGGGATCaaCGGATAATTTTCAACGTGTGCACTT > SEQ ID NO:2511 214067 206673_300824_1
GCAACCAACAGCCAAGGCGTTGAAAAGAGCATCACATGAAAATTTGCAGAGAACTGCTTCGCGACACATTACGTTGCCA
AAAACGTACTTCGACGCTCACATCTTCAAGACGTCTCACTGCAACGCCCAGCCGCAAAATGGCATTCTCCCAGCGTCAC
TTTTACACCCCCGAGACATCCTTCACTCCCCTCTTCCGCCTTCTTGATGACTTTGACAATTATTCTCGTCCAGGCAACG
CGGAGCAACAGGGTCGTCGCTCTGGCCTAGCGCACTGGCAACCGAAATTTGACATGCGCGAGACTGACTCCGCGTATGA
GCTCCATGGCGAGCTACCCGGCATGAGCAAGGAGAATGTGAACGTTGAATTCACCGATCCTCAAAATATGCTCGTAAGC
GGTAAAATTGAGAGGACATACACTTCTGGTACCCCACCTGCTGGAGCCCTGGAGGGAATTGCATCGAGAGGCAAGATCG
CCGAGGGCGGCGAAGGACAGGCCAAGACATCTTCCCGCGAAGCAACCGCCAAAGATGCGACTGAAGATACAGCCAAGTA
CTGGCTCACTGAGCGCAGTGTTGGCGAGTTCTCGCGCAACTTCAGTTTCCCTACGCGTATCAACCAAGAAAACGTGACA
GCGAGTTTTAAGGATGGCatccTCAACATTACTGttcccaaggctgccaaacatGagtCACGCCGCattacCGTcaact
aATTGacGTtt > SEQ ID NO:2512 214087 221036_300941_1
ACAACAAACAACGAAACAACCGCCCAATCGCCAATCGCCGCCTCGACATGGTGCTCGGCGACTACGAGGAAGCACAATA
GGCGGGACGCGAAGCAAACAAGCGCTGGGCGTCTGAGAAGTAGCCCGAGAGTCACAGCTACAGCTACAGCTACAGTGAA
CACGCGATAGAGTGATTCAGGACATCCAGAGACGAGACGAGGCGCCTGAACGAGATACGAAGCAAACAGACACGGGAAA
GCAGATGCAATGTCGGCAAACGTAACAAAGCCGGCGCCCAATCGGCCGCCAGCGGCGCGTAACGCCGGCCAGATCCTGT
CGATGCCGCCGAAATGGCTCGGCATGTACGACGAATTCATCACCAAGAACGCCGGCCAGGTGTCGCAGATTGAGAGCGC
GCTGAGGAGCTTGACGTATATCATTCCAGGCCGCTTTCGCGATGCTGAAATCGCCTCCGAGTCGATTCACTCGGGCGTC
CAGCTGCTGTCGCTCTACCACGACGGCATCCTCTCGCAGGCAGTGTCCAAGCTGCCCACGCCGCCTGTCCGGTCGGCTC
ATGCGCGCTACACGCGATACTGGACGCAGAAGAGCAAAACGTACCGCAGGATAGCCATGGTGCTGCAGATGGTCGTCTA
CACGGAGCTGCTGTGCGAAATGAGCGCC > SEQ ID NO:2513 214105 204254_300791_1
GCGTCAACTTCACGGCATCACGAGGTTCCTGGACAAGCCGTCACCATGTCCACTGACGATCTGAGCACCCATCTGGCCG
ACTCCGGCATCACCATGCGGTCCGACAGCGAGCAGTACTCTCCGGGCGATGAGGTCTCATCACCCTCGTCATCAAACTC
ACCGGTTATTCTCTACAAGCCCCCACAGCATGGAGTCTGATACGGAGCGCCGCCATCAATCTGGTTCTGCCATTCATC
AACGGAATGATGCTGGGATTTGGAGAGTTGTTTGCTCATGAGGCAGCATTCCGGTTAGGATGGGGCGGTACAAAGGTTT
TCCCTCTTTCTCGAAGACGAGCCCACCCCATTGGCCCAGGCATCGAAGTCCGTGAACGACCAGAGCGACCCGGGCCTTC
ACTAAGTGATTACGCAAGCTTAGAGTAGAAGGGAAGAATGGAATGAGGACGATAGGGGCATTGTATATGAATCAATCAT
GTCTAAATAAACAGATGCAGGCGCTTTTCCAAAAGACTGTGGCCCATCTGCTGCACTTTCAGAGCTCCCCAACCATATA
GGCAGCTAGTAGCGGCGGATAAGTGgCCGCGAATTGTACACCAGCAGAtTgcaCGAAGCTGTagcCACTGCATTAAAAT
AAatcaaTTCAACTTTTcTCAT

FIG. 2 continued

> SEQ ID NO:2514 214117 207781_300828_1
ATCGGAGTTGTTCCCGTTGTATAACAGGGCTTGACTATACTTCTTCATCTTCAGCTACACATACTCTCAGGCTCTTTCA
AAGTATTCGCCGGAGTCGTCTTTCCCCGACATGGTCATAACAAGCTTACAGAATGAGCCACGGACTCGATAACCTCACC
GGCCTCGCCGAGGGTATCGGTCTGCGCTTTCTAAATGAAGAGTGGAACGATAGCATCTCAAACGACCACCCGTTCACCA
TCCAATGGAACGAGTCGCTGGATGGGGCTCAGGCACCAGAGCTTGGGCTGTTCAAGATTACATATCCCAAAGATGGCGT
TATCGCATACGAGCTGGTATCAAATCTGACAGGCCGCATGAATAATGAAAATGCAACATGCTTGTGGACACCAAGCCAC
TTGGACGACGAATTATATACTCTATGGCTCTCATCCTCTCGAGACGCTCGCGCAAATTGGACGACGTCTCCTCCTTGGA
GACTAAAAGAAACTCCCCGACATTCACATCATTGGGCCGCCCCCATTGTTATCCCCATTATTGTGTTGCTCGCAGTGTA
TACCTTGGGACTCACCACCTGTATCGTATATCGACGCCGCAGAAAAGCGAGACGTGTGAGAGAGAAAAGCAagGGAAAG
GATCCTGAAAAGGACAAATCAAGTCAGACGCATCTCCTTggaGACGCGGAGAGACAT > SEQ ID NO:2515 214135 218626_300935_1
atcaacactcgacttgaacacatacaacagccaatcacctctttacatcctcactcaaacaatcaacaaacaaaccaac
aCAAAAACTCAACCATCTAATCTACATTTTTAAATAAAAACCCTCACACGACCATCCTCAAACAGCTCCAATACACACT
TCCGAGGAGAACCAGTCATCTGCTACCGATCGGCCCATAACTCGCTGCCTCTTGCTGCTTTGGGATCCACCACAGCTTT
TCTGACACCACCCCTCTCCCATCTGAGTTCCTCTGGGGTATCAAATCTCGCCCGACTACCTAGAACCAGGCCTTTTTTT
CTCCTTAAACAGCCCCGACAGCCATCACAGTTACCGCTCGAGCCGGCCTTAATCAGCCTACTTCAACTGGAGAGATAGC
CTTTTCGCGGCCTTTTCGCAACCCCGCTTTCCGCACAGTAGAAACCAGAAGCTTCGAAGCTCTCGAGATATATATTCGC
TACTGAGCCACATCCCTCCACTCTAGCTTCCCATAGCTATCACCACCGCACTCCCCTACACAACCAACCCCCAACAGTC
ATCATGAAGGTCGTCACCAAAGAAGAAGAAGCCGCCCACTACGGCGCTGTCGTCAAGGGCGGACTCATTGGTGGTACTC
TTGGTCTTGCCATTGGTGTCTCTGGTGTTGTCTACGCCTCAAGGCGCTACCCCAGCTTCCGTGGCTTGACACTCCCCTT
CCGAACTTTCCTCGTCACATCCACCGCCACCTTTGGAGCCATTGTCCAGGCTGATCGAGCTGGCATCAAGTTCCAGCAG
GGCAAGGACCCCATGAAGACCTACCGCGATGCCTCTCAGCGTGCTCAGGAGGTTATCCGTGAGAACGAGACTGCATACG
AGCGATTCATGAACTATGGACGCGAGCACCGCTACAGCATTGTCTGCGCCTCATGGCTTGCTAGTTTGGCCGTTGCCTT
TGCCATTGTCAGCCGCGCGCCTATGAGCACACCCCAGAAGATCGTGCAGGCTCGTGTCTACGCTCAGGGCCTGACTCTT
GCTGTGCTCATCGTCTCAGCTGCCTTTGAGATGAACGACGCCAAGAACGCAAAGGGCCGCTGGGAGACCGTCATGGTCC
TCGACCCCAACGACCCCGAGCACAAGCACCTCATTGAGAAGAGAATCCACCACGAGGAGTACGAGGGACAAGATCTGTG
GATGGATATGGTTGAGGCTGAGGAGAAGAGAATGGCTGCCCGCAAAGCTGAGCAGGAGCGCGAGCAGCAGCAGGCCCAG
TAAGCAAGCTGCTGAATG > SEQ ID NO:2516 214138 204492_300817_1
GAGGGAAAGAAAAATAGATAAAAGGGCCAGGGTCCGACCGTGTTGATTTGGAGTTTTGTGTCAGCACAGGATTTTGATG
AGACTGTTATTGAAAAGACTCTTTGCCTTGGTTGGCAGATTGGTTGTATTAGGCATACTGTTTCGATACGCTTCAACGT
ACTTTTTGAGTCGCAAAGCTACCATGACTGTGGCTCCTGTGATTGCGCTCTCACATGGTGGAGGTCCCCTCCCTATCCT
TGGTGATCCCTCTCACAAGGACATTGTTTACTCTCTCAAGAACAGAGTGCCCAAGATTCTCAAGCTCGGGACTCCT > SEQ ID NO:2517 214201 195674_300636_1
AATGGGTAAACCATTCCCGCAAGTTCAGCCTGGAGGGAGCCTGATTCTGGCTTACCGCGTCAAGGACAAGAATGTCCTG
GTGGTAGGCGGTGGTGAGGTCGCGGCTGGCCGCATCCTCAACTGCCTCAATGCCGATGCCCAAGTCACCGTCGTCTGCC
CTGCGTCAGGCCTCAACGAAGAGGTCGCATTCCGAATTGCCGAGAAGCAGGTGACACACATCGACCGCCTGTTCGAGCC
GTCCGATTTAGACAAAGCAGACATGGTGCTGGTCGCCATTGACGATCCGGCAGCCTCGACAGCGATATGGAAACTGTGC
AAGGAAAAGAGAATCCCGGCCAACATTGCGGACGTGCCCCCTGAGTGCGACTTTTACTTTGGCAGCGTCCATCGTGACG
GGCCTCTACAGGTCATGGTCAGCACCAACGGCAAGGGACCGCGGCTGGCGGCATCACTACGGCGGCATATTGCCAGCCA
ACTACCGCAGAATGTTGGGAATGCTATTGAGACAATTGGAGAGTTGCGGACACGGCTGCGCAAGGTTGCCCCCAATCAT
GAAGACAGTCAGAAGCGAATGCGATGGATGTCaaAAGtcagTGatacctacaaGTgggaagaGaTGagCGaaatcacg > SEQ ID NO:2518 214221 218585_300919_1
cggacgcgtgggCCTCGCTGCAACTCCACGCCTCGCCAATCTCGAACGCCTGTCAAAATGCTCTCCCGCGCCGCCACTC
GCACCACCTCCGTGGTCGCCCGCCGAGGCTTCCACACCACCCGCCCTCGCATGTCCTCTCCTTACCACTACCCCGAGGG
TCCTTACTCCAACTTGCCCTTCAACCCTCGCAGCAAGTGGTT > SEQ ID NO:2519 214235 208640_300807_1
GAAGCAACCAAGAATCTGCACCTCACTCGATAATAAAAAGAAATCGGTACTCAAGGTTTATAACTCATTCAAAATGCGT
TATACTGCTGTCCTCGCTGTCCTCGGCTTCTCCGGAGTCATGGCCAACAAAAACTTCGGACCCTTCGGATTTTTCGGAC
CCTGGTTCGATGGCGACTTAACTATCGATGACCTCGCTGACTTTCAGTTTCCTGAGAACCCTTGTGAGTTCATTGGTGG
TACTTGCGAGATCGCCACTTCCCTTACATTCTGCGCTGGTCGGGGCGACTTCAGCGTTGATTTGCCTTGTGGCGTTGGC

FIG. 2 continued

CTCGGCTGCTGCTGGCACCAGGACACCAGCAATGTTTGGTTTGAGCAATGGAAGGAGTGGCTCGAGCTACACAGCCGCA
TCAACTAAAGCCGCTTTAATGTCTTGACGCTTTGATGGCTTGACGCTTCTATGGCTTGACGCTTCTATGGCTTGATGCT
TTAATGGCTTGACGGAGTCTTCAATTGGCACGGTAGTGGGTGATGGAGAAATTAGCCGTACTGAACTCAATGAGAGATT
GTTAACCCCGATTAAGTag

> SEQ ID NO:2520   214250  211757_300870_1
ccatGGCTGAACCAACCCCCGGCCTCACTCCCGAGCAGCTCTCGGCCTTCCAAAAAGACGGCTATCTCATCATCCGCAA
CGCCCTCAAGCCAGAAACCGTCTCATCGCTCCTTAGCGAAACAAAGGGCCTGCTCGAGGGCTTCTCCCTCAAGGACCAC
CCGCTGACTCGCTTCTCCACGGGCGAGAAGTCGGACCACGTGGGCGACGACTACTTCCTCACGTCGGGCGACAAGATCC
GCTTCTTCTTCGAGGAGGACGCCTTTGACGACGCGGGCAACCTGACCAAGCCCAAGGAGCGCGCCGTCAACAAAATCGG
ACACGGCCTGCACGTGCACTCGCCGCCGTTTGCGCGGCTCATTGACGAGGCGTCGACGCGGGCCGCGGGCGAAGTGAGT
CCTGCGGCTGTGGCTCGTGATCTCGGGTTCAAGGATGCGCGGTGTCTGCAGAGCATGGTGATTTGCAAGCAGCCCGAGA
TCGGGGGCGCGGTGCCGCCGCACCAGGACTCGACGTTTTTGTACACGAGCGCGCCGTCGGCCGTGGGCTTCTGGTATGC
GCTGGAGGACGCGACGCTGGAGAATGGGTGCTTGAgttTCTTGCCGgggTCGcaTcgcTGGGCGCCCGtgGa > SEQ ID NO:2521   214256  200367_300816_1
GCGCTCGCCTGTTCATCTCTCTACGAAACCGCCCCCCAACACACGATCCTACAAGAGGAAAAGCGGATTGATTAAGACC
CGCCAAAGAAGAGGCGTCACGCAACATGGCGGAGGAGATCCTGGACAAAGTTCGGGATGTGGTGGAGGGCCAAATTGAC
TTTGAGGGCCAGAGACGAGCAGAAGGCCTTGCCACTCTGTTACTTGCCCTGACAGGACTCATCGCATTCAACGTCGGAT
ACGTACTACAAGACATCGTCAAATGCCTATATGTTGGACTAGGAGGAACGGTCTTGACATTTCTCATTATCATTCCGCC
GTGGCCCTTCTATAACAAGAACCCGGTCAAGTGGCTGCCTATCGGATCTGCATTTAACACGGGCGGGACATGACGACTG
GATAACGCCGCTCTGAGTAGGCCCCGGCGTTTTGTCACGTTGTCAAAATCAGCATGTAGCTTAAATCTTTTCGAAATCA
TGTGCCACATttcctctCCTccaggtcGTGATATCGTTccttGCTTTTGCtTCCCGTTCCGCCTACTCCGTTTATCGAC
CGTACTTTTGAAACTCCCAGTCTCTGTTgtctaGAGggcAGACTGATCGGGCCTTTAGCCATCGTGAAATGCAATGGAA
GTGGAAAGCATGGTTGCAAATTCCCCATGCGACAGTGCACTCCTCGCTGGTAGCGGATGCCTGGTTCGCCTGACATtct
ATGCAAAGATCCATGATATGGTTTCGGCAGATGGCGCAGTTGTCGACTACGATATCCCAAGCCCACAGCGCGACGGCGT
TCCACTTCTTGACTTCAAActtcttcTTGTCCGAGCCTTTGCTGACGACACCGTCGGCCTTTTTGGCGGCCACCGGGGC
ATCGCTCATTtcGACGTCAGCCATGTTCGGATAGCTCGTGACTTGTCAGGGAAGCtcTATCAGTGACGATGGTTCCGTG
ATCTCGCAGTATCGCGATAGGGatataaacgtgtgaggatgtgtaaacgaggggagcagtcgagctcttgggactcgat
ggatggatgacctgtgcggctct > SEQ ID NO:2522   214259  200377_300758_1
aagatcaggacaagacaattCGAGAGTGCCAAAAACAGCAAAAGGGCAGAGAGACGTCATCATGGCTCAGGCCAAGTTC
GCCGTTTATCCCAGCCTCGTCGACCGCACCGTCGTCATCACAGGTGGTGCGCAGGGTATCGCCGCCGACATGGTCGAGC
AGTTTTCCCTGCAGGGTTCTCAAGTCATATTTTTCGACGTCGAGGACGAGCTTGCCGCTGATTTAGTCCGAAAAGTGTC
TGATCAGGGCGTCAAACACAAGCCCATATACTACCACTGCGATGTCATCAAGATCGACGAGGAGCTCAAACCCACAGCG
GCCAAGATCCTGAAAGACCATCCCAAGATCGACGGACTCATAAACAGTGCCGCGAGGGCAATGGTGAAGCCCTCGCAGG
ATATCACGACTGAGTGGTGGGATGAGAGCGTCGCCGTGAACCTGCGGCATCAGTTCTTCCTGACCCAGGCCTTGCTGCC
GGGGCTTCTCCTTGCTGCTGGAAACGCTTCGGTGATTAACATGGGGAGCATCAACTGGCTCGTCTCTGCGACGGGTCAG
GCGCCTTACACGACGAGCAAGGCCGCCGTTGTGGGACTGACGAGGACGCTGGCACATGAGTTTGGAccgca > SEQ ID NO:2523   214264  205867_300802_1
ccacgtcactctcaacataatgtgtaaggcctcccaggttcgtctctctaatgtttcattgcctaactctcatacacag
cGGCATACGGCGGATACCAAAAGACTAGCTACGGCGCCCAGGGCGGCGATGACTCTGGTGGCTTCTTTGCCGGAGGGGG
TTCACAGCAAGGCAGCCAAGGTGGTGGTGGTGGCAAGTCATACCAAGACGAATCATTACGGCCCTTGACCATCAAGCAA
ATCCTCGAAGCTGAGGAACCGTACTCTGGTGCAGACTTCAAAGTGGACGGCGCTCCCATCACTCAAATCACATTCGTCG
GCCAGGTTCGCAGCATAAATCCACAACAGACGAATCTGACGATCAAGGTCGACGACGGCACAGGGCAAATTGACGTCAA
GAAGTGGATCGACGCGGACAAACAAGGCGATGCAGAGCCCGGCTTTGAGATTGATTCACACATCCGCGTCTGGGGTCGT
CTCAAGTCATTTTCCAACAAGCGACACGTTGGAGCCGTCGTCATTCGACCAGTAACGGATTTTAACGAGGTCAACTACC
ACCTACTCGAGGCGACATACGTACATTTGTTCTACACTCGTGGCGCCAGCGGTAACTCCGGTGCAGGACCAAACAACAG
TGATAgcATGTTTGTTGATGGCGGCgatggCTATAACGCTGGCGCCGGTGGAgcCCagcttcccACcaaGCTCTCTgGA
TGCagtgccgccgcaaagagaGTGTAcaaCtAcT > SEQ ID NO:2524   214267  205829_300802_1
TGAGTGCAGTGTAAGACAACATGGAAGACATGTATGTCAGCAATACGGATGTTTCCATACAGTCAAAGCGTTGCATCAA
CCCCGGCATGTCAGGAAGATGCTCTGGATACTAAGCGGGAAAATCTTCCGGATGCTGACCTGGCTGCTTCCAATTGCCC
TGTTGTCGATTCTTAATTTTGCGCAGGCGATCAGGCCACATGCCACATGCAAGTCCGAGTGCAGGTCCAAGCCGAGCCGC
AGAGGAGACAATGGGTCCAAATGCAAATGCATACAGGTAGTACTGCCTACGTGCGCTGCTACAGTACCGCTGGCTGTTC
ATTTCGTCTTCAGGGACAAAGGGGGATGGATGTACACCGATAGATCGGCCTAGTCGAATGTTACTTGGTCCATTCGTTC

FIG. 2 continued

```
CTTCTAAGCCATATTAggcaTCCaaGATGCTCGGTACTCGCATGGCCATGTACGGTCTCAcGgCtcaccgctaggcCTT
ttttgAATGTCGTTACTTCGTTAcgattatTGGGACAGATGGCGTagagctaccagtgctagtGGTGTaatCgacaaag
TTCgCTcctg > SEQ ID NO:2525  214329  210659_300891_1
TGGGCCTCCTGCGCGATCAGAGGTCTCTATGAGGAGATGAGCTATTGATTGCACTCAGCGCTAGATGTTTGATGAACCC
TCAGGACACAGCATTGGAAGTATTATTGATCAGAGAAAGGCTCTGGGCTATTCACTCCAGAGTTGCGAGAACTATGATT
CACGTTGACATACGTGTCGGGCCTGCAAGACCGCTGGAAAAAA > SEQ ID NO:2526  214339  214387_300857_1
ACCCCATCATCTGCTTCACATATTCATTATGGGGCATCTGTCGAGCACCAAAATGGCTCCCCCGATTCACTTCATCAC
CGGCAATGCGAATAATCTGAGAAAAGTCAAAGCGATCCTCGAACCGCAAATTGAGATTGACAGCCAGTCGCTGGATCTC
GAGGAAATCCAAGGAACGATTGAAGAGGTTGCCGAGTCAAAATGTCGTCGATCTGCCGACTTGGTAAACGGCCCGGTGC
TGGTTGAACACACGGCGCTCTGTTTTAATGCTCTCGGAGGCCTACCTGGGCCTTACATCAAATGGTTCCTGGATAAGAC
TGGGCACCAAGGTCTCAACAAACTTCTTGCGGCATACGAAGATCAATCTGCAGAAGCAGTTGGTACATTTGCATACTCA
CCACGACCTGGCCGCGACCCAATCATCTTCCAAGGACGGACGCCGGGTCCCATTGTACCTGCGCGAGGCCCTTCGAACT
TTGGCTGGGACC > SEQ ID NO:2527  214346  216971_300903_1
ATTGCGCGCCAAAAGACTGTACACAGACGTCTTTTGATATATTTTCAAAATGGGTGGCGGTGGAAAAATCCCTTACCCC
AAGCACGTCTGGTCGCCTTCTGGTGGTTGGTACGCCCAGCCTGCCAACTGGCGCGCCAACACGCTCATCGCCGGAGCCG
CCATGTTCGGCGTCATCGCTATTACGTGGAAGTTCAGCGCCGACAGGGAACGATGGGCGCATAAGCCGGAGCCGTGGGA
GTGGCATCCTAGCCGATACTGGTCAAAGCAGTTGATCGAGTGGGACAAGGAGGACAAGCTGAAGGCAGCAAGCAACAGC
AAGGAGTAGAGTTTTCTTTTTGGGAGAAGGATAATAGACGAAATTGTACAAATTCTATACGAACAAAAGGCAAACATTT
CT > SEQ ID NO:2528  214356  206692_300824_1
gcccacgcgtccgcccatatccgcacAGACAAATCTCACACAATGTCTACCGCCGAGCTCGCATCTTCCTACGCGGCCC
TGATCCTTGCCGACGATGGCATTGAGATCACCGCCGACAAGCTCCAGACCCTGATCGCCGCCGCCAAGGTCGAGGTTGA
GCCCATCTGGACATCAATCTTCGCCAAGGCTCTTGAGGGCAAGGACATTAAGGACCTCCTGGTCAACGTCGGCTCCGGT
GGTGGTGCCGCCGCTGCCCCTGGCGCTGCCGCCGCTGCTGGCGGTGCCGTCGACGCTCCTGCTGAGGAGGCAAAGG
AGGAGGAGAAGGAGGAGTCCGACGAGGACATGGGTTTCGGTCTCTTCGACTAAACGGCCAGCTCCACCTGTTGCGGCGA
CTGTTTTTCTCTTGCTTCTTTGTACTTCAACTGCATGGCACTTCGGGGTCTTTATACACATCGATGGATGCATACAGG
ATGGAGTGGGCGCCTATATCCTGCGTCCTGGGCAGAGTAGCTTCGTTCATAAGGATAATATGATGAATGCTCTCACACG
ACGGAGTTCACGCGGGGAGGGGACAAATAGTCAATTAAATGACTTGGGAAGAACAAAAAGAAATTTTTTGACAAATGTT
GAACTTTTGAAAAAaaa > SEQ ID NO:2529  214370  212920_300845_1
GGGGGGAGAAGAAAAGCCAGAAGATGCGATGGGGCCGTGAGTTTGAGTGTGAGTATTGCGGCGTTGTCCAGGTACAACG
GGGGGGACGAAATGCGAAAAGCGCACAAGACAAGGTAAAGGAAACGGCTAAAGAACAGACAGGGCGTGAGGATAGGAA
AAGGAAACAAAAACGAAGAGATTCCCAGTATTAAATGAAACGAATATGCGCCGTAGAGTAGAGAGGCACCAGAGCAGAC
TTCGAGAGTCGCTGGCGAGCTTACAATGCGGTACCGAACTTCATCGCGACGTTCGATGGGGAAAGAAGAGCAGAATCGA
TGACGGCCATGGGGGTCGTGGCATAGCT > SEQ ID NO:2530  214382  205102_300796_1
CACGCGGTGGTGATTGGAGGTGCGGATTTCACGCTTTCTGATGATACTGGCAGCAATTACATTTGCGCGGCTGGCGTTC
TTTGCAAGGATGCCCGGAATGCGGTTGTCTTTACTGTGAGCTACAAGAGCGGGAAGGGATATGCGTTTAACGTCAAGGG
CACGCAAAAGTATCTGTCTATTGGCGGGCGTGGATCGTCCAGTTATGTTTCCTTGACGGGGGGCTGGGATACTGGCAG
GCTTATAGCGTGAGTTATTGAATGTCTGGGAATATATAGCATGGCTAGTATTTTGAGATGGATTCATTGAGTATGAAAG
GGGTTGGGGTTAGACAAAGAAATTAAAATAGCATTATTCATTTCAGCCG > SEQ ID NO:2531  214388  220240_300953_1
AATGAACCCAAAGACCATTGAAGTGGCCTCAATATTGATCTATCAACTTTCACCTACTCTCGAACGTTTATTCTCGAGG
TAATAGCTTTTGAAGTTTTCATCATGTCCAAAAAGGTGGTCATAGTCGGCGGTGTTGGCGGAGGCATGTCCGCTGCCAC
CCGCTTGCGTCGTCTGGACGAATCAGCAACGATCACCGTGTTTGAGAAAGGAGCTTACGCTGGCTACGCGAATTGCGGT
ATACCTTATGCTCTGGGTAAGGTGATCAAAGATGACGAAGCTCTGATTTTACACACCACCAAAGTATTTCAAGGAATATT
TCAACATCGATGTTTACCTCAACACCGAAGTTATTGAGATTGACCGCACGAACGAGCAAGTGTGCACACGAACCGTTGG
AGAGACTGAGATTCGGCGAGTCGGCTATGACAAGCTCATCCTTTCCCAAGGCGCAGAAGCTGTGCAGCCGCAGATTGTT
GGAGTAGATCAGAGCCATGTGATCACTCTACGGACCATCTCGGATCTACAAGCTATTCGATCTATCATGGTCGAACGAT
```

FIG. 2 continued

```
GCGTGAGAGATGTTTGTATCATTGGAGGCGGATTCATTAGCCTTGAAGCGGCCGAAAACTTGCGAAAGATGAAGTTTGG
AGTCTCAATTGTCGAGCAATGGACCCATGTCTTGCCGTCAATAGACGCCGATATCGCACAGTTTCTTCACACCGAACTg
```

> SEQ ID NO:2532 214407 217984_300913_1
```
tgtacaACTCCAATCACTCATACCTCCCTTCTCTCAGCATACTCAACCTCATAACAACCACAATGGCTGCACAAGAAGG
ACGAGCTCCATATCCGCCATTCACACTTGAGACAGCTCAAGTCAAAGTCAAGGCCGCTCAAGATGCTTGGAACACCAGA
AACCCAGATGGTGTCAAAATGGCATACACCCCAGACTCAATCTGGCGCAATCGCGGCACATTTCTACAAGGCCGCGACG
AGATCAAGGCGTTCTTAACCGACAAATGGAGCAAAGAAGACGGCTACCGACTTCGCAAGGAGCTTTTTGCTTTTACAGA
CAACAAGATTGCCGTGCAGTTCTGGTACGAGTGGCATGATGAGGCAGGCCAGTGGTGGCGCACGTACGGGCTTGAGGAC
TGGACTTTTGCCGAGAATGGGCTGATGAGGAAACGTCAGATGAGTGGAAATGACGTGAAGATTAGCGATGCGGAGAGAT
GGTTCAAGGATGGCGTTGATGTGAACACCGTCGACATTTCCGAGAAGCACTGGTGAGGGAGGCTATTTACTAAACTTTA
ATGAAGTCTTTTGAATATATAGATAAGCAAAGTTTGGTTTAcgaAAAAAAA
```

> SEQ ID NO:2533 214411 215590_300882_1
```
GTGGATAGCGGATGGATACTTGCAGTAATATGGGGTAAGTGAGTGAGTGAGTGAGTGATATGGATACAGCGGGATGATG
ATGATGGTGGTGGTGGTGGTGTTGTCACTGATGTTGTCGAGTGAGTTGTTTGTTTTGTTTACCTTTGGAATTGATTGAA
ATGAAATGAAATGAAACAGCCCAATGCACAGCCTAAGTCCAAAGAAAACAAACCAG
```

> SEQ ID NO:2534 214414 211075_300895_1
```
TCTTCTTCCCGTCGTCCATCTTCGTATATCTTACGAAGTCGACAGTGGCGCGTCTCTGTTCCGTTTGAGACATCTGTCG
CCTGAGTGGTATAGACCAACCATCCGTCTCCCTCCTCTCCATATAAACCTCCGGGCATATCGCCGCCATGAGTGACGAC
GATGGGCTTTACGCTCATACTAGCCCCGCAGGCTACGGACACGATGTCGAGAAAAGCAGCGCCAGAATCGGAAACTACG
AGAATGTTCGCATCCGTGGTCTCGAGACCTCGCCTGAGACGTCTCTGCACCGCGGTCTCAAGGCGCGCCACATTTCCAT
GATTGCCATTGGTGGTGCGCTCGGCACTGGTCTCATCATTGGTACCGGAAAAGCCCTCGCTCAGGCTGGTCCCGGCTCG
CTGCTCATCTCGTATTGTTTCGTTGGGATTCTCGTCTACGGTGTCATGGCTTCTTTGGGAGAAATGGCTGCTTGGTTGC
CTATGAGTGCTGGATTTACGGGCTATGCGACGCGATACTGCCACCCTTCTCTGGGATTTGCTCTTGGTTGGACATATTG
GTTCAAGTACATCATTACCACCCCGAATCAGTTGACAGCTGCCGCTTTGGTCATCCAGTATTGGTGTCCTCGAGACAAG
GTCAATCCAGGTGTCTTCATTGCCATTTTCCTAGTCACCATTCTTGTTGTGAACTACCTAGGAATTgAACTGTTTGGCG
AACTTGAGTTCTGGCTGTCCTCTttcaaagtCATCATCATCGttgGTATCATCATCTtc
```

> SEQ ID NO:2535 214415 126625_300465_1
```
TTCACCTCAGGTTGTTAAAGCTTGATCTGAGTATTCAGAAACGCTAGCCAAGATGCAGAATGAAGAGGGACAAAACGTT
GATCTTTACATCCCCAGGAAATGCTCTGCTACCAACAGGGTGATCACTTCAAAGGATCATGCCTCTGTTCAACTTAATG
TTGGCCATTTGGATGATAAGGGCTTGTATATACCTGGCAGTTTCACCACTTTTGCTCTCTGTGGTTTCATCCGTGCTCA
GGGTGATGCTGACAGCGCACTGGATCGCCTCTGGCAGAAGAAGAAAGTCGAAGCGAGACAACAGTAGAAAAATAGATTT
GCTATTTGAGATTATCTTGTGATGGAGGATTTATGATAACTATTTCAATTTCATCTGAGTTTGACACTGTTTTTCCTCT
ACATATGGGATAGCTTTTCATCTTTGGATATTTCACTTGCCTTTCATGGTTTTGAGCa
```

> SEQ ID NO:2536 214415 215510_300882_1
```
acacttttcccgccaaatcaccacctctacgtcaccACTACCCCTCCCACACAACCGAAATGGAGAACGACCGTGGCG
ACATCGTGGACCTCTACGTCCCGCGCAAGTGCAGCGCTACCAACCGCATCATCAAGGCCAAGGACCACGGCTCTGTCCA
GATCTCCATTGCCAAGGTCGACGAGAACGGCCGCGCTGTCCCCGGCGAGAACCACGTCTACGCCCTCTGCGGCTTCATC
CGCGCCATGGGCGAGTCCGATGACTCCCTGAACCGATTGGCCCAGCGTGACGGCCTCGTCAAGAGCGTCTGGAGCGCTC
AGCGATAAATTTTGCAAAACAAAAATTTGGAAGAGGGACAAGCTCGGGTATGAAGGCAGGCGTGGAAACTAGAGTTGGC
TGCATGTAGCAATTCCAATTCAAGGCGTTTTGGCTCCGTTTCGagacAATTATTTgcgAcGTggAACTATGCgaTTCGg
acGTgacgTTgAtTgaaCAttTTTTATCA
```

> SEQ ID NO:2537 214415 195863_300638_1
```
TCACCACTACCCCCTCCCACACAACCGAAATGGAGAACGACCGTGGCGACATCGTGGACCTCTACGTCCCGCGCAAGTG
CAGCGCTACCAACCGCATCATCAAGGCCAAGGACCACGGCTCTGTCCAGATCTCCATTGCCAAGGTCGACGAGAACGGC
CGCGCTGTCCCCGGCGAGAACCACGTCTACGCCCTCTGCGGCTTCATCCGCGCCATGGGCGAGTCCGATGACTCCCTGA
ACCGATTGGCCCAGCGTGACGGCCTCGTCAAGAGCGTCTGGAGCGCTCAGCGATAAATTTTGCAAAACAAAAATTTGGA
AGAGGTACACAAAAACAACAACAATGCCGAAACAAAGGAGAAAGCCTTGGATATGGAAGAATCAGGTTAACTAACCTGA
TTTGCAGGGACAAGCTCGGGTATGAAGGCAGGCGTGGAAACTAGAGTTGGCTGCATGTAGCAATTCCAATTCAAGGCGT
TTTGGCTCCGTTTCGAGACAATTATTTGCGACGTGGAACTATGCGATTCGGACGTGACGTTGATTGAACATTTTTTATC
ATCCTATTAAACACCTACCGGCTAGCAAAGTCTCCTCGGACGAgcacCTCCCTGCTCTCTGTGATCGGGGATtctgggg
ctacctcgataGTCCtcgagccg
```

FIG. 2 continued

> SEQ ID NO:2538 214417 205572_300799_1
CAACTTACAAAGCCAAGAAACCATTGAAGCACATAACAAACCGTTCGAAAACCGCAACAATGTCTATCGTCCAGCCACA
AGAATACCAGACCGTTGACGACGTGCCGTATCAGCGAGGCCGTCCTCTCCCAACAGTCACCCCCGTCTTCCAGAACAAG
CTGCCCAACTCGCCTGGCAAGACGTCCATCGGCCTCCTCGTCGACTTCCCGCCCAACTCGTCGACGCCCCCCCACACGC
ACGGCGGCGCGGCCATCTCCGTCTTCGTCATCAAGGGCACCGTGCTCAACAAGATGAACGATGGCCCGACTCGTGTGAT
CCCGGCGGGCGGCACGTGGTTCGAGGCCCCCGGCTGCCACCACCGGACCAGCGACAACTTCAGCACCACGGAGCCGGCG
CAGATTCTGGCGACGATGGTGGTTGACACAAAGACTGTTGAAGAGGGAGGGATGGCGGCTCTTGTTGTGCTCGACCCGG
AGTATGCTGATATCAGACTTGGTTAAATTGATATGGATGCTGCAGTGAAGAGAACCGGAAGCTCGGAAGGGTGTGGGT
GTTGTCAATATCAGAAGTGGCCAGCGGAGGCTCGGATTGCTGTTAGTAAACGGGGCATCTCAGCAGGAAgGcaAAATGA
atATGtaAAGCAATCAATGgcaacgaatcGttt > SEQ ID NO:2539 214421 208555_300961_1
ggccagaaccgcgcgagtatacatctatctgcaacatctcttacctccatcttcgcaatggcttctgataagatggacc
gCGGCCTCGACGAAATCATTGcaGACAAGCGCAGCAATGGATCTCGAACCCGACGCGGTGGCGACCGCCGTCGTGACCG
TCAAgaCTATCCCCGTGATGGGGTGAAAAAGTCTCTCCGCAACGAACCTCGAAACTTGGATAGCGAATGGGTACATGAT
CGATACGAAGAGAACACGTATCGCAATAGAGGCCCTGCACCGCGTCGCAGGCGCGAGTCTCCCAGCGGGGGAGATGCCC
GCGGCGCACGACTCCGAGTCGAAAATATCCACTACGATCTCACCGAGGAGGATCTCGATGAACTTTTCCGAAGAATTGG
CCCCATCACAAAATTGCAACTGCGTTATGATCGGTCTGGACGGTCCGAAGGTGTAGCTTTCGTAACGTATGAGAGCAAA
GACGATGCCGCAGAGGCTGTGAGACAATTCGATGGTGCCAATGCGAACGGCCAGCCAATTCGTTTGTCCGTCATGTCAA
GTGGGCCTTCTCGAAACCCGTTTGATACTGCTGTGATGCCAGGCAAGCCTTTGTCCGAACGCATTTCTGCTCCTGGTGG
CAGATCTCGATCACTCTCCCCTCGCCGATACGATGAAGAAGatgccgCTCGCAGAGGCATTGATCGATAtgttccaggc
GGAAGTCGCT > SEQ ID NO:2540 214423 216388_300868_1
GCCCGTCACCTGGAGAAAAGCAGCGACTCTTCGTCTTCGTCTCCAACCACCACAATGTCTGGCTACACCGTCCGCAAGG
TTGCTGCCCAGAACACTCTGGAGCACCGCGTCTACATCGAGAAGGATGGCGTCCCCGTGTCGCCCTTCCACGACATTCC
TCTCTTTGCCAACCAGGAGCAGACCATCCTGAACATGGTTGTCGAGATTCCTCGATGGACCAATGGCAAGCTCGAGATC
TCCAAGGAGGAGCTCCTTAACCCCATCAAGCAGGACGTCAAGAAGGGCAAGCTTCGCTTCGTCCGCAACTGCTTCCCCC
ACAAGGGCTACCTCTGGAACTACGGTGCCTTCCCCCAGACCTGGGAAGACCCCAACACCGTCCACCCCGAGACCAAGGC
CAAGGGTGACAACGACCCTCTCGATGTCTGCGAGATCGGTGAGCTTGTTGGCTACCCCGGCCAGATCAAGCAGGTCAAG
GTCCTCGGTGTCATGGCCCTTCTCGACGAAGAGGAGACTGACTGGAAGGTCATTGTCATTGACGTCAACgaaccccttg
atCCTAAGTTgAACGaCgTTGAGGACGTCGagcGCCACCTgactggCcTg > SEQ ID NO:2541 214423 226311_300996_1
agcaacATGTCTACCTACACTACCCGGTCCATTGGTGCCCCCAACACTCTCGACTACAAGGTCTACATTGAGAAGGACG
GCAAGCCCGTTTCCGCCTTCCACGACATTCCTCTGTACGCCAATGCTGAGAAGACCATTCTCAACATGATTGTCGAGGT
TCCTCGATGGACCAACGCCAAGATGGAGATCTCCAAGGACCTTGCTCTGAACCCCATCATCCAGGACACCAAGAAGGGC
AAGCTCCGATTCGTCCGAAACTGCTTCCCCCACCACGGGATACATCCACAACTACGGTGCTTTCCCCCAGACCTGGGAG
ACCCCAACCACGTCCACCCCGAGACCAAGGCCAAGGGTGACAACGACCCGCTCGACGTCTGCGAGATCGGTGAGACTGT
TGGCTACACTGGCCAGGTCAAGCAGGTCAAGGTCCTCGGTGTCATGGCTCTCCTCGACGAGGGTGAGACTGACTGGAAG
ATCATCGCCATCGATGTCAAGGACCCTCTTGCCTCcaaggtcAAtGACattgaggatgttgagCgacacctgcCCGGTC
TTCTGCGAGgccaccaacgaatggttCcgaatCTACaagatccctGACGGAAAGCCCgagaac > SEQ ID NO:2542 214423 243145_301336_1
AAATCATTTATTGATTTAATCTCCTTTTTCCTTTATCATAATGCAAAGAATCCATTAAGAGAAGCACTTCAAACGAGCG
AGAGATCCCCCGCCGGGGCAGACCTTGTCACAAGCTTCACCCACGCTTGATGCGTCTCCTGGATCACCTTGAGCGCGTA
CTCCTTGCCAGCAGCCTTGTTCCCCAGCCCAAACTTATTCTGCGGCTTCCCATCCGGCACCTTGTAGTCGCGGAACCAG
TCCCGGATCTCCATCAGCGTCCCGGGAAAGTACTTCTCCACATCACTCTCATCGTTGAAAAGCCCAGCCCTGGGATCAT
CCACGGAGATGGCCACCACCTTCCAGTCCAGCTCCCCCTCATCGATCATCGCCAGCACCGCCACCGGCTTCACTCGAAG
AACTTCCCCACGCCCCGCCTTTCGCTCGCCGATCTCGACAACGTCGACCGGATCATTGTCACCAAGCGCTCCCTCCACA
TCCGGGTTGGCGTGGTTTGGATCTTCCCAAGTTTGCGGAAGAAGCCCGTAGTTCAGCGTATGTCGTATGGATAGAACC
GTAGCTTGCCTTTCTTCACGTCCTGCTTGATCGGCGT > SEQ ID NO:2543 214437 233222_301088_1
AGGCGGCTCGGCGGCGAAGATGTCTCTGGTGAGCAATGAGGAGTTTCAGCACATTCTTCGTGTGCTCAACACCAACGTG
GACGGGCGGCAGAAGATCATGTTTGCGCTCACCTCCATCAAGGGTATCGGCCGCCGCTTCGCCAACATTGTCTGCAAGA
AGGCCGATGTGGACATGAACAAGAGGGCTGGTGAGCTGACCGCTACCGAGCTCGAGAACCTGATGCTGATCGTTGCCAA
CCCGCGGCAGTTCAAGATCCCCGAGTGGTTCCTCAACAGGAAGAAGGACTACAAGGACGGGAGGTACTCCCAGGTTGTG
GCCAACGCTCTCGACATGAAGCTCAGGGACGACCTGGAGAGGCTCAAGAAGATCAGAAACCACCGTGGTCTTCGTCACT

FIG. 2 continued

ACTGGGGTCTCCGCGTCCGCGGGCAGCACACCAAGACCACTGGACGCCGTGGAAGAACTGTGGGAGTGTCCAAGAAGCG
ATAGATAGCCGCAGCTTTTGTTTGGTCTCTTAATTTCCAATATGTTTTAAGTGCAAATTTTAAAATTCAtTAAGAAAAT
TAATTT

> SEQ ID NO:2544 214437 4800_300317_1
GATCTTTCTCGGCATCCAAAAATGTCTCTAGTTGCGAACGAGGAGTTTCAGCATATTCTGCGTGTGCTCAATACTAATG
TCGATGGGAAGCAAAAAATTATGTTTGCTTTGACCTCAATCAAGGGTATTGGAAGGCGATTGGCTAACATTGTGTGCAA
GAAGGCTGATGTTGACATGAACAAGAGGGCTGGAGAACTAAGTGCTGCTGAGATTGATAACCTCATGACAATCGTTGCT
AACCCTCGCCAGTTCAAGATCCC

> SEQ ID NO:2545 214437 9161_300301_1
CCCACGCGTCCGCTTTTGTGTTCTTCACTCTCCAGCGATCGTTTATTGCTTGAAGACGGCTTCTTCTTCTCACAAATCT
CATCTCTGCTAATCAAAATGTCTCTGGTTGCAAATGAGGAGTTTCAACACATTCTTCGTGTGTTGAATACTAATGTTGA
TGGTAAGCAGAAGATTATGTTTGCCCTTACCTCTATCAAAGGTATTGGTAGGCGATTGGCTAACATTGTCTGCAAGAAG
GCTGATGTCGACATGAACAAAAGGGCTGGTGAGTTATCTGCTGCTGAGATTGATAACCTCATGACAATCGTTGCAAACC
CACGTCAGTTCAAGATCC

> SEQ ID NO:2546 214437 1101924_301477_1
GGGAGGGAGAGGGAGAGGGAGAGGGAGAGAGAGAAGTCGAAAACCGGCTAATCTGCGTCCTCTAATCATGTCGCTGATC
GCCAACGAGGATTTCCAGGACATGCTTCGTGTTCTCAACACGAACGTAGATGGGAGGCAGAAGATCATGTTCGCCCTCA
CGGCGATCAAGGGTATCGGCCGACGTTTCGCCAATCTCGTCTGCAAGAAGGCAGACGTCGACGTCAACAAAAGAGCTGG
AGAACTCTCTGCTGCAGAGTTGGAAAGCCTTATGGTGATTGTTGCAAATCCTAGACAGTTCAAGATCCCCGACTGGTTC
CTGAACAGAAAGAAGGACTACAAAGATGGACGCTTCTCAAGTAGTGTCCAATGCTTTGGATATGAAGCTCAGGGATG
ACCTTGAGAGGCTCAAAAAGATCAGGAATCACCGAGGTCTTCGCCACTACTGGGGCCTTCGTGTTCGAGGGCAGCACAC
AAAGACCACTGGCCGCCGAGGAAGGACTGTTGGTGTCTCTAAAAAGCGTGAGGGGGGTAATTCTAGTTCCTTGTCGTGG
CTGGCATTTAGAAATGTCTCAATT

> SEQ ID NO:2547 214437 190584_300693_1
cccaaaaccctaaccctcgcagccgcatcgcgccaccgcctcctcctcccctcccctccggcgagagagcccgcgcc
gTTGCCGCCGCCGCCGCCGCCGCCATGTCGCTGATCGCGGGGAGGACTTCCAGCACATCCTGCGTCTGCTGAACACGA
ACGTGGATGGGAAGCAGAAGATCATGTTCGCGCTCACCTCCATCAAGGGTGTCGGCCGCCGCTTCTCCAACATCGCCTG
CAAGAAGGCCGACATCGACATGAACAAGAGGGCCGGTGAGCTTACGCCGGAGGAGCTGGAGCGGCTCGATGACCGTGGTG
GCGAACCCGCGGCAGTTCAAGGTGCCCGACTGGTTCCTCAACAGGAAGAAGGACTACAAGGACGGGAGGTTCTCCCAGG
TTGTCTCCAACGCGCTCGACATGAAGCTcagggatgATCTTGAGAGGCTCAAGAAGATCAGGAACCACCGTGGTCTGAG
GCACTACTGGGGCCTCCGTGTGCGTGGGCAGCACACCAAGACAACCGGAAGGAGGGGTAAGACTGTCGGTGTGTCCAAG
AAGCGATAAGCCTAAGAAccacccGAGActtgaTGAAGCGtttcGttgggtGAtgttttgcCCtaggataatATTTTGC
AGCTATGGAACcttgtcgtaatgtatcttgaagagtgtctttgggAACta > SEQ ID NO:2548 214437 206738_300825_1
GTCTTCAACCCGAACAATCGAATCTAACGAGCAGCACGGCAACGTCCCATACAGTTGCCCAGCATGTCGCTCGTCACGG
GAGAGAAGACGAACTTTCAGTTCATTCTCCGTCTTCTGAACACCAACGTCGATGGAAAGCAGAAGGTTATGTACGCCTT
GACCAAGATCAAGGGTGTCGGTCGCCGATACTCCAACTTGGTCTGCAAGAAGGCCGATGTCGACCTGAACAAGCGCGCC
GGTGAGCTTACC > SEQ ID NO:2549 214437 224123_300979_1
GCGGACGCGTGGGTCGAATCAAGGTCATGTACGCCATGTGCAAGATCAAGGGTGTTGGTCGACGATACGCCAACCTGGT
CTGCAAGAAGGCCGATGTCGATCTCTCCAAGCGAGCCGGTGAGCTCACCGTCGAGGAGCTCGAGCGAATCGTTACTATC
ATCCAGA > SEQ ID NO:2550 214441 218691_300920_1
GTCGCAATCGATCAAACAAACACCAGGACAAACCGGCAAAGAAATACCCTGCAGTCCTCGAGACTCGCGATAGAGCAGA
AGTACATCAGTCTTATTTACTAGCGAGCAAGACAGTCAAAATGTCGTGGGCGGGATTCAAGAAGAATGTGAACCGCGCG
ACGACGCAGGTGATGATGAAGACGGCATGTGGAAAAGACAAACGATCGCGATTACGAGGTCGAAGAGAGACGGTTCA
AGACGATGGAAACAGCTGCACTGCGGCTGCAGAAAGAATCAAAGGGCTACCTTGACTCTTTGAGAGCCATGACAGCTTC
ACAGATGCGAATCGCCGAGACGATAGATGCGTTTTACGGCGACTCCGGTGCGAAGGATGGCGTGAGCAGGAGCTACAAG
CAGGCCGTCGAAGATCTCGACGCCGAAACCATCAAGGCCCTCGACGGGCCTTACCGAATGACGGTGCTCGACCCCATTG
GCCGGTTCTGCGCCTACTTCCCCGACGTCAACGAATGCATCAAGAAGCGCTCGCACAAGCTTCTCGACTACGATGCTCT
CCCGAGCTAAAGTGAAGAAGCT

FIG. 2 continued

> SEQ ID NO:2551 214443 200546_300853_1
ggcgcaatgcttcaacAGCGTCTCTCGCCACAGTCTGGATCTGCCCGTGCCGCCACTCTGAACTACAATCACGCAACCA
AACCTTAGTTTAAATGCGCCGCTCTGCGCCCCCACAAGAGCTTGTGCGCATGTGCTGTGGCACTCAGTTCAAAGTGGTA
CTGCCGAGTCAAGTGAGACGTGCACCCTGGTCGAGGCCGTGACCATGGCTTCTCACCCTCAGACCAACGAGCTTGACGC
ATCTGCCTCTGCAGTGGCATTGCCGAAGAAGACGCTATCGAGGGCTGACCTGCATCGTCGTCAGTCGGCAGACGAGCGG
ATTAACAACATTCTCGAGACGGCTCTGCAACGAGCAGAAACGATGGATCCCGCCTCTCTAAGCCTTCTCCAGAAAGGCT
CTTCCCACAATTCCTCTCCCAACTATGGAGCCTCCGGAACGGTGACAAGAGGGATATTGCAAGACTATCAGGCGGTACC
GACCAGCGATGAAAGCGATGCCACCCGTCCGAGAAAGGTTTCATACAGCGATGCGGCGAAGAAGGCCGGGAACCATGCG
AAGAGCCAGAGCTCTCTGCGGCAACGAAACGGAGTCTCCGGCTCGGAGGATACAAGATCGCCAACAAAAGCAAAGTCAT
CATGGACGAAGGAAACATTTCGAAAATTTCAGTCCCTTCAGTTGGAAAACAAGGGAAGCGTGGCTAGAGATCACCTGGC
TCTCGGTATGTCGCATGCGTATACAGCAGCTGAGCTGCATGTCTCAAGAGAACCAATTGGCTGACCATTTCATTTCCCC
CCCCTTCCAGAACGCACATTTCTAGCATGGCTTCGAACCTCTCTCGCTTTTGCATCGATTGGCGTCGCCGTGACGCAGC
TATTCCGCCTCAACACTGATAACGCTTCCGCCTCCGATTTCGACCACACAAGGCTACAAAAGATGGGCCGCCGTTGGG
TGCGACATTCCTCGCCATTAGTAtTGTGACCTTGCTCCTCGGTTGCAGACGATATTTCCATGCCCaggAATGGATCCTT
CAGGGCAAgttcccGGCAAGCCGAGGGAccATcAtTATCATGTCACTGGTGgcattggcccTCATGATTtT > SEQ ID NO:2552 214452 116650_300079_1
CCCACGCGTCCGCCCACGCGTCCGACAGGAAGCAGCGAGATGGAAGGCAAGAGCCGGCGACCGGAGATAACCGTCGTGC
CGGCGGCAGGCGGCGGCGCCGCCGCCGCCGTTGATGCGGTGAAGGCGGCGAACAAGGAGCCCATCAGCCCGGGCTCGCC
GTCCCTGGCGAGCGGCGCCGGCAAGGAGAGCCTGAGCCGCCATGAGGCCGCCGTCGTGTCCCTGCCCGCGTGGAAGCTC
GACGCGCTCTGCCAGGAGTCCGGCTCGTCGCCGGCGGTGATGAGGGCGCGCTTCCCCTACTTCTGAATTTCTGAATTTC
TGATGAAGCCATGAGCTTTTTGCCATCTTCGTACGTGTGTGTGTGTGTGTGTGTGATTGTAACTGTGTTGTTCATGG
CTGAGTAAAGAATTATACTTCCTACAAGCGGCTGTGATGTATATGTGAGCTGCTTTAGCTGACGCGTTCATCTTTGGAC
GCTGTAAAAACTAAAAACTGCCAGTTTTTCATGTAGCATCATTGG > SEQ ID NO:2553 214452 122240_300017_1
agcccttattacagtctaacagccttattaattctagcttgttatacggccacagtgttactatgagcaaacgcatatt
gCTCGTCTTATGCATCGTTTGTTTACAGCGACGACTCGTGATTACTCATGAGTAAACCATTTACAGGGTTGATTTGAAC
TAATTAATTAACCCCCCCCCCCCCCCCCCGAAGTCTAATCAGTCGCATTGCATAGAAGAAGAATAGAAGCATTTGA
AGCCTCCTCCTCCAGGTTGCAGCAAAAGCACAGGAAGGCAGCGAGATGGAAGGCAAGAGCCGGCGACCGGAGATAACCGT
CGTGCCGGCGGCAGGCGGCGGCGCCGCCGCCGCCGTTGATGCGGTGAAGGCGGCGAACAAGGAGCCCATCAGCCCGGGC
TCGCCGTCCCTGGCGAGCGGCGCCGGCAAGGAGAGCCTGAGCCGCCATGAGGCCGCCGTCGTGTCCCTGCCCGCGTGGA
AGCTCGACGCGCTCTGCCAGGAGTCCGGCTCGTCGCCGGCGGTGATGAGGGCGCGCTTCCCCTACTTCTGAATTTCTGA
ATTTCTGATGAAGCCATGAGCTTTTTGCCATCTTCGTACGTGTGTGTGTGTGTGTGTGTGTGATTGTAACTGTGTTGTT
CATGGCTGAGTAAAGAATTATACTTCCTACAAGCGGCTGTGATGTATATGTGAGCTGCTTTAGCTGACGCGTTCATCTT
TGGACGCTGTAAAAACTAAAAACTGCCAGTTTTTCATGTaGCATCATTGGAAAAAAAAAA > SEQ ID NO:2554 214460 219439_300945_1
gcccacgctgtcgcccacgcgtccgatttcactcttcTGCAGACGAGGACGGACCCGATTGACCATGTTGCGACAATCC
TTCAGAGCCTTTGCCCGCACGGCTGTTGCGAGACCGGCCGCGGCGAGAAGCTACGCTACCTTCAACTGGGAGGATCCCC
TCAATGCGAACAACCTCTTTACCGAGGAAGAGcaggcCATTGCAGAAACCGCAGAGCGATACTGCCAGGAACGACTACA
GCCTAGGGTCTTGcaggCCTACCGAGACGAACACTATGACCCCAAGATCCTcgaagaGATGGGCGAGCTGGGCCTGCtT
GGCTCCAGCatcaaggGCTACGGATGCgCTggcgtttcttCGGTGGCCggcggcCTGATTAcacgagcGGTCGagcGaG
tc > SEQ ID NO:2555 214471 214490_300858_1
TCATGCGCCTCAAAGAATGGAAGAAAACACAGGCGAATGACGTGAAACGAAAGATAAAAAGACAGGCGCCTTCATGCGA
GGGTTTCGCCAGTCGCCTCTAGCGTGTTTCGAAGCGCAGGGTTGAAACGCGGCTGCATGATGCCCGGCCGCCCATCTGA
GGCATGGCGGCTACCGGAACAGGACGACATCCGAAGACTTGAGGAGGCTCCGTGTTTGTTCGTTTCGTTTCGTCTTTCG
AGTGAAGGGTTGGTTCTTGTTTTCGGCTGTTGTGTGTTTTGGTTGACTTGTGTTTACGGGTTGGGGGTGAGTTGAATTG
AGTGCGAGACTTGATGCTTCTGTCAACAAGCCAGCCACTTACACTGCGGCTTCACCCTTTCGTCTCTTTTACCATGTTA
CGCAACATGGCGAATTTCCTTCTATAGGATCCATATTGCCCAAATTCAGATCCAGCCCGCAAGGGAGAATTTTATCCGC
CT > SEQ ID NO:2556 214472 208957_300810_1
CCAAATTTTCTGCTTGTTCCTGGCGCCTCTGACACACACACGCACTGACAAAGCTGACTGGCTGTGGGCAACTCCCT
AGGCCGCCTCGCTCTCGGTCGTATGGCACCGAGAAAGGGACCACACTGATAGCGGCGGGGCCTCGATAAACGCCGCAG
CAAGGGTCTACCGTCAAGAGCCGGAAGTTGTTGGCTCGCAGCTAGTTGCCCGGTTGGTGGATCCGATAATGCGAAGAGA
GTCTTTGGGACCTGCGATCAGATTGGGCAATACTAGGGGGTGGCAAGAGATTTGTTTGTTGGTGGGATGTTGTTGG

FIG. 2 continued

> SEQ ID NO:2557 214473 215157_300878_1
GGGAAAATAGACTGCGAGAGAGAGAGCGACGAAAAGAAGGAAATGCTCCGATCACGATTAGGGGCGGAATTGGAAATCC
GGAGCTCCGACAGAGTGCGAAATGCGAATGCGATAGTTCAAATGTATGATTGATTTACTGTATGAGGCGACGATGATGC
GATGAAGAAGAACGGAAAATATCCCGAGCTGATGCATACATTGCGGGCTTTCCGGATATCTCGTCAGCCCTCCTTCCAT
TATGTCAGAAGCTATTATGCAGTTGGTTTTGATGGATGGGCGAATTTGATGACAAGGTGCAGTTTACTGGACGGGACCG
G

> SEQ ID NO:2558 214476 195472_300634_1
gctgcattttggggtcgcAAATCTACAGCAAAAATGGCCTCGACAACGACCAAGCAGACCCCGGCGTCCTTTGTCGGGA
CCAGCAAGGTCGTCGAGACTGACTATCCGCTCATCGACAACGACCCTCACTTTAAGCGGGTTATCGGATATGCGAGAAC
GTCAGACTACGTAGCTGGTGCAACCTCTGCGGCCTTTGCACCGACTGCTCTCTATGCCCTCGAGAGGCTCGCCCCGTCG
CATGTTGGCCGGGGAGGCTTTGCCAAAGCCATGCGGTTAGCCGGATTCATTGGCTTGGCCGGCGGTTTCCTCTACTTTT
ACCAGCGATCAGCCCTTCGATTCTACGGCGCCACTGAGAACTCAAGGGAAGTCGAGATGGATATGCGAGAGATGGTTTC
CAAGGTCAAGGCGGGACAGCCTCTGTATGGCGAGAGCAAGCTGAGCCCTCACCTGCAGGGAGTTGCGGCCCGACAGAGC
AGATACTCTGCGCTCTTTTTCAGCACAGTACCGTGGTTCAACTTTGTCAACCACAACCAGCACGGCGTGGACACGGCCA
AGTACTATCAGCAGGCCGAGAGGGAACTGGAAGCAGAGCGGGCGGCGGGCAAGAGCTAGACGGgacCAAATGTGTATAT
TTAGCGGGACTACCgctTCTTGcgg > SEQ ID NO:2559 214478 208832_300809_1
ATCCCCGGATTCAACACTCAATGCCGCCTCCATGAACGACTCGAGCTTCGTCCAAGCCCAACAGCGCGTCGCTGAGCGA
CGAGCGGCCCGCGAGGTCGAACAACGGGCCCGAATCGCGGCTCAGCGCGAATCGTCTCGCGTGAACAACCAGCTGCAGC
GTCTGGCATACCCCCTCAATCGCCTCGCCGGTGTCTGGGATGCAGCCGCCTCTATAGAAAACACCCGGCCTGCGTTTCG
CGTTGCGCAGGTTGATGCCGAGCTGCTGGATGAAGAGCTGCTGGAGCTCCTCAAGGGGCAGGTTGGCGACGCCCTCAGA
TACTATGCCGGCGGGCATCTCAAAGACGACTGGTCTTCCGAGATTCAGCTGGCGCTCAGGGCCATCCTGTTCAAACTGA
GCGTCTGGGATAACGATGCAACGTACGGAGCGGGTCTACAAAACCCTCAAATACACCGACGCCAGAAAAGGGGGCCCCGT
GCTGTCACCCCCGACGAGGGTACAAAAGTCACTATACGGGCTGGTAAC > SEQ ID NO:2560 214504 216933_300903_1
aaacGAAACCGCAATCCATCTCCCGGCGGAAATTGCCCTCCAACCGCAACCATGTCGACCCTCCCCAGGACTCTGGGCA
ACCTGCGCAAGATTGGCATCAAGGAATACTTCCGCCAGATGCTGGTTCGTCTCTCGCCCTTCTAACCTCCCACGACCTC
TGGCTAACGCACAGCTCTTCGCGGTCCTCCTCGAATAGTACATCGGTGACACCAAGTACGGTACTCTCATCGGCCAGGA
TCGCTTCGGCAACAAATACTACGAGAACCTCGAGGAACTGCCCCTCCGAACCCGCTGGGTCGACTACGCCAAGCAGGAC
TACGATGCCTCCCACATCGAGCCCGGCTGGCACGCCTGGATCAGCTACTCCGTCGACAAGCCCCCGACCCAGGACAGCC
TCATCGCCACGGGCACCAGACACTTTGAGCCCGCCCTTCCCAAGCCCAACTTTACCGGAACGCGAGGCGCTTACAAGCC
GTATAACACAGTGAAATCGAAGCTTAATGCTTGGGAGCCGGTGGCCAAGGATCGGGTATGAGTGGTTTTTACGTTTTCT
TTTTTAAACCGTGGGAAAATATGGTGTACATAttGAAATCGCGCAACAAACGCAAACAAATCAAACAATAGACACAGAC
ATGTG > SEQ ID NO:2561 214527 220492_300955_1
TACAGTTCAAAATGGCCAGTTCAATTCTTCGAGGGAGGGCGCTGGGAGCCGTGCGCCAGGCCCGTTGCTTCAGCTCTAC
TCCAAGGCAATATGCCGCTGATGTCAAGAGCGTCGGTGTTCTCGGCGCCGGCCAGATGGGTCTGGGTATCGCTCTTGTT
GCTGCGCAAAAGGCGCAAGTTCCGGTTACTCTCGTCGATGCTTCTGAGCAGGCATTGAGTAAAGGCATTGCTTTTGCCG
AGAAGCTGCTGGCCAAGGACGTGTCCAAGTCTAGAATTACTCAGGAACAGGCTGATCAAGCCCGCTCCCTGCTGAAGAC
TAGTACCAAGATTGAGGACTTCTCTTCTGTCGACTTCATTATCGAAGCTGTGCCTGAGATCCCTCAGCTCAAGTTTGAC
ATCTTCAGCAAGCTGGCCAAGGTAGCTCCCGCTCACGCAATCTTGGCGACCAATACCTCTTCAATCTCCATCACGCGCA
TTGCTGCCGCCACTACCAACGATCCTAATGACACCTCGGCTTCATCGAGAGTTGTTTCTACTCACTTCATGAACCCGGT
CCCTGTTCAGAAGGGTGTAGAGATCATTAGCGGCTTGCAAACCAGCAAGGAGACGCTTGATACGGCAGTTGAGTTCTGC
AAGCGGATGGGCaaagtcACTTCCGTTTCGGCTGACTCTCCt > SEQ ID NO:2562 214530 216893_300902_1
agtatctCAAAGATGGGCACCAAGATGGATTTCCAACACTTTGCGCCGCAAATCGACAAGATCCCCAAAGTTACACCGA
GGCAAATCGCTTCTACTGCTCTTTGGAATACTGTCCGCGACAACTTCTCCATCTCGACGTGGATGGCCATTGGAGCCAC
CCTCCAGGGTCTCTTAGTTTTGTTCGCTCGACCTACATTCGCGATTGCACCGGCAACGCTCATCTTGCTTTACCGATTC
TCCCACACGATGCTCATGCACTACGGCTTTATTCGCAACACGCAGATGGAAGATGTCATCATGGGAAAGTATACCGTGC
AAATTCCCGACAAGGACGGTAAACCGCCAAGTGAGCCGTCGGGGACAGGCATGGCTGTCATCATGCTGGGCTTCAGAAA
CAATTCCGCCCTCGGTATGTTTGGAGCAGGCGGGCTGGAGACCTCCCTCAAGTTTCAAGCGATGTTGAAGGATCTCGAG
AATGATCCGGACTCCGGCTTTCTTGGCATGTGTGGGTATAAAGCTGCCAATGAGCGACCGACGGCCAACGGTTTCATGT
CGGTGCTTTATTTCCgtagtgTTGAGGAtATCAATCGattcgctcacgcCC

FIG. 2 continued

> SEQ ID NO:2563 214533 220285_300953_1
TCGACACCCCTTCACGCACTCGCCATTGCCGCGCTCCTCGTCACGCTCTGCTCGATTAGCCGTCTCTCGCCCATTGATT
GAACCTGCTCTCGGCCTCTGCAGCCACCCTCACGCAACCTACGCCTGACATCCTCTGCGTCGCTCGGCTGTCTCCCGGT
TTTATCCATCAGCTGAACCTTCACCTTCGCCTTCGCTCTCAAGAGGGAATCCGAGGGCCCGGCCGTTCTCTGCCATCTA
TTGTTATTGCCATTAACGCTGCTGCTGCTGCCACTGTCTCCTCTACTCCTGTTTCGCCCTCATATGTCTCAGCCGCCTC
GCCGGATGCCTCTACTATCACACCCTAAACACCGTATTAGCATACTTGATCTTACCAAACTGCCGTTGCAGTAACGCCG
GCTTCATCTTCTTGACAATGCCGTCGAAAACTAACAATGGTGTGGGAGTTCAGGTCGAGGACACAAAGATATGCGTTGT
CATGGTTGGTCTCCCGGCCCGCGGGAAGAGCTACATTGCCCAGTTAGCCCAGAGATACCTGCAATGGCTGTCGATTCCG
GCAGCGACTTTCAATGTCGGCAACTATCGGCGCAATGACGCTCCACAGCCGACTGCCGACTTCTTTGATTTTAACAATC
CCGAAGGAGAGCGGAAGCGCCGTGCGGCTGCCGAGGCCGCCGTTGCTGACATGCTTGCCTGGTTCCGCACCGGCGGCGT
CGTCGGCATCCTTGACGCGACCAATTCTACAAAGGAGCGCCGTAAATGGGTCATGGACACGTGCACCGCTCACGGCATT
GAAGTGCTCTTTGTCGAGAGCAAATGCGATGATGAAGAGGTCATCATGGCCAATATCCGTGACGTCAAGCTAACGAGCC
CCGACTATCGAGGCCAAGATCCCGAGGCCGcgGCGCAAGACTTTCGCAATCGCATCAGCCACTACGAGAAAGTTTACaa
GACCATCAACGCCGACGaGGATGAGgAcAaCTACAcCTAccTaAAGCTGATGAaCGTcggcaagCaagtcatca > SEQ ID NO:2564 214539 207607_300827_3
AAAGTTTGGCTACGCTGTGTTTATTGGCCTCCAGGGCTATGAAATCTTGCTGATCCCACTGTTAAAATGGAGTATGCT
ACTTTTCTCAAAGAGACTTCCGAACCCAATCCGATCTTATGTCAATATACCTTGGTATCCCAAAAGTTGAAAAGATGTC
GTCGCCCCTCTAGCCGCCACCAAGACCCCAGACTCCCCACAAGATAGCAGCATAGAAGAAGCAGAATGCACCTCTGTC
AGACAGTCTGCCTCCACTGCTTCTATTCATAAGTGGAGTGATGAGAATATTGAAGATAGAGGAATGTATCGATTACTGT
CTTCACCAAATAGAGACTGCCATGACGAGATCAGAATTTCGACACGTCCTGCAACTCCATCTAAGGCACTAATGTGCCT
TATACTTTCAATACATAAAAATAGGATTTTGGATCCAGGAGACTGCTATGACGACATTAAATCGATAGGTGCTTTAACT
CCATCTATGGCACCTTATATTTTCCTAACAAAAGAAAACCTCGTGTCTTCAATCCTTCGAGATCGTTTTTTGCGTCGAG
GCGAGCCTGATAATTTAACCTGTACCCAAATACTGAAATGCTAGAGGAGCCTGCTAACAGCTCACATAAGCAAGAAGGT
GGCCTCGACATCTGGAAATGCTGAAGAGC > SEQ ID NO:2565 214545 211475_300899_1
gttcacgattcctcctttcttccccctccatactatttATCCTGCCTCTTCCTCGTCTTCCATCTGTTGCCGGTGTGACT
CTTGCAATTCATTCCCTGCCCGGCTTCCTCGCTTGATTGAATAGCCGTTGCTACTTCCAACTGCAAATCATTATAGCTA
TACCTCCCTAGCTTCATATAAGCTCGGCTCTTCTAGGAACGCGCAAGCAAACATCCTCGGCAGTGACCCACGAGCCTTG
TCTGGAGATTTTAAATAGGAAAGCTCATCAACGGCACCTGAGCAGCGTCCAATTGCTCTGTTCAGCTCAATTAAGCTTT
CAAGATGCCTAGAGACGGCAGTAAACAACCGCCCTCAGCGGCGACAAACCTCATCGCTGGTGGTGGCGCCGGTATGATG
GAAGCCCTCGCCTGCCACCCTCTAGACACAATCAAAGTGCGAATGCAGCTCTCTCGCCGTGCACGAATGCCCGGCGCCC
CCCGCCGCGGCTTCATCAAGACTGGTGTAGAGGTTGTGAAAAAGGAAACTCCTCTCGCTCTATACAAGGGCCTCGGCGC
CGTCTTGACGGGCATTGTCCCTAAAATGGCTATCCGATTCACATCATTTGAGTGGTATAAGCAGCTCCTAGCCGATAAA
ACCACCGGCACCGTCTCAGGCCGAGGAACATTTCTGGCTGGTCTCGCTGCCGGTGTGACAGAAGCCGTGGCCGTCGTGA
CACCCATGGAGGTCATCAAAATCCGTCTGCAGGCGCAACATCACTCAATGGCCGATCCGCTGGATATTCCCAAATACAG
AAACGCCGCGCATGCTCTGTATACCGTCGTCAAGGAGGAAGGCTTCGGAGCGCTATACCGTGGAGTCAGCTTAACAGCC
TTAAGAcaaGGCTCCAACCAGGCTGTCAACTTCACGGCATACTCTTACTTTAAGCAGTGGCTCAaGGACTACCAGCctc
agtatACcgaCGGTaaC > SEQ ID NO:2566 214547 214966_300876_1
aaccctccagggcagctagcgaagagagcaggcccagttccgggtgacaggtcgggcaacgccgcgacggctgcgattc
cGAGCGAACGGCGCTGGCGTTCCAGACGGCACAGCAGCAAGCACAGCAACAGCACAGCACAGCTACGAACATCGAGGAT
CCCGCTCCAGGAACCGGTGCTATCCAGAACAAGGCCCCGGCGCTAGGACCCGCGGTTGGCAGTGGTGGATCGCAAGGCT
CCAGTCATGCCATGCAAGCGAGGGAAAAACGCTTGCATGCTCATGCTTTGCTCTGGCTCTAGATGAGTCTGAATCTCAT
CCATCCTCGACCTgctgctgtGTCTCCCCGTCCCGCACGAGGCTTCGGTCGGCGAGAGCCGGGATCGAGGCGTTGGGGG
ATGGCGTCTGTGAGCCagaCATGACCTGTCACAGCGCTGCGTCGATGATGAAAATGgcCTGATTTCTTGCTCGCGGAGC
TATGccGGGAccctgcaaccgcgaAATgggctgccacCGGCcAcAGAGAaaa > SEQ ID NO:2567 214548 216980_300903_1
CGAATATCATGCTATCAGCCGCTTCCTTCGTTCCTGGAAATGGTCCATGCTGACCTACCTACCCCTCGCCTTGGCCCTT
CAACTACGCAACCCCAGGCGCATCAACCTCGTCAAGGCCATCACCGGCTCTACCCGATCATCCACTTTTCTTGCTACCT
TTATAACCCTCTTTTACTACGGGGTGTGTCTGGCCCGCACTCGCCTCGGCCCCCGCGTCCTCGGCAAAGAAATACCGAA
CCGCCAGCGAATCGACGAGGGCATCTGTGTCGGTACCGGATGCTGCCTTTGCGGATGGAGCGTCTTCATCGAGACGGCA
GGTAGAAGGAAAGACATGGCCTTGTTTGTGGCGCCGCGGGCACTGGCAACGTTGGTCCCTCGGCGGTATCCCCTGGAGA
AGCAGTGGCGAGAGAAGTTGATATTCGCAGCGAGCACGGCAGTCGTGTTTACTTGCGCCCTTGAGAATCCAAAGAGAGT

FIG. 2 continued

TAGAGGCGTACTAGGGGGGATTTTTGGGCATGGTGTTGAAGAAATAAACCGGGCATATGGGCAAATATGATCTCTTTTAG
GGAGTTCTGAGACGTGACATGACTAATTTCTTCTTCTTCTTTGGATGTCTTTGGAATAAGCTACGGTTTTTAGATGATA
TACACAAACAACCCTGATGCTATAATTGGTAATAAATACATAATATTAATTGTTTATCCAaacaaAAAAaaaaa > SEQ ID NO:2568 214564 220225_300953_1
gcttcagcccggctctccaagaacaccatccgcctcaatcggcacatgcaaaagcagcgacactcgtcgatcgcggctg
aCAGACTGCAGAGCTACAGACGACAGATAGACACAGCTCCCTACCCTCAAGCTCACGCTCAAACTTGCTTTCGCACTCG
CACCCGCACCCGCACCCGCACGCGGGCTCGCGCCAGCCCTCCGCGAGACAATACGAGACCACAAAACACCACGGCATCT
TCCCCACATTCTCCAGCCAGAGACCTCTCCACGAATCGGGCTTGGGCTCATCCTATTTTGCCTTCCCTCCTCCCAACTC
CTTCCGAAATCTCGGCATCGTGAACTCCGGGCTCCAATGGCTACCAGAACGGGTTCGACCGGCGTGGCCACCTATGCCG
ACTGCGTCGATTCGCTGCGCAACTCTCTCAAATTCCTCGAGGCCTCCGTGGAGACCATTGACCGTGGCGTATCTGACTT
CCCTCGCCTCGTGAACGTCCTCAAGACAGTCCGACACTACGAACTCATTCCCCAGCCCACACTCGCTGCTGCTGAGGCT
TCCCTGCGCGACGAAATTGGGCCCTACATCGCTTTTCTCCTCAGCCGCGCTGATGCTCAAGTTGAACGCCAGGAACGCC
GCATTGAGACGCTCAAAGCCCGGGCTGAGTTACAACagggacgGTTAACTAGGCCTGATGAACcggCACGCAGcgtat > SEQ ID NO:2569 214569 207785_300828_1
GGACCTATAAGACAAGCTGTGGCTTTTTTAATCCTTACTTTCAATTCCATTCCAGTGTTGCTACCTTTTCTT
GGGAATAACTCAGCTACAAAGACAATTTTGAACCTACAACATCATCATCAAATTATCATTATTCAAAATGAAGTTCACA
ACCATCGTCACCGCTGCTGTCTCTTCAGCCATTGCCGTCTCCGGCACTCCCATCCACAAGCGCGAGATCGGCGGCGTAT
GTCTTCTCCCTCTCCTCTCCCTTGCATCTTCTCCATTCCTATCACTCGTCTGATTCAATATCATCTCTAACTATTGGTC
AATCCCTCACAGGTCCTCTTGTGCACCGGCGTCAATGCAACCGGCACCTGCAGCTACAACGTCTACGAACTCAAGACGT
GCCACCAGCTTCCCGCGCCTTTCCACCAAAACACCAGCACGTTTGCCCCCGACGGCGAAGACTTTGAGTGCTTCCCTCG
TATTGGCGACTGCGGTTCTATTTGCACCAGCCCGACGGGATGTACCTTTGGCAGCGTCGACTTTAACTACAAGAACAAG
TTCAATCTGGGGGCTATTAAGTGGAACACCTTGATTTCCAGCTTTGACTGTTCGCTGAAGACGACGACGACTTC > SEQ ID NO:2570 214613 108349_300381_1
CACACTCCAATTTCCAATTTCCAATTTCCCAATCTGCAATTTTCTCTTTCCCTTTCAACAAAGAAAAATCTCAGAGAGA
AAAATGGCGGATCAGCTCACCGACGATCAGATCTCTGAGTTCAAAGAAGCCTTTAGTCTCTTTGACAAGGACGGAGATG
GTTGCATCACAACTAAGGAGCTTGGAACTGTAATGCGGTCATTGGGGCAGAACCCAACCGAGGCTGAGCTTCAAGACAT
GATCAATGAAGTTGATGCTGATGGGAATGGGACCATTGATTTCCCAGAGTTCCTTAACCTGATGGCTCGCAAGATGAAG
GACACTGATTCCGAGGAGGAGCTAAAGGAAGCTTTCAGAGTGTTCGACAAGGATCAGAACGGATTCATCTCGGCAGCTG
AGCTTCGTCATGTCATGACAAACCTAGGCGAGAAGCTTACAGATGAAGAGGTTGATGAAATGATCCGTGAAGCTGATGT
GGACGGCGATGGGCAAATCAACTACGAGGAGTTTGTCAAGGTCATGATGGCCAAGTGAGAACTGACGAATCCAACTTTT
AATCTTTATTAGAAGTAAAAAATACGAAGAGAAGGAAACAGGGCAGATAAGTTTGTTGAGATTCTGTTTCAAATTAGGA
CATATTTACCTGTCTCAGTGCTTGCCTATTTTCcta > SEQ ID NO:2571 214613 1100495_301460_1
GTTCCACGTGCTTTTCTGCTCTCTTTTGGTTTCACGACTGCCCAACTCAACCTGCCCAGCGCTCTCTCTCTCTCTCTCT
CTCTCTTCCTGGTTTGGGTTTCTATGGCCGCAGTGATGGTCGAGCAGCCCCTGACAGAGGAGCAAATAGCCGAATTTAA
GGAGGCCTTTAGTCTTTTTGATAGAGATGGAGATGGGTGCATCACAACAAAGGAGTTGGGCACGGTGATGAGGTCGTTA
GGGCAGAACCCCACTGAGGCCGAGATCCAAGACATGATCAATGAAGTGGATGCAGACGGCAATGGGATCATCGACTTCA
TGGAGTTTGTGGGCCTCATGTCTAGGAAGATGAAGGATACTGACTCAGAAGAGGAGCTCAAAGAGGCCTTCAAGGTCTT
TGACAAGGATCAAAATGGCTTCATCTCAGCCCTTGAGCTCCGCCACGTCATGACCAACCTCGGTGAGAAGCTCAGTAAC
GAAGAGGTTGACGAGATGATCCGAGAAGCCGATGTGGACGGGGATGGCCAGATTAACTATGAAGAATTTGTCTTAATTA
TGATGAGTAGTAAGTAAGTAGGACCCCCATATAGAAGCCTCTTAAACCCTTCTCTAAGTCTTGTGTGTACTCATG > SEQ ID NO:2572 214613 190460_300818_1
CACAGCCCGCGCACCTCCACACCATTAGCCATCAACGACCAGCATCTCGGCTTTGCTCGCCTTCTCGAAGCTTCTGCTG
CCATGGCGGACCAGCTCTCCGAAGAGCAGATTGTAGAGTTCAGGGAGGCCTTCAGCCTCTTCGACAAGGACGGCGACGG
TTCTATCACCACCAAGGAGCTAGGAACCGTGATGCGAAGTCTGGGGCAGAACCCAACAGAGGCGGAGCTGCAGGACATG
ATCAGCGAGGTGGACGCGGACAGCAACGGCAACATCGAATTCAAGGAGTTCCTGGGCCTGATGGCGCGCAAGCTGAGGG
ACAAGGACTCCGAGGAGGAGCTGAAGGAGGCGTTCCGCGTCTTCGACAAGGACCAGAACGGGTTCATCTCGCCGCCGA
GCTCCGCCACGTGATGGCCAACATCGGGGAGCGGCTCACCGACGAGGAGGTCGGCGAGATGATCAGCGAGGCCGACGTC
GACGGCGACGGGCAGATCAACTACGAGGAGTTCGTCAAGTGCATGATGGCCA > SEQ ID NO:2573 214613 190427_300818_1
cctcgccactcgttccccttccttcctcTCCTCCTCTCGCGGAACCTTCTCGAAGCTTCCACACCCCCAACCTCGCCTC
CACCACCAACCCCCCATGGCGGACCAGCTCACCGACGAGCAGATCGCCGAGTTCAAGGAGGCGTTCAGCCTCTTCGACA
AGGACGGCGACGGTTGCATCACTACTAAGGAGCTTGGAACCGTGATGCGGTCCCTTGGTCAGAACCCAACTGAGGCGGA

FIG. 2 continued

```
GCTGCAGGACATGATCAACGAGGTTGATGCTGATGGCAATGGGACCATTGACTTCCCAGAGTTCCTGAACCTGATGGCG
AAGAAGATGAAGGATACCGACTCTGAGGAGGAGCTCAAGGAGGCCTTCCGTGTGTTTGACAAGGACCAGAACGGTTTCA
TCTCGGCTGCTGAGCTCCGCCACGTCATGACCAACCTTGGTGAGAAGCTGACCGACGAGGAAGTCGACGAGATGATCCG
TGAGGCTGACGTCGATGGCGATGGCCAGATCAACTACGAGGAGTTCGTTAAGGTCATGATGGCCAAGTGAGGAGGGTTC
CCATTAAATAAGTTCTGTCTGAaGTGAACTAAAACTGTCAGGGCCTACAACAAAGCTGTACTttgtgATG > SEQ ID NO:2574  214613  157582_301740_1
TTCAAACTTCAAAGACCAATCTTTTTGTTTCTCCCTTTACGTTCTCTGAATTCCAGAAGCTTCTTCTCCCTCTCTCAAT
GGCGGATCAGCTGACCGATGATCAGATCTCTGAGTTTAAGGAGGCTTTCAGCCTATTCGACAAGGACGGCGATGGTTGC
ATTACAACTAAGGAGCTTGGGACTGTGATGAGGTCATTGGGACAGAACCCAACTGAAGCTGAGCTCCAGGACATGATAA
ATGAAGTGGATGCTGATGGTAATGGAACCATTGACTTCCCAGAGTTTTTGAACCTCATGGCCAGGAAGATGAAGGATAC
AGACTCGGAGGAGGAGCTGAAGGAGGCATTCAGAGTTTTTGACAAGGACCAGAATGGTTTCATTTCTGCTGCTGAGCTC
CGTCATGTGATGACCAACCTTGGTGAGAAGCTTACTGATGAAGAAGTTGATGAAATGATTAGGGAGGCCGATGTCGATG
GTGATGGACAAATTAACTATGATGAGTTTGTTAAGGTCATGATGGCCAAGTGATTTCCCTCTTCTGCAGTTTACCTTTT
TTACACTGAAGAAAGACCAAACATTCATCAGACTGGGTCAGC > SEQ ID NO:2575  214613  147736_301255_1
GCAGATCAGCTCACAGATGATCAGATCTCTGAATTCAAAGAAGCTTTCAGCCTTTTCGATAAGGATGGAGATGGTTGCA
TCACCACTAAGGAGCTTGGGACAGTGATGCGGTCATTGGGACAAAATCCAACTGAGGCTGAGCTTCAAGACATGATCAA
TGAAGTAGATGCTGATGGAAATGGAACCATCGACTTTCCCGAGTTCCTTAACTTGATGGCTCGCAAGATGAAAGACACT
GATTCTGAGGAGGAGCTCAAGGAAGCTTTCAGAGTGTTCGACAAGGATCAGAATGGATTTATTTCTGCAGCCGAGCTGC
GACATGTCATGACAAACCTAGGCGAGAAGCTTACTGATGAAGAAGTTGATGAGATGATTCGTGAAGCTGACGTGGATGG
TGATGGCCATATCAACTATGAGGAGTTCGTCAAAGTCATGATGGCCAAGTGAGAACTGATCAACTTGACTTAATTCTTA
GTAGTAAAAAATTACAAAAAAAgaagcTGGCAACGGAGCagaTAAATtggaTGAGATCTCTATATTtg > SEQ ID NO:2576  214613  127261_300469_1
cgattattttgtCTGAAATTCCAGAACAATCTTCTCTCTTAAGTTTTCTCTGTTGTTGAATTGAAGAAGAAAATGGCAG
ATCAGTTAACCGATGACCAGGTCTCTGAGTTCAAGGAGGCCTTCAGCCTATTCGATAAGGACGGAGATGGTTGCATCAC
GACTAAGGAGCTTGGGACTGTGATGAGGTCGCTCGGACAGAACCCCACCGAAGCAGAGCTCCAAGACATGATAAACGAG
GTGGATGCAGATGGTAACGGAACCATTGACTTCCCTGAGTTTCTAAACCTCATGGCCCGGAAAATGAAGGATACTGACT
CCGAGGAGGAACTGAAGGAGGCGTTCAGAGTGTTCGACAAGGATCAAAATGGCTTCATCTCCGCTGCTGAGCTTCGTCA
TGTGATGACTAACCTTGGGGAGAAGCTTACTGATGAAGAAGTTGATGAGATGATTAGGGAAGCAGATGTCGATGGTGAT
GGTCAAATTAACTATGAGGAGTTTGTTAAGGTCATGATGGCTAAGTAATTTCACCATCTCTTATTGAAGTTGAAGTTTA
GACTTGTTAAAAATGTGAAAATTCCAAAAATATTTCATTGGATAGGATTTGCCTAGTGTAATGTGTTCCGTTGTACCAT
CTTGGATGTATTGGACCTGGAATGAATGTAATGcTTTAtTGt > SEQ ID NO:2577  214613  1108616_301519_1
GTTTTGGAGAGACGGGGAGCTGAGATGGCCGACCAGCTGACGGAGGATCAGATCGCAGAGTTCAAAGAAGCCTTCAGTC
TTTTTGATAAGGATGGAGATGGTTGCATCACAACGAAGGAACTGGGGACTGTGATGAGGTCTCTGGGCCAGAATCCAAC
GGAAGGAGAGCTACAGGACATGATCAATGAAGTGGATGCAGACGGAAGTGGAACCATTGACTTCCCCGAGTTCCTCAAC
CTCATGGCCCGCAAGATGAAGGACACCGACTCTGAGGAGGAGTTGAAAGAGGCCTTCCGTGTGTTTGACAAGGACCAGA
ATGGATATATCTCTGCCGAAGAGCTTCGTCATGTCATGACTAACTTGGGAGAGAAGCTGACCGACGAAgaagTTGATGA
GATGATACGGGAGGCGGACGTGGACGGCGATGGCCAAATCAATTAcgagGAATTTGTGAAGATAATGCTGTCCAaGTGA
GGAGACCGAACGGGAATACTTGGGTTGTGTGTGAGGGGACTTTCTCTTACTCGTAGCAATTCTTTTTgtgtgaAATTGA
GCAACta > SEQ ID NO:2578  214613  1112638_301803_1
TTCTCTCTCTCTCTCTCTCTCTCTCACTCTGTCCAGCTCCTCCTCCTCCTCAGCAATGGCAGACCAGCTGACAGAGG
AGCAAATCGCAGAGTTCAAGGAAGCCTTCAGCCTCTTTGATAAGGATGGAGATGGTTGCATCACAACGAAAGAGCTGGG
TACCGTCATGCGTTCCTTAGGGCAAAATCCAACTGAAGCAGAGCTTCGAGACATGATCAATGAGGTTGATGCTGATGGA
AACGGAACAATTGATTTTCCGGAATTCCTGAATTTGATGGCCCGTAAAATGAAGGACACGGACTCTGAAGAGGAGCTGA
AGGAGGCATTCAAGGTCTTTGATAAGGATCAAAATGGCTATATTTCTGCCGCCGAGTTGCGTCACGTGATGACTAATTT
GGGAGAGAAGTTGACGGATGAGGAGGTCGATGAGATGATTCGTGAAGCGGACATTGATGGGGACGGCCAGGTTAACTAT
GAGGAGTTTGTCAGAATGATGCTTGCAAAATAAAATCCCCCATTCCTTGCACTCAATCTAACACAAATAGGTTGCTAAT
TTGCTTTTTGGGATAGGTTGTATTAAGCTTGCACTCCCTAAGGAATGAATTGTTTTTTTCTTTCCCTTTTTTGTTCA
TATAGCCATGGCTGAAATGCTTGGGCACAATTATCAGTTATGCTTCATtGAGACaccATACgggCTttaTGaGCTTGTG
TAACTTTGATGaag
```

FIG. 2 continued

> SEQ ID NO:2579 214613 1107219_301505_1
AATAGATCCTCCTCAGGCGATACTGCTTCTGCTCATCTTCTCTCCTTCAATATCTCGTCCTTGGCAGTAGCGCGAATCG
AACAGCGGTGGAATGGCGGAGCAGCTGAGCCCTGAGCAAATCGCTGAGTTCAAAGAGGCCTTTAGCCTCTTCGACAGAG
ATGGAGATGGCTGTATTACAACTCGGGAGCTGGGGGTAGTGATGCGGTCGTTGGGTCAGAACCCAACGGAATCAGAGCT
TGTAGACATGATTAACGAAGTTGATGCTGATGGCAATGGGACCATCGATTTTGCGGAGTTTCTCAACTTGATGGCCCGC
AAGATGAAGGATACTGACTCTGAGGAGGAATTGAGGGAGGCTTTCAAAGTTTTCGATAAGGACCAGAATGGCTTTATCT
CCGCTTCCGAGCTGCGCCATGTGATGATAAACCTTGGCGAAAAGCTGACTGACGAAGAAGTGAAAGAGATGATTCGGGA
GGCTGATACGGACGGGGATGGCCAAGTCAACTACGAGGAGTTTGTGAAGATGATGCTCTCtaagtGagtCGGGAAAGTC
AAAGTCaaAAGCGAaAAGTGAAAAGTAAAAAGtaaaaAaAtT > SEQ ID NO:2580 214613 226347_300996_1
AAAAATATTACAAATGTCGCAAAACTCCAAATCTTTCAAGGACGCCTTTTCCCTGTTCGACAAGAAGGGCACCGGCAAG
ATTCCTGCTGAAGCTCTCGGTGATCTTCTCAGAGCTGTGGGCCAGAACCCCACCCTCGCTGAGATTGATGATCTGAAGC
AGACCATTCCCGCTGAGTTCGACTACGAGACCTTCTCCAAGATCGTCAACCGACCAAGCGGTTTCAAGTCTCTCGGTGA
GCCCGAGGATTACATCCGGGGATTCCAGGTGTTCGACAAGGACTCCACTGGGTTCGTGGGTGTCGGCGAGATGCGATAC
ATCCTTACCTCGCTGGGCGAGAAGATGTCTGATTCCGAGGTTGATGAGCTCCTTAAGGGAGTCAACGTTACTCGAGACG
GCAACGTCAACTACGTTGACTTCGTCAAGTCCATTCTGGCCCAGTAGATACCTAATATATTTTTTATGTTTGAGC > SEQ ID NO:2581 214613 1101059_301473_1
accccctctctctctgtctgtgcctctctctctctctctctctttatatatatatattctctttcctccggtcaaacgtt
gGGAGTAGCATGGCCGAACAGCTGACTGAGGATCAGATCGCAGAGTTCAAGGAAGCCTTCAGTCTCTTCGACAGAGATG
GCGATGGTTCCATCACCACCAAAGAGCTAGGGTACAGTTATGCGTTCTTTAGGGCAGAATCCAACGGAAGCTGAGCTTCG
AGACATGATCAATGAGGTTGACGCTGACGGAAATGGAACAATTGATTTTCCAGAGTTCCTTAATTTGATGGCTCGCAAA
ATGAAGGATACTGATTCTGAGGAGGAGCTGAAGGAAGCATTTAAAGTCTTTGATAAGGATCAGAATGGCTACATTTCTG
CTGCAGAGTTGCGTCACGTAATGACAAATCTTGGAGAGAAGCTGACTGATGAGGAGGTTGATGAAATGATTCGTGAAGC
TGACATAGACGGGGACGGCCAGGTTAATTATGAGGAATTTGTGAGAATGATGCTTTCAAAGTAATTCCAAACTTGTTCT
TGTTgCCGTTCGTATTCAAATAGCAGATCTACTGCTAACAAAGATTTGCTTTGGCACATAATTGAGCCGCTTTTTCATG
TGGAAGGAGGCAAAAAAAGGCCACAAAGTTCACCAGAACAATTAGCTGCTGTGTATTTTGAGGTAGTAGGTTATATAA
CGTTTGTagTGG > SEQ ID NO:2582 214613 245055_301564_1
AGGAACACAGCAGCAAGCTTGGTGCTTCGTCGTCCGGTACCCCTGTTCTTCGCAGGGCCTGAAAAGGAAGGAAGAGTTT
TAAGCAAGAGACATCGATGGCCGCCTCTGCTGCCGAGCAGCTCACACAGGAGCAATTGGCAGAGTTTAAGGAGGCCTTC
AGCCTGTTTGACAAAGATGGCGATGGCTGCATTACCACCAAGGAACTGGGGACGGTGATGAGATCCCTGGGACAGAACC
CCACCGAGGCGGAGCTGCAGGACATGATCAACGAGGTGGACGCGGACGGGAACGGGACCATCGACTTTGCCGAGTTCCT
GAGCCTTATGGCCAGGAAGATGAAGGACACCGACTCGGAGGAGGAGCTCAAGGAGGCGTTCCGGGTGTTCGACAAGGAC
CAGAACGGCTTCATCTCGGCGGTGGAGCTGCGGCATGTAATGACCAACCTCGGGGAGAAGCTCACCGACGAGGAGGTGG
ACGAGATGATCCGGGAGGCGGACGTCGACGGCGACGGGCAGATCAAC > SEQ ID NO:2583 214613 254553_301633_1
CCTCAGGCGATACTGCTTCTGCTCATCTTCTCTCCTTCAATATCTCGTCCTTGGCAGTAGCGCGAATCGAACAGCGGTG
GAATGGCGGAGCAGCTGAGCCCTGAGCAAATCGCTGAGTTCAAAGAGGCCTTTAGCCTCTTCGACAGAGATGGAGATGG
CTGTATTACAACTCGGGAGCTGGGGGTAGTGATGCGGTCGTTGGGTCAGAACCCAACGGAATCAGAGCTTGTAGACATG
ATTAACGAAGTTGATGCTGATGGCAATGGGACCATCGATTTTGCGGAGTTTCTCAACTTGATGGCCCGCAAGATGAAGG
ATACTGACTCTGAGGAGGAATTGAGGGAGGCTTTCAAAGTTTTCGATAAGGACCAGAATGGCTTTATCTCCGCTTCCGA
GCTGCGCCATGTGATGATAAACCTTGGCGAAAAGCTGACTGACGAAGAAGTGAAAGAGATGATTCGGGAGGCTGATACG
GACGGGGATGGCCAAGTCAACTACGAGGAGTTTGTGAAGATGATGCTCTCTAAGTGAGTCGGGAAAGTAAAAGTCAAAA
GCGAAAAGTGAAAAGTAAAAGTAAAAAATTGGTATGAATTGGGTTTGGTTATGCATGTCTCTACTGGATTCTCACGG
TGTATAAATTT > SEQ ID NO:2584 214613 282850_200090_1
CCTTATTTCAAATTTCCAGTAAAATAATCGAAAGAGATTATGGCGGATCAGCTGACTGACGATCAGATCTCTGAGTTTA
AAGAAGCCTTTAGCCTCTTCGACAAGGACGGCGATGGTTGCATCACTACGAAGGAGCTTGGAACCGTGATGCGGTCACT
GGGGCAGAACCCAACCGAGGCTGAGCTTCAAGACATGATCAACGAAGTTGATGCTGATGGGAATGGGACCATTGACTTT
CCTGAGTTCCTTAACCTGATGGCTCGCAAGATGAAGGACACTGATTCCGAGGAGGAGCTCAAGGAAGCTTTTAGAGTGT
TTGACAAGGATCAGAATGGATTTATCTCTGCAGCTGAGCTTCGCCATGTCATGACAAACCTAGGTGAGAAGCTTACAGA
CGAAGAGGTTGATGAGATGATTCGTGAAGCTGACGTGGATGGCAATGGGCAGATCAACTATGAGGAATTCGTCAAGGTC
ATGATGGCCAAGTGAGAATCCAACTTAATCTTTAAAATTAAAGTACAACAAAAAGGAACGGCGGATAAGTCTGATGAGG
TTTCTATTTCTGGttAGGATGTCTTCTTTGGCttattaGc

FIG. 2 continued

> SEQ ID NO:2585 214613 270642_200127_1
ATAGGGTTCTTTGAAATCGTGAAAAGAGAGAGAGAGAGAAATGGCAGAGCAGCTAACGGAGGAGCAGATCGCTGAGT
TCAAGGAGGCCTTTAGCCTTTTCGACAAGGACGGCGATGGCTGTATTACTACCAAGGAATTGGGAACAGTGATGAGATC
ACTTGGTCAGAATCCCACTGAAGCTGAACTACAGGATATGATCAGCGAGGTTGATGCTGATCAGAATGGAACCATTGAT
TTTCCAGAGTTCTTGAATCTGATGGCACGTAAGATGAAGGACACTGATTCTGAGGAAGAACTCAAAGAAGCTTTCAAGG
TTTTCGATAAAGATCAGAATGGCTTTATTTCTGCAGCTGAGCTTCGTCATGTAATGACAAACCTTGGAGAGAAGCTGAC
TGATGAAGAGGTTGATGAGATGATCCGAGAAGCAGATATTGATGGCGATGGGCAAGTTAATTACGAGGAGTTTGTCCGC
ATGATGCTTGCCAAGTGACTTTAGATTCTCGTGTATTTTGCGACGGCCACTTAGTTACCTATAACTTCTAGCTGTCAGT
TTATATTCTGTGTTGCTGTTAAGACAAACAAATGTGCCCTATGCTTTTACTAGTATCTAGACTCCTTTCAGTTTATATG

> SEQ ID NO:2586 214613 254332_301632_1
GCCACGCGTCCGCCACGCGTCCGCTTCTCTCTCTCTCTCTCTCTCTCACTCTGTCCAGCTCCTCCTCCTCCTCAG
CAATGGCAGACCAGCTGACAGAGGAGCAAATCGCAGAGTTCAAGGAAGCCTTCAGCCTCTTTGATAAGGATGGAGATGG
TTGCATCACAACGAAAGAGCTGGGTACCGTCATGCGTTCCTTAGGGCAAAATCCAACTGAAGCAGAGCTTCGAGACATG
ATCAATGAGGTTGATGCTGATGGAAACGGAACAATTGATTTTCCGGAATTCCTGAATTTGATGGCCCGTAAAATGAAGG
ACACGGACTCTGAAGAGGAGCTGAAGGAGGCATTCAAGGTCTTTGATAAGGATCAAAATGGCTATATTTCTGCCGCCGA
GTTGCGTCACGTGATGACTAATTTGGGAGAGAAGTTGACGGATGAGGAGGTCGATGAGATGATTCGTGAAGCGGACATT
GATGGGGACGGCCAGGTTAACTATGAGGAGTTTGTCAGAATGATGCTTGCAAAATAAAATCCCCCATTCCTTGCACTCA
ATCTAACACAAATAGGTTGCTAATTTGCTTTTTGGGATAGGTTGTATTAAGCTTGCACTCCCTAAGGAATG

> SEQ ID NO:2587 214613 248465_301583_1
ATCGATCCATCGATCCACCGGGCATTTCGTCAAAGAGGAGATGGCTGATCAGCTGACCGAGGACCAGATCGCCGAGTTC
AAGGAGGCGTTTAGCCTGTTCGACAAGGATGGAGACGGCTGTATCACAACTAAGGAGTTGGGAACGGTGATGCGATCGC
TTGGACAAAACCCGACCGAGGCGGAGCTCCAGGACATGATCAACGAGGTGGACGCCGACGGCAATGGGACCATCGACTT
CCCCGAGTTCCTCAACTTGATGGCGCGCAAGATGAAGGACACTGACTCGGAGGAGGAGCTCAAGGAGGCGTTCCGCGTC
TTCGACAAGGACCAGAACGGCTTCATCTCGGCTGCCGAGCTCCGCCATGTAATGACCAACCTCGGCGAGAAGCTCACGG
ACGACGAGGTGGACGAGATGATCCGCGAGGCTGATGTGGACGGGGACGGGCAGATCAACTATGAGGAGTTCGTCAAGAT
GATGCTAGCTAAGTAGTAGAACATCTGTTTCCTTTTTCTCTACTTTGTTCCTCGCCTTTCCTCTCTCTGTCTTTTCTCT
TTCCTTTTTGTTTTGGTAAAGTCCTGCTTCCATGTTAGGATGATGATTCCACCACGTCTAAAACCTTTTAAATTATTTG
TTCCTGTCCTTgcaaAAaAAaa > SEQ ID NO:2588 214620 219329_300944_1
GATCATGACTATGTGGGGTTGGATTCACGCGATAGCAGACTATTTGCTGTCCTGGGTGAAACTCGAGCAAAATGCGGAA
ATTGGGTGGCGTTCGTTCAATCGAAAGACCGGAAAGTTAGAGCGCGAACAACAGACACTGTGGAAGAAGCTCAAGCTTC
TCGTCTTATTTAACCCACTCATGGAATGGATTGATAGGAGTCAACTCATGCGTTTATACATGCATGAAGAGTCAATTGC
AGAAGGGCGAAGAGAAAGAACAACGAGTTCCAGGAGGCGCATCAAGGCTTTCGTTGACGCCTATGGAATAAACATGCAT
GATTTCGAGCCCTCTGATATCAGTCGCTATCCTACCTTTGAAGATTTCTTCACTCGTTCACTCCAAAACAGAGTCGCGTC
CCATTTGTAATGTTGACGACCCTTCCCATGCCGTCGTGGTGGCTGACTCGAGAGTCGTCGTCTTCAATTCCATTGGGGA
AGCAAAAGCGTTGTGGATCAAAGGCAAGAACTTTAGCCTCAATGATCTAGTCATGAGCAATGAAGTAGGTGATAAGTTT
AGAGACGCTGCCATTGCGAGCTTTCGGCTTTCACCGCAGGACTA > SEQ ID NO:2589 214623 220615_300937_1
GCGCGATTGTGAATTCGCGAGCGAATGAAACTCGTCGCATGCTTTGGATCCTGCTTCCGACAAGCTCCCACGACTTGGC
TTGGATAAACCTCTAACCTCCATTTTGGAATCGAGTGTCCTCCATGGCTCGAGAATAAGTCACATATTCAATCAACAGT
ATACATAGTTGTAATCGATACACCAATTTCTACTGGAAACGAGGTTTCCATGGGCTTCATCGAACTTCTCTTGGAGAAA
TTCTCCATCACGAGGTTCTTCCTCATCATGGCTGGCGTCTGGACAGCTGTATTCATCGTCGGCCGCATACGAGAACACC
AGAAAATCAAGAGCCTCGGCAGCTACGGCCCTTCTCTAAAGCCTCTTCTTCCATTTGGACTGGATTTTATCTACCACGG
AGCTCGTGCCACATTCCGCCAACAGACCTTTGCGCTATGGAGGGACGTCCTCTTCTCCCAATTCTGGACCGTCGAGATG
CGCGTCCTCAACGAACGAGTCTGCTTCACCGCTGACCCCGAGAACATCAACGCCGTGC > SEQ ID NO:2590 214633 1100838_301464_1
tgttattaggCCTAAACCTACCCTCTGTTCTTTTCAGGTAACTTAGCGGTTTCTTTTCCCTGTGTTTGGTGTTCGTAGT
CAAATCTGGCTATGGCTGGTAATGGCGTAGTGGCCATCTATGGCAATAGTAGCTCCATCGCAGACCCCAAGAAGTCCTC
CTATGGTGTCAAGGTCGGCCTTGCCCAAATGCTCCGCGGTGGTGTCATCATGGACGTCATTAACGTTGAACAGGCCCGT
ATCGCCGAAGAAGCTGGTGCCGTCGCTGTCATGGCCCTTGAGCGCGTCCCTGCTGATATCCGTGCTGAAGGCGGCGTCG

FIG. 2 continued

```
CCCGTATGAGTGACCCTGGCTTGATCAAGGAGATCAAGGCTGCCGTCACTATCCCTGTCATGGCCAAGGCCCGCATCGG
CCACTTTGTTGAGGCCCAGATCCTCGAGGCCATCGGTGTTGACTACATTGATGAGAGCGAGGTCCTCACGCCGGCCGAC
GATGCTCATCACGTCAACAAGCACAACTTCCGTGTCCCGTTTGTCTGTGGCTgccGGGACCTCGGCGAAGCACTCCGCC
GCATTGCGGAGGGCGCTGccATGATCCGCACcAaGGGGGAAGCCGGCACTggCGACATcGTtg > SEQ ID NO:2591 214633 156281_301364_1
GCGAAGCTTTGTCGTTTTTGATAAATTGTCACCCAATTTGGTTCAGGCATTTTCATCAACACCTTGCAAATGGAAGAAG
ACAGTGCCGTTACAGTGTACAGTGGCAGCGCAATTACCGACACCAAGAAGAATCCGTTCTCAATCAAAGTCGGGCTGGC
CCAAATGCTCCGTGGAGGAGCCATTGCTGAGGTCACCACCGTCGACCAAGCGAAGATCGCCGAATCCGCCGGCGCCTGC
TGCCTCGTAGTATCGGAACCTAAAGGACCCGGAATCTCGCGCATGGCCGACCCATCTGTAATCAAAGCGATCAAACAGG
CCGTCTCAATTCCCGTAATGGCAAAAGCCCGAGTCGGGCATTTTCTGGAAGCCCAGATCCTTGAAGCTATTGGAGCAGA
CTATGTAGACGAGAGCGAGGTTTTAGCCTTAGCCGACGAAGATCATTTCATCAACAAACACAATTTCCGTGCCCCATTC
GTCTGTGGGTGTCGAGATCTCGGAGAAGCATTAAGAAGAGTCCGTGAAGGTGCTGCGATGATTAGGACCCAAGGAGATC
TATTAGGTACAGGTAATATTGTGGACACAGTTCGCAATGTGAGGAAAGTGATGGGAGATATTAGAGTTCTATCAAACAT
GGACGAAGATGAGGTTTTCACTTTTTCAAAAAAGATCTCCGCGCCTTATGATATCGTTGCGCAAACGAAGCAGATGGGT
AG > SEQ ID NO:2592 214634 179812_300564_1
aGCAACCATTTCGTCATCGGACCATAGCACTCCCCAAATACCTCACTCTTCTCGCTGATCTGGTCCTGCTCTTATCCCT
CATTCCCATCATCAACTTTTCCACATCTCGAACAAATATGTCGGGAGACGGCTATCGTTCAGTCGCCTATTTCGTCAAC
TGGGCCATCTATGCTAGAAAGCATCGCCCCCAAGATCTCCCCGTTGATAAACTCACTCATATCCTCTATGCCTTTGCCA
ATGTCCGCCAAGATAGCGGGGAAGTACACATGACGGATGGCTGGGCGGACACAGACATCCATTGGGAGGGCGACTCATG
GAACGACACGGGAAACAACATGTATGGATGCCTCAAGCAGCTGAATCTTCTCAAGAAGCGCAACCGCAATCTCAAGGTT
TTGCTGTCCATTGGAGGTTGGACGTACAGCGGCAACTTCAAGGGCCCCGCCAGCACTCAGCAGGGCCGTGAGACATTCG
CCAAATCTAGTCTCGAGCTGCTCAAAAACTTGGGTTTCGACGGACTTGATATCGATTGGGAGTATCCCCAGAATGCAGA
CGAGGCTAGGAATTTCGTCGAGCTTCTCGCCACCGTCCGCagagaGCTGGATGCCTATTCTGCTACCCTTCCAAACTAC
AGccaCTTTGAACTGACTGttgCtTgtccCGccGGAGCTAcgCAct > SEQ ID NO:2593 214634 199488_300749_1
TTGAACAATCTACCAACATCACAAGCAATTCACCATGTTGAGCTTCCTCGGAAAATCGGTAGCCTTGCTGGCTGCGCTG
CAGGCTACTCTCAGCTCTGCAAGCCCCCTAGCCACAGAAGAGCGCTCTGTTGAGAAGAGAGCCAACGGATACGCAAACT
CCGTCTATTTCACCAACTGGGGCATTTACGACCGCAACTTCCAGCATGCCGATTTGGTGGCATCAGATGTCACTCATGT
CATCTACTCATTCATGAACCTCCAGGCAGACGGCACAGTTGTCTCTGGCGATACCTACGCTGATTTCGAGAAGCACTAT
GCCGATGATTCTTGGAATGATGTCGGCACCAATGCCTACGGCTGTGTCAAGCAGCTGTTCAAGGTCAAAAAGGCCAACC
GAGGCCTCAAGGTTCTGCTCTCCATCGGTGGCTGGACCTGGTCCACCAACTTCCCCTCTGCAGCAAGCACGGATGCCAA
CCGAAAGAACTTTGCGAAGACTGCCATTACCTTCATGAAGGATTGGGGTTTCGATGGCATTGACGTCGATTGGGAGTAC
CCTGCAGACGCCACCCAGGCCTCCAACATGGTTCTTCTGCTCAAGGAAGTCCGATCTCAGCTGGATGCTTATGCTGCCC
AGTATGCCCCTGGCTACCACTTCCTCCTCACCATTGCCGCACCGCTGGCAAGGATAACTACTCCAAGCTGCGCCTggc
cGATCTTGGCCAAGTTCTCGACTACATCAACCTCATGGcCTACGACTATGCTGGATCCTtcagccCCCTCACCGGTCAC
GACGCCAACCTGTTTGCCAACCCGTCCAACCCCAACGccacaCCCttcaacaccGattcTGCCGTTCAggattatatca
acggaGGTgttcccGCCcaaCaAGATTGTTCTCGGAATGCCCATCTACGGACGATCattccaGAAcAcCgctggtattgg
cCAGACTTACAACGGAGTTGGaggtggCGGTGGTGGCTCAACTGGAAGc > SEQ ID NO:2594 214637 215792_300884_1
ggttctcaaagtcttccggtgccgccggcCGTTTGGCTGCGGACCGAAAGGTGGACAGGAATCAACTCGTGATGAGATC
CGGGAAATGGCGGCCTCCGCCGGGATTTGGATTCCATTCTTTCGTTTTTTGTTGGTTTCTAACGTTGATGACCATTCAG
TGGCGGCGGCTATGAAGGATATGATGAGAGGTGGTGCTTATGCCGGTGTGTATCAAGTAACGAGTCCGCCTGGTCCAGG
CATCATCATACGATCCATCAATCATAATCAagggGAACACAGAGGCAAATCTTCT > SEQ ID NO:2595 214665 226205_300995_1
TTCTCCAACATGGCCATCTCCAACGACGCTAAGACCGCCACCCTCAAGGGCGACGACCAGTGGGTTGATCTCAAGCTCA
AGTCCTCCAAGGACTTGTCCCACAACACCAAGGCCCTCATCTTCGAGCTCCCTACCCCCGACTCCACCCTCGGTCTTAC
CACCGCTTCCGCTCTCCTCACCAAGTACGTGACCCCTAAGGGCTCCAACGTTGTCCGACCTTACACCCCTGTTTCCGAC
CCTGACTCCAAGGGCGAGTTTGAGCTCGTCGTCAAGTCCTACCCCGAGGGTAAGATGTCCAAGCACATCCACGAGCTCA
AGGAGGGTGACACTCTGTCCTTCAAGGGTCCCATCATCAAGTATCAGTGGCAGCCCAACCTCCACAAGGAGATCACCCT
GATTGGTGCCGGAACCGGCATCACCCCTCTGTACCAGCTCATCTCTGCCATCAACAAGAACCCCGAGGATAAGACCAAG
GTGAACCTCTTTTACGGTAACGCCACTGAGGGTGACATTCTCCTCAAGGACGAGATTGACGCCATCGCCAAGGCCAAGC
CCCAGCAGTTCAACGTCCACTACTTCCTCGACAAGCCTTCCGACAACTGGAAGGGTGAGAACGGATTTATCTCCG
```

FIG. 2 continued

> SEQ ID NO:2596 214666 211667_300901_2
CCCACGCgtccgCCAATCTCGACCATTACCATCATACAGCCAACCTCTACATAAGCACAAATACCATTCAAAATGTCTT
ACGGCGGTGACAACAACGACAACTACGGCTCTCGCCGTAATGACGACAACTTTGGCTCCGGAGGAGATTCTTTCGGCTC
TGGTGGAAACCAGCAATATGGCTCCGGAGGAGACTCATTTGGCTCTGGGGGAGATTCATACGGCTCTGGTGGAAATCAA
TTCGGCTCCGGCAACCGCCGTAACGATGACAGCTCATTTGGTACCAGTGGCCAGGGCGAGTTCGGCTCTGGAGGTAACT
ATGGCAGCTCTGGCGGTGACTCCTATGGGTCTGGAGGAAACACCTATGGCTCCGGCGGCAATGACAACTTTGGCTCTGG
GGGCAATGATACGTACGGCTCGTCCCGTAACCAAGAGTCTTCTTTTGGATCCA > SEQ ID NO:2597 214672 1098530_301485_1
GGAGAAGAGGTGATACGAGATGTCGTACGATGACGTGGAGATAGAGGACATGGAGTGGAACGCGGAGCTCGAAGCGTAC
ACCTATCCATGCCCTTGCGGAGACCTCTTCCAAATCTCTCTGCCTGACCTTCGCTTGGGAGAGGAGATAGCCAGATGCC
CTAGCTGCTCCCTCTACATCACCGTTGTCTACAACCTCGAAGACTTCCAAGACCCTCGGCCCCCGCCTCGCCCCCAACA
GCCGATCGCCGTCGCCTGATCTTTCCAGTTGCTTCGTTCAGTAAACTCGACATCTACATTCTATCCTAAATTGATAGTC
ACCAAATGTCTGGTGCACTTGAGACTGTTTATCTGACAAGATTTCATGTATCTTGGAGTTTTGCTTAAATCAGCATGTA
GAATGATAACTGTTGGCTTCTTGATGTTTCAAAGGttacnacacaaaaaaaa > SEQ ID NO:2598 214672 218013_300914_1
ACACAATTCCTCGCTGCGTGTGACTCGTGTCTCCAGCAAATACCGCAAAGATGTCTGACGACGGGCTCTCAATATACGA
TGAGATCGAAATCGAAGATATGACCTTCGACGAGGTTCTTCAAACATACTTCTACCCGTGTCCCTGCGGCGATCGTTTC
CAGATCGCTATCGATGACCTGCGCGACGAGCAGGATATTGCTGTGTGCCCCAGCTGTAGCTTGATGATTAGAGTTATTT
TCGACCTTGACG > SEQ ID NO:2599 214676 220786_300938_1
TCCTCAACACCGCACAAGCCCTCTGGGCCCGCCTCGTAGCAACCCACGATCCCCATACCATAGACTTCGTCGGCACCCT
CATCATCCAATTCATCTTCTGGTGGATCCCCTGCATCCTCTTTGTCTCTCTCGACTCTATCGCGCCCTCCTTCTCCGCG
AAACACAAGATCCAGCCCGCCCCCAAACAACCCTCCGCCAACGACATCCTCCACTCCGTCCTCGTCTGCATCCGCAACC
AAGTCATCGTCTTCGCCCTCCACGCCGTCCTCCTCTATGCCTCCTCTGCCAAGGGCCAGTCCCCCAGCATCAGAGTCGA
CGCGAGCTTCCCCACGGTCCAGGAGTTCACTACCACCTCGCCGTCAGCGTGCTCGCCCGCGAAGTCCTCTTCTACACCT
CCCACCGCATCTTCCACTGGCGGCCCTTGTACAGGCGCTTCCACAAGACGCACCACAAGTTCACCGCCCCC > SEQ ID NO:2600 214687 179612_300562_1
ATCGCTGACGCAAGATGGCTTCTCAGGCGGCAGCAAAGGCTGCTGGAGGCGTTGTTTCCATTGCAAAGAAACAAACCCT
CCAGTCCACCGGCTTGTGGGAGACCTTCCGCAAGGCCTTCGCCCTCGACCCCAATCGCTCCAACGGCGTCCCCCTGAAC
CCTTACTTCCGAAACCCGACGCCCGGAGCCTTGGACCCCCTCAGCTTCGACGACCCCGTCACTCTTCCCGCTGGCGACA
TTGCCGACAACGCCTACTGGAAGCGTGATGTCCGCTACCCGCAGCTCAGCGTCGTTACGCAGGGCGACGCCGT
GTCGTTGTTGACGGTTGGAAGCGCCGCACAGCCCAAGGTCGAGCTGATTGGCGAGGCCGGCGAGAAGGCTCTCGTTGCG
GCGCAGAAGGAGGGCGAGACGACGGGCCTGGCCAAGTTCCTGGAGAAGGCGCCCAAGGATGTGGCAAAGGACGTGTTCG
TCAATGGATTGCCTCCGCTGCCGAGCGGACAGGCCCTGGAGGCTGGAGGATGGGATGTGCACAAGTACGAGCTCAATGA
GGATCAGACATATGGTGAAGGCTATCCTACCagGACGTTCAAATaaGACGGGCAATAGGGTCGACTtgtgtaaa > SEQ ID NO:2601 214715 211778_300870_1
cctacatactcatccttcacgcttcaatcaccCttgaataatgaacgaggaaaagctcGGCCACAGTAATCATGAGGAC
ATTGTGCCTCCAGAATCCTCTACTGGAGATGAATTACAGACACCATCTACGGATTCCAAGGGCAAACAGAAGGCAGGCC
TGGAGTTAGCAGCATCTCAACTTGGGGCCTCTACAAAGCTGGTCGTCAATGCCATCACAACGTTTCGGGAAATGCCAGC
TTTGGCATCAGAATCAAAGTCCTCTCATGGTTCAAGTAGCATGGGCTCGTTTTCATCTATCGCTGGCGAGTACTCGTCA
TACAAACCACTCCAGAATCCGTTGCTTGACGAGACTACTCATGAGGGCCAGGATGATTTGTTTGAGACGTTTATCAAGA
GTTCAACGGATGCGTTGGTAAATGATGGCTATCAAGTAGACGTTTCAGGATCCTCATTTGCAGATCAAGAAGCATCGGA
TGGCTTGGCCGTTTTTGAATTTCTCTCACAGCCAGGAAATGAATCGATCGAGACGGCCATTTCTAGGGAAAATGATTTT
CAGATCTCAGGCGAGGATGAATCATGGAGTGAAGCTGTGGCTGGAACACTCATCGATGAGAACGACCAACTTGATTTTA
CTCCTGATTTTaTCACTAaTCCCGAACTGTCTTCTCAAGCAGCGccGTACCTTggAACAACGAACattgaaGaaACAaG
ttataCTTGgTtt > SEQ ID NO:2602 214724 210440_300889_1
gtcggattcaggcctcagcgctcggatcggcctcttttcctctcttccctctctgctttccatctgcccagcagaccga
gTTTGGCAGCGCAATGTTGCCTCTATCGGTGCGGCGCGCGGTGGCCGCTGCTCCTCAGGGGCAAGTGGGCTGACTTCT
CTCGCCGCGTCGGCTCCAAAGATCACAGCCTCGAGCTTCATCCTGAATCGTCCTCAGCGGCGCTACTCCTCGTCGAAAC

FIG. 2 continued

```
CCTCAAGATCCGATGAGCCCAACGATATTGCTGCCGGCCAGTCGGTGCCGGCATCTACCTCGCGCGGAGAGAGCAAAGG
CAGCAGGAAACGAAAGAGCAAGGATTCAGCCGACCGAAATGCGGCTTTCAAGAAACTGCCCAGTGTCCCTAGCACTCAC
CACATGTCTCAAGAGGCCCTGAGCTTATCGAGCTTCTTCTCACTCCACCGTCCCATTTCCATCACCCAGACCATGCCCA
GGACTgttACCGAcGAGCACTTTGCATCCATATTTgcgCCTCGATCAAAATCGAACAGGATAcgagacaCTgtcTCTAC
aatttctgACACCATTgagcagCtGGaaggccCcAtGGCtcaggtgacaaTaggatcTCa > SEQ ID NO:2603 214740 206654_300824_1
gcaaaagactacaaagcttttggtccagcaaccataaatccaactcatTGTCCCTCCACCACGAAATCTAGCAACCTCT
CCTCCTCGCCACACAGCCCGCAATGCTCACACCAGCTTCTTCAAGAATACTCGCCAGCGGCGCCCGCCGTGCCCTTTCG
TCGCGCAGCTTCCACGCTTCGGCTCGGCATCTGAACGACTCTCCCCCCCTGCCCGCGCGGAAGCCCATGGGCGCCTTCA
GAGGAGGTCTTTTCGGCTTCTTGTTTGGCAGCGTCCTGGCCGGCGGTGCCGTCTACAGCTACGTCCTGCAGGAGTACAA
GGCATCCAACGAGTTGCTTACCGAGGATATCTACACTCTTCAAGCCTCCGTCACCCGACTGACAAACCACGTCAAGATC
CTTGAGGAGAAGATCCAGCAGAAGAGAAAGTAAAGCCCGAAAAGATAAAAAACACAAATAGCGCAATGTCATTAGGGAT
GGTATGATACCAGCGCTTCAACGCTGGTGGAAAATACTGGGCAAACGAACAGCATTATGGCAATACTTGTGTCCTTGTT
TGTAACAACCTAACAAAGCCTCAATTGTAAATTGTACCTTAAGTATCTAGCctCTGAAATATCtagcaCaggaaACAGC
ACAAAAG > SEQ ID NO:2604 214756 208223_300833_1
GCTCGACTCTCACTTTCTTCTTTTCATCCCTCACTCTTCTCTCATCTTCTCTCCAATCCCCAATCCTCAATAACCTACG
CCGTGTCAGTCAAGCAGCTGTACATCATCGCATATCGACCGACGACGACCTTGTCCTGCGTCTTCCATCTCCAATTCTC
ACCCACCACTTACACCATCACACATCACAATGCCTGCTCCTCAGGTTAACGGCGAGGTCACCAGCCATGTCAATTCCGC
CTTCCTCCAGCACCTCTTCTCCTATCCTCTAGTTAGCGACGGCATTCACACTGTGACCACCAACGAATACGCACAGCGG
CCTATCAAGCTGGGCGAATCTGCCTATAAAACTTTTGCCGCCCCTGTTCTTCCCTACTTTTCCAAGCCCTATGGTATTG
TCTCTCCCTACGTCCAGAGGGCCGACTCCTTTGGCGACAAGACCCTGGACCGCATTGACGAGCGTTTTCCCATTGTCAA
GAAGCCCACTGGTGATCTCTACAACGAGACCCGTGGTCTGATTCTGTTCCCCTACCAGAAGGGACTCGAGGGCAAGGAG
CACGTTTTCAAGATCTATGCTTCCGAGCTTAAGAAGCTTGAGCAGGAGGGCGTCGTGGCCCAGGGCAAGGCTGCCGTTT
CCACCGCCTTCGTCATTAGCAACGAAACGCTGGCCTGGCTGAGCAGCTGGGTCGCTGTCAAGAAGGCCGACGCCTCTGA
GGCTACCAAGGAGAAGATCAACCAGTAGACGATTTCCGGAGTGGATTACAAGCGAAACAGCGCATCATTTCCTTTCTTG
ACCGGCCCTCTCTCTCTTCTTTGTCTTTCTCTTCTTACCCTTTTGTTGGCATTGAGTCGACTTTCTCTGTCACTGGATC
TCATTTGCtttgttGATGCCAGTTCGCTtttgtgATGAAcAgCACCtagagaAaAGGGGGAAGAAGGGCAGGCTGCTTC
GTCCGCTgcgaCTAGGCGTCTACGTCTGGCATCATGATCGCCACTACtagcTaGtGgCCaagCTCTGACGcatctcgtt
TCgatttcATCTCTCtttgATtccttgttTCggcggaCTAtg > SEQ ID NO:2605 214756 215312_300880_1
AATAACCTACGCCGTGTCAGTCAAGcaggTGTACATCATCGCATATCGACCGACGACGACCTTGTCCTGCGTCTTCCAT
CTCCAATTCTCACCCACCACTTACACCATCACACATCACAATGCCTGCTCCTCAGGTTAACGGCGAGGTCACCAGCCAT
GTCAATTCCGCCTTCCTCCAGGTATGCATGGATAAAAGAAGAGATTCGCCTTGTCATCACACAATGGCAAATGCGAATC
GAACCGAATCGTGATGGCTTTTGGTCCGGTTATTGATCATATTGGCAGCACCTCTTCTCCTATCCTCTAGTTAGCGACG
GCATTCACACTGTGACCACCAACGAATACGCACAGCGGCCTATCAAGCTGGGCGAATCTGCCTATAAAACTTTTGCCGC
CCCTGTTCTTCCCTACTTTTCCAAGCCCTATGGTATTGTCTCTCCCTACGTCCAGAGGGCCGACTCCTTTGGCGACAAG
ACCCTGGACCGCATTGACGAGCGTTTTCCCATTGTCAAGAAgcCCACTGGTGATCTCTACAACGAGAcCCGTGGTCTGA
TTCTGttCCCCTACCAGAAGGGACTCGAGGGCaaggagCACGTTTTcaagaTCTATGCttCcgagCTtaagaagCTTGa
gc > SEQ ID NO:2606 214766 218095_300914_1
CACACACACACTCACATCAAAATGTCTAACCTCCCTTCTGAGCCCGAATTCGAGCAGGCCTACAAGGAGCTGGCCAGCA
CCCTcgaggACAGCAGCCTCTTCAAaGAGCACCCCGAATACCGCACCGCTCTGCAggTTGCCGCCATTCCCGagcgagt
tattcagTTCCGCgttacctgggagGACgacaagGGCCAGCTCCGCgtcaACCGggatacCGTGTGCAGttcaacTCT
GCCCctcggcCCATacaaaggcGgTCTTCGATTTCACCCTACCGTCAACTTGTCcanttcctcaaAGgtTTCTTGGAttt
gagcagatTTTcaaagaATgctctgaccggtttgtcAatGGGTGGAGgAaaagGTGGTgccgAtTTCGaccccaagggc
aaGTCTGACAATGAGATCCGCcgtttctgCcaggcCtttATGCGCGAGCTGTCtcGTCACAttggcgCTGACACCGAcg
ttcccgcTGgcgACAtTGGTGtttctggccgcgagATTggatacatGtttggagc > SEQ ID NO:2607 214771 217657_300910_1
AGCAATCATGTTCTGTCTCCGAAGCTGGGTCCCGCTCCTCTTCATCCCGACAAACGCCTCGCCCGCCTTCATCCTCCTC
TTCTTCATCTGCACCTACTTCCTCAACCGCCCCTGCGTCTACTGCTCCGTCCTCCTCCATCCTCTTCCTCACCTCGT
GCAACTGGTCCGACCGCTGCTTCTTCGACCTCAGCAGCAACTGGTTCCTCCCTCGACCTCCTTCGTCCGTCCAGCTCCC
CGTCGACGATCAAGACTCGCACGCCCTCGCCCTCGCCTTCAACGACACCCTCGTCGACATGGTCAATTCTACAGCCAAA
GCCGCTGCCCGCGCCGCTGCGGAGGAGGTCGCTGTGCTGCGCAACGAGTGGACTGGCTTGGGCGTCCAGTGGCTGCGTA
```

FIG. 2 continued

ATTTGCTGGGCAATCGGGAGTGGAGGATCGACTGCATGGACATTTACATCAGGTTGTAAAACGAAGGGGAATTACATAC
ATGGAGCTTCTATGAGGGGAAGAAAACAAATATTGGAATGAAAAACTTCATCTACCTTTGTGCATTG

> SEQ ID NO:2608 214787 211412_300899_1
tcaaccaccACTCAGCAAGCAATCATCAAAACAGCCACTCTCACTTTTCTCTCAAAGTAAAACACTTCAAACCGCCAAC
ATGCAGGTTACTTCTATGCTCGCTCTCCTCTTTACCGTTGCCACTGGCGCTCTTGCAGCTCCCGGCCACGGAGCTCCTC
CTCCTCCCCATGTTCCTCCCCCTCCCCCTCCTCCTCCCACCAACCAAAACACCAACACCAACAACAATTGGCAATCCAA
CAGCTGTGGCAACGGCGCTTCTCCTTACTGCTGCAGTGCTACAGCTGATGGCCTGGGAGAGAACTACTGGAAGTGCTCT
GATCTCAATGATGTGTGCAACGACGTCATTGTTTGCTGCAACAACAATAGCAACAACAACAACCAGCAGGGAAAGCAAA
ACAACATCGACACCGGCAACCAGTCTTGCAGTGCCTTCGGACAACAGAAGGTCATCTACCTCTAAGCTTGCCTGCAGAA
GCTCAAAGTCGGCAATGGCTCTCTTATTTGCTTGTATCTTAGTCTTATAAGGCAGTTCATGTCCAAGTTTGTCGGCTAA
GGGCTGCGGTGACGGGTTTGAGAAAATGGGCAGTGGCATGTGGaacGGTGAAAAAATGCTTCttttctatttggtttgT
agcagggtggCTctTCTGAggcagtCTTTACaacCCGCtcactttCCTTAaGCCta > SEQ ID NO:2609 214794 205791_300922_1
GTGGTTTTAGTTTTGGAGGAGTTTTACTTTTTATTCTCTTTCATATTCCAATTCTGTACTTGTCTCGGAAGCCATATTT
ACAACTCTCAACACCACAATGGCGGGCTTCAAGAAACTACTCCAGACTCTAACTGGGAAAAAGAGCGACGATGCCACTC
AACCCGAAGAGCAGCAACGCCAAACTCCTCAGCCCAAACCTTGGTCCGGCATCGACAACACCCAACCAGCAGGCTCGAA
CCCCATCCGCGGCTTCTCCACCGAATATCTCGGCGAGCAAAAGTCCAGCAACACGGCCGTCCGCCGGGACCTCGGCTTC
GCGGGCCACATCGGCGGCCAGTGGTTCGGCGTGTACGGTGACACGCTGTGGTGCAGTCCCGGGGTGACGGACCCGGATT
TGGAGCCGGATCCGGAAGGGTTCCACGGCATGGTGCGGAACTCGGTGGCGGTGTTGACGGATGATCCGCTGGTAGTTCG
GTTTGTGCATTTGAATGGGGATGAGCCGGTGGCGCATCCGTTGCAGTTTACGCCGTTTGAGGAGCGGTGGGGGAGAcg
aattTGTTTGGGTTTGGG > SEQ ID NO:2610 214809 211343_300957_1
TCCACAATGGAGGCTCCAGTTGAGAAGAAGATTGAAAAGACAGCAAAGCCTTATGGCATGCGCAAAAATGGAATGCTAT
GGCATGCTCCGAAGAAGGCGTTTCGCCCGACCAAAGGCCTCTCATCGTATGAGCAGAGGACTTTTTAGCGAGCTGCAAT
GGCTCAGATGAAGGCAAAGGAAAAGGAGATGAAGGAGGAGAAGGAGGAAGAGCGCCAGCGTCGGATTCAAGCCATCAGG
GATAAGCGAGCAAAGAAGGAAGAGAGAGAAAGATA > SEQ ID NO:2611 214819 208304_300834_1
AGGGATCACCGAAACTGAGGATGTACGAGTACAGATATTTGCATCATGGATCTGATATTGGGAGAGGAGAGGAGATGCA
CGGGCCTTGCTTTTTTGGGGATGCAGGGAGGGGAAAAGCCGTCTGACAAGTCATTTTCGCGTATTGAGATGGACAGAGT
TCTAGATCCATTACTAGTTGCAAGCACGGTCTGACGGCATGTCGTATGGTGTTACTGCGTCTTGTGTGAGGCCAAGACA
GGACATAAGATTTGGTATTTTCTGTGTTGTTGAATGGATTGATGGAGGTTTTACAATACGGGTACCGTACAGGCTTCCA
TGGATTTTATCGGTGACG > SEQ ID NO:2612 214826 212090_300873_1
agcggccaaaacCGACGCCATGAGGTCCAATGGCGCTTCTGCACTGCTGAACGCCTTCCAGGGGCTGAAGATTTCCGCAT
GCACCCCGTTGCGACAACTGAGGGCCCCGATTCAGCACCAGTCCAAGGTTCTCGGCGCCGCTCTGCTCCAGAATGGCAG
AGCCTTTTCCACAAGCCCGGCCATGATGGGCACATGGCTCGAGCCTAGCTTGAACCGAAAGAagaAAATGGCAAAGGCA
CGGCCGCGAGTagCGACGGGAGGGTCTACGAAGGGCACAACGGTCATCTGGGCGACTACGGATTGCGCATGGTTGATC
ACCACCGAAGaATCAGCGCCAAGTCACTAAAGATGGCTGAGGATACGATTAAAGTGCGACTTCGAGGAGAGAAATACCG
ACTTTACAAGAGGAAGTGCTGCAACGTTGGTGTCTACGTCAGCGGTAACGAgaTGCgaATGGGTAAAGGAAAAGGTTCT
TTCGACCACTgggccaCAagaATGgcAGTCAGCcaagtcCTgttcgagaTcaagGGccGAATc > SEQ ID NO:2613 214828 208844_300809_1
tagaatcccagctcttgtttcagcacacgtgagcgaggcggcgcgacagaagattgacATTGTCGCCAAGTTTGTCGAG
GAAGAATGCATCCCCGCCGATCCCGTACTTGAAGCCCAGGTTGGCGAAGGCGATAACCGCTGGGAGAACCACCCGTCCA
TCATCGAGGAGCTCAAGGACAAGGCACGCAAGCTGGGCTTGTGGAACATGTTCCTGCCCAAGGGCTTCTACGCCGAGTC
TCCCGGCTGGACCAACCTCGAGTATGCCCTCATGGCAGAGTGGCTGGGCCGCTCGCGCAGCGCCTCGGAGGCGTGCAAC
TGCGCTGCTCCCGATACAGGCAACATGGAGGTGGTGGCCAAGTACGGCAATGCCGCGCAGaAGGAGGAGTGGTTGAAGC
CCCTGATGGAGGGCAAGATTCGCTCGGCTTTCCTGATGACTGAGCCCGAAGTCGCGTCATCGGATGCCACCAACATTCA
GCTCCAGATCACTCGCGacgCGCGACCACTACGTCCTCAATGGCTCCAAGTGGTGGTCCAGCGgTGCCGGCGACCCGCGA
TGCAAACTCTACATCGTCATGGGCAagactgatcccaacaacAAGGAtCcTTACAAGCAGCAGTCAGTCAtcctggtcc
cctgCTGGTCTGCcTTggc

FIG. 2 continued

> SEQ ID NO:2614 214888 205233_300797_1
gcctcgacgatggagacGCAATGGAGCCTCCTCCAACCAAACTGACACCAGGCAAGGGTGTTCAGTCGAAATCCAACAA
GGGCCCTCCATCACCGACATTGGCCAATGTTGCGCGCCACTTTGCTGTGGACAGCGGCTCAACATTGCTTGCCACGGCG
GTAATCACAGTCTTGATATTCGGTGGATGCTGCTCTAACGTGTATGCTTTAGAGGCCATCATCAACTTCGAGCCGACAA
ACGGAACCCTCGTAACTTTCGTTCAATTCCTATTCGTCTCTATAACGGGCTACGTAGCGCAATTCGATAGATCACGCCC
GCCGTTCTTCCTGACTCCCAACGTCGTCCCGCTTAGCCGCTGGCTTGTCAATATCCTGTTGTTCTTTACCATCAACGTC
TTGAACAACCATGCCTTCAGCTATGACATATCCGTACCGGTTCACATCATTCTACGATCCGGAGGTAGCATAACCACCA
TGGCTGCCGGATACCTTTACGGCAAGACGTATTCGCGCCCCCAAATATTTGCAGTGTTTCTGCTGAGTATTGGCGTCAG
CCTCGCTGCTTGGTCGGATTCAAAAGACAAGAAACCGAGTGACGGTATTTCTGACCCTGTATTCAACCCTGGGCTCTTG
ATCATCTTTGTCGCCCaagtaCTTTCGGCGATCATGGGGCTGTataccgaAGCAACATAtcgaaag > SEQ ID NO:2615 214902 216860_300902_1
gggtatcccgtcagcagccgctccctcctcattcccgtctcaccACCCACCATTGAGATTCTATCGCCCACCAAGCCTA
CAACACACAGCACAAGTATTATCGCCCATCATGCCTCAGCCTATTCCCGCAGCCAGCCGTCTCACCGACCTCTTCAGCT
TGAAGGGCAAGGTCGTTGTCGTCACCGGAGCTTCCGGGCCCCGAGGCATGGGAATTGAAGCTGCGCGTGGTTGCGCCGA
GATGGGCGCCGACCTCGCCATCACATATTCGTCTCGCAAGGAGGGTGCAGAGAAAAACGCTGCAGAACTGGAGAAAGAG
TACGGCGTCAAGGTCAAGGTGTACAAGATCAATGTGAGCGAGTACAAAGACGTCGAAAAGTTCGTCGATCAAGTGGTTT
CCGATTTTGGCAAGATTGATGCCTTCATTGCCAACGCCGGTGCGACAGCAAACAGCGGAGTTGTTGATGGCAGTTCTGA
CGACTGGGATCATGTTATCCAGATCGATCTGAGCGGCACCGCGTATTGCGCAAAGGCCGTCGGCGCTCACTTCAAGAAG
CAGGGTCGCGGATCCTTTGTCATAACAGCTTCAATGTCTGGCCATGTCGCAAACTACCCTCAGGAACAGACCTCATACA
ACGTTGCCAAGGCTGGCTGCATACATCTGGCGCGCTCTCTGGCCAACGAATGGCGCGACTTCGCCCGAGTCAACAGTAT
CTCGCCCGGCTATATTGACACCGGCCTGTCCGACTTTATCGATTCCAAGACACAAGAACTATGGAGGAGCATGATCCCA
ATGGGACGCAATGGCGACGCTAAGGAACTAAAGGGCGCGTATGTCTATCTCGTCAGCGATGCCAGTTCATAtacgACCG
GAGCCGATATTGTGATTGACGGAGGATAcactaccCGATAGAaaaccaatTCTTCTtttcctCtgt > SEQ ID NO:2616 214904 212107_300874_1
gcttctcacgggtagttgtatgaagaggagaTATCTTGCAGGTTTTTTTATCTACCTGTTTTCACCCCTTGGACGTATT
ATTTCTTATTAGTTTTGTTTGTTTGCCAAGAAATTCTATTCGCCATGGCTGTAAGACGAATGGTGTTTGCCGCGGCTCT
TGCTGGTCTGGCGATGGCCAAGCCCATCAAGCCCATCAAGCCAACAGGCACATTCTGTGGCATCATCTGCATAAGCGCG
ATTAGCGATTGCGGCGTACCATATGGAGGTTGCTACGATCCTTGTGTTGACCCAGCCCCTACACCTCTTCCTTGTGACG
TGGAAGGTCCAGTTCCGGAGAGTCCAGTCGTTGTGAGCCCAGTCCCAGCAACGCCAACCAGCGAAAATCCGTTCTCAGT
CACGCCTGGTTCGACCTCAGTCACTCCCACCGTGGAGAGTCCGAGTTCAGTCACTCCAGCCTCACAGACCCCAGTCGTT
GTGGTGAGCCCAGTCCCAGCGACGACAACCGGTGAGAACCCGAGTTCAGTCACTCCAGCCTCGGACACTCCAGAAGATG
AGGAAACTCGAGAAgattcT > SEQ ID NO:2617 214907 211940_300872_1
GCATGATATTGAATGGTTGGAAAGTCAGATGGAGGCGTTCAAAGCAATCACAGCGACCCTGCCGCAGCTTTCCTTTCAT
GAGACGAAGCGGTCGGAACATGGCTTTGTCGTCGAACAGCGGCATTCCATGTCTGGCTCGGATGGTGTGCGGATCGGCC
TGTCCGCTACTCATTCGGGTTTGATCCAATTTGAGGGCCGCGATGCAAACTACCAGACGTTTGTAGAAAAGTTCCGCGA
AATGATACATAAAGCCAAGG > SEQ ID NO:2618 214908 211956_300872_1
TGGCGTGGCGCCTCAGCCAGAAGCGTTGGGGATGACACCCGACCTCGCATTTGTGTACTAGTATGTACACAACACAGCC
GTGTGTCAGAGTATCATATCAGAGCTAAGGTTAGGTAGACAGACAGACGGCTTCGTTTGGCAACTCGCTGGATGCCAGA
TGGCAGAGCTTAGATGGTCAGCTTGGATGGTTGAGCACAGATGTGAATAGGCACCTGCGAGGACCAGCAGTGAGCAATA
TTGGAGCAGTTAAGAGTAAGGTAGCTGTCGGGATAGAGACTTGAGGACGGGCTGCTCCGTCCGGTCCCCATCTCGTGGAA
CCCGTAATCCAGTCAATGGATACCATAATCAATCCATAACTCCTCCATAAAAAAAAGAAAAAAAAG > SEQ ID NO:2619 214918 219879_300949_2
AATTTAAAAGTGTCGCATTAAACCGCCCCTACTTGCTTTTGCTCTCTTTGTTGTTCACTCGCAGCTACAACTCTCGCCC
ACAATGTCTCTCAAGAATGACGCTTTCCCTTCCTCCGAGGCCTTCGAGGCCATCAACGCCGCTCTCAGCAGCAGCGAAG
CCGACCGCAAGGACGCCATCAAGAATGGCAAGGCCGTCTTCGCCTTCACCCTCAAGAACAAGGCCGGCGAGACGGCCAG
CTGGCACATTGACCTCAAGGAGAAGGGCACAGTGGGCACTGGCGTCGGCGAGAACCCCACCGTCACTCTGTCTCTCTCC
GACGAAGACTTTGGCAAGCTCGTCACCGGCAAGGCCCAGGCCCAGCGCCTCTTCATGTCCGGCAAGCTCAAGGTCAAGG
GCGACGTCATGAAGGCTACCAAGATGGAGCCCATCCTGAAGAAGGCCCAGACCAAGGCCAAGCTGTAAAAAGCGGGCAT
TGGCAAGTTGGGCTGTTGATTATGGGAAAACAGGTGGAAACAAACCATTAAACGGCATTTTTTTGTTTTTATATGTATC
ATACCATCGCTGTTTACTACCACTGATGTTTACTGTTTTTTCTTTGTTCCCCGGCCGCAAAAGAGTTCGGCTAGGGACG
GTTGGTTATAGTGCCTTATGAATACTGGCATAGACGAGAATACCATATTCCGGCTGGACATGTTTCCAGTCTGGAGTTC
CTTTTTTtaaaaAAAAaaacaaccaac

FIG. 2 continued

> SEQ ID NO:2620 214919 217092_300904_1
GCAAATGGAACGCCGAGGGGTTCGCTGAGGAGGAAGACGACGATGTGCAGCTGGATTATTCCCGGCCTAGTCTCACAAG
TGACTCGGAGGCTGAGGCAGTTGGGCGGTCCAGCGCTCTGGATGCTGTTGAGTCGTCTACCTGGGGATCCACAAGCAAG
GGCAAGTTCATTCTCAAGGACTTGGGAGACGAGGTGCACGACATCTTGGCCTCGGCAGAGGCTCAGAAAGCCGAGAAGG
CTGCACGAGCAGACACCAAGACTGGCCTTTTGGGCACCGGAGTCAATGCCATCAGTGGGCTGTTCCGGAATGTGGTGGG
CGGCAAGACGTTGACCAAGGAGGATCTCGACAAGGCCATGAAGGGCATGGAAGATCATTTGCTGCGCAAAAACGTGGCG
CGCGAAGCTGCCGTTCGTCTTTGCGAAGGTGTCGAAAAGGAGCTGGTCGGTGTCAAGACTGGAAACTTTGAAAGTATCA
ACGCCAAGATCCAGGCGGCAATGGAGTCGTCTCTCACCAAAATGCTTACTCCCACCTCATCCCTCGATCTCCTTCGCGA
AATCGACTCCATCACAGCCCCCCCCAGTCACGTCTCTGCGCAAAGCTCGGCCCTACGTCATCTCCAT

> SEQ ID NO:2621 214920 217169_300905_1
AACCACGGCCACGACGACCGCGTCTGTCCGGGATTGATCCTGTCAACTGCTTTACCAGATATCTAGCCGTGCCACGATA
GAGCGCGCATGTCGGCGAGAGGGGGGCAGAAGAGGAGAAGAGTCAAGAGAAGGGGGGGCACAGCTGATAGACAGAGCGC
CGTCGAGCCTGTAGCATCGCCAAACTCAATGTAGGTACGTCTGATGAGTGTCGCTGCATGCAGATGACAGTCGTGGATG
CATGTCATTGGCACTTGATCAGCTCCATATTTGACAGTGCCCCTCCAACGGCGGCAAGCGAGAGTGAGGGGTTTGCTGT
TGTTATTTGTTGTTGCTGTTGCTTTGCTGTTGCATTTTCCTGAGGCATATGGGCCAAGATGAGAGATGGATGGATGACA
TGGATGAGATTGGTTTTTGTGTATAACAAAGCTTGATAATGGCATTGAACAAAGCTTGTGCCGGCTAGTCGATAAGGAC
GATGTCGATAACGCGTATCGCAGCTATCAGCCCATCTAATCGCAGCACAGCCTAACCCC

> SEQ ID NO:2622 214922 216962_300903_1
GATACCCAGTATACAGCAGACCGTCCCGAATATCCCAAGTATATCAAGTGCAAGACTGGGTTTATAACAATCGTTTTTG
ATAAACTGCAATTTTTCTCATTTCATACGCGTATTGGAAGACACTTTATTCGTATATTTACGATCTGTTCCTTTGCCTG
TCGAGTACACCACTACACCACTCAACGACACCTACATATTTCCTTTCACCATGGCACCAACCGCTATCGTTGATCTCGG
CGAGACCTTTTCCGTCGGCCAGAAGCTGGAAAATGTCTCCGACGCCATCGACGACGTAAACTGCATCAAGTACGATTCC
GAGTCCAAGTTCGACGCCAACAAAGACAAGGCAAACTTCCGCCAGTACGAGGATGCCTGCGACAGGGTCAAGAACTTTT
ACAAGGAGCAGCACGAAAAGCAGACTGTCGCCTACAACCTTGCTGCTCGCAACAGGTTCAAGAGCGCTTCACGGGTGCG
CCCGGAGATGACCGTCTGGGAGGCCATAGAGAAGCTCAACACTCTCGTTGATGAATCTGACCCAGACACGTCGCTGTCT
C

> SEQ ID NO:2623 214928 200511_300853_1
gcccacgcgtccgcaatgcattctggtttgttgggggctaagccttttcaaCGTTATGCGTGTTACTCCCGGATATTATC
TTGCAACATGGGCTTGTCATCTCCCGCCAGCCATTCGCTGTGATTCGTCCCGGGATGCTCCGCGGACATTGCTTCCTGG
CGTATTTCAGCATCCGGCATTGGTGAAGTTCCCACTATGGAGATAGAATCATGGATTTTGCCCCCGCCCCTTTTTTTTT
TCTTCTTTTCCACCCTTCTTTATGCTTATCTCTCAGCCCCTAGCAAACGGTGGACGGATATTCTCATCTAGATTGCTGA
CAACATGCCGTTAGCCCCCATCAACCACGAACCCGTCCCGACCCGGGGTCCAATATTCGTTCAGCTCGGCTgttCACCC
GTATACTCGTGCTTGACTTTTATTTTTGTTTTAGTTGGGAGATTATTTTGTATTTTGCaGAAGCAATATTTGCCACCT
GGGCAATATTCTCTCGAGTCAGCCATTGTaGgCAGCTGAAAAGGCTGATCTGTCTTGGCCTTgctCGTTTCCCCGCGCT
ggaATCCATCATGTGAGAAGCAATGGATGGAgacgagccATgcatCAAGAtTCTTGTCTGgagatctcCTGTgCagaTC
ACggAttcTcccAAAGCCAACTta > SEQ ID NO:2624 214931 217453_300908_1
tgaaagctTCCATATCGCATTCTCATGGcgaCTGTTGGGAATGCGGCCCGGCAGATACGAGATCGGGCACTGCGCGAAA
GATCGATCCGCGTGCTCGTATCGCCAACGCCAATCTCCTTCGCCGAGCGTCGCTCAGTTCTGCAGGTGCTGGAGCAATA
TGGCCCTGTCGAGTTCTTCAAGATGACTCCCGGCTACTACGCCAACTTTGTTTCTATAACGAGAGAGCCCTCGACCGCC
GAAAGATTGATAGCTAGCAGCCCTCTAACATACAAGATCACGGAGCCTGTCCGCAGCGCGGTGGAAGACATTTACGTTG
CAGATCTAAACGAACCAGAGAGCTTTAGCACCATGCAGCCGACAATAACTGGGCAACAGACGAGCGGCGCGAACTCTTG
GTCCGACGGCACGGAACAGGGACAGGAACAGGAACAAGGACGAGAGGCGGAACTAAAGCAAGGGGAGAGAGAGTTCAAA
CTGGAAATCTTCCCTGCGCCCGAGTACAATCATAGATTTGCCATGGCCGGTTCACCGCTGCACGGCATCTGGAACGATG
GCTACGaaca > SEQ ID NO:2625 214938 212786_300843_1
GCAAATTGGACATACACGATAATGCAATCCTCATCCATGGCCAGCGTAGCTTTCTTGACTACTGCAAAAGTAAAGGACG
ATGAGACAAAGGAGGTTGTGAATGCTTGCAACAACTTAGTGCCCATCTCCAACTCCCCAATACCCCATGTCTAGCCGG
AGCCTGCTTTTTGTCCGCGGCCAAGAAGGAAACGGGTATCAAACTCATCGGTCGCTTGGAAATATTTCCTAGTGAAAGC
GAACTTGCTACTGTTCAAAACTCTCCTGAATATAAGCGTTTCAGCGACTCGGTCACCGGCCAAAAACTTCACGAAGGCA
AGGAGACTGCCACTTTATGGCAGCCCACCGGCGGTTTTCTGACAAGGAAGAACCAAGCCTCGACAACAAAGGCCGGTGT
ACTTGTTTTAGCCAAGTTCATTTGCAATGATAAAGAGAACGCAGTTCAAAATCTCGTGAAAGAGTTGCAAACATATTGT
GAGTGGATCGAGGGCAACGAGCTCACGACATACACATATTGCGTAATGACAAGTCAAACTGCAAATAAGGAAGTTCTGC

FIG. 2 continued

TCTTTGAGCGTTATAAGGATCTTCCTTCCGTCAAGACCCATGGCCAAACAAATGAGTTCAAGTCTATGTTCAAACGAAT
TTCGCCTTGGATTGAAACAAAGCGTACCGAAATAACTCCATGGAGCGAATTAGACGGTTCTTTCTTCTCTTCCCTAGAC
TTAGAAGCCACAGCGAAGCTCTAAAGATAGCTCTATATTCCTTATAATTTTGTATTTTTTCTTCTATTCT

> SEQ ID NO:2626 214942 217246_300906_1
AGATGTTGATTCCAACGCCAGAGACTAGCGGTGGGACTGCTATTAAAATAGAATAAAGATCTTACTTGGCAGCCGTTTT
CCGGTTCACCAAGCTGCGGAGATTAGATAGAGGGCTACATGCGACCCTTGTACGATCAGCGCATATCATGAGAACAATT
CTGGACTCAGAATTTTGACGAGACCAGTTCCTT

> SEQ ID NO:2627 214953 212943_300845_1
CGCTACGGCTTATTTACTCTTCTGACCGGAGGTCTCGGTATTGACATGACCTTGGAGCCATCGCTGCCGCAACGAAATG
GAGTACTCGTACATGTAGCCGCAGTCTCTTGTCCATGCGAGCGGGCATTTCGTCGGCGTCCCAATGGTCACCGCGAGAC
CTATCATTTGAGATACTGTCTATCTTCCTGCATGTTGGCTGTACGAGACGAACGATATGACGGCTCCCTGCCTTTGATT
TCTATGCAGCAGTAGCCAAAAGAGAAAAGGTGTAATATGCAGCAAGGCCGCTATGTTGCCACCCCACGAGACCTCGACT
GCATGCACGTCCAGCGATACGTCTCCACGAGGCCGCGCATGACCGCTGTGTCGAGAGTGGATGGACTGCGGACACCTCT
CTGCTTGCAACGGCTCAGCAAATTTTGCCGTTGGGCCACCGAAGCCAAACGGCTCACCGTCTACGCAATTGGCACTCTA
AATGCTCCTTTCCGCAGCCGCCTTGCTTTCAATACGCGTCCACAAGCGTTTGTAGCCCTTGTCAGGCCGTTGCGGTT

> SEQ ID NO:2628 215009 1044246_301916_1
tcctttagggtttctgagtaagagaGGAGAAAGATAATAATTCCCCCGAGGGGTAGAGAGAGAGAGGAGAGAGAGAGAG
AGAGCAAGCAATGGCGACGGCCAAAACAGTAAAAGACGTTCCCTCTCATGACTTCGTTCGATCCTACGCCGCTCATCTC
AAGCGGTCCGGAAAGATCGAGGTTCCCGAATGGGTGGACTTAGTGAAAACCTCCACTGCCAAGGAGCTTGCCCCTTATG
ACCCTGACTGGTACTACATTAGAGCTGCCTCAATGGCTCGCAAAATTTACCTGAGGGGAGGTATTGGCGTTGGAGCCTT
CCGGAAGATTTATGGAGGCCGGAAGAGTAACGGGTCCCGCCCTTCACACTTCTGCAAAAGCAGCGGGTCCATTGCAAGA
GATGTGTTGAAGCAGCTCGAGAAAATTGACATCATTGAGAAGGACACAAGGGGGGGCGAAAGATTACATCCAATGGTC
AAAGGGatttgGATCAGGTTGCAGGTCAAGTTATAATTCCTTCTGCTGCTgccgnctagagttAATagttgatcAGGTC
AACTTTTCagtgggCCAagttgacTAGCCTCATAtttgGGtattagcaaATGGcGttttcGAttttagtttgactgggtt
gttCActgAAGGATaattgttCAATGAgattttgaaATCATAtTTTTCCCCTTCCAAAaa > SEQ ID NO:2629 215009 1100606_301462_1
AGAGAGGAAGGTCGAGGATAGAGGAGGAGCAGGAGATTGGAGATTAGGGTAGCTGAGGAAGAGCCATAGCCATAGCCAG
AGCCATAGCCATAGCCATGGAGGTCGCGGCAGAGAGTGCAGTGGTGGCCCCGGCAACGGCCAAGACCGTGAAGGATGTG
GCTTCCCATGACTTTGTTCGTTCTTACGCTAGTCACCTCAAACGAACCGGCAAGATTGAAGTTCCTGCGTGGGTGGATC
TTGTCAAGACCTCAACAGCCAAGGAGCTTGCCCCGTATGATCCAGACTGGTACTACATTAGAGCAGCTTCTATGGCTCG
CAAGATTTACCTAAGAGGCGGTGTCGGTGTCGGAGCTTTCAAGAAAATCTATGGAGGATCGAAGAGAAATGGATCAAGA
CCATCCCACTTTTGCAAGAGCAGTGGATCAATTGCCCGAGATGTTCTTAAGCAACTCGAGAAGATTGACATTGTGGAGA
AGGACCATAGAGGTGGAAGGCGTATCACCTCGAATGGACAGCGTGATCTAGATCAGGTTGCTGGAACTGTCTCAGTGAA
AGTTGTTTAATTTAATATGCATAATTCAACTTTTCGTAGTTTAGGATtttagtaGGGCATATAGTTTAATTTAAACATAG
ACCGGATtaTAGCATCTTTGCTTAGtggtttattgtgttgacTTGAGtgattAgtactgaaaTTataaagAGGGag > SEQ ID NO:2630 215009 200461_300759_1
acaccgttaaaatggccggcggaatcaccgttcgcgatgtcgatgTAGGTCCTCCttgaAACACATTGAAATCATAAAA
TCTAGGATTTCCCCCTTCTTTCACGATCACCTCTcgacgATCTCGCAACTTGGCCCCGAAGAAACAAAAAAttatcctc
gaaaCCTCCGACGcggCGATgttgtgGTctggcttcgatGAGCCGCAGCGgctGGAGTTGATCTGAATAcaatgcattg
aGAAAAAAACCAGCTGCTtgagCCTcggACCagCTACATAcatggTTGTGTAtaagcgTGGCATATATgtggaaaAAAA
TTCTTTGAGGGAtctaggagcagGcgcgagggagtcGCAAGACTTCTGACgacggaatatttGCTAATGGGTCCTTTTC
TGTAATCAGGCGCAAAAGTTCATCACTGCCTATGCTGCTTTCTTGAAGCGCCAGGGCAAGCTGCCCATCCCTGGTTGGG
TTGACACCGTCAAGACTGGTCCCGCCAAGGAGCTGCCTCCCCAGGACATTGACTGGTTCTACGTCCGTGCCGCCTCCGT
CGCCCGCCACGTCTACCTCCGCAAGACCGTCGGTGTTGGCCGTCTCCGCAAGGTTCACGGCACTGCCAAGAACCGTGGC
AACCGCCCCAGCCACCACGTCGATGCCTCCGGCTCCGTCGACCGCAAGGTCCTCCAGGCCCTCGAGAAGATTGGCGTCG
TTGAGCAGGACGAGGACAAGGGTGGCCGCCGCATCACCCAGTCCGGCCAGCGTGATTTGGACCGAATTGCCCAGACCAC
CGCTGAGGCCGAGGAGGAGGATGAGGAGTAAATCAAAATAAAGAAAAAAGTCTTTTGTTTTCTTCTTACAACTGTCAT
GGATGGCGGCATTTGGAATGGGCGTACGGTCTTAGTGTTTGAGATGTATGAACAAGATTCCCTCTGGTTTTGGGCTTTC
GGTTACCAAACTGGACGTGCCACAGCCGTCTTTTGATGAACa > SEQ ID NO:2631 215009 190991_300737_1
CGAGCCCCTCAAGCAGCCGCACCCTCACTCTCCTCTCCTGCCCCCCACGGCGGCGGCGGGATGGCGGATTCGACGGCGA
GGACGGTGAAGGACGTGAACCCTCATGAGTTCGTCAAGGCCTACTCCGCCCACCTCAAGCGCTCCGGCAAGTTGTTTGT
AGCCAGCCAGGAGCTCCTGTTGTTAGGCAACCTTCGAATATCTTTTTACCAGATGGAGCTCCCTGAGTGGGTTGACATC

FIG. 2 continued

```
GTGAAGACTGCGAGGTTCAAGGAGCTCCCTCCTTATGATCCGGACTGGTACTACACGAGGGCTGCCTCGATTGCAAGGA
AGATCTACCTGAGGCAGGGTATTGGTGTAGGTGGCTTCCAGAAGATCTATGGTGGCCGCCAGAGGAACGGCTCACGCCC
CCCGCACTTCTGCAAGAGCAGCGGCGCTATCTCACGCAACATCCTTCAGCAGCTGCAGAAGATGGGCATCATTGATGTC
GACCCGAAGGGTGGAAGACTCATCACCTCCCAGGGAAGGCGTGATCTGGACCAAGTGGGCGGAAGAGTTGATGTTACCA
TCGCCTGAACAGATCCATTGATCCTCAACCCTTAAT

> SEQ ID NO:2632 215009 15485_300353_1
CTCGAGCTTGCGGCCGCCTTGAGAATGAAATGGTAACAATTCTTAAAAGTAAAGATAAACACTAAAAGCACAATGGCCT
CAAAAGTAGAAGAAGAACAAAAAAGAACATTAAGATCTTCAAGGTTCAACTGCAATACGGCCAGCAACCTGGTCCAAAT
CCCTTTGGCCACTGGAAGTGATCCTTCTTCCTCCTTTGGTGTCGAGCTCAACAATGTTCATTGTCTCCAGCTGTTGGAG
GATGTGACGGGCAATACCACCACTGCTTTTGCAAAAGTGAGGTGGGCGACTACCGTTCCTCTTGCTTCCACCATAGATT
CTACGGAAAGCACCAACACCAAGTCCTCCCCTCAGGTAAACCTTCCTTGCCATAGATGCAGCTCTGATGTAGTACCAAT
CAGGATCATATGGTGCAAGCTCCTTCAACTTTCCGGTCTTCACAATGTCTGTCCATGTGGGAAGCTCGATCTTGCCAGA
TCGCTTGAGATGAGAAGCATAAGCCTTGACGAAGTCATGAGGCGAGACGTCTTTCACAGTTTTACCAGTTGCCATGGCT
CAAGTTATCAAAAGACTAAGCGGCCGCAAGCTCGAG

> SEQ ID NO:2633 215009 229518_301044_1
ATTGGATCAGCATTATGGCGGCGCCGGCGACGTCCAAGACGGTGAAGGATGTCTCGTCGCACGAATTCGTGCGTGCCTA
CGCGGCGCATCTCAAGAGATCTGGCAAGGTCGAGCTGCCGCCATGGACAGACATTGTCAAGACCTCTGTGGCCAAGGAG
CTAGCGCCGTATGATCCGGACTGGTTCTATGTTCGAGCTGCGTCCATGGCGGAGGAAGATCTACCTTCGCCGGCGCATTG
GCGTGGGGGCATTCAAGAAGATCTATGGCGGCAGCAAGAGGAACGGTGCTCGGCCGTCACACTTCTGCAAGAGTAGCGG
TGCCATCGCCAGGCACGTCCTCAAGCAGCTGGAGAAGATTGACATCGTCGAGAAGGAACCAAAGGGTGGACGAAGAATC
ACTTCCCAGGGACGACGGGATTTGGATCAAGTTGCTGGAAGAGTTGCTGTTGCTGTTGCGTGAGGTGTGCCACTATGAC
ATGACGTGGCACAGCGGTGTCTTTTGGTTATAGAAAATATCTTCCAGCTAAT

> SEQ ID NO:2634 215009 46839_300192_1
cggacgcgtgggcagctgcgttgggcaaaatcccagactaagatcagtgaTTAGTCTTTTGATAACTTGAGCCATGGCA
ACTGGTAAAACTGTGAAAGACGTCTCGCCTCATGACTTCGTCAAGGCTTATGCTTCTCATCTCAAGCGATCTGGCAAGA
TCGAGCTTCCCACATGGACAGACATTGTGAAGACCGGAAAGTTGAAGGAGCTTGCACCATATGATCCTGATTGGTACTA
CATCAGAGCTGCATCTATGGCAAGGAAGGTTTACCTGAGGGGAGGACTTGGTGTTGGTGCTTTCCGTAGAATCTATGGT
GGAAGCAAGAGGAACGGTAGTCGCCCACCTCACTTTTGCAAAAGCAGTGGTGGTATTGCCCGTCACATCCTCCAACAGC
TGGAGACAATGAACATTGTTGAGCTCGACACCAAAGGAGGAAGAAGGATCACTTCCAGTGGCCAAAGGGATTGGACCA
GGTTGCTGGCCGTATTGCAGTTGAACCTTGAAGATCTTAATGTTCTTTTTTGTTCTTCTTCTACTTTTGAGGCCATTGT
GCTTTTAgtgtttatctttactttaagaattgttaccatttcattctcaaggcggccgcaagctcgag > SEQ ID NO:2635 215009 271238_200032_1
cgttatttattatgcatcttgactaccccctcgaccacgcgtccgcccacgcgtccgGGGAGCAACGTGAAGAGAGATCT
GCATCAGCGCCGCAACAGCAGCAGAAGTGAAGATGGAGGCAGCGAGAACTGTGAAAGATGTTTCCCCTCACGAATTTGT
GAAGGCTTATGCAACTCACCTTAAGCGCTCCGGCAAGATGGAGCTTCCTGAGTGGACTGATCTCGTCAAGACTGGTAAA
CTCAAAGAGCTTGCTCCATATGACCCTGATTGGTACTACATTAGAGCTGCTTCTATGGCAAGGAAGATTTATTTGAGGG
GCGGTATCGGTGTTGGTGGATTCCGAAGAATCTATGGTGGTAACCAGAGGAATGGCAGCCGCCCTCGTCATTTCTGTAA
GAGCAGTGGTTCAGTTGCACGCAACATACTTCAGCAATTGCAGAACATGAACATCGTTGACTTTGATCCTAAGGGTGGA
AGGAGAATTACATCCAATGGCCAGCGTGATCTTGACCAAGTTGCTGGAAGAATTGCTGCAGCTCTTTAAGAGATGAATT
CAGGCAATTTTATGAATACATGAGTTAGCTCAAACTTATTGTTTCAGTTTGGACCTATATAAATTCAGGGTACTTTTCA
ATCAATTTTGTGGATGTTTTGTTTTGCCTTCCTGAACTTTTCGCGTCTCTCCCAATAtgtCAGTTTTgccct > SEQ ID NO:2636 215021 206059_300804_1
cacaagcttcagtcgatgtcgcaccttcgcaatAAGCCCTCACCTCACATAAACACGGGAGAACTACATTCAAGATGGA
TTTCTCTAAATTCAGCAAGGGTTTCTCTGATTTCAGTGCGCAGATTACTCCGTTTGCGTCACGGACCTTCCAGTTTACC
AAGGAGCAGTTGGGCCAAGCAGATGATCGAACTGAGCTTCCTGCCGATTACATCGACCTCGAGAAAAAGGTCGATGCGC
TGAAACAAGCCCACCAGAAGATGCTTGCGGTGACTTCGCAATATACCAACGAAGCCTATGACTATCCTCCCAACATCAA
GGAGACATTTCAAGATCTTGGCCGAACCGTGAGTGAGAAGGTCAGCCTTCTATCTTCGGCTACATCTACTTCAGAGGCC
CAAGCAGCTCTTGTGGCTCCAGCATCTGCGAAGCCGCAACCAAAGACTTTCAACCATGCCATCTCGTGCGAGCTTAT
CCAGCAGCCAGCTCCTGCACCAGCACCACACTGGTGCTGGCGAAGATCCTCTGGCAACAGCTCTCGAGAAATATGCACT
CGCGATGGAACGAGTGGGCGACGCGCGCCTTGCTCAAGATTCACAAATCCAAAGCCGATTCCTAGCAGGATGGAACACA
ACCCTCAATACCAATCTTACCTTTGCGGCGCGTGCTAgaaagaatgttga
```

FIG. 2 continued

> SEQ ID NO:2637 215023 219339_300944_1
CCCACGCGTCCGGGAAAGAGAAGGACTTTATCACACAAGCCGTTTCGGTTTCTACTTCTCCTTATTGTTATTATTACAT
CTCGGTGCACCGCTGCATATGGGCATGGAATGGAGGCTTTTTCTTTTTCTTCTTTTCTTCTTGTTGGTCAGTCTTTTAC
GAAATACGCAACAAGACCTTGGGTGGAGTTCTATGGATACGAATATGAGGCGTTTGTTGTGGATACGTGAATGTGGAAC
GAGAAACGTACGCAAGACGAGTATGAGTCTCTTGCATGAAATAGCATGATGGGTGGTTTGGAGAAGGACTAAGCAAGTG
GTTGCTGTCCTGAGCCTTTGGCCGTCTGCGACTTGGGGTTGTTGGAACAGGCCTTGCATGTCTTTATGACTGACAGAGG
TGAGCTTGGAGTTAGCGCTTTTGAAGGCAGCTCTTTTCAACAAGTTGCAAATTTCCATTTTATCATTCTATAAGCTGTT
CCATCTCCTTATTTCCACT

> SEQ ID NO:2638 215024 219395_300944_1
ACCCACGCGTCCGGTGGAGATCATTTTACTGTACTATAACGGTGGTGGCTGGATCGTCATGAGGCAAATCGGGCAATGC
GATGCGATACGATGGATCACGGCTAACATGACAATATTGATTAGTAGCATGATGATGAACCAACAGCACAGATCTGGAT
GGCTTTAGCTTTGACCACATGCCAAGCAGGCTGCCCAGGTTCACAGACCAGCC

> SEQ ID NO:2639 215032 1121540_301876_1
aaagGAGAGAGAGAGAGAGAGAGAGAGAGGTTGCAGGTTCCGGTAGCAAGGAAGGCGCAACCATGGTGGCAGCAAAGAA
GACGAAAAAGGCTCAAGAGAGCATCAACAACAGGTTAGCCCTGGTCATGAAGAGTGGCAAATTCACTCTTGGATACAAG
ACTGCCTTGAAATCTCTCCGTGGTGGCAAAGCAAAACTTGTCATCATCTCGAACAACTGCCCCCCACTAAGGAAGTCTG
AAATTGAGTACTACGCTATGCTCTCCAAGACAGGGGTGCATCAGTACAGTGGAAACAATGTGGACTTGGGCACAGCCTG
CGGGAAGTACTATCGCGTCAGCTGTCTTAGTATCACAGACCCTGGTGATTCTGACATCATCAGGACTGTGGAGTAGGGA
TGAGAGTTCAAACCAAGTTTAGTGTGGAAGTAGGACGTCTTTTAATTCCTCTGAGCATGCAAGGGGGCCGAGTTTTGCC
TCTTCACTGGAATTTaTTGATTagcctgtcaacCTCTGcttAAAGAgaacttgGcTatttcgTaGATGGCTAagtcTTG
AttgATgatgaaaTatg > SEQ ID NO:2640 215032 188351_300776_1
CCCCGGGACCTCGCAGTCGCCACCCCGAGCAGAAGCCGCCGCCGCCGCCCGAAACCCTCGCCGCCGTCGCTTCTCCTCG
GGGCGCAGCCATGGTGGCCGCAAAGAAGACGAAGAAGTCCACGGACAACATCAACAACAAGCTGCAGCTCGTGATGAAG
AGCGGCAAGTACACGCTCGGCTACAAGACCGTCCTCAGGACCCTCAGGAACTCCAAGGCGAAGCTAGTGATCATTTCTA
ACAACTGCCCACCTCTTCGGAAGTCAGAAATTGAGTACTACGCTATGTTGGCCAAGGTCACCGTCCACCACTTCCACGG
AAATAATGTCNATCTGGGGACAGCCTGTGGTAAATACTTCCGTGTTTGCTGCCTCAGCATTATTGATCCTGGTGACTCG
GATATCATCAAGACCACGGGTGAGCAGTAAGGATGAGCGGTTCCGCTGGCGCTTCAGATGCTGTCACACTGAGCTGTTC
TAGACATTGTAGTTGTTGCTGGACTTGATTTGGTCTCTCTCGTGTATCGAACAGCTTTTACCAGTCAACCAAAGTTTCG
TGGGAACATTGTTCTTGGATTGGAAAATTTTGTTCCTGGAAAAAAAAAAA > SEQ ID NO:2641 215032 194405_300763_1
ccgACCTCGCAGTCGCCCACCCCGAGCAGAAGCCGCCGCCGCCGCCCGAAACCCTCGCCGCCGTCGCTTCTCCTCGGGGC
GCAGCCATGGTGGCCGCAAAGAAGACGAAGAAGTCCACGGACAACATCAACAACAAGCTGCAGCTCGTGATGAAGAGCG
GCAAGTACACGCTCGGCTACAAGACCGTCCTCAGGACCCTCAGGAACTCCAAGGCGAAGCTAGTGATCATTTCTAACAA
CTGCCCACCTCTTCGGAAGTCAGAAATTGAGTACTACGCTATGTTGGCCAAGGTCACCGTCCACCATTTCCACGGAAAT
AATGTCGATCTGGGGACAGCCTGTGGTAAATACTTCCGTGTTTGCTGCCTCAGCATTATTGATCCTGGTGACTCGGATA
TCATCAAGACCACGGGTGAGCAGTAAGGATGAGCGGTTCCGCTGGCGCTTCAGATGCTGTCACACTGAGCTGTTCTAGA
CATTGTAGTTGTTGCTGGACTTGATTTGGTCTCTCTCGTGTATCGAACAGCTTTTACCAGTCAACCAAAGTTTCGTGGG
AACATTGTTCTTGGATTGGAAAATTTTGTTCCTGGCCCGAATCATGTTTTCAAttaaaacGcttggcTgtttTgTtcacT
GAACttcgcATCatta > SEQ ID NO:2642 215032 217679_300910_1
GCAACCGCATCAATCTAATCGCAAGATCGCAGCTCGCGCCCAAAATCAGTCAAAATGGCCCCTCAGAAGAAGAGCAAGA
AGGATGCCAACAGCATCAACTCCAAGTTGGCGCTTGTTATGAAGTCCGGAAAGGTCACTCTCGGCTACAAGTCTACTCT
CAAGTCTCTGCGATCCGGCAAGGCCAAGCTGATCATCATTGCTGGCAACACTCCTCCCCTGAGAAAGAGTGAACTCGAG
TACTACAGCATGCTGTCCAAGGCTCCCATCCACCACTTCGCTGGTAACAACATTGAGCTCGGCACTGCCTGCGGAAAGC
TCTTCCGCTGCTCCACCCTTGCCATCCTGGATGCTGGTGACTCTGATATCCTCAGCGACCAGCAGGCTTAAATAGCCGA
AATCTAGTGCATTCAAAACGGCGTTGGGGGTAAAACGGTTCAAGGGCAATATGGATACCATACACTTTCACATTATGTG
CGAGACGAAAACTTTTGATGCGAGACATCATCTACTAGGAAGGCAAATCCTTTGGGGATGGAAAAAAGCCCCAGAAATT
TCCAAGTGATAGTTATCTCAATGGAATAATACAGCCATGAAGACTGTTCCCCCTGTCaaaaaa

FIG. 2 continued

> SEQ ID NO:2643 215033 195947_300639_1
ccTCGGTCTCTACGCAATCGCGACTGCATCAGAAGCATTCAATTGCTCGTCAACGTCAACATGTCTCTCGCACAGTCTA
TCTACAGGCAAGTCGCAACGACAGCGAATCAACGAACGTAACTACGGCATCCTAACATATACCTCTACAGCACCGTCTT
CCGCAAGAACTTCACCATGCTTGCGGCCGTTTTCGGTGCCGGCTTCGCTTGGGAGATGTATGAGGAGCCTACCACATTC
GATCGAGCGTCAGGGCAGTAAAAGGCTAATTAAGGGTGCAACAGCGGTTTCAATGCCACCATGAACAAAATCTGGGACA
GCAACAACCGAGGCCGCCAATGGAAGGACATCCGACACAAGTACATTGAGGGCGGCGAGGACGAGGAGTAAGATCAACA
TGCAAATTCCGGTTGCTACGGCTAGAATGGGTGTGGCATGGGACTGCCTGGGGAAAATGTACAAAACCAACGAGAAATA
GAATGATTCACAACTTTTTCTTTCCCTTCG

> SEQ ID NO:2644 215043 1126279_302022_1
AGGTATATAAACTATTTATTAACAGACAAGGCCTACAGACTTATTTCTTCTTGGACACACCCACGGTGCGGCCACGGCG
GCCAGTGGTCTTGGTGTGCTGGCCTCGGACACGAAGGCCCCAGAAGTGACGCAGCCCTCTATGGGCCCGAATCTTCTTC
AGTCGCTCCAGGTCTTCACGGAGCTTGTTGTCCAGACCATTGGCTAGGACCTGGCTGTATTTTCCATCCTTTACATCCT
TCTGTCTGTTCAAAAACCAGTCTGGGATCTTGTACTGGCGTGGATTCTGCATAATGGTGATCACACGTTCCACCTCATC
CTCAGTGAGTTCTCCCGCCCTCTTGGTGAGGTCAATGTCTGCTTTCCTCAACACCACA

> SEQ ID NO:2645 215043 127831_300473_1
gcATCTCTTTCAAACTAAAGCAGCCGCAGCCGCAGCCGCACTGTGCCGAAAGCAGTGAAACCCTAACCATGTCGCTGGT
TGCAAACGAAGAGTTTCAGCACATTCTTCGTGTGCAAAACACGAACGTTGATGGAAAGCAGAAGATCATGTTCGCTATG
ACCTCTATCAAAGGTATCGGTCGCCGTTTTGCTAACATTGCTTGCAAGAAAGCCGATATCGACATGAACAAGAGGGCCG
GAGAACTCTCTGCTGCAGAGCTTGATAGCTTGATGGTGGTTGTGGCTAATCCTCGCCAATTCAAAATCCCAGATTGGTT
TTTGAACAGGCAGAAGGATTACAAGGATGGCAAGTTTTCTCAAGTTACATCAAATGCACTTGACATGAAACTCAGGGAT
GATCTGGAACGGCTGAAGAAGATCAGAAATCACCGTGGTTTGCGTCACTACTGGGGCCTTCGTGTACGGGGTCAGCACA
CAAAGACCACTGGCCGCAGGGGGAAGACTGTTGGTGTCTCCAAGAAGAGATAAATCATATGTTTTATGCTCTGCTCTTT
AGTATGCGTAGTCCGAACGCTTACAAGAAGTTTATTAGGGTTTTGTAATGTTTGCACTGAAATTTTCTTGTCTTgccat
tTggagggTTATAGttTATATAaATccTCTGAt > SEQ ID NO:2646 215043 57312_300056_1
ctcacatctcTTGAATACAGAAGAAGCCGCCGCCGCACAGAGCAAGATTTGAAACCTAGCAATGTCGCTCGTTGCAAAT
GAAGAATTTCAGCACATTCTTCGTGTGCAAAACACCAACGTCGATGGGAAGCAAAAGATCATGTTCGCTTTGACCTCAA
TCAAAGGTATCGGTCGTCGTTTTGCCAACATTGCCTGCAAGAAAGCTGATATCGACATGAACAAGAGGGCGGGAGAACT
TACTGCTGCAGAGCTTGACAGTGTGATGGTGGTTGTTGCAAATCCCCGTCAATTCAAAATACCTGATTGGTTTTTGAAT
AGGCAGAAGGATTACAAGGATGGGAAGTTTTCACAAGTTACCTCTAATGCTCTTGACATGAAGCTTAGGGATGATCTCG
AGCGCCTGAAGAAGATCAGGAATCATCGTGGTTTACGTCACTACTGGGGTCTCCGAGTGCGTGGTCAGCACACAAAGAC
CACAGGGCGCAGGGGGAAGACTGTTGGTGTCTCCAAAAAGAGATAAATCATCTACTTGTTCAGTTTGTTATGTGCTTTC
TCTTTATGTGCTCCGGGCGATACATGTTTAAGATATTTTaGGGGATTTTGTGTTGGTATGCTTAAATTTTCCTTTCcgt
tGGTGGATTACAgTATaattttttTccATAGTgACAAggAttTCTCTgctttATGATcT > SEQ ID NO:2647 215047 233304_301089_1
atccgagcttttaggtttaggggttctaaagccggctcaAGCACCCAAAGGTACGCATCGTCTCTAGCTCGGCAGCAATG
GCGGACACCCTCGTCTCTAAAGGGCGCATGGATGGCCACGGCGACTGGGTGACGGCCATCGCCACCCCTGTCGACAACA
GCGACCTCATCCTGTCGGCGTCGCGCGACAAGTCGGTCCTGGTCTGGGACCTGAGCAAGGACCCGATCGAGAACCACTA
CGGCTTCCCCAAGCGCCGCCTCACCGGCCACGCCACTTCGTCCAGGACGTGGTCATCTCCTCCGACAGCCAGTTCGCG
CTGTCGGGCTCGTGGGACAGCACCCTGCCCTCTGGGACCTGAGCACCGGCACCACCCGCCGGTTTGTCGGCCACA
CCAAGGACGTGCTCTCGGTCGCCTTCTCGGCCGACAACCGCCAGATTGTCTCCGGCTCCCGCGACAAGTCGATCAAGCT
CTGGAACACGCTGGGAGAGTGCAAGTATACCATCCAGGACCAGGACTCGCATACCGGGTGGGTGAGCTgcgTcCGGTTC
TCGccggtgACGACGAAccCGATCATCGTCTCCGGCGgctggGACAAgaTGGTGAaggtctggaacctgACCAACTGTa
aGCtgAgg > SEQ ID NO:2648 215047 258680_301698_1
AACATGAGCCAGAACGTTCTTCTTGTACTCCGACGAACCCTTGAGGGCCACAACGGCTGGGTTACCTCCCTCGCTACTT
CTTCCAACAACCCCGACATTCTGCTGTCCGGATCCCGAGACAAGTCCCTGATTGTCTGGTCTCTGACCCGAGACGACAC
CAACTACGGTGTCCCCCGAAAGTCTCTTAAGGGCCACTCCCACATTGTCCAGGACTGTGCCATCTCTCATGACGGAGCT
TACGCCATCTCCGGCTCTTGGGATAACACTCTCCGAGTCTGGGACCTGAACACCGGCGTGTCCAAGGACCGAGTCGTCA
GCCACAATGGTGACGTCCTTCCCG > SEQ ID NO:2649 215047 271525_200035_1
aaccgagagcagccctctcccattacctgcccgataaaatggCACAAGAATCACTAGTCCTCCGCGGAACAATGAAAGC
CCACACCGATTGGGTTACAGCCATCGCCACCCCAATTGACAACTCCGACATGATCGTTACTTCCTCCAGGGACAAGTCC

FIG. 2 continued

CTAATCGTCTGGTCTCTCACAAAGGACGGCCCACAATACGGTGTCCCCGCCGCCGTCTCACTGGGCACGGCCACTTCG
TCCAAGATGTCGTCCTTTCCTCCGACGGTATGTTTGCTCTCTCTGGCTCCTGGGACGGTGAGCTTCGCCTTTGGGATCT
TCAAGCTGGAACCACCGCTCGCCGTTTCGTCGGTCACACTAAGGATGTTCTGTGCGTTGCATTCTCCGTCGACAACCGT
CAGATCGTTTCCGCTTCCCGTGACAAATCCATCAAGCTCTGGAACACTCTCGGTGAATGCAAATATACCATTCAGGATG
GTGACTCGCATTCTGATTGGGTTTCATGTGTTCGTTTCAGCCCGAATACACTTCAGCCCACTATCGTTTCTGGATCCTG
GGACCGTACTGTGAAAATCTGGAACCTGACTAACTGTAAGCTGAGGTCCACTCTGGCTGGACACGCCGGCTACGTGAAC
ACCGTGGCAGTCTCTCCTGATGGTTCATTGTGTGCTAGTGGAGGCAAAGATGGTACAATTTTGCTTTGGGATTTGGCTG
AGGGGAAGAAGCTCTACTCGCTTGATGCTGGCTCTATCATTCACGCGCTCTGCTTTAGTCCTAACAGGTATTGGCTGTG
CGCAGCTACTGAAACTAGCATTAAGATTTGGGATTTGGAGAGCAAGAGCATTGTGGTGGATCTTAAAGTTGATCTCAAG
CAAGAGAGTGAGATGGCTACTGAAGGAACTATTGGCTCTGCCTGCAAAAACAAGATCATGTACTGCACCTGTTTGAGCT
GGAGTGCTGATGGAAGCACGCTTTTCAGTGGATATACAGATGGTTTGATTAGGGTTTGGGGTATTGGGCGTTATTAGGA
GTTGGCCATAGTCATTTAAAGACATTTAGATTTCTCTTGAAATGTTTGAAGAATGATATCTGGATTCTCTCtgttTCTC
ATggtttTGagagttttgttgttccAATTTTGGGATgttATTT > SEQ ID NO:2650  215047 38808_300194_1
CCCACGCGTCCGCGAAAACCCTAGTTTCAGAGGCATCTCCAGACACCGAAAATGGCGGAAGGACTCGTTTTGAAGGGCA
CCATGCGTGCACACACTGACATGGTGACGGCAATCGCCACCCCAATCGATAACGCAGACATCATCGTCTCAGCTTCCCG
CGACAAATCCATCATTTTGTGGAAACTCACCAAGGACGACAAAGCCTACGGTGTAGCTCAGAGGCGTCTCACTGGTCAC
TCTCACTTCGTTGAGGATGTTGTTCTCTCCTCCGATGGACAATTCGCGCTTTCCGGCAGCTGGGACGGCGAGCTCCGTC
TTTGGGATC > SEQ ID NO:2651  215047 254326_301632_1
GGCGTGCTTAAGAAGAGAGAGAGAGAGAGAGAGAGACAGAGAGAGAGAGAGGAGAGAGAGAGAGAGAAGCTGCAATGGCCG
AGACCTTAGTCCTGCGTGGGACCATGAAGGGGCACACTGACTGGGTCACGTCGATCAGTACGCCCATCGACAACTCCGA
CATGATCATCTCGTCATCCCGCGACAAGTCGCTCCTCGTATGGTCCCTCACCCGCGAGGAGGGCACCTTTGGTGTCCCC
AAGCGCCGACTCACCGGCCATGCCCACTTCGTCCAGGACGTCGTCCTCTCCTCCGACGGCCAGTTCGCGCTCTCGGGGT
CGTGGGACTCCACCCTCCGCCTCTGGGACCTCAACACTGGTGCCAACACCCGACGCTTTGTCAGCCACACCAAGGACGT
TCTCTCTGTCGCCTTCTCCGCTGACAACCGACAGATCGTCTCCGCCTCGCGTGACCGCACCATCAAGCTCTGGAATACC
CTTGGCGAGTGCAAGTACACCATCCAGGACCAGGATGCGCACACCGGGTGGGTGTCGTGCGTGCGGTTCTCTCCTGTGA
C > SEQ ID NO:2652  215047 1043268_301881_1
GCTCAGGCAGAGGCGTGCTTAAGAAGAGAGAGAGAGAGAGAGAGACAGAGAGAGAGAGAGGAGAGAGAGAGAGAGAAGC
TGCAATGGCCGAGACCTTAGTCCTGCGTGGGACCATGAAGGGGCACACTGACTGGGTCACGTCGATCAGTACGCCCATC
GACAACTCCGACATGATCATCTCGTCATCCCGCGACAAGTCGCTCCTCGTTTTGGTCCCTCACCCGNCGAGGAGGGCAC
CTTTGGTGTCCCCAAGCTGCCGCCTCAACGGCCATGCCCACTTCGTCCAGGACTGTCGTCCTCTCCTCCGACGGCCAGT
TCTGCGCTCTCGGGGTCGTGGGACTCCACCCTCCGCCTCTGGGACCTCAACACTGGTGCCACCAACCGACGCTTTGTCA
GCCACACCAAGGACGTTCTCTCTGTCGCCTTCTCCGCTGACAACCGACAGATCGTCTCCGCCTCGCGTTGACCGCACCA
TCAAGCTCTGGAATACCCTTGGCGAGTGCAAGTACACCATCCAGGACCAGGATGCGCACACCGGGTGGGTGTCGTGCGT
GCGGTTCTCTCCTGTGA > SEQ ID NO:2653  215047 194512_300764_1
CGGCTTCCCAATCTCTCCCCAGCGCCGCCGCCGCCGCCATCCTCCCCGAGCCCTAGCTCTCCCCTATCCCTCGCCGCAC
GCACCACCACCAACCATGGCCGGCGCGCAGGAGTCTCTGGTGTTGGCCGGCGTGATGCACGGCCACAACGACGTGGTGA
CGGCCATCGCGACCCCCATCGACAACTCGCCGTTCATCGTCTCCTCCTCCCGCGACAAGTCGCTGCTGGTGTGGGACCT
CACCAACCCCGTCCAGAACTCGGCGAGGGCGCCGGCGCCTCCGAGTACGCCGTGCCCTTCCGCCGCCTCACCGGCCAC
TCCCACTTCGTCCAGGACGTCGTCCTCAGCTCCGACGGGCAGTTCGCGCTCTCTGGCTCCTGGGACGGGGAGCTCCGCC
TCTGGGACCTCTCCACCGGGGTCACCACCCGCCGGTTCGTCGGGCACGACAAAGACGTCCTCTCCGTCGCCTTCTCCGT
CGACAACCGGCAGATCGTCTCCGGCTCCC > SEQ ID NO:2654  215047 1097436_301444_1
GACGGAGAAGAAGGGTCTAAGACCTTGAATCAGAGCAGCTATGGCGGAGACTCTAGTCCTCCGCGGCACCATGAAGGGC
CACACGGATTGGGTCACCTCCATCAGCACCCCATCGACAACTCCGACATGATCATCTCCTCGTCCCGCGATAAGTCGC
TCATGGTCTGGAATCTCACCCGTGAGGAAGGCGTCTACGGTGTCCCCAAGCGGCGCTTGACTGGCCATGCCCACTTCGT
CCAGGATGTGGTCCTATCGTCCGACGGGCAGTTCGCCCTCTCCGGCTCGTGGGACTCGACTCTCCGCCTCTGGGACCTG
GCTACCGGCGCCACCACCCGCCGCTTTGTCAGCCATACCAAAGACGTGCTCTCCGTCGCTTTCTCTGCCGACAATCGTC
AAATCGTCTCCGCCTCCCGTGACCGCACCATCAAGCTCTGGAACACCCTTGGTGAGTGCAAGTACACCATCCAGGACCA
GGATGCGCACAACGGATGGGTCTCGTGCGTCCGGTTCTCCCCCGCCACCGCCAACCCCACCGTCGTCTCGGGATCGTGG

FIG. 2 continued

GACCGGACCGTCAAAGTGTGGAACCTCACCAACTGCAAGCTCAGGACCACGCTCTCCGGCCACTCGGGCTATGTCAACA
CTGTCACTGTGTCCCCCGATGGCTCACTCTGCGCCAGCG

> SEQ ID NO:2655 215047 199820_300753_1
GCAACTGATCCTCAAAGGTACCCTCGAGGGCCACAATGGCTGGGTTACCAGCTTGGCCACCTCAATGGAGAACCCCAAC
ATGCTCCTGTCTGGTAGCCGAGACAAGACCCTGATCATCTGGAACCTCACACGCGACGAGACTCAATACGGATACCCCA
AGCGATCCCTCCACGGCCACTCCCACATTGTGTCGGACTGTGTCATCTCCTCTGACGGTGCCTACGCCCTCTCTGCCTC
TTGGGACAAGACCCTCCGTCTGTGGGAGCTCGCCACTGGCACCACCACCCGAAGATTCGTCGGCCACACCAACGATGTT
CTCTCCGTCTCCTTCTCCGCCGACAACCGACAGATTGTCTCCGGCTCTCGTGACCGCACCATCAAGCTGTGGAACACCC
TCGGTGACTGCAAGTACACCATCACCGACAAGGGCCACACTGAGTGGGTTTCCTGCGTCCGATTCAGCCCCAACCCCCA
GAACCCTGTGATTGTTTCCAGCGGTTGGGACAAGTTG

> SEQ ID NO:2656 215047 136912_300440_1
CCGGCTTCCCAATCTCTCCCCAGCGCCGCCGGCGCCGCCATCCTCCCCGAGCCCTAGCTCTCCCCTACCCCTCGCCGCA
CGCACCACCACCAACCATGGCCGGCGCGCAGGAGTCTCTGGTGTTGGCCGGCGTGATGCACGGCCACAACGACGTGGTG
ACGGCCATCGCGACCCCCATCGACAACTCGCCGTTCATCGTCTCCTCCTCCCGCGACAAGTCGCTGCTGGTGTGGGACC
TCACCAACCCCGTCCAGAACGTCGGCGAGGGCGCCGGCGCCCTCCGAGTACGGCGTGCCCTTCCGCCGCCTCACCGGCCA
CTCCCACTTCGTCCAGGACGTCGTCCTCAGCTCCGACGGCCAGTTCGCGCTCTCCGGCTCCTGGGACGGCGAGCTCCGC
CTCTGGGACCTCTCCACCGGGGTCACCACCCGCCGCTTCGTCGGCCACGACAAGGACGTCCTCTCCGTCGCCTTCTCCG
TCGACAACCGCCAGATCGTCTCCGCCTCCCGCGACCGCACCATCAAGCTGTGGAACACCCTCGGCGAGTGCAAGTACAC
CATCGGCGGCG

> SEQ ID NO:2657 215055 204471_300817_1
GTTTCGAACGGTGTCCATGGCGGGCGGATGGGCGGGACGAGAGGGGGAAGCTCGGCGCCACCATGCCTTTACAAAAAGT
ATCATTGATGAATAGAGTCGTAAATCCGATTCACGGCTGCGGAGGCAGTGAGCGGAAGATCGACCAACAGATTAGCGAT
GAGCGAGAGGGTCAAGGAAACTGACAGGGTGATTCAGATGCCCCCGGAAGTGGAGAGGAAACAAGAAGCCAGGGGTGT
TTGTCGTACACATGTTGCCAGCCTGCATCTGGCATCTGCTGCCAGCTATTGACAGCTACTTTCATTGGCCAGATGCTGC
AAATTGGAGCTGCACTGCACGGGCACAAGTTCGGATGGGGGATGACGGAAGCAAAACGGCTGCGTATTACCTGCGTTGG
TAGAATACTAAGGTATTGATGTAATATTTGGGTAGGTACGGATACGGTACTTTCATACAAAGAATCACTTAGTCATGGC
ACGCCTATCGATACCTCACCTCAGGCCAGCATCTTCACTTCGACTCGCTTATGCATTAGATCATATATCGAATCCATAT
AATATCAACTCATCATACTCAAAAAAAA

> SEQ ID NO:2658 215055 212896_300844_1
ACGGGGTCCATGGCGGGCGGATGGCCGTTACGACAGGGGGAATCTCGGCGCCACCATGCCTTTACAAAAGGTATCATTG
ATGAATAGAGTCTTGAATCCGATTCACGGGTGCGGAGGCACTGAGCGGAAGATCGACC

> SEQ ID NO:2659 215059 195707_300637_1
AGAGAGCGTTTTTTTTTTACTTGACTTTGGGTTTGGATGCTGGAATAGAAAGACGATACACAAGACAAGGAATCAGACA
GGACTTGCACAAGACATAGATCACAAGAAACGCGACCTCACCTCATCCTCGACGATGCCTTTCAACACAGAGCTCACCC
GCCGCCTGGGCATTCGCGTCCCCGTCATCCAGGGCGGCCTCATGCACGTCGGCACCGCAGACCTCGCGTCCGCAGTCTC
CAACGGCGGCGGCCTGGGCATCATCACCGCCCTCATCTCCCCCACGCCCGAAGCCCTGCGCGCCGAGATCCAGCGCTGC
CGCACCCTCACCGACAAGCCCTTTGGCGTCAACCTGACCCTCCTCCCGTCCTCCTCCGCCCGACTACCCGGCCTACG
CCCAGGCCATCATCGACGAGGGCGTCAAGATTGTCGAGACGGCCGGAAACTCGCCCGGCCCGGTGATTCGCCAGCTCAA
GGCCGCGGGCATCACGGTGCTGCACAAGTGTACGACGATTCGTCATGCCCAGAGCGCGATCAAGTTGGGCGTCGACTTT
TTGAGCATTGATGGGT

> SEQ ID NO:2660 215066 220467_300955_1
GTCTTCTCCAACTAAACAATAGCTCTTTTCTACTTCTAATTTTTTTTTATCTCAACTCACCATCTGAGCTATCAAGCT
AGAAAGTAACCACAGCAAATAATCATCATGGAGCTCGTCAACTACAACCACAAGACCTGCCCCAAGTGCTCTGCCACCA
TCACCTCCGAGTCCAAGACTTGCTCGAGCTGCGGCGCTACTTGCCCCGTCTAAGCTACCTCAGCTCGACCCGCCATCAA
CCTCAACCATCGCAACAACATGACGAGAATATCCTGAGGTGTGGCGGGACTGCAAGGACGCGCGGATGAGTGAATGAAT
AGATGAATGAAGGAATGATATACCTCAGCAGGACATGGTGCATTAAGACAAGGCGTTGATGGAAGAAGAGAAGCGATCA
TGTATGTCTAATATTCTAAGCTATATGCCAGTCCTTGTTACAGACAGGCGGCTAGAATAGTTCCTCGCAATGGAAGGAA
TCTAGAATGGCAATGGGCAATGGGCAATGGC

> SEQ ID NO:2661 215074 1119263_301895_1
GGTATCCGTCGGGACGCGAAGAAGTTCTGAAGCCATGTCGAAGCGAGGACGAGGAGGGTCCTCCGGGAACAAGTTCCGG
ATGTCTCTGGCTCTTCCAGTGGCCGCTGTTATGAACTGCGCGGACAACACCGGAGCCAAGAATCTCTACATCATCTCGG

FIG. 2 continued

```
TCAAGGGCGTTAAGGGAAGACTCAACCGTCTCCCTGCGGCTTGCGTTGGTGATATGGTCATGGCCACCGTCAAGAAGGG
AAAGCCTGACCTCAGGAAGAAGGTTATGCCGGCTGTCGTCGTTAGGCAGCGCAAACCCTGGAGGCGAAAGGACGGCGTC
TTCATGTACTTCGAAGACAATGCCGGAGTCATTGTGAATCCCAAGGGGGAAATGAAAGGCTCGGCCATTACAGGACCCA
TTGGGAAAGAGTGCGCTGATTTGTGGCCCAGGATTGCTAGCGCAGCCAATGCAATAGTCTAACCCTGCACTTGCGCATC
AGTTTTTGTCATTAGGGTCAATGCGGATCTTTAGTAATACAAAGTGGGCTACTGGTTTTGTGGGCTATATAAATGCTAT
ATCTTTGAAAGATTTGAGTAc

> SEQ ID NO:2662 215074 226287_300995_1
ACACAATGTCTGGAGCTTCTGGTACCAAATACAAGATGTCGGTGAGTATTGCAACACAAACAGCGACAGGCGACACACA
CGAAACAGCGGGTTTGATCGGGGCGACTTTGGAGATAATGACGGACGAACGAACGACACGGACGACGCAGGTTTTTCAT
GGATTGGGTGGCGACACAGAGAGCCCATAGAGCAGTTGAATCTGTGTATTCAGAAGACGGTGTACGTCAGCAGCTCAGC
AGACGGTGTCCAGGCGTTTGTATTGCAGACGATTCTGACAAGTCTTTTTGGGTGTTCCTCTGTGTCCATTTGCAGCCTT
GTACGACTGACTGTGAAAACCTTTCCATGTGTGCATTTGTACAGTCCGACTCGCCACTAAGTCGCCATTGATCTCTCCC
AATCGCTGCCGAAAGAAACCGTTTGTCCATCGAGGCTCTTTTTATCTCGTTTCTTTCCATACTAACCCATAGATGGCCC
TGCCCGTCGGAGCCATCATGAACTGCGCTTGACAACTCTGGTGCTCGAAACCTGTACGTCATTGCCGTCAAGGGCTGCG
GTGCTCGACTTAACCGACTGCCCGCCGCTGGTGCCGGTGACATGGTCATGGCCACCGTCAAGAAG

> SEQ ID NO:2663 215074 127512_300470_1
ccgagagggagagtgaagagcaacgccgtcgcggcaatgtcgaagcgaggacgtggaggttccgctgggaACAAGTTCA
GGATGTCGTTGGGTTTACCGGTGGCGGCAACTATTAACTGTGCCGATAACACTGGTGCAAAGAACCTTTACATCATTTC
GGTGAAGGGTATCAAGGGAAGGCTTAATAGGTTGCCTTCAGCTTGTGTTGGTGACATGGTTATGGCCACTGTGAAGAAG
GGTAAGCCTGATCTCAGGAAGAAGGTTATGCCTGCTGTCGTTGTTCGTCAGCGCAAGCCGTGGCGCCGAAAGGATGGTG
TTTTCATGTACTTTGAAGATAATGCTGGCGTAATTGTGAATCCCAAGGGTGAAATGAAGGGATCTGCCATTACTGGTCC
CATTGGGAAAGAGTGTGCTGATCTTTGGCCAAGGATTGCAAGTGCTGCCAATGCTATCGTTTAGTTTGAGAATTGTGTT
TTCCAATAGTTTATTTGAGTTTTTGAATATCAGGGAGTTCTTTTCTTGGTAAGAATTAGTGCAACTGGCTATGAGAATT
TTGCTGCACTCCAAATGTTTTTGTCTATGTAGGACATTACTGTTTCCTTTTCTTGTTGATGTGTTTGTTACGAGTAAAA
GAAAATAtGtTgAActAATTtattctct > SEQ ID NO:2664 215074 179579_300561_1
ttcacgacggcaATCCGCGACTTTGGCACGTTTCTCACGACTCTAACGCCCCCAACCCTTCAGACACAATGGCCAAGCA
ATCTCGTGGTGCCCCTGGTGGCAAGCTCAAGATGACCCTCGGTCTCCCCGTCGGTGCCGTCATGAACTGCGCCGACAAC
TCTGGTGCCCGTAACCTGTACATCATCTCCGTCAAGGGTATCGGTGCTCGCCTGAACCGCCTGCCCGCCGGCGGTGTCG
GTGACATGGTCATGGCCACCGTCAAGAAGGGGAAAGCCTGAGCTGCGAAAGAAGGTCCACCCCGCCGTCATTGTCCGACA
GTCCAAGCCCTGGAAGCGATTCGACCGTGTTTTCCTGTACTTCGAGGACAACGCTGGTGTTATCGTCAACCCCAAGGGT
GAGATGAAGGGCTCTGCCATCACTGGCCCCGTCGGCAAGGAGGCTGCTGAGCTGTGGCCCCGTATTCCAGCAACTCCG
GTGTCGTCATGTAAAGAGGTTGTTAAACGAAGGGAGGGATTTTTTTTTATTTACCAAAGAGAAGAGAGGAATGAAAAA
AAGACAAATGACCAAGTCCCTCGATGCGATCTTATagaagCGTGGAAACTCTTTTTCCCGCCTCCTGTCCCTTTTTCT
gatttTTttgttCtTTGGGGCATg > SEQ ID NO:2665 215074 25450_301000_1
TTTAATCTAAGCAAAATCTCTTAGAAACTGGAAATATGTCTGAAGCTCACAAAAGATTGTCGTCTCTACTTAAAACACT
CAAAACACCAACTATTTCGCGTTTCGTTGAAGACAGATACATAACCAGCAAAAGTGATAAATGATCTTCAGACAATGGC
GTTAGCAGCACTAGCAATCCTTGGCCAGAGATCCGCACACTCTTTCCCAATAGGTCCAGTAATTGCAGAACCTTTCATT
TCTCCCTTAGGGTTCACAATCACTCCAGCATTATCTTCAAAGTACATGAAAACACCGTCCTTTCGGCGCCATGGCTTAC
GTTGCCTAACAATCACAGCAGGAAGAACCTTTTTCCTGAGGTCTGGTTTACCTTTCTTGACAGTGGCCATAACCATGTC
ACCAACACAAGCAGAAGGTAACCGATTGAGACGACCTTTGATTCCTTTAACAGAGATGATGTAAAGGTTCTTAGCACCA
GTGTTGTCTGCACAGTTCACTGTGGCTGCAACGGGCAGACCAAGTGACATCCTGAATTTGTTACCAGACGTTCCTCCAC
GTCCTCGCTTCGACATTTTCGACGGCTCAAGCTCTAGGGCTTCTGATGTTTG > SEQ ID NO:2666 215074 8157_300316_1
AATTCGGCACCAGCTGCAACCATGTCGAAGCGAGGAAGAGGAGGAACCTCTGGTAACAAGTTCAGGATGTCACTGGGTC
TTCCAGTGGCAGCCACTGTGAACTGTGCTGACAACACCGGAGCTAAGAACCTTTACATCATTTCGGTTAAAGGAATCAA
GGGTCGTCTTAACCGTTTGCCATCAGCGTGTGTTGGTGATATGGTTATGGCTACTGTTAAGAAAGGTAAGCCTGATCTC
CGTA > SEQ ID NO:2667 215074 44094_300028_1
ccccccccccccgAGTTTTTGGTGGATAGAGGGAGGGCCGTGAAGATCGACACCGTCCGCAATGTCGAAGCGAGGACGA
GGAGGTTCCGCTGGGAACAAGTTCAGAATGTCGCTGGGTCTGCCGGTGGCGGCGACGGTGAACTGCGCCGATAACACAG
GTGCTAAGAACCTGTACATCATTTCAGTGAAAGGGATCAAAGGAAGGCTTAACAGGTTGCCTTCAGCTTGTGTTGGTGA
```

FIG. 2 continued

```
CATGGTTATGGCTACTGTTAAGAAAGGTAAGCCAGATCTTAGGAAGAAGGTTATGCCAGCTGTCATTGTTCGTCAGCGC
AAGCCCTGGCGCCGAAAGGACGGTGTTTTTATGTACTTCGAAGATAATGCTGGTGTGATTGTGAACCCCAAGGGTGAAA
TGAAAGGGTCTGCCATCACTGGCCCTATTGGAAAAGAATGTGCTGATCTTTGGCCTAGGATTGCAGGTGCTGCCAATGC
TATTGTGTAGGAGTAGGGTTGCTAAGTAGTTTACAGTTCTCGTTTTGTTGGGTTTTCATCAAGTTTCTGAATATCTGAG
GGCTTTGTCTTAATAAGAATTATTGCTCGGAATTTTGCAGTACTAACt

> SEQ ID NO:2668   215084 229051_301039_1
AGGCGGCGAAGGATGCTGCGGCTAAGCCCAAGTCCAAGTACTACCCAGCCGACGATGCTCCTGTGCCGCGGGCGATCCG
GCGCAAGATCCGCCCGACGAAGCTAAGGGCGAGCATCACACCTGGAACGGTTCTCATCCTTCTCGCCGGGAAGTACAAG
GGCAAGCGCGTAGTCTTCCTCAACCAGCTCCCGTCGGGATTATTGCTCGTCACTGGTCCTCGCTCGTTCAATGGCGTCC
GGCTCAAGAGGGTGAACCAGGCTTACGTGATCGCAACATCGACCAAGATCGACGTCTCTTCCGTGGACGTGGCCAAGTA
CGACGACAGCTTCTTCAAGAAGTTGAAGAAAGACGAGGAGGTGACCCCGGAGATGAAGAAGGCAAAGAAGGAAGCTCAA
GAGGCCGTGGACAAGGTCGTGATCGAGGTGATAAAGAAGGGAGAGCCGGAGCTAGCTCAGTACATCTCCGCCAGGTTCA
GCTTGAAGCGTGGAATGAAGCCTCACGAGCTAGTGTTTTAAACGAGGCCTTTTTTTCcTAATCAAAAATCAATCGTGAA
GAATAttccAcC > SEQ ID NO:2669   215084 253805_301630_1
CATTTGGAGAGGAGGCAGGAAGAAGGAAGGACGAGAGAGAGAGAGAGAGAGAGAAAGAGGGAGAGGGAGAGATGGCAAAGC
CTGAGGGAGGAGCGAAGGGGCCAAGGGCATCCCGGAACAAGTCACTGGTTCGAGGCGTGGGGCAATGCAGCAGGTCGCA
GATTGTACCACAAGAGGGGTCTATGGGCGATAAAGGCGAAGAACGGGGGCTGTCTACCGGGTCCAAACCAAGCCCAAAG
CGATGGACACCTCGGACTCCAAGGCCCGCCGCGGCAAAAACCCCAAATTCTAACCCGGCGACGACGTTGCCAAATCCTGGT
TAACAAGCGGTATATCAAGCCCAACAAACTCAGAGCTTAGCATTACCCTGGAACTGTGTTGATCCTCCTTGCTGGACAC
TTTAAGGGAAAGCGAGTTGTATTCTTGAAGCAGCTTGAGTCTGGACTACTTCTTGTGACAGGTCCGTTCAAGATTAACG
GTGTCCCCCTCAGGCGTGTGAATCAAGCATATGTGATTGCAACCTCCACAAAGCTTGATATCAGCTGCGTCAATGCTAG
CAAGATCACTGATGCGTACTTCAAGAGAGAGGTAGAGAAGAAGAAGAAGGGCGAAGCAGAGTTCTTCGAGGCTGAGAAG
GAGAAG > SEQ ID NO:2670   215084 258156_301689_1
AGCAATTCGAAATGGCGGACACCAACCCCACGACCCAGAAGTTCTCCAAGGGCGAGAGGTCGATCCCGCACCACTCGCA
GAAGGCCAGCAAGTACTACCCTGCTGAGGACGTCGCCGTCCCCAAGAAGGCCCGTAAGAGTGTTCGCCCTGCGAAGCCC
CGTGCCTCCCTCCAGCCCGGTTCCGTCGTCATCCTCCTCGCTGGTCGTTTCCGTGGCAAGCGTGTCGTTCTCCTCAAGC
ACCTTCCCCAGGGTGTTCTCCTCGTCACCGGTCCCTTCAAGGTTAACGGCGTTCCTCTGCGACGAGTCAACGCCCGCTA
TGTCATCGCTACCTCGACCACTGTCGACATCAAGGGTATCGATGAGGGTGTCCTGAAGAAGGCCTCCGAGGAGGGTTAC
TTCACCAAGGACAAGGCCGCACACAAGCCCGGAGAGGATGCTTTCTTCAAGCAGGGCGAGAAGCCCGAGAAGAAGGAGA
CCTCTAAGGACCGCGTCGAGGACCAGAAGGCCGTCGACAAggccCTTCTTGCCAACATCAAGAaggaGGCTCACCTCgt
tGACTACCTTGCCTCTAgcttcagcctccGCacctcCGACAGgccaCAccAGATGCAGTTCtaagCGTagGGTcaaGac
gggATT > SEQ ID NO:2671   215084 1170608_302038_1
TCTTTTTGAGCCAAGAGGGAGAGAGGGAGGGGGAGGGAGAAGGAAAGAAAAGCTTGACGACGGAGCTATGGCGAAGCCT
GTGGGGGGAGGAGCGAAGAAGGCGAGGGCATCCCGGAATAGGGAGGTGGTGCGGGGAGTCGGGCGGTGTAGCCGGTCCC
AGATGTACCACAAGAGGGGCTTGTGGGCCATCAAGGCCAAGAACGGTGGGTTTCTCCCTGCCCATGGTAAGACCCAGGT
CGCCCCTCAAGCCCCCTTAGCCAAGGCCCCCAAGTTCTACCCTGCCGACGATGTCAGAAAACCCCTCTGCAATAAGCGC
ATTGCTAAGCCTACTAAGCTCAGATCCAGCATTACACCCGGAACTGTTCTAATTCTCCTTGCTGGACATTTCAAGGGAA
AGAGAGTTGTCTTCCTGAAGCAACTTGAGTCTGGATTGCTTCTTGTCACTGGCCCTTTCAAGATTAATGGGGTTCCTAT
TAGGCGTGTGAATCAGGCATATGTGATTGCAACCTCGACTAAGCTCGACACAAGTTCCGTCGACACCAGCAAGTTCACC
GATGCATATTTCAAGAGGGAGGTTGAGAAAAAGAAGAAGGGCGAGGCTGAGTTCTTTGAGGCTGAGAAGGAGAAGAAGA
CCCTCCCTCCTGCAAGGAAGGAGGATCAGAAAGAGCTCGACGCTAAGCTGGTTCCAGTCATAGAGAAGATTCCAGACAT
GAAGGCATATTTGATGGCTAGATTCAGTCTCAAA > SEQ ID NO:2672   215084 183551_300623_1
CCCACGCGTCCGAAGTTCTACCCCGCCGACGAGGTCAAGCCCCGCGCCCCCAGCACCCGCAAGGCCAACCCTACCAAGC
TCAGGTCGACCATCACGCCGGGACGGTGCTGATCCTGCTCGCCGGGAGGTACATGGGGAAGCGCGTCGTGTTCCTCAA
GCAGCTCAAGTCCGGCCTGCTCCTCATCACCGGACCTTTTAAGATCAATGGAGTGCCCATCCGCCGTGTGAACCAGGCC
TACGTCATTGCCACATCCACGAAGGTTGACATCTCTGGTGTTAAGGTGGATAAGTTTGATGACAAGTACTTTGCCCGGG
ACAAGAAGGCAAAGGCCAAGAAGACCGAGGGTGAACTTTTTGAGACAGAGAAGGAGGCAACCAAGAATCTGCCCGACTT
CAAGAAGGATGACCAGAAGGCTGTGGATGCTGAGTTGATCAAGGCTATCGAGGTTGTCCCAGACCTGAAATCCTATCTT
GGTGCCCGGTTCTCTCTCAGGTACGGCGACAAGCCCCATGAGATGACATTCTAAGTTAGTCGGTACAAGTTTCAAGTTC
TGAGGAAGTCTTTTT
```

FIG. 2 continued

> SEQ ID NO:2673 215084 224010_300978_1
aCAACACCCTAAACATCAAAAATGTCCAAGCAGATCGGAGGAGCCAAGAACGGCGGTAGCCGAACCGTCCCCACTGAGA
AGGCCCCCAAGTGGTACGTCGCTGAGCCCACTCACGTCAAGATCCCCACCGTCCAGAACAAGTCCAAGCTGCGACCTTC
TCTTGTTCCCGGTGCCGTACTCATTCTCCTTGCCGGCCGATTCCGAGGCAAGCGAGTTGTTCTCCTCAAGTCTCTTGAG
GATGGCACTCTCCTTGTGACCGGTCCCTTCAAGGTCAACGGTGTCCCTCTCCGACGAGTCAACGCCCGATACGTCATTG
CCACCTCCACTAAGGTCGATGTCTCCGGTGTCAAGGCTGACAAGTTCACCCCTGCCTACTTCGCTCGATCTTCCGCCGA
CAAGAAGGCCGAGAAGCAGTTCTTCGCCGAGGGCAAGCAGAAGGAGCTCAAGGCCGAGCGAGTCGCCGACCAGAAGGAC
GTCGATGCTGCTCTCATTGCCGAGATCAAGAAGACTCCTCTTCTCAAGCAGTACCTGGCTTCCCAGTTCTCTCTCAAGT
CTGGTGACAAGCCCCACCTgctCAAGTtttaaattataaaaAcacaAAATGGAACATGGGGtggaaaatg > SEQ ID NO:2674 215084 209182_300812_1
tcctCTCCACACCCACATATCAGACACCCGAGAGAGTCAATATGTCGGCCAAGCCCACGACCAAGCAGTTCGGGAAGTC
GACCCGGGAGGTTCCCGCCTCCGCGGACCAGGCGAAGAAGTGGTACCCTGCCGACGACGAGAGCGCCCCGAAGAAGGTT
CGCAAGTCCGTCCGAACTTGGGCCCCCCGAAAGACCCTCCAGCCTGGTACCGTCCTGATCCTCCTCGGTCGGCCGCTTCC
GCGGCAAGCGTGTCGTCCTCCTCAAGACTCTTGACCAGGGTGTTCTCCTCGTCACTGGTCCCTTCAAGATCAACGGCGT
TCCCCTGCGAAGAGTCAACGCCCGATACGTCATCGCCACCTCCTACAAGGTCGACATCTCCGGCCTTGACGCCGCCAAG
ATTGAGGAGATCTCTCAGCCCAAGTACTTCACCGCCGAGAAGGCCAAGGAGAAGGCTTCCGCTGAGGCTTTCTTCAAGC
AGGGAGAGAAGCCCCAGAAGAAGGAGATCAACAGCAGCCGTGCTGCTGACCAGAAGGCCGTCGACAAGGCTCTGCTTGC
TAGCATCAAGAAGGTGGATCTGTTGGCCAGCTACCTCGCCAGCACCTTCAGCCTGCGGAAGGGTGACAAGCCTCACGAG
ATGGCGTGGTAAATTTGATTCAAACACAAAATCTCTCTGGCAGgtcgAAAGCACGGgg > SEQ ID NO:2675 215084 128551_300476_1
ccgctcaaaaactagggtttactctctcgccagagcagcttctcttctccaatggcgcccaagaaaactctccgtaacc
cAGAACTAATTCCTGGCCTGGGAAAATTCTCACGTTCTAAAATGTACCACAAGAAAGGTCTCTGGGCAATCAAAAAGAA
AAACGGCGGCACATTTCCATCCCACAGCAAAAAACCTGCCGCCGCCGCTCCGGTAATAAAACCCCCAAAGTTTTATCCC
GCCGATGACGTAGCAAAACCGCTTGTGAACAAACACAAGCCAAAACCTACAAAACTCAGAGCAAGCATTACACCTGGAA
CCGTTTTGATTATCCTAGCTGGTAAGTTTAAGGGGAAAAGAGTTGTGTTCTTGAAACAGCTTGCGTCTGGGCTTCTGCT
TGTTACTGGACCGTTTAAGCTTAATGGAGTTCCTTTAAGACGTGTGAATCAAGCTTATGTTATTGGTACCTCGACTAAG
GTTGATGTTTCGGGTGTGAATGTGGAGAAGTTTGATGATAAGTATTTTGCTAAGCAGGTTGAGAAGAAGCAGAAGAAGG
GAGAAGAGGAGTTTTTTGAAGACAAGAAAGAGGAGAAGAATGTGCTTCCACAAGTAAAGAAAGATGACCAGAAAACCgt
aGATGCAGCTTTgctCAaggccATTGATGGAGTTCcTGAATTGaaggcTTATTTGTCcGcgaggttCTCACTCAAggca
GacaTGAaACCACATGAACTtgtcTTTTagaggaaCAAacatCTacaacACTTTTTTTggataaaTtgatttt > SEQ ID NO:2676 215084 120093_300083_1
ccccccccccgaaaccttcactgctccatatatggatgcacattactaggtttaggttttattgaatcagcattctg
cAAAAGCAAAGGagaACTTCTACTTTCAGCAATGGCGGCAAAGAAGAGTCCCCGTAATCCAGAGCTGATTCGTGGAGTG
GGAAAACTTTCCCGTTCCAAGATGTATCACAAAAAGGGTCTTTGGGCAATCAAGAAGAAAAACGGCGGCTCTTTCCCCG
TCCACAAAAAAGCCGCCGCCGTCGCCACCACCGGCCGTCAAACCACCCAAAATTTACCCTGCCGATGACGTGGCAAAACC
CCTTGTCAACAAACACAAACCAAAACCAACAAAACTCAGAGCAAGTATTACACCTGGTACTGTTTTAATTATCCTTGCC
GGTAAGTTTAAGGGTAAGAGAGTTGTGTTTTTGAAACAGCTTAAATCTGGGCTTTTACTTGTTAGTGGACCATTTAAGC
TTAATGGTGTTCCTTTGAGGCGTGTGAATCAAGCTTATGTTATTGGTACTTCAACTAAAGTGGATGTTTCTGGTGTGAG
TGTTGAGAAGTTTGACGATAAGTATTTTGCAAAGCAAGCTGAGAAGAAACAGAAGAAGGGTGAGGGAGAGTTCTTTGAA
GACAAGAAAGAGGAGAAGAATGTGGTTCCTCAGGGAAAGAAGGATGACcagaAAGCTGTGGATGAAGCATTGATCaagg
CggttGAATGtttccTGAATTgaaggctTAtTtGTCTgctaggttCTCCCTCAAGTCGGGCATGaAaccccatGAGCtT
GTcTTt > SEQ ID NO:2677 215085 220703_300938_1
GCCCACGCGTCCGCGATGATAAAGTTGTGGGTAATTTAGATAGAGATGATTCGGCTGCAACGCTGAAAAGTGTTGATC
AAACTGGTAGGATTCAGTTCATTATTGTTCCTTCGCCCTTCGTGGATCGACGCTTCGCTTAACAGTGGCAGTGCTCGCG
GATGATGATCCGTCTGACGCGATCGGAGGCGGACCCAGAATGTGGATGAGGGAATCTCCACAAGGCGTAACTCCTTGG
TTTACTCTTGTTCGCACACAGATGTATCTTGAGAGTTGTTAAGGCTATAACGAGTGCGGTTGAGATACGTCTACGACTA
AGCATCTTGAGCAGAGTGTTAGTTGCGAAACGTTCAATTGACTAAGTAAGAGTAGAGAGTATCAAGCCTGCAAATCCAT
CCCCCCGAATCTCCGATTTTATGAGCCACCATAGCTCTTTTCGCCAAATGCAAATGCCGTAGATAGTGCCCATCCG > SEQ ID NO:2678 215087 220560_300956_1
GTCTTTCAGGTGCCCAGAGAAGACAGCTCGCAAACTGCGGAAGTCTTGATTGACCAGGATGGAGATTTGGATGGTTTTG
ATATGAAAGGCTTAAAAGACCAAGTTCTTGTATTCAAGTACAGAGGGAAATTCCACGCCGTTGATCATAAATGCCCTCA
TTCGTCTTACCCCCTCTCACAAGCCACTCCATTTGACATTGAGGATTTTGGCGTTGTCTTGAGTGCAGGACTGACCTGT

FIG. 2 continued

CCAAAACATGGTTGGTCGTTTGATCTGTTTACTGGCTCAGGAGACCGTGGAAACTATCAGCTTGGACTTTGGGAAACTC
AGTTGCGTGAAGTAAAGAATTCGGATACATCAGCAGACGAGGCTTCAGGTTCCGCGGAACAGGAAGTATGGGTTCGGAG
AAAACAGCGACAGCGC

> SEQ ID NO:2679 215091 220577_300956_1
GCATAGCGAGTGGCTTCGTTGGTGGTTTGAGGGCTGGAGCCCCGGTGCCCAGACAATGAGATTTGTGGAGTTTTACCCG
TGTTGGTTTTCTTTAGTGACGTATTGATGAACAGGTACAACGACTTCAGGCGATCGGCGGCGACGCTTATTTCTTGCAC
GCCCCCTTGGATGGGTCCCGCGAGAACCTTGGTAGGTTTAAAGGAGGTAGCTGTGCTCCGTAACGGGGTTGTTATTTAT
AGGCTAGTATTAAGGAGCTGAATGACGCGCTCGTGTCGAACCCAGGAAATGGAATATTCATTTTTGTGTGGTGATGGCG
ACAGAGAGTAGGGTTTGGTTACCCCGAAGAAAGCAAGATCGAGATTGAAGTGTGTATCGGCGATTTATCAGATCTAGGC
CGACTTGAGCATGTGAGATGACACGAGCTAACACCAGCATGATACAGCTGGCAGTCAATAAGAGACAAAGCTTGTTGTA
C

> SEQ ID NO:2680 215106 217379_300907_1
gcgccgacccgaGCTGTGGCCGGTGTGGCAAGCGGCCTGTCCCGGCTGGTGCCTCGTTCTCGTCCACGGCTGCCAATTG
CCTCTGTTTCTATTACAGCAAAGACGACGGCATCATCGCGATGGCACTCGGGCTTCTCGTCGGTCAaCCCCAACGAGGT
CTCACACTTCAATGCCCTCGCCGCTGagtGGTGGGAGCCGCACGGATCGTCGCGCCTACTACACCTCATGAACCCGCTG
CGCCACGACtTcATCCGCTCCTGTCGCGAGTCCTCCGACGACCTCAATTCCATCACATACCTCGaCATTGgctgcgGCG
gcGgCATCTTcgctGAGAGCGCCgccCGccTagcCACCACCAAGCACGTCACCggCATCGATCCCACACCGTCCGTCCT
CAACGTcgcaaaAGCACATgcccgcaAag > SEQ ID NO:2681 215107 158563_200019_1
CTTTGGACTGCCCCTTCCTCCCGATGCAATTTGGCTGAAAATATTGATAGTTGCCTACTTTTTTGGCTCTTTCCTCAAC
CACAATCTCTTGCTCGCCATTCATGAGCTCAGTCACAACCTCGATTTCTCCACTCCAGTCTATAACCGATGGCTTGGCA
TTTTTGCCAACCTTCCCATTGGCGTTCCCATGTCTGTTACCCTCCAAAAGTATCACCTTGAGCATCATCTCTACCAAGA
TGTAGATGGATTTGACATGGACATTCCACGCCTTGCTGAAGCACATGCCGTCAAAAACGTCATCACAAAATCTGTATGG
GTTGTCCTCCAGCTCTTCTTTTATGCTCTCAGACCTTTCTTTATCAAACCTAAACCACCCGGTATGTGGGAGTTCATCA
ATCTGATTATCCAGCTATGCTTTCATGGAGCCATGGTTTACTTTTGGGGTAGGAAATCCTTTGCATATCTGATCCTGTC
TACTTTTGGTGGGGAGGGATGCACCCGATGGCTGGTCGCTTCATTTCCGAGCATTATGTCTTCAAGTCTGACCAGGAG
GCATACTCCTATTACGGTCCCCTTAATCTTATGATGTGGAGTGTCGGATACCACATCGAGCACCATGATTTCC > SEQ ID NO:2682 215107 276101_200157_1
AAAAGGTGAGAGGTGAAAAAGAGGGAGCAGAAAATGGGGTTTGAAGGGGAAAAGAGAGAAGAGGAAGAAGGAGTAGTA
ATGGCTAATGATTTCTTTTGGTCATATACTGATGAACCTCATGCTTCTCGTAGAAGGCAAATCCTTTCTCAGTACCCTC
AAATTAAACAGCTTTTTGGCCCTGACCCTTTTGCCTTTCTCAAGATATCTGGAGTTGTTTTACTTCAGCTTTGGACTGC
TACCTTCCTTCATGATGCAAGCTGGCTGAAGATGTTGATAGTAGCGTACTTTTTCGGCTCTTTTCTAAACCACAACCTC
TTCTTGGCTATTCATGAATTAAGTCATAACCTTGCTTTCTCTACTCCAGTCTACAACCGTTGGCTTGGAATATTTGCCA
ACCTTCCTGTGGGTGTGCCAATGTCTGTCACCTTCCAAAAGTATCACCTTGAGCACCATCGCTTCCAAGGAGTTGATGG
AATCGACATGGACATCCCGAGCCTTGCTGAAGCCCATGTCGTAAAAAATGTACTTGCAAAATCTATATGG > SEQ ID NO:2683 215108 220756_300938_1
ATTTGATCTTTATTCTCTTTAATGTTCTCAGAAACCAATACGACAAAGTCAACTACATGATGAGCTCCCACAAGAAGAA
GAACGACAACAACAGCAGCAACATCCCGGAGGCACCACTGCCGCCAACATTCAAGGAGCAGCTCGACCAGGAGGCG
ATCGACAGCCGGGTTCACCAGCATGAGAGCGAAGAACACTCGACAGTGAAGGATATTGTCGATAAGATATCGCATGCCA
TTCCTGCTGTCGCCCCTCTCATCGGCGGATCAAATCCAGACAACAAGGTGGAGGAGCATAAAGAGGTGCCTCCGGGGCC
TCCTAATCGACCAGAGCATGATACCCAGATTGAAGAGTTTGTGAGGGAGCAGCATCGAAGCAACGGCATCGAGAATCTG
AGCGAGGGAAAGTCGTGATGGATTCATCCACGCTCTCGGTTCAGCAGAGTTTCTTCATGTACCAATAGCCATCAAGCTT
TTACTTTTTCTTGCTTTAATACAGTGAAACCTGCGGCTACTATGCAGGCTCTTTACAGATAATCC > SEQ ID NO:2684 215110 213175_300847_1
GGATTTGCGAAAGGGCGAGATTTTGGGTGTGACGCGGCAGACGGTGATTGGGGCGATTTGGGCAGCTCTGCCAAGGGTT
GGGTTCATGAAGATACAGTACGTGTTAGTGATGTGAAGCTGCTCCATGATGGGACTCGGAATGGCGGACGGATGCGGTC
ATGGGCTTTTGGAGATTGGCTTTTCTTGGTGGGCCGAGACGGCATCTAACTGGAGATTTGATGAAGGGGAATTCGAGCT
ATCAATACGGATATGCAGGACTGGATGATTCTGATTTGATGGCCCGAGGTGAAACTTGTCTGGAAACTTGATTCGGGGG
CAGCGAGAAAGATTGCCCAACGACCGGGTGTCTTTTCTTTCTTCCTCTCTTTGTCTAAGATGTACGAGTACGTCGGCGG
CAGGGCGAGCACAGTTAGCCAGAAGCAAGGGGATGGACTTTTTGACACAGACATACGGAGTACAGAAGAAGAAGATGCA
GGGAGCGTCATCCTCCCGCAAGATGTC

FIG. 2 continued

> SEQ ID NO:2685 215114 221072_300941_1
gaatgaaaggggaaaaaaggccagcatggcacgctcgcacccaagaacaaaaaaaggccggagcactaataggcacggc
aTGGGGGCCTCACGCCATCGATTGTGTAATAGGCGTACGACGGTTACGACAGGAACGTGCCACAAAAGGAGGGGTGGGA
AAACGGATGACGGGAACAaggAGGAAAACTGGCTCTTTAAGTTCCAACTTTGTTGCCAATAGCCAGTCGCTGCTGTCTG
TGTTTCTAGTTTCTACGGAGCATGAACCTGTGAGAACAAGCCACATCGGGGAGACGGGAAGATGGTGACACGGATGCGT
TTGTGGAGGTGGGTAAGCTTTGCGCAACATGTGCCAGCCTTATCTTGATATTGGACGCGGCGACGGCGAGATGGTTGGA
AGGGTGTGTCTATGTGTACCGACAAACGCATGGCTGATGAGACGGTGAATAAAACTGCACCAAGAAAGAGATGCATGAG
AGATGAATGACCAGTACCTAAGGTCTATGACATGTCGCTTTGCACTCGGTCGGACTCATTCACATGTAGTAAATACTAC
ATAACACCCACTTGCTCCAGTAATCATCACTTATAATAATACGGCGAGAAGACAAGTTGACACAGGGCGAAACAGGGCG
GAACAAGGGGCGAAGCGAGGTGGAAAATGGTAAACGCAGAGACTCTTTCTATGTACTAGCCATCGATCAAAAGGAAGGA
CAGCTCAGTCTTCGCTGCATGCTAAAGCAGCGGCCGATGGGATGGGGCTCCAAGGCAAggTGTAATACCGAGtACATGC
ATATcaaAaaagaaaagacgaaacgtt > SEQ ID NO:2686 215116 221183_300942_1
TTTTTCTCGCAACTCGCTGCTTGGCTCCAGTATCTGGCATTAGCACCTGTTGTGTGCGTTGGCCTGCCGTAGGTTGATG
CATCTGCAGCTGCAGCGTTTCCGCATCACATCACCTTCATCTTACATGACAAACCCCCTCTTTTTACTCCCTTCGATAC
GGTTATTGGTTCGAAGGCTTTACAATTCAGACGTGCAGGCACTAAGACATCCATCTCGACTGTTAGAGGTTGTCTTGCT
GCAGACGTTATCGTACCAGCACGGCTTATATAGCACCAGACAGACCCCTCCGCTGCAGCTGGTTTACTTCTTTTTATTA
ATCTCAACTATCACCACGGCTACCTATTCTTCACTTC > SEQ ID NO:2687 215117 221004_300941_1
ATCTTGGGATGTTCTGCAGACGATTGTCAAAGCCGGATTAACCCCGCAGGCATTGATGGCTGTCTCTCATCTCCACTTT
GCATCCTGTTGTTGGGGTAAAAGAATAAGCTCACCGTCATTGCTCAGCTTCTCGAAATCGTGAAGAATGAATCGCCGAA
AATTGATTACATGTACTCACCAGGNACATGTAGGCAGCTTCATATTTCACTCCTCCGACGTCTCGGCTAGACTTAGCCA
TGTCGATCAAGCATGAGCAAATCCCACATTGTTAGCTGTCAATCATTGTCCAGTGTCATCTCCCCACGTGGCAAAGACG
GCGTCAATCAATTTGGACAATCCCTGTGATATCTTAGACGCATCCTTGGCATCTTCTAAATGCTTAGAGTTTTGAGCTG
AAAATCGGTCATTAAAGTAACGC > SEQ ID NO:2688 215119 213184_300847_1
tgaagatttgctttgttttctaagttcaggggGTGCAATTGAGTCTTCTAAAGCGTGCTGGTGCAACATTCAAGCTGAC
GTTGGATAAACCTTCAACCGTAACTCTTGTACCTCTCAAGACATCAGAATCAGATGGATGGATTGATGAACTGACC
TGCATCTGCCCCACTCAACAATTTAATCCAGTCGAGCTTCTACAACGCCAATCTCAAAGCTCACAACTCTGTATTCACTC
ATCTTGACCAATTCTCTTTCAGTTTGACCTCAATCACTCTTTCCCTCATGAAGACCGACGACGCAGTGTCACAAACCAA
AAAAATAAAAAAA > SEQ ID NO:2689 215120 1044153_301886_1
GGTGGCATTGAGACATCCAACGAGGAGCATAGGCATGGCTAGACCTAGAATAGCTCTGCTGGCCCGACTTGCCCACAAT
GCCCAACCTGGCCTTCTCTGCTTTTCTCTCCTTCTTCATCTTCATCAATTGGGAGAGCCATGTCAACCATAGCCCAACC
CAAGACCATCACTTGCCGAGCTGCTGTTGCTTATGAAGCTAATGCACCATTGAAAATTGAGAAGGTTGAGGTTGCACCT
CCCAAAGCCCATGAGGTGCGGATCAAGATTACCCACACAGCCTTATGCCACACAGACTTGTACACTTTGAGTGGAAAGG
ATGCAGAAGGGCGTTTTCCTTGCATTCTTGGCCATGAAGCTGCCGGAATAGTTGAAAGTGTTGGAGAAGGTGTTACGGA
ATTGCAGCCGGGTGATAAGGTTATTCCATGCTACATAGCAGAATGCAGAGAATGCAGGTTCTGCAAATCTGGGAAAACT
AATTTATGTGGGAA > SEQ ID NO:2690 215120 226483_301034_1
ACACATCATGTCTACCGAAGGAAAGACCATCACTTGCAAGGCCGCCGTTGCCTGGGAGGCCGGCAAGCCCCTGACCCTT
GAAGACGTCGAGGTTGCTCCTCCCCAGGCCCACGAGGTTCGAGTCAAGGTCACCTACACTGGTGTCTGCCACACCGACG
CCTACACTCTCAGTGGCTCTGATCCCGAGGGAATCTTCCCCTCTGTTCTGGGCCACGAGGGTGCCGGTATCGTCGAGTC
TATCGGCGAGGGCGTCACCAGCGTCAAGCCCGGAGACTCCGTCATTCTGCTCTACACTGCCGAGTGCAAGGAGTGCAAG
TTCTGCAAGTCCGGCAAGACCAACCTGTGCCAGAAGGTGCGAGCCACCCAGGGTAAGGGTGTTCTGCCAGACGGAACCA
CCCGGTTCAAGTGCAAGGGCAAGGATCTCTATTCGTATATGGGCTGCTCTTCCTTCTCCCAGTACACTGTGGTTGCTGA
CGTCTCCCTCGTCGCCGTCGACCCCTCTGCTCCCAGGACCGAACCTGTCTGCTCGGCTGCGGTGTCACCACCGGCTAC
GGAGCTGCCACCGTCACCGCCAATGTCCAGAAGGGCGAC

FIG. 2 continued

> SEQ ID NO:2691 215120 221105_300942_1
GTCTGACTAACACAATGGCTTCGACTGTTGGCAAGACCATCACCTGCAAGGCTGCCGTTGCCTGGGAGGCCGGCAAGGA
GCTGAGCATTGAGGATGTCGAAGTTGCTCCTCCCAAGGCTCACGAGGTTCGCGTGCAGATCTACTACACCGGTGTCTGC
CACACTGATGCCTACACCCTCTCTGGCAAGGACCCGGAGGGTGCTTTCCCCGTCATCTTGGGACACGAGGGAGCTGGTA
TTGTCGAGTCTGTTGGCGAGGGCGTCACCAACGTGAAGCCCGGCGACCACGTCGTTGCTCTCTACACTCCCGAGTGTAA
AGAGTGCAAGTTCTGCAAGTCTGGCAAGACAAACCTCTGCGGCAAGATCCGAGCCACTCAGGGCCAGGGTGTCATGCCT
GATGGCACCAGCCGATTCAAGTGCAAGGGCAAGGACCTTCTCCACTTCATGGGAACATCGACTTTCTCTCAGTACACTG
TCCTCGCCGACATCTCCGTTGTAGCTGTCCAGCCCGATGCCCCCATGGACCGCACTTGTCTCCTTGGATGTGGTATCAC
CACCGGCTACGGCGCTGCCCGCATCACCGCCAAGTTGAGGAGGGTTCCAATATTGCCGTTTTTGGAGCTGGATGCGTT
GGCTTGTCAGTCGTTCAGGGAGCTGTCGTCAACAAGGCCGGTAAGATTATCGT

> SEQ ID NO:2692 215120 202228_300782_1
caacgaactgcgagtgattcaagaaaaaagaaaaCCTGAGCTTTCGATCTCTTCGGAGTGGTTTCTTGTTCTTTGAAAA
AGAGGGGGATTAATGGCGACAGCCGGGAAGGTGATCAAGTGCAAAGCGGCGGTGGCATGGGAGGCCGGGAAGCCGCTGT
CGATCGAGGAGGTGGAGGTTGCGCCGCCGCAGGCCATGGAGGTCCGCGTCAAGATCCTCTACACCGCCCTCTGCCACAC
CGACGTCTACTTCTGGGAGGCCAAGGGGCAAACACCTGTTTTCCCTAGGATCTTGGGCCATGAAGCTGGAGGCATTGTG
GAGAGTGTGGGAGAGGGTGTGACCGAACTCGCGCCGGGCGACCATGTCCTCCCGGTGTTCACCGGCGAGTGCAAGGAGT
GTGATCACTGCAAATCGGAGGAGAGCAACATGTGTGACCTCCTCAGGATCAACGTCGACCGCGGCGTCATGATCGGCGA
CGGCAAGTCCCGATTCACCATCAAGGGGAAGCCCATCTTCCACTTTGTTGGCACATCACCCTTCAGCGAGTACACCGTC
ATCCATGTCGGCTGCCTCGCGAAGATCAACCCGGAGGCGCCTCTCGACaagTCTGCAttCTCagcTGCGGTTTCTCTA
CCGGTTTTggTGCaaCAGTGAATGTCGCGAaaccgAAAAgggccagACcgtGGCtAttttcggTCTtggagctgttgg
tCTTGCTGCTATggaaggtgc > SEQ ID NO:2693 215120 190564_300693_1
CACACTGCTGCAGTGCTGCTTAAGCTCGCCATCCAGCCGCAATGGAAGATCAGAGCCTGAAGCCCATCCGTTGCAAAGG
TACACAATTCACTTACAGAGATCAGATCTGCATAGCTCCTTGGTACTACTACTACTACTACTCAATTCCTCACGCATGA
TATATGATTGATACATATCGACGACGACGATGCAGCGGCGGTCTGTAGAGCGGCCAGTGAGCCACTGATCGTCGAGGAG
ATCGTCGTCGATCCTCCGAAAGCCTACGAGATCCGCATCAAGATCATCTGCACCTCCCTGTGCCACACCGATGTCACCC
TCTGGCACAAGGTAGACCCTGCCTTTCCAAGAATCTTGGGCCACGAGGCCTACGGGGTGGTGGAGAGCGTGGGGGAGAA
CGTGGAGGGGCTCGCGGCGGGGGACACGGTGGTGCCGACGTTCATGGGGCAGTGCGACTCGTGCGCCAGCTGCGCGGCG
GAGTGGACGAACCAGTGCACCGCCGTGCCGTTCACCATGGGCCCCGGGATGCGGCGCGACGGCACAACCAGGTTCTGGG
ACGGCGAAGGGAAGCCGCTCAGCGACACGGTGGCCGTCACCAGCTTCAGCCAGTACACCGTCGTCGACGTCAACCAGGT
CG > SEQ ID NO:2694 215120 144478_200135_1
GAAGAAACCTTCCTATAAGAAAAGCCCGAAAACTAGACCACAACAGCGACATGGCTACCAATGGCATTTCTCATGTAAAT
GGTTCGCTTGGAAAAGTTATCACTTGCAGAGCTGCTGTAGCCTACGGTCCAGGGCAACCTTTGGTCGTAGAACAAGTGC
AGGTGGATCCACCTCAGAAAATGGAGGTCCGAATTAAGATCCTCTTTACTTCCATATGTCACACAGATCTCAGTGCTTG
GAAAGGCGAGAACGAAGCTCAACGAGCTTACCCTCGAATTCTAGGACATGAAGCCTCAGGAGTGGTGGAGAGCGTGGGA
GAAGGGGTGAAAGATATGAAAGCAGGAGATCGCGTAGTACCAATATTCAATGGAGAATGTGGAGACTGCATTTACTGCA
ACTCTACAAAGAAAAACAACTTGTGCGGCAAATTCAGGGTGGATGCGTTCAAAAGCGTGATGGTCAACGACGGCAAATG
CAGGTTCAGGAGTAAAGATGGCAACCCCATCTATCATTTCCTCAACACTTCCACATTTAGCGACTACACTGTTGTCGAC
TCTGCTTGCTTAGTCAAGATTGACCCCAATGCCCCACTTGACAAGATGACCTTGCTT > SEQ ID NO:2695 215120 119829_300360_1
CCTGATAGTCAGTTCATTAAAATTACTACTCTAGAAAAAAAGAATAAGTTACTGTAGCAGACGGATAAAAAGATACCAG
ATACCAACAACAATGTCAACCAATACTGCTGGTCAGGTCATTCGTTGCAAAGCTGCGATTGCGTGGGAAGCCGGCAAGC
CATTGGTGATAGAAGAAGTGGAGGTGGCACCACCACAAAAAAGTGAAGTTCGCCTCAAGATTCTTTTCACCTCCTTGTG
CCATACTGATGTTTACTTCTGGGAAGCTAAGGGGCAAACACCACTATTTCCTCGTATTTTCGGACATGAAGCTGGAGGA
ATTGTGGAGAGTGTAGGCGAAGGTGTTACAGATCTCCAACCAGGAGACCATGTTCTTCCTGTGTTCACTGGTGAATGCC
AGCAGTGTCGACACTGTAAATCAGAGGAAAGCAACATGTGTGACCTCCTTAGAATAAACACAGACAGGGGAGTTATGAT
CCATGATGGTCAGACAAGATTCTCCAAAGATGGCAAGCCAATATATCACTTTGTTGGAACTTCCACCTTT > SEQ ID NO:2696 215120 12507_300252_1
CCCACGCGTCCGGTCTTCCTGCGTTACTGGCGACTCAGGGACAGGTTATCACTTGCTAAGATGCGGGGCTTACTAGCC
AAACAAGCCTCTGTTCATCGAAAATGTGCAAGTGGCTCCACCTCAAGCTGGTGAGGCTCGGATCAAGATCCTCTACACT
GCTCTTTGTCACACCGACGCTTACACTTGGAGCGGGAAGGATCCTGAAGGGATCTTTCCTTGTATTCTAGGTCATGAGG

FIG. 2 continued

> SEQ ID NO:2697 215120 235829_301230_1
GGGCTTCGCGAAGAGCAATCTCTTCTAGTTCTAGAAACAAGATCATCAAATGCAAGCTGCTGTTGCATGGGAACCTGGA
GCACCTCTCCAGATCGAAGACATCGAGGTCTCCCCGCCTAGATCCAACGAAGTCCGGGTCAAAATCACTCACACTTCGC
TGTGTCAATCGGACATCACTTTCTGGCAGGATAAGCGAATGAATTTTTTGTTCCCCCGAATTTTCGGTCACGAAGCAGC
CGGGGTCGTGGAAAGCGTGGGAGACGGCGTTGAAGGCATTCACGAAGGAGACCACGTCGTGCCACTCTTCACCGGCGAG
TGTGGCAGTTGCAAGTATTGCATTTCCCACAGGACCAACCTGTGTGGACCTTTACGAGTGAATCCCGAGTACACGGGCG
TATATGGTGGAGAAGGGACGCGATTCAAAAAAGCCGACGTTGATATCTCGCACTTCATGGGCACTTCGACCTTCAGCCA
GTACACTGTTGTCAACAAAGGTCGTGTTGCAAAGATCCCGAAGGAAGCTCCACTGGACCAAGTTTGCTTGCTAAGCTGC
GGTATCACGACT

> SEQ ID NO:2698 215120 241167_301320_1
GGCGTCAACAGCTGGCAAAACGATACAATGCAAAGCTGCTGTTCTTCATAGTCTTGGATCTGATTACATCTTTGCGACG
ATCAATGTGGAGCCGCCACAGTCTGGGGAAGTTCGCATTAAAATCCTCTATGCTTCGATATGTCACACGGACATGTCCT
TTCCCGAGTATCTCCCCAACTTTCCACAAATCGTTGGACACGAAGGATCTGGAGTGGTGGAAAGCGTAGGAGAGGGGT
GACCGAATTTGTTCCTGGTGATTCCGTCATCTGCGTCTATCAAGGAGAATGTGGCAAGTGCAAGCTGTGCAACCTCTCC
AAAACAAACTTTTGCGAGTTCAGCATCGCGAGCTTGCTGAAGCCTGTCATGGCCTCCGACGGAAAGACGCGCTTCTCTC
TGCTCGATGGGACTCCGGTGTCCCACTTTGGAAACTCCTCCACATTCTCCGAGTACACCGTCGTGGCCGCCACTTCCGT
CGTAAAAATGGATACTATTCCTCTCGACCTTGCTCCGCTACTCAGCTGCGGAGTTCCCACTGGCTTGGGATCGTCACTA
AACATAGCAAACGTCGAAGCCGGTTCCACAGTGGCTGTCATCGGACTCGGAac

> SEQ ID NO:2699 215120 237465_301287_1
GGCAGCAGCAGGCTTTCTCTCTCCCGGAGCTGGGGATCCAGATTCATGGCGTCTGGCGACCGCGGGCAAGGTCATTACGT
GCAAGGCCGCTGTGGCCTATGAGGCCGGGAAGGCGCTCGCTATCGAGGATGTGGAAGTAGCTCCTCCACAGGCAAATGA
AGTACGCATCAAGATCACACACACTGCTCTCTGTCACACCGATCACTACACACTCAGTGGACAGGATCCAGAGGGACTT
TTTCCATGCATTCTCGGTCATGAAGCTGCCGGGATTGTGGAGAGCGTTGGAGATGGAGTGACCGACGTGAAACCCGGAG
ATCACGTCATTCCCTGCTACCAGGCCGAATGCAAAGAATGCAAGTTCTGCAAGTCCGGGAAGACGAACCTGTGCATCAA
AGTTCGTCCGGCGACCGGGAAAGGCGTCATGCTCTCGGATGGAAAGCCGAGGTTCAGCGTCAACGGGAAGCCGATCTAC
CATTTCATGGGAACTTCGACTTTCAGCCAGTACACGGTCGTGCATGACGTCTCCGTTGCCAAGATCAGTCGAAGCCC
CGCTAGACAAGGTCTGCTTGCTAGGATGTGGTATTCCTACAGGTCTTGGTGCCGTTTTTAACACTGCTAAAGTCGAGCC
AGGATCGACAGTCGGGAT

> SEQ ID NO:2700 215120 3848_300324_1
GCTGCTGTGGCATGGGGAGCTGGAGAGCCTCTAGTAATGGAAGATGTAAAAGTGGATCCTCCTCAAAGATTGGAAGTGA
GAATTCGAATCCTCTTCACTTCCATCTGTCACACTGATCTCAGCGCATGGAAAGGCGAGAACGAGGCTCAGCGAGCATA
CCCTCTAATCCTTGGCCATGAGGCAGCAAGGATAGTGGAGAGCGTATGGGAAGGTGTGGAAGAGATGATGGCAGGAGAT
CATGTGCTCCCTATTTTCACAGGAGAGTGTGGAGACT

> SEQ ID NO:2701 215120 3961_300330_1
CCCACGCGTCCGCACACACCAAACAAAACAAAACAAAAAACAGAGAGATGGAAAACGGAAACTCCTCCAGCGACAACAA
ATCTTCACATAAACCGATCCGATGCAAAGCGGCGGTTAGTAGGAAGGCTGGAGAGCCGTTGGTGATGGAAGAAATCATG
GTGGCGCCGCCGCAGCCTTTCGAGGTTCGGATTCGAATCATCTGCACCGCGTTATGTCACAGTGACGTCACTTTCTGGA
AACTCCAAGTTCCTCCAGCCTGCTTTCGAGGATACTAGGCCACGAGGCAATAGGCGTAGTGGAAAGTGTTGGTGAAAA
TGTGAAGGAAGTGGTAGAAGGAGACACCGTACTACCAACGTTCATGCCTG

> SEQ ID NO:2702 215120 274355_200056_1
aagggaagaagaaagtggggaaagaaaataataatttaagtgggctggcttttgacatggaaaagaacggcttagtaat
aATTGAAGTTAGAATCGCATCTATTTGAAGTGCCACTCATCCCTCAGAAAAACACTGTTAGTATTTTCACTCACAAATT
CATTCTGTGGTCCGAATTGGAGTTCATAGATCATCGCTACACAAGGTCAAGTCATCACCTGCAAAGCTGCGGTGGCCTG
GGAACCCAACAAGCCTCTGGTGATCGAGGATGTACAGGTAGCTCCACCACAGGCCGGTGAAGTCCGTGTTAAAGTTCTC
TATACTGCTCTCTGCCACACTGATGCTTATACCTGGAGTGGCAAGGATCCTGAAGGTCTCTTCCCATGTGTGCTTGGTC
ATGAGGCTGCAGGGATTGTAGAAAGTGTCGGTGAAGGAGTGACTGAGGTTCAGCCAGGAGACCATGTCATACCTTGTTA
CCAGGCTGAATGCAGAGAATGCAAGTTCTGCAAATCAGGAAAGACCAACCTTTGTGGTAAAGTAAGGGCGGCTACTGGG
GTAGGAGTTATGATGAATGACCGCCAGAGTAGATTTTCTATCAATGGAAAGCCAATCTATCATTTCATGGGAACTTCAA
CCTTCAGTCAGTACACTGTTGTCCATGATGTTAGTGTTGCAAAGATTGACCCAGTAGCTCCTCTGGAGAAAgtcTGCCT
TCTTGGATgtggtgttCCAACCGgccTTGGAGCTGTTTGGAACACtgcaAAAGTTGAACcaggtTCCATgttgctgtc
TTtggccTggg

FIG. 2 continued

> SEQ ID NO:2703 215120 255811_301645_1
GGAACTACTCCAGCTATGGCTTCCACTCAGGGCCAAGTCATCACTTGTAAAGCGGCGGTCGCATGGGAGGCGAAGAAAC
CTCTCGTGGTAGAGGAGGTTCAGGTGGCCCCTCCTGCCCAAGGAGAAGTCAGGATCAAGATTTTGTACACTGCATTATG
TCATACCGATGCCTATACGCTCGACGGACTGGATTCCGAAGGCCTTTTCCCCTGCATTCTCGGCCATGAGGCCGCAGGG
ATTGTTGAGAGCGTGGGGGAGGGAGTGACAGAACTGCAACCAGGTGATCACGTGATCCCTTGCTATCAAGCAGAGTGTA
GGGAGTGCAAGTTTTGCTTGTCGGGGAAGACAAACCTTTGCGGCAAGGTGAGGGTTGCAACAGGGGTTGGGGTAATGCT
GAGCGACCGCCAGAGCCGGTTCTCTTGCAAGGGGAAGCCCTTATATCACTTCATGGGACGTCGACTTTTAGCCAATAC
ACAGTAGTCCACGATGTCAGTGTCGCCAAGATCAAGCCCGAAGCTCCCCTAGAGAAGGTTTGACTCCTCGGATGCGGCA
TTCCCACAGGTTTGGGG

> SEQ ID NO:2704 215124 221193_300942_1
GAACAAAGACACGCTGCCAGCATTGGGCAAAACAGCTTCAACGAGGGCAATTGCTGGGAGGAAAACGGCGTCAATTGGC
AGCAGGAGAG

> SEQ ID NO:2705 215138 219938_300950_1
gcGAGACAACAACAATCATGGCCGCTATCCGCTCCTCGATGCGAGTCCTCAGCTCCTCTACTAGGGCAGCTTTCCGTCC
CAGTGCCGTCTTCTCGCGGTCCATGGCATCGGTCAGCGAGACTACTGAGCAGCAGCCCAAGATCAAGTCGTTCCAGATC
TACCGATGGAATCCCGATACCCCGACCGAGAAGCCCAAGCTTCAGACCTACTCCATTGACCTCAACAAGACGGGCCCCA
TGATCCTGGATGCCCTGATCAAGATCAAGAACGAGCAGGACCCGTCCTTGACCTTCCGAAGGAGTTGCCGAGAGGGCAT
CTGCGGCAGCTGTGCCATGAACATCAACGGCCAGAACACCCTGGCTTGCTTGTGCCGAATCCCCGCCGAGTCCTCGTCC
GATGTCAAGATCTACCCCGTCGCCGCACACCTACGTCGTCAAGGACCTGGTACCTGACTTGACGCACTTTTACAAGCAAT
ACAAGTCCATTGAGCCCTACCTGCAGCGCGACACCCCTGCTGAAGATGGCAAGGAGTACCGCCAGAGCAAGGCGGACCG
AAAGAAGCTGGACGGTCTCTACGAGTGCATTCTGTGCGCCTGCTGCTCAACCTCGTGCCCCTCTTACTGGTGGAATTCC
GAAGAGTACCTCGGTCCCGCCATCCTGCTGCAGTCCTACCGATGGCTGATTGACTCCCGAGACGAGCGCACGGAGGCCC
GCAAGTCCAAGCTCGAGAACTCCATGAGCCTGTACCGTTGCCACACCATCCTCAACTGCACACGCGCCTGCCCCAAGGG
CCTGAACCCCGGCAaggccATTgccGAGATCaAGAAGCAGATGTCTCTTGGGGCATAAggggCagggttggaattgtta
caat > SEQ ID NO:2706 215138 231946_301235_1
ATCGAGATGTTCCGGGCAGCTGGAGCGATCGCGACGCGCGCCAGGTCCGGCGCCGCGGCAGCCGCTAGCACTGTAAGTA
TCAGGGCAAGCGCCACGGCCGTGGATTCCGCCAAGGAATCCTCCAAGCCAGCTCCAAACGTCAAGGAATTCTCGATCTA
CCGCTGGGATCCCGACTCGAGCGGCCACCCCAAGCAGCAGATCTACAAGCTCGACCTAAACGAATGCGGTCCGATGGTG
CTGGATGCGCTCATCAAGATCAAGAACGAGGTCGACCAGGGTGTAACTTTTCGACGATCTTGCCGCGAGGGGATCTGTG
GTTCTTGCGCCATGAACATCAACGGCGAGGAATGGCCTGGCTTGCCTGACCAAGATCGACAAGGAGGCATCGGTCACGTC
CATTCTTCCACTTCCACACATGTACGTGATCAAGGACCTGGTGGTGGATCTGACCAACTTCTATCAGCAATACAAGAGC
GTGCAGCCGTGGCTCAAGAGCAAGACTGTGCTGGAAGCCGGGCAGAAGGAACACTTGCAGAGCAAGAAGGATCGGCTGA
AGCTGGATGGGATGTATGAGTGTATACTCTGTGCTTGCTGCAGCTCGTCGTGCCCGAGCTACTGGTGGAATCCGGAGAA
GTTCCTGGGGCCTGCGGCACTGCTTCATGCTCACAGGTGGATTgctGATAGCCGGGACGAgtAcAcGCAGgagaggctg
gATgcca > SEQ ID NO:2707 215138 55754_300141_1
TTTGATCGGAAGATTGGTTGGAACGAAACCGTCGAAATTAGCCACGGCGGCGAGGTTAATTCCGGCGAGATGGACCTCT
ACAGGAGCGGAGGCGGAAACAAAAGCTTCCTCTGGCGGCGGAAGAGGATCGAACTTGAAGACTTTTCAGATCTATCGAT
GGAATCCAGATAATCCAGGGAAGCCAGAGCTTCAAAATTACCAGATCGATCTCAAAGATTGTGGTCCAATGGTATTAGA
TGCTTTGATTAAGATCAAAAACGAAATGGATCCATCTCTTACTTTCCGTAGATCATGCCGTGAAGGGATCTGTGGTTCA
TGTGCTATGAACATTGATGGATGTAACGGACTTGCTTGTTTGACAAAGATTCAAGATGAAGCATCGGAGACGACGATTA
CACC > SEQ ID NO:2708 215138 274792_200059_1
TAAGATCGATTCGTGTGCTGAATCGACGATTACGCCGTTGCCACATATGTTTGTGATTAAGGATCTGGTTGTGGATATG
ACTAATTTTTATAATCAGTACAAGTCTATCGAACCTTGGTTGAAGAGGAAGACGGAGCCGCCGACCTCTGGGAAGGAGA
TACCGCAGAGTAAGAGTGATCGGGCAAAGTTGGATGGGATGTATGAGTGTATTCTTTGTGCTTGCTGTAGCACATCATG
CCCTAGTTACTGGTGGAATCCTGAGTCTTATCTTGGTCCGGCTGCACTGCTTCACGCTAACCGATGGATTATGGATAGC
CGTGATGAATATACTCAGGAGCGCCTGGACGCAGTTAATGATGAATTCAAGCTTTATCGCTGCCATACTATTCTGAACT
GTTCTCGTGCTTGCCCAAAGGGATTGAATCCTGGGAAGCATATTCAGAATATCAAGCGTCTGGAGCTTGCATCTTGAGC
CAGCAGTGATGTCGTTCCAATCTCTTTTGCTAAGATTTGATTTTTAAGGAG

FIG. 2 continued

> SEQ ID NO:2709 215138 253891_301630_1
GGGCAGATCAATCCGGTCAATCTCTTCGACAAATGCTGTAGCAATACCTGAGCAACAAACATCCTTGGCCTCTACCGAG
AAGTCGCCCAATCTGAAGAAATTCTCAATCTACAGGTGGGACCCTGACAGTAACTCAAAGCCGGCAATGCACACCTACA
CCATCGACACGAATGAGTGTGGCCCGATGGTACTTGATGCGCTAATCAAGATCAAGAACGAGATGGACTCAAACTCTCA
CTTTCCGTCGATCATGCCGGGAGGGGATATGCGGGTCCTGTGCCATGAATATCAATGGATGCAATGGGTTGGCATGCCT
CACAAAGATTGACCCGAGCCCCGGGAAGGAGGCCACTGTTGCTCCTCTCCCCCACATGTATGTCGTCAAGGACCTTGTT
GTTGACATGACCAACTTCTACAATCAGTATAAGAGTATAGAGCCCTGGCTGAAGAGAAAGAGCCCCCCAGAAGCAGCGG
GGAAAGAGCATTTCCAGAGCAAGAAAAGACCGTGAAAAGCTTGATGGGATGTATGAATGCATTCTTTGTGCTTGCTGTAG
TACCCTCTTGCCCAAGTTACTGGTGGAACCCGGAGAAATATTTGGGTCCCGCAACCTTGCTTCATGCACACAGGTGGATA
GCTGATAGTCGCGACGAGTACACGAATGAACGC

> SEQ ID NO:2710 215139 213212_300923_1
gcaatgcttgagccaaaatattgcctaggggaggaaaccacaagagatagacctcggcaatttgttagcgATCCATGGA
TTGATTCCATGACTAGCTAAaCgAGGCTAgaTGACATGAGGCAGCGTGAGAGAGATGGATGGGACGAGATCTGGTGGGT
TTGGTTTGGGAGGCGGTTTGGAGGTTTGGGGATCATACAGTaGTACTAGTACTACAAGTGCTGATGATGCATAGATAAT
GTACTTGAGGGGCGATGAGATGCGATGCGATGCCACGCGGTGCACGCGTATGTCATCCATCAGCGGTGATGCCCTCTCA
GACGAGTACGGAGTCGGTACCAGACAGCAATCAAAATTGGCGGGTGTTGGCTCTGCTCTGGTTtaaccactgccCCggc
atGTAcaactcct > SEQ ID NO:2711 215150 1097047_301436_1
GTGGAGTGTGCGTCGCAGGTTCGAACATCCAACCTTCCACGGACCTGCCGCCATGGTGCTCTCTAATGATATTGATCTT
CTACACCCTCCAGCTGAGCTGGAAAAGAAAAAGCATAAGCTAAAACGTCTCGTGCAGTCCCCAAACTCATTTTTCATGG
ATGTGAAATGTCAGGGGTGCTTTAACATAACGACTGTATTTAGCCACTCACAGACAGTGGTGGTTTGTGGTAACTGCTC
TACTGTTTTATGTCAACCTACTGGTGGTAAGGCTCGCCTGACAGAAGGATGCTCTTTCAGGAGAAAGAGCGAGTAGACT
GGGCATTGCTTGCCTCCTACCATTGCAAGATTTAATTGCACGGGTATTTAATGTTTTTGTTGAGGAGCATAGAGGATAA
CGAAGTATGTTGAGTCGGTCATTTTGAGTGTTGTTTCCTGTCATCATTACTAGACACTGTTGAATCATCGGCATAGAAT
CTTGGCACTATGATTTTGGAAAAATGCATAGAATTTTAGAAACATGATATTGGAGACATTTGATTGTTAGCACTTTTGA
AGAATATTAAATCATATGATAGACATTTta > SEQ ID NO:2712 215150 1099251_301550_1
GGCCTCCAGCCATGGTGCTCTCAAATGACATTGACCTTCTGCACCCTCCAGCCGAGCTGGAGAAAAAGAAGCACAAGCT
AAAACGTCTTGTGCAGTCTCCAAACTCTTACTTCATGGATGTGAAATGCCAGGGATGCTTCAACATAACGACTGTGTAT
AGCCACTCACAGACTGTGGTGGTCTGTGGGAGCTGCTCCTCTGTCTTGTGTCAGCCTACCGGCGGAAAGGCTCGCCTGA
TGGAAGGATGCTCTTTCCGAAGAAAGGGTGATTAATTTGATAGACCATCTTTACCCCTCACCCCCGTAAGCATATTGCT
AGAGATTGGTGGTGGTATTACATCTGCTGATTGTTCCCGAGGTTTGTGGGTCTGTAGCGGTAGGATTAGGTAGATGAAT
TAGCATGGAATCCTGACAAACAGTTTTGGCAACATTCAAATTAATTGAAAAACATTACTTCA > SEQ ID NO:2713 215150 154830_200016_1
CAGCAGCCTCGGAGGTTAAATAGCTTTTGCCGCTTTTCCAGGTCGCGAAAATGACTCTCTCAAATGATGTCGACTTGTTG
AACCCTCCTGCCGATCTGGAGAAGAGGAAACAAACTCAAGCGTCTTGTTCAATCTCCTAACTCTTTCTTTATGGATG
TTAAGTGCCAGGGTTGCTTTAACATAACAACTGTGTTCAGTCACTCGCAAACTGTGGTGGTGTGCGGGAACTGCCAGAC
TGTGTTGTGCCAGCCGACTGGTGGCCGTGCTAGACTCACCGAGGGTTGTTCTTTCAGGAGAAAGGGAGACTAAAGATGA
GAGAGAGACTACTTGCTTTTCTTTTAGAGTGGAAGTGAAAAGGTTTTATATGGGAAACAAAAATTCAGTTTTGATGCAA
TCCTGTTTGTTTTTATTTAATCTCTAGTCTTGAGTAAGAAAGAACCAAGGGTTTTGAATCTGTTGAGGATGCTTTGTTT
TTTTACTAAATTGGATTTTGAGTAAAAATATCTGTTGAATTTTCGCTTATAGTTTGCTTCTCCCCTGAAATTCCCTCTT
CAATTTGTTTGCcttTTTGCGTGCtgttaggGAaggtcAAAATTTGAAATTtggtttGATCtt > SEQ ID NO:2714 215150 195740_300637_1
ctccagcttgcgagcctctcaaatcgttgccagatttcgtcaAGACCCTCGACCTCGCAAGACACTTTACGGCAAATTT
TTTTCGAGACAATCAGACAAGATGGTGCTCGCTGTTGACCTTCTCAACCCTTCAGCGGCCTCTGAGGCCAAGAAGCACA
AGCTCAAGACCCTTGTTCCTCAGCCCCGATCCTTCTTCATGGACGTCAAGTGCCCCGGCTGCTTCACCATCACCACCGT
CTTCTCTCACGCCCAGACCGTTGTCATCTGCCAGGGATGCACCACCGTGCTGTGCCAGCCTACCGGCGGTAAGGCCAGA
TTAACCGAGGGCTGCTCTTTCCGAAGAAAGTAAACTGCCCGCGGGGCGGCTTTCTTTCCTTGGGTACTGATGACTCTTA
TGGTTATATGGTGGTGATCATCTCGGATCTGCAAACAAAACATCATCGACGTGGGGGATAGACATTATACCTTGCGAAA
ATAATCAATCTCTTTTGCAGATAGAAGATGGAACACCCAACACAGGGGCGTTTGGGGGTCTCCGGATATCTTGCATGGC
ACATCATTCTTCTCGTTTTTCCGTTTACGCGCCTTGTACCACAGAGTCGTTTCTTGAGGCAGGAACAAAAAAATAAAG
CACTGCATGGGTGTTCAGCTGGAGAAAGCATTCACTTGAGTGTCTAGATGGATCTTTGATGGACTGACTAGGCGCGATG
ACGTGGAGCCGCTGATTTGAGGATCGCTTCATACCCGGAGTGCAGTGGGTAGTGGAGGATAGCAGTGTGCTTTTGCGAA
ATTCAAAGGTTTCCACT

FIG. 2 continued

> SEQ ID NO:2715 215150 138580_300774_1
AGCCCTAGCCCCCCTCCCCCCCGCGCCGCCACCACCTCGCTCTCCGCCGCCGCCGCCGCCGTCTCCAACTTCAAGATGG
TGCTCTCGAACGACATCGACCTGCTTAACCCGCCGGCGGAGCTGGAGAAGCTCAAGCACAAGAAGAAGCGCCTCGTCCA
GTCCCCCAACTCCTTCTTCATGGATGTCAAGTGCCAGGGCTGCTTCAACATAACGACTGTATTCAGCCACTCCCAGACC
GTGGTTGTGTGCCCGGGCTGCCAGACCGTGCTCTGCCAGCCTACTGGTGGGAAGGCCAGGCTCACGGAGGGCTGCTCCT
TCCGCCGGAAGAGCGACTAGGTTAGGCTGTGTGGCTTGTTGTTACTGGGACAGAAATGCCCTGCTGAACAATACTATCC
CGTTACCCTTCCTGATGTGTACTCCATAAATTTTGTTAATTATGCCTACCTGTTTACTGCCCTGCATGATGTAGCAATG
CGTTATGTATCTTGCATTTTGTGCTGGAGAAAGCTACTTCGTATAATGCGTGCCCCTCCACCTTGTTCT

> SEQ ID NO:2716 215150 226660_301035_1
GAAACGAACGAATTAAAGCAAAATGGTTCTTACTCAAGATCTTCTCAACCCTTCTCCTCAGTCTGAGGCCCGAAAGCAC
AAGCTCAAGACTCTTGTCCCCCAGCCTCGATCCTTCTTCATGGACGTCAAGTGCCCCGGTTGCATCAACATCACTACTG
TCTTTTCTCACGCTCAGACCGTTGTGACCTGCGGCTCTTGCTCCACTGTCCTTTGCCAGCCCACCGGCGGTAAGGCCCG
ACTCACTGAGGGCTGCTCTTTCCGACGAAAGTAAATGCAGATCCTTTAGGAGCATCTAAAATATTAAAAGAGGGGGTGG
ACTGAAATACATACGAAAATTTGAAATCTCGATTTGATTAAAAGAAAGAATAAAACAAT

> SEQ ID NO:2717 215150 128865_300478_1
cccacgcgtccgcatcttcgctGCTTGTGGCGCAACACACAGCCTCCCCTCACTCTCATTTCAATTCATCTTGCGAAAA
TGGTTCTTTCAAATGATTACGATTTGTTGAACCCGCCAGCAGATGTTGAAAAGAGGAAGCATAAGCTCAAACGTCTTGT
TCAGTCTCCTAACTCTTTCTTCATGGATGTTAAGTGCCAAGGCTGCTTTAACATAACAACTGTGTTCAGCCATTCTCAG
ACAGTGGTTGTTTGCGGAAACTGCCAGACAGTTTTGTGCCAACCTACTGGTGGTCGTGCTAGACTTACCGAGGGATGTT
CTTTCAGGAGAAAGGGAGATTAGAGAGATAGCATTCAATTTACATTGAAATGAATCTTCATATGGGAATTTTGATGCAG
TACTCTATTTTAATTTTCACTATCTAGTCTTAATTAAGAACAAGTGTTTTTGAGTCTACTATGACTTGATTATGTTATG
GTTCTAATTTGAGTTATCCCTTTTGAAATTGGATTGTTACTACAATgttATCTCTGTggaggttCCCTGAAAGtagntt
tctattcttttatt > SEQ ID NO:2718 215150 1099584_301509_1
tTTCTTTTCCTCTTTCTCAATACTCTCATCGATCTCATCTCACTGCGCCTGCAACCATGGTTCTATCAAATGACATTGA
TCTACTGCACCCCCCAGCTTCTCTGGAGAAAAAGAAGCATAAATTGAAACGTCTGGTGCAATCTCCGAATTCATTCTTC
ATGGATGTCAAATGCCAGGGCTGCTTCAACATTACCACTGTGTTCAGTCATTCACAAACTGTGGTTGTATGTGGAAATT
GTTCGACTGTCCTATGCCAACCTACAGGAGGAAAAGCTAGACTAACTGAAGGCTCTTCTTTCAGAAGAAAGGGCGATTA
AGCTAAATTTCCAACGGTTCATATGATCTCTCTTTTAGCTCTGCTCGAAAAGAAACATTGATATGTTTTCAATTTCAAG
GCTTTTGTGATTTCGGTAAAATTTGTCAATCAGTTTTGGGTATATGTATGAGGCAGCTTAATGAAAATGCTTAATTAGT
GTTCAAGGGC > SEQ ID NO:2719 215150 1097255_301438_1
gtagaatTTAATTATTACGTGAAGTTTTCCTGTTTAATACTAATATTTAATAAAATATCATGCCTCTCGCTAAGGATTT
ATTGCACCCGCTTGCGGCGGAAGAAAAACGGAAACATAAGCTAAAACGTCTCGTTCAACATCCTAATTCATACTTTATG
GATGTGAAATGTCCCGGCTGCTATAAGATCACTACTGTCTTTAGTCACGCTCAATCGGAAGTTGTCTGTCCTGGATGTT
TCACAATTTTATGTATGCCCACAGGCGGTAAAGCCAGATTAACAGAAGGATGTTCTTTTCGAAGAAAACAACACTAATT
TTATGTTCCCTTCTGTAAAAAATTTTTTTAATGTTAAATTAAATAATAAAATTTAATTTCGTTTTAAG > SEQ ID NO:2720 215150 232731_301217_1
gGGCTGCGTCTCGAGCGGATCGAGGAGGCGAAAATGGTGCTCGCGAACGATATCGATCTGTTGCATCCGCCGGCGGAGT
TGGAGAAGAGGAAGCACAAATTGAAGCGTCTCGTGCCCACCCCCAATTCTTTCTTCATGGACGTCAAATGCCAAGGATG
TTTCAACATCACGACCGTGTTCAGCCACTCGCAGACGGTGGTTCTGTGCAGCAATTGCCAAAACGTTCTGTGCCAACCG
ACGGGGGGAAAGGCCCGCCTCACAGAAGGCTGCTCCTTCCGGAAGAAGAGCGACTCAATAACACGAGTTTTCCTTTGAA
GGTACACAAGCAACAAAAAAACACTAAGAAAAAAAAGAAAAGAACGCGGGGAGGGGTTTTgTAGCCTTTTGTAGCTGGTG
ATGGTTTCTATAATCTTCTTCTCTACTAGTAAGATGGTGGGAGGCTCGAGTGCTCTCTAGGGGATCCAACACGGATT
TCCCAGTCACACCGAAGCATCTCATCTATGTAATCCTCTCTTTTCTCAATCGTAATCAAATGCTCTAAAATTtGT > SEQ ID NO:2721 215163 213216_300851_1
CAGATGGTGGCGCTCAaccaTCCCACTCTTGTTCGCAAGCTTATTCTAGCTGGAACTGGGCCTAGTGCCGGTGAAGGTA
TTGAAGGTGGTGATCCGGTCATTTTTGGGCGTCTTGCTTCAGCTTCAAACGATGCAGAAGAAAAGAGCGGCTTTTTGGA
GGGCTTTTACTCCCTGACTGCCAAgaagCAATCTCAAGGCGGGAACTGGTGGAAGCGTATGACAACGGCTCGCCAGAAT
AGGTCTGATTACCTTGGACCTGAAGGCACCAAGGCTCAGATCGACGCAGTTCTTCGCTGGTCGAACCCTGAATATGTCT

FIG. 2 continued

CTGAGGGCTCATACAACCGTCTGAGCGAGATCAAGATCCCCGTCCTCGTGGCCAACGGCGACAATGACATCATTATCCC
CACAGTCAACAGCTGGGTCATGTTCAAGAGACTGACCAACGCTGATGCCCATCTCCACTTATACCCGGATGTGGGACAT
GGGTTCTTGAACGAGTATGCAGGCCAGTTCTCTGGCCTTGTCAACCAGTTCCTAGACGCTTAAGTGGGAATCAggcgtt
CTTTAaaGGCGCGAGTCTATCTATTTATGGGTTGTGTGGTTTCTATTGGGTCTGGGTtATATATAGGCTTCGTAACTAA
ATTTACT > SEQ ID NO:2722  215194  213320_300924_1
ttcAGAGAATCATTTCTATAGTATTCGTCTCTTGCTTTTGGTTCCCAAAAGAGCCATCGAATCCACCCTGGTTGATGATT
GTATATCCTCGATATCCAAGAGTGAATATTTTTGGTCCTCTCGAACCATCCGGAAGGATGGCGGTAGAAGCCTCGTGCA
TCTGCTGTATAGAGAGTTGTTTTTTCTCTTGATGATCTCGACCCCGTCAATGGTCTGCCTTCGGGCGCATTGGCGGGGT
GGATGTCGATGGACGTCTGACAGGCTTTTTTTTCATTACATTTCTGAGGCTTGCCTTGGATGTGAAGAAGAGTGGAAT
TCACATTCCAATTTTTTCTTTCTTTTCTCCTACGCCGCTGTGTTGGAAAATGTTGCCTCGTCCACAAAGAGTTTCGATA
CAGGCCTTGGCGATGCTTCTTCATCCAATGGCGTGTCCCTGGCCAGCATTCCCTCGCTTTTTGATCCATAGAACCTAT
AGAACTAGGTGAATCGCAAGAAGATCAAGCCGATGATCCAATGAATGCGACGGTGAGGAAATCGCCCGGCTCTCTGGCT
AATTtgtgATGCTCTAAATATTCATCGTAATACGCGATGcgaggcCATCTCTGGTATGta > SEQ ID NO:2723  215208  211629_300901_2
tttcctccacagtctagacgaatccttccgcttttcgcattggatacctattaaaagtctccgtttcccccccatcaatt
gagaGCCTCTCTCTTCATCTCGCCAAAACGATATTTATTCCgccGTctgtgtatTCTTGCCCGCATCTCTCACAACACC
GGCGTATCCTGTCGTGTCGTGTACCAcctggnttttatcatatcgTATTgCCTTCATACTACTTACTTAATTCCCGCCA
ACTTTCATCGTTCGCCATGCCGATTCGAAATCCGTTTACTCGCCGCCCcgGCACTCTCATCACAGTCGAGGACAATGTC
TACACCGACCAAGAGCGCATTTCTCCCGGCttTgagCGagTCGACACTGTTGGATCCAAGGCgtCGTCGGCTCTCagcA
TCCGCAGCGCCAGAAGTCAGGATACCGGCGAGtataagaTGAgtGTcGTCAATGATAGcggcgtatatctccCTCCCtc
aCCGTCGGAGGAGAAGGGCCACTGGCCGCGCAGATACCTTTCGTCGCGAGAATCGTCAGACAGCTCTGGCGAGATTGAG
CAATTTTCTATTTCTCGAGAGTCGTTTGACTCGTACCGACGCTCATTTGATATCTCGGCACGATCCCCATTTCTGCGT
ACGACGTTCCCGCTCGCATGAGTCTCGACTCAGCTCGATTCGCTCGAATGCCTAGGTCGGCAATCAACCGTAACATAGA
GCAACTGCCCACCGCTGAGGAGAACTTTGAGGACGTCGGACTCGAGGACCAGAAGCAGCCGCCCCGCAAACGAGGTTTC
TTTTCCAAACTGACAGAGACCCAAGAGAAGGACTCCACTGCTCAGACAGGAGTCTCGAGATTCCTCATGCCCGGTCGGA
AGAGGGCTCAAAGCGGCCAAGGGGCCGAGTTAGCGGCAATGGACCAGCCGACGGTGACTTCATCAAACTGAGAAATGCC
TGCCACGGGAAGCAACGACGACAACGACTCTGCAACTTGAAATAATTTATCGTACATACCTTTTCAAAAGTGTATCAGG
CGCCCATGTTTTTTTTTCTGGACTATGGATATGttTTATTTCtgcaacgACGGCGtttgggACGGCGT > SEQ ID NO:2724  215244  213781_300860_1
gcatcatcaaagcgaacaagctcagttgATGCCTCGAGACAGCGGCAGAAACCGACAACCACGAACCCCAAACTCGAAT
TCGAGCGCAAACCAGAGCACAGGAAGAGGGCAAATGTCGAACCCAAACAACTGGCAGGAGGAGGCGATGCGGCGTCTGC
GCCAGATGCAGACGCGGGGCGGGTATCCCGGACGAGGAGGACCGCAGATGCCCAGAGGAGCAAACGGCGCCTTGATTGG
AGGAATCTTGCTGGCGGGCGGCGCTTGGTTGCTGTCGAACTCGCTGTTCAACGTGGACGGTGGTCACCGAGCGATCAAG
TACCAGCGATTAAGAGGCGTGAGCAAGGAGATTTACAGCGAAGGAACACACATCAACATTCCTTGGTTCGAGACACCCA
TCATCTACGATGTACGAGCGAAGCCGCGCAATGTTGCTTCGCTGACTGGCACCAAAGACTTGCAGATGGTCAACATCAC
CTGCCGTGTTCTGTCAAGACCGAATGTCGAAGCTCTGCCTCAGATTTACCGAACACTTGGAACCGACTACGATGAGCGA
GTGCTgCCATCAATTGTGAACGAGGTCCTGAAGAGCGTAgtCGCTCAATTCAATGCCAGTcagctCATTACACAGCGAG
AGATGGTTgccCGATTAGTACGGGagaATCTgtctcgtcgagcTGCGCGattcaatatcctgatcgATgatGTGTCTct
gacgcATctt > SEQ ID NO:2725  215244  253339_301625_1
ACAACCCCAACTGGAAAAAATTCAGCAACCAGCTCAACCAGCTGCAGCGACAGGCCCAGAAGGGTGCCGGAGGTGCCGG
AGGCCCCAAGTTTGTCGGCGTCGGAGGCCTGGTCGTTCTGGCAATTGCTGCCGCCACCATCAACTCGTCTCTTTTCAAC
GTGGATGGTGGTTCTCGAGCCATCATGTACAACCGAATCGGCGGTATCTCTCCCCGAATTTACCCCGAGGGAACCCACA
TTGCCATTCCCTGGTTCCAGAGCCCCATCATCTACGACGTGCGAGCCAAGCCTCGAAATGTGGCTTCTCTGACCGGTAC
CAAGGATTTGCAGATGGTCAACATCACCTGCCGAGTGCTGTCTCGACCCAGCATCTCGGCTCTGCCTACTATCTACCAG
ACCCTTGGCAAGGACTACGACGAGCGAGTTCTGCCCTCTCTGGTCAACGAGGTGCTCAAGTCTGTGGTGGCCCAATTCA
ACGCCTCCCAGCTGATCACCCAGCGAGAGCGAGTCTCCCGGTTGGTCAAGGAGCAACTCATCAAGCGAGCCTCCAAGTT
CAACATCCTGCTGGATGACGTGTCACTCACATACATGACCTTCTCGCCCGA > SEQ ID NO:2726  215249  218439_300933_2
GGCAGCTTCTCTCACAATCACCACTCTCTTACACATACATCTATCAACTCCTTGTTGTAAAACCACCACCACATTCAAA
ATGAAGTTCTTCGCCGTCGCCGCTCTCTTCGTCGCCAGCGCCATGGCCGGCCCAATGGGCAGCGAAGGATGCCCAGGTG
GTCTTACTGGCACCGTTCCGCTCTGCTGTGCCACCAACGTCCTCGGCCTCGCGACCCTCGATTGCAGCACCCCCACTGT
TCCTGTACCCAATGTCGGCATCTTCCAGGCCCACTGTGCTTCCAAGGGCAAACAGCCTGTCTGCTGCACTGTTCCCGTT

FIG. 2 continued

```
GCCGGCCAGGGCCTTCTTTGCAACAAGCCCACTGGAGCTCAGTAGAGTGCCTGTTGTACTTGGATGGTGAACCCCGTCC
ACGGCATCACGGGGTTCACAACACCGACATCGAGGGGCTCGCAAATAGGAGGAGTTGAATGGCAATGGATGGGTATGGA
TGAAAATGGATGGACATAGGTGGAACTGGATGGATACAGTTGGGCAATGGATCATGGTGGAGGACTTAATGGTATATTT
GCGAGCGGGATAAGGGTTGTATGTAGAGTCACTCATTAAATCACAGCTATCACTGGc

> SEQ ID NO:2727   215258 1108626_301519_1
GAATTGCTTTTCCCTGTCCGATTCCGTTTCCGGCTTTGAAGAAGGAAGCAATAATCTATTTAGGGTTCTTCCGTCCAAC
TCAAAACCCTAACCCTAACCCTAGTTTTGAAGCTCAGTGCAGGTCAGCCATGGCGACCTTTGCGGAGGCTCCG
GTCGGGAACGCCAAGTCCGGCGAGAAGATCTTCAAGACGAAGTGCGCCCACTGCCACGCCGTTGAGAAATCCGCTGGTC
AAAAACATGGTCCCAATTTGAATGGGCTGTTTAGTCAGTCGTGGACTCCAGCTGGGTACTCCTACTCTGTATCAAACAA
AAACAAAGCTGTTGTGTGGGGAGAGGATACACTCTATGAGTACCTTCTCGATCCACAGAAGTATATTCCTGTCACAAAG
ATGGTTTTCCCAGGCTTGAAAAAACCTCAAGAGCGCACAGATCTCATTGCATACTTGAAAGAATCTACGAATTAATGAG
GCGATTTTTGATTGCCTTCAGAATAATTAATTAATTGAGCTTATTTTAGGGTTAGGCAAGCTGCATTTTTGGACCCAAC
AAATAATTTGCTTAATCGGGTTTTCCTTAATTCCTATTTAATTCACTTGGGTTACTCTTAAT

> SEQ ID NO:2728   215258 223706_300975_1
TTCTACAACACAAAAACTACAATGGGTTACAAGGAAGGTTCCGCTAAGAAGGGTGCTACTCTCTTCAAGACTCGATGCG
CTCAGTGCCACACCACCGAGGCCGGAGGACCCCACAAGGTCGGCCCCAACCTCCATGGTGTCATCAACCGACACTCCGG
AGAGGCCGAGGGCTACTCTTACTCCGATGCCAACAAGCGAAAGGGTATTGAGTGGACCACCGAGCATCTGTTTGAGTAC
CTCGAGAACCCCAAGAAGTACATTCCCGGTACCAAGATGGCTTTCGGAGGTCTCAAGAAGCCCAAGGACCGAAACGATC
TGATCACCTGGATGGTCGAGAACTGCTAAGCGTCTACAACTGGACCCTTAGCCTGTATATATCAATTGATTATTTAAAG
ATT

> SEQ ID NO:2729   215258 160087_200028_1
gtccggccgctttcttctccttttcttccttttttatttccttgtacgccacagaaaacctataagcttTCTCCTTCTT
CTTGCTTTCCACTTTCAGAAAAATCAGAAAAAAGCCCCAAATTCAAACCCAAATTCAAAAAATGGCATCTTTCGCAGAGG
CACCACCGGGGAACGAAGCAACAGGGGCAAAGATCTTCAAGACCAAGTGTGCTCAATGCCATACTGTTGAACAAGGTGC
TGGTCATAAACAAGGACCTAATTTGAATGGACTTTTTGGAAGGCAGTCTGGAACCACTGCTGGTTACTCCTACTCTGCT
GCCAATAAGAATATGGCTGTGATGTGGGAAGAAAAGACTTTGTATGATTATTTGCTCAACCCCAAGAAGTACATACCTG
GAACAAAGATGGTTTTCCCTGGTTTGAAGAAGCCACAGGAGCGTGCAGACCTCATTGCCTACCTGAAATCTGCTACTGC
GTAAGGAATTACCGACAGATATTTTCTATTTTGTAGTCTGATAGGCATGTTTTGCTGTGCGCAGGAAGATAAACCATTG
ATTTTTTTAAAGTAATAAGTTGACCTCTTTTGGTCTTGACTCATTTGTTTCCAGAGCACTGGTATACGAAATTTTTTGT
TACCTTCTGAAGAAGAGGTGAAAAACACTTGGCAAACAATGCCAATTTTAACATCTCTCTTATGA > SEQ ID NO:2730   215258 205932_300803_1
cccacgcgtccgctgaaaattttttgtattccaaagtagttaaccggtccaggtttctctttggacttttttcgactctta
cATCTTTCATTTCTTCCTAAGAACTCTTTAATACCCCATACTTCAAAATGGCTGGCGGTCAGTGTTAAGAAGGGTGCCAA
CCTCTTCAAGACCCGTTGCGCTCAGTGCCACACCGTCGAGGCCAACGGCGGCAACAAGATCGGCCCTGCTCTGCACGGC
CTCTTCGGCCGCAAGACCGGCTCCGTCGACGGCTACGCCTACACCGACGCCAACAAGCAGGCCGGCATCACCTGGGACG
ACAAGACCCTCTTCGCCTACCTTGAGAACCCCAAGAAGTACATTCCCGGCACCAAGATGGCCTTTGGTGGCCTGAAGAA
GGACAAGGATCGCAACGACCTCATTGCCTACCTCAAGGAGTCTACCGCTTAAGCGATGAATGAAGAAAAAGAATTGTAA
TGACAGAGATATCAATAGACGGGGTGCGGCGATTGTACTACTATAGATAAAGTTAGAATAGTCGAAGCACCATCACTGT
GCTTGTACCATTAATATCCAACTCCGCTTTTTCAGCG > SEQ ID NO:2731   215258 182015_300598_1
GAATTCACAAACCCTAGAAAAGTTGAGAAGGTTGTTCCTTCTTATTCTTCCTCTCAAAATCTCTATAAGTTTTCTGTAA
AAAGAAGTTTGAAATGGCAACTTTCGAAGAAGCTCCACCTGGTGATGCTAAGGCTGGGGAAAAGATCTTCAAGACTAAG
TGCGCTCAGTGCCATACTGTTGAGAAAGGATCTGGTCACAAACAAGGGCCTAACCTGAATGGTCTGTTCGGAAGGCAGT
CTGGAACAACTGCTGGTTACTCTTACTCAGCTGCTAACAAGAACAAGGCTGTGAACTGGGAAGAGAATACACTTTACGA
TTACTTGCTTAACCCCAAAAAGTACATTCCTGGAACAAAGATGGTTTTCCCAGGGCTGAAGAAGCCTAAGGAGCGAGCC
GACCTCATTGCTTACCTGAAGGAATCAACTGCCTAATCCTTTTACTGCCCCTTGGAATTCATTTTGGACGACTTTTGA
GGTGTGACATGATCGGATAGCAACAAATTTTTTCTTAAATAAACCCTTATTTTAGGTTTTTATTGCTGTTTCTTTTCAA
TCAGAATAGGGAGTAGGGATATTGCTCTCTTTTGAAAAGCAAAAACACCATTTTGGGGAac > SEQ ID NO:2732   215258 249707_301595_1
GCCTTACATTCCACCTTTCGACTTTACACGTCAATCCCCCCCTCCATCATCCAAAATGGGTTTCGAAGCCGGTGACGC
TAAGAAGGGTGCCAACCTTTTCAAGACCCGATCGCTCAGTGCCATACCCTGAAGGAGGGTGAGGGCAACAAGATTGGC
CCTATGCTCCACGGCCTCTTCGGCCGTAAGACCGGTCAGGTCGACGGTTACTCCTACACCGATGCCAACAAGCAGAAGG
GCATCACCTGGGACGAGAACACCCTGTTCGAGTACCTCGAGAACCCCAAGAAGTACATTCCTGGTACCAAGATGGCCTT
```

FIG. 2 continued

CGGTGGTCTCAAGAAGCCCAAGGACCGCAACGACTTGATCCAGTTTCTCAAGGAGGAGACCAAATAAGCGGTTCATTGT
CATTTTAACGCTTTGCAACTCCGAACCCGCCATGACCCTTCTATAATCCCGTTTCCAAAATTTCCTCCGTTTGTACAAC
AACGATAGACGCATGACCGAGGCGAGAGAGGCGCCTACGGGCGGCACCGTCTTGTGTAGACTTTGTTTGGTGTATCATG
ATATGGCGCTTTTTCGAGTTTTGGTGTCAGCAT

> SEQ ID NO:2733 215258 56654_300127_1
CAAGGCCGGTGAGAAGATCTTCAGGACCAAGTGTGCTCAGTGTCACACCGTCGAAGCAGGCGCCGGTCACAAACAAGGA
CCCAATCTAAACGGTCTATTTGGAAGACAATCTGGTACAACTGCTGGTTACTCTTACTCTGCTGCTAACAAGAACAAAG
CTGTGGAATGGGAAGAGAAGGCCTTGTACGATTACTTGCTCAACCCCAAGAAGTACATACCAGGTACCAAGATGGTGTT
CCCTGGGCTAAAGAAGCCGCAAGACCGTGCTGATCTCATC

> SEQ ID NO:2734 215258 251953_301662_1
GAGTGGTCGTGAGCTTTGCGGCGTCGATCTGCGATTTCCAGGGTAAAGTGGAATGGCGACTTTTGGCGATGCCCCGGCT
GGGAACGTGAAGAGCGGCGAGAAAATCTTCAAGACGAAGTGCGCGCAGTGCCATGTCGTGGAGGCAGGAGCTGGGCACA
GGCAAGGCCCCAATCTCCATGGTTTGCTTGGAAGGGTGTCTGGAACCTGCGAGGGGTATAGCTACTCGACTGCGAACAA
GAACAAGGCTGTTCATTGGAGCGAGGAGACGCTCTACGAGTACCTCCTGAATCCCAAGAAGTACATCCCTGGAACCAAG
ATGGTCTTCCCCGGCCTGAAGAAGCCGCAGGACCGAGCGGATCTCATCGCCTTCCTGaaGCAGAACTCTTGACACGCGA
AACGttTCTACtgcggcgCGGGGATTCAtggGGgagg > SEQ ID NO:2735 215259 217355_300907_1
gcaacaagcaacaacaaaacacATCAACTTACAACCCAACACAATCTCTTCAATTACATCCCACTTATATACTACCTTT
AAAGAAAACATCCAATCAAAATGACCAAAGTCCTCATCCTTGGCGCTACTGGTTATGTCGGCAAGAGACTAGCTGAGAC
TCTAGTTCGAAGCGGCCAGCACCAGGTATACGGCATTGCTCGAACTGAGGCCAAGGCCAAAACATTGGCTCTCGCAGAG
GTCACGCCCATCATCTGCGCTGATCCAGTAAATGAACCTAAATCCTATATGAAGGCTGTCCGCGACTACCACATCGATG
TTATTGTCGACATTGCTGGCGCCAATCAAGAGTCGGCCAAGTTCCTCAGCCATGCCAAGGAGATCAGCCAAGAGCGACT
GAACAGCTATGCCGCTTCTGGCATTAAGGGCCCTAAGCTTGGATTCATCTATTGTTCGGGCACTTGGGTTCATGGATCT
AGTGATAAAGCAGTCAACGATCTCAACATCGCTGGGCCCAGCGGTGTCACCCCTCCAagagCTCTTGtaGCGTGGAGAg
ttggcctcGAGAattccatCttggCatcttcCGATGTCttgg > SEQ ID NO:2736 215270 219840_300949_2
GCATCTGCAACATGCAACATGTGCCTGCTGCGCTCGATAGAGCCGACGAACCGGAATATTTGCCATTCAGGCAAACAAA
GATAGCTTCCCCACGCGTTAAGAGATTGCAGCCGCGCTACCAGGCCCTCCCAAAGCTTGCAAGCACTCCGTAGAGACCC
GTAAACGGAGATGGCACCTCCCGCTCCGTGAGCGATTTCGGGGAGGGGGAGGGGGACCAAAGATCATGGGGGAGGCTTT
TATTCTATCGACTCTCGGGAAGCATCTGCTCTCATCATCCCATTATCGGCAGCAAAGCAGCCAAGAGCCCCCACCAGAC
GGCCAGAAACTCGGGGTCAGCCCTGGCAACCTGGCTCGATTTCTGTCCTTGTGTGGGCGTGGGCGCGTGGGCGAAGATG
TTTTGAGTGATGGATGAGAATTAGGAAGAGACCANGGAGAGCAACCAATAAGAATCTGACGATAAGCAGCCCTGCTGTG
TGGCGGCTAGTGTGAGCCTTTTGGGCACATGTTTGGAGATTCTTGCGCGCCCTTGTACTTGTACTCCGTAGTTTTGAAT
GGACTCGGGTACAGTACGGAGCTGATGTCGTGATGTTTCTAAATTAGATAGGAGACGGGCAGACTAAAAA > SEQ ID NO:2737 215283 210826_300893_1
ccCACGCGTCCGCGCAATTATATTATGCTTGACAAGTTGAAACTGACCAAATAACAAAATACAACAACACCATGGCTAC
CACCAACGGCCCATCCAAATTCATCCCAGAACAGCTCTTCCACACTGTTCTCACCATAATCGACTACTCCCACGACGCC
TCCGGCGCCAACCGCACGCTATTCGTCCTCAAAACCCACGGCACCCTCGCCGCTGCAAAGAAATACGCCAGCCACGCCC
TAGAAGCCGTCAACTTCACAGCCGAAGACTTTGAAGTCTATCGCATCCGCGCCGACGAAGACCCAGCCAAACCCTGGAC
CCACGGCGACGGCGTGCTGGTTTTCGCTCGCTCCTTTGATGGGCAGGAGTTTCTCGTGGGAATCGACACTACTCCGAAC
AATGAGGCTTTGACCGCGACCTCGGATGGAGAGATGGTGCTGCCCGAGGGCGCAAAGTTCTTGCACTACCTTTTGCAGA
TTACGGTGGACTACAACGCCGACCGTAGCGGCAGCTCGCAGACCACGGAAATTGAAGGGACGTATGTCCATCGTGCGGA
TGCTTGGACGGCTGCGCATGTCTCTCTCGATCCAACTGAGTATGCAGAGTTTGATCGTCGTGGCGACGCACAATTTGTT
GAAGAATGGCCCTTTGGCGAAGACGTTGCAGTTCATGCCGTTTCTGAGACTGGACAAAACTACTTTATTGCGGTGAAAA
GGCCCCCCGAGCAGAAGCACGAGGTAAAGCATCACTCGCTGAAAAAATAGTTTTCATGTCTATTGCATTCGGTTCGTGG
AAGTAAGGACCtcgtctGTCGT > SEQ ID NO:2738 215283 217191_300905_1
CGCAATTATATTATGCTGGATGAGTTGAAACTGACCAAATAACAAAATACAACAAATCCATGGGCTATCAGCAAACGCT
CCATCCAAATTCATCCCAGAATAGTTCTTACACACTGTGCTCACCATAATCGAGTACTCCCATAAAGCCTCCGGAGCCA
ACCGTACGCTATTCGTCCTCAAAACCCACGGAACCCTCGCCGCTGCAAAGAAATACGCCAGTCATGCCCTACAAACCGT
CAACTTCACAGACGAAGACTTTGAAGTCTATCGCATCCGCACCGACGAAGAACCAGCCAAACCCTGAACCCATGGCGAC
GGAGTGCTGGTTTTCGCTCGCTCCTTTGATGGGCAGGAATTTCTCGTGGAAATCGACAGTACTCCGAACAATGATGCTT
TGA

FIG. 2 continued

> SEQ ID NO:2739 215296 219264_300929_1
ctcgtattcgcggtGACCCCAAGTTCCACGATCCGCAGTCGCTGGTCGGTTTATTGGCCGTCTCAGTCCTTCTTGGCAA
ACACGTTGCATCGTCTCATCATCTCACTCCTCGTAGCACAACATGTCTGAAGTTGTGGTGCGTGATGCGCGCTACTCAG
AGTTACCCGAAATTGCTCGCGTGATGGCAAAAGCATTCTGGGAAGATAATTTGTTTGGCCAGCTCATTCACCCTCATCG
AAATCAGTATCCGGATGATGTGCACCTGTACTGGCTGAGGCGGGCTCGTGTCAACTTCTGGGACTGTCGCTGGCGATGG
CTGGTCGCTGTTGATAAAGATGAGACTGGTCGTGAGGTTATCACCGGTATTGCGCAATGGGCAagaTTGGGCGATGGTG
GTAaGAGGTTGGACCGCTCGTACTTGGATCCTCGGAATTTGCTGAAGCCTCTGTCTTCTATTGCCATGACAATTCATGC
CTGGTTGTGgccaagTCGTGCAAgTGa > SEQ ID NO:2740 215303 206846_300826_1
GAAAAAGGATTAATCGCAACTCCGAGATCCTGCTGAATCACAATGAGACCTACTCAGGTTCGTCTGGGCGGCGGCGCCC
CTCAACCCAAGACTGGCCACTGGCTCGGTGACTGGGGCTCCTTTGGTGGTGCCAAGCAGAAGGGCATTATCGACTACGG
CCTGTCTGCCAACCGTCAGAACCCCTTTGCCGGTGCTGCCCACGATGCCATCTTCAACACCTTCCGCCGCACCAAGTCC
CAGATCTTCTACTGGCTCCCTCCTATGCTGGCTGGCTACTACCTGCTGAGCTGGGCCACCGAGCGAAACCACTACCTCA
ACTCCAAGGCTGGCCGTGCTGAGTTTGCCGACTCGGAGTAAAATGGTGCACGAATATGTTGAATTATGGGTGTCCAGGG
GACACAGTGTATATCAGCGTCTAGATTAGGAGAAAACAATAGAAACGTTTGACTCTAAAAAAAAAacaaaa > SEQ ID NO:2741 215303 212163_300874_1
GGATTAATCGCAACTCCGAGATCCTGCTGAATCACAATGAGACCTACTCAGGTTCGTCTGGGCGGCGGCGCCCCTCAAC
CCAAGACTGGCCACTGGCTCGGTGACTGGGGCTCCTTTGGTGAGTGTGCTCTACTTGACGAACGATTGCATCAGACCAC
CCGCGAAAGAGACTTTGAGGACGCAAGGAACCGGATGGTGGAGGGAAGATGAGGACGATTCAATGGGCCGATATCTTGA
TTCAGCTGGAGCAATTGAGGCGGAAGACATTGAACACGCTACGGAGCAACAATTGGATCAGGAATTGCGTCGAAGGACC
CGTCGGGACGAACTACAAAGATTGAAGGAGTCACTCGCATGCTAACATATGATGCTATAGGTGGTGCCAAGCAGAAGGG
CATTATCGACTACGGCCTGTCTGCCAACCGTCAGAACCCCTTTGCCGGTGCTGCCCACGATGCCATCTTCAACACCTTC
CGCCGCACCAAGTCCCAGATCTTCTACTGGCTCCCTCCTATGCTGGCTGGCTACTACCTGCTGAGCTGGGCCACCGAGC
GAAACCACTACCTCAACTCCAaggctGgccgtgCTGAgtttgccgaCTCGgagtaaAATGgtGcacGAATATG > SEQ ID NO:2742 215303 215383_300880_1
GAAAAAGGATTAATCGCAACTCCGAGaTcgtggtGAATCACAATGAGACCTACTCAGGTTCGTCTGGGCGGCGGCGCCC
CTCAACCCAAGACTGGCCACTGGCTCGGTGACTGGGGCTCCTTTGAAGGGCATTATCGACTACGGCCTGTCTGCCAACC
GTCAGAACCCCTTTGCCGGTGCTGCCCACGATGCCATCTTCAACACCTTCCGCCGCACCAAGTCCCAGATCTTCTACTG
GCTCCCTCCTATGCTGGCTGGCTACTACCTGCTGAGCTGGGCCACCGAGCGAAACCACTACCTCAACTCCAAGGCTGGC
CGTGCTGAGTTTGCCGACTCGGAGTAAAATGGTGCACGAATATGTTGAATTATGGGTGTCCAGGGGACACAGTGTATAT
CAGCGTCTAGATTAGGAGAAAACAATAGAAACGTTTGACTTTAAAAaaAAAaaataa > SEQ ID NO:2743 215309 205937_300803_1
gtcgggccttcaaagtcatacctTAAAGACAAAAGACATCGCGTGCGTTGCCAACCACCTTCTTTTACGCAACCCTACA
AACAACGGCATCTCGCCCGCGCATCTAGTCGCCTCGCTCCTTCGGCCTCCTCCAGCAACAACCTCCTCGCGGTATTCTG
GAAATACTAAGACGCTCGCTCACTCCTTTGGATATACAACCTAGACAGCATCTTTTATACAAATCGCCAACATGAAGTT
CTCCACCGCCTCCATCTTCCTCGCCGCCCTCGGCGCCTCTGCTCACCCCAGCGGCCACGCTCACAAGCGCGCCCACGAC
TCTCTCGAGGCCCGCAGCGACTTTGTCATTGCCAACAAGCCTGTTGAGCCCAGCCCTCCCGTCGCGACTCCCACTCCCA
CTCCTTCGCCTGCTGTTCCTACTCCTTcg > SEQ ID NO:2744 215325 104575_300370_1
cacgcccttaACCCCCGCCGCCGGAGGCTAATCCAGGAGGAACAATGGCATTCATCAAAGTCCAGAAGACTAGGGCTT
ATTTTAAGCGTTTCCAGGTCAAATTCAAGAGAAGGAGAGAGGGGAAGACTGACTACAGAGCAAGGAATCGCCTGATTAA
TCAGGACAAAAACAAGTACAACACTCCAAAATATCGTTTCGTTGTCCGATTTACTAACAGGGACATAATCGCCCAAATT
GTGTCTGCTAGCATAGCTGGTGATATGATTCTTGCTTCTGCATATGCTCATGAGCTACCTCAGTATCGGCCTCAAAGCTG
GACTGACAAATTATGCTGCTGCTTACTGTACTGGACTTCTCTTGGCAAGACGAGTTCTCAAGAAACTTGAAATGGATGA
GGAGTATCAAGGGAACCCTGAGGCTACTGGAGAGGATTACTCAGTTGAACCCGCTGAAAGCAGGAGGCCGTTCCGTGCA
CTTTTGGATGTGGGCCTTGTTAGAACTACTACTGGAAATCGTGTTTTGGTGCTCTAAAGGGTGCATTGGATGGTGGAC
TTGATATTCCTCATAGCGAAAAGAGGTTTGCTGGGTTCAGCAAGGACTCCAAGCAACTTGATGCTGATGTTCACCGCAA
GTACATCTATGGTGGCCATGTTGCAACATATATGAAGACGTTGACTGAAGATGAGCCTGAGAAATTTCAGTCTCACTTT
AGTGAGTACATCAAGCAAGGTCTTGAGGCTGATGATCTCGAGGAGATGTACAAGAAGGTTCATGCTGCCATACGTGCCG
ATCCAAGCCCAAAGAAATCTGAGAAGCAgCCTCCCAAGCAGCACAAGAGGTAcaacctgaagaAGctgactTATGAGGA
AAGGAaGGCCaa

FIG. 2 continued

> SEQ ID NO:2745 215325 219437_300945_1
gcaagtttgaggagcaagccagccatcgccaGGCACCACCGTCAAAATGCCTTTCCAAAAGCTCGCCAAGAACAGCGCG
TACTACAGCCGCTACCAGACCAAGTACAAGCGTAGACGTGAGGGAAAGACCGACTACTATGCTCGTAAGCGCCTCATCA
CCCAGGCCAAGAACAAGTACAATGCTCCCAAGTACCGCCTGGTCGTCCGCTTCACCAACAAGGACATCGTCATGCAGAT
CGTCAGCTCTGAGATCGCTGGTGACAAGGTCCTGGTCGCTGCCTACGCCCACGAGCTGAAGGCTTACGGCATCAACCAC
GGTCTGACCAACTGGTCCGCCGCCTATGCCACCGGTCTCCTGATCGCTCGCCGTGTCCTCACCAAGCTCGGCCTCGACA
AGGATTTCGTCGGTGTTGAGGAGGCTGACGGTGAGTTCACCCTCACCGAGGCCGCTGAGACCGACGATGGCGAGCGCCG
CCCCCTTCAAGGCCTTCCTTGACGTTGGACTTGCCCGTACCTCCACCGGTGCCCGTGTCTTCGGTGCCCTCAAGGGTGCC
TCCGACGGTGGCATCTTCGTCCCCCACTCCGAGAAGCGATTCCCTGGTTACGACATGGAGAGCAAGGAGCTGGACGCCG
AGACCCTCCGCAAGTACATCTACGGTGGCCACGTTGCCGAGTACATGGAGACCCTCGCCGATGACGATGAGGAGCGCTA
CAACAGCCAGTTCTCCAAGTACATTGAGGAcGATATCGAGGCCGACGGTCTCGAGGACCTCTACACCGAGGCCCACAAg
gccATCCgtgAGGACCCCTTCAAGaaggttGAGGGTGagAagaagaccaaggaGGagtggaagggcATCTccCTgAaGC
ACAAGAccATCAGACTc > SEQ ID NO:2746 215325 190813_300736_1
CCCAAACCCTAACCATTCCTTCTCCCACCTTCTCCCTTCTCGTCGCTCTTCCCCCTCCGCCGCCGCCGCAGCGGAGCAG
CAACAGCAGGCGAGCGACATGGGAGGGTTTGTCAAGACCCAGAAGACCCATGCCTACTTCAAGCGTTTCCAAGTCAAGT
TCAAGAGACGGAGGCAGGGCAAGACTGACTACAGGGCCAGGATTAGGCTCACCAACCAAGATAAGAACAAGTACAACAC
ACCGAAGTACCGCTTTGTTGTGAGATTTACAAACAAAGATATCACAGCTCAAATTGTCTATGCTACCATTGCGGGTGAT
ATCGTGATGGCTGCTGCCTACTCCCATGAGCTGCCTCGTTATGGTCTTGAAGTTGGTCTCACCAACTATGCGGCAGCTT
ACTGCACTGGCTTGCTTCTGGCTCGCCGTGTGCTCACGCTCCGTGGTTTGGACCAGGAGTACGAGGGCAATGTTGAGGC
CACTGGGGAGGACTACTATGTTGAACCAGCTGATGAAAGGAGGCCTTTCCGTGCTCTCTTGGATGTTGGCCTCATTAGG
ACAACCACTGGAAA > SEQ ID NO:2747 215325 171029_300534_1
CCTTCTCCCACCTTCTCCGTTCTCCTCGCTCTTCCCCCTCCGCCGCCGCCGCAGCGGAGCAGCAACAGCAGGCGAGCGA
CATGGGAGGGTTTGTCAAGACCCAGAAGACCCATGCCTACTTCAAGCGTTTCCAAGTCAAGTTCAAGAGACGGAGGCAG
GGCAAGACTGACTACAGGGCCAGGATTAGGCTCACCAACCAAGATAAGAACAAGTACAACACACCGAAGTACCGCTTTG
TTGTGAGATTTACAAACAAAGATATCACAGCTCAAATTGTCTATGCTACCATTGCGGGTGATATCGTGATGGCTGCTGC
CTACTCCCATGAGCTGCCTCGTTATGGTCTTGAAGTTGGTCTCACCAACTATGCGGCAGCTTACTGCACTGGCTTGCTT
CTGGCTCGCCGTGTGCTCACGCTCCGTGGTTTGGACCAGGAGTACGAGGGCAATGTTGAGGCCACTGGGGAGGACTACT
ATGTTGAACCAGCTGATGAAAGGAGGCCTTTCCGTGCTCTCTTGGATGTTGGCCTCATTAGGACAACCACTGGAAACCG
TGTCTTTGGTGCCCTCAAGGGAGCTTTGGATGGTGGTCTTGAC > SEQ ID NO:2748 215325 1111393_301534_1
GCAACCATCAGCAACCATGGTTTTCGTGAAGGCATTGAAGTCGAAGGCCTACTTCAAGAGGTACCAGGTTAAGTACAAG
AGACGTAGAGCTGGAAAGACAGACTACCGTGCCCGCATCCGTCTCACAACTCAGGACAAAAACAAGTACAACACCCCGA
AGTACCGTTTTGTGGTTCGATTTACAAACAAGGATATAATAGCCCAGATCACGTATGCTACGTTGGCAGGTGATATTGT
GCTTGCAGCTTCATATGCGCATGAGCTTCCCCGCTATGGGCTGCCAACTGGACTCACAAACTATGCGGCTGCGTATTGC
ACTGGTCTTCTATTGGCCCGTCGTGTACTGAAACAATTTGATTTGGATAAGGACTATCTCGGAAATGAAGAGGCCACTG
GTGAAGACTACAATGTGGAGGAAACTGGGGAGCGACGTCCATTCAGGGCTCTCCTTGATGTAGGGCTCATAAGGACAAC
AACTGGAAACCGGGTCTTTGGGGCGCTCAAGGGAGCTTTAGACGGAGGTCTTGATATCCCCCACAGTGAGAAAAGGTTC
GCTGGGTTCAGCAGAGATGACAAGTCTCTAAATGCTGACACTCACCGCAAATACATCTTT > SEQ ID NO:2749 215325 1109714_301524_1
atccgtcgttggagctcgacaggaggaggaggagggcagagagacacatccgtcagcggccatggtgttcgtgaaggc
gCTGAAGAGCAAGGCCTACTTCAAGAGGTACCAGGTCAAGTATAAAAGACGCAGAGCTGGTAAGACAGACTACCGTGCT
CGGATCCGTCTCACAACCCAGGATAAGAACAAGTACAACACTCCTAAGTACCGCTTTGTTGTTCGATTTACCAACAAGG
ATATAACTGCTCAGATTACATATGCGACCTTAGCTGGCGACATTGTGCTTGCTGCTGCATATGCACATGAGCTTCCCCG
CTATGGCCTACCCACTGGCTTCACCAACTATTCTGCTGCCTATTGCACTGGTCTTCTATTGGCCCGCCGTGTCTTGAAG
CAATTTGATTTGGACAAGGAATATGTTGGAAATGAAGAGGCTACCGGGGAAGATTACAACATTGAAGAAGCTGGCGAAA
GGCGACCATTCCGGGCTCTGCTTGATGTTGGTCTCATTCGAACCACTACAGGAAATCGAGTCTTCGGTGCTCTCAAGGG
AGCTTTAGATGGAGGTCTTGACATCCCCCACAGTGAGAAGAGATTTGCTGGCTACAGCAAGGACGATAAGTCTCTTAAT
GCTGACACCCACAGGAAGTACATCTTTGCTGGGCATGTTGCAGACTACATCAAGATGTTGAAAGAGGAAGaaccGGAGA
AGTAccAATCCCAATTCTCAaCttaCAttGCTgCtggaattGaacccgAAAGcttTGaaAGcaccttg

FIG. 2 continued

> SEQ ID NO:2750 215325 252815_301605_1
TGGAGCTCGACAGGAGGAGGAGGAGGGGCAGAGAGACACATCCGTCAGCGGCCATGGTGTTCGTGAAGGCGCTGAAGAG
CAAGGCCTACTTCAAGAGGTACCAGGTCAAGTATAAAAGACGCAGAGCTGGTAAGACAGACTACCGTGCTCGGATCCGT
CTCACAACCCAGGATAAGAACAAGTACAACACTCCTAAGTACCGCTTTGTTGTTCGATTTACCAACAAGGATATAACTG
CTCAGATTACATATGCGACCTTAGCTGGCGACATTGTGCTTGCTGCTGCATATGCACATGAGCTTCCCCGCTATGGCCT
ACCCACTGGCTTCACCAACTATTCTGCTGCCTATTGCACTGGTCTTCTATTGGCCCGCCGTGTCTTGAAGCAATTTGAT
TTGGACAAGGAATATGTTGGAAATGAAGAGGCTACCGGGGA

> SEQ ID NO:2751 215325 280894_200069_1
tttcacTCCCCCCAACCCCTAACGCCGGCGGCGGAGGCTAATCGAAGAACAACAATGGCCTTCATCAAAGTCCAGAAGA
CGAGGGCTTACTTTAAGCGTTTCCAGGTTAAATTCAAGAGAAGGAGAGAGGGAAAGACTGACTATAGAGCCAGGAATCG
GCTGATCAATCAGGACAAAAATAAGTACAACACACCAAAATACCGTTTTGTTGTCCGATTTACTAATAAGGACATTATC
GCACAAATTGTGTCTGCTAGCATTGCTGGTGACATGATTCTTGCCTCTGCCTATGCTCGTGAGTTGCCTCGTTATGGAC
TTAAAGTCGGACTGACAAACTATGCTGCTGCATACTGTACTGGACTTCTCTTGGCAAGACGAGTTCTCAAAAAGCTTGA
AATGGACGAAGAGTATGAAGGGAACCTCGATGTCAATGGGGAAGATTACTCCGTTGAACCTGCTGAAAGCAGGAGGCCT
TTCCGTGCTCTCTTGGATGTTGGCCTTATAAGAACTACCACAGGCAATCGTGTTTTTGGTGCTCTCAAGGGTGCATTGG
ATGGTGGATTGATATCCCTCATAGCGAGAaaaggttTGCTGGATTCGGCAAGGATtccAAGCAACTTGATGCAGATGT
TCACCGCAaGTAtAtCTACggtggccacGTTTCTGCATATATGAAAACAttGATGgAaGatgaacctG > SEQ ID NO:2752 215325 260019_301711_1
GGAAGGCCGAGCAGCGCAGCCATGGCCGTCGCTAAGGCGCAGAAATCCAAATCCTACTACAAGCGCTACCAGGTCAAGT
ACCGCCGCCGGCGAGAGGGTAAGACCGATTACCGCGCGCGGGTGCGATTGACAAACCAGGACAAGAACAAATACAATAC
ACCAAAGTATCGATATGTTGTGCGCTTCACGAACAAGGACATTGTCGCCCAGGTCGCTTATGCAACTATTTGCTGGCGA
TGTGATCATGGCCGCGGCCTACTCGCATGAACTGCCACGATACGGTCTCAAGGTCGGCCTGACGAACTACGCA > SEQ ID NO:2753 215325 253402_301626_1
aCAAGACCTCTGCCTACCACTCTCGGTTCCAGACCCCCTTCCGTCGACGACGAGAAGGTAAGACCGACTACTATGCTCG
AAAGCGACTCGTGACCCAGCACAAGGCCAAGTACAACACCCCCAAGTACCGACTTGTTGTGCGATTCACCAACAAGGAC
ATCATCGCCCAGATTGTCTCTTCCCAGCTCAAGGGTGACATTGTTTTCACTGCCGCCTACGCTCACGAGCTTCCCCGAT
ACGGTGTCAAGCACGGTCTTACCAACTGGGCCGCTGCCTACGCCGTCGGTCTTCTTGTTGCTCGACGAGCTCTCAAGAA
GCTCGGCCTCGACGAGACCTACAAGGGAGTTGAGGAGGTTGAGGGTGAGTTTGAGCTCACCGAGGCCGTTGAGGACGGT
CCTCGACCCTTCAAGGTCTTCCTTGATGTCGGTATGACCCGAACCACCACCGGTGCCAAGTGCCTTCGGTGTTCTCAAG
GGTGCTTCCGATGGTGGACTTTACGTCCCCCACTCCGCTTCTCGATTCCCCGGTTGGGATATCGAGTCCGAGGAGCTCG
ACTCCGAGAccCTgcGAAAGTACATCTTCGCTggccACGtttccgAGTACAtggAGGAGCTTgccGAtgaTGAtgaggA
GCGa > SEQ ID NO:2754 215347 219933_300950_1
GGCCATACGAACCGACACTTCCTCCTACTACGTACCTCCCCCCTACGGCGCCTATCCCCAAACCCCGGTAGCGACACCC
ACCGGCCAGCCTAAACACGAACCCTATTTCCCGCCGCCAACTCGACCCCAGCGAGCGCAAGGCTTCGAGGCTCCAAATC
AAAACGCCGCACCTCCCGTATCGTACAGGCCCGACGGACGGAGTTTCAGACCGTCGCTGCCTCCATTATCCACGTCGAC
CGACCCCTACCAATCTTTTGGAAGCGCTGGCCTTCCATCGTCCTCATCCTCAGATATGCCGCCACGAAAGGTAGTGGCG
CCTCCGCCCCCTACCCCAGCCGTCGAGCCGTCTCCTGTCCGGACAAAATTCCCGACGGCCCGGATCAAGCGGATCATGC
AGGCCGACGAGGAGGTAGGCAAGGTCGCTCAGCAAACGCCCATTGCTGTGGGCAAGGCATTAGAGCTGTTTATGATCCA
GCTCGTCACAAAGAGCGCAGATGTTGCCAAGGACAAGGGTTCCAAGAGAGTGACGGCGTCCATGTTGAAGCAGGTGGTG
GAGGCGGACGAGCAGTGGGACTTTCTTAGAGAG > SEQ ID NO:2755 215360 1097402_301444_1
AGCTTGATTTGGTGTATTGATCTTATTTATTGTTTCAATCTTCGATAAACCTAATTCATGTCAGAACTCGATATCCAAA
TCCCCACATCTTTCGACCCATTCAAGGAGGCGGACGCGAACAATCCAGGGACAGGTTCTCGCGACTACATCCACATACG
CATGCAGCAGAGGAACGGGCGTAAATGCCTGACCACTGTTCAAGGCCTCAAAAAGGAATTCAACTACAACAAGATCCTG
AAGGACGTCAAGAAGGAGTTCTGCTGCAATGGCACAGTTGTGCAAGACTCAGAACTCGGACAAGTGATACAGTTGCAAG
GAGATCAGCGAAAGAACGTGTACCAATTCCTCATTCAGGCTGGAGTATCAAAGAAGGAGAATATTAAGCTTCATGGTTT
TTAGTCAGTCAATGCTGCCGCCAGTCTGATTATTATTTTGCATGCTGTTAATTTTAAGCAAATAATATTCAGGTTGCA
GGTTATACCTGGCTTTGTAATTCGACCGCATTTTAATAATCGCGTGGTATAGCTGAAAATATGTACTGTGGCAGCAGAT
TTTATCATAATAATATAGTTACAAATTTGGTTAC > SEQ ID NO:2756 215360 1120059_301861_1
TAAAAAAACTGAGCTTGATGACAGAGATCGAGATTCAAGTCCCCACTCCCTTCGATCCTTTCAAGGAGGCAGATGAGAG
CAGTGGGACGCCCGGGACAGGATCGAAGGACTACGTCCATATTCGAATCCAGCAAAGGAATGGTCGCAAGAGCCTCACT

FIG. 2 continued

```
ACGGTTCAAGGGTTGCGAAAAGAGTTCAATTACAACAAGATCCTCAAAGATTTCAAGAAAGAGTTTTGCTGCAATGGGA
CTGTAGTCCAAGACCCTGAGCTGGGCCAGGTCATCCAACTTCAAGGAGATCAAAGGAAGAATGTGTCTCAATTCTTAGT
ACAGGCTGGTGTGGCAAAGAAGGAGCTGATCAAAATCCACGGCTTTTGATAGTACTATTGGCTATATATATATATATAT
ATATATATATATATATAATATG
```

> SEQ ID NO:2757 215360 198881_300685_1
```
GTCGACCACGCGTCCGGGTCAAGCCGTGCCGCGTCGTCGTCTCCCTCGCCTTTCCCCTCCGCTCCGCTTCGCCGATCAA
GCTTGCATTGAGACAAAGAAATCAGCTTTCATCTGGGGGAGACCAATCAAACTCAACTAGCAAATTTCATGTCTGATCT
CGACGTCCAGCTTCCATCAGCTTTTGATCCGTTTGCGGAAGCCAATGCTGAGGACTCCAGCGTTGGTGCTGGATCAAAG
GACTATGTACACGTGCGCATTCAGCAGCGCAACGGAAGAAAGAGTCTGACTACTGTTCAGGGCTTGAAGAAAGAGTACA
GTTACAACAAAATCCTCAAGGATCTGAAAAAGGAATTCTGTTGTAATGGTACTGTAGTCCAAGATCCAGAGTTAGGCCA
GGTCATTCAACTTCAAGGTGATCAGCGTAAAAATGTTGCGACGTTCCTAGTTCAGGCTGGAATTGTAAAGAAAGAGAGC
ATCAAAATACACGGGTTTTAGGCTACACATAATGCCTATGTGCTATTATATGATACAAAATATTGAAGTGTCTGAAGCC
TGAAGTTGTGATAATACCAGTTTTTACTACTTCAAGACATTTGAATTTGTGTCGGTGTGAGCTCTTGGTT
```

> SEQ ID NO:2758 215360 226595_300998_1
```
AAAAAACACCCTCCCCCTTCACTCGACAATCTGGACATAGGTCTCTAGATCGCGCCAATAACAGTTTATGTCTACTTCT
ATCGAAAACCTCAAGTCCTTTGATCCCTTCGCCGACACTGGTGACGACGATACTCAGCCTACCAACTACATCCATATCC
GTATCCAGCAGCGAAACGGACGAAAGACTCTGACCACAGTCCAGGGCCTTCCCGAAGAATATGACCTCAAGCGAATCCT
GAAGGTTCTCAAGAAGGATTTTGCCTGCAACGGAAACATCGGCAAGGACGAAGAGCACGGTGAGATTATTCAGCTCCAN
GGAGACCAGCGAGACAAGATTGTCGACTTCCTGACTGCCAAGCTTCAGATTGACAAGAAGACCATCAAGAAGCACGGTT
TCTAAATGGATCCCGCCAGTATATGTGGCTCAAACCTGCCTGACACGACTCCCATAGCGGAGTGCGATATAACGAGATT
AATTCCAATATCTGTGAT
```

> SEQ ID NO:2759 215360 218385_300917_1
```
gccagcccaacctctacatttgcgccAGCGCATTTAAAAAGCTCGTCGAGTCACCGCATAAAAAAAAACACACAAAAGG
CGCTCAGCCCCTCTCCCCGCCGACCCTTTTTTTCCCTGTCCCGCATCACCAAAAACCAAAACACCTCAGAGACCGTCGC
CTTTCGCAGCCGCCGGTTCATCAACCTCGCCTCCCCCAAACTTTCCTTTTTCCCACGAGAAACCCCGGAACATCCGAGT
TTATGTCCATCGAAAATCTCAAGTCCTTCGACCCCTTCGCCGAAGCCGACGACGACACCGGTGATATCAAAAAGGTCGA
GAACCATATCCATATTCGTATTCAACAGCGAAATGGTCGCAAGTCTCTGACCACGGTTACTGGTCTTCCTGCTAAATTT
GACCCCGGCAAGATTCTCACCTTCTTCAGGAAGGAATTCGCTTGCAATGGCAACAAGGTCAATGATGAAAAGGCCGGCG
AGGTGATCCAGCTCCAGGGCGACCAACGCAAGAAGGTCATGGATTTCCTCGTTGACAAGAAGAGCGGTCTCGGTCTCAA
CCCCGATAACATCACCGTTCACGGTGCCTAAATCGTCCTCTTTCGCGCCGCCGCCCCGGCCCGCCCTTCCAGCGACTTG
GCTTCACAGCATGCTGGTGATGAGCGTGTCGGAATGGGGCTGCTCGAGCAGCCTGTAACCTTACACAGACGCCTACCGC
AACCTCCATCGTCTAGTCGAGACCGCTGAACGTCCATCCTTTGCTGGGGGCTGCGAGCGGTCTCGTGTGATAGgaggcc
CTCTCCGGTACAAT
```

> SEQ ID NO:2760 215360 175669_300543_1
```
CCCCCGAGGAGGCATCCAAGCCAAGAAGAGGGAGAGCACCAAGGACACGCGACTAGCAGAAGCCGAGCGACCGCCTTCT
CGATCCATATCTTCCGGTCGAGTTCTTGGTCGATCTCTTCCCTCCTCCACCTCCTCCTCACAGGTTCTTGGTGTAGCTT
GCCACTTTCACCAGCAAAGTTTCATGTCTGATCTCGACATTCAGATCCCAACTGCCTTCGATCCCTTTGCTGAGGCCAA
TGCTGGAGACTCTGGTGCGGCTGCAGGATCAAAGGACTACGTTCATGTACGCATCCAGCAGCGTAATGGCCGTAAGAGC
CTGACCACTGTCCAGGGATTGAAGAAGGAATTCAGCTACACACAAGATCCTCAAAGATCTCAAGAAAGAGTTTTGCTGCA
ATGGTACTGTTGTCCAGGACCCAGAGCTTGGCCAGGTCATTCAACTTCAGGGTGATCAGAGGAAGAACGTATCAAATTT
TCTTGTTCAGGCCGGCATTGTGAAGAAGGAACACATCAAGATTCATGGTTTCTGAGCAACTGCCAAAACCATTGCAAAG
ACTATAGTTTGGGGTGGAGTATACTTGGTTGTGTACATGCCTGCGTGTTCCATTGTACACACAAAACCTAGCCACCTCT
TGACTCTTGAGTGTATGCTTGTTATCCGTGTGTTGAAGTTTGTAAGAGGCACCATCACTATAGATGATGGCTTgtgtcC
CTcTtTCa
```

> SEQ ID NO:2761 215360 152934_200081_1
```
TTTTCTCTATTTGCTCAGACTTATCCGAACGCGTGAGGGTTTGCTCTTTAACCACCTTTCCCATCTCTCCAAACCCTAA
TTTTCGGATCAGGTCTGAGCATCCAAGTATTGTGATTTCAGAGCGCTTGTCTTCCATTCTCTGAAAAGTTTCATGTCTG
AGCTCGACCTCCAAGTTCCCACTGCTTTTGATCCCTTTGCTGAGGCAAATGCTGACAATTCTGGAGCTGGGTCAAAAGA
TTATGTACACATTCGCATACAGCAAAGGAATGGTCGGAAAAGTCTGACAACTGTTCAAGGATTGAAGAAAGAATTCAGC
TACAATAAAATACTGAAGGACCTAAAGAAAGAGTTTTGCTGCAATGGTACTGTTGTCCAGGATCCAGAACTAGGCCAGG
TTATTCAACTCCAGGGTGATCAGAGGAAGAACGTTTCTGCATTTCTTGTCCAGGCTGAAATCGTGAAGAAAGAGTACAT
CAAAATTCATGGTTTCTGATTGCCATCATCATTCATCGAGCAGTTATCGCATTTGCAGTNTATCATATTTGTCGTGCCA
GCGCAGGAAATGCTATCCAAACTTAGTGATAATAAAGTTTCCTAGTGTGTTTTAAACCCAAACGGAAAAGAAATT
```

FIG. 2 continued

> SEQ ID NO:2762 215360 121445_300357_1
ccccACAACGCAGCTCCTGGTCAAGTCTTATCTGCCTTCCTCCCTCCTCTCGCCTTCCGCCTCGCGTGCGCTCCACCAC
CGAAAAAAAGGACAGGTTCCACATAAAGACCAACGAGTAAAAGCTTGATCTGTCCGGTGCCAACCAATCAACAAACAAG
TTTCATGTCTGATCTCGACGTTCAGCTTCCATCTGCCTTCGATCCGTTTGCTGAGGCAAATGCTGAGGACTCCGGCGCT
GGCCCTGGAGCAAAGGATTATGTGCATGTGCGCATCCAGCAGCGCAACGGCAGAAAGAGTCTAACTACTGTTCAGGGCT
TAAAGAAGGAGTACAGTTACAACAAGATCCTCAAGGATCTGAAAAAGGAGTTCTGCTGCAATGGTACTGTAGTCCAAGA
TCCAGAGCTTGGCCAGGTCATTCAGCTTCAAGGTGATCAGCGTAAGAATGTTGCCACGTTCCTAGTTCAGGCTGGGATT
GCTAAGAAGGACAACATCAAGATTCACGGTTTCTAAGCTGCCTATAGATGCTCGTATGCAATATCGTGTGCTGCCAGAT
ATTGGGAAGCCTCTGAAGCTACCAGTTACTGTTCTCTATATTTGAAGTCATAAGACTATTTGTTGCTATTAAAGCGATT
CTTGCTTGATGCAAGTTGTGTCCTCATTATGCACTACCGGCATATTATGAGTATGGTTTGTCTGGGATATTGTCAATCT
AATAAAAGTACTTGCTATTTGACTAt > SEQ ID NO:2763 215360 128327_300475_1
cccccggtgtgcactgacgttcactgtatgggctcggacttatccggaatttggggttttcTCTATCACCATCGTCTTC
ATCTCTCCCAACCCTAACCTTCGGATCAGGTCTGAGCATCCAAGTTTCGAGATTTGTGTGCGCTTGTTGTCTTCTACTA
CTCAACCAAGTTTAATGTCTGATCTCGACGCCCAAATTCCTACTGCTTTTGATCCCTTTGCCGAGGCAAATGCTGATAA
TTCTGGGGCTGGGTCAAAAGATTATGTGCACATCCGTATACAACAAAGGAATGGTAGGAAAAGCCTGACAACTGTGCAG
GGGTTGAAGAAAGAATTCAGCTACAACAAGATACTGAAGGATCTCAAGAAAGACTTTTGCTGCAATGGTACTGTTGTCC
AGGATCCTGAATTAGGCCAGGTTATTCAACTTCAGGGTGACCAGCGTAAGAATGTTTCTGCATTTCTTGTCCAGGCTGG
AATCGTGAAGAAAGAGCACATCAAAATTCACGGTTTCTGATTGTTATCATCAACCTTGCTGCACAGTTATCGTACTTGT
TACGTCAGTGCCAGAGATGCTATCCAAACTTAGTTCTAGTGGAACTTGCTTGTGTCTAATTTCTGCTGGTTTGATATAA
AATACTGCAGTTGCTTGCtTCTCTATGTTCTGTATGTtgaatATGAGTTATGCTATAttt > SEQ ID NO:2764 215360 244564_301559_1
CTCGAATCTCGGCAAGCGTCTTCGATCGATTCGGTCCAGCGGCGGCGAGCAGTAGATCAAGTTCATGTCTGAGGTCGAC
ATCCAGATTCCTGGCGCCTACGATCCCTTTGCCGACGCGAATGCTGAGGAATCCGGTGGTGTTGGGTCGGGAGAATACG
TCCATGTGAGGGTCCAGCAGCGAAATGGCCGCAAGAGCTTGACCACTGTCCAGGGCCTGAGCAAGGAATTCAACTACAA
CAAGATCCTTAAGGACTTTAAAAAGGAATTTTGCTGTAACGGCACTGTGGTGCAAGATCCGGAGCTGGGTCAGGTTATT
CAGCTACAGGGTGACCAACGCAAGAATGTTTCCCAGTTTCTTGTGCAAGCTGGTGTGGTCAAGAAGGATCTAATCAAGA
TCCACGGCTTCTAAGCGCTGTGGCTGCTGCTACTACTGCTGTATCGACTACTGTGGTGTTGTTGTGATGTAGCTAGTGG
CTAAGGTGGACAAGGGTGGGGAAAAAAGAGAGATA > SEQ ID NO:2765 215360 255183_301642_1
ATTTATGTTTCAATCTTCGATAAACCTAATTCATGTCAGAACTCGATATCCAAATCCCCACATCTTTTGACCCATTCAA
GGAGGCGGACGCGAACAATCCAGGGACAGGTTCTCGCGACTACATCCACATACGCATGCAGCAGAGGAACGGGCGTAAA
TGCCTGACCACTGTTCAAGGCCTCAAAAAGGAATTCAACTACAACAAGATCCTGAAGGACGTCAAGAAGGAGTTCTGCT
GCAATGGCACAGTTGTGCAAGACTCAGAACTCGGACAAGTGATACAGTTGCAAGGAGATCAGCGAAAGAACGTGTACCA
ATTCCTCATTCAGGCTGGAGTATCAAAGAAGGAGAATATTAAGCTTCATGGTTTTTAGTCAGTCAATGCTGCCGCCAGT
CTGATTTATTATTTTGCATGCTGTAATTTTAAGCAAATAATATTCAGGTTGCAGATTATACCTGGCTTTGTAATTTGAC
TGCGTTTTAATAATCGCGTGGTATAGCTGAAAATATGTACTGTGGCAGCAGATTTTATCATAATAATATAGTTACAAAT
TTGGTTACG > SEQ ID NO:2766 215369 199846_300753_1
tcgcttctaggccctGtTTCATTTGAGTTCAAACGCTTCTTCTCGTCTCTCGTTCAGAATTTATTTCGCGTCCTTCAAA
CAACTCAAAATGAAGTACTCTGTCGCTGCCGTCTCGGCCTTTGCCGCCGTCGTTCTCGCCAAGCCCGAgtTCctCAACT
CTGCTTTCCAGGTCCAGGAGGGCAAGCCTTTttacCCTCgagtacTCTGGCTGCTCTTCTGGCTGCGAGATTGTTCTCA
GACTggtgcTaGCACCAACCTGAAGGACGTcaaggttcTTGCTTCTTCTGCCACCGGCTCCTCCACTACCGTCACCctg
gaGgacattcccTCtggcAtCTACAGCTTCAaGATCACCGACAAGAGCGGCGAGAGCAACTACAGCCAGCAGTTCTCct
accagggcagCGGCAAGgccatCTcCaGCGCCTCATCTGCcaccaGCGCTGCTgagtccaACACGGCTGCTCCCACCTC
cgagacccaccACGGCTgAGCccaccagcaccaaagcttCCTCCaccaaGGAGCACTCcaccaCGCTggtcaagtcaac
caCTGCTCACTCCA > SEQ ID NO:2767 215379 1171563_302055_1
GCTTTAGGGAGGGGGTGAGGCTCGAAGCTACTGCGGCTGCCGGAGGAGGAGGAGGACCTGCCACGCCATGGGTATCTCA
CGAGATTCAGTGCACAAGAGGAGGGCCACTGGAGGGAAGAAGAAGGCATGGAGGAAGAAGAGAAAGTACGAGATGGGCC
GTCAGCCAGCGATGACAAAGCTGTCAAGCAACAAGACAGTGCGGAGGATCCGAGTGCGTGGTGGTAACTTCAAGTTCAG
GGCTTTGCGTCTTGACACTGGAAACTACTCCTGGGGGTCAGAGGCCACCACCCGCAAGTCGAGGATCCTGGATGTGGTC
TACAATGCCTCCAACAATGAGCTTGTCAGAACCCAGACTCTGGTCAAAAGTGCCATTGTCCAAGTTGATGCGACCCCTT

FIG. 2 continued

```
TCAGACAGTGGTACAGTCAACATTATGGCCTGGATATTGGCCGCAAAAAGAAATCCAGCAGCGCTGCCAAGAAGGAGAC
TGAGGAGGGTGATGCTGGAGATGAGGAAAAGAAGAAAAGCAAGCATGTTCTGCGAAAGCTAACAAAGAGGCAGGAAGGT
CAGAAGCTTGACTCTCATCTAGAGGATCAGTTTGCAAGTGGTCGTCTCTTGGCATGCATTTCGTCCCGCCCGGGACAGT
GTGGCCGAGCTGATGGGTAC
```

> SEQ ID NO:2768 215379 11794_300294_1
```
TGGTATCAACGCAGAGTGGCCATTACGCCGGGGCGGCTAAGCTCTCAGCAACCATGGGTATCTCACGAGATTCTATGCA
CAAGAGGCGTGCCACTGGTGGCAAGAAGAAAGCTTGGAGGAAGAAGCGAAAGTATGAACTTGGCCGCCAGCCTGCTAAT
ACTAAGATCTCGGCTAACAAGACAGTCCGACGAATTCGTGTGCGTGGTGGCAATGTGAAGTGGAGGGCACTGAGATTGG
ATACCGGAAATTACTCATGGGGTAGTGAGGCAGTCACACG
```

> SEQ ID NO:2769 215379 225245_300985_1
```
ACAGATTGCACCAGGAGACCCGACATCAGCGTCTTCTGAACAACCGCAATCATGGGTATCTCACGAGACTCTCGCCACA
AGCGTTCCGCGTCCGGTGCGAAGCGCGCATACTACCGCAAGAAGAGGGCTTTCGAGAAGGGCCGCCAGCCTGCCAACAC
CCGTATTGGCACAAAGCGTGTTCATCTTGTCCGCACCCGTGGCGGCAACCGCAAGTTCCGTGCCCTTCGTCTCGAAGCC
GGTAACTTCTCCTGGGGCTCCGAGGGCATCGCCAAGAAGACCCGTGTCATCGGTGTCGTCTACCACCCCTCCAACAACG
AGCTCGTCCGTACCAACACCCTGACCCGCTCCGCTATCGTCCAGATCGATGCCGCTCCCTTCCGACAATGGTACGAGGC
CCACTACGGCTCTTCGCTCGGCCGCAGGAGGCAGGTCAAGGCCGGTGAGAAGGAGGAGGACAAGAAGAAGTCCAACTCG
GTCACCAAGAAGCAGGCCGACCGCTTGAAGAACGGAGGAAAGATTGAGAACGCTGTTGAAGAAGCAGTTCGAGGCCGGTC
GTCTGTACGCCGCTGTCTCTTCCCGTCCCGGCCAGAGCGGTCGCTGCGACGGCTACGTCCT
```

> SEQ ID NO:2770 215379 211994_300872_1
```
gtttcattcctcccacatcggacaagtcgATTGCCCTGGTGAGCACCATTATCATCAGAAACCGCAATCATGGGTATCT
CTCGTGACTCTCGCCACAAGCGCTCCGCCTCCGGTGCCAAGCGCGCCTACTACCGGAAGAAGCGCGCTTTCGAGGCTGG
CCGCCAGGGTGCCAACACCAAGATTGGCGCCAAGCGAATCCACACCGTCCGCACTCGTGGTGGTAACCACAAGTACCGT
GCCCTGCGTCTCGACTCCGGCAACTTCGCCTGGGCCTCCGAGGGCTGCACCCGCAAGACCCGTGTCATTGCCGTCGCCT
ACCACCCTTCCAACAACGAGCTGGTCCGAACCAACACCCTGACCCGTAGCGCCATCGTCCAGATCGACGCTGCTCCTTT
CCGACAGTGGTACGAGTCCCACTACGGCCAGCCCATCGGCCGTAGACGCCAGAAGGCCCAGGCCGCCAAGGAGGGCAAG
GAGGTCGAGGAGGTCAAGAAGAGCAAGTCCGTCGAGAAGAAGCAGGCTGCTCGCTACGCCGCCAACGGCAAGGTCGAGT
CCGCTGTTGAGAAGCAGTTCGAGGCCGGTCGTCTGTACGCCGTTGTCACCAGCCGTCCCGGCCAGTCCGGCCGCTGTGA
CGGTTACGTTCTGGAGGGTGAGGAGCTGGCTTTCTACCAGAAGAAGCTGCACAAATAAACTCACAATGGCGTGAGTTGG
ATGGTGTTcaaggATTTTTTCGTTATCTTGGGcAtTtTcagggcatGAAGAGCTTTCTAACACACAAAGCATCGGAACG
GGTCCatagGGAAATGAAAAGCTTTTCTGCAATCATGTtactTTTTTCACGTTGTTTCATTCAAGTATGATAATGATAC
AAGAAACAAAACAATTCAACACACCT
```

> SEQ ID NO:2771 215379 208341_300959_1
```
GCAGGTGAGGAGGAGAGGAGACCCGCCGCCGCCGCCGCCATGGGTATCTCGCGTGATTCCATGCACAAGCGCCGCGCCA
CGGGCGGCAAGCAGAAGGCATGGCGCAAAAAGCGAAAGTATGAGCTCGGAAGGCAGCCTGCCAACACCAAGCTGTCAAG
CAACAAGACAGTGAGGAGGGTGCGTGTCCGTGGAGGTAATGTGAAATGGAGGGCCCTCCGTTTGGATACTGGCAACTAC
TCATGGGGAAGTGAGGCCGTGACCCGCAAGACCCGTATCCTTGATGTGGTCTACAATGCATCCAACAATGAGCTTGTCA
GGACTCAGACCCTTGTAAAGAGTGCTATTGTGCAAGTTGATGCTGCCCCCTTCAAGCAGTGGTACCTCACTCACTATGG
AGTGGATATTGGTAGAAAGAAgaAGGCTCCTGCAGCCAagaAGGATGCTGAGGGGCAGGATGCTGAAGCTACCACAGAG
GAAGCGAagaAAAGCAACCATGTTGTCAGGAAGCTTGagaagCGCCAACAGGGACGCACACTTGACGCCCACATCGAag
aACAGTTTggCAGTGGGAggttgctggccTGCAttttCTTcccGccCTGGGCAGTGtg
```

> SEQ ID NO:2772 215379 191353_300740_1
```
ccgCTCCCCCCCGCTAGTTCCCAACCAGCAGCTGCGGCGGCGCGAGCACACGAAGAGGAGGCGGAGCAGCCGGAGCCAC
CTCCGCCGCCGCCGCCACCATGGGTATCTCGCGTGACTCCATGCACAAGCGCCGGGCCACCGGTGGGAAGCAGAAAGCG
TGGAGGAAGAAGCGAAAGTATGAGCTTGGTCGCCAGCCGGCAAACACCAAGTTGTCGAGCAACAAGACAGTGAGGAGGG
TCCGTGTTCGTGGAGGAAATCTGAAGTGGAGGGCTCTTCGCCTGGATACTGGTAACTATTCTTGGGGAAGTGAGGCTGT
CACTCGCAAGACCCGTATCCTTGATGTGGTCTACAATGCGTCAAACAATGAGCTTGTGAGGACCCAGACCCTTGTGAAG
AGTGCCATTGTGCAAGTTGATGCTGCCCCATTCAAGCAGTGGTATCTCACTCACTATGGTGGCGATATCGGTAGGAAGA
AGAAAGCTCCTGCTGCTAAGAAGGATGCTGCTGAGGGACAAGAGGGTGAGGCTGCCACGGAGGAAGCAAAAAAGAGCAA
CCATGTTGTGAGGAAGCTTGAAAAGCGTCAGCAAACTCGCACTCTGGACTCGCACATTGAAGAGCAATTTGGCAGCGGA
AGGCTCTTGGCCTGCATCTCCTCCCGGCctgGcaatgtggcagaGCTGATGGGTAca
```

FIG. 2 continued

> SEQ ID NO:2773 215379 191050_300738_1
CCCCCGAGCGAGGCACAGCTACCGGCGGCGCAGCCACACAGCAGCAGCAGGTGAGGAGGAGAGGGAGACCCGCCGCCGCC
GCCGCCATGGGTATCTCGCGTGATTCCATGCACAAGCGCCGCGCCACGGGCGGCAAGCAGAAGGCATGGCGCAAAAAGC
GAAAGTATGAGCTCGGAAGGCAGCCTGCCAACACCAAGCTGTCAAGCAACAAGACAGTGAGGAGGGTGCGTGTCCGTGG
AGGTAATGTGAAATGGAGGGCCCTCCGTTTGGATACTGGCAACTACTCATGGGGAAGTGAGGCCGTGACCCGCAAGACC
CGTATCCTTGATGTGGTCTACAATGCATCCAACAATGAGCTTGTCAGGACTCAGACCCTTGTAAAGAGTGCTATTGTGC
AAGTTGATGCTGCCCCCTTCAAGCAGTGGTACCTCACTCACTATGGAGTGGATATTGGTAGAAAGAAGAAGGCTCCTGC
AGCCAAGAAGGATGCTGAGGGGCAGGATGCTGAAGCTACCACAGAGGAAGCGAAGAAAAGCAACCATGTTGTCAGGAAG
CTTGAGAAGCGCCAACAGGGACGCACACTTGACGCCCACATCGA

> SEQ ID NO:2774 215379 160105_200029_1
ttttttgttgagccctccgtattgagctagccgtcggaaccctatgatccttcgtcGCCGGCAACAATGGGTATCTCTC
GGGATTCGATGCACAAGAGACGTGCCACTGGAGGCAAGAAGAAGGCGTGGAGGAAGAAGAGAAAGTATGAGCTTGGAAG
ACAGCCTGCAAATACAAAGCTGGTGCCTAATGCTAAGACTGTTAGGAGGATAAGGGTCCGAGGAGGCAATGTGAAGTGG
CGCGCTTTGAGGTTGGACACTGGGAACTTCTCTTGGGGCAGTGAGGCTGTTACTAGGAAGACTCGTTTATTGGATGTGG
TGTACAATGCCTCAAACAATGAGCTGGTTAGGACACAAACTCTAGTGAAGAGTGCAATTGTTCAAGTTGATGCAGCTCC
ATTTAAGCAGTGGTATCTCCAGCACTATGGAGTTGATATTGGTCGCAAGAAGAAGAGTGCTGTCAAGAAGGAAGGAGAG
GAGGCTGAGACTGCTCCTGCTGCGGAGGAAAAGAAAAGCAaCCATGTGCAGAGAAAGCTGCAAAAGCGTCAACAAGATC
GTAaGATTGACCCACATGTTGaaGAGCAATTTGCtagtGGCCGTCTATtggctgcaaTCTCGTCACGacctggccaatG
TgGTCGTGCTGATGGTTAcatCtTggagggtAaggaact > SEQ ID NO:2775 215379 139025_300406_1
CGCTCTCCTCCCCCCCGCTAGTTCCCAACGAGCAGCTGCGGCGGCGCGAGCACACGAAGAGGAGGCGGAGCAGCCGGAG
CCACCTCCGCCGCCGCCGCCACCATGGGTATCTCGCGTGACTCCATGCACAAGCGCCGGGCCACCGGTGGGAAGCAGAA
AGCGTGGAGGAAGAAGCGAAAGTATGAGCTTGGTCGCCAGCCGGCAAACACCAAGTTGTCGAGCAACAAGACAGTGAGG
AGGGTCCGTGTTCGTGGAGGAAATCTGAAGTGGAGGGCTCTTCGCCTGGATACTGGTAACTATTCTTGGGGAAGTGAGG
CTGTCACTCGCAAGACCCGTATCCTTGATGTGGTCTACAATGCGTCAAACAATGAGCTTGTGAGGACCCAGACCCTTGT
GAAGAGTGCCATTGTGCAAGTTGATGCTGCCCCATTCAAGCAGTGGTATCTCACTCACTATGGTGTCGATATCGGTAGG
AAGAAGAAGCTCCTGCTGCTAAGAAGGATGCTGCTGAGGGACAAGAGGGTGAGGCTGCCACGGAGGAAGCAAAAAAGA
GCAACCATGTTGTGAGGAAGCTTGAAAAGCGTCAGCAAACTCGCACTCTG > SEQ ID NO:2776 215379 237706_301280_1
gcggacgcgtgggcggacgcgtGGGCGGAGCGAGGAGGAGGCGCCGCATCGTCGCGGATCGATCAGTCATGGGTATCTC
TCGCGATTCGCTCCACAAGAGGAGGGCTACCGGTGGTAAGAAGAAGCAATGGAGGAAGAAGAGAAAGTACGAGCTGGGG
AGGCAGCCGGCGATGACCAAACTGGCGGCCAAGACGGTGCGGCGCATTCGTGTCCGTGGTGGCAACCATAAGCTCCGCG
CTCTGAGGCTGGACGCTGGGAACTACTCGTGGGGAACCGAAGCCGTGGCCCGGAAGACGAGGATCTTGGAGGTTGTCTA
CAACGCCTCCAACAACGAGCTCGTCCGGACCCAGACGTTGGTGAAGAGCGCCATCGTTCAGGTGGACGCGACTCCCTTC
CGCGCGTGGTACAACCAGCACTACGGCATCGACCTCTCCCGCAAGAAGAAGACTGCCGCCAAGAAGGAAAAGGAAGGCG
AGGAAGCTACGACCGAGGCAGCGACCGAAGAGGAGAAGCCGAGGAGCCAGAACGCGCTCCGAAAGCTTGCGAGGAGGGC
CGACGGCCACAAGATCGACCCGCACATTGAGGAGCAAATGGCGAGCGGGAGGCTCCTTGCGAGCATTGCGTCTCGCCCC
GGGCAGTGCGGGCGTGCGGACGGGTACATTCTGGAAGGTAAGGAGCTGGAGTTCTACATGAAGAAGATCCAgaag > SEQ ID NO:2777 215379 284685_200100_1
gggcggacgcgtgggcggacgcgtgggcttagctgcttttAGCTCTCAGCAACCATGGGTATCTCACGAGATTCTATGC
ACAAGAGGCGTGCCACTGGTGGCAAGAAGAAAGCTTGGAGGAAGAAGAGAAAGTATGAACTTGGCCGCCAGCCTGCTAA
TACTAAGATCTCGGCTAACAAGACAGTCCGACGAATTCGTGTGCGTGGTGGCAATGTGAAGTGGAGGGCACTGAGATTG
GATACAGGAAATTATTCATGGGGTAGTGAGGCAGTCACACGCAAGACTCGTATCCTTGATGTGGTTTACAATGCCTCAA
ACAATGAACTTGTTCGCACACAAACTCTGGTCAAGAGTGCTATTGTTCAAGTTGATGCTGCGCCATTTAAACAATGGTA
CCTCCAGCATTATGGTGTTGACATTGGTAGGAAGAAGAAGGGCCCTGCTAAGAAGGAAACTACTGAAGAAGGAGAAGGT
GCTGCTGCCGCTGCAGAGGAAACTAAGAAGAGCAACCATGTTCTCCGGAAGATTGAGACACGTCAGAAGGATCGTAAAC
TTGATCCTCATATTGAAGAGCAATTTGGTGGTGGTAGGCTGTTGGCCTGTATCTCTTCTCGCCCTGGTCAATGTGGCAG
AGCAGATGGGTACATTTTGGAGGGAAAAGAGCTTGAGTTCTACATGAAGAAACTACAGAAGAAGaaaggcaaGgCTgga
gctggtggTac > SEQ ID NO:2778 215379 258478_301696_1
agcactccacgacaaccATGGGTATTTCTCGAGACTCCCGACACAAGCGATCCCACACCGGCGCCAAGCGTGTCTCCAT
CCACAAGAAGCGAAAGTTCGAGTGCGGTCGACAGGGTGCCGTCACCCGAATCGGCCCCAAGCGAATCCACACCGTCCGA
ACCCGTGGTGGTAACAAGAAGTTCCGAGCCATCCGAATCGAGACCGGCAACTTCTCCTGGGGCTCTGAGGGAACCACCC
GAAAGACCCGAGTCCTCGGTGTCTCTTTCCACCCCTCCAACAACGAGCTTATCCGAACCAACACTCTGACCAAGTCTGC

FIG. 2 continued

CATTGTCCAGATTGATGCCACTCCTTTCCGACAGTGGTACGAGTCCTACTACGGCAAGTCTCTCGGCAAGAAGAAGGCT
GGCCAGGAGGAGCCCGTCATTGCTGAGGCTGACCAGGCTGCCGTTGCTGCCCGACAGGCTGATGCCAAGCTCGACCCTG
CCGTCGAGGCTCAGTTCGGTGCTGGCCGACTCTACGCCTGCGTTTCTTCTCGACCCGGTCAGTCCGGCCGAGTTGACGG
TTACGTTCTCGAGGGAGAGGAGCTTGCTTTCTACCTCAAGAAGATTGTCTCCAAGAAGTAGACACAAAACTAAAATGTA
TTATTGCACGTGAAAAaa

> SEQ ID NO:2779 215382 244351_301557_1
GGGTGCGAGGAGGAGGAGGCGGGCGCGATGAAGACGACCTTGTCGGCCCAGACGATGGACATCCCCGAGGGGGTGAAGG
TAGAGATCCGGGCGAAGCAGATCCGGGTGACGGGGCCGCGGGGGGTGCTGCACAGGAATTTCAAGCACCTCAACCTCGA
CTTCCAGCTGCTGGAGAATGGGCGCAAGCTCAAGGTGGAGGCGTGGTTTGGGTCGCGCAAGACCATCGCCGCCATCCGC
ACCGCCGTGAGCCACGTGAAGAACCTCATCACCGGCGTCACCAAGGGCTTCCAGTACAAGATGAGGTTTGTCTACGCTC
ACTTCCCCATCAACGCCAACATCTCTGCCACCAAGCAAAACATCGAGATCCGGAACTTCCTCGGCGACAAGAGGGTGAG
AACTGTCGACATGCTTCCGGGTGTGACT

> SEQ ID NO:2780 215382 258567_301697_1
CAACACAATGAAATTCATCCAGGGCGACGTTCTGCTCGATATCCCCGAGGGTGTCACCGTTGACATCAAGGACCGACAA
ATCATCGTCACCGGCCCCCGAGGTACCCTCAAGAAGAACCTGTCTCACATCAACGTAGCCTTCGCTAAAGGTCTCCGAT
GACCATATCAAGATCACCATCTACGATGGTGACCGAAGGCATGTCGCTGCTCTGCGAACCGTCAAGACCCTCATCAACA
ACATGATCACCGGTGTCACCCGATGTTACAAGTACAAGATGCGATACGTCTACGCCCATTTCCCCATCAACGTCAAGCT
CATTAAGGACGGTTCCGTCGTTGAGATCCGAAACTTCCTCGGTGAGAAGCGATTCCTCTAATTCCCCATCCACGAGGGC
TGCAGCGCTGAGATCTCTACCAACCAGAAGGATGAGATCTGCATCATCGGTAACTCCATCGAGAACGTCTCTCAGACCT
GTGCTGACATCCAGCAGATCTGGCGAGTCCGACACAAGGATATCCGAAAGTTCCTTGATGGTATCTACGTTTCCGAGAA
T

> SEQ ID NO:2781 215382 48461_300376_1
TTTTAGCGATCGCCATTTTCACACACACAGAAGGAGAGCGGAAGAGAGAAACTAAGACAAGATGAAGACCATTCTGTCA
TCAGAAACCATGGATATCCCCGACGGCGTGAGCATCAAGGTGAAGGCAAAGCAAATCGAAGTAGAGGGACCAAGGGGCA
AACTTGTCCGAAACTTCAAGCATCTCAACCTCGATTTTCAGCTGATCAAGGATGAGGAAACTGGCAAGAAGAAACTGAA
GATCGACGCTTGGTTTGGATCTCGTAAGACTACCGCTGCTATCCGTACTGCTCTTAGCCATGTTGAGAATCTCATCACT
GGTGTTACCAAAGGTTACCGCTACAAGATGCGTTTCGTGTATGCTCACTTTCCCATCAATGCCTCCATCACCGGTGGTA
ACAAGTCCATTGAGATCCGTAACTTCCTTGGCGAGAAGAGAGTTAGGAAAGTGGACATGCTTGATGGGGTAACAGTTGT
TCGATCTGAGAAGGTGAAGGATGAGCTTGTATTGGATGGAAATGACATTGAGCTCGTTTCTCGCTCTGCTGCCCTCATC
AATCAAAAATGCCATGTGAAGAACAAGGATATCCGAAAGTTTCTTGATGGTATCTATGTCAGTGAGaagggCAGAATTG
CAGAAGAAGAGTGAGCAGTTTAgaagtAggCAtatCACTTATGAttcacaTccagaatGCCcAttTTaC > SEQ ID NO:2782 215382 144606_200136_1
GCCGGTAGGCAGTAGTGAGCGCAGAAGCAGGGAGAGACACAAAAAATGAAGACTATACTCTCATCAGAAACGATGGATA
TCCCCGATGGGGTGAAAATCAAGGTAAAAGCAAAGCAAATAGAAGTGGAGGGACCAAGAGGAAAGCTAACCCGCAACTT
CAAGCACTTGAATCTTGATTTTCAGCTCATAAAAGATGAAGAAACTGGAAAGAAAAAGCTCAAGATTGATGCTTGGTTT
GGATCTCGTAAAACCACAGCTGCTATTCGCACTGCTCTTAGTCACGTTGATAATCTCATAACTGGTGTCACAAAAGGGT
ACCGTTACAAGATGCGTTTTGTTTATGCCCATTTTCCTATCAATGCTTCTATCACTGGTGGGAACAAGGCTATTGAGAT
CAGGAACTTTCTGGGCGAGAAAAGGGTGAGGAAAGTCGATATGCTTGATGGGGTTACTGTTGTGAGGCTGAGAAAGTT
AAGGATGAATTGGTATTGGATGGAAATGACATTGAGCTTGTTTCTCGGTCTGCTGCCCTCATCAATCAGAAATGCCATG
TGAAGAACAAAGATATTCGTAAGTTCCTGGATGGTATCTATGTGAGTGAGAATGGAATAATAGCCGAAGAAGAGTAAGT
TATAGCAGATTGGTTGGGGGTTGTTTGGGGATCATCTGCTGATTTCATACGAACTCATATTTGAAGTTAATTCAACA > SEQ ID NO:2783 215382 195865_300638_1
GACAACCCCCAAGTCACAGCAGCCATGAGGTACATTCACTCTCAGGAGATCCTGGAAATTCCAGAGGGCGTCAAGGTCA
ACATCAAGACCCGTATCGTCACCGTTGAGGGTCCCCGAGGCAAGCTCACCAAGAACCTCGGTCACTTGGCTGTCAACTT
CGGTCACCCCAAGAAGAACACCATCTCCATCGAGATCCACCACGGCAACCGTAAGAATGTCGCCACTCTCCGTACCGTC
CGCTCCATCATCGAGAACTTGATCACCGGTGTCACCAAGGGCTTCAAGTACAAGATGCGATACGTCTACGCCCATTTTC
CCATCAACGTCAACCTGGACAAGAACAAGGAGACCGGTCTGTTCGAGGTGGAGATCCGAAACTTCATCGGCGAGAAGAT
CGTCCGACGGGTTACCATGCACGAGGGTGTCGATGTTGAGATCTCCAAGGCCCACAAGGGATGAGCTCATCCTGACCGGC
AACTCACTCGAGAACGTTTCCCAGACGCCGCAGATATCCAGCAGATCTGCCGGGTGCGCAACAAGGATATCCGAAAGT
TCTTGgacggTCTGTACGTTTCCGAGAAGGGCAACGTTGTTGAGGAGGCTTAAATGTACCGGACAAGGATCTCTGTTTC
TTTTGCGTTtcTGGGACTCCGGAGTGGCGaaggTTCATCATTGCATGTCACGTAGCAACGGGCTACTCTTTTACAAAA
AATACATTAAAAAGTAttttgtaacaaaaaaaaaaa

FIG. 2 continued

> SEQ ID NO:2784 215387 137761_300686_1
gcccgccgcccgttgggaagggagcttCGAGGCGGCCGGCCGCGGCGCGTCGGCCGGGCCGGCTTGGCCGGTGGCACGG
GCCCTTGGGGGCTTGCGCCCCTAACGTGGGTCGGGGCGGGCGGCGGGCGCAGGCGCCGCTTGCTAGCTTGGATTCTGAC
TTAGAGGCGTTCAGTCATAATCCGGCACACGGTAGCTTCGCGCCACTGGCTTTTCAACCAAGCGCGATGACCAATTGTG
TGAATCAACGGTTCCTCTCGTACTAGGTTGAATTACTATCGCGGCACGGTCATCAGTAGGGTAAAACTAACCTGTCTCA
CGACGGTCTAAACCCAGCTCACGTTCCCTATTGGTGGGTGAACAATCCAACACTTGGTGAATTCTGCTTCACAATGATA
GGAAGAGCCGACATCGAAGGATCAAAAAGCAACGTCGCTATGAACGCTTGGCTGCCACAAGCCAGTTATCCCTGTGGTA
ACTTTTCTGACACCTCTAGCTTCAAACTCCGAAGGTCTAAAGGATCGATAGGCCACGCTTTCACGGTTCGTATTCGTAC
TGGAAATCAGAATCAAACGAGCTTTTACCCTTTTGTTCCACACGAGATTTCTGTTCTCGTTGAGCTCATCTTAGGACAC
CTGCGTTATCTTTTAACAGATGTGCCGCCCCAGCCAAACTCCCCACCTGACAATGTCTTCCGCCCGGATCGGCCCGAGG
GACTCCGGCCTTAGAGCCAAAAGGAGGGGCCAGGCCCCGCTTCCGACTCACGGAATAAGTAAAATAACGTTAAAAGTAG
TGGTATTTCACTTGCGCCCGAGGGCTCCCACTTATCCTACACCTCTCAAGTCATTTCACAAAGTCGGACTAGAGTCAAG
CTCAACAGGGTCTTCTTTCCCCGCTGATTCCGCCAAGCCCGTTCCCTTGGCTGTGGTTTCGCTGGATAGTAGACAGGGA
CAGTGGGAATCTCGTTAATCCATTCATGCGCGTCACTAATTAGATGACGAGGCATTTGGCTACCTTAAGAGAGTCATAG
TTACTCCCGCCGTTTACCCGCGCTTGGTTGAATTTCTTCACTTTGACATTCAGAGCACTGGGCAGAAATCACATTGCGT
CAGCATCCGCGAGGACCATCGCAATGCTTTGTTTTAATTAAACAGTCGGATTCCCCTTGTCCGTACCAGTTCTGAGTCG
GCTGTTCGACGCCCGGGGAAGGCCCCCGAGGGGGCCGTTCCCGGTCCGTCCCCGGCCGGCACGCGGCGGCCCGCTCTC
GCCGCGCGAGCAGCTCGAGCAGTCCGCCGGCAGCCGACGGGTTCGGGGCCGGGACCCCGAGCCCAGCCCTCAGAGCCA
ATCCTTTTCCCGAAGTTACGGATCCGTTTTGCCGACTTCCCTTGCCTACATTGTTCCATTGGCCAGAGGCTGTTCACCT
TGGAGACCTGATGCGGTTATGAGTACGACCGGGCGTGGACGGTACTCGGTCCTCCGGATTTTCAAGGGCCGCCGGGGGC
GCACCGGACACCGCGCGACGTGCGGTGCTCTTCCGGCCGCTGGACCCTACCTCCGGCTGAACCGTTTCCAGGGTTGGCG
GGCCGTTAAGCAGAAAAGATAACTCTTCCCGAGGCCCCCGCCGGCGTCTCCGGACTTCCTAACGtcgCCGTCAACCGCC
ACGTCCCGGCTCGGGAAATCTTAACCCGATTCCCTTTCGGGGCACGCGCGTGGTCGCGCTCTCTGCCGGGGTTACCCCg
tcCCTTAGGATCGGCtTaccCATGTGCAAGTGCCGttcacATGGAa > SEQ ID NO:2785 215387 29693_300154_1
CGGACGCGTGGGCGGACGCGTGGGCGGAATTCGAAGCTAGAGGTGTCAGAAAAGTTACCACAGGGATAACTGGCTTGTG
GCAGCCAAGCGTTCATAGCGACGTTGCTTTTTGATCCTTCGATGTCGGCTCTTCCTATCATTGTGAAGCAGAATTCACC
AAGTGTTGGATTGTTCACCCACCAATAGGGAACGTGAGCTGGGTTTAGACCGTCGTGAGACAGGTTAGTTTTACCCTAC
TGATGACAGTGTCGCAATAGTAATTCAACCTAGTACGAGAGGAACCGTTGATTCGCACAATTGGTCATCGCGCTTGGTT
GAAAAGCCAGTGGCGCGAAGCTACCGTGCGCTGGATTATGACTG > SEQ ID NO:2786 215405 205202_300797_1
TTGTAGTGCCAGCACCGTCAATTGCCGGGTTTTTGTACGGTCACCGCTCAAGGGCTTCCTCGCCGCAGTCACGATGAAG
AACGGGCTATTACCACCCTTGCGATTCCTTCGCAGCACCAGCTTCCTGGGCGCAAACCAGGCACGATGGCTTCACAAGA
CGAGGCCGGCTCCGACAATCCCACAGCCTAGACCATTCGTCCCCGACGTCCAGACCTTCCTCACGCTCATTGGCCGCGG
CCTCAACAAGCACGCCTCCAAGTTCCCGTCATGGGAGTCTCTCTTCTCCCTCACCTCGCCACAACTCAAGGAGCTTGGA
ATCGAGCCTCCCCGCAGCCGCAGATACCTGCTGCAGTGGATGCAGCGATACCGAAAGGGTGCGCTGGGACCTGGCGGAG
ACTTCAAATACGTCACAGACGGCCAAGCTCTGCTGAAAGTAGCAACACCACCGGCCTCTGTTGTCAGCGATGCGAAATA
TGTGGTCAATGTGCCTCAAGACCAGGAGGCAGGTCTGGGGGATTCTGAAATCCTTCCTCGACCCAATGGCTACACAGTT
AGAGGACTCAAGTCAATAGCGGGGCCGTTTGCGACACCCTTgcCGCAACAggccGgTGCAGTCGTCAAAGTTACGGAGG
GCATGTGGGAGCAACGCCAAGGACGCAAGATTGATGGTGGTGAGAGAcaagggcGgagattcgcTTCaagagacggT > SEQ ID NO:2787 215420 1110134_301527_1
GGTGAAGGAGCTCTCTGTAAATCAAAGGAGGGGGTTAGCCATGGCCAAGGTGTATCCTGCTGTGAGTGAAGAGTACAAA
GTCGCAGTAGACAAGGCGAAGAGGAAGCTCCGAGCAATGATAGCGGAGAAGAACTGTGCCCCCCTCATGGTCAGGATTG
CCTGGCATAGTGCTGGAACCTATGATGTCAAAACCAAGACTGGTGGCCCCTTTGGGACTATGAAAAATGCAAGTGAACT
CGCCCATGGGGCCAATGCAGGCCTTAATAAGGCTGTTGCCCTCCTTGAACCAATCAAGGAACAATACCCCATTCTATCC
TATGCAGACTTTTATCAGCTTGCTGGAGTAGTTGCTGTGGAGGTAACTGGAGGGCCTGACATTCCCTTCCACCCTGGAA
GAGAGGATAAAACTGAGAGCCCAGAGGAGGTCGTCTTCCAGATGCTACCAAAGGGCCGAGTCACTTGCGTGATGTGTT
TGGTCACATGGGCTTGGGAGACAAGGAGAttgTTGCCCTCTCAGGAGCCCATACCCTGGGTCGTTGCCACAAAGATCGT
TCTGGATTTGAAGGGCCATGGACGACAAATCCCCTTTTATTTGACAACTCCTACTTCACTGAATTGCTTACTGGTGAGA
AGGAAGGACTGATCCAGCTCCCTTCT > SEQ ID NO:2788 215420 179507_300561_1
ATCAAGATGGCCTCTTCCGGCCGTCAGTTCGCCCGCGTGGCAACCCGCACAACCACCCGCTCCTTCGCTGCCGTCCCCC
GACAGGCTTTCCGCCAGCAGGGTCGCCGCTTCTACTCTTCTGAGCCCGAGAAGAAGTCATCCTCCTCTCCTGTACCT
TGGTGCTGCCGCCGCCGCCGGTGGTCTCGGCATCTGGTTCTTCACCTCTGGTGCCTCTGCCTCTTCCAAGACCTTTGTC
CCCACCCAGGCCGATTACCAGAAGGTCTACAACGACATCGCCGAGCGTCTCGATGCCGATTATGATGATGGCAGCTACG

FIG. 2 continued

GCCCCGTCCTGGTCCGTCTTGCATGGCACTGCAGCGGTACCTACGACAAGGAGACCAAAACTGGTGGCAGTAACGGTGC
TACCATGCGATTCGCTCCCGAGAGCGGCCACGGTGCCAACGCCGGTCTGATTGCTGCTCGTGACTTCCTCGAGCCTATC
AAGGCCAAGTATCCCTGGATCTTCCTACTCTGATCTCTGGATCCTCG

> SEQ ID NO:2789 215420 144692_200136_1
TTTCCTCCAGCAATGGCGAAGCCAATCGTCGACACGGAGTACCTCAAAGAAATTGAGAAAGCTCGTCGCGACCTCCGCG
CTCTCATCTCCAGCAAAAACTGTGCTCCTATCATGCTTCGCTTAGCATGGCACGATGCAGGAACGTACGATGCTAAGTC
TAAGACCGGTGGACCGAATGGTTCCATCAGAAATGAGGAAGAGTTCAGTCACGGTGCTAATAATGGATTAAAAATCGCT
CTTGACTTTTGCGAAGCAGTGAAGTCTAAACATCAAATGATAACGTATGCAGATTTGTACCAGCTTGCAGGAGTTGTTG
CAGTTGAAGTCACTGGTGGTCCGACCATTGATTTTGTCCCTGGTAGGAAGGATTCCAGTGTTTCTCCAAAGGAAGGACG
GCTGCCAGATGCTAAACAAGGTGTGCCACATCTGAAAGATGTATTTTATAGGATGGGTTTGTCTGACAAAGATATAGTG
GCACTATCTGGTGGTCACACACTGGGAAGGGCACATCCAGATAGATCAGGCTTTGATGGTCCATGGACAAAGGAGCCAC
TGAAATTTGACAATTCATATTTTGTGGAGCTGCTTAAGGGGAAACTGAGGGCCTGCTGAAACTTGCTACAGACATAGC

> SEQ ID NO:2790 215420 225160_300984_1
agaggaggcgagaggcgagaggaGAGGACGCATTCTTGGATCTAGATCGACAATCAGAATGGGCAAATCTTATCCTGCA
GTGAGCGACGAGTACCTGGCCGCCGTCGACAAGGCCAAGAGAAAGCTTCGCGGCTTCATCGCAGAGAAGAACTGTGCCC
CATTGATGCTTCGTCTTGCATGGCATTCGGCCGGGACTTTCGACTGTGCGTCCAAGACGGGTGGTCCCTTTGGAACCAT
GAAGCACGCCGAAGAACTCGGCCACGGCGCGAATGCCGGCCTCGACATCGCTATCAAGCTTCTCCAGCCGATTAAAGAC
CAGTTTCCGGTCCTGAGCTATGGCGACTTCTACCAGCTTGCTGGGGTCGTCGCAGTGGAGATCACTGGAGGCCCGGATA
TTCCATTCCATCCGGGGAGAGTGGACAGGGAGACATGCCCCGTAGAGGGCCGGCTTCCAGACGCGACCAAGGGAGCCGA
TCATCTCCGTGACGTTTTTGTGAAGCAAATGGGGCTCTCTGACAAGGACATTGTGGCTCTTTCTGGCGGTCACACTTTG
GGAAGAGCACACAAGGAAAGGTCGGGTTTTGAGGGCCCATGGACGCACAACCCTCTCCAGTTTGACAACTCCTACTTCA
CACTTCTGCTGAGCGGCGAGCAAg > SEQ ID NO:2791 215420 139236_300408_1
CGAGTACTAGTCACACCACACGCTTGGCTTGACGCCGCACGCCTCCGCTCCGCTCCGCCGCCGCGGCCGATCTCTCTAG
GGCTTCCAACCTCGCCGGCGACGCGACGCCACGCCATGGCAGCCCCGGTCGTGGACGCCGAGTACCTCCGCCAGGTCGA
CAGGGCGCGCCGCCACCTCCGCGCCCTCATCTCCTCCAAGGGATGCGCGCCCATCATGCTCCGCCTCGCATGGCATGAC
GCGGGCACTTATGACGTGAACACAAAAACTGGTGGTGCAAATGGTTCAATTAGATACGAGGAAGAGTACACTCACGGTT
CAAATGCTGGTCTAAAGATTGCTATTGATCTTCTCGAGCCTATTAAAGCCAAGAGCCCTAAGATCACATATGCTGACCT
TTATCAGCTTGCTGGAGTTGTTGCAGTTGAAGTTACTGGGGGTCCAACTGTTGAGTTCATTCCTGGAAGACGTGATTCG
TCAGTTTGCCCCCGTGAAGGGCGTCTTCCTGATGCTAAGAAAGGTGCACTGCACTTGAGGGACATCTTTTACCGGATGG
GCTTATCAGACAAAGATATAGTAGCTTTATCTGGGG > SEQ ID NO:2792 215420 122103_300016_1
CCCGGCCCAAGCCTTTCGAGTCGTCTTCTCCCCTTCTTCTCCTCCTCCTCCTCGATTCGGAGCTCCACCCGCAGCCATG
GCTAAGAACTACCCCGTCGTGAGCGCCGAGTACCAGGAGGCCGTCGAGAAGGCCAGGCAGAAGCTGCGCGCCCTCATCG
CCGAGAAGAGCTGCGCCCCTCTCATGCTCCGCCTCGCGTGGCACTCGGCGGGGACGTTCGACGTGTCGTCGAAGACCGG
GGGCCCGTTCGGGACGATGAAGACCCCCGGCGGAGCTGTCGCACGCCGCCAACGCGGGGCTGGACATCGCGGTGCGGATG
CTCGAGCCCATCAAGGAGGAGATACCCACCATCTCCTACGCCGATTTCTACCAGCTTGCCGGAGTTGTGGCCGTCGAGG
TGTCCGGTGGACCTGCCGTCCCCTTCCACCCAGGAAGGGAGGACAAACCTGCACCCCCACCTGAGGGCCGTCTTCCTGA
TGCTACCAAGGGTTCTGACCACCTAAGGCAGGTCTTCGGTGCGCAGATGGGCTTGAGTGATCAGGACATTGTTGCCCTC
TCTGGCGGTCACACCCTGGGAAGGTGCCACAAGGAAAGATCTGGTTTTGAGGGACCTTGGACAAGAAACCCTCTGCAGT
TTGACAACTCTTACTTCACGGAGCTTCTGAGTGGTGACAAGGAGGGCCTTCTTCAGCTTCCTAGTGACAAAGCCCTGCT
GAGTGACCCTGCCTTCCGCCCACTCGTCGAGAAATATGCTGCAGATGAGAAGGCTTTCTTTGAAGACTACAAGGAGGCC
CACCTCAAGCTctccgaactgggggttcgctgatgctgcgccgcttatccgtatgatgttccggattatgccgagcatct
acaaacagct > SEQ ID NO:2793 215420 120907_300518_1
cccacgcgtccgcccacgcgtccgcttctcccccttcttctcctcctcctcgattcggagctccacccgcagccatggcg
aAGAACTACCCCGTCGTGAGCGCCGAGTACCAGGAGGCCGTCGAGAAGGCCAGGCAGAAGCTGCGCGCCCTCATCGCCG
AGAAGAGCTGCGCCCCTCTCATGCTCCGCCTCGCGTGGCACTCGGCGGGGACGTTCGACGTGTCGTCGAAGACCGGGGG
CCCGTTCGGGACGATGAAGACCCCGGCGGAGCTGTCGCACGCCGCCAACGCGGGGCTGGACATCGCGGTGCGGATGCTC
GAGCCCATCAAGGAGGAGATACCCACCATCTCCTACGCCGATTTCTACCAGCTTGCCGGAGTTGTGGCCGTCGAGGTGT
CCGGTGGACCTGCCGTCCCCTTCCACCCAGGAAGGGAGGACAAACCTGCACCCCCACCTGAGGGCCGTCTTCCTGATGC
TACCAAGGGTTCTGACCACCTAAGGCAGGTCTTCGGTGCTCAGATGGGCTTGAGTGATCAGGACATTGTTGCCCTCTCT
GGCGGTCACACCCTGGGAAGGTGCCACAAGGAAAGATCTGGTTTTGAGGGACCTTGGACAAGAAACCCTCTGCAGTTTG
ACAACTCTTACTTCACGGAGCTTCTGAGTggtgACAAGgAgggCcttCTTCagcttCC

FIG. 2 continued

> SEQ ID NO:2794 215420 230081_301053_1
GAGGAGAGGGAGAGAATGCCGGTGCCGGTGGTGGACAATGCGTACCTCAAGGCGATCGAGTCGGCGAGGCGCGATCTCC
GCGCGTTCATTGCGGAGAAGAATTCCGCGCCACTGATGCTTCGATTGGCATGGCACGATGCCGGGACGTATGATGCTGT
GTCCAAGACTGGAGGACCGAATGGATCGATCCGGAGCGAGCGCGAGTATACCCACGCTGCCAACAATGGGATCAAAATC
GCCATAGACTTTTGTGAGCCTATCAAACAGAAATATCCCATTATCACGTATGCTGATCTCTACCAGCTTGCTGGCGTTG
TTGCTGTGGAAGTCACTGGAGGTCCTACAATAAATTTTGTTCCTGGCCGCAAGGAATCGGTCGCTACTACACCCGAAGG
ACGGCTTCCCGATGCTCATCTCGGGGCAAAGCATATCCGCGATGTCTTCTACAGAATGGGTCTATCTGACAAGGATATC
GTCGCTCTCTCTGGTGGTCACACACTGGGTAGAGGACACAAGGAAAGGTCTGGGTTTGAGGGACCCTGGACATCGCAGC
CATTGAAGTTCGACAATTCATACTTCACGGAGCTTTTGAGAGGAGAATCGGAAGGCCTGTTGCAGTTGCCGACAGACAA
GTGCTTGCTTGAGGATCCATCGTTCCGTCCATACGTGGAGCTGTATGcaaaGGacgaagaCGcattcttcaaAGAttaC
gCCGAGTCGCAcaagaagctAtCCga > SEQ ID NO:2795 215420 254329_301632_1
GTGATTTTCTGTCGACGGTGAAGGAGCTCTCTGTAAAAATCAAAGGAGGGGGTTAGCCATGGCCAAGGTGTATCCTGCT
GTGAGTGAAGAGTACAAAGCCGCAGTAGATAAGGCAAAGAGGAAGCTCCGAGCAATGATAGCGGAGAAGAACTGTGCCC
CCCTCATGGTCAGGATTGCCTGGCATAGTGCTGGAACCTATGATGTCAAAACCAAGACTGGTGGCCCCTTTGGGACTAT
GAAAAATGCAAGTGAACTCGCCCATGGGGCCAATGCAGGCCTTAATAAGGCTGTTGCCCTCCTTGAACCAATCAAGGAA
CAGTACCCCATTCTATCCTATGCAGACTTTTATCAGCTTGCTGGAGTAGTTGCTGTGGAGGTAACTGGAGGGCCTGACA
TTCCCTTCCACCCTGGAAGAGAGGATAAAACTGAGAGCCCAGAGGAGGGTCGTCTTCCAGATGCTACCAAAGGGCCGAG > SEQ ID NO:2796 215420 255646_301644_1
GAGAGAGAGAGAGGGAGGAAAGAGGAAGAAGAAGAGGATGGCGCCTCCAGTTGTAGATGATGCCTACCGCGGAGCCATC
GGGAAGGCCCGCCGTGACCTCCGCGCCTTCATTGCCGAGAAGAACTGCGCTCCCATCATGCTCCGCCTTGCATGGCACG
ATGCTGGTACCTATGATGCCAAAACAAAAACTGGTGGTGCAAATGGATCAATACGACCTGAGCAGGAACTTCTCCATGG
GGCAAATAGTGGTTTGAAAATAGCCATTGATTTTGTGAAACACTGAAGGTGAAGTATCCAGCTATCACATATGCTGAC
TTTTACCAGCTGGCTGGTGTAGTTGCAGTTGAGGTTACTGGAGGACCCACAGTTGAATTCATTCCTGGTCGTAAGGATT
CCCTG > SEQ ID NO:2797 215420 30206_300393_1
cccacgcgtccgccagatttttattatccttcctcgaaacgagatccacgattcgttgctgcgatcggcgttattatcgt
cAGCTCTCTCGTTTCTGTTCTGTGGTTCGATATTGCTGAGTTTCTAGGCTAATCTTACGAATCTGTGAAAGTTTTTGAG
AGATTTGGCTTCTGTAGCTCACTCCTGCTTGATTTAGAGCTTAGCTAAGCATGACGAAGAACTACCCAACCGTGAGCGAA
GATTACAAGAAGGCTGTTGAGAAGTGCAGGAGGAAGCTCAGAGGTTTGATCGCTGAGAAGAACTGTGCACCCATCATGG
TCCGACTCGCATGGCACTCTGCTGGAACTTTCGATTGTCAATCAAGGACTGGAGGTCCATTCGGAACAATGAGGTTTGA
CGCTGAGCAAGCTCATGGAGCCAACAGTGGTATCCACATTGCTCTTAGGTTGTTGGACCCCATCAGGGAGCAATTCCCT
ACCATCTCTTTTGCTGATTTCCATCAGCTTGCTGGTGTTGTGGCCGTTGAAGTTACTGGTGGCCCTGACATTCCTTTCC
ACCCTGGAAGAGAGGACAAGCCCCAACCACCTCCaGaGGGTCGTCTTCCTGATGCTACCAAggGTTGTGaccatTTGAG
AGATGTCTTTGCTAaGcAGATGGGCTTATCTGACAAAGACAtTgTCGCTTTATCTGgtgCCCACACTCTGGGACGATGC
CACAaggATAGGTCTggcttcgaaggtgCATggACATCAAACCCTCTaaTCTTCGACAACTCtTACttcaagGaaCTCt
tgagc > SEQ ID NO:2798 215422 218515_300967_1
cccacgcgtccgcccacgcgtccgcccacgcgtccgcccacgcgtccgcccacgcgTCCGCCCACGC
GTCCGAGAAATCAATTACAATCCCTCAATCCAGTCGCGTCAGACGCCCGCTTATCCAGACTCTCTCTCTCTCAAATCAC
AGTCGAACACGTTCTTCGCACCATCCACAGCCATGCCTCCCAAGAAGACCGAAGGTGCTGCCCCCAAGGCCAAGTCTGG
CGCTGCCCATGCCAGCTACCAGGACATGATTACGGATGCCATTCTCAATCTCAAGGATCGCAATGGCTCTAGCCGTCAG
TCTCTGAAGAAGTACGTCAAGGCCAACAACACCTTGAACGTTTCGGACAACATGTTCGATTCTCTCTTCAACAAGGCCC
TCAAGGCCGGTGTTGAGAAGGGCATCTTCGCCCAGCCCAAGGGCCCCTCTGGAGGCACCAAGCTGGCCAAGAAGAAGCC
CGAGGCCAAGAAGGCTGCCGCTCCCAAGAAGGAGAAGGACGCCACTGCTAAGAAGGCCACTGCCACCAAGAAGGCCGCC
GCCCCCAAGAAGGCCAAGGAGGGCGCCGAGAAGAAGGAAAAGAAGGAGAAGAAGGAGGGCGCTGCCACCAAGAAGGCTG
CTGCTCCCAAGAAG > SEQ ID NO:2799 215431 104809_300366_1
CCCACGCGTCCGCCCACGCGTCCGCCCACGCGTCCGCCATGAGAGAAATTAAGGTCCAGAAGCTCGTTCTCAATATCTC
CGTCGGTGAGAGCGGAGATCGTCTCACCAGAGCAGCTAAGGTCTTGGAGCAGCTTAGCGGCCAATCCCCTGTTTTCTCC
AAGGCTAGGTATACTGTGCGGTCTTTTGGAATCAGGCGTAATGAAAAGATAGCTTGCTATGTAACTGTCAGAGGGGAGA
AAGCTATGCAGCTACTTGAGAGTGGATTGAAAGTTAAGGAATACGAGTTGTTGAGAAGGAACTTCAGTGAGACCGGCTG
CTTTGGGTTTGGTATTCAGGAGCACATTGATCTTGGAATTAAATATGATCCGTCAACTGGTATTTATGGCATGGACTTC

FIG. 2 continued

TATGTTGTATTGGAGCGTCCTGGATACCGTGTTGCCCGTCGGCGCAGGTGCAAGTCTCGAGTTGGGATTCAGCACAGAG
TCACAAAGGAGGATGCGATGAAGTGGTTCCAGGTCAAATATGAAGGTGTTATCCTTAACAAGTCCTCAAACATTCAGTG
ATAAGCTTAGAA

> SEQ ID NO:2800 215431 226395_300996_1
AAAAATGACTGACTCCTCTGCCAACCCCATGCGAGAGCTGCGAATCGAGAAGCTCACCCTCAACATTTGTGTTGGTGAG
TCCGGTGATCGACTTACCCGAGCCGCCAAGGTGCTCGAGCAGCTTTCCGGTCAGACCCCCGTCTACACCAAGGCCCGAT
ACACCATCCGATCTTTCTCTATCCGACGAAACGAAAAGATTGCCGTCCACGTGACCGTCCGAGGCCCCAAGGCTGAGGA
GATTCTCGAGCGAGGCCTCAAGGTCAAGGAGTACGAGCTCAAGGCCAAGAACTTCTCTGAGACTGGTAACTTCGGTTTC
GGTATCAACGAGCACATCGACCTTGGTATCAAGTACGACCCCAACATCGGTATCTACGGTATGGACTTCTTCGTCATCA
TTGGTCGACCCGGTTACCGAgTtgCCCGACGAAAGCCATGCCGAGCTTCCGTTGGTATCAACCACCGAGTCACCAaGGA
GGACACCATCAAGTGGttCAAGCAGAAGTACGACGCTTCCGTCCTCTAAGCGGGTcATtTttGtATCAtatcctcaccC
ATCATGCAAaaATAAtCCA > SEQ ID NO:2801 215431 220409_300955_1
GACGCAGCAGCAGACCACGTCGCAAAACAACCGCAGCAATGGCCGCCGAAAAGTCCAGCAACCCCATGCGGGAGCTTAA
GATTCAGAAGCTCGTTCTGAACATCTCCGTCGGTGAATCTGGTGACAGACTCACTCGTGCCGCCAAGGTGCTTGAGCAG
CTGTCTGGTCAAACCCCCGTCTACAGCAAGGCCCGTTACACCGTCCGTACCTTTGGTATCCGCCGTAACGAAAAGATTG
CTGTCCACGTCACCGTCCGCGGCCCCAAGGCTGAGGAGATTCTCGAGCGTGGCCTCAAGGTCAAGGAGTACGAGCTTCG
CAAGCGCAACTTCTCCGAGACTGGCAACTTCGGCTTCGGTATCAGCGAGCACATCGATCTTGGTATCAAGTACGACCCT
TCCATCGGTATCTACGGCATGGACTTCTACTGCTGCATGACCCGCCCGGTGAGCGTGTCACCCGCCGCCGCCGCATGA
AGAGCAGAATCGGTGCTTCTCACCCGCATCAAGCGCGATGAGACCGTCAAGTGGTTCAAGGGCCGCTTCGATGGCATTGT
CCGATAAACGGTTTAAAATCCAAACCGAATAAAATACTTTTTTTTTCTTGTCTTGAAGGAAATGGGCATGGCGAACATT
TGGGGGtacaaagGATCATATggtCCATGTATTCTTCCGCTTGAttTTTACATCAGCTCgtaccaaaattttttgAGTCG
agcAAcggCCTGAgagaccgaccggCGCTATGCcggcttcAcA > SEQ ID NO:2802 215431 187284_300675_1
GCAGTCGAACCCGATGCGGGAGATCAAGGTGCAGAAGCTCGTGCTCAACATCTCCGTCGGCGACAGCGGGGACAGGCTC
ACCCGCGCCTCCAAGGTGTTGGAGCAGCTGATTGGGCAGAGCCCAGTTCTCTCCAAGGCGAGGTACACCGTGAGGTCAT
TCGGTATCCGTCGTAACGAGAAGATCGCTGTCCACCGTCAGGGGTCGATAATGCCATGCAGCTTTTGGAGAGTG
GCCTCAAGGTCAATGAGTACGATCTGCTGATGAGGAACTTCAGCTAGACCGGATGCTTCGGGTTCGGTATCCAATAGCA
CATTGATCTTGGCATCAAGTACGACCCGTCAACTGGTATTTATGGGATGGACTTCTATGTTGTTCTTGAGCGTGCTGGA
TACCGTGTTGCTCGCCGGCGCAGGTGCGAGTCCCGTGTTGGAATCCAGCACAGGGTGACCAATGAAGATGCCATGAAGT
GGTTCCAGGTCACGTATGAGGGTGTCATCCTCAAC > SEQ ID NO:2803 215431 155570_301357_1
GAATCGAAATGGCTTCAGAGAAGAAGTTGAGCAACCCAATGAGGGAAATCAAGGTTCAGAAGTTAGTCCTTAACATCTC
TGTTGGTGAAAGCGGAGATAGGCTCACCAGAGCAGCCAAGGTCTTGGAGCAACTCAGCGGCCAATCCCCTGTTTTCTCT
AAGGCTAGGTATACTGTCCGGTCCTTCGGAATTAGGCGTAATGAGAAGATTGCTTGCTATGTCACTGTcAGAGGAGACA
AAGCTATGCAGCTCCTTGAGAGTGGATTGAAAGTCAAGGAATACGAGTTGTTGAGAAGAAACTTCAGTGAGACTGGCTG
CTTTGGTTTTGGCATTCAGGAGCACATTGATCTTGGAATCAAGTATGACCCTTCAACCGGTATCTATGGTATGGATTTC
TATGTTGTGCTTGAGCGCCCAGGATACCgtgTTGCTCGTCGTAGGAGGTGCAAGGCCCGAGTTGGAATTCAGCACAGGG
TCACAAAGGATGACGCTATGAAGTGGTTCCAAGTCAAATATGAAGGTGTTATCCTTAACAAATCCTCAAACATTCAGTA
AGTTGATTGTGGATCAGtttgtcCCCcagcaagttTATGTTTTCTATGCATTttgtagacCAAcatttaATACTCCtag
agttcaaAGGTTTTGAAGAGTTgctgttatttggcatATCAGGATAt > SEQ ID NO:2804 215431 128352_300475_1
CCCCCCCCCCGTTTTGGATCTTCTTCGCGCCATCAGTACCCTACAACTCTCCCTGCAGCTGCAACATCTTCCAGCAGAA
TTGCGATGGCTTCAGAAAAGAAACTGAGCAATCCCATGAGGGAAATCAAGGTTCAGAAGCTTGTCCTTAACATCTCCGT
TGGTGAGAGTGGAGATCGACTTACTAGAGCTGCAAAGGTGTTGGAGCAACTTAGTGGTCAATCACCTGTTTTTTCTAAG
GCAAGGTACACTGTGAGGTCCTTCGGAATCAGGCGTAATGAAAAGATAGCTTGCTATGTGACTGTCAGAGGGGAGAAAG
CCACGCAGCTACTTGAGAGTGTATTGAAAGTCAAGGAATATGAGTTGTTGAGAAGGAACTTCAGTGAAACCGGCTGTTT
TGGGTTTGGTATTCAGGAGCACATTGATCTTGGGATCAAATATGACCCTTCAACTGGTATTTATGGTATGGATTTCTAT
GTTGTGTATTGGAGCGCCCTGGATACCGTGTTGCTCGTCGTCGTAGGTGCAAGTCTCGAGTTGGGATCCAGCACAGGGTCA
CGAAGGAGGATGCAATGAAGTGGTTCCAGGTCAAATAT > SEQ ID NO:2805 215431 1118003_301852_1
gggcCAGGGATAGAGAGGAGGAGAGTCTGTCGTTGTACCAGGAGGAGGAGGAGGACGAGTAGGAGGAGTCCTAGGGTTT
AGTAGAAGACAGCAACCATGGTGGCCGCGGAGAAGAAGCTGTTGAACCCCATGAGGGAGATCAAGGTGCAGAAGCTCGT

FIG. 2 continued

```
CCTCAATATCTCCGTTGGTGAGAGTGGTGATCGCCTTACCAGGGCTGCTAAGGTGTTGGAGCAATTGAGTGGACAGACT
CCTGTCTTCTCGAAAGCTAGATACACTGTGCGTTCATTCGGTATCCGCCGTAATGAAAAGATTGCATGCTATGTGACTG
TCAGAGGAGAGAAGGCAATGCAATTGCTAGAGAGTGGCTTGAAAGTCAAGGAATACGAGTTGCTGCGCAGGAATTTCAG
TGACACTGGTTGCTTTGGCTTTGGAATTCAGGAGCACATTGATTTGGGAATCAAGTATGACCCATCGACAGGTATCTAT
GGTATGGATTTCTTTGTAGTTCTGGAGAGGCCAGGATTCAGAGTTGCGAGGAGAAAGAGGGCGCAGGCACGTGTTGGCA
TTCAGCAAAGGGTAACGAAGGAGGATGCCATGAAGTGGTTCCAAGTCAAATATGAAGGAGTCATTCTCAACAAGTCCTC
CAACATCAGTTAGTTAGTTATCTATCTAACTgccTGCAGGCTTTGtaggacaaAATtagTG > SEQ ID NO:2806 215431 231594_301231_1
cgacCCACGCGTCCGAACTTCATCACCAGGTCGACTAATAACAGCAGCCATGGCTTCCGAGAAGGCAAACAACCCCATG
CGGGAGCTTAAGATTCAGAAGCTCGTTCTGAACATCTCCGTCGGAGAGTCTGGTGACAGACTTACCCGAGCCGCCAAGG
TCCTTGAGCAGCTTTCTGGTCAAACCCCCGTCTACAGCAAGGCCCGTTACACCGTCCGAACTttCGGTATTCGACGTAA
CGAAAAGATCTCTGTCCACGTCACCGTCCGAGGCCCCAAGGCTGAGGAGATTCTCGAGCGTGGCCTCAAGGTCAAGGAG
TACGAGCTCCGCAAGCGCAACTTCTCCGAGACCGGCAACTTCGGTTTCGGTATCAGCGAGCACATCGATCTCGGTATCA
AGTACGACCCCTCCATTGGTATCTACGGCATGGACTTCTACTGCTGCATGACCCGACCTGGTGAGCGTGTCACCCGCCG
TCGCCGAACAAAGACCAAGATCGGTGCCTCTCACCGCATCAAGCGTGAGGAGAGCATCAAGTGGTTCAAGTCTCGCTTC
GATGGTATCGTCCGATAAACGGTTGAAAACAAAATGGGTATTTGAATTTGCGGAtTgGGTCACGGCGAAAATAAGGGGA
AAACTCACATGGGGCATGTATTTTCtgttgCCATTgctgcatcaGCTCGACTCTTTTAGtCgag > SEQ ID NO:2807 215431 254985_301640_1
GGGGATATTGAGGAGGAGAGTCTGTCGTTGTACCAGGAGGAGGAGGAGGACGAGTAGGAGGAGTCCTAGGGTTTAGTAG
AAGACAGCAACCATGGTGTGCCGCGNGAGAAGAAGCTGTTGAACCCCATGAGGGAGATCAAGGTGCAGAAGCTCGTCCT
CAATATCTCCGTTGGTGAGAGTGGTGATCGCCTTACCAGGGCTGCTAAGGTGTTGGAGCAATTGAGTGGACAGACTCCT
GTCTTCTCGAAAGCTAGATACACTGTGCGTTCATTCGGTATCCGCCGTAATGAAAAGATTGCATGCTATGTGACTGTCA
GAGGAGAGAAGGCAATGCAATTGCTAGAGAGTGGCTTGAAAGTCAAGGAATACGAGTTGCTGCGCCAGGAATTTCAGTG
ACACTGGTTGCTTCGGCTTTGGAATTCAGGAGCACATCGATTTGGGAATCAAGTATGACCCATCGACAGGCTATCTATG
GTATGG > SEQ ID NO:2808 215431 50472_300171_1
AACCCCTAATCTTGAGATGGCATCGGAGAAGAAGCTCTCGAACCCTATGAGGGATATTAAGGTCCAGAAGCTAGTTCTT
AACATCTCTGTTGGTGAGAGTGGTGATCGTCTCACTCGTGCCTCCAAGGTGTTGGAACAGCTCAGTGGTCAGACTCCTG
TCTTCTCTAAGGCGAGGTACACTGTGAGGTCTTTCGGTATCAGGCGTAATGAAAAGATTGCGTGCTATGTCACCGTGAG
AGGTGAGAAGGCAATGCAGCTTCTTGAGAGTGGCTTGAAAGTGAAGGAATACGAGCTGTTGAGGAGGAACTTCAGTGAC
ACTGGCTGCTTCGGATTCGGTATCCAGGAGCACATTGATCTTGGAATCAAGTATGAT > SEQ ID NO:2809 215445 108017_300057_1
CAAAAAGAGAAACAAATCGATCGATCGAAAATGGCGGAATTGAGTGGACTGAAACTGGAGCAGAGGCATGGAAAATCCA
GAGTGAGAGTAGCCAGGGTTTGGAAAAGTCACGATGGGAAGCATCACTTTGCTGAATGGAGTGTTAACATTAGCCTCCT
CTCCGATTGTTTACCTGCCTATGTCGCCGGTGATAATTCCGACATCGTCGCCACCGATACCATGAAGAACACTGTTTAT
GTCAAAGCTAAGGAATGTTCAGAGCAACTCTCAGCTGAAGATTTTGCCATTATACTTGCAAAGCACTTCACCTCCTTTT
ATCCGCAGGTCACTGCTGCAATTGTCAATATAGTTGAAAAGCCATGGGAACGCATTAGCATAAAGGGCCAATACCATGA
ACACGGTTTTAAGCTTGGCTCTGAAAAACACACTACCGAAGTAATGGTCGATAAATCGGGAACATTGCGCATGACATCT
GGTATCGTGGGATTATCAGTTCTAAAGACAACTAAGTCAGGTTTTGAAGGATTTATTAGGGACAAGTACACTATGTTGC
CTGAAACACGGGAAAGAATGATGGCTACAGAGGTCACTGCATCTTGGAGGTACTTATTTGAATCTCTCTCaagtcttcc
ctTga > SEQ ID NO:2810 215445 205201_300797_1
GCTTCATTGCTGAGTGTGTTGATAGTTGACGTCTTGGTTTGTTTGTTCGCCGCTTCCAATCTCCGTGACACCTCCGCCA
CCAGTTCTCTCTCCCTCCATTGAACTCTCTCCTCCCGAGTAAATCACCAGCTTTCGTATCTTCACACAAACAATTCAAT
TCATCTCACCATCATGGCTACTGCTCACGTCTCCGCCGCCCGCTATGGCAAGGACAACGTCCGCGTCCTCAAGACCGAC
CGCGACGCCGCCACCGGCATCCACACCGTCACAGAAATGACCGTCAGCTGCCTCCTCGAGGGCGACATCGACGTCTCCT
ACACAAAGGGCGACAACAGCGTCGTCGTCGCCACTGACTCCATCAAGAACACAATCTTCATCACCGCAAAGCTGAACCC
CGTCAACCCCCCGGAGCTCTTCGCCGCCATCCTCGGCTCCCACTTCATCGACACCTACAGCCACATCCACGCCGCAAAC
GTCAAGGTCATCACGCACCGCTGGACGCGCATGGAGGTCCGCGGAAAGCCGCATCCTCACAGCTTCTTGCGCGACGGCC
AGGAGACGCGCAACGTCGAGGCCCGCATCACGCGCAAGGGTGGCATCGTCATCAACAGCGGCATTGAGGGCCTGACTGT
GCTCAAGAGCACCGGCTCGGCATTCCACGGCTttgtgcggACGAgTACACCactCTGGGC
```

> SEQ ID NO:2811 215445 116851_300515_1
GGAACGTGGCCGTCAACGGCGGCTCCGACTGCCTCCCCTCCTACACCTCCGACGACAACTCCGCCATCGTCGCCACCGA
TTCCATCAAGAACACCGTGTATGTGAAGGCCAAGGAATGCACGGAGATTGTCTCCATGGAGGAATTCGCGGAGATTCTT
GGAAGGCATTTCACCTCGCTGTACCCGCAGGTCTCAGAGGCAACGGGGACCATCGCCGAGCGTCCATGGGAGCGTGTGG
ATGTCGAGGGGAAGCCTCATTCCCACGGGTTCAGACTTGGTGGTGAGAAGCACGTCACAGAGGTCATTGGGAAGAAGTC
TGGAAACTTGCTCATAAATTCTGGAGTCCAAGGATACTCCCTGCTAAAGACAACTCAGTCCGGGTTTGAAAAATTTGTG
AGGGATCGATACACACTTCTTCCTGATACAAGAGAAAGGATTGTAGCAACAGAAGTAACTGCCTGGTGGAGGTATCCTT
TTGAGCATGTTTCCCAGATTCCATCAAAGGCATTCTGCTTCACACAAAGGTATCAAGACGTAAAGAAAGTTCTTGC

> SEQ ID NO:2812 215445 217296_300906_1
GTTTGTTTGTTCGCCgcttcCAATCTCCGTGACACCTCCGCCACCAGTTCTCTCTCCCTCCATTGAACTCTCTCCTCCC
GAGTAAATCACCCAGCTTTCGTATCTTCACACAAACAATTCAATTCATCTCACCATCATGGCTACTGCTCACGTCTCCGC
CGCCCGCTATGGCAAGGACAACGTCCGCGTCCTCAAGACCGACCGCGACGCCGCCACCGGCATCCACACCGTCACAGAA
ATGACCGTCGTCGCCACTGACTCCATCAAGAACACAATCTTCATCACCGCAAAGCTGAACCCCGTCAACCCCCCGGAGC
TCTTCGCCGCCATCCTCGGCTCCCACTTCATCGACACCTACAGCCACATCCACGCCGCAAACGTCAAGGTCATCACGCA
CCGCTGGACGCGCATGGAGGTCCGCGGAAAGCCGCATCCTCACAGCTTCTTGCGCGACGgccaggagaCGCGCAACGTC
GaggCcCGCATCACGCGCAAGGGtggcaTCGTCATCAACAGCGgcattGagggccTGAcTgtgCTCAAgagcAccGG > SEQ ID NO:2813 215459 200320_300758_1
ACTCACACACACAACTCAACCACACTTTCAACTCTCAACTACACCACAACTTACAATCTCATCTCGCGACCAACCAACT
TTCACAATGGAGACTGTCAAGCAAGCCGTCAACTACGTCGCTGAGTCCGTCCAGGGCGCTGCCTCTGGTATCAGCAAGG
AGACCAACAAGGAGATTGCCAAGGACAGCAACGTCGACGTTTCCACTCGTTTGTCCGCTGGCAAGGACGCCCTTGGTGA
CAAGATCGACGAGACTGGCCACAACAACAAGGCCGAGGCTCACAAGCAGCTGGCTGAGCACAACTAGATTGGCATAAGG
AGCTTCGATTGCTTCACAGGCGTTGAACCGGATCAGAGCGAAGGGAATATATAGCCTCACTAGGCAGGAATTGATGATT
TGAATTCGCAC > SEQ ID NO:2814 215459 211605_300901_1
AACAATCTCAGATCTTCATCTCAACTTTCAATCTTCCACACAAGCAAATAACCAACCAACCAACCAATCACAATGGATT
CCATCAAGCAGGGCGCCAACTACGTCGGTGAGAAGGTTCAGCAGGCCACCTCTGGTGCCTCCAAGGAGACCAACAAGCA
GGTCGCCAAGGACTCCGATGCCTCTGTCGGCACTCGTGCCTCCGCTGCCAAGGACGCTCTCGGTGACAAGATGGACGAG
TCCAAGCACGACGCCAAGGGCGAGGCCCACAAGCAGGCCATCTAAATGGACTGAGTGAGAGGGAACGATGACAACACTT
TTGCTTCTACCCCGTCTTGAGAGACAAATAGTCGATACCCCTATGAGAACTCAATAATACAACTTTTTCAGCCT > SEQ ID NO:2815 215461 218347_300917_1
ccgcaatccctccctcctcgaatgggtcCAATTGTCGCCCGCAAATcgcccGCACCGTCGCCGAagcCGAATCATTCAT
CATGTCCGACGAGGAAGGCCaggaGCTTGTCACCAAGCCCTTCAAGTTTGTCACTGCTGGTGAGATTGTCCAAcacGgC
CCCTTCTACGTGAACGAAACGACCGACCGGCTCGGGCAGCTTCATCAATGCATTGCCCATCGACTGCGAGCTACTTACC
CGCAGCTTGGAATAGCTTGAGCTTTGCCCGTCGCCGGAGGACCCGCTTCGCAGATATATATACCTTCGTTATATATGCA
CACATGTCGCTAACCCGAGTGCTCGCGCAGGCACTGATGCCCGTTTCCCCAACGTGAATCAGACCAAGCACTGCTGGCA
AAACTACGTCGACTACCACAAGTGCATTCTCGCCAAGGGAGAGGACTTTGCGCCTTGCCGTCAGTTCTGGTTGGCCTAC
CGATCACTGTGCCCTTCTGGATGGTACCAGCGATGGGACGAGCAGCGCGAGTCTGGTAACTTCCCTGTGAAGCTCGATG
CTTAAATTCCATATTTGAGGTGGCGGGGTACATAAGCAAGGGTGTTCACATAGATTAAGCAGCCAGGCGGCGCATGTGC
TGCCAGAAAATGTAGTAGTAGTCAATCACAAGCAAACAGGCTCAATTTTTGACTGTTAAAAT > SEQ ID NO:2816 215474 206618_300824_1
aGCTATATCGTTCTTCACCAGTAGCAGTATCACCCCACTGTCGCTATCATGGCCCGCGGAAATCAGCGTGATTTGGCGC
GCGCAAAAAATCAGAAGAATGCGTCCAAACATAAAGGCGGCAATACCGAGAACGGATATGAGCAAGCAAAATCCAAGTT
GAGTAACGCCGAGATTATGAGGCAGAAGCAAGCCAAAGCCAATGCCGAGAGAGACCTAGCGGCAGCAAAGGCATTACAA
GAGAAAAGGGACGCAAAGGCGAAGAAACCGACTGAATTGGGCGCTTCAGCTGTGGAGGTTACTGGACATGCAAATAACC
CAAGAGGATAGCAAGAGATGGGAGAAAACACGGCACGGCGAAATCAGGCGCTCCTTGAGACTTTCACAATACGGCGCAA
ATTTGGGACAATCTAGGTGAAGAGGGGGAAGCGTTTTTTGGCTTAATACCAGGTATAGCCATGGATAATAGCGAAATGG
ATATTTTGTTGCGGTAttgctATTATtAttcTACCAAAAAAAGTTcgaccTTGTGaaAAAAAa > SEQ ID NO:2817 215477 1114244_301844_1
AGAGAGAGAGAGAGAGAGGGGGGTAGAGGAGAGAGAGAGATATAGATAGATAGACAGATAGAGAGAGAGAGGAGAGA
GAGAATTCCGTCACCATGCCGCCCAAGTTCGATCCCTCGCAGGTGGTAGAAGTGTATGTCCGTGTGACAGGGGGTGAGG
TCGGCGCGGCCTCATCGCTGGCCCCGAAGATCGGCCCCCTCGGGCGTGTCCCCGAAGAAGATTGGGGAGGGACATCGCCAA
GGAGACCTCCAAGGACTGGAAGGGCCTCCGTGTCACCGTCAAGCTGACTGTCCAGAACCGGCAGGCCAAGATTGCCGTC
GTCCCCAGCGCCGCTGCCCTCGTCATCAAGGCACTCAAGGAGCCTGAGCGCGACCGCAAGAAGGTGAAGAACATCAAGC

FIG. 2 continued

ACACTGGGTCCATCACCCTCGACGACGTCATCGACATAGCCCGGATCATGCGCCCCCGCTCCATGGCCAAGCACCTCAC
TGGAAGCGTCAAGGAAATCCTTGGAACCTGTGTCTCTGTCGGGTGTACTGTCGATGGGAAGGACCCTAAAGACCTGCAG
ACTGAGATCGACGAGGGAGAAGTGGAAATCCCCGAGGATTAAACAAACAGGCCA

> SEQ ID NO:2818 215477 14019_300245_1
CCCACGCGTCCGGAAACTCCAAAACACAGAGCCATGCCGCCGAAGTTGGACCCGAGCCAGATCGTCGATGTGTACGTCC
GTGTAACCGGAGGAGAAGTGGGAGCCGCCAGTTCTCTAGCTCCAAAGATCGGTCCTCTCGGTCTCGCACCAAAGAAGAT
CGGAGAAGACATCGCGAAAGAGACGGCCAAAGAATGGAAAGGACTTCGTGTCACCGTGAAGCTGACGGTTCAGAATCGT
CAAGCTAAGGTAACCGTGGTTCCATCTGCTGCAGCTCTCGTCATCAAGGCGTTGAAGGAGCCAGAGAGAGACCGTAAG

> SEQ ID NO:2819 215477 158347_200003_1
aaagcccaagccctagctacactcttcctctactttttctaagtgtaacaaaaatgccgccaaagttcgatccttctcag
GTTGTCGAAGTCTTCGTCCGCGTCACCGGCGGCGAAGTCGGTGCGGCTAGTTCACTCGCTCCAAAAATCGGTCCACTCG
GTCTCTCCCCCAAGAAAATCGGAGAAGACATAGCTAAGGAAACCGCCAAGGATTGGAAGGGCCTTAGAGTTACCGTCAA
GCTCACCGTCCAAAACCGGCAGGCCAAAGTCTCCGTCGTACCTTCCGCAGCGGCGCTCGTAATCAAGGCTTTAAAGGAG
CCTGAGAGAGATCGCAAAAAGACGAAGAACATCAAGCACAATGGGAATATTTCGCTGGATGATGTGATTGAGATTGCGA
AAGTGATGAAGCCGAGATCTATGGCGAAGGATTTGACAGGTACTGTGAAGGAGATTTTGGGGACGTGTGTGTCCGTTGG
ATGTACTGTTGATGGAAAGGATCCTAAGGATTTGCAACAGGAGATTGATGATGGTGATGTTGAGATTCCTCTGGATTGA
GGAATAAGAGGTTAATTTTAAGATGTGTTTGTTATATTTAGTATTATTATGTGATATTTTGTTTATTTGGATTTGAGGA
TAATTTTGGAGAAATTGTCAGTTTTATTGGCATTGTTAGGATTTGATtattacctttttatgttgatgaaatgctcta
ttttgttt > SEQ ID NO:2820 215477 156539_301367_1
tcgCTCCAAAAATCGGTCCACTCGGTCTCTCCCCTAAGAAAATCGGAGAAGACATCGCAAAGGAAACCGCAAAGGACTG
GAAGGGTCTTCGAGTCACCGTGAAACTCACTGTTCAGAACCGTCAAGCTAAAGTCTCCGTCGTACCGTCCGCCGCGGCA
CTCGTCATCAAGGCATTGAAGGAGCCGGAGAGGGATCGCAAAAAGACGAAGAACATCAAGCATAATGGGAATATATCGC
TTGATGATGTGATTGAGATTGCTAAAGTGATGAAGCCTAGATCTATGGCTAAGGATTTGAATGGAACAGTGAAAGAGAT
TTTGGGGACTTGTGTTTCTGTTGGATGTACTGTTGATGGAAAGGATCCTAAGGATTTGCAGCAGGAAATTGATGATGGT
GATGTCGAAATTCCTCTGGATTAAGGAGGTTAAATTCTGAAATTCTCGCGATATAGTAGTTTTAAAATTTGAATTTGTA
TCGTTTTGGATTTTCAGAGAGATTTTATCAGAGGATAATTTTGATTTGATATCATATCATGATGAGAATACTCTCTTTG
GAAAATTTTTGGAAACAAATGTTGGCTTTTATTTGGAATTGTTATAAGATTTTGGATGATTATGAT > SEQ ID NO:2821 215477 224143_300979_1
GAAAAAATGCCTCCTAAGTTTGACCCCAATGAGGTGAAGATCATCTACCTGCGAGCCATGGGTGGTGAGGTCGGAGCTT
CCTCCGCTCTTGCTCCCAAGATTGGTCCTCTCGGTCTGCTGTCCCCAAGAAGATTGGTGAGGATATCGCCAAGGCCACCAA
GGCCCACAAGGGTGTCCGAGTCACTGTCCAGCTGACCATCCAGAACCGACAGGCCACCGTCTCCGTCGTCCCCTCTGCC
TCTTCTCTGGTCATTGCTGCTCTCAAGGAGCCCCCGCGTGACCGAAAGAAGGACAAGAACGTCAAGCACAACGGTAACA
TCCCCCTGGAGGAGATCATTGAGATTGCCCGAACCATGCGATCCAAGTCTTTCTCCAAGGAGCTGTCCGGAACCGTCAA
GGAGATTCTTGGTACTGCCCAGTCTGTTGGCGCCCGTGTCAACGGTAAGCCCGCTCACGTCATGATTGATGCTATCAAC
AACGGCGAGCAGGACATCCCCGATAACTAAAGttGTCGTAAAAAATAa > SEQ ID NO:2822 215477 204253_300791_1
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACTTGCAGCTTA
CAGCCACCTCCGTGCCACCGGTGGTGAGGTTGGTGCCTCTTCGGCCCTTGCTCCCAAGATTGGTCCTCTTGGTCTGTCG
CCCAAGAAGGTCGGTGAAGATATCGCCAAGGCCACTGGTGACTGGAAAGGTCTCCGTGTCACCGTCAAGTTGACCATTC
AGAACCGTCAGGCTGCCGTCTCTGTCGTGCCCACTGCCTCCTCTCTCATCATCAAGGCCCTCAAGGAGCCCCCGCGTGA
CCGCAAGAAGGAGAAGAACATCAAGCACAACAAGTCCGTCAGCCTCGATGAGATCATTGAGATTGCCCGCACCATGCGC
TTCAAGTCTTTCGCCAAGGAGCTGAAGGGAACCGTCAGGGAGATGCTGGGAACTGCTCAGAGTGTTGGCTGCCAGGTCG
ATGGAAAGACCCCCCAGGCTATCCTGGAGGCCATCGAGAACGGCGAGATTGATATCCCCGAGGAGTAGAGTGTCTGGTT
CAGACCGCCTGTCCCACCGAGAAGAAATTCTCGTGCATTGGTGACACATCAAAAATAGAAAAAAAGGTCAACC > SEQ ID NO:2823
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACTTGCAGCTTA
CAGCCACCTCCGTGCCACCGGTGGTGAGGTTGGTGCCTCTTCGGCCCTTGCTCCCAAGATTGGTCCTCTTGGTCTGTCG
CCCAAGAAGGTCGGTGAAGATATCGCCAAGGCCACTGGTGACTGGAAAGGTCTCCGTGTCACCGTCAAGTTGACCATTC
AGAACCGTCAGGCTGCCGTCTCTGTCGTGCCCACTGCCTCCTCTCTCATCATCAAGGCCCTCAAGGAGCCCCCGCGTGA
CCGCAAGAAGGAGAAGAACATCAAGCACAACAAGTCCGTCAGCCTCGATGAGATCATTGAGATTGCCCGCACCATGCGC

FIG. 2 continued

```
TTCAAGTCTTTCGCCAAGGAGCTGAAGGGAACCGTCAGGGAGATGCTGGGAACTGCTCAGAGTGTTGGCTGCCAGGTCG
ATGGAAAGACCCCCCAGGCTATCCTGGAGGCCATCGAGAACGGCGAGATTGATATCCCCGAGGAGTAGAGTGTCTGGTT
CAGACCGCCTGTCCCACCGAGAAGAAATTCTCGTGCAT

> SEQ ID NO:2824
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACTTGCAGCTTA
CAGCCACCTCCGTGCCACCGGTGGTGAGGTTGGTGCCTCTTCGGCCCTTGCTCCCAAGATTGGTCCTCTTGGTCTGTCG
CCCAAGAAGGTCGGTGAAGATATCGCCAAGGCCACTGGTGACTGGAAAGGTCTCCGTGTCACCGTCAAGTTGACCATTC
AGAACCGTCAGGCTGCCGTCTCTGTCGTGCCCACTGCCTCCTCTCATCATCAAGGCCCTCAAGGAGCCCCGCGTGA
CCGCAAGAAGGAGAAGAACATCAAGCACAACAAGTCCGTCAGCCTCGATGAGATCATTGAGATTGCCCGCACCATGCGC
TTCAAGTCTTTCGCCAAGGAGCTGAAGGGAACCGTCAGGGAGATGCTGGGAACTGCTCAGAGTGTTGGCTGCCAGGTCG
ATGGAAAGACCCCCCAGGCTATCCTGGAGGCCATCGAGAACGGC > SEQ ID NO:2825
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACTTGCAGCTTA
CAGCCACCTCCGTGCCACCGGTGGTGAGGTTGGTGCCTCTTCGGCCCTTGCTCCCAAGATTGGTCCTCTTGGTCTGTCG
CCCAAGAAGGTCGGTGAAGATATCGCCAAGGCCACTGGTGACTGGAAAGGTCTCCGTGTCACCGTCAAGTTGACCATTC
AGAACCGTCAGGCTGCCGTCTCTGTCGTGCCCACTGCCTCCTCTCATCATCAAGGCCCTCAAGGAGCCCCGCGTGA
CCGCAAGAAGGAGAAGAACATCAAGCACAACAAGTCCGTCAGCCTCGATGAGATCATTGAGATTGCCCGCACCATGCGC
TTCAAGTCTTTCGCCAAGGAGCTGAAGGGAACCGTCAGGGAGATGCTG > SEQ ID NO:2826
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACTTGCAGCTTA
CAGCCACCTCCGTGCCACCGGTGGTGAGGTTGGTGCCTCTTCGGCCCTTGCTCCCAAGATTGGTCCTCTTGGTCTGTCG
CCCAAGAAGGTCGGTGAAGATATCGCCAAGGCCACTGGTGACTGGAAAGGTCTCCGTGTCACCGTCAAGTTGACCATTC
AGAACCGTCAGGCTGCCGTCTCTGTCGTGCCCACTGCCTCCTCTCATCATCAAGGCCCTCAAGGAGCCCCGCGTGA
CCGCAAGAAGGAGAAGAACATCAAGCACAACAAGTCCGTCAGCCTCGATGAGA > SEQ ID NO:2827
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACTTGCAGCTTA
CAGCCACCTCCGTGCCACCGGTGGTGAGGTTGGTGCCTCTTCGGCCCTTGCTCCCAAGATTGGTCCTCTTGGTCTGTCG
CCCAAGAAGGTCGGTGAAGATATCGCCAAGGCCACTGGTGACTGGAAAGGTCTCCGTGTCACCGTCAAGTTGACCATTC
AGAACCGTCAGGCTGCCGTCTCTGTCGTGCCCACTGCCTCCTCTCATCATCAAGG > SEQ ID NO:2828
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACTTGCAGCTTA
CAGCCACCTCCGTGCCACCGGTGGTGAGGTTGGTGCCTCTTCGGCCCTTGCTCCCAAGATTGGTCCTCTTGGTCTGTCG
CCCAAGAAGGTCGGTGAAGATATCGCCAAGGCCACTGGTGACTGGAAAGGTCTCCGTGTCACCGTCAAGTTGACCATTC
AGAACCGTCAGG > SEQ ID NO:2829
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACTTGCAGCTTA
CAGCCACCTCCGTGCCACCGGTGGTGAGGTTGGTGCCTCTTCGGCCCTTGCTCCCAAGATTGGTCCTCTTGGTCTGTCG
CCCAAGAAGGTCGGTGAAGATATCGCCAAGGCCACTGGTGACTGGAAAGGTCTCCGTGTCA > SEQ ID NO:2830
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACTTGCAGCTTA
CAGCCACCTCCGTGCCACCGGTGGTGAGGTTGGTGCCTCTTCGGCCCTTGCTCCCAAGATTGGTCC
```

FIG. 2 continued

> SEQ ID NO:2831
gctCATTATCCTCCCCTggCAAGCAAACCACGAGCCTCTGTCAGATAATCAATCGCCATCATGCCTCCCAAGTTCGATC
CCAGCGAGGTCAAGGTCATGTTAGTTCACACAATGCGTCGCTTCACGTCCCGCGATCATCAGGTCTAACT > SEQ ID NO:2832
gctCATTATCCTCCCCTggCAAGCAAACCACGAGCCTCTGTCAGATAATCAATCGCCATCATGCCTCCCAAGTTC > SEQ ID NO:2833 215477 189170_300613_1
AAACCCCAGCCACCGCCGCCGCCGCCGCCACCACCGTTGCCGTTGCCGCCTCCACCACCCGCCCTCGACCACAGCCATG
CCGCCGAAGCTCGACCCGACCCAGGTGGTGGATGTGTTCGTCCGCGTGACCGGCGGTGAGGTCGGCGCGGCGTCGTCGC
TCGCCCCCAAGATCGGGCCGCTCGGTCTCTCCCCGAAGAAGATCGGAGAGGACATCGCCAAGGAGACCGCCAAGGACTG
GAAGGGCCTCCGCGTCACCGTGAAGCTCACCGTCCAGAACCGGCAGGCCAAGGTCTCCGTCGTCCCCTCCGCCGCGGCG
CTCGTCATCAAGGCGCTCAAGGAGCCCGAGAGGGACCGCAAGAAGGTGAAGAACATCAAGCACAGCGGCAACATCAGCC
TCGACGACGTCATCGAGATCGCGAGGGTCATGAGGCCCAGGTCCATGGCCAAGGAGATGGCCGGCACCGTCAAGGAGAT
CCTCGGCACCTGCGTCAGCGTCGGCTGCACCGTGGACGGCAAGGACCCCAAGGACCTGCAGCAGGAGATCTCCGACGGC
GAGGTCGAGATCCCCTCAGCTTAAGCAGGTTTGGCATTGGGGTGGTTGTTATGTGA > SEQ ID NO:2834 215477 252554_301602_1
GAGAGAGAGAGAGGGGGGTAGAGGAGAGAGAGAGATATAGATAGATAGACAGATAGAGAGAGAGAGGAGAGACAGAATT
CCGTCACCATGCCGCCCAAGTTCGATCCCTCGCAGGTGGTAGAAGTGTATGTCCGTGTGACAGGGGGTGAGGTCGGCGC
GGCCTCATCGCTGGCCCCGAAGATCGGCCCCCTCGGGCTGTCCCCGAAGAAGATTGGGGAGGACATCGCCAAGGAGACC
TCCAAGGACTGGAAGGGCCTCCGTGTCACCGTCAAGCTGACTGTCCAGAACCGGCAGGCCAAGATTGCCGTCGTCCCCA
GCGCCGCTGCCCTCGTCATCAAGGCACTCAAGGAGCCTGAGCGCGACCGCAAGAAGGTGAAGAACATCAAGCACACTGG
GTCCATCACCCTCGACGACGTCATCGACATAGCCCGGATCATGCGCCCCCGCTCCATGGCCAAGCACCTCACTGGAAGC
GTCAAGGAAATCCTTGGAACCTGTGTCT > SEQ ID NO:2835 215477 265565_200112_1
aAATGCCGCCCAAGTTCGATCCATCTCAGGTGGTCGAGGTTTTCGTCCGAGTTACCGGCGGTGAAGTCGGAGCTGCGAG
TTCACTCGCTCCAAAAATCGGTCCACTTGGTCTCTCCCCTAAAAAATCGGTGAAGACATCGCAAAGGAAACCGCCAAG
GACTGGAAGGGTCTCCGAGTCACAGTTAAACTCACCGTCCAAAACCGTCAAGCTAAAGTTTCCGTCGTTCCCTCTGCCG
CTGCACTCGTCATCAAGGCGTTGAAGGAGCCGGAACGTGACCGTAAGAAGACCAAAAACATCAAGCATAACGGTAACAT
CTCGCTCGATGACGTCATCGAGATCGCTAAGGTGATGAAGCCGAGATCGATGGCGAAGGATTTGACTGGAACAGTGAAG
GAGATTTTGGGCACGTGTGTATCAGTTGGCTGTACGGTAGATGGGAAGGATCCTAAAGACTTGCAGCAAGAGATTGATG
ATGGTGATGTCGAGATTCCTCTCGATTGAACGCTAATTATCAACTGATGGTAATATTATGTTAATTTTTTTTGACGTT
GTCATCTTGAGGATCATTTTGATATAaCTATGACTAgtaaaCACTGGAATTTTATAtTTGGCAATGTAgtttggATttT
gtttTTGCTCGATGAAg > SEQ ID NO:2836 215477 50112_300169_1
cttttcgtttgccacttttttgatcatgcgaaaCTCCAAAACACAGAGCCATGCCGCCGAAGTTGGACCCGAGCCAGATC
GTCGATGTGTACGTCCGTGTAACCGGAGGAGAAGTGGGAGCCGCCAGTTCTCTAGCTCCAAAGATCGGTCCTCTCGGTC
TCGCACCAAAGAAGATCGGAGAAGACATCGCGAAAGAGACGGCCAAAGAATGGAAAGGACTTCGTGTCACCGTGAAGCT
GACGGTTCAGAATCGTCAAGCTAAGGTAACCGTGGTTCCATCTGCTGCAGCTCTCGTCATCAAGGCGTTGAAGGAGCCA
GAGAGAGACCGTAAGAAGGTGAAGAACATTAAGCATAACGGTAACATCTCTTTCGATGATGTGACTGAGATTGCTAGGA
TTATGAGGCCTAGATCTATTGCTAAGGAGCTGAGTGGGACTGTGAGGGAGATTCTTGGAACGTGTGTCTCTGTGGGATG
CACTGTTGATGGGAAAGACCCTAAGGATCTTCAGCAGGAGATTCAAGAAGGTGAGATTGAGATTCCTGAGAATTAAGGA
ACAATGGAGTTTTTTTTTCTTCTTATGGGAATTTGAAATGCTTCTGTTGTTATCTTTCTCGTTTTACCATATTTTGTTT
TTGTTTGGGAACTTAGCTGCTATGATGTTTCACTTAGAATGACTCTCAAGTTTTGGATTCTTATTATTCTCTGTTTc > SEQ ID NO:2837 215477 26868_300393_1
cccacgcgtccggagaagaatcagagaaaatgccgccgaagttggatccatctcaaatcgtcgacgtctacgtccgagt
cACCGGAGGTGAGGTCGGAGCAGCGTCTTCACTCGCTCCAAAGATCGGTCCACTCGGTCTGGCACCAAAGAAGATCGGA
GAAGACATCGCCAAAGAGACAGCAGCGAAAGAATGGAAAGGTCTTCGAGTCACCGTGAAGCTTACGGTACAGAATCGTCAAG
CTAAGGTCACAGTGGTTCCATCCGCAGCGGCTCTAGTCATCAAAGCCCTCAAGGAGCCAGAGAGAGATAGGAAGAAAGT
GAAGAACATCAAACATAATGGCAACATTTCGTTTGATGATGTGATTGAGATTGCTAAGATAATGCGTCCTAGATCTATC
GCTAAGGAATTGAGTGGAACAGTGAAGGAGATTTTAGGAACTTGTGTCTCTTTTGGTTGCACTGTTGATGGTAAAGACC
CTAAGGATCTTCAGGAAAATTAACAGTGGTGACATTGATATTCCTAACGAGTGATAAAGGTTTTTACTTTTGAGTTCTC
TATCGTTTTATTTTTTGTATTTGATTTTGAGGATTTGGTATTAGTAATACTATATTTCGGAAGTTGAGAATTGTTGGCT
TTTGCCCATTTGAATCCTTTCTTGGGATTAATCAAAATGTtcaATTTTCTacaaAAAA

FIG. 2 continued

> SEQ ID NO:2838 215480 205294_300797_1
CGCAAAGGTCGTTGAGCCTTTCTTGCCCCAGCTCTACCAGCTTCCCCACCACATCTGGGAGAGCATCGACAGTCTCGAT
GCCCTGAGAGAGCTCTATGTCACGACGAATCCCCTGATTTCAGGCTTTGCGGCCTCTCTGGTTGTTGGGCTTCTCGCCT
TGATCGTGTCCGAGATCAATCGCAACTATTCTCAGATCGACCGCCTGTGGAGTATCCTGCCCAATCTATACGTTGTCCA
CATTGCGCTCTGGGCACGTGTAGCTGGTTTGCCGCATGGTCGAGTAGATTTGATTGCTGTCTGTACAACATTATGGAGT
ATTAGATTGACGTACAACTACTGGAGACGTGGCGGCTACAACATTGGCTCAGAAGACTACAGATGGATGATTGTCAAAG
CGCAACTCAACTCAGTTGTCTGGTTCATCTTCAACGTCACCTTCATTTCGTTTATCCAGAGCATCCTCCTGTACCTCTT
CTCGTGTGTGCCGGCATACGTCATCTTGCTATCATCTCAGTTTGAGCCTGAAGTTCAGGCAGTTGATCTGGTCTTTGCC
GGCGTTGAGATTCTTCTTGTCCTGAGCGAATGGATTAGCGATGGCCAGCAATGGGCTTTTCAAACCGCCAAATACAAAT
A

> SEQ ID NO:2839 215494 206082_300804_1
atcaaactatttcagcaattggaccctcgcgggagCCGAGGCGCAAAGATATAGGCCAAGATGAGGTCATTAGGAGAGC
GGTTAAACCTGCTTCGAAAGAAACTCATTAACATCAGATGCGGCCCCGGCGCAGCGATCCTCCCCGCGGAGGTCACCCG
GATACACATGGACTTCGCCCTCCGTCTAAAAGGCGGCCACATGGGAGCTAGGAAATTCTGGAGAGAATACCTCCCCCGC
CTGAAATACCACAACCCTTCCATCCCCATGATCGTCAACCGCCACGACCAGAACCAGCTCCCCCCAACCATGACAATCT
ACCTCCGCAAGGCCGGCTCCTCAGTAGCAGACCCAGCGTCTTCTTCTTCTTCTTCCTCCGAACCCATCGCCCAGCC
CTCATCCTCCCGAACGAACCTCTCCAAGGCCCAGCCCCCCACCGCGGACGAGCGCGTCGTCCACATCGACATGGCCAAC
AAGCACTCATCACACATCCTCGAGTTCTTCATGGCCGagaccCGCGCCGTTCCGCTGCAGCCCACGAACGAGGAGAttg
ccGAGATGCAGGCCCTCGAAACGCTgcgCAAGa > SEQ ID NO:2840 215516 208143_300832_1
CATCAAACAGCTCTTGGGATCCGTTCTGATCCAGCCAACAACCATCGCCATGTCTGAACCTCTCACCAAGTCGACTCCG
C > SEQ ID NO:2841 215516 221159_300942_1
TCATCCATCGTCTTTGATTCATCAAACAGGTAAACAGCCTTGATAGTCCCTTTGGCATCTTCTGCATCTCCGGCTTACA
CAGTCAATCCAGCTCTTGGATCCGTTCTGATCCAGCCAACAACCATCGCCATGTCTGAACCTCTCACCAAGGTCGACT
CCGCCGTTCAAGGCCTGTCATCATCACCGCCCAAAGAGAAGGGCCATAGGAGAACAAGCTCTAGCGCGGCTGGTGTTAT
GACCATTGCGGAAATCAATGAAAGCCATGCTCCTCTAGAACTCGCAATAGAGACACAGCAGACAGCGTGGAAAATAAAT
CAGCGGCCCAAGGATCTCGACAATGATCAGCTGCTACAGGTTCCCCTCACCAAGCCTCCCATCAAGAGCATAACATTGA
GGTTCCCTCATGGCAAAGAAGTCGTGGCTCGCAACCTGAAGGGCCTGACAATAGGTGACGCCCTGTCGGCCATTCACAA
GGCAAACAAGAACCGAGCTGATGATGAGCTTGATAATCCATACCTCAAGGGCTTCGCATGGGATCAGGGCGAGAACTAC
TTTGAAGTACATCTCCAGAGCCAGCCGGCGACGGGCTCGTCAAGCGGCGGTGGCGGTGGCAAGAAGAAGAAGAAGTCCA
AGGACAATGACGAGTAAATGAATATCCACCCATCCTAATGTCTGTTCAATAGTTCCTTCAATTGTTTTTTGTTTGGCT
TCGCCTGGTTCGTGCGAGTCGGCGCCCGGGATATTGcaactagatgTtg > SEQ ID NO:2842 215528 215428_300881_1
tctttcgatatctcatccttgcaactcgggtgtctCCTGCAGCACCGAATATCGTTTCCTGGAAACTTTAAATCTATCA
AAACAACAACTTCCTTTTACACATCCACCATGAAGTTCTCTAGCTTTGCTGTCCTTGCCGTTGCCGCCCTTGTTCAGGC
CAACCCAGCTCCCTCTCCCGCCCCATCTCCTGCTCCCGGCCTGGGCGACTTCATCGACGACGCTTCCACCTGGCTCACT
GGCAAGGCCGGCGAGGTCAAGACCTGGCTCTCCGACAAGGCTGGCGAGGCCTCCTCCTTCGCCAGCCACGTCCAGTCCA
AAGTCGACGCCAACGAGTCCAAGGCCAGCGCGGCAGCCAGCGCCATCAAATCCATCTTCGACGATGCGCCCTCCAGCGT
CATCGCCAGCCTGACCTCCGAAGCCGGCTCCAAGTTCAGCTCCCTCAGCAGCGTTGCCGCCACTGCCACCGGTGCAGCT
GCCTCCTCGGTCAACGCCGACATTTCCAAGCTCAGCGCCTCCCTTGCCAGTGCGACCAGTGAGGCCTGCCGCTGCCGCGT
CCACAAAGTCCCACGACGCTGCTCCTGTCCAGACTGCCTATATTgcaATTGGAGCCCTGATGGGCGGAGcTgCTgt > SEQ ID NO:2843 215538 217825_300912_1
GTTATTGTCGTCATCGGCTCTTCGTCGCCCAATTCGACGTCGTTGCATTCCGAATGGCACCAGCCGCGCACTCATACTC
TTCATACTCTTCAATGGACTGTTTGGCGTAGGTTGTCGATAGCCTCAAATATCTAGAGAGCAGCGATAGCCACAAGACA
CTCGACAAGACTCGATTCGAGAGCTCGCGACAAGCGCACATAGAAAATGCCAGCTCGGCGGAACAGGCGCTTCTTCTC
GCGAGAGCCATTCCACAATGACGACCGGCTAACATTGCAGCACGCCGAGGGGCCTTTTGGCTTTCTCAATCCAACAAGA
GCTCATTTCGACCACTCAGCACTGGCTCCGAAGCCGACGCCTGACGAGATAGCGGACACATGAGAGCGGCGATGATG
CGGAAACCAAGCACCAACAGACAAAACAAGCCGCCGATTCGAACGTCCCCGCCAAGAACGTCAAGTTCCTATGGCGGTC
TCGAGACAATCGAAAGGGTCGGCATCCCTTGCTCGTTCAAAAGCCGCTCCCGGGAGAGGAAGCGCCTTTCGTGACACCA
AGGTGCACGTCGCATC

FIG. 2 continued

> SEQ ID NO:2844 215552 147546_301253_1
AAAAAAGGAAAGTTAGCAAGCAAAGGTTTCGTACTGTCAAAATGAACATGTCACAACAATCACCGTCACCGTCCGCTGA
CCGGAGGTTGAGTGTTCTGGCGAGACACCTTGAACCATCGTCCTGCGCCACCGTCGAATCCTCTATCGTCGCTGCTCCT
ACCTCCGGAAATGCTGGAACCAACTCTGTCTTCTCTCACATCGTTCGCGCTCCCGAAGATCCTATTCTTGGCGTCACTA
TTGCTTACAATAAAGATAGCAGCCCCATGAAGTTGAATTTGGGAGTTGGTGCATATCGCACAGAGGAAGGAAAACCTCT
TGTTTTGAATGTTGTAAGACAAGCAGAGAAGCTACTAGTAAATGACAGGTCCCGCGTTAAAGAGTACCTATCTATTACT
GGACTGGCAGACTTCAATAAATTGAGTGCTAAGCTGATACTTGGCGCCGACAGCCCTGCTATTCAAGAGAACAGAGTAA
CAACTGTCCAGTGTTTGTCTGGCACAGGCTCATTGAGGGTTGGAGCTGAATTTTTGGCTCGACATTATCATCAACGCAC
TATTTATATTCCCCAACC

> SEQ ID NO:2845 215552 168290_300554_1
GAATTCACAACCATGGAATCTCAAAACTCTGGGTTCTAATATTTCAATGTCTCCTACTGCTTCTCATGGTGATTCTGTT
TTTGCTCACATTGTTCAAGCTCCTGAAGATCCAATTTTAGGGGTTACTGTTGCTTATAATAAAGATCCAAGTCCAATTA
AGTTGAATTTAGGAGTTGGGAGCTTATCGAACTGAGGAAGGAAAACCACTTGTATTGAATGTTGTAAGAAAAGCTGAACA
GATATTAGTTAATGACAGGTCTCGTGTGAAAGAGTATCTTCCTATTACTGGATTGGGAGAATTTAACAAATTGAGTGCC
AAGCTCATTTTTGGTGCTGACAGCCCTGCTATCCGTGAGAACAGGATTACTACTGTCCAATGCTTGTCTGGCACTGGCT
CGCTGAGGGTGGGAGGTGAGTTTCTTGCAAGACATTACCATCAGCGAACAATATATATTCCACAGCCAACATGGGGAA
CCATATCAAAGTATTCCAATTGGCAGGGTTGTCTGTGAAATATTATCGCTACTATGACCCAAAAACACGTGGATTGGAC
TTCCAAGGTATGCTGGGGGATCTCTCTTCTGCTCCATCAGGAGCCATAGTTCTTCT

> SEQ ID NO:2846 215552 237078_301250_1
ACAGGGAGAGTAGCTTCCATTCCATTCCATCCGGTAGGGCTATGGCGACTAGCATGGCGCTCAACGAGATTGCTGCTCC
AGCGGCGTCCAAGATGTCTTCCAGCCCAGCCGCAAAGAGCTTCGTTGGGCTCCGCACGGCTGCGTTTTCCACGAAGAAG
GCATCTTTTCCATCCATGAAGTGTGCTGCGAAGGTCAATATGGCTATCGCTGCCGACGTTTCTCGCTTTGAGAACGTTA
GCATGGCACCTCCGGATCCAATTCTCGGTGTTTCAGAGGCATTCAAGGCAGATAACGATGCTACCAAGTTAAACCTTGG
CGTTGGTGCTTACAGGACCGAGGATCTCCAACCTTATGTTCTTAAAGTCGTGAGAAAGGCTGAGAAGCTCATGCTGGAG
AAGGGAGAGAACAAAGAGTATCTTCCTATCGAGGGTCTTGCCGCATTTAACAAGGCCACTGCCGAACTTCTACTCGGAG
CTGGCAATCCAGTTATCAAGAAtggccGGATtgccACCGTTCAagGCCTATCTGGAACCGGGTCTCTGCgTCTGgGAGc
TgcaTTTAttgcaagATActtccCct > SEQ ID NO:2847 215552 239752_301307_1
ATCAGCTATGGAGAGCGTGGCGCTCAAGCGAGTTTCTGCTGTAGCCAACCATCTCAATCCCGAGCAGCAGCAGCAGCAG
CAGCAGCAACTCTCCATGGCTGTCGCCGCCAGCGCCGGCGCCTCTTCGGTGTTTGATCATCTGGAGCAGGCGCCCGAGG
ATCCCATTCTGGGAATAACTGTGGCATACAACAAGGACCCTCATCCCGGGAAAGTGAACCTTGGAGTCGGAGCTTACCG
CACAGAGGAAGGGAAACCCCTTATTTTGCATGTGGTTCATCGTGCTGAGGAACGTCTTCTAGCTGATCGCCCTGCTATC
GTGGAGAAGAGATTGGTAACTGCGCAGTGCCTTTCTGGAACGGGTTCCTTGCCGTGTAGGAGCCGAGTTTCTTTCAAGAC
ATTATGGTGTGAAGCTGGTTTTCCTTCCTACCCCGACGTGGGGAAATCACTTCAAGGTTTTCATGAATGCTGGACTTGG
TGTTAAGACGTATCGTTACTATGACAGCAAAACTCGTGGTCTTGACTATGAGGGTATGCTCGAGGACATAAGTGCAGCT
CCGACCGGATCGGTTATTCTCTTGCATGCA > SEQ ID NO:2848 215552 286510_200110_1
CATGGCGATCCGAGCCGCGATTTCCGGTCGTTCCCTCAAGCTTAGCTCGTCGGTAGGAGCGCGATCTTTGTCGTCGTTG
TGGCGAAACGTCGAGCCGGCTCCTAAAGATCCTATCCTCGGCGTTACCGAAGCTTTCCTCGCCGATCCTACTCCTCATA
AAGTCAATGTTGGCGTTGGAGCTTACAGGGACGACAATGGAAAACCCGTGGTACTGGAGTGTGTCAGAGAAGCAGAGCG
GAGGATCGCTGGTAGTTTCAACATGGAATATCTTCCTATGGGAGGTAGTGTCAACATGATCGAGGAGTCACTGAAGTTA
GCCTATGGGGAGAACTCAGACTTGATAAAAGATAAGCGCATTGCAGCAATTCAAGCTTTATCTGGGACTGGAGCGTGCC
GAATTTTTGCAGACTTCCAAAGGCGCTTTTGTCCCGATTCACAGATTTATATTCCTGTTCCTACATGGTCTAATCATCA
TAACATTTGGAAAGATGCTCACGTCCCTCAGAAAACGTACCATTATTATCATCCTGAAACAAAGGGGTTAGACTTTGCT
GCACTAATGGATGATATAAAGAATGCCCCAAATGGATCCTTCTTTCTGCTTCATGCttgtgCTCACAATCCTACTGGGG
TGGATCCTACAGAGGAACAATGGAGGGAGATCtcacaccagtTcaaggtgaAgggacatTTTgctTtCTttgACat > SEQ ID NO:2849 215570 220519_300956_1
gCTCCATCTTCATCTCCCCGTCTTTCATCGTCGCGTTCCCGTGCAGGAGGAAGCAGGAGTTTGTCTGTCTGTCCGCTGC
CTTTTCCAGTGCTTTCGGTGTAGTTTGTCGCAGGTTGACACTCTTCCGTTTTCCATCACAAATCCCCATCACAATCGTC
ACAATGCGGACCGCTGTCGCTCTCTCTGTGGCCGCTGTTGCCCAGGCCAGCACTTTCCAGATTGGCACCATCCACGAGA
ACTCTGCCCCCGTTCTCAGCACCGTTGAGGCCAACGCCATCCCCGATGCGTACATCATCAAGTTCAAGGACCACGTTGG
TGAGGCTCAGGCCGAGAAGCACCACGACTGGCTCCAGAGCGTCCACAGCTCCGGCGAGCAGGAGCGCCTTGAGCTCCGC
AAGCGAAGCAGCATCTTCGGCTCAGACGACGTGTTTGACGGCCTGAAGCACACCTTCAAGATGGACGGCTTCAAGGGCT
ATGCTGGTCACTTCCACGAGTCCACCATCGAGCAGGTCCGGAATCACCCGGATGTCGAGTACATCGAGCGCGACAGCAT

FIG. 2 continued

TGTCCACACTATGCTTCCCCTCGAGTCCAAGGACAACATCATCATTGAGGATTCTTGCACTCCCGAGACTGAGAAGCAG
GCTCCTTGGGGTCTTGCTCGTATCTCTCACCGAGATACCCTCAACTTCGGCTCCTTCAACAAGTACCTCTACACCGCTG
AGGGTGGTGAGGGTGTTGATGCCTACATCATTGACACTGGTACCAACATTGAGCACGTCGACTTCGAGGGTCGTGCCAA
GTGGGGAAAGACCATCCCTGCCGGCGACGAGGACGAGGATGGCAATGGCCACGGCACTCACTGCTCTGGTACCGTTGCT
GGTAAGAAGTACGGTGTGGCCAAGAAGGCCCACGTCTACGCCGTCAAGGTGCTCCGATCCAACGGATCCGGCACCATGT
CCGACGTCGTCAAGGGCGTCGAGTTCGCCGCCATCTCTCACCAGGAGGCCGTGAagcAGGCCAAGGATGGCAAGCGAAA
GGGCttcAaggGCTCCGTCGCCAACAtgtctcTTGGTGGtggcaaGACCTCTGCCCTTGACGCTGCTGTCAACGCTGCC
GTCaaggccgGtat > SEQ ID NO:2850 215575 206782_300825_1
GCCCCGGCCGTTCTGGCATTGCCGGCCTCTGATGCCGCATTGACCAGACGCCAGACCAGCCTCTCAACCATCACAGACC
AATATCTCTTCACCAGCGTTGCCATCAAAGTAAAAGGCTCTATCCCCTCATCATGAAGTTTGCAGCTCTTCTGGCCACT
CTTGCCCCGGCCGTTCTGGCATTGCCGGCCTCTGATGCCGCATTGACCAGACGCCAGACCAGCCTCTCAACCATCACAG
ACCAATATCTCTTCAGCCTCACTCTCCCTGATTTCATTTCCGCCGCAATGCCAAGAACCCAGCCACCCTTGACTGGAC
GTCTGACGGCTGCACCAGCTCACCCGATAACCCTTTTGGATTCCCTTTTGTTCCTGCTTGCTACCGCCACGACTTTGGC
TACCAAAACTACCGCATCCAAAACCGATTCACAGAGAGCGGCAAGCTCAGCATCGATAACAACTTCAAGGCCGATCTAT
ACTTCCAGTGCCAGACATCGAGTGTCCAAAGCGTTTGCAATGCTCTTGCTGATGTTTACTACGCTGCTGTGAGAGCGTT
CGGAGGCGGCGATGCTTCTCCTGGAAAGCGCGAACAATCACAAGAGGACTTGGTTAAGGTGTATGAAGAGAAGCTGGAG
ATTTACAACAACGCCGTGAAGGATGCCCAGGACAAGGGACTGCTGCCCATCTTGGAGTAAGGGGATAAAGCGTACTGCA
TACTTTTATATGATTGACGATACCAAATATGAAATAAAATTCTTCTACATG > SEQ ID NO:2851 215586 209074_300811_1
AGCCTTGCCTTGGCAAATAGACAACAGAGACCCTGTTTCAAGCCCGTTGACTCTGTGAAGCCAGATCTGGATTTGGCTT
CCATGCGTGCGTCTTATACTTTCAGGAGAACGCCGCAGTAGACTACTTAAAGACTTACTCTCCCACGTCAAGACGTTC
CTCTTCATCCATCTTTTCCAAGCACGACACCATGACTACCCGCTCCCTTCCTAGCAATGGCAGCTCTGCCTTTGACTAC
ATCATCGTTGGTGGAGGCACCGCAGGCTGTGTGATTGCCTCGAGACTCTCCAGCTATCTGCCCGAGCTCCGCGTTCTTC
TCATCGAGGCTGGTCCCTCCGACTTTAACCTCAACCACGTCCTCAATCTGAGAGAATGGCTGAGCCTGCTGGGCGGCGA
GCTAGACTACGACTACGGCACGACAGAGCAGCCCATGGGTAACAGCCATATCCGCCATTCTCGTGCCAAGGTTCTTGGA
GGATGCTCGTCACACAACACGCTCATTTCCTTCCGTCCTTTCCGCCACGACATGGACCGCTGGGTTGCTCAGGGCTGCA
AAGGCTGGACCTTTGAGAATGTCACTCGTCACATTGACAACCTTCGCAACAC > SEQ ID NO:2852 215601 1119601_301899_1
aCTCACTATAGGGCGAATTCGAGCTCGGTACCCGGGGATCCTCTAGAGTCGACCTGCAGGCATGCAAGCTTGAGTATTC
TATAGTGTCACCTAAATAGCTTGGCGTAATCATGGTCATAGCTGTTTCCTGTGTGAAATTGTTATCCGCTCACAATTCC
ACACAACATACGAGCCGGAAGCATAAAGTGTAAAGCCTGGGGTGCCTAATGAGTGAGCTAACTCACATTAATTGCGTTG
CGCTCACTGCCCGCTTTCCAGTCGGGAAACCTGTCGTGCCAGCTGCATTAATGAATCGGCCAACGCGCGGGGAGAGGCG
GTTTGCGTATTGGGCGCTCTTCCGCTTCCTCGCTCACTGACTCGCTGCGCTCGGTCGTTCGGCTGCGGCGAGCGGTATC
AGCTCACTCAAAGGCGGTAATACGGTTATCCACAGAATCAGGGGATAACGCAGGAAAGAACATGTGAGCAAAAGGCCAG
CAAAAGGCCAGGAACCGTAAAAAGGCCGCGTTGCTGGCGTTTTTCCATAGGCTCCGCCCCCCTGACGAGCATCACAAAA
ATCGACGCTCAAGTCAGAGGTGGCGAAACCCGACAGGACTATAAAGATACCAGGCGTTTCCCCCTGGAAGCTCCCTCGT
GCGCTCTCCTGTTCCGACCCTGCCGCTTACCGGATACCTGTCCGCCTTTCTCCCTTCGGGAAGCGTGGCGCTTTCTCAT
AGCTCACGCTGTAGGTATCTCAGTTCGGTGTAGGTCGTTCGCTCCAAGCTGGGCTGTGTGCACGAACCCCCCGTtcagc
CCGAccgCt > SEQ ID NO:2853 215601 147701_301255_1
CGAGCTCGGTACCCGGGGATCCTCTAGAGTCGACCTGCAGGCATGCAAGCTTGAGTATTCTATAGTGTCACCTAAATAG
CTTGGCGTAATCATGGTCATAGCTGTTTCCTGTGTGAAATTGTTATCCGCTCACAATTCCACACAACATACGAGCCGGA
AGCATAAAGTGTAAAGCCTGGGGTGCCTAATGAGTGAGCTAACTCACATTAATTGCGTTGCGCTCACTGCCCGCTTTCC
AGTCGGGAAACCTGTCGTGCCAGCTGCATTAATGAATCGGCCAACGCGCGGGGAGAGGCGGTTTGCGTATTGGGCGCTC
TTCCGCTTCCTCGCTCACTGACTCGCTGCGCTCGGTCGTTCGGCTGCGGCGAGCGGTATCAGCTCACTCAAAGGCGGTA
ATACGGTTATCCACAGAATCAGGGGATAACGCAGGAAAGAACATGTGAGCAAAAGGCCAGCAAAAGGCCAGGAACCGTA
AAAAGGCCGCGTTGCTGGCGTTTTTCCATAGGCTCCGCCCCCCTGACGAGCATCACAAAAATCGACGCTCAAGTCAGAG
GTGGCGAAACCCGACAGGACTATAAAGATACCAGGCGTTTCCCCCTGGAAGCTCCCTCGTGCGCTCTCCTGTTCCGACC
CTGCCGCTTACCGGATACCTGTCCGCCTTTCTCCCTTCGGGAAGCGTGgCGCTTTCTCATAgcTCAcgcTg > SEQ ID NO:2854 215601 187501_300678_1
gtcACTATAGGGCGAATTCGAGCTCGGTACCCGGGGATCCTCTAGAGTCGACCTGCAGGCATGCAAGCTTGAGTATTCT
ATAGTGTCACCTAAATAGCTTGGCGTAATCATGGTCATAGCTGTTTCCTGTGTGAAATTGTTATCCGCTCACAATTCCA
CACAACATACGAGCCGGAAGCATAAAGTGTAAAGCCTGGGGTGCCTAATGAGTGAGCTAACTCACATTAATTGCGTTGC

FIG. 2 continued

GCTCACTGCCCGCTTTCCAGTCGGGAAACCTGTCGTGCCAGCTGCATTAATGAATCGGCCAACGCGCGGGGAGAGGCGG
TTTGCGTATTGGGCGCTCTTCCGCTTCCTCGCTCACTGACTCGCTGCGCTCGGTCGTTCGGCTGCGGCGAGCGGTATCA
GCTCACTCAAAGGCGGTAATACGGTTATCCACAGAATCAGGGGATAACGCAGGAAAGAACATGTGAGCAAAAGGCCAGC
AAAAGGCCAGGAACCGTAAAAAGGCCGCGTTGCTGGCGTTTTTCCATAGGCTCCGCCCCCCTGACGAGCATCACAAAAA
TCGACGCTCAAGTCAGAGGTGGCGAAACCCGACAGGACTATAAAGATACCAGGCGTTTCCCCCTGGAAGCTCCCTCGTG
CGCTCTCCTGTTCCGACCCTGCCGCTTACCGGATACCTGTCCGCCTTTCTCCCTTCGGGAAGCGTGGCGCTTTCTCATa
gcTCACGCTGTaggtaTCTCagtTCGGTgtaggtcgttCGCTccaagctggGct > SEQ ID NO:2855  215601  189601_300607_1
CACTATAGGGCGAATTCGAGCTCGGTACCCGGGGATCCTCTAGAGTCGACCTGCAGGCATGCAAGCTTGAGTATTCTAT
AGTGTCACCTAAATAGCTTGGCGTAATCATGGTCATAGCTGTTTCCTGTGTGAAATTGTTATCCGCTCACAATTCCACA
CAACATACGAGCCGGAAGCATAAAGTGTAAAGCCTGGGGTGCCTAATGAGTGAGCTAACTCACATTAATTGCGTTGCGC
TCACTGCCCGCTTTCCAGTCGGGAAACCTGTCGTGCCAGCTGCATTAATGAATCGGCCAACGCGCGGGGAGAGGCGGTT
TGCGTATTGGGCGCTCTTCCGCTTCCTCGCTCACTGACTCGCTGCGCTCGGTCGTTCGGCTGCGGCGAGCGGTATCAGC
TCACTCAAAGGCGGTAATACGGTTATCCACAGAATCAGGGGATAACGCAGGAAAGAACATGTGAGCAAAAGGCCAGCAA
AAGGCCAGGAACCGTAAAAAGGCCGCGTTGCTGGCGTTTTTCCATAGGCTCCGCCCCCCTGACGAGCATCACAAAAATC
GACGCTCAAGTCAGAGGTGGCGAAACCCGACAGGACTATAAAGATACCAGGCGTTTCCCCCTGGAAGCTCCCTCGTGCG
CTCTCCTGTTCCGACCCTGCCGCTTACCGGATACCTGTCCGCCTTTCTCCCTTCGGGAAGCGTGGCGCTTTCTCATAGC
TCACGCTGTAggTATCTCagttcGGTgT > SEQ ID NO:2856  215601  226401_301034_1
cactataggGCGAATTCGAGCTCGGTACCCGGGGATCCTCTAGAGTCGACCTGCAGGCATGCAAGCTTGAGTATTCTAT
AGTGTCACCTAAATAGCTTGGCGTAATCATGGTCATAGCTGTTTCCTGTGTGAAATTGTTATCCGCTCACAATTCCACA
CAACATACGAGCCGGAAGCATAAAGTGTAAAGCCTGGGGTGCCTAATGAGTGAGCTAACTCACATTAATTGCGTTGCGC
TCACTGCCCGCTTTCCAGTCGGGAAACCTGTCGTGCCAGCTGCATTAATGAATCGGCCAACGCGCGGGGAGAGGCGGTT
TGCGTATTGGGCGCTCTTCCGCTTCCTCGCTCACTGACTCGCTGCGCTCGGTCGTTCGGCTGCGGCGAGCGGTATCAGC
TCACTCAAAGGCGGTAATACGGTTATCCACAGAATCAGGGGATAACGCAGGAAAGAACATGTGAGCAAAAGGCCAGCAA
AAGGCCAGGAACCGTAAAAAGGCCGCGTTGCTGGCGTTTTTCCATAGGCTCCGCCCCCCTGACGAGCATCACAAAAATC
GACGCTCAAGTCAGAGGTGGCGAAACCCGACAGGACTATAAAGATACCAGGCGTTTCCCCCTGGAAGCTCCCTCGTGCG
CTCTCCTGTTCCGACCCTGccGCTTAccGGATacctGT > SEQ ID NO:2857  215601  217501_300909_1
atCACTATAGGGCGAATTCGAGCTCGGTACCCGGGGATCCTCTAGAGTCGACCTGCAGGCATGCAAGCTTGAGTATTCT
ATAGTGTCACCTAAATAGCTTGGCGTAATCATGGTCATAGCTGTTTCCTGTGTGAAATTGTTATCCGCTCACAATTCCA
CACAACATACGAGCCGGAAGCATAAAGTGTAAAGCCTGGGGTGCCTAATGAGTGAGCTAACTCACATTAATTGCGTTGC
GCTCACTGCCCGCTTTCCAGTCGGGAAACCTGTCGTGCCAGCTGCATTAATGAATCGGCCAACGCGCGGGGAGAGGCGG
TTTGCGTATTGGGCGCTCTTCCGCTTCCTCGCTCACTGACTCGCTGCGCTCGGTCGTTCGGCTGCGGCGAGCGGTATCA
GCTCACTCAAAGGCGGTAATACGGTTATCCACAGAATCAGGGGATAACGCAGGAAAGAACATGTGAGCAAAAGGCCAGC
AAAAGGCCAGGAACCGTAAAAAGGCCGCGTTGCTGGCGTTTTTCCATAGGCTCCGCCCCCCTGACGAGCATCACAAAAA
TCGACGCTCAAGTCAGAGGTGGCGAAACCCGACAGGACTATAAAGATACCAGGCGTTTCCCCCTGGAAGCTCCCTCGTG
CGCTCTCCTGTTCCGACCCTGCCGCTTACCGGATACCTGTCCGCCTTTCTCCCTTCGGGAAGCGTGGCGCTTTCTCATA
GCTCACGCTGTaggtaTCTCagttcggT > SEQ ID NO:2858  215601  190901_300737_1
gaGTCACTATAGGGCGAATTCGAGCTCGGTACCCGGGGATCCTCTAGAGTCGACCTGCAGGCATGCAAGCTTGAGTATT
CTATAGTGTCACCTAAATAGCTTGGCGTAATCATGGTCATAGCTGTTTCCTGTGTGAAATTGTTATCCGCTCACAATTC
CACACAACATACGAGCCGGAAGCATAAAGTGTAAAGCCTGGGGTGCCTAATGAGTGAGCTAACTCACATTAATTGCGTT
GCGCTCACTGCCCGCTTTCCAGTCGGGAAACCTGTCGTGCCAGCTGCATTAATGAATCGGCCAACGCGCGGGGAGAGGC
GGTTTGCGTATTGGGCGCTCTTCCGCTTCCTCGCTCACTGACTCGCTGCGCTCGGTCGTTCGGCTGCGGCGAGCGGTAT
CAGCTCACTCAAAGGCGGTAATACGGTTATCCACAGAATCAGGGGATAACGCAGGAAAGAACATGTGAGCAAAAGGCCA
GCAAAAGGCCAGGAACCGTAAAAAGGCCGCGTTGCTGGCGTTTTTCCATAGGCTCCGCCCCCCTGACGAGCATCACAAA
AATCGACGCTCAAGTCAGAGGTGGCGAAACCCGACAGGACTATAAAGATACCAGGCGTTTCCCCCTGGAAGCTCCCTCG
TGCGCTCTCCTGTTCCGACCCTGCCGCTTACCGGATACCTGTCCGCCTTTCTCCCTTCGGGAAGCGTGGCGCTTTCTCA
TAGCTCACGCTGTAGGTATCTCaGttcggTgtaggtcgttcgCTCcaaGCtggGCTgtgTgcaCg

FIG. 2 continued

> SEQ ID NO:2859 215601 252701_301604_1
ACTATAGGGCGAATTCGAGCTCGGTACCCGGGGATCCTCTAGAGTCGGCCTGCAGGCATGCAAGCTTGAGTATTCTATA
GTGTCACCTAAATAGCTTGGCGTAATCATGGTCATAGCTGTTTCCTGTGTGAAATTGTTATCCGCTCACAATTCCACAC
AACATACGAGCCGGAAGCATAAAGTGTAAAGCCTGGGGTGCCTAATGAGTGAGCTAACTCACATTAATTGCGTTGCGCT
CACTGCCCGCTTTCCAGTCGGGAAACCTGTCGTGCCAGCTGCATTAATGAATCGGCCAACGCGCGGGGAGAGGCGGTTT
GCGTATTGGGCGCTCTTCCGCTTCCTCGCTCACTGACTCGCTGCGCTCGGTCGTTCGGCTGCGGCGAGCGGTATCAGCT
CACTCAAAGGCGGTAATACGGTTATCCACAGAATCAGGGGATAACGCAGGAAAGAACATGTGAGCAAAAGGCCAGCAAA
AGGCCAGGAACCGTAAAAAGGCCGCGTTGCTGGCGTTTTTCCATAGGCTCCGCCCCCCTGACGAGCATCACAAAAATCG
ACGCTCAAGTCAGAGGTGGCGAAACCCGACAGGACTATA

> SEQ ID NO:2860 215608 179786_300563_1
gctcgctAAGCACCTGCAAAACTTACCTTGACACTTTTGTCAATTTCATTCTTTAAGAACAACCGCATCAATAATCTTA
ATCAAGCTCCCTCGAGTTTAATTCCTAATACCGACAAAATGAAGTTCACCGCTGCTGTCGCTCTCGCCGCCGTTGGCGT
TTCTGCCGTCTACGTTCCTCCTAGCAACGTCACCGTTGTTACCGATGTCGTTGACCAATACGTCACCTACTGCCCCTAC
GCTACCCAGATCACCCACGGCAGCAAGACCTACACCGTCACTGAGCCCACCACTCTGACCATCACCGACTGCCCCTGCA
CCATCACCCGCCCCGTTACCGTCACCAGCAGCGTTGTCTGCAACACCTGCGGTAACGCCGCCCCTACTGGTGCTCCCTC
CGGTGGCAACGGCGGTGGTTACACTCCTCCTGCCTTCACCAACTCCACCATCACCACCCCTACCCAGGCCCCTCCCCCC
AGCGGCCCTGCCAGCACTGGTGGTGTTGTTCCTACTGCTCCTCCCGCCGTCCCCACTGGCGGTGCCAGCAAGGCCGTCC
TCTCCGGCGCCGGCCTTGCCGGTATCGTCGGTCTGGCcgcctTCGTCcTGTaaATCT > SEQ ID NO:2861 215610 142670_300500_1
ggaTTCTTTTCACTAACCAATTTTCTCTCCTACATTTCTTTAAACCCCATTCTTCTCTCCTAAGCCATGGCATCTGACA
AGAAGATCAAGATCGGAATCAATGGATTTGGAAGGATTGGTCGTTTGGTGGCAAGAGTTGCTCTGCAGAGAGATGATGT
TGAACTAGTTGCAGTGAACGATCCATTTATCTCTACTGATTACATGACATACATGTTTAAGTATGATTCAGTTCATGGA
CAATGGAAACACCACGAGCTTAAAGTCAAGGATGAAAAGACCCTTCTTTTTGGTGAGAAGTCCGTCAGAGTCTTCGGAA
TTAGGAACCCTGAAGAAATTCCATGGGCTGAAGCTGGTGCTGATTTCGTTGTGGAATCCACTGGTGTCTTCACTGACAA
GGACAAGGCTGCTGCTCACTTGAAGGGTGGTGCCAAGAAGGTCGTGATCTCTGCTCCTAGCAAGGATGCCCCATGTTT
GTTGTGGGTGTCAACGAGAAGGAGTACAAGCCAGAATATGACATTGTCTCCAATGCTAGTTGCACTACCAACTGCCTTG
CACCTTTGGCTAAGGTCATCAATGATAGGTTTGGAATTGTGGAGGGCCTCATGACTACTGTCCACTCCCTTACTGCCAC
CCAGAAGACTGTTGATGGGCCATCCATGaaggACT > SEQ ID NO:2862 215610 187137_300674_1
accgtgcacggccaatggaaGCACAGCGACATCAAGATCAAGGACTCCAAGACTCTGCTCTTGGGCGAGAAGCCGGTCA
CCGTTTTCGGCATCAGGAACCCTGACGAGATTCCGTGGGCTGAGGCTGGTGCTGAGTATGTCGTGGAGTCCACCGGTGT
CTTCACTGACAAGGAGAAGGCTGCTGCTCACTTGAAGGGTGGTGCCAAGAAGGTTGTCATCTCAGCCCCGAGCAAAGAT
GCTCCGATGTTTGTCTGCGGTGTCAACGAGGACAAGTACACTTCAGATATTGATATTGTCTCAAATGCTAGCTGCACCA
CAAACTGCCTTGCTCCTCTTGCCAAGGTCATTCATGACAACTTTGGTATTATCGAGGGTCTGATGACAACTGTTCATGC
CATCACTgccACCCAAAAGACCGTTGATGGACCGTCCAGCAAGGACTGGAGGGGTGggCaGGGCGGCCAGTTTTAACAT
CATTCCCAGCAgcaCTGGTGctgccaaaGCTgttgggaaggttCTTccTGATTTgaatggcaagcTTACGGGAATGTcc
Ttcc > SEQ ID NO:2863 215610 2210_300350_1
AATTCGGCACCAGCTCAATTTTTATAACGGATCCCTCTGCGATGTTCTCAGCTGATGCCGGGGCATCTTCTCCGTTTCC
TCTTCTGAAATCACAGGTGTATGGAGGATTGGTCGTTCGAAGGCTAGAGTTGCTCTGCAGAGAGATGATGTTGAACTAT
TTGCAGTGAACGATCCATTTATCTCTACTGATTACATGACATACATGTGTAAGTATGACTCAGTTCATGGACAATGGAA
ACACCACGAGCTTAAAGTCAAGGATGAAAAGACCCTTCTTTTTGGTGAGAAGTGCGTCAGAGTCTTCGGAATTAGGAAC
CCTGAAGAAATTCCATGGGCTGAAGCTGGTGCTGATTTCGTTGTGGAATCCACTGGTGTCTTCACTGAC > SEQ ID NO:2864 215610 226773_301004_1
GAGTTCCTCGTTTGCTCCGCCTCTCTTTCACTCATGGGCAAGATTAAGATCGGAATCAATGGGTTCGGCCGCATCGGCA
GGCTGGTGGCCAGGGTGGCGCTGCAGAGCGAGGATGTCGAGCTCGTTGCCGTCAACGATCCCTTCATCACCACCGAGTA
CATGACATACATGTTCAAGTATGACACCGTCCACGGCCAGTGGAAGCATCATGAGGTCAAGGTCAAGGACTCCAAGACC
CTCATCTTTGGCACGAAAGAGGTTGCGGTGTTCGGCTGCAGGAACCCTGAGGAGATCCCATGGGCTGCGGCTGGTGCTG
AATACGTTGTTGAGTCTACTGGTGTTTTCACCGACAAGGACAAGGCAGCAGCTCACTTGAAGGGTGGTGCCAAGAAGGT
CGTCATTTCTGCTCCCAGCAAAGACGCCCCATGTTCGTTGTTGGTGTCAACGAGAAGGAGTACAAGTCTGACGTTAAC
ATTGTCTCCAACGCTAGTTGCACCACCAACTGCCTGGCTCCTCTCGCCAAGGTCATCAATGACAGATTTGGCATCGTTG
AGGGTTTGATGACCACTGTCCATGCCATCACTGCTACCCAGAAGACTGTTGATGGGCCCCTCGATGAAGGACTGGAGAG
GTGGAAGGGCTGCTAGCTTCAACATCATTCCTAGCAGCACTGGAGC

FIG. 2 continued

> SEQ ID NO:2865 215610 211750_300870_1
gcgCAAGCATCCCTATCGTATCAACTTTCAACTCCAGTCACAAATCAGCTACAATGGCTCCCATCAAGGTCGGCATCAA
CGGCTTCGGTCGAATTGGACGTATCGTCTTCCGCAACGCTGTTGAGCACCCCGACATCGAGGTCGTCGCCGTCAACGAC
CCCTTCATCGAGACCACCTATGCTGCCTACATGCTCAAGTATGATTCCTCCCACGGTATTTTCAAGGGCGACATCGATG
TCGATGGCAAGGACCTCGTTGTGAACGGCAAGAAGGTCCGCTTCTACACCGAGCGTGACCCTGCCAACATCAAGTGGAG
CGAGACTGGCGCCGACTACATTGTCGAGTCCACCGGTGTCTTCACCACCACCGACAAGGCCAAGGCTCACTTGGCTGGC
GGTGCCAAGAAGGTCATCATCTCTGCCCCCTCTGCCGATGCCCCCATGTACGTGATGGGTGTCAACGAGGACAAGTACG
ACGGCTCTGCCGATGTCATCTCCAACGCCTCTTGCACCACCAACTGCCTGGCTCCCCTCGCCAAGGTCATCCACGACAA
CTACGGCATCGTTGAGGGTCTCATGACCACTGTCCACTCCTACACTGCCACCCAGAAGACCGTCGATGGTCCCTCCGCC
AAGGACTGGCGTGGTGGCCGTGGTGCTGCCCagaaCATGATCCCCagcAGCACTGGtGc > SEQ ID NO:2866 215610 207512_300806_1
cccacgcgtccgcgcatctcatcCCTCCTCTCGCTTAGTTCAGATCGAAATCGCAAATGGCGAAGATTAAGATCGGGAT
CAATGGGTTCGGGAGGATCGGGAGGCTCGTGGCCAGGGTGGCCCTGCAGAGCGACGACGTCGAGCTCGTCGCCGTCAAC
GACCCCTTCATCACCACCGACTACATGACATACATGTTCAAGTATGACACTGTGCACGGCCAGTGGAAGCATCATGAGG
TTAAGGTGAAGGACTCCAAGACCCTTCTCTTCGGTGAGAAGGAGGTCACCGTGTTCGGCTGCAGGAACCCTGAGGAGAT
CCCATGGGGTGAGACTGGCGCTGAGTTTGTTGTGGAGTCCACTGGTGTTTTCACTGACAAGGACAAGGCCGCTGCTCAC
CTGAAGGGTGGTGCTAAGAAGGTCGTCATCTCTGCTCCCAGCAAGGATGCCCCCATGTTTGTTGTTGGTGTCAATGAGA
AGGAGTACAAGCCTGACATCGACATTGTGTCCAATGCTAGCTGCACCACCAACTGCCTTGCTCCACTTGCCAAGGTTAT
CAATGACAGGTTTGGTATTGTTGAGGGTTTGATGACCACTGTCCATGCAATCACTGcaaCtCAGAAGacCGTTGATGGA
CCCTCGagcaaggactggAGgggt > SEQ ID NO:2867 215610 187192_300674_1
ATTCGTTTTTGAGTTCCTCGTTTGCTCCGCCTCTCTTTCACTCATGGGCAAGATTAAGATCGGAATCAATGGGTTCGGC
CGCATCGGCAGGCTGGTGGCCAGGGTGGCGCTGCAGAGCGAGGATGTCGAGCTCGTTGCCGTCAACGATCCCTTCATCA
CCACCGAGTACATGACATACATGTTCAAGTATGACACCGTCCACGGCCAGTGGAAGCATCATGAGGTCAAGGTCAAGGA
CTCCAAGACCCTCATCTTTGGCACGAAAGAGGTTGCGGTGTTCGGCTGCAGGAACCCTGAGGAGATCCCATGGGCTGCG
GCTGGTGCTGAATACGTTGTTGAGTCTACTGGTGTTTTCACCGACAAGGACAAGGCAGCAGCTCACTTGAAGGGTGGTG
CCAAGAAGGTCGTCATTTCTGCTCCCAGCAAAGACGCCCCCATGTTCGTTGTTGGTGTCAACGAGAAGGAGTACAAGTC
TGACGTTAACATTGTCTCCAACGCTAGTTGCACCACCAACTGCCTGGCTCCTCTCGCCAAGGTCATCAATGACAGATTT
GGCATCGTTGAGGGTTTGATGACCACTGTCCATGCCATCACTGCTAC > SEQ ID NO:2868 215610 230790_301071_1
aagaaaatttgtagatcttgtgtgtggcactggtggaggaagcgctcgccatcgctaggttagaagagttttcttcctt
tTCCTTTTCTTTAAATCATCCTTGATATTTCGATCGATTCTCGCCCATGGCCGCCGCAACGATGATGAAATCCACACTG
GCAGCGAGCTGTTCGTCGCTAGATCGAGTCGCCGCCACGAATGCGTCGCCGGCAGCGTCTTGTACCATGGTCGCGTCGC
CAAAGGCAAAAGCTTTTAAGATGTCCAGTTTctTTGCCGGATCCGAGGTGGGCTTGTACTCGGCTCCATTGTCGAGTCG
TGTGGCCAAGGGTTCAATGGTTCCAGTGAGGGCAGCACTTGCCGAGGCCCCGACCAAGCCAAAATCTGCTGGAACGAAA
GAGAAGACTCGAATTGCCATCAATGGCTTTGGACGCATTCGCAGACTGGTTCTCCGGgttgCGTTGACAAGAGACGACA
TCGAGGTTGTCGCAGTGAATGATCCATTCACCAGTTCGAAGTATATGGCTTACCTCTTTAAGTATGATTCCACTCACGG
GATCTTCCACGAGGAAGTGAAAGCCGTCGATGATAGCACGCTTGAAGTTGGTGGTCACAAGATCAAGGTTTTCGGACAG
CGTGACCCCGCTGATAtTCCATGGGGTGATGCCGGCGTCGACTTCGTCGTGGAGGCCTCTGGTgtct > SEQ ID NO:2869 215610 284141_200158_1
ctcaaacctaccgcctccattgttcgaccttcccatcgttcccaggtatcatgtgcaggtcttcaccagagtgctaact
cTGTCAAATTACAATCGTCCATCTTCGGAGATGCTGTCTCAGTCATGCAATGTTCGTCCTtattttattctGGTGCCTG
TAGCATTCAACCTGTTAGAGCAACTGCTACTGAGTTGCCTCCGACAGTTCCAAAGTCACGGACCAGTGGGAAGACAAGG
ATTGGTATAAATGGTTTTGGACGGATTGGGAGATTGGTATTACGAATTGCAACATTCAGGGATGATATTGAAGTTGTGG
CAGTTAATGACCCATTTATCGATGCAAAGTACATGGCTTACATGTTCAAGTATGACTCCACTCACGGGGTCTACAACTC
ATCCATCAGTGTCCTGGATGAGTCTACTTTGGAAATCAATGGAAGCAGATTAAAGTCAGTAGCAAAAGGGATCCCGCA
GATATTCCATGGGGTGATTTAGGTGCAGATTACGTTGTTGAATCTTCCGGTGTCTTCACAACTGTTGAGAAGCCTCAG
CACATAAGAAGGGTGGTGCAAAAAAGGTCGTAATCTCAGCTCCATCAGCTGATGCACCTATGTTTGTGGTAGGAGTGAA
TGAGAGAACTTACAAAACCACCATGGATGTTGTTTCTAATGCTAGCTGTACTACCAATTGCCTTGCTCCTCTTGCCAAG
GTggtTCATGAGGAGTTTGGCATTgttGaggGATTAATGACAACTgtgCATGCAACAACAGCTACCCAAAAGactgttG
ATGggCcatCGATg

FIG. 2 continued

> SEQ ID NO:2870 215610 233907_301095_1
ttcttcgatcagcgaaaagctctctctagtttcttcgaTTCTTCTACAGCGATGGGTTCCGAAGGACACAAGGTGAAGC
TTGGAATCAATGGATTTGGCCGGATCGGGAGGCTTGTGGCCCGAGTCGCGCTGGAACGCGACGATATTGAGCTCGTGGC
GGTGAATGATCCATTCATCAGCACAGACTATATGGCATACATGTTCAAGTATGACAGTGTCCATGGGAAATGGAAGAAG
GCCGATATTGAGGTCAAGGACCAGGAAACTCTGTCCTTTGGAGGCAAGGCCGTCAAGGCCTTTGGCTGCAAGGATCCCT
CCGATATTCCCTGGGGAAAGTGCGGTGTTGATTTCGTGGTGGAATCCACGGGTGTTTTCACCGAGAAGGAAAAGGCCTC
GGCACATCTCAAGGGTGGAGCAAAGAAGGTGATTATCTCGGCTCCCAGCAAGGATGCTCCAATGTTCGTCGTTGGTGTC
AACGAGACCGAGTACAAGAAGGATATGGATATTGTTTCCAACGCAAGTTGCACTACGAATTGTCTTGCTCCTCTTGCCA
AGGTCATTCACGATAAGTTTGGCATTGTCGAGGGCCTTATGACCACTGTGCACTCCCTTACTGCCTCGCAGAAGACTGT
CGATGGGCCGTCTTCCAAGGACTGGCGCGGTGGAAGAGGTGCCGGCTTTAACATCATCCCCAGCTCAACTGGAGCTgcc
AaggctgtgggaaaGGTgttacccgAtctGA > SEQ ID NO:2871 215611 223974_300977_1
GACACATACAAAAATGGCTACCAAGTCCGGAATCGCTATTGGACCCAACAAGGGCCACAAGGTCACTGCCCGAACCCCC
GCCACTCGAGTTTCTCGACGAAAGGGTGCCCTCTCTAAGCGATCCGCTTTTGTCCGAGACCTCGTAAAGGAGGTTACCG
GCCAGGCTCCTTACGAGCGACGAATCATTGAGTTGCTGCGAAACTCCAGTGATAAGCGAGCTCGAAAGCTCGCTAAGAA
GAAGCTCGGTACTTTCGGCCGTGCTAAGGCTAAGGTTGAGGACATGAACAACGTCATCACCGCTTCTCGACACGCCTAA
ATTAGCTAGCATATGTATTAAAAGTATGGAAATACACCCAAAAATGTTTGATT > SEQ ID NO:2872 215629 1007809_301403_1
acgcgtcgcATTTTTCGTTCTTTTTGCGTTTCTCTCTCTCTCTCGCTCTCTCTTTCTGTTTCCTGTGAAAATGCAGATC
TTTGTGAAGACCCTGACGGGGAAGACCATCACCCTGGAGGTGGAAAGCTCCGACACCATTGATAACGTCAAGGCCAAGA
TCCAAGACAAGGAGGGCATCCCCCCTGACCAGCAGCGCCTCATCTTTGCCGGGAAACAGCTTGAAGATGGCCGTACCCT
TGCAGACTACAACATCCAGAAGGAGTCCACCCTCCACCTTGTCCTCCGCCTCCGAGGTGGTATGCAAATCTTCGTCAAA
ACCCTCACCGGTAAGACCATCACCCTCGAAGTTGAGAGCTCTGACACTATCGACAATGTCAAGGCCAAGATCCAAGACA
AGGAAGGGATTCCCCCTGATCAGCAGAGGCTTATCTTCGCTGGGAAGCAGCTCGAAGACGGGCGAACCCTCGCTGACTA
CAACATCCAAAAGGAGTCCACCCTCCACCTCGTGCTGAGGCTCCGGGGAGGCATGCAGATCTTTGTCAAAACCCTGACG
GGGAAGACAATAACACTGGAGGTGGAAAGCTCTGACACAATTGACAACGTTAAAGCTAAGATTCAAGACAAGGAAGGGA
TCCCCCCCCGATCAGCAGCGTTTGATCTTTGccGGCAAGCAGCTGGAAGA > SEQ ID NO:2873 215629 1113020_301794_1
GAGAGAGAGAGAGAGAGAGAGAGAAGATGCAGATATTCGTGAAGACCCTGACGGGGAAGACCATCACCCTAGAGGTCGAGA
GCAGTGACACCATCGACAATGTCAAAGCCAAGATCCAGGACAAGGAAGGCATCCCCCCTGATCAGCAACGACTTATCTT
TGCCGGCAAGCAGCTGGAAGATGGCCGGACATTGGCAGACTACAATATCCAGAAAGAATCCACCTTGCACCTTGTTCTG
AGGCTCCGAGGTGGTATCATCGAGCCTTCACTGATGGCACTGGCTAGGAAGTACAATCAAGAGAAGATGATATGCCGCA
AATGTTATGCCCGCCTCCATCCTCGTGCAGTGAACTGCAGAAAGAAGAAATGTGGACACAGCAATCAGCTTCGCCCTAA
GAAGAAGATCAAGTAGATTTGACGCATCCTTCGGAGAGATTGAGGACCTATAACATTAGTGAGAGTGTTTTTTTgATTA
TCTATTGCCAGAATTGAATTTAGCACACTGGTCTCCCATCGGAACTTTTCTAATATTATATAATCAGTACTTTTTgtTGA
ACCAATAGCGTGTtGATCTTTTCATCCTTTTCAACATATGGAAttgtGTCGGGGTTAATTGAAAATGGCtAtaaATGAt
ttgg > SEQ ID NO:2874 215629 1110809_301539_1
GGGCAGGTAGAGGTGGAGGCAAGCGGGGGAAGATGCAGATATTTGTGAAGACCCTGACGGGGAAGACCATCACCCTCGA
GGTCGAGAGCAGTGACACCATCGATAATGTCAAAGCAAAGATCCAAGACAAGGAAGGAATTCCACCGGATCAGCAGAGG
CTTATTTTTGCTGGGAAACAACTGGAGGATGGTCGCACATTGGCTGACTACAATATCCAGAAAGAGTCTACTTTGCACC
TTGTTTTGAGGCTTCGAGGTGGTATCATAGAGCCTTCGCTGATGGCGCTCGCCAGGAAGTATAATCAAGAAGATGAT
ATGTCGCAAGTGCTATGCTCGTCTTCATCCTCGCGCTGTGAACTGCAGAAAAAGAAATGTGGGCACAGCAATCAGCTT
CGACCAAAGAAGAAGATCAAGTAGGTTGTTCGGTTGCAGCCTCTCCAGATATTCAGAATCTTGTTTTTTTTgCTGATTT
GAGGAAAAGTTGTTTGAGTGccATTTACCATGTTTTGGTGCAAGTGGCACTCTTATTATGTTAATCTCTGCAAGTAAT
TACTGACGATGAgtcGTTTgcaTTTgAattttCGGAACAAAAGgaatttgaattgcattttAGCtttcagaatcACAAT
ATCcaaaca > SEQ ID NO:2875 215629 154790_301351_1
gtcggattatcttctctacttctttcatcgccttcaaatttctctctcaaggtttgagaaaatttcctcaatttctcgc
tttaggagttctttttttattgaatcaccagatTGGGTGTGTCAAGCCCTAATTTTGAAGTTCATTTTTTCAAtTGTTTG
TTGTTGATTTTATGTTATAACAGATGCAGATCTTCGTAAAAACCCTAACCGGTAAGACCATCACTCTCGAGGTTGAGAG

FIG. 2 continued

```
TTCCGACACAATCGACAACGTAAAAGCCAAAATCCAGGACAAGGAAGGAATTCCCCCAGATCAGCAAAGGCTTATCTTC
GCCGGCAAGCAGCTTGAGGACGGCCGTACTCTCGCCGATTACAACATCCAGAAGGAATCTACTCTTCACTTGGTCCTCC
GTCTGCGTGGTGGGATGCAGATTTTCGTCAAAACCCTCACTGGCAAAACAATCACCCTTGAGGTGGAAAGTTCTGACAC
CATCGACAATGTCAAGGCTAAAATTCAGGATAAGGAGGGGAATTCCACCAGACCAGCAGAGGTTGATCTTCGCCGGCAAG
CAGCTTGAGGATGGTCGTACCCTTGCCGATTACAACATCCAGAAGGAGTCTACCCTTCACCTTGTCCTCCGTCTCCGTG
GTGGTATGCAGATCTTTGTCAAAACGCTCACCGGCAAAACCATCACCCTTGAGGTCGAGAGTTCCGACACCATCGACAA
TGTCAAGGCCAAAATTCAGGACAAGGAGGGCATTCCCCCAGACCAGCAGAGGTTGATTTTCGCTGGCAAGCAGCTCGAG
GATGGCCGTACACTAGCTGATTATAACATCCAGAAGGAATCCACCCTTCACCTTGTCCTCCGTCTCCGTGGTGGTATGC
AGATCTTCGTCAAAACACTCACCGGCAAGACCATCACCCTGGAGGTTGAAAGCTCTGACACCATTGACAATGTCAAGGC
CAAGATCCAGGACAAGGAGGGGATTCCCCCAGACCAGCAGAGGTTGATCTTTGCAGGTAAGCAGTTGGAAGATGGTCGC
ACCCTTGCGGACTACAACATTCAGAAGGAGTCCACCCTGCACTTGGTGCTGAGGCTGAGGGGAGGAATGCAGATCTTCG
TGAAGACATTGACCGGGAAGACCATCACCTTGGAGGTGGAGAGCTCTGACACCATCGACAATGTAAAAGCTAAGATCCA
GGACAAGGAGGGTATCCCACCCGACCAGCAGAGGTTGATCTTTGCTGGGAAGCAGCTCGAGGATGGAAGGACCTTGGCT
GACTACAATATCCAGAAAGAGTCAACCCTTCACCTTGTCCTCCGTCTCCGTGGTGGTTTCTAGGTTGTCTGTTGTTGAT
GACGTGGTGTCCTGTTAATTGGCTGTGTTGTCTGTTTCTAGTTGTGGTCATGATGTGCTTTGTTTGCTGAGGTCTCAAT
GATGTTCCATTCTGTTTCTGTTCGCTGTTTCTTTTATGTTCTCTgttgtgaataaagattccgatttctgt > SEQ ID NO:2876 215629 13944_300246_1
CCCACGCGTCCGAAAAAGATGCAGATCTTCGTGAAAACCCTAACGGGGAAGACGATCACTCTCGAGGTCGAGTCCTCTG
ACACCATCGACAATGTCAAGGCCAAGATCCAAGACAAGGAAGGAATCCCACCGGACCAGCAGCGATTGATTTTCGCCGG
AAAGCAGCTCGAAGACGGACGTACCTTAGCCGATTACAACAT > SEQ ID NO:2877 215629 135385_300413_1
GGGAAGCGAAGCTTTGCGTTCTCTAATCGCCTCGTCAAGATGCAGATATTCATTAAGACCCTCACTGGCAAGACCATCA
CCTTGGAGGTTGAGTCCTCCGATACGATTGACAATGTGAAGGCTAAGATTCAGGACAAGGAGGGCATCCCTCCGGACCA
GCAACGCCTTATCTTCGCTGGCAAGCAGCTTGAGGATGGGCGTACTCTCGCGGATTATAACATCCAGAAGGAGTCCACC
TTGCACCTTGTCCTCCGCCTTCGTGGAGGCATGCAAATATTCGTGAAGACCCTCACCGGCAAGACCATTACCCTGGAGG
TCGAGTCCTCCGACACGATCGATAATGTGAAGGCCAAGATCCAGGACAAGGAGGGAATCCCACCAGACCAGCAGCGTCT
CATCTTTGCTGGGAAGCAGCTCGAGGATGGCCGCACCCTTGCAGACTACAACATCCAAAAGGAATCCACCCTGCACCTT
GTCCTGCGCCTCCGGGGCGGTATGCAGATCTTTGTGAAGACCCTTACTGGCAAGACGATCACCTTGGAGGTTGAGTCCT
CTGACACGATCGACA > SEQ ID NO:2878 215629 128329_300475_1
agcGGCACTCCTCACCTTGATAATCTTGGTGCACATAGTTGGGAAAGATGCAGATATTCGTGAAGACCCTGACAGGGAA
GACTATTACCTTAGAGGTAGAGTCATCCGACACCATTGACAATGTTAAGGCTAAGATTCAGGACAAGGAAGGCATTCCA
CCAGACCAGCAGCGGTTGATTTTCGCAGGTAAGCAGCTTGAGGATGGCCGAACACTAGCCGACTACAACATCCAGAAGG
AGTCCACCCTCCACCTTGTCCTTCGCCTCCGTGGTGGTGCAAAGAAGCGTAAGAAGAAGACTTACACTAAGCCAAAGAA
GATTAAGCACAAGAAGAAGAAGGTTAAGCTCGCCGTCCTCCAGTTTTACAAGGTTGATGATTCTGGTAAGGTTCAGAGG
CTCCGCAAGGAGTGTCCCAACGCCGAGTGTGGTGCCGGGACTTTCATGGCTAACCACTTTGACAGGCACTATTGTGGTA
AATGTGGGCTTACCTATGTTTACCAGAAGGCTGGTGGTGATTAGATGAGTGTTACTTTGCTTATTACTTTTCCCCACAT
TTCTTGCCTTAAACTCTCCTAATGTCTTGTTTGTGACAAGATGTAATGAATTTGAATTATGGTATTgtGTTAGCAGCTT
ATGAaAt > SEQ ID NO:2879 215629 120052_300083_1
ggaaaaaggaaGCCGGAGCTCGTAACGAAAATGCAGATATTCGTGAAAACTCTCACTGGTAAAACCATTACTCTCGAAG
TTGAATCCAGTGATACAATCGACAATGTTAAAGCCAAAATACAAGACAAAGAAGGAATTCCACCGGACCAACAAAGGCT
GATTTTTGCTGGTAAGCAGCTCGAAGATGGACGCACCTTGGCCGATTACAACATCCAAAAAGAATCGACTCTACATTTG
GTGCTGAGGCTTCGTGGTGGAATCATTGAACCATCGTTGATGGCTTTGGCTAGGAAATACAATCAGGACAAGATGATAT
GCCGCAAGTGCTATGCTCGATTGCATCCCCGTGCTGTCAATTGCCGCAAGAAGAAGTGTGGACACAGCAACCAGTTGAG
GCCTAAAAAGAAGATTAAGTAGATGTAAATTTCTATTGCTGCGGACTTGTAGTTGTTGGCGGTATTAGATCTTTCAGAA
ACTGAACTTGGATTTCTTACCAAAAAAACAAATTGTACTTGGGTTTATCTTTGGGTTCTGttCTTTTTACCCCTtaag
attCATGgcttgtaTTTGGGaggtaAATGAAATCAATCagTATACTATAATTgCTATTTTGCTttGataTtggttTTTG
AaTCtt > SEQ ID NO:2880 215629 1171691_302057_1
ctcgaccacgcgtcggttttctttcagttgtgaatattgcttgctttctctctctctgtctctctctctctcttctgt
cTACCCTTTCTCTCtctgtcCtctgTTGAGCCAAGAAGAAGATGCAGATCTTCGTGAAGACCCTGACCGGCAAGACCAT
CACCCTCGAGGTCGAAAGCTCCGACACCATTGACAACGTCAAGGCCAAGATCCAGGACAAGGAGGGAATCCCCCCTGAC
CAGCAGCGCCTCATCTTTGCCGGTAAACAGCTCGAAGACGGCCGCACCCTTGCCGATTACAACATACAGAAGGAGTCTA
```

FIG. 2 continued

CCCTCCACCTTGTCCTTCGCCTCAGGGGCGGTATGCAAATCTTCGTCAAAACCCTCACTGGCAAGACCATTACCCTTGA
AGTCGAGAGTTCTGATACCATCGATAATGTGAAAGCCAAGATCCAAGATAAGGAGGGAATTCCCCCTGACCAGCAGCGC
CTTATCTTTGCTGGTAAACAGCTTGAAGATGGCCGCACCCTCGCTGATTACAACATACAGAAGGAGTCTACCCTCCACC
TTGTCCTTCGCCTCAGGGGTGGTATGCAAATCTTCGTCAAAACCCTCACCGGCAAGACCATTACTCTTGAAGTCGAGAG
TTCTGACACAATTGATAACGTGAAAGCCAAGATCCAAGATAAGGAGGGAATtcCCCCCGAccAGCAGAGGCTCATCTTT
GCTGGGAAGCAACTtgaagAtggTCGCA > SEQ ID NO:2881  215629  1100617_301462_1
GGAAGGGAGGAAGGGTGGTGTGGGTGGATTTGGAGGGGCCAAGATGCAGATCTTTGTGAAGACCCTGACAGGGAACACC
ATCACCCTAGAGGTTGAGAGTAGTGACACCATCGATAATGTCAAGGCTAAGATCCAAGATAAGGAAGGTATCCCCCCTG
ATCAACAACGCCTGATCTTTGCTGGAAAACAGCTTGAAGATGGCAGAACCTTGGCTGACTACAACATTCAGAAAGAGTC
CACGTTGCATTTGGTTCTAAGGTTGCGAGGTGGTATCATTGAGCCATCTCTGATGGCTCTTGCCAGGAAGTACAACCAG
GAGAAAATGATCTGTCGCAAATGCTATGCTAGGCTTCATCCTCGGGCTGGGAAT > SEQ ID NO:2882  215629  104542_300370_1
aggcattgagctacacactatcatagtatcattccattctgaagaaagaagaAATTCTAGCGCCGTAGTGCTCCTCGAG
TTCTCTCCTCCAAAGCGAAGATGCAGATCTTCGTGAAACCCTAACAGGTAAAACAATCACCCTTGAGGTTGAATCTTC
CGACACAATCGATAATGTGAAAGCCAAGATCCAAGATAAGGAAGGGATTCCCCCAGATCAGCAGCGTCTGATTTTCGCC
GGAAAGCAGCTTGAAGACGGCCGAACCCTAGCTGATTACAACATCCAGAAGGAGTCGACTCTTCATCTCGTGCTCCGCC
TCCGTGGTGGTGCTAAGAAGAGGAAGAAGAACTTACACCAAGCCTAAGAAGATTAAGCACAAGAAGAAGAAGGTTAA
GCTCGCTGTACTTCAGTTCTATAAGGTGGATGATTCTGCAGAAAGTCCAGAGGCTTCGTAAGGAGTGTCCTAATGCCGA
TGTGGTGCTGGAACTTTTATGGCTAACCACTTTGACCGTCACTACTGTGGTAAGTGTGGGCTCACCTATGTTTACAACA
AGGCCGGTGCCGATTGATCCCTATGTTTAGCTCTGTTTTAATGCTGTCGTCAATTTTATCTTTTTGTCGAACGGTTATT
TAGTATGGATTTTCCTTTTaaaTGATGTGGcaaccttgggattgttgAGTTATTTAACAGTtTTTGCTCGTTCTTAA > SEQ ID NO:2883  215629  228048_301033_1
AATCGACCGAAGGGGAGGGGGAGCGAAGCTTTGCGTTCTCTAATCGCCTCGTCAAGATGCAGATATTCGTTAAGACCCT
CACTGGCAAGACCATCACCTTGGAGGTTGAGTCCTCCGATACGATTGACAATGTGAAGGCTAAGATTCAGGACAAGGAG
GGCATCCCTCCGGACCAGCAACGCCTTATCTTCGCTGGCAACAGCTTGAGGATGGGCGTACTCTCGCGGATTATAACA
TCCAGAAGGAGTCCACCTTGCACCTTGTCCTCCGCCTTCGTGGAGGCATGCAAATATTCGTGAAGACCCTCACCGGCAA
GACCATTACCCTGGAGGTCGAGTCCTCCGACACGATCGATAATGTGAAGGCCAAGATCCAGGACAAGGAGGGAATCCCA
CCAGACCAGCAGCGTCTCATCTTTGCTGGGAAGCAGCTCGAGGATGGCCGCACCCTTGCAGACTACAACATCCAAAAGG
AATCCACCCTGCACCTTGTCCTGCGCCTCCGGGGCGGTATGCAGATCTTTGTGAAGACCCTTACTGGCAAGACGATCAC
CTTGGAGGTTGAGTCCTCTGACACGATCGACAATGTGAAGGCCAAGATCCAGGACAAGGAGGGTATTCCACCAGAcCAG
CAgcgCCTCATCTTCGCTGGCAAGCA > SEQ ID NO:2884  215629  226271_300995_1
gcgacagttagcaggaatcatCGACAACAATGCAAATCTTTGTCAAGACCCTTACTGGCAAGACTATCACCCTCGAGGT
GGAGTCCTCTGACACCATTGACAACGTCAAGTCCAAGATCCAGGACAAGGAGGGAATCCCCCCGGACCAGCAGCGACTT
ATCTTCGCCGGTAAGCAGCTCGAGGACGGCCGAACTCTTTCCGACTACAACATCCAGAAGGAGTCCACTCTCCATCTCG
TTCTGCGACTCCGAGGAGGTATCATCGAGCCCTCTCTCAAGGCTCTTGCCTCCAAGTACAACTGTGAGAAGGCCATCTG
CCGAAAGTGCTACGCCCGACTTCCTCCTCGAGCCACCAACTGCCGAAAGAAGAAGTGCGGACACACCAACCAGCTCCGA
CCCAAGAAGAAGCTCAAGTAAACTATTCGCATGTATGGTATATGtataaaaaTTCTGTT > SEQ ID NO:2885  215629  224458_300972_1
gGTGATTTCTAAACATGCAGATcTTTGTGAAGACCtTGACCGGCAAGACTATCACCCTCGAGGTGGAGAGCTCGGATAC
CATCGACAACGTTAAGACCAAGATCCAGGACAAGGAAGGGATCCCACCGGACCAGCAACGATTGATCTTCGCCGGGAAG
CAGCTTGAGGACGGACGGACCCTTGCGGACTACAACATCCAGAAGGAATCTACGCTTCACCTGGTTCTTCGTCTCCGCG
GTGGCATGCAGATATTTGTGAAGACCTTGACCGGCAAGACCATCACCCTCGAGGTGGAGAGCTCGGATACCATCGACAA
TGTCAAGACCAAGATCCAGGATAAGGAGGGATTCCTCCGGACCAGCAGCGACTTATCTTCGCCGGGAAGCAACTCGAG
GACGGACGGACCCTTGCCGACTATAACATCCAGAAGGAGTCGACTCTCCACTTGGTTCTTCGTCTCCGCGGTGGCATGC
AGATATTTGTGAAGACACTGACCGGCAAGACCATCACCCTCGAGGTGGAGAGCTCGGACGATTGACACGTTAAGAC
GAAGATCCAGGACAAGGAAGGGATCCCTCCTGACCAGCAGCGCCTCATCTTCGCCGGCAAGCAGCTCGAGGATGGACGA
ACTCTCGCCGACTACAACATCCAGAAGGAATCCACCCTTCACCTGGTGCTGCGTCTCCGCGGAGGCATGCAAATCTTCG
TCAAGACCCTGACCGGCAAGACCATCACTCTGGAGGTGGAGAGCTCGGATACCATCGACAACGTGAAGACCAAGATCCA
GGACAAGGAGGGAATTCCTCCGGACCAGCAGCGGTTGATCTTCGCGGGTAAGCAGCTCGAGGATGGGCGCACTCTTGCC
GACTACAACATTCAGAAGGAGTCTACACTCCATTTGGTGCTGCGTCTTCGCGGAGGCATGCAGATCTTCGTCAAGACCC
TCACGGGTAAGACGATCACCCTGAAGTCGAGAGCTCAGACACCATCGACAACGTGAAGACCAAGATCCAGGACAAGGA
GGGAATTCCTCCGGATCAGCAGCGGTTGATCTTCGCGGGTAAGCAGCTCGAAGATGGGCGCACTCTCGCCGACTACAAC

FIG. 2 continued

ATTCAGAAGGAGTCTACTCTCCATTTGGTGCTGCGTCTTCGCGGAGGCATGCAGATCTTCGTCAAGACCCTCACGGGTA
AGACGATCACGTTGGAGGTGGAGAGCTCGGACACGATTGACAACGTGAAGACCAAGATCCAGGACAAGGAGGGAATTCC
TCCGGACCAGCAGAGGCTGATCTTCGCCGGGAAGCAGCTCGAGGATGGCCGCACTCTTGCGGACTACAACATCCAGAAG
GAGTCTACTCTCCATTTGGTGCTCCGTCTTCGTGGAGGCCAGTAGATAGCATGTAGCGCgttagCGCGTGAAGTAt > SEQ ID NO:2886 215629 220302_300954_1
tccgcaacatctgaagattgcttaggacggcaataggtctattgtcgaggtatgtctgaaagatgctgcatttctatct
gCCCTCCATGAGCTCCGGGAGCTTCATGAGGGAATCATCGTTGATGTCTCCCTCTTGAGCATTCTTCTTTGTTTCCCGG
AGCTCTATTCCCCAAATCCCGAGATATTGCTCGTTGTCGCGAAGAAATTTGCAACACGGCAATTCTCGCCTTCTTCTCC
CCAAAGTCAACTCACGCAGGCAATGTATGCTGGGCAAACAAATCTAACCCTTCCAGTTAGGCAAGATGCAGATTTTCGT
CAAGACCCTCACGGGGAAGACGATCACCCTTGAGGTGGAGTCTTCCGACACCATCGACAATGTCAAGTCCAAGATCCAG
GACAAGGAGGGCATTCCCCCGGACCAGCAGCGATTGATCTTCGCTGGTAAGCAGCTGGAGGATGGCCGAACCCTCTCCG
ACTACAACATCCAGAAGGAGTCTACCCTCCACCTGGTCCTGCGCCTGCGTGGTGGTGCCAAGAAGAGAAAGAAGAAGGT
CTACACCACCCCCAAGAAGATTAAGCACAAGCGCAAGAAGACCAAGTTGGCTGTCCTCAAGTACTACAAGGTCAGCAAC
GATGGTAACATCGAGCGTCTCCGCCGCGAGTGCCCCAGCGAGACTTGCGGTGCTGGTGTCTTCATGGCTGCCATGCCTG
ACCGTCAATACTGTGGTCGTTGCCACCTGACCTACGTCTTCGACAAGCAGTAAACGACAAAACTTTCAAAAAGGGAAAA
AATTTATTGTGGATTGGACAGCTGGAGCCATGGGACTGCCATAACACACAAAGGCGTTGATGTAGCATTAGAGAGCACA
TCCGGCGGCTTCtggTAATGaat > SEQ ID NO:2887 215629 194175_300761_1
gccgccgcagcagcaaggagctagagagacaaggggagagagccccggggaagaagaagaagCAGCAGCTAGGGCGCC
AAGATGCAAATCTTCGTGAAGACCCTGACTGGGAAGACCATCACCCTCGAGGTGGAGAGCAGCGACACCATCGACAATG
TCAAGGCTAAGATCCAGGACAAGGAGGGAATCCCGCCGGACCAGCAGCGGCTGATCTTCGCCGGGAAGCAGCTGGAGGA
CGGACGCACCCTGGCTGACTACAACATCCAGAAGGAGTCCACCCTCCACCTCGTCCTCAGGCTCCGTGGCGGTATCATC
GAGCCGTCGCTTCAGGCGCTTGCCCGCAAGTACAACCAGGACAAGATGATCTGCCGCAAATGCTATGCGCGCCTGCACC
CTAGGGCTGTCAACTGCCGCAAGAAGAAGTGTGGTCACGACAACCAGCTGAGGCCCAAGAAGAAGATCAAGAACTAGAG
CGTCACTCGCCGGGTTCATGGACTGGTTAAATCAATCGTCATATTAGACTTTTATGCTTCCGTTGTTaTCTCCCTGGAT
GTTGTTGAACCGTGTTTTACTGTGCTGGATGCTtcagCTTCTTGTTTTGACGGTCGTGGTATATGGTAAttGgcagcaa
aCTATAttggtcatgtcgaAATtGTc > SEQ ID NO:2888 215629 191443_300785_1
cccggaccttgcTCCACACCCGCAGCAGCAGCAGCAGCAAGGAGAAGAAGAAGAGCCAAGATGCAGATCTTCGTGAAGA
CCCTAACGGGGAAGACCATCACGCTCGAGGTCGAGGCGACGACCATCGACAATGTCAAGGCCAAGATCCAGGACAA
GGAAGGCATCCCTCCGGACCAGCAGCGCCTCATCTTCGCCGGCAAGCAGCTGGAGGATGGCCGCACCCTGGCCGACTAC
AACATCCAGAAGGAGTCCACGCTCCACCTCGTCCTCCGCCTCCGCGGTGGCATCATCGAGCCCTCCCTCCAGGCCCTCG
CCCGCAAGTACAATCAGGACAAGATGATCTGCCGCAAGTGCTATGCTCGGCTGCACCCCAGGGCTGTCAACTGCCGCAA
GAAGAAGTGCGGCCACAGCAACCAGCTGAGGCCCAAGAAGAAGATCAAGAACTAGAGTTTGAGATATCATTTCCGCGGA
TCATTGAAATCAACAGGAAGATCAGAGTTTAAGTTTTTTTgTaGTGTAATGCCTCATGTTGTATGCCGAACTTTCTGtt
TATCCTgttgtATGTTAACCTTGGTTACGCTGGAGAGTACTccAGCTTAtT > SEQ ID NO:2889 215629 1832_300334_1
TTTTCTCTCTTTATTCAAACGCCTCTCAAGATGCAGATCTTCGTCAAAACCCTAACTGGAAAGACGATAACCCTTGAGG
TTGAAAGCTCCGACACAATTGACAACGTTAAGGCGAAGATTCAGGACAAGGAAGGAATTCCACCGGATCAGCAGAGGCT
GATCTTCGCCGGAAAGCAGCTCGAAGACGGCAGAACCCTAGCCGACTACAACATCCAGAAGGAATCGACTCTTCACTTG
GTGCTCCGTCTTCGTGGCGGTATGCAAATCTTCGTCAAAACCCTAACAGGGAAAACAATCACCCTTGAAGTTGAAAGCT
CCGACACTATTGATAACGTTAAGGCGAAAATCCAGGATAAAGAGGGAATCCCACCAGATCAGCAGAGGTTGATCTTTGC
TGGCAAACAG > SEQ ID NO:2890 215629 183163_300619_1
cttgaggtcgagtcctcggacacgatcgagaatgtgAAGGCCAAGATCCAGGACAAGGAGGGCATCCCCCCGGACCAGC
AGCGTCTCATCTTCGCTGGCAAGCAGCTGGAGGACGGCCGCACCCTTGCCGACTACAACATCCAGAAGGAGTCCACCCT
CCACCTTGTGCTCAGGCTCAGGGGTGGTATGCAGATCTTCGTCAAGACCCTGACCGGCAAGACCATCACGCTTGAGGTC
GAGTCCTCGGACACGATCGACAACGTGAAGGCCAAGATCCAGGACAAGGAGGGTATCCCCCCGGACCAGCAGCGCCTCA
TCTTCGCCGGCAAGCAGCTGGAGGATGGCCGCACCTTGGCTGACTACAACATCCAGAAGGAGTCCACCCTTCACCTGGT
TCTCAGGCTCAGGGGTGGGATGCAGATCTTCGTGAAGACCCTGACTGGCAAGACCATTACCCTTGAGGTTGAGTCGTCC
GACACTATTGACAACGTGAAGGCGAAGATCCAGGACAAGGAGGGCATCCCCCCGGACCAGCAGCGTCTGATCTTTGCTG
GTAAGCAGCTTGAGGATGGCCGCACCCTTGCGGATTACAACATCCAGAAGGAGTCCACACTCCACCTGGTGCTCCGCCT
CCGTGGTGGCCAGTAAGTCCTCAGCCATGGAGCTGCTGCTGTTCtagggtTCACAAGtctgcctatttgtCTTCCCCAA
TGGAGCTATGGttgtctggtCT

FIG. 2 continued

> SEQ ID NO:2891 215629 183090_300665_1
gaattcagattctcttttgcgatctaaAGGATCTTCTTCAATTCTCCTTCAAGATGCAGATCTTTGTGAAAACTCTTA
CTGGTAAGACCATCACCCTTGAGGTCGAGAGCTCAGACACAATTGACAACGTTAAGGCTAAGATTCAAGACAAGGAAGG
AATTCCTCCAGACCAACAACGTTTGATCTTTGCCGGAAAGCAGTTGGAAGATGGAAGAACTTTAGCTGACTACAACATC
CAGAAGGAATCAACTCTCCATCTTGTCCTTCGTCTTAGAGGTGGTATGCAAATCTTTGTCAAAACCTTGACTGGTAAGA
CCATCACTTTGGAAGTCGAGAGCTCTGACACCATTGATAACGTTAAGGCTAAGATTCAAGATAAGGAAGGAATTCCTCC
AGACCAGCAACGTTTGATCTTCGCCGGAAAGCAGTTGGAAGATGGTCGTACTCTTGCCGACTACAACATCCAGAAGGAG
TCTACTCTCCATTTTGGTTCTTCGTCTCAGaGGTGGTATGCAGATTTTCGTCAAGACCCTTACTGGAAAGACCATCACCT
TGGAGGTTGAGAGTTCCGACACCATCGATAATGTCAAGGCTAAGATTCAAGATAAGGAGGGTATCCCCCCAGACCAGCA
ACGTTTGATCTTCGCCGGAAAGCagCTGGAagaTGGTCGCACTCTTGCCGACTACAACATTCAGAAGGAGTCTACCCTC
CatTTGGTGctTcGTCTt > SEQ ID NO:2892 215629 168292_300554_1
GAATTCACGACTAAGAGGTGGTATTGCAGAGGTTTGTGAAAACGCTTACTGGAAAGACCATCACCTTAGAAGTTGAGAG
TTCAGATACCATTGACAATGTAAAAGCCAAAATTCAGGACAAGGAAGGAATTCCCCCGGATCAGCAGAGGTTGATCTTT
GCTGGCAAACAGTTGGAAGATGGAAGAACTCTAGCTGACTACAACATCCAGAAAGAATCCACTCTCCATCTCGTCCTCC
GTCTCAGAGGTGGTATGCAAATATTTGTGAAAACCCTCACTGGCAAGACCATTACTTTGGAAGTGGAGAGTTCTGATAC
CATCGACAATGTCAAGGCCAAGATCCAAGATAAGGAAGGTATTCCTCCAGACCAGCAGAGGTTGATTTTTGCTGGGAAG
CAGTTGGAAGATGGGCGTACCCTTGCTGACTACAACATCCAGAAGGAATCCACCCTTCACCTGGTTCTACGACTAAGAG
GTGGTATTGCAGATCTTTGTGAAAACGCTTACTGGAAAGACCATCACCTTAGAAGTTGAGAGTTCAGATACCATTGACA
ATGTAAAAGCCAAAATTCAGGACAAGGAAGGTATTCCTCCAGACCAGCAACGTTTGA > SEQ ID NO:2893 215629 155170_301353_1
TATCTCCTCAACTTTTCTCTCTTTATTCAAACGCCTCTCAAGATGCAGATCTTCGTCAAAACCCTAACTGGAAAGACGA
TAACCCTTGAGGTTGAAAGCTCCGACACAATTGACAACGTTAAGGCGAAGATTCAGGACAAGGAAGGAATTCCACCGGA
TCAGCAGAGGCTGATCTTCGCCGGAAAGCAGCTCGAAGACGGCAGAACCCTAGCCGACTACAACATCCAGAAGGAATCG
ACTCTTCACTTGGTGCTCCGTCTTCGTGGCGGTATGCAAATCTTCGTCAAAACCCTAACAGGGAAAACAATCACCCTTG
AAGTTGAAAGCTCCGACACTATTGATAACGTTAAGGCGAAAATCCAGGATAAAGAGGGAATCCCACCAGATCAGCAGAG
GTTGATCTTTGCTGGCAAACAGTTGGAAGACGGCAGAACCCTAGCCGACTACAACATTCAGAAGGAATCAACTCTTCAC
TTGGTACTCCGTCTTAGAGGAGGCATGCAAATCTTCGTCAAAACCCTAACCGGGAAAACAATCACCCTTGAAGTCGAAA
GCTTTGACACAATTGACAATGTCAAGGCGAAGATTCAGGACAAGGAAGGAATCCCACCAGATCAGCAGAGGTTGATCTT
TGCGGGTAAGCAATTGGAAGATGGAAGGACCTTAGCTGATTACAATATTCAGAAGGAGTCCACCCTCCATTGGTGCTC
CGTCTTCGTGGTGGAATGCAGATTTTTGTGAAGACTTTGACCGGGAAAACAATCACTCTTGAAGTTGAAAGCTCAGATA
CTATTGACAACGTTAAGGCCAAGATCCAGGATAAGGAGGGTATCCCACCAGATCAGCAAAGGCTGATCTTTGCTGGCAA
GCAGTTGGAAGATGGTCGTACTCTTGCTGATTACAACATTCAGAAGGAGTCGACTTTGCACCTTGTCCTCCGTCTCCGT
GGTGGTTTCTAAAGTGTCCGTCAGTGGTGGTGGTGATGTCTGTGTCTGTGTCTTGGGTCTTTGGTCTGTTTGGTGTTTG
TTTGATTCATGATTTAGTACTTTGTGTAGTTTCTGTTAGTTGTTATCATGTTATCTTTCAATAGAGGCGAGGAGTCTT
GTTTTCTTCTGTCTCTGTTTGTGAATAATAAAGTCGAATTATTG > SEQ ID NO:2894 215629 107869_300526_1
gGCaaGACCAtcaccctggaGGTTGAAAgctcTGacaccatTgAcAATgttAAGGcCAAGATCcAGGACAAAGAGGGGA
TTCCCCCAGATCAGCAGAGGTTGATCTTCGCAGGAAAGCAGTTGGAAGATGGTCGCACCCTTGCGGACTACAACATTCA
GAAGGAGTCTACTCTGCACTTGGTGCTAAGGCTGAGGGGAGGAATGCAGATCTTCGTGAAGACATTGACCGGGAAGACC
ATCACCTTGGAGGTGGAAAGCTCTGACACCATCGACAATGTCAAAGCTAAGATCCAGGACAAGGAGGGTATCCCCACCGG
ACCAGCAGAGGTTGATCTTTGCTGGTAAGCAGCTTGAGGATGGAAGGACCCTGGCCGACTACAATATCCAGAAAGAGTC
AACCCTTCACCTTGTCCTCCGTCTCCGTGGTGGTTTCTAGGTTGCCTGTTGTTGATGTTGTTGTGTCGTGTTGATTGGC
TGTGTCTTGTTGTGGTCATGATGTGTTTTGTCTACTAAGGTCCCAAAGATGTTCAATTCTGTTTCTGTTCGCCGTTTCT
TTCATATTTTCTGTTGTGAATAAAGACACCAGATTCTGTCCTAGTGCTTAGGTTTTGTGCTCTCTGTTGGCAGTaaaTG
AACTTTCCTTTGTTTtatccatt > SEQ ID NO:2895 215629 1044002_301885_1
tctttctctttgtggtatctctgtctctctctcTTCCTGAGAAAATGCAGATCTTTGTGAAGACCCTGACAGGGAAG
ACCATCACCCTGGAGGTGGAAAGCTCCGACACCATCGACAACGTCAAGGCCAAGATCCAAGACAAGGAGGGCATCCCCC
CTGACCAGCAGCGCCTCATCTTCGCTGGGAAACAGCTCGAAGATGGCCGTACCCTCGCTGACTACAACATCCAGAAGGA
GTCCACTCTCCACCTTGTCCTCCGCCTCCGAGGTGGTATGCAAATCTTTGTCAAAACCCTCACTGGTAAGACCATCACC
CTTGAAGTCGAGAGCTCTGATACTATTGACAATGTCAAGGCCAAGATCCAAGACAAGGAGGGGATTCCCCCTGACCAGC

FIG. 2 continued

AGAGGCTCATCTTTGCTGGGAAGCAGCTTGAAGATGGGCGGACCCTTGCCGACTACAACATCCAGAAGGAGTCCACCCT
CCACCTTGTGCTGAGGCTCCGGGGGGGCATGCAGATCTTCGTCAAAACTCTAACAGGGAAGACGATAACGCTGGAGGTG
GAAAGCTCTGACACAATTGACAATGTGAAGGCAAAGATTCAAGACAAGGAAGGGatcCCCctgaccAGCAGcgAttgAt
Ct > SEQ ID NO:2896 215629 211213_300897_1
acATACAAACACTTCTCACATCTCTTCCACCCTAAGGAATATCCGTTAACAGCGCATCTTCTTGCACTCTCTACGAATC
TCCCAGCGGCCAACGCTTAATCCGCCACCATGCAAATCTTCGTCAAGACCCTCACCGGCAAGACCATCACCCTCGAGGT
CGAGTCTTCCGATACCATCGACAATGTGAAGTCCAAGATCCAGGATAAGGAAGGCATTCCTCCTGACCAGCAGCGTCTG
ATTTTCGCTGGCAAGCAACTCGAGGATGGCCGAACTCTGTCCGACTACAACATCCAGAAGGAGTCCACCCTCCACCTGG
TCCTCCGCCTTCGTGGTGGTATGCAGATCTTCGTCAAGACCCTCACTGGAAAGACCATCACCCTCGAGGTGGAGTCATC
TGATACCATCGACAACGTCAAGTCCAAGATCCAGGACAAGGAGGGTATCCCTCCTGACCAGCAGCGACTGATCTTCGCT
GGTAAGCAGCTTGAGGATGGCCGAACCCTCTCCGACTACAACATCCAGAAGGAGTCCACTCTCCACCTTGTCCTTCGTC
TCCGTGGTGGTATGCAGATCTTCGTCAAGACGTTGACCGGCAAGACCATCACATTGGAGGTTGAATCATCAGACACCAT
CGACAATGTCAAATCAAAGATTCAGGACAAGGAGGGTATTCCCCCGGATCAGCAGCGTCTTATCTTTGCTGGCAAGCAG
CTTGAGGACGGTCGCACCTTGAGCGACTACAACATTCAGAAGGAGAGCACACTTCACCTTGTCCTCCGTCTTCGTGGTG
GTATGCAGATTTTCGTCAAGACTCTGACCGGCAAGACAATCACCCTCGAGGTGGAATCTTCCGACACCATCGACAACGT
TAAGTCCAAGATTCAGGACAAGGAGGGCATTCCTCCTGACCAGCAGCGCTTGATCTTTGCTGGTAAGCAGCTGGAagaC
GGTCGCACCTTGAGCGACTACAACATCCAGAAGgagagCACACTGCACTTGGTCCTgcgTCTGCGTGGtggccagTAAA
TGTGTCTTTTgctTAcgaccGCACTgttAcgaCTGAATTGGACGGTTGGGCGTTTTTGggaACTTTTTttcaaaGCAgA
TATgggaac > SEQ ID NO:2897 215629 229138_301040_1
AGAAGAGAGGCTCAGCGTTCAAGATGCAGATCTTCGTCAAGACCCTCACGGGCAAGACCATCACTCTCGAGGTCGAGAG
CTCCGATACCATTGACAATGTCAAGTCCAAGATCCAGGACAAGGAGGGCATTCCCCCGGACCAGCAGCGTCTGATCTTC
GCCGGAAAGCAGCTCGAGGATGGCCGCACTCTTTCGGACTACAACATCCAGAAGGAGTCCACCCTCCACTTGGTCCTCC
GCCTTCGTGGTGGTATGGCCAAGAAGCGCAAGAAGAAGGTGTACACCACCCCCAAGAAGATCAAGCACAAGCGCAAGAA
GACCAAGCTAGCTGTCCTCAAGTACTACAAGGTTGACGGCGATGGCAAGATCGAGCGTCTTCGCCGCGAGTGCCCCCAC
CCCGA > SEQ ID NO:2898 215629 284138_200158_1
ATCTTCGTGAAAACCCTAACTGGGAAGACCATCACCCTTGAAGTCGAATCGAGCGATACCATCGACAATGTCAAGGCCA
AGATTCAGGACAAGGAAGGTATTCCACCGGACCAGCAGCGATTGATCTTTGCTGGTAAACAGCTTGAAGATGTGCTACT
TTGGCTGATTACAGTATCCAGAAAGAGTCGACTCTGCATCTTGTGTTGAGGCTCCGTGGAGGGATCATTGAACCGTCTC
TTATGGCATTGGCCAGGAAATACAACCAGGATAAGATGATTTGCCGCAAGTGCTATGCCCGTCTGCATCCTCGTGCCGT
AAACTGCAGGAAGAAGAAATGTGGCCATAGCAACCAGTTGAGGCCAAAGAAGAAGATCAAGTAAACAGGCGGTTGCATT
TGCTGTCTAGATGCTATGCCAATTGAATGATTTTGTAGTTTGGTGGGTTTCTATTGTTGTCTGTTTAACTGCAGCACAT
TTGTTTCAACTTCAGTTCCATTTAGTGCTCATTTTTGAGTTTGGTATGATTA > SEQ ID NO:2899 215629 2834_300337_1
CCCACGCGTCCGGAAGACGAAACACAAAAGATGCAGATCTTCGTGAAAACCTTGACCGGCAAGACCATCACTCTCGAGG
TCGAGAGCAGCGACACCATCGACAATGTCAAGGCCAAGATCCAAGACAAAGAAGGAATCCCTCCGGATCAGCAGAGATT
GATCTTCGCCGGAAAGCAGCTCGAAGATGGTCGTACTTTGGCTGACTACAACATCCAGAAAGAATCTACACTTCATCTT
GTGTTGAGGCTTAGAGGAGGTATTATTGAGCCTTCCTTGATGATGCTTGCTCGTAAGTACAATCAGGATAAGATGATAT
GCCGCAAGTGCTATGCTCGTCTTCACCCAAGAGCTGTCAACTGCAGGAAGAAGAAGTGTGGTCACAGCAACCAGTTGAG
GCCTAAGAAGAAGATCAAGTAGAGAGACTCTTATCAAGAATCCCATCTCTTGCTTGCTTCTTTTTGTTGTCTTCCCTTT
GATAGGGTtTgtTTTTCTTGTTTCAGTGACTTTCTATGTTAAACGATAATGTCAGTAAaaggATtt > SEQ ID NO:2900 215629 274623_200058_1
TTCTGCTTTTCCTTCTCTAAGAAGCGTTTGATTCCCAAAAACCGTTTCAAAGATGCAAATCTTTGTAAAGACCCTCACT
GGCAAAACCATCACTCTCGAGGTTGAGAGTTCAGACACTATCGACAATGTTAAGGCAAAGATCCAAGATAAGGAAGGAA
TTCCTCCAGATCAGCAAAGGTTGATCTTTGCTGGAAAGCAGTTAGAGGATGGCCGAACTCTTGCTGACTACAATATCCA
AAAGGAGTCTACCCTCCACCTTGTCCTTCGTCTGCGTGGTGGTATGCAGATCTTTGTAAAAACTTTAACAGGGAAGACT
ATCACTCTCGAGGTTGAGAGCTCGGACACAATTGATAATGTTAAGGCAAAGATTCAGGACAAGGAAGGCATTCCTCCGG
ATCAGCAAAGGTTGATCTTTGCTGGAAAACAACTTGAGGATGGTCGTACCCTTGCTGACTACAACATCCAAAAGGAGTC
CACCCTCCACCTTGTTCTCCGTTTGCGTGGTGGTATGCAGATCTTTGTAAAAACTTTGACAGGAAAGACTATTACCCTT
GAGGTTGAGAGTTCCGATACAATTGACAATGTCAAAGCTAAAATCCAGGATAAAGAAGGCATTCCTCCAGATCAGCAGA
GGTTGATCTTCGCTGGAAAGCAACTTG

FIG. 2 continued

> SEQ ID NO:2901 215629 254982_301640_1
GGTTGAAGGAAGGGAGGAAGGGTGGTGTGGGTGGATTTGGAGGGGCCAAGATGCAGATCTTTGTGAAGACCCTGACAGG
GAAGACCATCACCCTAGAGGTTGAGAGTAGTGACACCATCGATAATGTCAAGGCTAAGATCCAAGATAAGGAAGGTATC
CCCCCTGATCAACAACGCCTGATCTTTGCTGGAAAACAGCTTGAAGATGGCAGAACCTTGGCTGACTACAACATTCAGA
AAGAGTCCACGTTGCATTTGGTTCTAAGGTTGCGAGGTGGTATCATTGAGCCATCTCTGATGGCTCTTGCCAGGAAGTA
CAACCAGGAGAAAATGATCTGTCGCAAATGCTATGCTAGGCTTCATCCTCGGGCTGTGAATTGCCGCAAGAAGAAATGT
GGACACAGCAATCAGTTGCGGCCAAAGAAGAAGATTAAGTAGATTTGGAGAAGCAATCATTGCATTGGAACAGTAGATG
CAGGAAGAGGGAAATGGGAGGAATGGAGATGCAGCTTNGTTATTGTTTTACTAGGATCTGTTATACAACTGAAGTGGCT
CAATGGGAACTAGCTTTTAGGCCTTAGCCTTTGGAC

> SEQ ID NO:2902 215629 248873_301587_1
gtaggGTTTCAAGTGGGCTGCCAAGATGCAGATCTTCGTGAAGACGCTCACGGGCAAGACGATCACTCTCGAGGTCGAG
AGCAGCGACACCATCGACAATGTCAAGACCAAGATCCAGGACAAAGAAGGCATTCCTCCGGATCAGCAGCGTCTCATCT
TCGCTGGCAAGCAACTCGAAGATGGCCGAACTCTCGCGGACTATAACATCCAGAAAGAGTCCACTCTCCATCTCGTGCT
GCGTCTTCGTGGAGGCATCATCGAGCCGTCCCTGATGGCCCTGGCGAGGAAGTATAATCAGGAGAAGACGATCTGCCGG
AAGTGCTATGCAAGGCTGCATCCTCGCGCTGTGAATTGCAGGAAGAAAAAATGTGGCCACTCCAACCAGCTGCGACCCA
AGAAGAAATCAAATAGAGAGTTTAGGACGATCAACTTTGTTTCTCTATATGAATGAAAAAGGGAAAACCTTTTgTCTT
TG > SEQ ID NO:2903 215629 248863_301587_1
aattaggtttcttcgatagcaagtagcgatgcagatcttcgtcaagactctcaccggcaagactatcacctTGGAGGTG
GAGAGCTCCGACACCATCGACAACGTCAAGACCAAGATCCAGGACAAGGAAGGGATCCCTCCGGATCAGCAGCGCTTGA
TCTTTGCCGGCAAGCAGCTTGAGGACGGGCGTACCCTCGCCGACTACAACATCCAGAAGGAGTCTACGCTTCATCTTGT
TCTTCGGCTGCGAGGAGGTATGCAAATATTCGTCAAGACCCTAACGGGTAAGACGATCACCCTGGAGGTGGAGAGCTCC
GACACCATCGACAACGTCAAGACCAAGATCCAGGACAAGGAAGGGATCCCGCCGGATCAGCAGCGTCTGATCTTCGCTG
GCAAGCAGCTCGAGGATGGCCGTACCCTGGCCGACTACAACATCCAGAAGGAGTCGACCCTTCATCTTGTGCTGCGTCT
GCGAGGAGGCATGCAGATCTTCGTTAAGACCCTCACTGGTAAGACGATCACCCTGGAAGTCGAGAGCTCGGACACCATC
GACAACGTTAAGACTAAGATCCAGGACAAGGAAGGGATCCCGCCGGATCAGCAGCGTCTGATCTTCGCTGGCAAGCAGC
TCGAGGATGGCCGTACCCTGGCCGACTACAACATTCAGAAGGAGTCTACACTCCATTTGGTGCTGCGTCTGCGAGGAGG
CATGCAGATCTTCGTCAAGACCCTCACTGGTAAGACGATCACCCTGGAAGTCGAGAGCTCGGACACGATCGACAACGTG
AAGACCAAGATCCAGGACAAGGAGGGAATTCCTCCGGACCAGCAGCGGttGATCTTCGCGGGTAAGCAGCTCGAGGATG
GGCGCACTCTTGCCGACTACAACATTCAGAAGGAGTCTACACTCCATTTGGTGCTGCGTCTTCGCGGAGGCATGCAGAT
CTTCGTCAAGACCCTCACGGGTAAGACGATCACCCTGGAAGTCGAGAGCTCAGACACCATCGACAACGTGAAGACCAAg
AtCCagga > SEQ ID NO:2904 215629 239507_301305_1
AAGATGCAGATCTTCGTGAAGACCCTGACGGGCAAGACCATCACGCTCGAAGTCGAGAGCAGTGACACCATCGACAACG
TCAAGTCCAAGATCCAGGACAAGGAGGGTATTCCCCCGGACCAACAGCGCCTGATCTTCGCCGGAAAGCAACTCGAGGA
TGGCCGCACTCTGTCCGACTACAACATCCAGAAGGAGTCAACCCTCCACTTGGTCCTCCGTCTCCGTGGTGGTATCATT
GAGCCTTCGCTGAAGGCGCTTGCCTCCAAGTACAACTGCGACAAGATGATCTGCCGCAAGTGCTACGCACGTCTGCCAC
CGAGGGCTGTCAACTGCCGCAAGAAGAAGTGCGGTCACACCAACCAGCTCCGCCCCAAGAAGAAGTTGAAGTAAACTAC
TCGCTCCTATCGGCGTCTGGCGAAGAGAGCAACGGGGTCGGTGGATACGAATTGCAACGATTGCATGCGATGGATATGA
GGGCTAGGTCACTACTACTTCTTCCACGGCACATGGCATCAATGGAGTGCTTGTCTTGTCTCGCATTTGGGACTTTATG
AAGGGAACCAGGCATGTAGAGTGAATCGATTCAAATTCAAAAACCACCA > SEQ ID NO:2905 215629 234660_301219_1
cgacccacgcgtccgcttttgtgggcgattcctgggtaatttcatacagcggcaactatgcagatcttcgtcaagacac
tGACTGGCAAGACGATCACTCTGGAGGTCGAGAGCTCGGACACGATCGATAATGTGAAGACCAAGATCCAGGACAagga
aGGGATCCCCCggaCCAGCAGCGTCTCATCTTCGCCGGGAAGCAGCTCGAAGACGGGCgaatctTGGcTGACTACAAC
ATCCAGAAGGAATCCACTCTCCATCTCGTCCTACGTCTTCGCCGGAGGCATGCAGATCTTTGTCAAGACGCTGACCGGCA
AGACCATCACTCTGGAGGTCGAGAGCTCAGACACGATCGATAATGTGAAGACCAAGATCCAGGACAAGGAAGGGATCCC
CCCGGACCAGCAGCGTCTCATCTTCGCCGGGAAGCAGCTCGAAGACGGGCGAACCTTGGCCGACTACAACATCCAGAAG
GAGTCGACCCTTCACTTGGTGCTGCGTCTCCGTGGAGGCATGCAGATCTTCGtcaagACCCTGACCGGCAAGACCATCA
CCCTCGAggTCGAGAGCTCGGACACCaTcgacaacgtcaagacgaagatccaggacaaggaagGCattcctCCCGACCa
gCAGCGTCTCATTTTCGCCGGGAAGCAActcgaaGACGGTCGCACTTTGgcTGACTACAACATCCAAAAGGAATCCACC
CTtcaCCTGgtactGCGTcTCCgtGGAGGCATGCagaTCtttgtGAAGACGCTCACCggcaagaacatCACCCTCGAGG
TCGAGAGCTcgGACACGATTGACAACgtcaagaccaaGaTTcaggacaagGAAGGCATTcCTCCcgaccagcAGCGTCT
CATCTTTgct

FIG. 2 continued

> SEQ ID NO:2906 215629 234079_301096_1
ggcgaggagagcggcggcgaagaaggacaagtgtggagccatgcagatcttcgtcaagacatgtaagttctacaatcca
tCGCCGCTAGCGGCGGCGGCGGCGCCATCGATCTTCCCCTTGATCGATTCTTTCTCCCTTTGTTCCAGTGACTGGGAAG
ACAATCACCCTCGAGGTTGAGTCGTCGGACACGATCGACAATGTGAAGACCAAGATCCAGGACAAGGAAGGGATCCCTC
CCGACCAGCAGCGGCTGATCTTCGCGGGCAAGCAGCTGGAAGATGGCCGGACGCTGGCGGACTACAACATCCAGAAGGA
GTCGACCCTCCACCTTGTTCTTCGCCTCCGGGGTGGCGGCAAGAAAAGGAAGAAGAAGACGTACACCAAGCCCAAGAAG
ATCAAGCACAAGAAGAAGAAGGTGAAGCTGGCGGTGCTCCAGTACTACAAGGTGGACGATTCGGGCAAGGTGAACAGGC
TGCGCAAAGAGTGCCCGAATCCAGAGTGCGGTGCCGGGACGTTCATGGCGAACCACTTTGATCGGCACTACTGCGGCAA
GTGTGGACTCACCTACGTCTACCAGAGAGCTGAAGCTTAGAGAGGATGACGAGCTTTGCTCTCTTTCCTTGTGTTTCTA
TCCAATTTTCTTTGAACGAAAGTATAATCTTTTCTTTTgtt > SEQ ID NO:2907 215629 229245_301041_1
GGGAGAATCAACGTTTCTTGGTAAGTCATAGCTATGGCGCTTATAGAATTTTGGGGCTTCTTGTAATTCTTGGATAATG
ACATGGGTATGACTGTTTGTAGATGATTTTCCGCTAGATGTTCTATATTAGGGTGTCGTTGTCCTTATGTTGATTCCTT
TGTCTATCCTAGCAGCAACGATGCAGATCTTCGTCAAGACCCTGACCGGTAAGACCATCACTCTGGAGGTCGACAGCTC
TGATACTATCGACAATGTAAAGACCAAGATCCATGACAAGGAAGGGATCCCCCCGGACCAGCACAGGCTCATCTTTGCC
GGTAAGCAGCTCGAGGATGGCAGGACTCTGGCCGACTACAACATCCAGAAGGAGTCGACTCTCCATCTCGTCCTACGTC
TTCGCGGAGGTATGCAGATCTTCGTCAAGACCCTCACCGGCAAGACCATCACGCTCGAGGTGGAGAGCTCCGACACGAT
CGACAACGTAAAGACCAACATCCACGACAAGGAAGGTATCCCCCCGGACCAGCATCGACTCATCTTTGCCGGGAAGCAG
TTCGAGGATGGACGAACGCTCGCCGACTACAACATCC > SEQ ID NO:2908 215642 208015_300831_1
TCTCATCCACCTCGTCCATCTCATCCTTTTGCTTCCAGCAGCTATCAAGACTTGACTTAAAAAAACCAGTCCTCATAAA
GACATCTACAATCAGTCACCATGCAGATCACCAAGAGCCTCATCGCTACCCTCTTTGCCGCTTCGACCGCCTTTGCGGC
TCCCACTCCTGCGGACAAGTCCATGATGGCCGCTGTCCCTGAGTGGACAATCACCAACCTGAAGAGAGTGTGCAACTCC
GGCAATACCTCCTGCACATGGACCTTTGGCGTCGATACACATCTCGCCACTGCCACCTCATGCACATACACCGTCAAGG
CTACCGCCAACGCTTCTCAGGCCACCGGCGGCCCCGTTACTTGCGGCCCTTACACTATCACATCCAGCTGGAGCGGCCA
GTTTGGCCCTAACAACGGCTTCACTACCTTTGCTGTTACCGACTTTTCGAAGAAGCTCATCACCTGGCCTGCCTATACC
GATGTTCAAGTTCAGGGCGGCAAGGTTGTTTCGCCCAACCAGAGCTACGCCCCGACCAACCTGCCATAGATGGAATGAA
TTTGCTTGGAATTACTATACGCAAGGTCAATTTACTCCCAAAGGAACAGCTGGTGATAATTGGAAACGACAATGAATCA
GGCGAGGGGGATACGTACCACAAAATTTAATGTAATAGATGATTGACTATGATAATACACTATTGATTAATgcGTCTc > SEQ ID NO:2909 215655 208515_300836_1
ACACTCACAAACAAACAAACAAGCTTCTCCATCTTTTTTCAGACTCCTTGAGAAGAGAACTCGGACTTAGACTTGACTT
AACTGTCTATTACACACACAGCTCTCCACTAAAAGCATCGAGCTCTTACACAACAACACACAAACAACTTTGTCAACAC
TCACAAACCCTTATCCGGTTTCACTCAACTCTTTTCTCTCTCAACAACAAACTCACTCACAATCACTATGCCTTCTTCT
CAAGGACAAAGCTGGTGGGCCCGCCACTGCACCCCCCGACCCCCGATCAACAAGGTCGTCGCCTGCCCCTGCCACTACT
GCTACAACAAGCCCGCCTGCGAGCTCGACTACCCCGAGTCGTCCAACTGCTCCGAGACGAACACCCCTGCTCAGTCGAG
GCCTGTCAGCCCCGAGGCCGCACCAGCTCGTCTTCGTCTTTTCACGTTGAGAAGGCCGAGAAGCAGTAAACGACACAT
TCGATCATCGAAATCATTCAAATCACAAAAGCGAGTACATCTTTGAAGATCCTTTGGATACTATAGGATATACACACAC
TTTCGGTTTCAACATTTTCTTTGTTTCATTCTCTCTACTGAGCGAGCGAATACAAATATAAAACGGGCGCGAAAAAA
AAGCACcAAcggcgctTctccCGATCAGTTCg > SEQ ID NO:2910 215669 195810_300638_1
cagatcattaCAATCAAACTCTTAATCTCTATTCTTAAATACATCTACCTCTCACAATGGATTTCGTCAACAAGGCTAT
GGGCAAGGAGGAGCGCTCCACTCAGGGCACCGCTCCCGCTGCTCCCCAAGCAGGCGGCCAGGTCCAGAAGGACGATTAC
GTCGACAAGGCTTTCGCCATGGGTGCCAAAAAGAGCGGCCACAACATGGATCGCAACACACAGGAGAAGATTACGGATG
CAGGCCGTAACATGTACGAGAAGGTGACAGGAAACAAGGTCGACCCCAAGTGGTCTAATTAATGAACGGACGAGTTATG
ACTCACAACAAGACTGTACAATAGTAATAATAACATCTTATCAACGCTGTCTGTTCCT > SEQ ID NO:2911 215670 208978_300810_1
AAATTCGAGGTGTTTTAGACGCAAGCTTCTCTTTTACACACTGAAGCTGCTGCTGCAACCATCACCAACATACCACACG
CAACAACACAACACCACCACGTAATAACGAGCAGAACACCCCTCGCTTGAACTTGTTGCAAAAAACACTCTCGCCTCTA
TTTCATAAATCAAATTACACACGAACAAAACAATGAATCCAACAGTCAGAGGCTTCTCAACCGCCGCAAGAGTGCACCC
GCCCTTTTTGCCACATCTCCGCCCATCGCCGCGCCGAGCCCGATCCGACGCTGGCTAAAAACTGCCGCCGTCATCACC
GCCGTCGGATACGCCTCAAAGACCTACCTCGACGCCACCCGCGCCCAGCGCCGCGAAACCGCCCTCGCACTTGAACATG

FIG. 2 continued

ATTCCGCCGAGAGGCAGCGCATGATGGAGAATTTGTATGGTGGGAGGGAGAGCTTGGAGGATTTGGAGAAGGGGGTTGC
TGAGTATGGCAAGCGGTAATCACCGAAGGAAAaacaaaAAAAAACGACAACAGACGGAaaaAaaaacttgaAGTAAAtT
caaGGGGTATTATTACACCAAAAGCGGCGAGGCATTTGGGGGGATTTGCATCAGGgctGATGGTGCCCTTGAGCGAAGC
atacatGGGAg > SEQ ID NO:2912 215672 104896_300366_1
cgccattagagttgcatcgtatccactgctcagcagctgctaaactcatccgacgAAAATGACATTCAAGAGAAGAAAC
GGAGGTCGTAACAAGCATGGACGTGGCCACACTAAATTCATTCGCTGCTCTAACTGCGGCAAGTGCTGCCCTAAGGACA
AAGCAATCAAGAGGTTCCTTGTGAGGAACATCGTTGAGCAATCAGCAGTGAGGGATGTTCAGGAAGCTTGTGCTTTTGA
ATTGTACACTCTTCCTAAGCTGTACTTGAAGATGCAATATTGTGTCTCATGTGCCATCCACTCCAAAGTTGTTAGGGTC
CGCTCTGTTACTGATAGGAGGGTCCGTGAGCCTCCACAGCGCTTCAGACGCCCAAGGGATGATGCTCCCAAGCCTGGTC
AAGCTCCACGCCCTGCCGGAGCTCCTACTGCAGCTCGTTCTTAAGTGCCTACATTTTGATCAACTACTGTTAGGCTTTT
GGGTTTTAGTTAATTTGAGATGTATTTTTGAAGTCGATTTCTCTATTTAGTTTTACTGGAACTATCATTAAATTTGTGT
ATGCAAATCTCAAGCAAACAGGCCTGttgttCGTCcTATAGCtTATATATCCTTTGCAaT > SEQ ID NO:2913 215672 211383_300957_1
tgggctttgcactgccaaaacggcccctccgccggcatggccataagaatggaggccttgtggaaagatcgtgaactttt
cCATGTACTTTACTTCGATCGTGAACTGCACCTCGCATTACATAAGGTGATTTATAGCAGGTACCACGGTACAACACCA
AAAAGAGCATACACCGCCAAATGGTCAAGAAGAGAAAGAACAACGGCCGCAACAAGAAGGGCCGCGGCCACACCAAGC
CCATCCGCTGCAGCAACTGCTCGCGATGCACTCCCAAGGATAAGGCGATCAAGCGCTTCACCATCCGCAACATGGTCGA
GTCTGCTGCCATCCGTGATATCTCCGATGCCTCTGTCTTCGCCGAGTACACTGTCCCCAAGATGTACCTGAAGCTGCAG
TACTGCGTCTCTTGCGCTATCCACGGCAAGATTGTCCGGTACGTTGCCTCCCCTGGGAGTGTTACAACTGCGCCTTTCT
GGCGTATGTGCTTCAGATGAGCCTTGGTTGTACTTTGGGACGTTCACACACGTCCCAGCTCTCGAACATATATACCCTC
CCCCGTCCCCCTAAAGGTACGTTTGACGCTGACAGAATCAAAATAGTGTCCGATCTCGCGTTGGCCGCCGTAACAGGGC
TCCCCCCCCTCGTGTCCGCTACAACAAGGACGgcaAGAAGATCACCCCTACCGcTGCCCCCAAGGTTTAAAAAATGGGT
ATGACGGGAATGGGTTGGACGGAGTCTGGTTTACTTTAACGCCTTCATGTaAtttgctTaGatgaatacccaGgaCAAA
GAGaaTc > SEQ ID NO:2914 215672 115123_300012_1
aaagccctagcttctctgagcagccgtcgagttccagccgtctccgaaaaTGACTTTCAAGAGAAGGAACGGAGGTCGC
AACAAGCATGGACGTGGCCACGTCAAATTCGTCCGTTGCTCCAACTGCGGCAAATGCTGCCCTAAGGACAAAGCCATCA
AGAGGTTTCTTGTGAGAAATATTGTTGAGCAAGCAGCTGTTAGGGATGTGCAGGAAGCTTGTGCTTTTGAAACGTACAC
TCTGCCTAAGCTGTATCTGAAGATGCAATATTGTGTATCATGTGCCATCCACTCCAAAGGTGGTTAGGGTCCGCTCTCGA
ACTGATAGGAGGGTCCGTGAGCCTCCACAGCGATTCAGGCGCCCAAGGGATGATGCTCCAAAGCCTGGTCAAGCTCCAC
GGGTTCCTGGAGCTGCTCCGACAGCAGCAGCTCGTACTTGAGTGCCTGCTGTTTTGATCATGTTGTTTAGCTATAGTGT
GAAAGTGACTATGGAGTTTTGTTATATATGGTGGTTTTGAGTACTTTTTTGGTTCAGTTTAATGGGACCTAGTACTATT
TTATGGCATGAAATTCTGGCTGGAgaaTAGAAAGATTTAAGttctat > SEQ ID NO:2915 215672 1111732_301800_1
AGAGGACTCTTTGTAGGTTTTTCTTGCAGGGTAGAAGACTCTTTTACTAGGGAGCTATGACGGTTAAGCGTAGAAGTAG
GGGACGAAGTAAGCATGGCCGTGGTCATGTTAATCCCATCCGATGCTCCAACTGTGGTCGATGCTGCCCTAAGGACAAA
GCAGTGAAGAGGTTCCTTGTCCGCAACATTGTCGAGCAAGCGGCAATCAGGGATGTCCAGGAAGCATGTGTTTATGATG
GATATGTTCTTCCAAAGCTTTACACAAAGATCCAACATTGCATCTCTTGTGCTATCCACTCCCGTGTAGTACGTGTCCG
CTCCAGAGAGGCTCGGAGGAACAGGGAGCCACCACAGCGTTTCCGTAGAAGGGAGGATAATGCCCCTGGACAGAACCGT
CCCCCTCCCCCTCCCCGCCCTTGAGATTTGTCAGGCAGTTCATTAATCCTCGAGACTTAGTGCTTTTTAATATCTTAGT
TGCAGCCTATATGAAGCTCCCACTGGGGCCCTTATTTTTGTCTTAAAACCAATTTGTGCTCCAAACTTGT > SEQ ID NO:2916 215672 205543_300799_1
aacagttcaatccagACACCGCCAAAATGGTCAAGAAGAGAAAGAACAACGGCCGCAACAAGAAGGGCCGCGGCCACAC
CAAGCCCATCCGCTGCAGCAACTGCTCGCGATGCACTCCCAAGGATAAGGCGATCAAGCGCTTCACCATCCGCAACATG
GTCGAGTCTGCTGCCATCCGTGATATCTCCGATGCCTCTGTCTTCGCCGAGTACACTGTCCCCAAGATGTACCTGAAGC
TGCAGTACTGCGTCTCTTGCGCTATCCACGGCAAGATTGTCCGTGTCCGATCTCGCGTTGGCCGCCGTAACAGGGCTCC
CCCCCTCGTGTCCGCTACAACAAGGACGGCAAGAAGATCACCCCTACCGCTGCCCCCAAGGTTTAAAAAATGGGTATG
ACGGGAATGGGTTGGACGGAGTCTGGTTTACTTTAACGCCTTCATGTAATTTGCTTAGATGAATACCCAGGACAAAGAG
AATCCTGGAGCCTAAATGAATCGGACTTTTTTCTTGTTGAAAAGATTC > SEQ ID NO:2917 215672 252883_301605_1
GGAAGAGGTAGAGGACTCTTTGTAGGTTTTGCTTGCAGGGTAGAAGACTCTTTTACTAGGGAGCTATGACGGTTAAGCG
TAGAAGTAGGGGACGAAGTAAGCATGGCCGTGGTCATGTTAATCCCATCCGATGCTCCAACTGTGGTCGATGCTGCCCT

FIG. 2 continued

```
AAGGACAAAGCAGTGAAGAGGTTCCTTGTCCGCAACATTGTCGAGCAAGCGGCAATCAGGGATGTCCAGGAAGCATGTG
TTTATGATGGATATGTTCTTCCAAAGCTTTACACAAAGATCCAACATTGCATCTCTTGCGCTATCCACTCCCGTGTAGT
ACGTGTCCGCTCCAGAGAGGCTCGGAGGAACAGGGAGCCACCACAGCGTTTCCGTAGAAGGGAGGATAATGGCCCAGGA
CAGAACCGTCCCCCTCCCCCTCCCCGCCCTTGAGATTTGTCAGGCACTTCATTAATCCTCGAGACTTAGTGCTT

> SEQ ID NO:2918 215672 275307_200155_1
tgagaaagtagagccGCAGATTATACTCAGAAGCTACCATCCAGAGCGAAAATGACTTTCAAGAGAAGAAACGGAGGTC
GTAACAAACATGGACGTGGCCACACAAAATTTATTCGTTGCTCTAATTGCGGCAAATGCTGCCCAAAGGACAAGGCCAT
CAAGAGGTTTCTTGTAAGGAACATTGTTGAGCAAGCTGCTGTACGTGATGTTCAGGAAGCTTGTGCTTTTGAAACGTAC
ACTCTTCCTAAGCTGTACTTGAAGATGCAATATTGTGTTTCATGTGCAATTCACTCTAAGGTGGTCAGAGTTCGTTCTG
TTACTGATAGGAGAGTTCGTGAGCCCCCACAGCGTTTCAGGCGCCCAAGGGATGATCTCCCAAAGCCAGGTCAAGCTCC
ACGCCCCGCTGGAGGAGCCCCTGCTGCACCTCGCACTTAACTTGATAGGCTTCAGGTTTTAATTAATCTGATAGTTATT
TTATCTGTTATATGTCGTGGTTTTGACTGTACTGTTTGATTTAGTTGATGGGACCAttTACCattttATGGAATTGAAT
TTTGAATGGAAAATGaGagaTCtaaATtttcg > SEQ ID NO:2919 215676 234396_301099_1
TTCATCCATCACCTCTCCACTCCATCTTATACCCCCTCAAAACCATCTTCAAGATGTCTGCCTCCGTCGGTTCTGCCAC
CAAGGATGTTGACCAGAGCAAGAAGTCCTTCATGGGCATGCCTGGTTTCGTCGTCGACTTCATGATGGGTGGTGTCTCC
GCTGCCGTCTCCAAGACCGCCGCCGCCCCCATCGAGCGTGTCAAGCTCCTCATCCAGAACCAGGACGAGATGCTCCGCT
CCGGCCGTCTCGCTAAGCCCTACACCGGCATTGGCGAGTGCTTCAAGCGTGTCATCGCTGAGGAGGGTACCGCCTCCCT
GTGGCGCGGCAACACCGCCAACGTTGTCCGTTACTTCCCTACCCAGGCCCTCAACTTCGCTTTCCGCGACACCTACAAG
TCCATGTTCGCCTTCAAGAAGGAGCGTGACGGCTACTGGTGGTGGATGGCCGGCAACCTTGCCTCCGGCGGTGCCGCTG
GTGCCACCTCCCTCCTCTTCGTCTACTCCCTCGACTACGCCCGTACTCGTC > SEQ ID NO:2920 215676 244185_301555_1
GGCCAGGCCAGGTATGAGCTCGGTGCCGTCGACAATCTCGGCAGACGCGATCGCCAGGCTGAAGAAGAAGGAAGATTTC
CCGGAGTCAAGGGGGGCGGCGCCGGCGGCGCCGGGGGTGGGAACGGCGACGAAGAGGGATCATCACCGGCGGCGGCGGCGA
CGATCCAGAGCAAGACGGTATGGGCAAATTTCCCCAAGGATTTGGTGGCCGGGGGACTGATGGGCGGCGTCGCGCACAC
GATCGTGGCGCCCATCGAGAGGGCCAAGCTGCTGCTCCAGACGCAGGAGAGCAATGTGGCGATAATGCAGGGGCGGCAG
CACCGCTACAAGGGGATGGTCGATTGTATCTTCCGCATCGCAAAGGATGAAGGGGTGCTGTCGCTCTGGCGCGGCAATG
GCAGCAGCGTCATGCGCTACTATCCGTCGCTAGCGCTCAACTTTGCCTTCAAGGACTTGTACCGATCGCTTCTCATCTC
GGACAAGAACGACGCTCTCTCCCGAGCACCGTTCAACTTCGTGGCCGGTGCCGCCGCCGGCTGCACCAGCCTCGTCTTT
GTCTACCCCCTGGACATCGGGCACACCCGTCTAGCC > SEQ ID NO:2921 215676 41394_300195_1
ctcgagcttgcggccgctaagcttttgatcCAGAACCAGGATGAGATGATTAAAGCTGGCAGGCTTTCTGAACCCTACA
AGGGTATTGGTGACTGTTTCGGCAGGACGATTAAGGATGAAGGTTTTGGTTCTCTATGGAGAGGAAACACTGCCAATGT
TATCCGTTATTTCCCCACTCAGGCCTTGAACTTTGCCTTCAAAGATTACTTCAAAAGACTTTTCAACTTTAAGAAGGAC
AGAGATGGTTACTGGAAGTGGTTTGCTGGTAACTTGGCATCTGGAGGAGCAGCTggtgcctcTtcccttctgtttgtgt
aCTcCCTTGACTATGcccgTACCCGTCTAGCtaaTGATgccaaggctgcaaagaAag > SEQ ID NO:2922 215676 253457_301626_1
GTCGCTGACCCCGCCAAGACCAATAAGACCATGAGTGGTTTCGCCACCGACTTCCTCATGGGTGGTGTTTCCGCCGCCG
CCTCCAAGACGGCTGCTGCCCCCATTGACCGAATCAAGCTCCTCATCCAGAACCAGGATGAGATGATCAACCAGGGCCG
TCTTGCCGCCCCCTACAAGGGCATTGGGGACCTGCTTCGTCCGCACCTAC > SEQ ID NO:2923 215676 235940_301276_1
AATCTCCTCTCAACCTTCTCCACCGCATGCACGATGGCTAAGGGTGATGTCGTTCACGCGGACAAGTCCTTCATGGGCA
TGCCCGGCTTCATGGTCGACTTCTTGATGGGTGGTGTTTCCGCCGCCGTCTCGAACACTGCCGCCGCTCCCATCGAGCG
TGTCAAGCTTCTCATCCAGAACCAGGATGAGATGCTCAAGTCCGGTCGTCTCGACCGCAAGTACCACGGTATCCTTGAG
TGCTTCAAGCGTACCTCCCAGGCTGAGGGTGTCCTCTCCCTCTGGCGTGGCAACACCGCCAACGTCGTCCGTTACTCCC
CCACCCAGGCCCTGAAC > SEQ ID NO:2924 215676 239578_301305_1
ttcaatctccactcgatctctttgcgcctttagatcgcaaaaatggccgataaaaagcaaagtgtgctcggCATGCCGC
CCTTCATGGTGGACTTCTTGATGGGTGGTGTCTCCGCCGCTGTCTCGAAGACTGCCGCCGCACCCATCGAGCGTGTCAA
GCTCCTCATCCAGAACCAGGATGAGATGTTGAAGTCCGGCCGTCTTGACCGCAAGTACAACGGTATCGCCGACTGCTTC
AAGCGTACTACCCAGGCTGAGGGTGTCCTCTCCCTCTGGCGTGGTAACACTGCCAACGTCATCCGTTACTTCCCCACCC
AGGCGCTGAACTTCGCGTTCCGTGACACTTACAAGTCCATGTTCGCCTACAAGAAGGAGCGCGATGGTTACGCCAAGTG
```

FIG. 2 continued

GATGGCTGGTAACTTGGCCTCCGGTGGTGCTGCTGGTGCCACTTCCCTCCTCTTCGTCTACTCCCTCGACTACGCCCGT
ACCCGTCTTGCCAACGACGCCAAGTCTGCCAAGAAGGGTGGTGAGCGTCAATTCAACGGTCTCGTCGACGTCTACaagA
AGAccCTCGCTtccGACGGTAttgccggTCTCTaccgTGGTtttcatGCCCTCCGTTGCTGgTATc > SEQ ID NO:2925 215676 243806_301552_1
AACAACAACTGCACACCAGCATCCTCTCCGCTCAATCATCCTTTCTCTGCTTCTACACTACCGCAAAAATGGTCGAAGG
AGACGTCAACCAGGGCAAGAAGTCCATCATGGGCATGCCCGGCTTCGTCGTGGACTTTCTCATGGGTGGTGTTTCTGCC
GCCGTTTCGAAAACTGCTGCTGCTCCTATCGAGCGTGTCAAGCTCTTGATTCAGAATCAGGATGAGATGCTGAAGAGTG
GTCGTCTGGACCGAAAATACAATGGTATTGTCGACTGCTTTTCCCGAACAGCCAAAGGCGAAGGTGTCATGTCCCTGTG
GCGAGGCAATACTGCCAATGTCATCCGTTACTTCCCTACCCAAGCGCTCAACTTTGCCTTCCGAGATACCTACAAGTCA
ATGTTCGCTTTCAAGAAGGACCGCGATGGTTACGCCAAATGGATGATGGGAAACTTGGCTTCCGGCGGTGCTGCTGGTG
CTACTTCCCTGCTCTTCGTTTACTCGCTTGACTACGCCCGTACCCGTCTTGCCAACGATGCCAAATCCGCGACCAAGGG
TGGCGACCGTCAATTCAACGGTCTCGTCGATGTCTACCGCAAGACTCTCGCCTCTGACGGTATTGCTGGTCTCTACCGT
GGTTTCGGTCCTTCCGT > SEQ ID NO:2926 215676 1170892_302040_1
gctcgcagggcagggattgcagATCTCGAACTCCCGCACCCCCCTCCCTGTAATGCGAGCACAGTCTTGCTGAAGCAGT
TGAAATGGCTGAGAGACCGCAAGCTCCGTCTGCTATGAATAGGTTCTCTGGCTACACCTACCTAGGTTCCAAGCTTACT
GAGAACCGCCAAAGAAGCCGAGGGCCAAACACCACCAGCAGCTACTATTCGTATGCAATAAGCCGCAATGGCCAGCCCA
AGCAGACCCCGATGCTTAACCTGAATGGTGCTGTTGGTTCAGTGAACCTGGACAGTTTCCAGAATGCTTCCCCCGCCAA
TGCCGAGTTTTTTGCCCCTGCAGCAAAGGAGAAGGGAGTACAaGGCTTCTTGATTGATTTCATGATGGGTGGTgTTTCT
GCTGCAGTTTCCAAAACTGCTGCTGCCCCTATTGAGCGAGTGAAGCTCCTTATTCAGAACCAGGATGAAATGCTCAAGT
CTGGCCGTCTCTCTGAACCCTACAAGGGTATCGGGGAATGTTTCTCCCGAACCATTAAGGAGGAAGgctTCATCTCCCT
TTACCGAGGAAATGtGGCCaACGTCATCCGTTACTTCCCTACTCAGGCTTTGAACTTTGcattcaaAGActacTTCaaG
aggatgttcaacTTCAAGAa > SEQ ID NO:2927 215676 195564_300635_1
TTCTTTTTTTCCGGGAAAGCGTTTGCACATCGGTCAAAATGTCTGAGAAGCCTCAAAAGGTCCTGGGCATGCCGCCCTT
CATGGCGGACTTTCTCATGGGTGGTGTCTCCGCCGCTGTCTCCAAGACTGCTGCCGCCCCCATTGAGCGTGTCAAGCTC
CTCATCCAGAACCAGGATGATGAGATGATCAAGAACGGCCGTCTCGACCGCCGCTACGCCGGTATTGGTGACTGCTTCAAGC
GTACCGCCGCCGACGAGGGTGTCTTGTCCCTGTGGCGTGGTAACACTGCCAACGTTATCCGATACTTCCCTACCCAGGC
CCTGAACTTTGCTTTCCGTGACAAGTTCAAGAAGATGTTCGGTTTCAAGAAGGAGCGTGATGGCTACGGCATGTGGATG
CTCGGTAACCTGGCCTCCGGTGGTGCTGCTGGTGCCACTTCTATGCTTTTCGTCTACTCCCTGGATTATGCCCGTACCC
GTCTTGCCAACGATGCCAAGTCCGCCAAGAAGGGCGGTGAGCGCAGTTCAACGGTCTTGTTGACGTCTACCGCAAGAC
CCTCGCCTCTGACGGTATTGCCGGTCTGTACCGTGGTTTCATGCCCTCCGTCGCTGGTATCATCGTCTACCGTGGTCTC
TACTTCGGCATGTACGACTCCATCAAGCCTGTTCTCCTGGTCGGTAACCTCGCCAACAACTTCCTTGCCTCTTTCGCTC
TCGGTTGGTGCGTCACCACCGGTGCCGGTATCGCTGCTTACCCTCTTGACACTATCCGACGACGAATGATGATGACTTC
TGGTGAGGCCGTCAAGTACAAGAACTCCTTCGATGCCGCCGCCAGATCATTGCCAAGAACGGTGCAAGTCTCTCTTC
AACGGTGCTGGTGCCAACATTCTCCGTGGTGTTGCCGGTGCTGGTGTCCTGTCCATCTACGATCAGCTCCAGATCCTTC
TCTTCGGAAAGgccTTCTCCGGTGGCTCTGGTTAAATTgctTTTTCTACGTTCTGTATAGACATTCTCCGGGCGTCtta
aCGCGGAGATgGGGttAATTggccagGTGgGTGTaatgcggggtccactgGTTGATCaaAaa > SEQ ID NO:2928 215676 155587_301357_1
GCGAGTCGAACGCAGGACTTCGTTCAACATTGCAATGGCAGATATGAACCAGCACCCAACTGTCTTCCAGAAGGCAGCT
AACCAGCTACACTTGAGCTCGAGTCTTTCCCAAGATGTCCATGCTCGCCATGTGGGCGTGCAACCTGCTGTTTACCAGA
GGCGTTTTGCTTATGGCAAATACTCCAATGCTGGACTACAACTTGTCAAGCCACTCAGGATCTATCATTGATCACCTC
AAATGCTTCACCAGTGTTTGTGCAGGCTCCTCAAGAGAAAGGACTTGCAGCTTTTGCCACTGACTTCCTCATGGGTGGA
GTTTCTGCTGCTGTGTCAAAGACTGCTGCTGCCCCTATTGAACGTGTTAAACTTTTGATCCAAAATCAAGATGAGATGC
TCAAGGCTGGTAGGCTCTCAGAACCATACAAGGGAATTGGCGATTGTTTGGGAGGACAATTAAGGAAGAAGGGATCGG
GTCTTTATGGAGAGGAAACACAGCTAATGTTATCCGTTATTTCCCCACTCAGGCTTTGAATTTTGCATTTAAGGACTAC
TTCAAGAGGCTTTTCAACTTCAAGAAGGACCGTGATGGCTACTGGAAGTGGTTTGCCGGCAACCTTGCATCTGGTGGTG
CTGCTGGTGCTTCCTCATTGCTCTTTGTCTACTCCTTGGACTATGCTCGTACCCGGCTTGCCAATGATGCCAAGGCCTC
AAAGAAGGGAGGTGAGAGGCAGTTTAACGGTTTAGTTGATGTCTACAGAAAGACGCTCAAATCTGATGGAATTGCTGGT
CTGTACCGTGGATTCAACATTTCATGTGTTGGTATCATTGTTTACCGTGGTTTGTACTTCGGAATGTATGACTCTTTGA
AGCCTGTTCTCTTGACTGGAAACTTGCAGGATAGTTTCTTTGCCAGTTTTGGTCTTGGTTGGCTCATCaccaaTggTGC
TGGTCTTGcttcctACCCAATTGATACAGTCAgaagaagaatGATGATGACGTc

FIG. 2 continued

> SEQ ID NO:2929 215676 127623_300471_1
cccccccctctagctcctcgttcttcgcccagctccatttCCTCTTTCGACTTCCAAGGCGAGTTGAACGCAGGAGTTT
ATTTAGCAATGGCGGATAACCAGCACCCAACTGTTTTTCAGAAAGTAGCTAACCAGATGCATCTGAGCTCCAGTCTTTC
CCAGGATGTCCATGCTCACTATGGGGGCATTCAAAGGCCTGCTCTCTATCAGAGACGTTTTGCATATGGCAATTACTCT
AATGCAGGACTGCAAAACTGCCAAGCCACACAGGATCTCTCATTGATTTCTGCAAACGCATCACCAGTGTTTGTGCAAG
CTCCCCAAGAAAAAGGATTAGCAGCTTTTGCCACTGACTTCCTTATGGGTGGTGTTTCTGCTGCTGTGTCAAAGACTGC
TGCTGCCCCTATTGAGCGTGTGAAGCTTTTGATCCAAAACCAAGATGAGATGATTAAGGCTGGTAGACTGTCAGAACCA
TACAAGGGAATTGGAGATTGTTTCGGGAGGACAATTAAAGATGAAGGATTTGGTTCTTTGTGGAGAGGAAACACTGCTA
ATGTCATTCGTTACTTCCCTACTCAGGCCTTGAACTTTGCATTTAAGGACTACTTCAAGAGGCTCTTCAACTTCAAGAA
GGACCGTGATGGCTACTGGAAGTGGTTTGCAgGCAACCTTGCATCTGGTGGTGCTGCTGGTGCTtcttcTTTGCTCTTT
GTTTACTCCCTTGACTATGCTCGTACTCGTCTTGCAAATGATGCCAAgGCTGCAAAGAAAGGAggTGGGAGACAGTTCA
ACGGTTTggTCGATGTCTACAAGaagactcTTGCATCTGATGGAATTGCTGGATTGTAcCGTGGGTTCaaCAtttcatg
TGTTGGTATCATTGtgtaccgcggtTTgtacttcggaATGTACGACTccTTGaaGccTGTGCTCTTGAc > SEQ ID NO:2930 215676 226691_301035_1
ggatgtcatcttaacgccggaggtgtacttgaccttgtagttgacatctcgcgcggaggcaatggtgtcgacctgcaga
gcgatCCACTTGGTCCACGTTTttcACCATGttGAATGTGTAGTTAGTCCACAATGTCCGACAAGTCCAACTTCCTCGT
CGACTTCCTTATGGGCGGTGTTTCCGCCGCCGTCTCTAAGACTGCTGCCGCTCCCATTGAGCGAGTCAAGCTCCTGATC
CAGAACCAGGAGGAGATGATCAAGCAGGGTCGACTTTCCCGACCTTACAAGGGTATCATCGACTGTTTCAAGCGAACCG
CCGCCGATGAGGGTATCGCCTCTTTCTGGCGAGGTAACACCGCTAACGTCATCCGATACTTCCCTACCCAGGCTCTTAA
CTTCGCCTTCAAGGACAAGTTCAAGAAGATGTTCGGTTTCAAGAAGTCTGAGGGCTACTGGTGGTGGATGGCCGGTAAC
CTTGCCTCCGGTGGTCTTGCCGGTGCCACCTCTCTCGCCTTTGTCTACTCTCTCGATTACGCCCGAACCCGACTTGCCA
ACGATGCCAAGTCTGTTGCTAAGGACGGAAAGGCTGCTGGTGAGCGACAGTACAACGGTCTGATCGATGTCTACCGAAA
GACCATTGCCTCCGACGGTATTGCCGGTCTCTACCGAGGTTTCGGTGTCTCCGTTGTCGGTATCATTGTCTACCGAGGT
CTGTACTTTGGTCTCTACGACTCTCTTAaGCCCGTTGTccttg > SEQ ID NO:2931 215678 206212_300820_1
ACCATCAAACAACAATACAATCCATACAGGATTACCTCTCAATTCAACCACCTTTACGACAATCGCAACTCAATAAAAT
CCT > SEQ ID NO:2932 215678 211872_300871_1
CACCATCAAACAACAATACAATCCATAGAGGATTACCTCTCAACTCAACCACCTTTACGACAATCGCAACTCAATAAGA
TTCTTTCAGTGTATTATCACTCAAGATTTGAATTTCGATTCGACCAAGAAAACTCCAATCAAATTTATTACACCATATA
ATATTTTCAACTTCAAACATTTTTCTCAATATGTCTGCTGCTACCGTCACCCGCGCTGCTGCCAGCACTGTTCGCAAGC
CTATTTCCTTCTACACTCAAGTCCGAAGAATGGGCCGTGTCTTTGAGAGCCACCCATACGAGAGATTTGCAACCACCAT
GAAGCCTGCAAAGCCCGACTACTACAAGAACATTTCTTTCACTGCTGGCAAGGTTGTCACTTATTTCCCCATCATCGGC
GCCATGCTTGGCTGGCCCGTCCTTTGCAAATGGGCTTTGGACGGACAGATCGGTCGCCTGTAAAGAGGTGATAGAGGCA
ATGGTATAGAGTGGGACAGCAAAAAGATATAGAGATGTCCATCTTTCGACTGTATATATACACTTTGGGCGTTTGGATG
GACTATGGGTGCGAAGCATATTTCGGCGCAACACAGATTAATTCAATTTGATTCTCTTTGTTAATTTATTCAAACGCGC
GCCTACACAACAATCTGTGATATaagaaTGTGTCAgccgAAA > SEQ ID NO:2933 215678 215357_300880_1
tccgACAATCCATagagGATTACCTCTCAACTCAACCACCTTTACGACAATCGCAACTCAATAAGATTCTTTCAGTGTA
TTATCACTCAAGATTTGAATTTCGATTCGACCAAGAAAACTCCAATCAAATTTATTACACCATATAATATTTTCAACTT
CAAACATTTTTCTCAATATGTCTGCTGCTACCGTCACCCGCGCTGCTGCCAGCACTGTTCGCAAGCCTATTTCCTTCTA
CACTCAAGTCCGAAGAATGGGCCGTGTCTTTGAGAGCCACCCATACGAGAGATTTGCAACCACCATGAAGCCTGCAAAG
CCCGACTACTACAAGAACATTTCTTTCACTGCTGGCAAGGTTGTCACGTAAGTACCCCAGACAATACAATACAACAAAC
CAGTACATCCATAGAGCGGCTGTACTAACACTTGGATTTTGCAGTTATTTCCCCATCATCGGCGCCATGCTTGGCTGG
CCCGTCCTTTGCAAATGGGCTTTGGACGGACAGATCGGTCGCCTGTAAAGAGGTGATAGAGGCAATGGTATAgagTGGG
ACAGCAAAAAGATATAGAGATGTCCATCTTTCGACTGTATATATACACTTTGGGCGTTtggaTGGACTATGGGtGcGAA
GCATATTTCGGCGCAACACAGATtaaTTCaaTTTGATTCTCTTCGAAAAAAaa > SEQ ID NO:2934 215685 200205_300757_1
atCACCAATTGCACCCCGCCATGGCTTCACCAATGGCTGCCTCTCGCCATGTCCAGCGCGTGGCTACACAGATCCGTCT
GCGCTCAGCGCGGGTTCCCAGAGGCCAATTGACCTTCAATCGATGGGCATCGTCCGCTTCGGGCAGTCGGCGAGCTCCC
GCCAGCTTCGGAACTTCATCCTCGGCAGCCGTTTGGCTTGCAGCCGCCGCCATTGGCATCACGGCTCCCTTGGCCTACA
GCTTGGTGAGTTTTACACGATAGGCCCGGGGAGACACAATTCATGCCGAGACCTTTCCAACTTACATGTCTCTTCTTGT
TTCCTTTTCCAGACAACAGCAGAACCTGCAAAGCTCACTCCCTTGCCGAAAAGGATGAGCAGAAGAAGAGAG
AGGCGGTTGTCACCGAAGAGTCGCCCATGCGCGCGGATGGAAAAGTTCATCAAGGAGCAGCAGCAAATAATTGTCAA

FIG. 2 continued

GGAACTCGAGCGCATCGACGGCAAGAAGTTTCGCAAAGACGAGTGGACGCGACCCAATGGCGGCGGCGGCATAACCTGT
GTGCTGCAGGAGGGCAACGTATTCGAAAAGGCCGGTCTCGGCGTCAGCGTCGTCTACGGAACGCTTCCCAAGCCcgCCA
TCTTGAAGATGCGCGAAAATCACAAgaaccTcgaccccGacgtcgagtcgctggaatcttCGCTgctg > SEQ ID NO:2935 215685 209003_300811_1
atCCCATCACCAATTGCACCCCGCCATGGCTTCACCAATGGCTGCCTCTCGCCATGTCCAGCGCGTGGCTACACAGATC
CGTCTGCGCTCAGCGCGGGTTCCCAGAGGCCAATTGACCTTCAATCGATGGGCATCGTCCGCTTCGGGCAGTCGGCGAG
CTCCCGCCAGCTTCGGAACTTCATCCTCGGCAGCCGTTTGGCTTGCAGCCGCCGCCATTGGCATCACGGCTCCCTTGGC
CTACAGCTTGACAACAGCAGAACCTGCAAAGCTCGACGTCACATCCCTTGCCGAAAAGGATGAGCAGAAGAAGAGAGAG
GCGGTTGTCACCGAAGAGTCGCCCATGCGCCTGCGGATGGAAAAGTTCATCAAGGAGCAGCAGCAAATAATTGTCAAGG
AACTCGAGCGCATCGACGGCAAGAAGTTTCGCAAAGACGAGTGGACGCGACCCAATGGCGGCGGCGGCATAACCTGTGT
GCTGCAGGAGGGCAACGTATTCGAAAAGGCCGGTCTCGGCGTCAGCGTCGTCTACGGAACGCTTCCCAAGCCCGCCATC
TTGAAGATGCGCGAAAATCACAAGAACCTCGACCCCGACGTCGAGTCGCTGGAATTCTTCGCTGCTGGCCTGAGCATGG
TGCTCCATCCGTACAACCCCATGGCTCCCACCGTGCACCTGAATTACCGATACTTCGAaacgggcaatCCCGaCggTAC
CtctcaggcgTGgtgGt > SEQ ID NO:2936 215692 204229_300791_1
GCGAAGAGATTTACTGTCTTGCTTACTCTGTTACTGAACTCATTGTTCTTTGAATTGAACCTTACGATATCAATTACAA
CCCATTGAGCTGCTGCACCACCAAGCTACCACACTTACATACAAACACACACACACACAAATCACCACTACAATAACCA
CACAAATCAACAACACCAAAACAACAACAACAACCGTCACAATGCCCGTCAACTACGTCTTCACAGAGTCCGCCCCCTC
CCAAAACAACTACATCAGATCCGGCCGCGGCCGGCGGCTGGCAACATTGTCCGCTCCTCAGCCCTCCCTCCCACATCATCA
TCCTCCGCCTCCTCCTCAGCCTCCCGCCAGCTCCCCAACCAGCGCTTCTTCTCTGGCATCGGCGGCGCCGGCAACGTCC
ACCAGGCCGACAAGCTCCAGCCCGCTCTGCTGCACTCCCTCGAGACCCCCGCCAACCAGAACCCATCGCGAGGCCACGT
CGGCCGCGGCGGTGCGGGCAACGTCTACAACCGCAAGCCTAGCGATGCCAGCAGTGTGTCGAGCGCGGGCAGCACTGCT
AGCTCGGTTGGCGAGAAGGCCAAGATGTGGGCGTCTCGCGTGAGCGGCTCATTCTCACGAAAGTAGATGAGATGTCTAC
ATATCCATCTCCATCTATATACCTACTACTGGTTGAGGATATAACTGGACTTGAAAATGAAAGAAAGAAACAAAATATA
ATCAACAAAAACTGGCGTTGAGGATACAACACGGTACTGGATGACATTTGGGGAGAGCGATTTTGATACACAACAACAC
AAAAAAATACACACATAAACCtgtgTGATGGATTTACGATTACGa > SEQ ID NO:2937 215729 205158_300796_1
agcaATTGCGCGCCAAAAGACTGTACACAGACGTCTTTTGATATATTTTCAAAATGGGTGGCGGTGGAAAAATCCCTTA
CCCCAAGCACGTCTGGTCGCCTTCTGGTGGTTGGTACGCCCAGCCTGCCAACTGGCGCGCCAACACGCTCATCGCCGGA
GCCGCCATGTTCGGCGTCATCGCTATTACGTGGAAGTTCAGCGCCGACAGGGAACGATGGGCGCATAAGCCGGAGCCGT
GGGAGTGGCATCCTAGCCGATAGTACGTTTATTTTTGATTGTATTGGGTGTGGTTGTGGGAATTTGGTCGTTTTTGCTA
ACGTTTTTCTTTTGCTTGAAGCTGGTCAAAGCAGTTGATCGAGTGGGACAAGGAGGACAAGCTGAAGGCAGCAAGCAAC
AGCAAGGAgTAGAGTTTTCTTTTTGGGAGAAGGATAATAGACgaAATTgTACAAATTCTATAcgaACAAAAGgcaAACA
TTTcaaaac > SEQ ID NO:2938 215737 199795_300752_1
CTTTGTTGATAGTTTGGCCGCCACTCGTAATTCAATTGGGGCGAGCGAGTGAGTTGCGAGTGTTGGTTTACGAGCACTA
CTGGGACGTTCTCCTACCGATAAAAGAAAAGAAGAAAAAGATGGCTGAGGAAGCATCGTTTCGAGACGCAGTTGCGTCT
GTTCCCGGCCTCTCGGGTGCTTCCGAGTCGGTTGCCGCCGACCAGCAGCCCAAGAAGTTCCCCAAGGGAGTGGTTCTGG
GCAAGGATGGCAAACCATGTCGAAGCTGCACATCATTTGCTTCCTGGGCCGCGCAGACAAAAAAGACGTCGCCACCGG
CAGCAGAGCAGTATCTACAACAGCAACAGCCGTCGCC > SEQ ID NO:2939 215737 213819_300861_1
gcCTCTCCCTGACATTCATTCCACCATGGCGCGCCGCCAGCATCTCACAGCGTCCATCCTGTTGGTCGTCGTCCTGTTC
TTCAGCTTCTCGTATTTCCTGTCCGGCTCGTCCAGCCACGATGTGGACCGAATCCATGAGCCTGCGGGAGAGCCCAAGT
CGGAATTCAAAGTGGACCTGGGTGGCATGCCAGCTAGTCTGCTTGACGGAGAGTCTATAGCCCCAAGCTGGAGAATGC
AACACTCAAGGCCGAGCTGGGTCGTGCAACATGGAAGTTTATGCACACAATGGTCGCCAGATTCCCCGAGCAGCCCTCA
AAGGAAGAGCGTAAGACTCTCGAGACGTTCATCTACCTCTTCAGCCGCCTATATCCCTGCGGTGACTGTGCGAGGCACT
TCCGGGGGCTGCTGTCAAAATACCCTCCCCAGACGAGCAGTAGGAATGCGGCGGCTGGATGGCTGTGCTTTGTGCATAA
CCAGGTTAACGAGAGACTGAAGaaGCCGATATTTGACTGCAACAACATTGGCGACTTTTAcgACTGCGGCTGCGGAGAT
GAAgataagaAgaagggga > SEQ ID NO:2940 215744 207926_300830_1
ccCACGCGTCCGCAACACTTACAACTATCAACATCTACCATATTCAAGATGCCTTCTTTCATTGTCACCCTCAAGGACG
ATGTGTCAGATGAACAGGTTGCCGCGTGAGTCGGGCTCCTGTTCCGCTTTGACGACAACCACTGACACGTTACCAGAGC
CAAGCAGAATGCCAAGGATGCCGGCGGCACGATCACACACGAGTACACCCTGATCAAGGGCTTTGCCGTTGAGTACCCT

FIG. 2 continued

```
GAGGGCATAGTTCACTCGCTCGCTGAGGACCCCTCAGTGCAGGCCGTCGAGGAGGATAAGGATATGAGGACGCAGTAAA
TGGAGCTCTCTATTCTGTTCTTGTTGCATCTACATCTACATACATCTACATTAGAAAGACGTAATATAGAGATTGTATC
AACATCTTCATCTTC

> SEQ ID NO:2941 215751 200190_300756_1
GCCATGCTGTGAGTTGTCTCTCCTCTGTCTTGTATCCAACGAACCTGGTCCTGGAAGGCTGCAGCCTCACTGCCTCACG
TTCTCGTACGCCGCCAGCCAGTGCTAGCATCCGCATCTCCCGTGGCTCGTCGCGGTGCAGCAAGCCCCCGTCACTCCTT
GGTCACAGAGCGCCATCATCATGCCAGCGTCGTTGTCACCAAGCCCTCAGTCCTCTCAGTCATCCCTGATGGAGACCAT
TCCAGATGACAAGGGTCCTGATTTGACCCTGGATAAGCCTTTgccCCAACGCCCCAGGACGCCCGCTAAGCTCTTGCGT
CTTGGGGTGcGGAATCGCCGCCACGAGTACCTGGTGAAAACTCGGTCGTATTTTgAcAATCTGGAACATGAACTTGCTG
GTATGATATCGCATCTCATTTTTTTCAATCTCTCTCCTGTTGTCGGCTGATGGGTCATGTCGACGATCCTGTAGCCTcg
aGAGAGACCTCATCATCCCTTTCCAAACCTGACTTGACCTGAAAACcAaCcATTGCGGTGTCGTGTagatcctGTCTTG
TATgagcgtctt > SEQ ID NO:2942 215772 199814_300753_1
CCCACGCGTCCGCCCACGCGATCCGGGGGGGGAATTGAACGGGGGTGAGGGCTTTATGAGAGAGGCGAGCTTTCGTACG
AGCCTTCGGATCAGATAAGATCAGGTCGGGCTGGTGACAGGCAGCCACGGCCCACCAGGGTCCGCCATAGGCGTACAAC
GACCCCGTAAGATCCCAGTAATGGCTCATTAATTGCTCCTGCTGTGGCTGGCATGATCATCGTCACATGGCCGGGTTTG
GGCGACTAAAATTAGCGGGCTGTGCCAGCAGGATGAGACCAAGACGGCAGAGGAGCACGGCCGAGAAGG > SEQ ID NO:2943 215781 199955_300754_1
GCCCTACCTGCCATGGTTCCAAGGCCCTCTCTTCTCCATGGCCACTGCCGCCGCCCGTGAGAACGAGAAGACCAACGTC
CGCGTAAACGAGGTGTATCTGATGTTCCGCGTTGAGGTTGACGAGGCTGCCAAGGAGCATGGCGTCTCAAGCAGCTCCG
AATTCGCCTCCGTCTACGAAGGATTTCTGAACAACCCTGAGATCCGCAGCTCGCGCGTTCGTGTTGCCTCGCCTGCTGA
CTTCACCGACCTGAAGTGGGCTAAGAAGTTCTAAAAAGACTGATGCGTCTTTTTTAAACCTTCGTGTTTCTCTCCATTA
AGCATTTTGAGAAATCATCTCCCTGTTGCTGGCTGATTACACATGGTTCAGTAGTTGACAATACTG > SEQ ID NO:2944 215803 212375_300848_1
gAAGAGGGACTGTACTGTACAGTAACTGTACCTTATGCAATTGTGCAGGATTATGTCTCTGCTGTAATGTATCTGCGGA
CGTATCTGCGGATGCCGGGGATGGACTCCGGTGTACTTGGCACGGCTCGCTTCCGTTTGACATAAAAATGCAGTGTAAC
AGGTAGATGGACGTACATGTAGATGTAAATGCGGTACT > SEQ ID NO:2945 215806 218617_300935_1
CAACAACGATTCTCATCAAAGAACAAACGCATCGTTCAAGATGAGAGCCAAATGGAGGAAGAAGCGCGTTCGTCGCCTT
AAGCGCAAGAGAAGAAAGATGAGGGCTCGCTCCAAATAAACGACTCGCTCTACCACTTGACTTGACACATCTTTCACAT
TTTGAATGAGTTCACGATAAAACACGACAAGCAAAGCTGCTGCACCACGGTACCACTCTATGACCGATTACAGCCATCA
AGTTGGAATCAGCATATTGGTGCGCCTCTCCAATTCAGCTACGGGAGTCAATGGACGAACGCGAGAGATGAGGACTGGA
CAATTTCAGTCAGGTGGAGACATCGTTTTCGAGGACGCGAAGGCCATGAAGCAAAACGCTGCTGCAAGAAGCACGCTTAG
GATCGATACGTTGCTTGACAAAGATCAAAGGCAGAATTTACTTCATTTCCAAATcaagaAAAAAAAAAAA > SEQ ID NO:2946 215810 213950_300862_1
acgcgtcggCGGCGTCTCCTACAAGAAATCGTTCGTTTCCCTCTGTCATTGCGAGCCTGTTGAGCAACACAACAAAAAG
GCGTCAACACACAAAGATCCAATCGCCAGATCTAAAGCCTCTGTGCTACTCAGTCCAACAATTGCACAAAGCGACACAA
CATACCGAAATCTGCAAACAATGTGTTTCCGCGTGGAGCCAAAGGCCAAATACTACTACCAGGAGGAAATCATTCCCTC
ACGGCCGTACCGCCATCACCATCACCATCACCATTCTTCCCACCACTCGCCGCGAGCGAGCTACTCGGCGGTTGAGCGC
TACAGCCCGCGGGTCAGCACCAGCAGCTACAGACGCAGCGTGCCGTCGAGGGTCGTGTATGAGGAGGACAACGCGGAGTC
GGTACTGAATGGGCTTTTGATTAGGACCAGGAATATCCTGTGATTTTCTTACTCTTTGTTTTTTTAACGACTCTATGGT
ACTGGTTATGGGAAATGAGACACATGTTAGAGGCTAGATAATGGGCGGATTGGGATGGAAACTCGAGGCAGGCGATGG
TTTCATGAGGATATGAGaACCTGGAATGCgGTGAcggcgTTGGTAACATATATTTCGCCTTTACGATTTGAATGAATGA
GATACATAAAACACAttcTaGaTGTctcGc > SEQ ID NO:2947 215813 200512_300853_1
GTCGACACGCGTGTTTTGGAGTAGTTGCTGAATGCTATGGTTGGTTTATATCAATATGATGAGTTTCAGATTAGTTCAC
AAAGGTTCTTTATGGCTCTTTTAAGGATGGGAAGCCGCAGAGAGTCGTGATCCTTTCAAAACCCAAGGCGTCGCACGTC
CGACGCTGTGTCTGAGCAAACATTGTTCACCCTTCAAGTTTCCACTACAACCTCGACCGGTACCACCATGAGCGGCATA
GAAAAGCGCATGTGGCTTGGACACCTCAACAAGGACCTGGGGCCCATTCCGAGGCcagaaATCCCATTCGCCCtcgtct
GGCttgtttaacgccttgcagggggGggaGagGGGAAGCTGAGCATGGGAGAGGGagacggAAAGaaacaAAAAGCAAA
CAtattTGATCATCATGC
```

FIG. 2 continued

> SEQ ID NO:2948 215817 209083_300811_1
AGCAGCTGACATCTGCCGTATCATCGCTCGTATCAGTTCGTCTCAACATGGCGCCCCTGGCTCAGGCTGTGACTGTGTC
TCTCAAGGACCTGCAGAATGGAGACGTCTCCTTCGAGACTCTGCAGAAAGCCTTTGGCCCTGATTCCCTCGGTATCCTA
GTGGTCAAGGACGTTCCACAAGAGTTCGCCCAGCTGCGCCATGTCGCCCTATCATATGGATCCTATTTGGGAAACCTGC
CCAAAGAGGAACTGGGTAAGTGCTTGTCTGCCTTTTCTTCTTCTTTTCTTTTCAAGCCGCCACCGAAGATGGATGGATG
GATGAACGGATGGAGGGTAGCCCAGGCACCTGTTTTCCCTATTTTCCAATGACACGAGCCGCGGAGCGCTTACCATCGC
TTCTACAGACAGGTTGGAAAACGCCAAAGCAAAGTATCTCACCGGCTGGTCGCTGGGCAAGGAGACTCTCAAGAATGGC
CAGGCCGACACCTTCAAGGGATCCTACTACGCCAACTGCGCCTTTTACGTGAATCCCACCCTAGAATGCGCTGAGCCCA
CGGCCGAGTTCTCGCCAGAGACGTTCCCAGAATACCTGTCGCCAAACGTCTGGCCCGCCGAGAATGTGCTTCCCGGCAT
GAAGCCGGCAGTGACAACTCTCT

> SEQ ID NO:2949 215823 200362_300758_1
ATGAATAATGACCAATTCCGAAAGTTGATGCTGGCCAAGTCGGGCAAAGCGTCAAAAGATGGCGCTTCATCCAAAGGCA
CGAGCTCCGGTGCGAACACGGGCTCCTTGGGATCTCGGCAGCGGAGCAGCATACCTATGACTCCGCGATCTTTGGGAGG
TGCCCAGGCCGATTTCGCGAGACAGCTGGCTGAGCGCAACCAAGCTCTAAACCCTCCAAAGAAGTTTAAGACATCTGTA
CCAAAGGGTGTGAAACTAGGGGAAGGATACATCGATAGATCGCAAGTTCGAGAGAGCGAAGAGGACGACCGAGAAGAGA
GACTAAAGGCGTTGGAAAAAGCTTTCAAAGACGAAGAAATTGACGAGGCAACATACGAAAAGCTACGGTTTCAGATTGC
AGGCGGAGATCTGGCAAGCACTCATCTAGTCAAAGGGCTTGATTTTAAACTCCTCGAAAGGATACGAAAAGGAGAGGAT
GTCTACGGAAATAAGGGAGTAGAAAAGGATAGCGCCGAAGAAGCACCCATAGAGGACGACGTGGATGACGAATTCGATC
GACTCGAAGAACAAGAcgtacaaGCCATTACGAAAGAAAAAGCGGAAAAGAAGAAGGGCACTCTTTCAACAGTGTCTCT
GGCACCTGGGAAAAAGAGAACACGCGA > SEQ ID NO:2950 215825 200446_300759_1
ggTAGCATTAGCTGGAATTTTGTTCATGCATCTGGCCCAGCAACAAGGTGAGAAGAGAaGACACGATACGGATTTGCA
AGTCGGTCTTCGAGATCTACTCTGCTAggAGACAACATCTTGCTCGGCTTTTAGAATTCTGACATGTCTTGCCGTGGTG
AAACGCTCATCCTCCAGGTTAGGTGCTAGACAATAAACctcgACGGGATCTTCGAGTCATGATGACGCACGGCAAGGCC
TCCGACCTTCCTATCGAAACCTGGAAGCCTGGTCTTCTTTTGATACGAGCAAGATGTACTGTACATCGTAATCAATATA
GCTGGCAGAGTATGGACCTGGAAAGATtggcgaTGCCTCCAGACTCCAGATCGAATAACCAAATTCTTCGTCagaagtt
gccacagctgcacggtcCctcgCGCCCTCTAATcaagagAGTCAGCTACTCaactcagatAGGGCAACATATCCCAATA
AACCTCtgcaataggcaggaggAGATGCGTAATATACTAATaatGGAac > SEQ ID NO:2951 215825 211258_300897_1
GTACATCTTGCTCGTATCAAAAGAAGACCAGGCTTCCAGGTTTCGATAGGAAGGTCGGAGGCCTtgcCGTGCGTCATCA
TGACTCGAAGATCCCGTCGAGGTTTATTGTCTAGCACCTAACCTGGAGGATGAGCGTTTCACCACGGCAAGACATGTCA
GAATTCTAAAAGCCGAGCAAGATGTTGTCTCCTAgcagAGTAGATCTCGAAGCTAACTTGATCAGAGACTGGTCTTACA
CTAGGTGACCGCTGCGAGTGTCTTGAGTCAACAGGAAAAGAATCCGCGAAGGAAAAAAAGAAAGGAGTGAACTCACACC
GACTTGCAAATCCGTATCGTGTCTTTCTCTTCTCACCTTGTTGCTGGGCCAGATGCATGAACAAAATTCCAGCTAATGC
TACAGTAAGGAGACACTAGCCGCGACTGcaaggAGAAAGCTCTagcTCGCTTGCACAAGACCCTCTTTCATGACAGCTA
GACGCCCGCGCCAGTGGACGGCTCTGACTTGAAGTTCTCTGAAGGATGACAAATGATGGACTTGagatctGgccacG > SEQ ID NO:2952 215827 190035_300615_1
CTAATGATAATGAATGATTGGAGTGCCAGAGATATCCAAGCTTGGGAAACTATACCTCTTGGACCTTTCCTTGGGAAAA
GTTTCAGTACCACAGTATCACCCTGGATCGTTACTATGGATGCCCTAAAGCCTTTCACCTGTGAAGCTCCTAAGCAGGA
ACCTGAACCTTTGCCTTACTTAGCTGAAAAGAACCACGTAAACTACGATATTCCTCTTGAGGTCTGGATTAAGCCCAAG
GAGCAAAGTGAACCATCAATGGTTGCAAAGAGTAACTTCAAGCATCTGTATTGGACTTTAACACAGCAACTAGCACACC
ACACTGTTAATGGATGCAATCTGAGACCAGGGGATATGTTTGCAACTGGCACACTAAGCGGACCTGAGACAGAATCTTT
GGGATGTTTGCTGGAGCTAACATGGAATGGGCAGAAGGAGATATCAGTTGGAAACTCGACCCGCAAGTTCCTAGAAGAT
GGGGATGAGGTCATCTTGACAGCTTG > SEQ ID NO:2953 215827 200207_300757_1
GGCGTGGGAATATGTGCCCCTCGGACCGTTCAACGGAAAGAACTTTGGCTCAACTATCAGCCCTTGGGTTGTTGTCGCG
GATGCGCTGGAGCCCTTCCGAGCCCAGCCGCTGCCGAATGATACCCCTGTTCAGGATTATCTCAAGCGAGTCACAGAAGG
AGAGCGTGTTTGACATTCAGCTTGAAGTCGGCCTTACAACTGCGGATGGCGACCATGTCGACCTGTCCAAGACAAGCGG
CCGAAATCTGCTCTGGTCCTTCCCGCAGATGATAACGCACCATACCGTTGGCGGATGTCCTCTCAGGGCCGGAGATTTG
TTGGGCTCGGGAACCATTAGCGGCTCAGAGCCTCGGGAACGTGGTAGCTTGCTTGAAATGACCGAGGCGGCAAGGTCG
ATGTTCAGCTCGAAAAGGGCGGGGTGCGTCGCTTCATCCAAGACGGTGACAGCCTGAACATGCGAGGATACTGCGAGAA
GAACGGAGTGCGGATCGGGTTTGGCGACTGTGAGGGCACGATTCTGCCTGCTCACGGGCGTAAAATTTGGGAGGGGAC
AACGGCATAATGAGAAATGTAACCAAAATATCCATTAGATGAAATCAAAAACAGAAGCCAAGAGCTCTTTGGGG

FIG. 2 continued

> SEQ ID NO:2954 215852 204334_300792_1
GCCCACGCGTCGGCTAATACATGGCTCTTTCCCGCTCAGATACGTTTACAGTAGCAGGTACTGCCTACCAGGACTTTAC
TTGCTTTTGGCAACTTGGGTAGGCCACGGCTGTCATGAAGGCGCATCTAATCCGTACATTAGCGGTGATACCCTGCGCA
CCTGTATTTTGACATCCCGCGTGATGCGGGATTCCAGAGCCGTTTCCAACGGCCTTTTGGGCATTGATATTTAGTTTTC
GATATGAGAGCTAGTACTTGCAGATGAACAACCATGAAGCACTATTGCGGCACTAGCAACAGGATTGCATTGACATCGA
CTCAATATGTAGCAAAG

> SEQ ID NO:2955 215859 1008419_301415_1
GTGCCATAGTCCCTGCTCTTAGAAACATACGACGACGAGTGCCAGCTTCTCTTCTCCAAAACCGAAACGTTTTGAGAGA
GAGAGAGAGAAATGGAGAACGTTTTGGGCGGCGCTGCCCCGCTTTTGGCCGTTTTCTCAGTAGTACCCAAGTAGACACT
ACTGCAGAGCTATTGGAATTTCCTGGGGCTCGAGTGCGCTACACAAGTGAGCTGAAATATATCCCGGAGTCTTTGGAGG
AGCCTGTTCCTTGTTTTCGTGTTTTGAATGATTATGGACAACGTATCGAAGGGTGCAGGGTGCATGAGGTTACTCAGGA
TCTTGCTCTAATGATGCACGAGCGAATGGTTATGCTTCAGGTCATGGACAATATCTTTTATGATGCACAAAGGCAGGGA
AGAATATCCTTTTATGTCATGACTACTGGAGAAGAAGCTATAAATATTGCATCTGCTGCAGCTTTATCACACGATGATG
TGGTTTTATCTCAGTACAGGGAATCTGGTATACTTATGTGGCGCGGGTTTACGCTTCAACAATTTGCAAATCAGTGTTT
CAGCAATGAGGCTGACTATGGAAAGGGGCGGCAAATGCCTGCCCACTATGGATGTAGT

> SEQ ID NO:2956 215859 210452_300889_1
NTCGAACAATGTTGAATCCGCTCAAGGCCAACTCGCGCGTCTTCGCAGGGGCCTCCATCCTGGAGACTGTGCTCAGCCG
TCCGTCTCCGTCATCT

> SEQ ID NO:2957 215859 195596_300635_1
GATTGTCCTTCTTCCAGCTGCCAAAATGTTGAATCCGCTCAAGGCCAACTCGCGCGTCCTTCGCAGGGCCTCCATCCGG
AGACTGGCTCAGCCGTCCGTCTCCGTCATCTCCAATCCCATCCGGAGCGCGGGAAGCCTCTCGCAACGGCCCAATTCGG
GATTTGTGTCGTTCCCCGGCGCTCTCAAGAGCTCCTTCACCAGCTCTCTCAAGTTTGAGACGCCCGAATCATACACAGC
CCTGCCGACGTACAGAGTCGTGGACCAGAATGGCCAAGTGGTTGACCCCTCCTTCACCCCTGACATCAGCGATGAGGCC
GTCATCAAGCTGTACAAGGATATGCTGTACATCTCCATCATGGATCTCATCATGTTTGATGCTCAGAGACAGGGCCGAC
TAAGCTTTTACATGGTAAGCGCTGGCGAGGAAGCCGTGAGCGTTGGCACCTCGAGTGTGCTGGACAAGGATGATCCCGT
CTTCTGCCAGTATCGAGAGCAGGGGCTGTTCAAGGAGAGGGGCTTCACGACGGAACAATTCATGTCACAGCTGTTTGCC
AACAGAAACGACAACGGCCGGGGCAGGAACATGCCCATTCACTACGGATGCAAGCCGTTGAACATTCACACTGTCTCCT
CGCCATTGGCTACACAACTTCCGCAGGCTTCGGGGGCGGCTTATGCCTTGAAGCTACAGAGACTACAAGACCCCAGCTC
GAAGCCAAGAGTAGCGGCAGTCTTTTTCGGAGAGGGAGCTGCCAGTGAGGGCGATTTCCATGCCGCGCTGAACATTGCC
GCCACACGCTCTTGTCCCGTTGTCTTCATCTGCCGCAACAACGGATTCGCCATTTCCACACCCACTCTCGATCAGTACC
GAGGAGACGGCATTGCGAGCAGAGGAATTGGCTATGGAATTGATACCATTCGAATTGACGGAAACGACATCTGGGCAGT
CAGAgAAGCCACAAAGAaggcaCgagaaATGGCACTGCAGgACggTGGCaagCCGGTGCTTATTgaagcCATGACCTAT
CGTGTCTCTCATCACAGTACTTccga > SEQ ID NO:2958 215863 204184_300790_1
TCATCGCTTCATTTCGCATATCGGCGCCATTCGTTCTTTCCACCTACTGACATACAAACGCACCTTATTTTCTTTCATT
CTTACTCTTTTCGTCCAGCCATCCGCTCTCTTTGTCTTGGCCTCATCACCGGTAGCTTCCTGACAGTAATTCGCCCGTC
TAGCCTGCCGTCTTGTTTATCAAAAGACAAAGCGCCAGGAGGGCAGGAACACCCCAGTATCGCGTCTACCAGCCCTGCGGCT
TCGATTCGGCTCAACCATCCATCTATCTCGGCGGCGTCAAAAGACAAGCTCCGACGAATCCAACTAACCAGAGCACCGAG
TCTTTGCTCTGCGTCAACTTGAACTCAGCTCTCTCCTTCGTCTATCTTACGCTTCGAGATATTCATCATGTATTCTTCA
AGGCTTATTTCGGTACTGGTCGTGGTGGTGTCCATCCTCTGCATGGCCCAGGCACTTGGTGGGACAACCAAAAAGTTC
ACC > SEQ ID NO:2959 215864 204292_300791_1
ggccgagaTACCCCGTCCGAAACGTTCTCACAATGGCGTCCCGCTTGGTACGAAGCGCTGTCGGCGCATCTCCCCTCCT
CCGAACCACCATCTCACGATCCGTCCCGGCCATTTCTGCCGCCGCCGTGCGATACTCGAGCAACGTGCC > SEQ ID NO:2960 215880 204393_300792_1
gcATCGACAATGGCATCCCTGCTGCGCACGCTCTCTCTGGCCGCAGGGCTTTTGCGCTCTTCTCAGGTTGTCAAGCCGT
TTGCGGCTGGCAGCTTTGCGACGGCAACGAGCAGCCCGGCTTCCTCGTGGATGGGATGGTTGTCCAAGCCCGCAGTTGG
AGGGACCCTGCAGCAGACGCGGGGCATGAAGGTTCACAGCTCGGTCAAGAAGAGGTGTGAGCACTGCAAGGTTGTTCGA
CGAAAGGCCGGCAAGCGACACAACGGATACCTGTACATTATCTGCAAGGCCAACCCTCGACACAAGCAGCGACAGAGCT
AAGGCGACTGCGAGGATGGTTCTTCTCTTTTTTGACGACGATGACGACGATGACACCCGGATGAGTGGGCATTCTGTAT
ATTATTGGCGTATAAAGGGTGACGAAAGGGAGCGACGAACAAACACACACAACGGTCTGGCAAAAAGCAATTGATAGAC
GATACTACGGCAATGGGCTTCGAAGACGTGGAGGACATGACACGAGCCCAAGTGCGAGCTTTCTTGCATGCTCGAGAAA
TGACGGTTCagagtGCCGTCGTAAAAATGTAcaaTTTTATGTAGtgttAcATACCCCCGATATAActctc

FIG. 2 continued

> SEQ ID NO:2961 215885 204322_300792_1
GTAATTGACTACTATGTGGGCATTCAATAACTCAGTCACATGCCAAAGACCTCCCCATCCATTGCATCTCCCTCAGTGA
AGAACAAAGCAGTTAGTTGTTGGCACTTTGTTCACCCATCAACAAAAAATTTCTTGCTCCAGGAATTGAAAGCCCTAAA
GGGAAAAAAAAAATTCAACAGCCGCGCATATAGCTCGTGACTCGACCACAACGTGAGCTAGTCATACGATAAAGCTGGG
GAACCAACAACGTGGGCAGATTTCCCCCCAGGACTCGGCCCACTTCCCCAGACTCCTCCAGACTCCTCCGCAGAGTGGA
AGATGCATGTTTCTTCCAGGTTCTGTGCCGAAATAAGCCTCTGGTATACTTAATGGCAGATGTCGAGCTCGCACAATGC
AGTAAAGTAATACCGAGCTCGCCAAAGCCCTCCAAAGCGGCATCATTGGGCGAACTCGGCTATATGTCTACGTGTTGGA
TAGAATAGAGTGACAAGTCACGATCAATAGTACTTTTTACAATGC

> SEQ ID NO:2962 215888 204494_300817_1
ATGGATTTGAGACACCAGGAAATGCAATGGACCTGTCTCTCGCTACTCTGCTGGTTAATTTCTGACTCTGGCGCTAATA
CACAACGACGATGGCGATGCTTTTTCCATACCCCATAGACCCGCTAGTCCCATCTGACATTACTCGACGATCAGCACAT
GTCGACCATCATATCCGCGCATTTGGGCTGGTACGGGGATATTTAGATGCCAAGGGCGAGCCTAAATGTTGAGCTGGTT
GACCAACGCTGCTTGTGACCAACAAGGAGCATGAGTTGGCCTCGTCAGCATTGCTCCCGCCAGAAATCTTTTACAACAC
AATACTACAGTGTACCTCCTTGGGCTTGACTTTCTACTACTCGTACAGGTCAAGCCATGTCAGATAGTCAGACCGTTGG
TAGTTCCATGTGG

> SEQ ID NO:2963 215922 205205_300797_1
aagcaatatcattGTTTGCTCAGGAGGCCAAAGCGAGCTTTTCGATTGATTGTCCTCTTTGTTCTTTGTTACATTTCAT
ATTTATTTGCGTCTTGGGGAGCCATTGCAATTGAATTGCTGCCGGTGCGGACTCTTGCAGCTCCGAGGCTCCGCTATCTCCATCTC
ACCGGTGATTCCTTGTGCGAGGTTCGGCGAGAATTCCAGCAATTATTGTCACTCTTTGTCCTTTCACGAACGGAGCGAA
ATATATATAATCAGCTACGCTGGGTAAAGAGAAAGAAGAGGAACCTCTGCACTCGCCGCATCCTACGAAATGATTCGGG
CGGCGTTTCAATCGAGAGCGGCACCGTTTGGAGCGGCCAAGAGCACGACGGTACAATATGGAGCATTGAGGGATGCTTG
GGCAAGGCTATTTTCGTCACAGCCTGTCATGAAGTCCCCGAGCAACAGCAGCAGAACATCATGGACGAGGTTACATTCA
ATTCAGCCCTGGCGGGGAACCACGCGCCACGGCCGCTTCGATGCGACCAAATGTCAGGATAGCTGACAGCTTTGCGAGGG
GGGCGCAAAGGCGGAGCTTTATGTTTTCGGCAtggaGGCGCAACACTGCGCAAggagctcagGAGAagttgtcgcTgag
CGGGGAGATTCAAGAAGctcctccaggaatacggGTGGTcggccgtCGGCGTCTACTTCGCGCTCagcgtgcTGGACTTT
CCGTTCtgcttcctCcTGGTGag > SEQ ID NO:2964 215926 120256_300383_1
CTTTCATAATGGACAGCAGGAGATGCAAATGCAAGTGGTGCGGGACGAAAATTTCAGCTCCCATTGGAGCACAAACCAT
TTCGTGCCCAAGGTGCCAATCTGTTACCCAACTCCAACCTCCAAGAACCAACAACGGCTTTGCCGCTGGGGTTATTAAC
AATATTATGGGTGCAGTAGTTAACACAGGGTTTCCAGCAAGGCTGGGAAGGATGAATCCAACAGATGCCAATAATTATC
AGCCTCAACCGTTCAACATGTCACCCCAGATTACTATGCAACCTCCAGCTGTTCATGGACGGAAGCGAGCAGTACTCTG
TGGAATAACCTACCGTGGGCATTCCAAGAGTCTGAAAGGAAGTATTAACGATGTTTTATCCATGAGATATCTTCTGGTT
CAGAAGTTGGGTTTCCCCAATGCATCCGTTCTTGTCCTTACAGAGGATGAGAAAGATCCATACAAAATCCCAACCAAGG
GCAATATCAGATCAGCCCTACGTTGGCTTGTTCATGGTTGTCAGCCAGGAGATTCACTAGTGTTCCACTACTCTGGCCA
TGGCACAC > SEQ ID NO:2965 215926 205094_300795_1
CCCACGCGTCCGCCCGCCTCAGCATGGAGGATATGGACCACCTCAGCCTCAATACGGCGGCCACCAGAACCAATATCCT
CCTCCCGGCGGCCCTCCCCCGAGCCACTACGCACCTCCTGCGCACCATCCTCCTCCGGGTCTAGATGCTTACGGCTATC
CTCTCAACCCTCCGACTGCCATGCACGCAAAGGCCGGCCCCCGCCTCCCTCGGCCCCTCAGCAGTTTGGCCACGGTGC
TCCGGGCGGCTACACCTTCCAGTACTCCAACTGCACAGGAAAGCGAAAGGCGCTGTTGATTGGAATCAACTATTTTGGC
ACAAAGGCCGAGCTCAAGGGATGCATCAACGATGTCCACAACGTGTCGGCATTCTTGGTTGAGCGATATGGCTATAAGC
GCGAGGACATGGTCATCCTGACAGATGACCAAAGCAACCCTGTCATGCGCCCAACCAAGGCCAACATCGTCCGTGCCAT
GGGATGGCTTGTTAATGGCGCCCAGCCCAACGATGCCCTTGTTCCTTCACTATTCTGGCCACGGCGGCCAGACCGAGGA
CAAGGACGGCGACGAAGACGACGGCTACGATGAAGTTATATACCCCGTTGACTTTGAACAAGCTGGACATCTTGTAGAT
GATGAGATCCACTTC

FIG. 2 continued

> SEQ ID NO:2966 215929 206158_300819_1
gtggatgatgatatgccagccatctagatgattttttgtggacgcgcgcaGTATCTCCTTGATCTTGTGCACTGGCCGCA
AATGGGGCTTGCCTCGTCGCCTGTCAGAAAAGGGGCACATGTCAGTCATTCCAATGACGTGTATAACGAGGGCGAGTGA
ATATTCTGATACTTAAGGGGTGTATAGGCAGCTATGGGGGTCTGACGAGATCCAGTGTTACTCACATTTTACTTTGCGC
TGCCTGCACGTATCGCTGTTAAGCAGAAGCCGACGGCAGAAGCGATTAGACACTGGCGTCGATAGTCTGAAAGACGAAT
CATTGCTTACCAGGCTGTGATACCACAAGGTCAGTAAGAGTAACAGCGGCAGGGTATGGAAGCAGGGGAGTCGATGCAA
AGATAACATGTCCACACACACACGCACGCACGCACCGTTGCATGCGCGACAGTACGCATATCAGGATACATGTATGTAC
ACACTCAGATGCATAGGAGCAAAGGAATGGGCTG > SEQ ID NO:2967 215929 214136_300855_1
atgccagccatctagatgattcttgtggaggcgcgcggtaTCTCCTTGATCTTGTGCactggCCGCAAATGGGGCttgc
ctCGTCGCCTGTCagaAaaggggCacaTGtcagtCATTccactGAcgtGTATAACGaggtgttactCACAtttttacttt
gcgctgCcTgCAcgtatCGCTGTta > SEQ ID NO:2968 215931 205031_300795_1
gaaattaatctatcGTGGTGATCAATTGGGAGCTTCATACCACCACTGAGCTCGTTCCGGCTTGCTCGGGCTTCTTCTT
CTCGCCAGGACGAGCCTTCTTGGCTGCTTTCGCCTGCTGAGAGCCTGCTGCTGGCAGACATAGCACCGCGTATGCCACC
TGGACAACGGCGACGACAGGCAGCGCGGATTGCAGCGTCAGCACCGGCTCTGCCACCAGGTCGTTGAATTGAGCGGCCA
GTAGCCCGAGCAGGACAGCTACTCGGCCGAAAGCGATGCCCTTTGACAAGGCATTGTCGAACGTCGGGACCGCGCCCAC
GGTGGCCTTTGGCTTGCTGTCGGTAGCCGGAGCTGGAGGAGCTTTTGCCAGTGCTGAGGACATGGTGATTGTGTCTACT
GGCGCATTCCTGTGATTCTTGGAGTTTGAGCTATTTGGACAATTCGAGGTTCCAGAAACATAGTTCGGCCAATGGCGGC
AATCACGTGACCTTGACCAAGGGAGCTTGTCGACCCAACCCTTGCTTCACTCTGCGTACATGTACGAGTATATACTTGA
ATCTGGAGGTATCACGATCAAATTATTACGGACAGTTGATTGTTGCGAGCAGCATATAAATAcaaatg > SEQ ID NO:2969 215934 205055_300795_1
GGCTGGGTGAGCCTTTTGCGCATCTTGACCTATATTACACCTTAGAACGACGCATATACATATTCCTAAACATTACGCT
TATGGCGGTTGATACCGAGGGGTCCGCCATCAACATTCCTGCTCCCGCAGCTGCCATGGGACTCACCCAAACGCCTGGA
AAAGGCGCTGCGAGCCACGATCTTCACCCGTCGGGCAAGCGGGCTCACGGCCGAGGAGTGCAGATACTTCGAGGCCTGG
CTCTCGCTGTGTACTTTTTAATCTGCTGTGTGACTATTGTCGCTTCGCAAGTTCTTGGGTGTTGGCTGTATTTCGTGAA
CCGCGAGATATACTACGATTACATGGCCTTGACCAAACGGTGGTTTGCCATAGTCGTAACTTGGATGACACAGATTTGG
GGCCCGGTAATCATCCGAATCAGCGGCGATGAGTCAGTCGCGGGAGAGATCCGTCCCACGGACGGTGGCGGAGTGCAGT
TCAACTTTCCTGAGCGGTTGGTGATGATAGCGAA > SEQ ID NO:2970 215935 205255_300797_1
tgtatatccgaggaatgccatgcggttgttttggtgttttgttgctgCTATGGAAGAGAGTCCACCAGAGCTGAAAACTG
CTTGCTCTCTTCCATTGCCATTACTACCACCACTACTGCTAATGCTTACGGGCTTGGCACGGTCAAGCATAACTCCAAG
CTTGGGCTCGGGAATAAAGTAAAAAAAAAAAAAAAgaCTTAACAACAATGCAATTGTCTCTCCCTGAGTGGCTCTCGGCT
TACAGTACTCCGTATCCCTGGCCTGCCATGACTGCAACTTGTCGGCTCTCGGCACTATGCCCAAGGGAGCAGCAAAACC
CCTTCAAGGCTTCAAGCATTGCGATATGGGGCTTATTTCCGTACAACAAAGAGAGCTGAAGAAAGATCAGCATCAACAT
CGTACGTTCCTTTccaggcgCCTAcaGAGGGCACGggt > SEQ ID NO:2971 215938 205024_300795_1
CTTTGTCATGTTGTAATGCAGGATCACGATTAATCTTTTCTTCTTCTCTCAACACACGGCCATGCGGCGTGAGAGGGAT
GACTCAGACGATGAAGACATTCCGCTGCATCACAAACGCCCGTTTGGCGCTGGGCTGAAGCGCAAGAAAATTGAGTTTG
TCAAAGCCACAGACGCAGACGCAAGCAACACGATCAAGAATCTGGGCAAGGAAACCGCCTCTATCGGAGATGTCTACGC
CAGCATAGTCCTAGGCGGCAGCTCCAGGGATTCATCATCAAAACCTGAAGGCACCAGCGATGAAAAGGACGACCAAAAG
GAGGACGCTGTTGAAAAAGAGCCGGAACCTCCAATATGTCCCGTCTGCTCTCTTCCCATCACAACGACGCTGCAGCAAC
ACGAGGCCTCGCTTGCCCATCAAGTCAGCCTGGAACACTCCCANCCTCCATCTGCACTAGATCGATCGCGCATGGGTTT
TGAAAGCCCCTGGAATCTCAGGGCTGGGATCCCGATTCCCGTCTTGGCCTGNGCCGAGAAGGCGAGGGCACCCGGTTCC
CCATCAAGGTAGCCAGGAAAGAGGACACGCTGGGAATCGGGGCTACTCGTACGCAGCCAAAGCAGGCGGTCCAAGAGAA
GCCTCGGGCTCTGACTG > SEQ ID NO:2972 215953 205619_300800_1
GGGAGCTATGATGGGCTTCATGGCGTGGAATTGGTTTGTTTTCTCTCATTCGTTGACTCTTTTCAATCAATATACACA
AGCAGATGGGTATTGGTTAAAGAGGGCGAGCGAGAGATTCACTTCAACGCAAAGCCTTGAAGAGAGAACAACTACTATA
GCAGTTACATCACCACGTCCAAACTATNCGTGCATCAGGAATCCTGCTTCTTGGGACGCGCTTGTGGCACCTCTTCAT
CAATGGGCATCAGTGCGTCTGCCGTGGCAT

FIG. 2 continued

> SEQ ID NO:2973 215961 216977_300903_1
aacaaCACCGCAACCATTCAGTTCTCTCAGCTCTTGGGATCGTTCCTCCTCTTCTCCTCCAACATCACAAACACAACAA
CCACCACCACCACCACTCAACCTACAAACAACGTCACAATGGCCGCCAAGCTCTCCGCCGATCTCCTCTTCCAGATGGC
CAAGGTCCGCCGCTCCATCTATCCCTTGAACAAGACTCTCCCCATCTCAACCTCTCGCATCCACGAGATCGTCAAGGAG
GCCACCCTCCACACTCCCTCCTCCTTTAACGTCCAGACCAACCGTGCCGTCGTCCTCTTCGGCGCCGAGCACGAGAAGC
TCTGGGACATCACCTCCGAGACCCTCAAGGCCATTGTCCCCGAGGACCAGTTCAAGTCCACCGCCGACAAGCTCGCCCT
CTTCAAGGGCGGCGCCGGCACCGTCCTCTTCTACGAGGACACCGACGCCACCAAGGCCCTCCAGGCCAAGTTCCCCATC
TACGCCGACCGCTTCCCTCCCTGGGCCGTTCAGTCCCTCGGCATGGAGCAGCTGCTCATTTGGACTgcCCTCGAGGTTG
AGGGCCTGGGCGCCAACCtCCAGCACTACaACCCCCTGAttGacctcAAGGTTGCTgagACCTGGGGCGTTCCCGCTCA
CTGGAGactcgatgcccagcTTGTCtt > SEQ ID NO:2974 215966 1101257_301474_1
gaaggtatAGGCAAGGTAGAGGCAGGCTTCTCTCTCTCGTCGTCTCGTTCTCAGGACAGAGGGAGGACACACACAGCTA
CAGACAATGTCGGGCAGGAAGAAGGTGAGAGAGGTGAAGGAGGAGAACGTCACCCTCGGGCCCGCTGTTCGAGAAGGGG
AGCACGTCTTCGGGGTCGCTCACATCTTCGCATCCTTCAATGACACCTTTGTGCATGTGACTGATCTCTCTGGAAAGGA
AACCCTTACCCGTGTCACAGGAGGCATGAAGGTGAAGGCAGACCGAGATGAGTCCTCCCCTTATGCAGCCATGCTTGCA
GCCCAAGACGTGGCTCAGAAGTGCAAGGAGTTGGGAATAACTGCATTGCACATCAAACTTCGGGCTACTGGTGGCAATA
AAACAAAAACACCTGGACCAGGTGCACAGTCTGCCCTCCGTGCCCTTGCTGCTTCTGGCCTGCGCATTGGACGCATTGA
GGATGTGACTCCCATTCCTACAGACAGCACTAGGAGAAAAGGGAGGTAGAAGAGGAAGGAGGCTCTAGAGAGTGTGCCTT
TATTTATTTCAGATCTTGAGAGCGTATGGAGTTCaAGGCCTGGCTCTCTTGAAGGAGTaGTTGTGgaaCTTCAAAtGtt
tTGCagagttTTg > SEQ ID NO:2975 215966 194231_300745_1
cccggcCGGTCTCCTCCGAACCCTAGCCTGCTTCTCCTCCTCCTCCCCGCCGCCGCCGCCGCGAGCACAGACGACGCAG
CCATGTCCGGGAGGAAGAAGACGCGAGAGCCCAAGGAGGAGAACGTGACGCTCGGCCCCACGGTCCGCGAGGGCGAGTA
CGTCTTCGGCGTCGCGCACATCTTCGCGTCGTTCAACGACACCTTCATCCACGTGACGGATCTGTCCGGCAGGGAGACG
CTCGTCCGCATCACCGGTGGCATGAAGGTGAAAGCTGACCGTGATGAGTCATCCCCTTATGCTGCCATGCTTGCATCCC
AGGATGTTGCACAGAGATGCAAGGAGCTTGGAATTACTggtCTGCACATTAAGCTCCGTGCTACTGGTGGAAACAAGAC
AAAAACTCCTGGTCCTGGTGCTCAATCTgcgCTTAGAGCTCTTGCACGTTCTGGCATGAaGATTGGACGCATTGAGGAT
GTTACTCCAGTCCCAACTGacAGTACCCGCAGAAAGGGTggcAGAAGaGGAaGgaggctGTaaTTCCGTGTagtgccTG
ttATGGGGGGAaAGCAAAGCTATCTATccTTGTcctTgc > SEQ ID NO:2976 215966 186815_300667_1
CCGAACCCTAGCCTGCTTCTCCTCCTCCTCCCCGCCGCCGCCGCCGCGAGCACAGACGACGCAGCCATGTCCGGGAGGA
AGAAGACGCGAGAGCCCAAGGAGGAGAACGTGACGCTCGGCCCCACGGTCCGCGAGGGCGAGTACGTCTTCGGCGTCGC
GCACATCTTCGCGTCGTTCAACGACACCTTCATCCACGTGACGGATCTGTCCGGCAGGGAGACGCTCGTCCGCATCACC
GGTGGCATGAAGGTGAAAGCTGACCGTGATGAGTCATCCCCTTATGCTGCCATGCTTGCATCCCAGGATGTTGCACAGA
GATGCAAGGAGCTTGGAATTACTGCTCTGCACATTAAGCTCCGTGCTACTGGTGGAAACAAGACAAAAACTCCTGGTCC
TGGTGCTCAATCTGCGCTTAGAGCTCTTGCACGTTCTGGCATGAAGATTGGACGCATTGAGGATGTtACTCCAGTCCCA
ACTGACAGTACCCgtaGAAAgGGTggcagaagAgGAAGGAGGCTGtaattcCgT > SEQ ID NO:2977 215966 211055_300895_1
GACAAATTCCTCAAAATGCCTCCCAAGAAGGTCGCCGCTACCTAAGTGAGAACATCTCCCTGGTGCCCCTCTGCCCGCG
ATGGC > SEQ ID NO:2978 215966 21627_300070_1
AAAAGGGGGAACAACAAAAGAAACCCTAGCTTCCCTTTGTACCTCTCTCTGTTCCAAACCATGTCGAAGAGAAAGACCA
AAGAGCCAAAGGTTGAGAATGTGACTCTTGGACCAGCTGTTCGTGAAGGAGAGCAAGTCTTTGGAGTTGTTCACGTCTT
TGCTTCATTCAACGACACTTTCATTCACGTGACTGATTTGTCTGGACGGGAAACACTTGTTCGCATCACTGGTGGAATG
AAGGTGAAAGCCGACAGAGATGAGTCCTCACCTTATGCTGCTATGCTTGCGGCACAAGATGTTGCTCAGCGATGCAAGG
AACTTGGAATCACTGCCATACATGTGAAACTCCGTGCCACTGGTGGTAACAAGACCAAGACCCCTGGACCTGGTGCTCA
GTCTGCTCTAAGAGCCCTTGCCCGTTCTGGCATGAAAATTGGTCGCATTGAGGATGTGACTCCAATCCCAACCGACAGT
ACCCGCAGAAAGGGTGGAAGAAGAGGAAGGAGGCTCTGAGTTATTTGGCCTCTCGTTGGATCTCCTTATGTAGCTTTCT
CAATGTTTCATTTTGTTTTTTCTTAGTTTGAAAAGAGTTTTGGAATTACTATGTTTTGTTATAGTCTCAACTCTGAACA
GCTTCGGATCTTTTTCTGTATGACCATAAGATATTCAAAATTG

FIG. 2 continued

> SEQ ID NO:2979 215966 207733_300828_1
CAACAGCCCCGTGACGAATAACCAGACGTCGACAAATTCCTCAAAATGCCTCCCAAGAAGGTCGCCGCTCCTAAGGAGA
ACATCTCCCTGGGCCCCTCTGCCCGCGATGGCGAGCTCGTCTTCGGCGTTGCTCGTATCTTCGCCTCCTTCAACGACAC
CTTCGTCCACGTCACCGATCTGTCCGGCCGTGAAACCATCACCCGTGTCACCGGTGGAATGAAGGTCAAGGCTGACCGT
GACGAGTCCTCCCCCTACGCTGCCATGTTGGCTGCCCAGGACGTCGCCGCCCGCTGCAAGGAGCTCGGCATCAACGCTC
TGCACATCAAGATCCGTGCCACCGGTGGTAACGGCACCAAGACTCCTGGCCCCGGTGCCCAGTCTGCTCTCCGTGCCCT
GGCCCGTGCTGGCATGAAGATTGGCCGCATTGAGGACGTTACTCCTACCCCCTCCGACTCTACCCGCAGAAAGGGTGGT
CGCCGTGGTCGTCGTCTGTAATTGCTGTATTTTTTTTTATACAAACAAAAAAAGTACGGCATCTGCATGCTTGGCGAAC
CTTTGGTTTGGGATCAAGGCAGGAGTTTCGCTATCTGGTTCTTTTATGTGGCGTTGAGAAAAAACGAGGAGAACGGCCC
TTAAAGCCTGGTCTCCAATTCTACCACGCTCTGCTCAGgttCCTTTGTCCTTTTTACTACAAAGAAGGATATA > SEQ ID NO:2980 215966 41956_300032_1
aattcAACCTTCCTCTGTATTCAACACCAGCAGAAGTCTCATCAGCAACAACACCATGTCAAAGAGGAGGACTAGGGAG
CCAAAGGAAGAGACTGTCACCCTTGGACCTGCTACGAGAGAGGGAGAGCTTGTTTTTGGTGTTGCCCACATTTTTGCAT
CATTCAATGACACTTTCATTCATGTGACTGATTTGTCTGGAAGGGAAACAATGGTTCGTATTACTGGTGGTATGAAGGT
CAAAGCCGATAGGGATGAATCTTCCCCATATGCTGCTATGCTTGCTGCACAAGATGTTTCTCAGCGATGCAAGGAGCTT
GGCATTAATGCACTTCACATTAAGCTTCGAGCTA > SEQ ID NO:2981 215973 220896_300939_1
TCCCATCCCATCTTCCAAACCACATCATCAATCTCTAAGCGTTGCCCATTATGAAGAGCGCTTTGATCGCCGCCGCGGC
GCTTGTTGGCTCCGCCCAAGCTGGCGTCCACAAGATGAAGCTGCAGAAGGTCTCCCTCGAGCAGCAGCTGGAGGGTTCA
ACCATCGAGTCCCAGGTCCAGCAGCTCGGCCAGAAGTACATGGGCATCCGCCCTACTAGCCGTGCCGATGTCATGTTCA
ATGACAAGGTGCCCAAGGTCCAGGGCGGTCACCCAGTGCCCGTCACCAACTTCATGAACGCCCAATACTTCTCCGAGAT
TACCATCGGTACTCCCCCTCAGACCTTCAAGGTTGTCCTTGACACTGGAAGCTCCAACCTTTGGGTTCCCTCCCAGTCG
TGCAACAGCATTGCCTGCTTCCTGCATTCCACGTACGATTCGTCCTCCTCGAAGACGTACAAGCAGAATGGATCCGACT
TCGAGATCCACTACGGATCAGGCAGCTTGACTGGCTTCATCTCCAATGATGTCGTCACCATTGGTGACCTCAAGATCGA
GAAGCAGGACTTTGCCGAGGCTACCAGCGAGCCCGGCCTTGCCTTTGCTTTCGGTCGCTTCGAcg > SEQ ID NO:2982 215980 205540_300799_1
GCGATTGTCTTTAGCCGAGAGGCGTTTGGCGATCTTGACATCATAGGAGCTGCTCTTCGTTGCGGCACCAGAACTTGCG
CGCATCTTTGAACAGAATACTTCGTGGAGCAATTGCTACCCCATGGCTCGGGAGCATCGTGTCAGATACATTAATCACT
CATAGCTGCAAGTACTCTTTGCGCCGGGGGCAGTGCTAGGCCCATGAGCCGCGCAATGTCATCGGTCTTATGCCGGCAT
TCAATCGGAATACGACTCTGGATCCGTCGTGCCGGTCTCGATATCGAAGCTCGGGGCAACACCAACAAGATGTAACGTA
AAATAACAAGACG > SEQ ID NO:2983 215981 217922_300913_1
ATTGTGCTCGTATCTCAGAGCTGACAAGCCTATCGACTTGCGGGCTGGGGGATCAAATCACGCCCTGACCTTGTGAGCG
GGCGACTTTTCAGCTTGTTCCCCCCCAAGGGAGTCGGCGCTTGCTGCATGGCAAGTCATGTCTTACGTCTCGCCATTGC
AGCCGCCGGCCCTGATGAAACCAGGGAATCGCCAGCCAGCCTAGCTTCAGATGGGGTTTGAAGTTCAGTCAACTGAACT
ACGTGGGCGGTTAAAAGGGCCTCGGGGATTGCTCGCAGCAAGGCCAGAGAGCGATGAGATGGGATGGAGAGAGAGAGAG
AGGGCTGCCGACTACCGGTGCACTGCATGTTATCTGCCGTAACATATACATGTACCTACTTAGTTAAGATGTATCACGC
ACGCGACC > SEQ ID NO:2984 215982 205596_300799_1
GCCGAGCCTCGCGCAGAACCCAAACCAAACCCGCACAGCAACAACACACACTCCACCTCGAGCTTCTGGTCTTTTAATC
ATAATCGTTACACTCCAAGGCTGCATTTCTTTGCTGAATACTCTATTCAACCAGACTCAACTCAACTCGACTCACCAGG
CTTCCATCTCCTCGCTACTCAAAAAGGCTCAGCCTTACCTATTTCTCCTCCTCCAACCTCATGGCATAAACGACACACN
CTCTCTCTCTCCNGATTGGTGATGGCAACAGGCGACAACGCCGCCTCCGAGCTACGAGGCCGTGTCCGCCGCTCCTCCT
CACCCTCCTCATCCTTCACATCCTCCTCACCCTCCTCCGCCTCCCATCTCCGTCGCGACGCCGGGCCTGTCTAAGCGCC
GTCCCGCCTCGTCTCCCTCGTCCCCGACTTCGTCCAGATCATCGTCGTCCAACCCCTGGTCATCGCCCACCAAGTCTTG
GTCATCGTCGTCATGTCCGCCTCCGCCCGCGCCTGTCCTGCGACGTAACGTCTCGTCTTCTAGCCTCTCGTCCCGGACG
GCCTTCGGAACTGACGCCTCTGACC

FIG. 2 continued

> SEQ ID NO:2985 215984 205825_300802_1
CGAAGATGAAGAATACGAATCCTCCCAGGATTCCGACTTCGCGCCGGACGATGCGCCCGAAGCAGCGTCTGGCTCCTCA
GATTCTGAAGA

> SEQ ID NO:2986 215995 205803_300802_1
GAGCCATTCCTGCGCAATCCTGTAGCTGCCCTCACGCACATCCCCCGGCACGGTGTGGCCCGCGCCGTCCACGGCCACA
AACGCCAGCCGGCCGGAGCTCTTCCACGACCCCGTCGCCGCCATGCTCTCCGGCAGCTCCCGCCACGGCGCGAGGCGAT
AGTCGGCCAGCCCGCTCCAGCGCAGGTTCTCGTACGCCCAGATGTTGCCCGGCGTGTTGACGATGTAGTCCTCGTTGCC
CTGCAGGACCAGCACGCGGATGTCGCCCAGGTTGGGGGTTCGGTAGGCGTCGAGGATGCGGGCGACCTCGCGGGTGGTG
GTCCGGAAGGGATCTTTGGAGTGGACGAAGGCGGAGTTGAGGACCATGTCGATGTCTTCGAATATATAATATGGGGAA
GCTTCAGGGCTTTCTTGATGTGGGCTTGGTTGATGTAGGCTGACATGTTGCCTTTCCTGATGTCTGCGCAGAAGGGCCA
GTTGGGACATGGAATATGGACTGTTTTGCAAATATTAGACAACTACGTTCAGACATTCAGGAGAAAAAAAAA

> SEQ ID NO:2987 216004 219747_300948_1
gccggttttgagggatgaggggagacatggacaaggtgttgttggctctatcattacgggatgtttaggtgtagaatct
gTATTCGGTTTCGATGGATGATAGAAAAGCTCCGTTAGATACACAGTGCGTGGGTCGAGCTGAGCAGACCGAGAGACAC
ATCGTATCCGGGAGGAACACTGCAGCTGCGCAGCTCCACTGCACTATTTCGGATGCCGTGGTTGCATTTTGTGTCGCTC
CGCCGTGGTTTTCGTCAGAGATCGGCCTGGCCTTGGTCTGGCCGAGGATCAAAGTTCTAGATGGGCCTTGTCTGGTTCC
AGAGGGGTATAAAGAGTCGAGCTGAGAAGCATCTAGACTTCAGTTTGAGCTCTCATCAAACAGAAGCAGTTAACTACTT
ATACAGCTACTATATAAGCTTTCCAACCAACCCCTCACCTGTCGCCTCAACCTCATACGACTCATCATCCTATTCCTCC
TTCAACAATTTCAATTCATTTCACAACTCTCAGTCAAGATGCAACTCTTCGCCGTCTTTGCCGCTGCCACTACACTTAT
TGCCGGCTCCAACGCCCTCTTCATCCCCCGCAACATCCACGTCGCAGACTTCCGCCTCTACAGCGCCGAGGGCTGCCAC
GACGGCAACCTCGGcgtctGGACCGTCATTGATGACGACTTCAAGAATGGCGAATGCAagGGCCTCAacgATAGTGAGC
CCAAGTCTCTGAGcctgacagaCATTAACAagggcTGCACATTCAcGgcttACACCgacgacaagtgcaCcaagggcaa
gaaggATTTCACaaaGGGACATTGCTtCgacaacaaggCCGGctggaaaGCCTggaGCATgaaGTGCGActacaaggac
tacaaggGTCCtccctACCTTCt > SEQ ID NO:2988 216005 206019_300804_1
ACTCACAATATTGGTTTAGCATTTCAAAACCGGCATCATGGCGGACGCAGATTTCAATCCTGACTCTGTCAACCTCACA
GCTATTGTTGATCAAGATGGAGACATCAGAGACATCATCTGCTTTCTCAATGCTGGCGACAACGACTACAATGGACAGC
TTGGTGCACGTGTTTCGGCTCTATTCGTCATCCTTGTCATTTCATCGGCAGCCACCCTGTTCCCCGTCCTGGCCACTCG
TGTCCGGCGTCTACGAATCCCGCTCTATGTCTATCTCTTTGCCCGATACTTTGGCTCCGGAGTCATCATTGCTACTGCC
TTCATCCATCTCCTCGAACCTGCCTATGAGGAGATTGGACCGGCTAGCTGCGTCGGCTTGACTAGTGGCTGGGCTGAAT
ACACATGGCCCCCTGCACTGGCTCTGACTTCGGCCATGCTCATCTTCCTGCTGGATTTCTTGGCCGAGTACTACGTCGA
GAGGAAGTACAAGCTGGCACATGTCGAAGTCGAAGGCACAATTACATCGGATCCTACTGTCCCTCATACTC > SEQ ID NO:2989 216006 195907_300639_1
cccacgcgtccgAACCACTCTCAAGCAACAATAACAACCTTTACCCAACTTCAAAGACTTTCAGTCTCTCAACTCAACA
CCTTCAAGATGTCTCCCTGGTGAGTCTTCTGAGGACCATTGGTCCATCACTTGCTCGGGAGTTCCTCTTTGCTTTACCT
TCAGCGTTCCACTACCTGATCTATGATACCTTCTTTCCCACCACCGAGCAAAGCACTCATTAGACATGTCACTAACGAT
TTTCTTTCAATAGCGCATGCAACTCCTGTGGATGCAAGGACAACTGCTCCAGCTGCTCCTGCACCAGCTGCAGCCACTA
AATCATCGTGCTCTTTTTCCTTCGCTGGATCTATACTCTCTCGGAATGACAGCTTGAGGGCTCGGATGTGCTTAAGACG
CCATGGGAAGGGCAAGGCATTTGGGCGAATAGACCTCCATCATGTGGGATATAGCAGAATAGGAATTTGAAGATTTTGC
CCTAACAC > SEQ ID NO:2990 216006 215159_300878_1
GTTTTCCAAGGATTTACTCCAGCTTGCAGGGGCCAAGATGTCACTGCATGGGGGTTTCGTTAATGAAGCTGTTCAGGGC
ATGATATGGTGCATGAGGATGCACGAGTGGATACTAACATATGACAGTTGATGCTCTTTTTATAGAGCATCCGTTTGGA
TATAAAAGCATCGAGTGTCGCCAACATTTTGATCTTGTTCCATCCATCAATCGCATCAACCACTCTCAAGCAACAATAA
CAACCTTTACCCAACTTCAAAGACTTTCAGTCTCTCAACTCAACACCTTCAAGATGTCTCCCTGCGCATGCAACTCCTG
TGGATGCAAGGACAACTGCTCCAGCTGCTCCTGCACCAGCTGCAGCCACTAAATCATCGTGCTCTTTTTCCTTCGCTGG
ATCTATACTCTCTCGGAATGACAGCTTGAGGGCTCGGATGTGCTTAAGACGCCATGGGAAGGGCAAGGCATTTGGGCGA
ATAGACCTCCATCATGTGGGATATAGCAGAATAGGAATTTGAAGATTTTGCCCTAACACACATATAATTTGCTTGTGAG
AAAAAAAAAAaacaa

FIG. 2 continued

> SEQ ID NO:2991 216006 221291_300969_1
GGCCAAgaTGTCACTGCATGGGGGTTTCGTTAATGAAGCTGTTCAGGGCATGATATGGTGCATGAGGATGCACGAGTGG
ATACTAACATATGACAGTTGATGCTCTTTTTATAgaGCATCCGTTTGGATATAAAAGCATCGAGTGTCGCCAACATTTT
GATCTTGTTCCATCCATCAATCGCATCAACCACTCTCAAGCAACAATAACAACCTTTACCCAACTTCAAAGACTTTCAG
TCTCTCAACTCAACACCTTCAAGATGTCTCCCTGGTGAGTCTTCTGAGGACCATTGGTCCATCACTTGCTCGGGAGTTC
CTCTTTGCTTTACCTTCAGCGTTCCACTACCTGATCTATGATACCTTCTTTCCCACCACCGAGCAAAGCACTCATTAGA
CATGTCACTAACGATTTTCTTTCAATAGCGCATGCAACTCCTGTGGATGCAAGGACAACTGCTCCAGCTGCTCCTGCAC
CAGCTGCAGCGTAAGTCCTGCTTCTCTCCCCTGCTTTGGGCATTGAGAAACTTTTCCACCAGAAAGCTAACAGATGGGA
ACATATAGCACTAAATCATCGTGCTCTTTTTCCTTCGCTGGATCTATACTCTCTCGGAATGACAGCTTGAGGGCTCGGA
TGTGCTTAAGACGCCATGGGAAGGGCAAGGCATTTGGGCGAATAGACCTCCATCATGTGGGATATAGCAGAATAGGAAT
TTGAAGATTTTGCCCTAACACACATATAATTTGCTTGTGAAg

> SEQ ID NO:2992 216008 205884_300802_1
agcacggAGCACCACCATGGCTTCAAGGTTGAAGATCTGGGGTGCCTGCAGGACTCTGGCGGTCCGGACGCAGCCCGTC
CGCCTTGCGGCTCAGCCATTCCGAAACCAGGTTTCAGCGACTCGATTCTATGCCGACGATGCGACCAACAAACCCTCCA
ATTCTCCGAGCGGTGCAAAGAGAGAAGCTTCTAGATCAGTTTCTAAATCAGAACCAACAAGTTCCAgggtTACTGAGGG
CACCTCTGGAGAATTGACCCAGAAAGCCGCACAAGAGACATCTTCATCACAAGCCTCACCCATTGAAGCGCTAGACGAT
GCGACCTTgGAACAAATACTATATGGCGGTCGACCCGTAACAAGTCAGCGGGAGGGCGGCTTGACAGAGGCGCAAGAGG
AGGCTCTATATCGCGAGGGTGTCATTCCCcaacagaGCAGGCggaagCTATCGTTGctgccgGGtcaCcagTCAatag
tcCCTGTTGGCTCAGAAGTGCAAAacgccggccaTAAgtttggtCTTCCTCAGAagccctatcCGGAcgg > SEQ ID NO:2993 216009 199477_300749_1
gAACCCTTCACGTCGTCGTCATAGCTGTGGATGGGCACTCACCCCTCCAACCCCTCCAAAGATCTCACCACCGGCCGAA
CCCTCCTCGATCTCTGCGCCGAGAATCAGCTCCTCCTCTCCGAATCCGTCGCTTCCAAATATGGCTCCAAGCTGCCCTT
CCTCTTCAAGGTCCTGTCCATCAACAAGGCCCTCTCCATCCAGGCCCATCCCAACAAGAAGCTCGCCGAGCAGCTCCAC
GCGCGGGACTCCAAAAACTACCCCGATGACAACCACAAGCCCGAGATGGCCATTGCAATCACCCCCTTTGAGGGACTCT
GCGGATTCAGGCCTCTGGGAGAGATTGCCCACTTCCTGGAGACGGTAAAGCCATTGAGAACTCTGGTCGGAGAGAGCGA
GGCGTCGCAGTTTGTGCAGGCTGCCAAGCAAGAGGGCGGTGACGAGGCGGCAAAGAAGAAGGCCCTGCAGACGGCATTC
GGAGGATTGATGTCGTCCTCTGCCGAAGACGTTGACAGAGAAACTGCTAGCCTCGTTGCACTCGCCGAGTCTGAGGGCG
CCGACTTCGCTGCCGGTGGTGTGTCATCCACCAAGGGCGCTGTCCTCGCCGAGCTTGTCACTCGACTCAACGGCcagtg
tggctCCGACATTGGCATTttCGTCCTCTTCTTC > SEQ ID NO:2994 216009 223778_300975_1
gcaacaacacACAACATGCTTATCCAACTCCAATGCGGAGCACAAACATACGACTGGGGCAAGCTCGGATCCAGCT
CGGCCGTGGCGCGGTTTGCCGCCAAGTCGGACCCTTCTCTCACCATTTCGGAGGAGACGCCGTACGCGGAGCTGTGGAT
GGGCACCCATCCTTCGGTGCCGTCCAAGGTGCTGGGCGACACAAACAGCACGACTCTGCGTCAGTTGATTTCTGCGTCA
CCCGACAAGCTGCTGACTCCCGCCGTGGAGCACAAGTTTGGCCCCGAGCTGCCGTTTCTGTTCAAGGTGCTGTCGATCC
GAAAAGCCCTGAGTATCCAGGCCCATCCCGACAAGGAGCTCGGAGCCCAGCTGCACGCGTCCGACCCCGCCCACTATCC
CGACGCCAACCACAAGCCCGAAATGGCTATTGCTCTTACCGACTTTGAGGGTTTCTGTGGCTTCCGACCTCTGTCTGAG
ATTGAGCACTTTCTCGAGACCGTGCCCGAGTTCCGGGAGCTTGTGGGCGACGAGTCTGCGAAGCAGTTTGCTTCCGAGC
GATCTGCCGACCCCAAGAAGGCTCTCCAGGCTCTGTTTGGCCGTCTGATGCGGTCTTcagacgaactcGTGgccTCCAa
ggccgCTGATCTCGTCAAGCGAGCCGagtctgAgggccccaagttcGCag > SEQ ID NO:2995 216010 195466_300634_1
cagccacacatgtagcaaagcgcacaattcgcatcataagtcatctcaatagcttttcttcttcttctcctcctcctc
tCTCTCCCTTGttCTCGTACTCCGCATGTCATCGCCATGATTGTGGATATTTGGGGTAGTCGATAAGTTCGAGATGGGG
CCTGCCGTCCCGATTTCTTCCAATGCaGGTACTTTTGAGCCGgcCCGGCGCGGGAACTGAACTCCTATAAGAGTGACCA
CATGGACGTGTGCACGGGGTGCGGGAATGGATACACCGCTTATTCAGACCATTACTCGCATTTGCGTCCAGAGATTGGA
GTTTGATAATTTTTACAAACTTGTACATAATACTGATGCATTCAGCCCTTGGTCCTGATGGCATGAGCAGACATAGCCT
CGGCCGACGATTTTGCCCCTGCAATGGTTCTCTGCCGATGTTTCCCGCAGCTTCTTGGCAGTTGGGGTAATACGATAAT
ACGACGATGGCATCTTTGGCCTGCACGCCGAATTGGGGTCAAATAGACGGTATTCCGAACATTTCATATTTAAGAAGCT
GTGCTGCACGCCAACCAACCTTTGGAATGGTGTGAATTGTGAAGGACATGATGCATGGTATAGGCCATGAGCTAGTCTC
AGAGAGATGGAGCCTCCGGTGTAAAAGTTGTACATTAATACGATCAAAGCCCGCTACGAAAAAAGAATGGCAATTGTAT
TACCCACGAAAAAaaaacacaaa > SEQ ID NO:2996 216013 206076_300804_1
acacgcgtcgtgcatgtcttggacctgctctcatcatctcatctccctcttgtttgaagaagagagatcttgtctcttc
cCACCTCTCACAGTTTGAAGCTGTGCATTGTTCAACAGCAACAAAAACATCATGTCAGACGACGGCCACGAAAAGGCGA
AACTCGAGTCTCACATAGACTTTGTTTCCACCGCGCCAGACTCACAAGATGTCAACGCCTTCATCGATGACATGGAGGG

FIG. 2 continued

```
CCAGCTCGAGGCTTCTGGAGGTCTCAAGACGGGCTTCTTCCATGTGCAGTTCAGCGACCCGCGGCACTTTACATGGCTG
CTCGTCGCCTTTGCCAGCATGGGCGGCCTGCTGTCTGGCCTGGACCAGAGCTTTGATCTCTGGCGCCAATCTGTTCTTGC
CCAAGGACTTGGACTTGACGGAGAGGCAGAACAGTTTGGTGAATTCGGGTATGCCGTTGGGTGCTGTGGGAGGCGCCTT
GTTGCTGTCGCCTGCGAATGAGTACTGTGGACGCAAGTGGGCGATTATCATCTCCATCCTGCTGTATACTGTTGGTGCT
GCGCTGGAAGCTGGCTCCATCAGCTTTGGTATGAtTgttTCTGGTCGTGTCATTCTGGGTCTTGGTGTcggccTCgagg
GcggcaCTgtccCCgtcTATGTCGCCGagaCTgtcGagcgcCGTAtccGAGgcaaccTCGTCTCGCTCTAccagtt > SEQ ID NO:2997 216018 208023_300831_1
TTGTCGCCAATAACCCACACAACGCGGCAAGATGCGTACCTACGAAGACAGCTTCTCCGGTCAGAGGATCTACCCTGGA
AAGGGTAAGATCTATGTCCGTGGCGACAGCAAGGTGTTCCGATTCGTCAACGGCAAGTCGGAGTCACTGTTCCTGCAGC
GAAAGAACCCCCGTCGCATTGCCTGGACGGTTCTGTACCGACGACAGCACCGCAAGGGTATCTCTGAGGAGGTTGCCAA
GAAGCGCACTCGCCGTGCCGTCAAGGCCCAGCGTGCCATCGTTGGTGCTTCCCTCGATGTCATCAAGGAGCGCCGATCC
ATGCGCCCCGAGGCCCGATCTGCCGCTCGCGCCGAGGCCATCCGACAGGACAAGGAGAAGAAGGCTGCTGCTCAGGCCG
TCAAGAAGGCTGAGAAGGCTAAGAACGCCGCCATCGCCGCCAAGGGCCAGGCCAAGGCAAATGTCAGCAAGCAGGGCGC
AAAGGGCGCACAGGTCAAGGTCGCCGCCCGAACCCGCTAAAAATATGAATAGACGGGATTGAGGGGAGCGAGGGGAGAA
AGATGTTGTGTGCAGTGCAGCGCAGCGGATGAGCAAAATGAAACAAAGTATGGAGTCTGTGGTTCTTGTCTCTTTCCgg
ccggttCTTCTACAATATCGgGTGTGCATGGAATGCCataggggtgCAttggTAGTtGagcaagTGACATACcggtgcaa
t > SEQ ID NO:2998 216020 205815_300802_1
GAAAAAAAAAAGTTGCGCCAGACGGGATGAAAGGCGAGACAAGGGGCTGGCTTGGGCTTTGGGCATGCACTGGGACTTT
GGGCTGAAGGTTGACCGAACCGAGTTGCTCAAACTGCGACATCGGTGCTGTATCAGGCTGCTATCTATGTATCCTCGTA
CAAGGCAAATGCACACACGGCTGATCTGAGATTACGGGGGGAAGAAACGCACTCAGTGGCCAATATGGTGGTTCGCAC
ACCCAGCGTTTGCTCTCCTATGTCGTTTGTATGGCGGGTATGCTCATGCTTGGGCTGAGGTGATGCGCGTCTGATTCCG
GCTAGCATACCGAACCCACTAGGTAGCGAGTTGATAGTATCGCCATTATATTGGATGTTGGATCGATATGTCCCGTTGT
ATCGGGCCAAGGTGCATTGCTCTATTGGCGGGCTAgcAGCTGACCACGAGACTTTTGTTGCCAGATGACTTGACAGGCT
AAGAACCAACAGACAACAACAATAGCGGGAGGGGGGATTCATTCAGCTGGTCAATATTTCACTATAGAGAGAGGGGTTG
ATTTCAATTCAATTCAATTACAGGAGGGGTATTCGTGGGACCACCTCGGCAGATACCAGTAGAGGCAAAGGGAATCCCG
CAACTCAACTCAAAACCCGAAGCCTCTCCGCTCCCTTATCTAGGGCGGCGAATTCTGACGTTGCTGATCCGATATCCGT
CGCGCGGCACGGCAGTCagggacgGGATGCGGCAAAGATTTGGCAATTCGTCTGGGTTGCTGTTGCAGCCTTCTTCACT
AGAAATGGAATCTCGCGGATCAAAAGGGAAGTGTGGGAAGCTCTCGCGCGGTACTTGGTGCGAGTTGGAGCGAAAGCGA
AGGGAGCCGCGGAAAGGGTTCGGGGCCGTGATTCCGGGGCAAGCGGCCAGATACCGACCTGGGTcCgagTTCGCCGGGT
CGTAGATCACGAGgCTGGTCCTTAGACTCAAAATCCcAAggggttTGGTTATGGTGTGaaacaaacaaacaaacac > SEQ ID NO:2999 216036 206402_300822_1
ACGCGCATCATTATGCCGGCATGGGCCCGGGGTCTGACCCTCACCATTTCCGAGACCAGAGCGTGCCGCATTTCGACAA
GGCGGGCCATACGCGGACGCACGAGCGGGAGGATCACCGGCGGTGGCAGCGGCAGAGAAGGGCTGTGGGGGATGATGGC
ATAGAGTTTTGAGCCGCAGACGAGCCTGGCCTGGCACTTTTTGATTGTGGCGGGGATATTGGCGGCGACGCTGTTTGTGC
CGGCGGTGTATTTGCAGTTTATGCGCCTGGGCGAGGCAGAAGAAGGAGAAGGAGTCGTGAGGCGGGTATGGCGTCTGGAG
TGTGATAGGGAAGGCTGTACAAAGAATAGAGCAGACTTATATAGAAATAGGCAATGGGGGGGCATGAGCGAACAATGCC
GATTTTAACGTTACG > SEQ ID NO:3000 216040 206403_300822_1
GGAATGACCCCTACCAGGATGTCGAATTACACAACTTGAACGAGGGGACGAGCCAAGGGGCACAGCACGGGAATTGATT
CGAGAGTTTTTAAATGATACCCATCTCCCAGCGAGGAGATTGCACTTAGAAAACGTGGCGGAGGCCCTCGAAGGAGAAA
ATGGTCTTTGTTTTGTTCTTCATCTTCTGCCTTGTCGAAGGGTCATGTATATGTCAGGAATAGCTGTGCACTAATATTT
AAACATAAGTTCCGTCT > SEQ ID NO:3001 216042 206435_300822_1
ggccctcggcgtacgagtagCAAAAAGCGTTCGGTCCATCTGGGTCCGGTTGGTAGGATTGGAACGAGAAAGAGGGGAA
TGGGATTCGAGAACGTGGAACTTGCTTGTGCCCTGGCAGTCTTCGGGTAATTGGCCGCGGAGATTAACATGGCGAGAGG
AAGCAAGACGTCAGAACGGATCGAAAAAAAGAAGAAGATAAATCC > SEQ ID NO:3002 216049 217596_300909_1
ggGATGAGGAGGGGGGTGTTTGTGTTGCGATAGGTAACTTAGTACGAGTAGATTCAAGATGGAGGGGGGGAATGAATC
TTGCTTGCTTGACTGCAGTCTGTAGTGTAATCAGGCAAATAAGGCAAATGAATACCTGTCAAGTCGACTCTCGGTATCG
AGTTCCGCATGTACTAAGCAGAAACATGCGTCATACTACGAATAAATATCCCTGGATGGGCGATTATTACTCCAATACG
CAtATTGATACCAACC
```

FIG. 2 continued

> SEQ ID NO:3003 216050 206377_300821_1
GCACCTTGTTGATACAGTACAGAAATGCTGCCAGTCGTACGAGAGCCATGGGTGCTCCGTCGAGCGCCTCTAGCTTGAC
GCCAGAAGGATCGAGGCTGATTGACGATGGAGCCCTGGCCCGCTTTTGGTCCTGTGCGCGACAGATGCTGGGATGAGGA
GAATCGTGATGACGAATATGTATTGATATCATATCGTGAGAGAGACATGGTTGGGGCTTACTGGTCTCTGTACGAGTAC
GATGCTGTACGTTCGTGTTGAATTATCTTGTACTGTATCGTGTTTTGTCGATCTGGGTGGTCAGTCT

> SEQ ID NO:3004 216053 206194_300819_1
GGCATGATGATTGTTGAACAGGTACGGAGGTTGGGAGACAGGAGACTAACACACCTTATTGTGCAAACTGTACAGCACA
GCAGAAAGTGGTTACATCGCCAGAATAAGCTTGTGATTATGGCCTCACCTTTTCCACAGCCCGCAGGTGACAGGCCACA
TGCAATCTTGGCATACTGTTCCTCTCTCTACAACAGCTGAACTCAGCCCAGTCGCCAAGGTTTCCTTCACGCTGGCT
TTCACTCTTATCATGGAGCATTGACGAGAGCCGGCACCAACGAGCATACCAAGGTGAAAAAAAGTTCTCCACAACACTC
CGTCCAATGTCCACCTTACATCCTACAGTACGCAAGGGCCCCGTAAGGCTATTCAGCTTCAAGCACAATCAAGCCATCC
AGGCAAGCCGACAAAAGCCGTCGGCCGAATCTCTCCTCGTATCGTCCTAAAAAGGGCGCGCGTGAGCCGCTTTGACCAC
AAGCCTTCACGTATCAAACTTGCGCATGGTGTACGAGGGAGAAGAAAAAAAAACGGTCCTCAGCCACTGAG

> SEQ ID NO:3005 216055 213940_300862_1
GAATGAACGTCTTTCTTGTGCTGGCGGCAAGTAATACTGTAGCAGGTACCTCGTGGAGCTCCATCGGGATGGGGCCGGT
TGGGAGTCGGTTGGGCACAAACAAGGTTTCTAACTGGATCTATTTCTTTCCATGTGTCTTTTAATCATTTTGAATTTTA
TTTTCCCCGGAGGCCGTGACACGTTTTTGACAGATGGGAGGAAGAGGCGGAGGCAGAGAGCAAAAAAACGCTCACACGT
GTCAGTCCGTAGCGGTGCCTTTTTTCTAACTGTCCGTATCTGGTCAGAGGCGGCGGCAGTAAATAAGTGTTGCCCGAAT
CAATAGTAGAAGAGGCGCCCGCTGTGGTGTATCGATTTGGTCAATGGAACTTGTCAATTGTCTACAGTAGTAGTAGCAC
TATCATCATTTGTTTCCGATTGTGTCATTGATTTTTAAATTCTGATGAACC

> SEQ ID NO:3006 216057 214632_300863_1
GATTCAATATCTTTCTCTCGACGTGGTTCGATTTCGATTCGACGTATCGGTGGGGGGGCATGAATAAGGTAATGGTTGT
GTTTAGTTGGGCTCGAAACTAATGTTACCCATCAGTAGTATCACCTATTGCTGACGTCGGCTTGAGGAAGTGGGTTCAA
TCGTGATACATTCGGCTCGTACAGTGCAATACAGATAAGATGATGCGATCAGAGAGGCAATTGTTAGGTCATGATTGAC
GGAGGATTCGAGCCGATGATGACAAGGCGACAAGAGCTGGGCAATCGACCCCAATTGGATGATTCTGGCACCCCAAGCT
GTGAATTCGGCTTGACCTTTGAACATCAACTTGCTGTAGGGTAGTGCAACCTTGGACGTAAAGAGAAGGCAGCGTCAGC
ATTTGTTAGCGCACAGTACCTACCTGTATGTATGTATGTCCGTCCATACAACTTTGATGAGACCGAGAcCGAGATAAAA
AGTGagCGgcgTCAGTGCCCAACTTGGTATAAAGGCtTgaagAac > SEQ ID NO:3007 216062 206581_300823_1
TCATATAGAGCATTTATCAATGCGAATAACAGACCCTGAGACACTGAATCAGAGAAGCTTTAGAAGCTCTTCTTCTCTC
TGTCTCCGCGCCTCTTATCGCTTACAGCCCCTCTACTGCTGCTGCTGCCTTTGTCAGGCCTGTCTTTTCAGTGTCGCAT
GCCCCGTCTTATCTTTCTACCTTGCACAACTCAGCCTTTGCGCTAATCAACGACATCTGCGATCTGTGTCGGCAGCAGA
AGAGTCCCAGATCACTGTCTCTCTTTTATTCTCCTTCTTCTAAACAGATCTGTGTTGCCCCCAAAGCAAGCGAGAATAC
GTCAAGATGGCTCTTCCGAAACGCATCATCAAAGAAACCGAACGCCTTATGGCGGAACCAGTTCCCGGAATCAGCGCCG
TGCCTCACGAAGATAACCTGCGATACTTTGACGTCGAGATCCACGGCCCTGCATCGTCACCATACGAAGGCGGCATTTT
CAAGCTTGAGCTCTTCCTCCCAGATGACTATCCCATGACTCCGCCCAAAGATTCGATTCCTTACTAAGATTTTCCACCC
AAACGTTGACAAGCTGGG > SEQ ID NO:3008 216068 218468_300966_1
AAGGCTGAAGCGTTCTTTTTCATTTCGAGGCTCTTTAGAAGTCAATTCGGCTCTGCGCAACACCAAGTAGCCATGTCGA
CAACCACCACCACAACAACGGCGCAGCCGATCACGGCTGAGACCATCCTTCGTCTCTTCCCCGACATCGATACCACCAG
CGAAGCGCTCTCAGGCCACGATGAGGAGCAGATCCGTCTGATGGACGAAGTCTGCATCGTAACGGACGAGAACGATGCG
CCAATTGGCACCGCAAGCAAGAAGATTTGCCACCTGATGACCAACATCGACAAGGGACTCTTGCACCGCGCCTTTTCCG
TCTTCCTCTTCAACGACAAGAACGAGCTCCTCCTCCAGCAGCGCGCCACTGAAAAGATTACCTTCCCAGACATGTGGAC
CAACACTTGCTGCTCCCACCCTCTGAGCATCCCTACCGAGACGGGCGCCAACCTGGTCGACTCTATCGCTGGAGCCAAG
CGTGCGGCTCAGCGCAAGCTGGATCACGAGCTTGGCATCAAGAAGGAGCAGGTCCCATTCGAAAACTTCCGCTTCTTGA
CCCGAATCCATTACAAGGCTCCCAGCGACGGCAAATGGGGCGAGCACGAGATTGACTATATCCTCTTCATCAAGGCCAA
CGTCGATCTCAACCCCAACGAGAACGAGGTGcaggccACCCAATATGTCACCGCCGATGG > SEQ ID NO:3009 216072 205692_300800_1
ACGCGTCGAAAAGCCCACAACATGGCGACAATGTCAAATCAGTCGCTGAGGGCGGCTGTTCGGTCGG

FIG. 2 continued

> SEQ ID NO:3010 216072 215508_300882_1
acatggcgacaatgtcaaatcagtcggtgggggcggctgttcggtcggttggacgattAAATGgacGgacGggtaggtc
TTCGGGCCTTACATCgaggcaATtCAGCACCTcgccagCTCATGgtaCgcagttGgaacaaCGggtTTgagcCTCGCAT
CATGAgATTCTAACTGgaaggacAAAACaggcgTCAGGGctgtcTTCGCcgagacgGAcAAcaCCGAAATgaacAagatC
CTCAacaCcatCCAAGaaaacaTCATCCTCCCCGGctagctCCCCGAAAAGCAgcgCAGggtCGTCTTTgacCCCaaga
tgaggtCCTACCTCgagCaaaaccCCATcatCATCGag > SEQ ID NO:3011 216072 206727_300825_1
aaaaagcccaccaacatggcgacaatgtcaaatcagtcgctgaGGGCGGCTGTTCGGTCGGTTGGACGATTAAATGGAC
GGACGGCTAGGTCTTCGGGCCTTACATCGAGGCAATTCAGCACCTcgccaGCTCATGGCGTCagggctgTCTTCGCCGA
GACGGACAACACCGAAATGAACAAGATCCTcacacacctattccccaagAAAACATCATCCTCCCCGCCTACCTCCCG
AAAAGCAGCGCAGGCTCGTCTTTGACCCCAAGATGAAGTCCTACCTCGAGCAAAACCCCATCATCATCGAGGTCGAGGG
CCTCGAACACAAATTCTCCTCCATCGACCACTTCACCGGTATCGAAAACTCAAAGACGATCCTCTCCGAGGCCCTCAGC
AGCATGAAGAGCCAGGACGACTGGGCCAACCTGGGAACCCTCCTGGCGGGGTACAagAAGGCGGGGATACGGCTCAAgg
caaACCACTGGGGGAAGATTGTGCGCATGGCAGGCAAGAGCGGCAACATTCACGCCGTCATTGAGTGCGCGAAGCAGTC
TGACAAGACGGGCCTCCTGTTCACCAACCGAGAGACGGTGGTACGGGTGCTCTCTTACAtcaatgAaaaggtcagcGGC
AGCaAtTGGGACG > SEQ ID NO:3012 216074 210768_300892_1
cgactcacctCCCTTTGCTCCCGCGCGGCCCATATATATACATATATATAAATACCAGCATATAAGTCATCCGTTCACC
AAGCGTCCACTCGCACTCCTCCTTCTCTCTTCCCCTTCTTCCACCTACACCAGACGAAGAAAGCATCCAATCGTTCACC
ATGAAGCCCCAAACTTTCGTTGTCGCTGCCCTCGGCCTCCTGTCCGGAGAAGCCATGGCCCAGAGCGTGCCGCCTCTGA
TCTCGTCTGTGTCTGCCGCCGTCTCCTCTGCCATTGCCTCTGGCAGTGCCATTGCTTCCAGCATTCGCTCCGAGGCCTC
GTCCGTCGCCAGCAGCATCCGCTCAGAAGCTTCTTCCATCGCCTCCAGCGAGACCAATACCGCAACCACTGGCACTGAG
ACCACCAGCAGTGAGACCACCTTGACAACTACCATCGCCACCACCACCACCACCCAAACCACTGTCGAGTCTGCCACCA
CAGAGCCTGCCACTACTATCCCCGGAACCACCAACAGCGAGACTACCAGGGCTGCCACCACCATTCCTGCTACTACCCG
CTCTGCCACCACTCGCGTCACCACCAGAACCTCTGCTACCACTTCTACCTCTACCGGTCTGGCCATTGCTCCCACTGCT
GATGCCAAGCTGCTGGCTCCCATCCTCGGTGCTGCCGCCGCCGTCTTGATGCTGTAAACACCTGTCTCTTGGAACTACT
ACTATCTATTTCATATGTTGGGCGGaggACTTGATA > SEQ ID NO:3013 216079 179846_300564_1
tcgacccacgcgtccgattcaacctcttccatcagtacttgctgtcattgtcacacagtgttatttttcgcgcgagagtg
gCACCTATTCGACAATGATTGAGGAAAAGAAAGACTTTTTCCCGGGCTTCAGCGCCTTGTCTGAGCAAGTCTATATCCG
CCACCCCGACGAACAAAATGAGGCTGTGAAGCGCCCTACCGATCCTCGGGCCGTCCTCATCTATTCCTGGGGCGATGGA
CAGCCAAAGAACGTGGTCAAGTATGCCGACGGATACCGGAATCTCTTCCCCTGCTCAACGCAGATCGTCGTGCTGGCCC
CCATCTCAAAGGCCATGTGGTCAAACCTCGACCAGCGCACGCAATCCATGAGACCTGTCATCGACGCCATCTTCCCGAA
GGAATCGGAAGATGACAAGGACTCTCAAAAGGTCGAGGACCGCGTGCTGGCTCACATCATGTCCAACACTGGAGGTATC
AACTATGCGGCGACGTTGAATGCCTACCGCCTTGTTCACGATAAGCCGATGCCGCATCACTTGCTGGTTCTCGATTCTA
CACCTGGAAGCGCCATCTTGACCCGCGAGAACTTGGGCCGCTGGTCACGCGCCATGGCCCTGGGCACTGCAAACTGGTT
CCCTTGGCCATTTGCCGTCACACAGACGCTTTGGGCTGGATTCCTCTGCGGAAACCGCTTCATCGAATGGGTCATTGGC
AAGGAGCCCGCGCCGGTGTTCAGCGTCAAAGCGGTGATTAACCCATACTACGAGaccAAGGATACGCGACACTTGTATA
TCTACAGCGAagATGATGATCTCATCCCGTATCaggAAATTGAAGAGCACATTGCACAAGCACGGAAAAGGGGATACAA
GTCTGATAATCACATGTTcaagggaAGcggccaTGTGCGCCACATGCAAATGtttaatGgagagtActggggAGCTATC
GGAACGTCGTGgaatagagcGACGAGCGaGCCTTCTGaggAGGCGTAATGGGTTgtGCTCAAGGCcAAAaGgggtcccg
atggaaatttgcGTTGCTTTcTATAGACGAACTCGCGTTg > SEQ ID NO:3014 216087 206830_300826_1
GCGCGATGATCCCCGCAGCAGCAAAAACGGCCGAAATCCATCCCGGCTGCCACTAAGAATCTCCCTTTGGGGCAGCCGC
TAGTGTCGGGAGCTGTTCTTCCCGAACACTTCTGCGACGATGCCTTGCCCTGTTTCAGACAAGCTGATGATGATGATGGG
CTTGCACGACCACGCGCCCGTCTGTGCTACACGCCCGGATCTGCCTTTTCGCAGGTTTGCTTGCGGG > SEQ ID NO:3015 216090 205026_300795_1
ACACACATAAATACACCAGCAAAACATCTTCTGCGATTTCTAGTGTTTTTTCACTTACACCAGCGCGACCATCGCCAAA
GCTACATACAACACAACACACAACACAATACATACACATCCAGACACTACCGTCTAACATAACACAAACCGCCGAAATG
GTCACTCAACCAGCCAAGATCCCCGTTGCCGCCCCAGGCCCCCTCGCTAGAGCTTTCCCAGCCGTCATCGCCGTCGGCG
TCAGTAAGTCATCTACTGAGACTTCATCCTCACTCTACCCTCAGTCCACTAACAACGACTTTAACTTCAAGTCTCTGCC
GTCGCGCTAAACGTTCGCTCCCAACTCAAGACTCATTCAGCCACTCAGGACCGCTTCTTCTCCCAGTACAAGAACCCCG
AGAGCGAAGCCGTCCGCCAAAAGGTGTTTGAGGGCGCTGTCGAGGACCCCCGCAAGAGCTGGTTCAACGTCCTGGGCTG
GTGACTATTTGAGGATTAAGCAGGGGTTTTGAAGACACAATCGCATTGCTGGGCGTTTATTTTAATTTTTAGTATCGAG

FIG. 2 continued

```
GAGTTGGAAAGGATATTTGTTGGCTGGTGAAGGCGTCGTGCATTGCTGTTTCGATGTGACCGCCTGGTGTATAAATGGC
GAAAGAAGGGGgttGTtgagaggcccgagtATTGATAccagcCTTatttagaTGGCACtttaatCTTCTAAAg > SEQ ID NO:3016 216090 207990_300830_1
ATTGACTACACACATAAATACACCAGCAAAACATCTTCTGCGATTTCTAGTGTTTTTTCACTTACACCAGCGCGACCAT
CGCCAAAGCTACATACAACACAACACACAACACAATACATACACATCCAGACACTACCGTCTAACATAACACAAACCGC
CGAAATGGTCACTCAACCAGCCAAGATCCCCGTTGCCGCCCCAGGCCCCCTCGCTAGAGCTTTCCCAGCCGTCATCGC > SEQ ID NO:3017 216095 253220_301624_1
TAAAAAATGTCAATTGGAAAGCTGTACGACGCCCCCTCTTGTCGAGTTACCCCCCTCAAGGCTCTCGTCAAGCATTTCA
AGCTCGATGTCGACATTGTCCAGCGGGACGCCGAGTTCGGCAAGCTCTTCCCTCTGAAGAAGGTGCCTGCTTTCGTGGC
CGCCGACGGAACCCCCATCCACGAGTTCATTGCAATCTCCTACTACCTCCTGTCTCAGATCCCCAACAACCCTCTTGCC
CCCAAGACCAAGGAGGACGAGGCCGAGGTTCTGCAGTGGGTTTCTTTCGGTAACCAGGAGGTCCTCGGTGCTGCCTGGG
ACACCTTTGGCCCTCTGACTGGCCGAGCCCCCTACAACAAGAAGTCTGTCGACGCCGCTTCCGAGCAGCTCGACAAGCT
CATTGCTCTCACCTACGAGCCCCACCCTCACCAAGAACACCTACCTTGTTGGTGAGAAGGTCACCTACGCTGACGTCGCC
AATGTCGCTCTCCTGTCTCGAGGCTTCGAGTACCTCTGTTTGACGACGCCTGGAAGAAGAAGTACCCCGCCACTACCCGAT
GGTGgCTCaccgtctccaagaacGCTGTCTTCACtggcTTCGacTTCC > SEQ ID NO:3018 216103 206815_300826_1
GCGGTGACATCCTAACCAAAAAGAAACTTGACCCTCATCGTAGCCGCTGTCGAGGCGCAACCTTTACCTGTATTGATTG
CATGGTATACTTTCCCGGCGTCGAATATCGTTCTCATACATCTTGCATGACAGAAGAGCAGAAATACCAAGGCGCATTG
TATAAGCCGAAGCAAAACAACAAGAAGCAGCAGCAACAgCagCAACATCATCAGCAACAACAGCCCACCATGAACTCGC
ATCGGTTAGGCATGGCCAACACGTTGGCCCTGCAGCCATTTGTCGAAGATGTCAACGAAGacaaGGAATACGAGTCGTG
GCACGAGTACGAAGACAAGTCTCGACCTCCCCCCGAGGcgCcaaCCCCTCCATCtgccgccgacgatGACCACGTCAAC
GTCTTTgacttccctagAcaaCTCTCAAAccccgactggctcaaacgtGagccatGCGCGAgaCCGAAAAGCTcctggT
CCcagcgaCAgcacctCTCTTgtgCGCTAC > SEQ ID NO:3019 216107 179711_300563_1
GTCTTATCAAGGATATGGGCGGCCCTACGGCCAACCACCGCCTCCCCAGGGCTATGGCCAGTATCCCCCTCCTCAACAG
GGCCAATATCCTCCTCAACAGCAGGGCCAGTACCCTCCTCCTCATGGGCAATATCCTCCGGCCCAGCAAGGGCAATACG
GCCAGCATCCTCCCCCTCAGCAGGGAGGTTATTACCAGTCTCCCCCGCCCCCTCCAGGCCAGTATCCCCCACCACAAGC
GCCCTACGGACAGCCGCCGCCTCAGCAATACGGGGCTCCTCCTCCTCAACACCAACAGCCCTACGGAGCGCCTCCTCCA
GGCCAATATGGAGCGCCTCCTCCGCAGCATGGAGGGCATTATGGTGCCCCTCCTCCGGCGCCTTACGGAGCTCCCCCAG
TGCAGCCTACGCCGCCGTCTATTGGCTATGGCGCACCCCAGATCATTCAATGGGACGGCACCCCAGATGCCCAGGCTTT
GCGCGGCGCCATGAAGGGCTTTGGAACGGACGAGAAGACACTGATTAATGTTCTCTCGCGAAAAGACCCGCTACAGATC
GAGGTGATTCGATCCACTTACGAGCGCACCTTCAAG > SEQ ID NO:3020 216108 206532_300823_1
TGTAGAACAATCTCTCTTTGTCCTGTAGTCTCTTTGACTTATAATCTGCTCTATCCTGCTGTTGCGTGGAAGCTTCAGA
GTCCTCCCTTTGTGTGTGCGCGTGAGCCGAAACAATCACCACAATTGCTGCTCGCACGCCCCGGAAACAACAAAGAGCC
CGCTGATCCGATCCGCCATCTCCGGCATACAATGCGCCGCTGCTCTTCTTCTTCATCAATCAGCTCTCAGTGGTCCTCT
ATAAGCGACGACCAGCTCAACTCCATCGTCCACATCAACAGCATCACCACCGCCGCCACCACAGTCACCGCCAGCAACT
CGTCTGTTGTATCTTCATCTGCCTCTGTTGCACCCTCAATCATGCCTTCAGTCCACACAATGTCTGAGCGCCGCCCTTC
CACCCCCCAGTATGAGCGCAGTCGCCAGGGAAGCACATGCTCCGTACTGAGCTGCGGCGGGCATGAGCCCTGATCGACC
AAGGAGCTGTGGAAgaCCATGTTGGAGCTCCAAGAGCGATATGGATGTTACACCTCAGCCAGAATGGATATGGCCGTTG
GAGCGGGAGACATGGCTCTCTCTAATGCCAAATCCATTTATTctcGaTACgCTAAACGACTCCGtCGTCgacctgcc
tgACGagggctgggagatgctcaaTCGCTgTctc > SEQ ID NO:3021 216109 206632_300824_1
gatcttgctGGGAGCTGTGATTTTGGCAGcgcGAAGCGTTTCCGGGTGCCAATTCTCACCACTGCAATCACAAGTCCCG
AGTACTACTCTGTCAACCATGGCCTCGATTGTGCGACCTTCTCTGCTGCGGCAGACTGCGCTGGCGGCTCGTTGCGCCA
AGCCTGCTTTCCGAAACAacgCCATCAaGGCTTCGGCTTTCCACACCTCGACTCAGCTCTCTGCCTTTCTGCCTCCCGG
ACCTCAGCGAATTGAGGGCACAGTCAACGACCCCGTCCCTATTCCCAAACcTAACGCCTCCCACGGCTCCTACCACTGG
ACCTTTGAGCGCCTCCTCGCCGCCGGCCTCGTGCCCCTCTCCATTGCTCCCTTCGCCGCCGGCTCTCTCAaccccACCA
CCGACGCCATCCTGTGCTCTGCCGTCCTCCTGCACTCTCACATTGGCTTCCAGTCCGTCATCATCGACTACATCCCCAA
GAACCGCTACTCCGGCCTGCGAAAGATCTTCTGGTGGGGCTTGAACCTggcgACCgtcaccgtCGGCGTGggatTGTAc
gagtttgagaccaacGATattggcGttaccgaggcTAt
```

FIG. 2 continued

> SEQ ID NO:3022 216109 208424_300835_1
GGAGCTGTGATTTTGCCAGCGCGAAGCGTTTCCGGGTGCCAATTCTCACCACTGCAATCACAAGTCCCGAGTACTACTC
TGTCAACCATGGCCTCGATTGTGCGACCTTCTCTGCTGCGGCAGACTGCGCTGGCGGCTCGTTGCGCCAAGCCTGCTTT
CCGAAACAACGCCATCAAGGCTTCGGCTTTCCACACCTCGACTCAGCTCTCTGCCTTTCTGCCTCCCGGACCTCAGCGA
ATTGAGGGCACAGGTATGCCGCGCAAAACGTGTTGCGCTCTCTCACATGCCGAACCGAACCTATGAAATAACTAACCAC
GAGCCTACATACAGTCAACGACCCTGCCCCTATTCCCCAACCTAACGCCTCGCACGGCTCCTACCACTGGACCTTTGAG
CGCCTCCTCGCCGCCGGCCTCGTACCCCTCTCCATTGCTCCCTTCGCCGCCGGCTCTCTCAACCCCACCACCGACGCCA
TCCTGTGCTCTGCCGTCCTCCTGCACTCTCACATTGGCTTCCAGTCCGTCATCATCGACTACATCCCCAAGAACCGCTA
CTCCGGCCTGCGAAAGATCTTCTGGTGGGGCTTGAACCTGgCGACCGTCACCGTCGGC

> SEQ ID NO:3023 216112 220325_300954_1
CGTTAACGAGTCGTTTGTTGAGCTCCTTTTCCCTTCCCAGTCTTTCGCTTTTGGGTCCGCACTTCTCCTGCAGGTCGCC
GTTTCCATACCATTTTCTAATAGTATCACTTCCGCACATCTTCACGAACGCGTCTCCCCGTCGTCGTACTATACAGTCA
ATATGGTGTCTTTCAAATCAGCCGTTGCCGCCGCCACGATGGCCTTTGTCTCGTTGGCCAATGCGAAGAGCTACTACAT
CGACCCTGACAGTGTCCCTCTGGCCACAAGACAGAGCTGGTGCCGTTCTGAGACGTCGACATGCCCCATCATCTGCCAG
CAGACCACCAACAAGCCGACATTGGTCAACGACTGCAGTCCTGATACCTTGAGCTTCGGTTGTCTCTGTGGTGATAACA
AGCAGCCTAACATTTCTGAGTACACCTTGACACTGCCCTTTTTCATTTGCCAGGAGTTTGTGGTCCAGTGCAGGACAGC
TTGTGGCTCGGACAACACTTGTGCGTCTAACTGCGCCGAGGATAACCCTTGTGGTGCCACCGATCCTAAGCGTTACAAC
TCAACTTCGACTGCTACAACAACAAcC

> SEQ ID NO:3024 216114 205785_300922_1
gccccccaaagctcctggactggtccctccaaaagccacagccgcaagcttggcagattggtaaaggtccagaacccag
gCCACTTGGTATTAAAGTATTTCTCCGTTAAGGAATGAAAGAAAGGTGGCTGTACTTCAGCTCATGCTTAGTTGGAACA
CAGCCCAAGCAATAGCACAAAGAGGCGTCTACTCCAACCATATCCAGCCATTATCTAGACAAAATAGAGAAAGAAACAG
AGAAAAGCCACGATATCGGATATCGACCAACTTCAAACTGGCAAAGCTGCAATCAACCCCCGACGTTGGGCTTGCTCTA
GAATCCGCCCAGCTGGCTGAGGAAGCGAATTCCTTCTCCTCGGCCTCCGTTATACTTCCTTTTACGTACCGTGATATTG
TGATAGACAGACGCCTCCAAAAAGGAACATCACAACAAAGTATCGCCAAGAATCCTCATCCGCAAGTACACAGGGGGAA
ACAACAAAACAAGCTTCCGACTCCTCGACTCCAGTGGGGGGCATCCCAGCCAGTCAATGATAAACACACAATCAAACAG
AGCACGATACAGAGAGAAGAAGCACCTCAAGCCGCCGTCAGTTTCACCCCCCCTTTAAAAGAGATTTGAACCCGAAAAG
GGCCGCTCGCATATTCAAGCCTTTCGCCAATGAGATCCCCCATCCATCCTCTCACATCCCGCACCCTCCACACCAAATG
CAAAACCCCCAATAAATTCTGTCGACGGGAGAAAAATAAGATATGCAGAGAGGAGCTCACTCAGCTGTGGCCACGtaga
aAGccTCGGCCCGTTCGCAACCCACAGcctGTATCaagTCAAAaccATAGAAgggccAGCGCCATgcccAGCCGGAATa
acgtcatgCAttGCTTGAatatgcctCTTGTGCGTc > SEQ ID NO:3025 216130 210976_300894_1
AAACAACCATGCCTCACAAACACAAGTCAAAAAAGGGCGAATTTGAAGCAGAGTTCGTTTGTGAGCGTACCATGAGTAG
ATTTCACTGACTAATCTTGGAGCTAGATTCGATCTCGCCCCTACAGAGAAAGCGCGATCTCTTCCAGTAAACAAACGAA
AAGCGGCATCAAGTTCTGGAGAGCAAGTCACAAAGAAGCGTGCCAGAAGCTCATTAAGAGGCAATGACACTCCGCGAGC
ATTCAAGAGAATCATGGCTGTGGCAGGGGGAAGAAAATTAGATCAGGCTTGGATGATGGTCAACTCGACAAAACGACT
ACGAAGGCTACCGATGTAACGAGCGAGAAACTTCAAATTCGTCCCGGTGAAAATTTAGGGGCCTTTGCCAGCCGGGTTG
ATGCGGCTCTACCAGTATCAGGGCTTGCGAAGAAAACCAGCACGAATGCAGAGGGCAAAGACGCATTAGGATTGAAAGT
GTATCGCACTCGCAAAGAGCGCAAAATGCACAAACTCTACGATCAGTGGAGGGCAGAGGAATCCAAGATACGAGAAAAG
AGGGAGGAGGAGCTAGAGCGCATAGCAGAACGCGACTTGGAAGACGATGCTGCCGGCATTCTTACTTCAGCTGCCTTCG
AAAACGACAATAGCCACACGAAAAGAGGAAGGGGGCAAGAGGAAGAGAATAGTAGAGGAAGa > SEQ ID NO:3026 216131 195983_300639_1
gcgctgAGAAGCCTGCATCGCCCGCCATGGCCATTACGCCGACCCAATTCGCCAAGAAGACGGCGCAGTCGACCAGCTG
GTCGGATGCGAAGCGTCGAGTCCTTTCTTCGTACCGCGAATGGATCCGAGCTGCGCCTGAGATCCAGACCATGTACAAT
GTCCCTCTCCCCATTTCTACCCTCCGAACACGGATGCGACAAGAGTTCGAGCGACACCGATACACGAACCAGCTGTCCA
TAGTTGACGTGCTTCTCTTCAAGTCCCATGCAGAGTACCAGGAAACAATGAACTTCTGGAAGCAGCAGACTCACATCTT
GTCTTATTCGGCGAAAACTTTAGAGGTGACAAGAGGCTTCCGTCCAGCTTCATGGCTGGTTTCCTTGAGGGTCGAAAT
TAGAAAGACAATGCAAGAAAGTTTGTTTTGTAAATATCTCTGTATAAAGATTTTGTGCCGAAACCCTCCAATAaaaAaa
aacacaacaacac > SEQ ID NO:3027 216142 204139_300790_1
cACACCTGCAAGCCGTCGGCTCTTCCTTCCTATTCCCATTGACAGGATAAACATACGTCTAGGCTGCTTCTGCTTGGCA
GGAACTACCTTTCCGAGCATCTGCCACTGCCTATCTGGGTATTGGGCATTGCCCAACGTGGTGCGCACTTGCTCGATCC
ATACCTACAATTACGGGTACCTTGATGATCTGGGGTATCTTGTAGTTTAGTTTGTATCTGCCGGGTCACGAGCAGCCAC
CACCGCCAACATTTGGTACTAGGCAATACTTCTGGGTGCCGATATATCACCTGTCACGTCTTTTCAGGTTTTGCATCTT

FIG. 2 continued

```
TTTGCTCTCTTCATCATCATCATCTTTCTTCTTTGTCACAATCACTTTGCCGTCTTCCACGGACATTTCCGCAGATCTG
CATCACAGAGATCTGCATCAGAGAGGATTTCAAGCTTTTCCTCTTTGTTTGCCTTCCTCTCCTCTTCTCTTCTTGGATC
ACAAAACAATCGGCAAAATTGACATCTCGATATTTTCTGCCTCCAATCACAGCCGTCATACCACCTGTGGCGTCTTTGC
CATCAATTCTCTGCTGCGGTGCTACCCGCCCTGCAGCAATTTTTCCCGCTGGCCGTCTGcAggcTTgcctcGGCtgtgg
GTtttccgtCGaccACTGaggcttagtgccCA > SEQ ID NO:3028  216147  207838_300829_1
AAGAGGCAGGAAACTCTCTTTTGGCCCCAGAAAATGCCAGACTAGGTCCGAAGAACTATCGATTCTAACGCCGATGATG
TCGCTTGCCGGCAGTCGAGGGCTCGGAATCGGCAACGCGGTTCCTTGGTAATTGGCCACAAGCTGGGGCACTATCTGGA
GACTATCCGCCCGAGCTGTCCGTTTGGCCTTTCCTAAATTGCCCATTCGAGTTAATGATGTAATGAGGAGAGGGACTCT
TGAAAATGGATATAAGGGCGCAGTCGCGCAAGCTGTTCTGAGCTGAAAAGAAAGGAGAGAGAAGGTCTCTGTACAAGCA
GGAGAACAAATCTTATCTCAATTGCAATTTGAAATTCCATCGCC > SEQ ID NO:3029  216152  207987_300830_1
gAAGACGGATTACTCGCACATATCGCGTGAGAAGAGCCTCCTCGTGGTTATTTGATGCTAGAAACCGCAGGTCCGTGGG
TTGTTTCGGGAGAGGAGGAAACCCaggggAAAGGGTCGCTTTGGATGAGGCTGTGCCGTATTAGCCGCGTATATTGCCA
ATGAGTGTGCTGTGTTTGGTGGTTGTGTTGCCTTCAagATGCAAAGTAATATATTTCCATCTTGGCATAGCATGTATTG
CTACGTACGTAGTAGtATGCAGATGGCTGGGATTGATGCTCTTACATGGAGTATattcccAGCTTCCT > SEQ ID NO:3030  216156  217712_300911_1
ttcacttcCTGAGGCCGCATCTCATTCAGCTTTTACCCCACCATCTCACAGCCCATCATCTATCTCATCCAACCTCTCA
CCACAACAGCACCTACATCTACAAGAGAGAACACTTCCCTCTTGAAAAAGTAAACCTAAATAAACACATCAAATCAAAA
TCCTCCATCATGGCCGACAAAGACCGCATCACCTGCCACGTCCTCGACACCACCGCCGGCCGCCCCGCAAAGGGCATCC
GCGTCCGCCTCGAAGGCCCCGTCCCCAGCTCTCCCAACGCCCACACTGCCGTCAACACCTTCGAGTCCCTCACCAACGA
CGACGGCCGCATCACCGTCTGGCTGCCCTACTCCTCAGAGTCCTCGGCCGGCGAGGTGCCCGTCTACACTCTCGAGGAC
GTCCTGGGCGCTATCAAGGGGCCTTCCCGGTGGACGCTGCGTTTCGACACTGCCGGCTACTTTGGCGAGGAAAAACAT
TCTTCCCAGAAGCCACCATTGTGTTTCGTGTTGAAGAGGGCCAGCATTACCATGTGCCGCTGCTGTTGAGTCCGTACAG
CTACACCACTTACCGGGGAAGCTAAAGGGGGGCATGGGAGGACAACGCGGCTTCACAGCCACAGTCGTTTCAGTTTCAG
AGTCAGAGTCAGAGTCAGTATTCAGAGATACATATGACAACAATGATATTGAAAGCGTGCTAGTCGTGGCAATGTCAAC
A > SEQ ID NO:3031  216160  207856_300829_1
gttcgtgctgaagatttgcaatgcgcgcgcacatctgagtatcctgagacggctgcagtctactgcaacttgtactcta
cTTGGGGTACCAGATGCTCCCTTCGGAGCAGGATCACGATTCAAACGCGCATCAATCACAGGAAATCCCTGTCGTCTGT
GTTTTGTTCCAACCCGGAACTGCTCAAATTGGGAACCCGAATGACATACTGTTTACCGCCATGTGTGTGGTTGGTTCTC
TTGAGAATCCGAGACATATTGTCTGTGACAATCGCATTGTCGACAAATCAACAAATCAAAAATGCGCCGTTGCGCTGTT
TGCCAAAGTTGGTGGGTGGGATGCTCTTTTATTCATTTTGCTCGCCTTTTTTTCTTCTTGCGCTCTAGCACGCCAACCT
GGATTCCAACCTTCTGGGACCACCCGATCGATCGTGGCAGAATTGAACGCACGAATAGGGCTTTTGTGTAACGCTGGAA
AGGACCACGGTGGCCGCTGGTATCCATTCTGTCCGCACACTTACTTCGGCATTGGGGCCAACGTTCCTGGCGATGCAGC
GGGACTGGTGGCATGAGTGGGTAGTTGACATGTTGGCTGCCCGTTCCGAACTTCTCCATCGGCCCCATTTCCACTGCGT
TGCCAGATCCGTTGGGATCAAGATTTAGGACGCTGGTGGCCTACCAACGCCCGCATCCGAGGAGAACCACAGCGGACGT
CCTCCGTACTTTTCTCCCCGTCCGTTGacgatatgctaccagcacatgcgccctgaacatgcaccatgttggactccat
agtaagattgggctgatataccacgcgc > SEQ ID NO:3032  216176  208060_300831_1
gggaaatttgttcaACCTCGACAAATCAACCCCGTCGCCCATAGTACAAGATGGTAAGTTAACAGTCAACCAAAAGACT
CTAATGGCCACAGTTTGTGAGTCAAATGCGCGAAAGCGCAATTGATGCAACAGCGTCTAGCTTTTATGCAAACCTGTTG
GAAAACATTCCGCCTGACATTCACACCTCGTGTGTGGACTGAAAGGTGAAGACTTGGCTGGAGACACAAATGTGTTGCT
GAAATATGCCACAATGTGTTCTCGTTAGAGTTCAGAGAAGACTTTTTGGCTTGAGCCCCTCGCTGATGTCTTCTTTTCT
CAATGACAGCCTCCCAAATCTGGCAAGAAGGTCGCCCCTGCTCCGTTCCCTCAGAGCAAGGCTGGCAAGAAGGGACCCA
AGAACCCCCTCATCGAGAAGCGCCCTCGCAACTATGGCATCGGCCAGGACATCCAGCCCAAGCGAAACCTGTCTCGCAT
GGTAAAGTGGCCCGAGTATGTCCGCCTCCAGCGCCAGCGCAAGATCCTTCGCCTGCCTCAAGGTCCCCCCTCTCTG
GCCCAGTTCCAGCACGTCCTTGACCGCAACACTGCCGCCCAGGCTTTCAAGCTCCTCAACAAGTACCGACCTGAGACCA
AGGTCGAGAAGAAGGAGCGTCTCCTGAAGGAGGCTACCGCCGTCAAGGAGGGCAAGAAGAAGGAGGACGTCAGCAAGAA
GCCCTACACCGTCAAGTACGGTCTCAACCACGTCGTTGGCCTGATTGAGAACAAGAAGGCTTCTCTCGTCCTCATCCCC
AACGATGTTGACCCCATTGAGTTGGTTGTCTTCCTTCCTTCTCTCTGCAAGAAGATGGGCATCCCCTACGCCATCATCA
aGGGCAaggctcgTCTCGgCACTGt
```

FIG. 2 continued

> SEQ ID NO:3033 216187 208071_300831_1
ATTTATCGAGTTTCACAGGGCTTACAACTCCTGTCCGGGGGGATTGGCAGATCTTGACAACTGAGGAGGACCGGATGCC
GTGACGTGTAGCTGCTAGGATGAATCTTGGATTGGAGATTTGCCAGTCGATTTGGATGGTGCCTTTCGGGATGGAGGGG
TGGAGGGTGGAGAGATATGACTAGTGTGGAGGTATCACAGCGTCGGGGGGCTGTGGAGAGTTCAGGGTAAGCCATTTGC
GGCTTTCACGCTCAGTAACACTCGGGGGTTTAAAACTGACTGATGGCCCATCTATACCTTGCAGAACGAATTTAGGTCC
TCGCAAGACTCTCCCTAGAGCCGCGTCCCGTCACTACTGCTGCTTTGGCATCAAATAGTGCTCAATGGCTAGGCCGAGG
GATTTGAAGACGATAGCAATGTAACCCATACGATCTGACTGAACGAAAAAAAACAACAACC

> SEQ ID NO:3034 216195 215323_300880_1
TCGACATCAGTCACAATGGCTTTCGGAACTCTCTTCACCACCGCCGACCAACCTCGTGCCGCCGCCATCAAGGCCGTCG
CCAAGGCCAACGGCCTCGAGCTCAACATCTCCAACGTTGAGGCTGGCAAGCCCACTGCTGAGCACCTCAAGGCTCACCC
TCTGGGCAAATACCCTGCTTTCCTCGGCGAGGATGGCTTTGCCCTGAGCGAGAGCATTGCTATCGCCATCTACGTCACC
TCCCAGAACGAGAAGACCACCCTTCTCGGCAAGACCAAGCAGGACTACGCTTCCATCCTCCGATGGATGTCCTACTTCA
ACACCGAGGTTTGCCCCAAGATCGGTGCTTGGATCAAGCCCCTGACCGGCGCCTCCCCCTACAACAAGAAGGCTGTCGA
TGACATCTCCAAGGAGGTTGCCCGTGCTGTTGATGCTGCTGAGGAGCACCTCACTCACCACACCTACCTCGTTGGTGAG
CGCATCACCCTGGCTGATCTCTTCAGCGCTGGCCTCCTCTACCGCGGCTTCCAGTACTTCTTCGACAAGCAGTGGCGCC
AGCAGCACCCCGCTGTTACTCGATGGTACGAGACCATTGTTAACCAGCCCATCTACACTgccGTCGccgagaaGCTcCC
CTTccTggagactcccg > SEQ ID NO:3035 216196 1099056_301487_1
AGAAAGAGAAGCTCATCAGCAAGTCTGGTCCTGTTTGTCTCTCTGTTACACAGATTCAGTGAATCAAGGAGAAGCACCT
TATTCTCTTCCTAATCATGGCTGCTATCGTTGAAGATGCTGGAGAGGTGCCCTCTGCGTCGGCGCCCACTCCTGTTCTT
GGGGAGCCAATGGATCTTTTGACGGCTTTGCAGTTGGTTTTGAAGAAGTCTCTTGCCCATGATGGGCTCTCGCGAGGGC
TCCATGAATCTGCAAAGGCTATTGAGAAGCATGCTGCGCAGCTCTGTGTCCTGGCTGAGGATTGCAATCAGGCTGAGTA
TACAAAGCTTGTCCAAGCCCTTTGTTCTGAGCACAATGTCAGCTTGATCTCGGTCCCCAGTGCCAAGAAACTTGGGGAA
TGGGCTGGGCTGTGCAAGATAGACCCCGAAGGGAATGCTCGCAAAGTTGTTGGATGCTCCTGTGTCGTTGTTAAGGATT
ATGGTGAGGAGACCGAAGGCCTGAACATTGTCCAGGAGTATGTAAAAAGCCACTGAGTTGAGAAGAGGAAAAGTCAATT
ATTAAGGAAAAATTACACTATTTTTGAGCGAAACTTTAC > SEQ ID NO:3036 216196 204982_300794_1
gaAAACCCCCTCACTAATTCTTTACACGTCAATTAATCTTCGAGGATCGCCCGACGAGAACAACAATCAAGATGTCGGA
CGTAGAAGAGAACAACGCCCCCGAGGTCGTCGAGGAGGTTGAAGTTTCCGGAGATGCCCCCAAGGGCCAGATGTCCGTT
CTGCACGCCCTCAAGGGTGTTCTCAAGCTCGCTCTCATGCACGACGGTCTCGCCCGCGGTCTCCGAGAAGCCTCCAAGG
CTCTTGACCGTCGCCAGGCTCACATGTGCGTCCTGAACGAGAACTGCGAGGAGGAGGCCTACAAGAAGCTGGTCATTGC
TCTCTGCAATGAGCACAAGATTCCTCTCATCAAGGTTCCCGATGGCAAGCAGCTCGGCGAGTGGGCCGGTCTTTGCGTT
CTGGACCGTGAGGGTAACGCCCGCAAGGTCGTCAACTGCTCTTGCGTCGTTGTTAAAGACTGGGGTGAGGAGTCTCAGG
AGCGTTCTATCATCCTGAACTACTTCCAGACTTCCCAGTAAGGGCATGGACGGCGTTGATTTAAGGGGTTATAGAGGTG
CCGTCTTGGTTTCTTTTCAGGACGCGTGAAAAAAAAAACGACTTTCTttagggtTGTACTCTAGGCcttgtatCATGGC
CATCTtgcaTGACGGGAAAAATaaaAaaggaatttacagaATCATCTGATATTGCTGGCTCTTTTGTGCACACTAATGC
TCTCTgAtaaaacatgCAGttttcCATTTTCTATtt > SEQ ID NO:3037 216196 1112045_301801_1
TCTTTCTTCTTCCTTTTAGCTTTCCTTTCGTTTTTTGATTTATTTTGAATACAGGAAATCCTCGAGGTCTCGCCCTCTT
CGTCCCCGTCTCTGCACAGGACAAGATCGTGAATCGAAGAAAGGATTTCGCAGTATCATGGCAGAAGTTGTGGTAGATG
AAACTGCGGAGAAGCCCTCGGCCTCGGTGCCAGTTTTGGGGGAGCCAATGGATCTTTTAACAGCATTGCAGTTGGTTCT
GAAGAAAGCAATGGCGCATGATGGCCTTGCCCGAGGCCTTCATGAAGGTGCCAAAGCTATTGAGAAACATGCGGCCCAG
CTCTGTGTACTGGCTGAAGACTGCAATCAGGCTGAGTATACCAAGCTGGTTCAAGCTCTTTGTTCAGAGCACAATGTCA
GTTTGATCTCAGTTCCTAGTGCCAAGAAACTGGGTGAATGGGCTGGGCTCTGCAAGATTGACTCTGAAGGTAATGCTCG
CAAAGTTGTCGGCTGCTCTTGCGTTGTCGTCAAGGATTAC > SEQ ID NO:3038 216204 208749_300808_1
ACAAGACATTGATCCTCAGTGGTTTTTGGGGGAATGCGCATCCTTTCTAGCCTTTATTATCTGCTGTGATGTTGAGGGG
CACAAGAGCTGACTGGATTGGCAGAAGATAATGGCAAAAAGAGATGCGCAAACGTTAGTACAAGCTCGACCAAGAGCA
TCATCTTTACCATCACATCTCATTTTTCAAATACATGAAATGGTCAGATATATTCATACGTGTCCAAGCGTTCAGAAAC
CAGCCAATCTCAGTCTTACATACTTGGAACATTTACATAGTATTGAGTCGCCTATTCATCAGGAAATCCTGGTTCAACA
AAACTCCTCCACTCAGAAAAGAAAAGAAAGCTAAAGCACC

FIG. 2 continued

> SEQ ID NO:3039 216207 1096904_301435_1
aaagttccTTTGTTCTAGTCTCTTTCTTTTGGTTTCAGATTACAGCGCGGAGGAGAGTTGCGGCACAGTCGGTCACCAT
GCCTTCGCACAAGACCTTTCTGATAAAGAAGAAACTGGCGAAGAAGCAGAAGCAAAACCGTCCCATCCCCCATTGGATT
CGGATGCGCACTGACAACACCATCAGGTACAATGCTAAGCGCAGGCACTGGCGCAGAACCAAGCTCGGCTTGTGATTGA
ATATCAATGGAACATTTCTTTCTTTGGAAAACATGTCAACCGAACTGGATCCTGCCAAATTTTGCCATGGAATTTATTA
GTTTTCAGAGTCGTTTGACTGCTGTTTGAAACTCCTTTTTATTTAGTCAAGTATCAAAAATGACTCAGCATTGATGGTC
TCCTTTCATATACACTCTTTTAATGTAGTCTTATAAGAAGCAATGTTTTTGGTTAGATTTTCATCTTATCCTGAAGTCT
CTATTGCATCTTTCAAATTTTTTTTGCACTCAGTTCATTattgcTAATGAGACCAATTTTATTAAAag > SEQ ID NO:3040 216207 1118248_301854_1
GGAGGAGGGAGGAAGAGGAAGAAGAGGAGGAGGAGGGAGGTATCTGAGCGAGGTCTACCGCCGATCACCATGCCTT
CCCACAAGACGTTCCTGATAAAGAAGAAGCTGGCTAAGAAGCAGAAGCAGAATCGCCCCATCCCTCACTGGATTCGTAT
GAGGACCGATAACACCATCAGGTACAATGCTAAGCGCAGACATTGGCGCAGAACCAAGCTTGGTCTGTAAGCTGGATTG
ACAGAGATGTTTTGAATTCAGCATGCTGCAATGATGGAATGGTTCATTAATTTGAGAATTCCTGGAATTAAGCATTTAA
ATTTTGGTTCACTCAGCACTGATTAAAATTTTGGAAAACAATACATTTCTTTGAATTTAGCTCTCAAATCTTTCGTGCA
ATGAACCTCTTTTAAGATGATTACTCTGGTTGCTTCATTTTCCTGCCTGCCCGGTTGAAAATTGTGTGTTACTCATCT
AGGTTCAGATGCTCTGGATACTACTACATCAAGTGTTTgttTTGACTCATAATCACAATTTAaTgtgttCTTTT > SEQ ID NO:3041 216207 1107223_301505_1
GTAGTAAAATTTTATTGAAATCTTCGAGTGTGTATGATTTAAATTTCCACTCGCTATGTCATCGCATAAATCTTTCAAG
ATCAAGCAAAAGCTTGCCAAAAAGCTGAAACAGAATCGACCCATCCCTCAATGGATCAGAATGCGTACCGGTAACACCA
TAAGATATAACGCTAAAAGACGTCATTGGAGAAGAACCAAGCTCAAATTGTAATTACAACCGGAATCGAACGTTTCGTT
ATTCTTTAATTTTCATGAATCTATTTTCTAGATTACGTTTATGATGATGGTTTCGTTGTGTGAAATTTACGAATAAAAC
GTCAACAGG > SEQ ID NO:3042 216207 145393_301059_1
acaacttcaagcagctTCAGAGCTTATCGCCGAGAATCTCCAACCGGTGAAAATGCCGTCACATAAGACATTTATGATT
AAGAAGAAACTGGCGAAGAAGCAGAGGCAAAACAGGCCCATTCCTTACTGGATTCGTATGAGGACTGATAACACTATCA
GGTACAATGCTAAGCGCAGGCACTGGCGTAGGACTAAGCTAGGGTTTTAAGGTGGAAGACTTGTGTTTTATTTATTGCT
TTTTTATGATAAAAACTTGTCGGATTATGTTTTTCGTTCATTAGGAGCTTATCTGTGATGAAACATGATGTGTTTTAA
TTTCTATGAAGTTTATATATTGAATGACTGTTTATGACTTTGTTTCTTGTt > SEQ ID NO:3043 216207 223809_300976_1
AAGACTTCAAGACCAAGTCCAAGCTGGCCAAGGCCTCCCGACAGAACCGACCCCTGCCCCAGTGGGTCCGATTCAAGAC
CAACAACACCGTTCGATACAACGCCAAGCGACGACACTGGCGACGAACCAAGCTTGGTATCTAAGCAGCGCGATGTATG
CTAGATCCGGGACCCCAAAAAATTCAATATATGGCTTTTGCACG > SEQ ID NO:3044 216207 204106_300790_1
gacccacgcgggcgatcattctcaACATCACGAAAATCGTCATCATCACCAGACTCGATACGCAAGGTCAATACGATGG
CGAGCCACAAGACATTCCGAACCAAGCAGAAGCTGGCCAAGGCCCAGAAGCAGAACCGCCCGGTTCCGCAATGGATTCG
CCTTCGCACTGGCAACACAATCCGCTACAACGCCAAGAGAAGGCACTGGAGAAAGACTCGCCTGGGCATCTAAGCGATT
TCGCCCAATCACCTGGCATTCCCGACCCTCTTGCACCGACGGTACCGACGTCTGGTTTCTTTGGCATGGTTTCGCGGTG
AAATAGTGGCGGATGGCGTAAAAGAAAAAGATTTTTTATCGTCTTTACGGCGTGTGGGGAGGGAGGATGCAGACGCAA
TGGAATGGGCACGGTTGCCTGGTTTCTCGATTCTTGATATTGCTTCATGTCACGGTCGGTCATAGGGAAAGGAATGAAC
CTATTTTGATGTCCATTTTGCTTTTTACCCGAGGATCAGTTTCCTTTTCTTTCTAAACATTGTGCTCATGCCG > SEQ ID NO:3045 216207 175712_300544_1
cccCCGGGCTTCTCCGTTCCAAGGGTTTCCTCGCGCCGCCGCCGCCGCCATGCCGTCGCACAAGACGTTCCAGATCAAG
AAGAAGCTGGCGAAGAAGATGCGCCAGAACCGCCCCATCCCGTACTGGATCCGCATGCGCACCGACAACACCATCAGGT
ACAACGCGAAGCGCAGGCACTGGCGCCGCACCAAGCTCGGGTTCTGAGCTTGGGGAGGAGAGGAGGACGAGGCGCCGGA
CGCCGCTGCCCTGGGAAGAAGAAGAAGAAGgagAAGCTAGGGCTTATGGGTTgcgTCGTGTTCGTTTCGAGGTTTTGCC
TGTCCTGAAGAGACTATCAGTAGCTgtGTGTATCTTGGAGCATCATAATTTTgCTGATTAAAGAACCACTTTCTTATCC
TGCCTAAAGTtgtcTGAATTTTATCTCAGcTgcagtgGATTGATCAgTTGAACTcCCTt

FIG. 2 continued

> SEQ ID NO:3046 216207 159662_200050_1
GCAGCAGCAGCTCCAGCTCCCAGGAGGAATTCCCAACCGTGAAAATGCCGTCACACAAGACATTCATGATCAAGAAGAA
GCTAGCAAAGAAGCAGAGGCAGAACAGGCCTATTCCTTATTGGATCCGAATGAGGACTGACAACACCATCAGGTACAAT
GCCAAGCGCAGGCACTGGAGGCGTACCAAGTTAGGATTTTAAGGTGGAGGATTTGAGTTTTGTTCAACATTTTATGGAA
AACTTTCTGGGGTTTTGGTATTTTCTACTTTTGTTTACTAGGAGCTTCTTCTGAAATGAAATCTAGTAGAGTTTCTACT
GATGTTTTGGTAAAAGTATTGGAGCTCAAGTTTCAGCAGAGTTTATGTATTAAATGACTATTTTTGGATTTATTATGTT
TTGTTGATC

> SEQ ID NO:3047 216207 44754_300030_1
GCCATTACGGCCGGGGAGGGTTTCAACGTTCAAGCAGCATCAGAGCTTATCGCCGAGAATCTCCAACCGGTGAAAATGC
CGTCCCATAAGACATTTATGATTAAGAAGAAACTGGCGAAGAAGCAGAGGCAAAACAGACCCATTCCTTACTGGATTCG
TATGAGGACTGATAACACTATCAGGTACAATGCTAAGCGCAGGCACTGGCGTAGAACCAAGCTAGGGTTTTAAGGTGGA
AGACTCGAGCTTTATTCATGATGTTAATGAAAAAACTTGTTGGATTATGTGGTTCGTTTTATAGGATCTTATTTTGTGA
TGAAACATGATGTGTTTTAATTTCAATGGAGTTTATATATTGAATGACGGTTTATGAGTTTATTTCTGGTC

> SEQ ID NO:3048 216211 208787_300808_1
GCAGAATGTCCCGCGCCGGGTCTGAGGCCAAAATGGGAAGACCTTCGATCAGACTCATCTCGTCATACATCTTCGACTG
GATTGTTCTCATCGTGGTTGCTGGAGTCGGTTATGTCCTCGGTGTTATCACGCCCAACAAGCGGCCCTTTTCTCTGGTG
AATCCAGACATCTCTTTCCCTTTTACAGAACATGAGACCGTCCCAGACTGGCTGCTCTTTGTCTTGAGCTGCGGTGTCC
CTGCCGTCATCATCGTCATTGTCTCCATCATCTTTGTACTGGAGCAACAGTACCCAAGAACACCCCTGCTTCACTGAT
ATGGAAACGTAAGCTATGGGAGCTTCACACCGGTCTTCTGGGGCTCCTAATGTCCGTTGCCTGTGGCTTCTTCTTCGTC
AGCGGTATCAAGAACATGTGTGGCAAGCCTCGACCTGATCTCCTCGCACGATGCCTGCCAGACCTGGAGAACGCTTCCA
AGTTCCTGATTGGCGGTTTCCAAGGAGAGTCCAAGTTGGGCAACAGCATTGGCCAGCTCTATTCGGCAGACATCTGCCA
GCAGACCGACAAGGCGAAGCTCAACGACGGCTTCCGAAGCTATCCCAGTGGCCACTCTGCCGCCTCTGCGGGTGGCCTC
CTCTATCTTTCACTCTTCCTTGCCCagtaaaTttgccgtAACTATGCCATTTGTGgc > SEQ ID NO:3049 216212 211234_300897_1
gttgatcataccaggcgcctttttttctgcttgagcttgtcgatatccagctgcaGTTGGGACTGCCAACCTCCAATTGG
ATGCGCATCGTGGTTTGAGGGAACATGCGACAATTACCTTCCTCAAACACCACAGTCAATCAATCCCGCTGACAGCCGA
GGGATTGCCCCCCATGCCGCCGCATCTGCACCCACGGTCACGAATGACCTCGTCACTCTTCGCTACGACGGTCCTTGCC
AGCTTCTTCGTTGTTGCCCTACCGCACTTATTACCATGCCCGGTCCCGCGGACAAAGTACGCTGATGGAGAGATTATCG
TCGACGAAAACGGCAGACGGAAGAGATGGAAGAGGAGGGATGTCGATACAAAAGACGGACTTGTGCAATTCAACCAGAC
AACAGACGATGAGATTGAGCGTGCAGCGGAGCGAATGACGAGGGAATGTCCCGTACCGAAACCCGGAGGGATGTTGGGA
GAGTGGCTCGGATTCCACGCCACGGAAGACAAGACAAGGGCAAACAGATGACGATTGATACCGCCAAATGAATAAAAAG
CAAAGAAAAAAGTTCAAATATGaaaAaaaaaaa > SEQ ID NO:3050 216216 208427_300960_1
GGAACCAATGAGTCTACGGCTAGCCACTCGGCGGCTGGCGCTGTCAAGCCCATCTTCTCCAGCCTCATTGCTGGCGCCG
ATTAATGGAGTTTCACATGGAACGGTTGGCGTACTGACTCAGCGTCGTCACAAATGGTCGATCAATGTGTTCAAAGGAT
GGGGGGAAATCTAGTTCCAAAGAATCTGGCGACAGAGGCCAGGACCCATCCGCCTCTGAATTGGACGATCCCAAGAAGCG
ACAGCAGTTCCTGCAAAGGAATATGCGGGGTGGAGTCGAAGACAACATTTTCCAGGACGAGATTGAGGCCGCGAAGCCG
GTAACCGATTCTCCAGCTGCCCAGACGACAGAGGAAAGGACGAAGGAGAGCCTAGCAATGGTGGTCGATCCAGATGCTC
GGAGCCGTATCCGGTGGCAGCGAAGAAAGGTCATCCAATCAGTGCGCCGCAACGGGCAGCTGACGAGAGAGGAGAAGAT
CAAAATGACGGAGCGCGAGCTCATTCACAAGAGCGACTTTTTCCCAACCAGCGTCAAGAAACTGGTCATGTTGGCACGG
CAGATTGCCGGCAAGCCAGTCGACGAGGCTATTCAACAAATGAAATGGTCAAAAAGAA > SEQ ID NO:3051 216219 218606_300935_1
AACCACTCGGCACATCATGAGTTCAGGATACGGCATGCATGGCGGCGTCGGCCGTTGCTTTCCTTTCTGGCAGGAGGTC
ATGGCCTGCTATGTCGTCAACACATCCGCCGCAGACGACTCAGGCAAGAAGAAGTGCTCGCCCGTACTAGAGGATTACT
ACGAGTGTCTGCACCACAAGAAGGAGCATGCGGACGACGTCTGGCCCTACAAGCCGCATATGCCCGAGCTCAATCGGCAAC
CGCACGAGACGATGCGCCAAGTGCCAGCCAGATCCGGAATCTAGGACTGCTAGGGAAGACGGAGGACACAAAAGCGGTG
CTTGGACAGGGAAACTGAGGCAATAGACGTGGCGGAGTTCGATTTCTTCTGCGCGAATACAACCCCCTTGGCGCGCATA
GATAGCGCAGCAAGTTCAATATAGGAAAAGCAGACAGAACTGGAGAGCCTTTTCGGATGCTGATTGTGAATTGGCGGCT
AATTCTGTCAGTTTGGAGGCTGTAATTCTGTACAAATTCGACGTACATtTTCATCCA > SEQ ID NO:3052 216219 254823_301639_1
TTTCGACACGCGTCGTGCTTGCTTGCTAGAACCACACAACTCACACAAAGATGTCTTCAGGATATGGTCTGACCGGAGG
TCCCTCACGATGCTTTCCCTTCTGGCAGGACGTGCTAGCCTGCTACGTCGTCAACACCTCGACTGATGACGACTCCGGC
AAGAAGAAGTGCGCCCCGGTGCTCGAGGACTACTACGAGTGCCTGCACCACAGGAAGGAGGCCTGCCAAAATCACAGCC

FIG. 2 continued

CTTCAGGCCGCATTCCGCCGCAAAGAAGCCGAAACACCCAGAGATAACGTGCCCTCCGCCGACCAGATCCGAACATTGG
GCCTGCTGGACCGCACCGACGAGGAAGTCAACATCCGTCCCGCCAAGTTCCTCCCCAAAATTGAGCACATGAACGGTTC
CAGGAAGCCAGAGACCAGCTAGAGAGGTGGAAGCAAAAGGATGCTGGGCAAAGGCAAATGACACAGCGTGAGCAAGTGG
TTGATTTACGGGCGCGAGGATTGAAAGGCGGAGCAGCACACAACATGCACATGTACAGATACCACGGCTAGAGTTCACA
TGGAGCTGCGCCCTCGCGGACAGTCTGTTTTTTTGACC

> SEQ ID NO:3053 216223 251521_301658_1
AGCTCTTGTTACCATCGTTCCAGCGCGCACAGCGCCTTTGGGCTCACCGTCCTCGCCACCCGGAGTAGCGGCGGCGGCG
GCGGCGGCGGCGGCGGCATTGGATCCGCCCCGGCAACGGCGGCGGCGGCAGCAGCAGCAGTAGCAAGAGAAGGAGGTTC
GTTTTCCGCAGTAGCAACCCTGGCGCAGAAGATTGGCAAGTCGATTCGAGGGCCTGGCGCCATGTCCAAGGCGCGGGTC
TATGCCGATGTGAACGTTCTTCGCCCCAAAGAGTACTGGGACTACGAATCGCTCTCGGTCGAGTGGGGCGACCAAGAAG
AGTATGAAGTGATTCGAAAGGTTGGCCGAGGCAAATACAGCGAGGTGTTTGAGGGCATCAATTGCGTCAACAACGAGCA
CTGCATCATAAAGATCCTCAAGCCTGGTCAAGAAGAAGAAGATAAAACGAGAGATCAAAATTCTCCAGAATCTC

> SEQ ID NO:3054 216223 273782_200145_1
aatccattacccaaatatataacattcccttccctcgtttgatggccgtacggccatttcacttctttgtttcattccg
cCACCACCACAACCATCGCCTCCTCTCTCCTTTCCGGCCACCTCTTCTCTCTTCCCCTCTCTCCTCCGTCAGTTTTCC
TCGAAAACTCCGTCGCTCTCTCTCACCCGACTCAAACACAAATCACCTTCTTCGTTACCTCCGCCGTCACCGTCATCTC
CTTATCTTCATCGACCGTCGGCGACTTTATCCGAAACCCTGGCGCAGAAAATAGGGAAATCTATTCGGCGTCCCGGTGC
GCCGTCCAAGGCCCGGGTTTATACGGACATCAATGTGATCCGACCCAAAGAGTATTGGGATTATGAATCCCTTACTGTT
CAATGGGGAGAACAGGATGATTACGAGGTGGTTAGGAAAGTCGGGAGGAGGAAAGTACAGCGAGGTGTTTGAGGGAATTC
ACACTACTAATAATGACAAATGCATCATCAAATTCCTTAAGCCTGTCAAGAAGAAAAAGATCAAGCGTGAGATTAAGAT
ACTGCAGAATCTTTGTGGTGGACCTAATATTgtGAAGTTACTCGATATCGTCAGAGATCAGCAATCGAAGACCCCAAGC
CTTATATTTGAATATGTGAATAACACAgATTTTaaagtgctgtatcCTaaTCTTTCcgacttcGATATTAGATATTACA
TCTATGAg > SEQ ID NO:3055 216223 208660_300807_1
GCCAGCATCCTTTTTCCCTTATCCTCAGGGGGTCGCTGATCCGTGACCGAGCCTGCCCAAGATGGCGCGCGTCTACGCC
GACGTCAACCAGAACATGCCCCGTAGTTACTGGGACTACGACAGCGTCAACATCAGCTGGGGAGTTCTCGAGAACTACG
AGGTCGTTCGCAAGATCGGCCGGGGCAAGTACTCCGAGGTCTTTGAGTGCATCAACGTCGTCAACTATCAGAAGTGCGT
CGTCAAGGTTCTCAAGCCTGTTAAGAAGAAGAAGATCAAGCGAGAGATCAAGATCCTGCAGAATCTGGCGGGTGGCCCC
AACGTCGTTGCGCTGCTCGATGTCGTGCGAGACTCTCAGAGTAAGACACCGTCTCTCATTTTCGAATATGTCAACAACA
CCGACTTCCGAAGCCTGTACCCCAAGTTCAACGACCTTGACGTGCGATTCTACATCCTGGAGCTGCTCAAGGCTCTGGA
CTACTGCCACAGCAAGGGAATCATGCACAGAGACGTCAAACCTCATAACGTTATGATCGACCATGAGAACAGAAAGTTG
CGTCTGATTGATTGGGGCTTGGCTGAGTTCTACCATCCTGGAACCGAATACAATGTGCGTGTTGCATCTCGTTACTTCA
AGG > SEQ ID NO:3056 216223 226241_300995_1
GAACCGACATCCAACATGAGCATGGAACCGCGATCGAAAAACCCGTACTCGGTTGCGCGGGTATTTGCGGACGTCAACG
CCAAAATGCCCCAGCAGTACTGGGACTACGATAACCTCACGATAACCTGGGGCAACATTGACAACTACGAAATCTACCG
CAAAATCGGCCGGGGCAAGTACTCGGAGGCATTTCAGGGCGTTTGTGTGGTCAACAAGCAGCAGTGTGTCATCAAGGTG
TTGAAGCCCGTGAAAAAGAAGAAGATTAAGCGAGAAATCAAGATTCTACAGAACGTGGCGGCTGGCCCTAACATTGTGT
CTCTTCTGGACGTGGTGCGTGATCCAGTCAACAAAACTCCCTCTCTCATCTTTGAGTACGTGGAGAATGTCGACTTCCG
ACAGGTGTTCCCCAAGTTCAAGGACTACGACATCCGATACTACATCTACCAGGTGCTGGTGGCCCTGGAGTACTCCCAC
TCCAAGGGAATCATGCACAGAGACGTTAAGCCCCATAACATCATGTACGACCCTCGACGGGCAAGGTGCGACTCATCG
ACTGGGGTCTGGCCGAGTTCTATCACTCGGGCACCTATTATAACGTCCGAGTGGCGTCTCGATGCTACA > SEQ ID NO:3057 216223 227890_301031_1
GTCGACCACGCGCGATTCTCTCTCCCCCACCCCCGAAACCCTAGCGCGACCTCGCCGCCGGCAATGGCCGCATGACCGA
TGCGCCTCCGCCGAGGAGCCGCCCGCACCCACCCAGCAGCAGCGTCGCCGTGCCCGCCGCCGCGGCGGCAGTGATCGCA
GCCGCCCTCGCGTCCTCCTTCCTCGCCCTGCTGCAGCCGCCCCGGCGCGCCCCGGTCGCCGCGGGATCCAGGGTCGGCA
TGTCGAAGGCGAGGGTCTACGCCGACGTCAACGTGCTGCGCCCCAAGGAGTACTGGGACTACGAGGCGCTCACCGTTCA
ATGGGGTGAGCAGGATGACTATGAAGTTGTCAGGAAAGTTGGAAGAGGTAAATATAGTGAAGTCTTTGAAGGCATCAAT
GTTAACAACAATGAGAAATGCATCATCAAGATACTCAAGCCTGTGAAGAAAAAGAAGATCAAAAGGGAGATTAAAATAC
TTCAGAATCTTTGTGGAGGTCCAAACATTGTGAAGCTTCTTGATATTGTCAGAGATCAACATTCTAAGACTCCTAGCTT
GATCTTTGAATATGTCAACAATACAGACTTCAAAGTGCTGTACCCCACGTTGACAGATTATGATATCCGCTACTACATA
TATGAGC

FIG. 2 continued

> SEQ ID NO:3058 216227 208414_300960_1
AAATCTTCAAGCTTCACTACAATCAAAATGCAGTTCTCCCTTGCCATCGCCGCCTCCGTGCTGGCTGCCACCGCCTCGG
CTGCTCCTGCAACCGTCTCCGGCACAAACACCAACGGCTCCATCTTCATGTTCGGAGACCCAGCTCCCGCTCGCAACCT
TCTCAACCAATTTGGTGCTTGCGGCCTCACCACCTACTTCGTCGGCCAGGTCCCCGACGACATGCCCCTGGTTGCTATG
CCCGCCAACATCTTCGACCAATTCGGCTCTGCTCAGCACAACACTCTCTGTGCCAAGATCATCACCCTCACCCGAAACG
GCGTTACTCGCCAGGCTGCTATTGCGGACCGCAACCTCAGCAACACCAACTCCATTGACATGACTCTTGATCTGTGGGA
GGCCTTTGGTGGACACGACAACGACGGCAGCATCATTCCTGGCTTCAGCTGGTCCATTGCCAACTAAGGAGTTGGTGGA
AGTGGCCTGCGGTTGAGTAGACTGCGACCTGTACATATTTCTACTCTCTTTCTGATGTATATATTTATGACTTTTGAGC
CCTCTCAGCAGGAGATTCTTGTATATATATGATCCTGCATGGGA

> SEQ ID NO:3059 216230 218029_300914_1
aactcatcctcacccTGCCATTCTCATCGCATCAACCGAAAGCATTTGCCATCGCACAATCGTCATTCAGCTACCAGAA
TTCCAGTTGTTCAATAAGGAGTCGCAATCATGGGTGGCGGAGATTTAAACTTGAAAAAGTCGTTTCATCCCGGTCTGCG
GCGGAACCAGCAGGCCGTCTACGAAGAAGAACAAAAGGCTCTCGCCGAGCGCAAACGAACCCAGCAGCGCATCAATGAG
ATCAAGGAGGAGCGCGCAAAGGAGGAGATCCAGAGACAGCTGGAGGCTGCGGGAGGCACCAAAAGGGTTGATCGCGTCG
ACTGGATGTACCAGGGCCCTACCGATGGCCAGGCTGGGACAACAGAAGAAACAGAGGCCTATTGCTGGGCAAGCGGAG
GATCGACAACCTCATCAAGGGCACCGACCACAAGAACCTCGAAAAGGCCGCTGGACAGGAGAGCTTCATTGCGCTGCAG
AACGCGAACAGCGCGCGCGACACAGCCGCCAAGATCCGCGATGATCCTCTGCTGGCCATCAAACGACAGGAACAAGCCG
CGTACGAGGCCATGATGAACGACCCCATCAGACGCCGCCAGCTCCTCTCGTCCATGGGCATCGACGATGGCAAGAaGAa
ggaccgagATGGAGACGGAGACGGACA > SEQ ID NO:3060 216234 208622_300807_1
gttttttgtTTTTTTTTTAATCTACTGGTATCAGATACTAACACTGGACtAcAATAGGCTCACATGCTTGACGTGGAGTG
CTTCACCTATTTAAACCGAGCATTGGAATCACACCTCGCCCCCATTGTGGTTTTGGCATCCAACCGTGGAATGTCCACA
ATAAGAGGTACCGACGACGTTGTCGCGGCTCATGGCATTCCTCCTGACTTCCTTGCCCGAATGCTCATCATCCCCACCT
CCCCATACTCGGCAGACGAGATTAAGAAGATTGTCAAGCTCCGGGCCACGACAGAGGGTGTGTCTATTACGGACGCTGC
CATTGACAAAATTTCCGAGCACGGTGTCCGTGTCAGCTTAAGATACTGgCTACAACTgctGaCACCCTCAAGCATTCTT
GCCAAGgcgAATGgccGTACTCAGATTGacGTCCAGGATGTGTCCGAGTgcgAaGATCTTTTCCTCGACGCCCgccgta
gcGCCTCGCTTCTTgctagcGAAGCGGGACGGGGCTATCTgtaACCTTGATTTgagATgagAAGCTGtagacgagCAgg
gctagatcGGGTGAAGGGGgaggatCTCATTgtgaaagaTgacgcTGGgcgg > SEQ ID NO:3061 216237 208607_300807_1
GACAGCCTGAAACCGCGAGTACAAGCATGGGGTTGGAAGCTCGACGTGTGAGCTCTCCTTTCGTCTGCCGTCAAAAAGT
CGATGCCAAGGAGGGTATTGCAGATGTGTTGTTGGCCATCAGCTTACCACTGGAGAGATCCAAGCAGTCATCCCGTGTG
CAGGCACAAGCCCAGTAAGCCGCTGCTCCCAATATGGACCACGTCAGCCATGCCGCCAACCGAGTCCCTCACCGTCTTC
CAAGATGGAGATGCTGTAGGGCTCACCCAGCGGTCGAAACATACCGCCTGTCTGAGGCCCCCTCCAGGGCATTTGCTAG
CCGACCTACTGTACTCGTGTCTCGTACACGGCAGTCGAATTGGTATACCTCCTCCGAAGCTGGTTCGTCATGCGCATGA
AAAGCGGTGTAGCGAGCAAGACTCAGCCGGCCAATCACGAATATCTCGGGCATCCTTGTCCGTCCAGGAATAGGCACAC
ACTCGAAATTAAGCT > SEQ ID NO:3062 216240 220729_300938_1
gggcggacgcgtgggctcagctataactggaatgattgccggttctgggaaacttgttctctcttacaatactagctct
aAGTCGAGATTCAAATTCAAAACCAAACAAGTTATCGTGGCCATGGGTTTACACGAACGACGCTTGCGATTCAACTGGT
GCCCATTAGGAAAGAGAAAGGAAATCAGTTGAAAATGCTGGCATGAGAACACTTTACAGCGAACGATTGTAAATATCAA
AGTGACAAAATCAAGTATCATGGAGCCAGGAAGCGCAAATGTCTTTGTTCTATGCTTCTCGAACCTTTGGCTACTAAG
ATTATAGACATGGCTGTTGCCAAATTAAGCGATGGAAAATTCATTGTGGTTCACATAAagaaAaAAAAaaacaa > SEQ ID NO:3063 216241 211112_300896_1
gacccacgcggcgGTCTTGTTGAACGGAAGGAAGTAGCCAATCCGTCAACTCCAGACACAATCTCTGCCCTCCTCTGGC
CTCACAATGTCCGCCATCTCCCGCAGCATCAGATCAGCATCCAAGCTGCGAGTCCAGTCGCGAGCCGCAAGTGGTCTCT
GCTCGGCCTCCATCGGCGCCGCTCGCTTTGTCTCGTCCGGCTTTGCTGTGCCTTCAACCCCCGCCTCGCGCAGCAACTT
CTCGACTTCCATTCCCAAGCTTTCTGGAGCGCCCATCATGTCTTCCTCGCCGCGAGTACGACCTCGAGATCAAGGACATT
GCCGACTATGTCGCCAACAAGACAATTGACTCTGAGCTAGCTTTTGACACTGCTCGATGGATTCTCCTCGACACCCTCG
GCTGCGGTCTTGAGGGCCTCCGCTTCAAGGAGTGCGCCAAGCTGCTGGGCCGATTGTCCCTGGCACCGTCGTGCCCAA
CGGCACAAAGGTTCCCGGCACTCCCTTTGTGCTGGATCCCGTCAACGGAGCCTTCAACATTGGCGCCATGATCCGATGG
CTCGACTTCAACGACTGCTGGCTGGCCGCCGAATGGGGCCACCCCTCTGACAACCTGGGTGCCATCCTGGCTGTTGCTG
ACTGGATCAACCGCACCAACAAGGCCGGCGGCAACCTGGCTGGCGGCAAGATCTTCACCATCCGAGACGTGCTCGaGGG
Catg

FIG. 2 continued

> SEQ ID NO:3064 216241 258694_301698_1
GGATCAAGACACACAATGCGAGCTTTCAGATCTGCCGCCAACTTCGGAGCTGCTTCTAACATCTACCGAAAGTCCTTCA
CCCCCGCTTCTATTGCCTCTAACCGATTTGTCTCTGCCAGAATGAGCTCCATCATGACCGACAACGCCCGACCTAACAC
CGACAAGGTTGTTCAGGACATTGCCGACTACATCCATGACTACAAGATCGACTCCTCCGTCGCCATGGAGACTGCTCGA
CTCTGTTTCCTTGACACTCTCGGCCTGTGGTCTTGAGGGTCTCAAGTACCAGCAGTGTGCCAACATTGTTGGCCCCGTTG
TTCCCGGCACCATTGTGCCCAACGGAACCAAGGTCCCCGGTACCGACTACCAGGTTGACCCCGTCGAGGTGCCTTCAA
CATTGGTACCATCATCCGATGGCTCGATTTCAACGACTGCTGGCTCGCCGCCGAGTGGGACACCCCTCCGATAACCTT
GGCGGTATCCTTGCCGTTGCCGACTGGCAGACTCGATCCGCCAAGGCCGGTCTTGAGGGCAAGGTCTTCAAGGTCAAGG
ATGTCCTCGAG

> SEQ ID NO:3065 216242 208495_300960_1
GCTCGTTATTATCTTTTGTGTTTAATCGGTTGATTGAGAAATCATGGCGACGACTGTGTCGGAGGCGCCCAAGATGGGC
ATTGAGATGATGCTGGAGCGCATCATGGGCGCGATGGAGAAGCAGAACCAAGAATTGACTGAGCTGCGAAAAGAATGCT
CAGATCTTCGTACGTCGAACAAGAGCATGGAGATTATGCTCCAGAACATTGCTCAAGGACGCAGCAATAGCCCTCCGGG
TCTCTCCGCCGGCATGTCTCCCAGCATTGGCCGCGAGCGAGCCCGCTCGCCTTTCTTGCCTCGCCGCTCCACAGCCCCC
CAGGCTGGTCCTTCTCAGGTCTTAATCACATCGCCCTCTCACGATATCACCACCCACTCTTTTCCCTTCCCGGATGATC
GTGAGATCCCCGGATTCTACGTCGTCATCCCTGCAGGCGGTGCTGGTACCCGCCTGTGGCCCCTCTCTCGCGAGAACCA
CCCCAAGTTTCTCCTCGATGTCAACCTTTGCGGCAACAGCTTGCTGCAGTCGACCTGGGAACGACTTCTTCCTCTGGCT
GGCCCTTCACGAATGACTGTCGTCGCGGGACCTGCTCACTCCGAGGGCATTTTGGGC

> SEQ ID NO:3066 216246 208648_300807_1
aaaggaaacgctcaaaggtacgtttattacgggggacagctgcgagactcccatcagccataagaaaaccaaagaaaaa
cGGGGTTTgttCATCATGTCACATCCACCACCTCCAGGCACGAATCTCCCTGCGCGCCCGCCCGCCAGCACATCGAGGC
CGGGCTTCAGATCGAGCTTCAACCCGTCGGGCCAGAATTCTGCcGCCCCGGTATCATCGTCGTCGACGTCGTCGTACTC
GAATGcaAACTCCGCGCGAGCAGCCGCCGCCTCGAGCTACCCAGCTGCCCAAACCCACTATGGCTCGTCCTACTCGAGC
TATCCTAGCCACGGTGCGGGCTCGTCCGTGAACCgctCTggtTCGGGATACTCGTACCCTCAAGCAGGCAATCAGCAGC
AACACTATCCCCAGCAACAACAAGCGCAAAGCTACGCCCTCATGCCTATTCGCAGCAACAACCGCaGTCGTACCAGGG
CCAGTCATACCAGGCTCAgcCATACCAAgggcAGCagtacCAAGCAgcaccgcgtaTccagaaCCCTTTTcCtacgccG
GGTGCTGCTgctgccgctggAccCGAtta > SEQ ID NO:3067 216256 209165_300812_1
AGCGCAGCAACAGCCCACGGGACAGGCGGGAGGACAGTCGCAGTCGGGACAATCTCAGTCGCAGGTTCCCCAGCACAAG
CGCGTCTACCAGGCGTGCATCCCGTGCCGTCGCCGCAAGGTGCGCTGCGACCTGGGCAGGGTCGACAACCCGCACGACC
CGCCGTGCGTGCGCTGCCGCCGCGAGAGCAAGGAGTGCTTCTTTAGTGCTACGCGCCGCAAGAGAAAGACGGACGAGGA
CGACAGCGATGCCGACGAGTACGTGGTGCGCAACGGCCGCAAGAAGCTGCACGCCGCCGACAGCCCGCCCTTTTCGCGC
TTCGACAAGCGCCAGTACACGCGACACGCCCCTGACCCCCGGGGGATCCCATGGCAGGACCCAGCCGCTGCGCAGGC > SEQ ID NO:3068 216257 208662_300807_1
agtgacggcactttttcgacgacgaATTGACGAGCAATTGATCGATACACGCGGTTCCCGCTGCCAGAACAAGTCAAGAT
GGTTTCTCAGACTCCCTTCCGCGCTGCGGAATTCAAGAGCGCCTACGGCCCCAAGTACGCTTTCCAGCCCAACTACCGC
GGCATCACCGTCCAGACTGCCACCCGATATGGCTTCCGAGCTGCCACCATCGGCGGTGGTCTCGGCGTTGCTCTGATGC
TCTTCGCCTCCAGCCTGCCCCGTGTCCGTTCTGACATCCTGCTAAAAATCCCCTTGGTTGGCGGCTTCTGGGAGAAGCA
GGAGGTTCACCCTGCCGACAACCCTTTCTAAATGCACTTGTTGGATGGTGTTTGTAAAATTGTAACAAGGCTTTGCGCA
GCTTGCCTTTGTATAAGAGATACACAATAGACTTTTCCTAAACCaaAAAaaaaAaagaa > SEQ ID NO:3069 216259 217553_300909_1
GGTTAATTTCGGATTGCCACAGAATAGGAGACTTGCCACTCCGGTGGTTATTCTCGGCATATATGCGACGTTAGAATAA
CCTGTTTAATCGTATATAGTCACTGTGAAGGAATCCATGAGGGCAATGTTGATGAATGTTGTCAGTGAAGTTGGAAGTA
TAGAACTTAGCCGGCTACAAACTAAAGAGCGTTGCCCAAAATGAAGCCCTATCCATTCCAATTCAACAGCACATCCTC
GT > SEQ ID NO:3070 216262 218530_300919_1
AGGGACTGCTGCTGGCGGCCATCCGAAGCAATGACCCCTGCATCTTCATGGAGCCCAAGATCCTGTACCGAGCCGCCGT
GGAGGAGGTCCCCGTGGCGCCGTATGAGTTGCCTCTGTCCAAGGCGGAAGTCATCAAGGAGGGCAAGAACGTCACAATT
GTTTCATATGGTCAGCCGTTGTACAACTGCATGGCGGCCATCAAGCAGGCAGAGGAGGATTTGGGCATCTCCGTCGAGC
TGATTGACCTGCGCACAATCTATCCCTGGGACAAGAAGACTGTGTTTGAAAGCGTTCAGAAGACTGGAAGAGTCCTGGT
CGTCCATGAGTCTATGGTGAACGCTGGTGTTGGTGCCGAGGTGGCTGCCGCCATTCAAGAGAACGCAGATACCTTCAAC
AGGCTCGAGGCTCCCGTGTCTCGTGTTGCTGGATGGAGTATCCACAACGCTCTGATATTCGAAAAGTTTCACGTCCCAG

FIG. 2 continued

ATGTTGCAAGAATTTACGACAGTATTAAAAAGACGGTTCAGTACTAAGAATGTGGGGAGCGAGTAACGTGTGACTTTAT
CTTTGAATTTCTAGAGCTTCTTCCTAGCATAAGTGTAAATAATAGAGAATAAAGCTTTCTGTAACACAC

> SEQ ID NO:3071 216268 103453_300026_1
tggtatcaacgcagagtgccattacgccggggactcACAACAGAAATAGCTACTAAACAAACAGCAAAAGATAACCAGA
AAAGATGGCGACTTTCCCTGTTGTTGATTTGGGGTTGCTTCAAACTGGGAAAAGGGCTGAAACATTGGATAAAATCAAA
GATGCATGTGAAAACTGGGGTTTCTTTGAGCTTGTGAATCATGGGATTTCCCATGAAGTGCTGGACACAGTTGAGAAGC
TTACTAAGCAGCATTACAAGAAATGCATGGAGCAAAGGTTCAAGGAAATGGTGGCAAGTAAAGGTCTTGAGGCGTCCA
AACTGAGATTGATGATCTGGATTGGGAAAGCACTTTTTACTTGAAACACCTCCCTGTTTCCACTGTGTATGAAGTTCCA
GACTTAGAGGATAAATACAGAAATGTTATGAAAGACTTCGCGTTGAGGCTAGAGAAACTAGCTGAAGATCTTCTTGATT
TGCTGTGTGAAAATCTCGGGCTCGAGCAAGGTTATTTGAAGAAAGCATTTTATGGTTCAAAGGGTCCAACTTTTGGTAC
CAAAGTTAGCAACTATCCTCCTTGCCCCAAACCAGAACTGATCAAAGGCCTACGTGCTCACACTGATGCTGGTGGCCTA
ATCCTGCTTTTccaaGATGACAaAGTCAGTggTCTTCAGTTACTGAAAGacggtaATTg > SEQ ID NO:3072 216268 209068_300811_1
GACACACAGACGCACTCACACACTCAGCTGAAGCGAGCGAGCGAGTGAACGAGAGAGAGAGACAGAGATGGCGAGTGTT
GCCTCCTTCCCGGTGATCAACATGGAGAACCTGGAGACCGAGGAGAGGGGCGCAGCAATGGAGGTCATCCGCGACGCCT
GCGAGAACTGGGGCTTCTTCGAGATGCTGAACCATGGCATCGCGCACGAGCTGATGGACGAGGTGGAGCGGGTGAGCAA
GGCGCACTACGCCAACTGCCGGGAGGAGAAGTTCAAGGAGTTCGCGCGGCGGATGCTGGAGGCCGGCGAGAAGGGCGCC
GACGTGAAGGGCATCGACTGGGAGAGCACCTTCTTCGTCCGCCACCGCCCCGTCTCCAACCTCGCCGACCTCCCCGACG
TCGACGACCACTACAGGCAGGTGATGAATCAATTTGCGTCGGAGATCGAGAAGCTCTCGGAGAGGGTGCTGGACCTGCT
GTGCGAGAATCTGGGCCTGGAGAAGGGTTACCT > SEQ ID NO:3073 216268 11073_300288_1
CTCGAGCTTGCGGCCGCCAAGCTCAATGGGGAAGAGAGAGACCAAACCATGGCTCTAATCAATGAAGCTTGTGAGAATT
GGGGCTTCTTTGAGATAGTGAACCATGGATTACCACATGACTTAATGGACAAGATCGAGAAGATGACAAAGGACCATTA
CAAGACATGCCAAGAACAAAAGTTCAATGACATGCTCAAGTCCAAAGGTTTGGATAATCTTGAGACAGAAGTCGAAGAT
GTCGATTGGGAAAGCACTTTCTACGTTCGTCACCTCCCTCAATCAATCTCAATGACATTTCAGATGTGTCTGATGAAT
ACAGGACGGCCATGAAAGACTTTGGTAAGAGACTGGAGAATCTTGCTGAGGATTTGTTGGATCTACTGTGTGAGAATCT
AGGGTTAGAGAAAGGGTATTTGAAGAAAGTGTTTCATGGAACAaa > SEQ ID NO:3074 216268 124507_300423_1
GTAATATTCGCTATTCTATTAATTTATTGTATCACATTTTTCACACACTCAAAAATTAAACACATATTTTACCAAGAAA
GCTATGGAGAACTTCCCAATTATCAACTTGGAAAAGCTCAATGGTTCTGAGAGAGCTGACACCATGGAAATGATTAAAG
ATGCTTGTGAGAACTGGGGCTTCTTTTGAGTTAGTGAACCATGGTATTCCACATGAAGTAATGGATACAGTGGAGAAAT
GACAAAGGGACATTACAAGAAGTACATGGAACAGAGATTTAAAGAATTGGTGGCTAGCAAAGGTCTTGAAGCGTGCAA
GCTGAGGTTACTGATCTTGATTGGGAAAGCACTTTCTTCTTGCGCCATCTTCCTAATTCTAACATTTCTGCAGTACCTG
ATCTTGATGATCAATACAGGGAAGTAATGAGAGATTTTGCTAAAAGGTTAGAAAATTTGGCAGAGGAGTTACTGGAGTT
GCTATGTGAAAATCTTGGCCTTGAAAAAGGCTACCTGAAAAAGGTGTTTTATGGGACAAAAGGTCCCAATTTTGGAACT
AAGGTTAGCAACTATCCTCCATGCCCAAAACCAGATTTGATAAAGGGACTGCGCGCCCACACAGATGCaggtggtATAA
tccttCTCTtccaagatGACAAAgtaagtggccTtcaacTcctc > SEQ ID NO:3075 216268 176055_300524_1
CCCCCCCGGCACACACAGACACACAGACGCACTCACACACTCAGCTTAAGCGAGCGAGCGAGTGAACGAGAGAGAGAGA
CAGAGATGGCGAGTGTTGCCTCCTTCCCGGTGATCAACATGGAGAACCTGGAGACCGAGGAGAGGGGCGCAGCAATGGA
GGTCATCCGCGACGCCTGCGAGAACTGGGGCTTCTTCGAGATGCTGAACCATGGCATCGCGCACGAGCTGATGGACGAG
GTGGAGCGGGTGAGCAAGGCGCACTACGCCAACTGCCGGGAGGAGAAGTTCAAGGAGTTCGCGCGGCGGATGCTGGAGG
CCGGCGAGAAGGGCGCCGACGTGAAGGGCATCGACTGGGAGAGCACCTTCTTCGTCCGCCACCGCCCCGTCTCCAACCT
CGCCGACCTCCCCGACGTCGACGACCACTACAGGCAGGTGATGAAGCAAT > SEQ ID NO:3076 216268 157859_301743_1
AAAATACATAGAAAGATGGAGAGTTTCCCAGTGGTTAACATGGAGTTGCTTAACACTGAACAAAGGGCTGCAACAATGG
AGAAAATTAAGAATGCTTGTGAGAACTGGGGCTTCTTTGAGGTGGTAAATCATGGGATCTGTCATGAGCTTCTGGACAC
AGTGGAGAAGTTGACAAAGGGACACTACAAGAAGTGTATGGAACAAAGGTTTAAGGAAATGGTTGCAAGTAAAGGGCTT
GAAGCTGTTGAGACTGAAATAAAGGATTTGGATTGGGAAAGTACTTTCTTCTTGAAACACCTTCCTGTTTCAAATATCT
CAGAAGTTCCTGATCTTGAAGATGAATACAGGAATGTAGGGAAAATCATGAAGGAGTTTGCTGAAAAGCTAGAGAAATT
AGCAGAGCAACTTTTGGACTTGCTCTGTGAAAATCTAGGACTGGAGCAAGGTTACCTGAAGAAAGCCTTTTATGGTTCA
AATGGTCCTACTTTTGGCACCAAAGTTAGCAACTATCCACCATGTCCCAAGCCTGATTTGATTAAAGGCCTTAGGGCTC
ACACTGATGCTGGTGGAATCATCCTTCTATTCCAAGATGACAAAGTCAGTGGTCTCCAACTACTCAAAGACGACAAATG

FIG. 2 continued

```
GATCGACGTTCCACCAATGCGCCACTCCATCGTCATTAACCTCGGAGACCAACTCGAGGTGATTACTAATGGAAAGTAC
AAGAGTGTGGAGCATAGGGTGATTGCTCAGCCTGATGGAAACAGAATGTCCCTAGCTTCATTCTATAACCCGGGGAGTG
ATGCTGTCATCTATCCAGCACCAGAATTGTTGGAGAAACAGAACAAAGTCATTTATCCTAAGTTTGTATTTGAGGACTA
TATGAAATTATATGCAGGTCTTAAGTTCCAGGCTAAAGAGCCAAGGTTTGAAGCAATGAAGGCTGTGGAAACTACTGTC
AACTCTGCCCCAATAGCTACTGTTTGAGACTTTGATGGAGTATTAatTagaaAACTGATtaaTGagaagaaaATggctt
agtAttaagattATGATGATGTATTGATGAT > SEQ ID NO:3077   216268 141827_300429_1
cccgACTAGATTCTTAATACACAACCCAGCTGGTGAAAGAGAGGAACTTGAGAGTTAGCTAGCATGGCGGCAGCATTGT
CGTTCCCGATCATCGACATGAGTCTGCTCGACGGGGCAGAGAGGCCCGCGGCGATGGGGCTGCTCCGCGACGCATGCGA
GAGCTGGGGCTTCTTTGAGATCCTGAACCACGGCATCTCGACGGAGCTGATGGACGAGGTGGAGAAGATGACCAAGGAC
CACTACAAGCGTGTGCGCGAGCAGAGGTTCCTCGAGTTCGCGAGCAAGACGCTCAAGGAAGGCTGCGACGACGTGAATA
AGGCGGAGAAGCTGGACTGGGAGAGCACCTTCTTCGTCCGCCACCTCCCGGAGTCCAACATCGCCGACATACCCGACCT
CGACGACGACTACAGGCGCCTCATGAAGCGCTTCGCGGCGGAGCTGGAGACGCTGGCGGAGCGGCTACTGGACCTGCTC
TGCGAGAACCTCGGCCTCGAGAAGGGCTACCTCACCAAGGCCTTCCGTGGCCCCGCGGGCGCACCCACCTTCGGCACCA
AggTCAGCAGCTACCCGCCGTGCCCGCGCCCCGACCtcgTCaagggCCtccGCGCCCACACCGACGCcggcggcATCAT
CcTGCTCtTc > SEQ ID NO:3078   216268 267836_200119_1
CCCCTCGACCACGCGTCCGGGAGATTCCGGTGATAGACTTCAGTAAGCTTGACTGTGAGGAGAGAAGTGCAACCATGAC
ACTTCTCCATCACGCTTGTGAGAAATGGGGCTTCTTTATGATAGAGAACCATGGAATTGACACTAACCTGATGGACAAT
GTGAAGCAGTACGATAANTAGCACTATGAAGCCAATATGAAGAAACGGTTCTATGAATCAGAGCTACCTATGAGCTTAG
AGAAGAAAGAAAAACTCAGCAACACAGACTGGGAAAGCACCTTCTTTCTTTGGCATCGTCCAAGTTCTAACATCTATGA
GATTGAAGGTCTCTCAAAGGATCTTTGCAACGCAGTAGATGGATACATTGATCAGCTGATTAATCTTGCTGAAAATCTT
TCAGAACTAATGTGTGAGAACCTTGGCCTAGAGAGGAGTTACATTAAGGAAGCATTTTCAGGAAGCAAGGGTCCTTCTG
TTGGAACAAAAGTGGCAATATATCCTCAATGTACGCGCCCTGAATTAGTCAGGGGATTGCGTGAGCACACAGATGCTGG
TGGTATCATTCTCTTACTCCAAGACGAACAAGTTCCTGGTCTGGAATTCTTTAAAGATGGACATTGGGTGAAAATTCCA
CCTTCCAAGAACAACAGAATTTTTGTAAACACTGGTGATCAAATCGAAATTTTAAGCAATGGGAT > SEQ ID NO:3079   216268 56232_300126_1
AACAAAAGTTCAATGACATGCTCAAGTCCAAAGGTTTGGATAATCTTGAGACAGAAGTCGAAGATGTGGATTGGGAAAG
CACTTTCTACGTTCGTCACCTCCCTCAATCCAATCTCAATGACATTTCAGATGTGTCTGATGAATACAGGACGGCCATG
AAAGACTTTGGTAAGAGACTGGAGAATCTTGCTGAGGATTTGTTGGATCTACTGTGTGAGAATCTAGGGTTAGAGAAAG
GGTATTTGAAGAAA > SEQ ID NO:3080   216268 283443_200093_1
aaacagcaaaagataaccagaaaagatggcgactactttcccagttgtgGATTTGGGGTTGCTTCAAACTGAGAAAAGG
GCTGAAACAATGGATAAAATCAAAGATGCATGTGAAAACTGGGGTTTCTTTGAGCTTGTGAATCATGGGATTTCCCATG
AAGTGTTGGACACAGTTGAGAAGCTTACTAAGGAGCATTACAAGAAATGCATGGAACAAAGGTTCAAGGAAATGGTGGA
AAGTAAAGGTCTTGAGGCTGTCCAAACTGAGATTGATGATCTTGATTGGGAAAGCACTTTTTACTTGAAACATCTTCCT
GTTTCCACTGTGTGTGAAGTTCCAGACTTGGAGGATAAATACAGAAATGTAATGAAGGATTTCGCGTTGAAGCTGGAAA
AACTAGCTGAAGATCTTCTTGATTTGCTGTGTGAAAACCTCGAACTCGAGCAAGGTTATTTGAAGAAAGTATTTTATGG
CTTAAAGGGTCCAACTTTTGGTACCAAAGTTAGCAACTATCCTCCTTGTCCCAAGCCAGAACTGATCAAAGGCCTACGC
GCTCACACTGATGCTGGTGGCCTAATCCTGCTGgttcAagacgAcAaagtcagtggtcttcaGTtAcTgaacgatggca
aatggaTTGatgtccCACCTATGAAACACTCAATtgacatcaaCcttggcgaCCAGCTCGaggtgaTAACAaatGGAag
atacaagagtatTGAGCACagagttATT > SEQ ID NO:3081   216268 43466_300031_1
cccacgcgtccgcTTCATATCTTCTTATTCATACACTAAATAAAAGCACATTTCTTCAATTCATTCTGCAAGAAAGATG
GAGAATTTCCCAATTATCAACTTGGAAAAATTAAATGGTTCTGAAAAAGCTGCCACCATGGAAATGATTAAGGATGCTT
GTGAAAACTGGGGCTTCTTTGAGTTGGTGAACCATGGAATCCCACATGAAGTAATGGACACAGTTGAGAAATTAACAAA
AGGGCATTACAAGAAATGCATGGAACAGAGGTTTAAGGAATTGGTGGCCAGTAAAGGTCTTGAAGGTGTACAAGCTGAG
GTTACTGATATGGATTGGGAAAGCACTTTCTTCTTGCGCCATCTTCCTGTTTCTAACATCTCTGAAGTCCCTGATCTTG
ATGATCAATACAGGGAGGTTATGAGAGATTTTGCTAAAAGATTAGAGAATTTAGCAGAGGAGCTCTTGGATTTGCTCTG
TGAAAATCTTGGTCTAGAAAAGGGATACTTGAAAAAGGTATTTTATGGATCAAAGGGTCCAAATTTTGGGACTAAAGTT
AGCAACTATCCACCATGCCCAAAACCAGATTTGATTAAAGGACTGCGCGCCCATACGGACGCTGGTGGCATAATCCTTC
TCTtccaagaTGACaaagTAAGC
```

FIG. 2 continued

> SEQ ID NO:3082 216272 218115_300915_1
aacaaataaatcaaggtttcgcctcgctgattccagtctagaaaccaCTGACTCGCCGCTGCTTCGTAAGATCAAGCAA
GTGTACAATCATCTCATTCTCTATCTACTTATTAGTCATGGGGAAAAGAAGCGAAAGTGAAAGCGGCTCAAAGCCGGAG
CGGGAAGAATCTCACGGCGCACCGGCTGAGCTTCCGCAAGAGGTGATCCCTTTCGACCCGGTGCCGACATACGAAGAAT
CGAGGCCAGGGCCATCGGATTCGGCCTCACTTTCCGTCTCCCATTCACTCTCTGCCACAGTCTCGGCATCAACACCGCA
GCCGCCGGCCGGAACCTCAGCCCTGGCCCCAACCGTTACCTCGCCATTTAATTTCCCTACCGATGGCAAAGGCAAAGAC
GGCTCCGTGAATGCTCCTCCACCAGTCTACAAGGTCGGGTCATCCAGTAGCAGCTCCAGCGCCGCCCGAACCATTGCCT
TTCCTCAGATCAAACCAGATCCAGACTCGCCTTTCCTGGTGGCCTATGCCCCTGTTCTTCTCAGCTATGGCATCACCGA
AGAAACATGGCGGTCTTTCATGACCACCATCTCGGCTTTCCTGACGGCCACCATCTCAGATCGTGCCCTATCACATGCC
ACCGATGTAGCTGCTCACAttggccaaaaTCCCAAAAACTTGGGCAGAAATGTTgctgcccATGCCAAATCCATCGgCA
GGAaCGtgtCGgaca > SEQ ID NO:3083 216283 122085_300015_1
cccccccgggtgcttttgcttcggtcgcccggtcagtgctGCAGACAAGCCACCCCCTTCCTCGCGTAGACTGCTCCC
CCCACAAACAAAAGCAATCCTAATCTCGGATTCGAGGCGAACGAGCGGCGGCGAGGGAGGGGGACTAGCGGCGATCGCG
ATTGGAGTCGGGTGGACACCGATCGCGGCGGCGCTCTGGGGGATCGGGGTGTGGAATCGAGGGGGAGGGAGGAGGAGAC
GGAGGCGATGGGGCGGCTGTTCGTGATGCACCTGGAAGGGAAGGTGTACAGCTGCAAGCACTGCCACACGCACCTCGGC
CTCTCCTCCGACATCATCTCCAAGTCCTTCCATTGCAAGCACGGGAAGGCGTACCTCTTCAATAAGGTTGTCAATGTGA
CTTCTGGAGTAAAAGAGGATCGCATGATGATAACCGGAATGCATACTGtgTCTGATATCTTCTGTGTTGGCTGCGGATC
CATTGTTGGATGGAAATATGAAGCTGCACATGAGAAGAGCCAgAGGTAcaAgGAAGGGAAATTTATTTTAgaGAGGTAT
AAGGTGTCTGGTCCTGATGGCAGCcACTACTTTGTTACACATGATGCTCATGttGGGGGAAGCGACGTGGACGACGTAT
GAAGCACAACTCGACATGCTCAAGC > SEQ ID NO:3084 216283 255060_301641_1
GAGAGAGAAAGAGAGAGGAGCATAGCAAAGCCAAGCCAAGAGATAGATAGATAGATAGATAGATAGATAGAGAGACAGC
ATAACCAAACCAAGCCAAGAGAGAGAGAGAGGAGCATAGCAAAGCAAAGCCAAGCCTCCTTCATGGGTTTCCCTGGN
TGAAAGGTATCCATTTTTTTCCTAGAGTGGGGGAGATATCATAATTATACATATGGGAAGGCTGTACTTAGTGCAGCTG
GAAGGCAAAGTCTATGGCTGCCGCTTCTGCAAGAGTCACTTGGCCAGCTCTAGCGAGTTAGTCTCAAAGAGTTTTCATT
GTAAGAATGGGAAGGCATACCTTTTCAATACAGTAGTCAATATTTCCCAGGGGCCTCAGGAAGACCGGATGATGGCAAC
AGGACTACACCGGGTTTCTGACATCTTTTGCAAAGGCTGCCATCAGCTTGTTGGCTGGAAATATGAAGCTGCATATGAA
GAGTGTCAGAAGTATAAGGAAGGGAAGTTTATTTTAGAGAGTACAGAGCAAGGACAATAGATGGAGATGGTACTCAATT
CTTCTTGGATGTGAGTCAAGGCAGCAGTGATGGAGAGGAGGCCTGATAC > SEQ ID NO:3085 216284 250191_301599_1
tctttcgtcgctgcggcgcgtcttctctcgatctccaggtgatagagggccgccgtcatgtctgcgcgcaagaagatcc
aGAAGGAGGAGGGGAAAGAGCCGGATTCTTTCGAGCTCACGGTTGCCCAGGCTCTGTCTGAGCTGGAGGGCGCAAACCA
GGAGCTTCGAGGAGACCTGCGCGACCTCTCGATCAATTCGGCGATGGAGGTTGATGTCTCTAGCAACCGCAAGGCCGTC
GTGATCAACGTACCGTACCGCTTAAGAAAGGCGTACCAGAAGATTCAACCCAGACTGGTGCGAGAGCTTGAGAAGAAAT
TCAGCGGCAAGGACGTGATCTTGATCGCAACCAGGCGCATCCTGAGGCCCCCGAAGAAGGGCGCCGCCGTGTCTAGACC
GAGGAGCCGAACTCTCACCGCTGTGCACGACGCCATCCTTGAGGACCTGGTCTACCCCACTGAGATCGTCGGCAAGCGC
ATCCGGTACCGCTTGGATGGCTCCAGAATTCTGAAGGTTTACCTTGACCCGAAGGAACGCAACAGCACCGAGTACAAGG
TGGAGACGTACTCGGGCGTCTACAAGAAGCTGACTGGCAAGGATGTGGTGTTTgAGTTTCCCGTGCAAGAAACGGCCTA
GACTCGTAATGGAGCATTTCCCTTTTTTTgctCTGATGAGTGGCTTAAGCGCTAAAAATTTTgacTTTTGGTTCTTAA
GTGGGGTTTccAGTTTCGGGCcGGTTTgacGGCTTCTCGAATACATGgTTTtccATTATGGGCGTC > SEQ ID NO:3086 216284 280447_200067_1
cacacacacacacaccagctctgtagttgcctcttacccgcagatctgtgaagatgtacacgtcaaagcaaaagattca
cAAAGATAAAGATGCTGAACCTACTGAGTTTGAGGAGTCTGTTGCGCAGGCTTTGTTTGATTTGGAAAACACCAATCAA
GAGCTGAAAAGTGAATTGAAGGACCTATACATCAATTCAGCAGCTCAAATTGATGTGTCAGGAAACAGGAAAGCTGTTG
TTATCCATGTGCCCTACAGACTGAGGAAAGCTTTCCGCAAGGTTCATGTTCGCCTTGTTAGGGAGTTGGAGAAGAAATT
CAGTGGCAAGGATGTAATTTTTATCGCCACTCGGAGGATAGCTAGACCTCCCAAGAGAGGTTCAGCTGCTCAACGACCC
CGCAGCAGAACTCTTACTTCTGTTCATGATGCCATATTGGAGGACTTGGTTGTTCCTGCTGAGATAGTTGGGAAGCGCA
CTAGGTATCGCATTGATGGCTCCAAGATAATGAAGGTGTTCTTGGACCCCAAGGAACGCAACAACACCGAGTACAAGTT
GGAGATTTTTCAGCCGTTTACAGAAAGCTTTCAGGCAAAGATGTTGTGTTCGAGTACCCCATCACTGAGgCATAAGGA
AACAAAATGCTTATCTTCATCAATTTGATGTGAAACTACAGTTTAGTGGTTCCTTTGAAATTTTGACAATTTCATTTTG
TTTAGAaTGCagagaacCATGTGaagtttcTAttGATTtcaCttataac

FIG. 2 continued

> SEQ ID NO:3087 216284 258418_301696_1
ACCCACACACAACCATGTCTGCCGCCCTCAAGATCATCAAGCAGGACCCCTCCGAGCTCGAGCTCCAGGTCGCCCAGGC
CTTTGTCGACCTCGAGAACTCCTCTCCCGACTTCAAGTCCGAGCTGCGACTTTTCCAGTTCAAGTCTGCCCGAGAGCTT
GAGGTTTCTGCCGGCAAGAAGGCCCTCGTTATCTTTGTGCCTGTCCCCGCCCTCCCCGCTGTCCACAAGATCCAGCAGC
GACTCACCCGAGAGCTCGAGAAGAAGTTCTCCGACCGACACGTTGTCTTCCTTGCTGAGCGACGAATCCTCCCCAAGGC
CGGCCGAAAGGCTCTGCCCTCTCAGCCTCGACCCATGTCTCGAACCCTGACCAAGGTCCACGAGGCTCTCCTCGAGGAT
CTCGTTTTCCCCACCGAGATCATTGGCAAGCGAGTCAAGTACCAGGTTGGTGGCACTCGAATCCAGAAGGTTTTCCTCG
ACTCCAAGGACTCCACCTTCATCGACAACAAGCTCGAGTCCTTCCAGTCTGTCTACAACAAGC

> SEQ ID NO:3088 216284 254078_301631_1
GCTTTGCATAGGCTTAGCGTGCGTTAGAGCAGGCCATTCACAAACAAGGTAGGAAGCTGTATCGAGCATTCGCCATGTT
TACTGCTCATCGGAAAATCCAGAAGGAAGCAGGCCATGAGCCTGATGAGTTCGAGGAGACTGTGGCTCAGGCCTTGTTT
GATTTGGAGAATAGCAACCAGGAGCTAAGGAGTGATTTGAAAGATCTTCATATTAACTCTGCCAAGCAAGTTGATATTT
CTGGTGGTAGGAAGGCTGTGGTTATTCACGTGCCTTACAGGCTTCGGAAGGCATTCAAAAAGATCCACCCCAGGCTGGT
TAGGGAGCTGGAGAAGAAATTTAGTGGAAAGGATGTTGTGGTGATAGCCACCCGGCGGATTCTCCGGCCTCCTAAGAAG
GGTTCTGCAATGACTCGTCCCCGCAGCAGGAGTCTGACCTCCGTGCATGAAGCCATCCTTGATGATCTTGTACATCCTG
CTGAGGTTGTTGGCAAGCGAGTCCGCTTTCGCCTTGATGGCTCCCGAATCATGCGGGTATACCTAGATCCCAAGGAGAG
AAACAGCACAGAAGCCAAGCTTGAGACCTTTAGTGCGGTCTACAAGCGCCTTACTGGCAAAGAGGTCGTTTATGAGTAC
CCTGTTCAGGAAACTG

> SEQ ID NO:3089 216284 103410_300026_1
tggtatcaacgcagagtggccattacggccggggggatCTTCTGTCAGAGCAAGTGATTCCGGCACACTCACAGATCTG
TCCGCTGTTGCCGAACACTCAGAGATCTGTGAAGATGTATACATCAAGGCAAAAGATTCACAAAGACAAAGATGCTGAA
CCTTCTGAATTTGAGGAGTCCGTTGCACAGGCTTTGTTTGACTTGGAAAACACCAACCAAGAGCTGAAAAGTGAATTGA
AGGATCTATACATTAATTCAGCAGCTCAAATTGATGTGTCAGGAAATAGGAAAGCTGTTGTTATTCACGTACCGTACAG
ACTGAGAAAAGCTTTCCGCAAGGTTCATGTCCGTCTTGTTAGGGAGCTGGAGAAGAAATTCAGTGGAAAGGATGTAATC
TTCATTGCCACCAGGAGGATAGTGAGACCCCCTAAGAGAGGCTCTGCTGCCCAGAGGCCCCGCAGCAGGACTCTTACTT
CTGTTCACGATGCTATATTGGAGGACTTGGTTGTACCAGCTGAGATTGTTGGGAAGCGAACTAGATATCGCATTGATGG
ATCCAAGATAATGAAGGTCTACTTGGACCCGAAGGAGCGCAACAACACCGAGTACAAGCTGGAGACCTTTTCTGCAGTT
TACAGGAAGCTTTCAGGCAAAGATGTTGTGTTCGAGTACCCCATCACAGAGGCTTAAAACATACAAAATAGTGGTCTTG
ATCTCTTTGACGCAGAACTATAAATTAGTGGCtACTTTataaaaattTGGCATttaa > SEQ ID NO:3090 216284 1097602_301446_1
AGAAGGGTTCTGCAGCCACTCGCCCACGAAGCCGAACCCTTACTTCTGTTCATGAAGCCATTCTTGACGACTTAGTCTA
CCCTGCTGAGGTTGTTGGGAAACGTATCCGGTTCCGCCTTGATGGCTCTCGAATCATGCGGGTGTACCTAGATCCCAAG
GAGAGAAACAGCACGGAAGCAAAGCTCGAGACATTTTCAGCAGTTTACAAACGTCTCACCGGAAAAGAAGTTGTCTTCG
AGTACCCTGTCCAAGAAACTGCTTGAGGCACCCCTTCTTGCACATTTTTGAATGTGAGGTAGTTGAGCTAGATAACTTTG
AATGGCATCTTTCCCTAATTTTGCCATCAATTTATGATGATGAGTCATCATCATCCTCTTTTCAACATGCATTTTATAG
ATGTTCAAAATCCTACTTAATATTTACTCGGCAATATTTTTCTTAATGATCCATCGAACTGTTCTTTAGTTAGTGTGCC
TAATGTTATTGTTGCTACCAAGTTTCTTCTCAATATATCAAAGAGTTCGTTTGGGA > SEQ ID NO:3091 216284 208856_300809_1
ctccCGTTGAGCATCACCAGTCAAGATGAGCGCCATTAACAAGATCGCCGCCAACAGCCCCTCGAGGCAAAACCCCTCC
GAGCTTGAGCAGAACATTGCTCAGGCTCTCTTCGATCTCGAGACCAACACTGCCGACCTCAAGGTTGCCCTGCGACCTC
TGCAGATCGTCTCTGCCCGTGAGATCGAAGTTGGCCACGGCAAGAAGGCTATTGTCATCTTTGTCCCCGTCCCTTCCCT
GCAGGGCTTCCACCGTGTTCAGCAGCGCCTGACCCGTGAGCTGGAGAAGAAGTTCTCCGACCGCCACGTCCTCATCCTG
GCTTCTCGCCGCATCCTGCCCCGCCCCAAGCGCTCTGCCCGCTCCCGCAACACCCAGAAGCAGAAGCGCCCTCGTTCCC
GCACTCTGACTGCTGTCCACGACGCCATCCTGGCTGATCTCACCTACCCCGTTGAGATCGTCGGCAAGCGTATCCGCAC
CAAGGAGGACGGCAGCaagaccCTCAaggtcaTCc > SEQ ID NO:3092 216284 194880_300767_1
cccggccgcctccgaatcgtagcgccggcgctgccagtgtccctcgctctcgcatcttcTCCTCGCGCCCAGGGGCCAG
GTAAGCGAAGATGTACACCGCGAGGAAGAAGATCCAGAAGGAGAAGGGCCTCGAGCCCTCCGAGTTCGAGGACTCCGTC
GCGCAGGCTTTCTTTGACCTCGAGAATGGCAACCAGGAGCTCAAGAGCGAGCTCAAGGACCTGTACATCAACAATGCAG
TCCAGATGGATATTGCCGGGAACAGGAAGGCTGTGGTGATTCACGTGCCGTACCGTCTGCGCAAGGCATTCAAGAAAAT
CCATGTCAGGCTTGTCAGGGAGCTCGAGAAGAAGTTCAGCGGCAAGGATGTGGTGATTGTTGCAACAAGGAGGATTGTG

FIG. 2 continued

```
AGGCCTCCCAAGAAGGGCTCGGCTGTTCAGCGCCCTCGCACAAGAACTCTTACCGCTGTTCATGATTGTATCTTGGAGG
ATGTAGTCTACCCAGCTGAGATTGTTGGCAAGCGCATCAGATACCGTCTGGATGGTGCCAAGGTCATCAAGATTTTCTT
GGACCCAAAGGAGCGCAACAATACCGAATACAAGCTTGAGAcCTTCtccgcaGTCTaccgcaGgCTTTgtgGGaaAGAT
GttgcctTCgagtAcCCTATgActgaaACtgcttgAAGaTGc > SEQ ID NO:3093 216284 194853_300767_1
ggagcgcactgcgaagcgaaccCTTCTCCGCCGCCTCCGCTCTTCGCTGCACGGTGCTAGCTCGCCGCCGTCCGTCTCG
CGCGCCTCAAGGGTTATCACAAGATGTATACAGCAAGGAGGAAGATCCAGAAGGACAAGGGTCTGGAGCCAACTGAGTT
TGAGGACACTGTTGCTCAGGCATTTTTTGACCTTGAGAATGGGAATCAGGAGCTGAAGAGTGACTTGAAGGACCTTTAC
ATCAATGGAGCAGTTCAGATGGATTTACCTGGCAACAGGAAGGCTGTTATTATTCATGTTCCATACAGGCTGCGGAAGG
CATATAAGAAGATCCATGTGAGGCTTGTTAGGGAACTTGAGAAGAAATTCAGTGGGAAGGATGTGGTTCTGGTTGCAAC
TAGAAGAATAGTGAGGCCCCCAAAGAAAGGCTCAGCTGTTGTTCGCCCTCGTACCCGCACACTTACTGCTGTTCATGAT
GGCATCTTGGAGGATGTTGTGTATCCAGCAGAGATTGTTGGGAAGCGTGTCAGATACCACTTGGATGGTAGAAAAATCA
TGAAGATCTTCCTGGACCCAAAGGAGCGCAACAACACCGAGTACAAGCTCGACACTTTCAGCTCTGTCTACAGGAGGCT
CTGTGGGAAGGACGTCGTGTTCGACTACCCCATGACCGAGACTGCGTAAACCATGTCATAGTTAGTCGACGGCTATCTT
TGGCCGCAAATGCTGCTACTCTTCCTAAAATAGACTATAACTGTGGTTTCCTATATGCGAAAAGTTTTGACAGTCCTGT
GATCTGCATATCTGATTGCTAGAACTGGTTTAAATTGTTCAGGTGTTTTCCAACTGCAGTTGTAGAACTTGTTGCTATG
TTCAATGGTAGTATTTTCAACGTGCG > SEQ ID NO:3094 216284 116430_300068_1
ATCTTCTCGCGCTCAGGGGCCAGGTAAGCGAAGATGTACACCGCGAGGAAGAAGATCCAGAAGGAGAAGGGCCTCGAGC
CCTCCGAGTTCGAGGACTCCGTCGCGCAGGCTTTCTTTGACCTCGAGAATGGCAACCAGGAGCTCAAGAGCGAGCTCAA
GGACCTGTACATCAACAATGCAGTCCAGATGGATATTGCCGGGAACAGGAAGGCTGTGGTGATCCACGTGCCGTACCGT
CTGCGCAAGGCATTCAAGAAAATCCATGTCAGGCTTGTCAGGGAGCTCGAGAAGAAGTTCAGCGGCAAGGATGTGGTAA
TTGTTGCAACAAGGAGGATTGTGAGGCCTCCCAAGAAGGGCTCGGCTGTTCAGCGCCCTCGCACAAGAACTCTTACTGC
TGTTCATGATGGTATCTTGGAGGATGTAGTCTACCCAGCTGAGATTGTTGGCAAGCGCATCAGATACCGTCTGGATGGT
GCCAAGGTCATCAAGATTTTCTTGGACCCAAAGGAGCGCAACAATACCGAATACAAGCTCGAGACCTTCTCCGCGGTCT
ACCGCAggCTTTGTGGGAAAGATGTTGCCTTTGa > SEQ ID NO:3095 216284 111932_300050_1
ctcaaactaaaCGTAGCTAGGGTTTCCCGCCGGCGCTGTTCCTTGCCTTTCTCTCACAGATCTGTGAAGATGTACACGT
CCAGGCAAAAGATTCACAAAGATAAGGATGCTGAACCTACTGAATTTGAGGAGTTTGTTGCACAGGCCTTGTTTGCTAT
GGAAAACACCAACCAAGAGCTGAAGAGCGAATTGAAGGACCTATACATCAATTCAGCCATGCAAATTGATGTGTCTGGA
AACAAGAAGGCCGTTGTTCTCCATGTCCCCTACAGGCTGAGAAAAGCTTTCCGCAAGATCCATGTCCGCCTTGTAGGG
AGCTCGAGAAGAAATTCAGTGGGAAGGATGTAATCTTCATTGCCACCCGGAGAATAGCGAGACCTCCAAAGAGAGGTTC
TGCTGCTCAACGGCCCCGTAGCAGGACTCTTACTTCTGTTCATGACGCCATATTGGAGGATGTGGTTGTACCTGCTGAG
ATTGTTGGGAAGCGTGTTAGGTATCACGTTGATGGATCCAAGATAATGAAGGTATTCTTGGACCCAAAGGAACGAAACA
ACACCGAGTACAAGCTGGAGaCtTTTTCAGCTGTTTACAGGAAGCTATCgggCaaAGATGttTtgtttgagtacccat
CACtg > SEQ ID NO:3096 216284 1108734_301520_1
TCTCCATTCTGGCTTTGCATAGGCTTAGCTGCGTTAGAGCAGGCCATTCACAAACAAGGTAGGAAGCTGTATCGAGCAT
TCGCCATGTTTACTGCTCATCGGAAAATCCAGAAGGAAGCAGGCCATGAGCCTGATGAGTTCGAGGAGACTGTGGCTCA
GGCCTTGTTTGATTTGGAGAATAGCAACCAGGAGCTAAGGAGTGATTTGAAAGATCTTCATATTAACTCTGCCAAGCAA
GTTGATATTTCTGGTGGTAGGAAGGCTGTTGTTATTCACGTGCCTTACAGGCTTCGGAAGGCATTCAAAAAGATCCACC
CCAGGCTGGTTAGGGAGCTGGAGAAGAAATTTAGTGGAAAGGATGTTGTGGTGATAGCCACCCGGCGGATTCTCCGGCC
TCCTAAGAAGGGTTCTGCAATGACTCGTCCCCGCAGCAGGACTCTGACCTCCGTGCATGAAGCCATCCTTGATGATCTT
GTTCATCCTGCTGAGGTTGTTGGCAAGCGAGTCCGCTTTCGCCTTGATGGCTCCCGAATCATGCGGGTATACCTAGATC
CCAAGGAGAGAAACAGCACAGAAGCCAAGCTTGAGACCTTTAGTGCGGTCTACAAGCGCCTTACTGGCAAAGAGGTTGT
TTTTGAGTACCCTgttCAgGAAACTGCttaggTggCTATAATCCCGAAggttAtTtTTTtGTCTTGCGcCcG > SEQ ID NO:3097 216287 200042_300755_1
gattcacggcgacatccgctgaatatcCCGGCACGCGCTTGAACCAGGACGTGGATTGGAACCTAGAGGCGGCGAAAGT
CAGAGCAGCCAGTTGCGTCTTTCTTGGGAGCCTTGCGCAAGGCTCTTCAATCCCTCACCATGGCGTCGTCTCTCCCCAC
CGAGCTCGGCAGCACCATCCAGGCCGGCCATATCAGAAGACATCCCGACCCTCGACAAGACATTGCGCCATCAACCGCC
GCCGACAAGAGGCAGCTGGTGGATTTCCACAGCGCGAGACGCGGTGATATCGACAACGACGACGACGATATCCCGTACA
GCGTCTTGCGTCCTCCAAAGAAGCACTACA
```

FIG. 2 continued

> SEQ ID NO:3098 216302 210327_300888_1
GGCAAAGGGATATGTGAATTTGGCGGTATACTTTTCTGTCTGAAGGTCTAGGAGGCGGAAGCCCTGGTCATTGCTTGCA
ATGGCGGCGGCAGGACTGTCAGACCTCCTGGGTTTGTATATCTTGATGTGGTTGGTAATCCCGCTAACGTCGTTGGATA
TCTGTCCCTCCGAGTAGCTCTTCTTATCCTCGGCAGTCAATGACTGCAGGAAGTAGTCGCCATTGAAGGTGCCGGCCAT
CAAGACACCGCAGCCGGCATCAAGGGTTGATATGGCGGGAGACGCCATTCCAGCAAAAGCACGCAGATTCATCGCTAGG
T

> SEQ ID NO:3099 216319 210561_300890_1
AAACCACCGTCATCATGCCTCCAGCAAGCTACTCGCGCCCGCCACAACACGACTCGTGGTTCGCGCCTCTATCCGTCGA
CCTGATCCTCAAGGTTCTCAACGTCACCATCTTCCATCCCTTCATCTGCTGGCTGATCCCGCTGTGCCTGCGCGCCCAG
ACGACCAAATGGGAGGCGCCGCCCATGGTGGGCGCCATTGCCTGGGCCATCTTCATCTCGGCCATGTGGATCGCGAGCG
CGGTCAACCAGCGCATTGCCAACGGCGCGCCGCGCGAGGTGGACCTGGGCGAGGAGGTGATTGTGGTGACGGGCGGCGC
GAGCGGGCTGGGCATGCTGGTGGCCGAGGTGTACGGCATGAGGGGCGCCAGCGTGGCCGTGCTGGATGTGAACGAGATG
GAGAATGGCGAGGCGAGGGGCGTGACGTTTTACAAGTGCGATGTGAGCGACAAGGAGCAGGTGGCCAAGGTTGCCGTTG
AGATTGAGAAGGATCTCGGTACGCCTACTGTGCTCATTAACAACGCTGCTATTGTCGTGGGCAAGCCGCTGCTGGACCT
CTCCATCGATGAGATCGAGaccAGCATCGGCACCAACCTCCTcGgccCCTTCTACT > SEQ ID NO:3100 216329 214955_300876_1
TTGACCGAAAGCCGTCTTTAACCCTCCCCCCAGCTGCACGAAAGCGGAGGATAGGCAGCCGGAACGGAGATCTCTTCCC
AAAGCTGGACCAAAGGGCAGGGCGCGCCAAGTACGGAGCTTGTGCACTGCCGTCCCAAGTACCTGGCAGCCTGGCAGTA
CCTCGGACGCACGCTGCCTGCCCCTCACCACGCGGAGTATCCAGGTACCTCGGTGTGCAGGTGCAGGCAGCTCTCCCTG
TCCTGCAGGAAAATGCAGGATAGAGGAAAGACCCGGAGACAAGTCTGGTGATTCTGGTGATTCCATCCTGCCGGGGGTC
AGGTTTTTACATAAGGCACTCTCGACTTCCATCTTATTTCCCCACTCGATCCCGATCTCTCTCTCTCTTGCACCAGCAG
GGAAGGAGTGGGCGACCCCGAAAAAAAAAACAATTAGAAAAAAAAAAAGAAAAAAAgAGGCGAACGAAGGAACGagCGA
ACGAgCGTCGTCGAGAaggcgCgAACAAggagAACGAgCCTGCGGGGTACCTTGGTGGACTTCCTGAc > SEQ ID NO:3101 216338 205090_300795_1
aattGACGACCACCAGCGCCGCCAGAATGTTCGCCGCACGATCAAGGGCAGTCTGCGCCGCCCGCCAGCTGCAGCGGAC
AACCCGAACCTACGCCTCCGAGTCCCACGGCCACCACTCGCCCGCTCCGGTCAACGAGTCCTTTGGGGCCGGATCTGTT
ATTGCCCTGGGCGCTTTCCTGGGCACCGTCCTAGTCTACCAGTTCCGCCCCACGGAGAGCGACAACTGGACGCCCTCTG
CCCTGCTCAACAAGTATCGATCAAAGGCCGAGGACTGGGAGGCCGTCAACACTCTGCACACAAAGGCCATGGAGCAGGC
CGGCTATGACAGGAATCTGTTCGAGAACGGCTCCAACAAGCACCGATTTGTCGACGTCGCATACCCCGAAGCTCTCCAA
TCCCACGCCGCGCGAAACATCCAGGCCGGCCACCTTGCCAACATTGACCATGCTGTGGAACACTACCGACAGCAGCACC
TGAAGATGGAGGAGAAGAAGGCGGCCAAGCTGGCGGCTGCCAAGGCAGAGTAGTTGCAGTTGCTACAGTATATCCAATT
TATAGAACAAAGTTTGCAACACATTGGGGCCAaTTCaatgcgTGATAATGATTCCAGTTgccggatgtaCCt > SEQ ID NO:3102 216345 214316_300857_1
gaaaactcaaaattaaattaaacataaagacaggctcccaaaaggctgtgacctcttcttattacatctttacaagcct
cCATAGCGTAAGATTCCCTCCACAAGGGTCGGGCTGATTTATCCTGTCGGAATAATCACTTGCGTAATTCGACGTCGT
TTCGCTCGCTTCTTACGGCAAGCCTACAAATCCCATTCCGGCAGCGAGCTCGCCTGGCGCGTGCCAAAATACGACGACC
GAAAACACCAAGTGCATGTGCCAACGGTGATTGGATTTGTGCGCTCCGAGATACCCAAACCAAAAGTACATGTTAGGAT
GCACGCGACCACGCCATGATCGGCGCTTGATCACGGGCCCATAATCGAGAGAGAGGCGCCGCTACCGGACGATAGAACG
GAGGGAATAGACAGATAGACGATAGACGGGACGAGGCGATCGATCAAGTCAGAGACAACAAATACCGAGTGGCGATGCCT
TCATCCGATAGTCTTGGGAGGCGGGCCTCACACGGCGCTGCCAGCCTGGCGACGTCGGCATCTTCTATACACGGCGCAG
CAGTTGGGTTTCGAGAAGGCCTGGGCTTGGCTGGAGTTGCGAGGAGGACGTTGGGAATCTGCTTTCTGCTATTGACGGT
GTTTCTATGGACGCTGTCCAACTTTCTCGCCAGCTTTATCTTTTCCGATGCAACCTACGATAAGCCCTTCTTCCTCGTC
TACTTCAACACCTCCATGTTCGCCATCTCTTTAATACCCATGTTTGTACGATATCTGCTCCAGAAAGGATTCCATGGCC
TACGAAGCGACGTCAGGCGCATGTGGGCGGAGCATCGATACCAAGCCGCCCCAGGCAGTCCCGCGATAGATAAAGAAGA
TCACCTAGCTCAAGAACGCTTGCTAGTAGACGAACGAGACCCCATGGCACCAACCTCGACTCCTTCAAAAGAGAAGCTC
AGCTTCCGAGAAACCGCAGTACTGAGCCTTGAGTTCTGCATGTTGTGGTTCCTCGCAAACTATTTtgCGTCTGCATGTC
TCgagtatAccag > SEQ ID NO:3103 216349 219711_300948_1
gatgcctgcattgtctttgGTAACGCATGGCCTGCGAAGGATACGACCGTCCTGCTATCCGAGATGATTATACAGACT
CCCTCATCAAGTCAGTGGCTGACCAGTGCAGCAAGACCGTTGTTATCTTTCACAACGCGGGGCCTCGATTGGTAGACGG
TTTTGTTGATCATCCAAATGTCACAGCAATCATCTTTGCCCATTTGCCAGGTCAAGAGAGCGGGCCAGCACTCGCTTCA
CTACTCTTTGGGGATACCAGCCCTTCCGGCAAGCTTCCGTACACAGTGGCGAAGAATGAATCTGATTATGGCGATGTCC
TCGATCCAGTACAGCCAGAAGGCGAATTCGTCAACTTTCCCCAGGCCGATTTCCACGAAGGAGTTTATCTTGACTATCG
CTACTTTGACAAAAAGGGCATTGAACCTCGATACGAGTTCGGCTTTGGACTTGGTTACACGACCTTTGCATATTCCAAC

FIG. 2 continued

```
ATATCCATCAACTATATTCAggggGCAAACACGTATCCATGGCCGGGCGGCCCTATTGTCAGCGGCGGACAAACGGATC
TATGGGATGCAATCGCCACCGTCAGCGTAAACATCAAGAATACAGGCAGCGTTGCTGGTGCCGAAGTGGCGCAGCTCTA
CATTGGTATTCCagggctCCGGCgaagcagcTTCGCGGCTTTGaaAAgCCCTttttgCAGCCTAAtGAg > SEQ ID NO:3104  216352  211079_300895_1
GCAACTCAGCATCCAACAGCATCTCCAAACCTCTACTCCTTAATCTCCAATCCTCTAGTCTTCAAGAAAACCCAAAACT
CCATTCAAAATGA > SEQ ID NO:3105  216352  215447_300881_1
acAACTCAGCATCCAACAGCATCTCCAAACCTCTACTCCTTAATCTCCAATCCTCTAGTCTTCAAGACAAACCCCAAAA
ACTCCATTCAAAATGAAGTTCTTCACTGTTGCCACCGTCTTCTTTACCGCTGTCCTCGCTGCCCCAGGCGGCTACTACC
CTCCTCCTCCTCCTCCTACCTATACCCTGCCTCCCAATGGCAACGGCAACGGCAACGGCAACGGCAACGGCAATGGCAA
TGGCAACACCAACACTGGCGGTTCTGCCCTGTGCCCTTCTGGCCTCTACTCCAACCCCAATTGCTGCGCCACCGATGTC
CTCGGCCTCGCTGATCTCGACTGCAGCGTTCCTTCCACAACTCCACACGATGGCGCTGCTTTCCGAAGCATCTGTGCGG
CGACTGGCAAGAGAGCTCGCTGCTGTGTTCTCCCCGTTGCTGGCGTAGCTGTTCTTTGCCAGGACCCCATTGGCGCCAA
TTAAAAGGCATCGCCAATATGACTCACGAGGTCCTTTGATGAATGTGTTATTGCACATGGCTCGGACCTACGGTATCAA
CACTGAACACTGACTTGAACATATGAgtcGTGAGCTTTTGGATATATGGAATATGACGGTTACTTATCTTCTATCTAAG
TTGGATATAgaTTTGTATACACATGACGTACTTa > SEQ ID NO:3106  216357  210782_300892_1
GCTTACATATTACAAACTGTCCTCTTACATATTACAAATATCCAACATAGACAGTAGACAGTATCAACGCCATGACCCG
AATTGCAGAGCCCACGCCACTTCCCCCCTCAGCTCCCATAAACGGCAGTGAGAAACACCAAGACCAACCCCGAGATGAG
CACAAGGAAAACTTGGGCACCTTCTCCGTGCCAAACATCCAGCTCCAGATCCGGGACCTCAAGCACCCCGGCTCAAAGC
GCTTCCTCGGCGCCGTCAACGCAACCGATCTCCTCACCACAGGCACTCTGAACGTCCTCAAGCTCTTGTACAACACTCC
CCCAAACCCGGAGACGACCGTTCCGCCAACCAGCTCCGTGACGCTCGTCCTCGAGGATATGCCCGGCGTGGCCTACACA
GTCGGCCATAACGACAATAACAACATCAAGGAAATCCACTTTTCGCTCTCGTACATTGCGCAAATCAACGCTTCTCGCG > SEQ ID NO:3107  216358  205586_300799_1
tgagcgtcgcattccgcacaaggaacgagaacaaagaacaaaccgatagcttcaaagttaccggccaacattgcgacgc
aACCACAAAGGGGAGGCTTTGACACTCAacTTTCTTTGAGCTCCACCCGGCACTaggcGGAagagGCGCGTCTAACTGA
AAAAAGAAAAAAGCTTttttTTCTCCGAGCagtgttCCCTCTCGCTTTCTCTCTCTCGCGCGGACAACGGAACGAATCGA
AACagCcTCGTCTTTGTCCAAGCTCCAAGCTCCAAGCTCCAAAGCTCAGCCTCGCATCCGCCCGCCATGGACGCCGTCC
GGTCTCTCGTCCAGCCCATCACACACAACCTGCCGGCCCCCATCCGGGACCTAGGCGTGTCGATCGTGGGCGAAACCTG
CTACAAGGCGCTGCTACTCGACGTCGACGTCGAAAACACGGAATGCATCAAGCTGGCCATCAGCAAGGGCCTGGGCATC
GGCATCGTCGGCGCATCGGCCGTCGTCAAGGTGCCCCAGATCCTCAAGCTGCTGCGGTCCAAGTCCGCCGAGGGCGTGT
CCTTTTTGTCGTACCTGCTGGAGACGAGCGCGTACCTCATCTCGCTGGCCTACAACGTGCGCAACGGCTTCCCCTTTAG
CACCTTTGGCGAGACCGCCTTTATCATGGGCCAGAACGTCGTCATCGCCATGCTCGTCCTCAACTACAGCGGCCGGCCC
GCCACGGCTGCGCTGTTTGTCGCCGCGCTGGCTGTCAGTGCGGCGgcgCTGTTTGCGGACAACATTGTGGATATGCAGG
CTTTGAGttaccTGCAggCTggt > SEQ ID NO:3108  216360  107417_300264_1
ATCGAGTAGGAGGATCTCTGAGGGATATGGCATCCAAGAGAATTCTGAAAGAGCTCAAGGATCTGCAGAAAGATCCTCC
CACCTCTTGTAGCGCTGGCCCAGTTGCTGAAGATATGTTTCACTGGCAAGCAACACTTATGGGTCCATCTGACAGTCCT
TATGCTGGCGGAGTGTTTCTTGTTACCATTCATTTTCCACCTGATTATCCATTTAAGCCTCCAAAGGTAGCTTTTAGGA
CAAAAGTTTTTCACCCAAACATCAACAGCAATGGTAGCATTTGCCTCGACATTTTGAAGGAACAGTGGAGCCCGGCACT
CACAATATCTAAGGTGTTGCTGTCCATCTGTTCTCTTCTAACAGACCCAAATCCTGATGATCCTTTGGTGCCTGAGATT
GCTCATATGTACAAGACTGATAAAAGCAAGTACGAAGCCACTGCTCGGAGCTGGACTCAAAAATATGCCATGGGTTAGT
TGCTGAAACACAAATATTTGGCTTTTATCTATGATGTATTAAGAAATTGTGTTATGCATAATTAACTCAAGGGAAAGGT
TGAATTGTGGCCCTCTGTAAAACACTTAATTTTCCTCATGTTTGTAAGATTAAATGGTTTTGAAattCtg > SEQ ID NO:3109  216360  1100623_301462_1
AGGGGGGAGAGTTCCTGACCTTTCGTAGCCACGTTTCTTTTCTTCTCTCTCTCTCTCTCTCTCTGTCTTTCGC
TTTCTCTCTCTCCTCTCCTTTCCTCTTTTCCTTCTCATTGTTCTCAAACTACACCCGCTCTCTCTCCCCTTCTCTCCTT
CTCTCTCTCTCTCTCTTTTGGGTGCCTTCCTTGCGTATCGGGAGGAGAACGGAAGAATGGCTTCGAAGCGGATCCTG
AAGGAACTGAAGGATTTGCAAAGGGATCCTCCCACTTCCTGCAGTGCAGGTCCTGTTGGGGAAGATATGTTTCATTGGC
AGGCAACTATCATGGGGCCAACTGATAGTCCTTATGCCGGTGGCGTCTTCATGGTCACTATTCATTTCCCCCCGGACTA
CCCCTTCAAGCCTCCCAAGGTTGCTTTCCGGACGAAAGTGTTCCACCCAAATATCAACAGCAATGGGAGCATCTGCCTT
GATATATTAAAAGAGCAATGGAGTTCCAGCCCTTACAATATCGAAGGTCTTGCTTTCGATTTGTTCACTTCTCACTGATC
CGAATCCCGATGACCCCCTTGTGCCGGAGATTGCACACATGTATAAGACGGATCGAGCCAAATACGAAGGTACTGCAAG
```

FIG. 2 continued

GAGTTGGACACAGAAGTATGCAATGGGTTGAGTTGAGTCTTTCTTCACTCAATTGCTACTCGCTCTTAATATATCCCCC
CCCCTTGATGTAATAAATATATGTTGGCAGACAAGTTAAAATATCGGCATACAAAAAGCCGTGTTTCTGAATGATCTTG
TTTCAAAACTGAATGAAtg

> SEQ ID NO:3110 216360 110920_300048_1
CCCACGCGTCCGGTCGTTGCTTAATTACTGTTCATTCACAGGAGGATCCTAATCTCTTTCAGGAGTCGCTATGGCTTCA
AAGCGGATCTTGAAGGAGCTCAAAGATCTTCAAAAGGATCCTCCTACTTCGTGTAGTGCTGGACCTGTTGCTGAGGACA
TGTTTCATTGGCAAGCAACGATAATGGGTCCTCCAGATAGTCCTTTTTCTGGTGGTGTTTTTCTGGTGACGATTCATTT
TCCTCCAGATTATCCATTCAAGCCACCTAAGGTTGCTTTCAGGACAAAAGTTTTCCACCCAAACATAAACAGCAATGGG
AGCATATGCCTTGACATTTTAAAGGAACAGTGGAGCCCTGCCCTAACGATTTCCAAGGTGTTGCTTTCAATATGTTCTC
TTTTGACGGACGCCAATCCTGATGATCCGTTGGTCCCAGAGATTGCACACATGTACAAGACAGACAGGAACAAGTATGA
GACAACTGCAAGGAGCTGGACCCAGAAGTATGCCATGGGCTAAACGTACCTTTGTATCATGGGTCAAGGGCATTTTAC
TTTCAGATACTTCACTATTTACATTCAATgtaCTAATCTgttCTTTGAGTTGTAACATGgAGTccATGTCTT > SEQ ID NO:3111 216360 1171183_302053_1
gtacaaatgtcTTCTCTCTCTCTCTCTCTCTCTCGTTCCTTTCGTTTCTTTGCCTTCCCTATAACGGCGGTGGCTAT
TTAAGAACTCCAAGTAGCAGAAGTTATAGTTGAAGAGGGATCTGGATCTGAATCTGAATCTGTGTCATGGCTAGCAAGA
GGATTTTAAAGGAACTCAAGGATCTGCAAAGGGATCCCCCAACCtctatGTAGTGCTGGTCCTATTGCAAATGATATGT
TCCATtGGCAAGCCACTATCATGGGTCCCTTTGATAGTCCATATGCTGGaGGAGTTTTTCTGgttACCATTCATTTCCC
CCCAGACTACCCATTTAAGCCTCCTAAGGTGTCCTTCAAAACCAAAGTCTTCCATCCAAATGTCAATAGTAATGGAAGC
ATTTGCCTTGACATCTTGAAGGAACAATGGAGTCCTGCTCTAACAATAGCAAAGGTCCTACTCTCGATATGCTCTCTTT
TGACTGATCCCAATCCTGATGACCCTCTCGTTCCAGAAATAGCCCACATGTATAAAACAGACAGGGCAAAGTACGAGAC
AACTGCAAGGAGTTGGACCTTGAAGTATGCTATGCCCTAAATAAAGCTCACCTCTTGCCTTGCATATAGTTGAGGTATA
TATATTATATATATaCaCacacgttATTACATATGca > SEQ ID NO:3112 216360 125313_300630_1
ggttcaattctcgctaatcaggttaagactcatatttcttcgattgtttggttgggaatggcttcgaaacgaatattga
aGGAGCTGAAGGATCTCCAAAAAGATCCTCCTACCTCATGCAGCGCCGGTCCTGTTGGAGAGGACATGTTTCACTGGCA
AGCTACAATAATGGGGCCCTCTGACAGCCCTTACGCTGGGGGTGTATTTTTAGTCACTATCCATTTTCCTCCAGATTAT
CCATTCAAACCTCCTAAGGTTGCTTTTAGGACAAAAGTTTTCCATCCAAATATCAACAGTAATGGGAGCATATGCTTGG
ACATACTGAAGGAGCAGTGGAGCCCCGCCTTAACTATTTCCAAGGTTTTGCTTTCAATCTGCTCACTTTTGACGGACCC
AAACCCTGATGATCCCCTTGTTCCTGAGATTGCTCACATGTACAAGACAGACAAGGCCAAATATGAAGCAACTGCCAGG
AGTTGGACCCAGAAGTATGCCATGGGCTAACTATTGCCTATGGCGGCTTGAATTGATATAAAGAAAAACAAATTTCAAT
GTCCTCCTTCTATGCTCTCTCCATTAACAAGTtgTATAATAGCATtAAGCAttgcccTCTGCAGGAAGAGACTAATGAT
GCTttgAattTgttTATATAggTAATAATAttTTATGCg > SEQ ID NO:3113 216360 1117116_301818_1
ttcccatctctctctttctctctcTCTAGGTATGGCGTCGAAACGGATACAGAAGGAGCTGCAGGACCTGCAGAAGGAC
CCCCCGACGTCATGCAGTGCCGGGCCGGCTGGGGAGGACCTCTTCCACTGGCAGGCCACCATCATGGGCCCCTCTGATA
GCCCCTACGACGGCGGCGTCTTCTTCATCACCATTCACTTCCCCCCTGACTACCCCTTCAAGCCCCCCAAAGTCAGCTT
CCAGACCAAGGTTTATCATCCAAACATCAGCTCGAACGGGAGCATTTGCTTAGACATTCTAAAGGAACAATGGAGTCCA
GCGTTGACGATTTCAAAGGTGTTGTTATCCATCTGCTCTCTGCTTACGGATCCAAATCCAGATGACCCTCTTGTCCCTG
AGATCGCTCACATCTACAAAACCCAGAAGGCTCGCTACGAGGAGACCGCCCGAGCATGGACCCAGAAATATGCAATGAA
CTAGTTGAAAAATTTCCTTACATATCCTTGCCCACCCTTCAAACTATAATAAGCATAAggTATGCTTTCTATATATGGA
GGCTAATCGTTAttgttTCTCCgtTgTCTTTCTCTATCATCAATCACAGttTCttg > SEQ ID NO:3114 216360 226238_300995_1
acgacACCAATTTTAAAAAATGGCTTTGAAGCGAATCAACAAGGAACTCAGTGATCTTGGACGTGATCCCCCCTCCTCT
TGCTCTGCTGGTCCTGTTGGCCAGGATCTGTTCCACTGGCAGGCTACTATCATGGGACCCTCAGACTCTCCTTACTCCG
GAGGTGTTTCTTTCTGTCTATCCACTTCCCCACTGACTACCCCTTCAAGCCACCAAAGGTGACCTTCACTACCCGAAT
CTACCACCCCAACGTCAACACCAACGGATCCATCTGTCTGGATATTCTCAAGGAGAACTGGTCTCCCGCACTCACCATC
TCCAAGGTGCTGCTGTCCATCTGCTCCATGCTACAGACCCCAACCCTGACGATCCTCTCGTGCCCGACATTGGCCACC
TGTACGAACGACCGAGCACGATACGACGCCACTGCCAAGGAGTGGACCAAGAAGTATGCCGTCTAggATGTATATAG
GGAGCAGGCATGAGCCTATGCAAGCGAATGGCTGTGACGATACAACTAGCCAATG > SEQ ID NO:3115 216360 223965_300977_1
ACCCACGCGTCGACAACAAGAAGAAGAATCGAGACTGACGTCATGAAGTTGCTAATGAGCGACTACGAAGTGACGCTGG
TCAATGATAGCATGCAGGAGTTTTACGTGCGGTTTGAAGGACCGGAAGAAACACCGTTCCAGGGAGGAATATGGAAGAT
CCACGTGGAACTGCCAAACGAGTACCCATACAAGTCGCCCTCCATCGGCTTTGTCAACAAGATCTTCCACCCAAATATC

FIG. 2 continued

GACGAGCTCAGCGGGAGCGTGTGCCTCGATGTCATCAACCAGACGTGGTCCCCCATGTTTGACATGGTCAACATCTTTG
AGGTCTTCCTGCCTCAGCTGCTGCGATATCCGAATCCCAGCGATCCTCTCAACGGAGAGGCCTCGGGTATGCTGATGCG
AGAGCCCAAGCAGTACGAGGGAGAAGGTCAAGGACTACGTGACCAAGTACGCCAGCAACGACTCTGTGTCGGCAGAGAAG
GACATTTCTGACGATGACGATCTCAGCAGCATTGGCTCGTTTTCTGACGACGACGAGGAGCCCGCCGGAGAGTTGGAAG
TCTAGTGCATATTTATATAACATTAAGAGTGCGACTGAGAGTCGTTTACTGTCT

> SEQ ID NO:3116 216360 218419_300966_1
GAACCGAACCGAACGTCCACGATCGATCCCCCTGCTGCAAGCTTTATAGCCACGAGAGACGCTACTGCAAGTGACGACG
CCGGGAGCCACACACCTCGAGAGGCTCAGACATACTCAGCATCTCATCTCCACATCTGCTTCTTATAATTGCCCTTCCG
GGCCAGAGAGTCCCTTGACAGTTGCCCATCATGAGCAGCCCACGCCGTCGAATTGAGACTGATGTCATGAAGATGTTGA
TGAGCGACTATGAAGTGACACTAGTGAACGATAACATGCAGGAGTTCTTTGTCAGATTCAAGGGCCCGGCAGAAACTCC
GTTCGAGGGAGGTCTTTGGAAAGTACATGTCGAACTTCCCGATACGTATCCGTATAAGTCACCTAGTATTGGCTTCGTG
AACCGAATTTTCCACCCAAACATCGATGAGCTATCTGGCTCTGTGTGTCTGGATGTCATCAACCAGACATGGTCCCCCA
TGTTCGATATGATCAACATTTTCGAGGTCTTCCTGCCGCAGCTTCTTCGATACCCCAACCCGACGGACCCTCTCAACGG
CGAAGCAGCTGCTCTGCTTATTAGGGAGCCCAAAAGCTACGACGCAAAAGT

> SEQ ID NO:3117 216360 215962_300886_1
tacctaatagtatttttacataggagcgttttctcgttcgcgtcCATTTTCATTTTGCGTCTACAGCGAAGCGATACTCTT
CCAGCACTACGCGATACCCCCTTTTGTCTATACTCACACCACCAAACGTAGCGACAAGCACAGCGACGCAACATTTACA
ATGAGCGCAAGAAGCGGAGCGAAACGACTCATCAAGGAGCTTGAGAGCTGGCGCAAGGAGCGCAAGGACGAAAAGGGCG
TGGAGAGGCTGGGTCCGATCAATGAGGATGATTTATTCGAGTGGGAGGCCGTCATCAACGGGAGGGAGATTGGATCGGG
CTATGATGAGGGCCGCTGGCTCATACACATCCAAATCCCCGCGCAGTATCCCTTGCAGCCGCCCAAGATGCGCTTCGTG
ACGACCATTGTGCACCCCAACATTGCGCTGCAGTCGGGCGAGATCTGCCTCGACCTGCTCAAGGACAAGTGGACGCCGA
CGTACAGCGTGCTGCAGTGCGTGCGCGCCGTGCGCATGCTGCTGAGCTATCCCGAGACGGACAGCCCGCTCAACGTCGA
TGTCGCGGCGCTGCTTAGAGGAGGCGATGTTTTGGGGACGCGAAAGCTGGTGCAATATTGGTGCTCGGAGCCGGAGGGA
agatATGATGgcccGTAaggGGGTGTG > SEQ ID NO:3118 216360 215413_300881_1
aCAGGACCGCCATCAGGGACTCTGCACCCCCGATCAGATAAAGCCTCTACCTAGCGCTCAGGACTTGCAGACGGTCGCC
TTGCATCGTCTCCAACGTCCGCCTAGGATCTTTTGATTCTTTCTTTGCCTCCTCGATCCGAGATCGATCTTCCACCACC
CTTTTAGATACCACATACCCTCATCACAATGGCCCTGAAGCGCATCAACAAGGAGCTCAAGGACCTCGGCACTGACCCG
CCATCATCCTGCTCCGCTGGTCCTGTTGGAGAAGATCTGTTTCACTGGCAAGCTACAATCATGGGACCCGGTGATTCAC
CATACTCAGGAGGCGTCTTCTTCCTGAAGATCCAGTTCCCTACGGATTACCCCTTCAAGCCCCCGAAAGTCAACTTCTC
CACCAGAATCTACCACCCCAACATCAACAGCAACGGCAGCATCTGCCTCGATATTCTTCGAGACCAGTGGAGCCCTGCT
CTGACCATTTCCAAAGTTCTCCTTTCCATCTGCTCTATGCTGACAGACCCGAACCCCGATGATCCCCTTGTGCCTGAGA
TTGCGCACGTGTACAAGACCGACCGGCCCCGGTACGAGGCGACTGCTagggAATGGAcccgcaaGTACGCCGTc > SEQ ID NO:3119 216360 210910_300894_1
AAGCCTCTTCGACCACCCTCTGCCATCGTCAGCCTTCGACTCTCTTCACCAAACCTCAACAAGCGACAAATTATCGCCA
GGGTGCTCCAACGCTCGCTCCGCCATCGCCAGTATCCTTTGGACCCATACTTTCGCTCTACAACACACACAACCCCTCT
TACGCCCACATAGCTTCGGCTACGTCAAGTTTCGGCATCATGTCTAGCAGAGATCGCCGTATAATGAAGGAGCTGCAGG
ATCTGACCGAGGACAAGGACACTTCCGGCATTCATGCTGCCCTAGAACAAGAGGGCTCGCTGACCGCTCTCAAGGGCTG
GTTCTTTGGCCCTGGAAATACGCCGTACGCTGGTGGCAAATTCGTGATTCACATTCAGCTTCCCACCGACTACCCCTTC
AAGCCACCCAAGATGAAGTTTGAGACCAGGATCTGGCATCCTAATGTCAGCAGTCAGCGGGCGTCATTTGTCTCGACA
CCCTCAACAAGAACTGGTCGCCTGTCCAAACGATCAAGACGGCTCTCCTCTCCGTCCGAATGCTTCTCGAAAACCCAAA
CCCCTCAGATCCACAGGACGGCGAAGTTGCACGGATGCTGCTCGACAGTCCCGACTCGTTTGTCCAGATGGCTCACGAG
TGGGCAGTCAGGCACGCCGGTGCGCCGCGACAGCGAAAcctCGACgtaaCTatattcagaaGCtggccagaccaaCaA
CTgctGTCGATGCGAGCcGataccaTggatacaagCcagtc > SEQ ID NO:3120 216360 190923_300737_1
CCCAACTCCATTATTCTTGCAAGGAGGAAGAGCAGCTAGAGGCGAGGCAAGAAAAGAAGTGAAATCTCTCCGTTA
GACAGGAAGAGGAAAAGCAAGGGGGAATTGGGGATGGCGTCAAAGAGGGATACAGAAGGAGCTCAAGGATCTGCAGAAGG
ATCCCCCTACATCATGCAGTGCAGGTCCTGTTGGTGAAGACATGTTCCACTGGCAGGCAACGATAATGGGTCCATCTGA
TAGCCCATATGCTGGTGGAGTTTTCCTAGTTACCATCCACTTCCCTCCTGATTATCCCTTCAAACCACCCAAGGTGGCG
TTTCGCACCAAGGTTTTCCATCCAAACATCAACAGCAACGGGAGCATTTGCCTTGACATCCTTAAGGACCAATGGAGCC
CAGCACTAACCATTTCCAAGGTGTTGCTGTCAATCTGTTCCCTGCTGACTGATCCGAACCCTGATGATCCTCTGGTCCC
TGAGATCGCCCACATGTACAAGACAGATAGGCACAAGTACGAGaACACAGCAAGGACCTGGACTcagaggtaCGCcaTg
tagcacctcagataTCGATGGACATGTCgaTGTTGTAACAACATTAtCAACgggtgtgtcTccCTcTcgccttgtgtgg
tgtaaggaTCAAAACcggCtTTgcagtgcaCTCt

FIG. 2 continued

> SEQ ID NO:3121 216360 187287_300675_1
CTCGTGTCCGCTGCGAAGAAAAGGGGCATATCATGGCATTGAAGCGGATCCTCAAGGAACTAAAGGACCTGCAGAAAGA
TCCTCCAACATCATGCAGTGCAGGTCCTGCTGGTGAGGATATGTTCCATTGGCAGGCGACCATTATGGGTCCTCCAGAT
AGTCCCTATGCTGGTGGAGTTTTCTTAGTGAATATTCATTTCCCCCCGGACTACCCCTTCAAGCCTCCAAAGGTATCTT
TTAAGACAAAGGTCTTCCATCCAAACATCAATAGCAATGGAAGCATATGCCTTGACATTCTTAAGGAGCAATGGAGCCC
TGCTTTGACCATTTCTAAGGTGTTGCTTTCGATCTGCTCGCTGCTCACTGACCCCAACCCGGACGACCCTCTTGTCCCT
GAGATTGCCCACATGTACAAGACGGATCGTCCAAAGTATGAGACGACAGCCCGCAGCTGGACCCAGAAGTATGCCATGG
GATGATGAAACCCACAAGCCCTGAATTCAAACCTGCTGCTTAAATGCAGACAGTCGTGGTAATTGTCCCATGAAAACT

> SEQ ID NO:3122 216360 182315_300660_1
GAATTCAGCAGCTAACAACAATACCCCAATACCAAACCCTAACCCTTAATCTCCCGCAGCTGTATAAAACCCTAATCAT
TAGATCCTGAGAAGAATCGGAGTTTTTTCTCACAGCTTTTTCTTACGGCTGTGAGGATGTCGACCCCTTCGAGGAAGAG
GTTGATGAGAGATTTCAAGAGATTGCAACAGGATCCTCCAGCAGGCATCAGCGGTGCACCGCAGGACAATAACATAATG
CTATGGAATGCTGTTATATTTGGCCCAGATGATACTCCCTGGGATGGAGGTACCTTTAAGTTGTCTCTGCAGTTTTCGG
AGGACTATCCAAATAAGCCACCAACAGTTCGGTTTGTTTCGCGGATGTTCCATCCAAATATCTATGCAGATGGAAGTAT
TTGCTTGGATATCTTACAGAATCAGTGGAGTCCTATTTATGATGTAGCTGCTATTCTAACTTCTATCCAGTCGTTGCTT
TGCGACCCGAACCCAAATTCTCCTGCTAATTCTGAAGCTGCAAGAATGTTTAGTGATAACAAGCGTGACTACAACAGAA
AAGTACGCGAAGTCGTTGAGCAAAGCTGGACAGCAGATTAACTGCTCATCCCTAACATGTGGATGTCATTTGACTTATT
CTGTAAAGTTTGAAGTCTACGTAAGTAAACATTTCCACTTGAAAACAATTGTAATACAGACATAAGAGTTATATA

> SEQ ID NO:3123 216360 167862_300551_1
GAATTCAAAAAGACTATAAAATCCAATCAACCTCTCCAATTCCCGGAATCCTCCTTCCTCCTCCGGTTTCTTCCTTTTT
CAGAGCACCGAGTTCCTCTGGATCCTCTCTCCTGGTTTCTTCAAATACCCTTTGGTTTTTTCCTTTACCCCTCTTGTA
AAATCTAGGGTTTCGAGAGAAAAAAATCTTCAGAGAGGATGGCCTCCAAACGGATCTTGAAAGAACTCAAGGATCTTCA
GAAAGATCCTCCTACTTCTTGCTCCGCAGGTCCTGTTGCCGAAGACATGTTTCACTGGCAAGCAACAATAATGGGTCCC
CCAGACAGTCCATACGCAGGAGGAGTCTTTCTAGTTACTATTCATTTCCCTCCAGATTATCCATTCAAGCCACCAAAGG
TTGCCTTCAGGACAAAGGTATTCCACCCTAATATCAACAGCAATGGGAGCATCTGTCTTGACATCTTGAAGGAGCAATG
GAGCCCTGCCTTGACCATTTCCAAGGTGTTGCTATCCATTTGCTCATTGTTGACGGACCCAAACCCAGACGATCCTTTG
GTGCCAGAGATTGCTCACATGTACAAAACCGACAGGAGCAAGCATG

> SEQ ID NO:3124 216360 128564_300476_1
cccgcacttcttccAACGTACTGGTGTACTATTATTGGCCCAAAATCCTCTTCCAGCTCTGCAATCTCCGTCTCCGTCA
ATTTTCAGTCAACCGAAATCCACCATCTTTCATTGTTCATCACCTTCAGGTTAGGGTTTGGATTTGAAGGTACAAGGGG
CTAATTGATGGCGTCGAAGAGGATATTGAAGGAGCTCAAGGATCTGCAGAAGGATCCTCCTACATCATGCAGTGCTGGT
CCAGTGGCAGAGGATATGTTCCATTGGCAAGCAACTATCATGGGGCCTACAGATAGCCCTTATGCCGGAGGTGTATTTT
TGGTTTCAATTCATTTCCCTCCGGATTATCCTTTCAAGCCTCCAAAGGTTGCCTTTAGAACTAAGGTTTTCCACCCTAA
CATCAATAGCAATGGAAGTATTTGTCTGGATATTCTAAAAGAGCAGTGGAGTCCAGCGTTAACCATATCTAAGGTCCTG
CTCTCCATCTGCTCCCTATTGACTGACCCAAATCCAGATGATCCACTTGTACCAGAAATTGCCCACATGTATAAGACTG
AAAGGTCTAAATACGAGACCACTGCTCGTAGCTGGACTCAGAAATATGCTATGGGATAATGGCAAAGGTGTCACCAGGC
ATGTCTGAGACTTTGTAACTGCAATGTCTTATTGTGCTTGTAGTGAATGAATAAATTCGgct > SEQ ID NO:3125 216360 1113883_301841_1
tctttctctcctatcTCTCTCCTCTCTCTCTCATGGCTTCCAAAAGGATTCAGAAGGAGCTGAAAGACTTGCAGAAG
GACCCCCCCTCATCATGCAGTGCAGGTCCTGTTGCGGAAGATATGTTTCACTGGCAGGCAACAATTATGGGACCAGATG
ACAGTCCTTATAGTGGTGGTGTGTTTTTGGTGACGATTCATTTCCCCCCAGATTATCCCTTCAAGCCCCCCAAGGTTGC
TTTTAGGACCAAGGTTTTCCACCCAAACATCAACAGCAATGGGACATTTGCCTGGATATATTAAAAGAGCAATGGAGT
CCAGCTCTGACAATATCTAAGGTCTTGCTTTCAATCTGCTCACTTCTCACTGATCCAAACCCCGATGATCCTCTGGTAC
CTGAGATTGCACACATGTACAAGATAGACAGAGCAAAATATGAAGGTATTGCAAGGAGTTGGACACAGAAGTATGCAAT
GGGTTGAGCCTTTTTTTTCGGCAAAAGATAACAACTTTTATCAGTCTATCTCATATCTAAAAGAATCGGTTTACAACT
TTCTGTttcTGCATCTTGtnggTCCAAAGCTCAAATCACACGtGTATCTTTACTttCATAGCCAAGGa > SEQ ID NO:3126 216360 238009_301291_2
atcataagtggggcaaaaaaagggttcatggcgaaggcgcacgAATCCACTGCGGCACTCCCCTTCTTGATCGATTAGG
TCAGATCGAAGTAGGTCGATCGATTGATAGATAGATTGGAAAGGGATCGGCGAAGATGCTCGATGTGTCCCGCGTCCAG
AAGGAGCTGGTGGAGATCGAGCGCGACAAGAAGCTGTCGGGCGTGAGCATTCAAGTCTTCGACGATGGGTTGAGTCGAA
TGCGAGGAACAATCACGGGGCCTGTTGGCACCCCCTACGAGGGCGGAATCTTCACCATCGATATTCAGTTACCTTCTGC
TTATCCTTTCGAACCACCAAAGATGCAATTCATGACTAAAGTCTGGCATCCAAACATCAGCAGCCAAAACGGAGCTATC
TGCCTGGACATTCTAAAGGATCAGTGGAGTCCAGCGCTGACGCTAAAGACTGCGCTACTGTCGCTACAAGCGCTGCTTT

FIG. 2 continued

CGACGCCGGAGCCGGGGGACCCTCAAGACGCGGTCGTCGCAAAGCAGTACCTGAGTGAGTATCCGGTTTTCGAGAGCAC
TGCGAGATACTGGACCGAAACGTTTGCAAAGAGATCGTCCCTTGGCATGGAAGAAAAGGTAGCGAAGCTAGTCGAGATG
GGATTTACGGATGAGGTTGCGACCGCTGCTCTAGAGTGCTGTGGCggcgacGAGAATg > SEQ ID NO:3127 216360 247566_301621_1
GGGCGGACGCGTGGGGGGCGATTAGGGTATATTGGCTTTGTCGCGGCTATGGCGTCCAAGAGAATCCTCAAGGAATTAA
AGGACTTGCAGAAGGATCCGCCCACTTCGTGTAGCGCAGGTCCTGTGGCCGAGGATATGTTTCATTGGCAAGCGACGAT
AATGGGTCCTCCCGATAGCCCCTACGCAGGGGGTGTGTTTTGGTCACCATCCATTTCCCCCCGGATTATCCCTTTAAG
CCCCCCAAGGTCGCATTTAGAACGAAAGTTTTCCACCCAAACATCAACAGCAATGGCAGCATCTGCCTCGACATTCTCA
AGGAGCAGTGGAGCCCGGCCTTGACAATCTCCAAGGTGCTGCTATCAATCTGCTCGTTGCTAACCGATCCAAACCCCGA
CGATCCACTGGTGCCCGAGATTGCTCACATGTACAAGACAGACAGGCCCAAGTATGAATCGACCGCCAGGAACTGGACG
CAGAAGTACGCCATGGGGTAAGCCCGGGCTTGTGAGCGGCGGCGGCGGCGGTGGCGGTGGCATGGCTCGCTATGATGTT
TGTGATACCATTTGGTTGCCTATCTATAAGTTGAAAGCAGGGATTGTCTTTGATTATGGAATTCTTTTGATTACTGTAT
ATAGAATTTCTATCACGTC > SEQ ID NO:3128 216360 252709_301604_1
tctgactcctcTCTCTCTCTCTTTAGATCTCTGGTCTCCGTCTCCGTGTCCGTCTCCGTTACTGTGTCTGTCTCCCT
TCCGTCGAGATCTGTGGATCTTATAGCCTAGCCCTAAAGGGGAACAGCAAGCTTTGGACTTTCCATGGCCTCCAAACGG
ATCCTGAAGGAGCTCAAGGATCTGCAGAGGGATCCTCCCACATCATGCAGCGCAGGACCTGTTGGGGAAGATATGTTTC
ACTGGCAGGCAACAATCATGGGACCGAATGATAGTCCATATGCTGGCGGTGTGTTTATGGTGACCATTCATTTCCCACC
GGATTACCCCTTCAAGCCGCCAAAGGTTGCTTTCAGGACTAAAGTTTTTCACCCTAACATCAACAGCAATGGGAGCATT
TGCTTGGATATATTAAAAGAGCAATGGAGTCCTGCTCTTACAATATCGAAGGTCCTGCTGTCAATTTGTTCGCTCCTGA
CGGATCCAAACCCCGATGATCCCCTTGTTCCTGAGATTGCGCATATGTACAAGACAGACAGAGCCAAATATGAAGGCAC
TGCAAGGAGTTGGACGCAGAAGTATGCAATGGGCTGAATCTCTGACCTCTCTCGCCCCTTTGTAATAATCAAAAGAta > SEQ ID NO:3129 216360 271676_200036_1
ggggagacgtttgaaTTGGGAATAGGAAGAGAGCAAAAATGGTGGACTTGGCGAGGGTACAAAAGGAGCTGCAAGAGTG
CAACAGAGATGTTGGGGTTTCAGGAATAAGTGTAACCCTTAAAGGTGACAGTCTCACTCACTTGATTGGTACAATCCCT
GGTCCTCTTGGTACTCCTTATGAAGGTGGTTCTTTCAAGATCGATATCACTCTTACTGATGGCTACCCATTCGAGCCTC
CAAAAATGAGATTTGCCACAAAAGTTTGGCATCCCAATATAAGTAGCCAAAGTGGAGCAATATGCCTAGACATCCTGAA
AGACCAgtctagCCCAGCGCTGACTCTCAAGACAGCTCTCCTTTCTATACAAGCATTACTCTTTGCTCCTGAACCTGAT
GATCCACAAGATGCAGTTGTTGCACAACAGTATCTCAGAGaCCATCagaccTTTGTTGGCACAgCtCgttactggacTg > SEQ ID NO:3130 216360 274064_200147_1
aaattattgggggtagctgaaaatacctagcaaagatacataacggaccaacggtatactgtcacgacatatctgctta
tAAAAAGGAGTCCTAATTTCACTGTAAACTTCTCGCTTTCTCCTCGGTCCCCTCCCAGAATCTGAATTGCAACGTGTAG
GAGGATCTCTGAAGGATTTGGTGAATCATGGCATCCAACGGATTCTCAAAGAGCTCAAGGATCTCCAGAAAGATCCTC
CTACCTCTTGCAGCGCTGGTCCAGTTGCTGAAGACATGTTTCATTGGCAAGCAACAATTATGGGTCCGCCTGACAGCCC
TTATGCTGGCGGAGTGTTTCTTGTTACCATTCATTTTCCACCTGACTATCCATTTAAGCCACCGAAGGTAGCTTTCAGG
ACAAAGGTTTTCCACCCAAACATCAACAGCAATGGTAGCATTTGCCTCGACATTTTGAAGGAACAATGGAGTCCGGCAC
TTACAATCTCCAAGGTATTGCTGTCAATCTGTTCTCTGTTGACAGACCCTAATCCTGATGATCCATTGGTGCCGGAGAT
TGCTCATATGTACAAGACTGATAAAAGCAAGTACGAAACAACTGCCCGGAGCTGGACTCAAAAGTATGCCATGGGTTAG
TTGCAGTGACCATCTCTGGAGGGGCTCCTTTTCTTCTgtggtaTTCTgtaTATCTATTATGTATTAAGaaAtggtgttC
TTATGCATAATCAACTcaagggGAAATgttGaaCAgGCCCcTGtaacaaTttg > SEQ ID NO:3131 216360 6887_300090_1
CCCACGCGTCCGCgCACGGTGATATTGAGAATCGCCGACCTGAATCGATCGGAAAACTTTCTCTGATTACCGGCGGTCA
ACACCGCTGAACACATATGTTTGTTTGACGACCTCTTCTCTCCGCGATCTTTACCTCAACAACGAGATCTGTTTCCACG
AAAGAAAGGAGGATGTCGACGCCAGCAAGGAAGAGGTTAATGAGGGATTTCAAGAGGTTGCAGCAAGACCCACCTGCGG
GTATTAGTGGTGCTCCACAGGACAACAACATTATGCTCTGGAATGCTGTCATATTTGGGCCTGATGACACACCATGGGA
TGGAGGTACTTTCAAACTCTCACTGCAGTTCTCTGAAGATTATCCCAATAAACCACCAACAGTTCGGTTTGTGTCACGG
ATGTTTCATCCTAATATTTATGCAGATGGGAGTATCTGCTTGGACATTCTACAAAACCAGTGGAGTCCAATCTATGATG
TTGCTGCTATACTTACCTCCATCCAGTCCTTGCTCTGTGACCCTAATCCGAATTCTCCTGCAAACTCGGAAGCTGCTCG
GATGTACAGCGAAAGCAAGCGCGAGTACAACAGgagAGTGCGTGATGTTGTTGAGCAAAGCTGGACTGCTGACTAGTAG
TAGTTTGTTGTAAGCGTTGTAGCTCTCTCTACTTTCTCTCAATCACGATTCAGCAACAGCTTTCTTCTCTTTTCATTCA
TGtc

FIG. 2 continued

> SEQ ID NO:3132 216360 57194_300378_1
cccacgcgtccgatctcttctattcataagttgtaaattcttattattgggATTTTTTCCCTTTTTAATTCAATCCAAG
AATTGAGTAGGACTAATGGCATCCAGGAGAATTCACAAGGAACTAAGGGAGTTGCAAAGAGACCCTCCTACTTCATGCA
GTGCAGGTCCGGTGGCACAGGATATGTTCCATTGGCAAGCAACCATTATAGGTCCAAATGACAGCCCTTATGCAGGTGG
TGTTTTCCAAGTGGCCATCCATTTTCCTCCTGATTACCCTTTCAAACCTCCCAAGGTGGCTTTCAAGACCAAAGTTTTC
CATCCAAATATAAATAATAATGGAAATATTTGTTTGGACATTCTTAAGGATCAATGGAGTCCTGCCCTCACCATATCAA
AGGTTTTGCTTTCCATATGTTCACTACTAACAGATCCAAATCCAGATGATCCATTGGTTCCAGAAATTGCTCATATGTA
CAAATCTGATCGGAAGAAATATGAATCAATGGCTCGTAATTGGACCCAAAAGTTTGCTATGAATTGAGTTGTTGTATTC
ATATAAAGCTCATGTGCTATAATTTGTAACAAAAGATCAATGATTTTCTCCTCCGCAGGCATGTAATAAAAGCACAAAA
TTATAATACTTGTGAAATGAGAATTTTTCACACTTGATA > SEQ ID NO:3133 216360 38614_300209_1
ccAaTAATGGGTCcattTGATAGTCCTTATTCAGGCGGTGTCTTTCTCGTAACCATTCACTTCCCTCCGGATTATCCTT
TCAAACCACCAAAGGTTGCATTCAGGACAAAAGTGTTCCACCCTAATGTCAACAGCAATGGAAGCATTTGCCTTGACAT
TTTGAAAGAACAATGGAGTCCTGCACTCACCATATCGAAGGTTTTGCTTTCGATATGTTCATTGTTAACGGACCCAAAC
CCAGATGATCCATTGGTTCCAGAGATTGCTCACATGTACAAAACCGATAGAGCAAAGTATGAGTCTACTGCGAGAAGCT
GGACTCAGAAATATGCAATGGGATGAAAGTTTGTGTCCTTTGATCCCTCACAGACTCGGTTTTAATAGAGAGAGAGAGA
GAAAGAGAGAGGACTTCTTCACATAGGGATCTTCCATGAAATAAGTTAGATTCCTATGTTTTATCATCTCTTTGTTTGA
AACCTCTTTAATCTCAAACAAAAACATTACTTCACCTCTTTATTATCC > SEQ ID NO:3134 216360 37480_300390_1
AAGGATCCTCCTACTTCATGTAGCGCAGGACCCGTTGCGGAAGACATGTTTCATTGGCAGGCCACGATAATGGGTCCAT
CGGATAGCCCTTATTCTGGAGGAGTTTTTCTTGTAACCATCCATTTCCCTCCAGATTACCCATTTAAGCCTCCTAAGGT
GGCTTTTAGGACGAAGGTGTTCCATCCAAACATTAACAGCAATGGAAGCATCTGCCTCGACATCTTGAAGGAGCAGTGG
AGTCCTGCTCTCACAATTTCCAAGGTGCTGCTATCGATCTGTTCTTTGTTAACGGATCCAAACCCAGATGATCCTTTGG
TCCCTGAGATAGCTCACATGTACAAGACAGACAAGAACAAGTACGAGTCCACTGCTCGGACCTGGACCCAAAAGTATGC
CATGGGCTGACACAAATACTGTCCTTAAGGAAGAGCCCTAATAATTAAACTCTTCTTATTTCTATGTAATGATCTTTTA
TAGACTTGTCTGTCTTATAAAATTTGTGAAGACAGGATCAGTAAGAAATTATTTGATCTCCATTCAA > SEQ ID NO:3135 216365 210803_300893_1
GATGAGACCTGTTCGGAAGATTCTGCAAGCGACTCATTTCAAACCCGTAATGAAAGATGGCAAGAGAATGTTGACGCCT
TGCTCTCCAGGAGACCCGGAGAAGATTGAGATGACGTACGACGATGTCAAGCCGGAAGAACTGTCGGCTCCGGACGTGA
CACTCCAAGATTTTGAGATAGCTTTGGCCGACTCACATCCTACAGTGTCCAAGGATGACATTGAGAAGCAGATTGAATG
GACGAATGAATTTGGAAGCGAGGGAGCTTAGGCAATGGGCGTGTCTTTGAGAGTACATGGCACAGCGGCGCTTTGAGG
AGTTAGAGGGGCATCTAGGCACTCTTTGCACATACAATGTTGAATTCGGGAATCGTAATGCATCTGTCTTACTGGAAAA
GAAGAAGAAGCTGTTCATATTCGATTCTTTTTATGGTAGATAGTGGGCCGGCATCTTTGTAGGATGTGATTAATTTTGA
GTCCAAGATGAATTGGTAAAAAAAAAAAACAA > SEQ ID NO:3136 216371 210759_300892_1
gacgatgagaatacATGTATTCAGACGGCCAATCACCGAAACAGCACAAATAAGAATATAAGCAATTATTGGTATGATA
TTGCAAGCTACATGAGTCAAACATCATAAAGCACCTAAGATACAGAGAGTGAAATTTAAGCTGCCTGCTTCGTCAGAGC
TTCGCTAATACGCCAGAGCTTTTCTGCCTGTGCGGGATCAACAGCCCCAGGCAACAAGCCCTCTTTTGTCAAGACTCCG
TCGGCCAAGTAGTAGCCATCCTTGTCTGACAAAATGTGTTAGTATTTGATTAGGTTACATGAGTGAAGTTGAGGTATAG
GAATGCTGGGATACACTGGGTGTGACGTACTGGACAGTCGAGAGTCGAAAGCGGCGATAATTCCAGTTGAGGATCCCTC
AGCCAAGGTCTTGGCCTTAATCGCCGAGTTCAGGTTACCGTTGTCATCGATCCAGCCTATCGCATATTAGCATTGTGAC
AAATTCAGAAAGACAAGCAATGAACAGTAGGATCAACGCTGAAAGAGCGCAATCCCCGCTGGCCAAAGTGCTGGACCAA
GCCGACTGACAAGAGAACATCGCATGCCTTGGAATTGCTGTAAGCCGTCCACTTCTCATAGTCTTTGCCGTTGTTGTAT
GAAAGGTCGTCCAAGAAGGACAGATTGGCGCGGGATTGAGCTTCGCTTGAGTAAGTCACAACGACGCCGTGCTCCGAGG
CGAGCAGCTTCTCAATCAATAAATTGATGAAGAGAAAGTGACCCAGGTGGTTAACAGCGAATTGCATCTCAATATCGTC
CTTGGACTTCTCAAATGATGGCACAGCCATGACGCCGGCGGTACAGATCATGGCATCAAGaACCGTAACAGAGCTGTTT
AccTCgGCGGCAGCCTTGCGGGTGGTttcCAATGAGgagAGATCGAGCACGATGGGCTGCACgacgGtgccTTtagggA
TGTctaggGacttgATCACCtc > SEQ ID NO:3137 216373 142632_300500_1
CCCACGCGTCCGCCCACGCGTCCGTTAAAATACAGATCTGTGTGTGAGAAGAAGGAACGCATCTGAAATCGATGGCAC
CCGCAGCAGATATCGAGGATGAGATCAAGGACGAGAAGAACCCTCCCCCACTTGATGAAGATGATATTGCTCTTCTCAA
GACTTATGGCTTGGGACCTTATTCCACAAGCATAAAGAAAGCTGAAAAGGAAATCAAGGAAATGGCCAAAAAGATAAAT
GATTTGTGTGGTATTAAGGAGTCTGACACTGGGCTAGCTGCACCAAGTCAATGGGATCTGGTTTCTGATAAACAGATGA
TGCAGGAGGAGCAACCTCTTCAGGTTGCCAGATGTACAAAGATAATTAGCCCCAATACTGAAGACGCAAAATATGTTAT

FIG. 2 continued

AAATGTCAAGCAAATTGCAAAGTTTGTTGTTGGATTAGGGGACAAAGTTTCACCTACCGATATAGAAGAAGGCATGCGA
GTCGGGGTTGATAGGAATAAATATCAGATTCAGATTCCATTGCCCCCCAAAATTGATCCTAGTGTTACCATGATGACAG
TTGAGGAAAAGCCTGATGTAACATATAATGATGTTGGTGGATGCAAGGAACAAATTGAAAAGATGAGAGAGGTTGTTGA
GTTGCCCATGCTTCACCCTGAAAAGTTTGTGAAACTTGGAATTGATCCCC

> SEQ ID NO:3138 216373 226313_300996_1
ACCACCACCACAAACCACCACATACAATGCCACCAAAATCTGATTGGGAAAAGTACAAGGCCCCCATCGACGAGGATGC
CGCGCAGGAGAAGATCATTCCTCTGTCCGAGGGCGACATCCAGGTACTCAAGACGTACGGAACTGCTCCCTATGGTACT
GCCCTCAAGAACATCGAGAAGGACATCAAGGACATGCAAGCACGAATCCAGGAGAAGGTCGGCATCAAGGAGTCCGACA
CAGGTCTGGCCCCGCACCACCTGTGGGACACACAAATGGACAAGCAGCGAATGAGCGAGGAGAATCCTCTCCAGGTGGC
TCGATGCACCAAGATTATCGAGACTGCTGAAGACCCCGGAAAGAGCAAGTACGTCATCAACGTCAAGCAGATCGCCAAG
TTTGTCGTGTCGCTGGGCGAGCGAGTGTCGCCCACAGATATCGAGGAGGGGATGCGAGTGGGAGTCGACCGGTCCAAGT
ACCAGATTCAGCTGCCTCTGCCACCCCGAATCGACCCTTCCGTCACCATGATGACGGTCGAGGAGAAGCCCGATGTCAC
CTACTCGGACGTGGGAGGCTCTAAGGAGCAGCTGGAGAAGCTGCG

> SEQ ID NO:3139 216373 210791_300892_1
ATTCCAAACGCGCATCACGACCAGCGATTCTTACTTCCTCGAACGGACCAAACGAATACTCTGGACGAGCTTAAAATCC
CTCAAACTCATTCTTTTATACGCCATAGATCCCCTAATTCTACGGACGTTGCGTCCAGTCCGCAGAGCCCATCATGCCT
TCTGCGACCGGTCAAAACTGGGAGAAATACACCAAGAAATTCGCCGACGATGAGATAGAGGAGAAGAAGATCACACCTC
TCACCGATGAGGATATTCAAGTGCTCAAGACATACGGTGCTGCCCCATATGCATCGACCATCTCAAAGCTCGAGAAGCA
AATCAAAGAGAAACAACAGAGCGTAGATGAGAAGATTGGCATCAAGGTATGAGTCGGCGCAACTGCGATGCGTCTACGG
CTATCTAACGTGTTGACGTAGGAGTCCGATACTGGTCTCGCACCGCCGCATTTATGGGATGTGGCCGACGACCG

> SEQ ID NO:3140 216373 250429_301623_1
AGCTTGGATTCCATGGCGCCAGCAGCAGCAGACGACGACATTCTCAAGGAGAAGAATCCACCGCCGCTCGACG
AGGATGACATTGCGCTGCTCAAAACATATGGTCTTGGTCCCTATGCTACCTCCACGAAGAAAGTGGAAAAGGAGATCAA
AGAACTGGCGAAGAAAGTAAATGATCTGTGCGGGATCAAGGAGTCGGATACTGGTTTAGCAGCTCCAAGCCAATGGAT
CTGGTGTCTGATAAACAAATGATGCAAGAAGAGCAGCCATTGCAAGTGGCTCGTTGCACCAAGATCATCAACGCAAACG
CGGACGACACAAAGTACGTGATCAACGTCAAACAAATAGCAAAATTTGTAGTTGGTCTTGGGGATAAGGTGTCTCCTAC
AGATATCGAGgaGGGAATGCGCGTCGGTGTTGATCGCAACAAATAccaGATCCAAATACCTTTGCCTCCTAAGATCGAT
CCAAGCGTGACTATGATGACCGTCGaGGagaagccggacgtaactTACAACGatATCggcggttgcAaggaacaaataG
AAaAatgcgTGA > SEQ ID NO:3141 216387 195951_300639_1
ggGGTGCGATGTGAGGCTGATTTGGGGTGTATGATTCGTGAGCGTGTAAGAGGAGGCAGCCCACGACTTTCTCTCTGTG
TCTGTGCTTGCTCACTTGCTCGCCTCCTTGGATTCGGCCTGTTGATCCGAATCAGAAGTAAATGTGTTTGAGACTGAGA
CTTGGTCTGGTCGAGACGATATGAGATGTGGCATGGAATTAGAAACACGTGTTTGGTATGGCGATTGCGATGCGATGAT
CCGCAGAAAGCAAGATCTCAGGGCGACTAACACGGATATACGGAGGTTCGACCAAGACACGAGGAATGATGGGGAAAGT
CTCAGTATGTCACTACGGAATTTATGATTACGTAGCAATGTATGAATTATCATTTCAC > SEQ ID NO:3142 216406 213056_300846_1
cgtcatcagaagcaccctgaattcgaacttgttgcccAGATTGGAAGCCATGGCCACATCAGGAAGCGGAGGCTGGGCT
CAGCTACGCCAGCAGGCCCGATCTTTGGAGAACCAGACGGAGAGTCTGTTTCATACCTTTTCCCAGTTCTCGACTGGAT
CCAACATCCCACCTAAGCCATCAGCAGAGGAGCGTGACATAGAAGCGAGATTGGAGGATGTATTAGACAAGCGCGACAA
TGTCATCGCCCAGCTCGCCCGACTTCTGGATTCTGAAGCATCCCTCAACACATCCGCGCTCAAACAAAACAACCTATCC
CTGCTCCGAGAGAAGCTTGCCTCTCATCGCCGCGACCTGACCCGTCTCAAGTCTACACTGCAGCAAGCTCGCAATCGCG
CCAACCTCCTCAGCAACGTGCAGTCCGATATTGACGAGTACCGCGCGAACAACCCGGAAGCTGCCGAGGCCGATTACAT
GTTGGACGAGCGTAATCGCATCGACAGAAGTAACGATGCGACAGACAGCGTCCTCAGCCAGGCATATGCTATCAACGAA
AGTTTTATTATCCAAAGGAGACCTTGGCGAGCATCAACCGGAGAATAACCATGGCCGCCAGCAAAGTGCCAGGCATCA
ACTCAATAATTGGACGTATAAGTACCAGGAAGAGGAGAGATGGAATcatTATGGGAACTTTTATCGCATTGTGCTTTAT
CGTCTTCTTCTGGTtcagGTAAACGGGCCATCATACattcacCggtGCTGCACATGTCGTTTGGCGtt > SEQ ID NO:3143 216408 119860_300360_1
cccccccccgaacagtagaaagctcgggcacttcccttccccttgtttcacagatctttgtatcaacAAAAATGGCG
ACAACAGGGAAGAAAACGAAGAAGACCCATGAGAGCATCAATAACAGGTTAGCTCTGGTAATGAAGAGTGGCAAGTACT
CTCTCGGTTACAAGACCGTTCTGAAGACCCTCAGGAGCTCTAAAGGGAAGTTGATATTGATATCTAACAACTGCCCACC
ATTGAGAAAGTCAGAGATTGAGTACTATGCTTGCTAAAGTTGGTGTTCACCATTTCAATGGAAACAATGTTGAT
CTTGGAACAGCATGTGGGAAGTATTTCCGTGTTTCATGCCTCAGCATCATTGACCCAGGTGATTCGGACATCATCAAGT
CTCTGCCTGGTGATCATTAAGCGATATTCACCAGGGTTTTGTTAAACCATTTTAGTGAGTTGAGAAAATCTGTACTATC

FIG. 2 continued

TTTTTATTCTTGTATTTCAGAGTTATACCAAGATTATAGAGGATGTTGGTATTATCTAGTTTTGTTGGTTTTATCATTT
CTCCAGAAGTTTTGAGGTCAGGTACATTATGATTTATTCACAGATCAATTTCCCTATACCATTTTGCTTTTCTAAATGA
GTTCACTAGaTTTTCTTGttGttaaAGGaAAAAA > SEQ ID NO:3144 216408 206031_300804_1
gCTAATCGCAAGATCGCAGCTCGCGCCCAAAATCAGTCAAAATGGCCCCTCAGAAGAAGAGCAAGAAGGATGCCAACAG
CATCAACTCCAAGTTGGCGCTtgttATGAAGTCCGGAAAGGTCACTCTCGGCTACAAGTCTACTCTCAAGTCTCTGCGA
TCCGGCAAGGCCAAGCTGATCATCATTGCTGGCAACACTCCTCCCCTGAGAAAGAGTGAACTCGAGTACTACAGCATGC
TGTCCAAGGCTCCCATCCACCACTTCGCTGGTAACAACGTAAGTTTTGCAATCTCAGACGCCCTGGACAAGTGAAGACC
TGGAAACGGGTATATCTACTTGCGCCATTACACACTTCTCGCTTCTTTCAGAAGCTACTCTTGCTACCCGAGAATTGCC
AATTCTTGCGGAATTGCCCAGAGAAGAAGTCTTTCAGACTTTGGAGGGTTCACATTGGCTTACATTATTCGTAAAACAG
ATTGAGCTCGGCACTGCCTGCGGAAAGCTCTTCCGCTGCTCCACCCttGCCATCCTGGATGCTGGTGACTCTGATATCC
TCAGCgaccaGcaggCTTAAATAGCCGAAATCTAGTGCATTCAAAacggcg > SEQ ID NO:3145 216408 253632_301629_2
tgaccctagcaagaagaagaaGAAGAATATTAGTTCCATCTCTTTGCCGGAAGTTCAACAGAGAAGGCAATCATGGTGG
CCGCTAAGAAGACGAAAAAGGCCCAAGAGAGCATCAACAATAGGCTAGCCCTAGTCATGAAGAGTGGCAAGTTCACTCT
TGGATATAAGACCACATTAAAGTCTCTACGCGGTGGCAAAGGGAAGCTTATTATTATCTCCAATAACTGTCCCCCCTTA
AGGAAATCAGAAATCGAGTACTATGCTATGCTCTCTAAAACTGGAGTTCATCAGTACAGTGGAAACAATGTGGACTTAG
GCACAGCCTGCGGGAAGTACTATCGGGTTAGCTGTCTTAGCATCACAGATCCCGGTGATTCGGACATTATCAGAACTGT
TGAATAGAGCTTAGAGAGGATTAAAGGCGGTAATGCTTATCATATTAGCTCATCTCGAGGGGGCTTCTTTGGAAgactt
GCATGAATTTCCCTAGTTTTCTTTTCTTGCTTTATTGGATCAGAGAAACCAATTAATATATATGGCTAAATTAAACATG
GAAAATTAAATTTGTAGTAGCCGACTGTTTTGCCGTGTCATTGGTGTTGCAAGTAAGGttctcgttTTTgTGCCAAAAA
AAAAaaacaa > SEQ ID NO:3146 216408 256592_301673_1
GAGAGGAGAGATCCAAGATGGTGGTCGCCGGGAAGAAGCAGAAGAAGACCCAGGAGAGCATCAACAACAGGTTGGCGCT
GGTGATGAAGAGCGGCAAGTTCACTCTGGGCTACAAGACGGTGCTCAAATCGCTGCGGAGTGGGAAAGGCAAGCTCGTT
CTCATCTCCAACAATTGCCCGCCGCTCCGCAAGTCGGAGATCGAGTACTACGCGATGCTCTCCAAAACCAACGTCCACC
ATTACAGTGGAAACAATGTGGAGCTTGGTACCGCTTGCGGCAAGTACTATCGGGTCTCTTGCCTTACCATCACAGATCC
AGGCGATTCGGATATCATCAAATCCATGTCCGCCGAGTGGAAAATCCATCCATCGATCAGCGCTCCTCTGTTTTGTTTCG
CTGTTCAACTTCTTGTAGGCCTCTTACTCTAGAAATATGGAACTTTAATGGAAAAACATTTCCTTCATAaaacaaaaca
aaa > SEQ ID NO:3147 216419 206771_300825_1
aggGGGTGATATTGGAATACCTAGGGACGCCTCTCAAACCGGCCTGTTCCATGAAGGAAACCCTGCAGCAGCGCCGTTA
GACTGACCTGACTTGACGAAAGCACCGGTCGAGACAGGATGAATTTGCGCAGCCGGGCATCGCAGCCGCACCCGCAGCG
CATCGCATCGCATCGCATCGCATCGCATCCAAGACAAGGCCGGTCCGGGTCCGGCCCAGCCAGCTGCTTTTTT
CATCATCTTCTTTTTGTTTCGGCGCCCCTCATGATATCAGTCCAGTGACGCTAGAGCAGGTGTCACATGGCCGATGACA
ACAACGTGGTGGTGCAGCTAAGCTCCGGCTAGCTGTTATCTGGCGACGGAATGTGTGTGATGCCATTGGGTGGTGTTGC
GAATGGCTGCTGGTTCGCGCGGGCTCACACTCACACCATCCATCACCAACAGCCCAATGACCTGTTCAACGTCCCTTGC
CCCATACGGTACTGTACATACATGTACTCGTGCAGTCCAGTCCAGACAATCTCGCTGACGGAGGGGCGCGCCACAAGTG
GAATCAATGGAGTGATCCAATGTGAAGGCATTTCTGTCTTCTTGGACAGGCAGGGGGTAGCAgtacctGCACGCACTGC
AGCGCATTTTAGCGCCGCTCCGTACTTGtACAtgagaagggggtccagCGCGCCACTTTTGTGcAgccaaGTgccaTCT
CGg > SEQ ID NO:3148 216427 1100565_301461_1
TGTTTCTTCGCTCGCTTTCCGGAGTACCACGAGGATCTCAGCGAAGGAGCGATGTTGATTCCCAAGAAAAACAGGGTTG
AGGTGTACAGGTACCTCTTCAAAGAGGGGTGCTATATGCCAGAAAAGATTTCAACCTTCCCAAACACCCTGAAATAGA
TGTGCCCAACCTTCAAGTGATCAAGCTGATGCAGAGCTTCAAATCAAAGGAGTATGTGAAGGAGAACTTCGCGTGGATG
CATTACTATTGGTATCTCACGAATGATGGTATTGAATACCTCAGGCAGTATCTCAACTTGCCTTCGGAGATTGTTCCGG
ATACATTGAAAAAGTCGGCACGACCTCCTGGTCGTCCCATGGGTGGCCCTCCTGGAGATCGTCCTAGGGGACCTCCTCG
TGATGGTGACAGGCCAAGATTTGGTGACCGGGAAGGTTACCGTGGTGGTCCCCCACGTGGACCTGGAGGATTCGGTGAC
AACAAAGGAGGTGCACCTGATAGCTTCCAACCATCATTCCGGAGTCGCCCTGGATTCGGACGAGGGGCTGGTGGCTTTG
GGAGTGGCGGTGAAAGCGGCCCTGCTTAAGCTTCTTCTCTGAGTAAAATAACCATCGGTTAGCTACTCAATAGCACTtg
gggTACCcgacatgTCTtgcaattGTGCTCCTTTatcaattt

FIG. 2 continued

> SEQ ID NO:3149 216427 128824_300478_1
ccccccccgagtccgtcccctttgctgctgcatttgggtggaggcttcagttgatttcccacttctcctcaattTTCGA
GCAGCTATGATTATCCCAGAGAAGAACCGGAGAGAGATCTCCAAGTACCTCTTCCAAGAGGGAGTATGCTTTGCAAAGA
AAGACTACAATTTGGCAAAGCATCCGAATATCGATGTGCCGAACCTGCAGGTGATAAAATTGATGCAGAGTTTCAAGTC
GAAGGAATACGTGCGTGAGACCTTTGCTTGGATGCACTATTATTGGTATCTGACCAATGACGGCATTGAGTTCCTCAGG
ACTTACCTCAATCTTCCTTCTGAAATTGTCCCTGCTACTCTCAAAAAGTCCGCTAAGCCTCTTGGTCGTCCCATGGGTG
GCCCTCCTGGCGACCGTCCCGTGGACCATCTAGGTTTGAGGGAGATAGGCCAAGGTTTGGTGACAGGGAAGGTTATCG
TGCTGGTCCAAGAGGTCCACCCGGTGAGTTTGGAGGTGAGAAGGGTGGAGCTCCAGCTGACTACCAGCCTGCATTCAGG
GGTGGTGGTGGAATACCTGGATTCGGGCGTGGGGCAGGAGGTTTCGGTGGTGCACCCCCTAGCTCAAGCTTCTCATAGA
TTGATCATATCTTTATTgtaGCTAGTTTTTATGCATTTTTGATAATCACATGTTGGAATTAACTTGCAGCGGTCGAAAG
CACTtggttCAATTGGGCATAAACTtctTTATTgG > SEQ ID NO:3150 216427 116574_300078_1
GTTTCGGGTTCCTCGACCTCTCGCCGCCGTCGTCCCGCGCGCTTGGAGGTCGGCCTGCTCGACGGTTGTCGCCATGATC
ATCCCCAAGAAGAACCGGAATGAGATCTGCAAGTACCTCTTCCAAGAGGGGGTTTTGTACGCCAAGAAGGACTACAATT
TGGCAAAACACCCACAGATTGATGTGCCAAACCTTCAGGTCATCAAGCTCATGCAGAGCTTCAAGTCCAAGGAGTATGT
CAGGGAGACCTTCTCCTGGCAGTACTACTACTGGTACCTCACTAATGATGGCATTGAGCACCTGAGGAATTACCTTAAC
TTGCCGTCTGAGATTGTACCTGCTACACTCAAGAAGTCTGCAAGGCCACCAGGCCGCCCATTTGGCTCTGGCCCCCCTG
GTGATCGCCCAAGGGGCCCACCTCGGTTCGAAGGGGACAGACCAAGGTTTGGAGACCGGGATGGCTACCGTGGTGGACC
TCGTGGTGCGCCTGGTGATTTTGGTGGTGAGAAGGGTGGTGCTCCTGCAGAATTCCAGCCATCATTCAGGAGTTCTGGT
GGTAGACCTGGCTTTGGACGCGGTGGCGGCGGTGGTTTCGGTGCTGGTCCCACCTCTTCCTCCATGGAGTGAAAGGAGC
TCAGGAT > SEQ ID NO:3151 216427 226345_300996_1
GCCAAAATGTTGATTCCCAAGGAAGACCGAAAGAAGATCCACCAGTACCTTTTCCAGCAGGGCGTCTGTGTCGCTAAGA
AGGACTTTAACCAGCCCAAGCACGAGGACATTGACACCAAGAACCTTTACGTCATCAAGGCTCTCCAGTCTCTGACCCTC
TAAGGGCTTCGTCAAGACCCAGTTCTCTTGGCAGTACTACTACTACACCCTCACCGACGAGGGTGTTGAGTACCTCCGA
GAGTACCTCCACCTTCCCGAGGGTGTTGTTCCCGAGACCCACAAGAAGACTGCCCGAGAGGAGACTGCTTCTCAGGGCC
GAGGTGGCCGACCCGAGCGAGGTCCCCGACGACAGGAGGGTGAGTACCGACGATACAACTCCAACAAGGAGTCTGCTCC
CGGTAACTACCAGCCTTCTTTCCAGTAAATGGGAGGATATATAAAAATGTATTATTCATGTTAAAACAACAAAAAAAA
C > SEQ ID NO:3152 216427 219735_300948_1
ttttggttgtacgcctgtTCCCGAAAAACCGTCAACTTTCCAACATCGACCCTCCGAGCAGCAAACCGCCACGATGTTG
ATTCCCAAGGCCGACCGCAAGAAGATTCACGAGTACCTCTTCCGCGAGGGTGTCCTCGTCGCGCAGAAGGACTTCAACC
TCCCCAAGCACCCCGATATTGACACCAAGAACCTGTTCGTCATCAAGGCTGCTCAGTCCCTCCAACTCCCGCGGCTATGT
CAAGACTCAGTTCTCTTGGCAATACTACTACTACACCCTGACCCCCGAGGGTCTCGACTACCTCCGGGAATGGCTTCAC
CTGCCTGCCGAGATCGTTCCTGCTACTCACATCAAGCAGCAGCGATCACACGCTCCTCCCCGTGGCATGCTCGGCGAGG
GCGAGCGTGAGCGACGACCTTTCGGTCGTGGACGTGGCGGCGACCGTGGTGACCGTGAGGGTGGATACCGAAGGAGGGA
TGCTGGCGAGGGCAAGGAGGGTGGTGCTCCCGGCGAGTTTGCTCCTCAATTCCGTGGTGGCTTTGGCCGTGGACGTGGT
GCTGCTCCTCCTTCCTAAACGAATCTGTCTCTTTCGGGGTTAACAAATCTTATGATGCATGGCGCAATAAGACAACGGC
ATGTAGTCTAAAAAACGTGAGGCAATCCTCACCATGAGTCCACTCATGAAGAAATGGGAAGTGAGGGGGGATATCGTGG
GAgtcttggaggttagA > SEQ ID NO:3153 216427 184561_300670_1
GAATTCAAGAGAGAGAGAGAAACAGAAGAGAAAAACATAAAAGAAGAAGAGCTTCCGTCGTCTCCAACTCGCCGCAA
CCATGATTATGTCCGAGAAGAACCGTCGTGAGATTTCAAAGTACCTCTTCCAAGAGGGAGTATTGTATGCAAAGAAGGA
TTTCAACTTGGCAAAGCATCCAGACATTGATGTACCAAATCTACAAGTGATTAAGCTTATGCAGAGTTTTAAATCAAAG
GAATACGTTCGTGAGACCTTCGCATGGATGCATTACTACTGGTTTTTGACTAATGATGGTATTGAGTTTTTGAGGACTT
ACTTGAACCTACCATCTGAGATTGTGCCTAACACTTTGAAGAAATCTGCTCAAACTGGAAGAGCACCACAGGGTGACAG
ACCTAGGCGTAATTATGAAGGTGGTGACAGACCTAGATTTGGTGGTGATCGAGATGATACCGTGGTGGTCCAAGAGGA
GGAGCACCAGGGGAATTTGGAGGAGATAAGGGTGGTGCTCCAGCAGAGTATCAGCCACAATTTAAGGGTTCTGGAGGTA
GGGGTGGTTTTGGTCGTGGTGGTG > SEQ ID NO:3154 216427 1109803_301525_1
GTAAAGGAGGATCTGAGGAGGTCGAAACGATGTTGATTCCCAAGAAAAACAGAGTGGAGGTGTACAGATACCTCTTCAA
AGAGGGAGTGCTGTATGCAAGAAAAGATTTTAATCTTCCGAAGCACCCAGAAATAGATGTGCCCAATCTTCAAGTTATC
AAGTTGATGCAGAGCTTCAAGTCAAAGGAATATGTGAAGGAGAACTTTGCATGGATGCACTACTACTGGTATTTGACAA
ATGATGGGATTGAGTACCTCAGGACGTACTTAAACTTGCCATCTGAGATTGTTCCAGACACTTTGAAGAAGTCAGCAAG

FIG. 2 continued

GCCTCCGGGTCGCCCCATGGGTGGCCCCCCTGGAGGGGACCGTCCTAGAGGCCCACCTCGTTTTGACGGAGACAGGCCA
AGGTTTGGTGATCGTGATGGGTATCGTGGTGGTCCTCCTCGTGACTCTGCTGGATTTGGTGACAAGGGAGGTGCACCAG
ATAGTTTTCAACCATCCTTCCGGAGTCGTCCTGGCTTTGGTCGTGGCGGT

> SEQ ID NO:3155 216427 254564_301633_1
GTTGTTAGGTTGGAGGAGTAAAGGAGGATCTGAGGAGGTCGAAACGATGTTGATTCCCAAGAAAAACAGAGTGGAGGTG
TACAGATACCTCTTCAAAGAGGGAGTGCTGTATGCAAGAAAAGATTTTAATCTTCCGAAGCACCCAGAAATAGATGTGC
CCAATCTTCAAGTTATCAAGTTGATGCAGAGCTTCAAGTCAAAGGAATATGTGAAGGAGAACTTTGCATGGATGCACTA
CTACTGGTATTTGACAAATGATGGGATTGAGTACCTCAGGACGTACTTAAACTTGCCATCTGAGATTGTTCCAGACACT
TTGAAGAAGTCAGCAAGGCCTCCGGGTCGCCCCATGGGTGGCCCCCCTGGAGGGGACCGTCCTAGAGGCCCAACTCGTT
TTGACGGAGACAGGCCAAGGTTTGGTGATCGTGATGGGTATCGTGGTGGTCCTCCTCGTGACTCTGCTGGATTTGGTGA
CAAGGGAGGTGCACCAGATAGTTTTCAACCATCCTTCCGGAGTCGTCCTGGCTTTGGTCGTGGCGGTGGTGGCTTTGGA
AGAGGTGGTGACCCCCTGCTCTTACAGAGTAATATATCTGGCAGTGGAGCCACTCGTTTGCAGT

> SEQ ID NO:3156 216427 259844_301709_1
GGTTCTTGATTGGCCGgccctaGTAGAGCGGCAGCTTGGGAAGAGGCTGGAGGCGACGCCGCGAAGATGTTGATCTCCA
AGAAGAATCGCGTGGAGGTCTACAAGTATCTGTTCAAAGAGGGTGTGCTCTATGCCAAGAAGGACTACAACCTGCCCAA
GCACCCGGAGATCGATGTGCCCAATCTCCAGGTGATCAAGCTGATGCAGAGCTTCAAGTCCAAGGAGTACGTCAAGGAG
TCGTTCGCCTGGATGTACTACTACTGGTACCTGACCAACGATGGCATCGAGTACCTGAGGACCTTCTTGAACCTCCCGT
CCGAGATTGTCCCCGCCACGCTCAAGAAGTCGGCCAGGCCACCGGGCCGTCCCATGCCCCAGCAGCCTCCAAGAGGTCC
TCCACGATACGAGGGGGACAGGCCGAGGTTCGGGGACCGCGAGGGATACAGGAGCGGCCCTCGAGGGGTGGATTCGGG
GACAAGGGTGGAGTTCCACCAGAATTCCAACCTTCGTTCAggggtCCAAGAACTGGATTTGGACGTGGTGGCGGCgGcT
TtgGAGGCCCCAGTGCTCCCGGCGCTCTCACCGAGTAGAGAGTttgtacatgttGTGGATCACTCGCATGCTCTAATGC
TAAATTTGATGTG > SEQ ID NO:3157 216427 36415_300077_1
ataagaagttaaaGCAAAACACATACAAACGCAGTCACCTTCTCTGTCGCCTCCTTCTTCAATCTCATCGCAATCATGA
TCATATCCGAGACTAATCGCCGTGAGATCTCCAAGTACCTCTTCAAAGAGGGTGTTTTGTTTGCCAAAAAGGATTTCAA
TTTACCACAACATCCTTTGATTGAGAGTGTTCCAAATCTGCAAGTTATCAAGTTGATGCAGAGTTTCAAATCTAAGGAA
TATGTGAGAGAGACCTTTGCTTGGATGCATTACTACTGGTTCCTCACAAATGAAGGTATTGACTTTCTTAGGACTTACC
TTAATCTCCCATCTGAGATTGTTCCTGCTACTCTGAAGAAGCAACAGAAGCCTCTTGGTCGACCTTTTGGAGGTGGTGG
TGACCGTCCCCGTGGCCCTCCTCGTGGTGATGGAGAGAGGAGGTTTGGTGACAGAGATGGATACCGTGGAGGTCCTAAA
TCAGGTGGAGAGTATGGTGACAAGGCTGGAGCACCTGCTGATTACCAGCCTGGCTTCAGGGGTGGAGCTAGTGGAGCAA
GGCAAGGGTTTGGTCGTGGAGCTGGTGGTTTTGGTGGTGGTGCTGGtCCAGcTGCTgGATCTGATCTACCTTGAAAAGG
ACtctctTgttTCTTTTggtctTATTTaaggtTACAtagcACCTTATTGagaacGaATgtGTCtTttGGAac > SEQ ID NO:3158 216427 291276_200077_1
TGAGGCTTCAGAGTGATTTCTCTCAGTTATCCGCTCTCTTCTTGCAGCAGCCATGATTATTTCAGAGAAAAACCGTAGA
GAGATCTCCAAATACCTCTTCCAAGAGGGGAGTATGCTATGCCAAGAAGGACTACAACTTGGCGAAGCATCCATTGATCG
ATGTGCCGAACCTACAGGTGATTAAGCTGATGCAGAGCTTCAAATCTAAGGAGTACGTTCGCGAGACATTCGCTTGGAT
GCACTACTACTGGTACCTTACAAATGATGGTATTGAGTTCCTCAGGACGTACCTGAACCTTCCTTCTGAAATTGTTCCT
GCTACTTTGAAAAAATCTGCTAAGCCTCTTGGTCGTCCCATGGGTGGACCTCCTGGCGATCGTCCTCGTGGACCACCAA
GGTTCGAGGGTGATAGGCCAAGGTTTGGTGATAGGGAAGGCTATCGTGCTGGACCAAGAGGTCCACCTGGTGAGTTTGG
AGGTGAAAAAGGGGGAGCTCCAGCTGACTATCAGCCTGCTTTCAGGGGTTCTGGTGGAAGACCTGGATTTGGTCGTGGA
TCTGGAGGTTTTGGTGGTGCACCCCCTAGTTCAAGCTTCTCTTAAGTCCTTGCTATCTTAggcTaggTGGTtGCaatTT
TGATTAtcagaTGGAAACACtTGGttgttcaTttctTGTCAAACTTAAAattccaagCTGGGAAagtttatctttaTg
ggttttagagaaCTAtaagttttActtcTGTtTCT > SEQ ID NO:3159 216429 211282_300897_1
GCACCATCTCGCTCCGGACACGGGAGAGACTGCGCTGTCCATCTGATGGCCTAGATTGGCAGACGCCGGGGCAATTGGC
ACGTACGCTGCCACCGACTTTGCATCCCCGGGGTCCTGTCCTGTCTCTCCAAATCCAAAGACCTCTTCTCCATCGCACA
CGAAGCATCGAGCCAGAGCATCCAGCCCCGCCCAGATCCCAGCCCGAGTACGTTGCGTGAATGAGCGGCCAAGACGGGA
CAAATCTCGAGGTTACGCTGCATCTGTTCTAACCTGCCACGCTGCTACAGTACAAGGACACCCTCAATCACATACGGAT
CGGCCCTGCGAATCAGCCCTGCGACTAATAATAGCCCTGTGAATCGGCCCCTGCTGAACCGGCATCCGAAAAAAAAAA
AC

FIG. 2 continued

> SEQ ID NO:3160 216430 211418_300899_1
GTACCGGCTAAATACTCGACGAAATGGTGTGAATCGTCGCGTAATGGTTGGACGATGGAGCGATGTCTTTATACTCTGC
TACGCTTACTTATCCACAACTTTATTTCGATTCACCGTGTGCTACAAATAGCACCCCACGGCGGGCTCTCGGAATTATA
GCTACAGTATTAAGCAATTGTATAATAGATTAAGGTTAGTTTTCCGAGTGAGCCGTTGCATCTCGGGCGGCAATCTGGG
GAGCATATTAGCAATAGATGAGCAATAG

> SEQ ID NO:3161 216433 211259_300897_1
TGGCCGCCTCCTCACAAGTTTGAAGAAGCGCTCAAGGACGGCATCACGGAGTGCAATGAAGCTGTACAAGGTCAGAGAG
GTCATGGTAAAGAGATGGTCGAGCAATCGAAACCGATGAATGGACTGTTGATGTCTATTTCAATTTCTACATTTTCCTT
TGCAGTGTCTTTTTGTGTAACATTACGGCGATACCTGGGGAATTTATTGAATGTGCAAATGCTATGGGAATACACGTCG
GCGACAACGTGTGTAATGTATACGAGAAACGATGGAACGAATCTGGATCAAATTACAGATGCATTTTAAAC

> SEQ ID NO:3162 216438 211360_300957_1
GGCTGGCGCCAGACGCGGTTCGTGAATGCATAGGTGCTCTGCTGGCAACTGACGTCTTGGGGCTTGGGTTGAGGGATGC
GGGCGTGTTGTATGGAGAGGTGCATGATGTGGGAGAGAGGGCCCCTGGTGAGACCCCACCGGGTGAGCGGTGGCCATAT
GAGCTAGCAGAAGGCGGGATAGAGATGGAAGACACGAAGAAGCCGGGTCGCGAAgaGGCGCTGTTCAGCATTGATGTCG
CGGATTGAGGGCCCGACGACAGGCGAGGAGtaggaGAACCGCGGGATGCACCTTGGCCAGACATCATGTGTAAGCCAAG
GTCGTCCGATGCTGGGCTGGCGGCCCGGCGCTTCTGACCTGCGCCTGCGTATGCATCTTCAATGTGAAGTCTCTTGaca
gAGGATGTCTCATCAATCTCCATATCGTCAGCAAAGCTGCCCTGGGTGGAAGTGGCATCATCGCTGTTgtTccgTCttg
ACCTGCCTCGGggTGAACGATCTGGTCC > SEQ ID NO:3163 216449 206630_300824_1
gggcgaAGATACGCAATTCCACAATCGCCATGGCGAAGCCGTATGTGCCGCATGACGTCCTTGACGAGACGGCCAAGAC
TTCATTGGTCGGCCTGGGCAGCGGCTTCTTCATTGCCGCCATCCAGAATGCCCTGTCGAAGCGCAACGTGGGCGCTATG
AGCGTCTTTACGCGGGGAGCTCCCATCATTGGCATTTGCGCTGCCGGTCCCGGTGCCTACGCCTTCTTCTCCCGGACGA
TGATGAACCTGCGGGAGAAGGATGATGCTTGGCCGCCGCCTTTGGAGGCTTCATGTGCGGCAGTGTCCTCGGACTTCC
TTTCCGACGCACACCCATCGTGCTGGCTCTTGGTGCTTTCGTTGGCACTGCCCAGGGCCTTTTCCACGTCACCGGAGGA
AAACTGGACAGCTTCTACAAGGAGGAGGATGAGTTTGAGCGCAAGGAGACTGTTAGACGGACAACCCGGTTGCCCGTTG
AGCAGACTATTGCCGAGCTGGGCGAGGGACGAGGCATCCGTCCTCCTGGATATGAGGAGAGAAGACGAGAGCGCATCAA
GGAAAAGTATGGCTTCGAAGTTAACCCTGTGAGCGCCACCGCTGAGGGTAGCCAATAAAATGATATCAAAAAAAATAT
GaaagaattaaagTcAGC > SEQ ID NO:3164 216450 211322_300957_1
GGCCAATGAGATTCTTTTCTATTTCGAGCCCCAAGCAGAGCTCATTCGTTAGCATCTTGCTACCTACACCCTGCATGCG
CATACGCGATGAATGGGCACCCGGTCTGTCTGCACTCTCGTACCCTCTGCTCAAACAAGCGAGAAACAGACGCCTCTGT
CGTCTCACTCGCTGCGCCAGCGCCTTGGCCTGGGTAAAGCGGCTGGGTAATGCAATCCGGCGCAACGGCCTTTGCCATG
TCTGGAACGCAATGCTACGCAAGTAACAGTAATGCCTGCGTTTGGTGCAGGTCGTCGCTCGCCACCGCTGGCTGGCTGA
CAGCCGGCAGTGCCGCAGACACGTATAATGATCCCACTCCAATACGTACAGAGACAACTGGCACACACCCCCAGGCCTG
AACGAGAGACTTGGATCTGGGAGCGAGCAAATTGATCTGATGCTGGCTAGCACGTACTACCCGACTTGACTTGCTACCA
TGTTGATACTGTATGCCTCGACTCGCCTTGCACGAACCATCTCATCGCAAGTCTGATCCGACGTGGAG > SEQ ID NO:3165 216461 212130_300874_1
cccacgcgtccgcggacgggggggcggacgcttgggttcgacagaagccgagttaagcggcgatagaagcaacaaaggt
gAAGTTGTGCCGGTCTGGTGGTTTATTGGAAAGAAACGAAGAGAAGAATGTTCCGGTCAAGGGAAGCGGCCTTTGGTCA
GTAGCCAAAGGGCAGATCAAGCGCCGCCTTGGAGGATTAAAAGGGCGGCTGCAGGGGTCCCAAGGCTGGTGCGCCTCAT
GGAATTGTATCGAagaAAGTCGATGGTGTGGCGGTGCCCGATAACGCAAAAAGCTGGCAACCTTTGTGCTGCCATGCGG
GCTAGCAGCGGGTACCGCCGAGTATTTGTTTGTCACTGTACAGAGGCGAGACGTGAGGCCGAgatTCGCATTGGTTCGG
AGTCTGGAGTAGGGAGGACAATATGGTAGCACGATTGTCATTGTGATTGCTTTGTTTATTAGTACTTAAAAAAAAAAT > SEQ ID NO:3166 216463 211675_300901_2
GGCCAATATGTGGCCTGCATGCTGTTTCTGATACAAATCCTCGTAATGCACAGACGTGAATAGTGCTGGCACAAGTCAC
ATTGCTGCTGCCTTGAAGGGTTCCATTTACATTTTGGTGCAGCTCTACCAACCG > SEQ ID NO:3167 216465 195679_300636_1
tCAACATTTCACCGTGATGATAATAGTCAAAGACCAAATCTCTTCTACGGACATTGAGACGATATCAATGAGCCGAGAC
AAAATGGAAAAGCGGAAGCACTAACGATTCAACTCTTTCTTCTCCTTGGCGCTGCCCTAGTGTCCATCGGCGGACGAT
TATACGCCCGATGGCGGCAGGTCGGAATGAAGAATCTTGGTCTTGATGATGGGCTTGCCATTACAGGAGTGATTCTCTT
TGTGCCCAATGTGGTCTTGGCATACATGATGAACACGCGGACCCATTGGATGGGCAATCATTCTGTCGGCAACAATACT

FIG. 2 continued

ACAACACAGCCGAGCCATAACGAAGATCAAATGAGGGAACTGGGATCGAAACTCTATCTATACAGCTGGTTATCCTATT
CCGCTGCATTATGGACGTTCAAGGCAGCCTTTCTCGCAAATGTCCTTCGTCGAATTCCCGAATCCGGCAGACGACAAAC
CCACCAGTATCTCGGCTTTGGCTTCCTGGCTGCAACATGGGTAGCAACGACGATGGCTCTCCTCCAAAGCTGTCGACCG
TTGCCCCACATGTGGCAGGTTTATCCCAGCCCAGGACTGTACTGCCAGCCTGCTACTTCACCGGTGCTGGCGTGGGTTT
ACTTCAGCTTCGATATCGTTACAAACCTCTATCTAGCGTCTGCAGCTACTCCTGTCGCTACTAGAAAAGACAAACCCAC
ATGGGAAAAGCTTCAGTGGGTCGCAACGCTTGTTTGCGGGCTTCTAGCCAC

> SEQ ID NO:3168  216471  211746_300870_1
GAACAATGCAGCTGGTGACAGGTTTGTCAAGTGGCAGGGGAGAATCGTATTCGTGTGGCGATGGTGATGTCGAATTTCG
AATGAGGGAGCCTTGGCGCGAAGAAAAAGAAGAGAGAGAGAGCGGAGAGGAGAGGAGAGGAGAGTGAAACAAGGAG
AAGTACAGAGGAGAGAGGAGAGAGACGCTGTGGTGCTAAGCAACCACGAGAGAGGAACATGAATGCGGTTTACAAGGTT
GACATTGGCGAACGAGCTTGGACCGCTTTGACAATGTGATGTGATGCAGGCTGGGTACTCCAAATGTTTCCAATTGAAC
GAATATCCAATCAGACAAGTAGAGA

> SEQ ID NO:3169  216488  219292_300929_1
GGAGGAGTGGCCGCCTTGGTAGCGGGCAAGGATGGCGATGAAACGTCAATCGTGCTTGACCCGGTAGCTTTGGAGCATG
AGTCTGTTCTTGCTGCCTGCTGCGTTGCATATCTACCCAACAGAGATGAGATCACAAATCTGTGGTTCAAAGGTCGGCT
GCCCTCAACAGCATCTCACAATCATCAGTCACTTGTCTCAAGGGCAGTGCACGCGAGTAAAGGAACACATGGGTTGATA
TCGGCGGCTCTCAGCGAAGTTATTGGCAATTCTCAAAACTAAAAGTACACCGCGttgagTAATAATGACGAtaATAACG
ATAATCTGGATCATGTATGCGCATTGCATACATTCGACATTCGCGTaggccAGGTGGGTGTGCTCCagaGGGGCATCTC
GAACATCTGGTGAGCGAAGAGAGGTCAGCACCGCTGTAAGTGCAACCAATCAAAttcATTACGAATACCATTGGCTATT
GATGGagACAATCACCAATGttaGgtgGTATgaggcatTgctATAAAATgctACttgttcgttaccACAATcagagaaA
TATCAAgtATAtTTATTAagaTcTATCTaAagcctTCATttccataccATatcggGcgggg > SEQ ID NO:3170  216489  204930_300794_1
CAATTGACACCCAAAGCTTCAATAACCTAACCAACCCTCTTATCCACAATGAAGAAAGCTGCGCCTGCGGCAAACGCTG
CCCGAGATGCCGGATCTCACGATCATATGCTCCAAGGAGGCCATGCCATAATGAAAGACGACCCTGAAGACTTCAACGC
TCCCAAGCTTTCCGAGAACATGTCGAAGCAGACTGGTCTTGGGGGATCCAAGCAGGGCAGCTTGCAAGGCAGCGCCGGC
ACTGGCGATAGTATGAGGCAGCGAGACACTCAAAGCCATGTAGGTCAAACATGCGGTGGTATACAATTGTGCTGACTAG
TATGAGTGATGAATACGGCCACGTAAAAAACGAGAATGCATTGCCGATTCGAAAAGCTGGTATCAGTGGGACATGCACA
CGATGATAGGAGTTGACGAGAATCCCGAGTTTGAAACATGTTGAAATAGGTTGTATAATATCATGGCGAGCAAAACCAA
TATTGAAACTATTTATAAACGCTtt > SEQ ID NO:3171  216489  214238_300856_1
tcCCATCCGTGCTCTTGATCCAAAAACCAATTGACACCCAAAGCTTCAATAACCTAACCAACCCTCTTATCCACAATGA
AGAAAGCTGCGCCTGCGGCAAACGCTGCCCGAGATGCCGGATCTCACGATCATATGCTCCAAGGAGGCCATGCCATAAT
GAAAGACGACCCTGAAGACTTCAACGCTCCCAAGCTTTCCGAGAACATGTCGAAGCAGACTGGTCTTGGGGGATCCAAG
CAGGGCAGCTTGCAAGGCAGCGCCGGCACTGGCGATAGTATGAGGCAGCGAGACACTCAAAGCCATTGATGAATACGGC
CACGTAAAAAACGAGAATGCATTGCCGATTCGAAAAGCTGGTATCAGTGGGACATGCACACGATGATAGGAGTTGACGA
GAATCCCGAGTTTGAAACATGTTGAAATAGGTTGTATAATATCATGGCGAGCAAAACCAATATTGAAACTATTTATAAA
CG > SEQ ID NO:3172  216492  212062_300873_1
GAAAATACTCCAAAATCAATCGTATCACCAATTCTATCAACTGCATCGCCAAATCGCCATGCCTGAGGGACGTCAATCT
CCTCCTCCCGAGCGCCAATCCGCCGCCCAAGTAGGGAACACTGGATCCGGCAAGGCCTCAGATATCAGCAAGACCAGCC
AAAAGGACCCAAAATCCCAGCTCGACTGTCTCACATCGAACCCCAAGGGACCGATGGACGATGTGCTTAAACACAAGTT
TTCCAGGGAGCCTGGAAACTGTGAGCGCTAATTAGAGCGACTCGTCTTCCGCAGTTCGCGACTAATGAATTATCATAGA
CACTCCGTTGAACGCTTAGGGAGAATAAATCGTCATGTTGTACAATAGTCATTCATAGCATCAATTATTGCATCGCTAT
ACTATAacaAAAAAAAAAAA > SEQ ID NO:3173  216495  212270_300875_1
GCTGACTGAAAATGTTTGAATCTTGCCAATAGAGTCCTAGATTTGTTCCTGCTATGGGTTCGACAGCATTTTGGCACAA
GGGGACGTATTTTCGGGTTCACCGAAAAAGGAATCGTTTGTCAACACTCATTCGTGGGGAGGCCCAATGAAAGACCTA
GAAGAGATTAAGGTTTCTTGCTTTGGTCGTTCCATCGATCCAATCAAAGAGTTACTCGCGGATGCCAAAGCTCTTTATT
ATAATGACACGCGCCAAAAGACGACCATCTATCGTCCCAGAGTCAAGGAGCAACGAAGGGACCATAACATGTGGCAGCA
AGTAGCACGACGGCCCGTTAGACCCATGTCAACAGTTGTGCTCGACTCTGGCGAAAAGCATGATATTCTGGCCGACGTC
AACGAATATCTGCACCCCTGGACGCCGCGATGGTATGCATCTCGAGGTATTCCGTTGAGGCGGGGATATCTGTTCCACG
GGCCACCAGGCACCGGAAAGACGAGCTTCTCCTTTGCGCTGGCGGGCGTGTTTGGGATCGACATTTATGTGATTAGCCT

FIG. 2 continued

> SEQ ID NO:3174 218801 180901_300652_1
CGAGCTCGGTACCCGGGGATCCTCTAGAGTCGagCTGCAGGCATGCAAGCTTGAGTATTCTATAGTGTCACCTAAATAG
CTTGGCGTagtcATGGTCATAGCTGTTTCCTGTGTGAAATTGTTATCCGCTCACAATTCCACACAACATACGAGCCGGA
AGCATAAAGTGTAAAGCCTGGGGTGCCTAATGAGTGAGCTAACTCACATTAATTGCGTTGCGCTCACTGCCCGCTTTCC
AGTCGGGAAACCTGTCGTGCCAGCTGCATTAATGAATCGGCCAACGCGCGGGGAGAGGCGGTTTGCGTATTGGGCGCTC
TTCCGCTTCCTCGCTCACTGACTCGCTGCGCTCGGTCGTTCGGCTGCGGCGAGCGGTATCAGCTCACTCAAAGGCGGTA
ATACGGTTATCCACAGAATCAGGGGATAACGCAGGAAAGAACATGTGAGCAAAAGGCCAGCAAAAGGCCAGGAACCGTA
AAAAGGCCGCGTTGCTGGCGTTTTTCCATAGGCTCCGCCCCCTGACGAGCATCACAAAAATCGACGCTCAAGTCAGAG
GTGGCGAAACCCGACAGGACTATAAAGATACCAGGCGTTTCCCCCTGGAAGCTCCCTCGTGCGCTCTCCTGttccGACc
CTGcCGCTTAccggatacctgTccGCCTttCT > SEQ ID NO:3175 218801 234301_301099_1
tacTCACTATAGGGCGAATTCGAGCTCGGTACCCGGGGATCCTCTAGAGTCGACCTGCAGGCATGCAAGCTTGAGTATT
CTATAGTGTCACCTAAATAGCTTGGCGTAATCATGGTCATAGCTGTTTCCTGTGTGAAATTGTTATCCGCTCACAATTC
CACACAACATACGAGCCGGAAGCATAAAGTGTAAAGCCTGGGGTGCCTAATGAGTGAGCTAACTCACATTAATTGCGTT
GCGCTCACTGCCCGCTTTCCAGTCGGGAAACCTGTCGTGCCAGCTGCATTAATGAATCGGCCAACGCGCGGGGAGAGGC
GGTTTGCGTATTGGGCGCTCTTCCGCTTCCTCGCTCACTGACTCGCTGCGCTCGGTCGTTCGGCTGCGGCGAGCGGTAT
CAGCTCACTCAAAGGCGGTAATACGGTTATCCACAGAATCAGGGGATAACGCAGGAAAGAACATGTGAGCAAAAGGCCA
GCAAAAGGCCAGGAACCGTAAAAAGGCCGCGTTGCTGGCGTTTTTCCATAGGCTCCGCCCCCTGACGAGCATCACAAA
AATCGACGCTCAAGTCAGAGGTGGCGAAACCCGACAGGACTATAAAGATACCAGGCGTTTCCCCCTGGAAGCTCCCTCG
TGCGCTCTCCTGTTCCGACCCTGCCGCTTACCGGATACCTGTCCGCCTTTCTCCCTTCGGGAAGCGTGGCGCTTTCTCA
TAGCTCACGCTGTaggtatCTCag > SEQ ID NO:3176 218801 316901_301428_1
tcactATAGGGCGAATTCGAGCTCGGTACCCGGGGATCCTCTAGAGTCGACCTGCAGGCATGCAAGCTTGAGTATTCTA
TAGTGTCACCTAAATAGCTTGGCGTAATCATGGTCATAGCTGTTTCCTGTGTGAAATTGTTATCCGCTCACAATTCCAC
ACAACATACGAGCCGGAAGCATAAAGTGTAAAGCCTGGGGTGCCTAATGAGTGAGCTAACTCACATTAATTGCGTTGCG
CTCACTGCCCGCTTTCCAGTCGGGAAACCTGTCGTGCCAGCTGCATTAATGAATCGGCCAACGCGCGGGGAGAGGCGGT
TTGCGTATTGGGCGCTCTTCCGCTTCCTCGCTCACTGACTCGCTGCGCTCGGTCGTTCGGCTGCGGCGAGCGGTATCAG
CTCACTCAAAGGCGGTAATACGGTTATCCACAGAATCAGGGGATAACGCAGGAAAGAACATGTGAGCAAAAGGCCAGCA
AAAGGCCAGGAACCGTAAAAAGGCCGCGTTGCTGGCGTTTTTCCATAGGCTCCGCCCCCTGACGAGCATCACAAAAAT
CGACGCTCAAGTCAGAGGTGGCGAAACCCGACAGGACTATAAAGATACCAGGCGTTTCCCCCTGGAAGCTCCCTCGTGC
GCTCTCCTGTTCCGACCCTGCCGCTTACCGGATACCTGTCCGCCTTTCTCCCTTCGGGAAGCGTGGCGCTttCTCATAG
CTCACGCTGtaggtaTCTCagtTCGgTgtaggtCGttcGCTccaaGCTgGgct > SEQ ID NO:3177 218813 199675_300751_1
GGCAAGTGCGTCTTCTTCTCGTGTCCACTACCAACGTTTGGCGCATCACAGCCGCGGCAGAGCCCAACTTGATTATCAC
ATCCTTGGTCACATCCTTGGGTTGTTGTCGATTCGCCTTCCATCCCCTCCATCTAGGCCTAATTTCATCCACCTCCAAC
CTTCCGCCCCCAACCTCCTTTCTCCTTGTTTACAACAACAACAAACGACCATCGATTCGACAGCTCGCGTGCGCATACA
ACACACATATCGTCGCCAACATGTCGTTCATGGGAGGCGCAGAGTGCTCAACGGCTGGCAACCCCCTGAGCCAGTTCCA
GAAGCACGTTCAAGATGACAAGACACTACAACGCGATCGTCTCGTCGGCCGGGGACCAGGCGGCCAGCTGGGAGGCTTT
CGCAGCTCGCCTGCCAATGCGCCCCAGGATGAGATGATGAACGGTTTCCTCAATGGTGGCCCAGGTCTTCAACAAGAGT
TTCCAACCTTGCCAGGCGGGCCTGCTGCCCACCTGAGCGCTGCCCCTATGGGCCCTTCGCCTGCGGCATGGGCACAAGA
CTTCAACGCCCAGCCCGGCATGGACGTC > SEQ ID NO:3178 218859 200114_300815_1
ATTCTAAAACAGTCAGCAGGGCTCGAGGCCTTGTGCGGCAGATATGGGGGCCAGCGACTCCAAGATAGGATTTAAGCAG
GGCATCTTCAGATTATCAGAGGAGCGCAACATTGCGGCGCATGATCCTTACTGGACTTCGGTTCGTCATGCCTTTGATC
CCAGATGGCCGCGGGGATGCTGATGCTGATGGGGTCATAGTTTTGGGAGCTTCCTGAATCGTCGGAAGATGTTTTTAGT
CTTTT > SEQ ID NO:3179 218924 258513_301697_1
ACAAAAACAACAATGTCTCTCAAGGTCGACGGCTTCACTTCTTCTATCATCTTCGACGTCATCCGTGACGGTCTTAACG
ACCCCTCTCAGGCCAAGCAGAAGGCTGAGTCCATCAAGAAGGCCAACGCCATCATTGTCTTCAACCTCAAGAACAAGGC
TGGCAAGACCGAGTCTTGGTACCTTGACCTCAAGAACGACGGTGACGTCGGCAAGGGCAACAAGTCCCCCAAGGGTGAT
GCTGACATCCAGCTCACTCTCTCTGACGACCACTTCCAGCAGCTCGTTGAGGGTAAGGCTAACGCCCCAGCGACTCTTCA
TGACCGGCAAGCTCAAGGTTAAGGGCAACGTCATGAAGGCTGCCGCCATTGAGGGTATCCTCAAGAACGCTCAGAACAA
CCTCTAAGCGCATCATTTATTGATTAATTGATGATTTACTATATCGaagaaAAAAAAAAAA

FIG. 2 continued

> SEQ ID NO:3180 218926 218525_300958_1
ccacgcgtcgccAAGACGAAAATGGAAGACTACAGCAACGACCCCAAACATGACCTCACCCCAGAGGCTGCCGCCCTGG
CACAACTGGGTCACAAGCAGGAACTCAAGCGAAATTTCTCCCTGATTTCTATGCTGGGTCTTGCCTTTGCCATCCTCAA
CACATGGACGGCCTTGGCAGCTTCAATTACACTCGCTCTCCCCTCTGGCGGCGCTAGTTCCGTTATCTGGGGTCTGATC
GTGGCCGGTATCTGCAATCTGTGCCAGGCTGCTTCTCTCGCCGAGTTCCTTTCCGCCTACCCCACAGCCGGAGGTCAGT
ATCACTGGGCCGCCATTGTTTCATGGAAGCGATGGAGCCGCGGTATTAGCTATGTTACTGGGTGGATCAATGTATCCGG
CTGGGTTGCTCTTAGTGCCACCGGTGGTTTGCTTGGCAGCACATTCATCGTGAACATCATTTCGCTGCTTCACCCCGAC
TATGAGCCTAAGGCTTGGCATCAATTCCTGATTTACATCGGCTTCGCTCTCATTGCCTTGGTCATCAATGCTTTCATGA
CCAGAAttCTGCCTCTCTTCACCAAGGcCGCGttCTTCTGGTCGGTTgccGGCtTCGTCATCATCAGCATTACGGTCTt
ggccaccgCGTccCCGg > SEQ ID NO:3181 218947 130266_300486_1
GAATTCAAGAAGAAAACAAACAGAAACTTCGTTGGGCCTTAAAATGTGTAATTTTTTTTCTCAGTTAATTACTTAACAA
AATTAACCAAACAAAAATCAATCCCATTACTGAATCCTGATCCTAATCCTAATCCAAATCCAACAATATTATTTTATTT
ATCTCTTCGTTTTCAGAGATAAAAAATCATATAAGTCTCTATTCCCAAGAAATTTATTAGTCATTACTCTGTTATTTCT
CAGTATCAGGATAAACTTAAAATTGAGAGAAAAAAATGGATCAGAAAGGAGAACAAGTATACGTGGGATCAATTGATCA
AGGAACAACAAGTACAAGATTTATAATCTATGATAAATCATCTAAAACTATTGCATCTCATCAAACTGAATTCACTCAG
TTCTATCCTGAATCAGGATGGGTAGAACACAATCCGATAGAGATATTAAAAAGTGTGAGACTTTGTATGGCAAAAGCAT
TAGATAAAGCAACAGCTGATGGATATAATGTTGATGAAGGATTAAAAGCTATTGGGATTACAAATCAGACAGAAACTAC
TCTTGTTTGGAGTAAATCTTCTGGTTTACCTCTACATAATGCTATTGATTGGATGGATGCCAAAACTACTAATATTTGC
AGGATATTAGAGAAAGAATTATCA > SEQ ID NO:3182 218947 205143_300796_1
TCTCAGTCGTGTCTGTCATTATTACTCGACCAGCGCAGCTCTGCTCTGTAGTGTCTGTATATTAAGACGTCGTTCCTGC
CATCTCTTCCCCCTTA > SEQ ID NO:3183 218947 240394_301313_1
GGGCCGCGAATCTGCCGCATTCATCGGGGCGATCGACCagGGCACCACAAGCACTCGATTTATCCTCTACGATCGCGAT
GCGAAGGCCGTCGCGTCGCATCAGGTGGAGTTTGCGCAGATTTATCCCCAGGCCGGATGGGTGGAGCATGATCCCATGG
AAATCCTCAAGACCGTGAAGGTTTGCATGGAAGAAGCTTGCGGCAAGTTTGCAAGCAAGGGTGTAAACTTCGATGTGGA
AGCTATCGGGATAACGAACCAGCGCGAGACAACCATTGTGTGGAGCAAGAGCACTGGCAAGCCTCTCTACAATGCCATT
GTTTGGATGGATACTAGAACAAGCTCCATTTGCAAACGCTTGGAACAAAGTCTCTCTGGTGGAAACAAGCACTTCGTTG
AGAACTGTGGACTTCCAATAAGCACGTACTTCAGCGCTTTGAAGCTACTGTGGCTGCTGGAGACGGTCCCCGACGTGAA
GTCCGCCGTGCTCTCCGGCGACGCTCTCTTCGGCACAGTCGATAGCTGGCTCATCTGGAACATGACCGGCGGCATCTCC
GGCGGTCTTCACGTCACGGActgctccaacgCTGCTAgaaccaTGCTCATGGACCTCA > SEQ ID NO:3184 218947 253075_301648_1
ACCACAAGACCCACCACAAACCCCACAACATGTCTTCCTACGTAGGAGCTCTCGACCAGGGTACCACCTCCACCCGTTT
CATTCTCTTTTCGCCTGACGGCAAGCCCGTGGCATCCCACCAGATCGAATTCACCCAGATCTACCCCCACCCCGGATGG
GTGGAGCACGACCCCGAGGAGCTCGTGAGCTCGTGTCTGGAGTGCATGTCGTCGGTGGCCAAGGAAATGCGAACCCAGG
GCATCAAGGTGGCCGACGTGAAGGCGATCGGAATCACCAACCAGCGAGAAACCACCGTGCTTTGGGACATTGAGACCGG
CCAGCCCCTGTACAACGCCATTGTGTGGTCCGACGCCCGAACCGGCGACACCGTCAAGAAGCTCGAGGCCCAGCCCGGC
GCTGACGAAATCCCCAAGCTCTGTGGCCTGCCCCTGTCCACCTACTTTGCCGGAGTCAAGGTCCGATGGATCCTGgATA
ACGTCAAGGAGGCCCGAGAGTGCTACGATCGAGGCAAGCtggcctTCTCCaccATCGACTCGTGgctgctcTACAAcCT
CACggGCgg > SEQ ID NO:3185 218977 189092_300612_1
AGGGTATCGTTCTTCCCGTGCCGCCGCCGCCGGCGGCGCTTCATCCCGACGCCGAAAGCCCGAAACCTAAACACCTCCT
CTTCCTCGCACGCCCATCTCCCGGATTCCAACCAAATCTCCGGGATGGCCTCGAACTGCTTCCGCGCCGCCGCCCGCATG
GCCTCCTCCGCCTGCCGCTCGGCGGCCTCCCGCTCAATCCCCTCCGCCGCCGGCGGCGGCGCCCCTCGCATCTCCAGGC
TGCCGGTGGAGCTCGGGTGCAGCGCGGGGTTGTCGCTGCTGCCGCTGCACAGCGCGGTGGCGGCGGCGAGGCTGACGTC
GCGGCTGAGCACGGCGTCGCGGAGCTGCTGCGCGCTCTCTCAGGGCACATGACTTGCTAGTTCTTGAAAGATTTTACCA
GGAGCTTGCTGTTTTGCTTCACAATCATCGAGAATGAGTGCCTTAACATGTCAAATTGTAATCAAGATAGCGTTATGT
TGTTTAAGCTAGAATCTTAGCTGCCTATGTTGAGGGGCAACATGATGGAATAAAGTAACATC > SEQ ID NO:3186 218985 212485_300849_1
AATAATCCAATTCTTTCAACATTCACTTGACGAAATGGCAAACCTTGCTACTGGGATTCACAAATTCCAAGGGCCGGAC
ATTGAACTAACTTATACGGTGCGAAGATCCGGACCATATCTTATTATTCAGGCAGCAGGATGGGGAATTTCTTCTCAGT
ATCTTCAAATTGGGCTTTCGCCTCTTGAGGCTCAATTTACCCTAATATACATGGAGCCCCGCGGCTCAGGCCCCTCCGA

FIG. 2 continued

```
GCGACCACAAGAAGACATAATGAGCACTTCCGATATGACTGACGACCTCGAGCTTTTACGAAAACACTTGGAATGTGAA
CAAATTAATTTGCTTGGTCATTCTAATTGAGGCACCATCGCCTTAGCGTATGCTGAGCGGTAGCCCGCCTCAGTCCGAA
ACTTGATCCTCCTCACACATTGGCCCGAAGGATACGATGACAGTCGCACTTGGCAACGATTTCTAGATGAGAGAAAGGG
CAATCCAGCATTTTCAAAAGCCCTTGCGGTGCTTGAGATAGCCGAAACT

> SEQ ID NO:3187 218986 213174_300847_1
cccacgcgtccgAGTTGCTGACTGACCAGGTGTAACTAGGAGCGGGCAGTAGTACACAGTCTTTGTCTTGTCTTTGTCT
TGTTTCTTCGTTGATATACCGCCGCCTATCATGCGCCGTCTCCTCTCCGTCAGCGCCTCTGCCAGTGCCCGCGGATTGA
CTGCCGCTTCCCCTCGGTCTACCATTGCCCTTGCCAAGATGGCCTCCAAGGCTCAGGCTGCCACAGCCGTCAGGAGGAT
TCATGCCACGGCTCAGCAGCTCAAGCCAATGGACGCCCTGTCGTCCACGGCCACCAGCTTCCCCACGACGCACGAGCAG
ATCGAGAATGTGCAGAACACGCCCTACTTCATCAACAACAAGTTTGTCCAGTCGACGACGGACAAGTTCATCGACCTGC
CCGACCCGGCCACCAACAACCTGGTGACCCGCGTGCCGCAGATGACGCAGGCCGAGATGAAGGCCGTCATCGAGAGCTC
CGAGAAGGCCTTCCAGTCGTGGAAGAACACCACCGTGCTGTTCCGCCAGCAGATCATGTTCCGCTACGTGCAGCTGATC
AAGGACAACTGGGACAGACTGGCCGCCAGTATCACGCTCGAGCAGGGCAAGACCTTTGCTGATGCCAAGGGCGATGTGC
TCCGTGGACTGCAGGTCGCCGAGGCTGCCGTTGGCGCCCCCGagCTGCTCAagGGcgaggTTc > SEQ ID NO:3188 219006 205276_300797_1
CTCTGTCGTCTCTCTCCATATCGAATCTTCTCTTCTCCTTTGATACCCTCTCGGTGTTGCAGACAGAATCATCAGTCAC
AATGGCTTCTCAGCAGATCCGCACTCCCATCACCGATCTTTTCAAGATCAAGCACCCCATCTTACTGGCCGGCATGAAC
GTCGCCGCCGGTCCCAAGTTGGCGGCTGCCGTCACCAACGCCGGCGGCATGGGCGTCATCGGCGGTGTCGGATACACCC
CAGAGATGCTCAAGGAGCAGATTGCCGAGCTCAAGAGCTACCTCAACGACAAGAACGCTCCCTTTGGTGTTGACCTGCT
TATCCCCCAGGTTGGTGGCAATGCCCGTAAGACC > SEQ ID NO:3189 219027 216011_300887_1
GTGGTGTCGATCCAAGGGGACGCGTGGCAACCGCTGCACAGCCCGCGTGTGGTGACTAGAGGCGGCTAACAGGTGGTAA
GTAATCGGATCTGCTGTTTCTCTTGTGCAGTCTCACACATGTCGCAGGGGTGGGTTTTGAATGGAGACGAAGCTTGTTG
CGATGAATCAAGTCATGCTAGCTGCATGCCTGACCGAGATGAGGAGGAGAGATGGAGAGATGGAGAAGAGAACGGAGCA
GTGGGAGAAAGAAAAGAGGAAGAGAAAGAGGCTAGGAAGCATTGCCACATTAAGTACAACAGGGGGGTTGATTCAGATC
GAGGAGAGCAGAAGGGGAGAAGTGGATAGAATAGGGCTTTGTGTCTGTGCTGTGGAGGAGGCATGTGGCCGTGCTGATG
AAAGAATTGGAACATGAAGCTTACCTCTATATTAGGACCAAAGTACGGAGTAGACCCTACC > SEQ ID NO:3190 219045 205739_300922_1
CGGACGCGTGGGGACTAGATAGGTAGAGATGGTTTGGCGGTCAATGCTGTGCTCGTTAGATGTCTCACGGGGGCCCGCA
TGTATCTCCATGTAGTTCCTCGCACGCAGCAAGAAAGAGGCAAAACCCGCGCGGTGTTAGTAGCGTTTGCCATCGGAAG
ACGATCGCCCAGCACGTCAAAGAGGCCATTTGATCAGTTACTCGATTGGTGCTCGCACGGGTTGGTTACG > SEQ ID NO:3191 219066 211240_300897_1
AGTATTCCTTACAATGGCTTCCGTCACCCGTCTCAGCAACTCTGCCCTGAGGGCTTCATTGCGAGCCCCTGCCCGGGCC
ACGGCTTTCAATGCCACCCGCTGCTACTCCGCCAAGGCTCAGTCCCTCAAGGACCGCTTTGCCGAGCTTCTCCCCGAGA
AGATTGAGCAGATCAAGACTCTCCGAAAGGAGCACGGTTCCAAGGTCGTCGACAAGGTCACCCTCGACCAGGTCTATGG
CGGTGCCCGTGGTATCAAGTCCCTCGTCTGGGAGGGTTCCGTTCTCGACGCCGAGGAGGTATCCGATTCCGTGGAAAG
ACCATCCCTGAGTGCCAGGAGATCCTCCCTAAGGCTCCCGGTGGCAAGGAGCCTCTCCCTGAAGGTCTCTTCTGGCTCC
TTCTGACCGGTGAGGTCCCTACCGAGCAGCAGGTCCGCGACCTGTCCGCCGAGTGGGCTGCCCGCTCCGATATCCCCAA
GTTCGTCGAGGAGCTCATCGACCACTGCCCTACCGACCTCCACCCCATGGCCCagtTCTCTCTGGCCGTCACTGCTCTC
GAGCACAcctCTTCCTTCGCcaaggccTacGccaagggTAtc > SEQ ID NO:3192 219066 218146_300915_1
tgcAAGAAAGGAAACGAATCGTCCACTCAGCTCGGCTCAATCATCATCACAATGGCTCTCAACCTCACCACGTCGGCTC
GAGCCCTGCGCTCCTTCAAGCCCTACACCCGTGCTGCTCTCCTTGCCAACGCCGCGCGATGCTACTCTACCGCTGAGCC
CGATCTCAAGACAACCCTCAAGGAGGTCATTCCCGCCAAGCGCGAGCTGCTCAAGAAGGTCAAGGCCCATGGCAGCAAG
GTCATTGGCGAGGTCAAGGTCGAGAACACCCTCGGCGGCATGCGTGGCCTCAAGGCCATGGTCTGGGAGGGATCCGTCC
TCGATGCCAACGAGGGCATTCGCTTCCACGGCCGCACCATCAAGGACTGCCAAAAGGAGCTCCCAAGGGCAAGACGGG
AACTGAGATGCTCCCCGAGTCCATGTTCTGGCTGCTTCTCACCGGCCAGGTCCCCTCCGTCAACCAGGTCCGCGAGTTC
TCCCGTGAGCTCGCCTCCAAGGCCCAGATCCCCGCCTTCGTCAACAAGATGCTCGACGAGTTCCCCAAGGATCTGCACC
CCATGACCCAGTTTGCCATTGCCGTCTCGGCCCTCAACTACGAGTCCAAGTTCGCCAAGGCCTACGAGCagggtcTCAA
CAaggCTGACTACTGGGAGCccaccTTGACGATtgcaTTTCTCTgctcGCCAag
```

FIG. 2 continued

> SEQ ID NO:3193 219066 241037_301319_1
ggcgatggcatTGGCGATGGCCTCCAGGGCGCGTAATGCGGCGTCCAAGCTTCGCCGCATTTCGGATGGATGCGAGTTG
TCGCCGCATTGGTTGTTTCGGCGATTGCTCACGACGGATCTTCGATCCCGGCTTATGCAACTCATTCCGGAAGAACAAG
AGAGATTGAAGAAATTGAAGAAGGAGCATGGATCGGTACCCCTCGGCCAAGTCACGATCGATATGGCTATTGGAGGAAT
GCGAGGTATCAAAGGGATGCTATGGGAGACGTCTTTACTCGACGCTGAAGAGGGAATCCGATTCCGAGGCTTGTCGATT
CCAGAATGCCAGGAGAAGCTTCCGGCTGCTGTGCCTGATGGTGAACCAATTCCAGAAGGATTGTTTTGGCTTCTTGTCA
CTGGTGAAGTTCCCAGCAAGGAGCAAGCTGCGACCTTGACGAAAGACTGGGCTTCTCGATCTGACATTCCAGGTCATGT
GTATGATGTTGTGAACGCTCTTCCAAAGAACGCGCATTCGATGACACAGTTTTCGGCTGGAGTGATGGCTTTACAAACC
GAAAGCGAGTTCCAAAAGGCCTACGAGAAAGGAATCAACAAATCCAAGTTCTGGGAGCCAGCGTACGAAGACGCAATGA
ACCTGATTgCGAGGTTGCCAGGCTTAGCTGCCTacGTataccgGAGAAaa > SEQ ID NO:3194 219066 258456_301696_1
AAATCTGAAATATCAATCATGATTTCTGCTATTCGTCCCGCCGTTCGATCTTCCGTTCGTGTTGCCCCTATGGCCAACA
CCGCCTTCCGGGCCTACTCTACCCAGGATGGTCTTAAGGAGCGATTCGCCGAGCTCATCCCCGAGAACGTCGAGAAGAT
CAAGAAGCTCCGAAAGGAGAAGGGTAACACCGTCATCGGCGAGGTCATCCTCGACCAGGCTTACGGTGGTATGCGAGGT
ATTAAGGGTCTCGTCTGGGAGGGATCCGTCCTCGACCCCGAGGAGGGTATCCGATTCCGAGGTCTGACTATCCCCGACC
TCCAGAAGCAGCTCCCCCACGCCCTGGCGGAAAGGAGCCTCTCCCGAGGGTCTTTTCTGGCTCCTGCTCACCGGCGA
GATCCCCACTGATGCTCAGGTCAAGGGTCTGTCCGCTGACTGGGCCTCTCGAGCCGAGATCCCCAAGCATGTTGAGGAG
CTCATCGACCGATGCCCCCCCACCCTCCACCCCATGGCTCAGCTCGGTATTGCCGTCAACGCTCTGGAGTCCGAGTCTC
AGTTCACCAAGGCTTACGAGAAGGGTGTTAACAAGAAGGAGTACTGGCAGTACACCTACGAGGA > SEQ ID NO:3195 219066 258755_301699_1
GcAACAACACAATGATCCCTCTTCGAACCGCCCGTGTTGCCCGAACCTCCGTGTCCTCCATGGTCCAGAAGCGATTTGC
TTCTGACCTCAAGGGCGCCCTCAAGGAGGCCATCCCCGCCAAGCTGGAGCTCTTCAAGAAGGTCAAGTCCGAGTACTCC
CAGAAGTCTCTCGGTGATTGCAAGGTCGAGAACCTGCTCGGAGGCATGCGAGGCCTCAAGTGCATGCTCTGGGAGGGCT
CCGTTCTTGACGCTGATGAGGGTATCCGATTCCACGGCAAGACCATCAAGGAGTGCCAGGAGGTGCTCCCCAAGGCCGT
TGAGGGCGGCGAGATGCTCCCCGAGTCCATGCTGTGGTTCCTCTTCACCGGCAAGGTTCCCACTGAGGAGCAGGTCCGA
GGCCTGTCTCGAGAGCTCGCTGAGAAGGGCGAGGTCCCCGAGTTTGTCAACAAGATGCTCGACAACCTGCCCCCTACCC
TGCACCCCATGACCCAGTTCTCCATGGCCGTGTCTGCCCTTAACCACGACTCCAAGTTCGCCAAGGCCTACGAGCGAGG
TATCCCCAAGTCCGAGTACTGGGAGTACACCTTCGATGACTCCATCGAccTCATTGCCAa > SEQ ID NO:3196 219090 206542_300823_1
GTCCAATTAGGCATTGACAGCAAACCAATTCCCTCCATAACTGGGCCTCTTCACACCCGTACTCAGAATGACCGACAGA
ATATTCCGCATCTTTAACCCGGGAGAACCAAAGGGTGATCCCGTTGAGAAGAGGCGCGCTCAGCTGCGACGTGCCCAAC
AATCTTATCGAGATCGCAAGGACAAGTACACCAAGGCGCTCGAGGCTGAACTAGCACGGTCTCGGAAGAGCGAGGCGGG
CTTGACGTTCCAGATCGAGCAGCTTCGTGTCAAAGTTCAGAAACTGGCCAGTCTCTTGTCCCAAAATGGCATCTCACTT
CCTCCAGATTTTGACAATGAGGAACAACTTCATGATGATGTACCGCGTATAGATTCATCTCCGCTCACAACGCGTGGAC
AACCACAAACCGCTGAAGGCTTCCTATCAAGTACAGATTCAACCTCTCCTGAGTCGGTGACGGACCAAGGAGCTATCTT
AAATAGTGGAAACCGCACTCTACGGCAGTACAGTTCGA > SEQ ID NO:3197 219108 204161_300790_1
cgaacggcggcgcacTACGTGGTCTCTTGGGGTGTAGCAATCAATACTTGTGTACACGTAGATACAGTAGTCTATGTCC
GTGTGCTTCTGGGGGTGGGCATTGATTATCTCCGTGCGGAGGAATATGGGGGTGTTCGTGTGTCTTGGTATCAATCAGG
CTATGCGGGAATACGATGTAGTTACGACGCCTCCTCTACTGTACATTACTGACATGCCCTGTAAAGACAAGGTGAGCAT
ACGAGACAATGCCGCTGTCTCTTTGGGAGGGAATTCGTTAGAGTCAGCCAAGAGCGCCATGTTGAATGAAAGAATCGGA
CATGGCTTATCTTAGTCCCCT > SEQ ID NO:3198 219136 135382_301225_1
AGACGACCAGCTCGCGCGCTCGGATCTCAGCCATGGAGAAGGCGATCGATCGCCAGCGCGTCCTCCTCGCCCACCTCCT
CCCCTCCTCCTCCTCCGACCAATCGCTCCTCTCCGCGTCGGCGTGCGCCGCCTGGGACAGCGCCGCCTACCAGAGGACT
TCCGCCTACGGGGACGACGTCGTCGTCGTCGCTGCCTACAGGACACCCATATGCAAGGCCAAGCGAGGAGGTTTCAAGG
ATACATACCCAGAGGACCTTCTTACTGTTGTTCTAAAGGCTGTTCTGGACAACACTAAGATCAACCCTGGTGAAATTGG
TGACATTGTAGTTGGCACGGTGCTAGGTCCAGGCTCGCAGCGTGCAATCGAGTGCAGGGCTGCGGCTTTCTATGCTGGA
GTTCCCGAAAACGTTCCTGTTAGAACTGTCAACCGGCAATGTTCCTCTGGATTACAGGCAGTGGCTGATGTTGCCGCGG
CCATTAAAGCTGGGTTCGACGACATAGGGATTGGTGCAGGCCTGGAATCCATGTCAGTAAATGCTATGGGTTGGGAAGG
ACAAGTAAACCCTAAAGTAAATGAAGTCCAGAAAGCACAGGATT

FIG. 2 continued

> SEQ ID NO:3199 219136 157591_301740_1
ATTTGTACTAAAAAAATAATCTTGAGATCAAATGGAGAAAGCAATTGAGAGACAAAGAGTTCTTCTTCAACACCTTCGT
CCTTCTCAAACTTCTTCTTCCTTGGAAAATATTGAATCATCCATTGCTGCATCTGTATGCTCTTCTGGAGACAGTGCTG
CTTACCAAAGGACCTCTGTCTTTGGAGATGATGTCGTCATAGTTGCTGCATATAGGACTCCTCTTTGCAAAGCAAAGAG
AGGAGGCTTCAAGGATACTTATCCTGATGATCTACTTGCTCCAGTTCTAAAGGCGTTGATGGAAAAGACTAATGTGAGC
CCTAGTGAAGTTGGGGATATCGTTGTCGGCACCGTGTTGGCCCCAGGTTCTCAGAGAGCAAGCGAGTGCAGGATGGCTG
CGTTTTATGCTGGTTTTCCTGAAACTGTGCCAGTTAGAACTGTAAACCGGCAATGTTCATCAGGCCTTCAAGCAGTTGC
TGATGTAGCTGCAGCTATTAAAGCTGGATTTTATGACATCGGTATTGGTGCTGGATTGGAGTCTATGACCACAAACCCA
ATGGCCTGGGAAGGATCAGTCAACCCAAAAGTTAAGATGATGG

> SEQ ID NO:3200 219136 195453_300634_1
TCTTCCTCTGTCTGCTATCTTTCCTCCTATCTCAGTCACCCATCCATCCTTTTCCTCCCATCTTTTCACACATTATTAC
AAAATGGGCGCCGCCGACAGAATTTCCCAGATTGGAGGCCAGATCTCCGGCAACCCTACCGCCGGTGGTCGCGACAAGA
TCCTCGAGAAGCGCCCTGACGATGTCGTCGTCACTGCCGCCTGCCGTACCGCCTTCACCAAGGGCGGCAAGGGTGGCTT
CAAGGACACCCCCGCTGGCGACCTTCTCGCTGGTGTCCTAAAGGCCATCATCGAACGCTCCAAGATCAACCCTGCGCTC
GTCGAGGACGTCGCCGTCGGCAACGTGCTTGCGCCGGGTGCCGGTGCCACTGAGTTCCGCGCCGCCGCTTTTGTCGCCG
GCTTCACAGAGGAGACGGCCGTGCGTGCGGTCAACAGACAGTGCTCTTCTGGCCTGCAGGCCTGTGTCGATGTCGCGAA
CCAGATCCAGGCTGGTATGATTGATATCGGTATTGGTGCCGGTGTGGAGAGCATGACCCTGAACTATGGCCCCAACGCC
GTGTCCGAACTCTCCGAAGACTTCCAGAAGGTCAAGGAGGCTGCCAACTGCAAGGTCCCCATGGGTGTTCTCTCCGAGG
CCATGGCCGTGGATCTCGGCATCACCCGTGAGAcccaaGAT > SEQ ID NO:3201 219136 223811_300976_1
aCAAAAATGGACCGACTTAACAACCTCGCCACCCAGCTCGAGCAGAACCCCGCCAAGGGCCTCGACGCTATCACCTCCA
AGAACCCCGATGACGTTGTCATCACCGCCGCCTACCGAACTGCCCACACCAAGGGAGGCAAGGGTCTGTTCAAGGACAC
CTCTTCTTCCGAGCTGCTCGCCTCTCTGCTGGAGGGCCTCGTCAAGGAGTCCAAGATCGACCCCAAGCTCATCGGTGAT
GTCGTCTGCGGAAACGTTCTCGCTGCCGGTGCCGGTGCCACTGAGCACCGAGCTGCCTGCCTTGTTGCCGGCATCCCCG
AGACCGTTCCCTTCGTCGCTCTCAACCGACAGTGCTCCTCTGGCTGATGGCCGTCAACGACGTTGCCAACAAGATCCG
AGCCGGCCAGATTGACATTGGTATCGGCTGTGGTGTCGAGTCCATGTCCAACCAGTACGGTCCCAACTCCGTCACCCCC
TTCTCCAACAAGTTCCAGAACAACGAGGAGGCTAAGAAGTGCCTGATCCCCATGGGTATCACTTCCGAGAACGTTGCCG
CCAAGTACAACGTGTCCCGAAAGGCCCAGGACGCCTTTGCTGCCAAGTCCTACGAGAag > SEQ ID NO:3202 219145 172017_301608_1
AGCAATTATACATTAAAATCACCTCATCACCTGCGGATACTATTATGCATATTAATTACTCGACCGGCAACAGCCATCC
CAGCATCCTCTTTTGGTAAAGTAGTGGCCTTCACATGCAAACATCGGCTATCGCAACTAACACCCCCTTCCCCTGTCC > SEQ ID NO:3203 219159 211395_300957_1
aaccacgccgccgtcctccccgactgcaacaagaaccacttcatcaacagtgtcgtgggagctgcctttggagctgccg
gTCAGCGCTGCATGGCCCTGAGCACACTGGTCATGGTTGGCGAGACCAAGGAGTGGCTCTCTGAGGTTGCTGAGCATGC
GCAGGCGCTCAAGGTCGATGGTGGCTTCGAGGAGGGTGCCGATCTGGGCCCCGTCATCTCCCCCAGAGCAAGGAGCGC
ATCTTGAGCATCATTGACAGCGCCGAGAAGGAGGGTGCTACGATCCTGCTCGACGGCCGTGGCTTCAAGTCTGAAAAGT
ACCCCAACGGCAACTTCATCGGACCCACCATCATCTCCAACGTCACTCCCGACATGACCTGCTACAAGCAGGAGATCTT
CGGCCCCGTGCTGGTGTGCCTCAACGTCGAGACCATCGACGACGCCATTGAGCTCATCAACAAGAACgagtacGgcaAC
GGCGttgccatCTTcacaaagtCGGGCGCc > SEQ ID NO:3204 219188 218159_300915_1
TCGACCGACGCTCGGCAACAATGGCGACAATTGCAAGCGGCTTGCGGCATGCGAGATGCGCAAGCTCGATTGCTGCAGC
TCAATGGCGGCCGGCAATCTTCCCGCGGTCGAACTTTCAACTCGCCATCCGGTCTATAACCAGCGACTCTCAAAAGCCT
CCCAGTCTTGAACTTGAAGCCGCCGAGTCCGTCCCGATCCCATACCAGGGCGTTACGCATGCGCGAGTTGTTCCGGCGA
CACCATCTTATTTCTCAAGAGAACCCCAGTTCAACGATTTATACATTGGAATCTCAAGCTGCTCACCAAGTACAACCA
CCTGCCCACAGTGCCGCCAAGTGAGGCCTCCGCAAATGCCATGGACAAAGCTGGAGGAGATGCGGGCGCAGATGGGAGAG
CCCATCAAGTCATCACACTATGCGAAGGTCATGCGAGTGGCCAAGCGCTTGAACCTCATCGAGCCCAGCCT > SEQ ID NO:3205 219193 206858_300826_1
GCCCGGGAAAGACATTTGTCGCTTTGGTTTGTGAAGACTACCTTAGGCTAGGCAATACCCGACGCTTCTGCTTATTCTT
CCTAGTCCTGTCCGCGAATGCTGTAGCAGCGAAATTGCACCGAGCAGCGTTTCCCATTCTGCGGCACCCGATCCCATGA
GCCGCGGTATCTGAGCGGATCTCCAGCAGCCGCGATATAAACACCACGCCGCCTTGACAAGGCCGTCCCCCCTTTGCCTCC
GTCTATCCTGCCATGTTGTCAGCAATCCGTTCCCAGAGACCGACAAATACCTTTCGACAGGTTGCCATCTCTTCTACCC
ATCGCATCGCCATGGCACCGCCTAAACGCAACAGCAGCTCGCTGCCTGCCGGCTATGTCGAGGACAAGTCGAAGGGCGC
AATGCTCAGATTCCAAGACTCGCTTCCTCGCCTCCCAGTCCCGACCCTCGAAGAGACCGCCAAGCGGTATCTCAAGAGC

FIG. 2 continued

TTACACCCCATAATCTCCGCCAGTGAACTCGAGAAGAGCACAGCGGCCGTCACCGAGTTCATCAAGCCCGGCGGAGTTG
GCAGCAAACTCCAGCAGAAGCTCGTTGCCAAGGCCCAAGACCCCAAGACAAAGAACTGGATGTACGAGTGGTGGAACGA
TGCTGCGTACCTGAGTTACCGCGACCCGGTAGTGCCGTATGTCAGCTACTTCTACTCGCACAGAGATGATCCCAAGCGA
CGCAACCCTGCCAAGCGGGCTGCGGCGCTCACCAGCGCTGTCCTCGAGTTCAAGAAGCTTGTCGACAGCGGCAGCCTCG
AGCCGGAGTACATGAAGAAACTGCCCATTTGCATGGACAGCTACAAGTGGATGTTCAACGCGAGCCGTGttgccgccAA
GCCcgcggattatccCATCAaGtTCTCCCacgaggaaAAcaagCACATTgttgtgAttcgcaAga > SEQ ID NO:3206 219244 204388_300792_1
ATAAATAGTAGCTGCTTGTTGTGAAGCACTGCTTTCATCAAAACAAGTACTCTCCAATCACATCTGGTGTTCGAACAAG
GTCACCACCCAACAACATTTCGCATATTCCATCAGGTCGATCGATTCCCAAGTCCGACAATCACCATGGCTGACGAAAC
CGTCAACATCGCTCCCAATGAGAAGGAGACCAACGGTGTCCAGCAGCAGACGGCGGTACCGCGCCAGGGCTTCACACAC
AACCACCACAGCGACTTCAATGAGATGACCATTGGCCAGTATGCTCAGGCTTTTGGTGGTGCTCTCCAACCCGGGGCAT
GGAGGCCATATGAGCACCGCAAGCTCGCCAACCCCGCCCCTCTGGGTCTTTCTGCTTTCGCCTTGACTACCTTTGTCCT
CTCCGCCATCAACATGCACGCTCGAGGAGTCTCGGCCCCCAATGTCGTCGTCTCTCTCGCCTTTGGTTATGGCGGTCTT
GTTCAGCTGCTTGCTGGCATGTGGGAGGTTGCTGCCGGTAACACCTTTGGTGCTACTGCTCTGGGTTCATATGGTGGTT
TCTGGATCTCATACGGTATTCTCTTGACCCCCGAATGGGGCATCACGGCTCCTGATGGCCCGTACGAGGGCAACGTTGC
TAGCGTGCTTGGCTTCTTCCTGACTGGCTGGTTCATCTTCACCACTGTGCTTCTGCTCTGCACCCTGCGATCCACTGTT
GCTTTCTTCCTCCTCTTCTTCttcCttgaccTgncCTTTTTCTTccTCGccATGGAGCAATACGCTgccGACTTgGCA
ACGCg > SEQ ID NO:3207 219244 213935_300862_1
GATAAATAGTAGCTGCTGTTGTGAAGCACTGCTTTCATCAAAACAAGGTACTCTCCAATCACATCTGGGTGTTCGAACA > SEQ ID NO:3208 219244 211606_300901_1
TGCTTGttGTGAAGCACTGCTTTCATCAAAACAAGTACTCTCCAATCACATCTGGTGTTCGAACAAGGTCACCACCCAA
CAACATTTCGCATATTCCATCAGGTCGATCGATTCCCAAGTCCGACAATCACCATGGCTGACGAAACCGTCAACATCGC
TCCCAATGAGAAGGAGACCAACGGTGTCCAGCAGCAGACGGCGGtatttctccaGGgctTCACACACAACCACCACAGC
GACTTCAATGAGATGACCATTGGCCAGTATGCTCAGGCTTTTGGTGGTGCTCTCCAACCCGGGGCATGGAGGCCATATG
AGCACCGCAAGCTCGCCAACCCCGCCCCTCTGGGTCTTTCTGCTTTCGCCTTGACTACCTTTGTCCTCTCCGCCATCAA
CATGCACGCTCGAGGAGTCTCGGCCCCCAATGTCGTCGTCTCTCTCGCCTTTGGTTATGGCGGTCTTGTTCAGCTGCTT
GCTGGCATGTGGTAAGTCATGAGCTCCGGGATTTCATAGTATTACAAACCTGGACCTATACTGATGGTTCGTCTttagg
gaGGTTGCTGCCGGTAACACCTTTGGTGCTACTGCTCTGGGTTCATATGGTGGTTtctgGATCTCATACGGTATTCTct
tgaccCCCGAATGGGGcatacggCTCCTgatgggccgtAcgagggCAACGTTGCtagCGTGCTTGGCtTCTTCct > SEQ ID NO:3209 219269 219563_300946_1
gcGACAAAACATCACAGTGCACATCATGGCGCGAGTACTTCGCAATAGAGCGGTTGCGTCACCGAAAACCACCGACGCC
GTAAAGCCTGACAGCACCCCAAAGGGCAAGAGAAAGGCCGCCGAAGAGTCTTCTCCCGTTGTGCTGAAGAAGCAGAAAT
CCGCCAAGAAGGAAGATGTCGAGACCAAGGCAGCCAAGTCACCCAAGGCAGCCAAGTCACCAAAGACTAAGAAGGAGGA
AAAGAAGAAAGAAGAAGAAAAGAAGCAAGATGTGATTGACATGGAGGAAGATTCCGAGTCTGAGGGACAAGAAGATGAG
GGAAATCTTCAGGCTTTGGCCGTCAACATTGACCCGGAAGAAGAGGCCCCCGTGAACGACGAAGAATTCCAGCCCGGTC
AGGACGTTGGCAAGATCCCCAAGGTCTCGAAAGACGTCCAGAAGTCGATCAAGGCATCGAAGGAAGAACCTGGCGTCGT
TTACATTGGCCGAATACCCCATGGTTTCTACGAATACgaAATGAGGCAGTACCTGTCTCAATTCGGCCCCATCTCCCGG
CTGCGTCTATCACGCAACAAGAAGACTGGCGCCAGCaagcACTTTgccTTTGTCGAAttTAACGAAgccAGCAC > SEQ ID NO:3210 219290 211150_300896_1
aaccgtctcatcttacaTGGCCTTGTTCCTTTCCATACTCCATTCTTCCCCAACCCCAACACCCCGCCAGCCGTTCTGT
CAGCGCCACAGCGCATTAGCCTCATCACCTCATTGCTCACTGGTCTGCAAACATTGCGCAAGGCGGTGAATTTTTCATG
TCGAGAATTGACATTATATAACAGCACGTATTCTAAGATTCATGTATTAAGTGCCGAGGAAATTCATTTCTTCCCCATC
CGTCAAAGTCCTAGGTAAGTAACAATGCATTAATCGTAATGTCCAACTCGGAGAGTTTTCAATACTCCTTATCGATAAG
TCATTATGTAATCAATCCTGCCGGGAAGGGAAATTTTGCTCCTCTCCCAAACCTCAAATCGCATCTCCAAAGCCCTGTG
ACGACATACAACACCCGAACAGCAATATCAAACCCCCAAACACCAAGGAACAAGCCCTCACCCCGTATTTTACCTCCCA
GTTTACAAAAACAAAACACAAGAATAAAACAACAACCATGTCTTTCCTCGGAATCGGTCGTCCCCAGCCCACCTCGGAG
CAAAAGAtTgct > SEQ ID NO:3211 23558 17861_300233_1
cccacgcgtccgCTCTTTCCTTCTCTCACCGCGAGAGTAACCGAGAGACATGATTCTGATAAACTCTAATTCTCCGACG
CTAATCTCAGCCgtTAGATTCGTGGGCTCATCTCCGTTCACCACTCGGGGGCTTTCTCAGTCCACTGTCTCAATCTCTA
GAAACAAAAGCTTCTTCTTCCACTTCACCGAGACGAAGGAGAAGAACGCAAGAAGAGATTATTTGAGAGTATCAATCGT
GTGTGACGCAGGAGGGATGTTTCCGGTGGATCCATGGGCTCCAACCATTGATTCACAGAGCATAGCATCACAACTCTTC

FIG. 2 continued

```
GCTGTATCTCTGTTTCCTTACATTGGCTTTCTCTATTTCCTCACTAAATCCAAATCAGCTCCAAAACTCACACTTTTCG
GTTTTTACTTCTTGCTTGCCTTCGTTGGAGCTACAATTCCAGCTGGGATTTATGCTAAGGTGCATTATGGAACATCGTT
GTCGAATGTTGATTGGTTACACGGAGGAGCTGAATCACTTCTTGCTCTTACCAATTTGTTTATCGTGTTGGGTCtTaGA
CAAGCtctGAGGAAGTCTCAAGATGATGATGATGATAAACTTGGTAATGATGATGAAGTTCCAACAACTCAAGAACAAG
GGAAATTtTCAGTGTAGTAAAACAAATgtaaattttttaattacgcagtttcacttgtttttttaattagattatatata
gtcgacgcccatctaattcccattttag > SEQ ID NO:3212   23558   23828_300223_1
cccacgcgtccgctctttccttctctcacCGCGAGAGTAACCGAGAGACATGATTCTGATAAACTCTAATTCTCCGACG
CTAATCTCAGCCGTTAGATTCGTGGGCTCATCTCCGTTCACCACTCGGGGCTTTCTCAGTCCACTGTCTCAATCTCTA
GAAACAAAAGCTTCTTCACCTTCACCGAGACGAAGGAGAAGAACGCAAGAAGAGATTATTTGAGAGTATCAATCGT
GTGTGACGCAGGAGGGATGTTTCCGGTGGATCCATGGGCTCCAACCATTGATTCACAGAGCATAGCATCACAACTCTTC
GCTGTATCTCTGTTTCCTTACATTGGCTTTCTCTATTTCCTCACTAAATCCAAATCAGCTCCAAAACTCACACTTTTCG
GTTTCTACTTCTTGCTTGCCTTCGTTGGAGCTACAATTCCAGCTGGGATTTATGCTAAGGTGCATTATGGAACATCGTT
GTCGAATGTTGATTGGTTACACGGAGGAGCTGAATCACTTCTTGCTCTTACCAATTTGTTTATCGTGTTGGGTCTTAGA
CAAGCTCTGAGGAAGTCTCAAGATGATGATGATGATAAACTTGGTAATGATGATGAAGTTCCAACAACTCAAGAACAAG
GGAAATCTTCAGTGTAGTAAAACAAATGTAAATTTTTAATTATGGAGTTTCACTTGTTTTTAATTAGATTATATATA
GTCGACGCCCATCTAATTCCCATTTTAG > SEQ ID NO:3213   23794   23751_300071_1
CCCACGCGTCCGCTCGATTTCAGATTTAAGATCTCAGATACAAAACTCCGACATGTCTACGTTCAGCGGCGATGAAACA
GCTCCCTTCTTCGGCTTCCTCGGCGCTGCAGCCGCACTCGTTTTCTCCTGTATGGGAGCTGCTTATGGAACCGCAAAGA
GTGGTGTTGGTGTGGCTTCTATGGGAGTTATGAGACCTGAGTTGGTGATGAAATCTATTGTCCCTGTTGTTATGGCTGG
AGTGTTGGGTATCTATGGATTGATCATTGCTGTTATCATCAGTACCGGGATTAACCCCAAGGCTAAGTCTTACTACCTC
TTTGATGGATACGCACATCTCTCGTCTGGTCTTGCTTGTGGTCTTGCTGGTCTCTCAGCTGGAATGGCCATTGGGATTG
TTGGTGATGCCGGTGTCAGGGCAAATGCTCAGCAGCCTAAGCTCTTTGTTGGGATGATTCTTATCCTTATTTCGCAGA
AGCGCTTGCTCTTTACGGGCTTATTGTAGGAATCATTCTTTCCTCACGAGCTGGCCAGTCTAGAGCTGAATGAGAATCT
AAACCACAAGACTGCTCAAAGGTACTTCCTTTACTTCTGTGTGCGTTTTGTTTTATCGTGATTAGTATGATGTATCATC
GGGAACCAAAAATTTTACTGGATTCTTGGAAATTTGTTTCGGAAACAAAACCGCCTATCTTCATTCTCCTTTTCTTTTC
CGGTGGTTACTCTCCGATGTAGAATTTTATTGTTTGATTCTGTAATAAAGAAGCTCTGAGGAGTTTGGTATGTTTTTGT
ATTCTTGTATTTGTCCTGAGGAAGTTAAATACATTTATTTGTAAAGAAGTTTGCTTTTCTGAAAAAA > SEQ ID NO:3214   23794   47337_300170_1
TCTCATTCCCGATCAGATCTCAACGACGACGAGCCATGGCTTCAACTTTCAGCGGCGATGAAACTGCTCCTTTCTTCGG
ATTCCTTGGCGCTGCCGCCGCTCTCGTTTTCTCCTGTATGGGAGCAGCGTACGGGACAGCGAAGAGCGGGGTTGGTGTA
GCGTCGATGGGTGTGATGAGACCAGAGCTTGTGATGAAATCGATTGTTCCTGTTGTTATGGCTGGAGTTTTAGGTATTT
ATGGTTTGATCATTGCTGTTATCATCAGTACCGGAATCAACCCTAAGGCCAAGTCTTACTATCTATTCGATGGCTATGC
TCATCTCTCTTCCGGTCTTGCTTGTGGTCTCGCTGGTCTCTCCGCCGGTATGGCTATTGGAATTGTCGGCGAT > SEQ ID NO:3215   23794   248040_301579_1
TAAGGGATAGATCCGTGGATAGCCGGGGAGGAGAATCGGATCCATGGCGTCGACCGATGCGTTCAGCGGCGATGAGACG
GCGCCCTTCTTCGGATTCATCGGCGCCGCCGCAGCTCTGGTCTTTTCCTGCATGGGAGCTGCGTATGGGACGGCAAAGA
GTGGTGTTGGCGTCGCGTCCATGGGTGTGATGCGGCCGGAGCTGGTGATGAAATCGATCGTCCCGGTGGTCATGGCGGG
AGTGCTGGGAATTTACGGCCTCATCATCGCTGTGATCATCAGCACCGGGATCAACCCAAAGGCCAAGTCGTACTACTTG
TTCGACGGCTATGCTCATCTATCGTCGGGCCTGGCCTGCGGTCTCTCCGGTCTCTCGGCAGGCATGGCCGATCGGCATTG
TCGGTGATGCGGGTGTCCGGGCCAATGCACAGCAACCCAAGCTTTTTGTGGGAATGATCCTCATACTCATCTTTGCCGA
GGCTTTGGCTCTATACGGTCTCATTGTTGGAATCATTCTGTCGTCCCGTGCCGGACAGTCCAGAGGATAAGCAGCAGCG
TTAATTTTAAGGTGGTTTATATGCGAGCATTCTTCTTAGCGTTTTTGTTTTGCTTACTGCTTGTATTATTATTCCTTC
CAACAAATAATTCTCGCTTATTAaaaaaaa > SEQ ID NO:3216   23794   255765_301643_1
CATTGAATCAGAGAGAGAGAGGATGGCGACGATGGAGTTCAATGGCGATACGACAGCCCCTTTCTTTGGATTCCTTGGG
GCTGCCTTTGCTCTCATCTTCTCTTGCATGGGTGCTGCATATGGAACTGCAAAAAGTGGTGTTGGAGTTGCGTCCATGG
GAGTGATGAGGCCCGAGCTAGTAATGAAGTCTATAGTCCCAGTTGTTATGGCTGGTGTTTTGGGTATCTACGGCCTCAT
TATTGCGGTTATTATCAGTACTGGAATAAATCCCAAGAGCAAAGCTTATTACTTGTTTGATGGCTATGCCCATCTCTCA
TCAGGGTTGGCTTGCGGTCTTTCTGGTCTCTCCGCAGGGATGGCCATTGGCATTGTCGGAGATGCTGGTGTAAGAGCTA
ATGCACAACAACCAAAGCTTTTCGTGGGCATGATTCTGATTCTTATCTTTGCTGAGGCTCTTGCCTTGTACGGTTTGAT
CGTGGGAATCATCTTATCGTCCCGTGCAGGACAATCTAGGGAGTGAGGCTACGCATGGTTTCGTGATCTGTTTATCGAA
TAATCAAGAACGCCGGTTTCACAAGGCTACCCTTGAAGTTTCGTGATGCCATATGAGTGCGGCAGATTGTCCCGATGA
```

FIG. 2 continued

> SEQ ID NO:3217 23794 1007927_301405_1
GGTCATCTTCAGATCCATCGGTGCAGAGAGAGAGAGAGACAGAGGAGAGAGGAGAGAGAGAGAAGAGAGAGAGAGAGAGAG
ATGGCAACTGTGGATTTCAATGGAGACACGACAGCCCCTTTCTTTGGATTTCTGGGCGCCGCCTTTGCTCTCATCTTCT
CTTGTATGGGAGCTGCATATGGAACAGCGAAAAGTGGAGTTGGAGTTGCTTCCATGGGTGTGATGAGGCCTGAGCTAGT
CATGAAGTCGATAGTTCCAGTTGTTATGGCTGGTGTTTTGGGTATCTATGGTCTCATCATCGCCGTCATCATTTCTACC
GGAATCAAGCCCAAAAGCAAGGCTTACTACCTTTTTGATGGTTATGCCCATCTCTCATCTGGATTGGCCTGTGGTCTTT
CTGGTCTCTCTGCGGGAATGGCTATC

> SEQ ID NO:3218 23794 1008438_301415_1
gagaaagagagttagacacgtatatatgtgtgtgtgtagatagatagatagatagatagagaggtacacacccacacat
aTAGAGAGAGATGCATAGAGAGATCTGATTCATCTCTCTGATAATAAATCAAATTGATCATTGAATCAGAGAGAGACAG
GATGGCGACGATGGAGTTCAATGGCGATACGACAGCCCCTTTCTTTGGATTCCTTGGGGCTGCCTTTGCTCTCATCTTC
TCTTGCATGGGTGCTGCATATGGAACTGCAAAAGTGGTGTTGGAGTTGCGTCCATGGGAGTGATGAGGCCCGAGCTAG
TAATGAAGTCTATAGTCCCAGTTGTTATGGCTGGTGTTTTGGGTATCTACGGCCTCATTATTGCGGTTATTATCAGTAC
TGGAATAAATCCCAAGAGCAAAGCTTATTACTTGTTTGATGGCTATGCCCATCTCTCATCAGGGTTGGCTTGCGGTCTT
TCTGGTCTCTCCGCAGGGATGGCCATTGGCATTGTCGGAGATGCTGGTGTAAGAGCTAATGCACAACAACCAAAGCTTT
TCGTGGGCATGATTCTGATTCTTATCTTTGCTGAGGCTCTTGCCTTGTACGGTTTGATCGTGGGAATCATCTTATCGTC
CCGTGCAGGACAATCTAGgGAGTGAGGCTAcgcAtggTTTTGTGATCTGTTTATCGAATAATCaaGAACGCcgggttca
caaggctaccCTtgaagTTTTGTGATGccATAtg > SEQ ID NO:3219 23794 2041_300349_1
GGATCCCCCGGGCTGCAGGAATTCGGCACGAGTCTGAATCTAATCAACTTCTCAGATCCAAACTCCGATCGGAACAATG
TCCTCGACTTTCAGCGGCGATGAAACTGCTCCTTTCTTCGGCTTCCTCGGCGCCGCTGCGGCTCTCGTCTTCTCCTGCA
TGGGAGCAGCGTACGGAACAGCAAAGAGCGGTGTAGGAGTGGCGTCTATGGGAGTGATGAGACCAGAGCTGGTGATGAA
ATCCATTGTTCCGGTGGTTATGGCTGGTGTGTTGGGTATTTATGGTCTGATTATTGCTGTTATTATTAGTACTGGTATT
AATCCCAAAACAAAGTCGTATTACCTGTTTGATGGATATGCTCATCTCTCCTCTGGTCTCGC > SEQ ID NO:3220 23794 145754_301061_1
GATCAATAAGCCTTTTTTCCCTCTCAGATCGCGAATCGCTTCAATACCAATTCGAAGAAAAAAAAATGGCATCGACTT
TTAGCGGCGATGAAACGGCACCGTTCTTCGGGTTCCTCGGTGCTGCAGCTGCCTTAGTCTTCTCCTGTATGGGAGCAGC
TTATGGAACAGCGAAAAGTGGGGTAGGGGTAGCATCGATGGGAGTAATGAGGCCGGAATTGGTGATGAAGTCAATTGTG
CCAGTTGTTATGGCTGGAGTTTTGGGTATTTATGGGTTAATTATAGCTGTGATTATTAGTACTGGGATTAATCCTAAAA
CAAAGTCGTATTATTTATTTGATGGATATGCTCACCTTTCATCTGGACTTGCTTGTGGTCTTGCTGGCCTTTCTGCTGG
TATGGCTATTGGAATCGTTGGCGATGCTGGTGTTAGAGCTAATGCACAGCAGCCAAAGCTTTTGTTGGGATGATTCTG
ATTCTTATTTTCGCTGAAGCCTTGGCTCTTTACGGCCTTATTGTCGGCATCATCCTCTCTTCCCGCGCTGGTCAATCTA
GAGCAGAGTAGAGAAAGATCTTCTCTTGTTCCATATTTGTGTAGTATCTTTGT > SEQ ID NO:3221 23794 111941_300050_1
agagaacgagggaggaGCAACCAGAAACAGATCTATTCAACTCCAAAACTCAAAAACACTGTATATTTACAGTTCTCAG
ATCCAAATCCTAACGACAATGTCGACCTTCGCCGGAGATGAAACTGCTCCTTTCTTCGGCTTCCTTGGCGCCGCCGCGG
CCCTCGTTTTCTCCTGTATGGGGGCAGCTTATGGAACAGCAAAGAGTGGTGTTGGAGTGGCGTCAATGGGAGTGATGAG
ACCTGAGTTGGTGATGAAATCTATTGTGCCAGTGGTTATGGCTGGTGTGTTAGGTATTTATGGGTTGATTATTGCTGTG
ATCATCAGTACTGGGATTAACCCCAAAACGAAGTCGTATTACCTATTTGATGGCTATGCTCATCTCTCCTCCGGTCTTG
CTTGTGGTCTTGCTGGCCTTTCTGCTGGAATGGCTATTGGTATTGTTGGTGATGCTGGTGTTAGGGCTAATGCACAACA
ACCTAAGCTTTTCGTTGGGATGATCCTCATTCTCATTTTCGCTGAAGCTTTGGCTCTTTATGGACTTATTGTTGGCATT
ATCTTGTCTTCCCGAGCTGGCCAGTCTAGAGCTGAGTGAAGTTAACTCCATTCTTACCGCGTTGTATGTGGGACTTCAG
TAGACCAAGGCAGTCAAAAGTATCTAATACGTGTATTgttATTCATTATCCCACAGCTGGAACTTAATTCAGTGGTGCA
ATGTTCTGTCTGTaGAAATAGgaa > SEQ ID NO:3222 23794 1110140_301527_1
gcaatggattccaatggagatgccaccgctccTTTTTTCGGCTTCCTCGGGGCCGCCTTCGCTCTCATCTTCTCTTGTA
TGGGGCTGCATATGGAACGGCAAAGAGTGGTGTTGGGGTGGCCTCCATGGGTGTCATGAAGCCCGAGCTAGTGATGAA
GTCGATAGTTCCGGTGGTTATGGCTGGTGTTTTGGGTATCTACGGCCTCATCATTGCAGTCATCATCAGTACTGGAATC
AATCCCAAAAGTAAATCATACTACCTCTTTGATGGCTATGCCCATCTCTCGTCTGGATTGGCTTGTGGCCTTTCTGGTC
TATCCGCTGGTATGGCCATTGGTATCGTTGGGGATGCTGGAGTCAGAGCTAATGCACAACAGCCAAAGCTATTCGTAGG
CATGATCCTGATTCTTATCTTTGCTGAGGCGCTTGCGTTGTATGGCTTGATTGTGGGCATTATCTTGTCATCACGCGCT
GGCCAGTCCAGGGAGTGAACTTGAGACTCCGGTATGCATTGAATGATCAAGGACTCGTCTCTTTTGTGAGATTAGCCTA

FIG. 2 continued

```
AGTTTTTTAATGGTAGAGACGCCTTATCAAGACATGtTTCATCATATTCAaGTGATAGCCTGTGCTagagcATCTGCTA
Tag
```

> SEQ ID NO:3223 258904 258922_301701_1
```
GCAGCATGCAGACTCCGCACACTACTTCAAAGCAAGGGCAATATTGTCATTCTTGTGTAATGTTCCACCACCATATCCA
AATCTGCTGCTACAACAACAACAACAACTCCAACGCCGGTTCTTACTCGATGGTCTTCTCCATGCAAAACGGTGGCGTT
TTCGAGCACAACGGTGAGGACTATCATCACTCTTCCTCCCTCGTTGACTGCACTCTCTCTCTTGGAACTCCTTCTACCA
GGCTTTGTGAGGAAGATGAGAAACGTACACGCTCTACTTCATCTGGTGCTTCTTCTTGCATCTCCAACTTTTGGGACTT
GATTCACACCAAAAACAACAACTCCAAAACGGCACCGTACAATAACGTTCCTTCTTTCTCCGCTAACAAGCCAAGTCGC
GGTTGTCCCGGTGGTGGTGGTGGCGGAGGAGGCGGTGGCGGATGTGACTCTCTTCTCGCTACACGCTGTGCCAACTGTG
ACACTACTTCTACTCCACTATGGAGGAATGGTCCTACAGGCCCTAACTCCCTATGCAACGCATG
```

> SEQ ID NO:3224 258904 258922_301750_1
```
TTATCATCTGGTAAAGTCATGGACAAGACTTGCCCTATCCGCTACATTAAGCCTCCAAGAAAGGAACGGAACACCGCCG
TGAGCACCGTCGGATTCAACGTTGTTTGCTACTCCACTGCCGTAATCATCCATGAACCTGATCTCATTTGCCGGATAAT
TACACGGAACCCTCTGCGTCGAGTGGTGATGAGCCCACGGAGTACCATTATTATTGTTGTTATTAGTGGCAGCATGGTA
ATTATTGTAGCCAGAGTTGTGATGCCCGTACTGGTCGGTTTGAACCGGTGCAGCTCCGACGACGGTGTTTCCTGTAACC
GCAGTAGTTCTTCTCTCTTCCTTCTTGAAACGAATGCCGGATGCGTTGCAT
```

> SEQ ID NO:3225 258906 258917_301701_1
```
GCAGCATGGGAAGAGGAAAGATAGAAATAAAGAGGATAGAGAACTCAACAAATCGACAAGTGACGTTTTGCAAAAGAAG
AAATGGACTTCTGAAGAAAGCCTATGAGCTTTCGGTCCTTTGCGATGCAGAAGTTGCGCTCATTGTTTTCTCCACTCGT
GGCCGTCTCTATGAATACGCCAATAACAACATAAGATCAACCATTGAGAGGTACAAGAAAGCTTGTTCTGATAGCACCA
ACACTAGCACTGTCCAAGAAATCAATGCCGCGTACTATCAACAAGAATCTGCTAAGCTGAGACAACAGATCCAAACGAT
TCAAAACTCCAACAGGAATCTGATGGGAGACTCTTTGAGTTCCTTAAGTGTCAAGGAACTAAAACAAGTTGAGAATCGC
CTTGAGAAAGCTATCTCTAGGATCAGGTCCAAGAAGCATGAGTTGCTTTTAGTTGAAATCGAAAACGCGCAGAAAAGGG
AGATTGAGCTTGACAATGAGAACATCTATCTAAGAACTAAGGTAGCAGAAGTGGAGAGGTATCAACAACACCATCATCA
AATGGTTAGTGGTTCAGAGATTAATGCAATTGAAGCT
```

> SEQ ID NO:3226 258915 231375_301083_1
```
GCGGCACGGAGGCGTTTCCAAATCTCGGCAAGCACTGCAACCACTCCTCGTGTGGCCAGCTCGATTTCCTGCCCTTCAA
ATGCGATGCGTGTTCCAAGGTCTTTTGCCTGGATCATCGTTCCTATGCAGCTCACAGCTGCCCCAAGGCGAATTCCAAA
GACTCTACAGTGATCGTCTGCCCGTTCTGTGCCTCGGGTGTCAAGACCGTGGCAGGCGAAGATCCAAACCTTACAATTG
ACAGACATCTCCAGACTTCTTGCGATCCAAGCAACTACGAGAAGGTGATGAAGAAACCAAAGTGTTGTGTCCGAGGTTG
CAAAGATGTGTTGACCTTCTCCAACAAGTTCCACTGCAAGGTCTGCCGCAAGGACACCTGCATGAAGCACAGATTCCCC
GCAGACCACGCATGCCAGGCCGCGGCATCTGCTCACAAGTCCGCACGAAACGTTGGTGGCGAGCTGGCGACGAAGTTCT
TTCAGGCTTTGTCGATCAGGACGGGCAGCGAGTGTGGGACTAGCAGCAGCAGCAGCAACAGCAGCA
```

> SEQ ID NO:3227 258915 258927_301701_1
```
GCAGCATGGGAACTCCAGAATTTCCAGATCTGGGTAAACACTGCTCCGTCGATTATTGCAAACAGATCGATTTCTTGCC
CTTCACATGCGATCGCTGCCTTCAGGTGTATTGTCTGGATCATCGTAGCTATATGAAACACGATTGTCCAAAAGGAAAC
AGAGGAGATGTCACTGTGGTTATTTGTCCATTATGTGCTAAAGGAGTTAGATTAAACCCTGACGAAGATCCCAACATCA
CCTGGGAGAAACATGTTAATACAGACTGTGATCCATCTAACTACGAAAAAGCTGTCAAGAAGAAGAAATGTCCTGTTCC
TAGATGCAGAGAACTCTTGACATTCTCCAATACTATTAAATGTCGAGATTGTAGCATCGATCATTGTTTGAAACATCGG
TTTGGACCTGATCATAGTTGTTCTGGACCCAAGAAGCCTGAATCGAGTTTCTCATTCATGGGTTTCTTGAGTACAAACA
CAAAAGAAGCTCCTGCATCATCATCATCTTCTTCGAGATGGTCTAGTCTTTTCGCTTCTGCGGAAGCAAGTATTAGTAG
ACTCGGTAACGATATAAGCCAGAAGTTACAGTTTGCGAGTGGCAATGATGGCAATTCAGAGAAAACGCAAGAGAGGAAT
GGAAAACAGAATTGTGGCAAAGTTACGGTTGATGTTTGTCCCAAATgtagtagagggtttcgtgatccggtggatctat
tgaagcatatcgataaggatcatcgtgtcacttctaaagcctagtaa
```

> SEQ ID NO:3228 258915 1118335_301855_1
```
ACTGCAGCGAGTCTTCTTGTCACCTGCTCGATTTCCTCCCCTTCACTTGCGACAATTGCAGCCAGGTCTTTTGCCTTGA
GCATCGATCGTACCAAGCCCACGATTGCCCCAAGGCGGATCTCAAGGACGTAAGCGTACTGCTCTGCCCCGTGTGTGCG
TCTTCCGTGCGGAGAGTGAGTGGCCAAGACCCCAACCTCACTCTTGAAGCCCATCTCTTGGGAGGGGCATGTGACCCGA
CCAATTATGAGCGCAC
```

FIG. 2 continued

> SEQ ID NO:3229 258915 159060_200139_1
AAGAAAGAAAAGCAAAGGTGAAAAGAAAAACATGGGAGGAGGAACAGAAGCTTTTCCAGATTTAGGAAGCCACTGCCAA
CATTCTGATTGCCGTCAGCTCGACTTTCTCCCCTTTACCTGCGATGCGTGTCAAAAGGTATTTTGTGTGGAGCACAGAT
CATGCGAGTCTCATGAATGCCCAAAATCCGATATTAACAGCCGAAAAGTTCTAGTTTGCGAAATCTGTTCCATGTCTAT
TGAAACTACTGGTTGTCAAGGTGAAGACGATAAAGTGCTATTGCAAAAGCACGAGAAATCTGGGGATTGTGACCCCAAG
AAGAAGAAGAAACCTACCTGTCCAGTGAAGAGATGCAAGGAGATTTTGACATTCTCAAACACCAGCACTTGCAAGAGTT
GCAGGATTCAAGTTTGCCTCAAACACCGCTTTCCTGCTGATCACGCCTGCAAACGGAGTTCTTCATTATCCCAGCCATC
GGCTAATAACAAGTTTTTGATTGCTCTGGCTGCTAGGAGTGGGAATGATTGTGGAAATAAAAGCCGCGCATCAACTTCA
CGCTCCACCACCCCTTCTGTTAAAGCTTATTGATTGTTTCAGAAAAATTGCTATACATTTAAAGA

> SEQ ID NO:3230 258924 263331_301724_1
GCAGCATGGATTATTCTTCGATGCATCAGAATGTGATGGGAGTATCTTCATGTTCAACACAAGATTATCAAAACCAGAA
GAAACCATTGTCGGCGACTAGGCCAGCTCCACCAGAGCAATCATTAAGATGCCCTCGCTGTGACTCCACCAACACAAAG
TTCTGCTACTACAACAACTACAGTCTCTCTCAACCTCGCTACTTCTGCAAATCTTGTAGGAGATACTGGACCAAGGGTG
GAATCCTAAGAAACATCCCAATCGGTGGTGCTTACCGGAAACACAAACGCTCCTCCTCCGCAACCAAAAGCCTCAGAAC
AACCCCTGAGCCCACGATGACCCATGACGgcaaaTCATTCCCAAcGgcgAgtTttggCTATAAtAATAATAAcattagc
aaCgAACAGATGgAGCTTGGGTTaGcatATGcCTTgttgaacaagcaaccTCTAGGGggttcTTCacaTCTagggtTCG
gaagcctCtCagTCTccAATGGCcAtgga > SEQ ID NO:3231 258924 316980_301428_1
GCAGCATGGTGGAACGTGCTCTGATCCCAAAAGTCCCATTGCCTGAAGCAGCTCTAAATGGCCCTAGATGTGACTCAAC
CAATACTAAGTTCTGTTACTTCAATAACTATAGCCTTACTCAACCTCGCCATTTCTGCAAAACATGTCGTCGCTATTGG
ACACGTGGCGGTACCTTGAGGAATGTTCCTGTAGGAGGAGGCTTTAGGAGGAACAACAGAAGCAAATCCAGATCGAAAT
CTACGGTCGTGGTCTCGACTGATAATACTACTAGTACTTCATCACTTACTTCTCGCCCAAGTTACTCAAATCCTAGCAA
GTTTCATATCTACGGTCAAATCCCGGAGTGTAATACCAACTTGCCCATCTTGCCTCCTCTCCAAAGCCTTGGAGATTAC
AATTCAAGCAACACTGGATTAGATTTTGGTGGAACTCAAATAAGCAATATGATAAGTGGTATGAGTACTAGTGGTGGGA
TCTTGGATGCATGGAGAATACCTCCATCACAAGAAGCCTCAGCAATTCCCTTTCTTGATCAACACTACCGGATTGGTGC
AATCTTCAAACGCCGTTATATCCATTACTACAAGGCGGGTT > SEQ ID NO:3232 258965 258993_301701_1
GCAGCTTTCTGCAACTTCTCCAAATCTCATACTTTCCAGAAAATCATTTTCCCAAGAAAAATAAAACTTTCCCCTTTGT
TCTTCTCCCCCAACAGCAATCACGGCGTACCAATCGGAGCTAGGAGGAGATTCCTCTCCCTTGAGGAAATCTGGGAGA
GGAAAGATCGAAATCAAACGGATCGAGAACACAACGAATCGTCAAGTCACTTTTTGCAAACGTAGAAATGGTTTGCTCA
AGAAAGCTTACGAGCTCTCTGTTCTTTGTGATGCTGAAGTCGCACTCATCGTCTTCTCTAGCCGTGGTCGTCTCTATGA
GTACTCTAACAACAGTGTAAAAGGGACTATTGAGAGGTACAAGAAGGCAATATCGGACAATTCTAACACCGGATCGGTG
GCAGAAATTAATGCACAGTATTATCAACAAGAATCAGCCAAATTGCGTCAACAAATAATCAGCATACAAAACTCCAACA
GGCAATTGATGGGTGAGACGATAGGGTCAATGTCTCCCAAAGAGCTCAGGAACTTGGAAGGCAGATTAGAGAGAAGTAT
TACCCGAATCCGATCCAAGAAGAATGAGCTCTTATTTTCTGAAATCGACTACATGCAGAAAAGAGAAGTTGATTTGCAT
AACGATAACCAGATTCTTCGTGCAAAGATAGCTGAAAATGAGAGGAACAATCCGAGTATAAGTCTAATGCCAGGAGGAT
CTAACTACGAGCAGCTTATGCCACCACCTCAAACGCAATCTCAACCGTTTGATTCACGGAATTATTTCCAAGTCGCGGC
ATTGCAACCTAACAATCACCATTACTCATCCGCGGGTCGCCAAGACCAAACCGCTCTCCAGTTAGTGTAATAA > SEQ ID NO:3233 258966 259079_301750_1
TTATCATCCACGCATTAGATCAATGTCCATATGGGGGTGATGCATATCCATTGACCTTGAACCAGTTGACCAAATGCCT
ACAGGAGTCTGAACAATGTTCTGACTTTGCTGAGGAACAGGAGGTGACGTTGCTGCTGTGTTATCGTTGTTGTTTTCCA
AAGCATCAGTATCTTGGACATCTTCAGAAGTTTCTTCACGTTTTTTAATCTTCCCTTTCGGAATTGCCCAAATGAAGCT
GCCAACAATGACCTGGACTTGGCTTGCTGCTATTAGAGGACCTCCAATTCCACCACCAATGACACGACCATCGGGGCTA
GCAAGTGAGACCGCTAGACTTCCAGTGCGGTTTGGGTAGTCATTGTCAGTTGTGTTCAGATAAGAAGTTGAGAGAGATA
TGAGCTCGAATAGACCCTCGTATATAATA > SEQ ID NO:3234 258966 259086_301702_1
GCAGCATGGCGTTATCCGGGTCGGGTTCTTACTATATCCAAAGAGGAATCCCCGGTTCTGGTCCTCCTCCTCCTCAAAC
TCAACCAACGTTTCACGGATCACAAGGATTTCATCATTTCACCAATTCCATCTCTCCTTTTGGGTCAAACCCAAACCCA
AATCCAAACCCTGGAGGTGTCTCTACTGGATTCGTGTCTCCTCCTTTACCCGTTGACTCTTCTCCGGCTGATTCGTCAG
CGGCGGCGGCGGGAGCTTTGGTTGCTCCTCCTTCAGGTGACACGTCTGTGAAGCGGAAGAGAGGACGGCCTAGaAAATA
TGGACAAGATGGTGGCTCTGTTTCGTTGGCATTGTCTCCTTCTATCTCCAACGTTTCCCCGAACTCTAACAAACGTGGC
CGTGGAAGACCTCCTGGCTCCGGCAAGAAGCAACGGCTATCTTCCATTGGTGAAATGATGCCTTCATCAACTGGGATGA
GCTTCACACCGCATGTAATCGTAGTTTCCATTGGTGAAGACATTGCTTCAAAGGTTATATCGTTCTCGCATCAAGGTCC

FIG. 2 continued

ACGAGCGATATGTGTCTTATCCGCAAGTGGTGCTGTCTCTACTGCaACTCTTCTTCaGCCAGCACCTTCTCATGGAACT
ATTATATACGAGGGTCTattCGAGCTCatAT > SEQ ID NO:3235 258967 230148_301054_1
GCTATTGTGGATCGATTCTTCCTCCTCGATCTGTGGGGATCGCTTTGATCTATAGGCGCAGAGCGCGATTCGCGGTCTT
ATGAATGCTGGGCAGCTGGAAATGGTAGGGTTGATGGCGAATCCAGCGCTTCCATCCGACGAAGCGGTGTCCAAGAAGA
TCCGGAAGCCCTACACCATCACCAAATCCAGGGAGAGCTGGACCGAGCAAGAGCACGACAAATTTCTAGAGGCCTTGCA
GCTGTTTGATCGGGACTGGAAGAAGATCGAAGCGTTTGTAGGCTCTAAGACAGTAATCCAGATTAGAAGTCATGCCCAG
AAATATTTTCTAAAGGTCCAAAAAAATGGGACTGGAGAACACGTCCCTCCCCCAAGGCCCAAGCGAAAGTCGGCTCAAC
CATATCCACAAAAGGCTGTCAAACCAGCTCCCACTTCGCGGGCAACTCCACAACAGTCACCACCGGATTTTGCTTACAT
GGTTCCGCAGcaaatGtAATATGTatgttccagcAGTCACTGgaaatcCc > SEQ ID NO:3236 258967 238107_301292_1
gcaaaggtttagggTTTTGGGGACATGTCGATTGCGCGGCAGCAGCAACAGCAGCAGCAGCAGCAGCAGCAAATGCCGG
ACTGCGATGCCGCGAGAAAGATTCGCAAGCCCTACACCATCACCAAGTCGCGAGAGAGCTGGACGGAGCAAGAGCACGA
CAAGTTCTTGGAGGCGCTTCAGCTCTTTGATCGGGACTGGAAGAAGATTGAGGCGTTCGTCGGCACCAAAACTGTGATC
CAGATTCGCAGCCATGCACAGAAGTATTTCTTGAAAGTCCAGAAGAATGGTACGGGGAACACGTACCGCCGCCGAGGC
CGAAGAGAAAAGCCGCAATGCCATATCCACAGAAAGCTCCCAAAGTCGTGCCTCCTCCTGTTATTGTCGAAAGGTTACC
GCATAGTCCCAGCAGCAGCGGTGGCAGTGACGATGTTTCTCCTGCAGCATCAGCACCGAACTTCGCAGCAGTGTATCAG
TTCCTCGGCAGCGTCTTCGATCCAAGCTCGTCAAACCATCTCGACACCTTGAGTGGAATGGATCAGATCGATCGAGAGA
CGGTTCTACTTCTCATGAGGAATTTGGCACTCAACTTATCCACCACCGAACTCACCGACCATCTAAGATATCTGTCGCT
CtgtcctGTTGGAGTCTAAGCGGGTaaaaatTTcgTCGg > SEQ ID NO:3237 258967 270107_200123_1
GAAGAGAAACAACTGTTGTATGTCAGGACAAGCTAGCATCTGTTTAATGTCTGGGGGCAAACATTGTGCCAGTTGCTTC
ACATATTGGGGCGCACTTCACGAAATATGCTTTATGTTCTGATATATGTCAATATACTAAAAAGCAAGCTATGCAGATA
CGTAGCCATGCACAGAAATACTTTCTGAAGGTCCAGAAGAGTGGGCAAGTGAACATGTACCTCCCCCACGCCCAAAGA
GAAAAGCAGCTCATCCTTATCCACAAAAAGCTCCTAAAAAGGTTGTGTCCCAAGTTGGCAGCATCCAGTTTCAACCTCC
AGGAGCTTTCCCTGAACCAGGATTTGGTATCGGGCCTGATTCTCTAGCATTGCCTGGAAATACAATTAATTTCTCTCCC
TGGACTTACGACAATGTGCCTGCTATCATCACAACACACATGCGAAAAGATGACGCACAATTATCCAGCGGAGGAGTCG
TGCAAAATTGCAGCAGCAGCAGTAACGAAAGCATGCATAGGATTTGTATGACTAAAGAGAGCAATGCCCAAACGGAGAG
CAAGAAGCAAATGAAAGTTATGCCAGACTTTGCACAAGTTTACAGGTTCATTGGCAGTGTCTTTGATCCATGTACGAGG
GACCACTTACAGAGGCTAAAAA > SEQ ID NO:3238 258967 260825_301718_1
gcggaggaggcgatggaatggggacgaggcggcGACGAGGCGGCCATCCAGGCGGCGCTAGGGTCCCTGATCCACGGAT
TCCGTAAGAGATTGTGATCTCGAGCTCTCTTCCACGCCGTTTGTTTGGGGAGTTTATCCTTTGATGGTCGCAGGGCAGT
GATGACTGATCCAGCTCCTGCTAGGACGCTGAGCCAGGATACTCGAGATCATCAACAAAACAAGCTCTTGGAACCGGGT
GTGAAGCAGCAGCAACAATTCGGTGATGTTTCTGCTGCGTTTGGAGACGACTCTCTTGCGAAAGTGAGGAAGCCGTATA
CGATCACGAAGCAGCGAGAGAGATGGACAGAGGAAGAGCATCAAAAGTTTCTGGAGGCTTTGAAACTCTATGGTCGTGC
ATGGCGTCGGATCGAAGAACATATTGGCACCAAGACTGCAGTCCAGATAAGAAGCCATGCTCAGAAGTTCTTTTCCAAG
CTGGAAAGAGACCAGGCAACTGGAAGCATCGTGCCAGGTACTGCGCAGGACATCGATATTCCTCCGCCTAGGCCAAAAC
GAAAGCCGAGCCATCCATATCCGCGGAAAGCAAACACAGAAGTTTCTCCAGTGGCTCTTCCAGCGGCTGATTttgATGG
AAAGCAGTGTCCTacCTCGATGGAtgtGACAGAAAGTCGTCGGG > SEQ ID NO:3239 258967 258979_301701_1
GCAGCATGAGTTTACCAAGCTCCGATGGATTTGGTTCGATTCCGGCCACGGGACGGACCAGTACGGTGTCGTTTTCTGA
GGATCCGACGACGAAGATTCGGAAGCCGTACACAATCAAGAGATCGAGAGAATTGGACAGATCAAGAGCACGATAAA
TTTCTAGAAGCTCTTCACTTATTCGATAGGGATTGGAGAAAATAGAAGCCTTTGTTGGATCAAAAACAGTAGTTCAGA
TACGAAGCCACGCTCAGAAATACTTTCTCAAAGTTCAGAAGAGTGGTGCTAACGAACATCTTCCACCTCCTCGACCTAA
GAGGAAAGCGAGTCATCCTTATCCTATAAAGGCTCCTAAAAATGTTGCTTATACCTCTCTCCCGTCTTCGAGTACATTA
CCGTTGCTTGAGCCTGGTTATTTGTATAGCTCTGATTCGAAGTCATTGATGGGAAACCAGGCTGTTTGTGCATCTACCT
CTTCTTCGTGGAATCATGAATCGACAAATCTGCCAAAACCGGTGATTGAAGAGGAACCGGGAGTCTCGGCCACGGCTCC
TCTCCCAAATAATCGCTGCAGACAGGAAGATACAGAGAGGGTACGAGCAGTGACAAAGCCAAATAACGAAGAAAGTTGT
GAAAAGCCACATAGAGTGATGCCGAATTTtGCTgaagtt > SEQ ID NO:3240 258967 130604_300489_1
GAATTCAATGCTTCAACCGCCATGGATGATGGTCGGAATTATATGGAAGTTGGCTCACAGTCTGGAAATGCAATGCAAT
TTAAGGACAATTATTCATCTGGAGAAGATAATTTACTTAAGGCTAGGAAACCTTATACCATCACTAAACAGCGTGAAAG

FIG. 2 continued

```
ATGGACTGAAGATGAACACAAGAAGTTTCTAGAAGCTTTAAGGTTGTATGGTCGAGCTTGGCGTCGGATAGAAGACCAC
GTCGGTACCAAGACTGCGGTTCAGATCCGAAGCCATGCTCAGAAATTTTTCACTAAGGTTGTAAGAGAATCAGGTAGTA
ATGATGCAGGCTCAGTGAAACCAATTGAAATTCCTCCTCCTCGCCCAAAGAGAAAACCTATGCATCCTTATCCCCGGAA
AATGGTTTCTCCAGCTAAAAAACAAACGTTGGCTTCTGAGAAGCTTGAAAGGTCAATGTCGCCGAATTTCTCAGAACAA
GAAAACCAATCACCTACATCTGTTTTATCTGTCGTGGGACCAGATGCTATGGGATCCTCATTTTCAAATACCCAAAGCC
GTTCTCAATCACCAGTGTCATCTGTTTCTGATGTTAAGCATGTTGTCTCATCATCTACCAAGCAAGAAATTGGTTCCCC
TTCAACTTCTTCATCAGCTGA

> SEQ ID NO:3241  258967  157419_301738_1
TCAAACTCTCCTTCCATGGCTACTAACAACTCAACACCTACCCAGTCATCTGGCAAAAAGGTTCGAAAACCTTACACCA
TAACTAAGTCTAGAGAAAGCTGGACTGAAGAAGAACACGACAAGTTCCTTGAAGCTCTTCAACTGTTTGACCGTGATTG
GAAGAAAATTGAGGATTTCGTAGGCTCAAAGACAGTAATTCAGATTCGCAGTCATGCTCAAAAGTACTTCTTGAAAGTC
CACAAGAATAGTACAACAGCACACGTGCCACCACCTCGGCCCAAACGCAAAGCAGCTCATCCTTATCCCCAGAAGGCAC
CAAAAAATGTTTCAGTACCACTGCAAGCCTCTATGGGTTACCCTTCTTCAATGAATTCCCTTCCACCTGGATATCCATC
ATGGGATGACACTTCCTTACTCTTAAATTCTCCATCTGGCGGAACAATCCATCACAAGATGAATACCATTTTCAAAGAA
TTCAGGGGAGCTACATTGATTAGTAACAGCGGCATCAGTGGCATTAGAAGTTCCAGCAGAACAGCGCGGAGTTCTGAAC
TACCAGAGCAGAGCAAACTAGGT

> SEQ ID NO:3242  258967  142493_300435_1
CCCCCCCTTTTGGCTGCTCTTTTGTGGTTGGCCGCACAAAGGTGAAATACTGGGAGTGTTGGCGTGATATAGAGGTCTA
GGAGGAGGTATGAGGTACTACTTGTGTCAGGTCCAGCGTTTGGTTGGAGATATGGAAGGAGGAGTGCTTTTGTTTGTGG
AAGACCTCAACTCTAACTGACAAAGCGACCAATTGCCAACACTTCTGTTATATTTCTTCTTTTTCTTGAATTGGGAATG
GAGATTAATTCCTCTGGTGAGGAAGCGGTGGTAAAGGTGAGGAAGCCATACACAATCACAAAGCAGAGGGAGCGTTGGA
CTGAGGCAAAGCACAACAGGTTCCTTGAAGCCTTGAAACTGTATGGGAGAGCCTGGCAGCGCATAGAAGAGCATGTTGG
GACAAAGACAGCTGTGCAGATCAGAAGTCATGCTCAAAAGTTCTTCACCAAGTTGGAAAAGGAAGCTATCAACAATGGC
ACTTCTCCAGGACAAGCTCATGACATCGACATACCTCCACCACGACCAAAAAGAAAACCTAACAGTCCATATCCTCGAA
AAAGTTG

> SEQ ID NO:3243  258970  1109510_301522_1
GTTTGGACGGAACATCGGGGCAGCTATGGCTATGGCGTCTAGGGTTTTCTCCCTTTCTCCGGCAGCTATGGCGTCCAAG
CTTGGCGGCAGTGTTGATCCCCTTGCTTCCCTTCCCCGCCGCCTTTCCTTCCCTCTGCCCTCCCGGAATTCCTTTAGGA
TTGCTGTGGCCTCTTCTTCTTCTTCTTCTTCCTCCCCCCCTTCTGTCCCTAACGTGGCGAAATCCGAGGAGGAATGGCG
TGCTATCCTTTCCCCAGAGCAGTTCCGCATTCTTCGCTTGAAAGGCACCGAGAGACCAGGTAGTGGAGAATATGACAAA
TTTTATGAAGAGGGCGTGTATGAGTGTGCAGGTTGTGGCACTCCTCTTTACAAATCTTCTGGCAAGTTTAATTCTGGAT
GTGGTTGGCCTGCTTTCTATGAAGGCTTAACTGGCGCCATCAAATCAACTGTTGATGCAGATGGGCGCAGGACAGAGAT
AACTTGTGCTGCGTGCGGGGGGCATTTGGGTCATGTATTTAAAGGGGAAggCtTTCCCACTCCTACCAAtGagaGGCAC
TGTGTCaaTAGCgTCTCTATCaaGTTTgttccagctaACTAAcTCaaAttTgcttctctttttttatcCTATaATGAttg
t > SEQ ID NO:3244  258970  257268_301680_1
GGGCGGACGGAGGCGGCGTGAAGAAGAGCGAGGAGGAATGGCGGGCAATCCTGACCCCGGAGCAGTTCCGTGTGATCCG
GCGCAAGGGCACGGAGTTTGCTGGCACGGGGAATCTACAACAAGCACTTTGAGGAGGGTGTCTACGAATGCGCCGCCTGT
GGGACACCGCTCTACAAGTCGGACACCAAGTTTGATTCCGGCTGTGGATGGCCTGCATTCTTTGAAGGCCTGCCCGGCG
CTATCAATCGGAACGCCGATGCCGACGGTCGGCGCGTCGAGATAACCTGTGCCGCGTGTGGTGGTCACCTGGGACACGT
CTTCAAAGGCGAGGGGTACCGAACACCGACAGACGAGCGTCACTGCGTCAACAGTGTCTCGCTGAAGTTCACACCCGAT
GACGAAGATTGATAATCAGTTAGTGGGATGATGTCTGCTCAACAAATAAACAATCAAGTAAGCAAACCTCTTCTGTTTT
TCTTCTCTCGCTAGG > SEQ ID NO:3245  258970  258996_301750_1
TTATCACTGAGATGTGATAGCGGAAGAGAACTTGAGAGCAACGCTGTTGACGCAATGGCGTTCGTCAGTTGGTGTTGGA
AAACCTTCATTTTTTAAGACATGACCTAGATGTCCATCACATTTGTGCAAGTTATCTCATATCTTAATCCAGCTCTCT
CCTCGGTTCGGTTAATGGCGCCAGGAATAGCATCAAAAAAAGCCGGCCAACCGCAACCGGAATCGAATTTAGTGGTTGA
TTTATAAACCGGATTTCCACAACCAACACAACAGTAGATTCCTTCCTCGAACAACTTCACATATTCTCCTGACCCTCTC
TTTTCAATAGATTTCTCTCTAAGAATCTTAAACTGTTCAGGAGATAGAACCGTACGCCACTCCTCGTTGGACTTTTTGA
TCATACCAGCTTCAGGAGCCGCCTTCGTTTCCATGCTGC > SEQ ID NO:3246  258970  258955_301701_1
GCAGCATGGCGGCTCCGGGATCGGTTCAGAAAGGAGATGAAGAGTGGCGTGCGATTCTTTCACCTGAACAGTTTCGGAT
TCTTCGTCAAAAGGGCACTGAATATCCAGGAACAGGGGAATATGTCAACTTCGACAAGGAAGGAGTTTACGGTTGTGTA
```

FIG. 2 continued

GGATGCAATGCTCCTCTTTATAAATCCACCACAAAGTTCAACGCTGGTTGTGGCTGGCCAGCTTTCTTTGAAGGAATCC
CCGGTGCCATTACCCGAACGACAGACCCAGATGGGAGAAGAATAGAGATCAACTGTGCAACATGTGGTGGACATCTTGG
TCATGTTTTCAAAGGAGAAGGTTTCGCTACTCCAACCGATGAACGCCATTGCGTGAACAGCGTTTCGCTTAAGTTCACA
CCCGCAGCGTCTTCCTTGTAATAA

> SEQ ID NO:3247 258970 8089_300316_1
AATTCGGCACCAGAATCGTTGAATCCGATTCGATTTGCCTCTCTTCCGGCGTAGCTTCGACGGTGGCAATGGCGGCTCC
GGGATCGGTTCATAAAGGAGATGAAGAGTGGCGTGCGATTCTTTCACCTGAACAGTTTCGGATTCTTCGTCAAAAGGGC
ACTGAATATCCAGGAACAGGGGAATATGTCAACTTCGACAAGGAAGGAGTTTACGGTTGTGTAGGATGCAATGCTCCTC
TTTATAAATCCACCACAAAGTTCAACGCTGGTTGTGGCTGGCCAGCTTTCTTTGAAGGAATCCCCGGTGCCATTACCCG
AACGACAGACCCAGATGGGAGAAGAATAGAGATCAACTGTGCAACATGTGGTGGACATCTTGGTCATGTTTTC

> SEQ ID NO:3248 258970 259070_301702_1
GCAGCATGGCGGATCTTGTGACGGTGGTTAAAAAAACAGAGGAGGAGTGGCGTGCAGTTCTTTCTCCTGAACAGTTTCG
GATTCTCCGTCAAAAGGGCACTGAAACGCCGGGAACAGAAGAATATGACAAGTTCTTTGAGGAAGGAATCTTCAGCTGC
ATCGGATGCAAAACTCCTCTTTATAAATCCACCACGAAGTTTGACGCCGGATGCGGCTGGCCAGCTTTCTTTGAAGGAC
TCCCCGGTGCCATTAACCGAGCCCCTGATCAGATGGGAGAAGAACTGAGATCACTTGTGCCGTATGTGATGGACATTT
AGGCCATGTTCATAAAGGTGAAGGTTATAGTACTCCAACCGATGAACGCCTTTGTGTTAACAGCGTTTCGATCAATTTT
AACCCGGCCAAACCTTCCTCTATAACCTGATAA

> SEQ ID NO:3249 258978 240953_301318_1
GCGCCAATGTCGCCCGGGACGATCTATCTCGATGTCCCGGAATCGCCATCGCTCGACAGCACGGAATCCACGGCCGATG
CCGATGTGGTGTCAGTGACCGCGGTGGGGGCAGCAGCGGCAGCGGCCTCCTCGACGCCATCGGCCTCTTCCGGATCGTC
CAAGGCCTGCCCCAAATCCACCAGCAGCGTCCATGAGCTCCTGGAATGCCCGGTTTGCACCAACTCGATGTATCCACCC
ATCCACCAGTGTCCAAATGGCCATACCCTTTGTTCTACTTGCAAAGTTCGTGTTCACAATCGTTGTCCGACTTGCCGAT
ACGAGCTTGGAAACATTCGCTGCCTGGCCTTGGAGAAGGTGGCGGAATCGCTGGAGCTCCCCTGCAGGTACCAGGGACT
TGGATGCCCGGATATTTTCCCTTACTACAGCAAGCTCAAGCATGAAGCTCAGTGTTGCTTCCGGCCTTACGGCTGCCCC
TACGCGGGATCCGAGTGCTCGGTCAGCGGCAACATTCCGACTTTGGTTGCTCACTTGCGAGACGATCACAAAGTTGACA
TGCACAATGGCTGCACTTTCAACCATCGCTACGTGAAGTCGAATCCTCAGGAAGTCGAGAATGCTACTTGGATGCTCAC
GGTTTTCAACTGTTA

> SEQ ID NO:3250 258978 259067_301702_1
GCAGCATGGATGTGACAGATGATGAAGAGATCCACCAAGATCGCCATTCCTACGCTTCTGTTTCCAAGCATCATCATAC
TAATAACAACACCACCAACGTTAATGCTGCTGCTTCTGGGCTTCTCCCTACCACCACCAGTGTTCATGAGCTTCTCGAA
TGTCCTGTCTGCACCAATTCTATGTACCCTCCCATTCATCAGTGTCACAATGGACATACGTTGTGTTCAACCTGTAAAG
CCAGGGTTCACAACCGCTGCCCAACTTGTAGACAAGAGCTCGGTGATATCCGTTGTTTGGCACTGGAAAAAGTAGCCGA
ATCACTTGAACTACCTTGTAAACACATGTCACTTGGATGTCCTGAAATCTTCCCTTATTACAGTAAGCTCAAACATGAG
ACTGTATGTAACTTCAGACCTTATAGCTGCCCTTATGCTGGATCCGAGTGTTCTGTTACGGGCGATATCCCTTTCTTAG
TTGCTCATCTGAGGGATGATCATAAGGTGGATATGCATTCTGGGTGTACTTTCAACCATCGTTATGTCAAGTCTAATCC
TCGTGAAGTCGAAAACGCCACATGGATGTTAACTGTCTTTCACTGCTTCGGTCAATACTTCTGTCTTCACTTTGAGGCA
TTCCAGCTCGGAATGGCTCCAGTCTACATGGCGTTCCTGCGTTTCATGGGGACGAGACAGAAGCTCGAAACTACAATT
ACAGTTTAGAAGTGGGAGGTTATGGTCGGAAGCTGATATGGGAAGGAACACCAAGAAGCGTAAGAGACAGCCACAGGAA
AGTTAGAGACAGTCATGATGGACTAATTATACAAAGAAACATGGCTCTCTTCTTCTCAGGTGGAGATAGGAAAGAGCTG
AAACTTCgagtcactggaaggatatggaaagagcaacaacaaagtggtgaaggtggaggagcttgtatcccaaacttgt
cttgataa > SEQ ID NO:3251 258996 241033_301319_1
AGCTCATCAAGAACGGGAATAGATCCATCGATTAGCGGCATTTTTCGCTGGAATTCAGCTCCAATTGCGGTGCCGAGTC
GTCGCCAGCGAATCATGGGGGCATCGCAGTCGAGTAAGGATTCATCGTCTTCTTCGGTCAGTGACACAGAATTTAAGGG
TGTGAGCGATGACGAGTGGAAGAAGCGGCTCACGGACGAGCTTTTTACGTCACGAGAAAGAAAGGGACCGAAAGAGCT
TTCGCAGGGCAGTACTGGGATACAAAGACTACTGGAATTTACGAGTGCATTTGCTGTGGAACACCATATTCAACTCCA
AGACCAAATTCGACAGCGGCACCGGGTGGCCATCGTACTACGAACCGATCGGAAACAATGTCAAAAGCGAGAGCGACTG
GTCCATTCCGTTCATGCCTCGCACAGAAGTGAAGTGTGCCAAGTGCGACGCTCACTTGGGACATGTCTTCGACGATGGT
CCGCCTCCCACTGGAAAGCGATATTGCATCAACAGTGCTTCGCTTAACTTGAAGTCGAGCTCATAGAAAGGTCAGCCCT
TTCATGTCGTAAATATCAATCCAATAAGTTGCAGAAGGTTTTCCATC > SEQ ID NO:3252 259006 259035_301702_1
GCAGCATGGGAAGGTCTCCTTGCTGTGAGAAAGACCACACAAACAAAGGAGCTTGGACTAAGGAAGAAGACGATAAGCT
CATCTCTTACATCAAAGCTCACGGTGAAGGTTGTTGGCGTTCTCTTCCTAGATCCGCCGGTCTTCAACGTTGCGGAAAA

FIG. 2 continued

AGCTGTCGTCTCCGATGGATTAACTATCTCCGACCTGATCTCAAGAGGGGTAACTTCACCCTCGAAGAAGATGATCTCA
TCATCAAACTACATAGCCTTCTCGGTAACAAGTGGTCTCTTATTGCGACGAGATTACCAGGAAGAACAGATAACGAGAT
TAAGAATTACTGGAACACACATGTTAAGAGGAAGCTATTAAGAAAAGGGATTGATCCGGCGACTCATCGACCTATCAAC
GAGACCAAAACTTCTCAAGATTCGTCTGATTCTAGTAAAACAGAGGACCCTCTTGTCAAGATTCTCTCTTTTGGTCCTC
AGCTGGAGAAAATAGCAAATTTCGGGGACGAGAGAATTCAAAAGAGAGTTGAGTACTCAGTTGTTGAAGAAAGATGTCT
GGACTTGAATCTTGAGCTTAGGATCAGTCCACCATGGCAAGACAAGCTCCATGATGAGAGGAACCTAAGGTTTGGGAGa
GtGaagTATaggTGCAGTGCGtgccGTT > SEQ ID NO:3253 259006 259046_301702_1
GCAGCATGGGAAGGTCACCGTGCTGTGAGAAAGCTCACACAAACAAAGGAGCATGGACGAAAGAAGAGGACGAGAGGCT
CGTCGCCTACATTAAAGCTCATGGAGAAGGCTGCTGGAGATCTCTCCCCAAAGCCGCCGGACTTCTTCGCTGTGGCAAG
AGCTGCCGTCTCCGGTGGATCAACTATCTCCGGCCTGACCTTAAGCGTGGAAACTTCACCGAGGAAGAAGACGAACTCA
TCATCAAGCTCCATAGCCTTCTTGGCAACAAATGGTCGCTTATTGCCGGGAGATTACCGGGAAGAACAGATAACGAGAT
AAAGAACTATTGGAACACGCATATACGAAGAAAGCTTATAAACAGAGGGATTGATCCAACGAGTCATAGACCAATCCAA
GAATCATCAGCTTCTCAAGATTCTAAACCTACACAACTAGAACCAGTTACGAGTAATACCATTAATATCTCATTCACTT
CTGCTCCAAAGGTCGAAACGTTCCATGAAAGTATAAGCTTTCCGGGAAAATCAGAGAAAATCTCAATGCTTACGTTCAA
AGAAGAAAAAGATGAGTgccCAGTTCAAGAAAAGTTCCCAGATTTGAATCTTGAGCTCAGAATCAGTCTtccTGATGAT
G > SEQ ID NO:3254 259007 259050_301702_1
GCAGCATGGGTCTTGATGATTCATGCAACACAGGTCTTGTTCTTGGTTTAGGCCTCTCACCAACGCCTAATAATTACAA
TCATGCCATCAAGAAATCTTCCTCCACTGTGGACCATCGTTTCATCAGGCTCGATCCGTCGTTGACTCTAAGCCTATCC
GGTGAGAGCTACAAGATCAAGACTGGTGCCGGCGCCGGCGACCAAATTTGCCGGCAGACCTCGTCCCACAGCGGCATCT
CATCTTTCTCGAGCGGAAGGGTAAAGAGAGAAAGAGAAATCTCCGGCGGCGATGGAGAAGAAGAGGCGGAGGAGACGAC
GGAGAGAGTGGTGTGTTCGAGAGTGAGTGATGATCATGACGATGAAGAAGGTGTTAGTGCTCGTAAAAAGCTTAGACTC
ACTAAACAACAATCTGCTCTTCTCGAAGATAACTTCAAACTTCATAGCACCCTTAATCCCAAGCAAAACAAGCTCTTG
CGAGACAGCTGAATCTAAGGCCTAGACAAGTTGAAGTGTGGTTCCAAAACAGGAGAGCTAGAACAAAACTAAAGCAAAC
AGAAGTGGATTGTGAGTTTTTGAAGAAATGTTGCGAGACTTTAACGGATGAGAATAGAAGGCTTCAAAAAGAGCTTCAA
GACCTTAAGGCTTTAAAATTGTCTCAACCGTTTTACATGCACATGCCGGCGGCGACTTTGACTATGTGCCCTTCTTGTG
AGAGACTCGGCGGTGGTGGTGTCGGAGGAGATACGACGGCGGTTGATGAAGAAACGGCGAAAGGAGCTTTCTCCATCGT
CACAAAGCCTCGTTTCTATAACCCTTTCACTAATCCTTCTGCAGCATGTTAGTAA > SEQ ID NO:3255 259007    107642_300380_1
ATTTATCAGATGATGGTTCACAAGCAGGAGAAAAGAAAAGAAGACTTAATATGGAACAAGTAAAAACTCTTGAGAAGAA
TTTTGAGTTAGGAAACAAACTTGAACCTGAGAGAAAAATGCAATTGGCTAGAGCTCTAGGCTTACAACCAAGGCAAATT
GCAATTTGGTTCCAAAATAGAAGAGCAAGATGGAAAACAAAGCAATTGGAGAAAGATTATGAAATTCTTAAAAGACAAT
TTGAAGCTATTAAAGCTGAAATGATGCTCTCCAATCTCAGAACCAAAAACTTCATGCAGAGGTATGACACCAAAAAAA
TAATCAAAATGTAGTACTAATTATTTAATTATAAGCTTTTCTTGTTATGTAGGAAATAAAATAATGTTGCACTTTAATG
ATGTCTCTTTCTTTTTTGGTTGTTAAAAATTCAAGAAGATTATGCTATTTTGGTGAAATAGTAAACCTTTCTTCTCTG
CTAGTTGTATTTTCAGAACCATGATATGTATTTGGTGCATGATTTCGCCA > SEQ ID NO:3256 259018 259036_301702_1
GCAGCATGGGTTCCAATTTTCATTACACAATAGATCTCAATGAAGATCAAAACCATCAGCCTTTTTTCGCTTCTCTTGG
ATCCTCTCTTCATCATCATCTACAACAACAACAACAACAACAACATTTTCATCACCAAGCCTCTTCTAATCCCTCT
TCTTTGATGTCACCGTCTCTTTCCTACTTTCCTTTCTTGATAAACTCTCGCCAAGATCAAGTATATGTTGGGTACAACA
ATAACACTTTTCATGATGTTCTTGATACCCATATCTCCCAACCTCTCGAGACCAAGAACTTTGTATCTGATGGTGGTTC
ATCATCAAGTGATCAAATGGTGCCCAAGAAGGAGACACGACTAAAATTGACGATAAAGAAGAAAGATAATCATCAAGAC
CAAACCGATCTTCCTCAATCCCCAATAAAAAGACATGACAGGACTAACCTCGCTCAAGTGGATATCTTCGAAGGTGAGAT
TAATGAAGAAGAAAAGGCGATTATTACCACCAGCGACAGCAGCAAACAACACACTAATAACGACCAATCCTCAAACCT
AAGCAATTCGGAAAGACAGAATGGTTATAACAACGATTGCGTGATTAGGATTTGCTCCGATTGTAACACAACCAAGACT
CCTCTTTGGAgaagtggtccgagaggtcccaa > SEQ ID NO:3257 259018 259036_301750_1
TTATCACCCGTGAACCATTCCGTGCGATAGAGCCATTAGTAAAATGGCAGCCTCCTTCTCATCTTGAGGGAAAACTTGC
TGATAAGCTGAACTTTTGCTCAACAGTAATGCTAGATCATCGAAATAGATATTGTCTGAAGATGATAACATCGTGGAGT
TGCTCTGGGTCTCCAAATCCTCGGCTAATGCGGTCTCCTCTAGTGTGATCATTCTCTTACACGTGTTTACCTTTAGGGG
CAAAGGAGATAAGATTTTACAAACTCCATTTGATATCTTGTTCTTGTGTTGCATCTTCTTCTTCATGACCGGTGGGGAT
ACGCCAGGGACTGCGGTTGCGGTTGCCGTGGCCATAGCG

FIG. 2 continued

> SEQ ID NO:3258 259028 291365_200078_1
GGGTTTTTTTTGGGGGGTGGAATTCTACAAATAGCTCAAGAATTTAGCCCAAAAGAAAGATGGCTGCAGGTACTTCATC
AGCTGTGTTTCTTGCAATGAGAGAAGAAGAACAAAACCAACAAATGAAACAACAACAACAAGAAGAATTTCTCATTCAA
CAGCAAGCACCACAAAAGAAGAGAAGAAATCAGCCTGGCACACCAAATCCAGATGCAGAGATAATAGCACTATCACCTA
AGACCCTAATGGCAACAAACAGGTTCGTATGTGAGGTATGCAACAAAGGTTTTCAAAGGGAACAAAACCTACAGCTACA
CAGAAGAGGACACAATTTACCTTGGAAGCTAAAGCAGAAGAGTACAAAAGAAGTGAAACGCAAAGTTTATTTGTGCCCT
GAGCCTACATGTGTTCACCATGACCCTTCTCGAGCCCTTGGCGATCTCACTGGTATTAAGAAACATTACTCCAGAAAAC
ATGGTGAGAAGAAATATAAGTGTGAAAAATGTTGTAAAAAATATGCTGTCCAGTCTGATTGGAAAGCTCATACTAAAAC
CTGTGGTACTCGCGAATACAAATGTGATTGTGGCACCCTTTTCTCAAGGCGTGATAGTTTCATCACCCACAGAGCCTTT
TGTGATGCATTGGCACAAGAAAGTGCGAGAAATCCACCAAGTTTGAGCAGCATTGGGAGTCATTTATATGGGAGTAGCA
ACAACATGAGTT

> SEQ ID NO:3259 259028 55666_300134_1
TAGACTCGTTTTTTCACCTCTATGTTTTTGTCTCTTTTAAGAAGCTTCCATGGAACTTTGTGACGTCTTCTATGCATCT
GGAGATTCTGGTCTCTTTGAAACCCTTGGTTACAGATCTCACATATGTATCTGTCTGATTCAAGAAGAGTTCTTGGTGA
TAAAGACACAACTTCTGCATCTGGATCTGGGGTACCTGCAGGTCTTCTTTTCCTCTTCTGAGTGGATGTGTTTGTGGTG
GTGACCCCATTTTCTGAAGAGGAGAGGAAAGGAT

> SEQ ID NO:3260 259033 259058_301702_1
gcagcatgcggattttgtgcgatgcttgcgagaacgcagccgcaatcatcttttgcgccgccgatgaagctgccctttg
tCGCCCCTGCGATGAAAAAGTTCATATGTGCAACAAGCTAGCTAGTCGGCATGTACGTGTTGGTTTAGcTGAACCAAGC
AATGCCCCATGCTGTGATATATGCGAAAATGCACCTGCCTTCTTTTACTGTGAGATAGACGGTAGTTCTCTTTGTCTGC
AATGTGACATGGTAGTACATGTTGGTGGCAAGAGAACACACGGTCGGTTTCTTTTGCTGAGACAGAGAATCGAGTTTCC
AGGGGATAAGCCTAAAGAAAACAATACGAGGGACAATTTGCAGAACCAAAGAGTCTCTACAAATGGAAATGGTGAAGCC
AATGGGAAGATTGATGACGAAATGATTGATCTAAATGCTAATCCACAAAGAGTACATGAGCCATCATCAAATAACAACG
GGATTGATGTAAATAACGAGAACAATCACGAGCCTGCAGGCCTTGTACCAGTTGGACCCTTTAAACGAGAGTCTGAGAA
GTGATAA > SEQ ID NO:3261 259045 258931_301750_1
TTATCAGGGGTATGACGGCCAGCCAGATGAATCAAACAGCATCGGATTGTTGGGTGGAGCGTAAACTTGATTCCCTCCG
GTGATTTGATTTGCGTTCATATTCTCCGTTCTTGGATGAGCTACCACCACCGATGAAATCTCCACCGTGTCTTCCTCAC
CGGAAACTTTGATGGTCCCGGCAGAGATTTGCTTCTTGATCAAACCCTGGTCTCTTAGTAGAGCTCTCAGCTTCTTCAC
CTCATCGTGTAA > SEQ ID NO:3262 25975 228336_301020_1
AACGCGACAGCTTCGCCTCGTCTCTCCCCCCCGAGTCCCCAACCCCTCCTCCTCCTCTTCCCCTTCCCCGCGCCGC
GGCGAGATCGCTCCCCCCGGGGGCAGCAGCTAGATCCCGATGGCTTCGCGCCGCCGCACCCTCCTCAAGGTCATCATCC
TCGGCGACAGCGGGGTTGGGAAGACGTCCCTGATGAACCAATATGTGAACAAGAAGTTCAGCAACCAGTACAAGGCTAC
GATTGGCGCGGATTTCCTCACCAAGGAGGTTCAGTTCGAGGATAGGCTCTTCACTTTGCAAATATGGGATACTGCTGGC
CAGGAAAGGTTTCAGAGTCTTGGTGTTGCATTCTACCGTGGAGCAGATTGCTGTGTTCTAGTTTATGATGTCAATTCTA
TGAAGTCATTTGATAATCTTAACAACTGGCGTGAAGAATTTCTAATTCAGGCAAGCCCATCAGACCCTGATAACTTCCC
TTTTGTTCTTTTGGGCAACAAAGTTGATGTAGACGGTGGCAACAGCCGTGTGGTCTCTGAGAAGAAGGCAAAGGCATGG
TGTGCCTCTAAAGGGAATATCCCATACTTTGAGACATCTGCCAAGGATGGTAC > SEQ ID NO:3263 25975 249503_301593_1
ACGAAGAAAGAAGGGAAAGCGGTGCCATCGCGGGCAGGAGCAGGGCCAGATCTGAGCTGCGCCGCCATCGATCGACGAC
CCAATCCACTGCCGCAGCTAAGGCGCCGCGAGATCCGGAGGTCTTTTGCAGGGATTTCGGGGATTCGCTGGTTTTCTT
GATCTCTTCCTCGGTTCTGCGAAGAAGACGCATCGGCAGCAATGAATCCCGAGTATGACTATCTCTTCAAACTCCTCCT
AATTGGCGATTCTGGCGTCGGGAAATCGTGCCTGCTGCTACGATTCGCGGATGATTCTTACCTTGAGAGCTACATCAGC
ACCATCGGGGTGGACTTCAAAATCCGAACAGTGGAGCTGGAAGGGAAGACTATCAAGCTCCAAATCTGGGACACTGCTG
GGCAAGAGCGCTTCAGGACTATCACGAGCAGTTACTATCGTGGAGCTCATGGCATAATCGTCGTGTACGACGTGACTGA
CCAGGAAAGCTTCAACAACGTCAAGCAGTGGCTCAACGAGATTGATCGCTACGCGAGCGAGAATGTGAACAAGCTCCTC
GTCGGGAACAAGTCGGATCTCACTGCCAAGAAGGTGGTCGACACTCAGACTGCCAAGGCCTTTGCAGACGAGATAGGAA
TCCCGTTTCTAGAAACCAGTGCCAAGAACGCGACCAACGTaGAGCAGGCATTCATGACCATGgCTGCGGAGATCAAGAA
CAGGATGGCAAGCCAACCAGCGATGAGCAACAAGCCGACCAACGTGAATATCAACAAGGGGCAACCTCTCAACCAGAAG
AATGGCTGCTGCTAGGAGGAGGAAGCAAAAGAAGCACAAGATTTACGTAGATGATGCTGCGATGAATGGTCGATCGTTG
TTTCAATTTTTTCTTTTTCTTCTCTCCAGTGGATATTTTTTAGTACTC

FIG. 2 continued

> SEQ ID NO:3264 25975  247721_301576_1
TTTGCGGGAGAGCTCTCGCCGAAGGCCTGATCTGTGCTGGGATCTACACCAGGAGCTCAAGCATGGCATCCAGGAAGCG
AACTCTCCTCAAGGCGATCATTCTCGGCGACAGCGGCGTCGGCAAGACATCGCTCATGAATCAATACGTGAACAAGAAA
TTTAGCAACCAGTACAAGGCGACCATTGGAGCGGATTTTCTCACCATGGAAGTCCAAGTGGAGGATAGGCTAGTGACGA
TGCAGATATGGGATACAGCCGGTCAGGAGCGATTCCAAAGCCTTGGTGTGGCCTTCTATCGAGGGGCTGATTGCTGTGT
GTTGGTATACGACGTGAATGTGATGAAGTCGTTTGATAATCTGGACAACTGGCGCGACGAGTTCCTCATCCAGGCAAGT
CCTTCTGATCCAGAGAACTTCCCTTTTATTGTTCTTGGCAACAAGGTCGATGTAGACGGGGGGAACAGCAGAGTGGTAT
CCGAGAAGAAAGCCAAGGCCTGGTGCGCGTCGAAGGGCAACATTCCATACTTTGAGACGTCTGCCAAGAAGACTACAA
CGTTGAGGCTGCCTTTCAATGTATAGCGAAGAATGCCTTGAGGAGTGAACCCGAAGAAGACTTCTACCTTCCGGACACG
AATGACCTCGCAAACAACAACAGAGTGACGAGATCATCTGGGTGT

> SEQ ID NO:3265 25975  255860_301645_1
CCCACGCGTCCGGAGAGAGAGAGAGCTTGGATTTTTTGGAAAGGAGAGAGAGAGAGAGGGTGCACCTCTTTTTTTCACT
CTTAAGTTTATTTTTGCTCTATTTTTATATTTCCTCTTCTTCGATCCGCATCGCTCTGCTCTGCTCTGCTCCTCCCTCG
TCAGAACTTTGTGCAGAACCTAGGGTCCTTTCGGGGGGAAAGGGGGGGGCAGAGAAGGACCCATCATGGCCTACAGAGC
AGATGAAGAGTATGACTATCTATTCAAGCTTGTGCTCATTGGAGACTCTGGAGTGGGCAAGTCAAACCTCCTCTCTAGA
TTCACTCGGAACGAATTCAGTCTCGATTCCAAATCGACTATTGGTGTTGAGTTTGCCACGCGTAGTCTAAACGTCGACG
GGAAGATGATCAAAGCCCAAATTTGGGACACCGCCGGCCAAGAAAGGTATAGAGCCATCACAAGTGCATACTATCGGGG
CGCAGTTGGCGCATTGCTTGTGTTTGATGTGACTAGGCATGTCACCTTCGAGAATGTCGAGAGGTGGTTAAAAGAGCTT
AAAGATCACACTGACGCGAATGCGGTTGTCATGCTTGTTGGGAACAAGAGCGATCTCCGACACCTTCGGGCGGTTTCAA
CGGAGGACGGCCAAGCCTTCTCCGAGAGAGAGGGCCTC

> SEQ ID NO:3266 25975  7810_300306_1
CCCACGCGTCCGCTACAATTCCTCTGTCGCTCTCACCAGTTAACAGCTACAGCACATAACTGTAACCACGCTTACCAAC
TCTAAACCTGAAATAGAGAAAGAGAGAGAGAGATACATGGAGTATGTGTGCGATTTTATGGCTTGTTTGATTGACGAT
GCAGCATATCATTTTTTAGCAAAAGATCTTGATAAGAGTGACTATGACCGATGACAAAACCCGAGCAAAAGCAATGAC
AAAAGCAGTTCAGTTTAAAGCCGTGGAAATAAAAGGCGATCACAGGAACCAGATAGAGGTAACCGGCGTGAAGTTGAT
ATGGATCCCTCTTATCCAAATACTCAGAAA

> SEQ ID NO:3267 25975  107130_300263_1
CTTTTTTTCTCTTCCTCAATTTTCTCTCTTCTCTCTCTTTCCGCCGATTCCAGATCTCATTTTCGAGAGAGTGAAGAAG
AAGAAGAGAACCAGAATTGAATAAAATGGCGGCAGTATCGCCATTAGCAAAATACAAGTTGGTTTTTTTGGGAGATCAA
TCTGTTGGAAAAACTAGCATCATTACTCGCTTCATGTACGATAAATTCGACACCACCTACCAGGCTACAATTGGTATCG
ATTTTTTGTCGAAGACAATGTACCTTGAAGATCGAACAGTTCGCTTGCAGCTCTGGGATACTGCTGGTCAGGAGAGATT
TAGGAGTCTTATTCCGAGCTACATCAGAGATTCTTCTGTTGCTGTAATTGTCTATGATGTTGCCAACCGCCAATCATTT
CTAAACACTTCAAAGTGGATTGAGGAAGTACGTACTGAACGGGGCAGTGATGTCATAATCGTTCTTGTTGGGAACAAAA
CTGATCTTGTTGATAAAAGGCAAGTATCCATCGAAGAAGGCGAAACCAAGGCTCGTGAATTTAACGTAATGTTCATAGA
AACCAGTGCTAAAGCTGGATTCAATATCAAGCCTCTGTTCCGAAAGATTGCTGCTGCTTTACCGGGAATGGAAGCCCTT
TCGT

> SEQ ID NO:3268 25975  1108973_301544_1
GTCCTTTGACTGCTTTTGTCCTTCCCATGGCCGCCTCTGGACCAGCCCGCGCTCGTGACCACGACTACCTCATCAAGCT
GCTGCTCATCGGGGATAGCGGTGTTGGCAAGAGTTGCTTGCTTCTACGATTTTCTGATGATACATTCACTACAAGTTTC
ATCACAACCATAGGAATTGATTTCAAGATAAGAACCATTGAGATGGATGGAAAGAGAATAAAGCTCCAAATATGGGATA
CAGCTGGGCAAGAGCGCTTTAGGACAATTACTACAGCATACTACAGAGGCGCCATGGGTATTATTCTTGTGTATGATGT
AACGGATGAATCATCTTTCAACAATATTCGCAATTGGATTAGGAATATAGAACAACATGCTTCAGATAATGTCAACAAG
ATATTAGTGGGTAACAAAGCTGATATGGATGAGAGCAAGCGGGCTGTGCCACATGAACGTGGTCAAGCACTTGCCAATG
AATATAACTTGAAGTTCTTTGAGACAAGTGCCAAAACAAATATGAATGTTGAAGAAGTCTTTTTTTCCATTGCAAGAGA
TATCAAGCAGCGGTTATCA

> SEQ ID NO:3269 25975  120549_300411_1
CAACCCCAACCCCTCTTCAAACCACTTATCACGCGCTCTGCTACCTCCCCATACAACACACACACACACACTTAATT
TCTCTCGCTAAACCCACGAATCCATACTCCCATTGCTTTCCCCGTGATCATTTTCCGGCGAGATCTCTGATACTCCGT
CGGAAAATCCTGATCGGATCCGCTATCTCTGAACTGCGATTCACTTTGCGATTTCGAAAGATCCGATTAGATATGGCTC
CAGTTCGGCTCTTGCGAAGTACAAGCTCGTCTTCTTAGGAGATCAATCTGTCGGCAAAACCAGTATTATCACGCGATT
CATGTATGATAAATTCGATAACACTTATCAGGCTACAATTGGTATTGACTTTCTGTCTAAGACTATGTACCTTGAAGAT

FIG. 2 continued

CGTACAGTACGATTGCAGCTATGGGATACTGCAGGTCAAGAGAGATTTAGGAGTCTCATACCAAGCTATATTAGGGACT
CCTCTGTTGCTGTCATTGTGTTTGATGTTGCTAGCAGGCAGTCCTTCTTAAATACTTCAAAGTGGATTGAGGAGGTTCG
AACTGAGAGGGGCAGCGATGTTATTATTGTCCTTGTTGGTAACAAAACTGATCTAGTTGACAAAAGGCAAGTTTCAATC
G

> SEQ ID NO:3270 25975   183346_300621_1
CCCCTCTCCGCCTCGCGAATCTCCTCCCCTCCCCCACGCAACTCGCCGCCTGCGCTGCCGCTGCTCGTGAGGGGGAGAC
GACGCCGGAGGAGATCGCCGCCGCCGCCGCCGCCGCCTCGGACGGCCGCGCCCCCCGCCGCGCGTGTACCACGGGCTT
GGGGGATTGATTGGTAGCGATGGCGGCGCCGCCGGCTAGGGCTCGGGCCGACTACGATTATCTCATCAAGCTGCTCCTC
ATTGGCGACAGCCGGTGTAGGAAAAAGTTGTCTCCTCCGGTTCTCAGATGGCTCTTTCACGACTAGTTTCATTACCA
CAATTGGTATTGACTTCAAGATAAGGACCGTTGAGTTGGATGGTAAACGGATTAAATTGCAAATCTGGGATACTGGTGG
CCAAGAACGCTTTCGAACTATTACCACTGCTTACTACAGGGGAGCAATGGGCATTTTACTCGTTTATGATGTCACCGAT
GAATCTTCATTCAACAACATAAGAAATTGGATCAGAAACATCGAACAACATGCCTCTGATAATGTGAACAAAATTTTGG
TGGGGAACAAAGCTGATATGGATGAAAG

> SEQ ID NO:3271 25975   159101_200140_1
ACGTTTTTGCATCTGAATTCTGCCGCGAACAATCAGATTCCGTACAATTCTCGCCGGTAGATCTCTCAATATTCCGGTG
ACTTTCGTGTGCTTTTAATCGCCATGAATCCAGAATATGACTACCTGTACAAGCTTCTGCTTATCGGTGATTCTGGTGT
TGGGAAGTCATGTCTCCTTTTGAGATTTGCTGATGACACATATCATGAGAGCTACATAAGCACAACTGGAGTTGATTTT
AAAATCCGGACAGTGGATCAAGATGGGAAGACCATTAAGCTTCAGATTTGGGATACTGCTGGACAAGAGCGTGTTAGGA
CGATCACTAGCAGCTACTATCGCGGAGCCCATGGCATAATAATTGTCTATGATGTGACGGATCACGAGAGCTTCAATAA
TGCGAAGCAAAGGCTGAATGAAATTGATCGTTATGCTACCCCAAACG

> SEQ ID NO:3272 25975   157979_301397_1
GAGAGTGCTCTCAAGCAAAGGATTTCTCTAGAGAGAGAGAGAGCGAGAGAGTGTGTCTGTGTGAGTGTGAGAAAGAGAG
AGAGAAATAGAGATGGCAAGGAGACCGGACGAGGAGTACGATTACTTGTTCAAGATAGTGTTAATCGGAGATTCAGGAG
TAGGCAAATCCAACTTGCTCTCCAGATTCACTAGAAATGAGTTTTGCTTGGAGTCCAAATCTACTATCGGCGTTGAATT
CGCCACTCGTACTCTCCAGGTTGAGGGAAGGATCATTAAGTCTCAGATCTGGGACACTGCTGGACAGGAGAGATATAGA
GCCATTACAAGTGCTTACTATAGAGGTGCACTTGGAGCTCTTCTGGTATACGATGTGACAAAACCTATGTCCTTTGAAA
ATGTCAGCCGATGGTTAAAGGAACTGAGGGATCATGCAGACTCCAACATTGTGATTATGCTCATTGGAAACAAGACTGA
TCTGAAGCATCTCCGAGCAGTTCCTACAGAGGATGCTCAGGGCTATGCTGAAAGAGAAGGGCTTCTTTCATTGAAACAT
CTGCTTTGGAGGCAACGAACGTAGAAAAAGCTTTCCAGATGAATCTTTCAGAAATCTATCGGATAATCAGTAAGAAGTC
ACTT

> SEQ ID NO:3273 25975   157926_301397_1
ACCTTGCTCTCCGTCATTTTCCGGCGACGATCCCTTTTTCCGCTATTTCCGGCCGTAAGGAACAGAAACATCCCCGTTC
CCTTCGCCCTTTGGATCAGTCAGCTTCGCAAAATCATGAATCCCGAATATGACTACTTGTTCAAACTTTTGTTAATAGG
AGATTCAGGTGTTGGAAAGTCATGTCTTCTCCTGAGATTTGCTGATGATTCTTATTTGGACAGCTATATCAGCACAATT
GGTGTTGACTTTAAAATACGTACAGTGGACAAGATGGGAAGCTATTAAACTTCAAATTTGGGACACTGCCGGACAAG
AACGTTTCAGGACAATTACAAGTAGTTACTACCGTGGAGCACATGGCATTATAATAACTTATGATATAACTGATCAAGA
AAGCTTCAACAATGTTAAGCAATGGTTGAGTGAAATTGATCGCTATGCAAGCGAAAACGTAAACAAGCTTCTGGTTGGA
AATAAGTGTGACCTAACTGACAACCGAGCTGTGTCATATGATACAGCAAAGGCGTTTGCTGATGAAATCGGCATCCCGT
TTATGGAGACTAGTGCAAAGAGTGCCACTAATGTTGAGCAAGCGTTCATGGCAATGGCAGCTGAAATAAAGAATAGGAT
GGCGAGCCAGCCGACATCAAACAATGCA

> SEQ ID NO:3274 25975   157486_301738_1
CTCCCTTCTAACAGTTGATTATAGGAGGACTTCAATTTCTGAAAGATCGTTTCAAATTTACTGGTTTTTATTCATTTTT
TAGCTCCGTTTAACCCTTTTGAACAAAAATAATGGCAGCTCGAAGGCGGATGCTTCTCAAGGTCATAATCCTAGGCGAT
AGCGGGGTGGGAAAGACATCTCTGATGAACCAGTATGTGAATCGTAAGTTTAGTAACCAATACAAGGCGACAATCGGAG
CTGATTTCTTGACAAAAGAAATTCAGTTTGAGGATAGGTTATACACATTGCAGATATGGGATACAGCTGGGCAGGAAAG
GTTCCAAAGCCTGGGTGTAGCTTTTTACCGTGGAGCAGATTGTTGTGTTCTAGTATATGATGTGAATGTTATGAAGTCA
TTTGAGAATCTTAACAACTGGAGGGAAGAATTTTTAATCCAGGCAAGCCCATCTGATCCCGAGAACTTCCCATTTGTCG
TAGTGGGGAATAAGATAGATGTTGATGGTGGCAACAGTCGAGTGGTCTCTGAGAAGAAAGTAAAGGCATGGTGTGCTTC
CAAGGGAAACATACCATATTTTGAGACCTCAGCAAAAGAGGGATTCAATGTGGA

> SEQ ID NO:3275 25975   155093_301352_1
TTCTTGACGTCAACCATCCTCTTCCTTTTTTCAAGTCCTAATTCTAATCAAAACCCTAATCGAACGATCACAAAAATCT
CCATCACGACCAAATAATCATTTCTCTTCTGCAAATTTCGATCAATTAACAACTATGGCAACCGGTGGAAACAAGAATA
TGAACGCCAAATTGGTGCTTCTTGGAGATGTTGGAGCTGGAAAATCTAGTCTAGTTCTGCGTTTTGTTAAAGGACAATT

FIG. 2 continued

TATTGAATTTCAGGAATCAACTATTGGTGCTGCATTTTTCTCCCAAACAGTAGCAGTGAATGATGCAACTGTAAAATTT
GAAATATGGGACACAGCAGGCCAAGAGAGATACCACAGTCTTGCTCCAATGTACTATAGAGGAGCTGCGGCTGCTATAA
TTGTTTTTGATATCACAAATCAAGCATCATTTGATAGGGCACAAAAGTGGGTTCAGGAGCTTCAGGCACAAGGTAATCC
AAATATGGTGATGGCACTTGCCGGGAATAAGGCAGATTTGTTAGATGCAAGAAAAGTGGCTGCAGAGGAAGCCCAAACA
TATGCCCAGGAGAATGGCCTTTTCTTCATGGAAACATCTGCAAAAACTGCATCTAATGTTCATGACATTTTCTATGACA
TAGCAAAGAGA

> SEQ ID NO:3276 25975  144467_200135_1
gatcgaagccccaaaaacatgcgcagaaaaggtcggttgtccagataagggagtagtacatattatgctcaataacaac
tACTGGGCATCAATCATCAATTCTACTGGAAACGTCTAAAATTGCCAACTGTCTGTCTTCCTCACGCCACACACACACA
CACATACCGGCGCGGAGTTTTCTGAATTTAGTCTCGTTTTGTCAGATCGAAGTCCGCCGAAGATGCCTTCACGCCGGCG
AACTCTTTTGAAAGTCATCATCCTCGGTGATAGCGGGGTTGGGAAGACCTCGTTGATGAATCAATATGTAAATAAGAAG
TTCAGCAACCAGTACAAAGCAACTATTGGGGCTGATTTCTTGACAAAGGAAGTGCAGTTTGAAGATCGGCTCTTTACAT
TACAGATTTGGGACACAGCTGGCCAAGAGAGATTTCAAAGTCTTGGTGTTGCGTTCTACCGTGGTGCTGATTGCTGCGT
CCTTGTGTATGATGTAAATTCAATGAAGTCAtTTGAAAACATaaACaaTTGGAGAGaaGAGtTTCtaaTtcaggctagc
ccaTCggATccagaaaattttccAtttGttgtgctGGGaa > SEQ ID NO:3277 25975  142035_300431_1
CCCCCGAGCAGCGCTCGTGTTCGGTCAAAAGCCTCGCCGCGGCGAGCTCGAGCTCATGGGCATTCCGGAGGGGAGGGAG
GGATGGGGGACGAGTCGGAGGGGGAGACGGAGGAGTACCTGTTCAAGGTGGTGATCATCGGGGACAGCGCGGTGGGGAA
GAGCAACCTGCTGTCCCGCTACGCCCGCAACGAGTTCAATCTCCACTCCAAGGCCACCATCGGCGTCGAGTTCCAGACG
CAGAGCATGGACATCAACGGCAAGGACGTCAAGGCCCAGATCTGGGACACCGCCGGCCAGGAGCGCTTCCGCGCCGTCA
CCTCCGCCTACTACCGCGGCGCCTTCGGCGCCCTCCTCGTCTACGACATCTCCCGCCGCTCCACCTTCGACAACGTCGG
TCGCTGGCTCCAAGAACTCAACACACATTCGGACACGACTGTAGCCAAGATGTTGGTGGGCAACAAGTGTGATCTGGAT
AATATCCGTGAAGTGCCGGTAGAGGAAGGCAAAGCACTTGCTGAAGCTGAAGGGCTGTTCTTCATGGAGACCTCTGCTC
TGGACTCGACAAACGTGAGGACAGCTTTCGAGATCGTAATCAAGGAGATCTACAGCAACGTGAGCAGGAAGATCTTGAA
TTCGGACTCCTACAA > SEQ ID NO:3278 25975 126840_300467_1
GCCATTACGGCCGGGGAAAGGAAAAGTAGGTAAACCAATGGTCAGACAGCAAGATCCCAGCAAAGACTAGCCAAGATCT
GCGTCTCCTCTCTCTCTCTCTCTCTCTCTCTCTCTAACTTTCAACTGCTGATTGAGTGTACAGAAGCTTAGTGTTCT
GGTTTAAAAAAAGATGGCGAGTGGGTATGGGGATGCGAGCCAGAAGATAGATTATGTATTCAAAGTGGTGTTAATCGGC
GACTCAGCTGTAGGCAAGTCTCAGATACTGGCTCGATTTGCTCGTAATGAATTTAGCCTGGATTCTAAGGCCACGATTG
GGGTTGAGTTCCTGACCCGAACCCTAGTCATTCAACACAAGTCTGTTAAAGCTCAGATCTGGGATACTGCTGGTCAAGA
ACGATATAGAGCTGTCACAAGTGCATACTACAGGGGCGCAGTTGGAGCTATGTTGGTTTATGACATAACGAAACGGCAA
ACCTTTGATCACATACCCCGTTGGCTGGAAGAGTTGCGTGCACATGCCGATAGGAATATCGTGATCATGCTGATCGGAA
ACAAAACAGATCTTGAAGACCAACGAGCTGTCCCTACCGAAGATGCTAAAGAATTCGCCC > SEQ ID NO:3279 262408 262566_301695_1
GCAGCATGAATAGAAAATACTTGGATCGTCGATCATATTCATGGTCCGGATCACAAGCAAGACCATACATATGCGAATT
TTGCGAGAGAGGTTTTTCCAACGCACAAGCTTTAGGAGGGCACATGAACATCCACAGAAAAGACAGGGCAAAACTTCGA
CAAGCGAACCTAAAAGAAGAAGACAGTGAAGATGCCATTTGCACCACTTCGAGAAATCGGTTTGGGCAAGAGCTTATTG
AGTTACCTTTCTTCGTTGATACGGTCGGTCCAAGAAGAAAAGGAGAAGATGATAAAAGCGAAAAGGTTTAGGAGATGA
AGAAAAGAAAAATATGAGGATACTTCAAAAGGCTTTATCTCAAAGTGCAGACGTGATAGATCTTGAGCTCCGTCTAGGA
TTAGATCCTTATAAAAAACAACAAGTACAAGTACGTAATAA > SEQ ID NO:3280 2625053016951     262410_301749_1
TTATTAAAGATGAAGATCGAGACTCACATGATCTTGCACGTTAGGGCTCAATCCGTAACCGTACGATGACATTCTGTTC
TGAGCAGCGGAGCCACCCACTTGCGATGATAGTTGAGTTTGAGAACGGGTCAACAACGGTAAAGTCGAATTAGAAGAAG
AAGAAGAGCCATTACTAGTAAACGCTGCGTTTGAGTTATAAACGCCTTGAACGCGAGGCGGTAGACGCCATAGTCCTAA
CTGACTCCCATAGCTGGGTCGTGTATAATACCCCGACGGCTTAGGACCAGAAGAAAATCCTCCATAGGACCTAGCCGCG
GTTAACGGACCATTGGTCCACGACGGGTAATGACGGTAACTGTAAGGGTTATTGTCAGGATGATAAAAGTAAGAGGAAA
CACCGCGTTTGGCAAGCTGACGTTCGCGTTTGTGAGCGTTTTGGTGTCCACCTAGGGCTTGTGAAGTAGGAAATTTCT
AAAGCAATAGTGACACTCGAATCTCCTGTTGTGGCTGATGCTATTATTGTCCGTACTGTTGTCTCCGGTTTGGTCTTCT
TCCTCTTCTTCTTCTTTGTTTTGGTCTGGTAAGGATCGGTGTAGTCTTCTTGACCGGTAGTAATAGAGAAATCTCTGC
CGGTGAAATCTTTTCCAAGACACGAATGGGTTTAGGGTTCTTATCTTTAGGACGGCGaatgaaaggaagctgagagaa
ggattcgacgttcacgaaatcttgagtttctgtttctccggtagcgtcgtccatgctgc

FIG. 2 continued

> SEQ ID NO:3281 262509 262446_301694_1
GCAGCATGACTCAAAAGCTGTTTATACAGTATAGTCTACGGTCTTACATCGTATTTTGGAAATATGACCAAATTACCCC
TTGGTTTGTCCATAAATATCAAGCTCCAACAATGCAATTCTTCCCTTTTCCCCTTCTAATTTCTCTCATCTCTCTATTA
GAAAAATTATTAGCAATTATGTTGTCCACTGCACCGGCCTTTTCATTCTCCGAACCGGG

> SEQ ID NO:3282 262509 262446_301749_1
TTATCATTGAAGATGAGGGTGGTTTTGTTCAGTCATGATCATTCTCCGGTTATGTAGTTCCCATTGTTGCTGTTGTTGA
AGTTGTCTAATGATCAGAATCCGACGCATCTCCGACAATCTTAGCCGGAGTATCTCTTGTTCTGTCACGAGCCGGTTAT
TGTCGGAATTCACTCGTTGAAGCTGGTGTAAAACTAACCGGAGTCGGTTCCCGAGCTCACGGTTTTCTAAATCCAACCG
GTTTACTTGCTCTCGTAAGTTATCAATGTGACTTTGTTTACGCATTCTTGACCGTTTCGCTGATTCCCGGTTTGACTCC
ATCCTCTTCCTCTTCCGCTCGTCGGTCATCTCCGGTTGGATCATTTTTTTCCGGTTATGGTTATTCTCTCCCGAACCGA
AATTTGTGATGGCTGTCAATTGTTTTGTGTCGTCCGAGTCCGGTTCATCTGCTTGAGAGCACGGTAGATCGTTTGATAT
GTCGGCGTCGTCACGACGAGGATTAATTTTGACGAAACCGGCACAAGATTCGTCAGAACCGGTTTTCATGTCATGAGAA
CCGGAATTAATTTTGACGGAACCAGTGTCGGATTCACCATAACAAGGACT

> SEQ ID NO:3283 262648 262732_301693_1
GCAGCATGGGTCAAAAGTTTTGGGAGAATCAAGAAGATCGAGCGATGGTTGAATCCACCATAGGCTCTGAAGCTTGCGA
CTTTTTCATCTCAACAGCTTCAGCTTCCAACACTGCCTTGTCCAAGCTTGTCTCACCACCAAGTGATTCCAATCTCCAA
CAAGGGTTACGTCACGTTGTTGAAGGATCTGATTGGGATTATGCTCTTTTCTGGCTAGCGTCCAACGTTAATAGCTCTG
ATGGTTGTGTCTTGATCTGGGGAGATGGTCATTGCCGTGTCAAAAAGGGTGCTTCAGGTGAGGATTACTCTCAGcAAGA
TGAGATCAAAAGACGTGTGCTTCGCAAGCTTCACTTGTCGTTCGTTGGTTCAGATgaagaTCATCGTTTGGTGAAATCA
CGaGCTCTTACTGATCTCgaCATgtctgaTCTGGCTtctttgtaCTTtccctttaggtGTGATACCAATaagtACGGtC
cctgctggAACCTATGTGTCTGGGAagCCTCTTTGGGCTGCAcatttgcct > SEQ ID NO:3284 262648 262732_301749_1
ACGGTTATTACTGTGATACAGAGGCAAGGAGCTTGTCCTTCAACTGCTCAGCGGTGCAGGCACCCTGAGGCCGGACAGT
GAATGTGTGAACCACACCCTCCTCTGTGATGGCCACGTTGGAATCATGAGGCATAACTTCATTCTCCCTCAACGTCTGT
ATCACCTTTGAAACTGGATGAGTTTCCAACGGACAGCTTAGCCTTACAACTGCATCATCATGCCTCTGTTGATAATCAA
CCTCTGCTGGAGTTATCTGATTACTCTCCCTCCTCTTCATTATCTGCTTCTCTGTTTCATACACCCTGATTTTCTTCTG
CATATCCGTGATGTAAGTGATTGGGTCTGCAAGGAGCGAAGCCTTGTCCACTCTTGGAGATGTTAGGCACCACCGCTCT
CAAAGCGTAGAATCTCTGG > SEQ ID NO:3285 262650 262713_301693_1
GCAGCATGGAGAGACGAACGAGACGAGTGAAGTTCACAGAGAATCGTACGGTCACAAACGTAGCAGCTACACCATCTAA
CGGGTCTCCGAGACTGGTCCGTATCACTGTTACTGATCCTTTCGCTACTGACTCGTCTAGCGACGACGACGACAACAAC
AACGTCACGGTGGTTCCAAGAGTGAAACGATACGTGAAGGAGATTAGATTCTGCCAAGGTGAATCTTCTTCCTCCACCG
CGGCGAGGAAAGGTAAGCACAAGGAGGAGGAAAGCGTAGTGGTTGAAGATGACGTGTCGACGTCGGTGAAGCCTAAAAA
GTACAGAGGCGTGAGACAGAGACCTTGGGGAAAATTCGCGGCGGAGATTAGAGATCCGTCGAGCCGTACTCGGATTTGG
TTTGGGACTTTTGTCACGGCGGAGGAAGCTGCTATAGCGTACGATAGAGCCGCGATTCATCTCAAAGGACCTAAAGCGC
TCACGAATTTCCTAACTCCGCCGACGCCAACGCCGGTTATCGATCTCCAAACGGTTTCCGCCTGCGATTACGGTAGAGA
TTCTCGGCAGAGCCTTCATTCAacgAcctCTgttaTAAGATTccacgTCaacgaggAaacaGAGCatgAgATTGAAGCG
ATCGAGCTAtctccGGAGAGAAagtcgcCggttataAaagCAAGAAGAagaatcgtcgCcggtttTGGTGTTCccgGAt
ccgtAtctgttaCCggaTttaTcTcTcgccgccgaATGTTTTtggcataCCgacatTGCCCtgacctttgtTtctcc
gatgaAgaaaCcggatcACaaTCAActttTGTTACcatacaCAGaggtTTCgatacAAGgagaaacccaaactgcaGATt
tcgagtttggtttgattgatgatcttcgagtcttccccatgggatgtggatcatttcttcgaccatcatcatcactctt
tcgattaataa > SEQ ID NO:3286 262658 198963_300647_1
GTCGAGCCACGCGTCCGCGGGGACAGATATGACGGCCGCCCTGCAAGCGCTGCTCGACCGGAGGGCGCTGTCCTTGGGC
CTGCCCACGCCGGCGATCAACAAGGAGGAGTACCTCGCCATCTGCCTCGCCGCGCTCGCCTGCACGCGGGCGGGGAAGG
CCCTGGTGGGAGTGGGAGGCCAGCAGCAGGTGCAGGCCTGCAATAAGTGGCTGTGCCCAGCGCCCGCGGCGCCTGAGGA
GCTCCGCTTCCGGTGCACCGTCTGCGGGAAGGCCTTCGCCTCGTACCAGGCGCTCGGCGGACACAAGTCCAGCCACCGG
AAGCCGCCTTCCCCGGGAGACCACTACGGCGCCGCCGCCGCGGCGCAGCAGCTGGCATCCGCTGGTGACTCGAAGGAGG
ACTCGGCGTCGTCAGCGGCCGGGAGCACTGGCCCGCACCGGTGCACCATCTGCAGGAGGAGCTTCGCGACGGGGCAGGC
GCTCGGCGGCCACAAGCGCTGCCACTACTGGGACGGCACGTCGGTGTCCGTCTCCGTCTCGGCGTCCGCGTCGGCCGCC
TCGTCGGCCGTCAGGAACTTCGACCTCAACCTGATGCCGCTG

FIG. 2 continued

> SEQ ID NO:3287 262715 262777_301693_1
GCAGCATGCAAGACTCTTCCTCTCACGAATCGCAACGTAACCTCCGGTCACCGGTGCCGGAGAAAACCGGAAAGAGTTC
TAAGACTAAAAATGAGCAAAAAGGTGTTTCTAAACAACCAAATTTTCGTGGGGTCAGAATGAGACAATGGGGAAAATGG
GTGTCTGAAATTAGAGAACCAAGAAAGAAATCAAGAATATGGCTCGGTACTTTCTCTACGCCGGAGATGGCGGCGCGTG
CACACGACGTGGCGGCTTTAGCCATCAAAGGTGGCTCTGCCCACCTTAATTTCCCGGAGCTAGCTTACCATTTGCCGAG
ACCGGCTAGCGCGGACCCTAAAGACATTCAAGAAGCCGCCGCCGCAGCAGCTGCCGTTGACTGGAAAGCACCGGAGTCT
CCGTCTAGCACCGTGACGTCATCTCCAGTCGCCGACGACGCTTTCTCCGATCTTCCTGATCTTTTGCTTGACGTGAATG
ATCACAACAAAAACGATGGATTCTGGGACTCGTTTCCGTACGAAGATCCTTTCTTTTGGAAAATTACTAGTAA

> SEQ ID NO:3288 262725 262748_301693_1
gcagcatgaatcttgaccaagaactcgccgagatcagagctagcagttccgaccacaccaattacttctacagctcgga
gAGGAGAGAGCACATGTTCGACAAAGTGTTGACACCAAGTGACGTCGGTAAACTAAACCGGCTCGTGATTCCAAAGCAA
CATGCAGAGAACTTCTTCCCTTTAGAGGACAATCAAAACGGCACAGTGTTGGATTTCCAAGACAAAAACGGCAAGATGT
GGAGGTTTCGTTACTCGTATTGGAACAGTAGCCAAAGCTACGTGATGACCAAAGGATGGAGCCGTTTCGTCAAGGAgAA
GAAACTCTTCGCCGGAGACACCGTCTCTTTCTACCGTGGCTACATCCCTGACGATAACGCACAACCGGAGAGACGACGG
AAAATAATGTTCATCGATTGGAGGCCTAGAGCCGAGATAAACTCCGTACACAACATTAACAATCATAACTTCGTTTTCG
GGTCTCCGACATATCCAACGGCTAGGTTTTATCCGGTGACGCCGGAATATTCCATGCCATACCGGAGTTTTCCACCGTT
TTATCAGAACCAATTTCAAGAACGGGAATATTTAGGGTATGGTTATGGTAGAGTTGTTAATGGTAATGGAGTGCGTTAC
TACGCAGGATCACCGTTGGATCAACATCATCAGTGGAATCTTGGTCGATCTGAGCCGTTGGTTTATGACTCGGTTCCAG
TTTTTCCAGCGGGGAGGGTACCTCCGTCGGCGCCTCCTCAGCCGTCGACGACGAAGAAGCTGAGGCTGTTTGGGGTTGA
CGTGGAAGAGtctTCAtCTTCAGGGGATACACGTGGCGAAATGGGAGTAGCAGGGTACTCTTCCTCGTCTCCGGTTGTG
ATCAGAGACGATGATCAATCATTTTGGAGGTCGCCACGTGGCGAAAtggcatcgtcttcttcggctatgcagctaagtg
gtgatgaagaatataagaggaaagggaaatctttagagctttgataa > SEQ ID NO:3289 262725 270909_200129_1
TGATAAGGTAGTCACCCCCAGTGACGTCGGCAAGCTCAATCGGTTAGTCATCCCCAAACAGCACGCTGAGAAGTATTTC
CCTCTTGATTCATCCACCAACGAGAAAGGCCTGCTCCTCAATTTCGAAGACAGAAACGGAAAGTCCTGGCGGTTCAGAT
ATTCTTACTGGAATAGCAGCCAAAGCTATGTGATGACCAAAGGTTGGAGCCGATTTGTCAAGGAGAAGAAGCTCGATGC
TGGGGATATTGTCTCTTTTCAGCGCGGAGTACGTGAATTAGGCAAAGATCGTCTGTTCATCGACTGGAGACGCCGTCCA
GATGCCCCGACCGACCATCTCCACACCCACTTCATGACTCATGTGCCGCTTTCACCCCATTTCTCTAATAATTTCCAGT
ACCGCTCCAATATTAATCATCAATACCCAGCTGCTTGGAATCAACCGCTCTTTTTGCAGCCAGACCATTCACCTTTACA
TTCCCGTCATGCCGGCAGCATGTCTCATCAGCAGCAATATAGCTACAGCGCCTATGGAATTCGGAACAGTCCCTAATTA
CTACGATACAGCTTCTAATT > SEQ ID NO:3290 262725 3071_300344_1
CCCACGCGTCCGCTAAACCGTCTCGTGATACCTAAACAACACGCCGAGAAACACTTTCCGTTACCGTCACCGTCACCGG
CAGTGACTAAAGGAGTTTTGATCAACTTCGAAGACGTTAACGGTAAAGTGTGGAGGTTCCGTTACTCATACTGGAACAG
TAGTCAAAGTTACGTGTTGACCAAGGGATGGAGTCGATTCGTCAAGGA > SEQ ID NO:3291 262762 250154_301599_1
TTTCTTCCCCTCAAAGAAAATTAGATAGAGAAAAAAGAAGAGGAAGAGGAACAAGAACAAGAAGCAAGCGAAGCAAGCG
AGCAAGCATTGGAGATGGATCTTCACGTAGGAATCGGCGGCGGCGGCGGCGGCGGCAGCAATGCGTTTGGATCGGG
GGACAGCGGCGGTGTCGGCAGCTGCGACAGCCCGACCATGGCGGCGCTCCACAAGTTCCTGCCCCTCCAACAACGAAGAC
TCGTGGTCGGCCGAGCACCTGTACGCCTGCGACGAGTTCCGCATGTTCGAGTTCAAGGTCCGGCGCTGCATGCGGGGGC
GCAGCCACGACTGGACCGAGTGCCCCTTCGCCCACCCGGGGGAGAAGGCGCGCCGCAGGGACCCCCGCCGCTTCCACTA
CTCGGGGACATCCTGCCCCGACTTCCGCAAGGGCTGCTGCAAGAACGGGGACAGCTGCGACCTGGCGCACGGCGTGTTC
GAGTGCTGGCTGCATCCCGCGCGCTACCGCACCCAGCCCTGCAAGGACGGCCGCAATTGCAAGCGCAAGGTGTGCTTCT
TCGCGCACACCCCGGAGCAGCTC > SEQ ID NO:3292 262762 286429_200109_1
gcactattgttgttctatacacgaagatccaaaaaaatgatgatgatcggaagatcacctcactcacatccgaccgtcc
aAGTCCCTCCTTGGGACGTTATGGATGATCAACGGTTGATGTTCCTTCCCCATTTTCCGTTACACACAACTACTCCAC
TAGTCCTGATTCTGGTTTCGACGCCTTAACGGCGTTGCAGCGTTACCTGCCGTCGAATGGTAACGACGTTTGTTCGAC
TCTGACGGCTTGGACATTCCCGTGGATGCGTTCTCATGTGATAATTTCCGCATGTATGAGTTCAAAGTGAGGAAGTGTG
CACGTGGAAGGTCACATGACTGGACGGAATGTCCGTACGCTCATCCCGGCGAAAAGGCTCGCCGTCGGGATCCGCGGAA
GTATCATTACTCCGGCACTGCTTGTCCAGATTTTCGTAAAGGCCTGTGTAAGAAAGGTGATGCATGTGAGTACGCGCAC
GGCGTATTCGAGTGTTGGCTTCACCCTGCTCGCTATCGCACGCAGCCTTGTAAGGATGGGACCCACTGTCGCCGGCGCG
TGTGCTTCTTTGCTCACACGCTGGAGCAACTGCGTGTTCTCCCTCAGAACAGTCCGCAAGCCATGCTGCTGAGTCTTG
TGACTCGTTCGACGGATCGCCGAGTCGACTCGGTTTTGACTCGTTTTCTTCATCTCCCCGTTTGACTCGCCTCCGATG

FIG. 2 continued

ACCCCGAGTGGATCACTGAGTCTCAACTCGGTTACCGGACTCGCTGAGTCGATGTGTAATATGCAGATTGGGATGGTTA
GGGGTATGGTTAGCCCTACATGGGGATTGCAAATGGGTTCTCCCGGGTTCGGTTCACCACGGAGCCCATCAACATTCCG
ACCCGGATTCATGAGTCTTCCAACAACTCCGACCCGAAACCCGACCCGATCTGGACTGGCTGTATTCGATCAGTGGGAG
AAGACTTACGAAGAGGAGCCACCGATGGAGaGGGTAGAATCTGGAaggGATCTCCGGGCCAgaaTTTATGCGAAACTCA
GCATGGAAAACTCGCttgACTCGggTGCTCcggatgttg > SEQ ID NO:3293 262762 262514_301695_1
GCAGCATGATGATCGGAGAAACTCGCAAGACTTATCCCACTGTTGAGATACCTCCATGGCCGATACTTGAATAGCTTAC
AACGTCTGAGTTTTTTCCTCCGGGTGATGAATAGTCCACATTGTATCATGCTTGAAGCTTTGGAGGAGTTGCAACGTGA
TTGGCCGTCTAACGAAACGGATCC > SEQ ID NO:3294 262762 262541_301695_1
GCAGCATGATGATCGGAGAAACTCGCAGGACTTATCCCACTGTTGAAATACCTCCATGGCCGGTACTTGAAGAGCTTAC
AACGTCGGAGTTTTTTTCTCCGGTGATGAATAGTCCAGATTGTAGCATGCTTGAAGCTTTGGCGGGGTTGCAGCGTTAT
TTGCCGTCTAACGAACCGGATCCGGAGTCATACCCGGATCTATTGGGTCCGGATTCACCAATCGATGCTTACTCATGCG
ACCATTTCCGTATGTACGATTTCAAAGTCAGGAGGTGTGCTCGTGGCCGGAGTCATGATTGGACGGAGTGTCCGTACGC
TCATCCCGGAGAAAAAGCTCGCCGGAGAGATCCGAGGAAGTACCATTACTCTGGTACGGCTTGTCCTGATTTTCGTAAA
GGTGGCTGCAAGAAAGGTGACTCTTGTGAGTTTGCTCATGGTGTTTTCGAGTGTTGGCTTCATCCAGCTCGTTACCGTA
CTCAGCCGTGTAAAGACGGTGGTAACTGTCTCCGGAAAATTTGTTTCTTTGCTCATTCACCGGATCAGCTTAGGTTTTT
ACATACTCGGAGCCCTGACAGAGTTTGATTCTTTTGACGTTTCGTCTCCGATTCGTGCTAGAGCATTTCAGCTGTCGATT
TCTCCGGTTTCTGGTTCGCCACCGATGAGTCCAAGAGCTGACTCGGAGTCTTCTCCGATGACTCAGTCACTGAGTCGAT
CTCTCGGGTCTTGTTCGATAAACGACGTCGTTCCTTCGTTTAGGAATTTACAGTTTAATTCGGTAAAATCATTTCCTCG
TAACAATCCTTTATTCGGATTCGGGTCGCCCCGTGGATCGATCTTGGGTCCTGGGTTTCAGTCTCTGCCTACAACACCG
ACCCGACCAGGGAATCTGGATATTTGGGAGTATGGTTTGGAGGAAGAACCCGTAATGGAGCGTGTCGTTGAGTCGGGTC
GTGAGCTACGAGAAAAGATGCGCGAGAAACTGCACAAGGAGAATTGCATGGATCGAGTTGCCCAGGATCCGGATCAGAA
TTTGGGTGAGGCTCCTGATGTCGGGTGGGTATCTGcctgctcatgtaataa > SEQ ID NO:3295 262762 142393_300434_1
CCCCGTGAAGCCGTGCTCCCGCGCCTACTCCCATGACTGGGCCGAGTGCCCCTTCGTCCACCCCGGCGAGAACGCGCGC
CGCCGCGACCCTCGCCGCTACTCCTACAGCTGCGTGCCTTGCCCGGAGTTCCGCAAGGGCGGCTCGTGCCGCAAGGGCG
ACGCGTGCGAGTACGCCCATGGCGTGTTCGAGTGCTGGCTCCACCCGGCGCAGTACAGGACGCGCCTCTGCAAGGACGA
GGTCGGCTGCGCGCGCCGCATCTGCTTCTTCGCCCACAAGCCCGACGAGCTCCGCGCCGTCAACCCCTCCGCCGTGTCC
GTCGGCATGCAGCCCACCGTATCGTCGCCGCGCTCCTCGCCGCCCAACGGGCTCAACATGGCGGCGGCGGCGGCGGCGA
TGATGAGCCCCGCCTGGCCGTCGTCCCCAGCGAGCCGCCTCAAGACGGCGCTCGGCGCGCGGGAGCTCGACTTCGACCT
CGAGATGCTCGCGCTGGACCAGTACCAGCAGAAGCTGTTCGACAAGGTGTCCGGCGCGCCGTCGCCGAGGGCGAGCTGG
GGCGCCGCGG > SEQ ID NO:3296 262762 146780_301067_1
atccctattccgcttcttgtttccttgcattcaacattactttcatgtccccaactttctaaaagtctgtcaattcaat
cCACCAATATTTCTTGAAAAGCCTAGAAATGGAAGGGCTTTGTGCTGAACAACATCATCACAAGTTTCATCCTTCTCAC
CACCTTTACCTTAACAAGAAATCTCTTCGTGATATTGACATTCCCCAAGAAAACTCCTCAGCCGCCGTTCTAATCTTT
CCGCCGACCCTGTCTCCGACATGTTTATGGACTCACCTAAATCAGATTCAGACACCCTTTTCCAGAAATTCTTACCTTA
CAACAGCCTTGACGAGGATGATTCTGATCCGTACTCTTCCGACCACTTTCGTATGTACGAGTTCAAGGTCCGCCGCTGT
ACTCGTAGCCGCAGCCACGATTGGACTGACTGCCCTTTCGCTCATCCAGGTGAGAAGGCTCGTCGGAGAGACCCAAGAA
GGTTCCATTATTCTGGAACTGTTTGCTCTGAATTccGTAAAggAAATtGTAAcCGAGGTGATAATTgtgaGTttgcacA
CGGGGTATtTGAAtg > SEQ ID NO:3297 262762 194865_300767_1
CCCCCCCGGGCTTACACATCGGACCACTCTCTCTGGGCGCGTCCATAGGCCGAGTCCACGAGATCTCGCCGTAGTCCAT
ACACCGGTTGATCGGAGGTCGTGTTGCCGCCGGCGGTGGCCATGATGATGATGGGGGAAGGAGTCAGCAGCGTCCCGCC
GTGGTCTCACCTCCCCGTGAGCGGAGTCGATGTACTCGGCGGCGGTGGTGGCGGTGGGGATGAAATGACCCCGTACGTG
ATCGCCGCGCTGCCGGGATTACCTGCCGGCGAATGATGTCGGGGTGGGGGCTGACAAGGAGGAGGAGGCCCGGCGATGG
CCGCGGCGGTGGACGCGTACGCGTGCGACGAGTTCCGGATGTACGAGTTCAAGGTGCGGCGGTGCGCGCGCGGGCGGAG
CCATGACTGGACCGAGTGCCCCTTCGCGCACCGGGGGAGAAGGCGCGCCGCCGCGATCCGGGCAAGTACCACTATTCC
GGCACCGGGTGCCCGGACTTCCGCAAGGGCGGGTGCA > SEQ ID NO:3298 262783 262626_301692_1
GCAGCATGAACAACAATCATTCCTATGATGATCGCAGTTTTCACATGCCACTTCATCCTTCTAACACAAGCAACCCTAA
TCCAAATCTCCAGTTTGCTTTATCTTCAAGCTACGATCACAGTCCTAAGAAGAAACGCACCAAAACCGTTGCTTCATCC

FIG. 2 continued

```
TCTAGTTCTTCACCAAAATCCGCGTCAAAACCAAAATACACCAAAAAACCAGACCCAAATGCCCCCAAAATCACACGTC
CATGTACTGAATGTGGCAGAAAGTTTTGGTCTTGGAAGGCTCTCTTTGGTCACATGAGATGTCACCCTGAGCGTCAATG
GCGTGGCATTAATCCTCCTCCTAACTACCGTGTGCCCACCGCGGCTTCTTCAAAACAGTTAAACCAGATATTACCAAAT
TGGGTCTCATTTATGTCCGAGGAAGACCATGAAGTCGCTTCTTGTCTCTTAATGCTGTCTAATGGTACACCATCATCAT
CGAGTATTGAACGGTTCGAGTGTGGAGGATGTAagaAAGTGttTggATCACATCAGGCTTTaGgAGGACACAGAGCGAG
TCATAAAAACGTTAAaGgctgttTCGCTATCACaAACGTAACCGATGATCCTATGACGgtttcTaCTTCtagtgggCAT
GATCATCAgggaAAAATCCTt > SEQ ID NO:3299  263005 228721_301036_1
GGCGCGCAAGGTCCGGAGAAGTAGGGAGCTGTGAAAGAAGGCGAGGAAGAAAAAAGAGAATTTTATTTTTTGTTCGTGG
TTGGATCATCTTGCTCTCGAGATATTTGACGTAGAGCAAGCTTTGTCTTTCATTGCTTTGATCGTTGTATAGCTTTTTG
GTTTTGAGAGGAAGAGATGGGAAGGTCAATGGATCCTTTGGTTCTTGGACGAGTGATTGGAGATGTGTTGGATATGTTT
GTCCCGGCTGTGGACATGAGTGTTTGCTACGGAAGCAAGCAAGTCAACAATGGTTGCGAGCTCAAGCCGTCGGCGACTC
AAGCCCGACCAACCGTCCAAGTTGTATCTCCTCACGAAGAAGGCGCTCTCTACACCTTGGTGATGGTCGATCCCGATGC
TCCAAGTCCCAGCGAGCCGTCCATGAGAGAATGGGTGCACTGGATCGTCGCCGATATCCCCTCTGGTGCGGATGCGAGC
CAAGGAAGGGAGATCCTCCAGTACATCGGCCCGAAGCCACCGACTGGAATCCACAGATACGTCTTCGTTCTGTTCCGGC
AAATGGGACCAGTCCTCATGCTCCCGCCGCTGATGAGGAACAACTT > SEQ ID NO:3300  263005 263043_301721_1
gcagcatggagaatatgggaactAGAGTGATAGAGCCATTGATAATGGGGAGAGTGGTAGGAGATGTTCTTGATTTCTT
CACTCCAACAACTAAGATGAATGTTAGTTATAACAAGAAGCAAGTCTCCAATGGCCATGAGCTCTTTCCTTCTTCTGTT
TCCTCCAAGCCTAGGGTTGAGATCCATGGTGGTGATCTCAGATCCTTCTTCACTTTGGTGATGATAGACCCAGATGTTC
CAGGTCCTAGTGACCCCTTTCTAAAAGAACACCTGCACTGGATCGTTACAAACATTCCCGGCACAACAGATGCTACGTT
TGGCAAAGAGGTGGTGAGCTATGAATTGCCAAGGCCAAGCATAGGGATACATAGGTTTGTGTTTGTTCTGTTCAGGCAG
AAGCAAAGACGTGTTATCTTTCCTAATATCCCTTCGAGAGATCACTTCAACACTCGTAAATTTGCGGTCGAGTATGATC
TTGGTCTCCCTGTCGCGGCCGTCTTCTTTAACGCACAAAGAGAAACCGCTGCACGAAACGCTA > SEQ ID NO:3301  263005 249941_301597_1
GGACGTGAACGCGCTGGATCCGCTTGTCTTGGGCGGGATCATCGGCGATGTGGTGGATGATTTCGTGCCATGCTGCGAG
ATGGCTGTCTACTACGGTCAATATCAGGTGGTAAACGGCTGTGACATTGGTCCATCTGCTGCCAGTTCGGCTCCAAACG
TCCAGATTGCCGGCAATTTCGACGATGGCTCTCAATTCACACTGATTATGACTGATCCTGATGCTCCAAGTCCATCCGA
TCCATCACTGCGCGAATATCTTCACTGGCTGGTGATTGATATTCCTGGAGCAACAGACCCA > SEQ ID NO:3302  263006 263149_301722_1
GCAGCATGTCTATGTCGTCTATGTCCTCCCCTTCCTCAGCTGTTTGTTCACCGGACCACTTCTCTCCTTCCGACCATCT
CTGCTATGTCCAATGCAACTTTTGCCAAACCATCCTTGCGGTTAATGTTCCTTACACAAGCTTGTTCAAGACCGTAACT
GTCCGATGTGGTTGCTGTACCAATCTCCTTTCGGTGAACATGAGATCATATGTCCTCCCAGCTTCTAACCAGCTCCAGC
TCCAGCTCGGTCCTCACTCTTACTTCAATCCCCAGGATATTCTGGAGGAGCTGAGAGATGCACCGTCTAACATGAATAT
GATGATGATGAATCAACATCCTACTATGAATGACATACCATCTTTCATGGATCTTCATCAACAACATGAGATTCCTAAA
GCACCACCCGTTAACCGCCCTCCAGAGAAAAGACAGAGAGTCCCATCCGCATATAACCGATTCATCAAGGAGGAGATCC
AACGTATCAAAGCTGGTAATCCTGATATAAGCCACAGAGAAGCCTTTAGTGCTGCTGCCAAGAATTGGGCCCACTTCCC
CCACATACACTTCGGGCTCGTGCCAGACAATCAACCCGTGAAGAAACCAACATGCCCCAaCAGGAGGGAGAGGATAAC
ATGGTGATGAAAGAAGGGTTCTACGCTCCTGCAGCTGCTAACGTTGGTGTGACTCCTTATTAA > SEQ ID NO:3303  263009 263107_301393_1
tcaggcctgttccgatggaggaggcaaattaagatctagatctaacagctgagatctcttctccatcccaccttcgaaa
tCAACGACCGATGACGAATCAGAGTCGCTTTGGGCACCACAAGCCATCTTCGTCGCAACATGCACCACCGGCGATCTAA
ACGCCGATGTCACAGGAGGAGGCTGACCACGACCTACGTTACCGATCCCCATCAGGTCCAAAAAGTAGACAGGACGCGA
CATCGGGATCTGATAACACGAGCCGCCGCCTCCTCCGCCGAGACTAAGCTCGAGCTGCGGGGGAACATTCCCAGCCGTC
GCTGAAGGCACAACTAACGTCGGAGGAGAAGCACAGTCGAGCGTGCTGCTCTGGCTAGGGCTACGCGCGAAACCGGTAG
GGACCTTCTGGTCACTCAGCTCGAGAAAAGTTGGGAAATTGGTCTTAGCCTTAGCACCACGAAAATCACGCGCCGCGT
ATCGTAAGTACGCGCCGCCTCTTCAGCCGTATCGAAAGTGCCAAGCCAGACGCGGGTTTTCTTGCCCGGATCTCGGATC
TCGGCGGCATAACGGCCCCAAGGACGCTTCCTAACGCCTCTGTAACGAATCTCCTtggcattattgtgggtctggttag
tagtagccgggtcgggtttcaagcccatcttggccatgctgc > SEQ ID NO:3304  263009 263392_301724_1
GCAGCATGGCCAAAATGGGCTTGAAACCCGACCCGGCTACTACTAACCAAAGCCACAATAATGCCAAGGA
```

FIG. 2 continued

> SEQ ID NO:3305 263030 263659_301731_1
GCAGCATGATGCATCAGATGTTGAATAAGAAAGATTCAGCTACTCATTCCACTTTGCCATACCTTAATACTAGCATCTC
TTGGGGAGTGGTTCCAAC

> SEQ ID NO:3306 263030 114161_300265_1
CTTGTCTCTCAATCTGACCCTTTTGGCCAATTGAAATCTGCATCTGTGGAACACACTGAGTTGCCAAAGGGGAATGCAA
CTGAGTTCACTATTTTCTCTGTATCTCCTTCAGGTGATTGGAAATCTTCAGGATATGGGCAAAACCAATCAAACATTCA
GGCTGCTGCTACCTCAGTTAATATGGACTATCGAAGTCACTTTGAGCTAGGGTTTAGTCAGTCCCTGATTTCTGCAAAA
TATCCTTACGGAGGACAGCAATCCGTCGGGTTATTTTCAGCTTATGGTCCTCAAATTTCGGGCCGTGTTATGCTGCCAT
TGAATTTGGCCTCTGATGAAGGCCCGATATTCGTAAACGCCAAGCAGTATCATGGGATACTGAGGCGTCGAAAGTCCCG
GGCTAAGGAAATGGAGAAGAAAGCTCTTAAACCACGCAAGCCATACTTGCACCTCTCTCGCCATCTCCATGCAATGCGC
CGACCTAGGGGCTGTGGTGGACGCTTCTTGAACACAAGGAAAATGAATGGAACTATGAAGGGTGGAAAAACCAACGATA
CAGTTAAGACTGGTGATGTTCACAGTTTTTACCCAACTGGATCCCAGAATTCTGAAGTGCTGCAGTCTGATAGTAGCAA
TTT

> SEQ ID NO:3307 263033 119074_300066_1
TCTTTTTATAATTGAAAAATATACTAAGTGACAAGAAAAAGTTCAAAGCTTGCTCTTAGCATTTCTCTTCCTTTTTCAG
CTCTCTTCTCATTCACTTTCTGTACAATTTTTCCCACTGAAAACCAAAAAAAATAGTGAATTTTCAAGAACTTGCAATA
ATGAAGAGATTTCGAAGTTCTGATTCTTTGGGCGTGCCATTGATATCCATGTGTCAAAATACTACAGATGACCACCACC
AATGGAACAGCCAAGTATATTCAAGGGACTTTCAATCCATGTTAGAATTAGGGTTAGAAGATGAACCCTGTGTAGAAGA
ATCCGGCCATGGATCGGAGAAGAAGCGGCGGCTAAGGGTGGATCAAGTGAAGGCTTTAGAGAAGAATTTTGAAGTGGAT
AACAAGCTTGAACCTGATAGGAAAGTGAAGTTGGCTCAAGAACTTGGTTTGCAACCAAGACAAGTGGCTATTTGGTTCC
AGAACCGCCGTGCACGGTGGAAGACAAAGCAATTGGAGAGAGATTACAATGTTCTTAAAGCAAATTTTGATTCTCTCAA
ACATAACTATGAATCTCTCCAACATGACAATGAAGCTCTCTTGAAAGAGATTTGTGAGCTGAAATCAAAGCTAAATGGG
GGAAATAATGAAAG

> SEQ ID NO:3308 263033 14155_300269_1
CCCACGCGTCCGCACATGGGTCTATCGGAGAAGAAGAGAAGATTAAAAGTTGACCAAGTCAAAGCTCTTGAGAAGAATT
TCGAACTTGAGAATAAACTCGAACCTGAGAGGAAAACTAAATTAGCACAAGAGCTTGGACTTCAACCTCGTCAAGTAGC
TGTTTGGTTTCAGAACCGTCGTGCACGGTGGAAAACAAAACAGCTTGAAAAAGATTACGGTGTTCTTAAGGGTCAATAC
GATTCTCTCCGCCACAATTTCGATTCTCTCCGCCGTGACAATGATTCCCTTCTCCAAGAGATTAGTAAAATCAAAGCTA

> SEQ ID NO:3309 263037 263041_301721_1
GCAGCATGTCTGTAGATTTCTCATCTGAGCGTGTTTGCTATGTCCACTGCAGCTTCTGCACCACGATTTTAGCGGTAAG
TGTACCATACGCAAGTTTGTTCACACTTGTGACGGTGAGATGTGGCCATTGTACCAATTTGCTATCCCTCAACATTGGA
GTTTCACTTCATCAAACCTTCAGCTCCTCCCATTCACCAAGATCTTCAGCCTCATAGACAGCACACAACCTCTCTGGTGA
CAAGGAAAGATTGTGCATCGTCTTCTAGGAGCACCAACAATTTATCGGAAAACATTGATCGTGAGGCTCCTAGAATGCC
TCCTATTCGCCCACCGGAGAAAAGACAACGTGTTCCTTCGGCCTACAACAGATTCATCAAGGAGGAAATCCAAAGGATT
AAGGCTTGCAATCCAGAGATTAGCCACCGTGAGGCATTTAGCACTGCTGCTAAAAATTGGGCACATTTTCCTCACATTC
ACTTTGGATTAAAGCTGGATGGCAACAAGAAAGGCAAGCAATTAGACCAGTCAGTTGCAGGCCAAAAGTCTAATGGCTA
TTACTAAAGCCTTTATATATATACACACATATATACACTTATACGTATATATATGTGTATAGATATATATGCGTGTGTA
TGATTTATGTTTATCTTTGTACGTACGCATTAATGAATGTGTAAGCAGAGAGCTGATGATGGAAAGAGATCAGGCGAGG
AAGAAGAAGATCATATAACGTTACATATATATACATGTGTGTATATATGTTCCTTTCTTTTTTCTTGCGTGTGCTTCAT
CTATAACTTCATTTCTAGTTTTATTCTCCTAATAAGTGAAGTCTATAAATTTGAACCTAAAATGTTTAGGAAGAATCTT
CTTTCTGAagattgtaatataactttcaactttactcaa > SEQ ID NO:3310 263037 263041_301750_1
TTATTACTATACATGAAAATTTTGGCCTGCAACTGAATGCTCTAATTGCTTGGGTTGCTTGTTGCCATCCAACTTCAAT
CCAAAGTGAATGTGACGAAAATGTGCCCAATTATAATCAGTAGTGCTAAATGCCTCACGGTGGCTAATCTCTGGATCGC
AAGCCTTAATCCTTAGGATCTCCTCCTTGATGAATCTGTCGTATGCCGAAGGAACACGTAGTCTTTTCTCCGGTGGGCG
AATAAGAGGCATTCTATGAACCTCACGATCAAT > SEQ ID NO:3311 263060 137709_300686_1
AGCCTAAAGCCTTTCCATAGTATTAACCCAAATCGAGCAAATTTTTTCTCATCTTGGTAGCTTTGATTCTTCGTCTTCT
TTGCGGGGATCGATTGATCTTGAGGAGCTTAATATATCGATTGAGATAGCAAATGGGGAGGCAGCCGTGCTGCGACAAG
GTTGGGCTGAAAAAAGGTCCATGGACGGCGGAGGAGGACCAAAAGCTCGTCAGCTTCCTCCTCGGCAACGGCCAATGCT
GCTGGCGTGCCGTCCCCAAGCTCGCCGGGTTGCTCCGGTGTGGGAAGAGCTGGCGGCTCCGGTGGACGAACTACCTCCG
GGCGGACCTGAAGCGTGGTCTCCT

FIG. 2 continued

> SEQ ID NO:3312 263078 190487_300818_1
CCCCCCGCTATTACTACTAGTACAAAACCAACGCGAAGGGCTCGTCGCGCACAACCAACTCGACACCGGGGCGAGGCGA
ACCAACGGGCGGCGTGGGCATGGGGAGGTCGCCATGCTGCGAGAAGGCGCACACGAACAAGGGGGCGTGGACGAAGGAG
GAGGACCAGCGGCTGATCGCCTACATCAAGGGGCACGGCGAGGGTTGCTGGCGGTCGCTGCCCAAGGCGGGGGGGCTCC
TCCGCTGCGGCAAGAGCTGCCGCCTCCGCTGGATGAACTACCTCCGCCCCGACCTCAAGCGCGGGAACTTCACCGACGA
CGACGACGAGCTCATCATCAAGCTCCACGCCCTTCTCGGCAACAAGTGGTCGTTGATTGCGGGGCACCTGCCGGGGAGG
ACGGACAACGAGATCAAGAACTACTGGAACACGCACATCAAGCGCAAGCTCCTGAGCCGGGGCATCGACCCGCAGACGC
ACCGGGCGGTCAGCGCCGGGAGCAGCGCCGCCGCGGCGAGCGGGCTGACCACGAC

> SEQ ID NO:3313 263078 262756_301693_1
GCAGCATGGCGGATCGTGTTAAAGGTCCATGGAGTCAAGAAGAAGATGAGCAGCTACGAAGGATGGTTGAGAAATACGG
ACCGAGGAATTGGTCTGCGATTAGCAAATCGATTCCAGGTCGATCTGGTAAATCGTGTAGATTACGTTGGTGTAATCAG
TTATCTCCGGAGGTTGAGCATCGTCCTTTCTCGCCGGAGGAAGATGAGACTATTGTAACCGCCCATGCTCAGTTTGGTA
ACAAGTGGGCGACGATTGCTCGTCTTCTTAACGGTCGTACGGATAACGCCGTTAAAAATCACTGGAACTCTACGCTTAA
GAGGAAATGCAGCGGAGGTGTGGCGGTTACGACGGTGACGGAGACGGAGGAAGGTCAGGATCGGCCGAAGAAGAGGAGA
TCTGTTAGCTTTGATTCTGCTTTTGCTCCGGTGGATACTGGATTGTACATGAGTCCTGAGAGTCCTAACGGAATCGATG
TTAGTGATTCTAGCACGATTCCGTCACCGTCGTCTCCTGTTGCTCAGCTGTTTAAACCAATGCCGATTTCCGGCGGTTT
TACGGTGGTTCCGCAGCCGTTACCGGTTGAAATGTCTTCGTCTTCGGAGGATCCACCTACTTCGTTGAGTTTGTCACTA
CCTGGAGCTGAGAACACGAGTTCGAGCCATAACAATAACAACAACGCGTTGATGTTTCCGAGATTTGAGAGTCAGATGA
AGATTAATGTAGAGGAGAGAGGAGAAGGACGTAGAGGTGAGTTTATGACGGTGGTGCAGGAGATGATAGAAGCTGAAGT
GAGGAGTTACATGGCGGAAATGCAGAAAACAAGTGGTGGATTCGTCGTCGGAGGTTTATACGAATCCGGCGGCAATGGT
GGTTTTAGGGATTGTGGAGTAATAACACCTAAGGTTGAGTAGTAA

> SEQ ID NO:3314 263127 263513_301730_1
GCAGCATGAACGGAGAAATCTCTCGTCCGCCGGAGCTAATATCGTCCCGGAATCCTTGCAAGAGTTTTGAAAATGCAAT
ACACAAAGCAGTTGAGGCAGAGCTCGCCGAGCTAGCGAAAAGCGACGCGAACGGCGGCGGAAAGAGTAAAGTGAAAGGA
CCTTGGTTGCCGGAGCAAGATGAGGCTCTCACGAGGCTTGTGAAAATGTGTGGGCCGAGGAACTGGAATCTAATCTCCC
GTGGAATCCCAGGTCGCTCTGGTAAATCTTGCCGATTACGTTGGTGTAATCAGCTCGATCCTATCCTCAAACGAAAACC
TTTCTCTGATGAGGAGGAGCATATGATAATGTCTGCACAGGCGGTTCTTGGGAACAAATGGTCTGTGATTGCTAAACTC
TTACCTGGGAGAACAGATAATGCCATTAAGAATCATTGGAACTCTAATCTTAGACGTAAACCAGCAGAACAATGGAAGA
TTCCTCTATTGATGTCTAATACAGAGATAGTATATCAActgtATCCATCAATGGTcagaAGGATATCAAACgcatccCc
CAAAGAACATCTACCTcaaGaAg > SEQ ID NO:3315 263127 316928_301428_1
GCAGCATGGGAAGAACACCTTGTTGTGACAAGATTGGTTTGAAGAAAGGTCCTTGGACGCCTGAAGAAGATGAGGTTCT
TGTTGCGCATATCAAGAAAAATGGACATGGAAGCTGGAGAACACTTCCTAAACTTGCTGGTTTACTTCGCGTGTGGGAAG
AGTTGCAGGCTGAGATGGACAAATATCTGAGACCAGACATAAAGAGAGGTCCTTTCACTGCTGATGAAGAGAAACTTG
TTATCCAGCTTCATGCCATTCTCGGCAACAGGTGGGCTGCTATTGCAGCACAGCTTCCAGGAAGAACAGACAACGAGAT
CAAGAACTTATGGAACACTCATTTGAAGAAACGTCTTTTATCTATGGGTCTTGATCCCAGAACTCATGAGCCATTACCT
TCATATGGGTTAGCTAAACAAGCTCCATCTTCACCAACAACTCGCCACATGGCTCAATGGGAAAGTGCTAGGGTTGAAG
CTGAGGCAAGGCTTTCTAGAGAATCAATGCTCTTTAGCCCTTCTTTTTACTCTGGTGTAGTAAAAACTGAATGTGATCA
CTTCTTACGCATTTGGAATTCCGAGATTGGTGAAGCTTTCAGGAATCTCGCTCCATTAGATGAATCAACTA > SEQ ID NO:3316 263136 263016_301721_1
GCAGCATGGCTACAGCTACGTATCCGCCTCCTCCACCATATTACAGACTCTACAAGGATTACTCAGAAAACCCTAATTC
TGCTCCTGAACCTCCTCCTCCGATTGAAGGCACCTACGTCTGTTTTGGAGGCAACTATACTACTGAAGATGTTCTTCCA
AGCTTAGAAGAACAAGGAGTGCCTCAACTTTATCCCAAAGATTCTAATCTTGATTACAAGAATGAACTCAGGTCACTGA
ATAGAGAACTACAGTTACATATATTGGAGCTTGCTGATGTTCTTGTTGACAGACCTTCTCAATATGCGAAGAGGATTGG
TGAAATTTCTTCTATCTTCAAGAATTTGCATCACCTTCTCAATTCCTTGAGGCCTCACCAAGCGAGAGCAACGCTTATT
CACATTATGGAACTTCAAATTCAACAGAGGAAACAAGCTGTGGAAGACATTAAAAGAAGAAGAGAAGAAGCACAGCGAC
TTCTAAAGGATGCTTACCTCACTTTAGATGGTCAATAGTAA > SEQ ID NO:3317 263146 274042_200147_1
AAACAGCCCCTATTGCTCTCTCCTTTCTCTCACCCAAACACACCACAAACAGTAGAGAGAGAAAAAAGCTGAGTTCTAG
AGAGATAAACTGAGTTCTAGAGAGAGAAAGTGAGTGCTTTCGGAAGGGAAGCTAATCCTCTGGTGCTTCTCGATCTTTG
ATTGCTCTAATCGGTATCAAAGGGGTCGGTCTTTTGTTGTTTCTTTCGACTTGTGGCCATGCGGAGAGGTAGAGCAACC

FIG. 2 continued

```
GCGGCGGCGAAGCAAGCGGCGGAGGTTCCAACCGAGGCTGGATCTGGAGGATTAAAAGAGATTAGGTTTCGTGGTGTCA
GAAAACGGCCGTGGGGAAGATTTGCAGCGGAGATTACAGACCCGTGGAAAAAAACTAGGGTTTGGCTTGGCACTTTTGA
TTCTGCCTAAGAAGCCGCTAAAGCTTATGACGCTGCAGCTCGGACTCTTAGGGGACCTAAAGCCAAAACTAATTTCCCT
TTACCACCGTATTCTCACTTCAATCAAACTGTAAACCCTAACGACCCGTTTATTGACCCGAGGTTATACTCACAGGAAA
GT

> SEQ ID NO:3318 263146 41964_300032_1
CAAAAAGAAAAAAATTTACAAAAACGAAACTGATTTCTGCGTAAAACTTTTCTGCTGAGAGAAAACAAAAAGCATGTGT
GGTGGTGCTATAATCTCCGATTACACTGCCCCGAGCCGGACTTCTCGCCGGCTCACCGCCGAGTTGCTATGGGGCCGAT
CCGATCTGAGCAATAAGCAAAATTTTTTTAACAATTATCACTCCAAGCGGTTGAGATCCCAAGTAGTTGACCTTGACGA
TGACTTCGAGGCTGATTTTCAGGACTTCAAAGATTTCTCCAATGATGAGGATGTTCAAGTCGATGTCAAGCGATTTGCC
CTCTCTGCTTCGAAAAACTCTACTGTTGAAGGCTCCAAATCTATGAAAACGGTTGATTCAGACAAGGATGCTGATAGAT
TCTCTAAGAGAAAGAGGAAGAATCAGTATAGGGGGATCAGACAGCGACCTTGGGGTAAGTGGGCAGCTGAAATACGTGA
CCCAAGAAAAGGAGTTCGGGTCTGGCTGGGAACTTTCAATACTGCAGAAGAAGCTGCCAGAGCTTATGATGTTGAGGCT
AGGAGGATCAGAGGTAATAAAGCTAAGGTAAACTTTCCC

> SEQ ID NO:3319 263146 55847_300130_1
TTCTTCCTAATTACACCATGCCCAACATCACCATGGTTTGAAACCCGACCCGGTTGCTCCAACGAACCCGACTCATCA
TGAGAGTAATGCTGCCAAAGAGATTCGTTACAGAGGCGTTAGGAAACGTCCATGGGGAAGATACGCCGCTGAGATCCGA
GATCCGGTTAAGAAAACTCGAGTCTGGCTCGGTACGTTCGACACCGCTCAGCAGGCGGCGCGTGCTTACGACGCAGCCG
CGCGTGACTTTCGTGGTGTTAAGGCTAAGACCAATTTCGGTGTTATCGTTGGTAGTAGTCCTACTCAGAGTAGCACCGT
CGTCGAC

> SEQ ID NO:3320 263146 202409_300784_1
CCCCCCCCGGCCAAATTCCAACGCACCACCGGGGCGGGAGCAAGCACCCACCATCCACCGGTCGAACAGTTGGCGCTCT
CGCCCGCCTTAGCTCGCTCTGCTCGTGGTGCTCGACCCGAGCAAGAACGGACATGGCTCCCAGGAACGCCGCCGAGGCC
GTCGCCGTCGCCGTGGCGGAGGGCGGAGGAGCCGGCTTGGAGCCCAGGTTCCGCGGCGTGAGGAAGCGCCCGTGGGGCA
GGTACGCGGCGGAGATCCGCGACCCGGCCACGAAGGCGCGGGTGTGGCTCGACACCTTCGACACCGGCGAGGCCGCGGC
GCGCGCCTACGACAGTGCCGGGCTCCACTTCCGCGGGCCCAAGGTCAAGACCAACTTCCCCGTCGCCTTCGCGCACGCC
CACCACCACGCCCCGCC

> SEQ ID NO:3321 263180 263060_301721_1
GCAGCATGGTGCGGACACCGTGTTGCAAAGCTGAACTAGGGTTAAAGAAAGGAGCTTGGACTCCCGAGGAAGATCAGAA
GCTTCTCTCTTACCTTAACCGCCACGGTGAAGGTGGATGGCGAGCTCTCCCCGAAAAAGCTGGACTCAAGAGATGCGGC
AAAAGCTGCAGACTGAGATGGGCCAATTATCTTAGACCTGACATCAAAAGAGGAGAGTTCACTGAAGACGAAGAACGTT
CAATCATCTCTCTTCACGCCCTTCACGGCAACAAATGGTCTGCTATAGCTCGTGGACTACCAGGAAGAACCGATAACGA
GATCAAGAACTACTGGAACACTCATATCAAAAAACGTTTGATCAAGAAAGGTATTGATCCAGTTACACACAAGGGCATA
ACCTCCGGTACCGACAAATCAGAAAACCTCCCGGAGAAACAAAATGTTAATCTGACAACTAGTGACCATGATCTTGATA
ATGACAAGGCGAAGAAGAACAACAAGAATTTTGGATTATCATCGGCTAGTTTCTTGAACAAAGTAGCTAATAGGTTCGG
AAAGAGAATCAATCAGAGTGTTCTGTCTGAGATTATCGGAAGTGGAGGCCCCACTTGCTTCTACTAGTCACACTACTAA
TACTACAACTACAAGTG

> SEQ ID NO:3322 263181 266371_200030_1
CCCTCGACCACGCGTCCGAAAACATTCTTCTTTCGCCATTAAACTCTTCATCTGCCATTACCTCGCCGCGTCTCAAAAC
TTGAACTTTAATCCACACATATAATCTTACTTCAGTTCTAGTAGATCAATAGCTGCAACATTTTTGGTTCTTCTTCCAA
TAGTCAAATATCAGATCTAGCATATATTTTTGTGTTGAACTTGAAGTTATCAGTGATGTCGTTTACGGGGACACAACAG
AAATGCAAGGCATGTGAAAAGACAGTTTACCCAGTTGAGCTTTTGTCAGCAGATGGGATTAGTTATCACAAATCTTGCT
TTAAATGCACCCATTGTAAAGGAACTCTCAAGCTGAGCAGTTACTCCTCAATGGAGGGTGTTCTGTATTGCAAGCCCCA
TTTTGAGCAGCTCTACAAAGAGTCTGGCAACTTCAACAAGAACT

> SEQ ID NO:3323 263181 1007763_301403_1
TCAGGTACGTTTTGGAGAAGTGCAAAGCCTGCGACAAGACAGTCTATTTTGTTGACCAGCTCACTGCCGATGGGATTTT
CTATCACAAGGCTTGTTTCCGCTGCCATCACTGTAACAGGACCTTGCAGCTGAGCGATTATTCTTCCTTTGAGGGAACT
CCCTACTGCAAGCCCCATTTTGAACAACTGTTCAAAT

> SEQ ID NO:3324 263181 11971_300283_1
TGGTATCAACGCAGAGTGGCCATTACGGCCGGGGATAAATGCAAAGCTTGTGATAAGACAGTTTATTTTGTTGATTTAT
TGTCTGCTGATGGAGCTACTTTTCATAAGTCTTGCTTCAAATGTAGCCATTGCAAAGGCACTCTTGTGATGAGCAATTA
TTCCTCAATGGATGGAGTCCTCTACTGCAAGCCACATTTCGAACAACTTTTTAAGGAATCTGGAAATTTTAGCAAAAAC
```

FIG. 2 continued

```
TTTCAGACTGCTTCCAGACCTGAGAGGGAAAATTCGCTGACAAAGGCTCCGACCAAACTCTCAGCCTTGTTCTCTGGAA
CTCAAGACAAATGTGCTGCGTGCAACAAAACTGTTTACCC
```

> SEQ ID NO:3325  263182  109177_300043_1
```
ctctctctaaaattttgcaaagttgtcattttgttaacaagaggtggaagaaaaataagaagaagagataatttcatgg
aTCTGAAAGAAACTGAGCTGTGTTTGGGGTTGCCTGGTGGTGGAGAAAGAGATAAAATCAAAGGGAAAAGAGGGTTTTC
TGAAACTGTTGATTTCAAACTTAATTTTCAAACCAATGATTCTTCTTCTGCTATGGATCTCAAGGAGAAAATCAAGACT
CCTACTACTAAAGAAATTGCTAATTGTAACAAGGATTCAGTCAAGCCACCTGCCAAGGCACAAGTGGTGGGTTGGCCAC
CAGTGAGATCTTTTAGGAAAAATGTAATGGCTCAGAAAAACAACACTGAAGAAACTGAAAAGAGTAATGCAACTGCTGC
TGCATTTGTGAAGGTTTGCATGGATGGTGCTCCTTATCTACGTAAGGTAGATTTGAAGATGTACAAAAGTTACCAGCAA
CTTTCTGATGCTTTGGCCAAGATGTTTAGCTCCTTTACTATGGGAAATTATGGGGCCCAAGGAATGATAGATTTTATGA
ATGAAAGCAAGCTGATGGATCTTCTCAATAGTTCTGAATATGTACCCACCTATGAAGATAAAGATGGAGACTGGATGCT
CGTGGGGGATGTACCTTGGGAGATGTTTGTTGATTCATGCAAGCGTTTACGCATAATGAaagqATCaqAAGCtatTGGA
CTTGCACcaagagcTATgGAGaAATGCAaGCg
```

> SEQ ID NO:3326  263182  145212_301058_1
```
ATTGTACAGTCCTATAGTTGGGCACAAGTTGTGGGTTGGCCACCAGTGAGATCATTCAGAAAGAATGTACTAACCGTCC
AAAAGAACAGCACCGGCAACGGCGAAAGCTCCGGCGGCGGCGCAGCCTTTGTGAAAGTTAGCGTGGACGGAGCTCCATA
CTTACGTAAAGTGGACTTAAAGATGTACAAAAGCTACCAACAACTCTCTGATGCCCTTGGCAAAATGTTCAGCTCTTTC
ACCATTGGAAATTGTGGGACTCATGGATTTAAGGATTTCATGAATGAGAGCAAATTGATAGACCTCTTAAATGGCTCAG
ACTATGTACCTACTTACGAAGACAAGGATGGAGACTGGACTTGTTGGAGATGTACCTTGGGAGATGTTTGTTGATTC
ATGCAAACGCTTGAGGCATAATGAAAGGATCAGAGGCCATTGGACTAGCACCAAGAGCAGTGGAGAAATGCAAGAACAGA
AGCTGAAATTGATGATCCAATTACTTGTTCATTGTATTTTT
```

> SEQ ID NO:3327  263182  157445_301738_1
```
tgtggcaccaagagagctGCTGATCCTATTTCACCTCCCCGTTCTAATGTCAGTCAGGTTGTTGGATGGCCTCCTGTAA
GAACTTATAGGATGAATACCCTAGTTAACCAGACAAAATCACCACCCTCAGAAGAATTTTGCGGGACAATTGAGAAATG
CAGAAGCAAACATATTATCACTAATGCGAGTAGCAGCAAGAGCAACAGTTTTGCCAAGGAGAAAGGGCTGCTCATCAAG
ACTTCCATGTTTGTGGAGGTCAATATGGATGGAGTTGCAATTGGAAGGAAGGTAGATCTGAATGCTCATAGTAGCTATG
AGAACTTGGAACAGACTTTAGATGGGATGTTCTTAAAACCCAGCACAACAGTTTGTGCAAGACCGTCAAATGCACAAGA
GCTAAGTGTCATGTCAGAAACGTCATCTTCAAGATTATTAGATGGATCATCAGAATTTGTGCTGACTTATGAAGACAAA
GAAGGAGACTGGATGCTTGTTGGAGATGTTCCATGGGAGATGTTTATTAGCTCCGTCAAGAGACTACCAATCATGAGGA
CATCTGACGCCAATGGACTTGGTACATCTCCAAGTTTCATGGAAAGAAATGGAAGACAGAGGACTAaGCCaTGATAGgt
CagataaAgaagcccccctTATTGgaaggATGAAGTAcagA
```

> SEQ ID NO:3328  263182  121569_300358_1
```
CCGAGAGATGGATTATCTGATTGCCGCCTGATGGATCTTAAAAATGGAACAGAACTTGTGCTCACTTATGAGGACAAGG
ATGAAGATTGGATGCTTGTTGGTGATGTTCCGTGGCGAATGTTCACAGACAGCTGTAGGAGGCTGAGGATTATGAAGGG
GTCAGATGCAGTGGGCCTTGCTCCAAGAGCCACTGACAAGAGCAAAATCGGAACTGAGCAAAAGATGAACCCAATATG
AATATCCGACCCCTACAATCACATCACTTTTACTTGTAAGGTCCCATTCTCTAAACCACAAGGGTAATGGTCTAAGTTG
CGAGAAGGGGATTACTTATACCTATGTGTCACCCTCTTTTTTTTTGGTTTTATTTGTACCAATTATGTTAGATTTTAA
GCGTAAGTTGTGTAAGTTCCTGTAAGTTGTCTACTTAACCTTGCTTGTAGTTTCTTCTGTAAATTGTTGTGCTGTATGA
TGCAAACTATTTTTGGGATTTTACTTG
```

> SEQ ID NO:3329  263182  137014_300441_1
```
CGGAGGTCAGTGTCGCAGCGACGAACGCCGACGAGCTAGCTCTCTCTCTCGATCGATGGCCATGGCGGCGGAGAGCATC
GACGCGGAGCTGCGCCTCGGGCTGCCCGGCAGCGGCGGCGGTGACGGCGTGGCGGCGAAGAAGCGGCGGTCGGCGTCGT
CGACGGTGAAGAGCGAGGCCTCCGGCACGGCCTGCTGCGGCGGCGCCGGCGCCCGGGACGTCGAAGACGGCGCCTCGCC
GGCGTCCAAAGTGCAGGTGGTGGGGTGGCCGCCGGTGGGGTCGTACAGGAGGAGCACGTTCCAGTCGTCGTCGTCGTCG
ACGGCGGCGGCGGCGAAGGGGAAGGGCGGCGGCGAGACGGATCAAGGGAGGAAGAATAAGGGAGGAGGGCTGTACGTGA
AGGTGAGCATGGACGGGGCGCCATACCTCCGCAAGGTCGACCTCCGGATGTACGCGGCTACAGGGAGCTCAGGGACGC
TCTCGACGCGCTCTTCGGCTGCTTCTCCGCCGACGCCTCCGCCTCCGCCGCCCACTTCGCCGTCGCCTATGAGGACAAG
GACGGCGACCTCATGCTCGCCGGCGACGTGCCCTGGGACATGTTCATCTCTTCTTGCAAGAAGCTGCGGATAATG
```

> SEQ ID NO:3330  263182  260419_301714_1
```
GTTACTACTAATGCTACTGCTGTTAAGAACTGGAGGCCGGCAATTCAAGATCCATCGAGGAATGGTGCCACTGTTGCTA
CTTTCACTCCATTCCAGAGGAGAGGAGATTCGTCACCGATGAATCACTTCTCGTGCTTGAACCAGGGCGAAGAAACTCC
ATCTTCAAGTGGTCCGATGGTTGGGTGGCCACCAGTTCAATCCTTTAGGAAGAACACGTTGGTTGCACCAGCACAAACT
GTAAAGCCGGCCGCGGAGCACACGGCCCCGGATCAAGTCAGTAATGGACAAGCAGCAGCAGCAGCAGTAGCAGCATCAC
```

FIG. 2 continued

```
TGTTCGTCAAGGTGTACATGGACGGCCTACCGATCGGTCGGAAAGTGGATCTGGATTTCAACAACAGCTACGTCAAGCT
CTCCTCGGCTCTCAAGGACATGTTTAGCGGCTTCGTGAGCGGTGCCGGCCAGCCGCTGTCCAAGCAAAAATCGTCTGGA
GATGTGCAGAACCTCTTTGATGGATATGAGACGGAGTACGTCCTGACTTACGAAGACAAGGATGGGGATTTGATGCTCG
TCGGCGATGTTCCGTGGAGGATGTTTGCAGCTACTGTGAAGAGGCTACGGATCATGAAAGGGTCTGATGCGATCGGTCT
TGGCGTTCCAAGGGATGCCGAGGCTATGACGCGATGAAAGAAAA

> SEQ ID NO:3331 263182 50938_300164_1
cacacatctcactgacccctatctctctctcttcaaacggtttagttccccaaaaaaatatcaaaagaactaaaaga
aAAACCCtagaAgCCGaagaATCTCcTACtCgttgtggATCGGATCACCTAACTAATTACTCGTTGATAATCATTATAT
CGAGAAATATGATTAATTTTGAGGCCACGGAGCTGAGATTAGGGCTACCGGGTGGGAATCACGGAGGAGAAATGGCTGG
AAAAAATAATGGTAAAAGAGGATTTTCTGAGACTGTTGATCTCAAACTGAATCTTTCATCGACGGCTATGGATTCAGTT
TCCAAAGTCGATTTAGAGAATATGAAGGAGAAGGTCGTAAAACCACCAGCCAAGGCACAAGTTGTGGGATGGCCACCGG
TACGATCTTTCCGCAAGAACGTCATGTCCGGCCAAAAACCGACCACCGGAGATGCCACCGAAGGAAACGATAAGACTTC
TGGCAGCAGTGGAGCCACCTCATCCGCCTCCGCATGTGCCACCGTGGCTTATGTGAAGGTTAGCATGGACGGTGCACCG
TACCTACGGAAAATTGACTTGAAACTCTACAAAACTTACCAAGATCTCTCCAACGCCTTAAGCAAAATGTTTAGCTCTT
TTACCATAGGCAACTATGGACCACAAGGAATGAAAGATTTCATGAATGAGAGTAAATTGATCGATCTTCTAAACGGATC
AGATTATgttcCaACATATGAagatAAAGATGGCGACTGgATGcTTGtaggagacGtAccGTGGGagaTgtTtGttGAT
TCAtGcaaACGTATAcgaaTAATGAagggatcgga > SEQ ID NO:3332 263182 35645_300081_1
TTTAATAAAAATTTCATCTTCTTTTTTCAAAAAGAGTTTTGCAGACATGCATGAGATAATTATTACAGTATGTTCTAAT
TATCTCCTTAATTAATTAAAATGCTTATAAACACAGATTGCTTATGTAATCTCATCGTCTAGTGTCTTGAAGACATGGG
AATATCAGATCAGATCAAATGTCTCTCTGGACCAAAAAAAAAGTAAAAAACCAATGATTAACTCTTATATATAACAAAA
ACCAGATGTACATTTATAAAGCTTTGAGACTCTCTGTCTGAAATAAAAGTTTCTAAAAAGACTCTTCAGTGCATCATCT
TCTCTTGCTTACTGCATCCAAATGTCAAGGCAGATGAAATCTCAGAGCTTTTAATCACACGCAGTCTCTTCACAGATGA
AACAAACATTTGCCATGGAACATCCCCAACAAGCATCTTGTCCCCTTCATTGTCTTCATAGGTTAAAGTAAATTCTCCT
TTCCCATCTAATAATCCAATGATAGGTTTCTCTTCTCCTTGACCATCAGAGATATCTCTTTGAGCTGCGAGTAGACCTC
TGAAGAGTTTGTCAACGACAAAAGAGAGCTGTTCGTAGCTGTTGTAAGCATTGAGATCAACTTTACGACCAATAGGAAC
ACCATCCATGTTGATCTTGACAAACATTCCTTCCTTCTTGGTTTCAACTTGTTTTTCACCATCATCACTCTTGTTGATT
TGACCTCCATGAGAGGATTCGTTACCTAGCTTTGAAGAGCTTGCGCTCGCTAGATTCTTTCTGAACGAACGAACCGGAG
GCCAACCCACCACTGGAC > SEQ ID NO:3333 263182 3142_300103_-1
GAGACCAATGGCATCCGATCCTTTCATGAGACGTACACTCTTGCATGTATCGACAAACATTGGTCAAGGAACTTCGCCG
ACGATCATCCAATCACCGTCTTTGGCTTCATAAGAGGCAACATAGTCCCACCTATTCACCAAACCCATCATTTTCCTCT
TATTCATGAAGCCTATCATTCCTTCTTCTCCTCCATGTTTGCCCATGGTAAAAAGCTGCCCATGTTGGACAAAGCATT
AGAAAGCTCATCGGAGCTTTTATACATCCTCAAATCGATTTTC > SEQ ID NO:3334 263186 263244_301723_1
GCAGCATGAACCTAGAAGAGAAACCAACCATGACGGCTTCAAGGGCTTCCCCTCAAGCCGAACATCTCTACTACGTCCG
GTGTAGCATCTGCAACACCATCCTCGCGGTTGGGATACCATTGAAGAGAATGCTTGACACGGTAACGGTGAAATGCGGC
CATTGTGGTAACCTCTCGTTTCTCACCACAACTCCTCCTCTTCAAGGCCATGTTAGCCTCACCCTTCAGATGCAGAGCT
TTGGTGGAAGTGACTATAAGAAGGGAAGCTCTTCTTCTTCCTCTTCCTCCACCTCCAGCGACCAGCCCCATCTCCCTC
ACCTCCCTTTGTCGTCAAACCTCCTGAGAAGAAGCAGAGGCTCCCATCTGCATACAACCGCTTCATGAGGGATGAGATC
CAACGCATcgtaagTGccaATCCggagataCcAcaccgTgaaGctatCAGTGCTGCTgcCAAAAATTGGGCTAAGTaca
tacccaactctcctacttccattacttccggagaccacaacatgatccatggcttgggattcggtgagaagaagtga > SEQ ID NO:3335 263187 263534_301385_1
TAAAGGCGACCACTACCATGTTCAAAACTTAGAGGAAGCTGATCAATAGCAAAAGAAGACATCTTACTTTCATCTGCAT
CCATGTTCCATATAGATTCCAAGGAACTTTCCCATGTTGGAGAAGCCAGAGGAGGGAAATTCAAGTAACAGCTTTGCTC
TGAGTAGTAGTTGTCTTTTACCGGTTTAATAACGTTTGCTCCAGACTGATTAATCTCTCTCCATATGTCATCCATGGAG
TAGTACCCGTCTTCGCATTCTTGATTCATTTTCCCGTTGGAGCCTCCAGTGTCTTGACTAGTAGTAGTGGTCATAGATG
ATGAGCAACAGTTCGAAGATGAGGAAGTAGGAGACATAGGTCGCTTCTTCTCTCTTGAGCCTTCTTCCTCATATGAGTCCT
CCAGTAGTTCTCTATCTCATTATCTGTGCTCCCCGGTAATTTCCGGGCAATTTTTGACCACCTGTTTCCCCATTTGGCG
TGAAGCTCAAGGACTAAACGCTCTTCTTGTGGAGTCATCTTACCACGTTTGAGACCAGGATGCAGGTAATTAACCCACC
T
```

FIG. 2 continued

> SEQ ID NO:3336 263191 250655_301650_1
AGATTTTTGCCTTCCACAAAGAAGCTAGACAATTTTGTGGAGGCAAGAGGGGTTTCTTTCTCATATCTTTGAGAGATTT
ACTGTCCAATTCCCTCCTCTTTGTGGAGAGATTTGATGGGAGAGAACTAGACCAGCTTGGGATTCGTATAGAGAGGACA
TATGGGATCTCCAAGATTGAACTTTGGCGATGTGTTTGCTTCTCCAGAATGCAGCAACGCGGATGGATTGGCGGCGGTG
ATCGCATCGTGTTCTCCAATGGCATTCCACCAAGGGATGGACGAAGCACTGAGCGGCTACAAGCGACCACTCTTTCCAA
TTTTCGAGGCATCGGCCGAAGAGACTGGAGACGACGACTTGTGCGACGACTCCACGGCTCAGCACGTCGAGAAGAAGCG
AAGGCTGTCAGTGGAGCAAGTCAAGGCTCTCGAGAAGAACTTCGAGATCGAGAACAAGCTTGAGCCCGACCGCAAGATC
CAGCTCGCCAAAGAGCTTGGACTGCAGCCAAGGCAAGTCGCGGTCTGGTTCCAGAACCGGCGCGCTCGATGGAAGACCA
AGCAGCTGGAGAAAGACTACGATCTCCTCAAGGCCGAGTATGACGATTTGAAGTCGAGCTATGTGGATCTCGCGAAAga
acgggACAAGCTTCAGGcagaggttgctagGCtGAGGCTAtgcATg > SEQ ID NO:3337 263191 263514_301730_1
GCAGCATGATGAAGAGATTAAGTAGTTCAGATTCAGTGGGTGGTCTCATCTCTTTATGTCCTACAACTTCCACAGATGA
GCAGAGTCCGAGGAGATACGGTGGGAGAGAGTTTCAGTCGATGCTTGAAGGATACGAGGAAGAAGAAGAAGCTATAGTA
GAAGAAAGAGGACACGTGGGCTTGTCGGAGAAGAAGAGAAGGTTAAGCATTAACCAAGTTAAAGCTTTGGAGAAGAATT
TTGAGTTAGAGAATAAGCTTGAGCCTGAGAGGAAAGTTAAGTTAGCTCAAGAACTTGGTCTTCAACCTCGTCAAGTTGC
TGTTTGGTTTCAAAACCGTCGTGCTCGGTGGAAGACAAAACAGCTTGAGAAAGATTACGGTGTTCTTAAAACCCAGTAC
GATTCTCTCCGTCATAACTTTGATTCCCTCCGCCGTGACAATGAATCTCTCCTTCAAGAGATTAGTAAACTGAAAACGA
AGCTTAATGGAGGAGGAGGAGAAGAAGAAGAAGAAGAGAACAACGCGGCGGTGACAACGGAGAGTGATATTTCGGTCAA
GGAGGAAGAAGTTTCGTTGCCGGAGAAGATTACAGAGGCACGTCGTCTCCTCCACAGTTTCTTGAACATTCTGATGGT
CTTAATTACCGGAGTTTCACAGATCTACGTGATCTTCTTCCATTAAAGGCGGCGGCTTCTTCATTCGCCGCCGCAGCTG
GATCTTCAGACAGTAGCCATTCAAGCGCTCTGCTGAATGAAGAAAGCAGCTCTAATGTCACTGTGGCGGCTCCGGTGAC
GGTTCCAGGAGGTAATTTCTTCCAGTTTGTGAAAATGGAGCAGACGGAGGATCATGAGGACTTTCTGAGTGgagaagaa
gcttgtgaattcttttccgatgaacaaccgccgtctctacactggtactccaccgttgatcattggaattga > SEQ ID NO:3338 263202 245778_301571_1
GCTGGTTTGGCGACGTCTAGGGTTCTTGGCATCTCGTCCCCGGTTGCCACACACTGCCGCAAAGATGAATCGAGAGAAG
CTCATGAAGATGGCTAGTGCTGTGCGCGACCGGTGGAAAGGGCACAGTGAGGAGGAAGAAAAAGGCTGTACATAAGACAA
CGACTACTGACGATAAGCGTCTCCAAAACACGCTTAAGAGGTTGGGGGTTAACACCATCCCCGGAATCGAGGAGGTTAA
CATTTTCAAGGACGACATTGTTCTCCACTTTGTCAGTCCCAAAGTGCAAGCGTCCATAGCTGCTAACACCTGGGTCGTG
AGTGGACCCGTCCAGACAAAGAAGCTTACGGAATTACTGCCCGGCATCATCGACCAGCTCGGCTTTACGGGGCCGGATA
ACTTGGAGAACCTCAAGAAGATTGCGCAGCAATTCAAGCGGCAAGAGAGCGGCGGTGGGGGCGGTGGCGGCGCAGCTCC
GCTGAGCACAATCGAAGACGACGAGGATGTCCCCGATCTCGTTCCCGGGGAGACTTTCGAGAAGCCCGCCGCTAATCCC
GCCGAGGAGGCCGTGGCCACTGCGTGATTCCGGGCAGAGCATATTCCTGCTGTGTACTTGTAGCCTCCTGGGCATATTC
TCCTTT > SEQ ID NO:3339 263202 57510_300029_1
gccattacggccgggatccttctgctcttcattttggggtgctgactgctgcctAGGGTTTTAGTTCTCTATTCTTCA
CCAAGATGAATGTAGAAAAGCTACGGAAAATGGCCGGTTCGGTCAGGACTGGTGGTAAGGGAACCATGCGAAGAAAGAA
GAAGGCCGTTCACAAGACAACTACAACTGATGACAAGAGACTTCAAAGCACCCTAAAAAGAATAGGGGTGAATGCTATT
CCTGCTATTGAAGAGGTTAACATTTTTAAGGAGGATGTAGTTATCCAATTCATGAACCCCAAAGTTCAAGCCTCTATTG
CTGCAAACACTTGGGTTGTTAGTGGTTCCCCTCAGACCAAGAAGTTGCAGGATATTCTTCCTCAAATTATTCACCAGTT
GGGCCCTGATAATTTGGAGAATTTGAAGAAGCTAGCGGAGCAGTTCCAGAAGCAGGCGCCTACCGGTGCGCCTGAAGGT
GGTGCTGCAGCACAGGAGGACGATGATGATGAGGTGCCGGAACCTGTGGCTGGCCAAACCTTTGAAGCAGCCGCTGCAG
AGGAGGGTCAC > SEQ ID NO:3340 263202 35625_300393_1
CCCACGCGTCCGGGTTTATACACAGATGAATAGGGAGAAGTTGATGAAGATGGCTAATACCGTCCGCACTGGCGGAAAG
GGTACTGTCAGAAGAAAGAAGAAGGCTGTGCACAAGACCAATACAACTGATGACAAGAGGCTTCAAAGCACTCTTAAGA
GAATTGGAGTTAACTCCATTCCCGCTATTGAAGAAGTTAACATCTTTAAGGATGATGTTGTTATTCAGTTCATCAACCC
TAAGGTTCAAGCTTCAATTGCTGCAAACACATGGGTTGTTAGCGGTTCTCCTCAGACCAAAAAATTGCAAGATATCCTT
CCTCAGATCATCAGCCAACTTGGACCAGACAACATGATGAACCTGAAGAAGCTAGCAGAACAGTTCCAGAAACAGGCTT
CTGGTGAAGGTAATGCCGCCTCAGCAACCATACAAGAAGAGGATGATGACGATGTCCCAGAGCTTGTTGGAGAGACATT
CGAAACTGCTGCTGAAGAGAAAGCACCCAGCTGCTGCTGCTTCTTCTTAGAGAGAAAAGAGCGAGACCACATCCAAAAAA
AAACCGCACTTTGATTTTTACATATCTTTATAATATGTTTGTTCGCTCGATCCTTTTTGTAGTTTCCGACCAGAATCTT
GTTTTCCATCTAATGACTTAAGGTTTTTATCCAATT

FIG. 2 continued

> SEQ ID NO:3341 263202 180887_300625_1
GAATTCAGGAAGCGTTAGAAGAAAGAAGAAGGCTGTACACAGGACCACGACCACAGATGATAAAAGGCTTCAAAGCACT
CTTAAAAGAATAGGTGTTAATGCCATTCCAGCCATTGAGGAGGTCAATATTTTCAAGGACGATGTAGTCATCCAGTGCC
AAAACCCTAAAGTTCAAGCTTCAATCGCTGCCAACACATGGGTTGTTAGTGGTTCTCCTCAAACAAAGAAATTGCAAGA
TCTTTTACCAGGAATTATTAACCAATTGGGACCTGATAACTTGGACAACTTAAGGAAGCTTGCAGAACAATTCCAGAAG
CAGATGCCTGGTGGTGCAGGTACCATTCCAGGAACAATCCCTGAGGAGGATGACGACGATATGCCAGAGCTTGTGGCCG
GAGAGACATTCGAGGCCGCAGCCGACGAGGAAAAAGCAGCTTCCTAGATATTGTAAGGGAGAGCTAAAATACTATATCC
CTACAATTTCTGTTTTTGACATTATCTATTGTCTTGAAATTTTTAGTGTTCTCAACTGCCTGGTTTTTTTTTCTTATTA
GGCCCTTCTCTCCTTTCTCTTGGGTAGCAATCAAACATGTTCATGG

> SEQ ID NO:3342 263216 263278_301723_1
GCAGCATGGGAAGAGGGAGAGTAGAATTGAAGAGGATAGAGAACAAGATCAATAGGCAAGTGACGTTTGCAAAGAGAAG
GAATGGTCTTTTGAAGAAAGCATACGAGCTTTCAGTTCTATGTGATGCAGAAGTTGCTCTCATCATCTTCTCAAATAGA
GGAAAGCTGTACGAGTTTTGCAGTAGTTCGAGCATGCTTCGGACACTGGAGAGGTACCAAAAGTGTAACTATGGAGCAC
CAGAACCCAATGTGCCTTCAAGAGAGGCCTTAGCAGTTGAACTTAGTAGCCAGCAGGAGTATCTCAAGCTTAAGGAGCG
TTATGACGCCTTACAGAGAACCCAAAGGAATCTGTTGGGAGAAGATCTTGGACCTCTAAGTACAAAGGAGCTTGAGTCA
CTTGAGAGACAGCTTGATTCTTCCTTGAAGCAGATCAGAGCTCTCAGGACACAGTTTATGCTTGACCAGCTCAACGATC
TTCAGAGTAAGGAACGCATGCTGACTGAGACAAATAAAACTCTAAGACTAAGGTTAGCTGATGGGTATCAGATGCCACT
CCAGCTGAACCCTAACCAAGAAGAGGTTGATCACTACGGTCGTCATCATCATCAACAACAACAACACTCCCAAGCTTTC
TTcCAGCCTTTGGAATGTGAACCCATtctTCAGATCGGGTATCAGGGGCaacaagatggaatgggagcaggaccaagtg
tgaataattacatgttgggttggttaccttatgacaccaactctatttga > SEQ ID NO:3343 263216 317040_301429_1
GCAGCATGGGAAGAGGGAGAGTGGAGATGAAGAGGATAGAGAACAAGATTAATAGACAAGTGACCTTCTCAAAAAGAAG
AAACGGTTTGCTGAAGAAAGCTTATGAGCTTTCTGTTCTTTGCGATGCCGAAGTTGCTCTCATCATCTTCTCAAGCCGT
GGCAAGCTCTACGAGTTTGGTAGTGTTGGAATTGAAAGCACAATCGAACGGTATAATCGTTGTTACAACTGCTCTCTAA
GCAATAATAAGCCTGAAGAGACTACACAGAGTTGGTGTCAGGAGGTGACAAAGCTTAAATCCAAATACGAATCTCTTGT
TCGTACTAACAGGAATTTGCtTGGAGaAGATCTTGGAGaAATGGGtGTgaaggaactgcaagCGctcgagaagcagctc
gaagccgCTCTTAccgcgactcgACAGCgcaAGAcacAaGTTATGATGgAaGaAATGgaagacCTtaggAAAAAggAGA
Gg > SEQ ID NO:3344 263216 317069_301429_1
GCAGCATGGGAAGAGGAAGAGTAGAGCTGAAGAGGATAGAGAACAAAATCAACAGACAAGTAACGTTTGCAAAGCGTAG
GAACGGTTTGTTGAAGAAAGCTTATGAATTGTCTGTTCTCTGTGATGCTGAAGTTGCTCTCATCATCTTCTCCAACCGT
GGAAAGCTCTATGAGTTTTGCAGCTCCTCAAACATGCTCAAGACACTTGATCGGTACCAGAAATGCAGCTATGGATCCA
TTGAAGTCAACAACAAACCTGCCAAAGAACTTGCAAGAGCTACAGAGAATATCTGAAGCTTAAGGGTAGATATGAGAA
CCTTCAACGTCAACAGAGAAATCTTCTTGGGGAGGATTTAGGACCTTTGAATTCAAAGGAGTTAGAGCAGCTTGAGCGT
CAACTGGACGGCTCTCTCAAGCAAGTTCGGTCCATCAAGACACAGTACATGCTTGACCAGCTCTCGGATCTTCAAAATA
AACAGCAAATGTTGCTTGAAACCAATAGAGCTTTGGCAATGAAGCTGGATGATATGATTGGTGTGAGAAGTCATCATAT
GGGAGGAGGAGGAGGATGGGAAGGTGGTGAACAGAATGTTACCTACGCGCATCATCAAGCTCAGTCTCAGGGACTATAC
CAGCCTCTTGAATGCAATCCAACTCTGCAAATGGGGTATGATAATCCGGTATGCTCAGAGCAAATAACTGCGACAACCC
AAGCTCAGGCGCAGCAGGGAAACGGTTACATTCCAGGATGGatgctctga > SEQ ID NO:3345 263216 263306_301724_1
GCAGCATGGGAAGAGGAAGAGTaGAGCTCAAGAGGATAGAGAACAAAATCAACAGACAAGTGACGTTTGCTAAACGTAG
aAATGGTTTGCTGAAAAAGCTTATGAGCTTTCTGTTCTCTGCGATGCTGAAGTCTCTCTCATCGTCTTCTCCAACCGT
GGCAAGCTCTACGAGTTCTGCAGCACCTCCAACATGCTCAAGACACTGGAAAGGTATCAGAAGTGTAGCTATGGCTCCA
TTGAAGTCAACAACAAACCTGCTAAAGAGCTTGAGAACAGCTACAGAGAGTACTTGAAGCTGAAAGGTagaTATGAAAA
TCTGCAACGTCAGCAGAGAAATCTTCTTGGAGAGGATCTTGGACCTCTGAATTCAAAGGAGCTAGAGCAGCTTGAGCGT
CAACTAGACGGCTCTCTGAAGCAAGTTCGCTGCATCAAGACACAGTATATGCTTGACCAGCTCTCTGATCTTCAAGGTA
AGGAGCATATCTTGCTTGATGCCAACAGAGCTTTGTCAATGAAGCTGGAAGATATGATCGGCGTGAGACATCACCATAT
AGGAGGAGGATGGGAAGGTGGTGATCAaCAGAATATTGCCTATGGACATCCTCAGGCTCATTCTCAGGGACTATACCAA
TCTCTTGAATGTGATCCCACTTTGCAAATTGGATATAGCCATCCAGtgtgctcagagcaaatggctgtgacggtgcaag
gtcagtcccaacaaggaaacggctacatccctggctggatgctgtga

FIG. 2 continued

> SEQ ID NO:3346 263221 263362_301724_1
GCAGCATGACTGATCAAGGATTGGAAGGGAGTAATCCAGTTGATCTTAGCAAGCATCCTTCAGGGATTGTTCCTACTCT
TCAAAACATTGTCTCCACGGTGAACTTAGACTGCAAGCTAGATCTTAAAGCCATAGCTTTGCAGGCTCGGAATGCTGAA
TATAATCCCAAGCGTTTTGCTGCGGTGATAATGAGGATCAGAGAACCGAAGACTACAGCATTAATATTCGCCTCAGGGA
AAATGGTCTGTACTGGAGCTAAGAGCGAGGACTTTTCGAAGATGGCTGCTAGAAAGTATGCTAGGATTGTGCAGAAATT
GGGATTCCCTGCAAAATTCAAGGATTTCAAGATTCAGAATATTGTAGGTTCTTGTGATGTCAAATTCCCTATAAGACTT
GAAGGTCTTGCTTACTCTCACGCTGCTTTCTCAAGTTATGAGCCCGAGCTCTTCcCAgggCTGAtTTATaggaTGAAAG
TCCCAAAAATCGTCCTTCTAATCTTTgTCTCTGGGAaGATCGTAATAACAGGAGCcaaGAtgagAGAtgagacctACAA
AGCCTT > SEQ ID NO:3347 263246 263173_301722_1
gcagcacGAGGAAGCCAGAGGTAGCCATTGCAGCTAGTACTCACCAAGTAAAGAAGATGAAGAAGGGACTTTGGTCTCC
TGAGGAAGACTCAAAGCTGATGCAATACATGTTAAGCAATGGACAAGGATGTTGGAGTGATGTTGCGaAAAACGCAGGA
CTTCAAAGATGTGGCAAAAGCTGCCGTCTTCGTTGGATCAACTATCTTCGTCCTGACCTCAAGCGTGGCGCTTTCTCTC
CTCAAGAAGAGGATCTCATCATTCGCTTTCATTCCATCCTCGGCAaCAGGTGGTCTCAgattgcAGcacgattgCCTga
TCGGaCcgataacgagaTccagaAtgtCTGGAAcT > SEQ ID NO:3348 263246 263247_301723_1
GCAGCATGAACAAAGGAGCTTGGACTAAAGAAGAAGATCAGCTTCTTGTTGATTACATCCGTAAACACGGTGAAGGTTG
CTGGCGATCTCTCCCTCGCGCCGCTGGATTACAAAGATGTGGTAAGAGTTGTAGATTGAGATGGATGAATTATCTAAGA
CCAGATCTCAAAAGAGGCAATTTTACTGAAGAAGAAGATGAACTCATCATCAAGCTCCATAGCTTGCTCGGTAACAAAT
GGTCTTTAATAGCTGGGAGATTACCAGGAAGAACAGATAACGAGATCAAGAACTATTGGAACACTCATATCAAGAGGAA
GCTTCTCAGCCGTGGGATTGATCCAAACTCTCACCGTCTGATCAACGAATCCGTCGTGTCTCCGTCGTCTCTTCAAAAC
GATGTCGTTGAGACTATACATCTTGATTTCTCTGGACCGGTTAAACCGGAACCGGTGCGT > SEQ ID NO:3349 263246 1119384_301896_1
ACCTTATTCTTTGTTCTTAAAACCTTATCTCTTTGCTCTGCAGTTCTATAGTTCTACTGTTAATCTGTTCTAAAGCAGG
GTTCAGGAAATAGCACAGGTATTAATTACTGAAGCTGTTATATTGTCTGTGATTAGTGCATATAGCTAGGGAAGGCAAG
GAAATAATGAAATTAGGACCTTGGACTCCTGAAGAGGATATGGCCTTGCAGCGGCTTGTTGCGAAGCATGGCCCCCGCA
ATTGGTCGCTCATTAGTAAAGGAGTCCCTGTGCGCTCTGGTAAGTCCTCGTCGCTTGCGGTGGTGTAACCAGTTGAGCCC
GGAGGTTCAGCACCGCCCTTTTAGCCCCGAGGAGGACGCTGTCATACTGGAGTCGCACCGGAGGCATGGCAATAAGTGG
GCCACCATCGCCCGCCTTCTTCCCGGCAGGACCGACAATGCCATCAAGAACCACTGGAACTCCGCCTTGCGCAAGCATG
GCGAAGCCTGCCTTGCTGGTGCCGGCGGCGCGGTGTCCCCCTTGTCCAGCTCGGACGGGCGGAAGCGCAGCTGTAGCAG
CATTAGCAACGAGGAGGCATCGTCATCATGGGTCAAAGAAAGTCTTGAAATAGACGAAGGAGAAG > SEQ ID NO:3350 263262 105083_300046_1
CAACTGTTCTCCGCCACAAAATCAAGAAAGACAGTGGCGGGGACTCAAAAAAACCACTAGTTTTCTGCTACCTCTAAAAA
CTTGACAATGGCATTTGCAGGAACAACACAGAAATGTATGGCATGAAAAGACAGTGTATCTAGTTGATAAATTAACTGC
AGACAATAGAGTCTATCATAAAGCTTGTTTCAGATGCCATCATTGCAAGGGTACTCTCAAGCTTAGCAACTACAATTCA
TTTGAGGGAGTTCTCTATTGTAGACCTCACTTTGATCAGCTCTTTAAAAGAACTGGAAGTCTGGACAAAAGCTTTGAAG
GGACACCCAAAATTGTGAAGCCAGAGAAAGATGAGAAACCACATGCTGCTAAAGTCTCAAGCATGTTTGTTGGAACAAG
GGAGAAATGTTTTGGCTGCAAGAATACTGTCTATCCAACAGAAAAGGTATCAGTGAATGGAACACCATATCACAAAAGC
TGCTTCAAATGTAGCCATGGTGGATGCACAATTAGCCCATCCAACTATATTGCGCACGAGGGGCGCCTTTACTGCAAAC
ATCACCATATTCAACTAATCAAGGAGAAAGGAAACTTAAGCCAGCTCGAGGGTGATCATGACAAGAATACAGTTAGAAC > SEQ ID NO:3351 263262 258305_301691_1
GCAAGGCGAAGGCGATCGATTCGATCGATCGATCTGTCGAGGCAGGGGCCCGGCAGCAGCTGTTCTACGATGTCGTCCT
TCTCTTTCGCCGGCACGCAGCAAAAATGTAAGGCATGCGACAAGACTGTCTACTTGGTAGACCAGCTCACTGCCGATGG
TGTCGTCTATCACAAAGCGTGCTTTCGATGCCATCACTGCAAAGGGACACTAAAGCTTAGCAATTATGCTTCGCTGGAA
GGGGTCTTGTATTGCAAGCCCCATTTCGATCAGCTCTTCAAGCTTACTGGAAGTTTCGATAAGAGCTTTGAGACAGGAC
TATTGCACAGACAACCTAGCGAAGAAGCGAGTAAGACGCCATCGAAGACATCGCTCTTGTTCTCTGGGACTCAAGAAAA
ATGTGTTGCTTGTGGGAAAACTGTGTACCCCATAGAAAAGGTGACTGTCGAGGGTACACCGTATCACAAATCTTGTTTC
AAGTGTTCTCACGGCGGCTGTACGATATCGCCATCGAATTATCAAGCTCACGAAGGCCAGCTCTACTGCAGACATCACT
ACACTCAGCTCGTCAAGGAGAAAGGAGACTTCAGCAATCTGTCCAAGCACCGGGGAAGGCAGCAGCGAAATagaAAtT
gGATTTTGGGTGTAAGGGAGTCTACTACGATCTTCAAAGGTTTGGTGAtgagaaaacgtTGCCtGaggtgaAtGgagga
tttga

FIG. 2 continued

> SEQ ID NO:3352 263262 271066_200130_1
TCATCCTTATCTTAACACCATTCTCTCTTAGCGTCTTTTCTCCAAAAACCAAAAACCAAGTGCTCTCTGCTGCAGAAAAT
CAACAAAAGGAAGGGGAAGATCCACAAAAGACCATTTTTGTTTTCTGTAAAACTTGCTCATATTAGCCATGGCATTTGC
AGGAACCACACAGAAATGCATGGCATGTGACAAAACTGTTTATCTGGTTGACAAATTAACTGCAGATAATAGAATCTAT
CACAAAGCTTGTTTCAGATGCCATCACTGCAAGGGCACTCTCAATCTTGGCAACTACAATTCCTTTGAGGGAGTTCTAT
ACTGTAGACCACACTTTGATCAGCTCTTCAAACAAACTGGCAGTTTGGATAAAAGCTTTGAAGGTACACCAAAAATTGT
GAAACCACAGAAACCCATTGACAGTGAGAAACCACAGGTAGCTAAAGTGACAAGCATGTTTGGTGGAACAAGAGAGAAA
TGTTTTGGCTGCAAGAAAACTGTCTACCCAACAGAAAAGGTATCAGATTAATGGTACGCCATACCACAAGAGCTGCTTC
AAATGTAGCCACGGAGGCTGTGTAATCAGCCCTTCCAACTATATCGCACATGAGGGGCGCCTCTACTGTAAACATCACC
ATATTCAACTTATCAAGGAGAAAGGCAACTTGAGCAAGCT

> SEQ ID NO:3353 263262 263266_301723_1
GCAGCATGGCGTTCGCAGGAACAACCCAGAAATGCATGGCATGTGACAAAACAGTTTATCTTGTCGACAAGTTAACCGC
CGATAACCGGGTCTACCACAAAGCTTGTTTCCGATGTCACCATTGCAAAGGAACTCTCAAGCTTAGCAATTACAACTCC
TTTGAAGGAGTTCTCTACTGCAGACCACATTTCGATCAAAACTTCAAGAGAACTGGAAGTCTTGAGAAAAGCTTCGAAG
GGACACCAAAGATTGGGAAACCTGATAGGCCTTTGGAGGGAGAGAGACCTGCTGGAACCAAAGTTTCGAATATGTTTGG
TGGAACACGAGAGAAATGCGTTGGTTGCGACAAAACCGTGTATCCAATTGAgaAGGTATCGGTGAATGGAACATTGTAC
CACAAGAGCTGCTTCAAGTGTACACATGGAGGCTGCACGATAAGCCCTTCGAATTACATAGCTCACGAGGGTAAGCTAT
ATTGCaAGCATCATCATattcagcTGATCaaggagaAaGgaaaCtTg > SEQ ID NO:3354 263262 7819_300306_1
TTATCTTGTCGACAAGTTAACCGCCGATAACCGGGTCTACCACAAAGCTTGTTTCCGATGTCACCATTGCAAAGGAACT
CTCAAGCTTAGCAATTACAACTCCTTTGAAGGAGTTCTCTACTGCAGACCACATTTCGATCAAAACTTCAAGAGAACTG
GAAGTCTTGAGAAAAGCTTCGAAGGGACACCAAAGATTGGGAAACCTGATAGGCCTTTGGAGGGAGAGAGACCTGCTGG
AACCAAAGTTTCGAATATGTTTGGTGGAACACGAGAGAAATGCGTTGGTTGCGACAAAACCGTGTATCCAATTGAGAAG
GTATCGGTGAATGGAACATTGTACCACAAG > SEQ ID NO:3355 263263 262663_301749_1
TTATCATCCATCGGCAGTGAAATCAAAAGGGCTCCAACTTCCAAACAAGAGATTGGTGGAATCATTGGATTCGTCAGCG
AAATGAACCACCGGTTCGTGTACAGCCTGAACCGGAGTCACGCCAACGTCTACATGGTTATGACCAATCAACAAAGCAT
CAGACCAAACACCATTAGTGTCTAAAGAGAGAAGCTCTTCACCAGGAAATGGAGGCAAGCCATTATAACCACATTCCTC
CACAATGTGTTCCACCGGATTAATATAATGATCATGATGACCATCATTGATGTCCATACTCCATGAAGGGTCCATGGAA
GTGCCGGTAGGATTATCTACCAAAAAATCCGTAGTGGCTAAGTCGCAATTTTCTTGTAGTATAGATTCGTCAGGCTTTG
GATTCAAGAAATTGGCGTAAACAAGAGCAAGATCGATGCTTGGTGAACCACCACCGGGGTTGCCAGAATTAGCGGTTAG
GCTAGTTTTAGTATTGTTACCAGAAGATGATTTGGGGCGGCGGGATTTTCGACAGCCACCGCCTACAGGAACATTGCGG
AGGGAACCACCTTTGGTCCAATATCTGCGGCAGCCTTTGCAGAAGTAGCGAGGCTGAGTGAGGCTATAGTTGTTGTAGT
AACAGAACTTTGTGTTAGAGGATCCACATCTTGGACAACTCGGCGTGATCTCCGCG > SEQ ID NO:3356 263276 263228_301723_1
GCAGCATGGGGAAAGGGAACATAGTTATACGAAGGATCGATAAATCTACAAATATACAAATGACTTTCTCCAAAAAAAG
GACTGGAATGCTTAAAAAAACTAAAAAATCATCGATCCTTAGATATGCAAAATTTGGTGTTATCATATGCTCT > SEQ ID NO:3357 263276 6676_300347_1
TCCCGGGTCGACCCACGCGTCCGAACAAGATCAATAGACAAGTGACATTCTCGAAAAGAAGAGCTGGTCTTTTGAAGAA
AGCTCATGAGATCTCTGTTCTCTGTGATGCTGAAGTTGCTCTTGTTGTCTTCTCCCATAAGGGGAAACTCTTCGAATAC
TCCACTGATTCTTGTATGGAGAAGATACTTGAACGCTATGAGAGGTACTCTTACGCCGAAAGACAGCTTATTGCACCTG
AGTCCGACGTCAATACAAACTGGTCGATGGAGTATAACAGGCTTAAGGCTAAGATTGAGCTTTTGGAGAGAAACCAGAG
GCATTATCTTGGGGAAGACTTGCAAGCAATGAGCCCTAAAGAGCTTCAGAATCTGGAGCAGCAGCTTGACACTGCTCTT
AAGCACATCCGCACTAGAAAAAACCAACTTATGTACGAGTCCATCAATGAGCTCCAAAAAAAGGA > SEQ ID NO:3358 263276 263350_301724_1
GCAGCATGGGGAGAGGGAAGATAGTTATACGAAGGATCGATAACTCTACAAGTAGACAAGTGACTTTCTCCAAGAGAAG
GAGTGGTTTGCTTAAGAAAGCTAAAGAGTTATCGATCCTTTGTGATGCAGAAGTTGGTGTTATCATATTCTCTAGCACC
GGAAAGCTCTACGACTACGCAAGCAATTCAAGTATGAAAACAATCATTGAGCGGTACAACAGAGTAAAAGAGGAGCAGC
ATCAACTTCTGAATCATGCCTCAGAGATAAAGTTTTGGCAAAGAGAGGTTGCAAGTTTGCAGCAGCAGCTCCAATATCT
ACAAGAATGCCACAGGAAACTAGTGGGAGAGGAACTTTCTGGAATGAATGCTAACGACCTACAAAACCTTGAAGACCAG
CTAGTAACAAGTCTAAAAGGTGTTCGTCTCACAAAGGATCAACTTATGACAAATGAAATCAGAGAACTTAATCGTAAGG
GACAAATCATCCAAAAAGAGAATCACG

FIG. 2 continued

> SEQ ID NO:3359 263276 1007782_301403_1
GGAGGTGAGAGTAGTACTGCATTTGCATTAAGATGGAAGAAGAGTGGAATAAGAAGAAGAAGAAGAGAGGGAAGATGGA
GATAAGGAGGATTGAGGAGAAAACGAGTCGGCAAGTGACGTTCAGCAAGAGGCGAAATGGGCTGCTCAAGAAGGCGTTC
GAGCTTTCGGTTCTTTGCGATGCTCAAATCGCCCTTCTCATTTTCTCGCCCACTGGAAAACTCTATGAATTCGCTTCCC
CCAGTATCACTGAGACAATGGATCGTTATAAAACATGTACAACAAGTCATAGCAACGATGGGGCAATAAGGCATCCCCA
ATATTGGATGCATGAAACAGAAAAACTTAAGGAACAACTTTCCTACCTACAAAATTGGCAGAGTCAACTTTTGGGTGAA
AATTTGAACGACCTAAATATGATGGATTTACAAACCTTGAGCAACAGCTAGATCACGGATTAAAAGATGTCAGATACA
AAAAGGTGAATATTCTACTTCAACAAAATCAAGATCTCAAGAGAAAGATTACAGAGCTAGAGAGCGAGGTTACCGGCCA
AGGGGCCAAGGCCGCTAGGAATGATGGGAATATATATGTCGATATGCGTAGGACTTAGTTGTTCCTTTTTTTATATTAA
ACTTGA

> SEQ ID NO:3360 263276 104804_300366_1
TCTTAATAATTGGAATTTGTGAGAGTTTTCCGAAAGGTTTTGAAGTCGCCGGAAAATAGCAATATTTTCCATTGAAGCC
AATCAGATGGGTCGAGGAAAGATAGAGATAAAGAGGATAGAGAACAACACAAACAGGCAGGTGACATTTTGCAAGAGAA
GAAATGGACTCCTCAAAAAGGCCTATGAACTTTCAGTACTATGTGAAGCTGAGATTGCTCTTATTGTTTTCTCCAGCCG
TGGCCGCGTCTATGAGTACTCTAATAACAACATTAAGGCAACTATTGATCGGTACAAGAAGGCTACTTCAGAAACCTCT
AACGCTTGCACCACTCAAGAGCTCAATGCTCAGTTTTACCAACAGGAATCGAAAAAGCTGCGCCAACAGATACAGATGA
TCCAGAATTCAAACAGGCATTTGGTTGGTGAAGGCTTAAGCTCTTTGAACGTAAGGGAGCTGAAGCAGTTGGAGAATAG
ACTTGAACGAGGCATTACTAGAATTAGGTCAAAAAAGCATGAGATGATACTAGCAGAAACTGAGAATTTGCAGAAGAGG
GAAATTCAACTTGAACAAGAAAATGCATTCCTCAGATCAAAGATAGCTGAAAATG

> SEQ ID NO:3361 263276 134801_300419_1
CATCGATCCATCAGTAGCTAGCTGGCGTAGCTAGCTAGCTAGCTGCATTGTCCGGCGAGAGAGATAACTGCTGCAGGGG
GCGGCCATGGGGAGGGGCAAGATCGAGATCAAGCGGATCGAGAACGCGACCAACAGGCAGGTGACCTACTCGAAGCGCC
GCACGGGGATCATGAAGAAGGCCAGGGAGCTCACCGTGCTCTGCGACGCCCAGGTCGCCATCATCATGTTCTCCTCCAC
CGGCAAGTACCACGAGTTCTGTAGCCCTTCCACCGACATCAAGGGGATCTTTGACCGCTACC

> SEQ ID NO:3362 263320 263368_301724_1
gcagcatgtcttGTAATAATGGAATGTCTTTTTTTCCCTTCAAATTTCATGATCCAAACCTCTTACGAAGATGATCATCC
TCATCAATCTCCATCTCTTGCTCCTCTTCTTCCTTCTTGCTCTCTACCTCAAGATCTCCATGGATTTGCTTCGTTTCTA
GGTAAGAGATCTCCAATGGAAGGGTGTTGTGATTTAGaaacAgGGGAACAATATGAATGgAgaagaGGATTATTCagatg
ATGGGtcaCAAATGGGAgagaagaagaGgagattgaACATGGAACAagtgaagacactaaagaataacTTTGagcTtgg
aaAcaaACTtgaACcagaGaGgaaAa > SEQ ID NO:3363 263327 263207_301393_1
ttcttgtcATTAATTAACtGCAGCATGCAGGATCTGACGTCAGCAGCAGCGTATTATCATCAGTCGATGATGATGACGA
CGGCGAAACAGAACCAACCAGAGTTACCAGAACAAGAACAGCTAAAGTGTCCTCGCTGTGACTCACCTAACACTAAATT
CTGTTACTACAACAATTACAATCTGTCACAGCCCCGTCACTTTTGCAAAAACTGTCGTCGTTACTGGACTAAAGGCGGT
GCTCTTCGTAACATCCCCGTCGGTGGTGGAACTCGGAAAAGCAACAAACGATCCGGTTCTTCTCCGTCTAGTAATCTCA
AGAACCAAACCGTCGCTGAGAAACCTGATCATCATGGGTCCGGGTCAGAAGAAAAAGAAGAGAGAGTTTCGGGTCAAGA
AATGAATCCGACCCGGATGTTATACGGGTTACCAGTTGGAGATCCGAATGGTGCGAGTTTTAGTTCGTTGTTGGCGTCG
AATATGCAGATGGGTGGGCTTGTTTACGAGTCCGGGTCGCGTTGGTTACCAGGTATGGATTTGGGTTTGGGTTCGGTAC
GGAGGAGTGATGACACGTGGACTGACTTAGCTATGAACAGAATGGAGAAGAATTGA > SEQ ID NO:3364 263327 263279_301723_1
gcagcatgtctttacaggaactcaacagaaatgcaaggcttgtgagaagactgtttatgctgttgagCTTCTCTCTGC
TGATGGAGTTGGATATCACAAGTCTTGCTTCAAATGCACTCACTGCAAAAGCAGGCTTCAGCTGAGTAGTTACTCATCA
ATGGAAGGTGTTTTGTACTGTAAGCCTCATTTTGAGCAGCTCTTTAAGGAGAGTGGTAGTTTCAACAAGAACTTTCAGT
CACCTGCAAAATCGGCTGACAAATCAACTCCTGAGCTGCAACAAGGACGCCTAGCCGAGTTGCTGGCAGGTTCTCTGGTAC
ACAAGAGAAATGCGCCACTTGTAGTAAAACTGTGTATCCTATTGAAAAGGTAACAGTCGAGAGCCAGACATATCACAAG
TCCTGCTTCAAGTGCTCACATGGAGGTTGCCCAATTTCACCTTCCAACTACGCAGCTCTTGAAGGAATCCTGTACTGCA
AGCACCATTTCGCTCAGCTCTTCAAGGAGAAGGGAAGTTACAACCACTTAATCAAATCCGCTTCCATCAAACGCTCTGC
AGCCGCAGCAGTCGCCGCCGGTGTACCAGCAGCCTCCGTTCCTGAATCTTAATAA > SEQ ID NO:3365 263329 111139_300052_1
CAAAAATGGGGAGAGCTCCTTGTTGTGATAAAGCTAATGTGGGGAGAGGACCATGGTCACCAGAAGAAGATGCTAAGCT
TAAGGAATTCATACAAAAATATGGCACTGGTGGTAATTGGATTGCTCTTCCTCAAAAAGCTGGATTAAGAAGATGTGGA
AAGAGCTGTACATTGAGATGGCTGAATTATCTAAGGCCTACTATCAAACATGGTGATTTTTCTGATGAGGAAGATAGAG
TTATATGCCGCTTGTATGCCAGCATTGGAAGCACGTGGT

FIG. 2 continued

> SEQ ID NO:3366 263329 137912_300687_1
CGCAGCACACATCCATCCATCCATCCATCTATCCAGAGAGCACAGCAACGGCGCATATATAGTACCCCTCTACCAAAGC
ACAACAACCAGAATCTCCTGAGCTCGATCTAGCTACTAGCTTGATCTATCCGATCAATCGACTGGCCCGCGAGGATCGA
TCGAGACTCGAAAGGGAGGGATTTTGATCCGGATCGGTCGACGATGGACATGGCGCACGAGAGGGACGCGAGCAGCGAG
GAGGAGGTGATGGGCGGCGACCTGCGTCGCGGGCCGTGGACGGTGGAGGAGGACCTCCTGGTCGTCAACTACATCGCCG
CGCACGGCGAGGGCCGCTGGAACTCGCTCGCCCGATCAGCAGGGCTGAAACGCACAGGCAAGAGCTGGCGGCTCCTGTG
GCTGAACTACCTCCGCCCCGACCTCCGGCGAGGCAACATCACGCCGCAGGAGCAGCTGGTCATCCTGGAGCTGCACTCG
CGGTGGGGAAACCGCTGGTCCAAGATCGCGCAGCACCTCCCGGGACGCA

> SEQ ID NO:3367 263342 258924_301750_1
GTTACTACAATAAAGCACCAGTATTAATGTAGTTGACAGTACTGCTCCAAATCTCTCTCCCTGAATCAATCTGATCAAC
ATGACCATGACCATGACCACTTCCTCCTCCCATGTTCATCTGCCAGGGGAATCCCCACAA

> SEQ ID NO:3368 263342 263331_301393_1
TTATAAAAACAATACACTATCAACGTAATTGTCAATACTGCTCCAAATCTCTCTCGCTGAATCAATCTGATCACTATGA
CCATGACCATGACCACTTCCTCCTCCCATGTACATCTGCCACGGGAATCCCCACAAAACCCTGTTTGGATCAATTGTCG
ACATCTGATCCATACCGCCTCCACCATTTCCAAACGCATACCCCGTGTTCTCCATCTGATGGATCGTGGTCCCATACAC
GCCATCCATGGCCATTGGATACTGACAGCTTCCGAACCCTATATGT

> SEQ ID NO:3369 263367 263220_301384_1
TTCCTCTGTCATCATCTGTTGCCAGCAACGTATTCTTTCCCATCTGGCTAGCCAGAACCTGGTTCTCTTCTCTCAGCAA
TTTCTCCTTTTCTTTAAGGGACTCGATATACTCCATCATCAGTTCTGCCTTCCTAGCTCTACTTACGGACAGAGCAGTC
TCAAGTTGTTCCTCCAGAGAAATTAGAGAATCTACACTTACATTATCGACATTTGGTTCTTCAAGCTTGCTTTGGACTG
TTTCTAGTAACTCCTTGTGTGGAAGATAATTCTGAATTTTTTCTTCAAGATCTAAGGCTCTAAGTTCATCAGCATGTTG
TATTTCATAACGATCAATGATCTTGGAAATGTCGTCACCGGAGGAAGAGTCATAGAGTTTTCCGGAGGCAGATACGACG
ACAACAGCGACGGAGGATTCACAGAGAATCGAAAGTTGTCGAGCTTTGTCGATGAGACCATTGCGTCGTTTGGAGAAAG
TGACTTGTCGACTGCTTTTGTTCTCGATTCGCTTGATCTCGATTTTTCTTCTTCCCATGCTGC

> SEQ ID NO:3370 263367 263318_301724_1
GCAGCATGGGAAGAAGAAAAATCGAGATCAAGCGAATCGAGAACAAAAGCAGTCGACAAGTCACTTTCTCCAAACGACG
CAAAGGTCTCATCGAAAAAGCTCGACAACTTTCAATTCTCTCGTGAATCTTCCATCGCTGTTGTCGCCGTCTCCGGTTCC
GGAAAACTCTACGACTCTGCCTCCGGTGACAACATGTCAAAGATCATTGATCGTTATGAAATACATCATGCTGATGAAC
TTAAAGCCTTAGATCTTGCAGAAAAAATTCGGAATTATCTTCCACACAAGGAGTTACTAGAAATAGTCCAAAGATTCTC
TAATATCTATGGAGGAACAGCTCGAGACTGCTCTGTCAGTAATTAGAGCTAAGAAGACAGAACTAATGATGGAGGATAT
GAAGTCACTTCAAGAAAGgGagaAGttgctgatagAaGagaACCAgAttcTgGctagccAGGtGGGGAAGAagaCGttt
CtggttataGAAGGTGACAGAGGAATGTcacggGAAAATg > SEQ ID NO:3371 263393 232763_301217_1
GAGGGACTGACCGTCTACTTCCCCTACGAGTTTATCTACCGGGAGCAGTATGCATACATGGTGGAGCTCAAGCACGCGC
TGGACGCCCGCGCCCACTGCCTGCTGGAGATGCCCACCGGCACCGGTAAGACGATCACGCTGCTCTCCCTCATCACCAG
CTACCAGCTCGCCAATCCCTCCATCGCCAAGCTCATCTACTGCACCCGCACCGTGCACGAGATGGGAGAAGGTGCTGGAC
GAGCTCCGCCGCCTCCACCGCTACCAGGAGCAGGAGATCGGCAGCAGCCGGGCCAAGATGCTGGCGCTGGGCCTCAGCT
CCCGGAAGAACCTCTGCGTCCACCCCGTCGTCAGCAGCGAGACGTCCAGGGAGAGTGTGGACGCCGGCTGCCGAAAGTT
GACGGCGTCGTGGGTGAGAGCCGCCGCCGAGACCAACCCCGACATTGAGACGTGCTCCTTCTACCAGGGCTACGAGAAG
CAAGGCAGCGACCAGCCACTGCCTGCGGGTGTCTACACTCTCCACGACCTCCGGGTTTACGGCAGGCAGAAAGGATGGT
GTCCATACTTCATGGCCAGACGCATGATCCAGTTTGCGAATGTGGTGGTGTACAACTACCAGTATTTGCTGGATCCCA > SEQ ID NO:3372 263514 146347_301065_1
TTGAATTCTCAATACCTACATAAACATCAATCTATATTGAACCACAACAAAAAGAGGCTAAATCAAGAACAAGTCAAGA
GGTTAGAGGAAAGTTTTGATTCAACTAAGAAGCTTGAGCCAGAGCAAAAAATCCAACTTGCTAAAGAGTTAGGTGTTCC
TCCGCGACAAATTGCTATCTGGTACCAGAACAGACGAGCTAGATGGAAGAACCAGAGCCTCGAGCTGGACTACAATGCT
CTTCAGCTTCAGCTTGACACTGCATTAGCTGAGAAGAGGAAGATTGAGAAAGAAAACGAACGTCTTCGAGGCGAGTTGA
AGAAGGTAAACGGGATGTTAGTTGCTTGTAAAAAAGCACAAGGACATGAAGAAACACAAGGATTTGTTCCTTTAAATGC
AACTAATCCCATTTCTAGTGGTTGTGAGGAAGGAGTAGTGAGTTCAAACTACCAAGAAGATGTGAGTTGTTTATTGATA
AAAAATAATAGTGACTCTAATTTGCAATTTGATGAGCTTTATGCTTGCTTGATGGGTGCAGAAGAAGGATCAAATTGTC
GTTTAAGTTGGCAAAATGGAAAAGATC

FIG. 2 continued

> SEQ ID NO:3373 263534 1117181_301818_1
ATGGAAGAAGGGATGAAGAAGGGGCCATGGAGTGGTAGCGAATACACGGTGCTGGTGGAGTATGTGAAGGAGAACGGGG
AGGGGGATTGGGACAAGGTGTACTTGAAGACGGGGTTGCCTAGGTCTGGGAAGAGTTGCCGCCTCCGATGGTCTAACCA
CCTCCGCCCTTTCCTCAAGAAGGGACCTTTCACCCTTCTTGAGCAGCAAGCTGTTCTTGCTTTCCATGCCTGCCTCGGT
AACCAGTGGGCTAAGATGGCCCAACTGATGCCTGGTCGGACAGACAATGAAATCAAAGATTTCTGGAACACTCATTGCC
AGCGCCTCTCCCGTCAGTGAACTTCTACACAGAATGTTGTGCTTTCTTCTCCAAATTTGACAGGTTTCTCAGCTTTTTT
TAAAATAAGCAAGAAGACAGCGTAAATTAAAATAAATTAGTACGTGTATTTCGGACATTCAAGTAGAGTgttaTTGGTC
ATGttgTAttAGGAAAAGTAgaccTCTGTAAATTCTACTATGttTgagATTCTTAGCCACG > SEQ ID NO:3374 263534 3270_300341_1
cCCACGCGTCCGACAACTACTACTcagagCAAAGcTgttACTTGAATTTCCCTCCTCTGGCTTCTCcAACATGGGAAAG
TTCCTTGGAATCTATATGGAACATGGATGcagATGAAAGTAAGATGTCTTCTTTTGCTATTGATCagtTTCCTCTAAGT
TTTGAACATGgTAGTGgtcGCCTTTAGTCtaggaTTTGATTCATTTGGAATgttTATATGTGCagCATATATATGTTAT
CAAACGACGACTgtaGTAGTTTccTATGACTTACATCaAAAATCaccacccacTgtactaatCTCATaaGTAgtcATCA
TCTTATGCCTtTgtttagtttgtaGagtgAgtgaaAaGATGtgtaatAcaagTCagaactcta > SEQ ID NO:3375 263534 6187_300329_1
CCCACGCGTCCGGAGAGGTAAAAGGTTCTATTGCCCAGAGAACGAGAGTTTGAGAACGAGAGAGAGAGATGACACTTGC
GCAAGAAGAATACCGTCATGGACCGTGGACAGAACAGGAGGACATCCTCTTGGTCAACTCTGTCCACTTGTTCGGAGAT
CGAAGATGGGATTTTG > SEQ ID NO:3376 263550 263645_301385_1
tcaatcgatgaccaaagacataatctttctcctgaagatttggctgaatcggttgcactctatatccaaactgcccatca
tGATCTCTCATCATCATTCCTCTTGCGttgCTTGCTATAGCCATCTCCTGTTGTTGCAGctgGAAAGTGAGTTGCCgtT
GCTCCTCCGCCATCATCTTCTCATTTCTCCTCTTTGATATAAGGATCTCCATCTGGTGGTCTCGGACTTTGTCgaggCC
AtGTTCAATGGCGTGCTCGACAGCCATCagaTttttCAAGTTGAgagaCTGTATATCTTCTCCCTTCAAATGCCTGAGC
TCCAGTTGTAAGCTATCATTCTCTTTCTTGATCCTATCAATCTCATTGCTAAGGTTCTCATGCTTAGCATCCCATAGTT
TCTTGCCAGATAACTTCTGGTATTGGTCCAACATAGCACCAAGATCCATGGAAGGACAACAGTAATCAATCATCTTACC
ATTACTTGCAAAGATTATGAGGGCAACTTGTGCATCACAAAGAACTGTGATCTCTTTAGCCTTCTTCACCAATCCATTC
CTCCTCTTTGAGAACGTCACCACTCTGTTGTTTGCGTCCTCTATCCTCTTTATCTCGATCTttcctctacccatgctgc > SEQ ID NO:3377 263611 263379_301724_1
GCAGCATGGCTGATAGGATCAAAGGTCCATGGAGTCCTGAATAAGACGAGCAGCTTCGTAAGCTTGTTGTTAAATACGG
TCCAATAAACTGGACAGTGATTAGCACATCTATTCCCGGGAGATCGGGGAAATCGTGTCGATTACGGTGGTGCAACCAG
CTTTCGCCGCAAGTAGACCATCGGTCGTATGCGGCTGAGGAATACCAGATGATCGCACCTGCTCACTCTCACATCGGCT
ATAACTGGGGGAGATTGGGTCGTCTTCTCTATGGTCGTACGTCCACTTCCGTGACTACTCAATGGAACTCGACGCTCGC
AAGGAAATGGCTTGAATCCTCTGATCTTTATAGAGCTGGTACGCCTTGACCACCAACTATATCATGCATTGATTACTGT
CAGACAGCGAAAGGAACGATTGCTGACTAACCAACTTGAAGAATC > SEQ ID NO:3378 263611 16705_300234_1
CCCACGCGTCCGCTCTCAAAACCAAAATCACTAAAGAGGAGAAGATTGCTAAAGTTTGATAAAACATTCCAAAATCAAT
GGCTGATAGGATCAAAGGTCCATGGAGTCCTGAAGAAGACGAGCAGCTTCGTAGGCTTGTTGTTAAATACGGTCCAAGA
AACTGGACAGTGATTAGCAAATCTATTCCCGGTAGATCGGGGAAATCGTGTCGTTTACGGTGGTGCAACCAGCTTTCGC
CGCAAGTTGAGCATCGGCCGTTTTCGGCTGAGGAAGACGAGACGATCGCACGTGCTCACGCTCAGTTCGGTAATAAATG
GGCG > SEQ ID NO:3379 263617 111230_300053_1
AATACCTCAAACTGAGACAACATCCAATCCTACTCTTCTACTACTACTACTTTTTACTCTCTTAAGTATATCAGTG
ATCAAGAATAATGGATATATTTAGAAGCTATTACTCGGACCCACTTGCTGAATGTTCATCAATTTCTGACAATGGTGGC
AGCTCCTGTAATAGAGCTAACCTTTTTGATGAGGAAGTTATATTAGCTTCGAATAACCCCAAGAGGCGCGCAGGGAGAA
AGAAGTTTCGAGAAACTCGACACCCAGTATACAGGGGAGTGAGGAAGAGGAATTCAGACAAGTGGGTTTGTGAAGTGAG
AGAACCAAACAAGAAATCAAGAATATGGCTGGGCACTTTCCCTTCAGCAGAAATGCGGCTAGAGCTCATGACGTGGCG
GCTATTGCATTAAAGGGCCGTTCTGCTTGCTTGAACTTCGCTGACTCTGCTTGGAAGTTGCCGATTCCTGCTTCCACCG
ACGCCAAGGATATTCAGAAAGCGGCCGGCTGAGGCCGCGGGAGGCATTCCGATCATCGGAGGCCGAAAACATGCCGGAATA
CTCAGGAGAAGATACGAAGGAAGTGAACAGTACTCCTGAAAATATGTTTTATATGGATGAGGAAGCGCTATTTTGCATG
CCGGGATTACTAGCGAATAT

FIG. 2 continued

> SEQ ID NO:3380 263617 263657_301731_1
GCAGCATGATAGCTTCAGAGAGTACCAAGAGCTGGGAAGCTAGCGCAGTCAGACAAGAGAATGAAGAAGAGAAGAAGAA
ACCGGTTAAAGATTCCGGTAAGCATCCGGTTTATCGGGGTGTCCGAAAGAGGAACTGGGGAAAATGGGTGTCCGAGATA
CGTGAACCTAGGAAAAAATCCCGAATATGGCTAGGAACGTTTCCTTCCCCGGAGATGGCGGCGCGTGCACACGACGTAG
CCGCTCTTAGCATCAAAGGAGCCTCCGCTATACTCAATTTCCCTGACCTAGCCGGCTCTTTCCCACGCCCTAGCTCGCT
TAGCCCTCGAGACATCCAGGTCGCGGCTCTCAAAGCCGCACACATGGAGACCTCACAGTCTTTTCTTCTTCTTCTTCT
TTAACGTTTTCATCTTCACAGTCTTCTTCTTCGCTAGAGTCTCTCGTGTCTTCCTCCGCGACCGGCTCCGAGGAGCTAG
GGGAGATTGTAGAGCTCCCAAGTTTGGGATCGAGCTATGATGGTTTGACTCAGCTAGGTAACGAGTTTATATTCTCTGA
CTCCGCAGACTTATGgccTTATCCACCGCAATGGTCAGAAggTGAtTACCAAATGAttccTgccTCGTTATCACAAGAt
tgGGATCTTCAAGGAcTgtaT > SEQ ID NO:3381 263633 263003_301721_1
GCAGCATGCAATCAAAACCGGGAAGAGAAAACGAAGAGGAAGTCAATAATCACCATGCTGTTCAGCAGCCGATGATGTA
TGCAGAGCCCTGGTGGAAAAACAACTCCTTTGGTGTTGTACCTCAAGCGAGACCTTCTGGAATTCCATCAAATTCCTCT
TCTTTGGATTGCCCCAATGGTTCCGAGTCAAACGATGTTCATTCAGCATCTGAAGACGGTGCGTTGAATGGTGAAAACG
ATGGCACTTGGAAGGATTCACAAGCTGCAACTTCCTCTCGTTCAGTAGATAATCACGGAATGGAAGGAAATGACCCAGC
GCTCTCTATCCGTAACATGCATGATCAGCCACTTGTACAACCACCAGAGCTTGTTGGACACTATATCGCTTGTGTCCCA
AACCCATATCAGGATCCATATTATGGGGATTGATGGGAGCATATGGTCATCAGCAATTGGGTTTTCGTCCATATCTTG
GAATGCCTCGTGAAAGAACAGCTCTGCCACTTGACATGGCACAAGAGCCCGTTTATGTGAATGCAAAGCAGTACGAGGG
AATTCTAAGGCGAAGAAAAGCACGTGCCAAGGCAGAGCTAGGAGGGAAAGTCATCCGGGACAGAAAGCCATATCTTCAC
GAGTCAAGACACAAGCATGCAATGAGAAGGGCACGAGCGAGTGGAGGCCGGTTTGCGAAGAAAAGTGAGGTAGAAGCGG
GAGAGGATGCAGGAGGGAGAGACAGAGAAAGGGgttcagcaaccaactcatcaggctctgaacaagttgagacagactc
taatgagaccctgaattcttctggtgcaccataa > SEQ ID NO:3382 263636 262684_301692_1
GCAGCATGGAATCGTCGTCGTCGGGAACAACTTCGTCGACGATTCAAACGTCGTCAGGATCGGAGGAGAGTCTCATGGA
GCAGAGGAAACGTAAACGGATGCTCTCAAACCGTGAATCTGCAAGGAGATCAAGAATGAAGAAACAAAAGCTCCTAGAC
GATCTAACGGCTCAGGTTAATCATCTGAAAAAAGAGAACACGGAGATCGTGACAAGTGTCAGCATCACAACGCAACACT
ACCTAACCGTTGAAGCAGAGAACTCTGTTCTCAGAGCTCAGCTTGATGAACTTAACCACAGGCTCCAATCTCTCAACGA
CATCATCGAGTTCCTCGACAGTAGCAACAACAACAACAACAACATGGGCATGTGTTCGAACCCTCTGGTTGGTTTG
GAGTGTGATGATTTCTTCGTGAATCAGATGAACATGTCTTATATTATGAACCAGCCTCTCATGGCGTCTTCTGATGCTT
TAATGTATTAATAA > SEQ ID NO:3383 263679 316905_301428_1
GCAGCATGGAGATGATGAGCTCTTCTTCTTCTACTACTCAAGTTGTATCATTCAGAGACATGGGGATGTATGAACCATT
TCAACAGTTATCTGGTTGGGAGAGTTCCTTTCAAATCAGATATCAACAATATTACTAGTAATCAGAATAACAATCAGAGT
TCTTCAACAACACTTGAGGTTGATGCTAGACCAGAAGCAGATGATAACAATAGAGTGAATTATACTTCTGTGTATAATA
ACTCTCTTGAAGCAGAACCGTCGAGTAATAATGATCAGGACGAAGACCGGATCAATGATAAGATGAAACGGCGTTTGGC
TCAGAACCGAGAAGCTGCTCGCAAAAGTCGTTTGAGAAAGAAGGCCCATGTTCAACAGTTAGAAGAAAGCCGGTTGAAG
TTGTCACAGCTCGAGCAGGAACTTGTAAGAGCTAGGCAGCAGGGATTATGCGTACGCAATTCTTCAGATACTAGTTATC
TAGGACCAGCTGGGAATATGAACTCAGGTATTGCTGCATTTGAGATGGAATACACACACTGGCTAGAAGAGCAAAACAG
GAGAGTTAGTGAGATTCGAACAGCGCTCCAAGCTCATATAGGTGACATTGAGCTCAAAATGTTGGTAGATAGTTGCTTG
AACCACTACGCAAATCTC > SEQ ID NO:3384 263679 143194_200007_1
GATACTATTTTGGAGGAAACTCTCATTTAGGAGGAGAACAAAACCTTCCTGTTAATATGGCCAACATGAGCTCAGATGC
TGCAGTTTTCGACATGGAGTACGCGAGGTGGCTAGAGGAACACCATCGACTAATGTGCGAGCTTCGAAACGCAGTGCAA
GAACATTTTCCAGAAAACGAGCTTCGAATCTATGTCGACAATTGTGTAACACACTACGATGAGATAATGAATCTCAAGA
GCATGCTTACAAAATCTGATGTCTTTCATCTTGTTTCTGGTATGTGGAAGACTCCAGCTGAACGGTGCTTCATGTGGAT
GGGAGGGTTTCGGCCATCTGAGCTCCTCAAAATTATCCTGAGTCAGATTGAGCCATTAACAGAACAACAACTTATGGGG
ATTTGTGGGTTACAACAATCAACACAAGAAGCAGAGGATGCACTCTCTCAAGGACTTGAAGCTCTTAATCACTCTCTCT
CAGACACCATTGCCTCTGATGCATTGTCTTGCCCTCAGAACATGGCCAACTACATGGGCCAAATGGCTCTTGCCATGAA
CAAACTCTCCACTCTTGA > SEQ ID NO:3385 263679 183327_300621_1
CGGACGCGTGGGCGCCGAGGCATGCGTCGGACAGCTTCGAGCAGGAGGCGTCCAAGCCTCGAGACAAGATCCAGAGGCG
GCTCGCGCAGAACAGAGAAGCAGCTCGCAAGAGCCGGCTACGGAAAAAGGCTTACATCCAGAACCTGGAGACGAGCCGG
ATGAAGCTGGCGCATCTGGAGCAGGAGATCACCCGAGCAAGGCAACAGAGCGCGTACATCAACCGCAGCAGCAACCCAG
CCACCCTACCAGCGCCCATCGATTCAGGTGTGGTGACGTTCGAGGTGGAGTACGCGCAGTGGGTGGAGGAGCAGGGGAG

FIG. 2 continued

GCAGACGGCGGAGCTGAGGGCGGCGCTGCAGGCGGCGGCGGAGGGGCCGGAGCTCCGGGCGGTGGTGGAGGCGGCGCTG
GCGCACTACGACAGGCTGTTCGCGGCGAAGCGTGAGGCGGCGAGGCGCGACGTGTTCTTCGTGATGTCCGGCGTGTGGC
GCACCGGCGCCGAGCGGTTCTTCCTCTGGATCGCCGGATTCCGCCCCTCCGAGGTGATCAGGGTGCTCGCGCCGCAGCT
GGAGCCGATGACGGAGCGGCAGGCCGCCGACGTGCAGGGGCTCCAGC

> SEQ ID NO:3386   2658      244515_301559_1
GTCGGGGTCAGTTCTAGGGTTTAGCACGGGGCCGCGACTTGCGAGGACGGTGGCCGGATTCGCGATGGAGCAAGTGGCG
CTGGATGACGCGAAGCTCAAATCTTCTGTCCAATCCTTCCGCGGCGGCAAGCGCGATCGAGAAGTCGTCACGGCGGGCG
GTTTTGATGTGGAAGGCATCTCGATCGGCGGTCATGAGACCTGTGTGATCGTCCCATCCATGAAGATCGCGTTCGATAT
TGGGCGATGTCCCCAGCGGGCGATCTCCCAGGATTTCCTCTTCATATCCCACTCTCATATGGACCACATCGGAGGAATT
GCAATGTATGTTGCTACTCGGGGTCTCTACTCGATGAAGCCACCCACAATTTTCGTGCCTTCGTCGATCAAACCACGG
TGGAGAAGCTCTTCGATGTTTATAGAGAGCTCGATCAGGCAGAGCTAGCAATGAAGCTGGTTGGACTTGACATCGGCGA
AGAGTATGATCTCGGGAAAGGATACATCGTCAAGCCTTTCAAGACATACCACGTAATTCCCAGTCAGGGTTATCTCATC
TATGCTGTGAAGAACAAGCTCAAGCCAGAATACATCG

> SEQ ID NO:3387   2658      47642_300191_1
CTTTAAGACATTCCATGTCATCCAAAGCCAGGGGTATGTAGTGTATTCAACTAAATATAAACTCAAGAAGGAATATATT
GGCCTATCTGGAAATGAAATTAAGAACTTGAAGGTTTCAGGTGTTGAGATTACAGACAGCATAATAACTCCTGAAGTTG
CTTTTACGGGAGATACAACGTCCGATTTTGTAGTTGATGAAACTAATGCTGATGCTCTCAAGGCAAAGGTTCTCGTCAT
GGAGAGCACATTTCTTGATGATTCGGTATCGGTAGAGCATGCGAGAGATTATGGACATATC

> SEQ ID NO:3388   26650     255716_301643_1
AGGGGAGGGCGCGCTCTGAAGCAGCCATGGTGAATGTTCCGAAGACCAAGAAGAGCTTTGCCAAGGCAAGGATGTAGGA
AGCATACGCTTCACAAGGTCACTCAGTACAAAAAGGGGAAGGATAGCTTGTATGTGCAAGGAAAGAGGCGTTATGACCG
AAAACAGTCGGGATATGGAGGTCAAACTAAGCCTGTCTTCCATAAGAAGGCAAAGACCACTAAGAAGATTGTCCTTAAG
CTGCAATGTCAGTCTTGCAAGCGCGTGATTCAACATCCCATCAAGAGATGCAAGCACTTTGAAATTGGAGGTGACAAGA
AGGGAAAGGGGACTTCCCTGTTCTAAATCTCATCATTTTTCTATCAGTTTTGGCTTGGGATCCCTGATCTTATTGTGTT
GGAGCTCTTCCTTATTCCATATAAGAGCTAATTCTTAGTCTTTCTGAGTTCCTACTGTATGAACTTATTATAATCCAAT
GCACAATTATGGCTACTCTTACTATTTATATGAACTTATTGTCATCCGATGCACG

> SEQ ID NO:3389   26650     50937_300164_1
CGGCAGTGGAAGTACGACGGCACGAGCTTCACCGAAGAGCGAAAATGGTGAACATTCCGAAAACTAAGAACACTTACTG
CAAGAACAAGGAGTGCAAGAAGCATACCTTGCACAAGGTGACGCAGTATAAGAAAGGTAAAGATAGCCTTGCTGCCCAA
GGAAAGCGTCGTTATGATCGTAAACAATCTGGTTATGGAGGTCAGACCAAGCCCGTCTTCCACAAGAAGGCTAAGACAA
CTAAGAAGATTGTGCTGAGGCTTCAATGCCAAAGCTGCAAGCATTTCTCGCAACGCCCGATTAAGAGGTGCAAGCACTT
TGAGATCG

> SEQ ID NO:3390   26650     291638_200080_1
AAGCAAAGGCGGTTTCTACTGCAGCTCCTTCCTTGCCTGAAGTCAGCCTCCGACCATGGTGAACGTTCCAAAAACTAAG
AAGACGTACTGCAAGTCAAAGGAGTGCAAAAAGCACACTCTGCATAAAGTTACACAGTACAAGAAAGGAAAAGATAGCC
TAGCAGCTCAAGGCAAGCGTCGGTATGATCGCAAGCAGTCTGGTTATGGTGGGCAGACGAAACCCGTTTTCCACAAGAA
GGCCAAAACTACCAAGAAGATTGTGCTAAGGTTGCAATGCCAGGGTTGCAAACATGTGTCCCAGCACCCAATCAAGAGA
TGCAAGCACTTTGAAATTGGTGGAGATAAGAAAGGAAAGGGAACTTCTCTCTTTTAAGTGGCGCATTCACGGAGATGAA
ATTGTTTATTTTTGTGTCGTGGTGGACTTTTTTATCAAGTGTAGCTCAACAATGTTTCTTTTGCATATTGAACAATGTA
TGTCTATGGTATAATACTTATATTTCGAGT

> SEQ ID NO:3391   26650     1100285_301458_1
gaaaccTATGGTAAGGGCGTAGGCATTGACAGACGTCTGGTTAGAGGTAGCTGTTCGACTTGCAGTCATGGTGAACGTT
CCAAAAACAAAGAAAAGCTTTTGCCAGGGCAAGGACTGCAAGAAGCATACCTTGCACAAAGTTACTAGTACAAGAAGG
GCAAGGACAGTCTCTACGTGCAAGGTAAGAGGCGTTATGACCGGAAGCAATCTGGATATGGAGGTCAAACCAAGCCAGT
CTTTCACAAGAAGGCTAAAACTACCAAAAAGATTGTACTGAAGCTTCAATGCCAGGGTTGCAAGCGTGTAACTCAGCAT
CCTATCAAGAGGTGCAAGCATTTTGAAATTGGTGGTGACAAGAAGGGAAAGGGAACATCTCTGTTCTGAGCTGTTGCAT
TGCTTTTGTCTTCTTTTTTAGTCTTGATCTTTATCTCGATGTAGTCCAATTAAAGCTTAATTTAAATACCCCAACGGAT
CCTATCTGGTTCTGTAGTTGCTTCAGATATCAGATTAATGACAATGTAGTTTATTTGAGAATTAATATCAACTCTTACC
ATTATTACG > SEQ ID NO:3392   26650     127233_300469_1
taatcctcgactcgcgacaatggtgaacgtACCTAAGACAAAGAAGACCTACTGCAAATCCAAGGAGTGCAAAAAGCAC
ACCTTGCATAAGGTCACACAATACAAGAAAGGAAAAGATAGTCTTGCTGCCCAGGGGAAGCGTCGTTATGATCGTAAGC

FIG. 2 continued

AGTCAGGTTATGGTGGACAGACAAAGCCCGTCTTCCACAAAAAGGCAAAAACTACAAAGAAGATTGTCTTAAGGTTGCA
ATGCCAGGGGTGCAAGCATGTCTCTCAGCACCCAATCAAGAGGTGCAAGCATTTTGAGATTGGTGGGGACAAGAAGGA
AAGGGAACCTCTCTTTTCTAGATTGCCTGTGATGCAAAATTTGATAGTTTTCTGTTATACGTTTTTAGATATCTTTTTT
TGTTGGTGTAGTTCAAGAGCTTTTGTTTTCTTAGATTCAAGTTAATATTATGCTGTGTTAATTACATTTTGATTAGGAG
ATCAAAGCTGTACTTTTCAAGTTTCTATTTAGTATGATTCTTGTTCCCTTATTgatgttcaagcatttggaagttactt
gtgctgcttt > SEQ ID NO:3393 26650 144866_200137_1
CATTTCTGTCTCACTCTTCGCCGGCGACAATGGTGAACGTTCCTAAGACAAAGAAGACCTACTGTAAGTCAAAGGAGTG
TAAGAAACACACTTTGCATAAGGTCACACAATACAAGAAGGGCAAAGATAGCTTAGCTGCTCAAGGAAAGCGTCGTTAT
GATCGCAAGCAGTCTGGATACGGGGGTCAAACAAAGCCCGTCTTCCACAAAAAGGCAAAAACGACAAAAAAGATTGTGT
TGAGATTGCAATGCCAGGGGTGCAAACATGTTTCGCAGCACCCAATCAAGAGGTGCAAGCATTTTGAGATTGGCGGGGA
CAAGAAAGGAAAGGGAACCTCTCTTTTCTAGATTGCCTGTGAAGCGGAATGTAACAGATCTTTCACCCCCTTCTGTTCT
GTTACACTGTTCAGATACTTTGGTAATATTTGATGTAGTGCAGGAGTTTCTGTTATTGAATCATGTGATCAATTTTGTG
ATGTCTTAGAGAATCTGATAAGGAGAGAAAATGAATATTTTAAGTTTTTGGTTTAGTATCTTGTTGCCTAAATCTATTG
CAAGAAAGTTATGCTGCTCTACCTCACtTGGCTGCATCAAtTTGTATGTTGGGAttATATTATAGg > SEQ ID NO:3394 26650 208415_300960_1
gtaacgacacCGCACACCGTCGTCAAAATGGTCAACATTCCCAAGACCCGTAACACCTACTGCAAGGGCAAGGAGTGCC
GCAAGCACACCCAGCACAAGGTCACTCAGTACAAGGCCGGCAAGGCTTCCCTGTTCGCCCAGGGTAAGAGACGTTATGA
CCGGAAGCAGAGCGGTTATGGTGGTCAGACCAAGCCCGTCTTCCACAAGAAGGCCAAGACCACCAAGAAGGTCGTCCTG
CGGTTGGAGTGCGTCAAGTGCAAGACCAAGTTGCAGCTGGCCCTGAAGCGATGCAAGCACTTCGAGCTGGGTGGTGACA
AGAAGACAAAGGGTGCTGCTCTGGTGTTCTAAATGCGTTGTTCTCCGGTATTATCAATTCTTATGCTTCTCCTGGCGGC
ATACGGGCATCATGGAACTTGGCGAAGGGGGTACTGGTCCTTGTTTAGAGGACAGCGGCTCATAGGAAACGAATAAAAA
GATTTCTTCATGGACCGCATTCACGCGTTTTTTACTGGGATATGCTTTACAGTGTTATGGTGGAAAAGCCAACCTGGGA
CAATATTCCAATTCACGATGGCCTGGTGTCTCTGTGCTaggCAACTTTAGTTCATGGaggaggcTCAGactagcTAACA
TGAAAAgaagcCgAATTTCACCCTTTT > SEQ ID NO:3395 26650 202344_300783_1
CCCCCGAGGGTTTTCGGCACCGAGCTCGCGCCGCCGCCATCGCACCCACCGAAGGAGGGAGAGGAACCCAAAGCTCGGC
GCCATGGTGAACGTGCCAAAAACTAAGAAGACTTACTGTAAGAACAAGGAATGCAGGAAGCACACCCTACACAAGGTTA
CCCAGTACAAGAAAGGAAAGGATAGCCTTTCTGCTCAGGGGAAGCGTCGTTATGACTGCAAGCAGTCAGGATATGGTGG
GCAGACAAAGCCTGTTTTTCACAAGAAGGCCAAGACCAAGAAGATCGTTCTGAAGCTGCAGTGCCAGAGCTGCAAG
CACTACTCTCAGCACCCGATCAAGAGGTGCAAGCACTTTGAAATCGGTGGAGACAAGAAGGGCAAGGGAACTTCACTCT
TCTAAGATGCTGATATTGCCCTGTTCCCCAATTCTCTGCCAGGAGTTAGCATTAAGAATGttCTTGTCTTGCCTTTCTA
GTACAAGTTATATATCCTCTTGttTTCAGTCAGGTCTTTtgatACATAACTACACTACTa > SEQ ID NO:3396 26650 176162_300519_1
CCCCCCCGGCCGCCACTCGCCGCAGCGTGTCGGCCAGACAAGGCAGCGCCTCCGAAACCCTAGCTCCCCGCCTTCCCCT
CCGCGGCCGCCAAAATGGTGAACGTTCCCAAGACCAAGAAGACCTACTGCAAGAACAAGGAGTGCAGGAAGCACACCCT
TCACAAGGTCACTCAGTACAAGAAGGGTAAGGACAGCCTGTCTGCCCAGGGAAAGCGCCGTTATGACCGTAAGCAGTCA
GGATATGGTGGTCAGACCAAGCCTGTTTTCCACAAGAAGGCAAAAACCACCAAGAAGATTGTGCTGAAGCTGCAATGCC
AAAGCTGCAAGCATTACTCCCAGCACCCCATCAAGAGGTGCAAGCATTTCGAGATTGGTGGAGACAAGAAGGGCAAGGG
AACATCTCTTTTCTAAACTACCTACTGGATACTGAAGTTGTGGGTCTATTGTGCTTCATACTTCAATGTTATTAGGAAC
TTAATTTAAGCAGACCATATCATGTATTCAAGTATCATCGTCTGACATTTACTCTAGCAAGGATTGGCTTTCTGCTGAA
TCAAGTTTTCTTGCTTAATGCTCGTCGAATCCAATGTGATGCATGTCTTTAGATGGCACTGCAATTGTGACTTTTGTCT
TATGGC > SEQ ID NO:3397 26650 1114206_301844_1
GAGGGGAGGGTGAGCTCTCTTCTGAAGCAGCCATGGTGAATGTTCCGAAGACCAAGAAGAGCTTTTGCCAAGGCAAGGA
TTGTAGGAAGCATACGCTTCACAAGGTCACTCAGTACAAAAAGGGGAAGGATAGCTTGTATGTGCAAGGAAAGAGGCGT
TACGACCGAAAACAGTCGGGATATGGAGGTCAAACTAAGCCTGTCTTCCATAAGAAGGCAAAGACCACTAAGAAGATTG
TCCTTAAGCTGCAATGTCAGTCTTGCAAGCGCGTGATTCAACATCCCATCAAGAGATGCAAGCACTTTGAAATTGGAGG
TGACAAGAAGGGGAAGGGGACTTCCCTGTTCTAAATCTCATCATTTTTCTATCAGTTTTGGCTTGGGATCCCTGATCTT
ATTGTGTTGGAGCTCTTCCGTATTCCATATAAGAGCTAATTCTTAGTCTTTCTGAGCTCCTACTGTATGAACTTATTAT
AATCCAATGCACAATTATGGCTACTCTTACTATATGAACTTATTATCATCCGATGCACAATTATGACTACTCTTACTAT
ATGAaCTTATAATCCGATGCACAATTATGGCCaAttttttaaaagcctcttatttgcgaaaacaactgttgaccaacctt
g

FIG. 2 continued

> SEQ ID NO:3398 2696    271191_200054_1
AGAGAACGTTTCAAGTTTTGCTGCATATGGTTGGACATTTATTAAACGTCAGCGTCGGAAAAGGCTCTGTTGTGTTCAG
AGTGGTTATAGAGACTGGAGCAGATGGTGGGAATGACAAAGTTTGGGGAACAAGAAGAGCAAACGTGACAGATGAATAT
GTGACTATAAAATTTGAAATTGAGGTTAGTCTTGAAGGCACTCAATCAGATAGTTCAATCTCCACCATTCACTTTGGTG
GAAGTAGGCATAATAGCAAGGAGGTAACGGAGGGCTTGAGTTTCAGCATGTGCAAAAGCTTGTCCAGATGATGCAGGG
AAATATATGGATGTCTTCGAACGCCCAGGGCCACGCACAAGGGATGACTCTTATCCTCAGGTTTCAAAAACAGTCGTCT
TTTAGGAAACGCATGTTTGAATATAGAAATCCTTTGGAGCAACCAATTTCCAGCACAATGTTCAGAGGCCTAAATGTAC
TCCTCACTGACGATGATGTAAATAGACTGGTAACAAGAAAGCTGCTCGAAAAACTTGGTTGCCAAGTAACTGCTGT
TTCAACTGGTTTTCAATGCCTAAGTGCCCTAGGCCCTTCATTAACAACCTTTCAAGTTGTCATTTTGGATC

> SEQ ID NO:3399 27245    144196_301078_1
GGAAGACCCGGATCTTTATTGAAACTATACTTCCTAAAATGGGGATTACGGCCACGGTCATTGACCCAGCCGATGTCGG
AGCTCTGGAGTTGGCTCTAAATCAGAAGAAAGTGAATCTTTTCTTTACCGAGTCTCCAACAAATCCATTCCTCAGATGT
GTAGACATTGAGATGGTTTCAAAGCTTTGTCATGAAAAAGGAGCCCTGTTTTGCATAGATGGGACTTTTGCAACTCCTC
TTAATNCAAAAGGCCTTGCCCTTGGGGCTGACCTCGTTCTGCACTCTGNAACAAAATTCCTTGGTGGGCATAATGATGT
TCTCGCTGGTTGCATTAGTGGTCCTGTAAAGTTAGTTTCAGAAATACGTAACCTGCATCACATCCTGGGTGGTGCTCTC
AATCCGAATGCCGCATATCTAATTATCCGAGGCATGAAGACGCTGCATCTTCGTGTACAGCAACAAAACTCTACTGCAT
TGAGGACGGCCGAGATTTTAGAGGCTCATCCCAAGCTGAGACATGTCTATTATCCAGGCCTGCACAGTCATCCAGAATA
TCACATTGCAAAGAAACAAATGACAGGTTTTGGTGGCGTGGTCAGTTTTGAGGTTGATGGAGAT

> SEQ ID NO:3400 27245    156285_301364_1
ATCAAAGCTTTGCCATGAAAATGGAGCGTTGGTTTGCATCGATGGGACATTTGCAACTCCTCTTAACCAAAAGGCCCTT
GCTCTAGGGGCTGACCTCGTTGTGCACTCTGCAACAAAATATATTGGTGGCCACAATGATGTTCTTGCTGGTTGCATTA
GTGGACCTGAAAAGTTAGTTTCAGTAGTTCGTAACTTGCATCATATCCTGTGTGGTGCTATCAATCCGAATGCTGCGTA
TTTGATCATCAGAGGTATGAAGACGCTGCATCTTCGTGTACAGCAACAGAACTCAACTGCACAAAGGATAGCCGAAATT
TTAGAGGCTCATCCCAAGGTGAGATGTGTCTATTATCCAGGCTTGCCGAGTCATCCAGAACATCAGCTGGCAAAGATAC
AAATGGCTGGTTTTGGTGGTGTGGTCAGCTTTGAGGTTGATGGGGATCTGCTGACTACTGCAAAATTCATTGATGCTCT
GAAAATTCCTTATATTGCTCCATCATTTGGAGGCTGCGAGAGCATTGTGGATCAACCAGCAATAATGTCTTACTGGGAT
CTTAGCCAGTCAGACAGAGCAAAGTATGGGATCTTGGACAACTTGGTTCGATTCAGCTTTGGAGTGGAAGACTTTGAGG
ATTTGAAAGCTGATATTCTTCAGGCTCTGGAGGCCATATAAGACCGTCTT

> SEQ ID NO:3401 27245    227812_301031_1
GCTATGCTCAGCGCGCTTGTTCCAGCAGGTGGGCACGTTGTGACCACCACTGATTGTTACCGCAAGACGAGAATTTACA
TGGAGACTGAACTACCTAAGAGGGGAATTACGATGACCGTTATTAGACCTGCTGACATGGATGCTCTCCAAAATGCACT
GGATAATAATAATGTATCCCTATTCTTCACCGAGACTCCTACTAATCCATTTCTGAGATGCATCGACATTGATCTTGTC
TCAAAAATGTGCCATAGCAAGGGAGCATTGCTTTGTATGATAGTACCTTTGCATCCCCAATCAATCAGAAGGCACTAA
CTCTAGGTGCTGACTTAGTTATCCATTCAGCAACAAAGTACATTGCTGGGCACAATGATGTTATTGGAGGCTGCATCAG
TGGCAGAGATGAGCTAGTTTCCAAAGTCCGCATCTATCACCATGTAGTTGGTGGTGTTCTAAATCCGAATGCTGCCTAC
TTGATTCTTCGAGGCATGAAG

> SEQ ID NO:3402 27429    1007264_301398_1
GGCTACTTCCTCATTCCCTCTCTCCAGCTTCTTTCCTTTTCTTTTCTTGCAAGCGTAGTTCATCATGGCTGCTACACTT
GCCTTTTCCCTCTTCGTCTTCGCCTGGCATTGTTCTTAATGCCTTCCTTGCTTGGACTCCTAAGCATAGTAGCCACTGC
TTTTGCCCAAAGTGGATGGAACTCTGCTCATGCCACCTTCTATGGTGGAAGTGATGCCTCCGGAACCATGGGAGGTGCT
TGTGGCTATGGTAATCTGTATAGCCANGGCTATGGGACCAACACTGCTGCCTTGAGCACTGCCCTCTTCAATGCAGGA
TGTCATGCGGGCGTGCTTTGAGATGAGGGGTGCTGATGACCCTCAGTGGTGCCTCCTGGTTCTATCATTGTTACTGC
CACCAATTTCTGCCCCCCTAATAACGCTTTGCCTAATAATGCTGGAGGCTGGTGCAATCCTCCCCTCCAACATTTCGAC
ATGGCCCAACCTGGCTTCCTGCAAATTGCCAAGTACAAGGCAGGCATTGTGCCAGTGCAATACAGAAGAGTTCCCTGTG
AGAAGAAGGGCGGCGTACACTTCACTGTGAATGGGCATTCCTACTTCAACCTAGTCCTGC

> SEQ ID NO:3403 27429    144557_200046_1
TTTCTGTCCACCAAACTACGCAAAGCCCAACGACAATGGTGGATGGTGCAATCCTCCACGTTCTCACTTTGATCTTGCC
ATGCCTATGTTCCTCAAGATTGCCGAGTACCGTGCTGGCATTGTTCCCGTTACTTATCGCCGGATACCATGCCGAAGC
GAGGAGGAATGAGATTCACAATCAATGGCTTCCGTTACTTCAACTTGGTATTGATCACAAACGTGGCGGGGGCAGGAGA
CATAATAAAGGTGTGGCTGAAAGGGCCAAAGACTAACTGGATACCCCTGAGTCGCAATTGGGGTCAAAATTGGCAATCA
AACGCTCTCTTGACAGCTCAATCCCTCTCTTTCACAGTCAAAGCCAGCGACCATCGCTCTTCTACTTCATGGAATATTG
TCCCTTCTCATTGGCAATTTGGCCAGACTTTCACTGGAAAGAATTTCAAAGTCTAATATCAT

FIG. 2 continued

> SEQ ID NO:3404 27429 119329_300025_1
ATGGCATCTTTCAACTGCAGATGGATATTGAGTTTCTTCCGCATTGCGACAATGGCGCTTTTTCACCAAGCAATAGCCT
ACGGCTACTATTCCACCCCTAAGTTTAACGCCCTGCCATGGAAGCTTGCTTATGCCACGTTCTACGGAGACGAGACTGC
TTCTGAGACAATGGGTGGAGCTTGTGGATATGGGAATTTGTTCAATTCTGGCTATGGAACAGCTACAGCAGCATTGAGC
ACGGTGTTATTTAGCAATGGATATTCATGTGGGCAATGCTTCCAAATAAAATGTGTGAACTCTAAGTTTTGCTACAAAG
GATTTACCACCGTTACAGCCACAAATCTCTGCCCACCCAATTGGGCCCAAGACTCCAACCATGGTGGCTGGTGCAACCC
GCCACGTCAACACTTTGACATGGCTAAACCTGCTTTCATGAAAATTGCTCAATGGAAAGCTGGCATTGTCCCTGTTATG
TACCGCAGGGTACCTTGCATCAAGAAAGGCGGGATCCAGTTCGCGTTCCAAGGAAACGGCTACTGGTTATTAGTATACG
TGATGAATGTCGCTGGAGGGGAGATGTGGCAACTATATGGGTGAAGGGAAGCAAAACAGGGTGGATGAAAATG

> SEQ ID NO:3405 27429 108452_300382_1
TTTCCTTTTCCTTTTCCCTCTTCTCTCTCTGTTTACTTGTTCACACACTGAATCACTATAGTGTGTGAGAAAATGGCTG
TAACTAAGATACTCTGCATTGCTACTACTCTTTTCTGTTTTCTCACCGCCGTCAATGCAAAAATCCCCGGCCGCTTACAC
CAGTGGCCCCTGGCAAGGCGCCCATGCCACTTTCTATGGTGGCTCCGACGCCTCTGGCACTATGGGTGGAGCTTGTGGA
TATGGGAATCTGTACAGCCAAGGGTACGGAGTGAACAATGCAGCACTGAGTACAGTCCTGTTCAACAATGGACTAAGCT
GTGGAGCTTGCTTTGAAATTAAGTGTGTTGACGATGGAAATGGTGCCTTCCCGGTAACCCATCGATTTTCGTCACGGC
TACTAACTTTTGCCCACCAAATTTCGCTTTGCCGAACGACGACGGTGGGTGGTGCAACCCGCCACGTCCTCATTTTGAC
TTAGCCATGCCTATGTTTCTCAAAATTGGTCAGTACCGTGCCGGAATTGTCCCAGTCACTTACCGCCGAGTACCATGCC
GGAAAGCAGGAGGGATCCGATTCACAATAAACGGGTTCCGTTACTTCAATTTACTAT

> SEQ ID NO:3406 27429 282184_200072_1
TAACAATGCAGGGGGTTGGTGTAATCCTCCCCTTCACCATTTTGACCTCTCTCAGCCTATTTTCCACACATTGCTCAGT
ACAAAGCTGGAATTGTCCCTGTTGCTTACAGAAGGGTACCCTGCAGAAGAAGGGGAGGAATTAGGTTCACAATCAATGG
ACACTCATATTTCAACCTTGTACTCGTAACAAATGTTGGTGGTGGTGGTGATGTTCATGCTGTAGCTGTAAAAGGAACA
AGAACTGGTTGGCAACCAATGTCAAGAAACTGGGGACAAAACTGGCAAAACAACAACTACCTTAATGGTCAAACACTCT
CATTTAAGGTCATTACAGGTGATGGCCGCAGTTTGATTTCCTACAATGTTGCACCAGCTCATTGGTCTTTTGGACAAAC
TTATACTGGAGCTCAATTCCACTGAAAAAACTTTGGCTGCTCAAGAATTTAATATTTTAGATAAATGGGGTTTTAAGTT
TGTAGTATATTAGTAGTATACTAGTATTAATGTTATGTATACTAATTTTGTCACTAGTATTAGTATTGTGACTGTTTTA
GTATAGAATGGGTGTACTCAAATAGAGTATATAGGAGGACTATGTCTATTTGGGAGGTTTTAGTGGCCTCTAGGGTTAA
AAAATGAAAAGGGCATATTTTAAAATTGTCCTTTTTTTCATTTTTA

> SEQ ID NO:3407 27429 284213_200096_1
tttcagttaaggtgtgtcaatgctcGACAGTACTGCTTGCCTGGCACAATTACTGTCACAGCAACAAATTTTTGCCCAC
CAGGTGGTTGGTGTGACCCTCCCAATCACCATTTTGATCTGTCTCAGCCTGTCTACTTGCGCATTGCTCAATATAGATC
TGGCATTGTTCCTGTTGCCTACCGAAGGGTACCTTGTAGAAGAAGGGGAGGAATTAGATTTACAATCAATGGTCACTCT
TACTTCAACTTAGTACTTGTGACCAATGTTGGCGGAGCAGGAGATGTACGATCATTGTACATCAAGGGATCAAGAACTC
AGTGGCAACCAATGTCAAGAAATTGGGGCCAAAATTGGCAGAATAACGCTTACCTCAATGGCCAAAGCTTATCTTTCAA
AGTCACCACAAGTGATGGTCGCACTGTAGTTTCTTATAATGCAGCTCCTCGTTCCTGGTCTTTTGGCCagACTTTTACT
GGAGGCCagTTCCGTTAATATCAAATTTTTTCAAGTATAGTGCTTACTATATATTTAATTTAAATATTATTCcAAGAGT
TGGCCTTAATGGCTTTTACTCACCATAATTTAAGAAAAAAAAAATggcacTTTTTGCTTGgccattcaattgtgGAaga
AAAGGaATTGATTCGgccTACTTTTTTTTG > SEQ ID NO:3408 27429 284159_200158_1
AAAGGTTCCTCATTAATGGCTAATCTACCAACATTCTCCATTATCTCACTTCTCTTCTTCTTTTTAAGCTTTTGCTTTC
ATGCAACTTTTGCTGATTATGGTGGCTGGCAAAATGCTCATGCCACTTTCTATGGCGGTGGTGATGCCTCTGGCACTAT
GGGGGGTGCTTGTGGATATGGAAATTTATATAGCCAAGGGTATGGAACCAACACTGCAGCACTAAGTACAGCACTATTC
AACAATGGTTTAACATGTGGGGCTTGTTACGAGCTTACTTGCAACAACAATGGTCAATCATGCCTCCAAGGGAGCATTA
CTGTGACTGCAACAAACTTCTGCCCTCCAAATCCATCCCTCCCTAACAACAATGGTGGTTGGTGCAATCCCCCTCTCCA
ACACTTCGATTTAGCTCAGCCTGCTTTCTTGCAAATTGCCAAATACAGAGCTGGAATCGTTCCTGTTTCTTTCCGAAGG
GTGCCCTGCAGGAGAAAGGGGGGTATAAGGTTTACAATAAATGGACACTCATTCTTCAACTTGGTTTTGGTGACTAATG
TTGGGGGTGCTGGTGATGTTCAATCAGTATCAATTAAAGGGTCTAACAGTGGATGG > SEQ ID NO:3409 27507 24061_300102_-1
GCGACCAGCTTGACACAGTGAGTTCTTCCCACGCTGTGTGACCCTAGGAGGGCGACGAGGCCGGGAGTGTCGATACCGA
TGGATTTGAACTTTTCAAGAACGACGGAGATACTCTCGTTGTGGTCGGGAAGATATGACTCGAGCATATCCGTCCTGCT
TTTAAGTCCATCTCTCCTTCCTGTCTTCAAAGGAATATAAGGTCCTCCTACTGCTTCGATGCCTTCTCTTGCGGACAAG
ACGAGAATGTCAGAACATGAGACAACACCAGGACACTCCCTCTCGAGAGCTTCCTTGATCTCCTCGATGTACCTAAAGT
TTCTAAGTCCGAAGCTCCTGTCGTGTTCTTTCTCTCCTAGCTCTCTTCTTGTCGAATCCAGCAAAAGCGACGCATCACA
TGACTCAACGGCGCAGTCATGGAAGATGTTACGGAGCCAAGAGAAAGCGGTGTTCTTGTGGCGTTTGTAGAGGAGTTTG

FIG. 2 continued

```
ACTTGTTCACGGACGATGTCTTCGGCCTGAGGACACGTGTCCTTGTAGAAGTTCATCATCAAACCTGGCTCAGCCTCTG
TTACTGCTTCAGATGTTGCAGAGAGTGCCCAAAGGCAAAGTATCGCCACCATCATCACACCTTTGCCTCCCATTTTTTT
TCTCTATCTTTCTTCTCTCACTCggacGCGTGGGTCGACccGGGa > SEQ ID NO:3410    27507    243941_301553_1
atgaccagtaagtatgtgtGGCTACTAAATGGCTTCCATGTCTCAGCAGCAGCTTCTTGTCGGTCTTTTTCTACTTCTC
ATTGCGGCATTGTGTTCTTCATCTTCCTCTGCTTCTTCGCTTCACAGCTATGCTCAGTCTTGTCCGAGAGCCGAGCAAA
TCATTGCCGACACTGTGAGGGAAGCGGCTGACAGAGATCCAACCACCCCCGCCGGCATTATCCGCTTGTTCTTCCACGA
CTGCTTCGTTGAGGGATGTGATGGATCTCTGCTGTTGGAATCGACACCCACCAATGGCAGGGACGTGGAGATGTTTGCA
CTCGGGAACAACAACTCTGCGCGTGGTTTCGAGATCATTGAGTTGGCGAAGACCCGGCTGGAGGCTGCCTGCCCGGGGA
CCGTGAGCTGCGCGGACACGCTCGCCATTGCTGCCAGAGACGCCACAACTCGCTTTGGAGGACCTTTCTATACTGTGCC
TACGGGTCGCTTCGACGGACGGGTCTCGAGCAGGAcgttggcCGACGCACGACTGCCGGGTCCCTCCTTCACTTTTGTT
GAGCTGAGAGACAACTTTTGGGAGAAACGcttgtcggtccatgATCTCGTCGTCCTCTCTGGTGGACACACCATtGgtc
g > SEQ ID NO:3411    27507    39132_300099_-1
cccacgcgtccgcaagtaacaaaaatggctatctcaaagcttattcctactcttgtgctctttgttttgttctcttttg
aTGTTAGTGTTGCTCATCCAGGTCTAGGATTTGGATGGGGAAGTAATAGTCCCATTGGAGGATCTTTTTACTCAAATCT
TTACCCACAATTTTACCAGTTCTCTTGTCCACAAGCTGATGAGATTGTTATGACGGtgCTCGAAAAAGCCaTAGCTAAA
GAACCAAGAATGGCAGCATCTTTACTCAGACTTCACTTCCACGACTGCTTCGTTCAGGGCTGTGATGCATCAATCTTGT
TGGATGATAGTGCAACCATAAGAAGTGAAAAGAATGCTGGACCAAACAAGAACTCCGTTAGAGGGTTTCAAGTAATCGA
CGAGATCAAAGCCAAACTTGAGCAAGCTTGTCCTCAAACTGTCTCCTGCGCCGACATTCTAGCTCTAGCTGCTCGTGGC
TCAACTATACTGAGTGGtggaCCATCATGGGAGCTtccACTAGGGAGGAGAGACTCGAggACCGCTAGCCTTaaTggCG
CAAACACGAACATTCCTGCACCTAACTCAACTATTCAAAATCTCttaACCATGTTCCAACGTAAAGGTTtgaAcgaAaa
agaCcttgtTTccctatcaGGaggacatacgaTTGGAGTagcgaGgtgccCAACGTTtaACAAAgactataccaTcaa
AAcGGtaaTAaCccacccgacGAgacgcTaaagaGGtcttaCTActatgGtctcaGGTCAATTTGTCCCCCcacagGCG
gtgacaacaaTATTTcacCtttagaCTTagcCtctCcTGcAagaTtTgacaacacAtACTTCAAGCTCCTTTTATGGGG
CAAAGgcttATtgacatcaaatgaagtgctTTTCCCTGGCAatgTAGGCAagaCtGgtgccttagtgaAAGCTtatgcC
gAAAACGaAaGACTTTTTTtcccacaaTtcgcAAagtcGaTGgttaaCATGGGAAAcatTCAGCCtcttaCtGGTTTTA
ATggtgaGaTCAGGAAAAGTTGTCATGtGATTAaCtAAAAAAACTgtgTgTTTTTGcattattattgtattaaggggtg
attaaaaataagtcgtgttatgttttcgatatgttagtgatttaattaacgtctttgaccg > SEQ ID NO:3412    27507    286549_200110_1
GACCAGTCCAACATCCAGTCTTTTTTCTTCTTTTTCTTTTTATTCCTTCATTGTTACAGAGAACAAATTAGAAAGCTGT
CTGAAACACCAGAAATATATGGAGAAACTACAAATGTATGTTAACCAAACACTATGTTTATACAAATACAACAAACTTT
TCTTTCTTGGTTTCTTGTGTTTGTTAACACTCTTTCCAACTTCATCTTCAAACCTTTCCTTCGATTTTTATGCACTGTC
TTGCCCTACAGCTGAATTCATGGTGAAAAATACAGTGAGATCAGCTTCCTCTATGGACCCAACACTCCCTGGAAAACTT
CTTCGTCTCCTTTTCCATGCTGTTTTGTTGAGGGTTGTAGTGCATCTATACTTTTAGAAGGGAAATGGAACAGAGAGAA
GTGATCCAGCAAACAAGTCACTTGGAGGATTCTCAGTAATAGAATCTGCAAAAAGAGTATTGGAAATCTTTTGCCCTCG
AACTGTTTCTTGTGCCGATATTATTGCATTGGCTGCTAGAGATGCTGTTGAATTCGCAGGAGGGCCAAATGTTCAAATT
CCAACTGGGAGAAGAGATGGGAAAATTAGTTTGGCTTCAAACGTGAGACCAAATATAGTGGACACAAGTTTCTCAATAG
ATCAAATGATTGATATATTTTCTGCAAAGGGATTGTCTTTGGATGATCTT > SEQ ID NO:3413    27507    283854_200095_1
aagaagtaatttatttcttagtttctcaatatcactaatggcttctcttggacttggtttaatccttgtaataatgttc
tTTCTATCTATATTCCAAGCATTTTCAGCTTCCACTTCCCATATTGGTGGTGACTATGCTAATCTTTATccacaattct
ACCAATTCACATGTCCTCAAGCTAATGATATTGTCATGTCTGTTTTAGAAGAGGCCATTGCTAAAGATTCAAGAATGGC
TGCTTCTCTACTTAGACTTCACTTCCATGACTGCTTTGTCCAGGGATGTGATGCATCCATATTATTGGATGGGAATAAA
GAATTCAAAAGTGAAAGGATGCTTCACCAAACAAGAATTCTGCTAAGGGATTTGAAGTGATTGATGAGATTAAAGCTA
AACTGGAACATGTTGTCCTCACACGGTCTCCTGTGCTGATATTCTAGCCCTTGTTGCTCGTGACTCTGTCCTCCTGAG
CGGTGGACCATTTTGGGAAGTGCCACTAGGAAGAAAGGACTCAAAGATAGCAGACTTCAACAGAGCAAGTATCGACATC
CCTGGACCAAACTCAACAATCCAAAACCTCATAAATCTTTTCAACAAACAAGGCCTAAAGGAAGAAGACCTTGTTTCTC
TTTCTGGAGGGCACACCATAGGGGTGGCAAGATGTGTGTCATTTAGGCAAAGGCTATACAATCAAAATGGTGACAATTT
GCCAGATGCAACTCTAGAAAGAGATTACTACTATGATTTGAAATCAATTTGTCCAACAAAGGGTGGAGACAATAACATT
TCTCCTCTAGATGTTGCTTCCCCTGTCAAATTTGATAATTCATATTTCAAGCACTTGTTAAATGGCAAAGGTCTTTTGA
ACTCAGATGAAGTACTTTTCACTGGAAATGTACAAAAGACTACAGAATTGGTGAAGAATTATGCTGAAAATGAGGGACT
TTTCTTCCAACAATTTGCAAAGTCTATGGTGAAAATGGGGAATATTAATACTCTGAATGAATTGAAGGGTGAAATTAGG
AAGAATTGTCGCATAGTTAACTAAAATAAATTAGTACTACTCTGTATTTATGAATAATTGCATGATCATGTTTAGTTCC
TGAGTTTTCTTTTGAATAAAGCTTTGGTTAGATGG
```

FIG. 2 continued

> SEQ ID NO:3414 27507  268468_200120_1
AAGAAGCTAGCTTTTGGTTTCTTAGATTATATTCCATAGACATTTCATTGATCATGGCTTTTCGTGTGAGTCATCTGAG
CCTTGCACTAAGCCTTGTGGCACTTGCACTTGCAGGTGTTGCTATTTATAGAAACACTTATGAAGCCATTAATTTGGGA
CTTCAAATGCTCTCTCCAGATTTTGATTTGCGGGAGTCAGCAGTCAGCATTTTAACCCTAAATAATGTTGATCAGCAAA
ATTCACACAAGTTGAGCCAGCAATCTCCAGAATCATGCGCCTTCTCAGCTGTTCGCGGAGTTGTAGACAGTGCTATTGA
CACAGAAAGACGCATGGGAGCTTCTCTTATTCGTCTCCATTTCCACGACTGCTTTGTTGATGGTTGCGATGGAGGTATT
CTTCTAGATGATATTGCTGGATCATTCCAAGGAGAACAGACCTCACCACCCAACAACAACTCAGCCAGAGGTTTTGAAG
TCATAGCACAAGCTAAACAAAGTGTAAAAGATACTTGTCCCAACGTATCTGTTTCTTGTGCAGACATCTTAGCCATTGC
TGCTCGTGATTCTGTTGTTAAACTTGGAGGACAAACCTATAACATTACACTGGGGAGAAGAGATGCAACAACCGCCAAC
TTCACTGGTGCTTTAACTCAACTTCCAGCTCCATTCGACAACCTTACCCTCCAAATAACGAAGTTCAGTGACAAAAACT
TTACTGTCCGGGAAATGGTGGCGCTAG

> SEQ ID NO:3415 27507  242849_301333_1
GGCAGCGGCAGTATTCGTGATTGCAGTGTTGCTGTCTCTGCATGGCAGTGCTTTCGGCCAGCTGAGCTCGACCTTTTAC
AGCTCCTCTTGCCCGAACCTCATCAACATCGTGAGAAACGGCGTCCGGCAGGCAGTTCAAGCAGAGGCTCGAATTGCTG
CCTCGTTCGTTCGACTCCATTTTCACGACTGTTTTGTTAATGGATGTGATGCTTCTATCCTGCTGGATGGCTCAAGTCT
GGAGCAAAACGCATTCCCAAACGTCAACTCTGCCAGGGGTTTTGACGTTGTGGATTCCATCAAGAGCTCCGTCGAGAGC
TCGTGTCCGGGCGCGGTTTCTTGTGCCGACTTGCTAGCACTCATAGCTCGAGAATCCGTCGTCGCGCTCAATGGACCTT
CGTGGACTGTAGTGTTCGGAAGAAGAGACAGCTTATCAGCGAGCCAGGCTGCAGCAAATGCCAATCTTCCTCCACCGAC
TTTCAACGCCTCCGCACTCATCGCTAACTTTCAGAACCAGTGACTTTCAGCGACAGACATGGTAGCTCTCTCGGGTGCT
CACACTATTGGACAGG

> SEQ ID NO:3416 27507  105169_300371_1
CTTGAGTAATCTTGAAAAAAAACCTAAAAAGTAGACAATCATGTCTTTTTTAAGATTTGTTGGTACAATTCTTTTCTTG
GTCGCAACTTTTGGAGCATCAAATGCTCAGTTAAGTGCAACATTTTATGATACCACTTGCCCTAATGTTACAAGTATTG
TACGTGGTGTTATGGATCAAAGGCAACGTACTGATGCTCGAGCTGGTGCCAAAATTATTCGTCTTCATTTCCATGATTG
CTTTGTTAATGGTTGTGATGGATCAATTTTGTTAGACACAGATGGGACTCAAACTGAGAAAGATGCAATTCCTAATGTT
GGTGCAGGAGGATTTGATATTGTTGATGATATTAAAACTGCATTAGAGAATGTATGCCCTGGTGTTGTATCTTGTGCAG
ATATTTTAGCCCTTGCATCTGAAATAGGAGTTGCCTTGGCTGGAGGTCCGTCGTGGCAAGTACTATTTGGCAGAAGAGA
TAGCTTAACAGCAAACCGATCTGGAGCTGAGAGTGATA

> SEQ ID NO:3417 27507  126040_300633_1
ggcttcaatttcccttctttgttttgcttcttcactcgtgctgatcatttccgcgggactttcggtccactttcatcaa
aCAGAAGCTCAAGGTACGCAACCAATTGTGAAGGGTCTTTCATGGACTTTCTATGACTCCATTTGCCCCAATGCTGAAT
CCATCATCAGAAGCCGCCTCCGGCAGGTTTTCCGGCAGGATATTGGCCAGGCTGCCGGCCTTCTTCGCCTTCACTTCCA
TGACTGTTTTGTCCAGGGTTGTGACGGATCAGTACTATTAGATGGTTCAGCGAGCGGACCAAGTGAGAAAGATGCACCT
CCCAACTTGACTTTAAGACAGCAGGCATTTAGGATTATTGAAGACCTTCGACGCCGTGTGCATCGAGAGTGCGGTAGGG
TGGTCTCTTGCGCAGATATCACAGCCATTGCTGCTCGCGATTCTGTTTTCTTATCTGGTGGCCCTGATTATGATCTACC
TTTAGGTAGAAGGGATGGACTCAACTTTGCAACAAGAAATGAAACCCTAGCCAACCTTCCACCTCCTTCATTCAACACA
AGTGCCATTCTAACTTCACTTGCCACCAAAAACTTCACCCCAACTGATGTTGTTGCACTTTCTGGTGGCCACACCATTG
GCATTGGTCATTGCACTTCTTTCACCGAGAGACTTTACCCTAACCAAGATCCATCCATgg > SEQ ID NO:3418 27507  133557_300450_1
GGTTCCAAAGTTTTCTTTTTCTTTGCTATCATCTTCTTTTCAGCGTGTCTCTGCTTTTGCGGAGGACAATTCTGGCCTT
GTAATGGACTACTACAAGGACACTTGCCCTCAAGCTGAAGATATTATCAGAGAACAAGTGAAGCTTCTCTACAAACGCC
ACAAGAATACTGCATTTTCTTGGCTCAGAAATATCTTCCATGACTGCTTTGTTGAGTCATGTGATGCTTCGTTGTTGCT
GGACTCAACAAGAAGGATGCTGTCCGAGAAGGAGACAGACAGGAGTTTTGGTATGAGAAATTTCAGATACATTGAGACT
ATTAAGGAAGCTGTTGAAAGGGAGTGTCCAGGTGTTGTTCTTGTGCTGATATTCTTTGTTTTGTCTGGTAGAGATGGCA
TTGTTGCTCTAGGAGGGCCATATGTCCCACTCAAAACTGGAAGAAGAGATGGAAGAAAGAGCAGAGCAGACATTCTTGA
GCAACACCTCCCTGACCACAATGAGAGCATGAGTGTTGTTCTTGAGAGGTTTGCCAATGTTGGTATCAACACTCCTGGA
GTTGTTGCCTTGCTAGGGGCTCACAGTGTGGGAAGAACACACTGTGTGAAGTTGGTTCACCGTTTGTATCCAGAAGTAG
ACCCTCAACTCAACCCAGACCATGTTCCTCACATGCTCAAGAAATGCCCTGACCCAATCCCAGACCCAAAGGCTGTAC > SEQ ID NO:3419 27507  137952_300687_1
CCCACGCGTCCGGAGGACGTCGTGCTGGGCGAGATGAGGATGATCCTCGAGGAGGATCCCACGCTCGCGCCGTCTCTGC
TCCGGATGCACTACCACGACTGCTTCGTCCAGGGGTGTGACGGATCGATCATGCTGAGGTCGAGGAGCGGGAAGGGGGA
GAGGGACGCGACGCCCAACCGGAGCATGCGGGGCTACGACGCCATCAATCGGATCAAGGCGAGGCTGGAGACCGTCTGC

FIG. 2 continued

CCGCTCACCGTCTCCTGCGCCGACATCATCGCCATGGCGGCGAGAGACGCCGTCTACCTGAGCAAGGGGCCGTGGTACG
ACGTGGAGACCGGGAGGAGGGACGGCGACGTGAGCGTGGCCGAGTACGCCGAGAACGACCTGGCGCCGCCGGACTCCAA
CATCGTCGACGTCAAGACCTTCTTCAGCGTCAAGTCTCTCAACGCCAAGGACATCGCCGTGCTCTTCGGATGCCACAGC
ATCGGGACGTCGCACTGCGGGGCGTTCCAGAAGCGGCTGTACAACTTCACCGGAAGGATGGACCAGGACCCGTCGCTGG
ACGCCGGCTACGCGGCGAAGCTCAAGAAGCTCT

> SEQ ID NO:3420  27507   137806_300705_1
CCCACGCGTCCGGCTCAAACACACACACGGCACTCCATTTTTAACAAGTGTTTTCTCTCTGACAAGCCAGCTGCACTTA
AGCATTGCTAGAGCGCTAAGCTACCTGCAGCGTAGTGTAGTGTAGTGTACTGCCATGGCAGTGCGCGTGCTTCTTCCTC
CTCCTCGCCGGTGGTTCTTGCTTTCTTCTCTGCTGCTGGTGGTGGCGGCGGCTGTTCCCGTCGTCCATGGATACGGCGG
CGGCGGTGGGCTGACGGTCGGGTTCTACAAGGAGTCGTGCCCGGAGGCGGAGAAGATAGTGCGCAAGGTGGTGGCGGCG
GCTGTCCATGACGACCCGACCACCACCGCCGCCGTGCTCAGGCTTCACTTCCACGATTGTTTCGTCAGGGGGTGTGAAG
GATCGGTGCTGATCAACTCGACCAAGAAGAACACGGCGGAGAAGGACGCCAAGCCGAATCACACGCTGGACGCGTACGA
CGTCATCGACGCAATCAAGGAGAAGCTGGAGCACAAGTGCCCCGCTACCGTCTCCTGCGCCGACATCCTCGCCATTGCT
GCCAGAGACGCCGTCTCCTTGGCAACAAAGGCGGTGAGGCAAGGACGGTGGAGCAAGGACGGCAACTTGTACGAGGTGG

> SEQ ID NO:3421  27507   144469_200135_1
ATTACTAAGCAAAAAATCATAGTACAAGCTGCTATTGAGCCTTAAAAAAATGGATTCCAAGAGCTTCAACCTTTCAGCT
TTTGCACTTTTAGCTTGCCTGATTTTATCTTTTTCAGTATCATCTCTTGCCTATGGGAAAAAAACAACATGGCCACCAC
TTAAAGTTGGTTTCTATAGATATAGCTGTCCCTCTGCGGAAGCAATTGTGAAAAATGTTGTATACAAAGCCGTATCGCG
TAATCCAGGCATTGCTGCTGGCCTTATCAGGCTCCATTTTCATGACTGCTTCGTCAGGGGGTGTGATGCATCAGTACTA
TTGGATGGACCAAACTCAGAGAAGGAAGGTGTTCCTAATAAGAACAGTTTACGTGGTTTTGAGGTTGTTGATGAAGCAA
AAGCACAACTTGAGGCTGCATGCCCTGGAACTGTGTCTTGTGCTGACATTCTTGCCTTTGCTGCTCGGGACAGTTCCTA
TAAAGTTGGGAAAATAAACTATGATGTCGAAGCTGGACGTCGCGATGGGCGTGTTTCCATTGACTCTGAAACATTAACC
AACCT

> SEQ ID NO:3422  27507   112425_300002_1
TACTCCTAAGAGGTTACGTAAGAAGCCACTTTGATGCATTTAGCTGTTTGTGTATTAACGCGTATGAAAATGTGAACCG
AATAAACTATTTTTGACATGGCCACTAGGTGTTAGTTGACGATGCATATGGCCAGCGTCAGAACCCCCTTCTCCTCCAC
CTCTATATATATTTCTTGATTGACTTTGACCAGCTTCATCACTAGATACTAGGGAATACCCAGAATACCTGTACAAACT
ATATATCTTCAATTTGTAGAAAACTCTGTCAGAAACATCCTTCTGTTCTGTGAAAATGATACCGCCATTAATATTTCTC
TCTTGTGTTTTTCATTTAGTTTCAGCTCAACTTCGAGTTGGCTTTTACAATTCTACCTGTCCACAAGCTGAAACTATTG
TTCGACAAGCTGTGCAAAAGCAGTTCAATATCGACCGTTCCATCACTGCAGCTCTGCTTCGCATGCATTTTCATGACTG
CTTTGTGAGAGGTTGTGATGCATCCATACTCATAAAGTCAACGAAGTCTAAGCAATCAGAAAGAAGTGCTGGACCAAAT
CAAACAGTACGAGGTTTCGAGCTTATAGATAATGTTAAGAAAAGCATAGAAACATCATGTCCATCAACTGTTTCATGCG
CTGACATAATAAC

> SEQ ID NO:3423  27507   227856_301031_1
caacaagcattctcttctaccttagcctactagctagctttgttgtctactctgatcgaggttggtggtgatcatggcg
tCGTCGAGGGTGATCctagcgCTGCTGCTCGCGGCGGCGGCGGTGATGGCGTCGTCGGCGCAGCTGGACGaGaaaTTCT
ACAGCAATTCGTGCcccagcgTggAGGCCGTCGTCCGGAAGGAGATGGTGCGCGCGCTCGGCGCCGCGCCCAGCCTCGC
CGGCCCGCTCCTCAGGATGCACTTCCACGACTGCTTCGTCAGGGGTTGCGACGGCTCGGTGCTGCTCGACTCGGCCGGG
AACAGCACGGCGGAGAAGGACGCGACGCCGAACCAGACGCTGCGCGGGTTCGGCTTCGTCGAGAGGGTGAAGGCCGCCG
TGGAGAAGGCATGCCCGGGCACCGTCTCCTGCGCCGACGTGCTCGCGCTCATGGCCAGGGACGCCGTGTGGCTGAGCAA
GGGCCCGTTCTGGGCGGTGCCTCTCGGCCGCCGCGACGGCAGGGTGTCCATCGCCAACGAGACCGACCAACTGCCGCCT
CCCACCGCCAACTTCACCGAGCTCACCCAGATGTTCGCCGCCAAGAACCTCGACCTCAAGGACCTCGTCGTCCTCTCCG
CTGGGCACACGATCGGGACGTCGCACTgctTCTCCTTCACTGACAGGCTGTACAACTTCACCGGCCTGGACAACGCCCA
CGACATCGACCCGACGCTGGAGCTGCAGTACATGGcgagGCTGAGGAGCAAGTGCACGAGCctccAAGAcaACACGACG
CtggTGg > SEQ ID NO:3424  27507   227781_301026_1
ccacgcgtcgcgagaagcatagctcgcttccacgcaagattaaaagctgcccctcttgctgctgcagactgcagtcctg
cAAGATCAGCGCCTGAAGCAAGAAGCGAAGAATCAAACGAGAGCctagcagcgtAGCAGATCGATCGATCGATCGATAT
TATGGAGGCGCGAGGAAGCAGAGGAATGCGGCTGTGGCTCCTGtcCGTGGCGGTGAtggccatggcgatggcgacgaGG
TCGCAGGCGCAGCTGCAGGTCGGGTACTACGACACGCTGTGCCGGCGGCGGAGATCATCGTGCAGGAGGAGGTCAGCA
AGGCGGTGTCCGGGAACCCCGGCATGGCCGCCGGCCTGTCCGTCTCCACTTCCACGACTGCTTCGTCAGGGGGTGCGA
CGCGTCGGTGCTGATCGACTCGACGGCCGGCAACGTGGCGGAGAAGGACGCCAAGCCCAACCTCACTCTCCGCGGCTTC
GGGGCGGTGCAGCGGGTCAAGGACAAGCTCAACGCCGCCTGCCCGGCCACCGTCTCCTGCGCCGACGTCCTCGCCCTCA

FIG. 2 continued

TGGCCCGTGACGccgtcgTCCTCGCCAACGGGCCCtccTgGCCCGTCTCGCTCGGCCGCCGcgacgGCCGcctctccAt
cgccAACGACACCAACCAgctgccgccCCCCAccgccAacttcaCCCAGctctccCAGATGTTCGCCgCCaaagGcctc
gacgCcaaggaCC > SEQ ID NO:3425 27507 226811_301228_1
GAGTACGACGAGAGCTAAGTAAACTTAGCTATATCGATCGACCATGGCGTCCAGGACTAGTGCTACTGCCGGCATGCTG
CTGCTCGCCGCCGCGGCTGCGCTGGTGTGCAGCTCGGCGGCGGCGAGGATGCCGCCGTTGGCGAAGGGGTTGTCGTTGG
GCTACTACGACGCGAGTTGCCCGCAGGCGGAGGCCGTCGTGTTCGAGTTCCTGCAGGACGCCATCGCCAAGGACGTCGG
CCTCGCCGCGGCGCTGATCCGGCTCCACTTCCACGACTGCTTCGTCCAGGGCTGCGACGCCTCCATCCTGCTCGACAGC
ACACCCACCGAGAAGAGCGAGAAGTTGGCGCCGCCGAACAAGACCCTCCGCAAGTCGGCGTTCGACGCCATCGACGATC
TCCGCGACCTGCTCGACAGGGAATGCGGCGACACCGTCGTGTCCTGCTCCGACATCGTCACCCTCGCCGCCCGCGACTC
CGTCCTCCTCGCCGGTGGCCCGTGGTACGATGTTCCCCTCGGCCGCCACGACGGCTCCAGTTTCGCGTCTGAGGACGCC
GTCCTGAGCGCGCTCCCGTCGCCGGACTCCAACGTCACCACGCTCCTCGAAGCGCTGGGCAAGCTCAAGCTCGACGCCC
ACGACCTCGTCGCCCTCT > SEQ ID NO:3426 27507 209330_300814_1
gagaagtagaaacaaacagagagcaattctcttctcctacctagcaacctagtgcagtgcagtgcagtgcagcgaaggt
tTACTTGGCGACTTCCATGGGTTGCCTGTTGATGCTCTGCTTGGTTTCTCCCCTCCTCCTCGCCACCTCTGTCCACGGC
AACCCGTGGTATGGGTATGGGTATGGCTTGTTCCGCAGTTCTACGACCACTCGTGCCCCAAGGCGAAGGAGATCGTGC
AGTCCATCGTAGCACAGGCGGTGGCCAGGGAGACCAGGATGGCGGCATCCTTGGTCAGGCTGCATTTTCATGACTGCTT
TGTCAAGGGGTGTGACGCGTCTGTGCTCCTGGACAACAGCACCACCATCATCAGTGAGAAGGGGTCAAACCCTAACATG
AACTCCCTCAGGGGTTTCGAGGTCGTCGACGAGATCAAGGCCGCCCTCGAAGCAGCTTGCCCCGGCACCGTCTCCTGCG
CCGACATACTCGCCCTcGCTGCACGCGATTCCACTGTCCTCGTTGGTGgccCGTACTGGGATGTGCCACTTGGCCGGAG
GGACTCACTGGGTGCCAgcatccagggctcCAACAACGACATCCCAGCTCCCAACAacagcctccccaccaTCATCacc
AAGttcaaGCG > SEQ ID NO:3427 27507 201050_300712_1
ATGGATGTGACGGCTCGATCCTGCTTGACGACACGTCGACGTTCACCGGCGAGAAGAGCGCCGGCCCGAACGCCAACTC
GGCCCGCGGGTTCGAGGTGATCGACGCCATCAAGACGCAGGTGGAGGCCTCCTGCAAGGCCACCGTCTCCTGCGCCGAC
ATCCTCGCCCTCGCCGCCCGCGACGGCGTCAACCTGCTGGGTGGGCCAACGTGGAGCGTGGCGCTGGGGCGGAAGGACT
CGCGCACGGCGAGCCAGAGCGCGGCGAACAGCAACCTGCCGGGGCCCGGGTCGAGCCTCGCCACGCTCATCAGCATGTT
CGGCAACCAGGGCCTCTCGGCGCGCGACATGACGGCGCTGGGGCGCCCACCATCGGCCGCGCCCAGTGCCAGTTC
TTCCGCAGCCGCATCTACACCGAGCGCAACATCAACGCCTCCTTCGCGTCGCTCCGGCAGCAGACGTGCCCGCGCTCCG
GCGGCGACGCCAACCTCGCGCCGTTCGACGTGCAGACGCCCGACGCCTTCGACAACGCCTACTACCAGAACCTCGTGTC
GCAGCGCG > SEQ ID NO:3428 27507 191367_300740_1
atcgatCTTTGTTAGCTAGAGTGTTGAGCAATGGCGTCCAAGCTGGGTATGGTTGTGCTACTGATCTCGGGCCTCTTTG
CTGCCCGTTGCGCGGCCGTGGTGACCACCGGCGAACCCGTCGTCGCCGGCCTCTCCTGGGGGTTCTATGACACGTCGTG
CCCGTCGGTGGAGGGCATCGTGAGGTGGCACGTCACCGAGGCCCTCCGCCGCGACATCGGCATCGCCGCCGGCCTCGTC
CGCATCTTCTTCCACGACTGCTTCCCGCAGGGGTGCGACGCGTCGGTCCTCCTGACGGGTTCCCAAAGCGAGCTGGGTG
AGATACCCAACCAGACGCTGCGGCCGTCGGCGCTGAAGCTCATCGAGGACATCCGCGCCGCCGTACACTCCGCCTGCGG
CGCCAAGGTGTCCTGCGCCGACATCACCACGCTCGCCACGCGTGACGCCATCGTCGCCTCCGGCGGGCCCTACTTCGAC
GTGCCTCTGGGGCGGCGCGACGGGCTGGCACCGGCGTCGAGCGACAAGGTGGGCCTCCTGCCGGCGCCCTTCTTCGACG
TGCCCACGCTCATCCAGGCGTTCAAGGACCGAAACCTGGACAAGACGGACCTGGTGGCGCTGCTCCGGCGCGCACACCAT
CGGACTAGGCCACTGCGGCAGCTTCAACGACCGCTTCGATGGCTCCAAGCCCATCATGGACCCTGTGCTGGTGAAGAAG
CTGCAGGCCAAGTGCGCCAAGGACGTGCCGGTGAACTCGGTCACGCAGGAGCTGGACGTCCGCACGCCCAACGCCTTCG
ACAACAAGTACTACTTCGACCTCATCGCcaaGCAGGGGATCTTCAAGTCCGACCAGggccTCATCGAGGACGCGCAGAC
cAACCgcacc > SEQ ID NO:3429 27507 175048_300529_1
GTTCTGTTGGGGAGAAGGGACTCCACCACTGCAAGCGAGGCCTTGGCAAATACCGACCTCCCTGCCCCTTCCTCTAGCC
TCGCAGAACTTATCGGCAATTTCTCCAGAAAGGGACTCGACGCAACCGACATGGTTGCTCTCTCAGGAGCACACACGAT
CGGGCAGGCGCAGTGCCAGAACTTCAGGGACAGGATCTACAACGAGACCAACATCGATTCCGCCTTCGCGACGCAACGC
CAGGCCAACTGCCCACGGCCGACGGGCAGCGGCGACAGCAACCTGGCGGCGCTGGACACGACGACGCCCAACGCCTTCG
ACAACGCCTACTACAGCAACCTGCTGTCGAACAAGGGGCTCCTGCACTCCGACCAGGTGCTCTTCAACGGCGGCAGCGC
GGACAACACGGTCAGGAACTTCGCGTCCAACGCGGCGGCGTTCAGCATCCGCCTTCACGACGGCCATGGTGAAGATGGG
GAACATCTCGCCGCTGACCGGGACGCAGGGGCAGATCAGGCTCAGCTGCTCCAAGGTGAACTCCTAATTAAGGAGTACT
ATGACGGGATGCGTTCGTTGCTGGAAGCAAA

FIG. 2 continued

> SEQ ID NO:3430 27507  159583_200025_1
GTTTGTAATATTAGCGCTGCTCTTTTGTTTGATTCTTTCTCTTTCTGTATTTGCTGAGGCTTCGTCGAAGAACAAACAT
AAGCCCAAACCAAAAAAATCAACGTTTGGTGTTGGATTCTATAAAGATCATGTCCAGCTGCTGAGGCCATTATTAGAA
AAGCTGTATTCAAAGCGGTTCTGAAGAATCCTGGCACTGCCGCTGGCATTATTCGCATGCATTTCCACGATTGCTTTAT
CAGGGGTTGTGATGGTTCAGTGCTGCTGGATTCAGTAAGAGGAAAGGAAACGGCTGAGAAGATAGTCCCATTAACAAC
CTAAGCCTTCGAGGGTTTGAGGTTATTGATGAAGCAAAAGCACGGCTGGAAAAACTATGTCCGCGCACAGTTTCGTGCG
CGGACATACTCGCCTATGCTGCAAGAGATAGTGCCTTGTTCGCG

> SEQ ID NO:3431 27507  157577_301740_1
GAAAGAGAGAGATCTTTCAAATCAAAGTTGCAAAAAATCTTATAATTATAATGTCTAAATTTGGCTATTTGGGCAATTT
TCTAGTGTTCTGTATTCTACAAGGAATAGTTGGTTCTAGCCATGCTCAGTTACAGCTCAACTTTTATGCAAAGAGCTGT
CCAAAAGCTGAGAAGATAATTCAAGATTATGTCCAAAAGCACATCCCAAATACTCCATCTCTTGCAGCTGCCTTACTCA
GACTGCAGTTCCACGATTGTTTTGTCAGGGGTTGTGATGCATCCGTGCTTTTGAATTTCACTTCGAGCACGAAAAAGCA
GACTGAAAAAGGGGCTATCCCTAATCAAACACTGAGAGGCTTCTCATTCATTGATGATGTGAAGAAAATAGTTGAAGCT
GAATGCCCTGGAGTTGTCTCTTGTGCAGATATTGTTGCATTAGTTTCTAGAGACTCTGTTGTGGTCACTGGAGGCCCTT
ACTGGAATGTTCCAACCGGTAGAAGAGATGGAAAAATATCTAATGCGTCCGAGGCCTTGGCAAACATCCCTCCTCCAAC
TAGTAACTTTTCCAGTCTACAGACATCTTTTGCTGGCAAAGGTCTTG

> SEQ ID NO:3432 3033  3552_300342_1
attcccgggtcgACCCACGCGTCCGCATCTTCTTCAGGCTCATCTTTCATCTCTATTCCATCCCAAACATCTTCTCTAG
TAGCGCATTTGGTATGAAATGTAGACTCAGAACACCTCTTACAAGAATATCCCCCACAACTCCAATCCATTTTCTTACG
ACAAACACCACATACTGAATCAATAATACCAAGAAGAGAAGTGCGAGAAATGCGATGATCATGGCGGTTGATATTGATG
ACCCATGGAAATCCAGAGCAATTGTTATGGGAAGTGAAATTGCATTGAAGACAGACATATGGGCTTCGATCTCCATGGA
GGCCGCAAGTGGTGCAAGTAAAAGAGATCAATTTTGGCATAAGGGTTAGTTCATGgttgtgGgtgttTTGGTCGTGAAG
ATTTAGTGgtggtgGAAGAGAAACACATCGCAAATccaaAGTAAAGttAcaaGCGGAACAgTgAtAAAACATTTCGTCA
AAAATCTTTTtcccacAtaaACTAcaaTtcccAtCagTAtaag > SEQ ID NO:3433 30367  155251_301354_1
tcgaccacgcgtcgttctcttcagattcactcttctctctctcttttctccatatattatgggtttcccagctaacag
cGAAAAGCCATTCAAGTTCTTGATCTATGGCCGCACCGGCTGGATTGGTGGCGTACTCGGCAAGCTCTGTGAAGCTCAA
GGTATAGACTACGTATACGGGTCGGGTCGGTTAGAAAACCGGAGCTGTCTTTGGAATCCGACATATCCACCATCAAACCGA
CCCATGTATTCAACGCAGCTGGAGTCACTGGCCGGCCTAACGTTGATTGGTGCGAATCCCATAAGGTGGAGACCATCAG
AACTAATGTGGTCGGCACTCTCACGCTTGCTGATGTTTGTAGAGAGAAGGGCTTGATCCTTATCAACTATGCTACTGGA
TGTATATTTGAATACGATGCGGGTCATCCGTTAGGGTCGGGTATCGGGTTCAAGGAAGAGGATACTCCTAATTTCACTG
GATCTTTCTATTCCAAGACTAAAGCTATGGTGGAGGAATTGCTGAAGAACTATGACAACGTCTGTACTTTACGAGTCAG
GATGCCCATCTCCGCTGACTTGACAAACCCGCGAAACTTCATCACCAAGATCACTCGATACGATAAGGTTGTCGATATC
CCAAACTCAATGACAATCTTGGAtGAAcTTCTCCCAATATCACTCGAGA > SEQ ID NO:3434 30518  13867_300247_1
CCCACGCGTCCGCTCTTTCGTAAAAATGGCGAGTTTTGAGGAAAGCTCTGATTTGGAAGCTATACAGAGCCATCTCTTA
GAAGACTTGTTGGTTTGTGATGGTTTCATGGGAGATTTTGACTTCGATGCTTCTTTTGTCTCAGGACTTTGGTGTATAG
AACCACACGTTCCTAAACAAGAACCTGATTCTCCAGTTCTTGATCCGGATTCTTTCGTCAACGAGTTCTTGCAAGTGGA
AGGGGAATCATCATCATCATCATCACCAGAGCTGAATTCATCGTCATCAACATATGAGACTGATCAGAGTgtgAAAAag
gcagAG > SEQ ID NO:3435 30518  23975_300104_-1
AATAATAAACGAATTTTTTTATTAACGGTCTTCTTTTTTGAAGAATCATATAATCCAACAAAGAAAAATCAAAATTATA
AAACCAATAAATGATCGCCACGTGCCACTTCAACAACCTCGCACTTCACCGTCAACCCCTTATCCATTCCACCACCGGC
GGCCACCGTTCTCCTCTTCTTCGGAGCTCCGTTCTCGTTAGAAGAAGGAAAAGAAGATCTCTTGGACTTAATCCGAACC
GGGTCGGGTTCTCCTGAATTAACTCTCAACGGAAAATTCAACAAAGCGCGGGAACCACGCATCCTGAAAGCAGCTCTGT
CGTAAGCCAACGCCGCGTCCTCCGCCGTCTCAAACGTCCCTAACCAAACCCTAGCTCCGTTCTTCGCCGGGTCTCTAAT
CTCCGCCGCAAATTTCCCCCACGGCCTTTGTCTCACTCCTCTATAATGCTTTCCCTTCGCCGCCGTCACCGCCGCCGAA
ACAGGACTCGTCTTCCTTCTTGACCGGAACAGAATCCACCGCCGCGAAACTCTCCGGAGTCTCGATCTTAACACTCG
GGAAAGAGCTACGATCTTCGTCGGAAGACGAAGAAGACGGCTCCCAACCGCCGTGAAAGGCGTCGTTGAGGATACCGTA
AACTAACATATCCTCAGAATCGTTTTCTTTCAACGGCAAATCTCCCCAGCTCTCGGTGAAGCAAGGATACAGTTTGCTA

FIG. 2 continued

AAGCTAGGGTTTCGTCCGTACACCGGTTTAATGCTCTGACCGGTTACACAAGATTGAGTAACCGAACTCGCTGTCGACT
CACTGAGTATCGGCTCCGATTCTCCTAGTAAGTGTCGTCGTATGGACTCAAGAAAAGCATAATCAGATTGAGAATCCGC
CGTCATCGACATAACAGAAAGAGAATTATTAAGAATGTTTTTTTGTTGTTTGGTTTGGTTCTTGTTGAGATTTCAAAAC
GGACGCGTggg > SEQ ID NO:3436    30518    55864_300130_1
CCCACGCGTCCGCTTTCTCTCTTTCGTAAAAATGGCGAGTTTTGAGGAAAGCTCTGATTTGGAAGCTATACAGAGCCAT
CTCTTAGAAGACTTGTTGGTTTGTGATGGTTTCATGGGAGATTTTGACTTCGATGCTTCTTTTGTCTCAGGACTTTGGT
GTATAGAACCACACGTTCCTAAACAAGAACCTGATTCTCCAGTTCTTGATCCGGATTCTTTCGTCAACGAGTTCTTGCA
AGTGGAAGGGGAATCATCATCATCATCATCACCAGAGCTGAATTCATCGTCATCAACATATGAGACTGATCAGAGTGTG
AAAAAGGCAGAGAGGTTCGAAGAAGAAGTAGATGCTAGACATTACCGAGGAGTGAGGCGAAGGCCGTGGGGGAAATTTG
CAGCAGAGATTCGAGATCCAGCAAAGAAAGGATCAAGAATCTGGCTAGGAACATTTGAGAGTGATGTTGATGCTGCAAG
AGCCTATGACTGTGCAGCTTTCAAGCTCCGGGGAAGAAAAGCCGTGCTCAACTTCCCTCTTGACGCCGGGAAATATGAA
GCTCCAGCGAATTCAGGAAGGAAAAGGAAGAAGTGATGTGCATGAAGAGCTTCAAAGAACTCAGAGCAATTCATCTT
CATCTTCCTGTGATGCATTTTAGCATATTAAGAGTGTGAGCAGTTTCCTTAAGTTGTATAAAGTAATTGTACAGAGGAA
ACGAATTGTGTAGGTTTAGTGtgcttgcaagttgcaacaaatgtgtatggatgttctgtttcttcatgtccctaagatt
tagaaacatcttcttatttcca > SEQ ID NO:3437    3054    3055_300395_1
CCCACGCGTCCGAAGCATACTCATCCTCTGATTTCGCTGGATTCAGCTGTACAATTCCGCACAAAGAAGCTGCATTGCA
ATGTTGTGATGAAGTTGATCCATTGGCAAAGTCTATAGGAGCTGTGAACACTATACTAAGGAGAAAAAGTGACGGAAAG
TTGTTGGGTTACAACACAGATTGTATTGGTTCCATTTCTGCTATTGAGGATGGCCTACGAAGTTCAGGTGATCCAAGCA
GTGTACCTTCTTCTTCTTCGCCATTGGCCAGTAAAACAGTGGTGGTTATTGGTGCTGGTGGAGCAGGCAAGGCTCTTGC
TTATGGTGCAAAAGAAAAGGGGGCCAAAGTTGTAATTGCTAATCGAACTTACGAACGAGCACTAGAACTCGCAGAAGCA
ATAGGAGGCAAAGCGTTATCTCTGACAGATTTAGATAACTATCACCCAGAAGATGGCATGGTTTTGGCAAACACAACAT
CTATGGGTATGCAACCAAATGTTGAGGAGACTCCAATTTCTAAGGATGCATTGAAGCACTATGCACTGGTCTTTGATGC
GGTATACACTCCGAGAATCACCAGACTGTTGAGGGAAGCAGAAGAAGTGGAGCCATAACTGTCTCAGGGTCAGAGATG
TTTGTCAGGCAGGCTTACGAGCAGTTTGAGATCTTCACCGGTTTACCCGCTCCAAAGGAACTCTACTGGCAAATAATGT
CAAAGTACTGAGACATAGCTTAAGTGTGTGTGTGTGTACTTCCATGAAAAGTCGTCGATTCAATAAAGCTTTAGATTGC
CATTTGTATGTTCCGAGAATGTCCTTTTTTGAGGCCATAAGCcgaatgactggttctctctttgtatttatatatatgt
ataaactattaagcctaacattaatctttttaagtttctttg > SEQ ID NO:3438    316741    1007772_301403_1
ACTTACAACACAGCAAAAGAAGCTTACTTACTTATTCACATACTCACTAACTCACAGTTAGTATCATTATTGAGAGGTC
CAGACTTCGCACAGAGACACCATGTGTGGAGGATCTATCTTATTCTCCTACTTAAGGCAGCAGCAAGCCCTGTCTCAGA
CTCAGATCCAGCATCAGCTTCCCAAATGGGATGAGGGGGATAATAACATTCCCCTTCCTGTTAAGGAAGAGGAGGAGGA
GAATCTGCTTCCCTCTTTCACTGTAGCTGAGACACCTGCCCCTCTTCCCCGTAAGCGGAAGAATCTGTACCGTGGTATC
CGGCAGCGCCCCTGGGGTAAGTGGGCGGCTGAAATCCGCGAACCCCGTAAAGGTGTCCGCGTATGGCTAGGTACCTTCC
ATACTGACGAAGATGCTGACCGCGCTTATGACACCGATGCCCGTCGAATCCGAGGCGACAAGGCCAAGCTCAATTTCCC
TGTTCCTAAATCGCAGCCCTCTTCATCAACTTCTGCGCCCAATTCTGCTACCGATACCCAAAGCAAGAGGCACCGCACC
AATACCAAAGCCTCTCGATGTGAACAGCTGTTCTCTTTCTCCCCTGATCAGAAAGAATCATGGCT > SEQ ID NO:3439    316741    183370_300621_1
CCCACGCGTCCGCTTAGCTAGGACCGACCGATCCGATGTGCGGCGGTGCAATCATCTACGACTACATCCCGGCGCGCCG
CCGGTTGTGCGCCTCCGACTTCTGGCCCGACGCCGACGACTCCGACCCCCACACCCCCGCTCCCGAGAAACCGCCGCGC
GCGAAGAGGGAGCGGAAGAACCAGTACCGCGGGATCAGGCAGCGGCCGTGGGGGAAGTGGGCGGCGGAGATCCGCGACC
CGGTGAAGGGGGTGCGCGTCTGGCTCGGCACCTACCCGACCGCCGAGGCCGCCGCGCGGGCCTACGACCGCGCCGCGCG
CCGCATCAGGGGCGCCAAGGCGAAGGTCAACTTCCCCAACGACTTCGGCGCCGCCCCCGCGCCGGCCGCGGCGGCGGCG
AAGGCCGTCCCTCGCGTCGCGCCCACGCCGGCCGTGCTCCCGCCGCCCAAGATGGAGGCGGTGTCCGAGGGCGCCGGCG
CCTGCTCCTCCGACGAGGTCAAGGAGCTGTCCGAGGAGCTGCTCGCGTACGAGAACTACATGAGCTTCCTCGGCATCCC
CTACATGGAGGGCG > SEQ ID NO:3440    316762    316892_301427_1
GCAGCATGTACGGACAGTGCAATATAGAATCCGACTACGCTTTGTAGGAGTCGATAACACGTCACTTGCTACGAGGAGG
ACGACAGAACGAGCTGCGACTCAATGAGTCAACACCGA > SEQ ID NO:3441    316807    316830_301427_1
gcggcatggattccagagagatccaccaccaacaacagcaacaacaacaacaacagcagcagcagcaacaACAGCA
ACATCTACAACAACAGCAACAACCACCGCCAGGGATGTTAATGAGTCACCACAATTCCTACAATCGAAACCCTAACGCC

FIG. 2 continued

```
GCCGCCGCTgtctcaATGGGTCACAACACCTCCACATCTCAAGctaTGCATCaaagatTACcttgtgttgggtcTATGC
CACcgcatCACCCTCaagaAcATCAGTaTCATCAtcctcagcCTCAGCaaCAGATaGATCagaagactcTcgaaTcTct
cggatttgatggatCGCCTccttcTGttgccGcCActcAACAA
```

> SEQ ID NO:3442 316820 316834_301427_1
```
gcagcaggagagacagccatgCTGTGACAAGCTAGGGGTGAAGAAAGGGCCGTGGACGGTGGAGGAAGATAAGAAGCTT
ATAAACTTCATACTAACCAATGGCCATTGTTGCTGGCGTGCTTTGCCGAAGCTGGCCGGTCTCCGTCGCTGTGGAAAGA
GCTGCCGCCTCCGGTGGACTAACTATCTCCGGCCTGACTTAAAACGAGGCCTTCTCTCGCATGATGAAGAACAACTTGT
CATAGATCTTCATGCTAATCTCGGCAATAAGTGGTCTAAGATAGCTTCAAGATTACCTGGAAGAACAGATAACGAAATA
AAAAACCATTGGAATACTCATATCAAGAAGAAACTTCTTAAGATGGGAATCGATCCTATGACCCATCAACCCCTAAATC
AAGAACCTTCTAATATCGATAATTCCAAAACCATTCCGTCCAATCCAGACGATGTCTCAGTGGAACCAAAGACAACTAA
CACGAAATACGTGGAGATAAGTGTCACGACAACAGAAGAAGAAAGTAGTAGCACGGTTACTGATCAAAACAGTTCGATG
GATAATGAAAATCATCTAATTGACAACATTTATGATGATGATGAAttgttTAGTTACTTATGGTCCGACGaAACTACTA
AAGA
```

> SEQ ID NO:3443 316833 14192_300269_1
```
CCCACGCGTCCGCAAACAGAGAAAATGTGTGGCGGTGCTATTATTTCCGATTATGCCCCTCTCGTCACCAAGGCCAAGG
GCCGTAAACTCACGGCTGAGGAACTCTGGTCAGAGCTCGATGCTTCCGCCGCCGACGACTTCTGGGGTTTCTATTCCAC
CTCCAAACTCCATCCCACCAACCAAGTTAACGTGAAAGAGGAGGCAGTGAAGAAGGAGCAGGCAACAGAGCCGGGGAAA
CGGAGGAAGAGGAAGAATGTTTATAGAGGGATACGTAAGCGTCCATGGGGAAAATGGGCGGCTGAGATTCGAGATCCAC
GAAA
```

> SEQ ID NO:3444 316834 109210_300044_1
```
cttcactcctatcccatatctcttcctctctctccttctttctccatcttttcttttttttaataaagatggatatAA
AACCATGCAACTCTCAAGATGTTGAAGTGAGGAAAGGACCTTGGACTATGGAAGAGGATTTAATTCTCATTAACTACAT
TGCTAATCATGGTGAAGGTGTTTGGAATTCCTTAGCAAAATCTGCTGGTCTCAAACGAACCGGAAAGAGCTGTCGACTC
CGGTGGCTAAATTATCTCCGGCCTGATGTCCGGAGGGGAAATATTACACCTGAAGAACAACTTTTGATAATGGAACTGC
ATGCTAAGTGGGGAAACAGGTGGTCAAAAATTGCAAAGCATTTGCCAGGAAGAACAGATAACGAGATAAAAAATTATTG
GAGGACAAGAATTCAGAAGCACATAAAGCAAGCAGAAAACATGAATGGACAAGCAGCTAATTCTGAGCAAAATGATCAT
CAAGAAGGAAGCAGTAGCCATATGTCGTCTGCTGGTCCAGCAgagaCTTACTCTCCAACTTCATACTCTGCTAATATTG
ACACAACTTTTCAAGGACCTTTTCTCACTGAAACAAATGACAACATTTGGAGCATGGaggaTATCTGGTCcATGCAAtt
gcttaacggcgaTtaagTATGttggtgaaTATtTTaaTtTgatttaatt
```

> SEQ ID NO:3445 316835 262517_301695_1
```
gcagcaatgaactcatTTTCAGCTTTTTCTGAAATGTTTGGCTCCGATTACGAGCCTCAAGGCGGAGATTATTGTCCGA
CGTTGGCCACGAGTTGTCCGAAGAAACCGGCGGGCCGTAAGAAGTTTCGTGAGACTCGTCACCCAATTTACAGAGGAGT
TCGTCAAAGAAACTCCGGTAAGTGGGTTTCTGAAGTGAGAGAGCCAAACAAGAAAACCAGGATTTGGCTCGGGACTTTC
CAAACCGCTGAGATGGCAGCTCGTGCTCACGACGTCGCTGCATTAGCCCTCCGTGGCCGATCAGCATGTCTCAACTTCG
CTGACTCGGCTTGCCGGCTACGAATCCCGGAGTCAACATGCGCCAAGGATATCCAAAAAGCGGCTGCTGAAGCGGCGTT
GGCTTTTCAAGATGAGACGTGTGATACGACGACCACGAATCATGGCCTGGACATGGAGGAGACGATGGTGGAAGCTATT
TATACACCGGAACAGAGCGAAGGTGCGTTTTATATGGATGAGGAGACAATGTTTGGGATGCCGACTTTGTTGGATAATA
TGGCTGAAGGCATGCTTTTACCGCCGCCGTCTGTTCAATGGAATCATAATTATGACGGCAAGGAGATGGTGACGTGTC
GCTTTGGAGTTACTAtaa
```

> SEQ ID NO:3446 316835 263067_301721_1
```
gcagcatgaactcattttctgcttttctgaaatgtttGGCTCCGATTACGAGTCTTCGGTTTCCTCAGGCGGTGATTA
TATTCCGACGCTTGCGAGCAGCTGCCCCAAGAAACCGGCGGGTCGTAAGAAGTTTCGTGAGACTCGTCACCCAATATAC
AGAGGAGTTCGTCGGAGAAACTCCGGTAAGTGGGTTTGTGAGGTTAGAGAACCAAACAAGAAAACAAGGATTTGGCTCG
GAACATTTCAAACCGCTGAGATGGCAGCTCGAGCTCACGACGTTGCCGCTTTAGCCCTTCGTGGCCGATCAGCCTGTCT
CAATTTCGCTGACTCGGCTTGGAGACTCCAAATCCCGGAATCAACTTGCGCTAAGGACATCCAAAAGGCGGCGGCTGAA
GCTGCGTTGGCGTTTCAGGATGAGATGTGTGATGCGACGACGGATCATGGCTTCGACATGGAGGAGACGTTGGTGGAGG
CTATTTACACGGCGGAACAGAGCGAAAATGCGTTTTATATGGCACGATGAGGCGATGTTTGAGATGCCGAGTTTGTTGGC
TAATATGGCAGAAGGGATGCTTTTGCCGCTTCCGTCCGTACAGTGGAATCATAATCATGAAGTCGACGGCGATGATGAC
GACGTATCGTTATGGAGTTATtaa
```

> SEQ ID NO:3447 316837 14612_300266_1
```
CCCACGCGTCCGCAAATCCTTCTTCCTCTTCAATTCTCTGTTTCCTCCAAAATGGCTACACCAAACGAAGTATCAGCTC
TTTTCCTCATCAAGAAGTATCTCCTCGACGAATTGTCTCCGTTGCCTACTACTGCCACCACCAATCGATGGATGAACGA
```

FIG. 2 continued

TTTCACGTCATTTCATCAAACCGGTTTCGAGTTTTCTGAATTTGAAACCAAACCGGAAATAATCGATCTCGTCACTCCC
AAACCGGAGATTTCTGATTTC

> SEQ ID NO:3448 316847 143787_200011_1
ATTAAGAGAAAATATTTCTTAGAAAATTGGCTCAAAATGGGAAGGTCACCATGTTGTGAGAAAGCTCATACAAACAAAG
GAGCATGGACTAAAGAAGAAGATGAAAGGCTTATTGCTTATATTAAAACTCACGGTGAAGGTTGTTGGAGGTCTCTTCC
TAAAGCTGCTGGCCTTCTCAGATGTGGTAAAAGTTGTCGTCTTCGTTGGATTAATTACTTAAGACCTGATCTTAAACGC
GGTAATTTCACTGAAGAAGAAGATGAACTCATTATCAAACTCCATAGCCTTCTTGGTAACAAGTGGTCACTTATAGCGG
GAAGATTACCCGGAAGAACAGACAACGAGATAAAGAATTATTGGAATACACATATAAGAAGGAAGCTTTTGAGTAGGGG
AATTGATCCAACAACACATAGGCTAATGGGTGAACCTACTGGTACACAAAAAATGACAACAATTTCTTTTGCTGCTGAT
GATCAAGAACAGAAGATTAAGATCAGCCCCGAATTCGAGACGATGAACAAGGA

> SEQ ID NO:3449 316847 316731_301426_1
GCAGCATGATGTGTAGTCGAGGCCATTGGAGACCTGCAGAAGACGAGAAGCTAAGAGAACTCGTCGAACAATTTGGTCC
TCATAATTGGAACGCCATAGCTCAGAAGCTCTCTGGTCGATCTGGTAAAACTGACTTTATATTAAAGTCATTTCTTTAA
TTTCTTACAAAGCATATATAAACTAGGGTTTAATATATTTATATAAAAATATATATGTTGGTTTGATTGGATCTTTTGG
TTTCAGGTAAGAGTTGTAGATTGAGATGGTTTAATCAATTGGATCCTAGGATTAACCGAAACCCTTTCACGGAGGAAGA
AGAAGAAAGGCTTTTAGCGTCTCATCGGATCCATGGGAACAGATGGTCTGTGATCGCTAGATTTTTTCCCGGTCGAACT
GATAACGCTGTTAAAAACCATTGGCACGTCATCATGGCTCGTCGTGGCCGAGAACGGTCCAAGCTCCGTCCACGAGGCC
TTGGCCATGATGGCACGGTGGCTGCGACTGGGATGATTGGTAATTATAAAGACTGCGATAAGGAGAGAAGATTGGCAAC
CACAACCGCTATCAATTTTCCTTATCAATTCTCTCATATTAATCATTTTCAAGTCCTCAAAGAGTTCTTGACCGGAAAG
ATCGGGTTCAGAAGTAGTACTACTCCAATCAAGAAGGAGCAATAGACCAAACTAAACGACCGATGGAGTTCTACAATT
TTCTTCAAGTAAACACGGATTCGAAGATACACGAATTGATAGGTAATTCAAGAAAAGACGAAGAAGAAGATGTCGATCA
AAACAAccGa

> SEQ ID NO:3450 316847 6326_300336_1
CCCACGCGTCCGCAAAAACCTCTGATAAGTTTTGGTTCTTGATATAAACAAAATGGGAAGATCACCGTGTTGCGATCAA
GACAAAGGCGTGAAGAAAGGACCGTGGCTGCCAGAAGAAGATGATAAGCTCACTGCTTATATAAACGAGAATGGTTATG
GGAATTGGCGGTCGCTTCCTAAGCTCGCTGGACTTAACCGCTGTGGCAAGAGCTGTCGGCTCCGGTGGATGAATTATCT
CCGGCCTGATATCCGGAGAGGCAAATTTTCCGATGGAGAAGAGAGTACTATCGTTAGACTCCATGCCCTCCTTGGCAAC
AAATGGTCGAAAATTGCGGGTCATCTTCCAGGAAGAACAGATAATGAAATTAAAAACTATTGGAACACTCATATG

> SEQ ID NO:3451 316850 316869_301427_1
GCAGCATGTGTGGCGGTGCTATTATTTCCGATTATGCCCCTCTCATCACCAAGGCCAAGGGCCGTAAACTCACGGCTGA
GGAACTCTGGTCAGAGCTCGATGCTTCCGCCGCCGACGACTTCTGGGGTTTCTATTCCACCTCCAAACTCCATCCCACC
AACCAAGTTAACGTGAAAGAGGAGGCAGTGAAGAAGGAGCAGGCAACAGAGCCGGGGAAACGGAGGAAGAGGAAGAATG
TTTATAGAGGGATACGTAAGCGTCCATGGGGAAATGGGCGGCTGAGATTCGAGATCCACGAAAAGGTGTTAGAGTTTG
GCTTGGTACGTTCAACACGGCGGAGGAAGCTGCCATGGCTTATGATGTTGCGGCCAAGCAGATCCGTGGTGATAAAGCC
AAGCTCAACTTCCCAGATCTGCACCATCCTCCTCCTCCTAATTATACTCCTCCGCCGTCATCGCCACGATCAACCGATC
AGCCTCCGGCGAAGAAGGTCTGCGTTGTCTCTCAGAGTGAGAGCGAGTTAAGTCAGCCGAGTTTCCCGGTGGAGTGTAT
AGGATTTGGAAATGGGGACGAGTTTCAGAACCTGAGTTACGGATTTGAGCCGGATTATGATCTGAAACAGCAGATATCG
AGCTTGGAATCGTTCCTTGAGCTGGACGGTAACACGGCGGAGCAACCGAGTCAGCTTGATGAGTCCGTTTCCGAGGTGG
ATATGTGGATGCTTGATGATGTCATTGcgtcgtatgagtaa > SEQ ID NO:3452 316857 316725_301426_1
GCAGCATGGGAAGAGCACCGTGTTGTGACAAAGCAAACGTGAAGAAAGGGCCTTGGTCTCCTGAGGAAGATGCAAAACT
CAAATCTTACATTGAAAATAGTGGCACCGGAGGCAATTGGATCGCTTTGCCTCAAAAGATTGGTTTAAATAGATGTGGA
AAGAGTCGCGGGCTGAGGTGGCTTAACTATCTTAGACCAAACATCAAACATGGTGGCTTCTCTGAGGAAGAAGAAACA
TCATGTGTAGCCTTTACCTTACAATCGGTACCAGGTGGTCTATAATCGCTGCTCAATTGCCGTGACGAACAGACAACGA
TATAAAAAACTATTGGAA > SEQ ID NO:3453 316860 242567_301330_1
GGATGGAGGGGGGCGATGCGAGCGGCAGCGCGGGCGGTGATCAGCTGGACCTGGAGGCGTACGCGGCGCTCTACTCGGG
GCGGACCAAGGTGACGCGCCTCTTCTTCATAGCTGACCACGCCAAGTCCCAGACGCTGGAGCTGGAGGCTCTGCGCATG
GCGCACAACAGAGATACGCAAGTCGGACAACACGCTGCTGTACAAGGAGGCGGTGGACAAGATTGGTGGCCGCCTGGGCG
CCGCCTATGCTCTCGACCAGGAATGGGTGGATGTCGTCGATCGCAGGTCCTTGCAGCGCCAGGAGAAGCTCGACATGGA
GCT

FIG. 2 continued

> SEQ ID NO:3454 316860 3870_300324_1
CCCACGCGTCCGGCATCAGAATGGGTTACAATGACTTTGGAGATTTCTATTACGCATGTGGTATGCTCGGAGATGCTTT
CAAGAACTATATCCGAACACGCGACTACTGCACTACGACAAAGCACATCATTCACATGTGTATGAATGCGATTCTTGTC
AGCATCGAAATGGGTCAGTTTACTCATGTTACAAGCTATGTGAACAAGGCAGAGCAGAATCCTGAAACCCTTGAACCTA
TGGTTAATGCAAAACTGCGATGTGCATCTGGATTGGCTCATTTGGAGTTGAAGAAGTACAAGCTAGCTGCTCGTAAGTT
CTT

> SEQ ID NO:3455 316860 156855_301732_1
AAAAACCCTAGCTCCGATCGAACGTTCAAGACATTAATCTCCGATGGAACCAGACGAGGATTTACGGCAAATAGCTGAC
GAGATCTACGCCAACGGCGATGAGAACTCGCAGCGTCACCGGCCGATTATCAGCGGCGAGCAGCTGGATATTGAGTTGT
ACGCCGCCTTATACAGCGGCCGAACAAAAATTATGAGGCTTCTCTTCATTGCTGATCGATGTGGCAATGCTTCAATGCA
ATTGGAGGCTTTGAGAATGTCCTACGATGAGATTAAGAAAGGGGAGAACACGCAATTGTTCCGTGAGGTTGTACAGAAG
ATTGATGGACGTTTAGGCCCTAAATATGGGCCGGACCCTGCTTGGTCCGACGCTGTGGATCGTCGAGCTGAGCTGAGGA
AGGAGAAGCTTGAGAACGAACTCAACGCTTATAGGACAAATCTGATCAAAGAGAGCATTAGGATGGGATACAATGATTT
TGGAGATTTCTACTATGCACTTGGACAGCTTGGAGAG

> SEQ ID NO:3456 316883 262503_301695_1
atgcagcaatgaactcattttctggcttttctgaaatgtttggctccgattACGAGTCTCCGGTTTCCTCAGGCGGTGA
TTACAGTCCGAAGCTTGCCACGAGCTGCCCCAAGAAACCAGCGGGAAGGAAGAAGTTTCGTGAGACTCGTCACCCAATT
TACAGAGGGAGTTCGTCAAAGAAACTCCGGTAAGTGGGTGTGTGAGTTGAGAGAGCCAAACAAGAAAACGAGGATTTGGC
TCGGGACTTTCCAAACCGCTGAGATGGCAGCTCGTGCTCACGACGTCGCCGCCATAGCTCTCCGTGGCAGATCTGCCTG
TCTCAATTTCGCTGACTCGGCTTGGCGGCTACGAATCCCGGAATCAACCTGTGCCAAGGAAATCCAAAAGGCGGCGGCT
GAAGCCGCGTTGAATTTTCAAGATGAGATGTGTCATATGACGACGGATGCTCATGGTCTTGACATGGAGGAGACCTTGG
TGGAGGCTATTTATACGCCGGAACAGAGCCAAGATGCGTTTTATATGGATGAAGAGGCGATGTTGGGGATGTCTAGTTT
GTTGGATAACATGGCCGAAGGGATGCTTTTACCGTCGCCGTCGGTTCAATGGAACTATAATTTTGATGtcgagggagat
gatgacgtgtccttatggagctattaa > SEQ ID NO:3457 316886 316787_301426_1
GCAGCATGTCAGGATCTGAGACGGGTTTAATGGCGGCGACCAGAGAATCAATGCAATttacaATGGCTCTCCACCAGCA
GCAGCAACACAGTCAAGCTCTTTACAAGCAGCCGATGAGATCAGTATCACCACCGCAGCAGTACCAACCCAACTCAGCT
GGTGAGAATTCTGTCTTGAACATGAACTTGCCCGGAGGTGAGTCTGGAGGCATGACTGGAACTGGAAGTGaccCAGTGA
AAAAGAGGAGAGGTagaCCGAGGAAATATGGGCCTGATAGTGGTGAAATGTCACTTGGTTTGAATCCTGGAGCTCCTTC
TTTCACTgtCAGCCAACctactagcggcggcGatggaggAgagaagaagagaGgaagatctcCtggttcttctagcaaa
aggCTcaagcttcaagctttaggcTcgactggaatcggattcacgCCTCAtgtACTtaCcgtgctggctggagaggatG
tatCATCCaagataATGGCgttaacTCAT > SEQ ID NO:3458 316886 316873_301427_1
GCAGCATGTCAGGATCTGAGACGGGTTTAATGGCGGCGACCAGAGAATCAATGCAATTTACAATGGCTCTCCACCAGCA
GCAGCAACACAGTCAAGCTCAACCTCAGCAGTCTCAGAACAGGCCATTGTCATTCGGTGGAGACGACGGAACTGCTCTT
TACAAGCAGCCGATGAGATCAGTATCACCACCGCAGCAGTACCAACCCAACTCAGCTGGTGAGAATTCTGTCTTGAACA
TGAACTTGCCCGGAGGTGAGTCTGGAGGCATGACTGGAACTGGAAGTGAGCCAGTGAAAAAGAGGAGAGGTAGACCGAG
GAAATATGGGCCTGATAGTGGTGAAATGTCACTTGGTTTGAATCCTGGAGCTCCTTCTTTCACTGTCAGCCAACCTAGT
AGCGGCGGCGATGGAGGAGAGAAGAAGAGAGGAAGACCTCCTGGTTCTTCTAGCAAAAGGCTCAAGCTTCAAGCTTTAG
GCTCGACTGGAATCGGATTTACGCCTCATGTACTTACCGTGCTGGCTGGAGAGGATGTATCATCCAAGATAATGGCGTT
AACTCATAATGGACCCCGTGCTGTGTGTGTCTTGTCTGCAAATGGAGCCATCTCCAATGTGACTCTCCGCcAGTCtgcc
acATCCGGTggaaCtgttac > SEQ ID NO:3459 316902 316930_301428_1
GCAGCATGAAACCTAACGGCGTAACAGTTCCGATTTCTGACCAGCAAGAACAGCTTCCATGTCCTCGTTGTGACTCATC
CAACACTAAGTTCTGTTACTACAACAACTACAACTTCTCTCAGCCTCGTCACTTCTGCAAAGCTTGTCGTCGTTACTGG
ACTCACGGTGGTACTCTCCGTGACGTTCCTGTCGGTGGTGGTACTCGTAAAAGCGCGAAACGTTCCCGCACTTGCTCGA
ACTCTTCTTCCTCCTCTGTTTCTGGTGTCGTCTCTAACTCTAACGGTGTTCCGTTACAAACGCGACCTCGTTCTCTTCCC
TCAGTCGTCAATCTCTAACGGCGTTACTCACACAGTAACTGAAAGCGACGGAAAGGGAAGTGCTTTATCTCTCTGTGGA
AGTTTCACCTCCACTCTGTTGAACCATAACGCTGCTGCGACGGCTACGCATGGATCCGGTTCGGTTATTGGTATCGGAG
GTTTTGGAATCGGACTCGGGTCGGGTTTTGATGACGTCAGCTTTGGACTCGGAAGAGCGATGTGGCCGTTTTCAACTGT
TGGTACTGCGACAACGACGAATGTTGGGAGTAACGGTGGTCATCACGCTGTTCCAATGCCAGCCACGTGGCAGTTCGAG

FIG. 2 continued

> SEQ ID NO:3460 316903 275144_200154_1
GAGAGAGAGAGAACCCAAAAACACAATAGTAATTTGTAACTTCTCTCTCTCCGTTACCTTTCTTCCGTTCATCGCCATC
GGACCTATAATTGGATCGAATCGGCTCAAAACTGTTTTATTAAATGGATACATATTGTTCGGACTGCAAACGGAACACG
GAGGTAGTATTCGACCACGCTGGCGGCGATACGGTTTGTTCTGAGTGTGGGCTGGTATTGGAATCCCGTTCAATCGATG
AGACATCTGAGTGGCGTACTTTTGCCGATGAATCCGGTGATCATGACCCGAATCGTGTTGGTGGACCCGTTAACCCGTT
ACTTGGCGATGCGGGCCTTTCAACTGTTTATTTCTAAAGGGCCTAATGGTAGTAATGGGGATGGTTCGCTTGCTCGGTTG
CAGAATCGGGGCGGTGATCCTGATAGAGCCATTATTATAGCTTTTAAGGCCATTGCTACTATGGCTGATAGGTTGAGCC
TTGTTTCTACTATAAGGGATCGAGCAAGTGAGATATATAAAAGGCTGGAAGATCACGAGTGTACTAGAGGCAGGAATCT
TGATCCCTTGGTAGCTGCTTGTATCTACATTGCAT

> SEQ ID NO:3461 316903 316992_301428_1
GCAGCATGTCGGATGCGTATTGTACGGATTGTAAAAAGGAGACGGAGTTGGTTGTCGATCACTCAGCCGGAGATACCCT
TTGCTCCGAGTGTGGTTTGGTTTTGGAATCTCACTCCATTGATGAGACCTCTGAGTGGCGTACCTTCGCTAATGAATCT
TCCAACAGCGATCCCAATCGTGTCGGTGGTCCAACCAACCCGCTTCTCGCTGATAGTGCTTTAACCACTGTTATCGCTA
AGCCCAATGGTTCATCTGGTGATTTCTTGTCTTCTTCTCTCGGGAGGTGGCAGAATCGTAACTCCAATTCCGATCGTGG
TTTGATTCAAGCTTTTAAAACCATTGCTACCATGTCTGAAAGGTTGGGACTTGTTGCAACTATCAAGGATCGGGCTAAT
GAGTTATATAAGAGGCTGGAGGATCAGAAGTCAAGCAGGGGAAGAAATCAGGATGCACTTTATGCAGCCTGTCTGTACA
TTGCTTGTCGCCAAGAGGACAAGCCACGAACTATTAAGGAAATATGCGTTATTGCCAATGGGGCGACAAAGAAGGAAAT
TGGCCGAGCAAAAGACTACATTGTTAAGACATTGGGACTGGAGCCTGGTCAGTCTGTGGATTTAGGAACTATACACGCT
GGTGATTTCAtGagaaggttctgctccAACCTt > SEQ ID NO:3462 316903 127201_300469_1
CCCCCACCAATTTACTCCTTTCCATTCCAACGCGCAGATTGTAGAGAGAGAATCAACTCCACAAACAAACACATAATCC
TTCTCTCTCTACCTCATCGATTTTGTTCCATTTTCAGGTTCAATCATAATCGGGTCTCGGGTCTCAATTAACCCGAATG
GGTGACGCGTACTGTCCGGACTGCAAACGGAACACGGAGGTGGTGTTTGACCACGCCGCCGGGGATACGGTTTGTTCGG
AGTGTGGGCTTGTGCTGGAATCCCGGTCCATTGATGAGACTTCGGAGTGGCGTACGTTTGCTGATGATTCAGGTGATCA
TGACCCGAACCGTGTTGGAGGACCCGTTAACCCGTTGCTTGGTGATGTGGGCCTTTCTACTGTAATTTCTAAAGGGCCT
AATGGGAGTAATGGGGATGGTTCTCTTGCTCGGTTGCAGAATCGAGGTGGCGATCCTGATCGTGCCCTCGTTATAGCTT
TTAAGGCCATTGCCAATATGGCTGACCGGTTGAACCATGGTTCTACCATAAAGGACCGAGCGAGTGAGATATACAAAAG
GCTGGAAGACCAGAAGTGTACGAGAGGAAGGAATCTGGACGCCTTGGTGGCTGCTTGTATCTACATTGCTTGCCG > SEQ ID NO:3463 316906 1110614_301541_1
TTCTGAGCTGAGCTGAGCTAGCATCCATGGCCACCACAGCCCTCTCCTCAGCCAACTTGGCCATCTCAAAGGCCAAATC
CAGCTACACTGCTGCTGAGACCACCAAGCTGCATAGCCATGGCCTTTCTAGTAGCGCCTCGCTCGCCTCCAAGCGGATT
CCGTCGGTTGGGTCCAGTGCTCGCCGGCCTTCCCGCGTCGCTGCCATCAGAATGGATTCCACCAAAGATAAGCCCCGTG
CTGGTGCTAAGGAGGCTGCTAAGGAGTCCCTCCTCACCCCCCGCTTCTACACCACTGACTTCGAGGACATGGAGCGCAT
GTTCAACATCGAGATCAACGGGAAGCTCAACGAGGAGGAGTTCGAGGCTCTCCTTGCGGAGTTCAAGGCTGACTACAAT
CAGACCCACTTCGTCCGGAACAATGAGTTCAAGGAGGCCGCCGCCGCTATCCAGGGGCCCATGCGCCAGATCTtTGTCG
AgTTccttgaAGGGTCCTGCACCGCTGAgttctcCGGGTTCCTCCTCTACAAGGaactgggacGGagaTTGAaGAaaac
caaatCCCATTGttgcggaAATtttcacCCTGATgtcccgAGATGAGGCTCGaCatgccggtTTCCTGAACAAGGGGCT
CTCAGATTTCAACTTGGCTCttgatcTGGGCTTCCTcacaaaaGCAaggAAGTacaccttctTCAAGCCt > SEQ ID NO:3464 316906 2042_300349_1
AATTCGGCACGAGAGAATGTCAGCCACCACAACTCCACCAACTTCAAAACCAACCAAGAAAGCTCAGAAACAAGGAATT
AAAGAGTCCCTTTTGACACCAAGATTTTACACTACTGATTTTGATGAAATGGAGACACTTTTCAACACTGAGATTAACA
AGAATTTGAATGAAGCTGAGTTTGAGGCTCTCTTGCAGGAATTCAAGACTGATTATAATCAGACTCACTTTGTTAGGAA
CAAGGAGTTTAAAGAAGCTGCTGATAAAATTCAGGGACCTCTTAGACAAATTTTTGTTGAATTCTTGGAGAGGTCTTGC
ACTGCTGAGTTCTCTGGGTTCTTCTCTACAAGGAGCTTGGA > SEQ ID NO:3465 316906 182633_300662_1
gaattcaaGCTACACAGACTCTGCAAAAATGGCTGCAGAGATGGCATTGATAAAACCCATCTCTAATTTCACTAGAACC
AGCCCTAAATTTATCACCTCAACCAGAAAATCATTCTCCGTTATCAAAATGGCATCTCAGTCCACTGCATCAACAACTA
AGTCAGGGAAACCAAAGAAAGCAATCAAAGAAACCTTACTCGCTCCTAGGTTTTACACAACTGATTTTGATGAAATGGA
AACTCTTTTTAACACTGAGATGAACAAAAACTTGAATGAAGCTGAGTTTGAAGCTCTATTGCAAGAGTTCAAAACTGAT
TACAATCAGACTCATTTCGTTAGAAACAAAGAGTTCAAAGAAGCTGCTGATAAATTGCAAGGTCCTCTTAGACAGATTT
TTGTTGAGTTCTTGGAGAGATCTTGTACTGCTGAGTTCTCAGGGTTTCTTCTTTACAAAGAACTTGGAAGAAGACTTAA
GAAAACCAATCCAGTTGTTGCTGAAATTTTCTCACTCATGTCCAGGGATGAAGCTAGGCATGCTGGATTCTTAAACAAG
GGACTGTCAGATTTCAACTTGGCACTGGATCTTGGATTTCTTACAAGGCTAGAAAATATACATTCTTCAAACCCAAGT
TCATTTTCTATGCTACATATTTATCTGAGAAAATTGGGTACTGGAGGTACATAACCATTTATAGGCACTTAAAGACCAA

FIG. 2 continued

CCCTGAATACCAAGTTTATCCAATTTTCAAGTATTTTGAGAACTGGTGCCAAGACGAGAACAGACATGGAGATTTCTTC
TCCGCACTGATGAAAGCTCAACCCCAGTTTCTTAACGATTGGAAAGCAAAGTTGTGGTCTCGGTTCTTCTGCCTATCGG
TGTACGTGACCATGTACTTGAATGACTgccagAgaACAGCTTTTTACGAAGGGatcGGACTTAACACTAAAGAATTTGA
TATGCACGTCATAATTGAGACaAACCGTACAGccGCaaggATtTTccCTGCAGTTCTagaTGTTGAGaaccCgga > SEQ ID NO:3466 316906 127886_300473_1
cccccggtaGTTTCTGCTGAAGTTATCGGGAAAAAAATGGCAACAGAAATGGCTTTACTAAAACCAATTACCAAATTC
AACACCTTTAACACCACCACCACTTCACGGATGAGCAACCACAGACTGCCGTTCACAGTGAGAATGTCAGCCACCACAA
CTCCACCAACTTCGAAACCAACCAAGAAAGCTCAGAAACAAGGAATTAAAGAGTCCCTTTTGACACCAAGATTTTACAC
AACTGATTTTGATGAAATGGAGACACTTTTCAACACTGAGATTAACAAGAATTTGAATGAGGCCGAGTTTGAGGCTCTC
TTGCAGGAATTCAAGACTGATTATAATCAGACTCACTTTGTTAGGAACAAGGAGTTTAAAGAAGCTGCTGATAAAATTC
AGGGACCTCTTAGGCAAATTTTTGTTGAATTCTTGGAAAGGTCTTGCACTGCTGAGTTCTCTGGGTTTCTTCTCTACAA
GGAGCTTGGAAGGAGGCTCAAGAAAACTAATCCCGTCGTTGCAGAGATTTTCTCCCTCATGTCCAGGGATGAAGCTCGC
CATGCTGGGTTTTTGAACAAGGGTTTATCTGATTTCAATTTGGCATTGGACTTGGGATTTTTGACAAAAGCAAGAAAAT
ACACTTTCTTCAAGCCGAAGTTCATCTTCTATGCAACTTACTTGTCTGAGAAAATTGGATACTGGAGGTACATTACCAT
ATACAGGCATCTCAAGGCCAATCCTGAGTACACATGTTATCCAATTTTCAAGTACTTTGAGAACTGGTGCCAGGACGAG
AACCGCCACGGTGATTTCTTCTCTGCTTTGATGAAAGCACAGCCTCAGTTCCTCAATGACTGGAAGGCAAAGTTGTGGT
CTCGCTTCTTCTGCCTTTCGGTTTATGTCACAATGTACTTGAATGACTGCCAAAGAACAGATTTCTATGAAGGCATTGG
GCTTAACACCAAAGAATTTGACATGCATGTCATCATTGAGACAAACCGCACAACAGCAAGGATTTTCCCTGCTGTCCTA
GACGTTGAGAACCCAGAATTCAAGAGGAAGTTGGACAGGATGGTGGAGATTAACCAAAAAATACTTGCTGTTGGGGAGA
GTGATGACATTCCACTGGTGAAGAATTTCAAAAGGATCCCTCTGATTGCAGCTCTGGCTTCTGAGTTATTGGCCGCGTA
TCTCATGAAACCCATCGAATCGGGTTCAGTTGATTTTGCAGAGTTTGAACCACAACTGGTCTACTAATTTCCTTTTccc
TCGtgacCTtgtgAAAAAaCAgaagTCGattcttctcaCa > SEQ ID NO:3467 316906 11125_300288_1
CTCGAGCTTGCGGCCGCTACACGACGGACTTCGAGGAAATGGAACAGCTTTTCAACACGGAGATCAACAAGAACCTTAA
CGAAGCAGAGTTCGAGGCTCTGCTTCAAGAGTTCAAGACCGATTACAACCAGACACATTTCGTGAGGAACAAGGAGTTT
AAAGAAGCTGCAGACAAATTGCAAGGACCTCTCCGACAGATCTTCGTTGAGTTCCTTGAGCGGTCTTGTACTGCTGAGT
TCTCTGGTTTCCTTCTCTACAAGGAGCTTGGTCGAAGACTCAAGAAAACAAACCCTGTTGTGGCTGAGATCTTCTCTCT
TATGTCTAGAGATGAAGCAAGACATGCCGGGTTCTTGAACAAGGGATTGTCTGATTTCAACTTGGCTCTTGATTTGGGT
TTCCTGACAAAGGCAAGGAAATACACTTTCTTCAAGCCAAAATTCATCTTCTACGCGACTTACTTATCCGAGAAAATCG
GGTACTGGAGATACATCACAATCTACAG > SEQ ID NO:3468 316906 230411_301068_1
ccacgcgtccgctcgcTAAGAACAAGCAGCTACATTCTCTCGAGCGCGATTCGCGGCGTCAACAGGGGGGCATGGCGGC
GGCAATGTCGGCAGCCAGCGTCGGCAATGTGAAGGTGAGTGGATTTGGCGGCCGATGGCGAGGGTTCCAGTCGAACCGC
GGCGGCAGCGTGGTGTTCTCCAGGAAGATCGTGGCCAGCGTCGCCGCCACGAAAGACGCCCCGAGGAAGGGCGCCA
AGGAGGCGGTGAAGGACACGCTGCTGACGCCGCGGTTCTACACGACGGACTTCGACGAGATGGAGCAGCTCTTCAATGC
GGAGATCAACAAGAAGCTCAACATGGCGGAATTTGAGGCGCTGCTCGCGGAATTCAAGGCCGACTACAACCAGACACAC
TTCGTAAGGAATCCAGAGTTTAAGGCCGCGGCCGACAAGATCACTGGACCGATGAGGAAGATCTTCGTGGAGTTTCTGG
AGAGGTCGTGCACTGCCGAGTTCTCCGGGTTCTTACTCTACAAGGAGCTGGGAAGAAGGCTCAAGAAAACCAATCCCGT
GGTTGCGGAGATTTTTACGTTGATGTCTCGAGACGAAGCACGGCATGCAGGGTTCCTGAACAAAGGTCTATCCGACTTT
AACTTGGCGCTGGATCTTGGTTTCCTGACCAAGGCCAGGAAGTAtacctTCTTCAAGCCGCAGTTCATCTTCTACGCGa
cttactcTCg > SEQ ID NO:3469 316906 47363_300170_1
cggacgcgtggggctctctatctcactctttgcttctgcaactcacagtcaatggcggctgaaatggcgttagtgaaac
cCATCTCCAAGTTCTCTTCCCCAAAGCTCTCAAACCCGAGCAAATTCCTCTCCGGCCGACGTTTCTCCACCGTGATCAG
AATGTCAGCCTCTTCCTCACCGCCTCCTCCAACCACCGCCACCTCGAAGTCCAAGAAGGGAACGAAGAAAGAGATTCAA
GAGTCGCTTCTTACTCCGAGGTTCTACACGACGGACTTCGAGGAAATGGAACAGCTTTTCAACACGGAGATCAACAAGA
ACCTTAACGAAGCAGAGTTCGAGGCTCTGCTTCAAGAGTTCAAGACCGATTACAACCAGACACATTTCGTGAGGAACAA
GGAGTTTAAAGAAGCTGCAGACAAATTGCAAGGACCTCTCCGACAGATCTTCGTTGAGTTCCTTGAGCGGTCTTGTACT
GCTGAGTTCTCTGGTTTCCTTCTCTACAAGGAGCTTGGTCGAAGACTCAAGAAAACAAACCCTGTTGTGGCTGAGATCT
TCTCTCTTATGTCTAGAGATGAAGCAAGACATGCCGGGTCTTGAACAAGGGATTGTCTGATTTCAACTTGGCTCTTGA
TTTGGGTTTCCTGACAAAGGCAAGGAAATACACTTTCTTCAAGCCAAAATTCATCTTCTACGCGACTTACTTATCCGAG
AAAATCGGGTACTGgAGATACATCACAATCTACAGACACCTCAAGgAAAAccCTGAGttccaATGttacCCAATCTTCA
AGTACTTTgagaacTggTGTCaagacgagaaCCGTCATGGTGAtttcTTctcTgc

FIG. 2 continued

> SEQ ID NO:3470 316924 263679_301731_1
gcagcatgcatagtttgaatgaaacagtaattcctgatgttgattacatgcagtctgatagagggcatatgcatgctgc
tGCCTCTGATTCCAGTGATCGATCAAAGGATAAGTTGGATCAAAAGACCCTTCGTAGGCTTGCTCAAAATCGTGAGGCA
GCAAGAAAAAGCAGATTGAGGAAGAAGGCGTATGTTCAGCAGCTGGAGAATAGTCGATTAAAGCTGACTCAACTTGAGC
AGGAGCTGCAAAGAGCAAGACAGCAGGGAGTTTTCATCTCAAGTTCAGGAGACCAAGCTCATTCTACTGGTGGCAATGG
GGCTTTGGCATTTGATGCAGAACACTCACGATGGCTTGAAGAAAAGAACAGGCAAATGAACGAGCTGAGATCTGCCCTG
AATGCTCATGCAGGTGATACTGAGCTCCGGATAATTGTGGATGGAGTGATGGCTCACTATGAGGAGCTTTTCAGGATTA
GAGCAATGCAGCTAAGAATGATGTCTTCCACTCGTTATCTGGAATGTGGAAAACACCAGCTGAGCGATGTTCTTGTG
GCTTGGCGGgttccgCTCATCCGAACTTCTCAAGCTCCTTgcGAATCagctagagcCCATGaCagaacGACAggTaaTg
ggCATCAaTAGCTTgc > SEQ ID NO:3471 316924 9442_300307_1
CCCACGCGTCCGCTCGATCGCGCTAGACAACAGGGATTCTATGTAGGAAACGGAATACATACTAATTCTCTCGGGTTTT
CGGAAACCATGAATCCAGGGATTGCTGCATTCGAAATGGAATATGGACATTGGGTTGAAGAACAGAACAGACAGATATG
TGAACTAAGAACAGTTTTACACGGACACATTAACGATATCGAGCTTCGTTCGCTAGTCGAAAACGCCATGAAACATTAC
TTTGAGCTTTTCCGGATGAAATCGTGTGCTGGCAAAGCCGATGTCTTCTTCGTCAT > SEQ ID NO:3472 316924 316952_301428_1
GCAGCATGAATACAACCTCGACACATTTTGTTCCACCGAGAAGGTTTGAAGTTTACGAGCCTCTCAACCAAATCGGTAT
GTGGGAAGAAAGTTTCAAGAACAATGGAGACATGTATACGCCTGGCTCTATCATAATCCCGACTAACGAAAAACCAGAC
AGCTTGTCAGAGGATACTTCTCATCGGACAGAAGGAACTCCTCACAAGTTTGACCAAGAGGCTTCCACATCTAGACATC
CTGATAAGATACAGAGAAGGCTAGCACAGAATCGAGAGGCAGCTAGGAAAAGTCGTTTGCGCAAGAAAGCTTATGTTCA
GCAGCTAGAGACTAGCCGGTTAAAGCTAATTCATTTAGAGCAAGAACTCGATCGTGCTAGACAACAGGGTTTCTATGTG
GGGAACGGAGTAGATACCAATGCTCTTAGTTTCTCAGATAACATGAGCTCAGGGATTGTTGCATTTGAGATGGAATATG
GACATTGGGTGGAAGAACAGAACAGGCAAATATGTGAACTAAGAACGGTTTTACATGGACAAGTTAGTGATATAGAGCT
TCGTTCTCTAGTCGAGAATGCCATGAAACATTACTTTCAACTCTTCCGAATGAAGTCAGCCGCTGCAAAAATCGATGtt
ttcTATGTCATGTCCGGAATGTggAAAACTtCAGCAGAGCggttt > SEQ ID NO:3473 316947 316941_301428_1
GCAGCATGGGAACGAGCGAAGACAAGATGCCATTTAAGACTACCAAACCAACATCTTCGGCTCAGGAAGTTCCTCCCAC
ACCGTATCCAGATTGGCAAAATTCAATGCAGGCTTATTATGGCGGAGGAGGTACTCCAAATCCTTTTTTCCCATCCCCA
GTTGGATCTCCTAGTCCTCACCCCTATATGTGGGGTGCTCAACACCATATGATGCCGCCTTATGGCACCCCAGTTCCGT
ACCCAGCAATGTATCCCCCGGGGGCAGTCTATGCTCATCCTAGCATGCCCATGCCTCCTAATTCTGGTCCTACCAACAA
GGAGCCTGCGAAGGACCAAGCTTCTGGCAAGAAGTCAAAGGGGAACTCGAAAAAAAAGGCTGAAGGAGGTGATAAAGCG
CTCTCTGGTTCAGGGAACGATGGTGCCTCTCATAGTGATGAAAGTGTCACAGCGGGTTCATCTGATGAAAATGATGAGA
ATGCCAATCAACAGGAACAGGGTTCAATTCGAAAGCCAAGCTTTGGACAGATGCTTGCTGACGCAAGTTCTCAAAGTAC
GACTGGTGAAATCCAAGGTTCGGTGCCCATGAAGCCGGTAGCCCCGGGGACTAATCTGAATATCGGGATGGACTTATGG
TCTTCCCAAGCTGGTGTACCaGTgAAggatg > SEQ ID NO:3474 316974 270560_200126_1
ATATTCCCCACTATCAATACCAATAATTTGAAGAAGAAGAAGAAGAAGAGATAGTTGGATATTGTTGGGATGGGGAGAG
GAAAGATAGAGATAAAGAGAATAGAGAACTCAAGTAACAGGCAAGTCACTTACTCCAAGAGAAGAAATGGTATCGTTAA
GAAAGCTAAAGAAATCACAGTTCTTTGTGATGCCAAGGTTTCCCTTATCATCTATGGTAATACTGGCAAGATGCATGAA
TATTGTAGCCCTTCTACTACGATAGCTGATATGCTGGATGGTTACCAAAAAGCTTCTGGGAGGAGGCTATGGGATGCTA
AGCATGAGAACTTGAGCAATGAAATTGATAGAATCAAGAAAGAGAATGACAGTATGCAGGTTAACCTCAGGCACCTTAA
AGGAGAAGATATCAATTCTCTGAACTACAAAGAACTTATGGTTATGGAAGAAGCCTTACAAAATGGGCTCTCTAGTATC
AGTGCCAAACAGTCTGAGATCTTGAGGATGGTCAGGAAAAATGACCAAATTCTGGAGGACGAACATAAGCAACTTCAAT
ATGCTTTGCACCAAAAGGAGATGGCAGCCATGGGCGGAAACATGAGAGTAATTCAAGAAGAAGTGTACCATCAAAGAGA
CAGAGATTACGAGTACCAGATGCCCTTTGCCCTGCGAGTTCAGCCAATGCAGCCAAACCTACACGAAAGAATGTAGCAT
TAATATTAATTCCACTATCTGCAGTTTAACT > SEQ ID NO:3475 316974 316944_301428_1
GCAGCATGGGAAGAGGAAGAGTagaGCTGAAGAGGATAGAGAACAAAATCAACAGACAAGTAACGTTTGCAAAGCGTAG
GAACGGTTTGTTGAAgaAAGCTTATGAATTGTCTGTTCTCTGTGATGCTGAAGTTGCTCTCATCATCTTCTCCAACCGT
GGAAAGCTCTATGAGTTTTGCAGCTCCTCAAACATGCTCAAGACACTTGATCGGTACCAGCTCTCGGATCTTCAAAATA
AAGAGCAAATGTTGCTTGAAACCAATAGAGCTTTGGCAATGAAGCTGGATGATATGATTGGTGTGAGAAGTCATCATAT
GGGAGGAGGAGGAGGATGGGAAGGTGGTGAACAGAATGTTACCTACGCGCATCATCAAGCTCAGTCTCAGGGACTATAC
CAGCCTCTTGAATGCAATCCAACTCTGCAAATGGGGTATGATAATCCGGTATGCTCAGAGCAAATAACTGCGACAACCC
AAGCTCAGGCGCAGCAGGGAAACGGTTACATTCCAGGATGGTGCTCTGA

FIG. 2 continued

> SEQ ID NO:3476 316976 24034_300105_-1
CCCACGCGTCCGTACCTTTTACAATTTGTTTATATATTTTACGTATCTATCTTTGTTCCATGGAGGGTTCGTCCAAAGG
GCTGCGAAAAGGTGCTTGGACTACTGAAGAAGATAGTCTCTTGAGACAGTGCATTAATAAGTATGGAGAAGGCAAATGG
CACCAAGTTCCTGTAAGAGCTGGGCTAAACCGGTGCAGGAAAAGTTGTAGATTAAGATGGTTGAACTATTTGAAGCCAA
GTATCAAGAGAGGAAAACTTAGCTCTGATGAAGTCGATCTTCTTCTTCGCCTTCATAGGCTTCTAGGGAATAGGTGGTC
TTTAATTGCTGGAAGATTACCTGGTCGGACCGCAAATGACGTCAAGAATTACTGGAACACTCATCTGAGTAAGAAACAT
GAACCGTGTTGTAAGATAAAGATGAAAAGAGAGACATTACGCCCATTCCTACAACACCGGCACTAAAAAACAATGTTT
ATAAGCCTCGACCTCGATCCTTCACAGTTAACAACGACTGCAACCATCTCAATGCCCCACCAAAAGTTGACGTTAATCC
TCCATG

> SEQ ID NO:3477 316976 273750_200145_1
aaaaatggccaatagcagtaatagttctaagaaagatatggatcgtgttaaaggtccaTGGAGCCCCGAAGAAGACGAG
CTTCTACAGCAGCTAGTTCATAAACATGGACCACGAAATTGGTCTCTTATTAGCAAATCCATACCTGGAAGATCCGGTA
AATCTTGCCGGTTAAGGTGGTGCAATCAGTTATCTCCACAAGTAGAGCATAGGGCTTTTACTCCCGAAGAAGATGAGAC
CATTATTCGTGCACATGCTCGGTTTGGGAATAAATGGGCTACTATAGCCCGACTTCTTAATGGACGAACCGATAACGCC
ATTAAGAACCACTGGAACTCTACCTTGAAGAGGAAGTCCTCCTCTCTTAGTGCTGATGAAGGTAACGAACTGGTGGACC
AAATCTTTCAAAATCAGCAGCCGCCGTTAAAGAGATCCGTTAGTGCCGGATCCGCCATGCCGGTGTCGGGTTTCCATTT
CAGTCCCGGTAGCCCGTCGGGTCGGACAGTGATTCCAGCCTTCATGTCACCTCATCGTCTCAATCTCACTTATTCAAG
CCTGTCGCCAGAGCCGGCGGTGTATTTCCGccGccGTCTATAGACACGTCATCTCCTTCCGATGATccgccgACttcCC
TTagccttTcGcttc > SEQ ID NO:3478 316976 263177_301722_1
GCAGCATGGGGAGACAACCATGCTGTGACAAAGTAGGGTTGAAGAAAGGACCATGGACTGCAGAAGAGGATAGGAAGCT
CATAAACTTCATCCTTACCAATGGACAATGTTGTTGGAGAGCTGTTCCTAAGCTTTCTGGTCTTCTTAGGTGTGGCAAG
AGTTGCAGACTTCGTTGGACTAACTATCTTAGACCAGACCTTAAGAGAGGTCTTCTCTCTGATTACGAAGAGAAGATGG
TCATTGATCTCCATTCCCAGCTTGGAAACAGGTGGTCAAAGATAGCTTCTCATTTACCAGGAAGAACAGACAACGAAAT
CAAGAATCATTGGAACACTCACATCAAGAAGAAGTTGAGGAAAATGGGGATTGATCCTCTTACACATAAACCACTCTCT
ATCGTCGAAAAAGAAGACGGAGAACCCTTAAAGAAGCTACAGAATAATACAGTTCCTTTTCAAGAAACAATGGAGCGTC
CTTTAGAGAACAACATCAAGAACATATCAAGACTTGAAGAGTCTTTAGGTGATGATCAATTCATGGAGATAAATCTTGA
GTATGGTGTcgaagaTGTCCCTCTTATTGAAACAGAGTCTTtagaccTTATCTGcaGCAattcaaCAATGTCTTCATCc
acGtccACATCTTCGCAttcttCTaATGAttCGAGt > SEQ ID NO:3479 316976 138333_300723_1
GGGGTGGTGTGTGGCTGATGCAGGTTTGCAGCGCAGCGGGAAGAGCTGCCGTCTCCGGTGGGTGAACTACCTGCATCCA
GAGCTGAAGCGAGGGAGGATGAGCCCGAGGAGGAGAGGATGGTGGTGCAGCTCCACGCCAAGCTCGGCAACAGGTGGT
CTCGCATCGCCAAGAGCATTCCTGGCCGCACCGACAACGAGATCAAGAACTACTGGCGCACCCACCTGCGCAAGCTCAA
GCTCAAACAGCAAAAGCAGCAGCAGTCCGACGACCACCACAACGACAACGACGACGACGACGACCGCAACTCCTCCTCC
TCTTCGTCCTCCTCCAACAGCAACAGCAACCTGCAGCAGCGCAGCCGCAGCCAGGATGAGTCGTCGGCCAGTGGCAGCC
TGCAGGCCCAACATCATGAGGACCAGCACCAACTGTTCCTTCATCCTCTCTGGAACGACGACATCATCGTCGACGTCGA
CTGCTGGAGCAGCAGCACCAACGTCGTCGCTCCGCCGCCGATGCCCGCCTCGCCGCTCTGGGATATCGATGACGCCTTC
TTCTGCTCGGATTATTCGCTACCTCTCTGGGGATAGTATATATCATCCATCAGCCGCCAAGACGATGACGACTACATCA
ACTCGATCGATCGATGCCTCCTAATCATGTGGGAGTACTCAGC > SEQ ID NO:3480 316976 183317_300621_1
GGTGACGTCTCCGTGGTGCGACACGATGGGGCTCAACAAGGGTCCATGGACGCCGGACGATGACACGGTCCTCATCGCC
CACATCCAGCTCCACGGCCACGGCAACTGGCGCGCCGCCCTGTCCAAGCAAGCCGGGCTGCTGCGTTGCGGCAAGAGCTGCC
GGCTCCGGTGGATCAACTACCTGCGGCCGGACATCAATCGGGGCAACTTCTCCAAGGAGGAGGAGGACACCATCATCCA
TCTTCCACGATCTGCTTGGCAACAGGTGGTCCGCAATTGCCGCCACGTTGCCCGGGAGGACGGACAACGAGATCAAGAAC
GTGTGGTACACCCACCTCA > SEQ ID NO:3481 316984 228576_301022_1
ccCGATCTCGCCGCGCGCGCTCAGCTCGTCGACAAGGCAGCGTGCACCCACCAAGATAGCGGGATGATCCAGTGAGCGC
GTGGAGGCGGTCGTTTGATTCTAGATTGTTCTAGAACCGAACGAGCGAGCTTAGCTAGCTAGCTAGCTGCTGCTGCTTCG
ATCGATCGGTCGTTGCCTCATGCAGGAGTTCCAGTCCATCCCGGGGCTCGCCGGCGGCTGTTCGGCGGCGCGGCGGCGA
GCTGACATCCGGCGCGCGCAGGCGCAGCAGGGCCCGGCGTCGGCGGGGATACCGTCGCCGGAGGCGGTGAAGT
GCCCGCGGTGCGAGTCGACCAACACCAAGTTCTGCTACTACAACAACTACAACCTCTCGCAGCCGCGCCACTTCTGCAA
GAGCTGCCGCCGGTACTGGACCAAGGGCGGCGTCCTCCGCAACGTCCCCGTCGGCGGCGGCtgccGCAAGAccAAGCGT

FIG. 2 continued

AGCGGCAGCTCGTCCGCTGCGTCCTCGGCCCCGTCGACGCCGACGGCGGCAaCTGACAACGCCAAGAACCAGCGgcgCG
CCTcGGCGTCGtccCCACGATCCAGTagcggcgGTagcggcaacACGagcCCcAc > SEQ ID NO:3482 316984 259078_301702_1
GCAGCATGATGATGGAGACTAGAGATCCAGCTATTAAGCTTTTCGGTATGAAAATCCCTTTTCCGTCGGTTTTTGAATC
GGCAGTTACGGTGGAGGATGACGAAGAAGATGACTGGAGCGGCGGAGATGACAAATCACCAGAGAAGGTAACTCCAGAG
TTATCAGATAAGAACAACAACAACTGTAACGACAACAGTTTTAACAATTCGAAACCCGAAACCTTGGACAAAGAGGAAG
CGACATCAACTGATCAGATAGAGAGTAGTGACACGCCTGAGGATAATCAGCAGACGACACCTGATGGTAAAACCCTAAA
GAAACCGACTAAGATTCTACCGTGTCCGAGATGCAAAAGCATGGAGACCAAGTTCTGTTATTACAACAACTACAACATA
AACCAGCCTCGTCATTTCTGCAAGGCTTGTCAGAGATATTGGACTGCTGGAGGGACTATGAGGAATGTTCCTGTGGGGG
CAGGACGTCGTAAGAACAAAAGCTCATCTTCTCATTACCGTCACATCAGTATTTCCGAGGCTCTTGAGGCTGCGAGGCT
TGACCCGGGcTtacagGcaaacacaaggGTCTTgagTTTtggtcTCGAagctcaacaGCAgcacgTTGCtgctcccatg
acacCTGTgatg > SEQ ID NO:3483 316996 259075_301702_1
GCAGCATGGCGAGAGGGAAGATCCAGATCAAGAGGATAGAGAACCAGACAAACAGACAAGTGACGTATTCAAAGAGAAG
AAATGGTTTATTCAAGAAAGCACATGAGCTCACGGTTTTGTGTGATGCTAGGGTTTCGATTATCATGTTCTCTAGCTCC
AACAAGCTTCATGAGTATATCAGCCCTAACACCACAACGAAGGAGATCGTAGATCTGTACCAAACTATTTCTGATGTCG
ATGTTTGGGCCACTCAATATGAGCGAATGCAAGAAACCAAGAGGAAACTGTTGGAGACAAATAGAAATCTCCGGACTCA
GATCAAGCAGAGGCTAGGTGAGTGTTTGGACGAGCTTGACATTCAGGAGCTGCGTCGTCTTGAGGATGAAATGGAAAAC
ACTTTCAAACTCGTTCGCGAGCGCAAGTTCAAATCTCTTGGGAATCAGATCGAGACCACCAAGAAAAGAACAAAAGTC
AACAAGACATACAAAAGAATCTCATACATGAGCTGGAACTAAGAGCTGAAGATCCTCACTATGGACTAGTAGACAATGG
AGGAGATTACGACTCAGTTCTTGGATACCAAATCGAAGGGTCACGTGCTTACGCTCTTCGTTTCCACCAGAACCATCAC
CACTATTACCCCAACCATGGCCTTCATGCACC > SEQ ID NO:3484 316996 317086_301429_1
GCAGCATGGGGAAGAGGGAAAGTTGAGCTGAAGAGGATAGAGAACAAGATCAATAGACAAGTTACTTTTGCAAAGAGAAG
AAATGGTTTGCTCAAGAAGGCTTATGAGCTTTCTGTCCTTTGTGATGCTGAGATTGCTCTTCTCATTTTCTCTAACCGT
GGCAAGCTCTACGAATTCTGCAGCAGCCCT > SEQ ID NO:3485 316996 266281_200085_1
TTTCTCTCTCTTTTATCTTCCTTTATAGCTTTACTCCTATCTTCGTCTCTCCTGCATTTAACTAAATTTAAGGGAGAGA
TGGTGAGAGGAAAAACAGAGATGAGGCGTATAGAGAACGCAACAAGCAGGCAAGTCACTTTCTCTAAACGCAGAAATGG
TTTGCTAAAGAAAGCATTTGAACTTTCAGTACTTTGTGATGCTGAGGTTGGTTTGGTTATATTTTCTCCAAGAGGAAAG
CTCTATGAATTTGCCACTTCTAGCATGCAGGAGATAATAGAGCGCTATAAGAGACATTCTAAAGACAAGGTTCAACCTG
AAAACCAAGCAGTGGGACACGATATGCAGCATTTGAAGCATGAGACAGCAAGTTTGATGAAGAAGATAGAACTTCTTGA
AACATCTAAAAGGAAACTCTTGGGAGAATGTTTAGGGTCCTGTACCCTAGAAGAATTACAGCAAATAGAAAAACAGTTG
GAGCGCAGTGTTAGCGCGATCCGGTCGCGAAAGATGCAAGTCTTTAGGGAACAAATGCAAAGATTGAAAGAAAAGGAGA
AAGCCCTTGCAGTTGAAAATGCAATGCTGAGGGAGAAGTTTGGAGGTCTTCAACAGAGACAAACATCAAGCGGAGAGAA
GGA > SEQ ID NO:3486 317014 317042_301429_1
GCAGCATGAAGTCTTTTTGTGATAATGATGATAATAATCATAGCAACACGACTAATTTGTTAGGGTTCTCATTGTCTTC
AAATATGATGAAAATGGGAGGTAGAGGAGGTAGAGAAGCTATTTACTCATCTTCAACTTCTTCAGCTGCAACTTCTTCT
TCTTCTGTTCCACCTCAACTTGTTGTTGGTGACAACACTAGCAACTTTGGTGTTTGCTATGGATCTAACCCAAATGGAG
GAATCTATTCTCACATGTCTGTGATGCCACTCAGATCTGATGGTTCTCTTTGCTTAATGGAAGCTCTCAACAGATCTTC
TCACTCGAATCACCATCAAGATTCATCTCCAAAGGTGGAGGATTTCTTTGGGGCCCATCACAACAACACAAGTCACAAA
GAAGCCATGGATCTTAGCTTAGATAGTTTATTCTACAACACCACTCATGAGCCCAACACGACTACAAACTTTCAAGAGT
TCTTTAGCTTCCCTCAAACCAGAAACCATGAGGAAGAAACTAGAAATTACGGGAATGACCCAGTTTGACACATGGAGG
GTCTTTTAATGTAGGGGTATATGGGAATTTCAACAGTCACTGAGCTTATCCATGaGCCCTGGGTCAcaaTCTagctgc
atCACtggctcTCACCAccACCAACAAAAcCaaAa > SEQ ID NO:3487 317021 284837_200075_1
GGGAGAGGAAAGATAGAGATCAAAAGAATAGAGAACTCAAGCAACAGGCAGGTCACTTACTCAAAAAGAAGAAATGGGA
TTTTGAAAAAAGCTAAGGAAATCAGTGTTCTTTGTGATGCTCGTGTTTCTGTCATCATTTTGCTAGTACTGGCAAGAT
GCATGAGTTCTCCTCTACTTCGTTGGTTGATATTTTGGATCAATACCACAAGCTTACTGGGAGAAGATTGTGGGATGCT
AAGTATGAGAACATGGACAATGAAATCAACAAAGTCAAGAAAGACAATGACAACATGCAAATTGAACTCAGGCACCTAA
AGGGGGAAGACATAACATCTTTGAACCACAGAGATCTCATGATGTTGGAAGATGCCCTTGATAATGGACTCACTAGTAT
CCGTAACAAGCAGAATGAGCTTCTGAGGATGATGAGGAAAAAGACTCAAAGTATGGAAGAGGAGCAAGACCAACTTAAT

FIG. 2 continued

```
TGCCAATTGCGGCAACTAGAGATAGCAAGCATGAATAGGAATATGGGAGAAATAGGGGAAGTGTTTCAGCAAAGGGAGA
ATGAATACCAAACTCAGATGCCTTTTGCCTTCCGAGTTCAACCAATGCAGCCTAATTTGCAGGAGAGGTTCTAATTAAA
AACCTTCATTTATTTGGCCATGACTTCAGACCTTTTATTATC

> SEQ ID NO:3488  317021  316957_301428_1
GCAGCATGGGAAGGGGTAGGGTTCAATTGAAGAGGATAGAGAACAAGATCAATAGACAAGTGACATTCTCGAAAAGAAG
AGCTGGTCTTTTGAAGAAAGCTCATGAGATCTCTGTTCTCTGTGATGCTGAAGTTGCTCTTGTTGTCTTCTCCCATAAG
GGAAAACTCTTCGAATACTCCACTGATTCTTGTATGGAGAAGATACTTGAACGCTATGAGAGGTACTCTTACGCCGAAA
GACAGCTTATTGCACCTGAGTCCGACGTCAATACAAACTGGTCGATGGAGTATAACAGGCTTAAGGCTAAGATTGAGCT
TTTGGAGAGAAACCAGAGGCATTATCTTGGGGAAGACTTGCAAGCAATGAGCCCTAAAGAGCTTCAGAATCTGGAGCAG
CAGCTTGACACTGCTCTTAAGCACATCCGCACTAGAAAAAACCAACTTATGTACGAGTCCATCAATGAGCTCCAAAAAA
AGGAGAAGGCCATACAGGAGCAAAACAGCATGCTTTCTAAACAGATCAAGGAGAGGGAAAAAATTCTTAGGGCTCAACA
GGAGCAGTGGGATCAGCAGAACCAAGGCCACAATATGCCTCCCCCTCTGCCACCGCAGCACCAAATCCAGCATCCT
TACATGCTCTCTCATCAGCCATCTCCTTTTCTCAACATGGGTGGTCTGTATCAAGAAGATGATCctatggcaatgagga
ggaatgatctcgaactgactcttgaacccgtttacaactgcaaccttggctgcttcgccgcatga > SEQ ID NO:3489  317069  263258_301723_1
GCAGCATGGGAAGAGGAAGAGTAGAGCTCAAGAGGATAGAGAACAAAATCAACAGACAAGTGACGTTTGCTAAACGTAG
AAATGGTTTGCTGAAAAAAGCTTATGAGCTTTCTGTTCTCTGCGATGCTGAAGTCTCTCTCATCGTCTTCTCCAACCGT
GGCAAGCTCTACGAGTTCTGCAGCACCTCCAACATGCTCAAGACACTGGAAAGGTATCAGAAGTGTAGCTATGGCTCCA
TTGAAGTCAACAACAAACCTGCTAAAGAGCTTGAGAACAGCTACAGAGAGTACTTGAAGCTGAAAGGTAGATATGAAAA
TCTGCAACGTCAGCAGAGAAATCTTCTTGGAGAGGATCTTGGACCTCTGAATTCAAAGGAGCTagaGCAGCTTGAGCGT
CAACtagacGGCTCTCTGAAGCAAGTTCGCTGCATCAAGACACAGTATATGCTTGACCAGCTCTCTGATCTTCaaGCTg
gAagaTATGATCGGCGTGAGACatcACCATAtacgaggAGGATGggaaggtgGTGATCAacagaATAttgccTATGGAC
ATCcTca > SEQ ID NO:3490  317079  246969_301615_1
ATTGTTGGAGAGGTGTCTAGGACGGCGCCATAGCTCCATTGAGCCTCAATGCTGCGGCTTCTTGGCTCATTGCTTCCAC
GGCGCCGCTAGGGTCTCGTCCAGTGGCGGCGGGCAAGTGATCGCCTTGGATCTGGTGGTTCTAGAGGGATTCGGGCAAT
GTGGAGCAGCACCGCGGCAATCTAGGCAGGGTTTGTGGCGGCGCCAAGAATGCGTGGGATGAGGAGCGAGGTGCGGTGA
TTCTCGCCCCGGACAGCGCGAGTTGGAGGCGGCAATGGAAGGTGTGAGGAGAGGTCCAAATCCAGAGCTTTGGCATGCC
TGCGCCGGGCCGCTTGTGTCTCTTCCGTGTATTGGGACGAAAGTGGTGTACTTTCCCCAAGGCCATAGCGAACAGGTGG
CTGCCTCGACCCAGAAGGAAGCAGATGCGGACATTCCTAGCTACCCCAATCTTCCGCCACACCTCTTTTGTCAACTTCA
CAACATCACTCTCCATGCTGATATCGAGACGGATGAAGTGTATGCGCAGATGACTCTCCAGCCTATGAATGCCCAAGAA
AAGGATTCGTTCATGGCCGACTTGGGCAGACAAAACCGGCAGCCCTCCGAGTATTTTGTAAAACGCTAACAGCGAGTG
ACACAAGTACACACGGCGGTTTTTCTATCCCTC > SEQ ID NO:3491  317079  316993_301428_1
GCAGCATGGCAAATCGCGGAGGTGAATATCTGTACGATGAGTTATGGAAATTATGCGCGGGACCTCTTGTTGATGTTCC
TCAAGCTCAAGAAAGAGTTTATTGTTTTCCTCAAGGTCACATGGAACAACTCGAAGCGTCAACGCAACAAGTCGACTTA
AATACGATGAAGCCTCTTTTTGTTCTTCCTCCTAAGATTCTCTGCAATGTTATGAACGTTAGTCTTCAGGCGGAGAAAG
ATACGGATGAGGTCTATGCTCAGATTACTTTGATCCCTGTTGGAACTGAAGTTGATGAACCTATGAGTCCTGATCCCTC
TCCTCCTGAGTTGCAAAGGCCGAAAGTTCACTCTTTCAGCAAGGTTTTGACAGCGTCTGATCAAGCACCCATGGTGGC
TTTTCTGTTCTAAGGAAACATGCCACGGAATGTCTTCCTCCGCTGGATATGACTCAGCAAACCCCGACCCAGGAGTTAG
TAGCCGAAGATGTGCACGGTTATCAGTGGAAATTCAAGCATATTTTAGAGGCCAACCACGGAGGCATCTATTGACGAC
AGGGTGGAGCACCTTTGTTACATCAAAGAGATTGGTTGCTGGGGACACCTTTGTattCCtG > SEQ ID NO:3492  317079  286354_200108_1
GTTGTACTAAAAGGACTAAAGTTTTCATTTTTGGGTTGCCCTTTCTTGGCTTTTTTGGTTTAACTAGTAAAAAGTAGGT
TCTTGATAGGAGTTAGTTTGATTTGCTGTAATGAGGGTATCTTCAGCTGGGTTCACTCCTCAACCAGAGGAAGCAGGGG
AGAAGAAATGCTTGAACTCAGAGCTGTGGCACGCTTGTGCCGGGCCACTAGTTTCGCTTCCGCCTGTAGGAAGCAGAGT
TGTGTATTTTCCTCAAGGGCATAGTGAACAGGTTGCTGCCTCGACAAACAAGGAAGTAGATGCTCATATCCCTAACTAT
CCTGGTTTACCACCGCAGCTAATTTGTCAGCTTCACAACCTGACAATGCATGCAGATGTTGAAACCGATGAAGTATATG
CTCAAATGACGTTGCAGCCACTAAGTGCACAAGAGCAAAAGGATGTGTGCCTGCTACCAGCAGAACTTGGCATCCCGAG
TAAACAACCAACCAACTATTTCTGCAAAACCTTGACGGCAAGTGACACCAGTACTCACGGTGGATTCTCTGTCCCCCGA
CGTGCAGCAGAAAAAGTTTTTCCCCCTCTTGATTACTCTCAGCAGCCGCCCTGTCA
```

FIG. 2 continued

> SEQ ID NO:3493   3442    25160_300074_1
AAAGACGCTGAAGAAGAACTTTGCCAACAAGGGTCTTAACGCTAAAGACCTTGTGGTTCTCTCAGGGGGTCACACCATT
GGAATCTCTAGTTGCGCTCTCGTCAACAGTCGTCTCTACAACTTCACAGGAAAGGGCGATTCTGACCCATCCATGAACC
CTAGCTACGTGAGGGAATTGAAGAGAAAGTGCCCGCCTACAGATTTCAGAACCTCACTGAACATGGACCCAGGCAGTGC
GTTGACATTCGACACTCACTACTTCAAGGTCGTGGCTCAGAAGAAAGGGCTCTTCACATCTGACTCTACGCTTCTCGAT
GACATTGAGACCAAAAACTACGTTCAGACTCAGGCCATTCTCCCTCCTGTGTTTCTTCTTTCAATAAAGATTTCTCCG
ATTCCATGGTCAAACTTGGTTTCGTCCAAATTCTTACCGGCAAAAATGGTGAGATCAGGAAGAGATGCGCCTTCCCTAA
CTAATTTGGATCGATCAGACCGGGTTCGGATGATTTTGAGTCTACACGTTTTTCTCTGCTTATTTTCTTTCTTTTTCT
TTTTTCTTTCACGGAAGTTTGAGCTTTGgt

> SEQ ID NO:3494   3442    37637_300081_1
CCCACGCGTCCGCATTCCTGTAAACACAAAAACTTGTAATTTCCAACGAAATGGCGCGGTTCAGTCTGGTTGTAGTCGT
GACTCTTAGTCTTGCCATCTCTATGTTCCCTGACACAACCACTGCTCAACTCAAAACCAATTTCTACGGAAACTCATGT
CCGAATGTTGAACAAATCGTGAAAAAAGTCGTCCAAGAAAAAATCAAACAGACCTTCGTCACCATCCCAGCTACTCTCC
GCCTCTTCTTCCACGATTGCTTCGTCAATGGATGTGATGCGTCGGTCATGATTCAATAACGCCTACCAACAAAGCCGA
GAAGGATCATCCAGACAATATTTCTTTGGCCGGAGATGGATTTGACGTTGTGATCAAAGCCAAGAAAGCTCTTGACGCT
ATCCCAAGTTGCAAAACAAAGTCTCTTGTGCTGATATTCTTGCTTTAGCCACCCGTGATGTTGTTGTCGCCGCCAAAG
GTCCGTCGTACGCAGTGGAACTCGGAAGGTTTGATGGTTTGGTGTCGACTGCGGCTAGCGTTAACGGAAACTTGCCCGG
ACCAAATAACAAAGTTACAGAACTTAACAAGCTTTTTGCCAAAAACAAACTTACCCAAGAGGACATGATCGCTCTTTCA
GCGGCTCACACACTTGGATTCGCCCATTGTGGCAAAGTGTTCAACAGAATCTACAACTTCAACCTCACACACGCCGTTG
ACCCAACTCTAAACAAAGCCTACGCTAAAGAACTTCAGTTGGCTTGTCCCAAG

> SEQ ID NO:3495   3442    34281_300390_1
CCCACGCGTCCGAGCGTTCAAAGCCAATTGCCTCAGCCCGAGTTTAACCTAAACCAGCTCAACGGCATGTTTAGCCGTC
ACGGCCTCTCTCAAACCGATATGATTGCCCTCTCAGGAGCACACACTATAGGATTTGCACATTGTGGAAAAATGTCAAA
GAGAATATACAATTTTAGCCCTACAACACGTATCGACCCGAGTATAAACCGTGGATACGTGGTTCAGCTTAAGCAAATG
TGCCCGATCGGTGTCGACGTAAGAATCGCAATCAACATGGATCCGACCAGTCCACGTACTTTCGATAATGCTTATTTCA
AGAATCTCCAACAAGGAAAGGGTTTGTTCACGTCAGATCAAATCGTTCACAGATCAACGGTCAAGATCTACAGTTAA
TTCGTTTGCCAATAGTGAAGGAGCTTTTAGACAAGCTTTCATCACAGCGATCACGAAGTTAGGTCGGGTTGGTGTTTTG
ACTGGTAATGCTGGTGAGATTCGAAGGGATTGTTCACGTGTCAATTAGTGTGATTTGAGGTTTTCTTTCTTTTATTCCT
TAAAGAGGATTTTTTTTTTAATAATAAAATTTAATTTCTTGTTGTCAAAATAAGGAGTTCATAAGTGTGAAACATGGA
AACTTAAATTAATAAGATGGGTTTATTTCGTTGACA

> SEQ ID NO:3496   35605   120668_300428_1
CAAGGCCATGCTGTTTGTAAACTTCAACAGTGACCTAATTGAGACTTTTAAATCCAAGTATCATGAATTTGCTGAGCAG
TACAAAGGCAATGATATTAGTTTCTTAATTGGTGATGTTGAGGCCAGTCAAGGTGCCTTCCAGTACTTTGGACTCAAGA
AAGATCAGGTACCTCTAATCATCATACAGACAAATGATGGGGAGAAATATCTCAAACCAAATGTTGAGCCTGATCATAT
TGCTTCATGGGTTAAGGATTTTAAGGATGGCAAGGTGAAGCCTTTCAAAAAATCAGAGCCTATCCCAGAGGTTAACAGC
GAACCTGTTAAAGTTGTGGTTGCTGACACTCTCCAGGAGATGGTTTTCAACTCTGCGAAGAATGTACTCCTTGAGTTTT
ATGCCCCTTGGTGCGGACACTGCAAGCAGTTGGCCCCTATCCTTGATGAAGTGGCTGTCTCATTTGAAAGCGATGCTGA
TGTTATGATTGCTAAAATTGATGCTACTGCTAATGATATTCCCCAGGGAACTTTTAATGTCCAAGGTTATCCGACTCTT
TATTTCAAGACAGCAAGTGGAAAAATCTCGCAGTATGAAGGTGACAGGACCAAGGAAGACATTATTGACTTCATCCACA
AGAATCGGGAT

> SEQ ID NO:3497   36009   36058_300084_1
TTTAGCCTCCGAGAGATTCAGAAATATTATATTAACCAAGAAGGTAATCACAACAGCTTATGTGATATGCATCAACAAT
AGAACATTAAAGATGAATTCAACAATTCCAAAACTGAAGAGAAGAGAATTGTCGACAAAGTTAAGAACTGATAACAGAA
TACAAAGCTTAAAAATTGGTCGAGTAACATAGATGTCCTCACATGACTGCACCAAGTCCTATCACTTGAACATAGCCAT
AATTCCAAAACAGAGAAGAATAAAACATAAAAGCTTAAGCCTTGGGGGCTACTTTCTCCTTAGCCTTTTGGAGTTTCAA
CACTTTCTTCACAATCTTTTGCTCTTCGACAAGGAATGCCCGAATGATCCTTTCCCTGA

> SEQ ID NO:3498   36934   23862_300072_1
tttttttttggtttatctgtccacTTTTTTATTCAAATAAAAGAAAAGCAGATTACATTGGATGATTTTATACAGTCGGT
TCTTTAACAAAGAAAGATGATTGATGCTAATATACACAATTACATAATCTTATACTTGAATTATACAGTAGTTTGGAAG
AAAGAATTATACAGTAGAAAAATATTACCGTGAAAAAGTAAAAAGTAAAAGTAAAACCATCATTATTAGTTGGTACTC
TCCACTTCATCTCTAAACCAATCTGAAGTACCCCAATCAAACGGCGTGGACTTTTCCTCCGGTAAGAACCGGTTCCGAC
AAATCGGGCACGTTATCTTATTACAGTCAACGATCCAACGGTCTAAACAACGATGATGAAACACGTGTCCACACTTCGG
TAGCTGTCTAATCTTATCGTCGGATACAAAATCGGATAAGCAAACCGTGCAGCAATCTTCCGGATCGGTCAAGAGATCG
GAGAAACGAACCACCGGGATTAACTCGTTGGCAAGAGTTGCTGACGTGGAGAGAGCGAGTCGGGTCGGGTCGGGTCGAG

FIG. 2 continued

AGGTCTCGTTGTGGTCAAGAAAACTTGGTAGACCGATGTAAGGACAAAGAGCATCGACCATGTCTCTAAAGAAACCGAT
GACGTAAAGTATCTTTAATATGTAACCTGGAATCTGAAGCTCGGTGATGAAATCTTCAGGAAGACCCATGATTTAGAGA
AAGATAGAGAAGAGAGCTAGATTGAGCGGACGCGTGGG

> SEQ ID NO:3499   36934   13671_300248_1
CCCACGCGTCCGCTCTCGTCTCTATCTTTCTCTCACACTCATGGGTCTTCCTACAGATTTCAAAGAGCTTCAGATTCCA
GGTTACGTACTAAAAACACTTTACGTCATCGGTTTCTTTAGAGACATGGTCGATGCTCTTTGTCCTTACATCGGTCTAC
CAAGTTTTCTTGACCACAACGAGACCTCTCGACCCGACCCGACCCGACTCGCTCTCTCCACGTCAGCAACTCTTGCCAA
CGAGTTAATCCCGGTGGTTCGTTTCTCCGATCTCTTGACCGATCCGGAAGATTGCTGCACGGTTTGCTTATCCGATTTT
GTATCCGACGATAAGATT

> SEQ ID NO:3500   37131   23944_300072_1
tttttttttatcgaatgataataatatttaaAATTTCCTTATTGATACGAAACATATATCCCTCGACAATACATATATA
GCGGTCTTTATTATTTTTATGTAGACCGATCGATATTGACCTCAAAATCATTACATAATATCAAACGCGATCAATGGCC
GAAACAAGCATGTTTCTGGAATCAGGCTGCCCAATGAGCTCATTGCCACAGTCGACAAATTGGTAGTCAACAATGAGAT
GGCCTTGTTGATAGCCAAAACCATCGGTGTCTATTTGATTGAACATTGCTACATCCAAATCCAAGCCTCCGTTGCTGCA
TTGGTCCACTATTCTCACAGTTACTGCAGCATTTGTTCTTGGGTTCTTCACCCTTAAACACTTGCCGCAAGAAGCTTGA
CCACGAGGTCCTGCCGGCCCGCAGAAGGCGGTCCAGCCATACTTGCTCCGCCATGCGTACGGCTTATCAGCATCCCACG
TGGAGCAATAAGCACTCACGGCTCTCAAATCCCAATTATTCTGCGCCGGATTATAGAAATGGTAGGTGGCGCGTACGTT
CGACGCGCTCTCCCCTGGTCCGCTAGGCCCACTTCCCCAACAATTGCTCTGACAGTTGTTGGTCGGAGAACAGTAGTCC
GCGGTGGTACCACAGTaACCGTACTGACTGCAGCAGATGTTACCGGGACAAGTTCGACcacCGCCTTGacgacCGCATT
GTTGTCCGGccaCCGtagccactgtgtatgataaaagtatgatggttatgctaagtctgatcttcatgatcccaagtc
tttgcggacgcgtggg > SEQ ID NO:3501   39086   38839_300194_1
GCAGTGGCTCAACCttGACGTGTCAATCTCTCGTTGGTTACTCAAGCAAGAACGCAACAACGTTGCGCAATATCCAAAC
CCTTTTTGCCGTCAAGAACCTCCGCTCGATCCTCGGAGCTAACAATCTCCCACTCAACACCTCACGTGACCAACGCGTG
AACCCGAATCAAGTCGTACGTGTCCCAATCCATTGCTCTTGCTCCAATGGAACCGGTGTCTCGAACCGGGACATCGAAT
ACACCATCAAGAAAGACGACATACTCTCTTTCGTCGCAACTGAGATTTTCGGTGGTCTCGTTACGTACGAGAAGATCAG
TGAGgttAACAAAATCCCTGACCCGAACAAAATCGAAATCggtcAAAagtttTGgATcccT > SEQ ID NO:3502   39086   56660_300127_1
CTGATAAACCTCTCGACGTTCCTCTTTTAGCTTGTAGCTCTTCTGTGAGGAAGGACTCGTTGGATGCTCCTCTGCTTCT
GTCTAACAACTCATACGTCTTCACTGCAAACAATTGCGTCAAGTGTACTTGTGACGCTTTGAAGAATTGGACTTTAAGC
TGTCAATCATCATCTGAGATTAAGCCTTCGAACTGGCAAACCTGCCCACCCATTTTCACAATGTGATGGAGCTTTGCTTA
ACGCCTCTTGCAGACAACCTCGTGATTGCGTCTATGCTGGTTACTCCAACCAAACCATCTTCACCACAGCTTCCCCAGC
TTGTCCAGATTCTGCTGGTCCTGATAACTATGCA > SEQ ID NO:3503   42037   57891_300118_1
GCCATTACGGCCGGGGATCTTGGAAGTTTAAAGGAAAAGGGAGAAAGAGAAATCTTTCTGTCTTAAGAGTAATTAGCAA
TGGCTTCCTCAGTTCTTTCCTCAGCAGCAGTTGCCACCCGCAGCAATGTTGCTCAAGCTAACATGGTTGCACCTTTCAC
AGGTCTTAAGTCTGCTGCCTCATTCCCTGTTTCAAGAAAGCAAAACCTTGACATCACTTCCATTGCCAGCAACGGCGGA
AGAGTGCAATGCATGCAGGTGTGGCCACCCAATTAACATGAAGAAGTATGAGACTCTCTCATACCTTCCCGATTTGAGCC
AGGAGCAATTGCTCTCCGAAATTGAGTACCTTTTGAAAAATGGATGGGTTCCTTGCTTGGAATTCGAGACTGAGAAAGG
ATTTGTCTACCGTGAACACCACAAGTCACCAGGATACTATGATGGCAGATACTGGACCATGTGGAAGCTACCTATGTTC
GGATGCACTGATGCC > SEQ ID NO:3504   42037   2062_300349_1
ggctgcaggaattcggcacgaggaaaatggagaaaGAGAAATCTTTCTGTCTTAAGAGTAATTAGCAATGGCTTCCTCA
GTTCTTTCCTCAGCAGCAGTTGCCACCCGCAGCAATGTTGCTCAAGCTAACATGGTTGCACCTTTCACAGGTCTTAAGT
CTGCTGCCTCATTCCCTGTTTCAAGAAAGCAAACCTTGACATCACTTCCATTGCCAGCAACGGCGGAAGAGTGCAATG
CATGCAGGTGTGGCCACCAATTAACATGAAGAAGTATGAGACTCTCTCATACCTTCCCGATTTGAGCCAGGAGCAATTG
CTCTCCGAAATTGAGTACCTTTTGAAAAATGGATGGttCCTTGCTTGGAATTCGAGaCtg > SEQ ID NO:3505   43341   57802_300037_1
GCCATTACGGCCGGGGGATTCAAGGAATTGGAAGATTTCTTGCCCATTGCGAAAAGTCCAGCTGAAGAGTGTGTAATGG
GGGTGGTGGGCAAAGCAGGGATTGGGCATTTAAGGCGTTCTCAGCGGGGCTGGGCGTTGCCACCATTTTCTTTGCAGC
TTCTTTCTCCCTCAACGTCTACCGTGGTCTCTCTTGGCATAATCGCCAATCGAGAATTGAGAAGGAAGGATCTAAAGTC
CTGCAGCAGGAAGAATGACGGTTTTAGACGTGTGCTACACTTTTACCTAACGTTGCAAGCCGAGATCATAATATAAGTTCT

```
GAATCTTTTTACGTTAAAATAACTTGAGGACGAGTATGATTTACACATTCTGTCATTGTTATTCATTTACTGTTGGTGG
CCACATAATTGTGGGAGTTGTAATTCTAAGTAGCTATTTAATTGTAGCAGCTGCTGACCGTTAAAATGGAGTTGGAACA
AGAACAACAACAACAACCCAGTATGGTCCTACAAGTGGGGTCTGGCTAGGAGATAATTTGAAAATGTCCCCTTCGT
TATTACT

> SEQ ID NO:3506  43445  270173_200123_1
ACGAAATCCTTTCTGTAGCTGAACGAACACATATTTGAAGGTAGCAATTTTGGAAAAAAGCATTATGGCACTAGTTTCT
GGAGGAAGATCATCGTTGAATCCAAATGCGCCCCTCTTTGTTCCTTCGTTTGTGCGCCAAGTGGAGGATTTTTCACCAG
AATGGTGGAATTTGGTGACAACTTCAACATGGTTCCATGACTATTGGATGAGCCAGAACCAGGGAGAGGAATATGGTAA
TGATCAATATGGAGCTGGTAATGATATCGCTGATTTGCTTCCTGAGAATATTGATCTCAATGTGGATGAGGATATCTTG
AACATGGAAGCTCAGTTTGAGGAGTTTCTCCAATCATCCAAAAGCGGGCAACAAGGAATTAAGTCACCTCTCTATGGTG
TCAATGGAATGCCACAATATGGATTGCCCAATGTTTCTGATCCGGTGATAAGAACTATGAGTTCACCAATGTACTATGA
GAAGCCAGCCAAGATCGTGAGCTCTAGGAACAGCTTCCGCAGCATCCAACAGCCTCGCTGAATGTGATTAGCTTAGCAA
AAGCTCTTGGTTTGCATTCAGAAAGTCAGTTCTTAGTACTCTTGACAAGCAGTAGTTAAGAAAGTCTCGAGTTTTAGTT
TTCATGTAACCTTTTTGTACAGAGCAAGGTAGGCAGCACTCTTGTATCTAGCCttgttCATaGTCTGATATCCtttCtT
TTGcttaac > SEQ ID NO:3507  43445  270287_200124_1
atcaatagctgaaggcctgaagcagatcaaagttcctaacaagctgattgacaacgcaacaatatggcgaccaacaagg
tTGAGATGGAGAAAAGTGAGGGAAATTTGAAACATCTAGGGTTTGTAAGGGTGTTGGCTATAAACACTGCGGTTTTGGT
GTCAAATCTGTACGAATACACGAAGCAGAACTCGGGGCCTCTGAGATCGACTGTGGGTACTGTAGAGAACGCGGTAACT
ACCGTGGTAAGGCCTGTTTACGAGAGGCTTAAAGGTGTTCCTGATGAAGTCCTTGTTTTCCTAGACCAGAAGGTGGACG
ATGGAGCAGCAAAATTTGATGAGCATGCTCCTCCCTTGGCCAAGAAGGTTGTCAGCAAAGCCCAGTCTGTATTTCAGAA
GGCATCAGAAGTAGCACAAGACTTGTTCAAGGAAGTACAAGTTGCTGGTCCTCGTGCAGCTATCAATCATGCTGGTGCA
TTGTCCAAGCAATTGGCTGCTAGTCAAGTGGCAGTTCTCTGGTATCATATAAATCATTGTGCGCCGTTGCATGGAATCG
CACAGATGGCTGCACCTACTGCTGCTCACTGGTCAGAGAAGTATAATCAACTAGTTGCTGACTTGAAGAAGAAAGGTTA
TATTGTTGTCAACTACATTCCTTTGATACCAGTTGAAGAAATCTCAAAGGCATATAAACAGGTTGAGTCTGCTGCGCAT
GAGAAAGACGATGCTCCTAATTCCAGTTCAAGTAAATCCGAATGATTATCTTAGTATATCTGTCTACCCAATGTTTAGT
TGTGCTTGTAAGACTTTAGTTTGGGATTGGGAGGTTTGGGGGTATCCATTGTATAGATCGCTCGATGCCACTTCTGTAG
CATCTTAAATGTTAAGGTTTTGTGCTTTGTATTCTTCTAAATGAGTTGTTGATTCTGTAATGGTGTGAGTGCCTATGCA
ATGTCCTGTCCATGCATAATGAAGTTTGAATTCTGCTAAG > SEQ ID NO:3508  43445  120130_300359_1
ccccgaagataagaattcatacgtgtaCGAAATCCTTTCTGTGGCTGAACGAACACATATATTTGAAGGTAGCAATTTT
GGGAAACAGCATTATGGCATTAGTTTCTGGAGGAAGATCATCGTTGAATCCGAATGCGTCCCTCTTCGTTCCTTCGTTT
GTGCGCCAAGTGGAGGATTTTTCACCAGAATGGTGGAATTTGGTGACAACTTCAACATGGTTCCATGACTATTGGATGA
GCCAGAACCAGGGAGAGGAATATGGTAATGATCAATATGGAGCTGGTAACAATATCGCTGATTTGCTTCCCGAGAATAT
TGATCTTAATGTGGATGAGGATATCTTGAACATGGAAGCTCAGTTTGAGGAATTTCTCCAATCATCCCAAAGCGGGCAA
CAAGGAGTTAAGTCATCTCTCTATGGTGTCAATGGAATGCCGCAATATGGTTTGCCCAATGTTTCTGATGCGCTGATTA
ATACTATGAGTTCACCAAGATCCCCCGTTGCGCCACCAATGTACTATGAGAAGCCAGCCAAGATCGTGAGCCCAAGGAA
CAGCTTCCGCATCATCCAACAGCCTCGCTGAACGCTATTGGCTTAGCAAGAGCTCTTGGTTTGCATTCAGAAAGTCAGT
TCTTAGTTTGCAGCTACTCTTGACAAGCAGTAGTTAAGAAAGTCTCGAGTTTTAGTTtGTtaaGaaaGtGTCGAGTTTT
AgttntcaTGTCACCTTTTGTATaGagcAaGgTaggCAGCACTCTTGTATCTAGCcttgttcaTagtCTGaTAc > SEQ ID NO:3509  43445  143873_301076_1
atcgttcctgtagTTGAAAGTAGATATTTTCTCGGACTTCGAAGCACATCTTCAGGTAACAATTTGGAGAAAGGAGAATG
GCGTTAGTTTCAGGAGGAAGGTCGACACTGAATCCGAATGCACCTCTTTTCATCCCGTCTTATGTGCGTCAAGTGGAGG
ATTTTTCACCCGAATGGTGGAATTTGGTGACAACTTCGACATGGTTCCATGATTATTGGACGAGCCAGCATCAAGGAGA
GGAATATGGCGATGATGCTTTTGGTTTTGCTGGGAATGATGTTGCTGACTTGCTTCCTGAAAATATCGATCTTGATGTT
GATGAAGATATTTTGAACATGGAAGCTCAGTTTGAAGAATTCCTCCAATCATCTGAAAGTGAACAACAAGGAATCAAGT
CATCGCTCTATGGTGTCAATGGTTTACCCAAGGGTTCGGAGGCACTCGTACGGACACTGAGCATGCCAAAGGGGCCAAA
ATCTCCCATTGAGCCACCAAAGTACTATGAGAAACCAGCAAAGATTGTTAGCCCAAAGAACAGCCTTCGCCGCATCCAG
CAGCCTCGCTAAATGTAGTTTAGCTTAAGCAAAAGCTCTTGGTTTGTAGTTTGGGAATGTCAGTccttaATttcgagCT
TTTAGTCTTCTTCACAAAGCATCAGTTGAGAGTCTGAGGAGTGTTTAGTTTCTGGTAGCCTTTTGTATAGAGCAAGGTA
GGTGGCACCTTCTGTATCTAGCCTTGTTCATAGTTGTAGTAt
```

FIG. 2 continued

> SEQ ID NO:3510 43460 1007654_301402_1
gaagcaaagcgtgtatcaacgctccttcctcgtctctctctctctctctcttctcttccgggctgctcctcttttctc
tCTCTCTCTTTCTCCCTCTCTTCTCGCGACGGAAGGAAGGCGGAATACTCCTTTCTCTTTCTCTTTCTCTCTCTCATAC
CGAGGTATTTAGGGTTTCCACAGGCGGAGAGAAGAGAGAGAGAGAGAGAGCGTCTTTCTTCCTCTACCGCTGCTACTAC
TACTGCTACGACCATGTCGGGGATCGCCAATGCTAACCTACCGCGGCGGATCATCAAGGAAACTCAACGGTTATTGAGC
GAGCCAGCCCCTGGCATAAGTGCATCACCTTCTGAGGATAACTTACGGTATTTCAATGTTATGATTCTTGgGCCAACTC
AATCTCCCTATGAAGGCGGGGTTTTCAAATTGGAATTGTTTCTACCCGAAGAATACCCAATGGCGGCTCCAAAGGTCCG
ATTCCTGACAAAAATTTATCATCCGAATATTGACAAGCTGGGGCGCATCTGCCTCGACATTTTGAAAGACAAGTGGAGC
CCTGCACTCCAAATTCGGACAGTCCTTCTAAGTATTCAGGCCCTTTTGAGTGCACCGAATCCTGACGATCCACTTTCTG
AGAACATTGCGAAGCATtggaAGACTAACGAGgcAGAAGCTATGCAAACAGCAAAGGAGTggaccagGATGTa > SEQ ID NO:3511 43460 214086_300854_1
cccacgcgtccggtcatcttcggcagacaGGCAACGAGCACCGAATCTCCCCGCGGATAAGGCTTCTTTTTTTCCGTCT
ACAAAACGTCACCTGTGCAACAACTGAAAGCTCTCTGGCTTCTCCGATTCGGCGGTCCAGGCCTCTCTTTCCACCTCTT
CCAACGTTTCTTTCAACCCTCTCCCTTTGATCAGGCATTTCAGGATACCGCTTCTCGTCCTCACCGGCGATCTCCGACG
AGCCAAGATGTTGAACATATGGTCTATGGTATTTGGAAAATGCGCCAGCTTCTATGCCCCGCCACAGAGAGTTCCTAAC
ACAAATTGCAGAAAAAAAGCAAAGGAGGCTGAAAATGCCGAAGGTCAGGCTGCTGGAGGGAAGAGGAAGAAGGTGAC
GGCGGCACAGCTACGAGTACAAAAAGATTTGTCAGAACTATCTCTCGGCGCAACGATGAAGACTGACTTCCCTGACCCC
GACAATATCCTCAACTTTATCCTGTCGATCGAGCCGGACGAGGGCATGTAccGAGGCGGAAAATTCACATTCGACTTTG
CCATCAaccaGAACttcacgcACGAGCcTCCTAAGGTGCTGTGCAGggagaagaTAtatcATCCCAACATtgatctcga
gggcaaGgtctg > SEQ ID NO:3512 43460 210888_300893_1
GGCAACGAGCACCGAATCTCCCCGCGGATAAGGCTTCTTTTTTTCCGTCTACAAAACGTCACCTGTGCAACAACTGAAA
GCTCTCTGGCTTCTCCGATTCGGCGGTCCAGGCCTCTCTTTCCACCTCTTCCAACGTTTCTTTCAACCCTCTCCCTTTG
ATCAGGCATTTCAGGATACCGCTTCTCGTCCTCACCGGCGATCTCCGACGAGCCAAGATGTTGAACATATGGTCTATGA
AAAAAAAGCAAAAAGGAGGCTGAAAATGCCGAAGGTCAGGCTGCTGGAGGGAAGAGGAAGAAGGTGACGGCGGCACAGCT
ACgaGTACAAAAAGATTTGTCAGAACTATCTCTCGGCGCAACGATGaagACTGACTTCCCTGACCCCGACAATATCCTC
AACTTTATCCTGTCGATCGAGCCGGACGAGGGCATGTACCGAGGCGGAaaatttcacATTCGACTTTGCCATCaaccaG
AACTTCCCGCACGAGCCTCCTAAGGTGCTGTGCAgggagaAGatataTCATCCCAACATTGATCTcgaggGcaacgtct
gccttaacattctgcgggagGACTGGAagcCggtgttgaaCTTGAatgctgtCATTGTGGGG > SEQ ID NO:3513 43460 1099124_301488_1
agtcAGGGTTTCGAACTCTTTCCTTCTCCTCCTCCTCCTCCCGTTCCCTGCGCCGAGGAGGAAGAAGAAAGAGCCAGGCC
AACTCAGAGAGGAGGAAAGAGGAAAGAGGAAAGAGGAAAGAAGAAGAAGAGGACCATCCCCCGCGCGCTATCCACGCTTGT
GCAGAACTATTTGACGCTAACATGATCAAGCTATTTAGTGTCAAGCAAAAACAAAAAGAAGCTGCTGAAAGTGCAAATG
GGAGGCCTCAAGTCAGGAAACAAAGTGCTGGGGAATTGCGTGTACAGAAAGATATCAGCGAGTTGAATTTGCCCAAAAC
AACTTCCATATCCTTCCCCAACGGGAAAATGATATGCTGAATTTTGAAATAAGCATTTACCCAGATGAAGGCTACTAT
CGTGGTGGAACTTTTTCTTCACTTTCAATATTTCCCCATTGTATCCTCATGAAGCCCCAAAAGTGAAATGCAAGACCA
AGGTATATCATCCAAATATAGATTTGGAAGGCAATGTCTGTCTAAACATTCTCCGGGAAGATTGGAAACCAGTCTTGAG
CATCAACTCAATAATATACGGccTTCAATATCTTCTTCTGGATCCAAACCCAGATGATCCTCTGAACAAGGAGgCAGCC
GAG > SEQ ID NO:3514 43460 1098140_301483_1
ttcatatatatatatatagagggaggaaggcttcgtgttggaccttccttttttgttttccttttttgccgccatcgccg
tCTTTCCTTCCTTCCTTCGATCGATCCATCCCTCCTCCTCTTCGCGATCAAGCTTCTCCTCCTCCCCCCCCCCCCCAAT
GGCCTCCAAACGGATCCTCAAAGAGCTCAAGGACCTACAGAAGGACCCCCCCACCTCGTGTAGCGCCGGCCCTGTTGCG
GAAGACATGTTCCATTGGCAGGCAACGATCATGGGACCCCGTTGATAGCCCTTACGCCGGAGGTGTGTTCATGTTGACAA
TCCACTTTCCCCCAGACTACCCTTTCAAACCTCCCAAGGTTGCTTTCAAGACAAAAGTATTTCATCCAAACATCAATAG
CAATGGGAGTATTTGCTTGGATATTTTGAAAGAGCAATGGAGCCCAGCTTTGACAATCTCCAAGGTTTTgCTTTCGATT
TGTTCTCTTCTCACTGACCCAAACCCCGATGATCCTCTGGTTCCTGAGATAGCACACATGTACAAGATAGACAGAGCCA
AGTACGAATCTACTGCAAGGAATTGGGCACAGAAGTATGCTATGGGCTAaTAGTTATTATAATGGACGTcCCATTGCAA
TGgTAGACAGGCCGAGGGAttgAttACACTTTcCtGttcttgttttcaaaccaTGggGGGttggATGTATCttgtg > SEQ ID NO:3515 43460 157388_301737_1
attcGATAAGAGAGAAGAAAAGAACCCATTTGCTGGCTCTTACGCTAACCTGAGATCACACAAATCCTCTTTTTTCTTC
AGCTTTTTTGTGCCTTCTCACTTAAGCAGGGACCATGATTAAGTTGTTTAAAGTAAAAGAAAAGCAGAGAGAGCAAGCT
GAGAATGCAAATGGAAAGCCACCAGTCAAGAAACAAAGTGCAGGAGAGTTGCGTCTTCACAAAGATATAAGTGAGCTAA
ATCTACCCAAAACATGTAGCATATCATTTCCCAATGGAAAAGATGACCTCATGAACTTTGAAGTCACTATTCGGCCTGA

FIG. 2 continued

```
TGAAGGATATTATATGGGTGGCACATTTACGTTCTCTTTCAGTATTTCCCCAATGTATCCTCATGAAGCCCCAAAGGTG
AAGTGCAAGACAAAGGTTTACCCACCCTAATATTGACTTAGAAGGAAATGTGTGTCTCAACATTCTTCGAGAAGACTGGA
AACCTGTGCTCAACATTAACACCATTATCTATGGTCTATATCATCTGTTCACGGAGCCGAATCACGAGGATCCCCTCAA
TCATGACGCAGCTGCTGTATTAAGAGACAACCCAAAGTTGTTCGAGTCCAACGTTAGAAGGGCAATGCATGGAGGCTAT
GTTGGGCAAACGTTCTTTCCTCGCTGTATGTAACATCTTTACTTCTGAATCAACTGATTTAAGAAGCTGATGGTGGAAG
TTTGAGAACTCTGGACTGTGTAAAGTTTGGGTGCAAAATCATTTCAGgtgGTCTTTCTGCAAACAGAaTATGGGTTCA
AATGTCTTAAAATATATGTAACTCGgaccagaaAAAATCttgtatgCtaaGTgTAAACTTTGcaaTTTgttTtgga
```

> SEQ ID NO:3516 43460 158243_200002_1
```
TGTTTTTAGTGAGACAAAGAGTGTGAAACTCTCTTACAATTTCTACTTTCTCTCTCTAGAAAAAAAGAGACCCTTAGCG
TAAATTTTCTGCGATCAAAAAAAGAATTCGATTCAATTCAATGGCCAACAGCAATCTTCCTCGAAGAATTATTAAGGAA
ACTCAACGTCTTCTCAGCGAACCCGCGCCGGGAATAAGTGCGTCTCCTTCGGAAGAAAATATGCGATACTTCAATGTCA
TGATTCTTGGTCCAACACAATCTCCTTATGAAGGAGGTGTTTTCAAACTGGAACTCTTTTTGCCTGAAGAGTACCCAAT
GGCTGCTCCGAAGGTTCGATTTCTCACCAAAATATACCACCCCAACATTGATAAGCTTGGTAGGATATGCCTTGATATT
CTCAAGGACAAGTGGAGTCCTGCTCTTCAGATTCGTACTGTTCTTTTGAGCATTCAAGCACTTCTGAGTGCACCAAATC
CAGATGATCCACTATCTGAGAACATTGCGAAGCATTGGAAGTCGAATGAGGCTGAAGCTGTTGAAACGGCTAAAGAATG
GACCCGCCTGTATGCGAGCGGTGCCTGAAACGAAACGACTAAGTGATTTTGAAAAAAAAAAGATGTGGAATGTAATTT
ATCCACTGTCTAATCAGGGGAGTTGGGAGGACTGAAAGCTAAATGCTTC
```

> SEQ ID NO:3517 43460 135036_300421_1
```
CGCCGATCTCCATCTGGCGAGCAGAGCAGGGGAGGGGAAGGGAAGGTATCCTGAAAGATGCTTAATCTTATCAAAATAA
AGGATAAAAAGAAAGAGCAGGCAGCAAGTGCTGCTGGAAAGGCTCCTGTGAAGAAGCAATCTGCTGGAGAGCTCCGTCT
TCACAAAGATATTAGTGAGCTAAACCTACCCAAGAGCACATCAATTTCTTTTCCCAATGGCAAGGATGATCTGATGAAT
TTTGAGATCATCGTCCGACCTGATGAAGGATATTACCTAGGTGGCACTTTCGTCTTTACTTTTCAAGTCTCTCCCTCTT
ATCCTCATGAACCTCCAAAGGTGAAGTGCAAGACCAAGGTATACCATCCAAATATTGATTTGGAAGGAAATGTATGCCT
GAACATTTTGCGTGAAGATTGGAAGCCTGTTCTCAACATCAACACTGTTATTTATGGCCTTAACCTTCTTTTTACGCAA
CCAAACGATGAGGATCCGTTGAACCATGAAGCAGCAGCTGTCCTCCGTGACAACCCAAAGCTGTTTGAAGCTAATGTTA
AAAGGGCAATGGCCGGAGGCTATGTGGGTCAACACTATTTCCCAAGATGTGCATGATATGGTGCTGGGTGCCACAAACA
TTAGTAAGTTAAG
```

> SEQ ID NO:3518 44067 115021_300011_1
```
GGGAGAGAACTTTTTTATTTAAAATTAGCTGAAAAGGAATATGTAGAAACTAAAGTAAGCACCGTTACAGTTCAATTA
GCACATGCTTCACAAGCAATCACATGATTTTAGATAGGTATATATCTGTTAACAAGCACAGAAAAGAGGGAAAAACAAA
CATTTTGCGTACAGATGGCCAGAATTGAATAAGAATGCAGAGAATCGCAGACGCAGCACATCTTCAAACAAGGAACGGT
TTTCAAAGAAATACAGGCATCCGACTTTGGATTCAAAGCTCACTATTAAACGGTTGAATGCGGAGGCTAGGTGTATGAC
AAAAGCTAAACGGCTTGGCGTTACTACTCCAGTGCTGTATGCTGTTGACCCTGTTACACATACTCTCACCTTTGAATAT
ATTGAAGGTCCTTCTGTGAAAGATATATTCCTTGGCTTTGGATTAGTTGGTGTTGACGATGAACGGATGACCGATATTG
GCACACAGATTGGTAATGCTATTGGCAAACTACACGATGGTGGCCTAGTCCATGGCGATTTGACAACATCAAATTATGT
TAATGAGG
```

> SEQ ID NO:3519 44146 160351_200006_1
```
GAGAATTGGTTGTTACTCCTGTTGAAAATACTGGATTTTGTCCAGAGGACGCCACCATAGTAGGGAACACCTGCTTATA
TGGAGCGACAGGTGGTCAAGTATTTGTCAGAGGTAAAGCAGGGAGCGTTTTGCTGTAAGGAATTCTCTTGCTCAAGCT
GTTGTAGAAGGCACTGGGGACCACTGTTGTGAGTACATGACAGGAGGGTGTGTTGGTGGTGCTTGGAAAGGTTGGTAGAA
ATGTAGCTGCTGGTATGACTGGGGGTTTGGCATACATTCTTGATGAGGATGATACCCTTATATCTAAGGTAAACAAGGA
GATTGTTAAGATCCAGAGAGTGGTTGCTCCAGTGGGTCAAATGCAGCTAAAGAGCCTAATCGAAGCCCATGTGGAAAAA
ACGGGCAGCACGAAAGGCGCAACTATTCTCAAGGAGTGGGACAAATATTTGCCACTATTTTGGCAATTGGTTCCACCCA
GTGAAGAAGACACTCCGGAGGCCAGTGCTGAATACGAGCAAGCTGCTGCTGGGCAGGTCACTTTGCAGTCTGCAGAGAT
ACCATTGAAGTAAATCTCACATGagcACAGCAATGACCATGATTctaagcaggagACAGTTTGTACAggAAAGAATGAT
ATTGTCTccACggaaggACTCGGTGAAGTCtgagagatcagaaCTCTTaaaggTGCaaGCaaCtatctttGTTGaacaa
aaggcTGATCTTTGTGATGCttcaGCAGCTgtaca
```

> SEQ ID NO:3520 44146 273623_200144_1
```
GGGCGGACGCGTGGGATTGCCGTTGCTACTATTTGCTTAGCCGAAGAACTTGGAAATTCGGGTACAACGTTTTAGACCT
GTTACTAGTTCTTGCCCCTCATTTTTTCTTTGAGGCGGTTTTCATGCCCGTGCTTAATAAGTTGTAACTTGTATCATG
ACATTGACAATTTCGTGAATGTGTAAATTAAAGTCATCC
```

FIG. 2 continued

> SEQ ID NO:3521 44146 35584_300096_1
GCTGCGAGGGAATTGCAGCTGAAGAGCTTAATTGAAGCACATGTGGAAAAAACCGGAAGCAGCAAAGGCGCGGGGATTC
TGAATGAGTGGGAAAAGGATCTACCTCTCTTCTGGCAACTGGGTCCACCGAGTGGGGGAGACACTCCTGAAGCTTCTGG
TGGTTACGTAAGAACATCCACCGGGGAAGGCACATTTCAATCGGGTTAGAGATCATTCAAGAGCAGGGTGGGGCAGTTG
AAACACAAGGATTGGTATACATCAATGGGGGAGGACTATGGAGAGCAGATTAATGGAAAATCATTATCATTCACATGTA
GATCAAATGGGGGGGACAATATTCTTATTGGCTTGGGATCTTTACAACAATACCATGGGTGCTATAACTGGACAGGAAA
TTCAGTAAAATAACTGGTTTCAACTGGCAAAA

> SEQ ID NO:3522 44146 44076_300114_1
GCCATTACGGCCGGGGACAAAAAAAATTGAAGCTCGAAATAGCTCATCAAAATGTTTTGGAAAACTAATCTTTTTATTT
GTGTTTCTTTGGCTATTTTGCTAATAGTAATACTCCAACTAGCTGATGCAAGGGAGATGTCTAAGGCGGCTGCTCCAAT
TACCCAAGGAATGGATTCAAACAACATTAGTGATCAAGCGGGTTATGCTCGGGTTTTACGTTGTTTGGCTTGCAGATGT
TGTGTCGGTTAAATTTTATATATTTTTTACGATCAAATATTTATACAATGTTTTTGTATGTGCTAAAAGTAATAATACTC
CAAAATAAGGCACAACATTGTGGTAGTATTAGTTTGTGTTGTTATACATGTCTTGTCCGGTTGTCTTTCAACTTTGTGG
TACTGTAATTTTAATTCTGGTCAATAAATAGTACTACTAATTAGTGTTTATGGTT

> SEQ ID NO:3523 44189 240852_301317_1
gaaagagagtgaGAGAGCTCGAGCAATGGCGGCAGTGTTGGAGAGCTCGGCCTTCTGCGGCTCGGCCCTGGCAGCAGCA
CCACCAGCTCGGGGCCTCCCCGCATTGAGCAGCAGCAGGCTCACCGTGAGAGCCAGCGGCGGCAAGAAGATCTCGACGA
AAACACCTCTAGGACCTTCTGGGGACCTCAGTTTTAAGTCTGGACGCGATGCTTCTGGCCGTGGCACCACGGGAAAGGG
CGTGTATCAATTCACAAAGAAATACGGAGCTAACGTGGATGGATACAGTCCGATCTATACTCCGGACGAATGGTCGCCT
TCGGGAGATGTTTACACGGGTGGCCAGACTgGGCTTTTGCTCTGGGCAGTAACGCTGGGAGGTATACTACTGGCCGGTG
TGTTCCTCGTATACAGTACTAGTGCTCTCGCAAGCTAAATCGTGTAAACGTTATATTGTCAAAAAGCGAGCAAAAAGGA
TTATTTCCATAcattgTCCATAGCTTGGACACGacTTcAatGTAGataaaggttgtattcatatttacaaatatatcgt
attctcgtc > SEQ ID NO:3524 44189 254865_301639_1
ACGCGTCGCTTTCGTCCGACCCCGAAGGTATCCCAGCTATGGCGTTCGCTCTCGAGAGGTCTGCTCTCCTCGGCAATTC
CGTCGTCGGTTTGCCTTCCCTGCCCAAGCTTAGTATAGCCTCCCCCCCTTCCACCGTCAAAATCTTTGCCAGCGGAGCA
AAGAAGATTAAGACCAAGGCACCACTCGGTCCTTCCGGAGATACCTCTTACCGTAATGGAGCTGATGCTTCTGGATCCA
AGGGCAAGGGTAAGGGAGTGTACCAGTTTGTCAACAAGTATGGAGCCAATGTCGATGGTTACAGCCCAATTTTCACCCC
TGATGAGTGGTCACCCAATGGAGATACCTACGTCGGCGGTACCACTGGATTGGCTATCGGGCTGTGACCCTCGGAGGC
CTTCTCCTCGCTGGTGTCTTCCTTGTTTATAGTACCAGTGCCCTTTCACAGTAGATTGTTGTTGAAAAGACAGACAATC
CTCATTTACAATTTATCTTATGATTATATGTAAACCATTGAACATACTTCGCTGCTATCAATGAATGAGAGCTATCATC
TCTCCATTTCATTATTGTAATTGTCGGTCATTCGAATCGGAACATTTGATCTATTTTAGAA > SEQ ID NO:3525 44503 44185_300387_1
ttGTCATTaattaAGGCCATTACGGCCGGGgAAAACAATACAGTTTGGATTTTCTTTCTTTGTATTTTTCAAAGCAAAG
GCAATGGAAGGGAAGACTATGTTCAAGTTATCTCATGTAGTTGCTTTCTTGCTCCTTGCATCGCTTTTTCAACCTCTTA
CGGCAAGAGATCTAGTATTCGAAGTAAGTGACGGAATAGAAGTCTTGCAATTCCCAATGGCAAAAGAAAACCAAGTGGA
AACACTTGATGATCCCTCTCTCTCAATAATTTGCCCAGGAAAGCAATCATGGCCTGAACTTGTGGGAAAGCCAGCGGCG
ACTGCTAAGAGAATAATTGAGAAAGAAAATCCCATAGCCAAAGTTCAGTTTTTGTTCCCTGGTATGGTTAGGCCACTTA
ATTATGTTTGTGGTCGAGTTTTTGTTGTTGTTAACTGGAAACTCATTGTTCGAGATACTCCCAGCATGGGTTAATTAAA
TAGTTCTATGGGACTATTATGGAAGATTCAGAATAAGTTGCCCCAAGAATTAATAAATAGAGTACTGGTGTTCTATAGT
GTACTCTTCATGTACTGTACTATTTCAATATAATAAATAAAATAAGTGTGGCTTTTTAAATTTGTATTATAAATATCTT
GccTCATTCTCTTTTATGTTgtaaTTTTTt > SEQ ID NO:3526 44503 44362_300112_1
gccattacggccggggATAGTACAATTTGGAGttTcCTTCTTTGTATTTTTCAAAGCAAAGGCAATGGAGGGGAAGACA
ATGGTCAAGTTATCTCATGTATTTGCTTTTTTGCTCCTTGCATCACTTTTGCAATCTCTTACGGCACGAGATCTGGTAT
TCGAAGTGAATGATGGAATAGAAGTCTTGAAATTTCCAATGGCAAAAGAAAACCAAGTGGAAACACTTGATGATGCCTC
TCTATCATTAATTTGCCAAGGGAAGCAAAAATGGCCTGAAGTTGTGGGAATGCCAGGAAGGACTGCTAAGAAAATAATT
GAGAAAGAAAATCCCTTAGTCAAAGTTCATTTTTTGTTCCCTGATATGCTTCAACCATTGGATTTAGATTGTAGTCGAG
TTTTTGTTCTTGTTAACTGGAAATTCATCGTTCAAATTACTCCCTCAGTGGGTTAATAAAATAGTTCTATGGGACTATT
ATGGAAGATTCAGAATAAGTTGCCCCAAGAATTAATAAATAGAGTACTGGTGTTCTATAGTGTACTCTTTATGTACTCT
ACTATTTCGATATAATAAATAAAATAAGTGTGGCCTTTTTAAATTTGTATT

FIG. 2 continued

> SEQ ID NO:3527 44503 104430_300410_1
GCCATTACGGCCGGGGAATACAGTTTGGATTTTCTTTCTTTGTATTTTTCAAAGCAAAGGCAATGGAAGGGAAGACTAT
GTTCAAGTTATCTCATGTAGTTGCTTTCTTGCTCCTTGCATCGCTTTTTCAACCTCTTACGGCAAGAGATCTAGTATTC
GAAGTAAGTGACGGAATAGAAGTCTTGCAATTCCCAATGGCAAAAGAAAACCAAGTGGAAACACTTGATGATCCCTCTC
TCTCAATAATTTGCCCAGGAAAGCAATCATGGCCTGAACTTGTGGGAAAGCCAGCGGCGACTGCTAAGAGAATAATTGA
GAAAGAAAATCCCATAGCCAAAGTTCAGTTTTGTTCCCTGGTATGGTTAGGCCACTTAATTATGTTTGTGGTCGAGTT
TTTGTTGTTGTTAACTGGAAACTCATTGTTCGAGATACTCCCAGCATGGGTTAATTAAATAGTTCTATGGGACTATTAT
GGAAGATTCAGAATAAGTTGCCCCAAGAATTAATAAATAGAGTACTGGTGTTCTATAGTGTACTCTTCATGTACTGTAC
TATTTCAATATAATAAATAAAATAAGTGTGGCTTTTTAAATTTGTATTATTAaAaa

> SEQ ID NO:3528 44508 1117531_301847_1
TCTCTCTTCCCCACCTTGGTTGAATATTCTCCATCGACGGGGAGAGACAACAACAGGCATGGCCTCACTACTGAAGCAA
CTGCAAGGCAAAGCATGCGTGGCCTCCCAGTTCGTGTCGAAACACGGATCGTCCTACTACAAATCCCTGATGGAGAGCA
ACAAGCAGTACATCGCCTCCGAGCCCACCGTTGAGAAGTGTCAGGAACTTTCCAAACAACTCTTTTACACCCGTCTTGC
CAGCTTGCCCGCTCGATATGAACACTTTTGGAAAGAGCTGGATCTCGTGAAGCAGAAAATCAAGAACAGGCAAGACTTG
AAGGTGGAGGAGGTTGGGATTGCTACATTATTTTCATTGGAGTGCTATGCATGGTATTGTGTTGGAGAAATTGCCGGAA
GAGGTTTCACTCTCACAGGCTATTATCCTTGACCTTTTTCAAGCTTCCATTTAAAAGTCTAATAGGGAACCAAGGAGAG
AGCTGTTTCAGACAAACCTTCCTAATAATGTCACCTGTGTGAATTTACATGACTGCAATTTTTGCaATTATCCGACTGA
GTCATGGTCCTTTGTCTCCTTTTCAGTCTTTTTAAAGATAtttgtTATATCATGGCAGTTATG > SEQ ID NO:3529 44508 113092_300021_1
tgaagtagcccatcacaagaagcattgaattttgttgcgcgcttgacattgcttaagtggctctttaacaaaggcatca
tGGCGGCATGGCGCTAAGGGAACTATGGCTTCAAAACTACCTATAGTGAAAGCAAAGGCTGTTGAAGTTTCAAAATTCT
TGACCAAGCATGGATGTGCATACTACAAGCAGACGTTGGAACAGAACAAGCAATATATTCAAGAGCCACCTACTGTGGA
GAAATGCCAGCATTTGGCAAAACAAGTATTCTACACTCGCTTAGCTAGTATTCCTTGCCGCTATCAAGCATTCTGGAAG
GAACTTGATGTCAAGCACTTGTGGAAGCACAAACAGGAGCTGAAAATCGAGGATGCTGGCATTGCTGCTCTTTTGGCC
TTGAATGTTTTGCTTGGTTTTGTGCTGGGGAGATCATAGGACGAGGGTTCACGATTACTGGTTATTATGTCTGAATGTC
TCCAAGTATTAGGTTCGAAAGGAATGACTTATGTCACTGTTGATGAAAGGTCATTGTCAATCTCTACTTTGAGCGGGAT
AACACGTATCAGCGAGATACAGATTTTCAATTTTCATGTTTAGCAAGTACACAATGTATGCAGAGGATGAGGTCTTCTG
CTAAAGATTTCAAAGGCTgagttaggagtaatatacgtgc > SEQ ID NO:3530 44508 180804_300625_1
GAATTCGAAGGACTCTTTCTTCCTTTTCTTCTTCCTCATCTCCAACTCTAAACCCTAAATTTCAACACTACAGGTTTTG
TGATTGATTGTTGTTAGAGATGGCATCGAAGTTTGTTCAATTGCAAAGTAAGGCATGTCAAGCGACAAAGTTTGTGAGG
ACACATGGTTCAGCTTATTACAAGCAGAAGTTGGAGCAGAACAAGAAGTTTGTTCAAGAGCCAGCTACTGTTGAAAAGT
GTAATGAATTGTCCAAACAATTGTTCTATACTCGTCTTGCAAGTATTCCTGGTCGTACTGAGTCATTCTGGAAGGAAGT
TGGTGCTGTCAAGCAACTATGGAAGAATAGGCAAGAGCTGAAGGTTGAGGACGCTGGTATTGCTGCTCTCTTTGGCTG
GAGTGCTTTGCTTGGTTCTGTGCTGGTGAGATTGCAGGAAGAGGATTTACCTTCACTGGTTACCATGTCTGATAAACAC
AATGTACCACCCAATGCTTCAACAAGGA > SEQ ID NO:3531 44508 128371_300475_1
ctctatcagaaagctagggtcactgctatgggcgactgaagcaAAACATCGCCCATAGTATTACTGCAAATTGTTGACG
AAAGGACTTTCTTGGTATTGATGGCATCCAAGATTCAGCAACTGCAATCTAAGGCATGTCAAGCTTCACAGTTTCTTGC
TAAGCATGGTACTGGCTACTACAAACAGATGCTGGAGCAGAACAACAGTATATTGTGGAGCCACCCAGTGTTGAGAAA
TGCAATGAATTGTCCAAGCAGTTGCTCTACACTCGTCTTGCCAGCATCCCTGCCCGTTATGAGTCATTTTGGAAGGAAG
TCGATTCCGTCAAGCACATCTGGAGGAATAGAAAGGAATTGAAGGTTGAAGATGCAGGTATTGCTGCTTTGTTCGGCTT
GGAGTGCTTTGCATGGTATTGTGCTGGTGAGATAGTAGGAAGAGGATTTACATTCACTGGTTACTATGTCTGAGATATC
AGTTCCCAAAAATTTGTTTGCGGAAATTGACAATTGTAAGATCTCTTTTTTATTaggATGATTTGAgtaacaggGAATT
CATATAag > SEQ ID NO:3532 44508 254947_301640_1
GATTCTCCATCGACGGGGAGAGACAACAACAGGCATGGCCTCACTACTGAAGCAACTGCAAGGCAAAGCATGCGTGGCC
TCCCAGTTCGTGTCGAAACACGGATCGTCCTACTACAAATCCCTGATGGAGAGCAACAAGCAGTACATCGCCTCCGAGC
CCACCGTTGAGAAGTGTCAGGAACTTTCCAAACAACTCTTTTACACCCGTCTTGCCAGCTTGCCCGCTCGATATGAACA
CTTTTGGAAAGAGCTGGATCTCGTGAAGCAGAAAATCAAGAACAGGCAAGACTTGAAGGTGGAGGAGGTTGGGATTGCT
ACATTATTTTCATTGGAGTGCTATGCATGGTATTGTGTTGGAGAAATTGCCGGAAGAGGTTTCACTCTCACAGGCTATT
ATCCTTGACCTTTTTCAAGCTTCCATTTAAAAGTCTAATAGGGAACCAAGGAGAGAGCTGTTTCAGACAAACCTTCCTA
ATAATGTCACCTGTGTGAATTTACATGACTGCAATTTTTGCAATTATCCGACTGAGTCATGGTCCTTTGTCTCCTTTTC
AGTCTTTTTAAAGATATTTGTTATATCATGGCA

FIG. 2 continued

> SEQ ID NO:3533 44508  46158_300176_1
ATCGACTCATCTCTCAGCTCACCGGTGCTGCATTATCAAAACTGCAGGAAGGATTTGGTTGTGAAGATGGCATCGAAGT
TGATACAAGTTCAATCAAAGGCATGTGAGGCTTCAAAGTTTGTGGCTAAGCATGGAACTTCCTACTACAGACAGCTGTT
GGAGAAGAACAAGCAGTATATCCAGGAACCTGCCACTGTTGAGAAGTGCCAAGAGTTGTCTAAGCAGTTGCTCTACACC
CGTCTTGCTAGCATTCCCGGACGCTATGAAACCTTCTGGAAGGAAGTAGACTACGCAAAGAACCTATGGAAGAACAGAT
CCGGTCTG

> SEQ ID NO:3534 44558  111252_300053_1
AAAGTTTGTATGAAACTGGATTCAGAAGTAACTGGATCATAACATTTTGAAGATTTTGTATTACAAATTTACACGTATT
GCTACTCAT

> SEQ ID NO:3535 4743  4510_300095_1
GCTCGAGAATTGCGGCCGCGAAAGAATGAAGCTATATTCCCCACAAGACCGATGTGGGTTTACGGATCGATATGGGATG
CATCGGACTGGGCCACAGAAAATGGAAGGATCAAAGCCGACTATCGATACCAACCATTTGTGGCTAAGTACAAAAACTT
TAAGCTAGCGGGATGCACAGCGGATAGCTCTAGCTCATGCAGACCGCCATCGCCTGCACCCATGCGCAACCGCGGGTTG
AGCCGGCAGCAGATGGCGGCATTGACATGGGCACAGAGGAACTTCTTGGTCTATAACTATTGCCATGATCCGAAAAGAG
ACCATACCCAAACACCAGAATGTTAAAACAAACAAACAAAGAAAGGTTATAATAATTTTATTTTGCATTATCAAACAT
ACATGAATAATTGGAGGTCTTGTGACGGGTCCACACTGGAAACTATATTGAAGCAGTTGAGCGTCCGGTCCTCTATGAT
TTGAGATTAAAAAGAAAAGGTTTTGTTTTTCAATACTTTGTAATGTTTCCATTTGGTATCTTTCTTATAATtgtaATAT
TgtgtgatCACATATATTAATATCT > SEQ ID NO:3536 4837  271915_200039_1
tgcagtcaagaatactttcttatctcttccttctacaatggcaactgctacaatgtctctctcTTCCCCTTCTTTTGCC
GGAAAGGCAATAAAACTCTCACCATCTTCCTCTGAAATTACTGGAAATGGAAAAGTCACCATGAGGAAGACTGTTACCA
AGGCTAAGCCTGTCTCCTCTGGCAGCCCATGGTACGGTCCTGATCGTGTCAAGTATTTGGGCCCATTTTCTGGTGAGTC
CCCAAGTTATTTGACTGGTGAATTTCCTGGTGATTACGGTTGGGATACTGCTGGACTTTCAGCTGATCCGGAAACCTTT
GCCAAAAACCGTGAGCTAGAGGTTATTCACTGCAGATGGGCTATGCTTGGAGCTCTTGGTTGCGTCTTTCCTGAGCTCT
TGGCCCGTAACGGTGTCAAGTTCGGCGAAGCTGTATGGTTCAAAGCTGGATCGCAGATTTTCAGTGAGGGTGGACTTGA
CTACTTGGGCAACCCAAGCTTGGTCCACGCGCAAAGCATCTTGGCTATTTGGGCTTGCCAAGtTGTGTTGATGGGAGCC
GTCGAGGGTTATCGTATTGCTGGTGGACCTCTTGGTGAGGTTGTTGACCCACTTTATCCTGGTGGTAGttttgacccat
tgggtCtTGCAGATgacccggAAGcttttgcTGAGCTTaaagt > SEQ ID NO:3537 4837  274126_200148_1
ACATTTGGAGCTAAGAAGAGGTAGAGAAAATGGTGGTAAGATTGCGGTTGTCGAGGTTCGGATGCAAAAACAAACCTTT
TTACAGAGTAATGGCGGCGGATAGCAGATCTCCCCGAGATGGCAAGCACTTGGAAGTCCTCGGTTACTACAATCCTCTC
CCAGGACAAGATGGTGGCAAACGGATGGGTCTTAATTTTGACCGGGTGAAATATTGGTTATCGGTTGGTGCACAGCCGT
CAGAACCGGTTGAACGTCTTCTTTTCCGAGCTGGCGTATTACCTCCTCCACCTATGCTAGCTATGGGACAAAAAGGCGG
TCCACGGGACACTCGTCCAGTTCATCCTATGACTGGACGTGCGTGGCACCGGAAAGTGTCAAAATTGCTGATCCAAAA
GTTAGTGCTAAAGTTGATGGAGATGACAAAGCTTAGAACCCGACTAGTTATATTTTATACGACTTCAACTTGAATAGCT
AATGTTTGTTCCAATAGTGATCTGTTGATATGTGATAATTACAGAACTAATATCTGTTTGTTGCTCTTGATTGCTGGGA
AACTTGATATCCAAGGACATATCATCGTTAAAGATGCTGTTGTCAGTGGTCTCTATAAACTATGTGATC > SEQ ID NO:3538 4837  4637_300310_1
CGCGCACTACTCAACCTTAATGGCCGACTCAACAATGGCTCTCTCCTCCCCTGCCTTCCCCGGCAAGGCCGACAAGCTT
TCCCCCG > SEQ ID NO:3539 4837  46145_300176_1
tcctttcctttcattgtagttaacgaaaagattacgattttggcaacatcagctatccagcaatcctccttcgccggcc
aAACGGCTCTCAAGCCCTCCAACGAACTCCTCCGCAAGGTTGGTGTATCCGGTGGTGGCCGTGTGACCATGCGTCGTAC
CGTCAAGTCTACTCCTCAAAGCATCTGGTACGGACCAGACCGTCCCAAGTACTTAGGACCATTCTCGGAGAATACACCG
TCCTACCTAACCGGAGAATACCCCGGAGACTACGGCTGGGACACCGCTGGACTCTCGGCTGACCCGGAGACATTCGCTA
AGAACCGTGAGCTTGAAGTAATCCACAGCAGATGGGCTATGTTGGGTGCTCTCGGATGCACATTCCCTGAGATTCTCtc
cAAGAACGgtgttAAATTCGGAGAAgccgtgtggttcaAGGCaGGTTCTCaGATTTTCTCagaaggaggtcTTGATTAC
CtcGGAAACCCTAACTTGATCCACGCGCAAAGCATCTTagccaTCTGGGctgttcaAGttgtgctCATGGggttCATTG
AaggctACAGAATCggAg

FIG. 2 continued

> SEQ ID NO:3540 4837    55863_300130_1
tttAAAAGATaattgtGAGAaATAGATGATaacccAaagGtttagcAATCTCGAGAGTAAAAAAAAAGAAaactcaaAA
cCAAAGATTATAATGGCTTCCTCAACCATGGCTTTGTCCTCCCCTGCCTTCGCCGGAAAGGCTGTGAAGCCTGCCGCAT
CAGATGTCCTCGGAAGCGGCCGTGTGACCATGAGGAAGACTGTCGCCAAGCCAAAGGGTCCATCAGGCAGCCCATGGTA
CGGATCTGACCGAGTCAAGTACTTGGGTCCATTCTCCGGCGAGCCCCCGAGCTACCTTACCGGTGAGTTCCCCGGTGAC
TACGGATGGGACACCGCTGGTCTATCCGCCGACCCAGAGACCTTCGCCAGGAACCGTGAGCTAGAAGTTATCCACAGCA
GATGGGCCATGCTCGGAGCCCTAGGCTGCGTTTTCCCTGAGCTATTGGCTAGGAACGGAGTGAAGTTCGGAGAAGCGGT
TTGGTTCAAGGCCGGTTCACAGATCTTCAGCGACGGAGGATTGGACTACTTGGGCAACCCGAGCTTGGTCCACGCTCAG
AGCATCTTAGCCATTTGGGCTACTCAAGTTATCCTCATGGGAGCTGTTGAGGGCTACAGAGTCGCCGGAGATGGTCCAT
TGGGAGAAGCAGAGGACTTGCTTTACCCAGGTGGGAGCTTCGACCCATTGGGCCTCGCTACTGACCCCGAGGCTTTCGC
GGAGTTGAAGGTGAAGGAGCTCAAGAACGGAAGGTTGGCTATGTTCTCTATGTTTGGATTCTTCGTTCAGGCCATTGTC
ACCGGAAAGGGACCGTTGGAGAACCTCGCGGACCACTTGGCTGATCCAGTCAACAACAATGCATGGGCCTTCGCTACCA
ACTTCGTCCCCGGAAAGTGAGTTTAATTTGTGATCGAGTTGTGTGTATCCGGTTTGTTGCATCTTGGAAATGTGATGCA
GATTTCATATCTtgtaaattactttgtatgtgtgtgaaatatttaagaagctttatgataaaaaaaaaaaccaaaaaag
gcggacgcgtggg > SEQ ID NO:3541 4837    53352_300088_1
CCCACGCGTCCGCATTTTTCCATCTTCCTCATCACCTTCCCAAGAAGAAGAACACCAAAGAAGAAGAAAGGTTAATAAT
GATGGGCAGTGTCGAGCTGAATCTGAGGGAGACTGAGCTGTGTCTTGGTCTTCCCGGTGGAGATACAGTGGCTCCGGTA
ACCGGAAACAAGAGAGGGTTCTCAGAGACGGTTGATCTGAAGCTAAATCTGAATAATGAGCCTGCAAACAAGGAAGGAT
CTACGACTCATGACGTCGTGACTTTTGATTCCAAGGAGAAGAGTGCTTGTCCTAAAGATCCAGCCAAACCTCCGGCCAA
GGCACAAGTTGTGGGATGGCCACCGGTGAGATCATACCGGAAGAACGTGATGGTTTCCTGCCAAAAATCAAGCGGTGGC
CCGGAGGCGGCGGCGTTCGTGAAGGTATCAATGGACGGAGCACCGTACTTGAGGAAAATCGATTTGAGGATGTATAAAA
GCTACGATGAGCTTTCTAATGCTTTGTCCAACATGTTCAGCTCTTTTACCATGGGCAAACATGGAGGAGAAGAAGGAAT
GATAGACTTCATGAATGAGAGGAAATTGATGGATTTGGTGAATAGCTGGGACTATGTTCCCTCTTATGAAGACAAAGAC
GGTGATTGGATGCTCGTCGGCGACGTTCCTTGGCCAATGTTCGTCGATACATGCAAGCGTTTACGTCTCATGAAAGGAT
CGGATGCCATTGGTCTCGCTCCGAGGGCGATGGAGAAGTGCAAGAGCAGAGCTTGAAGTCAAATTAAAAGGATAAGTGG
TATCGATTATATATTTGATTAAcccATTGATTggtgttaattgctcttttttttcttacgatgaacatacattgttcag
tttcttttgattgtctgtgttttgatcaaaaaa > SEQ ID NO:3542 4837    51021_300116_1
GCGCGTCTTGGTTGTAAACACCGACCCTTCTATCGTGTAGTTGTCGCCGATGAAAAATCGCGCAGGGACGGTAAACAAA
TCGAGGTGTTAGGCTTTTATGATCCACTCCAAGGCAAAGAAGATGCGGATAGAGTGAGCCTCAAATTCGACAGAATCAA
GTACTGGTTATCTGTTGGAGCTCAACCAACAGACACAGTGGAAAGCATGCTTTTCAGGGCCGGTTTGATACCACCAAAG
CCTATGGTAGTGGTCGGTTCAAAAAATGGGCAGAAGTCTACGAGCCAACATGTTTCACCCATTACAGGTGAAATCTTGA
ACTAAGAGTGTTGATGCGTTGAGCAAGAAAGAGCCTTTTGTGTCTGTGTGAAAGGAGTTTATGTAATGTTGTTTAAGAC
TTTTCTGTTTATGTGAAAGGAGTTAATGTAATGTTGTTTAAGACTTTTGCTTTCTATGTGAAAGCAGTTTAATGTTATG
TT > SEQ ID NO:3543 4837    44507_300427_1
CGGCATTTCAAACCATCAAACAATCACTTTTCTTTTTCATACACCATGGCTGCTTCTTCAATGGCTCTTTCTTCCCCTT
CTTTTGCTGGACAGGCAGTGAAACTCTCCCCATCTGCCTCAGAAATCACTGGAAATGGAAGGGTCTCCATGAGAAAGAC
TGTCACCAAACCTGTTGCATCTAGCAGCCCATGGTACGGCCCAGACCGTGTTAAGTACTTGGGCCCATTCTCCGGTGAG
GCCCCAAGCTACTTGACCGGTGAATTCCCAGGTGATTACGGATGGGATACTGCTGGACTTTCAGCAGATCCAGAAACCT
TTGCCAAGAACCGTGAACTCGAAGTGATCCACTGCAGGTGGGCTATGCTTGGAGCTCTTGGATGTGTCTTCCCTGAGCT
CTTGGCTCGTAATGGTGTCAAGTTTGGCGAAGCTGTCTGGTTCAAGGCTGGATCCCAAATCTTTAGTGAGGGTGGACTT
GACTACTTGGGCAACCCAAGCTTGGTCCATGCACAAAGCATCTTGGCCATCTGGGCTTGCCAAGTTATCTTGATGGGAG
CTGTTGAGGGTTACCGCGTTGCTGGTGGGCCTCTTGGTGAAGTTGTCGACCCACTCTACCCTGGTGGCAGCTTTGACCC
ATTAGGCCTTGCTGATGACCCAGAGGCATTTGCTGAGCTCAAAGTAAAGGAGATCaaGaatGGTAgaCtTGCCATGTTC
TCTATgtTCGGATTCTTTGt > SEQ ID NO:3544 4837    103636_300362_1
tttcttTATCACTTCAGCCATCAGAAAACTCTTCATTCTCCTTATTAAGCCATGGCTGCTTCTACAATGGCTCTTTCCT
CTTCTTTTGCCGGGAAGGCACTAAAACTCTCGCCATCTTCCTCTGAAATCACCGGAAATGGGAAAGTTACCATGAGGAA
GACTGCTAGCAAGCCCAAGCCTGTCTCTTCTGGCAGTCCATGGTATGGCCCTGACCGTGTCAAGTACTTGGGTCCATTC
TCTGGTGAGTCCCCAAGCTACTTGACTGGTGAGTTCCCTGGTGACTACGGGTGGGACACTGCTGGACTTTCAGCTGATC
CAGAAACTTTTGCCAAGAACCGTGAGTTGGAGGTGATCCACTGCAGATGGGCCATGCTTGGAGCTCTTGGATGTGTCTT
CCCCGAGCTCTTGGCCCCGTAACGGTGTCAAGTTTGGTGAGGCTGTATGGTTCAAGGCTGGATCCCAAATATTCAGCGAG
GGTGGACTTGACTACTTGGGCAACCCAAGTTTGGTCCATGCTCAAAGCATCTTGGCCATTTGGGCTTGTCAAGTTGTGT

FIG. 2 continued

TGATGGGAGCCGTTGAGGGTTACCGTGTTGCTGGTGGGCCTCTTGGGGAGGTTGTTGATCCACTCTACCCCGGTGGCAG
CTTCGACCCATTGGGCCTCGCTGAAGACCCAGAGGCTTTTGCTGAGCTCAAGGTAAAGGAGATCAAAAATGGTAGACTT
GCCATGTTCTCCATGTTTGGATTCTTTgttcaggctAtCGTaaCTGGaaagggcCCATtggagaaccttGccGATcAcc
tTGCagacccagttaataacaacGCttGGGcctAcgcaaCaaacttTGtccc > SEQ ID NO:3545 4837    107135_300263_1
CCGTGTAGTAGCTGCATTCAAGAGTTTCTCATCTACTTTCTATAATGGCAGCTGCTACAATGGCTCTCTCTTCCTCTTC
ATTTGCCGGAAAGGCGGTAAAACTCTCACCATCTTCCTCTAAAATCACTGGAAATGGAAAAGTTACCATGAGGAAGACG
GTTACCAAGGCCAAGCCTGTTTCTGCTGGTAGCCCGTGGTATGGTCCTGACCGTGTCAAGTACTTGGGACCATTCTCTG
GTGAGTCTCCCAGCTATTTGACTGGTGAGTTTCCTGGTGACTATGGATGGGACACTGCTGGACTTTCAGCCGATCCTGA
AACTTTCGCCAAAAACCGTGAGCTAGAGGTTATCCACTGCAGATGGGCGATGCTTGGAGCTCTTGGTTGCGTCTTCCCC
GAGCTCTTGGCACGTagCGGTGTCAAATTCGgtgAAGCTGTATGGTTCAAGGCTGGATCCCAAATTTTCAGCGAGGGTG
GACTTGACTACTTGGGCAACCCAAGTTTGGTTCACGCACAAAGCATCTTaGcCATATGGGCTTGCCAAGTtgtgttGAT
GGGAGCTgttg > SEQ ID NO:3546 4837    1101426_301476_1
TCTTTCTCTCCTTGTTTGTAAAGGATGGGAGTGGTGAAGCTTCGGCTGGCCCGATTCGGGCGAAAGAATATGCCCTTCT
ACCGCATTCATGCTGCCGACAGCAGAGCTCCCCGCGACGGAAAATTCCTCGAAAAAATCGGATGGTACAACCCCCTTCC
TGGTAAAGATGGGCACAAGCGAATTGGGATAAATTTTGATAGAGCAAAGTACTGGTTAGCAGTTGGAGCACAACCATCA
GATGTGGTAAAGAGGTTGTTCTTTATTGCCGGTATCTTGCCTAAACCACCTGTTCCTCCCATGCCAAAGAAGCCCCATC
GTCAACAAGTAAAGGAGTCTCCTTCGAAAGAGCATTAGTAGGGAGAACAAGGCACATTTGTCAACATTCAAAGGTCAAG
GCAAGGAGGGTGGCAAAGTGAACAGAAATGGATTCCAAGGTGCTGCAGTATGTAATGTAGCATTACATTATATTGCATT
TGTAACCAGGCATTCCAGAAGTGTGGATTTTAACAAAAGTAGCCTTCTATTTGATAATATGCTCAAGTCTGAATGGGGA
TACATTTAAATAGT > SEQ ID NO:3547 4837    108311_300381_1
cttctttctGTGTAGTAGCTGCATTCAAGAGTTTTTCATCTTCTTTCTATAATGGCAGCTTCTACAATGGCTCTCTCTT
CCTCTTCATTTGCCGCAAAGGCGGTAAAACTCTCATCATCTTCCTCTGAAATCATTGGAAATGGGAAAGTTATCATGAG
GAAGGCGGTTACCAAGGCTAAGCCAGTCTCTTCAGGCAGCCCATGCTGTACGGTCCTGACCGTGTCAAGTACTTAGGACCA
TTCTCCGGTGAGTCTCCGAGCTACTTGACTGGTGAATTTCCTGGTGACTATGGATGGGACACTGCTGGACTTTCAGCTG
ATCCAGAAACTTTTGCCAAGAACCGAGAGTTGGAGGTGATTCACTGTAGATGGGCTATGCTTGGAGCTCTTGGTTGCGT
CTTCCCTGAGCTCTTGGCACGTAATGGTGTCAAGTTCGGTGAAGCTGTATGGTTCAAGGCTGGATCCCAAATTTTCAGC
GAGGGTGGACTTGACTACTTGGGTAACCCAAGTTTGGTCCACGCACAAAGCATCTTagcCATCTGGGCTTGCCAAGTTG
TGTTGATGGGAGCCgttGaggGTTACCgtGTTGCTGgTGGACCTCTTG > SEQ ID NO:3548 4837    112407_300002_1
aggactttggtcctacctagttatttatatacagttgctgcaaggccattaaactcAAGCCATAAATCAAATATTCTTT
CTGTGTAGTAGCTGCATTTTCAAGAGCATTTCACTTTATTTCTGCAACAATGGCAGCTTCTACAATGGCTCTCTCTTCC
TCTTCTTTTGCCGGAAAGGCGCTGAAACTCTCACCATCTTCCTCTGAGATCACCGGAAATGGAAAAGTTACCATGAGGA
AGACAGTTACCAAGGCGAAGCCAGTCTCTTCTGGCAGCCCATGGTATGGTCCTGATCGCGTCAAGTATTTGGGCCCATT
CTCCGGTGAGTCCCCAAGTTACTTGACTGGTGAGTTCCCTGGTGATTATGGGTGGGACACTGCTGGACTTTCAGCTGAT
CCCGAAACTTTTGCAAAGAATCGTGAGCTAGAGGTGATCCACTGTAGATGGGCCATGCTTGGAGCTCTTGGTTGTGTCT
TCCCCGAGCTCTTGGCCCGTAATGGTGTCAAATTCGGTGAGGCTGTATGGTTCAAGGCTGGATCTCAAATTTTTAGCGA
GGGTGACTTGACTACTTGGGCAACCCAAGTTTGGTCCATGCACAAAGTATCTTGGCCATCTGGGCTTGCCAAGTCGTG
TTGATGGGAGCTGTTGAGGGTTATCGTGTTGCTGGTGGGCCTCTTGGTGAGGTTGTTGACCCACTCTATCCTGGTGGTA
GCTTTGACCCATTAGGTCTtGCTGATGATccagaggctTTtGCTGAGCTCaaggtgaaggaGatcaagaacggTagact
tgccATGtTCTCaaTgtttggattCttCg > SEQ ID NO:3549 4837    2044_300349_1
AATTCGGCACGAGCTTCAATCTCCTTATTAAACAATGGCTGCTTCTACAATGGCTCTCTCCTCTTCTTTTGCCGGAAAG
GCAGTAAAACTCTCACCATCTTCCCCTGAAATCACCGGAAATGGAAAAGTTACCATGAGGAAGACTGCTAGCAAGGCCA
AGCCTGCCTCTTCTGGTAGCCCATGGTACGGTCCTGACCGCGTCAAGTACTTGGGCCCTTTCTCTGGTGAGTCTCCAAG
CTACTTGACTGGTGAGTTTCCTGGTGACTACGATGGGACACTGCCGGACTTTCAGCTGATCCAGAAACTTTTGCCAAG
AACCGTGAGTTGGAGGTGATCCACTGCAGATGGGCCATGCTTGGAGCTCTTGGATGTGTCT > SEQ ID NO:3550 4837    181726_300627_1
GAATTCAAGAGAAGCTCTAAAATCTGTCTCAACCAATAAGAAAgCAATTTAAGATCTCTTATTAAAAAACTCACCATTT
TGAGTACTCTATTTAAGCAACCCAACTGCAACAACCACAAACATCATCTCCTTGCAATTCTTATAGCACTTCAATTTTC
TCATCCATCCATATATCAGTTAGCCATGGCAGCTTCTACAATGGCTCTATCTTCACCTGCATTGGCTGGCAAGGCACTT

FIG. 2 continued

```
GTTCCTTCCAGCTCTGAAGTTTTCGGTGAAGGCAGAATCTCCATGAGAAAAACCGTTGCAAAGCCAAAAACCGTTTCAT
CTAGCCCATGGTACGGACCTGACCGTGTTAAGTACTTGGGACCATTCTCTGGTGAATCTCCATCGTACTTAACCGGTGA
ATTTGCCGGTGATTACGGTTGGGACACCGCCGGTCTTTCTGCTGACCCAGAAACCTTCGCCAAGAACCGTGAGCTGGAG
GTCATTCACTGCAGATGGGCTATGTTGGGAGCTCTTGGATGTGTCTTCCCCGAATTGTTGTCTCGCAATGGTGTTAAAT
TTGGTGAAGCCGTTTGGTTCAAGGCTGGTTCACAAATTTTCAGTGAAGGTGGATTGGACTACTTGGGTAACTCAAGCTT
GGTTCATGCTCAGAGCATCCTTGCCATTTGGGCAACACAAGTTATCTTGATGGGTGCTGTTGAAGGTTACAGAGTTGGA
GGAGGACCATTAGGTGAGGTGGAGGACCCACTTTACCCTGgTGGAAGCTTCGaCCCATTAggCTTAGCTGATGATCCag
aaGCTTTTGCTgagTTgaaggtgAaggAAATTAagaacgggagattggCTATGttctccATGTttggattCTtt > SEQ ID NO:3551  4837    175819_300522_1
CCCCCCGAAAACCCTTGCTCCCACAGGAGTGAACACGACGCGACCCGAGCCGGAGAAGGGGAAGGGAAGGCGGCGGCGG
CGGCGGCGGAGGAGGAGGAGGCGCGAGGGGAGGCGAGCATGGTGGTGCGGATCCGGCTGGCGCGGTTCGGCTGCCGGAA
CCGGCCGTTCTACCGGGTGATGGCCGCCGACAGCCGCTCCCCGCGCGACGGCAAGCACCTCGAGGTCCTCGGCTACTAC
AACCCGCTCCCCGGGAAGGATGGTGGCAAGAGGATGGGGCTGAAATTCGACAGGGTCAAGTACTGGCTGTCTGTTGGTG
CTCAGCCATCAGATCCTGTGCAGCGCATCCTTTTTCGAGCTGGGCTTCTGCCTCCACCTCCAATGCTAGCTATGGCTCG
AAAGGGTGGACCTCGTGATAGGCGCCCAATTCATCCGATGACTGGGCGCCCCTTGG > SEQ ID NO:3552  4837    15362_300239_1
CTCGAGCTTGCGGCCGCCTCGCGCGTCTTGGTTGTAAACACCGACCCTTCTATCGTGTAGTTGTCGCCGATGAAAAATC
GCGCAGGGACGGTAAACAAATCGAGGTGTTAGGCTTTTATGATCCACTCCAAGGCAAAGAAGATGCGGATAGAGTGAGC
CTCAAATTCGACAGAATCAAGTACTGGTTATCTGTTGGAGCTCAACCAACAGACACAGTGGAAAGCATGCTTTTCAGGG
CCGGTTTGATACCACCAAAGCCTATGGTAGTGGTCGGTTCGAAAAATGGGCAGAAGTCTACGAGCCAACATGTTTCACC
CATTACAGGTGAAATCTTGAACTAAGAGTGTTGATGCGTTGAGCAAGAAAGAGCCTTTTGTGTCTGTGTGAAAGGAGTT
TATGTAATGTTGTTTAAGACTTTTCTGTTTATGTGAAAGGAGTTAATGTAATGTTGTTTAAGACTTTTGCTTTCTATGT
GAAAGCAGTTTAATGTTATGTTGGTTAAGACGCG > SEQ ID NO:3553  4837    136735_300438_1
CCCGCTAAAACCCTCGCCTTTTTCTGAGACTCAGAGCGGCGGCGAGCGCCGGCCGGTCGACGGCGGAGGAATTGGTGTG
GAGAGGGCGGGGAGATGGTGGTCCGGATCAGGCTGGCGCGGTTCGGCTGCCGGAACAGGCCCTTCTACCGGCTCATGGC
CGCCGACAGCCGCTCCCCGCGCGACGGCAAGCACCTCGAGGTCCTCGGCTACTACGACCCGCTCCCCGGGAAGGATGGT
GGCAAGAGAATGGGGTTAAAATTCGACCGGGTGAAGTATTGGCTATCAGTTGGAGCACAGCCATCGGATCCTGTGGAGC
GCATCCTCTACCGTGCTGGAATTCTACCTCCACCTCCAATGCTAGCTATGGCCCACAAGGGTGGGCCTCGCGACAGACG
TCCTATTGATCCCATGACTGGGCGCCCCTTAGACCTTGAGGGTGTCACAGTTGTTGATGATTCTCATACTCCCAAGAGT
GGTGATGGAGCACCTAACGAGGAGACAGCATAGATGAGGCATGATGATATATCTGTTTTAGCATATTGTGTGGTTTTGC
AAGATTAAAAAGTACTGTTTGTGGCCTTTCTGATGGGTGTTTGAGCCTGTGACTAGTATGTTGTGACCTTTCTTGCTGA
CCGGCTTTATTGATCTA > SEQ ID NO:3554  4837    134970_300420_1
AGGGCGGCGGAGGAGGAGGGACGGATGCGGCTCCGCTGACGCTCGAGCTGCTGCCCAAGGGCGGGGCCAAGCGCGGGTT
CGCGGACGCCATCGTTGGGGGTCCCGCCGGCCAGCGGCGGGAGGCGGCCGGGGGCAAGGCCGGCGGCGGCGGCGGCGCG
GCGGAGGCCGAGGAGGAGGAGGAGAAGAAGAAGGCGCAGGCGCCGGCGGCGAAGGCACAGGTGGTAGGATGGCCACCAA
TCCGCAGCTACAGGAAGAACACCATGGCGATGAGCCAGCCTGCTCTGAAAGGCAAAGACGACGGCGAGGCGAAGCAGGC
TCCGGCATCCGGTTGCCTCTATGTCAAGGTGAGCATGGATGGTGCTCCTTACCTCAGGAAGGTGGACCTCAAGATGTAC
AAGAACTACAAGGAGCTCTCTTTGGCTCTGGAGAAGATGTTCAGCTGCTTTACCGTCGGTCATGGTGAATCAAATGGGA
AGTCAGGGAGAGATGGATTATCTGATTGCCGCCTGATGGATCTTAAAAATGGAACAGAACTTGTGCTCACTTATGAGGA
CAAGGATGAAGATTGGATGCTTGTTGGTGATGTTCCGTGGCGAATGTTCACAGACAGCTGTA > SEQ ID NO:3555  4837    12644_300273_1
CCCACGCGTCCGAACAACAAATCTTAAACGTTTTACTTTGTGCTGCACTACTCAACCTCAATGGCCGCCTCAACAATGG
CTCTCTCCTCCCCTGCCTTCGCCGGTAAGGCCGTCAAGCTTTCCCCCGCGGCATCTGAAGTCCTTGGAAGCGGCCGTGT
GACAATGAGGAAGACTGTTGCCAAGCCAAAGGGCCCATCAGGCAGCCCATGGTACGGATCTGACCGTGTCAAGTACTTG
GGTCCATTCTCTGGCGAATCACCGAGCTACCTTACCGGAGAGTTCCCCGGAGACTACGGATGGGACACCGCCGGACTTT
CAGCTGACCCCGAGACATTCGCAAGGAACCgtGAACtataagttAtCCACAgcaggtgggCCATGCtcgGAGCCCtagg
ctgcgtcTTcccTGAGCTTTtggctagaaAcggagTcaaGttCggAGa > SEQ ID NO:3556  4837    126123_300460_1
gccattacggccggggacagctaaCTTCTCTATTACTTCAGCCATCAAAAAACACTTATTTTTCCTTATTAAACCATGG
CTGCTTCTACAATGGCTCTCTCTTCCACTTCTTTTGCCGGAAAGGCAGTAAAACTCTCACCATCTTCCTCTGAAATCAC
CGGAAATGGGAAAGTTATCATGAGGAAGACTGCTAGCAAGCCCAAGCCTGTCTCTTCTGGCAGCCCATGGTACGGTCCT
```

FIG. 2 continued

```
GACCGTGTCAAATATTTGGGTCCATTCTCCGGTGAATCTCCAAGTTACTTAACTGGTGAGTTTCCTGGTGACTATGGAT
GGGATACCGCTGGACTTTCAGCTGATCCAGAAACTTTTGCCAAGAATCGTGAGTTGGAGGTAATCCACTGCAGATGGGC
TATGCTTGGAGCTCTTGGTTGTGTCTTCCCTGAGCTCTTGGCTCGTAACGGTGTCAAGTTCGGTGAAGCTGTATGGTTC
AAGGCTGGATCCCAGATTTTCAGCGAGGGTGGTCTTGACTACTTGGGCAACCCAAGTTTGGTCCATGCTCAAAGCATCT
TGGCTATTTGGGCTTGCCAAGTTATTTTGATGGGAGCTGTTGAAGGTTACCGTGTTGCCGGTGGACCTCTTGGCGAGGT
TGTTGATCCACTTTACCCTGGTGGCAGTTTCGACCCGTTAGGCCTTGCTGAagacccagaagcttTGCTGAgctaaag
gTaaAggagatcaagaacGgCagacttgccaTGTTTTccATgTtTggattctTTGt > SEQ ID NO:3557    48423    48463_300119_1
GCCATTACGGCCGGGGATGGAGCTGCAAGATTGGAAAGAGGCATTGAAGTATTGCAGATTAACTATCCCGGGTTATGAG
AGAGTTTATCCAGAATGTCATCCTTTGCTCGGACTGCAATATTACACTTGGGGAAAACTTGAATGGTGGCTTGGTGAGA
CTGAGGAAGCTTATAGGGCACTAGCCAAGGCAGCAGAGATACTGCGAATTACTCATGGAACAAACAC > SEQ ID NO:3558    4845    237716_301280_1
agcgatgGCACCAGGTAAGCAGCGCCGCGACGACACCAAGAGCAAGGCGGCCAAGGCGGCCTTGTCGGCCAAGAGCGTC
AAGAATCCGGCCCCGAAGATGCGGCGGAGGAAGATCAGAACCTCCGTCACATTCCACCGGCCCAAGACCCTGAAGCAGG
CGAGGTCCCCAAAGTATCCCCGCCTGAGCGCCCCCAACCGCGAGAAGCTGGACCACTACAAGGTGCTCAAGTACCCGCT
CACCACCGAGTCGGCCATGAAGAAGATCGAGGACAACAACACCCTCGTCTTCATCGTCGACATCCGGGCCGACAAGAAG
AAGATCAAGAATGCCATCAAGATGATGTACGACGTCCAGACCAAGAAGGTCAATACTCTCATCAGGCCCGACGGTTTGA
AGAAGGCGTACGTGAGGCTCACCCCGGACATTGACGCTTTGGATGTGGCGAACAAGATTGGCATCATCTAGAAGAGCAA
GCTTAAAATCGGGTTTGTGTATCGCTTTAATGCAAAGTTTATGGTTTTTTTC > SEQ ID NO:3559    4845    272238_200042_1
AGCAGCTTCTCTCAGGGTTTCACACTGTACTTAACCAAATGGCTCCAGCTAAAGCTGATCCGTCCAAAAAATCTGATCC
CAAGGCACAGGCAGCTAAGGTTGCCAAGGCCGTCAAGTCAGGATCAACCTTCAAGAAGAAGTCACAAAAGATAAGGACA
AAAGTTACATTCCACCGACCCAAGACTTTGAAGAAAGATAGAAACCCCAAGTACCCTCGTATCAGTGCACCTGGAAGGA
ACAAACTTGATCAGTATGGGATTCTAAAGTATCCCCTCACCACCGAATCTGCGATGAAGAAGATTGAGGACAACAACAC
CCTTGTTTTCATCGTGGACATCAAGGCTGATAAAAAGAAGATTAAGGATGCCGTGAAGAAGATGTATGACATCCAGACA
AAGAAAGTCAATACCTTGATTAGGCCTGATGGGACGAAGAAAACATATGTGAGGTTGACTCCTGACTACGATGCATTGG
ACGTTGCCAACAAAATTGGAATCATCTAAACTAGTTACCTGTTTAGAATTTTACGAGAATTTAAAATCTTGGATTTGGG
TTTTTAGATACACTTGAATGGAAGTGCCTTCTATTTTTCATTTTCATTTTGTGTTTTAGAGACATGTTTTGTTCTGTAT
AAGAGAAATCAACTTTAAGCTGCAGTTTTCTTTCTCGAAATTCTCTGAATCCTAACCTgtctTCCCaaaaccttaagaG
TCGGAGGGG > SEQ ID NO:3560    4845    4774_300317_1
cGCAGTTGATGTCACCAAGAAAGCCGACCCTAAGGCTAAGGCTTTGAAAGCTGCGAAAGCAGTGAAATCTGGCCAAATC
GTTAAAAAGCCTGCGAAGAAGATCAGGACAAAGGTTACTTTCCACAGGCCAAAGACATTGACCGTTCCTAGAAAGCCTA
AGTACCCAAAGATCAGTGCTACTCCAAGGAACAAATTGGATCATTACCAGATCCTCAAGTACCCTCTCACTACTGAATC
TGCCATGAAAAAGATTGAAGACAACAACACCTTAGTCTTCATTgttgACATCCGTgCTGACAAGAAAAAGATCAAAGAT
GCTGTCAAGAAGATGTATGACATTcagaccaagaAAgtcAACACCCtca > SEQ ID NO:3561    4845    4777_300317_1
AAAAATGGCTTCAAGTTCCATAGCTCTTTTCTTGGCTCTCAATCTTCTCTTTTTCACAACAATCTCCGCCTGTGGTAGC
TGTACTCCGTGCGGCGGAGGTTGCCCCTCTCCCAAGCCAAAGCCAACTCCTAAACCAACCCCAAGCCCTAGCTCTGGCT
CGAGCAAGTGCCCTAAAGACACCCTCAAGCTCGGTGTCTGCGCTAATGTGCTCAACGGCCTCCTGGACTTGACCCTTGG
CAAGCCACCGGTCGAGCCATGCTGCAGCCTCATCCAAGGACTCGCTGATGTTGAGGCAGCCGTTTGTCTCTGCACCGCT
CTTAAGGCTAACATTCTTGGAATCAACTTGAACCTCCCAATATCTTTAAGTCTACTCCTTAATGTTTGCAGCAAACAAC
TtcctcctggcttccaatgctaaaAACCATAttGATATATaaTtTAAATAcaCttat > SEQ ID NO:3562    4845    51012_300116_1
CTCACAACCTAGCTAGCTAGTAAACAGTATTTTCTATATACCAAAAATGGCTTCAAGTTCCATAGCTCTTTTCTTGGCT
CTCAATCTTCTCTTTTTCACAACAATCTCCGCCTGTGGTAGCTGTACTCCGTGCGGCGGAGGTTGCCCCTCTCCCAAGC
CAAAGCCAACTCCTAAACCAACCCCAAGCCCTAGCTCTGGCTCGAGCAAGTGCCCTAAAGACACCCTCAAGCTCGGTGT
CTGCGCTAATGTGCTCAACGGCCTCCTGGACTTGACCCTTGGCAAGCCACCGGTCGAGCCATGCTGCAGCCTCATCCAA
GGACTCGCTGATGTTGA > SEQ ID NO:3563    4845    1097444_301444_1
GAGGCAAGGGCAGTGAAAGTTTTGGCGATGGCTCCTCCGACCAAAGGTGCAGTTGCAAAGACGGATTCCAAGGGCCAGG
CTGTGAAGGCGGCCAAAGCACTCAAGTCAAATGTCCATTTGAAGAAGAAAACCAGGAAGGTGAGGACTTCGGTGACCTT
```

FIG. 2 continued

CCACAGGCCCAAGACCTTGAAGAGGGTGCGCACCCCCAAGTACCCCCGCCTCAGTGCCCCCCACCGCAACAAGCTCGAC
CACTACGAAGTCCTCAAGTACCCCTTGACCACTGAATCTGCCATGAAGAAGATCGAGGACAACAACACCCTTGTCTTCA
TTGTTGATCTCCGTGCCAACAAGAAACAGATCAAGGATTCCGTCAAGAAGATGTATGACATCCAGACAAAGAAGGTTAA
CACCCTCATCACGCCTAAAGGATTGAAAAAAGCATATGTAAGGTTGACGGCAGACTATGATGGCTTGGACGTTGCAAAC
AAGATTGGTATTATTTAATCAAGGTATTGGACTAGAACCCAGGGCGAATTTTTTTCTGTAGTCTTTTAGTCAAAAGACC
TCGCGTGTACTGGGCTTAACTCTACCTGTGGAGGGAAGCTATCAAGTGAATTTTTGGTAAAGAAGAGGTCTTTCATTTA
AGTTGCAAAAGCTGA

> SEQ ID NO:3564    4845    217786_300911_1
GATAAGTCGACAACTCCTCAACCGCACAGGCGCCTCTCCGTGCAAATTCGACACCAAGCCGATACAATGGCCCCCGCTA
ACAAGAAAGCTGCCGCCAAGGGCTCCAAGCAGGCCAACGCCGCTGCCAAGGCCGCCCTCAAGGGTACTCACTCCTCCAA
GAACCGCAAGGTCCGCCTGACCACCTCTTTCCACCGCCCCAAGACTCTGGTCCTGTCCCGCGCTCCCCGGTACCCCCGG
AAGGGCATCAAACACGTCCCCCGTCTTGATGAGCACAAGATCATCATCCACCCTCTCAACACTGAGAGTGGCATGAAGA
AGATGGAGGAGAACAACACCCTGGTCTTCATCGTCGACGTCAAGGGCAACAAGGGCCAGATCAAGCTGGGCCTCAAGAA
GCTCTACGACATTGACACCGTCAAGATCAACACCCTGATCCGGCCTGACGGGTCAAGAAGGGCTACGCCCGCCTGACC
CCCGATGTCGATGCCCTCGACATTGGCGCCAACAAGCTGTCCCTGGTTTAAGCTGGATAATTTGTTG

> SEQ ID NO:3565    4845    145836_301062_1
TTTTCTCAGGTAAGCCACCCTGTTGGGTTTTTAGCACTGTCCTCAGCTATGGCTCCAGCTAAAGTTGATTTGGCCAAAA
AGAAAGACACCAAAGCCCAGGCTGTCAAGGCTGCCAAGGCTGTTAAGTCAGGATCATCCTTTAAGAAGAAGTCAACAAA
GATAAGGACAAAAGTTACTTTCCATCGACCTAAGACATTGAAGAAGGATAGGAATCCTAAGTACCCTCGCATTAGTGCA
CCTGGAAGGAACAAACTTGATCAATACGGGATCCTAAAATATCCTCTTACCACTGAGTCTGCAATGAAGAAGATCGAGG
ACAACAATACCCTTGTCTTCATTGTTGATATCAAAGCTGACAAAAAGAAGATAAAGGATGCAGTGAAGAAAATGTATGA
CATCCAGACAAAGAAAGTCAATACCTTGATCAGGCCCGATGGAACAAAGAAGGCTTATGTGAGGTTGACACCTGACTAT
GATGCTTTGGATGTGGCCAACAAAATTGGAATCATCTAAGTTGATTACCTAGTTTTTTAATTTTAATGTCAAACCTGAA
ATTTTGCAAATGAGCTCTTTAGAAACTTTTGAACAGGAAGTGCG

> SEQ ID NO:3566    4845    155726_301359_1
cgggagttctctgaggtttgcagtgtaggggcttagaactgtctcccatggctccagctaaagcagatgtggcaaagaa
aGGTGATCCCAAAGCCCAAGCCGTCAAGGCTGCCAAGGCTGTGAAATCAGGATCAACCTTTAAGAAGAAGTCAACAAAG
ATACGAACCAAAGTCACATTTCATCGGTCCAAGACATTGAAGAAGGATAGAAATCCCAAGTATCCCCGGATTAGTGCAC
CTGGAAGGAACAAACTTGATCACTACGGGATTCTTAAATATCCTCTCACCACTGAGTCTGCAATGAAGAAGATCGAGGA
CAATAATACACTTGTTTTATTGTTGACATCAAGGCTGACAAAAAGAAGATTAAGGATGCGGTGAAGAAAATGTATGAT
ATCCAGACAAAGAAAGTCAATACCTTGATCAGGCCTGATGGAACGAAGAAGGCATATGTGAGGTTGACACCAGACTATG
ATGCTTTGGATGTGGCGAACAAAATTGGAaTCATCTAAATGTATTAAATGgttTGGAt > SEQ ID NO:3567    4845    187205_300675_1
atccagagcaatggcgttgcaaacgcagccggtagcaaatgcgtcacctcttcatgttcttcggtccgtatgcgtcctc
cTCCTGGCCGCGTCGGCGACGGTGGCGGCGCGGCGCCACGGCCCGGCGgcgCCCATCGCCGGGCAGAGCATGTACCTGG
CGCCGAGCTGCCGCGCGCACACGGCGTCGCTGACGGACTTCGGCGGCGTGGGCGACGGCACGACGTCGAACACGACGCC
GTCCCGGAGAGGTAAGTTCAAGAGGCAGCCCTGTGAAGCTCCAATGGCTCCTAAAGCTGCTCCTGCCAAGAAGGGTGAT
GCCAAGGCCCAAGCCTTGAAGGCAGCCAAGGCTGTTAAGTCTGGGACAGCCAAGAAGACGACCAAGAAGATCCGCACAT
CCGTGACATTTCACCGCCCCAAGACCTTGAAGAAGTCTAGGGACCCCAAGTACCCAAGAGTCAGTACCCCTGGGAGGAA
CAAGCTTGATCAGTACCAGATCCTTAAGTATCCCCTTACCACTGAATCCGCAATGAAGAAGATCGAAGACAACAACACT
CTGGTCTTCATTgttGACCTTAAGGcTGACAAGAAGAAGATCAAGGCTGCTGTCAAGAAGATGTACGACATCcagGCAA
AGAAAGTGAACACTCTGATCAggCCTGATGGGAagaagaaggcTTACGTGAAGCTGACAcCagaCTACGATGCtctCGA
CGtggccaaCAagattGGCATCATCTAagtTa > SEQ ID NO:3568    4845    194011_300743_1
CAAGAGGCAGCCCTGTGAAGCTCCAATGGCTCCTAAAGCTGCTCCTGCCAAGAAGGGTGATGCCAAGGCCCAAGCCTTG
AAGGCAGCCAAGGCTGTTAAGTCTGGGACAGCCAAGAAGACGACCAAGAAGATCCGCACATCCGTGACATTTCACCGCC
CCAAGACCTTGAAGAAGTCTAGGGACCCCAAGTACCAAGAGTCAGTACCCCTGGGAGGAACAAGCTTGATCAGTACCA
GATCCTTAAGTATCCCCTTACCACTGAATCCGCAATGAAGAAGATCGAAGACAACAACACTCTGGTCTTCATTGTTGAC
CTTAAGGCTGACAAGAAGAAGATCAAGGCTGCTGTCAAGAAGATGTACGACATCCAGGCAAAGAAAGTGAACACTCTGA
TCAGGCCTGATGGGAAGAagAAGGCTTACGTGAAGCTGACACCAGACTACGATGCTCTCGACGTGGCCAACAAGATTGG
CATCATCTAAGTTAGGGTGCTGCAGTAGTCTTTTgTGTCCTGGTCTCTATGTGATTGGAGTTTTgTaGCTATTACTTAG
CGAATgccTCAGTGGCTAAGttATCACTAtTTTgctgcaCACTTccaTGaatTtgATATAatgcaagTGACTTATCGTg
agCta

FIG. 2 continued

> SEQ ID NO:3569 4845    188338_300776_1
gcTCCGCCGCCGCCAACCCCACCGCGGCGAGCTCCGCCTTCCGCCGGCCGCGATGGCTCCCAAGGCCGCTGTAAAGAAG
GCTGATGGAAAGACTCAACAAGCCTTGAAGGTTGCCAAGGCAGTGAAGTCTGGGTCAATCAAGAGAAAGTCAAAGAAGA
TCCGCACTTCGGTGACATTTCACAGACCAAAGACCCTGAAGAAGGCGAGAGACCCTAAGTACCCAAGAGTCAGTGCACC
TGGCAGGAACAAGCTTGATCAGTACCAAATCCTCAAGTACCCCCTTACGACCGAATCTGCCATGAAGAAGATTGAAGAC
AACAACACCCTTGTCTTCATCGTCGACCTCAAGGCAGACAAGAAGAAGATCAAGGCAGCTGTCAAGAAGATGTATGACA
TCCAGGCAAAGAAAGTTAACACTCTGATCAGGCCTGACGGCAAGAAGAAGGCTTACGTGAAGCTCACTCCAGACTATGA
TGCTCTTGATGTGGCCAACAAAATTGGCATCATTTAAGTTAGGGCGCTTTTTTTCATCATGTTGAACGTAAGATTTTGG
TTGGCTAGTTCTTAATGTTGAACAGAACCTTATAACTTGCAAAAGAACATCTTGAGTTTTGttgagCG > SEQ ID NO:3570 4845    175773_300544_1
CCCCCCCTCCACTACTACGAATCGCCAGCCGCCACACCGAGCTCCGCCGCCGCCAACCCCACCGCGGCGAGCTCCGCCT
TCCGCCGGCCGCGATGGCTCCCAAGGCCGCTGTAAAGAAGGCTGATGGAAAGACTCAACAAGCCTTGAAGGTTGCCAAG
GCAGTGAAGTCTGGGTCAATCAAGAGAAAGTCAAAGAAGATCCGCACTTCGGTGACATTTCACAGACCAAAGACCCTGA
AGAAGGCGAGAGACCCTAAGTACCCAAGAGTCAGTGCACCTGGCAGGAACAAGCTTGATCAGTACCAAATCCTCAAGTA
CCCCCTTACGACCGAATCTGCCATGAAGAAGATTGAAGACAACAACACCCTTGTCTTCATCGTCGACCTCAAGGCAGAC
AAGAAGAAGATCAAGGCAGCTGTCAAGAAGATGTATGACATCCAGGCAAAGAAAGTTAACACTCTGATCAGGCCTGACG
GCAAGAAGAAGGCTTACGTGAAGCTCACTCCAGACTATGATGCTCTTGATGTGGCCAACAAAATTGGCATCATTTAAGT
TAGGGCGCTTTTTTTCATCATGTTGAACG > SEQ ID NO:3571 4845    1112760_301793_1
aggtcttctttggatccAGCAAGGGAAGAAGGTAGGAAGGTAAGTGTCAAAGGTTCAGCCGGACTCCAGCGATGGCTCC
TCCGACAAAAGGTGCAGCGGCGAAGACAGACTCGAAGGGGCAGACCACTAAGGCTGCCAAGGCTGCTAAGGCACTGAAG
TCCAATGTCCATCTGAAGAAGAAGACACGGAAGGTGAGAACTTCCGTCACCTTCCACAGGCCTAAGACCCTGAAAAGGA
CTAGAACCCCCAAGTACCCTCGTGCGAGTGCCCCACACCGCAACAGGCTGGACCATTACGAGGTCCTTAAGTACCCCTT
GACCACGGAGTCTGCCATGAAGAAGATTGAAGACAACAACACTCTGGTCTTCATTGTGGACCTCCGTGCCAACAAGAAG
TCCATCAAGGATGCCGTCAAGAAGATGTACGACATCCAGACCAAGAAAGTCAACACCCTCATCACGCCGAAAGGATTGA
AGAAAGCTTATGTAAGGTTGACAGCTGATTATGACGGTTTGGACGTGGCTAACAAGATTGGTATTATTTAAATTAGATT
TGATTAGAATAGAGTTGGTTATATGTCTTTCTCAAGGCTTCTGGTTAAACTAAATTGAGTCTGTACCCAGACTTAACTC
CCTTTGGAGGAAAGTATCAAGTGAATTTTTGGCAATATTATTATTAGAGTGCTCTTATGTTTTAGGTGc > SEQ ID NO:3572 48458    109231_300044_1
cttgtccttttTggggataaaaacaggttagcccagatttgtatggagataacaacacaagactctttacctactggac
tAGTGATGCTTATCAAGCCACAGGCTGCTACAATCTGCTATGTTCAGGATTTATTCAAATCAATAATGAAATAGCAATG
GGGGCCACCATTTCCCCTCTTTCCAGCTATCATGGTTCACAATATGATATAAGCATTCTTGTCTGGAAGGATCCAAAAG
AGGGAAACTGGTGGATGCAATTTGGGAATGACTATGTATTGGGATATTGGCCAGGCTTTTTATTTTCATATTTAACAGA
CAGTGCTTCAATGATTGAATGGGGTGGGGAAGTGGTGAATTCAGAATCAGATGGACTTCACACCACAACTCAAATGGGG
AGTGGCCATTTTCCAGATGAAGGTTTTGGGAAATCAAGCTATTTCAGGAATATACAAGTAGTTGATGGTTCAAATAATT
TGAGAGCTCCTCAAGATCTTGGGATTTATACTGAGGATAACAATTGCTATGATGTTCAACTAGGAAAGAATAATGACTG
GGGGAACTACTTTTACTATGGTGGACCTGGTAGAAATTCTAATTGTCCATGACCAAGATTCTAAATGTTTTTACTTAA
TTCTTTCACTCTTTTAATGTAGTAAAACTGGTAATGTAGACATTGAGTCCTTTGTATGGTCATTGTTTTACTCTTTGTA
AAACTTTTGTTTTAGGGGCTAAGTTAGTGCGCAACAAATGTGTATCATTGTTGGTCTTTGTGTGAAAAGTTTTTCAC
CTTTCTTTTTAGACCTCcagtctctaAATAAAAATATTgttggGGACAAAAt > SEQ ID NO:3573 48458    48418_300376_1
GGCATTACCGGCGCCGGGACTGCATGCTGTGCACACGCGGGATATGCTGATCGAGCAATACCTATCCAAATTCACTAAC
CACAGATCTAATCAAACTGATAGCTATCAGCAGGGCTCTAAACAGCTTAAAAGGCGGATCCAATGCTAAATCAATAGTT
CTTCTGTAGCTTAATTTTATTTGATGATAACTGAGTATCATTTGGGGTTAGTAGATTGTTGTATTCTCCCCTTAAAATA
TGCGATAACAATTTTGGTTTTAATATATGGGATATGCAATTTTAG > SEQ ID NO:3574 48493    144457_200135_1
gagtcgacagcgatcacaaaagggcgatttTcatctcagctgttcaatcgatttcaggcagcttgcgcacacctttact
aTTACTCTTGTGTACTTGCTGCCTCCGATACAAGTAACCAGTAACTTGAGCTATGGGAAAGAGGAAGTCAAAGTCAAAG
CCACCTCCAAAGAAGAGGATGGACAAACTTGATACTGTTTTCAGCTGTCCTTTCTGTAGTCATGGCACCAGCGTGGAAT
GTCGCATTGATATGAAAAACTTGATTGGCGAGGCGAATTGCAGGATCTGCCAAGAGAGCTTCAGCACCACAGTCACTGC
ACTAACAGAGCCTATTGATATATACAGTGAATGGATTGACGAGTGTGAACGAGTCAACAACTATGAAGAAGATGATGTT
TCCTACAAGTTAGATCCTAACGAATGATCTGCTTCAAGATTGTGCAGCTTGTTGAGTAGCCAGAAATGATTTAAAGCTA
CCTTAAGCTTGACTTCAATTTTGGCAATTATTCGTCACACTGCCTAAGAAGAACCTAAACTTATCCAGGCCTCTGGAGT

FIG. 2 continued

```
CCAATAAGTAGCTCCATTTAAGAGGCTTTCTATGTCcAAATAGTTTGAAACAGAGTCAGTTGCTATCTTGTTTATGTTA
TGCCCCTGCAATTATAGCTTGCTTATATGAGACTGGCTtaATGATGTGAACCTAATGTtAaGTAggTTTATTTCTccC
```

> SEQ ID NO:3575 48602 124861_300426_1
```
AAGATATTAACAACTGTGTGCTCAGATAATCCCGTTGAGAATCAATCAGTCGGGTTCCAAAAAATGGAGTCCGAACTCC
AAAAATTACCACCTAAAACTACCCAAACAACACAACCCGAATCCGTGGACGAAAGTTCCCTTACCAAAGACGATCGTCC
ACTTCTCAAACCCGACCCGACTAGCCCTCAACTCCAAGTTCAATCCCAGTCTTCTAGTTCTAACCCTAACATCGAAGAA
TTAGACAAGAAATACGCCCCATATGTGAGGCATGACGTGTATGGAGTAATGGGCCGGGGCGAGTTGCCCTGGACCGAGA
AGGTTCTTTTGGGTATTGCGCTCGTGACGGTTGTACCTATGAGAGTTGTTGGGGCAATGACTATATTGGTTGTGTATTA
CTTGATTTGTAAGGTTTGTACAGCGTTTTCGGCACCGAATCGAGAGGAAGAGGAAGAGCAAGAGGATTATGCGCATATT
GGTGGGTGGAGAAGGGTTGTGATGATGCANAGTGGGATGTTCCTTTCGAGAGTAATGCTTTTCGTTTTTGGATTCTATT
GGATTAGCGAAACTTATTGCCCCATTGATCTCAATAGCAACTCAAATAATGAGCATGGATCAAACGATCAGGCTGAAGA
ACTTGAAAGACCAGGGGCTATTGTGTCAAATCACATTTCGTACTTGGATATCTTGTATCACATGTCTTCCTCATTTC
```

> SEQ ID NO:3576 48602 276196_200157_1
```
ATTTCTTGAGTTTGTGTTGATACAGATTTGAGATTGCTTTCGCAAGATTGCTTCTTGTGAAAGGGTGAAGGAGAATTA
TTATGTTTGGTTACTTGTGTTTAAAGGTACCAATGGATAAGACGAAAAGGAAAACCTGCACCAAGGGAGATAGCTCCCG
TTGTTGTATCTAATCATGTCTCTTACATAGAACCTATCTTCTTTTTCTATGAGTTATTTCCTACCATTGTTGCTTCCGA
GTCCCATGATTCCATGCCTTTCGTCGGAACCATTATCAGAGCTATGCAGGTGATATATGTTAATAGATTCTCCCCCACT
TCGAGGAAGCATGCTGTTAGTGAAATAAAGAGAAAAGCTTCTTGCAATCAATTTCCCCGAGTGCTTTTATTTCCTGAAG
GGACTACAACCAACGGAAGAGCTATTATTTCCTTTCAACTTGGTGCATTTATCCCTGGCTATCCTATCCAGCCTGTTAT
TGTGCGGTATCCCCACATACACTTTGACCAATCATGGGGGAATGTTTCCCTTGGAATGCTGATGT
```

> SEQ ID NO:3577 49145 49619_300182_1
```
GAGGCCATTACGGCCGGGAAGCCTAAAGGTGGATTAAAGGAGGCATTGAAAGTTGACCCTAATAAAGTAAGACGACTAA
GTGTAAGTGAACAGGCTTTCGAAAAGGCTGCCGAATCTCATGGGATGGAAATTGTGAGGTTCACGCAAAGAAACATTTT
AAGGGTGTATCCTAAAGGTACTAGGTTTAACTCATCCAACTACAAGCCACTAATTGGTTGGATGCATGGAGCTCAGATG
GTTGCATTTAACATGCAGGGATACGGTAGAGCGCTATGGTTGATGCATGGGATGTTCGGGTCAAATGGAG
```

> SEQ ID NO:3578 4936 49360_300178_1
```
GGCCATTACGGCCGGGCCAACTCTCACCGACCAGTTCGCTTGATGCAAATTCAAATAGCTTCAGTTTGGAAATTGGTAA
TGGTGAATTTAGTGGAGCTGAATTGAAGAAAATTATGGCAAATGAGAAACTTGCAGAGATAGCCTTAGCAGATCCAAAG
CGGGCCAAAAGGATTTTAGCCAACCGCCAATCTGCTGCTCGTTCAAAAGAGCGAAAGATGAGATACATTGCGGAGTTAG
AACACAAGGTGCAAACACTGCAGACTGAAGCCACCACATTGTCTGCTCAACTGACACTGTTGCAGAGAGATTCTGCTGG
GCTAACGAGCCAAAACCACGAGCTGAAGTTTCGTTTGCAAGCCATGGAGCAGCAAGCTCAACTCCGTGATGCACTAAAT
GAAGCATTAACTGCTGAAGTACAAC
```

> SEQ ID NO:3579 51719 251739_301430_1
```
TTCACGCTGGTGGCGAGAAAGTTCCTCAAGGTGCAAGTCCGGCCGTATATCCCCGACTTCAAGAAGGCGTTTGAGCACT
TTTGCATCCATGCCGGGGGTAGGGCCGTGTTGGATGATCTGCAGAAGAATATGGAGCTCACGGACTGGCATATGGAGCC
GTCGAGGATGACGCTGTTCAAGTGGGGGAACACTTCGTCCAGCTCGCTGTGGTACGAGCTTGCATACTGTGAGGCCAAG
GGACGCATCAAGAAGGGGGACAGGATCTGGCAGATTGCTTTCGGATCTGGGTTCAAGTGCAACAGTGCGGTGTGGAGGG
CGTGCATGGCGGTGGACGGAAAGGAAGTAAACAATGCGTGGTCGGAGTTTGTAAACACGGGTGATGTTTGAGATCACTG
CAATATATTAATGCCATGAATTTATGCTTAGTTTCT
```

> SEQ ID NO:3580 51719 33387_300457_1
```
CAGGAGCTTCAATCTTTCGGGGATGGGCTGCAGCGCGGGCCTGATCTCAGTTGATCTAGCCCGCGACTTGCTCCAAGTT
CATCCCAATTCAAATGCAATCATCGTCAGCACGGAGATCATAACGCCTAATTACTATCAAGGCAACGAGAGAGCCATGT
TGTTACCCAATTGTCTCTTCCGCATGGGTGCGGCAGCCATACACATGTCAAACCGCCGGTCTGACCGGTGGCGAGCCAA
ATACAAGCTTTCCCACCTCGTCCGGACACACCGTGGCGCTGACGACAAGTCTTTCTACTGTGTCTACGAACAGGAAGAC
AAAGAAGGACACGTTGGCATCAACTTGTCCAAAGATCTCATG
```

> SEQ ID NO:3581 51719 33354_300457_1
```
AAGAGCTTCAAAAGAATCTAGGCTTGAGTGAAGAGAATATGGAGGCTTCTAGGATGACACTTCACAGGTTTGGAAACAC
TTCTAGCAGTGGAATCTGGTATGAGTTGGCTTACATGGAGGCCAAGGAAAGTGTTCGTAGAGGCGATAGGGTTTGGCAG
ATCGCTTTCGGTTCTGGTTTTAAGTGTAACAGTGTGGTGTGGAAGGCAATGAGGAAGGTGAAGAAGCCAACCAGGAACA
ATCCTTGGGTGGATTGCATCAACCGTTACCCTGTGCCTCTCTAAATTATCATTCTTCTAAATTAAATCAAGTAAGATCT
CTAATTACTCCAACCAAAAGATACAGTTTGGTTGGATGATAGGAGTTATTTAC
```

FIG. 2 continued

> SEQ ID NO:3582 51719 6661_300347_1
ACCCACGCGTCCGAGCTATGCATTATGTTCCACCGAGAATTTCAATGGCTGCTGCTAGAGAAGAAGCTGAACAAGTCAT
GTTTGGTGCTTTAGATAACCTTTTCGCTAACACTAATGTGAAACCAAAGGATATTGGAATCCTTGTTGTGAATTGTAGT
CTCTTTAATCCAACTCCTTCGTTATCTGCAATGATTGTGAACAAGTATAAGCTTAGAGGTAACATTAGAAGCTACAATC
TAGGCGGTATGGGTTGCAGCGCGGGAGTTATCGCTGTGGATCTTGCTAAAGACATGTTGTTGGTACATAGGAACACTTA
TGCGGGTGTTGTTTCTACTGAGAACATTACTCAGAATTGGTATTTGGTAACAAGAAATCGATGTTGATACCGAACTGC
TTGTTTCGAGTTGGTGGCTCTGCGGTTTTGCTATCGAACAAGTCGAGGGACAAGAGACGGTCTAAGTACAGGCTTGTAC
ATGTAGTCAGGACTCA

> SEQ ID NO:3583 51719 56311_300123_1
CCCAGCGTCCGACGCAGAAGAAACCGGCAAAATCGGAGTGTCCCTCTCTAAAAACCTAATGGCGATAGCTGGAGAAGCT
CTCAAGACAAACATCACAACTCTCGGACCACTAGTTCTACCAATGTCCGAACAACTTCTCTTTTTCGCGACTCTTGTGG
CCCGAAAAGTCTTCAAAGTCAAGAAAATAAAGCCTTACATTCCTGATTTCAAGCTAGCTTTCGAGCATTTCTGTATCCA
CGCGGGAGGTAGAGCCGTGCTCGACGAGATTGAGAAGAACTTGGATTTACCCGAATGGCACATGGAGCCATCGAGGATG
ACGTTGAACCGGTTTGGTAACACTTCGAGTAGCTCACTTTGGTATGAGCTTGCGTATAGTGAAG

> SEQ ID NO:3584 51719 36438_300257_1
AATAATCAAGAGGCGTCACATTAAGAGTACAAGAGCTTAACCAGAAAAGAAAAAAAATAAACAAGGCAGAGTCTAGTAA
GACTAGGACTAACCAAACAAATGGTTTTTCATTAAATCAAAAGTCGAGCTTAACCGGATATCGGTCGATGCAGGGTTCC
CACGGACTACTAACCGAAGGCTTGACATTGTTTAAAGCCACCCAAACTGCACTGTTACACTTAAACCCACTTCCAAAAG
CAATCTGCCAAACCCGGTTTCCTTTCTTCATCCTACCTTTAGCCTCTATGTAAGCCAGTTCATACCAAATCGAGCTCGA
AAAAGTGTTTCCAAATCTGGGCAGGGTCATTCTGGATGCCTCGACATGAGTCTGCAAAAG

> SEQ ID NO:3585 51719 283635_200094_1
TAGCGATAAATATCGTGCAAAGTATTTTCAAGAATGAGAAGAACAAGGTTGCACTTATGGTAACATCTGAGTCCTTGAG
TCCAAATTGGTACACAGGGAATAATAGATCTATGATTCTTGCTAATTGTTTGTTTAGATCAGGAGGGAGTGCAATTCTC
TTGACAAACAAAGTGGCTTTAAAAAATAAGGCCATGTTCAAGTTGAAATGCCTAGTTAGAATACACCATGGTGCAAAAG
ATGAAGCTTATGATAGTTGCATACAAAAAGAAGATGATCAAGGTCACATAGGTTTCCACCTTGATAAAACATTACCAAA
GGCCGCGACAAAGGCACTAGTCGATAATTTGAAACAATTGCACCCTTAATTCTTCCAGTGAGAGAATTACTTAGATTT
GCAATTGTGTCACTTGTTAGAAAAATGAATTGGGGTTCAACAAAATGAGGAGCTAAGCCAGTAATCAATTTCAAAACAC
GTGTGGATCATATTTGCCTACATACAGGAGGAAAAGCACTAATTGATGGAGTTGGGACAAATTTGAATCTAAGTGAGTA
TGATTTAGA

> SEQ ID NO:3586 51719 103546_300363_1
TGGTATGAACGCAGAGTGGCCATTACGGCCGGGTACCAATCTTGTGTTTTTATAGGACTGACTGCCCTTGAACTGTTG
ATTTAACTTACCTCCCCGAAGCAGTGACTCAGGTACCGCCAAATCCTTGTATGGCAGAAGCAAGAAAAGAAGCTGAAGC
TGTTACGTTTGGAGCCATCGACGAGCTTCTTGCTAAAACCTCTGTTAAACCTAAGGATATTGGAATTTTAGTAGTGAAT
TGCAGCTTGTTTAACCCGACCCCCTCTTTGTCTGCGATGATTGTCAACCATTACAAACTTCGGGGGAACATTGTTAGTT
ACAATCTCGGTGGAATGGGTTGTAGTGCTGGTTTGATCTCGATTGATCTTGCGAAAGATCTTCTTCAAGTTCATCCCAA
CACTTATGCCTTGGTTCTTAGCATGGAAAACATCACTTTGAATTGGTATTTTGGTAATGAGAAGTCCATGCTCCTTCCA
AATTGCTTATTCCGGATGGAGGTGCTGCTGTGTTGCTCTCAAACAAAAGATCCGATCGAAGAAGATCAAAGTATCAGC
TGGTCCATACT

> SEQ ID NO:3587 51719 147090_200015_1
gcgtccggacttatataccagtagataaatggattccatcaaatttttctcttagtagtaatcaacatcaagctaaatt
gGTTATTGTTGGTGCcataGACGATCTGTTGGCAAAAACAGGAGTGAAAATCagAGAGATCGGGATTGTTGTTGTTAAT
TCTAGTATGTTTAATCCAACACCTTCTCTTTCTGCTATGATTGTCAACCATTATAAGCTTGGAGTTAATGTGATTACTT
ATAATCTTGGTGGCATGGGTTGCAGTGCTGGACTTATTTCTGTGGACCTAGCTAATCGGCTTTTACAGGGGAAAGCAAA
CACCTATGCACTTATAGTAAGCACGGAAGTAGTCTCAACGGCCTTCTATACAGGGAAAGACAAATCAAAGCTAATACCA
AATATGATTTTCCGGATGGGTGCTTCTGCTGTTCTCCTTTCGAACCGTTTCTCGGATCGTTGGCGCTCAAAATATCAAC
TGATGCATGTTGTCCGCACCCATAAAGGTCAGATGACAGAGCATTCGGTTGCCTCTACCAAGATGAGGAAGAGGATGG
AAAAAAAGGCATGTCATTGTCAAAAGACTTAATGGCAGTAGCTGGTGAGGCCTTAAAAACAAATATTACTACTTTGGGC
CCTCTAGTCCTCCCAATGTCCGAGCAGCTCCTATTTTCGTCTCTTTAATCGCGAGAAATGTTCTTAAAAGGAAAATAA
AGCCATATATCCCCGATTTCAAGATGGCATTCGAGCATTTCTGCATTCATGCAGGGGGGAGGGCCGTGTTGGACGAGCT
TCAGAAGAATCTTGATCTCACAGAGGAACTTATGGAACCTTCAAGAATGACTCTTTATAGGTTCGGAAACACTTCAAGT
AGTTCAGTGTGGTATAATTTGGCCTACTCTGAGGCCAAAGGGAGGATAAAGAAGGGTGACAGAGCATGGCAAATAGGTT

FIG. 2 continued

TTGGCTCAgGATTCAAATGTAACAGTGCTGTTTGGCGCGCGCTAAAGACCGTTGATGCAGCCATTGAAAAGAACGCGTG
GACGGATGAGATTGAGGATTTCCCTGTTCAAATCCCGTATTGATGATCagTACTGAAACCAtaaAACACATTCAAAATC
ACTCTAGTATATtTGTAtatGGGATTGtgcacCTAATTTTGaacaaGCGaggAATCTggaaTTaaTAaATTTAAGTaag
atggGGGGCa > SEQ ID NO:3588 51719   201051_300712_1
CCCACGCGTCCGGGTGCTCCGCGGGCGCGCCAAGATGGAGCTCGGCTGCCTCGTGCGCGCCAACATCGCCGCCAACGAC
GACGCCCACGCCTGCGCGCTGCAGCGGGAGGACGACGACGGCACCGTCGGGATCAGCCTCAGCAAGGCGCTCCCCAAGG
CCGCCGTCCGCGCCTTCGCCGCCAACCTCCGCCGCCTCGCCCCGCGCATCCTCCCCATCACCGAGCTCGCCCGCTTCGC
CGCCCAGCTGCTCATCACCAAGAAGCTCCTCCGCCGCCGCGCCACCGCCGCCACCGCCACCAAGCACACCGGCGGCGAC
GGGCCCAGGATCAACTTCAAGACGGGCGTGGACCACTTCTGCCTCCACCCCGGCGGCACGGCCGTGATCGAGGCCGTGA
AGCGCAGCCTGGGCCTCGACGACGACGACGTGGAGCCGGCGAGGATGACGCTGCACCGGTGGGGGAACACGTCGGCGAG
CAGCCTGTGGTACGTGCTGTCGTACATGGAGGCGAAGGGGAGGCTGAGGCGGGGCGACAAGGTGCTGATGGTGACGTTC
GGGTCGGGGTTCAAGTGCAACAGCTGCGTGTG > SEQ ID NO:3589 51719   201555_300717_1
GGGGAACCCGGCGGGACATGATGCTGCCCAACTGCCTGTTCCGGATGGGCGCGGCGGCGATCCTGCTGTCGAACAGGAG
GAGGGAGGCGAGGAGGGCCAAGTACAGGCTGATGCACGTGGTCCGCACGCACAAGGGCGCCGACGACCGCGCGTACCGG
TGCGTGTACGAGGAGGAGGACGAGCAGGGGCACTCGGGGATCTCGCTGTCCAAGGAGCTGATGGCCATCGCCGGCGACG
CGCTCAAGTCGAACATCACCACCATCGGCCCGCTGGTGCTGCCCATGTCGGAGCAGCTGCTCTTCTTCTTCCGCCTCGT
CGGCCGCAAGCTCATCAACAAGAAGTGGAAGCCGTACATCCCGGACTTCAAGCTCGCGTTCGAGCACTTCTGGATCCAC
GCCGGGGGACGCGCCGTGATCGACGAACTGCAGAAAAACCTGGACCTGTCCGCGCAACACGTGGAGGCGTCCCGCATGA
CGCTGCACCGGTTCGGCA > SEQ ID NO:3590 51719   187778_300680_1
CCTTGGGCACCTCGACGGGGAAGCTGTCGATCTCCCCGCCCACGGGTTGCGCTCGTCGGCGTCGGGCTCGACGGTGCG
GAGCGCCCTCCACACGGCGCTGTTGCACTTGAACCCGGAGCCGAACGCGATCTGCCACGCCGTCTGTCCGCGGCGGACG
CGGCCCTTGGCCTCGGCGTACGCGAGCTCGTACCAGAGCGAGCTGCTCGACGTGTTGCCCCACCGGTAGAGCGTCATCC
GCGACGGCTCCATGTGCCAGGCGCCGAGGCCGAGGTTCTTCTCGATGGTGTCGAGCACGGC > SEQ ID NO:3591 51719   13513_300249_1
CCCACGCGTCCGGGGAATAAGAAGGCTATGTTGATTCCGAATTGTTTGTTTCGTGTTGGTGGTTCGGCGATTTTGTTGT
CGAACAAGGGGAAGATCGTAGACGGTCTAAGTATAAGCTTGTTCATACCGTTAGGACTCATAAAGGAGCTGTTGAGAA
GGCTTTCAACTGTGTTTACCAAGAGCAAGATGATAATGGGAAGACCGGGGTTTCGTTGTCGAAAGATCTTATGGCTATA
GCTGGGGAAGCTC > SEQ ID NO:3592 51719   111153_300052_1
CCCACGCGTCCGGTTAACTGCAGCTTGTTTTCTCCAACTCCATCTTTATCAGCTATGGTTGTGAACAAATACAAGTTGA
GAAGTAACATAAAAAGTTACAATCTTTCTGGTATGGGATGTAGTGCTGGTTTAATCTCCATTGATTTGGCTAGAGACCT
TCTTCAAGTGCTTCCAAATTCATCTGCTTTAGTTGTAAGTACTGAAATTATAACACCTAATTATTACCAAGGTTCAGAA
AGAGCAATGCTTTTGCCTAATTGTTTGTTTAGAATGGGAGGTGCTGCTATACTTTTGTCAAACAAGAGAAAAGACAGCA
GTAGAGCTAAGTACAGATTAATGCATGTGGTTAGAACACATAAAGGTGCTGATGATAAAGCTTATAGATGTGTGTTTGA
GCAAGAAGATCCACAAGGAAAAGTTGGCATTAATCTTTCTAAAGATCTTATGGTTATAGCAGGAGAAGCTTTGAAATCC
AATATTACTACAATTGGTCCTTTAGTTCTCCCTGCCTCAGAACAACTTCTTTTCCTTTTTACTCTTATTGGGAGGAAAA
TATTTAACCCTAAATGGAAAGCTTATATTCCTGATTTCAAGCAAGCTTTTGAACACTTTTGCATACATGCTGGTGGAAG
AGCT > SEQ ID NO:3593 51719   107848_300526_1
AAAACAATCAGCATTACATAATAATGAGTGAATTTCTAGGATAAATCATGAATACGAAATAGTACACATGAATATCAAC
TGACAGATATTCAGCAAATTACCCCCTCAACTCTAAATTAATGACCCTAAACTCAATATCCAAGAAACATCAAAATGAG
AAGAACACTTACTTGATGGATCCTCATTACAATTGAAAGCAAGTAGAATTCCCTATCCCAGCTTCTCAATAGAAATTAC
ATCAGCTAAAGACTAGCTTTCAAATCACAAAAGGAAACGACTGAACAGCACATGCCAACAGATAAAGAATAATTCCCCA
AAAATTTTGGGAACACTAAGCTAAATGAAGGATTGTTAGATTTTTGCAACCCTTGGGACATCGACAGGGAACTGGTCGA
TCTCATCCATCCACGGGTTCTTCTCCTTGGCTGGATTAATTGACCGTAAAGCTTTCCAAACTGCACTGTTACATTTGAA
ACCTGAACCAAATGCTATCTGCCAAGTTCGGTCTCCCCTCTTGATCCTTCCCTTAGCTTCCGAGTAGGCCAATTCATAC
CAA

FIG. 2 continued

> SEQ ID NO:3594 51843 105011_300046_1
GAGATGAAAAAGAAGAAGAGAAATTAAGTTGCATGATGGAGTTGGAAAAGCAAGGGAAAATAGTACCATGGTGTTCACA
ACTTGAAGTTCTAACACATCCGTCATTAGGATGTTTCGTGTCGCATTGTGGATGGAATTCGACTCTGGAAAGCTTATCG
ACGGGTGTGCCTGTAGTGGCATTTCCTCATTGGACGGATCAAGGGACAAATGCTAAATTAATTGAAGATGTTTGGAAGA
TAGGTGTAAGGTTGAAAAAGAATGAAGATGGTGTGGTTGAGAGTGAAGAGATTAAAAGGTGCATAGAAATGGTAATGAA
TGGTGGAGAAAAAGGAGAAGAAATGAGAAGAAATGCTCAAAAATGGAAAGAATTGGCAAGGGAAGCTGTAAAAGAAGGT
GGATCTTCATATATGAATCTAAAAGCTTTTGTTCAAGAAGTTGGCAAAGGTTGTTGACATCTATCTAATTAAGCAATTG
TTTTCCTATTTGTAATTTGCTTCTTTTTTCCTAATAAAGTTTAGAGTTCAACTTCTAAA

> SEQ ID NO:3595 51843 226874_301005_1
ATTCGACCACAGTCACCACAGATCTTCTTCCTTCCCGAGACGCCAGGAAACGCCGGGAGAAAGCATGGGTTCTCTGGGA
GCAGCAGGTAAGCCGCACGCCGTGTGCATGCCGTACCCGGCGCAGGGGCACATCACCCCGATGCTGAACGTGGCGAAGC
TGCTCCACGCCCGCGGCTTCGACGTCACGTTCGTGAACACCGAGTACAACCACGCCCGCCTCGTCCGCACCCGCGGCGA
GGCCGCGGTGGCGGGCGCGCCGGGCTTCCGGTTCGCCACCATCCCCGACGGCCTGCCGCCGTCGGACGACGACGACGTC
ACGCAGGACATCCCGTCGCTGTGCCGCTCCACCAAGGAGACTGCCTTGCCCCCTTCCGCCGCCTCCTCGCCCAGCTGA
ATGACCCCGCCACGGGCCACCCGCCCGTCACCTGCGTCGTCTCCGACGTCGTCATGGGTTTCTCCATGGCTGCCGCCAA
GGAGCTCGGCCTCCCCTACGTCCAGCTCTGGACAGCCAGCTCCATCAGCTATCTCGGATACCGTCACTACCGCCTCCTC
ATGGAACGTGGCCTTGCCCCACTCAAAGATGTCGATCAGCTGACGAATGGATACCTTGACACGCCGGTGGAAGACGTGC
CGGGGCTGAGGAACAT

> SEQ ID NO:3596 51843 198918_300647_1
GTCGAGCCACGCGTCCGGGCCTGGCTGGAGGCGAAACCACCGCGCACCGTGGCGTACGTGTCCTTCGGCAGCGTGGCGA
CGCCGAGCCCGGCGCAGATGGCCGAGGTGGCGGAGGGTTTGTACAACACCGGCAAGCCCTTCCTCTGGGTGGTGAGGGC
ATCGGAAACCTCCAAGATACCGGAAGGCTTCGCCGCCAAGGCGGGGAAGCAAGGGAGAGGGCTCATCGTGACGTGGTGC
CCGCAGCTGGAGGTGCTGGCACACCCAGCTGTGGGTGCTTCGTGACGCAATGCGGGTGGAACTCAACGACAGAGGGGT
TGAGTGCCGGTGTACCAATGGTGGGGGTACCGCAGTGGTCAGACCACACAATGAAT

> SEQ ID NO:3597 51843 16568_300240_1
CCCACGCGTCCGAAAATACAAATCGACTTTCATATTTTCTCTGCATAAGAGAGAAAGAAAATGGGATCTCATGTCGCAC
AAAAACAACACGTAGTTTGCGTTCCTTATCCGGCTCAAGGCCACATCAACCCAATGATGAAAGTGGCTAAACTCCTTTA
CGCCAAAGGCTTCCATATTACCTTCGTCAACACCGTCTACAACCACAACCGTCTCCTCCGGTCCCGTGGGCCTAACGCC
GTTGACGGGCTTCCTTCTTTCCGGTTTGAGTCCATCCCTGACGGTCTACCCGAGACTGACGTGGACGTCACTCAGGACA
TCCCTACTCTTTGCGAGTCCACAATGAAGCACTGTCTCGCTCCATTCAAGGAGCTTCTCCGGCAGATCAACGCAAGGGA
TG

> SEQ ID NO:3598 51843 137801_300705_1
GGGTGCTAGCCCTCCTCATCGACCTCTTCCGTCGGCCCGCCGTCCCAGCCGGGATCCTTCTGACGCCGCCGCCCGACCT
CGCCGCCGCCGACGACGACGACGTCGACGGCGGAAGCTCAGCTGACCGTGCCGAGACGCTCCGGTGGCTCGACGAGCAG
CCGACCAAGTCGGTCATCTACGTGGCGCTGGGGAGCGAGGCGCCGGTGACGGCAAAGAACCTGCAGGAGCTCGCACTGG
GGCTGGAGCTCGCTGGCGTGCGCTTCCTGTGGGCGCTCCGGAAACCGGCGGCGGGAACGCTGAGCCACGCCTCCGCCGC
CGACGCCGACGAGCTCCTCCCCGACGGGTTCGAGGAGCGGACGCGCGGGCGCGGCGTGGTGTGGACGGGGTGGGTGCCG
CAGGTGGAGGTGCTCGCGCACGCCGCGGTGGGCGCGTTCCTGACGCACTGCGGCTGGGGCTCCACCATCGAGAGCCTCG
TGTTCGGCCACCCGCTGGTGATGCTGCCGTTCGTCGTCGACCAGGGCCTCGTCGCGCGGGCGATGGCGGAGAGGGGCGT
CGGCGTGGAGGTCGCCAGGGAGGACGACGACGAGGGCTCGTTCGGCCGGCACGACGTCGCCGCGGCGGTGCGGCGCGTC
ATGGTGGAGGATGAACG

> SEQ ID NO:3599 51843 240351_301313_1
GAAAGAGATGCTTCCTCTTGCCTACCGAACACCCAACGCATTTACCACGAATCTGGCAGTTGCAGCGAAGCGAACGAAA
ACTGCCGCATGCCTTCTTATCAACACGATCGAAGAGCTGGACCAGAAACTCGTGGACGTGCGCAGGTCCGAGTTTTCCA
GCTACTTAGCAGTCGGACCTCTGGTGTCCCAAGCGCTACTACAAGAACAGGATACTGCAGTCAGTTCCACAAGTGACGA
TTCTCTGAGCTGGTTGGACAAGCACGCTCACCGTTCGATTCTCTATATTGCCTACGGAAGCGTTGTGTCCCTGAAAGTT
AGCGACGCCCAGAAGATAGCGGAAGCTGTGAAAGCAAGTCGTCAGCCGGTTTTGTGGGCAGTAAGACGGAAGTTCGCAG
GCGACGTACCTGAGAACTTCTACGAAAGCTTGCAAGAAAGAGCTGGGACGCAAGCTTTGATCGTGGAATGGGCTCCGCA
AGTGGCTGTGTTGCGCCACCCTGCAGTTGGGGCCTTCTGGACGCACTGTGGATGGAATTCGGCTCTGGAAGCCTTGTGC
ACGGGAGTACCGATGCTTTGCTGGCCCTGCGAAGCCGATCAAAACGTCAATGCAAACACGATAGTGACCAATTGGAGAA
CTGGGATGATGGCGAGTAATGGACCACAAGATGACGCG

FIG. 2 continued

> SEQ ID NO:3600 51843  248579_301584_1
GGCAGTTCGAGGAGATGTCGGCAGGACTCGAAGAGCTCCGGAAGCCATTCCTTTGGGCCATTCGTCCGAAGTCGGTGAA
CAACTTGGAAACCGAGGCTTTCGAAGCCTTCAAGGCGAAAGTGAGCAGCTTCGGACTGGTTGTGACCTGGGCTCCTCAG
CTGGAAATTCTCCGCCATCCTTCAACTGGCGGGTTTCTAAGTCACTGCGGCTGGAACTCGACCATGGAGAGCATCTGCG
GCGGCGTTCCGATGATCTGCTGGCCCTGCGTCGCGGAGCAGAATCTAAACTGCAAACTGGTGGTGGAAGATTGGAAGAT
GGGACTGAGATTCTCAAATGTAGCCACACGAAAACTCGTCTCCAGGGAAGAGTTTGTGGAGGTGGTGGCGACACTGATG
GACGGACACAGCGGGGTTGTGATGAGGAAAAATGCAAAGAAGCTCCAGGAAGCAGCACACAAAACAGTCTCCAAGGGTG
GTTCCTCGTATAAGAATCTTGGAAATTTCGTGGACGCCATGAAGAGCATCCCTTCTTAGTTCTTTNTTATTCTCGATTC
ATTCTTGATTCAACTACTATCCGAATTTATATTTTTTAAACACTTCGATAAGTTGGTCCAGGAATAGTTTGTTTTCTC
GTATGATG

> SEQ ID NO:3601 51843  3056_300344_1
CCCACGCGTCCGATTTGGCAGATGAGAGTTACTTAACCAAGGAACACTTGGACACAAAAATAGACTGGATACCATCGAT
GAAGAACCTAAGACTAAAAGACATCCCTAGCTTCATCCGAACGACTAATCCTGACGACATCATGCTCAACTTTATCATC
CGTGAGGCTGACCGAGCCAAACGCGCTTCAGCTATCATTCTCAACACGTTTGATGATCTCGAACACGACGTTATCCAAT
CTATGA

> SEQ ID NO:3602 51843  250702_301651_1
GAAGAATAACTTCATCCCGTACATCGATGGTGTTCCACAGCTGCGAGCGAGAGAGCTTCCGCTCGGGCTCCATGACGGT
TGCCCCGACAACTTGAAAGAGGTCATGAAGAGGAACCTCAGCTCTTCCTGGGTGGTGATGAACACTTTCGACGAGATGG
AAAAAGAAGCCATCGCTGCAGCCCACAAGTACGTCGAGCACAAGCTAGTAGTGGTTGGTCCCCTGCTCCCGAGCACTTG
CTCTCCTTTCGGGAACGACGCGAGTCGACCAATCCTCAAGTGGCTGGACACCAAGAGTAGTGCCTCAGTGCTATACATC
TCATTTGGAACAGTGGCGGGAATAGCATCGATGAAGCCGATCGAGGAGCTGGCCAAAGGCCTGGAGGTTAGCGGCGTGG
ACTTTGTATGGGTGTTTAGAAGCAACCTCGTCGAGGACAAGCAAGGTGAGCAGCAGTTCATGGAAGAGTTCCGGGACAG
AACACAAGCTTCCGGAAGAGGACTGATCGTTCCCTGGGCACCGCAGCTCCAGGTGCTGCAGCACGACGCGGTCGGGGGG
TTCCTCTCGCACTGCGGCTGGAACTCAGTCCTGGAGAGCATCTGGAGCGGAGTTCCAATGCTGGGATGGCCATGCATCG
CAGAGCAGAATCTAAACTA

> SEQ ID NO:3603 51843  246561_301614_1
CGCGTCGCGGACGCGTGGGTCGATGGAATCGAGAGGCCTGCGATCGATTCTCTCAGGGGCAGCGGCGTGGAGGTCAGCT
CCATCGGGCCCTTGCATCTCCTGTCGGAGAAACTCGGGGCGATTGATCCGCGAGGAGGAGACGATCGCCGAAGAATCGA
GAGCGACGGAATCGTCCAGTGGCTGGACAAGAGGCCCGATTCCAGCGTCATCTACATCGCATTTGGCACTACGATGGCG
ATGGCAGATGGGCAATTCGAGGAGCTGGCGGAGGCTCTGGAGGAATCGCGGCAGAGTTTCGTGTGGGCGACGAGGGATC
TGTCACTGCTTCCACCCGGATTCCAAGGCAGAATGTCGGAGCTGGATCAAGGGCTGGTGGTGTCCTGGGCACCTCAGCT
GGAGATTCTGGGGCCACCGATCTACCGGTGGATTTCTGACACACTGTGGCTGGAATTCCGTGCTAGAATCCATGTCATTT
GGAATGCCCATGGTGACAAGGCCTATCACTGGAGACCAAGTTCTCACGGCAAAGTTTGTGGTCGACGAGTGGGTATTG
GTTTTGGTGTGAAGCGGATTGAGATTGGGCTGGAGGTGGCCCGCAAGGATGACCTCCAGAAGTCAATCAGGGCTCTTAT
GGAAGCTGATCCAGAAACCAGCAAGGTATGGAAAAATGCGAGGCGCATCAAGGAAATGG

> SEQ ID NO:3604 52689  7004_300321_1
CCCACGCGTCCGTGCTGAAGGTGGAGAACAGACCACTCTAGAAGCTGATGTGGTCCTCGTCTCAGCTGGTAGAACTCCG
TTCACATCTGGACTTGATCTAGAGAAAATCGGAGTTGAGACAGACAAAGGCGGGAGAATTCTGGTGAACGAGAGATTCT
CGACAAATGTTTCAGGCGTTTATGCAATTGGAGATGTGATTCCAGGACCAATGCTGGCTCACAAAGCCGAAGAAGATGG
TGTTGCATGTGTTGAGTTTATAGCAGGCAAACACGGGCATGTGGATTACGACAAAGTCCCTGGGGTTGTCTACACGTAC
CCTGAAGTTGCGT

> SEQ ID NO:3605 53369  23632_300255_1
cccacgcgtccgggctaatgttgatacaacaattctcaggaagtgctgctgtaatctcttatgcaagtaccatttttag
aAAAGCTGGTTTTTCGGTGGCCATTGGAACGACGATGCTAGGTATCTTCGTGATTCCAAAAGCCATGATTGGCCTCATT
CTTGTCGATAAATGGGGCAGACGTCCTCTCCTGATGCTTCAGCGTTTGGGATGAGCATGACTTGCATGCTACTTGGGG
TCGCCTTCACATTACAGAAAATGCAATTGCTTTCGGAACTAACTCCAATATTATCGTTTATATGCGTAATGATGTATAT
TGCAACTTATGCAATAGGCTTGGGAGGTCTACCTTGGGTAATTATGTCGGAGATATTTCCAATAAATATAAAAGTAACT
GCAGGAAGTATAGTTACGTTAGTCTCATTTTCAAGTAGTTCAATCGTCACTTACGCTTTCAACTTTCTGTTCGAATGGA
GCACTCAAGGAACGTTTTTCATATTCGCGGGTATCGGTGGAGCAGCGTTGCTTTTTATATGGTTGCTCGTTCCAGAAAC
GAAAGGATTATCACTCGAAGAAATACAAGTTTCACTTATTCATCAGCCCGATGAAAGAAATCAAACTTAATTTGAATTA
TTTTATTTTATTATAAAAATGATCAAATTCAGTTTATGGTGTTATATTTGTTTATTTACAAACAAGGATTTTTTTTTTT
CATTATGTAATTACTACTTTATTTTTCTGGGTAATTAGCCCCATTTTTATGATGTATATTTACGAGATGTAAAACTTGG
CCtacgtacatgtgtattttatctctaaaattgcaaatgtaatattttcggacatatattaaagaagagattgatttc
aaa

FIG. 2 continued

> SEQ ID NO:3606  53564   262765_301693_1
gcagcatggctctcgacactctcaattctcccacctccaccaccacaaccaccgctcctcctcctttcctCCGTTGCCT
CGACGAAACCGAGCCCGAAAACCTCGAATCATGGACCAAAAGAAAACGTACAAAACGTCACCGTATAGATCAACCAAAC
CCTCCTCCTTCTGAAGAAGAGTATCTCGCTCTTTGCCTCCTTATGCTCGCTCGTGGCTCCTCCGATCATCACTCTCCAC
CGTCGGATCATCACTCTCTTTCTCCACTGTCCGATCATCAGAAAGATTACAAGTGTTCCGTCTGTGGCAAATCTTTCCC
GTCTTACCAAGCGTTAGGTGGACACAAAACAAGTCACCGGAAACCGGTTAGTGTCGATGTTAATAATAGTAACGGAACC
GTTACTAATAACGGAAATATTAGTAACGGTTTAGTTGGTCAAAGTGGGAAGACTCATAACTGCTCTATATGTTTTAAGT
CGTTTCCCTCTGGTCAAGCATTGGGTGGTCACAAACGTTGTCACTATGATGGTGGTAACGGTAACAGTAACGGTGACAA
TAGCCACAAGTTTGACCTAAATTTACCGGCTGATCaagttagtgatgagacaattggaaaaagtcaactctccggtgaa
gaaacaaagtcggtgttgtgataa > SEQ ID NO:3607  53564   271521_200035_1
AAATCTTTCTCTCTTTCTCTCTAATTCTTTACTGACTACTTCTTTTAGTTCAGTTGCTAAAACACAAGGTAAGGATATG
GCGCTTGAAGCTTTGAACTCTCCAAGAACCCCAACCCCACCATCATTTCAGTATGAAAACACCACTCTCAACTACCTTG
AATCTTGGACAAAGGGTAAGAGATCAAAAAGACAACGTAGTATTATGGAACAACAGCCTACTGAAGAAGAATACTTAGC
TTTCTGTCTTCTTATGCTTGCACGTAGCGGTAATTCTACTACTTCAACGAAACAGATATCACCTTCCTCAGAGTCCAAG
AATTTATACAAGTGTTCAGTGTGTGGTAAGTCTTTTGGATCTTATCAAGCTCTAGGTGGACATAAAGCTAGTCACCGTA
AACAGCTCATTAACGGAGACGTCAATGAAAACTCCGNCACCACCTTCACTACCACCGCTGTTGCCACGTCAGCTAACGG
CCTTGGTGGGAAGATTCACGAGTGTTCTGTTTGCCACAAGAGTTTCCCAACTGGACAAGCTTTGGGTGGTCACAAAAGG
CGTCACTATGAGGGAAAGGTGACGTCATCGGACGGTGTGGGTTCCACGAGTA > SEQ ID NO:3608  57135   234171_301097_1
GGGTGAAGCAGAGTTCCTCTGTGGGCGTGGTTTTCACCTGCTGCGAGGTCCTTGATCTCAAGAATCCTCGATCCTAAT
CCTCAGACAAGGATTCACATGTGCGGTATCCGGAACAACGAATGGTTCAAGAGGAACTACATGCCTGTGAGACTGGCAG
ACGACGAAGACGGGACACTGGACGACATCGAAGCTGTTTTTGATGACTCTGAAGACCAGTTCGTGAAGGAACAGATAGA
CATGCAGGAAGGCCCTTCGATGATGAACGCCTTCGAACTTATTACTCTCTCACAAGGCCTCAATCTGTCCGCTCTTTTC
GACAGAAGACAAGACCTTGTTAAGCGTCAGACACGGTTTATCTCCAAATGTCCGGCCCGGGAATTGCTAGCAAGAATGG
AGGATACCGCAAACTCGATGGACTTCAAAGTGTACAAGCGTGGATACCAGATGAGATTTGAGGGGCTAACT > SEQ ID NO:3609  57135   286511_200110_1
AAAGCTGACATCTGGTCTTGTGGGGTGATCTTATTTGTCTTGTTGGCTGGTTATCTTCCGTTCCATGACTCAAATCTTA
TGAATATGTATAGGAAGATAAGTAGGGCGGAATACAAATGCCCTAATTGGTTCCCTTTAGAAGTGCGTAAACTTCTTTC
TAGTATCCTCGACCCAAACCCTCATACAAGGATTTCGATAGCCAAAATTAAGGAAAGCTCCTGGTTTAAGAAAGGGTTG
GAATCCAGACATGTGAGAACCAAACTAGTACAGAACCAAAATGTTAATGCAGATGGCGATGCTGTTTGCAGTTCGAGTT
TGGAGAACAGCATCTCTTCCTCTGACACAAAGCTAGAGTTGGCAAAACCTATGAATCTAAATGCATTTGATATCATCTC
TCTTTCAAGTGGTTTTGACTTGTCTGGTCTATTTATAAGAAATGATCAAAAGGAGGAACTGCAATTCACATCAGTGAAG
CCTGCCGCGGTCATCATATCTAAGCTTGAGGAAGTTGGCAAGAATCTGAACCT > SEQ ID NO:3610  57135   285720_200106_1
TGTATAACAAAATATCTGCTGCTGAATTTACTTGCCCACCTTGGATCTCTTTTGCTGCCATGAAGTTAATTACTCGCAT
CTTGGATCCAAATCCTACAACGCGTATTACCGCCCCTGAAATTTTGGAGGATGAGTGGTTTAAGAAAGATTATAGACCA
CCTGTTTTCGACGAGATAGAAGATGCAAACCTGGATGATGTTGAAGCTGTTTTCAAAGACTCTGAAGAATATCATGTAA
CAGAGAAAAAGAAGAGAAGCCAACTTCCATGAATGCATTCGAGTTGATTTCTATGTCACAAGGACTTAACCTCGGCAA
TCTCTTCGACGAACAGGGATTCAAGCGAGAAACAAGGTTCACATCTAAATGCCCGGCCAGCGAGATAATCAGTAAGATC
GAAGAAGCAGCTAAACCTCTCGGCTTTGATGTTAGCAAAAAGAACTACAAGATGAGGCTCCAAAATCTGAAAGCCGGAA
GAAAAGGGAACCTTAATGTTTCCACTGAGGTATTTCAAGTTGCTCCGTCTCTTCATATGGTTGAGGTGCGCAAGGCAAA
AGGTGACACTTTGGAATTCCACAAGTTCTACAAGAATCTTTCAACCTCCTTAGATGAAGTTGTATGGAAAACTGAAGAG
ACATGGAAAAGAAAAAGTGAAGAGC > SEQ ID NO:3611  57135   158358_200003_1
ATCCACAGACGCGCATCACATTTTCCGAGGTCATTGAGAACGAGTGGTTCAAGAAAGGGTATCGTCCACCTGTTTTGA
ACAGGCAGATGTTAGTCTTGATGATGTGAATGCTATTTTAGTGAATCTGCTGACTCTTCGAATCTTGTTGTGGATAGA
CGGGATGAACGTCCTTCTGCACCACTGACTATGAATGCTTTTGAGCTTATTTCAACTTCTCAGGGTCTCAATCTCAGTT
CTCTGTTTGAAAAGCAAATGGGGCTAGTCAAAAGGGAGACAAGATTTACATCGAGATGTCCTGCGAATGAAATTGTCTC
AAAAATTGAAGAAGCTGCTGTACCTTTGGGCTTCAATGTGAGGAAAAATAACTACAAGATTAAGCTTCATGGGGAGAAG
AGTGGGCGCAAAGGTCATTTATCCGTTGCAACCGAGATTTACGAGGTGGCACCTTCACTATACATGGTTGAGCTTC

FIG. 2 continued

> SEQ ID NO:3612  57135  181966_300658_1
GAATTCAGATGCCAATCTGATGGAGATGTACAGGAAGATTGGTAGAGGAGAATTTAAATTTCCTAATTGGTTGGGGGCA
GATGTGCGCAGGCTTCTGTCAAAGATCTTAATTCCAAACCCATATGAGAGAATCTCAATGGCGAAGATCATGGAAAGTT
CTTGGTTCAGAAAGGGGTTGAATGCCGAAGTAGAAAAGCCTTCACGGAAAAACAAGGGACCGAGCCTTTCTTCTGTGGA
TGTTGATGCGTTGTTTAGTCGGAATAATGATAACAGCAGTACCAGTAGTTCAGAAACAAAACCGACTAATTTGAATGCA
TTTGATATTATATCCCTTTCAGCGGGATTTGATCTGTCGGGTTTGTTTGAGAAAACTGACAATAAGAAGAAGGAATCGA
GGTTTATGTCAAGGCAGCCTGCCCCAACCATTATCTCTGCCCTGGAGGATGCTGCCCAGCGCCTGAGATTAAAGGTGAA
AAAGAAAGATGGAGGACACCTGAAATTTGAAGGGACAAAAGAAGGTAGAAAAGGAGTACTGTCCATTGATGCAGAGATA
TTCGAGGTAACTCCATCTTTTCATTGGGTTGAAATGAAGAAATCAAGCGGCGATACCATGGAGTATCAGAACATGTCGG
AGCATTGTTTAAGACCAGCGCTCAAGGACATCATTTGGGTTTGGCAAGGTGATCAACCTCGTGCTCTG

> SEQ ID NO:3613  57152  1007870_301404_1
GGAAGAGAGAGAGAGAGAGAGAGAGAGAGAGAGATCAATGGCAAGCATAGCCTTCGCAGCCTCCTCAGCCTCGGCCTCC
CCCTCCCTCGACCACGCTAGATCTCCCCTCATCCTCCCCCCTAAGGTCTCTTTCTTCTCATATGGGATCAAAAGCCCAG
CCTGCGATGCTAGCACTGGGTGGTCCTATACTCAAAAGGGCCGACTTTCAGGCATTCGGGCTTCTGTTTCCACAGAGGC
TCCTGCAAAGGTAGAGAAGGTATCTCGCAAGAATGATGAGGGCGTAATTGTCAACACTTTCAAGCCCAAGAATCCCTAC
ACCGGCCTTTGCCTTCTCAACACTAAAATTGTTGGGGATGATGCGCCTGGGGAGACGTGGCACATGGTCTTCAGCACGG
AAGGGATGGTAGAGTACAGAGAAGGGCAATCCATTGGGATCATCCCACCTGGTGTTGATGCTAATGGCAAACCTCACAA
ACTGAGGCTCTACTCCATTGCTAGCAGTGCCTTGGGTGATTTTGGAGACAAGAAGACTGTCTCTCTTTGTGTAAAGAGG
GTGGTATATACCAATGACCAGGGCGAGGAGGTCAAGGGTGTATGCTCCAACTACCTTTGTGATCTGAAGTCC

> SEQ ID NO:3614  57152  120711_300516_1
CGGAGACGACCGCAGCGCCGGGTGCGGAGGTGACTACTAAGGTGGAGAAGGTGTCGAAGAAGCAGGTGGATGGCGTGGT
GACGAACAAGTACAGGCCCAAGGAGCCGTACACGGGGCGGTGCCTCCTGAACACGAGGATCACCGGCGACGACGCCCCC
GGTGAGACGTGGCACATGGTGTTCAGCACCGACGGCGAGATCCCCTACCGCGAGGGGCAGTCCATCGGCGTCATCCCCG
ACGGCATCGACAAGAACGGCAAGCCCCACAAGCTCCGCCTCTACTCCATCGCCAGCAGCGCCATCGGGGACTTCGCCGA
CTCCAAGACGGTATCGCTGTGCGTGAAGAGGCTGGTGTACACCAACGATCAGGGAGAGATCGTCAAAGGAGTCTGCTCC
AACTTCCTCTGTGACCTGAAGCCTGGTTCGGACGTGAAGATCACGGGGCCAGTGGGGAAGGAGATGCTGATGCCCAAGG
ACCCCAACGCCACCATCATCATGCTGGGCACCGGCACCGGCATCGCGCCCTT

> SEQ ID NO:3615  57152  146360_301065_1
GTTCGTCTATATTCAATTGCATCCACCAGATATGGGGACTCTTTTGATGGGAAGACGGCCAGCTTGTGTGTCAGACGAG
CTGTCTACTATGATCCTGAGACAGGAAAAGAAGACCCTTCCAAAAATGGTGTTTGCAGCAACTTTCTGTGCGACTCAAA
GCCTGGTGACAAAGTGAAGATCACAGGTCCTTCTGGTAAGATAATGCTTCTACCAGAAGATAATCCAAATGCGACACAC
ATCATGATTGGAACTGGAACTGGTGTGGCTCCCCTTCCGAGGCTACCTTCGTCGTATGTTCATGGAATCGGTTCCAACTA
AGTTTAATGGCCTTGCTTGGCTTTTCCTTGGGGTTGCAAACACTGACAGCCTTCTATATGACGATGAGTTCACCAAGTA
TCTCAATGACTACCCAGGCAATTTCAGATATGACCGTGCTCTTAGCCGTGAACAAAAGAACAATAAAGGGGAAAGATG
TATGTCCAGGATAAAATTGAGGAATACAGTGATGAGATCTTCAAACTGCTGGATGAAGGGGCCCACATGTACTTCTGTG

> SEQ ID NO:3616  57152  283628_200094_1
tagaatatacacttctcttatcttcacatctccaatccttcaaatctcctccacccaatcctttaatccactagctacc
cTCTCTAAAAAGATCCCAACTCCCCTTCTCCTTATTTTCCTTATTCACCATTACCTTATTATCAATTCCCTCCTCTTAA
TATTTTGTTCCATTTCTTGATATCTCAAACATGGCTGCTGCAGTAAGTGCTGCAGTTTCTCTTCCATCGTCCAAGTCCA
CCTCTTTTCCCACCAGAACCTCCATCATCTCCCCTGAAAAGATCAACTTTAACAAGGTGCCTTTGTACTACAGAAATGT
GTCAGCTGGTAGTAGAGTGGTTTCAATCAGAGCCCAGGTGACCACAGAGGCTCCTGCTAAAGTTGAGAAGATTTCCAAG
AAACAAGATGAGGGTGTGGTTGTGAACAAGTTCAGGCCAAAGGAACCTTACATTGGTAGATGTCTACTCAACACTAAGA
TCACGGGTGATGATGCTCCTGGTGAAACTTGGCACATGGTCTTCAGCACTCAGGGGAGAGGTCCCATACAGAGAAGGACA
ATCCATTGGTGTGATTGCTGATGGTGTTGATGCCAATGGGAAGCCTCACAAACTCAGATTGTACTCCATTGCTAGCAGT
GCCCTTGGTGACTTCGGCGACTCCAAAACCGTTTCTCTGTGTGTCAAAAGGCTTATCTACACCAATGACAAAGGGGAAG
AAGTTAAAGGAGTTTGCTCAAACTTCTTATGTGACTTGAAGCCTGGAGCAGAAGTCAAGATTACTGGACCTGTTGGGAA
AGAAATGCTCATGCCTAAGGATCCAAATGCCACCATTGTTATGCTTGCAACTGGAACTGGAATTGCTCCTTTCCGTTCA
TTCTTGTGGAAGATGTTCTTTGAGAAACATGAGGATTACAAGTTCAACGGTTTGGCATGGCTTTTCTTGGGTGTTCCCA
CCAGCAGCTCGCTACTTTACAAAGAGGAGTTCAGAAAATGAAGGAGAAGGCCCCCGAAAACTTTAGACTGGACTTTGC
AGTGAGCAGAGAGCAAACAAACGAAAAAGGCGAAAAGATGTACATCCAAACCAGAATGGCACAATATGCAGAAGAACTA
TGGGGTCTGCTACAGAAAGACAACACCTTCGTCTACATGTGTGGACTCAAGGGCATGGAGTCTGGAATTGATGACATTA

FIG. 2 continued

TGACTTCACTTGCTGCTAGAGATGGTATTGTATGGGCGGACTACAAGAAGCAATTGAAGAAGGCAGAGCAATGGAATGT
GGAAGTCTACTAAATATTTTTGGTTTTCTTTGTATAAATATGAGCCAACTTTATGCTTCTCTACCCTTCATCCATGTAG
ATAGGTAAATTTTTCCTTTTAAATTAATTTTCATTTTTTTTTGGATTTTCCTTTTCTTGAAATTTCATCATTAAATGA
ATCAGTGTATTGACATTGGCCCTGTAAAAgGAATTGACGGCATGTATCAATAACATATAGCTGAATCAACCTCAATTGC
TgtcTgttG > SEQ ID NO:3617 57152 38528_300201_1
GCAGCAACTTCCTATGTGATTCAAAGCCCGGTGACAAGATTCAAATCACCGGTCCATCTGGGAAGGTAATGCTATTACC
CGAGAGTGATCCAAACGCGACACACATAATGATAGCCACGGGAACAGGAGTGGCTCCATACAGAGGCTACTTACGTCGA
ATGTTCATGGAAAACGTCCCAAACAAGACATTTAGCGGCTTAGCTTGGCTCTTCTTAGGCGTGGCCAACACCGATAGCC
TTCTCTATGACGAAGAGTTTACCAAGTACCTAAAAGACCATCCAGACAACTTTAGGTTCGACAAGGCATTGAGCAGAGA
GGAGAAGAACAAGAAAGGTGGAAAGATGTACGTGCAGGACAAGATTGAAGAATATAG > SEQ ID NO:3618 57152 52669_300091_1
tttttttttttttcatgtctaatgattgactttcttggtggagttacactgtgtccattaattgacacgattattcagtt
gCAAAAATGGCGAAAACCACAGAAAGACTATTAACTCAATACACTTCAACATGCCACTgCTTGTTCTTCCTGAGCTGAG
TAAGTTTCTGCTCCCAGCTTTCGCCTCGCTCTTCagcGACtctctTaAGCGTATCTTGAATCCCGGGCATCATTCCTTT
AAGTCCGCAAAAGTAAATAtgagcTCCATTgtcCAAAAGTTtgAaAaTTTCATCGCTGTATTCTTCAATCTTgtcCTGC
ACATACATTTTCCCTCCTTTCttgttTTTCTCTTCTCTGCtcagcGCTTTGTCgtaCCTGAAATTTTctGGATAGTCCT
TGcggtacCCGGCAAATTctTcatCaTaaagaaaACTGTCTGAGTTagccacacCAAGGAagaGCCAAGCAAGTCCGTC
AAACTTGAAAttGggaaCATtCTCCaTAAACATacgcCgtaggtaTcctctGtACGGagcaaCTCCGGttCCAGTAGCA
aTCattatgtgagTAGCTTtCGGgTCATCTTCAGGTAAAAGCATTACCTTTCCAGATGGACCGGTGATTTTAACTTTAT
CGCCGGGTTTGGCATTGcaCAAGAAGTTACTGCATACAcCAGCTTTGGAAGGATCttCTTTTCCTGTCTCCGGATCATA
GTAAATAGCTCGACGGACACATAGACTAGCTGTTTTGCCATCAAAAGAATCTCCATACCGTGTTGATGCAATCGAATAA
AGGCGAACGTTATGAGGTGCACCAGGTTTCTTGGGATTCTCACCAGGAGGAATGACTCCATAGCTTTGTCCTTCCCAGT
AAGGAACATTACCATCATGATCAATAACAATGTGGCAAGTCTCTCCAGGTGCTTGTGGACCAACAATTCTCTCAACCGA
AACAATAGTTGCAGTATAAGGCTCCTTAGGCCTAAACAAGTTTAAGGGAGTCTCTTTGGGATCTTCAAGTTCTAGAGGA
GTAACCAAGACTTTGGATTTGCTTGATTGCTGAAGTGACATGCATATTGTGGACCTTTTTTTCACACCTAAGCTTCTAG
ATTTCGAATCTAGTCTCAGCAGAGGAGGACCCCATGACTTATCAGTGAAGCTTATACTTTGAACCTTAATCATAGATCG
GCTCGACCCATCAATTCTAGTTGGAAGTgcaacggacatctgagaaggagtagttgagagagccatagcaatggagaaa
agagacgataattctcccggacgcgtggg > SEQ ID NO:3619 57152 3938_300330_1
tcCGCTGGGAAGGTAatgCtATTacccgagagtgatCcaaacgcgcccccATAAtgatagcCCCGGGAACAGGAGTGG
CTCCATACAGAGGCTACTTACGTCGAATGTTCATGGAAAACGTCCCAAACAAGACATTTAGCGGCTTAGCTTGGCTcTT
TTTAGGCGTGGCCAACACCGATAGCCTtCTCTATGACGAAGAGTTTACCAAGTACCTAAAAGACCATCCAGACAACTTT
AGGTTCGACAAGGCATTGAGCAGAGAGGAGAAGaccAAGAAAGGTGGAAAGATGTACGTGCAGgcCAAGATTGAAGAAT
ATAGTGATGAGATCTTCAAGCTTTTGGACAATGGAGCTCATATTTACTTCTGTGGGCTTAAAGGAATGATGCCTGGGAT
TCAAGATAcccTTAaaagaGTTGCagaaaagagaGGTGAgaGCTGGGACTTGAAGCTTtctCAGCTCAGGAAGAACAac
cAGTGGCCCGTTGAAGTCTATTGAGCTCTTTATTTGTATTTGCTGTTTTTGATTTTTGATTTAAGAATCGTAATAAATT
TGAATTTGGTGTTTTtctacTTTTCAaacATGATATGATGATaatatctgaaatttgttggttttgagaagagaatatt
ctcagagaataatcaatatatcatttatgtaaaaaaaaaaac > SEQ ID NO:3620 57165 228745_301036_1
ACTTAAGGGACCATATGCGACGAGCTGCCGATGTGTGCTTCGCCCAACTTTTCCGAGAGGGAAACGGAACTACAGGCAT
TGTTGATTTCACCAATTATGACGACATGAAATATGCGATTACAAAGCTTGACGATTCGGAATTCCGTAATCCATTCTCG
CGATCGTTCATCCGCGTCAAGGAAGACAGGTCTCAGGGATTCACACGCAAACCTTTCGCCGCATTGTCAGTCGAAGCCGGA
GCAAAAGTCGTACCCGCACTTACAGCCGTAGCAAAATCCGCAGTCGAAGTCGGGAGCCGTGGGCGATCTAAGAGTCCAGG
ATGCAGGTCCAAGTCATGCTCGAAGTCGGATTCGAAGTCTCCTGTGGCTCGATCGACGTCTCGGTCGTACTCGCCGCGC
TCACCGGGGTCTCCTGTTGTTAAGGAATCAAGCCGAATGCCGACTCCCCGTCGCTCCCGCTCAGATTCTCCTGCGGC > SEQ ID NO:3621 57165 2302_300350_1
AATTCGGCACCAGATTTTCTTTCTCCGTAATCTCTAGTGTTGGATCCTACAGGCATAATGGGTCGTTTAAGTCGGACT
ATCTATGTGGGCAATCTTCCTGGTGATATTCGTGAGAGAGAAGTAGAAGATTTGTTTTACAAGTATGGGCATATCGTGG
AAATTGAGTTGAAAGTTCCTCCTAGACCACCTGGTTATGCATTTGTAGAGTTTGAAGATTCTCGTGATGCTGATGATGC
CATCCGTGGGCGCGATGGCTATGACTTTGATGGACATCGATTACGAGTTAGTTGTCTCCCCACCTCCCCATCTTTTTGG
TGATGTGTGGTATTTTTTTGAAGTCAGATTATGTTCACCACTATT

FIG. 2 continued

> SEQ ID NO:3622  57165   240891_301317_1
GCGGAGGAGAAGGCGCTGCGTGCGTGCAGCGGCAGCGGTGGTGCTGTGGAGCGCCGGATTTGTCGCTGTGAATCGAGGT
AGCACTTAGCAATGAGTCGATCCAGTCGGACAATTTATGTCGGGAACCTTCCCGGTGATGTTCGGGAGCGCGAAATCGA
GGACTTGTTTCACAAGTATGGACATATTGTAGACATCGACTTGAAGCTGCCACCGAGGCCTCCAGGGTACTGTTTCATC
GAAGTCGAGGACGCTCGAGATGCCGAGGACGCCATTCGGGGTCGTGATGGCTACAACTTTGATGGATACCGTCTAACGT
GTTGAAATTGCTCACGGTGGCCGCGGACCTCCGTCCTCGGATCGATACAGTAGCCATGGTGGTCGGGGAGGAAGCGTAT
CCAGGCGTTCGGAATACAGAGTTATCATCACGGGTTTGCCTTCGTCGGCGT

> SEQ ID NO:3623  57165   239032_301300_1
tttgcttgtgcgcaagcggcggataaggcgctgcgggggcagcggcaccggcggtgcctggagcgccggattttcgcg
tGAATCGAGcTaccacTAaGCAATGAGTCGATCCAGTCGGACAATTTATGTCGGGAACCTTCCCGGTGATGTTCGGGAG
CGCGAAATCGAGGACTTGTTTCACAAGTATGGACATATTGTAGACATAGACTTGAAGCTGCCACCGAGGCCTCCGGGGT
ACTGTTTCATCGAATTCGAGGACGCTCGAGATGCCGAGGACGCCATTCGGGGTCGTGATGGCTACAACTTTGATGGATA
CCGTCTACGTGTTGAAATTGCTCACGGTGGCCGCGGCCCTCCGTCCTCGGATCGATACAGTAGCCATGGTGGTCGGGGC
GGAAGCGTTTCCAGGCGTTCGGAATACAGAGTTATCATCACGGGCTTGCCTTCGTCGGCGTCTTGGCAGGACTTAAAGG
ACCATATGCGACGAGCTGGCGATGTTTGCTTCGCCCAAGTTTTCCGAGAGGGAAACGGCATtGTTGACTTCACCAATTA
TGACGACATGAAATATGCGATTAAAAAGCTTGaCGAT > SEQ ID NO:3624  57165   107236_300020_1
CCCACGCGTCCGGGGTAAGAAGCGGATAAGAAGCTGATCGCCAATTTCATCAAACCCTAATTGATAATCCAGTGTTGCA
GCTAATTCTTCCTTCATTGCTGAGAATGAGTGGCCGTTTTTCACGCACGATTTATGTTGGCAACCTTCCAGCAGATATA
AAGGAATATGAAGTTGAAGATCTATTCTATAAGTACGGTCGTATATTGGATATTGAGTTGAAGATTCCACCTCGCCCTC
CTTGCTTTTCTTTTGTGGAGTTTGAAAGTTCTCGAGATGCAGAAGATGCCATCAGGGGTAGAGATGGTTACAACTTTGA
TGGCTGTCGCCTGAGGGTTGAGCTTGCTCATGGAGGAAGAGGGCCATCATCTTCAAGTGATCGCCGAGGCAGCTATGGC
AGCAGTGGTGGTGGAGGGCGTTATGGTGTTTCTCGGCATTCTGATTACCGAGTTATTGTTCGAGGTCTTCCATCTTCTG
CTTCTTGGCAAGATTTGAAGGATCATATGCGGAAAGCTGGCGATGTGTGCTTTGCTGAAGTTTCTCGTGACAGTGAAGG
TACCTTTGGCATGGTTGACTACACACATTATGAAGACATGAAGTATGCTATAAGGAAACTTGATGATACTGAG > SEQ ID NO:3625  57165   143346_200009_1
ACGGCTTCTACGCTGTGGATTGTGGCTTAGTCTGCTCTGGATCTTCCGAGTTTTCTTTTTCAGGGACAATGAGTCGATC
GAGTAGGACACTTTATGTTGGCAATCTTCCGGGCGATATTCGTGAGCGTGAAGTGGAAGATCTGTTTTACAAGTATGGC
CCAATAGCGCATATTGAGCTGAAAATTCCACCAAGGCCCCCTGGTTATGCTTTTGTTGAGTTTGAAGAAGTTCGTGATG
CTGAAGATGCTATTCGTGGTCGTGATGGCTATGATTTTGATGGGCACCGTCTGAGGGTTGAGCTTGCACATGGTGGGCG
TG > SEQ ID NO:3626  57165   145967_200138_1
AAAATTTTCTCCTCAGCTCTCTGTTTTCATCCGTCATCAAATCTTCTGAGGAATAATGAGTCGTTCAAGTAGGACAATT
TATGTTGGTAATCTTCCTGGTGATATTCGTGAGCGAGAAGTTGAGGATCTGTTCTACAAGTACGGCCCGATAGCTCATA
TTGATCTGAAAGTTCCACCAAGACCCCCGGGTTATGCTTTTGTTGAGTTTGAAGAGGCTCGCGATGCTGATGATGCTAT
TCGTGGGCGTGATGGCTATGATTTTGATGGGCATCGCTTGAGGGTTGAACTTGCACATGGTGGGCGTGGTAACTCATCA
GCAAATGATCGTTATAGTGGCAATAGTAGCGGTCGTAATCACAAATTTGGAGCTCCCAAACGTACCGAGTATCGAGTAT
TAGTTACCGGATTGCCCCATTCAGCATCCTGGCAGGATCTTAAGGATCACATGCGTCGAGCTGGGGATGTTTGTTTCTC
ACAAGTTTTCCGTGAGGGTGGTGGAACCACTGGGATTGTGGATTATACTAACCGCGACGACATGAAATATGCTATCAAA
AAACTTGATGAATCTGAGTTCCGGAATGCTTTTTCTCGTTCGACGATTCTCGTATGAcggggaCATgtttcaaatactt
GgttatagCATGCTTAATGcc > SEQ ID NO:3627  57194   107682_300380_1
ACGAACATAAGGCCGACGCGTATCATTTAACCTCCCGTCGACGTCTATCATTCAATTCTCGCCGCTTTTTGCTCGCGGT
GAGGATGTCGACACCGGCGAGGAAGAGACTGATGAGGGATTTTAAGCGGTTACAGCAAGATCCCCCGGCCGGCATCAGT
GGAGCTCCGTATGACAACAATATAATGCTATGGAATGCAGTCATTTTCGGCCCTGATGATACTCCCTGGGATGGAGGTA
CATTTAAGCTGACACTTCAATTCTCAGAGGACTATCCAAACAAACCACCAACTGTGCGGTTTATTTCCAGAATGTTCCA
CCCAAATATTTACGCTGATGGAAGTATTTGCTTAGACATCCTGCAAAATCAGTGGAGTCCCATATATGATGTAGCTGCT
ATACTGACTTCAATCCAGTGCAGTCTTTGCTCTGTGATCCAAATCCTAACTCGCCAGCAAATTCAGAAGCAGCACGCAT
GTTCAGTGAGAACAAGCGTGAATACAACAAGGAGGTGCGCGAGATTGTTGAACAGAGCTGGACAGCAGACTGACTTCTC
CCTCACTCTCGTCTGTGACAGCAGATTATCCTGTCTCATACTGAAATTGTTCTCGTCTTGTCACTACATTAGTAACTA > SEQ ID NO:3628  57194   1117629_301848_1
GGTGAAGAAGAAGAAAGAGAAGAAGAAGAAATGCAAGAAAAGGATTGAGATCGGCAAAAGACAGAAGGATTTCGCATTC
CTGGGTTTGTTGTGTGACCGAAACTGGATGGATAAGCCTCTTTAACCCCAACAAGGGCAGCGTTTAATCACTTTCAACA

FIG. 2 continued

AGTCCGGGGGGTTGGTTGCATACAATCCAACATAAGCTTTCACTTTCTTCCAAAGGCGATCAATCTCTTGCCACAATGT
CCACGCCGTCAAGGAAGCGTTTGATGCGTGATTTCAAGCGGCTTCAACATGACCCCCCTGCTGGTATTAGTGGTGCTCC
GCAGGACAACAATATCATGCTTTGGAATGCTGTCATATTTGGGCCGGACGACACACCTTGGGATGGAGGCACTTTCAAA
TTGACCTTGCAATTCTCGGAAGACTACCCCAATAAACCTCCAACAGTTCGTTTTGTGTCAAGGATGTTCCATCCAAACA
TCTATGCAGATGGAAGTATCTGCTTGGACATTCTGCAAAATCAATGGAGCCCCATATATGACGTTGCAGCGATACTTAC
ATCTA

> SEQ ID NO:3629 57194 1107776_301548_1
GAGAAGACGGAGAGAGAGAGAGAGAAGGGAAGTCCAGGCGTCTCTATCTTTCTTACTCTGCCCTTCTCAGCATTCCCAC
TGCCATGTCCACCCCTGCACGGAAGCGCTTGATGCGCGACTTCAAGCGGCTTCAGCATGATCCCCCTGCTGGCATAAGT
GGTGCTCCTCAGGACAACAACATTATGCTTTGGAATGCTGTCATCTTTGGGCCGGATGACACCATGGGATGGAGGTA
CGTTCAAGCTGACATTACAATTTTCTGAGGACTATCCAAATAAGCCTCCGACGGTCCGTTTTGTGTCGAGGATGTTCCA
CCCAAACATTTATGCCGATGGAAGTATCTGCCTGGATATTCTGCAGAACCAATGGAGCCCAATCTATGATGTCGCAGCA
ATACTTACATCCATTCAGTCTTTGCTCTGCGATCCAAACCCGAACTCTCCGGCAAATCCCGAAGCAGCACGAATGTATA
GCGAAAACCGGCGAGACTACAA

> SEQ ID NO:3630 57194 1109176_301542_1
GGAATGGCATCCTCTGCTCAGCTTCGATTGATGTCCGATCTGAAGGCCATTAGCCATGAGCCACCTGAGGGATGCAGTG
CCAGCCCTTATAGCGATGCGGACCTTTTTGTTTGGGACGCCACAATATTTGGTCCCGAAGATACTCCATGGGAATGTTG
TTCCTGTGACCGGATCCATCTTTCGAAACTTGAAAATTAGATGAACCTATCTGTAACTTTGTGTTCTATTGTATG
CTTGTGTTTCTTGTAGGTGGCATTTTCTGCCTCCGTTTGGTCTTTGGAGAGCATTACCCTGCCAAACCACCTCGTGTCA
GGTTTACTTCCGAGATATTTCACCCCAATGTGTACAATGATGGCACCTTATGCATGGACATTATACAAGATGCTTGGTC
TCCTTGCCACAACATCTGTACAATTCTAACATCTGTTCAGTCATTGCTAACAGATCCGAATCCCGCAAGCCCAGCTAAC
TCGGAAGCTGCACATTTATATCAAACTGATATTCAAGCATATAACAGGCGAGTTCGGCGTTGTGTGAGGAAGTCTTTGG
AAAGCACATAGTATACTTTGCTTTGCTTGTT

> SEQ ID NO:3631 57194 1118391_301855_1
agaatggctacttctgcgcagctccgcctcatgtcggacctcaaagccatcctcagcgagcctcccgagGGATGCAGCG
CAAGCCCTTACAATGATGATAATCTCTTTGTGTGGAATGCTACTATCTTTGGCCCTGAGGACAGCCCTTGGGAAGGTGG
GATTTTTTCTCTTCGTTTgATATTCGGAGATCAATATCCTGAAAAGCCACCTCGTgttaGaTTTACTAgcgagatnttC
CATCCAAatggtgtacacaaTggaaactTATGCATGGATATaattcaggatGCTTgGTCTCCCTgccAcaaCATCTgca
CTATAttgacTTCaaTACAGTCTTTAttgacggAtccaaATCCag > SEQ ID NO:3632 57194 1119709_301900_1
ggcctttataaccttagttacctatagtccattgacggttcgcaatcAGAATGGCTACTTCTGCGCAGCTCCGCCTCATG
TCGGACCTCAAAGCCATCCTCAGCGAGCCTCCCGAGGTGGGATTTTTTCTCTTCGTTTGATATTCGGAGATCAATATCC
TGAAAAGCCACCTCGTGTTAGATTTACTAGCGAGATTTTCACCATCCAAATGTGTACAACGATGGAACCTTATGCATGGAT
ATAATTCAGGATGCTTGGTCTCCCTGCCACAACATCTGCACTATATTGACTTCAATACAGTCTTTATTGACGGATCCAA
ATCCAGAGAGCCCTGCTAACCCAGAAGCTGCACACTTATATCGGACCGATATTCAAGCATATAATAGGAGGATCAAGCA
GTGCGTAAGAAAGTCTTTGGATAGTTAATGAGTATGGAAtTTCGACTGAAAGTAAACATGACGTAATTTggCTCTTGCT
aggCattcaCAGGTCTAAActaaacTATGGTTAAAGAAGATTGAATAACTCACTA > SEQ ID NO:3633 57194 145271_301058_1
tacgaaaccaacaaggaagagaatcaaattcttctattcccaataattcTCTATTCAGATTCGATCTCGGTCTCTGAGT
GATGGCTTCGAAACGGATCTTGAAGGAGCTCAAGGATCTCCAGAAGGATCCCCCTACCTCTTGCAGCGCCGGCCCCGTC
GGAGAGGACATGTTCCATTGGCAGGCCACAATTATGGGTCCCCCAGACAGCCCTTATACCGGTGGTGTATTCCTAGTTA
CTATACATTTTCCTCCTGATTATCCATTCAAACCTCCTAAGGTTGCTTTTAGAACAAAAGTTTTCCATCCAAATATTAA
CAGTAATGGCAGTATATGCCTGGACATATTGAAGGAGCAGTGGAGCCCTGCATTAACTATTTCCAAGGTTTTGCTTTCA
ATTTGCTCTCTTTTGACGGACCCAAATCCCGATGACCCCCTGGTGCCGGAGATTGCTCACATGTACAAGACAGACAGAG
CTAAATACGAATCAACTGCCAGGAGTTGGACCCAGAAATATGCCATGGGTTAGAACATTACCTATACGGGCCCGAGTCC
ATGTAAAAAGAATTCATGTGCCTGTTCTCTCTCCTCTCTCAACCagCAAAGTGTAGAATAGCATTAAATGTTGTCCTCT
ccAAGAAAAAGAGATGCTTTGAATATTTTTATATGGATTCTAACATtTTAAGAAATCTGGGAACTgttTATTTATCTGG
tt > SEQ ID NO:3634 57194 125388_300630_1
GGCAACTCCTTTTCATTTCCCCCCCCACCCTCCATCAACTGAAGTCTATGGCTTCGGGTTCTCAAGCTAGTCTCCTCCT
TCAGAAACAACTCAAAGATCTCTGTAAAAGACCAGTTGATGGATTTTCAGCTGGTTTGGTTGATGAAAGCGACTTATTC
GAATGGAGTGTCACCATTATCGGACCCCCGGATACTTTATATGAAGGTGGTTTCTTTAATGCTATCATGAGCTTTCCTC
AAAATTATCCCAACAGTCCTCCAACTATTAGGTTTACCTCGGAGGTGTGGCATCCTAATGTTTATTCTGATGGAAAGGT

FIG. 2 continued

TTGCATCTCAATACTTCACCCACCTGGTGATGATCCAAATGGGTATGAGCTTGCTAGTGAGCGTTGGTCTCCTGTCCAT
ACGGTTGAGAGCATAATTTTGAGCATCATATCAATGCTTTCAAGTCCTAATGATGAGTCTCCTGCTAATGTGGAAGCCG
CTAAGGAATGGAGAGATAATAGAGATGAATTCAAGAAAAAGGTCAGTCGTTGTGTAAGACGGTCTCAAGAAATGACATA
AAGACACGAATGCCAAAATCGGACTTCTTTCATCAGTTGTTGTTTGATACAAATGTAGAATTGTTGTCAAGGTCTGTCA
TACCTTTTGTAATATTTGCGAGTACGGTCATTATTTACATTT

> SEQ ID NO:3635 57194 124628_300424_1
TGCGAACTCCAGGGGCACCTCCTCCAACACAAAGCAGGAGTTGAGCGCAGAATCAAACCAAAACCCTAGCTCACCGCCT
TGTTTCCTCCGTATTGGTGGTTACAATGTCGACTCCGGCTAGAAAGAGGTTGATGAGAGATTTCAAGAGGTTGCAGCAG
GACCCTCCTGCTGGTATTAGTGGTGCACCTCAAGACAACAACATTATGCTTTGGAATGCCGTGATATTTGGTCCTGATG
ACACTCCTTGGGATGGTGGTACGTTCAAGCTGACTCTTCAATTCTCTGAGGATTACCCCAATAAGCCACCAACAGTGCG
GTTTGTTTCTCGCATGTTTCATCCTAACATTTATGCAGATGGAAGTATATGTTTGGATATTCTTCAAAATCAGTGGAGT
CCAATATATGATGTTGCAGCTATACTTACATCCATTCAGTCATTGCTGTGCGATCCCAACCCCAATTCACCTGCAAATT
CGGAAGCAGCTCGGATGTTCAGCGAGAATAAAAGGGATTACAACCGCAGAGTTAGAGAAGTTGTGGAGCAGAGCTGGAC
TGCAGACTGATTCTAAGGAAGAAAGATGTCATTGCTGACCGCAATTCGGGAGCACCAGGGTTCATCTATGTTACATTTA
CGGATTGAAACCTCTTCTTGGAAATTTTATTGGAACACATTTGTTTTGGCCCTAGTATTATGGCTTGGTGCTGTTTGCC
TTACCGTTTGCTGCATTGCATTGACAAGCTCCTGTAATATATGAATG

> SEQ ID NO:3636 57194 124562_300423_1
agaaatcaaatcgacccccttactcctcTAAATCCCCACACCCATCTCTCTCTCTCTCTCTCCTCAATCGAAGGATCC
GACAATAAAAGTTGATTGTCTTCAACATCTGTCTACCAGCAAAAACTACTTGCGTGCAGTCGCCAACTGATCCTAGGAT
TATACTTACATTTGGCTATGGCAACTAATGAAAATCTCCCACCAAACGTGATAAAACAATTGGCAAAGGAATTGAAAAA
TCTTGATGAAACTCCTCCTGAAGGCATCAAAGTAGGTGTCAACGATGATGATTTTTCAACCATATATGCTGATATCGAG
GGGCCAGCTGGGACTCCTTACGAGAATGGGGTTTTCCGCATGAAGTTGATTTGACGCATGATTTCCCTCATTCCCCAC
CCAAAGGTTATTTTCTGACCAAGATTTTTCATCCCAACATCGCTTCCATTGGCGAAATTTGTGTCAATGCTCTGAAAAA
AGATTGGAATCCTAGTTTGGGCCTACGACATGTTCTCATGGTGGTAAGGTGTTTGCTGATCGAGCCATTTCCAGAATCT
GCGTTAAATGAGCAAGCTGGTAAAATGCTGCTTGATAATTATGACGAGTATGCTAGACATGCAAggCTTTATACCagTA
TTCATGCTAAACCaaagactaaGttAAAga > SEQ ID NO:3637 57194 116594_300078_1
CCCACGCGTCCGCTCCTCCTCTTCCTCCCTCCCGATCCCCTGGCCCGCACGAAACTCAAAGCATCCCCGGCGCCGCAGC
TCCCCGGAGGAGGAAGCCCCCGCGCCCCGCCCGACCAGATCCGATGGCCAACAGCAACCTCCCCCGGCGAATCATCAA
GGAGACGCAGCGACTCCTCAGCGAGCCAGCGCCGGGAATCAGCGCGTCTCCGTCGGAGGAGAACATGCGCTACTTCAAC
GTCATGATCCTTGGCCCGGCACAGTCCCCCTATGAAGGTGGAGTTTTTAAGCTTGAACTCTTTTTACCCGAGGAATATC
CTATGGCTGCTCCAAAGGTTAGGTTCCTGACCAAAATATACCACCCCAACATTGACAAGCTTGGTAGGATATGCCTTGA
CATTCTCAAGGACAAATGGAGCCCAGCCCTTCAGATTCGGACAGTTCTTTTGAGTATCCAGGCACTCCTAAGTGCACCA
AACCCTGATGATCCTCTCTCTGATAACATTGCAAAGCACTGGAAAGCCAATGAAGCAGAAGCTGTTGAAACAGCAAAGG
AGTGGACTCGCCTGTATGCCAGCGGTGCATAAAACCCAATGCCTCTCGTGATGTAATAACCCGTCATGCTTTAGCCTTA
ATCAAATGCCATTTGCTTGATAAGAACAAACTGGAGATATTGGCAGTGGAAGGGAGTTTAAATGACTACC > SEQ ID NO:3638 57194 228530_301022_1
cccacgcgtccgcccacgcgtccgctcacctggcgcgccgaagcttctctcctctctctcaactccggcgagaggagga
gGCGGCGGTGGGGCGTTCGTCGGGAGAGAGACCAGGGCCGGGGGCTAGGGTTCGGCCGTTCAGAGAGGCGGCGGCTGA
GGAGGAGGAGCAGGAGGAGGAGGGGGTGAGGAGAGATGTCGACGCCGGCGAGGAAGCGGCTGATGCGGGACTTCAAGCG
GCTGCAGCAGGACCCCCCGCCGGAATCAGCGGCGCGCCGCACGACAACAACATCATGCTCTGGAACGCCGTCATCTTC
GGGCCGGATGATACGCCGTGGGACGGAGGCACGTTCAAGCTTACCttgcagTTTACAGAAGATTATCCCAACAAGCCGC
cGActgttTCGGTTTGTTTCTAGGATgttccaCCCAAATATTTAtGCAGATGGAAGCATCTGCTTGGATATTCTACAGAA
CCagtggaGCCCTATATATGATGTTGCTGCCATATTgaCTTCAATTCAGTCtttgctGTGTGATCCAAACCCCAACTCT
CCAGCAAACTCAGAAGctgccagACTGTTTAGTGAGAACAAGCGAGAGTACAACCGCAAGGTTCGTGAGaTCGTGGAGC
AGaGCTGGACAGCTGActagggcATGCAGcagggcaaCGGGtggTATCCaCCATGCCAGAAAGATGCAATAagcaaccg
tGAAAAacctgTg > SEQ ID NO:3639 57194 244077_301554_1
GCGAGAGAGAGCAGGAAGGCGATCGATCAGCTCCCGGCGGCGCTGTCGGAATCCGGATCTTGGAGCCGCTGCCATGGCC
AGTACCATCGCCAACAGCAATCTCCCGCGGCGGATCATCAAGGAAACGCAGCGATTACTGACCGAGCCAGCCGAAGGCA
TCAAAGCTTCGCCTGCCGAAGATAATTTGCGATACTTCAATGTGATGATCCTTGGCCCCGCACAGTCACCCTATGAAGG
TGGTGCTTTTAAACTGGAGCTTTTTCTTCCGGAAGAATATCCAATGGCTGCTCCAAAGGTTCGCTTCTTGACGAAAATT
TACCATCCAAACATCGACAAGCTGGGCCGGATTTGCTTAGACATTCTAAAAGACAAATGGAGTCCTGCTCTCCAGATTC
GAACAGTGCTTTTGAGTATTCAAGCTCTTTTGAGTGCTCCCAATCCTGAGGATCCCCTGGACGAGAACATCGCGAAGCA

FIG. 2 continued

CTGGAAGACAGACCAAGGAGGAGCCATCGCGACTGcaAGAGAGTGGACTCAACTCTACGCGACCCATAATTAAATCAAA
ATGCGGACCATTCGTCATCTTGGTTCGTTTAGTTTTTTCTgctTTGgTCATAttTgt > SEQ ID NO:3640 57194 254087_301631_1
ACGACCACCAATTCCAAGCACACATTCGGACACCCACACTCTCTATCTTGCGAACAGCCTGTCACGCGCGAAATCACTT
CCCCAACATCATCCTGGACTACAGTCTCCATAACGACACCACTCGCGCCTCACATCCCACGCATCACTTTCCAACATGT
CCACAGCAGCGAGGAGACGCTTGATGCGCGACTTCAAGCGCATGCAGACCGACCCTCCAGCTGGCGTCTCAGCCTCTCC
GATCGCAGACAATGTGATGACATGGAACGCCGTGATCATCGGGCCCTCCGACACACCCTTCGAGGATGGCACTTTCCGT
CTTGTCATGCACTTCGAAGAACAGTACCCCAACAAGCCACCGGGCGTCAAGTTCATCTCACAAATGTTCCACCCAAACG
TCTATGCCACCGGAGAGCTGTGTCTTGACATCCTGCAGAACCGCTGGAGTCCGACATACGACGTGGCGGCAATCTTGAC
CAGCGTGCAGAGCTTGCTCAACGACCCGAACACCAGCAGCCCTGCGAACGTGGAAGCCAGCAATCTATACAAGGACAAC
CGCAAAGAGTACACTAAGAGGGTACGGGAGACGGTCGAGAAAAGCTGGGATGACTGAGCAAAGCGCGCAACACGAAAGT
GAGTTATGAGGCAATCACTATCGAATTCAGACTGGCTTGCATGAGAC > SEQ ID NO:3641 57194 39306_300198_1
CCCACGCGTCCGAGCTCCCGGTATAAGTGCCTCTCCATCTGAGGATAATATGCGGTATTTCAACGTTATGATTCTTGGT
CCTACACAATCACCTTATGAAGGAGGAGTTTTCAAGTTGGAGCTCTTTTTGCCTGAAGAATACCCTATGGCAGCTCCCA
AGGTTAGGTTTCTCACAAAGATATACCATCCTAACATTGACAAGCTTGGAAGAATCTGTCTTGATATTCTCAAGGACAA
ATGGAGCCCTGCACTACAAATACGAACAGTGCTCTTAAGGTATATGAGCTGATTACATAAGATTATTTCCTGCTAAAAA
CTAT > SEQ ID NO:3642 57194 3194_300101_-1
AGGAGAAGGAATGTTTTTGTTTGAGATTAAAGAGGTTTCAAACAAAGAGATGATAAAACATAGGAATCTAACTTATTTC
ATGGAAGATCCCTATGTGAAGAAGTCCTCTCTCTTTCTCTCTTCTCTCTATTAAAACCGAGTCTTTGAGGGATCAAAGG
ACACAAACTTTCATCCCATTGCATATTTCTGAGTCCAGCTTCTCGCAGTAGACTCATACTTTGCTCTATCGGTTTTGTA
CATGTGAGCAATCTCTGGAACCAATGGATCATCTGGGTTTGGGTCCGTTAACAATGAACATATCGAAAGCAAAACCTTC
GATATGGTCAGTGCAGGACTCCATTGTTCTTTCAAAATGTCAAGGCAAATGCTTCCGTTGCTGTTGACATTAGGGTGGA
ACACTTTTGTCCTGAATGCAACCTTTGGTGGTTTGAAAGGATAATCCGGTGGGAAGTGGATGGTTACGAGAAACACTCC
GCCTGAATAAGGACTATCGGATGGACCCATTATTGTAGCTTGCCAATGAAACATGTCTTCAGCAACTGGGCCAGCACTG
CAGGAAGTTGGAGGATCCTTCTGGAGATCCTTGAGCTCTTTCAAGATCCGTTTCGAAGCCATTTCTCAACCAAAAAAAA
ACTCCTAGATCCAAAAAACCAAACCCTCAAGACAGAtcctccaaactcggttttgacgattcacttcctgcagatgatt
ttgagaaagagacagagagagccttcggacgcgtggg > SEQ ID NO:3643 57194 2752_300338_1
CCCACGCGTCCGGGATATTGAAAGAATTGAAGGAGTTGCAAAGAGACCCTCCTGTATCATGCAGTGCAGGTCCAACAGG
AGAAGATATGTTCCACTGGCAAGCTACTATAATGGGTCCGAATGAAAGTCCTTACTCCGGAGGTGTTTTCCTTGTCAAT
ATTCATTTCCCTCCTGATTATCCTTTTAAACCTCCCAAGGTTGTATTCAGAACCAAAGTGTTTCACGCAAACATCAACA
GTAATGGAAACATATGTTTGGACATTCTCAAAGACCAATGGAGCCCTGCCCTTACCATTTCTAAGGTTTGAAATTCTAT
ATATGTATTTAGTTATTTGGCAATATTTTCTATAATTCCATATATCAGATTTGGTATATAACCAAGAAGCTCCAATAGG
TAACACAAATTACTAACATTTTGGTATTATAGGTGCTTCTCTCTATATGCTCTCTTCTAACA > SEQ ID NO:3644 57194 272318_200043_1
ATGCTTATATTCAGGTCCGAAAATTATTTGCAATCTCGTTCCAACTCTTCTCTCTCCCGCAAAGTGAAGTCGGTCTGAA
ATTCGTAATGGCTTCAAAGAGGATTCAGAAGGAACTGAAGGACTTGCAGAAAGACCCCCCTGCTTCTTGCAGTGCAGGT
CCTGTTGGTGAGGATATGTTCCACTGGCAAGCTACAATTATGGGTCCATCTGACAGCCCATTTTCTGGGGGTGTTTTCC
TTGTGTCTATCCATTCCCCCCCAGATTATCCATTCAAGCCCCCAAAGGTTGCCTTCAAAACCAAAGTATTCCACCCAAA
CATCAACAGTAATGGTAGTATTGTCTGGACATCCTAAGAGAACAATGGAGCCCCGCCCTAACTGTATCCAAGGTGCTAC
TTTCCATTTGTTCCTTGCTTACTGATCCAAATCCAGATGATCCTTT > SEQ ID NO:3645 57374 55678_300134_1
AATGCATGATTTTTTTCGGGAAATGTTGCTTGATGTGGACAACATGCCGTATGAGGAGCTATTGGCACTTGAGGAACGC
ATAGGTGACGTGAGCACTGGCCTAAGCGAAGAGGTCATTTTGAAAGCAATGAAACACCACAAACATACATCTTAGTGTC
CTTCTTGTGTTGAGTTGTATCAGAACATAGAGCCATGCTGCATTTGTCATGAAGAGTATGTATAAGGTGATAATCTATG
AACCTTGAAATGTGGACATGAATTCCACAAGGACTGAATCAAGCAATGGGTCATGATCAAGAATCTCTGCCCCATTTGT
AAGACCGAAGCATTAAAGACGCC

FIG. 2 continued

> SEQ ID NO:3646 57374 105373_300373_1
GGCATCGTCCGTCAAGTTCAAGGTCGGCGTTGATGTTGGGGAGACAGCTCGATGGCGCTGTTGGAGTTCCATATTCTTG
GAGGTCTTTGGCTGCTGCCAGTGAAGGTAGGAGCAGGCTTGTTTCCGAGATTCGCAATGTATTGGATCTTATGCGCAGG
GGAGAGGCCTTAAGATTCGAGGATGTCATGATCCTCGATCAGTCGGTCTTCTTTGGAATGGCAGATATTCATGATCGCC
ATCGGGATATGCGGCTTGATGTTGATAACATGTCATATGAGGAATTACTTGCACTGGAGGAGCGCATTGGGAACGTCTG
CACTGGGCTTAGCGAAGAAACCATTTTGAATCGCCTGAAGCAACACAAGTATGTATGCATTAAAACAGAAGAACCTGTG
GATGCTGAGCCATGCTGTGTTTGTCAGGAAGAATATAAGGATGGTGAGGATCTTGGGAAACTGGATTGTGGCCATGATT
TTCATACCGACTGCATTAAACAGTGGCTCATGCAGAAGAATTTGTGCCCCATTTGCAAAACAACAGGGCTGAAAACCTG
AGGAAAGCGTTGAACATTTTTCTCGTGTCAAAGAAGTTGGATGTGACGGTTGGGCTAACGAAGGTTGGC

> SEQ ID NO:3647 57374 187535_300678_1
ccgccggatgcgcgggTACCGCCATTCCCCCGTCGGCCTCGAGGAAGAGATCATGATGTTTCAGACAAGAGTTCTGTTG
GGAGGAATGAGCATGTATGATCGGTACCAGGATTGGCGCCTTGATGTTGATAACATGACATACGAGGAGTTGCTTGAGC
TTGGAGATAAAATAGGTTATGTCAACACTGGATTGCGTGAGGATGAGATAGTTCGCAACCTTAGGAAGGTCAAACACCC
AGCCTTTGACTCCTCGTTCCGGTATTCAACAGAAATGGAAAAGAAATGCAGTATTTGTCAAGAAGAGTTTGAAGCCAAT
GAAGAGATGGGGAGGCTGGATTGCGGTCACAGCTACCATGTTTACTGCATTAAGCAATGGCTTTCTCAGAAGAACGTTT
GCCCAGTTTGCAAGACTGCCGTTACCAAGACTTGAAGTCCGGACTCCGGGCAACGACGATTGTATACCTGGGTCAAACT
TTCAAAACATGTTTGTTTGTGCTCTGTACAGTCAATTACATATGTTATTGTATAAACACATCATCCATTCTTTTGCATT
TGCAGATAGAAATGCCATATTGAGGCATCCTTTATC > SEQ ID NO:3648 57506 279837_200065_1
TCGATTGTTTGTTTTATTCAGGTGATCTACTCTAATAATTGGTCTTCGAAAAGTATAATCCTTTTTTTTTGGCTCGTCA
TTCTGGCTCTTTCTTTGACCTGATGTTCTTCATTTTGCTTCTCCTCTCATTCTTGAACTGAAAATTCATGTATTGTGAC
AATTAGTTGAAGAAGAAGGAGTAGCAAAGTGGGGTTGGGATGTTTGGGTCTGGAATGAATTTGATAACCACAATAATTG
GTTTTGGGATGAGTGCAACTTTTATAGTGTTTGAGTGTACTAGACTGATTTGTGGGAGGATAAGCAGGAGGCAATCAAG
GCAAATGTTTGAAATTGAATCATGGATTGATCTTCAAATGATTCACTAATGTAAACCTATTCTGGCAGCCAGAGCATCG
AATCAACGGGCTTGACTCTGTTGTGGTTGCTGCAATTCCCACCATGAAATTTCACCGCTAGGCTTTCACCTCCTC > SEQ ID NO:3649 57510 157636_301741_1
TTTGCTTCCCCCTTCCCACTGCGGCTAGGGTTTTAGCTCACTCTTCAAGATGAATGTAGAAAAGCTGCGTAAGATGGCC
GGTTCGGTCAGAACCGGTGGAAAGGGTACCATGAGAAGAAAGAAGAAAGCCGTTCACAAAACAACTACAACCGATGACA
AAAGACTACAGAGCACCTTGAAAAGAATAGGTGTCAATGGCATTCCTGGTATTGAAGAAGTCAACATTTCAAGGAGGA
TGTTGTTATCCAATTCATTAATCCCAAAGTTCAAGCATCTATTGGTGGAAACACATGGGTTGGTAGTGGTTCCCCCCAG
ACAAAGAAATTGGAGGATATCCTTCCTCAAATTATTCACCAATTGGGTCCTGGTAATTTGGAGAATTT > SEQ ID NO:3650 57702 226907_301006_1
ATTTTGCTGGAGAATAGTCGGATGCAGGAGGCGAAAAAAGATTCGATCTTTGGAGGCCTTGGCTCTGGGGCGCCCGTCG
GAGCGGATCGCTTCCCGTTTGATCCTCGGGAGTATTCGCCGGCGATGAGCTCCGACTCCAGGGAGCTGCTCGGGATCGA
TCCCCCGGAGCTCATCTTCCCCTTCGAATTAAAGAAGCAAATCTCGTGTTCTCTGCACCTAACAAACAAGACAGATGAA
TATGTCACGTTTAAGGTTAAGACAACTAGTCCAAAGAAGTACTGCGTCCGTCCAAATAACGGCATTGTGGCTCCCCAGT
CCACATCCAATGTTCTTGTAACAATGCAAGCTCAGCGGGAGGCGCCACCGGACATGCAATGCAAGGACAAATTCCTTGT
GCAGAGTGCCATAGTGACACAAGAGCTCACACCGAAGGATATCACCGGAGACATGTTTACGAAAGAATCAGGTAATGTG
GTGGATGAGGTGAAGTTAAAGGTTGTTTATACTCAACCTCACCCGACATCTCTCAATGGCGGGTCTGAGGAAGGTCTAG
GAAGCTTGAGTTATCAAGAAGCAACAAAAGGATCTAGAGAATCAGAAACAGTAACCTCTGAGCCATTGG > SEQ ID NO:3651 57708 159311_200023_1
GTTCTTTATCACAGAGTAGAGAAAACAAAAATGACGGAGGCAATGATTAGGAAAAAAGCCGGTATGGCTAGTGTGAAAG
ACATGCCGTTGTTGCAAGACGGTCCACCACCGGGCGGTTTGCACCGGTTCGATTCGCTCGTCGGATCCCTAACACCGG
TCCAAGTGCTTTGGCCATTTTCCTCACTGCTTTTGGTGCTTTCTCTTGGGGTATGTACCAAGTCGGCGTTGGAAATAAG
AAGCGTAGGGTAATAAAGGAAGAAAAGTATGCTGCTCGAAGGGCTATCTTGCCCATGCTTCAAGCTGAAGAGGATGAAA
GATTCGTTAAAGAGTGGAAGAAGTATCTTGAAGAAGAGGCTAGAATCATGAAGGATGTTCCCGGTTGGAAAGTTGGTGA
AAGTGTTTACAACTCTGGAAAATGGATGCCTCCAGCAACCGGAGAGCTTCGTCCTGATGTCTGGTAATATGTTGGCA > SEQ ID NO:3652 57708 53221_300395_1
TTTTTTTTTTGAGGGAAAAAaacAGAAAATGTtccTCAGTAccGTAcCaGCAATACATGAACTGTGTATGTATCAATTC
TCTTATTATACGATGGAAAAAGAGAGACAAGAAACATCAAGGTTCTAAAATGCTTAAACAAACATTCATTCATCATCAT
CAAAAGGAGCCATTGATAATTTACCAGACATCAGGACGAAGCTCTCCAGTAGCTGGAGGCATCCAACGACCAGAATTGT
ACACGTTTTCACCGACTTTCCATCCAGGAACATCCTTCATCACATCCGCCTCGTATTCTAGATACTTCTTCCACTCAGA
CACAAACCTTTCATCTTCTTCAGCTTGAAGAATTGGTAGAATCGCTCTACGAGCAGCGTATTTCTCTTCCTTCAACGCC

FIG. 2 continued

```
CTGCGGATTTTGTTGCCCTGACCGACTTGGTACATCCCCCAAGCAAAAGCACCTGAAACGGTAAGGAAAATAGCCATGG
CGCTTGGACCCGTGTTGGAGATCCGGCGAGCATATCGGACCGGTGCGAATCCACCCGGTGGTGGACCATCCTGAAGCAA
CGGCATATCCTTCACACTCGCCATTCCTGGCTTCTTCCTTATCATCGCCTCCGTCATCTTCTTCCTCGATCGATCACAA
TCCCAAATCGATCGGACGCGTGGG

> SEQ ID NO:3653   57708    8628_300308_1
tgtgtatgtatcaatTCTCTTATTATACGATGGAAAAAGAGAGACAAGAAACATCAAGGTTCTAAAATGCTTAAACAAA
CATTCATTCATCATCATCAAAAGGAGCCATTGATAATTTACCAGACATCAGGACGAAGCTCTCCAGTAGCTGGAGGCAT
CCAACGACCAGAATTGTACACGTTTTCACCGACTTTCCATCCAGGAACATCCTTCATCACATCCGCCTCGTATTCTaaT
ACTTCTTCCACTCagACACAAACCTTTCATCTTCTTCAGCTTGAAGAATTGgTagaATCGCTCtAcgagcAgCGTATTT
ctcttccttCAACGCCCTGCGGATTTTgttgccCTGaccgaCttggtacatccCCCaagCAaAagcacctgaaAc > SEQ ID NO:3654   6025     254827_301639_1
ACGCGTCGGGTGTCAACAAGCTTCTGCGCACCTTGTCTCCTTCGATCACCCTCAAGGTAGGAGATAAAACATGGCGATG
GCAATGGGTATGAAGCCCGGAAAGCCTGGCCTCGAGGAGCCTCAAGAAGCCCTCCATCGCATCCGTATCACCCTTTCTT
CCAAGAGTGTCAAAAACCTCGAAAAAGTGTGTGCGGATTTGGTTCGAGGTGCCAAAGAAAAAAAGTTGAAGGTCAAGGG
GCCTGTTAGAATGCCCACAAAGGTGTTGCGCCACACCACCAGGAAGTCCCCTTGTGGAGAAGGTACCAACACGTGGGAT
TGTTTTGAGCTGAGGATACACAAGAGAATCATTGATTTGCACAGCTCTTCAGAAGTTGTGAAGCAGATCACCTCGATTA
CAATCGAGCCTGGAGTCGAGGTGGAAGTGACAATTGCAGATGTCTGAGTGTAGTCAATTATTTCTTTTCGACCGGGAAA
AGGTTATTGACTTGGTTGAAGAGGGATGACTGGTCTTTCAATTTTAGGTTATGTTTCTCCTTACGAATATTTGTTAGGA
TTTTTGACATTTAATCCTGTGTTAACGGAGAATTGAGCTGGATAGTATT > SEQ ID NO:3655   6025     264942_301439_1
GGCGCATTTtttgcGGTTCCAATAGATACTTCTTGTAAAGTTCCAATCTCTTATTTCTTGTTTCAGAATATACATGCTTT
CGCTCACATCTCTTACCACAGTAAGTACTTGTAGTTAAGGTACCACAACACACACAAGAGAAAGTAGCCATTCTAGACC
TAGGACCAGGGTTAGATTCCACGTCACCCGCCAACTTCAGCAAATCAAAATTCAACAGCTGTTTGTAGAGCTCGGCATA
ATCCGGAACATCATACGGATAAGCGGCCACCACATCAGCTCACCTCGACCTCGACACCAGGCTCGATGGTGATG
GAGGTGATCTGCTTCACAACATCTGGGGAGCTGATGAGATCGATCACCCGCTTGTGGATGCGGAACTCGAAACGATCCC
ATGTGTTTGTTCCTTCACCGCACGGCGACTTGCGGGTGGTGATGTGGAGCACCTTGGTGGGGATCCTGACGGGGCCCTT
GACGCGCAGCTGCTTGTCCTTGGCGCCCTTCACCAGATCAGCGCAAACCTTCTCGAGGTTCTTGACGTTCTTGGAGGAG
AGGGTGATGCGGATGCGATTGAGCTGCAGCTCCCGCGCCTCCTCCATGCCGAGCTTCCCGCCCTTCATCGCGCCGCCGG
CGCCGTACACCGCAGCCGCCGCCATGCTTAATTAATGCGAAGGTAAATACAGTAGATTTAAACATCAGGACCTAGAGTT
CACCACTCGAAGTCTTTTCTCAGCTTCTTATCCACAAATTTCCCTTCACAATTAAACAGCAACTTAAACTTATTAAAGT
CAAAGATATGATAACATAAAGAAACCAAAGCAGAAATAGCACTATAAGGGGATCGATATCTATCCACTAAAGCCTTATC
CAAAGCATCAAGCACCTTAAAGTCTTTGTAAGATTTGTAattGTCATTGATAGAGATATAAATCTCACTCAAAACTTCT
ACATCTCTCACATCAGTTCTACCTAATTTgtga > SEQ ID NO:3656   6025     284322_200097_1
GAAGCTGCGGCTACGTCTTTTACATCTTCGTCGCATCTCCCTCAGCAAATCAAATCAAATCAAAATATGGCGTATGCAG
CAATGAAGGCAACAAAACCAGGGCTAGAGGAGCCCCAGGAGCAGATTCACAAGATTAGAATCACTCTTTCTTCCAAAAA
CGTTAAGAATCTTGAGAAAGTGTGTGCTGATCTGGTTCGTGGTGCCAAGGACAAGAGGCTCAGGGTAAAAGGACCTGTG
CGAATGCCCACTAAGGTTCTCAACATTACCACTAGAAAGTCTCCCTGTGGAGAAGGCACAAATACATGGGACAGGTTTG
AGCTGCGGGTGCACAAACGTGTGATTGACCTTTTCAGTTCCGCAGATGTTGTCAAGCAGATCACCTCAATCACCATTGA
ACCGGGTGTTGAGGTTGAGGTCACCATTGCTGATTCTTAGATTCTTCTCTGTTTTCATTAGGTTGTTGAATTTTTTCA
AGTACTAGTGGTTTGCAGTTGCTTTCTTGGCCGTCTAAATTATGGGCTTAAGGTTTTCTTTATTCCAATTAAAGTTTTG
CAGCTAAACCAGATACTAATACTATTTGATATTGGGAAGAGGATTTGTCCGttaaaa > SEQ ID NO:3657   6025     280739_200068_1
ggGTGAAGCGGCAGCAGTTTTCAGTCTCAGTTGCATAATTCTGAGCTTCTTCTCTCCACTCTCTGAAAGATGGCAGCAT
ATGCAGCAATGAAGCCGACCAAGCCAGGTCTAGAGGAGCCACAGGAGCAGATTCACAAGATTAGGATCACTCTTTCCTC
CAAAAATGTTAAGAATCTCGAGAAAGTGTGTGCTGATTTGGTTCGTGGTGCCAAGGATAAGAGGCTCAGGGTGAAGGGA
CCCGTGAGGATGCCCACAAAGGTCCTTAACATTACCACTAGAAAGTCTCCTTGTGGAAGGTACAAATACATGGGACA
GATTCGAGCTGCGTGCCACAAGCGAGTCATTGACCTTTTCAGCTCTGCAGATGTTGTCAAACAAATCACCTCAATCAC
CATTGAACCTGGTGTTGAGGTTGAGGTCACTATTGCTGATTCTTAGATCCTTTGTCTTACCTAGGTAGATGAGTTACTC
TTTATATGCTGTCGTATTTTGCCCTCCAGACTTTATGTATTACGAGTTTTTTGGAATTACAATTTTGCTGTTAAACTAA
GACTTTTGATAAAAGTAAAGTGTATGGTTTGTTTATTT
```

FIG. 2 continued

> SEQ ID NO:3658  6025    1099380_301549_1
ttgcGGGTGTCAACAAGCTTCTGCGCACCTTGTCTCCTTCGATCACCCTCAAGGTAGGAGATAAAACATGGCGATGGCA
ATGGGTATGAAGCCCGGAAAGCCTGGCCTCGAGGAGCCTCAAGAAGCCCTCCATCGCATCCGTATCACCCTTTCTTCCA
AGAGTGTCAAAAACCTCGAAAAAGTGTGTGCGGATTTGGTTCGAGGTGCCAAAGAAAAAAAGTTGAAGGTCAAGGGGCC
TGTTAGAATGCCCACAAAGGTGTTGCGCCACACCACCAGGAAGTCCCCTTGTGGAGAAGGTACCAACACGTGGGATTGT
TTTGAGCTGAGGATACACAAGAGAATCATTGATTTGCACAGCTCTTCAGAAGTTGTGAAGCAGATCACCTCGATTACAA
TCGAGCCTGGAGTCGAGGTGGAAGTGACAATTGCAGATGTCTGAGTGTAGTCAATTATTTCTTTTTGACCGGGAAAAGG
TTATTGACTTGGTTGAAGAGGGATGACTGGTCTTTCAATTTTAGGTTATGTTTCTCCTTACGAATATTTGTTAGGATTT
TTGACATTTAATCCTGTGTTAACGGAGAATTGAGCTGGATAGTATTTTGgaat > SEQ ID NO:3659  6025    1123650_301914_1
GAGGGCAGGGAGAGAGAGAGAGAGAGAGAGAGAGAGAGAGATAAGATGTCAATGGCAATGGCTATCAAGCCTGGTAAGGCT
GTTCTAGAGGAGTCTCAGGAGGCTCTTCACCGAATCCGAATTACCCTGTCCTCCACAAGTGTCAAAAACCTCGAGAAAG
TATGTGCCGATTCGGTTCGTGGTGCTAATGAAAAAAGGTTGAAAGTAAAGGGGCCTGTCCGTATGCCCACCAAGGTCTT
GCGCCACACT > SEQ ID NO:3660  6025    116648_300079_1
CCCTAACGCCACCCGCGCCGCCATCCCCGAGCACCACCAACCCCACCCCCCGAGCGAGCGGAGCGGAGAACGCGAGGCG
AGGCGAAGCAAACATGGCGGCGGCTGCGGTGTACGGCGCCGGCGGCGCGATGAAGGGCGGGAAGCTCGGCATGGAGGAG
GCGCGGGAGCTGCAGCTCAATCGCATCCGCATCACCCTCTCCTCCAAGAACGTCAAGAACCTCGAGAAGGTTTGCGCTG
ATCTGGTGAAGGGCGCCAAGGACAAGCAGCTGCGCGTCAAGGGCCCCGTCAGGATCCCCACCAAGGTGCTCCACATCAC
CACCCGCAAGTCGCCGTGCGGTGAAGGAACAAACACATGGGATGCGTTTCGAGTTCCGCATCCACAAGCGGGTGATCGAT
CTCATCAGCTCCCCAGATGTTGTGAAGCAGATCACCTCCATCACCATCGAGCCTGGTGTCGAGGTCGAGGTGACGATCG
CTGATGTGTAATGCTGCCAAACTAGCACTACCTTAGACCTACCTGTCTTGTTTCTCTGCTGCTTAGAATCTCGGTTCCG
ATTGCCATGCGTGTAACGGACATCCAACTGGTTTAGTGTATCTGGGTCTTTTATATGTGCGCGGATGCTATGGATCTTT
CTCATGTAAGAGGTGTGTAACTCGCCAGTTTTGCTTCAACCACATGAAATTTGGTATTGGATTCAATTTTTGTC > SEQ ID NO:3661  6025    223749_300975_1
AAAATGTCATTCAACAAGGATAAGGCCGACGCTGAAGCTCCCCAGCAGCTCCGAAAGATCAGAATCACTCTGACTTCCA
CCAAGATGAAGTCTCTTGAGAACGTCTCCGCTGACATCATCTCTCGAGCTAAGAACTCCAACGTTGGCGTCAAGGGCCC
CGTCCGACTCCCCACCAAGGTTCTTAACATCACCACCCGAAAGACCCCTAACGGTGAGGGTTCCAAGACCTGGGATCAC
TTTGAGATGCGAATCCACAAGCGACTCATCGATCTCCACTCCCTGCTGAGGTTGTCAAGAAGATCACCTCTATCAACA
TCGAGCCTGGTGTGGATGTTGAGGTCACCATTGCCGCTTAAGCTTGTTGACCCCAAAACTT > SEQ ID NO:3662  6025    195447_300634_1
CTTTCCCGGCCTCATCACTTTGCCGATACGAAGATCGTCCCCTTTCAATCCAATTATAACGATCCGTTCGAGTCGTGAA
GCCGTTCAAAATGTCTTACCAGAAGAACGACAAGGATGTTCAGGAGCCGGCTAAAAGCCACAAGATCCGCATCACCCTT
TCTTCTCGCAAGGTCCAGGTCCTCGAGAAGGTCTGCTCCGAGATCATCGACCGTGCCAAGAACAAGGACCTCCGCGCCA
AGGGCCCTGTCCGTCTGCCTACCAAGTGCCTGACCGTCACTCCCCGCAAGACCCCTTGCGGTGAGGGTTCCAAGACCTG
GGACCGCTTCGAGATGCGCATTCACAAGCGTCTCATCGACCTCCACGCCCCACTGAGGTCGTCAAGCAGATCATTGTC
AACATCGACGCTGGTGTCGAGGTTGAGGTCACCATCGCTGCTTAAGCGAATCTCCAATTTCGTAAAGATGTTGGAGTGG
CCGAGACCCTGACGTCGAGGGAGATGAAAACAGCCCTCGCAGCAGATAAGCACAAAATAAACTGGTTCAAGACATA > SEQ ID NO:3663  6153    103558_300363_1
TGGTATCAACGCAGAGTGGCCATTCTGCATTGTCTACATGCATAGTACTGTCCAGAAGGAGGATAACAACCCCGGATTA
ACCATCTTGAGGTGGATCTACGAAGAGCTTCCTTCTGACCATAAGGACAGGCTTCAGGTTGTATACTTTGTGCATCCTG
GGATACGGTCAAGGCTTGTTCTTGCAACACTAGGCAGATTTTTCCTGAGTGGAGGCTTGTATTGGAAAATAAAGTATGT
CAGTCGCCTGCAATATCTTTGGGATGACATAAAGAAAGGAGAGCTCCAGATTCCTGAATTTGTTCAAAAGCATGATGAC
ATTCTAGAGCACAGGCCACTGACTGATTATGGAATTGAACCAGATCCCCTCCACTTATCGCAGATGCCACCTACAGCCT
ACTCGTTTGGGAGACATGACTCGGGATGGTCATCTAGAGAGTACATGTCTTAGAAAAGCTGCTAGATTCTGTACAGCAT
TGTACTTATGTTCCAATTCTAAGAGTCTTTACTTATGTACTAAACTTTCTTCTGCTTGTCTCTGCTCACTTTTGTGTTA
CCATAAACCAGTACTGCATAAGTGATCTTTGTCAGAGAAAGAAAGGGAAGGAAACCCCTACTCTCTTCG > SEQ ID NO:3664  6153    144441_200135_1
gtTTTGCAAGTTATCCGAAATTCGATAACCATGTTTTCAGAAGTTGAACAAGAACAGCTTATTGAGAAACTTGAAATCT
TCAAAATCCAAGGCAGGATAAACGTGGCCGGAAAACCTTGCGCATCATCGGCAAATTCTTTCCTGCTAGGAATCTGAG
CGTTGAAGTGGTGAAGAAGTATTTAGCGGAGAAGATCTTTCCAGAACTTGAGAAACGGCCGTTTGCCGTGGTGTATGTT
CACACCGATGTGGAAAAAAGCGAGAACTTTCCTGGAGTATCAGCTTTACGATCCTTCTACGATGCGATTCCGGTGAAAG
TCCGAGATAATCTGGAGGCTGTTTATTTTCTTCACCCTGGCCTTCAAGCTAGGCTCTTCCTTGCCACTTTTGGTCGCTT

FIG. 2 continued

```
CATCTTCAGCGGAGGGTTGTATGGGAAATTGAGGTATGTGAACAGGGTGGATTATCTGTGGGAACATGTAAGGAGGAAT
GAGATTGAGATGCCAGAATTCGTGCTTGATCATGATGAAGATCTTGAGTACCGTCCGATGATGGATTATGGTTTGGAAA
GTGATCATGCGAGgGTCTATGGTGCGCCCGCAGTggaCtCTCcTGTGTccATGTACTccATGAGaTGCATCTCATaggC
GaaTCggAcggccTtTGCACTctTTTTgttccaTaGattaaATATGTAgaaacctTTTg > SEQ ID NO:3665  6153    25024_300072_1
AGAAACGATGAGTTCTCAGATTTCGGAGATTGAACAAGAGCAGCTGATCGAGAAGCTTGAGATCTTCAAGATCCATGGC
AGAGACAAACGTGGCCGTAAGATCCTTCGTATTATCGGAAAATTCTTCCCAGCTCGATTTCTGTCACTGGATGTGTTGA
AGAAGTATCTAGAGGAGAAGATATTTCCTCGATTAGGTAGAAAACCATTCGCCGTACTCTACGTCCACACCGGCGTACA
GAGAAGCGAGAACTTCCCAGGTATCTCAGCTCTACGAGCGATCTACGACGCAATTCCGGTAAACGTCAGAGACAATCTT
CAGGAGGTTTACTTCCTCCATCCAGGTCTTCAATCACGTCTCTTCCTCGCCACCTGCGGCCGATTTCTATTTTCCGGCG
GGTTGTACGGGAAGCTGAGGTACATAAGCAGAGTTGATTATCTGTGGGAACATGTGAGGAGGAATGAGATAGAGATGCC
GGAGTTTGTATACGATCACGATGATGATCTGGAGTATCGTCCGATGATGGATTACGGTCAAGAAAGCGATCACGCGAGG
GTTTTCGCCGGAGCCGCCGTGGATTCATCAGTCTCAAGTTTCTCCATGAGGTGTATCTCATAGCGTAAAAGGCTAAAAC
TCCACCCACTAGATATCGGATCGTATCTTATAAACCATATAATATACGAATACGATTAATAATATATCAAAAAGATTGG
AAATAGGTGTGCTTTTTGAAATTAGTGAGCGTTTTTTATGGAAAAGAAAAGAAAAGAAAGCAGTTGGCGTCTGGATAAA
GGGAAGGAGGAGAATCTTTAGATTTTTTCTTTAATCTGTTTTTCTTTTGTCTTGATTAGTTTTTTCTTTAGTGGTGGTG
GTTGTGAGTTAGTGTGTAAAATGTATATTGTCATATGTGAATTTAATAATAAGTCCTTTTGTaagatgatc > SEQ ID NO:3666  6153    6181_300329_1
CCCACGCGTCCGTCATCTTCTTCTTCACTCGCCTCAATTTTTGTTCCCTTCTTCTTCTATAATTCAACTGTGAATTTCA
CCGACGAAACAAAAAAGAGAGAGAGAGAGAGAGAAACGATGAGTTCTCAGATTTCGGAGATTGAACAAGAGCAGCTGAT
CGAGAAGCTTGAGATCTTCAAGATCCATGGCAGAGACAAACGTGGCCGTAAGATCCTTCGTATTATCGGAAAATTCTTC
CCAGCTCGATTTCTGTCACTGGATGTGTTGAAGAAGTATCTAGAGGAGAAGATATTTCCTCGATTAGGTAGAAAACCAT
TCGCCGTACTCTACGTCCACACCGGCGTACAGAGAAGCGAGAACTTCCCAGGTATCTCAGCTCTACGAGCGATCTACGA
CGCAaTTccggTaAACGTCAGagaCAATCTtc > SEQ ID NO:3667  6198    5960_300315_1
CCCACGCGTCCGCGTTTCCTAAGATCAAGAAGCCTTGTCCCCCAATTTACAAACCACCGGTGGTGATCCCTAAGAAGCC
GTGTCCACCAAAGATTGCACATAAACCCATCTACAAGCCGCCGGTTCCCATCTACAAGCCTCCAGTGCCTATCTACAAG
CCACCAGTGGTTATCCCCAAGAAACCGTGTCCACCAAAGATACACAAGCCCATCTACAAGCCACCCGTGCCTATCTACA
AGCCTCCAGTGGTGATCCCAAAGAAGACATTTcctccACTTCACAAGCCGATCTACAAGCACCCGgttcCTATCTACAA
ACCAATCTTCAAGCCgccAGTGGTGgtgATTccAAAGAAACCATGtccACCACTTccCAAGTTTcCACACTtccCACCT
AAATACATTccACACCCTAAGTTCGGAAAATggcctcctttcccTtctcatccttGAtaaaGATgcaaaaTcctctgtc
tttcttaaTttaagaaaagtgATCGAGTGat > SEQ ID NO:3668  6437    6512_300322_1
cccacgcgtccggagagagagagagagagagaaagaaagatccaacttccACAAAGAACCATGGAAGCTGAGAAAGAAA
CAGAACAAGAAGGAAACTTGACAGTAATGAAACTTCCGGTGTTACCAACTAAACCCAACACTCACAGCCACTCTATGTC
ATCACCAATTCACAGTTCCATATCAGCTTCAGTTCCCTTTAGCTGGGAAGAAGAGCCTGGCAAGCCCAAGCAACACTCT
ACTTCTTCTTCCTCCTCTTCCTCTTCCTCACCATTAACTTCTTATTCTTCATCtccTTTTGAAACTCACAAGTccTTag
agCTACCACCaaggcttcACTTACttGaaAAAGATGgaggaTCAGTAACcaaACTtcACtcgcctAtaacAgtCtTTGA
T > SEQ ID NO:3669  6477    57236_300132_1
AAGCTGCACAAGGCCGTGTCCCGTGTTCCTGGATGGAGGTGTCCGCCGTGGAACAGATGTCTTTAAAGCTTTGGCACT
TGGTGCATCAGGGGTGTTTATTGGGCGACCAGTCGTTTTCTCATTAGCTGCTGAAGGAGAAGCTGGTATCAGAAAAGTA
TTGCAGATGATGCGCGATGAGTTTGAGCTAACTATGGCATTAAGTGGCTGCCGTTCACTGAAAGAGATCACTCGTAACC
ACATTGTGGCCGATTGGGATGCTCCACGAGCTGCTCTTCCCGCGCCAAGTTTATAAAATAAAACCTTAGGTGTCAAATT
GTTTCACCATGACAACGTATTAGTTCCACATGTTTTCAATAGCTTACTTATCTTTCACGGGAACACTCA > SEQ ID NO:3670  6477    105404_300368_1
ggggagtatgctacagcaagagcagcgtcagcagcagggacaatcatgacattgtcaTCTTGGGCCACTTCCAGTGTAG
AGGAGGTTGCTTCAACAGGACCTGGCATCCGTTTCTTCCAGCTTTATGTCTACAAGGACAGGAATGTTGTTGCTCAGCT
TGTGAGAAGAGCTGAAAGAGCAGGTTTCAAGGCTATAGCCCTCACTGTTGATACCCCAAGGCTGGGACGTAGAGAAGCT
GATATTAAGAACAGATTTGTTTTGCCACCATTTTTGACGTTGAAAAACTTTGAAGGATTGGACCTTGGCAAGATGGACC
AAGCAAGTGACTCTGGATTAGCTTCATATGTTGCTGGTCAAATTGATCGCACTCTGAGTTGGAAGGATGTTCAGTGGCT
CCAGACTATCACTTCATTGCCAATCCTGGTAACGGGTGTACTTACGGCTGAGGATGCTAGGCTTGCAGTTCAGGCTGGA
GCAGCTGGTATCATTGTGTCAAACCATGGTGCTCGCCAACTCGATTATGTCCCTTCGACAATCATGGCTCTTGAAGAGG
```

FIG. 2 continued

TTGTGAAAGCTGCACAAGGCCGGATTCCTGTATTCTTGGATGGAGGTGTCCGCCGTGGAACAGATGTCTTCAAAGCTTT
GGCACTTGGAGCTTCAGGCATTTTCATTGGAAGGCCAGTAGTTTTCTCATTAGCTGCTGAAGGAGAAGCTGGAATCAAA
AAAGTGTTGCAAATGTTGCGCGATGAGTTTGAGCTAACTATGGCATTGAGTGGCTGCCGCTCACTGAACGAGATTACCC
GCAACCATATTGTCACTGAGTGGGATGCTCCACGTGCTGCTCTTCCAGCCCCAAGgttgtGAAAATGTACCTTAAGTGT
CAAATTGTTTCATCAAAACAAAGTATTGCTTCACTGTTTCAGaaGCtTATATTTCggttTTGAaTACttgtttCtgttT
aATGAgtTTAcgaaTATgttaaGCTTTtCTCagtaATCgaaAACTGAtaaAttCTaAAAAAAA > SEQ ID NO:3671 6477   128954_300401_1
CCCCCCTTGCCTCCAGTTGCAATGCCATGCGCTTTTATCAGCTATATGTGTATAAGAATAGGAATGTTTCAGCAACATT
AGTACGGCGGGCCGAGAGTTGTGGATTCAAGGCACTTCTTTTGACAGTTGACACTCCTATGCTCGGTCGGCGTGAAGCA
GATATCCGAAACAAAATGGTTTTCCCACGGAGTGGTAATCTCGAAGGTTTAATGACAATAGATGACCATGATACCACAA
ACGGTTCTCAGCTCGAACGATTCGCACGAGCGACGCTGGATCCATCATTATCATGGAAGGATATAGAGTGGCTCAAGTC
CATAACCAGCATGCCGATCTTTCTCAAGGGCATCGTCACCGCTGAGGACGCGAGGAGAGCAGTGGAGGCTGGGGTGGCC
GGCGTGATCGTCTCCAACCACGGCGCGCGGCAGCTGGACTACGCGCCGGCGACCATCGCCGCCCTGGAAGAGGTGGTCA
GGGCGGTGGCCGGCGCCGTGCCGGTGCTGGTCGACGGCGGAATCCGGCGAGGCACTGACGTGTTCAAGGCCCTGGCGCT
CGGCGCACGGGCGGTCATGGTTGGGAGGCCGGTGTTCTTCGGGCTGGCGGCGAGGGGGGAGGCAGG > SEQ ID NO:3672 6477   196285_300770_1
ACAGATGACCACTCCGTGGGAAAACCATTGTGTTTCGGATATCTGCTTCACGCCGATCTTTCTCAAGGGCATCGTCACC
GCTGAGGACGCGAGGAGAGCAGTGGAGGCCGGGGTGGCCGGCGTGATCGTCTCCAACCACGGCGCGCGGCAGCTGGACT
ACGCGCCGGCGACCATCGCCGCCCTGGAAGAGGTGGTCAGGGCGGTGGCCGGCGCCGTGCCGGTGCTGGTCGACGGCGG
AATCCGGCGAGGCACTGACGTGTTCAAGGCCCTGGCGCTCGGCGCACGGGCGGTCATGGTTGGGAGGCCGGTGTTCTTC
GGGCTGGCGGCGAGGGGGGAGGCAGGCGCGAGGCACGTGATCGAGATGCTCAACGGCGAGCTGGAGGTGGCCATGGCGC
TCTGCGGCTGCCGGAGCGTCGGCGAGATCACCCGCAGCCATGTCATGACCGAGGGTGACAGGATCAGGTCCCTGCTCTG
ATGAATCATTTCTCATCTGGCCAATGCAGCTTCAGGTCTAAAAATACAAGTGGGCTATGGGCCAACCCGTAAACCGATT
TATAGGTAATAAAATTTGACCGACCCGTGAATCTATTTATATGTAAA > SEQ ID NO:3673 6477   201155_300713_1
tggcttcttacgtcgccgggcaaatcgatcgcaccctgagctggaaggatgtgaagtggctgcagaccatcaccacgct
gCCGATCCTGGTGAAGGGAGTGATCACTGCAGAAGACACGAGGCTCGCCGTGGAGAACGGCGCGGCCGGCATCATCGTG
TCCAACCACGGCGCCCGCCAGCTGGACTACGTCCCGGCCACCATCAGCGCCCTCGAGGAGGTTGTGAAGGCGGCTCGCG
GGCAGCTCCCCGTCTTCCTCGACGGCGGCGTCCGCCGCGGCACCGACGTCTTCAAGGCGCTCGCCCTCGGCGCCGCCGG
CGTCTTCATCGGGAGGCCGGTGGTGTTCTCGCTGGCGGCGGCGGGGGAGGCCGGAGTCCGGAACGTGCTGCAGATGCTC
CGCGACGAGTTCGAGCTCACCATGGCGCTCAGCGGCTGCACCTCCCTCGCCGACATCACCCGCAACCACGTCATCACCG
AGGCCGACAAGCTCGGCGTCATGCCCGTCTCGCTTGTAAACAACAACGACGGCGAACTTGTCGCCGTCGATCGATCACCG
GCCGGCCGCCGCGACACGCTTTGCCGGCCGACGGATGATCGGCCGGGAATGAAGAAGAAGGTAGTAGCTgCCgAAGAAA
AGATTGGAAGATGCAAAGTTCTATAATTTTGGATGATGCTGCGTCATGTACTTTTGTTaATTgTcGAGtGAttGATCAC
CTGTAcCTAATTAAATGGTtTATTGGATTATTGgcggttttataCTAAACGaaCaAATTAaTAccT > SEQ ID NO:3674 6477   184286_300666_1
gaattcaagtgccatgcaAAAAATGGCTCACCCTGAAGGAGAGTATGCAACAGCAAGGGCAGCATCTGCAGCTAACACC
ATTATGACATTATCATCATGGGCTACTTCCAGTGTTGAAGAAGTTGCTTCAACAGGACCAGGGATTCGTTTTTTCCAAC
TCTATGTGTACAAGGACAGAAAAGTTGTTGAGCAGTTGGTTAGAAGAGCGGAACGAGCCGGCTTCAAGGCAATTGCTCT
CACTGTTGACACCCCAAGACTTGGGCGTAGGGAAGCTGACATTAAGAACAGATTCACTTTACCACCATTTTTGACTTTG
AAGAATTTTGAGGGATTGGACCTTGGACAGATGGAAAAGTCAAGTGACTCTGGACTTGCGTCATACAGTTGCTGGTCAAA
TTGATCGAACTCTAAGCTGGAAGGATGTGCAATGGCTTCAGACAATTACGAAGATGCCAATTCTAGTGAAGGGTGTTGT
TACTGCTGAGGATACTAGGTTAGCTATACAAGCAGGAGCAGCAGGTATCATCGTGTCCAACCATGGAGCTCGTCAGCTT
GACTATGCACCAGCCACCATCAGTTGTCTTGAGGAGGTCGTGAAAGCTGCACAGGGCCGAGTCCCCGTATTCCTTGATG
GTGGGGTTCGTCGTGGAACAGATGTTTTCAAAGCATTAGCtctAGgAGCTGCTGGCATATTTATTGGAAGaCcagttgt
gttCTCATTGGCTGCTGAaggtgaggctGgTGTAaaAAaggtactccagaTGCTtcgcGATGAATTTGAGTTGAcaaTG
GCCCTAAGtgGaTGCcgctcaCtcaa

FIG. 2 continued

> SEQ ID NO:3675 6477    116464_300068_1
ATTCGTTTCTTCCAGCTTTATGTTTACAAAGACAGGAGGGTGGTGGAGCAGCTTGTTAGGAGAGCTGAAAGGGCTGGAT
TCAAGGCGATTGCGCTTACGGTGGATACTCCGCGACTTGGCCGTAGGGAGGCTGACATCAAGAACAGGTTTGTTCTGCC
ACCATTTTTGACACTGAAGAACTTTGAAGGCCTGGAGCTGGGGAAAATGGACCAGGCTAGCGATTCAGGACTGGCTTCT
TACGTCGCCGGGCAAATCGATCGCACCCTGAGCTGGAAGGATGTGAAGTGGCTGCAGACCATCACCACGCTGCCGATCC
TGGTGAAGGGAGTGATCACTGCAGAAGACACGAGGCTCGCCGTGGAGAACGGCGCGGCCGGCATCATCGTGTCCAACCA
CGGCGCCCGCCAGCTGGACTACGTCCCGGCCACCATCAGCGCCCTCGAGGAGGTTGTGAAGGCGGCTCGCGGGCAGCTC
CCCGTCTTCCTCGACGGCGGCGTCCGCCGCGGCACCGACGTCTTCAAGGCGCTCGCCCTCGGCGCCGCCGGCGTCTTCA
TCGGGAGGCCGGTGGTGTTCTCGCTGGCGGTGGCGGGGG

> SEQ ID NO:3676 6606    156903_301733_1
accctttcaATCCTTTAATTTCTCATTTTGGCCCAACTCCCAAAAACCCCCACCGTCGCACCCCTCCGTTATTCCGCTGC
CTCCGCCACACCAGAAACCACCACCACGACCGCCACAGCATTCCACGGCCTTTGCTACGTCGTAGGGGACAACATCGAC
ACTGACCAAATCATCCCCGCAGAATACCTAACCCTAGTCCCGTCAAACCCAGACGAGTACAAAAAACTCGGGTCCTACG
CGCTGTGCGGACTCCCTTCATCGTACCAAACCCGTTTCGTCGACCCGGATGAATTCACATCCAAGTACTCCATCATTAT
AGGCGGCGACAACTTCGGGTGCGGGTCGTCGCGGGAGCACGCGCCGGTTGCTTTAGGAGCTGCGGGCGTGGCGGCGGTG
GTGGCGGAATCGTACGCGAGGATATTCTTTAGGAACTCGGTTGCGACTGGCGAAGTTTATCCGCTTGAATCGGAAGTGA
GGATTTGTGAGGAGTGTAAGACGGGTGATGTGGTGACTGTTGAACTAGGAGAGAGTAGGTTGATTAATCATACGACTGG
GAAAGAGTATAAATTGAAGCCAATTGGTGATGCTGGTCCTGTCATTGAAGCTGGTGGCATTTTTGCTTATGCAagacag
gCTggaATGAtTCCTTCCCGagaTGCTTAGttttcaaagtggtaattgattcggttcacATATtttctctt > SEQ ID NO:3677 6606    191135_300739_1
CCCCACACACTGAACACCATGGCGGCGGCGGCGGCGGCTCCGGCTCTATCCTTGGCCGAGGCGGCGCCGGTGACAGCAG
TTCTGGCACCGTGTCCCACGCCCTCGAGGACGTTCCGCCGCCGCAGCTGGGTCGCGGCTATCTGCCGGCCCGCCCTGAA
ATGCCACCACAGTCGTCCCCTGACCGCCGTGGTCGCCGCGGCTGCGGCTGCCGCTGCGGCGGGGGACTCGACGTCGGCC
GGCGTATTCCACGGCGAGTGCTTCGTCGTGGGGGATAACATCGACACCGACCAGATCATCCCCGGCCGAGCACCTGACCC
TGGTCCCGTCCAAGCCCGACGAGTACCGCAAGCTCGGCTCGTTCGCCTTCGTCGGCCTCCCCACCGCGGCCTACCCGAC
GCCGTTCGTCGCCCCCGGCGAGGAGACCACCCGCTACGCCGTCATCATCGGCGGCGCCAACTTCGGCTGCGGCTCCTCC
CGCGAGCACGCGCCCGTCGCCCTGGGCGCCGCCGGCGCCCGCGCCGTCGTGGCCGAGGGCTACGCGCGCATCTTCTTCC
GCAACTCCGTGGCCACCGGTGAGG > SEQ ID NO:3678 6606    25112_300074_1
CCCACGCGTCCGTTTATCCTTTGGATTCTGATACTAGGGTTTGGGATGAGTGTACATCTGGTGATGTTTCAACTGTTGA
CTTGACGGAAGGAGATAGTTTTTTGATCAATCATACCACTGGGAAAGAGTTCAAACTTAAGCCGATTGGTGATGCTTGA
CCAGTGATTGATGCTGGTGGTATATTTGCTTATGCTACGAAAGCT > SEQ ID NO:3679 6681    120571_300411_1
TGGAAAATCCGGTGCAGTTCTGACGCTCTCGTGTTAACTCTGCTCCGAAATGTCTGCATATGATAATGTGGTTGGCGGG
AAGTTGAAACTAAAGGGAAAGGCATTGGATGTAAAAGCCGCTGGAATAAAGAAAAAGAAAAGGAAAGAAAAGAAGGATT
ATGATCAAATCTCCCAAGTTACAGGAAAGGAGCTTTCAACAGATGGTGGTAGTGGATCTTTAGATGATCCCACCAAGGA
AGAGAGCACAGATGCCACTAAATCTGTTGGTGAAGAAAATGCTGGTCGCTGGGATGATAATCTAACCCCTGCAGAGAGG
CGCTACATAGAACAAAGGGAGAGGATTGACATGCATAAGATGGCCAAGACTGCTAATAAATCACATCGTGACCGAATCG
AAGATTTCAATCAGTACTTGGCAAACATGAGCGAGCACTATGACATTCCCAAAGTCGGTCCTGGTTAATTAAGAACAAA
TCAGAAATTTGCTCCATCTCTATATCTTGTTTATGGTTGTTTTGTTTTAGCATATTTAATAGCTACTTTTTTGCAATTT
GTATTATGTAATTTAGCAGTTTCCTTTGCTAGATGGTGAAGGGGAGCCTTGGAGTAATGGTAAA > SEQ ID NO:3680 6681    128928_300401_1
CCCCAACCCTCGCTTCTCGGGGACGCGGAGCGGCCAGCCGGCCACCTTCCACTGCCTCGAGCTCCTCTCCTTCTCCGGG
TTGGTGTGGCGTGGAGATCCATCCTGGCCGACCTCTTTCGCTAGGCGAGATGTCTGAGTACCAGAACGTCGTTGGGGGT
AGGCTCAAGCTGAAGGGGAAGGCGCTGGATGTGAAGGAAGGGGAGTCAAGAAGAAGAAGAAGAAGAAGCAGCACCACG
AGGAGTCATCTGAAGCCGGGCACGGAGAGCTTCACCAAGGTGGAAGCTCTGAAGTACCAGCTGACCCTAATGATGAATT
GACTGAAGCTGATAAGATGGGAGAAGGGAACCTGCAAGGCGACTATGATCACCTCACCCCAGCTGAGAGGCGTTAC
ATGGAGCAGAAGCAGAAGATTGACATGCATAAGCTAGCCAAAGTAGCCAACAAGTCACACAGGGACCGCTCCAGGACT
TCAACCAATACCTGGCAAATCTTAGCGAGCACTACGACATCCCAAAAGTTGGCCCTGGTTAACTTTGCCTATTCAGAGC
TTCGCAGGAATGCTTCCTATGCTGTACCCATCCAGCCATCTGTTAGCTTGTGATGCTCCTACCTGTATT

FIG. 2 continued

> SEQ ID NO:3681  6681    193761_300742_1
CCCCCGAACCCTCGCTTCTCGGGGACGCGGAGCGGCCAGCCGGCCACCTTCCACTGCCTCGAGCTCCTCTCCTTCTCCG
GGTTGGTGTGGCGTGGAGATCCATCCTGGCCGACCTCTTTCGCTAGGCGAGATGTCTGAGTACCAGAACGTCGTTGGGG
GTAGGCTCAAGCTGAAGGGGAAGGCGCTGGATGTGAAGGAAGGGGGAGTCAATAAGAAGAAAAAGAAGAAGCAGCACCG
CGAGGAGTCATCTGAAGCCGGGCACGGAGAGCTTCACCAAGGTGGAAGCTCTGAAGTACCAGCTGACCCTAATGATGAA
TTGACTGAAGCTGATAAGATGGGAGAAGAAGGAAACCTGCAAGGCGACTATGATCACCTCACCCCAGCTGAGAGGCGTT
ACATGGAGCAGAAGCAGAAGATTGACATGCATAAGCTAGCCAAAGTAGCCAACAAGTCACACAGGGACCGCATCCAGGA
CTTCAACCAATACCTGGCAAATCTTAGCGAGCACTACGACATCCCAAAAGTTGGCCCTGGTTAACTTTGCCTATTCAGA
GCTTCGCAGGAATGCTTCCTATGCTGTACCCATCCAGCCATCTGTTAGCTTGTGATGCTC

> SEQ ID NO:3682  6682    130728_300490_1
GAATTCAGAACAGGATATCAAAAGAAGAGAAGATGCTGTTACCAGAGCTGGTGTCCCCTCAGATGATAGAAACTGGCCT
CCGTTTTTTCCACTTATTCATCATGATATAGCTAATGAAATACCTATCCATGCTCAAAGGTTGCAGTATCTGGCTTTTG
CAAGTTGGTTAGGTATAGTCTTTTGTCTTGCATTCAATGTTATTGCTGTGACTGTCTGCTGGATTAGAGGGGGAGGTGT
TAAAATATTTTTCCTTGCTATTATCTATGCACTTCTTGGATGCCCTCTTTCATACGTGCTGTGGTACAGGCCACTCTAT
CGCGCGATGAGGACAGATAGTGCCCTGAAATTTAGTTGGTTTTTCCTGTTTTACCTGATGCACATTGGTTTCTGCATTG
TTGCTGCTATTGCCCCTCCGATTGTTTTCCAGGGGAAATCGTTTACGGGTATTCTTTCCGCCATATCAGTCTTCTCTGA
CCATGTGCTGCCTGGGATCTTCTATTTGGTTGGGTTTGGTTTTTTTTGCTTGGAAACACTTCTAAGCTTTTGGGTACTT
CAGAAAGTTTACATGTATTTCAGAGGTAATAAGTGAAGATTTCCTAAGCTCTAGTCAATATTCCAGTTGGTGTTCATGT
TGCAAAAAGCTATCAGTATATTCTTTACTTTCTCTTCGAGACAAGTTATCTATTTCTTGTGATTATGAATGTATTTTGG
GT

> SEQ ID NO:3683  6682    137156_300502_1
cggagcgcacgctagtggagcagctgctgcggggttggccaccgcctccatcgccgtcgccgactcgccgccatcgtc
gTTGCCGTCGTCGCCGTCGGCGGAGTAGGCAGGCGGCCATGGCGGGGAAGCACGGCCGCAACGGCTTCGAGGACGACGA
CGTCAATCCCTTCGCGGGAGGAAGTGTTCCTCCTGCCAACAATTCTCGACTCCCACCTCTCTCCCCATGAGCCAGCTGAT
TTTTACAATGTGGACATTCCTCTTGACTCGTCTAAGGATTTGAAGAAAAAGGAGAAAGAACTCCAGGCAATGGAAGCTG
AACTAAACAAAAGAGAAAGGGAACTGAAAAGGAAGGAAGAGGCTGCAGCCCAAGCTGGCATTGTCATTGAAGATAAAAA
TTGGCCACCCTTTTTCCCTCTCATTCACCATAATATTTCAAATGAGATACCTATTCATCTACAAAGAATGCAGTACCTT
GCATTTCATCGTTTTTGGGATTGGCAGCCTGCCTATTTTGGAATATCATAGCAACCACAACCGCATGGGTAAAAGGGG
AAGGTGTTATTATCTGGTTGCTTGCTATTATCTACTTCATATCTGGTGTACCTGGTGCTTATGTGTTATGGTACCGCCC
TCTTTATAATGCAATGAGAACTGAGAGTGCTTTGAAGTTTGGGTGGTTTTTTCTGTTTTACCTGATTCATATAATCTTC
TGTGTGTGGGCAGCTgtgGCTCCTCCTTTTCCTTTCAAAGGAAAATCTTTGGCTGGGATTTTGCCTGCCATTGATGTCA
TAGGCAAGagtGCTATAGTGGGGATATTTTACTTTGTCGGGTTTGGATTATTCTGCCTTGAGTCACTGCTGaGCATTgg
tgtcATTCAGCAAGTATACATGTACTtccGTGGAAGTGGAAAAGCCgc > SEQ ID NO:3684  6682    245620_301570_1
gcggggaagtccaacaagcaCACGACCCGGATCTGGTCGTGGATTTGGCATTCCCTGGGCCAGCGCCCCAAATGCAGCG
GCTTTTCTAGATCTTGAAAGCGATTCCTTGATCGTCTCCTGCCATGGCGTCGCGCTACGATTCGAATCCATTCGACGAG
GAAGATGTCAATCCCTTCTCGGACCCTGCTGTTCGTGCTCAAATGACGGGGAAGCCATCGTATCTGGGGAACAATTTCT
ATGAATCGCAACCATACAATGTTCCTCAGGTGAACTCGATATCTCCTCTAGCACCGGAGCGGACCTCGGTTGGAGATGC
CACCGTGGAAATTCCCCTGGGCAACATGAAGGATCTGAAGAAACGGGAAAAGGAGTTGAAAGACAAGGAAGAGCAACTC
CGAAAGAGAGAAGCCGAAGTGAAAAGCGAGAGGACGCTGCATCAAGAGCTGGAATCGTGCTCGAAGACAAGAACTGGC
CGCGCTTTCTCCCGATACTGCACCATGACATTGCGAGCGACATCCCGCAGTACTTGCAGCGCATCATGTACTACGCATA
TGGAAGCTGGCTCGGAATTCTCTTATGTTTGACGTGGAATTTTGTTGCCGTCACTGGAGCTTGGATCCAAAAGACTGTC
AGCGCTTCCTATGGTGTGCAGATATGGTTCCTCGCTATTATCTACATTCTTGCGGGCTTTCCGGGGTCCTTCTTCCTCT
GGTACAGACCTCTGTACCGTGCTATGAGGTCAGAGAGCGCGATCAAGTTTggATGGTTTTTCATCGCGTATCTGttcca
CATCCTGtttTGcaTCTTCTgctGTGTCGCTcctccCGTCGtg > SEQ ID NO:3685  6682    286496_200109_1
TCTTCTATTTTTGCTACTATTCAGATCTCATCTTTAAAGCAAAACTCAGAATTGGTTGAAATGGCGGGCCGTTATGATC
GAAACCCTTTTGATGAAGAAGAAGAAGTTAATCCTTTTGCTGGTGGTGGAGGCAGAGGGAAAGCTTCAGGGCAATCAAA
TTTTAGTGGAGGTGCATTTAATATCACATCTGGTAGTGTGCCTCCAGCAACAAACTCCAGGCTTTCACCCCTTCCACCA
GAGCCAGCTGGCTTCTATGACCGCGATGCACCAATTGATATTCCTCTTGATAGTGCTTCGGACTTGAAAAAGAAAGAAA
AAGAATTACAGGCTAAAGAGAGTGAATTGCGACGAAGGGAACAGGAACTAAAAAGGAGAGAAGATGCTGCAGCAAGAGC
TGGCATTGTTATCGAGGAGAAAAATTGGCCTCCGTTCTTCCCAATTATCCATCATGATATTGCAAATGAAATACCAATT
CATCTTCAAAAGCTACAATATGTTGCATTTACAACATTCTTGGGACTTGTTGCATGCCTTTTGTGGAACATCGTAGCTA CCACTACAGCATGGATTAAAGAAGGAGATGTAAAGATCTGGTTCCTTTCCATCATTTACTTCATATCGGCGGTTCCTGG
AGCCTATTTCATGTGGTATCGTCCTCTGTATCGCGCTTTTAGAACTGAGGGTGCCATGAAGTTTGCGTGGTTTTTCTTG
TTTTACATGGTTCACATTATATTCTGTATCTTCGCTG > SEQ ID NO:3686 6682    6702_300347_1
ggtcGACCCACGCGTCCGGTCTTCTTCTTCTTCTGATAACTAGATTTTTCAATCTTCTGAAGCTTTAATTTTTTCATAG
CCATGGCTAATCGTTATGATCCAAATCCTTTCGCTGAGGAAGAAGAAGTCAATCCTTTCGCTAATGCTAGAGGAGTTCC
ACCTGCGTCGAATTCGAGACTTTCGCCTTTGCCTCCAGAGCCTGTTGGTTTCGATTATGGTCGAACCGTAGACATTCCT
CTTGACAGAGCTGGTACACAGGATTTGAAGAAGAAAGAGAAGGAACTCCAAGCCAAAGAAGCTGAGCTAAAACGACGAG
AGCAGGACCTCAAACGGAAAGAAGATGCTGCTGCACGAGCTGGAATCGTTATCGAAGTGAAAAACTGGCCGCCTTTCTT
CCCGCTTATCCACCATGATATTGCAAATGAAATTCCGGTTCATCTCCAAAGACTACAGTATGTTACCTTTGCAACGTAT
TTGGGgttGgttctttgtcTTTTCTGGAATATCATCg > SEQ ID NO:3687 6686    6718_300347_1
GACCCACGCGTCCGAAAAAGCCTGCTTGATAGTATGACTGACATTGATCCATCAGTTTATGCCAACTTCTTTTGGGTCT
CTTCTCAGTACCATAAAGTCCGTCAAGAGTTCTCTGAGTTCTATAAAAATGCTCTTCTTTACCTCGCTTATACGTCTGT
GGACTCACTCTCGGAATCATTTAAGCTGGATTTGGCTTTTGATTTGTCGCTTTCAGCTCTACTTGGGGAGAATATCTAT
AACTTTGGGGAACTGTTAGCCCATCCAATTTTGAAAAGTCTGCTTGGAACAAATGTGGAATGGCTTTACCACATTCTAC
AAGCATTCAACCACGGAGATTTAGTTCAGTACCAAGAACTCTGTCGTGTGCACAATGCATCGTTGAGTGCTCAACCAGC
ACTGGTTGAGAATGAGAAGAAACTATTAGAGAAGATCAACATTCTCTGCCTTATTGAGATCATTTTC > SEQ ID NO:3688 6686    144041_200012_1
GGACAATCCATGTCTCCTGGGTGCAACCAAGAGTTCTTGGAATTCCCCAAATCAAGTCATTGCGTGATCGGCTAGACAA
TTGGGTGGAGAAAGTTCACACTACTTTGCTAGCAGTAGAGGCTGAAACTCCTGATTTAGTTGCATCATAATCATAATCA
AGCAGAGACTCTAGCGAAACTAAATCTAGTTTCTTGGGTTGTCATTGTCCCGATTTACGTAACAAATTCAATGATCTCG
ATGTGTTTTTAAGGGAAGCAGGTGCTTGTTATTGTATTTCATTTCGTCAGGTTCATAATGACATTCCTAGGGAAAACAG
GGAGCCATGTTGTGAAATGGCTGTACTTTACTGCTTTAGATACTTAGATCTTTTATGCACTAGAATCTAAAAGAATCCA
GTTTC > SEQ ID NO:3689 6717    1101690_301528_1
AGAAAAGGTCGGTAGAGAGAGAACGAGAAGGAGAAGGAGAGAGGAGAGAGAAGATGGCAGGAGTGTGGCCCGTAATGCA
AGATTGGGAGCCGGTGGTTGTTCGGAAGAAGACCCCAAACTCATCCTCCATGAAGGACGAGAAGGCTGTCAGCGCTGCT
CGCCGCGCCGGAGGACCCGTCGAGACCATCAGAAAACATAACGCTGGATCTAACAGAGGTCACATCCAGCACTATTAGC
CTGAACACAATGAAACTGGACGATGAGACTGACGTGCTGTCACATGATAAAGTTCCGTCAGAAATGAAAAAAGCGATCA
TGCAAGCACGCTT > SEQ ID NO:3690 6717    227113_301008_1
TCTTCTTGGTCCTCCTCTTGTCTCGTCTCGATGGCCGGGATTGGTCCGATCAGGCAGGAGGGGGAGCCGGTGGTGGTGC
GGAAGAAGGCGCCCACCGCCGCCGCCAAGAAGGATGAGAAGGCCGTCAACGCCGCCCGCCGCTCCGGCGCCGAGATCGA
GACCATGAAGAAGTATAACGCTGGAACGAACAAGGCGGCGTCAAGTGGCACATCCCTCAACACCAAGCGGCTGGATGAC
GACACCGAGAGCCTTGCCCATGAGCGTGTCTCAAGTGACCTGAAGAAAAACCTCATGCAAGCAAGGCTGGACAAGAAGA
TGACCCAGGCACAGCTTGCACAGATGATCAATGAGAAGCCCCAGGTGATCCAGGAGTACGAGTCAGGTAAAGCTATTCC
GAACCAGCAGATCATCGGGAAGCTTGAAAGGGCTCTTGGAACAAAGCTGCGCGGCAAGAAATAATGTTCTACTATTAGG
CCCTGAAGCATAGTGTTGGAGCAACCAAAGCCAAAATGTTTGCGTAACCTATGCTGGGTCTTTTGATACCATGCAGGAT
GTTTCTGTTGGTGCATGAGTGAATACTGAATAACTATTATG > SEQ ID NO:3691 6717    157938_301397_1
TTTCTCTAAAAGAAGAAAAGATGGCTGGAATATCACAAGATTGGGAGCCGGTGGTGATTCGCAAAAAAGTGCCGACCGC
CGCCGCAAGAAAAGACGAGAAAGCAGTCAACGCCGCCCGTCGCACCGGTGCTGAGATCGAAACCGTCAGAAAAGCTACT
GCAGGGTCAAACAAGGCTGCATCTAGCAGTACAACATTGAACACCAGGAAGCTTGATGAAGATACCGAGAACTTGTCAC
ATCAAAAGGTACCAACTGAATTGAAGAAAGCCATTATGCAAGCACGACAAGATAAGAAGTTAACTCAGTCTCAACTTGC
CCAGTTGATAAACGAGAAACCACACAAATCATTCAGGAGTACGAGTCTGGAAAGGCAATTCCAAACCAACAGATAATCTCT
AAACTGGAGAGAGCTCTTGGTGCTAAACTTCGCGGAAAGAAATAAAGGTTGGAATAGTGAACCTTTTGGATTAGACTGT
CTGGTTGTATCCTAAAAGTGGTCATGTACATGAGCTTTTTTACTTTAACCACTATGGTACTTGTTGTATCTGGATTCAT
GATGTGGTTTTCGTGGTTGACTTGGGTGTTTTTCTTGTGAAAAATG

FIG. 2 continued

> SEQ ID NO:3692 6717    249518_301593_1
gaggaAGAAGAGCAAGAGGAAGAGCGAAGAAGATGAGTGGGCATATCGCGCAGGATTGGGAGCCGGTGGTGATCCGGAA
GAAGGCCGTGACTGCCGGGCAGCGCCGCGACGAGAAGGCCGTGAACGAGGCGCGCCGGTCAGGAGGGCCGATCGAGACG
ATCAAAAAGTTCAATGCGGGGTCCAACAAGGCGGCGACGAGCACACCGGGAATCAACACTAAGAAGCTGGATGACGAGA
CGGAGGAGCTCGCCCACGAACGCGTTTCAACTGATCTAAAGAAGAACATCATGACTGCTCGCGCTGAAAAAAAAAATGA
CGCAGGCACAGCTTGCACAGCTGATTAACGAGAAGCCTCAAATCATCCAAGAGTACGAATCCGGGAAGGCCATCCCCAA
CCAGCAGATCATCTCCAAGCTCGAGCGCGCGCTGGGGACGAAACTGAGAGGCACCACCAAGAAGTGAGTAACTTCCCGT
CGTTTCTTTTCTTTCTGTCTGTGAAAGGTCGTAACTGTGCGAACAAAAACTATGCTTCTACAAACAACGTTTCGAGGAC
ACCCTCTGTAATGTAAATACAATGCTCTGCTGCTGTACAAGCAATAGCTACAGATACAAATCGATCCGGCTGCAAGCAA
CTCTACTGCCTGTCCGGAAGAAAGAATCGATCGAAGCTTTCGAAGCACGaagacttg > SEQ ID NO:3693 6717    56437_300139_1
acgaagaaagaagccctagattttgtcaaaatttggtttctgAACAAAAAACCATGGCCGGAATTGGACCGATAACTCA
GGATTGGGAGCCGGTGGTGATCCGTAAGAAACCCGCTAACGCCGCTGCCAAGCGCGACGAGAAAACTGTCAACGCCGCT
CGTCGATCCGGCGCCGATATCGAGACCGTCAGAAAATTCAATGCTGGAACCAACAAGGCGGCATCAAGCGGCACATCTC
TGAACACAAAAATGCTTGATGATGACACTGAGAACCTTACTCATGAACGTGTGCCTACTGAGCTAAAGAAAGCCATTAT
GCAAGCCAGGACAGACAAGAAGCTAACCCAGTCCCAACTTGCTCAAATCATCAATGAGAAGCCACAAGTGATTCAAGAG
TATGAGTCTGGCAAAGCTATACCCAACCAGCAAATCCTTTCTAAGCTGGAGAGAGCGCttgGAGCTAAGCTTCGtgGAA
AGaagTGAgCcaagtTCTACTGAtgtaGcaagtaacaaGaaTCAATgctttCGTCTAat > SEQ ID NO:3694 6717    38696_300209_1
GCAGCTAAGCGCGACGAGAAGACTGTCAACGCCGCTCGTCGAAGCGGCGCCGATATTGAGACCGTTCGAAAATTCAATG
CTGGATCGAACAAGGCTGCATCAAGCGGCACCTCCTTGAACACAAAGAAGCTAGATGATGATACTGAGAACTTATCTCA
TGATCGTGTGCCCACTGAATTGAAGAAAGCCATCATGCAAGCTAGAGGGGAGAAGAAGCTGACTCAGTCCCAACTTGCC
CATCTGATCAATGAGAAGCCACAAGTGATCCAAGAATACGAGTCTGGGAAAGCAATTCCGAATCAACAGATCCTTTCAA
AGCTGGAGAGGGCACTTGGTGCTAAACTCCGTGGAAAGAAGTAGAAGT > SEQ ID NO:3695 6717    6711_300347_1
CCCACGCGTCCGCATTTCTTGTTATTATCCACGAACGAAGAAAAACCTAGAAAACAGTTGAAGAAAGAAAATCACAAGA
GAAGCCATGGCCGGAATTGGACCGATTACTCAGGATTGGGAACCAGTTGTGATCCGCAAGAGAGCTCCTAACGCTGCAG
CTAAGCGCGACGAGAAGACTGTCAACGCCGCTCGTCGAAGCGGCGCCGATATTGAGACCGTTCGAAAATTCAATGCTGG
ATCGAACAAGGCTGCATCAAGCGGCACCTCCTTGAACACAAAGAAGCTAGATGATGATACTGAGAACTTATCTCATGAT
CGTGTGCCCACTGAATTGAAGAAAGCCATCATGCAAGCTAGAGGGGAGAAGAAGCTGACTCAGTCCCAACTTGCCCATC
TGATCAATGAGAAGCCACAAGTGATCCAAGAATACGAGTCTGGGAAAGCAATTCCGAATCAACAGATCCTTTCAAAGCT
GGAGAGGGCACTTGGTGCTAAACTCCGTGGAAAGAAGTAGAAGTGTAGAACAAAGCTTTTAAAGGTAACAACAAAAGCT
GATCGCAGTTtctctCCAGTCCACATGCTTTACCATATCCTAAAAACTATAtttATGTATGGTTTGGTTTAATGGCGTA
GTAGTTTGTTGcgaggaatctttcatgatgtaagaaaaacaaagctgtttggaaccttttgtcattataaataatttct
tctctttcttttt > SEQ ID NO:3696 6717    273913_200055_1
aagcgcaacaaaagcaagggtcaagaGAGATATTTTTTCCCGAGAAGAAGAAGAAAAAAAAGGATGAGTGGAGGAATAG
CACAAGACTGGGAGCCGGTGGTGATCCGCAAGAAGGCGCCTACCGCCGCCGCACGCAAGGATGAGAAAGCCGTCAACGC
CGCCCGTCGCTCCGGTGCTGAGATCGAAACCATCCGAAAATCTGCTGCTGGCACAAACAAAGCTGCCTCCAGTAGTACG
ACCTTGAACACCAGGAAACTTGATGAAGATACTGAGAATTTGGCTCATCAAAAGGTACCAACTGAACTGAAGAAAGCCA
TCATGCAAGCTCGACAAGATAAGAAGCTGACCCAGGCTCAACTTGCCCAGTTGATAAATGAGAAGCCTCAAATCATCCA
GGAGTATGAGTCTGGAAAGGCGATTCCAAATCAACAGATAATCTCTAAACTGGAGAGAGCTCTTGGTGCGAAACTTAGA
GGAAAGAAATGAAGTGCCTTTTGGGTTTCTCAAATCTCCGTTCCAGTCCTAAAAGTGGTCATGTACATGAACATCTTCC
TATGTTAGCCCTCTTTCTGTAACCACTTTGGTGCTTGTGCCTGTGTATGGATTGATGGTTGAGGATTTCCTAGCTAAAC
GGGTGTTACTAATATGGAAAATAAAGGCGTTTATGCTT > SEQ ID NO:3697 7393    228472_301021_1
gatgatttgagtcctcgtcgcgtcgcgtcgcgtcgtGTCCACCTGCGAATCCTCTAGTCCTCGCGAGTCGCGACACGCG
GAGCTTTGGCACCTGCAGCGATGGCGACCGACCACCGCCGCTTCCCCGTCTTCCTCGCCGCGGCGCTGCTCACCCTCCT
CCTCCTCCCGGCCTCCGCCGCGGCCACCGACGTCGAGTACTGCAGGCAGGGGCGGGATTATCCTGTGAAGGTGAGCGGA
GTGGAGATCGTCCCTGACCCCGTCGTCAGCGGGCAGCCGGCCACCTTCAAGATCTCCGCATCCACGGATAAAAGCATCA
CTAAGGGGAAGCTCGTGATAGATGTCAAGTACTTCTTTTTCCATGTCCATTCAGAAAGTCACAACCTTTGTGAGGAGAC
CTCTTGCCCAGTAACTGTGAATTCGTGCTTGCGCACGAACAGACTTTACCATCAATCACCCCACCAGGTTCTTACACT
CTCACCATGAGGCTACTAGATGACGGCAACAAGGAACTGACCTGCATCTCGTTTGGGTTCAGCATCGGGTTCATTTCAC
CTCTTGCTCTCATCTAAATTCAGCTGGAGTCACAGCAATGTACTTGCAGAACTccCATAGTCCTACCACAAC > SEQ ID NO:3698 7393   7410_300395_1
CCCACGCGTCCGCGCAGCTTTTGCTTCTTCGATAGAAAATCTAATTATCATCAATCATGTCTAAGTTCACGGGATTCTC
ATCTCTCGCTATCTCTTATTTTCTCTTGGTTTCAACGATTGTTGCAGCCACCGATGTTCACTACTGCGATAATAACGAA
GAGTATGAAGTAAAAGTACAAGGAGTTGATATAACTCCTTATCCTATAGCTAGAGGCGAGCCAGCTACTTTCAGAATTT
CTGCTAACACAGACACTGAGATCTCGAGCGGCAAGTTGGTGATCGAAGTTTCCTACTTTGGATGGCATATTCATTCTGA
GACACATGATCTTTGTGATGAGACAAGTTGTCCTGTGGCCATTGGAGATTTCTTGGTAGCGCACTCGCAAGTTCTTCCC
GGATATACCCCTCCTGGTTCATACTCACTAAAAATGAAGATGCTTGATGGACGCAAGAAGGAGTTAACTTGCATCAAGT
TCTCATTTGATATTGGATTTGGATCCTCCGTGGCCGACATGTAGAGCTGATTTGCTCGACGGGATACACCATCTTGTTC
TATACCATGGAACCACTCTCATTTATTTTGTATAAAATACACTCTCCTGCTATACATAATTGTTGATCAAAAACCCTTT
GAAAATTCTCATTCTGGACCATTCATGAATCCCCCCATTTATAGAAAAaacacagtaatgaat > SEQ ID NO:3699 7393   254010_301631_1
ATTGATAGATAGATAGAGAGATAGAGAGACAGAGAGAGAGAGAAAGAAAGAAAGAAAGAAGGAAAGAAAGGCCAAGGGC
ACAAGTTCAAAACCATCGATCTCTTCTACAATAGAATGAGCAATCTAAGAAGGATGTGCTATCTCTTTCTGGTTTTGAT
CAGTACCTTCTTTGCACTTGTGAATGCAAAGGTTACATGGCAGTCCTGCTCGTCAAGAATCGACTACAAAGTGGATGTG
CAAGGTGTCAGTGTTATTCCGGACCCTGTTGTGAAGGGAGTCGATGCAACATTTAAAATTCCTGCCATCACAAAGGATC
CAATTACCGGAGGCACAGTGGTGATAGATGTGTACTACTTTGGGATTCATGTACACTCTGAGAAAGATGATTTATGCAG
CAAAACAGAATGCCCGGTTGCACCTGGAGAGTTTACACTTACGAACTCCCAACCTCTACCCAATTTCACACCATCTGGA
TCTTATCGTCTCAACATGAATGTGTACGACACCGATGGAAGTCTGCTGACTTGTGTCAAAATCAGCTTTAAAATAGTGG
GATCAGTCAATCAGCTTGAATCCAGTGATTTGAACAGGTTTTCCGAAGATCGATTCGTGCATGAAGATTGATACAAGGC
TATGTCAGTTTCAAACAATAAATGTAAATATGGGATGA > SEQ ID NO:3700 7393   1108060_301546_1
GATAGATAGATAGAGAGATAGAGAGACAGAGAGAGAGAGAAAGAAAGAAAGAAAGAAGGAAAGAAAGGCCAAGGGCACA
AGTTCAAAACCATCGATCTCTTCTACAATAGAATGAGCAATCTAAGAAGGATGTGCTATCTCTTTCTGGTTTTGATCAG
TACCTTCTTTGCACTTGTGAATGCAAAGGTTACATGGCAGTCCTGCTCGTCAAGAATCGACTACAAAGTGGATGTGCAA
GGTGTCAGTGTTATTCCGGACCCTGTTGTGAAGGGAGTCGATGCAACATTTAAAATTCCTGCCATCACAAAGGATCCAA
TTACCGGAGGCACAGTGGTGATAGATGTGTACTACTTTGGGATTCATGTACACTCTGAGAAAGATGATTTATGCAGCAA
AACAGAATGCCCGGTTGCACCTGGAGAGTTTACACTTACGAACTCCCAACCTCTACCCAATTTCACACCATCTGGATCT
TATCGTCTCAACATGAATGTGTACGACACCGATGGAAGTCTGCTGACTTGTGTCAAAATCAGCTTTAAAATAGTGGGAT
CAGTCAATCAGCTTGAATCCAGTGATTTGAACAGGTTTtccgAAGATCGAttcGTGCATGaaGATtGATACaagGCTAT
GtCAGt > SEQ ID NO:3701 7393   129382_300405_1
CCCCCCCTGTACCCGGTGAAGGTGAGCGGGGTGGAGATCGTGCCCGATCCGGTCGCCCGCGGCGAGCCCGCAACCTTCA
AGATCTCCGCTTCCACTGATAAAACTATCGGTAAAGGGAAGCTGGTTATTGATGTGAAATACTTCTTCTTCTATGTCCA
CTCGGAAACTCGTGAGCTCTGTGATGTGACTTCCTGCCCGGCAAGTGGTGACTTCTTGGTAGCTCATCAGCAAACCCTG
CCATCATACACTCCACCAGGCTCTTACACCATCACCATGAAGATGCTGGGTGATAACGATGAGGAGCTGAGCTGCATCT
CGTTCGGGTTCAGCATCCGGTTTCGCTGCATCACAAGCCACCATCTGAATGCATCCAGAGGCAGAATTCAGAAATATCAC
ACCATGGATGTAATTACAAAAGCACCTATGTATCTTAGATCATAGAACTCAAATACAATGCGCATCTGCCAACACATTG
TGTTCAACTAAGACGTTTTATCCAGAGTTGAACATACAATAAAAACATCACTCACTAGTGTACCTAACTCCGTTTAGCT
GTTGAAATGTGTTGCATTGCATGTTGAATTGAGCCTGGATGCATCTTGATCTTGAGAAAAATTCCTGAACTTTTGAGG
TGTGAAGCTTGTGCAAGCAATCTGGGTGGTTGGTGCTGTACTTAACCACTAGCCACATGGGAAAACCATGTTATGTT > SEQ ID NO:3702 7393   125304_300630_1
GGCTCTGTTCGTATCTGGTCTCTCCTTCCTAAGTAGCAGTCCAACAGGTGATAATGTGGAATCGGTGGTTATAACGCTT
TAATAGGAGACTTGCACTTTCAACTATTATTATTCTCTCCCATCTTTATCTGTATCCGTCCTTTGCTTTGCTCCGATCA
AATGGCAATGATTGCCGTGAAACTCTTTGTTGGTCTTCTGTTATTCCTATGTCTTCTCTCCTCTCACTTCCGCTGAA
TCCACCGATTTCGAGTATTGCAATAAAAAGGCCAAGTACGATGTTAAGGTCAGTGGAATTGATATAACGCCCTATCCAG
TCAGCGGAGGTAAAAAGACCACATTCAGTATCAGTGCATCCACAGGTCAGAATCTCACCGGAGGAAAGCTGGTGATTGA
TGTTAACTATTTGTTCTTCCATGTCCACCACGAGGCCATCGACCTATGTAAAGAGACATCGTGCCCAGCTTCCGGTGAT
TTTGTGATTTCCCACTCACAAGAGTTGCCTGGATTTACTCCACCTGGATCATACACTCTTACAATGAAGATGGTGGATG
ACAAAAATCATCAACTGTCCTGCATAAGTTTTGGCTTCAGCATTGGGTTTATAGCCGAGTCCCAGGCGTTAGCAGCAGA
TAGCTAGGTGGTCCAAGGACCTAGTAACAAATAATGGTTTTTCAATATTGTAATCAAGTGTTCTCTCCAAACTT

FIG. 2 continued

> SEQ ID NO:4154 108496 127234_300469_1
GAACCCAGTTGGTCCAGTCACCGTATCAATTACCTCAATGGTGGCACCACAGCTGAGCTTCTTCTCGACAAATCTTCAG
GAGCTGGATTTCAATCAAAGAAATCGTATCTATTTGGGCACTTTAGTATGAAAATGAAGCTTGTTGGAGGTGATTCTGC
TGGTGTTGTCTCTGCATTTTATCTGTCATCAAACAATGCAGAACACGATGAGATAGATTTCGAATTCCTAGGGAACAGG
ACAGGCGAGCCGTACATATTACAGACCAATGTGTTTACAGGAGGTAAAGGAGACAGGGAGCAGAGGATCTATCTCTGGT
TTGATCCAACCAACGACTTCCATTCATATTCCGTTCTCTGGAACACCTTTCAAATTGTGATTTTTGTGGACGACGTGCC
AATAAGAGTATTCAAGAATTCGAAAGACATAGGTGTGGCATTCCCATTCAATCAGCCGATGAAGATCTATTCAAGCCTG
TGGAGTGCTGACGACTGGGCTACAAGAGGAGGATTAGAGAAAACAGATTGGTCAAAAGCGCCATTCACTGCTTCCTACA
CTTCATTCCACATAGATGGCTGTGAGGCATTCACCCCACAAGAAGTGCAAGTTTGTAATACAAATGGCATGAAATGGT

> SEQ ID NO:4155 108496 171062_300534_1
CGATCAGGGTGCAGCCGGGGTACACCGCCGGCGTCAACACGGCCTTCTACCTGTCGAACACGGAGCAGTACCCGGGGCG
CCACGACGAGATCGACATGGAGCTGCTGGGGACGGTGCCGGGGGAGCCGTACACGCTGCAGACGAACGTCTACGTGCGC
GGCTCCGGCGACGGCAACATCGTCGGCCGCGAGATGCGCTTCCACCTCTGGTTCGACCCCACCGCCGGCTTCCACCACT
ACGCCATCCTCTGGAACCCCGACCAAATCTTGTTCTTGGTGGACGACGTGCCGATCAGGAGGTACGAGAAGAAGGTGGA
GGGGACGTTCCCGGAGCGGGAGATGTGGGCGTACGGATCCATCTGGGACGCCTCCGACTGGGCCACCGAC

> SEQ ID NO:4156 108496 227985_301032_1
ACCATCAACCctgTCTCTGTAACTGTAACGAATGGAGAACGAATGGATGGcaaaATGTACATGGATCAAGAAGAAGAAGA
AGACGAAGACGAAGACGAaCAAGAACAAGAAGCAATTACAAATCATTCAAGAACTCATCAATGGAGGATTTGTTCATCA
TCACTTGCGGTAGCACTCGGCGGGGAAGCCCTGGGGGAAGCGCCAGCCGTCGGCGCAGTAGTTGTAGGACATGTAGTTG
CGCTCGGCCCACGCGACGGTGCCGAGCTCGGCGCCGTCGAGCTCGCGGTGGATCCACGCCGACGTGCCCTCGGGGCACG
ACGACGACGACCACCCGCCGGCGGGGTTGTTGTTGACGCACGCGTTGGCGCTGTACCCGCGGTACGACACCACGAACGG
CGCGCCGCTCCAGTCGATCTTGACGTCGCCGTGCCTCGTCGCCCAGTAGCTGCCGTCCCACAGCGTCGCGTGCAGCCTC
ATCGGCTTGCTCTGCGGGTACGCCAGGTCGTCGTACTTCTTGAACGTCCTCACCGGCACATCGTCCACCTGGAATATGA
TGTTTTGGGGATTCCAGATGATCTTGTAGGTGTGGAAGTCGGCGGTGGGGTCGAACCAGAGGTAGAACTGGTGCTCCTT
CTTGCCGTCGCCATTAGCCCAGACGTTGGTGTTCATGACGTAGGGGTTGCCGCTGAGGTTGCCCATGAACTCGATGTCG
ATCTCGTCGTGGCCGTCGCCCTCGCCGGAGGAGAGGTAGAAGGAGGTGACGGTGCCGGCGGAGTTgccgccGACGAGCT
TCATCTGGACGCTGAACTCGCCGAACAGGTAgGtgtCCTtGGAGGTGaacccgGACCCGGAgctccgGTCcagcGTCAG
CG > SEQ ID NO:4157 108496 284833_200075_1
GCGTCCGAAACCCCTCATAAAGGGGCAAAAATATTAAGAAAATGGTGAACTATTATCTTGTTATTGTCATATTTTTCTC
CGTTGTTGAATTGGTTTATGGGTCTTCAAGAAATTTGCCAATTTTAGCGTTTGATGAAGGCTACTCCCATCTCTTTGGT
GATAATAACCTTATGATCCTTAAAGATGGAAAATCTGCTCATATTTCTCTAGATGAAAGAACAGGGGCTGGATTTGTGT
CTCAAGACCTATATCTTCATGGATTCTTCAGTGCTTCTATTAAGCTTCCTGCTGATTACACTGCTGGTGTGGTTGTTGC
ATTTTATATGTCTAATGTGGACATGTTTGAGAAGAACCATGATGAAATTGACTTTGAGTTCTTGGGAAATATTAGAGGT
AAAGACTGGAGAATTCAGACCAATATTTATGGGAATGGTAGCACTAATGTTGGTAGAGAAGAAAGATATGGACTCCGGT
TTGACCCTTCTGAAGATTTCCATCAGTACAGTATCCTTTGGACTGAGAATTTTATCATCTTTTATGTAGATAATGTCCC
CATAAGAGAGATCAAGAGGACAGAGGCTATGGGTGGGGACTTCCCATCTAAGCCAATGTCTTTGTATGCTACAATATGG
GATGGTTCTGGTTGGGCTACCAATGGTGGAAAATACAAAGTCAATTACAAATATGCCCCGTATATTGCCAAGTTCTCTG
ATTTCGTCCTCCACGGATGTGCAGTTGATCCGATTGAATTATCATCCAAATGTGACATTGCACCAAAAACTGCATCAAT
CCCTGC > SEQ ID NO:4158 108496 279423_200062_1
AATAAGTATATGTTTGGGAAAGTTACTGTTCAGATTAAGCTTGTAGAAGGTGACTCTGCTGGAACTGTCACTGCTTTCT
ACATGTCATCAGAGGGACCAACCCATAATGAGTTCGATTTTGAGTTTCTAGGTAACACAACTGGTGAACCATACTCCGT
ACAGACCAATGTTTACGTAAATGGTGTGGGTAACAGAGAACAACGACTGAACCTTTGGTTCGACCCATCCAAGGAATTC
CATTCCTATTCCATCTTGTGGAACCAACGCCAAGTTGTATCTTAGTAGACGACACCCCAGTTCGTGTACACTCAAATT
TGGAGCACAAGGGAATTCCATTTCCAAAGGACCAAGCCATGGGTGTGTACAGTTCAATATGGAATGCAGATGATTGGGC
TACACAAGGCGGAAGGGTCAAGACTGATTGGTCACATGCACCCTTTGTTGCATCCTACAGAGGATTTGAGATTGATGGC
TGTGAATGTCCAGCAACTGTTGCAGCTGCTGAGAATTCTAAGCGGTGCAGCAGCACTGCTGAGAAAGGTATTGGTGGG
ACGAGCCAACAATGTCTGAGCTTAGTCTGCACCagagcCATCAGTtGATTTGGGTCagggCTAACCATATGgtcTATGA
TTATTGCACAGACACTGc

FIG. 2 continued

> SEQ ID NO:4159 108496 183156_300619_1
cccacgcgtccgggcaaggcgaccgccgacctgaagctcgtggcgggggattccgccggagttgtcactgctttctatc
tGTCGTCCGGCGGGGACAAGCACAACGAGTTCGACTTCGAGTTCCTGGGCAACGTCACCGGCGAGCCGTACCTGGTTCA
GACCAACCTGTACATCGACGGCGTCGGCAACCGGGAGCAGCGCATCGACCTGTGGTTCGACCCCACCGCCGACTTCCAC
ACCTACGCCGTGCTCTGGAACCCCAGCCAGGTCGTCTTCCTCGTCGACGACACCCCCATCCGCGTCTACGAGAACAAGA
ACGCCACCGCCGTTGTCAAGGGCCACCACCGCCACGCCGCCGCCGCCAATGCCACCAGCAACGCCACGTCGGCGTCCGC
GCCGCCGTTCCCGTCGCCGCAGCCGATGTCGGTCTACAGCTCCATCTGGAACGCGGACGACTGGGCGACGCAGGGCGGG
CGCGTGAAGACGGACTGGTCGCACGCGCCGTTCGTGGCCACGTTCCGCGACGTCCGCGTCGAGGGGTGCGCGTGGCGG
CGAACGCCACCGACTCGGACGCCGGCGAGGTGGCGCGGTGCACGGGGAGCTCGTGGGGCAAGGAGGGGAGGTACTGGTG
GAAGGAGAAGGACATGGAGGAGCTCACCGTGCACCAGAGCCAccaGCTCGTCTGGGCGCGCGCGCAccacctcGTCTac
gACTACTgcgTCga > SEQ ID NO:4160 108496 147145_301205_1
TAATTTTAATAATCTTGCAGAGATCACTTGGGGCGAAGGACGTGGTAAAATAACAGAAGGAGGCAGAGGCCTCTCTCTG
TCCCTTGACAAATTTTCTGGTTCGGGTTTTCAATCCAAGAATGAATATCTCTTTGGAAGATTTGACATGCAACTCAAAC
TTGTCCCTGGAAATTCCGCTGGCACTGTCACCACTTTCTTTTTATCTTCACAAGGAGAAGGACATGATGAGATCGACTT
CGAGTTCTTGGGTAATACGACTGGCGAGCCCTACACTGTCCACACCAACGTGTATTCTCAAGGAAAGGGAAACAAAGAA
CAACAATTCCACCTTTGGTTCGACCCAACTGCAGCATTTCACACCTACACCATTGTGTGGAACGCTAAACGTATAGTGT
TCTTGGTAGATAACATCCCACTTAGAGTATACAACAACCATGAAAGCAATGGCATTCCATTCCCAAAGAGCCAACCAAT
GAAAGTGTACTGCAGCTTATGGAATGCAGATGATTGGGCTACACAAGGAGGCAGAGTCAAGACTGATTGGACACATGCT
CCTTTCACTGCTTACTACAGAAACTTCAATATTGATGGCTGCGCAGTTACATCCGGTGCCTCTTCATGTAAGTCCACTG
ACTCTGCAGGCAATGCTAACGCATGGCAAAATCACGAGCTTGACGCTCAGGGCAGGAATAGGGTTCGATGGGTGCAAAG
TAgaCACATGGTTTACAACTATTGTGCTGATTCTAAGAGGTTTCCTCAAGGCTATTCTCACGAGTGCAAGAGCTCAAGG
TTTTAATTAGGAGATGGCACTTCGTTATATCAACTCCAAAGGTTTAAAGATTGATGCATAGcCTggTGGtttaTGGg > SEQ ID NO:4161 108496 134948_300420_1
CCCACGCGTCCGCCCACGCGTCCGGCCACGCGTCCGGCAAGAAGGAGCACCAGTTCTACCTCTGGTTCGACCCCACCGC
CGACTTCCACACCTACAAGATCATCTGGAATCCCCAAAACATCATATTCCAGGTGGACGACGTGCCGGTGAGGACGTTC
AAGAAGTACGACCTGCGCTACCCGCAGAGCAAGCCGATGAGGCTGCACGCGACGCTGTGGGACGGCAGCTACTGGG
CGACGAGGCACGGCGACGTCAAGATCGACTGGAGCGGCGCGCCGTTCGTGGTGTCGTACCGCGGGTACAGCGCCAACGC
GTGCGTCAACAACAATCCCGCCGGCGGGTGGTCGTCGTCGTGGTGCCCCGAGGGCACGTCGGCGTGGATCCACCGCGAG
CTCGACGGCGCCGAGCTCGGCACCGTCGCGTGGGCCGAGCGCAACTACATGTCCTACAACTACTGCGCCGACGGCTGGC
GCTTCCCCCAGGGCTTCCCCGCCGAGTGCTACCGCAAGTGATTTTGAACTCGATCGATTCAAATCCTCCTCCATTGATG
AGTTCTTGGCAATGATTTGTAATTGCTTCTTGTTCTTGTTTTCGTCTTCGTCTTCGTCTTCTTCTTGATCCATGTA
CATTTTGCCATCCATTCGTTCTCCA > SEQ ID NO:4162 108496 130861_300491_1
GAATTCAAGAACGATACAACTTGTGGTTTGATCCAGCCCGTGATTATCACCGATACAGCATTCTATGGACTGCCAAGCA
CATTATCTTTTACGTCGATGATGTTCCAATCCGTGAAGTATTACGTAATGAAGAAATGGGTGGAGACTACCCAGCCAAA
CCCATGGCACTATATGCAACAATATGGGATGCATCAACTTGGGCTACACAGGGTGGAAAATACAAAGTTGATTATAAGT
ACGCTCCATTCGTATCCGAATTCAAAGACTTAGTCCTTCATGGTTGTGCAGTTGATCCTATCCAGCAAGTGTCTTCACA
AGGTTGTTCTGAAACAGAAGCCGATTTAGAGAGTGCAGACTACGCTGTTATTACTCCTGACCGCCGCACAGCCATGAGT
AATTTTAGACAGAGATATATGTACTACTCATACTGCACTTTGAGATACTCCACCCCTCCACCTGAATGTGTGA
TAGTACCAGAAGAGAAGATCAGGTTTAAGGACACAGGGAGGTTGAAGTTCAGTGGTGGACATGGTGGTACTCATCACCG
GAGATCATCAAAGAGACGATCCAGGGTTTCGAAAATAGCAAAAGAAATATGATTTTATTTAATTTTT > SEQ ID NO:4163 108496 127293_300469_1
ctatcttctcagggacccacgcatgatgaaattgactttgaattcttgggaAATGTTACTGGTGAACCTTATATTCTCC
ACACAAATATTTATGCTCAAGGCAAAGGAAACAAAGAGCAGCAATTCTATCTTTGGTTTGATCCTACCAAAAATTTTCA
CACCTACTCAATTATTTGGAAACCCCAACACATTATTTTCTTGGTCGACAACACACCGATAAGAGTTTACAAAAATGCT
GAATCAATTGGTGTGCCATTTCCCAAGAATCAGCCCATGAGAATTTACTCTAGCCTTTGGAATGCTGATGACTGGGCAA
CAAGAGGAGGCCTAGTGAAAACTGATTGGTCTAAAGCACCATTTACAGCCTACTATAGAAATTTCAATTCTCAAACTTT
TGGCAGTTCACAGTTTTCAAATGAAAATGGCAAAATCAAGAACTTGATGCTAATGGTAGAAGAAGACTCAGATGGGTT
CAGAGGAATTTCATGATTTATAATTATTGTACTGATTTAAAAGATTTCCTCAGGGTTTTCCTCCAGAATGCAAAAGAT
TCTGAGTGATATTAGTTTGTTTTTGTGAAATTCTTTTATGTGTTTGTGGTTTTATTTTGTTAGTTTATAGCGATCAAAA
TAAATATTGTATTTTTCTCatttcattttatatgttatttgaagctagtcgttcatcttgta

FIG. 2 continued

> SEQ ID NO:4164 103896 113073_300021_1c
cccacgcgtccggggagctcctcctcatcaTCGAACATAGGTTTCCGATTATCGTCGAACAACTGATATAATCATCACA
CAAAGGTGTATACAGCTTCTTGGTGATAAACAGTCAACATGCCGGCCACAGCAGGTAGGGTTCGCATGCCTGCGAACAA
CAGGGTTCACAGTAGTGCAGCCCTACAGACGCACGGCATCTGGCAGAGTGCTATTGGTTATGATCCATATGCTCCTAGC
AAGGAGGACGACAAGAAATCTACCCAGAAGGCGTCAGCAGCTGATCCTGAAAATGCTTATGCGAGCTTTCAAGGTTTGC
TTGCACTTGCCCGGATCACGGGATCTAACGCTGATGAAACTCGTGGGGCGTGCAAGAGGTGTGGGCGGGTAGGCCACCT
CACTTTCCAGTGTAGGAATTTCGTTAGTGTTAAGGATGATAACAAGGATAAGGATCCGGAGGTGATTGAGGCTGCCGTG
TTGTCTGGATTGGAGAAGATCAAGGGGTCTAAGATGAAGGGAAAAGCAGAAAATGAGGAGAGCAGTGAAGAAGAAGAGG
AGAGTGAGAGTTCTGATTCGGATTATGATTCTGAAATGGAGAGGGCAATTGCTGAGAAGTATGGGAAGAAGGTAAGTAG
GAAGTTGAAGTCATCTAGGAAGCACAACAAGAAAGATTCAGATGATGATGAGGAGGAGGAGTCAGACTCTGGAAAAAGG
AAGAAGAGGGGCAGATCAAAGAGGAGGAGGAGTGGGAAGAAGAAGGGACACAGTGATTCGGAGGACGATGATGAAGATA
AGGATCGCAGGAAGAGGAGAAAGGAAAAGAGGAGGAAACGGGATGACTCATCAgacgaggATGAAGATCGTaggaggaG
GAGAAAAAGTAggaaggagaagaggaggaggagaaGTCATagaCATGCTGACAGttcTGaTgaatc > SEQ ID NO:4165 103896 280124_200066_1c
AAGAGGTGTGGGCGGGTAGGCCACCTCACTTTCCAGTGTAGGAATTTCGTTAGTGTTAAGGATGATAACAAGGATAAGG
ATCCGGAGGTGATTGAGGCTGCCGTGTTGTCTGGATTGGAGAGTTCTGATTCGGATTATGATTCTGAAATGGAGAGGGC
AATTGCTGAGAAGTATGGGAAGAAGGTAAGTAGGAAGTTGAAGTCATCTAGGAAGCACAACAAGAAAGATTCAGATGAT
GATGAGGAGGAGGAGTCAGACTCTGGAAAAAGGAAGAAGAGGGGCAGATCAAAGAGGAGGAGGAGTGGGAAGAAGAAGG
GACACAGTGATTCGGAGGACGATGATGAAGATAAGGATCGCAGGAAGAGGAGAAAGGAAAAGAGGAGGAAACGGGATGA
CTCATCAgaCGAggATGAAGATCGTAGGAGGAGGAGAAAAAGTagGAAGGAGAAGAGgAGGAGGAGAAGTCATAGAcaT
GCTGACAgTTCTGATGAATCAAGTGATGATTCTCctccacggCAcaaGCGTAgGAGCAggAgGACAgcctcagcATCTG
ATTCTGATgccagcaaCTCTGATGAttcacgaGtTGg > SEQ ID NO:4166 104005FL 103436_300026_1c
TGGTATCAACGCAGAGTGGCCATTACGGCCGGGGATGACCTAGGGTTCGTTGTTTTCGTGAATTTCTTAACGATAGGTT
TTGGGGTTTTATTCTAATTGGTGTTGAGAAGTTGTGGTTGACGGTTGGGTTCATTTGTTTGGTGTCGAATATCAAATTT
CTGGTGCTGAAGCTCGAAGAATAGCTTCAAATTTGTGGAGTTGAGTGCCTGAAGTTGTTGCGTAGCATATGCACTTGTC
GACGCATCAGGCTGAAATGGATAGAATACAATCAACACAAGAAACTGAAGATGGCAGTCAATCTGTTGATGTGTTTGCG
TCCGTCATGGGACCTGAGCATCCAGGACGCCTAAGATTGTACGGACGTGAGGTTACCAAGACTTCCATAAAAAGAAAAG
TGGTAGTTATTGGAACCTTTTCAAGTTCTACCGATGAGATGCTGCAACAAAAAATTGTGGAAATGGAAGAAAGGATGCA
ACAAAGAATGCTGGACAGTTTCAATGCACAAAAAGATGCCACGGAACAACAATTTCCATTTAACATCATTTCACAACAT
ATG > SEQ ID NO:4167 108256FL 127547_300470_1c
cgaccaatattcaCACACTTCTATCTTACATATTTAGCCAAAGCATCGTTAAAATGGCGTACATTAAGCAAGCTTTTCT
CTTGATTGCTCTCTTTGTTGCAATTACAGTTAATCTCTCTGGATCTCCTAAGTTGCAAGTGATGGCTTTACGAGACTTA
CCCGAAGAGGTTGCAATGATGAAAGATAAATTACTTCCATTAGGTGATATAGTAACTTGCTTGAAATACTGCAATGTCG
AAAGCGATTGCAGTGATGGTTGGATTTTGCCCAATTGTGTTCCATCTGCATTTCAGGGATGGAGATCTCAATGTGACTC
GCTTACTGCTACTGGTGAAGGTTATTTTGGAACTATACTCCGCGCTAAGCACAACAAAATATAAATTATATTGCTGCAA
TATATGAACTATTTATAAATGCTTGATCTCGTGTTATATTCAAGCATTTTAAATAATATAATGTTGTGTTTCCTACTTG
TCCAAGTTTATGTAAGAAAATGAATATGTAACCATGTTCTTGTTGTTGTCATCTTATATGCAGTTATTATGAAATATA
TGTTCTCTATTATCCCAATTAAAGTGGCACGAAACTTAATGGGAGATAATATTTACTATATATGATATGAATAGTGTCA
TTAACAACTGGTTTGGATGGTTGTTATGTTGTATTGTTATTTTAAATACAATGTTTGTTTTAATTGTTATTTAAATATT
GTTGTATCGTATCGTAACGATAAAAAGTGTCACTTTATAGAACAATAGATTTGGTGTGGGTCTCGTTACTTTGCTTTAA
TTTATTCTCTCGTTTTGCACTTTTTATTATTAAATAATTATATTTTATCCTTTACCCTACTTTTATGTATAGTATTTTC
TACTATGTATCCTATTTTTTCTTAGT > SEQ ID NO:4168 108256FL 158864_301994_1c
TTCTATCTTACATATTTAGCCAAAGCATCGTTAAAATGGCGTACATTAAGCAAGCTTTTCTCTTGA

FIG. 2 continued

> SEQ ID NO:4169 109562 114888_300374_1c
tgaccacaaagcacaatgatgatgagcaatatgtctggggaagcccaagCTGGTGGTTCTTTCACTGTTACCAGGGATAC
ATCTGGTGAGAACCTTGGTAGGGGTACAAAAATTACCCTCTTTCTCAAGGAGGATCAACTTGAATACCTTGAAGAACGT
AGGCTCAAGGACCTGATTAAGAAGCACTCTGAGTTCATCAGCTACCCAATCTCTTTGTGGGTTGAGAAGACCACAGAAA
AGGAAATCTCTGATGATGAGGAGGAAGAGGAGAAGAAAGATGAGGAAGGTAAGGTAGAGGAGGTTGACGAAGAAAAGGA
GAAGGAAGAAAAGAAAAAGAAGAAGGTTAAAGAAGTTTCTAATGAGTGGTCATTGGTGAACAAGCAGAAGCCCATTTGG
ATGAGGAAACCTGACGAGATCACGAAGGAAGAGTATGCCGCTTTCTATAAGAGCTTGACCAATGACTGGGAGGAGCATT
TGGCTGTGAAGCACTTCTCTGTCGAGGGCCAATTGGAATTCAAGGCCATTCTTTTGTTCCAAAAAGGGCTCCTTTTGAT
CTCTTCGACACAAGGAAGAAGCCCAATAATATCAAGCTGTATGTACGTCGTGTGTTCATTATGGACAACTGTGAGGAGT
TGATTCCTGAATATTTGAGCTTTGTGAAGGGTATTGTGGATTCCGAGGACCTTCCTCTTAACATCTCCAGAGAGATGTT
GCAGCAGAACAAGATCCTGAAGGTTATTCGCAAGAATTTGGTGAAGAAGTGCGTTGAGCTTTTCTTCGAAATTGCTGAG
AACAAGGAAGACtATAACAAGTTTTATGAGGCCTTCTCAAAgaaCCTCAAGCTTGGCATCCATGAggATTCCCAAAACA
gGTCTAAGTTTGCTGaacTGCTGCggTACCAttccACcaagaGCGgTGATGAGaTGACCagttTGAaggactatgtGa > SEQ ID NO:4170 109562 208340_300959_1c
AGAAGGAGACCGAGAAGGAGGTCCCTGATGGGGATGCTACTGAGGAGACCGTCACCGAGGAGGGTGATGACAAGAAGCC
CAAGGTCGACGAGATCGATGACGAGGAGGAGGAGAAGGAGAAGAAGCCCAAGACCAATAAGATCAAGGAGACCACCATC
GAGGAGGAGGAGCTCAACAAGCAGAAGCCCATCTGGACTCGCAACCCCCAGGACATCACCCAGGAGGAGTATGCTTCCT
TCTACAAGTCCCTCTCCAACGACTGGGAGGACCACCTCGGTGTCAAGCACTTCTCCGTCGAGGGTCAGCTCGAGTTCCG
TGCCATCCTCTTCGTTCCCAAGCGCGCTCCCTTTGACCTGTTCGAGACCAAGAAGACCAAGAACAACATCGAGCTCTAC
GTCCGCCGCGTCTTCATCACTGATGACGCCACCGACCTCATCCCTGAGTGGCTCAGCTTCGTCAAGGGTGTTGTCGACT
CTGAGGATCTCCCTCTCAACCTGTCTCGTGAGACTCTCCAGCAGAA > SEQ ID NO:4171 109562 187928_300682_1c
AAGAAGAAGAAAAAGAAAACAATCACTGAGAAGTACTGGGATTGGGAATTGGCTAATGAAACAAAGCCCATATGGATGA
GAAATCCAAAGGAAGTTGAGAAAACTGAGTACAATGAATTCTACAAGAAGGCATTCAATGAGTTTTTGGATCCTCTTGC
TTACACCCACTTTACAACAGAGGGTGAGGTGGAATTCAGGAGCGTCCTCTACATTCCAGGAATGGCACCTCTTAGCAAT
GAGGAGATAATGAACCCTAAGACCAAGAATATCCGGCTGTATGTTAAGAGAGTCTTCATATCAGATGACTTCGATGGCG
AGTTGTTCCCTAGATACTTAAGCTTTGTAAAGGGTGTAGTGGACTCAAATGATCTTCCTCTCAATGTTTCCCGTGAGAT
TCTTCAAGAAAGTCGTATTGTCAGGATCATGCGCAAAAGACTTGTCAGGAAGACATTTGATATGATTCAGGAGATTGCT
GACAAAGAGGACAAGGAGGACTACAAAAAATTTTGGGAGAGTTTTGGCAAATTTGTTAAACTTGGCTGCATTGAGGACA
CAGGAAATCACAAACGCCTTTCTCCTCT > SEQ ID NO:4172 109562 183205_300592_1c
CCCACGCGTCCGGAGAAGACAACTGAGAAGGAGATTTCTGATGATGAAGACGAGGAAGAGAAGAAGGATGCTGAGGAGG
GAAAGGTTGAGGATGTTGATGAGGAGAAGGAAGAGAAGAGAAGAAAAAGAAGAAGATCAAGGAAGTCTCTCACGAGTG
GAACGTGATGAACAAGCAGAAACCCATTTGGTTGAGGAAGCCAGAGGAGATCACCAAGGAAGAGTACGCTGCTTTCTAC
AAGAGCTTGACAAACGACTGGGAGGAACATCTGGCTGTCAAGCACTTCTCTGTGGAGGGTCAGCTTGAATTCAAGGCCA
TCCTGTTTGTACCAAAGAGAGCGCCATTTGACCTCTTTGACACCAGGAAGAAGCAAAACAACATCAAGCTGTACGTACG
CCGGGTGTTTATCATGGACAACTGTGAGGAGTTGATCCCAGAGTGGCTCAGCTTTGTCAAGGGCATTGTTGATTCTGAA
GACCTTCCCCTCAACATCTCACGTGAGATGCTCCAGCAGAACAAGATTCTGAAGGTGATCCGCAAGAACCTTGTGAAGA
AGTGCGTGGAGCTCTTCTTTgagaTCGCTGAGAACAAGGAAGACTACAaCAAgtcctaCGAGGCTtcctcCaaGaaT > SEQ ID NO:4173 109562 160451_200167_1c
GACCAAAACTGAGAAGTACTGGGATTGGGAGTTGACAAATGAGACAAAACCTATATGGATGCGTAATCCAAAAGAAGTC
GAGAAAGAACAGTACCAGGAATTCTACAAGAAAACTTTTAATGAGTTCTTGGATCCACTTATCTTTCTTTTCACTTCAC
TACAGAGGGTGAGGTGGAGTTTAGAAGTGTCCTGTATATACCTGGAATGGCTCCTCTTAACAATGAAGAAGTCATAAAT
CCCAAGACTAAGAACATACGCTTGCATGTGAAGCGTGTTTTTATTTCTGATGATTTCGATGGAGAGTTGTTTCCGAGGT
ACCTGAGCTTTGTTAAAGGAGTGGTGGACTCAGATGACCTTCCTCTTAACGTTTCACGAGAAATTTTGCAAGAGAGCCG
AATCGTTCGGATAATGAGAAAGAGACTAGTGAGAAAAGCATTTGACATGATTCAGGATCTCTCTGAAAGTGAGAACAAG
GAGGATTACAAAAAATTCTGGGAGAACTTTGGTAAATTTATAAAGTTGGGATGTATTGAAGACACTGGCAATCACAAGC
GAATAACTCCACTACTGAGATTTTTCTCTTCCAAAAGCAAAGAAGAGTTGATAAGCTTAGATGACTATATTGAGAACAT
GGGCGAAAACCAGAAGGCCATTTACTATTTGGCTACTGATAGCTTACAGAGTGCTA > SEQ ID NO:4174 109562 128324_300475_1c
aggggtacaaaaattaggctcttcctcaaggaggatcagcttgaataccttgaagagcgaaggcttaAGGATCTAGTTA
aaaAGCATTCTGAGTTCATCAGCTACCCAATCTCTCTGTGGGTTGAGAAGACCATAGAAAGGAAATCTCTGATGATGA
GGATGAAGAGGAGAAGAAAGATGAGGAAGGAAAGGTAGAGGAGGTTGATGAaaaAAAGGAGAAGGAAGAAAAGAAAAAG

FIG. 2 continued

AAGAAGATCAAGGAAGTATCTAATGAGTGGTCATTGGTAAATAAGCAGAAGCCCATATGGATGAGGAAACCCGAGGAGA
TCACAAAGGAAGAGTATGCTGCTTTCTACAAGAGCCTGACTAATGACTGGGAAGAACATTTGGCTGTGAAGCACTTCTC
TGTTGAGGGTCAGCTGGAGTTCAAGGCTGTTCTTTTTGTTCCAAAGAGAGCTCCTTTTGACCTCTTTGACACCAAGAAG
AAGCCCAACAACATCAAGCTGTATGTTCGCCGTGTGTTCATCATGGATAACTGTGAAGAGTTGATTCCTGAATATTTGA
GCTTTGTGAAGGGTATTGTGGATTCTGAGGATCTTCCCCTCAACATCTCCAGGGAGATGTTGCAGCAGAACAAGATCCT
TAAAGTTATTCGCAAGAACTTGGTAAAGAAGTGTATTGAGCTATTCTTTGAAATTGCTGAAAACAAGGAAGATTATGAC
AAGTTCTACGAGGCCTTCTCAAAGAACCTCAAGCTTGGTATCCATGAGGATTCACAGAACAGATCTAAGTTTGCAGAAC
TGCTGAGGTACCACTCCACAAAGAGTGGTGATGAGATGACCAGCTTGAAGGACTATGTAAcaaggatgaaagaaggcca
gaatgacatttactacattactggtgagagcaagaaggctgttgagaa > SEQ ID NO:4175 109562 129486_300479_1c
gaattctaagcttggagtaatttaggtgaatcgggtcaggcatgtagcaccactatcacttattcagtttatttctccc
aTCTCTGTTCTTCTTCATGTCAACAGAATCAAGTTCCAGACATCCAGAGATTCTCCCCACTCACAAAATAGAATGCTGA
AGAAAACCAGTGAGGGATGTATGTTTTCCTTCTGACTCATCTGCGTCGAATACTGCTCTATCTTAGTGATTTGATCCGT
CTCAGGTTCTCATCCCTACCCAACCAGATTACTAGGTCAGCAGGATTCAACAGTTAGGACTTCGACACTTTTGGATTGT
CATCATGGATGGCTCTAAGATGCAAAATAGGCATCAAAAATTAATTATGTTACAGCGCTCAGATGGAATGACACCCTAC
ATGAGTATCTTGGAAGATGGTTGAGAATATGATAGAATCAAGGATTTTAGTGAGGAAAAGCATGTGTTGGAGTCATTTC
ACATCTGAAGGTGATGTTCAGTCCAAGGTTGCTCTTTTTGTTCCTCCAAAGGCTCCTCATGATCTGTATGGGAGTTACT
ACAATGTTAACAAGTCCAACTTGAAGTTATACGCACATACGTGTCTTCATCTCAGATGGATTCGATGATCTTCTGCCAGG
TACCTGAACTTTTTGATTAACCAATTTTCCCCCACAAGATTACtTATATAGGTTCATTACACATGCATTTTGTAGCGAT
TGTATGTGTAACTAAGAGTTACACATGCATATTAGATGTGTAAcggctagttacacatgcgtattagatgtgtaactat
cgtttacatatgtcacatgcattgttttgtattcccgggaattc > SEQ ID NO:4176 109562 1190645_302178_1c
GGGCTGGTGGCTCTTTCACTGTCACCAGAGACTCCTCTGAGGTTCTTGTGACGTGGAACCAAAATCACTCTCTACCTGA
AGGAAGACCAGTTGGAGTATCTTGAGGAGAGGAGACTCAAGGACCTTGTCAAGAAGCACTCAGAGTTCATTAGCTACCC
CATCTCCTTGTGGACAGAGAAGACCACTGAGAAGGAGGTGAGCGATGATGAGGAAGAAGAGGAGAAGAAAGATGAGGAA
GAGGAAGGCAAGATTGAAGAAGTCGATGAAGAGAAGGAAAAGGAGAAAGAGAAGAAGAAGAAGAAGGTCAAGGAGGTGT
CCCATGAATGGTCGCTTGTGAACAAGCAGAAGCCTATTTGGATGAGGAAGCCTGAAGATATTGCCAAGGAGGAGTATGC
TGCCTTTTACAAGAGCTTGACCAATGACTGTGAAGACCATCTTGCTGTGAAACACTTCTCTGTTGAGGGACAGCTCGAG
TTCAAGGCTGTTCTCTTTGTCCCTGGGAGAGCCCCATTTGATCTCTTTGACACTCGCAAGAAGATGAACAACATCAAGT
TGTATGTCCGTAGGGTGTTTATCATTGGATAACTGCGAAGAACTCATTCCTGAGTACCTAGGCTTTGTAAAGGGTGTTG
TAGATTCTGAGGATTTGCCCCTCAA > SEQ ID NO:4177 109562 126052_300633_1c
TAAATCTGGAACTTCAGCCTTTGTTGAGAAGATGCAGACAAGTGGAGACCTGAATCTGATCGGACAATTTGGTGTTGGG
TTTTACTCGGTCTATCTTGTAGCTGACTATGTTGAGGTCATCAGCAAGCATAACGATGACAAACAATATGTCTGGGAGT
CGAAGGCTGATGGAGCATTTGCCATTTCTGAAGATGTATGGAATGAACCTCTTGGTCGTGGAACTGAAATTAGATTGCA
CCTTAGAGATGAAGCAGGAGAATACTTGGACGAGTACAAACTAAAGGACCTGGTGAAGAAATACTCTGAATTCATCAAC
TTCCCTATACATCTTTGGGCTAGCAAAGAGGTTGAGAAGGAGGTTCCTGCCGATGAAGACGAGTCAAATGATGAAGAAG
AAACATCTGAATCCAGCCCTTCTGAAGATGAAGAAGAAGATGATTCTGAGAAGGCAGAAGATGAGAAAAAGCCTAAAAC
TAAGAAAGTGAAGGAAACCACTTATGAGTGGGAGCTTTTGAATGATGTGAAAGCTATATGGCTTCGGAATCCAAAGGAG
GTGACAGAGGAAGAGTATACGAAATTCTATCACTCACTGGCAAAGGACTTCAGTGATGAGAAGCCCCTTGCTTGGAGTC
ACTT > SEQ ID NO:4178 109562 241523_301349_1c
AGTGGAGATTGAAAACAAGCCGAAAACAAAGAAAGTTAACGAAACACAGTGGGAATGGGAGTTGTTGAATGACGTGAAA
GCTATCTGGCTTACAAGTCCAAAGGATGTTACCGAGGAGGAGTACTCAAAGTTTTATCATTCGATCTCTAAGGATTACA
ACCCCGACAAGTCATGGAGTCATTTTTCTGCGGAAGGAGATGTTGAGTTCAAACCCGTGTTGTTTATCCCTCC
AAGGGCACCGCACGATCTCTACGAGAACTACTACAACAGCAAAGCGTCGTTGAAGCTTTACGTGCGACGAGTGTTTATA
TCCGACGAGTTCGACGAACTTCTGCCTAAATACCTCAACTTTTTGAAGGGCCTTGTTGATTCTGATACGTTGCCGCTGA
ACGTCTCTCGAGAAATGCTGCAGCAGCATGGCAGCCTGAAGACCATCAAAAAGAAACTTGTTCGCAAGGCTCTACACAT
GATTCGCAACATTGT > SEQ ID NO:4179 111048 1118543_301857_1c
gacaaaacaaaatgttagacttagcatcgaaattttaaagacacatacctcatcgttgcaggatagcgcaggctggatt
cAAAGAAGGTGATTTTACGAAAGGCAAAGTTATATACATCCAACAGCAGACCAGAGCAGTCAAACAAATGTACTGGGAT
TGATTGCTTCCTTGCATTAAATTCTGTAGGATTGACGCAGTTTGCACCTCATTAAAAGCCAGTTTACCAAGATGATGAG

FIG. 2 continued

```
CTATCTTGAAAAAGTTCTTTCCCCTAGGGAAGCACCTTCATCAAGTGGCGGTGGAATCAGTGAAGATGGGAAGCTCAGC
TATGGATATTCAAGCTTGCGTGGAAAGAGACCTTTCATGGAGGATTTTTATGAAGCAAAGATCTCTGAAGTTGAAGGTC
AAGTAGTTGGATTGTTTGGTGTTTTCGATGGGCATGGTGGACTCGCACTGCTGAATATGTGAAGAATCATTTGTTTGA
CAATCTAATCCAACATCCTCAGTTTCGAACTGATATCAAGACAGCCATTGCTGAGAGCTACAAGCAGACAGACATGGAT
CACCTAAAGGAGGAAGAGAAAGTGTATAGAGATAGAGATGCTGGCTCAACTGCATCAACGGCAGTCCTagttgGAGATA
AATTAACTGTGGCCAATGTTGGTGACTCCAGAGCTGTCTTATCTAGAGAGGGGATGGCTGTTgctGTTACAACAGATCA
TAAGCCTAATCGAGCCGATGAACggcaacGTA > SEQ ID NO:4180 111048 268631_200121_1c
AGAGTTCCCAACAAACACCAAGTTGGCCATAAGTGAAACATATCAACAAACAGACATGGACTTCTTAGATTCTGAAAAA
GATACCTTCCGAGATGATGGTTCCACTGCTTCAACAGCAGTTCTAGTTGGTAACCATCTCTATGTTGCCAATGTTGGAG
ATTCGCGAACTATAATATCGAAGGGCGGAAAAGCAATTGCTCTTTCTGAGGATCATAAGCCCAATCGAACTGATGAGAG
GAAGAGAATTGAAAGTGCCGGAGGTGTTGTGATGTGGGCTGGTACCTGGAGAGTTGGTGGTGTATTAGCAATGTCACGT
GCTTTTCGCAACCGTATGTTGAAGCAATTTGTTGTGGCCGAACCTGAGATTCAGGATCAAGAGATTGATGAGGAATTAG
AACTACTCGTGCTTGCCAGCGATGGGCTTTGGGATGTGGTACCAAATGAGGATGCTATTTCACTTGCACAAGCAGAAGA
AGAACCAGAAGCAGCTGCTAGGAAGCTAACAGAGACTGCATTTACTCGGGGTAGTGCTGACAATATTACCTGCATAGTG
GTGAAGTTTCACCACAAGAAGGTTGAACCAGAGGGGAGCCAGCAAGGTTGAAGAATTTGTTGATGCTGCATCTGCCTTT
TCCTGGTGGAAGGCTGCTTCAATG > SEQ ID NO:4181 111048FL 113586_300004_1c
TTATGGTACATGTTGCTTACTATAGTAGGCGGCTGAGGAGTGATTGAATTATATGGGTAATTTGTGTTGCTTCAATTCT
CTCTTCTCGCAGCTTGCAGGAGGACGGTCATTATGTAGTTCGGGAAAAGGAAGAAGCAATCAAGGGCCTACAAAGTATG
GTTTCAGCCTGGTTAAGGGGAAAGCTAGTCATCCCATGGAGGATTTCCATGTCGCTAAGTTCGTCCAGTTGCAAGGACG
TGAACTGGGACTTTTTGCTATTTATGATGGGCATTTGGGAGATAGCGTTCCTGCCTATTTACAGAAGCATTTGTTTTCC
AATATCTTAAACGAGGAAGATTTTCGGAATGATCCTCATAGGGCAATCTTAAAAGCATATGAGAGAACAGATCAAGCTA
TTCTTTCACACAGTCCTGATCTTGGAAGAGGTGGCTCTACTGCTGTGACTGCAATTCTTATAAATGGTCGTAAGTTATG
GGTAGCAAATGTTGGAGATTCCAGAGCAGTACTTTCTAGGAGGGGTCAGGCCATCCAGCTATCAATTGATCATGAACCA
AACACTGAGCGAGGCGACATTGAAAAC > SEQ ID NO:4182 111048FL 190467_300818_1c
ATCCAAAGTTCATCAGTGATATCAAGTCCGCTATCGCTGAAACGTACAACCATACAGATTCAGAATTTCTGAAAGCCGA
AAGTAGTCACACTAGGGATGCTGGCTCAACTGCCTCAACAGCTATTCTTGTAGGCGATCGCTTGCTGGTTGCTAATGTT
GGAGATTCTAGAGCAGTTGTTTGTAGAGGCGGGGATGCAATTGCAGTTTCAAGGGATCACAAACCCGACCAGTCAGATG
AGAGACAAAGAATTGAGGACGCTGGGGGCTTCGTGATGTGGGCTGGGACGTGGCGTGTTGGTGGTGTTCTTGCTGTTTC
TCGAGCATTTGGTGATAAGCTATTGAAGCAGTATGTAGTTGCTGATCCAGAGATCAAGGAGGAGATTGTCGATAGCTCC
CTTGAGTTCCTCATCCTTGCTAGCGATGGACTTTGGGATGTTGTAAGTAACAAGGAAGCTGTTGACATGGTGAGGCCTA
TTCAGGATCCCGAACAGGCAGCGAAGAGGCTTCTCCAGGAGGCGTACCAAAGGGGTAGCGCCGATAACATCACCGTTGT
TATTGTCCGCTTTTTGGAGGGAACAACGACTGGTGGTGGACCAAGTAGGGaggccgccaGCGACCAAAACTCATagttt
ctcccaggcagcagcATGgcttgttccTGTCTGTCATATCTGATGCtcaaggTagacgattac > SEQ ID NO:4183 111048FL 194319_300762_1c
GAAGGAACATGGCGTGTTGGTGGTGTGCTTGCTGTTTCTCGCGCTTTTGGTGACAAACTCTTAAAGCAGTATGTAGTTG
TGGATCCTGAGATTCGGGAGGAAGTTATTGATCACTCTCTCGAGTTCCTCATTCTTGCAAGTGATGGGCTGGGGGATGT
AGTAACCAATGAGGAGGCTGTCGACATGACCAGATCGATTCATGACCCAAAAGAAGCTGCAAAGAAGCTCTTGCAAGAG
GCCTACAAGAGGGAGAGCAGGGACAACATAACTTGTGTTGTCGTGCGCTTCTTGCATGGGCAAGGGAGTAGTGGATATG
CTTAAAAAACAACTGGTAAAAGTTACCCAATGTAGTTGTGTACCACCATGTATACATGTTTTAATTCAAATCTCACGGG
GTTAAATGGGGAGAAACTCGGAGTAGGATACGTGTATTCTGATGGCTGAAGTAAGCTGAAGGGTGAGTATGCCTTAGGT
TAACAA > SEQ ID NO:4184 111048FL 245744_301571_1c
acgcgtcggatcgattgaATGGAGCAGTAGCGGGTATGCGATAAATCGATCGATCCATCGACTAGTTCTTGCCCTTCCA
TTGATACCATGATCATCAGCGGCAGTGGAAGCGGCTCGGGCATCCCCATTCTCAAGAGGAAATGTCGCAGCCGTCGGC
GCAACTGCGGGCGAGGCCACAGCGTGGCGAGAGCTCCAAATGCCGGTATGGGGCAgcgATGGGGGAGAACTTGCTGGCC
CATGGATTCGAGGACCGGCACTATGCCCGGATCATCCACAGGAATGGGATGGAGATATCCATGTTTGGGGTGTTTGACG
GGCACAAGGGACCCGAGGTGGCAGATTACTTGCGGCATCATCTCTTTGATTCCATTCTGGATCATCCTCTCTTTGCTGC
CAATCCCAAGCAGGCGATCACCGAGTCGTACTTGGCTCTAGACAAGAGGATCTTGGAAATGGGAACCGTGATCAGGAGA
TCTGGCTCCACAGCCACGACTTGCATCCTCTTGGATGGATCCAGGCTCATCGTCGCAAACgttgGAGATTCGCGAGCGG
TGCTGTGCCGCGgTGGTGAGGCCGtGGTCGTCTCCGTGGATCACGACCCGAAAAAGCCGGAAGAGCGTGAAATGGTGGA
```

FIG. 2 continued gtcCAAAGGTGgcgAAGTTTGCATGACACTCGgtg

> SEQ ID NO:4185 111048FL 283956_200239_1c
ATGAATTTTCATGATTGATTCTGAGCTCAACATTAGATCTGACATTTTCTTGGCAGCTCAATTGCAAATCTTGAAATGA
AAGTTTGGATTTTTGGTGATAATTAAGCAATTGCATATCGGGTAAAATCAATTCAGAGGAGTTACAGTAATGGGGTATT
TGAATTCAGTATTATCATCATCTTCTAATCAAGTTCATGCTGATGATGCGCCTGTTAGTGGTGGTGGTCTAAGTCAGAA
TGGGAAGTTCAGCTATGGATACGCTAGCTCCCCGGGAAAAAGGTCCTCCATGGAGGATTTCTACGAGACAAGAATTGAT
GGTGTAGAAGGAGAGGTAGTTGGTCTCTTTGGAGTGTTTGATGGACATGGGGGTGCTCGGGCCGCAGAATATGTGAAAC
ACAATCTTTTCAGCAACCTCATAAGGCATCCAAAGTTTATATCAGACACCAAATCAGCAATAGCCGATGCATACAGCCA
TACAGACTCTGAATTTCTGAAATCAGAAAACAATCAGCACAAAGATGCTGGATCGACTGCTTCCACTGCCATTCTTGTA
GGTGATCGgTTACTGGTTGCAAATGTTGGTGATTCCagAGCTGTTATCTGCAGGGGAGGCACTGCTATTGCTgtttCTC
GAGACCACAAGCCTGACcaaAcAGATGagcGACAGCGCATt > SEQ ID NO:4186 111048FL 260893_301718_1c
gAGCGATGTGTCTCCGGCGATTGATCCGTACAAAGACCCCGGAAGAGCGCGAGGTTGTCTATGGGACATCGTGCGTCAA
GGGCAGATCCTCGCATCCTATGGAAGATTTCCTTGTCGCCGACATTAAGGAGGTGAGAGAGGACGATCAAGTACACGAT
CTTGGGCTGTTTGCCATCTATGACGGCCATCTAGGGCACAATGTGCCGGCGTATCTCCAGAAGAATCTCTTCGATAACA
TTCTCAATGAACCAGGATTTTGGAATGATCCAAGGACTGCCATCCGGAAAGCGTACGAGAGAACTGACAAGACTATCTT
AGAGAAGTCGATGGACTTGGGGATCGGCGGATCCACAGCAGTCACAGCAATACTGGTCGATGCTTCTCACCTCCTCGTC
GCCAACGTCGGTGACTCTCGAGCTGTTCTCTCTCGAGGAGGAGAAGCACTGCAACTCTCGGTTGATCACGAGCCAGGAC
AGCCAGCCGAGAGACACAACATCCAGGAGAAAGGTGGATTTGTCCTCAAACTTCCAGGTGATGTCGCTCGAGTGGATGG
CCAACTTGCTGTGGCTCGAGCTTTTGGTGACAAGAACCTCAAGGACCATTTAAGCGCCGATCCAGACATTAATAAAGTT
TCCATCGAGCCCAAGGACGAGTTCCTGATACTTGCCAGCGAaggccTCTGGAaGgTGATgaacaaccaggaagcagtgg
atctTATTcgcaaAATTAAaGaTCCAcagcacgcgggagaaAAactgacgtCGCAaGccg > SEQ ID NO:4187 111048FL 33249_300390_1c
CCCACGCGTCCGTTCTTGTAACAATGGCAGGCAGAGAGAGGCTCCATAAGATGAAGGTTGGATTATGCGGATCTGACAC
AGGCAGAGGTAAAACCAAGGTGTGGAAGAACATCGCACACGGTTATGACTTTGTGAAAGGCAAAGCGGGCCATCCGATG
GAGGACTATGTTGTGTCTGAGTTCAAGAAAGTAGACGGCCATGATTTGGGTTTGTTTGCTATCTTTGATGGTCACTTAG
GGCATGATGTAGCCAAGTACTTGCAAACCAATCTCTTTGATAACATACTCAAAGAGAAGGATTTTTGGACTGATACGAA
AAACGCTATAAGGAATGCATACATATCAACCGATGCTGTGATATTAGAGCAGTCACTTAAACTTGGCAAAGGTGGATCA
ACGGCTGTAACAGGCATTCTGATAGATGGGAAAACGCTAGTGATTGCTAACGTTGGAGACTCACGTGCAGTGATGTCAA
AGAACGGTGTTGCTTCTCAACTCTCTGTTGATCATGAACCAAGCAAGGAACAAAAGGAAATAGAAAGCCGTGGTGGCTT
TGTATCAAATATTCCAGGGGATGTTCCAAGAGTTGATGGACAACTAGCGGTTGCTAGGGCGTTTGGAGATAAGAGCTTA
AAGATACATCTGAGCTCAGATCCAGACATAAGAGACGAGAATATCGATCATGAGACTGAGTTTATCCTTTTCGCAAGTG
ATGGAGTTTGGA > SEQ ID NO:4188 111048FL 249987_301597_1c
GCGTTGTTTGCTTCCCCATTCTTCCTCCTCTCCTCTTTGTGGAATAAGCTGTGTGGCAAGGAAGGAGAAGGAAGTTGGA
CAAGAGACGCAATCGTTGCCGAGGTTAGATCGACGCCAGTTTGATCCATTTCGCCCTAGACAGCTCAATTTTGCCAGAA
AGAGAGATTTTTTGGGACTATGACAGCCTGACTGAAGGGGAAAGAGAAGATGAATGGGCCTTGGAAGGAGAATTTTAGT
GGTGGTGGGTTCAGTGAAGATGGCCGATTTTCGTTTGGATACTGCGGGCACTGTGGGAAAAGAGCTTCAATGGAAGATT
TCATTGAAGCCAGGATAGCCAAAGTTGAGGGTCAAGAAGTTGCCCTCTTTGGAGTGTTTGATGGCCACGGAGGACCCCG
AGCTGGCGAATTCGTGAAGAAGAACCTCTTCCAGAACGTGATCAGCCATCCGCAATTTACAAGCGACATCAAGTTCGCC
ATTTCCGACACTTACAAGCAAACGGACGACGACTATCTAAAAGACGAG > SEQ ID NO:4189 111048FL 235011_301223_1c
GACCGGATCTCCACCGCCATCACCCTCGATGCCGTTGATACAACATACCATCGTCGAGATCCCCACCACCACTGCCTCC
ACCTCCGCCACCGCCAGCGAGAGATGTGCTTGAGACTGCGCCATCGGGCGCCCGCAGATTCTCACGCGGGCAAGGGGAA
GAGCAAGCAGTCGAAGCGGAGGATCCAGCATGGTTTCTCCTGCGTCAATGGTGCAAGGCCAGCCACCCCATGGAAGATT
TCTATGTTGCCGAGTACCAGATGCATAGGAACCACGAGCTGGGCTTGTTCGCCATCTACGACGGCCATCTCGGCCACAC
TGTTCCCGATTACTTGAAGCGCAATCTCTTCAGCAACATTCTAAAAGAGCCGGGGTTCTTTACGAACCCGACGAATGCG
ATACGGAAGGCGTACCAGGAGACGGATCAGACAATCCTGGCCAAGGCGCCGGAGCTGGGATCGGGAGGGTCGACTGCAG
TGACTGCAATTTTGATACGGAGTAAGGTTACTGGTGGCGAATATAGGAGACTCCCGCGCCGTGTTGAGCGAGGGCGG
ACGGGCCCGGCAGCTCTCGGTGGATCACGAGCCGAGCAATGCGTCGGAGCACAAGAACATCCGGGACAGAGGTGGTTTC > SEQ ID NO:4190 111048FL 225005_300983_1c
AAATCGATTGAGCGAGAGGAGATCGGTCTCGGCGAAGCAAGCGATCGATCGATCGGCGGCGGCGAGGTAGGGGGTTCGA

FIG. 2 continued

TTGGGCAGGGATTTAGATCGCGACGGGAGAGTGCGCTGGGGGATGCCGGTTTTGGGTCAGCTGTTGCCAAGAAATCATG
CGGTGCTTGACGGAAGCGTTCATCCCGAGTGATTCGCGGACGCCGGTCAGCGGCAGCGGGCTAAGCGAAGATGAGCGAT
TTAGCTATGGATATTCGAGCCTTTGTGGGAAGAGGATGTCCATGGAGGATTTCTACGATGCTAGAATCTCTAAGATTGA
TGATAATGTGGTGGGTTTGTTTGGAGTTTTCGATGGACATGGCGGGTCTGAGGCTGCTGAGTATGTGAAAAAGAATCTT
TTCGACAACCTTACAAGGCACCCTCACTTTGTAAGCAACACAAAGCTTGCAATTGAGGAGGCATATAGGAAAACCGATG
CGGATTATTTACACAATGGTCCCGATCAGTGTGGCTCCACAGCTTCTACAGCTATTTTGGTTGGAGATAGATTACTTGT
GGCCAACCTCGGTGATTCACGAGCTGTGCTATGCAAGGCTGGCGAAGCcgttCCtttATCCAACGATCATAAgcCAAAT
CGATCGGATGAG > SEQ ID NO:4191 111048FL 196275_300707_1c
TTCTTCTTCCTCCTCCGTCGTTCGCGTGCATGCGTGAGGTGCTCCTCCTCGGCTCGTTGGTGGTTCTCGCCTTGTTGTC
GCTGTTCCCGTGCTGCTCCTGTCTCTCGCAGGGAGCGGAGGAGGAGGAGGACGACGGCGAGGTGCGCTTGATGGGGCTC
GCCGGAGAGGCCGCTGGCTCGCCTGGCAGTGGCGGCGGGTTCAGTGCAAATGGTAAATTTAGCTATGGTTATGCGAGCT
CTCCTGGAAAAAGATCCTCCATGGAGGACTTCTATGACACCAGAATTGATGGTGTCGATGGAGAGACCGTTGGACTGTT
TGGTGTCTTTGATGGTCATGGTGGAGCTCGAGCAGCAGAATTCGTCAAGCAGAACCTCTTCACCAATTTAATCAAGCAC
CCAAAGTTATTCAGTGATACCAAGTCTGCAATTGCTGAAACTTACACTAGCACGGACTCTGAACTTCTGAAAGCTGAAA
CCAGCCACAATCGAGATGCAGGGTCGACTGCCTCCACTGCAATTCTCGTAGGcgACCGTCTGCTCGTTGCAAATGTTGG
AGATTCTAGGGCTGTCATTTGTAGAGGAGGAGATGCTATAGCTGTGTCAAgagacCACAAGCCTGATCAGtcagacGAg
agGcagAGGatagaggaTG > SEQ ID NO:4192 111048FL 161955_200257_1c
GACAAAGAGCTTCTCTCTAATGGATAACGAAGTTGTCCACTATTCGAGTGGGGCTGTAGGTGGATCGAGCTCTAATTGT
AGGTGCGAGCTTCAGACTCCGCAGTGTGATACCGTCGGGTCAACCGCTGTTGTCTCGGTGGTTACTCCTGAGAAAATTA
TTGTTTCCAATTGCGGTGATTCTCGTGCTGTCCTTTGTAGAAATGGTGTTGCGATTCCTCTTTCCATTGATCATAAGCC
TGATCGACCAGATGAATTGAATCGGATACAAGAGGCTGGTGGTCGTGTTATATATTGGGATGGACCAAGGGTACTTGGA
GTTTTAGCTATGTCACGTGCAATTGGTGACAATTATTTGAAACCATATGTTATATCGGAACCAGAAGTGACCATCACAG
AACGAACCGATGAAGACGAGTGTTTGATATTAGCCAGCGATGGACTATGGGATGTTGTCTCAAACGAGACCGCTTGCGG
CATTGCTCGTATGTGCTTGCAGTCAAGGAGGCCACCGTCTCCACAGGGTTCGCCGGAAAATGACATCAGTGTGACCAGT
GCCGGAGAGAGCTCCGACCAGTTGTGTTCTGATGCATCAAT > SEQ ID NO:4193 111048FL 1190691_302178_1c
GATGGATTCTGGGACAATCCGTTAGTGGCGATGTCAAGGGCATATGAGCAGACGGATAAGGCTATTTTAACACATGCTC
CAGATTTGGGCATGGGTGGTTCCACTGCTGTCACTGCTATTTTGATCGATTGTACGCATCTCTTTGTGGCCAATGTGGG
CGACTCGAGAGGTGTTATATGCCGAGGTGGGGATGCTATTCAGCTCACTGTTGATCACGAGCCCAACATGGAACGCAAA
ACCATCCAAAGAAGAGGTGGTTTCGTCACTACTTTCCCAGGTGATGTGCCTAGAGTGGACGGGCAGCTGGCAGTCGCAC
GTGCATTTGGCGATAGGAACTTAAAGTGCCATTTGAGTGCTGATCCGGACGTGCAACGTTTGGTGGTGGATGGAACCGA
TGAGTTTTTTATCCTCGCAAGTGATGGATTATGGAAGGTAATGGATAATCAAGAGGCAGTGGAGCTGATAAGGAAGGTG
AGGGATCCAAAAGTAGCTGCCAAGCGATTGGCAGATGAAGCAATTGCAAGGCGCAGCACTGATGACATTTCATGCATTG
TTGTTCGATTTAAGTAGAGAAAAAAGAGAGAGAGAGACTTTTAAATGGGCTACTATTGTCCAAACATAAATCCTATTTT
TTGTACATATGTATGTATT > SEQ ID NO:4194 113072 1173756_302076_1c
TAACCAAAAGTGAAGCATGGCTACCGTAGAGGCAGTAAAGCCCTGTGATGATGTACCCAAAGTAGAGACCTCCCTCCCT
CCTCCTCCTCCTGTCAAAGAGGAGGTAAAGCCAGTAGAAGCTGAAAAAGAGGCAGCTCCCGAGGTTTCCAAGCCAGTAG
AAGCTTCCGCTGATGTCAGAACTCCAAAGGATCGCGATGTGGCCCTaGCCAAGGTGAATCGGAGAAGAAGCTAGCTCA
GATCAAGGCTTGGGAGGAGAATAAGAAATCTAACTCCCTCAACAAATATCAATGTGAGGTTTCTAAAATTGATGCTTGG
GAAAACTCAAAAAAGGCTAGTGCTGAGGCGAAGCTCAAGAAAGCTGAGGAAGCGTTGGAGAATAAGAAGGCAGCCTATG
TGGAAAGGATGAAGAATGAGATTGCAGCCATCCACAAGCTGGCAGAGGAGAAAAGGGCAGCTGCAGAGGCCAAGAAGGG
TGAGAATCTTGTTCAGACAGAAGAAACAGCTGCCAAATACAGGGCCTCGGGTGAGATACCGAAGAAGATGATGTGCTTT
GGAGGTTGATTCTTCATATCTCTCTCACATTTAACTATGGGGAGGGTTCCTTCATATGCAAGAATATCACATTGGGCA
TTATAGTCAATGGGATATCCACAGTACTAGAGCTATTgttTTTGATTTTTCACTtagaTTTgtgTGAATGTATTTGGG
TAgaCTATGATATTttgctTTGGGTATATATTCCTttccATGAAAGACATGATTAttgcgaaccatcGAAATGCTttg
ttaGGTAttcAATGAATGATTgTatCATGc > SEQ ID NO:4195 113072 286126_200182_1c
AATTTTCATTAATGATGGCAGAAGAAACAGCTAAGGATGTTGCCGATGATAAAGCCATCGTTCCATTTGCTCTTCCTTC
TTCTAAAGAAGAAAAAGACAAATCCAATGACTCAAAACCTCTTGCCATCGTCGAAACTAAAGCATTAGTACCTGTTGAG
AAAAGAGGATCTATTGATAGAGATGCAACTCTTGCACGATTTACGACAGAGAAGAGGTTGTCCCTAATCAAAGCATGGG

FIG. 2 continued

AAGAAAGCGAGAAATCAAAAGCTGAAAACAAAGCTCAGAGAAAGCAATCTGAAATCCTTGCATGGGAGAACAGCAAGAA
AGCAAGCTTGGAGGCTGAGCTCAAAAAGATTGAGGAGCAATTGTTGAAAAAGAAGGCAGAGTACATTGAGAAAATGAAA
AACAAGATTGCTCTACTCCACAAGTCAGCAGAAGAAAAGAGAGCGATAATTGAAGCTAAACGTGGAGAAGATCTTCTTA
TGGCAGAGGAAACAGCAGCAAAACACCGTGCCACTGAAACTTCTCCAAAGAAACCTCTCCTTGGATGTTTTTGAAGTGG
CAAAATATCATATACTCCTATACAATTATTGGTTACAAACATTGTATAGTGAAGTGTGCGGACTGGGAATTTCTTTGCA
TTAGAAACAACATTGTGAGATTATGCTCCTGGAGATAATTATCTGTCAATTTTTATTG

> SEQ ID NO:4196 113072 279832_200065_1c
tttttggattccttctatttatataaataaatatattcgtttaacaatatggcagaagcaattccagtacctcaagaac
cAGCTGTTGATAGTTCTCCAGCTGCCATGGCTACCAAAGCTGATGATTCTAAAGCTCTCGCCACTGTTCCTCCACCAAA
GACTGATTCTTCAACAAAGAAGAGTTCAAAGGGATCCCTCGATAGAGACATTGCTCTCGCACACCTTGAAACAGAGAGA
AGGAATTCTTATATTAAGGCATGGGAAGAAAGTGAAAAAGCAAGGTGGAAAACAAGGCCGAAAAGAAGCTCTCTGCAG
TTGGGACATGGGAGAACACCAAGAAAGCAAATCTTGAAGCTAAACTGAAGAAACTTGAGGAGCAACTAGAAGAAAAGAA
AGCAGAATATGCGGAGAAGATTAAAAATAGAGTAGCCGCAGTTCACAAGGAGGCTGACGAAAAGAGAGCTATGGTTGAA
GCCAGAAAGGGAGAAGAACTTCTTAAAGCAGATGAGATGGCTGCCAAGTATCGCGCCACCGGACAAGCCCCTAAGAAGT
TGCTTGGATGCCTTGGATGCTAAAGCTGTGAAAAGTTTGTTTCTCTTTTGTAAATTTTCAGGCTTGTTGCTCTTTATTG
GGTGTTTCAAACATGTCGAGTTTCCTATTTGTGTATGAAAAGCACTCATGAAAATTTTAAGTGTTACGATAATTATAAC
TCcACttCAGATGTTTCTACTAga > SEQ ID NO:4197 113072 272630_200131_1c
TTCCTTTTTACATACAATACAATAGAAAGAATAAAGCACTCTAATTCTTTTTCTCCTTTTCCTTCATTTTTGAGTATTG
CTATAGTGAATTTGATTTCCCAATTCTTTTGTGGAAATCACCTTTTTGTCTATATATATATATAATTGACCAAAATGGA
AGCTACACAACAGCAATAGCCATGGCCGCCAACAATTCTAAAGCTGTCACCACCATGCCACCACCTCAAAGGCCCAGAA
GAAGCTCTCTAAAGTTGCAGCATGGGAAAACAGCAAGAAAGCACATCTTGAAGCTAAACTGAAAAAACTTGAGGAAAGA
TTAGAGAATATGCAGAAAAGATGAAAAATAGAGCAGCTTTAATTCACAAAGAGGCAGAGGAGAAGAAAGCGATGGTTAA
AGCTAAACGAGGGGAACAAATTCTTAGAACGGAGGAGATGGCTGCTAAATATCGCGCCACAGGACAAACTCCTAAGAAG
TTACTTGGATGTGTGGGATGATTAAAGCTTTTCCCTTGTATATTTTCATGCTTGCTGCTTTTTAGTGTGTGTTCTTTTA
CGCATCAAGTTTTGTTGTAAGCTTCTAGTCTGTAAAGGATCTTACTAGTCTGCATAGGACAAACTCTCTTGTGCTCTAA
GGAATCCAGTGTCAATGATAATAAATCCACTTGAGAAGTTTTCGCAAA > SEQ ID NO:4198 113072 270343_200125_1c
gggcggacgcgtgggcggacgcgtgggaaaAGATCTTTCATCTTTCATTTCTGAGACTCTGATTCTGTTCCAAATCCTA
GAATTCTTCTTTTTTCTGAATTCTGTTTGTAGCCATGGCAGAAGTAGAAGCTACGAAAGTGGAGACTGAGAAAGTTGTG
GACCCTACTCCCCCTGCGCCTGAGGCTCCTGCACCTGTTAAAGAAGCAGAACCTGTTGTTGAAACTCCTAAAGAAGTGG
CTGATGAGAAAGCTATAGTTGCACCAGCTCTGCCTCCCCCTGAACAAGTCAAAGAAAAATCTGATGATTCTAAAGCACT
AGTTGTCGTAGAAGATAAAGCAGCAGAACCTGCTGAGGAGAAAAGGAGGGATCTATTGACAGATGCTGTGCTTGCT
CGAGTTGCAACAGAGAAGAGACTCTCACTAATCAAAGCATGGGAGAAAGTGAGAAATCAAAAGCCGAAAACAAAGCTC
AGAAAATGTATCTGCAATTGCTGCATGGGAGAATAGTAAGAAAGCAAACCTGGAGGCTGAGCTCAAAAAGATGGAGGA
GCAGCTGGAGAAAAAGAAGGCAGAATATATTGAGAAAATGAGAAACAAAATCGCTCTACTCCACAAGGAAGCTGAAGAA
AAGAGAGCGATGATTGAAGCTAAACGTGGAGAAGATCTTCTTAAGGCAGAGGAATTGGCAGCAAAATACCGCGCCACTG
GAACTGCTCCCAAGAAACTCCTTGGATGTTTTGAAGCAGCAAACATTAGACCTGCATCGATGGTGATTGAAAATGCTT
TTGTAAAGTTTGTGCAATTGGAATTTTTTCTTCTTATTAGATACATTGTGTGATTATGTATTTTAGAATCAATCATTG
TTTATTATTATGTGTGCATAGTGATGTATTCCATTGTAT > SEQ ID NO:4199 113072 258923_301701_1c
GCAGCATGGCGGAGGAACAGAAGATAGCGTTAGAATCAGAATCTCCGGCGAAGGTTACGACTCCTGCTCCAGCAGATAC
ACCGGCTCCAGCTCCGGCAGAGATTCCGGCTCCAGCTCCAGCTCCGACTCCGGCTGATGTCACGAAAGACGTTGCAGAG
GAGAAAATTCAAAACCCACCTCCGGAGCAAATTTTCGATGACTCCAAAGCCCTTACTGTTGTTGAGAAACCTGTAGAAG
AGCCTGCACCGGCGAAACCTGCGTCTGCATCGCTCGATAGAGATGTTAAGCTAGCTGATTTGTCAAAGGAAAAGAGATT
GTCTTTCGTCAGAGCGTGGGAGAAAGCGAAAAGAGCAAAGCAGAGACAAAGCTGAGAAGAAGATTGCAGATGTTCAT
GCTTGGGAAAACAGCAAGAAAGCAGCTGTCGAAGCGCAACTCAAGAAAATCGAGGAGCAACTAGAAGAAGAAGAAGCAG
AGTATGAAAGAGGATGAAGAATAAGGTTGCAGCGATTCACAAGGAAGCAGAAGAGAAGAGCAATGATTGAAGCTAA
GCGTGGAGAAGACGTTCTTAAAGCAGAAGAAACGGCTGCTAAATACAGAGCCACTGGAATTGTTCCAAAGGCAACTTGT
GGATGtttctaataa > SEQ ID NO:4200 113072 230307_301056_1c
GGTGAATGGCCCACTTTTGATCCTGGCTCGCCATTTATCTTCCCCAATCCACATCCTCAAGAGCTCGGCTTTTGAAGCA
GAATGACGGAACAAGCGGTTCCCGCGGCGCACGCTCCAGTGGACAAGAATGTCACCGAGACACCCAGCCCGAAGTCGGT GATTGGAACGAATGCCAACAGCCCCCGTCGCCGACAGATGCCCCTGCTGGAGAAACCCACGCTCATGCCGCTGCTGCT
CATCCTGAGGCTACTCACGCGAAGACTGTCGGAAGTCCCACCGTCAGCAAGAATTCGCTCGGGTCCTCATTGAAGACCG
ATGGAGGCGGATCCATGGATAGAGATTCTGCTCTCGCCAAGGTCCAAAACGAGAGGACAATGTCTAACGTCAAGGCCTG
GGAAGAGAGCCGCAAAGCCAAAGCCCACAACAGGTGCGCTGCAGTGATTGCGAAGATCGGTGCCTGGGAGGCCGCGAAG
AAGGCCGCGTCCGAAGCAAAATTGAAGCAGTCAGAGGAAAAACTCGAGAAGAAAAGAGCCGCACTCGTGGAGAAGATGC
ACAACCAGATAGCAGCCGCACACAAGTTGGCCGAGGAGCGACGAGCTCTG > SEQ ID NO:4201 113072 191556_300786_1c
ccccggctgttattagtacgcgccaccacgacgcccacgcacatcatcccTCCGCGCAAAAGCCTATCAACAGCTAAGC
CAAACAGGGTCAGGAGCCGGAGCCGTCCGGGAGAGGGAACACTCGAGCGATCCGTCCGTCCGCCCGCCCGTCGTCGTCG
CGCGCCATGGCTGAGGAGGAGGCCAAGAAGGTGGAGGTGGAGGTCACCGAGGCGCCACCCGCCGCTGCCGCTGCCGCGG
AGACGGAGCCGGCTGCCAAGGACGTCGCCGAGGAGAAGGCCGTCATCCCCGCCCCCGCCGCCGGCCGGAGGAGGAGAA
GCCTCCCGTCGACGACTCCAAGGCGCTGGCCATCGTCGAGAAGGTTGCAGATGAACCTCCTGCCGAGAAACCTGCTCAA
GGGGGCTCTAATGACAGAGATGTTGCTCTTGCAAGGGTGGAAACTGAGAAGAGGAACTCATTGATCAAAGCATGGGAGG
AAAATGAGAAGACAAAAGCTGAGAACAAGGCTTCGAAGAAGCTATCTGCTATTCTTTCCTGGGAGAACACAAAGAAAGC
AAACATAGAAGCTCAACTGAAGAAGATTGAGGAGCAACTGGAAAAGAAGAAGGCTGAATATGCAGAGAAGATGAAGAAC
AAAGTCGCGATCGTCCACAAGGAAGCTGAGGAGAAGAGAGCAATGGTCGAGGCAAAGCGCGGCGAGGAAGTCCTAAAGG
CCGAGGAGATGGCAGCCAAGTACCGTGCCACCGGCCATGCTCCCAAGAAACTCATCGGGTGCTTTGGGGCCTAAAGAAA
TTTTCGATTCACAACGAGCAAACGTGAAAGTGTTCATCAGTGGTTGCTTTGCTTCTTTCACCCTCCCAAGTGCGTAGTG
TGTTTGTTGGTGCAAGAAAGGTCGTGCCTGGTGTGTAAAGTCTGGTGTTGCTGTATATAACATATTACTCCCAAGACAG
ATATGTTTGGTGCTGTACATGTTTGATGCTTGACAGGCAACATTCTTATGTGTAGTTAAGaAGCCACATTGttATTgtt
ATTgacAGTAAGCTGttTgttcc > SEQ ID NO:4202 113072 186830_300667_1c
cccGAACACTCGAGCGATCCGTCCGTCCGCCCGCCCGTCGTCGTCGCGCGCCATGGCTGAGGAGGAGGCCAAGAAGGTG
GAGGTGGAGGTCACCGAGGCGCCACCCGCCGCTGCCGCTGCCGCGGAGACGGAGCCGGCTGCCAAGGACGTCGCCGAGG
AGAAGGCCGTCATCCCCGCCCCCGCCGCCGGCCGGAGGAGGAGAAGCCTCCCGTCGACGACTCCAAGGCGCTGGCCAT
CGTCGAGAAGGTTGCAGATGAACCTCCTGCCGAGAAACCTGCTCAAGGGGGCTCTAATGACAGAGATGTTGCTCTTGCA
AGGGTGGAAACTGAGAAGAGGAACTCATTGATCAAAGCATGGGAGGAAAATGAGAAGACAAAAGCTGAGAACAAGGCTT
CGAAGAAGCTATCTGCTATTCTTTCCTGGGAGAACACAAAGAAAGCAAACATAGAAGCTCAACTGAAGAAGATTGAGGA
GCAACTGGAAAAGAAGAAGGCTGAATATGCAGAGAAGATGAAGAACAAAGTCGCGATCGTCCACAAGGAAGCTGAGGAG
AAGAGAGCAATGGTCGAGGCAAAGCGCGGCGAGGAAGTCCTAAAGGCCGAGGAGATGGCAGCCAAGTACCGTGCCACCG
GCCATGCTCCCAAGAAACTCATCGGGTGCTTTGGGGCCTAAAGAAATTTTCGATTCACAACGAGCAAACGTGAAAGTGT
TCATCAGTGGTTGCTTTGCTTCTTTCACCCTCCCAAGTGCGTAGTGTGTTTGTTGGTGCAAGAAAGGTCGTGCCTGGTG
TGTAAAGTCTGGTGTTGCTGTATATAACATATTACTCCCAAGACAGATATGTTTGGTGCTGTACATGTTTGATGCTTGA
CAGGCAACATTCTTATGTGTAGTTAAGAagCCACATTgttATTgttATTGACAGTAAGCtgttTgTTCTTTT > SEQ ID NO:4203 113072 142482_300435_1c
CCCGAGTTCGTGTGCTTCTCTCATTTGTTCCTTGATATATGGGCTACGTCGTCAGAGAACTCGTGCAGATAGCTTCTTT
GGCTGAGTTGTTGGAGATGGCGGAGGTGGCGCCGCCGGCGCCGGCGCCGGAGCCGACCAAGGACATCGCCGAGGAGAGG
GCCGCCGTGCCGGCGCCGGAGGAGTCGAAGGCCATGACCGTCGTCGATGATGCTGAGAAAGCTGCAGCAACAGGTGGCT
CACACGAAAGAGACGCTCTCCTGACGACGGTCGCCACGGAGAAGAGGATATCGCTGATCAAGGCGTGGGAGGAGAACGA
AAAGGCCAAGGCCGACAACAAGGCGGCCAAGAAGTTGGCCGACATCGCCTCATGGGAGAACTCCAAGGTGGCCGAGATC
GAGGCCGAGATTAAGAAGTACCAAGAGTACCTGGAGAGGAAGAAGGCAGAGCAGGTGGAGAAGCTGATGAACGGCGTGG
CGAAGGTGCACAGGGCGGCGGAGGAAA > SEQ ID NO:4204 113072 138543_300774_1c
gctgtttgttttggcgataccatttgcatggcttgcccagcatcgtcgtcgtcgtcgggagcaaggaggaggagag
aCCATCGATCTTGATTGATTTGAAGCTAGATGGCGGAGGAGGCGAAGAAGGTGGAGGTGACCAAGGACATCGCCGAAGA
GAAGGCAGTGGTGCCGCTGCCGACGCCGCCGGCCACCGAGCACGACGACTCCAAGGCCATCGTCCTCGTCAAGGAAGCT
GAGGCTACAGGAGGTTCAGCTGAAAGAGATGCTTATCTCGCAAAAATTGTGTCGGAGAAGAGATTGGTACTGATCAATG
CCTGGGAGGAAAGCGAGAAAGCTAGAGCAGAGAACAGGGCGGCCAAGAAGCTGTCATACATCACTTCATGGGAGAATGC
AAAGAAAGCAGAGATGGAGGCTGAGCTGAAAAGGATCGAGCAAGAACTGGAGAAGAAGAAGGCGGCGTACGAAGAGAAG
CTGAAGAACAAGCTGGCATTGCTGCACAAGACGGCGGAGGAGAAGAGGGCGCTCACCACGGCGAAGCGTGGCGAGGAGC
TGATCATGGCGGAGGAGATGGCCGCCAAGTACCGTGCAAAGGGCGAGGCTCCGACGAAGCTGTTCGGGCTCTTGAAAGC
CTGAGAGAAATCATGAGGAGTTCATCATACATATATGCTGGGATTTGGTGTTGTTGATTAGTCTGTGAACTTACAGAAA
TTTGTATATGTGCAATGCATGGCATCCGTGTTTGCGTCGTGTGTATGTCGTCTAATTGAAGGGCCATTTGGTTTGTATT
TTGTCAGTTGGGTGGTTTGATTTCTGGTGCGTTTTGTAAAGGAATTGTGTATATGCATAGGGGAGTGCAGGCAGGGGAT

FIG. 2 continued

```
GATGGATTATGAATACGCTTATTCTTTCATGAAGATTTgttAGTAATTAAACATTCGTTAATTgttGTATTTTTTTCAA
AATAACTgctTaGgttgCTCCTTTTTCTCTgttg > SEQ ID NO:4205 113072 135472_300414_1c
tgatatatttgctacgtcgtcggagaacTCGTGCAGATAGCTTCTTTGGCTGAGTTGTTGGAGATGGCGGAGGTGGCGC
CGCCGGCGCCGGCGCCGGAGCCGACCAAGGACATCGCTGAGGAGAGGGCCGCCGTGCCGGCGCCGGAGGAGTCGAAGGC
CATGACCGTCGTCGATGATGCTGAGAAAGCTGCAGCAACAGGTGGCTCACACGAAAGAGACGCTCTCCTGACGACGGTC
GCCACGGAGAAGAGGATATCGCTGATCAAGGCGTGGGAGGAGAACGAAAAGGCCAAGGCCGACAACAAGGCGGCCAAGA
AGTTGGCCGACATCGCCTCATGGGAGAACTCCAAGGTGGCCGAGATCGAGGCCGAGATTAAGAAGTACCAAGAGTACCT
GGAGAGGAAGAAGGCAGAGCAGGTGGAGAAGCTGATGAACGGCGTGGCGAAGGTGCACAGGGCGGCGGAGGAGAAGCGA
GCGGCGACGGAGGCGCGGCGAGGGGAGGAGGTGGTGAAGGCCGAGGAGGCCgCAGCAAAGTACCGCGCCAAgGGAGAGC
CgcccaAGAaGTTGCTCTTCGGTTGAATCTCTTCTCGGTCATCTccATTGATCGTCGtc > SEQ ID NO:4206 120624 146170_200014_1c
agcaaagctggctgttgggtccaacggagcagaagaagaagaagtatgtggatcttggttgtattattgtgagtcggaa
gATTTTCAAGTGGACTGTGGGCTGTATTCTTGCCGCTGCGCTTTTAGCTGGATTCATTACTATGATTGTTAAGCTTGCA
CCTAGACACAAACACCACAACCCCCCACCTGATAATTATACCGTCGCTCTCCATAAAGCCCTCATGTTCTTCAATGCCC
AGAAATCTGGAAAATTGCCGAAGCACAACAATGTGTCATGGAGGGGGAATTCATGTTTAAAAGATGGCCAGTCAGATGA
TTCAACTATGTTCAAAAATTTGGTTGGGGGATATTATGATGCAGGAGATGCAATCAAGTTTAATTTCCCTCAGTCGTTT
GCTCTCACCATGTTAAGTTGGAGTGTGATCGAGTATAGTGCAAAATATGAAGCTGCTGGTGAGCTCGCTCATGTTAAAG
ATATTATTAAGTGGGGTACTGATTATCTCCTGAAGACCTTCAATTCCTCTGCTGATACCATAGACCGCATTGCTGCACA
GGTTGGAAAAGGGGATACTTCCGGAGGGAGTACTGATCACATTGTTGGGTGCGTCCAGAAGATATTGAT
TACGATCGGCCCGTGACTGAATGTCACGGCTGCTCGGACCTTGCTGCAGAGATGGCTGCTGCTCTGGCTTCTGCCTCCA
TTGTTTTTAAGGACAATAAGGCTTACTCACAAAAACTTGCACATGGTGCTAAAACTCTCTTCAAATTTTCTAGAGACCA
GCGTGGTAGATACAGTATCGGCAATGAAGCTGAAACCTTCTACAATTCTACCGGTTACTGGGATGAGTTTATATGGGGT
GCAGCCTGGCTGTACTATGCTACTGGAAATTCTTCATATCTTCAGCTTGCTACCACTCCTGGTCTTGCCAAACATGCTG
GTGCTTTTTGGGGAggccctGattatggtgtgctCAGctgggataacaaGCTCACTgga > SEQ ID NO:4207 120624 271162_200054_1c
ACTTTCCTGGATCTCCTTACAATTTTGAGCTGAAATATATATACACTAGTTTCTTTTAGCTCAAGAAATCAGAACCAGC
AACATGTACGGGAGGGATCCATGGGGAGGGGCACTGGAGATAAACGCAACAGATTCAGCTACAGATGATGATAGGAGCA
GGAACTTACTGGATTTTGACAAGGCGGCTTTGTCAAGGAATCTGGATGAGACACAACAGAGTTGGTTGTTGGGTCCAAC
TGAGCAGAAGAAGAAGAAGTATGTCGATCTTGGTTGTATTATTGTCAGTCGAAAGGTATTCAAATGGACTCTCGGCTGC
ATTGTTGCTGCTGCTCTCATTGCTGGACTTGTTACGCTGATTGTCAAGACTGTTCCTAAGCACCGACACCGTAGTCCCC
CACCGGATAATTACACTTTGGCTCTTCGCAAAGCCCTTATGTTCTTCAATGCCCAACGCTCTGGGAAACTACCTAAGCA
CAACAATGTATCATGGAGGGGAGTTCAGGTATGCAAGACGGCAAATCTGATGATTCAACCATGTTTAAGAATTTGGTT
GGTGGCTATTATGATGCAGGAGATGCAATAAAGTTTAAGAC > SEQ ID NO:4208 120933FL 143382_200009_1c
TCTTTAGTGTCTTTTATGCTGGAGTGGTGGCCTCAGGGATAGCATTCGCTGTACAGATATGGTGCATTGACAGAGGTGG
CCCAGTTTTCGTTGCTGTTTATCAACCTGTTCAGACTCTTGTAGTTGCTATTATGGCTTCCGTCGCTTTGGGTGAAGAG
TTCTACTTGGGAGGGATCATTGGAGCAGTGTTGATCATAACAGGATTGTACTTTGTGCTATGGGGCAAAAACGAAGAAT
CCAAATTTGCAAAGGCAGCAGCTGCTGCAATTCAGTCTCCAGTGGATCATTGTAACAACAACAGGCCAACTAGCCATAT
CAAGTCCTCTTTGGCTCAGCCACTGCTTGCTTCTTCAACTGAAAATGCTTAAACAAGAAAAGTTTACTGCAAACCAGAA
AATAAGATCTGCTATCCTAAATATTAAGGAAGAAAAGAAAAAGG > SEQ ID NO:4209 126593FL 119247_300018_1c
GCTGTTGAAACAGCGACCAAACAGGTTGAAACATCTAAGGAAGTCAAGGAGGAGAAGAAAGGAGGAGCACAGGATCTCA
AGTCAACCCTTTTGATTTCAGGGGCTGTAGTAGCTGTGGTTGGAGCACTTGTTGCTATTCTTAAGAAGGTGAAAGAGTC
AGCTAATTGAATGTAGATCCTTTGTATCTTTAACTTCATGTTCTACATTTTTTGTAAGACGAGCCTAAACTCTTGAAGG
GAAATAAATAAATTTCATAATGTTCTACTTGTAT > SEQ ID NO:4210 126593FL 126247_300461_1c
gccattacggccgggggaagatggcacttttttatccttttgattatctacaccacaggaaaagcaaagaccaaaattaat
tTATAAAATCTATTTAAAGTACCAAAAATATCTTTAGCAGTGACCAAATTAAGTCGAAAAAAAAATGGCAACTCCTGAA
GAAAACATTGCACCTGCAGCTCCACCACCGCCGGCGGCAGAACCATCAGCGGTGGAGGCTTTAGTGACCACTATTGAAA
CAGCGACCAAACAGGTTGAAACACCGAAGGAAGTCAAGGAGGAGAAGAAAGGAGGAGCACAGGATCTCAAGTTAACCCT
TTTGATTCCAGGGGCTGTAGTAGCTGTTGTTGGAGTAGTTCTTGCCATTGTCAAGAAGGTGAAAGAGTCGGCTAATTGA
```

FIG. 2 continued

ATGTAGATCCCTTGTATCGTCAACTTTATATTTCTGTACATTTTTTCCCCCTTTTTGTAAGACGAGCCTAAACTCTTTG
TCAGCTTTGAAGGGAAATAAATAAATTTCATATGCTTTTATTATAATGACTTCTACTTGTATAAATATATGAGCTCTCT
AGCTTTTATTATAATGACTTCTACTTGTATAAATGTATGAGCTCTCTTAGCTTATATCCTCCTCTCTACAGGGTATTTA
TTAGAACTAAAATGCGATTA

> SEQ ID NO:4211 126632FL 126627_300465_1c
gccattacggccggggcagaaagaacaagctaagggctagttacttaAGCAAATCAAGAAAATATGAGATCCATGCAG
TATTGGGAACCAACGTCTGACGATGAATTCGTCGATCATATTAAAAGAATGGAGAAAGCCCCAACCATGCACCCTGATA
TTCCTCTCTATCCAAATGTCTATTCTGTTTTCAAAAACAAAGCAAGCTATGATCAACCACAAAAATCTAGCTTGAATCA
TCAGAAGGACCCGTCCGCAGAATCCCTGAAGAAGGTTCAGTTTGCTGAATTCAACAAGAATGAAGAGAAGAACATCAAT
ACTCAGGCTGAGGCATATATCAACCAGAAGCACAAGAATTTTGAGCTACACAAATGGAGGACCTTCAAAGTATCATGTT
AAATGGTTTCAATCTTGTTGGCTGCAGGCAGCTGTCTGGCACTGGTGCTCTTCAATAACCTACGTAATATGTTACTCTG
CGTTTGTATCCCACAAAAATAAGGGGAATTTTTTTTTCAAGATATCGTTCATGTTTATCTTATATTTCCTATAGAGAGT
AGTACATTTGCACTGTGATTTGTTCTATCTAATAAAATGTTGTCTGTTTACTTTTCTG > SEQ ID NO:4212 126632FL 44645_300107_1c
GCCATTACGGCCGGGGCAGAGATCGGGAAGAAAAGATGCGTAGAATGGTAGAGTATGGTTGGCAAAACACGTCGTCGAA
TGAGTATCTTGATCATATTAAACGAATGGAGAGATCGCCAACGATGCACCCTGATCTTCCTCTCTACCCAAATGTCCAC
TCCCTCTTCAAAAATGGAATAGTGAGCAACGGACAAGAAAAGAAATGCACTACACTAACACCACAGTCGCAGAAGAAAG
TTCATTTCGTGGAACCTAAAGCTGAACTTACCAAGAATGAAAAGAAGAGTATTGACATGGAGGCTGATGGCTATATAAA
GCAGAAGCACGTCAACTTTGAGCTCCACAAATGGAGAACCTTCAAAGCTTGTTAAAAAGTTTCCAACGTACTTCATACA
AGATATACTACATGATATCTTAGTATAAATAACATGTAATATATGTCTGTCTTATTAGCTTCTGTTTGTACTCTAAAGG
GAAAGATATCTCTTATATGCGCTGTGACTATATATTTCGTAGATGTGGTGTTTTGATTTCAATTTATCTAATAATAAAG
CTATAAGTATGTTTATTACG > SEQ ID NO:4213 127667FL 112125_300040_1c
TAGGAAGTGGAGGCACTGTTTCTGGTGTTGGACAGTATCTGAAATCCAAAAATCCTAATGTCAAAATATATGGAATTGA
GCCAACAGAAAGCAATGTATTGAATGGTGGAAAACCAGGTCCTCACCACATAACTGGTAATGGAGTTGGATTCAAGCCT
GATATCCTAGACATGGATATAATGGAAGAAGTTCTGATGGTTTCAAGTGAAGAAGCAGTAAATATGGCTAGGGAACTGG
CATTAAAAGAAGGGCTTATGGTCGGGATATCATCAGGAGCTAATACAGTAGCAGCGCTTAGACTCGCCAACAAACCAGA
AAACAGAGGCAAACTCATTGTGACTATACATCCAAGTTTTGGAGAGAGGTACTTGTCATCGTCCTGTATCAAGAGCTT
AGGAAAGAGGCAGAGAACATGCAACCTGTTCCAGTTGATTAATGTCCTTTTACAGTAATATATATTAGTAGTCAAACTG
GTACAAGCAAATATATGTACTACCTGGAAACATTCACAAGCAAAAAGTCATAATGGAAATTTAGTTTTTTCTG > SEQ ID NO:4214 127667FL 167538_300548_1c
GAATTCAAAGGGTGTTGGTCGATTAAGACAGCGGGACGGTGGTCATGGGAGTCGAAATCCGCTAAGGAGTGTGTAACAA
CCCACCTGCCGAATCAACTAGCCCCGAAAATGGATGGCGCTGAAGCGCGCGACCCACACCCGGCCGTCGGGGCAATCGT
TAGGCCCCGATGAGTAGGAGGGCGCGGCGGTGGCTGCGAAACCTAGGCCGTGAGGCCGGGCGGAGCCTCCGTCGGTGCA
GATCTTGGTGGTAGTAGCAAATATTCAAATGAAATCAAGCTTATTGCCGTTGAACCAGTTGAAAGTGCTGTTCTATCTG
GAGGAAAGCCTGGTCCACACAAGATCCAGGGAATCGGTGCTGGTTTTATTCCTGGTGTACTGGAAGTTAATCTCATTGA
TGATGTTGTTCAAGTGTCAAGTGAGGAAGCTATTGAAACTGCAAAGCTTCTTGCGGTGAAAGAAGGGCTATTTGTTGGG
ATTTCATCTGGAGCTGCCGCTGCTGCTGCCATCAAGGTTGCAAAGAGGCCAGAATATGCAGGGAAACTCATTGTTGTGA
TTTTCCCTAGCTTTGGAGAGCGATATCTCTCCTCTGTTCTGTTTGAATCAGTGAGACGGGAGGCAGAAAACATGGTTTT
CGAGACATGATAAGTTGCAATGCCGACCAGCAGCGACAGATTGAAAGAGCAAGAGAGTGCAACTATACCATTATCTTCT
ATGCT > SEQ ID NO:4215 127667FL 285184_200103_1c
gcctgatcaaacctggcgagagtgtcctcattgaacctacaagtggaaacactggagtaggattggcatttatggctgc
tGCTAAAGGCTACAAACTCATCATTACGATGCCTTCTTCAATGAGTCTTGAGAGGAGAATTATTTTGCGTGCTTTTGGT
GCTGAGTTGGTGCTTACCGATCCAGCAAAAGGGATGAAAGGTTCTATTCAGAAGGCTGAAGAGATTAAGGCCAAAACAC
CTAACTCCTTTATTCTTCAGCAATTTGAAAACCCTGCAAACCCAAAGGTACACTATGAGACAACTGGTCCTGAGATCTG
GAAAGGCTCAAACGGGAAAGTAGATGCTCTCGTCTCTGGAATTGGAACAGGAGGCACAATAACAGGTTCAGGCAAGTAT
TTAAGAGAGCAGAACCCCGACATAAAGCTCTATGGTGTGGAACCAGTTGAAAGTCCTATTCTTTCTGGAGGAAATCCTG
GTCCGCATAAGATTCAGGGGATTGGTGCTGGTTTCATTCCTGGTGTTTTGGAAGTTGGTCTTATTGATGAAGTAATTCA
AGTTTCAAGTGAAGAAGCCATAGAAACCGCCAAGCTTCTGGCATTGAAGGAAGGTTTGCTTGTGGGCATATCATCTGGT
GCTTCTGCTGCTGCAGCAATCAAACTTGCTAAGCGCCCTGAAAATGCTGGGAAGCTCATTGTTGTTGTTTTCCCAAGCT
TCGGGGAGCGATATCTTTCCTCTGTGCTCTTTGAATCTGTTAGACGGGAAGCAGAGAACATGACCGTGGAGCCTTGAAC
ATTTTGTCCTTCGATTAGCATACCATAGTCTCAAGAGGATTTTCCAATCAAAGCAGAATGTTCTTGTCTGAACCTTTCC

FIG. 2 continued

```
CTTCCTGTTTGATCAAACTGCTAAAAATAAGGCCTTTTCTTTTCTTTAGTGGCCTTTCAAGTATATCTTAGTGCTTTTA
TAATTTTACTGttTCTACAACACTTGTGACAGTGGACTTGTAACAGGAATTTCAAGAGCTGTTGCTGCTTGTTCgtCAA
AgttCCTCTaagccTTTTATTTTCt
```

> SEQ ID NO:4216 127667FL 126860_300467_1c
```
GCCATTACGGCCGGGGCTTCAACAGTTTTCTAATCCTGCGGACACTCAGATTCATTTTGAGACGACTGGTCCAGAGATA
TGGGAAGAAACACAGGGTAATGTCGACATATTTGTCATGGGAATCGGAAGTGGAGGTACTGTGTCTGGTGTTGGACAAT
ATCTGAAATCCAAAAATCCTAATGTCAAGATATATGGAGTTGAGCCAACTGAAAGCAACGTACTGAATGGTGGAAAACC
AGGTCCTCATCACATAACAGGGAACGGGGTTGGATTCAAGCCAGATATTCTTGACATGGATATAATGGAGGAAGTGCTG
ATGGTTTCTAGTGAAGACGCCGTAAACATGGCTAGGGAGTTGGCAGTCAAGGAAGGGCTCATGGTTGGAATATCATCGG
GAGCTAATACAGTAGCAGCTCTTCAACTTGCTCAAAAACCAGAAAACAAAGGCAAACTCATAGTGACTATACATGCAAG
TTTTGGAGAGAGGTACCTGTCATCGGTTCTGTATCAAGATCTGAGGAAAGAGGCCGAGAATATGCAACCTGTTTCAGTT
GATTGATGTTGCAATTTTACTTATGAATTATATAGTTGAAGGCTCTGCAGAAAAATGTATTATTTTCCTAAAT
```

> SEQ ID NO:4217 127667FL 228243_301019_1c
```
GAGATTTTAAATAAGACACCTGATGCCTATATGCTGGAGGAGTTTGACAACCCTGCCAACCCAAAGGTACATTATGAGA
CTACTGGGCCAGAAATCTGGGAGGATTCTAAAGGGAAGGTGGATGTATTCATTGGTGGAATTGGAACAGGTGGAACAAT
ATCTGGTGCTGGCCGTTTCCTGAAAGAGAAAAATCCTGGAATTAAGGTTATTGGTATTGAGCCTTCTGAGAGTAACATA
CTCTCTGGTGGAAAACCTGGCCCACATAAGATTCAAGGCATTGGGCAGGATTTGTTCCAAGGAACTTGGATAGTGAAG
TTCTCGATGAAGTGATTGAGATATCTAGTGATGAGGCTGTTGAGACAGCAAAGCAATTGGCTCTTCAGGAAGGATTACT
GGTTGGAATTTCATCTGGGGCAGCAGCAGCAGCTGCCATTAAAGTTGCAAAAAGACCAGAAAATGCTGGAAAGTTGGTA
GTGGTTGTGTTTCCAAGCTTTGGTGAGAGGTACCTTTCATCTATCCTTTTTCAGTCGATAAGAGAAGAATGTGAGAAGT
TGCAACCTGAACCATGAGCCTAACTTCAGTGTTCACAACATCATAATT
```

> SEQ ID NO:4218 127667FL 279710_200064_1c
```
GTTCTTTTGAAAGCTTTTGGAGCTGAACTTGTTTTAACTGACCCAGCCAAAGGGATGAAAGGAGCTGTTTCAAAGGCTG
AAGAAATATTGAATAACACACCAGATGCCTATATCCTTCAACAATTTGACAATCGCCGCAAACCCCAAGATACACTATG
AAACAACGGGCCCAGAGATCTGGGAAGATACAAAAGGCAAGATAGACATACTTGTTGCAGGCATTGGAACTGGCGGAAC
CATTTCAGGAGCAGGGCGATTCCTGAAAGAGCAAAATCCAAACATTAAGATTATTGGTGTGGAGCCCACAGAAAGTAAT
GTACTATCAGGGGGAAAGCCTGGCCCTCACAAAATTCAAGGGATTGGAGCAGGTTTTATTCCATGGAACTTACATCAAG
ATGTCATGGATGAAGTGATAGAGATATCAAGTGACGAAGCTGTTGAAACTGCGAAGCAATTATCGCTACAAGAAGGGTT
ATTGGTTGGAATTTCTTCCGGAGCTGCTGCTCTTGCTGCCATTCAGGTTGGGAAGAGACGTGAGAATGAAGGAAAGCTT
ATTGCGGTTGTATTTCCAAGCTTTGGGGAACGATACCTCTCCACTATACTTTTCCAGTCTATACGGGAGGAATGCGAGA
AAATGCAACCAGAATCGTGAATATCTTCCTT
```

> SEQ ID NO:4219 127667FL 39327_300198_1c
```
GCAGAAACGTCTATTTTAAGAAAAACAATTTGCAATAAATCAAAGAAGAGGTTCCTTGTTGGTCACGAAATTACAGAAG
AAAATCAAAGCTCGGGCTGCATTTGCTCGCACTCTTCTCGAATCGACTGGAAAAGCTGGGTCGAGAGGTAACGTTCCCC
GAAGCTCGGGAACACAACGGCTATGAGTTTCCCGGCATTTTCAGGTCTCTTTGCAACCTGGATTGCAGCAGCAGCAGCA
GCTCCAGAAGATATACCAACCAACAAGCCTTCCTGGAGAGCTAGTTGCTTCGAGGTTTCAATAGCTTCCTCACTGGAAA
TCGCTATGTATTCATCTACAATAGCCAGATCCAAATTCTTGGGTACAAA
```

> SEQ ID NO:4220 130426FL 237081_301250_1c
```
gcggcggcGGCATCCACGGCATCGACGATTGGGAGCACGCTACCGCGGCCGGGTCTCCGGCGACGTAAGCATGAATCCT
CTCCCTTCTCGCCGTGCTCGTCGTGCTCTTTCTCCAAGTCGGCAGCGGCAGAGCCTCTGGATCGAAGAGCGACGATTTG
GTGCCCTGATCGCAGAGAATGGCGGGCGTGCAGGAATCGAGGGGGAGGATGGCGGCATTCGCGGCGACGACGGTCTCC
GAGAGCTCGGATATCCGGCCGCGGCGGCCTGGGGAGAAAAAGGGTTTGTGGAGGAGATGAGGTTTGTGGCGATGAAGC
TCCACACCAAAGATCAGGCCAAGCAAGGCGAGAAGGAGGCCGATGTGGAGCCGGTTGGAAGCTGGAAGCCGAGCATTCG
TGGTTATATCCAGTTCCttGTGGATAACAAGCTTGTCTACGAGACGCTAGAGGCTGTCGTGAACAGAGGATCGCATCCA
GCTTATGGCCAgtttcgAGAAACGGGATTAGAGAGATCGGAAGCGCTGGCGAaagatttggaatGGTTCAAGGAGCAgG
GAcACGAGATCCCAGagcCGAGCTTGGAGGGTAAATCCTACTCAGAGCTCCtagaaaCGCtTGCCgagGATGAtccgcc
AgcttTTATATGTc
```

> SEQ ID NO:4221 130426FL 282053_200233_1c
```
gtttagccatttacacagttcacaacacactgatgaatacaccattgaaactctccccataaaatataaaattccacca
aAAGAAAAATTCCTTTTTATATTCAGAATCTAGACAAAACATATAGATACACATAATTCTGTATCTATACccttttgct
tcaAGAAACTCCATAGCCATAAACAATAAAAGTATCAATTTTTCTTCTTCTCTTTCTTCAATCATCACTCGTTTCTTGT
TCCAATCCATTCAATCTGTCATTTTCATACAATTTTTCTAAATACCCTTTTCAAGAAATCTTCCTTTAAAAATGGCTTC
```

FIG. 2 continued

AATAACACCCTTATCTCAATCACAACCCCTTTATGAAAAAACCCAATTTACACTACTAAAAACACCTCAAAATCAGTTT
TGCTCAATACCCTTTTCAAGATTCACTCAAAGTTCAAAACTTTCATTGAAAAAATCAAGAATGGTTGTTGTTTCAGCTA
CAACTGCTGCTGAGAAATCCAATAAAAGGTATCCTGGTGAAGCTAAAGGGTTTGTTGAGGAGATGAGATTTGTGGCTAT
GAAATTGCATACTAAGGATCAATCTAAGGAAGGTGAAAAGAACCTGAAGGTCAGCCTATGGCTAAATGGGAACCTAGT
GTTGAAGGGTATTTGAAGTTTTTGGTGGATAGTAAATTGGTTTATGATACTTTGGAAAAGATTATGGAAAAGCTCCTT
TTTCTGAGTATGCTGAGTTCAGGAACACGGGATTAGAAAGGTCAGAGGCCTTAGCAAAAGATTTGGAATGGTTTAGGCT
GCAAGGTTATGCCATCCCAGAACCATCAGCTCCTGGTCTCAACTATGCTCGTTACCTAGAGGAGCTATCAGAAAAGGAT
CCTCAAGCATTTATTTGCCACTTTTACAACACATACTTTGCGCATTCAGCTGGTGGTCGCATGATAGGGAGAAAGGTGG
CTGAAAAGATACTCAATAAGAAAGAGCTGGAATTCTACAAATGGGACGGTGACCTTTCTCAGCTGCTGCAGAATGTTAG
AGAGAAGCTGAATAAAGTTGCAGAAAATTGGActagaGAGGAGAAGAATCAttGTTTGGAAGAGacggAGAAGTCATTC
AAGTTCTCAggGGAAATccTccGATTaaTATTGTCTTGATGCGCggCTTTGCATTTGTACGTTGGATggcctaaAGCTC
aAATTACTgtgAatagTCGTGttCAtTTTc > SEQ ID NO:4222 181824FL 130164_300485_1c
GCAGATACTTTACAATTTCGCCTGATGCGGTATTTTCTCCTTACGCATCTGTGCGGTATTTCACACCGCATCAGGTGGC
ACTTTTCGGGGAAATGTGCGCGGAACCCCTATTTGTTTATTTTTCTAAATACATTCAAATATGTATCCGCTCATGAGAC
AATAACCCTGATAAATGCTTCAATAATAGCACGTGAGGAGGGCCACCATGGCCAAGTTGACCAGTGCCGTTCCGGTGCT
CACCGCGCGCGACGTCGCCGGAGCGGTCGAGTTCTGACCGACCGGCTCGGGTTCTCCCGGGACTTCGTGGAGGACGAC
TTTGCCGGTGTGGTCCGGGACGACGTGACCCTGTTCATCAGCGCGGTCCGGGACCAGGTGGTGCCGGACAACACCCTGG
CCTGGGTGTGGGTGCGCGGCCTGGACGAGCTGTACGCCGAGTGGTCGGAGGTCGTGTCCACGAACTTCCGGGACGCCTC
CGGGCCGGCCATGACCGAGATCGGCGAGCAGCCGTGGGGGCGGGAGTTCGCCCTGCGCGACCCGGCCGGCAACTGCGTG
CACTTCGTGGCCGAGGAGCAGGACTGACACGTGCTAAAACTTCATTTTTAATTTAAAAGGATCTAGGTGAAGATCCTTT
TTGATATCGCggccG > SEQ ID NO:4223 181824FL 280394_200225_1c
GCTGCAGATATCAAAAAGGATCTTCACCTAGATCCTTTTAAATTAAAAATGAAGTTTTAGCACGTGTCAGTCCTGCTCC
TCGGCCACGAAGTGCACGCAGTTGCCGGCCGGGTCGCGCAGGGCGAACTCCCGCCCCACGGCTGCTCGCCGATCTCGG
TCATGGCCGGCCCGGAGGCGTCCCGGAAGTTCGTGGACACGACCTCCGACCACTCGGCGTACAGCTCGTCCAGGCCGCG
CACCCACACCCAGGCCAGGGTGTTGTCCGGCACCACCTGGTCCTGGACCGCGCTGATGAACAGGGTCACGTCGTCCCGG
ACCACACCGGCGAAGTCGTCCTCCACGAAGTCCCGGGAGAACCCGAGCCGGTCGGTCCAGAACTCGACCGCTCCGGCGA
CGTCGCGCGCGGTGAGCACCGGAACGGCACTGGTCAACTTGGCCATGGTGGCCCTCCTCACGTGCTATTATTGAAGCAT
TTATCAGGGTTATTGTCTCATGAGCGGATACATATTTGAATGTATTTAGAAAAATAAACAAATAGGGGTTCCGCGCACA
TTTCCCCGAAAAGTGCCACCTGATGCGGTGTGAAATACCGCACAGATGCGTAAGGAGAAAATACCGCATCAGGCGAAAT
TGTAAAGATATCGCGGCCGCTTaattaTgac > SEQ ID NO:4224 188837FL 190526_300693_1c
ACCCAACTACTAACAGGCAGCTGCCAGCCATGGCTTCCTCCCCGCCGTTTCGTCTACCTCTCGCCGTTGTGCTCCTACT
CGCAATAATATGTGTCCTTTTGGCTTCTCCTAGCTGCCATGCGGACGATCTCCCCGCCACCATGACAAACGAGCACGAG
AAAGAGCATCAGCTGATGATGATGATGATGGACAGGTTCCATAGGTGGATGGCGACGCACAACCGGTCGTACGCCTCCG
CCGACGAGAAGCTGCGGCGATTCGAGGTATACCGGAGCAACATGGAGTTCATCGAGGCGACCAACCGGAACGGGAGCCT
CACCTTCAAGCTCGGTGAAACGCCGTGCACCGACCTCACCCACGAGGAGTTCCTCGCGACCTACACCGGCGACGTACGC
CTTCCGCCGGAGCGGCGGGGGATGCAAGACGACTCCGACGAGGAGGATGCAGTGATTACAACCAGTGCTGGGTACGTCG
CCGGCGCCGGCGCCGGTAGGCGTACGGCTGGGGTGCCGGAGTCC > SEQ ID NO:4225 200622FL 103458_300026_1c
tggtatcaacgcagagtggccattacggccggggcttccattcaccaaaaagcctcgtttcctccgtagacaccctcag
cCTTCTCTCTCTTCTAGCCTTTTGTCTTGAAGAGACAAAATCAAGCCAATTTTGATCTTTGTTTCATCTTTGCTCTACA
GTCTTTCTTTTTTGTTTGTTGAATAATGGGGGGCTGAAACTAAGGTGTTTACTTTGGCTGAGGTCTCCCAGCACAACAA
CGCCAAGGATTGTTGGTTGGTTATTAGTGGCAAGGTATATGATGTGACAAAATTCTTGGATGACCACCCAGGAGGTGAT
GAGGTTTTGTTGTCTGCAACTGGAAAGGATGCAACAGATGATTTTGAGGACGTTGGCCACAGCAGCAGTGCTCGAGCGA
TGTTGGATGAGTATTACGTAGGTGATATTGATTCAGCGACCATCCCCACCAAGACCAAGTACACTCCTCCCAATCAGCC
ACATTACAACCAGGACAAAACATCAGAGTTTGTCGTCAAGCTCCTCCAATTCTTAGTTCCCCTGATTATTTTGGGTGTT
GCTTTTGGCATCCGCTTCTATATCAAACAGTCATCAGCTTGAAGATGGAGTTCGTGGTGAAGTCATAAGAAGTGTCCAG
AagaAAGGTTGTGTGTGTGTGTGTGGGGGGGGGG > SEQ ID NO:4226 200622FL 1099683_301449_1c
aatgaaatcttgttgaacttttcccctcttcttcttccttcagttgagagaGACGGTGGTTCTTCTTGGGTTCGGGTTC
AGGTGTGTAGATAGATCGTGGGAGAGCAATGGGCGACCAAAAGGTGTTCAGTTTCGAGCAGGTCTCGAACCACGCCCAA

FIG. 2 continued

```
TCCAAGGATTGCTGGATCATTGTCAGTGGAAAGGTTTACAATGTAACGCGGTTTCTGGATGAGCATCCTGGAGGAGATG
AAGTCATATTGTCATCCACAGGGAAAGATGCGACAGACGATTTCGAAGATGTGGGGCACAGCAAGACCGCGCGGGCGAT
GATGGAGGAGTACTACATCGGAGAGGTTGACCTTTCCACCGTCCCTTCCAAGCCATCCTATGCACCCGCCAAACAAGCC
CATTACAACCCCGACAAAAGCTCAGAGTTCATCATTAGGATTCTCCAGTTTCTTGTCCCACTTGCCATTCTGGGTTTAG
CGATTGCTGTCCGTGTTTTCACTAAGAAAACCGAATGATTGCATGCACCCTTTAAAAAGTAGTGGGTGGGGATAAGGGG
AATGGAAGAAGAAGAAAAAAAGGTGCGTCCCTAAAATGTGTTATCTATCGTAGAAGCTAATGTAGATGCGGTGTTTTCC
CTAGTTTTATCCCTAGGTTgCTTATTCATCCTgttaaattGtgGATACCTACACTGTTACAACTATGGaggccccttttG
GATCTGTTgcaagaAGGagGTTCcttgtttactTCCAtGTAATGAATattggcagt > SEQ ID NO:4227 200622FL 1117383_301820_1c
tgacatatattatataggactcatttagagggttagttgttgctggtagtagtcgatagtcGATAGTCGAGGGCCATGT
CGAAGAAGGTGTTCAGTCTGGAAGAGGTCTCTCAGCACAACTCCTCCAAGGATTGCTGGATCATCGTTCACAATAAGGT
TTATGATGTCACATCATACTTGGAAGATCACCCTGGGGGAGACGATGTTATTTTGCAAGCAACAGCTAAAGATGCCACT
GACGACTTTGAAGATGCCGGGCATGGCTCAGATGCACGGACATTGATGGAGAAGTATTACGTCGGGGATGTCGATCTTA
ATGGTAATCAAGgAAAACAACCCAACAAGTTCTATAGCCTTTCCAAGGAATCCGATCTCTTGATAAAGGTTTTgccAGC
TGttgCGGTACCACTCATTATTCTTGGAttggTTATCGTTGTTCGAAATCtaagaactctaAAAAACTCCCATGACTAG
aCctcTTCTTTAaAgAcTATCAAAttattcett > SEQ ID NO:4228 200622FL 55896_300130_1c
TTTCTCAGCACAGTAGCGCCAAGGATTGTTGGATCGTCATCGACGGCAAGGTTTATGATGTGACAAAGTTCTTGGATGA
TCATCCTGGTGGTGATGAGGTTATCTTGACTTCTACAGGGAAAGATGCGACCGATGATTTCGAGGATGTGGGACATAGT
TCGACTGCGAAAGCCATGCTAGATGAGTACTATGTGGGTGATATTGACACAGCTACTGTGCCGGTTAAAGCTAAGTTTG
TGCCTCCTACGTCGACGAAAGCCGTGGCTACTCAGGATAAGAGCTCGGATTTTGTTATTAAGCTCCTTCAGTTCCTTGT
TCCACTTCTAATCTTAGGCTTGGCTTTCGGCATTCGGTACTACACTA > SEQ ID NO:4229 200622FL 50844_300186_1c
CCCACGCGTACGGGCGAATCTAATTTCGTTTCACGATGTGGCTAAACATAAGTGCAAGAACGATTGTTGGATTCTCATC
CATGGAAAGGTCTATGACATCAGCACATCACACTTTCATGGACGAACATCCCGGAGGTGACAATGTTCTCCTCGCCGTCACCGGGA
AAGACGCGTCGATCGATTTCGAAGATGTGAACCATAGCAAAGATGCCAAGGAGCTAATGAAGAAATACTGTATCGGTGA
CGTTGACCAGTCAACGGTTCCGGTGACGCAACAGTATATTCCGCCGTGGGAGAAGGAATCTACGGCGGCGGAAACAACT
AAAGAAGAATCTGGAAAGAAGCTGCTTATCTACTTAATTCCTCTCTTGATACT > SEQ ID NO:4230 200622FL 274477_200057_1c
gtttccctctcttttttattgaacccaacaactttctgccactccactcaccTCGTTTCCTCCTCTAAAATCATAATCTA
ATTTATCTTTCAGTTTTATTTTTCTTAGAAAAATTGTGTAATAAATGGGTGGTCAATCTAAGGTCTACACTTTAGCTGA
GGTTTCTAATCACAACAATGTCAAAGATTGTTGGCTTATTATCAGTGGCAAGGTGTATAATGTGACGAAGTTCTTGGAA
GATCACCCAGGTGGGGATGAGGTTTTATTGTCCGCAACAGGAAAGGATGCTACTGATGATTTTGAGGATGTTGGTCACA
GCACTAGTGCTCGAGCAATGTTGAACGAGTATTATGTAGGTGATATTGATTCTTCCACCATACCAACAAAGGTCAAGTA
CACTCCTCCAAAGCAACCTCATTACAACCAGGACAAAACACCAGAGTTCATCGTCAAGCTCCTCCAATTCTTGGTTCCT
CTGATTATTCTAGGTGTGGCTTTTGGCGTTCGCTTCTACACTAAACAGTCAGCTTGAAGATTGATTATGGTGATCTCAT
AATAAGGATCCAAATTAGCGCAACGTTAGAAGAACAAAAAAAGAAAAGAAAAGAAAAGAAAAAGAGCTTTTACTTTG
TTaaCCaggCaAATTATCTTGTTTAaGttCTAttCTGGgacc > SEQ ID NO:4231 200622FL 253307_301625_1c
AATCATCAAAATGTCTGACACCGCCGCCATTCCTACTGATACTGCCGAGAAGAAGATCTTCACCCTCAAGCAGGTCGCC
GAGCACAAGGACCGAAATGATCTGTGGATGATCATCAACGGCAAGGTCTACGACATCTCCAGCTTCGTTGACGAGCATC
CCGGTGGAGAGGAGGTTCTTCTTGATGCCGGTGGAACTGAGGCCACCAACGCTTTCGACGACGTTGGACACTCTGAGGA
CGCTTACGGCATCCTTAACGACCTCTATGTCGGTGAGGTTGACCCCAGCGAGGACGTTATCCGAAAGACTCACACTGTC
AAGACTTCTTACGAGGACGGCGAGTCTGTTGGTGATGACCACGGATCTTCTTCCATGATCTTCCTCATTGTTGCTGCTG
CTGTTGCCGCCGCTGCTTTCTTCTACCTCCAGGGTCAGAAATAAGTATGTTAAATCATTTGGATATTGGTAGTTAATCA
TTTTTATT > SEQ ID NO:4232 200622FL 201905_300721_1c
cggacgcgtgggttgtttcagtggctcagaaattttcttcttttcgtattattgtttcctttatttaaggaaggagtt
gGGCTCTCTCTCTAAGTCTGAATCCCCACGAGACGAGAAACCTAGCAAAAATCTCGTCTTTCGCCGCTCTCTCCCTCCT
CTGATTCCTGCTGTTCTTGATCTTGGATCTCAATTCCCAACCAAGAACACACAGACAGAGAAAGGAAGGAGAAGAAGAT
GTCGAACGACAACAAGAAGGTGTATACCCTGGAGGAGGTCGCCAAGCACAACTCCAAGGACGACTGCTGGCTCATCATC
GGCGGAAAGGTATACAATGTGTCGAAATTCCTTGAGGACCATCCAGGAGGTGATGATGTCTTGCTATCTTCAACTGGCA
```

FIG. 2 continued

AGGACGCGACTGACGATTTTGAGGATGTCGGGCACAGCACGACTGCTCGTGCGATGATGGATGAGTATTACGTTGGCGA
CATCGACACATCCACAATACCCGCGAGGACGAAGTACGTTCCCCCAAAGCAACCACACTACAACCAGGACAAGACCCCG
GAGTTCATCATCAAGATCCTCCAGTTCTTGGTTCCCCTCGCCATATTGGGCCTGGCTGTTGCAATTAGGATCTACACCA
AGTCGGAGTCCGCTGCGGCCGCTTATCCGTATGATGTTCCGGATTATGCCGAGCTCTACAAACag

> SEQ ID NO:4233 200622FL 194119_300761_1c
CCGGCGGGGTTTCCGGCGCCGCCGAGAGAGCGGAGCGTGTCCAGATCGCGTGACTCCCCCACACTCCGCTCCGCTCCCC
CCGCGGCCACGCGCTCCTCGTCGGCTTCCGCTTCCTCCCACCACCTCGCAGCGTTGCAGGGCGTGGGCGTGGGCGGCGG
ACATGGCCGGCGAGAAGAAGGTGTTCGGGTTCGAGGAGGTGGCCGGCCACAACGTCACCAAGGATTGCTGGCTCATCAT
CGCCGGGAAGGTATATGATGTTACTTCTTTTATGGATGAGCACCCTGGTGGCGATGAAGTGTTGCTAGCAGTAACTGGC
AAAGACGCAACCAATGATTTTGAAGACATTGGCCACAGTGAATCAGCAAGGGAGATGATGGAGAAGTATCTCATTGGGG
AGATTGATGCTTCAACCATCCCAGTAAAGCGTACTCATGTCACTCCCCAGCAAGCGCCCGGCAACCCAGACAAGGGCGA
TGACATGCTCATTAAGATCTTGCAGTTTCTTGTCCCCATCTTGATCTTGGGGCTTGCATTTGCTATCCGGCAGTACACC
AAATCTGAGTAGATCTGTTATTACAATGTTGATAATCAATATGGTCCATGAAGCTATATTAGGTGAAATGATTTGGATC
AAAAGAACTAAATAATGATATTTGTTGAGGGGAACGGTATGT

> SEQ ID NO:4234 200622FL 171742_300536_1c
agatcgcgtgacTCCCCCACACTCCGCTCCGCTCCCCCCGCGGCCACGCGCTCCTCGTCGGCTTCCGCTTCCTCCCACC
ACCTCGCAGCGTTGCAGGGCGTGGGCGTGGGCGGCGGACATGGCCGGCGAGAAGAAGGTGTTCGGGTTCGAGGAGGTGG
CCGGCCACAACGTCACCAAGGATTGCTGGCTCATCATCGCCGGGAAGGTATATGATGTTACTTCTTTTATGGATGAGCA
CCCTGGTGGCGATGAAGTGTTGCTAGCAGTAACTGGCAAAGACGCCAACCAATGATTTTGAAGACATTGGCCACAGTGAA
TCAGCAAGGGAGATGATGGAGAAGTATCTCATTGGGGAGATTGATGCTTCAACCATCCCAGTAAAGCGTACTCATGTCA
CTCCCCAGCAAGCGCCCGGCAACCCAGACAAGGGCGATGACATGCTCATTAAGATCTTGCAGTTTCTTGTCCCCATCTT
GATCTTGGGGCTTGCATTTGCTATCCGGCAGTACACCAAATCTGAGTAGATCTGTTATTACAATGTTGATAATCAATAT
GGTCCATGAAGCTATATTAGGTGAAATGATTTGGATCAAAAGAACTAAATAATGATATTTGTTGAGGGGAACGgtATG > SEQ ID NO:4235 200622FL 158558_200019_1c
CCTTTCTTCTCTCTTCACTCTTCAATTCTTGTGTTAGTAGTCTTGACACCCAATTCAAGATTCATTACATCTTTCATTTCT
CCATTCCAATTGAGGAGTAATTTTTTTGCTGTGTCCATAAATGGGTGGTGAAACTAAGGTTTATACGTTGGCTGAAGTT
GCCCCTCACAACAATAACAAAGATTGTTGGCTTGTTATTAGTGGCAAGGTGTACGATGTGACAAAATTCTTGGACGACC
ACCCAGGTGGCGATGAGGTTTTGTTGGCTGCTACGGGAAAGGATGCAACTGATGATTTTGAGGATGTCGGCCACAGCAC
CAGTGCTCGAGCAATGTTGGATGAGTATTACGTAGGCAATATTGATTCAGCAACCATCCCTACAAAAACCAAGTACACT
CCTCCTAATCAGCCTCATTACAACCAGGACAAAACATCCGAGTTTGTAATTAAGCTCCTCCAGTTCTTAGTTCCCCTGA
TAATATTGGGTGTAGCTGTTGGCATCCGCTTCTACACCAAACAACAATCAGCTTGAAGATTGAGTACGCGATGAATTCA
TAATAAGTGTCcACATTTCCGAAATGTGACCCTTACCCACCCCCAAAGAAAACCCCCCACCAAAGATAAGCTAGAGAAG
AAAAAAAAAATGCTTTTTATTTTTCTATTTCtgtgacttCATAgttACACTGTTCGTGtt > SEQ ID NO:4236 200622FL 154693_301256_1c
gcacgAACGGAGAGAGAAAGAGAATCCGAAGAAACTCTGTTTCTCTCTCTTGTAGCAGGAAAAGATGGCATCAGATGGG
AAACTTCATGGATTTGAGGAGGTTGCCAAACACAACAAGACCAAAGATTGCTGGCTTATTATCAGCGGAAAGCGTGTATG
ATATAACTCCATTTATGGATGATCATCCTGGTGGTGATGAAGTTTTGCTTTCAGCAACTGGGAAAGATGCAACCAATGA
CTTTGAAGATGTTGGCCACACAGTGATTCTGCTAGAGAGATGATGGATAAGTATTACATTGGGGATATCGATGTGTCAACA
GTTCCCCTAAAACGTTCTTATGTTCCACCGCAACAAGCCCCATACAATCCAGACAAGACTCCAGAATTCATTATCAAAA
TTCTACAGTTCCTTGTACCCCTCTTGATCTTGGGCTTGGCCTTTGCAGTACGACACTACACCAAGGAGAAGTAAATTCT
TCTGGATTCCAGTTTGCATCAGTCCACTTATTCTTGATTTATGTAGTTGTTTAACGAACACTTGGTTTATCTTGTTTTA
GTTCATTATCGAGCTACAACAACTGAATGTGATCATCAATTTTGTGCTGTCCTTTGCAACTGCTTTGTCTGgTaAAAAA
A > SEQ ID NO:4237 200622FL 144719_200013_1c
AGCGTGGGGCTGTTGGCAGCGGGCGAAAGTTCAGAGGCAAGCTGAGTTTCTGTTTTGCAACCTGATTGTATCCGGTGAT
CGGCGACGATGAGCAAAGTTCATGCTTTTAATGAGGTGGCGGAGCATAACAAGAAAGAGGATTGCTGGCTTATCATCTT
TGGAAAGGTTTATAATGTAACCTCATTTCTGGATGATCATCCTGGAGGTGATGATGTCTTGCTGACTGCAACAGGGAAG
GATGCAACAGATGATTTTGAAGATGTTGGTCACAGTGATGATGCAAGAGAGATGATGAAGAAATACTACGTTGGTGAGA
TTGACAGTTCTACCCTTCCTGTTAAGCACAAATATACTCCGCCTGTAACTCCACCACCCCCTGGAAACCTTGGTTCTGG
AAATTTATCTAAGATATTGCAATTCTTGTTACCATTGTTGATATTGGGCGTAGCGCTTGCCTTGCGTTCCTTTTATCAG
AAAGAGTAGATCAACTGTCATATTTCAAGCTGCAATGGCTTATGGAATACAATACAACTTTCTCATAAGCTGCTTGCCA
TTTTCATATGTTGTGTTTTAGTCTTACGGATTAGTATCCTTTATTCAGCTTATGTGTATTTGCTACCCTTTGTTGGATG
TTCTACTGGGATGC

FIG. 2 continued

> SEQ ID NO:4238 200625FL 135410_300414_1c
GCGAGACTTCACATGTACGACTGGATAATACTTCTACTCCTTGCTGTTATAGATGGACTGTTGAACATAATTGAACCTT
TTCACCGTTTCGTCGGGAGGGACATGATGACTGACTTGAGATATCCATTGAAGGGCAATACTGTTCCCTTCTGGGCTGT
TCCGCTCATTGGAATTGTATTGCCTTGTGCCATCTTTGGTGGAATTTACTTCAAAAAGAAGAATTTCTATGATTTGCAC
CATGGCATACTGGGGATCCTATACTCTGTGCTTATAACTGCGGTAATCACAGATGCAATTAAGGATGGTGTGGGTCGTC
CACGCCCAGATTTTTTCTGGCGCTGTTTCCCAGATGGAAAGGATGTTTATGATAATGTCACTACTGGTGTCATATGCCA
TGGAGAGAAGAGTGTCATCAAAGAAGGTCACAAGAGCTTTCCAAGCGGGCACTCTTCATGGTCTTTTGCTGGTCTAGGC
TTCCTTGCATGGTACTTAGCTGGGAAGATCACAGTTTTTGATCGTAGAGGTCATGTTGCAAAGCTATGCATAGTATTTC
TGCCTCTTCTTACTGCTGCACTTGTGGCTGTTTCTCGAGTGGATGACTACTGGCATCACTGGCAGGATGTATTTGCAGG
CTCTCTGATAGGTCTTACAGTCGCATCATTTTGTTATCTGCAATTCTTCCCATATCCTTATGACGC

> SEQ ID NO:4239 200705 198465_300648_1c
GAATTCCAGCTGACCACCATGGCTTCTAGAGTGGACGAAACTACAGTCCCCTCATACTACTATTACGTGGATCCGGAAA
CTACATATACGTACCAACAACCAAATCCTCTACAGGACTTGATATCGGTGTATGGCTTGGATGACATCTCCAGGCAAGT
GGCAAGAACAAATTTGGACGGCACTAAAGCCGTGAAGCTAAGAAAATCTTACAAGAACCAGATAGCAGATCTTTCAGGT
AAATTCTCCACCATACCGACCAGAGAAAATGGTAAAGGTGGTCAAATAGCACATATTCTTTTCCAAAATAACCCAGACA
TGATGATACAACCACCTCAGCAGGGTCAAAACATGTCAGAGCAACAATGGCGCGAACAGCTGCGCAATAGAGACATAGC
ATTGTTTCAGCCTCCAAATTTCGATTGGGACCTTTGCTCTTCGGTACTATCGCAGTTTGAAAGGTCATATCCAAGCGAG
TTCGCAAACCAGAACCAAGGGGGAGCCCAAGCGCCGTTTGATATAGACGACTTGGCGTTTGATCTAGACGGTACAGGAA
AAAGCCAATCCGGCTCAAATTCAGGTAACAATAGTAAGAAAAGGAAGAACAAATCTAGTGGAAGTTCGATGGCTACACC
AACACATAGTGACAGTCATGAGGATATGAAAAGAag

> SEQ ID NO:4240 200709 189623_300607_1c
GAATTCCAGCTGACCACCATGAACTGTATCACTATTGACGTTTTTTTTACTGCTTTTTCCCATCCCTGCAAGCGAAAAA
AAAAGCAAGCTGACTCTTGTATAAACTGCAAGGACTCATTGATTAAAAGTAGATTTACATTACAGACTAAAGGAAAAGG
CAAACTATACCGGCTATACCACATTCGTTCAAAAATGCCCTCTACCACGCTACTGTTTCCGCAGAAACATATTAGGGCC
ATTCCAGGCAAGATATACGCGTTCTTCAGAGAGCTCGTCAGCGGAGTTATTATATCCAAGCCAGATCTAAGTCATCATT
ATTCTTGTGAAAATGCGACAAAGGAGGAAGGCAAAGATGCAGCAGATGAAGAAAAGACTACCACAAGTTTGTTTCCCGA
ATCAAATAATATAGACCGTTCTTTAAATGGTGGCTGCTCTGTGATCCCTTGCTCCATGGATGTCAGCGATTTGAACACG
CCAATATCGATCACACTATCTCCTGAGAATCGTATCAAATCAGAAGTAAATGCCAAGTCACTGCTCGGATCAAGGCCAG
AACAAGATACAGGCGCCCCTATCAAAATGTCTACTGGTGTCACAAGCTCTCCATTAaGTccATCAGGCTCCAccCCAGA

> SEQ ID NO:4241 20072 108010_300057_1c
ctagcgccttcagcagcagttgggttgtgaaatggccaagtccaaaaatcacacagctcacaaccagtcgtacaaggcc
cACAGGAATGGCATCAAGAAGCCAAGAAAGCACCGCCATTCATCTACCAAAGGAATGGATCCTAAGTTCTTGAGGAACC
AGAGGTATGCCAGGAAGCACAACAACAATAAGAGTGTTGGATCTACTGATGAAGAGTAAACAAATCCCTTAAAGTAACC
ATCGCTAGCACTGCTTTTTGAATTTGGGATTTTTTTTCTGTTTTTTTGTTATGGAATTATAGTGGTTATTTACTAGAAT
GGAACCTAATTTAGTTTGTTATTCTGTTATCTAAACCAGTTATTGGtctCTTTTGATCAATGGCATTGTCTATGCAGTT
TTATTCTTATTACTTTTTAATTTTTAATcagc > SEQ ID NO:4242 20072 1170653_302037_1c
GGGACTGCTCGATTGCGCTAGGCGTGGAGGCTACAGCGTCTGCTCTTTCACAGGTATCATGGCCAAGTCAAAGAATCAT
ACTGCTCATAACCAGTCCTACAAGACCCACAAGAATGGCATTAAGAAGGCTAAGAAGCAGAAGTATACCTCAAGGAAAG
GGATGGACCCCAAGTTCCTGAGGAATCAGAGGTATGCCAAGAAACACAACAGAAGTGCAGGTGGCTCCGAGTCTGGAGA
TGCAGAGGAGTAAAAGTTTTTTTCACCATGGAACTTTTTGCACTTTCATAATCTCACCACCACCAAGCAATATGCATCA
TAACTTTGAATTTGAGACAGGAAAATGTTTTTTAATTCACTGAATCAATCAGTTAGACAGAGATGTTACCAGTGATAGT
TATGAGTTAGAATTTCTATCAAGATATATTTATTTTCCTAAACTCTACcATTATGTGATCTTTTTTTgccTTTTgttg
tGGGATTATATTTAAGATCTgtttGGTGtt > SEQ ID NO:4243 20072 55987_300129_1c
GGAAAGTAAACCTAGCCGAGCAGATCTACCTCTCTCTCTCAGTACTCAGAGATGGCCAAGTCGAAGAATCACACGGCGC
ATAACCAGTCGGCGAAAGCCCACAAGAACGGAATCAAGAAGCCAAGGAGACACCGTCACACCCCAACCAGAGGAATGGA
CCCTAAGTTCCTGAGGAACCAGAGGTACGCAAGGAAGCACAACGTCAAGGCCGGCGAGAATGCTAGCGCTGAAGAATAA
GTGTTTTGATTATCTGTGAGACTTTTTGAAGTTTTTTTTAATGAATTTAAGACTTTCTTAGACAAAGGAACCAATTTA
CTTTGCGCTTTTGATCATGTTTACGCAATTGTGGTTTGTGTACTCTCTTATCCTGGCCTTAATTTAATATCAGCAGTTT
TCTATGC

FIG. 2 continued

> SEQ ID NO:4244 20072 252821_301605_1c
tCGATTGCGCTAGGCGTGGAGGCTACAGCGTCTGCTCTTTCACAGGTATCATGGCCAAGTCAAAGAATCATACTGCTCA
TAACCAGTCCTACAAGACCCACAAGAATGGCATTAAGAAGGCTAAGAAGCAGAAGTATACCTCAAGGAAAGGGATGGAC
CCCAAGTTCCTGAGGAATCAGAGGTATGCCAAGAAACACAACAGAAGTGCAGGTGGCTCCGAGTCTGGAGATGCAGAGG
AGTAAAAGTTTTTTTCACCATGGAACTTTTTGCACTTTCATAATCTCACCACCACCAAGCAAAATGCATCATAACTTTG
AATTTGAGACAGGAAAATGTTTTTTAATTCACTGAATCAATCAGTTAGACAGAGATGTTACCAGTGATAGTTATGAGTT
AGAATTTTCTATCAAGATATATTTATTTTCCTAAACTC

> SEQ ID NO:4245 20072 252071_301668_1c
GTTTTCGTAGCTGCGGCGCGATGGCGAAGTCGAAGAATCACACCGCCCACAACCAGTCGAGGAAGGCGCATCGTAATGG
CATCAAGAAGCCCCAGCGGCAGCGGTACACGTCCAAGAAAGGGATGGACCCCAAATTCTTGAGGAACCAGCGCTACTCG
AGGAAGCGCATGGAAGCGAAGCTGCGAGAACAAAGATCTTCTGAGTCTTAGAAAATGCTAATGTTCCTTTTGCTGAAAA
TATTTCTTTTTGAATCGAAGAAAATATTTCTATAC

> SEQ ID NO:4246 20072 121286_300355_1c
CCCCCAAAACCCTAGCTCCGCCGCCGCCGCCGTTCAACCGCTCGTCTCCTCCTCCCTCGCGAGCGCTCGTTTCGGATTC
GGGGGAGATGGCCAAGTCGAAGAACCACACGGCGCACAACCAGTCGTACAAGGCGCACAAGAACGGGATCAAGAAGCCC
AAGCGCCACCGCCAGACCTCCACCAAGGGGATGGACCCAAAGTTCCTGAGGAACCAGAGATATTCCAGGAAGCATAACA
AGAAGAGTGGTGAGGCTGAATCCGAGGAGTAAGATGGAAGTTGTCCTTTCGGAAAAGCATGTCTATTTTGCCAGTTTTA
ACTCAGCAACCTTTTAGACTATAGTTTCATTAATGATGGAACTTCTATGCTATTCTGTATGATGGAAAGATCTTTTGTT
CTACCTGAGCATTGTTGTGATAATGCTTTTTAGCTGATGCTGCTGGATGAATT

> SEQ ID NO:4247 20072 174959_300528_1c
ccgccgccgacctcctcccggggtcgcgacttctctcgacgccggtggagtgagagagagagagattGGAGATGGCCAA
GTCGAAGAACCACACGGCGCACAACCAGTCGTACAAGGCGCACAAGAACGGGATCAAGAAGCCCAAGCGCCACCGCCAG
ACCTCCACCAAGGGGATGGACCCAAAGTTCCTGAGGAACCAAAGGTATTCCAGGAAGCATAACAAGAAGAGTGGTGAGG
CTGAATCCGAGGAGTAAGATGGAAGTTGTCCTTTCGGAAAAGCATGTCTATTTTGCCAGTTTTAACTCAGCAACCTTTT
AGACTATAGTTTCATTAATGATGGAACTTCTATGCTATTCTGTATGATGGAAAGATCTTTTGTTCTACCTGAGCATTGT
TGTGATAATGCTTTTTAGCTGATGCTGCTGGATGAATTATATGCTATTGAGTTATGTGCCGTGAATTGTGAATCTACTT
TAGGCTACTAGGCATGTGAGGTTACAATCCTCGTTGGTGATGTCAGAATTAATAATGCATAATATTGGAGCGATATCAA
TATATTGGGTGCTG > SEQ ID NO:4248 200721 189427_300606_1c
TCTAAATTTTGGTAGCGCCATTGAAACATATTTTAGCGATAAAACAGGTCATAACCAAGTCGTCGAAAAAGCTCCCGTA
GCTTTGGATAACATTCTACGAAACCTTAAACTTGGTGAATTTATAACATATTTTGTCCTTAACAGAAAATCATTGCAAG
TAAATGTACCTCACCACTTGCTGTTCACAAATCAAACGGATTACGGAGAGTTCGCTGTTGAAAAAGGGGAACATGATAA
TATAGCTGGCAAATTTGAGACCCTTTTGAAGAAAAAGGAAATTTTAATCAGAAAATTACTAAATATTGAACAGAAAAAT
GACCATATTCTAGAAAATTGCTGCAATTCGGATGCTGAAATGAAAATATCGGAGAGCTAGTCTGCTCAATGATCACTC
TGGTATCAGGCATATTAGATTCAATTACTAATATGAACGCAGAAAACTCTGTTGATTTGGATTCAAAGCCCCTTCCGAA
CGCCTATTTTGCTCAGGACAGTGAAGAAGAATTAATGTCGCCAACACAAAGTATTACGTCAAATCTTGCCAGTGAAGAA
AATACACGTTGCACAACCAAAGACTTGATGGGAACTGTTTCTATTTTCATGCTGCCAATGGTGGAAGAATGCTATAATA
TCATTAGTTTGATAGGACCCATACCTACCACATTAaTAAGTTTATACATCCgTAATggaAAta > SEQ ID NO:4249 200733 189409_300606_1c
GAATTCCAGCTGACCACCATGAATTACCTGCGAGATAGATTTCCTCCGGATAATGACCAAAGACCCTTTAGATGTGAAA
TTTGTTCACGAGGTTTCCACAGACTTGAACATAAAAAAGGCACGGAAGAACGCACACTGGCGAGAAGCCTCACAAATG
TACCGTTCAGGGCTGTCCGAAAAGCTTCAGCCGAAGCGATGAACTAAAAAGACATTTGAGGACACATACTAAAGGCGTC
CAAAGGCGCAGAATAAAATCCAAGGGCTGCGAAAAACCGTTGTGAATACTGCTACCGCCGCCCCTACCACCTTCAATG
AAAACACTGGTGTTTCGCTCACGGGGATAGGTCAATCTAAAGTGCCACCTATTCTTATCTCCGTTGCTCAGAATTGCGA
TGACGTGAATATACGAAATACTGGAAATAATAATGGCATTGTGGAGACACAGGCACCTGCAATTTTAGTGCCTGTGATA
AATATTCCAAATGACCCTCATCCGATTCCAAGTAGCCTCTCCACTACTTCTATCACCTCCATTGCATCAGTATATCCCT
CTACTTCTCCATTCCAGTACCTGAAAAGCGGGTTTCCTGAAGATCCTGCATCTACACCGTATGTACATTCGTCCGGAAG
TTcTtTaccCTGGGTGaattgtcttcaaaCTCCTCTATatTTtc

FIG. 2 continued

> SEQ ID NO:4250 200733 223438_300932_1c
GAATTCCAGCTGACCACCATGCAAAGCCCATATCCAATGACACAAGTGTCTAACGTTGATGATGGGTCACTATTGAAGG
AGAGTAAAAGCAAGTCCAAAGTAGCTGCGAAGTCAGAGGCGCCAAGACCACATGCTTGTCCTATCTGTCATAGAGCTTT
TCACAGACTGGAACATCAGACGAGACACATGAGAATTCATACAGGTGAGAAGCCTCACGCGTGTGACTTCCCCGGATGT
GTGAAAAGGTTCAGTAGAAGCGATGAACTGACGAGACACAGAAGAATTCATACAAACTCCCACCCTCGAGGTAAAAGAG
GCAGAAAGAAGAAGGTTGTGGGCTCTCCAATAAATAGTGCTAGTTCTAGTGCTACCAGTATACCAGATTTAAATACGGC
AAATTTTTCACCGCCATTACCACAGCAACAC

> SEQ ID NO:4251 200733 198591_300649_1c
GACCACCATGAATTACCTGCGAGATAAATTTCCTCCGGGTGATGAGCAAAGAACCTTTATATGTGAAATTTGTTCACGA
GGTTTCCACAGACTCGACCATAAAAAAAGGCACGGAAGAATGGACACTGGCGACAAGCCTCACAAATGTACCGTTCA

> SEQ ID NO:4252 200741 189475_300606_1c
GAATTCCAGCTGACCACCATGGAGGATCAGGATGCTGCATTTATCAAACAGGCTACAGAAGCAATAGTGGATGTATCAT
TAAATATAGATAACATAGATCCTATAATAAAAGAGTTATTAGAAAGGGTAAGGAATAGGCAAAACAGGTTACAAAATAA
AAAACCAGCACTCATACCGGCAGAAAATGGTGTTGATATAAATAGTCAAGGCGGTAACATAAAGGTTAAAAAGGAAAAC
GCATTACCAAAACCACCGAAGTCCAGCAAAAGCAAACCCCAAGATCGTAGAAATAGTACTGGTGAAAAAAGATTTAAAT
GTGCGAAATGTTCGTTGGAATTTTCAAGATCATCAGATTTGAGAAGGCACGAAAAGACACACTTCGCCATATTGCCTAA
CATTTGTCCTCAATGTGGCAAAGGTTTTGCAAGGAAAGATGCATTGAAAAGACATTATGATACACTGACATGTAGGAGA
AACAGGACTAAATTACTAACTGCGGGTGGTGAGGGTATCAATGAATTACTGAAAAAAGTCAAGCAATCCAACATCGTTC
ATCGTCAAGATAACAACCACAATGGTAGCAGTAATGGCTGACATGGCAATTCCCGGGGATCGCGgccgcgTcga > SEQ ID NO:4253 200748 131003_302360_1c
gaattccagctgaccaccatggtCGTAATTAACGGGGTCAAATATGCCTGTGAAACGTGTATCAGGGGTCACAGGGCGG
CGCAGTGTACTCACACTGATGGTCCGCTACAGATGATCAGACGCAAGGGAAGACCATCGACCACATGTGGCCATTGTAA
AGAGCTGAGAAGAACCAAGAACTTCAACCCATCCGGTGGGTGCATGTGTGCCTCTGCACGACGGCCAGCTGTTGGCAGC
AAGGAAGATGAAACACGATGTCGTTGTGATGAGGGTGAACCTTGTAAATGTCATACCAAGAGGAAAAGCAGCCGGAAAT
CAAAGGGAGGGTCATGCCACAGAAGGGCAAATGATGAAGCAGCGCATGTCAATGGTCTCGGTATTGCAGATCTGGACGT
TCTTTTGGGCCTAAATGGTCGCTCGTCGGATGTAGACATGACAACCACATTGCCGAGTTTGAAGCCACCTCTGCAAAAC
GGAGAAATTAAGGCCGACAGCATTGACAATCTTGATTTGGCTTCCCTCGATCCGCTTGAGCAAAGCCCTAGTATATCTA
TGGAACCTGTTAGTATCAATGAAACAGGAAGCGCATATACAACTACGAACACAGCACTAAGCGATATCGACATTCCATT
CTCCATCAATGagttgaaCGAGCTATACAAACAAGTATCTTCGCAtaactcacaTTCACAATAACAt > SEQ ID NO:4254 200749 200737_302424_1c
GAATTCCAGCTGACCACCATGAGTCTTAAAGAAGACGACTTtGGCAAGGATAATTCTAGAAATATAGAATCATATACTG
GTAGAATTTTtgACGTATATATACAAAAAGATTCGTATTCACAGTCGGCCTTGGATGATATGTTTCCAGAAGCCGTAGT
TTCAACCGCCGCTTGTGTGAAAAATGAAGCGGAGGATAACATCAATCTCATAGACACGCATCCTCAATTCGAACTGGTA
AATACTGGACTGGGTGCTAAATCGGACGATTTGAAATCTCCATCAGCAAAGGCTACGTTCACTGACAAGCAGAGGAAGA
ATGAAGTACCAAATATATCTGTGAGCAACTACTTTCCCGGACAAAGTAGCGAAACGTCGTCAACAACGGAATCTTGGAC
TATCGGTTGTGATAAGTGGTCAGAAAAGGTAGAAGAGGCATTCCTTGAGGCACTTAGACTGATAATGAAAAATGGGACC
ACAAAAATAAAAATAAGAAATGCCAATTTTGGAAGAAACGAGCTGATTTCATTATATATCAAGCACAAAACCAACGAGT
TCAGAACcAAAAAGCAAATTtcttccCATAttcAAGTC > SEQ ID NO:4255 200759 189853_300609_1c
GAATTCCAGCTGACCACCATGATGAATGAAGACATATCCATCATTGATGGCCATAATAGTTTTTTAACGGAAAAAAGCA
CCGTGCTATTAACCCAAGCCAAGAGAACACTAGAAGACGAAAAGGAAATGATTACTCCCCGAGCTCAACTGTGAGAAA
AACAATGAAGGAAGTAAATAAGAGGCCGTCGCATCCCCTCTCACCGGATCACTCGTCCCCAATTGCTCCATCTAAGGCC
AAGCGCCAAAGATCGGACACATGCGCTCGGTCCAATGGTAACCTAACCTTGGAAGAAATTCTTCAATCTTTGGAAAGAA
GAAGAATAAATGGTGAACTCGCCAAGAAACCTCCATATTCGTATGCAACTTTGATTTGCTTGGCCATTTTGCAATCTCA
GGAGGGAAAGCTAACGCTATCCCAGATATATCATTGGATCCACGTTCACTTCCCTTATTACAAGCAGAAAGATGCTAGT
TGGCAAAATTCAATAAGACATAACTTGTCTTTAAATGATGCGTTCATCAAGACTGAAAAGTCCTGCGATGGTAAGGGTC
ATTTCTGGGAGGTCAGACCGGGTGCCGAAACAAAATTTTTCAAAGGTGAAATCGTGGTTATGAATTTGTAAAGGACTC
CTTACAAGACattgggaagtattTTGAAATagattCTacacttggatGAAtta > SEQ ID NO:4256 200773 198524_300649_1c
CCAGCTGACCACCATGGGCAATATCCTTCGGAAAGGTCAGCAAATATATTTAGCAGGTGACATGAAGAAGCAAATGTTG
CTAAATAAAGATGGAACACCTAAGAGGAAGGTGGGCAGACCAGGCAGAAAAGGATTGACTCTGAAGCTAAGAGTAGGA
GGACTGCCCAGAATAGGGCAGCTCAACGAGCGTTCCGAGATAGGAAAGAAGCCAAAATGAAGAGTTTGCAAGAGAGGGT

FIG. 2 continued

AGAGTTACTAGAACAGAAAGATGCGCAGAATAAGACTACCACGGACTTTTTACTATGTTCTTTAAAAAGTTTACTGTCG
GAAATTACAAAATATAGAGCTAAGAATTCTGATGATGAAAGAATATTAGCCTTCCTCGATGATCTGCAAGAACAACAGA
AAAGGGAAAACGAAAAAGGAACAAGTACAGCAGTTAGCAAGGCTGCAAAAGGAATTGCCATCGCCTAATTCAGATGAAAA
CATGACTGTGAACACAAGTATAGAAGTACAGCCGCACACTCAAGAGAATGAGAAAGTTATGTGGAACATAGGCTCATGG
AACGCTCCCAGTTTAACCAATTCGTGGGATTCTCCCCCCGGAAATCGAACAGGTGCCGTTACCATCGGTGACGAAA

> SEQ ID NO:4257 200786 198407_300648_1c
GAATTCCAGCTGACCACCATGAGTTTTCTTTCCAAACTTTCCCAAATACGAAAATCAACGACTGCATCAAAAGCCCAAG
TGCAAGATCCATTACCCAAGAAGAATGACGAAGAGTATTCCTTGTTACCCAAAAATTACATAAGAGACGAAGATCCTGC
AGTAAAAAGATTGAAGGAGCTGAGGCGGCAGGAACTGTTAAAGAATGGTGCTTTGGCTAAAAAAAGTGGTGTAAAACGG
AAACGTGGCACCTCATCTGGATCTGAGAAAAAGAAAATAGAAAGGAATGACGATGATGAAGGTGGCCTTGGAATTAGGT
TTAAGAGGTCTATTGGAGCAAGTCATGCGCCACTCAAGCCAGTTGTAAGGAAGAAACCTGAACCTATCAAAAAGATGTC
ATTTGAAGAGCTAATGAAACAAGCGGAAAATAATGAGAAACAGCCCCCAAAAGTTAAGTCATCGGAACCCGTAACTAAG
GAACGCCCACATTTTAACAAGCCAGGTTTCAAAAGTTCAAAAAGACCACAAAAGAAAGCATCCCCTGGCGCAACATTGC
GTGGAGTATCTTCTGGAGGCAATAGCATAAAATCATCAGACTCACCCAAGCCCGTCAAGCTCAACTTGCCCACAAATGG
At

> SEQ ID NO:4258 200786 198413_300648_1c
GTGAAGGAATTCCAGCTGACCACCATGAGTTGTCTTTCCAAACTTTCCCAAATAGGAGAATCACCGACTGCATCAAAAG
CCCAAGTGCAAGATCCACGACCCAACAAGAATGACGAAGAGGATGCCTCGTTACCCAAAAATTACATAAGACACGAACA
TCCTG

> SEQ ID NO:4259 200788 198749_300651_1c
GAATTCCAGCTGACCACCATGCACGTTTTCTTTCCTTTGCTTTTCCGCCCTTCCCCTGTTCTGTTCATCGCATGTGCAT
ATATATATATAGATATATATATACATTGTACACGGTGCACGGTAGTGAACATAACTATGAGCACGAACAGAGTCCCGAA
CCTCGACCCGGACTTGAATTTAAACAAAGAAATCTGGGACCTGTACTCGAGCGCCCAGAAAATATTGCCCGATTCTAAC
CGTATTTTGAACCTTTCTTGGCGTTTGCATAACCGCACGTCTTTCCATCGAATTAACCGCATAATGCAACATTCTAACT
CTATTATGGACTTCTCCGCCTCGCCCTTTGCCAGCGGCGTGAACGCCGCTGGCCCAGGCAACAACGACCTCGATGACAC
CGATACTGATAACCAGCAATTCTTCCTTTCAGACATGAACCTCAACGGATCTTCTGTTTTTGAAAATGTGTTTGACGAC
GATGACGATGATGATGACGTGGAGACGCACTCCATTGTGCACTCAGACCTGCTCAACGACATGGACAGCGCTTCCCAGC
GTGCTTCACATAATGCTTCTGGTTTCCCTAATTTTCTGGACACTTCCTGCTCGTCCTCCTTCGATGACCACTTTATTTT
CACCAATAACTTACCATTTTTAAATAATAATAGcattaataaTAATCAta > SEQ ID NO:4260 200818 198405_300648_1c
GAATTCCAGCTGACCACCATGTCCAGCAGCAATTTTAACGAGATGAACGAACTAAATATGACTCAAACAAATTATGGCA
GCACAAAATATACCGCTCAGCATCATCAAGGTGTAATAAATGCCATCATCTCTTCACTGACAGCCCCAGATCAGCCAAC
TACCGTATCATTACAATATTCCAACGACAAGAACATGGCGACGGAAATACAAGCCTTATGCTAAACTCTCCGGACCAAAC
TGGACCTATTATGTGAAGGATTTGGAAGTTTCTATTGGTAGAAATACTGATCCCTTAAACAGTGCACTACAGGAAATT
CAGATGGTGTAAAAAACACATATAGAGTGAATATTGATCTCGGACCTGCCAAAGTCGTTTCTAGAAAAGCAGGCCATAAT
AAAATACAACATGAATATCGGCGGTTGGGAATTGCACATATTGGGCCGTAACGGCGCTAAAGTAAACTTTCAAAGGACT
CATAATGGACCCAACAATCCTCCCATTCGATTATCTTCCGGAACCCTGCTAGACATAGGAGGAACACAAATGATGTTT > SEQ ID NO:4261 200884 1099211_301550_1c
TCTCTTCTTGTGAGACAAGTTGGAGCATCGTTTGATCTCATCATAGTTGTATTATTCCTCCACTCCGTGTATCCAACGC
TTCTTCAAGTCGTTACGAAAGAATGGCGGCAGCGGATACAGAGATGGCGATGGAGCCCTCAGGCGAAGGATCGAGCTCT
GCTGCCGGCAAACGCGAGAAGCGATTCGAGATCAAGAAATGGAACGCCGTTGCCCTCTGGGCCTGGGATATTGTGGTTG
ACAACTGTGCCATCTGTCGGAATCATATCATGGATCTATGTATTGAATGCCAGGCAAACCAGGCTAGTGTAACAAGTGA
AGAATGCACAGTAGCATGGGGTGTTTGTAATCACGCTTTTCATTTTCACTGCATTAGTCGGTGGCTGAAGACTCGTCAA
GTTTGCCCATTAGATAATAGCGAGTGGGAGTTCCAGAAGTATGGCAGGTGATGGCGGTTATGATTTCATGTTGATAATA
GACACATGttTTCAATATGGCTTTTgACAGATTTTCTGAATCAGCAGTATACTgttTtTCTTCTTCTTCATCTCTTTgt
tGGTATGttTTTTtTgtaCTTGGCTTTATGCACTCAAATATTTGAATGAgATTgttgATATATATATGATGTCAGTTTg
gCTgttagcccaACTCTTATTTTgatAgTaaaagaaAAAAAACTCcttGac > SEQ ID NO:4262 200884 1109814_301525_1c
GATCTCTCTCTCCCTCTTTCTCTCTCTGTCTGTCTGTTTGGAAGCAAAACGTAGGAGAAGAAGAAGGAGAAGGAGGGGA
AGAGCTAAGAGAATGGCATCGGCGATGGGAGTGGAGGGTGAGAGAGAGGGTCACGGCGAAGGGTGCAGCGGAAAGCGGG
AGAAGCGCTTCGAAATCAAGAAATGGAACGCCGTCGCTCTTTGGGCCTGGGATATTGTAGTAGACAATTGTGCTATATG
CCGCAACCATATCATGGATCTATGCATTGAATGCCAAGCAAATCAAGCTAGTGCGACGAGTGAAGAATGCACAGTAGCA

FIG. 2 continued

```
TGGGGTGTTTGCAATCATGCTTTTCATTTTCATTGCATTAGTCGTTGGTTGAAGACTCGTCAAGTTTGTCCCTTAGATA
ATAGCGAGTGGGAATTCCAGAAGTATGGCAGGTAGTTTCGTCTGGATTTCTTTGCCCTCTTATATTATTGTGGTGATCT
TTGCAACACTATATTTCGGAACCCACTGATCCGGGAGGAGGGTTTCATGCATCCATCATGATGCAGTTTTTTCGTTTTT
TTTTTGATCTAATCGTACAATATAACAATGCAATCTTTAACTTTCTTCTGATATGTCTACCAAGGTGATTGAAATTTTA
TGAaGCCgtgTGATATATATGTGATATATAGATATATATAt > SEQ ID NO:4263  200884  280376_200225_1c
aaaattccccgtctctgtaaactcgaattcaatttctcgCGGTGTATATTGAATTCCAAAGGCGTGTGTTATAGCTTCC
GTCCAATGGCATCTGTCGACACCGACGTGACTATGGTTCCGGCCGGCGATGGTTCTACCGGTGCCGGAGCTTCATCATC
ATCTTCCACTAAGAAGGCCAAGCGTTTTGAGATCAAAAAGTGGAACGCCGTCTCTCTATGGGCTTGGGATATTGTGGTT
GATAACTGTGCTATCTGTAGGAACCACATCATGGATCTCTGTATTGAATGTCAAGCTAATCAAGCTAGTGCAACAAGTG
AGGAATGCACAGTGGCCTGGGGAGTTTGCAACCATGCATTCCACTTCCATTGCATTAGCAGATGGCTCAAGACTCGTCA
AGTCTGTCCACTTGATAACAGTGAGTGGGAGTTTCAGAAATATGGTCACTAGATTTGTTGCTCCTGGCAAAAATGGG
ATATTCAGAAATTTGATTCATCTGATCAGAGTATACCGATTGAGTTACATTCCTTGATTGGGAACTCTAATGAAGCTTT
TGTGCTTTTAGTTCATCGATGTGACTTCACTTTTTGTTGGCACTTGGTAATTTTGAGACGTGATATTACCATGTGAACT
TGTGCTATTTTGGATGTGCGTTGGTTCTTTTATCAAGTTTTTTGGGCTTTTGTTTGGGT > SEQ ID NO:4264  200884  270122_200123_1c
gaagaaaattgtgagaTCGAGAACCCTAGAATTTGGACTACGATTTCTTGATTCAGCAGGGAAAATGGATACAGACGTC
GAGATGGTTTCCCCGGTGAAGAATCCAACGCTGCAGCAGCAGCAACTTCATCAGCATCTACTGCTTCTTCTTCCACTAA
GAAACCGAAATGTTTTGAGATCAAAAAATGGAATGCTGTCGCTCTTTGGGCTTGGGATATCGTTGTAGACAACTGTGCT
ATTTGCAGGAATCATATTATGGATCTATGCATTGAATGCCAAGCTAATCAAGCTAGTGCTACGAGTGAGGAGTGCACTG
TTGCTTGGGGTGTATGTAACCATGCCTTCCACTTCCACTGTATCAGTCGCTGGCTCAAAACCCGTCAAGTGTGTCCATT
AGATAATAGTGAGTGGGAATTTCAGAAGTATGGTCACTAGAGGGATTCAACAAGTGGCACGAGAGGCAATTATACTGCT
TCATCATAATGTCGTTAAATGTAGTTTGTTGTAGTAATACTTGTTCCAATGCCTTTTTCTGTGTTGCTTTACATATCT
GAGTCTGCTTTGGCcATCTGATAGGCTTTACTAGAGAGCTCGTACTGAATCACGTGCTGTGTGATTCTGCTTACTGAAG
TCAAACTTGTCCTTGTCGATTATGTTTGGGAAaaccttCaactagagccacTagcaaaaTCTggcGccAaTGttAtTtt
aCCTTCATTACTCTAataTT > SEQ ID NO:4265  200884  245522_301569_1c
gggcggacgcgtgggcggacgcgtgggggaggaggaggagccCTAGCACTGGTGATGGCGAGCGTGGACATGATGGACG
TGGCTGGCCCTTCGGGCGAGGGCTCCAGCAGCGCCGCCAGTAGCTCCACCAGGCGCTCCAAGCGCTTTGAGATCAAAAA
GTGGAACGCTGTGGCGCTTTGGGCCTGGGATATCGTGGTCGATAACTGCGCCATCTGCCGGAACCACATCATGGATCTG
TGCATCGAGTGCCAGGCAAACCAGGCCAGCGCCACCAGCGAGGAGTGCACCGTCGCTCGCCTGGGGCGTTTGCAACCATGCGT
TTCACTTCCACTGCATCAGCCGCTGGCTCAAGaccCGCCAAGTCTGCCCCCTCGATAACAGCGAGTGGGAgttccaGAA
GTACGGGCGTTgACAAACAGCTATTtggttttaGCGTGTACGCGGCTCATGTTCTCcttgtcCGAGCTTCAgagatTTG
TACtttttTCTTCGTTGATGTTCCAAATTTGCCTTGGCTAtTgAATCCTACCGTcTtGAGCAGCAAAATCCTTGTTACA
ATCGGTTGACTCTTACGGTTGCACGTGATGAGGAGTACTTGGTGGTAGTattcgaGgtcaagCc > SEQ ID NO:4266  200884  237650_301289_1c
atGGAGCCCTAGCGCTGGTGATGGCGAGCGTGGACATGATGGACGTGGCTGGCCCTTCGGGCGAGGGCTCCAGCAGCGC
CGCCAGTAGCTCCACCAGGCGCTCCAAGCGCTTTGAGATCAAAAAGTGGAACGCTGTGGCGCTTTGGGCCTGGGATATC
GTGGTCGATAACTGCGCCATCTGCCGGAACCACATCATGGATCTGTGCATCGAGTGCCAGGCAAACCAGGCCAGCGCCA
CCAGCGAGGAGTGCACCGTCGCCTGGGGCGTTTGCAACCATGCGTTTCACTTCCACTGCATCAGCCGCTGGCTCAAGAC
CCGCCAAGTCTGCCCCCTCGATAACAGCGAGTGGGAGTTCCAGAAGTACGGCCGTTGAGAGCCGGAGAGCGAACAGCTA
TTTTGTTTTAGCGTGTACGCGGTTCATGTTCTCCTCGTCCGAGCTTCATATTTCTCCAGAGATTTGTACTTTTTTCTTC
GTTGATGTTCCAAATTTGCCTTGGCTATTGAATCCTACCCCGTCTTGAGCAGC > SEQ ID NO:4267  200884  198406_300648_1c
GAATTCCAGCTGACCACCATGAGCAACGAAGTTGACAGGATGGATGTGGATGAAGATGAATCGCAAAATATTGCGCAAA
GCTCAAACCAAAGTGCGCCAGTGGAAACCAAAAGAAGAGATTTGAAATTAAGAAATGGACCGCAGTGGCGTTTTGGTC
ATGGGATATAGCTGTTGACAACTGTGCTATTTGCAGGAACCATATAATGGAACCATGCATTGAATGCCAGCCAAAGGCC
ATGACGGACACTGATAATGAATGTGTAGCAGCCTGGGGTGTCTGTAATCACGCTTTCCATTTGCACTGTATTAATAAAT
GGATCAAGACAAGAGACGCATGCCCATTAGATAACCAACCTTGGCAGTTAGCAAGATGCGGTAGGTGACATGGCAATTC
CCGGGGATC
```

FIG. 2 continued

> SEQ ID NO:4268 200884 198402_300648_1c
GAATTCCAGCTGACCACCATGGCCCGCAATAGATGCGCTTCCTTAACATGGCAATTCCCGGGGATC

> SEQ ID NO:4269 200884 189691_300607_1c
GAATTCCAGCTGACCACCATGGCCCGCAATAGATGCGCTTCCTTAACATGGCAATTCCCGGGGATC

> SEQ ID NO:4270 200884 170235_300531_1c
ctcctcctcGCGCTCCCCTCCCACCCTAGGGTTCGCCATGGACAAGGGCGACGTCGCCGTGGCCGTGCCCCCTCCATC
GCCGGCGCCTCCTCCTCCGGGGCCAAGAAGGGCAAGCGCTTCGAGATCAAAAAGTGGAACGCTGTCTCCCTCTGGGCCT
GGGACATCGTCGTGGACAACTGCGCCATCTGCCGCAACCACATCATGGACCTCTGCATCGAGTGCCAGGCGAACCAGGC
GAGCGCCACCAGCGAGGAGTGCACCGTCGCTTGGGGAGTTTGCAACCATGCATTCCACTTCCACTGCATCAGCCGTTGG
CTCAAGACCCGTCAAGTGTGCCCTCTAGACAACAGCGAGTGGGAGTTCCAGAAGTATGGTCACTAGACAATTCTCTTTC
GGGAGCAAAAGCGGCTTCAAGTTTCTCGTATCAAGTATTAGCACTAAGTGATAACTAATGATTACGATGGGTAGGCTGC
ATTGTTAATGTTTCAGAAGCTTGTATTTTCGGTAGAAACATATCATGCTGGTAGCTCAGCGAATCTCCTCAAACTTATT
TTCGCTGAAATCAAGCAGCAGTTCGTATTTACT > SEQ ID NO:4271 200884 144658_200136_1c
CGTCCGAATtaaCACTCTTTGAAGCTtaACATTTAATGGCATCACCGGACACCGACGTGCCTATGGTTCCCGCCGGCGA
GGGTTCAACCGGCGTTGGATCGTCCACTAAAAATCCCAAGCGATTCGAAATCAAAAAGTGGAATGCTGTTGCTCTCTGG
GCTTGGGATATTGTGGTAGATAATTGTGCAATCTGTAGGAATCACATCATGGATCTGTGTATCGAGTGTCAAGCTAATC
AAGCTAGCGCGACAAGTGAGGAATGCACAGTTGCTTGGGGTGTTTGTAACCATGCATTCCACTTCCATTGCATTAGTCG
GTGGCTCAAGACTCGTCAAGTGTGTCCACTTGATAACAGCGAGTGGGAGTTTCAGAAGTATGGTCACTAGTATTTATTG
TTGGTGTACAGTGAATGGAGTTTCAAGTGTTGTCTGTTGGATTGAAGTCCCTATCCTCTCTTTGCTATCATCGGCGTT
GAAAAGAATGATTATAaCGTCTACTTATGTTCCTTCAATTTTCGttCTGCaaATATG > SEQ ID NO:4272 212347FL 204359_300792_1c
CCCACGCGTCCGCCCACGCGTCCGACATTCGTTGTCTGAACACTAAACCAAAAAACTCCAAAAAAAACAACTTAATACA
CACCCCCCCAACAACACTTAATACCGACAAGATGAAGGCCGCTTTCGTTGCTGTTGCTCTCGCCGCTCTGGCCCAGGCT
CAGACCCGCGCTGATATCCCATCCTGCGCTCTGCCCTGCCTCGACGACGCCGTCAAGGCCAACACCAAGTGCTCCACCA
CCGACTACGCCTGTATCTGCAAGGACTTCAACGCTGTTCAGGGCGCTGCCACCGGCTGTGTCGTTGAGAAGTGCGGTAC
CGACGTTGCCATCAACAAGGTCCTCCCCGCCACTCAGGCTCTCTGCGCCGCCAACTCTGGATCCGGCTCTGGCTCTTCT
TCTGCTGCCAACACCACTCCCGCCCAGCAGACCACCTCTGCCGCCCAGTCTTCTTCTGCTGCCCAGTCTTCCTCTGCTG
CTCAGTCCTCTGTCGCCCAGCGCTCCCCCAGCTCTGCCCCCGCCCAGACCACCTCTGCTGCCCAGACCACTCCCGTCA
TTCCCGTTGGCACTGGCACTGGCGTTCCCCCGCTGGCAACAAGACCACCACCGGTGCTCCCACCGCCCCTACCAGCGG
CGCTTCCACCATCCTGCCCGGCCTTGCCTTCATCGCCGCTCTCTGCGCCTTTGCCCTGTAAGGGGTTTGACAATGAACG
ACGACGAGATGGgaaggGTGAcGat > SEQ ID NO:4273 212347FL 218769_300936_1c
TTTCACAGTCCAGCTACATTCGTTGTCTGAACACTAAACCAAAAAACTCCAAAAAAACAACTTAATACACACCCCCCCA
ACAACACTTAATACCGACAAGATGAAGGCCGCTTTCGTTGCTGTTGCTCTCGCCGCTCTGGCCCAGGCTCAGACCCGCG
CTGATATCCCATCCTGCGCTCTGCCCTGCCTCGACGACGCCGTCAAGGCCAACACCAAGTGCTCCACCACCGACTACGC
CTGTATCTGCAAGGACTTCAACGCTGTTCAGGGCGCTGCCACCGGCTGTGTCGTTGAGAAGTGCGGTACCGACGTTGCC
ATCAACAAGGTCCTCCCCGCCACTCAGGCTCTCTGCGCCGCCAACTCTGGATCCGGCTCTGGCTCTTCTTCTGCTGCCA
ACACCACTCCCGCCCAGCAGACCACCTCCCGTCATTCCCGTTGGCACTGGCACTGGCGTTCCCCCGCTGGCAACAAGAC
CACcaacgGTGCTCCCACCgacccTACCAGCGGCGCTTCCACCATCCTGCCCGGCCTTGCCTTCATCGCCGCTCTCTGC
GCCTTTGCCCTGta > SEQ ID NO:4274 212347FL 220353_300954_1c
CCCACGCGTCCGAAACAACCTTCTTCATCAATTCTACTACAACGACCTTCCTACTTAAACAATCTCTCGATACCAACTC
CCCAAGATGAAGTTCACTCTCGTCCTTGCTACCTTTGCCGCCGTCGTCTACGGTCAAACCATCGATGACATTCCCGCAT
GTGCTCGTACTTGCATTGAGAACGCCGTTCTAGCCGCTGGTTGCTCGTCTGGAACTGACGTCGCATGCGCTTGCGCACA
TTTCACTGCTGTTCAGAATGGCTCTACTAGCTGTGTCATTGCTGCTTGTGGCGTTTCTGTCGCCATTAGTATGTGCTCC
CCTCTCATTTTGGTCGAGGATATTTACGTCTCAAATGCTTATGTATATTTATAGACCAAGTTCTGCCTGCCACCCAGGC
TCTTTGTGCCAACCAGTGAACTCATCATCGAGAGGGAGAAAATGACATGGGAGAAAATCAGGTACTCTTGTACATTGA
CAAACAAGTACATAGCTGAATGGTGTGAATGAATAAAACGCATTGCTGCTGGACACCGCTCTGTTCATTTCTGTAtttC
AATGAGTAttCATGCGATATGTAGCTTGA

FIG. 2 continued

> SEQ ID NO:4275 212347FL 212363_300848_1c
CAAGAAACAAACAACCTTCTTCATCAATTCTACTACAACGACCTTCCTACTTAAACAATCTCTCGATACCAACTCCCCA
AGATGAAGTTCACTCTCGTCCTTGCTACCTTTGCCGCCGTCGTCTACGGTCAAACCATCGATGACATTCCCGCATGTGC
TCGTACTTGCATTGAGAACGCCGTTCTAGCCGCTGGTTGCTCGTCTGGAACTGACGTCGCATGCGCTTGCGCACATTTC
ACTGCTGTTCAGAATGGCTCTACTAGCTGTGTCATTGCTGCTTGTGGCGTTTCTGTCGCCATTAACCAAGTTCTGCCTG
CCACCCAGGCTCTTTGTGCCAACCAGTGAACTCATCCATCGAGAGGGAGAAAATGACATGGGAGAAAATCAGGTACTCT
TGTACATTGACAAACAAGTACATAGCTGAATGGTGTGAATGAATAAAACGCATTGCTGCTGGACACCGCTCTGTTCATT
TCtgcaAAAa > SEQ ID NO:4276 212363FL 208329_300959_1c
GCGCTTGCGCACATTGCATTGCTGTTCAGAATGGCTCTACTACCTGTGTCATTGCTGCTTGTGGCGTATCTGTCGCCAT > SEQ ID NO:4277 212454FL 195581_300635_1c
ATCTAGATACCCTCCCCTTCTTCTTCTCTTCTTTCCCCCCCCTTCACATTTGTGTCTTGACGTCGTATTTCGCTTCAGCG
TCATCCCCCATCACACATACACACATAGCAACTTGCCGACGTCATGGCTGAGCAACTGAGATACGACGGCCAGGTCGTG
GTCATCACCGGAGCTGGCGGTGGTCTGGGCAAGGCCTATGCCACTTTCTTCGGCTCTCGAGGCGCCAGCGTGGTCGTCA
ACGACCTGGGCGGCACGTTCAAGGGCGAGGGAAACTCTACAAAGGCTGCTGATGTCGTCGTCGACGAGATCAAAAAGGC
CGGCGGCAAGGCCGTTGCCAACTACGACAGCGTCGAGTTCGGCGAGCGCATCATCGAGACCGCCATCAAGGCCTTTGGC
CGCATCGACATCCTCATCAACAATGCCGGCATCCTGCCGCGACATTGCCTTCAAGAACCTCAAGGACGCGAGGACTGGGACC
TCATCATGAAGGTCCACGTCACGGGCGCCTACAAGTGCTCCCGCGCCGCCTGGCCTCACTTCCGCAAGCAAAAGTACGG
CCGAGTCATCAACACCGCCTCGGCCGCCGGTCTGTTTGGCAGCTTTGGCCAGACCAACTACTCTGCTGCCAAGCtcgcc
aTGGTTGGCttcaacgagacactggcc > SEQ ID NO:4278 212492FL 212448_300849_1c
GTTTCGGAGGCTGATTGAGTCGGAGGGGCTGCCTTATTGCGGCAGAGGAATAGTGACGTCATGACTATCAAGGACCCTG
GAGGTTACCTAAAAGAAAAGCATCTGGACGAGGTGACGTAGCCATCAATGCGATCGATTGTTTGCTCTATCTCCTCGGG
TCGGCTGTTGATTTAGTATTAAACTAATGGATATGAATAGTGTTAGAGTGTGCGAATGGATCTCATTGTTTGAATTGAT
GAATCTCGGAAGATCTGAGCTAGCTGCAAGATGCCTCAAGCCATGCGCAAGGCACGTGTGGATGGAGGCAAGATTGGAT
GGAGATTTACTGTAAATCTTCCAACTTTAACTATAGAAGGGAAAGGGGGAAAGAGGCGATCGCTATACCGCTGGTTGGA
TTCAGCTCCAGGGACAGATTTCATCAAAACAAGCGATGAACTGTGTGGTGACATATATATACGAGTACGGGTTTGATCA
TAATTCGC > SEQ ID NO:4279 212646FL 207732_300828_1c
GATGAGGACGATGTTGAGGATGTGATTGGAGAAGACATGGACGAAGACATTTATGATTAAGCGGATTGATCAATCCAGG
AAACAAAGTTTCACCCAAAAGTTATTTTTCTTTTCTCGTCACGGATATGGCATACGGAGTTTCAGGAGGAAATGGGGAA
ACCGTTTTTGGTTTGAGTAATTACTCATAAATTGGCCCTCTATAATGTATCATAACTAAAAATGAAAATATTGTTCATT
AAAAATG > SEQ ID NO:4280 212719FL 212775_300843_1c
GCCCAATCGCCAAATACACAAATCCATTGAGCTACAAATAACAAGCAGCATGGACACCAAACCTGACACTTTCTCCTTG
GCCGTATGCGCCATGTTGACTTCTCCCGCAATCTCCGCTAAACGCTTCCAAACCCAAGCCGGGCTGCGTATGCTAAGAG
GAAAATTCTAACCGCGAAGAGTGAATGATCTTCTCAACG > SEQ ID NO:4281 212719FL 220081_300951_1c
CTAACCCCAATCGCCAAATACACAAATCCATTGCGCTACAAAGAACAAGCACCATGGACGCCAAGCCTGCCACTTTCTC
CTTGGCCGCTGCGCCAGTTGCTTCTCCCGCAGCCTCCGCGAGCGCTTCCAAGCCCAAGCCGTGCTGCGTATGCAAAGAG
GAAAAGTCGAAGCGCGATGAGTGCATGCTCTTCTCAACGGCCAAGGATCCCGCAGCCGACTGCAGATCGCTCGTTGACC
AATACAAGAGCTGCATGCAGGGCTTCGGATTCACTGTATAAATCAAAATATCTTCATCTTGGCGCTATGCCTTTGTACA
TTATCACCATATAGACTACTCGGAAAAGTACAGCGCTCGATTATTCTCCATTCTAGaGTAACGATCCCATCCCctgata
aAAAAAAAAcaaAa > SEQ ID NO:4282 212756FL 195734_300637_1c
TCGACCGACGCTCGGCAACAATGGCGACAATTGCAAGCGGCTTGCGGCATGCGAGATGCGCAAGCTCGATTGCTGCAGC
TCAATGGCGGCCGGCAATCTTCCCGCGGTCGAACTTTCAACTCGCCATCCGGTCTATAACCAGCGACTCTCAAAAGCCT
CCCAGTCTTGAACTTGAAGCCGCCGAGTCCGTCCCGATCCCATACCAGGGCGTTACGCATGCGCGAGTTGTTCCGGCGA
CACCATCTTATTTCTCAAGAGAACCCCAGTTCAACGATTTATACATTGGAATCTCCAAGCTGCTCACCAAGTACAACCA
CCTGCCCACAGTGCCGCCAAGTGAGGCTCCGCAAATGCCATGGACAAAGCTGGAGGAGATGCGGGCGCAGATGGGAGAG
CCCATCAAGTCATCACACTATGCGAAGGTCATGCGAGTGGCCAAGCGCTTGAACCTCATCGAGCCCAGCCT

FIG. 2 continued

> SEQ ID NO:4283 212777FL 199983_300754_1c
tgtcttgtcattattactcgaccgcgtcgagcCaagaaaccattgaagcacataacaaaccgttcgaaaaccgcaacaa
tGTCTATCGTCCAGCCACAAGAATACCAGACCGTTGACGACGTGCCGTATCAGCGAGGCCGTCCTCTCCCAACAGTCAC
CCCCGTCTTCCAGAACAAGCTGCCCAACTCGCCTGGCAAGACGTCCATCGGCCTCCTCGTCGACTTCCCGCCCAACTCG
TCGACGCCCCCCCACACGCACGGCGGCGCGGCCATCTCCGTCTTCGTCATCAAGGGCACCGTGCTCAACAAGATGAACG
ATGGCCCGACTCGTGTGATCCCGGCGGGCGGCACGTGGTTCGAGGCCCCGGCTGCCACCACCGGACCAGCGACAACTT
CAGCACCACGGAGCCGGCGCAGATTCTGGCGACGATGGTGGTTGACACAAAGACTGTTGAAGAGGGAGGGATGGCGGCT
CTTGTTGTGCTCGACCCGGAGTATGCTGATATCAGACTTGGTTAAATTGATATGGATGCTGCAGTGAAGAGAACCGGAA
GCTCGGAAAGGGTGTGGGTGTTGTCAATATCAGAAGTGGCCAGCGGAGGCTCGGATTGCTGTTAGTAAACGGGGCATCT
CAGCAGGAAGGCAAAATGAATATGTAAAGCAATCAATGGCAACGAATCGtTTTgACTAacagaaaaaaaaaaa > SEQ ID NO:4284 212794FL 216348_300868_1c
GTTGGGTCGTGTTGATGCCTCGTTTTGGATATGCATCGTATACTTGCTTGGAGGAGATGAGGTTTGTGCTGAAGAGAGA
GAGACAGCTTTGACAGTCTTGCTGTTTGTTATTCCGTGGGGGTATCTCAATTCGAGGATGTATTTATTTACTAGATGCT
AGCATGAATTTTTTTTTGATCCTTGAGAAAAAAAGAAAAA > SEQ ID NO:4285 212808FL 211910_300872_1c
AGAGGATTAAGGATTGGGAAATAATAAgaGAGTTGTCGAGAGGTCACTGGTGGCAAATGTTTTTGTTATAGGTAGCCCA
TCAACCCGTATCACACAAGACTGAGCAGTATATATAGAATTCTCAGCTCTCTCCTCGGTGTCCCTCTTGTTATCCCAAG
TATACGATACTCACCAaggacgTCCATCACCCACTCCTTATACAGGTATAGCACTGCGAGAACCTGCCCAGCATGCATC
GTCAATACGCCCCTccgcgcgaACCTATCCGCAATGAGATTGTCGTCGTCTTTGGCGAGTTCTGCGGTACCTtcatgtT
CCTCCtgAtGTCCTTCATCGGCACCCAGGCCGCCATCGAAAACAACGATCCAACAAACCCCAACGCGCCTctattTCCC
TTTTCGCTCttgtatgTTGCTTCTTCTTTCGgaGCtgcACTGGCCGTCAACGTATGgGTCTTTTacagaGTGACGGGCG
GCAtG > SEQ ID NO:4286 212830FL 214926_300876_1c
gagaaCATAACCACAACTAAGTCATAAGGAAACAATCACGATTCTGAATATCTATTCGCGTTATATACAAGCTAAAATG
AAGCCGTTTTATCTGATTTCTATTCTATTTACCAGTTTGGGCACTGCTATCCCAGTTATCCCTAGGGATAATAACGGAA
TCCTCGATAATTTCCTAGCTATTGTGAAAGACGCGACAGGAATTGATCGGACACCCGTCCACGGGCTCGTCGGCACTGT
CCTGAATGGTGGCACCAAATCTATCTTGATTAACTCGACTGTCCTGGGTCTTGCAGAGGCAATTTTTGATGAGGTGAAA
TCCCAATTAGGCATTCAAGATCCGCGGTCGCTTGAAGAAACTATTGCGTCTTTGGAAGAGGCGGGTAATGAGACTTTTA
ACCAATTCTGCCAACTACTCGACACGTTCCGCAGAGAGGATAAAGGTCCTGCTGGAGGAACCATTGACTCGCTAGGCGT
GGGCAATATATCCTCATTAGACTTGGCATCTTCTATCGACTTGATCATAAACTTGGTCGGACTACAATGTCCAAGTGGT > SEQ ID NO:4287 212858FL 219568_300946_1c
AAACATACGGCCTCGTGTGGCGCCTTGTCTCAGGGACAACAGACGACGAGCAACTCAAAGACCAGAGCTAAACATGGCT
TGGCTAGATGGCAATAAGCAGAGCACGCTTCAATCGAGAACAGACGCGCTCGACAATAAAGGATGTGCTACGGCACAGC
CATTGGGACAGATGATGTCGCGGTTCAACGGTAAGTCTTTTGATCTTGTTGATTGAGCATCATAACGTGAGGCCGGCTC
TAGTTGTTCAGGACGATAAATGCCACTTGCAATGACCGAAGCTGTTTGAGTCTCAATACACTCTGTACCAGATGAAAGG
GCTTCTATGTCTGCTAGGTTTTCATAGATTTGTCATAGTTATGACTCCTGAAGAAGTAGTTGTACTGCTAAATGAGAGC
CACTGTGTTTGCTTTGCCCCTGGCTAGCTAGTAGaAT > SEQ ID NO:4288 212883FL 211901_300872_1c
tttttcggcgtttggcatcaaaATCCCTTGGTCAGCGAACCCCGAGCCCGTGCGCTTGGGAAAAGTATGGGGGATTGAC
TTTTCGAGGGAGGGTCATGTGATCTTAGTACGTACCGCAGTTTTTAGTAACAGCCTAGAGGTTGCAAGTTTTTTTTTAG
AAATTCCCAACGCCAATGTTGGCTGTGGC > SEQ ID NO:4289 212892FL 211493_300899_1c
cgcatcttcacCaAGGCGCCGTCATCGCGCGGCATCATCGTCATTGACTTGAGCTTGGAAAGCTCAGCAAGATGCCAGC
AACCATGGCCCCTCCAACGCAGACTTTCAACCTCGATGTTGAGGCAATCTCGGGCATTTGCGGATCTATCTCTATAGCC
TGTTGGGTGGTCGTGTTCTCTCCGCAAATCATACAAAATTCCAACGCAGCAGCGCCGACGCTCTTTCGATTCAATTCA
TCATTGCTTGGCTCCTAGGAGATGTCTTCAATATCCTCGGAGCCGTTTTACAGGGAGTTCTCCCCACCATGATCATCCT
AGCCATCTACTACACCATTGCCGATCTCGTACTGCTCTCCCAGCTGTTTTACTATCGCGGATTTACGTGGCGCGACGAG
CCGACTCCATCCCCGCCCAAGACAAATGgccACTCTTCGACATCA

FIG. 2 continued

> SEQ ID NO:4290 212892FL 258836_301700_1c
ACAACCACAGACACGCACACGACGACTCGATATGGACGCCGTGTACACCGCAGTACAACCTCCAATTCATGGCCTAGAC
TCATCAGCCCTCAGCGGCATTATGGGATGCATTTCCATCGCCTGCTGGATCATTGTTTTCACGCCCCAGATTTATGAGA
ATTTCAAACGACAATCGTCAGAAGGACTGTCTCTCTCCTTCGTCGTCATCTGGCTCATTGGAGACATCTTCAATGTGCT
CGGAGCCATCCTCCAAAAGATCATCCCCACCATGATCATCCTCGCCATCTACTACACCCTGGCCGACATTCTGCTGCTC
TTGCAATGTCTGGTGTACACACACAGAAACAAGATGGTTGATCTCAAGCACCTGTCTCCCGCCACACCTCTTCTTGAGG
CCGATCCCAGCCACGATGCCGAGCCCCGTCCTGCTCCCGTGACCGAACCCGTGCCGCGAGCCAAGGTCATCTTCTACCG
TCTGCTGATGGTGGCCACCGTCATCGCTGCCGGCATTCTGGGCTACGTCTTCTCGTCCAACAACCACAAGGACGGTAAG
CCCGAGAAGCCCCACGACGATCCTTTGGAGATGAACATGCTGGGTCAGTTTTTCGGCTGGCTATGTGCT

> SEQ ID NO:4291 212902FL 212913_300845_1c
cccacgcgtccgccgtgactgaagttcaaccaCATCCCAAACACAATATAAAACCCTCACATTTTCAAAAGAAAATCGA
TTATTATCACACTAGAAATTAAGAAAAATAACAGGAAGCATGTCTGACGAAGAGGGCGGCACAACAAGATGCTGCGCCC
CGTTCCTCGCTCTCACCGAGCCCATTGAAGTCAGCGAACTAGGATGGCCTCGACAAACCATCCGCATTTTTCCAATGGC
CCTGGCCCAGTCCCCTCTTGTTCATCAACGAAAGTAGCGATGCGCGGGATCACTGCGCCAACGAGCGAACTTTCCTTTC
GTACCTCCGCCTGTCGATATACATGGCCATCGTCTCTGTCGCCATCACCGTCTCGTTCCACATCAAGGGTACGCCCAGC
GATCTCGAGCGCCGGGTGGCAAAGCCCCTTGGTGGCATTTTTTGGGTACTGTCTGTTGTGACTTTGGCTTTAGGAGCGG
GAAACTATATCAGGACTGTCAATTTATATGGTAAAAGAGCCGCTATTGTGCAATCTGGCTGGAAGACTCAGGTGGTGtt
GGGTATAATAGCTgctTCAATCATTGGGACGTGCATCATAT > SEQ ID NO:4292 212990FL 212948_300845_1c
cccacgcgtccgCTGTTCCTCCTCCTAGCTTCAAAAAGACGCCAAACCCTCAAAACTGCTCCCAACCAAAAATAATCCA
CTACAAACGCTTTCGATAAACTTGCTCAAATGCTCTCAGATGGGTAACGCAGATGCGTGTGATTGGCTGGCTGTGCGCC
TGGTCCCTGTTTTAGCCTCCCCGCCATTCGGGATCCGGAAACCGACTGTCTCTTTTGGACTGGGCTGGAAGATTTGGAA
GAAAGACGGTACTGTAGGGGAAAGATGATGCTTAATATTTGCTGTAAATTCTTATTGTTACTCATTGCATGTTACGCAA
TCGGGGCCTTCTTTTTGGCTTGGCAGTTGGTTATGTTAGTAATTGGCATGTACAGTACTGTATGACTCTGC > SEQ ID NO:4293 212995FL 219352_300944_1c
GACCCACGCGTCGTGCCCCTTATGATGTTTGTGTTTGAGACACGGCTGATGAGGGCTGAGAAGTTGTTCAACATTGCAC
AACGTCTGGAAAGACGGCAGTGGGCCATTCGAGTAAGAAAAGAACAACAGACGGATCCAGACTCTTGGTAGTAGCTAGG
CAGCAGTTTAACAGAAGGAACAAAACGGGTAATGCGGGTGGTTTTGGACGCCATGTGTTGACGTCTCTCCAGCTTTCTC
CATCTTCTCCGTACTGACTCTGTCTCCATTTGGCCGGGTTAGTCTTGTCAGTTTGGGGTTGGTCTTTGTCATGGAGCCA > SEQ ID NO:4294 213048FL 213090_300846_1c
catcCACGACAGCTTCGATAGCTTCGACaaaGACGAAAATCATCATGAAGCTTTCGCTGGGGATTGCCGCAGCATTTGT
GAGCTGCGCTGCAGCATCGCAGCCCGCCGCCGACGTTTACGTTCTGCCGAATCGCGAATCCGCATCGCCGCCGTCCATT
CCCAGCAGCGTTGCCCGACTCATCTTGCTGAAGCTGGCGGACTCCAGTTCCTTTTCCTTGGTCCGCGATATTCCTGACG
ACGTCGATGTAGAAGAGGTGGTCTCGTTGATGAATCGATATGGAGGCGTCACTACTCCATTGTTCGATGAGCTCGCTCA
TGAGCCTAAGCAGCTGTTCATTGCGCTTCAGGGCTTGACGACGAGCAGATGAAAGAGACCAGAGCGAAATTACAGCGG
CAGCCCTCATTCACTATCCCCGATGTGCCTCATATCGACCGTCTGCAATGGGCAACGGGCACTGAACCGCCTCCATCCG
AGTTTGTAAAAGGAAAAGGGATCAGCTGCTCTTATGATGAGATGACCAACCCAGTCGAGTCCCGGTGCTGGAAGGGAAA
GAGCTTGCTGGCTAGTTTTGATATCCAAAAGAAGCCCGAATACTTGGACGACGTGATCGACAGCTTCCCACGGCTGACC
TCGCTTGCTGAGATTGGCGAAGTGCAAACGACTTTCCTCTTCTTCACTGGCGTTGGTAAATTGTCGAGCCAGACCAAAG
CACTTCACAAGCGCCAGGCGGAGCGGGTGATTTCCCACTTTCATAAGACT > SEQ ID NO:4295 213052FL 213043_300846_1c
cccacgcgtccggcaccaattcccaattcatCTATATAATCTTCTATATCCCGATCGACACCACATCACATCCCGCCAT
GGCCGCTCCGACAGAAGCGCAGCTCGCGCATATCCAGCTACCTCGAACAGCTCGACATCCACTCCATCCACAAGAACTTC
CGCAACCCCAACTGGAAGCCCAACCAGCGCCGAAACAAGAACCTCAAGGCCATCGTAGGCGACGCGTCGAAACGAGAAG
CCTCTGCCCTTGCGACTCCACAAGACGTCAGCGGCGATGCGACCCCAGCCGCCGACGATGGCCTCTCGACCAGCGGCAC
CTCGACGCCGGCCACAAGCACCAATGGGAACCCGCCGCCGCCGCGAATCTTGCGCAGGCTTCGCGTAGTTTGTCGAAGCTC
GTGCTGGAAAAGACGTTGAAGCCGCCTGTGGGAGGGGCTGGAGCTGTGTCGGCCACCAAACGCGACGTACACAAATATTG
AGTCGGCGCCTTCATTAGCACATTCGAAGCACTACTGCGATATTACGGGCCTTCCGGCGCCTTACTTGGATCCCAAGAC
CAGGCTGCGGTATCACAACAAGGAAGTGTTTGGGTTGATCAGAGCAttgccCCAGAGCTCTgcgGAGCAgttcctggcT
gctCGtggcgCGCATAcggtgcTGAagtgagcgcGCTgGTGgATGattATAcg > SEQ ID NO:4296 213063FL 220266_300953_1c
CGGAGCTGAGAAATATTAATGATACTATTAGGTCGCAGCGAAATCGATTGATCTATTCGTATTGGGGGTGCAGGGGGAA

FIG. 2 continued

```
TCCCAGGTGACGGCGTGGTCTGCCGCAACAGTTGGCGGTGTACCCATCGACAAATGTCTCTCAGCGGACAATGCCATCA
ATCGCGCCGAACTTTCCAGCGAGTGTAAGAATCGATCGCAAAGTATAGTTCGAGCCAAAGGAGCAACTCCTTTCGGTAT
TGGTTCCATCGTGTCCAGCATTTGCTCTGCCATTGTCTTTGACAAGCGGACCGTTCATCCTCTAAGCCACTTCCAGCCG
TCATTTGGATGCTGTTTCAGCTTACCCGTGGTGCTCGGCATAAAAGGAATTGAACGCACAGTAAAAGTGCCACTGGATA
GGGACGAGGATGTTCAAATAGCCGACTCAGCAATTGCACTCAAAATGATGATTGACCAAGTGAGTAAGAACTGGTGAGT
ATAGCGAATTGAGAAAAATAAGACAAGGAGGGGGGCTATTAGGGACCATAACTGTCTCGTAAATTAAGAGTTGTCTAGC
TAATACACTACGAATGTGTATGTAATGCAAAATTTGGATGTGTAAAT

> SEQ ID NO:4297 213084FL 217877_300912_1c
aggcatttggctagagGacaaaacaacatgagcccaacagtttaaAATCGATCATCGTCAGGTTGTTCAAAGCCAAGAT
TTAGAATAATCACCTATGCGTGTAATTAGTACGGTTCAGAGAAGATGCAACCAACTCCAAGTCAGGTACAAATTTCAAT
GATTCAAAGACTGGTATATATGGCCTTGTTTTGCAGAGCATCAAACTTTCTGCCGGGTCGGTACCTACATTAATGGGC > SEQ ID NO:4298 213120FL 220480_300955_1c
gGTTTGGCTTGCAGTAAGACCGGCTTATGAGAAAGACCATTGTGAGAGATGTAAGGCTGATCCGGAGCTCTACGTCATC
TGAGACATGACATTGGCATGATGAGGGTCCAGTAACTACCTGATGATTGGGGTAATCGAAAGAGATGCAGAGAGAAACA
CGCAACTCTGAGAAAGCGTCCCGTTACACACGGAACACACTGCCTCCGGACAGCGGCTTGTGGCTCATTGCTTGAGTCC
CTTAATCAGCAATCCCCAGGTTCTCTTGACAGCTCAGCGGTGCAGTTTTGCGGGCACAGCTGATCCACCCGTCAACGGG
GCGGGACGCCGGGAAGCCGGGACTCCGGGGCTAAAATGACATCGCCATGACATCCGCACCGTCCGACCAGAACTGCTAC
TACTCAAGACGGTAAGCAAGTGCTaGcAAAAGTGAGTTTTACGAGGTAAGCAAGTAGGAACGTGGCTTATAAAGCCACA
GCTagcTTGAGGCGAAGGCTGCTagtaggAACTAAAGTCAGCTtaTACTAtTTATAAGctcACTGCATGGGCtagtaaT
AATAGCTC > SEQ ID NO:4299 213123FL 1176988_302115_1c
TACTCGAGCTGATTTAACAAATTTTAACAAAATATTAACGCTTACAATTTCCTGATGCGGTATTTTCTCCTTACGCATC
TGTGCGGTATTTCACACCGCATCAGGTGGCACTTTTCGGGGAAATGTGCGCGGAACCCCTATTTGTTTATTTTTCTAAA
TACATTCAAATATGTATCCGCTCATGAGACAATAACCCTGATAAATGCTTCAATAATAGCACGTGAGGAGGGCCACCAT
GGCCAAGTTGACCAGTGCCGTTCCGGTGCTCACCGCGCGCGACGTCGCCGGAGCGGTCGAGTTCTGGACCGACCGGCTC
GGGTTCTCCCGGGACTTCGTGGAGGACGACTTCGCCGGTGTGGTCCGGGACGACGTGACCCTGTTCATCAGCGCGGTCC
AGGACCAGGTGGTGCCGGACAACACCCTGGCCTGGGTGTGGGTGCGCGGCCTGGACGAGCTGTACGCCGAGTGGTCGGA
GGTCGTGTCCACGAACTTCCGGGACGCCTCCGGGCCGGCCATGACCGAGATCGGCGAGCAGCCGTGGGGCGGGAGTTC
GCCCTGCGCGACCCGGCCGGCAACTGCGTGCACTTCGTGGCCGAGGAGCAGGACTGACACGT > SEQ ID NO:4300 213123FL 254923_301640_1c
GCTGATTTAACAAATTTTAACAAAATATTAACGCTTACAATTTCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGGACTGACACGT > SEQ ID NO:4301 213123FL 259641_301707_1c
ttactcGAGCTGATTTAACAAATTTTAACAAAATATTAACGCTTACAATTTCCTGATGCGGTATTTTCTCCTTACGCAT
CTGTGCGGTATTTCACACCGCATCAGGTGGCACTTTTCGGGGAAATGTGCGCGGAACCCCTATTTGTTTATTTTTCTAA
ATACATTCAAATATGTATCCGCTCATGAGACAATAACCCTGATAAATGCTTCAATAATAGCACGTGAGGAGGGCCACCA
TGGCCAAGTTGACCAGTGCCGTTCCGGTGCTCACCGCGCGCGACGTCGCCGGAGCGGTCGAGTTCTGGACCGACCGGCT
CGGGTTCTCCCGGGACTTCGTGGAGGACGACTTCGCCGGTGTGGTCCGGGACGACGTGACCCTGTTCATCAGCGCGGTC
CAGGACCAGGTGGTGCCGGACAACACCCTGGCCTGGGTGTGGGTGCGCGGCCTGGACGAGCTGTACGCCGAGTGGTCGG
AGGTCGTGTCCACGAACTTCCGGGACGCCTCCGGGCCGGCCATGACCGAGATCGGCGAGCAGCCGTGGGGCGGGAGTT
CGCCCTGCGCGACCCGGCCGGCAACTGCGTGCACTTCGTGGCCGAGGAGCAGGACTGACACGTGCGGCCGCGTCGAGGG
GTAG > SEQ ID NO:4302 213123FL 264693_301383_1c
GTCGACGAGCTGATTTAACAAATTTTAACAAAATATTAACGCTTACAATTTCCTGATGCGGTATTTTCTCCTTACGCAT
CTGTGCGGTATTTCACACCGCATCAGGTGGCACTTTTCGGGGAAATGTGCGCGGAACCCCTATTTGTTTATTTTTCTAA
ATACATTCAAATATGTATCCGCTCATGAGACAATAACCCTGATAAATGCTTCAATAATAGCACGTGAGGAGGGCCACCA
```

FIG. 2 continued

TGGCCAAGTTGACCAGTGCCGTTCCGGTGCTCACCGCGCGCGACGTCGCCGGAGCGGTCGAGTTCTGGACCGACCGGCT
CGGGTTCTCCCGGGACTTCGTGGAGGACGACTTCGCCGGTGTGGTCCGGGACGACGTGACCCTGTTCATCAGCGCGGTC
CAGGACCAGGTGGTGCCGGACAACACCCTGGCCTGGGTGTGGGTGCGCGGCCTGGACGAGCTGTACGCCGAGTGGTCGG
AGGTCGTGTCCACGAACTTCCGGGACGCCTCCGGGCCGGCCATGACCGAGATCGGCGAGCAGCCGTGGGGCGGGAGTT
CGCCCTGCGCGACCCGGCCGGCAACTGCGTGCACTTCGTGGCCGAGGAGCAGGACTGACACGTGCGCGGCCGCTCaGct

> SEQ ID NO:4303 213123FL 258937_301701_1c
gcAGATACtttacaaTttCGCCTGATGCGGTATTTTCTCCTTACGCATCTGTGCGGTATTTCACACCGCATCAGGTGGC
ACTTTTCGGGGAAATGTGCGCGGAACCCCTATTTGTTTATTTTTCTAAATACATTCAAATATGTATCCGCTCATGAGAC
AATAACCCTGATAAATGCTTCAATAATAGCACGTGAGGAGGGCCACCATGGCCAAGTTGACCAGTGCCGTTCCGGTGCT
CACCGCGCGCGACGTCGCCGGAGCGGTCGAGTTCTGGACCGACCGGCTCGGGTTCTCCCGGGACTTCGTGGAGGACGAC
TTCGCCGGTGTGGTCCGGGACGACGTGACCCTGTTCATCAGCGCGGTCCAGGACCAGGTGGTGCCGGACAACACCCTGG
CCTGGGTGTGGGTGCGCGGCCTGGACGAGCTGTACGCCGAGTGGTCGGAGGTCGTGTCCACGAACTTCCGGGACGCCTC
CGGGCCGGCCATGACCGAGATCGGCGAGCAGCCGTGGGGCGGGAGTTCGCCCTGCGCGACCCGGCCGGCAACTGCGTG
CACTTCGTGGCCGAGGAGCAGGACTGACACGT > SEQ ID NO:4304 213123FL 189636_300607_1c
GCTGATTTAACAAATTTTAACAAAATATTAACGCTTACAATTTCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGGACTGACACGTGCGGCCGCgt > SEQ ID NO:4305 213123FL 207611_300827_3c
ctcatctcagtcgtGTCTTGTCATTATTACTCGAGCTGATTTAACAAATTTTAACAAAATATTAACGCTTACAATTTCC
TGATGCGGTATTTTCTCCTTACGCATCTGTGCGGTATTTCACACCGCATCAGGTGGCACTTTTCGGGGAAATGTGCGCG
GAACCCCTATTTGTTTATTTTTCTAAATACATTCAAATATGTATCCGCTCATGAGACAATAACCCTGATAAATGCTTCA
ATAATAGCACGTGAGGAGGGCCACCATGGCCAAGTTGACCAGTGCCGTTCCGGTGCTCACCGCGCGCGACGTCGCCGGA
GCGGTCGAGTTCTGGACCGACCGGCTCGGGTTCTCCCGGGACTTCGTGGAGGACGACTTCGCCGGTGTGGTCCGGGACG
ACGTGACCCTGTTCATCAGCGCGGTCCAGGACCAGGTGGTGCCGGACAACACCCTGGCCTGGGTGTGGGTGCGCGGCCT
GGACGAGCTGTACGCCGAGTGGTCGGAGGTCGTGTCCACGAACTTCCGGGACGCCTCCGGGCCGGCCATGACCGAGATC
GGCGAGCAGCCGTGGGGCGGGAGTTCGCCCTGCGCGACCCGGCCGGCAACTGCGTGCACTTCGTGGCCGAGGAGCAGG
ACTGACACGTG > SEQ ID NO:4306 213123FL 135677_300416_1c
GCTGATTTAACAAATTTTAACAAAATATTAACGCTTACAATTTCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGGACTGACACGTGCggccGCgt > SEQ ID NO:4307 213123FL 226621_300999_1c
GCTGATTTAACAAATTTTAACAAAATATTAACGCTTACAATTTCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGGACTGACACGT

FIG. 2 continued

> SEQ ID NO:4308 213133FL 208416_300835_1c
gcggacgcgtgggcggacgcgtgggcggacgcgtgggcggacgcgtgggAAGGAATCAGCCAAAGCTCGCGCGTTACCC
CGGGGGTTTGGTTCTCCATCTGACTGCTTTGTACTGCTACTACTGCCCGGAGTGCGAGTAACACCCGCTCGTATTATCG
CGACGCCTTTACACTTTTGATTACTCGAGTTGGTCCCTCCGATCTTCAGGGACCGTTTAATGCGGCTATTCTCCCAAGC
GGAGCTTCGTGGTCTTAACGGTTGTTGCGTTGCCGAGCCAGTCTGTGTATTAGTTGTGTCCCGAGCTTATTGAACCTGC
TGCACGCACTTAATCCGCTTCTTTGCCCTTGATACCTACATGCCTGCATTTGGCAGCACACGCCACCTGGTACGTTGTA
TTTAGTTACTCTTAGTCTATGCAGACAACAACTTCTCTCTCCCAACC > SEQ ID NO:4309 213137FL 220540_300956_1c
aacttacaAATTACAACCTACAACTGCCCACAATGTCGCTTTCTGTTGGTGCTTCTCTGCGGCCTGCGGCCTTCCGCTG
CGTTGGTGCGTCTGCCGTGCGCATGCGATGTGCTTTTGGCACAACTGCGTCCAGAAGGAGTGAGAGCTCGACGCCGGGC
GAGCTTGGGGTTGGAGAGCTGCAGGGCGCATCGTTTCGCATTGAGCCTCTCCGGAGGGTTGGGGAGGATGCTTCGACTA
TGCCGAGCGAGACTTTTATACCAATCTCGGAAGCGCGGAACCCTCGAGTCGGATCTTTTACTGTCTACGTTTGCCTCACA
GAACCTGCCCACCATGACGGCCGAAGAACTGCGGCAGTACGACCTCTTCCTCGACGAGAACGACTGGGACATATACTAC
TGGGCGACGCAGCGGGAGCCGAATTCCACGACGAACCCTTCCGTGACGGCGAGTCCGGCGAGTGCTTCGGCGAGCGAAG
GGTTCGAGGCGAGACAGCAGGATGAGTTGCCCAAGAATCCGCCAAAGGGGGAGTGGGCGCAGACGGTGGGCAATTTTAA
GCCTGCGTATAGGCCGGTGCCGcagaGTGGAAGGATAGCGAGATTTTGgAGAAGTtgagggcGcatgtgagGAGGAAG
AGTGTGAA > SEQ ID NO:4310 213144FL 211502_300900_1c
agatcacTCCACCACGAAGCACTTTTCAAACCGAAGACCTACACGCATCTTCATTTTCAACCGCCAAAATGGGTATGAT
CGACGCCAAGAACAGGGTGACGGAGCACCAGCGCTTTTACCAGGCTGCGTACAAGGCTCACACCCGCCTGTGGAAGATT
AACCCCCGAAGCAACTGGTACATGGCCCCCTACCTCGTCGCCCTCTGGGGAGGTTTCGGAGCTACCCTTTACGCTGCCA
GCCGAAAGGTTGCCGGCCACAACACCTGGTTCAGCAAGGATTAAAGTATCGGTATCTATGGGACGAGCCAATTGAGTTA
CCCCAACTTGCGTCAAATGCAAGATTGAGGGTATGTATGAGTTTAAAGTCTTATAGACAGTAAATATAGGATTTGTCAG
TCCGTCTCATACGTCTCGCTGCT > SEQ ID NO:4311 213260FL 213888_300861_1c
acaatacatctcatgttcacagagcagatacatcttcaaccctctcccaAGAGATATCTGGGCTTCAACTCTCAATTCA
TATTTACAATAAAAGTAATAAAGATTGAAACCGCCAGCAACTCCAAGTCACAACCACATACATCATGCCTGCGCAAACT
ACATCTCCCCACCTGGCCAACCTCGAGCGCGACGGCTCGTCGTCATCAAATCCATCGTCTCCCCCTCGAAGCTCGAGG
CCCTCCGCACCGCCAGCCTTAAAGCAGAGCAGCTCGCCCGCAGCGGCCAATGGCCTCACGTGCGGACCGTGGGCAAACA
GTTCCCGCCGTGGAACCACGAGGAGGCGCAGGAGAAGGGCATCTGGGGCGTGCAGCACCTGATGAAGCCTTCGATGCCC
GGCCACGAGACGTTTACGGCGCTGTACTTTTCCGAAGAGATCTTGAGCATTGTGAGGGAGTTGCTGCAGTGTGAGGATG
AGGAGCTGGTGATGGAGCTGTTTAACATGCTGGTGAGGCCGGATAAAGACTTTGAGCTGCGGTGGCATCGGGATGATAT
CTCGGCGGAGGCGTCGGCGGAGGAGGAGATGGAGAGGCTTGGGCGGCCGGCGTTTCACGCGCAGTATAATTTTGCGCTG
TGGGAGGATGAGTCGcTTgttttg > SEQ ID NO:4312 213287FL 215161_300878_1c
GCCAATCGGGAACAAAAAAGGGCTGCGCGTTCTTTTTGCCTCTCCTGACTCCTTACAGATGGGTGGCATTGCTAAGGTA
CAGTGTGGAGTCTGCAGTGGATTCGAGAGCTGCGATTTCAGTTGTTTGGACCTGGACGGAGAATTTTACGGAGCAGCTC
ACCCTTGATCCAGTTTAGGTAGGCGGTGTCTCTTGTTGGCGTGTTTTATAAGAGCAACTTTGCTGGTGGTAATAATGAT
GTCCATGCTATTTTCGTATTTCTGGAATAGGTACCTGGTATGGCAAAGAGAATAGAATGATGGTGAATGAGATTACACA
GTTCG > SEQ ID NO:4313 213354FL 215223_300879_1c
GGAGTTTGTTCGTTTATTTCGTTCTCCCTAAGATGTTGCGGATCATGATGTAGTTGCTCTCCAAGTATACATAAGATAG
CCATAAACATAGCCACAGCAGCGCCCAACAACAACTGGGACCAAGGGTGGGTGGAAGTCTGGCTTCCAGCACAGTACTT
TGCATGATAGAGTCATGACAATGTCATGAAAAGAGAATTGTATGTACATGTCTTATATTTCCTGATACAGCTTGGGCAC
GGAGCGCGTGTGACGAAGGTAGGTGATGGTTGCTACGTATAGGTAGGTTGGGATTGAAGTCACATGCTTCATCCTCACT
TGTATGAAACCCGTTTCTCAGCCCATACCAGCATATTTGAACCAGTTGGGACGGCAATCTTCTCGGTGGAGGAACGGCT
CACCATCCGTCAGTCGACCAGTAACACAGCCCTTGCATTTGGGAGAGTTGGGGCAGTTGAAAAAGGGGATGTGCTGGTA
GCCAATATCACGGAACCAGTGGATTTTGCTAGAATCCTCAAATAGACCCAGGGCAAT > SEQ ID NO:4314 213387FL 1099213_301550_1c
ggaagaaagaagctttcatttcaTTTCATTGGCCAAAATGAAATTCAATCCCAGAGTGAGCAGCTCCCGACGGAAGTC
GCGTCGAGCGCATTTTACGGCCCCTTCAAGCGAGAGACGCATTTTGATGAGTTCTACTCTCTCATCAGAGCTCAAGAAC
AAATACAATGTGCGAAGTGTCCCAGTACGTAAAGACGATGAGGTGCAAGTAGTGCGAGGGACATTCAAGGGAAGAGAGG

FIG. 2 continued

```
GGAAGgTTGTGCAGGTGTATCGACGCAAATGGGTTATTCACAtcgaGCGCATCACCCGCGAcaAAGTTAACGgagctag
cgtTAAtGtcgGAAtTGATCCCTCaaaGGTGATAATTACAAAGCTGAagcTGGATAaggacaggaaggcCCTCCTtgac
agaaaGGGAaagGgaagagcagccgacaagGGAaaaggaaAGTTcTCTgcAgAgGATgtagcagcacctCttcaagATA
TCgatTAAgtGa
```

> SEQ ID NO:4315 213387FL 175920_300523_1c
```
CCCCTGGCCCACCAAAACCCTAGCCGCGCCGCCGCCGCCGACGACCAGGTAAGGAAGGAGATCCGCCGCCGGCGCCGCC
ATGAAGCGCAACCCACGCGTGACGAGCTCCCGGAGGAAGTGCCGCAAGGCGCACTTCACGGCGCCGTCGTCCGTCCGCC
GCGTGCTCATGTCGGCGGCGCTGTCGTCGGAGCTCCGCCACAAGTACAACGTGCGGTCCATCCCGATCCGCAAGGACGA
CGAGGTGCAGGTGGTGAGGGGGAGCTACAAGGGCGCGAGGGGAAGGTGGTGCAGGTGTACCGCCGTCGCTGGGTCATC
CACGTCGAGCGGATCACCAGGGAGAAGGTGAACGGCTCCACCGTCAACGTCGGCATCCACCCCTCCAAGGTCGTCGTCA
CCAAGCTCAAGCTCGACAAGGACCGCAAGGCCATCCTCGACCGCAAGGCGC
```

> SEQ ID NO:4316 213387FL 252878_301605_1c
```
AGGCGTAGGTGTAGTTGTAGGAGGAGGAGGCGAGGAGCCGAGGAGGAGCAGGAGTTCAAGGTCCGTCGCCCACCATGAA
GTACAATCCCAGAGTGAGCAGCTCAAGGCGTAAGTCACGCCGGGCTCATTTTACTGCCCCTTCAAGTGAGAGGCGTCTT
TTGATGAGCTCTGCCCTTTCATCAGAGCTGAAGAACAAGTACAGTGTGCGATGTGCCCCAATCCGAAAGGATGATGAGG
TCCAGGTTGTCCGAGGTACTTACAAGGGCAGAGAGGGCAAGGTTGTCCAGGTGTACCGACGCAAGTGGGTTATCCATAT
AGAGCGCATCACTCGCGAGAAAGTCAATGGAGCTACCGTCAATGTGGGGATTCACCCTTCAAAGGTTATTATCACAAAG
CTAAAATTGGACAAGGACAGGAAGTCTCTCCTAGAAAGGAAGGGCAAGGGAAGAGCGGCCGACAAGGGCAAGGGCAAGT
TCTCTGCTGAGGATGTAGCTGCACCTCTTCAAGACGTGGATTAACTTTTTTGCTCT
```

> SEQ ID NO:4317 213387FL 247139_301617_1c
```
GGAGAACCCTAGGCGGCGGCGAGAGGTAGGCGGCAGCAATGAAGTCCAATCCGGCGGTGAGCAGCTCGCGGCGCAAGTC
GAGGAAGGCGCATTTCTCGGCGCCATCGAGCCTGCGCCGGGTGCTGATGAGCGCATCGCTGTCGTCGGATCTACGGAAC
AAATACAATGTTCGATCTGTTCCTGTCCGCAAGGACGACGAGGTCCAGATCGTTCGCGGCTCGTTCAAGGGTCGGGAGG
GCAAGGTCACCCAAGTCTACCGCAAGAAGTGGGTGATTCACGTCGAGCGCATCACGCGCGAGAAAGTGAACGGTGCTAC
TGTGAACGTTGGTGTTCATCCGTCCAAGGTTGTGATCACCAAGTTGAAGCTGGACAAGGACAGAAAGGCGCTGCTGGAC
AGGAAGGGCAAGGGACGTGCGGCAGAGAAAGGCAAGGGGAAGTTCACGACCGAGGATGTGGCTCCGGCGCTCCAAGAAG
TGGATTGATTGTTTCTTTCTACTCTTATCTAGTCTTCTTACTCAAAAATGCGAACTCTCCAGGATTTTGGCTGTCCAAC
TTGATGTTAAGTGAAAACGTTTTTTatTGTTTGATCCATCACAAAaaa
```

> SEQ ID NO:4318 213387FL 228272_301019_1c
```
TTCTTTTTTTTTTTCTCTCTCCCTTCTCTCTCTCTACAAATCTGGGGCTCCCAGTATAGCTTAGGTTGATTTAATTAT
GGTTAACCTCTCACAGTAATCCGGGTGAGAGGTGGGAAGCCAAAGTGGGAGAAGCAAATATTCTCAGGGCAGGTAAGGT
AAGCGAAGGCGAGAAGAGAAGAGACGAGAGAGAAGAGGAAGAAGGTAAACTAGTCTCTCTTGTACATGGTGGCTTCC
TTCCCTTCCCTTCTCTTCCCATCTCTCTCTCCTCTGGTTTTCTCCTACCTTTTCTTTTGGGGGAAAAAATAATATTAAT
TAAGGCGCGCGTGCGCGCCGCCGCCGCCATGAAGCGCAACCCACGCGTGACGAGCTCCCGGCGGAAGTGCCGGAAGGCG
CACTTCACGGCGCCGTCCTCCGTCCGCCGCGTCCTCATGTCCGCCGCCCTCTCCACCGAGCTCCGCCACAAGTACAACG
TCCGCTCCATCCCCATCCGCAAGGACGACAAGGTGCAGGTGGTGAGGGGGAGCTACAAGGGCCGCGAGGGGAAGGTGGT
GCAGGTCTACCGCCGCCGGTGGGTGATCCACGT
```

> SEQ ID NO:4319 213387FL 224305_300971_1c
```
GTCTCGCATCTTCGCGAAGAAAAAGCAGAAAGGCGCACTTCGGTGCCGGCTCGACTCAGCGCCGCAACATCATGAGCGC
TCCTCTTAGCAAGGAGCTCCGTGAGAAGCACGGTGTCAAGTCGCTCCCAGTTCGCAAGGAGGATGAGGTCTCAGTCATC
CGTGGCTCTAACAAGGGTCGTGAGGGCAAGGTTTCGTCGGTTTACTTTTTGAAGTATGTTATCCACGTCGACCGTCTCG
TCCGCGAGAAGTCCAACGGCCAGTCTGTTCCCATCGGCGTTGCACCATCGAAAGTCGTCATCACCAAGCTCAAGCTCGA
CAAGAACCGCGAGTCTATCCTGGAGAGGTTGAAGCTGGGTCGCGAGACGAAGGCAAAGTCGATGAAGGAGAAGGCATAG
AGGAACGCCGACACGAAGGACGCGGGAGAGATCATTTGCATTAGGCGTTCATGATTCTGTGGTTATAAGAGCACCCATG
GATGGGACGGCATGGCATTTTCACGGCACAGTCAAAATTCAATGTGTATTGAAGAGCAGACATCCAAATGTGAA
```

> SEQ ID NO:4320 213387FL 195673_300636_1c
```
gctcaaccGACAAAACAGGATCTCCTCGTCGTCCAAATCCAACCGTCAAGATGGTCAAGGTTAACAAGAACATTTCCTC
CTCCAGGAGCAAGAGCCGTGCCGCTCACTTCAAGGCCGGCTCCGGCCAGCGCCGTGTCATCATGAGCGCTCCCCTTAGC
AAGGAGCTGCGCGAGAAGTACAACGTCCGCAGCATCCCCATCCGCAAGGACGACGAGGTCACCATTGTCCGTGGCTCCA
ACAAGGGCCGTGAGGGCAAGGTCACCTCCGTCTACCGTCTCAAGTACGTGATCCACGTCGAGCGTGTCACCCGCGACAA
GGCCAGCGGCCAGAGCGTCCCCCTGGGCATCCACCCCTCCAACGTCGTCATCACCAAGCTCAAGCTCGACAAGGACCGT
GAGAGCATCCTGTCTCGCTCCAAGGTCGGCCGTGAGCTCCGTGTCCCCAACAAGATCTCTGCTTAAATTCATAAGCAAA
```

FIG. 2 continued

TCTTAACAATTGGGTGAGACGAGGAGATGAATCTTTTTTTTTCAACTTAACAGTTTTTCCATGTGATGCATCCAtGGC
ACAATGATGGGCAAGGAATGGGCATATATACTCCGGCGTTTTagcGATACCCgagaCcCCTGcaggtccggCTTTCtCa
gcagggTagaTgAATCgagaaTTTTACAATTCTcaatggccgtttcaCcaaCttg > SEQ ID NO:4321 213387FL_187507_300678_1c
CTAGCTCCCCCCGCGCCGCCGCCGCCGCCGCCATGAAGCGCAACCCACGCGTGACGAGCTCCCGGCGGAAGTGCCG
GAAGGCGCACTTCACGGCGCCGTCCTCCGTCCGCCGCGTCCTCATGTCCGCCGCCCTCTCCACCGAGCTCCGCCACAAG
TACAACGTCCGCTCCATCCCCATCCGCAAGGACGACGAGGTGCAGGTGGTGAGGGGGAGCTACAAGGGCCGCGAGGGGA
AGGTGGTGCAGGTCTACCGCCGCCGGTGGGTGATCCACGTCGAGCGCATCACGAGGGAGAAGGTGAACGGGTCCACCGT
CAACGTCGGGATCCACCCCTCCAAGGTGGTCGTCACCAAGCTCAAGCTCGACAAGGACCGCAAGGCCATCCTCGACCGC
AAGGCGA > SEQ ID NO:4322 213387FL_157865_301743_1c
AAACCCTAGAGCTCATCTTCTTCACCGGCTGCCCATTGGCGAAGAAGCAGAGCAGACCAGAAATCAGCAAAAATGAAGT
ACAATCCAAGAGTATCCTCCTCCCGCCGTAAGAGTAGAAAAGCCCATTTCACGGCGCCTTCAAGCGAGCGCAGGGTGAT
AATGAGCGCGCCGTTATCCACCGAATTACGTTCAAAGTACAACGTAAGATCTATGCCGGTGAGGAAAGACGACGAAGTC
CAAGTCGTTCGTGGGACCTACAAGGGGCGTGAGGGAAAAGTCGTCCAAGTGTACCGTAAGAAATGGGTGATTCACATTG
AACGTATAACTAGAGAGAAGGTCAATGGATCTACTGTTAACGTTGGTATTCATCCTTCTAAGGTTATTGTTACGAAACT
CAGGCTTGACAAGGACAGGAAATCGCTACTTGATCGTAAGGCCAAGGGACGCGCAGCTGCTGATAAGGACAAGGGTACT
AAGTTTACTGCTGAGGATATCATGCAGACCGTCGATTGATTTTTTCAATCGTATCTTTCTGTCTGGTATTGTTTTTTAG
CTAAAGAGAGGATTTTAGTGCTTTTAAGACATTGAATTTTGTTCGAGTTTCTGTTATTTAAATCAatGATGATGATACT
TCTGAATCTTAtacactatatttGCTCagccatTGGTGCATACTTGgtgattaaAGttCTAAAGC > SEQ ID NO:4323 213387FL_147063_200015_1c
TTTATCAGCCGCATTTGCAGTCTGTGTGTTTGAATCAGATTTTGCAAAGATGAAGTACAATCCAAGAGTTTCCTCCTCC
CGCCGGAAAAGCCGAAAGGCCCATTTCACGGCCCATCAAGCGTCCGCCGAGTGTTAATGAGCGCACCCTTATCCTCCG
AATTACGCACCAAGTACAACGTAAGATCTATGCCGGTAAGAAAAGACGACGAGGTTCAAGTCGTACGAGGAACATACAA
GGGGCGTGAGGGTAAAGTTGTCCAAGTTTATCGCAAGAAATGGGTGATTCACATTGAGCGGATAACACGTGAGAAGGTT
AATGGATCCACTGTTAATGTTGGTATTCACCCATCTAAGACTGTTATTACTAAGCTCAGACTTGATAAGGACCGTAAAT
CTTTGATTGATCGTAAGGCTAAGGGACGTGCTGCTGCTGATAAAGACAAGGGTACTAAGTTCACTACTGAGGATATTAT
GCAGACCGTTGATTAAATTTTGAACCTGTTTGTCGCTGTTACAGAGTTCTATtgggTAGCTGAACGAGAGgttATATTA
CTAAttTAGTACgttttgtgttgttaagaTtTttgggaTCTttaaTtCtA > SEQ ID NO:4324 213387FL_1118410_301856_1c
TTTTAGAGGGAGCAGGCGTAGGTGTAGTTGTAGGAGGAGGAGGCGAGGAGCCGAGGAGGAGCAGGAGTTCAAGGTCCAT
CGCCCACCATGAAGTACAATCCCAGATGAGCAGCTCAAGGCGTAAGTCACGCCGGGCTCATTTTACTGCCCCTTCAAG
TGAGAGGCGTCTTTTGATGAGCTCTGCCCTTTCATCAGAGCTGAAGAACAAGTACAGTGTGCGATGTGCCCCAATCCGA
AAGGATGATGAGGTCCAGGTTGTCCGAGGTACTTACAAGGGCAGAGAGGGCAAGGTTGTCCAGGTGTACCGACGCAAGT
GGGTTATCCATATAGAGCGCATCACTCGCGAGAAAGTCAATGGAGCTACCGTCAACGTGGGGATTCACCCTTCAAAGGT
TATTATCACAAAGCTAAAATTGGACAAGGACAGGAAGTCTCTCCTAGAAAGGAAGGGCAAGGGAAGAGCGGCCGAGAAG
GGCAAGGGCAAGTTCTCTGCTGAGGATGTAGCTGCACCTCTTCAAGACGTGGATTAACTTTTTGCTCTAGTAAAACGG
TATTCCGTGGTTGATGAACATATGCCGAAGGTGGGAGTGGTTAAATGCCTACCCACCTCAGTTTTAGTGGAGAGAACTG
TTAGCTGTCATTTTTATCTGGCTAGTTTCTGCAATGATACTAGAGATATATCTTTTTtGGTAACCTtg > SEQ ID NO:4325 213387FL_128885_300478_1c
cggcagagatagtgagagagagcgacagagaaatcggcgaagatgaagtacaatccaagagtatcctcgtcccgccgca
aGAGCAGGAAGGCTCATTTCACAGCTCCTTCCAGCGTTCGTCGCGTGTTGATGAGCGCATCTTTGTCATCCGAATTGCG
AACCAAGTACAACGTTAGGTCTATGCCGGTGAGGAAGGACGACGAGGTTCAGGTTGTTCGTGGGACCTACAAGGGCCGT
GAGGGCAAAGTTGTTCAAGTTTACCGTAAGAAGTGGGTGATTCACATTGAGCGCATTACCAGAGAGAAAGTTAACGGAT
CTACCGTTAACGTTGGAATTCACCCTTCCAAGGTTGTCGTCACCAAGCTCAGGCTCGACAAGGACCGTAAGTCTCTTCT
TGACCGTAAAGCTAAGGGTCGTGCTGCTGCTGATAAAGATAAGGGTACTAAGTTCACGCCGAGGATATCATGCAGACC
GTTGATTAGTTTTTCTGCTACCTCTAGTGTTTTTGTCTTGTTATATTTTGTTGCTGTTAGTACTTGATGCTTGTTGGGA
TAGCTGAAGAGAGTGTTTCTGAAGCTATGAATTTTGTTGCAGTATTTATGATAACAGTATGCAATTTTTGCTATAATC
AAATGTCTTTCTCGTT

FIG. 2 continued

> SEQ ID NO:4326 213569FL 207785_300828_1c
ggacctataagacaagctgtggcttttttaatccttaatccttactttcaattccattccagtgttgctacctttctt
gGGAATAACTCAGCTACAAAGACAATTTTGAACCTACAACATCATCATCAAATTATCATTATTCAAAATGAAGTTCACA
ACCATCGTCACCGCTGCTGTCTCTTCAGCCATTGCCGTCTCCGGCACTCCCATCCACAAGCGCGAGATCGGCGGCGTAT
GTCTTCTCCCTCTCCTCTCCCTTGCATCTTCTCCATTCCTATCACTCGTCTGATTCAATATCATCTCTAACTATTGGTC
AATCCCTCACAGGTCCTCTTGTGCACCGGCGTCAATGCAACCGGCACCTGCAGCTACAACGTCTACGAACTCAAGACGT
GCCACCAGCTTCCCGCGCCTTTCCACCAAAACACCAGCACGTTTGCCCCCGACGGCGAAGACTTTGAGTGCTTCCCTCG
TATTGGCGACTGCGGTTCTATTTGCACCAGCCCGACGGGATGTACCTTTGGCAGCGTCGACTTTAACTACAAGAACAAG
TTCAATCTGGGGGCTATTAAGTGTAACACCTTGATTTCCAGCTTTGACTGTTCGCTGAAGACGACGACGACTTCAACTG
agTAAAAAGGAAAAAAGACAAAATTATGTTTTaCAAAGTGTTGGAggaTcgcATCTTgttttTGTTTAATGTACGACTTA
TAcCAacGAtGaggatccatctcAt > SEQ ID NO:4327 213728FL 213725_300860_1c
GGCGTTTGTGGTTGACAGAGGGAGAGGCTGTGTTTGGTTGAAGGAGGAGAAGAAGAAGAAGAAGATGTGAAGAGGAAAT
GCCGAAAAGAAGGATGAAAGATATGTTCTTGTCTCGAGCTCTTTCCAATTGCTCTGGCCTTGTGCATACCATACAGAGG
CAGGCAGTCGCAAGAACAAATAACGAGGCAATTTGCAATGCAAAAAAAAAAAAACAA > SEQ ID NO:4328 213777FL 219650_300947_1c
TCTCCTTCCAAGATGGGAGAGTTTCACGTGGGGTAGGGGACATTATTCTGTTTTTCACCTCTTTGTCGTTGTCCCTCA
TACGGCTTTCGTAATTACGCCGTTATGTACCCATGTCCTGTCTGATGCGTTGGTCACGCTGGTCGACGCTGCGGGGGGA
AGGCAAACGAAGGCAACAGAACGGAAAAGGGAAATAAAAATAAAAGTTGAACCTAGGGGGGTTTGATAATGGCCAGCGT
GCGGCAGGCTTACAAAACAACGGGAAGATTTTCACGTTGGGCGGGATTACGGCTCTGATTTGTTATTCACTCTAGCTAC
TAGTCATGGCCGAAAACAATAATGCCAAGGTTTTTTCGG > SEQ ID NO:4329 213778FL 217536_300909_1c
AGCAACATTAATTGTTCTTCTTTTGTCTGGGTGATAGACTTGTCTTCCAAGCGACCTCTATTAGACTCCGTATAGAACT
ATAGAGCCACACGGAACAAACCCAATAGGCTATTGCCAGCACACACACCCGGGAAAAAAAAAAGGAACGACAAAAAACC
TTGGAAATAATAATCAGAAACCCAAAAGTGAGACACACGGAAGACAAGGCAGACATCAATTCACACCCGTCCCGTGTCT
CTCAAGTATAAAACAAAACTCCAGCAACTAAACCACACATCCACCGCAACACCAAAAAACAACTATCACCATCACCATG
GCCGCCCTCAGCCCGGAGCAGATCGCCATCATCAAGTCCACTGTGCCCATCATCCGCGAGCACGGCACCACCGTCACCA
CCACCTTCTACGCCAACATGCTCGCCGCCCATCCGGAGCTCAAGAACTACTTCTCCTTGCGCAACCAGCAGACCGGCGC
CCAGCAGGCCGCCCTCGCCAACTCCGTCCTCGCCGCCGCCACCCACATCGACAACCTGGGCGTCATCGCGGGAGCCGTC
GAGAAGATCGCCCACAAGCAC > SEQ ID NO:4330 213781 215244_300879_1c
agcgaacaagctcagttgATGCCTCGAGACAGCGGCAGAAACCGACAACCACGAACCCCAAACTCGAATTCGAGCGCAA
ACCAGAGCACAGGAAGAGGGCAAATGTCGAACCCAAACAACTGGCAGGAGGAGGCGATGCGGCGTCTGCGCCAGATGCA
GACGCGGGGCGGGTATCCCGGACGAGGAGGACCGCAGATGCCCAGAGGAGCAAACGGCGCCTTGATTGGAGGAATCTTG
CTGGCGGCGGCGCTTGGTTGCTGTCGAACTCGCTGCTGTTCAACGTGGACGGTGGTCACCGAGCGATCAAGTACCAGCGAT
TAAGAGGCGTGAGCAAGGAGATTTACAGCGAAGGAACACACATCAACATTCCTTGGTTCGAGACACCCATCATCTACGA
TGTACGAGCGAAGCCGCGCAATGTTGCTTCGCTGACTGGCACCAAAGACTTGCAGATGGTCAACATCACCTGCCGTGTT
CTGTCAAGACCGAATGTCGAAGCTCTGCCTCAGATTTACCGAACACTTGGAACCGACTACGATGAGCGAGTGCTGCCAT
CAATTGTAACGAGGTCCTGAAGAGCGTAgtCGCTCAATTCAATGCCAGTcagctCATTACACAGCGAGAGATGGTTgc
cCGATTAGTACGGGagaATCTgtctcgtcgagcTGCGCGattcaatatcctgatcgATgatGTGTCTctgacgcATctt > SEQ ID NO:4331 213803FL 217661_300910_1c
tgaaactGAAGAGACACCATATTAACTCCAAGATTCAGCTCCCTCAGCTCAGCAATAGCCTCAGCCTCAGCCTCAGCCT
CAGCCTCAAAATAAAATGGCCGTCACTGGCCTTGTTGCAGTCGAGACGCTGCCCCGATTCCTCCTCCCACGGCTCAGCT
GGACTGCGCCGCTCGCCGCATCTCGATCTGCTGCAGCCCAACCCTTTGCCCCTCTACAAGCACGAACGAACCAAAGAGC
AGTGCCCGCCTTCAACACCAATTTCTCGGCCAGAAGATACAACAATGGCCAGATACCGGCGCTGAGGCGAGGGTTTCAC
GCGACGAGTCGACGATCCCGAGAGCATCATTTCGATACGCTCAAGTTTGTCAAGCAGCTCAAGGATGAGGGCTTTACCG
AGGAGCAATCAGTCGCCATGATGAAGGTTCTCAACGACGTCATCCAGGAGAGGTTTGTGTTTGCAATCCTCAAGGGCTC
CTAACGAGCATGccATTGCTAGTGCTAATACCAACACTTCAATTGCAGCATCCAAAACcTGACCCTAACCATGGTCCTC
CGCGACGATGCTgccagAac

FIG. 2 continued

> SEQ ID NO:4332 213809FL 200495_300759_1c
AGAGGACAAAAGGGAAATGATGTTCCCTCTCCTTAAACAGTCGAACCTTGTGTCAGGGGGGGGGGGGAAGTGAAGAGGG
TTTGTATTCATGAAAGGAGATTTGCGCCTAAGCTCAAGCGCAAAATGAATCCT

> SEQ ID NO:4333 213813FL 199605_300751_1c
gattagatcAGATTGCAGGCACCCTCAATTGGCATCACATCATGCTGGCGACAAGAGCACTCCGAGCGGCCCACGGGCC
CAAGCCCAACATCACCGGCTTCAACATGCGAGCCCTCAAAGAGGCCACTGGCCAGCCCCGATACGACCCTTGGGAGAGA
GCCGAGGCATGGCGATACAAGGGCACCTTTTCCAGATGGAACCGATTCCGGAGCGGCTTCCCTGGCTTGGGAATCGCGT
CTGTTGCATTTGCCGGATACTGCGCCTACGAGTACCTCTTCCTCAAGGATGAACACCACGGCGAGGGACATGGCGAGGG
GCACCACTAGAGCGTTTTTTTTTTGCGAGCGAGAGCAGTCAGGAGTGTGCGAGAGGAGAAGAGAGAGGAAATGTATATA
CATCTCTCCAAAGACAAGAAAACTCAGGCCTGGTCTTGCGGCGGGCAAAAAATGAATCCAACACAAATCAATATAAACT
CTATTTAG > SEQ ID NO:4334 213814FL 216451_300869_1c
gatccaaatcccacaaGTCGAAACGAACCCAATTGGCACGCACACCAGAGGCCATATACAAATACAAATATCCCCCCCC
TTGAACCGACTCTCGCCCACCCGCCCATCATGCATCTCATGTACACCCTCGACGCCAGCGGCAACCGCCTCTACACCCT
CAAGAAGGTCGCCCACGGCCAGGTCACCAAGTCTGCGCACCCGGCGCGCTTCTCTCCCGACGACAAGTGGTCTCGCCAG
CGCGTTACGCTGAAGCGCCGCTTTAACCTGCTCTTGACGCAGCAGAAGGAGGAGGCTATGTAAATTCGCATCATGGAGA
TACCCTCGAACCAAAGAAATCCCAAGCGGCGTTAATTGGGAGCGACTTCGGGCATGCTTTTTGAGGTGATAATTGATTC
GTCATTGTCCTCTGTTGGCGATACGGGATAAAGAGAACGGCAAGCTCTTCTTCTAGAGAGTCACAAAGTTGGCCATTCG
TCCCAATTCGGGTAACCGACTGGCTTTGTTTCCTTCGCTTAGGATCGATGGAGGAATACACTTGAGCGAGCAACATTGT
TCGTTTGGGGACAGCAATGAGAGACTACAgGaGGGGGGGTGAGTGTCTGGCGAGaGCTTGACtaagTgGATGGGTGGAT
GGATGAcaag > SEQ ID NO:4335 213816FL 266806_200031_1c
CCGTTATTTATTATGCATCTTGACTACCCCTCGACCACGCGTCCGGGCCGCTTAATTAATGACAAGAACACGAACTGAG
ATGGAGTAGTGATACTGTAAGATCTATTTAAAACGAATCCGATTCGGCGACAGTAGCCTCCGAATCATCATCGATTAAA
TTATTCTTTTTAAAACTCATTCCTCCAAAATCCTTAACATTTCTATAGTTCTTGTTCGGCACTGACCGATCACTACTAC
TATTTTTCCCTTTGCGGACATCACTCTTTTTTCCGGTTCGAGATCGAAACTTTGCAAGCCTGATCGACATAGGGACATC
TTCCATGAACTCATCAACGACTTCTTCTGTAAGTTCCATGGGCCCTCCGTCTCTCACGTTTGTAATCTTCTCTCTCAAA
CCTAATTTTATATTATTTCTATAAACAATACACACCGACACAAACTCCAGAGAAAGCGGACAGAAACCCGCTGACATCT
TCACATTTCTAATATTAACTAAAACTTGCCAGACGTTTCTCATCGCGTCCTGGGTGGTTATAGCATAATTGGGAACGAC
CTTG > SEQ ID NO:4336 213816FL 290877_301424_1c
ggaacttgcctgaCAATTGCAGAGGAGGTGTGAGCGTGTGTCTGGTGGACAAAAGGATGGAAAGAGCCGACGAGGCCAC
TCTCGGATCTTACTACACAGCAGCTGCAAAGAAAAGATTTCAGTTCAAGGTCGTTCCCAATTATGCTATAACCACCCAG
GACGCGATGAAAAACGTCTGGCAAGTTTTAGTTAATATTAGAAATGTGAAGATGTCAGCGGGTTTCTGTCCGCTTTCTC
TGGAGTTTGTGTCGGTGTGTATTGTTTATAGAAATAATATAAAATTAGGTTTGAGAGAGAAGATTACAAACGTGAGAGA
CGGAGGGCCCATGGAACTTACAGAAGAAGTCGTTGATGAGTTCATGGAAGATGTCCCTATGTCGATCAGGCTTGCAAAG
TTTCGATCTCGAACCGGAAAAAAGAGTGATGTCCGCAAAGGGAAAAATAGTAGTAGTGATCGGTCAGTGCCGAACAAGA
ACTATAGAAATGTTAAGGATTTTGGAGGAATGAGTTTTAAAAAGAATAATTTAATCGATGATGATTCGGAGGCTACTGT
CGCCGAATCGGATTCGTTTTAAATAGATCTTACAGTATCACTACTCCATCTCAGTTCGTGTTCTTGTCATTAATTAAAT
GGCTAGCAAAGGAGAAGAACTTTTCACTGGAGTTGTCCCAATTCTTGTTGAATTAGATGGTGATGTTAATGGGCACAAA
TTTTCTGTCAGTGGAGAGGGTGAAGGTGATGCTACATACGGAAAGCTTACCCTTAAATTTATTTGCACTACTGGAAAAC
TACCTGTTCCATGGCCAACACTTGTCACTACTTTCTCTTATGGTGTTCAATGCTTTTCCCGTTATCCGGATCATATGAA
ACGGCATGACTTTTTCAAGAGTGCCATGCCCGAAGGTTATGTACAGGAACGCACTATATCTTTCAAAGATGACGGGAAC
TACAAGACGCGTGCTGAAGTCAAGTTTGAAGGTGATACCCTTGTTAATCGTATCGAGTTAAAAGGTATTGATTTTAAAG
AAGATGGAAACATTCTCGGACACAAACTCGAGTACAACTATAACTCACACAATGTATACATCACGGCAGACAAACAAAA
GAATGgAATCAAAGCTAACTTCAAAATTCgccACAACATTGAAGATgGATcCGTTcaaCTAGCAGAccAttATcaacAa
aA > SEQ ID NO:4337 213817FL 219451_300945_1c
GACAAGTTCAATTCGCAGCAACAGAAGCGGCGCAGACAGCATGAGCTCATCACTGAGGAGCTGCGTTGCGGCCCGGCCG
CTGGCTCGCATCTCGCAGACGGTCGCTTCACGGAACGGCGTCCAGAGCGTCCGGTGTCTGTCCCAGACAAGCCCACGAT
GGGAGGATTCAAAAGATGCAAAGCCAGAACCACCCAAGGCGGTGCCTCCAAAGCCTCGAACCGAGTCGCTCCTCGACAG
CATCTACAGCATTACCCAGGCGCCAAACAGCCGGTCCGCGCAGTCCAACCCCATGGGCAGCCTCTCCCAGAGCATGGTC
TTCCAGGCCCTCAGCAAATCCAACATCGACACCAGCGTCCTGTCAGGCGGTCCCTCGCAGGCAGCGCAGAAGAAGGAGG

FIG. 2 continued

ATGAATTGGAGCCATTCCATTTCCACGTCTACTCGCACAAGCACAACACTCACATTACATGCACAAAGCCCAATCGGGA
ACCCATCATCTCCATGTCATGCGGCAACATTGGCTTCAGGAAATCACGGCGGGGCACCTTCGATTCGGCCTACTCTTTG
ACAAAGTACGTTTTgqAgc

> SEQ ID NO:4338 213825FL 199660_300751_1c
GCCGGCTAGCAGTATAGAGCGGATGGGCATCGTAGATGGGCAGTGACGATAGTGTACACCCGGAAAAAGTGACTGCGTA
TCGCTTTGCCCCTCCGTGTCTTCCGACGGGATTGTCTCGATAAAAATGACATCAGCACGGGAAGAAGAAGAGCATCTCC
ACTAACGGCACACACAAACACGCATAGAACAAGACGCTCTCCGTACTCCTCGGAGCCGGTGCTCTCCCTGCAGGG

> SEQ ID NO:4339 213825FL 220306_300954_1c
gagcccCAACTCTTTTTTGTTTTCTGTATTTCTCTCTCTCACTTTCACTCTCTCTTCTCTCTTGTTTCTTCTCCTTCTT
TCTCTTGGTTACCCAGCTAAGTGAAGCTCAACAACCGCAAACATGGCTGCCCCCTCGAGCAAGACCACCAAGAACCTCA
ATGGCAAATGGACCATGAACAAGACGCTCTCCGACTCCTCGGAGCCGGTGCTCTCCCTGCAGGGCGTTGGCTACCTGAT
CCGCAAGGGCATCAGCCTGGCCACCATCACCCTCGAGGTCGAGCAGTACGAGGGCCCGCCCAAGCCGCCCAACACCGCC
GCCGACGTCGTCACGCACATCGACATCAAGCAGTCCGCGTCGGGCCTGTCGAGCACGCAGGAGAACCGCTGCTTCGACA
ACTTCCCGCCGCGACCACACCGACTGGCTGTTTGGCACCGTGACGGGCCGCAGCCGCTGGGTAGGCCTGGACGAGGTCAC
CGACGAGTTCCTCAAGAAGGGCTGGGAGGTCGAGGGTGAGGGTCAGAGCTTCATCACCAACATTGCTGAGAACAAGGAG
AAGGGCTGGGTTGCCGAGCAGGTCTGGGGATTCCAGATTGTTGATGGCGAGCGCAGATACTGCAGACATAtTGTTGTGA
cCAAgGGAGCGGAGCGGGctCAgATCCGActcGTCTACGAcTTCaaCGAagaGtaagggGGGGGTTTgTGTGACAGGTG
CTCAtTtTGATATCATatagaagaGCTGAcg > SEQ ID NO:4340 213827FL 199626_300751_1c
aaacgaagtactgtaatcgtacgtactcaattgacgggctttcgaccccctgttttgcatctgcggtcgaataaacaccg
aCTGCATCTCCATCAGATTGCGCTTGGCGGCCGGGTCTACTGTTGCAGTTGATGCCGCCCAACTCTGGCAAAACCTGGC
GCTGCGGCTGCGGCTGGAGACCGGGGGAGCGATTCTGGCTGCCCAAACGAGAACCGGGGGGCATGTCAATGCACAGTTG
CATCGAAATTTGGCGATTAATTTTTTTACGAGGGAGGATTAGgATTAGGACTTTGCACGGTAGG > SEQ ID NO:4341 213845FL 208217_300833_1c
gggcaatcttaacggaatgaagctttcctggtcgccatgagagacatatgcggagaaaccgaaatgtgcaattgtccag
cAATTGCTTTTATTCTAGGGTCTACGAGAGCCTGGGTCAACGCCACCGTCAGGATTTGTGGCGGCGCCTCAGCAGTTAC
GAACCAGTCTTCTGCTCATGCTCCCGCCTGGGGTCGCCTTCACAACTGCAGTAGCATTGGCGTCCGGATAGAGCATCA
AATCTTTCGCGAGACAAGATCGACGGATACACAAACATGAGCTACGAAGATACTTTAATTCGATCGAGAATAACGGGTT
TATCCTATATAACCAGGAGAAATTCCACGAGTGACACATCAACAGGAGGCACCAGTCATGACTACGTCCCCATAATTGT
TATGACTGTTATTGTCGTGGCGATCGTTCTGGTACTCCTTATCCTTGCTCAATACACAAAGGTGCTTGATCGGAAAAAG
CCAGCCAACGGATTTGATGATCCAGAAAGCGCACAGAATGCCGGCAAAATCGAGAAACTGAACCAAAAAGCTCCGACTC
AATCCTACAAGAGCTGGAAGGAGAAGAGCGAGGAAGCGACTGGTTCCGTTAAACAAAGTACTACTCATGTCGTATGTGC
AATATGTTTGGAGACCCTACAAGAAGACGATACAATTCGCCTGCTATCATGCGCGCACATTTTCCACTCTCTTTGTTTG
GCAAAATGGTTTTTGAAGAGGCATAATACTTGTCCGCTTTGTAAGGCGTGCTTCATGTCTTCGTCGGAGAAATCCTCGA
TACCTGTACAGGTTCCAGAAAGAACACATGCCCGATGAGAAATCTCAAACAATAATATAtTTGa > SEQ ID NO:4342 213858 210968_300894_1c
AAAACATTGAAGACGGGAAAGCCGCTGGAGGTTGGTACTTCCTTTGATATAGTCGCTTTTTTTTTTCGCTGTAAATCTT
TCGGATTACACTATATCATCATGAAGTTTCACGCAACTGCCCTTACACTTGCATATTTGGCAAACTATGCTTCGGCAGC
AGTGGCCCAGCCGAGGAGTGAAGCAAACGAGTCTGCTACTCCCGAAGGCAAGACGTTCTCCATCTCTCAAGTATATAAC
GAACAGTACAAAGCAACCAATGTCCCCGCCACCTACATTGCAGCTCTGGCAAAATATAGCCCCCCAGCTCCCAGAGCACA
TCAAACATGTGATCATGgCCAATCCGGATCTGCACCgcagATTTGGCTCTCTTCTTGATGCTGGTAATCAGACGGGCAC
TGCCGTTGCCACACCATCTCCGGGAGCCGATTCGGAATATGTTATTCCCATCAAGATTGGCaCACCCCCTCAAACCGtg
cCAATAAACCTTGatACCGGTTCATCAGACCTTTGGGTCTTCTCGACAGACACGTATCCGTCCCAAGt > SEQ ID NO:4343 213863FL 187223_300675_1c
ATGAGATGCAAGCAGTTTCTGTTAAGAGCCAATTGCAACAGATTGCAAGGCCAATGTACAGCAACCCACCTGTTCATGG
TGCACTGGTTGTCTCCATAATCCTTAATGATCCAGAATTAAAGAGTTTATGGTTGAAAGAGGTCAAGGGTATGGCTGAT
CGAATCATTGGAATGCGGAAGGCACTCCGGGAAAATCTCGAAGGCCTAGGTTCACCATTGTCATGGGATCACATCACCA
ATCAGATTGGAATGTTCTGCTACAGTGGGATAACACCTGAACAGGTGGATCGCTTAACCAATGAATACCATATTTACAT
GACCCGTAATGGCAGAATAAGCATGGCTGGTGTAACAACAGGAAATGTGGCGTATTTGGCTAATGCTATTCATGAGGTC
ACTAAAACGAAATGAAGCTACTTCCTCTTCCCTCTTCGGCCAATGAAATGAGGCTTGCAAGCGGCGGCGTTTTTTTTT
GGGGGGTGGTCTATTGACCTTTAAGATGGTTGTACTACAGAAATAATCCAGTGAACATGCTGGTGTTTCTCCAACTTCG
GATTTTCCCTGTATGGAG

FIG. 2 continued

> SEQ ID NO:4344 213863FL 45861_300075_1c
GCAAAATAACAATTGTTGGTGGCAAATTAAAGTAACCAATATTTTCTTAGAAACGGTAGATCTCAGTGTCACAATCCTC
ACTTTGGTTTTGGTTCAACCATCTTTAGTCAAAAGACATGAGGAAACATATGGTACCATCAGAAAAAAACCATAGTATA
TAAGCCAACAAAAACGGTGTTCTTTTTTTTTGTCCCATTTTATTTGTAGAAACAGCAAAAAAATGTATGGTCGCTAGTT
TAGCCGAGGCGGGTCACTGCAGCATGCATAGCATCGGCAAGGTGAGGCACTGTCTTCGAACTTAGACCTGCCATGCTTA
TTCTCCCATCAGAGGTCATGTAAATGTGGAACTCTTTGGTCATGAATTCAACTTGCTCCTTGTTCAATCCAGTAAATGT
AAACATCCCAATCTGTTTGATAATATGACTCCAGTCACCAGGTGTACCTCTAGCTTGTATAGCTTCAAATAACTGTTGG
CGCATGCTCTTTATACGGTCAGCCATTTCTTTCAGCTCGATGGTCCAGTTGTTGTACATATCACTGCTTTTTAGAATGG
TGGCAACAATTGATGCTCCATGAATAGGGGGGCTCGAATACATGGGCCGCACAACAAGCTTCACCTGGCTCTCAACCTT
ACTA

> SEQ ID NO:4345 213863FL 220212_300953_1c
GGCCGTCATTATCCGAGAGAAGAAGCACTTCCCCTTCTTTGACTGTGCCTACCAGGGCTTTGCCTCTGGCGACCTTGCT
CGAGACGCCGCCGCTGTGCGTTACTTTGTCGAGCAAGGCTTCGAGCTCGTAGTTGCCCAGAGCTTCGCCAAGAACTTTG
GTCTTTATGGAGAGCGAGCTGGCTGCTTCCACGTTGTGGCTGCTCCTGCCGCTGATGCCACCACCACAATCACCCGCAT
TGCATCTCAGCTTGCCATTCTGCAACGATCAGAGATTTCCAACCCTCCTTTGTATGGCGCCAGAATCGCTAGCACCGTT
CTGAATGACGCCCAGCTCTTCGCCGAGTGGGAGGAGAATCTGAAGACCATGTCCGGCCGCATCATCGACATGCGCAAAG
CTCTCCGTTCCAAGCTTGAAGAGTTGGGAGACTCCAGGAACCTGGAACCACATCACAGACCAGATCGGCATGTTCAGCTT
TACTGGCCTATCAGAACCCCAAGTTCTCAAGCTCCGCGAGGAGTAT

> SEQ ID NO:4346 213863FL 208922_300810_1c
GGCCATCCGAAAAGTCGTTGGTGAGACTCGGGAATTTGTATGATAATGGTTTGATAGATGGGCTTCGAGGACGTGACGA
TAATTATCACCGCCGCTGGCCAGGAACTTGCGTGGTTTCGATTAGTGTTCTTTTTTCCTTTGTATTCGATAGCACATGG
GTGTGTGGGCATAGATGCAGCTAGACAAATAGCAAATACGGGTTTGAGGGCCTCGGGGAGTTTCATCCCTTGACAACG

> SEQ ID NO:4347 213882FL 213839_300861_1c
ATGTGGCCACGGGAATGACGCAAAAGGCGCCGAGAGCGGAAATGGAGAGAAAAAAAACCCAATTGCACCTCGTGATGAT
GCCACTCAAATGTCTGTGGTCGAGCCACTggcTTCTACCTACGCTTACATTACCTAACAAggaacGAAACATTTTGCGG
CAAGgagaattggaTCATTGActtggcGAATGggCTAATGAATGTcgtcaatTGCAGGCctcgtggtttgGcg > SEQ ID NO:4348 213903FL 211903_300872_1c
AGCTGGTCCCCTGGAGAAAGATGAGGAAAAGACCCGGAAGGAGAAAAGGGAATCGTGTGATTTAATTTGCTATGCCGGA
TCGTAGCCGTGGATGTGAGATGAGGCGGGAAGGGAGAAGCCGGAGAAGGCGGGCCTTGACACGGAGCTGAAGAATTTTC
TTTTTCTTTGTGTCGCGTGTTGTGTGCTTTGATCGTGATTCTTTTGCCGTAGCCCTTTTTTTACATACATTTGTGTGCA
TAACTATTACC > SEQ ID NO:4349 213922FL 208006_300831_1c
AAAGAAAATAGAGAAGGGGGAGAAAAGAAGAGAGCCTCTTAGAGGATGATGCTGAATGACGCTGTGGATGGTGAAATGT
GAGATGAGCAAGGTTTGTGTTACATGTATATTAAGAGGATTTTTTCTTTTTGTGGACGGTTTTTTATATGTGATATTAT
GGAGAAACTAGCAAGGATGGAGAAAAGGGGAGAAAAGGAACGATAAGTTTATCTCTGTTTGGGCATGTATGGGTGTTA
ATATGATTGACTTGTCATATGTGAATGATGAGTAGATGATGTGATCAACACTTGGATGAGAGACTCACAACCAGATTTA
CGAGTCATTCATCTATACAGACATAAACGCTGAGAACGTCATCGGAGGTATTGCTTCACTTCACATCTTGATGCTATAT
GTAGCTGGCCGCATTTCGTTTGCTGGAAAGAGGTGCACGGATTAAGATGCAAGTAGCACATGTACGGTTGAGAAACTCA
GGAACACAAAAGATGTACATTAAACTCCCATTCTAGAGAACCTATTTACAG > SEQ ID NO:4350 213950FL 217549_300909_1c
GGCGTCTCCTACAAGAAATCGTTCGTTTCCCTCTGTCATTGCGAGCCTGTTGAGCAACACAACAAAAAGGCGTCAACAC
ACAAAGATCCAATCGCCAGATCTAAAGCCTCTGTGCTACTCAGTCCAACAATTGCACAAAGCGACACAACATACCGAAA
TCTGCAAACAATGTGTTTCCGCGTGGAGCCAAAGGCCAAATACTACTACCAGGAGGAAATCATTCCCTCACGGCCGTAC
CGCCATCACCATCACCATCACCATTCTTCCCACCACTCGCCGCGAGCGAGCTACTCGGCGGTTGAGCGCTACAGCCCGC
GGGTCAGCACCAGCAGCTACAGACGCAGCGTGCCGTCGAGGGTCGTGTATGAGGAGCAACGCGGAGTCGGTACTGAAT
GGGCTTTTGATTAGGACCAGGAATATCCTGTGATTTCTTACTCTTTGTTTTTTTAACGACTCTATGGTACTGGTTATG
GGAAATGAGACACATGTTAGAGGCTAGAATAATGGGCGGATTGGGATGGAAACTCGAGGCAGGCGATGGTTTCATGAGG
ATATGAGAACCTGGAATGCGGTGACGGCGTTGGTAACATATATTTCGCCTTTACGATTTGAATGAATGAGATACATAAA
ACACAttcTaGaTGTctcGc

FIG. 2 continued

> SEQ ID NO:4351 213951FL 195839_300638_1c
ACAAAATGCTTATGAGCGGGCCGCGGGTACCATGTCAGTGTACGGGTACTCGTACAAGTTCTCTGGACGAGCAGATGCA
ACCATCCGGCAGTCAAACTTGATGCTACTTGACCTGTAACATTTGCATTGATGAGCGGCAGCAGGGCCTGGCAACCTGG
GTAGTACTCCCAAGTATTGCCCGTACACGTCCTAACATGCGGCAGGCGATCAAGCCGTTCTCAGGGCGCTAACAAGGGG
GGGACGAGGCGCACTGGAAGCGCTGAGAACACATGCATCGTGAGGTGATGGAGTCGGTGGGCTCGGGTAGATGTACCTA
AAGGGCACATAACCTTGCCTGGCTCTTTGGTCCTGGAAGGGGTGATGTGATTTACTTTCAATGGAAGAAGCCGGATGTT
GCGACTGCTGGACCCATGTACTTGTACTTGTACGAGTATGCCAATGAGAAGAGATCAAGATGAACAAAAAGAACGATGC
CAAGAAACAAGGTCCTGAaAA

> SEQ ID NO:4352 214010FL 217129_300905_1c
GAACTTCTTTTCATCCAGGCAGCCAAAAAGGGCAGTGCAAGGCAGGCATCGTCAGTTGCAGCGCGGGTGATTGGCTCAT
CCGCCGGGCTCTTTTTTTGCCCTTCGACTTGCTTTGATGCCCGGAGGGATGTGAATCCAAAGAGAGGCGACCTGCCCAA
AGAGGGAAACAGGGCAACGTGAGCGGGTAGATTCGCAGCTAGGAACAGGACAAGCATCACACATGTATGTAAGATGGTC
ACTCCGGCCCTTGCTCGGAATCAACCGCGGGGACCCGTGTGAGCAAAGATAGATACCGTATGAATATATCGTATCCTAG
GAT

> SEQ ID NO:4353 214105FL 204254_300791_1c
GCGTCAACTTCACGGCATCACGAGGTTCCTGGACAAGCCGTCACCATGTCCACTGACGATCTGAGCACCCATCTGGCCG
ACTCCGGCATCACCATGCGGTCCGACAGCGAGCAGTACTCTCCGGGCGATGAGGTCTCATCACCCTCGTCATCAAACTC
ACCGGTTATTCTCTACAAGCCCCCCACAGCATGGAGTCTGATACGGAGCGCCGCCATCAATCTGGTTCTGCCATTCATC
AACGGAATGATGCTGGATTTGGAGAGTTGTTTGCTCATGAGGCAGCATTCCGGTTAGGATGGGGCGGTACAAAGGTTT
TCCCTCTTTCTCGAAGACGAGCCCACCCCATTGGCCCAGGCATCGAAGTCCGTGAACGACCAGAGCGACCCGGGCCTTC
ACTAAGTGATTACGCAAGCTTAGAGTAGAAGGGAAGAATGGAATGAGGACGATAGGGGCATTGTATATGAATCAATCAT
GTCTAAATAAACAGATGCAGGCGCTTTTCCAAAAGACTGTGGCCCATCTGCTGCACTTTCAGAGCTCCCCAACCATATA
GGCAGCTAGTAGCGGCGGATAAGTGgCCGCGAATTGTACACCAGCAGAtTgcaCGAAGCTGTagcCACTGCATTAAAAT
AAatcaaTTCAACTTTTcTCAT > SEQ ID NO:4354 214117FL 218244_300916_1c
gtagagcaagtgagacgggagattgtggatcagcgttgagggaagtgcttactcgtgaaattctcgtggcctgttttcg
cCCTCATTTCTTTGGCCCGCCTGTTGGCAGACAAATAATTTCCACCAAAGTCATGCCCCGTGGATATATCGGGTATATA
AGCACGTCTGATCCACCGACGGAAACATCGCGACATATTGATTGAAATCTAGATCTGAGAGTCGGATGAATTGTCCGTCT
CCGGGCATTTCTCAATGGCGCTTACTTCAGGACGTGATTGGTTCAGCCCTAAGGACAAGCCATGATACATTGCAACCTT
TGAGTTGGGCAAATGACAGATCATTTCAACATCTAGATGGATATACAGCAAGTGAAGGAAGTCGGAAAGAGAGTAACCT
CTAAGAAACTGGATCTTTATTCTTCATTCTTTTCACCAGGTGGATTATGACCTACCAAGCTCCGGCTGACCGAAGACAT
TGCCGCCCGAGTTAGAATGAAGAACAATCCAAGTCGAATAAATTAGTTGTTATAGCTATCGTAAAATTATCTCAAAATT
AAATACAAGTTGGATTATCTTGACGGTATGAAAACCTCTC > SEQ ID NO:4355 214144FL 195466_300634_1c
cagccacacatgtagcaaagcgcacaattcgcatcataagtcatctcaatagcttttcttcttcttctcctcctcctc
tCTCTCCCTTGttCTCGTACTCCGCATGTCATCGCCATGATTGTGGATATTTGGGGTAGTCGATAAGTTCGAGATGGGG
CCTGCCGTCCCGATTTCTTCCAATGCaGGTACTTTTGAGCCGgcCCGGCGCGGGAACTGAACTCCTATAAGAGTGACCA
CATGGACGTGTGCACGGGGTGCGGAATGGATACACCGCTTATTCAGACCATTACTCGCATTTGCGTCCAGAGATTGGA
GTTTGATAATTTTTACAAACTTGTACATAATACTGATGCATTCAGCCCTTGGTCCTGATGGCATGAGCAGACATAGCCT
CGGCCGACGATTTTGCCCCTGCAATGGTTCTCTGCCGATGTTTCCCGCAGCTTCTTGGCAGTTGGGGTAATACGATAAT
ACGACGATGGCATCTTTGGCCTGCACGCCGAATTGGGGTCAAATAGACGGTATTCCGAACATTTCATATTTAAGAAGCT
GTGCTGCACGCCAACCAACCTTTGGAATGGTGTGAATTGTGAAGGACATGATGCATGGTATAGGCCATGAGCTAGTCTC
AGAGAGATGGAGCCTCCGGTGTAAAAGTTGTACATTAATACGATCAAAGCCCGCTACGAAAAAAGAATGGCAATTGTAT
TACCCACGAAAAAaaaacacaaa > SEQ ID NO:4356 214235FL 208640_300807_1c
GAAGCAACCAAGAATCTGCACCTCACTCGATAATAAAAGAAATCGGTACTCAAGGTTTATAACTCATTCAAAATGCGT
TATACTGCTGTCCTCGCTGTCCTCGGCTTCTCCGGAGTCATGGCCAACAAAAACTTCGGACCCTTCGGATTTTTCGGAC
CCTGGTTCGATGGCGACTTAACTATCGATGACCTCGCTGACTTTCAGTTTCCTGAGAACCCTTGTGAGTTCATTGGTGG
TACTTGCGAGATCGCCACTTCCCTTACATTCTGCCGCTGGTCGGGGCGACTTCAGCGTTGATTTGCCTTGTGGCGTTGGC
CTCGGCTGCTGCTGGCACCAGGACACCAGCAATGTTTGGTTTGAGCAATGGAAGGAGTGGCTCGAGCTACACAGCCGCA
TCAACTAAAGCCGCTTTAATGTCTTGACGCTTTGATGGCTTGACGCTTCTATGGCTTGACGCTTCTATGGCTTGATGCT
TTAATGGCTTGACGGAGTCTTCAATTGGCACGGTAGTGGGTGATGGAGAAATTAGCCGTACTGAACTCAATGAGAGATT
GTTAACCCCGATTAAGTagt

FIG. 2 continued

> SEQ ID NO:4357 214256FL 200367_300758_1c
GCGCTCGCCTGTTCATCTCTCTACGAAACCGCCCCCCAACACACGATCCTACAAGAGGAAAAGCGGATTGATTAAGACC
CGCCAAAGAAGAGGCGTCACGCAACATGGCGGAGGAGATCCTGGACAAAGTTCGGGATGTGGTGGAGGGCCAAATTGAC
TTTGAGGGCCAGAGACGAGCAGAAGGCCTTGCCACTCTGTTACTTGCCCTGACAGGACTCATCGCATTCAACGTCGGAT
ACGTACTACAAGACATCGTCAAATGCCTATATGTTGGACTAGGAGGAACGGTCTTGACATTTCTCATTATCATTCCGCC
GTGGCCCTTCTATAACAAGAACCCGGTCAAGTGGCTGCCTATCGGATCTGCATTTAACACGGGCGGGACATGACGACTG
GATAACGCCGCTCTGAGTAGGCCCCGGCGTTTTGTCACGTTGTCAAAATCAGCATGTAGCTTAAATCTTTTCGAAATCA
TGTGCCACATttcctctCCTccaggtcGTGATATCGTTccttGCTTTTGCtTCCCGTTCCGCCTACTCCGTTTATCGAC
CGTACTTTTGAAACTCCCAGTCTCTGTTgtctaGAGggcAGACTGATCGGGCCTTTAGCCATCGTGAAATGCAATGGAA
GTGGAAAGCATGGTTGCAAATTCCCCATGCGACAGTGCACTCCTCGCTGGTAGCGGATGCCTGGTTCGCCTGACATtct
ATGCAAAGATCCATGATATGGTTTCGGCAGATGGCGCAGTTGTCGACTACGATATCCCAAGCCCACAGCGCGACGGCGT
TCCACTTCTTGACTTCAAActtcttcTTGTCCGAGCCTTTGCTGACGACACCGTCGGCCTTTTTGGCGGCCACCGGGGC
ATCGCTCATTtcGACGTCAGCCATGTTCGGATAGCTCGTGACTTGTCAGGGAAGCtcTATCAGTGACGATGGTTCCGTG
ATCTCGCAGTATCGCGATAGGGatataaacgtgtgaggatgtgtaaacgaggggagcagtcgagctcttgggactcgat
ggatggatgacctgtgcggctct > SEQ ID NO:4358 214267FL 205829_300802_1c
TGAGTGCAGTGTAAGACAACATGGAAGACATGTATGTCAGCAATACGGATGTTTCCATACAGTCAAAGCGTTGCATCAA
CCCCGGCATGTCAGGAAGATGCTCTGGATACTAAGCGGGAAAATCTTCCGGATGCTGACCTGGCTGCTTCCAATTGCCC
TGTTGTCGATTCTTAATTTGCGCAGGCGATCAGGCCACATGCCACATGCAAGTCCGAGTGCAGGTCCAAGCCGAGCCGC
AGAGGAGACAATGGGTCCAAATGCAAATGCATACAGGTAGTACTGCCTACGTGCGCTGCTACAGTACCGCTGGCTGTTC
ATTTCGTCTTCAGGGACAAAGGGGGATGGATGTACACCGATAGATCGGCCTAGTCGAATGTTACTTGGTCCATTCGTTC
CTTCTAAGCCATATTAggcaTCCaaGATGCTCGGTACTCGCATGGCCATGTACGGTCTCAcGgCtcaccgctaggcCTT
ttttgAATGTCGTTACTTCGTTAcgattatTGGGACAGATGGCGTagagctaccagtgctagtGGTGTaatCgacaaag
TTCgCTcctg > SEQ ID NO:4359 214275FL 211211_300897_1c
GGTGATCTGAAGAGAATGGGTCGACCAGCGCTACTTGTACAGTATCGAATGCACGATGCGTCTTATGATCAGCGCGTGT
CTTGCACATATGCATACGTCAAACAATGCATCCTCCACAATCTTCATCATCACTCCACAAATAGCTTCCATGTTACTTT
CCGCATTCTAGGTACCGCCTCAGTGTTGGCTGAGGTTTGCCACATGCACACCATTGTTGACGTACCATGTGGCTCAGTT
CAGCCATCGACATCTCCAGACAAGCCTACCAAAGAAAGTCAGCCTCAGCCTTAACTGCTCTCGAGGGTTTCAGTCATCA
ATTAGCCCTACAGCTCCGCCTTCCCTCGGCCCGTGCGGCAAAAGACGACTGGAGATCTAGATTGTGAGAAATACGAAGA
TATTAGTGGATTTCTCGTACCAGGAACGAGGAC > SEQ ID NO:4360 214346FL 205158_300796_1c
ATTGCGCGCCAAAAGACTGTACACAGACGTCTTTTGATATATTTTCAAAATGGGTGGCGGTGGAAAAATCCCTTACCCC
AAGCACGTCTGGTCGCCTTCTGGTGGTTGGTACGCCCAGCCTGCCAACTGGCGCGCCAACACGCTCATCGCCGGAGCCG
CCATGTTCGGCGTCATCGCTATTACGTGGAAGTTCAGCGCCGACAGGGAACGATGGGCGCATAAGCCGGAGCCGTGGGA
GTGGCATCCTAGCCGATACTGGTCAAAGCAGTTGATCGAGTGGGACAAGGAGGACAAGCTGAAGGCAGCAAGCAACAGC
AAGGAGTAGAGTTTTCTTTTTGGGAGAAGGATAATAGACGAAATTGTACAAATTCTATACGAACAAAAGGCAAACATTT
CT > SEQ ID NO:4361 214346FL 208666_300807_1c
AGCAATTGCGCGCCAAAAGACTGTACACAGACGTCTTTTGATATATTTTCAAAATGGGTGGCGGTGGAAAAATCCCTTA
CCCCAAGCACGTCTGGTCGCCTTCTGGTGGTTGGTACGCCCAGCCTGCCAACTGGCGCGCCAACACGCTCATCGCCGGA
GCCGCCATGTTCGGCGTCATCGCTATTACGTGGAAGTTCAGCGCCGACAGGGAACGATGGGCGCATAAGCCGGAGCCGT
GGGAGTGGCATCCTAGCCGATAGTACGTTTATTTTTGATTGTATTGGGTGTGGTTGTGGGAATTTGGTCGTTTTTGCTA
ACGTTTTTCTTTTGCTTGAAGCTGGTCAAAGCAGTTGATCGAGTGGGACAAGGAGGACAAGCTGAAGGCAGCAAGCAAC
AGCAAGGAGTAGAGTTTTCTTTTTGGGAGAAGGATAATAGACGAAATTGTACAAATTCTATACGAACAAAAGGCAAACA
TTTCaaaac > SEQ ID NO:4362 214382FL 205102_300796_1c
CACGCGGTGGTGATTGGAGGTGCGGATTTCACGCTTTCTGATGATACTGGCAGCAATTACATTTGCGCGGCTGGCGTTC
TTTGCAAGGATGCCCGGAATGCGGTTGTCTTTACTGTGAGCTACAAGAGCGGGAAGGGATATGCGTTTAACGTCAAGGG
CACGCAAAAGTATCTGTCTATTGGCGGGCGTGGATCGTCCAGTTATGTTTCCTTGACGGGGGGCTGGGATACTGGCAG
GCTTATAGCGTGAGTTATTGAATGTCTGGAATATATAGCATGGCTAGTATTTTGAGATGGATTCATTGAGTATGAAAG
GGGTTGGGGTTAGACAAAGAAATTAAAATAGCATTATTCATTTCAGCCG

FIG. 2 continued

> SEQ ID NO:4363 214407FL 1100515_301461_1c
TGAAGAGTGAAGAGAGAGACACGGCCCTGGTTCCCCCCTTCACAAGAGAGAGTGCCCTGGCCAAGGTTCAACGGGCCGAGG
ATCTATGGAACACCAGGGACCCCGAAAAGGTGGCCCAGGCCTACGCTCCCGATTCCATCTGGCGTAACCGCAACGAGTT
CTTCCAAGGCAGAGCGGCAATTGTTGAGTTCTTGAGGCGTAAATGGGACGAGGAGAAGGAGTACCGTCTGAAGAAACGT
CTCTTTTGCTTCGAGGCAAATAAGATTGCGGTGGAATTCGAATACGAGTTTGTTGATGGAAGCGGGGTGCAATGGTGGA
GAGCTTATGGCCTTGAACATTGGACCTTCGACGATAATGGCTTGATGACCAATCGTGACATGTCTGCTAATAATGTGCC
CATCAAGGAGGAGGATAGGTTGTTCAAGTGAGATTATTTTATCCTTGCAAGTGCAATACTCCCAGGCACTAGGACCACT
TTTTTTTATTTCATCTTTTTTTTCTTTTCAAACTTTTGTTGTTGTTTTTGTAAAAAGGAAGCTTTCTTTTATTAAATAA
AGGATCAATGTTGCATAGGGCAAAA

> SEQ ID NO:4364 214407FL 217984_300913_1c
tgtacaACTCCAATCACTCATACCTCCCTTCTCTCAGCATACTCAACCTCATAACAACCACAATGGCTGCACAAGAAGG
ACGAGCTCCATATCCGCCATTCACACTTGAGACAGCTCAAGTCAAAGTCAAGGCCGCTCAAGATGCTTGGAACACCAGA
AACCCAGATGGTGTCAAAATGGCATACACCCCAGACTCAATCTGGCGCAATCGCGGCACATTTCTACAAGGCCGCGACG
AGATCAAGGCGTTCTTAACCGACAAATGGAGCAAAGAAGACGGCTACCGACTTCGCAAGGAGCTTTTTGCTTTTACAGA
CAACAAGATTGCCGTGCAGTTCTGGTACGAGTGGCATGATGAGGCAGGCCAGTGGTGGCGCACGTACGGGCTTGAGGAC
TGGACTTTTGCCGAGAATGGGCTGATGAGGAAACGTCAGATGAGTGGAAATGACGTGAAGATTAGCGATGCGGAGAGAT
GGTTCAAGGATGGCGTTGATGTGAACACCGTCGACATTTCCGAGAAGCACTGGTGAGGGAGGCTATTTACTAAACTTTA
ATGAAGTCTTTTGAATATATAGATAAGCAAAGTTTGGTTTAcgaAAAAAAA > SEQ ID NO:4365 214411FL 216318_300868_1c
gtggatagcggatggatacttgcagtaaTATGGGGTAAGTGAGTGAGTGAGTGAGTGATATGGATACAGCGGGATGATG
ATGATGGTGGTGGTGGTGGTGTTGTCACTGATGTTGTCGAGTGAGTTGTTTGTTTTGTTTACCTTTGGAATTGATTGAA
ATGAAATGAAATGAAACAGCCCAATGCACAGCCTAAGTCCAAAGAAAACAAACCag > SEQ ID NO:4366 214441FL 218691_300920_1c
GTCGCAATCGATCAAACAAACACCAGCACAAACCGGCAAAGAAATACCCTGCAGTCCTCGAGACTCGCGATAGAGCAGA
AGTACATCAGTCTTATTTACTAGCGAGCAAGACAGTCAAAATGTCGTGGGCGGGATTCAAGAAGAATGTGAACCGCGCG
ACGACGCAGGTGATGATGAAGACGGGGCATGTGGAAAAGACAAACGATCGCGATTACGAGGTCGAAGAGAGACGGTTCA
AGACGATGGAAACAGCTGCACTGCCGCTGCAGAAAGAATCAAAGGGCTACCTTGACTCTTTGAGAGCCATGACAGCTTC
ACAGATGCGAATCGCCGAGACGATAGATGCGTTTTACGGCGACTCCGGTGCGAAGGATGGCGTGAGCAGGAGCTACAAG
CAGGCCGTCGAAGATCTCGACGCCGAAACCATCAAGGCCCTCGACGggcCTTACCGAATGACGGTGCTCGACCCCATTG
GCCGGTTCTGCGCCTACTTCCCCGACGTCAACGAATGCATCAAGAAGCGCTCGCACAAGCTTCTCGACTACGATGCTCT
CCGAGCTAAagtgaagAAg > SEQ ID NO:4367 214472FL 208957_300810_1c
CCAAATTTTCTGCTTGTTCCTGGCGCCTCTGACACACACACACGCACTGACAAAGCTGACTGGCTGTGGGCAACTCCCT
AGGCCGCCTCGCTCTCGGTCGTATGGCACCGAGAAAAGGGACCACACTGATAGCGGCGGGGCCTCGATAAACGCCGCAG
CAAGGGTCTACCGTCAAGAGCCGGAAGTTGTTGGCTCGCAGCTAGTTGCCCGGTTGGTGGATCCGATAATGCGAAGAGA
GTCTTTGGGACCTGCGATCAGATTGGGCAATACTAGGGGGTGGCAAGAGATTTGTTTGTTGGTGGGATGTTGTTGG > SEQ ID NO:4368 214473FL 215157_300878_1c
GGGAAAATAGACTGCGAGAGAGAGAGCGACGAAAAGAAGGAAATGCTCCGATCACGATTAGGGGCGGAATTGGAAATCC
GGAGCTCCGACAGAGTGCGAAATGCGAATGCGATAGTTCAAATGTATGATTGATTTACTGTATGAGGCGACGATGATGC
GATGAAGAAGAACGGAAAATATCCCGAGCTGATGCATACATTGCGGGCTTTCCGGATATCTCGTCAGCCCTCCTTCCAT
TATGTCAGAAGCTATTATGCAGTTGGTTTTGATGGATGGGCGAATTTGATGACAAGGTGCAGTTTACTGGACGGGACCG
G > SEQ ID NO:4369 214533FL 207606_300827_3c
gttgtttttttgttttTCATCTTTCttCTTTGTCACAATCACTTTGCCGTCTTCCACGGACATTTCCGCAGATCTGCAT
CACAGAGATCTGCATCAGAGAGGATTTCAAGCTTTTCCTCTTTGTTTGCCTTCCTCTCCTCTTCTCTTCTTGGATCACA
AAACAATCGGCAAAATTGACATCTCGATATTTTCTGCCTCCAATCACAGCCGTCATACCACCTGTGGCGTCTTTGCCAT
CAATTCTCTGCTGCGGTGCTACCCGCCCTGCAGCAATTTTTCCCGCTGGCCGTCTGCAGGCTTGCCTCGGCTGTGGGTT
TTTCGTCGACCACTGAGGCTTAGTGCCCATCAGCCACTAAAGCGGCTTGACGTCGATTCTCAACTTTGAACCCTTTTGA
GCTGCCTCTGGCCTCTGCCTCATCTCTCCCACACCCTCACGCGCGCAGTCTTGAATCAACACCCCTTCACGCACTCGCC
ATTGCCGCGCTCCTCGTCACGCTCTGCTCGATTAGCCGTCTCTCGCCCATTGATTGAACCTGCTCTCGGCCTCTGCAGC
CACCCTCACGCAACCTACGCCTGACATCCTCTGCGTCGCTCGGCTGTCTCCCGGTTTTATCCATCAGCTGAACCTTCAC

FIG. 2 continued

```
CTTCGCCTTCGCTCTCAAGAGGGAATCCGAGGGCCCGGCCGTTCTCTGCCATCTATTGTTATTGCCATTAACGCTGCTG
CTGCTGCCACTGTCTCCTCTACTCCTGTTTCGCCCTCATATGTCTCAGCCGCCTCGCCGGATGCCTCTACTATCACACC
CTAAACACCGTATTAGCATACTTGATCTTACCAAACGTTGCCGTTGCGAGTAACGCCGGCTTCATCTTCTTGACAATGCCGT
CGAAAACTAACAATGGTGTGGGAGTTCAGGTCGAGGACACAAAGATATGCGTTGTCATGGTTGGTCTCCCGGCCCGCGG
GAAGAGCTACATTGCCCAGTTAGCCCAGAGATACCTGCAATGGCTGTCGATTCCGGCAGCGACTTTCAATGTCGGCAAC
TATCGGCGCAATGACGCTCCACAGCCGACTGCCGACTTCTTTGATTTTAACAATCCCGAAGGAGAGCGGAAGCGCCGTG
CGGCTGCCGAGGCCGCCGTTGCTGACATGCTTGCCTGGTTCCGCACCGGCGGCGTCGTCGGCATCCTTGACGCGACCAA
TTCTACAAAGGAGCGCCGTAAATGGGTCATGGACACGTGCACCGCTCACGGCATTGAAGTGCTCTTTGTCGAGAGCAAA
TGCGATGATGAAGAGGTCATCATGGCCAATATCCGTGACGTCAAGCTAACGAGCCCCGACTATCGAGGCCAAGATCCCG
AGGCCGCGGCGCAAGACTTTCGCAATCGCATCAGCCACTACGAGAAAGTTTACAaGACCATCAACGCCGACGaGGATGA
GgAcAaCTACAcCTAccTaAAGCTGATGAaCGTcggcaagCaagtcatca > SEQ ID NO:4370    214564FL 220225_300953_1c
gcttcagcccggctctccaagaacaccatccgcctcaatcggcacatgcaaaagcagcgacactcgtcgatcgcggctg
aCAGACTGCAGAGCTACAGACGACAGATAGACACAGCTCCCTACCCTCAAGCTCACGCTCAAACTTGCTTTCGCACTCG
CACCCGCACCCGCACCCGCACGCGGGCTCGCGCCAGCCCTCCGCGAGACAATACGAGACCACAAAACACCACGGCATCT
TCCCCACATTCTCCAGCCAGAGACCTCTCCACGAATCGGGCTTGGGCTCATCCTATTTTGCCTTCCCTCCTCCCAACTC
CTTCCGAAATCTCGGCATCGTGAACTCCGGGCTCCAATGGCTACCAGAACGGGTTCGACCGGCGTGGCCACCTATGCCG
ACTGCGTCGATTCGCTGCGCAACTCTCTCAAATTCCTCGAGGCCTCCGTGGAGACCATTGACCGTGGCGTATCTGACTT
CCCTCGCCTCGTGAACGTCCTCAAGCACGTCGACACTACGAACTCATTCCCCAGCCCACACTCGCTGCTGCTGAGGCT
TCCCTGCGCGACGAAATTGGGCCCTACATCGCTTTTCTCCTCAGCCGCGCTGATGCTCAAGTTGAACGCCAGGAACGCC
GCATTGAGACGCTCAAAGCCCGGGCTGAGTTACAAcagggacgGTTAACTAGGCCTGATGAACcggCACGCAGcgtat > SEQ ID NO:4371    214613FL 108349_300381_1c
CACACTCCAATTTCCAATTTCCAATTTCCCAATCTGCAATTTTCTCTTTCCCTTTCAACAAAGAAAAATCTCAGAGAGA
AAAATGGCGGATCAGCTCACCGACGATCAGATCTCTGAGTTCAAAGAAGCCTTTAGTCTCTTTGACAAGGACGGAGATG
GTTGCATCACAACTAAGGAGCTTGGAACTGTAATGCGGTCATTGGGGCAGAACCCAACCGAGGCTGAGCTTCAAGACAT
GATCAATGAAGTTGATGCTGATGGGAATGGGACCATTGATTTCCCAGAGTTCCTTAACCTGATGGCTCGCAAGATGAAG
GACACTGATTCCGAGGAGGAGCTAAAGGAAGCTTTCAGAGTGTTCGACAAGGATCAGAACGGATTCATCTCGGCAGCTG
AGCTTCGTCATGTCATGACAAACCTAGGCGAGAAGCTTACAGATGAAGAGGTTGATGAAATGATCCGTGAAGCTGATGT
GGACGGCGATGGGCAAATCAACTACGAGGAGTTTGTCAAGGTCATGATGGCCAAGTGAGAACTGACGAATCCAACTTTT
AATCTTTATTAGAAGTAAAAAATACGAAGAGAAGGAAACAGGGCAGATAAGTTTGTTGAGATTCTGTTTCAAATTAGGA
CATATTTACCTGTCTCAGTGCTTGCCTATTTTCcta > SEQ ID NO:4372    214613FL 226347_300996_1c
AAAAATATTACAAATGTCGCAAAACTCCAAATCTTTCAAGGACGCCTTTTCCCTGTTCGACAAGAAGGGCACCGGCAAG
ATTCCTGCTGAAGCTCTCGGTGATCTTCTCAGAGCTGTGGGCCAGAACCCCACCCTCGCTGAGATTGATGATCTGAAGC
AGACCATTCCCGCTGAGTTCGACTACGAGACCTTCTCCAAGATCGTCAACCGACCAAGCGGTTTCAAGTCTCTCGGTGA
GCCCGAGGATTACATCCGGGGATTCCAGGTGTTCGACAAGGACTCCACTGGGTTCGTGGGTGTCGGCGAGATGCGATAC
ATCCTTACCTCGCTGGGCGAGAAGATGTCTGATTCCGAGGTTGATGAGCTCCTTAAGGGAGTCAACGTTACTCGAGACG
GCAACGTCAACTACGTTGACTTCGTCAAGTCCATTCTGGCCCAGTAGATACCTAATATATTTTTATGTTTGAGC > SEQ ID NO:4373    214613FL 225436_301049_1c
GCTCCATCGATCCATCCACCGATCGATCGAGCTCTACATCCTGCGCAAGAACACACGATGGTAGAGGAGCTCACCGAGG
AGCAGATTGCAGAGTTTAAGGAGGCATTCAGCCTCTTCGACAAGGACGGCGATGGCTGCATTACCACCAAAGAGCTCGG
AACGGTGATGCGATCGCTGGGACAGAACCCGACGGAGGCAGAGCTCCAAGACATGATCAATGAGATCGATGCCGACGGC
AGCGGCACGGTCGATTTCCCAGAGTTCTTAAACCTCATGGCCAGGAAGATGAAAGACACCGACTCCGAGGAAGAGCTCA
AGGAGGCGTTCCGAGTCTTCGACAAGGAACAGAACGGCTTCATCTCCGCGGCGGAGCTGCGGCACGTCATGACCAACCT
CGGCGAGAAGCTCACCGACGACGAGGTTGACGAGATGATCCGCGAGGCAAACGTCGACGGCGATGGACAGATCAACTAC
GAAGACTTTGTAAAGATGATGATGTCCAAGTGATCCAGGGAAGTCGCCATTGATTGCTCTGCTCGCTCTATAGATCAAG
GGAATGCGACCACGATGTATTGCTCTGTCTCTATTGTGCAATTCCTTGCCACCTCTGTCTTGTATGGAATA > SEQ ID NO:4374    214613FL 147736_301255_1c
GCAGATCAGCTCACAGATGATCAGATCTCTGAATTCAAAGAAGCTTTCAGCCTTTTCGATAAGGATGGAGATGGTTGCA
TCACCACTAAGGAGCTTGGGACAGTTGATGCGGTCATTGGGACAAAATCCAACTGAGGCTGAGCTTCAAGACATGATCAA
TGAAGTAGATGCTGATGGAAATGGAACCATCGACTTTCCCGAGTTCCTTAACTTGATGGCTCGCAAGATGAAAGACACT
GATTCTGAGGAGGAGCTCAAGGAAGCTTTCAGAGTGTTCGACAAGGATCAGAATGGATTTATTTCTGCAGCCGAGCTGC
GACATGTCATGACAAACCTAGGCGAGAAGCTTACTGATGAAGAAGTTGATGAGATGATTCGTGAAGCTGACGTGGATGG
```

FIG. 2 continued

TGATGGCCATATCAACTATGAGGAGTTCGTCAAAGTCATGATGGCCAAGTGAGAACTGATCAACTTGACTTAATTCTTA
GTAGTAAAAAATTACAAAAAAAgaagcTGGCAACGGAGCagaTAAATtggaTGAGATCTCTATATTtg > SEQ ID NO:4375 214613FL 146586_301066_1c
ttcaaacttcaaagaccaatctttttgtttctccctttacgttctctgaattCCAGAAGCTTCTTCTCCCTCTCTCAAT
GGCGGATCAGCTGACCGATGATCAGATCTCTGAGTTTAAGGAGGCTTTCAGCCTATTCGACAAGGACGGCGATGGTTGC
ATTACAACTAAGGAGCTTGGGACTGTGATGAGGTCATTGGGACAGAACCCAACTGAAGCTGAGCTCCAGGACATGATAA
ATGAAGTGGATGCTGATGGTAATGGAACCATTGACTTCCCAGAGTTTTTGAACCTCATGGCCAGGAAGATGAAGGATAC
AGACTCGGAGGAGGAGCTGAAGGAGGCATTCAGAGTTTTTGACAAGGACCAGAATGGTTTCATTTCTGCTGCTGAGCTC
CGTCATGTGATGACCAACCTTGGTGAGAAGCTTACTGATGAAGAAGTTGATGAAATGATTAGGGAGGCCGATGTCGATG
GTGATGGACAAATTAACTATGATGAGTTTGTTAAGGTCATGATGGCCAAGTGATTTcCCTCTTCTGCAGTTTAccTTTT
TTACACTGAaGAAAGACCAAACattcATCAGACtggGtcAGC > SEQ ID NO:4376 214613FL 142414_300435_1c
AGCCATTCTCTCCGCGACGGTCTCGTCTTCCCCACCCCTCGCCTCCTCGCGCGCTCGGTGAGAGAAGCGAAGAAGAAGA
AGAAGAGGAGGAGGAAGAAGCCAGGCTAAGCCCAGCGGCATGGCGGACCAGCTCACCGACGACCAGATCGCCGAGTTCA
AGGAGGCCTTCAGCCTCTTCGACAAGGACGGCGATGGTTGCATCACAACCAAGGAGCTGGGAACCGTGATGCGTTCGCT
GGGGCAGAACCCAACGGAGGCCGAGCTCCAGGACATGATCAACGAGGTCGACGCGGACGGCAACGGCACCATCGACTTC
CCGGAGTTCCTCAACCTGATGGCACGCAAGATGAAGGACACCGACTCGGAGGAGGAGCTCAAGGAGGCGTTCAGGGTGT
TCGACAAAGACCAGAACGGCTTCATCTCCGCCGCCGAGCTCCGCCACGTCATGACCAACCTCGGCGAGAAGCTGACCGA
CGAGGAGGTCGACGAGATGATCCGCGAAGCCGACGTCGACGGTGACGGCCAGATCAACTACGAGGAGTTCGTCAAGGTC
ATGATGGCCAAGTGAGGCACCCACTTCCCCTGCCGATGATGGCATAGTACCCTGGGAGGAGGAAACCGTGCATTGCCGTA
TTAGTAAGGGGATGCAAACACTGGTTTCAGTCGTCTTCCCTGATGAAGAAAACCGAACCGTACTAGTTGTAGTTGCTGA
ACATTTTTCTATCTCTCCAGTCTCTCCGGTgTgccATGGAACTTCTTGCTTGAtTTTTCTgtgTGAATCTGtt > SEQ ID NO:4377 214613FL 130580_300488_1c
GAATTCACAACAGAGACTCGGCCATCATAATTCCGCGTTCTCTAAAATTTACCTTTTAGAGATCCCATCTTCCTCTTGT
TCTTCGTTGATATTATATCACACAGGGAAGAAACAAAATCATGGCTGATCAATTAACTGACGACCAGATCTCTGAGTTC
AAGGAAGCTTTCAGCTTATTCGACAAGGATGGAGATGGTTGCATCACAACCAAGGAACTGGGAACTGTCATGCGTTCAC
TAGGTCAGAACCCAACAGAAGCAGAGCTCCAGGACATGATAAACGAGGTTGACGCTGATGGAAATGGAACAATTGATTT
TCCAGAGTTCCTCAACCTTATGGCACGTAAAATGAAGGATACTGACTCAGAGGAGGAACTAAAAGAGGCTTTTAGGGTA
TTCGACAAGGACCAGAATGGTTTCATTTCTGCAGCTGAGTTGCGCCATGTCATGACCAACCTAGGGGAGAAGCTTACAG
ACGAGGAAGTTGATGAGATGATTCGTGAAGCTGATGTAGATGGTGATGGTCAAATCAACTATGAGGAATTTGTCAAAGT
CATGATGGCCAAGTAAGGAGACTCATCCCCTTACCACTAAAAAGGGAAAAGAGAAACA > SEQ ID NO:4378 214613FL 1112638_301803_1c
TTCTCTCTCTCTCTCTCTCTCTCTCTCACTCTGTCCAGCTCCTCCTCCTCCTCAGCAATGGCAGACCAGCTGACAGAGG
AGCAAATCGCAGAGTTCAAGGAAGCCTTCAGCCTCTTTAAGGATGGAGATGGTTGCATCACAACGAAAGAGCTGGG
TACCGTCATGCGTTCCTTAGGGCAAAATCCAACTGAAGCAGAGCTTCGAGACATGATCAATGAGGTTGATGCTGATGGA
AACGGAACAATTGATTTTCCGGAATTCCTGAATTTGATGGCCCGTAAAATGAAGGACACGGACTCTGAAGAGGAGCTGA
AGGAGGCATTCAAGGTCTTTGATAAGGATCAAAATGGCTATATTTCTGCCGCCGAGTTGCGTCACGTGATGACTAATTT
GGGAGAGAAGTTGACGGATGAGGAGGTCGATGAGATGATTCGTGAAGCGGACATTGATGGGGACGGCCAGGTTAACTAT
GAGGAGTTTGTCAGAATGATGCTTGCAAAATAAAATCCCCCATTCCTTGCACTCAATCTAACACAAATAGGTTGCTAAT
TTGCTTTTTGGGATAGGTTGTATTAAGCTTGCACTCCCTAAGGAATGAATTGTTTTTTTTTCTTTCCCTTTTTTGTTCA
TATAGCCATGGCTGAAATGCTTGGGCACAATTATCAGTTATGCTTCATtGAGACaccATACGggCTttaTGaGCTTGTG
TAACTTTGATGaag > SEQ ID NO:4379 214613FL 1108616_301519_1c
GTTTTGGAGAGACGGGGAGCTGAGATGGCCGACCAGCTGACGGAGGATCAGATCGCAGAGTTCAAAGAAGCCTTCAGTC
TTTTTGATAAGGATGGAGATGGTTGCATCACAACGAAGGAACTGGGGACTGTGATGAGGTCTCTGGGCCAGAATCCAAC
GGAAGGAGAGCTACAGGACATGATCAATGAAGTGGATGCAGACGGAAGTGGAACCATTGACTTCCCCGAGTTCCTCAAC
CTCATGGCCCGCAAGATGAAGGACACCGACTCTGAGGAGGAGTTGAAAGAGGCCTTCCGTGTGTTTGACAAGGACCAGA
ATGGATATATCTCTGCCGAAGAGCTTCGTCATGTCATGACTAACTTGGGAGAGAAGCTGACCGACGAAGAAGTTGATGA
GATGATACGGGAGGCGGACGTGGACGGCGATGGCCAAATCAATTACGAGGAATTTGTGAAGATAATGCTGTCCAAGTGA
GGAGACCGAACGGGAATACTTGGGTTGTGTGTGAGGGGACTTTCTCTTACTCGTAGCAATTCTTTcagtatgAAATTGA
GCAACTATTGCCCTAGTCTCTTGTaGGCCTTGCATTGACTTGCCTTGCcTTGCAaATCAGtaat

FIG. 2 continued

> SEQ ID NO:4380 214613FL 109275_300044_1c
cccggaaatgaatTGAAAAGACGATTATTTTGTCTGAAATTCCAGAACAATCTTCTCTCTTAAGTTTTCTCTGTTGTTG
AATTGAAGAAGAAAATGGCAGATCAGTTAACCGATGACCAGGTCTCTGAGTTCAAGGAGGCCTTCAGCCTATTCGATAA
GGACGGAGATGGTTGCATCACGACTAAGGAGCTTGGGACTGTGATGAGGTCGCTCGGACAGAACCCCACCGAAGCAGAG
CTCCAAGACATGATAAACGAGGTGGATGCAGATGGTAACGGAACCATTGACTTCCCTGAGTTTCTAAACCTCATGGCCC
GGAAAATGAAGGATACTGACTCCGAGGAGGAACTGAAGGAGGCGTTCAGAGTGTTCGACAAGGATCAAAATGGCTTCAT
CTCCGCTGCTGAGCTTCGTCATGTGATGACTAACCTTGGGGAGAAGCTTACTGATGAAGAAGTTGATGAGATGATTAGG
GAAGCAGATGTCGATGGTGATGGTCAAATTAACTATGAGGAGTTTGTTAAGGTCATGATGGCTAAGTAATTTCACCATC
TCTTATTGAAGTTGAAGTTTAGACTTGTTAAAAATGTGAAAATTCCAAAAATATTTCATTGGATAGGATTTGCCTAGTG
TAATGTGTTCCGTTGTACCATCTTGGATGTATTGGACCTGGAATGAATGTAATgCTTTAtTGt > SEQ ID NO:4381 214613FL 1101059_301473_1c
ACCCCTCTCTCTCTGTCTGTGCCTCTCTCTCTCTCTCTCTTTATATATATATATTCTCTTTCCTCCGGTCAAACGTT
GGGAGTAGCATGGCCGAACAGCTGACTGAGGATCAGATCGCAGAGTTCAAGGAAGCCTTCAGTCTCTTCGACAGAGATG
GCGATGGTTCCATCACCACCAAAGAGCTAGGTACAGTTATGCGTTCTTTAGGGCAGAATCCAACGGAAGCTGAGCTTCG
AGACATGATCAATGAGGTTGACGCTGACGGAAATGGAACAATTGATTTTCCAGAGTTCCTTAATTTGATGGCTCGCAAA
ATGAAGGATACTGATTCTGAGGAGGAGCTGAAGGAAGCATTTAAAGTCTTTGATAAGGATCAGAATGGCTACATTTCTG
CTGCAGAGTTGCGTCACGTAATGACAAATCTTGGAGAGAAGCTGACTGATGAGGAGGTTGATGAAATGATTCGTGAAGC
TGACATAGACGGGGACGGCCAGGTTAATTATGAGGAATTTGTGAGAATGATGCTTTCAAAGTAATTCCAAACTTGTTCT
TGTTgCCGTTCGTATTCAAATAGCAGATCTACTGCTAACAAAGATTTGCTTTGGCACATAATTGAGCCGCTTTTTCATG
TGGAAGGAGGCAAAAAAAAGGCCACAAAGTTCACCAGAACAATTAGCTGCTGTGTATTTTGAGGTAGTAGGTTATATAA
CGTTTGTAgTGG > SEQ ID NO:4382 214613FL 282850_200090_1c
CCTTATTTCAAATTTCCAGTAAAATAATCGAAAGAGATTATGGCGGATCAGCTGACTGACGATCAGATCTCTGAGTTTA
AAGAAGCCTTTAGCCTCTTCGACAAGGACGGCGATGGTTGCATCACTACGAAGGAGCTTGGAACCGTGATGCGGTCACT
GGGGCAGAACCCAACCGAGGCTGAGCTTCAAGACATGATCAACGAAGTTGATGCTGATGGGAATGGGACCATTGACTTT
CCTGAGTTCCTTAACCTGATGGCTCGCAAGATGAAGGACACTGATTCCGAGGAGGAGCTCAAGGAAGCTTTTAGAGTGT
TTGACAAGGATCAGAATGGATTTATCTCTGCAGCTGAGCTTCGCCATGTCATGACAAACCTAGGTGAGAAGCTTACAGA
CGAAGAGGTTGATGAGATGATTCGTGAAGCTGACGTGGATGGCAATGGGCAGATCAACTATGAGGAATTCGTCAAGGTC
ATGATGGCCAAGTGAGAATCCAACTTAATCTTTAAAATTAAAGTACAACAAAAAGGAACGGCGGATAAGTCTGATGAGG
TTTCTATTTCTGGttAGGATGTCTTCTTTGGCttattaGc > SEQ ID NO:4383 214613FL 279978_200222_1c
tttctttaaaaacggtcaaagtgccaaaaacgaaatcaaaaggcataaaacttgcgcATAGGGTTCTTTGAAATCGTGA
AAAGAGAGAGAGAGAGAGAGAAATGGCAGAGCAGCTAACGGAGGAGCAGATCGCTGAGTTCAAGGAGGCCTTTAGCCTTTT
CGACAAGGACGGCGATGGCTGTATTACTACCAAGGAATTGGGAACAGTGATGAGATCACTTGGTCAGAATCCCACTGAA
GCTGAACTACAGGATATGATCAGCGAGGTTGATGCTGATCAGAATGGAACCATTGATTTTCCAGAGTTCTTGAATCTGA
TGGCACGTAAGATGAAGGACACTGATTCTGAGGAAGAACTCAAAGAAGCTTTCAAGGTTTTCGATAAAGATCAGAATGG
CTTTATTTCTGCAGCTGAGCTTCGTCATGTAATGACAAACCTTGGAGAGAAGCTGACTGATGAAGAGGTTGATGAGATG
ATCCGAGAAGCAGATATTGATGGCGATGGGCAAGTTAATTACGAGGAGTTTGTCCGCATGATGCTTGCCAAGTGACTTT
AGATTCTCGTGTATTTTGCGACGGCCACTTAGTTACCTATAACTTCTAGCTGTCAGTTTATATTCTGTGTTGCTGTTAA
GACAAACAAATGTGCCCTATGCTTTTACTAGTATCTAGACTCCTTTCAGTTTATATGTTTTAACTTCCGGgCTAATGGT
GTATACAgCtATAGTCCCTTGCCCATTCagagggTAAAAGAaaaggAGaAATTAGaTAGTgGCATTggtaatATCTTGt
tAGttG > SEQ ID NO:4384 214613FL 254332_301632_1c
GCCACGCGTCCGCCACGCGTCCGCTTCTCTCTCTCTCTCTCTCTCTCTCACTCTGTCCAGCTCCTCCTCCTCCTCAG
CAATGGCAGACCAGCTGACAGAGGAGCAAATCGCAGAGTTCAAGGAAGCCTTCAGCCTCTTTGATAAGGATGGAGATGG
TTGCATCACAACGAAAGAGCTGGGTACCGTCATGCGTTCCTTAGGGCAAAATCCAACTGAAGCAGAGCTTCGAGACATG
ATCAATGAGGTTGATGCTGATGGAAACGGAACAATTGATTTTCCGGAATTCCTGAATTTGATGGCCCGTAAAATGAAGG
ACACGGACTCTGAAGAGGAGCTGAAGGAGGCATTCAAGGTCTTTGATAAGGATCAAAATGGCTATATTTCTGCCGCCGA
GTTGCGTCACGTGATGACTAATTTGGGAGAGAAGTTGACGGATGAGGAGGTCGATGAGATGATTCGTGAAGCGGACATT
GATGGGGACGGCCAGGTTAACTATGAGGAGTTTGTCAGAATGATGCTTGCAAAATAAAATCCCCCATTCCTTGCACTCA
ATCTAACACAAATAGGTTGCTAATTTGCTTTTTGGGATAGGTTGTATTAAGCTTGCACTCCCTAAGGAATG > SEQ ID NO:4385 214613FL 248465_301583_1c
ATCGATCCATCGATCCACCGGGCATTTCGTCAAAGAGGAGATGGCTGATCAGCTGACCGAGGACCAGATCGCCGAGTTC

FIG. 2 continued

AAGGAGGCGTTTAGCCTGTTCGACAAGGATGGAGACGGCTGTATCACAACTAAGGAGTTGGGAACGGTGATGCGATCGC
TTGGACAAAACCCGACCGAGGCGGAGCTCCAGGACATGATCAACGAGGTGGACGCCGACGGCAATGGGACCATCGACTT
CCCCGAGTTCCTCAACTTGATGGCGCGCAAGATGAAGGACACTGACTCGGAGGAGGAGCTCAAGGAGGCGTTCCGCGTC
TTCGACAAGGACCAGAACGGCTTCATCTCGGCTGCCGAGCTCCGCCATGTAATGACCAACCTCGGCGAGAAGCTCACGG
ACGACGAGGTGGACGAGATGATCCGCGAGGCTGATGTGGACGGGGACGGGCAGATCAACTATGAGGAGTTCGTCAAGAT
GATGCTAGCTAAGTAGTAGAACATCTGTTTCCTTTTTCTCTACTTTGTTCCTCGCCTTTCCTCTCTCTGTCTTTTCTCT
TTCCTTTTTGTTTTGGTAAAGTCCTGCTTCCATGTTAGGATGATGATTCCACCACGTCTAAAACCTTTTAAATTATTTG
TTCCTGTCCTTgcaaAAaAAaa > SEQ ID NO:4386 214613FL 245055_301564_1c
AGGAACACAGCAGCAAGCTTGGTGCTTCGTCGTCCGGTACCCCTGTTCTTCGCAGGGCCTGAAAAGGAAGGAAGAGTTT
TAAGCAAGAGACATCGATGGCCGCCTCTGCTGCCGAGCAGCTCACACAGGAGCAATTGGCAGAGTTTAAGGAGGCCTTC
AGCCTGTTTGACAAAGATGGCGATGGCTGCATTACCACCAAGGAACTGGGGACGGTGATGAGATCCCTGGGACAGAACC
CCACCGAGGCGGAGCTGCAGGACATGATCAACGAGGTGGACGCCGGACGGGAACGGGACCATCGACTTTGCCGAGTTCCT
GAGCCTTATGGCCAGGAAGATGAAGGACACCGACTCGGAGGAGGAGCTCAAGGAGGCGTTCCGGGTGTTCGACAAGGAC
CAGAACGGCTTCATCTCGGCGGTGGAGCTGCGGCATGTAATGACCAACCTCGGGGAGAAGCTCACCGACGAGGAGGTGG
ACGAGATGATCCGGGAGGCGGACGTCGACGGCGACGGGCAGATCAAC > SEQ ID NO:4387 214613FL 201036_300712_1c
GTCTCTCCTCCTCCCATCTCCGCTTCCCTTCTTCTTCTTCGTTGATCCACTCACCCGCCGCGCGCAGAGGAGGCCA
TGGCGGATCAGCTCACCGACGACCAGATCGCCGAGTTCAAGGAGGCCTTCAGCCTCTTCGACAAGGACGGCGATGGTTG
CATCACAACCAAGGAGTTGGGAACTGTCATGCGTTCACTAGGGCAGAACCCAACGGAAGCTGAGCTCCAGGACATGATC
AACGAGGTTGATGCTGATGGCAATGGAACCATTGATTTTCCTGAGTTTCTCAATCTGATGGCTCGCAAGATGAAGGACA
CTGATTCAGAGGAAGAACTCAAGGAGGCCTTCCGGGTGTTTGACAAGGACCAAAATGGCTTCATCTCCGCTGCTGAGCT
CCGCCATGTGATGACAAATCTTGGCGAGAAGCTAACTGACGAGGAGGTGGATGAGATGATCCGTGAGGCTGATGTTGAT
GGTGATGGTCAGATAAACTATGAGGAGTTTGTGAAGgTCATGATGGCcAAGTGAGCCATGGAACCATACTCTAAGgCaG
AGGAGATTGTGTGTTGCATAGTCCTAGTTaAGATGcaaCACTTGTTTTATCAATTtccagtgaagcaTccTACTAGCT > SEQ ID NO:4388 214613FL 190460_300818_1c
CACAGCCCGCGCACCTCCACACCATTAGCCATCAACGACCAGCATCTCGGCTTTGCTCGCCTTCTCGAAGCTTCTGCTG
CCATGGCGGACCAGCTCTCCGAAGAGCAGATTGTAGAGTTCAGGGAGGCCTTCAGCCTCTTCGACAAGGACGGCGACGG
TTCTATCACCACCAAGGAGCTAGGAACCGTGATGCGAAGTCTGGGCAGAACCCAACAGAGGCGGAGCTGCAGGACATG
ATCAGCGAGGTGGACGCGGACAGCAACGGCAACATCGAATTCAAGGAGTTCCTGGGCCTGATGGCGCGCAAGCTGAGGG
ACAAGGACTCCGAGGAGGAGCTGAAGGAGGCGTTCCGCGTCTTCGACAAGGACCAGAACGGGTTCATCTCCGCCGCCGA
GCTCCGCCACGTGATGGCCAACATCGGGGAGCGGCTCACCGACGAGGAGGTCGGCGAGATGATCAGCGAGGCCGACGTC
GACGGCGACGGGCAGATCAACTACGAGGAGTTCGTCAAGTGCATGATGGCCA > SEQ ID NO:4389 214613FL 176172_300519_1c
CGCCACTCGTTCCCCTTCCTTCCTCTCCTCCTCTCGCGGAACCTTCTCGAAGCTTCCACACCCCCAACCTCGCCTCCAC
CACCAACCCCCCATGGCGGACCAGCTCACCGACGAGCAGATCGCCGAGTTCAAGGAGGCGTTCAGCCTCTTCGACAAGG
ACGGCGACGGTTGCATCACTACTAAGGAGCTTGGAACCGTGATGCGGTCCCTTGGTCAGAACCCAACTGAGGCGGAGCT
GCAGGACATGATCAACGAGGTTGATGCTGATGGCAATGGGACCATTGACTTCCCAGAGTTCCTGAACCTGATGGCGAAG
AAGATGAAGGATACCGACTCTGAGGAGGAGCTCAAGGAGGCCTTCCGTGTGTTTGACAAGGACCAGAACGGTTTCATCT
CGGCTGCTGAGCTCCGCCACGTCATGACCAACCTTGGTGAGAAGCTGACCGACGACGAGGAAGTCGACGAGATGATCCGTGA
GGCTGACGTCGATGGCGATGGCCAGATCAACTACGAGGAGTTCGTTAAGGTCATGATGGCCAAGTGAGGAGGGTTCCCA
TTAAATAAGTTCTGTCTGAAGTGAACTAAAACTGTCAGGGCCTACAACAAAGCTGTACTttgtgATG > SEQ ID NO:4390 214613FL 174890_300527_1c
ctctccgcgacggtctgggcttccccaccccctcgcctcctcgcgcgctcggtgagagaagcgaagaagaagaagagag
gAGGAGGAAGAAGCCAGGCTAAGCCCCGCGGCAGCCAGCTCACCGACGACCAGATCGCCGAGTTCAAGGAGGC
CTTCAGCCTCTTCGACAAGGACGGCGATGGTTGCATCACAACCAAGGAGTTGGGAACTGTCATGCGTTCACTAGGGCAG
AACCCAACGGAAGCTGAGCTCCAGGACATGATCAACGAGGTTGATGCTGATGGCAATGGAACCATTGATTTTCCTGAGT
TTCTCAATCTGATGGCTCGCAAGATGAAGGACACTGATTCAGAGGAAGAACTCAAGGAGGCCTTCCGGGTTTTGACAAG
GACCAAAATGGCTTCATCTCCGCTGCTGAGCTCCGCCATGTGATGACAAATCTTGGCGAGAAGCTAACTGACGAGGAGG
TGGATGAGATGATCCGTGAGGCTGATGTTGATGGTGATGGTCAGATAAACTATGAGGAGTTTGTGAAGGTCATGATGGC
CAAGTGAGCCATGGAACCATACTCTAaagcAGAGGagATTGTGTGTTGCATAGTCCTAgctAAGATGCAACACTTGTTT
TATCAATTTCCAGTGAAGCATCCTACTAGCTgtaGTCGCTaaaaaggaTTTTCcTgCTATGTTCcTCTg

FIG. 2 continued

> SEQ ID NO:4391 214613FL 1100495_301460_1c
gttccacgtgcTTTTCTGCTCTCTTTTGGTTTCACGACTGCCCAACTCAACCTGCCCAGCGCTCTCTCTCTCTCTCTCT
CTCTCTTCCTGGTTTGGGTTTCTATGGCCGCAGTGATGGTCGAGCAGCCCCTGACAGAGGAGCAAATAGCCGAATTTAA
GGAGGCCTTTAGTCTTTTTGATAGAGATGGAGATGGGTGCATCACAACAAAGGAGTTGGGCACGGTGATGAGGTCGTTA
GGGCAGAACCCCACTGAGGCCGAGATCCAAGACATGATCAATGAAGTGGATGCAGACGGCAATGGGATCATCGACTTCA
TGGAGTTTGTGGGCCTCATGTCTAGGAAGATGAAGGATACTGACTCAGAAGAGGAGCTCAAAGAGGCCTTCAAGGTCTT
TGACAAGGATCAAAATGGCTTCATCTCAGCCCTTGAGCTCCGCCACGTCATGACCAACCTCGGTGAGAAGCTCAGTAAC
GAAGAGGTTGACGAGATGATCCGAGAAGCCGATGTGGACGGGGATGGCCAGATTAACTATGAAGAATTTGTCTTAATTA
TGATGAGTAGTAAGTAAGTAGGACCCCCATATAGAAGCCTCTTAAACCCTTCTCTAAGTCTTGTGTGTACTCATGAAAG
GAAACATCCCCAGACtGagCCCTTTgGTGTACTaaAGCATCACcaaAgc > SEQ ID NO:4392 214623FL 220615_300937_1c
GCGCGATTGTGAATTCGCGAGCGAATGAAACTCGTCGCATGCTTTGGATCCTGCTTCCGACAAGCTCCCACGACTTGGC
TTGGATAAACCTCTAACCTCCATTTTGGAATCGAGTGTCCTCCATGGCTCGAGAATAAGTCACATATTCAATCAACAGT
ATACATAGTTGTAATCGATACACCAATTTCTACTGGAAACGAGGTTTCCATGGGCTTCATCGAACTTCTCTTGGAGAAA
TTCTCCATCACGAGGTTCTTCCTCATCATGGCTGGCGTCTGGACAGCTGTATTCATCGTCGGCCGCATACGAGAACACC
AGAAAATCAAGAGCCTCGGCAGCTACGGCCCTTCTCTAAAGCCTCTTCTTCCATTTGGACTGGATTTTATCTACCACGG
AGCTCGTGCCACATTCCGCCAACAGACCTTTGCGCTATGGAGGGACGTCCTCTTCTCCCAATTCTGGACCGTCGAGATG
CGCGTCCTCAACGAACGAGTCTGCTTCACCGCTGACCCCGAGAACATCAACGCCGTGC > SEQ ID NO:4393 214637FL 200156_300815_1c
GGTTCTCAAAGTCTTCCGGTGCCGCCGGCCGTTTGGCTGCGGACCGAAAGGTGGACAGGAATCAACTCGTGATGAGATC
CGGGAAATGGCGGCCTCCGCCGGGATTTGGATTCCATTCTTTCGTTTTTTGTTGGTTTCTAACGTTGATGACCATTCAG
TGGCGGCGGCTATGAAGGATATGATGAGAGGTGGTGCTTATGCCGGTGTGTATCAAGTAACGAGTCCGCCTGGTCCAGG
CATCATCATACGATCCATCAATCATAATCAAGGGGAACACAGAGGCAAATCTTCT > SEQ ID NO:4394 214665FL 105492_300368_1c
cttcaggaagctagcaaaggcggcggcaggtgcaccCgtcgcgtgcattcagtagagaaggccattattccaagtctaa
tTTTGCTAACCCTAGCTTCCCCTTTGGAGCTATTGCTGCCGTTGCTGGTTGTGTTTCCTACTATTACTGCTCTTCTTCT
CCTCATTTGGTGTACTTAGAGCAAATCAATGAAGATTCTGGTCAAAAAGTTGCTTTAAATCCTGATAAATGGATTGAAT
TTAAGCTGCAAGATCGAGCACCAGTTAGCCACAATAGTCATCTGTTCAGGTTTTCATTCGATCCTTCTTCAAACTTAGG
TCTTGATATTGCATCTTGCATTCTTACGAGGGCACCGATGGGAGAAAATGCTGAAGGAAAACCAAATTATGTCATTCGA
CCTTATACTCCTATATCTGATCCAGATTCCGAGGGATACTTTGATTTGTTAATTAAGGTTTATCCTGAAGGGAAAATGA
GCCAGCATTTTGCAAGCTTAAAGCCAGGCGATGTACTTGAAGTGAAAGGGCCCATTGAGAAATTGCGTTATAGTACAAA
CATGAACAAACATATAGGCATGATTGCAGGGGGCAGTGGCATCACTCCAATGCTCCAGGTGATAGAGGCCATTCTTAAA
AACCCTGATGATAATACTCAGGTCTCATTGATTTATGCTAATGTGTCACCTGATGACATATTGCTAAAGAAGAAGCTTG
ATGTACTTGCGGCAACTCacctcnnattcncaaGGTATTTTACACTGTAGATAGTCCAACCAATGATTGGAGAGGCGGC
ATCGGTTACGTATCAAAGGACATGATTGTGAAAGGACTACCTCCGCCCAGTGATGATCACTTATACTCGTATGTGGTC
CTCCTGGGATGTGAAACATTTATCTGGCGAAAAGCCAAAACCTCGTGAGCAAGGCGAGCTAACTGGGCTACTCAACGA
TGTGGGCTTTACAGAAAACATGGTTTACAAATTTTAGTTAGTCCGTTAACTTTACTTTCCCTTATCCTTTATTGAATAA
AATTTTTTGAAGAAACACAATATCCTACACCACATAATCCGAGCGTTTGGACGAGCATTCAGGATGTTTACTAAAggC
CATGTTACAGATTGTGTTAAGTGAGGAATTCTTTTTGAAACATCTagacaACACTTATTTTAggGGGAAAaTaaAAAAG
CTTGATATACCTGTaag > SEQ ID NO:4395 214665FL 1117054_301817_1c
ACTTCTCATTTCTGAGTCCTGACTGTGTCCCTCTTGAAGAAGAAGGTGTGTGAGAGAGAGAGAGAGATGGGAGAGATGG
TGCAGGTCCTGCTGGAAGATCCCATAACCCGAGCTGGCATCGCCATCGCCGTCGTCGCTGTCGTCGCCGGAGCCGCTTA
CCTCGCCCTTGCTTCCAAGAAGCCCAAAGGATCGATAGATCCAGAGAACTTCAGGAAATTCAAATTAGTGAAGAGAACT
CAAGTCAGTCACAATGTTGTCCGGTTCAAATTTGCATTGCCAACACCAAATTCGGTGCTTGGTTTGCCCATTGGTCAGC
ACATCAGCTGCGGGGGTAAAGATAGTGAAGGTGCTGATGTGATTAAGCCTTACACTCCGACAACATTAGATTCTGATCT
TGGTATTTTTGATCTGGTTATTAAGATATATCCCCAAGGTAGAATGTCGCACCATTTTAGTAAGCTTCAAGTCGGTGAT
TACTTGGATGTTAAGGGTCCTAAGGGTAGATTCAAGTATAAGCCAGGCCAAGTGAGAGCATTTGGAATGCTTGCAGGTG
GTACGGGCATCACTCCCATGTTTCAGGTGACTCGGGCTATTTTAGAGAATCCGAATGACAAGACCAAAATCCATCTAAT
CTATG > SEQ ID NO:4396 214665FL 246419_301613_1c
tgATCAAGACAAAGGGAGGAGAGAATGGTGAGCCAGGAGGTGGCGAATCCAACGTTTCCAGTGCTAAGCATCGGCATCG
CACTACTCTCCGTCGTCGCCGCCGCCTTCTTCTTGTGGATTTCCGGCCGCCGCCGCCCCAAGAAGGCTTTGGATCCGGA

FIG. 2 continued

```
GAAATGGATAGAGTTTAAGCTGGTGAAAAGGCTCCAAGTGAGCCCCAATGTCACAAAGTTTCGCTTTGCGTTGCAGACC
CCTACCACGATTTTGGGACTTCCAGTTGGTCAGCATATGACTTGCCGTGGTAAGGATAGAGATGGAGCTGAAGTAATCA
AGCCTTACACACCGACAACACTTGATTCCGATGTTGGATACTTTGAACTCGTCGTCAAGATTTACTCGCTGGGAAGAAT
GTCGTATCATTTTGCCGATCTCAAGGAGGGAGATTTCCTATCCTGTAAAGGACCCAAGGGCCGCTTTTCTTACAAGCCA
AACAGTTATAAGGCTTTCGGTATGCTTGCCGGTGGTTCCGGCTTGACTCCAATGTATCAGGTGAGTCGGGCGATTTTGG
AGAACCCCGAGGACAAAACAAAGATTTTCCTCATTTACGGGAACGTCATGTATGACGATATActgcTcaaggaagaGCT
GGACagcatggtgaagaaataccgGGTCGCTTCGGTgtctactacgTgct > SEQ ID NO:4397 214665FL 223841_300976_1c
gatctgctattgtgtcCAAGCCCTGGGCCCCCATTGCTGCCACCTCTGTAGTTGCCGCCGCCGCCTCTTCCTACTACTT
CTCCAACATGGCCATCTCCAACGACGCTAAGACCGCCACCCTCAAGGGCGACGACCAGTGGGTTGATCTCAAGCTCAAG
TCCTCCAAGGACCTGTCCCACAACACCAAGGCCCTCATCTTCGAGCTCCCTACCCCCGACTCCACCCTCGGTCTTACCA
CCGCTTCCGCTCTCCTCACCAAGTACGTGACCCCTAAGGGCTCCAACGTTGTCCGACCTTACACCCCTGTTTCCGACCC
TGACTCCAAGGGCGAGTTTGAGCTCGTCGTCAAGTCCTACCCCGAGGGTAAGATGTCCAAGCACATCCACGAGCTCAAG
GAGGGTGACACTCTGTCCTTCAAGGGTCCCATCATCAAGTATCAGTGGCAGCCCAACCTCCACAAGGAGATCACCCTGA
TTGGTGCCGGAACCGGCATCACCCCTCTGTACCAGCTCATCTCTGCCATCAACAAGAACCCCGAGGATAAGACCAAGGT
GAACCTCTTTTACGGTAACGCCACTGAGGGTGACATTCTCCTCAAGGACGAGATTGACGCCATCGCCAAGGCCAAGCCC
CAGCAGTTCAACGTCCACTACTTCCTCGACAAGCCTTCCGACAACTGgaagGGTGAGAACGgatttaTCTCcg > SEQ ID NO:4398 214665FL 118143_300064_1c
AAAAGGGAAAGCAAGCTTTAGATTTCAGAGTTGTTTCATCCGCAAACTCTGTTAAACAGCCCTAGTAGTCCACCATATG
CAAATAATAACAATCTTTCCTCAGCTATAAATGACAGCATTCTCGATGGAGCTTAAATATCAATGAAAGGATAAAAATT
AAAAAAAATGCAAAGAAGAAAAGGAAGTTAAAACTGGAATTGCATCTCTGGGGTGTATCCAAGGGCTTCAAGATGAGCA
GCCATAGCCTTGTTCATTGGAGGTGGACCACACCTCAGTATCTGAATGTCAGATGCCGGGGCAGGACAATGATTCTGAA
TCATTTCCTTGGACACAAATCCAACACCACCGCTCCATACTTCAGGAGGCTGATTCAGTACGTAATAAATTTTGAAACG
GTCAGGATAGTTAGCAGCAAGGCCATCCAACTGTTCCTTTAAAAGTATGTCTTCATAGGTAACATTAGCATATATCAAG
TGCACTTTTGTCTTGTCATTTGGATTTTCGAGAATAGCTCTAGCAACCTGAAACATTGGGGTAATGCCAGAGCCTCCAG
CAAGCATTCCAAATGCTCTCACTTGGCCAGGCTGGTACTTAAAGCGGCCCTTAGGTCCCTTCACAGCCATATAATCACC
CTCACGCATTTCTCGGAAATGATGAGACATCCTTCCTTGAGGATACATCTTAATAACTAGTTCAAAATATCCAACATCT
GAG > SEQ ID NO:4399 214666FL 211667_300901_2c
TCGACCATTACCATCATACAGCCAACCTCTACATAAGCACAAATACCATTCAAAATGTCTTACGGCGGTGACAACAACG
ACAACTACGGCTCTCGCCGTAATGACGACAACTTTGGCTCCGGAGGAGATTCTTTCGGCTCTGGTGGAAACCAGCAATA
TGGCTCCGGAGGAGACTCATTTGGCTCTGGGGGAGATTCATACGGCTCTGGTGGAAATCAATTCGGCTCCGGCAACCGC
CGTAACGATGACAGCTCATTTGGTACCAGTGGCCAGGGCGAGTTCGGCTCTGGAGGTAACTATGCCAGCTCTGGCGGTG
ACTCCTATGGGTCTGGAGGAAACACCTATGGCTCCGGCGGCAATGACAACTTTGGCTCTGGGGGCAATGATACGTACGG
CTCGTCCCGTAACCAAGAGTCTTCTTTTGGATCCA > SEQ ID NO:4400 214676FL 220786_300938_1c
TCCTCAACACCGCACAAGCCCTCTGGGCCCGCCTCGTAGCAACCCACGATCCCCATACCATAGACTTCGTCGGCACCCT
CATCATCCAATTCATCTTCTGGTGGATCCCCTGCATCCTCTTTGTCTCTCTCGACTCTATCGCGCCCTCCTTCTCCGCG
AAACACAAGATCCAGCCGCCCCCCAAACAACCCTCCGCCAACGACATCCTCCACTCCGTCCTCGTCTGCATCCGCAACC
AAGTCATCGTCTTCGCCCTCCACGCCGTCCTCCTCTATGCCTCCTCTGCCAAGGGCCAGTCCCCCAGCATCAGAGTCGA
CGCGAGCTTCCCCACGGTCCAGGAGTTCACTACCACCTCGCCGTCAGCGTGCTCGCCCGCGAAGTCCTCTTCTACACCT
CCCACCGCATCTTCCACTGGCGGCCCTTGTACAGGCGCTTCCACAAGACGCACCACAAGTTCACCGCCCCC > SEQ ID NO:4401 214740FL 206654_300824_1c
gcaaaagactacaaagcttttggtccagcaaccataaatccaactcatTGTCCCTCCACCACGAAATCTAGCAACCTCT
CCTCCTCGCCACACAGCCCGCAATGCTCACACCAGCTTCTTCAAGAATACTCGCCAGCGGCGCCCGCCGTGCCCTTTCG
TCGCGCAGCTTCCACGCTTCGGCTCGGCATCTGAACGACTCTCCCCCCCTGCCCGCCGGAAGCCCATGGGCGCCTTCA
GAGGAGGTCTTTTCGGCTTCTTGTTTGGCAGCGTCCTGGCCGGCGGTGCCGTCTACAGCTACGTCCTGCAGGAGTACAA
GGCATCAACGAGTTGCTTACCGAGGATATCTACACTCTTCAAGCCTCCGTCACCCGACTGACAAACCACGTCAAGATC
CTTGAGGAGAAGATCCAGCAGAAGAGAAAGTAAAGCCCGAAAAGATAAAAAACACAAATAGCGCAATGTCATTAGGGAT
GGTATGATACCAGCGCTTCAACGCTGGTGGAAAATACTGGGCAAACGAACAGCATTATGGCAATACTTGTGTCCTTGTT
TGTAACAACCTAACAAAGCCTCAATTGTAAATTGTACCTTAAGTATCTAGCctCTGAAATATCtagcaCaggaaACAGC
ACAAAAG
```

FIG. 2 continued

> SEQ ID NO:4402 214787FL 211412_300899_1c
tcaaccaccACTCAGCAAGCAATCATCAAAACAGCCACTCTCACTTTTCTCTCAAAGTAAAACACTTCAAACCGCCAAC
ATGCAGGTTACTTCTATGCTCGCTCTCCTCTTTACCGTTGCCACTGGCGCTCTTGCAGCTCCCGGCCACGGAGCTCCTC
CTCCTCCCCATGTTCCTCCCCCTCCCCCTCCTCCTCCCACCAACCAAAACACCAACACCAACAACAATTGGCAATCCAA
CAGCTGTGGCAACGGCGCTTCTCCTTACTGCTGCAGTGCTACAGCTGATGGCCTGGGAGAGAACTACTGGAAGTGCTCT
GATCTCAATGATGTGTGCAACGACGTCATTGTTTGCTGCAACAACAATAGCAACAACAACAACCAGCAGGGAAAGCAAA
ACAACATCGACACCGGCAACCAGTCTTGCAGTGCCTTCGGACAACAGAAGGTCATCTACCTCTAAGCTTGCCTGCAGAA
GCTCAAAGTCGGCAATGGCTCTCTTATTTGCTTGTATCTTAGTCTTATAAGGCAGTTCATGTCCAAGTTTGTCGGCTAA
GGGCTGCGGTGACGGGTTTGAGAAAATGGGCAGTGGCATGTGGaacGGTGAAAAAATGCTTCttttctatttggtttgT
agcagggtggCTctTCTGAggcagtCTTTACaacCCGCtcactttCCTTAaGCCta > SEQ ID NO:4403 214794FL 205791_300801_1c
GTGGTTTTAGTTTTGGAGGAGTTTTACTTTTTTATTCTCTTTCATATTCCAATTCTGTACTTGTCTCGGAAGCCATATTT
ACAACTCTCAACACCACAATGGCGGGCTTCAAGAAACTACTCCAGACTCTAACTGGGAAAAAGAGCGACGATGCCACTC
AACCCGAAGAGCAGCAACGCCAAACTCCTCAGCCCAAACCTTGGTCCGGCATCGACAACACCCAACCAGCAGGCTCGAA
CCCCATCCGCGGCTTCTCCACCGAATATCTCGGCGAGCAAAAGTCCAGCAACACGGCCGTCCGCCGGGACCTCGGCTTC
GCGGGCCACATCGGCGGCCAGTGGTTCGGCGTGTACGGTGACACGCTGTGGTGCAGTCCCGGGGTGACGGACCCGGATT
TGGAGCCGGATCCGGAAGGGTTCCACGGCATGGTGCGGAACTCGGTGGCGGTGTTGACGGATGATCCGCTGGTAGTTCG
GTTTGTGCATTTGAATGGGGATGAGCCGGTGGCGCATCCGTTGCAGTTTACGCCGTTTGAGGAGCGGTGGGGGGAGAcg
aattTGTTTGGGTTTGGG > SEQ ID NO:4404 214809FL 211343_300957_1c
TCCACAATGGAGGCTCCAGTTGAGAAGAAGATTGAAAAGACAGCAAAGCCTTATGGCATGCGCAAAAATGGAATGCTAT
GGCATGCTCCGAAGAAGGCGTTTCGCCCGACCAAAGGCCTCTCATCGTATGAGCAGAGGACTTTTTAGCGAGCTGCAAT
GGCTCAGATGAAGGCAAAGGAAAAGGAGATGAAGGAGGAGAAGGAGGAAGAGCGCCAGCGTCGGATTCAAGCCATCAGG
GATAAGCGAGCAAAGAAGGAAGAGAGAGAAAGATA > SEQ ID NO:4405 214819FL 208304_300834_1c
AGGGATCACCGAAACTGAGGATGTACGAGTACAGATATTTGCATCATGGATCTGATATTGGGAGAGGAGAGGAGATGCA
CGGGCCTTGCTTTTTTGGGGATGCAGGGAGGGGAAAAGCCGTCTGACAAGTCATTTTCGCGTATTGAGATGGACAGAGT
TCTAGATCCATTACTAGTTGCAAGCACGGTCTGACGGCATGTCGTATGGTGTTACTGCGTCTTGTGTGAGGCCAAGACA
GGACATAAGATTTGGTATTTTCTGTGTTGTTGAATGGATTGATGGAGGTTTTACAATACGGGTACCGTACAGGCTTCCA
TGGATTTTATCGGTGACG > SEQ ID NO:4406 214888FL 205233_300797_1c
gcctcgacgatggagacGCAATGGAGCCTCCTCCAACCAAACTGACACCAGGCAAGGGTGTTCAGTCGAAATCCAACAA
GGGCCCTCCATCACCGACATTGGCCAATGTTGCGCGCCACTTTGCTGTGGACAGCGGCTCAACATTGCTTGCCACGGCG
GTAATCACAGTCTTGATATTCGGTGGATGCTGCTCTAACGTGTATGCTTTAGAGGCCATCATCAACTTCGAGCCGACAA
ACGGAACCCTCGTAACTTTCGTTCAATTCCTATTCGTCTCTATAACGGGCTACGTAGCGCAATTCGATAGATCACGCCC
GCCGTTCTTCCTGACTCCCAACGTCGTCCCGCTTAGCCGCTGGCTTGTCAATATCCTGTTGTTCTTTACCATCAACGTC
TTGAACAACCATGCCTTCAGCTATGACATATCCGTACCGGTTCACATCATTCTACGATCCGGAGGTAGCATAACCACCA
TGGCTGCCGGATACCTTTACGGCAAGACGTATTCGCGCCCCCAAATATTTGCAGTGTTTCTGCTGAGTATTGGCGTCAG
CCTCGCTGCTTGGTCGGATTCAAAAGACAAGAAACCGAGTGACGGTATTTCTGACCCTGTATTCAACCCTGGGCTCTTG
ATCATCTTTGTCGCCCaagtaCTTTCGGCGATCATGGGGCTGTataccgaAGCAACATAtcgaaag > SEQ ID NO:4407 214907FL 211940_300872_1c
GCATGATATTGAATGGTTGGAAAGTCAGATGGAGGCGTTCAAAGCAATCACAGCGACCCTGCCGCAGCTTTCCTTTCAT
GAGACGAAGCGGTCGGAACATGGCTTTGTCGTCGAACAGCGGCATTCCATGTCTGGCTCGGATGGTGTGCGGATCGGCC
TGTCCGCTACTCATTCGGGTTTGATCCAATTTGAGGGCCGCGATGCAAACTACCAGACGTTTGTAGAAAAGTTCCGCGA
AATGATACATAAAGCCAAGG

FIG. 2 continued

> SEQ ID NO:4408 214920FL 217169_300905_1c
AACCACGGCCACGACGACCGCGTCTGTCCGGGATTGATCCTGTCAACTGCTTTACCAGATATCTAGCCGTGCCACGATA
GAGCGCGCATGTCGGCGAGAGGGGGGCAGAAGAGGAGAAGAGTCAAGAGAAGGGGGGGCACAGCTGATAGACAGAGCGC
CGTCGAGCCTGTAGCATCGCCAAACTCAATGTAGGTACGTCTGATGAGTGTCGCTGCATGCAGATGACAGTCGTGGATG
CATGTCATTGGCACTTGATCAGCTCCATATTTGACAGTGCCCCTCCAACGGCGGCAAGCGAGAGTGAGGGGTTTGCTGT
TGTTATTTGTTGTTGCTGTTGCTTTGCTGTTGCATTTTCCTGAGGCATATGGGCCAAGATGAGAGATGGATGGATGACA
TGGATGAGATTGGTTTTTGTGTATAACAAAGCTTGATAATGGCATTGAACAAAGCTTGTGCCGGCTAGTCGATAAGGAC
GATGTCGATAACGCGTATCGCAGCTATCAGCCCATCTAATCGCAGCACAGCCTAACCCC

> SEQ ID NO:4409 214928FL 200511_300853_1c
gcccacgcgtccgcaatgcattctggtttgttgggggctaagcctttcaaCGTTATGCGTGTTACTCCCGGATATTATC
TTGCAACATGGGCTTGTCATCTCCCGCCAGCCATTCGCTGTGATTCGTCCCGGGATGCTCCGCGGACATTGCTTCCTGG
CGTATTTCAGCATCCGGCATTGGTGAAGTTCCCACTATGGAGATAGAATCATGGATTTTGCCCCCGCCCCTTTTTTTTT
TCTTCTTTTCCACCCTTCTTTATGCTTATCTCTCAGCCCCTAGCAAACGGTGGACGGATATTCTCATCTAGATTGCTGA
CAACATGCCGTTAGCCCCCATCAACCACGAACCCGTCCGACCCGGGGTCCAATATTCGTTCAGCTCGGCTgttCACCC
GTATACTCGTGCTTGACTTTTATTTTTGTTTTTAGTTGGGAGATTATTTTGTATTTTGCaGAAGCAATATTTGCCACCT
GGGCAATATTCTCTCGAGTCAGCCATTGTAGgCAGCTGAAAAGGCTGATCTGTCTTGGCCTTgctCGTTTCCCCGCGCT
ggaATCCATCATGTGAGAAGCAATGGATGGagacgagccATgcatCAAGAtTCTTGTCTGgagatctcCTGTgCagaTC
ACggAttcTcccAAAGCCAACTta > SEQ ID NO:4410 214938FL 212786_300843_1c
GCAAATTGGACATACACGATAATGCAATCCTCATCCATGGCCAGCGTAGCTTTCTTGACTACTGCAAAAGTAAAGGACG
ATGAGACAAAGGAGGTTGTGAATGGCTTGCAACAACTTAGTGCCCATCTCCAACTCCCCAATACCCCATGTCTAGCCGG
AGCCTGCTTTTTGTCCGCGGCCAAGAAGGAAACGGGTATCAAACTCATCGGTCGCTTGGAAATATTTCCTAGTGAAAGC
GAACTTGCTACTGTTCAAAACTCTCCTGAATATAAGCGTTTCAGCGACTCGGTCACCGGCCAAAAACTTCACGAAGGCA
AGGAGACTGCCACTTTATGGCAGCCCACCGGCGGTTTTCTGACAAGGAAGAACCAAGCCTCGACAACAAAGGCCGGTGT
ACTTGTTTTAGCCAAGTTCATTTGCAATGATAAAGAGAACGCAGTTCAAAATCTCGTGAAAGAGTTGCAAACATATTGT
GAGTGGATCGAGGGCAACGAGCTCACGACATACACATATTGCGTAATGACAAGTCAAACTGCAAATAAGGAAGTTCTGC
TCTTTGAGCGTTATAAGGATCTTCCTTCCGTCAAGACCCATGGCCAAACAAATGAGTTCAAGTCTATGTTCAAACGAAT
TTCGCCTTGGATTGAAACAAAGCGTACCGAAATAACTCCATGGAGCGAATTAGACGGTTCTTTCTTCTCTTCCCTAGAC
TTAGAAGCCACAGCGAAGCTCTAAAGATAGCTCTATATTCCTTATAATTTTGTATTTTTTCTTCTATTCT > SEQ ID NO:4411 214942FL 217246_300906_1c
AGATGTTGATTCCAACGCCAGAGACTAGCGGTGGGACTGCTATTAAAATAGAATAAAGATCTTACTTGGCAGCCGTTTT
CCGGTTCACCAAGCTGCGGAGATTAGATAGAGGGCTACATGCGACCCTTGTACGATCAGCGCATATCATGAGAACAATT
CTGGACTCAGAATTTTGACGAGACCAGTTCCTT > SEQ ID NO:4412 215024FL 219395_300944_1c
ACCCACGCGTCCGGTGGAGATCATTTTACTGTACTATAACGGTGGTGGCTGGATCGTCATGAGGCAAATCGGGCAATGC
GATGCGATACGATGGATCACGGCTAACATGACAATATTGATTAGTAGCATGATGATGAACCAACAGCACAGATCTGGAT
GGCTTTAGCTTTGACCACATGCCAAGCAGGCTGCCCAGGTTCACAGACCAGCC > SEQ ID NO:4413 215033FL 195947_300639_1c
CCTCGGTCTCTACGCAATCGCGACTGCATCAGAAGCATTCAATTGCTCGTCAACGTCAACATGTCTCTCGCACAGTCTA
TCTACAGGCAAGTCGCAACGACAGCGAATCAACGAACGTAACTACGGCATCCTAACATATACCTCTACAGCACCGTCTT
CCGCAAGAACTTCACCATGCTTGCGGCCGTTTTCGGTGCCGGCTTCGCTTGGGAGATGTATGAGGAGCCTACCACATTC
GATCGAGCGTCAGGGCAGTAAAAGGCTAATTAAGGGTGCAACAGCGGTTTCAATGCCACCATGACAAAATCTGGGACA
GCAACAACCGAGGCCGCCAATGGAAGGACATCCGACACAAGTACATTGAGGGCGGCGAGGACGAGGAGTAAGATCAACA
TGCAAATTCCGGTTGCTACGGCTAGAATGGGTGTGGCATGGGACTGCCTGGGGAAAATGTACAAAACCAACGAGAAATA
GAATGATTCACAACTTTTTTCTTTCCCTTCG > SEQ ID NO:4414 215048FL 220046_300951_1c
CTGCCAGATTTGCCCAAGTGCAGCTGGGGGGGAGGTTGTTAGCATGTCGTCTCGGTGCCAATCACCCGGTATGTACCA
AAGGGAGATAGCCTCTTT > SEQ ID NO:4415 215055FL 204471_300817_1c
GTTTCGAACGGTGTCCATGGCGGGCGGATGGGCGGGACGAGAGGGGGAAGCTCGGCGCCACCATGCCTTTACAAAAAGT
ATCATTGATGAATAGAGTCGTAAATCCGATTCACGGCTGCGGAGGCAGTGAGCGGAAGATCGACCAACAGATTAGCGAT

FIG. 2 continued

GAGCGAGAGGGTCAAGGAAACTGACAGGGTGATTCAGATGCCCCCCGGAAGTGGAGAGGAAACAAGAAGCCAGGGGTGT
TTGTCGTACACATGTTGCCAGCCTGCATCTGGCATCTGCTGCCAGCTATTGACAGCTACTTTCATTGGCCAGATGCTGC
AAATTGGAGCTGCACTGCACGGGCACAAGTTCGGATGGGGGATGACGGAAGCAAAACGGCTGCGTATTACCTGCGTTGG
TAGAATACTAAGGTATTGATGTAATATTTGGGTAGGTACGGATACGGTACTTTCATACAAAGAATCACTTAGTCATGGC
ACGCCTATCGATACCTCACCTCAGGCCAGCATCTTCACTTCGACTCGCTTATGCATTAGATCATATATCGAATCCATAT
AATATCAACTCATCATACTCAAAAAAAA

> SEQ ID NO:4416 215055FL 212896_300844_1c
ACGGGGTCCATGGCGGGCGGATGGCCGTTACGACAGGGGGAATCTCGGCGCCACCATGCCTTTACAAAAGGTATCATTG
ATGAATAGAGTCTTGAATCCGATTCACGGGTGCGGAGGCACTGAGCGGAAGATCGACC

> SEQ ID NO:4417 215055FL 219293_300929_1c
ACGGTGTCCATGCCAGGCGGAGGGGCGGGACCAGAGGGGTAAGCTCCGCGCCACCATGCCTTTACAAAAAGTATCATTG
ATG

> SEQ ID NO:4418 215066FL 220467_300955_1c
GTCTTCTCCAACTAAACAATAGCTCTTTTCTACTTCTAATTTTTTTTTATCTCAACTCACCATCTGAGCTATCAAGCT
AGAAAGTAACCACAGCAAATAATCATCATGGAGCTCGTCAACTACAACCACAAGACCTGCCCCAAGTGCTCTGCCACCA
TCACCTCCGAGTCCAAGACTTGCTCGAGCTGCGGCGCTACTTGCCCCGTCTAAGCTACCTCAGCTCGACCCGCCATCAA
CCTCAACCATCGCAACAACATGACGAGAATATCCTGAGGTGTGGCGGGACTGCAAGGACGCGCGGATGAGTGAATGAAT
AGATGAATGAAGGAATGATATACCTCAGCAGGACATGGTGCATTAAGACAAGGCGTTGATGGAAGAAGAGAAGCGATCA
TGTATGTCTAATATTCTAAGCTATATGCCAGTCCTTGTTACAGACAGGCGGCTAGAATAGTTCCTCGCAATGGAAGGAA
TCTAGAATGGCAATGGGCAATGGGCAATGGC

> SEQ ID NO:4419 215085FL 220703_300938_1c
GCCCACGCGTCCGCGATGATAAAGTTGTGGGGTAATTTAGATAGAGATGATTCGGCTGCAACGCTGAAAAGTGTTGATC
AAACTGGTAGGATTCAGTTCATTATTGTTCCTTCGCCCTTCGTGGATCGACGCTTCGCTTAACAGTGGCAGTGCTCGCG
GATGATGATCCGTCTGACGCGATCTGGAGGCGGACCCAGAATGTGGATGAGGGAATCTCCACAAGGCGTAACTCCTTGG
TTTACTCTTGTTCGCACACAGATGTATCTTGAGAGTTGTTAAGGCTATAACGAGTGCGGTTGAGATACGTCTACGACTA
AGCATCTTGAGCAGAGTGTTAGTTGCGAAACGTTCAATTGACTAAGTAAGAGTAGAGAGTATCAAGCCTGCAAATCCAT
CCCCCCGAATCTCCGATTTTATGAGCCACCATAGCTCTTTTCGCCAAATGCAAATGCCGTAGATAGTGCCCATCCG

> SEQ ID NO:4420 215091FL 220577_300956_1c
GCATAGCGAGTGGCTTCGTTGGTGGTTTGAGGGCTGGAGCCCCGGTGCCCAGACAATGAGATTTGTGGAGTTTTACCCG
TGTTGGTTTTCTTTAGTGACGTATTGATGAACAGGTACAACGACTTCAGGCGATCGGCGGCGACGCTTATTTCTTGCAC
GCCCCCTTGGATGGGTCCCGCGAGAACCTTGGTAGGTTTAAAGGAGGTAGCTGTGCTCCGTAACGGGGTTGTTATTTAT
AGGCTAGTATTAAGGAGCTGAATGACGCGCTCGTGTCGAACCCAGGAAATGGAATATTCATTTTTGTGTGGTGATGGCG
ACAGAGAGTAGGGTTTGGTTACCCCGAAGAAAGCAAGATCGAGATTGAAGTGTGTATCGGCGATTTATCAGATCTAGGC
CGACTTGAGCATGTGAGATGACACGAGCTAACACCAGCATGATACAGCTGGCAGTCAATAAGAGACAAAGCTTGTTGTA
C

> SEQ ID NO:4421 215108FL 220756_300938_1c
ATTTGATCTTTATTCTCTTTAATGTTCTCAGAAACCAATACGACAAAGTCAACTACATGATGAGCTCCCACAAGAAGAA
GAACGACAACAACAACAGCAGCAACATCCCGGAGGCACCACTGCCGCCAACATTCAAGGAGCAGCTCGACCAGGAGGCG
ATCGACAGCCGGGTTCACCAGCATGAGAGCGAAGAACACTCGACAGTGAAGGATATTGTCGATAAGATATCGCATGCCA
TTCCTGCTGTCGCCCCTCTCATCGGCGGATCAAATCCAGACAACAAGGTGGAGGAGCATAAAGAGGTGCCTCCGGGCC
TCCTAATCGACCAGAGCATGATACCCAGATTGAAGAGTTTGTGAGGGAGCAGCATCGAAGCAACGGCATCGAGAATCTG
AGCGAGGGAAAGTCGTGATGGATTCATCCACGCTCTCGGTTCAGCAGAGTTTCTTCATGTACCAATAGCCATCAAGCTT
TTACTTTTTCTTGCTTTAATACAGTGAAACCTGCGGCTACTATGCAGGCTCTTTACAGATAATCC

> SEQ ID NO:4422 215110FL 213175_300847_1c
GGATTTGCGAAAGGGCGAGATTTTGGGTGTGAGGCGGCAGACGGTGATTGGGGCGATTTGGGCAGCTCTGCCAAGGGTT
GGGTTCATGAAGATACAGTACGTGTTAGTGATGTGAAGCTGCTCCATGATGGGACTCGGAATGGCGGACGGATGCGGTC
ATGGGCTTTTGGAGATTGGCTTTTCTTGGTGGGCCGAGACGGCATCTAACTGGAGATTTGATGAAGGGGAATTCGAGCT
ATCAATACGGATATGCAGGACTGGATGATTCTGATTTGATGGCCCGAGGTGAAACTTGTCTGGAAACTTGATTCGGGGG
CAGCGAGAAGATTGCCCAACGACCGGGTGTCTTTTCTTTCTTCCTCTCTTTGTCTAAGATGTACGAGTACGTCGGCGG
CAGGGCGAGCACAGTTAGCCAGAAGCAAGGGGATGGACTTTTTGACACAGACATACGGAGTACAGAAGAAGAAGATGCA
GGGAGCGTCATCCTCCCGCAAGATGTC

FIG. 2 continued

> SEQ ID NO:4423 215114FL 221072_300941_1c
gaatgaaagggggaaaaaaaggccagcatggcacgctcgcacccaagaacaaaaaaaggccggagcactaataggcacggc
aTGGGGGCCTCACGCCATCGATTGTGTAATAGGCGTACGACGGTTACGACAGGAACGTGCCACAAAAGGAGGGGTGGGA
AAACGGATGACGGGAACAaggAGGAAAACTGGCTCTTTAAGTTCCAACTTTGTTGCCAATAGCCAGTCGCTGCTGTCTG
TGTTTCTAGTTTCTACGGAGCATGAACCTGTGAGAACAAGCCACATCGGGGAGACGGGAAGATGGTGACACGGATGCGT
TTGTGGAGGTGGGTAAGCTTTGCGCAACATGTGCCAGCCTTATCTTGATATTGGACGCGGCGACGGCGAGATGGTTGGA
AGGGTGTGTCTATGTGTACCGACAAACGCATGGCTGATGAGACGGTGAATAAAACTGCACCAAGAAAGAGATGCATGAG
AGATGAATGACCAGTACCTAAGGTCTATGACATGTCGCTTTGCACTCGGTCGGACTCATTCACATGTAGTAAATACTAC
ATAACACCCACTTGCTCCAGTAATCATCACTTATAATAATACGGCGAGAAGACAAGTTGACACAGGGCGAAACAGGGCG
GAACAAGGGGCGAAGCGAGGTGGAAAATGGTAAACGCAGAGACTCTTTCTATGTACTAGCCATCGATCAAAAGGAAGGA
CAGCTCAGTCTTCGCTGCATGCTAAAGCAGCGGCCGATGGGATGGGGCTCCAAGGCAAggTGTAATACCGAGtACATGC
ATATcaaAaaagaaaagacgaaacgtt > SEQ ID NO:4424 215116FL 221183_300942_1c
TTTTTCTCGCAACTCGCTGCTTGGCTCCAGTATCTGGCATTAGCACCTGTTGTGTGCGTTGGCCTGCCGTAGGTTGATG
CATCTGCAGCTGCAGCGTTTCCGCATCACATCACCTTCATCTTACATGACAAACCCCCTCTTTTTACTCCCTTCGATAC
GGTTATTGGTTCGAAGGCTTTACAATTCAGACGTGCAGGCACTAAGACATCCATCTCGACTGTTAGAGGTTGTCTTGCT
GCAGACGTTATCGTACCAGCACGGCTTATATAGCACCAGACAGACCCCTCCGCTGCAGCTGGTTTACTTCTTTTTATTA
ATCTCAACTATCACCACGGCTACCTATTCTTCACTTC > SEQ ID NO:4425 215117FL 221004_300941_1c
ATCTTGGGATGTTCTGCAGACGATTGTCAAAGCCGGATTAACCCCGCAGGCATTGATGGCTGTCTCTCATCTCCACTTT
GCATCCTGTTGTTGGGGTAAAAGAATAAGCTCACCGTCATTGCTCAGCTTCTCGAAATCGTGAAGAATGAATCGCCGAA
AATTGATTACATGTACTCACCAGGNACATGTAGGCAGCTTCATATTTCACTCCTCCGACGTCTCGGCTAGACTTAGCCA
TGTCGATCAAGCATGAGCAAATCCCACATTGTTAGCTGTCAATCATTGTCCAGTGTCATCTCCCCACGTGGCAAAGACG
GCGTCAATCAATTTGGACATCCCTGTGATATCTTAGACGCATCCTTGGCATCTTCTAAATGCTTAGAGTTTTGAGCTG
AAAATCGGTCATTAAAGTAACGC > SEQ ID NO:4426 215119FL 213184_300847_1c
tgaagatttgctttgttttctaagttcaggggGTGCAATTGAGTCTTCTAAAGCGTGCTGGTGCAACATTCAAGCTGAC
GTTGGATAAACCTTCAACCGTAACTCTTGTACCTCTCAAGACATCAGAATCAGATGATGGATGGATTGATGAACTGACC
TGCATCTGCCCACTCAACAATTTAATCCAGTCGAGCTTCTACAACGCCAATCTCAAAGCTCACAACTCTGTATTCACTC
ATCTTGACCAATTCTCTTTCAGTTTGACCTCAATCACTCTTTCCCTCATGAAGACCGACGACGCAGTGTCACAAACCAA
AAAAATAAAAAAA > SEQ ID NO:4427 215124FL 221193_300942_1c
GAACAAAGACACGCTGCCAGCATTGGGCAAAACAGCTTCAACGAGGGCAATTGCTGGGAGGAAAACGGCGTCAATTGGC
AGCAGGAGAG > SEQ ID NO:4428 215139FL 213212_300923_1c
gcaatgcttgagccaaaatattgcctaggggaggaaaccacaagagatagacctcggcaatttgttagcgATCCATGGA
TTGATTCCATGACTAGCTAAaCgAGGCTAgaTGACATGAGGCAGCGTGAGAGAGATGGATGGGACGAGATCTGGTGGGT
TTGGTTTGGGAGGCGGTTTGGAGGTTTGGGGATCATACAGTaGTACTAGTACTACAAGTGCTGATGATGCATAGATAAT
GTACTTGAGGGGCGATGAGATGCGATGCGATGCGACGCGGTGCACGCGTATGTCATCCATCAGCGGTGATGCCCTCTCA
GACGAGTACGGAGTCGGTACCAGACAGCAATCAAAATTGGCGGGTGTTGGCTCTGCTCTGGTttaaccactgccCCggc
atGTAcaactcct > SEQ ID NO:4429 215194FL 213339_300924_1c
ttcAGAGAATCATTTCTATAGTATTCGTCTCTTGCTTTGGTTCCCAAAAGAGCCATCGAATCCACCCTGGTTGATGATT
GTATATCCTCGATATCCAAGAGTGAATATTTTTGGTCCTCTCGAACCATCCGGAAGGATGGCGGTAGAAGCCTCGTGCA
TCTGCTGTATAGAGAGTTGTTTTTCTCTTGATGATCTCGACCCCGTCAATGGTCTGCCTTCGGGCGCATTGGCGGGGT
GGATGTCGATGGACGTCTGACAGGCTTTTTTTTCATTACATTTCTGAGGCTTGCCTTGGATGTGAAGAAGAGTGGAAT
TCACATTCCAATTTTTTCTTTCTTTTCTCCTACGCCGCTGTGTTGGAAAATGTTGCCTCGTCCACAAAGAGTTTCGATA
CAGGCCTTGGCGATGCTTCTTCATCCAATGGCGTGTCCCTGGCCAGCATTCCCTCGCTTTTTGATCCATAGAACCTAT
AGAACTAGGTGAATCGCAAGAAGATCAAGCCGATGATCCAATGAATGCGACGGTGAGGAAATCGCCCGGCTCTCTGGCT
AATTtgtgATGCTCTAAATATTCATCGTAATACGCGATGCgaggcCATCTCTGGTATGta

FIG. 2 continued

> SEQ ID NO:4430 215270FL 219840_300949_2c
GCATCTGCAACATGCAACATGTGCCTGCTGCGCTCGATAGAGCCGACGAACCGGAATATTTGCCATTCAGGCAAACAAA
GATAGCTTCCCCACGCGTTAAGAGATTGCAGCCGCGCTACCAGGCCCTCCCAAAGCTTGCAAGCACTCCGTAGAGACCC
GTAAACGGAGATGGCACCTCCCGCTCCGTGAGCGATTTCGGGGAGGGGGAGGGGACCAAAGATCATGGGGGAGGCTTTT
TATTCTATCGACTCTCGGGAAGCATCTGCTCTCATCATCCCATTATCGGCAGCAAAGCAGCCAAGAGCCCCCACCAGAC
GGCCAGAAACTCGGGGTCAGCCCTGGCAACCTGGCTCGATTTCTGTCCTTGTGTGGGCGTGGGCGCGTGGGCGAAGATG
TTTTGAGTGATGGATGAGAATTAGGAAGAGACCANGGAGAGCAACCAATAAGAATCTGACGATAAGCAGCCCTGCTGTG
TGGCGGCTAGTGTGAGCCTTTTGGGCACATGTTTGGAGATTCTTGCGCGCCCTTGTACTTGTACTCCGTAGTTTTGAAT
GGACTCGGGTACAGTACGGAGCTGATGTCGTGATGTTTCTAAATTAGATAGGAGACGGGCAGACTAAAAA

> SEQ ID NO:4431 215296FL 212163_300874_1c
GGATTAATCGCAACTCCGAGATCCTGCTGAATCACAATGAGACCTACTCAGGTTCGTCTGGGCGGCGGCGCCCCTCAAC
CCAAGACTGGCCACTGGCTCGGTGACTGGGGCTCCTTTGGTGAGTGTGCTCTACTTGACGAACGATTGCATCAGACCAC
CCGCGAAAGAGACTTTGAGGACGCAAGGAACCGGATGGTGGAGGGAAGATGAGGACGATTCAATGGGCGATATCTTGA
TTCAGCTGGAGCAATTGAGGCGGAAGACATTGAACACGCTACGGAGCAACAATTGGATCAGGAATTGCGTCGAAGGACC
CGTCGGGACGAACTACAAAGATTGAAGGAGTCACTCGCATGCTAACATATGATGCTATAGGTGGTGCCAAGCAGAAGGG
CATTATCGACTACGGCCTGTCTGCCAACCGTCAGAACCCCTTTGCCGGTGCTGCCCACGATGCCATCTTCAACACCTTC
CGCCGCACCAAGTCCCAGATCTTCTACTGGCTCCCTCCTATGCTGGCTGGCTACTACCTGCTGAGCTGGGCCACcGAGc
GAAAccActacctCAACTCCAaggctGgccgtgCTGAGtttgccgaCTCGgagtaaAATGgtGcacGAATATG > SEQ ID NO:4432 215296FL 215383_300880_1c
GAAAAAGGATTAATCGCAACTCCGAGaTcgtggtGAATCACAATGAGACCTACTCAGGTTCGTCTGGGCGGCGGCGCCC
CTCAACCCAAGACTGGCCACTGGCTCGGTGACTGGGGCTCCTTTGAAGGGCATTATCGACTACGGCCTGTCTGCCAACC
GTCAGAACCCCTTTGCCGGTGCTGCCCACGATGCCATCTTCAACACCTTCCGCCGCACCAAGTCCCAGATCTTCTACTG
GCTCCCTCCTATGCTGGCTGGCTACTACCTGCTGAGCTGGGCCACCGAGCGAAACCACTACCTCAACTCCAAGGCTGGC
CGTGCTGAGTTTGCCGACTCGGAGTAAAATGGTGCACGAATATGTTGAATTATGGGTGTCCAGGGGACACAGTGTATAT
CAGCGTCTAGATTAGGAGAAAACAATAGAAACGTTTGACTTTAAAAaaAAAaaataa > SEQ ID NO:4433 215296FL 215303_300880_1c
GAAAAAGGATTAATCGCAACTCCGAGATCCTGCTGAATCACAATGAGACCTACTCAGGTTCGTCTGGGCGGCGGCGCCC
CTCAACCCAAGACTGGCCACTGGCTCGGTGACTGGGGCTCCTTTGGTGGTGCCAAGCAGAAGGGCATTATCGACTACGG
CCTGTCTGCCAACCGTCAGAACCCCTTTGCCGGTGCTGCCCACGATGCCATCTTCAACACCTTCCGCCGCACCAAGTCC
CAGATCTTCTACTGGCTCCCTCCTATGCTGGCTGGCTACTACCTGCTGAGCTGGGCCACCGAGCGAAACCACTACCTCA
ACTCCAAGGCTGGCCGTGCTGAGTTTGCCGACTCGGAGTAAAATGGTGCACGAATATGTTGAATTATGGGTGTCCAGGG
GACACAGTGTATATCAGCGTCTAGATTAGGAGAAAACAATAGAAACGTTTGACTCTACGAGATATTTGATTCTGTTCTT
CGTCAAGAGATTGATACACTAATTTGACgaaaacacaAAagaaA > SEQ ID NO:4434 215373FL 195472_300634_1c
gctgcattttggggtcgcAAATCTACAGCAAAAATGGCCTCGACAACGACCAAGCAGACCCCGGCGTCCTTTGTCGGGA
CCAGCAAGGTCGTCGAGACTGACTATCCGCTCATCGACAACGACCCTCACTTTAAGCGGGTTATCGGATATGCGAGAAC
GTCAGACTACGTAGCTGGTGCAACCTCTGCGGCCTTTGCACCGACTGCTCTCTATGCCCTCGAGAGGCTCGCCCCGTCG
CATGTTGGCCGGGGAGGCTTTGCCAAAGCCATGCGGTTAGCCGGATTCATTGGCTTGGCCGGCGTTTCCTCTACTTTT
ACCAGCGATCAGCCCTTCGATTCTACGGCGCCACTGAGAACTCAAGGGAAGTCGAGATGGATATGCGAGAGATGGTTTC
CAAGGTCAAGGCGGGACAGCCTCTGTATGGCGAGAGCAAGCTGAGCCCTCACCTGCAGGGAGTTGCGGCCCGACAGAGC
AGATACTCTGCGCTCTTTTTCAGCACAGTACCGTGGTTCAACTTTGTCAACCACAACCAGCACGGCGTGGACACGGCCA
AGTACTATCAGCAGGCCGAGAGGGAACTGGAAGCAGAGCGGGCGGCGGGCAAGAGCTAGACGGgacCAAATGTGTATAT
TTAGCGGGACTACCgctTCTTGcgg > SEQ ID NO:4435 215459FL 199838_300753_1c
CCCACGCGTCCGCACAACTCAACCACACTTTCAACTCTCAACTACACCACAACTTACAATCTCATCTCGCGACCAACCA
ACTTTCACAATGGAGACTGTCAAGCAAGCCGTCAACTACGTCGCTGAGTCCGTCCAGGGCGCTGCCTCTGGTATCAGCA
AGGAGACCAACAAGGAGATTGCCAAGGACAGCAACGTCGACGTTTCCACTCGTTTGTCCGCTGGCAAGGACGCCCTTGG
TGACAAGATCGACGAGACTGGCCACAACAACAAGGCCGAGGCTCACAAGCAGCTGGCTGAGCACAACTAGATTGGCATA
AGGAGCTTCGATTGCTTCACAGGCGTTGAACCGGATCAGAGCGAAGGGAATATATAGCCTCACTAGGCAGGAATTGATG
ATTTGAATTCGCAC

FIG. 2 continued

> SEQ ID NO:4436 215459FL 218779_300921_1c
TCGACCCACGCGTCCGAAACAATCTCAGATCTTCATCTCAACTTTCAATCTTCCACACAAGCAAATAACCAACCAACCA
ACCAATCACAATGGATTCCATCAAGCAGGGCGCCAACTACGTCGGTGAGAAGGTTCAGCAGGCCACCTCTGGTGCCTCC
AAGGAGACCAACAAGCAGGTCGCCAAGGACTCCGATGCCTCTGTCGGCACTCGTGCCTCCGCTGCCAAGGACGCTCTCG
GTGACAAGATGGACGAGTCCAAGCACGACGCCAAGGGCGAGGCCCACAAGCAGGCCATCTAAATGGACTGAGTGAGAGG
GAACGATGACAACACTTTTGCTTCTACCCCGTCTTGAGAGACAAATAGTCGATACCCCTATGAGAACTCAATAATACAA
CTTTTTCAGCCGAAAAAAAaaagaaaa > SEQ ID NO:4437 215575FL 206782_300825_1c
GCCCCGGCCGTTCTGGCATTGCCGGCCTCTGATGCCGCATTGACCAGACGCCAGACCAGCCTCTCAACCATCACAGACC
AATATCTCTTCACCAGCGTTGCCATCAAAGTAAAAGGCTCTATCCCCTCATCATGAAGTTTGCAGCTCTTCTGGCCACT
CTTGCCCCGGCCGTTCTGGCATTGCCGGCCTCTGATGCCGCATTGACCAGACGCCAGACCAGCCTCTCAACCATCACAG
ACCAATATCTCTTCAGCCTCACTCTCCCTGATTTCATTTCCCGCCGCAATGCCAAGAACCCAGCCACCCTTGACTGGAC
GTCTGACGGCTGCACCAGCTCACCCGATAACCCTTTTGGATTCCCTTTTGTTCCTGCTTGCTACCGCCACGACTTTGGC
TACCAAAACTACCGCATCCAAAACCGATTCACAGAGAGCGGCAAGCTCAGCATCGATAACAACTTCAAGGCCGATCTAT
ACTTCCAGTGCCAGACATCGAGTGTCCAAAGCGTTTGCAATGCTCTTGCTGATGTTTACTACGCTGCTGTGAGAGCGTT
CGGAGGCGGCGATGCTTCTCCTGGAAAGCGCGAACAATCACAAGAGGACTTGGTTAAGGTGTATGAAGAGAAGCTGGAG
ATTTACAACAACGCCGTGAAGGATGCCCAGGACAAGGGACTGCTGCCCATCTTGGAGTAAGGGGATAAAGCGTACTGCA
TACTTTTATATGATTGACGATACCAAATATGAAATAAAATTCTTCTACATG > SEQ ID NO:4438 215595FL 211010_300895_1c
tcAGCTCACACTCTCCAGGCTCACACAAAACTCACTACAATAAAAACACAATCTTCAATTCTTTGAACCTTTTTCAAGT
TTCGCCAACATGAAGTTCACCACTACTGCCGTTCTTGCCATTGCCGCATTCGTTGAATCGGCCACTGCTCTGGGCAAGG
CCCGTGTCGTCAACAAGTGCCCCTTCAGCGTCACCACCTGGTCCGTTGGCAGCGCCATCTCCAACCCAACAACCCTTGC
TCAAGGCGGTTCCTATGGCGAGACCTTCTCACGAGACCCCGTAACCGGCGGTCGTGCCATCAAGGTCACCGTCCAGCCC
GATGGCCTCTACACTGGCAAGCCCCAGACCAACTTCGCCATCAACCTTGAGGGCAACACCATCTGGTACGATCTTTCAG
ATGTCTTTGGCGATGCCTTCAACGGCCACAAGGTCGTTGTTTCCAGCGCCAACACTGCTTGCCCCAGATTGTTTGGGG
CAGCGGAATCCCTCCTGCCGGAAGCCAGGTCAAGAACTGCGGTGCGGATAAGGATGTGACTTTGACTCTGTGTGCTTAG
AGTTAAGGGAGGACGGAATCATGTCAAGGGAAAGGTTTAAATCAAGTTTATGATAGAATTTCAAGTCCTAGCTATGTTT
AAGACTTATGACAGTATGAATTGATGAGTTTACTGC > SEQ ID NO:4439 215642FL 208015_300831_1c
TCTCATCCACCTCGTCCATCTCATCCTTTTGCTTCCAGCAGCTATCAAGACTTGACTTAAAAAAACCAGTCCTCATAAA
GACATCTACAATCAGTCACCATGCAGATCACCAAGAGCCTCATCGCTACCCTCTTTGCCGCTTCGACCGCCTTTGCGGC
TCCCACTCCTGCGGACAAGTCCATGATGGCCGCTGTCCCTGAGTGGACAATCACCAACCTGAAGAGAGTGTGCAACTCC
GGCAATACCTCCTGCACATGGACCTTTGGCGTCGATACACATCTCGCCACTGCCACCTCATGCACATACACCGTCAAGG
CTACCGCCAACGCTTCTCAGGCCACCGGCGGCCCCGTTACTTGCGGCCCTTACACTATCACATCCAGCTGGAGCGGCCA
GTTTGGCCCTAACAACGGCTTCACTACCTTTGCTGTTACCGACTTTTCGAAGAAGCTCATCACCTGGCCTGCCTATACC
GATGTTCAAGTTCAGGGCGGCAAGGTTGTTTCGCCCAACCAGAGCTACGCCCCGACCAACCTGCCATAGATGGAATGAA
TTTGCTTGGAATTACTATACGCAAGGTCAATTTACTCCCAAAGGAACAGCTGGTGATAATTGGAAACGACAATGAATCA
GGCGAGGGGGGATACGTACCACAAAATTTAATGTAATAGATGATTGACTATGATAATACACTATTGATTAATGCGTCTc > SEQ ID NO:4440 215667FL 205766_300922_1c
TGGATAATTGACCGTTGATACTGATTATTCGCCTGAGTAACAAATTCTACCTACATTTACTGCCTGCCCTCTCCTATTT
CGCCATCGAAAAGGCCCGTCTGTTGTCGCCGCCGAAGCAGTTAGCAGGGGGTCATACGCTAAACCACCCCTCCTCCTC
TTTAACGACCACCTCCTCTCTTCTCTCACTCTCCACCTCCTCCTCTCCATCAAACATCTCGACTCCCTACAGCCAAA
AGCTTCTCTCATGTCCGACTACGCTCCTCCCACAGGGCCTCCGCCGCCCAAGGCCCCCGAAGTTCCCGCTGGCTGGGCC
GCCCGGTGGAACGACCAATACAAAGAATGGTTCTACGTAAATATCTACACCAAAAAGTCCCAATGGGACAAGCCCACCA
GTCCTGTCTTCCCTGACGGAGACGCCCCGCTTCCGGGCCTCCCCAGGCTATGACGGCCACAACGCTCCCCGCACGTC
CGATGCCAAGACGAACCCCTATGGCGATCAGAGCAACAACTTTGGAGGCTCATCATCAAGGCAGACGCAGGAAGACG > SEQ ID NO:4441 215669FL 195810_300638_1c
cagatcattaCAATCAAACTCTTAATCTCTATTCTTAAATACATCTACCTCTCACAATGGATTTCGTCAACAAGGCTAT
GGGCAAGGAGGAGCGCTCCACTCAGGGCACCGCTCCCGCTGCTCCCCAAGCAGGCGGCCAGGTCCAGAAGGACGATTAC
GTCGACAAGGCTTTCGCCATGGGTGCCAAAAAGAGCGGCCACAACATGGATCGCAACACACAGGAGAAGATTACGGATG
CAGGCCGTAACATGTACGAGAAGGTGACAGGAAACAAGGTCGACCCCAAGTGGTCTAATTAATGAACGGACGAGTTATG
ACTCACAACAAGACTGTACAATAGTAATAATAACATCTTATCAACGCTGTCTGTTCCT

FIG. 2 continued

> SEQ ID NO:4442 215670FL 210675_300891_1c
AAATTCGAGGTGTTTTAGACGCAAGCTTCTCTTTTACACACTGAAGCTGCTGCTGCAACCATCACCAACATACCACACG
CAACAACACAACACCACCACGTAATAACGAGCAGAACACCCCTCGCTTGAACTTGTTGCAAAAAACACTCTCGCCTCTA
TTTCATAAATCAAATTACACACGAACAAAACAATGAATCCAACAGTCAGAGGCTTCTCAACCGCCGCAAGAGTGCACCC
GCCCTTTTGCCACATCTCCGCCCATCGCCGCGCCGAGCCCCGATCCGACGCTGGCTAAAAACTGCCGCCGTCATCACC
GCCGTCGGATACGCCTCAAAGACCTACCTCGACGCCACCCGCGCCCAGCGCCGCGAAACCGCCCTCGCACTTGAACATG
ATTCCGCCGAGAGGCAGCGCATGATGGAGAATTTGTATGGTGGGAGGGAGAGCTTGGAGGATTTGGAGAAGGGGGTTGC
TGAGTATGGCAAGCGGTAATCACCGAAGGAAAaacaaaAAAAAACGACAACAGACGGAaaaAaaaacttgaAGTAAAtT
caaGGGGTATTATTACACCAAAAGCGGCGAGGCATTTGGGGGGATTTGCATCAGGgctGATGGTGCCCTTGAGCGAAGC
atacatGGGAg > SEQ ID NO:4443 215680FL 211825_300871_1c
gatcctcaatgggcagatctgtgtgagagttggggtatataaagacatctgtctctgccccggatcctgacttttctc
cAGCATCACCCCAGCAAGCATTCGCCTCTCGTTCAGATCTCAAGACAAAAAGCACTCAAACCAATCACTCAACCTCTTC
AAGACCACCTTTCAAAACAAACCTTCAACATGAAGTTCACCGCCGTTGCCTTTGCCGCCCTCGCTACTCTGGCTACAGC
CAGCCCTCACCCTCCTCCTCCTCACGGTTGCAAGCCTGCTACCTACTCTTGCCTTCCCAACGACAGCGGTTGGCAAGTG
TGCAGCACTGCCGGTCAGTGGGTGTTTGCTGGCACCTGCCCTCCCAAGACTGTCTGCAAGTTCGACAGCCAAAATGGCA
GCCCCTACTGCGTTCCCCCCAACTTCACCATCCCATAAATCCATTAAATGGGGATCAACGGGGCTACTTACAAAAGCCT
ACCGGATGAGCATGAGATTTAGAGTTTTTGGTTGCTAAGACGTTTCGTGG > SEQ ID NO:4444 215680FL 212806_300844_1c
TACTCTTGCCTTCCCAACGACAGCGGTGGGCAAGTGTGCAGCACTGTCGGTCAGTGGGTGTTGGCTGGCACCTGCCCTC
CCAAGACTGTGTG > SEQ ID NO:4445 215716FL 214687_300863_1c
ATCGCACTGAGACTCCCCCATCGCTGACGCAAGATGGCTTCTCAGGCGGCAGCAAAGGCTGCTGGAGGCGTTGTTTCCA
TTGCAAAGAAACAAACCCTCCAGTCCACCGGCTTGTGGGAGACCTTCCGCAAGGCCTTCGCCCTCGACCCCAATCGCTC
CAACGGCGTCCCCCTGAACCCTTACTTCCGAAACCCGACGCCCGGAGCCTTGGACCCCCTCAGCTTCGACGACCCCGTC
ACTCTTCCCGCTGGCGACATTGCCGACAACGCCTACTGGAAGCGTGATGTCCGTCGCGCGTACCCGCAGCTCAGCGTCG
TTACGCAGGGCGACGCCGTGTCGTTGTTGACGGTTGGAAGCGCCGCACAGCCCAAGGTCGAGCTGATTGGCGAGGCCGG
CGAGAAGGCTCTCGTTGCGGCGCAGAAGGAGGGCGAGACGACGGGCCTGGCCAAGTTCCTGGAGAAGGCGCCCAAGGAT
GTGGCAAAGGACGTGTTCGTCAATGGATTGCCTCCGCTGCCGAGCGGACAGGCCCTGGAGGCTGGAGGATGGGATGTGC
ACAAGTACGAGCTCAATGAGGATCAGACATATGGTGAAGGCTATCCTACCAGGACGTTCAAATAAGACGGGCAATAGGG
TCGACTTGTGtAAATAcAgAt > SEQ ID NO:4446 215730FL 219961_300950_1c
ACAGCAGCCATGAGGTACATTCACTCTCAGGAGATCCTGGAAATTCCAGAGGGCGTCAAGGTCAACATCAAGACCCGTA
TCGTCACCGTTGAGGGTCCCCGAGGCAAGCTCACCAAGAACCTCGGTCACTTGGCTGTCAACTTCGGTCACCCCAAGAA
GAACACCATCTCCATCGAGATCCACCACGGCAACCGTAAGAATGTCGCCACTCTCCGTACCGTCCGCTCCATCATCGAG
AACTTGATCACCGGTGTCACCAAGGGCTTCAAGTACAAGATGCGATACGTCTACGCCCATTTTCCCATCAACGTCAACC
TGGACAAGAACAAGGAGACCGGTCTGTTCGAGGTGGAGATCCGAAACTTCATCGGCGAGAAGATCGTCCGACGGGTTAC
CATGCACGAGGGTGTCGATGTTGAGATCTCCAAGGCCCAGAAGGATGAGCTCATCCTGACCGGCAACTCACTCGAGAAC
GTTTCCCAGAGCGCCGCAGATATCCAGCAGATCTGCCGGGTGCGCAACAAGGATATCCGAAAGTTCTTGGACGGTCTGT
ACGTTTCCGAGAAGGGCAACGTTGTTGAGGAGGCTTAAATGTACCGGACAAGGATCTCTGTTTCTTTTGCGTTtcTGGG
ACTCCGGAGTGGCgaaggTTCATCATTGCATGTCACGTAGCAACGGGGCTACTCTTTTACAAAAAATACATTAAAAAGT
AttttgtaacaaaaaaaaaaaA > SEQ ID NO:4447 215772FL 199814_300753_1c
CCCACGCGTCCGCCCACGCGATCCGGGGGGGAATTGAACGGGGGTGAGGGCTTTATGAGAGAGGCGAGCTTTCGTACG
AGCCTTCGGATCAGATAAGATCAGGTCGGGCTGGTGACAGGCAGCCACGGCCCACCAGGGTCCGCCATAGGCGTACAAC
GACCCCGTAAGATCCCAGTAATGGCTCATTAATTGCTCCTGCTGTGGCTGGCATGATCATCGTCACATGGCCGGGTTTG
GGCGACTAAAATTAGCGGGCTGTGCCAGCAGGATGAGACCAAGACGGCAGAGGAGCACGGCCGAGAAGG > SEQ ID NO:4448 215781FL 199752_300752_1c
gttgccgccgtcaagggagccctgcggtctggccgtcaggtcctggccattgtccgcaaccaggcctctgctgataagc
tCTACAAGCACGTCGGGTCATCCCAgggcatCCAGGTTGTCGAGGCCAGTGTCGTGTCTGACACGGGGGTCAAGGGCGT
CGTCGaccaggTTAAGGCCGGGAAGCTGcCAGCCTTCCAGCacgtttacACCTGCGTTGGTGGCGAGTATACCGACGTT
CCACTTAAGGACATCACCACCGAGAGGCTCCGCAAGAACATTAACATGGCCTTTGAGTCCAACTTCTTCGCTTACCGTG

FIG. 2 continued

```
ACACCATCGAGtatCtTTATAAGCAGAACCACCCTAACAGCACATGGACTATCTGTACTGGCTCCcagggtGATGaggC
TATGTttgcccTaccTGCCATgggccaAGGCCCTCTCTTCTCCATGGCCACTGCCGCCGCCCGTGAGAACGAGAAGACC
AACGTCCgcgtaaacGAGGTGTATCTGATGTtCCGCGttgaggttgacgaGGCTGCCAAGGaGcATGGCGTCTCAAGCA
GCTCCGAAttcGCCtccgtctaCGaaggatttctgaacaacCCTGAGaTCCgcagctCGCGcgttcgtgttgccTCGCC
TGCTGACTTCACCGACCTGAAGTGGGCTAAGAAGTTCTaAAAAGACTGATGCGTCTTTTTTaaACCTTCGTGtttTCTCT
CCAtTAAGCATtttgaGaaatcaTCTCCCtgttgCTGGCTGAtTACACATGGTTcagtagttgACAatactg > SEQ ID NO:4449 215803FL 212375_300848_1c
gAAGAGGGACTGTACTGTACAGTAACTGTACCTTATGCAATTGTGCAGGATTATGTCTCTGCTGTAATGTATCTGCGGA
CGTATCTGCGGATGCCGGGGATGGACTCCGGTGTACTTGGCACGGCTCGCTTCCGTTTGACATAAAAATGCAGTGTAAC
AGGTAGATGGACGTACATGTAGATGTAAATGCGGTACT > SEQ ID NO:4450 215806FL 212915_300845_1c
CCCACGCGTCCGCCCACGCGTCCGCCCACGCGTCCGCATCAAAGAACAAACGCATCGTTCAAGATGAGAGCCAAATGGA
GGAAGAAGCGCGTTCGTCGCCTTAAGCGCAAGAGAAGAAAGATGAGGGCTCGCTCCAAATAAACGACTCGCTCTACCAC
TTGACTTGACACATCTTTCACATTTTGAATGAGTTCACGATAAAACACGACAAGCAAAGCTGCTGCACCACGGTACCAC
TCTATGACCGATTACAGCCATCAAGTTGGAATCAGCATATTGGTGCGCCTCTCCAATTCAGCTACGGGAGTCAATGGAC
GAACGCGAGAGATGAGGACTGGACAATTTCAGTCAGGTGGAGACATCGTTTTGAGGACGCGAAGGCCATGAAGCAAAAC
GCTGCTGCAAGAAGCACGCTTAGGATCGATACGTTGCTTGACAAAGATCAAAGGCAGAATTTACTTCATTTCCAAACCA
AAAAG > SEQ ID NO:4451 215813FL 200512_300853_1c
GTCGACACGCGTGTTTTGGAGTAGTTGCTGAATGCTATGGTTGGTTTATATCAATATGATGAGTTTCAGATTAGTTCAC
AAAGGTTCTTTATGGCTCTTTTAAGGATGGGAAGCCGCAGAGAGTCGTGATCCTTTCAAAACCCAAGGCGTCGCACGTC
CGACGCTGTGTCTGAGCAAACATTGTTCACCCTTCAAGTTTCCACTACAACCTCGACCGGTACCACCATGAGCGGCATA
GAAAAGCGCATGTGGCTTGGACACCTCAACAAGGACCTGGGGCCCATTCCGAGGCcagaaATCCCATTCGCCCtcgtct
GGCttgtttaacgccttgcaggggGGgaGagGGGAAGCTGAGCATGGGAGAGGGagacggAAAGaaacaAAAAGCAAA
CAtattTGATCATCATGC > SEQ ID NO:4452 215825FL 200446_300759_1c
ggTAGCATTAGCTGGAATTTTGTTCATGCATCTGGCCCAGCAACAAGGTGAGAAGAGAAaGACACGATACGGATTTGCA
AGTCGGTCTTCGAGATCTACTCTGCTAggAGACAACATCTTGCTCGGCTTTTAGAATTCTGACATGTCTTGCCGTGGTG
AAACGCTCATCCTCCAGGTTAGGTGCTAGACAATAAACctcgACGGGATCTTCGAGTCATGATGACGCACGGCAAGGCC
TCCGACCTTCCTATCGAAACCTGGAAGCCTGGTCTTCTTTTGATACGAGCAAGATGTACTGTACATCGTAATCAATATA
GCTGGCAGAGTATGGACCTGGAAAGATTggcgaTGCCTCCAGACTCCAGATCGAATAACCAAATTCTTCGTCagaagtt
gccacagctgcacggtcCctcgCGCCCTCTAATcaagagAGTCAGCTACTCaactcagatAGGGCAACATATCCCAATA
AACCTCtgcaataggcaggaggAGATGCGTAATATACTAATaatGGAac > SEQ ID NO:4453 215825FL 211258_300897_1c
GTACATCTTGCTCGTATCAAAAGAAGACCAGGCTTCCAGGTTTCGATAGGAAGGTCGGAGGCCTtgcCGTGCGTCATCA
TGACTCGAAGATCCCGTCGAGGTTTATTGTCTAGCACCTAACCTGGAGGATGAGCGTTTCACCACGGCAAGACATGTCA
GAATTCTAAAAGCCGAGCAAGATGTTGTCTCCTAgcagAGTAGATCTCGAAGCTAACTTGATCAGAGACTGGTCTTACA
CTAGGTGACCGCTGCGAGTGTCTTGAGTCAACAGGAAAAAAATCCGCGAAGGAAAAAAAAGAAAGGAGTGAACTCACACC
GACTTGCAAATCCGTATCGTGTCTTTCTCTTCTCACCTTGTTGCTGGGCCAGATGCATGAACAAAATTCCAGCTAATGC
TACAGTAAGGAGACACTAGCCGCGACTGcaaggAGAAAGCTCTagcTCGCTTGCACAAGACCCTCTTTCATGACAGCTA
GACGCCCGCGCCAGTGGACGGCTCTGACTTGAAGTTCTCTGAAGGATGACAAATGATGGACTTGagatctGgccacG > SEQ ID NO:4454 215827FL 161037_200169_1c
TGGACAAGCTGATTCATGTGTTGTGACAAGAAGCAACTTCAACCACTTATATTGGACAATTACTCAACAACTAGCACAC
CATACTATCAATGGTTGCAACCTAAGGCCTCGGGGACCTGTTTGGAACTGGAACTATCAGTGGACCAGAACCAGAATCCT
ATGGATGCTTGCTTGAATTGACATGGAATGGACAAAAACCTCTGTCTTTTGGTGGAACTCACCCGTACATTCTTAGAAGA
TGGAGATGAAGTAACTTTCTTTGGTTATTGTCAGGGCAATGGATACAAAGTTGGTTTTGGAAGATGCTCTGGGAAGATT
GTCCCGGCTCCACAATGAGCATGACTTACTACATTGCCCTGCCCATGAGCAATGGGGAAATGTTGCCTGTTGTATACAA
TAATTCcAAGCTTGGTTTCTGATCAAAATTAGGAGTAGAATCAGAAGAAATCGTGGAAAACTCTTGgCtaggACAAGTG
AGAGCATTATGTATTCTACATTATTTTACTGCaaAcAAGTaccaattcatgTtGAAA > SEQ ID NO:4455 215827FL 190035_300615_1c
CTAATGATAATGAATGATTGGAGTGCCAGAGATATCCAAGCTTGGGAAACTATACCTCTTGGACCTTTCCTTGGGAAAA
```

```
GTTTCAGTACCACAGTATCACCCTGGATCGTTACTATGGATGCCCTAAAGCCTTTCACCTGTGAAGCTCCTAAGCAGGA
ACCTGAACCTTTGCCTTACTTAGCTGAAAAGAACCACGTAAACTACGATATTCCTCTTGAGGTCTGGATTAAGCCCAAG
GAGCAAAGTGAACCATCAATGGTTGCAAAGAGTAACTTCAAGCATCTGTATTGGACTTTAACACAGCAACTAGCACACC
ACACTGTTAATGGATGCAATCTGAGACCAGGGGATATGTTTGCAACTGGCACACTAAGCGGACCTGAGACAGAATCTTT
GGGATGTTTGCTGGAGCTAACATGGAATGGGCAGAAGGAGATATCAGTTGGAAACTCGACCCGCAAGTTCCTAGAAGAT
GGGGATGAGGTCATCTTGACAGCTTG

> SEQ ID NO:4456 215827FL 200207_300757_1c
GGCGTGGGAATATGTGCCCCTCGGACCGTTCAACGGAAAGAACTTTGGCTCAACTATCAGCCCTTGGGTTGTTGTCGCG
GATGCGCTGGAGCCCTTCCGAGCCCAGCCGCTGCCGAATGATACCCCTGTTCAGGATTATCTCAAGGAGTCACAGAAGG
AGAGCGTGTTTGACATTCAGCTTGAAGTCGGCCTTACAACTGCGGATGGCGACCATGTCGACCTGTCCAAGACAAGCGG
CCGAAATCTGCTCTGGTCCTTCCCGCAGATGATAACGCACCATACCGTTGGCGGATGTCCTCTCAGGGCCGGAGATTTG
TTGGGCTCGGGAACCATTAGCGGCTCAGAGCCTCGGGAACGTGGTAGCTTGCTTGAAATGACCGAGGGCGGCAAGGTCG
ATGTTCAGCTCGAAAAGGGCGGGGTGCGTCGCTTCATCCAAGACGGTGACAGCCTGAACATGCGAGGATACTGCGAGAA
GAACGGAGTGCGGATCGGGTTTGGCGACTGTGAGGGCACGATTCTGCCTGCTCACGGGGCGTAAAATTTGGGAGGGGAC
AACGGCATAATGAGAAATGTAACCAAAATATCCATTAGATGAAATCAAAAACAGAAGCCAAGAGCTCTTTGGGG

> SEQ ID NO:4457 215830FL 200255_300757_1c
CCCAGCAGCGTCACTATCTCCTGACCATGCGGCCACTTTTGTTTTATTACCCGAGAGAGCAAAAGTCGTCCCATCCCAT

> SEQ ID NO:4458 215852FL 204334_300792_1c
GCCCACGCGTCGGCTAATACATGGCTCTTTCCCGCTCAGATACGTTTACAGTAGCAGGTACTGCCTACCAGGACTTTAC
TTGCTTTTGGCAACTTGGGTAGGCCACGGCTGTCATGAAGGCGCATCTAATCCGTACATTAGCGGTGATACCCTGCGCA
CCTGTATTTTGACATCCCGCGTGATGCGGGATTCCAGAGCCGTTTCCAACGGCCTTTTGGGCATTGATATTTAGTTTTC
GATATGAGAGCTAGTACTTGCAGATGAACAACCATGAAGCACTATTGCGGCACTAGCAACAGGATTGCATTGACATCGA
CTCAATATGTAGCAAAG

> SEQ ID NO:4459 215872FL 214746_300864_1c
tcgcgatctagaactAGTCCGGGTTTACATTGATAAGTGACGGATATGCATCCCGAAAATGACAAATTTGTAAGCATGT
CACTGCCGGCAAAGAACCCTGAATGCTCTAGATGCTTCCGAAGGATTCTCCATAAGATGATATCCCATGCAGTTTGTGC
CAAAATGGGTTAACGGACGCCCGATTCCGTGGGTGTGCATTTGATTGAGACCCCCATGTTTGCAGTGAATCGGTTGGGT
AAGATGCATTGGAGAGGATGTACGTAGGAGGTTCATTTATTGCTGCTCTTATTTTCCATGTTATTATTTAAATACATGA
TCATATTCACATATTTACATTTGAGTTGAGTGCATCTGCTATGAATGTTTCTAGAACCATCCTTAGCAGCTACATCATT
ACGACATATAGTGGTGGTccctctgattcactttcatacacaccctgaacgacacatcttctacacttattaggaaaca
aaaaaagcggacgcgtggg > SEQ ID NO:4460 215880FL 204393_300792_1c
gcATCGACAATGGCATCCCTGCTGCGCACGCTCTCTCTGGCCGCAGGGCTTTTGCGCTCTTCTCAGGTTGTCAAGCCGT
TTGCGGCTGGCAGCTTTGCGACGGCAACGAGCAGCCCGGCTTCCTCGTGGATGGGATGGTTGTCCAAGCCCGCAGTTGG
AGGGACCCTGCAGCAGACGCGGGGCATGAAGGTTCACAGCTCGGTCAAGAAGAGGTGTGAGCACTGCAAGGTTGTTCGA
CGAAAGGCCGGCAAGCGACACAACGGATACCTGTACATTATCTGCAAGGCCAACCCTCGACACAAGCAGCGACAGAGCT
AAGGCGACTGCGAGGATGGTTCTTCTCTTTTTGACGACGATGACGACGATGACACCCGGATGAGTGGGCATTCTGTAT
ATTATTGGCGTATAAAGGGTGACGAAAGGGAGCGACGAACAAACACACACAACGGTCTGGCAAAAAGCAATTGATAGAC
GATACTACGGCAATGGGCTTCGAAGACGTGGAGGACATGACACGAGCCCAAGTGCGAGCTTTCTTGCATGCTCGAGAAA
TGACGGTTCagagtGCCGTCGTAAAAATGTAcaaTTTTATGTAGtgttAcATACCCCCGATATAcctctc > SEQ ID NO:4461 215885FL 204322_300792_1c
GTAATTGACTACTATGTGGGCATTCAATAACTCAGTCACATGCCAAAGACCTCCCCATCCATTGCATCTCCCTCAGTGA
AGAACAAAGCAGTTAGTTGTTGGCACTTTGTTCACCCATCAACAAAAAATTTCTTGCTCCAGGAATTGAAAGCCCTAAA
GGGAAAAAAAAATTCAACAGCCGCGCATATAGCTCGTGACTCGACCACAACGTGAGCTAGTCATACGATAAAGCTGGG
GAACCAACAACGTGGGCAGATTTCCCCCCAGGACTCGGCCCACTTCCCCAGACTCCTCCAGACTCCTCCGCAGAGTGGA
AGATGCATGTTTCTTCCAGGTTCTGTGCCGAAATAAGCCTCTGGTATACTTAATGGCAGATGTCGAGCTCGCACAATGC
AGTAAAGTAATACCGAGCTCGCCAAAGCCCTCCAAAGCGGCATCATTGGGCGAACTCGGCTATATGTCTACGTGTTGGA
TAGAATAGAGTGACAAGTCACGATCAATAGTACTTTTTACAATGC
```

FIG. 2 continued

> SEQ ID NO:4462 215888FL 204494_300817_1c
ATGGATTTGAGACACCAGGAAATGCAATGGACCTGTCTCTCGCTACTCTGCTGGTTAATTTCTGACTCTGGCGCTAATA
CACAACGACGATGGCGATGCTTTTTCCATACCCCATAGACCCGCTAGTCCCATCTGACATTACTCGACGATCAGCACAT
GTCGACCATCATATCCGCGCATTTGGGCTGGTACGGGGATATTTAGATGCCAAGGGCGAGCCTAAATGTTGAGCTGGTT
GACCAACGCTGCTTGTGACCAACAAGGAGCATGAGTTGGCCTCGTCAGCATTGCTCCCGCCAGAAATCTTTTACAACAC
AATACTACAGTGTACCTCCTTGGGCTTGACTTTCTACTACTCGTACAGGTCAAGCCATGTCAGATAGTCAGACCGTTGG
TAGTTCCATGTGG

> SEQ ID NO:4463 215929FL 206158_300819_1c
gtggatgatgatatgccagccatctagatgattttttgtggacgcgcgcaGTATCTCCTTGATCTTGTGCACTGGCCGCA
AATGGGGCTTGCCTCGTCGCCTGTCAGAAAAGGGGCACATGTCAGTCATTCCAATGACGTGTATAACGAGGGCGAGTGA
ATATTCTGATACTTAAGGGGTGTATAGGCAGCTATGGGGGTCTGACGAGATCCAGTGTTACTCACATTTTACTTTGCGC
TGCCTGCACGTATCGCTGTTAAGCAGAAGCCGACGGCAGAAGCGATTAGACACTGGCGTCGATAGTCTGAAAGACGAAT
CATTGCTTACCAGGCTGTGATACCACAAGGTCAGTAAGAGTAACAGCGGCAGGGTATGGAAGCAGGGGAGTCGATGCAA
AGATAACATGTCCACACACACACGCACGCACGCACCGTTGCATGCGCGACAGTACGCATATCAGGATACATGTATGTAC
ACACTCAGATGCATAGGAGCAAAGGAATGGGCTG > SEQ ID NO:4464 215929FL 214136_300855_1c
atgccagccatctagatgattcttgtggaggcgcgcggtaTCTCCTTGATCTTGTGCactggCCGCAAATGGGGCttgc
ctCGTCGCCTGTCagaAaaggggCacaTGtcagtCATTccactGAcgtGTATAACGaggtgttactCACAttttacttt
gcgctgCcTgCAcgtatCGCTGTta > SEQ ID NO:4465 215931FL 205031_300795_1c
gaaattaatctatcGTGGTGATCAATTGGGAGCTTCATACCACCACTGAGCTCGTTCCGGCTTGCTCGGGCTTCTTCTT
CTCGCCAGGACGAGCCTTCTTGGCTGCTTTCGCCTGCTGAGAGCCTGCTGCTGGCAGACATAGCACCGCGTATGCCACC
TGGACAACGGCGACGACAGGCAGCGCGGATTGCAGCGTCAGCACCGGCTCTGCCACCAGGTCGTTGAATTGAGCGGCCA
GTAGCCCGAGCAGGACAGCTACTCGGCCGAAAGCGATGCCCTTTGACAAGGCATTGTCGAACGTCGGGACCGCGCCCAC
GGTGGCCTTTGGCTTGCTGTCGGTAGCCGGAGCTGGAGGAGCTTTTGCCAGTGCTGAGGACATGGTGATTGTGTCTACT
GGCGCATTCCTGTGATTCTTGGAGTTTGAGCTATTTGGACAATTCGAGGTTCCAGAAACATAGTTCGGCCAATGGCGGC
AATCACGTGACCTTGACCAAGGGAGCTTGTCGACCCAACCCTTGCTTCACTCTGCGTACATGTACGAGTATATACTTGA
ATCTGGAGGTATCACGATCAAATTATTACGGACAGTTGATTGTTGCGAGCAGCATATAAATAcaaatg > SEQ ID NO:4466 215931FL 219778_300948_1c
GCCCACGCGTCGATCAATTGGGAGCTTCATACCACCACTGAGCTCGTTCCGGCTTGCTCGGGCTTCTTCTTCTCGCCA > SEQ ID NO:4467 215935FL 205255_300797_1c
tgtatatccgaggaatgccatgcggttgttttggtgtttgttgctgCTATGGAAGAGAGTCCACCAGAGCTGAAAACTG
CTTGCTCTCTTCCATTGCCATTACTACCACCACTACTGCTAATGCTTACGGGCTTGGCACGGTCAAGCATAACTCCAAG
CTTGGGCTCGGGAATAAAGTAAAAAAAAAAAAAAGaCTTAACAACAATGCAATTGTCTCTCCCTGAGTGGCTCTCGGCT
TACAGTACTCCGTATCCCTGGCCTGCCATGACTGCAACTTGTCGGCTCTCGGCACTATGCCCAAGGGAGCAGCAAAACC
CCTTCAAGGCTTCAAGCATTGCGATATGGGGCTTATTTCCGTACAACAAAGAGAGCTGAAGAAAGATCAGCATCAACAT
CGTACGTTCCTTTccaggcgCCTAcaGAGGGCACGggt > SEQ ID NO:4468 215961FL 216977_300903_1c
AACATCACAAACACAACAACCACCACCACCACCACTCAACCTACAAACAACGTCACAATGGCCGCCAAGCTCTCCGCCG
ATCTCCTCTTCCAGATGGCCAAGGTCCGCCGCTCCATCTATCCCTTGAACAAGACTCTCCCCATCTCAACCTCTCGCAT
CCACGAGATCGTCAAGGAGGCCACCCTCCACACTCCCTCCTCCTTTAACGTCCAGACCAACCGTGCCGTCGTCCTCTTC
GGCGCCGAGCACGAGAAGCTCTGGGACATCACCTCCGAGACCCTCAAGGCCATTGTCCCCGAGGACCAGTTCAAGTCCA
CCGCCGACAAGCTCGCCCTCTTCAAGGGCGGCGCCGGCACCGTCCTCTTCTACGAGGACACCGACGCCACCAAGGCCCT
CCAGGCCAAGTTCCCCATCTACGCCGACCGCTTCCCTCCCTGGGCCGTTCAGTCCCTCGGCATGGAGCAGCTGCTCATT
TGGACTGcCCTCGAGGTTGAGGGCCTGGGCGCCAACCtCCAGCACTACaACCCCCTGAttGacctcAAGGTTGCTgagA
CCTGGGGCGTTCCCGCTCACTGGAGactcgatgcccagcTTGTCtt > SEQ ID NO:4469 215981FL 217922_300913_1c
ATTGTGCTCGTATCTCAGAGCTGACAAGCCTATCGACTTGCGGGCTGGGGATCAAATCACGCCCTGACCTTGTGAGCG
GGCGACTTTTCAGCTTGTTCCCCCCCAAGGGAGTCGGCGCTTGCTGCATGGCAAGTCATGTCTTACGTCTCGCCATTGC
AGCCGCCGGCCCTGATGAAACCAGGGAATCGCCAGCCAGCCTAGCTTCAGATGGGGTTTGAAGTTCAGTCAACTGAACT
ACGTGGGCGGTTAAAAGGGCCTCGGGGATTGCTCGCAGCAAGGCCAGAGAGCGATGAGATGGGATGGAGAGAGAGAGAG

FIG. 2 continued

AGGGCTGCCCGACTACCGGTGCACTGCATGTTATCTGCCGTAACATATACATGTACCTACTTAGTTAAGATGTATCACGC
ACGCGACC

> SEQ ID NO:4470 215982FL 205596_300799_1c
GCCGAGCCTCGCGCAGAACCCAAACCAAACCCGCACAGCAACAACACACACTCCACCTCGAGCTTCTGGTCTTTTAATC
ATAATCGTTACACTCCAAGGCTGCATTTCTTTGCTGAATACTCTATTCAACCAGACTCAACTCAACTCGACTCACCAGG
CTTCCATCTCCTCGCTACTCAAAAAGGCTCAGCCTTACCTATTTCTCCTCCTCCAACCTCATGGCATAAACGACACACN
CTCTCTCTCTCCNGATTGGTGATGGCAACAGGCGACAACGCCGCCTCCGAGCTACGAGGCCGTGTCCGCCGCTCCTCCT
CACCCTCCTCATCCTTCACATCCTCCTCACCCTCCTCCGCTCCCATCTCCGTCGCGACGCCGGGCCTGTCTAAGCGCC
GTCCCGCCTCGTCTCCCTCGTCCCCGACTTCGTCCAGATCATCGTCGTCCAACCCCTGGTCATCGCCCACCAAGTCTTG
GTCATCGTCGTCATGTCCGCCTCCGCCCGCGCCTGTCCTGCGACGTAACGTCTCGTCTTCTAGCCTCTCGTCCCGGACG
GCCTTCGGAACTGACGCCTCTGACC

> SEQ ID NO:4471 216049FL 206285_300820_1c
gGGATGAGGAGGGGGGGTGTTTGTGTTGCGATAGGTAACTTAGTACGAGTAGATTCAAGATGGAGGGGGGGAATGAATC
TTGCTTGCTTGACTGCAGTCTGTAGTGTAATCAGGCAAATAAGGCAAATGAATACCTGTCAAGTCGACTCTCGGTATCG
AGTTCCGCATGTACTAAGCAGAAACATGCGTCATACTACGAATAAATATCCCTGGATGGGCGATTATTACTCCAATACG
CATATTGATACCAACC

> SEQ ID NO:4472 216057FL 214632_300863_1c
GATTCAATATCTTTCTCTCGACGTGGTTCGATTTCGATTCGACGTATCGGTGGGGGGGCATGAATAAGGTAATGGTTGT
GTTTAGTTGGGCTCGAAACTAATGTTACCCATCAGTAGTATCACCTATTGCTGACGTCGGCTTGAGGAAGTGGGTTCAA
TCGTGATACATTCGGCTCGTACAGTGCAATACAGATAAGATGATGCGATCAGAGAGGCAATTGTTAGGTCATGATTGAC
GGAGGATTCGAGCCGATGATGACAAGGCGACAAGAGCTGGGCAATCGACCCCAATTGGATGATTCTGGCACCCCAAGCT
GTGAATTCGGCTTGACCTTTGAACATCAACTTGCTGTAGGGTAGTGCAACCTTGGACGTAAAGAGAAGGCAGCGTCAGC
ATTTGTTAGCGCACAGTACCTACCTGTATGTATGTATGTCCGTCCATACAACTTTGATGAGACCGAGAcGAGATAAAA
AGTGAgCGgcgTCAGTGCCCAACTTGGTATAAAGGCTtgaagAac > SEQ ID NO:4473 216062FL 103561_300363_1c
tggtatcaacgcagagtggccattacggccggggggttacataggaataagtaatatatttattgttttccccttcgtcc
aAACTATAGGCTCAAATACCTTATCCAAGCTCAGCAGATCTCCGTTTTCACCTAATTCAATCAATCGCCTCGCATCTTC
TAGGGCTTGGATTTGAAGGTATACGAGCTAATCTATGGCGTCGAAGCGTATATTGAAGGAGCTCAAGGATTTGCAGAAG
GATCCTCCGACATCATGCAGCGCTGGTCCAGTTGCTGAGGATATGTTCCACTGGCAAGCAACTATCATGGGTCCTACGG
ATAGCCCTTATGCAGGAGGCGTATTTTTGGTTTCGATTCATTTCCCTCCTGATTATCCTTTCAAGCCTCCAAAGGTTGC
ATTTAGAACTAAGGTTTTCCACCCCAACATCAATAGCAATGGAAGTATATGTTTGGATATTCTTAAAGAACAGTGGAGT
CCAGCTTTGACCATATCCAAGGTCTTGTTGTCCATCGTTCTCTGTTGACTGATCCAATCCAGACGATCCACTTGTAC
CAGAAATTGCTCATATGTACAAGACTGACAGGGCCAAGTACGAGGCCACTGCTCGTAGCTGGACACAGAAATATGCTAT
GGGATGATGCGGAAAGTGTCCTTGGACGTGCCTGAGACaCttTTAATTGCaacagtttcattgtgcTttCAcccTtaag
tgCaaTgtctttgtgcttggaTGAaagtaaaatattg > SEQ ID NO:4474 216062FL 104611_300369_1c
tactgtcaaatcagatctcttcaatttgctagggttttggtttcttctccctctctgatggcttcgaaacggatattga
aGGAGCTTAAGGATCTCCAGAAAGATCCTCCTACCTCTTGCAGTGCCGGCCCCGTTGGAGAGGACATGTTTCACTGGCA
AGCTACAATAATGGGCCCTCCAGATAGCCCCTACACCGGGGGTGTATTTTTAGTCACTATCCATTTTCCTCCTGATTAT
CCATTTAAACCTCCTAAGGTTGCTTTTAGGACAAAAGTTTTGCATCCAAATATTAATAGCAATGGTAGTATATGCTTGG
ACATATTGAAGGAGCAATGGAGCCCTGCCTTGACTATTCTAAGGTTTTGCTTTCAATATGCTCACTTTTGACGGATCC
AAATCCTGATGACCCCTTGGTGCCTGAGATTGCTCATATGTACAAGACGGACAGGGCAAAATACGAAACAAccgCCCGG
AGTTGGACCCAGAAGTATGCCATGGGTTAAACCGTTACCTATGGCACTTGAATTTATGTAAAAAGAAAGAATGCATCTG
TCCTCTACTTTCCATACAAGaaGTATAGAATAGCATTGAAc > SEQ ID NO:4475 216062FL 105318_300373_1c
CAGTTTAAGAGAGAAATATAGGACTTCTTCCAACGTACTGGGGTACTATTATTGGCCCAAAATCCTCTTCCAGCTCTGC
AATCTCCGTCTCCGTCAATTTTCAGTCAACCGAAATCCACCATCTTTCATTGTTCATCACCTTCAGGTTAGGGTTTGGA
TTTGAAGGTACAAGGGGCTAATTGATGGCGTCGAAGAGGATATTGAAGGAGCTCAAGGATCTGCAGAAGGATCCTCCTA
CATCATGCAGTGCTGGTCCAGTGGCAGAGGATATGTTCCATTGGCAAGCAACTATCATGGGCCTACAGATAGCCCTTA
TGCCGGAGGTGTATTTTTGGTTTCAATTCATTTCCCTCCGGATTATCCTTTCAAGCCTCCAAAGGTTGCCTTTAGAACT
AAGGTTTTCCACCCTAACATCAATAGCAATGGAAGTATTTGTCTGGATATTCTAAAGAGCAGTGGAGTCCAGCGTTAA
CCATATCTAAGGTCCTGCTCTCCATCTGCTCCCTATTGACTGACCCAAATCCAGATGATCCACTTGTACCAGAAATTGC

FIG. 2 continued

CCACATGTATAAGACTGAAAGGTCTAAATACGAGACCACTGCTCGTAGCTGGACTCAGAAATATGCTATGGGATAATGG
CAAAGGTGTCACCAGGCATGTCTGAGACTTTGTAACTGCAATGTCTTATTGTGCTTGTAGTGAATGAATAAATTCGGCT
AAAGAACTTAGTTTACTTCTTAATCTCCCTTAAAGTGGGTTGTCAACAGACATTTCTTTTCAATTTGTGAATATCTATT
TGGTGACTATTAGTAAGGGAGACACTTCAGtgtaattttacttcgtttgccagttt > SEQ ID NO:4476 216062FL 1106278_301498_1c
GTGTAGTCATGTCTTCGAAGCGGATTCTGAAGGAGCTGAAAGACTTGCAAAGGGATCCACCAACCTCATGCAGCGCAGG
ACCTGTTGGGGAGGATCTTTTTCATTGGCAAGCAACAATCATAGGGCCTGATGATAGTCCTTATGTTGGTGGGGTGTTC
ATGGTCACGGTTCATTTTCCCCAGGACTATCCCTTCAAGCCTCCCAAGGTTGCTTTCAGGACAAAAGTATTTCACCCAA
ATGTGAGCAGCAATGGGAGCATTTGCCTAGATATCTTAAAAGAGCAATGGAGTCCAGCTCTTACAATATCGAAGGTCTT
GCTTTCGATTTCTTCACTTCTTACGGATCCGAACCCTGATGATCCCTTGGTTCCGGAGATTGCCCACATGTACAAGACC
AACACGGCCAAGTATGAAGCCACGGCCAGGAGTTGGACACAAAAGTATGCCATGGGGTGAGAGGCTTTTCCTTTGAAAG
AGAAAATGGCCTTTATATATTGTTTATGTTTAAAACCTCCGTTCAAACCTTGTATTTTTTTCTCAAAATGCTACTTTT
T > SEQ ID NO:4477 216062FL 1100623_301462_1c
GGGTGCCTTCCTTGCGTATCGGGAGGAGAACGGAAGAATGGCTTCGAAGCGGATCCTGAAGGAACTGAAGGATTTGCAA
AGGGATCCTCCCACTTCCTGCAGTGCAGGTCCTGTTGGGGAAGATATGTTTCATTGGCAGGCAACTATCATGGGGCCAA
CTGATAGTCCTTATGCCGGTGGCGTCTTCATGGTCACTATTCATTTCCCCCCGGACTACCCCTTCAAGCCTCCCAAGGT
TGCTTTCCGGACGAAAGTGTTCCACCCAAATATCAACAGCAATGGGAGCATCTGCCTTGATATATTAAAAGAGCAATGG
AGTCCAGCCCTTACAATATCGAAGGTCTTGCTTTCGATTTGTTCACTTCTCACTGATCCGAATCCCGATGACCCCCTTG
TGCCGGAGATTGCACACATGTATAAGACGATCGAGCCAAATACGAAGGTACTGCAAGGAGTTGGACACAGAAGTATGC
AATGGGTTGAGTTGAGTCTTTCTTCACTCAATTGCTACTCGCTCTTAATATATCCCCCCCCCCTTGATGTAATAAATATA
TGTTGGCAGACAAGTTAAAATATCGGCATACAAAAAGCCGTGTTTCTGAATGATCTTGTTTCAAAACTGAATGAATgca
aGCAaTGTgtTTTTAt > SEQ ID NO:4478 216062FL 1100320_301459_1c
GGTTAAAGCTTAGAGAGACATCTGCCCTTGCAAGTGAAGAGGATCAATCGATCGATCAGCCATGGCAGCGAGGGTAAGA
CTATTCAAGGAATACAAGGAAGCAATGAAAGACAAGGCTGTTGACTCAGATATTGTACTTACTTGTGATGATACAAACA
TATACAGGTGGACAGGACACATCAAGGGTCCAGAAGATACACCATACCAAGAAGGTGTTTTTCAGCTAGCCATAAATGT
TCCAGATCAGTACCCTCTGGTGCCACCCCAAATACGGTTTGTGACCAAGATTTTTCACCCAAACGTTCACTTTAAGACA
GGGGAGATATGCCTAGATATTTTGAAGGCGGCTTGGAGCCCAGCATGGACATTGCAATCTGTTTGCCGTGCTATAATAG
CCCTAATGGCTCATCCTGAGGCAGATAGTCCTTTAAATTGCGATTCCGGCAATCTACTAAGATCGGGTGATAACCGTGG
ATTTTATTCGATGGCTCGTATGTACACCCGATTGGCGGCGGCGCCAAAGCCTTGATTCTCTTCACATCTTTTCAAAAAA
TATCAAGGATTTCTCATAGCTACTAAGATGCTTTCCATGTGAAGaatTATATAttCGGGCACAAATGATTTgGACACGT
GgGttttagaG > SEQ ID NO:4479 216062FL 1099839_301451_1c
TAAGAGTATCTGCGTTGAATTGAAGCGAAAGGACTTTAAGGAATGGCATCCTCTGCTCAGCTTCGATTGATGTCCGATC
TGAAGGCCATTAGCCATGAGCCACCTGAGGGATGCAGTGCCAGCCCTTATAGCGATGCGGACCTTTTGTTTGGGACGC
CACAATATTTGGTCCCGAAGATACTCCATGGGAATGTGGCATTTTCTGCCTCCGTTTGGTCTTTGGAGAGCATTACCCT
GCCAAACCACCTCGTGTCAGGTTTACTTCCGAGATATTTCACCCCAATGTGTACAATGATGGCACCTTATGCATGGACA
TTATACAAGATGCTTGGTCTCCTTGCCACAACATCTGTACAATTCTAACATCTGTTCAGTCATTGCTAACAGATCCGAA
TCCCGCAAGCCCAGCTAACTCGGAAGCTGCACATTTATATCAAACTGATATTCAAGCATATAACAGGCGAGTTCGGCGT
TGTGTGAGGAAGTCTTTGGAAAGCACATAGTATACT > SEQ ID NO:4480 216062FL 1098140_301483_1c
ttcatatatatatatatagagggaggaaggcttcgtgttggaccttcctttttgttttccTTTTTGCCGCCATCGCCG
TCTTTCCTTCCTTCCTTCGATCGATCCATCCCTCCTCCTCTTCGCGATCAAGCTTCTCCTCCTCCCCCCCCCCCCAATG
GCCTCCAAACGGATCCTCAAAGAGCTCAAGGACCTACAGAAGGACCCCCCCACCTCGTGTAGCGCCGGCCCTGTTGCGG
AAGACATGTTCCATTGGCAGGCAACGATCATGGGACCTGTTGATAGCCCTTACGCCGGAGGTGTGTTCATGTTGACAAT
CCACTTTCCCCCAGACTACCCTTTCAAACCTCCCAAGGTTGCTTTCAAGACAAAAGTATTTCATCCAAACATCAATAGC
AATGGGAGTATTTGCTTGGATATTTTGAAAGAGCAATGGAGCCCAGCTTTGACAATCTCCAAGGTTTTGCTTTCGATTT
GTTCTCTTCTCACTGACCCAAACCCCGATGATCCTCTGGTTCCTGAGATAGCACACATGTACAAGATAGACAGAGCCAA
GTACGAATCTACTGCAAGGAATTGGGCACAGAAGTATGCTATGGGCTAATAGTTATTATAATGGACATCCCATTGCAAT
GGTAGACAGGCCGAGGGATTGATTACACTTTCCTGTTCTTGTTTTCAAACCATGggGGGttggATGTATCttgtg

FIG. 2 continued

> SEQ ID NO:4481 216062FL 107664_300380_1c
TGCGAACTCCAGGGGCACCTCCTCCAACACAAAGCAGGAGTTCAACGCAGAATCAAACCAAAACCCTAGCTCACCGCCT
TGTTTCCTCCGTATTGGTGGTTACAATGTCGACTCCGGCTAGAAAGAGGTTGATGAGAGATTTCAAGAGGTTGCAGCAG
GACCCTCCTGCTGGTATTAGTGGTGCACCTCAAGACAACAACATTATGCTTTGGAATGCCGTGATATTTGGTCCTGATG
ACACTCCTTGGGATGGTGGTACGTTCAAGCTGACTCTTCAATTCTCTGAGGATTACCCCAATAAGCCACCAACAGTGCG
GTTTGTTTCTCGCATGTTTCATCCTAACATTTATGCAGATGGAAGTATATGTTTGGATATTCTTCAAAATCAGTGGAGT
CCAATATATGATGTTGCAGCTATACTTACATCCATTCAGTCATTGCTGTGCGATCCCAACCCCAATTCACCTGCAAATT
CGGAAGCAGCTCGGATGTTCAGCGAGAATAAAAGGGATTACAACCGCAGAGTTAGAGAAGTTGTGGAGCAGAGCTGGAC
TGCAGACTGATTCTAAGGAAGAAAGATGTCATTGCTGACCGCAATTCGGGAGCACCAgGGTTCATCTATGTTACATTTA
CGGATTGAAACCTCTTCttggAAATTTTATTGGAACACATTTGttTTGgccctagtaTTATGGCTtGgTGCTGTttgCC
ttAccgtTTGCTGCAttGCAttGacaagcTccTGtaatATATGAaTg > SEQ ID NO:4482 216062FL 107138_300263_1c
AAATCCCCCGTCACCCCCAACAAAATAAAAAGAGCCAAAAAGGTCAGGAAAAAATCATGTCTTCACCAAGCAAACGGAG
AGAAATGGACTTGATGAAGCTGATGATGAGTGATTACAAGGTGGAAATGATCAATGACGGCATGCAAGAATTTTATGTG
CATTTCCATGGACCTGCTGAAAGTCCTTATCATGGTGGAGTTTGGAAAATGAAAGTTGAACTTCCCGATGCCTACCCTT
ATAAATCTCCGTCAATTGGCTTTGTTAATAAAATCTATCATCCAAATGTTGATGAGATGTCAGGCTCAGTTTGTTTAGA
TGTTATCAATCAGACTTGGAGTCCCATGTTTGATTTGACAAACGTGTTTGAAGTGTTTCTTCCACAACTTCTCTTGTAT
CCTAACCCGTCGGACCCTTTGAATGGGGAAGCAGCTGCCTTGATGATGCGAGACCGAACTGCGTATGAACAAAGAGTTA
AAGAATATTGTCAAAAATATGCCAAACCAGAAGATGTTGGAGCTGCACCAGAGGAGAAGTCAAGTGATGAGGAGTTAAG
TGAAGCTGAATATGACTCGGATGATGAGGAAATGGCAGGCCCCGTTGATCCATAATAATTCCTTCTATTTCCATTACTA
TCTTTATATGTAAATGATGTTATTTATCCTGTTTAAAAT > SEQ ID NO:4483 216062FL 104744_300367_1c
cccacgcgtccgcccacgcgtccgcccacgcgtccgcccacgcgtccggctcagcatctctaggcttcagcactgcaat
cTTCGTCTTTCTGCAAACTCAATTAATCCCCTCTACCACTCTGCCACCTTCAGATTTGAGCTTGGGTTTGAAGGTAAGG
AAGTAACATATGGCGTCAAAGCGCATATTGAAGGAGCTGAAGGATCTGCAGAAGGACCCTCCCACGTCATGCAGCGCTG
GTCCTGTGGCTGAGGACATGTTCCATTGGCAAGCAACAATCATGGGCCCTACAGATAGCCCTTATGCAGGGGGTGTATT
CTTGGTTTCTATTCATTTTCCTCCTGATTATCCGTTCAAGCCACCTAAGGTTGCATTTCGAACTAAGGTTTTCCACCCT
AACATCAATAGCAATGGAAGCATTTGTCTGGATATTCTTAAAGAGCAGTGGAGTCCAGCATTGACCATATCTAAGGTCC
TGTTGTCCATCTGCTCTCTATTGACAGACCCAAATCCAGACGATCCTCTTGTACCAGAAATTGCTCATATGTACAAGAC
TGACAGGTCCAAATATGAGGCCACTGCTCGTAGCTGGACACAGAAATATGCCATGGGATAATAGCAAAAGTGTCACCGg
GCAtgtcagagactttgtagcTGCACCgTCTtaattgtgCtTGGGTg > SEQ ID NO:4484 216062FL 57194_300378_1c
cccacgcgtccgatctcttctattcataagttgtaaattcttattattgggATTTTTTCCCTTTTTAATTCAATCCAAG
AATTGAGTAGGACTAATGGCATCCAGGAGAATTCACAAGGAACTAAGGGAGTTGCAAAGAGACCCTCCTACTTCATGCA
GTGCAGGTCCGGTGGCACAGGATATGTTCCATTGGCAAGCAACCATTATAGGTCCAAATGACAGCCCTTATGCAGGTGG
TGTTTTCCAAGTGGCCATCCATTTTCCTCCTGATTACCCTTTCAAACCTCCCAAGGTGGCTTTCAAGACCAAAGTTTTC
CATCCAAATATAAATAATAATGGAAATATTTGTTTGGACATTCTTAAGGATCAATGGAGTCCTGCCCTCACCATATCAA
AGGTTTTGCTTTCCATATGTTCACTACTAACAGATCCAAATCCAGATGATCCACTGGTTCCAGAGATTGCTCATATGTG
CAAGAGTGATCGGAACAAGTATGAATCAATGGCTCGTAGTTGGACTCAAAAGTATGCTATGAACTGAGTCTGAATACAT
TAAGAAAAAACTCTAGTTTGTGACAAATATGAATTTCTTGGTATCGAGCAATATATAAAATGTTCAGGAAAACTGGCAC
TCTTATGAAAAATGAGATGAGTGACAGTTGGATGTATTTAAATCTCGGGATTTGTTTTAAATAAAAGGGTGATTTTACT
GTCTTCTTatt > SEQ ID NO:4485 216062FL 50942_300164_1c
CTTCTCTCTAATACGAGACAGAAAAAGGCGAAAACCTCGCCAATCCGATTACGCGAAAAATCAAAGGTTTTTGGATATG
GCGTCGAAGCGGATCTTGAAGGAATTGAAGGATCTCCAGAAGGATCCACCTACATCATGTAGCGCAGGTCCTGTTGCTG
AAGACATGTTTCACTGGCAGGCAACGATAATGGGTCCTTCAGAGAGTCCTTATGCTGGAGGTGTTTTCCTTGTAACCAT
CCATTTCCCTCCGGATTACCCATTCAAGCCTCCTAAGGTGGCCTTTAGGACCAAGGTGTTCCATCCCAACATTAACAGC
AACGGTAGCATTTGCCTCGACATCTTG > SEQ ID NO:4486 216062FL 39306_300198_1c
CCCACGCGTCCGAGCTCCCGGTATAAGTGCCTCTCCATCTGAGGATAATATGCGGTATTTCAACGTTATGATTCTTGGT
CCTACACAATCACCTTATGAAGGAGGAGTTTTCAAGTTGGAGCTCTTTTTGCCTGAAGAATACCCTATGGCAGCTCCCA

FIG. 2 continued

AGGTTAGGTTTCTCACAAAGATATACCATCCTAACATTGACAAGCTTGGAAGAATCTGTCTTGATATTCTCAAGGACAA
ATGGAGCCCTGCACTACAAATACGAACAGTGCTCTTAAGGTATATGAGCTGATTACATAAGATTATTTCCTGCTAAAAA
CTAT

> SEQ ID NO:4487 216062FL 38614_300097_1c
GGATAATAAAGAGGTGAAGTAATGTTTTTGTTTGAGATTAAAGAGGTTTCAAACAAAGAGATGATAAAACATAGGAATC
TAACTTATTTCATGGAAGATCCCTATGTGAAGAAGTCCTCTCTCTTTCTCTCTCTCTCTATTAAAACCGAGTCTGTG
AGGGATCAAAGGACACAAACTTTCATCCCATTGCATATTTCTGAGTCCAGCTTCTCGCAGTAGACTCATACTTTGCTCT
ATCGGTTTTGTACATGTGAGCAATCTCTGGAACCAATGGATCATCTGGGTTTGGGTCCGTTAACAATGAACATATCGAA
AGCAAAACCTTCGATATGGTGAGTGCAGGACTCCATTGTTCTTTCAAAATGTCAAGGCAAATGCTTCCATTGCTGTTGA
CATTAGGGTGGAACACTTTTGTCCTGAATGCAACCTTTGGTGGTTTGAAAGGATAATCCGGAGGGAAGTGAATGGTTAC
GAGAAAGACACCGCCTGAATAAGGACTATCAaatgGACCCATTAtTgg > SEQ ID NO:4488 216062FL 37480_300389_1c
TTGAATGGAGATCAAATAATTTCTTACTGATCCTGTCTTCACAAATTTTATAAGACAGACAAGTCTATAAAAGATCATT
ACATAGAAATAAGAAGAGTTTAATTATTAGGGCTCTTCCTTAAGGACAGTATTTGTGTCAGCCCATGGCATACTTTTGG
GTCCAGGTCCGAGCAGTGGACTCGTACTTGTTCTTGTCTGTCTTGTACATGTGAGCTATCTCAGGGACCAAAGGATCAT
CTGGGTTTGGATCCGTTAACAAAGAACAGATCGATAGCAGCACCTTGGAAATTGTGAGAGCAGGACTCCACTGCTCCTT
CAAGATGTCGAGGCAGATGCTTCCATTGCTGTTAATGTTTGGATGGAACACCTTCGTCCTAAAAGCCACCTTAGGAGGC
TTAAATGGGTAATCTGGAGGGAAATGGATGGTTACAAGAAAAACTCCTCCAGAATAAGGGCTATCCGATGGACCCATTA
TAgtGGCCTGCCAATGAAACATGTCTTCCGCAACGGGTCCTGCGCTACATGAAGTAGGAGGATCCTT > SEQ ID NO:4489 216062FL 35521_300098_-1c
CCCGGGACGACCCACGGGGGCGGGATATTGAAAGAATTGACGGATTTGCTAAGAGACCCTCCTGTTGGGGGACCAATCA
AAACCAGACCACAAGATATGTGCCACTGGCAAGCTACTATAATGGGTCCGAATGAAAGTCCTTACTCCGGAGGTGTCTT
CCTTGTCAATATTCATTTCCCTGCTGATTATCCTTTTACACCTCCCAAGGTTGTATTCACAACCAGAGTGTTTCACGCA
AACATCAACATTCTTGGAAACATATGTTTGGACATTCTCAAAGACCAATGGAGCCCTGCCCTTACCATTTCTAAGGTTT
GAAATTCTATATATGTATTTAGTTATTTGCATGTCGCCTGTTAAGGCTTCTTTGGACAGAGCTCCAGGTTTGTCAATCT
TGTCCCCAAGAACGAGAAGAGGGATACCATTAG > SEQ ID NO:4490 216062FL 293034_200199_1c
ATGCTTATATTCAGGTCCGAGTTTTATTTGCAGTCTCGTTCCAACTCTTCTCTCTCCCACAAAGTGAAGTCGGTCTGAG
ATTCGTAATGGCTTCAAAGAGGATTCAGAAGGAACTGAAGGACTTGCAGAAAGACCCCCCTGCTTCTTGCAGTGCAGGT
CCTGTTGGTGAGGATATGTTCCACTGGCAAGCTACAATTATGGGTCCATCTGACAGCCCATTTCTGGGGGTGTTTTCC
TTGTGTCTATCCATTTCCCCCCTGATTATCCATTCAAGCCCCCAAAGGTTTCCTTTAAAACCAAAGTATTCCATCCAA
CATCAACAGTAATGGTAGTATTTGTCTGGACATCTTAAAAGAACAATGGAGCCCTGCCCTTACTGTATCCAAGGTGCTG
CTTTCCATTTGCTCCTTGCTTACTGATCCAAATCCAGATGATCCGTTAGTGCCAGAGATTGCTCACATGTACAAGACTG
ATAGAGTGAAGTATGAGAGTACTGCTAGATCTTGGACCCAGAAATATGCCATGGGATGAAAACATTTGGCTTACTCCCA
TGAACATCGGGCCTTTATGCTATAGTAGTAAATAAAAATAGGCGCGGAACACAATTTC > SEQ ID NO:4491 216062FL 292918_200249_1c
AGAAATCGAGTAGGAGGATCTCTGAGGGATATGGCATCCAAGAGAATTCTGAAAGAGCTCAAGGATCTGCAGAAAGATC
CTCCCACCTCTTGTAGCGCTGGCCCAGTTGCTGAAGATATGTTTCACTGGCAAGCAACACTTATGGGTCCATCTGACAG
TCCTTATGCTGGCGGAGTGTTTCTTGTTACCATTCATTTTCCACCTGATTATCCATTTAAGCCTCCAAAGGTAGCTTTT
AGGACAAAAGTTTTTCACCCAAACATCAACAGCAATGGTAGCATTTGCCTCGACATTTTGAAGGAACAGTGGAGCCCGG
CACTCACAATATCTAAGGTGTTGCTGTCCATCTGTTCTCTTCTAACAGACCCAAATCCTGATGATCCTTTGGTGCCTGA
GATTGCTCATATGTACAAGACTGATAAAAGCAAGTACGAAGCCACTGCTCGGAGCTGGACTCAAAAATATGCCATGGGT
TAGTTGCTGAAACACAAATATTTGGCTTTTATCTATGATGTATTAAGAAATTGTGTTATGCATAATTAACTCAAGGGAA
AGGTTGAATTGTGGCCCTCTGTAAAACACTTAATTTTCCTCATGTTTGTAAGATTAAATGGTTTTGAAattCtg > SEQ ID NO:4492 216062FL 285250_200180_1c
gaatttcaattctcgctaatcaggctaagactcagatttcttcgattgtttggttttAATGGCTTCGAAACGAATATT
GAAGGAGCTGAAGGATCTCCAAAAAGATCCTCCTACCTCATGCAGCGCCGGTCCTGTTGGAGAGGACATGTTTCACTGG
CAGGCTACAATAATGGGGCCCTCTGACAGCCCTTACGCTGGGGGTGTATTTTAGTCACTATCCATTTCCTCCAGATT
ATCCATTCAAACCTCCTAAGGTTGCTTTTAGGACAAAAGTTTTCCATCCAAATATCAACAGTAATGGGAGCATATGCTT
GGACATACTGAAGGAGCAGTGGAGCCCCGCCTTAACTATTTCCAAGGTTTTGCTTTCAATCTGCTCACTTTTGACGGAT
CCAAACCCTGATGACCCCCTTGTTCCTGAGATTGCTCACATGTACAAGACAGACAAGGCCAAATATGAAGCAACCGCCA
GGAGTTGGACCCAGAAGTACGCCATGGGCTAACTATTGCCTATGGCGGCTTGAATTGATATAAAGAAAAACAAATTTCA

FIG. 2 continued

```
ATGTCTTTCTTCTCTgtTCTCTCCATTAACAAGTTGTACAATAGCATTAAGCATTGCCCTCTGCAggAAGAATTATGAT
GCTTTAaAttttgttTATATGGATTctaatATTTGATgtgGGGaaGCATATATTTATCTg
```

> SEQ ID NO:4493 216062FL 274064_200147_1c
```
aaattattgggggtagctgaaaatacctagcaaagatacataacggaccaacggtatactgtcacgacatatctgctta
tAAAAAAGGAGTCCTAATTTCACTGTAAACTTCTCGCTTTCTCCTCGGTCCCCTCCAGAATCTGAATTGCAACGTGTAG
GAGGATCTCTGAAGGATTTGGTGAATCATGGCATCCAAACGGATTCTCAAAGAGCTCAAGGATCTCCAGAAAGATCCTC
CTACCTCTTGCAGCGCTGGTCCAGTTGCTGAAGACATGTTTCATTGGCAAGCAACAATTATGGGTCCGCCTGACAGCCC
TTATGCTGGCGGAGTGTTTCTTGTTACCATTCATTTTCCACCTGACTATCCATTTAAGCCACCGAAGGTAGCTTTCAGG
ACAAAGGTTTTCCACCCAAACATCAACAGCAATGGTAGCATTTGCCTCGACATTTTGAAGGAACAATGGAGTCCGGCAC
TTACAATCTCCAAGGTATTGCTGTCAATCTGTTCTCTGTTGACAGACCCTAATCCTGATGATCCATTGGTGCCGGAGAT
TGCTCATATGTACAAGACTGATAAAAGCAAGTACGAAACAACTGCCCGGAGCTGGACTCAAAAGTATGCCATGGGTTAG
TTGCAGTGACCATCTCTGGAGGGGCTCCTTTTCTTCTgtggtaTTCTgtaTATCTATTATGTATTAAGaaAtggtgttC
TTATGCATAATCAACTcaagggGAAATgttGaaCAgGCCCcTGtaacaaTttg
```

> SEQ ID NO:4494 216062FL 271676_200036_1c
```
ggggagacgtttgaaTTGGGAATAGGAAGAGAGCAAAAATGGTGGACTTGGCGAGGGTACAAAAGGAGCTGCAAGAGTG
CAACAGAGATGTTGGGGTTTCAGGAATAAGTGTAACCCTTAAAGGTGACAGTCTCACTCACTTGATTGGTACAATCCCT
GGTCCTCTTGGTACTCCTTATGAAGGTGGTTCTTTCAAGATCGATATCACTCTTACTGATGGCTACCCATTCGAGCCTC
CAAAAATGAGATTTGCCACAAAAGTTTGGCATCCCAATATAAGTAGCCAAAGTGGAGCAATATGCCTAGACATCCTGAA
AGACCAgtctagCCCAGCGCTGACTCTCAAGACAGCTCTCCTTTCTATACAAGCATTACTCTTTGCTCCTGAACCTGAT
GATCCACAAGATGCAGTTGTTGCACAACAGTATCTCAGAgaCCATCagaccTTTGTTGGCACAgCtCgttactggacTg
```

> SEQ ID NO:4495 216062FL 265904_200082_1c
```
aatctccagTGCCTTTTAAGCCGGCGACGAACATAAGGCGCCGCCCTATCATTTAACCTCCCGTCGACGTCTATCATTC
AATTCTCGCCGCTTTTTGCTCGTAGGTCAACAATTCCGTATTTCTTATGCGGTGAGGATGTCGACACCGGCGAGGAAGA
GACTGATGAGGGATTTTAAGCGATTACAGCAGGATCCCCGGCCGGCATCAGCGGAGCTCCGTGTGACAACAATATAAT
GCTATGGAATGCA
```

> SEQ ID NO:4496 216062FL 258580_301697_1c
```
GAAACCACCGTCCACCCTACCCACCCTCCGCAGACCTCTTCTCTTGCGCCGCGACCCAAAGAACAAGAGGATAGCTGAA
GAACCCGAAAAGAATGCAGATGGAAGCCCAGAATGCCGACCCCTTTGCTGAAAACCCCGCCAAGCTGCAAATGTCGGGA
TCCAACTCAAACGACGGCCACTCGGTCACCAAGCGCCTGCAAAACGAGCTGATGCAACTCATGATGTCCGACACGCCCG
GAATCTCGGCGTTCCCCGTGTCCGACGCAGATCTGCTCAACTGGACCGGCACCCTGACCGGCCCGGAGGGAACGGTCTA
CGAGGACCTGACGTTCAAAATCTCGCTGGCCTTCCCCCAAAACTACCCCTACACCGCACCCACAATCAAGTTCATCAGC
CCCATGTGGCATCCCAACGTGGACATGTCCGGCAACATCTGCCTGGACATTCTCAAGGAAAAGTGGTCTGCCGTGTACA
ACGTGCAGACAATTCTCTTGTCCCTGCAGTCGCTGTTTGGCGAGCCCAACAACAAGTCGCCTCTCAACGCCCAGGCCGC
CCAGCTGTGGGACACGGACATGGATGAGTACAAGCGGCTGCTGATGCAGCGGTACGAGGCCCCTGACGATGA
```

> SEQ ID NO:4497 216062FL 255882_301645_1c
```
ACGCGTCGGAGACCACCCCATTCTCTCTCTCTCTCTCTCTCTACCCTGTTTTCTCCCGCCCTGTGGTTTTAACACCC
CTCGAAGGCTGGTCTTTAGCCTGTGTGTGTGTGTGTGTCTCCCTCCTCTCCTTTTTCTGTTTTGCAGCGAGTTCGAA
TTGAGGAGCAGCAAGTTCGAATTGCTTAGATGGCGTCCAAGCGGATCCTGAAGGAGCTCAAGGATCTGCAGAGGGACCC
CCCCACCTCTTGCAGCGCTGGACCTGTAGCAGAGGACATGTTCTACTGGCAGGCTACAATAATGGGCCCTGACGACAGC
CCTTATGCTGGAGGTGTCTTCCTGGTGACCATTCATTTCCCCCGGATTACCCATTCAAACCCCCAAAGGTTGCTTTTA
GGACTAAAGGTTTTCCANCCCAAACGTCAACAGCAATGGAAGTATCTGCTTGGACATCTTGAAAGAACAATGGAGTCCT
GCATTAACCATTTCACAGGTTCTGCTCTCAATTCGCTCATTGTTGACGACCCAAACCCAGATGACCCCTAGTTCCAG
AAATTGCTCACATGTATAAAGCGGAACAGGGCGAAATATGAAGCCACTGCAAGGAGCTGGACTCAAAAATATGCCATGG
GCTAATGCTACCCCTTATATATATATAAGGCGATGGGTGGTGAGTCTGTTTCCACATCTT
```

> SEQ ID NO:4498 216062FL 254087_301631_1c
```
ACGACCACCAATTCCAAGCACACATTCGGACACCCACACTCTCTATCTTGCGAACAGCCTGTCACGCGCGAAATCACTT
CCCCAACATCATCCTGGACTACAGTCTCCATAACGACACCACTCGCGCCTCACATCCCACGCATCACTTTCCAACATGT
CCACAGCAGCGAGGAGACGCTTGATGCGCGACTTCAAGCGCATGCAGACCGACCCTCCAGCTGGCGTCTCAGCCTCTCC
GATCGCAGACAATGTGATGACATGGAACGCCGTGATCATCGGGCCCTCCGACACACCCTTCGAGGATGGCACTTTCCGT
CTTGTCATGCACTTCGAAGAACAGTACCCCAACAAGCCACCGGGCGTCAAGTTCATCTCACAAATGTTCCACCCAAACG
TCTATGCCACCGGAGAGCTGTGTCTTGACATCCTGCAGAACCGCTGGAGTCCGACATACGACGTGGCGGCAATCTTGAC
CAGCGTGCAGAGCTTGCTCAACGACCCGAACACCAGCAGCCCTGCGAACGTGGAAGCCAGCAATCTATACAAGGACAAC
```

FIG. 2 continued

CGCAAAGAGTACACTAAGAGGGTACGGGAGACGGTCGAGAAAAGCTGGGATGACTGAGCAAAGCGCGCAACACGAAAGT
GAGTTATGAGGCAATCACTATCGAATTCAGACTGGCTTGCATGAGAC

> SEQ ID NO:4499 216062FL 252709_301604_1c
ACTGTGTCTGTCTCCCTTCCGTCGAGATCTGTGGATCTTATAGCCTAGCCCTAAAGGGGAACAGCAAGCTTTGGACTTT
CCATGGCCTCCAAACGGATCCTGAAGGAGCTCAAGGATCTGCAGAGGGATCCTCCCACATCATGCAGCGCAGGACCTGT
TGGGGAAGATATGTTTCACTGGCAGGCAACAATCATGGGACCGAATGATAGTCCATATGCTGGCGGTGTGTTTATGGTG
ACCATTCATTTCCCACCGGATTACCCCTTCAAGCCGCCAAAGGTTGCTTTCAGGACTAAAGTTTTTCACCCTAACATCA
ACAGCAATGGGAGCATTTGCTTGGATATATTAAAAGAGCAATGGAGTCCTGCTCTTACAATATCGAAGGTCCTGCTGTC
AATTTGTTCGCTCCTGACGGATCCAAACCCCGATGATCCCCTTGTTCCTGAGATTGCGCATATGTACAAGACAGACAGA
GCCAAATATGAAGGCACTGCAAGGAGTTGGACGCAGAAGTATGCAATGGGCTGAATCTCTGACCTCTCTCGCCCCTTTG
TAATAATCAAAAGAta

> SEQ ID NO:4500 216062FL 248560_301584_1c
ggacagtatgtcTACTCCATCCAGGAAGCGCTTGATGCGAGATTTCAAGCGCCTCCAGCATGATCCACCCGCCGGGATC
AGCGGCGCGCCGCAGGACAACAACATCATGCTGTGGAATGCGGTGATTTTCGGGTAAGAGaggCCgCTTCTAGGGTTTA
GAGTTTCTAAAGGACTTTTTTCGTGGTTTGCtGCAGGCCTGACgatacTCCCTGGGATGGAGGGACATTCAAGCTGACA
TTGCAGTTTACGGAGGACTACCCCAACAAACCTCCCACTGTGAGATTTGTTTCAAAGATGTTCCATCCCAATATTTATG
CTGACGGAAGTATTTGCCTCGACATCCTGCAAAATCAATGGAGTCCAATCTACGATGTCGCGGCCATTCTTACTTCCAT
ACAGTCATTGCTTTGTGATCCTAACCCGAACTCGCCGGCCAACTCCGAGGCAGCTCGGATGTACAGCGAAAACCGCCGA
GAGTACAACAGGAGAGTTCGCGACATAGTCGAGCAGAGTTGGACGGCGGAGTAGCTCCCCTTGGtTCAAGAGCTTGTAA
GAGTGGCCATCACAGAGAGATGTGTGCTGCTCCGAGCACACATAAAGAATCTTGTCAAAAAACAATCCGGAAAGCTGTC
GCCTCTACAGACCAGCGTTGAAGGTCGACCATCGAACTCGTTTGCTTCTGTTGGAACCagggccaGTGTTCTGGTACTC
ACCATAGAACAGGGTGCTGAGAGCGAAGTCCCCGTTCCATTCCAACCATCCACGGGGTTGAATTATGTCACTGATGAAC
GACTTCATGAACACCGTCCgcgAGTAGAGCTTCCACGgCCTTCCgagtttATGAAAGAcAGCCcgtgttcTGTCGCTT
ATCGACg > SEQ ID NO:4501 216062FL 247566_301621_1c
GGGCGGACGCGTGGGGGGCGATTAGGGTATATTGGCTTTGTCGCGGCTATGGCGTCCAAGAGAATCCTCAAGGAATTAA
AGGACTTGCAGAAGGATCCGCCCACTTCGTGTAGCGAGGTCCTGTGGCCGAGGATATGTTTCATTGGCAAGCGACGAT
AATGGGTCCTCCCGATAGCCCCTACGCAGGGGGTGTGTTTTTGGTCACCATCCATTTCCCCCCGGATTATCCCTTTAAG
CCCCCCAAGGTCGCATTTAGAACGAAAGTTTTCCACCCAAACATCAACAGCAATGGCAGCATCTGCCTCGACATTCTCA
AGGAGCAGTGGAGCCCGGCCTTGACAATCTCCAAGGTGCTGCTATCAATCTGCTCGTTGCTAACCGATCCAAACCCCGA
CGATCCACTGGTGCCCGAGATTGCTCACATGTACAAGACAGACAGGCCCAAGTATGAATCGACCGCCAGGAACTGGACG
CAGAAGTACGCCATGGGGTAAGCCCGGGCTTGTGAGCGGCGGCGGCGGCGGTGGCGGTGGCATGGCTCGCTATGATGTT
TGTGATACCATTTGGTTGCCTATCTATAAGTTGAAAGCAGGGATTGTCTTTGATTATGGAATTCTTTTGATTACTGTAT
ATAGAATTTCTATCACGTC > SEQ ID NO:4502 216062FL 246013_301574_1c
gatcgcatgcacacggcagggaaGGGGAAGTGGAGGAAGGGTTGCGATCTCGCGGCTGGATCGTCCAGGATAGGGCGCC
GCATCGACTCGCCGCCTACGCCGCCGCTGCCGCCGCCGCTATGGCCGTGACCCTGGGTTTGTAGGGATTTTCCATC
CAGATTTCGAGGAGATCGCTGCGCGTTTCTCGTTCATGGCTGAGAACTTACCCCCAAAGGTGATTCGAGCGCTTGCAAA
GGAGCTCAAGAGCTTGGACGAGAGCCCTCCAGAGGACATTCGCGTTCATGTAAATGACGACAACTTCTCGAGCATTTTC
GCGGACATTGAGGGACCACCCGGAACACCGTACGAAAGTGGCGTCTTCCGGATCAGGCTTTTGCTTAGTCCCGATTTCC
CGCAAACGCCACCGAAAGGTTATTTCGTCACCAAGATCTTCCATCCAAACATCGCAAAGAATGGAGAGATTTGCGTGAA
CGTTTTGAAGAAGGATTGGAAGCCGACGCTCGCCTGAGGCATGTTCTTCTTGTCGTACGGTGCTTGCTCATAGAGCCG
TTTCCAGAATCGGCACTTAACGAGGACGCTGGAAAGATGTTGATGGAGGATTACGATGGATACGCAAAGCACGCCAGAT
TGATGACAAACATCCACGCGATGAAGCCAAAGCCAAAGACcaCGAAAGTCGCCATAGCCGAGTCAAcggtggTGAACAG
caacgcGGAGgag > SEQ ID NO:4503 216062FL 244825_301562_1c
cgcgattgtagatgctatagatcCAGGTCGCCTCGTCGTCGTCCCGTGGCGCCGCTGTAGATAGGGTTTGATTCATCGC
GCAGCAGCGGCAGCGGCGATGTCTACGCCGGCGAGGAAGCGGCTGATGCGGGATTTCAAGCGGCTGCAGCACGATCCAC
CGGCGGGCATCAGCGGCGCTCCACAGGACAACAACATCATGCTGTGGAATGCGGTCATCTTTGGGCCGGATGATACGCC
ATGGGATGGAGGAACATTCAAGCTCACCTTGCAGTTCACAGAGGATTATCCAAACAAGCCACCAAATGTGCGGTTTGTT
TCGAAGATGTTCCATCCCAATATTTATGCGGACGGAAGCATTTGCCTGGACATTCTCCAAAACCAGTGGAGCCCGATCT
ACGATGTTGCTGCAATATTGACATCGATCCAGTCTCTACTATGCGATCCAAACCCGAACTCTCCTGCTAATTCCGAAGC
CGCACGGATGTACAACGAGAACAGGCGAGAGTACAACAAGAAAGTTCGCCAAGTCGTGGAGCAGAGCTGGACAGCGAAC

FIG. 2 continued

```
GACTGAAACCGAGAGTTCTGCTCGGCTGCTCGACATGCTGGTACGCGATTTTCTGGCGATCACGGACGGAATtcTACTA
ACCAGCAGGAGCactgTATatcctcTGTACTCGGAtTTTTTTTcttaggtGATGTGGTTGcaactaagaaagt > SEQ ID NO:4504 216062FL 239823_301308_1c
GGAAATATTTGCTACAGGGTAGATGCTTCCCCATTTTTAGGTCTAAAGCTTCTTTCTCCTCCCTCGATTCGATTCGATC
CATCGGCGGCGGCGGCGATGAACATGAACGGCGGCGTCGATGCGATCGCGCAGCAGCAAGCGACGAACAATCCGGCGGG
TAGCAAGCAGAGCAAACCCAATTTGCAGCCGGTGGACAGCCATTCCGTCGCCCGGAGGTTGCAGTCGGAGCTCATGGCC
TTGATGACTTGCGGGGACCCGGGAATCTCAGCGTTCCCAGACGGCGACAACATCTTTACGTGGATTGGAACCATCAAAG
GGAGCGACGCGACGGTGTACGAAGGTCTCTCCTTCAAGCTCTCGTTGCGCTTCCCGACCGACTATCCATTCAAGCCGCC
ACTGGTCAAGTTTGAGACGTCGTGTTTCCATCCCAATGTCGATCAGCATGGCAACATTTGCCTCGACATCTTGCAGGAT
AAATGGTCCTCGGCCTACGATGTTAGAACCGTGTTGCTGTCCATCCAAAGCTTGCTAGGAGAACCAAACAACGATAGTC
CTCTCAACAGCTATGCGGCAGCATTGTGGCCAAACCAAGAAGAGTACAAGAAAGTGATGAACAGGCAGTGCCGCGACGG
ATCTGGTCGATGAGAAAGGGTCGATCGACAAGAGAG > SEQ ID NO:4505 216062FL 238009_301291_2c
atcATAAGTGGGGCAAAAAAAGGGTTCATGGCGAAGGCGCACGAATCCACTGCGGCACTCCTCTTCTTGATCGATTAGG
TCAGATCGAAGTAGGTCGATCGATTGATAGATAGATTGGAAAAGGATTGGCGAAGATGCTCGATGTGTCCCGCGTCCAG
AAGGAGCTGGTGGAGATCGAGCGCGACAAGAAGCTGTCGGGCGTGAGCATTCAAGTCTTCGACGATGGGTTGAGTCGAA
TGCGAGGAACAATCACGGGGCCTGTTGGCACCCCCTACGAGGGCGGAATCTTCACCATCGATATTCAGTTACCTTCTGC
TTATCCTTTCGAACCACCAAAGATGCAATTCATGACTAAAGTCTGGCATCCAAACATCAGCAGCCAAAACGGAGCTATC
TGCCTGGACATTCTAAAGGATCAGTGGAGTCCAGCGCTGACGCTAAAGACTGCGCTACTGTCGCTACAAGCGCTGCTTT
CGACGCCGGAAGCCGGGGACCCTCAAGACGCGGTCGTCGCAAAGCAGTACCTGAGTGAGTATCCGGTTTTCGAGAGCAC
TGCGAGATACTGGACCGAAACGTTTGCAAAGAGATCGTCCCTTGGCATGGAAGAAAAGGTAGCGAAGCTAGTCGAGATG
GGATTTACGGATGAGGTTGCGACCGCTGCTCTAGAGTGCTGTGGCGGCGACGAGAATg > SEQ ID NO:4506 216062FL 237695_301289_1c
gggaacgcgggaaggggcggcaACGGCGATGGCGCTGGCGTCGGCGGCGGCCTTGTGACAGTCAACCACAGCATGCTCG
TTGCGGCTGCCGCCACTGCCACTACAGCGTCGATCGAATTCTTGTATTCCTGCAAGCTAGGGTGGGGCGAGAATGCTGT
CGTCGGCCCAGTTGCGGCTCATGTCCGACCTCAAGGCGATTCAACAGGAGCCGCCAGAGGGATGTAGTGCTAGTCCACA
AGGCGAAGAGAATCTCTTTGTGTGGGGAGCCACTGTGTTTGGGCCGGATGAAACACCATGGGAAGGGGCGATCTTGCCT
CTTCGTCTCACCTTTGGCGAGCACTACCCGGCGAAGCCACCGCGCGTGAGATTCACGTCCGAAGTGTTCCATCCAAATG
TCTACAGTGACGGCGCACTGTGCATGGATATCATCCAGGATGCATGGTCTCCTTGCCACAACGTCAGCACCATTCTCAC
CTCGATTCAGTCTCTCCTGACTGATCCAAATCCAGCGAGTCCAGCGAATCCCGAAGCCGCGCATATGTATCAAAACGAT
CTCCAAGCATACAACAGGAGAGTGCGCCAGTGTGTGAGGAAGTCCCTAGATATATAAAACTCCAAAGTTTTATTTATCT
ATCTATCATAGTGAtTATCta > SEQ ID NO:4507 216062FL 233923_301095_1c
GCGAGAGAGAGCAGGAAGGCGATCGATCAGCTCCCGGCGGCGCTGTCGGAATCCGGATCTTGGAGCCGCTGCCATGGCC
AGTACCATCGCCAACAGCAATCTCCCGCGGCGGATCATCAAGGAAACGCAGCGATTACTGACCGAGCCAGCCGAAGGCA
TCAAAGCTTCGCCTGCCGAAGATAATTTGCGATACTTCAATGTGATGATCCTTGGCCCCGCACAGTCACCCTATGAAGG
TGGTGCTTTTAAACTGGAGCTTTTTCTTCCGGAAGAATATCCAATGGCTGCTCCAAAGAACTGCAATAGGTTCGCTTCT
TGACGAAAATTTACCATCCAAACATCGACAAGCTGGGCCGGATTTGCTTAGACATTCTAAAAGACAAATGGAGTCCTGC
TCTCCAGATTCGAACAGTGCTTTTGAGTATTCAAGCTCTTTTGAGTGCTCCCAATCCTGAGGATCCCCTGGACGAGAAC
ATCGCGAAGCACTGGAAGACAGACCAAGGAGGAGCCATCGCGACTGCAAGAGAGTGGACTCAACTCTACGCGACCCATA
ATTAAATCAAAATGCGGACCATTCGTCATCTTGGTTCGTTTAGTTTTTTCTgctTTGgTCATAttTgt > SEQ ID NO:4508 216062FL 230618_301070_1c
tACTCCATCCAGGAAGCGCTTGATGCGAGATTTCAAGCGCCTCCAGCATGATCCACCCGCCGGGATCAGCGGCGCGCCG
CAGGACAACAACATCATGCTGTGGAATGCGGTGATTTTCGGGCCTGACGATACTCCCTGGGATGGAGGGACGTTCAAGC
TGACATTGCAGTTTACGGAGGACTACCCCAACAAACCTCCCactGTGAGATTTGTTTCAAAGATGTTCCACCCCAATAT
TTATGCTGACGGAAGTATTTGCCTTGACATCCTGCAAAATCAATGGAGTCCAATCTACGATGTCGCGGCCATTCTTACT
TCCATACAGTCATTGCTTTGTGATCCTAACCCGAACTCGCCGGCCAACTCCGAGGCAGCTCGGATGTACAGCGAAAAcc
gccGAGAGTACAACAGGAGAGTTCGCGACATAGTGCGAGCAGAGTTGGACGGCGGAGTAGCTCCCcttggaTTTGTGGGT
AAGACAGCATTTATGGGTGATCTTtCAATATATATGTTGCATTGGTTAGATCACAGCactGgCtTCttgagTATGTA
TATg
```

FIG. 2 continued

> SEQ ID NO:4509 216062FL 226366_300996_1c
ACGACACCAATTTTAAAAAATGGCTTTGAAGCGAATCAACAAGGAACTCAGTGATCTTGGACGTGATCCCCCCTCCTCT
TGCTCTGCTGGTCCTGTTGGCCAGGATCTGTTCCACTGGCAGGCTACTATCATGGGACCCTCAGACTCTCCTTACTCCG
GAGGTGTTTTCTTTCTGTCTATCCACTTCCCCACTGACTACCCCTTCAAGCCACCAAAGGTGACCTTCACTACCCGAAT
CTACCACCCCAACGTCAACACCAACGGATCCATCTGTCTGGATATTCTCAAGGAGAACTGGTCTCCCGCACTCACCATC
TCCAAGGTGCTGCTGTCCATCTGCTCCATGCTCACAGACCCCAACCCTGACGATCCTCTCGTGCCCGACATTGGCCACC
TGTACAAGAACGACCGAGCACGATACGACGCCACTGCCAAGGAGTGGACCAAGAAGTATGCCGTCTAGGATGTATATAG
GGAGCAGGCATGAGCCTATGCAAGCGAATGGCTGTGACGATACAACTAGCCAATGTTAGATTTATGGATGGTAAAACAA
TGTGTGTCgaGGAAAaa

> SEQ ID NO:4510 216062FL 216386_300868_1c
ATGAAGATATATTTTCAAGACCTGCGATAGGTTTTGATATCAAAACGGAAGCTTGCTATGGGGTACGAACATTATTATG
GGAGGAGTTGAGAGATTATTCTTTTCTTCCATTTTCTTTGGCTTGGTTGCAAATATTTTAGAAGGCTCAAATTTGTTTC
GAGATGAGCCGCAAGCGTTACTGTCCGCGCTTCTATGGTGTATGTCTTAGATAGTACAAGTGGTCTTGCAGCAGATATA
CCACTGGCGCAATACATCATCACATTACACACAAAAAAAAAAAACCAA

> SEQ ID NO:4511 216062FL 215413_300881_1c
aCAGGACCGCCATCAGGGACTCTGCACCCCCGATCAGATAAAGCCTCTACCTAGCGCTCAGGACTTGCAGACGGTCGCC
TTGCATCGTCTCCAACGTCCGCCTAGGATCTTTTGATTCTTTCTTTGCCTCCTCGATCCGAGATCGATCTTCCACCACC
CTTTTAGATACCACATACCCTCATCACAATGGCCCTGAAGCGCATCAACAAGGAGCTCAAGGACCTCGGCACTGACCCG
CCATCATCCTGCTCCGCTGGTCCTGTTGGAGAAGATCTGTTTCACTGGCAAGCTACAATCATGGGACCCGGTGATTCAC
CATACTCAGGAGGCGTCTTCTTCCTGAAGATCCAGTTCCCTACGGATTACCCCTTCAAGCCCCCGAAAGTCAACTTCTC
CACCAGAATCTACCACCCCAACATCAACAGCAACGGCAGCATCTGCCTCGATATTCTTCGAGACCAGTGGAGCCCTGCT
CTGACCATTTCCAAAGTTCTCCTTTCCATCTGCTCTATGCTGACAGACCCGAACCCCGATGATCCCCTTGTGCCTGAGA
TTGCGCACGTGTACAAGACCGACCGGCCCCGGTACGAGGCGACTGCTAGGGAATGGACCCGCAAGTACGCCGTCTAGGC
AATACCAAACGGTTTCTTTTAAGGGGTTTTGATGGCGCTGGGTGTTTGACGTCCTCTATCACGCAATGACGGTGCGGCA
TGTTTGGCGAGCCTCTACGTTATAAGCGGGTGCGGGGATGATATTCGAAGGCGGACAGTGCAAGTTTTTTCTTTCTTCT
CCTTGCTGTTCTCATCATCTCTTCGGGTGCACCGCATTTATGATGCTGGGGGTGAGACGACGCATGGCCGGCGGACAGG
TGGCAGACTAGACAGAAATATCCGCTATTCAAGGGCTTATGCGGCTGGACTTGACTTTGGGTTTgcaTCAACAACGTGT
ACTCTGCATCCAACAACAGGCATCTGATTTAaCGCGTCTATACg > SEQ ID NO:4512 216062FL 211510_300900_1c
gcttttatcacttttgagaaccactcattcatccatctccgcaagatcgtctgtttttgtttacaatggattataccga
gGATAACCAGAATTCTGCTCCTGGCAGCGTCCAGGCTTCCAAGCTCAATGCCGCTCGCAAGGGTCCCGATTCGCAGAGC
GTCACTAAACGACTCCAGACCGAGCTGATGACTCTCATGAcatctccAGCACCCGGTATCTCCGCATTCCCCTCTGCCG
ACGGCAACCTTATGTCGTGGACCGCCACCATCGAGGGCCCCGAGGATACACCTTATTCCGGACTCACGTTCAAGCTGAG
CTTCGCGTTTCCTTCAAACTATCCTTATGCCGCGCCGACGGTCCTCTTCAAGACGCCCATCTACCACCCCAACGTCGAC
TTCTCTGGCCGCATCTGCCTTGACaTTCTCAAGGACAAGTGGACAGCCGCCTACAACATTCAGACCGTTCTGCTGAGTC
TGCAGAGCTTACTCGGCGAGCCCAATAACGCATCTCCATTAAACGGCGAGGCAGCAGAGTTGTGGGacaaggatATGgA
agagtTcaagaagaagGTGtTGGGACgCCATCGCGAcatcgaggaggaGTAATGGGATTcATAGCGTGcagattttttaT
gatTTTACgTttaCGGGTatttggagtCtttggggCAcgaATCggtcgttttttgaaagGGTatttgGGTGTATTTTGca
tttccacagccagagctggGaAAGGAGGGCTACCTGCCCCTTCCACAAGCGCa > SEQ ID NO:4513 216062FL 210910_300894_1c
AAGCCTCTTCGACCACCCTCTGCCATCGTCAGCCTTCGACTCTCTTCACCAAACCTCAACAAGCGACAAATTATCGCCA
GGGTGCTCCAACGCTCGCTCCGCCATCGCCAGTATCCTTTGGACCCATACTTTCGCTCTACAACACACACAACCCCTCT
TACGCCCACATAGCTTCGGCTACGTCAAGTTTCGGCATCATGTCTAGCAGAGATCGCCGTATAATGAAGGAGCTGCAGG
ATCTGACCGAGGACAAGGACACTTCCGGCATTCATGCTGCCCTAGAACAAGAGGGCTCGCTGACCGCTCAAGGGCTG
GTTCTTTGGCCCTGGAAATACGCCGTACGCTGGTGGCAAATTCGTGATTCACATTCAGCTTCCCACCGACTACCCCTTC
AAGCCACCCAAGATGAAGTTTGAGACCAGGATCTGGCATCCTAATGTCAGCAGTCAGACGGGCGTCATTTGTCTCGACA
CCCTCAACAAGAACTGGTCGCCTGTCCAAACGATCAAGACGGCTCTCCTCTCCGTCCGAATGCTTCTCGAAAACCCAAA
CCCCTCAGATCCACAGGACGGCGAAGTTGCACGGATGCTGCTCGACAGTCCCGACTCGTTTGTCCAGATGGCTCACGAG
TGGGCAGTCAGGCACGCCGGTGCGCCGCGACAGCGAAAcctCGACgtaaCTatattcagaaGcCtggccagaccaaCaA
CTgctGTCGATGCGAGccGataccaTggatacaagCcagtc

FIG. 2 continued

> SEQ ID NO:4514 216062FL 207919_300830_1c
gccagtacgaacgaacattcagccttgtgcaggggaagcagaagaTCATATAGAGCATTTATCAAGCGAATAACAGACC
CTGAGACACTGAATCAGAGAAGCTTTAGAAGCTCTTCTTCTCTCTGTCTCCGCGCCTCTTATCGCAAACAGCCCCTCTA
CTGCTGCTGCTGCCTTTGTCAGGCCTGTCTTTTCAGTGTCGCATGCCCCGCCTCATCTTTCTACCTTGCACAACTCAGC
CTTTGCGCTAATCAACGACATCTGCGATCTGTGTCGGCAGCAGAAGAGTCCCAGATCACTggtCTCTCTTTTATTCTCC
TTCTTCTAAACAGATCTGTGTTGCCCCCAAAGCAAGCGAGAATACGTCAAGATGGCTCTTCCGAAACGCATCATCAAAG
AAACCGAACGCCTTATGGCGGAACCAGTTCCCGGAATCAGCGCCGTGCCTCACGAAGatAACCTGCGATACTTTGACGT
CGAGATCCACGGCCCTGCATCGTCACCATACGAAGGCgGCATTTTCAAGCTTGAGCTCTTCCTCCCAGATGACTATCCC
ATGACTCCGCCcAAAGATTCGATTCCTTACTAAGATTTTCCACCCAAACGTTGAcaagcTgGg > SEQ ID NO:4515 216062FL 197269_300700_1c
CTCACCTGGCGCGCCGAAGCTTCTCTCCTCTCTCTCAACTCCGGCGAGAGGAGGAGGCGGCGGTGGGGCGTTCGTCGGG
AGAGAGACCAGGGCCGGGGGGCTAGGGTTCGGCCGTTCAGAGAGGCGGCGGCTGAGGAGGAGGAGGAGGAGGAGGAGGG
GGTGAGGAGAGATGTCGACGCCGGCGAGGAAGCGGCTGATGCGGGACTTCAAGCGGCTGCAGCAGGACCCGCCCGCCGG
AATCAGCGGCGCGCCGCACGACAACAACATCATGCTCTGGAACGCCGTCATATTCGGACCGGATGACACGCCGTGGGAT
GGAGGCACGTTCAAGCTGACACTACAATTTACAGAAGATTATCCCAACAAACCACCAGTTGTTCGGTTTGTCTCAAGGA
TGTTTCACCCAAATATTTATGCAGATGGAAGTATCTGCTTGGATATCCTACAAAATCAATGGAGCCCTATATATGATGT
TGCTGCGATATTGACCTCTATCCAGTCCCTGCTCTGTGATCCAAACCCAAACTCCCCTGCAAACTCCGAAGCAGCCAGA
CTGttCAGCGAGAACAAGCG > SEQ ID NO:4516 216062FL 190923_300737_1c
CCCAACTCCATTATTGATTCTTGCAAGGAGGAAGAGCAGCTAGAGGCGAGGCAAGAAAAGAAGTGAAATCTCTCCGTTA
GACAGGAAGAGGAAAAGCAAGGGGGAATTGGGGATGGCGTCAAAGAGGATACAGAAGGAGCTCAAGGATCTGCAGAAGG
ATCCCCCTACATCATGCAGTGCAGGTCCTGTTGGTGAAGACATGTTCCACTGGCAGGCAACGATAATGGGTCCATCTGA
TAGCCCATATGCTGGTGGAGTTTTCCTAGTTACCATCCACTTCCCTCCTGATTATCCCTTCAAACCACCCAAGGTGGCG
TTTCGCACCAAGGTTTTCCATCCAAACATCAACAGCAACGGGAGCATTTGCCTTGACATCCTTAAGGACCAATGGAGCC
CAGCACTAACCATTTCCAAGGTGTTGCTGTCAATCTGTTCCCTGCTGATCCGAACCCTGATGATCCTCTGGTCCC
TGAGATCGCCCACATGTACAAGACAGATAGGCACAAGTACGAGaACACAGCAAGGACCTGGACTcagaggtaCGCcaTg
tagcacctcagataTCGATGGACATGTcgaTGTTGTAACAACATTAtCAACgggtgtgtcTccCTcTcgccttgtgtgg
tgtaaggaTCAAAACcggCtTTgcagtgcaCTCt > SEQ ID NO:4517 216062FL 187287_300675_1c
CTCGTGTCCGCTGCGAAGAAAAGGGGCATATCATGGCATTGAAGCGGATCCTCAAGGAACTAAAGGACCTGCAGAAAGA
TCCTCCAACATCATGCAGTGCAGGTCCTGCTGGTGAGGATATGTTCCATTGGCAGGCGACCATTATGGGTCCTCCAGAT
AGTCCCTATGCTGGTGGAGTTTTCTTAGTGAATATTCATTTCCCCCCGGACTACCCCTTCAAGCCTCCAAAGGTATCTT
TTAAGACAAAGGTCTTCCATCCAAACATCAATAGCAATGGAAGCATATGCCTTGACATTCTTAAGGAGCAATGGAGCCC
TGCTTTGACCATTTCTAAGGTGTTGCTTTCGATCTGCTCGCTGCTCACTGACCCCAACCCGGACGACCCTCTTGTCCCT
GAGATTGCCCACATGTACAAGACGGATCGTCCAAAGTATGAGACGACAGCCCGCAGCTGGACCCAGAAGTATGCCATGG
GATGATGAAACCCACAAGCCCTGAATTCAAACCTGCTGCTTAAATGCAGACAGTCGTGGTAATTGTCCCATGAAAACT > SEQ ID NO:4518 216062FL 182315_300660_1c
GAATTCAGCAGCTAACAACAATACCCCAATACCTAACCCTAATCTCCCGCAGCTGTATAAAACCCTAATCAT
TAGATCCTGAGAAGAATCGGAGTTTTTTCTCACAGCTTTTTCTTACGGCTGTGAGGATGTCGACCCCTTCGAGGAAGAG
GTTGATGAGAGATTTCAAGAGATTGCAACAGGATCCTCCAGCAGGCATCAGCGGTGCACCGCAGGACAATAACATAATG
CTATGGAATGCTGTTATATTTGGCCCAGATGATACTCCCTGGGATGGAGGTACCTTTAAGTTGTCTCTGCAGTTTTCGG
AGGACTATCCAAATAAGCCACCAACAGTTCGGTTTGTTTCGCGGATGTTCCATCCAAATATCTATGCAGATGGAAGTAT
TTGCTTGGATATCTTACAGAATCAGTGGAGTCCTATTTATGATGTAGCTGCTATTCTAACTTCTATCCAGTCGTTGCTT
TGCGACCCGAACCCAAATTCTCCTGCTAATTCTGAAGCTGCAAGAATGTTTAGTGATAACAAGCGTGACTACAACAGAA
AAGTACGCGAAGTCGTTGAGCAAAGCTGGACAGCAGATTAACTGCTCATCCCTAACATGTGGATGTCATTTGACTTATT
CTGTAAAGTTTGAAGTCTACGTAAGTAAACATTTCCACTTGAAAACAATTGTAATACAGACATAAGAGTTATATA > SEQ ID NO:4519 216062FL 179640_300562_1c
tcgacccacgcgtccgaacaatccccaGCCTCACCAAAAAGGACACAAAATAACGACATTCACTCTCTCTCTCTCTC
TCTTCCTCTTTTCTCCATTCTCTCGCGGGTCATCCGCCCACCATGGCCCAATCCACCGCCCACCGCCGCCTCCTTCAA
GAATACCGCGCCCTCACAAACAACCCGCCCGAAGGCATCACCGCCGGCCCCGTCTCCGAGGACGACCTGCTGCACTGGG
AATGCCTCATCCAGGGGCCTGAGGGAACTCCCTTTGAGGGCGGCGTCTTTCCCGCAGAGCTCAAGTTTCCCAAGGACTA
TCCGCTGGCGCCGCCGACGATGAAGTTTCTCGCTGACATGTGGCATCCGAACGTCTACCCCAGCGGCCTCGTCTGCATC
TCCATCCTCCACCCTCCCGGCGACGACCCCAACCACTACGAGCACGCCTCCGAGCGCTGGTCCCCCATCCAGTCCGTCG

FIG. 2 continued

AAAAGATCCTCATCTCTGTTATGAGCATGCTAGCTGAGCCCAACGACGAGAGCCCCGCCAACGTCGAGGCCGCCAAGAT
GTGGCGCGAGCGTCGGGATGAGTACGAAAAGACGGTCCGCGACGGTGTTCGGCGCATGTTGGGTTTGTAACAGCGCATG
TTGGGTTTG

> SEQ ID NO:4520 216062FL 167862_300551_1c
GAATTCAAAAAGACTATAAAATCCAATCAACCTCTCCAATTCCCGGAATCCTCCTTCCTCCTCCGGTTTCTTCCTTTTT
CAGAGCACCGAGTTCCTCTGGATCCTCTCTCCTGGTTTCTTCAAATACCCTTTGGTTTTTTTCCTTTACCCCTCTTGTA
AAATCTAGGGTTTCGAGAGAAAAAAATCTTCAGAGAGGATGGCCTCCAAACGGATCTTGAAAGAACTCAAGGATCTTCA
GAAAGATCCTCCTACTTCTTGCTCCGCAGGTCCTGTTGCCGAAGACATGTTTCACTGGCAAGCAACAATAATGGGTCCC
CCAGACAGTCCATACGCAGGAGGAGTCTTTCTAGTTACTATTCATTTCCCTCCAGATTATCCATTCAAGCCACCAAAGG
TTGCCTTCAGGACAAAGGTATTCCACCCTAATATCAACAGCAATGGGAGCATCTGTCTTGACATCTTGAAGGAGCAATG
GAGCCCTGCCTTGACCATTTCCAAGGTGTTGCTATCCATTTGCTCATTGTTGACGGACCCAAACCCAGACGATCCTTTG
GTGCCAGAGATTGCTCACATGTACAAAACCGACAGGAGCAAGCATG

> SEQ ID NO:4521 216062FL 135317_300413_1c
GTCCTCGTCCTCGCGTAGGCGCGGCGGCCGAGGAACAAGTCCGTCACGCGAACCTTCCAGAACCCCCTCCTCACACGTC
ACGCAACCTCCTCCTCCTCCTCCTCCTCTTTATTACGACTACCCCCCCCCCCCGGCGCCCCCTCCTTTTTTCAGA
TTCGGAGAGACCTACTCGTCGTTAGACCGCCATGGCGTCCAAGCGGATCCTCAAGGAGCTCAAGGACCTGCAGAAGGAT
CCCCCAACCTCCTGCAGCGCCGGCCCTGTGGCTGAAGATATGTTCCACTGGCAGGCAACACTGATGGGTCCATCAGATA
GCCCTTATGCTGGAGGCGTGTTTTTGGTTACCATTCATTTTCCTCCAGATTATCCATTCAAACCGCCTAAGGGGGCATT
CAAGACAAAGGTGTTCCACCCAAACATTAATAGCAACGGAAGCATATGCCTTGATATCTTGAAGGAGCAGTGGAGTCCT
GCATTGACT

> SEQ ID NO:4522 216062FL 1186661_302132_1c
ctctctAGGAAGGCGGAATACTCcttctCTtctcttctcTCTCTCATACCGAGGTattaGGGTTCCACAGGCGGAGAGA
AGAGAGAGAGAGAGAGAGCGTCTTTCTTCCTCTACCGCTGCTACTACTACTGCTACGACCATGTCGGGGATCGCCAATG
CTAACCTACCGCGGCGGATCATCAAGGAAACTCAACGGTTATTGAGCGAGCCAGCCCCTGGCATAAGTGCATCACCTTC
TGAGGATAACTTACGGTATTTCAATGTTATGATTCTTGGCCCAACTCAATCTCCCTATGAAGGCGGGGTTTTCAAATTG
GAATTGTTTCTACCCGAAGAATACCCAATGGCGGCTCCAAAGGTCCGATTCCTGACAAAAATTTATCATCCGAATATTG
ACAAGCTGGGGCGCATCTGCCTCGACATTTTGAAAGACAAGTGGAGCCCTGCACTCCAAATTCGGACAGTCCTTCTAAG
TATTCAGGCCCTTTTGAGTGCACCGAATCCTGACGATCCACTTTCTGAGAACATTGCGAAGCATTGGAAGACTAACGAG
GCAGAAGCTATGCAAACAGCAAAGGAGTgGACCAGGATGTATGCCTGTGGggcctgaaAAC > SEQ ID NO:4523 216062FL 116594_300078_1c
GCACGAAACTCAAAGCATCCCCGGCGCCGCAGCTCCCCGGAGGAGGAAGCCCCGCGCCCCGCCCCGACCAGATCCGAT
GGCCAACAGCAACCTCCCCCGGCGAATCATCAAGGAGACGCAGCGACTCCTCAGCGAGCCAGCGCCGGGAATCAGCGCG
TCTCCGTCGGAGGAGAACATGCGCTACTTCAACGTCATGATTCCTTGGCCCGGCACAGTCCCCCTATGAAGGTGGAGTTT
TTAAGCTTGAACTCTTTTTACCCGAGGAATATCCTATGGCTGCTCCAAAGGTTAGGTTCCTGACCAAAATATACCACCC
CAACATTGACAAGCTTGGTAGGATATGCCTTGACATTCTCAAGGACAAATGGAGCCCAGCCCTTCAGATTCGGACAGTT
CTTTTGAGTATCCAGGCACTCCTAAGTGCACCAAACCCTGATGATCCTCTCTCTGATAACATTGCAAAGCACTGGAAAG
CCAATGAAGCAGAAGCTGTTGAAACAGCAAAGGAGTGGACTCGCCTGTATGCCAGCGGTGCATAAAACCCAATGCCTCT
CGTGATGTAATAACCCGTCATGCTTTAGCCTTAATCAAATGCCAtTTGCTTGATAAGaacaaACTggagataTtggcag
tggaagggAGttTAAATGACTACc > SEQ ID NO:4524 216062FL 115025_300011_1c
CAAATTCTTAAAACTATCTCCACTATCTCTTTCTCTCTCTAGACAAATTAAGAACCCTTAGCGTAAACTCTGCGACCGA
AGAACCCCACCCACCCAGGCAGCCTTCAATTCAATTCCAATGGCGAACAGCAATCTTCCTCGCCGAATTATCAAGGAAA
CTCAACGGCTTCTCAGCGAACCTGCACCAGGAATAAGTGCATCTCCATCGGAAGATAATATGCGATACTTTAATGTCAT
GATTCTTGGTCCTACACAGTCTCCTTATGAAGGAGGCGTCTTCAAGCTCGAACTCTTTTTGCCTGAAGAGTACCCGATG
GCTGCTCCTAAGGTTCGATTCCTCACCAAAATCTACCATCCGAACATTGATAAGCTTGGAAGGATATGTCTTGATATTC
TTAAAGACAAGTGGAGTCCTGCACTTCAGATCCGTACTGTACTTTTGAGCATTCAAGCACTTTTGAGTGCTCCAAATCC
GGATGATCCACTCTCTGAGAATATCGCAAAGCACTGGAAGTCAAATGAGGCTGAAGCTGTTGAAACGGCTAAGGAGTGG
ACACGCCTATATGCAAGTGGTGCATGAAGGCATTAGCAACGAAATATTTAAAAATAACAAAAATTATGGACTGTATCCT
ATTGACTTGCTTATCaATATGGATGgctgttaaTGCCTggACTcttccgAttgcctcccaTaattGCtTccctgtcctt
g > SEQ ID NO:4525 216062FL 1119709_301900_1c
ggccttataaccttagttacctatagtccattgacggttcgcaatcAGAATGGCTACTTCTGCGCAGCTCCGCCTCATG

FIG. 2 continued

```
TCGGACCTCAAAGCCATCCTCAGCGAGCCTCCCGAGGTGGGATTTTTTCTCTTCGTTTGATATTCGGAGATCAATATCC
TGAAAAGCCACCTCGTGTTAGATTTACTAGCGAGATTTTCCATCCAAATGTGTACAACGATGGAACCTTATGCATGGAT
ATAATTCAGGATGCTTGGTCTCCCTGCCACAACATCTGCACTATATTGACTTCAATACAGTCTTTATTGACGGATCCAA
ATCCAGAGAGCCCTGCTAACCCAGAAGCTGCACACTTATATCGGACCGATATTCAAGCATATAATAGGAGGATCAAGCA
GTGCGTAAGAAAGTCTTTGGATAGTTAATGAGTATGGAAtTTCGACTGAAAGTAAACATGACGTAATTTggCTCTTGCT
aggCattcaCAGGTCTAAActaaacTATGGTTAAAGAAGATTGAATAACTCACTA > SEQ ID NO:4526 216062FL 1119652_301899_1c
GAGAAGAACTGTGGTGGGTGGGGGGCCATAATAATAAGAAGAGGTATTATTATTATTATTATTATTAGTATTATAA
TGAGCTTGCAGAGAGGAGGGCAGGAGGGTAGCTTGGCTATGGCGGATGGAAAGCACTCTGGTGCCCCCGTTGATACACA
TTCCGTCGCTCGTAGATTGCAGTCGGAGCTCATGGCATTGATGACCTGTGGGGGGGACCCAGGTGTATCTGCTTTTCCT
GACGGAGACAACATCTTCTCTTGGCTTGGAACCATCAAAGGAAGCACCGCAACTGTCTATGAGGGTCTCTCGTTCAAGC
TTTCTTTGCGCTTTCCAAATGAGTACCCTTTCAAGCCTCCCACTGTGAAATTCGATACCCCTTGCTTCCACCCCAACGT
TGATCAGTATGGCAACATTTGCCTTGACATCTTGCAGGATAAGTGGTCATCTGCTTATGACGTCCGCACCATTCTCTTG
TCTATTCAAAGTCTACTTGGAGAGCCCAATAATGCTAGTCCATTGAACAGTTATGCGGCAACTCTATGGTGCAATCAAG
AAGAGTTCAAGAAGGCGATGCAAAAACATCACAAAGATGCTACTGGACTTAC > SEQ ID NO:4527 216062FL 1118391_301855_1c
agaatggctacttctgcgcagctccgcctcatgtcggacctcaaagccatcctcagcgagcctcccgaggGATGCAGCG
CAAGCCCTTACAATGATGATAATCTCTTTGTGTGGAATGCTACTATCTTTGGCCCTGAGGACAGCCCTTGGGAAGGTGG
GATTTTTTCTCTTCGTTTgATATTCGGAGATCAATATCCTGAAAAGCCACCTCGTgttaGaTTTACTAgcgagatnttC
CATCCAAatggtgtacacaaTggaaactTATGCATGGATATaattcaggatGCTTgGTCTCCCTgccAcaaCATCTgca
CTATAttgacTTCaaTACAGTCTTTAttgacggAtccaaATCCag > SEQ ID NO:4528 216062FL 1118324_301855_1c
TATAACGGCGGTGGCTATTTAAGAACTCCAAGTAGCAGAAGTTATAGTTGAAGAGGGATCTGGATCTGAATCTGAATCT
GTGTCATGGCTAGCAAGAGGATTTTAAAGGAACTCAAGGATCTGCAAAGGGATCCCCCAACCTCATGTAGTGCTGGTCC
TATTGCAAATGATATGTTCCATTGGCAAGCCACTATCATGGGTCCCTTTGATAGTCCATATGCTGGAGGAGTTTTTCTG
GTTACCATTCATTTCCCCCCAGACTACCCATTTAAGCCTCCTAAGGTGTCCTTCAAAACCAAAGTCTTCCATCCAAATG
TCAATAGTAATGGAAGCATTTGCCTTGACATCTTGAAGGAACAATGGAGTCCTGCTCTAACAATAGCAAAGGTCCTACT
CTCGATATGCTCTCTTTTGACTGATCCCAATCCTGATGACCCTCTGTTCCAGAAATAGCCCACATGTATAAAACAGAC
AGGGCAAAGTACGAGACAACTGCAAGGAGTTGGACCTTGAAGTATGCTATGCCCTAAATAAAGCTCACCTCTTGCCTTG
CATATAGTTGAGGTATATATATTATATATATACACAcgTTATTACATATGcaactactattgcattgctatAATcttt
gctagaatCTCCAATAAGATATgtaatatg > SEQ ID NO:4529 216062FL 1117629_301848_1c
AGAAAAGGATTGAGATCGGCAAAAGACAGAAGGATTTCGCATTCCTGGGTTTGTTGTGTGACCGAAACTGGATGGATAA
GCCTCTTTAACCCCAACAAGGGCAGCGTTTAATCACTTTCAACAAGTCCGGGGGGTTGGTTGCATACAATCCAACATAA
GCTTTCACTTTCTTCCAAAGGCGATCAATCTCTTGCCACAATGTCCACGCCGTCAAGGAAGCGTTTGATGCGTGATTTC
AAGCGGCTTCAACATGACCCCCCTGCTGGTATTAGTGGTGCTCCGCAGGACAACAATATCATGCTTTGGAATGCTGTCA
TATTTGGGCCGGACGACACACCTTGGGATGGAGGCACTTTCAAATTGACCTTGCAATTCTCGGAAGACTACCCCAATAA
ACCTCCAACAGTTCGTTTTgTGTCAAGGATGTTCCATCCAAACATCTATGCAGATGGAAGTATCTGCTTGGACATTCTG
CAAAATCAATGGAGCCCCATATATGACGTTGCAGCGATACTTACATCTATTCAGTCTTTgctTTgcgATCCGAACCCGA
AtTCTcCtgcgaaTtcggaggCAG > SEQ ID NO:4530 216062FL 1117116_301818_1c
ttcccatctctctctttctctctcTCTAGGTATGGCGTCGAAACGGATACAGAAGGAGCTGCAGGACCTGCAGAAGGAC
CCCCCGACGTCATGCAGTGCCGGGCCGGCTGGGGAGGACCTCTTCCACTGGCAGGCCACCATCATGGGCCCCTCTGATA
GCCCCTACGACGGCGGCGTCTTCTTCATCACCATTCACTTCCCCCCTGACTACCCCTTCAAGCCCCCCAAAGTCAGCTT
CCAGACCAAGGTTTATCATCCAAACATCAGCTCGAACGGGAGCATTTGCTTAGACATTCTAAAGGAACAATGGAGTCCA
GCGTTGACGATTTCAAAGGTGTTGTTATCCATCTGCTCTCTGCTTACGGATCCAAATCCAGATGACCCTCTTGTCCCTG
AGATCGCTCACATCTACAAAACCCAGAAGGCTCGCTACGAGGAGACcGCCCGAGCATGGACCCAGAAATATGCAATGAA
CTAGTTGAAAAATTTCCTTACATATCCTTGCCCACCCTTCAAACTATAATAAGCATAAggTATGCTTTCTATATATGGA
GGCTAATCGTTAttgttTCTCCgtTgTCTTTCTCTATCATCAATCACAGttTCttg
```

FIG. 2 continued

> SEQ ID NO:4531 216062FL 158243_200002_1c
tgttttagtGAGACAAAGAGTGTGAAACTCTCTTACAATTTCTACTTTCTCTCTCTAGAAAAAAAGAGACCCTTAGCG
TAAATTTTCTGCGATCAAAAAAAGAATTCGATTCAATTCAATGGCCAACAGCAATCTTCCTCGAAGAATTATTAAGGAA
ACTCAACGTCTTCTCAGTGAACCCGCGCCGGGAATAAGTGCGTCTCCTTCGGAAGAAAATATGCGATACTTCAATGTCA
TGATTCTTGGTCCAACACAATCTCCTTATGAAGGAGGTGTTTTCAAACTGGAACTCTTTTTGCCTGAAGAGTACCCAAT
GGCTGCTCCGAAGGTTCGATTTCTCACCAAAATATACCATCCCAACATTGATAAGCTTGGTAGGATATGCCTTGATATT
CTCAAGGACAAGTGGAGTCCTGCTCTTCAGATTCGCACCGTTCTTTTGAGCATTCAAGCACTTCTGAGTGCACCAAATC
CAGATGATCCACTCTCAGAGAACATTGCGAAGCATTGGAAGTCGAATGAGGCTGAAGCTGTTGAAACGGCTAAAGAATG
GACACGCCTGTATGCAACCGGTGCCTGAAACGGCATGACTAAGTGATTTTGAAAAGAAAAAGAAAAAAGATGTGGAATG
TAATTTATCCACTGTCTAATCAGGGGACATGGGAGGACTGAAAGCTAAATTACCATCTATAATATTTTCCCTACCCTTG
AAATTGTATAGTCAAATATTGCACCTTTTTAttCCAAGTTGAAgaaaCTt > SEQ ID NO:4532 216062FL 156775_301369_1c
aaaataaaacccccttttttcccATTCCGATCAAATTGAATCAATTGATTTAAGGTTCTTCTGAGCTGTGAAGTGCTTGT
TCTGATTATAAAGGATTGAATAAGGATGCAGGCTTCAAGGGCAAGGCTTTTCAAAGAGTACAAAGAAGTACAGAGAGAG
AAATCTGCTGATCCAGATATTCAATTAGTTTGTGATGATTCTAATATCTTTAAATGGACGGCTCTTATTAAAGGGCCAT
CTGAAACTCCTTATGATGGCGGAGTTTTCCAGCTTGCTTTCTCAGTTCCGGAGCAGTATCCTTTGCAACCTCCTCAAGT
GCGGTTCCTGACCAAAATATTTCACCCAAATGTTCATTTTAAGACTGGAGAGATTTGCCTTGATATTTTGAAGAATGCA
TGGAGCCCAGCATGGACACTCCAGTCTGTTTGTCGAGCTATAATTGCTTTGATGGCTCACCCCGAAGCTGATAGTCCAC
TAAACTGTGACTCAGGCAATCTTCTTCGATCTGGTGATATCAGAGGATATCAGTCAATGGCAAGGATGTACACTAGACT
TGCAGCAATGCCCAAGAAAGGCTAAAACAATGAGCTACAACCTCGTTCGCACAGCTTGTAATAATGGCATTAACAAAAG
TTGAATTGTTGCATATCCGTGTTTAGTGTTTTCTAACAGCAGTGCATGACCTATtgtttATTAATCCTTTTGTTTTTC
GcATAtTtCTGATACaGCTCATCTCatttagcaggtTTCttgtgTGCCTttagcaaGtggaataTgtataAa > SEQ ID NO:4533 216062FL 145271_301058_1
tacgaaaccaacaaggaagagaatcaaattcttctattcccaataattcTCTATTCAGATTCGATCTCGGTCTCTGAGT
GATGGCTTCGAAACGGATCTTGAAGGAGCTCAAGGATCTCCAGAAGGATCCCCCTACCTCTTGCAGCGCCGGCCCCGTC
GGAGAGGACATGTTCCATTGGCAGGCCACAATTATGGGTCCCCCAGACAGCCCTTATACCGGTGGTGTATTCCTAGTTA
CTATACATTTTCCTCCTGATTATCCATTCAAACCTCCTAAGGTTGCTTTTAGAACAAAAGTTTTCCATCCAAATATTAA
CAGTAATGGCAGTATATGCCTGGACATATTGAAGGAGCAGTGGACCCGCATTAACTATTTCCAAGGTTTTGCTTTCA
ATTTGCTCTCTTTTGACGGACCCAAATCCCGATGACCCCCTGGTGCCGGAGATTGCTCACATGTACAAGACAGACAGAG
CTAAATACGAATCAACTGCCAGGAGTTGGACCCAGAAATATGCCATGGGTTAGAACATTACCTATACGGGCCCGAGTCC
ATGTAAAAAGAATTCATGTGCCTGTTCTCTCTCCTCTCAACCagCAAAGTGTAGAATAGCATTAAATGTTGTCCTCT
ccAAGAAAAAGAGATGCTTTGAATATTTTTATATGGATTCTAACATtTTAAGAAATCTGGGAACTgttTATTTATCTGG
tt > SEQ ID NO:4534 216062FL 136820_300439_1c
GAACGGCTGCGCGTCTTCCCGTTCGTCCTCCTGTCCGGTCCGAGCCCCTCTGACGACGCGACTTTCCCCACGCCGGGAT
CGAGCTCCGGGGAGGGGAGCTGCGAGCTGAAACACTTTGTCATATCAGTCAACAGTAGAGAGGAGACCAGATGCAGGCA
TCTAGAGCTAGGCTCTTTAAGGAGTATAAGGAGGTGCAGCGAGAAAAGTCAGCTGATCCAGATATCCAGTTAATCTGCG
ATGATTCAAACATATTCAAGTGGACTGCTCTTATCAAGGGCCCTTCGGAGACACCTTTTGAAGGTGGTGTATTTCAACT
TGCATTCTCTATTCCTGAGCAATACCCTCTCCTTCCTCCGCAAGTTCGCTTCTTGACCAAAATTTTCCACCCGAATGTG
CATTTCAAGACAGGTGAGATTTGCCTGGATATCTTGAAGAATGCGTGGAGCCCAGCATGGACACTACAATCCGTTTGTA
GAGCCATAATTGCATTGATGGCCCATCCTGAACCAGACAGTCCACTTAACTGTGACTCAGGCAACCTCCTGCGCTCAGG
CGACATCAGAGGCTATCAATCCATGGCAAGAATGTATACTAGGTTGGCTGCCATGCCAA > SEQ ID NO:4535 216062FL 126473_300463_1c
GCCATTACGGCCGGGAATCAAAATCTATCTCAACCCTTCtgtCTTCTTCTTCCCCTTCAGTTTCTCAAAAATTCTCAAG
AAGAAGAAGAAAGAAAGAAAAAAATCGTCTCCTTTTCTGTTCAAAAAAAATATATCTTGAAATTAAAAATTCAGATGGC
TACAATGAACAGTGGAAACAACAGCAATACTCAAGCAACTGCTCAGGTTATGCCTTCACCTAAACAGAGTTTGCCTACT
GCAAAAACTGTTGATACCCAGTCTGTTCTTAAAAGGTTGCAGTCTGAATTGATGGCTCTAATGATGAGCGGTGATTCTG
GGATATCTGCATTTCCTGAAGAAGACAACATATTTGTTTGGAAAGGGACAATAACTGGTAGCAAAGATACTGTTTTTGA
AGGAACAGAATACAAGCTCTCTCTTTCATTTCCTGCTGATTACCCTTTCAAACCACCAAAGGTTAAATTTGAGACTGGT
TGCTTTCATCCCAATGTTGATGTCTATGGCAACATATGCTTAGACATTCTTCAGGATAAGTGGTCATCTGCTTATGATG
TGAGGACTATACTGATTTCCATTCAGAGTCTGCTTGGAGAGCCAAACATAAGCTCACCTCTAAACACTCAAGCTGCTGC
TCTTTGGTGCAATCAAGaaGAATACAgaaAGAtg

FIG. 2 continued

> SEQ ID NO:4536 216062FL 125232_300629_1c
GGCGTCGATTCTCTTTGACACTCGTGCCGCTTCATCACTCAGGCGGTCAGGGATGTCGACGCCAGCGAGGAAAAGATTG
ATGAGGGATTTTAAGAGGTTACAGCAGGATCCTCCTGCCGGCATCAGTGGTGCTCCGTATGACAACAATATTATGCTCT
GGAATGCCGTTATATTCGGTCCTGATGACACACCTTGGGATGGAGGTACGTTCAAGCTCACCCTTCAGTTTACGGAGGA
CTACCCCAACAAGCCTCCAACTGTGCGGTTTATTTCCAGGATGTTCCATCCAAATATTTACGCCGATGGAAGTATATGC
TTGGACATACTGCAAAATCAGTGGAGTCCTATATATGACGTAGCTGCTATACTTACTTCAATCCAGTCTTTGCTCTGTG
ATCCAAACCCAAACTCGCCAGCAAATTCAGAAGCAGCACGCATGTTTAGTGAGAATAAGCGCGAGTACAACAGGAAGGT
GCGTGAGATTGTTGAGCAGAGCTGGACAGCAGACTAACATCTCTCAGGCTGAATCTGTTTTGGGAGATTTTCCTGGTAC
CGCCTGTGTCGAGCTGAAAACTTTTCAGTGCCGTTGCTACATTAAAAACAAATGTAGCAGGAAATTGTACTTTTATGTG
TTGTAGGAAACTCTGATTGCCTTTATCTTCATGTTCTGCTACTCGACTATGAGACGTTGTACATATGATGATCTCTTGT

> SEQ ID NO:4537 216062FL 124562_300423_1c
agaaatcaaatcgacccctctactcctcTAAATCCCCACACCCATCTCTCTCTCTCTCTCTCTCCTCAATCGAAGGATCC
GACAATAAAAGTTGATTGTCTTCAACATCTGTCTACCAGCAAAAACTACTTGCGTGCAGTCGCCAACTGATCCTAGGAT
TATACTTACATTTGGCTATGGCAACTAATGAAAATCTCCCACCAAACGTGATAAAACAATTGGCAAAGGAATTGAAAAA
TCTTGATGAAACTCCTCCTGAAGGCATCAAAGTAGGTGTCAACGATGATGATTTTTCAACCATATATGCTGATATCGAG
GGGCCAGCTGGGACTCCTTACGAGAATGGGGTTTTCCGCATGAAGTTGATTTTGACGCATGATTTCCCTCATTCCCCAC
CCAAAGGTTATTTTCTGACCAAGATTTTTCATCCCAACATCGCTTCCATTGGCGAAATTTGTGTCAATGCTCTGAAAAA
AGATTGGAATCCTAGTTTGGGCCTACGACATGTTCTCATGGTGGTAAGGTGTTTGCTGATCGAGCCATTTCCAGAATCT
GCGTTAAATGAGCAAGCTGGTAAAATGCTGCTTGATAATTATGATGAGTATGCTAGACATGCAAGGCTTTATACCAGTA
TTCATGCTAAACCAAAGaCTAAGTTAAAAACA > SEQ ID NO:4538 216062FL 121412_300357_1c
ATTTGATCGGAGGGTGAATATGTCGACGCCAGCAAGGAAGAGGTTGATGAGGGATTTCAAACGACTGATGCAGGATCCT
CCAGCTGGCATAAGTGGGGCCCCACAGGACAACAATATAATGCTTTGGAATGCTGTAATTTTTGGCCCTGATGATACTC
CTTGGGATGGAGGTACGTTCAAGCTGACACTTCAGTTTACTGAAGATTATCCTAACAAGCCACCTACAGTGCGATTTGT
TTCTCGGATGTTTCATCCTAACATTTATGCTGATGGGAGCATATGCTTAGATATACTACAAAACCAGTGGAGCCCCATA
TATGATGTAGCTGCTATACTCACATCCATCCAGTCGCTGCTTTGCGATCCAAACCCAAATTCACCTGCCAACTCTGAAG
CTGCCCGCCTATTCAGTGAGAACAAGCGGGAATACAACCGAAAAGTTCGTGAGATAGTGGAGCAGAGCTGGACCGCGGA
CTGATCCACTCCATCTAACCATATGATGCCTGATACTTAAAACGCTCATCTTTTCAGTGTGTCGTGTACCAAACTGCTT
GTAATTAAAATGCTAAAACAGTAAAACGTGC > SEQ ID NO:4539 216062FL 120926_300518_1c
CGGACGCGTGGGCGCAAACGGCGAAGCAGAAGGGGGAAGGAGAGAGAGAGAGAGAGAGAGAGAGAGGGGGACTCAGCGA
GCGGTGGGCGAGAGGGGGAGATCGAAACCCTAGCTAGGGTTTGCCGCGCGGCGGCGGCGGGGATGTCGACGCCGGCGAGG
AAGCGGCTGATGCGGGACTTCAAGCGGCTGCAGCAGGACCCGCCCGCGGGGATCAGCGGCGCGCCGCACGACAACAACA
TCATGCTCTGGAACGCCGTCATCTTCGGGCCGGATGATACGCCGTGGGACGGAGGCACGTTCAAGCTTACCTTGCAGTT
TACAGAAGATTATCCCAACAAGCCGCCGACTGTTCGGTTTGTTTCTAGGATGTTCCACCCAAATATTTATGCAGATGGA
AGCATCTGCTTGGATATTCTACAGAACCAGTGGAGCCCTATATATGATGTTGCTGCCATATTGACTTCAATTCAGTCTT
TGCTGTGTGATCCAAACCCCAACTCTCCAGCAAACTCAGAAGCTGCCAGACTGTTTAGTGAGAACAAGCGAGAGTACAA
CCGCAAGGTTCGTGAGATCGTGGAGCAGAGCTGGACAGCTGACTAGGGCATGCAGCAGGGCAACGGGTGGTATCCACCA
TGCC > SEQ ID NO:4540 216062FL 1197049_302200_1c
ATGGCTTCCAAAAGGATTCAGAAGGAGCTGAAAGACTTGCAGAAGGACCCCCCCACATCATGCAGTGCAGGTCCTGTTG
CGGAAGATATGTTTCACTGGCAGGCAACAATTATGGGACCAGATGACAGTCCTTATAGTGGTGGTGTGTTTTGGTGAC
GATTCATTTCCCCCCAGATTATCCCTTCAAGCCCCCCAAGGTTGCTTTTAGGACCAAGGTTTTCCACCCAAACATCAAC
AGCAATGGGAGCATTTGCCTGGATATATTAAAAGAGCAATGGAGTCCAGCTCTGACAATATCTAAGGTCTTGCTTTCAA
TCTGCTCACTTCTCACTGATCCAAACCCCGATGATCCTCTGGTACCTGAGATTGCACACATGTACAAGATAGACAGAGC
AAAATATGAAGGTATTGCAAGGAGTTGGACACAGAAGTATGCAATGGGTTGAGCCTTTTTTTCGGCAAAAGATAACAA
CTTTTATCAGTCTATCTCATATCTAAAAAGAATCGGTTTACAACTTTCTGTTTCTGCATCTTGTTGGTCCAAAGCTCAA
ATCACACGTGTATCTTTACTTTCATAGCCAAGGAGTTGATATAGAAGTAGtGCAAGGAACAGGTAC > SEQ ID NO:4541 216062FL 1190701_302176_1c
TCCGCTCACTCACTTACTCACTCACTGCTTACAGATTTAGGGATTCCAGAAAGCAAGCTGTGCGAGCGGTCCTTCATGG
CTCTGCTGATCTAGTTGAAGATTACCTGACCTGACTTCGTTCCTCCATGGCAACAAATGAAAATTTACCACCTAAAGTC
ATAAGGGAGCTGGCTCGGGAGCTAAAGGCATNGGATGAGAGCCCTCCGGCGGATATCAGAGTGCTAGTTAATGAGGACA
ATTTGTCCATCATATATGCAGATATTGAAGGACCATCTGGCACACCATATGAGGGAGGCGTCTTCCGCTTGAAGTTGGT

FIG. 2 continued

CTTAAGTCAAGATTTTCCGAATACACCTCCCAAGGGATATTTCATCACAAAGATTTTTCATCCAAATGTAGCCAACAAT
GGGGAAATATGTGTGAATGTCCTAAAAAAGGATTGGAAGCCTGTGTTGGGGTTGCGACACATTCTTTTGGTAATCAGAT
GTTTACTCATCGAGCCATTCCCTGAATCTGCCTTGAATGAGGAAGCGGGGAAAATGCTTATGGAAGATTATGAGGGCTA
TGCGAAACATGCCAGGCTAATGACGAGTATCCATGCAAACAAATTGAGGGCAAAGACTAGCAATAGCATGAATGCGGGT
GGTCCAGGTCCAACTGAACTGGTAAGCTCTATGACTACTAACAATAGCATTTTAACTCCAAGCTCAGATGCGGGT

> SEQ ID NO:4542 216062FL 143665_200045_1c
CGGTAGTAGTAGTGGAGGAAGAACATGGCCGTCGACGACGTCGGTGTCTAGTTCCGGTAAGAGAATACAGAAGGAAATG
GCTGAACTAAGCATAGAGGCGCCACCAGATTGTGCAGCTGGGCCTAAAGGCGATAATCTTTACCATTGGGTTGCCACCC
TCTTCGGCCCACCTGGAACACCTTATGAGGGTGGAATATATTTTGTCGATATAACCTTCCCTTCTGATTATCCATTTAA
ACCTCCAAAGGTTGTATTCAAAACTCGCATATATCATTGCAATGTCGAGCCTTCTGGAAATGTTAGCTTGGACATCCTA
ACAGATAACTGGAGTCCAGCATTAACAATCTCGAAAGTACTACTTGCTCTGAGATCAATGTTCACCACTCCAGAAACCT
ATAAGCCAGTTGTTCCTGGTATTGCACACTTATACTTTGAAGATAAAGCCAAACATGATGAAATAGCTACACAATGGAC
ACTGCGATTTGCAAGGTGAAAAAATGAATTCAATGTGGAATTTTCTTAACCAAGTTCTGGTCAGCCCCCTG

> SEQ ID NO:4543 216062FL 1116844_301815_1c
CCCACGCGTCCGTTCAGTTTGGGGTGAGTTTGAGGGGTCAGTAGTAGTAGCAGTAGCAGGGGAAAGGGGAAGGGAGAGC
GGTATGGCTTCCAAGCGGATCCTGAAGGAGCTCAAGGACCTCCAGAAGGACCCCCCCACCTCTTGCAGCGCAGGTCCTG
TAGCCGAGGATATGTTTTATTGGCAAGCAACAATAATGGGTCCACCTGATAGTCCATATTCTGGGGGGGTGTTTTGGT
CACCATTCATTTCCCTCCTGATTATCCCTTCAAGCCTCCAAAGGTTGCTTTCAAAACTAAAGTCTTCCACCCGAATGTC
AATAGCAATGGGAGTATCTGCTTGGATATACTGAAGGAACAGTGGAGTCCGGCTCTTACCATCTCCAAGGTTCTTCTGT
CAATATCCTCTTTGCTTACCGACCCCAATCCAGACGATCCCTCGTTCCGGAGATTGCACACATGTACAAAACGGACAG
GATGAAGTATGAAACAACTGCAAGAAATTGGACCAGGAAGTATGCCATGGGATAAAGACAGGATCTCGTTTCTTCTCA
TAC

> SEQ ID NO:4544 216062FL 1116092_301809_1c
TCTGTTTTTCTGTGAATCCCTCGCAGAGAGTATCTCCACTACTAGCGCGCCAGAGATTTTCTGCCATCCTGTCGTTGCG
GGAATTGTTATTATAAAGAAAATGAGCTTGAACAGAGCCTCAGGCGTGGTGATGAACGGGGTGATGGGTGACCCTGCTG
CCCCTGTCCCTGCTGCAGCTGCTGGAAAGCAGTCTGCCCCTGCCTCCCATCCCGTCGAAACTCACTCCGTCTCTCGCAG
ATTGCAGTCGGAGCTCATGGCATTAATGACAAGCGGAGACCCAGGCGTGTCGGCCTTCCCGGACGGAGACAATATTTTC
TCATGGATGGGAACCATCAAGGGGGGAACCGGAACTGTCTACGAGGGAATGTCTTTCAAGCTCTCTTTACGCTTCCCCA
ACGAGTACCCATTCAAGCCTCCCACTGTGAAGTTCGACGGTGCATGCTTCCACCCGAATGTCGACCAGTTTGGCAACAT
CTGGCTCGACATCCTCCAAGACAAGTGGTCATCTGCTTACGATGTGCGTACAGTCCTTCTCTCCATTCAAAGTC

> SEQ ID NO:4545 216062FL 1111370_301534_1c
GAGCGCATCTCAAAAGCCCCAAGCCTAGGGCCTGTCTTCCCCTTGGAACAAAAGCACCCCCCACCCATAGCCATTAGCC
ATTAGCCATTATGTCAGAAACTCAGGCTAGCCTTCTCCTTGGCAAACAACTTAGAGAGCTTTTAAAATCTCCAGTGGAA
GGTTTCTCAGCAGGGCTGGTGGATGATTCTAACCTCTTTGAATGGAATGTGACCATTATTGGTCCTCCTGATACATTAT
ATGAAGGTGGTTTCTTCAATGCCATTATGAGCTTTCCCAAAAATTATCCAAATAGTCCTCCAACAGTCAGGTTCACCTC
TGAGATGTGGCACCCAAATGTGTATCCGGATGGCCGTGTTTGTATTTCCATTCTTCATGCCCCGGGGGATGATCCAAAT
GGATACGAACATGCTAGCGAGCGGTGGTCACCAGTGCACACGGTGGAAACCATTCTATTGAGCATCATTGCAATGCTTT
CCAGTCCAACGACGAGTCTCCGGCAAATATAGATGCAGCAAAGGAATGGAGAGAGAACAGGGCGGAGTTTAAGAAGAA
AGTGCGTCGCATTGTACGGCGATCTCAAGAGTGTCTCTGAATTTGGCAATATACCAGGGTATGTATCCTCATTGAGAAA
CCCTTGAAACTTCTCTGAATTGATagaAAAAAGGAAGGGACATACATATATATcaga > SEQ ID NO:4546 216062FL 1110673_301541_1c
TGCTTACAGGCGTTAGAAGAGAAGACGGAGAGAGAGAGAGAGAAGGGAAGTCCAGGCGTCTCTATCTTTCTTACTCTGC
CCTTCTCAGCATTCCCACTGCCATGTCCACCCCTGCACGGAAGCGCTTGATGCGCGACTTCAAGCGGCTTCACCATGAT
CCCCCTGCTGGCATAAGTGGTGCTCCTCAGGACAACAACATTATGCTTTGGAATGCTGTCATCTTTGGGCCGGATGACA
CACCATGGGATGGAGGTACGTTCAAGCTGACATTACAATTTTCTGAGGACTATCCAAATAAGCCTCCGACGGTCCGTTT
TGTGTCGAGGATGTTCCACCCAAACATTTATGCCGATGGAAGTATCTGCCTGGATATTCTGCAGAACCAATGGAGCCCA
ATCTATGATGTCGCAGCAATACTTACATCCATTCAGTCTTTGCTCTGCGATCCAAACCCGAACTCTCCGGCAAATTCCG
AAGCAGCACGAATGTATAGCGAAAACCGGCGAGACTACAACCGGAAAGTGCGCGAAATAGTGGAGCAAAGCTGGACGGC
TGAATGATGGATGAACTGTCTACCTCTAGTGATATACAAGTGTGTCGAAACAGTTGCATGAGGTTGAACTAATTCTCTC
CTTTTACAAGTTTGGCACTTTCGTAAAAATTCT

FIG. 2 continued

> SEQ ID NO:4547 216062FL 110920_300048_1c
CCCACGCGTCCGGTCGTTGCTTAATTACTGTTCATTCACAGGAGGATCCTAATCTCTTTCAGGAGTCGCTATGGCTTCA
AAGCGGATCTTGAAGGAGCTCAAAGATCTTCAAAAGGATCCTCCTACTTCGTGTAGTGCTGGACCTGTTGCTGAGGACA
TGTTTCATTGGCAAGCAACGATAATGGGTCCTCCAGATAGTCCTTTTTCTGGTGGTGTTTTTCTGGTGACGATTCATTT
TCCTCCAGATTATCCATTCAAGCCACCTAAGGTTGCTTTCAGGACAAAAGTTTTCCACCCAAACATAAACAGCAATGGG
AGCATATGCCTTGACATTTTAAAGGAACAGTGGAGCCCTGCCCTAACGATTTCCAAGGTGTTGCTTTCAATATGTTCTC
TTTTGACGGACGCCAATCCTGATGATCCTTTGGTCCCAGAGATTGCACACATGTACAAGACAGACAGGAACAAGTATGA
GACAACTGCAAGGAGCTGGACCCAGAAGTATGCCATGGGCTAAACGTACCTTTGTATCATGGGGTCAAGGGCATTTTAC
TTTCAGATACTTCACTATTTACATTCAATGTACTAATCTGTTCTTTGAGTTGTAACATGGAGTCCATGTCTTAAGAGGA
AAGGAAAATCATGGACGCTGCTCCTAAAAGTTTGTATGTGCAAATTGATCTTTGAAAGAAACCAATTAATTAGActtTT
ctttc > SEQ ID NO:4548 216079FL 179591_300561_1c
tcgacccacgcgtccGATTCAACCTCTTCCATCAGTACTTGCTGTCATTGTCACACAGTGTTATTTTCGCGCGAGAGTG
GCACCTATTCGACAATGATTGAGGAAAAGAAAGACTTTTTCCCGGGCTTCAGCGCCTTGTCTGAGCAAGTCTATATCCG
CCACCCCGACGAACAAAATGAGGCTGTGAAGCGCCCTACCGATCCTCGGGCCGTCCTCATCTATTCCTGGGGCGATGGA
CAGCCAAAGAACGTGGTCAAGTATGCCGACGGATACCGGAATCTCTTCCCCTGCTCAACGCAGATCGTCGTGCTGGCCC
CCATCTCAAAGGCCATGTGGTCAAACCTCGACCAGCGCACGCAATCCATGAGACCTGTCATCGACGCCATCTTCCCGAA
GGAATCGGAAGATGACAAGGACTCTCAAAAGGTCGAGGACCGCGTGCTGGCTCACATCATGTCCAACACTGGAGGTATC
AACTATGCGGCGACGTTGAATGCCTACCGCCTTGTTCACGATAAGCCGATGCCGCATCACTTGCTGGTTCTCGATTCTA
CACCTGGAAGCGCCATCTTGACCCGCGAGAACTTGGGCCGCTGGTCACGCGCCATGCCCTGGGCACTGCAAACTGGTT
CCCTTGGCCATTTGCCGTCACACAGACGCTTTGGGCTGGATTCCTCTGCGGAAACCGCTTCATCGAATGGGTCATTGGC
AAGGAGCCCGCGCCGGTGTTCAGCGTCAAAGCGGTGATTAACCCATACTACGAGaccAAGGATACGCGACACTTGTATA
TCTACAGCGAagATGATGATCTCATCCCGTATCaggAAATTGAAGAGCACATTGCACAAGCACGGAAAAGGGGATACAA
GTCTGATAATCACATGTtTcaagggaAGcggccaTGTGCGCCACATGCAAATGtttaatGgagagtActggggAGCTATC
GGAACGTCGTGgaatagagcGACGAGCGaGCCTTCTGaggAGGCGTAATGGGTTgtGCTCAAGGCcAAAaGgggtcccg
atggaaatttgcGTTGCTTTcTATAGACGAACTCGCGTTg > SEQ ID NO:4549 216108FL 206532_300823_1c
TGTAGAACAATCTCTCTTTGTCCTGTAGTCTCTTTGACTTATAATCTGCTCTATCCTGCTGTTGCGTGGAAGCTTCAGA
GTCCTCCCTTTGTGTGTGCGCGTGAGCCGAAACAATCACCACAATTGCTGCTCGCACGCCCCGGAAACAACAAAGAGCC
CGCTGATCCGATCCGCCATCTCCGGCATACAATGCGCCGCTGCTCTTCTTCTTCATCAATCAGCTCTCAGTGGTCCTCT
ATAAGCGACGACCAGCTCAACTCCATCGTCCACATCAACAGCATCACCACCGCCGCCACCACAGTCACCGCCAGCAACT
CGTCTGTTGTATCTTCATCTGCCTCTGTTGCACCCTCAATCATGCCTTCAGTCCACACAATGTCTGAGCGCCGCCCTTC
CACCCCCCAGTATGAGCGCAGTCGCCAGGGAAGCACATGCTCCGTACTGAGCTGCGGCGGCATGAGCCCTGATGCGACC
AAGGAGCTGTGGAAgaCCATGTTGGAGCTCCAAGAGCGATATGGATGTTACACCTCAGCCAGAATGGATATGGCCGTTG
GAGCGGGAGACATGGCTCTCTCTCTAATGCCAAATCCATTTATtctcGaTACgCTAAACGACTCCGtCGTcgacctgcc
tgACGagggctgggagatgctcaaTCGCTgTctc > SEQ ID NO:4550 216130FL 210976_300894_1c
AAACAACCATGCCTCACAAACACAAGTCAAAAAGGGCGAATTTGAAGCAGAGTTCGTTTGTGAGCGTACCATGAGTAG
ATTTCACTGACTAATCTTGGAGCTAGATTCGATCTCGCCCCTACAGAGAAAGCGCGATCTCTTCCAGTAAACAAACGAA
AAGCGGCATCAAGTTCTGGAGAGCAAGTCACAAAGAAGCGTGCCAGAAGCTCATTAAGAGGCAATGACACTCCGCGAGC
ATTCAAGAGAATCATGGCTGTGGCAGGGGGGAAGAAAATTAGATCAGGCTTGGATGATGGTCAACTCGACAAAACGACT
ACGAAGGCTACCGATGTAACGAGCGAGAAACTTCAAATTCGTCCCGGTGAAAATTTAGGGGCCTTTGCCAGCCGGGTTG
ATGCGGCTCTACCAGTATCAGGGCTTGCGAAGAAAACCAGCACGAATGCAGAGGGCAAAGACGCATTAGGATTGAAAGT
GTATCGCACTCGCAAAGAGCGCAAAATGCACAAACTCTACGATCAGTGGAGGGCAGAGGAATCCAAGATACGAGAAAAG
AGGGAGGAGGAGCTAGAGCGCATAGCAGAACGCGACTTGGAAGACGATGCTGCCGGCATTCTTACTTCAGCTGCCTTCG
AAAACGACAATAGCCACACGAAAAAGAGGAAGGGGGGCAAGAGGAAGAGAATAGTAGAGGAAGa > SEQ ID NO:4551 216131FL 195983_300639_1c
gcgctgAGAAGCCTGCATCGCCCGCCATGGCCATTACGCCGACCCAATTCGCCAAGAAGACGGCGCAGTCGACCAGCTG
GTCGGATGCGAAGCGTCGAGTCCTTTCTTCGTACCGCGAATGGATCCGAGCTGCGCCTGAGATCCAGACCATGTACAAT
GTCCCTCTCCCCATTTCTACCCTCCGAACACGGATGCGACAAGAGTTCGAGCGACACCGATACACGAACCAGCTGTCCA
TAGTTGACGTGCTTCTCTTCAAGTCCCATGCAGAGTACCAGGAAACAATGAACTTCTGGAAGCAGCAGACTCACATCTT
GTCTTATTTCGGCGAAAACTTTAGAGGTGACAAGAGGCTTCCGTCCAGCTTCATGGCTGGTTTCCTTGAGGGTCGAAAT
TAGAAAGACAATGCAAGAAAGTTTGTTTTGTAAATATCTCTGTATAAAGATTTTGTGCCGAAACCCTCCAATAaaaAaa
aacacaacaacac

FIG. 2 continued

> SEQ ID NO:4552 216156FL 200449_300759_1c
gtgcatctcacaTTCACTTCCTGAGGCCGCATCTCATTCAGCTTTTACCCCACCATCTCACAGCCCATCATCTATCTCA
TCCAACCTCTCACCACAACAGCACCTACATCTACAAGAGAGAACACTTCCCTCTTGAAAAAGTAAACCTAAATAAACAC
ATCAAATCAAAATCCTCCATCATGGCCGACAAAGACCGCATCACCTGCCACGTCCTCGACACCACCGCCGGCCGCCCCG
CAAAGGGCATCCGCGTCCGCCTCGAAGGCCCCGTCCCCAGCTCTCCCAACGCCCACACTGCCGTCAACACCTTCGAGTC
CCTCACCAACGACGACGGCCGCATCACCGTCTGGCTGCCCTACTCCTCAGAGTCCTCGGCCGGCGAGGTGCCCGTCTAC
ACTCTCGAGGACGTCCTGGGCGCTATCAAGGGGCCTTCCCGGTGGACGCTGCGTTTCGACACTGCCGGCTACTTTGGCG
AGGAAAAAACATTCTTCCCAGAAGCCACCATTGTGTTTCGTGTTGAAGAGGGCCAGCATTACCATGTGCCGCTGC > SEQ ID NO:4553 216240FL 220729_300938_1c
gggcggacgcgtgggctcagctataactggaatgattgccggttctgggaaacttgttctctcttacaatactagctct
aAGTCGAGATTCAAATTCAAAACCAAACAAGTTATCGTGGCCATGGGTTTACACGAACGACGCTTGCGATTCAACTGGT
GCCCATTAGGAAAGAGAAAGGAAATCAGTTGAAAATGCTGGCATGAGAACACTTTACAGCGAACGATTGTAAATATCAA
AGTGACAAAATCAAGTATCATGGAGCCAGGAAGCGGCAAATGTCTTTGTTCTATGCTTCTCGAACCTTTGGCTACTAAG
ATTATAGACATGGCTGTTGCCAAATTAAGCGATGGAAAATTCATTGTGGTTCACATAAagaaAaAAAAaaacaa > SEQ ID NO:4554 216268FL 103453_300026_1c
tggtatcaacgcagagtgccattacgccggggactcACAACAGAAATAGCTACTAAACAAACAGCAAAAGATAACCAGA
AAAGATGGCGACTTTCCCTGTTGTTGATTTGGGGTTGCTTCAAACTGGGAAAAGGGCTGAAACATTGGATAAAATCAAA
GATGCATGTGAAAACTGGGGTTTCTTTGAGCTTGTGAATCATGGGATTTCCCATGAAGTGTTGGACACAGTTGAGAAGC
TTACTAAGGAGCATTACAAGAAATGCATGGAGCAAAGGTTCAAGGAAATGGTGGAAAGTAAAGGTCTTGAGGCTGTCCA
AACTGAGATTGATGATCTGGATTGGGAAAGCACTTTTTACTTGAAACACCTCCCTGTTTCCACTGTGTATGAAGTTCCA
GACTTAGAGGATAAATACAGAAATGTTATGAAAGACTTCGCGTTGAGTCTAGAGAAACTAGCTGAAGATCTTCTTGATT
TGCTGTGTGAAAATCTCGGGCTCGAGCAAGGTTATTTGAAGAAAGCATTTTATGGTTCAAAGGGTCCAACTTTTGGTAC
CAAAGTTAGCAACTATCCTCCTTGCCCCAAACCAGAACTGATCAAAGGCCTACGTGCTCACACTGATGCTGGTGGCCTA
ATCCTGCTTTTCCAAGATGACAAAGTCAGTGGTCTTCAGTTACTGAAAGACGGTAATTGGATTGGATTGATGTCCCACCTATGA
AACACTCGATTGTTATCAACCTTGGCGACCAGCTGGAGGTCATAACAAATGGAAAGTACAAGAGTATTGAGCACAGAGT
TATTGCACAACAAGATGGCACTAGAATGTCAATTGCTTCATTTTATAATCCAggAAGTGATGCTGTGATATTTCCAGCA
CCAGAATTggTTGAAAAGGcagaaGAAGAGaacaaGTTGAAGTATCCCAAATTTGTGTTTGaagattACATGaaGCTGT
ATGcaggt > SEQ ID NO:4555 216268FL 1110522_301790_1c
GTATATTGCCGAGGAGGGCGCTGTCAGAGATTGGAGGGACTACCTTTACCTCCACCTTGACCCTCCCTCCACTAGAGAT
TATAACCATTGGCCTGTGGATGCAAGTTTTAGGGAGACCGTTGACAAATATAGCAAGGAGACCCTAAAGGTTGGGAAAA
AGTTGTTAAGCCTCTTATCTGAAAATTTGGGTCTTCATCCATCTTGTTTTGAGGAGCATCTAGTAAAAATTCACCAAAA
GATGCTCATTAACTACTACCCTCCATGCCCAGAGCCTGAGTTGACCGCAGGATTTCACAAACATTCCGATTTTGGAGCC
ATAACATTAGTGATGCAAGAAGTTGGTGTAGTTGGCTTGCAAGTCCACAAAGATGGAGAGTGGATTCCAATCATCCCAG
AAAAAGGTGCTTATGTGGTGAATATTGCAGATCAAGTGGAGATTTAAGCAATGGACGATACAAGAGTATAGAGCATCG
TGTAGTCACAAATCCCTACAAGTCTCGAATATCTGTACCTGTTTTCCATGATGCAGCTCTTGATGCTGTTATTTCTCCT
ATTAACAATATCTTGAAAAATGAAAATGATTGCCAATACAAGAAATGCAGATTTGAGGACCATGAGATAACATTCTATT
CCTATGGAGCAAAT > SEQ ID NO:4556 216268FL 1108731_301520_1c
AATTGTTGGAGATCCTCTGCAAAGAACTGGGATTGGACGAAAACTACATAACTCAACACTTGGACAATGGAAGCAACTC
GGTGTTTCGCTTCAATTTCTACCCCCCTTGCCCAAAGCCTTCCATGATGATGGGATTGGGAGCCCATTCTGACCCTCAC
ATTCTGACAATCCTACATCAAGATCAAATTGGCGGGCTCCAGGTCTTTAAAGACTCTAAATGGATCGGGGTGCGACCTC
AGGCCAACTCGTTAATCATTAATGTTGGCGACGCTCTCCAAGTGTGGAGCAACGGAATCTACAAGAGCATCGAACATCG
AGTCGTGTGTAACAATATGAGTGGCCGGTTGTCTATGCTTTTTTTCTCAATCCAGGGGAGGACACACAGATAACACCT
GCCCCGAAACTATTTAACAGTGACTATGAGCACTGTAGCAAATACAAGAGCTTTACATGGAAAGAATATCGCCAATCCA
TGTACGCTTACAGACTGAAGGGGAAAAGCAACCTCCAACGCTTCACCCTCCATTAGCATTATTAATAGGCTAAAAAAAT
GCAAGGCTCTTCTACCTTGCTTGGGAAACTCTCAATGTCCTTAGTTGGCATTAGAAAATTTGATGTAGTTACAAAATAA
ACT > SEQ ID NO:4557 216268FL 56232_300126_1c
AACAAAAGTTCAATGACATGCTCAAGTCCAAAGGTTTGGATAATCTTGAGACAGAAGTCGAAGATGTGGATTGGGAAAG
CACTTTCTACGTTCGTCACCTCCCTCAATCCAATCTCAATGACATTTCAGATGTGTCTGATGAATACAGGACGGCCATG
AAAGACTTTGGTAAGAGACTGGAGAATCTTGCTGAGGATTTGTTGGATCTACTGTGTGAGAATCTAGGGTTAGAGAAAG

FIG. 2 continued

GGTATTTGAAGAAA

> SEQ ID NO:4558 216268FL 43403_300149_1c
CCCACGCGTCCGCTTCATATCTTCTTATTCATACACTAAATAAAAGCACATTTCTTCAATTCATTCTGCAAGAAAGATG
GAGAATTTCCCAATTATCAACTTGGAAAAATTAAATGGTTCTGAAAAAGCTGCCACCATGGAAATGATTAAGGATGCTT
GTGAAAACTGGGGCTTCTTTGAGTTGGTGAACCATGGAATCCCACATGAAGTAATGGACACAGTTGAGAAATTAACAAA
AGGGCATTACAAGAAATGCATGGAACAGAGGTTTAAGGAATTGGTGGCCAGTAAAGGTCTTGAAGGTGTACAAGCTGAG
GTTACTGATATGGATTGGGAAAGCACTTTCTTCTTGCGCCATCTTCCTGTTTCTAACATCTCTGAAGTCCCTGATCTTG
ATGATCAATACAGGGAGGTTATGAGAGATTTTGCTAAAAGATTAGAGAATTTAGCAGAGGAGCTCTTGGATTTGCTCTG
TGAAAATCTTGGTCTAGAAAAGGGATACTTGAAAAAGGTATTTTATGGATCAAAGGGTCCAAATTTTGGGACTAAAGTT
AGCAACTATCCACCATGCCCAAAACCAGATTTGATTAAAGGACTGCGCGCCCATACGGACGCTGGTGGCATAATCCTTC
TCTtccaagaTGACaaagTAAGC > SEQ ID NO:4559 216268FL 269688_200209_1c
GTAATATTCGCTATTCTATTAATTTATTGTATCACATTTTTCACACACTCAAAAATTAAACACATATTTTACCAAGAAA
GCTATGGAGAACTTCCCAATTATCAACTTGGAAAAGCTCAATGGTTCTGAGAGAGCTGACACCATGGAAATGATTAAAG
ATGCTTGTGAGAACTGGGGCTTCTTTGAGTTAGTGAACCATGGTATTCCACATGAAGTAATGGATACAGTGGAGAAAAT
GACAAAGGGACATTACAAGAAGTACATGGAACAGAGATTTAAAGAATTGGTGGCTAGCAAAGGTCTTGAAGCTGTGCAA
GCTGAGGTTACTGATCTTGATTGGGAAAGCACTTTCTTCTTGCGCCATCTTCCTAATTCTAACATTTCTGCAGTACCTG
ATCTTGATGATCAATACAGGGAAGTAATGAGAGATTTTGCTAAAAGGTTAGAAAATTTGGCAGAGGAGTTACTGGAGTT
GCTATGTGAAAATCTTGGCCTTGAAAAAGGCTACCTGAAAAAGGTGTTTTATGGGACAAAAGGTCCCAATTTTGGAACT
AAGGTTAGCAACTATCCTCCATGCCCAAAACCAGATTTGATAAAGGGACTGCGCGCCCACACAGATGCaggtggtATAA
tccttCTCTtccaagatGACAAAgtaagtggccTtcaacTcctc > SEQ ID NO:4560 216268FL 267836_200119_1c
gtccgggagattccggtgattgacttagtaagcttgacggcgaggagagaagtgcaaccatggcacttctccataCGCT
TGTGAGAAATGGGGCTTCTTTATGATAGAGAACCATGGAATTGACACTAACCTGATGGACAATGTGAAGCAGCTCGTGA
TTCAGCACTATGAAGCCAATATGAAGAAACGGTTCTATGAATCAGAGCTACCTATGAGCTTAGAGAAGAAAGAAAAACT
CAGCAACACAGACTGGGAAAGCACCTTCTTTCTTTGGCATCGTCCAAGTTCTAACATCTATGAGATTGAAGGTCTCTCA
AAGGATCTTTGCAACGCAGTAGATGGATACATTGATCAGCTGATTAATCTTGCTGAAAATCTTTCAGAACTAATGTGTG
AGAACCTTGGCCTAGAGAAGAGTTACATTAAGGAAGCATTTTCAGGAAGCAAGGGTCCTTCTGTTGGAACAAAAGTGGC
AATATATCCTCAATGTACGCGCCCTGAATTAGTCAGGGGATTGCGTGAGCACACAGATGCTGGTGGTATCATTCTCTTA
CTCCAAGATGAACAAGTTCCTGGTCTGGAATTCTTTAAAGATGGACATTGGGTGAAAATtcCACCttccaagaacAaca
gaatTTTtGTaaaCACtggTGatcaaaTCGaaatTTTAAGCAATGggaT > SEQ ID NO:4561 216268FL 243488_301339_1c
gcgtccggaacaatgccgactcagggagtgaaggagctagtggagaattctcaagatcatataccagataagtatatca
aGCCCGAGCGTGCCCGTGTTAGATACAACAGTTCCACACAggggattCCCCTCATTGACCTCGCTGAAATCCATGGACA
AGGAAGAAGTGATGTTCTTCGTGCCATAAGAGATGCGGCAGGAGAGTGGGGATTCTTCCAGGTGATCAATCACAGCGTT
CCACCAGCTTTGATGGAGGCTATGATGAAGGCTGCTCGTGAGTTCTTCGACCTGCCTCTAGAGGAAAAAATGGCATATT
TTTCTGAAGATTTTGAGGAGAGAATTCGTTTCTGCACCAGCTTTGTTCCTTCAACGGAAGAACGCTGGGACTGGCAAGA
CAACCTCTCGCATACTTTTCCACCTTACGGAGACGATCACCCCTGGCCAAAGAAGCCACACTTGTACGAGGAAGTTGCG
AAGGAGTATCTCCACCAGGTTTTGGAGCTGGGGAACGCAATCGCAGGTGCAATCTCTGAAAGCTTGGGCTTAGAAAAAG
ACTTTCTCCTAAAGGCGTTCGGAGAGGGCAGGCACAACATGCGTCTAAACTATTATGCACCTTGTCCAAGACCCGATCT
TGCAGTGGGCTTCAGTCCTCACTCCGACTTCGGAGGTTTTACCATCCTGATGCAAGACCAAGTAGGAGGGCTTCAGGTG
AAAAAGGACGAGGACTGGTACTTTGTCAAACCAGTCAAGCACTCCTTCGTGGTCAATATCAGTGATCAACTCGAGATAT
TTAGCAACGGTAGGCTCCGGAgtgccGAACACCGAGCTacGGtGAACTCAAGCTCCGAAAGgattTCAATggctactt
gcttTGAGCCTTCt > SEQ ID NO:4562 216268FL 209068_300811_1c
GACACACAGACGCACTCACACACTCAGCTGAAGCGAGCGAGCGAGTGAACGAGAGAGAGAGACAGAGATGGCGAGTGTT
GCCTCCTTCCCGGTGATCAACATGGAGAACCTGGAGACCGAGGAGAGGGGCGCAGCAATGGAGGTCATCCGCGACGCCT
GCGAGAACTGGGGCTTCTTCGAGATGCTGAACCATGGCATCCGCGCACGAGCTGATGGACGAGGTGGAGCGGGTGAGCAA
GGCGCACTACGCCAACTGCCGGAGGAGAAGTTCAAGGAGTTCGCGCGGCGGATGCTGGAGGCCGGCGAGAAGGGCGCC
GACGTGAAGGGCATCGACTGGGAGAGCACCTTCTTCGTCCGCCACCGCCCCGTCTCCAACCTCGCCGACCTCCCCGACG
TCGACGACCACTACAGGCAGGTGATGAATCAATTTGCGTCGGAGATCGAGAAGCTCTCGGAGAGGGTGCTGGACCTGCT
GTGCGAGAATCTGGGCCTGGAGAAGGGTTACCT

FIG. 2 continued

> SEQ ID NO:4563 216268FL 187871_300681_1c
CACAACCCAGCTGGTGAAAGAGAGGAACTTGAGAGTTAGCTAGCATGGCGGCAGCATTGTCGTTCCCGATCATCGACAT
GAGTCTGCTCGACGGGGCAGAGAGGCCCGCGGCGATGGGGCTGCTCCGCGACGCATGCGAGAGCTGGGGCTTCTTTGAG
ATCCTGAACCACGGCATCTCGACGGAGCTGATGGACGAGGTGGAGAAAATGACCAAGGACCACTACAAGCGTGTGCGCG
AGCAGAGGTTCCTCGAGTTCGCGAGCAAGACGCTCAAGGAAGGCTGCGACGACGTGAATAAGGCGGGAGAAGCTGGACTG
GGAGAGCACCTTCTTCGTCCGCCACCTCCCGGAGTCCAACATCGCCGACATACCCGACCTCGACGACGACTACAGGCGC
CTCATGAAGCGCTTCGCGGCGGAGCTGGAGACGCTGGCGGAGCGGCTACTGGACCTGCTCTGCGAGAACCTCGGCCTCG
AGAAGGGCTACCTCACCAAGGCCTTCCGTGGCCCCGCGGGCGCACCCACCTTCGGCACCAAGGTCAGCAGCTACCCGCC
GTGCCCGCGCCCCGACCTCGTC

> SEQ ID NO:4564 216268FL 141827_300429_1c
CCCGACTAGATTCTTAATACACAACCCAGCTGGTGAAAGAGAGGAACTTGAGAGTTAGCTAGCATGGCGGCAGCATTGT
CGTTCCCGATCATCGACATGAGTCTGCTCGACGGGGCAGAGAGGCCCGCGGCGATGGGGCTGCTCCGCGACGCATGCGA
GAGCTGGGGCTTCTTTGAGATCCTGAACCACGGCATCTCGACGGAGCTGATGGACGAGGTGGAGAAGATGACCAAGGAC
CACTACAAGCGTGTGCGCGAGCAGAGGTTCCTCGAGTTCGCGAGCAAGACGCTCAAGGAAGGCTGCGACGACGTGAATA
AGGCGGAGAAGCTGGACTGGGAGAGCACCTTCTTCGTCCGCCACCTCCCGGAGTCCAACATCGCCGACATACCCGACCT
CGACGACGACTACAGGCGCCTCATGAAGCGCTTCGCGGCGGAGCTGGAGACGCTGGCGGAGCGGCTACTGGACCTGCTC
TGCGAGAACCTCGGCCTCGAGAAGGGCTACCTCACCAAGGCCTTCCGTGGCCCCGCGGGCGCACCCACCTTCGGCACCA
AGgTCAGCAGCTACCCGCCGTGCCCGCGCCCCGACCtcgTCaagggCCtccGCGCCCACACCGACGCcggcggcATCAT
CcTGCTCtTc > SEQ ID NO:4565 216268FL 132569_300447_1c
AAAAAGATAGGATCTGTCTGCTATTATTATCTAAGTCTGTTTAGGTTTTGTGTTTTTTATTACTACAACAACATAATGA
CTATTCCGGTGATTGATTTCTCAAAGCTTGATGGAGAGGAAAGAGCCCAAACTTTGGTTCAGATTTCCAAAGGTTGTGA
AGAATGGGGATTTTTTCAGTTGGTGAATCATGGGATACCAGTGGAGCTGCTTGAGAGGGTGAAGAAAGTGTGTGCAGAA
TGCTTTAAGCTGGAAAGAGAAGAGGCTTTCAAGAATTCAACACCAGTCAAGTTGCTTAATGAGCTAGCGGAGAGCAAGA
AGAGTGCAATTATAAGGTTGAAAATGTGGATTGGGAAGATGTCTTCCTTCTCACTGATGACAATCAATGGCCCTCCAA
CACTCCTCAATTCAAGGAGACAATGAAAGAATATAGATCAGAACTGAAGAGCTAGCAGAGAGTGTGATGGAAGTAATG
GATGAAAACTTAGGCTTACAAAAAGGGTCAATCAAGAAAGCCTTCAATGAAGGAGAAGGTGACAATAATGCTTTTTTTG
GAACAAAAGTGAGTCACTACCCACCTTGCCCTCATCCAGAAATGGTGAATGGCCTAAGAGCTCACACTGATGCTGGAGG
TGTGATTCTACTCTTCCAAGATGATCAAGTTGATGGCCTTCAAATCCTC > SEQ ID NO:4566 216268FL 128550_300476_1c
AAAATACATAGAAAGATGGAGAGTTTCCCAGTGGTTAACATGGAGTTGCTTAACACTGAACAAAGGGCTGCAACAATGG
AGAAAATTAAGGATGCTTGTCGAGAACTGGGGCTTCTTTGAGGTGGTAAATCATGGGATCTGTCATGAGCTTCTGGACAC
AGTGGAGAAGTTGACAAAGGGACACTACAAGAAGTGTATGGAACAAAGGTTTAAGGAAATGGTTGCAAGTAAAGGGCTT
GAAGCTGTTGAGACTGAAATAAAGGATTTGGATTGGGAAAGTACTTTCTTCTTGAAACACCTTCCTGTTTCAAATATCT
CAGAAGTTCCTGATCTTGAAGATGAATACAGGAATGTAGGGAAAATCATGAAGGAGTTTGCTGAAAAGCTAGAGAAATT
AGCTGAGCAACTTTTGGACTTGCTCTGTGAAAATCTAGGACTGGAGCAAGGTTACCTGAAGAAAGCCTTTTATGGTTCA
AATGGTCCTACTTTTGGCACCAAAGTTAGCAACTATCCACCATGTCCCAAGCCTGATTTGATTAAAGGCCTTAGGGCTC
ACACTGATGCTGGTGGAATCATCCTTCTATTCCAAGATGACAAAGTCAGTGGTCTCCAACTACTCAAAGACGACAAATG
GATCGACGTTCCACCAATGCGCCACTCCATCGTCATTAACCTCGGAGACCAACTCGAGGTGATTACTAATGGAAAGTAC
AAGAGTGTGGAGCATAGGGTGATTGCTCAGCCTGATGGAAACAGAATGTCCCTAGCTTCATTCTATAACCCGGGAGTG
ATGCTGTCATCTATCCAGCACCAGAATTGTTGGAGAAAAGAGAACAAAGTCATTTATCCTAAGTTTGTATTTGAGGACTA
TATGAAATTATATGCAGGTCTTAAGTTCCAGGCTAAAGAGCCAAGGTTTGAAGCAATGAAGGCTGTGGAAACTACTGTC
AACTCTGCCCCAATAGCTACTGTTTGAGACTTTGATGGAGTATTAATTAGAAAACTGATTAATGAGAAGAAAATGGCTT
AGTATTAAGATTATGATGATGTATTGATGATTTGTTTATATTGATTAGTTGGGGTGTTTTCCTTGTTTTATGCCACTTG
GGTTTTTCATGTACTGTTGTCTGGTAGTCTAAGAGGAATTTATTGTTATGTTCTCaaaagaagttccttttaacttgaa
aaaaag > SEQ ID NO:4567 216268FL 120181_300359_1c
AAGAAAGCCTTTTATGGTTCAAAGGGTCCTACTTTTGGCACCAAAGTTAGCAACTATCCACCATGTCCCAAGCCTGATT
TGATTAAAGGCCTCAGGGCTCACACCGATGCTGGTGGAATCATCCTTCTATTCCAAGATGACAAAGTCAGTGGCCTCCA
ACTGCTCAAAGACGACAAATGGATCGACGTTCCACCAATGCGCCACTCCATTGTCATCAAACTCGGTGACCAACTTGAG
GTGATTACTAATGGAAAGTACAAGAGTGTGGAGCATAGGGTGATTGCTCAGCCTGATGGAAACAGAATGTCCCTAGCTT
CGTTCTATAACCCGGGGAGTGATGCTGTCATCTATCCAGCACCAGAATTGTTGGAGAAAGAGAACAAAGTCATTTATCC

FIG. 2 continued

```
TAAGTTTGTTTTTGAGGACTATATGAAATTATATGCAGGTCTTAAATTCCAGGCTAAGGAGCCAAGGTTCGAGGCAATG
AAGGCTGTGGAAAATACTGTCAACGCTGCCCCAATAGCTACTGTTTGAGACTTTTCATGGAGTATTAATTAGAAAACTG
ATTAATGAGAATAAAATGGCATAGTATTAAGATTATGATGATGTAATAATGATTTGTTTATGTTGAttaGTGGGgggtg
ttTTTCTtGtttTgtgccactttgGgttTTttcatgTAcTgttTTCTGgtAGTCTa > SEQ ID NO:4568 216268FL 1174142_302095_1c
GAAATCATACTAGAGGCTATGTCAATAACACTTGGGCTCAACCCAGGAACGTTAAAAGAAGCATTTGGAGGCGATAAAA
ATTGCAGCTTAAGTCAACGTATTAATTTCTACCCTTCTTGCCCTCAACCTGACCTCACCTTAGGGTTATCTCCTCACTC
GGACCCCGGGGGTCTAACTGTCCTTCTTCAAGATGACCAAGTCAGTGGCTTGCAAGTGCACTACGAGGGGGAATGGGTT
GATGTCAAACCCATTCCTGGTGCATTTGTCGTAAATCTCGCTGATCAAATCCAATAATGACCAATGGGAGGTACAAGA
GCGTGGAGCACAGAGTGGCAGTCAATTGCGATCAAAGCAGGCTATCCATAGCTACCTTTTGCAATCCTAGCAATGAACT
TCTGATAAGCCCTTTGAAAGAGTTGGTGGGTGAATCTAGTGAGCTTCAGTACAACCCCATGACCTTTAGAGAGTACAGG
TCCTTCATAAGGAGGATAGGAACAAAAGGCAAATATTTCCTTAACTATGTGCAATCACCTAAACACTCTGTATTGCCAT
CCCCATAGCACATCTTCTTCTAATTATCATCTCCTCTACCTTGTAAAACAACCCATTTTGTTAAAAAACGTAGAATGTG
TGTGTGTGTGTGTGTACATATA > SEQ ID NO:4569 216332FL 195613_300636_1c
AAAAAACACACCAAGCACAAAGAAGAAAATTCACCCATCCAGGTCGCTGCTCCGTTGCAAAAATCTCTCATGATGGAGA
CTGGCCATGAGACATTGGATGTTTTGCGTTCCGGTTTGTCGTGCCCTTGGCTGCAAGGCAGAATCCCCCTTTGAACCTG
ATTGTCAGACACAGTCAAGACGAGGACGGAGACAGAGCTTCTGTTGTCAGCCATGGCCAGCTTACAGCTTCCAACGGCC
TGCTACTGAATGCTGTCGATGCCATGGTGATCTCGACCGTACATGAGAACCCGCGAGCTCACGTTGCGCAGCCTGCTTC
CCCTCACGTCATCCGCCCTGGTCGCCGTGAGGTGAGGACCAGGCTGCGTCACGACACCCGCCTTGCGAAAAAGATCGCAC
AAAAAGGACAAGCTCTTCCTCCTCCATCGCCGACTTCTATACATCTTATCACGCGAATTGGATGGCGCACGAAGCAATA
TTTCTCTCTGGTCAAAACCGGTTCGAGGTTTCGTATGATTTTTTTTCTTTACTTCATTGCTCCCGTTGGGGGGCTTC
TTCCTCTTCTAATCCTAAAGCACCGACCCCA > SEQ ID NO:4570 216339FL 200469_300759_1c
gcttttcTCCTGGGATTTTCGAGTGCAAACATCTGCCCTTGTTTGCGTCTTTCCGCCTGCGCAAACCAGAACACCGCAC
TTCCTCCCGAGACAGAAACGAGTGTTGGTTGCCCCAGACTGTCTTTGATTCTGAGACATTTGGCCTCCCTTGCAGGTAA
CTGACGGTGAGAATAAAAGCCGACGGGCCGCCGCCTGCAGCAAACGAAACCAGCGACATACAAAAAGAAACACAAACAA
GCAAATCAATTCCCGAGCAAGAAAAAAAGAAGAAGCCCATCATGAAGATGCTTTCGTTTGCCGCCCTCTCGGTGCTCGT
GTTGGGCGCTTCGGCCCTGGCTGCGCCGCCGGCCCACCCCCGGCCGACAATGGGTGCTGCTGCTGCACATCAACAAG
AAGAGAATCGACTGCGACAGGTCGATCCCGGCGTCGGAGTGCATCTGCCCCAGGTCATCTGCCCCGCCGGCGCGCCCA
CGTTCACGCACGGCACGCCGCCGAAAGCCACCCCACCGCCCACGCCGCTGCCGACTTACAAGCAGTGCTGCTGCTGCAA
TCCCAACATTAACAAGATTGTGTGCTCGCTGAGGCTCGTGGAGGACTGTATCTGCTTGGCCGTGATGTGTCCGACGGAT
GCAAAGACCATCTTTGTCAGGCCAACTGGCGTTCCGACTGTCGCTTAAGAGTATTCGTTGGCGAGCCGACTTGCCTGAA
TCCTGGACCGGGGACATGACATGGGGGGAGGGAAAATACAGGGCAAGGCATTGCTGATGGTGAATGCACAACACGCGTG
GCAGACTGGCCGAAAATTGATGATTTACTGATGGGCGACTTTGGACTTGAAATGGGGCATGCCGGATGGGTTACTTGAC
AGTATTTACACCATTTCTATTCAACAATAAATGGAATTCTCTaGataaaAAAAa > SEQ ID NO:4571 216339FL 214447_300858_1c
cccacgcgtccgcccacgcgtccgGAAACACAAACAAGCAAATCAATTCCCGAGCAAGAAAAAAAGAAGAAGCCCATCA
TGAAGATGCTTTCGTTTGCCGCCCTCTCGGTGCTCGTGTTGGGCGCTTCGGCCCTGGCTGCGCCGCCGGCCCACCCCCC
GGCCGACAATGGGTGCTGCTGCTGCACATCAACAAGAAGAGAATCGACTGCGACAGGTCGATCCCGGCGTCGGAGTGC
ATCTGCCCCCAGGTCATCTGCCCCGCCGACTTACAAGCAGTGCTGCTGCTGCAATCCCAACATTAACAAGATTGTGTGC
TCGCTGAGGCTCGTGGAGGACTGTATCTGCTTGGCCGTGATGTGTCCGACGGATGCAAAGACCATCTTTGTCAGGCCAA
CTGGCGTTCCGACTGTCGCTTAAGAGTATTCGTTGGCGAGCCGACTTGCCTGAATCCTGGACCGGGGACATGACATGGG
GGGAGGGAAAATACAGGGCAAGGCATTGCTGATGGTGAATGCACAACACGCGTGGCAGACTGGCCGAAAATTGATGATT
TACTGATGGGCGACTTTGGACTTGAAATGGGGCATGccGGATGGGttACTTGACAGtatttacACCATTTCTattcaaC
AaTaaATg > SEQ ID NO:4572 216349FL 219711_300948_1c
gatgcctgcattgtctttgGTAACGCATGGGCCTGCGAAGGATACGACCGTCCTGCTATCCGAGATGATTATACAGACT
CCCTCATCAAGTCAGTGGCTGACCAGTGCAGCAAGACCGTTGTTATCTTTCACAACGCGGGGCCTCGATTGGTAGACGG
TTTTGTTGATCATCCAAATGTCACAGCAATCATCTTTGCCCATTTGCCAGGTCAAGAGAGCGGGCCAGCACTCGCTTCA
CTACTCTTTGGGGATACCAGCCCTTCCGGCAAGCTTCCGTACACAGTGGCGAAGAATGAATCTGATTATGGCGATGTCC
TCGATCCAGTACAGCCAGAAGGCGAATTCGTCAACTTTCCCCAGGCCGATTTCCACGAAGGAGTTTATCTTGACTATCG
CTACTTTGACAAAAAGGGCATTGAACCTCGATACGAGTTCGGCTTTGGACTTGGTTACACGACCTTTGCATATTCCAAC
```

```
ATATCCATCAACTATATTCAgggggCAAACACGTATCCATGGCCGGGCGGCCCTATTGTCAGCGGCGGACAAACGGATC
TATGGGATGCAATCGCCACCGTCAGCGTAAACATCAAGAATACAGGCAGCGTTGCTGGTGCCGAAGTGGCGCAGCTCTA
CATTGGTATTCCagggggctCCGGCgaagcagcTTCGCGGCTTTGaaAAgCCCTttttgCAGCCTAAtGAg
```

> SEQ ID NO:4573 216429FL 211282_300897_1c
```
GCACCATCTCGCTCCGGACACGGGAGAGACTGCGCTGTCCATCTGATGGCCTAGATTGGCAGACGCCGGGGCAATTGGC
ACGTACGCTGCCACCGACTTTGCATCCCCGGGGTCCTGTCCTGTCTCTCCAAATCCAAAGACCTCTTCTCCATCGCACA
CGAAGCATCGAGCCAGAGCATCCAGCCCCGCCCAGATCCCAGCCCGAGTACGTTGCGTGAATGAGCGGCCAAGACGGGA
CAAATCTCGAGGTTACGCTGCATCTGTTCTAACCTGCCACGCTGCTACAGTACAAGGACACCCTCAATCACATACGGAT
CGGCCCTGCGAATCAGCCCTGCGACTAATAATAGCCCTGTGAATCGGCCCCTGCTGAACCGGCATCCGAAAAAAAAAAA
AC
```

> SEQ ID NO:4574 216463FL 211675_300901_2c
```
GGCCAATATGTGGCCTGCATGCTGTTTCTGATACAAATCCTCGTAATGCACAGACGTGAATAGTGCTGGCACAAGTCAC
ATTGCTGCTGCCTTGAAGGGTTCCATTTACATTTTGGTGCAGCTCTACCAACCG
```

> SEQ ID NO:4575 218859FL 200114_300756_1c
```
ATTCTAAAACAGTCAGCAGGGCTCGAGGCCTTGTGCGGCAGATATGGGGGCCAGCGACTCCAAGATAGGATTTAAGCAG
GGCATCTTCAGATTATCAGAGGAGCGCAACATTGCGGCGCATGATCCTTACTGGACTTCGGTTCGTCATGCCTTTGATC
CCAGATGGCCGCGGGGATGCTGATGCTGATGGGGTCATAGTTTTGGGAGCTTCCTGAATCGTCGGAAGATGTTTTTAGT
CTTTT
```

> SEQ ID NO:4576 218924FL 206095_300804_1c
```
AATTTAAAAGTGTCGCATTAAACCGCCCCTACTTGCTTTTGCTCTCTTTGTTGTTCACTCGCAGCTACAACTCTCGCCC
ACAATGTCTCTCAAGAATGACGCTTTCCCTTCCTCCGAGGCCTTCGAGGCCATCAACGCCGCTCTCAGCAGCAGCGAAG
CCGACCGCAAGGACGCCATCAAGAATGGCAAGGCCGTCTTCGCCTTCACCCTCAAGAACAAGGCCGGCGAGACGGCCAG
CTGGCACATTGACCTCAAGGAGAAGGGCACAGTGGGCACTGGCGTCGGCGAGAACCCCACCGTCACTCTGTCTCTCTCC
GACGAAGACTTTGGCAAGCTCGTCACCGGCAAGGCCCAGGCCCAGCGCCTCTTCATGTCCGGCAAGCTCAAGGTCAAGG
GCGACGTCATGAAGGCTACCAAGATGGAGCCCATCCTGAAGAAGGCCCAGACCAAGGCCAAGCTGTAAAAAGCGGGCAT
TGGCAAGTTGGGCTGTTGATTATGGGAAAACAGGTGGAAACAAACCATTAAACGGCATTTTTTGTTTTTATATGTATC
ATACCATCGCTCGTTTACTACCACTCGATGTTTACTGTTTTTTCTTTGTTCCCCGGCCGCAAAAGAGTTCGGCTAGGGACG
GTTGGTTATAGTGCCTTATGAATACTGGCATAGACGAGAATACCATATTCCGGCTGGACATGTTTCCAGTCTGGAGTTC
CTTTTTTtaaaaAAAAaaacaaccaac
```

> SEQ ID NO:4577 218924FL 224049_301394_1c
```
ATctctTATTCATTACACAAAAACAACAATGTCTCTCAAGGTCGACGGCTTCACTTCTTCTATCATCTTCGACGTCATC
CGTGACGGTCTTAACGACCCCTCTCAGGCCAAGCAGAAGGCTGAGTCCATCAAGAAGGCCAACGCCATCATTGTCTTCA
ACCTCAAGAACAAGGCTGGCAGACCGAGTCTTGGTACCTTGACCTCAAGAACGACGGTGACGTCGGCAAGGGCAACAA
GTCCCCCAAGGGTGATGCTGACATCCAGCTCACTCTCTCTCTGACGACCACTTCCAGCAGCTCGTTGAGGGTAAGGCTAAC
GCCCAGCGACTCTTCATGACCGGCAAGCTCAAGGTTAAGGGCAACGTCATGAAGGCTGCCGCCATTGAGGGTATCCTCA
GAACGCTCAGAACAACCTCTAAGCGCATCATTTATTGATTAATTGATGATTTACTATATTGAAAAAAAAgaAAAAA
```

> SEQ ID NO:4578 219027FL 216011_300887_1c
```
GTGGTGTCGATCCAAGGGGACGCGTGGCAACCGCTGCACAGCCCGCGTGTGGTGACTAGAGGCGGCTAACAGGTGGTAA
GTAATCGGATCTGCTGTTTCTCTTGTGCAGTCTCACACATGTCGCAGGGGTGGGTTTTGAATGGAGACGAAGCTTGTTG
CGATGAATCAAGTCATGCTAGCTGCATGCCTGACCGAGATGAGGAGGAGAGATGGAGAAGAGAACGGAGCA
GTGGGAGAAAGAAAAGAGGAAGAGAAAGAGGCTAGGAAGCATTGCCACATTAAGTACAACAGGGGGGTTGATTCAGATC
GAGGAGAGCAGAAGGGGAGAAGTGGATAGAATAGGGCTTTGTGTCTGTGCTGTGGAGGAGGCATGTGGCCGTGCTGATG
AAAGAATTGGAACATGAAGCTTACCTCTATATTAGGACCAAAGTACGGAGTAGACCCTACC
```

> SEQ ID NO:4579 219090FL 206542_300823_1c
```
GTCCAATTAGGCATTGACAGCAAACCAATTCCCTCCATAACTGGGCCTCTTCACACCCGTACTCAGAATGACCGACAGA
ATATTCCGCATCTTTAACCCGGGAGAACCAAAGGGTGATCCCGTTGAGAAGAGGCGCGCTCAGCTGCGACGTGCCCAAC
AATCTTATCGAGATCGCAAGGACAAGTACACCAAGGCGCTCGAGGCTGAACTAGCACGGTCTCGGAAGAGCGAGGCGGG
CTTGACGTTCCAGATCGAGCAGCTTCGTGTCAAAGTTCAGAAACTGGCCAGTCTCTTGTCCCAAAATGGCATCTCACTT
CCTCCAGATTTTGACAATGAGGAACAACTTCATGATGATGTACCGCGTATAGATTCATCTCCGCTCACAACGCGTGGAC
AACCACAAACCGCTGAAGGCTTCCTATCAAGTACAGATTCAACCTCTCCTGAGTCGGTGACGGACCAAGGAGCTATCTT
AAATAGTGGAAACCGCACTCTACGGCAGTACAGTTCGA
```

FIG. 2 continued

> SEQ ID NO:4580 219108FL 204161_300790_1c
TACGTGGTCTCTTGGGGTGTAGCAATCAATACTTGTGTACACGTAGATACAGTAGTCTATGTCCGTGTGCTTCTGGGGG
TGGGCATTGATTATCTCCGTGCGGAGGAATATGGGGGTGTTCGTGTGTCTTGGTATCAATCAGGCTATGCGGGAATACG
ATGTAGTTACGACGCCTCCTCTACTGTACATTACTGACATGCCCTGTAAAGACAAGGTGAGCATACGAGACAATGCCGC
TGTCTCTTTGGGAGGGAATTCGTTAGAGTCAGCCAAGAGCGCCATGTTGAATGAAAGAATCGGACATGGCTTATCTTAG
TCCCCCGG

> SEQ ID NO:4581 219136FL 1190033_302191_1c
ggataagctttcttccctcctggccggaaaagtagggttgcattctcttttgctcTCTCTCTCTCTCTCTTTTCGTTTCA
TCGTTCGCAgggaaATCAGTCGTCGGATCGAATCCCGTCCCGGCCGTGCCTAGGAACGTGCAGAATCTGAGAATAGGAA
GAATCAGGAAGAAGAAAGAATGGAGAAAGTTCGCTCCAGACAGCAGGTTTTACTGGACCATCTCCGTCCATGCAGCACT
CCTCGGATCTCCACTGAACTTGTGAGATCTGTCTGTTTAGCTGGAGATAGTGCAGCTTATGAAAGAAGAACCGACTCTA
GCGATGATGTGGTGATTGTGGCAGCTTACCGCAGCGCTCTCTGCAAAGCCAAAAGAGGAGGCTTCAAGGATACCTACCC
TGAGGACTTGCTGGCACCGGTGCTCAAGGCTTTGGTAGAGAGAACTGGCGTGAATCCGGCAGAAATTGGAGATATCGTG
GTAGGAACTGTTCTGGCTCCAGGATCTCAGCGTGCTTCCGAGTGTAGAATGGCTGCTTTCTATGCAGGTTTCCCAGAGA
GTGTTCCTGTAAGAACTGTGAATAGGCAATGTGCATCTGGCTTGCAAGCTGTGGCTGACGTTGTTTCAGCAATAAAGGC
AGGATTTTACGACATAGGAATCGGAGCTGGTTTGGAGTCAATGACAGCGAATCCTATGAGTTGGGAAGGTTCTGTGAAT
CCAAAGGTTGAAATGAATcaaTGCGCTcaggAtTGTCTTCTTCCAATgg > SEQ ID NO:4582 219136FL 56776_300142_1c
ttgttgtgggtactgttttggcacctggatctcagagagccagtgaatgcaggatggctgcgttctatgctggtttccc
tGAAACCGTGGCTGTCAGAACTGTGAATAGACAGTGCTCATCTGGGCTTCAGGCTGTTGCTGATGTAGCCGCTGCCATT
AAAGCGGGATTTTATGACATTGGTATCGGGGCTGGTTTGGAGTCCATGACTACCAATCCAATGGCATGGGAAGGGTCAG
TCAACCCAGCGGTGAagaAGTTTGCACAAGCGCAGAATTgtcTTCTTCCTATGGGTgtTACGTCAGAAAATGTAgcACA
ACGCTTTGGTGTCTCAAGGCAGGAGCAAGATCAAGCTGCTGTTGACTCGCACAGAAAGGCAGCTGCTGCTACTGCTGCT
GGTAAATTCAAGGATGAGATCATTCCTGTTAAGACCAAGCTTGTTGACCCGAAGACTGGTGATTAGAAACCCATTACAG
TTTCTGTTGATGATGGTATCCGACCAACCACAACTCTTGCTtCTCTTGGGAAGCTGAAGCCAGTGTTTAAGAAGGATGG
CACCACTACTgctGGAAATTCCAGCCAAGTAAGTGATGGTGCaGGAGCGGttctcctAATGAAGAGAAGTgttGCAATG
CAAAAAGGACTtcccgTTCTTggtgTATTCaggaCATtTGCtgcagTTGgtgttgaCCCTGCAATCAtgggtATc > SEQ ID NO:4583 219136FL 41847_300145_1c
CCCACGCGTCCGCTTTTAGGCACTGTTAGCCAGGTCAGTGATGGTGCGGCTGCAGTGCTTCTTATGAAGAGAAGTGTAG
CTATGCAGAAGGGACTTCCTATTCTTGGCGTATTCAGGAGCTTTGCTGCCGTTGGTGTGGATCCTGCTGTAATGGGAAT
TGGGCCAGCTGTTGCTATACCAGCTGCTGTTAAGTCTGCTGGTCTTGAGCTTGACAATATTGACCTGTTTGAAATAAAT
GAGGCATTTGCATCCCAGTTTGTGTATTGCCGCAAGAAACTCAATCTTGACTCCGAAAAGGTTAATGTGAATGGAGGGG
CAATGGCTCTTGGGCATCCTCTGGGTGCTACAGGTGCACGTTGCGTGGCAACTCTGCTTCATGAGATGAAACGTC > SEQ ID NO:4584 219136FL 292278_200195_1c
AAATACAAGAGAGGAGCAGGATGACTATGCAGTTCAAAGTTTTGAACGTGGCATTGCTGCTCAGGAAGCTGGTGCTTTT
GCATGGGAGATTGTGCCGGTTGAGGTGCCTGGAGGAAGAGGAAAACCATCCATTATTGTTGATAAGGATGACGGTCTAG
GAAAGTTTGATGGTGCAAAATTGAGAAAACTCCGACCAAGTTTTAAGGAAAAAGATGGTACTGTGACTGCTGGTAACGC
TTCTAGCATAAGTGATGGAGCTGCTGCATTGGTCTTAGTAAGTGGAGAGAAGGCAATAAAACTTGGACTAAATGTGATT
GGAAAGATCAGTGGCTATGCTGACGCTGCTCAGGCACCTGAATTATTCACAACTGCACCTGCTCTAGCAATTCCAAAAG
CTATCAAAAGTGCTAGCTTAGAGGCTTCTCAAATTGACTTCTATGAAATTAATGAAGCTTTTGCTGTGGTATCTCTTGC
AAATCAGAAGCTGCTTGGTCTTAATCCAGAAAAAGTTAATGTACATGGTGGAGCTGTATCTTTAGGGCATCCTCTTGGA
TGCAGTGGAGCTCGTATTTTGGTTACACTTCTCGGGGTATTGAGACAGAAAACGGCAAATATGGCGCTGCTGGTGTTT
GCAATGG > SEQ ID NO:4585 219136FL 279632_200063_1c
atttgtactaAAAAAATAATCTTGAGATCAAATGGAGAAAGCAATTGAGAGACAAAGAGTTCTTCTTCAACACCTTCGT
CCTTCTCAAACTTCTTCTTCCTTGGAAAATATTGAATCATCCATTGCTGCATCTGTATGCTCTTCTGGAGACAGTGCTG
CTTACCAAAGGACCTCTGTCTTTGGAGATGATGTCGTCATAGTTGCTGCATATAGGACTCCTCTTTGCAAAGCAAAGAG
AGGAGGCTTCAAGGATACTTATCCTGATGATCTACTTGCTCCAGTTCTAAAGGCGTTGATGGAAAAGACTAATGTGAGC
CCTAGTGAAGTTGGGGATATCGTTGTCGGCACCGTGTTGGCCCCAGGTTCTCAGAGAGCAAGCGAGTGCAGGATGGCTG
CGTTTTATGCTGGTTTTCCTGAAACTGTGCCAGTTAGAACTGTAAACCGGCAATGTTCATCAGGCCTTCAAGCAGTTGC
TGATGTAGCTGCAGCTATTAAAGCTGGATTTTATGACATCGGTATTGGTGCTGGATTGGAGTCTATGACCACAAACCCA
ATGGCCTGGGAAGGATCAGTCAACCCAAAAGTTAAGATGATGGCACAAGCTCAAGACTGTCTTCTTCCTATGGGTATTA

FIG. 2 continued

CTTCTGAGAATGTAGCACATCGTTTTGGTGTGACAAGGCAGGAACAAGACCAGGCTGCAGTTGATTCGCATCGTAAGGC
TGCTGCAGCCTCCGCTTCCGGAAAATTCAAAGATGAAATAATTCCTGTACCCACAAAGATTGTTGATCCAAAAACCGGA
GATGAGACACCGGTAACGATCTCTGTTGATGATGGTATACGGCCAAATGCCTCTGTTTCAGACTTGGCAAAGTTAAAGC
CAGTGTTCAAGAAGAGTGGAACTACTACTGCTGGGAACTCTAGCCAAGTCACTGATGGTGCTGGAGCTGTACTTCTTAT
GAAAAGAAGTCTTGCAATGCAAAAGGGACTTCCTATCCTTGGTGTATTCAGGACCTTTGCTGCCGTGGGTGTAGACCCT
GCTATTATGGGAATTGGTCCAGCTGTTGCAATTCCTGCTGCTGTCAAGTCCGCAGGCCTTGAACTTGAAGATATTGATC
TCTTTGAGATAAATGAGGCATTCGCATCACAATATGTCTATTGCCGTAAGAAGCTGGAACTTGACCCGGAGAAGATCAA
CGTTAACGGAGGTGCAATGGCCCTTGGGCATCCTTTGGGTGCTACAGGAGCTCGATGCGTTGCAACTCTGCTGCACGAG
ATGAAACGTCGTGGGAAGGACTGCCGATTTGGTGTGGTGTCCATGTGCATAGGCACTGGAATGGGGGCAGCTGCTGTCT
TTGAAAGAGGAGACTCCTGTGATGAGCTATGCAACGCGCGAAAAATtggAAGCCACAATCTTTTATCCAAAGATGCTCT
ATAAACAGTAGGGATACTCAATTAATAATATTTACAGAGAAgaagaacAATAaatcATAGTAAGCTTTtgagaCattttc
TtggAaAA > SEQ ID NO:4586 219136FL 263707_301747_2c
CTTTTTTTTTTTAGACAAGTTGGTCTATCCTTTCACCGGAATCCCGCGTCATATGCATCAGGCTTCACAACATTTTCTG
ATACAAATAGACAATCATCTGATAACTTTCGAAAGCAAAAGGTAATCAGATGAACAGGCTGACAAGGGACAACTTTTGA
GTTATTATGCATGAATTTCCTAATTAACAAGGATTCTCCAACTAGCCAAGTTCAGAGCTGGATGAGATTACAGATACAC
AAGCGTTTTATTCCCTACTCTTGTGTTGATATTTCAAACAATAGTGGCAGTTGCACAATTTTTATGACATATATATATA
GTTCTAGTTACATGGCGTCCTTCGAAAGCCGGTTATGGGTCGGGATGCACCGAGCATTAGTGAGCTCATCCACTGCATC
CCCACGCTCAAAGACAGCAGCAGCCCCCATGCCAGAACCTATGCACATGGAAATCACACCAAATCGACAGTCTTTGCCC
CGTCGCTTCATTTCGTTGAGAAGGGTACTGACAGACCGTGCACCTGTAGCACCCAATGGATGCCCAAGAGCCATTGCAC
CTCCGTTAACGTTAACTTTTGCAGGATCAAGTCCCAACTTCTTGCAGCAGTATACGTACTGTGATGCAAAGGCCTCATT
AATCTCGAAAAGGTAAACATCATCTATTTGAAGACCAGCAGCTTTCACTGCCGCAGGGATGGCAACAGCAGGACCAACA
CCCATTATAGCTGGATCAACTCCAACTGCTGCAAAGCTCCTGAAGACGCCAACTATTGGAAGACCCTTTTGCATAGCAA
TGTCACGTCTCATTAGTAAGACTGCTCCAGCACCATCGCTTACTTGGCTAGCGTTTCCAGCAGTAGTGGTGCCATCTTT
AGAGAATGCTGGTTTGAGTTTTGACAGGACTGCCAATGAAGTGCCTGGTCGGATTCCATCATCTGCCGAGACCACTATC
TCCTTTTCCTCACCAGTTTTTGGATCCACAATCTTCGTCGTGAACTGGAACAATTTCTTCCTTGAATTTACCAGAAGCAG
CTGCAGCCGCAGCCTTCCTGTGGGACTCAACAGCAGCCTGGTCTTGCTCCATTCGTGTTATGCCAAATCGTTTTGCAAC
ATTCTCGGACGTGAGGCCCATTGGGAGAAGGCAATCGCGTGCTTGAGAAAACAGCTCAACTTTGGGGTTCACTTGCCCA
TCAAgGCGAACTTGGTTCACTGTCATGGACTCTAGGCCAGCAGCAATACCAATGTCATAAAGTCCTGCTTTAATGTTAG
AAGCAACATTTGCAACTGCTTGAAGCCCAGACGAACATTGCCTGTTTACAGTCATAAGAGGAACGGTATCAGGGAATCC
AGCATAAAATGCAGCCATTCTGCATTCAATTGCCCTTTGGGACCCAGGAGCTAAAACAGTACCAACAACAATATCACCA
ACTTCACTTGGGTTCAACTTCGTTTTATCTATCAAAGCCTTGAATACTGGAACCAAGAGGTCCTCTGCGGGAGTATCCT
TGAAACCACCTCTCTTGGACTTGCAAATTGCTGTCCTATAGGCAGCGACGATGACGACGTCGTCTGCGAAGCACGCCCC
GCGGTGGTACGCGGCGCTGTCCCCCGCGGCGGCACGCGCTCGCGGTGATGGCCGGCGCGGCGGCGGGACTCGCGGCG
GGCTCCAGGTGGGCGAGAAGCACCCTCTGCCTGTTGATCGCCTTCTCCATGCTTAATTAAAGTTCCAATCTCTTATTTC
TTGTttcagaatatacatgctttcgctcacatctcttaccacagtaagtacttgtagtaaggtaccacaacacacacaa
gagaa > SEQ ID NO:4587 219136FL 259824_301709_1c
agtacAGAGAGAGCGATCGATCGAGGAGAGATGGAGGCGGAGAGGAAATTGAGGATGCGCCAGCAAGTGCTGCTGGATC
ATCTCCGGCCGTCGGCGGCGCCTCGCCCTGTCAATCTCGTGACCTCCATTTGCTCTGCTGGGGATTCCGCGGCGTATCC
TAGAACGACTGATTTCTCCGACGATGTTGTGGTTGTAGCTGCTTATAGGACTCCTATTTGTAAAGCCAAGCGTGGTGGT
TTCAAGGACACCTACCCCGAGGACTTGCTGACTCCGGTTCTAAAGGCTGTTGTGGAGAAAGTTGGTTTGAATCCTGCGG
AAGTTGGAGACATCGTTGTTGGAAGTGTGCTTGCTCCTGGATCGCAGCGTGCGAATGAGTGCCGGATGTCGGCATTTTA
TGCTGGATTTCCAGAAACCGTCCCTGTGCGCACGGTGAACAGGCAATGCTCTTCTGGTCTTCAAGCTGTGGCTGATGTT
GCAGCTGCGATCAAGGCGGGTTTTTACGATATTGGCATTGGTGCTGGTCTGGAGTCTATGTCGGTGAACGGGATGGTCT
GGGAAGGCTCAGTAAATCCAAAGGTTGAGATGAACCAAAAGGCTCAAGACTGCTTGCTACCGATGGGCATTACCTCTGA
AAATGTTGCTGAGAGGTATGGAGTGACTAGGCAGGAGCAAGATGAAGTGGCTGTTACCTCTCATCGTCGTGCCGCGGCT
GCAACTGCAAGTGGAAGGTTTAAGGATGAGATCATTCCTATTCCAACAAAGCTTGTCGATCCGAAATCTGGGGAAGAGA
AGCAAGTTGTGATTTCTGCTGATGACGGCTTTCGCCCGAATGCAAAGGTCGCTGATCTTGCGAAGCTGAAGCCGGCGTT
CAAGAAAGGAGGCACCACTACTGCTGGAAACTCAAGCCAAGTCAGTGATGGTGCGGGTGCTGTGTTGCTGATGAAACGG
AGTACCGCCATTCAACGAGGACTGCCTATCCTTGGAGTCTTCAGGAGTTTCGCTGCCGTCGGCGTCGACCCCGCGGTCA
TGGGTATCGGACCAGCTGTTGCGATACCCAAAGCCGTGAGTGACGCCGGTTTGGAGATAAGCGACATTGACTTGTTCGA
ACTAAACGAGGCTTTTGCATCACAATTCACTTACAGCTGCAAGAAGCTCGACCTTGATATGGAGAAAGTGAATGTGAAC
GGTGGTGCTATTGCTCTTGGTCATCCTCTAGGCGCAACAGGAGCTCGCTGTGTTGCTACTTTACTCCATGAGATGGCGA
AACGAGGAAAAGACTGTAGATTTGGAGTTGTATCGATGTGTATCGGTAGTGGAATGGGAGCCGCTGCAGTGTTTGAGAG
AGGAAACACGGTCGacgtcTTAAGCAATGTTCGTCCAGTCCAggcaaaTAACCAGCTGTCGaaggatGCTCGATAGATC
CCCg

FIG. 2 continued

> SEQ ID NO:4588 219136FL 255665_301644_1c
GATCGTTCGCAGGAAATCAGTCGTCGGATCGAATCCGTCCCGGCCGGCCTAGGAACGAATCTGAGAATAGGAAGAATCA
GGAAGAAGAAAGAATGGAGAAAGTTCGCTCCAGACAGCAGGTTTTACTGGACCATCTCCGTCCATGCAGCACTCCTCGG
ATCTCCACTGAACTTGTGAGATCTGTCTGTTTAGCTGGAGATAGTGCAGCTTATGAAAGAAGAACCGACTCTAGCGATG
ATGTGGTGATTGTGGCAGCTTACCGCAGCGCTCTCTGCAAAGCCAAAAGAGGACGCTTCAAGGATACCTACCCTGAGGA
CTTGCTGGCACCGGTGCTCAAGGCTTTGGTAGAGAGAACTGGCGTGAATCCGGCAGAAATTGGAGATATCGTGGTAGGA
ACTGTTCTGGCTCCAGGATCTCAGCGTGCTTCCGAGTGTAGAATGGCTGCTTTCTATGCAGGTTTCCCAGAGAGTGTTC
CTGTAAGAACTGTGAATAGGCAATGTGCATCTGGCTTGCAAGCTGTGGCTGACGTTGTTTCAGCAATAAAGGCAGGATT
TTACGACATAGGAATCGGAGCTGGTTTGGAGTCAATGACAGCGAATCCTATGAGTTGGGAAGGTTCTGTGAATCCAAAG
GTTGAAATGACTCAATGCGCTCAGGATTGTCTTCTT

> SEQ ID NO:4589 219136FL 226571_300998_1c
gatgatgatgacaacgagaaggaggttaCCGTCAACAAGGACGACGGTATCCGACCTGGTGTCACCGCCGAGAAGCTCG
GCAAGCTCAAGCCTGCTTTCTCCGCCGAGGGAACCACCCACGCTGGTAACGCCTCTCAGATCTCCGACGGTGCCGGAGC
CGTTCTCCTCATGCGACGATCTGTTGCCGAGAAGCTTGGCCAGCCCATCCTTGCCAAGTTTGTCCACTGCAAGACCGTC
GGTGTTCCCCCCGAGCTCATGGGAATTGGCCCCGCTTACGCCATTCCTGCTGTCCTTGAGGACCTTGGTCTGACCGTCA
ACGACGTTGACGTTTTCGAGATCAACGAGGCTTTCGCTTCCCAGGCTCTGTTCTCCATCCAGCATTGTGGAATCGACGA
GTCCAAGGTcaACCCCCGAGGTGGTGCCATTGCTATTGGCCACCCTCTGGGAGCCACCGGTGCTCGACAGTTTGCCACT
CTGCTCTCCGAGCTTAAGGAGTCTGGCAAGAAGGTCGGTGTCACCTCCATGTGCATTGGTACCGGTATGGGTGCCGCTT
CTCTGGTTGTTGCCGAGTAAATGTACATACAAGATTATTTATAGAAATGAATCGCGATCGAACAaaaaaaaA > SEQ ID NO:4590 219136FL 226438_301034_1c
acaAGACACACAAAAATGGACCGACTTAACAACCTCGCCACCCAGCTCGAGCAGAACCCCGCCAAGGGCCTCGACGCTA
TCACCTCCAAGAACCCCGATGACGTTGTCATCACCGCCGCCTACCGAACTGCCCACACCAAGGGAGGCAAGGGTCTGTT
CAAGGACACCTCTTCTTCCGAGCTGCTCGCCTCTCTGCTGGAGGGCCTCGTCAAGGAGTCCAAGATCGACCCCAAGCTC
ATCGGTGATGTCGTCTGCGGAAACGTTCTCGCTGCCGGTGCCGGTGCCACTGAGCACCGAGCTGCCTGCCTTGTTGCCG
GCATCCCCGAGACCGTTCCCTTCGTCGCTCTCAACCGACAGTGCTCCTCTGGTCTGATGGCCGTCAACGACGTTGCCAA
CAAGATCCGAGCCGGCCAGATTGACATTGGTATCGGCTGTGGTGTCGAGTCCATGTCCAACCAGTACGGTCCCAACTCC
GTCACCCCCTTCTCCAACAAGTTCCAGAACAACGAGGAGGCTAAGAAGTGCCTGATCCCCATGGGTATCACTTCCGAGA
ACGTTGCCGCCAAGTACAACGTGTCCCGAAAGGCCCAGGACGCCTTTGCTGCCAAGTCCTACGAGAAGGCCGCCGCTGC
CCAGGCCg > SEQ ID NO:4591 219136FL 218466_300918_1c
AGCTCGGCCAGACCATCCTCGGCAAGTACGTCGCCGGCGCCATCGTCGGCGTCGCGCCCCTGCTCATGGGTCAGGGTCC
CTGGAAGGCCATCCCCAAGGCCCTGCAAAAGGCAGGCATCTCCAAGGACGACGTCGACATCTTCGAGATCAACGAGGCG
TTTGCCAGCCAGTGCCTGTGGTGCGCCAACCAGCTGGGCATCCCCCACGAGAAGATCAACCCCAAGGGCGGTGCCATTG
CCTTTGGCCACCCCCTGGGCTGCACTGGTGCTCGGCAGGTTTCGACGCTGCTGTATGAGCTTAAGAGGACGGGTAAGAA
GGTTGGCAACACATCCATGTGCATTGGCACTGGTATGGGCATGAGCGCCGTCTGGGTTGCCGAGTAAAGTGGATGATGA
TTAATAGGTGCGGGTATATATGGGATGAATGTGTACGAATAGAAAACGAGTCTCTTGTTTATGTTCTCGTAAATGCAG
AGAACAATCTAGCATAGAAATATTGAATACCTGATGTTAATA > SEQ ID NO:4592 219136FL 208733_300808_1c
GCAAAGTGATACCGTCTTTACGTCGAATTGTTTCTTAGATCTTGCGGATACAGTACATCACATCGCACCATGGCTGTCG
AACGAATTGGCTCCATCATCAAGCACCTGGCCCCCGGGTCATCGCTGAACAACATCCAGTCCAAGAACCCCGACGACAT
CGTCATCACCTATGCCGCTCGAACACCGCTCACCAAGGCTGGCAAGGGAGGCTTCAAGGACACCAGCCTAGAGTACATG
GTCTATGCTCTGCTGGAGAAGGTTCGCGAGAGAAGCGGTGTTGACCCTGCTCTCGTTGAGGACATCTGCCTCGGCAACG
TGACCGATGCTCAAGCCGCCTACAAGGTCCGAACTGCTGCCCTCGCTGCCGGCTACCCCAACACCGCCGGTGCCAGCTC
CGTCAACCGCTTCTGCTCCTCCGGTCTCAAGGCTATCGCAGACATTGCCCACTCTATCTCCAATGATTCCATCGCTGTG
GGCATTGCCATGGGCGCCGAGCATGTCGCACGGTCGCCCTACTGAGGAGTTTGATGAGGCCGTGTTGAAGAAGAGCC
AGGAGGCCGACGACGCCGTTCAGCCCATGGGCTGGACCAGCGAGAACGTCAGCAAGgACttTGGca > SEQ ID NO:4593 219136FL 200602_300746_1c
GAATTCCAGCTGACCACCATGTCTCAAAGACTACAAAGTATCAAGGATCATGTGGTGGAGAGCGCCATGGGTAAGGGTG
AATCGAAGAGGAAGAACTCGTTGCTGGAGAAAGGACCCGAAGATGTAGTTATTGTGGCTGCTAACAGGTCTGCCATCGG
TAAAGGTTTTAAAGGTGCCTTCAAAGATGTAAACACAGACTACTTATTATACAACTTTCTCAATGAGTTCATCGGGAGG
TTTCCGGAACCTTTGAGGGCTGATTTGAACTTAATCGAAGAAGTTGCCTGTGGAAATGTTCTCAATGTTGGAGCCGGTG
CTACAGAACACAGGGCTGCATGCTTGGCAAGTGGGATTCCCTACTCGACGCCATTTGTCGCTTTAAACAGACAATGTTC

FIG. 2 continued

TTCAGGTTTAACGGCGGTGAACGATATTGCCAACAAGATTAAGGTTGGGCAAATTGATATTGGTTTGGCGCTGGGAGTG
GAATCAATGACCAATAACTACAAAAACGTCAATCCCTTGGGCATGATCTCCTCTGAAGAGCTGCAAAAAAACCGAGAAG
C

> SEQ ID NO:4594 219136FL 196549_300704_1c
CAGTTGATGATGGAATTAGGCCACGGACCACAGCATCTGGATTGGCAAAGCTTAAACCAGTTTTCCGGAAGGATGGTAC
CACAACTGCAGGCAACTCTAGTCAAGTGAGCGATGGTGCTGGAGCTGTTCTTCTCATGAGGAGGGACGTAGCGATGAAG
AAGGGACTTCCTATTCTTGGTGTTTTCAGGAGCTTTGCTGCTGTTGGAGTAGATCCTGCTGTTATGGGTGTTGGTCCTG
CAGTAGCAATACCAGCTGCAGTGAAGTCTGCTGGACTCCAGATTGAAGACATTGATCTGTTTGAATTGAATGAGGCCTT
CGCTTCGCAGTTCGTGTATTGCTGCAACAAGCTGGGACTGGACAGGTCAAAAGTAAACGTGAATGGAGGCGCAATCGCC
CTAGGACATCCTCTTGGTGCAACAGGTGCCCGGTGCGTCGCAACTCTTCTGAATGAAATGAAGCGCCGGGGCAGGGACT
GCAGATTCGGTGTTGTCACCATGTGCATTGGATCTGGCATGGGGGCAG

> SEQ ID NO:4595 219136FL 195453_300634_1c
TCTTCCTCTGTCTGCTATCTTTCCTCCTATCTCAGTCACCCATCCATCCTTTTCCTCCCATCTTTTCACACATTATTAC
AAAATGGGCGCCGCCGACAGAATTTCCCAGATTGGAGGCCAGATCTCCGGCAACCCTACCGCCGGTGGTCGCGACAAGA
TCCTCGAGAAGCGCCCTGACGATGTCGTCGTCACTGCCGCCTGCCGTACCGCCTTCACCAAGGGCGGCAAGGGTGGCTT
CAAGGACACCCCGCTGGCGACCTTCTCGCTGGTGTCCTAAAGGCCATCATCGAACGCTCCAAGATCAACCCTGCGCTC
GTCGAGGACGTCGCCGTCGGCAACGTGCTTGCGCCGGGTGCCGGTGCCACTGAGTTCCGCGCCGCCGCTTTTGTCGCCG
GCTTCACAGAGGAGACGGCCGTGCGTGCGGTCAACAGACAGTGCTCTTCTGGCCTGCAGGCCTGTGTCGATGTCGCGAA
CCAGATCCAGGCTGGTATGATTGATATCGGTATTGGTGCCGGTGTGGAGAGCATGACCCTGAACTATGGCCCCAACGCC
GTGTCCGAACTCTCCGAAGACTTCCAGAAGGTCAAGGAGGCTGCCAACTGCAAGGTCCCCATGGGTGTTCTCTCCGAGG
CCATGGCCGTGGATCTCGGCATCACCCGTGAGAcccaaGAT > SEQ ID NO:4596 219136FL 182981_300664_1c
GAATTCGGAACCGGAGAAAAAGAGTCCAATTCTTATCAAAATCAAATCATCATCATCTCTCATCGCTTTGATCTGAATT
TTCATTTTATAGAGAGAAATGGAGAAAGCTATTAACAGACAAAGAGTTCTGTTAGAACATCTTCGTCCATCGTCTTCCC
AGAGAAGCGAATCTGTGATCTCTCCGTCTATTTGTTTGGCTGGAGACAGTGCTGCATATCAAAGAACTGCTGCTTTTGG
TGACGATGTTGTGATTGTTGCTGCGTACCGAACTGCCCTATGCAAGTCAAAACGTGGAGGTTTCAAAGATACCCTTCCT
GATGACATACTTGCACCTGTTCTCAGGGCTGTGATGGAAAAAACTAATGTTAACCCGGCTGAGGTTGGAGATATTGTTG
TTGGAACAGTCTTGGCACCAGGCTCCCAGAGAGCAAGTGAATGCCGTATGGCAGCATTTTATCTGGTTTCCCTGACAC
TGTGCCCATTAGAACTGTGAACAGGCAATGCTCATCTGGTCTACAGGCAGTTGCTGATGTACCTGCTGCCATAAAAGCC
GGATTTTATGATGTTGGAATTGGAGCTGGCCTGGAGTCGATGTCAGTAAATCCCATGGCCT > SEQ ID NO:4597 219136FL 135382_300413_1c
AGACGACCAGCTCGCGCGCTCGGATCTCAGCCATGGAGAAGGCGATCGATCGCCAGCGCGTCCTCCTCGCCCACCTCCT
CCCCTCCTCCTCCTCCGACCAATCGCTCCTCTCCGCGTCGGCGTGCGCCGCCTGGGACAGCGCCGCCTACCAGAGGACT
TCCGCCTACGGGGACGACGTCGTCGTCGTCGCTGCCTACAGGACACCCATATGCAAGGCCAAGCGAGGAGGTTTCAAGG
ATACATACCCAGAGGACCTTCTTACTGTTGTTCTAAAGGCTGTTCTGGACAACACTAAGATCAACCCTGGTGAAATTGG
TGACATTGTAGTTGGCACGGTGCTAGGTCCAGGCTCGCAGCGTGCAATCGAGTGCAGGGCTGCGGCTTTCTATGCTGGA
GTTCCCGAAAACGTTCCTGTTAGAACTGTCAACCGGCAATGTTCCTCTGGATTACAGGCAGTGGCTGATGTTGCCGCGG
CCATTAAAGCTGGGTTCGACGACATAGGGATtGGTGCAGGCCTGGAATCCATGTCAGTAAATGCTATGGGTTGGGAAgG
ACAAGTAAACCCTAAAGTAAATGaagtccaGAAAGCACAGGAtt > SEQ ID NO:4598 219136FL 142211_300433_1c
ccccaagtaatcggcgctttcgcgagagagagcgataCGAACAAGAGAAAATCTTCTCCAGACACCGCGGCGGGCTTCC
CCACCCCATCGGAAGGAAGAAGACGACCAGCTCGCGCGCTCGGATCTCAGCCATGGAGAAGGCGATCGATCGCCAGCGC
GTCCTCCTCGCCCACCTCCTCCCCTCCTCCTCCTCCGACCAATCGCTCCTCTCCGCGTCGGCGTGCGCCGCCGGGACA
GCGCCGCCTACCAGAGGACTTCCGCCTACGGGGACGACGTCGTCGTCGTCGCTGCCTACAGGACACCCATATGCAAGGC
CAAGCGAGGAGGTTTCAAGGATACATACCCAGAGGACCTTCTTACTGTTGTTCTAAAGGCTGTTCTGGACAACACTAAG
ATCAACCCTGGTGAAATTGGTGACATTGTAGTTGGCACGGTGCTAGGTCCAGGCTCGCAGCGTGCAATCGAGTGCAGGG
CTGCGGCTTTCTATGCTGGAGTTCCCGAAAACGTTCCTGTTAGAACTGTCAACCGGCAATgtTCCTCTGGATTACAGGC
AGTGGCTGATGTTGCCGCGggccaTTAAAGCTGGGTTCTACGACATAGGGATTGGTgcaggCcTggaatccatgtcagt
aaaTGctatgggTtgg > SEQ ID NO:4599 219136FL 153095_200044_1c
GTTCTTCTGGCCTCCAGGCCGTTGCTGCTGTAGCTGCATCAATAAAAGCAGGATTCTATGATATACGCATTGGTGCTGG
ACTAGAGTTAATGACGGTTGACAATATTGGAAGAGTTCAACAAGTTAATCCGAAAGTAGATGCATTTGCACAAGCGCGT

FIG. 2 continued

```
GACTGCCTTCTTCCTATGGGCATTACTTCTGAGAATGTCGCCCAACGTTTTGGAGTGACACGGCTAGAACAAGACCAGG
CTGCTGTTGTTTCTCACCAGCGAGCTGCTGCAGCTACTGCATCTGGAAAGTTCAAAGATGAGATTATCCCAGTATTGAC
AAAGATCGTGGACCCACAAACTCGAAGGGAGAAGCCCATTGTGATTTCTGTAGATGATGGCATTCGGCCAAACACAAAT
TTGACAAACCTGGAAAAGCTGAAACCAGCATTCAAAGTGACGGAACCACAACTGCAGGCACTGCTAGCCAGGTCAGTG
ATG

> SEQ ID NO:4600 219145FL 136763_301608_1c
AGCAATTATACATTAAAATCACCTCATCACCTGCGGATACTATTATGCATATTAATTACTCGACCGGCAACAGCCATCC
CAGCATCCTCTTTTGGTAAAGTAGTGGCCTTCACATGCAAACATCGGCTATCGCAACTAACACCCCCTTCCCCTGTCC

> SEQ ID NO:4601 219145FL 212792_301608_1c
GGACAGGGGAAGGGGGTGTTAGTTGCGATAGCCGATGTTTGCATGTGAAGGCCACTACTTTACCAAAAGAGGATGCTGG
GATGGCTGTTGCCGGTCGAGTAATTAATATGCATAATAGTATCCGCAGGTGATGAGGTGATTTTAATGTATAATTGCT

> SEQ ID NO:4602 263681FL 109369_300045_1c
TCATCTTAAAAAAACTAACACAACCAAGAAAGAAAAAAACGTGCTAATGGAAGATCCTCAAGAAAAAGCAATATTCAT
ATGTATAGAGGAGTAAGGAAGAGAAAATGGGGGAAATGGGTGTCGGAGATACGCGAACCGGGGAAGAAAACACGAATAT
GGCTAGGGAGTTATGAGACACCGGAGATGGCTGCTGCAGCCTATGATGTTGCTGCATTTCATCTAAAAGGCGAGAGAGC
AAGACTCAATTTCCCCGAATTAATCCATAGTTTTCCAAAACCCTCAAGTTCTAAGCCTGAAGATGTGCAAATGTCAGCT
CATGAAGCAGCAATGAGGTTCAAAAGACAAACTCCAGAGCCACCCGAGGGGGTGGCTGTGGCGGTGGTGGCACGGTGG
TTCCGGTGAGGGTAGGTCTATCGTCGAGTCAAATTCAGGCGATTAATGACTCGCCATTGGACTCACCTAAAATGTGGAT
GGAGCTAGCTGGGGCATTGTTATTACGAGATCCAGTTAGAGAATACACTTGTCCCTCGTATTCTTTTACCGATCCTATG
GTATTGTGTGAAGACATTGCTGAGGTTGGGGAGTGGGATGAAATGCAACAGAATCATGATTCCATTTGGA

> SEQ ID NO:4603 263681FL 111230_300053_1c
aatacctcaaactgagacaacatccaatcctactcttctactactactactacttttactctcttaagtatatcagtg
aTCAAGAATAATGGATATATTTAGAAGCTATTACTCGGACCCACTTGCTGAATGTTCATCAATTTCTGACAATGGTGGC
AGCTCCTGTAATAGAGCTAACCTTTCTGATGAGGAAGTTATATTAGCTTCGAATAACCCCAAGAGGCGAGCAGGGAGAA
AGAAGTTTCGAGAAACTCGACACCCAGTATACAGGGGAGTGAGGAAGAGGAATTCAGACAAGTGGGTTTGTGAAGTGAG
AGAACCAAACAAGAAATCAAGAATATGGCTGGGAACTTTTCCTAGTGGCTGCAGAAATGGCGGCTAGAGCTCATGATGTGGCG
GCTATTGCATTAAGGGGCCGTTCTGCTTGTTTGAACTTTGCTGACTCTGCTTGGAGGTTACCTATCCCTGCTTCCTCCG
ACGCCAAGGATATTCAGAAGGCGGCGGCTGAGGCAGCCGAggCTTTCCGGTCGTCTGAggCTGAAAATATGCCGGAGTA
CTCAGGCGAAAATTCAAAGGAAGTTAACACTCCTGAAACGCCAGAAAATATGTTTTATATGGATGAGGAggCGCTATTC
TGCATGCCggGATTaattGCGAATATggCAgaaggactaatgttACCtccacctCAGttcccaAATTGGAGATCATATG
GAAtTAGCTGATGtttacaTGccTttgtggagttattCtatttaAatataacTCtggttatcaCttacca > SEQ ID NO:4604 263681FL 263178_301722_1c
GCAGCATGCCCCTCTCGTCACCAAGGCCAAGGGCCGTAAACTCACGGCTGAGGAACTCTGGTCAGAGCTCGATGCTTCC
GCCGCCGACGACTTCTGGGGGTTTCTATTCCACCTCCAAACTCCATCCCACCAACCAAGTTAACGTGAAAGAGGAGGCAG
TGAAGAAGGAGCAGGCAACAGAGCCGGGGAAACGGAGGAAGAGGAAGAATGTTTATAGAGGGATACGTAAGCGTCCATG
GGGAAAATGGGCGGCTGAGATTCGAGATCCACGAAAAGGTGTTAGAGTTTGGCTTGGTACGTTCAACACGGCGGAGGAA
GCTGCCATGGCTTATGATGTTGCGGCCAAGCAGATCCGTGGTGATAAAGCCAAGCTCAACTTCCCAGATCTGCACCATC
CTCCTCCTCCTAATTATACTCCTCCGCCGTCATCGCCACGATCAACCGATCAGCCTCCGGCGAAGAAGGTCTGCGTTGT
CTCTCAGAGTGAGAGCGAGTTAAGTCAGCCGAGTTTCCCGGTGGAGTGTATAGGATTTGGAAATGGGGACGAGTTTCAG
AACCTGAGTTACGGATTTGAGCCGGATTATGATCTGAAACAGCAGATATCGAGCTTGGAATCGTTCCTTGAGCTGGACG
GTAACACGGCGGAGCAACCGAGTCAGCTTGATGAGTCCGTTTCCGAGGTGGATATGTGGATGCTTGATGATGTCATTGC
Gtcgtatgagtaa > SEQ ID NO:4605 263681FL 263067_301721_1c
gcagcatgaactcatttctgctttttctgaaatgtttGGCTCCGATTACGAGTCTTCGGTTTCCTCAGGCGGTGATTA
TATTCCGACGCTTGCGAGCAGCTGCCCCAAGAAACCGGCGGGTCGTAAGAAGTTTCGTGAGACTCGTCACCCAATATAC
AGAGGAGTTCGTCGGAGAAACTCCGGTAAGTGGGTTTGTGAGGTTAGAGAACCAAACAAGAAAACAAGGATTTGGCTCG
GAACATTTCAAACCGCTGAGATGGCAGCTCGAGGCTCACGACGTTGCCGCTTTAGCCCTTCGTGGCCGATCAGCCTGTCT
CAATTTCGCTGACTCGGCTTGGAGACTCCGAATCCCGGAATCAACTTGCGCTAAGGACATCCAAAAGGCGGCGGCTGAA
GCTGCGTTGGCGTTTCAGGATGAGATGTGTGATGCGACGACGGATCATGGCTTCGACATGGAGGAGACGTTGGTGGAGG
CTATTTACACGGCGGAACAGAGCGAAAATGCGTTTTATATGCACGATGAGGCGATGTTTGAGATGCCGAGTTTGTTGGC
TAATATGGCAGAAGGGATGCTTTTGCCGCTTCCGTCCGTACAGTGGAATCATAATCATGAAGTCGACGGCGATGATGAC
GACGTATCGTTATGGAGTTATtaa
```

FIG. 2 continued

> SEQ ID NO:4606 263681FL 263039_301721_1c
GCAGCATGATAGCTTCAGAGAGTACCAAGAGCTGGGAAGCTAGCGCAGTCAGACAAGAGAATGAAGAAGAGAAGAAGAA
ACCGGTTAAAGATTCCGGTAAGCATCCGGTTTATCGGGGTGTCCGAAAGAGGAACTGGGGAAAATGGGTGTCCGAGATA
CGTGAACCTAGGAAAAAATCCCGAATATGGCTAGGAACGTTTCCTTCCCCGGAGATGGCGGCGCGTGCACACGACGTAG
CCGCTCTTAGCATCAAAGGAGCCTCCGCTATACTCAATTTCCCTGACCTAGCCGGCTCTTTCCCACGCCCTAGCTCGCT
TAGCCCTCGAGACATCCAGGTCGCGGCTCTCAAAGCCGCACACATGGAGACCTCACAGTCTTTTTCTTCTTCTTCTTCT
TTAACGTTTTCATCTTCACAGTCTTCTTCTTCGCTAGAGTCTCTCGTGTCTTCCTCCGCGACCGGCTCCGAGGAGCTAG
GGGAGATTGTAGAGCTCCCAAGTTTGGGATCGAGCTATGATGGTTTGACTCAGCTAGGTAACGAGTTTATATTCTCTGA
CTCCGCAGACTTATGGCCTTATCCACCGCAATGGTCAGAAGGTGATTACCAAATGATTCCTGccTCGTTATCACAAGAT
TGGGATCTTCAAGGACTGTATaattattaa > SEQ ID NO:4607 263681FL 262753_301693_1c
GCAGCATGCAAGACTCTTCCTCTCACGAATCGCAACGTAACCTCCGGTCACCGGTGCCGGAGAAAACCGGAAAGAGTTC
TAAGACTAAAAATGAGCAAAAAGGTGTTTCTAAACAACCAAATTTTCGTGGGGTCAGAATGAGACAATGGGGAAAATGG
GTGTCTGAAATTAGAGAACCAAGAAAGAAATCAAGAATATGGCTCGGTACTTTCTCTACGCCGGAGATGGCGGCGCGTG
CACACGACGTGGCGGCTTTAGCCATCAAAGGTGGCTCTGCCCACCTTAATTTCCCGGAGCTAGCTTACCATTTGCCGAG
ACCGGCTAGCGCGGACCCTAAAGACATTCAAGAAGCCGCCGCCGCAGCAGCTGCCGTTGACTGGAAAGCACCGGAGTCT
CCGTCTAGCACCGTGACGTCATCTCCAGTCGCCGACGACGCTTTCTCCGATCTTCCTGATCTTTTGCTTGACGTGAATG
ATCACAACAAAAACGATGGATTCTGGGACTCGTTTCCGTACGAAGATCCTTTCTTCTTGGAAAATTACTAGTAA > SEQ ID NO:4608 263681FL 262675_301749_1c
GCAGCAATGAACTCATTTTCAGCTTTTTCTGAAATGTTTGGCTCCGATTACGAGCCTCAAGGCGGAGATTATTGTCCGA
CGTTGGCCACGAGTTGTCCGAAGAAACCGGCGGGCCGTAAGAAGTTTCGTGAGACTCGTCACCCAATTTACAGAGGAGT
TCGTCAAAGAAACTCCGGTAAGTGGGTTTCTGAAGTGAGAGAGCCAAACAAGAAAACCAGGATTTGGCTCGGGACTTTC
CAAACCGCTGAGATGGCAGCTCGTGCTCACGACGTCGCTGCATTAGCCCTCCGTGGCCGATCAGCATGTCTCAACTTCG
CTGACTCGGCTTGGCGGCTACGAATCCCGGAGTCAACATGCGCCAAGGGATATCCAAAAAGCGGCTGCTGAAGCGGCGTT
GGCTTTTCAAGATGAGACGTGTGATACGACGACCACGAATCATGGCCTGGACATGGAGGAGACGATGGTGGAAGCTATT
TATACACCGGAACAGAGCGAAGGTGCGTTTTATATGGATGAGGAGACAATGTTTGGGATGCCGACTTTGTTGGATAATA
TGGCTGAAGGCATGCTTTTACCGCCGCCGTCTGTTCAATGGAATCATAATTATGACGGCGAAGGAGATGGTGACGTGTC
GCTTTGGAgttactaa > SEQ ID NO:4609 263681FL 262552_301695_1c
ttGCAGCATGGGAAAACAAATCAACATAGAGAGTAGTGCTACTCATCATCAAGACAATATTGTTTCCGTTATAACAGCC
ACGATATCCTCCTCCTCCGTCGTAACGTCTTCGTCAGACTCTTGGTCTACCTCCAAAAGATCGTTAGTGCAAGACAATG
ACTCCGGAGGGAAACGGCGGAAGAGCAACGTTAGTGATGATAACAAGAATCCGACGTCGTATAGAGGAGTGAGGATGAG
GAGTTGGGGAAAATGGGTGTCGGAGATTAGAGAGCCGAGGAAGAAATCAAGAATATGGCTTGGCACTTATCCAACGGCA
GAGATGGCAGCTCGTGCTCATGATGTGGCGGCTTTAGCTATTAAAGGCAACTCCGGTTTTCTTAATTTCCCTGAATTAT
CCGGTTTGCTTCCTCGTCCGGTTAGCTGCTCTCCTAAGGATATACAAGCTGCAGCTACCAAAGCCGCCGAAGCAACCAC
GTGGCACAAACCGGTTATCGATAAGAAATTAGCTGATGATGAGCTAAGCCACtCTGAGTTGTTGTCTACCGCTCAGTCTTCG
ACTTCTAGTAGTTTCGTGTTTTCTTCGGACACGTCGGAGACTTCTAGTACGGACAAGGAAAGCAACGAAGAGACGGTGT
TTGATTTGCCGGACCTTTTCACGGACGGGCTTATGAACCCAAACGATGCGTTTTGTTTATGCAACGGCAcctttacgtg
gcagctttacggagaggaggatgtagggttcaggtttgaagagccgtttaattggcaaaatgactaataa > SEQ ID NO:4610 263681FL 262503_301695_1c
atgcagcaatgaacTCATTTTCTGCCTTTTCTGAAATGTTTGGCTCCGATTACGAGTCTCCGGTTTCCTCAGGCGGTGA
TTACAGTCCGAAGCTTGCCACGAGCTGCCCCAAGAAACCAGCGGGAAGGAAGAAGTTTCGTGAGACTCGTCACCCAATT
TACAGAGGAGTTCGTCAAAGAAACTCCGGTAAGTGGGTGTGTGAGTTGAGAGAGCCAAACAAGAAAACGAGGATTTGGC
TCGGGACTTTCCAAACCGCTGAGATGGCAGCTCGTGCTCACGACGTCGCCGCCATAGCTCTCCGTGGCAGATCTGCCTG
TCTCAATTTCGCTGACTCGGCTTGGCGGCTACGAATCCCGGAATCAACCTGTGCCAAGGAAATCCAAAAGGCGGCGGCT
GAAGCCGCGTTGAATTTTCAAGATGAGATGTGTCATATGACGACGGATGCTCATGGTCTTGACATGGAGGAGACCTTGG
TGGAGGCTATTTATACGCCGGAACAGAGCCAAGATGCGTTTTATATGGATGAAGAGGCGATGTTGGGGATGTCTAGTTT
GTTGGATAACATGGCCGAAGGGATGCTTTTACCGTCGCCGTCGGTTCAATGGAACTATAATTTTGATGTCGAGGGAGAT
GATGACGTGTCCTTATGGAGCTATTATAA

FIG. 2 continued

> SEQ ID NO:4611 263681FL 259038_301702_1c
gcagcatggtctccgctctcagccgtgccatagagaatccgacagacCCGCCGGTCAAACAAGAGCTTGATAAATCGGA
TCAACATCAACCAGACCAAGATCAACCAAGAAGAAGACACTATAGAGGCGTAAGGCAGAGACCATGGGGTAAATGGGCG
GCAGAAATCCGCGATCCAAAGAAAGCAGCCCGTGTCTGGCTCGGGACTTTCGAGACGGCAGAGGAAGCTGCTTTAGCCT
ATGACCGAGCTGCCCTCAAATTCAAAGGCACCAAGGCTAAACTGAACTTCCCTGAACGGGTCCAAGGCCCTACTACCAC
CACAACCATTTCTCATGCACCAAGAGGAGTTAGTGAATCCATGAACTCACCTCCTCCTCGACCTGGTCCACCTTCAACT
ACTACTACTTCGTGGCCAATGACTTATAACCAGGACATACTTCAATACGCTCAGTTGCTTACGAGTAACAATGAGGTTG
ATTTATCATACTACACGTCGACTCTCTTCAGTCAACCTTTTTCAACGCCTTCTTCATCTTCTTCTTCCTCCCAACAGAC
GCAGCAACAGCAGCTACAACAACAACAACAGCAGCGTGAAGAAGAAGAGAAGAATTATGGTTacaattATTATAACTAC
CCAAGAGAATAaTaagCGgccgcgtcgaggGGT > SEQ ID NO:4612 263681FL 316861_301427_1c
GCAGCATGCCCCTCTCGTCACCAAGGCCAAGGGCCGTAAACTCACGGCTGAGGAACTCTGGTCAGAGCTCGATGCTTCC
GCCGCCGACGACTTCTGGGGTTTCTATTCCACCTCCAAACTCCATCCCACCAACCAAGAGGAGGCAGTGAAGAAGGAGC
AGGCAACAGAGCCGGGGAAACGGAGGAAGAGGAAGAATGTTTATAGAGGGATACGTAAGCGTCCATGGGGAAAATGGGC
GGCTGAGATTCGAGATCCACGAAAAGGTGTTAGAGTTTGGCTTGGTACGTTCAACACGGCGGAGGAAGCTGCCATGGCT
TATGACGTTGCGGCCAAGCAGATCCGTGGTGATAAAGCCAAGCTCAACTTCCCAGATTGCACCATCCTCCTCCTCCTAA > SEQ ID NO:4613 263681FL 316805_301427_1c
GCAGCATGCCCCTCTCGTCACCAAGGCCAAGGGCCGTAAACTCACGGCTGAGGAACTCTGGTCAGAGCTCGATGCTTCC
GCCGCCGACGACTTCTGGGGTTTCTATTCCACCTCCAAACTCCATCCCACCAACCAAGTGAAGAAGGAGCAGGCAACAG
AGCCGGGGAAACGGAGGAAGAGGAAGAATGTTTATAGAGGGATACGTAAGCGTCCATGGGGAAAATGGGCGGCTGAGAT
TCGAGATCCACGAAAAGGTGTTAGAGTTTGGCTTGGTACGTTCAACACGGCGGAGGAAGCTgccATGGCTTATGATGTT
GCGGCCAAGCAGATCCGTGGTGATAAAGCCAAGCTCAACTTCCCAGAttGCACCATCCTCCTCCCCTAA > SEQ ID NO:4614 263681FL 248226_301581_1c
GAAAAATATCTCAACAGCAGTCAAAAGCTTACCTGATCGATCACACATTGAAGCTGCCGCCGCATGGGACAGAGTGAGT
GGAGACGAGAGGCAGCAGTCCAATCCCATCTGGGAGCGGAGAGCAAAGCGCCGCGCTGCCGACGGGCTCGATGAATCCA
CTTCGGCGGAGGAGACCGACTCGAGTCCGAATTACAAGGGAGTTCGTCGCCGCAGCTGGGGGAAGTGGGTGTCGGAGAT
TCGAGAGCCCCGAAAGCGTACCAGAATATGGCTAGGTTCTTTAGCCACGCCGGAGATGGCTGCCAAGGCCTACGACTAC
GCCGTCTACTGCCTGAGAGGCCCCTCCGCAATGCTCAATTTACCAGACTCGCCGACAGCAATCTCTCCTGGTAAGAAGC
TCACTTCCTCTAAAGAGATTCAAGC > SEQ ID NO:4615 263681FL 237977_301290_1c
aAGAGATTTGGAGAGGAGGAATTCACAGCTTTCAATCGAGCAATCCATCAATCAATCAATCAACTCAAGTTCGAAAGCA
ATCCCCGGTCAATCGATCAAGGTTTGGGTCTCTGCTTTAGCTCTCTAGATCCCGCATTGGTCGCTAGCAAAATAGCGCG
GATCAAGGCAGCATCGTCGCCGCCAATGACGGCGGCCAGGAGGTACAAGGGGGTGAGGATGAGGAGTTGGGGGAAATGG
GTGACAGAGATCAGGGAGCCGAAGAAGAGATCGCGCATTTGGCTGGGATCGTACGCCACGGGGAGATCGCAGCCAGGG
CGTACGACGCGGCGCTCATGTGTCTCCGCGGCCCGTCCGCCCAATTCAACTTCCCGGCCTTGGCTCCACGGCATCTCCC
CTACAACCCGCAGTGCTCCCCGGCATTCGTCCAGCAGGCGGCGGCGGAGGCGGCGGCGGAGGCAGCGGAGGCGCTGGGG
ACATCCAGCCCCGAGGAGGAACACTCCAATTCGTCGTCGCATCCTTCTTCATTCGAGACGAGCTCGATATCCACATCCG
GCGAGAACAATTGCTCGTCGATATCGTCGGACGAGGAGGTGAGCACTGCCAAGGGGGGATCGACCGCGATCCAGCAGca
gggaTcaCTGGCGTACGAGg > SEQ ID NO:4616 263681FL 233854_301094_1c
GATAGATCTTGCCAGACCTTCTGTCAGGCGTGAATTGGCGGTGGACAGGACCACCAACGAGCGTTCTAAGTCTCCACTT
TGATGAGAACGGCAAGAAGAGATATCTACCTCGATTTGCAGCCATGGTCGAGAAGCTCTTCCAGCACAGATTGTCTAGG
ATCGAAGATGGAAGCTACTTCCGTCGAACAGGCGGCAACAGCGGCAGCAGCAGCGGGAGTAGCGGCAACGGATCATGTG
GAAGACGAGATCACGGATTGCTTCTTCCCAGGACCAAGTACAAAGGAGTACGAAAGCGGAGCTGGGGGAACTATGTATC
GGAGATCCGGGAGCCGAGCAAGCGGTCTCGAATCTGGCTCGGCTCGTTCGAGACGCCGGAGATGGCGGGCCGAGCTTAC
GACGCCGCCGTTCTGTGCCTGAGAGGTCCACACTCCAGCTTCAACTTCCCAGAGTTCGTCCCCGGCTTGCCTCGTCCTT
TACCGAC > SEQ ID NO:4617 263681FL 183370_300621_1c
CCCACGCGTCCGCTTAGCTAGGACCGACCGATCCGATGTGCGGCGGTGCAATCATCTACGACTACATCCCGGCGCGCCG
CCGGTTGTGCGCCTCCGACTTCTGGCCCGACGCCGACGACTCCGACCCCCACACCCCCGCTCCCGAGAAACCGCCGCGC
GCGAAGAGGGAGCGGAAGAACCAGTACCGCGGGATCAGGCAGCGGCCGTGGGGAAGTGGGCGGCGGAGATCCGCGACC
CGGTGAAGGGGGTGCGCGTCTGGCTCGGCACCTACCCGACCGCCGAGGCCGCCGCGCGGGCCTACGACCGCGCCGCGCG

FIG. 2 continued

```
CCGCATCAGGGGCGCCAAGGCGAAGGTCAACTTCCCCAACGACTTCGGCGCCGCCCCCGCGCCGGCCGCGGCGGCGGCG
AAGGCCGTCCCTCGCGTCGCGCCCACGCCGGCCGTGCTCCCGCCGCCCAAGATGGAGGCGGTGTCCGAGGGCGCCGGCG
CCTGCTCCTCCGACGAGGTCAAGGAGCTGTCCGAGGAGCTGCTCGCGTACGAGAACTACATGAGCTTCCTCGGCATCCC
CTACATGGAGGGCG
```

> SEQ ID NO:4618  263681FL 159280_200022_1c
```
TAAGATTCTCCTTCCCCATCTCCCCCTTTTTTCTTCCTTTTGTGTAGGGTAGATTTTCATCAATACTTATAGAGGTTCC
TTTTTTGGGAAAGAGAAAACCAAAAGGAGGATTCTATTTTGTTGTTTGTTTGATGGTTTCGATGATGGAAGGAGAAAAG
AGAAAGCAAAGGCAACACCAACAAGATAAGCCATATAGAGGTATAAGGATGAGGAAGTGGGGTAAATGGGTTGCTGAAA
TTAGAGAACCAAATAAAAGGTCTCGAATTTGGCTTGGTTCTTACTCTTCCCCTGTCGCCGCCGCTCGAGCTTATGACAC
CGCCGTATTTTATCTCAGAGGTCCTACGGCTAGGCTTAATTTCCCTGAATGTATAGTCAATGATGACCGTGAACTTCAC
GATTTATCTGCTGCTTCTATTCGCAAAAAAGCTACTGAAGTTGGTGCTAGAGTTGATGCTTTGCAAACTGCCGCCCTTC
ATAATAATTCTTCTGCAGGTTTTACTGAATCCAACAGTAATTCAAATATTAACCCGAGAAGGGTTACTATTAAACCGGA
TTTGAATGAATATCCTAGCCCTGAAAGTTGCGACGAAGATAACTGAAATCTGCAGCTTTTAATTAGTTcGaTCTccaaG
aTTTTACTGgCGAaa
```

> SEQ ID NO:4619  42023 159225_200022_1c
```
AGTGAACATTAAGAATGGCGGAAAAAGGAGGAAAAGGGTTTTCTCTACCAAAAAATGGAAAGTCTGCCCTCAAATCTCC
TGCATCCAAAGGGAAGGATGATATCTCAGCAAAATCGAAAAGAGGAAGGAAAGTTCAGTTTGATCCTGAAGGATCACTG
GATACCAATCTCACAAAATCGAATGGAAAAGCTGATCAACCATCTTCCAAAGATGTTTCCGGCAAAGGCGGGAAAGGAG
AAAAAGCTGGCAGTGGTAGTAAAAGTCAAACAGCAAAAGCACCTGGTCCGTTGGAGCTTAGAGTTGAACAAGAACTTCC
GGACAATACAACATGTCTGATGGACTGTGAAGCTGCTGATATTTTGCAAGGAATCCAAGAGCAAATGGTGGTTTTGTCT
GAAGATCCAGCTATAAAACTACCTATTTCATTTGACAGGGGATTGATGTATGCACAAAGGAACAGGCTTTACGATAATC
CCGATACGgttaAACAAATACTCAAACCTCTAAAAGAGCACGGTGTTTccGATGGGGAGCTCTGCATGATTgccaACtT
TGCCGTGGAATCTGTTGATGAAGTAttTTCTCTTGTTCCCTCATTTAagactaaaaagagcaAGCTGagagtt
```

> SEQ ID NO:4620  43341FL 57802_300037_1c
```
GCCATTACGGCCGGGGGATTCAAGGAATTGGAAGATTTCTTGCCCATTGCGAAAAGTCCAGCTGAAGAGTGTGTAATGG
GGGTGGTGGGCAAAGCAGGGGATTGGGCATTTAAGGCGTTCTCAGCGGGGCTGGGCGTTGCCACCATTTTCTTTGCAGC
TTCTTTCTCCCTCAACGTCTACCGTGGTCTCTCTTGGCATAATCGCCAATCGAGAATTGAGAAGGAAGGATCTAAAGTC
CTGCAGCAGGAAGAATGACGGTTTTAGACGTGCTACACTTTTACCTAACGTTGCAAGCCGAGATCATAATATAAGTTCT
GAATCTTTTTACGTTAAAATAACTTGAGGACGAGTATGATTTACACATTCTGTCATTGTTATTCATTTACTGTTGGTGG
CCACATAATTGTGGGAGTTGTAATTCTAAGTAGCTATTTAATTGTAGCAGCTGCTGACCGTTAAAATGGAGTTGGAACA
AGAACAACAACAACAACCCAGTATGGTCCTACAAGTGGGGTCTGGCTAGGAGATAATTTGAAAATGTCCCCTTCGT
TATTACT
```

> SEQ ID NO:4621  43449 114802_300374_1c
```
GGAGCTTCATCTGATGAATTGTGTAAAGAAAACTGAAGAAGGAAACTCTTCAATGGAAAAAGAAATAAACAGATTGGTA
AATTTGCTAAAAGAGGCTGAGCAAGAAGTTTCTTTCAAAGAGGAAGCAGTTCAGTTGAAGAATTCCCTGCATGAAGCTG
AATCTGAGGTGACCTATCTGAAAGAGGTTCTTGGTGAAGCAAAGGGCGAGAGCATGAAATTGAAGGAGTCGCTGTTGGA
CAAGGAAAATGAAGTGCAGAATATTCTTCAGGAGAATGAGGAGCTTCGTAGTAGAGAAGCCGAATCTTTAAAGAAAGTT
GAAGAGTTGTCCAACTCCCTCAAAGAAGCTCTGGCCAAAAAGGAAACTGAAGAAAATGGCGAGCTTTCTGAAAGTGAAA
AAGATTATGATATGCTTCCAAAGGTGGTGGAATTCTCTGAACGAAATGGAGGAGGAATACTGGAGAAGCCTAAGATTGA
AGTTATTCCTCATCAATCTGAGCAATCTGCTGAAGAAAATCTGAAAGAGTCGTCAACATCATCTCGCATGATGAAGCT
GTTGAGACCTTAACTGAAGTTGAGAAGCCAAATGGCGAACTGAAGGGAAATGAGCACAAAGAAAAGGAAGATGATGATT
C
```

> SEQ ID NO:4622  43449 43401_300031_1c
```
AATCCCTCAGTTTTTTCCAAGAAAAGCACAAAAATCCAACATGGAGTATTACAATGATAATGGCTTTTTAGAAGAACTA
TTATCTCTAAGAAATGACTCATGGGATACTACTACAACACTTGTTCCTATGGAAATGACAGATTTTACAACTTTGAAT
CTTTAAACTCTCTTGATATTCCACTTCCTTGTGCTTCTACTACTATTACTACCTCTAATTCCTTTGAAGACTACTCATA
TGATTTGCCATTTGACCAAAGTCTAATAAATTCTTCATTTTATGGTGATGAATTGTCTCCTCTTGAGCTAACTGATAAT
ACGTCCTCATTCCCTAATTCCCATGAAGATTTTCCTCAATCTTGGAAGATGTAGTTGGGAACTATAGTTTTCAGAATT
TGGAAATGGGAATAATATTCCTTGTAAATTGGAGCAAATTCAAGTATGTGAAGCAGCAGCACCTTCCTGTTTCAATGA
TGGTTTGTGTCCAGAAAGAAAGACAAAATCCAAGAAATTAGATGGGCAACCTTCTAAGAACTTAATGGCCGaGagaagg
agaaggAAAAGACTCaATGATAGACTCTCTATGCTtagaTCAgTAGTTccCaagatTAGTAAGAtggAcAg
```

> SEQ ID NO:4623  43449 43409_300149_1c

FIG. 2 continued

CGAGAAACTAGCCGCAGAAAATGTTCAGTCCCTCTTGGAAGAGAAAAACAAACTTATAAATGAGTTGGAGAACTCCACG
GAGGAGGAAGAGAAAAGTAAGAAGGCGATGGAAAGTTTGGCATCGGCATTACATGAAGTTTCTTCAGAAGCAAGAGAAG
CCAAAGAGAGGTGGTTGTCTAGCCAAGCTGAACATGAACATTACGAAACACAAATAGAAGACTTGAAGTTAGTATTGAA
AGCAACCAATGAAAAGTACGAAAGCCTGCTTGATGAAGCGAAAGAGAAAATTGATGATCTCACTAATTCAGTCGAACAA
TCTAAGAATGAGCACCAAATT

> SEQ ID NO:4624 44503FL 102972_300106_1c
GCCATTACCGCCGGGGAATACAGTTTGGATTTTCTTTCTTTGTATGGGGGAGAGCCAAGGCAATGGAAGGGAACACTAT
GTTCAAGTTATCTCATGTAACTGCTTTCTTGCTCCTTGCATCACTTTT

> SEQ ID NO:4625 44503FL 44362_300112_1c
gccattacggccggggATAGTACAATTTGGAGttTcCTTCTTTGTATTTTTCAAAGCAAAGGCAATGGAGGGGAAGACA
ATGGTCAAGTTATCTCATGTATTTGCTTTTTTGCTCCTTGCATCACTTTTGCAATCTCTTACGGCACGAGATCTGGTAT
TCGAAGTGAATGATGGAATAGAAGTCTTGAAATTTCCAATGGCAAAAGAAAACCAAGTGGAAACACTTGATGATGCCTC
TCTATCATTAATTTGCCAAGGGAAGCAAAAATGGCCTGAAGTTGTGGGAATGCCAGGAAGGACTGCTAAGAAAATAATT
GAGAAAGAAAATCCCTTAGTCAAAGTTCATTTTTTGTTCCCTGATATGCTTCAACCATTGGATTTAGATTGTAGTCGAG
TTTTTGTTCTTGTTAACTGGAAATTCATCGTTCAAATTACTCCCTCAGTGGGTTAATAAAATAGTTCTATGGGACTATT
ATGGAAGATTCAGAATAAGTTGCCCCAAGAATTAATAAATAGAGTACTGGTGTTCTATAGTGTACTCTTTATGTACTCT
ACTATTTCGATATAATAAATAAAATAAGTGTGGCCTTTTTAATTTGTATT > SEQ ID NO:4626 44503FL 44185_300387_1c
ttGTCATTaattaAGGCCATTACGGCCGGGGAAAACAATACAGTTTGGATTTTCTTTCTTTGTATTTTTCAAAGCAAAG
GCAATGGAAGGGAAGACTATGTTCAAGTTATCTCATGTAGTTGCTTTCTTGCTCCTTGCATCGCTTTTTCAACCTCTTA
CGGCAAGAGATCTAGTATTCGAAGTAAGTGACGGAATAGAAGTCTTGCAATTCCCAATGGCAAAAGAAAACCAAGTGGA
AACACTTGATGATCCCTCTCTCTCAATAATTTGCCCAGGAAAGCAATCATGGCCTGAACTTGTGGGAAAGCCAGCGGCG
ACTGCTAAGAGAATAATTGAGAAAGAAAATCCCATAGCCAAAGTTCAGTTTTTGTTCCCTGGTATGGTTAGGCCACTTA
ATTATGTTTGTGGTCGAGTTTTTGTTGTTGTTAACTGGAAACTCATTGTTCGAGATACTCCCAGCATGGGTTAATTAAA
TAGTTCTATGGGACTATTATGGAAGATTCAGAATAAGTTGCCCCAAGAATTAATAAATAGAGTACTGGTGTTCTATAGT
GTACTCTTCATGTACTCGTACTATTTCAATATAATAAATAAAATAAGTGTGGCTTTTTAAATTTGTATTATAAAAAAAA
AAAAAAAAAAAAAAAAAAAAAAAAAAAAAAAAAAAAAAAAAAAAAAAAAAAAAAAAAAAAAAAAAAAAAAAAAAAAAAA
AAAAAAAAAAAAAAAAAAAAAAAAAAAAAAAAAAAAAAAAAAAAAAAAAAAAAAAAAAAAAa > SEQ ID NO:4627 44508FL 113092_300021_1c
tgaagtagcccatcacaagaagcattgaattttgttgcgcgcttgacattgcttaagtggctctttaacaaaggcatca
tGGCGGCATGGCGCTAAGGGAACTATGGCTTCAAAACTACCTATAGTGAAAGCAAAGGCTGTTGAAGTTTCAAAATTCT
TGACCAAGCATGGATGTGCATACTACAAGCAGACGTTGGAACAGAACAAGCAATATATTCAAGAGCCACCTACTGTGGA
GAAATGCCAGCATTTGGCAAAACAAGTATTCTACACTCGCTTAGCACTAGTATTCCTTGCCGCTATCAAGCATTCTGGAAG
GAACTTGATGATGTCAAGCACTTGTGGAAGCACAAACAGGAGCTGAAAATCGAGGATGCTGGCATTGCTGCTCTTTTTG
GCCTTGAATGTTTTGCTTGGTTTTGTGCTGGGGAGATCATAGGACGAGGGTTCACGATTACTGGTTATTATGTCTGAAT
GTCTCCAAGTATTAGGTTCGAAAGGAATGACTTATGTCACTGTTGATGAAAGGTCATTGTCAATCTCTACTTTGAGCGG
GATAACACGTATCAGCGAGATACAGATTTTCAATTTTCATGTTTAGCAAGTACAATGTACGCAGAGGATGAGCCTTCTG
CTAAAGATTTCAAAGGCTGAGTTAGGAGTAATATACGTGCTTCAATAAGGCGGCATCAAGCATGTATTGCGCGATTATT
GTTGCTTCTATATGTTTATTTTCCTCTGGAATCAa > SEQ ID NO:4628 44508FL 180804_300625_1c
GAATTCGAAGGACTCTTTCTTCCTTTTCTTCTTCCTCATCTCCAACTCTAAACCCTAAATTTCAACACTACAGGTTTTG
TGATTGATTGTTGTTAGAGATGGCATCCAAGTTGTTCAATTGCAAAGTAAGGCATGTCAAGCGACAAAGTTTGTGAGG
ACACATGGTTCAGCTTATTACAAGCAGAAGTTGGAGCAGAACAAGAAGTTTGTTCAAGAGCCAGCTACTGTTGAAAAGT
GTAATGAATTGTCCAAACAATTGTTCTATACTCGTCTTGCAAGTATTCCTGGTCGTACTGAGTCATTCTGGAAGGAAGT
TGGTGCTGTCAAGCAACTATGGAAGAATAGGCAAGAGCTGAAGGTTGAGGACGCTGGTATTGCTGCTCTCTTTGGTCTG
GAGTGCTTTGCTTGGTTCTGTGCTGGTGAGATTGCAGGAAGAGGATTTACCTTCACTGGTTACCATGTCTGATAAACAC
AATGTACCACCCAATGCTTCAACAAGGA > SEQ ID NO:4629 44508FL 125370_300630_1c
ggcccacgcgtccgAAACCAAGAGGCGCAGGCAGCAAAGTCTCGCCCATCGTCTTTCCTTAACACCTATCCGTAGGTTC
ATTCATTTGCAGAGCTCAAAGGGAATTGATGGCATCCAAAATTCAGCAACTACAATCTAAGGCATGCCAAGCTTCACAA
TTCCTCACCAAGCATGGTACTACCTACTACAAACAGTTTCTGGAGCAGAACAAACAGTATATTGTTGAGCCACCCACCA
TTGAGAAGTGCAATGAATTGTCAAAGCAGTTGTTCCATACTCGTCTTGCCAGCATCCCTGGACGTTATGAGTCATTCCA

FIG. 2 continued

GAAAGAACTTGATTCTGTGAAGCACATGTGGCAGAATAGAAAGGATTTGAAGGTCGAAGATGCCGGTATTGCTGTTTTG
TTTGGCTTGGAATGCTTTGCATGGTATTGTGCTGGTGAGATAGTAGGAAGAGGATTTACATTCACCGGTTACTGCGTCT
GAGATCTTCAGTTTCATAAAATTTGTTCGCACGATTGACACTGCTGTAAGGTCTGTCTCATATTACGGTGTGACTGGGA
GTCTATACAAGAGTTTATGTACACCAAAAGCTTTTAAAGCTGAGAAATCAGCGCTTAAAATTgtttCACAATAATATgc
ccATTTCgttcttttcccACTCCagtgaagtggctt > SEQ ID NO:4630 44508FL 46158_300176_1c
ATCGACTCATCTCTCAGCTCACCGGTGCTGCATTATCAAAACTGCAGGAAGGATTTGGTTGTGAAGATGGCATCGAAGT
TGATACAAGTTCAATCAAAGGCATGTGAGGCTTCAAAGTTTGTGGCTAAGCATGGAACTTCCTACTACAGACAGCTGTT
GGAGAAGAACAAGCAGTATATCCAGGAACCTGCCACTGTTGAGAAGTGCCAAGAGTTGTCTAAGCAGTTGCTCTACACC
CGTCTTGCTAGCATTCCCGGACGCTATGAAACCTTCTGGAAGGAAGTAGACTACGCAAAGAACCTATGGAAGAACAGAT
CCGGTCTG > SEQ ID NO:4631 44508FL 128371_300475_1c
AAACATCGCCCATAGTATTACTGCAAATTGTTGACGAAAGGACTTTCTTGGTATTGATGGCATCCAAGATTCAGCAACT
GCAATCTAAGGCATGTCAAGCTTCACAGTTTCTTGCTAAGCATGGTACTGGCTACTACAAACAGATGCTGGAGCAGAAC
AAACAGTATATTGTGGAGCCACCCAGTGTTGAGAAATGCAATGAATTGTCCAAGCAGTTGCTCTACACTCGTCTTGCCA
GCATCCCTGCCCGTTATGAGTCATTTTGGAAGGAAGTCGATTCCGTCAAGCACATCTGGAGGAATAGAAAGGAATTGAA
GGTTGAAGATGCAGGTATTGCTGCTTTGTTCGGCTTGGAGTGCTTTGCATGGTATTGTGCTGGTGAGATAGTAGGAAGA
GGATTTACATTCACTGGTTACTATGTCTGAGATATCAGTTCCCAAAAATTTGTTT > SEQ ID NO:4632 44508FL 254345_301632_1c
acctTGGTTGAATATTCTCCATCGACGGGGAGAGACAACAACAGGCATGGCCTCACTACTGAAGCAACTGCAAGGCAAA
GCATGCGTGGCCTCCCAGTTCGTGTCGAAACACGGATCGTCCTACTACAAATCCCTGATGGAGAGCAACAAGCAGTACA
TCGCCTCCGAGCCCACCGTTGAGAAGTGTCAGGAACTTTCCAAACAACTCTTTTACACCCGTCTTGCCAGCTTGCCCGC
TCGATATGAACACTTTTGGAAAGAGCTGGATCTCGTGAAGCAGAAAATCAAGAACAGGCAAGACTTGAAGGTGGAGGAG
GTTGGGATTGCTACATTATTTTCATTGGAGTGCTATGCATGGTATTGTGTTGGAGAAATTGCCGGAAGAGGTTTCACTC
TCACAGGCTATTATCCTTGACCTTTTTCAAGCTTCCATTTAAAAGTCTAATAGGGAACCAAGGAGAGAGCTGTTTCAGA
CAAACCTTCCTAATAATGTCACCTGTGTGAATTTACATGACTGCAATTTTTGCAATTATCCGACTGAGTCATGGTCCTT
TGTCTCCTTTTCAGTCTTTTTAAAGATATTTGTTATATCATGGCA > SEQ ID NO:4633 44508FL 116832_300515_1c
GCTGGCGCAGCTACGGTCCAAGGCGGCGCAGGCGTCGGAGCTCGTGTCGAAGCACGGGTGCGCCTACTACAAGGAGGTG
ATGGAGAAGAACAAGCAGCACGTGGTGCAGCCACCCACCGTGGAGAAGTGCCAGGAGCTCTCCAAGCAGCTCTTCTACA
CCCGCCCTCGCCAGTTTGCCAGGCCGCTATGAGGCATTTTGGAAGGAATTTGATGGTGTCAAGCAGGTATGGAAGAATAG
AAAGGAGCTCAAGGTAGAGGACCTTGGAATTGTGACATTATTTGGAGTTGAGCTTTATGCGTGGTTCTGCGTAGGCGAG
ATTGTTGGCAGAGGATTCACCATAACCGGCTATAAGGTCTAGAAGAGTTCTGATTAAGACCTGGTTTATAAAATACACT
GTTAGCTGATGCTTGTCGAAATGACAAAGATACCTCCTGCCTTTTCACAATTTTGTTTATGGAAAGTCTTTCTAGTGCT
GGATGTCAGCCAAGACGAGCACATCGTTGCAACACTGCTTCAATAATTTGCTCGATCTCT > SEQ ID NO:4634 44508FL 1189382_302143_1c
ACCTTGGTTGAATATTCTCCATCGACGGGGAGAGACAACAACAGGCATGGCCTCACTACTGAAGCAACTGCAAGGCAAA
GCATGCGTGGCCTCCCAGTTCGTGTCGAAACACGGATCGTCCTACTACAAATCCCTGATGGAGAGCAACAAGCAGTACA
TCGCCTCCGAGCCCACCGTTGAGAAGTGTCAGGAACTTTCCAAACAACTCTTTTACACCCGTCTTGCCAGCTTGCCCGC
TCGATATGAACACTTTTGGAAAGAGCTGGATCTCGTGAAGCAGAAAATCAAGAACAGGCAAGACTTGAAGGTGGAGGAG
GTTGGGATTGCTACATTATTTTCATTGGAGTGCTATGCATGGTATTGTGTTGGAGAAATTGCCGGAAGAGGTTTCACTC
TCACAGGCTATTATCCTTGACCTTTTTCAAGCTTCCATTTAAAAGTCTAATAGGGAACCAAGGAGAGAGCTGTTTCAGA
CAAACCTTCCTAATAATGTCACCTGTGTGAATTTACATGACTGCAATTTTTGCAATTATCCGACTGAGTCATGGTCCTT
TGTCTCCTTTTCAGTCTTTTTAAAGATATTTGTTATATCATGGCAGTTATGttagGAAaa > SEQ ID NO:4635 48493FL 144457_200135_1c
CCCACGCGTCCGCTGCCTTTTAGCTTCTTTTGAGGTCAAGGggttcGAGTCGACAGCGGTCACCAAAAGGCGATTTTTA
TCTCAGCTGTTCAATCGATTTCAGTATCTTGATCTATGGGAAAGAGGAAGTCAAAGTCAAAGCCACCTCCAAAGAAGAG
GATGGACAAACTTGATACTGTTTTCAGCTGTCCTTTCTGTAGTCATGGCACCAGCGTGGAATGTCGCATTGATATGAAA
AACTTGATTGGCGAGGCGAATTGCAGGATCTGCCAAGAGAGCTTCAGCACCACAGTCACTGCACTAACAGAGCCTATTG
ATATATACAGTGAATGGATTGACGAGTGTGAACGAGTCAACAACTATGAAGAAGATGATGTTCCTACAAGTTAGATCC
TAACGAATGATCTGCTTCAAGATTGTGCAGCTTGTTGAGTAGCCAGAAATGATTTAAAGCTACCTTAAGCTTGACTTCA
ATTTTGGCAATTATTCGTCACACTGCCTAAGAAGAACCTAAACTTATCCAGGCCTCTGGAGTCCAATAAGTAGCTCCAT

FIG. 2 continued

```
TTAAGAGGCTTTCTATGTCcAAATAGTTTGAAACAGAGTCAGTTGCTATCTTGTTTATGTTATGCCCCTGCAATTATAG
CTTGCTTATATGAGACTGGCTtaATGATGTGAACCTAATGTtAaGTAggTTTATTTCTccC
```

> SEQ ID NO:4636 52817 1100748_301463_1c
```
AAAACTCACATTTAAGTTTACAAGATGACGAGAGCAAGAATTTCAGCTGGTGTAGGTTCATCTCAGGCGGATGTTGTTG
TTGACCTGGGACATCCACTTTTAAATAGAACATTCGATGGATTTGTTAAAATTGGAGGGATTGGTGCTGCCCATTCTGC
TGCACAAGAGGCTTTCCACAGCTTGAAAAAGGGCAGTATTTCAAAAAACGACCTTGAACACACGGTGAAACGTATGGGC
AAGGAAGGTTTACAATGGGGTGTTGTTGCTGGAGTTTATAGTGGCATGCAATATGGAATGGAACGAGTCCGAGGAAAGC
AAGACTGGAAGAATGCAATGCTCGGGGGGGCAGTAACAGGAGCCCTTCTTGCATGTGGAGAGAAGGGCTCGAGCAGAGA
CAAAGTCATCCAGAATGCAATCACTGGGGCAGCAGTTGCCACCGCGGTCGAATTCTTGCGCTACGTGATCTAGATGTCA
GTGCTAAAAGAACCCCACCTCCCTTTTGCTTTATGACTTACGAAACTTTTCATGTTCTATAAGAAAATAATAAAAAATA
AA
```

> SEQ ID NO:4637 52817 52809_300084_1c
```
CCCACGCGTCCGAAAATATCCCAAAACCAAAAACAGAGGAAGAAAGAAGAAGAAAAGATGCCTTCAAGCACATTCTCCG
GGACTGTTAGCACGCCGAAGCTGTCGGTGGCAGTGGACATGGGAAACCCTTTTCTCAATCTCACCGTTGATGCCTTCCT
CAAGATCGGAGCTGTTGGAGTCACTAAATCTCTTGCAGAAGACACTTACAAGGCCATCGAGAAAGGGAGTCTCTCCAAG
AGCACTTTGGAGCATGCGCTTAAGAAGTTGTGTAAAGAAGGTGTTTACTGGGGAGCTGCTGGTGGAGTGTACATTGGAA
CAGAATACGGAATCGAACGTATCCGTGGCAGCAGAGATTGGAAAAACGCAATGTTAGCAGGCGCGGCGACAGGAGCAGT
GCTCTCAGCGGTTGGTAAGAAAGGCAAAGACACTATTGTGATCGATGCCATTCTTGGTGGCGCGCTTGCAACCGCTTCT
CAGTTCGTTAACAATCATTATTTCTA
```

> SEQ ID NO:4638 52817 239716_301307_1c
```
tgctctcgtcacctctgggaattttttttgctttgtaacctccctacCTTTGGCTGATTGATCGATTTCTTCTTGCCGC
TAGAGGAAAAATGCCGCAAGGTCGCGTCAACACCAGCTTCGATGGACCCAGTGTGGATGTTCTCATCGACATGGGACAT
CCTCTCCTCAACCGAATCGTGGATGGATTCATCAAAGTCGGCGGGGCCGGTGTCCTCCATGCCGCGGCCCAAGAATCCT
TCCGCTACATGTCGCAAGAGAGCACCAACAAGAGATCTCTCGAGAAATCGGTGAACCAAATGGGGAAGGAGTGTCTGCA
ATGGGGAATGGTGGCTGGAGTCTATTGCGGGATGACTTATACGATGCAGGAAGCTCGAGGCGTCCACGACTGGAAGAAC
GCACTGCTTGGTGGAGCATTGACGGGCGCGGCATTATCGCTGACGGACTCGTCTGTGACCCACGAGCGCGTCATCTCGA
GCGCCATCACCGGCGGAGCGATTGCGACCGCTGCCGAGTTCCTCCGCAATCTGACCTGAAAATTATTCTCAAATCTCCG
GCAGCTCCGCCATGGATGGGAATAATAGTGGTATACTTGTCGATGATCATCTATCTACATATGTGTGCAAGAGCCTGGT
TTTTCTACTGTGACGACTCTTGGCATTtaAAATCTATGA
```

> SEQ ID NO:4639 52817 230992_301073_1c
```
cacgcgtcgggcgtaacgaggctttcatttcttactggcagctcaagcaaacttgttttAGAGGTTGTAACACAAACGA
ATGTCCTCGCTGTGCCAGATCCGGCACGATCTAGAAAAAAAACTTTTGTAGCACCTTTCAACCATATAGTTTGATAGTG
TCTTCTTTTCTTTTCTTTCGATTTCAAGCAAAATGCCGAAGGGAGGGGTCTCTGCCAGCATGAATTCTCC
AACTGTGGATGTCATAATTGACATGGGGAATCCATTCCTGAACAGGACTGTGGATGGATTCTTCAAGATTGGAGCTGTC
AGTGCAGGACATGCAGCGGGCCAAGAAGCTTTTAAATCTCTCAAGAATCAAACTGTTACCAAACGTGATCTCGAGCATA
CGCTCAAGCGCATGGGAAGAGAAGGCTTACATTGGGGAACTATAGCTGGAGTTTACACTGGAATGGAGTATGGCATTGA
GCGAGTTCGTGGAAAGCATGACTGGAAAAATGCAATGCTTGGGGGTGCTGTCACAGGAGCACTCGTGAGCTTCGCTGAA
CCTCACTACAGCCGAGACAAGATGTTTCAGAACGCCATCGCTGGGGCCGCGattgccACGGCctcGGAGTTCCTGCGTC
AGCTTAc
```

> SEQ ID NO:4640 52817 197277_300700_1c
```
GATTCATCGATCGAGAAGTCGAGGTAGTACATACGTTGGATTGGATTGGAGGAGGAGAATGCCTCGCGGTGGGTTCTCG
GGGTCGATAAGCTCGCCCAGGATCGACGTCGCCATCGACATGGGGAACCCCTTCCTCAACCGCACCGTCGACGGCTTCC
TCAAGATCGGCGCCGTCGGGGCGTGCAAGGTCGCCGCCGAGGACACATTCGACTGCCTCCACAGAGGGGATGTTTCAAA
GCACAAGCTTGAGCATATGCTGAAGAAATGTGCAAGGAGGGTGCCTATTGGGTACTGTTGCTGGGGTGTATGTGGGC
ATGGAGTACGGAGTGGAGAGGATTCGTGGTCGCCATGACTGGAAGAATGCTATGATTGGAGGTGCTTTAAGTGGTGCTC
TGATCTCTGCTGCCAGCAACAACCACAAAGACAAGATCATCAAGGACGCCATCACCGGAGGCGCTGTTGCAACAGCTGT
CGAGTTCATCAACTACCTCACTTAGTCATGTAACTGCGTNTTTGCAGTGGCTTTTGTTGGACAGCAAGAATAAGAGCTT
CTTCACTGAAGCCATG
```

> SEQ ID NO:4641 52817 153644_200160_1c
```
GCAGATTTTCAGCATCATTAGCTTCTCCAAAGGTGGATTTGGTTATTGATATGGGCAACCCACTTCTCAACCAAACTGT
TGATGCTTTCTTGAAAATCGGCACTGTTGCTGTCACCAAAACTGCTGCTGAAGAAACTTATCACATCGTCAAAAAAGGC
AGTGTGTCGAGTCACAACTTTGAGAATTCGTTGAAGAAAATGTGTAAAGAGGGTGCTTATTGGGGGACTGTGGCTGGGG
```

TATATGCTGGAATGGAGTATGGAGCAGAGAGGATCCGTGGAACCAGAGATTGGAAGAATGCGATGATTGGGGGTGCATT
GACTGGGGCTCTCATATCTGCTGCAAGCAACAACAATCGCGACAAGATTGTGATGGATGCCATTACAGGAGGTGCTGTT
GCAACTGCTGCTGAGTTTCTTAATTATCTCACATGAATTTCTTACCAACTACTTAAGAACATTGCTTAGCATTTGCTCT
ATTTCTCGAATTGTATCCATTTGAAATTACTAGCTTATGACATGAATCTTAGACTATTTGAATATGTTTAAGTGAATCT
ATAAATTAGCTATCTTTTTCAAAAAAAAAA

> SEQ ID NO:4642 52817 1113092_301794_1c
TTCATCAGTCTTAAGAGAGATGGCGTCAGTGAACTCGAAGGTGTCCTCTGTCGATGTTTTGGTTGATACAGGTCACCCC
CTTGTCAATAGGCTTCTCGATGCTTTCCTTAAATCTGCAGGGGTAGGAGCTGCACACGCCGCATCCCAGGACATCTCCA
AAATGGTTCTTCAAGGGGATTCGAACAAGAAATCTGTCGAAAATATGGTTCAGCGGATGGGCAAGGAAGCAGTTCAATG
GGGACTGGTAACTGGAGTCTACACTGGCATCACATATGGCATGCAGGAGGCCAGAGGAAGACATGATTGGAAGAATGCA
ATGTTGGGAGGAGCTCTAACCGGCGCAGCTCTGTCGTTAACAGAGTCTAATAGCTCCCATGAACGCATAATCCAAATG
CAATCACCGGTGGAGCCATTGCTACGGCCATCGAATTCCTCCGTAGCCTCACTTAAAAACCTTGGAACCACATTAGTTT
GGGATGTAGGCCTAGATGGACTCATCTCATCTAGCATCAGACAATAAGAAAACCTTTTTCTGTGCTATTTTTTTCAAGA
TTAATGAACAAATATATAATAATCTATGCTCTACCCTA

> SEQ ID NO:4643 53376FL 113054_300021_1c
cctttttcgagcaccaaaatatcaatatcaacttcatcagaataatctaaaaacttttttagcctaccaaagtggaaag
cCAAAGAAAAAAATGTCATCTGAGATTTTCAAAGCAACCAATGACTTACCGGAAACAGAAATCTCCGGCCTCAATTTCA
AGGAAACTGAGCTCAGCCTCGGCTTACCCGGCGAATCACGAAAGCAAATCTCCGGCCACAAAACGTGGAATCTCCGACGC
TATGGAATTAAGCCTAGGGAGCTCTAACTCTGAAGATTATCACTCTAAAAATGAAATCTCTACTGGAACCAAACCTCCA
GCAAAGGCACAAGTAGTGGGATGGCCACCTGTGAGGTCATACAGGAAAAACATGATAGACAAGTGCAAGTACGTGAAAG
TGGCAGTAGATGGAGCTCCCTACTTGAGAAAAGTAGATTTGGAGTTGTACGACAGTTACCAGAAGCTGTTAAATGCTCT
ACAAAACATGTTTACTTGCCTAACTATCTGTAATTTTCAAAGCGAAAGCAAGCTTATGGATATTACAAATGGTGTGGAA
TATGTACCAACCTATGAAGATAAAGATGGAGATTGGATGCTTGTTGGAGATGTTCCTTGGAAAATGTTTGttGATGCTT
GTAaGagaATCAGGTTGATGAagagcTCggAaGCaaTTggAttagCtccaaggaCACCCGTGAAATGCTCGAGtAcaaG
CTAAAC > SEQ ID NO:4644 53376FL 125528_300632_1c
CTCAACTTATTAAGAAAAATACCAAAGAAACAAACAAGAGAAGAAAAGAAAAAAGGATTTTTTATTAATTATATTTTGA
AGAAGGATTTTTTAAATTAAAATCTTGACAGAATTCAGATGACGAGTGTGATAGGAGTTGAGTGTGACAAAATTCGATT
GGATTATGAAGCGGAGACGGAGCTTAGGCTAGGGTTGCCTATAGCCATTAATGGAAATGAAGGTGAAATGACGTCAAAG
AATAATGGGAAGAGAGTCTTTTCAGAAACTGTTGATTTGAAACTAAATCTTTCTTCAAAGAATTCTAGGGTTGATAACA
TTAAGGAGAAGAAAAATATTGCTCCCACTGATCCTGCTAAGCCACCAGCCAAGGCACAAGTTGTGGGTTGGCCACCAGT
GAGATCATTCAGAAAGAATGTACTAACCGTCCAAAAGAACAGCACCGGCAACGGCGAAAGCTCCGGCGGCGGCGCAGCC
TTTGTGAAAGTTAGCGTGGACGGAGCTCCATACTTACGTAAAGTGGACTTAAAGATGTACAAAAGCTACCAACAACTCT
CTGATGCCCTTGGCAAAATGTTCAGCTCTTTCACCATTGGAAATTGTGGGACTCATGGATTTAAGGATTTCATGAATGA
GAGCAAATTGATAGACCTCTTAAATGGCTCAGACTATGTACCTACTTACGAAGACAAGGATGGAGACTGGATGCTTGTT
GGAGATGTACCTTGGGAGATGTTTGTTGATTCATGCAAACGCTTGAGGATAATGAAAGGATCAGAGGCCATTGGACTAG
CACCAAGAGCAGTGGAGAAATGcaagAACAGAAGCTGAAATTGATGATCCAATTACTTgttcaTTGTAttttt > SEQ ID NO:4645 53376FL 137014_300441_1c
CGGAGGTCAGTGTCGCAGCGACGAACGCCGACGAGCTAGCTCTCTCTCTCGATCGATGGCCATGGCCGGCGGAGAGCATC
GACGCGGAGCTGCGCCTCGGGCTGCCCGGCAGCGGCGGCGGTGACGGCGTGGCGGCGAAGAAGCGGCGGTCGGCGTCGT
CGACGGTGAAGAGCGAGGCCTCCGGCACGGCCTGCTGCGGCGGCGCCGGCGCCCGGGACGTCGAAGACGGCGCCTCGCC
GGCGTCCAAAGTGCAGGTGGTGGGGTGGCCGCCGGTGGGGTCGTACAGGAGGAGCACGTTCCAGTCGTCGTCGTCGTCG
ACGGCGGCGGCGGCGAAGGGGAAGGCGGCGGCGAGACGGATCAAGGGAGGAAGAATAAGGGAGGAGGGCTGTACGTGA
AGGTGAGCATGGACGGGGCGCCATACCTCCGCAAGGTCGACCTCCGGATGTACGGCGGCTACAGGGAGCTCAGGGACGC
TCTCGACGCGCTCTTCGGCTGCTTCTCCGCCGACGCCTCCGCCTCGCCGCCCACTTCGCCGTCGCCTATGAGGACAAG
GACGGCGACCTCATGCTCGCCGGCGACGTGCCCTGGGACATGTTCATCTCTTCTTGCAAGAAGCTGCGGATAATG > SEQ ID NO:4646 53376FL 158978_200021_1c
CTCTCTCTAAAATTTTGCAAAGTTGTCATTTTGTTAACAAGAAGTGGAAGAAAAATAAGAAGAAGAGATAATTTCATGG
ATCTGAAAGAAACTGAGCTGTGTTTGGGGTTGCCTGGTGGTGGAGAAAGAGATAAAATCAAACGGAAAGAGGGTTTTC
TGAAACTGTTGATTTGAAACTTAATTTTCATACCAATGATTCTTCTTCTCCTATGGATCTCAAGGAGAAAATCAAGACT
CCTACTACTAAAGAAATTGCTAATTGTAACAAGGATTCAGTCAAGCCACCTGCCAAGGCACAAGTGGTGGGTTGGCCAC
CAGTGAGATCTTTTAGGAAAAATGTAATGGCACAGAAAAACAACACTGAAGAAACTGAAAAGAGTAATGCAACTGCTGC
TGCATTTGTGAAGGTTTGCATGGATGGCGCACCTTATCTACGTAAGGTAGATTTGAAGATGTACAAAAGTTACCAGCAA

FIG. 2 continued

CTTTCTGATGCTTTGGCCAAGATGTTCAGCTCTTTTACTATGGGAAATTATGGGGCCCAAGGAATGATAGATTTTATGA
ATGAAAGCAAGCTGATGGATCTTCTCAATAGTTCTGAATATGTACCCACCTATGAAGATAAAGATGGAGACTGGATGCT
CGTGGGGGATGTACCTTGGGAGATGTTTGTTGATTCATGCAAGCGTTTACGCATAATGAAAGGATCAGAAGCTATTGGA
CTTGCACCAAGAGCTATGGAGAAATGCAAGCGCAGGATTTGAAAACTCCATAGAAGGCTATAAACAATATGTTGAAGAA
GCAGCTTTTGTGATTGTTGTTTCCATTTGTCTGTATTTTTATTTTATAGTATATAGTTTTTAATTAAAAGAAGTGATCT
TTAATTTGGACAGTTGTAATAGAGAAGAAGCAATAAACTCAAAAACCCCCCCT

> SEQ ID NO:4647 53376FL 201538_300717_1c
aggcgcaggcgccggcggcgaaggcacaggtggtaggatggccaccaatccgcagctacaggaagaacaccatggcgat
gAGCCAGCCTGCTCTGAAAGGCAAAGACGACGGCGAGGCGAAGCAGGCTCCGGCATCCGGTTGCCTCTATGTCAAGGTG
AGCATGGATGGTGCTCCTTACCTCAGGAAGGTGGACCTCAAGATGTACAAGAACTACAAGGAGCTCTCTTTGGCTCTGG
AGAAGATGTTCAGCTGCTTTACCGTCGGTCATGGTGAATCAAATGGGAAGTCAGGGAGAGATGGATTATCTGATTGCCG
CCTGATGGATCTTAAAAATGGAACAGAACTTGTGCTCACTTATGAGGACAAGGATGAAGATTGGATGCTTGTTGGTGAT
GTTCCGTGGCGAATGTTCACAGACAGCTGTAGGAGGCTGAGGATTATGAAGGGGTCAGATGCAGTGGGCCTTGCTCCAA
GAGCCACTGACAAGAGCAAAAATCGGAACTGAGCAAAAGATGAACCCAATATGAATATCCGACCCCTACAATCACATCA
CTTTTACTTGTAAGgTcCCATTCTCTAAACCACAAGGGTAATGGTCTAAGTTGCGAGAAGGGGATTACTTATACCTATG
TGTCACCCTCTTTTTTTTTTTggtTTTATTTgtaCcaaTTATGTTagaTTTTAaGCGTAAGTTGTGTAAgtTCcTgtaAG
TTGTCTACTTAACCTTGCTTgtagtTTCTtctgtAAAttgtTGTGCTGTATGATGCAAACTATTTTTGggaTTTTACTT
G > SEQ ID NO:4648 53376FL 197257_300700_1c
AACTGGGAACAATATGAATGAGGTGAATGGCTCTGATGCTGTTACAACTTATGAAGACAAGGATGGTGACTGGATGCTT
GTTGGAGATGTCCCGTGGCAGATGTTTGTCGAGTCATGCAAACGCTTGAGGATCATGAAGGGTTCCGAAGCCATTGGTC
TTGCACCAAGAGCAAAGGACAAGTACAAGAACAAGAGCTGAAAATGTTGCAGTATTAAGATGCTGAGCATGGTGCCATA
AGAATGGTGTTCTTGCAGTGTGTTATGGTTTCCTTAGAAATATAAGGTTTTACTTGTTTAGCTGGATTAAAAGAAGGAA
GAGTTGTCATGTTTAATTTGTTTATGGACCAGAAGCAATAATCTATTTGTGTGTAGCTGGATTGGTGTTATGTGATGTC
CCCTACCGTGTGTCCCAAGATCTACTTGATGATTTTATTCCAATGTTGTTAATTTAG > SEQ ID NO:4649 53376FL 35645_300081_1c
TTTAATAAAAATTTCATCTTCTTTTTTCAAAAAGAGTTTTGCAGACATGCATGAGATAATTATTACAGTATGTTCTAAT
TATCTCCTTAATTAATTAAAATGCTTATAAACACAGATTGCTTATGTAATCTCATCGTCTAGTGTCTTGAAGACATGGG
AATATCAGATCAGATCAAATGTCTCTCTGGACCAAAAAAAAAGTAAAAAACCAATGATTAACTCTTATATATAACAAAA
ACCAGATGTACATTTATAAAGCTTTGAGACTCTCTGTCTGAAATAAAAGTTTCTAAAAAGACTCTTCAGTGCATCATCT
TCTCTTGCTTACTGCATCCAAATGTCAAGGCAGATGAAATCTCAGAGCTTTTAATCACACGCAGTCTCTTCACAGATGA
AACAAACATTTGCCATGGAACATCCCCAACAAGCATCTTGTCCCCTTCATTGTCTTCATAGGTTAAAGTAAATTCTCCT
TTCCCATCTAATAATCCAATGATAGGTTTCTCTTCTCCTTGACCATCAGAGATATCTCTTTGAGCTGCGAGTAGACCTC
TGAAGAGTTTGTCAACGACAAAAGAGAGCTGTTCGTAGCTGTTGTAAGCATTGAGATCAACTTTACGACCAATAGGAAC
ACCATCCATGTTGATCTTGACAAACATTCCTTCCTTCTTGGTTTCAACTTGTTTTTCACCATCATCACTCTTGTTGATT
TGACCTCCATGAGAGGATTCGTTACCTAGCTTTGAAGAGCTTGCGCTCGCTAGATTCTTTCTGAACGAACGAACCGGAG
GCCAACCCACCACTGGAC > SEQ ID NO:4650 53376FL 35523_300098_-1c
ccTcatcacCTTCCCAAGAAGAAGAccCCCAAAGAAGAAGAAAGGTTAATAATGATGGGCAGTGTCGAGCTGAATCTGA
GGGAGACTGAGCTGTGTCTTGGTCTTCCCGGTGGAGATACAGTGGCTCCGGTAACCGGAAACAAGAGAGGGTTCTCAGA
GACGGTTGATCTGAAGCTAAATCTGAATAATGAGCCTGCAAACAAGGAAGGATCTACGACTCATGACGTCGTGACTTTT
GATTCCAAGGAGAAGAGTGCTTGTCCTAAAGATCCAGCCAAACCTCCGGCCAAGGCACAAGTTGTGGGATGGCCACCGG
TGAGATCATACCGGAAGAACGTGATGGTTTCCTGCCAAAAATCAAGCGGTGGCCCGGAGGCGGCGGCGTTCGTGAAGGT
ATCAATGGACGGAGCACCGTACTTGAGGAAAATCGATTTGAGGATGTATAAAAGCTACGATGAGCTTTCTAATGCTTTG
TCCAACATGTTCAGCTCTTTTACCATGGGCAAACATGGAGGAGAAGAAGGAATGATAGACTTCATGAATGAGAGGAAAT
TGATGGATTTGGTGAATAGCTGGGACTATGTTCCCTCTTATGAAGACAAAGACGGTGATTGGATGCTCGTCGGCGACGT
TCCTTGGCCAATGTTCGTCGATACATGCAAGCGTTTACGTCTCATGAAAGGATCGGATGCCATTGGTCTCGCTCCGAGG
GCGATGGAGAAGTGCAAGAGCAGAGCTTGAAGTCAAATTAAAAGGATAAGTGGTATCGATTATATATTTGATTAACACA
TTGATTGGTGTTAATTGCTCTTTTTTTCTTACGATGAAATACATTGTTCAGTTTCTTTTGATTGTCTGTGTTTTGATC
AAAAAA > SEQ ID NO:4651 53376FL 271353_200033_1c
cgttatttattatgcatcttgactaccctcgaccacgcgtccgcaatttccacctcatcagaggacaataatgcctgt
gGATTAAATCTCAAGGCAACTGAGCTCAGGCTCGGGCTCCCTGGGTCTCTCTCTCCCGAAAGGGGCATAGAGACTTGCC CTTTGGCCTCGAACGAGAAGCTGCTTTTTCCCTTGCACCCTGCCAAAGATAGTGCTTTGGCCGTATCACAGAAAACAGT
TGTTACCGGCAACAAACGTGGATTTTCAGATGCTATGGATGGATTCTCAGAGGGAAAGTTTATGCCAAATTCAGGTGTG
AAAGCAGGCGAAACAAAGGAGACCTCACATGTTCAACCACCAAAATTGAAAGAGGCAACTAATCAGAACACAGTTCCAG
AGAGGACTTCTGCTGTGAATGAGGCTTCAAACCGTGTAGGCAGCAGTGCCCCTGCTACCAAGGCACAGGTTGTTGGTTG
GCCACCCATTCGATCTTTTAGAAAGAATACATTAGCCTCTACCTCAAAGAACAAGGAAGAGGTGGATGGAAAAGCTGGA
TCACCAGCTCTTTTCATTAAGGTCAGCATGGACGGTGCTCCTTATTTGAGGAAAGTGGACCTCAGAAACTATTCTGCAT
ATCAGGAGCTCTCTTCTGCTCTCGAGAAGATGTTTAGCTGTTTTACTATTGGTCAATACGGATCTCATGGAGCTCCTGG
GAAGGAGATGTTAAGTGAAAGCAAATTGAAGGATTTGCTTCATGGATCTGAATATGTACTCACTTATGAGGATAAAGAT
GGTGACTGGATGCTTGTTGGTGATGTCCCTTGGGAGATGTTTATTGATACCTGTAAAAGGCTGAGAATCATGAAAGGTT
CAGATGCCATTGGCCTGGCCCCAAGGGCTATGGAAAAGTGTCGGAGCAGGAATTAGCCTATCTACACATGATTAAAGCT
ATCCATCCAGCAGTACTGGTATGAAAGGAAATGGAGAAAGGGTGAAGAGACTCAAAAACTTGAATCCTTTTTAAAGCAT
TAACAATGGCTGGTTGTTGGTCCTGGACAGCACAGCATGGGTAGATGGATGGTTTGCTTAGTTAACATTGGCGTTTCTC
ATATTCGCGTaaTtAATGTCGTCTTAAGCTCTTTATCTTGTCTATTaaAAAACCCATTTGATATTTGAGTTTGTCTGCG
aacTAaTGTGTGgtgaaCTGAGaGtTCTTCTagaggtaatttaGTATGTTAAGTGTAtTGCtTGTTgAagtTtCtTTAa
gTGTGTActta > SEQ ID NO:4652 53376FL 263182_301722_1c
GCAGCATGATTAATTTTGAGGCCACGGAGCTGAGATTAGGGCTACCGGGTGGGAATCACGGAGGAGAAATGGCTGGAAA
AAATAATGGTAAAAGAGGATTTTCTGAGACTGTTGATCTCAAACTGAATCTTTCATCGACGGCTATGGATTCAGTTTCC
AAAGTCGATTTAGAGAATATGAAGGAGAAGGTCGTAAAACCACCAGCCAAGGCACAAGTTGTGGGATGGCCACCGGTAC
GATCTTTCCGCAAGAACGTCATGTCCGGCCAAAAACCGACCACCGAGATGCCACCGAAGGAAACGATAAGACTTCTGG
CAGCAGTGGAGCCACCTCATCCGCCTCCGCATGTGCCACCGTGGCTTATGTGAAGGTTAGCATGGACGGTGCACCGTAC
CTACGGAAAATTGACTTGAAACTCTACAAAACTTACCAAGATCTCTCCAACGCCTTAAGCAAAATGTTTAGCTCTTTTA
CCATAGGCAACTATGGACCACAAGGAATGAAAGATTTCATGAATGAGAGTAAATTGATCGATCTTCTAAACGGATCAGA
TTATGTTCCAACATATGAAGATAAAGATGGCGACTGGATGCTTGTAGGAGACGTACCGTGGGAGATGTTTGTTGATTCA
TGCAAACGTATACGAATAATGAAGGGATCGGAagcaatcggacttgctccaagggcattagaaaagtgaagaacagaag
ttga > SEQ ID NO:4653 53376FL 260419_301714_1c
GTTACTACTAATGCTACTGCTGTTAAGAACTGGAGGCCGGCAATTCAAGATCCATCGAGGAATGGTGCCACTGTTGCTA
CTTTCACTCCATTCCAGAGGAGAGGAGATTCGTCACCGATGAATCACTTCTCGTGCTTGAACCAGGGCGAAGAAACTCC
ATCTTCAAGTGGTCCGATGGTTGGGTGGCCACCAGTTCAATCCTTTAGGAAGAACACGTTGGTTGCACCAGCACAAACT
GTAAAGCCGGCCGCGGAGCACACGGCCCCGGATCAAGTCAGTAATGGACAAGCAGCAGCAGCAGTAGCAGCATCAC
TGTTCGTCAAGGTGTACATGGACGGCCTACCGATCGGTCGGAAAGTGGATCTGGATTTCAACAACAGCTACGTCAAGCT
CTCCTCGGCTCTCAAGGACATGTTTAGCGGCTTCGTGAGCGGTGCCGGCCAGCCGCTGTCCAAGCAAAAATCGTCTGGA
GATGTGCAGAACCTCTTTGATGGATATGAGACGGAGTACGTCCTGACTTACGAAGACAAGGATGGGGATTTGATGCTCG
TCGGCGATGTTCCGTGGAGGATGTTTGCAGCTACTGTGAAGAGGCTACGGATCATGAAAGGGTCTGATGCGATCGGTCT
TGGCGTTCCAAGGGATGCCGAGGCTATGACGCGATGAAAGAAA > SEQ ID NO:4654 53376FL 188938_300611_1c
CTTTGGACGACGAGGTCAGTGTCGCAGCGACGAACGCCGACGAGCTAGCTCTCTCTCGATCGATGGCCATGGCGGCG
GAGAGCATCGACGCGGAGCTGCGCCTCGGGCTGCCCGGCAGCGGCGGCGGTGACGGCGTGGCGGCGAAGAAGCGGCGGT
CGGCGTCGTCGACGGTGAAGAGCGAGGCCTCCGGCACGGCCTGCTGCGGCGGCGCCGGCGCCCGGGACGTCGAAGACGG
CGCCTCGCCGGCGTCCAAAGTGCAGGTGGTGGGGTGGCCGCCGGTGGGGTCGTACAGGAGGAGCACGTTCCAGTCTTCG
TCGTCGTCGACGGCGGCGGCGGCGAAGGGGAAGGGCGGCGGCGAGACGGGATCAAGGGAGGAAGAATAAGGGAGGAGGGC
TGTACGTGAAGGTGAGCATGGACGGGGCGCCATACCTCCGCAAGGTCGACCTCCGGATGTACGGCGGCTACAGGGAGCT
CAGGGACGCTCTCGACGCGCTCTTCGGCTGCTTCTCCGCCGACGCCTCCGCCTCCGCCGCCCACTTCGCCGTCGCCTAT
GAGGACAAGGACGGCGACCTCATGCTCGCCGGCGACGTGCCCTGGGACATGTTCATCTCTTCTTGCAAGAAGCTGCGGA
TAATGCGAGGATCTGAGGCGAAATGATATATATCGAAATCG > SEQ ID NO:4655 53376FL 157445_301738_1c
tgtggcaccaagagagctGCTGATCCTATTTCACCTCCCCGTTCTAATGTCAGTCAGGTTGTTGGATGGCCTCCTGTAA
GAACTTATAGGATGAATACCCTAGTTAACCAGACAAAATCACCACCCTCAGAAGAATTTTGCGGGACAATTGAGAAATG
CAGAAGCAAACATATTATCACTAATGCGAGTAGCAGCAAGAGCAACAGTTTTGCCAAGGAGAAAGGGCTGCTCATCAAG
ACTTCCATGTTTGTGGAGGTCAATATGGATGGAGTTGCAATTGGAAGGAAGGTAGATCTGAATGCTCATAGTAGCTATG
AGAACTTGGAACAGACTTTAGATGGGATGTTCTTAAAACCCAGCACAACAGTTTGTGCAAGACCGTCAAATGCACAAGA
GCTAAGTGTCATGTCAGAAACGTCATCTTCAAGATTATTAGATGGATCATCAGAATTTGTGCTGACTTATGAAGACAAA
GAAGGAGACTGGATGCTTGTTGGAGATGTTCCATGGGAGATGTTTGTCAACACTGTGAAAAGGCTAAGAATCATGAGGA

FIG. 2 continued

CTTGTGAGGCTAACGGACTTGCTCCAAGAATCCCTCAGAAACAGGAGAGACAAAAAGGAAAACCAAtctAATTTGCTTT
GGTGCAAGGAAAATGCATGAAATCATAGTTTGGAAGGAAAAAAAAGTAAAACAGAAATAGGGAAGTGTTAAAAGAGTTA
ATGGATCTTGTTACTTTTTCATGGTTGCATTTTTGTTTTGCACCATTTTTCTCTTCATTTTTTTCTTTTTTTTTCTTT
TTGGTTGTGTTTAGGTCTCAAGCccctcatatagctgatacaccaatgttttgcccaaacctactttttctcataatgt
aaatatgggaatccaaattttctc > SEQ ID NO:4656 53376FL 134970_300420_1c
agggcggcggaggaggagggacggatgcggctccgctgacgctcgagctgctgcccaagggcggggccaagcgcgggtt
cGCGGACGCCATCGTTGGGGGTCCCGCCGGCCAGCGGCGGGAGGCGGCCGGGGGCAAGGCGGCGGCGGCGGCGGCGGCG
GCGGAGGCCGAGGAGGAGGAGGAGAAGAAGAAGGCGCAGGCGCCGGCGGCGAAGGCACAGGTGGTAGGATGGCCACCAA
TCCGCAGCTACAGGAAGAACACCATGGCGATGAGCCAGCCTGCTCTGAAAGGCAAAGACGACGGCGAGGCGAAGCAGGC
TCCGGCATCCGGTTGCCTCTATGTCAAGGTGAGCATGGATGGTGCTCCTTACCTCAGGAAGGTGGACCTCAAGATGTAC
AAGAACTACAAGGAGCTCTCTTTGGCTCTGGAGAAGATGTTCAGCTGCTTTACCGTCGGTCATGGTGAATCAAATGGGA
AGTCAGGGAGAGATGGATTATCTGATTGCCGCCTGATGGATCTTAAAAATGGAACAGAACTTGTGCTCACTTATGAGGA
CAAGGATGAAGATTGGATGCTTGTTGGTGATGTTCCGTGGCGAATGTTCACAGACAGCTGTAGGAGGCTGAGGATTATG
AAGGGGTCAGATGCAGTGGGCCTTGCTCCAAGAGCCACTGACAAGAGCAAAAATCGGACCTGAgcAAAAGaTGAACCCA
ATATGAATATCCGACCCCTACAATCACATCACTTTTACTTGTAAGGTCCCATTCTCTAAACCAcaagggTAATGGTcTA
AGttgCGagaagggGATTACTTATACCTAt > SEQ ID NO:4657 53376FL 116869_300515_1c
gccaagggcgccaagcgcggggtctccgacgaggcgcgtccgctgccggcgtccgccgccgccgccgccgccgggga
aGGGCAAGAAGGCGGCGGCCGGCGAGGAGGATGAGGATGCGGAGGAGGAGGACAAGAAGGTCGCCGCCGCGCCGCaGgC
GCCTGCTGCCAAGGCTCAGGTGGTTGGATGGCCACCAATTCGCAGCTACCGCAAGAACACGATGGCTACTAACCAGCTG
AAGAGCAGCAAGGAGGATGCTGAAGCGAAGCAGGGCCAGGGGTTCCTGTACGTCAAGGTCAGCATGGATGGTGCCCCCT
ACCTCAGGAAGGTGGACCTCAAGACCTACAAGAACTACAAGGACCTGTCAACTGCGCTTGAGAAGATGTTCATTGGCTT
CACAACTGGCAAGGATGGCTTATCTGAGAGCCGCAAGGATGGTGAATATGTGCTGACTTATGAAGACAAGGATGGAGAC
TGGATGCTTGTTGGCGATGTTCCATGGGAGATGTTTGCCAACTCTTGTCGCAGACTCAGGATCATGAAAGGTTCAGATG
CAATTGGACTTGCTCCAAGGGCAGTTGATAAGTCCAAAAACCGCAACTAGAATGGTTTCTGCCCCACAGTCAAAAGCAA
GATGGAGATCAAATGACTGTAGGGAATTTTCTGAAAACCAAGAAGTCTAACAGTTTTAAGATGGAGTCTGCCTTATGGT
CTGTACTACATGGTTTGCTATTGTGAAAGTTAAAAAAAAAAGGTGTCTTGTTATGTTAGCTTCGCCAAATCTCCtaggg
ACATAAACTCTATTTGATTGTGCCCAAGTCTTTGTACGTGTGTTAATGCTATTCGTGTAAATGGTTTGGTACACCATGT
GCTACTGCTATGATTGagcACCCCTACCTACT > SEQ ID NO:4658 57142 1188260_302136_1c
CACGCGTCGCTTGTCACTGACGGGACCGATAACCATTTGGTTCTGTGGGATCTTCGGCCTTTGGATTAACAGGAAACAA
ATACGAGAAAGTTTGTGAGCTGTGCCATATTACTCTCAACAAAAATGCTGTGTTTGGAGATAGTGGTGCTTCGGCTCCT
GGAGGAGTGAGAATTGGTACGCCGGCTATGACTTCAAGAGGCTGTGTCGAGGTCGACTTTGAGGTTGTAGCGGAGTTTC
TTATGATGGCTCTTCAAATCTCAGTGAAGATACAAAGGGAGCACGGAAAGCATTTAAAAGACTATTGGAAAGCTCTGCA
TAATAATAAGGAGATCGAGGACATCAGAAACAACGTCGAGAAATTTGCTTCAGTCTTCGAGATGCCAGGGTTTGATACT
GCAACTATGAAGTACAATCAATAGCCTTTGTGTTGAACTGTGCACTCCTTGTTTTATTAATACAAATTTCCATAGAATT
TAGGCAATTTTCATTTCCAAATGTAGGCACACAGATTGCCAAATACACCACTAAAACCGTGACTGGTTTTGATGCCACC
TGGAGATTTTTACATGTACTTGCTATTGAAGAGGTAGCTCTCATATGCTAAGAAATGATTGTGCTCTACATGTACCTTT
GACTGTTAGGACAGTTCTATCATGGAGCCTTGGCATAATGGCAAGTGCCATTCTGAGAATGATGTATTTTATAATTAAA
GTTAACAGGTTAT > SEQ ID NO:4659 57142 137613_300726_1c
gcccacgcgtcgcccatggctactacaccgcgggcgggaagaagatctccgcgacgtcgatctacttcgagagcctccc
cTACAAGGTGAGCGCCGCCACGGGGTACATCGACTACGAGAAGCTGGAGGAGAAGCGCTCGACTTCCGCCCCAAGCTC
ATCATCTGCGGCGGCAGCGCGTACCCGAGGGACTGGGACTACGCCAAGCTCagggccGTCGCCGACAAGGTCGGGGCGC
TGCTCCTCTGCGACATGGCGCACATCAGCGGCCTCGTCGCCGCGCAGGAAGCTGCAAATCCTTTTGAGTACTGTGATGT
GGTTACCACCACCACGCACAAGTCCCTCCGAGGACCAAGAGCTGGCATGATCTTCTACAGGAAGGGCCCTAAGCCTCCC
AAGAAGGGGCCAGCCTGAGGGTGCTGTCTATGACTACGAGGACAAGATCAACTTCGCAGTGTTCCCGTCACTGCAAGGTG
GTCCTCACAACCACCAGATTGCAGCCCTTGCTGTTGCTCTGCAGCAAACCATGACACCTGGATTCAAGGCCTACGCAAA
GCAGGTCAAGGCCAACGCTGTCGCCATTGGCAAGTATCTTATGAGCAAGGGCTACAAAATGGTGACTGATGGAACTGAG
AACCACCTTGTTCTCTGGGATCTTCGCCCTCTTGGCTTGACTGGCAACAAGGTTGAGAAGATGTGTGACCTTTGCAGCA
TTACACTTAACAAGAATGCTGTCTTTGGTGACAGCAGTGCATTGGCTCCTGGCGGTGTCCGCATTGGTACTCCTGCGAT
GACATCCAGGGGTCTTGTCGAgaAggACTTTGAGCAGaTcggcgaGTTcctCCAcc

FIG. 2 continued

> SEQ ID NO:4660 57142 120536_300411_1c
cggacgcgtgggCTGATACAAAGAAGATATCTGCCGTCTCTATATTTTTGAGACCATGCCATACAGACTGAATGAGAG
CACTGGCTACATCGACTATGACCAGCTTGAGAAAAGTGCCACACTCTTTAGGCCAAAGTTAATTGTCGCTGGTGCTAGT
GCTTATGCACGTCTTTACGACTATGCACGTATCCGAAAGGTTTGTGACAAACAGAAGGCTATCATGTTGGCAGATATGG
CTCATATTAGTGGGTTAGTTGCAGCTGGAGTCATCCCATCACCATTTGATTATGCAGATGTTGTGACTACCACAACCCA
CAAATCCCTTCGCGGGCCTCGTGGTGCCATGATTTTCTTCCGGAAGGGTGTGAAGGAGGTTAACAAGCAAGGAAAGGAG
GTGTTGTACGACTATGAAGATAAAATTAACCAGGCAGTCTTTCCTGGACTTCAAGGTGGTCCTCACAATCATACAATTA
CTGGCTTGGCAGTTGCTTTGAAACAGGCAATGACTCCAGAATACAAAGCTTACCAAGAGCAATGCCTTAGCAACTGCTC
AAAATTTGCCCAGGCGTTAGCGGGAATGGGTTATGAACTTGTTTCTGGTGGAACAGAGAATCACTTGGTCTTGGTGAAC
TTGAAAAACAAGGGTATTGATGGTTCTAGGGTTGAAAAAGTTTTGGAAGCGGTACATATTGCAGCCAATAAGAACACTG
TTCCTGGAGATGTATCTGCCATGGTCCCTGGTGGCATCAGAATGGGGACTCCTGCACTCACATCAAGGGGATTTATTGA
GGAAGATTTTGTGAAAGTTGCTGAATTCTTTGATGCTGCTGTGAAGATAGCAGTGAAAATAAAGGGTGAGGCTCAAGGA
ACAAAGTTGAAAGACTTTGTGACAACACTACAGTCTAGTGCTTCCATCCAGTCGGAGATTGCAAAACTCCGCCATGGTG
TGGAGGAGTATGCAAAGCAGTTCCCTACAATTGGGTTTGAGAAGGAAACCATGAAGTACAAAAACTGAGAGCTCGACTG
AGTATATACACAAGGACCAATATCCAATTTCTTGAAGGTGTATGGGATGCACATTCAAACTGCAGTTTGCTCTCAAGGA
TAGGATTTTCATCTTATAATATTATGTAAAATCCAGCAGTACTTGGTTCCCAACTTTGCACTTTGTATATTAACGATTG
TAAATCATCTCAGGTCCTTGAAAGCAATAAACTCCTCTTATCTCAGtAAAAagaaagaagaaAAACattgnccTGTAT
TGCTTAATATTTTCCTTTTATTAATGagagtaccatGTGTTgtgTTGGAAAAAAATG > SEQ ID NO:4661 57142 57182_300378_1c
TAGCTTCTCATTTCACCATTTTCTTAACATCCCCTACATGGCAATTAGTTTTTTATATGACTATTTGGTATATAATTAT
ATCAAAATTATAAGCACGGGGCTAGTCAGCACTAGCAATGGCTCATATTAAGATGTTGATATGGGCATGTTGCTTGCG
CTATTGACTAGTTTTGCCTATGGTATTGGTGTTAATTGGGGTACACAAGCTGCACAAACTTTGCATCCCACAACAATTG
TTCAAATGCTAAAGGATAATAAGATTGATAAGATCAAATTATTTGATTCTGATCATTGGACTGTTAAGTACTTTGCTGG
TACTGGTATTGAGGTTATCCTTGGAATTCCAAACAATCAGTTGGGCAAATTTGCAGATGATTATGACTTTGCCAAGGAA
TGGGTGAAAAAAAATGTCAGCACACATTTGTATGATGGAGGTGTTATTATTAAGTACATTGCTGTTGGAAATGAACCAT
TCTTGAAATCATACAATGGTTCATTCATGAAATCAATATTTCCAGCGTTACAGAATGTTCAAAAAGCTCTTGATTCTGC
TGGACTTGGAGACAAAATCAAAGCTACAATCCCGCAAAATTCCGATGTTTATGAATCTGGTAATTCAGGTCCATCACAT
GGCGA > SEQ ID NO:4662 57142 55763_300141_1c
cccacgcgtccgtcttttcaggccaaaattgattgttgctggtgcaagtgcttatgctagattgtatgactatgcccgc
atcagaaaGgTCTGTAAcAAGCAAAAAGctgtaATGCtAGCagaTATGGCACACATCAGTGgttTGgttgctgctAATg
taATCCCTTCACcgttCGACTATGCTGATGttgtaACCACCACAACTCACAAGTCACTtCGTgGaCCCCgtgGAGCCAT
GATTTTCTtcagaaagggtgttAaggaaAttAAcaaGCAagggAAAGaggttTtGTATGATTTTGAAGACAAGATCAAC
CAAGCTGTcTTCcCTggTCTTCAAGGTGGTCCACACAACCACACTATCACAGGACTAGCTGTTgCTTTGAAACAGGCAA
CTACTtcaGaGTACAAAGCATACCAAGAACAAGTCCTGAGTAACAgtgcaAAgttcgctCagaCTCTAATgGagaGAGG
ATATGAACTTgtttctggTGGAactgacaaccatctggttctAgtgAATCTAAAGCCCaagggaattgATGGATctaca
attgaTAAAgtgttggAAGCTgtttacaTTgcatccaACAaaAACAc > SEQ ID NO:4663 57142 48608_300033_1c
GCCATTACGGCCGGGGCATATTGCAGCCAATAAAAACACTGTGCCTGGTGATGTATCCGCCATGGTGCCTGGTGGCATT
CGCATGGGAACCCCAGCTCTGACTTCTAGGGGATTTATTGAGGAGGATTTTGTGAAAGTGGCTGAATTTTTTGATGCTG
CTGTGAAGTTGGCCCTTAAGGTCAAGGCTGAGACCCAAGGAACAAAGTTGAAGGACTTTGTGGAAACTTTGAGTTCAGA
CTCCAAAATTCAATCTGAGATTGCCAGGCTAAGGCAGGACGTTGAGGACTATGCAAAACAATTTCCTACTGTTGGTTTC
GAGAAAGAAACAATGAAATACAAGGATTGAGCTGGGATCTAGTATTCAGATGGAATCGGAAGGCATTTTTCTCCAATGA
AGTTAGAACTTGTCTTTAGAAGTCTTCTGGAAGTCACTTGCAGGCGAGGAAAACAGTTGCACGGATCACATTTGTATAA
TTTTCTAAATCAAAGTCATGATCAGATGTAATTTTCAAGCTGTAAAACAACTGTTCCAAAATTCAATTTGTCTCACTCT
TGGTTTAGAGAAGGACGAGAAAGCCAACAATGGTTTACGGAAAGTCCTTTGTGGAATACTCGCAAAGG > SEQ ID NO:4664 57142 293346_200265_1c
attaattgttgctggtgctagtgcctatgcacgtctttacgactatgaacgaatccggaaggtctgcgacaaacagaaa
gCTATTTTATTAGCAGATATGGCACACATTAGTGGATTGGTTGCAGCTGGAGTCATCCCATCACCATTTGATTATGCTG
ATGTTGCTACTACCACAACCCACAAATCCCTTCGTGGTCCTCGTGGTGCTATGATTTTCTTCAGGAAGGGTGTTAAAGA
GGTTAACAAGCAAGGCAAGGAGGTTTTGTACGACTATGAAGACAAAATCAATCAGGCAGTCTTTCCTGGACTTCAAGGC
GGTCCTCACAATCACACCATTACTGGCTTGGCAGTTGCCTTGAAACAGGCAATCACTCCAGAATACAAAGCATACCAAG
AGCAGGTCCTCAACAACTGCTCAAAATTTGCCCAGGCTTTAATGGAGAATGGTTATGAGCTTGTCTCTGGAGGAACGGA
GAATCACTTGGTTTTGGTGAACCTGAAAAACAAGGGTATTGATGGTTCTAGGGTTGAGAAAATCTTGGAAGCTGTACAT

FIG. 2 continued

ATTGCAgccaACAAGAACACTGTTCCTGGGGATGTATCTGCCATGGgcCCCGGAGGcatcaggATGgGaactcctgcgc
TCActtatcgtggattagGTGaagAagaTtatgcGAAA > SEQ ID NO:4665   57142 240420_301314_1c
gaGCGGGCTCGTGGCTGCTGGTCAACTTGCTAATCCTTTCGAGTACTGTGATGTGGTTACAACCACTACTCACAAGTCT
TTAAGAGGTCCTCGTGGAGGAATGATATTTTTCCGGAAAGATCCAGTTCTGGGACTGGACTTGGAAACAGCTATAAACA
ATGCAGTATTCCCCGGTCTGCAgggaggACCTCACAATCACACAATTGCTGGACTGGCCGTGTGCCTGAAGCACGCAGT
AACCGAAGAATTCAAGCAGTATCAAAAGCAGGTGATTGCGAACTGTCAAGCGCTTGCAGACAAGCTGGTGGAGttgGGA
TTCACGCTGGTGTCTGGCGGAACCGAAAATCACCTGGTCCTTGTTGATCTGCGTCCTTTGGGAATTGACGGTGCCAGAA
CTGAAAAGGTGCTGGATCGTGCTTCCATCACGCTCAACAAGAACTCAGTACCAGGTGACAAGAGTGCGTTAGTTCCGGG
AGGTGTACGCATCGGCACACCTGCATTGACAACGAGAGGACTCAAGGAAGAGGACTTCGTCAAAGTAGCAGAGTTCATT
CACGAAGGCGTCCAAATCGCCAGACAGCTCAAGGAAACAGTCCGGCAAGGGAAAATGAAAGAGTACGTCCAGGCACTCG
AATCTCCAGACTCTCCAGTCCAGACGAGCATCGCCGATCTACGGAACAGAGTCGAAGC > SEQ ID NO:4666   57142 167971_300552_1c
gaattcggagagagagacacacagtgagagaggtATGGCACTTGACCTTCCACATGGTGGGCATCTTTCTCATGGGTAT
CAGACTGACACCAAAAAAATATCTGCTGTATCTATATTTTTGAGACAATGCCATACCGATTGGATGAGAGCACTGGTT
ACATTGATTACGACCAGTTGGAGAAGAGCGCTACACTCTTCAGGCCGAAACTGATTGTTGCTGGTGCAAGTGCTTATTC
ACGATTCTACGATTATGCACGCATTCGCCAGGTGTGCGACAAGCAAAAAGCTATATTGTTGGCAGATATGGCTCACATC
AGTGGGCTTGTTGCTGCTGGTGTCATCCCATCTCCATTTGAGTATGCCGATGTGGTGACCACTACAACACATAAATCCC
TTCGTGGACCACGTGGGGCCATGATATTTTACAGAAAGGATTGAAGGAAGTCAACAAACAAGGCAAAGATCATGTA
TGACTACGAGGACAAAATTAATCAAGCCGTGTTTCCTGGGCTTCAAggAGGTCCACACAATCACACAATTACTGGATTA
GCAGTTGCACTGAAACAGGCAACTACCCCAGAATACAAGGCTTATCAAGAACAAGTGCTCAAAAATTGCTCACAGTTTG
CCAAAACCTTGAACGCATTGGGATATGACCTTGTTTCCGGTGGTACTGAAAACCATTTAGTCTTGGTCAATTTGAAAAA
CAAGGGTATTGATGGCTCAAGAGTTGAGAAAGTAATGGAATTGGTTCATATCGCTGCTAACAAGAACACTGTTCCCGGG
GATGTCTCTGCCATGGTTCCTGGTGGCATTCGAATGGGAACACCTGCTCTCACTTCAAGGGGATTCCTTGAGGAAGATT
TCGCTAAAGTAGCAGAGTTCTTTGATGCTGCTGTGAATTTGGCCTTGAAAGCCAAAGCTGAATGCAAAAAAGGTGCAAA
ATTGAAGGACTTTATGGCCGCGGTTGAAAACAGTGCTAGCATTCAGTCTGAAATTAAACAGCTCCGTCATGACGTTGAG
GAATATGCAAAGCAATTCCCTACAATCGGGTTCTGCAAAACAACAATGAAATACAAGCAATAAACTCCACTATTATAAG
TGGGCATATATGCTTCGGTAGTGCAGTGGAGTATCTACAAAGGCGAATGAGATGGACACGGGAAGGGAGCAAACTGCCT
TTTAATGTAGGGAATATATGAATGCTTTCAATCAGTGAATGGGATATATTGTTGACACTACAGGGTTCTAAGCATGAAG
AGAGTACCATTTGGTTCAAATTTCATTCTTCATTCAAGAATTGAATTATATGTATATTATTAAACTTGATCAATTATAA
TGCAACAATATAAAgcttgt > SEQ ID NO:4667   57142 127290_300469_1c
CCCCCCCGCTTTATTGAGAAGAAATTGCAGACTGGTTACTGGAGGGACTGACAATCACATGATACTGTGGGATCTGAGA
AATCTTGGGTTAACAGGTAAGAATTTTGAAAAGGTTTGCGAGTTGTGTCACATCACTCTCAATAAAGTAATGGTCTTCG
ATGATAATGGAAGTATTACTCCTGGAGGTGTGAGGATAGGTACCCCTGCTATGACATCAAGAGGCTGTATAGAGAATGA
TTTTGAGACGATAACAGATTTCCTCCTCAAGGCAGCACAGATTACAAATTCAGTACAGAGAGAACATGGAAAGCTCGCA
AAGGCTTTTCTGAAAGGCCTTGAAAACAACAAAGATGTTATTGAGTTAAGAACACGCGTTGAAAGTTTTGCATCACTGT
TTGCAATGCCTGGATTTGAAGTATAATCTAGCTGGAAATCTCGTTCTGGTGGATGAATTCTTTTTTTATTCGTTGACCA
ACCTTTTTTGTGGATTGGGAGAACAATGGTGCACCCAACTCTTGGTTAGTAATTGACTAGGCTTGATATGATTTTAAG
TGTCAATTGAGCTCAAAGCCTGGATTAACTTATGATTGCCACGTTGGAGTATTTTGTGTCCTTATTGACTGTGAAGGTT
GGCTGGAGGTGCCAAAATAAATC > SEQ ID NO:4668   57142 124549_200004_1c
aaATTTCTGCTACTTCGATTTATTTTGAGAGTTTGCCTTATAAGGTGAATTCAACAAATGGATATATTGATTATGATAG
GTTGGAAGAGAAGGCTTTGGATTTAGGCCTAAATTGATTATTTGTGGAGGTAGTGCTTATCCTAGAGATTGGGATTAT
AAGAGATTTAGAGAAATTGCTGATAAATGTGGAGCCCTTTTGCTTTGTGATATGGCTCACATTAGTGGCCTTGTTGCTG
CTCAGGAAGCCGCCGATCCCTTTGAATATTGTGACTTGGTCACTACCACCACTCACAAGAGCTTGAGGGGTCCAAGGGC
CGGTATGATCTTCTACCGCAAGGGCCCTAAGCCACCAAAGAAGGGACAGCCTGAGGATGCGGTCTATGACTTTGAAGAC
AAGATTAACTTTGCTGTTTTCCCCTCGCTCCAGGGTGGTCCTCACAACCACCAAATTGGTGCTCTTGCTGTTGCCCTAA
AACAGGCCGCAACTCCTGGTTTTAAGGCTTATGCTAAGCAAGTTAAGGCCAATGCAGTTGCTCTCGGCAACTACCTCAT
GAGCAAAGGATACAAACTCGTAACTGGTGGGACTGAGAACCATCTTGTCCTTTGGGATCTTAGACCTCTTGGTTTGACT
GGTAACAAGGTTGAGAAGCTTTGTGACCTTGCCAACATTACTGTTAACAAGAATGCTGTTTTGGTGACAGCAGTGCTT
TGGCCCCAGGAGGTGTTCGTATTGGTACTccTGCAATGACATCAAGGGGATTGGttGAgAAGGACTTCGAGCAGAttgc
cgAGttcctccacagGGCTGtTACCATCACCTTGaacatccagaaggagTACggAAAGCTTTTGAaggAtTtCaaCaag
gggtCTTGTCaataacaaggaaaTTGAagaacTc

FIG. 2 continued

> SEQ ID NO:4669 57142 1198102_302209_1c
gggcacttgaggcttttcgcttggacccggcaaagtggggagtgaatgtgcagccaTGTCGGGTTCACCAGCGAACTTC
CATGTTTACACTGCTCTCTTGAAACCACATGACAGAATTATGGCTCTTGATCTTCCTCATGGTGGCCACCTTTCCCATG
GATACCAGACTGATACTAAGAAGATATCGGCTGTTTCAATATACTTTGAGACGATGCCATACCGACTGAACGAAACCAC
AGGCTTCATCGACTATGATCAGCTTGAAAAATCTGCTACTCTATTCAGGCCCAAATTAATTGTTGCTGGAGCCAGTGCT
TATTCCCGGCACTATGACTATGCGCGCATGCGTAAGGTCTGTGACAAGCAAAAGGCTGTGCTCTTGGCGGATATGGCGC
ATATCAGTGGACTTGTAGCTGGTGGTGTGGTTCCCACTCCCTTCGACTTTGCAGATGTTGTTACAACTACTACTCACAA
GTCTTTGCGGGGCCCTCGCGGGGCCATGATATTCTATAGGAAGGGGCTCAAGGAGGTCAACAAACAAGGACAAGAAGTT
ATGTATGATTATGAAGACAAAATCAATGCCGCTGTGTTTCCTGGTCTCCAAGGAGGACCACACAATCACACGATTACTG
GCCTTGCCGTGGCCCTAAAACAGGCAGCCTCATCTGAATTCAAAGCTTATCAGGAGCAAGTTCTGAGTAATTGTGCTCA
TTTCGCAAAATCTCTTATGTCGAAGGGCTATGAGCTTGTGTCTGGGGGAACTGATAATCACCTTGTGCTCGTGAATCTT
AAGAACAAGGGaattgatGGATcaagggtgGAACGTATCTTGGAACTGgcTCACattgctgcaAACAAGAACACCGTCc
ctgggGatgtgtcttgcctGATTCCAGGAGGCATCCGAatggGAACtCctgcTTtGACATCGAGAGGATTTacagAGGA
GAATTTCGaGaag > SEQ ID NO:4670 57142 119088_300066_1c
TGTTTCTGGTGGAACAGAGAATCACTTGGTCTTGGTGAACTTGAAAaAcaAGGGTATTGATGGCTCTAGGGTTGAAAAA
GTTTTGGAAGCGGTACATATTGCAGCCAATAAGAACACTGTTCCTGGAGATGTATCTGCCATGGTCCCTGGTGGCATCA
GAATGGGGACTCCTGCACTCACATCAAGGGGATTTATTGAGGAAGATTTTGTGAAAGTTGCTGAATTCTTTGATGCTGC
TGTGAAGATAGCAGTGAAAATAAAGGGTGAAGCTCAAGGAACAAAGTTGAAAGACTTTGTGACAACACTGCAGTCTAGT
GCTTCCATCCAGTCGGAGATTGCAAAACTCCGCCATGGTGTGGAGGAGTATGCAAAGCAGTTCCCTACAATTGGGTTTG
AGAAGGAAACCATGAAGTACAAAAAATGAGAGCTCGACTGAGTGTATACACAAGGACCAATATCCAACTTCTTGAAGGT
GTATGGGATAGACTTTCAACTGCAGTTTGCTCTCAAGGATAGGATTCTCATCTTATAATAATATGTAAAATCCAGCAGT
ACTTGGTTCCAGACTTTGCACTTTGTATATTAACGAGTGTAAATCAACTGAGGTCCTTGAAAGCAATAAACTCCTCTTA
TCTCAGT > SEQ ID NO:4671 57374FL 105373_300373_1c
GGCATCGTCCGTCAAGTTCAAGGTCGGCGTTGATGTTGGGGAGACAGCTCGATGGCGCTGTTGGAGTTCCATATTCTTG
GAGGTCTTTGGCTGCTGCCAGTGAAGGTAGGAGCAGGCTTGTTTCCGAGATTCGCAATGTATTGGATCTTATGCGCAGG
GGAGAGGCCTTAAGATTCGAGGATGTCATGATCCTCGATCAGTCGGTCTTCTTTGGAATGGCAGATATTCATGATCGCC
ATCGGGATATGCGGCTTGATGTTGATAACATGTCATATGAGGAATTACTTGCACTGGAGGAGCGCATTGGGAACGTCTG
CACTGGGCTTAGCGAAGAAACCATTTTGAATCGCCTGAAGCAACACAAGTATGTATGCATTAAAACAGAAGAACCTGTG
GATGCTGAGCCATGCTGTGTTTGTCAGGAAGAATATAAGGATGGTGAGGATCTTGGGAAACTGGATTGTGGCCATGATT
TTCATACCGACTGCATTAAACAGTGGCTCATGCAGAAGAATTTGTGCCCCATTTGCAAAACAACAGGGCTGAAAACCTG
AGGAAAAGCGTTGAACATTTTTCTCGTGTCAAAGAAGTTGGATGTGACGGTTGGGCTAACGAAGGTTGGC > SEQ ID NO:4672 57374FL 55678_300134_1c
AATGCATGATTTTTTTCGGGAAATGTTGCTTGATGTGGACAACATGCCGTATGAGGAGCTATTGGCACTTGAGGAACGC
ATAGGTGACGTGAGCACTGGCCTAAGCGAAGAGGTCATTTTGAAAGCAATGAAACACCACAAACATACATCTTAGTGTC
CTTCTTGTGTTGAGTTGTATCAGAACATAGAGCCATGCTGCATTTGTCATGAAGAGTATGTATAAGGTGATAATCTATG
AACCTTGAAATGTGGACATGAATTCCACAAGGACTGAATCAAGCAATGGGTCATGATCAAGAATCTCTGCCCCATTTGT
AAGACCGAAGCATTAAAGACGCC > SEQ ID NO:4673 57374FL 187535_300678_1c
ccgccggatgcgcgggTACCGCCATTCCCCGTCGGCCTCGAGGAAGAGATCATGATGTTTCAGACAAGAGTTCTGTTG
GGAGGAATGAGCATGTATGATCGGTACCAGGATTGGCGCCTTGATGTTGATAACATGACATACGAGGAGTTGCTTGAGC
TTGGAGATAAAATAGGTTATGTCAACACTGGATTGCGTGAGGATGAGATAGTTCGCAACCTTAGGAAGGTCAAACACCC
AGCCTTTGACTCCTCGTTCCGGTATTCAACAGAAATGGAAAAGAAATGCAGTATTTGTCAAGAAGAGTTTGAAGCCAAT
GAAGAGATGGGGAGGCTGGATTGCGGTCACAGCTACCATGTTTACTGCATTAAGCAATGGCTTTCTCAGAAGAACGTTT
GCCCAGTTTGCAAGACTGCCGTTACCAAGACTTGAAGTCCGGACTCCGGGCAACGACGATTGTATACCTGGGTCAAACT
TTCAAAACATGTTTGTTTGTGCTCTGTACAGTCAATTACATATGTTATTGTATAAACACATCATCCATTCTTTTGCATT
TGCAGATAGAAATGCCATATTGAGGCATCCTTTATC > SEQ ID NO:4674 57744 107718_300258_1c
cttccattttccaccgttcgggcaagataataaaaactacaagtatatagcagtaacgtttcttcttcttcttcttcct
tTGTGAAGCAAGAAATACTTAATAGTAGAAGAGTATGGCTCTGAGAATGTGGGTTTCTTCAACAGCCAACGCACTAAGA
ATCTCCAGAACCAATCTAATTGCCCCCTCTTTTTCTTTCTCCAGATGCTTTTCAACTGTTCTTGATGGGCTGAAGTATG

FIG. 2 continued

CATCTTCACATGAATGGGTGAAGCATGACGGTTCAGTTGCCACTGTTGGCATCACTGATCATGCTCAGGACCATCTTGG
AGAAGTAGTGTTTGTGGATCTGCCAGAAACAGGTGGTTCTGTTTCCCAAGGAAGCAGCTTTGGAGCTGTTGAGAGTGTC
AAAGCCACCAGTGACATTAACTGTCCTATCTCGGGTGAGATTGTTGAGGTCAACACAAAGCTTACTGAAACGCCTGGCT
TGGTAAATTCAAGCCCATATGAAGATGGATGGATGATTAAAGTGAAGCCAAGCAGTCCATCAGAATTGGAGTCTTTGAT
GGGTTCCAAAGAGTACACAAAATTCTGTGAAGAAGAGGATAGTCATTGACACCTGAATGTACTTCTTGGTCCAATTTGG
ATTAACTGGGGTGCTTAAGGTTGCTATTGTTATAGAAATTTCCAGTCAATAAATAAAATTGTTCAAGCATAAAAAATTA
TCTtccacttGTCTCATAACATCTtTGccTATGCaGtTCTgtgattTGat > SEQ ID NO:4675 57744 1106747_301502_1c
acctgactaaagaacggccaccAGTCAGGTTCTAGGAAGAGAGAGAGAGAGAGAGAGCCTAGCCAGCCAGCCAGCCAGAAA
ACGGTAGTTATGGCCCTTCGTTCATTTGCTGCGCAGGCTGTCTCTCGCCTCCGTTGCAGTTGCCGTAGTAGCGGCAACT
TCGCACCTGCCGTCGCTTCTTCCTTCCTTCGCCATTTCAGCTCTGCCTATCCATCGGACTTGAAGTACGCCAAATCGCA
CGAATGGGTGCGAGCCGAGGATTCCAAGGCGACCATGGGCATTACCGACTTTGCCTTGGAGCAACTGGGAGATGTGGTT
TATGTGGAATTGCCTAGCGTTGGACAGGAGGTAGCTCAAGGCGAGTCTGTTTGCACGGTGGAGAGTGTCAAAGCAGCCA
GTCAGGTCTATGCCCCCATCAGCGGGAAAGTAGTTGAGGTCAACACCGAGATCACAACGAAACCTGAAACGATGAAGGA
TGATCCCTATGGAACAAGCTGGTTGGTGAAATTTGATATCAGCAAACCTGATGAGCTCAAGGCACTCTTGGACGCAGAT
GCTTACAAGACCCAAGTTGAGAGTGAAGAACATCACTGATTTAGTAATCCTGAACCTTATTCTTGTTGTAAGCAGTTG
AATGCCAGTTATCTTTATTGAAATCAAATATGATCCAAATCAGATCAATATGTGGAGGGACTATGGGCTaGtGagttgt
tGTCTTgtcTCGttcTTga > SEQ ID NO:4676 57744 50064_300166_1c
aaaacacagaacaagaattagaaagaagggagagaaagcaaaaatggcgctaagaatgtgggcttcttctacagcaaac
gCTCTCAAGCTTTCTTCTTCTGTTTCCAAgtcTCATCTCTCTCCTTTCTCCTTCTCTAGATGCTTCTCCACAGTTTTGG
AGGGTTTGAAGTATGCAAATTCACATGAGTGGGTTAAACATGAAGGCTCTGTTGCCACCATTGGCATCACTGCCCATGC
TCAGGACCATTTAGGTGAAgtGgtGTTTGTTGAACTGCcagaGGACAATACTTCAGTGAGCAAAGAGAAAAGCTTTGGA
GCAGTGGAGAGTGTGAAGGCAACAAGTGAGATCTTATCACCAATCTCAGGTGAAATCATTGAGGTTAACAAGAAGCTCA
CAGAATCACCTGGCTTGATCAACTCAAGCCCCTATGAAGATGGTTGGATGATCAAAGTGAAACCAAGTAGCCCCGCGGA
GTTGGAATCTTTGATGGGTCCAAAGGAATACACCAAGTTCTGCGAGGAGGAAGATGCTGCTCACTaggAGGGTTTCTCT
CtgtCTTTTATGTTCGAAGTTCTATCAATTCTCATGCTTgttTTCTAAATTTGCATACACtctATGACCAACTTCACAA
AATaaGAGTTCaaGAAGATGAAACAGAGACCtaacAAACACATTaaGATTT > SEQ ID NO:4677 57744 229762_301046_1c
aagcttttgtggccgcaaggctgcgctccagtgcttgtggaaggaacATTCTCTGCCCTAATAATCTGTCTTGCTGCTT
ACTACGATGGCTCTACGCACCATGGCGACGCAAGCTGCGACGCTGCTGAGAATTCGGTGCCAGCCGAACTACCTCGCGC
AGGCGCTGGCAATTCGTGGATTTGCAACTGAAGCCGCAGCTACCGTTCCAATTCCCCAAGATTTGAAGTTCCTCGAGTC
GCATGAATGGGTCGAAAGTGGAGGATGGAACTGGCACCGTAGGAATCAGTGACCATGCTCAGCATGAGCTTGGAGACGTT
GTGTTTGCGGACTTGCCCGAGGTGGGGTCGTCGGTGAGCAAAGGCAAGAACTTTGGCGTGGTGGAGAGCGTCAAGGCTT
GCAGCGACATCTACAGCCCCGTCTCTGGCGAAGTCGTCGAAGTGAACGAAGAGGTCAAGGCAACGCCAGCTCTGGTGAA
CAAGAGTgcatTCGgcGATGGATGgCTCATCAAAGTAAAGCTGTCCAGCGTGTCGGACCTCGACGGCCTAATGGATTCA
GCAGCATACGAAGAGCACGTCAAGAGTGAGGCTCACTAGCCGAGCACACAAAGCGCAAAGCACAAATCACAGTATGTTTCG
AAAAGCTCTACTAGCAAGAAGGATAATTTTCTTTCCAAAGTCC > SEQ ID NO:4678 57744 209384_300814_1c
agctaactaggagaaggaaaaaagaagaacgcagatactttggtaACAAGCAAGAAATTGGCACAGAAATGGCTCTGAG
GCTGTGGGCTAGCTCAGCTGCCAATGCCCTCAAGATCTCATGCAGTGGAGCCACCAGGGCTGCACCTGCCTACTCAATC
TCCAGATACTTCTCCACTGTTCTTGATGGGTTGAAGTACAGCTCCTCTCATGAGTGGGTCAAGAATGATGGCTCTGTGG
CCACAATTGGAATTACAGACCATGCTCAGGGCCATCTGGGAGAGGTGGTGTTCGTGGAGCTGCCGGAGGCGGGGGCGAA
GGTGAGCCAGGGAGGTGCATTCGGCAACGTGGAGAGTGTGAAGGCCACCAGCGACATCAACTCCCCCATCTCCGGTGAG
GTCGTCGAGGTTAACGACAAGCTCTCTGAGACACCCGGCCTGATTAACTCAAGCCCGTACGAGGACGGGTGGATGATCA
AGGTGAAGCCGAGCAGCCCGTCGGAGCTGGACGCCCTGCTGGACCCGGCCAAGTACACCAAGCACTGCgAGGAGGAaga
cgCTCACtaggcTCTTCCTCTCtgtgttTTTTCTCTCCCATTTTgTCACTCCGAccTAAt > SEQ ID NO:4679 57744 175904_300523_1c
GGAAGAGCTCGGCGGTGGAACAGCTCGCTCGATCATGGCCGCCGCCGCCGCCGCCTCAAGGGCGCTCTGGGCTTGCCGC
ACCGCCTCCTACCTTCGGATCTCCTCCTTCCCCAGGGCTTTCTCCACCGTCCTTAAAGATCTAAAATATGCTGATACTC
ATGAGTGGGTGAAGGTTGAGGGTGATTCAGCAACCATAGGGGTCACAGACCATGCTCAGGACCATTTGGGTGATGTTGT
GTATGTTGAGCTTCCACAAGTTGGTTCCACAGTATCACAAGGAACGAACTTTGGTGCGGTTGAAAGTGTGAAAGCAACC
AGTGATATCAATGCACCAGTATCTGGAGAGATTATTCAAGTAAATGATGAACTAAGTGAAAAACCAGGATTTATAAATG

FIG. 2 continued

GAAGTCCATATGAGAAGGGATGGATCATCAAGGTTAAGATAAGTGATCCAAGTGAGTTAAACTCGCTGATGGATGATGA
GAAGTACAAGAAGTTTTGTGAGGAAGAAGATGGCAAACACTGATCAATCCCCTAACTGCTGGATTTCAAGAAACTATGC
AGCAACTCACCATCATGACAATGAGCCATCTCGC

> SEQ ID NO:4680 57744 159722_200141_1c
agcaaacgagagtgtgtgtgccgcaaacttagagagaggagcactgctttgagtactttataagatggctaccaagttg
tGGGCTTCAAGGGTTGCTTCATACCTCAGAGTATCAACGCTTCACAGAGCATTTGCTACTGTTGTCAAGGATTTAAAGT
ATGCAGACTCTCACGAATGGGTCAAAGTTGATGGTAGCTCTGCAACAATAGGCATCACAGATCATGCTCAGGATCATTT
GGGTGATGTTGTGTATGTTGAATTACCCGAAGTGGGGGCTTCTGTTACTCAATCTGGCAGTTTTGGCGCTGTTGAAAGT
GTCAAGGCCACCAGCGATATCAATTCTCCTGTTTCAGGGAAGGTGGTGGAAGTTAATGAGAAGCTCGACTCCTCTCCTG
CTCTGATCAATGGGAGCCCATATCAAGAAGGATGGATTATAAAGGTGGAGATGAACAACCCCGACGAGCTCAAATCGTT
GATGGACCCTGACAaGTAtTCCAGTTTTTGTGATGAAGaagacgCGAAACACTGATTGAAACCTcaCaAAGTTGAGCAa
GaACGCACTTTCCTGCAggattTtTCGTAGtgCATAAataggc > SEQ ID NO:4681 57744 146987_200005_1c
GCCATTACGGCCGGGGACATTACTAGAGAGAAAAATGGCTTTGAGAATGTGGGCTTCTTCAACAGCCAATGCATTGAGA
ATTTCCACTGCCTCAAGAGCTAATCTTTCCCCTGCTTATTCACTCTCTAGATGCTTTTCCACTGTTCTTGATGGGTTGA
AGTATGCATCTTCACATGAATGGGTGAAGCATGAGGGTTCAGTGGCAACAGTTGGAATCACTGACCATGCTCAGGATCA
TCTTGGAGAAGTGGTGTTTGTGGATCTACCAGAAACTGGTGCTGCTGTTTCACAAGGAAGCAGTTTTGGTGCTGTTGAA
AGTGTGAAAGCTACCAGTGACATTAACTGTCCAATCTCGGGCGAGATCGTTGAGGTCAATACAAAGCTCACTGAAACAC
CTGGTTTGGTTAATTCGAGTCCATATGAAGACGGTGGATGATTAAGGTGAAGCCGAGCAGTCCATCCGAGCTAGAATC
TTTGATGGGGTCCAAAGAGTACACAAAATTCTGTGAAGAAGAGGATAGTCACTAAAACTTGAAGGTGTTTTGTTTATTC
AACTTGGACTAACTTTGCCTGGTTAAGGCTGATACTGTGATGAAACTTCCTGTCACTTGTTAAAATTCTACAAAAATCA
AAACAACATCCACTTTTCTGGTGTTTTTTTTGCCTTATGCAGAGTTGTGATGTAGTCTTTTGGTAATTAAGATCATCTT
GCTCTCTGATTATTACACTCCGATGTTTTCTAAAAAAAAAaacat > SEQ ID NO:4682 57744 138902_300728_1c
GGAGAGAGAGAGAGACAGACAGAGTGCGGCGCCGAGGAGGAGAGGAGCAATAATCCAATTCCAATCCATTCCTCCGCGACC
TCGTCGTCCGATCATGGCCGCCTCCAGGTTGCTGTGGGCTTCCCGCGCCGCCTCCTACCTCAAGATCTCCACT
TTCCCCAGGGCCTTCTCCACCGTGCTGAAGGATCTGAAGTATGCCTGACACTCATGAATGGGTTAAGGTTGAGGGTGATT
CGGCAACCGTTGGAATTACAGACCATGCCCAGCACCATTTGGGTGATGTTGTGTATGTGGAGCTTCCAGAAGTTGGCAG
CAGTGTATCCCAGGGAAAGAACTTTGGTGCTGTTGAAAGTGTGAAGGCAACCAGCGATATCTACTCTCCAGTATCTGGA
GAGGTGGTTGCAGTGAACGATGGACTAGGCGATGAACCTGGATTGGTTAATACAAGTCCATACGAGAGTGGGTGGATCA
TCAAGGTCAAGGTTAGTGATTCAGGTGAGCTCAATTCATTGATGGATGACGCGAAATACTCGAAATTCTGCGAGGAAGA
AGATAGCAAGCATTGAACAAATACCAGTGACTTGTGATCTGCAAAGAATGCGCCTTGACCCTTTTGTCAATGCTTGTGA
TGTGCTATCGAGCACTTATCTTTACCACCGGCTGCTCCTGAAA > SEQ ID NO:4683 57744 136845_300439_1c
cccgatccctcatcctcactgcagctttccgctatactaccaccaccactgagctgccactactcatccagctaactag
gAGAAGGAAAAAAGAAGAACGCAGATACTTTGGTAACAAGCAAGAAATTGGCACAGAAATGGCTCTGAGGCTGTGGGCT
AGCTCAGCTGCCAATGCCCTCAAGATCTCATGCAGTGGAGCCACCAGGGCTGCACCTGCCTACTCAATCTCCAGATACT
TCTCCACTGTTCTTGATGGGTTGAAGTACAGCTCCTCTCATGAGTGGGTCAAGAATGATGGCTCTGTGGCCACAATTGG
AATTACAGACCATGCTCAGGGCCATCTGGGAGAGGTGGTGTTCGTGGAGCTGCCGGAGGCGGGGGCGAAGGTGAGCCAG
GGAGGTGCATTCGGCAACGTGGAGAGTGTGAAGGCCACCAGCGACATCAACTCCCCCATCTCCGGTGAGGTCGTCGAGG
TTAACGACAAGCTCTCTGAGACACCCGGCCTGATTAACTCAAGCCCGTACGAGGACGGGTGGATGATCAAGGTGAAGCC
GAGCAGCCCGTCGGAGCTGGACGCCCTGCTGGACCCGGCCAAGTACACCAAGCACTGCGAGGAGGAAGACGCTCACTAG
GCTCTTCCTCTCTGTTTTTTTCTCTCCCATTTTGTCACTCCGACCTAATTTCTCCCTGTTGCAACAACTgctCTGTATc
cGTATACGATTAATAACTGAATCttcaggCTTtgccatgtGTTc > SEQ ID NO:4684 57744 129901_300483_1c
GAATTCATGAGAGTGTGGGCTTCTTCAATTGCGGGGCACTTAAATTCTCTTCATCTTCTACCTTGAAGCAGACTTCAC
TCTATCCATCTGCTTTTGCCGCCTCCAAATGCTTCTCCACCGTTTTGGATGGATTGAAATATGCACCATCACATGAATG
GGTGAAACATGAAGGAGATGTACCTACCATTGGTATTACAGACCATGCTCAGGATCATTTGGGAGAGGTGGTGTTTGTG
GAGCTACCATAAGCTGGTGGTGCAGTGACAAAAGCAAGTGGATTTGGAGCTGTAGAGAGTGTCAAGGCAACAAGTGACA
TCAACTCGCCTATTTCTGGAGAGATTGTTGAGGTCAACACCAAGCTCACCGACACCCCTGGCTTGATTAACTCAAGTCC
TTATGAGGATGGATGGATGATCAAAGTGAAACCATCAAGTCCAGCTGAACTTGAATCTTTAATGGATTCAAAGGGTTAC
ACCAAGTTCTGTGAGGAAGAAGATGCCAGCCATTAATTTAGTTTGATGGATATGTTTCTTTCTTTGCCACTTTGTTTCG
AAATTTCGATTTGGGTTAGCTAACTGAAATTTCTCCATCTGCAGTTGTTATCAATAATGATGTCAATATTACTGAA

FIG. 2 continued

> SEQ ID NO:4685 103560FL 156583_301367_1d
atactaggttgcgctaacatagctcggaaactatcacgctgccatcgcgcttgctccaaacgccactatctccgccgtc
gGGAGCCGTACGATCGAAAAAGCAACAGCGTTTGCTAAGGAAAACGGctATCCGTCGACTACAAAGTTATACGGCAGTT
ATGAGGCTGTTCTGGATGATACGGAAATTGATGCCGTTTACATACCTCTTCCGACAAGCCTGCATGTGAAGTGGGCTGT
TTTGGCGGCcCaGAAAAAGAAGCACGtttaGCTGGAAAAGCCCGTCGCTTTAAACGTGAAGGAGCTGGATACGATTTTG
GAGGCGTGTGAATTGAATGGGGTGCAGTACATGGATGCTACCATGTGGATGCATCATCCTCGTAGTGTTAAGATGAAGG
AGTTCCTCTATGATTCTCAGCGTTTTGGCCAACTCAAATCGGTACACAGCACTTTTGCTTATCTTGGTGACCAAGAGTT
TCTAAAGAATGACATTCGTGTGAAAGCCGACCTTGATGCTCTAGGTGCTCTAGGCGATGCTGGTTGGTACAGTATTCGT
GCGATCTTGTGGACTACTGATTATGAATTGCCCAAAACTGTGACGGCTCTGCCTGATCCAGAATTAAATGAAGCTGGAG
TTATCCTATCCTGTGGTGCTTCTTTGAGTTGGAAAGACGGAAGGGTAGCAACTTTCTATTGTTCGTTTTAGCCAATTT
GGTCATGGATATCGCTGCTAATGGATCCAAAGGAAATTTGCGGGTGCATGACTTTGTAATTCCGTTTCAAGAAAATGTT
GCTCCATTTTACACGGTGGAAAGTTCGAGGTTTGGTGAACTTTCTATATCGATTCATCCTGCACCAAATGAGCAAATAG
TAAGCACTGATCTCCCACAAGAggCTCTCATGGTAAAGGAGTTCTCTAATCTGGTCCGAAGTATCAAAGGGGAAGGTTG
TAAACCTGAGaaGAAGtggccaacaATTAGTAGAAAAACACaaCTTGTGGTGGATGCTGTCaagGCGTCAATTGACAag
gGTTTTGAGCcTgttga > SEQ ID NO:4686 103560FL 275042_200153_1d
ATTTTGGTTGCTGAAAAAAAGAAGCATTTGCTGTTGGAAAAACCTACTGCTTTGAATGTAAGTGAACTGGATAAGATTG
TTGAAGCTTGTGAAAGAAATGGTGTTCAGTTTATGGATGCTAGTATGTGGTATCATCATCCTAGAACTGCTAAAATGAA
GGAGTTCATTTCTGATCCTAATCTCTTTGGACAAGTCAAAGCAATTCACAGCTCATCATCATATTCACCTGGTCCGGTA
TTTCTTGAAAACAACATCAGAGTAAAGCCAGACTTGGATGCCCTTGGGGCGCTGGGAGATGCGGGTTGGTACTGCATTG
GCGCAATATTATGGCCTATGAACCAAAACCTGCCAACACTGTGACAGCACTGCCTACTGTTGCAAGAAACTCGGCTGG
CGTTATCTTGACATGCAGTGCCTCCCTGCATTGGAAAAAGAGGAAACTGTCGCTACATTTTACTGCTCTTTCGTTTCA
CATGAAACGATGGACTTGATAGTTTATGGCTCCAACGGTACCTTTTATCTCTACGACTTCATTATCCCCATGGACGAGA
ACTCTGCTTCGTTCAGCTTTACTTCTGGTGCCAAGTTCGTGGATCGCCATATCGGATGGAACATGAAACCTCGGGCAGT
TGAAGTAACTTCTAAGTTTCCGCAAGAGGCTTCTATGATTCAAGAATTTTCT > SEQ ID NO:4687 103718FL 103717_300027_1d
tggtatcaacgcagagtggccattacggccggggaccaagCAAAAACTCAAAACTTCACATCTTTAGTAGTAGCATCAA
TATTCAAGATGGTTCTCCAAACTCAACTTGGGTTGAACAAGCCCCAATCCTACGCTCACGAGCAAAATTATTATTCCGA
CGGCAGCCATGGCGGCTCTATGCAAATGACAAGGCCATCGGGCTATTCCACCATGCCATATGGCCAGTCCACTCACAAT
CACATGATGATGGGTCATGGTGGCCAACATCATGGCGGACACTATGGTGGTCATGGCCATGGCTACGGCGGTCATGAAC
ATCATGGGGCGCATATGCCCCATGACTCCACTAACTTTTCAAGCAGCACCAATATGGTCCATAGTGATGCTGGCTATGG
CAGTGGAATGCAACAATCTACCCATATGTTGTCAGCCATGGGCATGGGATCGACCAATTATCATGGCCATGGTTATGGT
GGCAGCCACCCTAGTCAGTACAGCCAGAGCCAAAAGTTCAACTGGGCTCTTAAGGATCTGGAGGAATAAATATATGATA
AATTTTATGCTATCCTGTATGGTGAAAGTATGTGTGTGTTTTGGTAGTGGATTTTGCTAATTATATAGCATGAAGAAAC
TACTACCTAAATAAGTAATAATGTACTAAACAGTCTGCTGCTTTACTTGATTATCAATGCATCTACTTATCATTACTAA
ATGATGAATAAAAAATAAAAGTATGTTTATAacGaa > SEQ ID NO:4688 103718FL 103757_300027_1d
tggtatgaacgcagagtggcattacggccggggaaaaCAAAAACTCAAAACTTCACATCTTTAGTAGTAGCATCAATAT
TCAAGATGGTTCTCCAAACTCAACTTGGGCTGAACAAGCACCAATCCTACGCTCACGAACAAAACTACTATTGCGATAG
CAGCCATGGCGGCTCTATGCAAATGACAAGGCCTTCGGGCTATTCGACCTTGCCATATGGTCAGTCCACTCACAACCAC
ATGATGATGGGTCATGGTGGCCAACACCATGGCGGACCCTATGGCGGTCATGGCCATGGCCATGGCGGACACTATGGTA
GTCATGGACATCATGGGGCGCATATGCCCCATGACTCCACCAACTTTTCAAGCAGCACCAATATGGTCCATAGTGATGG
TGGCTATGGAAGTGGAATGGAACAATCTACCCATATGGGCATGGGGTCGACCAATTATCAAGGCCATGGTTATGGTGGC
AGCCACCCTAGTCAGTACAGCCAGAGCCAGAGCCTAACTGGGCACTTAAGGATTTGGAGGAATAAATTTATGATAAAT
TTTATGCTATCCTGTATGGTGGAAGTATGTGTGTGTGTTTTGGTAGTGGATTTGCCTATATATGTAGCATAAAGAACTA
CTACCTGAAGAAATAATGTACTAAGCAGTCTGCTGGTTTGCTTGTTTATCTATGTATCTACTTTATCATTACTAAATGA
TGAATAATTATAAGTATGTTTATAacT > SEQ ID NO:4689 103896FL 113073_300021_1d
cccacgcgtccggggagctcctcctcatcaTCGAACATAGGTTTCCGATTATCGTCGAACAACTGATATAATCATCACA
CAAAGGTGTATACAGCTTCTTGGTGATAAACAGTCAACATGCCGGCCACAGCAGGTAGGGTTCGCATGCCTGCGAACAA
CAGGGTTCACAGTAGTGCAGCCCTACAGACGCACGGCATCTGGCAGAGTGCTATTGGTTATGATCCATATGCTCCTAGC
AAGGAGGACGACAAGAAATCTACCCAGAAGGCGTCAGCAGCTGATCCTGAAAATGCTTATGCGAGCTTTCAAGGTTTGC
TTGCACTTGCCCGGATCACGGGATCTAACGCTGATGAAACTCGTGGGCGTGCAAGAGGTGTGGGCGGGTAGGCCACCT

```
CACTTTCCAGTGTAGGAATTTCGTTAGTGTTAAGGATGATAACAAGGATAAGGATCCGGAGGTGATTGAGGCTGCCGTG
TTGTCTGGATTGGAGAAGATCAAGGGGTCTAAGATGAAGGGAAAAGCAGAAAATGAGGAGAGCAGTGAAGAAGAAGAGG
AGAGTGAGAGTTCTGATTCGGATTATGATTCTGAAATGGAGAGGGCAATTGCTGAGAAGTATGGGAAGAAGGTAAGTAG
GAAGTTGAAGTCATCTAGGAAGCACAACAAGAAAGATTCAGATGATGATGAGGAGGAGGAGTCAGACTCTGGAAAAAGG
AAGAAGAGGGGCAGATCAAAGAGGAGGAGGAGTGGGAAGAAGAAGGGACACAGTGATTCGGAGGACGATGATGAAGATA
AGGATCGCAGGAAGAGGAGAAAGGAAAAGAGGAGGAAAAGGGATGACTCATCAGACGAGGATGAAGATCGTAGGAGGAG
GAGAAAAAGTAGGAAGGAGAAGAGGAGGAGGAGGAGAAGTCATAGACATGCTGACAGTTCTGATGAATCAAGTGATGAT
TCTCCTCCACGGCACAAGCGTAGGAGCAGGAGGACAGCCTCAGCATCTGATTCTGATGATTCACGAGTTGGCAGAGACA
AAAAACGTTCTGAGAAGAGGAGCAGGAAGCGTCATGATGATGAATAGTAGTAATCGGACTCGTGCAAGGAGGATATACCA
TCTACTATTTGAATTGCAGGTCCATTCCTTTCTATGGAATTGCTTTTCTAGGCACTTGATGTGTATCTGTCTATGTTTA
CTTTTTATCTTTTTGCCTCAACAAATACTCGTGTGCTTGAGTCTCCCTTCATGGTCTTGAATATTGTTTAACTGACGTT
GCAGTATTTTGCCAGTTATTACAAAATGTGGGCATCTTTGTTGAACCTACTTCaggttaACcttTtgaaggttTTGCGG
ATttgttaATTacaacctgtgAATTAtgcAACTTTGTaaggtgtttgttgaAGTGATATATCACTCTGtacTt > SEQ ID NO:4690   103896FL 280124_200066_1d
AAGAGGTGTGGGCGGGTAGGCCACCTCACTTTCCAGTGTAGGAATTTCGTTAGTGTTAAGGATGATAACAAGGATAAGG
ATCCGGAGGTGATTGAGGCTGCCGTGTTGTCTGGATTGGAGAGTTCTGATTCGGATTATGATTCTGAAATGGAGAGGGC
AATTGCTGAGAAGTATGGGAAGAAGGTAAGTAGGAAGTTGAAGTCATCTAGGAAGCACAACAAGAAAGATTCAGATGAT
GATGAGGAGGAGGAGTCAGACTCTGGAAAAAGGAAGAAGAGGGGCAGATCAAAGAGGAGGAGGAGTGGGAAGAAGAAGG
GACACAGTGATTCGGAGGACGATGATGAAGATAAGGATCGCAGGAAGAGGAGAAAGGAAAAGAGGAGGAAACGGGATGA
CTCATCagaCGAggATGAAGATCGTAGGAGGAGGAGAAAAAGTagGAAGGAGAAGAGgAGGAGGAGAAGTCATAGACaT
GCTGACAgTTCTGATGAATCAAGTGATGATTCTCctccacggCAcaaGCGTAgGAGCAggAgGACAgcctcagcATCTG
ATTCTGATgccagcaaCTCTGATGAttcacgaGtTGg > SEQ ID NO:4691   104065FL 103561_300363_1d
tggtatcaacgcagagtggccattacggccgggggttacataggaataagtaatatatttattgttttcccttcgtcc
aAACTATAGGCTcAAATACCTTATCCAAGCTCAGCAGATCTCCGTTTTCACCTAATTCAATCAATCGCCTCGCATCTTC
TAGGGCTTGGATTTGAAGGTATACGAGCTAATCTATGGCGTCGAAGCGTATATTGAAGGAGCTCAAGGATTTGCAGAAG
GATCCTCCGACATCATGCAGCGCTGGTCCAGTTGCTGAGGATATGTTCCACTGGCAAGCAACTATCATGGGTCCTACGG
ATAGCCCTTATGCAGGAGGCGTATTTTGGTTTCGATTCATTTCCCTCCTGATTATCCTTTCAAGCCTCCAAAGGTTGC
ATTTAGAACTAAGGTTTTCCACCCCAACATCAATAGCAATGGAAGTATATGTTTGGATATTCTTAAAGAACAGTGGAGT
CCAGCTTTGACCATATCCAAGGTCTTGTTGTCCATCTGTTCTCTGTTGACTGATCCAAATCCAGACGATCCACTTGTAC
CAGAAATTGCTCATATGTACAAGACTGACAGGGCCAAGTACGAGGCCACTGCTCGTAGCTGGACACAGAAATATGCTAT
GGGATGATGCGGAAAGTGTCCTTGGACGTGCCTGAGACaCttTTAATTGCaacagtttcattgtgcTttCAcccTtaag
tgCaaTgtctttgtgcttggaTGAaagtaaaatattg > SEQ ID NO:4692   104065FL 104744_300367_1d
TTCGTCTTTCTGCAAACTCAATTAATCCCCTCTACCACTCTGCCACCTTCAGATTTGAGCTTGGGTTTGAAGGTAAGGA
AGTAACATATGGCGTCAAAGCGCATATTGAAGGAGCTGAAGGATCTGCAGAAGGACCCTCCCACGTCATGCAGCGCTGG
TCCTGTGGCTGAGGACATGTTCCATTGGCAAGCAACAATCATGGGCCCTACAGATAGCCCTTATGCAGGGGGTGTATTC
TTGGTTTCTATTCATTTTCCTCCTGATTATCCGTTCAAGCCACCTAAGGTTGCATTTCGAACTAAGGTTTTCCACCCTA
ACATCAATAGCAATGGAAGCATTTGTCTGGATATTCTTAAAGAGCAGTGGAGTCCAGCATTGACCATATCTAAGGTCCT
GTTGTCCATCTGCTCTCTATTGACAGACCCAAATCCAGACGATCCTCTTGTACCAGAAATTGCTCATATGTACAAGACT
GACAGGTCCAAATATGAGGCCACTGCTCGTAGCTGGACACAGAAATATGCCATGGGATAATAGCAAAAGTGTCACCGgG
CAtgtcagagactttgtagcTGCACCgTCTtaattgtgCtTGGGTg > SEQ ID NO:4693   104065FL 1098140_301483_1d
TTTTTGCCGCCATCGCCGTCTTTCCTTCCTTCCTTCGATCGATCCATCCCTCCTCCTCTTCGCGATCAAGCTTCTCCTC
CTCCCCCCCCCCCCAATGGCCTCCAAACGGATCCTCAAAGAGCTCAAGGACCTACAGAAGGACCCCCCCACCTCGTGTA
GCGCCGGCCCTGTTGCGGAAGACATGTTCCATTGGCAGGCAACGATCATGGGACCTGTTGATAGCCCTTACGCCGGAGG
TGTGTTCATGTTGACAATCCACTTTCCCCCAGACTACCCTTTCAAACCTCCCAAGGTTGCTTTCAAGACAAAAGTATTT
CATCCAAACATCAATAGCAATGGGAGTATTTGCTTGGATATTTTGAAAGAGCAATGGAGCCCAGCTTTGACAATCTCCA
AGGTTTTGCTTTCGATTTGTTCTCTTCTCACTGACCCAAACCCCGATGATCCTCTGGTTCCTGAGATAGCACACATGTA
CAAGATAGACAGAGCCAAGTACGAATCTACTGCAAGGAATTGGGCACAGAAGTATGCTATGGGCTAATAGTTATTATAA
TGGACATCCCATTGCAATGGTAGACAGGCCGAGGGATTGATTACACTTTCCTGTTCTTGTTTTCAAACCATGggGGGtt
ggATGTATCttgtg > SEQ ID NO:4694   104065FL 105318_300373_1d
```

FIG. 2 continued

CAGTTTAAGAGAGAAATATAGGACTTCTTCCAACGTACTGGGGTACTATTATTGGCCCAAAATCCTCTTCCAGCTCTGC
AATCTCCGTCTCCGTCAATTTTCAGTCAACCGAAATCCACCATCTTTCATTGTTCATCACCTTCAGGTTAGGGTTTGGA
TTTGAAGGTACAAGGGGCTAATTGATGGCGTCGAAGAGGTATTGAAGGAGCTCAAGGATCTGCAGAAGGATCCTCCTA
CATCATGCAGTGCTGGTCCAGTGGCAGAGGATATGTTCCATTGGCAAGCAACTATCATGGGGCCTACAGATAGCCCTTA
TGCCGGAGGTGTATTTTTGGTTTCAATTCATTTCCCTCCGGATTATCCTTTCAAGCCTCCAAAGGTTGCCTTTAGAACT
AAGGTTTTCCACCCTAACATCAATAGCAATGGAAGTATTTGTCTGGATATTCTAAAAGAGCAGTGGAGTCCAGCGTTAA
CCATATCTAAGGTCCTGCTCTCCATCTGCTCCCTATTGACTGACCCAAATCCAGATGATCCACTTGTACCAGAAATTGC
CCACATGTATAAGACTGAAAGGTCTAAATACGAGACCACTGCTCGTAGCTGGACTCAGAAATATGCTATGGGATAATGG
CAAAGGTGTCACCAGGCATGTCTGAGACTTTGTAACTGCAATGTCTTATTGTGCTTGTAGTGAATGAATAAATTCGGCT
AAAGAACTTAGTTTACTTCTTAATCTCCCTTAAAGTGGGTTGTCAACAGACATTTcttttcaatttgtgaatatctatt
tggtgactattagtaagggagacacttcagtgtaattttacttcgtttgccagttt > SEQ ID NO:4695 104065FL 107664_300380_1d
TGCGAACTCCAGGGGCACCTCCTCCAACACAAAGCAGGAGTTCAACGCAGAATCAAACCAAAACCCTAGCTCACCGCCT
TGTTTCCTCCGTATTGGTGGTTACAATGTCGACTCCGGCTAGAAAGAGGTTGATGAGAGATTTCAAGAGGTTGCAGCAG
GACCCTCCTGCTGGTATTAGTGGTGCACCTCAAGACAACAACATTATGCTTTGGAATGCCGTGATATTTGGTCCTGATG
ACACTCCTTGGGATGGTGGTACGTTCAAGCTGACTCTTCAATTCTCTGAGGATTACCCCAATAAGCCACCAACAGTGCG
GTTTGTTTCTCGCATGTTTCATCCTAACATTTATGCAGATGGAAGTATATGTTTGGATATTCTTCAAAATCAGTGGAGT
CCAATATATGATGTTGCAGCTATACTTACATCCATTCAGTCATTGCTGTGTGATCCCAACCCCAATTCACCTGCAAATT
CGGAAGCAGCTCGGATGTTCAGCGAGAATAAAAGGGATTACAACCGCAGAGTTAGAGAAGTTGTAGAACAGAGCTGGAC
TGCAGACTGATTCTAGGGAAGAAAGACGTCATTGCTGACTGCAGATCAGGAGCACCACGGCTCATCTATGTTTCAATCA
gTAAATGTAACCTCTTTTTTGAtcaatAGATtcctaaTCTTTTccTaagaAAAAAACATGTCTTGCTgTGgaggaaGCT
GTGgCtgtggATCtggctgcaaatGcggcagtGGCtgt > SEQ ID NO:4696 104065FL 1099839_301451_1d
GGAATGGCATCCTCTGCTCAGCTTCGATTGATGTCCGATCTGAAGGCCATTAGCCATGAGCCACCTGAGGGATGCAGTG
CCAGCCCTTATAGCGATGCGGACCTTTTTGTTTGGGACGCCACAATATTTGGTCCCGAAGATACTCCATGGGAATGTGG
CATTTTCTGCCTCCGTTTGGTCTTTGGAGAGCATTACCCTGCCAAACCACCTCGTGTCAGGTTTACTTCCGAGATATTT
CACCCCAATGTGTACAATGATGGCACCTTATGCATGGACATTATACAAGATGCTTGGTCTCCTTGCCACAACATCTGTA
CaATTCTAACATCTGttCAGTCATTgcTAACAGATCCGAATCCCGCAAGCCCAGCTAACTCGGAAGCTgcaCATTTATA
TCAAACTgATAtTCAAGCATATAACAGGCGagttcggCgttgtgTgaggaagtctttTGgaaAGCacatagtATACT > SEQ ID NO:4697 104065FL 1100623_301462_1d
GCGTATCGGGAGGAGAACGGAAGAATGGCTTCGAAGCGGATCCTGAAGGAACTGAAGGATTTGCAAAGGGATCCTCCCA
CTTCCTGCAGTGCAGGTCCTGTTGGGGAAGATATGTTTCATTGGCAGGCAACTATCATGGGGCCAACTGATAGTCCTTA
TGCCGGTGGCGTCTTCATGGTCACTATTCATTTCCCCCCGGACTACCCCTTCAAGCCTCCCAAGGTTGCTTTCCGGACG
AAAGTGTTCCACCCAAATATCAACAGCAATGGGAGCATCTGCCTTGATATATTAAAAGAGCAATGGAGTCCAGCCCTTA
CAATATCGAAGGTCTTGCTTTCGATTTGTTCACTTCTCACTGATCCGAATCCCGATGACCCCCTTGTGCCGGAGATTGC
ACACATGTATAAGACGGATCGAGCCAAATACGAAGGTACTGCAAGGAGTTGGACACAGAAGTATGCAATGGGTTGAGTT
GAGTCTTTCTTCACTCAATTGCTACTCGCTCTTAATATATCCCCCCCCCTTGATGTAATAAATATATGTTGGCAGACAA
GTTAAAATATCGGCATACAAAAAGCCGTGTTTCTGAATGATCTTGTTTCAAAACTGAATGAATgcaaGCAaTGTgtTTT
TAt > SEQ ID NO:4698 104065FL 1100258_301458_1d
GCATGTCTGGAGGAATAGCTCGAGGTCGTCTAGCAGAGGAGCGCAAAGCATGGCGCAAGAATCACCCTCATGGGTTTGT
GGCGAGGCCTGATTCTCAACCGGATGGTTCAATGAACTTGATGCTTTGGCAATGCATTATACCTGGAAAAGTTGGGACT
GATTGGGAAGGTGGTTTCTTCCCTTTGGCAATTCATTTCAGCGAAGACTATCCCAGCAAGCCACCCAAGTGCAAATNTA
CCCAAGGGTTTTTCCATCCGAATGTGTACCCATCTGGGACAGTGTGCCTGTCCATATGGAATGAGGATTCTGGATGGAG
ACCTGCCATAACTGTCAAACAAATACTTGTGGAATTCAGGACCTTCTTGATTCACCGAATCCTGCAGATCCTGCCCAA
AGTGATGCATATCAACTCTATGTTCAAGATCCCATTGAGTATAAAAAGAGGATTAGACAGCAATCCAAGCAATATCCTC
CCCCTATTT > SEQ ID NO:4699 104065FL 1119709_301900_1d
ggccttataaccttagttacctatagtccattgacggttcgcaatcAGAATGGCTACTTCTGCGCAGCTCCGCCTCATG
TCGGACCTCAAAGCCATCCTCAGCGAGCCTCCCGAGGTGGATTTTTTCTCTTCGTTTGATATTCGGAGATCAATATCC
TGAAAAGCCACCTCGTGTTAGATTTACTAGCGAGATTTTCCATCCAAATGTGTACAACGATGGAACCTTATGCATGGAT
ATAATTCAGGATGCTTGGTCTCCCTGCCACAACATCTGCACTATATTGACTTCAATACAGTCTTTATTGACGGATCCAA
ATCCAGAGAGCCCTGCTAACCCAGAAGCTGCACACTTATATCGGACCGATATTCAAGCATATAATAGGAGGATCAAGCA

FIG. 2 continued

GTGCGTAAGAAAGTCTTTGGATAGTTAATGAGTATGGAAtTTCGACTGAAAGTAAACATGACGTAATTTggCTCTTGCT
aggCattcaCAGGTCTAAActaaacTATGGTTAAAGAAGATTGAATAACTCACTA > SEQ ID NO:4700 104065FL 1119652_301899_1d
GAGAAGAACTGTGGTGGGTGGGGGGCCATAATAATAAGAAGAGGTATTATTATTATTATTATTATTAGTATTATAA
TGAGCTTGCAGAGAGGAGGGCAGGAGGGTAGCTTGGCTATGGCGGATGGAAAGCACTCTGGTGCCCCGTTGATACACA
TTCCGTCGCTCGTAGATTGCAGTCGGAGCTCATGGCATTGATGACCTGTGGGGGGGACCCAGGTGTATCTGCTTTTCCT
GACGGAGACAACATCTTCTCTTGGCTTGGAACCATCAAAGGAAGCACCGCAACTGTCTATGAGGGTCTCTCGTTCAAGC
TTTCTTTGCGCTTTCCAAATGAGTACCCTTTCAAGCCTCCCACTGTGAAATTCGATACCCCTTGCTTCCACCCCAACGT
TGATCAGTATGGCAACATTTGCCTTGACATCTTGCAGGATAAGTGGTCATCTGCTTATGACGTCCGCACCATTCTCTTG
TCTATTCAAAGTCTACTTGGAGAGCCCAATAATGCTAGTCCATTGAACAGTTATGCGGCAACTCTATGGTGCAATCAAG
AAGAGTTCAAGAAGGCGATGCAAAAACATCACAAAGATGCTACTGGACTTAC > SEQ ID NO:4701 104065FL 1118391_301855_1d
agaatggctacttctgcgcagctccgcctcatgtcggacctcaaagccatcctcagcgagcctcccgaggGATGCAGCG
CAAGCCCTTACAATGATGATAATCTCTTTGTGTGGAATGCTACTATCTTTGGCCCTGAGGACAGCCCTTGGGAAGGTGG
GATTTTTTCTCTTCGTTTgATATTCGGAGATCAATATCCTGAAAAGCCACCTCGTgttaGaTTTACTAgcgagatnttC
CATCCAAatggtgtacacaaTggaaactTATGCATGGATATaattcaggatGCTTgGTCTCCCTgccAcaaCATCTgca
CTATAttgacTTCaaTACAGTCTTTAttgacggAtccaaATCCag > SEQ ID NO:4702 104065FL 1118324_301855_1d
GCCTTCCCTATAACGGCGGTGGCTATTTAAGAACTCCAAGTAGCAGAAGTTATAGTTGAAGAGGGATCTGGATCTGAAT
CTGAATCTGTGTCATGGCTAGCAAGAGGATTTTAAAGGAACTCAAGGATCTGCAAAGGGATCCCCCAACCTCATGTAGT
GCTGGTCCTATTGCAAATGATATGTTCCATTGGCAAGCCACTATCATGGGTCCCTTTGATAGTCCATATGCTGGAGGAG
TTTTTCTGGTTACCATTCATTTCCCCCCAGACTACCCATTTAAGCCTCCTAAGGTGTCCTTCAAAACCAAAGTCTTCCA
TCCAAATGTCAATAGTAATGGAAGCATTTGCCTTGACATCTTGAAGGAACAATGGAGTCCTGCTCTAACAATAGCAAAG
GTCCTACTCTCGATATGCTCTCTTTTGACTGATCCCAATCCTGATGACCCTCTCGTTCCAGAAATAGCCCACATGTATA
AAACAGACAGGGCAAAGTACGAGACAACTGCAAGGAGTTGGACCTTGAAGTATGCTATGCCCTAAATAAAGCTCACCTC
TTGCCTTGCATATAGTTGAGGTATATATATTATATATACACAcgTTATTACATATGcaactactattgcattgct
atAATctttgctagaatCTCCAATAAGATATgtaatatg > SEQ ID NO:4703 104065FL 1117629_301848_1d
AGAAAAGGATTGAGATCGGCAAAAGACAGAAGGATTTCGCATTCCTGGGTTTGTTGTGTGACCGAAACTGGATGGATAA
GCCTCTTTAACCCCAACAAGGGCAGCGTTTAATCACTTTCAACAAGTCCGGGGGGTTGGTTGCATACAATCCAACATAA
GCTTTCACTTTCTTCCAAAGGCGATCAATCTCTTGCCACAATGTCCACGCCGTCAAGGAAGCGTTTGATGCGTGATTTC
AAGCGGCTTCAACATGACCCCCCTGCTGGTATTAGTGGTGCTCCGCAGGACAACAATATCATGCTTTGGAATGCTGTCA
TATTTGGGCCGGACGGACACCACCTTGGGATGGAGGCACTTTCAAATTGACCTTGCAATTCTCGGAAGACTACCCCAATAA
ACCTCCAACAGTTCGTTTTgTGTCAAGGATGTTCCATCCAAACATCTATGCAGATGGAAGTATCTGCTTGGACATTCTG
CAAAATCAATGGAGCCCCATATATGACGTTGCAGCGATACTTACATCTATTCAGTCTTTgctTTgcgATCCGAACCCGA
AtTCTcCtgcgaaTtcggaggCAG > SEQ ID NO:4704 104065FL 1117116_301818_1d
TAGGTATGGCGTCGAAACGGATACAGAAGGAGCTGCAGGACCTGCAGAAGGACCCCCCGACGTCATGCAGTGCCGGGCC
GGCTGGGGAGGACCTCTTCCACTGGCAGGCCACCATCATGGGCCCCTCTGATAGCCCCTACGACGGCGGCGTCTTCTTC
ATCACCATTCACTTCCCCCCTGACTACCCCTTCAAGCCCCCCAAAGTCAGCTTCCAGACCAAGGTTTATCATCCAAACA
TCAGTCGAACGGGAGCATTTGCTTAGACATTCTAAAGGAACAATGGAGTCCAGCTTGCAGATTTCAAAGGTGTTGTT
ATCCATCTGCTCTCTGCTTACGGATCCAAATCCAGATGACCCTCTTGTCCCTGAGATCGCTCACATCTACAAAACCCAG
AAGGCTCGCTACGAGGAGACcGCCCGAGCATGGACCCAGAAATATGCAATGAACTAGTTGAAAAATTTCCTTACATATC
CTTGCCCACCCTTCAAACTATAATAAGCATAAggTATGCTTTCTATATATGGAGGCTAATCGTTAttgtttCTCCgtTg
TCTTTCTCTATCATCAATCACAgttTCttg > SEQ ID NO:4705 104065FL 1117069_301817_1d
AAGAGTTGATGCGATGTCAGGAGGGATAGCCTGTGGCCGCCTGGCAGAGGAGCGCAAGGCATGGCGAAAGAACCACCCC
CATGGGTTTGTGGCAAGGCCAGATTCTCTACCAGATGGAACAATGAACCTAATGCTTTGGCAGTGCATTATACCTGGGA
AAGTTGGGACTGATTGGGAAGGTGGTTTTTTCCCTCTAGCAATCTATTTCAGTGAAGACTATCCCAGCAAGCCACCAAA
GTGCAGATTTCCTCAAGGCTTTTTCCATCCAAACATCTATCCATCCGGGACAGTCTGCCTCTCTATCTTGAACGAGGAT
TCCGGATGGAGGCCTGCCATAACTGTCAAACAAATTTTAGTCGGGATCCAAGATCTTCTAGATGCTCCGAATCCTGCTG
ACCCTGCTCAAACCGATGCATATCAGCTCTTTGTTCAAGATCCTATTGAATATAAAAGGAGGGTTAGACATCAGTCAAA

FIG. 2 continued

GCAATATCCTCCCCCTATTTGAAGCTGAAGCGGCTTTGTTTATGATAGGTGGACCATGCATCAGAAATGCATGGCTTGT
TGCTGATTATTATTCTTTTTCAAATCACATGAAAATGACCACTTCAATGGAATGACAGATTT

> SEQ ID NO:4706 104065FL 1116844_301815_1d
CCCACGCGTCCGTTCAGTTTGGGGTGAGTTTGAGGGGTCAGTAGTAGTAGCAGTAGCAGGGGAAAGGGGAAGGGAGAGC
GGTATGGCTTCCAAGCGGATCCTGAAGGAGCTCAAGGACCTCCAGAAGGACCCCCCCACCTCTTGCAGCGCAGGTCCTG
TAGCCGAGGATATGTTTTATTGGCAAGCAACAATAATGGGTCCACCTGATAGTCCATATTCTGGGGGGGTGTTTTGGT
CACCATTCATTTCCCTCCTGATTATCCCTTCAAGCCTCCAAAGGTTGCTTTCAAAACTAAAGTCTTCCACCCGAATGTC
AATAGCAATGGGAGTATCTGCTTGGATATACTGAAGGAACAGTGGAGTCCGGCTCTTACCATCTCCAAGGTTCTTCTGT
CAATATCCTCTTTGCTTACCGACCCCAATCCAGACGATCCCCTCGTTCCGGAGATTGCACACATGTACAAAACGGACAG
GATGAAGTATGAAACAACTGCAAGAAATTGGACCAGGAAGTATGCCATGGGATAAAAGACAGGATCTCGTTTCTTCTCA
TAC

> SEQ ID NO:4707 104065FL 135317_300413_1d
GTCCTCGTCCTCGCGTAGGCGCGGCGGCCGAGGAACAAGTCCGTCACGCGAACCTTCCAGAACCCCCTCCTCACACGTC
ACGCAACCTCCTCCTCCTCCTCCTCCTCTTTATTACGACTACCCCCCCCCCCCGGCGCCCCCTCCTTTTTTCAGA
TTCGGAGAGACCTACTCGTCGTTAGACCGCCATGGCGTCCAAGCGGATCCTCAAGGAGCTCAAGGACCTGCAGAAGGAT
CCCCCAACCTCCTGCAGCGCCGGCCCTGTGGCTGAAGATATGTTCCACTGGCAGGCAACACTGATGGGTCCATCAGATA
GCCCTTATGCTGGAGGCGTGTTTTTGGTTACCATTCATTTTCCTCCAGATTATCCATTCAAACCGCCTAAGGGGGCATT
CAAGACAAAGGTGTTCCACCCAAACATTAATAGCAACGGAAGCATATGCCTTGATATCTTGAAGGAGCAGTGGAGTCCT
GCATTGACT

> SEQ ID NO:4708 104065FL 127807_300473_1d
cccctttttggctacccTACAACCTTCTTGAGACCCCTTTAAATTCCTCACTTTCTCTCTCTAGAATCTCTCTCTTTTTC
TCTCTCTATCTCTCTCTGAAGTCGTATGGCTTCAGGTTCTCCTTCACAAGCCAGTCTTCTCCTTCAGAAACAACTCAAA
GATCTCAATAGAAACCCAGTTGATGGATTTTCAGCAGGTTTAGTTGATGAAAATAACTTATTTGAATGGAGTGTTACAA
TTATTGGCCCCCAAGATACTCTATATGAAGGGGGTTTCTTTAATGCTATCATGAGTTTTCCTCAAAATTATCCCAACAG
TCCTCCAACTGTGAGATTTACCACAGATATCTGGCATCCTAATGTTTACTCCGACGGAAAAGTTTGCATCTCAATTCTT
CACCCGCCCGGTGATGATCCAAATGGCTATGAGCCTTGCCAGTGAACGTTGGTCTCCTGTCCACACGGTGGAGATATAG
TTTTAAGCATCATATCCATGCTTTCGAGCCCTAACGATGAGTCTCCTGCTAACGTTGAAGCTGCTAAGGAATGGAGGGA
AAAAAGAGATGAATTCAAGAAAAGGGTCAGTCGTTGTGTAAGACGGTCACAAGAAATGTAGTAAACATGCATGCCAACC
TGCATTTCTGCGATTAaGCCAAGgaaTTGGCATCGTTCTTTTGGCTAGCTGTTTATTTATGCTACAAAAATgTAGAATT
TG > SEQ ID NO:4709 104065FL 126473_300463_1d
GCCATTACGGCCGGGAATCAAAATCTATCTCAACCCTTCtgtCTTCTTCTTCCCCTTCAGTTTCTCAAAAATTCTCAAG
AAGAAGAAGAAAGAAAAGAAAAAAATCGTCTCCTTTTCGTTCAAAAAAAAATATATCTTGAAATTAAAAATTCAGATGGC
TACAATGAACAGTGGAAACAACAGCAATACTCAAGCAACTGCTCAGGTTATGCCTTCACCTAAACAGAGTTTGCCTACT
GCAAAAACTGTTGATACCCAGTCTGTTCTTAAAAGGTTGCAGTCTGAATTGATGGCTCTAATGATGAGCGGTGATTCTG
GGATATCTGCATTTCCTGAAGAAGACAACATATTTGTTTGGAAAGGGACAATAACTGGTAGCAAAGATACTGTTTTTGA
AGGAACAGAATACAAGCTCTCTCTTTCATTTCCTGCTGATTACCCTTTCAAACCACCAAAGGTTAAATTTGAGACTGGT
TGCTTTCATCCCAATGTTGATGTCTATGGCAACATATGCTTAGACATTCTTCAGGATAAGTGGTCATCTGCTTATGATG
TGAGGACTATACTGATTTCCATTCAGAGTCTGCTTGGAGAGCCAAACATAAGCTCACCTCTAAACACTCAAGCTGCTGC
TCTTTGGTGCAATCAAGaaGAATACAgaaAGAtg > SEQ ID NO:4710 104065FL 124562_300423_1d
agaaatcaaatcgacccttactcctcTAAATCCCCACACCCATCTCTCTCTCTCTCTCTCCTCAATCGAAGGATCC
GACAATAAAAGTTGATTGTCTTCAACATCTGTCTACCAGCAAAAACTACTTGCGTGCAGTCGCCAACTGATCCTAGGAT
TATACTTACATTTGGCTATGGCAACTAATGAAAATCTCCCACCAAACGTGATAAAACAATTGGCAAAGGAATTGAAAAA
TCTTGATGAAACTCCTCCTGAAGGCATCAAAGTAGGTGTCAACGATGATGATTTTTCAACCATATATGCTGATATCGAG
GGGCCAGCTGGGACTCCTTACGAGAATGGGGTTTTCCGCATGAAGTTGATTTTGACGCATGATTTCCCTCATTCCCCAC
CCAAAGGTTATTTTCTGACCAAGATTTTTCATCCCAACATCGCTTCCATTGGCGAAATTTGTGTCAATGCTCTGAAAAA
AGATTGGAATCCTAGTTTGGGCCTACGACATGTTCATGGTGGTAAGGTGTTTGCTGATCGAGCCATTTCCAGAATCT
GCGTTAAATGAGCAAGCTGGTAAATGCTGCTTGATAATTATGATGAGTATGCTAGACATGCAAGGCTTTATACCAGTA
TTCATGCTAAACCAAAGaCTAAGTTAAAAACA > SEQ ID NO:4711 104065FL 120926_300518_1d
CGGACGCGTGGGCGCAAACGGCGAAGCAGAAGGGGAAGAGAGAGAGAGAGAGAGAGAGAGAGGGGACTCAGCGA

FIG. 2 continued

GCGGTGGGCGAGAGGGGGAGATCGAAACCCTAGCTAGGGTTTGCGCGCGGCGGCGGCGGGGATGTCGACGCCGGCGAGG
AAGCGGCTGATGCGGGACTTCAAGCGGCTGCAGCAGGACCCGCCCGCGGGGATCAGCGGCGCGCCGCACGACAACAACA
TCATGCTCTGGAACGCCGTCATCTTCGGGCCGGATGATACGCCGTGGGACGGAGGCACGTTCAAGCTTACCTTGCAGTT
TACAGAAGATTATCCCAACAAGCCGCCGACTGTTCGGTTTGTTTCTAGGATGTTCCACCCAAATATTTATGCAGATGGA
AGCATCTGCTTGGATATTCTACAGAACCAGTGGAGCCCTATATATGATGTTGCTGCCATATTGACTTCAATTCAGTCTT
TGCTGTGTGATCCAAACCCCAACTCTCCAGCAAACTCAGAAGCTGCCAGACTGTTTAGTGAGAACAAGCGAGAGTACAA
CCGCAAGGTTCGTGAGATCGTGGAGCAGAGCTGGACAGCTGACTAGGGCATGCAGCAGGGCAACGGGTGGTATCCACCA
TGCC

> SEQ ID NO:4712 104065FL_1197049_302200_1d
ATGGCTTCCAAAAGGATTCAGAAGGAGCTGAAAGACTTGCAGAAGGACCCCCCCACATCATGCAGTGCAGGTCCTGTTG
CGGAAGATATGTTTCACTGGCAGGCAACAATTATGGGACCAGATGACAGTCCTTATAGTGGTGGTGTGTTTTTGGTGAC
GATTCATTTCCCCCCAGATTATCCCTTCAAGCCCCCCAAGGTTGCTTTTAGGACCAAGGTTTTCCACCCAAACATCAAC
AGCAATGGGAGCATTTGCCTGGATATATTAAAAGAGCAATGGAGTCCAGCTCTGACAATATCTAAGGTCTTGCTTTCAA
TCTGCTCACTTCTCACTGATCCAAACCCCGATGATCCTCTGGTACCTGAGATTGCACACATGTACAAGATAGACAGAGC
AAAATATGAAGGTATTGCAAGGAGTTGGACACAGAAGTATGCAATGGGTTGAGCCTTTTTTTTCGGCAAAAGATAACAA
CTTTTATCAGTCTATCTCATATCTAAAAAGAATCGGTTTACAACTTTCTGTTTCTGCATCTTGTTGGTCCAAAGCTCAA
ATCACACGTGTATCTTTACTTTCATAGCCAAGGAGTTGATAtagaagtaGtGCAAGGAACAGGTAC > SEQ ID NO:4713 104065FL_1190701_302176_1d
TCCGCTCACTCACTTACTCACTCACTGCTTACAGATTTAGGGATTCCAGAAAGCAAGCTGTGCGAGCGGTCCTTCATGG
CTCTGCTGATCTAGTTGAAGATTACCTGACCTGACTTCGTTCCTCCATGGCAACAAATGAAAATTTACCACCTAAAGTC
ATAAGGGAGCTGGCTCGGGAGCTAAAGGCATNGGATGAGAGCCCTCCGGCGGATATCAGAGTGCTAGTTAATGAGGACA
ATTTGTCCATCATATATGCAGATATTGAAGGACCATCTGGCACACCATATGAGGGAGGCGTCTTCCGCTTGAAGTTGGT
CTTAAGTCAAGATTTTCCGAATACACCTCCCAAGGGATATTTCATCACAAAGATTTTTCATCCAAATGTAGCCAACAAT
GGGGAAATATGTGTGAATGTCCTAAAAAAGGATTGGAAGCCTGTGTTGGGGTTGCGACACATTCTTTTGGTAATCAGAT
GTTTACTCATCGAGCCATTCCCTGAATCTGCCTTGAATGAGGAAGCGGGGAAAATGCTTATGGAAGATTATGAGGGCTA
TGCGAAACATGCCAGGCTAATGACGAGTATCCATGCAAACAAATTGAGGGCAAAGACTAGCAATAGCATGAATGCGGGT
GGTCCAGGTCCAACTGAACTGGTAAGCTCTATGACTACTAACAATAGCATTTTAACTCCAAGCTCAGATGCGGGT > SEQ ID NO:4714 104065FL_1189927_302191_1d
GCAAGGCTAGGCAAGGCAAGNAAGATAAGAGAGTGAGAGAGGAGAGAGAGAGAGAGAGAGAGAGGGGACAGATAGAG
AGAGAGAGAGAGCTATGGCGGATACTCAGGCAAGCCTTCTCCTCCGTAAACAACTCAAAGAGCTATCAAAAAGGCCCGT
GGAAGGATTTTCAGCTGGTCTTGTGGATGATTCCAATGTTTTCGAATGGAATGTCACCATCATCGGTCCGCCTGACACA
TTGTATGAAGGTGGGTTCTTCAATGCAATAATGAGTTTTCCCACGAACTATCCAAACAGCCCACCATCTGTGAGGTTCA
CCTCGGAGATGTGGCATCCAAATGTTTATCCGGATGGGCGTGTTTGTATCTCTATTCTTCATGCTCCAGGTGACGATCC
CAATGGCTATGAGCTTGCTAGTGAGCGTTGGTCGCCTGTGCATACGGTGGAGACTATTCTCTTGAGCATCATAGCTATG
CTTTCGAGCCCAAATGATGAATCCCCGGCAAACATTGATGCAGCGAAGGAATGGAGAGAAAGCAGGGACGAATTCAAAA
GGAAGGTAAGTCGGATTGTAAGGCGTTCGCAAGAGTG > SEQ ID NO:4715 104065FL_1186661_302132_1d
AGGAAGGCGGAATACTCcttctCTtctcttctcTCTCTCATACCGAGGTattaGGGTTCCACAGGCGGAGAGAAGAGAG
AGAGAGAGAGAGCGTCTTTCTTCCTCTACCGCTGCTACTACTACTGCTACGACCATGTCGGGGATCGCCAATGCTAACC
TACCGCGGCGGATCATCAAGGAAACTCAACGGTTATTGAGCGAGCCAGCCCCTGGCATAAGTGCATCACCTTCTGAGGA
TAACTTACGGTATTTCAATGTTTATGATTCTTGGCCCAACTCAATCTCCCTATGAAGGCGGGGTTTTCAAATTGGAATTG
TTTCTACCCGAAGAATACCCAATGGCGGCTCCAAAGGTCCGATTCCTGACAAAAATTTATCATCCGAATATTGACAAGC
TGGGGCGCATCTGCCTCGACATTTTGAAAGACAAGTGGAGCCCTGCACTCCAAATTCGGACAGTCCTTCTAAGTATTCA
GGCCCTTTTGAGTGCACCGAATCCTGACGATCCACTTTCTGAGAACATTGCGAAGCATTGGAAGACTAACGAGGCAGAA
GCTATGCAAACAGCAAAGGAGTgGACCAGGATGTATGCCTGTGgggcctgaaAAC > SEQ ID NO:4716 104065FL_116594_300078_1d
ctCCTCCTCTTCCTCCCTCCCGATCCCCTCCCCGCACGAAACTCAAAGCATCCCGGCGCCGCAGCTCCCCGGAGGAG
GAAGCCCCGCGCCCCGCCCCGACCAGATCCGATGGCCAACAGCAACCTCCCCGGCGAATCATCAAGGAGACGCAGCG
ACTCCTCAGCGAGCCAGCGCCGGAATCAGCGCGTCTCCGTCGGAGGAGAACATGCGCTACTTCAACGTCATGATCCTT
GGCCCGGCACAGTCCCCCTATGAAGGTGGAGTTTTTAAGCTTGAACTCTTTTTACCCGAGGAATATCCTATGGCTGCTC
CAAAGGTTAGGTTCCTGACCAAAATATACCACCCCAACATTGACAAGCTTGGTAGGATATGCCTTGACATTCTCAAGGA
CAAATGGAGCCCAGCCCTTCAGATTCGGACAGTTCTTTTGAGTATCCAGGCACTCCTAAGTGCACCAAACCCTGATGAT
CCTCTCTCTGATAACATTGCAAAGCACTGGAAAGCCAATGAAGCAGAAGCTGTTGAAACAGCAAAGGAGTGGACTCGCC

FIG. 2 continued

TGTATGCCAGCGGTGCATAAAACCCAATGCCTCTCGTGATGTAATAACCCGTCATGCTTTAGCCTTAATCAAATGCCAt
TTGCTTGATAAGaacaaACTggagataTtggcagtggaagggAGttTAAATGACTACc > SEQ ID NO:4717 104065FL 115025_300011_1d
CAAATTCTTAAAACTATCTCCACTATCTCTTTCTCTCTCTAGACAAATTAAGAACCCTTAGCGTAAACTCTGCGACCGA
AGAACCCCACCCACCCAGGCAGCCTTCAATTCAATTCCAATGGCGAACAGCAATCTTCCTCGCCGAATTATCAAGGAAA
CTCAACGGCTTCTCAGCGAACCTGCACCAGGAATAAGTGCATCTCCATCGGAAGATAATATGCGATACTTTAATGTCAT
GATTCTTGGTCCTACACAGTCTCCTTATGAAGGAGGCGTCTTCAAGCTCGAACTCTTTTTGCCTGAAGAGTACCCGATG
GCTGCTCCTAAGGTTCGATTCCTCACCAAAATCTACCATCCGAACATTGATAAGCTTGGAAGGATATGTCTTGATATTC
TTAAAGACAAGTGGAGTCCTGCACTTCAGATCCGTACTGTACTTTTGAGCATTCAAGCACTTTTGAGTGCTCCAAATCC
GGATGATCCACTCTCTGAGAATATCGCAAAGCACTGGAAGTCAAATGAGGCTGAAGCTGTTGAAACGGCTAAGGAGTGG
ACACGCCTATATGCAAGTGGTGCATGAAGGCATTAGCAACGAAATATTTAAAAATAACAAAAATTATGGACTGTATCCT
ATTGACTTGCTTATCaATATGGATGgctgttaaTGCCTggACTcttccgAttgcctcccaTaattGCtTccctgtcctt
g > SEQ ID NO:4718 104065FL 215413_300881_1d
aCAGGACCGCCATCAGGGACTCTGCACCCCCGATCAGATAAAGCCTCTACCTAGCGCTCAGGACTTGCAGACGGTCGCC
TTGCATCGTCTCCAACGTCCGCCTAGGATCTTTTGATTCTTTCTTTGCCTCCTCGATCCGAGATCGATCTTCCACCACC
CTTTTAGATACCACATACCCTCATCACAATGGCCCTGAAGCGCATCAACAAGGAGCTCAAGGACCTCGGCACTGACCCG
CCATCATCCTGCTCCGCTGGTCCTGTTGGAGAAGATCTGTTTCACTGGCAAGCTACAATCATGGGACCCGGTGATTCAC
CATACTCAGGAGGCGTCTTCTTCCTGAAGATCCAGTTCCCTACGGATTACCCCTTCAAGCCCCCGAAAGTCAACTTCTC
CACCAGAATCTACCACCCCAACATCAACAGCAACGGCAGCATCTGCCTCGATATTCTTCGAGACCAGTGGAGCCCTGCT
CTGACCATTTCCAAAGTTCTCCTTTCCATCTGCTCTATGCTGACAGACCCGAACCCCGATGATCCCCTTGTGCCTGAGA
TTGCGCACGTGTACAAGACCGACCGGCCCCGGTACGAGGCGACTGCTagggAATGGAcccgcaaGTACGCCGTc > SEQ ID NO:4719 104065FL 211510_300900_1d
gcttttatcacttttgagaaccactcattcatccatctccgcaagatcgtctgtttttgtttacaatggattataccga
gGATAACCAGAATTCTGCTCCTGGCAGCGTCCAGGCTTCCAAGCTCAATGCCGCTCGCAAGGGTCCCGATTCGCAGAGC
GTCACTAAACGACTCCAGACCGAGCTGATGACTCTCATGAcatctccAGCACCCGGTATCTCCGCATTCCCCTCTGCCG
ACGGCAACCTTATGTCGTGGACCGCCACCATCGAGGGCCCCGAGGATACACCTTATTCCGGACTCACGTTCAAGCTGAG
CTTCGCGTTTCCTTCAAACTATCCTTATGCCGCGCCGACGGTCCTCTTCAAGACGCCCATCTACCACCCCAACGTCGAC
TTCTCTGGCCGCATCTGCCTTGACaTTCTCAAGGACAAGTGGACAGCCGCCTACAACATTCAGACCGTTCTGCTGAGTC
TGCAGAGCTTACTCGGCGAGCCCAATAACGCATCTCCATTAAACGGCGAGGCAGCAGAGTTGTGGGacaaggatATGgA
agagtTcaagaagaagGTGtTGGGACgCCATCGCGAcatcgaggaggaGTAATGGGATTcATAGCGTGcagattttttaT
gatTTTACgTttaCGGGTatttggagtCtttggggCAcgaATcggtcgttttttgaaagGGTatttgGGTGTATTTTGca
tttccacagccagagctggGaAAGGAGGGCTACCTGCCCCTTCCACAAGCGCa > SEQ ID NO:4720 104065FL 197269_300700_1d
cccacgcgtccgcccacgcgtccgCTCACCTGGCGCGCCGAAGCTTCTCTCCTCTCTCTCAACTCCGGCGAGAGGAGGA
GGCGGCGGTGGGGCGTTCGTCGGGAGAGAGACCAGGGCCGGGGGCTAGGGTTCGGCCGTTCAGAGAGGCGGCGGCTGA
GGAGGAGGAGGAGGAGGAGGGGGTGAGGAGAGATGTCGACGCCGGCGAGGAAGCGGCTGATGCGGGACTTCAAGCG
GCTGCAGCAGGACCCGCCCGCCGGAATCAGCGGCGCGCCGCACGACAACAACATCATGCTCTGGAACGCCGTCATATTC
GGACCGGATGACACGCCGTGGGATGGAGGCACGTTCAAGCTGACACTACAATTTACAGAAGATTATCCCAACAAACCAC
CAGTTGTTCGGTTTGTCTCAAGGATGTTTCACCCAAATATTTATGCAGATGGAAGTATCTGCTTGGATATCCTACAAAA
TCAATGGAGCCCTATATATGATGTTGCTGCGATATTGACCTCTATCCAGTCCCTGCTCTGTGATCCAAACCCAAACTCC
CCTGCAAACTCCGAAGCAGCCAGACTGTTCAGCGAGAACAAGCGCGAGTACAACCGCAAAGTCCGCGAGATTGTGGAGC
AGAGCTGGACGGCCGACTAAGCCAAGGACATGATTGAGTTGCAGTTTCTGCAACAAGCTTCTCCTAAAGATATGCAATT
CTGGCTTTCCCGGTCTGTATCACCTACTAAAAACATAAAAAATCTTCAGTTGTTGTAATTCCTGAGCTTGATCCCCTGC
CTTCCCCTACTTGTTTTCCCAATGTAGTGGCTACCTATTTGATGAATTTATAAGGTATTGATGCTTATGT > SEQ ID NO:4721 104065FL 191440_300785_1d
cccccccccatgattcccttctcgaatcttctcacttgctgctgaagtgctccgctccgctccgctccgatccaatcca
cTCCGCCCGAGTCCCCCACCCATCGGGACCCACCAgcgcgcAGGGTgGGTGgcCATCGATCGATCGgcCCATCggcGATT
cCcgcGGGATCTGcggcgGCGCGGGGGGATTTGATCGGAGGGTGAATATGTCGACGCCAGCAAGGAAGAGGTTGATGAG
GGATTTCAAACGACTGATGCAGGATCCTCCAGCTGGCATAAGTGGGGCCCCACAGGACAACAATATAATGCTTTGGAAT
GCTGTAATTTTTGGCCCTGATGATACTCCTTGGGATGGAGGTACGTTCAAGCTGACACTTCAGTTTACTGAAGATTATC
CTAACAAGCCACCTACAGTGCGATTTGTTTCTCGGATGTTTCATCCTAACATTTATGCTGATGGGAGCATATGCTTAGA
TATACTACAAAACCAGTGGAGCCCCATATATGATGTAGCTGCTATACTCACATCCATCCAGTCGCTGCTTTGCGATCCA

FIG. 2 continued

```
AACCCAAATTCACCTGCCAACTCTGAAGCTGCCCGCCTATTCAGTGAGAACAAGCGGGAATACAACCGAAAAGTTCGTG
AGATAGTGGAGCAGAGCTGGACCGCGGACTGATCCACTCCATCTAACCATATGATGCCTGATACTTAAAACGCTCATCT
TTTCAGTGTGTCGTGTACCAAACTGCTTGTAATTAAAATGCTAAAACAGTAAAACGTGc

> SEQ ID NO:4722 104065FL 190923_300737_1d
CCCAACTCCATTATTGATTCTTGCAAGGAGGAAGAGCAGCTAGAGGCGAGGCAAGAAAAGAAGTGAAATCTCTCCGTTA
GACAGGAAGAGGAAAAGCAAGGGGGAATTGGGGATGGCGTCAAAGAGGATACAGAAGGAGCTCAAGGATCTGCAGAAGG
ATCCCCCTACATCATGCAGTGCAGGTCCTGTTGGTGAAGACATGTTCCACTGGCAGGCAACGATAATGGGTCCATCTGA
TAGCCCATATGCTGGTGGAGTTTTCCTAGTTACCATCCACTTCCCTCCTGATTATCCCTTCAAACCACCCAAGGTGGCG
TTTCGCACCAAGGTTTTCCATCCAAACATCAACAGCAACGGGAGCATTTGCCTTGACATCCTTAAGGACCAATGGAGCC
CAGCACTAACCATTTCCAAGGTGTTGCTGTCAATCTGTTCCCTGCTGACTGATCCGAACCCTGATGATCCTCTGGTCCC
TGAGATCGCCCACATGTACAAGACAGATAGGCACAAGTACGAGaACACAGCAAGGACCTGGACTcagaggtaCGCcaTg
tagcacctcagataTCGATGGACATGTcgaTGTTGTAACAACATTAtCAACgggtgtgtcTccCTcTcgccttgtgtgg
tgtaaggaTCAAAACcggCtTTgcagtgcaCTCt > SEQ ID NO:4723 104065FL 187420_300677_1d
CTCCACGCCTCCACAAATAAAGCTCGTCCCGAGGAAGGGCGGCGACCCACCCCCTCCCAATCGCCAAAACCCTAACTCC
GATCCGATCGAGCTCTGCTTCCCATGGCGACTGCCGCGAGCCAGGCGAGCCTCCTGCTCCAGAAGCAGCTCAAAGATCT
CGCGAAGAACCCCGTGGATGGGTTCTCGGCGGGGCTTGTGGACGATAGCAACGTGTTCGAGTGGCAGGTCACCATCATC
GGCCCGCCCGATACCCTGTATGATGGAGGCTACTTCAATGCAATAATGACCTTCCCCCAGAATTATCCGAATAGTCCCC
CATCAGTAAGGTTTACCTCTGAGATGTGGCATCCAAATGTTTATCCTGATGGGCGCGTATGCATTTCTATCCTTCATCC
ACCTGGTGAAGATCCCAACGGTTATGAGCTTGCGAGCGAACGGTGGACACCTGTGCATACAGTTGAAAGTATAGTTCTG
AGCATCATTTCGATGCTCTCTAGTCCAAATGATGAGTCTCCAGCAAATATTGAAGCGGCTAAGGATTGGAGAGAAAAGA
GGGACGATTTCAAGAAAAAGGTTAGACGCATTGTTCGTAAATCACAGGAAATGCTCTGAA > SEQ ID NO:4724 104065FL 187287_300675_1d
CTCGTGTCCGCTGCGAAGAAAAGGGGCATATCATGGCATTGAAGCGGATCCTCAAGGAACTAAAGGACCTGCAGAAAGA
TCCTCCAACATCATGCAGTGCAGGTCCTGCTGGTGAGGATATGTTCCATTGGCAGGCGACCATTATGGGTCCTCCAGAT
AGTCCCTATGCTGGTGGAGTTTTCTTAGTGAATATTCATTTCCCCCCGGACTACCCCTTCAAGCCTCCAAAGGTATCTT
TTAAGACAAAGGTCTTCCATCCAAACATCAATAGCAATGGAGCATATGCCTTGACATTCTTAAGGAGCAATGGAGCCC
TGCTTTGACCATTTCTAAGGTGTTGCTTTCGATCTGCTCGCTGCTCACTGACCCCAACCCGGACGACCCTCTTGTCCCT
GAGATTGCCCACATGTACAAGACGGATCGTCCAAAGTATGAGACGACAGCCCGCAGCTGGACCCAGAAGTATGCCATGG
GATGATGAAACCCACAAGCCCTGAATTCAAACCTGCTGCTTAAATGCAGACAGTCGTGGTAATTGTCCCATGAAAACT > SEQ ID NO:4725 104065FL 182315_300660_1d
GAATTCAGCAGCTAACAACAATACCCCAATACCAAACCCTAACCCTTAATCTCCCGCAGCTGTATAAAACCCTAATCAT
TAGATCCTGAGAAGAATCGGAGTTTTTTCTCACAGCTTTTTCTTACGGCTGTGAGGATGTCGACCCCTTCGAGGAAGAG
GTTGATGAGAGATTTCAAGAGATTGCAACAGGATCCTCCAGCAGGCATCAGCGGTGCACCGCAGGACAATAACATAATG
CTATGGAATGCTGTTATATTTGGCCCAGATGATACTCCCTGGGATGGAGGTACCTTTAAGTTGTCTCTGCAGTTTTCGG
AGGACTATCCAAATAAGCCACCAACAGTTCGGTTTGTTCGCGGATGTTCCATCCAAATATCTATGCAGATGGAAGTAT
TTGCTTGGATATCTTACAGAATCAGTGGAGTCCTATTTATGATGTAGCTGCTATTCTAACTTCTATCCAGTCGTTGCTT
TGCGACCCGAACCCAAATTCTCCTGCTAATTCTGAAGCTGCAAGAATGTTTAGTGATAACAAGCGTGACTACAACAGAA
AAGTACGCGAAGTCGTTGAGCAAAGCTGGACAGCAGATTAACTGCTCATCCCTAACATGTGGATGTCATTTGACTTATT
CTGTAAAGTTTGAAGTCTACGTAAGTAAACATTTCCACTTGAAAACAATTGTAATACAGACATAAGAGTTATATA > SEQ ID NO:4726 104065FL 265904_200082_1d
aatctccagTGCCTTTTAAGCCGGCGACGAACATAAGGCCGCCGCCTATCATTTAACCTCCCGTCGACGTCTATCATTC
AATTCTCGCCGCTTTTTGCTCGTAGGTCAACAATTCCGTATTTCTTATGCGGTGAGGATGTCGACACCGGCGAGGAAGA
GACTGATGAGGGATTTTAAGCGATTACAGCAGGATCCCCGGCCGGCATCAGCGGAGCTCCGTGTGACAACAATATAAT
GCTATGGAATGCA > SEQ ID NO:4727 104065FL 258580_301697_1d
GAAACCACCGTCCACCCTACCCACCCTCCGCAGACCTCTTCTCTTGCGCCGCGACCCAAAGAACAAGAGGATAGCTGAA
GAACCCGAAAAGAATGCAGATGGAAGCCCAGAATGCCGACCCCTTTGCTGAAAACCCCGCCAAGCTGCAAATGTCGGGA
TCCAACTCAAACGACGGCCACTCGGTCACCAAGCGCCTGCAAAACGAGCTGATGCCAACTCATGATGTCCGACACGCCCG
GAATCTCGGCGTTCCCCGTGTCCGACGCAGATCTGCTCAACTGGACCGGCACCCTGACCGGCCCGGAGGGAACGGTCTA
CGAGGACCTGACGTTCAAAATCTCGCTGGCCTTCCCCCAAAACTACCCCTACACCGCACCCACAATCAAGTTCATCAGC
CCCATGTGGCATCCCAACGTGGACATGTCCGGCAACATCTGCCTGGACATTCTCAAGGAAAAGTGGTCTGCCGTGTACA
```

FIG. 2 continued

ACGTGCAGACAATTCTCTTGTCCCTGCAGTCGCTGTTTGGCGAGCCCAACAACAAGTCGCCTCTCAACGCCCAGGCCGC
CCAGCTGTGGGACACGGACATGGATGAGTACAAGCGGCTGCTGATGCAGCGGTACGAGGCCCCTGACGATGA

> SEQ ID NO:4728 104065FL 255882_301645_1d
ACGCGTCGGAGACCACCCCATTCTCTCTCTCTCTCTCTCTCTACCCTGTTTTCTCCCGCCCTGTGGTTTTAACACCC
CTCGAAGGCTGGTCTTTAGCCTGTGTGTGTGTGTGTGTCTCCCTCCTCTCCTTTTTCTGTTTTGCAGCGAGTTCGAA
TTGAGGAGCAGCAAGTTCGAATTGCTTAGATGGCGTCCAAGCGGATCCTGAAGGAGCTCAAGGATCTGCAGAGGGACCC
CCCCACCTCTTGCAGCGCTGGACCTGTAGCAGAGGACATGTTCTACTGGCAGGCTACAATAATGGGCCCTGACGACAGC
CCTTATGCTGGAGGTGTCTTCCTGGTGACCATTCATTTCCCCCCGGATTACCCATTCAAACCCCCAAAGGTTGCTTTTA
GGACTAAAGGTTTTCCANCCCAAACGTCAACAGCAATGGAAGTATCTGCTTGGACATCTTGAAAGAACAATGGAGTCCT
GCATTAACCATTTCACAGGTTCTGCTCTCAATTCGCTCATTGTTGACCGACCCAAACCCAGATGACCCCTAGTTCCAG
AAATTGCTCACATGTATAAAGCGGAACAGGGCGAAATATGAAGCCACTGCAAGGAGCTGGACTCAAAAATATGCCATGG
GCTAATGCTACCCCTTATATATATATAAGGCGATGGGTGGTGAGTCTGTTTCCACATCTT

> SEQ ID NO:4729 104065FL 254087_301631_1d
ACGACCACCAATTCCAAGCACACATTCGGACACCCACACTCTCTATCTTGCGAACAGCCTGTCACGCGCGAAATCACTT
CCCCAACATCATCCTGGACTACAGTCTCCATAACGACACCACTCGCGCCTCACATCCCACGCATCACTTTCCAACATGT
CCACAGCAGCGAGGAGACGCTTGATGCGCGACTTCAAGCGCATGCAGACCGACCCTCCAGCTGGCGTCTCAGCCTCTCC
GATCGCAGACAATGTGATGACATGGAACGCCGTGATCATCGGGCCCTCCGACACACCCTTCGAGGATGGCACTTTCCGT
CTTGTCATGCACTTCGAAGAACAGTACCCCAACAAGCCACGGGCGTCAAGTTCATCTCACAAATGTTCCACCCAAACG
TCTATGCCACCGGAGAGCTGTGTCTTGACATCCTGCAGAACCGCTGGAGTCCGACATACGACGTGGCGGCAATCTTGAC
CAGCGTGCAGAGCTTGCTCAACGACCCGAACACCAGCAGCCCTGCGAACGTGGAAGCCAGCAATCTATACAAGGACAAC
CGCAAAGAGTACACTAAGAGGGTACGGGAGACGGTCGAGAAAAGCTGGGATGACTGAGCAAAGCGCGCAACACGAAAGT
GAGTTATGAGGCAATCACTATCGAATTCAGACTGGCTTGCATGAGAC

> SEQ ID NO:4730 104065FL 253305_301625_1d
AACCAAAAATACCATACACCATGTCGGGCAAGCGACCATCTGTGGCCCAGAAGCGGCTCATGAAGGAGTACAAGCAGTT
CATTAGTGATCCTCCCCAGGGAATCAGTGCAGGTCCTGCTGACGAAGATAACTTTCTACTCTGGGAATGTCTGATACAG
GGACCAGATGATACTCCGTACGAGGGTGGCCTGTTCCCCGCAACACTCAAATTCCCCCAGGATTACCCCCTGTCCCCTC
CAGTGATGAAGTTCACCTGCGAAGTGTACCACCCCAACATTTACAAGGACGGAACCGTGTGTATTTCCATTTTGCATGC
TCCTGGTGACGATCCCAACATGTATGAGAGCGCTTCGGAACGGTGGTCGCCCATCCAGTCGGTAGACAAGATTCTGCTG
TCGGTGATGAGCATGCTAGCCGAGCCCAACGACGAGTCAGGGGCCAACATTGACGCCAGCAAAATGTGGCGA

> SEQ ID NO:4731 104065FL 252709_301604_1d
tctgactcctcTCTCTCTCTCTCTTTAGATCTCTGGTCTCCGTCTCCGTGTCCGTCTCCGTTACTGTGTCTGTCTCCCT
TCCGTCGAGATCTGTGGATCTTATAGCCTAGCCCTAAAGGGGAACAGCAAGCTTTGGACTTTCCATGGCCTCCAAACGG
ATCCTGAAGGAGCTCAAGGATCTGCAGAGGGATCCTCCCACATCATGCAGCGCAGGACCTGTTGGGGAAGATATGTTTC
ACTGGCAGGCAACAATCATGGGACCGAATGATAGTCCATATGCTGGCGGTGTGTTTATGGTGACCATTCATTTCCCACC
GGATTACCCCTTCAAGCCGCCAAAGGTTGCTTTCAGGACTAAAGTTTTTCACCCTAACATCAACAGCAATGGGAGCATT
TGCTTGGATATATTAAAGAGCAATGGAGTCCTGCTCTTACAATATCGAAGGTCCTGCTGTCAATTTGTTCGCTCCTGA
CGGATCCAAACCCCGATGATCCCCTTGTTCCTGAGATTGCGCATATGTACAAGACAGACAGAGCCAAATATGAAGGCAC
TGCAAGGAGTTGGACGCAGAAGTATGCAATGGGCTGAATCTCTGACCTCTCTCGCCCCTTTGTAATAATCAAAAGAta > SEQ ID NO:4732 104065FL 252320_301670_1d
TTGACAGTGTGTGTTCTTCTTTCTCGCACTTGTTCCGTGTGCCCGGGGTTAGCCCTAGGGCGATCTTTGCGCGATCCGG
GCAGGGGATCGGGGCCGCGGCGCATCCACGCGGGCGATGCGCTAGATTGGGCACCCGGCGGCGAGGATCAGGGTTTGGA
TTTGTCGGTAGCAATAGCCCTATCGATCTCCATCGATCGATCGAGCTGGGCGGCGGGGGAATGGGCGAGAGCCAGGCGA
GCCTCCTCTTGCGCAAGCAGTTGAAAGATTTGACAAGAAATCCTCTGGATGGATTCTCGGCTGGATTGGTGGACGATTC
CAATGTGTTTGAGTGGGCGGTGACCATCATCGGGCCACCAGACACCTTGTATGAAGGTGGTTATTTCAACGCTATCATG
AGCTTTCCTCTGAATTATCCCAATAGTCCTCCGACCGTGAGATTTACGTCGGATATGTGGCATCCAAATGTTTACCCGG
ATGGTCGTGTTTGCATCTCCATCCTTCACGCTCCTGGAGACGATCCAAATGGCTACGAGCTGGCGAGCGAACGATGGTC
TCCAGTTCACACGGTAGAAACTATTCTTTTGAGTATAATCTCGATGCTTTCGAGCCCAAACGACGAGTCACCAGCCAAC
ATCGACGCCGCTAAAGAGTGGCGAGAGCGAaGaga > SEQ ID NO:4733 104065FL 248560_301584_1d
ggacagtatgtcTACTCCATCCAGGAAGCGCTTGATGCGAGATTTCAAGCGCCTCCAGCATGATCCACCCGCCGGGATC
AGCGGCGCGCCGCAGGACAACAACATCATGCTGTGGAATGCGGTGATTTTCGGGTAAGAGaggCCgCTTCTAGGGTTTA
GAGTTTCTAAAGGACTTTTTTCGTGGTTTGCtGCAGGCCTGACgatacTCCCTGGGATGGAGGGACATTCAAGCTGACA

FIG. 2 continued

```
TTGCAGTTTACGGAGGACTACCCCAACAAACCTCCCACTGTGAGATTTGTTTCAAAGATGTTCCATCCCAATATTTATG
CTGACGGAAGTATTTGCCTCGACATCCTGCAAAATCAATGGAGTCCAATCTACGATGTCGCGGCCATTCTTACTTCCAT
ACAGTCATTGCTTTGTGATCCTAACCCGAACTCGCCGGCCAACTCCGAGGCAGCTCGGATGTACAGCGAAAACCGCCGA
GAGTACAACAGGAGAGTTCGCGACATAGTCGAGCAGAGTTGGACGGCGGAGTAGCTCCCCTTGGtTCAAGAGCTTGTAA
GAGTGGCCATCACAGAGAGATGTGTGCTGCTCCGAGCACACATAAAGAATCTTGTCAAAAAACAATCCGGAAAGCTGTC
GCCTCTACAGACCAGCGTTGAAGGTCGACCATCGAACTCGTTTGCTTCTGTTGGAACCagggccaGTGTTCTGGTACTC
ACCATAGAACAGGGTGCTGAGAGCGAAGTCCCCGTTCCATTCCAACCATCCACGGGGTTGAATTATGTCACTGATGAAC
GACTTCATGAACACCGTCCgcgAGTAGAGCTTCCACGgCCTTCCgagtttATGAAAGAcAGCCccgtgttcTGTCGCTT
ATCGACg > SEQ ID NO:4734  104065FL 57194_300378_1d
cccacgcgtccgatctcttctattcataagttgtaaattcttattattgggATTTTTTTCCCTTTTTAATTCAATCCAAG
AATTGAGTAGGACTAATGGCATCCAGGAGAATTCACAAGGAACTAAGGGAGTTGCAAAGAGACCCTCCTACTTCATGCA
GTGCAGGTCCGGTGGCACAGGATATGTTCCATTGGCAAGCAACCATTATAGGTCCAAATGACAGCCCTTATGCAGGTGG
TGTTTTCCAAGTGGCCATCCATTTTCCTCCTGATTACCCTTTCAAACCTCCCAAGGTGGCTTTCAAGACCAAAGTTTTC
CATCCAAATATAAATAATAATGGAAATATTTGTTTGGACATTCTTAAGGATCAATGGAGTCCTGCCCTCACCATATCAA
AGGTTTTGCTTTCCATATGTTCACTACTAACAGATCCAAATCCAGATGATCCATTGGTTCCAGAAATTGCTCATATGTA
CAAATCTGATCGGAAGAAATATGAATCAATGGCTCGTAATTGGACCCAAAAGTTTGCTATGAATTGAGTTGTTGTATTC
ATATAAAGCTCATGTGCTATAATTTGTAACAAAAGATCAATGATTTTCTCCTCCGCAGGCATGTAATAAAAGCACAAAA
TTATAATACTTGTGAAATGAGAATTTTTCACACTTGATA > SEQ ID NO:4735  104065FL 52729_300084_1d
GCAGTTCTCTGAAGATTATCCCAATAAACCACCAACAGTTCGGTTTGTGTCACGGATGTTTCATCCTAATATTTATGCA
GATGGGAGTATCTGCTTGGACATTCTACAAAACCAGTGGAGTCCAATCTATGATGTTGCTGCTATACTTACCTCCATCC
AGTCCTTGCTCTGTGACCCTAATCCGAATTCTCCTGCAAACTCGGAAGCTGCTCGGATGTACAGCGAAAGCAAGCGCGA
GTACAACAGGAGAGTGCGTGATGTTGTTGAGCAAAGCTGGACTGCTGACTAGTAGTAGTTTGTTGTAAGCGTTGTAGCT
CTCTCTACTTTCTCTCAATCACGATTCAGCAACAGCTTTCTTCTCTTTTCATTCATGTCTTGTGTTTCCAAAACTATTT
AAGTGATTCCATGCTTTGATGTAACCCAACATCCTTAAAAAAACAACTTTGTACCAAACCATCTGAATTATTCACTTTT
GTGTATATATGTATTACGATTTAAAA > SEQ ID NO:4736  104065FL 50942_300164_1d
CTTCTCTCTAATACGAGACAGAAAAAGGCGAAAACCTCGCCAATCCGATTACGCGAAAAATCAAAGGTTTTTGGATATG
GCGTCGAAGCGGATCTTGAAGGAATTGAAGGATCTCCAGAAGGATCCACCTACATCATGTAGCGCAGGTCCTGTTGCTG
AAGACATGTTTCACTGGCAGGCAACGATAATGGGTCCTTCAGAGAGTCCTTATGCTGGAGGTGTTTTCCTTGTAACCAT
CCATTTCCCTCCGGATTACCCATTCAAGCCTCCTAAGGTGGCCTTTAGGACCAAGGTGTTCCATCCCAACATTAACAGC
AACGGTAGCATTTGCCTCGACATCTTG > SEQ ID NO:4737  104065FL 38614_300209_1d
ccAaTAATGGGTCcattTGATAGTCCTTATTCAGGCGGTGTCTTTCTCGTAACCATTCACTTCCCTCCGGATTATCCTT
TCAAACCACCAAAGGTTGCATTCAGGACAAAGTGTTCCACCCTAATGTCAACAGCAATGGAAGCATTTGCCTTGACAT
TTTGAAAGAACAATGGAGTCCTGCACTCACCATATCGAAGGTTTTGCTTTCGATATGTTCATTGTTAACGGACCCAAAC
CCAGATGATCCATTGGTTCCAGAGATTGCTCACATGTACAAAACCGATAGAGCAAAGTATGAGTCTACTGCGAGAAGCT
GGACTCAGAAATATGCAATGGGATGAAAGTTTGTGTCCTTTGATCCCTCACAGACTCGGTTTTAATAGAGAGAGAGAGA
GAAAGAGAGAGGACTTCTTCACATAGGGATCTTCCATGAAATAAGTTAGATTCCTATGTTTTATCATCTCTTTGTTTGA
AACCTCTTTAATCTCAAACAAAAACATTACTTCACCTCTTTATTATCC > SEQ ID NO:4738  104065FL 37480_300389_1d
TTGAATGGAGATCAAATAATTTCTTACTGATCCTGTCTTCACAAATTTTATAAGACAGACAAGTCTATAAAAGATCATT
ACATAGAAATAAGAAGAGTTTAATTATTAGGGCTCTTCCTTAAGGACAGTATTTGTGTCAGCCCATGGCATACTTTTGG
GTCCAGGTCCGAGCAGTGGACTCGTACTTGTTCTTGTCTGTCTTGTACATGTGAGCTATCTCAGGGACCAAAGGATCAT
CTGGGTTTGGATCCGTTAACAAAGAACAGATCGATAGCAGCACCTTGGAAATTGTGAGAGCAGGACTCCACTGCTCCTT
CAAGATGTCGAGGCAGATGCTTCCATTGCTGTTAATGTTTGGATGGAACACCTTCGTCCTAAAAGCCACCTTAGGAGGC
TTAAATGGGTAATCTGGAGGGAAATGGATGGTTACAAGAAAAACTCCTCCAGAATAAGGGCTATCCGATGGACCCATTA
TAgtGGCCTGCCAATGAAACATGTCTTCCGCAACGGGTCCTGCGCTACATGAAGTAGGAGGATCCTT > SEQ ID NO:4739  104065FL 293034_200199_1d
ATGCTTATATTCAGGTCCGAGTTTTATTTGCAGTCTCGTTCCAACTCTTCTCTCTCCCACAAAGTGAAGTCGGTCTGAG
ATTCGTAATGGCTTCAAAGAGGATTCAGAAGGAACTGAAGGACTTGCAGAAAGACCCCCCTGCTTCTTGCAGTGCAGGT
```

FIG. 2 continued

CCTGTTGGTGAGGATATGTTCCACTGGCAAGCTACAATTATGGGTCCATCTGACAGCCCATTTTCTGGGGGTGTTTTCC
TTGTGTCTATCCATTTCCCCCCTGATTATCCATTCAAGCCCCCAAAGGTTTCCTTTAAAACCAAAGTATTCCATCCAAA
CATCAACAGTAATGGTAGTATTTGTCTGGACATCTTAAAAGAACAATGGAGCCCTGCCCTTACTGTATCCAAGGTGCTG
CTTTCCATTTGCTCCTTGCTTACTGATCCAAATCCAGATGATCCGTTAGTGCCAGAGATTGCTCACATGTACAAGACTG
ATAGAGTGAAGTATGAGAGTACTGCTAGATCTTGGACCCAGAAATATGCCATGGGATGAAAACATTTGGCTTACTCCCA
TGAACATCGGGCCTTTATGCTATAGTAGTAAATAAAAATAGGCGCGGAACACAATTTC

> SEQ ID NO:4740 104065FL 292918_200249_1d
AGAAATCGAGTAGGAGGATCTCTGAGGGATATGGCATCCAAGAGAATTCTGAAAGAGCTCAAGGATCTGCAGAAAGATC
CTCCCACCTCTTGTAGCGCTGGCCCAGTTGCTGAAGATATGTTTCACTGGCAAGCAACACTTATGGGTCCATCTGACAG
TCCTTATGCTGGCGGAGTGTTTCTTGTTACCATTCATTTTCCACCTGATTATCCATTTAAGCCTCCAAAGGTAGCTTTT
AGGACAAAAGTTTTTCACCCAAACATCAACAGCAATGGTAGCATTTGCCTCGACATTTTGAAGGAACAGTGGAGCCCGG
CACTCACAATATCTAAGGTGTTGCTGTCCATCTGTTCTCTTCTAACAGACCCAAATCCTGATGATCCTTTGGTGCCTGA
GATTGCTCATATGTACAAGACTGATAAAAGCAAGTACGAAGCCACTGCTCGGAGCTGGACTCAAAAATATGCCATGGGT
TAGTTGCTGAAACACAAATATTTGGCTTTTATCTATGATGTATTAAGAAATTGTGTTATGCATAATTAACTCAAGGGAA
AGGTTGAATTGTGGCCCTCTGTAAAACACTTAATTTTCCTCATGTTTGTAAGATTAAATGGTTTTGAAattCtg > SEQ ID NO:4741 104065FL 285250_200180_1d
gaatttcaattctcgctaatcaggctaagactcagatttcttcgattgtttggttttAATGGCTTCGAAACGAATATT
GAAGGAGCTGAAGGATCTCCAAAAAGATCCTCCTACCTCATGCAGCGCCGGTCCTGTTGGAGAGGACATGTTTCACTGG
CAAGCTACAATAATGGGGCCCTCTGACAGCCCTTACGCTGGGGGTGTATTTTTAGTCACTATCCATTTTCCTCCAGATT
ATCCATTCAAACCTCCTAAGGTTGCTTTTAGGACAAAAGTTTTCCATCCAAATATCAACAGTAATGGGAGCATATGCTT
GGACATACTGAAGGAGCAGTGGAGCCCCGCCTTAACTATTTCCAAGGTTTTGCTTTCAATCTGCTCACTTTTGACGGAT
CCAAACCCTGATGACCCCCTTGTTCCTGAGATTGCTCACATGTACAAGACAGACAAGGCCAAATATGAAGCAACCGCCA
GGAGTTGGACCCAGAAGTACGCCATGGGCTAACTATTGCCTATGCGGCTTGAATTGATATAAAGAAAAACAAATTTCA
ATGTCTTTCTTCTCTgtTCTCTCCATTAACAAGTTGTACAATAGCATTAAGCATTGCCCTCTGCAggAAGAATTATGAT
GCTTTAaAttttgttTATATGGATTctaatATTTGATgtgGGGaaGCATATATTTATCTg > SEQ ID NO:4742 104065FL 274422_200057_1d
gcgaactCCTCCCAAGTCATATCCCTCAAAGTCACAGTATCTCGTACTTTGGTTTCTCCTTTTGTTTGGGATAAGAGAA
AGACAGTAATGTCAGGAGGTATAGCCCGTGGCCGTCTTGCAGAGGAGCGCAAAGCTTGGCGCAAAAATCACCCCCATGG
GTTTGTAGCAAAGCCAGAGACGCTTTCGGATGGGTCAGTTAACTTGATGGTTTGGCACTGCAGTATTCCTGGTAAAGCA
GGAACGGACTGGGAAGGCGGTTTTTATCCGGTTACGATACACTTCAGTGAAGATTATCCTAGCAAACCACCTAAGTGCA
AATTCCCACAAGGCTTCTTCCATCCGAATGTCTATCCATCAGGAACAGTTTGCTTGTCGATCCTCAACGAAGATAGCGG
TTGGAGACCTGCCATTACAGTGAAACAGATACTGGTTGGTATCCAAGACTTGTTAGATCAGCCAAACCCTGCTGATCCT
GCCCAAACCGAAGGGTATCATCTCTTTATTCAGGATGCTATTGAGTACAAGAAGCGGGTTAGGCTGCAGGCCAAGCAGT
ATCCTCCTCTGGTGTAGTCTAAATAATGGTCGTATGTTTGGATCGTGGTTCTAATGCAACTTGAAACTATGGTATTCAT
AGCCTGCTGATAGCTGACAGTCTTCTGGCAAATGATGCTGACTTGg > SEQ ID NO:4743 104065FL 274064_200147_1d
aaattattgggggtagctgaaaatacctagcaaagatacataacggaccaacggtatactgtcacgacatatctgctta
tAAAAAAGGAGTCCTAATTTCACTGTAAACTTCTCGCTTTCTCCTCGGTCCCCTCCAGAATCTGAATTGCAACGTGTAG
GAGGATCTCTGAAGGATTTGGTGAATCATGGCATCCAAACGGATTCTCAAAGAGCTCAAGGATCTCCAGAAAGATCCTC
CTACCTCTTGCAGCGCTGGTCCAGTTGCTGAAGACATGTTTCATTGGCAAGCAACAATTATGGGTCCGCCTGACAGCCC
TTATGCTGGCGGAGTGTTTCTTGTTACCATTCATTTTCCACCTGACTATCCATTTAAGCCACCGAAGGTAGCTTTCAGG
ACAAAGGTTTTCCACCCAAACATCAACAGCAATGGTAGCATTTGCCTCGACATTTTGAAGGAACAATGGAGTCCGGCAC
TTACAATCTCCAAGGTATTGCTGTCAATCTGTTCTCTGTTGACAGACCCTAATCCTGATGATCCATTGGTGCCGGAGAT
TGCTCATATGTACAAGACTGATAAAAGCAAGTACGAAACAACTGCCCGGAGCTGGACTCAAAAGTATGCCATGGGTTAG
TTGCAGTGACCATCTCTGGAGGGGCTCCTTTTCTTCTgtggtaTTCTgtaTATCTATTATGTATTAAGaaAtggtgttC
TTATGCATAATCAACTcaagggGAAATgttGaaCAgGCCCcTGtaacaaTttg > SEQ ID NO:4744 104065FL 247566_301621_1d
GGGCGGACGCGTGGGGGCGATTAGGGTATATTGGCTTTGTCGCGGCTATGGCGTCCAAGAGAATCCTCAAGGAATTAA
AGGACTTGCAGAAGGATCCGCCCACTTCGTGTAGCGCAGGTCCTGTGGCCGAGGATATGTTTCATTGGCAAGCGACGAT
AATGGGTCCTCCCGATAGCCCCTACGCAGGGGGTGTTTTTGGTCACCATCCATTTCCCCCCGGATTATCCCTTTAAG
CCCCCCAAGGTCGCATTTAGAACGAAAGTTTTCCACCCAAACATCAACAGCAATGGCAGCATCTGCCTCGACATTCTCA
AGGAGCAGTGGAGCCCGGCCTTGACAATCTCCAAGGTGCTGCTATCAATCTGCTCGTTGCTAACCGATCCAAACCCCGA
CGATCCACTGGTGCCCGAGATTGCTCACATGTACAAGACAGACAGGCCCAAGTATGAATCGACCGCCAGGAACTGGACG

FIG. 2 continued

CAGAAGTACGCCATGGGGTAAGCCCGGGCTTGTGAGCGGCGGCGGCGGCGGTGGCGGTGGCATGGCTCGCTATGATGTT
TGTGATACCATTTGGTTGCCTATCTATAAGTTGAAAGCAGGGATTGTCTTTGATTATGGAATTCTTTTGATTACTGTAT
ATAGAATTTCTATCACGTC

> SEQ ID NO:4745 104065FL 247187_301617_1d
gatcgcatgcacacggcaggaaggggaagtggaggaagggttgcgatctcgcggatcgtccaggatagggcgccgcatc
gACTCGCCGCCTACGCCGCCGCTGCCGCCGCCGCCGCTATGGCCGTGACCCTGGGTTTGTAGGGATTTTCCATCCAGAT
TTCGAGGAGATCGCTGCGCGTTTCTCGTTCATGGCTGAGAACTTACCCCCAAAGGTGATTCGAGCGCTTGCAAAGGAGC
TCAAGAGCTTGGACGAGAGCCCTCCAGAGGACATTCGCGTTCATGTAAATGACGACAACTTCTCGAGCATTTTCGCGGA
CATTGAGGGACCACCCGGAACACCGTACGAAAGTGGCGTCTTCCGGATCAGGCTTTTGCTTAGTCCCGATTTCCCGCAA
ACGCCACCGAAAGGTTATTTCGTCACCAAGATCTTCCATCCAAACATCGCAAAGAATGGAGAGATTTGCGTGAACGTTT
TGAAGAAGGATTGgAAGCCGACGCTCGGCCTGAGGCATGTTCTTCTTGTCGTACGGTGCTTGCTCATAGAGCCGTTTCC
AGAATCGGCACTTAACGAGGACGCTGGAAAGATGtTGATGGAGGATTACGATGGATACGcaaAGcacgccAGaTtGATG
AcaaACatccacgcGatgaagccaaAGccaaAGACcacgAAAgtCGCCAta > SEQ ID NO:4746 104065FL 244825_301562_1d
CGCGATTGTAGATGCTATAGATCCAGGTCGCCTCGTCGTCGTCCCGTGGCGCCGCTGTAGATAGGGTTTGATTCATCGC
GCAGCAGCGGCAGCGGCGATGTCTACGCCGGCGAGGAAGCGGCTGATGCGGGATTTCAAGCGGCTGCAGCACGATCCAC
CGGCGGGCATCAGCGGCGCTCCACAGGACAACAACATCATGCTGTGGAATGCGGTCATCTTTGGGCCGGATGATACGCC
ATGGGATGGAGGAACATTCAAGCTCACCTTGCAGTTCACAGAGGATTATCCAAACAAGCCACCAAATGTGCGGTTTGTT
TCGAAGATGTTCCATCCAATATTTATGCGGACGGAAGCATTTGCCTGGACATTCTCCAAAACCAGTGGAGCCCGATCT
ACGATGTTGCTGCAATATTTGACATCGATCCAGTCTCTACTATGCGATCCAAACCCGAACTCTCCTGCTAATTCCGAAGC
CGCACGGATGTACAACGAGAACAGGCGAGAGTACAACAAGAAAGTTCGCCAAGTCGTGGAGCAGAGCTGGACAGCGAAC
GACTGAAACCGAGAGTTCTGCTCGGCTGCTCGACATGCTGGTACGCGATTTTCTGGCGATCACGGACGGAATtcTACTA
ACCAGCAGGAGCactgTATatcctcTGTACTCGGAtTTTTTTTcttaggtGATGTGGTTGcaactaagaaagt > SEQ ID NO:4747 104065FL 239823_301308_1d
GGAAATATTTGCTACAGGGTAGATGCTTCCCCATTTTTAGGTCTAAAGCTTCTTTCTCCTCCCTCGATTCGATTCGATC
CATCGGCGGCGGCGGCGATGAACATGAACGGCGGCGTCGATGCGATCGCGCAGCAAGCGACGAAGCAGCGAACAATCCGGCGGG
TAGCAAGCAGAGCAAACCCAATTTGCAGCCGGTGGACAGCCATTCCGTCGCCCGGAGGTTGCAGTCGGAGCTCATGGCC
TTGATGACTTGCGGGGACCCGGGAATCTCAGCGTTCCCAGACGGCGACAACATCTTTACGTGGATTGGAACCATCAAAG
GGAGCGACGCGACGGTGTACGAAGGTCTCTCCTTCAAGCTCTCGTTGCGCTTCCCGACCGACTATCCATTCAAGCCGCC
ACTGGTCAAGTTTGAGACGTCGTGTTTCCATCCCAATGTCGATCAGCATGGCAACATTTGCCTCGACATCTTGCAGGAT
AAATGGTCCTCGGCCTACGATGTTAGAACCGTGTTGCTGTCCATCCAAAGCTTGCTAGGAGAACCAAACAACGATAGTC
CTCTCAACAGCTATGCGGCAGCATTGTGGCCAAACCAAGAAGAGTACAAGAAAGTGATGAACAGGCAGTGCCGCGACGG
ATCTGGTCGATGAGAAAGGGTCGATCGACAAGAGAG > SEQ ID NO:4748 104065FL 237695_301289_1d
gggaacgcgggaaggggcggcaACGGCGATGGCGCTGGCGTCGGCGGCGGCCTTGTGACAGTCAACCACAGCATGCTCG
TTGCGGCTGCCGCCACTGCCACTACAGCGTCGATCGAATTCTTGTATTCCTGCAAGCTAGGGTGGGGCGAGAATGCTGT
CGTCGGCCCAGTTGCGGCTCATGTCCGACCTCAAGGCGATTCAACAGGAGCCGCCAGAGGGATGTAGTGCTAGTCCACA
AGGCGAAGAGAATCTCTTTGTGTGGGGAGCCACTGTGTTTGGGCCGGATGAAACACCATGGGAAGGGGCGATCTTGCCT
CTTCGTCTCACCTTTGGCGAGCACTACCCGGCGAAGCCACCGCGCGTGAGATTCACGTCCGAAGTGTTCCATCCAAATG
TCTACAGTGACGGCGCACTGTGCATGGATATCATCCAGGATGCATGGTCTCCTTGCCACAACGTCAGCACCATTCTCAC
CTCGATTCAGTCTCTCCTGACTGATCCAAATCCAGCGAGTCCAGCGAATCCCGAAGCCGCGCATATGTATCAAAACGAT
CTCCAAGCATACAACAGGAGAGTGCGCCAGTGTGTGAGGAAGTCCCTAGATATATAAAACTCCAAAGTTTTATTTATCT
ATCTATCATAGTGAtTATCta > SEQ ID NO:4749 104065FL 233923_301095_1d
GCGAGAGAGAGCAGGAAGGCGATCGATCAGCTCCCGGCGGCGCTGTCGGAATCCGGATCTTGGAGCCGCTGCCATGGCC
AGTACCATCGCCAACAGCAATCTCCCGCGGCGGATCATCAAGGAAACGCAGCGATTACTGACCGGACGCAGCCGAAGGCA
TCAAAGCTTCGCCTGCCGAAGATAATTTGCGATACTTCAATGTGATGATCCTTGGCCCCGCACAGTCACCCTATGAAGG
TGGTGCTTTTAAACTGGAGCTTTTTCTTCCGGAAGAATATCCAATGGCTGCTCCAAAGAACTGCAATAGGTTCGCTTCT
TGACGAAAATTTACCATCCAAACATCGACAAGCTGGGCCGGATTTGCTTAGACATTCTAAAAGACAAATGGAGTCCTGC
TCTCCAGATTCGAACAGTGCTTTTGAGTATTCAAGCTCTTTTGAGTGCTCCCAATCCTGAGGATCCCCTGGACGAGAAC
ATCGCGAAGCACTGGAAGACAGACCAAGGAGGAGCCATCGCGACTGCAAGAGAGTGGACTCAACTCTACGCGACCCATA
ATTAAATCAAAATGCGGACCATTCGTCATCTTGGTTCGTTTAGTTTTTTCTgctTTGgtCATAttTgt

FIG. 2 continued

> SEQ ID NO:4750 104065FL 230618_301070_1d
tACTCCATCCAGGAAGCGCTTGATGCGAGATTTCAAGCGCCTCCAGCATGATCCACCCGCCGGGATCAGCGGCGCGCCG
CAGGACAACAACATCATGCTGTGGAATGCGGTGATTTTCGGGCCTGACGATACTCCCTGGGATGGAGGGACGTTCAAGC
TGACATTGCAGTTTACGGAGGACTACCCCAACAAACCTCCCactGTGAGATTTGTTTCAAAGATGTTCCACCCCAATAT
TTATGCTGACGGAAGTATTTGCCTTGACATCCTGCAAAATCAATGGAGTCCAATCTACGATGTCGCGGCCATTCTTACT
TCCATACAGTCATTGCTTTGTGATCCTAACCCGAACTCGCCGGCCAACTCCGAGGCAGCTCGGATGTACAGCGAAAAcc
gccGAGAGTACAACAGGAGAGTTCGCGACATAGTGGAGCAGAGTTGGACGGCGGAGTAGCTCCCcttggaTTTGTGGGT
AAGACAGCATTTATGGGTGATCTTTtGCAATATATATGTTGCATTGGTTAGATCACAGCactGgCtTCttgagTATGTA
TATg > SEQ ID NO:4751 104065FL 226366_300996_1d
ACGACACCAATTTTAAAAAATGGCTTTGAAGCGAATCAACAAGGAACTCAGTGATCTTGGACGTGATCCCCCCTCCTCT
TGCTCTGCTGGTCCTGTTGGCCAGGATCTGTTCCACTGGCAGGCTACTATCATGGGACCCTCAGACTCTCCTTACTCCG
GAGGTGTTTTCTTTCTGTCTATCCACTTCCCCACTGACTACCCCTTCAAGCCACCAAAGGTGACCTTCACTACCCGAAT
CTACCACCCCAACGTCAACACCAACGGATCCATCTGTCTGGATATTCTCAAGGAGAACTGGTCTCCCGCACTCACCATC
TCCAAGGTGCTGCTGTCCATCTGCTCCATGCTCACAGACCCCAACCCTGACGATCCTCTCGTGCCCGACATTGGCCACC
TGTACAAGAACGACCGAGCACGATACGACGCCACTGCCAAGGAGTGGACCAAGAAGTATGCCGTCTAGGATGTATATAG
GGAGCAGGCATGAGCCTATGCAAGCGAATGGCTGTGACGATACAACTAGCCAATGTTAGATTTATGGATGGTAAAACAA
TGTGTGTCgaGGAAAaa > SEQ ID NO:4752 104065FL 179640_300562_1d
tcgacccacgcgtccgaacaatccccaGCCTCACCAAAAAGGACACAAAATAACGACATTCACTCTCTCTCTCTCTCTC
TCTTCCTCTTTTCTCCATTCTCTCGCGGGGTCATCCGCCCACCATGGCCCAATCCACCGCCCACCGCCGCCTCCTTCAA
GAATACCGCGCCCTCACAAACAACCCGCCCGAAGGCATCACCGCCGGCCCCGTCTCCGAGGACGACCTGCTGCACTGGG
AATGCCTCATCCAGGGGCCTGAGGGAACTCCCTTTGAGGGCGGCGTCTTTCCCGCAGAGCTCAAGTTTCCCAAGGACTA
TCCGCTGGCGCCGCCGACGATGAAGTTTCTCGCTGACATGTGGCATCCGAACGTCTACCCCAGCGGCCTCGTCTGCATC
TCCATCCTCCACCCTCCCGGCGACGACCCCAACCACTACGAGCACGCCTCCGAGCGCTGGTCCCCCATCCAGTCCGTCG
AAAAGATCCTCATCTCTGTTATGAGCATGCTAGCTGAGCCCAACGACGAGAGCCCCGCCAACGTCGAGGCCGCCAAGAT
GTGGCGCGAGCGTCGGGATGAGTACGAAAAGACGGTCCGCGACGGTGTTCGGCGCATGTTGGGTTTGTAACAGCGCATG
TTGGGTTTG > SEQ ID NO:4753 104065FL 176210_300520_1d
gacctGCGAACTCTCCACGCCTCCACAAATAAAGCTCGTCCCGAGGAAGGGCGGCGACCCACCCCCCCCCAATCGCCAAA
ACCCTAACTCCGATCCGATCGAGCTCTGCTTCCCATGGCGACTGCCGCGAGCCAGGCGAGCCTCCTGCTCCAGAAGCAG
CTCAAAGATCTCGCGAAGAACCCCGTGGATGGGTTCTCGGCGGGGCTTGTGGACGATAGCAACGTGTTCGAGTGGCAGG
TCACCATCATCGGCCCGCCCGATACCCTGTATGATGGAGGCTACTTCAATGCAATAATGACCTTCCCCCAGAATTATCC
GAATAGTCCCCCATCAGTAAGGTTTACCTCTGAGATGTGGCATCCAAATGTTTATCCTGATGGGCGCGTATGCATTTCT
ATCCTTCATCCACCTGGCGAAGATCCCAACGGTTATGAGCTTGCGAGCGAACGGTGGACACCTGTGCATACAGTTGAAA
GTATAGTTCTGAGCATCATTTCGATGCTCTCTAGTCCAAATGATGAGTCTCCAGCAAATATTGAAGCGGCTAAGGATTG
GAGAGAAAAGAGGGACGATTTCAAGAAAAAGGTTAGACGCATTGTTCGTAAATCACAGGAAATGCTCTGAAAGATAAGG
AGCACAAGGGGGAGTAAGCGAGTGCTACAACAGGTGCACTACACTTAACTGTCTGTCGTCAAACGACTACCTAAAGATA
GCATTTttgcTTCTTCCCCtgtaTATTTCCCCCTCAGTGTCATTCGAGTGGTGATGTTGGTCttgtctCCGaGatgCTC
GGAAatgTTGCctatt > SEQ ID NO:4754 104065FL 167862_300551_1d
GAATTCAAAAAGACTATAAAATCCAATCAACCTCTCCAATTCCCGGAATCCTCCTTCCTCCTCCGGTTTCTTCCTTTTT
CAGAGCACCGAGTTCCTCTGGATCCTCTCTCCTGGTTTCTTCAAATACCCTTTGGTTTTTTTCCTTTACCCCTCTTGTA
AAATCTAGGGTTTCGAGAGAAAAAAAATCTTCAGAGAGGATGGCCTCCAAACGGATCTTGAAAGAACTCAAGGATCTTCA
GAAAGATCCTCCTACTTCTTGCTCCGCAGGTCCTGTTGCCGAAGACATGTTTCACTGGCAAGCAACAATAATGGGTCCC
CCAGACAGTCCATACGCAGGAGGAGTCTTTCTAGTTACTATTCATTTCCCTCCAGATTATCCATTCAAGCCACCAAAGG
TTGCCTTCAGGACAAAGGTATTCCACCCTAATATCAACAGCAATGGGAGCATCTGTCTTGACATCTTGAAGGAGCAATG
GAGCCCTGCCTTGACCATTTCCAAGGTGTTGCTATCCATTTGCTCATTGTTGACGGACCCAAACCCAGACGATCCTTTG
GTGCCAGAGATTGCTCACATGTACAAAACCGACAGGAGCAAGCATG > SEQ ID NO:4755 104065FL 160218_200051_1d
gcaggcgacgcgcaagaaactgaagtctagtcttaaccccatccaagctcaatttcaatctcgtcgattctctttgaaa
tTCTTGCCGCTTCATCGTTCAGGCGGTCAGGGATGTCGACGCCAGCGAGGAAAAGATTGATGAGGGATTTTAAGAGGTT
ACAGCAGGATCCTCCTGCCGGCATCAGTGGTGCTCCGTATGACAACAATATTATGCTCTGGAATGCCGTTATATTCGGT

FIG. 2 continued

```
CCTGATGACACACCTTGGGATGGAGGTACGTTCAAGCTCACCCTTCAGTTTACGGAGGACTACCCCAACAAGCCTCCAA
CTGTGCGGTTTATTTCCAGGATGTTCCATCCAAATATTTACGCCGATGGAAGTATATGCTTGGACATACTGCAAAATCA
GTGGAGTCCTATATATGACGTAGCTGCTATACTTACTTCAATCCAGTCTTTGCTCTGTGATCCAAACCCAAACTCGCCA
GCAAATTCAGAAGCAGCACGCATGTTTAGTGAGAATAAGCGCGAGTACAACAGGAAGGTGCGTGAGATTGTTGAGCAGA
GCTGGACAGCAGACTAACATCTCTCAGGCTGAATCTGTTTTGGGAGATTTTccTGGTAccGccTGTGTCGAGCTGAAAA
CTTTTCAGTGCCGttgctACATTAAAAACAAATGTagcagGAAATTgTACTTTTATGTGttgTaggaaaCTCTGAttgc
cTTTatcTTCATGTTCTGCTACTCGACTATGagaCgttgtacataTGATGATcTCTTGt > SEQ ID NO:4756 104065FL 158243_200002_1d
tgttttagtGAGACAAAGAGTGTGAAACTCTCTTACAATTTCTACTTTCTCTCTCTAGAAAAAAAAGAGACCCTTAGCG
TAAATTTTCTGCGATCAAAAAAAGAATTCGATTCAATTCAATGGCCAACAGCAATCTTCCTCGAAGAATTATTAAGGAA
ACTCAACGTCTTCTCAGTGAACCCGCGCCGGGAATAAGTGCGTCTCCTTCGGAAGAAAATATGCGATACTTCAATGTCA
TGATTCTTGGTCCAACACAATCTCCTTATGAAGGAGGTGTTTTCAAACTGGAACTCTTTTTGCCTGAAGAGTACCCAAT
GGCTGCTCCGAAGGTTCGATTTCTCACCAAAATATACCATCCCAACATTGATAAGCTTGGTAGGATATGCCTTGATATT
CTCAAGGACAAGTGGAGTCCTGCTCTTCAGATTCGCACCGTTCTTTTGAGCATTCAAGCACTTCTGAGTGCACCAAATC
CAGATGATCCACTCTCAGAGAACATTGCGAAGCATTGGAAGTCGAATGAGGCTGAAGCTGTTGAAACGGCTAAAGAATG
GACACGCCTGTATGCAACCGGTGCCTGAAACGGCATGACTAAGTGATTTTGAAAAGAAAAAGAAAAAAGATGTGGAATG
TAATTTATCCACTGTCAATCAGGGGACATGGGAGGACTGAAAGCTAAATTACCATCTATAATATTTTCCCTACCCTTG
AAATTGTATAGTCAAATATTGCACCTTTTTAttCCAAGTTGAAgaaaCTt > SEQ ID NO:4757 104065FL 145271_301058_1d
tacgaaaccaacaaggaagagaatcaaattcttctattcccaataattcTCTATTCAGATTCGATCTCGGTCTCTGAGT
GATGGCTTCGAAACGGATCTTGAAGGAGCTCAAGGATCTCCCAGAAGGATCCCCCTACCTCTTGCAGCGCCGGCCCCGTC
GGAGAGGACATGTTCCATTGGCAGGCCACAATTATGGGTCCCCCAGACAGCCCTTATACCGGTGGTGTATTCCTAGTTA
CTATACATTTTCCTCCTGATTATCCATTCAAACCTCCTAAGGTTGCTTTTAGAACAAAAGTTTTCCATCCAAATATTAA
CAGTAATGGCAGTATATGCCTGGACATATTGAAGGAGCAGTGGAGCCCTGCATTAACTATTTCCAAGGTTTTGCTTTCA
ATTTGCTCTCTTTTGACGGACCCAAATCCCGATGACCCCCTGGTGCCGGAGATTGCTCACATGTACAAGACAGACAGAG
CTAAATACGAATCAACTGCCAGGAGTTGGACCCAGAAATATGCCATGGGTTAGAACATTACCTATACGGGCCCGAGTCC
ATGTAAAAAGAATTCATGTGCCTGTTCTCTCTCCTCTCTCAACCagCAAAGTGTAGAATAGCATTAAATGTTGTCCTCT
ccAAGAAAAAGAGATGCTTTGAATATTTTTATATGGATTCTAACATtTTAAGAAATCTGGGAACTgttTATTTATCTGG
tt > SEQ ID NO:4758 104065FL 143665_200045_1d
CGGTAGTAGTAGTGGAGGAAGAACATGGCCGTCGACGACGTCGGTGTCTAGTTCCGGTAAGAGAATACAGAAGGAAATG
GCTGAACTAAGCATAGAGGCGCCACCAGATTGTGCAGCTGGGCCTAAAGGCGATAATCTTTACCATTGGGTTGCCACCC
TCTTCGGCCCACCTGGAACACCTTATGAGGGTGGAATATATTTTGTCGATATAACCTTCCCTTCTGATTATCCATTTAA
ACCTCCAAAGGTTGTATTCAAAACTCGCATATATCATTGCAATGTCGAGCCTTCTGGAAATGTTAGCTTGGACATCCTA
ACAGATAACTGGAGTCCAGCATTAACAATCTCGAAAGTACTACTTGCTCTGAGATCAATGTTCACCACTCCAGAAACCT
ATAAGCCAGTTGTTCCTGGTATTGCACACTTATACTTTGAAGATAAAGCCAAACATGATGAAATAGCTACACAATGGAC
ACTGCGATTTGCAAGGTGAAAAAAATGAATTCAATGTGGAATTTTCTTAACCAAGTTCTGGTCAGCCCCCTG > SEQ ID NO:4759 104065FL 124677_300424_1d
TTCTCAAGCTAGTCTCCTCCTTCAGAAACAACTCAAAGATCTCTGTAAAAGACCAGTTGATGGATTTTCAGCTGGTTTG
GTTGATGAAAACAACTTATTCGAATGGAGTGTCACCATTATCGGACCCCCAGATACTTTATATGAAGGGGGTTTCTTTA
ATGCTATCATGAGCTTTCCTCAAAATTATCCCAACAGTCCTCCAACTATTAGGTTTACCTCGGAGGTGTGGCATCCTAA
TGTTTATTCTGATGGAAAGGTTTGCATCTCAATACTTCACCCACCTGGTGATGATCCAAATGGATATGAGCTTGCTAGT
GAGCGTTGGTCTCCTGTCCATACGGTTGAGAGCATAATATTGAGCATCATATCAATGCTTTCAAGTCCTAATGATGAGT
CTCCTGCTAATGTGGAAGCCGCTAAGGAATGGAGAGATAATAGAGATGAATTCAAGAAAAAGGTCAGTCGTTGTGTAAG
ACGGTCTCAAGAAATGACATAAAGACACGAAtgccAAAATCGGACTTCTTTCATCAGtTGttGTTTGATACAAATGtag
aAtTgttgTCAaGGTCTGTCATAccTTTTgtaaTATttgcgagtacggTCAtTAtTTACAtTT > SEQ ID NO:4760 104065FL 1111370_301534_1d
AGGAAAGGAGCGCATCTCAAAAGCCCCAAGCCTAGGGCCTGTCTTCCCCTTGGAACAAAAGCACCCCCCACCCATAGCC
ATTAGCCATTAGCCATTATGTCAGAAACTCAGGCTAGCCTTCTCCTTGGCAAACAACTTAGAGAGCTTTTAAAATCTCC
AGTGGAAGGTTTCTCAGCAGGGCTGGTGGATGATTCTAACCTCTTTGAATGGAATGTGACCATTATTGGTCCTCCTGAT
ACATTATATGAAGGTGGTTTCTTCAATGCCATTATGAGCTTTCCCAAAAATTATCCAAATAGTCCTCCAACAGTCAGGT
TCACCTCTGAGATGTGGCACCCAAATGTGTATCCGGATGGCCGTGTTTGTATTTCCATTCTTCATGCCCCGGGGATGA
TCCAAATGGATACGAACATGCTAGCGAGCGGTGGTCACCAGTGCACACGGTGGAAACCATTCTATTGAGCATCATTGCA
```

FIG. 2 continued

ATGCTTTCCAGTCCGAACGACGAGTCTCCGGCAAATATAGATGCAGCAAAGGAATGGAGAGAGAACAGGGCGGAGTTTA
AGAAGAAAGTGCGTCGCATTGTACGGCGATCTCAAGAGTGTCTCTGAATTTGGCAATATACCAGGGTATGTATCCTCAT
TGAGAAACCCTTGAAACTTCTCTGAATTGATagaAAAAAGGAAGGGACATACATATATATcaga > SEQ ID NO:4761 104065FL 1110673_301541_1d
TGCTTACAGGCGTTAGAAGAGAAGACGGAGAGAGAGAGAGAGAGAAGGGAAGTCCAGGCGTCTCTATCTTTCTTACTCTGC
CCTTCTCAGCATTCCCACTGCCATGTCCACCCCTGCACGGAAGCGCTTGATGCGCGACTTCAAGCGGCTTCAGCATGAT
CCCCCTGCTGGCATAAGTGGTGCTCCTCAGGACAACAACATTATGCTTTGGAATGCTGTCATCTTTGGGCCGGATGACA
CACCATGGGATGGAGGTACGTTCAAGCTGACATTACAATTTTCTGAGGACTATCCAAATAAGCCTCCGACGGTCCGTTT
TGTGTCGAGGATGTTCCACCCAAACATTTATGCCGATGGAAGTATCTGCCTGGATATTCTGCAGAACCAATGGAGCCCA
ATCTATGATGTCGCAGCAATACTTACATCCATTCAGTCTTTGCTCTGCGATCCAAACCCGAACTCTCCGGCAAATTCCG
AAGCAGCACGAATGTATAGCGAAAACCGGCGAGACTACAACCGGAAAGTGCGCGAAATAGTGGAGCAAAGCTGGACGGC
TGAATGATGGATGAACTGTCTACCTCTAGTGATATACAAGTGTGTCGAAACAGTTGCATGAGGTTGAACTAATTCTCTC
CTTTTACAAGTTTGGCACTTTCGTAAAAATTCT > SEQ ID NO:4762 104065FL 110920_300048_1d
CCCACGCGTCCGGTCGTTGCTTAATTACTGTTCATTCACAGGAGGATCCTAATCTCTTTCAGGAGTCGCTATGGCTTCA
AAGCGGATCTTGAAGGAGCTCAAAGATCTTCAAAAGGATCCTCCTACTTCGTGTAGTGCTGGACCTGTTGCTGAGGACA
TGTTTCATTGGCAAGCAACGATAATGGGTCCTCCAGATAGTCCTTTTTCTGGTGGTGTTTTTCTGGTGACGATTCATTT
TCCTCCAGATTATCCATTCAAGCCACCTAAGGTTGCTTTCAGGACAAAAGTTTTCCACCCAAACATAAACAGTAACGGG
AGCATATGCCTTGACATTTTAAAGGAACAGTGGAGCCCTGCCCTAACGATTTCCAAGGTGTTGCTTTCAATATGTTCTC
TTTTGACGGATGCTAATCCTGATGATCCTTTGGTCCCAGAGATTGCACACATGTACAAGACAGACAGGAACAAGTATGA
GACAACTGCAAGGAGCTGGACCCAGAAGTATGCCATGGGCTAAACGTACCTTTGTATCATGGGGTCAAGGGCATTTTAC
TTTCAGATACTTCACTATTTACATTCAATGTACTAATCTGTTCTTTGAGTTGTAACATGGAGTCCATGTCTTAAGAGGA
AAGGAAAATCATGgAcgcTGCTccTAAaagtttGTAt > SEQ ID NO:4763 104065FL 1109176_301542_1d
GGAATGGCATCCTCTGCTCAGCTTCGATTGATGTCCGATCTGAAGGCCATTAGCCATGAGCCACCTGAGGGATGCAGTG
CCAGCCCTTATAGCGATGCGGACCTTTTTGTTTGGGACGCCACAATATTTGGTCCCGAagATACTCCATGGGAATGTTG
TTCCTGTGACCGGATCCATCTTTCGAAACTTGAAAATTAGATCAATGAACCTATCTGTAACTTTGTGTTCTATTGTATG
CTTGTGTTTCTTGTAGGTGGCATTTTCTGCCTCCGTTTGGTCTTTGGAGAGCATTACCCTGCCAAACCACCTCGTGTCA
GGTTTACTTCCGAGATATTTCACCCCAATGTGTACAATGATGGCACCTTATGCATGGACATTATACAAGATGCTTGGTC
TCCTTGCCACAACATCTGTACAATTCTAACATCTGTTCAGTCATTGCTAACAGATCCGAATCCCGCAAGCCCAGCTAAC
TCGGAAGCTGCACATTTATATCAAACTGATATTCAAGCATATAACAGGCGAGTTCGGCGTTGTGTGAGGAAGTCTTTgg
AAAGCACATAGTATACTTTGCTTTgCTTGTt > SEQ ID NO:4764 104065FL 1106278_301498_1d
GTGTAGTCATGTCTTCGAAGCGGATTCTGAAGGAGCTGAAAGACTTGCAAAGGGATCCACCAACCTCATGCAGCGCAGG
ACCTGTTGGGGAGGATCTTTTTCATTGGCAAGCAACAATCATAGGGCCTGATGATAGTCCTTATGTTGGTGGGGTGTTC
ATGGTCACGGTTCATTTTCCCCAGGACTATCCCTTCAAGCCTCCCAAGGTTGCTTTCAGGACAAAAGTATTTCACCCAA
ATGTGAGCAGCAATGGGAGCATTTGCCTAGATATCTTAAAAGAGCAATGGAGTCCAGCTCTTACAATATCGAAGGTCTT
GCTTTCGATTTCTTCACTTCTTACGGATCCGAACCCTGATGATCCCTTGGTTCCGGAGATTGCCCACATGTACAAGACC
AACACGGCCAAGTATGAAGCCACGGCCAGGAGTTGGACACAAAAGTATGCCATGGGGTGAGAGGCTTTTCCTTTGAAAG
AGAAAATGGCCTTTATATATTGTTTATGTTTAAAACCTCCGTTCAAACCTTGTATTTTTTTCTCAAAATGCTACTTTT
T > SEQ ID NO:4765 104065FL 1105885_301496_1d
GAGAGAAGAATGTCAGGAGGCATGCTCGAGGTCGACTTGCTGAGGAGAGGAAAGCTTGGCGTAAAAGCCATCCCTTTGG
ATTCGTGGCGAGACCGGATAGCAAACCCGATGGATCCATTGATCTCATGGTCTGGCGATGCATGATTCCTGGAAAACCT
GGTACTGATTGGGATTCTGCCCTTTTTCCTTTAACAATCTACTTCACTGAAGACTATCCTAGTAAGCCACCAAAGTGCA
AATTTCCTGAAGGTTTTTTCCATCCCAACGTTTATCCTTCTGGAACAGTTTGCCTCTCTATTCTCAATGAGGATTTGGA
TTGGAGACCAGCTATTACGGTGAAACAAATACTGATTGGAATTCAAGAGCTTTTAGATGAACCGAATCCCAACAGTCCT
GCTCAAGAAGATGCTTACAGACTATTTGTTCAGGATCCTGCGCAGTACAAGATTCGAGTGAAACAACAGTCTAAACAGT
ATCCTCCGACCTTGTAATTGTACTCAACTTTCAAAGTATATACATTTGCTATCGAATTGAAAATACTTTGAAAATAGTT
CTGGATTTGTTGAGATTATGCAACTCATATATATTATATATATATATTAATCAAGGAAGATAGCCT > SEQ ID NO:4766 104765FL 104766_300367_1d
TCGCCCACTATAATCTCACCTAAGCAGTACAAAAAGAGGTGTCGCAAGGCCATGACCACCTATTTTCTCATGGTCCCAG

FIG. 2 continued

```
ATCAATGGTCACCACCGTCTATCATTCCCAGTAAATCACAGACTGATTTATGTGAAGAGAACATGCAAGATGGATGATC
TGCCAAGTGATTTTGTACATCTGTTCGTATATTGAGCACATATTTGGGTTTCTCGCATTGGTTATCCCAGGTTCATACA
TCTCCCATATTTTCGATTCCCATTCTTTTGGAACGCAGTTCCGGTTGCATTCTCCCTAAAGTGGGAGAACACATGATTT
CTTGTCAGAGCACTTGGTAAGAGGTTTGTATTTCAGTGAAAGTCTCCATTGCACAGAATATAGGTGGCTCTCCGTGGAA
ATATTTTTGTAAATCTTTTTCTTTTAATTACAATTTTCTTTGGGTGTAAAATCCAAGGTATACATGAGTTCCGAAGGAT
CATTGGCAATTTTATACAATGCATGATTTTGGAGCAATTTAGCTGGTGTAGTTTCAAGTGTATCGCGATTCTTTCCTCT
GTAATTTTTGTAATTGTGATTTTGAAAGGTGAATCTTCTTACCTTTA

> SEQ ID NO:4767 105352FL 109190_300043_1d
GGGTTTTTTTTTTTTTTTTTTTTTTTTTTTTTTTTTTTTGGGAAACGGGAAATTTTAATTCACTTCTTTCCAAAA
AACTTTGGAAATACAGACCCCCAAGAAACATCCCGGGAACAATTTGGGGGGCAAAACGGGGACGGTACCGGGAACCAAA
GTAAACCATAACGGAACTTCAACCAAACGGAAAACCATAAATTTCAAACAAAAAAATAAATTTAAGGGGACGGGAAATT
TAACTCCTCCAGTTTCCTTAAAAACCACCACCGAAACCACCTTTACGAAGACCACCTCCATAACCGCCGCCACCACCAT
AACCTCCGCCGTTACCGGGAAACTGAGCTTTGTTGACGGGGATGTTACGGCCGTAAAGGGCTTGACCGTTCATCCCTTC
AATAGCGGCCCTAAGGGATTTCTCATCCTGGAAGGGAACAAATCCAAATCCTTTAAATCTACCAGTT

> SEQ ID NO:4768 105352FL 251492_301657_1d
GTTCCGGATCTCTGCCCCAAAACTTGTCTTGGCCATGGCGGCAGTGGATGAATACCGATGCTTCGTTGGCGGCCTGTCG
TGGTCGACCACGGACAGCAACTTGGAAGACGCATTCCGGCCGTATGGCACCGTGATCGAAGCCAAGGTGGTGCTTGACA
GGGACACCGAAAAATCACGCGGCTTTGGCTTCGTGACTTTCGAGGACGAGACTTCGATGCAAGATGCGATCGATAGCAT
GCACGGCAAGGATCTTGATGGCCGCTCCATCACCGTGAGCAAAGCTCAGCCAAAGTCCGGAGGTGGAGGCCGAGATGGT
GGCCGTGACCGAGATGGAGGCCGAGACGGGGGCCGAGATGGAGGATATGGAAGGCGCGGTGGCGGCGGCGGCGGCGGCG
GCGGCGGAGGTGGAGGTGCAGGCGGAGGTGGCGGTGGTGGCTGCTTCAAGTGTGGCGAGAATGGTCACTGGgctagagA
CTGTACCAGCAGcGgcggCGGTGGCGGTGACAagtatgggagcCGAGGTGGTGACCGacgTggaagtggacGcTAcggC > SEQ ID NO:4769 105352FL 139067_300406_1d
CCCCTGGTGGTCTCTCAGAGGTGGGTTGGCTTCTCCTCCCCCTCCCGGTTCGGTTCGGGTCCGGTTCGATTTCGGTTTT
TTCTTCGGTTCGGGGGTTGGTGGGAAAGCATGGCGGCGCCGGATGTTGAGTACCGCTGCTTCGTCGGCGGCCTCGCCTG
GGCCACCGACGACCGCTCCCTCGAAGCCGCCTTCTCCACCTACGGCGAGATCCTCGAGTCCAAGGTCCGATGGATTCCC
TCTTCTCTGTGTTTTTTTGATGCGATTTGGTGGTGGTGTTCGTCAGATCTGGTTGCGTAGATCTGACTATGGGGGTTG
TGGTATGCGGTGCAGATCATCAACGATCGGGAGACGGGGAGGTCGCGCGGGTTCGGGTTCGTGACGTTCTCGAGCGAGC
AGGCCATGCGCGACGCCATCGAGGGGATGAACGGCAAGGAGCTCGACGGCCGCAACATCACCGTTAACGAGGCCCAGTC
GCGCCGCTCCGGAGGCGGAGGCGGCGGTGGCTACGGCCAGCGCGGCGGAGGCGGAGGCTACGGTGGCGGCGGCTACGGT
GGTGGTGGCGGCGGCGGTGGCTACGGCCAGCGCCGTGAaggcggctacggCGGtggcggtGGCTAcggtggcGgccgtg
gTGGcg > SEQ ID NO:4770 105352FL 137967_300687_1d
CCCGCTCGTGCTCTCTTTGAGGTGGGTTGGCTTCTCCTCCCCCTCTTTACCTTTTCCTCCTCGGTTCGGTTCCGTGGTT
CGTCTAGGGTTTAGTGGGTTGAGATGGCGGCGCCGGATGTCGAGTACCGCTGCTTCGTCGGCGGCCTCGCCTGGGCCAC
CGACGACCGCTCCCTCGAGGCCGCCTTCTCCACCTACGGCGAGATCCTCGACTCCAAGATCATCAACGACAGGGAGACG
GGGAGGTCACGTGGGTTTGGCTTCGTCACCTTCTCCTCCGAGCAGTCGATGCGCGACGCCATCGAGGGCATGAACGGCA
AGGAGCTCGACGGCCGCAACATCACCGTCAATGAGGCCCAGTCCCGCCGCTCCGGCGGCGGAGGCGGGGGCTACGGCGG
CGGCGGTGGCGGCTACGGCGGCGGTCGTGGAGGCGGCGGCTACGGAGGAGGTGGCGGCGGCGGCTACGGCGCCGTGAG
GGCGGCTACGGTGGCGGCGGCGGCTACGCGGCGGCCGTGGCGGCGGCGGCGGCTACGGTGGCAGCCGTGGCGGCG
GCTACGGCGGCGACTCCGGCGGGAACTGGAGGAACTGATTGGTGGGGCCCATCGTGGCCAGTTATCCTTAGCTATCCGT
GTCAGAATCATCTTATCATCGAGTCGAGTCGTTATCGTGTCCAGTGGCTCTCTCgagtcGAGAAGCCCTCTAtCCAtcC
AtccagtGttaGGTGTTCTTCGTCCg > SEQ ID NO:4771 105352FL 124532_301024_1d
acgcgtcgcgctcctcatttgtttctctctccttaaaccctcaaaacctttctttcctcagatttgtcaatttatctgc
gCAAATGGCTTTCTACAACAAACTCGGTGGTCTTTTGAGGCAGAGCATTTCTGGTAATGCAGTAAGTGCAACATCACCA
ATGCCTTCAATGCTTGATGCCGTCCGGTGCATGTCAACCAAGCTTTTCATTGGTGGTCTTTCATGGGGAACTGATGATC
AGTCGCTCAGAGACGCCTTTGCTACCTTTGGTGATGTTGTTGATGCTAGGGTAATTGTTGACAGAGATTCTGGCAGATC
AAGGGGATTTGGATTTGTGAACTTCTCAGATGATGAAAGTGCCAATGAGGCTATTAAAGCAATGGATGGTCAGGAACTC
CAGGGAAGGAATATTCGTGTTAGTATTGCCCAAGAGAGAGCTCCTCGAAGCGGAGGTTTTGGCGGTTCCGGTGGATTTG
GTGGTGGCTATGGTCAAGCTAGAGATAATGATGGATACTAAGTCACTTTGATTTTTTCTAAGCTGTCAATGTGTGCATG
ATAACGTTTATCTAAGAAGAGGACTTTGGCGGAAGATAGCTTTGTTGAGTTTATCTATATTAAGaCTTCTTTTCGTGca
aggttTTAGTATCAATAATTTTTCCTGATTTATGGCTAGC
```

FIG. 2 continued

> SEQ ID NO:4772 105352FL 120785_300516_1d
GGTGCTCTCTTTGAGGTGGGTTGGCTTCTCCTCCCCCTCTTTACCTTTTCCTCCTCCTCGGTTCGGTTCCGTGGTTCGT
CTAGGGTTTAGTGGGTTGAGATGGCGGCGCCGGATGTCGAGTACCGCTGCTTCGTCGGCGGCCTCGCCTGGGCCACCGA
CGACCGCTCCCTCGAGGCCGCCTTCTCCACCTACGGCGAGATCCTCGACTCCAAGATCATCAACGACAGGGAGACGGGG
AGGTCACGTGGGTTTGGCTTCGTCACCTTCTCCTCCGAGCAGTCGATGCGCGACGCCATCGAGGGCATGAACGGCAAGG
AGCTCGACGGCCGCAACATCACCGTCAACGAGGCCCAGTCCCGCCGCTCCGGCGGCGGCGGCGGAGGCGGGGGCTACGG
CGGCGGCGGTGGCGGCTACGGCGGCGGTCGTGGAGGCGGCCGGCTACGGAGGAGGTGGCGGCGGCGGCTACGGCGCCGT
GAGGGCGGCTACGGTGGCGGCGGCGGCTACGGCGGCGGCCGTGGCGGCGGCGGCGGCTACGGTGGCAGCCGTGGCGGCG
GCTACGGCGGCGACTCCGGCGGGAACTGGAGGAACTGATTGGTGGGGCCCATCgtggc > SEQ ID NO:4773 105352FL 119921_300361_1d
cgagtatagtaaaatggctgctgaaggagAATACAGTTGTTTCGTCGGTGGGCTCGCATGGGCAACCACCGACAGAACC
TTAGCTGACGCATTCGGTACATACGGCGAAGTTCTCGACTCGAAGGTCCGTTTGCGCAGAGCAGAAATTGAATCCGGGC
CCATTTTTTGGCTTTGTTGATGATCTTCTGTTACTGATTACTGTTTATTACTCTCTGGTTTACTTGATTCATCTGTTAC
TGTTACTGTTATTACTGTTATACCCTTGAAACGGTACGTTCCGTCTTTTTTCTCTTTTTGTCAAGAGATGAAGATAGAT
CGATTAATTATTTTGCTTGTAAACGTTGTAGATATGTTAGATCTGAGATTTTTTTTGTTTTATTTTTATTTTTTTCAGA
TCATTAACGACAGAGAAACTGGCAGATCTAGAGGATTTGGCTTTGTTACCTTTAAGGATGAGAAATGCATGAGGGATGC
TATCGAAGGGATGAACGGTCAGGAACTTGACGGCCGTAACATTACCGTTAACGAAGCTCAAGCTCGTGGAAGTGGAGGC
GGCGGCGGTGGTGGTTACGGAgGTGgCCGACGtgaAggaggaggCGGTGGTtacggAGgtggtgGTGGTggttAcGgt > SEQ ID NO:4774 105352FL 1187687_302188_1d
tcttctTATCATCCTCATCACCATCACTATCGACGTTATCGTCATCTTCAACGTCATCCTCGTCGCCATCCTCGACGCT
GTGTATCCTGCGTCGTCGCATCGTCGTCGTCACCATGAGTGTGGGTGGTGGAGCCGACGGGGAATATAGATGCTTCG
TAGGAGGGCTCGCTTGGGCTACCGATGACCGTGCCCTTCAAGCTGCCTTCCGTCAGTTTGGCGAAGTTGTCGAATCCAA
GGTGATTAGTGATCGCGAAACTGGTCGATCTCGAGGGTTTGGATTTGTTACGTTTGGTGAGGAGAAAGCGATGAGGGAT
GCGATAGAATGCATGAATGGGAAGGATTTGGATGGGAGGAGCATCACGGTCAACCAGGCCCAAAGCCGCTCATCAGGCG
GTGGCGGGGGCCGCGGTGGCTTTCGTCGTCCAGAAGGTGGGAGGTTTGGAAATGGGGGATATAATGAGGAGAGGAGAGG
CTATGGTGGTAGAGGAGGAGGAGGTAGCTATGGGGGTAAAGAGCGTGGCTATGGTGGTGGAGGTGCTCGTACAACCTAC
TCTGTTGGAGGAGGTGGCGGTGGTAAATATGGAGGACCCCTTGAccAAGGAAATtggCGAAAGTGaattaggaTagaTG
GatagatAGATAGATAGATATATAGaTa > SEQ ID NO:4775 105352FL 1178309_302127_1d
GGGTGTTGTTGTTTAGTTCGGGTTTCCTGTTTCGTTCTTTGTGGGCCGTGGATCTAGCGGAAGACACCCCGCCGTTCTC
GAGCTTCGAACAGCCGACGTTGCCTAGCTGGGATACATGGCGGCAGTGGAGTATTCCTGTTTCGTCGGAGGCCTGGCAT
GGGCCACCGACGACCGCAGCCTCGAGACCGCCTTCCGCCCCTTCGGAAATGTCACAGACTCCAAGATTATCAATGATCG
TGAAACTGGAAGGTCTCGTGGCTTTGGGTTTGTTACCTTCTCTGAGGAGCAATCCATGCTGGATGCGATAGAGGGTATG
AATGGGAAGGAGCTCGATGGAAGAAACATTACTGTAAACCAAGCTCAGAGCCGTGGTTCTGGAGGTGGAGGTGGTGGTG
GCGGTGGTGGATTCCGCAGATCTGAAGGTGGCCGATCAGGAGGAGGAGGGGGATATGGAGGAGGAGGGTATGGAGGAGG
AGGAGGGTATGGAGGAAGTGGTGGCTATGGGCAGTCTGGTGGTGgaggtgGatataatgGTgGTGGtg > SEQ ID NO:4776 105352FL 1116904_301816_1d
GACGGCACAATAGTGTAAAGCCCAGTAGCATCTTCTTCAATGGCGCTAGCTTCTCGGTTCGGTTCGCTCCTCCGTCGTC
TGGGGGCACCGTCCTCTGCTTCGAACCAGGGATCAGCAGCACTTGCGGTAACCTCTCCTTTCTCGCAGGTCCTCTCCAG
GGGTTTCTGCGATGCGGCCGATGCCTCCCCCAAGCTTTTCATTGGCGGACTGGCATGGATTACTGATGATTCTTCTTTG
AGGGATGCCTTTTCCTCTTTTGGTGTTGTTACTGATGCCCGTGTTATAACAGATCGTGAGACTGGCAGATCTAGGGGTT
TTGGATTTGTTACCTTCTCTACTACTTCTGAGGCTGAGAGTGCCCTTAACTCAATGAATGGCCGGGATCTGAATGGGAG
AGCAATCAGAGTCAACTTTGCAACAGAAAGGCCGTCTGGTGGTATGGGTATGGGCAGGTTTGGAGGTGGATGGGGGGGC
TCTGGTGGAGGCGGCGGCGGTTTTGGTGGAGGGAATCGCGACGGCGGTGGTTTTGGTGGCGGTGGTGGTGGCGGTGGTT
TTGGTAATGGTAGTGGTGGTTATGGTGGTGGTGATGACCTC > SEQ ID NO:4777 105352FL 1110445_301789_1d
TAGTTTAGTTGTAAGTAGTATTTTCTAGGTCTAGAGTTCGAGGATGGCTGGCGGCGTCGAGTACCGTTGCTTTGTTGGA
GGCCTTTCTTGGAACACTGATGACCGAAGCCTTGAGACTGCCTTTAGCTCTTACGGCGAGGTTATCGACTCCAAGATCA
TAAACGACCGGGAAACCGGTAGGTCTCGTGGTTTTGGCTTTGTGACATTCGCCTTGGAGCAATCCATGTTCGATGCCAT
CGAGGGGATGAACGGGAAGGAGCTTGACGGCCGAAGCATTACAGTGAACCAGGCCCAGGATCGTTCCAGTGGAGGTGGC
GGTGGCGGCGGCGGTGGGGGTTACAGATCAGGGCGTTCTGGTGGAGGTGGAGGAGGGTATGATGGTGAGCGAAGAAGCT
ATGGCGGAGGGGGCCGGTCTgttggcggCGGTGGATAtggtggtagTGGtggtGGTGGTggttaTGgAg

FIG. 2 continued

> SEQ ID NO:4778 105352FL 46978_300175_1d
CAGCTTCTCCTCTTCTCAGAAATTAGGGTTCCGTCTCAAATTACGAGCAGATCTCGTACTCTCTGAAGATGTCTGAAGA
TCCGGAGTACCGTTGCTTCATTGGTGGGCTTGCTTGGACAACGTCTGATCGTGGTCTCAGAGATGCCTTTGAGAAGTAT
GGTCACCTCGTTGAGGCCAAGGTGGTTCTTGACAAGTTTTCTGGTCGCTCCCGTGGTTTTGGATTCATCACTTTCGATG
AGAAAAAAGCTATGGATGAAGCTATTGCAGCAATGAATGGAATGGATTTGGATGGGCGAACTATCACTGTTGATAAAGC
TC

> SEQ ID NO:4779 105352FL 284977_200102_1d
GAAAAAAATGGCAGAAGGTGAATACAGGTGCTTCGTCGGTGGGTTAGCATGGGCTACTACCGACCAAACACTTGGGGAG
GCTTTTTCTCAGTTCGGCGAAATTCTTGACTCGAAGGTCTGTGGCAAAACAGAGCAGAGATCGGATTCGAGCCGATTTG
AATCGGCTTCGTTGACCCTCTGTTACTGGAAAAATTGATCTGTTACTACTCTCTCTGTTACTGTTACTACTCTCTGGTT
TATCTGTTACTGTTACTATTTGATACTAATATTCCACTTTCCCCGAAACGATTATCAATGACAGAGAAACTGGTCGATC
TAGAGGGTTTGGATTTGTTACATTCAAGGACGAGAAATCTATGAGGGACGCTATTGAAGGGATGAACGGCCAGGACCTT
GACGGTCGTAACATCACCGTCAACGAAGCTCAGTCTCGCGGAAGCGGTGGAGGCGGTGGCGGTTACCGTGGTGGTGGCG
GTGGAGGCTACGGAGGCGGTGGCCGTCGTGAAGGTGGTTATGGCGGCGGTGGTGGTTACGGAGGTGGCCGTCGTGAAGG
TGGTTATGGCGGCGGTGGCGGCTATGGAGGTGGCCGCCGTGAaggTGGTTACGGTGGTGGCTCGAAggAAACTggAgg
AGTTAGaTtTtccggttccTttagattTAATTTTTTgttTGAATTTTATG > SEQ ID NO:4780 105352FL 280167_200066_1d
tctgtatctgcattgagaagtGGCTTAAACCCTAGCCGCTCCTCATTTGTTTCTCTCTCTCCTTAAACCCTCAAAGATT
CTCCTTCCTCAGATTTGTCAATTTATCTGTACAAATGGCTTTCTACAACAAACTCGGTGGTCTTTTGAGGCAGAACATT
TCTGGAAATGCAGTAAGTGCAACAACACCAATGCCGTCAATGCTTGATGCCTTCCGGTGCATGTCGACAAAGCTTTTCG
TTGGTGGTCTTTCATGGGGAACTGATGATCAGTCACTGAGAGATGCCTTTGCTACCTTTGGTGATGTTGTTGATGCAAG
GGTAATCGTTGACAGAGATTCTGGCAGATCAGGGGATTTGGATTTGTGAACTTCTCAGATGATGAAAGTGCCAATGAG
GCTATTAAAGCAATGGATGGTCAGGAACTCCAAGGAAGGAATATTCGTGTGTTAGTATTGCCCAAGAGAGAGCTCCTCGAA
GTGGTGGTTTTGGTGGCTCTGGTGGTGGATTTGGTGGCGGCTATGGTCAAGCTAGAGACAATGATGGATACTAAGTCAC
TTTTATTTTTGATAAGCTGTCAATGTGTGCATGATAACTTTTATCTAAGTAGAGGACTTTGGTGGGATAGCTTTGTTGA
GTTTATCTATATTAAGACTTCTTTTCGTGCAAGGTTTTGGTATCAATAATTTTTCCTGATTTATGGGTAAAaa > SEQ ID NO:4781 105352FL 279985_200222_1d
GTTGTTTCGTCGGTGGGCTCGCATGGGCAACCACCGACAGAACCTTAGCTGACGCATTCGGTACATACCGCGAAGTTCT
CGACTCGAAGATCATTAACGACAGAGAAACTGGCAGATCTAGAGGATTTGGCTTTGTTACCTTTAAGGATGAGAAATGC
ATGAGGGATGCTATCGAAGGGATGAACGGTCAGGAACTTGACGGCCGTAACATTACCGTTAACGAAGCTCAAGCTCGTG
GAAGTGGAGGCGGCGGCGGTGGTGGTTACGGAGGTGGCCGACGTGAAGGAGGAGGCGGTGGTTACGGAGGTGGTGGTGG
TGGTTACGGTGGTAGCCGACGTGATGGAGGCGGCGGCGGTTACGGAGGAGGCCGACGTGAAGGAGGAGGCGGTGGTTAC
GGAGGTGGTGGTGGTtatGGCGGTGGTGGACGTTATTAGTTTCAATGTACTTAATTTTGGCCCATTGTTAAATTGGCCT
TTAGATTAGTATCCATTACTGTTTTAGTGTGgttGGTGTTATTGTcCTTTATATATTTGGttAAGATACTGTGAATCTG
TATTTTACAAAGTTCCATGGAATCTAGTaaATGATGgtttACGa > SEQ ID NO:4782 105352FL 272607_200131_1d
TTTTTTAGGGTTTCTTCTTATTAATCAGAAAAAAATGGCAGAAGGTGAATACAGGTGCTTCGTCGGTGGGTTAGCATGG
GCTACTACCGACCAAACACTTGGGGAGGCTTTTTCTCAGTTCGGCGAAATTCTTGACTCGAAGGTCTGTGGCAAAACAG
AGCAGAGATCGGATTCGAGCCGATTTGAATCGGCTTCGTTGACCCTCTGTTACTGGAAAAATTGATCTGTTACTACTCT
CTCTGTTACTGTTACTACTCTCTGGTTTATCTGTTACTGTTACTATTTGATACTAATATTCCACTTTCCCCGAAACGGT
ACGTTCCGTCTTCCTCTGTTTATACAAGAGATGAAGATAGATCGATTTTATGTTTCTCCCCTATTTTTTTTGATTTTTG
ATTTTATGGATTTTCCCCATTTTGGATGTTACGTTGTAGATCCGTTTAGATCTGATGTGGTTTTTATGATATTTGAAAA
TTTCAGATTATCAATGACAGAGAAACTGGTCGATCTAGAggGTTTGGATTTGTtACATTCAAGgACGAGaAATCTATGa
gggACGCTATTGaaggGATGAACggccaggaccttgacggTCGTAaCATCACCGTCaacgaagctcaatctCGcggaag
cggTgGAggCGGTGGCggttaccgtGgTGGTggcggtGG > SEQ ID NO:4783 105352FL 272162_200041_1d
aaactttctctccatctcttcgtagccgcctccctctcatctcCGAATCTTCATTATTTTCAAAGTAGCAGCGGTCTGTT
TCAGAAATGGCGGATGATGAATATCGCTGTTTTATTGGTAATTTGTCATGGTCAACTTCTGATCGAGGATTAAAAGATG
CATTTGAGAAGTTTGGAAATCTTCTTGTTGATGCAAAGGTTGTACTTGACAAGCTCTCTGGCCGATCTCGTGGATTTGGTTT
TGTTACATTTGATGAAAAGAGAGCAATGGAAGATGCCATTGAAGCAATGAATGGAGTGGACTTAGATGGTCGTGATATT
ACTGTAGACAAAGCCCAGCCTGACAAAGGTTCAGGTAGAGATTTTGATAGTGATCGACCTCGTGACCGAGATCGGGGTC
GCGATCGTGATCGCGGTAGCCGTGATTATGGAGGTGGACGGGGATCTGGTGGTGGTGGAGACTGCTTTAACTGTGGTAA

FIG. 2 continued

GCCAGGACACTTTGCCAgAGAATGCCCTAATGAAggGGGTAGAGGTGGTCGGTATGGTGGCggaggtGGTGGTAGTAGA
aGCAGTGGCTATGGACCTGATAggaacggaGATCGATATGGAAGCCgcagcggCa > SEQ ID NO:4784 105352FL_271938_200039_1d
TTTACTTCGTTTTTAGGGTTTCTTCTTATTCTTATTAATCAGAAAAGAATGGCAGAAGTTGAATACAGGTGCTTCGTCG
GTGGGCTAGCATGGGCTACCACCGACCAAACACTTGGGGATGCTTTTTCTCAGTTCGGCGAAATTCTCGACTCGAAGAT
CATCAATGACAGAGAAACTGGTAGATCTAGAGGATTTGGATTTGTTACCTTCAAGGATGAGAAATCCATGAGGGACGCT
ATTGAAGGGATGAACGGTCAAGACCTTGACGGCCGTAACATCACCGTCAACGAAGCTCAGTCTCGCGGTAGCGGCGGAG
GCGGTGGTGGTGGTGGCGGTTACCGTGGTGGTGGCGGTGGAGGCTACGGAGGTGGTGGCCGTCGTGAAGGTGGATACGG
TGGTGGTGGTGGTTACGGAGGTGGCCGACGTGAAGGTGGTTATGGTGGTGGCGGCGGTTATGGAGGTGGTCGTCGTGAA
GGTGGTTACGGTGGTGGTTCTGAAGGAAACTGGAGGAGTTAGATTTCCGTTGCCTTTAGATTTATTTTTTGTTTGAAA
TTTATGGTTCTACGTTTGGTTGAAGTTCCGTTATGGTTTACTTTGGTTCCTGTTACTGTCCTCGTTTTGACCGCGAGAT
TGTTACCGTGATGTTACTTGTGGATCTGTATTTACAAAGTTCTCTGGAATGAAGTGAATTAAGATTTACAGTCT > SEQ ID NO:4785 105352FL_255857_301645_1d
ACCCACGCGTCCGCGGACGCGTGCGGTTACAAGGGCCTCTTGCCCGGTCCGGTGTTCGATTCCCAGGTTTTCCGGCTCG
GTCTTGTTCGGTTCGTTTTTTCCGGTTCGCGTTTCGGATCTGAGGTATGTCGTCTGATGCGGAGTACCGCTGCTTCTTT
GGGGGGCTTAGCGTGGGTCACCGATGATCAAACCCTTCAGGAGGCTTTCAGTCGTTATGTGTTTTTGTTATAGACTCTA
AGGTGATTAGTGATCGGGAAACGGGGCGGTCTCGCGGGTTTGGCTTTGTCACCTTTGCAGATGAGCAGGCGATGATGGA
GGCCATTCAGGAGATGAATGGGAAGGAGCTAGATGGGCGGAATATAACCGTCAATCAAGCACAGAATCGCTC > SEQ ID NO:4786 105352FL_255783_301643_1d
CGGGGTTCGGAAACATGGGGTCTGAGTACCGTTGCTTCGTCGGGGGTCTGGCTTGGTCCACTAATGACCAGGCTTTGGA
ATCCGCTTTCAGTCAATTCGGAACTGTCATCGAATCGAAGGTTATCAATGACCGTGAGACTGGAAGGTCTCGTGGATTC
GGGTTTGTTACATTCGAGGATGAGCAAGCCATGAGGGATGCAATTGAAGGGATGAATGGAAAGGATCTAGATGGCAGGA
ACATTACTGTAAATCAGGCTCAGGACAGGTCATCAAGTGGTGGTGGTGGTGGCGGCTACCGAGGAGGTGGTGGTGGCGG
TGGAGGTTACCGTGGTGGTGGTGGTTACGGTGGCGGTGGCAGTGGATACCGCTCAGGTGGTGGTGGTGGATATGGTGGT
GGCGGCCAACGTAGGGATTCTGGGTACGGTGGAGAAGGTGGTGGCTACTCTGGCGGTGGGGGCTACGGTGGTGGTGGTG
GTGGATACGGTGGAAGTGGTGGTGGTGGTGGTAACAACAGGTGGAGGGACAATtAaccaacctaTCAAAGGATGTGtaa
ctAGCTatt > SEQ ID NO:4787 105352FL_255769_301643_1d
GTGGGCCGTGGATCTAGCGGAAGACACCCCGCCGTTCTCGAGCTTCGAACAGCCGACGTTGCCTAGCTGGGATACATGG
CGGCAGTGGAGTATTCCTGTTTCGTCGGAGGCCTGGCATGGGCCACCGACGACCGCAGCCTCGAGACCGCCTTCCGCCC
CTTCGGAAATGTCACAGACTCCAAGATTATCAATGATCGTGAAACTGGAAGGTCTCGTGGCTTTGGGTTTGTTACCTTC
TCTGAGGAGCAATCCATGCTGGATCGATAGAGGGTATGAATGGGAAGGAGCTCGATGGAAGAAACATTACTGTAAACC
AAGCTCAGAGCCGTGGTTCTGGAGGTGGAGGTGGTGGTGGCGGTGGTGGATTCCGCAGATCTGAAGGTGGCCGATCAGG
AGGAGGAGGGGgATATGGAGGAGGAGGGTATGGAGGAgg > SEQ ID NO:4788 105352FL_255654_301644_1d
GTGTTCTGATACTGCAATGGCCGCTGCCGTAGAGTATCGCTGCTTCGTCGGAGGTCTGTCATGGGGCACAGACGACCGC
GCCCTCGAGCGCGCCCTTCAGCACCTTTGGGGAGGTCATCGATTCGAAGGTTGTTAACGATCGTGAATCGGGGAGATCTC
GTGGTTTCGGATTCGTGACATTCACTCAAGAACAGTCTATGCTTGACGCGATTGAGGGGATGAACGGGAAAGAGCTCGA
CGGGAGGAACATCACTGTGAATCAAGCACAAGAACGGAACTCCGGAGGTGGTGGAGGCGGGTTTCGAAGGTCCGAAGGC
CGTTACGGCGGGGCGGGGCGGATACGGCGGGGCGGTTACAGATCCGGCGGTGGAGGCAGTGGCGGATACGGCGGAG
GCAGCGGTGGCTATGGCGGTGGTGGCCAAAGAAGGGACTCCGGCGGCTACAACGGCGGAGGTGGTGGTGGCTATGGCGG
TGGAGGCCGCTACGAGTGAGAACGGATACCAGTCGGGATTCGAACTACCGGCCTCGctGCCAGTGGGAAATTAACTCTG
TCGGGTCTCGAACTCCCGACCGGTTTCTTTTTCCTGCCTTTTTCTTTGGAC > SEQ ID NO:4789 105352FL_254954_301640_1d
GTTCCGTCGGCAAGAGCTCTTGGCTCCTATAGTGGTCGTTCGGTTTTAGGGTTAAGGGTTTTGGTTTTCGGAAGGCTAA
CAACAATGGCGGAAGGGGAGTACCGATGCTTCGTGGGAGGTCTGGCCTGGGTTACAGATGATAGGGCTCTCGAAGATGC
CTTCCGGTCCTACGGGAGGGTCACTGATTCCAAGGTCATCAGTGACAGAGAGACCGGGCGCTCCCGCGGATTTGGATTC
GTGACGTTTGAAGACGAACAGTCGATGCTTGATGCGATCGAGGGGATGAATGGGAAGGAGCTTGACGGGCGGAGCATTA
CTGTGAACCAAGCGCAAAGCCGCTCAGGTGGAGGGGGTGGTGCCGGCGGTGGCTATCGCAGGTCTGAGGGTAGATACGG
GGGTGGGGGCGGAGGATATGATGGAGAGAGGAAAGGATACGAAGGAGGAGGGGGCAGATCTGGTGGCGGTTATGGGGGC
GGCGGTGGTGGGCAGAGGTACAGCTCTGGCTATGGCGAGGGTGACTACAATGCGGGAGGTGGTGGCGGTGGAAGCCGAT
GGAGGAATTGAGTAGTGCTTAAAAAGTTTTCACACATTTGTTCTATCCATCCTTTTAAAGTTCAGTTGGTTACTCTAAT

FIG. 2 continued

ATTATATATTGTTATCATTATTATATTTTAGTTTATCCTT

> SEQ ID NO:4790 105352FL 234440_301201_1d
AGAAGGGCAGCGAAGAAGATGAAAGAAGAGTATCGATGCTTCATCGGCGGCTTGGCCTGGAGCACCACCGATCGCGGCT
TGGAGACCGCTTTCGAGCCCTATGGATCCATCGTCGAAGCCAAGGTGGTGTATGATCGAGAACAGAGCCGGTCCCGGGG
CTTCGGCTTTGTGACCTTCGCGGACGAGGAGGCGATGGAAAACGCCATCCGGAAGATGCACAACCAGGAGCTGGACGGC
CGATCCATCACTGTCAGCAAGGCGCAGCCGAAAACTGGCGGCGGCGGCGGCGGCGGCGGCGGTGGCGGTGGCCGTGGAG
GAGACAGGGACCGGGACAGGGACAGGGACAGGGACAGGGACCGGGGTGGCGGCGGCTACGACCGCGGACATGGCGGAGC
TAGTGGCGACTGCTTCAACTGTGGAAACAAAGGCCACTGGGCTCGTGACTGTCCANAGAGCGGCGGCGGTGGTGGAAGA
GACCGCGGTGGTGGCCGAGACCGAGACAGGTATGGGAGTGATAGATACGGCAGTGACCGCGGTGACAGGTACGGTGGCG
GCGATGGTAACCGCGGCAGCGGC

> SEQ ID NO:4791 105352FL 233303_301089_1d
AAGAAATGGCCGAGGTCGATGTGGAGTACCgtggCTTCGTCGGCGGCCTCGCTTGGGCGACGGACGACATGAGCCTCGG
CAACGCATTCAAATCCTTCGGCGATGTCGTCGAATCCAAGGTACATATACAGTGAGTGACAAGGGCCGCTTGAATCTTT
GCTTTGCTGCCCAGCCGCCGCCCCGGATCGAGAGAATGCTGGCCAATTTACCCCAAGATCTCTCTCTCTTTCTTTGTAG
GTGATCAACGACCGCGAGACGGGCAGATCCCGCGGCTTTGGATTCGTCACTTTCCGGGACGAGAAATCCATGAACGACG
CCATCGAATCGATGAACGGCAAGGATCTGGATGGCCGCAACATCACCGTCCACCAGGCACAGCAAAGGCCGACCATGAC
CAGCCGCTATAGTGGATCTAACCAAGACCGTGGTGGCGACCGCGGCAACGGCGGCGGCTACAGTGACCGTGGTGGCGAC
CGTGGTAACGGTGGCGGCTACAGTGACCGTGGTGGGTATAACAGGCGGAATTCTGGCGGGGGCGGCGGCGGTGGCGGCG
TCGGTGGCGGCGTCGGTGGTGAGGCCGGCGGAGCTGGCGTTGGTGGCGGCGGCGGTCGCCGCTACGGCGGTGCCCGGTC
AGACGGTCGGTCCGATGTTGGTAACTGGAGAAGAAGCGAGTAGTAGCAGCAGCTCGACGGAGGACGGATCACGTCCAGAG
TAAACTTAATTGTCGTCCATCCAGACTTGTTATTGTCTAATTCCCCTGCtattgtgTTGTCATAcagCTAGTGAAATAC
GaaacttGTGGTttt > SEQ ID NO:4792 105352FL 229011_301039_1d
AAATGGCCGAGGTCGATGTGGAGTACCGttggttcGTCGGCGGCCTCGCTTGGGCGACGGACGACATGAGCCTCGGCAA
CGCATTCAAATCCTTCGGCGATGTCGTCGAATCCAAGGTGATCAACGACCGCGAGACGGGCAGATCCCGCGGCTTTGGA
TTCGTCACTTTCCGGGACGAGAAATCCATGAACGACGCCATCGAATCGATGAACGGCAAGGATCTGGATGGCCGCAACA
TCACCGTCCACCAGGCACAGCAAAGGCCGACCATGACCAGCCGCTATAGTGGATCTAACCAAGACCGCGGCGGCGACCG
TGGCAACGGCGGCGGCTACGGTGGTGCCCGGTCAGACGGTCGGTCCGATGTTGGTAACTGGAGAAGAAGCGAGTAGTAG
CAGCAGCTCGACGAGGACGGATCACGTCCAGAGTAAACTTAATTGTCGTCCATCCAGACTTGTTATTGTCTAATTCCCC
TGCTATTGTGTTGTCATACAGCTAGTGAAATACGAAACTTGTGGTTTTACCGctnanaaaaaaaaaaaa > SEQ ID NO:4793 105352FL 227520_301029_1d
CATCCGATTCGCCGCCGCCTTCGTCTTCCTCGCAGAGATGGCGGACGTGGAGGAGTACCGTTGCTTCATTGGGAATCTG
TCATGGTCCACAACTGATGAAAGCCTCAAGGATGCCTTTGGCAAATTTGGCAACCTCACTGAAGCAAAGGTGGTTTTTG
ACAAGTATTCTGGCCGTTCTCGTGGTTTTGGCTTTGTGACCTTTGATGAGAAGAAAGCCATGGAAGATGCTATTGAAGG
AATGAATGGATTGGATTTGGATGGGCGGGCGATCACTGTCGATAAAGCTCAGCCACAAGGACCTGGTAGAGACCGTAAT
GGAGACCGTGATTATGATCGTGACCGTGGATCTCGTTATGACCGTGGCCGTGACTTTGGTGGTGGTGGGCGTGCACCAC
GTGGCTCAGGTGGTGGTGGGGATTGCTACAAGTGTGGAAAACCTGGCCACTTTGCTAGAGAGTGCCCATCTGGAGATGG
TGGTGGTAGAGGTGATAGATATGGTGGCCGAGATGATAGGTACGGTGGTGGTGGTGGCGGTGGCGGCCGTTATGGATCT
GACCGTGGTGGTGACCGTTATTCTGGTCGTAGTCGAGATGGTGGTGGCTACG > SEQ ID NO:4794 105352FL 201132_300713_1d
cCCGGTGGTCTCTCAGAGGTGGGTTGGCTTCTCCTCCCCCTCCCGGTTCGGTTCGGTTCGGTTCGGGTCCGGTTCGATT
TCGGTTTTTCCTTCGGTTCGGGGGTTGGTGGGAAAGCATGGCGGCGCCGGATGTTGAGTACCGCTGCTTCGTCGGCGGC
CTCGCCTGGGCCACCGACGACCGCTCCCTCGAAGCCGCCTTCTCCACCTACGGCGAGATCCTCGAGTCCAAGATCATCA
ACGATCGGGAGACGGGGAGGTCGCGCGGGTTCGGGTTCGTGACGTTCTCGAGCGAGCAGGCCATGCGCGACGCCATCGA
GGGGATGAACGGCAAGGAGCTCGACGGCCGCAACATCACCGTCAACGAGGCCCAGTCGCGCCGCTCCGGAGGCGGAGGC
GGCGGTGGCTACGGCCAGCGCGGCGGAGGCGGAGCGCTACGGTGGCGGCGGCTACGGTGGCGGCGGCTACGGCGGCGGCT
ACGGCCAGCGCCGTGAAGGCGGCTACGGCGGCTGGCCGTGGCCTACGGTGGCGGCGGTGGCGGCGGCTACGGCGGCGG
CTACGGCGGCGGCTACGGCAGCCGCGGCGGCGGCAACTCCGACGGGAACTGGAGGAACTGAGCGGTGGGGCCCTCATGG
gcCAAGTTATCTATCTATCTAATCGAGCTACCATCATCATCATCCGATCGTTATCATCGTTAGTT > SEQ ID NO:4795 105352FL 187131_300674_1d
ACTAGACCTCCGAACCAAACCGAGGGCAAGAGCATCCGATTCGCCGCCGCCTTCGTCTTCCTCGCAGAGATGGCGGACG
TGGAGGAGTACCGTTGCTTCATTGGGAATCTGTCATGGTCCACAACTGATGAAAGCCTCAAGGATGCCTTTGGCAAATT

FIG. 2 continued

TGGCAACCTCACTGGAGCAAAGGTGGTTTTTGACAAGTATTCTGGCCGTTCTCGTGGTTTTGGCTTTGTGACCTTTGAT
GAGAAAAAAGCCATGGAAAATGCTATTGAAGGAATGAATGGATTGGATTTGGATGGGCGGGC

> SEQ ID NO:4796 105352FL 175162_300530_1d
GGTGGTCTCTCAGAGGTGGGTTGGCTTCTCCTCCCCCTCCCGGTTCGGTTCGGGTCCGGTTCGATTTCGGTTTTTTCTT
CGGTTCGGGGGTTGGTGGGAAAGCATGGCGGCGCCGGATGTTGAGTACCGCTGCTTCGTCGGCGGCCTCGCCTGGGCCA
CCGACGACCGCTCCCTCGAAGCCGCCTTCTCCACCTACGGCGAGATCCTCGAGTCCAAGATCATCAACGATCGGGAGAC
GGGGAGGTCGCGCGGGTTCGGGTTCGTGACGTTCTCGAGCGAGCAGGCCATGCGCGACGCCATCGAGGGGATGAACGGC
AAGGAGCTCGACGGCCGCAACATCACCGTTAACGAGGCCCAGTCGCGCCGCTCCGGAGGCGGAGGCGGCGGTGGCTACG
GCCAGCGCGGCGGAGGCGGAGGCTACGGTGGCGGCGGCTACGGTGGTGGTGGCGGCGGCGGTGGCTACGGCCAGCGCCG
TGAAGGCGGCTACGGCGGTGGCGGTGGCTACGGTGGCGGCCGTGGTGGCGGCAGCTACGGTGGTGGCTACGGCAGCCGC
GGCGGCGGCAACTCCGACGGGAACTGGAGGAACTGAGCGGTGGGGCCCTCATGGCCAAGTTATCTATCTATCTAATCGA
GCTACCATCATCATCATCCGATCGTTATCATCGttAGTTTTGTGTGGAACTATCTagtTTgt > SEQ ID NO:4797 105352FL 147049_200015_1d
CGTCCGATTCTCTTTAAAAATAAAAATATGGCAGCTGAGGTTGAGTCAGGTGCTTTGTAGGTGGGCTGGCATGGGCTAC
CACCGATAGAACTTTAGGAGATGCTTTTGCTCACTACGGCGAAGTTGTCGACTCGAAGATCATCAACGATCGTGAAACT
GGAAGATCAAGGGGATTTGGCTTTGTTACCTTCAGTGATGAGAAAGCTATGAGGGACGCAATTGAAGGAATGAACGGTC
AGAACCTTGACGGTCGTAACATCACCGTTAATGAAGCTCAATCACGCGGCAGCGGTGGTGGCGGCGGTGGTTTCGGAGG
TGGCAGACGCCGTGAGGGCGGATACAGTGGTGGTGGCGGATACGGTGGTGGTAGTGGCGGCTATGGAGGTGGCAGACGT
GAGGGTGGCTACAGCGGTGGTGGCGGCGGCTATGGTGGTTACGGAGGTGGCCGTAACCGTGGATATGGTGGCGGTT
ATGGTGGTGGTGGTGGTGATGGTGGGTCCCGCTACTCAAGAGGTGGCGGTGCATCCGAGGGAAGCTGGAGGAATTAATA
ATTTTGATTTTTTAAAAAAAAATGGTGATTATGCTTCTGGGTTGGGTAAGAGTCTATTTTTGTTACT > SEQ ID NO:4798 105352FL 142833_300444_1d
gcgtccgttcTTTTTTAGGGTTTCTTCTTATTAATCAGAAAAAAATGGCAGAAGGTGAATACAGGTGCTTCGTCGGTGG
GTTAGCATGGGCTACTACCGACCAAACACTTGGGGAGGCTTTTTCTCAGTTCGGCGAAATTCTTGACTCGAAGATTATC
AATGACAGAGAAACTGGTCGATCTAGAGGGTTTGGATTTGTTACATTCAAGGACGAGAAATCTATGAGGGACGCTATTG
AAGGGATGAACGGCCAGGACCTTGACGGTCGTAACATCACCGTCAACGAAGCTCAGTCTCGCGGAAGCGGTGGAGGCGG
TGGCGGTTACCGTGGTGGTGGCGGTGGAGGCTACGGAGGCGGTGGCCGTCGTGAAGGTGGTTATGGCGGCGGTGGTGGT
TACGGAGGTGGCCGTCGTGAAGGTGGTTATGGCGGCGGTGGCGGCTATGGAGGTGGCCGCCGTGAAGGTGGTTACGGTG
GTGGCTCTGAAGGAAACTGGAGGAGTTAGATTTTCCGGTTCCTTTAGATTTAATTTTTTGTTTGAATTTTATGGTTCTA
AGTTTGGTTGAAGTTCCGTTATGGTTTACTGTGGTTCCTGTTACTGTTCTTGTTTTTGACCGCGAGATTGTTACCGTGA
TGTTACCTAGTGGATCTGTATTTACAAAGTTCTCTGGAATCAAGTGAATTAaGATTTACAgTCt > SEQ ID NO:4799 105352FL 142627_300500_1d
TTTTCCATCTCTCTTATAAATTAAAAAAATCAATGGCTGAAGTTGAATACCGGTGCTTCGTCGGTGGGCTCGCATGGGCT
ACCACTGATCGAACCCTAGGCGAAGCTTTCTCTCAGTAGGCGAGGTGCTTGAATCGAAGGTCCGTTTGTCGGTCGCAG
AGCAGAGATCGGAATCCGAGCCCTGCTTTGGCTTCGTTTACCCCTCTGTTACTGTTGATTCATCTGTTACTGTTACTAT
GTCTCTATCTGTTACTGTTGATTCATCTGTTACTGTTACTATTTGATACTATTATTCGTTCTCTCTAACGATCATCAAC
GACCGTGAAACCGGTAGATCTAGAGGATTTGGCTTTGTTACTTTTGGCGATGAGAAATCCATGAGGGACGCTATCGAAG
GGATGAACGGCCAAGACCTTGATGGTCGTAACATAACCGTTAACGAAGCTCAATCACGCGGAAGCGGTGGAGGCGGCGG
CGGCGGCGGTGGTTTCCGCGGTGGACGTCGTGAGGGAGGCCGGCGGATACGGAGGGGGAGGATATGGAGGTGGAAGACGC
GAGGGCGGCGGCGGCGGTTACGGCGGAGGCGGCGGCGGTTATGGCGGTGGCCGTGACCGTGGATATGGCGGTGGTGGTG
ACCGTGGATACGGTGGTGATGGAGGATCACGCTACTCAAGGGGTGGTGGTGACTCTGATGGAAACTGGAGGAATTAGAT
AATTGAGAAGATGTGGATTTTAGTTATTTTGATCGCAGTTTAAGTTGGTTATATCTTAATGTTAGTGTGACTCTTTTTT
GACCGTTATTTGGCTCGTTACGTTACTGTGTTTTTCTATTAACTGAGTTCTTATGGAATGAATTAAATTAAGgTCTACA
AATTAAATCTTTCTTTTGCAT > SEQ ID NO:4800 105352FL 109268_300044_1d
cggacgcgtgggtttcattagggtttaacctcttctctagtatctcagtatagtaaaatgactgctgaagtAGAATACA
GTTGTTTCGTCGGTGGGCTCGCATGGGCAACCACCGACAGAACCTTAGCTGACGCATTCGGTACATACGGCGAAGTTCT
CGACTCGAAGGTCCGTTTGCGCAGAGCAGAAATTGAATCCGGGCCCATTTTTTGGCTTTGTTGATGATCTTCTGTTACT
GATTACTGTTTATTACTCTCTGGTTTACTTGATTCATCGTTACTGTTACTgttATTACTgttATACCCTTGAAACGAT
CATTAACGACAGAGAAACTGGCAGATCTAGAGGATTTGGCTTTGTTACCTTTAAGGATGAGAAATGCATGAGGGATGCT
ATCGAaggGATGAACGGTCAggaaCTTGACGgccgTAACATTACCgttAACGAAGCTCAAGCTCGTGgAagtGgaggcG
GCGGCGGTGGTGg

FIG. 2 continued

> SEQ ID NO:4801 105352FL 1106211_301498_1d
gcGAAGGGGTTTCAGCTGCTCCTTCTCAGTTCCGGTTCGTTTCTTGGTCTGTTTTTTGTGTTCTGATACTGCAATGGCC
GCTGCCGTAGAGTATCGCTGCTTCGTCGGAGGTCTGTCATGGGGCACAGACGACCGCGCCCTCGAGCGCGCCTTCAGCA
CCTTTGGGGAGGTCATCGATTCGAAGGTTGTTAACGATCGTGAATCGGGGAGATCTCGTGGGTTCGGATTCGTGACATT
CACTCAAGAACAGTCTATGCTTGACGCGATTGAGGGGATGAACGGGAAAGAGCTCGACGGGAGGAACATCACTGTGAAT
CAAGCACAAGAACGGAACTCCGGAGGTGGTGGAGGCGGGTTTCGAAGGTCCGAAGGCCGTTACGGCGGGGGCGGGGGCG
GATACGGCGGGGGCGGTTACAGATCCGGCGGTGGAGGCAGTGGCGGATACGGCGGAGGCAGCGGTGGCTATGGCGGTGG
TGGCCAAAGAAGGGACTCCGGCGGCTACAACGGCGGAGGTGGTGGCTATGGCGGTGGAGGCCGCTACGAGTGAGAA
CGGATCCCAGTCGGGATTCGAACTACCGGGCTCGCTGCCAGTGGGAAATTAACTCTGTCGGGTCTCGAACTCCCGACCG
GTTTCTTTTTCCTGCCTTTTTCTTTGGACATGTTTGCTTACTACTTCTGCTACTACAACTACTACTTTACAACTAcg

> SEQ ID NO:4802 105352FL 1111371_301534_1d
ggaggagactcctccgagatTTTCCCCTTTGTTCTGGTTCGTTTTTCTCTGTTTGGTTTCTCTGTTCGGGGTTCGGAAA
CATGGGGTCTGAGTACCGTTGCTTCGTCGGGGTCTGGCTTGGTCCACTAATGACCAGGCTTTGGAATCCGCTTTCAGT
CAATTCGGAACTGTCATCGAATCGAAGGTTATCAATGACCGTGAGACTGGAAGGTCTCGTGGATTCGGGTTTGTTACAT
TCGAGGATGAGCAAGCCATGAGGGATGCAATTGAAGGGATGAATGGAAAGGATCTAGATGGCAGGAACATTACTGTAAA
TCAGGCTCAGGACAGGTCATCAAGTGGTGGTGGTGGTGGCGGCTACCGAGGAGGTGGTGGTGGTGGTGGTGGTTACCGT
GGTGGTGGTGGCCGGTGGTTACAGTGGCGGTGGCAGTGGATACCGCTCAGGTGGTGGTGGATATGGTGGTGGTGGCCAAC
GTAGGGATTCTGGGTACGGTGGAGAAGGTGGTGGCTACTCTGGCGGTGGGGGCTACGGTGGTGGTGGTGGTGGATACGG
TggAAGTGGTGGTGGTGGtggtAACAACAGgt > SEQ ID NO:4803 105352FL 1097922_301456_1d
AAGGGTTTTGGTTTTCGGAAGGCTAACAACAATGGCGGAAGGGGAGTACCGATGCTTCGTGGGAGGTCTGGCCTGGGTT
ACAGATGATAGGGCTCTCGAAGATGCCTTCCGGTCCTACGGGAGGGTCACTGATTCCAAGGTCATCAGTGACAGAGAGA
CCGGGCGCTCCCGCGGATTTGGATTCGTGACGTNTGAAGACGAACAGTCGATGCTTGATGCGATCGAGGGGATGAATGG
GAAGGAGCTTGACGGGCGGAGCATTACTGTAAACCAAGCGCAAAGCCGCTC > SEQ ID NO:4804 107421FL 105233_300372_1d
CAAAAATGGAGGGTTGCAGTCGCATCTCGCCAGACTATATGGCACAACAGTTTGACGTCAACGAGAGGATGAGATCTAT
ACTAATCGACTGGCTCATTGAGGTACACCACAGTTTGATCTCAGGGAAGGAAGAGACATTATTCCTAACTGTTAATTTGATA
GATAGATTTTTGGAGAAACAATCCGTTGTGAGAAAGAAACTGCAGCTTGTTGGTCTTGTCGCCATGTTACTAGCGTGCA
AATATGAGGAAGTTTCTCTCCCTGCGGTGGATGATTTGGTGGTCATTTCGGATAAAGCATACACAAGGAAGGAGGTTCT
TGAAATGGAAAAATTGATGCTCAATACGCTGCAGTTTAATATGTCAGTTCCAACTCCATATGTTTTTATGAGAAGATTT
CTCAAAGCTGCTCAATCAGATAAAAAGCTTGAGCTACTTTCGTTCTTCTTGATCGAACTTTGCCTCGTGGAATATGAAT
TGCTTAAATTTCCACCATCGTTTATTGCTGCTGCTGCAATCTATACAGCTCAGTGCACACTTTATGGTGTTAAACAATG
GAGTAAGACGTGCGAGCTGCACTCTAAATACTCGGAAGATCAACTTCTGGAGTGTTCCAGATTGATTACGGAAT > SEQ ID NO:4805 107421FL 273933_200055_1d
GGGCTATGCTCATTGCCTCTAAATATGAAGAAATTTGGGCTCCTGAGGTGAATGATTTTGTGTGCATCTCAGACAAAGC
CTACAGTCATGAGCAGGTTTTGGCAATGGAGAAAAGGATTCTTGGCCAATTGGAGTGGTACTTAACAGTTCCAACACCT
TATGTGTTCCTCGTCCGCTTCATTAAAGCTGCTGTTTCCAATGCACAAATGGAAAACATGGTTTATTTCCTGGCTGAAT
TGGGGTTAATGAATTATGCAACAAATATATACTGCCCATCCATGATTGCTGCCTCAGCAGTCTATGTTGCTCAACACAC
ACTGAATTGCACTCCGTTTTGGAACGATACGCTAAAACTGCATACTGGTTTCTCAGAGTCTCAGCTACTGGGTTGTGCA
AAGTTGCTGGTAAGCTATCATATGGAGGCTCCAGAACACAAGCTAAAGGTGATTTACAAGAAGTATTCCAAACCAGAGA
GAGGTGCTGTTGCACTGCGACCTCCAGCCAAATTCCTCTTGGCTGCTTCTTCATATGAGTAATAATAGGGGCTTAGTTC
GAGTTCTCTACTTTATTTTTAAATTTTTTTCTTGTATTGAAATATTTAGTTAAGCTCTCTTACTTTGGATCT > SEQ ID NO:4806 107421FL 147609_301254_1d
GCGGTGCTTTTGTGAACCCCTTCAAATATCAGATTGAGAACACGGTATATTTTCTGGCTGAGCTGGGGTTGATGAATTA
TGCAACCATTATCTACTGTCCCTCGATGATTGCTGCCTCAGCGGTCTATGCTGCTCGACACACCCTCAATAGGACACCA
TTTTGGAATGAGACACTTAAGCTCCACACTTGGTTTCTCAGAGTCTCAGCTAATAGAATGTGCAAGGTTGTTAGTGAGCT
ATCAATCTGCGGCTGCAACTCACAAGCTAAAGGTGATATACAAGAAGTACTCCAGTCCGGAGAGGTGTTGTTTCATT
ACTAACTCCGGCCAAATTCCTGTTGGCTGCATCATTATCAAGTGTGTCATCGGGGCGATGCGATTTAGCCAAGAGCACA
GAAGCAGGAGCAACATCATCATCCCCTATGGTGGTGGTAGGTTGTCAAAGGTGCCACATGTATGTCATGGTAACTGAAG
CTGATCCAAGATGCCCCCAATGCAAGAGCACTACTACTAGGAAGATGACTTAAGTTGGTTTCATTAATCAAGAATCCAA
ACAGTTCTTTTATTGCTTGCTAGGTTTCATTTTTGTTTCTATAAATGGAGCACTACTTGAGCTCCATAGTTGTGACTTA
CATTTTTGTTTCTTGATTAATATTCTTTTT

FIG. 2 continued

> SEQ ID NO:4807 107421FL 284381_200097_1d
AAATGCTCAAGTTTCCGCCATCATTCATAGCTGCTGCAGCAATCTATACAGCTCAGACCACACTCTACGGTGTTCAGCA
ATGGAGTAAGACATGCGAGTGGCATACTAGTTACTCTGAAGATCAACTTCTGGAGTGCTCGAGATCGATTGTGATCATC
ACCAGAAGGCAGCAACAGGAAAACTAACTGGAGTACATAGGAAGTACAGCACGTCTAAATTTGGTTATGCAGCAAAGTG
TGAGCCTGCCCATTTTCTTGTGCAGACACAACAGCAATAAGAAAAGGCGCATGTATAGTTATTACTAACTTTATGTGCA
CATGGATTCCTAAAGATTTAATTAGGAAGTTCCATTGGTATAACGAGAACGGGTCGGAGTAATAGGAAGATTAACTTAG
CCTTATAGAGCTCCGGGGAGTTTGATAATCTCTTATAGAGCTCATTGTTGTTGCATTTTACAATGTTCAAAATTTGAAC
ATGGCTGGATTTCAGTTTCATTTACGAACAGTAATAAAAAGTCAAAAAACTTTTCAC

> SEQ ID NO:4808 108358FL 104075_300058_1d
acattttTAGTCTGAATAAAATGGCCAAGGCTACTGTATCATCCATTGTCCTCCTCCTCACTTTGAACATTCTCTTCTT
CGCAATGGTTAGTTCAACTTACATCCCATGCCCACCAAAAACAAAGAATCAACCCCATCCCACTACCCCATCATCCAAG
GGTTATAAGAAGTGCCAAAAGGACACACTAAAATTGAAGGTGTGTGCCAATTTATTGAATGACTTGGTGCATGTTGTTA
TTGGAAGCTCATCAAAGAGTTCATGCTGCTCTCTCATTGAGAATCTTGCTGATGTTGATGCTGCAGTTTGCCTTTGCAC
TGCCATTAAAGCTAAGCTCTTGGGAACTAACCTTGATACCGCTCTTTCCCTCAGCTTATTGCTCAACAATTGTGGAAAG
ACTGTTCCTAAAGACTTCCAATGTGCATAAATGGCCATCTTCCCACCCCAACTTGTTTGGTAATGAGGCGTAGTTGTCT
GTTTGTGGTGTTTGTTTTCTCCATAAGATTTTCGTCGGAGATTTCAACTAAAAAATAATCAGTACTGAGTGTGTTTGTG
CACGGTTGCTTATTTTCTCAGGAAATATGTGGAATTATTCTAGTGCTTAGAAGTACTGAGTGTGTTTATTCATGGTTGC
TTATTTTCAATGTGTTGTATCCCATATTTATTTGTAATAAGATGGTTATGTTCTCACTAAGGAAATATATTATGATTGA
TCTCGGG > SEQ ID NO:4809 108358FL 159618_200050_1d
AAAAATCTACTTATAACAACTAAAGTTAGTAGCTATATCATTCATTAAGAAATGGCTTCTAAAAAAACTACTTCTCTTG
CTCTCTTTATTCTTGTCAACCTTCTATTTTTCTCCCTTGTGAGTGCATGTGGCACTTGCCCTAGTCCTAAACCAAAGCC
AAAGCCGAAACCAAAACCAGGTCCTAGCCCATCCAAAGGCAAGTGCCCAATTGATACTCTAAAATTAGGTGTTTGTGCT
AATGTTTAGGCAATTTGCTTGGACTTTTGATTGGTAATCCTCCAAAAAAACCTTGTTGCACTCTCATTCAAGGTGTTG
CGGACCTTGAGGCTGCTGTTTGCCTATGCACTGCTATTAAAGCCAACATTCTTGGGATTAACCTTAATGTCCCTCTTTC
TCTAAGCCTTCTTCTTAATGTTTGTGGAAAAAAGGTTCCATCTGGCTTCCAGTGTCCTTGAACAGTACAACGTCCACAT
ATTTTGATTTGGGTTTTGGATT > SEQ ID NO:4810 108358FL 144879_200137_1d
tcagtATTAATACAAAACATAAATCCTCTGCTTCGTTATGGATTCAAAGAGATACTTAGTTACTCTCTTTTTATTCTTT
AACATTCTTTTCTTTACCCTTGTAAGTGGCTGCTGGAGTGGCTGCAATAATCCACCAACTCCAAAACCAAATTCGAACC
CGAACCCAAATCCTAACCCTAGCCCATCAAAGGGACACTGCCCTAGAGATGCCCTAAAACTAGGTGTTTGTGCCAAGGT
GCTGAACGGACCTGTCGGAGCCGTCATCGGAACTCCACCGGACATGCCTTGTTGTTCCGTACTAGGTGGACTTTTGGAT
CTTGAAGCTGCAGTTTGCCTTTGCACTGCACTGAAAGCCAACATTCTTGGAATAAACATTGATATTCCCATTGCATTAA
GCTTGCTTATTAATACTTGTGGGAAAAGTCTACCATCTGACTTCACTTGTGCCTAAGCTATAATGCTTCTCTTTTAAAG
TTCATGTTGTATTTTAGTTCTTCGTTGTTAGGACTTAGGAATGAGCACTTGATAATTTGTACGAAGCTAGGGAATGTTC
TTCCATCTCCTTTGTAATTCACTAGTGCTTTCTCTATTGACTTGATGAATTTCTAaTTC > SEQ ID NO:4811 108358FL 43494_300149_1d
acgttcagtttgaataaaatggccaaggctactgtatcatccattggcctTCTCCTCGCTCTGAACATTCTCTTCTTCA
CAATGGTTAGTTCAACTTACATCCCATGCCCACCAAAAACAAAGAATCAACCCCATCCCGCTACCCCATCATCCAAGGG
TTATAAGAAGTGCCCAAAGGACACACTAAAATTGAAGGTGTGTGCCAATTTATTGAATGACTTGGTGCATGTTGTTATT
GGAAGCTCATCAAAGAGTTCATGCTGCTCTCTCATTGAGAATCTTGCTGATGTTGATGCTGCAGTTTGCCTTTGCACTG
CCATTAAAGCTAAGCTCTTGGGAACTAACCTTGATACGCTCTTTCCCTCAGCTTATTGCTCAACAATTGTGGAAAGAC
TGTCCCTAAAGACTTCCAGTGTGCATAAATGGCCATCATCTATTTTCATCCTATCCCGACTTGTTTGGGAATGAGGCGT
AGTTGTCTGTTTGTGTTGTTTGTTTTCTCTACAAGATATTCGTTGGAGAAATACTATCAGTAATAAGTGTGTGTATGCA
TGGTTGCTTATTTTCAATGTGTTGTATCCCATATTTATTTGTAATATGATGGTTATCTTCTCATTAAGGAATTATATGA
TGttttatctcgggaaatcaattattgacaaggtattgatattaagttgttttttttcc > SEQ ID NO:4812 108358FL 127691_300471_1d
CAACATTTCACTAATTAGCCACATTCAATTGTTGAGAGTGCTAACTATTTAACTCTTAGAAATGGCTAAGTTTGCAATA
TCCTCCATTGCCCTTCTTCTCACTTTGAACATTGTCTTCTTAACTATGGTTAGTTCCACTAATGTCCCATGCCCACCCA
CCCCATCAAAGGGTCATTCCAAGCCCCACCCTAAGCCTACCCCTACCCCCTCTACCCCCTCTACCCCATCCACCCCATC
AACTCCATCATCAAAGGGTAAGTGCCCAAAGGACACACTTAAGCTAAAAGTGTGTGCCAACTTATTGAATGACTTAGTG
CACCTTGGTATTGGAAGTGATCCAGCCAAGACTCCATGTTGTTCTCTAATTCATGGACTTGCTGATCTTGATGCTGCTG
TTTGCCTTTGCACTGCAATTAAAGCCAATTTATTGGGAATTAACCTCAACGTACCTCTTTCCCTCAGTTTGTTGCTCAA

FIG. 2 continued

```
CAACTGTGGAAAGTATGTTCCTAAGGATTTCCAATGCGCATAAACTAGCTAGCCAATAACTTTCTCCCTGCAGAAAATT
TCCACTTCATATATTTATTTTTCAGTGTGTTTAATTTGGTATTTTGTATGCTTATAGTTTGCTTATGTTTTCAAAGGaA
GATATATTgtATTCTAATt

> SEQ ID NO:4813  109191FL 103534_300363_1d
tggtatcaacgcagagtggccattacggccgggGATCACAACTAACTTTGACATCTCAAACTAGCAACCTCTCACTTTC
CTCTTGATAAACCATGGCTGCTTCTACAATGGCTCTTTCTTCCCCTTCTTTCGCTGGACAGGCAGTGAAACTCTCCCCA
TCTGCCTCAGAAATCACTGGAAATGGAAGGGTCTCCATGAGAAAGACTGTCGCCAAACCCGTCGCATCTAGCAGCCCAT
GGTACGGTCCAGACCGTGTTAAGTACTTGGGCCCATTCTCCGGTGAGGCCCCAAGCTACTTGACCGGTGAATTCCCAGG
TGATTACGGGTGGGATACTGCTGGACTTTCAGCAGATCCAGAAACTTTTGCCAAGAACCGTGAACTCGAGGTGATCCAC
TGCAGATGGCTATGCTTGGTGCTCTTGGATGTGTCTTCCCTGAGCTTTTGGCTCGTAACGGTGTCAAGTTTGGTGAGG
CTGTGTGGTTCAAGGCTGGATCACAAATCTTTAGTGAGGGTGGACTTGACTACTTGGGCAACCCAAGCTTGGTCCATGC
ACAAAGCATCTTGGCAATCTGGGCTTGCCAAGTTATCTTGATGGGAGCTGTTGAGGGTTACCGTGTTGCTGGTGGGCCT
CTTGGTGAAGTTGTCGACCCACTCTACCCTGGTGGCAGCTTTGACCCATTAGGCCTTGCTGATGACCCAGAGGCATTTG
CCGAGCTCAAGGTAAAGGAGATCAAGAATGGCAGACTTGCCATGTTTTCTATGTTCGGATTCTTTGTTCAGGCCATTGT
TACCGGAAAAGGTCCATTGGAGAACCTTGCTGACCACCTTGCAGACCCCGTTAACAACAATGCGTGGGCCTACGCCACA
AACTTTGTTCCCGGAAAGTGAATCTTAAAACATTCTCAAAATTCTGATTGTTTGATGGCCTTGTAAAGCTGTTGTGAGT
TACCTGACAATATAATGCGATTTTGTTTGTGTTTCAAG > SEQ ID NO:4814  109191FL 279377_200061_1d
acaaataagattaaaaatcttacaaatggctacttctgcaattcaacaatctgcatttgctggacagacagctcttaag
tCACAGAATGAGCTCGTTAGGAAGATTGGTAGCTTTAATGGTGGACGTGCCACTATGCGACGTACGGTTAGAAGTGCCC
CACAAAGCATTTGGTATGGAGAAGACAGACCAAAGTACTTGGGACCATTCTCCGAGCAAACTCCATCTTACTTGACTGG
TGAGTTTCCGGGTGATTATGGGTGGGATACCGCGGGACTTTCAGCTGACCCAGAAACATTCGCCAGGAACCGTGAGCTT
GAGGTGATCCATTGCCGTTGGGCCATGCTTGGTGCTTTGGGTTGTGTCTTCCCTGAAATCCTTTCCAAGAATGGTGTTA
AATTTGGTGAGGCAGTTTGGTTCAAGGCTGGATCCCAAATCTTCTCAGAAGGCGGTCTTGACTACCTTGGTAACCCAAA
CCTTATTCATGCACAAAGCATTCTTGCTATTTGGGCATCCCAAGTTGTGCTCATGGGCTTAATTGAAGGATACAGAGTT
GGCGGAGGCCCACTGGGTGAAGGTCTTGACAAGATCTATCCGGGAGGAGCTTTTGACCCACTAGGGCTCGCTGATGATC
CCGAGGCATTCGCTGAGTTGAAGGTGAAGGAAATCAAGAACGGCCGATTGGCTATGTTCTCAATGTTTGGATTTTTCGT
TCAAGCCATTGTCACAGGAAAGGGACCAATTGAAAACCTTTACGATCATATTgctGACcctgttgccaacaaCGCATGG
GCTTt > SEQ ID NO:4815  109191FL 272804_200132_1d
aaaaaagaagcttctttagctcaccaattaaacaaatggccacttctgcaattcaagaaTCTGCATTTGTTGGCCGGAC
AGTGGCTAAATCACAAAATGAGCTTGTTAGGAAAATTGGCAGCTTTGGCGGAGGCCGTGCTACCATGAGACGTACTGTT
AAAAGCCCTCCTCAAAGCATCTGGTATGGAGAAGACCGTCCAAAATATTTGGGCCCATTCTCTGAGCAAACTCCATCTT
ACCTTACTGGTGAATTTCCCGGTGATTACGGGTGGGATACTGCTGGACTCTCAGCTGACCCAGAAACATTCGCAAGAAA
CCGTGAACTTGAGGTGATCCATTGCCGTTGGGCCATGCTTGGTGCTTTGGGTTGTGTCTTCCCTGAAATTCTATCAAAG
AATGGTGTTAAATTCGGTGAAGCTGTTTGGTTCAAGGCAGGAGCCCAAATCTTTTCAGAAGGTGGACTTGACTACCTCG
GCAACCCAAACCTTGTCCACGCCCAGAGCATCCTTGCCATTTGGGCTTGCCAAGTTGTCCTAGTGGGCTTGATTGAAGG
ATACAGGGTTGGTGGAGGCCCACTTGGTGAAGGTCTTGACAAGATCTATCCAGGAGGTGCCTTCGACCCACTTGGCCTA
GCTGATGATCCCGAGGCTTTTGCTGAGTTGAAGGTTAAGGAAATCAAGAATGGACGATTGGCTATGTTTTCAATGTTCG
GATTCTTTGTTCAGGCTATTGTTACAGGAAAAGGCCCAATCGAGAACCTTTACGACCACATTAATGACCCAGTAGCCAA
CAATGCTTGGGCTTTTGCTACCAACTTTgtACCCGGAAAGTGAAATGTTTTGTCTgtGTTATATgtAAAAATTTggGCT
AATGAAGTTTtctgcttgt > SEQ ID NO:4816  109191FL 255729_301643_1d
tcgacTCAGCAAGAGCTAGACATGGCTTCGCTCTCTTCCTCATTGGCCGGGCAAGTAGTGTTGAAGGCACAGAGCTCAC
TCGCAGCGAAGGTGGGCAACAATGTATTGGGCGAGGCAAGAGTTAGCATGAGGAAAACTGCCTCCAGAGTGTCGGTACC
GGACAGCCCATGGTACGGCCCAGAGCGGGTCAAGTACCTAGGCCCATTCTCCGGCGACTCGCCCTCATACTTGACTGGG
GAGTTCCCCGGTGACTACGGCTGGGACACTGCTGGCCTCTCTGCCGACCCCGAGACCTTTGCCCGCAACAGGGAGCTAG
AGGTCATCCACTGCCGATGGGCCATGTTGGGCGCACTGGGCTGTGTCTTCCCTGAGCTCCTCTCAAAGAACGGTGTCAA
GTTTGGCGAAGCTGTCTGGTTCAAGGCTGGGTCTCAGATCTTTGCCGAGGGTGGCTTGACTACCTGGGTAACCCTAGC
CTGGTCCATGCCCAGTCTATCCTTGCCATCTGCCAGGTCATCTTGATGGGTGCTGTTGAAGGCTACCGTGTTG
CTGGTGGGCCCCTTGGCGATGTAACTGACCCCATCTACCCTGGTGGCAGCTTCGACCCCCTAGGGCTAGCTGATGACCC
CGAGGCCTTCTCTGAGCTGAAAGTGAAGGAGATAAAGAATGGACGGctGGCTATGTTCTCCATGTTTGGATTCTTCGTG
CAGGCcATCGTGactggtaagGGCCcAGTTGAGAACTTG
```

FIG. 2 continued

> SEQ ID NO:4817 109191FL 247896_301577_1d
GCTTTCTTCCTCTCCATCTTCGTTTGTGCTCCCTGATCGAGCAATGGCCACCATGACCGCCGCCGCCACCACATTCGCC
GGCCAGACCGTGCTCAAGGCCCAGAACGAGTTCGTCGCCCGCAACGCCAGCAATGGATCCCGGGTCGCGATGCGCAAGA
CCGCCAAGGCGGCATCCAGCGGCAGCCCATGGTATGGCCCCGACCGCGTCAAGTACCTCGGCCCCTTCAGCGGCGAGGT
TCCCTCGTACCTCAACGGCGAGTACCCCGGCGACTACGGCTGGGACACTGCCGGGCTGTCGGCCGACCCGGAGACATTC
GCCAAGAACAGGGAGCTGGAAGTGATCCACTGCCGGTGGGCAATGCTGGGTGCCCTTGGCTGTGTCTTCCCCGAGCTTC
TCTCCAAGAACGGCATCAAGTTCGGCGAGGCAGTGTGGTTCAAGGCCGGTTCCCAGATCTTCAAGGAGGGTGGACTCGA
CTACCTGTGCAACCCCAGCCTGATCCACGCCCAATCCATTCTCGCCATCTGGGCCTGCCAGGTCATCCTCATGGGCGCA
GTGGAGGGCTACCGCGTCGCCGGGGGGCCGTTGGGCGAGGTGACGGACCCGATCTACCCAGGTGGCAGCTTCGAACCCC
TCGGATTGGCAGAGGATCCCGAGGCGTTTGCGGAGCTCAAGGTGAAGGAGATCAAG

> SEQ ID NO:4818 109191FL 196145_300724_1d
CCCGGCGACTACGGGTGGGACACCGCGGGGCTCTCCGCCGACCCGGAGACGTTCGCCAAGAACCGGGAGCTGGAGGTGA
TCCACTCCAGGTGGGCGATGCTCGGCGCGCTGGGCTGCGTGTTCCCGGAGCTCCTCGCCCGCAACGGCGTCAAGTTCGG
CGAGGCGGTGTGGTTCAAGGCGGGGTCGCAGATCTTCAGCGAGGGCGGGCTCGACTACCTCGGCAACCCGAGCCTGATC
CACGCGCAGAGCATCCTCGCCATCTGGGCGGTCCAGGTGGTGCTCATGGGCGCCGTCGAGGGGTACCGCATCGCCGGCG
GGCCGCTCGGCGAGGTCGTCGACCCGCTCTACCCCGGCGGCAGCTTCGACCCGCTCGGCCTCGCCGACGACCCGGAGGC
CTTCGCGGAGCTCAAGGTGAAGGAGATCAAGAACGGCCGCCTCGCCATGTTCTCCATGTTCGGCTTCTTCGTCCAGGCC
ATCGTCACCGGCAAGGGCCCCCTCGAGAACCTCGCCGACCACCTCGCCGACCCCGTCAACAACAACGCCTGGGCCTACG
CCACCAACTTCGTCCCCGGCAAGTGAGCGCCGCCGCCGCCGTGCTGCCATGGCGACGCATCGCcTTCAGCtaAGCtagc
taggttgacgACGATGCGCgtCTCTGCAggagAgtgt > SEQ ID NO:4819 109191FL 182356_300660_1d
gaattcGTTAGCCATGGCAGCTTCTACAATGGCTCTATCTTCACCCGCATTGGCTGGTAAGGCACTTGTTCCTTCCAGC
TCTGAAGTTTTCGGTGAAGGCAGAATCTCCATGAGAAAAACCGTTGCAAAGCCAAAAACCGTTTCATCTAGCCCATGGT
ACGGACCTGACCGTGTTAAGTACTTGGGACCATTCTCTGGTGAATCTCCATCATACTTAACCGGTGAGTTTGCCGGTGA
TTACGGTTGGGACACTGCCGGGCTTTCTGCTGACCCAGAAACCTTCGCCAAGAACCGTGAGCTGGAGGTCATTCACTGC
AGATGGGCTATGTTGGGAGCTCTTGGATGTGTCTTCCCCGAATTGTTGTCTCGCAATGGTGTTAAATTTGGTGAAGCCG
TTTGGTTCAAGGCCGGTTCACAAATTTTCAGTGAAGGTGGATTGGACTACTTGGGTAACTCAAGCTTGGTTCATGCTCA
GAGTATTCTAGCTATCTGGGCTACACAAGTTATCTTGGGGTGCAGTTGAAGGTTACCGTGTTGCTGGTGGTCCACTA
GGAGAGGTTGTCGACCCACTTTACCCAGGTGGTAGCTTTGACCCTCTTGGCCTTGCTGACGATCCAGAGGCTTTTGCTG
AATTGAAGGTGAAAGAAATCAAGAATGGGAGATTGGCAATGTTCTCAATGTTTGGGTTCTTTGTTCAAGCTATTGTGAC
TGGTAAGGGACCTTTGGAAAATTTGGCTGATCACCTAgcTGATCCCGTTAGCAACAATGCTTGGAACTACGCCACTAAC
tTCGcaccCggAAAgtgaagaaaTTTTGTtTGagaTTgtCagattagatTAttggaaaCTGat > SEQ ID NO:4820 109191FL 182270_300659_1d
GAATTCGGGGAGGCAGTGAAGCTAACTCCATCCATTCCAGAACGCGAAGGAAGAATTACCATGCTCTTCCAGAAAAGGA
CACCGGCAAAAGCAGCTAAATCATCCAAACCCGCAGTTTCATCTAACAGCCCATGGTATGGTCCTGACAGAGTTAAGTA
CTTGGGACCTTTCTCCGGTGAGGCACCATCATATCTCAATGGTGAATTTCCTGGTGACTATGTTGGGATACCGCTGGG
TTATCTGCTGATCCTGAAACTTTCGCCAAGAACCGTGAGCTTGAAGTGATCCATTGCAGATGGGCTATGCTCGGAGCTC
TAGGATGCATCTTCCCTGAATTGCTCTCGCGCAATGGAGTTAAATTCGGTGAAGCCGTTTGGTTCAAAGCCGGAGCACA
GATTTTCAGCGAGGGAGGATTGGACTACTTAGGTAACTCAAGCTTAGTACATGCTCAAAGCATTTTAGCTATTTGGGCG
ACACAAGTTATCCTGATGGGTGCAGTGGAAGGTTACCGTGTCGCCGGTGGACCTCTTGGTGAGATTGTCGACCCACTGT
ACCCCGGTGGCAGCTTCGACCCTCTTGGACTTGCTGATGACCCAGAGGCTTTTGCTGAATGGAAGGTGAAGGAGATTAA
GAACGGAAGATTGGCGATG > SEQ ID NO:4821 109191FL 181959_300658_1d
gaattcaggtaagaatggcaaccatggctctgtcttctccatcatttgcaggcaaagctgtgactctaaacccgggaac
aGAATTCCCAACCAATGTAAGATCTGGCAGCAACAGCAAGATCTCGATGAGGAAGACATCCGCAAAGAAGCCTGCTGCT
TCTTCAGGAAGTCCATGGTATGGTCCAGACCGTGTCAAGTACCTCGGTCCCTTCTCTGGTGAGTCTCCATCCTACTTAA
CTGGTGAATTCGCTGGTGACTATGGCTGGGACACTGCTGGACTATCAGCTGATCCAGAGACCTTTGCCAAGAACCGCGA
ACTTGAGGTGATCCATTCAAGGTGGGCGATGCTTGGCGCTTTGGGCTGTGTCTTCCCTGAACTCCTCTCGAGAAATGGA
GTCAAATTCGGCGAAGCAGTTTGGTTCAAAGCCGGCTCTCAGATATTCAGTGAAGGAGGACTTGACTATTTGGGAAATT
CCAGCTTGGTTCATGCACAGAGCATCCTGGCTATATGGGCCACTCAAGTCATCCTTATGGGCGCCGTCGAAGGCTACAG
AGTTGCTGGCGGTCCACTAGGTGAGGTTGTTGATCCCCTTTACCCAGGTGGAAGCTTCGATCCATTAGGCCTCGCAGAG
GACCCAGAGGCATTTGCCGAGCTAAAGGTAAAAGAACTAAAGAACGGGCGACTTGCTATGTTCTCCATGTTTGGGTTCT
TCGTTCAGGCTATTGTGACGGGCAAAGGTCCTCTAGAGAACCTGGCAGACCACCTTGCCGACCCAGTGAACAACAATGC
CTGGTCATATGCTACGAACTTCGCTCCCGGGAAGTGAGCATAAGCATAGCAAAGGCAAAATGGAGTTTGAtttcctact

FIG. 2 continued tttttctgtaatatcctctgtacattcatttagcttgtaaaattgtgtagaatgtagctgcggttggtct > SEQ ID NO:4822 109191FL 154249_200163_1d
TTTCTAGTAGCTGCAGTCAAGAATACTTTCTTATCTCTTCCTTCTACAATGGCAACTGCTACAATGTCTCTCTCTTCCC
CTTCTTTTGCCGGAAAGGCAATAAAACTCTCACCATCTTCCTCTGAAATTACTGGAAATGGAAAAGTCACCATGAGGAA
GACTGTTACCAAGGCTAAGCCTGTCTCCTCTGGCAGCCCATGGTACGGTCCTGATCGTGTCAAGTATTTGGGCCCATTT
TCTGGTGAGTCCCCAAGTTATTTGACTGGTGAATTTCCTGGTGATTACGGTTGGGATACTGCTGGACTTTCAGCTGATC
CGGAAACCTTTGCCAAAAACCGTGAGCTAGAGGTTATTCACTGCAGATGGGCTATGCTTGGAGCTCTTGGTTGCGTCTT
TCCTGAGCTCTTGGCCCGTAACGGTGTCAAGTTCGGCGAAGCTGTATGGTTCAAAGCTGGATCGCAGATTTTCAGTGAG
GGTGGACTTGACTACTTGGGCAACCCAAGCTTGGTCCACGCGCAAAGCATCTTGGCTATTTGGGCTTGCCAAGTTGTGT
TGATGGGAGCCGTCGAGGGTTATCGTATTGCTGGTGGACCTCTTGGTGAGGTTGTTGACCCACTTTATCCTGGTGGTAG
TTTTGACCCATTGGGTCTTGCAGATGACCCGGAAGCTTTTGCTGAGCTTAAAGTAAAGGAAATCAAGAATGGCAGACTT
GCTATGTTTTCCATGTTTGGATTCTTTGTTCAAGCTATCGTCACCGGAAAGGGTCCATTGGAGAATCTTGCAGACCATC
TTGCAGACCCCGTTAACAATAATGCTTGGGCATATGCCACAAACTTCGTCCCTGGAAAATGAAGTTCATAAAAGAGTCT
TGTTCTATTGCCTTGTTGTTTGATGGTTCTGTAAAGtTATTGTGAATTACAAAAAAATGACAATATGAAATTTGTTCGG
TCtcc > SEQ ID NO:4823 109191FL 52310_300094_1d
CCCACGCGTCCGCCTTTTTTGGTTTTTTTTTTTATCATAAAGCTTCTTAAATATTTCACACACATACAAAGTAATTTAC
AAGATATGAAATCTGCATCACATTTCCAAGATGCAACAAACCGGATACACACAACTCGATCACAAATTAAACTCACTTT
CCGGGGACGAAGTTGGTAGCGAAGGCCCATGCATTGTTGTTGACTGGATCAGCCAAGTGGTCCGCGAGGTTCTCCAACG
GTCCCTTTCCGGTGACAATGGCCTGAACGAAGAATCCAAACATAGAGAACATAGCCAACCTTCCGTTCTTGAGCTCCTT
CACCTTCAACTCCGCGAAAGCCTCGGGGTCAGTAGCGAGGCCCAATGGGTCGAAGCTCCCACCTGGGTAAAGCAAGTCC
TCTGCTTCTCCCAATGGACCATCTCCGGCGACTCTGTAGCCCTCAACAGCTCCCATGAGGATAACTTGAGTAGCCCAAA
TGGCTAAGATGCTCTGAGCGTGGACCAAGCTCGGGTTGCCCAAGTAGTCCAATCCTCCGTCGCTGAAGATCTGTGAACC
AGCCTTGAACCAAACCGCTTCTCCGAACTTCACTCCGTTCCTAGCCAATAGCTCAGGGAAAACGCAGCCTAGGGCTCCG
AGCATGGCCCATCTGCTGTGGATAACTTCTAGCTCACGGTTCCTAGCGAAGGTCTCGGGATCGGCGGATAGACCGGCAG
TGTCCCACCCGTAATCACCGGGGAACTCTCCAGTGAGGTAGCT > SEQ ID NO:4824 109191FL 31166_300077_1d
CCCACGCGTCCGTGTTTAGAAGAAGCAATGGCCACTTCAGCAATCCAACACTCTTCTTTCGCTGGCCAAACGACCCTAA
AGCCATCCAACGATCTCCTCCGCAAAATCGGAGCCTCCAATGGCGGTGGCCGCATCATCATGCGTCGTACCGTCAAGTC
TACTCCTCAGAGCATCTGGTACGGACCCAGACCGTCCCAAATACCTAGGACCCATTTTCCGAAAACACACCATCATACCTA
ACCGGAGAATACCCTGGAGACTACGGTTGGGACACCGCTGGTCTCTCAGCCGATCCAGAAACATTCGCAAAGAATCGTG
AGCTCGAAGTGATCCACAGTAGATGGGCAATGTTGGGAGCTTTAGGCTGCACCTTCCCTGAAATTCTCTCAAAAAACGG
AGTCAAATTCGGTGAAGCCGTGTGGTTCAAGGCAGGATCTCAAATCTTCTCAGAAGGAGGGCTTGACTACCTCGGAAAC
CCTAACTTGATCCACGCGCAAAGCATATTAGCTATATGGGCGTGTCAAGTTGTGCTAATGGGATTCATTGAAGGGTACA
GAATCGGAGGTGGTCCTCTTGGGGAAGGGCTTGACCCGCTTTACCCGGGCGGNGCCTTCGACCCGTTGAACTTAGCGGA
GGATCCAGAAGCGTTTTCAGAGTTGAAAGTGAAGGAGCTTAAAAACGGTCGTCTTGCTATGTTCTCAATGTTTGGATTC
TTTGTCCAAGCCATAGTTACCGGTAAAGGTCCGATCGAAAATCTGTTCGATCACATTGCAGACCCTGTGGCTAACAATG
CTTGGGCTTACGCCA > SEQ ID NO:4825 109191FL 130831_300491_1d
gaattcgggcacagctgtagctttgaacgcacaggggaaattcccaaccaatgttagatccagtagcaatggaatgatt
gTGATGAGGAAGACATCAGCAAAGAAGCCTGCTGCTTCTTCAGGAAGCCCATGGTACGGTCCAGACCGTGTCAAGTACC
TTGGACCCTTCTCTGGTGAGTCTCCATCTTACCTAACTGGTGAGTTCCCTGGTGATTACGGCTGGGATACTGCTGGACT
ATCTGCAGACCCAGAGACCTTTGCCAAGAACAGGGAATTGGAAGTGATTCATTCCAGGTGGGCTATGCTTGGCGCTTTG
GGATGTGTTTTCCCTGAACTTCTCTCTAGAAATGGAGTTAATTTTGGAGAAGCAGTCTGGTTCAAAGCTGGTTCTCAGA
TTTTCAGTGAAGGTGGACTTGACTACTTGGGAAACTCCAGCCTGGTTCATGCACAGAGCATCTTAGCTATTTGGGCAAC
CCAAGTTATCCTTATGGGAGCTGTTGAGGGATACAGAGTTGCCGGTGGTCCACTAGGTGAGATCGTCGACCCACTTTAC
CCAGGTGGTAGCTTTGACCCCTTAGGACTTGCAGAGGACCCAGAGGCATTTGCTGAGCTGAAGGTAAAGGAACTTAAGA
ACGGGAGACTTGCTATGTTCTCCATGTTCGGATTCTTCGTTCAGGCTATTGTTACCGGCAAAGGTCCTTtagagAATCT
GGCAGATCACCTGTCTGACCCTGTGAACAACAATGCTTGGTCATATGCTACCAATTTTGCTCCAGGAAAGTGAGAATGT
ACATGATAGTCAACTaagaTGATTTCATTTCCTTCAAAAggCgaaggaGATGGCTTTTCttATCTTTCAACTTTTGTAC
ATACatccATTTAGCttGTaAAACAATCTGGCAttCggATTAATTTGTACTTaa > SEQ ID NO:4826 109191FL 129521_300480_1d
gaattcaagtcatggccacctctgccattcaaaggtctgcattcgctggtcaaactgctttgaagcaacaaatgagtt

FIG. 2 continued cATCCGCAAAGTTGGCAATGTGGAAGGTGGTCGTATCTCCATGCGCCGCACTGTAAAAAGCATTCAGTCAAGCATGTGG
TATGGACCAGACAGACCTAAGTACTTGGGACCATTCTCAGAACAGACCCCATCTTACCTCACTGGTGAATTTCCAGGTG
ACTACGGTTGGGACACAGCCGGGTTATCTGCTGACCCAGAGACATTTGCAAAGAACCGTGAACTCGAAGTGATCCACTG
CAGGTGGGCTATGTTGGGTGCCCTAGGATGTGTCTTCCCTGAGGTTCTCTCAAAGAACGGTATCAACTTTGGCGAGGCA
GTATGGTTCAAAGCTGGATCACAGATCTTCTCTGAGGGAGGTTTGGACTACCTTGGAAACCCTAACTTGGTACATGCCC
AAAGCATTCTTGCAATCTGGGCTACTCAGGTTGTGCTAATGGGGTTTGTTGAGGGATACAGAGTTGGTGGTGGTCCACT
TGGAGAAGGACTAGACAAACTTTACCCCGGTGGATCTTTTGACCCTCTAGGATTAGCTGATGACCCAGAGTCATTCTCT
GAATTGAAGGTAAAGGAAATCAAGaATGGAAGACTTGCTATGTTCTCTATGTTTGGGTATTTCGTTCAGGCTATTGtta
CCGGAAAGGGTCCAATTGAAAACCTTTATgACCaCgtcgcCGATcctGttgcAAATAACGCATgggcTTACGCTACTAA
CTttgctccTGGAAAATGAATGTAAATttttcctaggGTGTATCa > SEQ ID NO:4827 109191FL 1197212_302201_1d
TACCGGTCTTGCTTCAGAGCCAGAGCTAGAGCTAGAAATGGCCTCGTTCTCTTCCTCCCTGGCTGGTCAAGTAGTGTTG
AAGCCACAGAGCTCACTCGCAGCGAAGGTGGGCAACAATGTATTGGGCGAGGCAAGAGTTAGCATGAGGAAAACTGCCT
CCAGAGTGTCGGTACCGGACAGCCCATGGTACGGCCCAGAGCGGGTTAAGTACCTAGGCCCATTCTCCGGCGACTCGCC
CTCATACTTGACTGGGGAGTTCCCCGGTGACTACGGCTGGGACACTGCTGGCCTCTCTGCCGACCCCGAGACCTTCGCC
CGCAACAGGGAGCTAGAGGTCATCCACTGCCGATGGGCCATGTTGGGCGCACTGGGCTGTGTCTTCCCTGAGCTCCTCT
CAAAGAACGGTGTCAAGTTTGGCGAAGCTGTCTGGTTCAAGGCTGGGTCTCAGATCTTTGCCGAGGGTGGGCTTGACTA
CCTGGGTAACCCTAGCCTGGTCCATGCCCAGTCTATCCTTGCCATCTGGGCTTGCCAGGTCATCTTGATGGGTGCTGTT
GAAGGCTACCGTGTTGCTGGTGGGCCCCTTGGCGATGTAACTGACCCCATCTACCCTGGTGGCAGCTTCGACCCCCTAG
GGCTAGCTGATGACCCCGAGGCCTTCTCTGAGCTGAAAGTGAAGGAGATAAAGAATGGACGGCTGGCTATGTTCTCCAT
GTTTGGATTCTTCGTGCAGGCCATCGTGACTGGTAAGGGCCCAGTTGAGAACTtgg > SEQ ID NO:4828 109191FL 1188125_302137_1d
GTCTGATCAAGGAGGCAGAGCCCAGCCATGGCTTCGGTGACAGCAGCGCTTTCTTCCTCCCTGGCCGGGCAAGTAGTGT
TGAAGCCACAGAGCGAGCTAGCAGCGAAGGTGGGCAACAATGTGCTGGGCGAGGCAAGGATTAGCATGAGGAAAACTGC
CTCCAGAGTGTCGGTGCCAGACAGCCCATGGTACGGCCCAGAGCGGGTCAAGTACCTAGGCCCATTCTCCGGCGACTCT
CCCTCATACTTGAATGGGGAGTTCCCCGGCGACTACGGCTGGGACACTGCGCCGGGCTCTCTGCTGACCCCGAGACATTTG
CCCGCAACAGGGAGTTGGAGGTTATCCACTGCCGCTGGGCCATGTTGGGCGCTCTAGGCTGTGTCTTTCCCGAGCTCCT
CGCCAAGAATGGCGTCAAGTTCGGAGAAGCTGTCTGGTTCAAGGCTGGGTCCCAAATCTTTGCTGAGGGTGGTCTTGAC
TACCTAGGTAACCCTAGCCTTGTCCATGCCCAGTCTATCCTTGCCATCTGGGCTTGCCAGGTCATCCTTATGGGTGCTG
TTGAAGGCTACCGTGTTGCTGGTGGTCCCCTTGGTGATGTGACTGACCCCATCTACCCTGGTGGAAGCTTTGACCCCCT
TGGCCTAGCTGATGACCCCGAGGCCTTCTCTGAGCTCAAAGTGAAGGAGATTAAAAATGGTCGGTTGGCTATGTTCTCC
ATGTTCGGATTCTTCGTGCAGGCCATCGTGACTGGCAAGGGCCCAGTCGAAAACTTGGTTGACCACCTTGCTGACcCTG
tTAACAACAATGCCTggGCAttcGCCACCAACTTTGTCCCCGGGAATTAGAGtGTAgTCTGCTACTtgtttgaATGATc
TTTTCcTATAAtg > SEQ ID NO:4829 109191FL 116613_300079_1d
cgcggccaccatggcgctctcctccccggtgatggcccgcgcggcgccgtcgacctcctccgcgctcttcggcgaggcg
cGGATCACCATGCGCAAGACCGCCGCGAAGCCCAAGCCGGCGGCGTCGTCGGGGAGCCCGTGGTACGGCGCCGACCGCG
TCCTCTACCTCGGCCCGCTCTCCGGCGAGCCGCCGAGCTACCTCACCGGCGAGTTCCCGGGCGACTACGGGTGGGACAC
CGCGGGGCTCTCCGCCGACCCGGAGACGTTCGCCAAGAACCGGGAGCTGGAGGTGATCCACTCCCGGTGGGCGATGCTG
GGCGCGCTGGGCTGCGTCTTCCCGGAGCTCCTCGCCCGGAACGGCGTCAAGTTCGGCGAGGCGGTGTGGTTCAAGGCGG
GGTCGCAGATCTTCAGCGAGGGCGGGCTCGACTACCTCGGCAACCCGAGCCTGATCCACGCGCAGAGCATCCTCGCCAT
CTGGGCGGTCCAGGTGGTGCTCATGGGCGCCGTCGAGGGGTACCGCATCGCCGGCGGGCCGCTCGGCGAGGTCGTCGAC
CCGCTCTACCCCGGCGGCGCCTTCGACCCGCTCGGCCTCGCCGATGACCCGGAGGCCTTCGCGGAGCTCAAGGTGAAGG
AGATCAAGAACGGCCGCCTCGCCATGTTCTCCATGTTCGGCTTCTTCGTCCAGGCCATCGTCACCGGCAAGGGCCCCCT
CGAGAACCTCGCCGACCACCTCGCCGACCCCGTCAACAACAACGCCTGGGCCTACGCCACCAACTTCGTCCCCGGCAAG
TGAGCGCCGCCGCCgccGTGCTGCCATGGCGACGCATCGCCTtC > SEQ ID NO:4830 109411FL 137953_300687_1d
GTACGAAAAGAGGAGAGCCATATCCCAGCATAAAGAGCCTCAAGCATCTGCTAGATCTCAACATATTGTCCCCCGATCA
GAAGGAAGGCGCAGCCGTTCTGGAAAGAAAGGGAAAAAGAGACCTGCTCGCCGCAGATCTCAACAGAAAACAGATGAAT
TATCTGCTGTAGAGAGTGGCAGTAATTATTCCTCACGCAGAGATGTATACTGCAATGAGTGGAAGGGACCAGGTATT
GAGTTCCAGTTCACGATTTGCGTCTCCTGAGGACTCAAAATACAAGCAGAAATCTCCTGCTGAATCCCCAATGGAAATA
ACTTCTGAGACGAAGTTGCCTACAGTTCTCAGAAGGAAATATCCTGATACACTCAAAGATGGTTTTGTTGTAGCCTTGA
GAACAAAAGATAATTCAGGGTTCCATGTTGCAAGACAGAGACTTGCTGGTGGTGGTGGTTGGATCCTTGATATCGTGTC
AAATGCTACAAACAGGGACCCTGCTGCTCAGTTCCTAGTCACTTTCAAAAACAAGGATACCATGGGATTACGTTCCTTC

FIG. 2 continued

GTCGCTGGTGGTAAACTATTGCAGATTAATAGGAGGATGGAGTTTGTGTTTGCAAGTCATACATTTGATGTTTGGGAGA
GCTGGATGCTGGAGGGGTCCTTGTTGGAG

> SEQ ID NO:4831 111429FL 110949_300048_1d
ATCCTCGGAGAAAGGTTGTGTTGGCTGCTAGCTAGTAATGGGGATATGTGTGTTTCAAATTTTTAGTAGTACTATTACG
TTAGGTAAAGTCACTAAAATTCTCGTTTAATCCTAGTTATGATCGAAAAGCTAATAAGAGGGTTTATTTCTTTTGTTAT
ATACGTAGTAGTACTAGTAATTTTATGTTAGAAGAGGAGAGAGGGATAGCTGAGAATTATTGAGGATTAACTACGTACG
TTTCATAAGCTTTCTTTGGATGTTAATGATGTGATAGAATGAGAGTTGTGGTCATCATATGTACAATTTAAAATTGTTA
TCCCTTTGATGAACTGACTTTCTAATTAAAAGATTGAAGTTCTCTTCTCTAAGC

> SEQ ID NO:4832 111429FL 284628_200100_1d
TGGCTGCCACTTCTCTTACTTTATTTCTAGCTTTTCTTTGTTTCTCTCAAGTTATCTACTTGAATGCCGTCCCAATTAC
AAGAAGCGAATGTCTGGTATACAAATCTCAAGAACACAAGGTTTTAAAGAATATGAATGAGAGTATGGAAATAGCTGAT
CGTGCCATCATAAGAAGAATGGACGCCGAGCTCAATGATTATCCTGGTGCCGGTGCGAATAATCACCACACTCCAGGCC
ACCCTTAGGAAAAGGATGACATGCACTAATCGAGAAATGATTCTAGAGAAAGGTTGTGTTGGCTGCTAGCTAGTAATA
GATATATATGTGCTCCAAATGTTTAGTAGTATTATTGTGTTAGGTAAAGTCACTAAATTTCTCGTTTAAATCCTAGTTA
TGATCGAAAATCTAATAAGAGGAGTTTTATCTCTTTTGTTATAAAAAAAAAG

> SEQ ID NO:4833 111761FL 107041_300262_1d
TAATATCAAAGAAAAGAAAGGAAAATGACTTGTACATTTTCTCTCAAATTGATTGTTAGTGTTGTCACTTTGCTTTGTT
TAATTCACTTTTCCTGTGTTTGTGATGCTAAAAGGATGCTTAggGAGGAAAATGAGAAGTTATTTAAGGTAAAAAAGGA
TGATTCGGCTTCTCCTTCTCCAgaTTCAACAAACATTGgtgGATTTCCTTTTCCATTCAATTTTCCACCATTTTCTGAT
GGAATTCCAAATATACCCttCAATTTTCCATTTCCTGACTTTGGATCATCacgAGGATTGCCTGgGTTTGGAattccTG
gGaCTGgGGATAATAACCCATTTACTTTTccaaTcCCTggagatccTAatgttgctgttccACCCCCagctgtcgcCCC
TTaaattCcTATACAaCtTtCTCTCTgtgaTTAtcagaTtAaatTTGtgaG > SEQ ID NO:4834 111761FL 291875_200191_1d
ttcttttctattTAATATCAAAGAAAAGAAAGGAAAATGACTTGTACATTTTCTCTCAAATTGATTGTTAGTGTTGTCA
CTTTGCTTTGTTTAATTCACTTTTCCTGTGTTTGTGATGCTAAAAGGATGCTTAGGGAGGAAAATGAGAAGTTATTTAA
GGTAAAAAAGGATGATTCGGCTTCTCCTTCTCCAGATTCAACAAACATTGGTGGATTTCCTTTTCCATTCAATTTTCCA
CCATTTTCTGATGGAATTCCAAATATACCCTTCAATTTTCCATTTCCTGACTTTGGATCATCAGGAGGATTGCCTGGTT
TTGGAATTCCTGGTACTGGTGATAATAACCCATTTACTTTTCCAATCCCTGGAGTTCCTAATGTTGCTGTTCCACCCCC
AGCTGCCGCCCCTTAAATTCCTATACAACTTTCTCTCTGTTATTATCAGTTTAATTTTGTAAGAAGAAGGAAATCAAGG
AGTAAGTTTTAGAGCCATAGGCTCAAA > SEQ ID NO:4835 111761FL 274012_200147_1d
tttctATTTTATATCAAAGAAAAGAAAGGAAAATGACTTCTACATTTTCTCTTAAGTTGATTATTAGTGTTGTCACTTT
GCTTTGCTTAATTCAGTTTTCCAGTATTTGTAATGCTAAAAGGATGCTTAGGGAGTCTAATATAGGAAAGGAAAATGAG
AATATATTTAAGGAGAAAAAGGATGATTCAACAAACATTGGTGGATTTCCTTTTCCATTCAATTTTCCACCATTTTCTG
ATGGAATTCCAAATATACCCTTCAATTTTCCATTTCCTGACTTTGGATCGTCAGGAGGATTGCCTGGTTTTGGAATTCC
TGGGACCGGTGGTAGTGGTACTGGTGATAATAATCCATTTTCGTTTCCGATCCCTGGAGTTCCTAATGTTGCTGTTCCA
CCCCCAGCTGCCGCCCCTTAAATTCCTATACAAGTTTCTCTCTGTTATTAGCAGTTTAGCCTTTTGGCTGGGGTCATGT
AAAACATTAAAAAAAAAATGATAAAGAAGAAGGAAATCAAGGAGTAAGTTTTAGAGCCATAGGCTCAAATGAATTACTA
TTTCTTGTCCTTGTTTCTGATGTAATTAATTAGAAAATGGGAAATGACATGGATGTCAAGTAAAAAGAACTCGTATTT
TTCTAcccgattAACAagggtatcaCcTtcaAACTTGACTTCAGCACGCGtgttGTAGTTCCCgtcATCTTTGAAAGAT
ATAGtgCGTTCCTGTACATAACCTTCGGGCATGGCACTCTTGAAaaAGTCAtgcCgtttcaTATGATCCggataAcGgg
aaaagcatTg > SEQ ID NO:4836 112105FL 267847_200119_1d
ttattctcttcttttttgacaAGAAAATATCATGAATTTCCTCTCATCTTTGGCAAAGAGCGCCGGCGGTCAATCCGCC
GACGAGCCTAAGAAAACCGCCGGTGAGGAAGCTTCAACTGCTGACCTTTTTTCCAGTGCGAAAGTGTTAgcatattcAG
CTCAAAGTCAATTCAACAAAGATTCCGGCAACGTCGATAACAAAAAAGTCGCTGCTGCTGCTGCTGATGTTCTTGACGC
TGCCACAGAAATACGGAAAGTTAGACGAAACTCAAGGTGTTGGACAGTATATTGAAAAAGCCGAAACTTATCTCCACCAG
TACGGTTCTGCTAACCCATCCACCACCACCGATGCCGCCGCTGCCAAAGGCCCCGGCAGCCACACCAGATACCAAAGATA
CAAAGGCACCTACACCGGCTCCGGCCGGCAGCAGATACTGATGAAACAAAGGCACCGGCACCGGCTCCTGCGGGCAGCAGA
TACTGAAGAAACAAAGGCATCGGCTCCGGCACCGGCGGCAGCAGATACTGAGGAAACAAAGGCACCGGCAACCGCAGAT
ACCGAAGAACCACCGGCACCGGCACCAGCACCGGCGCCGGCACCGGAAGAGAAGGGAGAAGGGTATGGGCAATACGTGA
AAATGGCAGAAGGATTTCTGAAATCAGGAGATGATGAATCAGCGAAAGCATCTGAAGGAGGATCAGATTATCTTAAGAT

FIG. 2 continued

```
GGCCGGTGACTTCTTAGGCAAGAAGTGATTAGTTTAATCAGATTCTTTTTAATAATGACTGTTATTTTCCAAGTTTTTC
TTCTTTCATTTTCTTTGCCACTGTTCAGTGTTCATTACCGGCGGCGAACTTCTTCAGTAGCCGTCGCCGGAGCTGGTTT
TTACTTGGCATGTATGTAATTTGTGTGTGTGTGTGTTTTTCCAGTATGATTTTTAGAGTGTAATGGAATTTGTGTTA
TATGGATAAAgTGATCCTTTATgatgtTATTGGTGtaTATGATATGGTCgtgAtTCTTAATTATAtTcgtcTTCCTTCT
AtTC > SEQ ID NO:4837 113072FL 1173756_302076_1d
agaaccctcgttctgtttctccccCCCCCCCCCCCCTCTCTCTCTCTCTCTCTCTCTCTCTTAACCAAAAGTGAA
GCATGGCTACCGTAGAGGCAGTAAAGCCCTGTGATGATGTACCCAAAGTAGAGACCTCCCTCCCTCCTCCTCCTGT
CAAAGAGGAGGTAAAGCCAGTAGAAGCTGAAAAAGAGGCAGCTCCCGAGGTTTCCAAGCCAGTAGAAGCTTCCGCTGAT
GTCAGAACTCCAAAGGATCGCGATGTGGCCCTaGCCAAGGTGAATACGGAGAAGAAGCTAGCTCAGATCAAGGCTTGGG
AGGAGAATAAGAAATCTAACTCCCTCAACAAATATCAATGTGAGGTTTCTAAAATTGATGCTTGGGAAAACTCAAAAAA
GGCTAGTGCTGAGGCGAAGCTCAAGAAAGCTGAGGAAGCGTTGGAGAATAAGAAGGCAGCCTATGTGGAAAGGATGAAG
AATGAGATTGCAGCCATCCACAAGCTGGCAGAGGAGAAAAGGGCAGCTGCAGAGGCCAAGAAGGGTGAGAATCTTGTTC
AGACAGAAGAAACAGCTGCCAAATACAGGGCCTCGGGTGAGATACCGAAGAAGATGATGTGCTTTGGAGGTTGATTCTT
CATATCTCTCTCACATTTAACTATGGGGAGGGTTCCTTCATATGCAAGAATATCACATTGGGGCATTATAGTCAATGGG
ATATCCACAGTACTAGAGCTATTgttTTTGATTTTTCACTtagaTTTTgtgTGAATGTATTTGGGTAgaCTATGATATT
ttgctTTGGGTATATATTCCTttccATGAAAGACATGATTAttgcgaaccatcGAATATGCTttgttaGGTAttcAATG
AATGATTgTatCATGc > SEQ ID NO:4838 113072FL 138543_300774_1d
gctgtttgttttggcgataccatttgcatggcttgcccagcatcgtcgtcgtcgtcgtcgggagcaaggaggaggagag
aCCATCGATCTTGATTGATTTGAAGCTAGATGGCGGAGGAGGCGAAGAAGGTGGAGGTGACCAAGGACATCGCCGAAGA
GAAGGCAGTGGTGCCGCTGCCGACGCCGCCGGCCACCGAGCACGACGACTCCAAGGCCATCGTCCTCGTCAAGGAAGCT
GAGGCTACAGGAGGTTCAGCTGAAAGAGATGCTTATCTCGCAAAAATTGTGTCGGAGAAGAGATTGGTACTGATCAATG
CCTGGGAGGAAAGCGAGAAAGCTAGAGCAGAGAACAGGGCGGCCAAGAAGCTGTCATACATCACTTCATGGGAGAATGC
AAAGAAAGCAGAGATGGAGGCTGAGCTGAAAAGGATCGAGCAAGAACTGGAGAAGAAGAAGGCGGCGTACGAAGAGAAG
CTGAAGAACAAGCTGGCATTGCTGCACAAGACGGCGGAGGAGAAGAGGGCGCTCACCACGGCGAAGCGTGGCGAGGAGC
TGATCATGGCGGAGGAGATGGCCGCCAAGTACCGTGCAAAGGGCGAGGCTCCGACGAAGCTGTTCGGGCTCTTGAAAGC
CTGAGAGAAATCATGAGGAGTTCATCATACATATATGCTGGGATTTGGTGTTGTTGATTAGTCTGTGAACTTACAGAAA
TTTGTATATGTGCAATGCATGGCATCCGTGTTTGCGTCGTGTGTATGTCGTCTAATTGAAGGGCCATTTGGTTTGTATT
TTGTCAGTTGGGTGGTTTGATTTCTGGTGCGTTTTGTAAAGGAATTGTGTATATGCATAGGGGAGTGCAGGCAGGGGAT
GATGGATTATGAATACGCTTATTCTTTCATGAAGATTTgttAGTAATTAAACATTCGTTAATTgttGTATTTTTTCAA
AATAACTgctTaGgttgCTCCTTTTTCTCTgttg > SEQ ID NO:4839 113072FL 135472_300414_1d
tgatatatttgctacgtcgtcggagaaacTCGTGCAGATAGCTTCTTTGGCTGAGTTGTTGGAGATGGCGGAGGTGGCGC
CGCCGGCGCCGGCGCCGGAGCCGACCAAGGACATCGCTGAGGAGAGGGCCGCCGTGCCGGCGCCGGAGGAGTCGAAGGC
CATGACCGTCGTCGATGATGCTGAGAAAGCTGCAGCAACAGGTGGCTCACACGAAAGAGACGCTCTCCTGACGACGGTC
GCCACGGAGAAGAGGATATCGCTGATCAAGGCGTGGGAGGAGAACGAAAAGGCCAAGGCCGACAACAAGGCGGCCAAGA
AGTTGGCCGACATCGCCTCATGGGAGAACTCCAAGGTGGCCGAGATCGAGGCCGAGATTAAGAAGTACCAAGAGTACCT
GGAGAGGAAGAAGGCAGAGCAGGTGGAGAAGCTGATGAACGGCGTGGCGAAGGTGCACAGGGCGGCGGAGGAGAAGCGA
GCGGCGACGGAGGCGCGGCGAGGGGAGGAGGTGGTGAAGGCCGAGGAGGCCgCAGCAAAGTACCGCGCCAAgGGAGAGC
CgcccaAGAaGTTGCTCTTCGGTTGAATCTCTTCTCGGTCATCTCcATTGATCGTCGtc > SEQ ID NO:4840 113072FL 142482_300435_1d
CCCGAGTTCGTGTGCTTCTCTCATTTGTTCCTTGATATATGGGCTACGTCGTCAGAGAACTCGTGCAGATAGCTTCTTT
GGCTGAGTTGTTGGAGATGGCGGAGGTGGCGCCGCCGGCGCCGGCGCCGGAGCCGACCAAGGACATCGCCGAGGAGAGG
GCCGCCGTGCCGGCGCCGGAGGAGTCGAAGGCCATGACCGTCGTCGATGATGCTGAGAAAGCTGCAGCAACAGGTGGCT
CACACGAAAGAGACGCTCTCCTGACGACGGTCGCCACGGAGAAGAGGATATCGCTGATCAAGGCGTGGGAGGAGAACGA
AAAGGCCAAGGCCGACAACAAGGCGGCCAAGAAGTTGGCCGACATCGCCTCATGGGAGAACTCCAAGGTGGCCGAGATC
GAGGCCGAGATTAAGAAGTACCAAGAGTACCTGGAGAGGAAGAAGGCAGAGCAGGTGGAGAAGCTGATGAACGGCGTGG
CGAAGGTGCACAGGGCGGCGGAGGAAA > SEQ ID NO:4841 113072FL 191556_300786_1d
ccccggctgttattagtacgcgccaccacgacgcccacgcacatcatcccTCCGCGCAAAAGCCTATCAACAGCTAAGC
CAAACAGGGTCAGGAGCCGGAGCCGTCCGGGAGAGGGAACACTCGAGCGATCCGTCCGTCCGCCCGCCCGTCGTCGTCG
CGCGCCATGGCTGAGGAGGAGGCCAAGAAGGTGGAGGTGGAGGTCACCGAGGCGCCACCCGCCGCTGCCGCTGCCGCGG
```

FIG. 2 continued

AGACGGAGCCGGCTGCCAAGGACGTCGCCGAGGAGAAGGCCGTCATCCCCGCCCCCGCGCCGCCGGCCGAGGAGGAGAA
GCCTCCCGTCGACGACTCCAAGGCGCTGGCCATCGTCGAGAAGGTTGCAGATGAACCTCCTGCCGAGAAACCTGCTCAA
GGGGGCTCTAATGACAGAGATGTTGCTCTTGCAAGGGTGGAAACTGAGAAGAGGAACTCATTGATCAAAGCATGGGAGG
AAAATGAGAAGACAAAAGCTGAGAACAAGGCTTCGAAGAAGCTATCTGCTATTCTTTCCTGGGAGAACACAAAGAAAGC
AAACATAGAAGCTCAACTGAAGAAGATTGAGGAGCAACTGGAAAAGAAGAAGGCTGAATATGCAGAGAAGATGAAGAAC
AAAGTCGCGATCGTCCACAAGGAAGCTGAGGAGAAGAGAGCAATGGTCGAGGCAAAGCGCGGCGAGGAAGTCCTAAAGG
CCGAGGAGATGGCAGCCAAGTACCGTGCCACCGGCCATGCTCCCAAGAAACTCATCGGGTGCTTTGGGGCCTAAAGAAA
TTTTCGATTCACAACGAGCAAACGTGAAAGTGTTCATCAGTGGTTGCTTTGCTTCTTTCACCCTCCCAAGTGCGTAGTG
TGTTTGTTGGTGCAAGAAAGGTCGTGCCTGGTGTGTAAAGTCTGGTGTTGCTGTATATAACATATTACTCCCAAGACAG
ATATGTTTGGTGCTGTACATGTTTGATGCTTGACAGGCAACATTCTTATGTGTAGTTAAGaAGCCACATTgttATTgtt
ATTgacAGTAAGCTGttTgttcc > SEQ ID NO:4842 113072FL 270343_200125_1d
gggcggacgcgtgggcggacgcgtgggaaaAGATCTTTCATCTTTCATTTCTGAGACTCTGATTCTGTTCCAAATCCTA
GAATTCTTCTTTTTTCTGAATTCTGTTTGTAGCCATGGCAGAAGTAGAAGCTACGAAAGTGGAGACTGAGAAAGTTGTG
GACCCTACTCCCCCTGCGCCTGAGGCTCCTGCACCTGTTAAAGAAGCAGAACCTGTTGTTGAAACTCCTAAAGAAGTGG
CTGATGAGAAAGCTATAGTTGCACCAGCTCTGCCTCCCCCTGAACAAGTCAAAGAAAAATCTGATGATTCTAAAGCACT
AGTTGTCGTAGAAGATAAAGCAGCAGAACCTGCTGAGGAGAAAAAGGAGGGATCTATTGACAGAGATGCTGTGCTTGCT
CGAGTTGCAACAGAGAAGAGACTCTCACTAATCAAAGCATGGGAGGAAAGTGAGAAATCAAAAGCCGAAAACAAAGCTC
AGAAAAATGTATCTGCAATTGCTGCATGGGAGAATAGTAAGAAAGCAAACCTGGAGGCTGAGCTCAAAAAGATGGAGGA
GCAGCTGGAGAAAAAGAAGGCAGAATATATTGAGAAAATGAGAAACAAAATCGCTCTACTCCACAAGGAAGCTGAAGAA
AAGAGAGCGATGATTGAAGCTAAACGTGGAGAAGATCTTCTTAAGGCAGAGGAATTGGCAGCAAAATACCGCGCCACTG
GAACTGCTCCCAAGAAACTCCTTGGATGTTTTTGAAGCAGCAAACATTAGACCTGCATCGATGGTGATTGAAAATGCTT
TTGTAAAGTTTGTGCAATTGGAATTTTTTTCTTCTTATTAGATACATTGTGTGATTATGTATTTTAGAATCAATCATTG
TTTATTATTATGTGTGCATAGTGATGTATTCCATTGTAT > SEQ ID NO:4843 113072FL 286126_200182_1d
AATTTTCATTAATGATGGCAGAAGAAACAGCTAAGGATGTTGCCGATGATAAAGCCATCGTTCCATTTGCTCTTCCTTC
TTCTAAAGAAGAAAAAGACAAATCCAATGACTCAAAACCTCTTGCCATCGTCGAAACTAAAGCATTAGTACCTGTTGAG
AAAAGAGGATCTATTGATAGAGATGCAACTCTTGCACGATTTACGACAGAGAAGAGGTTGTCCCTAATCAAAGCATGGG
AAGAAAGCGAGAAATCAAAAGCTGAAAACAAAGCTCAGATGAAAGCAATCTGAAATTCCTTGCATGGGAGAACAGCAAGAA
AGCAAGCTTGGAGGCTGAGCTCAAAAAGATTGAGGAGCAATTGTTGAAAAAGAAGGCAGAGTACATTGAGAAAATGAAA
AACAAGATTGCTCTACTCCACAAGTCAGCAGAAGAAAGAGAGCGATAATTGAAGCTAAACGTGGAGAAGATCTTCTTA
TGGCAGAGGAAACAGCAGCAAAACACCGTGCCACTGAAACTTCTCCAAAGAAACCTCTCCTTGGATGTTTTTGAAGTGG
CAAAATATCATATACTCCTATACAATTATTGGTTACAAACATTGTATAGTGAAGTGTGCGGACTGGGAATTTCTTTGCA
TTAGAAACAACATTGTGAGATTATGCTCCTGGAGATAATTATCTGTCAATTTTTATTG > SEQ ID NO:4844 113072FL 279832_200065_1d
tttttggattccttctatttatataaataaatatattcgtttaacaatatggcagaagcaattccagtacctcaagaac
cAGCTGTTGATAGTTCTCCAGCTGCCATGGCTACCAAAGCTGATGATTCTAAAGCTCTCGCCACTGTTCCTCCACCAAA
GACTGATTCTTCAACAAAGAAGAGTTCAAAGGGATCCCTCGATAGAGACATTGCTCTCGCACACCTTGAAACAGAGAGA
AGGAATTCTTATATTAAGGCATGGGAAGAAAGTGAAAAAAGCAAGGTGGAAAACAAGGCCGAAAAGAAGCTCTCTGCAG
TTGGGACATGGGAGAACACCAAGAAAGCAAATCTTGAAGCTAAACTGAAGAAACTTGAGGAGCAACTAGAAGAAAAGAA
AGCAGAATATGCGGAGAAGATTAAAAATAGAGTAGCCGCAGTTCACAAGGAGGCTGACAAAAGAGAGCTATGGTTGAA
GCCAGAAAGGGAGAAGAACTTCTTAAAGCAGATGAGATGGCTGCCAAGTATCGCGCCACCGGACAAGCCCCTAAGAAGT
TGCTTGGATGCCTTGGATGCTAAAGCTGTGAAAAGTTTGTTTCTCTTTTGTAAATTTTCAGGCTTGTTGCTCTTTATTG
GGTGTTTCAAACATGTCGAGTTTCCTATTTGTGTATGAAAGCACTCATGAAAATTTTAAGTGTTACGATAATTATAAC
TCcACttCAGATGTTTCTACTAga > SEQ ID NO:4845 113072FL 272630_200131_1d
TTCCTTTTTACATACAATACAATAGAAAGAATAAAGCACTCTAATTCTTTTTCTCCTTTTCCTTCATTTTTGAGTATTG
CTATAGTGAATTTGATTTCCCAATTCTTTTGTGGAAATCACCTTTTTGTCTATATATATATATAATTGACCAAAATGGA
AGCTACACAACAGCAATAGCCATGGCCGCCAACAATTCTAAAGCTGTCACCACCATGCCACCACCTCAAAGGCCCAGAA
GAAGCTCTCTAAAGTTGCAGCATGGGAAAACAGCAAGAAAGCACATCTTGAAGCTAAACTGAAAAAACTTGAGGAAAGA
TTAGAGAATATGCAGAAAAGATGAAAAATAGAGCAGCTTTAATTCACAAAGAGGCAGAGGAGAAGAAAGCGATGGTTAA
AGCTAAACGAGGGGAACAAATTCTTAGAACGGAGGAGATGGCTGCTAAATATCGCGCCACAGGACAAACTCCTAAGAAG
TTACTTGGATGTGTGGGATGATTAAAGCTTTTCCCTTGTATATTTTCATGCTTGCTGCTTTTAGTGTGTGTTCTTTTA
CGCATCAAGTTTTGTTGTAAGCTTCTAGTCTGTAAAGGATCTTACTAGTCTGCATAGGACAAACTCTCTTGTGCTCTAA

FIG. 2 continued

GGAATCCAGTGTCAATGATAATAAATCCACTTGAGAAGTTTTCGCAAA

> SEQ ID NO:4846 113072FL 258923_301701_1d
GCAGCATGGCGGAGGAACAGAAGATAGCGTTAGAATCAGAATCTCCGGCGAAGGTTACGACTCCTGCTCCAGCAGATAC
ACCGGCTCCAGCTCCGGCAGAGATTCCGGCTCCAGCTCCAGCTCCGACTCCGGCTGATGTCACGAAAGACGTTGCAGAG
GAGAAAATTCAAAACCCACCTCCGGAGCAAATTTTCGATGACTCCAAAGCCCTTACTGTTGTTGAGAAACCTGTAGAAG
AGCCTGCACCGGCGAAACCTGCGTCTGCATCGCTCGATAGAGATGTTAAGCTAGCTGATTTGTCAAAGGAAAAGAGATT
GTCTTTCGTCAGAGCGTGGGAAGAAAGCGAAAAGAGCAAAGCAGAGAACAAAGCTGAGAAGAAGATTGCAGATGTTCAT
GCTTGGGAAAACAGCAAGAAAGCAGCTGTCGAAGCGCAACTCAAGAAAATCGAGGAGCAACTAGAGAAGAAGAAAGCAG
AGTATGCAGAGAGGATGAAGAATAAGGTTGCAGCGATTCACAAGGAAGCAGAAGAGAGAAGAGCAATGATTGAAGCTAA
GCGTGGAGAAGACGTTCTTAAAGCAGAAGAAACGGCTGCTAAATACAGAGCCACTGGAATTGTTCCAAAGGCAACTTGT
GGATGtttctaataa > SEQ ID NO:4847 113072FL 230307_301056_1d
GGTGAATGGCCCACTTTTGATCCTGGCTCGCCATTTATCTTCCCCAATCCACATCCTCAAGAGCTCGGCTTTTGAAGCA
GAATGACGGAACAAGCGGTTCCCGCGGCGCACGCTCCAGTGGACAAGAATGTCACCGAGACACCCAGCCCGAAGTCGGT
GATTGGAACGAATGCCAACAGCCCCCCGTCGCCGACAGATGCCCCTGCTGGAGAAACCCACGCTCATGCCGCTGCTGCT
CATCCTGAGGCTACTCACGCGAAGACTGTCGGAAGTCCCACCGTCAGCAAGAATTCGCTCGGGTCCTCATTGAAGACCG
ATGGAGGCGGATCCATGGATAGAGATTCTGCTCTCGCCAAGGTCCAAAACGAGAGGACAATGTCTAACGTCAAGGCCTG
GGAAGAGAGCCGCAAAGCCAAAGCCCACAACAGGTGCGCTGCAGTGATTGCGAAGATCGGTGCCTGGGAGGCCGCGAAG
AAGGCCGCGTCCGAAGCAAAATTGAAGCAGTCAGAGGAAAAACTCGAGAAGAAAAGAGCCGCACTCGTGGAGAAGATGC
ACAACCAGATAGCAGCCGCACACAAGTTGGCCGAGGAGCGACGAGCTCTG > SEQ ID NO:4848 113072FL 186830_300667_1d
cccGAACACTCGAGCGATCCGTCCGTCCGCCCGCCCGTCGTCGTCGCGCGCCATGGCTGAGGAGGAGGCCAAGAAGGTG
GAGGTGGAGGTCACCGAGGCGCCACCCGCCGCTGCCGCTGCCGCGGAGACGGAGCCGGCTGCCAAGGACGTCGCCGAGG
AGAAGGCCGTCATCCCCGCCCCCGCGCCGCCGGCCGAGGAGGAGAAGCCTCCCGTCGACGACTCCAAGGCGCTGGCCAT
CGTCGAGAAGGTTGCAGATGAACCTCCTGCCGAGAAACCTGCTCAAGGGGGCTCTAATGACAGAGATGTTGCTCTTGCA
AGGGTGGAAACTGAGAAGAGGAACTCATTGATCAAAGCATGGAGGAAATGAGAAGACAAAAGCTGAGAACAAGGCTT
CGAAGAAGCTATCTGCTATTCTTTCCTGGGAGAACACAAAGAAAGCAAACATAGAAGCTCAACTGAAGAAGATTGAGGA
GCAACTGGAAAAGAAGAAGGCTGAATATGCAGAGAAGATGAAGAACAAAGTCGCGATCGTCCACAAGGAAGCTGAGGAG
AAGAGAGCAATGGTCGAGGCAAAGCGCGGCGAGGAAGTCCTAAAGGCCGAGGAGATGGCAGCCAAGTACCGTGCCACCG
GCCATGCTCCCAAGAAACTCATCGGGTGCTTTGGGGCCTAAAGAAATTTTCGATTCACAACGAGCAAACGTGAAAGTGT
TCATCAGTGGTTGCTTTGCTTCTTTCACCCTCCCAAGTGCGTAGTGTGTTTGTTGGTGCAAGAAAGGTCGTGCCTGGTG
TGTAAAGTCTGGTGTTGCTGTATATAACATATTACTCCCAAGACAGATATGTTTGGTGCTGTACATGTTTGATGCTTGA
CAGGCAACATTCTTATGTGTAGTTAAGAagCCACATTgttATTgttATTGACAGTAAGCtgttTgTTCTTTT > SEQ ID NO:4849 113595FL 1100690_301462_1d
gaaGTCGACACTGCCGGAACCCTAGCTCCTCTCTTAAGCTCGACCTCAGCTATGGCGGCGGCAGTAGCAGTAGCAGCCTCT
TCCTCCCTCTCTCTTTCCCGGCACTCTGCCGCCACGGCACCAGTGTCGCCCCTGCGTAGGGCCCTCCCCCCGTCGCTGC
CTTTCCCCGCCTCCCAAGCTCTCAAGCTCTCTACTTCGCCTTTCGTCCCAGCCACTCTAAGATTTTGCCCTTATCTGT
CAATGCGGTTTCAACTGAGGAAAAAACGTCATCATCGGTTGAAGCCGAAGTACCGGCCGAGGATTTAGTGGCCGACTTA
AAGGAAAAGTGGGATAAGCTGGAGAACAAGTCGACAGTCTTAACCTACGGCGGAGGTGCTTTGCTTGCCATTTGGTTCT
CTTCGATAGTTGTTTCTGCCATTAACGCAGTTCCCCTGCTTCCGAAGCTTATGAGTTTGTGGGCCTTGGATATACTGG
TTGGTTTGTCTATAGGTACCTTCTTTTCAAGGAAAGTAGGAAAGAGCTAGTCTTGGATATTGAGGATTTGAAGTCAAAG
ATAACCGGGTCTGGAAAGGAAGATTAGGCAAGGAGGGACTTATTCTATCCATGGCAAGTAAGGTGGTTTGTCTGTGTGT
GTTTtaGGTAggATAAATtt > SEQ ID NO:4850 113595FL 1120378_301864_1d
GTACGAGGCACTCGCACGGAGAGAGAGAGAGAGAGAAAGGAAGAGGAGATAGATAGATAGATAGATAGAGAGAGAGA
GAAGAGCCATGGCCACAGCTTCCATGGTTTCATTGCAGGCGCACAGCCATGGCCTTCCCCTTTTCACCTTCAACATCTCG
CCACTCCCACTCCCATTCCCCTTCACTTGCCTTCACAAGAATGCCCCCCCCCGCCAACCCTCTCAAGCCCTCCCTCTTC
ATCCCGTCAGG > SEQ ID NO:4851 113595FL 118050_300063_1d
cccacgcgtccggAAGAAAATATACTACTTTTGGGGATATCAAGAAACCAAAAAAGGAGATTTGAGATAGACAAGAAA
GAGAGGCCAAAGTTAAGCAATAAGCATACACCGCCAGCCCCAAAAATCTAAGCATCGGCCAAATGGCAGCAGCAGCTTC
TACTTCAATGGCAGCTACTGCCGTCTTTGCTTCTCGTTTCCCACTTTCCTCCACCACCAAAGCCGCCCCTGTTCGCTGC

FIG. 2 continued

```
TCCGCTTTGCCTTACCTTCCACCCCGCCTTTCTGCTACCGCGTTCTCTACTTCCTTCCAGTTTGCTGAACCCAAGAAGG
CTTCGCTACTCCAGGTCAAAGCCTCTTCATCAGAAGAATCCGGTGCTGTTGATACCAGTGAATTGTTGACAGATCTAAA
AGAAAAGTGGGATGCTGTTGAAAACAAGTCTACAGTTATAGTATATGGAGGTGGGGCAATTGTTGCAGTTTGGCTGTCT
TCAATTGTTGTTGGTGCTATCAACTCAGTTCCTTTGCTCCCGAAAATAATGGAGCTGGTGGGCCTTGGATACACCGGGT
GGTTTGTCTACCGCTATCTTCTATTCAAGTCAAGTAGAAAAGAATTGGCAGAAGACATTGAGCAATTGAAGAAGAAGAT
TGCAGGAACTGAATAAATGCACATAAATGGCAATGCCAGTTCAGACTGTTAAATTTTCTGTACAAGAGGCATCTGCTCG
TGTGAAGTAGAGTAGATTTTGTTGTAATTTTCTTCTATTCTGAGCAAATCTTCAAATAAAATAATGTATTTACCTTACA
GTTCATTGTGCTTATAAATTATATAGCAGTATCCACTCTGTTTCTATG

> SEQ ID NO:4852 113595FL 1186522_302133_1d
cgtgtcttgtccctactattcgacccacgcgtcgcccacgcgtccgcccacgcgtccgcccacgcgtccgcgaagcATT
TCCACAATCGCGTAGAGAGAGAGAGGGGAGACAGAAGAGAGAGAGAGATAGAGAGAGAGAGAAGCGATGGCCGCCACTGC
CGCCCTCTCTCTGCATGCACCCCCTTCGTTGGCGAATGCCGCCCCCTCCCCTTCTTCTCTCTCTCTCCTCTGCCCCT
TTCCCCAGAATGGCCTTCTCCGCTAGACCTTCCCTCCGCCTCTCAGGTAACCTAAGATTTTCACCTCTGCCCATCAAGG
CAATATCAACCGAGGAAAAACAAGCATCCGTAGAAACTGAAGCCCCAGTAGAAGATGTATTGGCGGACTTGAAGGAAAA
GTGGGACAAAATTGAGAACAAGTCAACTGTGTTCATTTATGGTGGAGGTGCTCTGGCTTCCATTTGGGTGTCATCAATA
GTCGTGGGAGCTATTAACACAGTTCCATTGCTTCCTAAGGTAATGGAACTGGTTGGACTAGGCTACACTGTTTGGTTTG
TGTACAGGTACCTCCTTTTTAAGGAAAGCAGGAAAGAGCTAGTCTCTGATATTGAGGATATCAAGGCAAAGATAGTCGG
TGTTGGTAAGGAAGAGTGAAGTAAAAGCTCAGAAGATATAATGTGGTATGTCTAGGGTTAAAAAGAAAattgtTCTATT
GAAGTTGACTcttgttcgCTTttgTAACGTttgactaCATTCCatgaaGGAggtggaaaatttgagTCAGattcctgct
GATGTGT > SEQ ID NO:4853 113595FL 254831_301639_1d
GACAGAAGAGAGAGAGAGATAGAGAGAGAGAGAAGCGATGGCCGCCACTGCCGCCCTCTCTCTGCATGCACCCCCTTCG
TTGGCGAATGCCGCCCCCTCCCCTTCTTCTCTCTCTCTCCTCTGCCCCTTTCCCCAGAATGGCCTTCTCCGCTAGAC
CTTCCCTCCGCCTCTCAGGTAACCTAAGATTTTCACCTCTGCCCATCAAGGCGATATCAACCGAGGAAAAACAAGCATC
CGTAGAAACTGAAGCCCCAGTAGAAGATGTATTGGCGGACTTGAAGGAAAGTGGGACAAGATTGAGAACAAGTCAACT
GTGTTCATTTATGGTGGAGGTGCTCTGGCTTCCATTTGGGTGTCATCAATAGTCGTGGGAGCTATTAACACAGTTCCAT
TGCTTCCTAAGGTAATGGAACTGGTTGGACTAGGCTACACTGTATGGTTTGTGTACAGGTACCTCCTTTTTAAGGAACA
GCAGGAAAGAGCTAGTCTCTGATATTGAGGATATCAAGGCAAAGATAGTCGGTGTCGGTAAGG > SEQ ID NO:4854 113595FL 247661_301622_1d
GCGGACGCGTGGGGGGAGATTTTAGGGCGAATTCCGGGGCGCGATGGCGGCATCTATCGCGGCATTCACGGCCGCTCCA
TCTTCTTGCTGCGCGGCGGCGGTGGCGTCGGCATCGGCCTCGTCGTCATCGATTCGGCCGCTTCCACTGAAAAGATCGG
TCCTCAAGCTCCACAGCGCGGCAATGCCGGGGTCTTTGAAGTTCTCTCCGCTCACAGTGATGGCTACGACCTCGTCCGA
GGAGAAGACAACTGGGACGACGACGTCGACGGAAGAAGTGAGCAAGCAAGTGGAGGACATTGTGTCGGATTTGAAGGAA
AAGTGGGATGGTGTGGAGAACAAGACTACTGTCTTGATTTACGGTGGTGGAGCGCTGGTCACGCTATGGTTCTCGGCAA
CAATCGTTGGAGCTATCAACTCGGTTCCATTGCTTCCAAAGGTAATGGAGCTTATTGGACTGGGATACACTGGCTGGTT
CGTCTACCGGTATCTTCTCTTCAAGTCGAGTAGAAAGGAGCTGCTGGAAGACGTGGAAGAGCTCAAGAAGAAGATCACG
GGCGCAACCGAGTAAGAAGACGAGTAGAGCGAGCTGTTTGATGATGTCCGAAAGAAGAAACTCTGACGTGCCTGGATGG
AACCAGGCCGGCTTTGATCGATCG > SEQ ID NO:4855 113595FL 191336_300740_1d
cccacgcgtccgggccagggaagagccaggtagAGCCGAAGAGGGTCCACGACTGACATGGCCGCCACGGCGTGCTCCA
CGGCGCCTCTTCTCGGTGGAGCTCGCCTCCCCGCCGTCGGCGCCGCCTTGCCGCCGCCCTCCGTTCTCCTCCTCCCCA
GCGCAACTTCCCCTCTCCTCTCCGCCTCCATGACGCACCGAGGCTATCTCTGCTCCGGGCGAGGGCGTCGTCCGACGAC
ACCTCGTCCTCCGCCGCGACCGGCGACGAGCTCATCGAAGACCTGAAAGCTAAGTGGGACGCCGTTGAGAACAAGTCCA
CCGTCCTCACGTACGCCGGCGGCGCCATCATCGCCCTCTGGCTGTCGTCCGTCATCGTCGGCGCCGTCAACTCCGTGCC
TCTGCTTCCCAAGTTCATGGAGCTCGTCGGGCTCGGGTACACAGGCTGGTTTGTGTACCGCTACCTCCTCTTCAAGGAA
AGCAGGAAGGAATTGGCCGACGACGTCGATTCTTTGAAGAAGAGGATTGCTGGGACAGAGTAAAAAATGCCGTCGTCTG
CACCAATTTTTTGGAACGATTCTTTGGATCGCACATTgcaGAGaccaaAACCCGTTGTtTagaGTACTAgTgttTGgTA
ccGCGAAGCTt > SEQ ID NO:4856 113595FL 186836_300667_1d
GACGAGCTCATCGAAGACCTGAAAGCTAAGTGGGACGCCGTTGAGAACAAGTCCACCGTCCTCACGTACGCCGGCGGCG
CCATCGTCGCCCTCTGGCTGTCGTCCGTCATCGTCGGCGCCGTCAATTCCGTGCCTCTGCTTCCCAAGTTCATGGAGCT
CGTCGGGCTCGGGTACACAGGCTGGTTTGTGTACCGCTACCTCCTCTTCAAGGAAAGCAGGAAGGAATTGGCCGACGAC
GTCGATTCTTTGAAGAAGAGGATTGCTGGGACAGAGTAAAAAATGCCGTCGTCTGCACCAATTTTTTGGAACGATTCTT
```

FIG. 2 continued

TGGATCGCACATTGCAGAGACCAAAACCCGTTGTTTAGAGTACTAGTGTTTGGTACCGCGAAGCTTTGTTTTGTTCCTT
TCCTTGATGGGCAATAACAGTGTCTTCACGTGTAGATCGAATTAATAATAATTACGAATTGCGTCTCGACT

> SEQ ID NO:4857 113595FL 181164_300654_1d
gaattcaagagaaaaacaagtaCAGAGAGAGTGAGTTTAGTGAAGAAGTAATGGCAACTATGTATGCAGCAGCAAGTGC
ATCTTCAATGCTAGTGGCAAGACCTCGTTTGCCAAAAACCATTAGCTGCTCAGCAGGTTTACCTTATCTTCCACCTCGT
CCATCCGTTTCTTCATTCTCTACCTCCATCAAAAACTACCCAGTGTCAAGCAGCAGATTTTCAACTCTCCGAGTCAAAG
CTGAGGAGACATCATCTGTTGAGGTTAATGATATAATTGAAGACTTAAAAGAGAAGTGGGATGGACTTGAAAACAAGTC
TACCGTTCTTATCTACGGTGGTGGTGGTTTGGTTGCACTTTGGCTATCTACAGTTGTGGTTGGCGCCATCAATTCAGTT
CCTTTGCTTCCAAAGATCATGGAACTAGTAGGACTCGGTTACACTGGATGGTTTGTCTACCGATACCTTCTCTTCAAGT
CAAGCAGAAAAGAACTAGCAAGTGATATCGAATCCTTGAAGAAAAAGATTGCAGGAACCACCGAATAGAGTCAGACATA
AGATGGTCTTGCAGTGGGGCTATTTTGTTTATTGTCCTTAGATTTATTTGAGAATCATTATATGGCTCTTGTTTTTTTA
GTTCTTCTGGATCTCATGTATAAGAGAGATTTATGTGAACCCTgttAATgttAATACTTCATt > SEQ ID NO:4858 113595FL 170256_300531_1d
ccccgagctGCTGCCTCTAGCTTACTTGGTGATAAGGAGGAGGAGGAGGAGGGCACCGACATGGCCGCAGCCACGGCGT
ACACCGTGGCGCTCCTCGGCGCCACCGGCGCGCGCGTCCCCGCCGCTCCACGCTCCGCCGCACTTCTGCCGCGCCGCGG
CGGCGTGCTCCAACCGCTGCGCCTCCAGGACGCGCCGCGACTGTCCCTGCTCCGCGTCAGGGCCGCCTCCGACGACACC
TCCACCTCGGCCAGCGGCGACGAGCTCGTCGCCGACCTCAAGGCAAAGTGGGAGGCGATCGAGGACAAGCCGACGTTCC
TCCTCTACAGCGGCGGCGCCGTCGTCGCCCTCTGGCTCCACCACCGTCGTCGGCGCCATCAACTCCGTGCCGCTGCT
CCCCAAGATCCTGGAGCTCGTCGGCCTCGGCTACACCGGCTGGTTCGTCTACCGCTACCTCCTCTTCAAGGAGAGCAGG
AAAGAGTTGGCGACCGACATCGAGACCTTGAAGAagaAgaTCGCTGGAACGGAGTAATTAAGCAGCTGCATTTGTCCGG
GGAAGTTTTGGGGGgtgACtCtctagagtgCtTGcTgctgctTCCTCTATgtgatgttTgtaTATCTCtAcgagaatAT
gttcTGCTcccAtgtgCagt > SEQ ID NO:4859 113595FL 122187_300016_1d
ccccagagtgtgagatcgagctgaaagAAAAAGAGAGGCCACGAAGAGAGCTCAGCTGCTGCCTCTAGCTTACTTGGT
GATAAGGAGGAGGAGGAGGAGGAGGGCACCGACATGGCCGCAGCCACGGCGTACACCGTGGCGCTCCTCGGCGCCACCG
GCGCGCGCGTCCCCGCCGCTCCACGCTCCGCCGCGCTTCTGCCGCGCCGCGGCGGCGTGCTCCAACCGCTGCGCCTCCA
GGACGCGCCGCGACTGTCCCTGCTCCGCGTCAGGGCCGCCTCCGACGACACCTCCACCTCGGCCAGCGGCGACGAGCTC
GTCGCCGACCTCAAGGCAAAGTGGGAGGCGATCGAGGACAAGCCGACGTTCCTCCTCTACAGCGGCGGCGCCGTCGTCG
CCCTCTGGCTCACCACCGTCGTCGTCGGCGCCATCAACTCCGTGCCGCTGCTCCCCAAGATCCTGGAGCTCGTCGGCCT
CGGCTACACCGGCTGGTTCGTCTACCGCTACCTCCTCTTCAAGGAGAGCAGGAAAGAGTTGGCGACCGACATCGAGACC
TTGAAGAAGAAGATCGCTGGAACGGAGTAATTAAGCAGCTGCATTTGTCCGGGGAAGTTTTGGGGGGTGACTCTCTAGA
GTgcttGCTgcTGCTTccTCTGTGTGATGttTgtaTATCTCTAcgagaaTATgttctgctCCCATGTGCAgtaACAgcg
TaGTGCAAAAACtgtatCaAACCTACTATCAGTTgtttcTTCG > SEQ ID NO:4860 114417FL 137759_300686_1d
TGATCCACCGTCACGTGCTCTTCCTGAAAATAATGAGCCTATATTGCCATTGCCGAAACAAACACCTCAAAAGTACAAT
GGAGCTGGTTCACACAGCAATCACCACTACAGGGGCCGTGGAAGAGGTAGAGGCAGCGCGTTTTCGCAGTCAGTAACAA
ATTTTACTGAAGAATTTGATTTCATGGCCATGAATGAAGGTTTAACAAAGATGAAGTCTGGGGTCATCTTGGTAAGAA
ATCCCATTCAAGGGACAAAGATGGTGAGCTGGGCGATGATGTGTTTGATGAAGACCTGGAGGATGAGGAAACAGAAAAT
CCTGAGCTAGCTGCTAAGCCTGTTTATGTCAAGGATGACTTTTTTTGATTCCCTCACTAGTGGAACATTTGGACGTGGAG
GGCAAAACGGGAGGTCAAGATTTTCCGAACAGCGCAAACTAGATACAGAGACTTTTGGTGATTTCCCAAGGCATCGCCA
GCCCTATCGTGGTGGGGGGCGTGGTTACCGTGGCGGCGGTCGCGCCCGTGGGTCATACTACGGTGGCAGAGGGTATGGA
AGCATGGGAGCAAGGGGTGGGCAGGGTAATTCTTACCCTCA > SEQ ID NO:4861 114417FL 160823_200168_1d
acaagacttctgtttctgctattgcctcatcgacattaagtgctagtttacctactttgcctcctttgacaacaagtcc
tGATGTACCGGCAATATCTATTAAACCCAATCCAGTACCTAGCCCAGCTTTGTCTCAATCTGTATCTACTGTCATGGGG
CCATCCAGTTCTAATCTAGTGGAGACACCCACACCTTCTCTGGTAACTCCGGGGCAGCTGCTGCAATCTGGACCAATTG
ATGTTCCATCAACTCAATCTACACAGACAGCTCAAAAAGATGTTGAAGTGGTACAAGTATTGCCTGCCACCATCTTCAGA
AACTCCAGCTCCGGTTAAAACAGAAGCTCAGCCACCAATATTACCATTACCACCTCAGACACGTGTGCAGAAGACAAAT
GGAGCTCCATATCAGGCACGTTACAACAACTACAGAGGGCGCGGTGGAAGAGGAATGGGGGTTTCAAGACCGGTAACAA
AATTCGAAGAGGATTTTGATTTTATGGCCATGAATGAGAAGTTCAAGAAAGACGAAGTGTGGGGTCATCTTGGCAAAAG
TAACAGAGAAGGAGATGGAAATGGCAGCGACGAAGATGTCTCTTTCAATGAATATGATGATGTTCTTCCTAAGATTGAT
GTCAAGGTGGTTATTTAAATTCTCTTTGACCTCAATTCTTATGCATACCCttgtcCACGTATCTTGGACCTAGCTTtgt
aTTTATGTCAGTGTTGTCAAAAGCGCGCATAAAGCGCACTCAAGCCCCGATTCGAGGTCCAAAACATGTTGAGCGCTTT

FIG. 2 continued

```
GCTTCGCtttgtgTGCGCTGTAGTGTCACATCAAAGCTCTAAAGCATACTTTTCCTCGTCAATgaGTGTAATCCTGAAA
aggctacattaaacaaTTAATATTTCACTCTCGTAAattttT
```

> SEQ ID NO:4862 116461FL 108386_300381_1d
```
AGATCCATACACAAATACTCGATAAAACTCTCCTTGTATCTGAATCTAATCAACTTCTCAGATCCAAACTCCGATCGGA
ACAATGTCCTCGACTTTCAGCGGCGATGAAACTGCTCCTTTCTTCGGCTTCCTCGGCGCCGCTGCGGCTCTCGTCTTCT
CCTGCATGGGAGCAGCGTACGGAACAGCAAAGAGCGGTGTAGGAGTGGCGTCTATGGGAGTGATGAGACCAGAGCTGGT
GATGAAATCCATTGTTCCGGTGGTTATGGCTGGTGTGTTGGGTATTTATGGTCTGATTATTGCTGTTATTATTAGTACT
GGTATTAATCCCAAAACAAAGTCGTATTACCTGTTTGATGGATATGCTCATCTCTCCTCGGTCTCGCTTGTGGTCTTG
CTGGACTTTCTGCTGGAATGGCTATTGGTATTGTTGGTGATGCCGGTGTTAGGGCTAATGCACAACAGCCAAAGCTTTT
TGTTGGGATGATCCTCATTCTCATTTTTGCTGAAGCTTTGGCTCTTTATGGGCTTATTGTTGGAATTATATTGTCTTCA
CGAGCTGGGCAGTCCAGAGCAGAGTGAAGTTGGCTTATTAATACTATTCTTACTATGATGTATGTGAGACTCAGTAAAC
CCTGGCAAAACTTGATCCTTGCTAAAGTCAAAAAGTTATCTATGTCTATGTTTgTTATTCATGTTGGCACGGTtgcTAC
TGGTGCTGCTATGTGCTGTTTGTanaAAAATaggagTGagtAtTTATTTTAATAATAACTTAaGAaGttttcgtATtTg
acc
```

> SEQ ID NO:4863 116461FL 1117003_301817_1d
```
aaggcgtaaggtgggggaatacccgtgctgtggtggtggtgtggtggtggtcactggtcttcttcacaagccatatact
aCTACTAGTTGGAGTGGAGAGAGAGAGAGGGAGAGAGAGATCTGATTCATCTCTCTGATAATAAATCAAATTGATCA
TTGAATCAGAGAGAGACAGGATGGCGACGATGGAGTTCAATGGCGATACGACAGCCCCTTTCTTTGGATTCCTTGGGGC
TGCCTTTGCTCTCATCTTCTCTTGCATGGGTGCTGCATATGGAACTGCAAAAAGTGGTGTTGGAGTTGCGTCCATGGGA
GTGATGAGGCCCGAGCTAGTAATGAAGTCTATAGTCCCAGTTGTTATGGCTGGTGTTTTGGGTATCTACGGCCTCATTA
TTGCGGTTATTATCAGTACTGGAATAAATCCCAAGAGCAAAGCTTATTACTTGTTTGATGGCTATGCCCATCTCTCATC
AGGGTTGGCTTGCGGTCTTTCTGGTCTCTCCGCAGGGATGGCCATTGGCATTGTCGGAGATGCTGGTGTAAGAGCTAAT
GCACAACAACCAAAGCTTTTCGTGGGCATGATTCTGATTCTTATCTTTGCTGAGGCTCTTGCCTTGTACGGTTTGATCG
TGGGAATCATCTTATCGTCCCGTGCAGGACAATCTAGGGAGTGAGGCTACGCATGgTTTTGTGATCTGTTTATCGAATA
ATCaaGAACGCcgggttcacaaggctaccCTtgaagTTTTGTGATGccATAtg
```

> SEQ ID NO:4864 116461FL 1116185_301810_1d
```
ttcctctcTCTCTCTTCCTATCTTCCTTGTTTGATCTCTGATCCGGCAATGGATTCCAATGGAGATGCCACCGCTCCTT
TTTTCGGCTTCCTCGGGGCCGCCTTCGCTCTCATCTTCTCTTGTATGGGGGCTGCATATGGAACGGCAAAGAGTGGTGT
TGGGGTGGCCTCCATGGGTGTCATGAAGCCCGAGCTAGTGATGAAGTCGATAGTTCCGGTGGTTATGGCTGGTGTTTTG
GGTATCTACGGCCTCATCATTGCAGTCATCATCAGTACTGGAATCAATCCCAAAAGTAAATCATACTACCTCTTTGATG
GCTATGCCCATCTCTCGTCTGGATTGGCTTGTGGCCTTTCTGGTCTATCCGCTGGTATGGCCATTGGTATCGTTGGGGA
TGCTGGAGTCAGAGCTAATGCACAACAGCCAAAGCTATTCGTAGGCATGATCCTGATTCTTATCTTTGCTGAGGCGCTT
GCGTTGTATGGCTTGATTGTGGGCATTATCTTGTCATCACGCGCTGGCCAGTCCAGGGAGTGAACTTGAGACTCCGGTA
TGCATTGAATGATCAAGGACTCGTCTCTTTTGTGAGATTAGCCTAAGTTTTTTAATGGTAGAGACGCCTTATCAAGACA
TGtTTCATCATATTCAaGTGATAGCCTGTGCTagagcATCTGCTATag
```

> SEQ ID NO:4865 116461FL 144378_200134_1d
```
agcacgtgaatatcaccgaattatcaattattgcgtcaacagccaatcaaagagggagAGAGAACGAGGGAGGAGCAAC
CAGAAACAGATCTATTCAACTCCAAAACTCAAAAACACTGTATATTTACAGTTCTCAGATCCAAATCCTAACGACAATG
TCGACCTTCGCCGGAGATGAAACTGCTCCTTTCTTCGGCTTCCTTGGCGCCGCCGCGGCCCTCGTTTTCTCCTGTATGG
GGGCAGCTTATGGAACAGCAAAGAGTGGTGTTGGAGTGGCGTCAATGGGAGTGATGAGACCTGAGTTGGTGATGAAATC
TATTGTGCCAGTGGTTATGGCTGGTGTGTTAGGTATTTATGGGTTGATTATTGCTGTGATCATCAGTACTGGGATTAAC
CCCAAAACGAAGTCGTATTACCTATTTGATGGCTATGCTCATCTCTCCTCCGGTCTTGCTTGTGGTCTTGCTGGCCTTT
CTGCTGGAATGGCTATTGGTATTGTTGGTGATGCTGGTGTTAGGGCTAATGCACAACAACCTAAGCTTTTCGTTGGGAT
GATCCTCATTCTCATTTTCGCTGAAGCTTTGGCTCTTTATGGACTTATTGTTGGCATTATCTTGTCTTCCCGAGCTGGC
CAGTCTAGAGCTGAGTGAAGTTAACTCCATTCTTACCGCGTTGTATGTGGACTTCAGTAGACCGAGGCAGTCAAAAGT
ATCTAATACGTGTATTGTTATTCATTATCCCACAGCTGGAACTTAATTCAGTGGTGCAATGTTCTGTCTGTAGAAATAG
GAATTAAATTTTTCTACTCAATAATAATAGCTTAAAGAGCTGTGCAATTTGGTCAGTATTTATCGTATATTTTGCGGTG
AACGGTCTGAACCATTTTGTTTATGAGATTCGTGCATGTATCATTTCATCTTGATTTATTATGTTGATTGTGCAACATC
TATGAGTTTGAGCt
```

> SEQ ID NO:4866 116461FL 157054_301734_1d
```
accgatcagaaaaattgtcatcaaaattccgatcggtcactggcgaaatctctgataaactgaaaaaaatgtcatcaac
tTTCAGCGGCGATGAAACGGCGCCCTTCTTCGGTTTCCTCGGAGCAGCTGCAGCTCTCGTTTTCTCCTGTATGGGAGCT
GCTTATGGAACGGCGAAGAGTGGGGTGGGGGTAGCCTCAATGGGAGTAATGAGGCCAGAGCTTGTGATGAAGTCAATTG
```

FIG. 2 continued

TGCCGGTTGTTATGGCCGGAGTGTTAGGTATTTATGGTTTGATTATTGCGGTAATTATCAGTACGGGAATTAACCCTAA
GACCAAATCATATTACCTTTTTGATGGATATGCGCATCTTTCTTCTGGTTTGGCTTGTGGTCTGGCTGGCCTTTCCGCT
GGAATGGCTATTGGAATTGTTGGTGATGCTGGTGTTAGAGCAAATGCACAACAACCAAAACTGTTTGTTGGTATGATCC
TGATTCTCATCTTTGCCGAGGCATTGGCTTTATACGGACTGATTGTCGGCATCATCCTTTCTTCCCGTGCTGGTCAATC
TAGAGCAGAATAGAAATTAATGATTTCCAGGTTCATGATGGAATCATTTTGCATCATTGTGCTGGCAGTTTGGTAACTG
ATACTGGTTTAGATGCATCTTTTCCTTTTCCGTCACACTGTGTAGATTTGGAAGCTGCTTTTTCCCTGCATGCAATCTA
GAGAACGTTCTCTTAATTTTTCAATTGCTATATTTTGCAATAATGAGGAGCATCTTGTTGGTTGAATGCTGATACAATT
GTATAATTTTTGTtggaaTGcattTATTACCTCGGTATATG > SEQ ID NO:4867 116461FL 160365_200006_1d
gatcAATAAGCCTTTTTTTCCCTCTCAGATCGCGAATCGCTTCAATACCAATTCGAAGAAAAAAAATGGCATCGACTT
TTAGCGGCGATGAAACGGCACCGTTCTTCGGGTTCCTCGGTGCTGCAGCTGCCTTAGTCTTCTCCTGTATGGGAGCAGC
TTATGGAACAGCGAAAAGTGGGGTAGGGGTGGCATCGATGGGAGTAATGAGGCCGGAATTGGTGATGAAGTCAATTGTG
CCAGTTGTTATGGCTGGAGTTTTGGGTATTTATGGGTTAATTATAGCTGTGATTATTAGTACTGGGATTAATCCTAAAA
CAAAGTCGTATTATTTATTTGATGGATATGCTCACCTTTCATCTGGACTTGCTTGTGGTCTCGCTGGCCTTTCTGCTGG
TATGGCTATTGGAATCGTTGGCGATGCTGGTGTTAGAGCTAATGCACAGCAGCCAAAGCTTTTCGTTGGGATGATTCTG
ATTCTTATTTTCGCTGAAGCCTTGGCTCTTTACGGCCTTATTGTCGGCATCATCCTCTCTTCCCGCGCTGGTCAATCTA
GAGCAGAGTAGAGAAAGATCTTCTCGTGTTCCATATTTGTGTAGTATCTTTGTGTTCTTCCTCGTTGGACGAGTGAGTT
TGGCTGTTAAATCACATTTTGTTTTGATTTGGGCTCCAAGATTATGTATTTGTTTGCGTGGCtagagAATTGgttACGT
GCAGATCaGCTGTAGattagatCTCTCaATAAggATAtcaGtTTTTCTGATGCTCcAt > SEQ ID NO:4868 116461FL 158173_200001_1d
GGAACTTTTAGATCCGATCATTACACTTCTTCTCTCTCCAAAAACAACTTCGCAGAAACAATGGCGTCGACTTTCAGCG
GCGATGAAACAGCTCCCTTCTTCGGCTTCCTCGGCGCTGCCGCTGCCTTAGTCTTCTCCTGTATGGGGGCAGCTTATGG
TACTGCTAAGAGTGGGGTAGGAGTGGCATCTATGGGTGTGATGAGGCCAGAGCTAGTGATGAAGTCTATTGTGCCCGTG
GTTATGGCTGGAGTTTTGGGTATTTATGGATTGATTATAGCTGTGATAATCAGTACTGGCATTAACCCAAAAACCAAGT
CTTATTATCTTTTGATGGCTATGCTCACCTTTCTTCTGGTATTGCTTGTGGCCTTGCTGGACTTTCTGCTGGTATGGC
CATCGGAATCGTTGGTGATGCTGGTGTTAGAGCTAATGCGCAACAGCCAAAGCTCTTTGTTGGGATGATTCTGATTCTT
ATTTTCGCTGAAGCCCTGGCTCTTTATGGCCTTATTGTTGGCATCATTCTCTCTTCTCGTGCTGGCCAGTCCAGAGCAG
AGTAGAAGATGAGCATGTTATGCTCCGTAACTGTGAATTATCTNTTTGTTCTTCCGCATTGGATGAGATAGTCTGGCTG
CTGAATTATGTTA > SEQ ID NO:4869 116461FL 47337_300170_1d
TCTCATTCCCGATCAGATCTCAACGACGACGAGCCATGGCTTCAACTTTCAGCGGCGATGAAACTGCTCCTTTCTTCGG
ATTCCTTGGCGCTGCCGCCGCTCTCGTTTTCTCCTGTATGGGAGCAGCGTACGGGACAGCGAAGAGCGGGGTTGGTGTA
GCGTCGATGGGTGTGATGAGACCAGAGCTTGTGATGAAATCGATTGTTCCTGTTGTTATGGCTGGAGTTTTAGGTATTT
ATGGTTTGATCATTGCTGTTATCATCAGTACCGGAATCAACCCTAAGGCCAAGTCTTACTATCTATTCGATGGCTATGC
TCATCTCTCTTCCGGTCTTGCTTGTGGTCTCGCTGGTCTCTCCGCCGGTATGGCTATTGGAATTGTCGGCGAT > SEQ ID NO:4870 116461FL 255765_301643_1d
CATTGAATCAGAGAGAGAGAGGATGGCGACGATGGAGTTCAATGGCGATACGACAGCCCCTTTCTTTGGATTCCTTGGG
GCTGCCTTTGCTCTCATCTTCTCTTGCATGGGTGCTGCATATGGAACTGCAAAAAGTGGTGTTGGAGTTGCGTCCATGG
GAGTGATGAGGCCCGAGCTAGTAATGAAGTCTATAGTCCCAGTTGTTATGGCTGGTGTTTTGGGTATCTACGGCCTCAT
TATTGCGGTTATTATCAGTACTGGAATAAATCCCAAGAGCAAAGCTTATTACTTGTTTGATGGCTATGCCCATCTCTCA
TCAGGGTTGGCTTGCGGTCTTTCTGGTCTCTCCGCAGGGATGGCCATTGGCATTGTCGGAGATGCTGGTGTAAGAGCTA
ATGCACAACAACCAAAGCTTTTCGTGGGCATGATTCTGATTCTTATCTTTGCTGAGGCTCTTGCCTTGTACGGTTTGAT
CGTGGGAATCATCTTATCGTCCCGTGCAGGACAATCTAGGGAGTGAGGCTACGCATGGTTTCGTGATCTGTTTATCGAA
TAATCAAGAACGCCGGTTTCACAAGGCTACCCTTGAAGTTTCGTGATGCCATATGAGTGCGGCAGATTGTCCCGATGA > SEQ ID NO:4871 116461FL 252921_301610_1d
gctttgttttctctctctcttgatccagcttcggaggttggctatggcgacgatggacttcaacgggatacgacgg
cCCCCTTCTTCGGATTTCTGGGAGcaGCCTTTGCCttgATCTTCTCTTGTATGGGTGCGGCATATGGAACAGCAAAGAG
TGGAGTTGGGGTTGCTTCAATGGGTGTTATGAGGCCTGAGCTTGTGATGAAGTCCATAGTTCCAGTGGTTATGGCTGGT
GTCTTGGGTATTTATGGTTTGATCATAGCTGTCATTATCAGCACAGGAATCAACCCCAAAAGCAAGGCATATTACTTGT
TTGATGGATACGCCCATCTCTCGTCGGCCCTAGCTTGTGGGCTTCTGGTCTTTCAGCTGGAATGGCAATCGGGattgt
tGGTGATGCCGGTGTCagggcaaATGCACAGCAGCCAAAGCTTTTTGTTGGCATGATTCTGATTCTTATTTTTGCGGAG
GCTCTTGCTTTGTACGGTTTGATCGTCGGCATTATTCTCTCTTCTCGTGCAGGTCAATCAagggaATGATTCTTCCATG
CCCTTTGATTCTACCCATTCCAACTATCCAAATTATATTGTCCTATGGTAGGACATGTTTTTCTTTCTTTTTAACTAT

FIG. 2 continued

ATTTTTTTCTTCCGGatttGACCAATAAGGAAACAAAGAAggcaactcTTTGtttcaaTGagttttcATCTCTTagTGG
ATGTATGCttttCTTTCATGAGTGATAAgaaataTCAtt > SEQ ID NO:4872 116461FL 248040_301579_1d
TAAGGGATAGATCCGTGGATAGCCGGGGAGGAGAATCGGATCCATGGCGTCGACCGATGCGTTCAGCGGCGATGAGACG
GCGCCCTTCTTCGGATTCATCGGCGCCGCCGCAGCTCTGGTCTTTTCCTGCATGGGAGCTGCGTATGGGACGGCAAAGA
GTGGTGTTGGCGTCGCGTCCATGGGTGTGATGCGGCCGGAGCTGGTGATGAAATCGATCGTCCCGGTGGTCATGGCGGG
AGTGCTGGGAATTTACGGCCTCATCATCGCTGTGATCATCAGCACCGGGATCAACCCAAAGGCCAAGTCGTACTACTTG
TTCGACGGCTATGCTCATCTATCGTCGGGCCTGGCCTGCGGTCTCTCCGGTCTCTCGGCAGGCATGGCGATCGGCATTG
TCGGTGATGCGGGTGTCCGGGCCAATGCACAGCAACCCAAGCTTTTTGTGGGAATGATCCTCATACTCATCTTTGCCGA
GGCTTTGGCTCTATACGGTCTCATTGTTGGAATCATTCTGTCGTCCCGTGCCGGTCAGTCCAGAGGATAAGCAGCAGCG
TTAATTTTAAGGTGGTTTATATGCGAGCATTCTTCTTAGCGTTTTTTGTTTTGCTTACTGCTTGTATTATTATTCCTTC
CAACAAATAATTCTCGCTTATTAaaaaaaaa > SEQ ID NO:4873 116461FL 23121_300070_1d
CCCACGCGTCCGCTCGATTTCAGATTTAAGATCTCAGATACAAAACTCCGACATGTCTACGTTCAGCGGCGATGAAACA
GCTCCCTTCTTCGGCTTCCTCGGCGCTGCAGCCGCACTCGTTTTCTCCTGTATGGGAGCTGCTTATGGAACCGCAAAGA
GTGGTGTTGGTGTGGCTTCTATGGGAGTTATGAGACCTGAGTTGGTGATGAAATCTATTGTCCCTGTTGTTATGGCTGG
AGTGTTGGGTATCTATGGATTGATCATTGCTGCTGTTATCATCAGTACCGGGATTAACCCCAAGGCTAAGTCTTACTACCTC
TTTGATGGATACGCACATCTCTCGTCTGGTCTTGCTTGCTGTGGTCTTGCTGGTCTCTCAGCTGGAATGGCCATTGGGATTG
TTGGTGATGCCGGTGTCAGGGCAAATGCTCAGCAGCCTAAGCTCTTTGTTTGGGATGATTCTTATCCTTATTTTCGCAGA
AGCGCTTGCTCTTTACGGGCTTATTGTAGGAATCATTCTTTCCTCACGAGCTGGCCAGTCTAGAGCTGAATGAGAATCT
AAACCACAAGACTGCTCAAAGGTACTTCCTTTACTTCTGTGTGCGTTTTGTTTTATCGTGATTAGTATGATGTATCATC
GGGAACCAAAAATTTTACTGGATTCTTGGAAATTTGTTTCGGAAACAAAACCGCCTATCTTCATTCTCCTTTTCTTTTC
CGGTGGTTACTCTCCGATGTAGAATTTTATTGTTTGATTCTGTAATAAAGAAGCTCTGAGGAGTTTGGTATGTTTTTGT
ATTCTTGTATTTGTCCTGAGGAAGTTAAATACATTTATTTGTAAAGAAGTTTGCTTTTCTGAAAAAAA > SEQ ID NO:4874 116461FL 213257_300851_1d
ACATATTAAAGCCCCAGCAGGCCAAGTCATCGACAGCGTCCCTCGCGCATCTGCCAGACTTCGGAAGCTTCGCACGAGC
ACCAGAAACCACTCCTCCCTACGCCTCTTTAAAATCTTTATCGCTTCGATAACCCATCGTCGTCACAATGGCCACCGAA
CTTTGCCCCGTCTACGCGCCCTTCTTTGGTGCCATGGGCTGCACCTGCGCCATCGTCTTCACCTGCCTGGGTGCCTCAT
ACGGTACTGCCAAGTCTGGTGTTGGTATTGCCGCCATGGGTGTCCTCCGCCCTGACCTTATCGTCAAGAACATTGTCCC
CGTTATTATGGCTGGTATCATTGGTATTTACGGCCTCGTCGTTTCCGTCCTGATCTCCGATGGTCTCAAGCAGGACCTC
CCTCTCTACACTGGCTTCATTCAGTTTGGTGCTGGTCTCTCTGTCGGTCTCGCTGGTCTCGCTGCTGGTTTTGCCATCG
GTATTGTTGGTGATGCTGGTGTCCGAGGAACTGCCCAACAGCCCCGTCTCTTCGTCGGAATGATTCTGATTCTTATTTT
TGCTGAAGTCTTGGGTCTTTACGGTCTCATTGTTGCTCTGTTGATGAAc > SEQ ID NO:4875 116461FL 201454_300716_1d
aagagatcgatcgatcgatcaaccgatctcgccggagaaggaagaggagcaAAGATGTCGTCGGTGTTCAGCGGCGATG
AGACGGCGCCCTTCTTCGGCTTCCTCGGCGCCGCCTCCGCCCTCATCTTCTCATGCATGGGTGCGGCGTACGGGACGGC
GAAGAGCGGCGTCGGCGTGGCGTCCATGGGCGTGATGCGCCCGGAGCTCGTGATGAAGTCCATCGTGCCCGTGGTCATG
GCTGGTGTGCTCGGTATCTACGGCCTCATCATCGCCGTCATCATCAGTACAGGGATCAACCCCAAGGCTAAGCCGTACT
ACCTCTTTGACGGCTACGCGCATCTGTCGTCCGGGCTCGCCTGTGGCCTCGCCGGTCTCGCTGCCGGAATGGCCATCGG
CATCGTCGGTGATGCTGGTGTCAGGGCAAATGCACAGCAACCAAAGCTTTTCGTGGGCATGATCCTCATCCTCATTTTC
GCAGAAGCGCTTGCCCTGTATGGTCTCATTGTGGGCATCATCCTCTCATCCCGTGCCGGCCAATCTCGTGCAGATTAGG
CACTTTGCGGTACCATACCGCTGTTATTCCACTGGCTATATTCTTGAGAAAACCTGAAACTTACTTGGGAGCTCTAGTT
TAATGTATTAAAAGATCGATTTGTAGCTTAAGGAAGGTGGCACTTCCAGTCCTTTTTGTTTCTTTTGTGGTGGTTCATG
CAAAGTTTTTTGGGTTAGGCTGGATTTGCTGCTCCTGAGCAAACGGATTTAATCTCATTCGTGGTGAATAAAAAACACG
GgattGTAGCT > SEQ ID NO:4876 116461FL 190803_300736_1d
ctgaatcCCCAAATCGAAGCACTCCTCTCCTCTCCTCTCCTCAGATCGGATCGCGAGAGCCCCAATCCCACCACCGATC
GATCCATTCCTGCTGCTCGCGGCCACCGGAGAAGGAGAGAGAGAGAGAGCTCGACCTCGTCGGCGGGTGAAGGATCGCA
GCAGCAGCAGCGGCGGTAGAGCAGGAGGAGAGGCGAAGATGTCGTCGGTGTTCAGCGGCGATGAGACCGCCCCCTTCTT
CGGCTTCCTCGGCGCCGCCTCCGCCCTCGTCTTCTCATGCATGGGGCGGCGTACGGGACGGCGAAGAGCGGCGTCGGG
GTGGCGTCGATGGGGGTGATGCGCCCGGAGCTCGTGATGAAGTCCATCGTGCCCGTGGTCATGGCTGGTGTGCTGGGTA
TCTACGGCCTCATCATCGCAGTCATCATCAGCACGGGGATCAACCCCAAGGCCAAGCCCTACTACCTCTTCGACGGCTA
CGCCCACCTCTCATCTGGCCTCGCCTGTGGTCTCGCCGGTCTCGCTGCCGGAATGGCCATTGGCATCGTTGGTGACGCC

FIG. 2 continued

GGAGTCAGGGCGAACGCCCAGCAACCAAAGCTGTTCGTGGGTATGATCCTCATCCTCATTTTTGCCGAAGCGCTTGCTC
TCTATGGGCTCATCGTCGGCATCATCCTGTCATCCCGCGCTGGCCAATCTCGTGCGGATTAGGCATGTTTCAACACGCA
AACCCTTAGTGGGTTCTTGTTTCATATTCCTGAAACTACAAGCTGACCTCTAGGGGTTTATTCTGTCTTAGTTTCTGTT
CTTCTGTTGGGTCATGAACAAAAAAACATCTGTATCCAAGGGATGTTTGCCCTTGTGGTGCCATTCTTTTTCGCTATGG
TGGTGCTGGCGGCGGTCTGAATCTTATTTATGCACAGTTTTTTTGGGTCTGGCTAGACAGTGATGTAATCTGGTGAATA
AGCAAATAATTCGTAATGCAATGGGAGCATGAGACTCTTTTGTTCACT

> SEQ ID NO:4877 116461FL_56446_300139_1d
TACTGGTATTAATCCCAAAACAAAGTCGTTTTATCTGTTTGATGGATATGCTTCTCTCCTCGGTCTCGCTTGTGGTCT
TGCTGGACTTTCTGCTGGAATGGCTATTGGTATTGTTGGTGATGCCGGTGTTAGGGCTAATGCACAACAGCCAAAGCTT
TTTGTTGGGATGATCCTCATTCTCATTTTTGCTGAAGCTTTGGCTCTTTATGGGCTTATTGTTGGAATTATATTGTCTT
CACGAGCTGGGCAGTCCAGAGCATAGTGAAATTGGCTTATTAATACTATTCTTACTATGATGTATGTGAGACTCAGTAA
ACCCTGGCAAAACTTGATCCTTGCTAAAGTCAAAAAGCTATCTATGTCTATGTTTGTTATTCATGTTGGCACGGTTGCT
ACTGGTGCTGCTATTGTGCTGTTTGTAAAAAAAT

> SEQ ID NO:4878 116461FL_56262_300126_1d
ACAAAAGCCAATTCTCTCTCTCTCCCTCCAGATTCAAACGATCCGATCCAAAACTTTGAGATCCGAGAAGATGTCTACG
TTCAGCGGCGATGAAACTGCTCCGTTCTTCGGCTTCCTTGGCGCCGCCGCCGCTCTCGTCTTCTCCTGTATGGGAGCTG
CTTATGGAACAGCAAAGAGTGGTGTTGGTGTGGCTTCAATGGGAGTGATGAGACCTGAGTTGGCTATGAAGTCTATTGT
CCCTGTGGTTATGGCTGGTGTTTTGGGTATTTATGGACTTATTATTGCTGGTATCATTAGTACCGGCATCAATCCTAAG
GCTAAGTCTTACTACCTATTTGACGGATACGCTCACCTTTCGTCT

> SEQ ID NO:4879 116461FL_174801_300527_1d
CCCACGCGTCCGCCAAGGGCAAGCCCTACTTCCTCTTCGACGGTTACGCCCACCTCTCCTCCGGTCTCGCCTGCGGCCT
CGCCGGTCTCGCCGCCGGCATGGCCATCGGCATCGTCGGCGACGCCGGAGTCAGGGCCAATGCGCAGCAGCCAAAGTTG
TTCGTGGGCATGATCCTCATCCTTATCTTTGCAGAAGCTCTTGCTCTGTATGGCCTGATTGTTGGTATCATCCTCTCGT
CTCGTGCGGGCCAATCTCGAGCGGATTAGAGGGTTTTGGAAGAACAAGACACGGTTCACCATTGTATTCTATTCCAAGT
GTTAATTTCTTCTTATAGACTGCTTGGTCTTGTCTGTGTTTATACTCATTGTCTGTATTCAAGCTATTGTGGGTTGTTG
TATTTATTATTTGAATTTTTGAAGTAATAATCGGTACCAGGCCGTCCGAGATGTGATTAATAATGAATGAATAAATAAA
TAAGC

> SEQ ID NO:4880 116461FL_144875_200137_1d
agcgaaaggctaCAATAATCTCTCTCTCTCTTTCTCTCTCTCTCTAGAAGATTTTGAGAAGTATCTCAGATCCAAATCA
ATAACACACTTCTGAGATCCAATCAGAAACAATGTCTTCGACTTTCAGCGGCGATGAAACTGCTCCCTTCTTCGGCTTT
CTCGGCGCTGCTGCGGCCTTGGTCTTCTCCTGTATGGGAGCAGCTTATGGTACAGCAAAGAGTGGCGTAGGGGTGGCAT
CAATGGGTGTGATGAGGCCGGAGTTGGTGATGAAGTCAATTGTGCCGGTTGTTATGGCTGGTGTTTTGGGTATTTATGG
ATTGATTATAGCTGTGATTATTAGTACAGGGATTAACCCGAAAACCAAGTCTTACTATCTTTTTGATGGATATGCTCAC
CTTTCTTCTGGTCTTGCTTGTGGTCTTGCTGGCCTTTCTGCTGGTATGGCCATTGGAATCGTTGGTGACGCTGGTGTGA
GAGCCAATGCACAACAGCCAAAGCTTTTTGTCGGGATGATTTTGATTCTTATTTTTGCTGAAGCCCTGGCTTTGTATGG
CCTTATTGTTGGAATCATCCTCTCTTCGTGCTGGTCAGTCTAGAGCAGAGTAGAAGAAGAGAATGCTGTGCACCATT
ACTGTGAATTATCTTTGTGTTTTTCATGGATGAGCTagTCTGGCTGCTGAATTACATTTCCCTTTTTTCTTTGGGTtcc
aaGaTTCTGTACTTGATTTCTTGgttagaaGaaTTGgttcatataTGCggttCTGCTGTaGattagatcCCTAAATaaA
GaagTCagttaaTCTGATGCCCcaaCttTCaaggacaatgGGTttttttgtaaaTgc > SEQ ID NO:4881 116461FL_139353_300409_1d
ccccgccaaatcgaagcactcctctcctctcctctcctcagatcggatcgcgagagccccaatcccaccaccgatcgat
cCATTCCTGCTGCTCGCGGCCACCGGAGAAGGAGAGAGAGAGAGCTCGACCTCGTCGGCGGGTGAAGGATCGCAGCAGC
AGCAGCGGCGGTAGAGCAGGAGGAGAGGCGAAGATGTCGTCGGTGTTCAGCGGCGATGAGACCGCCCCTTCTTCGGCT
TCCTCGGCGCCGCCTCCGCCCTCGTCTTCTCATGCATGGGGGCGGCGTACGGGACGGCGAAGAGCGGCGTCGGGGTGGC
GTCGATGGGGGTGATGCGCCCGGAGCTCGTGATGAAGTCCATCGTGCCCGTGGTCATGGCTGGTGTGCTGGGTATCTAC
GGCCTCATCATCGCAGTCATCATCAGCACGGGGATCAACCCCAAGGCCAAGCCCTACTACCTCTTCGACGGCTACGCGC
ACCTCTCATCTGGCCTCGCCTGTGGTCTCGCCGGTCTCGCTGCCGGAATGGCCATTGGCATCGTTGGTGACGCCGGAGT
CAGGGCGAACGCCCAGCAACCAAAGCTGTTCGTGGGTATGATCCTCATCCTCATTTTTGCCGAAGCGCTTGCTCTCTAT
GGGCTCATCGTCGGCATCATTCTGTCATCCCGCGCTGGCCAATCTCGTGCGGATTAGGCATGTTTCAACACGCAAACCC
TTAGTGGGTTCTTGTTTCATATTCCTGAAACTACAAGCTGAGCTCTAGGGGTTTATTCTGTCTTAGTTTCTGTTCTTCT
GTTGGGTCATGAACAAAAAAACATCTGTATCCAAGGGATGTTTGCCCTTGTGGTGCCATTCTTTTTCGCTATGGTGGTG
CTGGCGGCGGTCTGAATCTTATTTATGCACAGTTTTTTTGGGTCTGGCTAGACAGTGATGTAATCTGGTGAATAAGCAA
ATAATTCGTAATGCAATGGGAGCATGAGACTCTTTTGTTC

FIG. 2 continued

> SEQ ID NO:4882 116461FL 1187626_302188_1d
ccacgcgtcCGAAAAAGGAGGAGGATTTGATCTACCTGTTGGACGACGAAGACGACGACGACGACGGCGACAATGGCCA
CAATGGATTTCAACGGCGACACCACTGCCCCCTTCTTCGGCTTCCTGGGGGCAGCCTTCGCTCTCATTTTCTCCTGTAT
GGGAGCTGCATATGGAACGGCAAAGAGTGGAGTTGGAGTGGCTTCAATGGGTGTCATGAGGCCCGAGCTTGTGATGAAG
TCCATAGTTCCAGTTGTTATGGCTGGTGTCTTGGGTATTTATGGCTTGATCATAGCTGTCATTATCAGCACAGGAATCA
ATCCTAAAAGCAAAGCATACTATTTGTTCGATGGATACGCACATCTATCATCAGGCCTGGCTTGTGGGCTTTCTGGTCT
CTCAGCTGGAATGGCCATTGGGATTGTTGGTGATGCTGGTGTCAGGGCAAATGCGCAGCAACCCAAGCTCTTTGTGGGC
ATGATTCTTATCCTCATCTTTGCAGAGGCTCTTGCTTTGTATGGTTTGATTGTTGGAATTATTCTCTCGTCACGTGCTG
GCCAATCGAGGGAATAAggTGTGAGCTCAAATGACccTGCTTTCCTTTTATAAGAGTTAGCCTATCCTTGGGtGTACTA
CTactggTAtcgagaCtgtTtggGCAGgttt > SEQ ID NO:4883 116461FL 1105722_301495_1d
ATTTGTGTGGATCGATCTGATCGAAGGACAACAATGGCCGACTCAGACTTCAATGGCGACACCACTGCCCCCTTCTTCG
GCTTCTTGGGAGCCGCCTTTGCCCTCATCTTCTCTTGTATGGGTGCGGCATATGGAACAGCAAAGAGTGGAGTTGGGGT
TGCTTCAATGGGTGTTATGAGGCCTGAGCTTGTGATGAAGTCCATAGTTCCAGTGGTTATGGCTGGTGTCTTGGGTATT
TATGGTTTGATCATAGCTGTCATTATCAGCACAGGAATCAACCCCAAAAGCAAGGCATATTACTTGTTTGATGGATACG
CCCATCTCTCGTCAGGCCTAGCTTGTGGGCTTTCTGGTCTTTCAGCTGGAATGGCAATCGGGATTGTTGGTGATGCCGG
TGTCAGGGCAAATGCACAGCAGCCAAAGCTTTTTGTTGGCATGATTCTGATTCTTATTTTTGCGGAGGCTCTTGCTTTG
TACGGCTTGATCGTCGGCATTATTCTCTCTTCTCGTGCAGGTCAATCAAGGGAATGATTCTTCCATGCCCTTTGATTCT
ACCCATTCCAACTATCCAAATTATATTGTCCTATGGTAGGACATGTTTTTCTTTCTTTTttaactATattttTTTCTTC
CGGATTTGACCAATAAGGA > SEQ ID NO:4884 119262FL 103772_300027_1d
TGGTATCAACGCAGAGTGGCCATTAGGCCGGGGAAAGCAAGAATCAGCAAATGGCTGATGAGGGAGTGAAATTGCTAGG
ACACTGGCCAAGCCCTTTTGCTCTAAGGGTTCATTGGGCTCTGAAACTTAAAAGGGGTTGATTATGATTACCAAGAAGA
AGATCTCCCGAACAAAAGTCCTTTGCTCCTGCAGTATAATCCAGTTCATAAAAAGATTCCAGTTCTGGTTCATAATGGG
AAACCTATTGCAGAATCATTAGTCATACTTGAATACATCGACGAGACTTGGAAGCATAATCCCCTCCTCCCTGAAGATC
CTTATGAAAGAGCCAAAGCGTTTCTGGGCAAAATTTATTGATGATAAGTGTGTGCCAGGAATCTTTGGTACTTTCTCTA
AGGTCGGAGAGGAGCAGCAGCAGATAGCAAAAGAAGCTCGCGAGAACTTGAAACTTCTGGAGGGCGAGCTAGACAAGAA
AAGCTTTTTTGGAGATGCGAGGATAGGCTTCATTGACTTGCATCTGCTTGGATAATTTTTGGGCTC > SEQ ID NO:4885 119262FL 105064_300046_1d
CCCACGCGTCCGGCAAAAAATTGAGAACCAAAGTTGTGATGGGGCACAAGTGAAGTTGCTAGGCTTTTGGTATAGTCCA
TTTACTCACAGAGTTAAGTGGGCTCTAAAGATAAAGGGTGTGAAATATGAATATATAGAAGAAGATCGAGATAATAAGA
GCTCTCTACTTCTTCAATCCAATCCTATTCACAAAAAAGTCCCTGTTCTCATTCACAATGGAAAACCCATTGTTGAGTC
TCTGGTCATTCTTGAGTACATTGATGAGACATTTGAAGGCCCTTCCATTTTTCCTAAAGACCCTTATGATCGAGCTTTA
GCTCGTTTTTGGGCTAAGTTCCTTGACGACAAGGTGACTGCAGTACCGAATATTTTCCGTCGCAAAGGGGAGGAGAAAG
AGAAAGCTAAAGAGGAAGTATGTGAGATGTATAAAGTTCTTGACAATGAGTTCAAGGATAAGAAGTTTTTTGTGGGTGA
GAAATTTGGGTTTGCTGATATTGCTGCAACTTTGGTGGCATTTTGGCTTGGAGTTTTTGAAGAAACCTCTGGAATTGTT
TTAGTGACAAGTGAAAAATTTCCAAATTTTTGTAAGTGGAGAGGCGAATACATTAACTGCAGCCAAATCA > SEQ ID NO:4886 119262FL 1107913_301516_1d
AGAAATTGAAGCAATGGCAGGAGGACCAAAGGAAGAAGAAGAGGCAGTGACGCTTTTGAATATGTGGCGCAGCCCATTC
GGGATGCGGGTGGTCTTCGCTTTGAAGCTGAAGGGGTCAAATACCAGTTGATCGAGCAGAGCCTCAGCGAGAAAGCC
AGCTTCTGATAAAGGCCAACCCTATCTACAAGAAGGTGCCTGTCCTGATCCACAATGGAAAGCCCATTTGTGAATCCTC
CATCATTGTGCAATACATAGACGAGACATGGCCAGATCAGGAAGAAGAAGCCGACCTCCTCCCTAAACAGCCCTTAGCC
CGGGCCCATGCTCGCTTCTGGGCTGATTTTATTGACAAAAAGGTATTTGGTCTTTTGCCAAGGATGATAAGATCGAGTG
GGGAGGAAATTCAAAAGGCTAGGGAGGAGTTAATTGGGTGCCTTGAGGTGATAGAAGGGGAACTGAAAGATGAATATCC
ATTCTTTGGTGGGAAGAGGATGGGTTATGCAGATGTGGTTCTTGCACCCCTAGTG > SEQ ID NO:4887 119262FL 56388_300123_1d
CGGACGCGTGGGTGGCGAACCTACCGATTCTTTTGGATTACTGGCCAAGTATGTTTGGGATGAGGGCTAGAGTTGCGTT
GCGAGAGAAGTTGTTGAGTTTGAATACAGAGAGGAAGATTTCTCGAACAAGAGCCCTTTACTCCTCCAGAGTAATCCC
ATTCACAAGAAAATCCCGGTTCTGGTCCACAACGGTAAACCGGTATGTGAATCTCTTAACGTTGTCCAGTACGTCGACG
AGGCTTGGCCCGAGAAGAACCCGTTCTTCCCTTCCGATCCTTACGGGAGAGCTCAGGCTCGATTCTGGGCTGATTTCGT
GGACAAGAAGTTCACCGACGCCCAATTCAAGGTATGGGGGAAGA

FIG. 2 continued

> SEQ ID NO:4888 119262FL_44079_300028_1d
GGCAATTTTGTCAAGCAATCCTTAATTTTCAGCGAAAAAAATGGCAGATGAAGTTGTCCTTTTGGATACCTATGTAAGC
GTGTTTGGGATGAGGGTTAGGTTTGCGCTGGCCGAGAAAGGCATAAAGTATGAATACAAGGAGCAGGATTTGCTGAACA
AAACCCCTCTTCTCCTACAAATGAACCCAATTCACAAGAAAATTCCAGTCTTGATCCACAATGGAAAACCAATATGTGA
AACCCTTATCATTGTTCAGTACATAGATGAAGTTTGGAAGGACAAATCCCCTTTAATGCCCTCCGACCCTTATGAGAGA
GCTCAAGCTAGGTTTTGGGCTGATTATATTGACAAAAAGATTTATGATGCTGGAAGGAAAATTTGGACTACAAAAAAGG
AGGATCAAGAAGCAGCAAATAAAGAATTCATAGAGTGCTGGAAGTTATTGGAAGGGGAGTTAGGAGACAAGCCATACTT
TGGAGGGGAAAGTTTTGGGTTTGTGGATATGGCCCTTATTCCTTACTATTGCTGGTTCCCTACTTATGAGAAATTTGGC
AATTTTAGCATAGAGGCAGAGTGTCCTAAGATTGTGGCATGGGCTAAGAGGTGTATGCAAAAGGAGAGTGTCTCAAAGT
CTCTTGTtGACCCTGGCaaagtCTATGAT > SEQ ID NO:4889 119262FL_39440_300196_1d
CCCACGCGTCCGACGAACACTTACAAAAAAAAATCTCTTTGTGAGCTTTAGCGATCGTAACAATGGCGAACGAGGTGAT
TCTTCTTGATTTCTGGCCGAGTATGTTCGGGATGAGGACAAGGATCGCATTGAGGGAGAAAGGTGTTGAATTTGAGTAC
AGAGAAGAAGATCTAAGGAACAAGAGTCCTTTGCTTCTCCAGATGAATCCGATTCACAAGAAGATTCCTGTTCTCATCC
ACAATGGTAAACCGGTTAACGAATCTATCATCCAGGTTCAGTACATTGACGAGGTCTGGTCTCACAAGAACCCTATCCT
TCCTTCTGATCCTTACCTGAGAGCTCAAGCTaggttCTGGGCTGATTTCATTGAcaagaagctgtAtgaTGCtc > SEQ ID NO:4890 119262FL_39233_300206_1d
CCCACGCGTCCGGGGAAAGCCAAACCGGTATATTTTCTTTAAACAGGATATATAGATGAACCAAGAAGAGCACGTAAAG
CTTCTGGGCTTATGGGGAAGTCCTTTTAGCAAAAGAGTAGAGATGGTCCTAAAACTTAAGGGCATACCTTATGAGTACA
TTGAAGAAGATGTTTATGGAAACAGGAGCCCTATGCTTCTCAAGTACAACCCTATACACAAGAAGGTCCCTGTCCTCAT
CCACAATGGTAGATCGATAGCCGAATCATTGGTGATTGTCGAATACATCGAAGATACGTGGAAGACAACTCACACGATC > SEQ ID NO:4891 119262FL_283556_200238_1d
ATTCTGTTGGATTGTTGGTGCAGTATGTATGGATGAGGGCAAGAATAGCACTTGCAGAAAAAGGTGTGAAGTATGAGT
ACAAAGAAGAGGATTTGAACAATAAAAGCCCACTGCtTTTGGAAATGAACCCTATTCACAAGAAAGTCCCAGTCTTAAT
TCACAATGGGAAATCAATTTGTGAGTCACttgtTATAGtcCaATATATTGATGAAGTTTGGAAAGGAAATGgaccAtTG
ATTCCTTCTGAtccTTATGagaAagctcaagcTtggttcTGGtctgactaTATGGGTaaTACcgtacaTGAATATGCAG
TgaaaatatGGGcatcAaaAggagaataccAagaacaagCatgtaacgAcTATtTatgtcgactTAagtTgATagaggG
AGTACttggtgacaagccTTATTTggaggagaAAActatggATTTttggaTat > SEQ ID NO:4892 119262FL_271309_200033_1d
cgttatttattatgcatcttgactaccCCtcgacccacgcgtccgcggacgcgtgggcggacgcgtgGGTTCTGCTAGA
TTTCTGGCCAAGTTCTTTTGGTATGAGGATAAGAATTGCATTGGCCTTAAAGGGAATCAAATATGAAGCAAAGGAGGAA
AACCTATCTGATAAAAGCTCTTTGCTTCTGGAGATGAACCCTGTTCACAAAAAGATACCTATTTTGATTCACAATAGTA
AACCCATTTGTGAGTCTCTAAACATTCTTGAGTACATTGATGAAGTTTGGCATGACAAATGTCCATTACTTCCTTCTGA
TCCTTACGAAAAGTCACGAGCCAGATTCTGGGCTGACTATATTGACAAGAAGATATATAGCACAGGAAGAAGAGTGTGG
AGCGGTAAAGGTGAAGATCAAGAAGAAGCAAAGAAGGAATTCCTAGAAATATTCAAGACTTTGGAAGGAGACCTTGGAA
ATAAAACTTACTTTGGTGGTGATAATTTGGGTTTTGTGGATGTGGCttTggTTCCCTTTACTAGTTGGTTTTATTCTTA
TGAGACTTTTGCTAATTTTAgtATAGaagcagagtGtccaaagctggtggTATgggcAAAaGATGTATGGAGaaCGaG
Tgtgtctc > SEQ ID NO:4893 119262FL_267954_200173_1d
CTTATTCTTCTTCTCACTTGCTTTTCATAACAATGGCGAACGAAGAGGTGATTCTGTTGGATTTCTGGCCTAGTATGTT
TGGGATGAGGCTGAGGATTGCATTAGCTGAAAAGGAGATAAAGTATGAGTACAAAGAAGAGGACTTGAGGAACAAAAGC
CCTTTGCTTTTACAAATGAATCCTATCCACAAGAAATCCCAGTGTTGATTCACAATGGAAAACCCATTTGTGAGTCTA
TTATTGCAGTTGAGTACATTGAAGAAGTTTGGAAAGACAAAGCCCCTAATTTGCTTCCTTCTGATCCTTATGACAGAGC
TCAAGCTAGGTTCTGGGCTGACTACATTGACAAGAAGTTGTATGATGTTGGGAGGAAGTTATGGGCAACAAAAGGAGAA
GAGCAGGAGGCAGCTAAGAAAGATTTCATAGAATGCCTCAAGGTGCTGGAGGGAGCATTAGGAGACAAGCCTTACTTTG
GAGGGGAAAGTTTTGGGTTTGTGGATATTGCTCTGATTGGATACTACAGCTGGTTTTATGCCTATGAGACTTTTGGCAA
CTTCAGCACAGAGGCCGAGTGCCCAAAGTTTGTGGCTTGGGCCAAAAGGTGCATGCAGAGGGAGAGTGTTGCTAAGTCT
TTACCTGACCAACCTAAAGTCCTTGAGTTTGTAAAAGTTCTTAGGCAGAAGTTTGGACTTGAGTaAACATATGCATATT
TGGTTATGCACCATAATGTAttAAagaaggcaTtTCAtt > SEQ ID NO:4894 119262FL_254943_301640_1d
GCAGAGAGAGAGTTGAGGCAAGAACTATGGCGAGGGAGAGGGAGATGTGAAGGTATTGAGCAGTTGGTTGAGCATGTT
TGGCATGCGAGTTCTTATCGCCCTTCATGAGAAGAATGTGCCATTTCAACTCATTGAGGAGGATCTCTCTAACAAGAGT

FIG. 2 continued

GAACTCTTGTTGCAGTCGAATCCCATCCACAAGAAGATCCCCGTGCTGGTTCACAAGGGGAAAGCCATCTGTGAGTCAA
GCATCATCGTTGAATACATAAACGAGACATGGCCTTCCCCTCCCCTCTTCAATCCTTCCACCCCCTACAACACTTCCCT
TCATCGATTTTGGGCTGATTACATTGACAAGAAGTTCTATGATGCAGGGGCAAGGGTTATTAAAAGTCCAACAGGAGAA
GCCCAGGAGTGTGCAGTTAAGGATTTGGTGGAGAGTTACAAGATGATGGAGAAGGCATTCGCTGAGATGAGTTGTGGGA
TTAAGCCTTTCTTTGGTGGAGACTCCATGGGGTTAGTGGATGTCGTGTTTGCTCCCTATGTATCTTGGTTCTGTGTATA
TGAGAGCATAGGGGGATTCAAGCTCCCAGGGGAGGATGAATGCCCACTACTAAGTGCATGGACCAAGAGAGTGTTGAAA
GTGC

> SEQ ID NO:4895 119262FL_252913_301610_1d
AGAGAGAGAGAGTGTGGTGGAAGCAGCAGCTGAGACTGAAAGAGAGTGAGTGGTGGTAGCAGCAGTTAAGAGAGAGAGA
GAGAGAGTAGTAGTAGTAGTAGGCAAGGAAGAAGGTATGGCAACTGTGACTGAAAGTGAAAGTGAGGTGAAGGTGCTGT
CCACATGGGCTAGCATGTTCGGCATGCGCGTGCTCATCGCCCTCAACGAGAAGGGCGTCCCTTATGAGCTCACCCAGGA
GGACCTTCGCAACAAGGGCCAGCTCTTGCTTCAGTCCAATCCCATCCACAAGAAGGTACCCGTCCTCCTCCACCATGGG
AAACCCATCTGTGAATCCAACATCATTGTCCAATACATCGACGAAACGTGGGCTTCCCCTCCCTTCTTTCAACCCCCTA
CCCCTTATAACCGTGCCATGCACCTCTTCTGGGCTGACTTCGTCGATAAAAAGTTTTATGCAGAGACGGGCTCGAAGGT
TCTAAGAAGCATGCCTGGGGAAGACCGCGACAAAGCAGTGGAGGAGTTTCAGAACAGCTACAAAATGATGGAAAAGGCA
TTGGGGGATATGGCATGTGGGAAGCCTTTCTTTGGTGGAGACTCCATTGGCTTTCTTGACATTGCCTTTGCTCCTTTCG
TTTGTTGGTTCAAGGCTTTTGAGACA

> SEQ ID NO:4896 119262FL_245861_301572_1d
gGAAGAGGGAGTGAAACTCttgaCTTCTGGTCGAGTCCTTATGCTTGTCGAGTGAGGCTAGCTCTGGGTCTCAAGGGC
ATCGAGTTTGAGCTCCAGGAGGAAGATCTGTACAATGCAAAGAGTGAGCTGCTGCTGAATTCcaATCCCGTTCACAAGA
AGATCCCCAGTTCTCATCCACAATGGCAAGGCCATCTGCGAGTCCGTCAACATCATTGAGTAcgttgacGAAGtctggGC
GGATCgAAGCCCCAATTTTCTCCctcgggATGATGCGTTTGCTCGAGCTACTGCTCGGTTTTGGGCTGATTTCGTCGAC
AAAAAGTTTATGAGCAGGACGGCGGCATCCTACCGAGCAGCCTATTCCAGCGCAGGTGAGGAaAAAGAGCGAGCAAACA
ATGAGATGATTCAAGATTTCATGGCACTGGAGGAGTTTCTTGCGAGACAGGAGATCGCGCGGCTCCGCGTGCCCGGCCC
CGatacctGTCCTCGTCTCTGCCGCTGGATGGATGCAGTCAAAGGCAATCCTTTTGCCAGAGCTGCCTATCCTGACCAG
AGAGAACTTAtggcctcCACTAAagtccgAtttgaGAAACGTTTTGTGAATGCAAATAGg > SEQ ID NO:4897 119262FL_244902_301563_1d
agagggcATTGAAGCATTAGCAGCACAGCAACAATGGCGAGCGACAGCGTGAAGGTCCTCAACTTCTGGCCGAGCATG
TTCGGCTTGCGCGTCCACTACGCTCTGGACCTCAAAGGTGTGCCTTACGAGTACAAGGAGGAGGACTTGGCGAACAAGA
GCGAAGAGCTCCTCAAGGCGAATCCCATCTACACCAAGATCCCCGGTTCTCATCCACAATGGCAAGCCTGTCTCCGAATC
CCTCATCATCCTTGACTACATCGATAGCGTCTGGCCCAGTTCTCCCAAGCTGCTCCCAAAAGATCCATACGACAAGGCC
GTGGCTCTCTTCTGGGCGGATTTCGTCGATAAAAAGGTGTATGATGCTGGACATTGGATCATCAGAGCTACTGGAGAGC
AGCACAAGAAAGCCGGCGAGGATTTCAAGTGGGCGCTGATGAAGATCGATGAAGCTCTCGGCACTGTTGCTCCAGGCAA
GCCTTTCTTTGGCGGTGACGCCATGAACATTGCGGATGTGAGCCTTGCACCGTTTATATGCTGGTTCGAGGGGTACCAG
AAGGTGGGAGGATTCCAGCTTCCAGGTCCCGAGGAGTGGCCTCGTCTCTACAAGTGGATTGATGCTGTCAATTCCGTGG
AAGCGATCAAGAAATCTACTCCAAGTCGGGAGAAGATGGTTGAGTTTATCGAGCTCTATAGGAAACGAATGGCAGGGGC
TGCATAAGAGAAATATCACTGATCGGTGA > SEQ ID NO:4898 119262FL_243587_301340_1d
atggcggatcaggtgactctcctctcgctgcCCGCGAGCCCGTTCGCAATGAGCGTTAAGATGGCGCTGATTGAGAAGG
GTGTCGACTTCAAGACGGTGGAGGAGAACTACAGGGCAAACGGCCAAGAGCGAGATGCTGCTCAAGGTGAATCCCGTGAC
TAAACAGGTGCCTGTTCTGCTCCACGGTGACAAACCCGTCTACGAGTCGCTCGTCATTCTCGAGTACATTGAGGACATT
TGGAAGGGTCAGGGCACTCGGCTCCTGCCCGAGGATGGATACCAGCGGTCGCTTGCTCGGTTCTGGGCCAACTTTGGCA
ACACCAAGTTTTGGGAGACTGGACTGCTGATAATGAAGAGGATCGGAGAGGGGCAGATGAAAGCTAGAGATGACGTCGT
CGAGATGATCCATCTGATGGAACAGGAGTGGAGCAAACCTGAGTATGGAAAGCCGTTCCTGTTTGGTGACAAGCTCAGC
CTGGCTGACTTGGTTTTGGCTCCTATTGCGTCGTGGAAGCTGACATTCGAGACCCTGGGGAAGTTCAAGTTTCCGGACG
CTCAGACATGTCCACGGATGGCCCAGTGGCTGGATGCAATTGAGAATCACCCCACGGTGAAGTCGGCCATCCTGGCACC
GGATATGAATCTGGATAATGCCAATTTCTACCAGGACTTcataaaaCgcagCA > SEQ ID NO:4899 119262FL_236794_301261_1d
gcttccactcaagaagtgacccttctcagcgcTTGGGCGAGCCCCTTcagcaTGCGAGTCAAGTTgGCACTCACACTCA
AAGGCATTGAGCACGAAGATCTTCCACaGGATCTCAGcaacaagaGCAAGCtgcTGCTCGACTCCAATCCCATCCAcAA
GAAGATCCCCGGTCCTCATCCACAaggGGaggccactgcccgAGTCagtcaccattgtcCAGTacattgatGAGgtatgg
cctggaaaGTCCCcgctgcTGCCTCAGgAtcCATTCCTTCGtgccgagcaccgCTTCTggacCGACTTCATCGACAAgA
AGtTCTTCGActgcttcatgcGCTTCATGCGCACtgAGGATAAtgccggaATCAacgaccaattggatgcATCTCGaga

FIG. 2 continued gAGCGctagagAAGCTCGGAAGCAAgaaggGgCcGttctttggcGGCgagagcATGTCGTTCctgcacgTGATtcttgc
ccCTTTCAGCGTCTGgatccc > SEQ ID NO:4900 119262FL 235772_301229_1d
cgtccgggcTTCCACTCAAGAAGTGACCCTTCTCAGCTTTTGGGCGAGCCCCTTCAACATGCGAGTCAAGTTGGCACTC
ACACTCAAAGGCATCGAGCATGAAGATCTTCCACAGGATCTCAGCAACAAGAGCAAGCTGCTGCTCGACTCCAATCCCA
TCCACAAGAAGATCCCGGTCCTCATCCACAAGGGGAGGCCACTGCTCGAGTCAGTCACCATTGTCCAGTACATTGACGA
GGTATGGCCTGGAAAGTCCCCGCTGCTGCCTCAGGATCCATTCCTTCGTGCCGAGCACCGCTTCTGGGCCGACTTCATC
GACAAGAAGTTCTTCGACTGCGTCATGCGCTTCACGCGCACTGAGGATAATGCCGCAATCAACGAAGAATTTGTCGAGA
ATTGGATGCATCTCGAGAGAGCGCTTGAGAAGCTCGGAAGCGAGAAGGGGCCGTTCTTTGGCGGCGAGAGCATGTCGTT
CctGGACGTGATTCTTggCCCTTTCagCATCTGGATCCCTggcgtcggcaatgtccTGGgccTcaagacgCCCcatgag
aAAtgcccgcgTCTACACAAGTGGTTTACtggcatcTCTgagcaTccCGATg > SEQ ID NO:4901 119262FL 225732_300990_1d
aaaagagaaatgggGGAAGAGGGAGTGAAACTCTTGAGCTTCTGGTCGAGTCCTTATGCTTGTCGAGTGAGGCTAGCTC
TGGGTCTCAAGGGCATCGAGTTTGAGCTCCAGGAGGAAGATCTGTACAATGCAAAGAGTGAGCTGCTGCTGAATTCCAA
TCCCGTTCACAAGAAGATCCCCAGTTCTCATCCACAATGGCAAGGCCATCTGCGAGTCCGTCAACATCATTGAGTAcgtt
gacGAAGTCTGGGCGGAtcgAaGCCCCAGTTTTTCTCCCTcggGATGATgcgttTgctCgAGCtacTgctcgGTTTTGGG
CTGATTTCGTcgacaAAAAGTTTATgagcagGacggcggcatcctaccgAGCagcCTATTCcagcgcaGgTgaggaaAA
AGAgcGAGcAaACAATGagatgATTCAAGATTTCAtggCactGGAGGAgttTCTTGCGagacagggaaCAgtgTTTTtc
agCGGAAGCAACACGGACAtGgGCTTTGTTGACATTGTTGCCTCTTTCATGCCATGGTGGACGCCCGCATACGTAGAGA
TCGCTCGGCTCCGCGTGCCCGGCCCCGATACCTGTCCTCGTCTCTCCCGCTGGATGGATGCAGTCAAAGGCAATCTTTt
tgccaGAGcc > SEQ ID NO:4902 119262FL 209369_300814_1d
CAAACATCGACACATCGTGTCCATCGGAGGCACAGGAGAGATGGCCGGCGCCGGACGCGACGAGCTGAAGCTGCTCGGC
ATGTGGGCCAGCCCGTATGTCAGCAGAGCCAAGCTCGCGCTCCAACTCAAGGGCGTGAGCTACGAGTACATCGAGGAGG
ATCTCGGCAACAAGAGCGACCTCTTCCTCCGCTCCAACCCGGTGCACAAGACGGTGCCGGTGCTCATCCACAACGGCAA
CCCCATCTGCGAGTCGAGCATCATCGTGCAGTACATCGACGAGTCCTTCCCCTCCTCCGGCGCCTCCCTCCTCCCCGCC
GACCCCTACGACCGCGCCGTCGCTCGCTTCTGGGCCGCTACATCGACGACAAGCTAGCGCGCGCCGTGGAGAATGGTGT
ACAGGGTGAANACGGAGGAGGAGAGGGACNAGCTCATGAAGCAGACGCTCGCGGCCGTGGACGTGCTGGAGGGAGGACT
GAAGGAGTGCTCCAAGGGGAAGGGATGCTTCTTCGGCGGCGACAGCGTCGGCTACGTCGACGTCGTGCTGGGTGGGCTC
GTGTCGTGGGTGCACGCCAGCGACAAGCTCTCCGGCGC > SEQ ID NO:4903 119262FL 201384_300715_1d
AAAGATGGGTGAAAGGGTGAAGCTCATCGGTGCTTTCGCCAGTGCATACGGCCACCGCGCAGAGGTGGCGCTTCGCCTG
AAAGGCGTGCGATACGAGCTCATCCTGGAAGACCTCCGCAACAAGAGCGACCTGCTGCTCAACCACAACCCCGTCCACA
AGCTCGTCCCCGTCCTCCTCCATGGCGACCGCTCCTTGAGCGAGTCCCCTCGTCATCCTCGAGTACATCGACGAGACTT
CCATGGTCCACCCATCCTCCCAACCGATCCGTACGATCCGTCACGCTGGCGCGTTTCTGGGCGCAGTTCATCGATCAGAAG
TTTGGTAGGTTCAATTTCTGGATCCCGTTCGTCGCAAATGGAGGGCAACATGCAGGATTGTTTCGTGAGGGAAGCAAAGG
AGAATCTGGCGCTTCTTGAAGGGCAGCTCAAGGGGAGGAGATTCTTCGGAGGCGACGCCATCGGGTTCTTGGACATAGC
AGCGTGCTTGATAGCTCACTGGCTTGGTGCGTTCGAGGAGGTATGTGGGGGTGACCTTGGCCACGGATGAGGAGTTCCC
TGCTTTGTGCGAGTGGAGGAGACGCTACGTCAACGATGAGGCCGTGAAGCCGTGCCTGCCGAATAGGGACGAACTCGTT
GCGTATTACCGTGAACGCA > SEQ ID NO:4904 119262FL 194057_300743_1d
CCCCCGAACCACCAAACAGAACAGAGCTCGCAACTCACAAGCTGATACAGAGCAGAGACCATCGGAGTTCAGAGTTCAG
ACACGAGAAAGCCATGGCCGGAGGAGGAGACGAGCTGAAGCTGCTCGGGCATGTGGGCGAGCCCGTACGTTCTGCGAGTG
AAGCTCGCGCTCAGTCTCAAGGGCCTCGACTACGAGTACGTCGAGGAGGATCTCAAGAACAAGAGCGAGCTCCTCCTCA
GCTCCAACCCGGTGAACAAGAAGGTGCCCGTCCTCATCCACAATGGCAAGCCAGTCTGCGAGTCGCAGATCATCCTGCA
GTACCTCGACGAGGCGTTCCCCGATGCCGGCGCCACCCTGCTCCCCGCCGACCCCACGAACGCGCCGTCGCTCGCTTC
TGGGCCGCATTCTGCGACGACACGATCGCGAAGGCGTCGCAGCAGGCGTCGTCGGGAAAGACGGAGGA > SEQ ID NO:4905 119262FL 189106_300613_1d
AGAACAGTCTCAAAGCTTCGCCCAAGCAGAGAAGAATGGCCGCCGGAGGAGGAGGAGGAGACGAGCTGAAGCTGCTCGG
ATTGTGGGCGAGCCCGTACGTCCTGCGAGCGAAATTCGCGCTCAGCTTCAAGGGCCTGAGCTACGAGAACGTCGAGGAG
GACCTCCACAACAAGAGTGAGCTGCTCCTGAGCTCCAACCCGGTGCACAAGAAGGTGCCCGTGCTCATCCACAACGGCA
AGCCCATCTGCGAGTCGCAGATCATCGTGGAGTACGTCGACGAGGCGTTCCCTGACGCCGGCGAGTCCCTTCTCCCCTC CGACCCTTACGACCGCGCCGTCGCTCGCTTCTGGGCCGCCTACATCAATGACAAGTTCATGCCGGCGTGGCAGAAGGCG
TCGTTGGGCCTCACGGAGGAGGAGAAGGCGGAGGCGGTGAAGCAGATGCTCGCCGCGATCGAGAACCTGGGAGACGGCGT
TCAAGGAGTTGTCCAAGGGGAAGCCCTTCTTCGGCGGCGACACCGCCGGGTACCTCGACGTCACGCTCGGCGCCGTGGT
CGGCTGGGCGCGCGCCGGCGAGGTCCTGTTCGGGAGGAAGCTCTTCGACGCCACTAGG > SEQ ID NO:4906 119262FL 182721_300663_1d
GAATTCAAGTCCTCTTCTTCTCAAAATGAACCCACTTCATAAAAAAATCCCTGTTCTGATTCATAATGAAAAACCAATT
TCCGAATCCTTACTAATCGTCCAATACATTGATGAAATTTGGAAAGATAAATCTCCACTTTTACCTAATGATCCATATG
AAAGAGCTTCAGAGAGATTATGGGCTGATTATGTTGACAAAAAGGTATTTGAAATCGGGAGGAAGTTATGGATGACTAA
AGGAGAAGAACATGAGAAAGCTAAGAATGATTTCATTGAATGTATGAAGGTATTAGAAGGAGAGCTTGGAGATAAGATT
TACTATGGAGGTGACAAAATGGGGTTTTTAGATGTGGCTTTTGTTCCTTACTACAGTTGGTTTTACTCTTATGAAACTT
GTGGCAAGTTTAGTATGGAAGAAATTTGTCCTAAATTGATGGAATGGGCAAAGAAATGTATGGAGAAAGATAGTGTCTC
TGAATCACTTCCCGAATCACAAAAGATTTATCAATTCGTTTTGAAACTCAAGCAGAGGTATGGAATTGTTGA > SEQ ID NO:4907 119262FL 180911_300652_1d
GAATTCAGAAGGTGAGGAAGACTAGATCAAAATATTTTCTTGTGGTATCAGAAGAAAGGTAAACTCTAAATTTAGTTAT
GGCAGGATCAGGAAGTGAAGAGGTGAAGATCTTAGGTGGATGGCCAAGTCCATTTGTGATGAGGCCTAGAATTGCACTC
AACATTAAATCAGTCAAGTACGATTTTCTTGAAGAGACATTTGGTAGCAAAAGTGATCTTCTTCTGAAATCAAATCCTG
TCTACAAGAAGATGCCTGTTATGATTCATGAGGATAAACCCATCAATGAATCAATGACCATTGTTCAGTACATTGATGA
TGTCTGGGCTTCTGCCGGTCATTCTATCATCCCTTCTGATCCTTATGATGCTTCCATTGCTCGTTTCTGGGCAACCTAC
ATTGATGACAAGTTCTTTCCATCTTTAACTGGTGTTGCAAAAAGCAAGGATGCAGAACAAAGAAAAGCAGCCATTGAAC
AAGTGATTGCAGGGTTTGCTCTAATTGAAGAAGCTTATCAGAAAATTAGCAAAGGAAAAGACTTTTTCGGTGGAGAAAA
AATCGGATACCTTGATATTGCATT > SEQ ID NO:4908 119262FL 155665_301358_1d
GCAAGAATGGAGATGATGAGGTGATTCTATTGAACTTTGGCCTAGTATGTTGGAATGAGAGTAAAGGTTGCACTAGCTG
AAAAGGAGATCAAATATGAATACAAGGAAGAAGATTATTTACTGCTAAAAGTCCTTTGCTACTGAAAATAAATCCAATC
CACAAAAAAGTCCCAGTTTTAATTCACAACGGTAAAACTGTTTGTGAATCTCTTATTGCAGTTCAATATATTGATGAGG
TTTGGAATGACAAAGCTTCATTGTTACCCTCTGATCCTTATGAGAGAGCACAAGCTAGGTTCTGGGCTGATTACACTGA
CAAGTTGTATGATTATGGGAGAAAAATATGGGCAACCAAAAGAGAAGAGTTAGAGGAAGCTAAGAAGGAATTGATAGAT
CCACTCAAGTTACTAGAGCTAGAAGTATTGGGAGACAAACCTTACTTTGGAGGGGAAAGCTTCGGTTTTGTGGATATTG
CCTTAATTGGATTTTACTGCTGGTTTTATACCTATGAGTACTTTGCCA > SEQ ID NO:4909 119262FL 154638_301256_1d
gcgtTTTTTTCTCTCATTCAACTGAATCTCTTCTGTTTCTGATATTTTGCTTTGATATATCATGGCGGGAAATGATGTG
AAAATATTAGGAGCATGGCCTAGTCCATTTGTTATGAGGCCACGTATTGCTCTTAACATAAAATCTGTGGCCTATGATT
TTTTGGAGGAACAATTTGGTTCTAAAAGTGAACTTCTCCTTAAATCAAACCCAGTTTACAAGAAAATCCCAGTTCTAAT
TCATGACGGAAATCCCATTTCTGAATCTCTCATTATTGTTCACTATATTGATGAAGTTTGGAGTTCTGGTCCATCTATT
CTCCCTTCTGATCCTTATGATCGTGCTATTGCCCGATTTTGGGCCACTTATATCGACGATAAGTGGTTTCCAGCAATGC
GTGGCATTGCAGCAGCCCAAGGGGAGGATGCACAAAAGGCAGCAACGGAACCGGTGGTCGAAGGGCTGGTATTATTGGA
AGATGCCTTCAAGAATTGCAGCGAAGgCAACAAGTTCTTTGGTGGAGACAAAATCGGATACTTGGACATTGCCCTTGGC
TGCTTTTTGGGCTGGATGAGGGTGACTGAGAAGTTGaaCAATGTAAAGCTgcttGATGAag > SEQ ID NO:4910 119262FL 144870_200137_1d
tcaaacatatagaaaagtaccacttaattagtgagatggcagaagtgaagttgcttggtgtttcactcagcccttttag
tCGAAGAGTTGAATGGGCTCTGAAGATTAAAGGAGTGGAATATGAATTTATAGAAGAAGACCTACAAAACAAGAGCCCT
CTGCTTCTTGAATCAAACCCTGTTCACAAGAAAATACCAGTGCTTATTCACAATGGAAAGCCCATTTCTGAATCTATGG
TCATTCTTGAATACATTGATGAGACTTTTGAAGGCCCTTCTATCTTGCCTAAAGACCCCTATGAACGAGCTTTAGCTCG
TTTCTGGGCTAATTTTCTTGATGTTAAGTGCATAACTACAATTGGAAAAGCTTTATTTGGAAAAGGAGAGGAGTCAGAC
AAAGCTATAGAGGAATGTGGTGAGCTGCTCAAGATTCTTGATAATGAGCTCAAGGACAAAAAATTCTTTGTGGGAGATA
ACTTTGGGTATGCTGATATAGCTGCAAATTTAATGGCATTTTGGCTGGGAATTCTTGAAGAAGCCTCTGGAGTAATTTT
GGTGACAAATGAAAAATTTCCCAATTTTTGTGCATGGAAAGATGAGTATATTAACTGCAGCCATGTTAAGGAACATTTA
CCTTCAAGGGATGCATTACTTTCCCATTTTCAACCTCGCTTTCAAACTGCAGCAGCTCCCAAATAAAAATACTTGCGGG
ACTACACTAGATTGTTGTTGTTGTATTTGCAAATTGTCATGATTTGAATTGTGGCAATaaAACACCTACTAACGAAAAC
CAgCTTTTCACAGAGTAggGAGTATCTTGTGTATTTgttTTGCTGATTTGTCAATGATtTTATGTGATTGTaaTTTCTT
CcAgCtattACATGATAAGAGTCATGTTTtcc > SEQ ID NO:4911 119262FL 142573_300436_1d

FIG. 2 continued

CCGGAACCAAGAAGGACACTAAAGCAGTAGTCTAGTCTCGGGGCCAAGCAAGAACCAAAAAGCAATTAAGATCGAACTC
GAGCAAACATGTCGTCGACTAACAACAGTTCAGGCGAGCCGCCGCCGGCGGTGCGCGTGCTGGGCGGTTGGGCGAGCCC
CTTCACGAACCGCGTGGTGGTGGCGCTGAAGCTGAAGGGCGTGGAGCACGAGATGTTGCAGGAGACGGTGGGGAAGAAG
AGCGAGCTGCTGCTCCGGTCCAACCCGGTGCACAAGAAGTTCCCCGTGCTGCTCCACCACAGGAAGCCCCTCCCCGAGT
CTCTCGTCATCGTCGAGTACATCGACGAGGTCTGGCCGGCCTCCAATGGCGGCGCCCGGCCATTCTCCCTCGCGACCC
CCACGGCCGAGCCGTCGAGCGGTTCTGGGCACGGTACGTCGATGACAAGGTAAGGGCATGTCTTGCGTAATTTTTTTTT
GTCTCTGAACATTTTCTTCTTGTTTCTTGGAGAATTTTTGCTCTTGCTTTGATGATATTTTTGCAGATTCTACCAGGGC
TTCGGGTTTTGAGAGGATCGGTGGCCGGAGACAAGGACCAAACC

> SEQ ID NO:4912 119262FL 138792_300727_1d
GATGGCCGGATCAGGAGACGAGCTGATGCTGCTCGGCAAATGGCCAAGCCCATTCGTCACCAGGGTTGAGCTCGCGCTC
GGCCTCAAGGGCCTCAGCTACGAGTACGTCAAGCAGGACCTCGTCAACAAGAGCGAGCTCCTCCTCGCCTCCAACCCGG
TGCACAAGAAGATCCCCGTGCTCATCCACAACGGCAAGCCGGTCTGCGAGTCGTCAATCATCGTGCAGTACATCGACGA
GGCCTTCCCCGACGCCGGCGCCGGCGCCGCCCTGCTCCCCGCCGACCCCTACGAGCGCGCCGTCGCTCGCTTCTGGGTC
GCCTACGTCGACGACAAGTTCGTTCCGGCATGGGTGGCGACGTTCAGAGGCAAGACGGAGGAGGAGAAGGCGGAGGGGA
TGAAGCAACTGCTCGCGGCGGTGGAGACGCTGGAGGGAGCCCTGAAGGATTGCTCCAAGGGGAAGCCCTTCTTCGGCGG
CGACACAGTCCGGATCGTGGACGTCGCGCTTGGTGGCCTCATCTCGTGGGTGAAAG

> SEQ ID NO:4913 119262FL 125287_300629_1d
atttagaaccaaagtagtgatatcatatggcaggagtgaagtTGCTTGGTCTTTGGTATAGCCCTTTTAGTCACAGAGT
TGAGTGGGCTCTAAAGCTTAAGGGCGTGAAATATGAATTTGTAGAAGAAGATTTACAAAACAAGAGCCCTCTGCTTCTT
CAATCAAACCCTGTTCACAAGAAAATACCAGTGCTTATTCACAATGGCAAACCCATTTCTGAGTCTCTTGTCATTCTTG
AATACATTGATGAGACTTTTGAAGGTCCTTCCATTTTGCCTAAAGACCCTTATGATCGATCTTTAGCTCGTTTCTGGGC
TAAGTTCCTTGACGATAAGGTGACTGTAATAGTGAATACTTTCCTTAGCAAAGGGGAGGAACAAGAAAAAGCTAAAGAG
CAAGTTTGGGAGATGTTGAAAGTTCTTGACAATGAGCTCAAGGATAAGAAGTTTCTTGTAGGTGACAAATTTGGGTTTG
CTGATATTGCAGCAAATTTGGTGGCATTTTGGCTAGGAGTTTTCGAAGAAGCCTCTGGAATTGTTTTAATGACAAGTGA
AAAATTTCCAAATTTTTCTAAGTGGAGAGATGAGTACACTAACTGCAGCCAACTCAAGGAATCTCTGCCTCCAAGAGAT
GAGTTGCTTGCTTTTTTCCGAGCTCGTTCTCAAGCTGCTACAACTTCTGCTTCCGCTCCCAAATGAACAGATTCGcATA
CAtttTaTGAAGTTTcgagatTATGTGTTagaAtaaacttttgaatCtaggacgagGTCTGTagattcaattatGTATA
CTTAtgcaaaaggaaaAAAatTaaattttataTAAgattaagCtcGttcAGAACT > SEQ ID NO:4914 119262FL 1188591_302141_1d
AAGTTAGTTCTCTCTCCCTCTCTTAGGCAGGTCTCAAAGGCCATTTCTCTCTCTCTCTCTTTCTCTCTCTCGTGGGC
AGGTCTCAGGGGTCATTTCTCTCTCTCTCTCAGGAAAACTAGAATAGGAGGTGAAGGGCAAATGGCAGGAGGACAAG
AAGGGGAGGTGAAGCTTCTCTCAGCTTGGTTTAGCCCATATGGAGGAAGGGTAGTGTTGGCCCTGCATGTCAAGGAGGT
TCCCTTTTCCTACATTGAGGAGGATCTGGGAAAGAAGAGCCAGCTCTTGCTCGAATCCAACCCTGTTTACGAGAAGGTG
CCCGTCCTTCTCCATGCCGGCAAGGCCATCTGCGAATCCCGTGTCATCATCGAGTATATTGACGAGGTTTGGCCTGGCC
GTGGTAGCTTGTTGCCCCTTGACCCTTACGCCCGTTCGCAGCATCGGTTCTGGGTCGATTACATCGACAAAAAGCTGTC
GAGCGCATGGCGGCTAGTCCTGTCTACATCAGGCGAAGAACAAGGAAAGGCGGTGGAGGAGTTGATTGCCTTGTTGAAG
CCTCTGGATGAGGCATTGAGGGAGCTATCTGGAGGCAAACCCTTCTTCAATGGAGATGACATGGGCT.

> SEQ ID NO:4915 119262FL 1177880_302126_1d
gagagagagagagagagagagagagaGAGAGTGAGTAAGGGTGAGAGTGAGAGTGAAAGTTGAGGTAAGAATGGGAGAG
GGAGAGGGAGATGTGAAGGTGTTGAGTAGCTGTTATAGCATGTTTGGGATGCGAGTCCTAATCGCCCTTCATGAGAAGA
ATGTGCCCTTTCATCTCATTGAAGAGGATCTCTCTAACAAGAGTGAACTGTTGGTGCAATCGAATCCCATCCATAAGAA
GATCCCCGTGTTGGTTCACAAGGGGAAAAGCATCTGTGAGTCAAGCATCATCGTTGAATACATAAATGAGACATGGCCT
TCCCCTCCCCTCTTCAACCCGTCCACCCCTTACAACACTTACCTTCATCGCTTTTGGGCTGATTACATTGACAAGAAGT
TCTATGATGCAGGGTCAAGGATTGTTACAAGTGCAGCTAGAGAAGCTCAAGAGGGTGCAATTAAGGACTTGGTGGAGAG
TTACAAGATGATGGAGAAGGCATTGGCTGAGATGAGTGGTGGGGTTAAGCCTTTCTTTGGTGGAGAGTCAGTGGGGTTT
GTAGATGTTATGTTGGCACCCTTTTTACCTTGGTTTTgCTCATTCGAGATCATAGGGGGGT > SEQ ID NO:4916 119262FL 1119831_301901_1d
tgagagttgagggttgagagttgaaaagagcaataatcaacaataatgggtgacctgtgaggGAGAAGAGGAGGTGAAG
CTGTTGGGGTTCTGGCCAAGCCCATATGTCATGAGAGTGGTCTTTGCCTTGAGGTTAAAGGGGGTCAAGTATGAGGACA
TAGAGGAGATTCCGTTCGAGAAGAGCCAACGATTTGGTGGAGGCAAACCCTGTGTACAAGAAGATACCTGTCCTCATTC
ACAACGGGAAACCCATCTGTGAGTCTTCCATCATCCTGCAATACATCGATGACACATGgCCACATGAACACACaAaCTT
CCTTCCTAAAcagcCCTTTGCcagggcttATACTCGCTTCTGGGCTGATTTCATTGacAAGAAGGTattccagCcGATG
CATACTCCTTgtgtatttctgATTCAATTCAATTCAATTCAACTAGTGCTTATCGTCATAAAATTGGttTAATGGTGAt

FIG. 2 continued tgcAGGtatttgATGCGgcTTCTCGAgtTCTGAGATCGAGCGGggAGCAACAAGAAAAGGCGTGGGACGAGTATattgg
gTaccttgagGTt > SEQ ID NO:4917 119262FL_1116172_301810_1d
AGCAAGCAGGGTTGTAAGCAAGTTAAAGTACGAATGGGAGAGGGAGAGGGAGATGTGAAGGTATTGAACAGTAGGTTTA
GCATGTTTGGCATGCGAGTTTTAATAGCCCTTGAGGAGAAGAATGTGCCCTATGAACTGATTGAGGAGGATCTGAGAAA
CAAGAGCAAGCTCTTGGTGCAATCGAATCCCATCCACAAGAAGATCCCCGTCCTCCTCCACAAGGGGAAGCCCATATGC
GAGTCAAGCATCATCGTTGAATACATCAACGAGACATGGGCTTCCCCTCCCCTCTTCGATCCTTCCACCCCCTACAACA
CTTCCCTTCATCGCTTTTGGGCGAATTAC > SEQ ID NO:4918 119262FL_1114607_301804_1d
gaaaggggaaaaaaagaggaagaaAGGACACGCCAAGCATGGAGGAGGGACAACAGAGGGCGGGGGAAGTGAAGGTGTT
GGGGAATTGGGCCAGCATGTTTTCTATGCGAGTCTGCATTGCTCTCGATGAGAAGGCCGTCCCATACGAAGCCACAAAC
GAGGACCTACGAAACAAGGGCCAGCTCTTGCTACAATCCAACCCTGTCCACAAGAGTGTCCCCGTCCTCCTTCACAATG
GCAACCCCATCTGTGAGTCTTCCATCATCGTCGAATACATCGATCAGACATGGCCTTCCCCTCCCCTTTTCAACCCCGC
CACCCCTTACAACCGAGCCATGCATCGCTTCTGGGTTGATTTCATTGACAAAAAGTTTAGTGAAGCGGGTGCAAGGATT
TTTAGAAGTCCACCAGGAGAAGTTCAAGATGGTGGATCAAAGGACTTGGTTGAGAGTTACAAGACGCTAGAGAAGGCAT
TGAAGGAGATGGCTTGTGGGAAGCCTTTCTTTGGTGGAGAATCCATTGGGTTTGTGGATGTTGCCTTAGCTCCATTTAT
ATCTTGGTTCAAGACATATGAGACACTGGGAAAATTCAAGTTACCAGGGGAAGAAGAATGCCCTTTGTTAAGTGCATGG
GTGAAGAAAGTGTCCGAAGTGCCTAGTGTGAAAAAAACCTTGCCAGACCCCGACAAGGTCcttgacTTTGTCTAtggcC
TCAGAAgcatactTCTTCagtagTGAATGc > SEQ ID NO:4919 119262FL_1098513_301485_1d
GAGAGAGAGAGAGAGAGAGAGAGAAGGTGAAGATGGGGATGAGGTGAAGGTGTTGGGCTCTTGGGTGAGCGGTTTCGC
CTTGAGAGTGTGCATTGCCCTCAACGAGAAGGGCGTCCCATACGAGCTCTTAGAGGAGGACCTTCAAAACAAGAGCCAG
CTGTTGCTCCAATCCAACCCCGTCCACAAGAAGATCCCCGTCCTCCTTCACAATGGGAAACCCATCTCTGAGTCTCCCG
TCATTGTCGAATACATCGATGAAACATGGCCCTCCCCTCCCCTTTTCAACCCCCCCACCCCTCACAACCGAGCCTTGCA
TCGCTTTTGGGCAGATTTCATCGACAAAAAGTTTGCTGATGCAAGCTTGAGGATTATACATAGCCCACCTGGAGAAGTA
CAAGATGGTGGAGTGAAGGACATTGTGGAAAGTTATAGGATTCTATAGAAGGCATTGGAAGATATGGCATGTGGAAAAC
CTTTCTTTGGTGGAGAATCCATTGGGTT > SEQ ID NO:4920 119262FL_1098364_301484_1d
gagagagagatagagagagagagagagcgagagtGGTGGTAGCAGCAGCAGCTGAGAGTGAAAGAGAGAGAGAGA
GCGTGGGGGTAGCAGCAGTTGAGAGAGAGAGAGAGAGAGAGAGAGTAGTAGTAGTAGTAGGCAAGGAAGAAGGTATGGC
AACTGTGAGTGAAAGTGAAAGTGAGGTGAAGGTGCTGTCCACATGGGCTAGCATGTTCGGCATGCGCGTGCTCATCGCC
CTCAACGAGAAGGGCGTCCCCTATGAGCTCACGGAGGAGGACCTTCGCAACAAGGGCCAGCTCTTGCTTCAGTCCAATC
CCATCCACAAGAAGGTACCCGTCCTCCTCCACCATGGGAAACCCATCTGTGAATCCAACATCATTGTTCAATACATCGA
CGAAACGTGGCCTTCCCCTCCCTTCTTTCAACCCCCCTACCCCTTATAACCGTGCCATGCACCTCTTCTGGGCCGACTTC
GTTGACAAAAAGTTTTATGCAGAGACGGGCTTGAAGGTTCTAAGAAGCATGCCTGGGGAAGACCGCGACAAAGCGGTGG
AGGAGTTTCAGAACAGCTACAAAATGATGGAAAAGGCATTGGGGGATATGGCATGTGGGAAGCCTTTCTTTGGTGGAGA
CTCCATTGGCTTTCTTGACAttgcctTTGCTCCTTTCGTTt > SEQ ID NO:4921 119262FL_135668_300416_1d
GTTCCAGCCATGGCAGCAGACGAAGGGAGTGAAGGTGTTCGGCATGTGGGCGAGCCCCATGGCGATCCGTGTGGAGTGG
GCGCTCCGGCTCAAGGGCGTCGACTACGAGTACGTCGACGAGGACCTCGCCAACAAGAGCGAGGCGCTGCTCCGGCACA
ACCCGGTGACCAAGAAGGTGCCCGTGCTGGTCCACGACGGCAAGCCTCTCGCCGAGTCCACCGTCATCGTCGAGTACAT
CGACGAGGCCTGGAAGCACGGTTACCCCATCATGCCCTCCGACCCCTTCGACCGTGCTCAGGCGAGGTTCTGGGCCAGG
TTCGCTGAAGAAAAGTGCAACGCTGCTCTGTACCCGATCTTCATGACGACCGGAGAGGAGCAGAGAAAGCTGGTGCACG
AGGCCCAGCAGTGCCTGAAGACGCTGGAGACGGCCCTGGAGGGGAAGAAGTTCTTCGGCGGCGACGCCTTCGGCTACCT
TGACATCGTCACCGGGTGGTTCGCCTACTGGCTGCCGGTCATCGAGGAGGCCTGCGGCGTCGAAGTCGTCACCGACGAG
GCGCTGCCCCTGATGAAGGCCTGGTTCGACCGGGTCCTCGCCGTCGACGCCGT > SEQ ID NO:4922 126534FL_115033_300011_1d
ATCAATTTGCCAAGGCTAGAATTAACATACCAGATAGTGGCTTTTTCTGCAGCTCCTACATCTCCGAACTGTATCGTTT
TCACAGTTAAGCATATCAGCCCCACTTTAGTCGCAATTAGCACATGTCAACCGGGGGCAACGGAATGGACAACTGCCAA
TTACCAAAATCGTTTGCCATTTGTTAGCAGCATTTGGAATAAGTTAGTTTTCTGCAATGGTCTCTTTTATTGTCTGAGT
CTTACTGGTTGGTTGGGAGTCTATAATCCAGAAGAACGTACTTGGCTTGTTCGTGTGGTTCCACCTCCGAGATGCCCTG
AAAATTTTTTCGTGAAAAATTGGTGGAAAGGAAAATTTATGGCAGAGTACAATGGAGATATCTATGTGATATACACTTG

FIG. 2 continued

CTCTACTGCAAATCCGGTGATATATAAGTTAGACCAAATAAATAAAATTTGGGTTGAGATGCAAACTTTAGGTGGTTTG
ACACTTTTTGCAAGCTTTCTGTCATCCCAAGCAAGGACAGACGTTCTTGGGGTGATGAGAAATAGTATTTATTTCTCGA
AAGTTCGTTTTTATGGAAGGCGTTGCATATCCTATTCCCTCTATC

> SEQ ID NO:4923 126534FL 155282_301354_1d
CTTAGAAAAGAACCACAAAAAACTGACTTCTTGCAGCTATGGCTGCAAGCAAAAAGAAGAAAAATGAAGTTATTAGCTG
CAACAACTCCAACTAATGGTGGTCCTTCTACTGAGGAGCGTGAAGGATCTGATGAGCAAAACTCATTGTCTTGTGTACC
AATGGAAATTCTAGAACTGATTCTCTCCCGGTTAAACTTGAGAGAAAACATCCGTGCTTCTGCTGTTTGCAAGCAATGG
CTTGCTGTCTCCATTTCTGTACGAGTTGCAAATAAACCAC

> SEQ ID NO:4924 128348FL 103518_300363_1d
tgtatggcgcagagtggccattcggccggggGAAGCCAAGTTTGGGAAAATCTTAAAAGAAAGAAAGAAATGATGACGA
ATCGCCACTTCCTCTTCGCTCTTCTTTTCACTTTCTTTCTTTCAGCTGTTGCTGCAGATTCTTCTGAAGAGTGTGTATA
CACATTGTATGTTAAAACTGGATCAATCATAAAGGGTGGAACAGACTCCAAAATCAGCGTTACACTTGGCGATGCTAAA
GGAAAATCAGTATATATTCCAGATCTAGAGAAATGGGGTTTAATGGGCCCAAATTATGATTACTACGAAAGGGGTAATG
TGGATATCTTCACTGGTAGAGGCCAATGTTTAAGCCCACCAATTTGCAGGCTTAATGTTACTTCCGATGGATCAGGTGA
CCACCACGGTTGGTTTCTTGATTTTGTTGAGACTACTTTTACTGGGCCACACAAAACTTGTAGCCAATCCATATTCTAT
GTCGAACAATGGTTGGCTTCTGATGCTCCTCCTTATGAGTTATCAGTTTCTCTTGATGGTTGTAAAAAGAAGACTGGGC
TTCGACATGCTCGGCGTTTTGTCGTGGGCCAGCCCAATGGGTCTGCTTCAGAATAGTTTGGCCCGTTGAAGTTCTTTTT
GTAATTTTGTCGTTGAGATGATTTTGATGTGTAGATTGCCCTGTGTTTTCCCTTCTCTTTGGTTGAAATAAATTTCTTG
TTTGGGGCTTCCTTTCTTGCTTGTTTAGTCGTCATATCTTTGACTTATTGGCTCTTTTGGCAATTTGCAATCTTTTATG
TACTCAataag > SEQ ID NO:4925 128348FL 1108676_301519_1d
GTCATCACACAAGTGAAGAAGCAGTAGCAGTAGAAGGAGATAGAAGGGAACCTCTCTCTCTCTCTCTCTCTTTGCTG
ATGATGAAGACGACTATGGCTGTTTTCGCCCTTCTCTCTCTCTTCCTTCTTCTCCTCCCCCCTTTTCCTTCATCAGCTG
ATGATCCTTGTGTATACTCAATCTATGTACGAACGGGGTCAATATTCAAGGGGGGAACGGATTCGAAGATGAGTGTGGA
GCTCTACGATGCGAATGGGTACTACATTACGATCAACAATTTGGAGGAGTGGGGGGGGTTAATGGGTCCAGACCACGAC
TACTATGAGAGGGGCAATCTTGACATCTTTAGTGGTTTGGGGGACTGCCTGACCGGACCCATCTGCGCTCTCAACCTCA
CCTCGGACGGCACGGGGGCCCACCATGGGTGGTATTGCAACTACCTGGAAGTTACTGCCACGGGTGCCCACATCCCTTG
CTCCCAACAGCTCTTTACCATAGAGCAATGGCTTGCCACTGATACCTCTCCTTACTCCCTCACTGCCCTTCGATATAAT
TGCCCTGATGCTTTGTCCTCGCCTCGCTTCCTCGCATGCCTTCCAATTCGCAACCGAAGAATGGTCAACTAATGTCCC
ATTAGTACTCTATCACCCTGCTTCGTAATAAAAAGATAGCCCCTTCTTGTGTACTATGGAGGGAGGGGGGTATCTCTCT
CAAGGtaccttatttgttGATGtttctcgaggcacctcgcaTTAAtgtatgTGttgtttactaTcttgtacGCttgtgt
GATAAATct > SEQ ID NO:4926 128348FL 157312_301737_1d
tttgcctttattcgttctcATTTTTCTAGAGAAAGAGAGTTCAAGAAACCATGGGAGTAGCTCAAGTTAACCAAATATG
GTTCCATTTCATGATAATCCTCTTCTTCATCTCCATATCTTCTAGTTCTGCATCAGAAGATGATTGTGTGTACACAGCT
TACGTTCGAACTGGATCAATCATAAAGGCTGGAACTGACTCAAACATTAGTTTGACTCTCTACGATGCCGCTGGCTATG
GGATAAGAATCAAGAACTTAGAGGCATGGGGTGGGCTTATGGGCCCAGGTTACAACTATTTCGAAAGAGGAAACTTGGA
TATATTCAGTGGACGTGGTCCATGTTTGACTGGGCCGATCTGCAAAATGAATCTGACTTCTGATGGATCAGGCCCACAT
GCCGGATGGTACTGTAACTACGTCGAAGTTACCGTTACTGGAGCCCACCAACAATGCAACCAGCAGCTTTTCACCGTGG
AGCAGTGGCTCGGCACTGACGTTTCGCCGTATGAGCTGACGgccGTCAGGAACAACTGTAAGAAGCCAAAGTTTGAgaa
ACAACAGGCCTTTTATGATTCTGAATCTTATCCAgttgttGATGTaaTttaatgggggTAg > SEQ ID NO:4927 128348FL 171733_300536_1d
ccccgatctccaccaccactttcccggggaccgcggcgggaaAGGGCCTTCGAGACTTGGGAGGTTGGAGCGAGCAAGC
TCGGCCATGGCGAAGCTCTCCTGCCTTCTCATCGTCTCCTTCGCCGTCGTCGCGGCGTTGGCGGCCACGGACGACGACG
CGGCGGCGGCGGCTGAGGGGATCACGGTGGCGGAGGCGTCGTCGGACCCGGAGAACAAGTGCGTGTACACGATATACGT
GCGGACGGGGACGATCTGGAAGGGCGGGACGGACTCGGTGATCGGCGTGACGCTGCTGGGCGCCGACGGCTCCGGGGTG
CGGATCCGCGACCTGGAGCGGTGGGGCGGCCTCATGGGCGACGGCCACGACTACTACGAGCGCGGCAACCTCGACATCT
TCAGCGGCCTCGGCCCCTGCATGCGCCAGGCGCCGTGCCGGATGAACCTCACCTCCGACGGCACCGGCCCGCACCACGG
CTGGTACTGCAACTACCTCGAGGCCACCGTCACGGGTCCCCACCTCGGCTGCGCGCAGCAGCTCTTCACCGTCGAGCAG
TGGCTCGCCACCGACGCATCGCCCTACCGCCTCTACGCCGTCGTCGACAACTGCAACAAGGCCAaggaCGCCGCCG > SEQ ID NO:4928 128348FL 252626_301603_1d
GATGTCGACGGGGAAAGGCTTAGCTCTAATCCTGGCATTTGCTGCCATCGCCACCTGCATCACCTCTGCTACGAACCAA

FIG. 2 continued

```
TGCGTATACACTATTTATGTGAGGACGGGAAAGGTGATAAAAGGGGGGACAGATTCAAACATTTCGGCACGATTCTATG
ATGCCAACGGATACTATATCAATTTGGAAAATTTGGCAGAATGGGGTGGTTTGGGAGGTCCTGGCTACAACTACTTTGA
GAGAGGCAATTTGGATGTGTTCACAGGCCTTGGGCAGTGCCTCACGGCCCCCATTTGCGCGCTCAACCTGACCTCAGAC
GGCACTGGAGACCAACACGGGTGGTACTGCAACTATGTGCGAGGTCACCTCCACCGGGCCCCACATCCCTTGCAGCCAAC
ACCAATTCACCATCGAGCAATGGCTTGCCACTGACACCTACCCTTTCGAGCTCAATGCCACCCGTGACGATTGCCTGGT
CGAGGGCAAAACCAGCGCCTCCAAGGCAATTTCATCAGAGTCGAGCTAGAGTTCCAGCTGGGCCTTTTTTGGCTTCCGT
TTTTGATGAATAAGCAAGCTCCTTCT

> SEQ ID NO:4929 128348FL_147510_301253_1d
AGAGAGTTCAAGAAACCATGGGAGTAGCTCAAGTTAACCAAATATGGTTCCATTTCATGATCATCCTCTTTTTCATATC
TTCTATTTCGGCATCTGAAGATGATTGTGTGTACACAGCTTACGTTCGAACTGGATCAATCATAAAGGCTGGAACTGAC
TCAAACATTAGTTTGACTCTCTACGATGCCGATGGCTATGGGATAAGAATCAAGAACTTAGAGGCATGGGGTGGGCTTA
TGGGCCCAGGTTACAACTATTTTGAAAGAGGAAACTTGGATATATTCAGTGGACGTGGTCCATGTTTGAATGGGCCGAT
CTGCAAAATGAATCTGACATCTGATGGATCGGGCCCACATGCCGGATGGTACTGTAACTACGTCGAAGTTACAGTTACT
GGAGCCCACCAACAATGCAACCAGCAGCTTTTCACCGTGGAGCAGTGGCTCGGCACTAACGTTTCGCCATATGAGCTGA
CGGCCGTCAGGAACAACTGtAAGAAGTCCAAGTCCACAGTTTATGATTCTGAATCTTATCCAGTTGTTGATGTAATTTA
ATGGGGGcagccCCACATAttGTCTCTGTGGttttttctttagaGtGagaaGAattaacgTGAtgc > SEQ ID NO:4930 128348FL_47162_300174_1d
AAAAAAACAAAATGGCTCGTCGCGATGTTCTCCTCCCTTTCCTCCTCCTTCTCGCCACCGTCTCCGCCGTAGCTTTCGC
CGAAGATGATCCAGACTGTGTATACACATTCTACCTCAGAACCGGATCGATCTGGAAAGCCGGAACCGATTCGATCATC
AGCGCAAGAATCTACGATAAGGACGGTGACTACATCGGAATCAAAAACCTTCAAGCTTGGGCTGGATTAATGGGACCTG
ATTACAATTACTTCGAGAGGGGTAATCTCGACATTTTCAGTGGAAGAGCACCGTGTTTACCTAGTCCGATCTGTGCCTT
AAACCTAACCTCCGATGGCTCCGGCGATCACCATGGTTGGTACGTTAATTACGTTGAG > SEQ ID NO:4931 128348FL_292168_200194_1d
ttttcctcTCATTTTCTAGAGAAAGAAACAACAAGACGTACAGAACGAGAGTTCAAGAATCTGCAATGGGAGTGGCTCG
AGTTAACCAATTCTGGTTGCATCTTGTCATCCTCTTCTCCATCTCCGTTGCTTCCATTTCTAGCACTGTAAGTCACCCT
TCTCTACTTCTACTACGTTGACAGATTTAGAGTAGATGCACTGGATTACGTCGAACTCACCGCGTTAAAAAGCTGCCCG
GTGCAATAAGCTCCCGTAGTGGACGGGTCCGGAGAAGGGTCGAACTCACTGCTTTACTTCTTAATTACCTTATATGTAA
GAAAAGAAACAAATATATATGAGTAAGAATACAACACATTGATTCTAAATTATAAATTTGTCACTGTGTACCATAATAT
TTTTCATTTTGCAATTGCTGAATTGATGGGAAAATGCAGGAACTGAATTGTGTATACACAGCTTATGTTCGGACTGGGA
CATACTGGGGATCTGGAACTGACTCAAAAATTTCCTTGTCTCTTTATGATGCCACTGGCCATGGACTTAGAATCAATAA
CCTACAAGCCTGGGGCGGGCTTATGGGCCCGGGTTATGACTACTTTGAAATGGACCAATTGGATATGTTTACGGGCCGT
GGTCCATGTTTGACTGGGCCAATCTGTAAAATGAACTTGACTTCTGATGGATCAGGTGAGCACCACGGATGGTACTGTA
ACTACGGGGAAATCACGTCTACAGCAGAACACAAACGATGCAGCCAACAGGCGTTCACCGTGGAGGCGTGGCTCAGTGC
CGGTCAGTACCCAGATGGGTTGACCGCCATTAAGGAACAACTGTAAGCGTATTTCCAACGAACAACAACCAATTCATGA
TTCTGATCAATCTTATCATGTTGTGGATGTAATTTAATTCGAGTTTATTGGACGTTGTATGATTTACGAAGGCCATTTA
GGCCAAGGCCTGATATGTACTCTCACGAGTGCTACATAGTTGGAATGAAAAGTTTTCTTTACCCATATCTTT > SEQ ID NO:4932 128348FL_279714_200064_1d
gagaggaaGAAAAAGCTCAAGAGAAGACATGGGAATAGCAGCTCACTCCAACCATTTCTGGTCCCTTCTCTTCATAGTC
TTTTTCTCTTTCTCCATCTCCTCCATTTCCGGATCTGATGATGATTGCGTGTACACAGCTTATGTCCGAACGAGTTCAA
TAATAAAGGGTGGAACAGATTCGATTATCAGTTTGAGTCTCTACGATGCAAACGGGTATGGTCTTAGAATCAAGAACCT
TGAGGCCTGGGGTGGCTTATGGGCTCTGGTTACAACTATTTCGAGAGGGGAAATTTGGACATTTTCAGCGGACGAGGC
CCATGTTTGACTGGGCCTGTCTGCAAAATGAATTTGACTTCCGACGGAACAGGCAAAGGCCATGGATGGTACTGTAACT
ACGTGGAGGTCACCGTCACCGGAGTCCATAAAGCATGCAACCAACAGAATTTCGAAGTGGAGCAGTGGCTAGCTACTGA
TGCTTCGCCGTATGAGCTTACGGCTGTTAGAGACAACTGTAAGAAGTCCAAGTCCGATGAGAAACTGTCCATTTCCGAT
GTCTACGGAACTCATTCCACTCCACCTGTTTCTGTGATTTAAATTTCTAGTTATTGGGTTTTAATGGGCCTGGACCCAC
ATTTCCCTTTTACCCTTATTACTgtgATGTGAAATTTATCAGGGGTAAGAATGACATttCATgTgTgTcaatgttgcTt
tCATGTTATAGTATGAGatagaggAgtaGT > SEQ ID NO:4933 128348FL_274067_200147_1d
GGGCGGACGCGTGGGCGGACGCGTGGGCGGACGCGTGGGGCCTTTTATCCTCTCATTTCTAGAGAAAGAAAAAATTTCT
CTTGCACAACTAGCTGCCATGGGAGTAGCTCATCAAGTTAACCAATTCTGGTTCCCTCTCATTATCATCCTCTTCTCCA
TCACCATTTCTTCTACTTCTGGAACTGAATCAAATTGTGTGTACACAGCTTACATTCGGACTGGGCCATTCATGGAGGA
TGCAACTGACTCAAAAATAAGCTTGACTCTCTACGATGCGAGTGGCTATGGAATTAGAATCAAGAACCTAGTGGCTTGG
GGTGGGCTTATGGGATCAGGGTACAACTACTTTGAAACGGACCACTCGGATATGTTCAGTGGCCATGGACCATGTTTGA
```

FIG. 2 continued

CTGGGCCGATCTGCAAAATGGTCTTGACTTCTGATGGTACAGGCCGACACTCAGCATGGTACTGTAACTACGTGGAAGT
CACCTCAACAGGAGACCACAAACAATGCAGTCAACACTGTTCAAAGTGGATCAGTGGCTTAGCACAGATCGTTCGCCG
TATCAGTTGACTGCCACAAGAAACAACTGTAGGCGTATATCCGGTGACCAACAACCCATTGTTGTTGATGTAATTTAAT
TCGAGTTCATCATATTGGGCTACTTACAAACTAC

> SEQ ID NO:4934 128348FL 130994_300509_1d
GAATTCACATCTAAAGTCAACAACAAGAGCTTCTCGCTTCTCCTCGTCTCTGTTCTCCTCTCTTTTGCAATCCTCTCTC
AATCTGCTGATGATTGTGTATACACAGTATACACAAGAACAGGATCAATCATCAAAGGAGGAACGGATTCAAAATCTC
ACTAAGATTATACAGCAAATACGGTAAGTACATCGAGATCCCAAATCTTGAATCATGGGGTGGATTAATGGGTCCTGGT
TACGATTATTTCGAAAGAGGTAATCTTGATATCTTCAGCGGAAGAGGTTATTGTCTGGGTTCACCGGTTTGTGCCATGA
ATCTGACTTCCGATGGTACTGGTTCCGGTCACGGATGGTATGTGAATTATGTTGAAGTTACTACTACCGGTGCACATAT
TAATTGTGGTCAACAGAATTTTGAAGTGGAAGATTGGCTTGCTCTTGATAGATCTCCTTATAGTCTTACCGCTATCAAG
AATAATTGTAATCAGAAATTATCTGATCATGATTCTCATTCTGCTGATCAGTCTATGTAAAATTTGATCTCTTGTTTGA
TTCGGTGGTGGTCTAGTATGAGTGATCGGACGGTCGTCATTGTGTGTTGTAATGTTGAAATTATTTTCTTGAATAAAAT
GATTGAGTGAGTAGTG

> SEQ ID NO:4935 129424FL 1170936_302040_1d
AGAAAGAGAGAGACCAGAGAGAGAGAGAGAGAGAGACTGGTAACAATGGCAATGGCGTTGAGAGCAGCGTTCCAGTGCA
CGCCAAGCGCATCATCCCTTTCGTCCTCCTCCTCCTCGGCATCGCCCCTCCTCCGTCGGGGTGCTGCTGCCGCCCTGAG
GTTTGCACGCTGCTCGACCCCGGTAACGCGGGAAGCCCACTCTGCAGCCCTCCTCCCTTCAGAGCCGCCGCTCGGTCC
TGGCGCGCCCTCTCCCTCCCTGCCTCCCAGCTCACCGCCTCCCCTCCCACCCCCGCTTACACCATCAAGGAGGAGGGTA
AGCCCGAGTCCCTCGACTTCCGCCTCTTCTACTTCAGCGATGATTCCGGCAAAAAGATCTCACCATGGCACGACATACC
TTTAGAAGCCAAGGATGGCATGTTCAACTGTATTATAGAGATTCCAAAGGAAACCAGTGCGAAAATGGAAGTGGCCACC
GACGAATTCTACACCCCTATCAAGCAAGATACTAAGAAGGGC

> SEQ ID NO:4936 129424FL 227659_301030_1d
GTCGCTCCGCCGCCGCCGCTGTTCACTCCGCACCAACTCCGACGATCCCCCGGCGAGCTCTCGACGATGGCGACGG
CGGCGACGGCGTCGGCTACGGCGGCCACCCGCTTCACGCGGCTGGCGGGGGTCGGGCTCCGGCGCACGGCCCGCCTCCC
CACGGCCGTGCGGTTCCAGCGCCGGGTGCTCGCCACCACCGCGCTCCTCAGGACCGCCGAGCTCCGGCCCAAGGAGCAG
GGCCTGCCCGAGACGCTCGACTACCGCGTGTTCCTCGTCGACGGCGGGGGCCGCAAGGTTGTCGCCGTGGCACGACGTG
CCCCTGCGCGCAGGCGACGGGGTTGTTCCACTTCGTCGTGGAGAATCCCAAGGAGAGCAGCGCCAAGATGGGAGGTCGC
CACCGACGAGTCATTCACCCCCCATCAAGCAGGACACCAAGAAGGGCAACCTCCGATACTACCCGTACAACATTAATTGG
AATTATGGATTATTTCCCCAAACATGGGAGGACCCAACTCTTGCAAACACCGATGTCGAAGGAGCATTTGGGGATAATG
ATCCTGTTGATGTTGTTGAGATTGGTGAAAGACGTGCTAACATTGGAGATGTTCTTAAGGTAAAACCGTTGGCAGCTTT
AGC

> SEQ ID NO:4937 129424FL 243145_301336_1d
AAATCATTTATTGATTTAATCTCCTTTTTCCTTTATCATAATGCAAAGAATCCATTAAGAGAAGCACTTCAAACGAGCG
AGAGATCCCCCGCCGGGGCAGACCTTGTCACAAGCTTCACCCACGCTTGATGCGTCTCCTGGATCACCTTGAGCGCGTA
CTCCTTGCCAGCAGCCTTGTTCCCCAGCCCAAACTTATTCTGCGGCTTCCCATCCGGCACCTTGTAGTCGCGGAACCAG
TCCCGGATCTCCATCAGCGTCCCGGGAAAGTACTTCTCCACATCACTCTCATCGTTGAAAAGCCCAGCCCTGGGATCAT
CCACGGAGATGGCCACCACCTTCCAGTCCAGCTCCCCCTCATCGATCATCGCCAGCACCGCCACCGGCTTCACTCGAAG
AACTTCCCCACGCCCCGCCTTTCGCTCGCCGATCTCGACAACGTCGACCGGATCATTGTCACCAAGCGCTCCCTCCACA
TCCGGGTTGGCGTGGTTTGGATCTTCCCAAGTTTGCGGAAGAAGCCCGTAGTTCCAGCGTATGTCGTATGGATAGAACC
GTAGCTTGCCTTTCTTCACGTCCTGCTTGATCGGCGT

> SEQ ID NO:4938 129424FL 49512_300159_1d
GCCATTACGGCCGGGGACTGGAAAATAGTTGCTATTTCACTAGACGATCCAAGAGCTTCACTTGTTAATGATGTTGATG
ATGTAGAGAAACATTTTCCGGGCACTCTCACCGCAATCAGGGACTGGTTTAGAGACTATAAGATACCTGATGGAAAACC
TGCCAATAGGTTTGCTCTTGGCAACAAGCCAGCAAACAAGGATTACGCTCTTAAGGTGATTACGGAAACCAATGAATCT
TGGGCAAAGCTTGTCAAAAGATCTATCCCGCTGGTGAGCTTTCACTTGTATAGATGCCAATTGATAGAGCTTGAGCCA
gcTAGTTTTCATGCTCGTAACCTAAACTGGACGCGGAAAATGGCCCCAGGATTATGCtctTCGCTTTTGAGGTGGAAGT
CCATTCATATtctTAAGACAGTTTTTTGTTAAAAATGTTACTGTTTTctATTTCATCATCCATAATTTTGTTCatgca
gtagtgttttcaaattttatttagggtgaaaacaggtgtactgactactgataattgaattgatcgtcattcctc > SEQ ID NO:4939 129424FL 127868_300473_1d
CCCCCCGAGTTCCCCATTTCAGCAGCAAAGGCAACAATGGCGGCTGCAAGAGTAATGATATCAGCCAACAACACTCTAA
CAACTTCTCTTTTATCCAAAATTCCTCTCCAAAAGCCCAATAGTTTCAACCTTTGTTTCCGCAATAGGTCTGCTGCTGC

FIG. 2 continued

ACACAGGAGCCAACTTTTCACTTGCACTGCTATTTACAATCCCCAGATTCAAATCAAAGAACAAGGCCAGCCCGAAACT
TTAGATTACCGTGTCTTTTTCGTTGATGATTCCGGCAAAAAGGTGTCCCCTTGGCATGACATACCACTGCATTTAGGTG
ATGGTGTTTTCAATTTTATTGCTGAAATTCCTAAAGAATCGAGTGCAAAGATGGAAGTTGCTACAGATGAGCTGTACAC
ACCAATAAAGCAAGACACAAAGAAGGGGAAACTTAGATACTACCCATATAATATTCATTGGAACTATGGATTGCTTCCT
CAAACCTGGGAAGACCCCTCATTTGCAAATGCTGAAGTTGAGGGGGCATTCGGAGATAATGACCCTGTTGATGTTGTCC
AGATTGGGGAAAGTCGTGCTAAAATTGGCC

> SEQ ID NO:4940 129424FL 129116_300403_1d
CCCCCGAGTCTCCCGCCGCCGCCGCCGGGGGTCACTCCGCACCAACTCCGACGATCCCCCGGCGAGCTCTCGACGATGG
CGACGGCGGCGACGGCGTCGGCTACGGCGGCCACCCGCTTCACGCGGCTGGCGGGGGTCGGGCTCCGGCGCACGGCCCG
CCTCCCCACGGCCGTGCGGTTCCAGCGCCGCGTGCTCGCCACCACCGCGCTCCTCAGGACCGCCGAGCTCCGGCCCAAG
GAGCAGGGCCTGCCCGGACGCTCGACTACCGCGTGTTCCTCGTCGACGGCGGGGGCCGCAAGGTGTCGCCGTGGCACG
ACGTGCCCCTGCCGCGCAGGCGACGGGGTGTTCCACTTCGTCGTGGAGATCCCCAAGGAGAGCAGCGCCAAGATGGAGGT
CGCCACCGACGAGTCATTCACCCCCATCAAGCAGGACACCAAGAAGGGCAACCTCCGATACTACCCGTACAACATTAAT
TGGAATTATGGATTATTTCCCCAAACATGGGAGGACCCAACTCTTGCAAACACCGATGTCGAAGGAGCATTTGGGGATA
ATGATCCTGTTGATGTTGTTG

> SEQ ID NO:4941 129833FL 105009_300046_1d
ACTTTTACAGATCTATTTGACTATTTCCCGCTCACAGCTTTGGTTGAATCCGAAATTTTTTGCCTCCATGGTGGTTTGT
CTCCATCTATTGAAACTCTTGATAATATTCGTAATTTTGACCGAGTCCAAGAAGTTCCACATGAGGGGGCCATGTGTGA
TCTTTTGTGGTCCGATCCTGATGATCGATGCGGCTGGGGTATTTCACCCAGGGGTGCTGGATATACATTTGGCCAAGAT
ATATCTGAGCAGTTTAACCACACCAACAACTTAAAACTAATTGCGAGAGCACACCAACTGGTTATGGAGGGATTCAATT
GGGCACATGATCAAAAAGTGGTTACCATATTTAGTGCCCCTAATTATTGCTACCGCTGTGGGAATATGGCATCCATCTT
GGAAGTTGACGACTGCAATGGCCATACATTCATTCAGTTTGAACCAGCTCCTAGAAGAGGGGAACCAGATGTAACCCGA
AGAACGCCAGATTACTTCTTATGATGAAGCAACAGAAACTCGGTGGTTTTGCTGCAGCAGGTTTTGCTAAACTTGTCCT
AGGAGGTCTATAGTTAATACTGCTGTAGTTTCACGATACTGCGATTGCATGAAGCATGTAAATCGGGC

> SEQ ID NO:4942 129833FL 188955_300611_1d
AGATGCGAAAATTAACAGAGTGTATGGTTTCTATGATGAATGTAAGAGGCGATTCAATGTTCGACTGTGGAAGATTTTC
TGTGATTGCTTCAACTGCTTGCCTATGGCAGCACTCATTGACGATAAGATACTCTGCATGCATGGTGGCCTCTCACCTG
AACTGAATAGCTTGGATCAAATAAAGGATATCGAGAGGCCCACTGAGATTCCTGACTATGGTCTTTTGTGTGATTTAGT
TTGGTCTGATCCTAGTCCTGACTCAGAAGGGTGGGGAGAGAGTGACAGAGGTGTTTCCTGCACTTTTGGTGCAGATAAG
CTTGTAGAATTTTTGGAGAAGAATGATCTTGATCTTATATGCCGCGCTCATCAGGTTGTTGAGGATGGCTACGAGTTCT
TTGCGCAAAGGAGATTAGTGACAATCTTTTCAGCTCCAAACTATTGTGGGAATTTGATAATGCGGGTGCTCTGTTGAG
CATAGATGAAAGTTTAATGTGTTCTTTTCAAATCTTGAAGCCAAATGATACAGGGGCTCCACATTCAAGGAAACCAACT
TCAAACAAGACCCCAAAAACTGGAAACGCTTAACTTATATTATATCAAGCTACAAAGCATAATTGTTGTCAGCCCGAAG
GGGGTGATCTCTTTTATGTCTCGGATCCACCAGGGCATGGC

> SEQ ID NO:4943 129833FL 1176372_302109_1d
GCACGAGGGTCTATGTGTGATCTCTTGTGGTCTGATCCTGATGATCGTTGTGGATGGGGAATATCTCCTCGTGGAGCTG
GATACACCTTTGGGCAAGATGTCTCCGAACAGTTTAATCACACTAATAATTTAAAGCTTATAGCAAGGGCACACCAGCT
AGTAATGGAAGGCTTCAACTGGGCACATGAGCAAAAAGTGGTTACAATATTCAAGTGGCACCGAACTATTGCTATCGCT
GTGGTAATATGGCATCCATTTTGGAAATTGGCGATAACATGAGTCAGCATTTCATTCAGTTTGATCCAGCTCCAAGACG
AGGAGAACCGGATGTGACAAGGAGGACCCCTGACTACTTCTTATAATAGACTCAGTCGATTTTCTATGATAGTTCATCT
TTGGTCTGGATAACCAGGATGGCTGGGAGATTGGCAAGGTATATATTTAACTGCAATTCTGTGTTGTATCATGAGGATG
GGCTAGTGCTTGGCTAATAGTTGGGTTAGCTCTTAGGCTAAAGGTGGTTGGGTTAGTGCATATTCTTCGTTTCTGCAAA
GAAGGCATCAAGGTTGTAGTGGTGTGAGTAGTGCAATGTTCTTGCAATCTTTGTTGGATCAAGTGTTTTCCTCAATTTT
TACTT

> SEQ ID NO:4944 129833FL 114363_300007_1d
CGACGGCGCAGCAGGGGAGTGAAGAGAGCAATTCTCTTCAGCTGCAATTGCCCTACCCTATGCTATTCAATCGGAGAAG
ATATTAGTAGTAGATTTTGGTTACAGAGCTCGCCGGTGACTTGAAGAAGTTTGACGAAGAAGTCAGAAAGATGTCAGAC
CTAGACAGGCAAATAGAACAGCTCAAGAGATGCGAACCGTTAAATGAATCGGAAGTGAAGGCTATTTGTCTTAAAGCTA
TGGAAATCCTCGTTGAAGAAAGCAATGTGCAGAGAGTGGACGCCCCTATCACTATATGTGGTGATATCCACGGGCAATT
TTACGACATGAAAGAGCTATTCAAAGTGGGAGGTGATTGTCCAAAGACAAATTACTTGTTTCTCGGAGATTTTGTTGAT
AGAGGATTTTATTCCGTTGAGACATTTCTTCTTCTACTAGCTCTGAAGGTGAGATATCCAGATCGAATCACTCTTATCA
GAGGTAACCATGAGAGCCGCCAGATCACACAGGTGTATGGATTCTATGATGAGTGCCTGCGGAAGTATGGTTCAGTAAA
TGTTTGGAGATATTGCACGGATATCTTTGACTACTT

FIG. 2 continued

> SEQ ID NO:4945 129833FL 114338_300007_1d
TTCTACACGCTTTACCAGTTTTTTTATACTGTCACAAAGGACACGTGTCGTGTAAATGTGCTCACCAAAATTGGTGTTT
CAAACCTGTCAACTTTATTCTGCTTGATCAATCATCACACACACACACACAGAGTAGAGGAAGAAGGATATGGGTTCAG
TAGATTTGGATGATATAATAAACCGTTTAATTGAAGTTCGACATAGACCAGGGAAACAAGTCCAGCTATCCGAATACGA
AATCAGGCACCTTTGTCTCAAATCTAAAGAAATTTTCTTGCAACAGCCTAATCTTCTTGAGCTTGATGCACCTATCAAG
ATCTGTGGGGATATCCATGGCCAGTATTCTGATCTACTGAGGCTATTCGAATATGGTGGATTTCCTCCAAGATCCAATT
ACCTATTCTTGGGCGATTATGTGGATCGTGGGAAGCAGAGTCTGGAAACAATATGCCTTATACTTGCATATAAAATAAA
ATATCGTGAGAACTTTTTCCTTTTGAGGGGAAATCATGAATGTGCTTCTGTGAATCGTATATATGGATTCTATGATGAG
TGTAAACGAAGGTTCAATGTTCGACTGTGGAAGATATTCACAGATTGTTTTAACTGCATGCCTGTGGCAGCTCTGATTG
ACGA

> SEQ ID NO:4946 129833FL 1097392_301443_1d
GCCCCCTCCACCTATCTCTCTCCTCTCTCTCTTCTCTCTTTCTCTCTCTCTCTCTCTCTGTCTATCTGTCTGC
AGATCGACAGAGATTTAGCTGTTTTCTGGGTTAGGGGAGGAGAAGAAGGGGTAGGTCGAGATGAGTGTGCCTCCTGGTA
TCGTGGACCGCAATGCGAATCTGGATGCGCAGATCGAGCAGCTCATGAACTGCAAGCCTCTCTCCGAGACCCAGGTGCG
AGCTTTATGTGAGAAAGCGGAGGAAATTTTGATGGAGGAGAACAATGTGCAGCCTGTCAAATGTCCTGTCACGATATGT
GGTGATATTCACGGGCAGTTTCATGATCTTGCAGAACTATTTCGGATTGGTGGAAAGTGTCCGGACACTAATTATCTAT
TCATGGGTGACTATGTGGATCGTGGATACTACTCAGTAGAAACTGTTACTCTTCTAGTAGCACTGAAGGTTCGATACCC
TGAAAGAATCACCATACTTAGGGGCAACCATGAAAGTCGTCAGATTACTCAAGTGTACGGGTT

> SEQ ID NO:4947 129833FL 111221_300053_1d
CCCACGCGTCCGGCCACCTGTTCGGCGACAATTTTTCTTGGACTGCAATGAGATGGCGGATCTTTGTGACAGTGCCGAA
AGGATATTTGCGAGTGAACCTAGCGTTTTACAGCTTAGGGCTCCTATTAAGATATTCGGTGACCTGCATGGGCAATTTG
GGGATCTTATGCGTCTTTTCGAAGAGTATGGTTCCCCATCGACTGCTGGGGATATATCGTATATTGACTACCTTTTCTT
AGGAGATTATGTTGACAGGGGCCAGCACAGTTTGGAAACGATAACTCTTCTTCTTGCTTTAAAGGTTGAGTATCCCCTC
AATGTACATCTAATTCGTGGGAACCATGAAGCTACAGATATTAATGCGCTTTTCGGCTTTCGAATTGAGTGCATTGAAC
GGATGGGTGAGCGAGATGGAATTTGGGCATGGCATCGATTTAATAGATTGTTCAACTGGCTTCCTCTGGCAGCATTAAT
CGAGAAAAGATAATCTGTATGCATGGTGGTATTGGAAGGTCAATTAATCATGTTGAACAAATAGAAAATATCCAGCGT
CCTATCACTATGGATGCTGGCTCAATTGTTCTTATGGATTTATTGTGGTCTGACCCAACAGAAAATGATAGCGTTG

> SEQ ID NO:4948 129833FL 1121437_301875_1d
CACGCCTTATTTTGGTTGCTATAAGCACCCCCTTGCCCTGCCCTGCCCTGCCCAGCCCTCCCCCTCCCCTGCCCTGCCC
TTTGGGGGATTTCGTCACAGAGAGAGAGAGAGAGGAGAAAGAGAGAGAGAGAGATGGGGCTACAGCTGGATCAGTGGAT
CGAGCAGGTCAAGGGCGGCCAGTGCCTCCTCGAAGACGAGCTCAAACAACTCTGTGAATACGTGAAGGAGATACTGATT
GAAGAGTCAAACGTGCAGCCTGTGAATAGTCCAGTGACTGTCTGCGGGGATATTCATGGCCAATTTCATGATTTGATGA
AACTCTTTCAAACGGGTGGGCAAGTACCTGATACTAGCTATATCTTTATGGGTGATTTCGTGGATCGAGGCTACAATAG
CCTGGAAGTCTTCACAATTTTGTTATTACTAAAAGCGAGGTATCCAGCCAACATGACACTTCTTAGGGGTAATCATGAA
AGCAGGCAAATCACACAGGTGTATGGATTTTATGATGAATGTCAGCGGAAATATGGGAATCCAAATGCGTGGCGTTATT
GTACTGATGTATTCGACTACTTGACACTGGCTGCTATTATTGATGGCAGAGT

> SEQ ID NO:4949 129833FL 113755_300005_1d
atttctctctactttctgtattctccttttcgggttttggggcagattctgagagattcacttcgttgtaaagaactgct
cTATCAGTCGACTCTGCATTTGGGCAAATAATTGCATTCAGAAACAAATAATTAGTTAATTGGCAGAGCTGTAGATTTA
GAAAAGGGGCAGATGGATTTGGATCAGTGGATAACGAAGGTGAAAGACGGGCAGCACTTGGCCGAGGACGAGCTTCAGC
TCCTTTGTGAATATGTTAAGGAAATCCTGATAGAGGAGTCAAATGTGCAACCCGTTAATAGTCCAGTTACTGTTTGTGG
AGACATCCATGGCCAGTTTCATGATCTAATGAAACTTTTCAGACTGGAGGTCATGTACCCGAGACGAATTACATTTTC
ATGGGAGATTTTGTTGATCGTGGATACAATAGTCTAGAAGTATTTACAATTTTGTTGCTCCTTAAAGCAAGGTACCCAG
CCAACATTACTCTGTTACGTGGAAATCACGAGAGCAGGCAACTAACACAGGTTTATGGATTCTATGATGAATGCCAAAG
GAAGTATGGAAATGCAAATGCTTGGCGGTATTGCACCGATGTTTTTGACTAtCTTACTCTCTCggccatcATAGACgGA
ACAGTATTATGTGTCcAcggTGGACTTTCTCCTGATGTTAGAATTATTGATCagATCAGAGTCATTGAACGAAATTGCG
AAATTCCCCATGAAgggccctttcttgcgaccCTTATGTGGAGTGACcCCGaagatattGAAaCATGgGCagTaAGTCC
tcGaggAgcaggtTGGCTTTTTGGAt > SEQ ID NO:4950 129833FL 1113227_301796_1d
tccattttttttacggcttattctgatttctgttgcctcatccatctccgtctccgtcgccatcgccaggaggaggagga
GGAGGCCTCGAGCCCCCCCCCTGCCACCTAACTGTAACTGTTTATTATCCGTCTCCGCCACCTCTAATGGACCAAGCCT
TGCTGGATGATATCATTGCACGCTTGTTGGACGTGCGGAGCAGCCGGCCAGGGAAACTGGTGCAGCTTTCTGAGGCAGA

FIG. 2 continued

```
AATCAGGCAGCTATGTACCACTGCCAAGACTATCTTCATGGAGCAGCCTAACCTGATTGAGCTTGAAGCACCCATGAAG
ATTTGCGGTGACATTCATGGACAATACTCTGATCTATTACGTCTTTTTGAGTATGGTGGGTTTCCACCAAATGCCAACT
ATCTCTTTCTAGGAGATTATGTGGACCGGGGGAAACAAAGCCTTGAAACAATCTGCCTACTCCTTGCATACAAAATCAA
GTATCCTGAAAACTTCTTCTTACTTAGGGGAAACCATGAGTGCGCTTCAATAAATAGAATATATGGCTTCTACGATGAA
TGCAAAAGgagatTCAATGTCAGGCTGTGGAagacatTTACAgattgttTCAACACATTACCTGTGGCAGCTCTCattg
atGaaaaaatATTATGTATGCATGGGGGACTATCCCCGGatttgcATAACcttgatCAGATAAAGAGGCTgagccgTCC
GGCTGATGTTCCAGATCAaggcttgctCTGtgacctTTTATGGgcaGATCCGGAcaaaga > SEQ ID NO:4951 129833FL 230569_301069_1d
GGGACTTGCGGCAGGTTGCCAAAATCGTTCCCAAAGATCCGGATGCAAAGAAGAAGATTCGGGAATGCGAGAGCGCGAT
CAAGAAGTTAAGATTCGAGGAGGCGGTCGCCACCGACGAGAGGCGCTCGGTTGCAGGCACGATAGATCCCAGTACTTTT
GTAGTAGAAGACTCGTACACAGGAGCGAGGATACAAGGAGACCAACTATACTTGAAATTCGTTAAACAGATGATGCAAG
AGTTCAAGGACGAGAAACGTTTGCACAAAAGATACGCTTATCAGATAATGCGGCAGACCTTGGATCTGCTCACTAGTCT
CCCGACTCTCGTCGAAATAACTATCCCAGAGAATCGCCACATTACAGTATGTGGCGACATTCACGGCCAGTACTATGAC
CTGCTTAACATCTTTGAGATAAACGGCTTGCCTTCGAACGAGAATCCTTACCTGTTTAACGGCGATTTTGTTGATCGAG
GGTCTTTCTCCGTCGAAGTAATCCTGACGTTGTTCGCTTTCAAGTGCTTGTATCCTCAAGCCATGCACCTTGCGAGGGG
AAATCACGAGAGCCAAAGTATGAACAAAGTCTATGGTTTTGACGGTGAAGTCAAGGCCAAGTACTTCTCAGACGTAATG
CCAGAG > SEQ ID NO:4952 129833FL 174834_300527_1d
CCCACGCGTCCGGTGTGCGTAGCTTAGATCGTGTCCAAGAGGTTCCGCATGAGGGACCAATGTGTGATCTTCTATGGTC
TGATCCAGATGACCGCTGTGGTTGGGGCATATCTCCTCGTGGTGCTGGCTACACTTTTGGGCAGGATATATCCGAGCAA
TTCAATCACACCAACAATCTCAAACTTGTAGCTCGGGCTCATCAACTAGTTATGGAAGGATATAATTGGGCTCATGAAC
AAAAAGTTGTTACTATATTCAGTGCTCCAAATTATTGTTACCGATGTGGGAATATGGCATCCATTTTGGAAGTTGATGA
CTGCAACAGCCATACTTTTATTCAGTTCGAACCAGCTCCTAGGAGAGGTGAGCCTGACGTGACACGGAGGACGCCCGAT
TATTTCCTTTGAGTTAATGGTGCTACCATTTGTCACCTTGTATTGCGAATTTGCGATAGTCAAATGCTGGTCAGTGATA
CTTTGCTGGACTGTGAAACCTGCGCATAGGCCAACGAACAATAACAAGGGAACATCAGATCCCTTCGTAAAACTTGACC
CTCCATTGGTCAATGCAAGAGATGCTGCTA > SEQ ID NO:4953 129833FL 157287_301736_1d
tCCTCTCTCTCTCTCTCTCTCTCTCTCTCTCCGTCTGTAGAGCTGAGAGAAAATCAAACCAAATCAAATCAAGTT
TGATTTCATCCCCCTTTTCCGCTAGGGTTTCTGCACAAATTTCCCTCCAGAATCAGTAGAAAAGAAGATCAATCAGCAA
TGGATCCGGTGCCATCGAGCGCATCTCATGGAAATCTTGACGAACAAATTGCTCAGCTTATGCAGTGCAAACCCTTGTC
TGAACAGGAGGTAAGAGGGCTATGTGAGAAAGCAAAGGAGATTCTAATGGAAGAGAGCAACGTGCAGCCTGTGAAAAGC
CCTGTGACTATATGTGGTGATATTCATGGTCAGTTCCATGATCTTGCTGAGCTTTTTCGAATTGGTGGAAAGTGTCCTG
ACACTAATTATTTGTTCATGGGAGATTATGTGGATCGTGGATACTATTCTGTTGAAACAGTAACGCTTTTAGTGGCTCT
CAAAGTGCGATATCCCCAGCGAATTACAATCCTAAGGGGTAATCATGAGAGTCGCCAGATTACTCAGGTTTATGGGTTT
TATGATGAATGCCTGCGGAAATATGGTAATGCCAATGTGTGGAAGACTTTCACAGATCTGTTCGACTACTTTCCTCTGA
CTGCTTTGGTTGAGTCAGAGaTTTTTTGCctcCATGGTGGTCTGTCTCCATCTATTGAAACTCTTGATAATATTCGCAA
TTTTgaccgTGTACaagaaGTTccACATgagggTGCTATGTGTGATCTTTTATggTCTGATCcTGATGATcGaTGtggt
tGGGGTATCtc > SEQ ID NO:4954 129833FL 153073_200044_1d
gggctcaaggattgcataagaagatcatatccactttgcttaggccgcGAAATTGGAAAGCACCTGTTAATAGAAAGTT
CTTTCTCGATTCATATGAAGTGGGTGAGCTTTGTTATGCAGCTGAGCAGATCTTCATGCATGAGCCTACAGTTCTTCAA
TTGAAAGCTCCTGTCAAAGTTTTTGGTGATCTTCATGGACAGTTTGGTGATTTGATGCGGCTATTTGATGAATATGGAT
TTCCTTCAACAGCTGGAGACATTACTTACATTGACTATTTGTTTCTGGGTGATTACGTTGATCGAGGACAGCACAGCTT
GGAGACAATCACTTTACTCCTAGCTCTGAAGATTGAATATCCAGAGAATGTACATTTGATAAGGGGAATCATGAAGCT
GCTGATATAAATGCACTTTTTGGCTTCCGTATTGAGCATCGAGAGAATGGGAGAGAGTGATGGGATCTGGGCATGGA
CGCGTTTCAATCAACTTTTTAACTATCTtccATTGGCTgccCTCGTCGAAAAGAAAATCATCTGCATGGTGGGAT
AGGGAGGTCAATTAATTCattagagcaaattgagAagATAGAGaggccTATAACAATGGATGCTGGTTCAATagtccTA
ATGGAtttGCTATGgTctgA > SEQ ID NO:4955 129833FL 142515_300436_1d
CCCGTGATGAATGCTTGAGAAAGTATGGAAATGCAAATGGAGGGAAATACTTTACAGACTTGTTTGATTATTTGCCTCT
CACAGCTCTTATAGAAAACCAGGTGTTCTGCCTTCACGGGGGTCTCTCTCCATCATTGGATACTTTAGATAACATCCGT
GCTCTTGATCGTATACAAGAGGTTCCTCATGAAGGACCCATGTGTGATCTTTTGTGGTCTGACCCAGATGACAGATGCG
GGTGGGGAATTTCACCGAGAGGAGCAGGTTATACATTTGGGCAAGATATCGCTCAACAGTTTAACCATACAAATGGTCT
```

ATCTCTCATCTCAAGGGCACATCAACTTGTAATGGAAGGATTTAATTGGTGTCAGGACAAGAATGTTGTGACGGTCTTC
AGTGCACCAAACTACTGTTATCGCTGTGGTAACATGGCTGCAATTCTTGAGATTGGCGAAAACATGGATCAGAACTTCC
TCCAATTTGATCCAGCTCCTCGGCAAATTGAACCAGACACAACACGCAAGACTCCCGACTACTTTTTGTAATTT

> SEQ ID NO:4956 129833FL 137956_300687_1d
atacaggcgacgcgagcaaccacgcggtcgcagaagaaagagagagagagagatggcggcatgagcacctcctcctgga
tCGCCACCTCCCCCGATCCCCCgcaAACCCTAGCgacCgggCCCCCagcgccACCTCCCCTGgggcGGCGCCCTGGTG
AGGAGGGAGGAGGAGGAGGGGGAGGTGGGGAGGGGGGaggcgactatGCCGTCGCACGCGGATCTGGACCGGCAGATCT
CgcagCTgcgGGGAGtggaAGTTCCTGGGGGAGGCGGAGGTGAGGGCGCTGTGCGAGCAGGCGAAGGCCATCCTCATGGA
GGAGTGGAACGTGCAGCCGGTGCGGTGCCCCGTCACGGTCTGCGGCGACATCCACGGCCAGTTCTACGACCTCATCGAG
CTCTTCCGCATCGGCGGCgaggCGCCCGACACCAACtacctcTTCATGGGCGACTacgtcgaccgtggCTACTACTCAG
TGGAGACTgtctcgttgTTGGTGGCTTTgaaAGTACGCTACAGAGATCGaattacaatAtTgagaggaaatCATGagag
cagACAAAtcactcaagTgtacggCTTCTACGATGAAtGCTTGagAAAGTATGGAAA > SEQ ID NO:4957 129833FL 129463_300479_1d
GAATTCAAAGGCGATCTGAGAAGAAGAAGATAGGGGACGAGAATTGTTGTCTCGTTTTACCACCAATTCATCGCTCTCT
GTCTTACTTCCCACTCATTAATTTTAGGGTTAGGTTTCCTCGATTGTATTGCTGAAAAGTAATTTTATTTCATTTTTTT
TTTTTGGAAGAAAATGAGTGTGGATCCGGTTTCAACCAACACTCATGGCAACATCGATGAGCAGATTTCACAGCTTAT
GCAGTGCAAGCCCTTACCCGAACAAGAGGTCAGGACATTGTGTGAGAAGGCTAAAGAGATATTAATGGAAGAAAGCAAT
GTACAGCCTGTTAAAAGTCCAGTGACGATATGCGGTGACATCCATGGCCAATTTCATGATCTTGCAGAACTTTTTCGCA
TCGGAGGAAAGTGTCCAGATACCAATTATTTGTTTATGGGAGACTATGTGGATCGTGGTTATTATTCAGTGGAAACAGT
AACTCTGCTGGTCGCCCTGAAAGTGCGATACCCGCAAAGAATTACCATTCTTAGAGGGAAATCATGAAAGTCGCCAGATA
ACACAAGTCTATGGGTTCTACGATGAATGTTTGCGAAAGTACGGCAATGCGAACGTGTGGAAGACTTTTACGGACCTAT
TTGACTATTTTCCATTGACAGCCTTGGTGGAATCAGAAATTTTTTGTTTGCAT > SEQ ID NO:4958 129833FL 127721_300472_1d
cccccccccccgattgaatgaatcaatcaggggataatcttcttataccaagtcgctcacatctacaccctcaaaact
cAAACCCCATTTGCAGTAGGTAAAAAATTGTTAGAGAAAACTGAAAAAAATGGACCAAAATGTGTTAGATGATATTATA
AGTCGGCTTCTTGAAGTAAAGGGTAAACCAGGGAAACAAGTAGTGTTAACAGAGGCTGAAATCAAACAGCTGTGTTTGA
TTTCTAAAGAGATTTTCTTGAAACAGCCTAATTTATTGGAACTTGAAGCACCCATCAAGATTTGTGGTGACATTCATGG
TCAATATTCTGATCTTCTGCGGCTTTTTGAGTATGGtgGTTTGCCTCCTAAATCCAACTACTTATTTTTAGGGGATTAT
GTTGATCGCGGCAAGCAGAGCCTaaagACTATATGTCTTTTACTTGCATACAAGATAAAATATCCCGAAAACTTTTTCT
TGCTAAGGGGAAATCATGAATGTGCTTCCATAAACCGTAtATATGGATTTTATGATGAATGTAAGAGaaGATTTAATGT
TAGATTATGGAAAATCtTcaCaGATTGCTTcaaTTGTCTGccagtggccgcTtTAatagaTGAAAAAat > SEQ ID NO:4959 129833FL 292417_200248_1d
AGCACCTCTGTTTTCTCCGTTGGGTTTTGCAATTTCTGATTGAGCCACGATTCCGTCAGTCTCGATTAATCGCCAACAA
CAGTTGAGTAAATCGGCTCCATCCACATTACATTCCAGACAAATCTGTACATTTGCGAAGCAAAGCCACTTAATTGCAA
GTACGAAGGGCAGAGCAGTAGATTTAGAAGAGGGACAGTGGATTTGGACCAGTGGATAACGAAGGTTAAAGAGGGGCAG
CATCTGGCTGAGGACGAGCTTCAGCTCGTCTGTGAATACGTTAAGGATATCCTGATTGAGGAATCAAATGTGCAGCCTG
TTAATAGTCCAGTTACCGTCTGTGGGGACATACATGGCCAATTTCATGATTTAATGAAACTCTTCCACACTGGAGGTCA
CGTGCCAGAGACAAATTACATCTTTATGGGAGATTTTGTTGATCGTGGATACAATAGTCTTGAAGTTTTCACGATTTTG
TTGCTCCTTAAAGCAAGATATCCTGCCAACATTACTCTTTTACGTGGGAATCACGAGAG > SEQ ID NO:4960 129833FL 286381_200108_1d
AAGAAAACTTTTGGATAGACAAATGTCTGTCAACAGTGTTCCCAAAAAGGTGATTGCCCATCTTTTGAAACCTCGAGGA
TGGAAGCCGCCTGTCAGACGGCAATTTTTCTTGGATTGCAATGAGATAGCTGATCTCTGTGATAGTGCAGAAAGAATAT
TTTCCAGTGAACCTAGTGTGTTACAGCTAAGGGCTCCTATTAAGATATTTGGTGACTTGCATGGGCAATTTGGGGATCT
CATGCGCCTTTTTGATGAGTATGGTTCCCCATCAACTGCTGGGGACATAGCGTACATCGATTATCTCTTCTTAGGAGAT
TATGTTGATAGGGGCCAGCACAGCTTGGAGACCATGACTCTTCTCCTTGCTTTAAAGGTGGAGTATCCACACAACGTTC
ATTTAATTCGAGGGAACCATGAAGCGGCAGATATTAATGCTCTTTTTGGCTTCCGAATTGAGTGCATTGAACGAATGGG
TGAGAGAGATGGAATCTGGGCTTGGCATCGGATCAATAGGTTGTTCAATTGGCTTCCTCTGGCAGCACTAATTGAGAAA
AAAATAATCTGTATGCACGGTGGTATTGGAAGGTCAATTAATCATGTAGAACAGATAGAGAATATACAGCGTCCTATCA
CCATGGAAGCAGGGTCGATCA > SEQ ID NO:4961 129833FL 274169_200148_1d
ATCATTCATGATTTCAAGAAAACTATCCATATTAACCCATCAATATCAAATCTACAACTTTTTCTCTTGTAATAAACGA
TTCTAAGAGAAAAATACAAACACCCTTTTCTTGTTTCTTCCTTGACCTTTTGTTATTTAGTTTGTTTTGGATTGTGGGT

FIG. 2 continued

```
ATTTTTAGCTTGTTTTTAGTGTTTTCTTGAAACCCCATCAATATCAAATCTACAATTTTTTCTTCTTTCTATAAGAAAA
TACAAACACCCTTTTGCACCCTTTTCTTGTTTTTCCCTTTCCCTTTTGTTGTTTTTCTAGTGTTTGTGGAAACCCCAGG
TCGAGAAAGAAACAAAGGAATGGCACAAAATAACGAGCAGCAGGTACATGTGCAGGGATTAGTAGAGGCAGGGGTTCTT
GATGATATAATAAACAGATTATTGGAGTTTAGGAATGCAAGAACAGTGAGGCAGGTTCAGCTTTCAGAAGCTGAGATCC
GTTCACTTTGTAGTGCTTCAAGGGAAATCTTCCTTCAGCAGCCTAATCTTCTTGAACTTGAAGCCCCCATCAAGATCTG
TGGTGACATTCATGGCCAATATGGTGATCTTTTGAGGCTTTTTGAATACGGTGGTTTTCCTCCCGAGGCTAATTATTTG
TTTTTAGGGGACTACGTCGACCGTGGCAAACAAAGTTTGGAAACTATATGCCTTCTACTTGCATACAAAATTAAATATC
CT

> SEQ ID NO:4962 129833FL 267145_200172_1d
GAAGACAATCCGTATCTGTTCAATGGTGACTTTGTTGATAGAGGGTCTTTCTCTCTAGAGGTCATATTGACATTATTTG
CCTTCAAGTGCATGTGTCCATCAGCTATATACCTTGCGAGAGGAAATCACGAAAGCAAGAGCATGAACAAGATATATGG
GTTTGAGGGCGAGGTCAGATCTAAGTTAAGCGAAACCTTTGTGGAACTCTTTGCTGAAGTGTTCTGTTGCTTGCCTTTG
GCTCATGTCATAAATGGGGAAGTCTTTGTAGTTCATGGAGGCCTTTTCAGTGTTGATGGTGTGAAACTTTCTGATATTA
GAGCAATCGATCGGTTTTGTGAGCCCCCTGAGGAGGGGTTAATGTGTGAATTGCTATGGAGTGATCCACAACCTCAGCC
TGGTAGAGGACCTAGTAAACGAGGTGTTGGTCTTTCTTTTGGGGCGGATATAACTAAAAGATTCTTGCAGGAAAATAAT
TTGGATTTAGTGGTTCGATCTCATGAAGTGAAGGATGAAGGTTATGAGATTGAGCATGACGGCAAGCTCATCACGGTGT
TTTCTGCTCCAAATTATTGTGACCAGATGGGTAACAAGGGTGCTTTCATACGGTTCGAGGCTCCCGATATGAAGCCAAA
CATTGTGACATTTTCAGCAGTGCCACATCCTGATGTCAAGCCGATGGCATATGCGAACAACTTCC

> SEQ ID NO:4963 129833FL 266058_200083_1d
ctctgtataaatctctagaaaattctagagaaaaaaatgccgtcgcatggagatctacatcagcaaatcgcacaattga
gtgcagTGCAAGCCGCTATCAGAAGCGGAGGTGAAAACGCTGTGTGATCAAGCGAGAGCTATACTTGTAGAGGAATGGA
ATGTTCAGCCGGTGAAATGTCCGGTGACTGTTTGCGGCGATATTCATGGACAGTTTTACGATCTCATTGAGCTCTTTCG
GATTGGCGGCAaCGCTCCTGATACTAATTATCTCTTCATGGGCGATTATGTTGACCGTGGATACTAtTcGgtgGaGacg
gtcacACttTTGGTTGCTct > SEQ ID NO:4964 129833FL 26116_300076_1d
gatattattcgtggtttggttgagtttcggaacacaagacctggatcggggaatcaagttcatctcagtgaaggtgaaa
ttcttcaGCTTTGTGCTGTCTCCAAAGAAATATTTCTTCAACAGCCCAATCTGCTTGAATTGGAAGCTCCCATCAAGAT
CTGCGGTGATATTCATGGGCAGTATTCAGATCTATTGAGGCTTTTTGAGTATGGAGGGTTCCCTCCCGAAGCTAATTAT
TTGTTCTTGGGTGATTATGTTGACCGTGGCAAGCAAAGCTTGGAAACAATATGTCTTCTTCTAGCTTACAAAATCAAGT
ACCCTGAGAACTTCTTCTTGTTGAGAGGGAATCATGAATCTGCTTCCATTAATCGTATTTACGGTTTCTATGATGAGTG
CAAACGCAGGTTCAATGTCAGACTCTGGAAAATATTCACCGATTGCTTTAACTGTCTTCCTGTGGCCGCCTTAATTGAT
GACAGAATACTATGTATGCATGGTGGGATTTCCCCAGAGCTGAAAAGTTTGGACCAGATTAGAAATATTGCACGGCCGA
TGGATATTCCGGAGTCTGGTTTGGTATGTGATTTACTATGGTCGGATCCTAGTGGAGACGTAGGCTGGGGCATGAATGA
TCGTGGTGTTTCATACATTTTGGAGCTGACAAAGTcgcAGAGTTCTTGGAGAAACATGACATGGcccTTATCTGTCGT
GCCcacCAGGTTGTTGAAGATGGGTATGAGTTCTTTGCAGAAAGACAACTTGTTACAGTATTTTCAGCTCCCAACTATT
GCGGGGAATTTgacaacgcTGGcgcAATGATGaGCATTGATGAGAGCTTAATGTGCTCATTCCAGATTCTAAAGCCgtC
agAAAAGAAGTcgcCTTTTCTGTgacacCGATTATCCAGTGACcacCaTTGCTTCAAATTAACAATTCtACAAAAGTTG
TATACTGGCAAGAGGATCTAGAGACGGAAACTGCTCAATTGGgacCTTAATGGTACTGATAATAGAGCATTAGACATGT
AGCTGTTGACAGTGATGGCATCGAGCAGAAGGAACAAGTCAAGTCTGTACTGTGATTTTAGCATCTCTcacATCTATGT
TTGTCTAAAATGTGTGTGTGTTTTTAGTCTTctctctgaataatattagattctcatttgtactctctatttacctagg
agaacccaaattcaaaactttttttagtctca > SEQ ID NO:4965 129833FL 258891_301700_1d
ATTCGTCACTGCTTCACCTCGCTTGCCATTGAAAACGCCAGCTACGTCAACACCGAAAGAAGGGGTTACATCGACAATT
TAAATATTACGACAACGACAACGACAATGGACGTGGAAATGACAGACGTCAAGGAGCCTGCGTCTACCTTGTACACTGG
CACTCTCGACCAATGGATTGAACAGCTGAAGGAATGCAAACCGCTGACCGAAGCCGAAGTTGCCACCATGTGTGACATG
GCTCAAGAAATTCTTCAGCAAGAATCTAACGTCCAGGGTGTGCACACCCCTGTCACAGTGTGCGGTGATGTACACGGGC
AGTTCCATGACCTTATGGAGCTATTCTGTATTGGAGGACCCTGTCCAGATACGAATTACCTGTTCATGGGAGACTATGT
TGACCGAGGATACTACTCGGTCGAGACTATCTCCTTGCTGGTTGCCATGAAGATCCGGTATCCCAACAGAATCACCATC
TTGCGAGGAAACCACGAATCTCGACAAATCACACAAGTCTATGGCTTCTACGACGAGTGCCTGCGGAAATACGGCCATG
CCAACGTTTGGAAGCGATTCACAGACCTCTTCGACTACTTGCCTCTCACAGCTCTCATAGAAAACAAAATATTCTGTCT
GCACGGAGGA > SEQ ID NO:4966 129833FL 251763_301430_1d
GGAAACCATGAAAGCAGGCAGATCACTCAAGTGTATGGATTCTATGATGAGTGTCTTAGGAAATATGGAAATGCGAACG
```

FIG. 2 continued

```
TGTGGAAGTACTTCACCGATTTGTTCGACTACTTACCACTCACGGCGCTCATTGAGAACCAAATTTTCTGTCTCCATGG
CGGTCTTTCGCCGTCTCTGGATACTTTAGACCACGTCCGTGCTCTGGATCGCATTCAGGAAGTACCGCATGAAGGACCG
ATGTGTGATCTGCTTTGGTCCGACCCGGATGATCGGTGTGGGTGGGGAATCTCGCCAAGGGGTGCGGGGTACACATTCG
GTCAAGACATCGCAGAGCAGTTCAACCACACTAATGGCCTGAGCTTGGTGGCCCGTGCACACCAGCTTGTGATGGAAGG
ATACAACTGGTGCCAGGACAAGAACGTTGTGACGGTGTTTAGTGCTCCCAACTACTGTTACCGGTGCGGAAACATGGCG
GCAATAATGGAGATCGACGAGACGATGGGGCGGACTTTCCTCCAATTCGAGCCGGCTCCTCGACAGAGTGAGCCCGACG
TTACTCGCAAGACACCCGACTACTTTTTGTAAgaGgcaagtccTTTCTTGttccttggcgaGCTTGagtttg > SEQ ID NO:4967 129833FL 243754_301342_1d
agaggcagaggcggcggcgcagcgttctagaTTGTGGAGATATTCATGGCCAGTTTTACGACATGAAGGAGCTATTTAG
AGTAGGGGGTGATTGCCCGCAGACGAATTATTTGTTTCTAGGCGATTTTGTTGATCGAGGATTCTACTCGGTGGAGACG
TTCTTGTTGTTGTTAGCTCTCAAGGTTCGTTATCCCGACAGGATCACGCTTATAAGAGGAAACCATGAAAGCCGGCAAA
TCACGCAGGTTTATGGTTTCTACGACGaatgCCTTCGAAAGTATGGATCTGTTAATGTATGGCGCTATTGCACAGACAT
TTTTGACTACTtaaggttTGTCAGCATTgAtTGATAACAGGATATTTGGTGTGCATGGGGGGCTCTCCCCCGCGATTAC
CACCATCGATCAGATCAGGACAATCGACCGAAAGCAAGAAGTTCCACACGacgGTGCGATGTGCGATCTGCTGTGGTCG
GACCCCGAGGACATAATCGGCTGGGGGATGAGCCCGAGAGGCGCCGGTTACTTGTTCGgcggcaACGTTGCAAcGgcct
ttAATCACGCAAACAAgacTGAGATTATCTGCcGAGCacaccagctGGTCATGGAAGGCTTTAAGTGGATGTtcagaag
CAGGTGgtgacaGTGTGgt > SEQ ID NO:4968 129833FL 243235_301337_2d
AACGAAGGAAAAAGCTTTTATGCAAAATCAACTTTGGTGTTGTGTATAAGCTACGCATAGCTCCGATCCGAACCGATCT
GAATCCGCAAAGAAGAAGACTAGTCGTCGCTAGTGTCGCTGCTGCTGTGGTTTTTGTTGATGTTGTAGTAGTAGTCGTC
GCCATGTCTTGTGTTCTCTTCACTTGCCTGCTCCCTTCTTGTCCGCCGGCTTGAGGATCTGGAAAGAACACATGAGCGT
ATCGTCCACGCTCATCATCGCTCCTGCGTTGTCAAATTCGCCGCAGTAGTTCGGGGCCGAGAATATTGTTACAAGCTGC
CTCTTGGCAAAGAACTCGTAGCCGTCCTCCACTACCTGGTGAGCTCGGCACACGAGATCCAAGTCATGCTTTTGTAGAA
AATCCGCTACCACGTCCGCTCCAAATGTATACGAGACGCCACGGTCGTTGCTTCCCCAGCCTGTCACGTCCTTGTCCGG
ATCGGCCCAGAGAAGATCACATAAGAGCCCGGTGTCGGGAACGTCCGTGGGCCGGGAGATCTTCCTGATCATGTCCAAG
CTCTTCATGTCCGGGGAGAGGCCCCCGTGCATGCACAGTATC > SEQ ID NO:4969 129833FL 240214_301312_1d
gagtagagaAGAGTTTAGAAATAGAGGTATAGGCGACACAGGCCCGGCCCGATCCGAGGGCTCCCTGGATGCGCATCGG
ACGGCGTCGCAGCCACTGCCCCGCCCCGCCCCGCCCCGCCCAGATCCCTTCCAGGGTTAGACGATTGTATTGTTTAGGG
TTTTGTGCATTGCTAGGATGAACGTGGCACCGCCAGCAGCAAATGGCTACGGTCAGCTGGACGCACAGATCGAGCAGCT
GATGCAGTGCAAGCCGCTGGTAGAACAGGAGGTGCAGTCCTTGTGCGAGAAGGCCAAAGAAATTTTGATGGAGGAAAAT
AATGTGCAGCCAGTAAAGTGTCCGGTCACCATTTGTGGCGACATACACGGCCAGTTCCACGACCTTGCGGAGCTCTTCA
GAATCGGTGGCAAGTGTCCAGATACCAACTACTTGTTTATGGGGGACTATGTGGACCGAGGATACTACTCTGTTGAGAC
CGCAACCCTTTTGGTCGCGTTGAAGGTTCGGTATCCCGACCGAATCACCATTCTACGAGGGAATCACGAAAGCCGCCAG
ATCACGCAAGTTTACGGTTTTTATGACGAGTGCTTGCGAAAGTATGGAAATGCAAACGTTTGGAAGATCTTCACCGATC
TgtttgaCTATTTTCCTTTGACGgccttggtaGagTCGGAGatattctgctTGCACGGaggGCttt > SEQ ID NO:4970 129833FL 236002_301277_1d
ACAGCGCAGTGGCGGGCATGGACTTGGATCAGTGGATCGAAAAGGTCAAGTCGGGGCAGCACCTCCTCGAGGACGAGCT
CAAGCAGCTGTGTGAATATGTCAAGGAGATTTGGTAGAGGAGTCGAATGTGCAGCCAGTAGACAGCCCGGTCACGGTT
TGCGGAGATATTCATGGCCAGTTCCACGACTTGATGAAGCTCTTCCACACCGGCGGCCATGTCCCCCACACGAATTACA
TCTTTATGGGAGATtttgtgGATCGTGGATATAACAGTCTCGAGGttTttaCTATTCTTCTTCTTCTCAAAGCGAGGTA
TCCTGCGCATATGACTCTCTTGAGAGTGAATCACGAGAGTAGGCAAATTACGCAGGTGTATGGTTTCTATGACGAATGC
GAGCGGAAGTATGGAAATCCAAACGCTtggcgtTACTGTACTGACGTTTtgACTATCTGACTATTTCGGCGATCATCG
aCGGAAGAGTGCTTTGCGTGcaaggaGGTCTATCgactgacAtcagaTCCATt > SEQ ID NO:4971 129833FL 235806_301230_1d
GGCTATGGCGGCGCATCGCGACGAGGGCTGGTTCGCTATCGATCGAGAGGAGGGATGCGCGGTGGTGCCCGGCATCTAG
ATGTGGCGACGCCGCGATTCTTCTTCTTCTTGTCCCAGCTTCTCCGGGCGTGGAGATTTTCGGATTTCCGGCCTCA
AGCAACTGGAGCTAGGGCGCATTGGCTGTGGGTGATCTACCGCCGGGGCAGGGTTGCACGGATCTGATTGTTCCAGCAG
CGCTAGGGTTTGTGGATTTTGGGGAGATTTCTTCTCCAAATCGTCGTCTTCTTGGATCGATCGATCCCTCTTGCTTCGT
CCATCCGCCATGCCTTCCCACGGTGATCTTGATCGGCAGATCGAGCAGCTATGGAGTGTAAGCCGCTCTCGGAGATGG
AGGTGAAGAATCTGTGCGAGCAAGCCAGGGCCATCCTCGTCGAGGAATGGAACGTCCAGCCGGTCAAGTGCCCGGTGAC
GGTGTGCGGCGACATCCACGGCCAGTTCCACGATCTGATCGAGCTCTTTCGGATCGGCGGCAAGGCGCCCGACACGAAT
TATCTCTTCATGGGCGACTATGTCGATCGCGGGTACTACTCTGTGGAGACtGtGACGCTGc
```

FIG. 2 continued

> SEQ ID NO:4972 129833FL 234338_301099_1d
ggagaagaggcagaggaatggcgcagtgagtgagcatcgatcgatcgatcgcggggcggcggcggccatgtccgacctg
gACCGGCAGATCGAGCAGCTCAAGCGATGCGAGCCGCTCAAGGAGTCGGAGGTCAAGGCGCTGTGCCTCAAGGCCATGG
AGATCCTCGTCGAGGAGAGCAATGTCCAGAGAGTAGACTCTCCAGTCACGATTTGTGGAGATATTCATGGCCAGTTTTA
CGACATGAAGGAGCTATTTAGAGTAGGGGGTGATTGCCCGCAGACGAATTATTTGTTTCTAGGCGATTTTGTTGATCGA
GGATTCTACTCGGTGGAGACGTTCTTGTTGTTGTTAGCTCTCAAGGATCACGCTTATAAGAGGAAACCATGAAAGCCGG
CAAATCACGCAGGTTTATGGTTTCTACGACGAATGCCTTCGAAAGTATGGATCTGttAATGTATGGCGCTATTgcaCAG
ACAtTTTTGACTACTTAAGTTtgTCAGCAttGattGataacAGGATAttTGgTGTGcatGGGGGGCTCtcccccgcaat
caccaccATCGATCAGATcaggacaaTCG > SEQ ID NO:4973 129833FL 121394_300356_1d
CCCGCTCTCCTCCTCGGCCGCGTAAAACACCTCCCACCGCCTCCTCCACCCCCTCCTCCTCCCCCCGCAGAGCCGAAAC
CCTAACTCCGCCGATCTCTCCAGGTGCCCAAGGGGAGGGAGGGGATGGCGGCGGCACCGGGGGCGGGAGGGCAGGGCGG
CGGCGGGATGGACGCCGTCCTCCTCGACGATATCATCCGCCGCCTGCTCGAGGTGCGGACGGCGCGCCCGGGGAAGCAG
GTGCAGCTCTCCGAGTCGGAGATCCGCCAGCTCTGCACTGTATCCCGAGAAATCTTCCTCAGCCAGCCCAATCTCCTCG
AGCTCGAGGCGCCCATCAAGATCTGCGGTGACATCCATGGTCAGTACAGTGACCTTCTAAGGCTTTTTGAGTATGGTGG
TTTTCCCCCAGAAGCCAATTATCTATTCTTAGGTGATTATGTTGATCGAGGCAAACAAAGTTTGGAAACAATATGCCTC
CTCCTTGCATACAAAATCAAGTACCCGGAGAATTTTTTTCTTCTCAGAGGCAATCATGAGTGTGCATCAATAAACAGGA
TATATGGATTTTATGATGAATGCAAACGCCGATTTAAT > SEQ ID NO:4974 129833FL 121149_300525_1d
CGGACGCGTGGGGCCAATTGTCCGACCTGCTCCGGCTGTTCGAGTTCGGCGGGCTGCCGCCGACGGCGAACTACCTGTT
CCTCGGCGACTACGTGGACCGCGGGAAGCAGAGCATCGAGACGATCTGCCTCCTGCTGGCATACAAGATCAAGTACCCG
GACAACTTCTTCCTGCTGCGAGGCAACCACGAGTGCGCGTCGATCAACCGAATCTACGGGTTCTACGACGAGTGCAAGC
GCCGGTTCAGCGTCCGCCTCTGGAAGCTCTTCACCGACTGCTTCAACTGCCTCCCCGTCGCCGCCGTCATCGACGACAA
GATCCTCTGCATGCACGGCGGCCTCTCGCCGGACCTCGACAGCCTCGACCGGATCAGGGAGATCGCCCGACCCGTCGAC
GTCCCCGACCAGGGCCTCCTCTGCGACCTCCTCTGGTCCGACCCCGACCGCGAGAGCTCCGGCTGGGGCGAGAACGACC
GCGGCGTCTCCTTCACCTTCGGCGCCGACAAGGTCACCGAGTTCCTCAACAAGCACGACCTCGACCT > SEQ ID NO:4975 129833FL 110948_300048_1d
ttcgctttcccttccacagtagaaaaatcaacccttcatgcgtacagatTATAGAGACCCAGAAAAAGGGGATACCCA
CTTTCTCAATGGACGCTGCAGCAGTTGATAGGATCATTGAGAAGCTAATAGAAGTCCGATCATCGAAGCCTGGAAAGTT
GGTGCAGCTGTCCGAGTCTGAAATCAAGCAACTGTGTGTTGCCTCTCGTGATATCTTCCTCAAACAGCCCAATCTCCTT
GAACTTGAAGCACCCATCAAAATTTGCGGTGACATTCATGGGCAGTACAGTGACCTGTTGAGGCTTTTCGAATATGGTG
GTTTTCCTCCGAAGGCTAACTACTTATTTTTAGGTGATTATGTAGATCGTGGCAGGCAGAGCCTGGAAACAATATGCCT
CTTGCTTGCCTACAAGATTAAGTATCCTGAGAACTTTTTCTGCTTAGAGGAAACCATGAATGTGCTTCAATAAATAGG
ATATATGGGTTCTATGACGAATGTAAGCGCCGGTTCAACGTCGAAACTGTGGAAATCCTTTACAGACTGTTTCAATTGTC
TTCCTGTGGCAGCACTTATTGATGAGAAGATACTATGCATGCATGGGGGTCTCTCGCCTGATCTCTCTAGCTTGGATCA
GATAAGAAACTTACCACGTCCAACTGCCATACCCGATACTGGTTTGCTTTgTGATTTACTTTGGTCAGATCCTGGTAAA
GATGtGAAggGGTGGGGGATGaaCGATA > SEQ ID NO:4976 131281FL 1176804_302110_1d
ggagaactggagctctctctctctctctctctctctctctatatatatatatatatatatataaaggtctgcatt
aAGGTCTAATTTACACCGATCTGCGATCATTGAGGGGAATAAGGAGGGAAGGGTTGGATTGAGAATGGAGAACAACGGG
GTTGTGACAGTGTACGGCAATGGGGCCATATCTGAGCCGAAGAAGGCTTCCTATGCGGTCAAGGTTGGCTTAGCCCAGA
TGCTTAGGGGGGCGTCATCATGGGATGTTGTTAATGCTGACCAAGCGCGGATCGCAGAGGAGGCTGGAGCAGCCGCTGT
TATGGCATTGGAGCGTGTCCCTGCAGACATCCGTGCACAAGGCGGTGTCGCTCGGATGAGCGACCCGGAGCTCATCAAG
GAGATCAAAGCTGCTGTCACAATCCCAGTAATGGCCAAGGCCCGGATCGGCCATTTTGTGGAGGCCCAGATCTTGGAAG
CCATTGGAATTGACTATGTTGATGAGAGCGAAGTTCTAACCCCCGCTGATGACGCCCACCATATAAACAAGCACAACTT
CCGGGTCCCGTTCGTGTGTGGTTGCCGCGGTCTTGGCGAGGCCCTCCGTAGAATCGCCGAGGGt > SEQ ID NO:4977 131281FL 219564_300946_1d
gccctcatatattgaaggcatcgccaacccgatcacaaaccttcttgtccagacttgcAAACCACTCAATCGATTCCTT
GATACCCCTTGGGACAACTCTACTTGTTCTCTCCAAACTTACCCCTCCAAATACCATCATCACCATCACCATGACCAAC
GACGTCTCTACCAACGGCTCTTCTGCCGCTCCTGCGACCACCTTCGCCCTCAAGGCTGGTCTCGCCAGATGCTCAAGG
GCGGCGTCATCATGGACGTCACCAACGCCGAGCAGGCCCGCATCGCCGAAGAAGCTGGTGCCTGCGCCGTCATGGCCCT
CGAGCGAGTTCCCGCCGATATCCGCAAGGACGGCGGCGTCGCCCGCATGTCCGACCCGGCTATGATCAAGGAGATCCAG

FIG. 2 continued

```
GACGCCGTCACCATCCCCGTCATGGCAAAGGCCCGTATCGGCCACTTCGTCGAGTGCCAGATCCTCGAGGCTCTTGGTG
TCGACTACATTGACGAGTCCGAGGTCCTGACGCCCGCCGACGACGAGAGCCACGTCGAGAAGAGCCCCTTTGGCGTGCC
CTTTGTCTGCGGCTGCCGCAACCTGGGCGAGGCCCTGCGCCGTATTGCCGAGGGCGCTGCCATGATCCGAACAAAGGGC
GAGGCCGGCACCGGTGACGTTGTCGAGGCCGTCCGCCACATGAAGACTGTCAACAGGGACATTGCGCAGGCCAAGGCTG
CTCTTGCCGAGGGCGGTATTGTTCGTCTCCGCGAGCTTGCTCGTAAGCTCGAGGTTGACGTcGAGCTGCTGCGCCAGAC
TGCTGAGCTGGGCCGTCTCCCTGTTGTCAACTTCGCCGCCGGTGGTGttgCCACTCCTGCTGATGCTgCTCTCATGATG
CAGCTTGGCTGTGACGGCGTCTTCGTCggcagCGGCATCTTCAAGTCTGgcgacccTGCCAAgcgagccaaggccaTTG
TCCgcgcTGTCaCTCACTTCCGTGACCCCAAGGTCCTTGCTGAGTGCAGCACCGGACTGGGCGAGGCCATGGTTGGCAT
CAACTGCGACGCTATGAAGCCCGAGGAGAAGCTTGCCGGCCGTGGCTGGTAAATACCCCCTATTATATGATTTTAGCAA
GGGAAAGCAAGAGGAGGAAAAGCAAAAGTGTGGTATATAAAAACGGAAGagaCAGAGGAGGAAAAAATGACTGGCACAG
AGCCTCAAAATGTATCTATTCTACTGTTGGATTTGGGCGTTGTGGACTTTTTATCGCTTTGGGTGGCACTTAGCATGCT
GAACATCAAAATTCTGAagaTGCCGTCAGGATATGCAACCTAttgaGGATTATACAGCATagcaCGAAATCTACATTta
cttgtttgcacTTGa > SEQ ID NO:4978 131281FL 55801_300130_1d
CTCTTGAACGTGTTCCCGCCGATATTCGAGCTCAAGGCGGTGTTGCTCGAATGAGCGATCCAGAGATGATCAAAGAAAT
CAAAAACGCCGTGACGATTCCGGTGATGGCGAAAGCTAGAATTGGTCATTTCGTTGAAGCTCAGATCCTGGAAGCAATC
GGAGTTGATTACGTCGACGAGAGTGAAGTTCTCACTCTCGCCGACGAAGATAATCACATCAACAAACATAATTTCAAAA
TCCCTTTTGTTTGTCGATGTAGGAATCTCGGTGAAGC > SEQ ID NO:4979 131281FL 282057_200233_1d
cccgATCCCTAGCCACTTTACTCCTATTCTCCTCCACCACCTTTTCATTTCCTATCTCCTCCTCTTTTCTCTTCTGCTC
AGTTCCTCTCTTTCACATACACACTCACAAAAAAAATTCGATTATGGCCGGAAGCGGTGTGGTAACACTTTACGGAAAT
GGTGCACTCACCGAGACTACAAAGCAATCCCCTTTCTCAGTGAAAGTGGGTCTCGCTCAGATGCTTCGCGGCGGCGTTA
TCATGGACGTCGTCAATCCCGAGCAGGCCCGTATAGCCGAGGAGGCAGGCGCGTGTGCCGTCATGGCCCTTGAGCGCGT
CCCCGCTGATATACGCGCTCAGGGCGGCGTAGCCCGCATGTCGGATCCCCAGCTTATCAAAGAAATCAAACAGGCTGTT
ACCATCCCCGTTATGGCCAAGGCCCGTATCGGTCACTTCGTCGAGGCCCAAATCCTCGAGGCTATCGGAATCGATTACG
TGGATGAATCAGAAGTCCTCACTCTCGCCGACGATGAGAACCACATCAACAAGCACAAATTTCCGCATTCCTTTTGTCTG
TGGCTGCCGTAACCTCGGCGAAGCCCTCCGCCGTATCAGGGAGGGAGCCGCCATGATACGCACCAAGGGGGAAGCCGGT
ACCGGCAACATCATCGaagccgTccgTcacGTGCGttccgtgatgGgtgAtAtc > SEQ ID NO:4980 131281FL 247585_301621_1d
ttccattgctttaatcaGGATCGCGGAGGCGGAGGAAGAAAGAGTAGCGGCGATGGATGCCAACGGCGTGGTGGCCGTG
TACGGCAACGGCGCCATAGCGGAGCCCAAGAAGGCGTCATACGCGGTCAAGGTCGGTCTCGCCCAGATGCTCCGCGGCG
GCGTCATCATGGACGTGGTCAACGCCGAGCAGGCCCGCATCGCCGAGGAGGCCGGCGCGGTGGCGGTCATGGCCCTGGA
GCGCGTCCCGGCGGACATCCGCGCCCAGGGTGGCGTCGCAGGGATGaGCGACCCGGGCATGATCAAGGACATCAAGAaG
GCGGTCACCATTCCGGTCATGGCAAAAGCCCGCATTGGGCAtTtTGTCGAGGGGCAGGTGCTCGAGTCCATCGGCGTCG
ACTTcGTGGACGagtCCGAGGTGCTCaCcCCCGCCGACGACGCCAACCACATCAACAAGCACAACTTCCACGTCCCGtt
cGTGTGCGGCTGccgcaACCTGGGCGAGGCGCTGCGGCGGAtcaccgagggcGcggtcatgaTCCGgacccaaggcgc
acgcggcaccgGgaacgtGATCGAGGCGGTGCGCCACGTCCGGTCGCTCATGGGGGACATCCGGCggctgcgcagcCTG
gacgaggAcgaggtg > SEQ ID NO:4981 131281FL 1187201_302172_1d
TGTTATTAGGCCTAAACCTACCCTCTGTTCTTTTCAGGTAACTTAGCGGTTTCTTTTCCCTGTGTTTGGTGTTCGTAGT
CAAATCTGGCTATGGCTGGTAATGGCGTAGTGGCCATCTATGGCAATAGTAGCTCCATCGCAGACCCCAAGAAGTCCTC
CTATGGTGTCAAGGTCGGCCTTGCCCAAATGTCCGCGGTGGTGTCATCATGGACGTCATTAACGTTGAACAGGCCCGT
ATCGCCGAAGAAGCTGGTGCCGTCGCTGTCATGGCCCTTGAGCGCGTCCCTGCTGATATCCGTGCTGAAGGCGGCGTCG
CCCGTATGAGTGACCCTGGCTTGATCAAGGAGATCAAGGCTGCCGTCACTATCCCTGTCATGGCCAAGGCCCGCATCGG
CCACTTTGTTGAGGCCCAGATCCTCGAGGCCATCGGTGTTGACTACATTGATGAGAGCGAGGTCCTCACGCCGGCCGAC
GATGCTCATCACGTCAACAAGCACAACTTCCGTGTCCCGTTTGTCTGTGGCTGccGGGACCTCGGCGAAGCACTCCGCC
GCATTGCGGAGGGCGCTGccATGATCCGCACCAAGGGGGAAGCCGGCACTGGCGACATCGTTGAGGCGGtccgccaCGT
GCGttCTgtaggTGgagaa > SEQ ID NO:4982 131281FL 156281_301364_1d
GCGAAGCTTTGTCGTTTTTGATAAATTGTCACCCAATTTGGTTCAGGCATTTTCATCAACACCTTGCAAATGGAAGAAG
ACAGTGCCGTTACAGTGTACAGTGGCAGCGCAATTACCGACACCAAGAAGAATCCGTTCTCAATCAAAGTCGGGCTGGC
CCAAATGCTCCGTGGAGGAGCCATTGCTGAGGTCACCACCGTCGACCAAGCGAAGATCGCCGAATCCGCCGGCGCCTGC
TGCCTCGTAGTATCGGAACCTAAAGGACCCGGAATCTCGCGCATGGCCGACCCATCTGTAATCAAAGCGATCAAACAGG
```

FIG. 2 continued

```
CCGTCTCAATTCCCGTAATGGCAAAAGCCCGAGTCGGGCATTTTCTGGAAGCCCAGATCCTTGAAGCTATTGGAGCAGA
CTATGTAGACGAGAGCGAGGTTTTAGCCTTAGCCGACGAAGATCATTTCATCAACAAACACAATTTCCGTGCCCCATTC
GTCTGTGGGTGTCGAGATCTCGGAGAAGCATTAAGAAGAGTCCGTGAAGGTGCTGCGATGATTAGGACCCAAGGAGATC
TATTAGGTACAGGTAATATTGTGGACACAGTTCGCAATGTGAGGAAAGTGATGGGAGATATTAGAGTTCTATCAAACAT
GGACGAAGATGAGGTTTTCACTTTTTCAAAAAAGATCTCCGCGCCTTATGATATCGTTGCGCAAACGAAGCAGATGGGT
AG

> SEQ ID NO:4983 167332FL 114319_300007_1d
AATTTTCTCTCTTTCATTTCTTCCTCTCAATTTTCTTCTTCTGCCACTTTTAATTTTCCTCTAATGGATCCCGTTTCAG
TTTGGGGCAACGAACCTCTCTCCGCCGTAGATCCCGAAATCCATGACCTAATCGAAAAGGAAAAACGCCGCCAAAGCCG
CGGAATCGAACTAATCGCATCGGAAAATTTCACATCATTCGCCGTAATTGAAGCTCTCGGCAGTGCTTTAACCAACAAA
TACTCCGAAGGAATTCCCGGTAACCGTTACTACGGTGGAAATGAATACATTGACATAATCGAAAACTTGACCAGAAGCC
GTGCTTTAACGGCTTTTCATTTAGATCCAACAAAATGGGGAGTAAATGTTCAACCCTATTCTGGTAGCCCAGCGAATTT
CGCTGCGTATACAGCTGTTTTGAATCCACATGATAGGATTATGGGATTGGATTTACCATCTGGTGGACATTTAACTCAT
GGTTATTATACTTCTGGAGGGAAGAAAATTTCTGCTACTTCGATTTATTTTGAGAGTTTGCCTTATAAGGTGAATTCAA
CAAATGGATATATTGATTATGATAGGTTGGAAGAGAAGGCTTTGGATTTTAGGCCTAAATTGATTATTTGTGGAGGTAG
TGCTTATCCTAGAGATTGGATTATAAGAGATTTAGAGAAATTGCTGATAAATGTGGAGCCCTTTTGCTTTGTGATATG
GCTCACATTAGTGGCCTTGTTGCTGCTCAGGAAGCCGCCGATCCCTTTGAATATTGTGACTTGGTCACTACCACCACTC
ACAAGAGCTTGAGGGGTCCAAGGGCCGGTATGATCTTCTACCGCAAGGGCCCTAAGCCACCAAAGAAGGGACAGCCTGA
GGATGCGGTCTATGACTTTGAAGACAAGATTAACTTTGCTGTTTTCCCCTCGCTCCAGGGTGGTCCTCACAACCACCAA
ATTGGTGCTCTTGCTGTTGCCCTAAAACAGGCCGCAACTCCTGGTTTTAAGGCTTATGCTAAGCAAGTTAAGGCCAATG
CAGTTGCTCTCGGCAACTACCTCATGAGCAAAGGATACAAACTCGTAACTGGTGGGACTGAGAACCATCTTGTCCTTTG
GGATCTTAGACCTCTTGGTTTGACTGGTAACAAGGTTGAGAAGCTTTGTGACCTTGCCAACATTACTGTTAACAAAAAT
GCTGTTTTTGGCGACAGCAGTGCTTTGGCCCCAGGAGGTGTTCGTATTGGTACTccTGCAATGACATCAAGGGGATTGG
TTGAGAAGGACTTCGAGCAGATTGCCGAGTTCCTCCACAGGGCTGTTACCATCACCTTGAACATCCAGAAGGAGTACGG
AAAGCTTTTGAAGGATTTCAACAAGGGTCTTGTCAATAACAAGGAAATTGAAGAACTCAAGGCTGACGTCGAGAAATTC
TCATCCTCCTTTGACATGCCCGGCTTCAAGTTGTCTGAGATGAAGTACAAGGACTAAATTCAGTGTGCATCACAACTGC
TATTGTATTTCTTGGTTTGTTTCTTTAGTTTGGATGGAAGAAAATGTTTCTCTACAAGTTAAATTCAATTCAGAAGAA
AAACAAATAATGGTTTTCCTCTTTATTCTGCATTTGGTGCTGTAGGTTATTGGATTTTTGTCCTGCAAGGCATTTCGTA
AGTGGCCTCTTCTTAAACTTTACCAAGATTGTAATGTCCAAAATGAGTACCACGAATGTATGTTGTTTTCATTTCTTgt
aTCCTAGTAATTCATGCAATCCTCTGTCTCTTATATATGACTGATTACACTTTCGTACCCATAAA

> SEQ ID NO:4984 167332FL 55763_300141_1d
cccacgcgtccgtcttttcaggccaaaattgattgttgctggtgcaagtgcttatgctagattgtatgactatgcccgc
atcagaaaGgTCTGTAAcAAGCAAAAAGctgtaATGCtAGCagaTATGGCACACATCAGTGGtttGgttgctgctAATg
taATCCCTTCACcgttCGACTATGCTGATGttgtaACCACCACAACTCACAAGTCACTtCGTgGaCCCCgtgGAGCCAT
GATTTTCTtcagaaaggGtgttAaggaaAttaAcaaGCAagggAAAGaggttTtGTATGATTTTGAAGACAAGATCAAC
CAAGCTGTcTTCcCTggTCTTCAAGGTGGTCCACACAACCACACTATCACAGGACTAGCTGTTgCTTTGAAACAGGCAA
CTACTtcaGaGTACAAAGCATACCAAGAACAAGTCCTGAGTAACAgtgcaAAgttcgctCagaCTCTAATgGagaGAGG
ATATGAACTTgtttctggTGGAactgacaaccatctggttctAgtgAATCTAAAGCCCaagggaattgATGGATctaca
attgaTAAAgtgttggAAGCTgtttacaTTgcatccaACAaaAACAc > SEQ ID NO:4985 167332FL 254052_301631_1d
gctccatcctcatccaaacctcacttctcacttcttcttcttcttgtgttcgactacctctgcattcttgtggggt
tAGGGGTTCGAGAGATTGTAGAGGATGGCAATGCTTTCCATCGCAGCTCTTCGACGGATCCAGTCCGTTGCTCGAGCAG
GAGGAATCCGTTTGTCTTCGTCTGCTGCAGCAGTTGCCAATGAAGAGTCATACCTCCGCCTCAAAGACAAATCACATGT
CACGTGGCCAAAAGTACTAAATACATCTTTGGAGAGATAGACCCAGAAGTCACAAATATAATTGAACTGGAGAAGAAT
CGCCAATGGAAGGGTCTGGAGCTCATTCCTTCAGAGAACTTTACATCACTCTCAGTGATGCAGGCTGTTGGTTCTGTCA
TGACAAATAAATACAGTGAAGGCTATCCGGGAGCCAGATATTAtGGAGGAAATGAGTTTATCGATATGGCAGAGTCACT
ATGTCAAAAACGGGCACTTGAGGCTTTTCGCTTGGACCCGGCAAAGTGGGGAGTGAATGTGCAGCCATTGTCGGGTTCA
CCAGCGAACTTCCATGTTTACACTGCTCTCTTGAAACCACATGACAGAATTATGGCTCTTGATCTTCCTCATGGTGGCC
ACCTTTCCCATGGATACCAGACTGATACTAAGAAGATATCGGCTGTTTCAATATACTTTGagacgaTGCCATACCgact
gaacgaaaccacaggcTTCATCgactATGAT > SEQ ID NO:4986 167332FL 240420_301314_1d
gaGCGGGCTCGTGGCTGCTGGTCAACTTGCTAATCCTTTCGAGTACTGTGATGTGGTTACAACCACTACTCACAAGTCT
TTAAGAGGTCCTCGTGGAGGAATGATATTTTTCCGGAAAGATCCAGTTCTGGGACTGGACTTGGAAACAGCTATAAACA
ATGCAGTATTCCCCGGTCTGCAgggaggACCTCACAATCACACAATTGCTGGACTGGCCGTGTGCCTGAAGCACGCAGT
```

AACCGAAGAATTCAAGCAGTATCAAAAGCAGGTGATTGCGAACTGTCAAGCGCTTGCAGACAAGCTGGTGGAGttgGGA
TTCACGCTGGTGTCTGGCGGAACCGAAAATCACCTGGTCCTTGTTGATCTGCGTCCTTTGGGAATTGACGGTGCCAGAA
CTGAAAAGGTGCTGGATCGTGCTTCCATCACGCTCAACAAGAACTCAGTACCAGGTGACAAGAGTGCGTTAGTTCCGGG
AGGTGTACGCATCGGCACACCTGCATTGACAACGAGAGGACTCAAGGAAGAGGACTTCGTCAAAGTAGCAGAGTTCATT
CACGAAGGCGTCCAAATCGCCAGACAGCTCAAGGAAACAGTCCGGCAAGGGAAAATGAAAGAGTACGTCCAGGCACTCG
AATCTCCAGACTCTCCAGTCCAGACGAGCATCGCCGATCTACGGAACAGAGTCGAAGC > SEQ ID NO:4987  167332FL 226285_300995_1d
GAACACATCTCCACCATGTCTTCATACGCCCTTTCCAACAACCATAAGGATCTCATTGAAGCCTCCCTCCACGACCTCG
ACCCCGAGGTCGAGGGCATCATGAAGGACGAGATTGACCGACAGAAGCACTCCATCGTCCTCATTGCCTCCGAAAACTT
CACCTCCAAGTCTGTTTTCGACGCCCTTGGATCTCCCATGTGCAACAAGTACTCCGAGGGATACCCCGGCGCCCGATAC
TACGGTGGTAACCAGCACATTGACCGAATCGAGACTCTGTGCCAGAACCGAGCCCTCAAGGCCTTCGGCGTCACCCCCG
ACAAGTGGGGCGTCAACGTCCAGACCCTGTCTGGCTCCCGCAAACCTCCAGGTCTATCAGGCCATCATGAAGCCCCA
CGATCGACTCATGGGTCTTGATCTGCCCCACGGAGGCCATCTTTCTCACGGTTACCAGACCGACAACCGAAAGATCTCC
GCCGTCTCCACCTACTTCGAGACCATGCCCTACCGAGTCGACCTCGAGACCGGCATCATCGACTACGACATGCTCGAGA
AGACTGCCATCCTCTATCGACCCAAGGTTCTGGTTGCCGGAACCTCCGCTTACTGCCGACTCATTGACTACAAGCGAAT
GCGAGAGATTGCCGACAAGGT > SEQ ID NO:4988  167332FL 200673_300746_1d
GAATTCCAGTGACCACCATGCCTTACACTCTTCCGACGCTCATCATAAGTTAATCACCTCTCATTTGGTGGACACCGAC
CCTGAAGTGGACTCCATTATCAAGGATGAAATTGAAAGACAAAAGCACTCCATCAATTTGATTGCTTCTGAAAATTTCA
CCTCAACCTCCGTTTTCGATGCCCTTGGAACTCCATTGTCCAACAAATACTCTGAAGGTTATCCAGGTGCTCGTTACTA
CGGTGGTAATGAACACATTGACAGAATGGAAATTCTATGTCAACAAAGAGCTTTGAAAGCTTTCCATGTTACTCCAGAC
AAGTGGGGTGTTAACGTCCAAACTTTATCTGGTTCTCCTGCTAACTTGCAGGTTTATCAAGCTATTATGAAGCCTCATG
AAAGATTGATGGGTCTATACCTACCAGATGGTGGTCATTTGTCTCACGGTCACGCTACTGAAAACAGAAAAATTTCTGC
TGTTTCCACATACTTCGAATCTTTCCCATACAGAGTTAACCCAGAAACCGGTATTATCGACTACGATACTTTAGAAAAG
AACGCCATCCTATATAGACCAAAGGTTCTTGTTGCTGGTACTTC > SEQ ID NO:4989  167332FL 183188_300619_1d
ccccgaccgagcgagccgcatacgcattccgtcgaacacctcacccgcacccaccaccaccaacctcccaccccacaac
cCACATCCATGTGCACGCGCGCCCTCCTCTCCTCCTCCGTCTATATATCCCCTCCTCTCCACCCCTCCCCACCACTCCCC
TCCTCCCGCCTCGCCGCCGCAACCACCGCCGCCTCGCCGCAGCATCACCCGCAGCCGCCGCCGCCGCCGCCATGGAC
TCCGTCGCGTCGTGGGGGCTGACCCCGCTCGCCGCGGCCGACCCGCTCGTCCACGACCTCCTCGAGCGGGAGAAGCGGC
GGCAGCGGAGCGGCATCGAGCTCATCGCCTCGGAGAACTTCACCTCCTTCGCCGTCATGGAGGCCCTCGGCTCCGCGCT
CACCAACAAGTACTCCGAGGGGATGCCCGGGGCGCGCTACTACGGCGGGAACGACGTCATCGACGAGATCGAGAACCTG
TGCCGCGACCGCGCCCTCGCCGCGTTCCGCCTCGACGCCGCGTCGTGGGGCGTCAACGTGCAGCCCTACTCCGGCTCGC
CGGCCAACTTCGCCGCCTACACGGCGCTCCTCAACCCGcaCGACCGCATCATGGGGCTCgagctCCCCTCCGGTGgccA
CCTCACCCATGGCTACTACACCGCGGCGGGAAGAAGATCTCCGCGACGTCGATCTACTTCGAGAGCCTCCCCTACAAG
GTGAGCGCCGCCACGGGGTACATCGACTACGAGAAGCTGGAGGAGAAGGCGCTCGACTTCCGCCCCAAGCTCATCATCT
GCGGCGGCAGCGCGTACCCGAGGGACTGGGACTACGCCAAGCTCagggccGTCGCCGACAAGGTCGGGGCGCTGCTCCT
CTGCGACATGGCGCACATCAGCGGCCTCGTCGCCGCGCAGGAAGCTGCAAATCCTTTTGAGTACTGTGATGTGGTTACC
ACCACCACGCACAAGTCCCTCCGAGGACCAAGAGCTGGCATGATCTTCTACAGGAAGGGCCCTAAGCCTCCCAAGAAGG
GCCAGCCTGAGGGTGCTGTCTATGACTACGAGGACAAGATCAACTTCGCAGTGTTCCCGTCACTGCAAGGTGGTCCTCA
CAACCACCAGATTGCAGCCCTTGCTGTTGCTCTGCAGCAAACCATGACACCTGGATTCAAGGCCTACGCAAAGCAGGTC
AAGGCCAACGCTGTCGCCATTGGCAAGTATCTTATGAGCAAGGGCTACAAAATGGTGACTGATGGAACTGAGAACCACC
TTGTTCTCTGGGATCTTCGCCCTCTTGGCTTGACTGGCAACAAGGTTGAGAAGATGTGTGACCTTTGCAGCATTACACT
TAACAAGAATGCTGTCTTTGGTGACAGCAGTGCATTGGCTCCTGGCGGTGTCCGCATTGGTACTCCTGCGATGACATCC
AGGGGTCTTGTCGAGAAGGACTTTGAGCAGATCGGCGAGTTCCTCCACCAGGCCGTGACCATCTGCCTCAACATCCAGA
AGGAGCACGGCAAGCTCCTCAAGGACTTCTCCAAGGGCCTGGTGAACAACAAGGACATCGAGAACCTCAAGCTGGAGGT
CGAGAAGTTCGCCACCTCCTTCGACATGCCCGGCTTCACCCTCGACAGCATGAAGTACAAGGAGTAGGAAAACAAAAAC
ACACACAAACCATGGTCCTACCGCCGCTAATCGTCGACCAGCTGTGCTCTCGTGGACCGCCGTCGTCGTCATCTTCTTC
CTCGGCACAAGCTGGCCCTGTGTTACGGATTTTGTCTGCCCATCGAGATGATAGGTTTCATAAAACGCTCTCTCCCCCA
CCCTGCTGCTGCCTCTGGTTTGGTTGCCAACCTCATCCCCCATCGGTTTTTTTCCTCCTCTTGTTTCTAATTTCTAGGA
GCTGTGCCTTTTGGAATCATGGAATGTCAAGTATTTGCCAATAATCAATCCGTTTGATTTCTGCCT > SEQ ID NO:4990  167332FL 139331_300409_1d
CCCCCCCACCTCTATCAGGGTCACCTGCCAGACTTCCATGTTTACACTGCCCTATTGAAACCACATGAGAGAATCATGG
CTTTGGATCTTCCTCATGGTGGACATCTTTCTCACGGCTACCAGACTGATACTAAGAAGATTTCAGCAGTTTCGATATT

FIG. 2 continued

CTTTGAGACAATGCCCTACAGATTGGATGAAAGCACTGGCTTGATTGATTATGATCAGATGGAGAAAAGTGCCGTTCTT
TTTAGGCCAAAGTTGATCGTTGCGGGTGCAAGTGCATATGCGTCTTTATGACTATGACCGCATGCGGAAGGTTTGTG
ACAAGCAGAAGGCAATACTTCTAGCAGATATGGCACATATCAGTGGGCTTGTCGCAGCTGGTGTTGTTCCATCTCCTTT
TGATTATGCAGATGTAGTGACTACCACTACTCACAAGTCACTCCGTGGACCACGTGGAGCCATGATCTTTTACAGGAAG
GGGGTGAAAGGAGTAAACAAGCAAGGCAAAGAGGTTATGTATGACTTTGAGGACAAGATCAATGCTGCTGTCTTCCCAG
GTCTGCAAGGTGGACCACATAATCATACCATTACTGG

> SEQ ID NO:4991 167332FL 132542_300447_1d
ctgagaattgttggattgtgtgattgttttttcaattacaatggatttgagccaatcgcaatcgagtaatctctcgcta
gGGTTTATTGCTCATGCGTCCCCGGCGGGAAGCGCACCTAGTCGTGCTCATATCGCCGACGACTCGATCACTTTTCAGA
TCGATTCTAGGGTTAAGGACCAATCGCATCTGATTCCGCCTGTTCCACTTCAATTGATGGACAAGCAAACGGAGGAGAA
CGAAAAGAACGGGGGAGAGAGTGGGGATGAAGAGAGGGAAGTTGAAGAATTTCGTATTCTAGGACATTCCATGTGTATA
AAACGGAGGAGAGATATTGATAGCACGTCGTCTTCTTCGTCTTCAAAGTGCTTTAGGGTTACGAGTTCCAATGAGCATA
TGCTAGGGCTAGAATCGCGAATAAGCGCTGTTAGAGCTTGGGGTAATCAGGGTTTACAGGTAGCTGACCCGGATATATT
TGAGATAATGGAGAAGGAGAAGCAGAGACAGTACAAAGGGATTGAACTGATTGCCTCTGAGAATTTTGTATGCAAGGCT
GTGATGGAGGCATTaggGAGCCATTTAACAAACAAGTATTCTgaaggaGCACCggGGGCaaggtaCTAtGGTGGTAATC
AGTTTATAGATGAGATTGAAACTCTATGTTGTAAGCGTGCATTAGCTGCTTTTGGACTTGACCCTGAGAATTGGGGTGT
GAATGTGCAACCATATTCTTGCACTTCAGCAAACTTTGCGGTTTATACTGGTTTGCTACTGCCTGGTGATCGGATAATG
GGATTGGATACACCGTCTGGTGGAAACACAAGTCATGGGTATTATCTTCCTAATGGAAGAAAAGTTTCAGGGGCTTCAA
TTTTCTTTGAGAGTCTGTCTTATAAGGTTGACCCCCAAACTGGGTATGTAGATTTTTGATAAGCTTGAGGAAAGGGCTCT
TGATTTCCGTCCTAAGATACTTATATGTGGGGGGAGTTCGTATCCCCGGGAATGGGATTATGCAAAGTTTAGACAGATT
GCGGACAAATGTGGTGCAGTTTTGTTGTGCGATATGGCACAAATTAGCGgtcTCATTGCTGCAAAGGAATGTGCGAGTc
cCTTTGATTATTgtgATATAGttACTTCAACaaCTCATAAAAGTcttcgagGtcctaggggaggtaTTATCtttTTATAg
gAAAggATCAAAGccaag > SEQ ID NO:4992 167332FL 1188260_302136_1d
CACGCGTCGCTTGTCACTGACGGGACCGATAACCATTTGGTTCTGTGGGATCTTCGGCCTTTGGATTAACAGGAAACAA
ATACGAGAAAGTTTGTGAGCTGTGCCATATTACTCTCAACAAAATGCTGTGTTTGGAGATAGTGGTGCTTCGGCTCCT
GGAGGAGTGAGAATTGGTACGCCGGCTATGACTTCAAGAGGCTGTGTCGAGGTCGACTTTGAGGTTGTAGCGGAGTTTC
TTATGATGGCTCTTCAAATCTCAGTGAAGATACAAAGGGAGCACGGAAAGCATTTAAAAGACTATTGGAAAGCTCTGCA
TAATAATAAGGAGATCGAGGACATCAGAAACAACGTCGAGAAATTTGCTTCAGTCTTCGAGATGCCAGGGTTTGATACT
GCAACTATGAAGTACAATCAATAGCCTTTGTGTTGAACTGTGCACTCCTTGTTTTATTAATACAAATTTCCATAGAATT
TAGGCAATTTTCATTTCCAAATGTAGGCACACAGATTGCCAAATACACCACTAAAACCGTGACTGGTTTTGATGCCACC
TGGAGATTTTTACATGTACTTGCTATTGAGAGGTAGCTCTCATATGCTAAGAAATGATTGTGCTCTACATGTACCTTT
GACTGTTAGGACAGTTCTATCATGGAGCCTTGGCATAATGGCAAGTGCCATTCTGAGAATGATGTATTTTATAATTAAA
GTTAACAGGTTAT > SEQ ID NO:4993 167332FL 128325_300475_1d
ggtgTGTGTAACAGGGGAGAAGCTGACAATAATTATGGCCATGGCAACGGCTCTTCGAAGACTCTCCTCTTCTGTTGAC
AAACCAATTAAGCGTCTCTATAATGGCGGCTCTCTCTATTACATGTCATCGTTGCCTAATGAAGCTGTTTACGAGAAGG
AAAAAAATGGTGTCACGTGGCCAAAGCAACTGAATGCTCCTCTAGAGGAGGTTGATCCTGAAATTGCTGACATTATTGA
GCTTGAGAAAGCACGCCAGTGGAAGGGACTTGAACTCATTCCTTCAGAAAATTTCACTTCTGTGTCTGTAATGCAAGCT
GTTGGATCCATTATGACAAACAAGTACAGTGAAGGATATCCTGGGGCTAGATACTATGGAGGAAATGAGTATATTGACA
TGGCGGAAACATTATGCCAGAAACGTGCTTTAGAAGCATTCCGGTTGGATCCTGCAAAATGGGGAGTGAATGTGCAGCC
TCTATCAGGATCACCTGCTAATTTTCATGTTTACACTGCACTTTTAAAACCTCATGAAAGAATCATGGCCCTTGATCTT
CCCCACGGTGGACATCTTTCTCATGGATATCAGACTGATACAAAGAAGATATCTGCCGTCTCTATATTTTTGAGACCA
TGCCATACAGACTGAATGAGAGCACTGGCTACATCGACTATGACCAGCTTGAGAAAAGTGCCACACTCTTTAGGCCAAA
GTTAATTGTCGCTGGTGCTAGTGCTTATGCACGTCTTTATGACTATGCACGTATCCGAAAGGTTTGTGACAAACAGAAG
GCTATCATGTTGGCAGATATGGCTCATATTAGTGGGTTAGTTGCAGCTGGAGTCATCCCATCACCATTTGATTATGCAG
ATGTTGTGACTACCACAACCCACAAATCCCTTCGCGGGCCTCGTGGTGCCATGATTTTCTTCCGGAAGGGTGTGAAGGA
GGTTAACAAGCAAGGAAAGGAGGTGTTGTACGACTATGAAGATAAAATTAACCAGGCAGTCTTTCCTGGACTTCAAGGT
GGTCCTCACAATCATACAATTACTGGCTTGGCAGTTGCTTTGAAACAGGCAATGACTCCAGAATACAAAGCTTACCAAG
AGCAATGCCTTAGCAACTGCTCAAAATTTGCCCAGGCGTTAGCGGGAATGGGTTATGAACTTGTTTCTGGTGGAACAGA
GAATCACTTGGTCTTGGTGAACTTGAAAAACAAGGGTATTGATGGTTCTAGGGTTGAAAAAGTTTTGGAAGCGGTACAT
ATTGCAGCCAATAAGAACACTGTTCCTGGAGATGTATCTGCCATGGTCCCTGGTGGCATCAGAATGGGGACTCCTGCAC
TCACATCAAGGGGATTTATTGAGGAAGATTTTGTGAAAGTTGCTGAATTCTTTGATGCTGCTGTGAAGATAGCAGTGAA
AATAAAGGGTGAGGCTCAAGGAACAAAGTTGAAAGACTTTGTGACAACACTACAGTCTAGTGCTTCCATCCAGTCGGAG
ATTGCAAAACTCCGCCATGGTGTGGAGGAGTATGCAAAGCAGTTCCCTACAATTGGGTTTGAGAAGGAAACCATGAAGT
ACAAAAACTGAGAGCTCGACTGAGTATATACACAAGGACCAATATCCAATTTCTTGAAGGTGTATGGGATGCACATTCA

FIG. 2 continued

AACTGCAGTTTGCTCTCAAGGATAGGATTTTCATCTTATAATATTATGTAAAATCCAGCAGTACTTGGTTCCCAACTTT
GCACTTTGTATATTAACGATTGTAAATCATCTCAGGTCCTTGAAAGCAATAAACTCCTCTTATCTCAGtAAAAaagaaa
gaagaaAAACattgnccTGTATTGCTTAATATTTTCCTTTTATTAATGagagtaccatGTGTTgtgTTGGAAAAAAAAT
G > SEQ ID NO:4994 167332FL 241141_301320_1d
GTCTGTTTCTTTTCTCACAATCCCACCAAACTACCTCACAATGTCTCCCACAAACGCTGAGTATGCGCTCTCTGAGACG
CACAAGGAGATGCTCGAGAAGTCTCTCCTCGACTCCGACCCTGAGGTTGCCACCATCATGAAGGATGAGATTCAGCGCC
AGCGCGAGTCCATTATCCTCATCGCCTCCGAGAACATCACCTCTCGCGCCGTCTTCGATGCCCTTGGTTCCCCCATGTC
CAACAAGTACTCCGAGGGTTACCCTGGTGCTCGTTACTACGGTGGAAACCAGCACATCGACCAGATCGAGCTTCTCTGC
CAGCGCCGTGCCCTTGAGGCCTTCCACCTCGATTCCGAGAAGTGGGGTGTGAACGTCCAGTGCCTTTCTGGATCCCCCG
CCAACCTCCAGGTCTACCAGGCTATCATGCCTCCTCACGGCCGTCTTATGGGTCTTGACCTTCCCCATGGTGGCCATCT
TAGCCACGGTTACCAGACCCCCGCCCGCAAGATCTCTGCTGTCTCTACCTACTTCGAGACCATGCCTTACCGTGTCGAC
CTCGACACCGGCATCATCGACTATGACACCCTCCAGAAGAACGCTATCCTCTACCGNCCCAAGGTCCTCGTTGCCGGTA
CTTCCGCCTACTGCCGTCTTATCGACTACGAGCGTATGCGCAAG > SEQ ID NO:4995 167332FL 127106_300468_1d
cccccccccCAGTTGGATCGGTTATGACTAacaAGTATAGTGAAGGATATCCTGGTGCCAGATACTATGGAGGAAATG
AGTACGCATACTGTTTGCTAAATCTCGTTCTCCTAATTCTTTTGTAATTAACCTGTATTTTCATGTTATATATCAGCTT
CAGATATTCTTTTCCTATTATGAGAGAATGAGTGTCCAGGTACATAGACATGGCAGAAACTTTATGCCAgaAACGTGCT
TTGGAAGCATTCAGGCTGGATCCTGCAAAGTGGGGAGTGAATGTGCAGCCTCTATCAGGATCACCTGCTAATTTTCATG
TTTACACTGCATTATTAAAACCTCATGAACGGATCATGGCTCTTGATCTTCCTCATGgtgGACATCTTTCTCATGGATA
TCAGACTGATACGAAgaagaTATCTGCAGTCTCTATATTCTTTGAGaCAATGCCTTACAGACTCAATGAGAGCACTGGC
TATATTGACTATGACCAGCTTGAGAAAAGTGCCACACTCTTTAGGCCAAAATTAATTGTTGCTGGTGCTAGTGCCTATG
CACGTCTTTACGACTATGAACGAATCCGGAAGGTCTGCGACAAACAGAAAGCTATTTTATTAGCAGATATGGCACACAT
TAGTGGATTGGTTGCAGCTGGAGTCATCCCATCACCATTTGATTATGCTGATGTTGTCACTACCACAACCCACAAATCC
CTTCGTGGTCCTCGTGGTGCTATGATTTTCTTCAGGAAGGGTGTTAAAGAGGTTAACAAGCAAGGCAAGGAGGTTTTGT
ACGACTATGAAGACAAAATCAATCAGGCAGTCTTTCCTGGACTTCAAGGCGGTCCTCACAATCACACCATTACTGGCTT
GGCAGTTGCCTTGAAACAGGCAATCACTCCAGAATACAAAGCATACCAAGAGCAGGTCCTCAACAACTGCTCAAAATTT
GCCCAGGCTTTAATGGAGAATGGTTATGAGCTTGTCTCTGGAGGAACGGAGAATCACTTGGTTTTGGTGAACCTGAAAA
ACAAGGGTATTGATGGTTCTAGGGTTGAGAAAATCTTGGAAGCTGTACATATTGCAgccaACAAGAACACTGTTCCTGG
GGATGTATCTGCCATGGGcCCCGAGGcatcaggATGgGaactcctgcgcTCActtatcgtggattagGTGaagAagaT
tatgcGAAA > SEQ ID NO:4996 168151FL 1172611_302063_1d
GCTTCTTCTTCTTGTTCGACTACCTCTGCATTCTTTGTGGGGTTAGGGGTTCGAGAGATTGTAGAGGATGGCAATGCTT
TCCATCGCAGCTCTTCGACGGATCCAGTCCGTTGCTCGAGCAGGAGGAATCCGTTTGTCTTCGTCTGCTGCAGCAGTTG
CCAATGAAGAGTCATACCTCCGCCTCAAAGACAAATCACATGTCACGTGGCCAAAAGTACTAAATACATCTTTGGAAGA
GATAGACCCAGAAGTCACAAATATAATTGAACTGGAGAAGAATCGCCAATGGAAGGGTCTGGAGCTCATTCCTTCAGAG
AACTTTACATCACTCTCAGTGATGCAGGCTGTTGGTTCTGTCATGACAAATAAATACAGTGAAGGCTATCCGGGAGCCA
GATATTATGGAGGAAATGAGTTTATCGATATGGCAGAGTCACTATGTCAAAAACGGGCACTTGAGGCTTTTCGCTTGGA
CCCGGCAAAGTGGGGAGTGAATGTGCAGCCATTGTCGGGTTCACCAGCGAACTTCCATGTTTACACTGCTCTCCTGAAA
CCACATGACAGAATTATGGCTCTTGATCTTCCTCATGGTGGCCACCTTTCCCATGGATACCAGACTGATACTAAGAAGA
TATCGGCTGTTTCAATATACTTTGAGACGATGCCATACCGACTGAACGAAACCACAGGCTTCATCGACTATGATCAGCT
TGAAAAATCTGCTACTCTATTCAGGCCCAAATTAATTGTTGCTGGAGCCAGTGCTTATTCCCGGCACTATGACTATGCG
CGCATGCGTAAGGTCTGTGACAAGCAAAAGGCTGTGCTCTTGGCGGATATGGCGCATATCAGTGGACTTGTAGCTGGTG
GTGTGGTTCCCACTCCCTTCGACTTTGCAGATGTTGTTACAACTACTACTCACAAGTCTTTGCGGGGCCCTCGCGGGGC
CATGGATATTCTATAGGAAGGGGCTCAAGGAGGTCAACAAACAAGGACAAGAAGTTATGTATGATTATGAAGACAAAATC
AATGCCGCTGTGTTTCCTGGTCTCCAAGGAGGACCACACAATCACACGATTACTGGCCTTGCCGTGGCCCTAAAACAGG
CAGCCTCATCTGAATTCAAAGCTTATCAGGAGCAAGTTCTGAGTAATTGTGCTCATTTCGCAAAATCTCTTATGTCGAA
GGGCTATGAGCTTGTGTCTGGGGGAACTGATAATCACCTTGTGCTCGTGAATCTTAAGAACAAGGGaattgatGGATca
agggtgGAACGTATCTTGGAACTGgcTCACattgctgcaAACAAGAACACCGTCCctgggGatgtgtcttgcctGATTC
CAGGAGGCATCCGAatggGAACtCctgcTTtGACATCGAGAGGATTTacagAGGAGAATTTCGaGaag > SEQ ID NO:4997 168151FL 130609_300489_1d
gaattcagaggagagagagagacacacagagaaagggtgGCGATGGCAATGGCACTTCGTAGGCTCTCATCTTCTTCAA
TCAACAAACCTATCCGTCCTCTCTTCAATGCCGATTCCTACTATTGCATGTCATCTCTTCCAAGTGAAGCTGTTGGTTA
TCCTGGTGCTAGATACTATGGAGGAAACGAGTACATTGATATGGCAGAAACTTTGTGCCAGAAACGTGCCTTGGAGGCT

FIG. 2 continued

```
TTCCGTTTGGATCCTGCTAAATGGGGAGTTAACGTGCAATCTTTGTCTGGGTCCCCTGCCAATTTCCAAGTCTACACTG
CACTATTGAAGCCCCACGAGAGAATTATGGCACTTGACCTTCCACATGGTGGGCATCTTTCTCATGGGTATCAGACTGA
CACCAAAAAGATATCTGCTGTATCTATATTTTTTGAGACAATGCCATACCGATTGGATGAGAGCACTGGTTACATTGAT
TACGATCAGTTGGAGAAGaGCGCTACACTCTTCAggCCGAAACTGATTGTTGCTGGTGCAAGTGCTTATTCACGCTTCT
ACGATTATGCACGCATTCGccaggTGTGCGACaAGCAAAAAGCTATATtgttggCagataTggCTCACAtcagtggGCt
tgttgctgctggTGTCATcccATCt > SEQ ID NO:4998 168151FL_119088_300066_1d
TGTTTCTGGTGGAACAGAGAATCACTTGGTCTTGGTGAACTTGAAAaAcaAGGGTATTGATGGCTCTAGGGTTGAAAAA
GTTTTGGAAGCGGTACATATTGCAGCCAATAAGAACACTGTTCCTGGAGATGTATCTGCCATGGTCCCTGGTGGCATCA
GAATGGGGACTCCTGCACTCACATCAAGGGGATTTATTGAGGAAGATTTTGTGAAAGTTGCTGAATTCTTTGATGCTGC
TGTGAAGATAGCAGTGAAAATAAAGGGTGAAGCTCAAGGAACAAAGTTGAAAGACTTTGTGACAACACTGCAGTCTAGT
GCTTCCATCCAGTCGGAGATTGCAAAACTCCGCCATGGTGTGGAGGAGTATGCAAAGCAGTTCCCTACAATTGGGTTTG
AGAAGGAAACCATGAAGTACAAAAAATGAGAGCTCGACTGAGTGTATACACAAGGACCAATATCCAACTTCTTGAAGGT
GTATGGGATAGACTTTCAACTGCAGTTTGCTCTCAAGGATAGGATTCTCATCTTATAATAATATGTAAAATCCAGCAGT
ACTTGGTTCCAGACTTTGCACTTTGTATATTAACGAGTGTAAATCAACTGAGGTCCTTGAAAGCAATAAACTCCTCTTA
TCTCAGTGa > SEQ ID NO:4999 168151FL_266075_200083_1d
CCCTCGACCACGCGTCCGGCTATGGCTCTTCGTAAACTCTCTTATGGTTCCTCCATTAAGCTTCTTCGTCCTCTCTCCA
TGGCCCTTCCCTCTATTACATGTCGTCTTTGCCTAGTCAAGCAATTCGTGAAAGGGAGGATCCGCGTGTTACGTGGATA
AAGCAGCTGATTGTGCTACTTGAGGATATCGATCCAGAGATCGCCGACATCATTGAGCATGAGAAAGCTAGACAATGGA
AGGGTCTTGAGCTTATCCCTTCAGAGAATTTTACGTCATTGTCGGTGATGCAAGCAGTTGGATCAGTAATGACCAACAA
GTACAGTGAAGGGTATCCGGGTGCTAGATACTATGGAGGAAACAGTACATTGACATGGCAGAGAGATTGTGTCAAAAA
CGTGCATTAGAAGTTTTTAACTTGGATCCTGCCAAATGGGGAGTCAACGTTCAGTCGTTGTCTGGATCCCCTTCAAACT
TTCAAGTGTACACTGCTTTATTAAAGCCTCATGAGAGAATTATGGCCCTCGATCTTCCTCATGGTGGACATCTCTCACA
TGGTTATCAGACCGACACAAAGAAAATTTCTGCTGTATCTATCTTTTCGAGACCATGCCATACAGATTGGATGAGAGC
ACAGGTTATATTGACTATGATCAGCTGGAGAAAAGTGCAGTACT > SEQ ID NO:5000 168151FL_284537_200099_1d
gaatctcaataagtgaagggattttggtggttaattgtaacatggaagcttgttgcggagctgcaatcatggGttcagt
tCAGCAGCCTGTTTGGGTTAAAAGTTCAGCTTTTCCTTCAAAAGGGGCTGCTGGTATTCCGGCTCGGGTTAAATTATGC
TCTGTAAAACCCTGCAGAGCATCTCCAATTGAAGGGAGCTTGTTAACAGGAAGCCCTACTTCTTCTGTAGGTGCTAGGA
GCAGTTTGAAGACTATGGATTGAGTGAAGCTGATCCTGATGTCCGTGCTATAATTGACAAAGAGAAGAAACGTCAATT
TAGGAGCTTAGAACTTATTGCATCTGAGAATTTCACATCTCGAGCAGTGATGGAAGCAGTTGGTTCTTGCCTTACAAAC
AAATACTCCGAAGGGCTTCCAGGAAAAAGATACTATGGTGGTAATGAATACATTGATGAGTTGGAAACTCTCTGTCAAG
AAAGAGCATTGGCTGCCTTTAGTTTAGATGGAAAGCAATGGGGTGTGAACGTCCAACCATTATCTGGTTCGCCAGCAAA
TTTTGCAGTCTACACAGCTGTTCTTAATCCACATGACCGGATTATGGGATTGGACTTACCTCATGGTGgcCACTTGTCC
CATGGATTTATGACTCCTAAACGACGAGTTTCTgcCACCTCTGtttTACTTTGAGTccATGCCTTATCGACttGATGAAT
CTACAggCAtcctcGattaTAaAATGCATGagaAaA > SEQ ID NO:5001 168151FL_49823_300187_1d
CATCTTTCTCATGGTTATCAGACTGACACCAAGAAGATATCAGCTGTGTCTATCTTCTTTGAAACAATGCCCTATAGAT
TGGACGAGAGCACTGGCTACATCGACTACGATCAGATGGAGAAAAGTGCTACTCTTTTC > SEQ ID NO:5002 168151FL_48608_300033_1d
GCCATTACGGCCGGGGCATATTGCAGCCAATAAAAACACTGTGCCTGGTGATGTATCCGCCATGGTGCCTGGTGGCATT
CGCATGGGAACCCCAGCTCTGACTTCTAGGGGATTTATTGAGGAGGATTTTGTGAAAGTGGCTGAATTTTTTGATGCTG
CTGTGAAGTTGGCCCTTAAGGTCAAGGCTGAGACCCAAGGAACAAAGTTGAAGGACTTTGTGGAAACTTTGAGTTCAGA
CTCCAAAATTCAATCTGAGATTGCCAGGCTAAGGCAGGACGTTGAGGACTATGCAAAACAATTTCCTACTGTTGGTTTC
GAGAAAGAAACAATGAAATACAAGGATTGAGCTGGGATCTAGTATTCAGATGGAATCGGAAGGCATTTTTCTCCAATGA
AGTTAGAACTTGTCTTTAGAAGTCTTCTGGAAGTCACTTGCAGGCGAGGAAAACAGTTGCACGGATCACATTTGTATAA
TTTTCTAAATCAAAGTCATGATCAGATGTAATTTTCAAGCTGTAAAACAACTGTTCCAAAATTCAATTTGTCTCACTCT
TGGTTTAGAGAAGGACGAGAAAGCCAACAATGGTTTACGGAAAGTCCTTTGTGGAATACTCGCAAAGG > SEQ ID NO:5003 168151FL_266434_200086_1d
cggacgcgtggggctcgccaatggaagggGctcgaactcattccttcagaaaatttcacttcccttTcggtgatgcaag
CAGTTGGATCGGTTATGACTAACAAGTATAGTGAAGGATATCCTGGTGCCAGATACTATGGAGGAAATGAGTACATAGA
```

FIG. 2 continued

CATGGCAGAAACTTTATGCCAGAAACGTGCTTTGGAAGCATTCAGGCTGGATCCTGCAAAGTGGGGAGTGAATGTGCAG
CCTCTATCAGGATCACCTGCTAATTTTCATGTTTACACTGCATTATTAAAACCTCATGAACGGATCATGGCTCTTGATC
TTCCTCATGGTGGACATCTTTCTCATGGATATCAGACTGATACGAAGAAGATATCTGCAGTCTCTATATTCTTTGAGAC
AATGCCTTACAGACTCAATGAGAGCACTGGCTATATTGACTATGACCAGCTTGAGAAAAGTGCCACACTCTTTAggcCA
AAATTAATTGTTGCTGGTGCTAGTGCCTATGCACGTCTTTACGACTATGAACGAATCCGGAAggTCTGCGACaAACAGa
AAGCTATTTTATTAGCAgaTATGGCACACATTagTGGATTGGttGCAGCTGGAGTCATcCCATCAccAtttGattATGC
TGATGttgtcaCTACCACaacccac > SEQ ID NO:5004 168151FL 242160_301326_1d
gGGAAGATCGATCGATGGCGCTAGCTTCGGCGGCGGTGCTGCGGCGATTGTCGAGGTTTCGCGCGTCCACAGCGCTCGC
GATCAGCGTGAACAGGGCTCTCGGTGACGCCGGATCGATCTTCTCGCGCAATGCGTCGACTGCGGTGGCCAATGAGGAG
GTTTACTCGCGATTCGAGAGCTCAAAGGACAAGTCCCATGTCACTTGGCCAAAACAACTCAACTCTCCACTGGCAGATG
TCGACCCCGAAATTGCTGATATTATTGAGCTAGAGAAAAATCGTCAATGGAAGGGACTTGAGCTCATTCCCTCGGAAAA
TTTTACCTCGACTTCGGTCATGCAAGCCGTGGGATCGATAATGACGAACAAGTATAGTGAGGGGTATCCAGGAGCTCGT
TACTACGGTGGAAATGAGTAGGTTCATTGATATGGCCGAGAGTTTGTGCCAGAAGCGAGCGCTAGAGGCCTTTCGACTC
AACCCGGAAGAATGGGGAGTCAACGTGCAGTCTTTATCTGGATCTCCGGCAAACTTTCAAGTATATACAGCTCTGCTTA
AACCGCATGACAGAATTATGGCTCTAGATTTACCACACGGAGGCCATTTGTCGCATGGATATCAGACagacactaAGAA
gATCtcgggcgttTcGaTCTTCTTTGagacaatgccgtaTAGa > SEQ ID NO:5005 168151FL 240949_301318_1d
aagaaggctagggttcttggcctcgaaatatgggcagatctatCTTCCAGCGCCTAGATCGCCGCATCGCCCGCATTAC
AGTCGCGCTAGATCAATGGCGGCCGTCAAGGACTGGGGCAATCAGCCGCTGGTGGCGGTGGACGAGGAGATTTTCGACC
TGATCGAGCACGAGAAGGCGCGGCAGTGGCGGGGGATCGAGCTCATCGCGTCGGAGAATTTCACGTCCCAGGCGGTGAT
CGAGGCGCTGGGCAGCGCCCTCACGAACAAGTACTCGGAAGGTATGCCAGGGAATCGCTACTACGGCGGCAACGAATTC
ATCGACCAGATCGAGGAGCTGTGCCGATCCAGGGCGCTGGCGGCATTCCGGCTGGATCCGGGCAGCTGGGGCGTCAATG
TCCAGCCCTACTCCGGCAGCCCCGCGAATTTCGCCGCGTATACCGCTGTGCTTGAGCCGCACGACCGGATTATGGGGCT
GGATCTTCCGTCGGGTGGGCATCTCACGCATGGCTACTATACGTCCGGCGGGAAGAAGATCTCGGCCACCTCCATCTAC
TTCGAGAGCTTGCCTTACAAGGTGGATCCGAAGACTGGCTACATTGACTATGATCGGCTCGAGGAGAaggCCATGGatt
tccggcccaagcttatCATCTGTGGcg > SEQ ID NO:5006 168151FL 167332_302305_1d
gaaccctcttcatcatcttcttcctcagaaatctcctgatcttctttctaaattcccaatctaaccctctccaaggatc
cCGTCAATGAATGGGGTAACACACACCCTTAAACGTTGCAGATCCAGACATCTTCGATTTAATCGAAAAAGAAAAGAGAAG
ACAATGCAGAGGTATCGAATTGATCGCTTCTGAAAACTTCACATCTTTCGCTGTGATTGAAGCActtgGTAGTGCTTTA
ACAAACAAATACTCCGAAGGTATTCCCGGTAACAGATACTACGGAGGTAATGAATTCATCGATGAGATTGAAAATCTAT
GTCGTTCAAGAGCTTTGGAAGCATTCCGATGTGATCCAGCGAAATGGGGTGTGAATGTACAGCCTTACTCTGGTAGTCC
TGCTAATTTTGCAGCGTATACTGCTTTGTTGAATCCACATGATAGAATTATGGGTCTTGATTTGCCATCAGGTGGTCAT
TTGACACATGGTTATTATACATCTGGTGGTAAGAAGATTTCTGCTACTTCAATTTACTTTGAGAGTTTGCCTTATAAGG
TGAATTCTACTACTGGGTATATTGATTATGATAAGTTGGAAGAGAAAGCTTTGGATTTCAGACCTAAATTGATTATCTG
TGGTGGTAGTGCTTATCCTAGAGATTGGGATTATGCTagaTttagagcTGTTGCTGATAAATGTGGTGCTCTTTTGCTT
TGTGACATGGCTCACATTantGGTCTTGTTGCTGCTcaggAAGCTGccAACCCATTTGAATACTGTGACGTTGTCACAA
CCACAACTCACAAGAgtttGAGGGGAccTaggGCTGGTATGATCTTCttc > SEQ ID NO:5007 168151FL 130212_300486_1d
GAATTCGAGAGAAATCTTTTTTTGGGGTTGAGAGGAGAGAGAGAGACACACAGAGAGAAAAAATGGCGATGGCAATGGC
ACTTCGTAGGCTCTCATCTTCTTCAATCAACAAACCTATCCGTCCTCTCTTCAATGCCGATTCCTACTATTGCATGTCA
TCTCTTCCAAGTGAAGCTGTTGATGATTCTAAGGATAAATCTCGTGTTCAATGGCCAAAGCAATTGAATGCACCATTAG
CAGAAGTGGATCCAGAGATTGCTGACATTATTGAGCTTGAGAAAGCTAGGCAATGGAAGGGTCTGGAATTGATTCCTTC
AGAGAATTTCACATCTGTGTCGGTCATGGAAGCTGTTGGTTCTATCATGACTAACAAATACAGTGAAGGTTATCCTGGT
GCTAGATACTATGGAGGAAATGAGTACATTGATATGGCAGAAACTTTGTGCCAGAAACGTGCCTTGGAGGCTTTCCGTT
TGGATCCTGCTAAATGGGGAGTTAACGTGCAATCTTTGTCTGGGTCCCCTGCCAATTTCCAAGTCTACACTGCACTATT
GAAGCCCCACGAGAGAATTATGGCACTTGACCTTCCACATGGTGGGCATCTTTCTCATGGGTATCAGACTGACACCAAA
AAAATATCTGCTGTATCTATATTTTTGAGACAATGCCATACCGATTGGATGAGAGCACTGGTTACATTGATTACGATC
AGTTGGAGAAGAGCGCTACACTCTTCAGGCCGAAACTGATTGTTGCTGGTGCAAGTGCTTATTCACGCTTCTACGATTA
TGCACGCATTCGCCAGGTGTGCGACAAGCAAAAAGCTATATTGTTGGCAGATATGGCTCACATCAGTGGGCTTGTTGCT
GCTGGTGTCATCCCATCTCCATTTGAGTATGCCGATGTGGTGACCACTACAACACATAAATCCCTTCGTGGACCACGTG
GGGCGATGATATTTTACAGAAAGGGATTGAAGGAAGTCAACAAACAAGGCAAAGAGATCATGTACGACTATGAGGACAA
AATTAATCAAGCTGTCTTTCCTGGGCTTCAAGGAGGTCCACACAATCACACAATTACTGGATTAGCAGTTGCACTGAAA

FIG. 2 continued

```
CAGGCAACTACCCCAGAATACAAGGCTTATCAAGAACAAGTGCTCAAAAATTGCTCACAGTTTGCCAAAACCTTGAACG
CATTGGGATATGACCTTGTTTCCGGTGGTACTGAAAACCATTTAGTCTTGGTCAATTTGAAAAACAAGGGTATTGATGG
CTCAAGAGTTGAGAAAGTAATGGAATTGGTTCATATCGCTGCTAACAAGAACACTGTTCCCGGGGATGTCTCTGCCATG
GTTCCTGGTGGCATTCGAATGGGAACACCTGCTCTCACTTCAAGGGGATTCCTTGAGGAAGATTTCGCTAAAGTAGCAG
AGTTCTTTGATGCTGCTGTGAATTTGGCCTTGAAAGCCAAAGCTGAATGCAAAAAAGGTGCAAAATTGAAGGACTTTAT
GGCCGCGGTTGAAAACAGTGCTAGCATTCAGTCTGAAATTAAACAGCTCCGTCATGACGTTGAGGAATATGCAAAGCAA
TTCCCTACAATCGGGTTCTGCAAAACAACAATGAAATACAAGCAATAAACTCCACTATTATAAGTGGGCATATATGCTT
CGGTAGTGCAGTGGAGTATCTACAAAGGCGAATGAGATGGACACGGGAAGGGAGCAAACTGCCTTTTAATGTAGGGAAT
ATATGAATGCTTTCAATCAGTGAATGGGATATATTGTTGACACTACAGGGTTCTAAGCATGAAGAGAGTACCATTTGGT
TCAAATTTCATTCTTCATTCAAGAATTGAATTATATGTATATTATTAAACTTGATCAATTATAATGCAACAATATAAAg
cttgt > SEQ ID NO:5008 168151FL 127290_300469_1d
CCCCCCCGCTTTATTGAGAAGAAATTGCAGACTGGTTACTGGAGGGACTGACAATCACATGATACTGTGGGATCTGAGA
AATCTTGGGTTAACAGGTAAGAATTTTGAAAAGGTTTGCGAGTTGTGTCACATCACTCTCAATAAAGTAATGGTCTTCG
ATGATAATGGAAGTATTACTCCTGGAGGTGTGAGGATAGGTACCCCTGCTATGACATCAAGAGGCTGTATAGAGAATGA
TTTTGAGACGATAACAGATTTCCTCCTCAAGGCAGCACAGATTACAAATTCAGTACAGAGAGAACATGGAAAGCTCGCA
AAGGCTTTTCTGAAAGGCCTTGAAAACAACAAAGATGTTATTGAGTTAAGAACACGCGTTGAAAGTTTTGCATCACTGT
TTGCAATGCCTGGATTTGAAGTATAATCTAGCTGGAAATCTCGTTCTGGTGGATGAATTCTTTTTTTATTCGTTGACCA
ACCTTTTTGTGGATTGGGAGAACAATGGTGCACCCAACTCTTGGTTAGTAATTGACTAGGCTTGATATGATTTTAAG
TGTCAATTGAGCTCAAAGCCTGGATTAACTTATGATTGCCACGTTGGAGTATTTTGTGTCCTTATTGACTGTGAAGGTT
GGCTGGAGGTGCCAAAATAAATC > SEQ ID NO:5009 168264FL 107760_300258_1d
ctttatcttgatgctgttgagtcccacaaaggacattgtcatgtatgtgaactccccaggagggtcagtaacggcAGGA
ATGGCCATATTTGATACCATGCGGCATATTCGGCCTGATGTCTCCACTGTCTGTGTTGGACTTGCTGCAAGTATGGGAG
CTTTTCTTCTCAGCGCGGGCACCAAAGGAAAGAGATACAGCTTGCCAAATTCAAGGATAATGATTCACCAGCCTCTTGG
TGGCGCTCAAGGTGGCCAAACTGATATAGATATACAGGCTAATGAAGTTGCATCACAAAGCTAACCTGAATGGGTAC
CTTGCCTACCACACTGGTCAAAGTCTTGAGAAGATTAACCAGGATACTGATCGTGATTTTTTCATGAGTGCAAAGGAAG
CTAAAGAGTATGGGCTAATTGATGGTGTCATCTTGAATCCCATGAAAGCCCTTCAACCTCTTGCAGCAGCTGCTGAACA
ATCATAGCTGAGTCAATTTTCTCCCAATCATTTTCCTCTCGCGCTTGGATGATGTTATTGATAGTCATGACTAGAGATT
GTAATTGATTACTGGGTTTTGGGTAGAATTATCATTCCTGCTGCCAGGAGCAATTGTACACGAACGTTTACAAGTTCAT
CAGAGGGAAGAGTAAAATGTATCTGACCTAATCCCATAAACGTTTTCGCAGGTCTTGATGTTTCTTTTAAAGATTACT
TTTTTACtttc > SEQ ID NO:5010 168264FL 260539_301715_1d
cacgcgtcgctcagaggatggctatggcgttcttgagtacgccagaaatcgttcacagtgggacgcaacttaaccagtg
gAGCAGCAGCAGCAGCAGCAGCAATAGCCTGGCGGCACTCCAGGGCAGCTCTTCCTCTTCCCATGCGACACGAATGCAGA
TCGAAGCGGCTATCGTGCGTTACCCGGGCGTCGAGAATGCAGCAGAATAGCATCTCCAGCGAGCGGTTTTGGTCTCCGG
ATGTGGCGATTCAAGATGGACTGTGGTCGATAAGGAGAGATTTGGAGGTTCCTCCCTCGGCTTATTTGGGAGGAACTTT
TACTGCCGGGCAAGGCCAAGGTCCGCCTCCCATGCTACAGGAGCGTTTCCAGAGCGTCATCAGCCAGCTTTTCCAGCAC
AGGATAATTCGGTGCGGTGGAGCAGTGGACGACGATATGGCCAATCTCATCGTAGCGCAGCTTCTGTATCTTGATGCTG
CTGATCCAAAGAAGGATATTGTGATGTACGTGAACTCCCCTGGAGGCTCTGTTACCGCTGGAATGGCCgTGTTTGACAC
TATGAGGCACATTCGTCCGAATGTGAGCACTGTCTGTGTTGGACTTGCCGCAAGTATGGGTGCTTTTCTTCTCAGTGCA
GGCACGAAAGGAAAGCgttacAGCTTGCCAAACTCCAGAAtTATGATCCATCAGCCTCTCGGtggCGCtcaag > SEQ ID NO:5011 168264FL 25018_301000_1d
TTTTTTTTTTCAGCACAGTAAGAAACTTTACTTTGGTCTTCATGTATGTATCAACTACAGAGTTTGATCCCAAACAAAT
CTGATTTTCCTTGTAGAATAGAAACATATTTCATGGAAAATCTCAGTTCATCAAAGGCCCAAAAAAGAACAAGTGCTAA
AGCTGAACCACTACCTTTAGGCGATTAAGCTGCTGCAAGTGGCTGGAGAGCTTTAAGAGGGTTCATGATAACACCGTCG
ATAAGTCCATACTCTTTTGCTTCTTTGGCACTCATGAAGAAATCACGGTCTGTGTCCTGGTTTATCTTCTCCAGGCTTT
GACCAGTGTGGTATGCGAGGTAACCGTTTAGGTTTGCCTTGTGATGCAGCATTTCATTTGCCTGAATGTCAATGTCGGT
TTGGCCACCTTGAGCTCCACCAAGCGTCTGATGGATCATTATCCTTGAGTTTGGTAGACTGTATCTTTTTCCTTTGGTT
CCAGCACTAAGCAGAAAAGCTCCCATACTAGCAGCTAGACCAACACAAACAGTGGACACATCAGGCCGGATGTGCCTCA
TAGTATCGAATATAGCCATGCCAGCTGTAACTGATCCACCAGG > SEQ ID NO:5012 168264FL 249294_301590_1d
GTTTAGGGCTCTTGCCCTAGAGCTATGGCGACATGGACGTTGCCGCATTCTTCGCCTTCTCCGCCGCGCGGGCCGGTCC
```

ATCGCGTCGATCTCAAGAACAAGGTACATAGAGTAGGCGCTGCTGCTCGCGGCAGGGGCCCGATTCTGGGGAAATCGAG
GCTTCTTTGCGAGAACTGGGGAGTTGGAAGCTCTAGCCCTGATTCGCAGCCGCCAGAAGGTCGATCGTTCCTCTTGGAT
CCAGCGGGGGTCCTACTACAGCAGCGCATTGTGTTCCTTGGATCGCAGGTTGACGATGTGTCGGCGGACCTTATCATCA
GTCAGCTTCTTCTTCTCGACGCCAGAGATTCATCAAAGGATATAAAAATGTTTATCAACTCGCCTGGTGGCTCTGTTTC
AGCTGGGATGGGAATTTATGATGCTATGAAGCTGTGCCGAGCGGATGTATCAACTATTTGCTTCGGCCTCGCAGCGTCG
ATGGGGGCTTTCTTGCTGGCTTCTGGAACAAAAGGGAAGAGATACTGCATGCCAAATTCTCGTGTCATGATCCATCAAC
CTTTGGGAGGCGCTGGTGGTGCGGCGATT

> SEQ ID NO:5013 168264FL 241495_301348_1d
GCTGCCGGCAATGATGAATGCCACGGCGTCATCGTCTCCTCGCTGCTTCAATCCAAGTGACAAATCGTCAGCGGCGTGG
AGCATCTCGCGGCGCCACCACCAATCTGGGCTTGGCATCGGGAGGCTGGGGCGGCGGGGGATTTGCCGAGCACAAGTGG
TGATGATGCCCATCGGCACCCCCAAAGTTCCCTATAGAACACCCGGCGAGGGGACTTGGCAATTCGTGGATATCTGGAA
TGTGCTGTACCGAGAGAGAATAATTTTTATGGGGCAGCACATTGACGAAGAGTTTGGCAATCAAGTTCTCGCGACCATG
CTCTACTTGGACAGTGTTGATTCCAGCAAAGACCTCCACTTTTACATGAGTTGTCCTGGTGGTGATTTAACTCCTTCCA
TGGCTATTTACGATACAATGGGAAGCATTAAAAGCCGGATGGGAACCATGGCAATGGGTTATGCGTATAACATCGCTGG
CTTCTTGCTTGCAGCTGGAGACAAGGGCATGCGAAGCTCCATGCCTCTCACGAGAATTGCCATACAACCTCCTCAAGGA
GCCGCTCGCGGAAAGGCGGACGACATACAAAACGAGGCTAAAGAACTTTCTCGTGTTCGTGACTATCTG

> SEQ ID NO:5014 168264FL 237641_301289_1d
CTTGGCGCCCGGCAAGAACCATGGCTGGCATGGATTCCAGAGCTCGAGGTCAGGCATCGCGAGGTTCCGGCGGAGAGAA
TGCGCGATCCATGGCGGCGGCGGCGGCGGCGTCTCAATATCGCCGCCATCGCCGGCTCTTTCCCATCCGTTCGTGA
TGCCTAGAATGCGAGGGTTTGATCTTCCATTCGTCGAGTGGTGAGGGGAGGCAGGGCAGTGAGGAGAATACGATCAGGG
CGGCGAAGAAGGGGTCGCCGCCGCTGGCCCCGGTGGTGATCACGCCGGCTGGGGTGTCGGACCTTACCAGCCTCATGTT
TCGCAATAGGATCATCTTCATTGGCCAGCCTATCAATTCGCAAGTGGCACAGCGAGTTATCTCCCAGCCTCGTAAGCCTT
GCTGCCGTCGACGAGAACAAAGATATACAAATTTATATCAATTGTCCTGGAGGAAGCACGTACTCAGTGTTTGCCATTG
ACGATTGCATGTCATGGATTAAGCCAAGAATCAGCACTGTATGCTTTGGCATGGCGGCGAGCCAAGGAGCTTTGATTCT
AGCCGGTGGAACGAAAGGTCTTCGTTTCGCGATGCCGAACTCTAGAGTGATGATCCATCAACCTCAAGGAGGCTGTGGT
GGGACCATGGAGGACGTGAGGAGACAAGTGAACGAAGTCGTACAATCAAGAAACAAAATCGAT

> SEQ ID NO:5015 168264FL 127672_300471_1d
ccccgagtttcttatcccgttttttttaccagggtgctcgtgggataactcttaaatCCGCCGGCGAACACTCTCCCTCT
AGTATTCCGTCACTGAATCTCGCCGGAGCAATAAAATGGTAGCGTCTTCCATCACCGGAACGTCAATTATTCCTGCCTC
TTTCCGGAAGCAAACGTCTTCTTCGTCTTTGTTTTCTTCTAGAACAAATCAATACCAGTTACTTTTCTGCAGAAGCTTA
ACGAAGCGGGTAGTTTCTGTTCTCCGAAGTCCGTATTCTGATTCATCAGCTATTGGATTGTCTCACAAGACTCTGAAAA
CCCCGTTAAAGCTCAATGAGCACGAATCCAGCGGTCTTACCAATTCAAGCTTTGGTGTTATCGAAGCAAAAAAGGGGAA
TCCACCCGTCATGCCTGCTGTGATGACACCAGGGGGGCCTTTGGATCTCTCTACTGTGTTATTCAGGAATCGAATTATC
TTCATTGGACAACCAATCAACTCCGCAGTTGCTCAGAGAGTTATATCACAACTTGTGACCCTCGCAACTATCGATGAAA
ATGCAGATATTTTGATCTATCTTAATTGTCCTGGTGGAAGTACCTATTCTGTCTTGGCAATATATGACTGCATGTCATG
GATAAAGCCTaaggtTGGTACAGTATGTTTCGGAGTAGCTGCAAGCcaaggaGcActtCtttCttGccggtgGagaa > SEQ ID NO:5016 168264FL 127647_300471_1d
TAAAAGCAAAGAGAAAGAAGGAACAGCTTAGATGGAGGGAGGTTGTCTAACATTCACCACAGCACCAACAAGACCTTCA
ACCTTATTCAATTACAATCCCACAATTACCAAACAATTTTACAGCAATTCACTACCTAATACTATTACAAATGATAAAC
GAAGAAGAGGATTGTCAATAAAAGCATCGACCCACAACTTTTCTACAGCGAAACCGACGCTATCTCGGAACTGGGATGT
TTCCAGTTACTCAAAAGCACCTGCTTGGTTGCCCAGATTTGAAGAACTTGATACTACCAATATGCTTCTTCGTCAAAGG
ATTATCTTCTTGGGTTCTCAGGTAGATGATATGACTGCAGATTTTGTTATAAGCCAGCTATTATTTCTTGATGCCAAAG
ATCAGAAAAGGACATCAGATTGATCATTAATTCACCTGGTGGTTCAGTAACTGCTGGGATGGGAATCTATGATGCTAT
GAAAATGTGCAAGGCTGATGTTTCTACAATCTGCATGGGACTGGCTGCATCGATGGGTGCGTTTCTCCTCGCATCTGGC
AGCAAGGGAAAGAGGTACTGCATGCCGAACGCAAGGGTGATGATTCATCAACCACTTGGAACTTCtGgtgGTAAAGCAA
CAGAGATGAGTATACGGAtcagagaaatggcATACCACaagattaagctTAa > SEQ ID NO:5017 168264FL 1174115_302092_1d
GATATGGCAAATTTGATAGTTGCTCAACTGCTTTATCTCTATTTGGATCGAGAGCATCAAGATAAAGATATTGTTATGT
ACGTGAACTCTCCTGGAGGTTCTGTCACTGCTGGAATGGCCATCTTTGACACCATGAGGCATATACGGCCGAATGTTAG
CACTGTCTGTGTAGGTTTAGCTGCAAGTATGGGGTGCATTTATTCTTAGCGGAGGTACCAAAGGGAAAAGATACAGCCTT
CCGAACTCAAGAATAATGATTCACCAGCCTCTTGGAGGAGCCCAGGGTCAGCAGACTGATGTTGAAATTCAGGCCAATG
AGATTCTGCATCATAAAGCAAATNTGAATGCGTATCTTGCCTATCATACAGGCCAATCACTGGACAAAATAGTGCAAGA
CACGGACA

FIG. 2 continued

> SEQ ID NO:5018 182081FL 1101224_301474_1d
cctctcccattcgtggattggctctTGCAGAAGAAGGGTTTCGAGGTTTCTTGGCCAGTCTATATTCTGGCAAGCGGTT
GTGAAGGTGGGCATTGCTGTCTCTGAAGGGTCTTTACATCATCATCAGGGTAGGTAACAATGTCAGGAGCAGGGCAACG
TCTAAATGTAGTCCCGACAGTAACAGTTCTAGGTGTGATTAAAACTCGTTTGGTGGGTGCAACGAAGGGGCATCAGCTA
CTAAAGAAGAAGAGCGATGCATTAACAGTACAGTTCCGTCAAATCCTAAGGCACATCGTACAGACTAAAGAGGCCATGG
GGGACTCTATGAAGCCGCTGCTTTTGCCCTCACAGAGGCCAAATACACCGCTGGCGACAACATCAAACACGTTGTCCT
TGAAAATGTTGACTCCGCCACAGTCAAAGTCCGGTCAAAGCAGGACAATGTGGCAGGAGTCAAACTTCCCCGTTTTGAG
TTCGTGACAGAGGCAGGGGAGTCAAAGAATGATTTGACTGGTCTTGCTCGAGGAGGTCAGCAGATCCACCTCTGTAAAT
CGGCGTTTATCAAATCAGTTGAGGTTCTTGTTGAGTTGGCCTCTCTGCAGACATCGTTTCTTACCCTTGATGTGGCCAT
TAagaccACTAACCGGAGGGTCAACGCTTTAgaGaATGTGGTCaaacccAAGTTGGaGaacaccATAAGCtaCAT > SEQ ID NO:5019 182081FL 56186_300140_1d
CTTACACTCTAATTTCAGTGATTTACTTGTTAATAACTCACCTTTTGAGAGGCCCAGTGGTGATATATGGCTGGCCAAA
ATGCGCGTCAGAATGTGGTTCCCACTGTTACTATGCTCGAGGTTATGAAAGCTCGTCTTGGTGGCGCTACAAGAGGCCA
TGCTCTCCTCAAGAAAAGAGAGATGCTTTAACTGTTCAGGTTAGGGCACTTCTCAAGAAAATCGACACAGCTAAGGAG
TCTATGGGAGATATGATGAAGACATCGTCTTTTGCTCTTACCGA > SEQ ID NO:5020 182081FL 268244_200176_1d
tgcaattcgatcttagccccgagaattttgttcttggcacagttgacccAACTCTTTTCTTCTGCTGAGATATCTGAAT
AATCTCCTGATCTCTTTCTTCTCCGTGCGAAATCTAGTTTTTAAGTAGCTTAGCAAAATGTCCGGGCAAAGTCAGCGTT
TGAATGTTGTACCCACAGTTACGATGCTGGGAGTTATTAAAGCTCGCCTTGTTGGAGCAACAAGAGGCCATGCTTTGCT
GAAAAAAAAAGTGATGCTTTGACTGTGCAATTCCGTCAGATTCTAAAGAATATAGTGTCAACAAAGGAATCAATGGGA
GAAGTCATGAAAGATTCCTCCTTTGCTCTGACTGAGGCAAAATATGCTGCTGGTGAGAACATCAAGCACGTTGTCCTTG
AAAATGTCCAGAATGCAACTCTTAAAGTTCGATCTCGGCAGGAAAATATTGCTGGGGTGAAGCTCCCCAAGTTTGAACA
TTTCTCTGAAGGGGAGACCAAGAATGACCTGACTGGATTAGCTAGAGGGGGCAACAGGTACAAGCCTGTCGTGCTGCT
TATGTGAAATCTATTGAGTTACTTGTTGAGCTTGCATCGCTGCAAACATCATTCTTGACTCTTGATGAGGCAATCAAGa
CCACAAATCGGAGGGTCAATGCCTTggagaatGttGTAAAGcctcggCtggagaataCagttCtTTAcatcaaggggA
ACTtGATg > SEQ ID NO:5021 182081FL 258721_301699_1d
GAGAAGCCGTCTTTCCGACGCGAATGACCTTGGGTATGATGAAGGGAAAGCTCAAGGGAGCTACCCAGGGTCACAACCT
GCTGAAGCGAAAGTCCGAGGCCCTGACCAAGCGGGTCAGAGACATTACACGAAAGATTGACGAATCGAAGCACAAAATG
GGCAGAGTTATGCAGACCGGAGCCTTCTCTCTCGCTGAGGTCACCTACGCTACCGGGGACAACATCAACTACCAAGTGC
AGGAGTCCGGCCGATCCGGTCGTCTGGGTGTGCGTGGCAAGGAAAAAAACGTCTCCGGTGTCCAGTTGGCCTCCTTTTC
TTCTTACTACGTCGAGGAGAACTCCGACTTCTCTCACCGGTCTTGGTCGAG > SEQ ID NO:5022 182081FL 254033_301631_1d
TCTCCTCTCCCATTCGTGGATTGGCTCTTGGAGAAGAAGGGTTTCGAGGTTTCTTGGCCAGTCTATATTCTGGCAAGCG
GTTGTGAAGGTGGGCATTGCTGTCTCTGAAGGGTCTTTACATCATCATCAGGGTAGGTAACAATGTCAGGAGCAGGGCA
ACGTCTAAATGTAGTCCCGACAGTAACAGTTCTAGGTGTGATTAAAACTCGTTTGGTGGGTGCAACGAAGGGGCATCAG
CTACTAAAGAAGAAGAGCGATGCATTAACAGTACAGTTCCGTCAAATCCTAAGGCACATCGTACAGACTAAAGAGGCCA
TGGGGGACTCTATGAAGCCGCTGCTTTTGCCCTCACAGAGGCCAAATACACCGCTGGCGACAACATCAAACACGTTGT
CCTTGAAAATGTTGACTCCGCCACAGTCAAAGTCCGGTCAAAGCAGGACAACGTGGCAGGAGTCAAACTTCCCCGTTTT
GAGTTCGTGACAGAGGCAGGGGAGTCAAAGAATGATTTGACTGGTCTTGCTCGAGGAGGTCAGCAGATCCACCTCTGTA
AATCGGCGTTTATCAAATCAGTTGAGGTTCTTGTTGAGTTGGCCTCTCTGCAGACATCGTTTCTTACCCTTGATGTGGC
CATTAAGACCACTAACCGGAGGGTCAACGCTTTAGAGAATGTGGTCAAACCCAAGTTGGAGAACACCATAAG > SEQ ID NO:5023 182081FL 181992_300658_1d
gaattccgaattcagtcatttctcgctcgctctcttgtttcgtaaaaattttctatcttgaattaagatctggggatg
gCGGGACAAAATCAAAGATTAACAGTAGTACCAACAGTCACAATGCTTGGAGTAATGAAAGCACGTTTAATAGGAGCAA
CAAGAGGTCATGCTTTACTTAAGAAGAAATCTGATGCATTAACTGTTCAATTTCGTCAGATCTTAAAAAACATTGTTTC
AGCTAAAGAATCAATGGGTGATATTATGAAAACTTCATCATTTGCTTTGACTGAAGCTAAATATGTAGCTGGTGAGAAT
ATTAAACATACTGTTCTTGAAAATGTTCATAACGCTTCGTTAAAGGTGAGATCGCGTACTGAGAATGTTGCTGGAGTTA
AATTACCCAAGTTTGAGTATTTCACTGAAGGTGAAACTAAGAATGATTTGACTGGATTAGCACGAGGTGGACAACAGGT
GCAACTTTGTAAGGCTGCTTATGTCAAAGCAATTGAAGTTCTTGTTGAACTTGCTTCGCTTCAAACGTCTTTTTTGACT
CTTGATGAAGCAATTAAGACTACTAATCGCCGTGTTAATGCTCTAgaGAATGTTGTGAAGCCTaggATTGAGAATACTA
TTAGTTATATCAAGGGTGAATTGGATGAACTTGAAgagaggATTTCTTtaggtTGAAgaagaTtcaagggTATAAAAg

FIG. 2 continued gagagagaTGGa

> SEQ ID NO:5024 182081FL 232517_301216_1d
AAAGAGGAGGAGAGAGATCCGGCGATGTCGGGGCAGCAGCAGCGCCTCAATGTGGTGCCGACGGTCACGGTGTTGGGCG
CGATCAAGGCGCGGCTGATCGGCGCCACGAAAGGTCACCAGCTCCTCAAGAAGAAGAGCGATGCCCTGACGATGCAGTT
CCGGCAGATCCTCAAGCGCATCGTCCAGACCAAGGAAGCGATGGGCGACACCATGAAGTCGGCATCGTTCGCCCTCACA
GAGGTAAAGTATACAGCCGGCGACAGCATCAAGCACATAGTTCTAGAGAATGTGGACGTGGCGACGATCAAGGTACGAG
CAAAGCAAGACAATGTAGCCGGTGTCAAGCTTCCAAAATTCGAGCACTACGTCGAGGCCGTGGGAGACGAAGAACGATCT
AACCGGCTTGGCCAGAGGTGGCCGACAGGTCCAGCTCTGTAAGTCGTCGTTCATCAAGGCGGTGGAGCTGCTGGTGGAG
CTGGCGTCGCTGCAGACATCTTTCCTGACGCTGGACGAGGCGATCAAGACGACCAACCGGAGAGTGAACGCTCTGGAGA
ACGTCGTCAAGCCGAGGATCGAGAACACCATTCTCTACATCAAGGGCGAGCTGGACGAGCTCGAGAGAGAAGAGTTCTT
CCGGCTGAAGAAGATCCAGGGATTCAAGAAGAAGGAGGTCgagag > SEQ ID NO:5025 182081FL 207483_300805_1d
CTCGATGAGGCCATCAAGACCACCAACCGGCGTGTCAACGCGCTGGAGAACGTCGTGAAGCCGAGGCTGGAGAACACCA
TCAGCTACATCAAGGGGGAGCTGGACGAGCTCGAGCGTGAGGACTTCTTCAGGCTCAAGAAGATCCAGGGTTACAAGAA
GAGGGAGATCGAGAGGCAGATGGCTGCAGCCAAGCAATTCGCAGAGGAACAGCTTGCGGAGGAGGTTGCCCTCAAGAGG
GGTATCTCTGTGGGTGCTGCCACCAACATGTTGGTTGCCGGTGGAGAGAGGGACGAACACATCATCTTCTGATCATCTT
CGGTCATACAGTGATTCAATCGTGGTGGAAATAATAAGTTGTGATGCTGGAGCTCCAGAATCGCACCTGTTTATAGAGT
GGCGGACGTTTTGTTTCAGGCGGGAGTCTGGACTCTGTTCATCCAAAAGACCACAAATAATTTGGACTTGGAACCAACC
AACGGAT > SEQ ID NO:5026 182081FL 126602_300465_1d
gccattacggccggggagttcgaactcggacagatattgggattcgattttcgacccgagagttttGTTCTTGGCACAG
TTGACCCAACTCTCTTCTTCTGCCGAGTTTATCTAATCAATCTCCTCCTGATCTCCTTCTTCTCCCTTAGTAGTTTAGC
AAAATGTCCGGGCAAAGTCAGCGTTTGAATGTTGTACCCACAGTTACGATGCTGGGGGTTATTAAAGCTCGCCTTGTTG
GAGCAACAAGAGGCCATGCTTTGCTGAAAAAGAAAAGTGATGCTTTGACTGTGCAATTCCGTCAGATTCTAAAGAATAT
AGTGTCAACAAAGGAATCAATGGGAGAAGTCATGAAAGACTCCTCCTTTGCTCTGACTGAGGCAAAATATGCTGCTGGT
GAGAACATCAAGCACGTTGTCCTTGAAAATGTCCAGAATGCAACTCTTAAAGTTCGATCTCGGCAGGAAAATATTGCTG
GGGTGAAGCTTCCCAAGTTTGAACATTTCTCTGAAGGGGAGACCAAGAATGACCTGACTGGATTAGCTAGAGGTGGGCA
ACAGGTACAAGCCTGTCGTGCTGCTTATGTGAAATCTATTGAGTTACTTGTTGAGCTTGCATCGCTGCAAACATCATTC
TTGACTCTTGAtgaggcaATCAAGaCcacAAATCggagggtCAATGCCTTggagaatgttgtaaAGcctcggCT > SEQ ID NO:5027 182081FL 125225_300629_1d
ggcccacgcgtccgttaaaggcaacgttgatagttgaccccactcccccgcaagcgcctctcccatCTGATTCGTGTCT
GAAATCCTCGCTATCTTTCTCTCCCATTCTGACGAATTCGACTTCTAAAGTAGCTAAGCAAAATGTCCGGGCAAAGCCA
GCGTTTGAATGTCGTTCCTACAGTTACAATGCTTGGTGTGATCAAAGCTCGCCTTGTTGGTGCTACAAGAGGCCATGCT
CTGCTCAAGAAGAAGAGTCGATGCTTTGACTGTGCAGTTCCGTCAGATTCTAAAGGACATTGTGTCAACGAAGGAATCAA
TGGGAGATGTCATGAAAACTTCCTCCTTCGCTCTGACAGAGGCAAAATATGCTTCTGGCGAGAACATTAAGCATGTTGT
CCTTGAAAATGTCCAGAATGCAACCATCAAAGTTCGATCTCGCCAAGACAATATTGCGGGTGTAAAGCTCCCTAAATTC
GAGCATTTCGCTGAAGGAGAGACAAAGAATGACCTGACTGGATTAGCTAGAGGGGGCAACAGGTGCAAGCTTGCCGTG
CTGCTTACGTGAAATCTATTGAGTTGCTTGTTGAGCTTGCCTCTCTACAGACATCATTCTTGACGCTTGATGAGGCGAT
CAAGACCACAAATCGGAGGGTTAATGCATTGGAGAATGTTGTGAAGCCACGGTTGGAGAACACAGTGCTTTACATCAAA
GGAGAACTTGATGAACTGGAAAGGGAAATTCTTTCGTCTAAAGAAGATACAAGGTTACAAGAAGAGGGAGGTAGAGA
GACAGATGCTGGCTTCCAAGCAATACGCAGAGGAAAAGGCTGCAGAAGAAATTTCCTTGAAGAGAGGTATTTCGCTAGG
TACAGCCCATAACTTGCTATCCCATGCTTCACAGAAAGACGAGGACATTATTTTCTGATAAGGAGGTCAAATGATTTAT
TTAAATTGCATTGTGTGGCTTGTCTTTTCTTGTCCTTCATTACAAATGGAAAATTGATTagATGGAGAGTCTTTTCGTA
TTTAATAAGAGCTCTATGCATATTTGTATTTAAAAGTTAATTTATGGACAATATGGGGGGTTACCTTGTtAAAAAAAAA
atgacaAAAAAaaattact > SEQ ID NO:5028 182229FL 104802_300366_1d
CCCGCTCTTGAAAGCAAAGGTCAAGGGTAGCAATAGCTTTAAGCTTAGAAATTATTTTCAGAAATGGCTTCCTCAGTTA
TGTCCTCAGCAGCTGCTGTTGCGACCGGCGCCAATGCTGCTCAAGCCAACATGGTTGCACCCTTCACTGGCCTCAAGTC
CGCCTCCTCCTTCCCTGTTACCAGGAAACAAAACCTTGACATTACCTCCATTGCTAGCAATGGTGGAAGAGTTCAATGC
ATGCAGGTGTGGCCACCAATTAACATGAAGAAGTACGAGACACTCTCATACCTTCCTGATTTGAGCCAGGAGCAATTGC
TTAGTGAAGTTGAGTACCTTTTGAAAAATGGATGGGTTCCTTGCTTGGAATTCGAGACTGAGCGTGGATTCGTCTACCG
TGAACACCACAACTCACCAGGATACTACGATGGCAGATACTGGACCATGTGGAAGTTGCCCATGTTCGGGTGCACTGAT
GCCACTCAGGTGTTGGCTGAGGTCGAGGAGGCAAAGAAGGCTTACCCACAAGCCTGGGTTAGAATCATTGGATTCGACA

FIG. 2 continued

ACGTCCGTCAAGTGCAATGCATCAGTTTTATCGCCTCCAAGCCAGAAGGCTACTAAAATCTCCATTTTTAAGGCAACTT
ATCGTATGTGTTCCCCGGAGAAACTGTTTTGGTTTTCCTGCTTCATTATATTATTCAATGTATGTTTTTGAATTCCAAT
CAAGGTTATGAGAACTAATAATGACATTTAATTTGTCTTTGgt

> SEQ ID NO:5029 182229FL 141829_300429_1d
ccgctcAAGCCACTGCTGCAGCGTGACTCTGCTCTAGCACCTCACCAAGCAGAAAGCTAGAGAGCTAGCAATGGCGCCC
ACCGTGATGGCCTCGTCGGCCACCTCCGTTGCTCCCTTCCAGGGGCTCAAATCCACCGCCGGGCTCCCCGTCAGCCGCC
GCTCCAACAGCGCCGGCCTCGGCAGCGTCAGCAACGGTGGAAGGATCAGCTGTATGCAGGTGTGGCCGATTGAAGGCAT
CAAGAAGTTTGAGACCCTGTCGTACCTGCCACCGCTCACGGTCGAGGACCTCTTGAAGCAGATCGAGTACCTGCTCCGG
TCCAAATGGGTGCCTTGCCTCGAGTTTAGTAAGGTCGGGTTCGTCTACCGTGAGAACCACAGGTCTCCTGGGTACTATG
ATGGCAGGTACTGGACCATGTGGAAGCTGCCTATGTTCGGATGCACTGATGCCACCCAGGTGCTCAAGGAGCTCGAGGA
GGCCAAGAAGGCATATCCAGATGCATTTGTTCGCATCATCGGCTTCGACAACGTCAGGCAGGTGCAGTTGATTAGCTTC
ATCGCCTACAAGCCCCCGGGTTGCGAGGAGTCCGGCGGAAACTAAGCTAGTTGGCAAGCCAGCAAGCTCACTCGTGAGC
TCTATACAGAGGAGACTCGATTGATCTATTCGGTTTTGGcagctttGaacgttC > SEQ ID NO:5030 182229FL 130748_300490_1d
gaattcaagcaatgacggtatctggggaacaacaggtggaaacggctgctaataccccgtaggctgaggagcaaaaGGA
AGACATTGTCAGGTGGGGAGTTTGGCTGGGGCGGCACATCTGTTAAAAGATAACGCAGGTGTCCTAAGATGAGCTCAAC
GAGAACAGAAATCTCGTGTGGAACAAAAGGGTAAAAGCTCGTTTGAAAGAGTTAACTGCATGCAGGTATGGCCACCAAG
TGGTTTGAAGAAGTTTGAGACCCTCTCATACCTTCCTCCATTGACCGTCGAGCAACTATCAAAGGAAGTTGACTACCTT
CTCCGTAATGGCTGGGTTCCCTGTTTGGAATTCGACGCCAGAGGATTCGTCTACAGAGAACACGGTAACACCCCTGGAT
ACTACGATGGTCGTTACTGGACAATGTGGAAGCTACCCATGCTTCGGTTGTACCGATGCTTCCCAGGTTATCAAGGAGCT
AGAAGAGGCCAAGGCTGCATACCCTGACTCTTTCATCAGAATCATCGGATTCGACAACGTTCGTCAAGTCCAATGTGTT
AGTTTCATTGCATACAAgccctgagAGTTcagcctActggagaTGTTTAATTTGATGGATTagtagcggtGCACAgagC
aAAATCCTATCCATATA > SEQ ID NO:5031 182229FL 191373_300740_1d
ccccggcCTCAACAGCACTGCTACTGGACATACTCTACTACTACTAGCCAGTAAGCTAGCTAACTAACTACGTGGCTAT
GGCCCCCACCGTGATGGCCTCCTCGGCCACCTCCGTGGCTCCATTCCAAGGGCTCAAGTCCACCGCCGGCCTCCCCGTC
AGCCGCCGCTCCACCAACTCGGGCTTCGGCAACGTCAGCAATGGCGGAAGGATCAAGTGCATGCAGGTGTGGCCAATTG
AGGGCATCAAGAAGTTCGAGACCCTATCGTACCTGCCACCACTCACCGTGGAGGATCTTTTGAAGCAGATCGAGTACCT
GCTTCGATCCAAGTGGGTGCCTTGTCTCGAGTTCAGCAAGGTTGGGTTCGTCTACCGTGAGAACCACAGGTCTCCCGGA
TACTACGATGGCAGGTATTGGACCATGTGGAAGCTGCCCATGTTCGGCTGCACCGATGCCACCCAGGTGCTCAAGGAGC
TCGAGGAGGCCAAGAAGGCCTACCCTGATGCCTTTGTCCGTATCATCGGCTTCGACAACGTCAGGCAGGTGCAGTTGAT
TAGCTTCATCGCCTACAAGCCCCCAGGTTGCGAGGAGTCTGGTGGCAACTAAGCTAAGATCAAGCATCGCGCTGGTGGA
TTGCTGCCTATAATAATAGTATGCAGCTTTGTTTTGGGCTATGTTGATGATATATCAATATATAATATGCTATATATtT
TTATTTTaCAGTtTGGttATGtaccATCTCaa > SEQ ID NO:5032 182229FL 184657_300671_1d
gaattcaaaggaaaaaatggcttcttcagtgatttcctctgccgcagtcgcctccgtaaggagtgccgcccccgctcaA
GCTaGCATGGTTGCACCATTCAGTGGTTTGAAATCAGTTGCCGCTTTCCCTGTTACCCGCAAATCAAACGATATCACCT
CAGTTGCCAGCAACGGTGGAAGAGTTAACTGCATGCAGGTATGGCCACCATCCGGTTTGAagaagTTTgagacCCTCTC
ATACCTTCCTCCATTGACCGTGGAGCAATTATCAAAGGTaGTGACAATAAATAACAATACCGGGCTCTTCGAGTCTGGT
AATTggaattTGACGCCAGAggATTCGTGTACAGagaACACgGTAACAccCCTGGATACTATGATGGTCGTTACTGGAC
AatgtggaaGttAcccATGttCgGTTgta > SEQ ID NO:5033 182229FL 181705_300627_1d
gaattcAAGTATGAACTAATTCAGACTGTGAAACTGCgaatGGCTCATTAAATCAGTTATAGTTTGTTTGATGGTACTT
GCTACTCGGATAACCGTAGTAATTCTAGAGCTAATACGTGCAACAAACCCCGACTTCTGGAAGGGATGCATTTATTAGA
TAAAAGGTCGACGCGGGCTTTGCCCGTTGCTCAGATGATTCATGATAACTTGACGGATCGCACGGCCTTTGTGCTGGCG
ACGCATCATTCAAATTTCTGCCCTATCAACTTTCGATGGTAGGATAGTGGCCTACTATGGTGGTGACGGGTGACGGAGA
ATTAGGGTTCGATTCCGGAGAGGGAGCCTGAGAAACGGCTACCACATCCAAGGAAGGCAGCAGGCGCGCAAATTACCCA
ATCCTAACACGGGGAGGTAGTGACAATAAATAACAATACCGGGCTCTTCGAGTCTGGTAATTGGAAAGAGGATTCGTCT
ACAGAGAACACGGTAACACCCCCGGATACTACGATGGTCGTtaCTGGACAATGTGGAAGCTacCCATGTTCGGTTGTAC
CGATGCTTccCAGGTTATCAAggagCT > SEQ ID NO:5034 182229FL 181150_300654_1d
gaattcAAgaaGACCCTGTTGAGCTTGACTCTattCCGACTTTGTGAAATGACTTGAGAGGTGTAGGATAAGTGGGAGC

FIG. 2 continued

CGTCTTTGGCGGCGAAGGTGAAATACCACTACTTTTAACGTTATTTTACTTATTCCGTGAGGCGGAAGCGGGGCATCGC
CCCTCTTTTTAGATCCAAGGCTAGCTTGCTATGCCGATCCGGGCGGAAGACATTGTCAGGTGGGGAGTTTGGCTGGGGC
GGCACATCTGTTAAAAGATAACGCAGGTGTCCTAAGATGAGCTCAACGAGAACAGAAATCTCGTGTGGAACAAAAGGGT
AAAAGCTCAAGCTAGCATGGTTGCACCATTCAGCGGCTTGAAATCCGTTGCTGCATTCCCAGTTACCCGAAAATCAAAC
GACATCACCTCCGTTGCCAGCAATGGTGGAAGAGTTAACTGCATGCAGGTATGGCCACCAAGTGGTTTGAAGAAGTTTG
AGACCCTCTCATACCTTCCTCCATTGACCGTCGAGCAACTATCaaaggaa > SEQ ID NO:5035 182229FL 171765_300536_1d
ctctaCTACTACTAGCCAGTAAGCTAGCTAACTAACTACGTGCTATGGCCCCCACCGTGATGGCCTCCTCGGCCACCTC
CGTGGCTCCATTCCAAGGGCTCAAGTCCACCGCCGGCCTCCCCGTCAGCCGCCGCTCCACCAACTCGGGCTTCGGCAAC
GTCAGCAATGGCGGAAGGATCAAGTGCATGCAGGTGTGGCCAATTGAGGGCATCAAGAAGTTCGAGACCCTATCGTACC
TGCCACCACTCACCGTGGAGGATCTTTTGAAGCAGATCGAGTACCTGCTTCGATCCAAGTGGGTGCCTTGTCTCGAGTT
CAGCAAGGTTGGGTTCGTCTACCGTGAGAACCACAGGTCTCCCGGATACTACGATGGCAGGTATTGGACCATGTGGAAG
CTGCCCATGTTCGGCTGCACCGATGCCACCCAGGTGCTCAAGGAGCTCGAGGAGGCCAAGAAGGCCTACCCCGATGCCT
TTGTCCGTATCATCGGCTTCGACAACGTCAGGCAGGTGCAGTTGATTAGCTTCATCGCCTACAAGCCCCCAGGTTGCGA
GGAGTCTGGTGGCAACTAAGCTAAGATCAAGCATCGCGCTGGTGGATTGCTGCCTATAATAATAGTATGCAGCTTTGTT
TTGGGCTATATTGATGATATATCAATATATAATATGCTATATATTTTTATTTTACAGTttggttATGTACCATctcaAT
GgcctcTGCTCttAACACATATGtaatAATCTCttCCCtccctCTCCGAccgggttttAttGTaaGAGTACTACaattaT
cgttGGgtgaggaTATGt > SEQ ID NO:5036 182229FL 168174_300553_1d
gaattctaattaaaacaaagcattgcgatgggcccTGCGGATGCTAACGCAATGTGATTTCTGCCCAGTGCTCTGAATG
TCAAAGTGAataAATTCAACCAAGCGCGGGTAAACGGCGGGAGTAACTATGACTCTCTTAAGGTAGCCAAATGCCTCGT
CATCTAATTAGTGACGCGCATGAATGGATTAACGAGATTCCCACTGTCCCTGTCTACTATCCAGCGAAACCACAGCCAA
GGGAACGGGCTTGGCAGAATCAGCGGGGAAAGAAGaCCCTGTTGAGCTTGACTCTagTCCGACTTTGTGAAATGACTTG
AGaGGTgTAGGATAAGTGGGAGCCGTCTTTGGCGGCGAAggTGAAATACCACTACTTTTAACGTTATTTTACTTATTCC
gtgagGCGGAAGCGGGGCATCGCCCCTCTTTtatatcCAaggctagcTTGCTATGCCGATCCGTTgCTGCaTTCCCAG
TTACCCGAAAATCAAaCGACATCACCTccgTTGCCagCAATGgtgGAagagtTAACTgcatgcaggTAtggccacCAag
tgGTTTGa > SEQ ID NO:5037 182229FL 167866_300551_1d
gaattctGCCATGCATGTGTAAGTATGAActgatTCAGACTGTGAAACTGCGAATGGCTCATTAAATCAGTTATAGTTT
GTTTGATGGTACTTGCTACTCGGATAACCGTAGTAATTCTAGAGCTAATACGTGCAACAAACCCCGACTTCTGGAAGGG
ATGCATTTATTAGATAAAAGGTCGACGCGGGCTTTGCCCGTTGCTCAGATGATTCATGATAACTTGACGGATCGCACGG
CCTTTGTGCTGGCGACGCATCATTCAAATTTCTGCCCTATCAACTTTCGATGGTAGGATAGTGGCCTACTATGGTGGTG
ACGGGTGACGGAGAATTAGGGTTCGATTCCGGAGAGGGAGCCTGAGAAACGGCTACCACATCCAAGGAAGGCAGCAGGC
GCGCAAATTACCCAATCCTAACACGGGGAGGTAGTGGCAATAAATAACAATACCGGGCTCTTCGAGTCTGGTAATTGGA
ATGAGTACAATCTAAATCCCTTAACGAGGATCCATTGGAGGGCAAGTCTGGTGCCAGCAGCCGCGGTAACACCCCCGGA
TACTACGATGGTCGTTACTGGACAATGTGGAAGCTACCCATGTTCggttGTACCGACGCTTCcCAggttATc > SEQ ID NO:5038 182229FL 167835_300551_1d
aacaaagcattgcgatggtccctgcggatgctaacgcggtGTGATTTCTGCCCAGTGCTCTGAATGCCAAAGTGAAGAA
ATTCAACCAAGCGCGGGTAAACGGCGGGAGTAACTATGACTCTCTTAAGGTAGCCAAATGCCTCGTCATCTAATTAGTG
ACGCGCATGAATGGATTAACGAGATTCCCACTGTCCCTGTCTACTATCCAGCGAAACCACAGCCAAGGGAACGGGCTTG
GCAGAATCAGCGGGGAAAGAAGACCCTGTTGAGCTTGACTCTAGTCCGACTTTGTGAAATGACTTGAGAGGTGTAGGAT
AAGTGGGAGCCGTCTTTGGCGGCGAAGGTGAAATACCACTACTTTTAACGTTATTTTACTTATTCCGTGAGGCGGAAGC
GGGGCATCGCCCCTCTTTTTAGATCCAAGGCTAGCTTGCTATGCCGATCCGGGCGGAAGACATTGTCAGGTGGGGAGTT
TGGCTGGGGCGGCACATCTGTTAAAAGATAACGCAGGTGTCCTAAGATGAGCTCAACGAGAACAGAAATCTCGTGTGGA
ACAAAAGGGTAAAAGCTCGTTTGATTCTGATTTCCAGTACGAATACGAACCGCTCaAGCTAGCATGGTTGCACCATTCa
gcGGCTTGAAATccgTCTCTGCATTCcCagttaCCCGCAAATCAAACGACATCAcct > SEQ ID NO:5039 182229FL 167719_300550_1d
gaattcaaggtcgacgcggactttgcccgtgggtcagaTGATTCATGATAACTTgACGGATCGCACGGCCTTTGTGCTG
GCGACGCATCATTCAAATTTCTGCCCTATCAACTTTCGATGGTAGGATAGTGGCCTACTATGGTGGTGACGGGTGACGG
agaATTAGGGTTCGATTCCGGAGAGGGAGCCTGAGAAACGGCTACCACATCCAAGGAAGGCAGCAGGCGCGCAAATTAC
CCAATCCTAACACGGGGAGGTAGTGACAATAAATAACAATACCGGGCTCTTCGAGTCTGGTAATTGGAATGAGTACAAT
CTAAATCCCTTAACGAGGATCCATTGGAGGGCAAGTCTGGTGCCAGCAGCCGCGGTAATTCCAGCTCCAATAGCGTATA
TTTAAGTTGTTGCAGTTAAAAAGCTCGTAGTTGGACTTTGGGTTGGGTCGTCCGGTCCGCCCTTTGGGTGTGCACCGGT

FIG. 2 continued

CGTCTCGTCCCTTCTACCGGCGATGCGTTCCTAGCCTTAATTGGCCGGGTCGTGCCTCCGGTGCTGTTACTTTGAAGAA
AttataqTGCTCAAAGCAAGCCCAAGCTCTCCagcaACGgtgGAAgagTTAACTGCATGCAGGTATGGCCACCAagtGG
TTTgaacaagtgtgagAccCTCTCATaccTTCCTCCatcgaccgtcGagcaATtgTCAAAGgAaGt > SEQ ID NO:5040 182229FL 167675_300549_1d
GAATTCATGACCACCATCCGGTTTGAAGAAGGTTGACACCCTCTCATACTTTCCTGCATTGACCGCGGACTAATTATCA
AAGGAAGGTGACTACCTTCTCCGTAATGGATGGGTTCCCTGCCTGAAATTCGACGCCAGAAGATTACTGTACAGATAAC
ACAGCAACACCCCTGGATACTATGAGTGGTGCGGTACTGGACAATGCGGAAGTTACCCATGTTCGGGTGTACCGACTCT
TTCCACGTTATCAAGGAGCTACAAGAGGCCAAGGCTGCTTACCCACACTCATTCAT > SEQ ID NO:5041 182229FL 167344_300546_1d
gaattcaagtatgaactaattcagactgtgggacTGCGAATGGCTCATTAAATCAGTTATAGTTTGTTTGATGGTACTT
GCTACTCGGATAACCGTAGTAATTCTAGAGCTAATACGTGCAACAAACCCCGACTTCTGGAAGGGATGCATTTATTAGA
TAAAAGGTCGACGCGGGCTTTGCCCGTTGCTCAGATGATTCATGATAACTTGACGGATCGCACGGCCTTTGTGCTGGCG
ACGCATCATTCAAATTTCTGCCCTATCAACTTTCGATGGTAGGATAGTGGCCTACTATGGTGGTGACGGGTGACGGAGA
ATTAGGGTTCGATTCCGGAGAGGGAGCCTGAGAAACGGCTACCACATCCAAGGAAGGCAGCAGGCGCGCAAATTACCCA
ATCCTAACACGGGGAGGTAGTGACAATAAATAACAATACCGGGCTCTTCGAGTCTGGTAATTGGAAGAGTTAACTGCAT
GCAGGTATGGCCACCAAGTGGTTTGAAGAAGTTTGAGACCCTCTCATACCTTCCTcCATTGACCGTCGAGCAATTGTCA
aaggaagtCGACTAccttctccgtaatggATGGgTtccctgtTTGgaattcgacgCCa > SEQ ID NO:5042 182229FL 145962_200138_1d
atggcttccTCAGTTATGTCCTCAGCTGCCGCTGTTTCCACCGGCGCCAATGCTGTTCAAGCCAGCATGGTCGCACCCT
TCACTGGCCTCAAGGCCGCCTCCTCCTTCCCGGTTCCAGGAACAAAACCTTGACATTACTTCCATTGCTAGAAATGG
TGGAAGAGTCCAATGCATGCAGGTGTGGCCGCCAATTAACAAGAAGAAGTACGAGACACTCTCATACCTTCCTGATTTG
AGCGTGGAGCAATTGCTTAGCGAAATTGAGTACCTTTTGAAAAATGGATGGGTTCCTTGCTTGGAATTCGAGACTGAGC
ATGGATTCGTCTACCGTGAACACCACCACTCACCAGGATACTACGATGGCAGATACTGGACGATGTGGAAGTTGCCCAT
GTTCGGGTGCACCGATGCCACTCAGGTCTTGGCTGAGGTAGAGGAGGCCAAGAAGGCTTACCCACAAGCCTGGGTCAGA
ATCATTGGATTCGACAACGTCCGTCAAGTGCAATGCATCAGTTTCATCGCCTACAAGCCCGAAGGCTATTAAAATCTCC
ATTTTTAGGACAGCTTACCCTATGTATTCAGGGGAAGTTTGTTTGAATTCTCCTGGAGAAACTGTTTTGGTtttcCTTT
GTTTTAATCTTCTTTCTATTAT > SEQ ID NO:5043 182229FL 291735_200247_1d
ggTAAAGGAAAAAAAGGAAAAGAGAGAAAGAGAAATCTTTCTGTCTTAAGTGTAATTAACAATGGCTTCCTCAGTTCT
TTCCTCAGCAGCAGTTGCCACCCGCAGCAATGTTGCTCAAGCTAACATGGTTGCACCTTTCACTGGTCTTAAGTCAGCT
GCCTCGTTCCCTGTTTCAAGGAAGCAAAACCTTGACATCACTTCCATTGCCAGCAACGGCGGAAGAGTGCAATGCATGC
AGGTGTGGCCACCAATTAACAAGAAGAAGTACGAGACTCTCTCATACCTTCCTGATTTGAGCGTGGAGCAATTGCTTAG
CGAAATTGAGTACCTCTTGAAAAATGGATGGGTTCCTTGCTTGGAATTCGAGACTGAGCACGGATTTGTCTACCGTGAA
CACCACAAGTCACCGGGATACTATGACGGCAGATACTGGACCATGTGGAAGTTGCCTATGTTCGGATGCACTGATGCCA
CCCAAGTGTTGGCCGAGGTGGAAGAGGCGAAGAAGGCATACCCACAAGCCTGGATCCGTATTATTGGATTCGACAACGT
GCGTCAAGTGCAGTGCATCAGTTTCATTGCCTACAAGCCAGAAGGCTACTAAGTTTCATATTAGGACAACTTACCCTAT
TGTCCGACTTTAGGGGCAATTTGTTTGAAATGTTACTTGGCTTCTTTTTTTTTAATTTTCCCACAAAAACTGTTTATG
TTTCCTACTTTCTATTCGGTGTATg > SEQ ID NO:5044 182229FL 284226_200096_1d
cccccccgAATATTCAGCAATGGCTTCCTCAGTTATGTCCTCAGCTGCCGCTGTTGCCACCGGCGCCAATGCTGCTCA
AGCCAGTATGGTTGCACCTTTCACTGGCCTCAAGTCCGCAACCTCCTTCCCTGTTTCCAGAAAACAAAACCTTGACATT
ACTTCCATTGCTAGCAACGGCGGAAGAGTTCAATGCATGCAGGTGTGGCCACCAATTAACAAGAAGAAGTACGAGACAC
TCTCATACCTTCCCGATTTGAGCCAGGAGCAATTGCTTAGTGAAGTTGAGTACCTGTTGAAAAATGGATGGGTTCCTTG
CTTGGAATTCGAGACTGAGCGTGGATTCGTCTACCGTGAACACCACAGCTCACCAGGATATTATGATGGCAGATACTGG
ACCATGTGGAAGTTGCCCATGTTCGGGTGCACTGATGCCACTCAGGTGTTGGCTGAGGTCGAGGAGGCAAAGAAGGCTT
ACCCACAAGCCTGGGTTAGAATCATTGGATTCGACAATGTCCGTCAAGTGCAATGCATCAGTTTCATCGCCTACAAGCC
AGAAGGCTACTAGAATCTCCATTTTTAAGGCAACTTATCGTATGTGTTCCCCGGAGAAACTGTTTTGGTTTTTCCTGCT
TCATTATATTATTCAATGTATGTTTTTGAATTCCAATCAAGGTTATGAGAACTAATAATGACATTTAATTTGTTTCTTT
TCTaaTATATGCTTTTgtaacTTGt > SEQ ID NO:5045 182229FL 126182_300460_1d
ccCACGCGTCCGGCAAAAGCTAAATAATTAATTGCAACAATGGCTTCCTCTGTGATTTCCTCAGCTGCTGCCGTTGCCA
CCGGCGCTAATGCTGCTCAAGCCAGCATGGTTGCACCCTTCACTGGCCTCAAATCTGCTTCCTCCTTCCCTGTTACCAG

FIG. 2 continued

```
AAAACAAAACCTTGACATTACATCCATTGCTAGCAATGGTGGAAGAGTCCAATGCATGCAGGTGTGGCCACCAATTAAC
ATGAAGAAGTACGAGACACTCTCATACCTTCCTGATTTGAGCCAGGAGCAATTGCTTAGTGAAGTTGAGTATCTTTTGA
AAAATGGATGGGTTCCTTGCTTGGAATTCGAGACTGAGCGTGGATTTGTCTACCGTGAACATCACAGCTCACCAGGATA
CTACGATGGCAGATACTGGACCATGTGGAAGTTGCCCATGTTCGGGTGCACTGATGCCACTCAGGTGTTGGCTGAGGTC
GAGGAGGCAAAGAAGGCTTACCCACAAGCCTGGGTTAGAATCATTGGATTCGACAACGTCCGTCAAGTGCAATGCATCA
GTTTTATCGCCTCCAAGCCAGAAGGCTACTAAAATCTCCATTTTTAAGGCAACTTATCGTATGTGTTCCCCGGAGAAAC
TGTTTTGGTTTTCCTGCTTCATTATATTATTCAATGTATGTTTTTGAATTCCAATCAAGGTTATGAGAACTAATAATGA
CATTTAATTTgtttCTTTTCtAAtgA > SEQ ID NO:5046 182229FL 129887_300482_1d
gaattcaaaagctcgtttgattctgatttccagggcgAATACGAACCGTGAAAGCGTGGCCTATCGATCCTTTAGATCT
TCGGAATTTGAAGCTAGAGGTGTCAGAAAAGTTACCACAGGGATAACTGGCTTGTGGCAGCCAAGCGTTCATAGCGACG
TTGCTTTTTGATCCTTCGATGTCGGCTCTTCCTATCATTGTGAAGCAGAATTCACCAAGTGTTGGATTGTTCACCCACC
AATAGGGAACGTGAGCTGGGTTTAGACCGTCGTGAGACAGGTTAGTTTTACCCTACTGATGACAGTGCCGCGATAGTAA
TTCAACCTAGTACGAGAGGAACCGTTGATTCACACAATTGGTCATCGCGCTTGGTTGAAAAGCCAGTGGCGCGAAGCTA
CCGTGTGCAGGATTTGACGCCAGAGGATTCGTGTACAGAGAACACGGTAACACCCCTGGATACTATGATGGTCGTTACT
GGACAATGTGGAAGTTACCCATGTTCGGTTGTACCGACGCTTCCCAGGTTATCAAGGAGCTAGaGGAGGCCAaggCTGC
TTACCCAGaCTCATTCATCAGAATCATCGGATTCGACAACGTTCGTCAAGTACAATGTGTTAGTTTCATCGCATACAAG
CCAGACAGTACTGCCTACTGAAAACCTTTGATGAATTAGTTCATCTTACATATGCTTGTCTCAAAGATTAAGCCATGC
ATGTGTAAGTATGAACTAATTCAGACTGTGAAACTGCGAATGGCTCATTAAATCAGTTATAGTTTGTTTGATGGTACTT
GCTACTCGGATAACCGTAGTAATTCTAGAGCTAATACGTGCAACAAACCCCGACTTCTGGAAGGGATGCATTTATTAGA
TAAAAGGTCGACGCGGGCTTTGCCCGTTGCTCAGATGATTCATGATAACTTGACGGATCGCACGGCCTTTGTGCTGGCG
ACGCATCATTCAAATTTCTGCCCTATCAACTTTCGATGGTAGGATAGTGGCCTACTATGGTGGTGACGGGTGACGGAGA
ATTAGGGTTCGATTCCGGAGAGGGAGCCTGAGAAACGGCTACCACATCCAAGGAAGGCAGCAGGCGCGCAAATTACCCA
ATCCTAACACGGGGAGGTAGTGACAATAAATAACAATACCGGGCTCTTCGAGTCTGGTAATTGGAATGAGTACAATCTA
AATCCCTTAACGAGGATCCATTGGAGGGCAAGTCTGGTGCCAGCAGCCGCGGTAATTCCAGCAACGGTGGGAGAGTTAA
CTGCATGCAGGTATGGCCACCATCCGGTTTGAAGAAGTTTGAGACCCTCTCATACCTTCCTCCATTGACCGTGGAGCAA
TTATCAAAGGAAGTTGACTACCTTCTCCGTAATGGATGGGTTCCCTGTTTGGAATTCGACGCCAGAGGATTCGTGTACA
GAGAGCACGGTAACACCCCCGGATACTACGATGGTCGTTACTGGACAATGTGGAAGCTACCCATGTTCGGTTGTACCGA
TGCTTCCCAGGTTATCAAGGAGCTAGAGGAGGCCAAGGCTGCATACCCTGACTCTTTCATCAGAATCATCGGATTCGAC
AACGTTCGTCAAGTACAATGTGTTAGTTTCATCGCATACAAGCCCGAGAGCACCAGCTACGAACAGTAAAAGATGAACA
TAATCCAATTCATTTCTGTGTCTTTTTAATTTTTGTTTTTTGTTTTAATTTGTTTTCCTAATTCGGTTTAGCGAGTTA
TATTATTCGTAATCTTTAAATGGATTCGAGTGTATGAGCAACGATAATAATAATATCGTCTAATCCGATTGTTTTTATT
TGTTTATCACAATATATATGATGCATAAATGATGATAATAATTAAAGATTGCTTTTGAATT > SEQ ID NO:5047 182229FL 128913_300401_1d
CGTGACTCTGCTCTAGCACCTCACCAAGCAGAAAGCTAGAGAGCTAGCAATGGCGCCCACCGTGATGGCCTCGTCGGCC
ACCTCCGTTGCTCCCTTCCAGGGGCTCAAATCCACCGCCGGGCTCCCCGTCAGCCGCCGCTCCAACAGCGCCGGCCTCG
GCAGCGTCAGCAACGGTGGAAGGATCAGCTGTATGCAGGTGTGGCCGATTGAAGGCATCAAGAAGTTTGAGACCCTGTC
GTACCTGCCACCGCTCACGGTCGAGGACCTCTTGAAGCAGATCGAGTACCTGCTCCGGTCCAAATGGGTGCCTTGCCTC
GAGTTTAGTAAGGTCGGGTTCGTCTACCGTGAGAACCACAGGTCTCCTGGGTACTATGATGGCAGGTACTGGACCATGT
GGAAGCTGCCTATGTTCGGATGCACTGATGCCACCCAGGTGCTCAAGGAGCTCGAGGAGGCCAAGAAGGCATATCCAGA
TGCATTTGTTCGCATCATCGGCTTCGACAACGTCAGGCAGGTGCAGTTGATTAGCTTCATCGCCTACAAGCCCCCGGGT
TGcGAGgAGTCTGGCGGAAACTAaGCTAGTTGGCAAGCCAGCAAGCTCACTcgTgagCTCTATACa > SEQ ID NO:5048 20019FL 44526_300427_1d
GCCATTACGGCCGGGGAAGAAAAAAAGAACGAAGAAAGGGAGCAGGCACGAAACGCAGCCGAGCAACAACTGAAAGCG
AGGCTTCTTCAGCTTCAGCTCGACTATGAATCCAATTCTTCAAACGTGAAGAAAATAAAGCTGCTAATCGTTTCACGCT
TTCTGGATATAATATTGGAAACTGAAACTTGATTACCTAGGATGAAGAAGCTTCTAGAATTTGGGAGGAAAGCAATGTT
CTATATTAGGGTTCTTTCAGGCTACGAAGAGCGTCGAATCCGATCTTATCGATTACAGATGCAACAACGCCTTAAACAG
GCGGAGGAGAGGAAGGCAGCAATAAGGAAGGTTCCTGAACAGATGATATTGTCAGAAGTTAGGCGAATGGTGGAAGAGA
TGCAAGCTTTGAAGAAGAAGCTAGAGGAGACTGAGGCTGCTGTTGATGACTACTTCAAACCAATAAATAAGGAAGCAGA
AGCAATAGTGAAAATGCAGCTTGAAGGAGAGGAGAATAGAACAAAGGAGATGATGAATATCTTGCAGAAACAAGCTTTT
CTTGAGAAGCATCAGCCAGAGAAACTAATAAGCGCAGAAAATGTGGTCACAGAAAAACATGGCCAAGATAAAGCATCTA
CATAGATTCCACCAGAAGTAAGATGCTTTTGT > SEQ ID NO:5049 20072FL 108010_300057_1d
ctagcgccttcagcagcagttgggttgtgaaatggccaagtccaaaaatcacacagctcacaaccagtcgtacaaggcc
```

FIG. 2 continued cACAGGAATGGCATCAAGAAGCCAAGAAAGCACCGCCATTCATCTACCAAAGGAATGGATCCTAAGTTCTTGAGGAACC
AGAGGTATGCCAGGAAGCACAACAACAATAAGAGTGTTGGATCTACTGATGAAGAGTAAACAAATCCCTTAAAGTAACC
ATCGCTAGCACTGCTTTTTGAATTTGGGATTTTTTTTCTGTTTTTTTGTTATGGAATTATAGTGGTTATTTACTAGAAT
GGAACCTAATTTAGTTTGTTATTCTGTTATCTAAACCAGTTATTGGtctCTTTTGATCAATGGCATTGTCTATGCAGTT
TTATTCTTATTACTTTTTAATTTTTAATcagc > SEQ ID NO:5050 20072FL 55987_300129_1d
GGAAAGTAAACCTAGCCGAGCAGATCTACCTCTCTCTCTCAGTACTCAGAGATGGCCAAGTCGAAGAATCACACGGCGC
ATAACCAGTCGGCGAAAGCCCACAAGAACGGAATCAAGAAGCCAAGGAGACACCGTCACACCCCAACCAGAGGAATGGA
CCCTAAGTTCCTGAGGAACCAGAGGTACGCAAGGAAGCACAACGTCAAGGCCGGCGAGAATGCTAGCGCTGAAGAATAA
GTGTTTTGATTATCTGTGAGACTTTTTGAAGTTTTTTTTAATGAATTTAAGACTTTCTTAGACAAAGGAACCAATTTA
CTTTGCGCTTTTGATCATGTTTACGCAATTGTGGTTTGTGTACTCTCTTATCCTGGCCTTAATTTAATATCAGCAGTTT
TCTATGC > SEQ ID NO:5051 20072FL 252071_301668_1d
GTTTTCGTAGCTGCGGCGCGATGGCGAAGTCGAAGAATCACACCGCCCACAACCAGTCGAGGAAGGCGCATCGTAATGG
CATCAAGAAGCCCCAGCGGCAGCGGTACACGTCCAAGAAAGGGATGGACCCCAAATTCTTGAGGAACCAGCGCTACTCG
AGGAAGCGCATGGAAGCGAAGCTGCGAGAACAAAGATCTTCTGAGTCTTAGAAAATGCTAATGTTCCTTTTGCTGAAAA
TATTTCTTTTTGAATCGAAGAAAATATTTCTATAC > SEQ ID NO:5052 20072FL 252821_301605_1d
tCGATTGCGCTAGGCGTGGAGGCTACAGCGTCTGCTCTTTCACAGGTATCATGGCCAAGTCAAAGAATCATACTGCTCA
TAACCAGTCCTACAAGACCCACAAGAATGGCATTAAGAAGGCTAAGAAGCAGAAGTATACCTCAAGGAAAGGGATGGAC
CCCAAGTTCCTGAGGAATCAGAGGTATGCCAAGAAACACAACAGAAGTGCAGGTGGCTCCGAGTCTGGAGATGCAGAGG
AGTAAAAGTTTTTTTCACCATGGAACTTTTTGCACTTTCATAATCTCACCACCACCAAGCAAAATGCATCATAACTTTG
AATTTGAGACAGGAAAATGTTTTTAATTCACTGAATCAATCAGTTAGACAGAGATGTTACCAGTGATAGTTATGAGTT
AGAATTTTCTATCAAGATATATTTATTTTCCTAAACTC > SEQ ID NO:5053 20072FL 1170653_302037_1d
GGGACTGCTCGATTGCGCTAGGCGTGGAGGCTACAGCGTCTGCTCTTTCACAGGTATCATGGCCAAGTCAAAGAATCAT
ACTGCTCATAACCAGTCCTACAAGACCCACAAGAATGGCATTAAGAAGGCTAAGAAGCAGAAGTATACCTCAAGGAAAG
GGATGGACCCCAAGTTCCTGAGGAATCAGAGGTATGCCAAGAAACACAACAGAAGTGCAGGTGGCTCCGAGTCTGGAGA
TGCAGAGGAGTAAAAGTTTTTTTCACCATGGAACTTTTTGCACTTTCATAATCTCACCACCACCAAGCAATATGCATCA
TAACTTTGAATTTGAGACAGGAAAATGTTTTTAATTCACTGAATCAATCAGTTAGACAGAGATGTTACCAGTGATAGT
TATGAGTTAGAATTTTCTATCAAGATATATTTATTTTCCTAAACTCTACcATTATGTGATCTTTTTTTgccTTTTgttg
tGGGATTATATTTAAGATCTgtttGGTGtt > SEQ ID NO:5054 20072FL 174959_300528_1d
ccgccgccgacctcctccgggggtcgcgacttctctctcgacgccggtggagtgagagagagagagagattGGAGATGGCCAA
GTCGAAGAACCACACGGCGCACAACCAGTCGTACAAGGCGCACAAGAACGGGATCAAGAAGCCCAAGCGCCACCGCCAG
ACCTCCACCAAGGGGATGGACCCAAAGTTCCTGAGGAACCAAAGGTATTCCAGGAAGCATAACAAGAAGAGTGGTGAGG
CTGAATCCGAGGAGTAAGATGGAAGTTGTCCTTTCGGAAAAGCATGTCTATTTTGCCAGTTTTAACTCAGCAACCTTTT
AGACTATAGTTTCATTAATGATGGAACTTCTATGCTATTCTGTATGATGGAAAGATCTTTTGTTCTACCTGAGCATTGT
TGTGATAATGCTTTTTAGCTGATGCTGCTGGATGAATTATATGCTATTGAGTTATGTGCCGTGAATTGTGAATCTACTT
TAGGCTACTAGGCATGTGAGGTTACAATCCTCGTTGGTGATGTCAGAATTAATAATGCATAATATTGGAGCGATATCAA
TATATTGGGTGCTG > SEQ ID NO:5055 20072FL 121286_300355_1d
CCCCCAAAACCCTAGCTCCGCCGCCGCCGCCGTTCAACCGCTCGTCTCCTCCTCCCTCGCGAGCGCTCGTTTCGGATTC
GGGGGAGATGGCCAAGTCGAAGAACCACACGGCGCACAACCAGTCGTACAAGGCGCACAAGAACGGGATCAAGAAGCCC
AAGCGCCACCGCCAGACCTCCACCAAGGGGATGGACCCAAAGTTCCTGAGGAACCAGAGATATTCCAGGAAGCATAACA
AGAAGAGTGGTGAGGCTGAATCCGAGGAGTAAGATGGAAGTTGTCCTTTCGGAAAAGCATGTCTATTTTGCCAGTTTTA
ACTCAGCAACCTTTTAGACTATAGTTTCATTAATGATGGAACTTCTATGCTATTCTGTATGATGGAAAGATCTTTTGTT
CTACCTGAGCATTGTTGTGATAATGCTTTTTAGCTGATGCTGCTGGATGAATT > SEQ ID NO:5056 212584FL 219006_300927_1d
CTCTGTCGTCTCTCTCCATATCGAATCTTCTCTTCTCCTTTGATACCCTCTCGGTGTTGCAGACAGAATCATCAGTCAC
AATGGCTTCTCAGCAGATCCGCACTCCCATCACCGATCTTTTCAAGATCAAGCACCCCATCTTACTGGCCGGCATGAAC

FIG. 2 continued

GTCGCCGCCGGTCCCAAGTTGGCGGCTGCCGTCACCAACGCCGGCGGCATGGGCGTCATCGGCGGTGTCGGATACACCC
CAGAGATGCTCAAGGAGCAGATTGCCGAGCTCAAGAGCTACCTCAACGACAAGAACGCTCCCTTTGGTGTTGACCTGCT
TATCCCCCAGGTTGGTGGCAATGCCCGTAAGACC

> SEQ ID NO:5057 212616FL 206879_300826_1d
CCCACGCGTCCGGGATCTTGGTGGGCACCACGACGTTCTTCTCCATCCTCATCTTCTCGATCAACACTGTCTTTGCTCA
GGAAACACTCGCGCAGTGGATTGGAGATTACCTGACTCAATCTGCTGGTGTTACGGTTGTCTTCGAATCAGCCATAGTG
CCCAAGTGGAAGAATGGCGTTATCGCATTTCGTAATGTGTTTATTTCAAGAAGACCCGGGCAGATCGAATCATCCGTCA
GCAAGGGATCGTCTGACGCTGCTGCTGTTGCTGCCGCAGGGCGCCAGGTTCAGCATAACGGGACTGTTACCGAAGACGA
TGGCAACTATACGCAATTTGATGTAACGATCGCAAACGTCAATGTCACACTTTCATTCCTCAACTGGTGGAATGGCAGG
GGGCTTCTCAAAGATGTGGAAGTAAATGGTGTTAGAGGAATTGTCGATCGCACCTCTGTCCGTTGGCCACTGCAGCAAA
TCGACCCCTTGTCTTACCgccACAAACACCAACCAGGCGATTTTGAGATTGAATCTTTCAAATTGGAAGATCTTTTGCT
CACCATTCGCCAACCTGATggcttccgccccTTCTCAGTGAGCATATACTCCTGCgaactCCCTCGACTGAG > SEQ ID NO:5058 212661FL 204366_300792_1d
GCTTCCTCTTAATTCCAATTCAGCCTCTCTGTTTAGTAACGCATTCACAATGTCTGGACCTGGCGTCGGCTTCGAGTAT
CCTCCTCAGTCCGTTTCTTGGCTGAAGCGCGATGTGCTTCTCTTCGCCAACTCTATCGGCGCTACTGCTGACGAGCTTC
ACTTCCTCTACGAACTCCACCCCAACTTTGCCGTCTTCCCTACTTACCCTGTCATCCTGCCGTTCAAGGGCGACACACA
GGAAGTGATTGACTTCTACGCCTCCCAGAAGAAGATCAAGGTCCCTGGCGTCCCCGACTTCGACTCCCGCCGCGTCGTC
GACGGCCAGCGAAAGATTGAGTTCCTCAAGCCCCTGCCCGTCTCCTCCGAGGGCACAAGTTCGAGATCCGCCAAAAGG
TCCTCGGCGTCTACGACAAGGGCCGTCCCGGCTCCGTCGTCGACACCCAGCTCGAGCTCGTCGACGCCAACACCAACGA
AGTCTACACCCGTCTCTTCGGCAGCGCCTTCTACGTGGCCCAGGGCAACTGGGGCGGTCCCAAGGGCCCTGCCACCGAG
AACTTCCCCCCCTCCCAAGGACAAGAAGCCCGACTGGGTGTTGGAGAACCAGATCTCCAGGGAGGCTGCTCACCTGTACC
GTCTGAATGGCGACTACAACCCCCTGCACGCCACCCCCGAGCCTGGTgtcaagATgggcttcccaggCGccATCATgca
cggTCt > SEQ ID NO:5059 212682FL 207909_300830_1d
ggcgcccaggagcaatgtctcagggcccaacgaatgtgcgGTGAACGAGCTGCTACTGCACCGCCGATTGTCTGATGCA
AGCAAGGGAGTTGTTTGTTTGCTCCATCCTTGATTCACTTTAATGCTTGTTATTAGGTACTTTAAGAGCCAGGTTGAAA
GGGTACTTTGCAAGTGCTTAAATCTCCATTCTGCCTTATACTCCATGCCTGTAATTGTATAGTAGCACcagggtaaGCC
AGCAATACCGCAAGCTGGCAGTATCAATCGCCATTTTTCTCTACAAAAAAAG > SEQ ID NO:5060 212738FL 208881_300809_1d
GCAAATTGGACATACACGATAATGCAATCCTCATCCATGGCCAGCGTAGCTTTCTTGACTACTGCAAAAGTAAAGGACG
ATGAGACAAAGGAGGTTGTGAATGGCTTGCAACAACTTAGTGCCCATCTCCAACTCCCCAATACCCCATGTCTAGCCGG
AGCCTGCTTTTTGTCCGCGGCCAAGAAGGAAACGGGTATCAAACTCATCGGTCGCTTGGAAATATTTCCTAGTGAAAGC
GAACTTGCTACTGTTCAAAACTCTCCTGAATATAAGCGTTTCAGCGACTCGGTCACCGGCCAAAAACTTCACGAAGGCA
AGGAGACTGCCACTTTATGGCAGCCCACCGGCGGTTTTCTGACAAGGAAGAACCAAGCCTCGACAACAAAGGCCGGTGT
ACTTGTTTTAGCCAAGTTCATTTGCAATGATAAAGAGAACGCAGTTCAAAATCTCGTGAAAGAGTTGCAAACATATTGT
GAGTGGATCGAGGGCAACGAGCTCACGACATACATATTGCGTAATGACAAGTCAAACTGCAAATAAGGAAGTTCTGC
TCTTTGAGCGTTATAAGGATCTTCCTTCCGTCAAGACCCATGGCCAAACAAATGAGTTCAAGTCTATGTTCAAACGAAT
TCGCCTTGGATTGAAACAAAGCGTACCGAAATAACTCCATGGAGCGAATTAGACGGTTCTTTCTTCTCTTCCCTAGAC
TTAGAAGCCACAGCGAAGCTCTAAAGATAGCTCTATATTCCTTATAATTTTGTATTTTTTCTTCTATTCT > SEQ ID NO:5061 212943FL 214953_300876_1d
GCTACGGCTTATTTACTCTTCTGACCGGAGGTCTCGGTATTGACATGACCTTGGAGCCATCGCTGCCGCAACGAAATGG
AGTACTCGTACATGTAGCCGCAGTCTCTTGTCCATGCGAGCGGGCATTTCGTCGGCGTCCCAATGGTCACCGCGAGACC
TATCATTTGAGATACTGTCTATCTTCCTGCATGTTGGCTGTACGAGACGAACGATATGACGGCTCCCTGCCTTTGATTT
CTATGCAGCAGTAGCCAAAAGAGAAAAGGTGTAATATGCAGCAAGGCCGCTATGTTGCCACCCCACGAGACCTCGACTG
CATGCACGTCCAGCGATACGTCTCCACGAGGCCGCGCATGACCGCTGTGTCGAGAGTGGATGGACTGCGGACACCTCTC
TGCTTGCAACGGCTCAGCAAATTTTGCCGTTGGGCCACCGAAGCCAAACGGCTCACCGTCTACGCAATTGGCACTCTAA
ATGCTCCTTTCCGCAGCCGCCTTGCTTTCAATACGCGTCCACAAGCGTTTGTAGCCCTTGTCAGGCCGTTGCGGTTGCC
CGCGTACCACCGCCCAGTGGAGAACAAGCG > SEQ ID NO:5062 212996FL 219484_300945_1d
AAGCTTCTGCTACATCGCCAACATTCTGTTTTGATTATAACGATCTGAATGCCTACCTCCTCACCGTTGTGGGTGTTTC
TCGGCCTGAGAGCGATCAAGCCACGCTTTTTCATGACATCATGACCAAGGCTCAAGGGGAGCTCGTATATCACTTCGC
GAGATCCAGACCTTGTGTTCCAGAGAAGCCATCGTCAAATTGGACTCGGGTGTGAATCTAGCTCAAGCTATAGAAAAGC

FIG. 2 continued

TTGGTAGCGGAATACACAGAATCTTGGTTACTGAACAAGCTGGGAATGTTATTGGGATTATAAGCCAACTTCGCATGGT
GGAGTTCTTCTGGAACGAAGGGATCAATTTTCCCACCATTGACCGACTTAATCCAGTCACGCTACAAGAGTTAGGAATT
GGAGTGCGGCCGATAATCTCTGTCCACGCCGACGCTCCTCTTACTGAAGCTTTATCGCTCATGTATGATGAGGGCCTTT
CAAGCGTAGCTATTGTAGACAACGGACAAAATGTGGTGGGCAACATCTCAACAAAGGATGTGCGGCATTTGACAAGCTC
CTCGAGTGCATATTTGCTTGGTAACTCTTGTATGCACTTCATTTCCATCATT

> SEQ ID NO:5063 213122FL 220748_300938_1d
GTCATGGAGAACGTCCTCTTCAAGGTCTCCTACCCTGCCGAGTTCCACTCCCAGACCGTGACCACTGCATCCAGTACAT
GGCCTNCCGTCATGCTCGTCTTCGGCCGCCTCGAGGCCACCGACTACGTCGACGGCTCTGAGGCTGCTACTTCGGAGCT
TGTCGAGTCTCTGCGCAAGAAGATCAAGTGCGTTGAGGACCCCCAGTACACTCAGGACTACCATGACCCTGCCCTGCGA
ACCATCTCCAACGCCCCTGACCGTTGAG

> SEQ ID NO:5064 213149FL 212915_300845_1d
CCCACGCGTCCGCCCACGCGTCCGCCCACGCGTCCGCATCAAAGAACAAACGCATCGTTCAAGATGAGAGCCAAATGGA
GGAAGAAGCGCGTTCGTCGCCTTAAGCGCAAGAGAAGAAAGATGAGGGCTCGCTCCAAATAAACGACTCGCTCTACCAC
TTGACTTGACACATCTTTCACATTTTGAATGAGTTCACGATAAAACACGACAAGCAAAGCTGCTGCACCACGGTACCAC
TCTATGACCGATTACAGCCATCAAGTTGGAATCAGCATATTGGTGCGCCTCTCCAATTCAGCTACGGGAGTCAATGGAC
GAACGCGAGAGATGAGGACTGGACAATTTCAGTCAGGTGGAGACATCGTTTTGAGGACGCGAAGGCCATGAAGCAAAAC
GCTGCTGCAAGAAGCACGCTTAGGATCGATACGTTGCTTGACAAAGATCAAAGGCAGAATTTACTTCATTTCCAAACCA
AAAAG

> SEQ ID NO:5065 213179FL 209162_300812_1d
tggagtcccggtgctcgacgtagtatttgcctttttttcgagcgctccatccttcgttgtcattgccggctcttataaac
aAGGCTTCAGGCTCTTCCATAACCAAAAACTAACACGCGAAAGCGgctGTTGATCTCCCAGCCTTATTCCGCGCATTCC
TCTGCCACCAATACCATGGACCGCCAGACCATCATGGAGACCAACCGGTCTCTTCGAACCATTAAGAATGAGCTCGAAA
GCCTCCTCGAGAAAGGCGTCATCGACGAAGCCGCTTTCGACACTATTCATGCCGCCCTGCCCGCCGAAACTCCTCTTCG
TGGAGCCGCTCCCGGAAGCGCTGCTCGTTCTGCAAACCAAACACCTCTTCAGCCTGTGGCGGCTGCAACTCCTCCGGTC
CAGGCCCCTGTCCAGGCCTTTCAGAACCTCAACGTCAACGGAACCTCTCCCGCCCCTCCTTCATACGATGATACTCCCG
CTCCTGGCGTCCCACGCGCTCTCCGGCTCCGGCTGGGAAGCCCGTTTTGGCCCATGCGAGAGCCTTGTACCGCTACGAT
GCCAGCGATGCCCGCGACCTGAGCCTGGAAAAGGACGATAAGATCGATGTCTACGAATACATGAACCAGGactggtgga
ntgggcgtAAccaccgcACTGGCATGGAGGGCATCTTCCCCCAAAACTACGTTtttgtcgAGCAGGagcaaaAggCTcc
TAtgCcagctCCcgTGGCctaaccccAGCAgccggcatatggctaccgcagggGACctccggcgCAGCAgaacccTTA
CAATGCCAGTgtgccacctATGGCGATAgcagaGGg > SEQ ID NO:5066 213330FL 207739_300828_1d
AGACTTTATGTTGTTGGCGGTGAATGGCTCAACATCGAAGCTCTAGGCGCCGGAGGTATTGCTCCTGTTGCAAGCTTGG
CCGCAAATGGGAAAACTTTTATGCCGGGCTGTTTTTTTTCCGGTTTGTCAATGGGGCCGTGCGATTACCTAAGATGAGG
CAGAGCAGCGGCGGCTTCGAGTTTGAATTTACAAGAAACATGGATTGTGCTCGGAGTACGCCGTGGTATGTAGGATGGT
CTGTGGCTGAGGTCGTCCAGCTTCAGGTGTTTATATATGGCTTTACCGGCAGATTTCACAAGCTCAATCGACTTTTGGA
AAGTGTGTTTCAGGCTATTCTTGAACTTTATACTCGACGTATAAGTCTGGCTAAGAGATTTTGCTATTTCCTATATCAT
TATCATAACATGGGCATATATGGGTCAATGGATGGTAAATGAAATTTGATTTGTACGGGAC > SEQ ID NO:5067 213340FL 1107806_301547_1d
attgagcatagagaagacaactttgcaaactctatagagtttTATAATGCAACCTGGCCTCGTGAGCTTTGCATAAATT
TTCCCCTAGAGGCTATAATTCAGAAGCATGCAGAGAATATTTAGTTCTTGTTGAATATAACAAGGCCCCCTACCCAAAA
AAGCGCACAAACTAGATAATGTCTACAACAACTTTGACTAAGGTGGGGCAGAGAATTGCTTCAAATGCTCGTCGTCAAG
CCCTCACTTTGACAGATGCCGCAGCAAAGAGAGTTCAAGATCTTCTGAATAAAAGACATAAACCCTTTTTGCGACTCGG
TGTGAAGGCTCGTGGATGCAATGGACTCAGTTACACCCTTAATTATGCAGACGAGCAAGGAAAGTTTGAGGAATTAGTG
GAAGATAAAGGAGTCAAAATCTTGATTGATCCTAAGGCCTTGATGCATCTTGTCGGAACAAAGATGGATTTCATTGAGG
GCAAGCTCAAGTCTGAGTTTGTCTTTATAAATCCAAACTCCAAGGGTCAATGTGGGTGTGGAGAGTCATTTATGACGTG
ACCAAGGAGATTCATATCGTTACATTCACCCAAAATCCAAGGGTGTACGAGGTTAGGGAGACTCATTAATGTTTTCCTC
AATCAAATTTATAGCTTTgCCTATAACATGCTGTGCTATTTTCtttaaCAAGCa > SEQ ID NO:5068 213340FL 230982_301073_1d
GGAACGAGGATGATGCGGAGGCTATGTTCAGCGCAGGTTAGGAAGAAGAATGGCAGCGGTGTGTGCCGTCAAGGAAGGC
CTGAGGCAAGCTTCATCGGCCAGGAAGCAGGCGCTTGCATTAAGCGATACGGCTGCAACGAGGATTCGGCACTTGCTTG
ATATGAGGAGCAAGAATTTCTTACGCTTGGGAGTGAGAGTTCGAGGTTGCAATGGCCTCACCTACACCATGAACTACGC
AGACGAGGCTGGAAAATACGATGAGCTCGTGGAAGACAAAGGTGTCAAGGTGTTGGTCGATCCGCGGGCATTGATACAC

FIG. 2 continued

ATCGTCGGCACCAAGATGGATTTCGTAGAAGACCGTCTCAAGTCGGAGTTCGTGTTTATAAATCCCAATGCCACCGCCA
AATGTGGCTGCGGCGAATCCTTCACGACCGGCTCACAAACTACACGGCCGCAAAGTCAGTAGGAGAACTTCTTGATATG
ATTGGTCAGACTTGGCCAAATTTCAACGGTAGAATGAATAAATNGGTCGGTTGTTCAAGCTTGCCAATTTTTGAATCTG
AAAAAA

> SEQ ID NO:5069 213340FL 218693_300920_1d
gcacgtttgggcAGCATCTTTATGATACAATGATGAACGTCTCCTTCTCTACCGGCCGCGCTGCGCTGCGCCTCAGCCG
CTCGTCCTTCCGCCACCTGTGCGCATCCAGAGTCGCCGGCTTTGCTTACCACTCCTATCCGCTGCCGTCCAAAATCCCC
GAGCCTCCCACAAGCGACAACCTCTCCAAGTCATCCCTTGCCCAGCCAGAGGCCCTTCCTCGCGTCCACGAGACACGGC
CGCCTCCTCAACACGATGCCGTACCCAAGCCGATGGCCCCACCGCAGGTTGAAGCTCAGTCGCCTTCTCCAACAACCTC
CTCAGTTCCTCCATCTCCCAAAGCCGCCGAGACCGATGCGCAAAAGACACAGCCTGCTCCCGCTGCTCGACCTCGTTCC
AAGCTTCGCGCGCGCAAGGCCGCAATGAAGCTCACACCCGCCGCCGTGGAGCAGCTGCGCGCACTGCTCAACCAGCCCG
ACCCGAAGCTCATCAAGGTCGGTGTGCGGAACCGAGGCTGCAGTGGGCTCGCATACCAGCTGGAATACGTCGATAAGCC
GGGCGCTTTCGATGAACTGGTGGAGCAAGACGGCGTCAAGGTCTTGATTGACAGCAAGGCACTCTTCAGCATCATTGGC
AGCGAAATGGACTGGGCGGAaGATAAACTGAGTCAGAAGTTTGTGTTTAAGAACCCTAATAttAAGGAGCAATGCGGCT
GCGGGAgAgtcATTTATGGTCTAAGGAGCTTGTGAagcTACAAAGGaaCAAGACAAAGGCCATggCACatgagaaTACTA
CCAaggccgATGTATggagAGATtgtaCgaTgAcgacTa > SEQ ID NO:5070 213369FL 213370_300924_1d
actttgtgtacctcgagatcgggtatataaagttacctcggggcgcctcttagtgctggcgttcgtggcttgtctgctaac
aATCAGGTTATATCCAGAGCTTGGGCACCAGAGCTCTTCTTACACTGCCAATCTCTGCATCATCTCGTAAACAGAGTAT
ACAATTCTGGATACAATTTTTCTTCGTCCATGGGGTCTCAAGTCCAAGAAGAGCTGACAGTGCTCGTCACTGGATTTC
AGCCTTTCCGGCCAGAATATCCAATCAACCCGTCATGGGAAATCGCGAGAGCCCTCCCAGAATACCTCCCTCCGCTAAG
GGCCAAGGACCCAAACTCTCGAAATGCCGTCGACATCCCGCCTGTGCGCATTCTGGTGCACCCCGACCCCATCCGAGTC
AACTACAAGGTGGTGAGGGAGCTTGTGCCAACACTGTGGGAGGAGACGTACGCGGGCCGCAAGATTGACGTCGTCATTC
ACATGGGCATGGCAGGGCCGCGGCTCATGTATCAGATCGAGAGCCGAGGACATCGTACGGGTACAAGTCTCTCGATGT
TGACGGGAAGCACCTTGACGAGCTCGATGGGAAACGGGACGAAGAGTGGATCTGGCATGGCCTCCCGGATGTGCTGAaG
ACGGACTTGAATATACAGGACATCTGGCAGAGATGGCAGCAGCACAGCTCGAATGACAtGGAtcttcGAATCTCTGACG
AT > SEQ ID NO:5071 213734FL 1173809_302075_1d
TTGAAGAGTGGCCATTACTGCTATTCTCTCTCCTCTCTCCTCTCTCCTCTCCTTGCTGAGCATTGGCCCAGACGTGTCC
TCTTCCCTTCAGAATGTCTGTTTTACCACACTCCATGGCTGATTCTTCAGTTTCAATCCTTGTGAAACTGGCTCTTCTG
GCGCAGAAATTTACAGGGTTAAAGTCAAGTGCTTTTCTTGGTCAGCAAGTTGGCCAACCACAAATGAGCATGCCGTTGG
TAGTTCAATGCAAAGAAAATGGTGGAAGCAGAATTTCAAATGGCTCTCGCCACACATGTTTCCAGGTTTGAGAAGGTGA
CAATGGCCGCACCAGATCCGATTCTTGGTGTCAACGATGCTTTTAAGCTAGACAAGAACGAATTGAAGTTAAATCTTGG
TGTTGGAGCATATAGGACCGAAGAGCTTCAGCCTTATGTTTTAAATGTGGTGAAAAAGGCTGAAAGACTTCTGCTGGAG
AAAGGTGAAAATAAGGAGTATCTTCCTATTGAGGGTCTCGCGGCTTTCAACGAAGCAACTGCTAGCTTGATTTTCGGAG
CAGATAGTCCTATCATTAAAGAAGGCAGAGTAGCAACAGTGCAAAGCCTCTCAGGCACTTGTTCTCTTCGACTTGCAGC
TG > SEQ ID NO:5072 213734FL 124824_300426_1d
cccacgcgtccgctccctcaacaaatatcacacttccattacatctttgaagttcttttcattcattttatcaaAATGA
CAAATTCCTCCAATTCTGTTTTTGCCCATGTTGTTCGTGCTCCTGAAGATCCCATCTTAGGAGTCACAGTTGCTTATAA
CAAAGATACCAGCCCACTGAAGTTGAATTTGGGTGTTGGCGCATATCGCACTGAGGAAGGAAAGCCCCTTGTTCTTAAT
GTGGTGAGACGGGCTGAACAAATGCTCGTGACACGTCTCTGCAAGGAGTATCTCTCAATTACTGGACTAGCGG
ATTTTAACAAGCTGAGTGCAAAGCTTATATTTGGTGCTGACAGCCCTGCCATTCAAGAGAACAGGGTGACTACTGTTCA
GTGCTTGTCGGGCACAGGTTCTTTGAGGGTTGGGGCTGAGTTTCTGGCTAAGCATTATCATGAACGTACTATATATATA
CCACAGCCAACATGGGGAAACCATCCGAAGGTTTTCACTTTAGCCGGGCTTTTAGTAAAATATTACCGTTACTACGACC
CAGCAACACGAGGCCTGGATTTCCAAGGACTTTTggatGATCTTGCTGCTGCACCCGCTggagcAATAGTTCTTCTCCA
TGCATGTGCTCATaACCCaaCtggCgttgAtccaacaAATgaccagtgggagaaAA > SEQ ID NO:5073 213734FL 147546_301253_1d
aaaaaaggaaagttagcaagcaaaggTTTCGTACTGTCAAAATGAACATGTCACAACAATCACCGTCACCGTCCGCTGA
CCGGAGGTTGAGTGTTCTGGCGAGACACCTTGAACCATCGTCCTGCGCCACCGTCGAATCCTCTATCGTCGCTGCTCCT
ACCTCCGGAAATGCTGGAACCAACTCTGTCTTCTCTCACATCGTTCGCGCTCCCGAAGATCCTATTCTTGGCGTCACTA
TTGCTTACAATAAAGATAGCAGCCCCATGAAGTTGAATTTGGGAGTTGGTGCATATCGCACAGAGGAAGGAAAACCTCT
TGTTTTGAATGTTGTAAGACAAGCAGAGAAGCTACTAGTAAATGACAGGTCCCGCGTTAAAGAGTACCTATCTATTACT

FIG. 2 continued

GGACTGGCAGACTTCAATAAATTGAGTGCTAAGCTGATACTTGGCGCCGACAGCCCTGCTATTCAAGAGAACAGAGTAA
CAACTGTCCAGTGTTTGTCTGGCACAGGCTCATTGAGGGTTGGAGCTGAATTTTTGgCTCGACATTATCATCAACGCAC
TATTTATATTCCCCAACCAACATGGGGAAACCACCCAAAAGttTTCACttTagcTgggttATCagtaaagagtTACCGC
TACTATGATccagcaaCTCGTggactcaaTttTCA > SEQ ID NO:5074 213734FL 168290_300554_1d
GAATTCACAACCATGGAATCTCAAAACTCTGGGTTCTAATATTTCAATGTCTCCTACTGCTTCTCATGGTGATTCTGTT
TTTGCTCACATTGTTCAAGCTCCTGAAGATCCAATTTTAGGGGTTACTGTTGCTTATAATAAAGATCCAAGTCCAATTA
AGTTGAATTTAGGAGTTGGAGCTTATCGAACTGAGGAAGGAAAACCACTTGTATTGAATGTTGTAAGAAAAGCTGAACA
GATATTAGTTAATGACAGGTCTCGTGTGAAAGAGTATCTTCCTATTACTGGATTGGGAGAATTTAACAAATTGAGTGCC
AAGCTCATTTTTGGTGCTGACAGCCCTGCTATCCGTGAGAACAGGATTACTACTGTCCAATGCTTGTCTGGCACTGGCT
CGCTGAGGGTGGGAGGTGAGTTTCTTGCAAGACATTACCATCAGCGAACAATATATATTCCACAGCCAACATGGGGGAA
CCATATCAAAGTATTCCAATTGGCAGGGTTGTCTGTGAAATATTATCGCTACTATGACCCAAAAACACGTGGATTGGAC
TTCCAAGGTATGCTGGGGGATCTCTCTTCTGCTCCATCAGGAGCCATAGTTCTTCT > SEQ ID NO:5075 213734FL 208922_300810_1d
GGCCATCCGAAAAGTCGTTGGTGAGACTCGGGAATTTGTATGATAATGGTTTGATAGATGGGCTTCGAGGACGTGACGA
TAATTATCACCGCCGCTGGCCAGGAACTTGCGTGGTTTCGATTAGTGTTCTTTTTTCCTTTGTATTCGATAGCACATGG
GTGTGTGGGCATAGATGCAGCTAGACAAATAGCAAATACGGGTTTGAGGGCCTCGGGGAGTTTCATCCCTTGACAACG > SEQ ID NO:5076 213734FL 226694_300999_1d
TCCCCTCCTCACAACTCCACCAGACTCTCAAAACGATGCTCCGAACCATCGCCCGAACCCACGCTGTGGCCGCCACCAA
GGTCGTGCGAGCCTCCACTTTTTCTGCCACCCCCGCCGCCTCTTTTGTGCGATTCCAGTCCGTCTGGGCCAAGGTCCCC
CAGGGTCCCCCCGACGCCATTCTCGGAATCACCGAGGCGTTCAAGAAGGACGCCTTTGAGCAGAAGATCAACCTCGGTG
TTGGCGCCTACCGAGATGACGGCGGAAAGCCCTTCGTTCTTCCCTCCGTCCGAGAGGCCGAGAAGGAGGTGGTGAACAA
GGCCCTCGACAAGGAGTACGCCCCCATCACCGGAGTCCCCGCCTTCACCAAGGCTGCTGCCGAGCTCGCTTACGGCGCC
GACTCCCCCGCCGTCCTCGAGGACCGAATTGCCATCACCCAGACCATCTCCGGTACCGGTGCTCTGCGAATCGGAGCCG
AGTTCCTCAACAAGTTCTACTCCTCCAagaaGATTCTGCTCCCCcagcctTCTTGGGC > SEQ ID NO:5077 213734FL 216942_300903_1d
tcatcatcGTCCTCTCAATCTCGTTCCCAATCAACTCCGTCTGCCTCTCTCGCCCGCATCAACAACATTGCGAGCCACA
TCTCTCCCACAATGGCTTCCACCACCAGTTTCCCGGCAGAAACGGTGCCCCAGGCGCCTGAAGATCCCCTCTTTGGCCT
GGCCCGCGCCTACAAGGCTGACAACAGCCCGCTAAAGGTCGACCTGGGAATCGGCGCCTACCGAGATAACAATGCGAAG
CCATGGGTTCTTCCTGTGGTAAAGAAGGCTGATGAGATTCTCCGAAACAACCCCGAACTGAACCACGAGTATGCCCCGA
TTGCAGGTATCGAGAGCTTCACCAGCAAGGCTGCGGAGCTGATGCTCGGCGCCGATTCGCCCGCTCTCGCGGAGCGCCG
CACTACGTCTATGCAGACCATCTCGGGAACCGGTGCCGTTCACTTGGGAGCTCTGTTCCTCGCCAAGTTTTACAAAGGC
AGCCAGACCGTCTATGTGTCAAATCCCACATGGGCAAACCACCATCAGATCTTTTCCAATGTCGGCATCAAGGTCGCCC
AGTATCCCTACTTCAGCAAGGAGACCCGGGGGCTGGACTTTGATGGCATGACCGCTGCCATCTCAGCGGCTCCTGAAGG
TTCCATCATCCTGCTCCACCCCTGTGCGCACAACCCAACCGGCGTCGACCCAACACTTGATCAGTGGAAGGAGTTGGCC
GTCATTATCCGAGAGAAGAAGCACTTCCCCTTCTTTGACTGTGCCTACCAGGGCTTTGCCTCTGGCGACCTTGCTCGAG
ACGCCGCCGCTGTGCGTTACTTTGTCGAGCAAGGCTTCGAGCTCGTAGTTGCCCAGAGCTTCGCCAAGAACTTTGGTCT
TTATGGAGAGCGAGCTGGCTGCTTCCACGTTGTGGCTGCTCCTGCCGCTGATGCCACCACCACAATCACCCGCATTGCA
TCTCAGCTTGCCATTCTGCAACGATCAGAGATTTCCAACCCTCCTTTGTATGGCGCCAGAATCGCTAGCACCGTTCTGA
ATGACGCCCAGCTCTTCGCCGAGTGGGAGGAGAATCTGAAGACCATGTCCGGCCGCATCATCGACATGCGCAAAGCTCT
CCGTTCCAAGCTTGAAGAGTTGGAGACTCCAGGAACCTGGAACCACATCACAGACCAGATCGGCATGTTCAGCTTTACT
GGCCTATCAGAACCCCAAGTTCTCAAGCTCCGCGAGGAGTAT > SEQ ID NO:5078 213734FL 45861_300075_1d
GCAAAATAACAATTGTTGGTGGCAAATTAAAGTAACCAATATTTTCTTAGAAACGGTAGATCTCAGTGTCACAATCCTC
ACTTTGGTTTTGGTTCAACCATCTTTAGTCAAAAGACATGAGGAAACATATGGTACCATCAGAAAAAAACCATAGTATA
TAAGCCAACAAAAACGGTGTTCTTTTTTTTTGTCCCATTTTATTTGTAGAAACAGCAAAAAAATGTATGGTCGCTAGTT
TAGCCGAGGCGGGTCACTGCAGCATGCATAGCATCGGCAAGGTGAGGCACTGTCTTCGAACTTAGACCTGCCATGCTTA
TTCTCCCATCAGAGGTCATGTAAATGTGGAACTCTTTGGTCATGAATTCAACTTGCTCCTTGTTCAATCCAGTAAATGT
AAACATCCCAATCTGTTTGATAATATGACTCCAGTCACCAGGTGTACCTCTAGCTTGTATAGCTTCAAATAACTGTTGG
CGCATGCTCTTTATACGGTCAGCCATTTCTTTCAGCTCGATGGTCCAGTTGTTGTACATATCACTGCTTTTTAGAATGG
TGGCAACAATTGATGCTCCATGAATAGGGGGGCTCGAATACATGGGCCGCACAACAAGCTTCACCTGGCTCTCAACCTT
ACTA

FIG. 2 continued

> SEQ ID NO:5079 213734FL_286510_200110_1d
CATGGCGATCCGAGCCGCGATTTCCGGTCGTTCCCTCAAGCTTAGCTCGTCGGTAGGAGCGCGATCTTTGTCGTCGTTG
TGGCGAAACGTCGAGCCGGCTCCTAAAGATCCTATCCTCGGCGTTACCGAAGCTTTCCTCGCCGATCCTACTCCTCATA
AAGTCAATGTTGGCGTTGGAGCTTACAGGGACGACAATGGAAAACCCGTGGTACTGGAGTGTGTCAGAGAAGCAGAGCG
GAGGATCGCTGGTAGTTTCAACATGGAATATCTTCCTATGGGAGGTAGTGTCAACATGATCGAGGAGTCACTGAAGTTA
GCCTATGGGGAGAACTCAGACTTGATAAAGATAAGCGCATTGCAGCAATTCAAGCTTTATCTGGGACTGGAGCGTGCC
GAATTTTTGCAGACTTCCAAAGGCGCTTTTGTCCCGATTCACAGATTTATATTCCTGTTCCTACATGGTCTAATCATCA
TAACATTTGGAAAGATGCTCACGTCCCTCAGAAAACGTACCATTATTATCATCCTGAAACAAAGGGGTTAGACTTTGCT
GCACTAATGGATGATATAAAGAATGCCCCAAATGGATCCTTCTTTCTGCTTCATGCTTGTGCTCACAATCCTACTGGGG
TGGATCCTACAGAGGAACAATGGAGGGAGATCTCACACCAGTTCAAGGTGAAGGGACATTTTGCTTTCTTTGACATGGC
CTATCAAGGATTTGCTAGTGGGAATCCAGAGAAGGATGCTAAGTCTATCAGGATATTTCTTGAAGATGGTCATCCGATA
GGATGTGCTCAATCATATGCAAAAAATATGGGACTATATGGCcagCGAGTTGGTTGCCTAAGTGTGGTTTGTGAGGATG
AAAAACAAGCAGTGGCAGTGAAAAGTCAGTTGCAGCAGCTTGCTAGGCCCATGTATAGTAAtCcACCTGTTCATGGCGC
ACTTGTTGttgCTACcatcCTTGGAGATCCAAACT > SEQ ID NO:5080 213734FL_284634_200100_1d
ccctcgaccacgcgtccgcggacgcgtGGGTTTCATCGATCAGTTCTTCCCTTTCTCTTCGGTTCCCTGTAAAACCAAA
GCCTCCCCATTTTTCTCTTCTACCCGAGCTTTAAGATGGCTTCCACAATGTTCTCTCTAGCTTCTGCCGCTCCGTCAGC
TTCTTTTTCCTTGCAAGATAATCTCAAGTCAAAGCTGAAGTTGGGGACTTCTAACCAAAGTGCCTTTTTCGGGAACGAC
TTCGTGAAGGCAAAGTCAAATGGTCGTACTACTATGACTGTTGCTGCTAACGTCTCTCGATTTGAGGGAATAACTATGG
CTCCTCCTGACCCCATTCTTGGAGTTTCTGAAGCATTCAAGGCTGATACAAATGAACTGAAGCTTAACCTTGGTGTTGG
AGCTTACCGCACGGAGGAGCTTCAACCATATGTCCTCAATGTTGTTAAGAAAGCAGAAAACCTTATGCTAGAAAGAGGA
GATAACAAAGAGTATCTTCCAATAGAAGGTTTGGCTGCATTCAACAAAGTCACAGCAGAGTTATTGTTTGGAGCAGATA
ACCCAGTAATTCAGCAACAAAGGGTGGCTACTATTCAAGGCCTGTCAGGAACTggGTCAttGCGTAttGCTGCaGcACT
GATAGAGCGttACttccctggctC > SEQ ID NO:5081 213734FL_258632_301698_1d
atctagtcatctcacgacatttgactaacgactctatttattaacctgacggtgcaccccaacccagtaacacgttact
aACTACCCCGTCTCTATCACCACGTGACTCTGAACCAAATCTTTGGCTTTATTTTCACGTTCCCAACACAAAATCCAAA
CCGCCAATCACCCCATCTTTTTAATCAGCAACTCTCCCCTCAACACTACGGTTTTCGAAGTAGTTATTTATTCATATTT
ATAATGTCATACTTTGCATCAGTCCCCGCAGCTCCCGCAGATGCCCTTTTCGGCCTCATGGCCAAGTACAAGGCCGATA
CCTTCGACAAGAAGGTCGACCTCGGAGTCGGAGCCTACCGAGATAACACCGGAAAACCCTGGGTCCTCCCTGTCGTCTC
CAAGGTCGATTCTCTGATTGTCGCCGACCCCACTGCCAACCACGAGTACCTCCCCATCACTGGTCTGCCAGACTTCACC
AAGTCTGCCGCCAAGCTGATTCTGGGGCCTGACTCTCCTGCCATCAAGGAGAACCGAGTTGCCTCTTGCCAGACAATCT
CTGGAACTGGAGCAAACCATCTGGGATCTCTCTTCCTGTCGCGGTTCCCCTCCTCCGCCGCTCCCCCAAGAGCGTCTT
CCTCAGCCGTTCTCCCCCTTCCCCTGGAGCAACCGGAGATACTCCTCCCCGAGCTGCTGGCGgCCgaATCTGGATCTCC
AACCCCACCTGGgccaacCACAAGCAGATCTTCGAGAACGTCGGTCTGACCg > SEQ ID NO:5082 213734FL_256651_301674_1d
GATCAGCTATGGAGAGCGTGGCGCTCAAGCGAGTTTCTGCTGTAGCCAACCATCTCAATCCCGAGCAGCAGCAGCAGCA
GCAGCAGCAGCAACTCTCCATGGCTGTCGCCGCCAGCGCCGGCGCCTCTTCGGTGTTTGATCATCTGGAGCAGGCGCCC
GAGGATCCCATTCTGGGAATAACTGTGGCATACAACAAGGACCCTCATCCCGGGAAAGTGAACCTTGGAGTCGGAGCTT
ACCGCACAGAGGAAGGGAAACCCCTTATTTTGCATGTGGTTCATCGTGCTGAGGAACGTCTTCTAGCTGATCGCTCCAG
AAACAAGGAATACTTGTCAATCACTGGGCTGGCAGACTTTAACAAGCGAAGCGCGACGCTCATTCTGGGAGCGATAGC
CCTGCTATCGTGGAGAAGAGATTGGTAACTGCGCAGTGCCTTTCTGGAACGGGTTCCTTGCGTGTAGGAGCCGAGTTTC
TTTCAAGACATTATGGTGTGAAGCTGGTTTTCCTTCCTACCCCGACGTGGGGAAATCACTTCAAGGTTTTCATGAATGC
TGGACTTGGTGTTAAGACGTATCGTTACTATGACAGCAAAACTCGTGGTCTTGACTATGAGGGTATGCTCGAGGACATA
AGTGCAGCTCCGACCGGATCGGTTATTCTCTTGCATGCATGTGCTCATAATCCCACTGGCGTGGATCCGACACCGCAGC
AGTGAAGGAATCCGTCAGACAATTCGGAAGCGAGGACACTTgccATTTTTCGACAGCGCGTATCAGGGGTTCGCCAGCG
GGAGttTGGACAGGGATGcgctcgcGgTTCGAaGCT > SEQ ID NO:5083 213734FL_239752_301307_1d
ATCAGCTATGGAGAGCGTGGCGCTCAAGCGAGTTTCTGCTGTAGCCAACCATCTCAATCCCGAGCAGCAGCAGCAGCAG
CAGCAGCAACTCTCCATGGCTGTCGCCGCCAGCGCCGGCGCCTCTTCGGTGTTTGATCATCTGGAGCAGGCGCCCGAGG
ATCCCATTCTGGGAATAACTGTGGCATACAACAAGGACCCTCATCCCGGGAAAGTGAACCTTGGAGTCGGAGCTTACCG
CACAGAGGAAGGGAAACCCCTTATTTTGCATGTGGTTCATCGTGCTGAGGAACGTCTTCTAGCTGATCGCCCTGCTATC
GTGGAGAAGAGATTGGTAACTGCGCAGTGCCTTTCTGGAACGGGTTCCTTGCGTGTAGGAGCCGAGTTTCTTTCAAGAC
ATTATGGTGTGAAGCTGGTTTTCCTTCCTACCCCGACGTGGGGAAATCACTTCAAGGTTTTCATGAATGCTGGACTTGG

FIG. 2 continued

```
TGTTAAGACGTATCGTTACTATGACAGCAAAACTCGTGGTCTTGACTATGAGGGTATGCTCGAGGACATAAGTGCAGCT
CCGACCGGATCGGTTATTCTCTTGCATGCA

> SEQ ID NO:5084 213734FL 237078_301250_1d
ACAGGGAGAGTAGCTTCCATTCCATTCCATCCGGTAGGGCTATGGCGACTAGCATGGCGCTCAACGAGATTGCTGCTCC
AGCGGCGTCCAAGATGTCTTCCAGCCCAGCCGCAAAGAGCTTCGTTGGGCTCCGCACGGCTGCGTTTTCCACGAAGAAG
GCATCTTTTCCATCCATGAAGTGTGCTGCGAAGGTCAATATGGCTATCGCTGCCGACGTTTCTCGCTTTGAGAACGTTA
GCATGGCACCTCCGGATCCAATTCTCGGTGTTTCAGAGGCATTCAAGGCAGATAACGATGCTACCAAGTTAAACCTTGG
CGTTGGTGCTTACAGGACCGAGGATCTCCAACCTTATGTTCTTAAAGTCGTGAGAAAGGCTGAGAAGCTCATGCTGGAG
AAGGGAGAGAACAAAGAGTATCTTCCTATCGAGGGTCTTGCCGCATTTAACAAGGCCACTGCCGAACTTCTACTCGGAG
CTGGCAATCCAGTTATCAAGAAtggccGGATtgccACCGTTCAagGCCTATCTGGAACCGGGTCTCTGCgTCTGgGAGc
TgcaTTTAttgcaagATActtccCct > SEQ ID NO:5085 213734FL 234369_301099_1d
GCTAGCGGGCTTGTCAGGAACGCGGGGAAGCGATTCATGTCTACTGCGGCGGCGGCTTCGGCATCGTCGGCTCCAGCTG
GAGCTCGATCCGGATGGTGGGAAGCCGTGCAGCCGGCGCCGCGGGATCCGATCCTCGGCGTCACTGAGGCTTTTCTCGC
CGATTCCGATCCCAAAAAGGTCAATGTTGGCGTGGGCGCGTATAGGAACGATGAGGGCAAGCCGGTCGTGCTGGAATGC
GTCCGCAAGGCCGAGCAAATCATTGCTGGCAAGCAAAATATGGAATATCTTCCAATGGGAGGCCTTGTGAAGTTTAATG
ATCTCTCCGTCAAGCTTGCCTATGGCGACTCCGCTCCAGTTCTTGAGGAGAAGCGAGTGGCCGCGGTCCAGACGCTCTC
TGGAACTGGTGCTTGCAGACTTTTCGCTGATTCCAGAAGCGATTCAAGCCAGACTCACGCATTTACATCCCGGTTCCT
ACCTGGGCCAACCATCATAACATTTGGAGGGATGCCCGAGTCGAGGCTCACACTTTCCGCTACTACAAGCCAAGTACGC
GGGGATTGGACTTCGAAGGGTTTGTGGAAGATCTGAAAAAAGCGCCGGAGGGATCTTTCGTCCTGCTGCATGCTTGCGC
TCACAACCCCACCGGAGTTGACCCTACCGCCGAGCAGTGGAAGGAAATTTCTCAGCTTTTCAAGAGCAATGGACTCTTC
CCGTTCTTCGACATGGCTTACCAAGGATTCGCGAGCGGTGACACTGTCAGGGATGCTCAGGCAATCCGCATCTTCATGG
AAGATGGACATCAGCTGGCCTGCGCACAGTCGTTTGCCAAAAACATGGGCCTGTATGGACAAAGGGTCGGATGCTTGAG
TGTCGTCTGCGACAACCCGGAACAGGCTGTGAACGTAAAGAGTCAGCTGCAGCAAATTGCTCGTCCAATGTACAGCAAT
CCACCGCTTCACGGGGCTCAGATTGTCACCACCGTGTTGAGCGACCCGGAGCTCAAGGAGATGTGGTACAAGGAAGTCA
AGGTCATGgCGGACAGGATCATTggAATGcGCGACGCTCTAAAAGCCaacttggagAAGCTtggCTCGAagc > SEQ ID NO:5086 213734FL 233065_301275_1d
TGGTGTTAAGGTTCTGATTTCGTCTCCTACATGGGGGAACCACAAGAACATCCTGAGTGACGCAGGCGTGCCATGGTCA
GAGTACAGATACTTTGATCCTCAGACTGTTGGACTGGATTTCAACGGCATGATTGAAGATATCAAGGCTGCTCCCAAAG
GCTCGGTGATATTACTTCACGGTTGTGCTCACAACCCCACCGGCATCGACCCGACACCAGAACAATGGGATGCAATTGC
CGATGTGCTCGAGGAGAAAGGCCATATGCCATTCTTTGATGTCGCATACCAGGGATTCGCGAGTGGAAGTCTGGATGAG
GACGCGAACTCCGTCAGGAAGTTTGCCAGTCGTGGTTTCGAGATGTTCGTCGCGCAGTCTTACAGCAAGAACCTTGGCC
TGTATGCGGAAAGAATTGGTGCGATTAACGTTATCCTGCCAACCGCAGACCTGGCGACAAGAGTAAAGAGCCAGCTTAA
ACGACTGGCAAGGCCTATGTACTCGAATCCTCCAGTCCATGGAGCACGCATTGTTGCCAACGTCGTCGGCGACTCGGTT
TTGTTCGACGAGTGGAGAGCCGAGATGGAGATGATGGCTGGGAGGATCAAGGGTGTGAGGCAGAAGCTCTACGAGGCAC
TGTCGACGAAGGACAAGAGCAGCAAAGACTGGTCCT > SEQ ID NO:5087 213734FL 207662_300827_3d
AATCTCGTTCCCAATCAACTCCGTCTGCCTCTCTCGCCCGCATCAACAAACATTGCGAGCCACATCTCTCCAC > SEQ ID NO:5088 213734FL 187320_300676_1d
CGGCGGATCGCCGGGAGCATGAACATGGAGTACCTTCCAATGGGTGGAAGCATAAAGATGATTGAAGAATCACTTAAAC
TGGCCTATGGGGAGAACTGTGAGTTCATCAAGGACAAGAGGATCGCAGCAGTGCAGGCTCTTTCAGGAACTGGTGCATG
TCGCCTCTTTGCAGATTTCCAGAAGCGTTTCTTGCCAGATTCACAGATTTATATACCCACACCTACATGGGCCAACCAT
CACAATATTTGGAGGGATGCCCAAGTACCACAAAAGACATTTACCTATTACCATCCAGAGTCAAGAGGACTTGACTTTG
CAGGCCTAATGGATGATATCAAGAATGCTCCAGATGGTTCATTCTTTTTGCTTCATGCTTGTGCGCATAATCCCACTGG
AGTAGATCCTTCAGAGGAACAATGGAGGGAGATATCTCATCAGTTCAAGGTGAAGAAACATTTTCCATTCTTCGACATG
GCATACCAAGGATTTGCTAGTGGTGATCCAGAGAGAGATGCCAAGGCAATTCGAATATTTCTTGAAGATGGACATCAAA
TTGGATGTGCACAGTCATATGCGAAAAACATGGGACTTTATGGACAAAGAGCAGGAT > SEQ ID NO:5089 213734FL 187223_300675_1d
ATGAGATGCAAGCAGTTTCTGTTAAGAGCCAATTGCAACAGATTGCAAGGCCAATGTACAGCAACCCACCTGTTCATGG
TGCACTGGTTGTCTCCATAATCCTTAATGATCCAGAATTAAAGAGTTTATGGTTGAAAGAGGTCAAGGGTATGGCTGAT
CGAATCATTGGAATGCGGAAGGCACTCCGGGAAAATCTCGAAGGCCTAGGTTCACCATTGTCATGGGATCACATCACCA
ATCAGATTGGAATGTTCTGCTACAGTGGGATAACACCTGAACAGGTGGATCGCTTAACCAATGAATACCATATTTACAT
```

```
GACCCGTAATGGCAGAATAAGCATGGCTGGTGTAACAACAGGAAATGTGGCGTATTTGGCTAATGCTATTCATGAGGTC
ACTAAAACGAAATGAAGCTACTTCCTCTTCCCTCTTCGGCCAATGAAATGAGGCTTGCAAGCGGCGGCGTTTTTTTTT
GGGGGGTGGTCTATTGACCTTTAAGATGGTTGTACTACAGAAATAATCCAGTGAACATGCTGGTGTTTCTCCAACTTCG
GATTTTCCCTGTATGGAG

> SEQ ID NO:5090 213742FL 204942_300794_1d
aCGGACATCATTGTATAGCTGTAAAATCACAACTCATAAACAGATCTCGTCCTTTACATCTTATTCTCTTCAAGCTCAT
CACAGCATCGTATCATCATAGTCAACATGTCTCTCCAATACTTCCCTTCCGTCAAACCCTCCGCCATCGCCCTCGGCAC
CTTCTTCAACCACGGCGTCGACCTCGTCGTCCTCGCCCCCGTCTTCGGCCAGACCTACCAGCGCGCAAAGGCCTCCAAC
ACAAAGGAGGAGTTCATCCGCTCCCGCGAGGCCAGCGGCGCCGCCGTCGCCTGGGGCACCTCGTTTGTGGGATCTGCCC
TGCAGAGCTACGGCGTGGGCGCGCTGCTTAATGCCACGGGCACCCTGAGCCACAAGGGCGCTGCGTATCTCGGCGCCTT
GATCTTCGCGGCGACGTCAGCTCCTGGATTCATCTCTCAGATCTTTAGCGAAAAGAGGCCTCTTGACACCGTCGGCGTC
AATGTCGCTGCTAAGCTGCTCGAGACTATCGGCCTGTCCTTGGTTCTCAACTGGTGGGGAACCAGGACCAATCCCTTTG
AGTAAATGGGATATCTCTTCGTAATTCTTTCCTGAGGCTGGTTCTGGGAGGAGTTGACAGGGAATGGAAAGGCCCCATC
ATATATGAcggccTTTGttGTATAACATCACACCTAAATtAGtc > SEQ ID NO:5091 213742FL 253007_301648_1d
GTCTCTCCACTACTTCCCCCCCATCAAGCCCTCCGCCCTTGCCGTCGGCACCATCTTCTCCCACTTCTCCTCTTTGATT
GGTTTCGCCCCCGTCATTGGCGACACCATCAAGCGAGCCAAGGCCGCTGACACCCCGAGGAGTTTGCCCGACAGAAGG
AGAACAACGGCGTCCTCGCCCTCTACGGATCTTCTCTGCTCGGCTCCGGTCTGCAGTCTTACGCCGTGTCGGCCCTGAT
TGTCCTCACCGGCACCACCACCACTAAGGGTGCTGCCTACCTCGGAGGTCTCATCTTCGCCGTCAACTCCATCCCCACC
CTCGTCACCGGAATCTTCCAGGAGAACCGACCCGTCGAGTACCTCGTTGGCAAGACCCTCTCTGCTCTGCTGGAGACCG
TTGGTCTTACTCTCACTCTGAACTGGTGGGGAACCCGAAACGAGACTCTTTCTCTCGCCAAGTAAGCTGTATATTAATG
CATTATGATGATTc > SEQ ID NO:5092 213756FL 215257_300879_1d
GCGAATGATGCTGATGGATTGATGATTTGGGGTTCAGGCTTTTTCCCTTCTCGCTCGTCGCCACAATGTCAATTGCATC
AGCGCCCAATGCGCTTCGAGCCTCATCAGGGTGCGCCTCAAGGCTGGGGCTGTCTCTCCATAAAGGCCCATCATCAAGC
CTTCTCCTGCGGGTAGCAAGTGTCTCGACAACTGCGCCGCAATGCAAGCGCAAGACAAAGGACAGCAACAAGCGACTAG
GCGTCAGGATCCTCTACGGATCGGGCCCGCGAGAGCCGGTGTCCATGTCCAACATGCCGCTGCCG > SEQ ID NO:5093 213783FL 210779_300892_1d
TCGACCCACGCGGGCGCAACAACATCCACTCAGCTGGCCTCTGGCTTCACCTCGGAACCCGATTGTCAGCTCCGCCAA
TCCAGCCATGGTTCGGCTGCCCAACCACCCTCAAATTAGAAATACTCAGGCCCAGCAGCATGTCGCGCAATACCATCAG
CACCCATCCTCCGCACCAGCCACGCCAGCCGCAAGCATAATACTAAATAGACAGTTTGAGAGCTCAGCGGGCCCGGCCA
CAAAGAGAGGGCCGCGGTCCATTACAGGGCCCGGAAATCTGCCGACAACGTCAAGCGGCTTAGCGAGACATTCATCCCT
TGGTCCTGGTATACCTAAGAGCGGCTCTGGAGCTAATCTGGGAGCCGGCGGTGCTGTCCGGGCAGGAAGTGCTGGACCG
AGAGCAGGATCGGTCAAAGGGGTAGTTGGAGTAGCGGGTCGCAGAGGCACCCCGACGATGAGTGGTCGGAAGAAGCCAC
CCAACAGATCGTCACTTTCCCGGGTGAAGACGGCCTCAAACAGAAATTCGCCGGCAT > SEQ ID NO:5094 213829FL 135410_300414_1d
GCGAGACTTCACATGTACGACTGGATAATACTTCTACTCCTTGCTGTTATAGATGGACTGTTGAACATAATTGAACCTT
TTCACCGTTTCGTCGGGAGGGACATGATGACTGACTTGAGATATCCATTGAAGGGCAATACTGTTCCCTTCTGGGCTGT
TCCGCTCATTGGAATTGTATTGCCTTGTGCCATCTTTGGTGGAATTTACTTCAAAAAGAAGAATTTCTATGATTTGCAC
CATGGCATACTGGGGATCCTATACTCTGTGCTTATAACTGCGGTAATCACAGATGCAATTAAGGATGGTGTGGGTCGTC
CACGCCCAGATTTTTCTGGCGCTGTTTCCCAGATGGAAAGGATGTTTATGATAATGTCACTACTGGTGTCATATGCCA
TGGAGAGAAGAGTGTCATCAAAGAAGGTCACAAGAGCTTTCCAAGCGGGCACTCTTCATGGTCTTTTGCTGGTCTAGGC
TTCCTTGCATGGTACTTAGCTGGGAAGATCACAGTTTTTGATCGTAGAGGTCATGTTGCAAAGCTATGCATAGTATTTC
TGCCTCTTCTTACTGCTGCACTTGTGGCTGTTTCTCGAGTGGATGACTACTGGCATCACTGGCAGGATGTATTTGCAGG
CTCTCTGATAGGTCTTACAGTCGCATCATTTTGTTATCTGCAATTCTTCCCATATCCTTATGACGC > SEQ ID NO:5095 213894FL 219319_300944_1d
ggtacgttattgttttttgttggccttttcactttggtTtgttttaatttcttcgttttgttttctgttgcagagg
aGAAGCGTGAAGATAGGAGAGAATAGAGATAGAGAGGCAATTGCACGGAATGTTTAGCCAACAAGTTGCTCGTGGCGGG
CGCCGCATCGGCCAGATGGCTCGAGGCGGCCAATATCCGTCACTCGCTGCGCTCAGAGGAGCTGCTCAACGACGATGTT
ATGCTGAGGCTGCACAGGCAGCCCCCAAGGGACGTATCGGTCGAGGCCTCGGGCTGCTCCTGTATGGCGTTGCATTTAG
CGGCCTCGGAGCAGCAGCAACATTCTATTCGATGGTACAAAAGGGTTTCGCCTCGTTCACCGACGCCGAGTCAGCCAAA
CTGTTTGTCCCAGATAGCGACGAGCTGCAACAAATCGAAGAGACAATCAACAAACACCCGCTCGTCCAAGAGCTTCGAT
```

```
CACGACCAGAGTTCAAGGAGTCACGACCACACCTAAAGATGTCAAGCGAAGTCCGCAGCCGCACCCTCACCGGCGGCGC
TCTACAAGGCGACGGCATGATCATGGTCCCCCCCGTCGCCTTCATCGAGGACGGCGGCAAGTCCATCGTCAGCGTCACG
TACATTGGCGACAAACTATGCGGCCACCCAGGCCTCGTGCACGGGGGCCTGCTGGCGACGATGCTGGACGAGGGGCTGG
CGAGGGGCTGCTTCGACGCGCTGCCGCACAAGATTGCCGTGACGGCgagcctggagaTCAACtACCGCAAgccgac > SEQ ID NO:5096 213909FL 212092_300873_1d
atcatctaattcaagtatgtcatatcccgcggtgtgtgatgcgatgtgatgtgattgactgatgctgatctttgtcgat
tGTTTTACTTGTAGCAAACTCAAGTATAACTTATACCTACTATTTATACCTACTCAACAGTATACTCGACCTTGTCCAA
CAAAATCAAAACAAAACAACAACCGAGGCAAATCAAATAACAAACTACCTCAAAAATGGACTCTTCACCACCAACAACC
CCAACCAAAACTCAACAATCACAAAACCTCCAGCAATCTTCTCCTCACCCCCAAGACTCCTCCCCCGCCTGCCAATCCG
CCATCAAACACTCCTCATCGTGGAAGCCCAGCTCGCTCGACCGCCGCCTCAGCTGGAGCTCCCAGGACCAGAAGCACGC
GCTGCAGATGAGCGGCATTGACGGCGTGCAGTCGGGACACCAGGGCTTTACGGAGCGATGAATGCCTTTCCATCCAGTC
GGGGTCTTTCTTTCTTTTTTTATTCTATGGAGAGAAGGTGTAGATTGGGAATGAAAGAGGGGGAAAGAAGATGAATTCA
TAAAACTCTATATGAGCGTGGTTTTCTTCTTCTTCTTTCTTTTCAATGATTTGATGAAACAAAAGGGCTATTG
GGAAAATTTGGGAAATTGGGTCACTGGCATTGCATGGCAACGGAGCGAAAAAGAAAAAAACAATAGGcaTAATgcacgC
GACTttgTGTGt > SEQ ID NO:5097 213935FL 1042887_301879_1d
GTGGGAACCCGCGGCCTCAGCGAGCCTAACATCGTTGTTGGCGCTGCGTTCGGCTATGGCGGTCTCGTTCAGCTTTTGG
CTGGCATGTGGGAAATCGCTCTCGGCAACACCTTCGGTGCCACTGCTCTTTCATCTTACGGTGGTTTCTGGATCGGAAC
AGCT > SEQ ID NO:5098 213935FL 204388_300792_1d
ATAAATAGTAGCTGCTTGTTGTGAAGCACTGCTTTCATCAAAACAAGTACTCTCCAATCACATCTGGTGTTCGAACAAG
GTCACCACCCAACAACATTTCGCATATTCCATCAGGTCGATCGATTCCCAAGTCCGACAATCACCATGGCTGACGAAAC
CGTCAACATCGCTCCCAATGAGAAGGAGACCAACGGTGTCCAGCAGCAGACGGCGGTACCGCGCCAGGGCTTCACACAC
AACCACCACAGCGACTTCAATGAGATGACCATTGGCCAGTATGCTCAGGCTTTTGGTGGTGCTCTCCAACCCGGGGCAT
GGAGGCCATATGAGCACCGCAAGCTCGCCAACCCCGCCCCTCTGGGTCTTTCTGCTTTCGCCTTGACTACCTTTGTCCT
CTCCGCCATCAACATGCACGCTCGAGGAGTCTCGGCCCCAATGTCGTCGTCTCTCGCCTTTGGTTATGGCGGTCTT
GTTCAGCTGCTTGCTGGCATGTGGGAGGTTGCTGCCGGTAACACCTTTGGTGCTACTGCTCTGGGTTCATATGGTGGTT
TCTGGATCTCATACGGTATTCTCTTGACCCCCGAATGGGGCATCACGGCTCCTGATGGCCCGTACGAGGGCAACGTTGC
TAGCGTGCTTGGCTTCTTCCTGACTGGCTGGTTCATCTTCACCACTGTGCTTCTGCTCACCCTGCGATCCACTGTT
GCTTTCTTCCTCCTCTTCTTCTTCCTTGACCTGGCCTTTTTCTTCCTCGCCATGGAGCAATACGCTGCCGACTTGGGCA
ACGCGACCGCTTCCCTGGCTCTGCAGAAGACCGGTGGTCTCTTTGGTTTCTTGGCTGCTTTCGCGGCTTGGTACAATGC
CTTGGCCGGTATCCAGGACAGCAGCAACTCCTTCTTCCAGGTTCCCGTCATCCACTTCCCCTGGTCCGAGGCCGCTCGT
GAGCGCCGTGCCAGCAAGTCTGAGCGTGCTCAGGCATAAATTTCGTCTTTGGAAGTGTGATCTGTTCTTGGTTATGATG
AGCGATGTTGGGAAAAGGAATGATACCTGAGTGAAGCGAGCGCGCGGTTCCTAGCGGGCTGGGCTGCGAGTAAGAATGA
ATACAACTGGGCCTTTTTTCTTTTTTTATCTGGTTAACAAACGTTATTGCGATGTAATACAGGAAGCTGCATACCAGCT
GCTGATATACCTATTaATGAAAAaaaaaaaacaaaaacaaaacaccc > SEQ ID NO:5099 213935FL 223992_300977_1d
gccctcttctacaaccatgaacaccgaaatccccgatctcgaaaagcAGCAGATTGACCACAACTCTGGCTCTGACGAC
CCCCAGCCTATCCACGACGATATGGCCCCCGTGTCTCGAATCCGATCCTCTGGACCCAACCACGAGTACATTCATATTG
CCGACCAGAAGTTCCACAGAGACGACTTCTACAGGGCCTTTGGTGGTACCCTGAACCCCGGTGGAGCTCCCCAGCCTTC
CCGAAAGTTCGGTAACCCTGCTCCTCTCGGTCTGTCTGCCTTTGCCCTCACTACTCTTGTTTTCTCGCTGTGCACCGTC
CAGGCTCGAGGTGTCCCCAACCCCAGCATCGCCGTTGGCCTTGCTCTGTTCTACGGAGGTGTCTGCCAGTTCGCTGCCG
GTATGTGGGAGTTTGTCCAGGAGAACACCTTTGGTGCTGCTGCTCTTACTTCGTACGGAGGTTTCTGGATGTCTTGGGC
TGCTATTGAGATGAACGCATTTGGAATCAAGGACTCTTACAAcGAccCTAttgaggttCAGaACGCGgtTGgTAtttat
cTgtttggaTggttCAtTTTCACTCTCATGCTCACTCt > SEQ ID NO:5100 213935FL 218079_300914_1d
AAAATCGCTCCCAATGAAAAGAGACCAAAGGTGTCCAGCATCAGAAGGGGGTACCGCGCCAGGGCTTCACACACAATC
ACCACAGCGACTTCAATGAAATGACCA > SEQ ID NO:5101 213935FL 200372_300758_1d
TCTCGACCACGCGTCGAGTAGCTGCTGTTGTGAAGCACTGCTTTCATCAAAACAAGTACTCTCCAATCACATCTGGGGT
TGGGTCCGAACAAGGTCACCACCCAACAACATTTCGCATATTCCATC
```

FIG. 2 continued

> SEQ ID NO:5102 213962FL 210926_300894_1d
AGCTGGATTACGAACGAGGATTGGGAGCATTCAAAATTCACATTGTCAACCACGCATCGCAGCACCTATACGTGCATTT
TCGACTATGGCCTCCAACAAGGATGCGCCAGCTGCGATTAAACGCAAGGACCTCTACGAGGCCCTGAGGCTCTCGCGAC
TCCCAGATGAGCAGAGCGGCTCACAGGATCCCATCAAGAGATTCGTCAGTCGTACACCAGCCTGGAGGCCTGGGAATGA
GCTGCCATGGGGATCAATCGACTCTGAAGGGTATAAGAAGGGCAACACGGTTGACTTTAACCCGGCTGCGTTTGGAGGC
CACGTCTTCGCCCAGGCACCCTTGGCGGCTGCGAGAGCGGTGGAGGAAGAAGAGAATGGCAATGGCAATGGCAATGACA
AACTAGGCATTCATTCCATCCAAGGCGTCTTTACAAAAGCGGGCGCGATTGATCGGCCATTCATCTATGATGTGACAAA
TGTCCACTCAAGCCGTTCATTCACCACCAAGCTGGTCCAGGCACGGCAGCCCACAGAGGCTTCAGATGCTCCGAATGgc
cCATTCCCCGAGTCTGATGCGAATCGGCCGCTGGGCCCCGTCAGTTTcacctGTCTCACAACGTTCAAGCGTCCCATTC
CCATGCCatcgcCCGCAGAGCTGCAGATCaaagggTcggCAcaggaaCGCTat > SEQ ID NO:5103 213967FL 220892_300939_1d
ACACAATTCCTCGCTGCGTGTGACTCGTGTCTCCAGCAAATACCGCAAAGATGTCTGACGACGGGCTCTCAATATACGA
TGAGATCGAAATCGAAGATATGACCTTCGACGAGGTTCTTCAAACATACTTCTACCCGTGTCCCTGCGGCGATCGTTTC
CAGATCGCTATCGATGACCTGCGCGACGAGCAGGATATTGCTGTGTGCCCCAGCTGTAGCTTGATGATTAGAGTTATTT
TCGACCTTGACG > SEQ ID NO:5104 214014FL 206406_300822_1d
GCAACCTAAGCGCACCTAGATATCATGGCGGACAACACTAACCCCGGAAACTTTGCCAACCGGTATGATATCAACAGCG
GTTTTAAAAGTAAATCATTGACCAATTGTTGTTAGCCCCAAGGAGGAAGTGCAGTCGATTGCATCCAAGGGTGGACAGG
CGAGTCACCAGGGCGGCTTCGCTTCCATGGATCCTGACAAGCAGCGCGAGATTGCGTCCAAGGGCGGCCAGGCCTCTGG
AGGATCTTTTGAGCCCGGAAGCAAGAAAGCTCAAGAGGCGGGCCGCAAGGGTGGTTTGCAGTAAAGCATGACCGTAACT
CTAGTGTCGATTCACTGGTAGACGGTGTGATTATCTCTTATTGTAGATAAACATACACTAGCAATTTTGCTCTAATACA
AACTAATTGGTCCTAC > SEQ ID NO:5105 214047FL 224072_300978_1d
acatttcgaacacacaacacAATGCACAGAACATACTCTCTCCGAAACAGCAGAGCTCCTACCGCTGCTCAGCTCGCCT
CCCCTCCTCCTCCCACCTCTTCTACTAAGAGCGGACGATTCTTCGGCAATGGTTCCATTGTCCACTCTTTCCGACGATC
CGCCGCCGGCTCCATGGGCCCCGATCTCGCCCGAAAGCTCGCCCAGCTCGTCAAGATGGAGAAGAACGTGATGCGATCC
ATCGAGCAGCAGGCCCGAGAGCGACGAGAGGTTGCCAAGCAGCTGTCTCTCTGGGGTGAGGACGCGTGACGAGGATGTCT
CCGACGTCACCGACAAGCTCGGTGTTCTCATCTACGAGATTGGTGAGCTCGAGGACCAGTTCATCGACAAGTACGACCA
GTACCGAATCACCCTGAAGTCCGTGCGAAACATTGAGGCTTCCGTCCAGCCCTCTCGAGACCGAAAGCAGAAGATCACC
GACCAGATTGCCCACCTCAAGTACAAGGAGCCCAACTCCCCCAAGATTATTGTTCTTGAGCAGGAGCTTGTCCGAGCCG
AGGCTGAGTCCCTTGTCGCTGAGGCCCAGCTCTCCAACATCACCCGAGAGAAGGTCAAGGCCGCTTTCAACTACCAGTT
TGACGCCATCCGAGAGCACTCCGAGAAGCTCGCTCTGATTGCCGGCTACGGTAAGGCTCTGCTCGAGCTGCTCGACGAC
ACCCCCGTCACCCCCGGTGAgtCTCGACCCGCCTACgaCGGCTAcgAGGCCTCCAAGCAGGTCATCATCGATGCCGaga
ACGccCttgcaagctggactctGGACCAGGCTTCCGTCAAGCCTACTCTGTCCATCCGACGAGCTGACGTTGACGACTA
CGATGACGAGGAAGAGGAGGGAGCCGAGTGGGCCGAGGACGAGCCTTCCGCCGTTGTGGAGGAGGGCAAgGTTCTTGAC
GCCTAAGTCTGCCGTGGAAAAGGACATGCTAATTTTTGTTGAAAAGTCTCTTTTGTATTTTTAACTACTTTTTACTACT > SEQ ID NO:5106 214087FL 221036_300941_1d
ACAACAAACAACGAAACAACCGCCCAATCGCCAATCGCCGCCTCGACATGGTGCTCGGCGACTACGAGGAAGCACAATA
GGCGGGACGCGAAGCAAACAAGCGCTGGGCGTCTGAGAAGTAGCCCGAGAGTCACAGCTACAGCTACAGCTACAGTGAA
CACGCGATAGAGTGATTCAGGACATCCAGAGACGAGACGAGGCGCCTGAACGAGATACGAAGCAAACAGACACGGGAAA
GCAGATGCAATGTCGGCAAACGTAACAAAGCCGGCGCCCAATCGGCCGCAGCGGCGCGTAACGGCCGGCCAGATCCTGT
CGATGCCGCCGAAATGGCTCGGCATGTACGACGAATTCATCACCAAGAACGCCGGCCAGGTGTCGCAGATTGAGAGCGC
GCTGAGGAGCTTGACGTATATCATTCCAGGCCGCTTTCGCGATGCTGAAATCGCCTCCGAGTCGATTCACTCGGGCGTC
CAGCTGCTGTCGCTCTACCACGACGGCATCCTCTCGCAGGCAGTGTCCAAGCTGCCCACGCCGCCTGTCCGGTCGGCTC
ATGCGCGCTACACGCGATACTGGACGCAGAAGAGCAAAACGTACCGCAGGATAGCCATGGTGCTGCAGATGGTCGTCTA
CACGGAGCTGCTGTGCGAAATGAGCGCC > SEQ ID NO:5107 214135FL 214110_300855_1d
GGAGCAGCTGTCCTTGACTCCAGCTAGGCATGGAGAGATTTTTGGGCGGTTTGCGGTGCCTTTTGCGGTAAGGCTGAGC
AGTGTTTGAGGTCGGGGAGAATGGATGGAACGAAATCGAGTTTGGCTGCGTGGGGGCCGCAGATCGCATGTCAGATCGC
CGGTCGGTCTGCTAAGCGATGCTTAAAGTCGGAATTGCCCGATCGAATCTCCATTCCGATGGCGGAGATAGAAGGCTGT
ATGATGGAGAGCCAGTCTGACGAGAACATGGGAAAAGATGGAAGATGGGGATGGAAAGGAAATGGAGATGGAGATGGCG
ATGGAGATGATAGAGATGGAAAATGGAAGATGAATATCTATTACTCTGGGCTCGAAGAGAGTCAGTAGAGTCAGAACGG
TGGGGGAGAGATACCTTAGGCTTTGATGTGCTGAACGCGCGAAACATCGCGAGAACG

FIG. 2 continued

> SEQ ID NO:5108 214138FL 1174232_302095_1d
aacAGAGGATGGACACCTACTACATATCCCATGGCTCCCCCATGCTCCCCCTGCAGTCCTCTGCGGATGCCCACGGCTT
CCTCTCCCGCTGGCGGGAGGTCAACCTCCCCGACAAGCCCACCGCCATCCTCTCCATCTCCGCCCATTGGTACACCTCT
GAGCCCCTCATCAACTCTGTCGCGAAAAACGACACCATCCACGACTTCTATGGCTTCCCTCCCGAGCTCTACACTCTAC
AATACAATGCTCCTGGGTCTCCTGCCCTTGCTCAAAGAGTGAAAGAGCTGCTCAAATCTGCGGGGTTCAAATCGGTACG
GGAGGACCCCAAGAGAGGGTTGGATCATGGTGCTTGGGTGCCACTTTACCTCATGTATCCTGAGGCTGATATACCAGTC
GTCCAACTATCTGTGCAACCACACAAAGATGGTGCCCATCATTTCAAAATGGGGCAAGCCTTGGCACCCCTCAGGGATG
AGGGTGTCCTTATAATGGGATCTGGAAGTGCTACCCACAATCTTCGAGCTTTGGACTTGAGCAATGGACCTCCCCCTGC
TTGGGCCCTGTCTTTTGACAATTGgCTCAATGACTCTCTAATCAATGGAAGGTTTgAAGATGTGATAAATTATGaaAAG > SEQ ID NO:5109 214138FL 204492_300817_1d
GAGGGAAAGAAAAATAGATAAAAGGGCCAGGGTCCGACCGTGTTGATTTGGAGTTTTGTGTCAGCACAGGATTTTGATG
AGACTGTTATTGAAAAGACTCTTTGCCTTGGTTGGCAGATTGGTTGTATTAGGCATACTGTTTCGATACGCTTCAACGT
ACTTTTTGAGTCGCAAAGCTACCATGACTGTGGCTCCTGTGATTGCGCTCTCACATGGTGGAGGTCCCCTCCCTATCCT
TGGTGATCCCTCTCACAAGGACATTGTTTACTCTCTCAAGAACAGAGTGCCCAAGATTCTCAAGCTCGGGACTCCT > SEQ ID NO:5110 214138FL 285345_200104_1d
GGGCCTTTGAAATTGAAGGAGACGTTCTTCATATCACATGGTTCCCCTACGCTTTCCATAGATGAGTCTTTGCCCGCCA
GGCACTTCTTAAAAGGCTTTAGAGAAAGATTTTTAAATCAAAAGCCGAATGCGATATTGATGATTTCTGGTCATTGGGA
AACTTCTGAACCAACTGTTAATTCTATTCGTGGCCGCCATGATACCATTCATGACTTCTACGGCTTCCCTAAACCCATG
TACCAGCTCAAATACCCTGCACCAGGAGCTCCAGAATTGGCTAAAAGGGTGAAGGAAGTTCTCATGGCATCAGGGTTCA
CGACAGTGCATGAAGACAAAAAAACGTGGTTTGGACCATGGTGCATGGGTCCCTCTGATGCTCATGTACCCGGAAGCAG
ATATTCCAGTCTGCCAGCTCTCGGTCCAGCCCAATAGGGATGGTACTTATCACTACAACATGGGAAGAGCATTGGCCTC
CCTCAAGGATGAAGGTGTCCTCATAATTGGTTCTGGATCAGCCACTCACAACCTAAGGGCTCTCGGTTCATCCAAAAGT
GTTGTTTCTTGGGC > SEQ ID NO:5111 214138FL 239374_301303_1d
GGGGTCCACAGCACAGGTAATAACAATTGGGCCATTCCGCCGCCATATCGCCAGCCTGCTGCAGGGGGGCAGCAGCAGC
AGCAGCAACAACAACAGGAGCAGCAGCGTCCGCAGCGGCAGCAACATGATGATGGACGTGCTCTATGTGTCTCACGGCT
CACCCATGGTGCCTTTTGAGGAGATCCCAGTCAGGGACTTCTTGAAGGGCATGGCCGGGCTGGTCAAGAGCAGGCCCAA
GGCAATTCTCATGGTGTCTGGCCACTGGAGAGACGGGAACCGACGGTGACTACCACAGCGCGAAACCCCACGATTCAC
GACTTCTATGGCTTCCCTCGCGAGCTCTACGAGCTCAAGTATGATGCGCCTGGTGCTCCGGACGTAGCCAAGCGAGCAA
AGCAGCTTCTCTACGACGCCGGATTCAAGCAAGCTGGCGAAGATCCCACACGAGGCCTGGATCACGGCGCCTGGGTTCC
ACTGTCGCTGGCGTTTCCAGCCGCTGACATTCCAGTTTTCCAGTTGTCTCTACAGTCTCACAAGGACGCTGCCTACCAC
TACCAGCTAGGCCGTGCATTGGCTCCGCTCAC > SEQ ID NO:5112 214201FL 195674_300636_1d
AATGGGTAAACCATTCCCGCAAGTTCAGCCTGGAGGGAGCCTGATTCTGGCTTACCGCGTCAAGGACAAGAATGTCCTG
GTGGTAGGCGGTGGTGAGGTCGCGGCTGGCCGCATCCTCAACTGCCTCAATGCCGATGCCCAAGTCACCGTCGTCTGCC
CTGCGTCAGGCCTCAACGAAGAGGTCGCATTCCGAATTGCCGAGAAGCAGGTGACACACATCGACCGCCTGTTCGAGCC
GTCCGATTTAGACAAAGCAGACATGGTGCTGGTCGCCATTGACGATCCGGCAGCCTCGACAGCGATATGGAAACTGTGC
AAGGAAAAGAGAATCCCGGCCAACATTGCGGACGTGCCCCCTGAGTGCGACTTTTACTTTGGCAGCGTCCATCGTGACG
GGCCTCTACAGGTCATGGTCAGCACCAACGGCAAGGGACCGCGGCTGGCGGCATCACTACGGCGGCATATTGCCAGCCA
ACTACCGCAGAATGTTGGGAATGCTATTGAGACAATTGGAGAGTTGCGGACACGGCTGCGCAAGGTTGCCCCCAATCAT
GAAGACAGTCAGAAGCGAATGCGATGGATGTCaaAAGtcagTGatacctacaaGTgggaagaGaTGagCGaaatcacg > SEQ ID NO:5113 214259FL 200377_300816_1d
aagatcaggacaagacaattCGAGAGTGCCAAAAACAGCAAAAGGGCAGAGAGACGTCATCATGGCTCAGGCCAAGTTC
GCCGTTTATCCCAGCCTCGTCGACCGCACCGTCGTCATCACAGGTGGTGCGCAGGGTATCGCCGCCGACATGGTCGAGC
AGTTTTCCCTGCAGGGTTCTCAAGTCATATTTTTCGACGTCGAGGACGAGCTTGCCGCTGATTTAGTCCGAAAAGTGTC
TGATCAGGGCGTCAAACACAAGCCCATATACTACCACTGCGATGTCATCAAGATCGACGAGGAGCTCAAACCCACAGCG
GCCAAGATCCTGAAAGACCATCCCAAGATCGACGGACTCATAAACAGTGCCGCGAGGGCAATGGTGAAGCCCTCGCAGG
ATATCACGACTGAGTGGTGGGATGAGAGCGTCGCCGTGAACCTGCGGCATCAGTTCTTCCTGACCCAGGCCTTGCTGCC
GGGGCTTCTCCTTGCTGCTGGAAACGCTTCGGTGATTAACATGGGGAGCATCAACTGGCTCGTCTCTGCGACGGGTCAG
GCGCCTTACACGACGAGCAAGGCCGCCGTTGTGGGACTGACGAGGACGCTGGCACATGAGTTTGGACcgca > SEQ ID NO:5114 214370FL 212920_300845_1d

FIG. 2 continued

GGGGGGAGAAGAAAAGCCAGAAGATGCGATGGGGCCGTGAGTTTGAGTGTGAGTATTGCGGCGTTGTCCAGGTACAACG
GGGGGGACGAAATGCGAAAAGCGCACAAGACAAGGTAAAGGAAACGGCTAAAAGAACAGACAGGGCGTGAGGATAGGAA
AAGGAAACAAAAACGAAGAGATTCCCAGTATTAAATGAAACGAATATGCGCCGTAGAGTAGAGAGGCACCAGAGCAGAC
TTCGAGAGTCGCTGGCGAGCTTACAATGCGGTACCGAACTTCATCGCGACGTTCGATGGGGAAAGAAGAGCAGAATCGA
TGACGGCCATGGGGGTCGTGGCATAGCT

> SEQ ID NO:5115 214421FL 220363_300954_1d
ggccagaacCGCGCGAGTATACATCTATCTGCAACATCTCTTACCTCCATCTTCGCAATGGCTTCTGATAAGATGGACC
GCGGCCTCGACGAAATCATTGCAGACAAGCGCAGCAATGGATCTCGAACCCGACGCGGTGGCGACCGCCGTCGTGACCG
TCAAGACTATCCCCGTGATGGGGTGAAAAAGTCTCTCCGCAACGAACCTCGAAACTTGGATAGCGAATGGGTACATGAT
CGATACGAAGAGAACACGTATCGCAATAGAGGCCCTGCACCGCGTCGCAGGCGCGAGTCTCCCAGCGGGGGAGATGCCC
GCGGCGCACGACTCCGAGTCGAAAATATCCACTACGATCTCACCGAGGAGGATCTCGATGAACTTTTCCGAAGAATTGG
CCCCATCACAAAATTGCAACTGCGTTATGATCGGTCTGGACGGTCCGAAGGTGTAGCTTTCGTAACGTATGAGAGCAAA
GACGATGCCGCAGAGGCTGTGAGACAATTCGATGGTGCCAATGCGAACGGCCAGCCAATTCGTTTGTCCGTCATGTCAA
GTGGGCCTTCTCGAAACCCGTTTGATACTGCTGTGATGCCAGGCAAGCCTTTGTCCGAACGCATTTCTGCTCCTGGTGG
CAGATCTCGATCACTCTCCCCTCGCCGATACGATGAAGAAGatgccgCTCGCAGAGGCATTGATCGATAtgttccaggc
GGAAGTCGCT > SEQ ID NO:5116 214423FL 129424_302308_1d
GAAAAATGGAGCTCAATGATTAGAAATTATCAATACTTCGTCCAAAGAAATGGAGGAAGTTGTTTGGAATCCAGCATGA
AGAAAACAATAGAGAGAGGAGGGGGATAGGAGCGGGCCAAAGTGCCTCTTATCTTCAACTTTTAAAAATTCAAATTTT
ACAGAAGGGAGAGCTCCCCAGCAGGAACAGTTCTCTTTGACAAGTTTAGCCCAAGCTTCGTTGGTTTCAGTTATTACCTT
CAGAGCATAATCCTTGTTGGCTGCTTTGTTCCCAAGTCCAAACTTATTGGCAGGCTTTCCATCTGGGATCTTGTAGTCT
CTGAACCAATCTCTTATAGCAGTGAGAGTGCCCGGGAAATGTTTCTCAACATCACCAACATCATTGACGAGTGAAGCTT
TTGGGTCATCCAACGAAATCGCAACAATTTTCCAGTCGAGTTCTCCTTCGTCAATCATAGCCAAAGCACCTAAAGGCTT
GACTTTAAGAATCTCGCCAATTTTTCCTTGCCTCTCCCCAATTTCAACAACATCAACTGGATCATTATCTCCGAATGGC
CCTTCAACTTCAGAATTAGCTACTGTGGGGTCTTCCCATGTCTGTGGGAGCAATCCCATAGTTCCAATTGATGTTGT > SEQ ID NO:5117 214423FL 226311_300996_1d
agcaacATGTCTACCTACACTACCCGGTCCATTGGTGCCCCCAACACTCTCGACTACAAGGTCTACATTGAGAAGGACG
GCAAGCCCGTTTCCGCCTTCCACGACATTCCTCTGTACGCCAATGCTGAGAAGACCATTCTCAACATGATTGTCGAGGT
TCCTCGATGGACCAACGCCAAGATGGAGATCTCCAAGGACCTTGCTCTGAACCCCATCATCCAGGACACCAAGAAGGGC
AAGCTCCGATTCGTCCGAAACTGCTTCCCCCACCACGGATACATCCACAACTACGGTGCTTTCCCCCAGACCTGGGAGG
ACCCCAACCACGTCCACCCCGAGACCAAGGCCAAGGGTGACAACGACCCGCTCGACGTCTGCGAGATCGGTGAGACTGT
TGGCTACACTGGCCAGGTCAAGCAGGTCAAGGTCCTCGGTGTCATGGCTCTCCTCGACGAGGGTGAGACTGACTGGAAG
ATCATCGCCATCGATGTCAAGGACCCTCTTGCCTCcaaggtcAAtgACattgaggatgttgagCgacacctgcCCGGTC
TTCTGCCGAgccaccaacgaatggttCcgaatCTACaagatccctGACGGAAAGCCCgagaac > SEQ ID NO:5118 214423FL 216388_300868_1d
GCCCGTCACCTGGAGAAAAGCAGCGACTCTTCGTCTTCGTCTCCAACCACCACAATGTCTGGCTACACCGTCCGCAAGG
TTGCTGCCCAGAACACTCTGGAGCACCGCGTCTACATCGAGAAGGATGGCGTCCCCGTGTCGCCCTTCCACGACATTCC
TCTCTTTGCCAACCAGGAGCAGACCATCCTGAACATGGTTGTCGAGATTCCTCGATGGACCAATGGCAAGCTCGAGATC
TCCAAGGAGGAGCTCCTTAACCCCATCAAGCAGGACGTCAAGAAGGGCAAGCTTCGCTTCGTCCGCAACTGCTTCCCCC
ACAAGGGCTACCTCTGGAACTACGGTGCCTTCCCCCAGACCTGGGAAGACCCCAACACCGTCCACCCCGAGACCAAGGC
CAAGGGTGACAACGACCCTCTCGATGTCTGCGAGATCGGTGAGCTTGTTGGCTACCCCGGCCAGATCAAGCAGGTCAAG
GTCCTCGGTGTCATGGCCCTTCTCGACGAAGAGGAGACTGACTGGAAGGTCATTGTCATTGACGTCAACGaaccccttg
atCCTAAGTTgAACGaCgTTGAGGACGTCGAgcGCCACCTgactggCcTg > SEQ ID NO:5119 214443FL 199653_300751_1d
CAAAAAGGCTCCAGGCATCGTCTTTGACAAGGAGGACTACACTGCTCGCTACAACTGGTCAATTCCGCTACGTTCATAC
GCGGAAGAAAAAGAACATGTCGCTAACAGCAATCGCAACAACAATGCAGACGGCTCTGCAACGAGCAGAAACGATGGAT
CCCGCCTCTCTAAGCCTTCTCCAGAAAGGCTCTTCCCACAATTCCTCTCCCAACTATGGAGCCTCCGGAACGGTGACAA
GAGGGATATTGCAAGACTATCAGGCGGTACCGACCAGCGATGAAAGCGATGCCACCCGTCCGAGAAAGGTTTCATACAG
CGATGCGGCGAAGAAGGCCGGGAACCATGCGAAGAGCCAGAGCTCTCTGCGGCAACGAAACGGAGTCTCCGGCTCGGAG
GATACAAGATCGCCAACAAAAGCAAAGTCATCATGGACGAAGGAAACATTTCGAAAATTTCAGTCCCTTCAGTTGGAAA
ACAAGGGAAGCGTGGCTAGAGATCACCTGGCTCTCGAACGCACATTTCTAGCATGGCTTCGAACCTCTCTCGCTTTTGC
ATCGATTGGCGTCGCCGTGACGCAGCTATTCCGCCTCAACACTGATAACGCTTCCGCCTCCGATTTCGACCACACAagg
ctaCAAAAGAT

FIG. 2 continued

> SEQ ID NO:5120 214443FL 200546_300853_1d
ggcgcaatgcttcaacAGCGTCTCTCGCCACAGTCTGGATCTGCCCGTGCCGCCACTCTGAACTACAATCACGCAACCA
AACCTTAGTTTAAATGCGCCGCTCTGCGCCCCCACAAGAGCTTGTGCGCATGTGCTGTGGCACTCAGTTCAAAGTGGTA
CTGCCGAGTCAAGTGAGACGTGCACCCTGGTCGAGGCCGTGACCATGGCTTCTCACCCTCAGACCAACGAGCTTGACGC
ATCTGCCTCTGCAGTGGCATTGCCGAAGAAGACGCTATCGAGGGCTGACCTGCATCGTCGTCAGTCGGCAGACGAGCGG
ATTAACAACATTCTCGAGACGGCTCTGCAACGAGCAGAAACGATGGATCCCGCCTCTCTAAGCCTTCTCCAGAAAGGCT
CTTCCCACAATTCCTCTCCCAACTATGGAGCCTCCGGAACGGTGACAAGAGGGATATTGCAAGACTATCAGGCGGTACC
GACCAGCGATGAAAGCGATGCCACCCGTCCGAGAAAGGTTTCATACAGCGATGCGGCGAAGAAGGCCGGGAACCATGCG
AAGAGCCAGAGCTCTCTGCGGCAACGAAACGGAGTCTCCGGCTCGGAGGATACAAGATCGCCAACAAAAGCAAAGTCAT
CATGGACGAAGGAAACATTTCGAAAATTTCAGTCCCTTCAGTTGGAAAACAAGGGAAGCGTGGCTAGAGATCACCTGGC
TCTCGGTATGTCGCATGCGTATACAGCAGCTGAGCTGCATGTCTCAAGAGAACCAATTGGCTGACCATTTCATTTCCCC
CCCCTTCCAGAACGCACATTTCTAGCATGGCTTCGAACCTCTCTCGCTTTTGCATCGATTGGCGTCGCCGTGACGCAGC
TATTCCGCCTCAACACTGATAACGCTTCCGCCTCCGATTTCGACCACACAAGGCTACAAAAGATGGGCCGCCCGTTGGG
TGCGACATTCCTCGCCATTAGTAtTGTGACCTTGCTCCTCGGTTGCAGACGATATTTCCATGCCCAggAATGGATCCTT
CAGGGCAAgttcccGGCAAGCCGAGGGAccATcAtTATCATGTCACTGGTGgcattggcccTCATGATTtT > SEQ ID NO:5121 214460FL 219439_300945_1d
gcccacgctgtcgcccacgcgtccgatttcactcttcTGCAGACGAGGACGGACCCGATTGACCATGTTGCGACAATCC
TTCAGAGCCTTTGCCCGCACGGCTGTTGCGAGACCGGCCGCGGCGAGAAGCTACGCTACCTTCAACTGGGAGGATCCCC
TCAATGCGAACAACCTCTTTTACCGAGGAAGAGcaggcCATTGCAGAAACCGCAGAGCGATACTGCCAGGAACGACTACA
GCCTAGGGTCTTGcaggCCTACGCGAGACGAACATATGACCCCAAGATCCTcgaagaGATGGGCGAGCTGGGCCTGcttT
GGCTCCAGCatcaaggGCTACGGATGCgCTggcgtttcttCGGTGGCCggcggcCTGATTAcacgagcGGTCGagcGaG
tc > SEQ ID NO:5122 214471FL 214490_300858_1d
TCATGCGCCTCAAAGAATGGAAGAAAACACAGGCGAATGACGTGAAACGAAAGATAAAAAGACAGGCGCCTTCATGCGA
GGGTTTCGCCAGTCGCCTCTAGCGTGTTTCGAAGCGCAGGGTTGAAACGCGGCTGCATGATGCCCGGCCGCCCATCTGA
GGCATGGCGGCTACCGGAACAGGACGACATCCGAAGACTTGAGGAGGCTCCGTGTTTGTTCGTTTCGTTTCGTCTTTCG
AGTGAAGGGTTGGTTCTTGTTTTCGGCTGTTGTGTGTTTTGGTTGACTTGTGTTTACGGGTTGGGGGTGAGTTGAATTG
AGTGCGAGACTTGATGCTTCTGTCAACAAGCCAGCCACTTACACTGCGGCTTCACCCTTTCGTCTCTTTTACCATGTTA
CGCAACATGGCGAATTTCCTTCTATAGGATCCATATTGCCCAAATTCAGATCCAGCCCGCAAGGGAGAATTTTATCCGC
CT > SEQ ID NO:5123 214478FL 208832_300809_1d
atccccggattcaACACTCAATGCCGCCTCCATGAACGACTCGAGCTTCGTCCAAGCCCAACAGCGCGTCGCTGAGCGA
CGAGCGGCCCGCGAGGTCGAACAACGGGCCCGAATCGCGGCTCAGCGCGAATCGTCTCGCGTGAACAACCAGCTGCAGC
GTCTGCCATACCCCCTCAATCGCCTCGCCGGTGTCTGGGATGCAGCCGCCTCTATAGAAAACACCCGGCCTGCGTTTCG
CGTTGCGCAGGTTGATGCCGAGCTGCTGGATGAAGAGCTGCTGGAGCTCCTCAAGGGGCAGGTTGGCGACGCCCTCAGA
TACTATGCCGgcgGgCATCTCAAAGACGACTGGTCTTCCGAGATTCAGCTGGCGCTCAGGGCCATCCTGTTCAAACTGA
CCGTCTGGGATAACGATGCAACGTACGGAGCGGCTCTACAAAACCTCAAATACACCGACGCCAGAAAAGGGGCCCCGT
GCTGTCACCCCCGACGAGGCtACAAAAGTCACTATAcgggcTggTaac > SEQ ID NO:5124 214519FL 195951_300639_1d
ggaggaTCAGGTGCGATGTGAGGCTGATTTGGGGTGTATGATTCGTGAGCGTGTAAGAGGAGGCAGCCCACGACTTTCT
CTCTGTGTCTGTGCTTGCTCACTTGCTCGCCTCCTTGGATTCGGCCTGTTGATCCGAATCAGAAGTAAATGTGTTTGAG
ACTGAGACTTGGTCTGGTCGAGACGATATGGATGTGCATGGAATTAGAAACACGTGTTTGGTATGGCGATTGCGATG
CGATGATCCGCAGAAAGCAAGATCTCAGGGCGACTAACACGGATATACGGAGGTTCGACCAAGACACGAGGAATGATGG
GGAAAGTCTCAGTATGTCACTACGGAATTTATGATTACGTAGCAATGTATGAATTATCATTTC > SEQ ID NO:5125 214519FL 218772_300936_1d
GGGGTGCGATGTGAGGCTGATTTGGGGTGTATGATTCGTGAGCGTGTAAGAGGAGGCAGCC > SEQ ID NO:5126 214530FL 216893_300902_1d
agtatctCAAAGATGGGCACCAAGATGGATTTCCAACACTTTGCGCCGCAAATCGACAAGATCCCCAAAGTTACACCGA
GGCAAATCGCTTCTACTGCTCTTTGGAATACTGTCCGCGACAACTTCTCCATCTCGACGTGGATGGCCATTGGAGCCAC
CCTCCAGGGTCTCTTAGTTTTGTTCGCTCGACCTACATTCGCGATTGCACCGGCAACGCTCATCTTGCTTTACCGATTC
TCCCACACGATGCTCATGCACTACGGCTTTATTCGCAACACGCAGATGGAAGATGTCATCATGGGAAAGTATACCGTGC

FIG. 2 continued

AAATTCCCGACAAGGACGGTAAACCGCCAAGTGAGCCGTCGGGGACAGGCATGGCTGTCATCATGCTGGGCTTCAGAAA
CAATTCCGCCCTCGGTATGTTTGGAGCAGGCGGGCTGGAGACCTCCCTCAAGTTTCAAGCGATGTTGAAGGATCTCGAG
AATGATCCGGACTCCGGCTTTCTTGGCATGTGTGGGTATAAAGCTGCCAATGAGCGACCGACGGCCAACGGTTTCATGT
CGGTGCTTTATTTCCgtagtgTTGAGGAtATCAATCGattcgctcacgcCC > SEQ ID NO:5127 214539FL 207607_300827_3d
AAAGTTTGGCTACGCTGTGTTTTATTGGCCTCCAGGGCTATGAAATCTTGCTGATCCCACTGTTAAAATGGAGTATGCT
ACTTTTCTCAAAGAGACTTCCGAACCCAATCCGATCTTATGTCAATATACCTTGGTATCCCAAAAGTTGAAAAGATGTC
GTCGCCCCCTCTAGCCGCCACCAAGACCCCAGACTCCCCACAAGATAGCAGCATAGAAGAAGCAGAATGCACCTCTGTC
AGACAGTCTGCCTCCACTGCTTCTATTCATAAGTGGAGTGATGAGAATATTGAAGATAGAGGAATGTATCGATTACTGT
CTTCACCAAATAGAGACTGCCATGACGAGATCAGAATTTCGACACGTCCTGCAACTCCATCTAAGGCACTAATGTGCCT
TATACTTTCAATACATAAAAATAGGATTTTGGATCCAGGAGACTGCTATGACGACATTAAATCGATAGGTGCTTTAACT
CCATCTATGGCACCTTATATTTTCCTAACAAAAGAAAACCTCGTGTCTTCAATCCTTCGAGATCGTTTTTTGCGTCGAG
GCGAGCCTGATAATTTAACCTGTACCCAAATACTGAAATGCTAGAGGAGCCTGCTAACAGCTCACATAAGCAAGAAGGT
GGCCTCGACATCTGGAAATGCTGAAGAGC > SEQ ID NO:5128 214548FL 216980_300903_1d
CGAATATCATGCTATCAGCCGCTTCCTTCGTTCCTGGAAATGGTCCATGCTGACCTACCTACCCCTCGCCTTGGCCCTT
CAACTACGCAACCCCAGGCGCATCAACCTCGTCAAGGCCATCACCGGCTCTACCCGATCATCCACTTTTCTTGCTACCT
TTATAACCCTCTTTTACTACGGGGTGTGTCTGGCCCGCACTCGCCTCGGCCCCCGCGTCCTCGGCAAAGAAATACCGAA
CCGCCAGCGAATCGACGAGGGCATCTGTGTCGGTACCGGATGCTGCCTTTGCGGATGGAGCGTCTTCATCGAGACGGCA
GGTAGAAGGAAAGACATGGCCTTGTTTGTGGCGCCGCGGGCACTGGCAACGTTGGTCCCTCGGCGGTATCCCCTGGAGA
AGCAGTGGCGAGAGAAGTTGATATTCGCAGCGAGCACGGCAGTCGTGTTTACTTGCGCCCTTGAGAATCCAAAGAGAGT
TAGAGGCGTACTAGGGGGGATTTTGGGCATGGTGTTGAAGAAATAAACCGGGCATATGGGCAAATATGATCTCTTTTAG
GGAGTTCTGAGACGTGACATGACTAATTTCTTCTTCTTCTTTGGATGTCTTTGGAATAAGCTACGGTTTTTAGATGATA
TACACAAACAACCCTGATGCTATAATTGGTAATAAATACATAATATTAATTGTTTATCCAaacaaAAAAaaaaa > SEQ ID NO:5129 214633FL 167306_301607_1d
ATTAGGAAATATTCAATAGAATATATCTGAACCAACATCATTCCATAAGATTCTTAAAAACAACAACCCTTCTTCTTCA
GTTACACAGAAGAGAAACGAAACTAGAGCACCTAACATTTTAAAAGATCCCCACGACTATCTATATCTACCAGACACAT
GGGAACAAATAAAAAACGAAACACTCATATATGAAATTTTCTTTTTTTTTCCTATGAATAACCAAAGTGTGCAAGGAAA
TGAGGTCTAATTCTCACCTCCAATGCAATTCAGTCGAATCAAAGCCTTTGATTATTCATTCAGACCGAGCAGCAAACCT
TTCAACCTTACGGGCATTAAGGTTAATTCCAACCATAGCTTCACCCAAACCAGAGCTAACATCAGCAAGAATGTCAGGA
TCGCTATAATGAGTCACAGCTTGCACAATCGCCCTAGCACGTTTAGCAGGATCACCACTCTTAAAAACACCGGAACCAA
CGAAAACACCATCACAACCCAATTGGATCATCAGAGCAGCATCAGCAGGAGTAGCAACACCACCAGCAGCAAATTGAAC
AAACCATGGGATTGTAGTCCACCACTTCATCCCACACAAAGTAATCGCTTATGTCGT > SEQ ID NO:5130 214633FL 223816_300976_1d
ACAACACACACACAACACAATGTCTACCGTCGAGAAGTCTTTTGAGGAGCAGTTCAAGCTGCAGGCCGGTCTGGCCCAG
ATGCTCAAGGGTGGCGTCATCATGGACGTTGTCAACGCCGAGCAGGCCAAGATTGCCCAGGAGGCCGGAGCCGTGGCCG
TTATGGCCCTTGAGAAGATCCCCGCCGACATTCGAGCCGACGGAGGAGTCGCCCGAATGTCCGACCCCGCTATGATCAA
GGAGATCATGGCTGCCGTGTCCATCCCCGTTATGGCCAAGTGCCGAATCGGTCACTTTGTCGAGGCCCAGATCATTGAG
GAGATTGGTGTCGACTACATTGACGAGTCTGAGGTTCTGACCCCCGCTGACCAGTTCCACCACATCAACAAGCGAGACT
TCAAGGTCCCCTTCGTTTGCGGTGCCAAGAACCTGGGTGAGGCTCTCCGACGAATCCACGAGGGAGCTGCCTTCATCCG
AACCAAGGGTGAGGCCGGTACTGGTGATGTCACCGAGGCCGTCAAGCACATGCGAACCATCCAGTCCGAGATCAACAAG
ACCCGACACATGTCTGAGATTGAGCTCTACACCTACGCCAAGGAGATTGGTG > SEQ ID NO:5131 214633FL 182915_300664_1d
tgtactaacagtatatggaaatggagcaataacagaggcaaaaacctcaccattctctgttaaagtacgattaccacag
aTGCtTagaGgagGagtAATCATGGATGTTGTTAATGcaGAACAAGccagaATCgctgaagaatCAGGTGCTTGTGCTG
TCATGGCATTAGAACGTGTACCAGCAGATATTCGTGCTCAAGGTGGTGTTGCTCGTATGAGTGATCCACAGATGATTAA
AGAAATCAAACAGGCTGTTACTATTCCTGTCATGGCTAAAGCTCGGATTGGTCATTTTGTTGAAGCTCAGATTCTCGAA
GCAATTGGTGTTGATTATATCgaTGAGAGTGAGGTTTTGACCCTTGCTGATGAAGAACATCATATTAACAAGCATAATT
TCAGGATTCCATTTGTTTGTGGTTGTCGTAATCTTGGTgaaGCCCTaaGGAGGATTCGGGAAGGTGCGGCTATGATTCG
AACAAAGGGTGAAGCTGGAACTGGTAATGTTGTTGAAGCTGTTAGgCATGTgagGTCTGTcaTGGGTGATAtgagGCtt
gtgCGTaataTGGATGATgatgaggtgtgttCATAt > SEQ ID NO:5132 214672FL 1114826_301805_1d

FIG. 2 continued

```
GCGGGATTAGGAGTTGGAGAAGAGGTGATACGAGATGTCGTACGATGACGTGGAGATAGAGGACATGGAGTGGAACGCG
GAGCTCGAAGCGTACACCTATCCATGCCCTTGCGGGAGACCTCTTCCAAATCTCTCTGCCTGACCTTCGCTTGGGAGAGG
AGATAGCCAGATGCCCTAGCTGCTCCCTCTACATCACCGTCGTCTACAACCTCGAAGACTTCCAAGACCCTCGGCCCCC
GCCTCGCCCCCAACAGCCGATCGCCGTCGCCTGATCTTTCCAGTTGCTTCGTTCAGTAAACTCGACATCTACATTCTAT
CCTAAATTGATAGTCACCAAATGTCTGGTGCACTTGAGACTGTTTATCTGACAAGATTTCATGTATCTTGGAGTTTTGC
TTAAATCAGCATGTAGAATGATAACTGTTGGCTTCTTGATGTTTCAAAGGTTAGATATTGTCATATCTCGTGTGAGTTT
TTTAAATTTTTGGTCATGCTAGATACCATGATAATATATTATGCAAGGACTATAtg

> SEQ ID NO:5133 214724FL 210440_300889_1d
gtcggattcaggcctcagcgctcggatcggcctcttttcctctcttccctctctgctttccatctgcccagcagaccga
gTTTGGCAGCGCAATGTTGCCTCTATCGGTGCGGCGCGGTGGCCGCTGCTCCTCAGGGGGCAAGTGGGCTGACTTCT
CTCGCCGCGTCGGCTCCAAAGATCACAGCCTCGAGCTTCATCCTGAATCGTCCTCAGCGGCGCTACTCCTCGTCGAAAC
CCTCAAGATCCGATGAGCCCAACGATATTGCTGCCGGCCAGTCGGTGCCGGCATCTACCTCGCGCGGAGAGAGCAAAGG
CAGCAGGAAACGAAAGAGCAAGGATTCAGCCGACCGAAATGCGGCTTTCAAGAAACTGCCCAGTGTCCCTAGCACTCAC
CACATGTCTCAAGAGGCCCTGAGCTTATCGAGCTTCTTCTCACTCCACCGTCCCATTTCCATCACCCAGACCATGCCCA
GGACTGTTACCGACGAGCACTTTGCATCCATATTTGCGCCTCGATCAAAATCGAACAGGATACGAGACACTGTCTCTAC
AATTTCTGACACCATTGAGCAGCTGGAAGGCCCCATGGCTCAGGTGACAATAGGATCTCAGGACCAAGGGCTGGCGAT
GGTATGCACagaGTTGATGTCAagAACCCTGACGGAACCGAGTCGAGCATCTATCTCCAGGTTGACACCATGTCTGGAG
ACTTCTTGCCTTTCCGCCCCCCTCCGCTGCCCGAGGCGCAGCAAGGCATTGAGGCTGAAGGAGTTGCGGCTGAGGCTGA
AGCTCTGGAAGAggCAGCTCACCACCGAGtttacaagGCcatgttcAcCATTGAGGAGTCCACAGAGTCAgAcggccaa
ATCAGGATCatcgcCCACAGCCCTCGAATTATCCAGGACGAGCAGCCCCGGAGCTTCTTGGAGCGTCTGGCAGTccgcc
AACTGCGg > SEQ ID NO:5134 214824FL 241515_301349_1d
TCTCAATGCCTGGTCGCTCCACCATACGTCTTATCCGCCATTTTGATGTACGCAACCTCGTGGTACGGCGACAAGTACA
AGACGCGTGCACCGATCTTGATCCTCAACTCGACGATCTCCATCATCGGCCTGCCTATCATGGGCTTTTCGTCCAATAA
TGCCGTCCGATATTTCGGCGCGTTCATCGGCATTGCCGGCTCTAACGCAAATATCCCCGCCACCATGGCGTACCAGGCG
AACAACATCCGCGGACAGTGGAAGCGAGCCTTCTGCAGCGCCACATTGACAGGTCTGGGTGGTGTTGGTGGTATTGCTG
GTAGCCTGGTGTTTCGCTCGCAGGACGCTCCAGATGTGAATGGCTTCATCGCCGTCATTGTGGCAAATGTTGTTGT
TGTGATTATCGCCTGTTTGCTAAGTATTCTCTTCAAGCGTCCAATAAGCTGGCCGACGAGGGCAAGCTGATTCTCAAC
GACAACCCAGACTTCAGATACACACTTTGAATGATAGGCTTCGAATGCTTGTGGGCCAGTCGTAATGGAGACTAGAAGA
ACCATCTCGGGATCGAGTAGCCAAAGAAATACCTAACATAGAA > SEQ ID NO:5135 215283FL 210826_300893_1d
ccCACGCGTCCGCGCAATTATATTATGCTTGACAAGTTGAAACTGACCAAATAACAAAATACAACAACACCATGGCTAC
CACCAACGGCCCATCCAAATTCATCCCAGAACAGCTCTTCCACACTGTTCTCACCATAATCGACTACTCCCACGACGCC
TCCGGCGCCAACCGCACGCTATTCGTCCTCAAAACCCACGGCACCCTCGCCGCTGCAAAGAAATACGCCAGCCACGCCC
TAGAAGCCGTCAACTTCACAGCCGAAGACTTTGAAGTCTATCGCATCCGCCGACGAAGACCCAGCCAAACCCTGGAC
CCACGGCGACGGCGTGCTGGTTTTCGCTCGCTCCTTTGATGGGCAGGAGTTTCTCGTGGGAATCGACACTACTCCGAAC
AATGAGGCTTTGACCGCGACCTCGGATGGAGAGATGGTGCTGCCCGAGGGCGCAAAGTTCTTGCACTACCTTTTGCAGA
TTACGGTGGACTACAACGCCGACCGTAGCGGCAGCTCGCAGACCACGGAAATTGAAGGGACGTATGTCCATCGTGCGGA
TGCTTGGACGGCTGCGCATGTCTCTCTCGATCCAACTGAGTATGCAGAGTTTGATCGTCGTGGCGACGCACAATTTGTT
GAAGAATGGCCCTTTGGCGAAGACGTTGCAGTTCATGCCGTTTCTGAGACTGGACAAAACTACTTTATTGCGGTGAAAA
GGCCCCCCGAGCAGAAGCACGAGGTAAAGCATCACTCGCTGAAAAAATAGTTTTCATGTCTATTGCATTCGGTTCGTGG
AAGTAAGGACCtcgtctGTCGT > SEQ ID NO:5136 215283FL 217191_300905_1d
CGCAATTATATTATGCTGGATGAGTTGAAACTGACCAAATAACAAAATACAACAAATCCATGGGCTATCAGCAAACGCT
CCATCCAAATTCATCCCAGAATAGTTCTTACACACTGTGCTCACCATAATCGAGTACTCCCATAAAGCCTCCGGAGCCA
ACCGTACGCTATTCGTCCTCAAAACCCACGGAACCCTCGCCGCTGCAAAGAAATACGCCAGTCATGCCCTACAAACCGT
CAACTTCACAGACGAAGACTTTGAAGTCTATCGCATCCGCACCGACGAAGAACCAGCCAAACCCTGAACCCATGGCGAC
GGAGTGCTGGTTTTCGCTCGCTCCTTTGATGGGCAGGAATTTCTCGTGGAAATCGACAGTACTCCGAACAATGATGCTT
TGA > SEQ ID NO:5137 215480FL 205294_300797_1d
CGCAAAGGTCGTTGAGCCTTTCTTGCCCCAGCTCTACCAGCTTCCCCACCACATCTGGGAGAGCATCGACAGTCTCGAT
GCCCTGAGAGAGCTCTATGTCACGACGAATCCCCTGATTTCAGGCTTTGCGGCCTCTCTGGTTGTTGGGCTTCTCGCCT
TGATCGTGTCCGAGATCAATCGCAACTATTCTCAGATCGACCGCCTGTGGAGTATCCTGCCCAATCTATACGTTGTCCA
```

```
CATTGCGCTCTGGGCACGTGTAGCTGGTTTGCCGCATGGTCGAGTAGATTTGATTGCTGTCTGTACAACATTATGGAGT
ATTAGATTGACGTACAACTACTGGAGACGTGGCGGCTACAACATTGGCTCAGAAGACTACAGATGGATGATTGTCAAAG
CGCAACTCAACTCAGTTGTCTGGTTCATCTTCAACGTCACCTTCATTTCGTTTATCCAGAGCATCCTCCTGTACCTCTT
CTCGTGTGTGCCGGCATACGTCATCTTGCTATCATCTCAGTTTGAGCCTGAAGTTCAGGCAGTTGATCTGGTCTTTGCC
GGCGTTGAGATTCTTCTTGTCCTGAGCGAATGGATTAGCGATGGCCAGCAATGGGCTTTTCAAACCGCCAAATACAAAT
A

> SEQ ID NO:5138 215729FL 205158_300796_1d
ATTGCGCGCCAAAAGACTGTACACAGACGTCTTTTGATATATTTTCAAAATGGGTGGCGGTGGAAAAATCCCTTACCCC
AAGCACGTCTGGTCGCCTTCTGGTGGTTGGTACGCCCAGCCTGCCAACTGGCGCGCCAACACGCTCATCGCCGGAGCCG
CCATGTTCGGCGTCATCGCTATTACGTGGAAGTTCAGCGCCGACAGGGAACGATGGGCGCATAAGCCGGAGCCGTGGGA
GTGGCATCCTAGCCGATACTGGTCAAAGCAGTTGATCGAGTGGGACAAGGAGGACAAGCTGAAGGCAGCAAGCAACAGC
AAGGAGTAGAGTTTTCTTTTTGGGAGAAGGATAATAGACGAAATTGTACAAATTCTATACGAACAAAAGGCAAACATTT
CT

> SEQ ID NO:5139 215729FL 208666_300807_1d
agcaATTGCGCGCCAAAagaCTGTacagAGACGTCTTTTGATATATTTTCAAAATGGGTGGCGGTGGAAAAATCCCTTA
CCCCAAGCACGTCTGGTCGCCTTCTGGTGGTTGGTACGCCCAGCCTGCCAACTGGCGCGCCAACACGCTCATCGCCGGA
GCCGCCATGTTCGGCGTCATCGCTATTACGTGGAAGTTCAGCGCCGACAGGGAACGATGGGCGCATAAGCCGGAGCCGT
GGGAGTGGCATCCTAGCCGATAGTACGTTTATTTTTGATTGTATTGGGTGTGGTTGTGGGAATTTGGTCGTTTTTGCTA
ACGTTTTTCTTTTGCTTGAAGCTGGTCAAAGCAGTTGATCGAGTGGGACAAGGAGGACAAGCTGAAGGCAGCAAGCAAC
AGCAAGGAgTAGAGTTTTCTTTTTGGGAGAAGGATAATAGACgaAATTgTACAAATTCTATAcgaACAAAAGgcaAACA
TTTcaaaac > SEQ ID NO:5140 215744FL 207926_300830_1d
CCCACGCGTCCGCAACACTTACAACTATCAACATCTACCATATTCAAGATGCCTTCTTTCATTGTCACCCTCAAGGACG
ATGTGTCAGATGAACAGGTTGCCGCGTGAGTCGGGCTCCTGTTCCGCTTTGACGACAACCACTGACACGTTACCAGAGC
CAAGCAGAATGCCAAGGATGCCGGCGGCACGATCACACACGAGTACACCCTGATCAAGGGCTTTGCCGTTGAGTACCCT
GAGGGCATAGTTCACTCGCTCGCTGAGGACCCCTCAGTGCAGGCCGTCGAGGAGGATAAGGATATGAGGACGCAGTAAA
TGGAGCTCTCTATTCTGTTCTTGTTGCATCTACATCTACATACATCTACATTAGAAAGACGTAATATAGAGATTGTATC
AACATCTTCATCTTC > SEQ ID NO:5141 215744FL 218437_300933_2d
CCCACGCGTCCGCAACACTTACAACTATCAACATCTACCATATTCAAGATGCCTTCTTTCATATGTCACCCTC > SEQ ID NO:5142 215922FL 205205_300797_1d
aagcaatatcattGTTTGCTCAGGAGGCCAAAGCGAGCTTTTCGATTGATTGTCCTCTTTGTTCTTTGTTACATTTCAT
ATTTATTTGCGTCTTGGGGAGCCATTGCAATTGAATTGCTGCGCTCTGGGCATCGTACACACGCATTTTTCTCGGCAAT
TCCGGCTTGAGCTGCACGGCATACGAAATTGCTGCCGGTGCGGACTCTTGCAGCTCCGAGGCTCCGCTATCTCCATCTC
ACCGGTGATTCCTTGTGCGAGGTTCGGCGAGAATTCCAGCAATTATTGTCACTCTTTGTCCTTTCACGAACGGAGCGAA
ATATATATAATCAGCTACGCTGGGTAAAGAGAAAGAAGAGGAACCTCTGCACTCGCCGCATCCTACGAAATGATTCGGG
CGGCGTTTCAATCGAGAGCGGCACCGTTTGGAGCGGCCAAGAGCACGACGGTACAATATGGAGCATTGAGGGATGCTTG
GGCAAGGCTATTTTCGTCACAGCCTGTCATGAAGTCCCCGAGCAACAGCAGCAGAACATCATGGACGAGGTTACATTCA
ATTCAGCCCTGGCGGGGAACCACGCGCCACGGCGCTTCGATGCGACCAAATGTCAGGATAGCTGACAGCTTTGCGAGGG
GGGCGCAAAGGCGGAGCTTTATGTTTTCGGCAtggaGGCGCAACACTGCGCAAggagctcagGAGAagttgtcgcTgag
CGGGAGATTCAAGAAGctcctccaggaatacggGTGGTcggccgtCGGCGTCTACTTCGCGCTCagcgtgcTGGACTTT
CCGTTCtgcttcctCcTGGTGag > SEQ ID NO:5143 215951FL 213813_300861_1d
cccacgcgtccgcccacgcgtccgAGATCAGATTGCAGGCACCCTCAATTGGCATCACATCATGCTGGCGACAAGAGCA
CTCCGAGCGGCCCACGGGCCCAAGCCCAACATCACCGGCTTCAACATGCGAGCCCTCAAAGAGGCCACTGGCCAGCCCC
GATACGACCCTTGGGAGAGAGCCGAGGCATGGCGATACAAGGGCACCTTTTCCAGATGGAACCGATTCCGGAGCGGCTT
CCCTGGCTTGGGAATCGCGTCTGTTGCATTTGCCGGATACTGCGCCTACGAGTACCTCTTCCTCAAGGATGAACACCAC
GGCGAGGGACATGGCGAGGGGCACCACTAGAGCGTTTTTTTTTGCGAGCGAGAGCAGTCAGGAGTGTGCGAGAGGAGA
AGAGAGAGGAAATGTATATACATCTCTCCAAAGACAAGAAAACTCAGGCCTGGTCTTGCGGCGGGCAAAAAATGAATCC
AACACAAATCAATATAAACTCTATTTAGAGC > SEQ ID NO:5144 215953FL 205619_300800_1d
```

FIG. 2 continued

GGGAGCTATGATGGGCTTCATGGCGTGGAAATTGGTTTGTTTTCTCTCATTCGTTGACTCTTTTCAATCAATATACACA
AGCAGATGGGTATTGGTTAAAGAGGGCGAGCGAGAGATTCACTTCAACGCAAAGCCTTGAAGAGAGAACAACTACTATA
GCAGTTACATCACCACGTCCAAACTATNTCGTGCATCAGGAATCCTGCTTCTTGGGACGCGCTTGTGGCACCTCTTCAT
CAATGGGCATCAGTGCGTCTGCCGTGGCAT

> SEQ ID NO:5145 215980FL 205540_300799_1d
GCGATTGTCTTTAGCCGAGAGGCGTTTGGCGATCTTGACATCATAGGAGCTGCTCTTCGTTGCGGCACCAGAACTTGCG
CGCATCTTTGAACAGAATACTTCGTGGAGCAATTGCTACCCCATGGCTCGGGAGCATCGTGTCAGATACATTAATCACT
CATAGCTGCAAGTACTCTTTGCGCCGGGGGCAGTGCTAGGCCCATGAGCCGCGCAATGTCATCGGTCTTATGCCGGCAT
TCAATCGGAATACGACTCTGGATCCGTCGTGCCGGTCTCGATATCGAAGCTCGGGGCAACACCAACAAGATGTAACGTA
AAATAACAAGACG

> SEQ ID NO:5146 215995FL 205803_300802_1d
atCCTGTAGCTGCCCTCACGCACATCCCCCGGCACGGTGTGGCCCGCGCCGTCCACGGCCACAAACGCCAGCCGGCCGG
AGCTCTTCCACGACCCCGTCGCCGCCATGCTCTCCGGCAGCTCCCGCCACGGCGCGAGGCGATAGTCGGCCAGCCCGCT
CCAGCGCAGGTTCTCGTACGCCCAGATGTTGCCCGGCGTGTTGACGATGTAGTCCTCGTTGCCCTGCAGGACCAGCACG
CGGATGTCGCCCAGGTTGGGGGTTCGGTAGGCGTCGAGGATGCGGGCGACCTCGCGGGTGGTGGTCCGGAAGGGATCTT
TGGAGTGGACGAAGGCGGAGTTGAGGACCATGTCGATGTCTTCGAATATATAATATGGGGAAGCTTCagggctTTCTT
GATGTGGGCTTGGTTGATGTAGGCTGACATGTTGCCTTTCCTGATGTCTGCGCAGAAGGGCCAGTTGGGACATGGAATA
TGGACTGTTTTGCAAATATTAGACAACTACGTTCAGACATTCAGGAGAAGCTTGAAAGTTTCTTCagaaaaaacaaaaa
aaaaac > SEQ ID NO:5147 216010FL 195466_300634_1d
cagccacacatgtagcaaagcgcacaattcgcatcataagtcatctcaatagcttttcttcttcttctcctcctcctc
tCTCTCCCTTGttCTCGTACTCCGCATGTCATCGCCATGATTGTGGATATTTGGGGTAGTCGATAAGTTCGAGATGGGG
CCTGCCGTCCCGATTTCTTCCAATGCaGGTACTTTTGAGCCGgcCCGGCGCGGGAACTGAACTCCTATAAGAGTGACCA
CATGGACGTGTGCACGGGGTGCGGGAATGGATACACCGCTTATTCAGACCATTACTCGCATTTGCGTCCAGAGATTGGA
GTTTGATAATTTTTACAAACTTGTACATAATACTGATGCATTCAGCCCTTGGTCCTGATGGCATGAGCAGACATAGCCT
CGGCCGACGATTTTGCCCCTGCAATGGTTCTCTGCCGATGTTTCCCGCAGCTTCTTGGCAGTTGGGGTAATACGATAAT
ACGACGATGGCATCTTTGGCCTGCACGCCGAATTGGGGTCAAATAGACGGTATTCCGAACATTTCATATTTAAGAAGCT
GTGCTGCACGCCAACCAACCTTTGGAATGGTGTGAATTGTGAAGGACATGATGCATGGTATAGGCCATGAGCTAGTCTC
AGAGAGATGGAGCCTCCGGTGTAAAAGTTGTACATTAATACGATCAAAGCCCGCTACGAAAAAGAATGGCAATTGTAT
TACCCACGAAAAAaaaacacaaa > SEQ ID NO:5148 216020FL 205815_300802_1d
GAAAAAAAAAAGTTGCGCCAGACGGGATGAAAGGCGAGACAAGGGGCTGGCTTGGGCTTTGGGCATGCACTGGGACTTT
GGGCTGAAGGTTGACCGAACCGAGTTGCTCAAACTGCGACATCGGTGCTGTATCAGGCTGCTATCTATGTATCCTCGTA
CAAGGCAAATGCACACACGGCTGATCTGAGATTACGGGGGGGAAGAAACGCACTCAGTGGCCAATATGGTGGTTCGCAC
ACCCAGCGTTTGCTCTCCTATGTCGTTTGTATGGCGGGTATGCTCATGCTTGGGCTGAGGTGATGCGCGTCTGATTCCG
GCTAGCATACCGAACCCACTAGGTAGCGAGTTGATAGTATCGCCATTATATTGGATGTTGGATCGATATGTCCCGTTGT
ATCGGGCCAAGGTGCATTGCTCTATTGGCGGGCTAgcAGCTGACCACGAGACTTTTGTTGCCAGATGACTTGACAGGCT
AAGAACCCAACAGACAACAACAATAGCGGAGGGGGGATTCATTCAGCTGGTCAATATTTCACTATAGAGAGAGGGGTTG
ATTTCAATTCAATTCAATTACAGGAGGGGTATTCGTGGGACCACCTCGGCAGATACCAGTAGAGGCAAAGGGAATCCCG
CAACTCAACTCAAAACCCGAAGCCTCTCCGCTCCCTTATCTAGGGCGGCGAATTCTGACGTTGCTGATCCGATATCCGT
CGCGCGGCACGGCAGTCagggacgGGATGCGGCAAAGATTTGGCAATTCGTCTGGGTTGCTGTTGCAGCCTTCTTCACT
AGAAATGGAATCTCGCGGATCAAAAGGGAAGTGTGGGAAGCTCTCGCGCGGTACTTGGTGCGAGTTGGAGCGAAAGCGA
AGGGAGCCGCGGAAAGGGTTCGGGGCCGTGATTCCGGGCAAGCGGCCAGATACCGACCTGGGTCCgagTTCGCCGGGT
CGTAGATCACGAGgCTGGTCCTTAGACTCAAAATCCcAAgggttTGGTTATGGTGTGaaacaaacaaacaaacac > SEQ ID NO:5149 216036FL 206402_300822_1d
ACGCGCATCATTATGCCGGCATGGGCCCGGGGTCTGACCCTCACCATTTCCGAGACCAGAGCGTGCCGCATTTCGACAA
GGCGGGCCATACGCGGACGCACGAGCGGGAGGATCACCGGCGGTGGCAGCGGCAGAGAAGGGCTGTGGGGATGATGGC
ATAGAGTTTGAGCCGCAGACGAGCCTGGCCGGGCACTTTTTGATTGTGGCGGGGATATTGGCGGCGACGCTGTTTGTGC
CGGCGGTGTATTTGCAGTTTATGCGCCTGGGGAGGCAGAAGAAGGAGAAGGAGTCGTGAGGCGGGTATGGCGTCTGGAG
TGTGATAGGGAAGGCTGTACAAAGAATAGAGCAGACTTATATAGAAATAGGCAATGGGGGGGCATGAGCGAACAATGCC
GATTTTAACGTTACG > SEQ ID NO:5150 216040FL 206403_300822_1d

FIG. 2 continued

```
GGAATGACCCCTACCAGGATGTCGAATTACACAACTTGAACGAGGGGACGAGCCAAGGGGCACAGCACGGGAATTGATT
CGAGAGTTTTTAAATGATACCCATCTCCCAGCGAGGAGATTGCACTTAGAAAACGTGGCGGAGGCCCTCGAAGGAGAAA
ATGGTCTTTGTTTTGTTCTTCATCTTCTGCCTTGTCGAAGGGTCATGTATATGTCAGGAATAGCTGTGCACTAATATTT
AAACATAAGTTCCGTCT

> SEQ ID NO:5151 216042FL 206435_300822_1d
ggccctcggcgtacgagtagCAAAAAGCGTTCGGTCCATCTGGGTCCGGTTGGTAGGATTGGAACGAGAAAGAGGGGAA
TGGGATTCGAGAACGTGGAACTTGCTTGTGCCCTGGCAGTCTTCGGGTAATTGGCCGCGGAGATTAACATGGCGAGAGG
AAGCAAGACGTCAGAACGGATCGAAAAAAAGAAGAAGATAAATCC > SEQ ID NO:5152 216050FL 206377_300821_1d
GCACCTTGTTGATACAGTACAGAAATGCTGCCAGTCGTACGAGAGCCATGGGTGCTCCGTCGAGCGCCTCTAGCTTGAC
GCCAGAAGGATCGAGGCTGATTGACGATGGAGCCCTGGCCCGCTTTTGGTCCTGTGCGCGACAGATGCTGGGATGAGGA
GAATCGTGATGACGAATATGTATTGATATCATATCGTGAGAGAGACATGGTTGGGGCTTACTGGTCTCTGTACGAGTAC
GATGCTGTACGTTCGTGTTGAATTATCTTGTACTGTATCGTGTTTTGTCGATCGGGTGGTCAGTCT > SEQ ID NO:5153 216055FL 213940_300862_1d
GAATGAACGTCTTTCTTGTGCTGGCGGCAAGTAATACTGTAGCAGGTACCTCGTGGAGCTCCATCGGGATGGGGCCGGT
TGGGAGTCGGTTGGGCACAAACAAGGTTTCTAACTGGATCTATTTCTTTCCATGTGTCTTTTAATCATTTTGAATTTTA
TTTTCCCCGGAGGCCGTGACACGTTTTGACAGATGGGAGGAAGAGGCGGAGGCAGAGAGCAAAAAAACGCTCACACGT
GTCAGTCCGTAGCGGTGCCTTTTTCTAACTGTCCGTATCTGGTCAGAGGCGGCGGCAGTAAATAAGTGTTGCCCGAAT
CAATAGTAGAAGAGGCGCCCGCTGTGGTGTATCGATTTGGTCAATGGAACTTGTCAATTGTCTACAGTAGTAGTAGCAC
TATCATCATTTGTTTCCGATTGTGTCATTGATTTTTAAATTCTGATGAACC > SEQ ID NO:5154 216074FL 210768_300892_1d
cgactcacctCCCTTTGCTCCCGCGCGGCCCATATATATACATATATATAAATACCAGCATATAAGTCATCCGTTCACC
AAGCGTCCACTCGCACTCCTCCTTCTCTCTTCCCCTTCTTCCACCTACACCAGACGAAGAAAGCATCCAATCGTTCACC
ATGAAGCCCCAAACTTTCGTTGTCGCTGCCCTCGGCCTCCTGTCCGGAGAAGCCATGGCCCAGAGCGTGCCGCCTCTGA
TCTCGTCTGTGTCTGCCGCCGTCTCCTCTGCCATTGCCTCTGGCAGTGCCATTGCTTCCAGCATTCGCTCCGAGGCCTC
GTCCGTCGCCAGCAGCATCCGCTCAGAAGCTTCTTCCATCGCCTCAGCGAGACCAATACCGCAACCACTGGCACTGAG
ACCACCAGCAGTGAGACCACCTTGACAACTACCATCGCCACCACCACCACCACCCAAACCACTGTCGAGTCTGCCACCA
CAGAGCCTGCCACTACTATCCCCGGAACCACCAACAGCGAGACTACCAGGGCTGCCACCACCATTCCTGCTACTACCCG
CTCTGCCACCACTCGCGTCACCACCAGAACCTCTGCTACCACTTCTACCTCTACCGGTCTGGCCATTGCTCCCACTGCT
GATGCCAAGCTGCTGGCTCCCATCCTCGGTGCTGCCGCCGCCGTCTTGATGCTGTAAACACCTGTCTCTTGGAACTACT
ACTATCTATTTCATATGTTGGGCGGAggACTTGATA > SEQ ID NO:5155 216082FL 216081_300887_1d
tcgaccacgcgtccgGTTGAGAAACGCGAGAACGGCATTGAGAAGAGGTGAAAATTCGTTCGACATAGAGCACAATCAT
GGCCATGATTGATGTCTCTCGGCGGAGGAGGTCGCTTCTGAAGGATGCGACTGCATTGGACCATCTGCCCGCTGAATTA
CTTGAAATTATCAAGCATCAGTCGTCGACGAAGCTCTTCGATGCTGTATCAGAAGCCGCGCTCATACCATCACTTACAG
AGAGGATCTTTGTGCATTTCGAAGATGTGTTTTCAGACATTTGCGCACGATGGATTCTCAACGCCGGCAACGGACCACG
ACGGTTATTAATTGCGTCAGCTATTGCCAGGATTTTGCCATTTGCGCCGTATCTCTCGACTTTTCTTCAATGTCCCGGC
AGAGGTGGAGAGGAAGCGGCGCAGGGACCTTCGCTTCACTTGGTGCTGCCGACCATTGATGGAGTGAATTTGGGGTTGG
ATGCAGATGCATTGCTGCAGGCTTTAttaacaTActgggaGACTttttccagctTCGACCTGAGAACTTTCAGCTCATTA
ATTCCACCCGAGtACCTGCAGAGCTTGTTTGCGCATGAGAGCCGGGCAGTGAGATATCTAAAAAaa > SEQ ID NO:5156 216090FL 205026_300795_1d
ACACACATAAATACACCAGCAAAACATCTTCTGCGATTTCTAGTGTTTTTTCACTTACACCAGCGCGACCATCGCCAAA
GCTACATACAACACAACACACAACACAATACATACACATCCAGACACTACCGTCTAACATAACACAAACCGCCGAAATG
GTCACTCAACCAGCCAAGATCCCCGTTGCCGCCCCAGGCCCCCTCGCTAGAGCTTTCCCAGCCGTCATCGCCGTCGGCG
TCAGTAAGTCATCTACTGAGACTTCATCCTCACTCTACCCTCAGTCCACTAACAACGACTTTAACTTCAAGTCTCTGCC
GTCGCGCTAAACGTTCGCTCCCAACTCAAGACTCATTCAGCCACTCAGGACCGCTTCTTCTCCCAGTACAAGAACCCCG
AGAGCGAAGCCGTCCGCCAAAAGGTGTTTGAGGGCGCTGTCGAGGACCCCCGCAAGAGCTGGTTCAACGTCCTGGGCTG
GTGACTATTTGAGGATTAAGCAGGGGTTTTGAAGACACAATCGCATTGCTGGGCGTTTATTTTAATTTTTAGTATCGAG
GAGTTGGAAAGGATATTTGTTGGCTGGTGAAGGCGTCGTGCATTGCTGTTTCGATGTGACCGCCTGGTGTATAAATGGC
GAAAGAAGGGGgttGTtgagaggcccgagtATTGATAccagcCTTatttagaTGGCACtttaatCTTCTAAAg > SEQ ID NO:5157 216090FL 207990_300830_1d
```

ATTGACTACACACATAAATACACCAGCAAAACATCTTCTGCGATTTCTAGTGTTTTTTCACTTACACCAGCGCGACCAT
CGCCAAAGCTACATACAACACAACACACAACACAATACATACACATCCAGACACTACCGTCTAACATAACACAAACCGC
CGAAATGGTCACTCAACCAGCCAAGATCCCCGTTGCCGCCCCAGGCCCCCTCGCTAGAGCTTTCCCAGCCGTCATCGCC
GTCGGCGTCATCTCTGCCGTCGCGCTAAACGTTCGCTCCCAACTCAAGACTCATTCAGCCACTCAGGACCGCTTCTTCT
CCCAGTACAA

> SEQ ID NO:5158 216109FL_206632_300824_1d
gatcttgctGGGAGCTGTGATTTTGGCAGcgcGAAGCGTTTCCGGGTGCCAATTCTCACCACTGCAATCACAAGTCCCG
AGTACTACTCTGTCAACCATGGCCTCGATTGTGCGACCTTCTCTGCTGCGGCAGACTGCGCTGGCGGCTCGTTGCGCCA
AGCCTGCTTTCCGAAACAacgCCATCAaGGCTTCGGCTTTCCACACCTCGACTCAGCTCTCTGCCTTTCTGCCTCCCGG
ACCTCAGCGAATTGAGGGCACAGTCAACGACCCCGTCCCTATTCCCAAACcTAACGCCTCCCACGGCTCCTACCACTGG
ACCTTTGAGCGCCTCCTCGCCGCCGGCCTCGTGCCCCTCTCCATTGCTCCCTTCGCCGCCGGCTCTCTCAaccccACCA
CCGACGCCATCCTGTGCTCTGCCGTCCTCCTGCACTCTCACATTGGCTTCCAGTCCGTCATCATCGACTACATCCCCAA
GAACCGCTACTCCGGCCTGCGAAAGATCTTCTGGTGGGGCTTGAACCtggcgACCgtcaccgtCGGCGTGggatTGTAc
gagtttgagaccaacGATattggcGttaccgaggcTAt > SEQ ID NO:5159 216109FL_208424_300835_1d
GGAGCTGTGATTTTGCCAGCGCGAAGCGTTTCCGGGTGCCAATTCTCACCACTGCAATCACAAGTCCCGAGTACTACTC
TGTCAACCATGGCCTCGATTGTGCGACCTTCTCTGCTGCGGCAGACTGCGCTGGCGGCTCGTTGCGCCAAGCCTGCTTT
CCGAAACAACGCCATCAAGGCTTCGGCTTTCCACACCTCGACTCAGCTCTCTGCCTTTCTGCCTCCCGGACCTCAGCGA
ATTGAGGGCACAGGTATGCCGCGCAAAACGTGTTGCGCTCTCTCACATGCCGAACCGAACCTATGAAATAACTAACCAC
GAGCCTACATACAGTCAACGACCCTGCCCCTATTCCCCAACCTAACGCCTCGCACGGCTCCTACCACTGGACCTTTGAG
CGCCTCCTCGCCGCCGGCCTCGTACCCCTCTCCATTGCTCCCTTCGCCGCCGGCTCTCTCAACCCCACCACCGACGCCA
TCCTGTGCTCTGCCGTCCTCCTGCACTCTCACATTGGCTTCCAGTCCGTCATCATCGACTACATCCCCAAGAACCGCTA
CTCCGGCCTGCGAAAGATCTTCTGGTGGGGCTTGAACCTGgCGACCGTCACCGTCGGC > SEQ ID NO:5160 216112FL_220325_300954_1d
CGTTAACGAGTCGTTTGTTGAGCTCCTTTTCCCTTCCCAGTCTTTCGCTTTTGGGTCCGCACTTCTCCTGCAGGTCGCC
GTTTCCATACCATTTTCTAATAGTATCACTTCCGCACATCTTCACGAACGCGTCTCCCCGTCGTCGTACTATACAGTCA
ATATGGTGTCTTTCAAATCAGCCGTTGCCGCCGCCACGATGGCCTTTGTCTCGTTGGCCAATGCGAAGAGCTACTACAT
CGACCCTGACAGTGTCCCTCTGGCCACAAGACAGAGCTGGTGCCGTTCTGAGACGTCGACATGCCCCATCATCTGCCAG
CAGACCACCAACAAGCCGACATTGGTCAACGACTGCAGTCCTGATACCTTGAGCTTCGGTTGTCTCTGTGGTGATAACA
AGCAGCCTAACATTTCTGAGTACACCTTGACACTGCCCTTTTTCATTTGCCAGGAGTTTGTGGTCCAGTGCAGGACAGC
TTGTGGCTCGGACAACACTTGTGCGTCTAACTGCGCCGAGGATAACCCTTGTGGTGCCACCGATCCTAAGCGTTACAAC
TCAACTTCGACTGCTACAACAACAAcC > SEQ ID NO:5161 216114FL_205785_300922_1d
gcccccaaagctcctggactggtccctccaaaagccacagccgcaagcttggcagattggtaaaggtccagaacccag
gCCACTTGGTATTAAAGTATTTCTCCGTTAAGGAATGAAAGAAAGGTGGCTGTACTTCAGCTCATGCTTAGTTGGAACA
CAGCCCAAGCAATAGCACAAGAGGCGTCTACTCCAACCATATCCAGCCATTATCTAGACAAAATAGAGAAAGAAACAG
AGAAAAGCCACGATATCGGATATCGACCAACTCAAACTGGCAAAGCTGCAATCAACCCCCGACGTTGGGCTTGCTCTA
GAATCCGCCCAGCTGGCTGAGGAAGCGAATTCCTTCTCCTCGGCCTCCGTTATACTTCCTTTTACGTACCGTGATATTG
TGATAGACAGACGCCTCCAAAAAGGAACATCACAACAAAGTATCGCCAAGAATCCTCATCCGCAAGTACACAGGGGGAA
ACAACAAAACAAGCTTCCGACTCCTCGACTCCAGTGGGGGGCATCCCAGCCAGTCAATGATAAACACACAATCAAACAG
AGCACGATACAGAGAGAAGAAGCACCTCAAGCCGCCGTCAGTTTCACCCCCCCTTTAAAAGAGATTTGAACCCGAAAAG
GGCCGCTCGCATATTCAAGCCTTTCGCCAATGAGATCCCCCATCCATCCTCTCACATCCCGCACCCTCCACACCAAATG
CAAAACCCCCAATAAATTCTGTCGACGGGAGAAAAATAAGATATGCAGAGAGGAGCTCACTCAGCTGTGGCCACGtaga
aAGccTCGGCCCGTTCGCAACCCACAGcCTGTATCAAGTCAAAACCATAGAAGGGCCAGCGCCATGCCCAGCCGGAATA
ACGTCATGCATTGCTTGAATATGCCTCTTGTGCGTCTTATACCATCAGTATGAGCCACCATTTTCTTGCATCTAGTCGT
ATATCTTGCCGTGTCCGTGTCGCAGCCTCGGCAGcctcaGTTTcaacATCTGAAgaagaaggggaggaaaaAAAAagga
ggctggataGGTAGTTCtgcaGCCGTCAtagtgcAAAATattcccTCCATCACAAAAA > SEQ ID NO:5162 216142FL_212671_300842_1d
cACACCTGCAAGCCGTCGGCTCTTCCTTCCTATTCCCATTGACAGGATAAACATACGTCTAGGCTGCTTCTGCTTGGCA
GGAACTACCTTTCCGAGCATCTGCCACTGCCTATCTGGGTATTGGGCATTGCCCAACGTGGTGCGCACTTGCTCGATCC
ATACCTACAATTACGGGTACCTTGATGATCTGGGGTATCTTGTAGTTTAGTTTGTATCTGCCGGGTCACGAGCAGCCAC
CACCGCCAACATTTGGTACTAGGCAATACTTCTGGGTGCCGATATATCACCTGTCACGTCTTTTCAGGTTTTGCATCTT
TTTGCTCTCTTCATCATCATCATCTTTCTTCTTTGTCACAATCACTTTGCCGTCTTCCACGGACATTTCCGCAGATCTG

FIG. 2 continued

```
CATCACAGAGATCTGCATCAGAGAGGATTTCAAGCTTTTCCTCTTTGTTTGCCTTCCTCTCCTCTTCTCTTCTTGGATC
ACAAAACAATCGGCAAAATTGACATCTCGATATTTTCTGCCTCCAATCACAGCCGTCATACCACCTGTGGCGTCTTTGC
CATCAATTCTCTGCTGCGGTGCTACCCGCCCTGCAGCAATTTTTCCCGCTGGCCGTCTGCAGGCTTGCCTCGGCTGTGG
GTTTTTCGTCGACCACTGAGGCTTAGTGCCCATCAGCcactaAAGCGGCTTGACGTCGATTCTCAACTTTGAACCCTTT
TGAGCTGCCTCTGGCCTCTGCCTCATCTCTCCCACACCCTCACGCGCGCAGTCTTGAATCAACACCCCTTCACGCACTC
GCCATTGCCGCGCTCCTCGTCACGCTCTGCTCGATTAGCCGTCTCTCGCCCATTGATTGAACCTGCTCTCGGCCTCTGC
AGCCACCCTCACGCAACCTACGCCTGACATCCTCTGCGTCGCTCGGCTGTCTCCCGGTTTTATCCATCAGCTGAACCTT
CACCTTCGCCTTCGCTCTCAAGAGGGAATCCGAGGGCCCGGCCGTTCTCTGCCATCTATTGTTATTGCCATTAACGCTG
CTGCTGCTGCCACTGTCTCCTCTACTCCTGTTTCGCCCTCATATGTCTCAGCCGCCTCGCCGGATGCCTCTACTATCAC
ACCCTAAACACCGTATTAGCATACTTGATCTTACCAAACTGCCGTTGCAGTAACGCCGGCTTCATCTTCTTGACAATGC
CGTCGAAAACTAACAATGGTGTGGGAGTTCAGGTCGAGGACACAAAGATATGCGTTGTCATGGTTGGTCTCCCGGCCCG
CGGGAAGAGCTACATTGCCCAGTTAGCCCAGAGATACCTGCAATGGCTGTCGATTCCGGCAGCGACTTTCAATGTCGGC
AACTATCGGCGCAATGACGCTCCACAGCCGACTGCCGACTTCTTTGATTTTAACAATCCCGAAggaGAGCGGAAgCGCC
GTGCGGctgc > SEQ ID NO:5163 216147FL 207838_300829_1d
AAGAGGCAGGAAACTCTCTTTTGGCCCCAGAAAATGCCAGACTAGGTCCGAAGAACTATCGATTCTAACGCCGATGATG
TCGCTTGCCGGCAGTCGAGGGCTCGGAATCGGCAACGCGGTTCCTTGGTAATTGGCCACAAGCTGGGGCACTATCTGGA
GACTATCCGCCCGAGCTGTCCGTTTGGCCTTTCCTAAATTGCCCATTCGAGTTAATGATGTAATGAGGAGAGGGACTCT
TGAAAATGGATATAAGGGCGCAGTCGCGCAAGCTGTTCTGAGCTGAAAAGAAAGGAGAGAGAAGGTCTCTGTACAAGCA
GGAGAACAAATCTTATCTCAATTGCAATTTGAAATTCCATCGCC > SEQ ID NO:5164 216152FL 207987_300830_1d
gAAGACGGATTACTCGCACATATCGCGTGAGAAGAGCCTCCTCGTGGTTATTTGATGCTAGAAACCGCAGGTCCGTGGG
TTGTTTCGGGAGAGGAGGAAACCCagggqAAAGGGTCGCTTTGGATGAGGCTGTGCCGTATTAGCCGCGTATATTGCCA
ATGAGTGTGCTGTGTTTGGTGGTTGTGTTGCCTTCAagATGCAAAGTAATATATTTCCATCTTGGCATAGCATGTATTG
CTACGTACGTAGTAGtATGCAGATGGCTGGGATTGATGCTCTTACATGGAGTATattcccAGCTTCCT > SEQ ID NO:5165 216180FL 208005_300831_1d
GGGGGGGACGATGCGGCGCATGTACCAGGTGTGCAAGCTGGTGCACGCCGATCTGAGCGAGTACAACATCCTCTACCAC
GACGGCAAGCTGTACATCATCGACGTTTCGCAGAGCGTGGAGCCGGACCACCCGCGGTCGCTCGAGTTCTTGCGCATGG
ATATCAAGAACGTGGGCGACTTCTTCCGGCGCAAGGGCGTCGACACGCTGCCTGACCGGGCCATTTTCAACTTCATCAC
CGTGCCTGAGGGGCCGGTCGAGGAGCCTGAGCTGGCGGAGGCGATTGCCAAGTTATACGAGACGAGACTTCCTGCTGCG
AACGAGGAGGAGGCTGCTGCTGAGGAGGTGGACACGGAGGTTTTCCGGAACCAGTACATCCCGCAGACGCTGGAGCAGG
TGTATGACATTGAAAAGGATGTCAAGAAGCTCGGTCTTGGAGAGGGCAATGAGTTGGTGTACAGCAAGTTGCTGGCTGA
CCAGGTTGTTGCGCCCAAGGCAGACGGCGAAGGAGAGGATGAGGATGAGGAAGATTCGGACGATGAGTCGGGCGAGGGA
GCTTCCCTTGGCAGTGATGATTCTGAAGATGATGAGAGTCGGTTTGACAAGGGACGGCCGAGAGGTCGCAAGTTTGAGG
ACAAGGACGAGAAAAAGCAACATA > SEQ ID NO:5166 216187FL 208071_300831_1d
ATTTATCGAGTTTCACAGGGCTTACAACTCCTGTCCGGGGGGATTGGCAGATCTTGACAACTGAGGAGGACCGGATGCC
GTGACGTGTAGCTGCTAGGATGAATCTTGGATTGGAGATTTGCCAGTCGATTTGGATGGTGCCTTTCGGGATGGAGGGG
TGGAGGGTGGAGAGATATGACTAGTGTGGAGGTATCACAGCGTCGGGGGGCTGTGGAGAGTTCAGGGTAAGCCATTTGC
GGCTTTCACGCTCAGTAACACTCGGGGGTTTAAAACTGACTGATGGCCCATCTATACCTTGCAGAACGAATTTAGGTCC
TCGCAAGACTCTCCCTAGAGCCGCGTCCCGTCACTACTGCTGCTTTGGCATCAAATAGTGCTCAATGGCTAGGCCGAGG
GATTTGAAGACGATAGCAATGTAACCCATACGATCTGACTGAACGAAAAAAAACAACAACC > SEQ ID NO:5167 216204FL 208749_300808_1d
ACAAGACATTGATCCTCAGTGGTTTTTGGGGGAATGCGCATCCTTTCTAGCCTTTATTATCTGCTGTGATGTTGAGGGG
CACAAGAGCTGACTGGATTGGCAGAAGATAATGGCAAAAAGAGATGCGCAAACGTTAGTACAAGCTCGACCAAGAGCA
TCATCTTTACCATCACATCTCATTTTTCAAATACATGAAATGGTCAGATATATTCATACGTGTCCAAGCGTTCAGAAAC
CAGCCAATCTCAGTCTTACATACTTGGAACATTTACATAGTATTGAGTCGCCTATTCATCAGGAAATCCTGGTTCAACA
AAACTCCTCCACTCAGAAAAGAAAAGAAAGCTAAAGCACC > SEQ ID NO:5168 216212FL 211234_300897_1d
gttgatcataccaggcgccttttttctgcttgagcttgtcgatatccagctgcaGTTGGGACTGCCAACCTCCAATTGG
ATGCGCATCGTGGTTTGAGGGAACATGCGACAATTACCTTCCTCAAACACCACAGTCAATCAATCCCGCTGACAGCCGA
GGGATTGCCCCCATGCCGCCGCATCTGCACCCACGGTCACGAATGACCTCGTCACTCTTCGCTACGACGGTCCTTGCC
```

FIG. 2 continued

AGCTTCTTCGTTGTTGCCCTACCGCACTTATTACCATGCCCGGTCCCGCGGACAAAGTACGCTGATGGAGAGATTATCG
TCGACGAAAACGGCAGACGGAAGAGATGGAAGAGGAGGGATGTCGATACAAAAGACGGACTTGTGCAATTCAACCAGAC
AACAGACGATGAGATTGAGCGTGCAGCGGAGCGAATGACGAGGGAATGTCCCGTACCGAAACCCGGAGGGATGTTGGGA
GAGTGGCTCGGATTCCACGCCACGGAAGACAAGACAAGGGCAAACAGATGACGATTGATACCGCCAAATGAATAAAAAG
CAAAGAAAAAAGTTCAAATATGaaaAaaaaaaa > SEQ ID NO:5169 216216FL 208427_300960_1d
GGAACCAATGAGTCTACGGCTAGCCACTCGGCGGCTGGCGCTGTCAAGCCCATCTTCTCCAGCCTCATTGCTGGCGCCG
ATTAATGGAGTTTCACATGGAACGGTTGGCGTACTGACTCAGCGTCGTCACAAATGGTCGATCAATGTGTTCAAAGGAT
GGGGGAAATCTAGTTCCAAAGAATCTGGCGACAGAGGCCAGGACCCATCCGCCTCTGAATTGGACGATCCCAAGAAGCG
ACAGCAGTTCCTGCAAAGGAATATGCGGGGTGGAGTCGAAGACAACATTTTCCAGGACGAGATTGAGGCCGCGAAGCCG
GTAACCGATTCTCCAGCTGCCCAGACGACAGAGGAAAGGACGAAGGAGAGCCTAGCAATGGTGGTCGATCCAGATGCTC
GGAGCCGTATCCGGTGGCAGCGAAGAAAGGTCATCCAATCAGTGCGCCGCAACGGGCAGCTGACGAGAGAGGAGAAGAT
CAAAATGACGGAGCGCGAGCTCATTCACAAGAGCGACTTTTTCCCAACCAGCGTCAAGAAACTGGTCATGTTGGCACGG
CAGATTGCCGGCAAGCCAGTCGACGAGGCTATTCAACAAATGAAATGGTCAAAAAGAA > SEQ ID NO:5170 216219FL 218606_300935_1d
AACCACTCGGCACATCATGAGTTCAGGATACGGCATGCATGGCGGCGTCGGCCGTTGCTTTCCTTTCTGGCAGGAGGTC
ATGGCCTGCTATGTCGTCAACACATCCGCCGCAGACGACTCAGGCAAGAAGAAGTGCTCGCCCGTACTAGAGGATTACT
ACGAGTGTCTGCACCACAAGAAGGAGCATGCGAGAGCGCTGGCCCTACAAGCCGCATATGCCCGAGCTCAATCGGCAAC
CGCACGAGACGATGCGCCAAGTGCCAGCCAGATCCGGAATCTAGGACTGCTAGGGAAGACGGAGGACACAAAAGCGGTG
CTTGGACAGGGAAACTGAGGCAATAGACGTGGCGGAGTTCGATTTCTTCTGCGCGAATACAACCCCCTTGGCGCGCATA
GATAGCGCAGCAAGTTCAATATAGGAAAAGCAGACAGAACTGGAGAGCCTTTTCGGATGCTGATTGTGAATTGGCGGCT
AATTCTGTCAGTTTGGAGGCTGTAATTCTGTACAAATTCGACGTACATtTTCATCCA > SEQ ID NO:5171 216219FL 254823_301639_1d
TTTCGACACGCGTCGTGCTTGCTTGCTAGAACCACACAACTCACACAAAGATGTCTTCAGGATATGGTCTGACCGGAGG
TCCCTCACGATGCTTTCCCTTCTGGCAGGACGTGCTAGCCTGCTACGTCGTCAACACCTCGACTGATGACGACTCCGGC
AAGAAGAAGTGCGCCCCGGTGCTCGAGGACTACTACGAGTGCCTGCACCACAGGAAGGAGGCCTGCCAAAATCACAGCC
CTTCAGGCCGCATTCCGCCGCAAAGAAGCCGAAACACCCAGAGATAACGTGCCCTCCGCCGACCAGATCCGAACATTGG
GCCTGCTGGACCGCACCGACGAGGAAGTCAACATCCGTCCCGCCAAGTTCCTCCCCAAAATTGAGCACATGAACGGTTC
CAGGAAGCCAGAGACCAGCTAGAGAGGTGGAAGCAAAAGGATGCTGGGCAAAGCCAAATGACACAGCGTGAGCAAGTGG
TTGATTTACGGGCGCGAGGATTGAAAGGCGGAGCAGCACACAACATGCACATGTACAGATACCACGGCTAGAGTTCACA
TGGAGCTGCGCCCTCGCGGACAGTCTGTTTTTTTGACC > SEQ ID NO:5172 216227FL 208414_300960_1d
AAATCTTCAAGCTTCACTACAATCAAAATGCAGTTCTCCCTTGCCATCGCCGCCTCCGTGCTGGCTGCCACCGCCTCGG
CTGCTCCTGCAACCGTCTCCGGCACAAACACCAACGGCTCCATCTTCATGTTCGGAGACCCAGCTCCCGCTCGCAACCT
TCTCAACCAATTTGGTGCTTGCGGCCTCACCACCTACTTCGTCGGCCAGGTCCCCGACGACATGCCCCTTGGTTGCTATG
CCCGCCAACATCTTCGACCAATTCGGCTCTGCTCAGCACAACACTCTCTGTGCCAAGATCATCACCCTCACCCGAAACG
GCGTTACTCGCCAGGCTGCTATTGCGGACCGCAACCTCAGCAACACCAACTCCATTGACATGACTCTTGATCTGTGGGA
GGCCTTTGGTGGACACGACAACGACGGCAGCATCATTCCTGGCTTCAGCTGGTCCATTGCCAACTAAGGAGTTGGTGGA
AGTGGCCTGCGGTTGAGTAGACTGCGACCTGTACATATTTCTACTCTCTTTCTGATGTATATATTTATGACTTTTGAGC
CCTCTCAGCAGGAGATTCTTGTATATATATGATCCTGCATGGGA > SEQ ID NO:5173 216230FL 204434_300817_1d
gtaacatgatgatattggcgcagggcaTATGGACGACATGATTCTAATCTGGAGAGAAGCCGCATTGTACTGTATTAA
CTAAAGATTGGATGAGGATATTATCTGGCGTTTTGGATTGGCAAACGGGAATACAAATGGCGAGTCATGAATGATCAA
AAAaaaaaaacca > SEQ ID NO:5174 216230FL 218029_300914_1d
aactcatcctcacccTGCCATTCTCATCGCATCAACCGAAAGCATTTGCCATCGCACAATCGTCATTCAGCTACCAGAA
TTCCAGTTGTTCAATAAGGAGTCGCAATCATGGGTGGCGGAGATTTAAACTTGAAAAGTCGTTTCATCCCGGTCTGCG
GCGGAACCAGCAGGCCGTCTACGAAGAAGAACAAAAGGCTCTCGCCGAGCGCAAACGAACCCAGCAGCGCATCAATGAG
ATCAAGGAGGAGCGCGCAAAGGAGGAGATCCAGAGACAGCTGGAGGCTGCGGGAGGCACCAAAAGGGTTGATCGCGTCG
ACTGGATGTACCAGGGCCCTACCGATGGCCAGGCTGGACAACAGAAGAAACAGAGGCCTATTTGCTGGGCAAGCGGAG
GATCGACAACCTCATCAAGGGCACCGACCACAAGAACCTCGAAAAGGCCGCTGGACAGGAGAGCTTCATTGCGCTGCAG
AACGCGAACAGCGCGCGCGACACAGCCGCCAAGATCCGCGATGATCCTCTGCTGGCCATCAAACGACAGGAACAAGCCG

FIG. 2 continued

CGTACGAGGCCATGATGAACGACCCCATCAGACGCCGCCAGCTCCTCTCGTCCATGGGCATCGACGATGGCAAGAaGAa
ggaccgagATGGAGACGGAGACGGACA > SEQ ID NO:5175 216234FL 215388_300880_1d
ccgcCCAgcgtcAtcttttcacAATGAGatcctcCCCCCTTCACCCgatctagcccTGctcgtctaCAGCTTctcATctc
AAATCAAGGTtacAGATAGCCCCGTCCCGCTTCgctagcAAGAAGCGAGGCgctacggcGGGCGTCGAGGAAAAGATCt
TcgcACTCGGACACATCCTGGACgtCAATCTGAGTACggcCATTcgcCTTGGCAAGAATGCTTGAGGGTGtCagcAGTT
GTAGcCAGTATCTTAAGCTGACACGGACACCGTGCTCGGAAATTTTGTCAATGGCAGCGTCCGTAATAGACACACCCTC
TGTCGTGGCCCGGAGCTTGACAATCTTCTTAATCTCGTCTGCCGAGTATGGGGAGGTGGGGATGATGAGCATTCGGGCA
AGGAAGTCAGGAGGAATGCCATGAGCCGCGACAACGTCGTCGGTACCTCTTATTGTGGACATTCCACGGTTGGATGCCA
AAACCACAATGGGGGCGAGGTGTGATTCCAATGCTCGGTTTAAATAGGTGAAGCACTCCACGTCAAGCATGTGAGCCTA
TTgTaGTCCAGTGTTAGTATCTGATACCAGTAGATTAAAAAAAAAacaaaaac > SEQ ID NO:5176 216234FL 244423_301558_1d
TCAACAACAAGGTGGCGGAGTGGAGAGAGGAAGGGAAGGCCGAGATCGTCCCGGGGGTTCTCTTCATCGACGAGGTACA
TATGCTCGACATGGAGTGCTTCTCGTTCCTCAACCGGGCGCTGGAGAACGAGATGTCTCCCATTCTCGTCGTCGCTACA
AACCGGGGCATCACCAAGATCCGAGGGACCAACTACAAGTCCCCGCACGGGATCCCGATCGATCTCCTGGACCGGCTGC
TCATCATCTCAACGCAGCCATACACCGAGGACGAGATGCGGCGGATCCTGGACATCCGGGCCGAGGAGGAGGACGTGGA
AATGTCCGAGGAGGCCAAGGAGCTGCTCACCAAGATCGGGCAGGAGACGTCGCTGAGGTACGCGATCCATCTCATCACC
GCCGCGGCGCTGGCTTGCCAGAAGAGGCGGGGGAAGGAAGTGGGCATCGAGGACATCAGCAAGGTCTACTCGCTCTTCA
TGGACGTGAAGAGATCGACGCAGTTCCTCATGGAGTACCAGGAGCAGTTTATGTTTAACGAGGTACCTGATGCTACCGA
TATGGTGGAAGGATAGATGGAAGTCGTCATGTCTAGCTGATTTTACGTAGCTCTCTGCGAGAAGTTAGTAAAGATTTT > SEQ ID NO:5177 216238FL 1100515_301461_1d
TGAAGAGTGAAGAGAGACACGGCCCTGGTTCCCCCCTTCACAAGAGAGAGTGCCCTGGCCAAGGTTCAACGGGCCGAGG
ATCTATGGAACACCAGGGACCCCGAAAAGGTGGCCCAGGCCTACGCTCCCGATTCCATCTGGCGTAACCGCAACGAGTT
CTTCCAAGGCAGAGCGGCAATTGTTGAGTTCTTGAGGCGTAAATGGGACGAGGAGAAGGAGTACCGTCTGAAGAAACGT
CTCTTTTGCTTCGAGGCAAATAAGATTGCGGTGGAATTCGAATACGAGTTTGTTGATGGAAGCGGGGTGCAATGGTGGA
GAGCTTATGGCCTTGAACATTGGACCTTCGACGATAATGGCTTGATGACCAATCGTGACATGTCTGCTAATAATGTGCC
CATCAAGGAGGAGGATAGGTTGTTCAAGTGAGATTATTTTATCCTTGCAAGTGCAATACTCCCAGGCACTAGGACCACT
TTTTTTTATTTCATCTTTTTTTCTTTTCAAACTTTTGTTGTTGTTTTGTAAAAAGGAAGCTTTCTTTTATTAAATAA
AGGATCAATGTTGCATAGGGCAAAA > SEQ ID NO:5178 216238FL 217984_300913_1d
tgtacaaACTCCAATCACTCATACCTCCCTTCTCTCAGCATACTCAACCTCATAACAACCACAATGGCTGCACAAGAAGG
ACGAGCTCCATATCCGCCATTCACACTTGAGACAGCTCAAGTCAAAGTCAAGGCCGCTCAAGATGCTTGGAACACCAGA
AACCCAGATGGTGTCAAAATGGCATACACCCCAGACTCAATCTGGCGCAATCGCGGCACATTTCTACAAGGCCGCGACG
AGATCAAGGCGTTCTTAACCGACAAATGGAGCAAAGAAGACGGCTACCGACTTCGCAAGGAGCTTTTTGCTTTTACAGA
CAACAAGATTGCCGTGCAGTTCTGGTACGAGTGGCATGATGAGGCAGGCCAGTGGTGGCGCACGTACGGGCTTGAGGAC
TGGACTTTTGCCGAGAATGGGCTGATGAGGAAACGTCAGATGAGTGGAAATGACGTGAAGATTAGCGATGCGGAGAGAT
GGTTCAAGGATGGCGTTGATGTGAACACCGTCGACATTTCCGAGAAGCACTGGTGAGGGAGGCTATTTACTAAACTTTA
ATGAAGTCTTTTGAATATATAGATAAGCAAAGTTTGGTTTAcgaAAAAAAA > SEQ ID NO:5179 216242FL 208495_300960_1d
GCTCGTTATTATCTTTTGTGTTTAATCGGTTGATTGAGAAATCATGGCGACGACTGTGTCGGAGGCGCCCAAGATGGGC
ATTGAGATGATGCTGGAGCGCATCATGGGCGCGATGGAGAAGCAGAACCAAGAATTGACTGAGCTGCGAAAAGAATGCT
CAGATCTTCGTACGTCGAACAAGAGCATGGAGATTATGCTCCAGAACATTGCTCAAGGACGCAGCAATAGCCCTCCGGG
TCTCTCCGCCGGCATGTCTCCCAGCATTGGCCGCGAGCGAGCCCGCTGCCTTTCTTGCCTCGCCGCTCCACAGCCCCC
CAGGCTGGTCCTTCTCAGGTCTTAATCACATCGCCCTCTCACGATATCACCACCCACTCTTTTCCCTTCCCGGATGATC
GTGAGATCCCCGGATTCTACGTCGTCATCCCTGCAGGCGGTGCTGGTACCCGCCTGTGGCCCCTCTCTCGCGAGAACCA
CCCCAAGTTTCTCCTCGATGTCAACCTTTGCGGCAACAGCTTGCTGCAGTCGACCTGGGAACGACTTCTTCCTCTGGCT
GGCCCTTCACGAATGACTGTCGTCGCGGGACCTGCTCACTCCGAGGGCATTTTGGGC > SEQ ID NO:5180 216246FL 187166_300674_1d
CCCACGCGTCCGGACTGGCCCGACAATGACTATCGCTTATTTTGTGGAGATCTGGGCAATGAAGTCAATGACGACGTCC
TCTCAAAAGCTTTTTCACGGTTCCCCTCCTTCAACATGGCAAGGGTTGTTCGAGATAACAGAACTGGCAAAACAAAAGG
ATATGGATTTGTGAGCTTTTCAAACCCTACTGACCTTGCTGGAGCAATTAAACAAATGAATGGGAAGTATGTTGGGAAC
CGCCCTATTAAATTGCGTAAAACCAATTGGAAAGAGAGGACCGATGTTGATGCTCTACAAAGACAGAAGAATCACATCC

FIG. 2 continued

AGAAGAAACCTAACATGCCCAAGAACAGTATCCTTCC

> SEQ ID NO:5181 216246FL 22136_300069_1d
TGTGGACACACGTTTTCATAAAGTAAATACCACCGGTTGGGGCTAAAGCTAAACATAGCAGCCCAACAATACATAACCA
TACCGTTTTCAACAAAACTAATGATAATGTTTGTTCATTTATATTTATGAGTAACAGGTTTGGAAATTTTAAGCCACAA
AAATAAAAGAGATCGTCACTTGTGAAGTATGCTCTTCTTCACAGTTTTTTGCTTCTTATTGCTGTGATGCTTTTGTCTT
TCAGCAGCCTCCTGATCTGTTCTCTCTTTCCAGCTACTCTTTCGTAGTTTTATCGGACGATTTCCAACATACTTACCAT
TCATTTCTTTTAAGGCTGCTGCTAGATCCGCAGGATTTAAGAAACTCACAAACCCATAACCCTTGGTTTTACCAGTCCG
CTTATCTCTAATGACCTTGGCCATATTGAAGGTGGGGAATCTAGCAAATGCTTTGGAAAGAACATCATCATTCACTTCG
TTCCCAAGATCACCACAGAACAGACGATAGTCATTTTCTGGCCATTCTGAAAGAGTAGGATCCTCCCAAGACTGTCCAG
CAGCTTTACGAGGAATGGCTCTCTTTTTAGTTTCTGCTTTGTGTTCGGTTTCACTACTTGCCAAAGCAGCTTTTACATT
CTCAAGAGCTTCTGGTGTAATTGTCTGTGCATCTCTTTGGAACAATTGATGTGCCTGTTGGTACTGAGGGTAAGCGTAG
ACGGCAGGAACCGGTCCAACAGGCTGAGGATAGACCGTAGCTCCGGGAATGGATGCCACAGGCGCCGGTACAGCAGGCG
AAGGCGCCGCCGCGTAAGGCTGTGGAGGCTGATACGGAGCGGAATAGTAAGAATTAGCTGCCTATGTGTACTGAGACGA
GGAagatgaagaagaagaacctgaagatggtgggattgacatcggagaagcaaatcgccgcctcgcaaaatcggacgcg
tggg > SEQ ID NO:5182 216246FL 208648_300807_1d
aaaggaaacgctcaaaggtacgtttattacgggggacagctgcgagactcccatcagccataagaaaaccaaagaaaaa
cGGGGTTTgttCATCATGTCACATCCACCACCTCCAGGCACGAATCTCCCTGCGCGCCCGCCCGCCAGCACATCGAGGC
CGGGCTTCAGATCGAGCTTCAACCCGTCGGGCCAGAATTCTGCcGCCCCGGTATCATCGTCGTCGACGTCGTCGTACTC
GAATGcaAACTCCGCGCGAGCAGCCGCCGCCTCGAGCTACCCAGCCTGCCCAAACCCACTATGGCTCGTCCTACTCGAGC
TATCCTAGCCACGGTCGGGCTCGTCCGTGAACCgctCTggtTCGGGATACTCGTACCCTCAAGCAGGCAATCAGCAGC
AACACTATCCCCAGCAACAACAAGCGCAAAGCTACGCCCCTCATGCCTATTCGCAGCAACAACCGCaGTCGTACCAGGG
CCAGTCATACCAGGCTCAgcCATACCAAgggcAGCAgtacCAAGCAgcaccgcgtaTccagaaCCCTTTTcCtacgccG
GGTGCTGCTgctgccgctggAccCGAtta > SEQ ID NO:5183 216249FL 212775_300843_1d
GCCCAATCGCCAAATACACAAATCCATTGAGCTACAAATAACAAGCAGCATGGACACCAAACCTGACACTTTCTCCTTG
GCCGTATGCGCCATGTTGACTTCTCCCGCAATCTCCGCTAAACGCTTCCAAACCCAAGCCGGGCTGCGTATGCTAAGAG
GAAAATTCTAACCGCGAAGAGTGAATGATCTTCTCAACG > SEQ ID NO:5184 216249FL 220081_300951_1d
CTAACCCCAATCGCCAAATACACAAATCCATTGCGCTACAAAGAACAAGCACCATGGACGCCAAGCCTGCCACTTTCTC
CTTGGCCGCTGCGCCAGTTGCTTCTCCCGCAGCCTCCGCGAGCGCTTCCAAGCCCAAGCCGTGCTGCGTATGCAAAGAG
GAAAAGTCGAAGCGCGATGAGTGCATGCTCTTCTCAACGGCCAAGGATCCCGCAGCCGACTGCAGATCGCTCGTTGACC
AATACAAGAGCTGCATGCAGGGCTTCGGATTCACTGTATAAATCAAAATATCTTCATCTTGGCGCTATGCCTTTGTACA
TTATCACCATATAGACTACTCGGAAAAGTACAGCGCTCGATTATTCTCCATTCTAGaGTAACGATCCCATCCCctgata
aAAAAAAAcAcaaAa > SEQ ID NO:5185 216256FL 209165_300812_1d
AGCGCAGCAACAGCCCACGGGACAGGCGGAGGACAGTCGCAGTCGGGACAATCTCAGTCGCAGGTTCCCCAGCACAAG
CGCGTCTACCAGGCGTGCATCCCGTGCCGTCGCCGCAAGGTGCGCTGCGACCTGGGCAGGGTCGACAACCCGCACGACC
CGCCGTGCGTGCGCTGCCGCCGCGAGAGCAAGGAGTGCTTCTTTAGTGCTACGCGCCGCAAGAGAAAGACGGACGAGGA
CGACAGCGATGCCGACGAGTACGTGGTGCGCAACGGCCGCAAGAAGCTGCACGCCGCCGACAGCCCGCCCTTTTCGCGC
TTCGACAAGCGCCAGTACAGCGACACGCCCCTGACCCCCGGGGATCCCATGGCAGGACCCAGCCGCTGCGCAGGC > SEQ ID NO:5186 216257FL 208662_300807_1d
agtgacggcacttttcgacgacgaATTGACGAGCAATTGATCGATACACGCGGTTCCCGCTGCCAGAACAAGTCAAGAT
GGTTTCTCAGACTCCCTTCCGCGCTGCGGAATTCAAGAGCGCCTACGGCCCAAGTACGCTTTCCAGCCCAACTACCGC
GGCATCACCGTCCAGACTGCCACCCGATATGGCTTCCGAGCTGCCACCATCGGCGGTGGTCTCGGCGTTGCTCTGATGC
TCTTCGCCTCCAGCCTGCCCCGTGTCCGTTCTGACATCCTCGTAAAAATCCCCTTGGTTGGCGGCTTCTGGGAGAAGCA
GGAGGTTCACCCTGCCGACAACCCTTTCTAAATGCACTTGTTGGATGGTGTTTGTAAATTGTAACAAGGCTTTGCGCA
GCTTGCCTTTGTATAAGAGATACACAATAGACTTTTCCTAAACCaaAAAaaaaAagaa > SEQ ID NO:5187 216259FL 175122_300530_1d
CCCACGCGTCCGCCACCGCGACACTCCCCTTCCCTTCCTTCTCCGGTCTCCTCCCTCTCTCGTCGTCGTCGTCGCC
GTCGCCGGCTCGCCGCGTTCTCCTCCGCCGCCGCTGCTGAGCCGGGATGGCCGCGCGTAGCCCCTACTTCGTCCCCGAG

```
AGCGAGGGGATCCGGGCCGGGGAGTCGCCGGCCGCGGCGCTCCGCAGGATCCTCGCGTCGCCGGGGGCGCACCAGGCCC
CCTGCTGCTTCGACGCGCTCGGCGCCCGCCTCATCCAGCGCGCGGGGTTCCCGATCTGCTTCATGGGCGGTTTCTGTGT
TTCTGCCGCACGACTTGGATTGCCAGATGCTGGTCTCATCTCATATGGAGAAATGGTAGATCAAGGGCGTCTGATCACT
GAAGCTGTATCACTCCCAGTTATCGGCGATGGTGATAATGGCTATGGAAATGCTATGAGCATTAAGAGAACCGTAAAAG
GGTATATTAATGCTGGTTTTGCTGGAATCATGCTCGAAGATCAGGTGGCACCAAAAGCATGTGGACATACTGAAGGAAG
GAAAGTTATCTCAAGGGAGGATGCTATCATGCACATAAA

> SEQ ID NO:5188 216259FL 226961_301006_1d
ACTCCCCTTCCCTTCCTTCTCCGGTCTCCTCCCTCTCTCGTCGTCGTCGTCGTCGCCGTCGGCGGCTCGCCGCGTTCTC
CTCCGCCGCCGCTGCTGAGCCGGGATGGCCGCGCGTAGCCCCTACTTCGTCCCCGAGAGCGAGGGGATCCGGGCCGGGG
AGTCGCCGGCCGCGGCGCTCCGCAGGATCCTCGCGTCGCCGGGGGCGCACCAGGCCCCCTGCTGCTTCGACGCGCTCGG
CGCCCGCCTCATCCAGCGCGCGGGGTTCCCGATCTGCTTCATGGGCGGTTTCTGTGTTTCTGCCGCACGACTTGGATTG
CCAGATGCTGGTCTCATCTCATATGGAGAAATGGTAGATCAAGGGCGTCTGATCACTGAAGCTGTATCACTCCCAGTTA
TCGGCGATGGTGATAATGGCTATGGAAATGCTATGAGCATTAAGAGAACCGTAAAAGGGTATATTAATGCTGGTTTTGC
TGGAATCATGCTCGAAGATCAGGTGGCACCAAAAGCATGTGGACATACTGAAGGAAGGAAAGTTATCTCAAGGGAGGAT
GCTATCATGCACATAAAAGCTGCCGTAGATGCTAGGAAAGAGAGTG

> SEQ ID NO:5189 216259FL 217553_300909_1d
GGTTAATTTCGGATTGCCACAGAATAGGAGACTTGCCACTCCGGTGGTTATTCTCGGCATATATGCGACGTTAGAATAA
CCTGTTTAATCGTATATAGTCACTGTGAAGGAATCCATGAGGGCAATGTTGATGAATGTTGTCAGTGAAGTTGGAAGTA
TAGAACTTAGCCGGCTACAAACTTAAAGAGCGTTGCCCAAAATGAAGCCCTATCCATTCCAATTCAACAGCACATCCTC
GT

> SEQ ID NO:5190 216259FL 208958_300810_1d
ATACTCGGACCCAAGCAAGATTCTCGCTACATGCTGCTCTGACGATGGACTAGGATCACGTCTGGTGGAAGAAGCTAGG
TTCCCGTACATATGTTTGGGTGGATTCATGGTCGCGTCTAGCTTGGGATTACCAGACACTGGATACATTGCCTTC

> SEQ ID NO:5191 216262FL 218530_300967_1d
AGGGACTGCTGCTGGCGGCCATCCGAAGCAATGACCCCTGCATCTTCATGGAGCCCAAGATCCTGTACCGAGCCGCCGT
GGAGGAGGTCCCCGTGGCGCCGTATGAGTTGCCTCTGTCCAAGGCGGAAGTCATCAAGGAGGGCAAGAACGTCACAATT
GTTTCATATGGTCAGCCGTTGTCAACTGCATGGCGGCCATCAAGCAGGCAGAGGAGGATTTGGGCATCTCCGTCGAGC
TGATTGACCTGCGCACAATCTATCCCTGGGACAAGAAGACTGTGTTTGAAAGCGTTCAGAAGACTGGAAGAGTCCTGGT
CGTCCATGAGTCTATGGTGAACGCTGGTGTTGGTGCCGAGGTGGCTGCCGCCATTCAAGAGAACGCAGATACCTTCAAC
AGGCTCGAGGCTCCCGTGTCTCGTGTTGCTGGATGGAGTATCCACAACGCTCTGATATTCGAAAAGTTTCACGTCCCAG
ATGTTGCAAGAATTTACGACAGTATTAAAAAGACGGTTCAGTACTAAGAATGTGGGGAGCGAGTAACGTGTGACTTTAT
CTTTGAATTTCTAGAGCTTCTTCCTAGCATAAGTGTAAATAATAGAGAATAAAGCTTTCTGTAACACAC

> SEQ ID NO:5192 216283FL 1096723_301433_1d
GAGAGAGAGAGAGAGAGAGAGAGAGAGAGAGAGAGCACCTGCACCATGAGATTCCAGGTCCAGTGTAAAGCTGGTTTGTTTCG
ATTCCCAAATTAGAAAATCTAAGGTCTTTTATCCAAGAGCACGAAGGAAGAGATATAGATATGGGCAGGCTGTACTTGC
TACGCCTAGATGGCAAAATTTATAGCTGTCGCTACTGCAGGAGCCACTTGGCCAGCTGTAGTGAGTTAATCTCAAAGAC
TTTTCACTGCAGACTTGGGAAGGCTTACCTTTTCAACACAGTAGTCAATGTCTCAGCAGAGCCTGAGGAAGACCGGGTG
ATGACGACAGGCTTGCACAAGGTTTCTGACATTTTTTGCAAAGGATGTCATCAGATTGTTGGCTGGAAATATGAAGAAG
CATATGAAGAGAGCCAGAAATACAAAGAAGGCAAATTTGTTCTGGAGAGAGCAAGGATAATAGACGGTAATGGCGATAG
CAGTGGATTCTACTTGGAATCCAATCAAGCCTGCAGTGATGAAGAGGAGGCTTGATAGTAATAATATATCCCACTTGCA
ATATGTTAAATGTGCTATTTACATACGCTAATATAATATATATAGTAATGTAGGCGCATGTGGAATGGTAT

> SEQ ID NO:5193 216283FL 1097550_301445_1d
GAGAGAGAGAGAGAGAGACACACACACACACCATTCTTATTACTTGCACAGATTACCTATGGCTTTCTCTCTCTCTCTG
GAGGAGAAAGCTTTTGGAGCTGGTTTTTGCCTCCGCCCAATTTAGCACATCTGTGGTTTTGGTGGGTCAAGGTCTCCTT
TTTTCTTTCAAAGTGAGGAAAAGGAATAAAACACACATATGGGAAGACTGTACTTAGTGCAGCTGGATGGCAGAATTTA
TCAATGTTGTTACTGCCGGAGTCACTTGGCCAGCTGCGGCGAGTTAGTCTCAAAGCGTTTTCATTGCCGACTCGGGCAG
GCTTACCTTTTCAACACAGTAGTCAATGTTTTGGAGGGGCCTCCAGAAGATCGAATGATGTCGACTGGCCTACACAAGG
TGGTTGACATCTTTTGCAAAGGCTGCCATCAGATTGTTGGTTGGAAATATGAAGTAGCATATGAAGAGAGTCAGAAGTA
CAAAGAAGGGAAATTCATATTGGAGAGAGCGAGGATGATAGATGGGAAAGTAGAGAATCCTATTTGGAAGTCAATCAG
GCTGGAAATTATGGAGACGAGGTTCAATAGTTGTCTACTCTTGTTTCAAGTGCAATATTTTAATGGACATATATGTGTA
CATAT
```

FIG. 2 continued

> SEQ ID NO:5194 216283FL 50790_300156_1d
AAATGGGAAGGATATTCACGGTGGAGCTTGAAGGAAGATCTTACAGATGCAGGTTCTGCAGAACCCATCTCGCTCTTCC
CGATGATCTTGTCTCTCGGTCGTTTCATTGCCGTAGAGGAAAGGCTTACCTCTTCAACCGTTCGGGGAACATAAGTATG
GGTCCTCTAAAGGAAAGACTGATGCTTTCCGGTATGCACACCGTAGCTGACATTTTCTGCTGCTGTTGTGGACAGAATG
TTGGCTGGAAATACGAATCAGCGCACGAGAAAGCTCAGAAGTATAAAGA

> SEQ ID NO:5195 216283FL 255176_301642_1d
GAGAGAGAGAGAGAGCACCTGCACCATGAGATTCCAGGTCCAGGTAAAGCTGGTTGTTTCGATTCCCAAATTAGAAAAT
CTAAGGTCTTTTATCCAAGAGCACGAAGGAAGAGATATAGATATGGGCAGGCTGTACTTGCTACGCCTAGATGGCAAAA
TTTATAGCTGTCGCTACTGCAGGAGCCACTTGGCCAGCTGTAGTGAGTTAATCTCAAAGACTTTTCACTGCAGACTTGG
GAAGGCTTACCTTTTCAACACAGTAGTCAATGTCTCAGCAGAGCCTGAGGAAGACCGGGTGATGACGACAGGCTTGCAC
AAGGTTTCTGACATTTTTTGCAAAGGATGTCATCAGATTGTTGGCTGGAAATATGAAGAAGCATATGAAGAGAGCCAGA
AATACAAAGAAGGCAAATTTGTTCTGGAGAGAGCAAGGATAATAGACGGTAATGGCGATAGCAGTGGATTCTACTTGGA
ATCCAATCAAGCCTGCAGTGATGAAGAGGAGGCTTGATAGTAATAATATATCCCACTTGCAATATGTTAAATGTGCTAT
TTACATACGCTAATATAATATATATAGTAATGTAGGCGCATGTGGAATGGTATTTTTCTTTTTTCATTCCATTTTGAA
TGCATCTA

> SEQ ID NO:5196 216283FL 255060_301641_1
GAGAGAGAAAGAGAGAGGAGCATAGCAAAGCCAAGCCAAGAGATAGATAGATAGATAGATAGATAGATAGAGAGACAGC
ATAACCAAACCAAGCCAAGAGAGAGAGAGAGGAGCATAGCAAAGCAAAGCCAAGCCTCCTTCATGGGTTTCCCTGGN
TGAAAGGTATCCATTTTTTTCCTAGAGTGGGGGAGATATCATAATTATACATATGGAAGGCTGTACTTAGTGCAGCTG
GAAGGCAAAGTCTATGGCTGCCGCTTCTGCAAGAGTCACTTGGCCAGCTCTAGCGAGTTAGTCTCAAAGAGTTTTCATT
GTAAGAATGGGAAGGCATACCTTTTCAATACAGTAGTCAATATTTCCCAGGGGCCTCAGGAAGACCGGATGATGGCAAC
AGGACTACACCGGGTTTCTGACATCTTTTGCAAAGGCTGCCATCAGCTTGTTGGCTGGAAATATGAAGCTGCATATGAA
GAGTGTCAGAAGTATAAGGAAGGGAAGTTTATTTTAGAGAGTACAGAGCAAGGACAATAGATGGAGATGGTACTCAATT
CTTCTTGGATGTGAGTCAAGGCAGCAGTGATGGAGAGGAGGCCTGATAC

> SEQ ID NO:5197 216283FL 238585_301295_1d
GCAATCTCCAGCGCGGGTCGATGATCGCCGCGGCGCGATTGGCGGGCGAGATTCCGGTCGATTGAATCCATTGATCGAT
CGGTTGATTGATTGATTGTCGCCTTGGATTTTGGCTGGTCCCAAGAAAGGGGGCTTTGGCGAAATTCGCGTGTTCTTGG
CGGATTTCCACCACCGGCGCTGCCCCCGGTCTCTCCAATGCAAGGATTTTGAGACAGGTCGACTGATTCGTATCGATCA
AGGGAGATGGGGAGGCTGTGCCTGATTGAATTGGACGGACGATTCTATAGCTGCCATTCGTGCCGGACACATCTCGCAA
ACTTCGATCAATTGATGTCAAAGGCCTTTCACTGCAAACACGGAAAGGCTTATCTTTTCAACACAGTTGTTAATGTGTT
TGAGGGACCATTGGAGGAGCGGGTGATGACCACTGGTATCCACACGGTGGCTGACATCTACTGCAAAGGCTGCCAGCAG
AACGTTGGATGGAAATACGAAGCCGCGCAGCACAAGTCCCAGAAGTACAAGGAAGGGAAATTCATTCTAGAGAAGTA
GAGTTGTAGGCTGTGAGAGAGGCGATTTCTATCTGGAAACCCAGGCGATTGGAAGTGACCCGGACGA

> SEQ ID NO:5198 216283FL 238123_301292_1d
GGGAAAGAGGGACTTGGCGCATGGGGAAGATCATCCAGGAATATTTGTCGGGCGATCGAATCTACTGCTGCAGCAATTG
CCATACCCATGCCGCCGATCACGAGCAGGTTGTGTCCAAGAATTTCAATGGGCGATTTGGCCGTGCCTACCTCTTCAAC
AAACTGGTGAATGTGTTTCTGGGGCCCAAGGAAGAGCGAATGCTCATCACTGGATTGCACACGGTGAACGATATCTACT
GCATTTGCTGCCAGCAAGTCCTCGGCTGGAAATATGATACTGCGCAGGAAGAGAGGGAGAAGTACAAGGAGGGCAAGTA
TATCATTGAGAAGAAAAGATGACCAAAGAGAATTGGTAACGTGTGAATACGATAACATTCATGTATTTAATAATAAGA
ATCCTATTTTAATTC

> SEQ ID NO:5199 216283FL 198921_300647_1d
CCCACGCGTCCGGCACAAAGTCGATTCCTTTCCGCCTCAGCGGGGCCGCTTGTTTCGATCGAAGCATCGCGAGAGGCAG
CCCGCCGCCTGGGTTTCGTGCCGATTTTGATTTCCTTTTTCTTGGCCGCCTCTGCCTCTCTCTCTCTCTCTCTCTCTCC
CTTTCTTGGTTCGATTGTTCCTGGTTCTTGGCCTGATTGGTTGAACCTGCTTCTTCTGGAATCAATTAGGGGAGAAATA
TTTGCAGGAGAGGGCGGTGGCGATGGCGGAGTTGGTTGGGCCGCGGGTGTACAGCTGCTGCCATTGCCGGAACCACGT
CTGCCTCCACGACGACATCATCTCCAAGGCCTTTCAGGGGAGGAACGGCCGTGCGTTTCTTTCTCTCATGCTATGAAC
ATATCTATGGGTCCAAAGGAGGACAGGCAGCTTATGACAGGGCTTCACACAGTTGCTGATATCTACTGCCGTGATTGCC
GTGAGGTATTGGGTTGGAAGTATGAAAGAGCATTTGAAGAATCCCAGAAGTACAAGGAAGGAAAATTCATATTTGAG

> SEQ ID NO:5200 216283FL 195977_300639_1d
GATTTCTCCACCACTCGCTCGGCATTTGTTCTCTCTTCCTCAGCGATTTAAAGGACCTGACCCGTCTCACGAATCAAGA
GGCATAACCGTTACTGCCATCTCAGACCGCTAAGCAGCGATATCGTCATATTCGCGGCGCTGTGAAGGACAAGAACGAG
AACGAGAACTGTTGAAGCTTGGCTCACCCAGTCCCCGCAGCAATGGGCCTGGCCTACAACACCTACCTCACCAGCAACA

FIG. 2 continued

```
AGATCTACGGTTGCAAAACATGCAAGGCGCATCTTGCGAACCACGAGGACATCATCTCTCGGAACTTCCGGGGCCAACA
TGGCAAGGCCTACCTGTTCCATCGTGTCGTCAATATCGACACCGGTGACCCTAATGAGCGTAACATGACCACCGGCCGC
CACATTGTCCGTGACATCGCCTGCCATCAGTGCAAAGAAACGGTGGGTTGGAAGTACGACAAGGCTTTTGAGACTTCTG
AAAAGTACAAGGAGGGCAAGTTCATCCTTGAAGCTGAGCTGCTATGTAACGTCGCTTGATTGTACGAATTTCACCTCTT
TAGCATGATTTCATCAAGATGGGCCCTTCTTTTTTCTCTCATGTTTTTGTTCTTGGCTTCAATAGGCGttCaACAGATA
GTAGTTTCAGACAAAGCACAGCaTCcttgggCTGGAGTGAt > SEQ ID NO:5201 216283FL 162283_200171_1d
aagtGCAACATTGACAAACTTTTAATCCATATCTTTCTTAACTGGGTTGTTTTAATTTTCAACCTTAATTCTGAGTCTT
CAATTTAATACTGATCCAAAAGTCTTCTAAGGCAAAGATGGGGAGACTATTTGTGTTGACTCTTGAAGGCAAGATCTAT
AGCTGCAAGCACTGTGGAACTCATCTTGCTCTTTCTGAAAGCATTGTTTCTAAGTCTTTCCACTGCCGACATGGGAAGG
CTTATCTCTTCAGTAAGGTAGTGAATGTCACTTCTGGCGAGATAGAGAATAGAATGATGATGACTGGTATGCACACTGT
GGCCGACATTTTCTGCGTCTGTTGTGGGTCAATTGTTGGATGGAAATATGAGACCGCCCATGAGAAGAGCCAAAAGTAC
AAGGAAGGAAAATCCGTGCTTGAGCGGTTTAAGATTTCTGGCCCTGATGGAAGCCATTACTGGGCCAGTCATGAAACTC
ATGTTGCAGGAAGTGATGCTGATGATGTTTGATCACCTCACCATCAGATAAAATAGTTCTATCCCAAATGTACATTCTT
TAACCTACCACCCCACTATATTCTTTATGGACCATTGGATTCTTGAATTGCTTGCTCACTCAGCAGCTTCTTCTACCTG
ACCTCTATCATGTATAATAATATGGAAGTAGCCATATAATATTGCAGCCTAACATGACCAtCTCCCCTATATTTGTTTG
TAATGACAGTCTTTACTATACTag > SEQ ID NO:5202 216283FL 146948_301204_1d
CATCTTTTGTAATCATAAACTCACCAAACTCCGACACCCCTCTTTGCTTTACCCCACTGTACAGACAGCCCCGCAAAAC
ACACACACTCTCACTCTCTCTCTGTGGCAACCAGCTGATCAATCTGCGATTGCTTACCTTGACACTATGACCAGATA
AAAACAGATACACTTNTTTGGTCAAAGAAGAAAGGCTGTGTAGATAACAGATTGTAGTTTTTTGAAGGATATAAAGAAG
AGTGTCACAGCTATTGAGAAAACTTGTGCTTATTTTGATCATCAAATGGCTGAAATTATTGGCCCTAGATTGTACAGTT
GCTGCAATTGTAAAAATGAAGTTGCACTACACGATGACATCATTTCTAAGGCTTTTCAGGGAAGAAATGGTCGAGCATT
TTTGTTTTCTCATGCAATGAACATAGTCGTGGGGCCAAAAGAGGATAGACAGCTAATGACGGGCCTCCATACAGTTGCT
GATGTCCATTGCTGCGACTGTCGTGAGGTTCTTGGCTGGAAATATGAACGCGCTTATGAAGAGACGCAGAAGTACA > SEQ ID NO:5203 216283FL 122085_300015_1d
cccccccgggtgcttttgcttcggtcgcccggtcagtgctGCAGACAAGCCACCCCCTTCCTCGCGTAGACTGCTCCC
CCCACAAACAAAAGCAATCCTAATCTCGGATTCGAGGCGAACGAGCGGCGGCGAGGGAGGGGACTAGCGGCGATCGCG
ATTGGAGTCGGGTGGACACCGATCGCGGCGGCGCTCTGGGGGATCGGGGTGTGGAATCGAGGGGGAGGGAGGAGGAGAC
GGAGGCGATGGGGCGGCTGTTCGTGATGCACCTGGAAGGGAAGGTGTACAGCTGCAAGCACTGCCACACGCACCTCGGC
CTCTCCTCCGACATCATCTCCAAGTCCTTCCATTGCAAGCACGGGAAGGCGTACCTCTTCAATAAGGTTGTCAATGTGA
CTTCTGGAGTAAAAGAGGATCGCATGATGATAACCGGAATGCATACTGtgTCTGATATCTTCTGTGTTGGCTGCGGATC
CATTGTTGGATGGAAATATGAAGCTGCACATGAGAAGAGCCAgAGGTAcaAgGAAGGGAAATTTATTTTAgaGAGGTAT
AAGGTGTCTGGTCCTGATGGCAGCcACTACTTTGTTACACATGATGCTCATGttGGGGGAAGCGACGTGGACGACGTAT
GAAGCACAACTCGACATGCTCAAGC > SEQ ID NO:5204 216283FL 1119636_301899_1d
AGAGAAAGAGAGAGAATGGGAAGACTATTCTTGATCCACCTTGAGGGTAAGATATACAAATGCCGCATCTGCAACTGCC
ACTTGGCAAAGTGCAGCGACCTTTTTTCGAAGAACTTTCACTCCAAGAATGGAAAGGCTTATCTGTTCAACACAGTAGT
AAATGTCTCAGTTGGGCCAAAAGAAGATCGGATGATGACTACTGGCTTGCATACAGTATTGGATATTCACTGCTCTTCC
TGTAATCAGATTGTTGGTTGGAAATATGAAACGGCCTATGAAAAAAGCCAGAAATACAAGGAAGGAAAGTTCATTTTGG
AGAGGGCTAAGGTGATAGATGGACATGGGCGGACTAATTTATCGGCGGAAATTAATCTTATTTGAATCGATGCTGACGA
TTCATGATACGTCGGTAACTAAGCACCCATTTGTAAATAATCTTCTAATTTTTTTGCCATTGCACTGCCTCAATTTTTT
GGTGGGCGAATTTGGTTCGAGAAAAATAGAAGCATTTTTTCTCATTCAATGCCAAATGATTCAAACTTGTAAATGGTG > SEQ ID NO:5205 216283FL 1108938_301544_1d
ggagtgGAGTAGGAGTAGTTGGGGATATGGGGTTGTTGTTCCGGGAGCACCTGAGCGGACCTCGCATCTACTGCTGCAG
CAACTGCCGGATGCACGCCGCCAACCAGGACCGGGTCTACGTCAAAAGCTACCAGGGCCGCTTTGGTTATGCCTATATC
TTCAATTCCATGGTGAATGTGTGCCTTTCTTCTAAAGAACGTGTGCACATGACTGGCTTGCACACCATCACCGATATTC
ATTGCAGCTCGTGCCATCAAATCCTTGGTTGGAGATATGAAAAAGCTTATGAGCAGAGAGAAGTACATGGAGGGGAA
GTATATCATGGAGAGATCTAgaATGGTCAAGGAGACTCACTAGCTTCATTTTaTTTTTTTCCCAACTtTGTATACTCAC
AACATGAAAATTAAAAGAGAACAAAGGCTATTTACATATATTTgCAGCCCTTTttaGGCCattaattgcaaAtTTAGCT
ATTTTTcaaaattaggagattcttttttTGGCCACCAAaaccacTTTTtggaccaaaaAAATAgaaagcaatagtCTaaa
tttgattaATGTAATGTCATTTATgaggattaatTgCCTAAaAATGTAta
```

FIG. 2 continued

> SEQ ID NO:5206 216283FL 1097148_301437_1d
CGTCGAGATAGATAGATAGATAGATAGATAGAGAGACAGCATAACCAAACCAAGCCAAGAGAGAGAGAGAGAGGAGCAT
AGCAAAGCAAAGCCAAGCCTCCTTCATGGGTTTCCCTGNATTTAAGATCTATCATTTGAGAGCTCTAAAATCTGCAGAA
TAACGCTACAAAAAACAGATTCTAGGACCGTGAAAGGTATCCATTTTTTTCCTAGAGTGGGGGAGATATCATAATTATA
CATATGGGAAGGCTGTACTTAGTGCAGCTGGAAGGCAAAGTCTATGGCTGCCGCTTCTGCAAGAGTCACTTGGCCAGCT
CTAGCGAGTTAGTCTCAAAGAGTTTTCATTGTAAGAATGGGAAGGCATACCTTTTCAATACAGTAGTCAATATTTCCCA
GGGGCCTCAGGAAGACCGGATGATGGCAACAGGACTACACCGGGTTTCTGACATCTTTTGCAAAGGCTGCCATCAGCTT
GTTGGCTGGAAATATGAAGCTGCATATGAAGAGTGTCAGAAGTATAAGGAAGGGAAGTTTATTTCAGAGAGAGCAAGGA
CAATAGATGGAGATGGTACTCAATTCTTCTTGGATGTGAGTCAAGGCAGCAGTGATGGAGAGGAGGCCTGATACTTCCT
TTCTTCAATATACATCTTTCAACACACCTTGGTATGTAGTATATATATA

> SEQ ID NO:5207 216287FL 200042_300755_1d
gattcacggcgacatccgctgaatatcCCGGCACGCGCTTGAACCAGGACGTGGATTGGAACCTAGAGGCGGCGAAAGT
CAGAGCAGCCAGTTGCGTCTTTCTTGGGAGCCTTGCGCAAGGCTCTTCAATCCCTCACCATGGCGTCGTCTCTCCCCAC
CGAGCTCGGCAGCACCATCCAGGCCGGCCATATCAGAAGACATCCCGACCCTCGACAAGACATTGCGCCATCAACCGCC
GCCGACAAGAGGCAGCTGGTGGATTTCCACAGCGCGAGACGCGGTGATATCGACAACGACGACGACGATATCCCGTACA
GCGTCTTGCGTCCTCCAAAGAAGCACTACA > SEQ ID NO:5208 216302FL 210327_300888_1d
GGCAAAGGGATATGTGAATTTGGCGGTATACTTTTCTGTCTGAAGGTCTAGGAGGCGGAAGCCCTGGTCATTGCTTGCA
ATGGCGGCGGCAGGACTGTCAGACCTCCTGGGTTTGTATATCTTGATGTGGTTGGTAATCCCGCTAACGTCGTTGGATA
TCTGTCCCTCCGAGTAGCTCTTCTTATCCTCGGCAGTCAATGACTGCAGGAAGTAGTCGCCATTGAAGGTGCCGGCCAT
CAAGACACCGCAGCCGGCATCAAGGGTTGATATGGCGGGAGACGCCATTCCAGCAAAAGCACGCAGATTCATCGCTAGG
T > SEQ ID NO:5209 216315FL 205567_300799_1d
CTCACAGAGCCGATCAAATACCGCCAAAATGCCCAAGGAAGTCGCTGACATCAAGAAGTTCATCGAGATCTGCCGTCGG
AAGGACGCTTCCTCCGCGCGGATCAAGAAGAACAAGAAGGCCCACAACATCAAGTTCAAGGTCCGATGCCAGAAGAACC
TCTACACTCTGGTGCTGAAGGACAATGACAAGGCCGAGAAGCTCAAGCAGGCCTGCCTCCCAACCTGCAAATCGCAGA
GGTCCCCAAGAAGAACTAAGGAAATGAATTGGTGGTAAAATAGGGGTGGCTTTGGGCGTGGGAAGGGTTTACATGCACA
ACTGGGCGTCTCGGGATACCTTGCATTTCATGTGCTCAGAACGCACGCTCGCAATAGAGCTCAAAAAATAACGATTTGA
GACACAAAAAGCAACAATCGCACACCAAAATCTGGTGAGCCCGATGTCTTTCTTGTGCCGGCTATGCTACCTGAAGAAA
GGGAGCCCCCCGGTTACTCGGTGATGCCTATTTACACGACGTGCCTGAAGCGGCGATGATCTTTCTTGAGGGCGaggC
TCGCCAATCCTTCCAGTCGTTTCTTCGGAACATcgcCagtccagaatacaatCAAATCTTCCttgtcttcctcaAAAAA
aa > SEQ ID NO:5210 216315FL 217480_300908_1d
tcTAGGTAACCACCAGCACACGCAAACGATACGAAAAACCGAGAACAAGTATACCTTCAGCTCCGCGGACAACAATCAT
CACCGCGGACAACAATCGTCACTGCACGTCTGCCTAGTTGAGAGTTCCAAGTGTAAAAACATCAGCAGTTGCCTTGCTG
CGTGGTTCCCAAGTCCAGATAGTCAACAGATCAAACACAAGACAAACCTGCCTGTTCGATTACTTTGCCTCCTTGTAGT
ACAATTCGCAATAGTTCACCAAATCACCAGTCATCATGCCTGTCACTGAGTTTGCCATTATCAAGCTGAGGCCCAATTT
CGACCCCCTCGAGTTTCTCGAGACACTCATGGAGTGTCAAGAGATTCAGGACAATTGGATTCGCCGCAATCAGCCATGC > SEQ ID NO:5211 216318FL 206662_300824_1d
GATAGCGGATGGATACTTGCAGTAATATGGGGTAAGTGAGTGAGTGAGTGAGTGATATTGGATACA > SEQ ID NO:5212 216318FL 215590_300882_1d
GGATGGATACTTGCAGTAATATGGGGTAAGTGAGTGAGTGAGTGAGTGATATGGATACAGCGGGATGATGATGATGGTG
GTGGTGGTGGTGTTGTCACTGATGTTGTCGAGTGAGTTGTTTGTTTTGTTTACCTTTGGAATTGATTGAAATGAAATGA
AATGAAACAGCCCAATGCACAGCCTAAGTCCAAAGAAAACAAACC > SEQ ID NO:5213 216329FL 214955_300876_1d
TTGACCGAAAGCCGTCTTTAACCCTCCCCCCAGCTGCACGAAAGCGGAGGATAGGCAGCCGGAACGGAGATCTCTTCCC
AAAGCTGGACCAAAGGGCAGGGCGCGCCAAGTACGGAGCTTGTGCACTGCCGTCCCAAGTACCTGGCAGCCTGGCAGTA
CCTCGGACGCACGCTGCCTGCCCCTCACCACGCGGAGTATCCAGGTACCTCGGTGTGCAGGTGCAGGCAGCTCTCCCTG
TCCTGCAGGAAAATGCAGGATAGAGGAAAGACCCGGAGACAAGTCTGGTGATTCTGGTGATTCCATCCTGCCGGGGGTC
AGGTTTTTACATAAGGCACTCTCGACTTCCATCTTATTTCCCCACTCGATCCCGATCTCTCTCTCTCTTGCACCAGCAG
GGAAGGAGTGGGCGACCCCGAAAAAAAAACAATTAGAAAAAAAAAAGAAAAAAAgAGGCGAACGAAGGAACGagCGA

FIG. 2 continued

ACGAgCGTCGTCGAGAaggcgCgAACAAggagAACGGagCCTGCGGGGTACCTTGGTGGACTTCCTGAc

> SEQ ID NO:5214 216338FL 205090_300795_1d
aattGACGACCACCAGCGCCGCCAGAATGTTCGCCGCACGATCAAGGGCAGTCTGCGCCGCCCGCCAGCTGCAGCGGAC
AACCCGAACCTACGCCTCCGAGTCCCACGGCCACCACTCGCCCGCTCCGGTCAACGAGTCCTTTGGGGCCGGATCTGTT
ATTGCCCTGGGCGCTTTCCTGGGCACCGTCCTAGTCTACCAGTTCCGCCCCACGGAGAGCGACAACTGGACGCCCTCTG
CCCTGCTCAACAAGTATCGATCAAAGGCCGAGGACTGGGAGGCCGTCAACACTCTGCACACAAAGGCCATGGAGCAGGC
CGGCTATGACAGGAATCTGTTCGAGAACGGCTCCAACAAGCACCGATTTGTCGACGTCGCATACCCCGAAGCTCTCCAA
TCCCACGCCGCGCGAAACATCCAGGCCGGCCACCTTGCCAACATTGACCATGCTGTGGAACACTACCGACAGCAGCACC
TGAAGATGGAGGAGAAGAAGGCGGCCAAGCTGGCGGCTGCCAAGGCAGAGTAGTTGCAGTTGCTACAGTATATCCAATT
TATAGAACAAAGTTTGCAACACATTGGGGCCAaTTCaatgcgTGATAATGATTCCAGTTgccggatgtaCCt > SEQ ID NO:5215 216357FL 210782_300892_1d
GCTTACATATTACAAACTGTCCTCTTACATATTACAAATATCCAACATAGACAGTAGACAGTATCAACGCCATGACCCG
AATTGCAGAGCCCACGCCACTTCCCCCCTCAGCTCCCATAAACGGCAGTGAGAAACACCAAGACCAACCCCGAGATGAG
CACAAGGAAAACTTGGGCACCTTCTCCGTGCCAAACATCCAGCTCCAGATCCGGGACCTCAAGCACCCCGGCTCAAAGC
GCTTCCTCGGCGCCGTCAACGCAACCGATCTCCTCACCACAGGCACTCTGAACGTCCTCAAGCTCTTGTACAACACTCC
CCCAAACCCGGAGACGACCGTTCCGCCAACCAGCTCCGTGACGCTCGTCCTCGAGGATATGCCCGGCGTGGCCTACACA
GTCGGCCATAACGACAATAACAACATCAAGGAAATCCACTTTTCGCTCTCGTACATTGCGCAAATCAACGCTTCTCGCG > SEQ ID NO:5216 216365FL 210803_300893_1d
GATGAGACCTGTTCGGAAGATTCTGCAAGCGACTCATTTCAAACCCGTAATGAAAGATGGCAAGAGAATGTTGACGCCT
TGCTCTCCAGGAGACCCGGAGAAGATTGAGATGACGTACGACGATGTCAAGCCGGAAGAACTGTCGGCTCCGGACGTGA
CACTCCAAGATTTTGAGATAGCTTTGGCCGACTCACATCCTACAGTGTCCAAGGATGACATTGAGAAGCAGATTGAATG
GACGAATGAATTTGGAAGCGAGGGAGCTTAGGCAATGGGGCGTGTCTTTGAGAGTACATGGCACAGCGGCGCTTTGAGG
AGTTAGAGGGGCATCTAGGCACTCTTTGCACATACAATGTTGAATTCGGGAATCGTAATGCATCTGTCTTACTGGAAAA
GAAGAAGAAGCTGTTCATATTCGATTCTTTTTATGGTAGATAGTGGGCCGGCATCTTTGTAGGATGTGATTAATTTTGA
GTCCAAGATGAATTGGTAAAAAAAAAAACAA > SEQ ID NO:5217 216384FL 216933_300903_1d
aaacGAAACCGCAATCCATCTCCCGGCGGAAATTGCCCTCCAACCGCAACCATGTCGACCCTCCCCAGGACTCTGGGCA
ACCTGCGCAAGATTGGCATCAAGGAATACTTCCGCCAGATGCTGGTTCGTCTCTCGCCCTTCTAACCTCCCACGACCTC
TGGCTAACGCACAGCTCTTCGCGGTCCTCCTCGAATAGTACATCGGTGACACCAAGTACGGTACTCTCATCGGCCAGGA
TCGCTTCGGCAACAAATACTACGAGAACCTCGAGGAACTGCCCCTCCGAACCCGCTGGGTCGACTACGCCAAGCACGAC
TACGATGCCTCCCACATCGAGCCCGGCTGGCACGCCTGGATCAGCTACTCCGTCGACAAGCCCCCGACCCAGGACAGCC
TCATCGCCACGGGCACCAGACACTTTGAGCCCGCCCTTCCCAAGCCCAACTTTACCGGAACGCGAGGCGCTTACAAGCC
GTATAACACAGTGAAATCGAAGCTTAATGCTTGGGAGCCGGTGGCCAAGGATCGGGTATGAGTGGTTTTTACGTTTTCT
TTTTTAAACCGTGGGAAAATATGGTGTACATATTGAAATCGCGCAACAAACGCAAACAAATCAAACAATAGACACAGAC
ATGTG > SEQ ID NO:5218 216403FL 211095_300895_1d
GGCTGCAAATCCAGAGGCGAGACATTGTTAGAACCAACTCAGCGGGAGTCCGATTCCATACGAGTACTCGTATGAGGAC
ACTTGCTCACTGTCATATCTGAAGTCTTGAAGTGCTGC > SEQ ID NO:5219 216406FL 213056_300846_1d
cgtcatcagaagcaccctgaattcgaacttgttgcccAGATTGGAAGCCATGGCCACATCAGGAAGCGGAGGCTGGGCT
CAGCTACGCCAGCAGGCCCGATCTTTGGAGAACCAGACGGAGAGTCTGTTTCATACCTTTTCCCAGTTCTCGACTGGAT
CCAACATCCCACCTAAGCCATCAGCAGGAGCCGTGACATAGAAGCGAGATTGGAGGATGTATTAGACAAGCGCGACAA
TGTCATCGCCCAGCTCGCCCGACTTCTGGATTCTGAAGCATCCCTCAACACATCCGCGCTCAAACAAAACAACCTATCC
CTGCTCCGAGAGAAGCTTGCCTCTCATCGCCGCGACCTGACCCGTCTCAAGTCTACACTGCAGCAAGCTCGCAATCGCG
CCAACCTCCTCAGCAACGTGCAGTCCGATATTGACGAGTACCGCGCGAACAACCCGGAAGCTGCCGAGGCCGATTACAT
GTTGGACGAGCGTAATCGCATCGACAGAAGTAACGATGCGACAGACAGCGTCCTCAGCCAGGCATATGCTATCAACGAA
AGTTTTATTATCCAAAGGGAGACCTTGGCGAGCATCAACCGGAGAATAACCATGGCCGCCAGCAAAGTGCCAGGCATCA
ACTCAATAATTGGACGTATAAGTACCAGGAAGAGGAGAGATGGAATcatTATGGGAACTTTTATCGCATTGTGCTTTAT
CGTCTTCTTCTGGTtcagGTAAACGGGCCATCATACattcacCggtGCTGCACATGTCGTTTGGCGtt > SEQ ID NO:5220 216425FL 112451_300002_1d
cccacgcgtccggtcggatcctccattgcttcagcgatcacaccgatgctggagtgtcaacgacaaagcagagagaggg

FIG. 2 continued

```
tTTAATGGGCAAAACCGAAAATCTATAATTCTTCAAATTTCTGGATTTTGATTTAAGTGGTATTTCAGATTGGGGATCG
TATATTGAAATTTCGAGTGGTTGATTGGGTTTACAGGAGGATGGTGCTGGTATTAGCATTGGGCGATCTTCACATCCCG
CATAGGGCTGCTGATCTTCCCGCTAAGTTTAAGTCTATGCTTGTTCCTGGAAAGATCCAACATATCATCTGTACTGGTA
ACCTATGCATTAAAGAGGTTCATGATTACTTAAAGACTCTTTGTCCTGACTTGCATATTGCTAGAGGCGAGTATGATGA
GGAGACACGTTACCCCGAGACCAAGACGCTAACAATTGGTCAATTTAAGCTTGGATTATGCCATGGCCACCAGGTTATT
CCATGGGGTGATTTGGACTCATTAGCCATGCTTCAAAGGCAATTGGATGTAGACATACTTGTGACTGGCCATACCCATC
AGTTCACAGCCTACAAACATGAAGCAGGGGTTGTTATAAATCCAGGATCTGCTACTGGTGCCTACAGTAGCATCACATA
TGATGTCAACCCTAGCTTTGTTCTAATGGACATTGATGCCCTGCGTGTTGTGGTCTATGTTATGAACTCATCGATGGA
GAAGTCAAAGTTGACAAGATTGATTTCAAGAAGACAACAACACAGAATGCTAATTGAATAGCATAACTTGAAATTCAGC
TGattntagTGGAATCCTGAAGTCGATAagacaTTATATTCCTCTGTCTGC > SEQ ID NO:5221 216430FL 211418_300899_1d
GTACCGGCTAAATACTCGACGAAATGGTGTGAATCGTCGCGTAATGGTTGGACGATGGAGCGATGTCTTTATACTCTGC
TACGCTTACTTATCCACAACTTTATTTCGATTCACCGTGTGCTACAAATAGCACCCCACGGCGGGCTCTCGGAATTATA
GCTACAGTATTAAGCAATTGTATAATAGATTAAGGTTAGTTTTCCGAGTGAGCCGTTGCATCTCGGGCGGCAATCTGGG
GAGCATATTAGCAATAGATGAGCAATAG > SEQ ID NO:5222 216432FL 211211_300897_1d
ggtgatctgaagagaatgggtcgaccagcgctacttgtacagtatcgaatgcacgatgcgtcttatgatcagcgcgtgt
cTTGCACATATGCATACGTCAAACAATGCATCCTCCACAATCTTCATCATCACTCCACAAATAGCTTCCATGTTACTTT
CCGCATTCTAGGTACCGCCTCAGTGTTGGCTGAGGTTTGCCACATGCACACCATTGTTGACGTACCATGTGGCTCAGTT
CAGCCATCGACATCTCCAGACAAGCCTACCAAAGAAAGTCAGCCTCAGCCTTAACTGCTCTCGAGGGTTTCAGTCATCA
ATTAGCCCTACAGCTCCGCCTTCCCTCGGCCCGTGCCGCAAAAGACGACTGGAGATCTAGATTGTGAGAAATACGAAGA
TATTAGTGGATTTCTCGTACCAGGAACGAGGACAGACATTGGTGTGTTGATGAAAATAGAAACTTGAACCGGCGAAACC
TTGAACGGTGAGTACGAGATATGGAAGACGAATAGCAGCGTATGAGTCAAGTTGCAGCACTAGACTTCTTGGTTAGGCC
CTTTTCTCTTCCCATTTTCCCGCCATGAGCGTGGATAGATGCATCTACATGGTGATAGGCGAGCCGAAATCGAATCATT
TCTCACGTCTCCAAAGGCCCAGCCCTACGTTACAGCCGGCCATCGCTAAGCAGATCGCCTACTCGGTGCTAAATTCTGA
CTTCTCAGGCAGCACGAGATGCCGTCCAGTCGCTGCTTGTTCACGGGCACAAGGGGGGGATCTCTCCCTTGATGCCTAC
TTGTATACGAGAAGAGAGACGACGGACATTAGCCGCATGCAAGATTACGAACGGGTCATCTCGCCAAGAGAAAGCTTGT
GTTGTATGTTACCGCTTCTTTGGAATTAATCGCTATCGAAAGGAACAGGGCCtagaaCTTAGTAGCTTccCATCGAAAt
tctcgtgCTATTGtttccTTGa > SEQ ID NO:5223 216433FL 211259_300897_1d
TGGCCGCCTCCTCACAAGTTTGAAGAAGCGCTCAAGGACGGCATCACGGAGTGCAATGAAGCTGTACAAGGTCAGAGAG
GTCATGGTAAAGAGATGGTCGAGCAATCGAAACCGATGAATGGACTGTTGATGTCTATTTCAATTTCTACATTTTCCTT
TGCAGTGTCTTTTTGTGTAACATTACGGCGATACCTGGGGAATTTATTGAATGTGCAAATGCTATGGGAATACACGTCG
GCGACAACGTGTGTAATGTATACGAGAAACGATGGAACGAATCTGGATCAAATTACAGATGCATTTTAAAC > SEQ ID NO:5224 216438FL 211360_300957_1d
GGCTGGCGCCAGACGCGGTTCGTGAATGCATAGGTGCTCTGCTGGCAACTGACGTCTTGGGGCTTGGGTTGAGGGATGC
GGGCGTGTTGTATGGAGAGGTGCATGATGTGGGAGAGAGGGCCCCTGGTGAGACCCCACCGGGTGAGCGGTGGCCATAT
GAGCTAGCAGAAGGCGGGATAGAGATGGAAGACACGAAGAAGCCGGGTCGCGAAgaGGCGCTGTTCAGCATTGATGTCG
CGGATTGAGGGCCCGACGACAGGCGAGGAGtaggaGAACCGCGGGATGCACCTTGGCCAGACATCATGTGTAAGCCAAG
GTCGTCCGATGCTGGGCTGGCGGCCCGGCGCTTCTGACCTGCGCCTGCGTATGCATCTTCAATGTGAAGTCTCTTGaca
gAGGATGTCTCATCAATCTCCATATCGTCAGCAAAGCTGCCCTGGGTGGAAGTGGCATCATCGCTGTTgtTccgTCttg
ACCTGCCTCGGggTGAACGATCTGGTCC > SEQ ID NO:5225 216449FL 206630_300824_1d
gggcgaAGATACGCAATTCCACAATCGCCATGGCGAAGCCGTATGTGCCGCATGACGTCCTTGACGAGACGGCCAAGAC
TTCATTGGTCGGCCTGGGCAGCGGCTTCTTCATTGCCGCCATCCAGAATGCCCTGTCGAAGCGCAACGTGGGCGCTATG
AGCGTCTTTACGCGGGGAGCTCCCATCATTGGCATTTGCGCTGCCGGTCCCGGTGCCTACGCCTTCTTCTCCCGGACGA
TGATGAACCTGCGGGGAGAAGGATGATGCTTGGGCGCCGCCTTTGGAGGCTTCATGTGCGGCAGTGTCTCGGACTTCC
TTTCCGACGCACACCCATCGTGCTGGCTCTTGGTGCTTTCGTTGGCACTGCCCAGGGCCTTTTCCACGTCACCGGAGGA
AAACTGGACAGCTTCTACAAGGAGGAGGATGAGTTTGAGCGCAAGGAGACTGTTAGACGGACAACCCGGTTGCCCGTTG
AGCAGACTATTGCCGAGCTGGGCGAGGGACGAGGCATCCGTCCTCCTGGATATGAGGAGAGAAGACGAGAGCGCATCAA
GGAAAAGTATGGCTTCGAAGTTAACCCTGTGAGCGCCACCGCTGAGGGTAGCCAATAAAATGATATCAAAAAAAATAT
GAAAGAATTAAAGTCAGCTGCCAGAGATTTTTGAGGTGAGTTCTGCGGGCAGCTTGTACATATATCCCATCGCATTCCA
GTGCGGAAGAGATGCGATGCTAGATAATCGGATTTTTTTTTTTGTTTTCCAAAAAAAG
```

FIG. 2 continued

> SEQ ID NO:5226 216455FL 219568_300946_1d
AAACATACGGCCTCGTGTGGCGCCTTGTCTCAGGGACAACAGACGACGAGCAACTCAAAGACCAGAGCTAAACATGGCT
TGGCTAGATGGCAATAAGCAGAGCACGCTTCAATCGAGAACAGACGCGCTCGACAATAAAGGATGTGCTACGGCACAGC
CATTGGGACAGATGATGTCGCGGTTCAACGGTAAGTCTTTTGATCTTGTTGATTGAGCATCATAACGTGAGGCCGGCTC
TAGTTGTTCAGGACGATAAATGCCACTTGCAATGACCGAAGCTGTTTGAGTCTCAATACACTCTGTACCAGATGAAAGG
GCTTCTATGTCTGCTAGGTTTTCATAGATTTGTCATAGTTATGACTCCTGAAGAAGTAGTTGTACTGCTAAATGAGAGC
CACTGTGTTTGCTTTGCCCCTGGCTAGCTAGTAGaAT

> SEQ ID NO:5227 216461FL 212130_300874_1d
cccacgcgtccgcggacggggggggcggacgcttgggttcgacagaagccgagttaagcggcgatagaagcaacaaaggt
gAAGTTGTGCCGGTCTGGTGGTTTATTGGAAAGAAACGAAGAGAAGAATGTTCCGGTCAAGGGAAGCGGCCTTTGGTCA
GTAGCCAAAGGGCAGATCAAGCGCCGCCTTGGAGGATTAAAAGGGCGGCTGCAGGGGTCCCAAGGCTGGTGCGCCTCAT
GGAATTGTATCGAagaAAGTCGATGGTGTGGCGGTGCCCGATAACGCAAAAAGCTGGCAACCTTTGTGCTGCCATGCGG
GCTAGCAGCGGGTACCGCCGAGTATTTGTTTGTCACTGTACAGAGGCGAGACGTGAGGCCGAgatTCGCATTGGTTCGG
AGTCTGGAGTAGGGAGGACAATATGGTAGCACGATTGTCATTGTGATTGCTTTGTTTATTAGTACTTAAAAAAAAAAT > SEQ ID NO:5228 216471FL 211746_300870_1d
GAACAATGCAGCTGGTGACAGGTTTGTCAAGTGGCAGGGGAGAATCGTATTCGTGTGGCGATGGTGATGTCGAATTTCG
AATGAGGGAGCCTTGGCGCGAAGAAAAAAGAAGAGAGAGAGAGCGGAGAGGAGAGGAGAGGAGAGTGAAACAAGGAG
AAGTACAGAGGAGAGAGGAGAGAGACGCTGTGGTGCTAAGCAACCACGAGAGAGGAACATGAATGCGGTTTACAAGGTT
GACATTGGCGAACGAGCTTGGACCGCTTTGACAATGTGATGTGATGCAGGCTGGGTACTCCAAATGTTTCCAATTGAAC
GAATATCCAATCAGACAAGTAGAGA > SEQ ID NO:5229 216474FL 211563_300900_1d
TCCTCCTCCCTGGTTCCAGACTGTTACCCGTCTCGGAATACAGCGAGACACGGACGACGGAGATCGGGAATGTGGGGCC
GGAGAATCCGATG > SEQ ID NO:5230 216488FL 212104_300874_1d
GGAGGAGTGGCCGCCTTGGTAGCGGGCAAGGATGGCGATGAAACGTCAATCGTGCTTGACCCGGTAGCTTTGGAGCATG
AGTCTGTTCTTGCTGCCTGCTGCGTTGCATATCTACCCAACAGAGATGAGATCACAAATCTGTGGTTCAAAGGTCGGCT
GCCCTCAACAGCATCTCACAATCATCAGTCACTTGTCTCAAGGGCAGTGCACGCGAGTAAAGGAACACATGGGTTGATA
TCGGCGGCTCTCAGCGAAGTTATTGGCAATTCTCAAAACTAAAAGTACACCGCGttgagTAATAATGACGAtaATAACG
ATAATCTGGATCATGTATGCGCATTGCATACATTCGACATTCGCGTaggccAGGTGGGTGTGCTCCagaGGGGCATCTC
GAACATCTGGTGAGCGAAGAGAGGTCAGCACCGCTGTAAGTGCAACCAATCAAAttcATTACGAATACCATTGGCTATT
GATGGAgACAATCACCAATGttaGgtgGTATgaggcatTgctATAAAATgctACttgttcgttaccACAATcagagaaA
TATCAAgtATAtTTATTAagaTcTATCTaAagcctTCATttccataccATatcggGcgggg > SEQ ID NO:5231 216489FL 204930_300794_1d
CAATTGACACCCAAAGCTTCAATAACCTAACCAACCCTCTTATCCACAATGAAGAAAGCTGCGCCTGCGGCAAACGCTG
CCCGAGATGCCGGATCTCACGATCATATGCTCCAAGGAGGCCATGCCATAATGAAAGACGACCCTGAAGACTTCAACGC
TCCCAAGCTTTCCGAGAACATGTCGAAGCAGACTGGTCTTGGGGGATCCAAGCAGGGCAGCTTGCAAGGCAGCGCCGGC
ACTGGCGATAGTATGAGGCAGCGAGACACTCAAAGCCATGTAGGTCAAACATGCGGTGGTATACAATTGTGCTGACTAG
TATGAGTGATGAATACGGCCACGTAAAAAACGAGAATGCATTGCCGATTCGAAAAGCTGGTATCAGTGGGACATGCACA
CGATGATAGGAGTTGACGAGAATCCCGAGTTTGAAACATGTTGAAATAGGTTGTATAATATCATGGCGAGCAAAACCAA
TATTGAAACTATTTATAAACGCTtt > SEQ ID NO:5232 216489FL 214238_300856_1d
tcCCATCCGTGCTCTTGATCCAAAAACCAATTGACACCCAAAGCTTCAATAACCTAACCAACCCTCTTATCCACAATGA
AGAAAGCTGCGCCTGCGGCAAACGCTGCCCGAGATGCCGGATCTCACGATCATATGCTCCAAGGAGGCCATGCCATAAT
GAAAGACGACCCTGAAGACTTCAACGCTCCCAAGCTTTCCGAGAACATGTCGAAGCAGACTGGTCTTGGGGGATCCAAG
CAGGGCAGCTTGCAAGGCAGCGCCGGCACTGGCGATAGTATGAGGCAGCGAGACACTCAAAGCCATTGATGAATACGGC
CACGTAAAAAACGAGAATGCATTGCCGATTCGAAAAGCTGGTATCAGTGGGACATGCACACGATGATAGGAGTTGACGA
GAATCCCGAGTTTGAAACATGTTGAAATAGGTTGTATAATATCATGGCGAGCAAAACCAATATTGAAACTATTTATAAA
CG > SEQ ID NO:5233 216492FL 212062_300873_1d
GAAAATACTCCAAAATCAATCGTATCACCAATTCTATCAACTGCATCGCCAAATCGCCATGCCTGAGGGACGTCAATCT

FIG. 2 continued

CCTCCTCCCGAGCGCCAATCCGCCGCCCAAGTAGGGAACACTGGATCCGGCAAGGCCTCAGATATCAGCAAGACCAGCC
AAAAGGACCCAAAATCCCAGCTCGACTGTCTCACATCGAACCCCAAGGGACCGATGGACGATGTGCTTAAACACAAGTT
TTCCAGGGAGCCTGGAAACTGTGAGCGCTAATTAGAGCGACTCGTCTTCCGCAGTTCGCGACTAATGAATTATCATAGA
CACTCCGTTGAACGCTTAGGGAGAATAAATCGTCATGTTGTACAATAGTCATTCATAGCATCAATTATTGCATCGCTAT
ACTATAacaAAAAAAAAAAA > SEQ ID NO:5234 219045FL 212568_300850_1d
tgcggacgcgtgggcggacgcgtgggtccgGACGCGTGGGGACTAGATAGGTAGAGATGGTTTGGCGGTCAATGCTGTG
CTcGTTAGATGTCTCACGGGGGCCCGCATGTATCTCCATGTAGTTCCTCGCACGCAGCAAGAAAGAGGCAAAACCCGCG
CGGTGTTAGTAGCGTTTGCCATCGGAAGACGATCGCCCAGCACGTCAAAGAGGCCATTTGATCAGTTACTCGATTGGTG
CTCGCACGGGTTGGTTACG > SEQ ID NO:5235 42023FL 159225_200022_1d
AGTGAACATTAAGAATGGCGGAAAAAGGAGGAAAAGGGTTTTCTCTACCAAAAAATGGAAAGTCTGCCCTCAAATCTCC
TGCATCCAAAGGGAAGGATGATATCTCAGCAAAATCGAAAAGAGGAAGGAAAGTTCAGTTTGATCCTGAAGGATCACTG
GATACCAATCTCACAAAATCGAATGGAAAAGCTGATCAACCATCTTCCAAAGATGTTTCCGGCAAAGGCGGGAAAGGAG
AAAAAGCTGGCAGTGGTAGTAAAAGTCAAACAGCAAAAGCACCTGGTCCGTTGGAGCTTAGAGTTGAACAAGAACTTCC
GGACAATACAACATGTCTGATGGACTGTGAAGCTGCTGATATTTTGCAAGGAATCCAAGAGCAAATGGTGGTTTTGTCT
GAAGATCCAGCTATAAAACTACCTATTTCATTTGACAGGGGATTGATGTATGCACAAAGGAACAGGCTTTACGATAATC
CCGATACGgttaAACAAATACTCAAACCTCTAAAAGAGCACGGTGTTTcCGATGGGGAGCTCTGCATGATTGCCAACTT
TGCCGTGGAATCTGTTGATGAAGTATTTTCTCTTGTTCCCTCATTTAAGACTAAAAAGAGCAAGCTGAGAGTTCCCCTC
GAGAATGTCTTGGGTGAACTAGCCAAACTTAGAAGGCCACGCGTAAAGGGGGCTCAAAACGAGCATTATATGGTATATGT
ACAGAGGGTTCTGCATGTATCGCTAAAGGGCATGTCCGACAGTTAGGCGACCAGCAACAGAAGTTTTCTTTCTTATTTT
ACCTGTCTTTTGTTCTGGTTATTTGCTAGGATTTTCCGCGGCAGTGTAAATCTGTTGATCGCGTCGTTCTTCTCTTTTG
ATTCCC > SEQ ID NO:5236 43449FL 104245_300060_1d
TCGAAGACAGATGTTGGAGAGAGCTTTGACCAGGTAAACGGATTACCTTCAGTGGAAAATCCTGAGAATGGTGGCACAT
CTCCTACAAAGCCACAAAGTCAGAAGAAGAAGAAACCTTTGCTTCATAAATTTGGAAGCCTACTGAAGAAGAAAGGCAC
CAACAGCCAGAAGTAATAGACCCCACCGGTTGTCACCTATCATGTGCCTGACGTGTAGAGAGGTATACTAAATTCAAGAG
TAAATGTTGGACTTAATTGTGTTTGCTCAAAATCTTTGCTTTTCTTTTCTTTTTTTTGGTTATTTGTTTGTC
TCAAATAGGTGTTTACATAAGAAAAAGATTGTATCATCGGTAGTGTTCCATTCTTATTAGTTCTGGGGTTCAGTTTCTC
AATGTGGTTTTATCATGTTGGGCAATATCCTTTATTTTTATATTATTCTTTTAGCTTTNNNAAAANAAAAAAAA > SEQ ID NO:5237 43449FL 43409_300149_1d
CGAGAAACTAGCCGCAGAAAATGTTCAGTCCCTCTTGGAAGAGAAAAACAAACTTATAAATGAGTTGGAGAACTCCACG
GAGGAGGAAGAGAAAAGTAAGAAGGCGATGGAAAGTTTGGCATCGGCATTACATGAAGTTTCTTCAGAAGCAAGAGAAG
CCAAAGAGAGGTGGTTGTCTAGCCAAGCTGAACATGAACATTACGAAACACAAATAGAAGACTTGAAGTTAGTATTGAA
AGCAACCAATGAAAAGTACGAAAGCCTGCTTGATGAAGCGAAAGAGAAAATTGATGATCTCACTAATTCAGTCGAACAA
TCTAAGAATGAGCACCAAATT > SEQ ID NO:5238 43449FL 114802_300374_1d
GGAGCTTCATCTGATGAATTGTGTAAAGAAAACTGAAGAAGGAAACTCTTCAATGGAAAAAGAAATAAACAGATTGGTA
AATTTGCTAAAAGAGGCTGAGCAAGAAGTTTCTTTCAAAGAGGAAGCAGTTCAGTTGAAGAATTCCCTGCATGAAGCTG
AATCTGAGGTGACCTATCTGAAAGAGGTTCTTGGTGAAGCAAAGGGCGAGAGCATGAAATTGAAGGAGTCGCTGTTGGA
CAAGGAAAATGAAGTGCAGAATATTCTTCAGGAGAATGAGGAGCTTCGTAGTAGAGAAGCCGAATCTTTAAAGAAAGTT
GAAGAGTTGTCCAACTCCCTCAAAGAAGCTCTGGCCAAAAAGGAAACTGAAGAAAATGGCGAGCTTTCTGAAAGTGAAA
AAGATTATGATATGCTTCCAAAGGTGGTTGGAATTCTCTGAACGAAATGGAGGAGGAATACTGGAGAAGCCTAAGATTGA
AGTTATTCCTCATCAATCTGAGCAATCTGCTGAAGAAAAATCTGAAAGAGTCGTCAACATCATCTCGCATGATGAAGCT
GTTGAGACCTTAACTGAAGTTGAGAAGCCAAATGGCGAACTGAAGGGAAATGAGCACAAAGAAAAGGAAGATGATGATT
C > SEQ ID NO:5239 44146FL 128962_300401_1d
CCCCCCTGCAGCTGAAGGGCTTGATTGAGGCTTACGTTGAAAAAACAGGCAGCGAGAAAGGTGCCACGATTTTGAGAGA
ATGGGAGGCATATCTGCCACTCTTCTGGCAACTGGTACCACCAAGTGAAGAAGACTCTCCTGAAGCTTGTGCCGAGTTT
GAACGAGTACTTGCCAAGCAAGCAACAACAGTACAATCGGCGAAGTGATCTACTGCAATTCCCAAGTGATCAGATTAGA
CAACAGGAAGGTGTTCTTTGGTACTTTCCAGGTGATTTTTTCCTGGGACCGCATCAAGGAAAACAAAATAACAACTGGC
ATACTTGTGAAGCACCGAAGTGCCCCCAAAGACTGCGATTTTGTGGAAGCTCTGCCCAAGGCATCTTTTGAAACGAAGT

FIG. 2 continued

TTCACATGATCGTGGAGGATTCTTCTTTGCGCCCTTGCACTTGCACGCCCTAGTTAACCACCCCCCTGTAAATTGGTTT
GCTGACGCTAGGTTGCTATTTGCAGAGGCAGTGAAGACACACTTCTAAACTTCTCCATTCCTGTACAGGATTCGTGTCC
TATGTAATCGTATTTTTGGTTCTGGACACATTAGTTCTTACATTTATACCCGTCCAGTGGGGGCATGCGAGTCG

> SEQ ID NO:5240 44146FL 46528_300193_1d
tcgctgaagcagtagttgaaggcactggagaccattgctgtgagtacatgactggtggctgtgtagtcgtgcttggaaa
gGTGGGAAGAAACGTTGCTGCTGGTATGACAGGAGGGTTAGCTTACCTTCTTGATGAAGACGACACTCTTCTTCCTAAG
ATTAACAGAGAGATAGTGAAGATCCAAAGAGTAACTGCGCCTGCTGGGGAATTGCAGCTGAAGAGCTTAATTGAAGCAC
ATGTGGAAAAAACCGGAAGCAGCAAAGGCGCAACGATTCTGAATGAGTGGGAAAAGTATCTACCTCTCTTCTGGCAACT
GGTTCCACCGAGTGAGGAAGACACTCCTGAAGCTTCTGCTGCTTACGTAAGAACATCCACCGGGGAAGTCACATTTCAA
TCGGCTTAGAGATCATTCAAGAGCAGGTTGTGGCAGTTGAAACACAAGGATTGATATACATCAATGGTGGAGGACTATG
GAGAGCAGATTAATGGAAAATCATTATCATTCACATGTAGATCAAATGTGTGGGACAATATTCTTATTGTCTTGTGATC
TTTACAACAATACCATGGTTGCTATAACTGTACAGTAAATTCAGTAAAATAACTGCTTTCAACTGTCAAAA > SEQ ID NO:5241 44146FL 283519_200238_1d
cccacgcgtccggttttctgacacctggaatgaacataagacttattggagaagctaacgactatgtcggaaagggcat
gGCTGGAGGAGAATTGGTTGTTACTCCTGTTGAAAATACTGGATTTTGTCCAGAGGACGCCACCATAGTAGGGAACACC
TGCTTATATGGAGCGACAGGTGGTCAAGTATTTGTCAGAGGTAAAGCAGGGGAGCGTTTTGCTGTAAGGAATTCTCTTG
CTCAAGCTGTTGTAGAAGGCACTGGGGACCACTGTTGTGAGTACATGACAGGAGGGTGTGTTGTGGTGCTTGGAAAGGT
TGGTAGAAATGTAGCTGCTGGTATGACTGGGGGTTTGGCATACATTCTTGATGAGGATGATATACCCTTATATCTAAGGTA
AACAAGGAGATTGTTAAGATCCAGAGAGTGGTTGCTCCAGTGGGTCAAATGCAGCTAAAGAGCCTAATCGAAGCCCATG
TGGAAAAAACGGGCAGCACGAAAGGCGCAACTATTCTCAAGGAGTGGGACAAATATTTGCCACTATTTTGGCAATTGGT
TCCACCCAGTGAAGAAGACACTCCGGAGGCCAGTGCTGAATACGAGCAAGCTGCTGCTGGGCAGGTCACTTTGCAGTCT
GCAGAGATACCATTGAAGTAAATCTCACATGagcACAGCAATGACCATGATtctaagcaggagACAGTTTGTACAggAA
AGAATGATATTGTCTccACggaaggACTCGGTGAAGTCtgagagatcagaaCTCTTaaaggTGCaaGCaaCtatctttG
TTGaacaaaaggcTGATCTTTGTGATGCttcaGCAGcTgtaca > SEQ ID NO:5242 44146FL 273623_200144_1d
GGGCGGACGCGTGGGATTGCCGTTGCTACTATTTGCTTAGCCGAAGAACTTGGAAATTCGGGTACAACGTTTTAGACCT
GTTACTAGTTCTTGCCCCTCATTTTTTCTTTGAGGCGGTTTTCATGCCCGTGCTTAATAAGTTGTAACTTGTATCATG
ACATTGACAATTTCGTGAATGTGTAAATTAAAGTCATCC > SEQ ID NO:5243 44146FL 256030_301646_1d
ATTCAATGTGGATAGGGCAGTTTGTGGCCGGATCGCTGGTGTGATAGCCAAGAAGTATGGTGACACAGGCTTTGCAGGG
CAGCTTGATCTCAAGTTCATTGGAAGTGCTGGGCAATCTTTTGCCTGTTTCTTAACACCAGGGATGAATGTTAACCTGA
TTGGTGAGGCAAATGATTACGTCGGCAAGGGAATGGCTGGTGGGGAGATTGTAATCTGTCCAAATGAGAATGCTGGTTT
TGTTCCCGAGGAGGCTACAATCGTTGGAAATACCTGCTTATATGGAGCTACTGGTGGTCAAGTCTTTGCAAGGGGGAAA
GCTGGGGAGCGCTTTGCAGTGAGGAACTCCTTTGCTGAAGCTGTGATTGAGGGAACTGGTGACCATTGTTGTGAATATA
TGACTGGCGGCTGTGTTGTTGTTCTTGGAAAGGTGGGTAGAAATGTGGGAGCAGGTATGACGGGTGGACTGGCTTACCT
TCTTGATGAAGACGATACTCTGCGACCTAAGGTTAACACGGAGATAGTTCGGATGCAGAGAGTAGTTGCACCTGCTGGA
GA > SEQ ID NO:5244 44146FL 172043_300539_1d
GTCAAGATGTCCACAGTAGTGGCCCTGTTCTTGACGAGACAATCCTTGCCGATCCTGATATATCCGATGCGATTGAGAA
TGAGAAGGAGGTTTCCAAGACATTTCAAATTTACAATGTTGACAGGGCTGTCTGTGGTCGAGTAGCAGGTGTCATTGCC
AAGAAGTATGGTGACACAGGATTTGCAGGCCAGCTCAACATTACGTTTACTGGAAGCGCAGGGCAGTCCTTTGGATGTT
TCCTAACTCCTGGAATGAATATTCGGCTAGTTGGAGAGGCCAACGATTATGTGGGAAAGGGTATGGCTGGTGGAGAGCT
GGTTGTAGTTCCTGTAGAAAAAACAGGATTTGTTCCTGAGGATGCTGCTATAGTTGGTAACACTTGTCTGTATGGAGCT
ACTGGTGGTCAGGTATTTGTGAGAGGCAAAACAGGTGAAAGATTTGCAGTTAGAAACTCCCTTGGTCAAGCAGTGGTTG
AGGGCACTGGAGATCATTGCTGCGAGTACATGACTGGTGGCTGTGTAGTTGTACTTGGCAAAGTTGGGAGGAATGTTGC
AGCTGGAATGACGGGTGGCCTTGCCTATATTCTAGATGAGGATGATA > SEQ ID NO:5245 44146FL 167827_300551_1d
GAATTCAAGGGCATGGCCGGAGGCGAAGTGGTGTAACTCCTGTAGAGAATACTGGGTTCGTTCCTGGAATGAACATTC
GACTTGTTGGAGAAGCTAACGACTATGTAGGAAAGGGCATGGCCGGAGGCGAAGTGGTTGTAACTCCTGTAGAGAATAC
TGGGTTCGTTCCTGAAGAAGCGACTATTGTTGGAAATACATGCCTCTATGGTGCTACCGGAGGTCAAATATTTGTTCGA
GGAAAAGCTGGGGAACGTTTTGCTGTAAGAAACTCTCTTGCTCAAGCCGTGGTTGAAGGTACTGGAGATCATTGTTGTG
AGTACATGACTGGTGGTTGTGTGGTTGTACTTGGAAAGGTTGGACGAAATGTAGCTGCGGGAATGACTGGTGGTTTGGC

FIG. 2 continued

ATACATGCTTGATGAGGATGACACACTCATCTCCAAGATAAACAAGGAGATCGTGAAGATTCAGAGAGTGATTGCACCT
GCAGGGCAAGTACAATTGAAGAGTCTAATAGAAGCTCATGTTGAGAAAACTGGTAGCAGCAGAGGCACTCTTATTTTGA
AAGAGTGGGAAACATACCTTCCTCTATTCTGGCAATTAGTACCACC

> SEQ ID NO:5246 44558FL 111252_300053_1d
AAAGTTTGTATGAAACTGGATTCAGAAGTAACTGGATCATAACATTTTGAAGATTTTGTATTACAAATTTACACGTATT
GCTACTCAT

> SEQ ID NO:5247 48423FL 48463_300119_1d
GCCATTACGGCCGGGGATGGAGCTGCAAGATTGGAAAGAGGCATTGAAGTATTGCAGATTAACTATCCCGGGTTATGAG
AGAGTTTATCCAGAATGTCATCCTTTGCTCGGACTGCAATATTACACTTGGGGAAAACTTGAATGGTGGCTTGGTGAGA
CTGAGGAAGCTTATAGGGCACTAGCCAAGGCAGCAGAGATACTGCGAATTACTCATGGAACAAACAC

> SEQ ID NO:5248 57145FL 46852_300192_1d
CTTAGAGAGTATCAAATCAATCTCCGGCGGATGGGGCGCGGCGGCGCGTTCCTGTGACGCTTGTAAATCAGTTACCGCC
GCCGTGTTCTGTCGAGTTGACTCAGCTTTCTTATGCATAGCATGTGACACAAGAATCCATTCCTTCACTCGCCACGAGC
GCGTGTGGGTTTGTGAAGTTTGTGAACAAGCTCCCGCCGCCGTCACTTGCAAAGCCGACGCCGCCGCTCTTTGCGTCAG
TTGTGATGCCGATATTCACTCTGCTAATCCTCTCGCTAGCCGTCACGAACGTGTCCCCGTCGAAACTTTCTTCGACTCA
GCCGAAACCGCCGTCGCCAAAATCTCAGCTTCTTCGACTTTtggtATCCTTGgctCATCcacCAccgttgaTTTaacc > SEQ ID NO:5249 57145FL 57193_300121_1d
CAACAGGCCAGAGAGAAGAAAGAAGAGAAAAATATGGGCATATTGAGAGGCGGCGCAGATTGTTTTCCAGGAGGATGGG
GTGCGGCGGC > SEQ ID NO:5250 57319FL 154234_200163_1d
TGTTCTTCTCATGTTCATTCACCTCCTTGCTGAGACATCACACTTTACAGTGGATTGGAGTAAATCAAGACAATTACCA
GAATTGGGAGCAATACATTCAGTGGATCATAACCAAGTCTAAAGGGAAATCTGGTCGAGCTCAAATGATGAAAATGGTC
TTTGCTGAAATGCTTTACAGTATTTGGTTAGAAAGAAACTCCAGATTGTTCAATCACACTTCATGTTCCAGTGGACATC
TACTTAGAAGCATTGCTTATACATGTCATGTTAGGAGTCCCCCTAAAGTTAATGTACACCTACTGCATTATCTCCTGTA
ATTAGAAACATAGGTATAGTAATGTAGATGCTAGCTAGTTTTTATCATAGATGATAGTCAGCTGTGTATAGCTGAACTA
TGGCTTTGTAAAGATATACCTTTGGTGATTAATACAACAAATTTAATTACC > SEQ ID NO:5251 57506FL 1110734_301540_1d
TCGACCCACGCGTCCGTATCTTGAAAAAGGAAAGAGGAGAGAGAGAGTGATGGACTTTCAAAGCTAGTTATCACCTAAT
GCATAACAAAGAATAATCAAAGCAGAATGGTGTCGGCGTTGAACCTGAGCATCTCCATGGCCGGATTCGGCATCCTGTT
GGTGTTGGTAATTGGAAGCCGTTTGCTTCTCTCTTGGTTGCGGCGTAGGGATAATTCCGGAAGCCAGGCCGAGCAAAGC
ACTGATGCGAATTTGGTAAAACGGAACATCCATGGCCTAGAACCTACAGTAGTGGCTTCTTTTCCAACCATATTATACA
AATCACAACAAGTTTTACATTTCCAAAGGAAAACCATCTGTGCTCGGTGTGTCTAGGAGACTATAAGGAGAAAGAGAT
ACTTCGAGTGTTACCACATTGCGGACATTCCTTCCACATTACCTGCATTGATGCATGGCTTCGTCAACACTCCACCTGC
CCCATCTGCCGCATCTCATTGCGCTCTCTTCTTCCTGACATTCAACGGGACCCTCCACTCCAAGATGTCATCACCTTGT
AGTACCACAGAACTTCGAAAAATNTGGAGACGACTACTTTGGGTACATGTCAAGGTTTGATGCATCAATGACACGAGAA
AACCGAAAACTCAAGTGCTAAACCCGAACCATATCCTCCTT > SEQ ID NO:5252 57506FL 279837_200065_1d
TCGATTGTTTGTTTTATTCAGGTGATCTACTCTAATAATTGGTCTTCGAAAAGTATAATCCTTTTTTTTTGGCTCGTCA
TTCTGGCTCTTTCTTTGACCTGATGTTCTTCATTTGCTTCTCCTCTCATTCTTGAACTGAAAATTCATGTATTGTGAC
AATTAGTTGAAGAAGAAGGAGTAGCAAAGTGGGGTTGGGATGTTTGGGTCTGGAATGAATTTGATAACCACAATAATTG
GTTTTGGGATGAGTGCAACTTTTATAGTGTTTGAGTGTACTAGACTGATTTGTGGGAGGATAAGCAGGAGGCAATCAAG
GCAAATGTTTGAAATTGAATCATGGATTGATCTTCAAATGATTCACTAATGTAAACCTATTCTGGCAGCCAGAGCATCG
AATCAACGGGCTTGACTCTGTTGTGGTTGCTGCAATTCCACCATGAAATTTCACCGCTAGGCTTTCACCTCCTC > SEQ ID NO:5253 57591FL 154728_301351_1d
GCTGCAGATATCAAAAAGGATCTTCACCTAGATCCTTTTAAATTAAAAATGAAGTTTTAGCACGTGTCAGTCCTGCTCC
TCGGCCACGAAGTGCACGCAGTTGCCGGCCGGGTCGCGCAGGGCGAACTCCCGCCCCCACGGCTGCTCGCCGATCTCGG
TCATGGCCGGCCCGGAGGCGTCCCGGAAGTTCGTGGACACGACCTCCGACCACTCGGCGTACAGCTCGTCCAGGCCGCG
CACCCACACCCAGGCCAGGGTGTTGTCCGGCACCACCTGGTCCTGGACCGCGCTGATGAACAGGGTCACGTCGTCCCGG
ACCACACCGGCGAAGTCGTCCTCCACGAAGTCCCGGGAGAACCCGAGCCGGTCGGTCCAGAACTCGACCGCTCCGGCGA
CGTCGCGCGCGGTGAGCACCGGAACGGCACTGGTCAACTTGGCCATGGTGGCCCTCCTCACGTGCTATTATTGAAGCAT

FIG. 2 continued

TTATCAGGGTTATTGTCTCATGAGCGGATACATATTTGAATGTATTTAGAAAAATAAACAAATAGGGGTTCCGCGCACA
TTTCCCCGAAAAGTGCCACCTGATGCGGTGTGAAATACCGCACAGATGCGTAAGGAGAAAATACCGCATCAGGCGAAAT
TGTAAAGATATCGCGGCCGCTTaattaTgac > SEQ ID NO:5254 57591FL 181237_300695_1d
GCAGATACTTTACAATTTCGCCTGATGCGGTATTTTCTCCTTACGCATCTGTGCGGTATTTCACACCGCATCAGGTGGC
ACTTTTCGGGGAAATGTGCGCGGAACCCCTATTTGTTTATTTTTCTAAATACATTCAAATATGTATCCGCTCATGAGAC
AATAACCCTGATAAATGCTTCAATAATAGCACGTGAGGAGGGCCACCATGGCCAAGTTGACCAGTGCCGTTCCGGTGCT
CACCGCGCGCGACGTCGCCGGAGCGGTCGAGTTCTGGACCGACCGGCTCGGGTTCTCCCGGGACTTCGTGGAGGACGAC
TTTGCCGGTGTGGTCCGGGACGACGTGACCCTGTTCATCAGCGCGGTCCGGGACCAGGTGGTGCCGGACAACACCCTGG
CCTGGGTGTGGGTGCGCGGCCTGGACGAGCTGTACGCCGAGTGGTCGGAGGTCGTGTCCACGAACTTCCGGGACGCCTC
CGGGCCGGCCATGACCGAGATCGGCGAGCAGCCGTGGGGCGGGAGTTCGCCCTGCGCGACCCGGCCGGCAACTGCGTG
CACTTCGTGGCCGAGGAGCAGGACTGACACGTGCTAAAACTTCATTTTTAATTTAAAAGGATCTAGGTGAAGATCCTTT
TTGATATCGCgg > SEQ ID NO:5255 57591FL 30913_300081_1d
GATATCTTTACAATTTCGCCTGATGCGGTATTTTCTCCTTACGCATCTGTGCGGTATTTCACACCGCATCAGGTGGCAC
TTTTCGGGGAAATGTGCGCGGAACCCCTATTTGTTTATTTTTCTAAATACATTCAAATATGTATCCGCTCATGAGACAA
TAACCCTGATAAATGCTTCAATAATAGCACGTGAGGAGGGCCACCATGGCCAAGTTGACCAGTGCCGTTCCGGTGCTCA
CCGCGCGCGACGTCGCCGGAGCGGTCGAGTTCTGGACCGACCGGCTCGGGTTCTCCCGGGACTTCGTGGAGGACGACTT
CGCCGGTGTGGTCCGGGACGACGTGACCCTGTTCATCAGCGCGGTCCAGGACCAGGTGGTGCCGGACAACACCCTGGCC
TGGGTGTGGGTGCGCGGCCTGGACGAGCTGTACGCCGAGTGGTCGGAGGTCGTGTCCACGAACTTCCGGGACGCCTCCG
GGCCGGCCATGACCGAGATCGGCGAGCAGCCGTGGGGGCGGGAGTTCGCCCTGCGCGACCCGGCCGGCAACTGCGTGCA
CTTCGTGGCCGAGGAGCAGGACTGACACGTGCTAAAACTTCATTTTTAATTTAAAAGGATCTAGGTGAAGATCCTTTTT
GATATCTGCAGC > SEQ ID NO:5256 57708FL 159311_200023_1d
gttctttatcacagagtagagaaaacAAAAATGACGGAGGCAATGATTAGGAAAAAAGCCGGTATGGCTAGTGTGAAAG
ACATGCCGTTGTTGCAAGACGGTCCACCACCGGGCGGTTTTGCACCGGTTCGATTCGCTCGTCGGATCCCTAACACCGG
TCCAAGTGCTTTGGCCATTTTCCTCACTGCTTTTGGTGCTTTCTCTTGGGGTATGTACCAAGTCGGCGTTGGAAATAAG
AAGCGTAGGGTAATAAAGGAAGAAAAGTATGCTGCTCGAAGGGCTATCTTGCCCATGCTTCAAGCTGAAGAGGATGAAA
GATTCGTTAAAGAGTGGAAGAAGTATCTTGAAGAAGAGGCTAGAATCATGAAGGACGTGTTCCCGGTTGGAAAGTTGGTGA
AAGTGTTTACAACTCTGGAAAATGGATGCCTCCAGCAACCGGAGAGCTTCGtccTGATGTCTGGTAATATGTTGGCAGG
AGACAACGAAAACTGCTTTGTTTCAgcggaGTTCATACTTACCTtTggATTTCTTTCCTCATTGGAATaaaATGTATCT
GCAAAATCTGtacacATGTttagaaTGAAgttACATGAtttgc > SEQ ID NO:5257 57708FL 53221_300395_1d
CCCACGCGTCCGTCTCAGAATCCCTAGAACACACTCTGATTAACGAATCAAAGATCGATTTGGGATTGTGATCGATCGA
GGAAGAAGATGACGGAGGCGATGATAAGGAAGAAGCCAGGAATGGCGAGTGTGAAGGATATGCCGTTGCTTCAGGATGG
TCCACCACCGGGTGGATTCGCCACCGGTCCGATATGCTCGCCGGATCTCCAACACGGGTCCAAGCGCCATGGCTATTTC
CTTACCGTTTCAGGTGCTTTTGCTTGGGGGATGTACCAAGTCGGTCAGGGCAACAAAATCCGCAGGGCGTTGAAGGAAG
AGAAATACGCTGCTCGTAGAGCGATTCTACCAATTCTTCAAGCTGAAGAAGATGAAAGGTTTGTGTCTGAGTGGAAGAA
GTATCTAGAATACGAGGCGGATGTGATGAAGGATGTTCCTGGATGGAAAGTCGGTGAAAACGTGTACAATTCTGGTCGT
TGGATGCCTCCAGCTACTGGAGAGCTTCGTCCTGATGTCTGGTAAATTATCAATGGCTCCTTTTGATGATGATGAATGA
ATGTTTGTTTAAGCATTTTAGAACCTTGATGTTTCTTGTCTCTCTTTTTCCATCGTATAATAAGAGAATTGATACATAC
ACAGTTCATGTATTGCTGGTACGGTACTGAGGAACATTTTCTGTTTTTTCCCTCAAAAAAAAAA > SEQ ID NO:5258 57708FL 175751_300544_1d
CCCCCGATCGTCGTCTCGCCTTGCCCCGTCCACTAACCCTAGCGGCAACTGCGATCTCCAACCGCTCGATCTCTCGCCG
GAGGCTCCAGATCTGCGGGAGGTAGTCGACCTCGTCGCCGGCGGTGGGGTTTCCGAATCGGGGGCGAAGATGACGGAGG
CGTGGGTGCGGCACAAGCCCGGGATGGCGAGCGTCAAGGACATGCCGGTGCTGCAGGACGGGCCGCCGCCGGGCGGCTT
CGCGCCCGTGCGCTACGCGCGCCGGATCCCCACCAAGGGGCCCAGCGCCATCGCCATCTTCCTCACTACCTTCGGCGCC
TTCGCCTGGGGATGTACCAGGTTGGCCAGGGGAACAAGGTCCGCCGTGCACTCAAAGAGGAGAAAATTGCTGCCCGCA
CCGCTTTAGTGCCAGTGCTCCAAGCTGAAGAAGATGAAAGATTTGTCAAAGAGTGGACAAAGTCTCTTATGTGGGAGGA
AATAATTATGAAAGATGTCCCTGGATGGAAGGTCGGCCAAAGTGTCTATAATTCCGGGAAATGGATGCCTCCTGCCACC
GGCGAGCTGCGTCGTGAAGATTGATGAAATCCAAGGGGCTTG > SEQ ID NO:5259 57744FL 107718_300258_1d

FIG. 2 continued cttccattttccaccgttcgggcaagataataaaaactacaagtatatagcagtaacgtttcttcttcttcttcct
tTGTGAAGCAAGAAATACTTAATAGTAGAAGAGTATGGCTCTGAGAATGTGGGTTTCTTCAACAGCCAACGCACTAAGA
ATCTCCAGAACCAATCTAATTGCCCCCTCTTTTTCTTTCTCCAGATGCTTTTCAACTGTTCTTGATGGGCTGAAGTATG
CATCTTCACATGAATGGGTGAAGCATGACGGTTCAGTTGCCACTGTTGGCATCACTGATCATGCTCAGGACCATCTTGG
AGAAGTAGTGTTTGTGGATCTGCCAGAAACAGGTGGTTCTGTTTCCCAAGGAAGCAGCTTTGGAGCTGTTGAGAGTGTC
AAAGCCACCAGTGACATTAACTGTCCTATCTCGGGTGAGATTGTTGAGGTCAACACAAAGCTTACTGAAACGCCTGGCT
TGGTAAATTCAAGCCCATATGAAGATGGATGGATGATTAAAGTGAAGCCAAGCAGTCCATCAGAATTGGAGTCTTTGAT
GGGTTCCAAAGAGTACACAAAATTCTGTGAAGAAGAGGATAGTCATTGACACCTGAATGTACTTCTTGGTCCAATTTGG
ATTAACTGGGGTGCTTAAGGTTGCTATTGTTATAGAAATTTCCAGTCAATAAATAAAATTGTTCAAGCATAAAAAATTA
TCTtccacttGTCTCATAACATCTtTGccTATGCaGtTCTgtgattTGat > SEQ ID NO:5260 57744FL 50064_300166_1
aaaacacagaacaagaattagaaagaagggagagaaagcaaaaatggcgctaagaatgtgggcttcttctacagcaaac
gCTCTCAAGCTTTCTTCTTCTGTTTCCAAgtcTCATCTCTCTCCTTTCTCCTTCTCTAGATGCTTCTCCACAGTTTTGG
AGGGTTTGAAGTATGCAAATTCACATGAGTGGGTTAAACATGAAGGCTCTGTTGCCACCATTGGCATCACTGCCCATGC
TCAGGACCATTTAGGTGAAgtGgTGTTTGTTGAACTGCcagaGGACAATACTTCAGTGAGCAAAGAGAAAAGCTTTGGA
GCAGTGGAGAGTGTGAAGGCAACAAGTGAGATCTTATCACCAATCTCAGGTGAAATCATTGAGGTTAACAAGAAGCTCA
CAGAATCACCTGGCTTGATCAACTCAAGCCCCTATGAAGATGGTTGGATGATCAAAGTGAAACCAAGTAGCCCCGCGGA
GTTGGAATCTTTGATGGGTCCAAAGGAATACACCAAGTTCTGCGAGGAGGAAGATGCTGCTCACTaggAGGGTTTCTCT
CtgtCTTTTATGTTCGAAGTTCTATCAATTCTCATGCTTgttTTCTAAATTTGCATACACtctATGACCAACTTCACAA
AATaaGAGTTCaaGAAGATGAAACAGAGACCtaacAAACACATTaaGATTT > SEQ ID NO:5261 57744FL 229762_301046_1d
aagcttttgtggccgcaaggctgcgctccagtgcttgtggaaggaacATTCTCTGCCCTAATAATCTGTCTTGCTGCTT
ACTACGATGGCTCTACGCACCATGGCGACGCAAGCTGCGACGCTGCTGAGAATTCGGTGCCAGCCGAACTACCTCGCGC
AGGCGCTGGCAATTCGTGGATTTGCAACTGAAGCCGCAGCTACCGTTCCAATTCCCCAAGATTTGAAGTTCCTCGAGTC
GCATGAATGGGTGAAAGTGGAGGATGGAACTGGCACCGTAGGAATCAGTGACCATGCTCAGCATGAGCTTGGAGACGTT
GTGTTTGCGGACTTGCCCGAGGTGGGGTCGTCGGTGAGCAAAGGCAAGAACTTTGGCGTGGTGGAGAGCGTCAAGGCTT
GCAGCGACATCTACAGCCCCGTCTCTGGCGAAGTCGTCGAAGTGAACGAAGAGGTCAAGGCAACGCCAGCTCTGGTGAA
CAAGAGTgcatTCGgCGATGGATGgCTCATCAAAGTAAAGCTGTCCAGCGTGTCGGACCTCGACGGCCTAATGGATTCA
GCAGCATACGAAGAGCACGTCAAGAGTGAGGCTCACTAGCCGAGCACAAAGCGCAAAGCACAAATCACAGTATGTTTCG
AAAAGCTCTACTAGCAAGAAGGATAATTTTCTTTCCAAAGTCC > SEQ ID NO:5262 57744FL 209384_300814_1d
agctaactaggagaaggaaaaaagaagaacgcagatactttggtaACAAGCAAGAAATTGGCACAGAAATGGCTCTGAG
GCTGTGGGCTAGCTCAGCTGCCAATGCCCTCAAGATCTCATGCAGTGGAGCCACCAGGGCTGCACCTGCCTACTCAATC
TCCAGATACTTCTCCACTGTTCTTGATGGGTTGAAGTACAGCTCCTCTCATGAGTGGGTCAAGAATGATGGCTCTGTGG
CCACAATTGGAATTACAGACCATGCTCAGGGCCATCTGGGAGAGGTGGTGTTCGTGGAGCTGCCGGAGGCGGGGCGAA
GGTGAGCCAGGGAGGTGCATTCGGCAACGTGGAGAGTGTGAAGGCCACCAGCGACATCAACTCCCCCATCTCCGGTGAG
GTCGTCGAGGTTAACGACAAGCTCTCTGAGACACCCGGCCTGATTAACTCAAGCCCGTACGAGGACGGGTGGATGATCA
AGGTGAAGCCGAGCAGCCCGTCGGAGCTGGACGCCCTGCTGGACCCGGCCAAGTACACCAAGCACTGCgAGGAGGAAga
cgCTCACtaggcTCTTCCTCTCtgtgttTTTTCTCTCCATTTTgTCACTCCGAccTAAt > SEQ ID NO:5263 57744FL 175904_300523_1d
CCCCCCCCCCGGAAGAGCTCGGCGGTGGAACAGCTCGCTCGATCATGGCCGCCGCCGCCGCCGCCTCAAGGGCGCTCT
GGGCTTGCCGCACCGCCTCCTACCTTCGGATCTCCTCCTTCCCCAGGGCTTTCTCCACCGTCCTTAAAGATCTAAAATA
TGCTGATACTCATGAGTGGGTGAAGGTTGAGGGTGATTCAGCAACCATAGGGGTCACAGACCATGCTCAGGACCATTTG
GGTGATGTTGTGTATGTTGAGCTTCCACAAGTTGGTTCCACAGTATCACAAGGAACGAACTTTGGTGCGGTTGAAAGTG
TGAAAGCAACCAGTGATGATACTAATGCACCAGTATCTGGAGAGATTATTCAAGTAAATGATGAACTAAGTGAAAACCAGG
ATTTATAAATGGAAGTCCATATGAAGAGGATGGATCATCAAGGTTAAGATAAGTGATCCAAGTGAGTTAAACTCGCTG
ATGGATGATGAGAAGTACAAGAAGTTTTGTGAGGAAGAAGATGGCAAACACTGATCAATCCCCTAACTGCTGGATTTCA
AGAAACTATGCAGCAACTCACCATCATGACAATGAGCCATCTCGC > SEQ ID NO:5264 57744FL 159722_200141_1d
agcaaacgagagtgtgtgtgccgcaaaacttagagagaggagcactgctttgagtactttataagatggctaccaagttg
tGGGCTTCAAGGGTTGCTTCATACCTCAGAGTATCAACGCTTCACAGAGCATTTGCTACTGTTGTCAAGGATTTAAAGT
ATGCAGACTCTCACGAATGGGTCAAAGTTGATGGTAGCTCTGCAACAATAGGCATCACAGATCATGCTCAGGATCATTT
GGGTGATGTTGTGTATGTTGAATTACCCGAAGTGGGGGCTTCTGTTACTCAATCTGGCAGTTTTGGCGCTGTTGAAAGT

FIG. 2 continued

```
GTCAAGGCCACCAGCGATATCAATTCTCCTGTTTCAGGGAAGGTGGTGGAAGTTAATGAGAAGCTCGACTCCTCTCCTG
CTCTGATCAATGGGAGCCCATATCAAGAAGGATGGATTATAAAGGTGGAGATGAACAACCCCGACGAGCTCAAATCGTT
GATGGACCCTGACAaGTAtTCCAGTTTTTGTGATGAAGaagacgCGAAACACTGATTGAAACCTcaCaAAAGTTGAGCAa
GaACGCACTTTCCTGCAggattTtTCGTAGtgCATAAataggc > SEQ ID NO:5265  57744FL 138902_300728_1d
GGAGAGAGAGAGACAGACAGAGTGCGGCGCCGAGGAGGAGAGGAGCAATAATCCAATTCCAATCCATTCCTCCGCGACC
TCGTCGTCCGATCATGGCCATGGCCGCCTCCAGGTTGCTGTGGGCTTCCCGCGCCGCCTCCTACCTCAAGATCTCCACT
TTCCCCAGGGCCTTCTCCACCGTGCTGAAGGATCTGAAGTATGCTGACACTCATGAATGGGTTAAGGTTGAGGGTGATT
CGGCAACCGTTGGAATTACAGACCATGCCCAGCACCATTTGGGTGATGTTGTGTATGTGGAGCTTCCAGAAGTTGGCAG
CAGTGTATCCCAGGGAAAGAACTTTGGTGCTGTTGAAAGTGTGAAGGCAACCAGCGATATCTACTCTCCAGTATCTGGA
GAGGTGGTTGCAGTGAACGATGGACTAGGCGATGAACCTGGATTGGTTAATACAAGTCCATACGAGAGTGGGTGGATCA
TCAAGGTCAAGGTTAGTGATTCAGGTGAGCTCAATTCATTGATGGATGACGCGAAATACTCGAAATTCTGCGAGGAAGA
AGATAGCAAGCATTGAACAAATACCAGTGACTTGTGATCTGCAAAGAATGCGCCTTGACCCTTTTGTCAATGCTTGTGA
TGTGCTATCGAGCACTTATCTTTACCACCGGCTGCTCCTGAAA > SEQ ID NO:5266  57744FL 146987_200005_1d
GCCATTACGGCCGGGGACATTACTAGAGAGAAAAATGGCTTTGAGAATGTGGGCTTCTTCAACAGCCAATGCATTGAGA
ATTTCCACTGCCTCAAGAGCTAATCTTTCCCCTGCTTATTCACTCTCTAGATGCTTTTCCACTGTTCTTGATGGGTTGA
AGTATGCATCTTCACATGAATGGGTGAAGCATGAGGGTTCAGTGGCAACAGTTGGAATCACTGACCATGCTCAGGATCA
TCTTGGAGAAGTGGTGTTTGTGGATCTACCAGAAACTGGTGCTGCTGTTTCACAAGGAAGCAGTTTTGGTGCTGTTGAA
AGTGTGAAAGCTACCAGTGACATTAACTGTCCAATCTCGGGCGAGATCGTTGAGGTCAATACAAAGCTCACTGAAACAC
CTGGTTTGGTTAATTCGAGTCCATATGAAGACGGGTGGATGATTAAGGTGAAGCCGAGCAGTCCATCCGAGCTAGAATC
TTTGATGGGGTCCAAAGAGTACACAAAATTCTGTGAAGAAGAGGATAGTCACTAAAACTTGAAGGTGTTTTGTTTATTC
AACTTGGACTAACTTTGCCTGGTTAAGGCTGATACTGTGATGAAACTTCCTGTCACTTGTTAAAATTCTACAAAAATCA
AAACAACATCCACTTTTCTGGTGTTTTTTTTGCCTTATGCAGAGTTGTGATGTAGTCTTTTGGTAATTAAGATCATCTT
GCTCTCTGATTATTACACTCCGATGTTTTCTAAAAAAAAAAaacat > SEQ ID NO:5267  57744FL 136845_300439_1d
cccgatccctcatctcactgcagctttccgctatactaccaccaccactgagctgccactactcatccagctaactag
gAGAAGGAAAAAAGAAGAACGCAGATACTTTGGTAACAAGCAAGAAATTGGCACAGAAATGGCTCTGAGGCTGTGGGCT
AGCTCAGCTGCCAATGCCCTCAAGATCTCATGCAGTGGAGCCACCAGGGCTGCACCTGCCTACTCAATCTCCAGATACT
TCTCCACTGTTCTTGATGGGTTGAAGTACAGCTCCTCTCATGAGTGGGTCAAGAATGATGGCTCTGTGGCCACAATTGG
AATTACAGACCATGCTCAGGGCCATCTGGGAGAGGTGGTGTTCGTGGAGCTGCCGGAGGCGGGGGCGAAGGTGAGCCAG
GGAGGTGCATTCGGCAACGTGGAGAGTGTGAAGGCCACCAGCGACATCAACTCCCCCATCTCCGGTGAGGTCGTCGAGG
TTAACGACAAGCTCTCTGAGACACCCGGCCTGATTAACTCAAGCCCGTACGAGGACGGGTGGATGATCAAGGTGAAGCC
GAGCAGCCCGTCGGAGCTGGACGCCCTGCTGGACCCGGCCAAGTACACCAAGCACTGCGAGGAGGAAGACGCTCACTAG
GCTCTTCCTCTCTGTTTTTTTCTCTCCCATTTTGTCACTCCGACCTAATTTCTCCCTGTTGCAACAACTgctCTGTATc
cGTATACGATTAATAACTGAATCTtcaggCTTtgccatgtGTTc > SEQ ID NO:5268  57744FL 1106747_301502_1d
acctgactaaagaacggccaccAGTCAGGTTCTAGGAAGAGAGAGAGAGAGAGAGCCTAGCCAGCCAGCCAGCAGAAA
ACGGTAGTTATGGCCCTTCGTTCATTTGCTGCGCAGGCTGTCTCTCGCCTCCGTTGCAGTTGCCGTAGTAGCGGCAACT
TCGCACCTGCCGTCGCTTCTTCCTTCCTTCGCCATTTCAGCTCTGCCTATCCATCGGACTTGAAGTACGCCAAATCGCA
CGAATGGGTGCGAGCCGAGGATTCCAAGGCGACCATGGGCATTACCGACTTTGCCTTGGAGCAACTGGGAGATGTGGTT
TATGTGGAATTGCCTAGCGTTGGACAGGAGGTAGCTCAAGGCGAGTCTGTTTGCACGGTGGAGAGTGTCAAAGCAGCCA
GTCAGGTCTATGCCCCCATCAGCGGGAAAGTAGTTGAGGTCAACACCGAGATCACAACGAAACCTGAAACGATGAAGGA
TGATCCCTATGGAACAAGCTGGTTGGTGAAATTTGATATCAGCAAACCTGATGAGCTCAAGGCACTCTTGGACGCAGAT
GCTTACAAGACCCAAGTTGAGAGTGAAGAACATCACTGATTTTAGTAATCCTGAACCTTATTCTTGTTGTAAGCAGTTG
AATGCCAGTTATCTTTATTGAAATCAAATATGATCCAAATCAGATCAATATGTGGAGGGACTATGGGCTaGtGagttgt
tGTCTTgtcTCGttcTTga > SEQ ID NO:5269  57744FL 129901_300483_1d
GAATTCATGAGAGTGTGGGCTTCTTCAATTGCGGGGGCACTTAAATTCTCTTCATCTTCTACCTTGAAGCAGACTTCAC
TCTATCCATCTGCTTTTGCCGCCTCCAAATGCTTCTCCACCGTTTTGGATGGATTGAAATATGCACCATCACATGAATG
GGTGAAACATGAAGGAGATGTACCTACCATTGGTATTACAGACCATGCTCAGGATCATTTGGGAGAGGTGGTGTTTGTG
GAGCTACCATAAGCTGGTGGTGCAGTGACAAAAGCAAGTGGATTTGGAGCTGTAGAGAGTGTCAAGGCAACAAGTGACA
TCAACTCGCCTATTTCTGGAGAGATTGTTGAGGTCAACACCAAGCTCACCGACACCCCTGGCTTGATTAACTCAAGTCC
```

FIG. 2 continued

TTATGAGGATGGATGGATGATCAAAGTGAAACCATCAAGTCCAGCTGAACTTGAATCTTTAATGGATTCAAAGGGTTAC
ACCAAGTTCTGTGAGGAAGAAGATGCCAGCCATTAATTTAGTTTGATGGATATGTTTCTTTCTTTGCCACTTTGTTTCG
AAATTTCGATTTGGGTTAGCTAACTGAAATTTCTCCATCTGCAGTTGTTATCAATAATGATGTCAATATTACTGAA

> SEQ ID NO: 5270 103535 119252_300024_1b
AGTAGCACTCCAACAAAGAGCACTTCTGCACTTGCAAGCTCTGTTGCCTATTTTTCCAGAGAAGAGAAAAATATGGGTG
CTGACAAAGGGAAGAAGCAAAAAGTTGATGAAGAGAACAACATCATTGATGGTGAGCTCGTTTTTTCCATTGAGAAATT
GCAAGAAATACAAGACGAGCTTGAGAAGATCAATGAGGAAGCAAGTGATAAAGTATTGGAAGTGGAACAGAAGTACAAT
GAGATCCGCAAGCCTGTCTATGACAAACGAAATGACATCATTAAAGCTATCCCGGACTTCTGGTTGACTGCTTTTTTGA
GTCATCCTGTCCTAGGTGAGCTTCTAACTGAAGAAGACCAAAAGATCTTCAAGTTTCTAAGTTCTATTGAAGTTGAAGA
CTCTAAAGATGTGAAGTCGGGCTACTCGATAACCTTTAACTTCAATGCGAATCCTTATTTTGAAAATACAAAGCTGGCA
AAGACCTATACCTTCCTTGAAGATGGACCCACAAAGATTTCTGCTACAACAATAAAATGGAAAGAAGGCATGGCCATTC
CTAATGGAGTTGCACATGAGAAGAAAGGAAACAAGCGATCTCATGCTGAGGAAAGCTTCTTCACATGGTTCAGTGAAGT
CAATCAAAAAGATGAGGATGAGGATGAGGCCCTAGAGATTCAGGATGAGGTCGCTGACATAATTAAGGATGACTTGTGG
CCGAACCCTCTCACCTATTTTAATAACGAGCCTGATGAAGAAGATTTTGATGGTGACGAGGGAAAGGACAGTGAAGGCT
CTGAAGAAGAAGAGGAAGAAGTGGAGGATGAGGATGGTGATGAAGAATGAAGGCAGATAAACTGTTCAAGACCCCTATT
TTGGGATCTCGTCTTCAGCGGTTTTAATCATCAGGGTTTAGTGTCTGTAAAAAGGCTTTGAATGTTGCCAAAGAACAAA
ATAACTGTGGTGACTATACCTTTTCTTCTCTTGTATGGTTATAACCTATGAGCAAAATATCTAATTCCGGAGGTTAACA
AAAAAAAAAAA

> SEQ ID NO: 5271 103535 51808_300087_1b
TTTTTTGGCAAGATTTAGGACATGGATGATGAAATGGTTGGGACAAACAGAATGTAGCTATTGATAGTAAATAAACTAA
ATATTCCAAAAGAGAAAGCTTAGTCTCATCATTGCTAAAATTGAGAACCTCATAACACAAACTTTACACATCTGTTATA
GAAGCAAGCCAGCAATGTGTTATCTTTGGGCTCCCATCATTCCTCACCATCTTCCTCCTCTTCATCGTCATCGTCTTCT
TCTCCCTCTTCGTCACCATCATCATCTCCATCAAAATCCTCTTCATCAGCATCATTGTTGAAGTAGGTGAGAGGGTTGG
ACCAGAGATCTTCCTTGATAATATCAGCAACCTCATCATGAATCTCATCCCCAGCATCTTCCTTATGTTGAGCATCAGT
AAACCAAGTAAAGAAACTCTCCTCTGGCAATGCACGTTTATTTCCTTTCTTATCATCATGGTTCACTCCATTTGGCAAG
CCCTTGCCCTCCTTCCATTTGATAGGAGTTGCAGTGATTTTGTTGTTCCTTCTTCAAGGAAAGTAAATGTCTTGGTAA
GCTTGGCATCCTCAAAGAACGGGTTTGAAGTGAAGTGAAAAGTTATAGAGTATCCAGATTTCACATCTTTGGCATCCTC
CACTTCCAGAGAGTTCAAGTACTTAAAATCTTTTGGCTTCTTCAGTCAAGAGGTCGCCTAAGGCAGGATGACTCAAA
AAAGCAGTCATCCAAAAGCCAGGAATCGATTGGATAACTTCATTGCGCTTGTCATAGACAGGTTTCCGTATCACGTTAT
ATTTCTGCTCTACTTCCAAGACCTCGTCACTGGCCTTTTCGTTAATCTTCTCGAGGTCGTCTTGAATCTCCTGAAGCTT
CTCAATTGAGAGAACAAGCTCTGCGTCGATTTGCTCCAAGTTTTCTTCTTCGCCTTTCTCTTCAATTTTCGACTTCTTG
CTCTTGTCCGCGACCATTTTCAGTTCACTTCCTTTGAGGAAACCCTAATTCCAAAGAAAGAGAGGATTTTGGCTCCTCC
TTTTTGGTCTCTTCTCTTCTTGTGGTTCCCGGACGCGTGGG

> SEQ ID NO: 5272 103541 246011_301574_1b
AAAGAAGAGGAGACAGAAGAAGAAGAAGAAGAAGAAAAGAAGAAAGAGAGATGGCGGCAATCTCGTCGTCTCTGGGCCT
CAGCAAGGCACAGTTCTTCGGCTCATTCGATGCTAGCGATCGGCGAGAGGCTCTTCTTCTCGCGTTGGAATCGCGAGA
TCGAAGTGTGTGATCCGCGCGATGCAGCAAGAACACGATCCGTCGAGACGAGCAGCAGTCTTTGGCCTGGTCGCAGTGG
CCGCGGGCGTACTGGCCGTGGAGGAATCGCGAGCAGTGAGTGGAATCAAGATCAATGGGCCACCTCCACCATCCGGAGG
ACTTCCTGGGACGGAGAACGCCGATCAGCCGCGCGACTTGGATCTGCCACTCAAAGAGCGATTTTCATCCAGCCGCTG
TCGCCAGCCGAGGCAGTGGATAGAATCAAGGACGCGTCGAAGGACATTGTGGGAGTAAAGGAGCTGATCGAGAAGAAGA
GCTGGCCGTATGTCCGCAACGATCTTCGCAGCAAGGCGACTTACTTGAGGTATGACATCAAAACCATCCTGGATGCCAA
GCCCAAGGCCCAGCGCAAAGAGCTCAAGAAATACACGGACAGTCTCTTCGACACAATTGACAAGCTTGACTATGCAGCT
CGAGCAAAGGATCCCGCAGCCGCGAGCAAGTGCTACAGCGACACCGTAGCTGCATTGGACACTGTTATTGCCAAAATCT
CGGCATAAATATATA

> SEQ ID NO: 5273 103541 1113936_301907_1b
TCTAAATCAAGGATATCAGAGGTGCTAGTGGTGCTATCGTTGTAAAGGGAAGATGGCTCAAGCAGTAGCGATGGCCGGG
CTTTGCTCATCCCTCTCCTCGGCCGCTTCCTCGCTCGACGGGGCCGGCTCTCGCCTCTTGGCCTCCTCCCCTTCTTCCT
CTGCCCCCTCTAAACCATCCCTTCGCCTCCCTTTAATCCGCGCTAGCTCGTCGAATCCCTCAGAAGACGCTTCTGCTAA
ATCTAGTACTAGACGCCAAATCTTGTCCCTCGTTGCTGTCTCTGCTTTGCTTGTCTCTAAACAAGCCCTCGCCGACCCT
AGCCCTATCAAGCTCTTTGGCCCTCCCGCCCCTTCTGGTGGCCTCCCTGGGACTGAAAATGCCGACGAAGCTCGAGATC
TAGACTTGCCATTGAAGAATAGATTTTACCTGCAACCTCTTCCTCCCGTGGAAGCGATCGCCAGGGCGAAGGAATCTGC
CAAAGAGATTGTGAATGTGAAGGCATTGATCGACAAGAAGGCTTGGCCCTATGTCCAGAACGGGCTCCGATCACAGGCT
TCCTACCTGCGCTTTGACCTCAACACTGTTATCGCTTCCAAGCCGAAGGATGAAAAGAAAGCTCTTAAAAGCCTTAGCA
CTAAGCTCTTTAACACTATCAATAATCTGGACTATGCTGCTAGAAGCAAAAGTACCACCCAGGCGGAGAAATATTATGG

FIG. 2 continued

AGAAACTGTTTCGGCATTGAATGATGTTCTTGCTAAGCTTGGATGATTATTCTGGTTTCCCTTTGTAATATCTTTTAGT
CTCTAGTTTTATCCAACTTAAGAAGATTATGAGTGGAATGATGTAACATTTGAGAGAACCTGCCCACCTTATTGGAATT
TAATCACTTGTAATCGC

> SEQ ID NO: 5274 103541 130502_300488_1b
GAATTCAATGGCGCAAGCTATAGCATCAGTATCTGGCTTAAGCAGCTTCTCGCAAGGTACAAACAGATTGAATGTGGCT
ACTACCAACAGCCGAACGGCCAGAAGTCGTGTTGGTTTCAGCGTTAGATCTGAGAAGAAGTCGGAATCGGAGACTGCTC
AGAGTAGCCGTAGAGCACTATTGGGTGTCTTAGCTGTGGGACTAACCACTGGATCTTTCGTGAAGAATGTGCTTGCTGA
TGCTAGGCCTATTGTAATCGGGCCACCTCCCGCTCCTTCCGGTGGTTTACCGGGGACTCTAAATTCTGATGAAGCAAGG
GACTTAGATCTACCCCTAAAAACAAGGTTTTTCCTACAGCCTAAGACTCCAGAAGAAGCAGCTCAAAGAGTAAAAGAAT
CAGCGCAAGCGATCCTAGGTGCCAAGGCACAGATAGACAAAAAGGCATGGCCGTATGTCCAGAATGAACTACGATCCAG
CGCCGAATATCTTCGTTACGATCTCAGAACTATCATCTCTGCAAAGCCCAAGGATGAGAAGAAACCACTCAAAGAACTG
TCTGACAAGCTTATCCAAAACCTCAATAGTCTGGACTATGCTGCAAAGGTTAAGAGCACTCCTGAAGCAGAGAAGTACT
ATGCCGAAACAGCAGCATCATTAAAAGAAGTTCTAGCAAAGATTGGTTAAGAGATACTTGTCAAGAGCTGAACATCAAT
TATTTTATTCTTCTTCCTGATGAAACTGAGTGACGATTTTGTCATTCCCGAACAATCATTGCTGTATTACTTTTTTTG
GTATGATCAAAGGATGAATATAACCATATA

> SEQ ID NO: 5275 103541 11894_300290_1b
TGGTATCAACGCAGATGGCCATTACGCCGGGGGCCTGAAACAAATTTCAGAAAGTTCACCAAAATGGCTCATGCTATGG
CTTCAATGGGTGGCCTAATTGGTTCTTCTCAAACTGTGTTGGATGGTCAGCTCAGTGGCTCAGCCCGTTTGAGCACTGT
TAGCACCAGCAGAATTGCCTTGGCTAGACCAGGACTCAGCATTAGAGCCCAACAGGGGTCTGCTGACACTGAAACTAGC
CGTAGAGCCGTCATCGGTCTTGTTGCTGCTGGCCTTGCTGGTTCCTTTGCTCAAGCAGCCTTTGCTGCAGCTAAATCAA
TCAAGATTGGGGGCGCTCCTCCTCCCTCTGGTGGATTACCTGGAACTTTGAACTCGGATGAGGCAAGGGACTTGGTCT
ACCATTGAAGAAGAGGTTTTACCTTCAACCATTGACTCCAGCTGAAGCAGCCCAGAGAGTTAAGGATTCAGCCAAGGAG
ATTGTTAGCGTCAAGAATTTCATCGACAAGAAGGCCTGGCCATATGTCCAGAATGACCTTCGTCTC

> SEQ ID NO: 5276 103619 283854_200095_1b
GTAATTTATTTCTTAGTTTCTCAATATCACTAATGGCTTCTCTTGGACTTGGTTTAATCCTTGTAATAATGTTCTTTCT
ATCTATATTCCAAGCATTTTCAGCTTCCACTTCCCATATTGGTGGTGACTATGCTAATCTTTATCCACAATTCTACCAA
TTCACATGTCCTCAAGCTAATGATATTGTCATGTCTGTTTTAGAAGAGGCCATTGCTAAAGATTCAAGAATGGCTGCTT
CTCTACTTAGACTTCACTTCCATGACTGCTTTGTCCAGGGATGTGATGCATCCATATTATTGGATGGGAATAAAGAATT
CAAAAGTGAAAAGGATGCTTCACCCAAACAAGAATTCTGCTAAGGGATTTGAAGTGATTGATGAGATTAAAGCTAAACTG
GAACATGTTTGTCCTCACACGGTCTCCTGTGCTGATATTCTAGCCCTTGTTGCTCGTGACTCTGTCCTCCTGAGCGGTG
GACCATTTGGGAAGTGCCACTAGGAAGAAAGGACTCAAAGATAGCAGACTTCAACAGAGCAAGTATCGACATCCCTGG
ACCAAACTCAACAATCCAAAACCTCATAAATCTTTTCAACAAACAAGGCCTAAAGGAAGAAGACCTTGTTTCTCTTTCT
GGAGGGCACACCATAGGGGTGGCAAGATGTGTGTCATTTAGGCAAAGGCTATACAATCAAATGGTGACAATTTGCCAG
ATGCAACTCTAGAAAGAGATTACTACTATGATTTGAAATCAATTTGTCCAACAAAGGGTGGAGACAATAACATTTCTCC
TCTAGATGTTGCTTCCCCTGTCAAATTTGATAATTCATATTTCAAGCACTTGTTAAATGGCAAAGGTCTTTTGAACTCA
GATGAAGTACTTTTCACTGGAAATGTACAAAAGACTACAGAATTGGTGAAGAATTATGCTGAAAATGAGGGACTTTTCT
TCCAACAATTTGCAAAGTCTATGGTGAAAATGGGGAATATTAATACTCTGAATGAATTGAAGGGTGAAATTAGGAAGAA
TTGTCGCATAGTTAACTAAAATAAATTAGTACTACTCTGTATTTATGAATAATTGCATGATCATGTTTAGTTCCTGAGT
TTTCTTTTGAATAAAGCTTTGGTTAGATGG

> SEQ ID NO: 5277 103619 39132_300097_1b
CCCACGCGTCCGCAAGTAACAAAAATGGCTATCTCAAAGCTTATTCCTACTCTTGTGCTCTTTGTTTTGTTCTCTTTTG
ATGTTAGTGTTGCTCATCCAGGTCTAGGATTTGGATGGGGAAGTAATAGTCCCATTGGAGGATCTTTTTACTCAAATCT
TTACCCACAATTTTACCAGTTCTCTTGTCCACAAGCTGATGAGATTGTTATGACGGTGCTCGAAAAAGCCATAGCTAAA
GAACCAAGAATGGCAGCATCTTTACTCAGACTTCACTTCCACGACTGCTTCGTTCAGGGCGTGATGCATCAATCTTGT
TGGATGATAGTGCAACCATAAGAAGTGAAAAGAATGCTGGACCAAACAAGAACTCCGTTAGAGGGTTTCAAGTAATCGA
CGAGATCAAAGCCAAACTTGAGCAAGCTTGTCCTCAAACTGTCTCCTGCGCCGACATTCTAGCTCTAGCTGCTCGTGGC
TCAACTATACTGAGTGGTGGACCATCATGGGAGCTTCCACTAGGAGGAGAGACTCGAGGACCGCTAGCCTTAATGGCG
CAAACACGAACATTCCTGCACCTAACTCAACTATTCAAAATCTCTTAACCATGTTCCAACGTAAAGGTTTGAACGAAAA
AAACCTTGTTTCCCTATCAGGAGGACATACGATTGGAGTAGCGAGGTGCCCAACGTTTTAACAAAGACTATACCATCAA
AACGGTAATAACCAACCAAACGAGACGCTAAAAAGGTCTTACTACTATGGTCTCAGGTCAATTTGTCCCCCACAGGCG
GTGACAACAATATTTCACCTTTAGACTTAGCCTTTCCTGCAAGATTTGGCAACACATACTTCAAGCTCCTTTTATGGGG
CAAAGGGTTATTGACATCAAATGAAGTGCTTTTCCCTGGCAATGTAGGCAAGACTGGTGCCTTAGTGAAAGCTTATGCC
GAAAACGAAAGACTTTTTTTCCCACAATTTGCAAAGTCGATGGTTAACATGGGAAACATTCAGCCTCTTACTGGTTTTA
ATGGTGAGATCAGGAAAAGTTGTCATGTGATTAACTAAAAAAACTGTGTGTTTTTGCATTATTATTGTATTAAGGGGTG

FIG. 2 continued

ATTAAAAATAAGTCGTGTTATGTTTTTCGATATGTTAGTGATTTAATTAACGTCTTTGACCG

> SEQ ID NO: 5278 103619 188484_300691_1b
CCCGGCGCCACCAAACAACCCCAGCCTCCGGGGATTCGAGGTGATCGACGCCGCCAAGGCCGCCGTCGAGGCGGCGTGC
CCGCGCGTCGTCTCCTGCGCCGACATCCTCGCCTTCGCCGCCCGCGACTCCGTCGCGCTCACCGGCAACGTCACCTATA
AGGTCCCCGCCGGCCGCCGCGACGGCAACGTCTCCATCGCCCAGGACGCGCTCGACAACCTGCCCCCTCCCACCTTCAA
CGCCACGGAGCTCGTCGGCCGCTTCGCCAACAAGTCGCTCACCGCCGAGGACATGGTGGTGCTCTCCGGCGCCCACACC
ATCGGCGTCTCCCACTGGGACTCCTTCACCCCGCGCCTCTACAACTTCACCGGCGTCGGCGACGCCGACCCGGCGATCA
GCCCCGCCTACGCGTTCCTCCTCCGCGCCGTGTGCCCCTCCAACAGCAGCCAGTTCTTCCCCAACACGACGGTGGACAT
GGACGTGATCACCCCG

> SEQ ID NO: 5279 103619 227278_301009_1b
CTCTTCTTCACCTTCCTCGTGGCCTTCTTCCCCGGCGCCGCCGTCGGCGGGGGGCTGAAGGTCGGGTTCTACAACAAGA
CGTGCCCGTCGGCGGAGCGCCTGGTGCAGCAGGCGGTGGCCACCGCGTTCAAGAACAACAGCGGCGTCGCCCCCGGCCT
CATCCGGCTGCACTTCCATGACTGTTTTGTCAGAGGCTGCGACGCCTCGGTTTTGATCGACGGGAACGACACCGAGAAG
ACCGCGCCACCAAACAACCCCAGCCTCCGGGGATTCGAGGTGATCGACGCCGCCAAGGCCGCCGTCGAGGCGGCGTGCC
CGCGCGTCGTCTCCTGCGCCGACATCCTCGCCTTCGCCGCCCGCGACTCCGTCGCGCTCACCGGCAACGTCACCTATAA
GGTCCCCGCCGGCCGCCGCGACGGCAACGTCTCCATCGCCCAGGACGCGCTCGACAACCTGCCCCCTCCCACCTTCAAC
GCCACGGAGCTCGTCGGCCGCTTCGCCAACAAGTCGCTCACCGCCGAGGACATGGTGGTGCTCTCCGGCGCCCACACCA
TCGGCGTCTCCCACTGCGACTCCTTCACCCCGCGCCTCTACAACTTCACCGGCGTCGGCGACGCCGACCCGGCGATCAG
CCCCGCCTACGCGTTCCTCCTCCGCGCCGTGTGCCCCTCCAACAGCAGCTAGTTCTTCCCCAACACGACGGTGGACATG
GACGTGATCACCCCGGCGGCGCTCGACAACAAGTACTACGTCGGGGTCACCAACAACCTGGGCCTCTTCACGTC

> SEQ ID NO: 5280 103619 260028_301711_1b
GATGGCTAGCATAGAAGTTCATGCTAATATGTTAACGTGCTTGCATTTTTTGCTTGTTCCTGGCAGCCGTCAAAGCGCA
GCTCACTCCAGGTTTCTACGACAAGTCATGCCCGACATTACTTCCCACTATCCGTGCTGTTCTTGAAAAGGGCGTCGCT
CAAGAGCCCCGGATCGCTGCCTCGCTGCTGCGCCTGCATTTCCACGACTGCTTCGTCAATGGATGCGACGCTTCTCTCC
CTTCCTGGACGAATACCCCCGGGCTTCACTGGGCGAGAAAACCGCAGCTCCAAACAAAAGATCCGCCCGTGGCTTCCCG
GTGGTGGACAGGGCAAAGTTCGCGGTGGAGAAGGCATGTCCGGGAGTGGTGTCCTGCGCAGACATTCTCGCCATCCTAG
CTCGTGAATCCGTCACCTTGATGGATGGACCGAGCTGGGTGGTGCAACTTGGTCGCCGCGACAGCACCACTGCCAACCG
CAGCGCGGCCAACAATGACATCCCTCCGCCAAACTCCACACTGGCGATTCTCCTCTCCAAGTTCCAAGCCAAAGGCCTC
AACGCCAAAGATCTCGTCGCTCTGTCTG

> SEQ ID NO: 5281 103619 224554_300973_1b
TTCTACGCCTCCATTTCCATGACTTGCTTCGTTCAGGGGTGCGATGCGTCGGTGCTGCTAGATGATACCCCAACTTTCC
AAGGGAGAGAAGACGGCCGGGCCAAACAACAACTCCATACGAGGATTCGAAGCGATCGATGCGATCAAATCTTCTTTGG
AGAGTAGCTGCAAGGGGGTAGTGTCATGCGCAGACATTCTAGCTCTGGCAGCTCGCGACTCGGTGGTCTTGAGCGGTGG
ACCATCGTGGGAAGTGCCACTGGGACGACGAGACAGCACCACAGCTAGCTTCTCCGGAGCTGGGAATCGGTTGCCCAGC
TTCTTTTCCGACGTGAATGGATTGATCAAGTCTTTCACAGACGTTGGTTTACAAGCAGAAGACATGTTTACGCTATCTG
GGGCGCATTCAATCGGTCATGCTAGATGCCTTGCTTTTGCGCTCTAGAATTTTCAATGATAGTGGCAGTGGAAGTCCAGA
TCCCAGCATTCGCGTCAGCTTTCTCTCCATGCTTCAGTCCAAATGCCCGCAGAGTGGAGATGTTAACGCTCTCCAGCCA
CTGGATGCGACGACTATCACCAAGTTTGATAA

> SEQ ID NO: 5282 103619 198830_300685_1b
TAGTCGACCACGCGTCCGGGGCTACTCCCGGTGCCTCTTCTTCCGCAGGCGCCTCTACAACGAGACCGACACGCTGGAC
CCGGCCTACGCCGCGGCGCTCGAGGAGCAGTGCCCCATCGTCGGCGACGACGAGGCGCTCGCCTCGCTGGACGACACGC
CGACCACCGTGGACACCGACTACTACCAGGGCCTCACGCAGGGCCGCGCGCTGCTGCACACGGACCAGCAGCTGTACCA
GGGCGGCGGCGGCGGCGACAGCGACGAGCTGGTCAAGTACTACGGCGAGAACCCGGACAAGTTCTGGGAGGACTTCGGC
GCCGCCATGGTGAAGATGGGCAACATCAGCCCGCTCACCGGCGA

> SEQ ID NO: 5283 103619 187413_300677_1b
CCCACGCGTCCGGTGCTTTTGGACTCGTCGGGGAACATGTCGGCGGAGAAGGACGGCCCACCCAACGCGTCGCTGCACG
CCTTCTACGTCATCGACAACGCCAAGGCCGCCGTCGAAGCCCTCTGCCCCGGCGTCGTCTCCTGCGCTGACATCCTCGC
GCTGGCCGCCAGGGACGCAGTCGCCATGTCCGGTGGTCCTTCTTGGCAAGTGCCGGTGGGTCGTCGTGACGGGCGCGTG
TCGCTGGCGAGCGAGACGACGACGGCGCTACCGGGGCCGACGGCGAGCTTCGACCAGCTGAAGCAGGCGTTCCACGGGC
GCGGGATGTCGACCAAGGACCTGGTGGTGCTGTCGGGGGTCACACGCTTGGCTTCGCACACTGCTCCTCCTTCCAGAA
CCGCATCCAGCCGCAGGGCGTCGACCCCGCGCTTCACCCCTCCTTCGCCGCCACCCTCCGCCGCTCCTGCCCACCCAAC
AACACCGCCAGGTCTGCCGGCTCCTCCCTCGAGCCCACCTCCTCCGCCTTCGACAACTTCTACTATCGGATGCTGCTCT

FIG. 2 continued

CCGGCCGTGGCCTTCTCTCCTCCGACGAGGCGCTGCTCACCCACCCCAAGACGCGCGCCC

> SEQ ID NO: 5284 103619 154616_301256_1b
TGTACTATTGGACGATACTAGTACATTCACAGGAGAAAAGAATGCGCCTGGTAATCGAAATTCAGCCAGAGGATTTGAA
GTCATTGATGCAATAAAAGCAAACGTGGAGAAAGCTTGCCCGTCTACAGTTTCATGTGCTGATATACTGACTCTAGCAG
CTAGAGAAGCTATCTATCTCACTGGGGGCCCATATTGGTCACTTTCTTTGGGCCGTCGAGATAGTCTTATCGCAAGTCA
GAGTGCAGCTAATGCTCAAATTCCATCACCTTTTGAGCCCTTACAAAACATTACTGCTAAATTTGTTTCAAAGGGTCTT
GACGTAAAAGATGTTGTGGTGCTATCAGGTGCTCACACCATTGGATTTGCTCAATGTTTCACCTTCAAGCAAAGGCTGT
TTGATTTTGATGGATCTGGAAATCCTGACCCGACACTGGATTCATCATTACTGGGCAATCTGAGAAGCGTATGTCCCAA
CCAAAATGATTCAGATTCCAACCTTGCCCCTTTAGATGCAGTCACAATCAACAAGTTCGATAATGTATATTTCAAGAAT
CTGATGAACAATTCTGGGCTTCTTC

> SEQ ID NO: 5285 103718 103717_300027_1b
TGGTATCAACGCAGAGTGGCCATTACGGCCGGGGACCAAGCAAAAACTCAAAACTTCACATCTTTAGTAGTAGCATCAA
TATTCAAGATGGTTCTCCAAACTCAACTTGGGTTGAACAAGCCCCAATCCTACGCTCACGAGCAAAATTATTATTCCGA
CGGCAGCCATGGCGGCTCTATGCAAATGACAAGGCCATCGGGCTATTCCACCATGCCATATGGCCAGTCCACTCACAAT
CACATGATGATGGGTCATGGTGGCCAACATCATGGCGGACACTATGGTGGTCATGGCCATGGCTACGGCGGTCATGAAC
ATCATGGGGCGCATATGCCCCATGACTCCACTAACTTTTCAAGCAGCACCAATATGGTCCATAGTGATGCTGGCTATGG
CAGTGGAATGCAACAATCTACCCATATGTTGTCAGCCATGGGCATGGGATCGACCAATTATCATGGCCATGGTTATGGT
GGCAGCCACCCTAGTCAGTACAGCCAGAGCCAAAAGTTCAACTGGGCTCTTAAGGATCTGGAGGAATAAATATATGATA
AATTTTATGCTATCCTGTATGGTGAAAGTATGTGTGTGTTTTGGTAGTGGATTTTGCTAATTATATAGCATGAAGAAAC
TACTACCTAAATAAGTAATAATGTACTAAACAGTCTGCTGCTTTACTTGATTATCAATGCATCTACTTATCATTACTAA
ATGATGAATAAAAAATAAAAGTATGTTTATAACGAA

> SEQ ID NO: 5286 103718 11729_300294_1b
TGGTATCAACGCAGAGTGGCCATTACGGCCGGGGACCAAGCAAAAACTCAAAACTTCACATCTTTAGTAGTAGCATCAA
TATTCAAGATGGTTCTCCAAACTCAACTTGGGTTGAACAAGCCCCAATCCTACGCTCACGAGCAAAATTATTATTCCGA
CGGCAGCCATGGCGGCTCTATGCAAATGACAAGGCCATCGGGCTATTCCACCATGCCATATGGCCAGTCCACTCACAAT
CACATGATGATGGGTCATGGTGGCCAACATCATGGCGGACACTATGGTGGTCATGGCCATGGCTACGGCGGTCATGAAC
ATCATGGGGCGCATATGCCCCATGACTCCACTAACTTTTCAAGC

> SEQ ID NO: 5287 103752 11764_300294_1b
TGGTATCAACGCAGAGTGGCCATTACGGCCGGGGGTGGTCCTACGCATGTGCAAAGCAATTGATTGAGAGGTTGATCTA
TGCTGAGGGTGCTGAGAATGGCTTANAATTCACCATTGTTAGGCCCTTCAACTGGATTGGTCCGAGGATGGATTTCATA
CCTGGGATTGATGGTCCTAGCGAAGGTGTTCCGAGAGTGTTGGCTTGCTTTAGTAATAATCTTTTAAGACATGAACCAC
TAAAGCTAGTGGATGCGGACACTCGCAAAGAACCTTCATATATATTAAGGATGCTATTGAAGCTGTTCTCCTGATGAT
TGAAAATCCTGCACGGGC

> SEQ ID NO: 5288 103752 273683_200144_1b
CCCACGCGTCCGGAAACTCGAATTTTTAGAGAGAGAAAGTGCAATTTTTACAGGGGAAAAATGGCAGGAGGGAGAGTAG
ATCTGGACGGCAATGTTATAAAGCCGATGAAAATATGCATGATCGGCGCCGGTGGTTTCATTGGGTCCCACTTATGTGA
GAAGCTGATGAATGAAACGCCGCACACGGTGCTCGCTGTCGATGTTTACAGTGATAAAATCAAGCATCTACTTGAACCG
GCTGATCTCCCTTGGACCGGTCGAATTCAGTTCCATCGAATTAATATTAAGAATGATTCTCGTCTTGAAGGTCTCATCA
AAATGGCAGATCTGGTTGTAAATCTTGCTGCGATCTGCACGCCAGCTGATTACAATACTCGTCCACTTGACACAATCTA
CAGCAACTTCATTGACGCTTTACCAGTGGTTAAATACTGCTCAGAAAATGGAAAGCGTCTCATTCACTTTTCAACTTGT
GAAGTTTATGGGAAAACCATAGGTGCCTTTTTACCCGAAGACAGCCCATTGCGACAGGATCCTGCTTACTACGTCCTTA
AGGAAGATGTCTCTCCTTGTATTTTTGGATCTATTGAGAAGCAAAGGTGGTCCTACGCATGTGCAAAGCAATTGATTGA
GAGGTTGATCTATGCTGAGGGTGCTGAGAATGGCTTAGAATTCACCATTGTTAGGCCCTTCAACTGGATTGGTCCGAGG
ATGGATTTCATACCTGGGATCGATGGTCCTAGCGAAGGTGTTCCGAGAGTGTTGGCTTGCTTTAGTAATAATCTTTTAA
GACATGAACCACTAAAGCTAGTGGACGGTGGACACTCACAAAGAACCTTCATATATATTAAGGATGCTATTGAAGCTGT
TCTCCTGATGATTGAAAATCCTACACGGGCTAATGGGCAGATCTTTAATGTCGGCAATCCCAATAATGAAGTTACAGTT
AGGCAGCTTGCTGAAATGATGACTCAGATGTATTCAAAGGTGAGTGGAGAATCTCCTCCTGAAACACCCACCATTGATG
TAAGTTCTAAAGAATTTTACGGCGAGGGGTACGATGACAGTGACAAGCGAATTCCAGACATGACCATAATTAACAGACA
GCTCGGTTGGAACCCGAAGACATCCCTATGGGACTTGCTTGAATCCACGCTGACATACCAACATAGGACTTATGCTGAG
GCTGTCAAGCAGGCAATGTCACAGACAACTGGAAATTGAATTTGAAATCAGAGCAGTGGTTAGTGTGTGC

> SEQ ID NO: 5289 104067 232538_301216_1b
GAGGAGCAAATGGGTCAGTCGCTTTGCTGCTTCCAGGTCCCCCAGTCCAAGGTGGCGATCAAGGAACGATGGGGCAAAT

FIG. 2 continued

TCGACGAGGTTCTAGATCCTGGATGCCACTTCGTCCCCTGGTGCTTTGGCAGCAACATTGCCGGCTCTCTCAACCTCCG
CATTCAGCAGCTGGATGTGCGCTGCGAGACCAAGTCCAAGGATAACGTATTCGTCACGGTTGTAGCTTCGGTCCAGTAT
ACTGTTGTCCAGGCCGACGCCATGGATGCATACTACAAGCTTTCTAACCCGAGGGAACAAATCCAAGCTTATGTCTTTG
ATGTCGTTCGTGCTTGCGTTCCAAAGATGAACTTGGACGATGTGTTTGAACAGAAGAACGAAGTAGCCAAGGCTGTCGA
GGACGAGCTCGAAAGGCAATGGCTACATACGGATATCGCATCGTCCAGACTTTGATTGTCGACGTTGAGCCGGACAAA
CATGTTCGCAACGCGATGAACGAGATCAATGCAGCTGCGAGGATGAGGGTGGCGGCCAACGAGAAGGCCGAGGCCGAGA
AGATCCTCCAGGTGAAGCGAGCCGAGGCCGAGGCCGAGTCCAAGTACCTCTCGGGAGTTGGTGTTGCGAGGCAGCGGCA
GGCGATCGTAGATGGCCTCCGCGAGAGCGTCTTGGCGTTCTCGCACAATGTTCCAGGGACGAGTGCCAAAGACGTGATG
GACATGGTGCTACTGACGCAGTATTTCGACACCATGAAGGAGATTGGCGCTGCTTCCAAGTCTTCCACCGTCTTCCTCC
CGCATGGACCAGGCGCTGTTCGTGACGTCGCGGA

> SEQ ID NO: 5290 104067 251134_301654_1b
GGAAATGGCTTGCTGTGTGTGCATCGATCAGGCTAGCGTCGGGATCCTGGAGAAATGGGGCAAGTTCGTGCGCGTGCTG
GAGCCCGGATTCAGCTGCGTCGTGCCGTGCTTTGGCCAGTTCGTGGCTGGGACGCTGTCCCTCAAGGTGCAGTACTTGG
ATGTGCGGTGCGAGACCAAGACAAAGGACAACGTGTTTGTGTCCCTCGAGTGCTCCATCCAGTACCGCGTGGTGCGGGA
GAACGCGGACGATGCTTTCTACGAGCTGCAAAGCCCCGAGCAACAGATACGTTCCTACGTCTTCGATGGTCAGTATCTC
ATATACGTCGGTAGTCTAGGCCCATTGTGATATGTTACTGGCAGTGATCCGGGCGTCTGTTCCCAAGATGTCGCTGGAC
GAGGTCTTTGAGCAGAAGAGCGACATTGCGAAGGCGGTTTCGGATGAGCTAGAGAAGGTTGTAAAAGGTTTCCTATAT
TGCTCTCGCTCACAATTGTCAAACAGGTGATGAGCGCGTATGGTTACTCGATTGAGCAGATACTCATCATCGATATTCT
CCCTGATGCTGCCGTTCGGAAAGCCATGAACGAGATCAACGCAGCCCAGAGAATGAGAATGGCGGCAGTCGAGAAGGGA
GAGGCTGAGAAGATCCTGCAAGTCAAGAGGGCCGAAGCCGAGGCCGAGTCCAAGTATTTGTCGGGGCTGGGAGTGGCCA
GGCAGCGGCAGGCTATCACCGACGGGCTGAGGGAGAGCGTGCTGACCTTCTCGCAGGATGTTCCCGGGACTTCTGCCAA
GGAGGTGATGGACCTTGTCATGATCACTCAGTACTTCGATACCCTTAAAGACATTGGTGCCAGCTCCAAAAACACTGCT
ATGTTCATACCTCACGGACCCGCGCACGTCAACGACATCGCCCAGCAGCTCCGGGACGGGGTTCTGCAAGCCAACACTG
CTGCGTCCTTGATGGATTGAATGGAATCTCATGCTTAT

> SEQ ID NO: 5291 104067 255879_301645_1b
GTAGAGTACACAATGGGTCAAGCTCTTTGCTGTGTGCAAATTGACCAGTCTACTGTGGGTATCCGAGAAAGGTGGGGGA
AATATATAGAATTACTCCATCCTGGATGCCATTGTGTTATGTGGTGTCTTGGAAGCAATGTTGCTGGTATTCTTTCCTT
ACGGCTTCAAAAGCTTGATGTCCGTTGTGAAACAAAACCAAGGATAATGTTTTTGTGACAATAGTTGCTTCTGTACAA
TATCGGGCTGTGATAGACCACGCCGATGATGCTTTCTACAAGTTGTCGAACCCCGCGAGCAAATTCAGGCATATGTCT
TTGATGTGATTAGAGCAAGTGTGCCAAAGATGAATCTTGATGATGTATTTGAACAAAAGACTGAAGTAGCCAAAAGTGT
TGCAGATGAACTAGAGAAAGCAATGTCAACGTATGGATATGAAATTGTCCAAACATTGATTGTTGACATAGATCCCGAT
GAAACTGTAAAGCGAGCTATGAATGAAATCAATGCAGCTGCAAGGCTTAGAGTAGCGACGCTAGACA

> SEQ ID NO: 5292 104067 1101449_301476_1b
ATCAGCTTTTTGAGACCTTGGAGTAGAGTACACAATGGGTCAAGCTCTTTGCTGTGTGCAAATTGACCAGTCTACTGTG
GGTATCCGAGAAAGGTGGGGGAAATATATAGAATTACTCCATCCTGGATGCCATTGTGTTATGTGGTGTCTTGGAAGCA
ATGTTGCTGGTATTCTTTCCTTACGGCTTCAAAAGCTTGATGTCCGTTGTGAAACAAAACCAAGGATAATGTTTTTGT
GACAATAGTTGCTTCTGTACAATATCGGGCTGTGATAGACCACGCCGATGATGCTTTCTACAAGTTGTCGAACCCCGC
GAGCAAATTCAGGCATATGTCTTTGATGTGATTAGAGCAAGTGTGCCAAAGATGAATCTTGATGATGTATTTGAACAAA
AGACTGAAGTAGCCAAAAGTGTTGCAGATGAACTAGAGAAAGCAATGTCAACGTATGGATATGAAATTGTCCAAACATT
GATTGTTGACATAGATCCCGATGAAACTGTAAAGCGAGCTATGAATGAAATCAATGCAGCTGCAAGGCTTAGAGTAGCG
ACGCTAGACAAAGCAGAAGCTGAGAAATTACT

> SEQ ID NO: 5293 104067 146260_301064_1b
AGTTAATATGGGAAATTTGTTCTGTTGTGTTCAAGTTGATCAATCCACAGTTGCAATTAAGGAGCAATTTGGCAAGTAT
CAGGATGTGCTTGAGCCAGGTTGCCACTGTGTGCCTTGGTTCCTTGGAAGCCAGTTGGCTGGTCATCTCTCCCTCAGGG
TGCAGCAACTAGATGTGCGCTGCGAAACCAAGACAAAGGACAATGTATTTGTCAATGTTGTCGCATCAATTCAGTATCG
TGCCCTGGCGGACAAAGCAAATGATGCTTTCTACAAACTAAGTAACACTAAGGGTCAAATTCAGGCTTATGTTTTTGAT
GTCATAAGAGCAAGTGTTCCAAAACTCAATCTGGATAATGTCTTTGAGCAAAAAATGAAATTGCTAAGGCTGTTGAAG
AGGAACTTGAGAAAGCTATGTCAGCTTATGGATATGAAATTGTTCAGACACTTATAGTTGATATAGTACCAGATGAGCA
TGTGAAGAGGGCTATGAATGAAATCAACGCTGCTGCTAGGTTGAGGGTGGCTGCTAATGAGAAGGCAGAAGCTGAGAAG
ATTTTGCAAATTAAGAGGGCTGAAGGGGAGGCCGAGTCTAAGTATCTCGCAGGCTTAGGTATTGCACGACAACGTCAAG
CAATTGTGGATGGTCTGAGAGACAGTGTGCTAGGATTTTCAGTCAATGTGCCTGGAACTAGTGCAAAGGATGTTATGGA
CATGGTCCTCGTAACCCAGTACTTTGACACAATGAA

> SEQ ID NO: 5294 104081 103523_300363_1b

FIG. 2 continued

```
TGGTATGAACGCAGAGTGGCCATTACGGCCGGGGGAAAGAGAGATACAAAGTCGCCGTTGGTGTTGCTGAGGCATTAGA
ATATCTTCACAGCAGAGATGCTCAACCAGTGATCCACCGTGATGTAAAATCGTCAAATATACTACTCTCTGATGATTTT
GAGCCGCAGCTCTCTGACTTTGGACTTGCTAAATGGGCAACAACCACCTCATCTCATATTACATGCACTGATGTAGCTG
GAACTTTCGGTTACTTGGCTCCCGAATATTTCATGTATGGAAAGGTTAATGACAAGATTGATGTCTATGCATTTGGAGT
AGTACTTCTTGAGCTTCTTTCAGGAAGAAAGCCGATAAGTAACAATTGCCCGAAGGGTCAAGAGAGCCTGGTTATTTGG
GCAAAGCCAATTCTGACTTGTGGGAAGTATACCCAATTACTAGACCCACAGTTGAGTTCTGACTATGATCATGAACAAG
TAGAAAGCATGGTGCTAGCTGCTGCCCTTTGTATCAGACGTGCTCCACGAGCTCGACCACAAATGAGCATTGTTTCGAA
GCTGCTCAAAGGTGATGCTGAAACAACCAAGTGGGCAAGGTTACAAGTCAAT

> SEQ ID NO: 5295  104081  116649_300079_1b
CCCACGCGTCCGTGAAGATCGCTCTCGGTGCTGCTAAAGGGGTAGCCTTTCTCCATGGAGGTCCCAAACCAGTAATTTA
CAGGGATTTTAAGACATCAAATATTCTTCTTGATGCGGAGTACAATGCAAAACTTTCAGATTTTGGGTTAGCGAAAGCT
GGTCCTCAAGGCGATAAAACTCATGTCTCTACACGGGTTGTCGGTACCTATGGTTATGCTGCACCCGAGTATGTAATGA
CAGGACACTTGACATCCAAGAGCGATGTATATAGCTTCGGAGTAGTGTTACTCGAGATGTTAACCGGTAGACGATCAAT
GGACAAGAAGCAGCCTACTGGGGAGCAGAACCTAGTGGCATGGGCGAGGCCGTATCTAAGTGATCGGCGAAGGCTCTAC
CAGCTCGTAGATCCTCGCTTGGGGCTGAACTATTCAGTAAGAGGGGTGCAGAAGGTTGCTCAGATCTGCTACCACTGCC
TCAGCCGTGACACCAAGTCTCGTCCGACAATGGATGAAGTTGTCAAGCACCTGACGCCGTTGCAGGACCTAAATGACAT
GGCGTCTGCATCATATAGACCTCGATCATCTCAGCGTGGAAAGGCACGTCGGTGATGGCCGGATCCACTGCTAAAAAGC
AGCGAAATTTGATGATTTTTAAGGTCATTTCCGGGTGCTTTGTTTTGGTTTTAATTGTATAGTGAAACTAGGCTTGATA
ATCCTCAAATCCCTGGAGATGTGACGCCCCTGATGTCTAATCT

> SEQ ID NO: 5296  104081  131219_300512_1b
GAATTCAGGCTATCACAAAGTTCATGTCAAATTGAACAAGAGTTCAGGAATGAAGTTATCTTAGTAGCTAAACTTCAAC
ACAGAAATCTTGTAAGGCTTCTTGGCTTTTGTCTAGCTGGTGAAGAAAAATTACTTATCTACGAATTTATGCCAAATGC
AAGCCCTTGATCAGTTCATATTCGATCCAATTAAACGCACATATCTGAATTGGGAAAGACGGTACAAGATAATAGAAGGA
ATAGCAAAAGGCCTCCTCTATCTTCATGAAGAGTCGCACCTTAAAATTATCCATCGAGATCTCAAAGCTGGTAATATAT
TACTCGACATCGACATGAATCCAAAAATTGCAGATTTTGGCACGGCTAGGCTTTTTGTGCTTGATCAAACTCACGCTAG
TACAAAAAGAGTTGTGGGAACACATGGCTACATGGCCCCAGAGTATATATTACATGGGCATTTCTCCGAGAAATCAGAC
GTCTATAGTTTTGGTGTCTTAATTTTAGAGATCCTCAGTGGACAGAAGATTAGCAATTTTCAGAATTCAGAAATGGCTC
GGGACCTTCTCAGCTATGCATGGAGACATTGGAAGAATGGATCTGCTTTAGAGTTGTTAGATCCAGTCGTGAAGGACGC
ATGTTCAGGAAATGACGCGATGAGATGCAT

> SEQ ID NO: 5297  104081  11543_300292_1b
TGGTATCAACGCAGAGTGGCCATTACGCCGGGGGAAAGACAGATACAAAGTCGCCGTTGGTGTTGCTGAGGCATTAGAA
TATCTTCACAGCAGAGATGCTCAACCAGTGATCCACCGTGATGTAAAATCGTCAAATATACTACTCTCTGATGATTTG
AGCCGCAGCTCTCTGACTTTGGACTTGCTAAATGGGCAACAACCACCTCATCTCATATTACATGCACTGATGTAGCTGG
AACTTTCGGTTACTTGGCTCCCGAATATTTCATGTATGGAAAGGTTAATGACAAGATTGATGTCTATGCATTTGGAGTA
GTACTTCTTGAGCTTCTTTC

> SEQ ID NO: 5298  104081  113132_300022_1b
TAGTGGAGGTGCTTATGCTTAGTCTTCTTCATCATCCTAGCTTGGTGAACTTAATTGGTTATTGTGCTGACGGGGACCA
GAGGCTTCTTGTCTACGAGTTCATGCCTTTGGGATCACTAGAGGATCATCTTCATGATCTCCCTCCTGATAAATAACCA
GTAGATTGGAACACGAGAATGAAGATAGCAGCTGGTGCAGCAAAAGGTTTGGAGTACCTTCATGATAAGGCAAACCCTC
CTGTTATTTATAGGGACTTCAAGTCATCCAACATATTGCTCGAGGAAAATTTTTTCCCGAAGCTTTCAGATTTTGGGCT
TGCTAAACTTGGTCCTACTGGAGACAAGTCACATGTGTCCACAAGGGTCATGGGAACTTATGGTTACTGTGCCCCTGAG
TATGCCATGACTGGACAATTGACTGTAAAATCTGATGTCTATAGTTTTGGGGTTGTCTTCTTGGAGCTTATCACTGGGC
GTAAGGCTATTGACAGCACCATGCCTCAGGGAGAGCAAAACCTTGTCGCATGGGCTAGGCCACTGTTTAATGATCGTAG
GAAGTTTGCAAAATTAGCAGATCCAAGGCTGCAAGGACAATTTCAATGAGAGGTCTATACCAGGCTTTAGCTGTGGCG
TCCATGTGTATCCAAGAACAGGCTGCTGCTCGTC

> SEQ ID NO: 5299  104081  245049_301564_1b
GCTCATTGCATGACATACTTCATGGGAGGAAAGGTGTGAAAGGTGCTTTGCCCGGTCCTGTGCTGGATTGGGCCCAACG
CGTGAAGATCGCGGTAGGGGCTGCGAAAGGACTGGAGTATTTGCATGAAAAGGTCTCTCCACCACTTATTCACCGCGAC
ATCAAATCCAGCAACGTCCTGCTCTTTGACGACTACACGGCCAAGATAGCAGACTTCAATCTCTCAAATCAAGCTCCAG
ACATGGCAGCACGGCTCCACTCGACTCGTGTGCTTGGAACCTTCGGGTACCATGCTCCAGAATATGCTATGACGGGTCA
GCTCACACAGAAGAGTGATGTGTATAGCTTCGGCGTCGTCTTGCTGGAGCTGCTTACTGGAAGAAAGCCAGTGGATCAT
TCAATGCCTCGTGGACAGC
```

FIG. 2 continued

> SEQ ID NO: 5300 104081 197849_300701_1b
GAATCCAGCAACATTATGCTCTTTGACAACGATGTTGCGAAAGTAGGAGACTTCGATGTATCCAATCAGTCCCCGGACA
TGGCGGCTCGCCTCCACTCCACTCGTGTTCTTGGCACCTTCGGTTATCATGCTCCTGAGTACGCGATGACAGGGCAGCT
TAGCACGAAGAGCGATGTCTATAGCTTCGGAGTCGTGTTGCTGGAGCTTTTAACAGGTCGCAAACCGGTCGATCATACG
CTGCCCCGTGGCCAGCAGAGTCTTGTGACATGGGCTACTCCAAGGCTAAGTGAAGACAAGGTGAAGCAATGCGTGGATC
CAAGGCTTGAAGGGGATTATCCTCCCAAGGCTGTTGCCAAGATGGCTGCCGTAGCTGCGCTGTGCGTGCAGTACGAGGC
GGACTTCAGGCCCAACATGAGCATCGTCGTCAAGGCTCTGAACCCACTCCTCAACAAGCCGCCCGAACAATCGCCCCGC
CTCCTTCACCGACGCCGGCGAGCGATCCGGAT

> SEQ ID NO: 5301 104081 182753_300663_1b
GAATTCAGGCTCTGACGGACAGGAAATAGCCGTGAAGAGGCTATCGAGAAATTCAGGTCAAGGTGCACAAGAGTTCAAA
AATGAAGTTACCTTAGTAGCTAAACTTCAGCACCGAAATCTTGTGCGACTTCTAGGCTTCTGTATAGATGGTGAAGAAA
AATTACTCGTCTATGAATTCATGCCAAATGGAAGCCTTGACCAACTCCTATTCGATCCAAATAAGTGTACACATCTGGA
CTGGGAAAGACGATACAAGATAATAGGAGGGATAGCAAGAGGGCTTCTCTATCTTCACGAGGAGTCTCGACTAAAAATT
ATCCACCGAGATCTCAAAGCTAGCAATATTTTATTAGACACAGATATGAATCCTAAAATTGGAGATTTCGGCATGGCTA
GGCTTTTTGTGGTTGACCAAACACAAGCTAATACAAACAGAGTTGTTGGAACTTATGGCTACATGGCTCCAGAGTATGC
AATGCATGGACAATTCTCTGTGAAATCAGACGTATTTAGTTTCGGTGTTTTAGTTATAGAGATTCTCAGTGGACAGAAA
AACAATTG

> SEQ ID NO: 5302 104081 270332_200125_1b
TACTCTTCAAAGGATATCATCAAAAAGCTGGAGACTCTGAACGGGGAACACATAATTGGTTCTGGGGGATTTGGAACTG
TATACAAGCTTGCAATGGATGACGGCAATGTATTTGCCTTGAAGAGAATTATCAAGATGAATGAAGGTTTTGTTTGGTT
CTTCGAGAGGGAGCTTGAAATTCTTGGAAGCATTAAGCACCGATATCTGGTAAATCTGCGAGGATATTGCAATTCTCCA
ACGTCGAAGTTGTTGATATATGACTTCTTATCCGGAGGTAGCCTAGATGAAGTTCTGCACGAGAGATCTGAGCAACTAG
ACTGGGGTGCACGGCTGACTGTAATCATGGGAGCTGCGAAAGGGTTGGCATATTTACATCATGATTGTTCCCCTCGAGT
AATCCACCGTGACATAAAGGCTAGCAACATTTTGCTTGATGGCAATTTTGAGGCTCGAGTATCTGATTTTGGACTGGCC
AAATTACTCGGAGATGAGGAGTCTCACATCACAACAATTGTAGCTGGCACATTTGGGTATTTAGCTCCAGAGTACATGC
AGAGTGGTAGGGCTACAGAAAAGACTGATGTTTACAGTTTTGGAGTTCTGGTTCTTGAAGTCATAAGTGGAAAGAGGCC
AACTGATGCATCATATA

> SEQ ID NO: 5303 104081 272322_200043_1b
TAGGTTTACGTTATCTTCACAAAGAATGCAGAGTGGGCTGCATTGTCCACCGAGATATGAGACCCAACAACATTCTCAT
CACCCATGACTTCGAACCACTAGTTGGAGACTTTGGTTTAGCTAGGTGGCAACCTGATGGTAACACAGGTGTTGAGACG
AGAGTAATTGGAACATTTGGGTACTTGGCGCCGGAGTATGCTCAAAGTGGCCAGATTACAGAAAAGCTGATGTTTACT
CATTTGGAGTGGTACTGGTGGAGCTTGTTACAGGACGCAAGGCAGTGGATCTTACAAGGCCTAAAGGCCAGCAGTGTCT
CACAGAATGGGCTCGTCCATTATTGGAAGAATGTGCAGTTGATGAGCTAATTGACCCCCGGCTGGAGAACTGCTATTCC
GAACATGAAATATACTGCATGTTGCATGCGGCGTCTTTGTGCATACGACGGGATCCTCAGGCCAGGCCTCGCATGTCTC
AGGTACTGCGGATACTTGAAGGCGACCTCATCGTGGAATCTGGTAAACTGTCAGCAACACCTGCTTATGATTTGGAAGC
CAAAGCGGAAGAATTTTGTCAGATTCGCTGCAACAGT

> SEQ ID NO: 5304 104254 27819_300076_1b
CTTCATCAAATCTCACAAATCTTCAACACTTAATCACAAATCTCAAAGCTTCGGATACCAAATGGCTCGTACCAAGCAA
ACCGCAAGGAAATCCACCGGAGGAAAAGCCCCAAGGAAACAACTCGCAACAAAGGCGGCGAGGAAATCAGCTCCGGCGA
CCGGAGGAGTAAAGAAGCCACACAGATTCCGTCCTGGAACTGTTGCCCTAAGAGAAATCAGGAAGTATCAGAAGAGCAC
TGAGCTTCTGATCCGCAAGCTTCCGTTCCAGCGTTTGGTTCGTGAGATCGCTCAGGATTTCAAAACAGATCTGCGTTTC
CAGAGCAGCGCCGTCGCAGACTTCAGGAAGCGGCTGAAGCATACCTCGTTGGATTGTTTGAAGACACCAATCTTTGCG
CGATTCATGCTAAGAGAGTCACTATCATGCCTAAGGATATTCAATTGGCGAGGAGAATTAGAGGCGAGAGGGCTTAAGA
AGGAGATTGAAGTACTCTAGACTGTGATCGTTATGCTTATGTATATCTTTCGTTTTCCCTAATTTCGTGTTTTAGGGTT
GGATTAGGTTTTGCGTTTATGTTGTTCGATATCTAACGGATCAAAATCTCTCCTTCCTTAGCAAAGTTTGAAAACTCCC
TCCACATTTTCAAAAAAAAAAC

> SEQ ID NO: 5305 104254 317134_301452_1b
TGCTTTTGGCCACAGACCTACTCACGATTGGCAGTTGATCACAAGCCTCTTCCGCAATGGAGCATGGCATTCCACAACT
GTGTCCAACGATTCCATTCAGGGCGCATTTTTGCGGTTCCAATAGATACTTCTTGTAAAGTTCCAATCTCTTATTTCTT
GTTTCAGAATATACATGCTTTCGCTCACATCTCTTACCACAGTAAGTACTTGTAGTTAAGGTACCACAACACACACAAG
AGAAAGTAGCCATTCTAGACCTAGGACCAGGGTTAGATTCCACGTCACCCGCCAACTTCAGCAAATCAAAATTCAACAG
CTGTTTGTAGAGCTCGGCATAATCCGGAACATCATACGGATAAGCGGCCGCACCGCGCTCACCACGGAGGCGGCGGGCC
AGCTGGATGTCCTTGGACTGGATGGTGACACGCTTGGCGTGGATGGCGCAAAGGTTGGTGTCCTCGAAGAGGGAGACGA

FIG. 2 continued

```
GGTAGGCCTCAACGGACTCCTGGAGAGCGCCGATGGCAGAGGACTGGAAGCGGAGATCCGACTTGAAGTCCTGAGCGAT
CTCACGGACAAGACGCTGGAAGGGCAGCTTGCGGATGAGAAGCTCGGTAGACTTCTGGTAACGACGGATCTCACGGAGA
GCGACGGTACCAGGCTTGTACCTGTGGGGCTTCTTGACACCGCCGGTTGAGGGGGCGGACTTGCGAGCAGCCTTGGAGG
CGAGCTGCTTACGGGGAGCCTTGCCACCAGTGGACTTACGGGCGGTCTGCTTAGTGCGAGCCATGCTTAATTAATGCGA
AGGTAAATACAGTAGATTTAAACATCAGGACCTAGAGTTCACCACTCGAAGTCTTTTCTCAGCTTCTTATCCACAAATT
TCCCTTCACAATTAAACAGCAACTTAAACTTATTAAAGTCAAAGATATGATAACATAAGAAACCAAAGCAGAAATAGC
ACTATAAGGGGATCGATATCTATCCACTAAAGCCTTATCCAAAGCATCAAGCACCTTAAAGTCTTTGTAAGATTTGTAA
TTGTCATTGATAGAGATATAAATCTCACTCAAAACTTCTACATCTCTCACATCAGTTCTACCTAATTTTGTGATAAAT

> SEQ ID NO: 5306 104254 206088_300804_1b
AGCCCCACCAAGTCTTTTTTCAAGCATCTTCACAGTCAACACATCACAACAACTCATCATGGCCCGCACCAAGCAGACC
GCCCGTAAGTCCACTGGTGGCAAGGCTCCCCGCAAGCAGCTCGCTTCCAAGGCTGCCCGCAAGAGCGCTCCCTCCACCG
GAGGTGTCAAGAAGCCTCACCGTTATAAGCCTGGTACCGTCGCTCTCCGTGAGATTCGACGATACCAGAAGTCGACTGA
GCTCCTGATCCGCAAGCTCCCCTTCCAGCGTCTGGTCCGTGAAATCGCTCAGGACTTCAAGAGCGATCTCCGCTTCCAG
TCTTCTGCCATCGGCGCCCTCCAGGAGTCCGTCGAGTCTTACCTCGTCTCCCTCTTCGAGGACACCAACCTTTGCGCCA
TCCACGCAAAGCGTGTCACCATCCAGAGCAAGGACATCCAGCTCGCCCGCCGCCTCCGTGGTGAGCGCAACTAAGTTGG
AGAGACTTTGGGAGGAACGTTGCAGACATGACTTTTGCTTTTCACACGAGTGTTTCTGGGGTCAAGGGATAATCAGGCG
TTACAAATGAGAGTTTTTATTCCCCTTTATGGTTCGGAATGTATATTACCAGTGCGTCAGGGAAAAAGCACTGCATAAA
TGCAAACGAGGTTCACGGCCTCACGGGTTAACGAACTATAATAACTGCATCACTCTAAAAAAA

> SEQ ID NO: 5307 104254 235726_301229_1b
GAGGGGAAAGATTTCGTCGCGCTAGGGTTTTCTGATTCGTCGTCCATGGCGCGTACTAAGCAGACTGCTCGCAAATCCA
CGGGAGGCAAGGCGCCCAGGAAGCAGCTCGCGACCAAGTGAAATCCGCAAGTACCAGAAGAGTACCGAGCTGCTCATCC
GCAAGCTGCCCTTCCAGAGGCTTGTGCGTGAGATTGCTCAGGACTTCAAGACGGATCTGAGGTTCCAGAGCCACGCGGT
ACTGGCGCTGCAGGAGGCGGCGGAGGCATACCTGGTGGGTCTTTTCGAGGACACGAACTTGTGCGCGATCCATGCCAAG
CGGGTGACCATCATGCCCAAGGACATCCAGCTGGCTCGCCGCATTCGTGGAGAGAGGGCGTAAGCCACAGGGTGCTATT
CATGACCCGTTCGCTACTACTGATGAAGGACATCGAAAAGTCTTAGAAGGATCACTTTGTTTTGTAATATACTATTAGA
ACAGCAATTCAAGTTGCTTTTGCTGTGATTTAGTCAAATAAATTTCGTGGTGTATGATAATAGAGCGCATTAGCTCAAA
TCGTTATATTTGTCACACTACTTAATCACCAAAAAAA

> SEQ ID NO: 5308 104254 245410_301568_1b
ACAACAACAACCATCTCCATCACCCACCACAACTACTTCTCCATCTACCAACAACATGGCCCGCACTAAGCAGACCGCC
CGCAAGTCCACTGGTGGCAAAGCCCCCCGCAAGCAGCTCGCATCCAAGGCAGCTCGTAAGAGTGCGCCATCTACCGGTG
GTGTCAAGAAGCCTCACCGCTACAAGCCCGGAACCGTCGCTCTCCGTGAGATCCGTCGCTACCAGAAGTCGACTGAGCT
CCTCATCCGCAAGCTGCCCTTCCAGCGCCTTGTCCGTGAGATTGCCCAGGACTTCAAGTCCGATCTCCGCTTCCAGTCC
TCTGCCATCGGTGCTCTCCAGGAGTCCGTTGAGGCCTACCTCGTCTCCCTCTTCGAGGACACCAACCTCTGCGCCATCC
ACGCCAAGCGTGTCACCATCCAGAGCAAGGACATCCAGCTCGCCCGCCGCCTCCGTGGTGAGCGTGGTTAAGTTTCTCA
ACAACACATCGACACGACATGACAACTTCTTCGGGTCAGTGATTGGATTGGGTCTTTAGTGGTTAGGATATCAAGGCGT
CTATAGGGTTTCATGGTTCACGGTCTTCAACTCGGTTTATGAGTGCACACGAGCGGTGCTGAGCATGTAGTATATCCAG
GTTAATCAGTGATGGTCACTGGCGATATTATCTCGAAATCAACAGATTTCTACTTC

> SEQ ID NO: 5309 104254 256059_301646_1b
ACGCGTCGCAAGTAGTAGGCTGCAATGGCTGCACAAGCAAACTGCTCGGAAATCGACAGGAGGGAAGGCTCCTCGCA
AGCAGTTGGCCACCAAGGCGGCTCGCAAGAGCGCCCCCTGCTACAGGTGGAGTGAAGAAGCCTCACAGGTTCAGGCCTGG
AACTGTCGCCCTTCGTGAGATTCGAAAGTACCAGAAGAGCACTGATCTCCTCATTAGAAAACTCCCATTCCAACGCTTG
GTCCGTGAAATCGCCCAAGACTTTAAAACCGACCTCAGATTCCAAAGCTCTGCTGTCTTGGCCCTCCAAGAGGCTGCTG
AAGCCTACCTCGTCGGCCTCTTTGAAGCACACAAACCTGTGTGCAATCCATGCCAAAAGGGTCACCATTATGCCTAAGGA
TATCCAGCTCGCTAGGCGTATCAGAGGGAGCGTGCTTAAACAGTTTCCCCCCCTCAGGTCCCTCTCTTTAAACGTTGT
ATACATACACCACTTTCAGTTTCGAAAAAAAAAAACAAA

> SEQ ID NO: 5310 104254 1108029_301546_1b
AATTCCTCCTGCACTTCGACGACTCTTCTGATTTCCTGCGATGGCTCGTACCAAGCAGACAGCTCGTAAGTCTACTGGT
GGAAAGGCACCCAGGAAGCAGCTTGCTACTAAGGCTGCAAGGAAATCTGCTCCCACTACTGGCGGAGTAAAGAAGCCCC
ACAGATACAGGCCTGGAACTGTTGCTCTTAGAGAGATCCGCAAGTACCAGAAAAGCACAGAGTTGCTGATTAGGAAGCT
TCCTTTCCAGAGGCTTGTTCGTGAGATTGCCCAAGATTTTAAGACTGATTTGCGGTTTCAAAGCCATGCTGTGCTGGCA
TTGCAAGAGGCAGCAGAGGCATACCTGGTTGGACTCTTTGAGGACACCAACCTCTGTGCCATCCATGCGAAGAGGGTCA
CCATTATGCCTAAAGATATCCAGCTTGCCAGGAGGATCCGTGGGGAGAGAGCTTAACCCGTCTTCCTTATCTTTTGCTG
AAAGAACTGTAGTTATTTTAGTTATTTAATTGTTGTCATCTTGTCTTGTGCTCGAAGTAACTGCCTTGTTACTTCGCTG
```

FIG. 2 continued

TTGGGCTCGTTCCCAAGAAACTTGTGGTCTTATTGGCCAATTGTACTAGCTTAATATACACTGCTTGTTTTCGAAAA

> SEQ ID NO: 5311 104254 111226_300053_1b
ATAAAGTTCCTCTTCTCCTTCTGTAGTTTCCTCTCTAATTTCAAGGTTTCCTCACACCCTTCAAACTCGAGCAATCTTA
AGGAACTCAGATGGCTCGTACGAAGCAAACGGCTCGTAAATCTACTGGAGGCAAGGCTCCAAGGAAGCAACTTGCAACA
AAGGCTGCCCGTAAGTCTGCCCCAACAACAGGAGGAGTTAAGAAGCCTCACAGATACAGACCTGGAACCGTTGCTCTTC
GTGAAATTCGCAAGTACCAGAAGAGTACTGAGCTGTTGATCAGGAAATTGCCATTCCAAAGGCTTGTTCGTGAAATTGC
ACAGGACTTCAAGACTGATTTGCGTTTCCAGAGTCACGCTGTATTGGCTTTGCAAGAAGCAGCTGAGGCCTACCTTGTT
GGATTGTTTGAGGACACAAATCTGTGCGCCATTCACGCCAAGCGTGTCACTATCATGCCCAAGGATATCCAGTTGGCCC
GAAGAATTAGGGGAGAAAGAGCTTAGAATGATCTGTTCTGCCGTATCGTGCTTAGATTGTTGATTTTTTTTTGAATTG
CCGTCTTTCTGCATTTTTCTTCTTTGTTCTTCATATAGGTAGTTTTACTAGATATGAATGGCTGTGGCATACTGG
AAATTTGATACTCTCTATTATATAGTCGAATTTTATTGGAACTCTTTTTTACATTTGAAGGGAAGAAAATTAATTTCAT
ATGCTTTTATTAAAAAAAAAAAACATGTCGGCCGCCTTGGCC

> SEQ ID NO: 5312 104254 144294_200133_1b
CCCACGCGTCCGCAAACACTCATATATTCTTTCATCCAAATCCTTTGAGCCCTAATTCCCAAATGGCTCGTACAAAGCA
AACTGCCCGAAAATCCACCGGAGGGAAAGCTCCGAGAAAGCAATTAGCCACAAAAGCTGCCAGAAAGTCAGCTCCGGCC
ACCGGGGGAGTGAAGAAGCCTCACAGATTCAGGCCAGGGACTGTTGCGCTTCGTGAAATCCGCAAGTACCAGAAATCAA
CTGAGCTTTTGATCCGTAAGCTCCCGTTCCAGCGTTTGGTTCGGGAGATAGCTCAGGACTTCAAGACCGATCTCCGTTT
CCAGAGTTCGGCTGTGGCTGCGCTCCAGGAAGCTGCTGAGGCTTATCTCGTCGGTTTGTTTGAGGACACAAACTTGTGT
GCTATTCATGCTAAGAGGGTTACTATTATGCCTAAGGATATTCAGCTTGCTAGGAGAATTAGGGGTGAGAGGGCATAAG
TGTGAACCTACGGTAGCTATGGGAGCTTGTAACTGAGCATATGGTAGATGAGTTTCTAGGCTTTTACTGTATTTTGGTC
CAAAATTTTCTCAATTCTGGATATGTAGTCGTATTAAAAGTATTTTAATGAAATATCAGTTCTTCTTTGC

> SEQ ID NO: 5313 104254 128740_300477_1b
ATTCGCTACACAAAAGCAGATAGAAGAAAGAAGAAGGAGAAAAGAAAAAA

> SEQ ID NO: 5314 104254 127891_300473_1b
AACACATTCTCTCTCTCTAGAAACTGTACTCTTTCTTTCTCTAGAAGATCTGAAGCAATGGCAAGAACAAAGCAAACAG
CCCGAAAATCCACAGGAGGAAAGGCACCAAGGAAGCAATTAGCCACAAAAGCCGCAAGGAAATCAGCACCAGCAACAGG
AGGAGTGAAGAAGCCTCACCGTTTCCGCCCTGGTACAGTGGCTCTTCGTGAGATCCGAAAGTACCAGAAGAGCACTGAG
CTTTTAATCCGAAAATTACCTTTTCAAAGACTGGTCAGAGAAATTGCACAGGATTTCAAGACGGATCTTAGGTTCCAGA
GCAGTGCTGTAGCTGCACTACAAGAAGCTGCTGAGGCTTACTTGGTGGGTCTCTTTGAGGATACAAATCTGTGTGCTAT
TCACGCTAAAAGGGTGACTATTATGCCTAAGGATATTCAGTTGGCTAGGCGTATTAGGGGTGAAAGGGCTTAATGTTTC
ATTGTTGTGTTTTTTGTGTTTAGGGTTATGGTGAATGTGGTATGTAACGGTGTTTAGTTGTTTTTTGCTTGAAATGTAA
TGATAACTTTTGTTAATGAAAGTCCAAGTTCCTC

> SEQ ID NO: 5315 104254 127804_300473_1b
CGCTCCACAAAAGCAGAGAGCAGAGAGCAGAGAGAAGAAAGAAGAAGAAGGAGAACAAGAAAAAAGAGAAGATGGCTCG
TACCAAGCAAACTGCTCGTAAGTCTACTGGAGGAAAGGCACCTAGGAAGCAACTTGCTACTAAGGCTGCTCGTAAGTCT
GCTCCTACTACTGGTGGAGTAAAGAAACCTCACAGATACCGCCCTGGTACTGTTGCTCTTCGTGAAATCCGTAAGTACC
AGAAGAGTACTGAGCTCCTGATCAGGAAGCTCCCATTCCAGAGGCTTGTTCGTGAAATTGCTCAGGATTTCAAGACTGA
TCTGCGTTTCCAGAGTCATGCTGTGTTGGCTCTGCAGGAGGCTGCTGAGGCTTACTTGGTTGGTCTCTTTGAGGACACA
AATCTTTGTGCCATTCATGCCAAGCGTGTCACTATCATGCCCAAAGGACATTCAGCTCGCTAGGCGTATCAGGGGCGAGC
GTGCTTAATTTGATCAAGTGTGGTAGCTTTGTTGGTGCTTTAGATCCTTTTCTTAAAAGACTGATGTATTAAAAAATA
GTGGTAGGAACGATGTTCTATGTTGATCTTATTTTGTGGTGGATGGAGGTGTGCTGTAATTGTTGTTCTGTTTGGGGAA
GTGGCAGAAACATAGTACTTGTTGAATCTTTCTAATGTTTTATTGTCACACCACTGGTGTTGAACAAGTTTCAGAATTTG
CATCTAATGTTTAGTTCAACTGTTTGG

> SEQ ID NO: 5316 104254 126252_300461_1b
GCCATTACGGCCGGGGAACCAAAGCAATTTCCAATCTACAAAACTCTTTCTTATGGCTCGTACCAAGCAAACTGCTCGC
AAATCAACAGGTGGAAAGGCTCCAAGGAAGCAGCTAGCAACCAAGGCTGCAAGAAAGTCAGCTCCGGCCGACCGGAGGAG
TGAAGAAGCCTCACCGTTTCCGTCCAGGAACTGTGGCTCTCAGGGAAATCAGGAAGTACCAGAAGTCTACTGAGTTGTT
GATAAGGAAGCTGCCATTTCAGAGGCTGGTGAGGGAGATAGCTCAGGATTTCAAGACAGATCTGAGGTTCCAGAGCAGT
GCTGTTGCTGCTCTTCAAGAGGCAGCTGAAGCTTACCTAGTTGGACTCTTTGAAGACACCAATCTCTGTGCCATTCACG
CGAAGAGGGTCACCATAATGCCTAAGGACATTCAGTTGGCCAGGAGGATTCGTGGAGAAGGGCTTAGGACGATAATTT
CTTATGGTTATGGTTATGGTTAATGTCCTGTTCTCTGTATTAGAGTTTTGTTTGCATCTTTTGTTAAATGTCAGGGTTA
GTGATGTAAATAAAATGGCTGGTTTTGATCAAAGTACATGTAACACCTCTGGTTTACTAGTATTTGATTAATGAAATCT

FIG. 2 continued

GTAGTTCATTTTGTTTCAAAAAAA

> SEQ ID NO: 5317 104254 1170870_302038_1b
TGTTTGCGGAGTTCTTCTCTTCTTCCCGCCCTTTCGTATTTCTCTGTCTGGTTAAAAGATGGCTCGTACTAAGCAGACC
GCCCGTAAATCCACCGGAGGGAAGGCCCCTAGGAAGCAGCTTGCCACAAAGGCTGCAAGGAAGTCTGCCCCTACCACAG
GTGGAGTTAAGAAGCCTCACCGATACAGGCCTGGAACTGTTGCTCTGCGTGAGATCCGTAAGTACCAGAAGAGTACTGA
GCTTTTGATAAGGAAGTTGCCATTTCAGAGGCTTGTTCGGGAGATTGCACAGGATTTCAAGACTGATCTAAGGTTTCAG
AGCCATGCTGTCTTGGCTCTGCAAGAGGCTGCTGAGGCCTACCTTGTTGGCCTGTTTGAGGATACCAATCTCTGTGCTA
TCCATGCCAAGAGGGTACAATTATGCCCAAGGACATCCAACTTGCGAGGAGGATCCGAGGGGAGAGGGCTTGATTTCT
TCTTTTGCTCCTCTTTAAACTAATATGACCTTCATTCGAACACTTCTTTTGTTTTGAATCTGAAAGCTCTAGCAATAGA
CGCTAATTGCACCCTTTTAACAATGTATTGCTTCAAATGCCTATAATAGACCTATGTTGCCCTTTTGTGTTCTGTAAAT
AATTGGCAGCTTGATTCAAATGTGGGATGATTTTTTCTGACTAGTAACCTTACATTTTGGGTTTCCTCA

> SEQ ID NO: 5318 104254 111648_300023_1b
TACAATCAGAGCATTTCTCAATCTACAAAATGGCCCGTACTAAGCAAACAGCTCGCAAATCAACAGGTGGTAAGGCTCC
AAGGAAGCAGTTAGCTACCAAGGCTGCGAGAAAGTCAGCTCCGGCGACCGGAGGAGTGAAGAAGCCTCACCGTTTCCGT
CCTGGAACTGTGGCTTTAAGGGAAATCAGGAAGTACCAGAAATCAACAGAGTTGTTGATAAGGAAGCTGCCATTTCAGA
GGCTGGTGAGGGAAATAGCACAGGATTTCAAGACAGATCTGAGGTTCCAAAGCAGTGCTGTTGCTGCCCTACAAGAGGC
TGCAGAGGCTTACCTTGTTGGCCTCTTTGAAGATACAAATCTCTGTGCCATTCACGCCAAGAGGGTCACTATCATGCCA
AAGGACATTCAGCTTGCTAGGAGGATTCGCGGCGAAAGGGCTTAGAATGAAGCTTGTTATGCTTATGGTTATGGTTAAT
TCGTGTTCTCTGATCTAGGGCATTGTTTTGTGTGTTTTGCTGAATGTTAGGGTTAGTGATGTAAATCAAGCGACTTG
TTCCAATCAAATCAAATATATGTAAAACCTCTGGTTTATTAGTATTTTGAAATCTTATGAATGAAATTTGTACTCAT
TTTGCCG

> SEQ ID NO: 5319 104254 155514_301357_1b
AAAAGGTTCCTCTTCTACTTTTGCAGTTTCCTCTCTAATTTCAAGCCATCCTCATCAGCCTTCAAAATCAAGCAATCCT
AAGGAAATCAGATGGCTCGTACGAAACAAACTGCCCGTAAATCTACTGGAGGCAAGGCTCCAAGGAAGCAGCTTGCAAC
CAAGGCTGCCCGTAAATCTGCCCCAACAACAGGAGGAGTTAAGAAGCCTCACAGATACAGACCTGGAACCGTTGCTCTT
CGTGAAATTCGCAAGTACCAGAAGAGCACTGAGCTGTTGATCAGGAAATTGCCATTTCAAAGGCTTGTTCGTGAAATTG
CACAGGACTTCAAGACTGACTTGCGTTTTCAGAGTCACGCTGTGTTGGCCTTGCAAGAAGCAGCTGAGGCATACCTTGT
TGGATTGTTTGAGGACACTAATCTGTCGCCATTCACGCCAAGCGTGTGACTATCATGCCTAAGGATATCCAGTTGGCC
AGAAGAATTAGGGGAGAACGAGCTTAGAATGATTTTTTCTGCTTTCTCTTGCTTAGATTATTGAAGTTTTTTCTTTAGC
GTTTTCTGTTTTTTTCTTCTTCATATAGGTAGTTTTACTAGATATGAATGGATGTGGAGTACTGGAAATTTGATACTCT
ATTAAATAGTCGATTTTCAGCTTTAGCCAAAAAAAAAC

> SEQ ID NO: 5320 104254 155031_301352_1b
AGGGCCTAATCTACAAAGTCTTTCACATTATCATAATATATTCGAAATGGCTCGTACCAAGCAAACTGCCCGCAAATCC
ACTGGTGGAAAGGCTCCAAGGAAGCAGCTAGCTACCAAGGCCGCGAGAAAGTCAGCTCCAGCGACCGGAGGAGTGAAGA
AGCCTCACCGTTTCCGTCCAGGAACTGTTGCTCTCAGGGAAATCAGGAAGTACCAGAAGTCCACTGAATTGTTGATAAG
GAAGCTGCCATTTCAGAGGCTGGTGAGGGAAATAGCACAAGTCTTCAAGACAGATCTGAGGTTCCAAAGCAGTGCTGTT
GCTGCTCTTCAAGAGGCTGCTGAGGCTTACCTTGTCGGACTCTTTGAAGATACCAATCTCTGTGCTATTCACGCGAAAA
GGGTCACCATAATGCCAAAGGACATTCAGCTTGCTAGGAGGATTCGTGGAGAAAGGGCCTAGAATGATGCTATGTTAAT
CTTATGGTTATTGTTAATTTTGTGTTCTTCTGATTTAGGGCTGCTTTTTCTGTCGTTCGTGGAATGTTAGGGCTAGTG
ATGTAAATCAAATGACTTGTTTCCGTCAAACTATATGTAAAACCTCTGGTTTACCAGTATTCTAAGATTTGATCAATGA
AATCTACGTTCATTTCCTTTCAATC

> SEQ ID NO: 5321 104254 104409_300364_1b
AATAAAATTCGACTATATAATAGAGAGTATCAAATTTCCAGTATGCCACAGCCATTCATATCTAGTAAAAACTACCTAT
ATGAAGAACAAAGAAGAAAAATGCAGAAAGACGGCAATTCAAAAAAAAAATCAACAATCTAAGCACGATACGGCAG
AACAGATCATTCTAAGCTCTTTCTCCCCTAATTCTTCGGGCCAACTGGATATCCTTGGGCATGATAGTGACACGCTTGG
CGTGAATGGCGCACAGATTTGTGTCCTCAAACAATCCAACAAGGTAGGCCTCAGCTGCTTCTTGCAAAGCCAATACAGC
GTGACTCTGGAAACGCAAATCAGTCTTGAAGTCCTGTGCAATTTCACGAACAAGCCTTTGGAATGGCAATTTCCTGATC
AACAGCTCAGTACTCCTCTGGTACTTGCGAATTTCACGAAGAGCAACGGTTCCAGGTCTGTATCTGTGAGGCTTCTTAA
CTCCTCCTGTTGTTGGGGCAGACTTACGGGCAGCCTTTGTTGCAAGTTGCTTCCTTGGAGCCTTGCCTCCCCCGGCCGT
AATGGC

> SEQ ID NO: 5322 104702 107768_300258_1b
GCAATTTCTCAAATGGCAGTCTCATCCATAGCCAATCTCTTCTCCTTCTTCACCCCCTCCAAACCCCCACCCCCAGAG

FIG. 2 continued

CTTCCCCCCTCCAATTCTCTCTTCCTGCTGTTGATTCCCTCTCTTCTTCAACACCTATCAACAATCACAAATACCCATT
ATCACTATCGTGTTCTAATTCTGATGTTACGGCCGTCGTTTACCCCTCACTTGCAAATGCAAACACTCTTTACTTCAGG
TCGGGATACAATGTTCAGGTAATTGTGGATGATAATGAGCACGAAGAGAAGCTTGTTGGACGGTTTCGTAGGGAGGTTA
TGAGAGCTGGAGTCATACAGGAATGCAAGCGTAGGAGATATTTCGAGAACAAGCACGACAAATTGAAGCGCAAGTCACG
TGAGGCTGCTAAACGCAACCGCAAGAGACGTGGCCCACCAAGAAATTTCTCAGATGATAAGCAAGAGGCATCTAAGAGC
AAGAGGGATGACGAAGGGGAAGATAACTGGGAACTTCCTGATGGAGGTCTTCCCTATTGATTTTATTGTAGTTCCTTTT
TCCTTTTTTTTGGGGTCCTGTAGAAATGTGGTTTATTTCCACTTTGGAGAGAATCTATTCATATAATTCCCCATGGGAA
TCATTTTCCTTGATTTTTCCAACTGCATTTACCTGATTCCTTTGATACTAGATGCTCGTGAAGATGTAATTGTTAAGCC
TGCTTCATAGTGTACGAGCTTCAACTACTA

> SEQ ID NO: 5323 104768 108183_300259_1b
AAAGGGTATAGGAAATGGTCTGCCACTTGGAGCTGTTGTCACAACTCCAGAAATTGCAAGTGTTATGGCTCAAAAGATA
CAGTTTAATACATATGGGGGGAACCCTGTTTGCTCTGCTGGTGGACATGCAGTACTCAGAGTGATCGATAAGGAACAAC
GCCAAAAGCATTGTGCTGAGGTTGGCTCACACTTGATTGGGCGGCTGAGGGATCTACAGAAAAGACACGACATAATTGG
AGATGTGAGAGGAAGGGGTTTAATGGTTGGTATCGAACTCGTCACTGACACAAAAGAAAAAACACCCGCCAAGGCAGAA
ACTGGAGTTCTCTTTGAGAAGCTTAGAGAACTTGGTGTTCTTGTAGGGAAAGGTGGTTTACATGGAAATGTTTTCAGAA
TAAAGCCTCCTATGTGTTTTGGCAAGGATGATGCAGACTTTCTAGTTGATGCATTGGACTATTCAATTTCAAGTTGTG
AAAATCTCTCAAGAGTAGGCAGAACAGATTGTTGTGAATTGCTCAGTTGATTCTCCTTCAACCAAAGGACACACCTTAT
TTTCCAGTACAATAACTACGTAAAAGAAAGCAAGAAAGTGTTCTACAAAAATCGAGGGAACAGAGGATTAAAATATGCA
TGGATGCAGAATGTGGTTTGACAATTTCAGTTTAATTATAGTTGATGAT

> SEQ ID NO: 5324 104768 3991_300330_1b
CCCACGCGTCCGAAGTTCCAATACTATTGGACTAACTGCTCTTAACACATGGAAGTACCCATTACCTCAGGGGGAAATC
CATCACGTAGTAAATCCAGATCCATACCGTGGAGTTTTTGGCTCTGATGGTTCTCTTTATGCTAAAGATGTTCAAGACC
ACATCGAGTATGGTACCTCTGGAAAAGTAGCTGGATTTATCGCAGAGACCATCCAGGGGGTCGGAGGAGCTGTAGAATT
GGCTCCTGGTTACTTAAAGTCGGTTTATGAAATTGTTCGCAACGCTGGTGGTGTATGCATTGCTGATGAAGTCCAAACT
GGATTTGGGCGAACAGGAAGCCACTATTGGG

> SEQ ID NO: 5325 104768 226826_301005_1b
GCCCACCGAGTGCATGTCGTTCACCAACTGCTTCCATGGCAGGACCATGGGGTCGCTCGCGCTCACCAGCAAGGTCCAA
TACCGGGAGCCATTCGCGCCGGTGATGCCCGGCGCGACGTTCGCCGAGTACGGGAACCTAGAGGAGGCCAAGAAGGTGA
TACAGTCTGGCAAAATTGCTGCCGTGTTCGTCGAGCCCGTGCAGGGCGAGGGTGGGATCCATAGTGCCACCAAGGAGTT
CTTGCAGGGGCTGCGGGATGCCTGCGATGAGGCTGGAGCTCTCTTGGTCTTTGATGAGGTGCAATGTGGTCTGGGACGC
ACAGGTTACCTCTGGGCGTATGAAGCCTATGGAGTACTACCTGACATTATGACCTTGGCAAAGCCATTGGCCGGTGGTC
TCCCCATTGGTGTAGTCTTGGTCACCGAGAAGGTTGCTTCAGCAATAAACTTCGGCGACCACGGTACCACATTCGGGGG
AGGCCCTCTTGTTTGCCAAGCTGCATTGACCACATTGGATAAGATCCAGAAACCTGGCTTCCTAGCAGAGGTGGCCAAG
AAAGGAGAGAACTTCAAGCAGCTTCTCAGTACCAAGCTGAGCGGAAACGCCCATGTGAAAGAGATCCGGGGGATCGGTC
TCATTGTCG

> SEQ ID NO: 5326 105019 229185_301040_1b
AGGAGAGCTTTTGGTAGACGCTATGGGCTCTGGAATTCAGTGAGGAGGTACAGCGAGCACAATCCAAAATGTAAGTTCA
CCTTGAAAGGTTCTAGCACGGCTTTAAGGATGGATGGGATACATATAGCTCAGGAAATCAAGCAAGACATCGCAGAGAC
GGTAAGAAATGGCACTTCGAGGCCTGGATTGGCGGTGCTCCAGGTGGGAGACAGCACCCGGTCACAAACTTACATAAAA
AACTTACGAACAGCGTGCAACGAAGTTGGAATCAAGAATTTCACGTCGCAGTTGCCCGAAACAGCTCCATTGCAAACGA
TCTTGCAAGCGCTCAGAGTTTTAAATTCGGATGGGAGCGTTCATGGCATTGTCGTGCAGCTCCCTCTACCAAAGAAGAT
TCGACCAGAAACTGTGCTTCAAGAGATATGTCTGGAGAAAGATGTCGACGGCCTCCATCCCCTCAACTTGGGAAAGCTG
GCTCTCGAGAACTTCCAGCCAAGTTTCGTGCCATGCACCTCGAGAGCTTGTCTTGAGCTTCTAACTCGCTACAACGTCC
AAG

> SEQ ID NO: 5327 105019 8131_300316_1b
AATTCGGCACGAGGGCTCATGGCGTCATCATCTGATCACACGGCGAAGATAATCGACGGCAAGGCGATTGCTCATACCA
TCAGATCAGAGATCGCCGAGGAAGTTCGCGGTCTATCTGAGAAACACGGCAGGGTCCCAGGACTAGCTGTAGTTATTGT
TGGGAGCCGAAAGGATTCACAGACCTATGTGAATACTAATAGGAAAGCGTGCGCTGAGGTTGGGATTAAGTCATTTGAC
GTGGGCCTACCAGAGGAAGTTTCTGAAGCTGATCTTATTAGCAAAGTTCATGAACTAAATTCAAATCCGGATGTCCATG
GCATATTAGTTCAACTCCCATTGCCGAAACATATTAATGAGGAGCATATATT

> SEQ ID NO: 5328 105143 284977_200102_1b
GAAAAAAATGGCAGAAGGTGAATACAGGTGCTTCGTCGGTGGGTTAGCATGGGCTACTACCGACCAAACACTTGGGGAG

FIG. 2 continued

```
GCTTTTTCTCAGTTCGGCGAAATTCTTGACTCGAAGGTCTGTGGCAAAACAGAGCAGAGATCGGATTCGAGCCGATTTG
AATCGGCTTCGTTGACCCTCTGTTACTGGAAAAATTGATCTGTTACTACTCTCTCTGTTACTGTTACTACTCTCTGGTT
TATCTGTTACTGTTACTATTTGATACTAATATTCCACTTTCCCCGAAACGATTATCAATGACAGAGAAACTGGTCGATC
TAGAGGGTTTGGATTTGTTACATTCAAGGACGAGAAATCTATGAGGGACGCTATTGAAGGGATGAACGGCCAGGACCTT
GACGGTCGTAACATCACCGTCAACGAAGCTCAGTCTCGCGGAAGCGGTGGAGGCGGTGGCGGTTACCGTGGTGGTGGCG
GTGGAGGCTACGGAGGCGGTGGCCGTCGTGAAGGTGGTTATGGCGGCGGTGGTGGTTACGGAGGTGGCCGTCGTGAAGG
TGGTTATGGCGGCGGTGGCGGCTATGGAGGTGGCCGCCGTGAAGGTGGTTACGGTGGTGGCTCTGAAGGAAACTGGAGG
AGTTAGATTTTCCGGTTCCTTTAGATTTAATTTTTTGTTTGAATTTTATG

> SEQ ID NO: 5329    105143 3014_300344_1b
CCCACGCGTCCGCTCTCTTACATTTTGAAACCCTAATTTCTCTTCTTTTCCCCAAAAAAAAATGTCTGAAGTTGAGTAC
CGGTGCTTTGTCGGCGGCCTTGCCTGGGCACCAATGATGAAGATCTTCAAAGGACGTTCTCACAGTTCGGCGACGTTA
TCGATTCTAAGATCATTAACGACCGCGAGAGTGGAAGATCAAGGGGATTCGGATTCGTCACCTTCAAGGACGAGAAAGC
CATGAGGGATGCGATTGAAGAGATGAACGGTAAAGAGCTCGATGGACGTGTCATCACCGTGAACGAGGCTC

> SEQ ID NO: 5330    105143 187131_300674_1b
ACTAGACCTCCGAACCAAACCGAGGGCAAGAGCATCCGATTCGCCGCCGCCTTCGTCTTCCTCGCAGAGATGGCGGACG
TGGAGGAGTACCGTTGCTTCATTGGGAATCTGTCATGGTCCACAACTGATGAAAGCCTCAAGGATGCCTTTGGCAAATT
TGGCAACCTCACTGGAGCAAAGGTGGTTTTTGACAAGTATTCTGGCCGTTCTCGTGGTTTTGGCTTTGTGACCTTTGAT
GAGAAAAAAGCCATGGAAAATGCTATTGAAGGAATGAATGGATTGGATTTGGATGGGCGGGC

> SEQ ID NO: 5331    105143 201132_300713_1b
CCCGGTGGTCTCTCAGAGGTGGGTTGGCTTCTCCTCCCCCTCCCGGTTCGGTTCGGTTCGGTTCGGGTCCGGTTCGATT
TCGGTTTTTCCTTCGGTTCGGGGGTTGGTGGGAAAGCATGGCGGCGCCGGATGTTGAGTACCGCTGCTTCGTCGGCGGC
CTCGCCTGGGCCACCGACGACCGCTCCCTCGAAGCCGCCTTCTCCACCTACGGCGAGATCCTCGAGTCCAAGATCATCA
ACGATCGGGAGACGGGGAGGTCGCGCGGGTTCGGGTTCGTGACGTTCTCGAGCGAGCAGGCCATGCGCGACGCCATCGA
GGGGATGAACGGCAAGGAGCTCGACGGCCGCAACATCACCGTCAACGAGGCCCAGTCGCGCCGCTCCGGAGGCGGAGGC
GGCGGTGGCTACGGCCAGCGCGGCGGAGGCGGAGGCTACGGTGGCGGCGGCTACGGTGGTGGTGGCGGCGGCGGTGGCT
ACGGCCAGCGCCGTGAAGGCGGCTACGGCGGTGGCGGTGGCTACGGTGGCGGCCGTGGTGGCGGCGGCTACGGCGGCGG
CTACGGCGGCGGCTACGGCAGCCGCGGCGGCGGCAACTCCGACGGGAACTGGAGGAACTGAGCGGTGGGGCCCTCATGG
GCCAAGTTATCTATCTATCTAATCGAGCTACCATCATCATCATCCGATCGTTATCATCGTTAGTT

> SEQ ID NO: 5332    105143 260156_301712_1b
AGCGAAGAAGATGAAAGAAGAGTATCGATGCTTCATCGGCGGCTTGGCCTGGAGCACCACCGATCGCGGCTTGGAGACC
GCTTTCGAGCCCTATGGATCCATCGTCGAAGCCAAGGTTACAATGAGTCTGATTTGTTCTTTGGGTCGGTCTAGGCACC
GGCTTCCTTGCTTGCCTTCTTTTGTGCAGAGTTTCCACAGGTGGTGTATGATCGAGAACAGAGCCGGTCCCGGGGCTTC
GGCTTTGTGACCTTCGCGGACGAGGAGGCGATGGAAAACGCCATCCGGAAGATGCACAACCAGGAGCTGGACGGCCGAT
CCATCACTGTCAGCAAGGCGCAGCCGAAAACTGGCGGCGGCGGCGGCGGCGGCGGCGGTGGCGGTGGCCGTGGAGGAGA
CAGGGACCGGGACAGGGACAGGGACAGGGACAGGGACCGGGTGGCGGCGGCTACGACCGCGGACATGGCGGAGCTAGT
GGCGACTGCTTCAACTGTGGAAACAAAGGCCACTGGGCTCGTGACTGTCCAGAGAGCGGCGGCGGTGGTGGAAGAGACC
GCGGTGGTGGCCGAGACCGAGACAGGTATGGGAGTGATAGATACGGCAGTGACCGCGGTGACAGGTACGGTGGCGGCGA
TGGTAACCGCGGCAGCGGC

> SEQ ID NO: 5333    105143 246240_301611_1b
GCACGAAAAAATCAGTCAAAATGAGCAAACTTTACGTCGGAAACCTGTCTTGGAACACCTCGGACGAGACCCTCCGCGA
GGCCTTCTCCCAGTTTGGCCAGGTCACTGACTCCATCATCATGCGCGACCGCGAGACCGGCCGAGCCCGAGGATTCGGA
TTCGTTACCTTCAGCACCGAGGACGAGGCTAAACGCCGCTGTCGAGGGCCTGAACGAGCAGGAGCTCGACGGACGACGC
ATCCGAGTCAACGTTGCCAACGCCCGTTCCTCTGGAGGCAGCGGCGGCTACGGCGGCGGCCGTGGTGGTGGCTACGGAG
GTGGTGACCGAAACGACCGACAGGGTGGTGGCGGTTACGGTGGTGGCTACGGCGGTGGTGATCGCCANGGCGGCGGCTA
CAGCCCAGGTGGTTACGGCGGCGGCGGTGGCGGCTACGGCGGCGACCGCAACGACCGTGGCAACAACGGTGGTTACTAG
ATGTGGTGTACTCTCTCCCCAAACATCACATGGTCGGCGACAAGACTGGCAGCGGAAG

> SEQ ID NO: 5334    105143 104237_300060_1b
AGGAGGAGGAGTTTCAAGAACCACCTGAAGATGCTAAGTTGGTTGTTGGAAATTTACCTTATGATGTAGACAGTGAAGG
GCTGGCTCGACTTTTTGAGCAGGCTGGTGTTGTTGAGATTGCTGAGGTTATTTACAATAGGGACACTGATCAAAGTCGT
GGATTTGGGTTTGTGACAATGAGTACGGTGGAAGAAGCTCAGAAAGCTGTGGAAATGTACAATCGTTATGACGTCAATG
GAAGACTCTTGACAGTCAACAAAGCTGCTCGTAGAGGCGAGCGACCTGAGCGCCCGCCTCAGACATTTGAACAGTCCTA
CAGGATCTACGTCGGCAATATCCCATGGGGCATTGATGATGCACGCCTTGAGCAACTGTTCAGTGAACATGGAAAAGTA
```

GTGAGTGCTCGGGTAGTTTATGACAGAGAAACTGGCCGGTCGCGAGGTTTTGGTTTTGTTACGATGGCAAGTGAAGCTG
AAATGAGTGATGCAATTGCTAACCTTGATGGACAGAGTTTGGATGGGAGGACAATCAGGGTAAACGCTGCTGAAGATAG
ATCCAGTCGCAACACGTTTTGATTTGATCAAACGTTCATTTGTTCTATAAACATAGCGGTCACAAATCTGCAGGTACGA
GTGTTTTTTTCGGGAATTTTTG

> SEQ ID NO: 5335 105143 142627_300500_1b
CTCTCTTATAAATTAAAAAAATCAATGGCTGAAGTTGAGGGCCGGTGCTTCGTCGGTGGGCTCGCATGGGCTACCACTG
ATCGAACCCTAGGCGAAGCTTTCTCTCAGTACGGCGAGGTGCTTGAATCGAAGGTCCGTTTGTCGGTCGCAGAGCAGAG
ATCGGAATCCGAGCCCTGATTTGGCTTCGTTTGCCCCTCTGTTACTGTTGATTCATCTGTTACTGTTACTATGTCTCTC
TGTTACTGTTGATTCATCTGTTACTGTTACTGTTACTATTTGATACTATTATTCGTTCCCTCTTAACGGTACGTTCCGT
CTTACTTCTCTTCTTATAAAAGAGATGAAGATAGATCGGTTATTCTTTTTTGTCCAATTTGCTTGGAATGAATGTAACT
TCTCGAGCATGCTCGTACATAGTCCTTTTGCTTTGTTTTTTCCTGTCGACGGTCTAGATCTGGAAGATCTGATGTTGTTT
TGGTGNTGATTTTGATTTTACAGATCATCAATGACCGTGAAACCGGTAGATCTAGAGGATTTGGCTTTGTTACTTTTGG
CGATGAGAAATCCATGAGGGACGCTATCGAAGGGATGAACGGCCAAGACCTTGATGGTCGTAACATAACCGTTAACGAA
GCTCAATCACGCGGAAGCGGTGGAGGCGGCGGCGGCGGCGGTGGTTTCCGCGGTGGACGTCGTGAGGGAGGCGGCGGAT
ACGGAGGGGGAGGATATGGAGGTGGAAGACGCGAGGGCGGCGGCGGCGGTTACGGCGGAGGCGGCGGCGGTTATGGCGG
TGGCCGTGACCGTGGATATGGCGGTGGTGGTGACCGTGGATATGGTGGTGATGGAGGATCACGCTACTCAAGGGGTGGT
GGTGACTCTGATGGAAACTGGAGGAATTAGATAATTGAGAAGATGTGGATTTTAGTTATTTTGATCGCAGTTTAAGTTG
GTTATATCTTAATGTTAGTGTGACTCTTTTTTGACCGTTATTTGGCTCGTTACGTTACTGTGTTTTCTATTAACTGAG
TTCTTATGGAATGAATTAAATTAAGGTCTACAAATTAAATCTTTCTTTTGCAT

> SEQ ID NO: 5336 105143 137967_300687_1b
CCCGCTCGTGCTCTCTTTGAGGTGGGTTGGCTTCTCCTCCCCCTCTTTACCTTTTCCTCCTCGGTTCGGTTCCGTGGTT
CGTCTAGGGTTTAGTGGGTTGAGATGGCGGCGCCGGATGTCGAGTACCGCTGCTTCGTCGGCGGCCTCGCCTGGGCCAC
CGACGACCGCTCCCTCGAGGCCGCCTTCTCCACCTACGGCGAGATCCTCGACTCCAAGATCATCAACGACAGGGAGACG
GGGAGGTCACGTGGGTTTGGCTTCGTCACCTTCTCCTCCGAGCAGTCGATGCGCGACGCCATCGAGGGCATGAACGGCA
AGGAGCTCGACGGCCGCAACATCACCGTCAATGAGGCCCAGTCCCGCCGCTCCGGCGGCGGAGGCGGGGGCTACGGCGG
CGGCGGTGGCGGCTACGGCGGCGGTCGTGGAGGCGGCGGCTACGGAGGAGGTGGCGGCGGCGGCTACGGGCGCCGTGAG
GGCGGCTACGGTGGCGGCGGCGGCTACGGCGGCGGCCGTGGCGGCGGCGGCGGCGGCTACGGTGGCAGCCGTGGCGGCG
GCTACGGCGGCGACTCCGGCGGGAACTGGAGGAACTGATTGGTGGGGCCCATCGTGGCCAGTTATCCTTAGCTATCCGT
GTCAGAATCATCTTATCATCGAGTCGAGTCGTTATCGTGTCCAGTGGCTCTCTCGAGTCGAGAAGCCCTCTATCCATCC
ATCCAGTGTTAGGTGTTCTTCGTCCG

> SEQ ID NO: 5337 105143 135412_300414_1b
ATCGACAGCGAGCGCCTCGCCCAGCTCTTCGAACAGGCCGGCATCGTCGAGGTCTCCGAGGTCATCTACAACAGAGAAA
CAGATCGGAGTCGTGGATTTGGATTTGTCACCATGAGCACCGTTGAGGAGGCTGAGAAGGCTGTGGAGATGTTCCATCG
CTACGATGTTGATGGGAGGCTTCTGACTGTAAACAAGGCAGCTCCTAGAGGCGCTCGGGTGGAAAGACCTCCCCGTCAG
TTTGGGCCTTCTTTCAGGATTTATGTGGGCAATCTCCCTTGGCAAGTGGATGACTCTAGGTTGGTACAGCTGTTCAGCG
AGCATGGCAAAGTAGTCGACGCCAGAGTTGTGTATGACAGAGAAACTGGGCGTTCACGAGGATTTGGTTTTGTAACAAT
GGCGACACAGGAAGAATTGGATGACGCTATTGCAGCCCTCGATGGACAGAGTTTGGATGGCCGTGCGCTGAGAGTGAAT
GTTGCAGAGGAGCGACCACCGCGCCGAGGCTTTTAATGGGATAGCAGGCTTTGTGGGGGTTTAACAGCATCGGAGGCAT
CATAGCACGTCTGATACTGGTTTAGTCCCTCAAATAGTAGCTTTCTTGCGATTCTTGGTTCTGTATCCTTCCCAAGTCCT
TTCTCATGCCTGCTGTTTACTGCTCCTTTCTTGTTAACTGTTGGTTGTGGCCCACGAGTTGATGCACGTAAGCTACTGT
TATGATGCCCCTCTACCCCAATTTGTCGATGCA

> SEQ ID NO: 5338 105143 124532_301024_1b
ACGCGTCGCGCTCCTCATTTGTTTCTCTCTCCTTAAACCCTCAAAACCTTTCTTTCCTCAGATTTGTCAATTTATCTGC
GCAAATGGCTTTCTACAACAAACTCGGTGGTCTTTTGAGGCAGAGCATTTCTGGTAATGCAGTAAGTGCAACATCACCA
ATGCCTTCAATGCTTGATGCCGTCCGGTGCATGTCAACCAAGCTTTTCATTGGTGGTCTTTCATGGGGAACTGATGATC
AGTCGCTCAGAGACGCCTTTGCTACCTTTGGTGATGTTGTTGATGCTAGGGTAATTGTTGACAGAGATTCTGGCAGATC
AAGGGGATTTGGATTTGTGAACTTCTCAGATGATGAAAGTGCCAATGAGGCTATTAAAGCAATGGATGGTCAGGAACTC
CAGGGAAGGAATATTCGTGTTAGTATTGCCCAAGAGAGAGCTCCTCGAAGCGGAGGTTTTGGCGGTTCCGGTGGATTTG
GTGGTGGCTATGGTCAAGCTAGAGATAATGATGGATACTAAGTCACTTTGATTTTTTCTAAGCTGTCAATGTGTGCATG
ATAACGTTTATCTAAGAAGAGGACTTTGGCGGAAGATAGCTTTGTTGAGTTTATCTATATTAAGACTTCTTTTCGTGCA
AGGTTTTAGTATCAATAATTTTTCCTGATTTATGGCTAGC

FIG. 2 continued

> SEQ ID NO: 5339 105143 120785_300516_1b
CCCCCCCCCGGTGCTCTCTTTGAGGTGGGTTGGCTTCTCCTCCCCCTCTTTACCTTTTCCTCCTCCTCGGTTCGGTTCC
GTGGTTCGTCTAGGGTTTAGTGGGTTGAGATGGCGGCGCCGGATGTCGAGTACCGCTGCTTCGTCGGCGGCCTCGCCTG
GGCCACCGACGACCGCTCCCTCGAGGCCGCCTTCTCCACCTACGGCGAGATCCTCGACTCCAAGATCATCAACGACAGG
GAGACGGGGAGGTCACGTGGGTTTGGCTTCGTCACCTTCTCCTCCGAGCAGTCGATGCGCGACGCCATCGAGGGCATGA
ACGGCAAGGAGCTCGACGGCCGCAACATCACCGTCAACGAGGCCCAGTCCCGCCGCTCCGGCGGCGGCGGCGGAGGCGG
GGGCTACGGCGGCGGCGGTGGCGGCTACGGCGGCGGTCGTGGAGGCGGCGGCTACGGAGGAGGTGGCGGCGGCGGCTAC
GGGCGCCGTGAGGGCGGCTACGGTGGCGGCGGCGGCTACGGCGGCGGCCGTGGCGGCGGCGGCGGCTACGGTGGCAGCC
GTGGCGGCGGCTACGGCGGCGACTCCGGCGGGAACTGGAGGAACTGATTGGTGGGGCCCATCGTGGC

> SEQ ID NO: 5340 105143 109268_300044_1b
CGGACGCGTGGGTTTCATTAGGGTTTAACCTCTTCTCTAGTATCTCAGTATAGTAAAATGACTGCTGAAGTAGAATACA
GTTGTTTCGTCGGTGGGCTCGCATGGGCAACCACCGACAGAACCTTAGCTGACGCATTCGGTACATACGGCGAAGTTCT
CGACTCGAAGGTCCGTTTGCGCAGAGCAGAAATTGAATCCGGGCCCATTTTTTGGCTTTGTTGATGATCTTCTGTTACT
GATTACTGTTTATTACTCTCTGGTTTACTTGATTCATCTGTTACTGTTACTGTTATTACTGTTATACCCTTGAAACGAT
CATTAACGACAGAGAAACTGGCAGATCTAGAGGATTTGGCTTTGTTACCTTTAAGGATGAGAAATGCATGAGGGATGCT
ATCGAAGGGATGAACGGTCAGGAACTTGACGGCCGTAACATTACCGTTAACGAAGCTCAAGCTCGTGGAAGTGGAGGCG
GCGGCGGTGGTGG

> SEQ ID NO: 5341 105143 104446_300364_1b
GACTGTAAATCTTAATTCACTTCATTCCAGAGAACTTTGTAAATACAGATCCACAAGTAACATCACGGTAACAATCTCG
CGGTCAAAACGAGGACAGTAACAGGAACCAAAGTAAACCATAACGGAACTTCAACCAAACGTAGAACCATAAATTTCAA
ACAAAAAAATAAATCTAAAGGCAACGGAAATCTAACTCCTCCAGTTTCCTTCAGAACCACCACCGTAACCCCCGGCCGT
AATGGC

> SEQ ID NO: 5342 105154 1109025_301543_1b
ATGGTTTCCATGCCTGTGATCTTCTTCGCCGTTGTCCTCCTGTCCGCAGCAGGCCTCGAGGCCGCGACCGCTCCTCTCT
CCGTAGTCGGCTACGACCCTGCTGCCCTCGCCTCCGACAGGGAGCTTCTCGAAGCTTTCGAGCAATGGCTTTCCACGCA
TGGCAAGAGCTATGCAACGCAGCAAGAGAAGGAGGCCCGCCTTGAGGTCTTCAAGGACAACCTGCGCTACATCGACGAG
CACAATAGCAAAGGCGAGAGCGGATTCTGGCTGTCCCTCAACAAATTTGCTGATATGCCACATGAGGAGTTTAGGTCGA
AATACTTGGGGGCCAAAATTGACAATCCTCGTCGCCTCGACGTGGAAACAGCCTGAAATCCTTCCGTTACCAGGGAGT
CAAGGATGTGCCCACATCTATTGATTGGCGAGAGAAGGGTGCTGTCACTGCAGTTAAGGATCAAGGCGGTTGCGGGAGT
TGCTGGGCTTTCTCTGCCGTTGCTTCTATGGAGGGCATCAACCAAATTGTCACTGGTGACTTGATTTCTCTCTCGGAGC
AGGAGCTTGTTGACTGTGATCGGTCCTATGACCAAGGATGCAATGGCGGTCTCATGGATTACGCCTTTGACTTTGTCAT
TTCCAACGGTGGGATTGACACAGAGGATGACTACCCA

> SEQ ID NO: 5343 105154 144645_200136_1b
TTTTCCTTTGCATTGTCAGCCATGGCTAAAACCATAATACACACTCTCTTCTTCGCCCTCTTTTCGTCCTTATCCTATG
CAATTGACATGTCCATATAGATTACAAAAATAACCACTATGCTAGTAAATGGACATTGCAAAGTGATGAGGATCAGGT
GAAGAATGTATACGAACTGTGGCTGGCAGAGCATGGGAAAGCATATAATGTTCTGGGAGAGAAGGAAAAAAGATTTGAG
ATTTTTAAGGATAATTTGAGGTTCATTGAGGAACATAACAATTCTGGGAATCGTACGTACAAGGTGGGATTGAACCAGT
TTGCTGATCTCACGAACGAGGAGTACCGGACCATGTATTTGGGCACCAGAAGTGACGCTAGGCGCCGCTTTGTTAAGTC
CAAAAACCCAAGCCAGCGTTATGCTTCTCGGCCCAACGAGCTGATGCCTCATTCTGTGGATTGGAGGAAGAGAGGCGCC
GTTGCTCCTATCAAAAATCAAGGGAGTTGTGGGAGTTGTTGGCTTTCTCAACAGTAGCAGCGGTGGAAGGCATAAACC
AGATCGTAACAGGGGAAATGATCACACTATCCGAACAAGAACTTGTAGATTGTGATAGAGTCAAAAACTCTGGTTGTAA
TGGTGGCCTAATGGACTATGCCTTTGAGTTCATCATCTCTAAC

> SEQ ID NO: 5344 105154 268638_200121_1b
CCACAAAGCAGGAAAAACACCCAATCATGGCAAATCATAGCTCCACTCTCACCATATCCCTACTTCTCCTCCTCTTCTT
CTTCTCCACCTTATCTTCCGCTTCCGACATGTCCATCTTAACCTACGACGAAAACCAACACTTTCGAACAGACGCTGAA
GTCATGTCCTTGTACGAGTCATGGCTAGTCGAACATGGAAAATCCTACAACGCCTTAGACGAAAAAGACAAGCGGTTTC
AGATCTTTAAAGATAACCTAAGATACATAGATGAACAAAACTCTGTTCCAAACAAGAGTTACAAGCTTGGTTTAACAAA
ATTTGCTGATCTGACTAACGACGAGTACAGGTCCATGTACTTAGGTACTAAGACCACTGATCGTCGCAGGTTGTTGAAA
AACAAAAGCGATCGGTATCTTCCTAAAGTTGGGGATAGCTTGCCTGACTCAGTTGACTGGAGAGAGAAAGGTGTTCTTG
TTGGAGTTAAGGATCAAGGAAGCTGTGGGAGTTGTTGGGCATTCTCTGCAATTGCTTCCGTTGAAGCAGTGAACTCGAT
AGTCACTGGAGATGTGATTTCACTATCGGAGCAAGAGCTGGTTGATTGTGATACTTCCTACAACGACGGCTGCAATGGC
GGTCTTATGGACTATGCCTTTGATTTCATCATTAAAAATGGAGGAATTGACACTG

FIG. 2 continued

> SEQ ID NO: 5345 105154 3064_300392_1b
CCCACGCGTCCGCAAAAGAAAAACAAACGTACTCAAATGGCTCTTTCTTCACCTTCAAGAATCCTCTGTTTTGCTCTTG
CCTTATCCGCTGCTTCTCTCTCCCTCTCTTTCGCTTCTTCCCACGATTACTCCATCGCTGGATACTCCCCCGAGGATTT
GGAATCTCATGACAAACTCATAGAACTCTTCGAAAACTGGATCTCAAATTTTGAGAAAGCTTATGAAACCGTTGAAGAG
AAGTTTCTTAGGTTCGAAGTTTTCAAGGATAATCTAAAGCACATCGATGAGACTAACAAGAAAGGGAAAAGCTACTGGC
TCGGGCTCAACGAGTTTGCGGATTTGAGCCATGAGGAGTTCAAGAAAATGTATTTAGGGCTCAAGACTGATATACTGAG
ACGCGATGAAGAAAGATCTTACGCAGAGTTCGCTTACAGGGACGTCCAAGCTGTTCCTAAGTCTGTTGACTGGAGAAAG
AAAGGAGCTGTGGCGGAAGTTAAGAACCAGGGCTCTTGTGGAAGTTGTTGGGCGTTTTCGACAGTAGCAGCTGTCGAAG
GTATAAACAAGATTGTGACAGGAAACTTGACAACATTGTCCGAACAAGAACTCATAGACTGTGACACGACCTACAACAA
TGGCTGCAACGGTGGTCTCATGGACTATGCCTTTGAGTACATT

> SEQ ID NO: 5346 105187 270855_200128_1b
TTTTCCCCTTTCAGCCCAATGTTGCCGACGACTTTCTGACCTTCTCAAAAACCTCTGTGTTTCTCTCACATTTCTGGTG
CCAATCTCTTGATATTTATTGGAGAAGACGATGGCAGCTCCACCAGCGAGGGCTCGAGCAGATTATGATTATCTTATCA
AGCTCCTCCTCATTGGTGATAGCGGTGTGGGAAAGAGTTGTTTGCTGCTGAGGTTCTCAGATGGTTCCTTTACAACAAG
TTTCATCACCACTATTGGAATTGACTTTAAGATAAGAACAATTGAACTTGATGGCAAGCGGATTAAATTACAAATTTGG
GATACAGCTGGTCAGGAGCGTTTCCGCACTATCACGACAGCATATTATCGAGGAGCCATGGGTATTCTGCTGGTGTACG
ATGTCACGGACGAGTCATCTTTCAATAACATCAGGAACTGGATTCGCAACATAGAGCAGCATGCTTCTGACAATGTCAA
TAAGATTTTGGTTGGGAACAAGGCTGATATGGACGAAAGCAAAAGGGCTGTGCCAACTTCCAAGGGTCAAGCTCTTGCT
GATGAATATGGCATTAAGTTCTTCGAAACAAGTGCAAAAGACAAACATGAATGTGGAAGAAGTTTTCTTTTCAATTGCT
AGGGATATCAAAC

> SEQ ID NO: 5347 105187 6263_300336_1b
CCCACGCGTCCGCGATTTTTCGCCTGAACCTGCGGATTTTTCGATTCTTCAAATTCAATGTCTTATGCTTATCTCTTCA
AGTATATCATCATCGGCGATACTGGAGTGGGGAAATCATGTCTTCTGCTTCAGTTCACCGACAAGAGGTTTCAGCCGGT
GCATGACCTTACCATTGGTGTTGAATTTGGGGCTAGGATGATCACCATCGATAACAAACCTATCAAGCTTCAGATCTGG
GATACGGCTGGTCAAGAATCCTTTAGGTCTATTACAAGGTCATACTATAGAGGAGCTGCAGGGGCATTGCTTGTCTATG
ATATCACAAGGAGGGAGACATTTAACCATCTAGCTAGCTGGCTAGAAGATGCAAGGCAGCATGCAAATGCAAATATGAC
GATAATGCTCATTGGGAAT

> SEQ ID NO: 5348 105187 50513_300167_1b
CAATCTTTCGTCGGAAAAAGAAGAAGAAGAAGCAGAGCTGGGTTTAGTTTTTTCACGAGAAGCAAAGAGATCAATAAG
TCAGTGAGCTTTTTTCTCGTTTCTGACGATGGCGGTTGCGCCGGCAAGAGCTCGTTCAGACTATGATTACCTCATCAAG
CTTCTTCTCATCGGCGATAGCGGGGTGGGGAAGAGTTGTTTGTTACTTCGATTCTCAGATGATACTTTCACTACAAGTT
TCATTACTACCATTGGTATTGACTTCAAGATAAGAACTGTTGAACTTGATGGGAAGCGTATCAAAT

> SEQ ID NO: 5349 105187 25975_300103_-1b
CCCACGCGTCCGCTACAATGCCTCTGTCGCTCTCACCAGTTAACAGCTACAGCACAAAACTGTAACCACGCTTCCGATC
TCTAAAACCTGAGAGAGAGAGAGAGAGAGAGAGAGACAGAGAGAAGTGTTTCAATAGTTTGGCGTGAAGATGGCCGGAG
GAGGCGGATACGGCGGCGCATCGGGGAAAGTTGATTACGTCTTCAAAGTTGTTCTAATCGGAGATTCGGCTGTTGGGAA
ATCGCAACTACTTGCTCGATTCGCTAGAGACGAATTCAGCATGGATTCTAAAGCCACCATCGGCGTCGAGTTCCAAACT
CGTACCCTCTCCATTGAACAAAAAAGCATTAAGGCTCAGATCTGGGATACCGCTGGTCAGGAAAGATACAGAGCCGTTA
CAAGCGCATACTACAGAGGAGCAGTTGGCGCAATGCTGTTTATGTATGACGAAACGTGAGACCTTTGAGCATATTCC
GCGTTGGCTTGAAGAACTGAGGGCGCACGCTGATAAGAACATTGTCATCATCCTTATTGGAAACAAGTCTGATCTAGAA
GATCAAAGAGCTGTTCCCACTGAAGACGCTAAAGAGTTTGCTGAGAAGGAAGGACTCTTTTTCCTCGAGACCTCTGCTT
TAAACGCAACCAATGTCGAAAACTCCTTCAACACTCTAATGACTCAGATATACAATACCGTGAACAAGAAGAATCTTGC
ATCTGAAGGCGACTCAAATAACCCCGGTTCATTGGCTGGTAAGAAGATTCTCATCCCAGGTTCTGGACAGGAGATTCCC
GCTAAGACCAGCACTTGTTGTACTTCTTCTTGATCTGTCTCCTACTCAAGCAAGATTCATTTTTTTTCCTCCTGAATT
TGTGATAGAGAATGCTACTTTCATTGTATATTCTTTTTCGAATCTGGCTTGTTTGCTAGTTCATTAAACATTGGTGTGC
AATTGGACACCGATAGAAAGTATTGGAACAAATAGCTTTTGAATGAAATATGAAACAAACAGTCTTTGAGAGTTAAAAA
A

> SEQ ID NO: 5350 105187 258444_301696_1b
ACACAATGTCACGCAAAGACACGGCGCCGCTCTACAAGCTCATTGTGCTGGGAGACGGAGGCGTCGGCAAAACAGCTCT
CACCATCCAACTGTGCCTAAACCACTTTGTGGAGGAATACGACCCCACCATCGAAGATTCATACCGAAAGCAGGTGGTG
CTCGATGGCCAGACCGCCATGTTGGAAATACTCGACACCGCCGGCCAGGAGGAGTATACTGCTCTGAGAGACCAGTGGA

FIG. 2 continued

```
TCCGAGACGGCGAGGGATTCATCTTGGTCTACAGTATCACTTCGCGGTCGTCATTCTCTCGCATTCGTACTTACTACGA
GCAAATCCAGCGAGTCAAGGAGGACGACGAGGGCTTCAGCGTGGTCATTGTCGGCAATAAGAGCGATCGAAACGCTGAG
CGAGTCGTTTCCACTGATGATGGACGGGCTCTGGCTCGAGAGCTCAACTCTGGCTTCTTCGAGGCCTCTGCCAAGCTCA
ATGTCAACATTGAAAATGCCTTCTTCGACTGCGTTCGAGCGTGCCGAATCCAGCGTAACGGAGGCCAGGTTGAGCAGCC
CGCCGACACAGGAGCTGCCCAGCCCCTCGTGACGCCCGGCGTTGCTGCTGGAGGCGCCCCAGTTAACAACCAGA
```

> SEQ ID NO: 5351 105187 253174_301628_1b
```
AAAAAGAGAACCATGCTGAAGGTCGTCATCCTCGGCGACTCCGGCGTTGGTAAGTCGTCGTTGATGCAACAGTACGTCA
ACAACAAGTTCAGCACACAATACAAGGCCACGATCGGAGCCGACTTTCTCAACAAAGAGCTGACTCTCGAGGGCCGAAA
AGTCAACATGCAAATCTGGGACACGGCCGGTCAGGAACGGTTCCAATCCCTCGGTCTGGCTTTCTACCGAGGCGCCGAC
TGTTGCGTTCTGGTCTACGATGTCAACAACTCCAAGAGTTTTGATGCCCTGACTCTGTGGCGAGATGAGTTCCTTCTCC
TTGCCAACCCCCGAGACCCAGAAAACTTTCCTTTTGTGGTGATCGGTAACAAGGTGGATGTGGAGGAGAGCAAGCGGGC
AGTTTCCGCCAAGCGAGCCCAGGCCTTCTGCAAGGCAACCGGCAACATTCCCTATTTTGAGACCAGTGCCAAGGAGGAC
ACTGGTGTAGACCAGGCTTTCGAGACCGTTGCTCGAAACGCCATGGCACAGGTGGACTCAGAGGACTACACGGACGATT
TCGCCGACATCATCAACATCCATCTGGATAATGAGCAGTCCAACTGTGCTT
```

> SEQ ID NO: 5352 105187 209276_300813_1b
```
CACGCAGACGCGCACCAACCCGCCGGCATGCGCGTCCGATGCTTTGCTTTGCCCGCCGCGATTCGATCCACGCCTGAG
CGAGCGAGCGGGGCGAGCAACGCGCCCTTCCTTCCCTTGCCATGGCCTCTTCACCGGCGAGCAGCTACGACTGGTCCTT
CAAGATCCTGCTCATCGGGGACTCGGCCGTCGGCAAGAGCAGTCTGCTCGTCAGCTTCGTCTCCGCCTCCACATCGAC
GACGAAATCGCTCCCACCATAGGGGTTGACTTTAAAATCAAATTTCTCACTGTCAATGGGAAGAAACTGAAGCTAACAA
TATGGGACACTGCTGGCCAGGAAAGGTTTAGGGGAATCACAAGTTCTTACTACAGAGGTGCCCATGGCATCATTCTAGT
GTATGATGTCACAAAGAGAGAAAGTTTCACAAATTTGGCTGATGTATGGGCCAAGGAAATAGAATTGCATTCGACAAAT
AAAGAGTGCATCAAAATGCTTGTCGGGAACAAGGTGGACAAGAATGAGGAAAGGATGGTGACAAGGGAAGAAGGTCTTG
CCTTTGCCCAGGAATCTGGATGTCTTTTTCTT
```

> SEQ ID NO: 5353 105187 201333_300715_1b
```
CTCTCTCTCTCTCTCCCCCTCCCTCCGATCTCGCCGCGTCCGTGTCCCCTCGCCGCCGCAGCCAGGGTCGAGGGCTCGG
CGACCGGAGGAGGAGAGGCCGGAACCCGCCGCCGCCGCCGCCGCCTCCGCCTGTAGCGAGATCGCTCGATCCGGTTCGC
CTCCCGCCGCCAGTCCGCCAGCCCAGTCCGATCCGTTGAGGGGGAGGGGACGCTCTAGTGTGGGGATTGGGGGAATCG
ATGGCGGCGCCGCCGGCGAGGGCTCGGGCCGACTACGATTACCTCATCAAGCTGCTCCTCATCGGCGACAGCGGTGTTG
GGAAAAGTTGTCTCCTCCTACGGTTCTCTGATGGTTCCTTCACCACCAGTTTTATTACCACCATCGGGATTGATTTCAA
AATAAGAACAATCGAACTGGATGGTAAACGGATTAAACTTCAAATCTGGGATACAGCTGGTCAAGAACGTTTCCGAACT
ATTACAACTGCCTACTACAGGGGAGCAATGGGTATTTTGCTTGTTTATGATGTCACCGACGAGTCATCATTTAATAATA
TAAGAAACTGGATTAGGAACATAGAGCAACATGCTTCCGATAATGTGAACAAGATTTTGGTAGGCAACAAAGCTGACAT
GGATGAAAGCAAAAGGGCCGTACCAACTTCAAAGGGGCAAGCACTTGCTGATGAATA
```

> SEQ ID NO: 5354 105187 187968_300682_1b
```
AAGAATTTTCAGGTTTTCTTCTCGCTTTCACCGGAGAAGGAGAAGGAGAGGAAGGTGTTGATCGAATCCTCCTCCAATC
GCGCGCGATTCGATCCCCGTTGCTGGCTCGCTCGCTCCGCCGATCCCTCATCCGATCTGAATCCCCGATCTGATGGCGG
CCAACCCCGGCAACAAGATCCGCAACGCCAAGCTGGTTCTTCTTGGAGATGTGGGCACGGGCAAGTCGAGCCTCGTTCT
CCGGTTTGTGAAGGGCCAGTTTGTTGAATTCCAGGAGTCCACCATCGGCGCGGCCTTCTTCTCGCAGACCTTGGCGGTT
AACGACGAGACGGTGAAGTTCGAAATCTGGGATACTGCAGGGCAGGAGAGGTATCATAGCTTGGCTCCGATGTACTATC
GTGGTGCGGCTGCCGCAATAGTTGTCTACGACATCACAAATGCGGCCTCTTTCACACGTGCAAAAAAATGGGTTCAAGA
ACTTCAAGCGCAAGGAAACCCAAACACGATAATGGCTCTTGCTGGTAACAAGGCTGATATGGT
```

> SEQ ID NO: 5355 105187 190996_300737_1b
```
CCCCCCGCCCTTTTTGCAGGTTGGGTGCTCCTCCTCCTCGGGAGCCATATGAAACCCTAGATCAGATCTCATCCCCCCA
CCTTCGTCATCCCATACGAGGAGGTTATTATGGATTCTTCGTCTTCATCGTGGTCCACCCAGACGCAGAGCCAGCCGGA
TTTGGATTACCTCTTTAAGCTGCTCCTCATCGGGGACTCGGGCGTCGGCAAGAGCAGTCTCCTCCTCCGGTTCACCTCG
GACTCTTTCGAGGATCTCTCGCCCACCATAGGTGTCGACTTCAAGGTCAGGATGGTTAACACCGGGGCAAAAAACTCA
AGCTTGCCATCTGGGACACAGCTGGACAGGAGCGATTTAGAACC
```

> SEQ ID NO: 5356 105187 1008449_301415_1b
```
GAGAGAGAGAGAGCTTGGATTTTTTGGAAAGGAGAGAGAGAGAGAGAGGGTGCACCTCTTTTTTTTCACTCTTAAGTTT
ATTTTTGCTCTATTTTTATATTTCCTCTTCTTCGATCCGCATCGCTCTGCTCTGCTCTGCTCCTCCCTCGTCAGAACTT
TGTGCAGAACCTAGGGTCCTTTCGGGGGGAAAGGGGGGGCAGAGAAGGACCCATCATGGCCTACAGAGCAGATGAAGA
GTATGACTATCTATTCAAGCTTGTGCTCATTGGAGACTCTGGAGTGGGCAAGTCAAACCTCCTCTCTAGATTCACTCGG
```

FIG. 2 continued

AACGAATTCAGTCTCGATTCCAAATCGACTATTGGTGTTGAGTTTGCCACGCGTAGTCTAAACGTCGACGGGAAGATGA
TCAAAGCCCAAATTTGGGACACCGCCGGCCAAGAAAGGTATAGAGCCATCACAAGTGCATACTATCGGGGCGCAGTTGG
CGCATTGCTTGTGTTTGATGTGACTAGGCATGTCACCTTCGAGAATGTCGAGAGGTGGTTAAAAGAGCTTAAAGATCAC
ACTGACGCGAATGCGGTTGTCATGCTTGTTGGGAACAAGAGCGATCTCCGCCACCTTCGGGCGGTTTCAACG

> SEQ ID NO: 5357 105187 1118070_301852_1b
AATTAATTTTTAAAAATTTCCCTTGCTCCTTCCGGCAGATCGATCCCCTTTCCTTCCTTCTTTTTCTCTTTCTATCTCT
TCTTCTTTTCTCTCTCCCGTCTTTGCTCTGCCTTGTTGTTGACGAGAAGAAGAAGAAGGAGAAGGAGGTGGAGAGT
AAGGATCGATGGCCGCCTCTGGAGCAGCTCGAGCTCGTCGACCATGACTACCTCGTCAAGCTGCTCCTCATCGGGGATAG
CGGTGTTGGCAAGAGTTGCTTGCTTCTCCGATTTTCTGATGACACGTTCACTACAAGTTTCATCACGACCATAGGAATT
GATTTTAAGATCAGAACTATTGAGATGGATGGAAAAGAGTAAAGCTCCAAATATGGGACACTGCCGGACAAGAGCGCT
TTAGGACAATTACTACAGCCTATTACAGAGGCGCTATGGGTATCATTCTTGTGTATGATGTAACAGATGAGTCGTCTTT
CAACAATATTCGCAATTGGATTAGGAATATAGAACAGCATGCTTCTGACAATGTCAACAAGATATTAGTAGGCAACAAA
GCTGATATGGATGAGAGCAAGCGGGCAGTGTCACATGAACGCGGTCAAGCACTTGCCAATGAATATAACTTGAACTTCT
TCGAGACAAGTGCCAAAACAAATATGAACGTGGAGCAGGTCTTTTTCACCATTGCAAGATATCAAGCAACGGTTAAC
GGATGCTCCTTCGAAGACTGAGGCGGCGGCAATCAGCATTTCAAAGCCGAACCAACAAGACAAC

> SEQ ID NO: 5358 105187 1171156_302052_1b
TCTCTCTCTCTCTCTTCTCTTTCGCAAATCTGAGCTGGTCATCCATGGCCACCCGCAAGCGTACCCTCCTCAAAGTCAT
CATCCTCGGAGATAGCGGGGTTGGAAAGACATCTCTCATGAATCAATATGTAAACAAAAGTTTAGCAATCAGTACAAG
GCTACAATTGGTGCTGATTTTCTCACTAAAGAGGTTCAAGTTGAATATAGACTTGTCACCATGCAGATTTGGGATACTG
CTGGTCAAGAGCGCTTTCAAAGCCTTGGAGTTGCTTTCTACCGTGGTGCAGACTGCTGTGTTCTAGTTTATGATGTGAA
TGTCACTAAGAGTTTTGACAATCTAGACAATTGGCGAAATGAGTTTCTTATCCAGGCCAACCCTTCTGATCCAGAGAAC
TTTCCGTTTGTGCTGCTTGGCAATAAAGTTGATATCGACGGTGGTAATAGCAGGGTGGTGTCGGAAAAGAAAGCAAAAG
CATGGTGTGCAAATAAAGGCAACATTCCATACTTTGAAACTTCTGCCAAGGAAGACATAAATGTTGACGCAGCATTCCA
ATGTATTGCTAAAAATGCATTGAAGAATGAGACAGAAGAGGA

> SEQ ID NO: 5359 105187 139292_300408_1b
CGAGTTGGGGAGAGGAGAGAAACCGAGATCGATCCGCACCCACCGCGACAAACGCTCTCCCCTCCCCTCCCCCTCCGCC
CTTCGCTCCCATCCGCTCCGCCCCCTCGCCGCGCAGCGCCGGCGGCGAGAAGGTTGAGTTCGTGGGGGGTGTGACCGAA
CGATGGCGTACCGGGCGGACGACGACTACGACTACCTCTTCAAGGTGGTGCTCATCGGGGACTCCGGGGTCGGGAAGTC
GAACCTGCTGTCCCGCTTCACGCGCAACGAGTTCAGCCTCGAGTCCAAGTCCACCATCGGCGTCGAGTTCGCCACCCGC
AGCATGCACGTCGACGACAAGGTCGTCAAGGCCCATATCTGGGACACCGCCGGGCAAGAAAGATATCGAGCTATTACAA
GCGCATACT

> SEQ ID NO: 5360 105187 131272_300512_1b
GAATTCAAAACACAGAGCAACAAAGTCATCGTACTTTAAAAAAAAAAAATGCCTGCACGAAGAAGAACCCTTTTAAAGG
TCATAATCCTCGGCGACAGTGGGGTTGGGAAGACTTCTCTGATGAACCAGTATGTGAATAAGAAGTTTACTAATCAGTA
TAAAGCAACCATTGGAGCTGATTTCCTGACTAAGGAAGTTCAATTTGAAGATAGGCTTTTTACTCTACAGATATGGGAC
ACGGCTGGGCAGGAAAGGTTCCAAAGTCTAGGCGTTGCCTTTTACCGTGGTGCAGACTGCTGTGATCTTGTATATGATG
GTAATGTTGCCAAGTCATTTGAAAATTTGAACAACTGGAGGGAAGAATTTCTTATTCAGGCTAGCCCATCAGACCCAGA
CAATTTTCCCTTTGTTGTTGTGGGTAACAAGGTTGACGTGGAC

> SEQ ID NO: 5361 105187 125556_300632_1b
GGGAGAGAAAAAGTAGTGAATCATGCCATAAGCATTCACAATACTTTTACTGGCCGCCTTCTCTCTCTGTATCACATTG
CACTGTTACATAGTGGCACTTTCTTTGTGAAGTCTTTTTAGAGAGAGAAAGTACGTATTTTTTTGTATCGGAGGAACT
TTTGGAGAGAGAAAGTTGAGAAAAGGAGTCGTCGGACAGTTAGCTGATGGCGACGACGGGGCAGAGCAATAGCAGTTAC
GATCTGTCATTTAAGATATTGTTGATCGGAGATTCCGAGTAGGCAAAAGTAGCCTGCTCGTTAGCTTCATTTCTAATG
CCGTCGACGATCTTGCCCCTACCATTGGTGTTGATTTTAAGATAAAGACGCTCACTGTTGGTAGGAAAAGACTGAAGCT
TACCATTTGGGACACAGCTGGACAGGAGAGGTTCAGGACACTGACAAGCTCCTACTACAGAGGTGCTCAAGGGATCATT
CTTGTCTATGATGTAACAAGAAGAGAGTCCTTCACAAACTTGTCTGATGTTTGGGCAAAAGAGGTGGAGTTGTACAGTA
ATAATCAGGATTGTGTGAAGATGCTGGTTGGAAATAAAGTTGACAAAGAATCTGAGAGAGCTGTGAC

> SEQ ID NO: 5362 105187 1109772_301524_1b
GCCCAAGCCTTGAGATTCCCAAGCCAGATCTCAGCAGCTAGGCAGTAGCAGCTTGGCAGTGTGGAAGTCATGGCATCAG
AGTTCGATCATCTATTTAAGTTGCTTCTTATAGGAGATTCGGGTGTAGGCAAGAGTAGTTTGCTCTTGCGCTTTACATC
GGGCACCTTTGATGACCTTTCGCCTACTGTTGGTGTTGATTTTAAGCTGAAAACAATGACTTTGGAGGGGAAGAGGTTA
AAGCTCACAATTTGGGATACAGCTGGCCAGGAGCGATTTCGTACACTTACAAGCTCTTATTATAGAGGTGCACAAGGGA

FIG. 2 continued

TAATACTCGTTTATGATGTGACAAGACGGGAGACATTCACTAACCTTTCAGATGCATGGTTGAAAGAAGTTGAGCTATA
CTCTACCCACCAAGATTGTATCAAGATGCTTGTTGGTAATAAAGTTGACATGGAGTCGGAGCGTGTCGTCACCAAAAGG
GAGGGTATAGCATTCGCAAGGCAACATGGCTGCTTATTCATTGAAAGCAGTGCTAAAGCAAGAGTTAATGTTGAGCAAT
GCTTTGAGGAGC

> SEQ ID NO: 5363 105187 157256_301736_1b
CCCAACTCTCTCTCTCTCTAGATCACCATTTCCACTTTCTGCCTCTTCCCCCGAAGACTCTTACACTTTTCACAACTTC
AAAAATGGATTCATCAGATGATGAAAGTGGTGAGGAATATCTTTTCAAGATTGTAATAATTGGTGATTCAGCAGTTGGA
AAATCAAATTTGTTAACACGTTATGCAAGAAATGAATTCAACTTGCATTCAAAGGCAACAATTGGAGTTGAGTTTCAGA
CCCAAACTCTTGAAATTGACGGTAAAGAAGTAAAAGCTCAGATTTGGGATACTGCTGGTCAAGAAAGATTTAGAGCTGT
TACTTCTGCTTATTATCGTGGTGCTTTTGGTGCTCTTGTTGTTTATGATATTACTAGACGTACCACTTTTGATAGCATC
CCTCGTTGGCTTGATGAGATCAAAACGCATTCTGATACCACGGTTGCAAGGATGCTCGTGGGAAATAAATGTGATTTGG
ATAACATAAGAGCTGTGAGCGTAGAAGAAGGCAAAAGCTTGGCAGAATCGGAAGGAATGTTCTTCATGGAGACATCTGC
CCTCGATGCAACAAACGTAAACAAGGCTTTCGAGATGGTGATTCAGAGATCTACAATAGTGTTAGCAGAAAGGTTTTG
AATTCTGATTCTTATAAAGCTGAATTGTCTGTCAACAGAGTTAGCCTCGTCGATAATGGTACCGATGGATCAAAACAAA
ATCAAGGCTATTCTTGTTG

> SEQ ID NO: 5364 105187 157355_301737_1b
GAACAATTTGCTAAGCGCACGCAGCACAAAGTGCGCAGAATAGCCAATTGAGGTGTGTGTGTCTGTGTGTGCAAATCAT
ATACGAATTGATTATTCAATGGCAGCACCACCGGCAAGAGCTAGAGCGGACTATGATTACCTCATAAAGCTTCTTTTGA
TCGGCGATAGTGGTGTTGGTAAGAGTTGCCTTCTTTTACGTTTCTCTGATGGGTCCTTCACCACAAGCTTTATAACAAC
CATTGGAATCGACTTTAAAATTCGGACCATTGAGCTTGATGGAAAAAGGATCAAGCTTCAGATATGGGATACAGCTGGT
CAGGAACGGTTTCGGACTATCACTACTGCTTACTATCGTGGAGCCATGGGTATATTGTTGGTGTATGATGTTACTGACG
AATCCTCCTTTAACAACATTAGGAACTGGATTCGTAACATTGAGCAGCATGCCTCAGACAATGTCAACAAAATACTTGT
AGGGAACAAGGCTGACATGGATGAAAGCAAGAGGGCTGTTCCTACGTCAAAGGGCCAATCACTTGCAGATGAGTATGGG
ATTAAGTTTTTTGAAACTAGTGCAAAGACAAATCTTAACGTGGAACAAGTTTTCTTCTCAATAGCAAGAGATATAAAGC
AAAGGCTAGCAGACACAGACTCCAAGGCTGAGCCTTCGACGCTCAAGATTAATCAACCAGATGCAGGAGCTGGAGGTAG
TCAAGCTGC

> SEQ ID NO: 5365 105271 171234_300535_1b
GGAGGACGAGAGCGCCGGGGAGAGGTCATACACGTCTGAGCAGCTGGAGGTTGTGCGCCAGGTCAAGAAGCACACCAGG
GACTACTACCAGATCCTCGGCCTCGAGAAGGACTGCACTGTGGAGGACGTGCGCAAGGCCTACCGCAAGCTCTCCCTCA
AGGTGCATCCCGACAAGAACAAGGCCCCCGGTGCCGAGGATGCGTTCAAGGCCGTCTCCAAGGCCTTCCAGTGCCTCAG
CGATGCCGAGAGCCGCAAGCGCTATGACCTTGTTGGCTCGGACGAGCCGGTGACTTACAACAGGAGGGCTGCCTCCACT
GCCCGTGCGTATAATGGGTTTTATGAGGATGAATTTGATCCGGATGAGATATTCAGAAACTTCTTCTTTGGCGGGATGG
CGCCTGCCACCACCAGACAGTTTGGGCAATTTGGGACGTTTCATTTCAGGACTGCCGGCATGCACCATGGCCATGGGGC
GCAAAATTCCGGTGGCTCCACTCTCCGGATGCTTATTCAGCTGTTGCCTGTTCTATTGCTGCTGTTGCTCAACTTCCTG
CCATCTTCTGAACCTGTCTACTCGCTGTCCCGCTCTTACCCTTATGAGCACAAATTCCAAACCACACGTGGAGTCACAT
ACTATGTCAAGTTGCCTAACTTTGAGGAGCAGTATCCACACCAGAGCACTGAGCGTGCAACACTCGAACGGCATGTTGA
GCGGGATTACTTCTCAATACTCTCACAGAATT

> SEQ ID NO: 5366 105271 225412_301049_1b
AAAGCAACAGGGAGGAGGCGGAGCGCTGCGTCCGGATCGCGCGGGCGGCCATTGAATCCGGCGACAAGATCCGCGCACG
TAAGTTCGCCTCCATCGCCCACCGCCTCCGGCCGGAGGACCTAGATGTAGGAGAATTGGTGGCCAAGCTGGGGCTGGCC
GACGACCGCGGCGACGACGAGCAGTCAAAGGATTCCAGCGCCAGCACCACCAGCGGCAGCTCGAGGAGGCGGCGGAGGA
ACGGTGAGTACGAGTCCGAGGTCAAGGACACGGCCACCAGCGGCGCCGCCAACCCCGCCGCCGCCGAGGCGACGCCGGA
ACAGATCGAGGTCGTGGTCCGAATCAACCGGACGTCCGACTACTACCAGATCTTAGGGCTCAAGAAGGAATGCTCTGAC
GAGGACGTGAGGAAAGCCTACCGCAAGCTCTCGCTCAAGGTCCACCCGGACAAGAACAAGGCCTCCGGGGCCGAGGAGG
CATTCAAGTCGGTGTCGAGAGCCTTTCAGTGCTTGAGCAGCCCGGAACTCCGCGACAGCTACGATCGATACGGGCCGGA
GGAGACGAGGAACCTGGCACAGCAGCATCAGCAGCAGCATGGAATGCG

> SEQ ID NO: 5367 105271 276083_200156_1b
AAGAAGACGAAACACCAGTTTTCTTTTCTCCGACTGCTCGACCGTCGGTCGGTCGTTCTTCAGACATCATTTCCGATAG
AAGGTGAATCGAATTGCGATTGCTTGTTTCTCTAAGTGTATTGTGATCCGTAGAAGGTTGCTTTTCTGTTTCAGAGCC
GAAATTCAGTTTAAGGTTTCTTGCGGAGTTGAGTTGAAGTTGTGATTTGAACGATATAATGGATAGTAACAAGGATGAG
GCTTTAAAATGCATTGGTATTGCCAAGGATGCAATTGTATCTGGCAATAAGCAGAGAGCCCTCAAGTTTATTAGAATTG
CGCGGCGCCTTAACAGTAATTTATCTGTAGATGATCTTTTGGCTGCTTGTGAAAATCTGGAGTCATCAACTGCTGGATC
CTCAAGTGAGGTTAGAAATGTTGAAAATGTGAATAATGTCACGAGTCGTGTCAAGTCTGATGATGTATCTGACGGGGAG

FIG. 2 continued

```
AGGAACTATACAGAAGAACACGTGCAATTGATTAGGCAAATTAAGACTAAGAAGGACTATTACTCTATTCTTGGTCTAG
AGAAGGGTAGTTCAGTTGAGGAGATCAGGAAAGCATACAGAAAACTGTCATTGAAAGTTCATCCTGACAAAAATAAGGC
TCCGGGCTCTGAAGAGGCGTTTAAGAAAGTCTCTAAGGCGTTTAAGTGTTTGAGTGATGATGATT

> SEQ ID NO: 5368  105272 226993_301006_1b
GAGAAGAAATGGCCGCTTTATCTTAGCACCAAAAACACAATCCTGAAGAAATATGATGGAAGGTTCAAGGATATTTTCC
AGGAGGTCTATGAAGCTGGGTGGAAATCCAAGTTTGAGGCTGCCGGAATATGGTATGAGCATCGTCTCATCGATGACAT
GGTTGCTTATGCACTTAAGAGTGAAGGGGGCTATGTGTGGGCTTGCAAGAATTACGATGGAGATGTGCAGAGTGATTTC
TTAGCTCAAGGCTTTGGTTCATTGGGTTTGATGACATCAGTATTGGTGTGCCCTGATGGAAAAACAATTGAAGCTGAAG
CTGCCCATGGCACGGTTACCCGTCATTTCCGTGTTCACCAGAAGGGAGGTGAAACCAGCACAAACAGCATTGCTTCAAT
CTTTGCTTGGACCAGAGGACTTGCACACAGGGCAAAGCTTGACGACAATGCTAGACTTCTTGACTTTGCACTAAAACTT
GAAGCTGCTTGCGTTGGAACCGTGGAATCTGGGAAGATGACCAAAGACCTTGCTCTTCTTATTCACGGGTCTTCAAACG
TCACAAGAAGCCATTACCTGAACACTGAAGAGTTCATTGATGCGGTTGCTGCGGAGCTCCGGTCAAGACTGGCAGCCAA
CTGAGCTTTTT

> SEQ ID NO: 5369  105272 240223_301312_1
ATGATGGCCGGTTTAAAGATATCTTCCAGGACGTCTATGAAGCCGACTGGAAGACCAAGTTTGAGGAAGCTGGAATCTG
GTACGAGCATCGACTTATTGATGACATGGTAGCCTACGCACTGAAGAGTGAAGGTGGCTATGTATGGGCCTGCAAAAAT
TACGACGGAGATGTCCAGAGTGATTTTCTTGCTCAAGGTTTCGGCTCGCTCGGTCTCATGACTTCGGTCCTGAGATGTC
CTGATGGTAAAACCATTGAAGCTGAGGCAGCTCATGGCACAGTGACACGTCACTTCAGGGTGCATCAGAAAGGAGGAGA
GACTAGTACCAACAGCATTGCGTCAATATTTGCGTGGAGCCGTGGCCTTGGCCATAGGGCTAAACTGGATGGTAACTCG
AGACTCCAAGAGTTTGCTGATAAGCTGGAAGCGGCTAGTATTGGAACCGTCGAAGCTGGCAAGATGACAAAGATCTTG
CTATACTCGTCCACGGCTCCAAGGCTTCTAGAGACTTGTATCTAAACACTGAAGAGTTTCTAGATTCGGTTGCAGAGGA
CCTCAAGCGACGACTCTCCTCCCCTGTTACCTCCAAACTGAAGGAGCCACTACTCCAAGGCCGATGAAGGCACCGCACC
ACTGCACGAGAAATAATAGAAT

> SEQ ID NO: 5370  105272 1096674_301432_1b
GATCTGAAGAAATATGATGGAAGATTCAAGGATATATTTCAAGAAGCTTATGAGCAGAAATGGAAGACCAAATTTGAAG
CAGCAGGAATATGGTATGAACATCGCCTCATTGATGATATGGTAGCATACTGTTTGAAAAGTGACGGCGGCTATGTCTG
GGCTTGTAAAAACTACGATGGAGATGTGCTTAGCGACCTTCTTGCTCAAAGGATTTGGCTCATTAGGTTTGATGACCTC
CGTTTTGATTTGCCCGGATGGGAAAACCATTGAAGCAGAAGCTGCTCATGGAACAGTAACACGGCATTTTCGCGTGCAT
CAGAAAGGAGGAGAGACAAGTACAAACAGCATAGCTTCAATATTTGCATGGACTCGTGGTCTCAGTCATAGGGCCAAGT
TAGATGGGAATGACAGGCTTCTTGATTTCGCTCTAAAGCTAGAAGGTGCATG

> SEQ ID NO: 5371  105272 115195_300012_1b
AGAAGTCCCAATGGCAAAATCAGAAACATTTTAAATGGGACTGTTTTCCGGGAGCCTATACTATGCAAAAACGTCCCCA
GAATTGTTCCTGGTTGGAAGAAACCCATTTGTATTGGTAGGCATGCCTTTGGTGACCAGTATCGTGCCACAGATGCAAT
TATTAATGGACCCGGAAAGCTCAAAATGGTTTTTGAGCCAGAAAATGGGGAAGCCCCTTCGGAACTAGATGTTTATGAT
TTTAAAGGTCCGGGTGTTGCACTTGCCATGTACAATGTTGACCAGTCAATTCGAGCGTTTGCTGAATCATCAATGTCAA
TGGCATTTTCAAAGAAATGGCCTCTTTACTCGAGTACAAAAAATACAATTTTAAAGAAATACGATGGAAGGTTTAAGGA
CATTTTTGAAGAGGTATATGAAGAGAAGTGGAAGCAACAGTTTGAGGAACACTCGATATGGTATGAGCATAGACTGATA
GATGATATGGTAGCTTATGCATTAAAAAGTGAGGGTGGATATGTTTGGGCTTGCAAGAACTATGATGGAGATGTCCAGA
GTGATATGCTCGGTCAAGGATTTGGTTCTCTGGGCCTCATGACCTCTGTATTGGTATCTTCTGATGGCAAGACAT

> SEQ ID NO: 5372  105377 104285_300060_1b
ATTCTTCTCTCCCTTTGCGAAACAAGCTAACTTTCTCCCGAGTCTTTTTCTTCTTCCTCTCAAGATGCAGATCTTTGTA
AAGACACTCACTGGGAAAACCATTACTCTTGAGGTTGAGAGTTCAGACACAATTGATAACGTGAAGGCCAAAATTCAAG
ACAAGGAAGGGATTCCCCCAGACCAGCAGAGGCTGATATTTGCTGGAAAGCAGCTTGAAGATGGCCGAACTCTTGCTGA
TTACAATATTCAAAAGGAGTCTACCCTCCACCTTGTCCTCCGTCTACGTGGTGGTATGCAGATTTTTGTTAAAACTCTT
ACTGGCAAAACCATTACTCTTGAGGTCGAGAGTTCAGACACCATTGACAATGTTAAGGCCAAGATTCAAGATAAGGAAG
GCATTCCACCTGATCAGCAAAGGCTGATCTTTGCTGGAAAGCAACTTGAGGATGGAAGGTCCCTCGCGGATTACAACAT
TCAAAAGGAGTCGACCCTACATCTTGTCCTCCGTCTACGTGGTGGCATGCAGATTTTTGTTAAAACTTTAACGGGCAAG
ACGATCACTCTTGAAGTTGAGAGCTCAGATACCATTGACAATGTAAAGGCAAAGATCCAGGACAAGGAGGGTATTCCTC
CAGACCAGCA

> SEQ ID NO: 5373  105377 139045_300406_1b
AAAAAAGGGAAGAAATTTTTTCTTTTTTTTTGTTCGCCTCCGCTTCTTCCTCACGCAGCTCTCGCCTCGCCTCGCCG
CCCGCCACTAGAGAGGAGAGGGAGAAGGAGAAGGAGGCGAATCCCAGCAAAAGAAGATGCAGATCTTCGTGAAGACCCT
```

FIG. 2 continued

```
GACGGGGAAGACCATCACCCTCGAGGTGGAGAGCAGCGACACCATCGACAACGTCAAGGCCAAAATCCAGGACAAGGAA
GGGATCCCTCCAGATCAACAGCGTTTGATATTCGCCGGCAAGCAGCTGGAAGATGGGCGCACACTGGCCGACTACAACA
TTCAGAAGGAGTCAACTCTTCACTTGGTCCTCAGGCTCAGGGGTGGCACTATGATCAAGGTTAAGACCCTCACTGGAAA
AGAGATTGAAATTGACATTGAGCCCACCGACACGATCGATAGGATCAAGGAGCGTGTTGAGGAGAAAGAAGGCATTCCT
CCCGTGCAGCAAAGGCTTATCTATGCTGGTAAGCAGCTTGCCGACGACAAGACTGCGAAGGACTATAACATCGAAGGTG
GCTCTGTCCTCCATCTTGTCCTTGCTCTGAGGGGTGGTTATTAGTAAAGCTAATGTGCTAGTACTTAGCTCAATAC

> SEQ ID NO: 5374  105377 138074_300688_1b
CGAAAAATTTCTCCCCAATCTCGCGAGGCTCTCGTCGTCGAATCGAATCCTCTCGCGTCCTCAAGATGCAGATCTTTGT
GAAGACATTGACCGGCAAGACTATCACCCTCGAGGTGGAGTCCTCTGACACCATCGATAATGTCAAGGCTAAGATCCAA
GATAAGGAGGGCATCCCCCCGGACCAGCAGCGTCTCATCTTCGCTGGCAAGCAGCTGGAGGATGGCAGGACCCTTGCTG
ACTACAACATCCAGAAGGAGTCGACCCTTCACCTTGTCCTCCGCCTCCGTGGTGGCATGCAGATCTTTGTCAAGACTCT
GACCGGCAAGACTATCACCCTTGAGGTGGAGTCTTCTGACACCATCGACAACGTCAAGGCCAAGATCCAGGACAAAGAG
GGCATCCCCCCAGACCAGCAGCGTCTCATCTTCGCCGGCAAGCAGCTGGAGGATGGCAGGACCCTTGCTGACTACAACA
TCCAGAAGGAGTCCACCCTCCACCTTGTCCTCCGCCTCCGTGGTGGCATGCAGATCTTTGTCAAGACACTGACCGGCAA
GACCATCACCCTCGAGGTGGAATCTTCTGACACCATCGACAACGTCAAGGCCAAGATCCAGGACAAGGAGGGCATTCCC
CCGGACCAGCAGCGTCTCATCTTTGCCGGCAAGCAGCTTGAGGACGGCAGGACCCTTGCTGACTACAACATCCAGAAGG
AGTCAACGCTTCACCTTGTCCTCCGTCTCAGGGGAGGCATGCAAATCTTCGTGAAGACTCTGACCGGCAAGACCATCAC
CCTCGAGGTGGAGTCTTCTGATACCATCGACAATGTCAAGGCCAAGATCCAGGACAAGGAGGGCATTCCCCCGGACCAG
CAGCGCCTCATCTTTGCTGGCAAGCAGCTGGAGGATGGCAGGACCCTTGCTGACTACAACATCCAGAAGGAGTCCACCC
TCCACCTTGTGCTCCGCCTTCGTGGTGGTATGCAGATCTTTGTCAAGACCCTCACAGGCAAGACCATCACCCTGGAGGT
TGAGAGCTCGGACACCATCGACAACGTCAAGGCCAAGATCCAGGACAAGGAGGGCATCCCCCCAGACCAGCAGCGTCTC
ATCTTCGCCGGCAAGCAGCTCGAGGATGGCCGCACCCTCGCCGACTACAACATCCAGAAGGAGTCTACCCTCCACCTGG
TGCTTCGTCTCCGTGGTGGTATGCAGATCTTCGTGAAGACCTTGACTGGGAAGACCATCACTTTGGAGGTTGAGAGCTC
CGACACCATTGATAATGTGAAGGCCAAGATCCAGGACAAGGAGGGGATTCCCCCAGACCAGCAGCGTCTGATCTTCGCT
GGCAAGCAGCTGGAGGATGGACGCACCCTCGCCGACTACAACATCCAGAAGGAGTCCACCCTCCACCTGGTGCTCCGCC
TCCGTGGTGGTCAGTAATCAGCCAGTTTGGTGGAGCTGCCGATGTGCCTGGTCGTCCCGAGCCTCTGTTCGTCAAGTAT
TTGTGGTGCTGATGTCTACTTGTGTCTGGTTTAATGGACCATCGAGTCCGTATGATATGTTAGTTTTATGAAACAGTTT
CCTGTGGGACAGCAGTATGCTTTATGAATAAGTTGGATTTGAACCTAAATATGTGCTCAATTTGCT

> SEQ ID NO: 5375  105377 128329_300475_1b
AGCGGCACTCCTCACCTTGATAATCTTGGTGCACATAGTTGGGAAAGATGCAGATATTCGTGAAGACCCTGACAGGGAA
GACTATTACCTTAGAGGTAGAGTCATCCGACACCATTGACAATGTTAAGGCTAAGATTCAGGACAAGGAAGGCATTCCA
CCAGACCAGCAGCGGTTGATTTTCGCAGGTAAGCAGCTTGAGGATGGCCGAACACTAGCCGACTACAACATCCAGAAGG
AGTCCACCCTCCACCTTGTCCTTCGCCTCCGTGGTGGTGCCAAGAAGCGTAAGAAGAAGACTTACACTAAGCCAAAGAA
GATTAAGCACAAGAAGAAGAAGGTTAAGCTCGCCGTCCTCCAGTTTTACAAGGTTGATGATTCTGGTAAGGTTCAGAGG
CTCCGCAAGGAGTGTCCCAACGCCGAGTGTGGTGCCGGGACTTTCATGGCTAACCACTTTGACAGGCACTATTGTGGTA
AATGTGGGCTTACCTATGTTTACCAGAAGGCTGGTGGTGATTAGATGAGTGTTACTTTGCTTATTACTTTTCCCCACAT
TTCTTGCCTTAAACTCTCCTAATGTCTTGTTTGTGACAAGATGTAATGAATTTGAATTATGGTATTGTGTTAACAGCTT
ATGAAATTAAGGATTTTTGTCAGTT

> SEQ ID NO: 5376  105377 113036_300021_1b
ATTCTCATTATCTCCTCAACTTTTCTCTCTTTATTCAAACGCCTCTCAAGATGCAGATCTTCGTCAAAACCCTAACTGG
AAAGACGATAACCCTTGAGGTTGAAAGCTCCGACACAATTGACAACGTTAAGGCGAAGATTCAGGACAAGGAAGGAATT
CCACCGGATCAGCAGAGGCTGATCTTCGCCGGAAAGCAGCTCGAAGACGGCAGAACCCTAGCCGACTACAACATCCAGA
AGGAATCGACTCTTCACTTGGTGCTCCGTCTTCGTGGCGGTATGCAAATCTTCGTCAAAACCCTAACAGGGAAAACAAT
CACCCTTGAAGTTGAAAGCTCCGACACTATTGATAACGTTAAGGCGAAAATCCAGGATAAAGAGGGAATCCCACCAGAT
CAGCAGAGGTTGATCTTTGCTGGCAAACAGTTGGAAGACGGCAGAACCCTAGCCGACTACAACATTCAGAAGGAATCAA
CTCTTCACTTGGTACTCCGTCTTAGAGGAGGCATGCAAATCTTCGTCAAAACCCTAACCGGGAAAACAATCACCCTTGA
AGTCGAAAGCTTTGACACAATTGACAATGTCAAGGCGAAGATTCAGGACAAGGAAGGAATCCCACCAGATCAGCAGAGG
TTGATCTTTGCGGGTAAGCAATTGGAAGATGGAAGGACCTTAGCTGATTACAATATTCAGAAGGAGTCCACCCTCCATT
TGGTGCTCCGTCTTCGTGGTGGAATGCAGATTTTTGTGAAGACTTTGACCGGGAAACAATCACTCTTGAAGTTGAAAG
CTCAGATACTATTGACAACGTTAAGGCCAAGATCCAGGATAAGGAGGGTATCCCACCAGATCAGCAAGGCTGATCTTT
GCTGGCAAGCAGTTGGAAGATGGTCGTACTCTTGCTGATTACAACATTCAGAAGGAGTCGACTTTGCACCTTGTCCTCC
GTCTCCGTGGTGGTTTCTAAAGTGTCCGTCAGTGGTGGTGGTGATGTCTGTGTCTGTCTTGGGTCTTTGGTCTGTTT
GGTGTTTGTTTGATTCATGATTTAGTACTTTGTGTAGTTTCTGTTAGTTGTTATCATGTTATCTTTCCAATAGAGGCGA
GGAGTCTTGTTTTCTTCTGTCTCTGTTTGTGAATAATAAAGTCGAATTATTG
```

FIG. 2 continued

> SEQ ID NO: 5377 105377 1113240_301796_1b
GGCAGAGAGAGGAGAGGGAGAGAGAGATGCAGATCTTCGTGAAAACCCTAACAGGGAAGACCATCACTCTCGAAGTCGA
GAGCAGTGATACCATCGACAATGTCAAAGCCAAGATCCAGGACAAAGAAGGGATACCACCAGATCAGGAGAGGCTGATA
TTTGGTGGCAAGCAGCTTGAAGATGGGCGCACACTGGCTGATTACAACATCCAAAAGGAGTCCACACTGGATCTGGTGC
TGAAGTTGCGTGGAGGGACCATGATCAAGGTTAAGACCCTCAATGGGAAGGAAATT

> SEQ ID NO: 5378 105377 155867_301360_1b
TTCGTCAAACCCTCACCGGCAAGACCATCACCCTGGAGGTTGAAAGCTCCGACACCATTGACAATGTCAAGGCCAAGAT
CCAGGACAAGGAGGGGATTCCCCCAGACCAGCAGAGGTTGATCTTTGCAGGTAAGCAGTTGGAAGATGGTCGCACCCTT
GCGGACTACAACATTCAGAAGGAGTCCACCCTGCACTTGGTGCTGAGGCTGAGGGGAGGAATGCAGATCTTCGTGAAGA
CATTGACCGGGAAGACCATCACCTTGGAGGTGGAGAGCTCTGACACCATCGACAATGTAAAAGCTAAGATCCAGGACAA
GGAGGGTATCCCACCCGACCAGCAGAGGTTGATCTTTGCTGGGAAGCAGCTCGAGGATGGAAGGACCTTGGCTGACTAC
AATATCCAGAAAGAGTCAACCCTTCACCTTGTCCTCCGTCTCCGTGGTGGTTTCTAGGTTGTCTGTTGTTGATGACGTG
GTGTCCTGTTAATTGGCTGTGTTGTCTGTTTCTAGTTGTGGTCATGATGTGCTTTGTTTGCTGAGGTCTCAATGATGTT
CCATTCTGTTTCTGTTCGCTGTTTCTTTTATGTTCTCTGTTGTGAATAAAGATTCCGATTTCTGT

> SEQ ID NO: 5379 105377 109158_300043_1b
CAATAATCCGTCATGCAGATCTTCGTGAAAACCCTAACGGGAAAGACCATAACCCTCGAAGTCGAGAGCAGCGACACCA
TCGACAATGTCAAGGCCAAAATTCAGGACAAAGAAGGGATACCTCCTGATCAGCAGAGGTTGATTTTTGCTGGAAAACA
GTTGGAAGATGGTCGAACTCTGGCTGATTACAATATCCAGAAAGAATCAACACTTCACCTGGTTTTGAGGCTCAGGGGA
GGAACTATGATTAAGGTGAAGACTCTCACTGGAAAGGAAATTGAGATTGATATTGAACCCACAGACACACCATTGATCGA
TTAAGGAACGAGTTGAGGAAAAAGAAGGAATACCTCCTGTGCAGCAAAGGCTTATTTATGCTGGAAAGCAGCTAGCTGA
TGACAAGACCGCTAAGGATTACAATATTGAAGGAGGTTCTGTTCTTCATCTCGTTCTTGCATTGATGGGTGGTAGTCTT
TAGAATGCTCCGAATTTGGGTAAAAATGTGCAACCTTTATCCACGAATTTATCATGACAGTTCTCTTTTGTTTTCTTTT
TACCTTTTCTCATGTAAAACATGAAAACTTGGTTAAAGCTGACTAGCTGAGATTGATTTCCCCTTATAAAAAAA

> SEQ ID NO: 5380 105377 175171_300530_1b
CCCAAAATCGCAGAGAAGAAAAAATCTCCCCTCGAAGCGAAGCGTCGAATCGCCTTCTCAAGATGCAGATCTTTGTGAA
GACCCTCACCGGCAAGACCATCACCCTCGAGGTTGAGTCCTCGGACACCATTGACAATGTCAAGGCCAAGATCCAGGAC
AAGGAGGGCATCCCTCCGGACCAGCAGCGTCTCATCTTCGCTGGCAAGCAGCTTGAGGATGGCCGCACCCTGGCCGACT
ACAACATCCAGAAGGAGTCCACCCTCCACCTTGTGCTCAGGCTCAGGGGAGGCATGCAGATCTTCGTCAAGACCTTGAC
TGGCAAGACCATCACCCTTGAGGTCGAGTCGTCTGACACCATTGACAATGTCAAGGCCAAGATCCAGGACAAGGAGGGC
ATCCCCCCAGACCAGCAGCGTCTCATCTTCGCCGGCAAGCAGCGGGAGGATGGCCGCACCCTTGCTGACTACAACATCC
AGAAGGAGTCCACCCTCCACCTTGTGCTCAGGCTCAGGGGAGGTATGCAGATCTTCGTCAAGACCCTGACCGGCAAGAC
CATCACCCTCGAGGTCGAGTCCTCGGACACGATCGACAACGTGAAGGCCAAGATCCAGGACAAGGAGGGCATCCCCCCG
GACCAGCAGCGTCTCATCTTTGCTGGCAAGCAGCTGGAGGATGGCCGCACCCTTGCCGACTACAACATCCAGAAGGAGT
CCACCCTCCACCTTGTGCTCAGGCTCAGGGGTGGTATGCAGATCTTCGTCAAGACCCTGACCGGCAAGACCATCACGCT
TGAGGTCGAGTCCTCGGACACGATCGACAATGTGAAGGCCAAGATCCAGGACAAGGAGGGTATCCCCCCGGACCAGCAG
CGTCTCATCTTCGCCGGCAAGCAGCTGGAGGATGGCCGCACCTTGGCTGACTACAACATCCAGAAGGAGTCCACCCTTC
ACCTGGTTCTCAGGCTCAGGGGTGGGATGCAGATCTTCGTGAAGACCCTGACTGGCAAGACCATTACCCTTGAGGTTGA
GTCGTCCGACACTATTGACAACGTGAAGGCGAAGATCCAGGACAAGGAGGGCATCCCCCCGGACCAGCAGCGTCTGATC
TTTGCTGGTAAGCAGCTTGAGGATGGCCGCACCCTTGCGGATTACAACATCCAGAAGGAGTCCACACTCCACCTGGTGC
TCCGCCTCCGTGGTGGCCAGTAAGTCCTCAGCCATGGAGCTGCTGCTGTTCTAGGGTTCACAAGTCTGCCTATTGTCTT
CCCCAATGGAGCTATGGTTGTCTGGTCTGGTCCTTGGTCGTGTCCCGTTTCATTGTGTACTATTTACCTGTAATGTGTA
TCCTTAAGTCTGGTTTGATGGTGTCTGAAACGTTTTGCTGTGGTAGAGCAGCATGGAAGAACTATAATGAATAAGTGAT
CCCTAATCATTGTGTCC

> SEQ ID NO: 5381 105377 183163_300619_1b
CTTGAGGTCGAGTCCTCGGACACGATCGAGAATGTGAAGGCCAAGATCCAGGACAAGGAGGGCATCCCCCCGGACCAGC
AGCGTCTCATCTTCGCTGGCAAGCAGCTGGAGGACGGCCGCACCCTTGCCGACTACAACATCCAGAAGGAGTCCACCCT
CCACCTTGTGCTCAGGCTCAGGGGTGGTATGCAGATCTTCGTCAAGACCCTGACCGGCAAGACCATCACGCTTGAGGTC
GAGTCCTCGGACACGATCGACAACGTGAAGGCCAAGATCCAGGACAAGGAGGGTATCCCCCCGGACCAGCAGCGCCTCA
TCTTCGCCGGCAAGCAGCTGGAGGATGGCCGCACCTTGGCTGACTACAACATCCAGAAGGAGTCCACCCTTCACCTGGT
TCTCAGGCTCAGGGGTGGGATGCAGATCTTCGTGAAGACCCTGACTGGCAAGACCATTACCCTTGAGGTTGAGTCGTCC
GACACTATTGACAACGTGAAGGCGAAGATCCAGGACAAGGAGGGCATCCCCCCGGACCAGCAGCGTCTGATCTTTGCTG
GTAAGCAGCTTGAGGATGGCCGCACCCTGGCCGACTACAACATCCAGAAGGAGTCCACCCTCCACCTTGTGCTCAGGCT
CAGGGGAGGCATGCAGATCTTCGTCAAGACCTTGACTGGCAAGACCATCACCCTTGAGGTCGAGTCGTCTGACACCATT
GACAATGTCAAGGCCAAGATCCAGGACAAGGAGGGCATCCCCCCGGACCAGCAGCGTCTCATCTTCGCTGGCAAGCAGC

FIG. 2 continued

TTGAGGATGGCCGCACCCTGGCCGACTACAACATCCAGAAGGAGTCTACCCTCCACCTTGTGCTCAGGCTCAGGGGAGG
CATGCAGATCTTCGTCAAGACCTTGACTGGCAAGACCATCACCCTTGAGGTCGAGTCGTCTGACACCATTGACAATGTC
AAGGCCAAGATCCAGGACAAGGAGGGCATCCCCCCAGACCAGCAGCGTCTCATCTTCGCCGGCAAGCAGCTGGAGGATG
GCCGCACCCTTGGTGACTACAACATCCAGAAGGAGTCCACCCTCCACCTTGTGCTCAGGCTCAGGGGAGGTATGCAGAT
CTTCGTCAAGAGCCTGACCGGCAAGACCATCACCCTCGAGGTCGAGTCCTCGGACACGATCGACAACGTGAAGGGCAAG
ATCCAGGACAAGGAGGGCATCCCCCCGGACCAGCAGCGTCTCATCTTCGCCGGCAAGCAGCTGGAGGACGGCCGCACCC
TTGGCGACTACAACATCCAGAAGGAATCCACCCTCCACCTTGTGCTTAGGCTCAGGGGAGGTATGCAGATCTTCGTCAA
GACCCTGACTGGCAAGACCATCACACTTGAGGTCGAGTCCTCGGACA

> SEQ ID NO: 5382    105377 248863_301587_1b
TCATCAATTAGGTTTCTTCGATAGCAAGTAGCGATGCAGATCTTCGTCAAGACTCTCACCGGCAAGACTATCACCTTGG
AGGTGGAGAGCTCCGACACCATCGACAACGTCAAGACCAAGATCCAGGACAAGGAAGGGATCCCTCCGGATCAGCAGCG
GTTGATCTTTGCCGGCAAGCAGCTTGAGGACGGGCGTACCCTCGCCGACTACAACATCCAGAAGGAGTCTACGCTGCAT
CTTGTTCTTCGGCTGCGAGGAGGTATGCAAATATTCGTCAAGACCCTAACGGGTAAGACGATCACCCTGGAGGTGGAGA
GCTCCGACACCATCGACAACGTCAAGACCAAGATCCAGGACAAGGAAGGGATCCCGCCGGATCAGCAGCGTCTGATCTT
CGCTGGCAAGCAGCTCGAGGATGGCCGTACCCTGGCCGACTACAACATCCAGAAGGAGTCGACCCTTCATCTTGTGCTG
CGTCTGCGAGGAGGCATGCAGATCTTCGTTAAGACCCTCACTGGTAAGACGATCACCCTGGAAGTCGAGAGCTCGGACA
CCATCGACAACGTGAAGACTAAGATCCAGGACAAGGAGGGAATTCCTCCGGACCAGCAGCGGTTGATCTTCGCGGGTAA
GCAGCTCGAGGATGGGCGCACTCTTGCCGACTACAACATTCAGAAGGAGTCTACACTCCATTTGGTGCTGCGTCTTCGC
GGAGGCATGCAGATCTTCGTCAAGACCCTCACGGGTAAGACGATCACCCTGGAAGTCGAGAGCTCAGACACCATCGACA
ACGTGAAGACCAAGATCCAGGACAAGGAGGGAATTCCTCCGGATCAGCAGCGGTTGATCTTCGCGGGTAAGCAGCTCGA
AGATGGGCGCACTCTCGCCGACTACAACATTCAGAAGGAGTCTACTCTCCATTTGGTGCTGCGTCTTCGCGGAGGCATG
CAGATCTTCGTCAAGACCCTCACGGGTAAGACGATCACGTTGGAGGTGGAGAGCTCGGACACGATTGACAACGTGAAGA
CCAAGATCCAGGACAAGGAGGGAATTCCTCCGGACCAGCAGAGGCTGATCTTCGCCGGGAAGCAGCTCGAGGATGGCCG
CACTCTTGCGGACTACAACATCCAGAAGGAGTCTACTCTCCATTTGGTGCTCCGTCTTCGTGGAGGCCAGTAGATAGCA
TGTAGCGCGTTAGCGCGTGAAGTAT

> SEQ ID NO: 5383    105377 234660_301219_1b
CGACCCACGCGTCCGCTTTTGTGGGCGATTCCTGGGTAATTTCATACAGCGGCAACTATGCAGATCTTCGTCAAGACAC
TGACTGGCAAGACGATCACTCTGGAGGTCGAGAGCTCGGACACGATCGATAATGTGAAGACCAAGATCCAGGACAAGGA
AGGGATCCCCCCGGACCAGCAGCGTCTCATCTTCGCCGGGAAGCAGCTCGAAGACGGGCGAATCTTGGCTGACTACAAC
ATCCAGAAGGAATCCACTCTCCATCTCGTCCTACGTCTTCGCGGAGGCATGCAGATCTTTGTCAAGACGCTGACCGGCA
AGACCATCACTCTGGAGGTCGAGAGCTCGGACACGATCGATAATGTGAAGACCAAGATCCAGGACAAGGAAGGGATCCC
CCCGGACCAGCAGCGTCTCATCTTCGCCGGGAAGCAGCTCGAAGACGGGCGAACCTTGGCTGACTACAACATCCAGAAG
GAATCGACTCTCCATCTCGTCCTACGTCTTCGCGGAGGCATGCAGATCTTTGTCAAGACGCTGACCGGCAAGACCATCA
CTCTTGAGGTCGAGAGCTCGGACACGATCGATAATGTGAAGACCAAGATCCAGGACAAGGAAGGGATCCCCCCGGACCA
GCAGCGTCTCATCTTTGCTGGGAAGCAACTCGAAGACGGGCGAACCTTGGCCGACTACAACATCCAGAAGGAGTCGACC
CTTCACTTGGTGCTGCGTCTCCGTGGAGGCATGCAGATCTTCGTCAAGACCCTGACCGGCAAGACCATCACCCTCGAGG
TGGAGAGCTCCGACACGATTGACAACGTTAAGACGAAAATCCAGGACAAGGAAGGGATCCCTCCTGACCAGCAGCGCCT
CATCTTCGCCGGCAAGCAGCTCGAGGATGGACGAACTCTCGCCGACTACAACATCCAGAAGGAATCCACCCTTCACCTG
GTGCTGCGTCTCCGCGGAGGCATGCAAATCTTCGTCAAGACCCTGACCGGCAAGACCATCACGCTCGAGGTCGAGAGCT
CCGACACGATCGACAACGTAAAGACCAAGATCCAGGACAAGGAAGGGATCCCCCGGACCAGCAGCGACTCATCTTTGC
CGGGAAGCAGCTCGAGGATGGCAGGACTCTGGCCGACTACAACATCCAGAAGGAATCCACCCTTCACCTGGTGCTGCGT
CTCCGCGGAGGCATGCAAATCTTCGTCAAGACCCTGACCGGCAAGACCATCACTCTGGAGGTGGAGAGCTCGGATACCA
TCGACAACGT

> SEQ ID NO: 5384    105377 224458_300972_1b
GGTGATTTCTAAACATGCAGATCTTTGTGAAGACCTTGACCGGCAAGACTATCACCCTCGAGGTGGAGAGCTCGGATAC
CATCGACAACGTTAAGACCAAGATCCAGGACAAGGAAGGGATCCCACCGGACCAGCAACGATTGATCTTCGCCGGGAAG
CAGCTTGAGGACGGACGGACCCTTGCGGACTACAACATCCAGAAGGAATCCACGCTTCACCTGGTTCTTCGTCTCCGCG
GTGGCATGCAGATATTTGTGAAGACCTTGACCGGCAAGACCATCACCCTCGAGGTGGAGAGCTCGGATACCATCGACAA
TGTCAAGACCAAGATCCAGGATAAGGAGGGGATTCCTCCGGACCAGCAGCGACTTATCTTCGCCGGGAAGCAACTCGAG
GACGGACGGACCCTTGCCGACTATAACATCCAGAAGGAGTCGACTCTCCACTTGGTTCTTCGTCCGCGGTGGCATGC
AGATATTTGTGAAGACACTGACCGGCAAGACCATCACCCTCGAGGTGGAGAGCTCGGATACCATCGACAATGTCAAGAC
CAAGATCCAGGATAAGGAGGGGATTCCTCCGGACCAGCAGCGTTTGATCTTCGCTGGGAAGCAGCTCGAGGACGGACGG
ACCC

FIG. 2 continued

> SEQ ID NO: 5385 105377 183090_300665_1b
GAATTCAGATTCTCTTTTTGCGATCTAAAGGATCTTCTTCAATTCTCCTTCAAGATGCAGATCTTTGTGAAAACTCTTA
CTGGTAAGACCATCACCCTTGAGGTCGAGAGCTCAGACACAATTGACAACGTTAAGGCTAAGATTCAAGACAAGGAAGG
AATTCCTCCAGACCAACAACGTTTGATCTTCGCCGGAAAGCAGTTGGAAGATGGAAGAACTTTAGCTGACTACAACATC
CAGAAGGAATCAACTCTCCATCTTGTCCTTCGTCTTAGAGGTGGTATGCAAATCTTTGTCAAAACCTTGACTGGTAAGA
CCATCACTTTGGAAGTCGAGAGCTCTGACACCATTGATAACGTTAAGGCTAAGATTCAAGATAAGGAAGGAATTCCTCC
AGACCAGCAACGTTTGATCTTCGCCGGAAAGCAGTTGGAAGATGGTCGTACTCTTGCCGACTACAACATCCAGAAGGAG
TCTACTCTCCATTTGGTTCTTCGTCTCAGAGGTGGTATGCAGATTTTCGTCAAGACCCTTACTGGAAAGACCATCACCT
TGGAGGTTGAGAGTTCCGACACCATCGATAATGTCAAGGCTAAGATTCAAGATAAGGAGGGTATCCCCCCAGACCAGCA
ACGTTTGATCTTCGCCGGAAAGCAGCTGGAAGATGGTCGCACTCTTGCCGACTACAACATTCAGAAGGAGTCTACCCTC
CATTTGGTGCTTCGTCTTAGAGGTGGTATGCAAATCTTCGTGAAGACCTTGACCGGAAAGACCATCACTCT

> SEQ ID NO: 5386 105377 175812_300522_1b
CCCGGACCTTGCTCCACACCCGCAGCAGCAGCAGCAGCAAGGGGAAGAAGAAGAGCCAAGATGCAGATCTTCGTGAAGA
CCCTAACGGGGAAGACCATCACGCTCGAGGTCGAGAGCAGCGACACCATCGACAATGTCAAGGCCAAGATCCAGGACAA
GGAAGGCATCCCTCCGGACCAGCAGCGCCTCATCTTCGCCGGCAAGCAGCTGGAGGATGGCCGCACCCTGGCCGACTAC
AACATCCAGAAGGAGTCCACGCTCCACCTCGTCCTCCGCCTCCGCGGTGGCATCATCGAGCCCTCCCTCCAGGCCCTCG
CCCGCAAGTACAATCAGGACAAGATGATCTGCCGCAAGTGCTATGCTCGGCTGCACCCCAGGGCTGTCAACTGCCGCAA
GAAGAAGTGCGGCCACAGCAACCAGCTGAGGCCCAAGAAGAAGATCAAGAACTAGAGTTTGAGATATCATTTCCGCGGA
TCATTGAAATCAACAGGAAGATCAGAGTTTAAGTTTTTTTGTAGTGTAATGCCTCATGTTGTATGCCGAACTTTCTGTT
TATCCTGTGGTATGTTAACCTTGGTTACGCTGGAGAGTACTCCAGCTTATTTTGATGACATAATTGACTACAAAGTCAA
GGTTATATG

> SEQ ID NO: 5387 105377 39255_300206_1b
CCCACGCGTCCGCTCAAAATCTTAAAAACTTTCTCTCAATTCTCTCTACCGTGATCAAGATGCAGATCTTTGTTAAGAC
TCTCACCGGAAAGACAATCACCCTCGAGGTGGAAAGCTCCGACACCATCGACAACGTTAAGGCCAAGATCCAGGATAAG
GAGGGCATTCCTCCGGATCAGCAGAGGCTTATTTTCGCCGGCAAGCAGCTAGAGGATGGCCGTACGTTGGCTGATTACA
ATATCCAGAAGGAATCCACCCTCCACTTGGTCCTCAGGCTCCGTGGTGGTATGCAGATTTTCGTTAAAACCCTAACGGG
AAAGACGATTACTCTTGAGGTGGAGAGTTCTGACACCATCGACAACGTCAAGGCCAAGATCCAAGACAAAGAGGGTATT
CCTCCGGACCAGCAGAGGCTGATCTTCGCCGGAAAGCAGTTGGAGGATGGCAGAACTCTTGCTGACTACAATATCCAGA
AGGAGTCCACCCTTCATCTTGTTCTCAGGCTCCGTGGTGGTATGCAGATTTTCGTTAAGACGTTGACTGGGAAAACTAT
CACTTTGGAGGTGGAGAGTTCTGACACCATTGATAACGTGAAAGCCAAGATCCAAGACAAAGAGGGTATTCCTCCGGAC
CAGCAGAGATTGATCTTCGCCGGAAAACAACTTGAAGATGGCAGAACTTTGGCCGACTACAACATTCAGAAGGAGTCCA
CACTCCACTTGGTCTTGCGTCT

> SEQ ID NO: 5388 105377 31142_300086_1b
CCCACGCGTCCGCTCTCCCAAAGCCTAAAGCGATCTCTGCAAATCTCTCGCGACTCTCTCTTTCAAGATGCAAATCTTC
GTGAAAACACTCACTGGCAAGACTATCACTCTCGAGGTTGAGAGCTCTGACACCATCGACAATGTTAAGGCAAAGATTC
AGGACAAGGAAGGCATTCCTCCGGATCAGCAAAGATTAATATTCGCCGGTAAACAGCTAGAAGATGGCCGTACCTTGGC
CGATTACAACATTCAGAAAGAATCAACCCTTCATTTGGTTCTCCGTTTAAGAGGTGGTATGCAAATCTTTGTCAAGACT
CTGACTGGCAAGACCATTACTTTGGAGGTTGAGAGCTCTGACACTATTGACAACGTCAAAGCAAAGATCCAGGACAAGG
AAGGAATCCCTCCGGATCAGCAGAGACTTATCTTTGCCGGTAAGCAGCTTGAAGACGGAAGAACTCTTGCTGACTACAA
CATTCAAAAGGAGTCGACCCTTCATTTGGTGCTTCGTCTTCAGAGGTGGTATGCAAATCTTTGTCAAGACCCTCACTGGT
AAAACAATCACCCTTGAGGTTGAGAGTTCAGACACCATTGACAATGTCAAAGCTAAGATCCAAGATAAAGAGGGAATTC
CTCCGGATCAGCAGAGGCTTATCTTTGCCGGTAAGCAGCTCGAAGATGGACGCACCCTTGCAGATTACAACATCCAAAA
GGAGTCGACACTTCATCTTGTGCTTCGTCTCCGTGGTGGTATGCAGATCTTTGTGAAGACCCTTACCGGAAAGACCATT
ACTCTGGAGGTTGAAAGCTCAGACACCATCGATAATGTCAAGGCTAAGATTCAGGACAAGGAAGGGATCCCACCAGACC
AACAGAGACTCATCTTCGCTGGAAAACAGCTTGAGGATGGTCGCACACTTGCAGATTACAACATCCAGAAGGAGTCGAC
TCTTCACTTGGTTCTTCGTCTTCGTGGTGGAAGCTTTTAAGCTTTTTGTGATCTGATGATAAGTGGTTGGTTCGTGTCT
CATGCACTTGGGAGGTGATCTATTTCACCTGGTGTAGTTTGTGTTTCCGTCAGTTGGAAAAACTTATCCCTATCGATTT
CGTTTTCATTTTCTGCTTTTCTTTTATGTACCTTCGTTTGGGCTTGTAACGGGCCTTTGTATTTCAACTCTCAATAATA
ATCCAAGTGCATGTTTACC

> SEQ ID NO: 5389 105377 38919_301003_1b
TTTATTTTTTTAAGAAGAAGTTCGACTTGTCATTAGAAAGAAAGAGATAACAGGAACGGAAACATAGTAGAACACTTAT
TCATCAGGGATTATACAAGGCCCCAAAACACAAACCACCAAAGTTTTACATGAAACGAAACATTGAACTTCTTAAGCAT
AACAGAGACGAGATTTAAAAAACCACCACGAAGACGCAGGACCAAGTGAAGAGTAGACTCCTTCTGGATGTTGTAGTCGG

FIG. 2 continued

CCAAAGTACGTCCATCCTCAAGCTGCTTTCCAGCGAAGATGAGACGCTGCTGGTCCGGAGGAATACCTTCCTTGTCCTG
GATCTTGGCCTTGACGTTGTCAATGGTGTCGGAGCTTTCCACTTCAAGGGTGATGGTCTTTCCGGTCAAAGTCTTGACG
AAGATCTGCATACCTCCACGCAGACGCAACACCAAGTGAAGGGTCGACTCCTTCTGGATGTTGTAATCCGCCAAAGTAC
GACCATCCTCCAATTGTTTTCCGGCAAAGATCAACCTCTGCTGGTCCGGAGGGATTCCTTCCTTATCCTGGATCTTGGC
CTTCACGTTGTCAATGGTGTCAGAGCTCTCTACCTCCAAAGTGATAGTCTTTCCGGTGAGAGTCTTCACGAAGATCTGC
ATACCTCCACGCAGACGCAAGACCAAGTGAAGTGTGGACTCCTTCTGAATGTTGTAGTCAGCCAAAGTTCTTCCATCTT
CAAGTTGCTTTCCGGCG

> SEQ ID NO: 5390  105377 44358_300112_1b
CCCACGCGTCCGGGGTAAACTGAAGAGTGCGCCGCAAAATGCAGATCTTCGTGAAAACCCTAACCGGGAAGACAATCAC
GCTCGAGGTTGAATCGAGCGACACCATTGATAATGTCAAGGCTAAGATTCAAGACAAAGAAGGTATTCCACCGGACCAG
CAGCGGTTGATATTCGCCGGAAAGCAGCTCGAAGATGGACGTACTCTTGCTGATTATAACATCCAGAAAGAGTCAACTT
TGCATTTGGTTTTGAGGCTTCGTGGAGGGATTATTGAGCCTTCTCTGATGGCTTTGGCTAGGAAGTACAACCAGGATAA
GATGATTTGTCGCAAGTGCTATGCTCGCCTGCATCCTCGTGCTGTTAACTGCAGGAAGAAAAAATGTGGGCACAGCAAC
CAGCTGAGGCCAAAGAAGAAGATCAAGTAGACGTGATGTCTTTTCTAAGCTTAGATCAATTTTGCGCGTTGCAGCTATA
TATTGCCAGTCCGTTGTTTTTACAGTTTTCAGTCCTGCTTCAATTTGATGTCATGGATAACAAACATGTCTTAAACATC
TAATTATTGGATAAGATATCTTTGTGCACTCAATATATGTCT

> SEQ ID NO: 5391  105377 46816_300192_1b
AAAACCCTCACCGGAAAAACCATAACCCTAGAGGTCGAAAGCAGCGACACCATCGACAATGTCAAAGCCAAAATTCAGG
ACAAAGAGGGAATACCACCTGATCAACAGAGGTTGATATTTGCTGGTAAGCAGCTTGAAGATGGTAGAACATTAGCGGA
TTACAACATTCAGAAAGAATCGACTCTTCACTTGGTATTGAGGCTTAGGGGTGGGACTATGATTAAGGTGAAGACTCTC
ACAGGGAAGGAAATTGAGATTGATATCGAACCAACCGATACTATTGATCGGATTAAGGAACGTGTTGAGGAGAAAG

> SEQ ID NO: 5392  105377 4655_300310_1b
CGCGGTATGCAGATCTTCGTGAAGACTCTCACCGGAAAGACTATCACTTTGGAGGTAGAGAGCTCTGACACCATTGACA
ACGTGAAGGCCAAGATCCAGGATAAGGAAGGAATCCCTCCGGACCAGCAGAGGTTGATCTTTGCCGGAAAACAATTGGA
GGATGGTCGTACTTTGGCGGATTACAACATCCAGAAGGAGACGACCCTTCACTTGGTGTTGCGTCTGCGAGGAGGTATG
CAGAAATTCGTCAAGACTTTGACCGGAAAGACCATCACCCTTGAAGTGGAAAGCTCCGACACCATTGACAACGTCAAGG
CCAAGATCCAGGACAAGGAGGGAATCCCCCCCTGACCAGCAGCGCCTCATCTTTGCCGGTAAACAGCTCGAAGACGGCCG
CACCCTTGCCGATTACAACATACAGAAGGAGTCTACCCTCCACCTTGCCTTCGCCTCAGGGGCGGTATGCAAATCTTC
GTCAAAACCCTCACTGGCAAGACCATTACCCTTGAAGTCGAGAGTTCTGATACCATCGATAATGTGAAAGCCAAGATCC
AAGATAAGGAGGGAATTCCCCCTGACCAGCAGCGCCTTATCTTTGCTGGTAAACAGCTTGAAGATGGCCGCACCCTCGC
TGATTACAACATACAGAAGGAGTCTACCCTCCACCTTGTCCTTCGCCTCAGGGGTGGTATGCAAATCTTCGTCAAAACC
CTCACCGGCAAGACCATTACTCTTGAAGTCGAGAGTTCTGACACAATTGATAACGTGAAAGCCAAGATCCAAGATAAGG
AGGGAATTCCCCCCGACCAGCAGAGGCTCATCTTTGCTGGGAAGCAACTTGAAGATGGTCGCA

> SEQ ID NO: 5393  105377 56456_300139_1b
TTACAATATCCAGAAGGAATCCACCCTCCACTTGGTTCTCAGGCTCCGTGGTGGTATGCAGATTTTCGTTAAAACCCTA
ACGGTAAAGACGATTACTCTTGAGGTGGAGAGCTCTGACACCATTGACATCGTCAAGGCCAAGATCCAAGATAAGGAGG
GTATTCCTCCGGACCAGCAGAGGTTGATCTTCGCCGGAAAGCAACTTGAGGACGGCAGAACTTTGGCGGATTACAACAT
CCAGAAGGAGTCTACGCTTCATTTGGTCTTGCGTCTGCGTGGAGGTATGCAGATCTTCGTAAAGACTTTGACCGGAAAG
ACCATCACTCTTGAAGTTGAGAGCTCCGACACCATTGATAACGTGAAGGCTAAGATCCAGGACAAGGAAGGCATTCCTC
CGGACCAGCAGCGTCTCATCTTCGCTGGAAAGCAGCTTGAGGATGGACGTACTTTGGCCGACTACAACATCCAGAAGGA
GTCTACTCTTCACTTGGTCCTCCGTCTCCGTGGTGGTTTCTAAACCTTGTCTCTCTCTTATGGTTACTGAACCAAGT
TCATGTATCGTTTCATCTAGTACTTTGGTGGTTTATGTTTTGGGGCCATGTACAGCCTCTGATAAATAATTGATCGACT
ATGTTTCCGTTA

> SEQ ID NO: 5394  105377 50818_300186_1b
CGACAATGTTAAAGCCAAAATCCAGGACAAAGAGGGCATACCACCTGATCAACAGAGGCTGATTTTTGCTGGTAAGCAA
TTGGAAGATGGCCGGACCTTAGCTGATTACAACATCCAGAAAGAGTCTACTCTTCATCTTGTCCTCAGGCTCAGAGGTG
GAACCATGATCAAGGTGAAGACACTCACTGGAAAAGAAATCGAGATTGATATCGAACCAACCGACACTATTGATCGGAT
CAAAGAACGTGTTGAAGAGAAAGAAGGCATCCCTCCTGTTCAACAAAGGCTCATATATGCCGGAAAACAGCTTGCTGAT
GACAAAACGGCCAAAGATTATGCGATAG

> SEQ ID NO: 5395  105377 48451_300376_1b
GCCATTACGGCCGGGGATAGAAGAGGAGTAGAAGATCGCTGGTGAGGGCGGAGAAAATGCAGATCTTCGTGAAAACTC
TGACGGGTAAAACTATAACCCTTGAGGTTGAATCCAGTGACACAATTGACAATGTCAAGGCCAAAATTCAAGACAAGGA

FIG. 2 continued

AGGAATTCCACCGGACCAACAAAGGCTGATTTTTGCTGGTAAGCAGCTTGAAGATGGCCGCACCCTTGCTGACTATAAC
ATTCAGAAAGAGTCGACTCTGCATTTGGTACTGAGGCTTCGTGGTGGAATTATTGAACCATCTTTGATGGCTTTGGCTA
GGAAGTACAATCAGGACAAAATGATTTGCCGCAAGTAGGTGCTATGCTCGTTTGCATCCTCGTGCTGTCAATTGCCGCA
AAAAGAAGTGTGGCCACAGTAACCAGTTGAGGCCCAAGAAGAAGATCAAGTAGATGGTGATTTTGAAGTCCCGGCAACA
TGTAGCTGCTAATGTTGAGATCCTTAAGAAAATTATTAGATATGTTGTTGGGTTGCCTGTTCAATTTACTCTGAAACAT
TGAAGGATTTGTGTTTGAGCTACTTCAATATTTCTTAATGAGCTAGATTCTGTTGGTTACATTACATAAGTTTTGCTCG
ATGTGTAGTTCTATGTGCTTTTATCCAGC

> SEQ ID NO: 5396 105405 38613_300209_1b
CCCACGCGTCCGTATGGAAAAGATCTGGCATCACACTTTCTACAATGAGCTTCGTATTGCTCCTGAAGAGCACCCTGTT
CTTCTTACCGAGGCTCCTCTTAACCCAAAGGCCAACAGAGAGAAGATGACTCAAATCATGTTTGAGACCTTTAACTCTC
CCGATATGTATGTCGCCATCCAAGCTGTTCTCTCCTTGTACGCCAGTGGTCGTACAACCGGTATTGTGCTGGATTCTGG
TGATGGTGTGTCTCACACTGTGCCAATCTACGAGGGTTTCTCTCTTCCTCATGCCATCCTCCGTCTTGACCTTGCTGGA
CGTGACCTTACTGATTACCTCATGAAGATCCTTACAGAGAGAGGTTACATGTTCACCACAACAGCAG

> SEQ ID NO: 5397 105405 280155_200066_1b
TCCTTACAGCGTTTCAACAGAGTGTTGTAGAGAGAGAAAGCGAGCCGGCCTTCGTCTTTGGTTGGCTTTGCTTCTCGGA
TCGATCTTCCTCTCTTTTTTCCTCTTTTGTTTTCAGGTGAATTAAGATGGCCGACGGCGAGGATATTCAGCCCCTTGTT
TGTGACAATGGAACTGGAATGGTTAAGGCTGGATTTGCTGGTGATGATGCTCCTCGAGCAGTGTTTCCCAGTATTGTGG
GTCGTCCTCGGCACACTGGTGTTATGGTCGGAATGGGACAGAAGGATGCTTATGTGGGTGATGAAGCTCAATCCAAGAG
AGGTATCTTAACCTTGAAATATCCTATTGAGCATGGTATAGTCAGCAACTGGGATGATATGGAGAAAATATGGCATCAT
ACTTTCTACAATGAGCTTCGAGTTGCTCCTGAAGAACACCCTGTTCTCCTGACTGAGGCACCCCTTAATCCTAAGGCCA
ACAGAGAGAAGATGACCCAGATTATGTTTGAGACATTTAACGTTCCAGCTATGTATGTTGCTATTCAGGCTGTGCTCTC
ATTGTATGCTAGTGGTCGTACTACTGGTATTGTGTTGGACTCTGGTGATGGTGTGAGTCACACTGTCCCTATCTATGAA
GGTTATGCTTTGCCCCATGCCATTCTTCGTTTGGATCTTGCTGGTCGTGACCTTACCGATAGCCTGATGAAGATCCTCA
CTGAGAGAGGATACATGTTCACCACCACCGCTGAACGGGAAATTGTCCGTGATATGAAAGAAAAGCTTGCCTATGTGGC
TCTTGACTATGAGCAGGAACTTGAAACTGCCAGGAGCAGTTCCTCCATTGAAAAGAACTATGAATTGCCAGATGGACAG
GTTATTACTATTGGTGCTGAAAGGTTCCGTTGCCCGGAAGTTCTCTTCCAACCATCGATGATCGGGATGGAAGCTGCAG
GTATCCATGAGACTACCTACAACTCCATCATGAAATGTGATGTGGATATT

> SEQ ID NO: 5398 105405 247054_301616_1b
GAGGTTTTAGGGTTTTTCCGGGCGCGATGTATGGTGGAGATGAGGTATCCGCCATTGTCGTCGATCTGGGATCGCATTC
TTGTAAAGCGGGCTATGCCGGAGAGGATGCGCCAAAGGCAGTGTTTCCATCGGTTGTAGGAGCTGTGGGGGAAAAGCCC
AACAGCACTTACTATGTTGGAAATCAGGCAATACAATATAGGCGTGATTTTATGGAGGTTTGCCCTGCATTGAAAGATG
GTCTCGTAGCAGATTGGGACATAGTTGAGGGCATCTGGGATCACGCTTTCAAGGAACGGCTCCTGATTGACCCGAAAGA
GCATCCAATGCTTCTCGCTGAGGCATCATTCAATCCTCAGCAACACAGGGAAAAGACTGTAGAGCTCATGTTTGAGAAA
TATGGTGTACCTGCGGTCTTTCTCGCTAAGAATGCTGTGCTTACGTCGTTTGCGTCTGGACGAGCTACATCTCTGGTTG
CCGACTGTGGTGGTGGCTCAACTACTGTTGCTGCAGTCCATGATGGCTATGTTTTGCACAAGGCTGTTTTCAGGTCTCC
CATCGGCGGCGAAGTCCTCACTGATTGCCTCTTAAAGATCTTAGAGTCGAAGAATGTTAATATCAGGCCGAGGTATTCG
TTCAAGAAGAAAGAACC

> SEQ ID NO: 5399 105405 253250_301624_1b
ACTGAGCGAATATGAGCGAACAACCAATTGTGCTAGATCAAGGAACCGGCTTTGTGAAAATCGGCTACGGAGGCACCAA
CTTCCCCGAACACACCTTCCCGTCGATGGTGGGTCGGCCCATTCTGCGGGCTGAAGAGCGGGCCACAGACACATACGGC
GACGTGGCCATCAAGGACATTATGTGTGGAGACGAGGCTGCCGCGGCACGAAACATGCTGCAGATCTCGTACCCGATGG
AGAACGGAGTGATTCGAAACTGGGAAGACATGGGTCACCTGTGGAACCACTCGTTTTACGACAAGATGAAGATTGACAC
CCGGGGTCGAAAGGTGCTGCTCACAGAGCCTCCCATGAACCCCCTCAAGAACCGGGAAAAGATGTGCGAGATCATGTTT
GAGCACTACGGCTTCAATGGCGTTTATGTAGCCATCCAGGCCGTCCTGGCTCTGTACGCACAGGGCCTGTCGTCAGGAG
TGGTGGTGGACTCTGGAGACGGTGTTACCCACGTGGTGCCTGTCTACGAGTCTGTGGTGCTCAACCACCTGACCCGTCG
TCTGGACGTCGCTGGTCGAGATGTCAACCGACAGCTGATTGCTCTGCTACTGCGACGAGGATACGCCTTCAACCGAACT
GCCGACTTCGAGACCGTGCG

> SEQ ID NO: 5400 105405 253058_301648_1b
ATTTCATCGACAAATCTCTTTGCTACCAACAACCACACAAATTAAAAATGGAAGACGAAACTGTTGCCCTCGTTATCGA
TAACGGATCCGGTATGTGCAAGGCCGGTTTCGCCGGTGATGACGCTCCCCGAGCTGTTTTCCCCTCCATCGTCGGTCGA
CCCCGACATCAGGGTGTCATGGTCGGCATGGGCCAGAAGGACTCCTATGTTGGTGATGAGGCCCAGTCCAAGCGAGGTA
TCCTGACCCTCCGATACCCCATCGAGCACGGTATTGTTACCAACTGGGATGACATGGAGAAGATCTGGCACCACACCTT
CTACAACGAGCTCCGAGTTGCTCCTGAGGAGCACCCCGTCCTGCTCACCGAGGCCCCCATCAACCCCAAGTCCAACCGA

```
GAGAAGATGACCCAGATCTTCTTCGAGACTTTCAACGCTCCCGCTTTCTACGTCTCTATCCAGGCCGTCCTCTCCCTGT
ACGCCTCTGGTCGAGTCACCGGTATCGTTCTTGACTCTGGTGATGGTGTCACCCACGTTGTGCCCATCTACTCTGGTTT
CTCTCTCCCCCACGCCATCATGCGACTCGATATGGCTGGCCGAGATCTTACCGACTACCTCATGAAGATTCTCTCCGAG
CGAGGTTACTCTTTCACCAACTCCGCCGAGCGAGAAATCGTCCGAGACATCAAGGAG

> SEQ ID NO: 5401  105405 111416_300055_1b
ATAGCCAACCGTGGACACCACTAATTTACTCCTCCTAAAGCTCCCTCTTTTTTACACAAAGTAGATAAAACATGGCAGA
CGGTGAGGATATTCAGCCACTCGTCTGCGATAATGGGACTGGAATGGTCAAGGCAGGGTTTGCTGGAGATGATGCTCCA
AGAGCAGTATTTCCGAGTATTGTTGGTCGCCCACGCCACACAGGTGTGATGGTTGGCATGGGGCAAAAAGATGCATATG
TTGGTGATGAAGCTCAATCCAAACGTGGTATTCTAACTTTGAAATATCCAATTGAACATGGTATTGTTAGCAACTGGGA
TGATATGGAGAAAATCTGGCATCACACGTTCTACAACGAACTTCGTGTTGCACCAGAGGAGCATCCTGTACTACTCACT
GAAGCACCTCTTAACCCGAAGGCTAATCGCGAAAAAATGACTCAAATCATGTTTGAGACATTTAATGCTCCTTCTATGT
ATGTCGCCATTCAAGCCGTTCTGTCCCTTTATGCTAGTGGTCGTACAACAGGTATTGTCCTGGATTCTGGTGATGGTGT
TAGCCACACTGTCCCAATCTATGAGGGATATGCTTTGCCACATGCTATCCTCCGTCTTGATTTAGCCGGTCGTGACTTG
ACCGATCACCTAATGAAAATCTTAACAGAGCGCGGTTACTCGTTCACTACTAGTGCTGAACGAGAAATTGTGAGGGATG
TGAAGGAAAAACTCTCCTACATTGCGCTTGACTTTGAGCAGGAAATGGACACGTCGAAAACTAGCTCTTCTGTTGAGAA
GAGCTACGAGTTGCCCGATGGTCAAGTGATTACCATCGGTGCTGAGCGTTTCCGATGCCCTGAAGTCCTTTTCCAACCT
TCAATGATTGGAATGGAAGCTGCAGGCATTCACGAAACGACTTACAACTCGATCATGAAGTGCGACGTGGATATCAGAA
AAGATCTGTACGGAAATATTGTACTCAGTGGCGGTTCAACTATGTTTCCTGGAATTGCTGATAGAATGAGCAAGGAAAT
TACTGCATTGGCACCTAGCAGTATGAAAA

> SEQ ID NO: 5402  105405 1118929_301892_1b
AACAAGGAATCCACATCTAGGGTTCGCTTTCTTTGCCTCTCTCAGCTCAATATCCTCCCTCCTGGAGTTATACTAAAGC
CAGAAGATGGCAGACGCTGATGAGGTGCAGCCCCTTGTCTGTGACAATGGAACAGGAATGGTTAAGGCTGGGTTTGGTG
GTGACGATGCTCCTCGTGCAGTCTTTCCTAACATTGGGGGAAGGGCCAGGCATACTGGTGTCATGGTAGGCATGGGGCA
AAAAGATGCATATGTGGGTGATGAGGCACAATCGAAAAGAGGAATATTGACACTCAAGTATCCCATCGAACATGGCATA
GTTACCAATTGGGATGACATGGAGAAGATATGGCACCATACCTTCTATAATGAGCTCCGAGTGTGCCCTGAAGAGCACC
CCGTCCTACTTACTGAGGCCCCTATGAAACCTAAAGCCAATCGTGAGAAGATGAGCCAGATCATGTGCGAGACCTTCAA
TGTGCCCGCGATGTATGTATCTATCCAGACAGTCTTGTGCCTTTATGCCAGTGGACGAACTACTGGTATAGTGCTGGAT
TCACGAGATGGTGTGTCTCACACGGTCCCTATAT

> SEQ ID NO: 5403  105405 146560_301066_1b
CTAAACTCTTTTTCTCTCTACAATTTCGAAGGAAGTAGCATGAGATGGCAGATGGAGAGGATATTCAGCCACTTGTCTG
TCACAATGGAACAGGAATGGTCAAGGCTGGGTTTGCTGGAGATGATGCTCCACGAGCTGTATTCCCTAGTATTGTTGGC
CGGCCCCGCCATACTGGTGTGATGGTGGGTATGGGTCAGAAAGATGCCTACGTGGGAGATGAAGCTCAATCAAAAAGAG
GTATTTTAACTCTTAAATACCCAATTGAGCATGGAATTGTCAGCAACTGGGATGATATGGAGAAGATCTGGCATCATAC
TTTCTACAATGAGCTTCGTGTTGCGCCCGAGGAGCATCCGTCTCTTAACTGAAGCGCCTCTTAACCCAAAGGCTAAT
CGTGAAAAGATGACCCAGATTATGTTTGAGACTTTTAATACCCCAGCTATGTATGTTGCTATTCAGGCTGTCCTCTCAC
TGTATGCCAGTGGTCGTACCACCGGTATTGTGTTGGACTCTGGTGATGGTGTCAGCCACACCGTCCCAATTTATGAGGG
GTATGCCCTCCCACATGCCATTCTCCGTCTTGACTTGGCAGGCCGTGACCTCACTGATAGTTTGATGAAGATCCTTACC
GAGCGTGGTTACATGTTCACCACCTCAGCTGAGCGGGAAATTGTCAGGGACGTGAAAGAAAAGCTTGCTTACATAGCTC
TTGACTATGAACAGGAACTCGAGACTGCAAAGACCAGCTCTTCTGTAGAGAAGAACTATGAGCTACCGGATGGGCAGGT
GATCACCATTGGTGCTGAGCGTTTCCGTTGTCCTGAGGTCCTTTTCCAACCATCAATGATTGGAATGGAAGCTGCAGGA
ATCCACGAGACTACATACAACTCTATCATGAAGTGTGAT

> SEQ ID NO: 5404  105405 135394_300413_1b
GGCCGGTTTTGCTGGTGATGAGGCACCCAGGGCTGTCTTTCCTAGCATTGTAGGCAGGCCACGCCACACTGGTGTCATG
GTTGGTATGGGCCAGAAGGATGCCTATGTGGGTGATGAAGCTCAGTCGAAAAGAGGTATACTGACATTGAAATACCCAA
TCGAGCATGGTATTGTCAACAACTGGGATGACATGGAGAAGATATGGCACCACACCTTCTACAATGAGCTCCGTGTGGC
TCCTGAAGAGCATCCTGTATTGCTGACCGAGGCTCCTATGAACCCCAAGGCAAACAGAGAGAAGATGACCCAGATCATG
TTCGAGACCTTCAACTGCCCAGCGATGTACGTTGCCATCCAGGCCGTTCTTTCGTTGTATGCCAGTGGTCGAACAACTG
GTATTGTACTTGACTCTGGTGATGGTGTAAGTCACACTGTTCCAATATACGAAGGATTTACACTCCCGCATGCTATTCT
TCGACTCGATCTTGCTGGGCGTGACCTTACCGACAACCTTATGAAGATTCTCACAGAGAGGGGTTACTCCTTCACCACA
ACTGCTGAGCGGGAAATTGTTAGAGACATAAAGGAGAAGCTCGCCTATGTTGCTCTTGATTATGAACAGGAGCTTGATA
CTGCCAGGAGTAGCTCCTCTATTGAGAAGAGCTATGAGCTGCCTGACGGCCAGGTCATCACCATCGGAGCAGAAGGTT
CAGGTGCCCGGAGGTGCTCTTCCAGCCATCTTTTATTGGTATGGAAGCTCCTGGCATCCATGAAGCCACATACAACTCC
ATCATG
```

FIG. 2 continued

> SEQ ID NO: 5405 105405 133730_300417_1b
CGGAGGAGCACCCCGTCCTCCTCACCGAGGCTCCTCTCAACCCCAAGGCCAATCGTGAGAAGATGACCCAGATCATGTT
TGAGACCTTCAACACCCCTGCTATGTACGTCGCCATCCAGGCCGTCCTCTCTCTGTATGCCAGTGGTCGTACCACAGGT
ATTGTGTTGGACTCTGGTGATGGTGTCAGCCACACTGTCCCCATCTATGAAGGATATGCTCTCCCCCATGCTATCCTTC
GTCTCGACCTTGCTGGGCGTGATCTCACTGATTACCTCATGAAGATCCTGACGGAGCGTGGTTACTCATTCACCACAAC
GGCCGAGCGGGAAATTGTGAGGGACATGAAGGAGAAGCTTTCCTACATCGCCCTGGACTATGACCAGGAAATGGAGACT
GCCAAGACCAGCTCCTCCGTGGAGAAGAGCTACGAGCTTCCTGATGGACAGGTTATCACCATTGGTGCTGAGCGTTTCC
GCTGCCCTGAGGTCCTCTTCCAGCCTTCCTTCATAGGAATGGAAGCTGCGGGTATCCATGAGACTACATACAACTCCAT
CATGAAGTGCGACGTGGATATTAGGAAGGATCTATATGGCAACATCGTTCTCAGTGGTGGTACCACTATGTTCCCTGGC
ATTGCTGACAGGATGAGCAAGGAGATCACTGCCTTGGCTCCTAGCAGCATGAAGATCAAGGTGGTCGCCCCTCCTGAAA
GGAAGTACAGTGTCTGGATTGGAGGATCCATCTTGGCATCTCTCAGC

> SEQ ID NO: 5406 105405 127823_300473_1b
CTTCACCCGCTATTCAGTCAAACAGCAAAAAGGGTTTGATTTCAATCAAGTCCTTAGAAGATGGCTGAAGGTGAGGACA
TTCAACCACTCGTTGTTGACAATGGAACTGGAATGGTTAAGGCTGGCTTTGCTGGAGACGATGCTCCAAGGGCTGTATT
TCCTAGTATAGTTGGTCGTCCTAGACACCAAGGAGTAATGGTCGGGATGGGGCAAAAAGATGCCTATGTTGGTGATGAA
GCTCAGTCTAAAAGAGGTATTCTGACTTTGAAATATCCGATTGAACATGGTATTGTCAGCAACTGGGATGACATGGAGA
AAATTTGGCATCATACATTTTACAATGAGCTTCGTGTTGCTCCCGAGGAGCATCCTGTTCTTCTTACTGAGGCACCACT
TAACCCCAAGGCAAACCGAGAGAAAATGACCCAGATCATGTTTGAGACCTTCAATGTGCCAGCCATGTATGTTGCAATC
CAGGCCGTTCTTTCTCTGTATGCTAGTGGTCGTACTACTGGTATTGTGCTTGATTCTGGTGATGGTGTGAGCCACACTG
TCCCCATCTATGAGGGATATGCACTTCCCCATCTTGAGGTTAGATCTTGCTGGTCGTGATCTTACTGATTATCT
CATGAAGATTCTCACTGAGAGAGGTTATATGTTTACCACATCTGCTGAACGGGAAATCGTTCGTGATGTGAAGGAGAAG
CTTGCCTATGTCGCATTGGATTTTGAACAGGAGCTTGAGACAGCAAAGAGTAGCTCATCAGTTGAGAAGAGCTATGAGC
TTCCTGATGGACAAGTAATTACTATTGGTGCTGAGAGGTTCCGTTGCCCTGAAGTCCTCTTCCAGCCATCATTGATTGG
AATGGAAGCAGCAGGAATTCATGAAACAACCTATAACTCAATCATGAAATGTGATGTGGACATTAGGAAGGATTTATAT
GGAAATATTGTACTCAGTGGTGGATCAACTATG

> SEQ ID NO: 5407 105405 11955_300070_1b
TGGTATCAACGCAGAGTGGCCATTACGGCCGGGGGGGTTTCATTTGAATTTTTCTTGTTTTTGCATTTGGAACTCATAG
CCAACCGTGGACACCACTAATTTACTCCTCCTAAAGCTCCCTCTTTTTTACACAAAGTAGATAAAACATGGCAGACGGT
GAGGATATTCAGCCACTCGTCTGCGATAATGGGACTGGAATGGTCAAGGCAGGGTTTGCTGGAGATGATGCTCCAAGAG
CAGTATTTCCGAGTATTGTTGGTCGCCCACGCCACACAGGTGTGATGGTTGGCATGGGGCAAAAAGATGCATATGTTGG
TGATGAAGCTCAATCCAAACGTGGTATTCTAACTTTGAAATATCCAATTGAACATGGTATTGTTAGCAACTGGGATGAT
ATGGAGAAAATCTGGCATCACACGTTCTACAACGAACTTCGTGTTGCACCAGAGGAGCATCCTGTACTACTCACTGAAG
CACCTCTTAACCCGAAGGCTAATCGCGAAAAAATGACTCAAATCATGTTTGAGACATTTAATGCTCCTTCTATGTATGT
CGCCATTCAAGCCGTTCTGTCCCTTTATGCTAGTGGTCGTACAACAGGTATTGTCCTCGATTCTGGTGATGGTGTTAGC
CACACTGTTCCAATCTATGAGGGATATGCTTTGCCACATGCTATCCTTCGTCTTGATTTAGCCGGTCGTGACTTGACCG
ATCACCTAATGAAAATC

> SEQ ID NO: 5408 105405 229260_301041_1b
GCGTGGACAGGGCGCAAGGGCGGCGGCGGTCATCGCGCGGCGGCCCGGATCTTTACCGAAATCCATTCTTTCTCCGCGC
TAAGAGGCAGCCATGTCGGAAACCGAGGATGTCCAGCCGCTCGTCTGCGACAATGGATCCGGAATGGTCAAGGCCGGAT
TTGCCGGAGACGATGCCCCCCGTGCCGTGTTTCCAAGCATCGTGGGTCGCCCACGGCACACTGGGGTCATGGTTGGAAT
GGGTCATAAGGATGCCTATGTTGGAGACGAGGCCCAGTCCAAGCGTGGAATCTTGACCCTAAAGTACCCGATCGAGCAT
GGCATTGTTACCAACTGGGACGATATGGAGAAGATATGGCACCATACCTTCTACAATGAGCTCCGTGTCGCCCCCGAGG
AGCACCCGGTTCTCCTCACCGAGGCACCGCTCAACCCCAAGGCCAACCGCGAGAAGATGACGCAGATCATGTTCGAGAC
CTTCAACGTTCCCGCAATGTACGTTGCGATCCAGGCGGTGTTGTCGCTCTACGCCAGCGGTCGGACAACTGGTATTGTG
CTCGATTCTGGTGATGGTGTTACGCACACTGTGCCTATCTACGAGGGATATGCTTTGCCGCATGCCATTTTA

> SEQ ID NO: 5409 105405 216857_300902_1b
TTTCGACCTCTTTCTTCCCCCTTCAAGCTAACCCTCGAGATCCTGGGATCGCGCGAGCTTCTTCTTTTGTCTCTTACCA
ACTTTTCCATCAGCTTCATACATTAATCAGTCACAATGGAGGAAGAAGTTGCTGCCCTCGTCATCGACAATGGTTCCGG
TATGTGCAAGGCCGGTTTCGCCGGTGATGACGCTCCCCGAGCTGTTTTCCCCTCCATTGTCGGAAGACCCCGTCACCAT
GGTATCATGATCGGTATGGGTCAGAAGGACTCCTACGTCGGTGATGAGGCTCAGTCCAAGCGTGGTATCTTGACACTGA
GATACCCCATCGAGCACGGTGTCGTCACCAACTGGGACGACATGGAGAAGATCTGGCACCACACCTTCTACAATGAGCT
GCGTGTTGCCCCCGAGGAGCACCCCGTCCTGCTCACCGAGGCCCCCATCAACCCCAAGTCCAACCGTGAGAAGATGACC
CAGATCGTCTTCGAGACCTTCAACGCCCCCGCCTTCTATGTCTCTATCCAGGCCGTTCTGTCCCTGTACGCTTCCGGTC
GTACCA

FIG. 2 continued

> SEQ ID NO: 5410 105405 181575_300656_1b
TCCACGAATTCAGGGGAGAAAAACTTCTCCTCCACAATCTGCTCCCTCTCTCAATAAAGGCAAGGTATAAATTATGGCG
GGCGCTGACGACATTCATCCACTTGTATGTGACAATGGAACTGGAATGGTGAACGCTGGATTTGCTGGTGATGATGCTC
CAAGGGCTGTATTCCCTAGTATTGTCGGTAGGCCTAGGCACACAGGTGTTATGGTTGGAATGGGTCAGAAGGATGCCTA
TGTTGGGGATGAGGCACAGTCTAAGAGAGGTATTCTTACTTTGAAGTACCCTATGGAGCATGGAATTGTGAGCAACTGG
GATGACATGGAAAAGATCTGGCATCATACCTTCTACAACGAACTGCGTGTGGCTCCTGAAGAACATCCTGTTCTCCTTA
CTGAAGCCCCTCTGAACCCTAAAGCCAACAGAGAGAACATGACGCAAATCATGTTTGAAACTTTCAATGTCCCTGCCAT
GTATGTTGGTATTCAAGCTGTGCTTTCCCTTTATGCCAGTGGCCGTACCACAGGTATTGTGCTCCACTCTGGTGATGGT
GTCAGCCACACTGTCCCCATCTACG

> SEQ ID NO: 5411 107101 227452_301028_1b
AGAAAAGATCAAAGAAATCAATTCTATACCATGGTCTTTTCTTCGGTTCCGGCCGTCTATCTTGATCCACCCAATTGGA
ACCAGCAGCAACAGCAAGCTCACCACGGTCAGCTTCCAAGTGGCGGCAACGGCGGCGGCGGCGGCGGCGGCGGAGGTGG
AGTGGACGCGCACCACCACCACCACCACCACCACCACCAGCTGCCGCCGATGCCGCCGTATCACGGCGGCCTCATGGCG
CCTCGGCCTGACATGGTAGCAGCGGCCGTCGCGGCGAGCGGCGGCGGCGGCGGTGGCGGCGGCGGCCCCGACCGGCGGC
CGGTGCGGCCGGGCTCGATGACGGAACGGGCTCGGCTGGCGAAGATCCCGCAGCCGGAGCCGGGGCTCAAGTGCCCGCG
CTGCGAGTCCACCAACACCAAGTTCTGCTACTTCAACAACTACTCGCTCTCGCAGCCGCGCCACTTCTGCAAGACGTGC
CGCCGCTACTGGACGCGCGGCGGAGCGCTCCGCAACGTCCCCGTCGGCGGCGGGTGCCGCCGCAACAAGCGCACCAAGT
CGTCCAAGTCGTCCTCGTCGACGTCGGCCGCCGGCTCGGCCTCCGCCACCGGCGGCACGTCGTCGTCCACATCGTCGAC
CGCCACGGGTGGCAGCAGCAGCGC

> SEQ ID NO: 5412 107101 263261_301393_1b
TCAGTTTTTCTCCGCTCTGTTCATAGCCAGATCGGTCCATGGGTTATTATTATTATTACCCGGTTCGGTTCTCCTCAAA
CCCAAACCCATACCCGGATGATCCCAACCCGACCCGTCAAGCATGATCCCTCCTCCAAGACCAAGCTGCATATTAT
TCGCCAACAACGAGCTAAAGCTTCCACCAATCCATACCCTTCACGTCTTGGTCACCGATCGGAAACCCGTAAAGCAT
CCGGGTCGGATCCAAATCCGGTTTTTGAGAATTACGTGGATCAGGATCCGGATCCGGGTTTTTCGTCTTCTTGTTTTGG
CTACTGTTGGAAGGAGAGGAAGCAGAAGAAGAAGAAGAAGTGGATCGTTTGGTTGCGTTCTTACGAGAACCACCACCGA
CGGGAACGTTACGGAGGGCGCCGCCTTTAGTCCAGTAACGACGACAGCTTTTGCAAAAGTGACGAGGCTGTGAGAGATT
GTAGTTGTTGTAGTAACAGAATTTAGTGTTTGGTGAGTCACAACGAGGACACTTTAACTGTTCTTGCTCTGCAAACTGT
GGTTGTTGTTGTTGTTGCTTCGCCATCATCGTCTGGTAATATGCTGCTGGATCCTGCATGCTGC

> SEQ ID NO: 5413 107101 291446_200079_1b
GGGAAGAATCATATATCAGGAGAGCTCAGCAAAACCAAGTCAGAGGAGAAAGATCAAAATCAAATGATGGAAGGTTCAG
AAGATCCTAAGCTTTCATCAGAATCTGACAACAATCCAAAAACTCCTAATATTGATGAAGATTCACCTGCAATAAAAAC
ATCCAAGACTAAAAATGATCCGAATGATGCATCAAATTCTCAGGAGAAACCTCTTAAGAAGCCAGATAAAATTCTTCCA
TGCCCCCGTTGTAATAGTATAGATACCAAATTCTGCTACTATAACAATTACAATGTCAACCAGCCTCGACATTTCTGCA
AGAGCTGCCAGAGATATTGGACTGCTGGTGGTACCATGAGGAATGTGCCTGTCGGAGCTGGTCGTCGCAAGAACAAGAA
TTCTGCACCGCATTGTCGTCACATCACAATCCCTGAAGCCCTCCAAGCGGAAAGAATCGATCCTCCAAATGGATTTCAT
CATCCAACGTTCAAACCCAATGGTATTGTACTATCCTTTGGGCCTGACTCACCCCTTTCTGAATCTATGGCTTCTATTC
TTAGCCTTTCAGAGAAAAAGGTACCAAACGGGATTCATAACGGTTTCTATGGGCCTGAAAACAAGAACTCGTTTCGCGA
AGGTGGAGAAAATGGGGATGACTGTTGTGGTGGATCTTCAGTCACTACATCAACTTCAATGGTCGAT

> SEQ ID NO: 5414 107101 28880_300151_1b
CCCTCGACCCACGCGTTCGAGATAAACCTCTCTGCTTTAAAAGAATCTGCTATACTCAGAGTTGCAGGTTTTAAAGTTG
GCAAATGTGAAATCTCGCCGGAAATTTCACCGGAAAACGTTAATATAAGTTGCTACATTCATTTTTACAGTATTTTTTG
AGAAATGCAAGATATACATCCGATCGGGGCGGTGGAGGACGGTTTTTTGGTGGTGGAGGAGACAGGAGGTTAAGGCCTA
ACCATCACCAAAACCAGCAAGTTTTAAAGTGTCCACGTTGCGATTCTCCAAACACCAAATTCTGTTACTATAACAACTA
CAATCTCTCTCAGCCGAGACACTTTTGCAAAAGTTGCCGGAGATACTGGACTAAAGGCGGCGTCCTTCGTAACGTCCCC
GTCGGTGGTG

> SEQ ID NO: 5415 107421 157115_301735_1b
GTGAGCAGCATGTTGGCAAAGGGCTTCATCTTGGGCAAGGATGCAGTTAACAAAGCAAAGACATTTGATGAGAAACACC
AGTTCATATCCACTGCCTCAGCCAAAGTTGCTTCACTAGACCAAAAAATTGGACTTAGTGAGAAAATCAATATGGGAAC
AACTATTGTGAATGACAAAGTGAAAGAAATGGACCAGAAGTTCCAAGTTACTGAAAAGACAAAATCAGCTTTAGCAGCT
GCTGAGCAGACAGTTAGCACTGCTGGATCTGCCATCATGAAGAACAGATATGTTTTGACAGGGGCATCTTGGGTTACTG
GTGCTTTCAATAAGGTCACCAAGGCTGCAGGGGAAGT

FIG. 2 continued

> SEQ ID NO: 5416 107594 1007670_301402_1b
GCTGAACAGGATCGCCTCTCATTCTCTCTCTTCCCCTGGAGATCTGTTGATTCCCCCCATCCAGCCAACATGCGTGAGA
TATTGCACATCCAGGGTGGGCAGTGTGGCAACCAGATTGGTGCCAAGTTCTGGGAGGTAGTATGTGCAGAGCACGGCAT
TGATCCCACTGGCAAGTACACAGGGAACTCAGATCTGCAGCTGGAGAGGGTGATTTTGTACTACAACGAGGCTAGTGG
GGTCGCTATGTTCCTCGAGCAGTGCTCATGGATCTGGAGCCTGGCACCATGGACAGTGTGCGCACTGGCCCCTTTGGCC
AGCTCTTCCCGCCCTGATAACTTCGTCTTTGGCCAGAGTTGGGGCTGGCAACAATTGGGCTAAGGGCCCTTACACTGAG
GGTGCCGAGCTTATTGATTCTGTCCTTGATGTTGTCCGCAAGGAGGCAGAGAATTCTGACTGTCTTCAAGGGTTTCAAG
TATGCCACTCTCTAGGTGGAGGCACTGGATCAGGGATGGGCACTTTGCTGATATCAAAGATCAGGCAAGAGTACCCTGA
CCGGATGATGCTTACATTTTCTGTCTTCCCCTCTCCCAAAGTGTCGGACACGGTTGTGGAGCCATACAATGCTACCTTG
TCCGTCCACCAGCTTGTGGAGAATGCAGATGAGTGTATGGTGCTTGA

> SEQ ID NO: 5417 107594 1046613_301977_1b
TAGCCCTATCACCATGAGGGAGTGCATCTCAGTCCACATTGGGCAGGCCGGTATCCAGGTCGGCAATGCCTGCTGGGAA
CTCTACTGCCTCGAGCATGGCATCCAGCCGGATGGGCAGATGCCAAGCG

> SEQ ID NO: 5418 107594 1097904_301456_1b
AAGGTTTCTGAGGGGCGTCTTAATAAACGCCTACACAGAAGCCTCTCTCTCTCTCTATTGTATCTTGTAAGGATGAG
GGAGTGCATCTCGATCCATATAGGGCAGGCTGGTATTCAGGTTGGCAATGCCTGTTGGGAGCTCTACTGCCTTGAACAT
GGCATCAAGCCCGATGGTCAGATGCCTAGTGA

> SEQ ID NO: 5419 107594 1172003_302059_1b
GTCGGCAAAGATAAAACCAAGACCCCCCCCTAGTAGTAGTACTACTGCCCATCACTCTCCCTCCTTTCCTTGTTGTTTG
TAGTGCTTGTGTTGGGGCACCATAAACCCTAGGAATTTGCTGAGCCTTGTGGGAAGCAAAGATGAGGGAGATAATCAGT
GTGCACATAGGGCAGGCCGGAATCCAGGTGGGGAATGCATGCTGGGAGCTGTACTGCCTCGAACACGGGATCCAGCCTG
ATGGTCGTATGCCCAGTGACAAGTCCGTGGGGGTTGCGGATGACGCGTTCAACACGTTCTTCAGTGAGACGGGAGGTGG
GAAGCACGTGCCCAGGGCCATCTTTGTGGATCTGGAGCCCACTGTGATTGATGAAGTCCGCACTGGGACTTACCGCCAG
CTCTTTCACCCGGAGCAGCTCATCTCCGGCAAGGAGGATGCTGCCAACAACTTTGCCCGGGGCCATTACACGGTGGGCA
AAGAGATTGTTGATCTATGCTTGGACCGAGTGAGGAAGCTGGCGGACAATTTGTACTGGCTTGCAAGGCTTCTTGGTCT
TCAATGCTGTGGGAGGCGGCACTGGATCCGGTCTTGGTTCCCTCTTACTAGAACGCCTCTCTGTTGACTATGGCAAAAA
ATCGAAGCTTGGATTCACAATCTATCCCTCCCCTCAAGTGTCGACTGCGGTTGTGGAGCCATATAACAG

> SEQ ID NO: 5420 107594 137660_300726_1b
CGCAGAGAAAGGCGTCTTCGTACTCGCCTCTCTCCGCGCCTCCGCGCTTTTCCTCCTCCTCTCCCCTCTCTCCCTTCTC
CGCCGCCGTCGCAGCATCAACCCAATCCGCCGCCATGAGGGAGTGCATCTCGATCCACATCGGCCAGGCCGGTATCCAG
GTCGGGAACGCGTGCTGGGAGCTCTACTGCCTCGAGCATGGCATCCAGGCTGATGGTCAGATGCCCAGTGACAGGACTG
TTGGTGGAGGTGATGATGCTTTCAACACCTTCTTCAGTGAGACTGGTGCTGGGAAGCATGTTCCCCGTGCTGTATTTGT
TGATCTTGAGCCTACTGTGATTGATGAGGTGAGGACTGGTTGCTACCGCCAGCTCTTCCACCCTGAGCAGCTCATCAAT
GGCAAGGAGGATGCAGCTAACAACTTTGCCCGTGGTCACTACACCATTGGCAAGGAGATTGTTGATCTGTGCCTTGACC
GCATCAGGAAGCTTGCTGACAACTGCACTGGTCTCCAAGGTTTCCTTGTGTTCAACGCTGTTGGAGGTGGAACGGGCTC
TGGTCTTGGTTCCCTTCTCCTGGAGCGCCTTTCTGTGGACTATGGCAAGAAGTCCA

> SEQ ID NO: 5421 107594 136924_300440_1b
CCCCCGCTACCACACCGCAGAGAAAGGCGGGGTCGTACTCGCCTCTCTCCGCGCCCTCCTCCGCCGCCGCTCGCCGCCG
TTCGTCTCCGCCGCCACCGCCGCCGCCATGAGGGAGTGCATCTCGATCCACATCGGGCAGGCCGGTATCCAGGTCGGGA
ACGCGTGCTGGGAGCTCTATTGCCTCGAGCATGGCATCCAGCCTGATGGACAGATGCCTGGTGACAAGACCGTTGGGGG
AGGTGATGATGCTTTTAACACCTTCTCAGTGAGACTGGTGCTGGGAAGCATGTCCCCCGTGCTGTCTTCGTCGATCTT
GAGCCTACCGTGATTGATGAGGTGAGGACTGGTGACTACCGCCAGCTCTTCCACCCTGAGCAGCTCATCAGTGGCAAGG
AGGATGCAGCCAACAACTTTGCCCGTGGTCACTACACCATTGGCAAGGAGATTGTTGATCTGTGCCTTGACCGCATCAG
GAAGCTTGCCGACAACTGCACTGGTCTCCAGGGCTTCCTTGTGTTCAACGCTGTTGGAGGAGGAACGGGCTCCGGTCTC
GGTTCCCTTCTCCTTGAGCGTCTCTCTGTGGACTATGGCAAGAAGTCCAAGCTCGGGTTCACCGTGTACCGTCCCCTC
AGGTCTCCACCTCTGTGGTTGAGCCATACAACAGTGTCCTCTCCACCCACTCCCTCCTTGAGCACACCGATGTCGCTGT
CCTGCTCGACAATGAGGCCATCTATGACATCTGCCGCCGCTCCCTCGACATTGAGCGCCCAACCTACACCAACCTCAAC
AGGCTTGTGTCCCAGGTCATCTCCTCACTGACTGCCTCCCTGAGGTTCGATGGTGCTCTGAATGTGGATGTCAACGAGT
TCCAGACCAACCTGGTGCCCTACCCGAGGATCCACTTCATGCTTTCCTCCTACGCCCCGGTGATCTCGGCCGAGAAGGC
CTACCACGAGCAGCTCTCCGTGGCGGAGATCACCAACAGCGCCTTCGAGCCGTCCTCCATGATGGCCAAGTGCGACCCG
CGCCACGGCAAGTACATGGCGTGCTGCCTGATGTACCGCGGCGACGTGGTCCCCAAGGACGTGAACGCCGCGGT

FIG. 2 continued

> SEQ ID NO: 5422 107594 135682_300416_1b
CCCACGCGTCCGCCCACGCGGGCGCCCACGCGTCCGCCCACGCGTCCGCTGTCTTCCTCTGAACCCTGAACCAATCCCG
AACTCTGAACTCTGAAGGCTGCAGAGACAGGCAGAGAGATATGAGGGAGATAATAAGCATCCACATAGGGCAGGCGGGC
ATCCAGGTGGGGAATTCTTGCTGGGAACTATACTGCCTCGAGCATGGCATCCAGCCGGACGGCCTCATGCCCAGCGACA
CAACTCCTGGAATTGCAAGGGATGCATTCAACACGTTCTTCAGCGAGACGAGTTCAGGCAAGCACGTCCCAAGGGCGTT
GTTCGTCGACCTGGAGCCCACGGTGATTGATGAGGTGAAGACCGGGCCATACCGCCAGCTCTTCCACCCAGAGCAGCTC
ATCTCCTACAAGGAAGACGCTGCTAACAACTTTGCTCGTGGGCACTACACAGTTGGAAGAGAGGTGGTAGATCTTTGCC
TTGATCGACTAAGAAAACTGGCAGATAACTGCACTGGTCTCCAAGGTTTTCTGGTTTTCAATGCTGTTGGTGGAGGAAC
CGGCTCTGGACTTGGTTCATTACTTTTAGAGCGCCTA

> SEQ ID NO: 5423 107594 129404_300479_1b
GAATTCATCCTTCTTCTTTCTCTGGTCTCACCGTCTCAGATCCTCTCTTTTTCTCCATCGAAATACCCAAAAAATGAGG
GAATGCATCTCAATCCACATTGGCCAAGCAGGGATCCAAGTTGGAAACGCCTGTTGGGAACTTTATTGCCTTGAATATG
GAATACAGCCTGATGGACAAATGCCGAGTGACAAAACTGTCGGCGGAGGAGACGATGCTTTCAATACGTTTTTCAGTGA
AACGGGTGCAGGAAAACACGTACCTCGTGCCATTTTCGTAGATCTTGAACCTACTGTTATCGATGAAGTACGAACTGGT
ACTTACCGTCAATTGTTCCATCCTGAACAACTTATTAGCGGCAAAGAAGATGCAGCTAATAACTTTGCTAGAGGCCATT
ACACAATTGGGAAGGAGATTGTGGATCTATGCCTTGATAGGATCAGAAAGCTTGCCGATAATTGCACTGGGCTACAAGG
GTTTTTGGTATTTCATGCTGTTGGTGGTGGTACAGGATCTGGTCTTGGATCTCTACTTCTTGAGAGACTCTCTGTTGAT
TATGGAAAGAAATCGAAATTGGGGTTTACTGTTTACCCGTCTCCACAGGTTTCAACTTCTGTGGTTGAACCCTACAACA
GTGTTTTGTCTACTCATTCTCTTTTGGAGCACACTGATGTATCTGTACTACTTGATAATGAAGCTATTTATGATATC

> SEQ ID NO: 5424 107594 128811_300478_1b
CCCCCCCCCCCGGTCCCTACATTTATCTGGGTCTTCAATCTTTCACTCTTCTCTGCCGCCTCTCATTTCTGAGATCTAC
GCATTTTCTTCAAATTTCTGCATCTTCTTTTCCAGATCTCAGTTTAAAAAATGCGTGAAATCCTTCACATTCAAGGTG
GACAATGCGGCAACCAAATCGGTGCCAAGTTCTGGGAAGTTGTTTGTGCCGAACACGGCATTGATTCCACCGGCCGTTA
CAACGGCGATTCAGATCTCCAGCTTGAGAGAATCAATGTCTATTACAATGAGGCTACCTGTGGAAGGTTTGTTCCTAGG
GCTGTTCTTATGGATCTGGAACCTGGTACCATGGACAGTATCAGATCTGGTCCGTACGGTCAGATCTTTAGGCCTGATA
ACTTCGTGTTTGGTCAGTCTGGTGCTGGCAACAATTGGGCTAAAGGACATTACACTGAAGGCGCTGAATTGATTGATGC
TGTCCTTGATGTTGTTCGTAAGGAAGCTGAAAATTGTGACTGCCTTCAAGGATTTCAAGTGTGCCACTCATTGGGTGGA
GGTACGGGATCTGGAATGGGAACCCTTCTGATATCAAAGATCAGAGAAGAATATCCCGATAGAATGATGCTTACGTTCT
CAGTTTTCCCGTCTCCTAAGGTTTCTGACACTGTTGTTGAGCCTTATAATGCTACTTTGTCGGTGCATCAGTTGGTTGA
GAATGCGGACGAATGTATGGTCCTTGATAATGAAGCTTTGTATGACATCTGCTTCAGAACCCTCAAGCTTACAACCCCC
AGCTTTGGAGATTTGAATCATTTGATATCAGCTACAATGTCTGGTGTCACATGTTGTTTGCGTTTCCCTGNGCAGTTGA
ACTCTGATCTTAGAAAACTAGCTGTGAATCTGATCCCGTTCCCTAGGCTCCATTTCTTCATGGTTGGTTTTGCACCACT
GACTTCACGTGGTTCTCAGCAATACAGGGCCTTGACAGTTCCTGAACTTACCC

> SEQ ID NO: 5425 107594 1119252_301895_1b
GCGTCCTCAACACGCGAATTGCAGAGCGGAATCTGGAACCTCGAACTCTCGACCTCGGACCTTTCAGAGCAGAAGAAGA
AAAATGAGGGAGATAATCAGCATACACATCGGGCAGGCCGGGATCCAGGTCGGCAATGCCTGCTGGGAGCTCTACTGCC
TCGAGCATGGTATCCAGCCCGATGGCCGCATGCCTAGTGATAAATCGGTGGGGGTGGCGGATGATGCTTTCAACACGTT
CTTCAGTGAGACGGGGGCAGGAAAGCATGTCCCTCGGGCCATCTTTGTGGATCTGGAGCCGACAGTGATTGACGAGGTC
CGCACAGGCACCTACAGGCAGCTCTTCCACCCGGAGCAACTCATCTCCGGCAAGGAGGATGCTGCCAACAACTTTGCCC
GTGGCCATTACACCGTGGGCAAAGAGATTGTGGATCTGTGCCTGGATCGAGTGAGGAAGCTTGCAGATAATTGCACGGG
TCTGCAGGGTTTCCTTGTGTTCAATGCGGTGGGAGGCGGTACCGGATCCGGTCTTGGCTCCCTCTTGCTTGAACGACTC
TCTGTTGACTACGGCAAGAAATCAAAGCTCGGTTTCACCATCTACCCTTCTCCTCAAGTCTCCACTGCAGTGGTGGAGC
CATACAACAGCGTCCTCTCCACTCATTCCCTCCTGGAGCACA

> SEQ ID NO: 5426 107594 274632_200058_1b
GGGCGGACGCGTGGGCTGAGAACCACATTCACAATTCGAATTTCGAAAACTCATCTCTTTCTGTTTAAACGGCGTCTTG
ATAAACGCCGCTTTTTCTCCTCTTTGAAATTTGAATTTTTAGGGTTTCGGTGAAAATGAGAGAGTGCATTTCGATCCAC
ATTGGTCAGGCTGGTATTCAGGTCGGAAATGCCTGCTGGGAACTTTACTGCCTGGAGCACGGCATTCAGCCTGATGGCC
AGATGCCAGGTGACAAGACTGTTGGAGGGGTGATGATCATTCAACACCTTCTTCAGTGAAACTGGAGCTGGAAAGCA
TGTCCCTCGGGCTGTCTTTGTAGATCTTGAGCCCACTGTCATTGATGAAGTGAGGACAGGAACATACCGACAGCTCTTT
CACCCTGAACAGCTCATAAGTGGCAAGGAAGATGCAGCCAATAACTTTGCCCGTGGTCACTATACCATTGGGAAAGAGA
TTGTTGATCTTTGCTTGGATCGCATCCGAAAGCTTGCAGACAACTGTACTGGTCTTCAAGGGTTCCTGGTTTTCAATGC
TGTTGGTGGTGGTACTGGTTCAGGTCTGGGTCGCTTCTTCTGGAGCGTCTCTCTGTTGACTACGGAAAGAAGTCAAAA
CTTGGTTTCACAATTTACCCTTCACCACAGGTCTCAACTTCTGTTGTTGAGCCTTACAACAGTGTCCTCTCAACTCATT
CCCTCCTTGAGCACACTGATGTTTCCATCCTTCTGGACAACGAAGCCATTTATGACATTTGCAGGCGCTCACTGGACAT

FIG. 2 continued

```
TGAGCGCCCTACTTACACCAACCTTAACCGCCTTATCTCACAGGTTATCTCCTCACTCACAGCATCTTTGAGGTTTGAT
GGTGCTTTGAATGTTGATGTGAATGAATTCCAGACCAATCTTGTGCCATATCCCAGGATCCATTTTATGCTTTCCTCAT
ATGCTCCTGTCATTTCTGCTGAGAAGGCCTACCATGAGCAGCTCTCAGTTGCAGAGATCACCAACAGTGCTTTTGAGCC
ATCTTCTATGATGGTTAAGTGTGACCCTCGTCATGGCAAGTACATGGCTTGCTGTCTCATGTTCCGTGGTGATGTGGTG
CCCAAGGATGTTAATGCTGCTGTGGCCACCATCAAGACTAAGCGCACCATCCAATTTGTTGACTGGTGCCCTACTGGAT
TCAAGTGTGGTATTAACTATCAGCCACCAACTGTTGTTCCTGGTGGCGACCTTGCTAAGGTGCAGAGGGCTGTTTGCAT
GATTTCCAACTCAACCAGTGTTGCTGAGGTCTTCTCACGCATTGACCATAAGTTTGATCTGATGTA

> SEQ ID NO: 5427   107594 274637_200058_1b
CCCACGCGTCCGAAAACCTTCACTTTCCTCACTCCTAAAAAACAAAAGCACAGAAAAATTCAAAATCACTTAAAAAATG
CGTGAGATTTTGCACATTCAAGGAGGCCAATGCGGGAACCAAATCGGAGCCAAGTTTTGGGAAGTTATCTGTGCCGAAC
ATGGCATTGATTCCACTGGAAGGTATGCAGGAGACAATGATCTTCAACTGGAGCGGTTGAATGTTTACTATAACGAAGC
GAGTTGTGGAAGGTTTGTTCCACGCGCTGTCCTCATGGATTTGGAGCCTGGAACTATGGATAGTGTCAGATCTGGGCCA
TATGGTCAGATTTTCCGGCCCGATAATTTTGTTTTTGGACAGTCTGGTGCTGGTAATAACTGGGCCAAGGGTCACTACA
CTGAGGGAGCCGAGCTTATTGATTCGGTTCTCGATGTTGTGAGGAAGGAGGCTGAAAACTGTGACTGTCTACAAGGTTT
CCAGGTTTGTCACTCTTTGGGAGGTGGAACTGGATCAGGAATGGGAACTCTCCTTATTTCAAAGATCAGGGAGGAGTAC
CCAGATAGAATGATGCTTACCTTCTCTGTTTTCCCTTCCCCCAAGGTTTCAGACACAGTTGTTGAGCCCTATAATGCTA
C

> SEQ ID NO: 5428   107594 50882_300186_1b
CGGACGCGTGGGGTCACTCCCATCTTTCATATTCCTTCACCATCTCTCTCTCTCTCGATCTTGTGAACCACTACACACA
CTAACACAATGAGAGAGATCCTTCACATTCAAGGTGGTCAATGCGGTAACCAGATTGGTTCCAAGTTCTGGGAAGTCAT
CTGCGACGAGCACGGCATCGATTCCACCGGACGTTACAGTGGAGACACTGCAGATCTCCAGCTTGAACGTATCAATGTC
TATTACAATGAAGCTTCAGGTGGAAGATACGTTCCTCGTGCTGTTCTTATGGATCTTGAGCCTGGTACTATGGATAGTA
TCAGATCCGGACCGTTTGGTCAGATCTTCCGTCCTGATAACTTTGTCTTTGGTCAGTCTGGTGCTGGTAATAATTGGGC
TAAAGGTCATTACACT

> SEQ ID NO: 5429   107594 57188_300378_1b
AAATATCTCAAATCCCCACCCCTCTAAATTCACACATTCTGTTTCTCTCTTACCCTAGTTCCATTTGCCATTTCAGTTT
TTCAAATTCCTCCAAAAAAGAGAGAAAATGAGAGAAATCTTACACATTCAAGGCGGCCAATGCGGTAACCAAATCGGTT
CCAAATTCTGGGAAGTTATCTGTGATGAGCACGGCGTTGATCCTACAGGCCGTTACAAAGGCCACCGCCGCTGAGTCGGA
TCTTCAACTTGAACGTATTAATGTGTATTTCAATGAAGCTTCTGGTGGACGTTATGTTCCTAGGGCTGTTCTTATGGAT
CTGGAGCCTGGTACTATGGATAGTATCAGATCTGGTCCGTACGGACAGATCTTTAGGCCTGATAACTTCGTTTTTGGTC
AGTCCGGTGCTGGTAATAATTGGGCGAAAGGTCATTACACTGAAGGAGCGGAGTTGATTGATGCTGTTCTCGATGTTGT
TCGTAAAGAGGCTGAGAATTGTGATTGCTTGCAAGGATTTCAGGTTTGTCACTCACTCGGTGGTGGGACTGGATCTGGC
ATGGGAACTCTATTGATTTCCAAGATAAGGGAGGAGTATCCAGACAGAATGATGCTCACATTCTCTGTTTTCCCATCTC
CAAAGGTGTCTGACACTGTTGTAGAACCATACAATGCTACACTGTCTGTGCACCAACTGGTGGAGAACGCTGATGAGTG
TATGGTCCTTGATAATGAAGCCTTATATGATATTTGTTTCAGGACTTTGAAGCTCACTACTCCAAGTTTTGGTGACTTG
AACCATTTGATCTCTGCAACCATGAGTGGTGTTACTTGCTGTTTGAGATTCCCTGGTCAGCTGAACTCAGACCTGAGAA
AGTTGGCTGTGAATTTAATTCCCTTCCCACGTCTTCATTTCTTCATGGTGGGCTTTGCACCATTGACCTCTCGCGGATC
GCAGCAATACATTTCCCTCACAGTGCCAGAGCTTACTCAACAAATGTGGGATGCAAAGAATATGATGTGTGCTGCAGAT
CCCCGTCATGGACGCTACCTGACAGCTTCTGCAATGTTTAGGGGAAAGATGAGCACAAAGGAAGTGGACGAACAAATGA
TCAATGTGCAGAAC

> SEQ ID NO: 5430   107594 284759_200101_1b
AACTACTCTCTCGATCGAGTGAGTAGTTCTACTTCTCTCTCGATCAATTTCTAGATTTCTTCAGTTGCCTTCCCGATTT
TAAAGAAAAAATGAGAGAAATCCTTCACATTCAAGGTGGACAATGTGGAAACCAGATCGGATCAAAGTTCTGGGAAGTT
GTATGTGATGAACACGGAATTGATCCTACTGGACGCTATGTTGGAACCTCAGATCTGCAGTTGGAACGTGTTAATGTGT
ATTACAATGAAGCGTCATGTGGGAGGTTTGTTCCCCGTGCAGTGCTCATGGATCTTGAGCCTGGCACGATGGACAGCGT
GAGGACTGGTCCTTATGGCCAGATCTTTAGGCCTGATAACTTTGTTTTCGGTCAATCCGGTGCTGGAAACAATTGGGCT
AAGGGGCATTACACTGAGGGTGCTGAGCTTATTGATTCTGTTTTAGATGTTGTCAGGAAGGAGGCTGAGAATTGCGACT
GTCTTCAAGGATTCCAGGTGTGTCACTCACTTGGTGGAGGAACAGGTTCTGGAATGGGAACCTTGCTGATCTCAAAGAT
CAGGGAGGAATACCCTGACCGCATGATGCTCACATTCTCTGTGTTCCCATCACCGAAGGTTTCAGATACAGTGGTTGAG
CCATATAATGCTACCCTTTCAGTGCATCAGCTTGTTGAAAATGCTGATGAGTGTATGGTTCTTGACAATGAAGCTTTAT
ATGACATCTGTTTCAGGACTCTCAAGCTTACCACACCCAGCTTTGGAGATTTGAACCACTTGATTTCTGCTACTATGAG
TGGGGTCACTTGCTGCCTCAGGTTCCCGGGTCAATTGAACTCTGATCTTCGGAAGCTAGCTGTTAACCTGATCCCCTTC
CCTCGTTTACACTTCTTCATGGTTGGATTTGCTCCTCTCACTTCTCGTGGTTCACAGCAATACCGTGCACTAACAGTCC
CGGAGCTGACTCAGCAAATGTGGGATGCCAAGAACATGATGTGTGCTGCTGATCCACGCCATGGTCGTTACCTCACT
```

FIG. 2 continued

> SEQ ID NO: 5431 107594 39253_300206_1b
CCCACGCGTCCGATCTCACTCTCACCGCCTTCATTTCCTCGATCTCCGTCTTCCTCCTTCTCCGTCTGTCGCAGAGCAT
CGCTCGAATTAGGGTTTCTGCTGAGAGAAGATGAGGGAAATCATTAGCATTCATATCGGACAAGCCGGGATCCAAGTCG
GAAATTCCTGCTGGGAGCTTTACTGTCTCGAACATGGAATCCAGCCCGACGGAATGATGCCGAGTGATACTACAGTTGG
TGTTGCACACGATGCGTTCAATACTTTCTTTAGCGAGACTGGTGCAGGGAAGCATGTTCCTAGGGCTGTCTTCGTTGAT
CTTGAGCCTACTGTTATCGACGAAGTTCGTACTGGTACTTACC

> SEQ ID NO: 5432 107594 271388_200033_1b
CGTTATTTATTATGCATCTTGACTACCCCTCGACCACGCGTCCGCCCACGCGTCCGCCCACGCGTCCGCCCACGCGTCC
GAAAAGAGGCTGGTTGTTCATTAGGTTTTTATTGTGAAGAGAATTATTGAAATTGGGGACAATGAGAGAAATAATAAGC
ATACACATAGGGCAAGCTGGGATTCAGGTGGGAAATTCATGTTGGGAGCTCTATTGCCTTGAACATGACATACACCCTG
ATGGCATGATGCCTAGTGACAACTCCCCTGGTGTAGGACATGATGCTTTCAATACCTTCTTTAGTGAAACCAGTGCAGG
GAAGCATGTCCCAAGAGCTATTTTTGTCGATCTCGAACCCACTGTTATTGAGGTGAGAACTGGGACTTATCGCCAG
CTTTTCCATCCTGAGCAGCTCATTTCAGGAAAGGAAGATGCTGCAAATAATTTTGCGAGAGGGCATTATACAGTTGGGA
AGGAGATTGTCGATCTATGCCTTGATCGGGTAAGGAAATTGGCTGACAATTGCACGGGTTTGCAAGGGTTTTTGGTGTT
TAATGCCGTTGGTGGTGGTACTGGTTCTGGATTGGGGTCATTGTTGCTGGAACGTCTATCTGTGGATTATGAAAAAAG
TCTAAGCTTGGATTTACTATCTATCCTTCTCCCCAGGTATCTACTGCTGTTGTTGAGCCTTATAACAGTGTTCTTTCAA
CTCATTCCCTTCTTGAACACACCGATGTTGTTGTCATGTTGGACAATGAAGCCATTTATGATATCTGTAGGAGATCCCT
AGACATTGAGAGGCCTACATATACCAATTTGAATAGACTGATCTCTCAAATCATTTCATCCTTGACCACTTCATTACGG
TTTGATGGAGCCATTAATGTGGATATTACTGAGTTCCAGACAAACCTGGTACCATATCCTCGCATCCACTTTATGCTTT
CATCCTATGCCCCAGTGATCTCAGC

> SEQ ID NO: 5433 107594 236614_301247_1b
GGCAGGGCAGGGTTTTCGGACGGGCGTCGGCACACACGCCGGAACGAAGCCTTAGATCTCTTTTCTTCTCTCCCTCTCC
GATCAATCTCTAGCCAAGATGAGGGAATGCATCTCGATCCACATCGGCCAGGCTGGAATCCAGGTCGGCAATGCTTGCT
GGGAGCTCTACTGCCTCGAGCACGGCATCCAGCCGGATGGCAGATGCCCAGCGACAAGACTGTGGGCGGCGGCGACGA
TGCTTTCAACACCTTCTTTAGCGAGACGGGTGCCGGCAAGCACGTCCCCCGCGCCGTGTTCGTGGATCTTGAGCCCACT
GTCATCGATGAGGTCGCACTGGGACTTACAGGCAGCTCTTCCACCCGGAGCAGCTCATCAGTGGCAAGGAAGATGCCG
CGAATAACTTCGCCCGTGGTCACTATACCATTGGCAAGGAGATCGTGGACCTTTGCCTCGATCGCATCAGGAAGCTGGC
CGATAACTGCACTGGACTGCAGGGATTCCTGGTCTTCCACGCTGTCGGTGGTGGAACAGGATCCGGCCTGGGCTCGCTG
CTGCTCGAGCGCCTGTCGGTCGACTACGGA

> SEQ ID NO: 5434 107594 248173_301580_1b
GGTTGGGGTTTGGAATCGAGGGCGTCTTCGCAAACGCTCTAGGGTTTCATCGATCAAGCTCTAGATTCTCGTCGATTGT
CTCGCGCCGCTCCATCCACGATGAGGGAATGCATCTCGATCCACATCGGCCAGGCCGGGATCCAGGTCGGGAACGCTTG
CTGGGAGCTCTACTGCCTCGAGCATGGCATCCAGCCCGATGGGCAAATGCCCAGTGACAAGACGGTCGGAGGAGGAGAC
GATGCGTTCAACACCTTCTTTAGCGAGACTGGCGCTGGGAAGCACGTCCCCCGTGCCGTCTTCTTGGATCTGGAACCCA
CCGTCATCGACGAGGTCCGGACTGGGACCTATCGCCAGCTCTTCCACCCTGAGCAGCTCATCAGCGGAAAAGAAGACGC
TGCTAACAACTTTGCTCGCGGCCACTATACCATCGGGAAGGAGATCGTGGACCTTTGCCTTGATCGCATCAGGAAGTTG
GCGGACAATTGTACCGGCTTGCAAGGCTTCCTCGTCTTCCATGCTGTGGGCGGTGGCACCGGCTCGGGTCTTGGTTCCT
TACTGCTAGAGAGGCTGTCCGTGGACTACGGGAAGAAGTCCAAGCTCGGCTTCACTGTCTATCCCTCTCCCCAGGTGTC
GACGTCCGTTGTGGAGCCCTACAACAGTGTCCTCTCC

> SEQ ID NO: 5435 107594 260061_301711_1b
ATTTGAGGAGGCTGTTCTTCCCGGCTGTGAAGGCGCTGCTTCTCAAAGGCAATCGAAGATGCGTGAGATTCTCCACATC
CAGGGTGGACAATGCGGCAACCAGATCGGTGCCAAGTTCTGGGAGGTGATCTGCGACGAGCACGGGATCGATCCCACCG
GGAACTACCACGGTGACTCGGATCTCCAGCTCGAGAGGATCAATGTCTACTACAATGAGGCCACTGGTGGGCGCTTCGT
TCCCCGCGCCGTGCTCATGGATCTGGAGCCGGGCACCATGGACAGCGTGAGATCTGGGGTTTTTGGGCAGATCTTCCGG
CCGGATAACTTCGTGTTTGGTCAAACCGGCGCTGGCAACAACTGGGCCAAGGGGCATTACACTGAAGGGGCCGAGCTCA
TCGATTCCGTGCTGGATGTGGTGAGGAAGGAAGCCGAGAGCTGTGACTGCCTCCAAGGTTTCCAAGTGTGCCATTCTCT
TGGAGGTGGTACCGGGTCTGGAATGGGTACACTGCTCATCTCCAAGATTCGAGAAGAGTACC

> SEQ ID NO: 5436 107594 226634_301035_1b
GTCAAGCCGGTTGCCAGATTGGTAACTCGTGCTGGGAACTTTACTGCCTGGAACACGGTATCCAGCCCGATGGATACCT
CGACCCCGACCGAAAGACGGGATCCCGGGAGGAGGGATTCTCCACCTTCTTCTCCGAGACTGGCTCCGGCAAGTACGTG
CCCCGAACCATCTACGTCGATCTCGAGCCCAATGTGGTCGATGAGGTGCGAACCGGAAAGTACAAGAACCTGTTCCACC
CCGAGCAACTCATCACTGGCAAGGAGGACGCCGCTAACAACTACGCCCGAGGTCACTACACCGTTGGAAAGGAGCTGAT

FIG. 2 continued

CGACCAGGTCATGGACCGAGTCCGACGAGTCGCCGACAACTGTAACGGTCTCCAGGGCTTCCTCTTCACCCACTCTTTC
GGTGGAGGAACCGGTTCCGGTTTCGGAGCTCTGCTGCTTGAGCGACTCTCGGTCGACTTCCCCAAGAAGTCCAAGCTCG
AGTTTGCCGTCTACCCTGCCCCCCAAGTCTCCACCTCCGTTGTCG

> SEQ ID NO: 5437   107594 207429_300805_1b
CCCACGCGTCCGGGCGTCTTCGTACTCGCCTCTCTCCGCGCCCTCCTCCGCCGCCGCTCGCCGCCGTTCGTCTCCGCCG
CCACCGCCGCCGCCATGAGGGAGTGCATCTCGATCCACATCGGGCAGGCCGGTATCCAGGTCGGGAACGCGTGCTGGGA
GCTCTATTGCCTCGAGCATGGCATCCAGCCTGATGGACAGATGCCCGGTGACAAGACCGTTGGGGGAGGTGATGATGCT
TTTAACACCTTCTTCAGTGAGACTGGTGCTGGGAAGCATGTCCCCCGTGCTGTCTTCGTCGATCTTGAGCCTACCGTGA
TTGATGAGGTGAGGACTGGTGACTACCGCCAGCTCTTCCACCCTGAGCAGCTCATCAGTGGCAAGGAGGATGCAGCCAA
CAACTTTGCCGTGGTCACTACACCATTGGCAAGGAGATTGTTGATCTGTGCCTTGACCGCATCAGGAAGCTTGCCGAC
AACTGCACTGGTCTCCAGGGCTTCCTTGTGTTCAACGCTGTTGGAGGAGGAACGGGCTCCGGTCTCGGTTCCCTTCTCC
TTGAGCGTCTCTCTGTGGACTATGGCAAGAAGTCCAAGCTCGGGTTCACCGTGTACCCGTCCCCTCAGGTCTCCACCTC
TGTGGTTGAGCCATACAACAGTGTCCTCT

> SEQ ID NO: 5438   107594 201764_300719_1b
AGATGTCATATAGAGCTTCATTGTCAAGTACCATGCACTCATCGGCATTCTCAACAAGCTGATGGACAGATAGTGTGGC
ATTGTAAGGTTCCACCACGGTATCAGAAACCTTTGGTGAGGGGAAAACTGAGAATGTCAACATCATCCTGTCCGGGTAC
TCCTCCCTGATCTTTGAGATGAGCAGGGTACCCATACCAGAACCAGTTCCTCCTCCTAGAGAGTGGCAGACTTGAAATC
CTTGGAGGCAGTCGCAGTTCTCGGCCTCCTTGCGGACGACGTCGAGGACGGAGTCGATGAGCTCGGCGCCCTCGGTGTA
GTGGCCCTTGGCCCAGTTGTTGCCGGCGCCGGACTGGCCGAAGACGAAGTTGTCGGGGCGGAAGATCTGGCCGAAGGGA
CCGGAGCGCACCGAGTCCATGGTGCCCGGCTCGAGGTCCATGAGCACGGCGCGCGGAACGAACCTGCCGCCGCTGGCCT
CGTTGTAGTAGACGTTGATCCGCTCGAGCTGGAGGTCGGAGTCGCCCGAGTACTTGCCGGTGTGGTCGATCCCGTGCTC
GTCGC

> SEQ ID NO: 5439   107594 182225_300659_1b
GAATTCAGGTGCATCCCTCTCTCTCTCTCTCTGAAATCTCTTGTTCGCTTCTCAAACCCTAGAAACAAAATGGGGAA
TGAGAGAGATTCTTCATATCCAGGGAGGACAATGTGTAATCAGATCGGAGCTAAGTTTTGGGAAGTAGTCTGTGCTGA
GCATGGAATTGATCAAACTGGAAGATATGAAGGCGATTCAGAGCTTCAATTGGAGAGAATCAATGTCTATTACAACGAA
GCAAGTTGTGGTAGATATGTACCAAGAGCTGTACTCATGGATCTTGAACCTGGTACTATGGATTCACTTAGATCTGGTC
CCTTTGGTCAGATCTTCAGACCTGATAACTTCGTCTTTGGTCAATCTGGTGCTGGTAACAACTGGGCTAAAGGTCATTA
CACAGAAGGAGCTGAGTTGATTGATTCTGTTCTTGATGTTGTCAGAAAGGAAGCGGAAAACAGTGATTGTTTACAAGGT
TTCCAAGTATGTCACTCTTTGGGGGGAGGAACTGGTTCTGGAATGGGAACTCTATTGA

> SEQ ID NO: 5440   107642 226978_301006_1b
ACTACGACGAGCAGCTCCCGGAGAAGAAGCGGCGCCTCACGCCGGAGCAGGTGCATCTGCTGGAGAGGAGCTTCGAGGA
GGAGAACAAGCTGGAGCCCGAGCGGAAGACGGAGCTGGCGCGGAAGCTAGGGCTGCAGCCGCGGCAGGTCGCCGTGTGG
TTCCAGAACCGCCGCGCGCGCTGGAAGACCAAGCAGCTCGAGCGCGACTTCGACCGCCTCAAGGCGTCGTTCGACGCCC
TCCGCGCCGACCACGACGCCCTCCTCCAGGACAACCACCGCCTCCACTCTCAGGTCATGTCGTTGACCGAGAAGCTGCA
AGAGAAGGAGACGACGACCGAGGGCAGCGCCGGCGCGGCCGTTGACGTCCCGGGCTTGCCTGCGGCGGCCGACGTGAAG
GTCGCCGTCCCGGACGCCGAGGAACCGGCGCTGGAGGAGGCGGCGGCGGCGTTCGAGGAGCAGCAGGAGCAGCAGGTGA
AGGCCGAGGACAGGCTGAGCACGGGCAGCGGCGGGAGCGCGGTGGTGGACACGGACGCGCAACTGGTGGTCGGG

> SEQ ID NO: 5441   107642 263271_301723_1b
GCAGCATGGAATCCAATTCGTTTTTCTTCGATCCATCTGCTTCACACGGCAACAGCATGTTCTTCCTTGGGAATCTCAA
TCCCGTCGTCCAAGGAGGAGGAGCAAGATCGATGATGAACATGGAGGAAACTTCGAAGCGAAGGCCCTTCTTTAGCTCC
CCTGAGGATCTCTACGACGATGACTTTTACGACGACCAGTTGCCTGAAAAGAAGCGTCGCCTCACTACCGAACAAGTGC
ATCTGCTGGAGAAAAGCTTCGAGACAGAGAACAAGCTAGAGCCTGAACGCAAGACTCAGCTTGCCAAGAAGCTTGGTCT
ACAGCCAAGGCAAGTGGCTGTCTGGTTTCAGAATCGCCGAGCTCGTTGGAAAACAAAACAGCTTGAGAGAGACTACGAT
CTTCTCAAGTCCACTTACGACCAACTTCTTTCTAACTACGACTCCATCGTCATGGACAACGATAAGCTCAGATCCGAGG
TTACTTCCCTGACCGAAAAGCTTCAG

> SEQ ID NO: 5442   107642 263284_301393_1b
TAATTGTACTGTTCTGATCAAGCCATGGCCAAAAACCAGAATGGTCATCCATTGCACAGAACATGTTACTGATACTATT
CTCTTCTTTAACCATACTCTGTCCTGAAGATGAGTTTTGAAAGAACTGCATTGTTGTAGTAGTTGTCGTTGCGGTGGCT
GGCGACGGTGGGAAGAAGTGTCGACCAACTGTCTGTGGTGGCGGTGGGTGGCCACCGGTTAATGTACTGTCGTTTGATG
GCGGCGCAGTTGAGATATCTAGTCTGAGATTATCTGAACTGTTATCACTTCTGTTACTGCAAGATCCTTCAGTTTCTTT
GTTTAGATTTATTGATTCTGTTTGTTCTCTGTTTTTTAATCCCATTATCTCAGCTTGGAGTTTCTGATTATGAGTTTGA

FIG. 2 continued

AGAAGATCATTTTCAGCTTTAAGTGTATCAAACTGTCGTTTAAGAGTATCATAATCTTTCTCTAGCTGCTTTGTTTCCC
AACGAGCTCTTCGATTTTGAAACCAAATCCCGATCTGTCTTGGTTGCAAACCTAAGGCACGAGCTAGCTGCA

> SEQ ID NO: 5443 107642 39091_300075_1b
TTGAAGAAAATCATCTCTTTGTATTAGTGAATGTCTGAATGACTTTAGGGACAAATTTTAAATCTATTCAGACAAAGAG
AAACAGATCAAACGAAACAAAACAGAGACAAGACTATATATATTGGAATCTTGTCTGCGTCGAAACAGAATCAGACCCA
TGAGGGTGATGAAGATCCATGTCCATTGCTAACAAAGCAAGCGTAAAGCTCGTCGAATACCACCACTTGATCATCATGA
TCTTCATCACAAGAACCAAGATTAGAATTATCAACAGGAGAATCTTGATTTGTGAACAGAGCAAGCTGATTCCTTGCTC
TCTTCAGCTCATCTTGGAGAAACTGCACTTGATGCTCTAACTTTGCCTTGTCGGAGAGAGCTGCTTCGTGCTTGGACTG
AAGAGTGCAGTGTTGGACCTCAAGAGACTGAGTCTTGAACCTGGCTCGCTTGTTTTGGAACCAGACAGCGACTTGTCTT
TGAGGTAGACCAAGCTGGTTCGACAGTTGAAGTTTCAGATCTGGCTCAAGCTTCTTGGTCATAGTGAAGCACTTCTCCA
GTTGTCTAACTTGATCTTGTGTTAGCCTCTTCTTCTTGTTTTTACCCTGACTCTGAGAATTCTCCATTTTTCTCTTCTT
TTTTGGTTTTTCTTTTGGTCGGACGCGTGGG

> SEQ ID NO: 5444 107642 146347_301065_1b
ACAACAAAAGAGGCTAAATCAAGAACAAGTCAAGAGGTTAGAGGAAAGTTTTGATTCAACTAAGAAGCTTGAGCCAGA
GCAAAAAATCCAACTTGCTAAAGAGTTAGGTGTTCCTCCGCGACAAATTGCTATCTGGTACCAGAACAGACGAGCTAGA
TGGAAGAACCAGAGCCTCGAGCTGGACTACAATGCTCTTCAGCTTCAGCTTGACACTGCATTAGCTGAGAAGAGGAAGA
TTGAGAAAGAAAACGAACGTCTTCGAGGCGAGTTGAAGAAGGTAAACGGGATGTTAGTTGCTTGTAAAAAAGCACAAGG
ACATGAAGAAACACAAGGATTTGTTCCTTTAAATGCAACTAATCCCATTTCTAGTGGTTGTGAGGAAGGAGTAGTGAGT
TCAAACTACCAAGAAGATGTGAGTTGTTTATTGATAAAAAATAATAGTGACTCTAATTTGCAATTTGATGAGCTTTATG
CTTGCTTGATGGGTGCAGAAGAAGGATCAAATTGTCGTTTAAGTTGGCAAAATGGAAAAGATCTTTGGGTGTGGAAAAG
TT

> SEQ ID NO: 5445 108256 158864_301994_1b
TTCTATCTTACATATTTAGCCAAAGCATCGTTAAAATGGCGTACATTAAGCAAGCTTTTCTCTTGA

> SEQ ID NO: 5446 108358 104075_300058_1b
ACATTTTTAGTCTGAATAAAATGGCCAAGGCTACTGTATCATCCATTGTCCTCCTCCTCACTTTGAACATTCTCTTCTT
CGCAATGGTTAGTTCAACTTACATCCCATGCCCACCAAAAACAAAGAATCAACCCCATCCCACTACCCCATCATCCAAG
GGTTATAAGAAGTGCCAAAAGGACACACTAAAATTGAAGGTGTGTGCCAATTTATTGAATGACTTGGTGCATGTTGTTA
TTGGAAGCTCATCAAAGAGTTCATGCTGCTCTCTCATTGAGAATCTTGCTGATGTTGATGCTGCAGTTTGCCTTTGCAC
TGCCATTAAAGCTAAGCTCTTGGGAACTAACCTTGATACCGCTCTTTCCCTCAGCTTATTGCTCAACAATTGTGGAAAG
ACTGTTCCTAAAGACTTCCAATGTGCATAAATGGCCATCTTCCCACCCCAACTTGTTTGGTAATGAGGCGTAGTTGTCT
GTTTGTGGTGTTTGTTTTCTCCATAAGATTTTCGTCGGAGATTTCAACTAAAAAATAATCAGTACTGAGTGTGTTTGTG
CACGGTTGCTTATTTTCTCAGGAAATATGTGGAATTATTCTAGTGCTTAGAAGTACTGAGTGTGTTTATTCATGGTTGC
TTATTTTCAATGTGTTGTATCCCATATTTATTTGTAATAAGATGGTTATGTTCTCACTAAGGAAATATATTATGATTGA
TCTCGGG

> SEQ ID NO: 5447 108358 43494_300149_1b
ACGTTCAGTTTGAATAAAATGGCCAAGGCTACTGTATCATCCATTGGCCTTCTCCTCGCTCTGAACATTCTCTTCTTCA
CAATGGTTAGTTCAACTTACATCCCATGCCCACCAAAAACAAAGAATCAACCCCATCCCGCTACCCCATCATCCAAGGG
TTATAAGAAGTGCCCAAAGGACACACTAAAATTGAAGGTGTGTGCCAATTTATTGAATGACTTGGTGCATGTTGTTATT
GGAAGCTCATCAAAGAGTTCATGCTGCTCTCTCATTGAGAATCTTGCTGATGTTGATGCTGCAGTTTGCCTTTGCACTG
CCATTAAAGCTAAGCTCTTGGGAACTAACCTTGATACCGCTCTTTCCCTCAGCTTATTGCTCAACAATTGTGGAAAGAC
TGTCCCTAAAGACTTCCAGTGTGCATAAATGGCCATCATCTATTTTCATCCTATCCCGACTTGTTTGGGAATGAGGCGT
AGTTGTCTGTTTGTGTTGTTTGTTTTCTCTACAAGATATTCGTTGGAGAAATACTATCAGTAATAAGTGTGTGTATGCA
TGGTTGCTTATTTTCAATGTGTTGTATCCCATATTTATTTGTAATATGATGGTTATCTTCTCATTAAGGAATTATATGA
TGTTTTATCTCGGGAAATCAATTATTGACAAGGTATTGATATTAAGTTGTTTTTTTTCC

> SEQ ID NO: 5448 108358 160331_200006_1b
AAAATAATTTTTTTTAATTAAAAAATGGCTTCTAACAAGGTTTTCTCTACTCTTGCTATTTTCCTTACTTTTAACCTA
ATTTTTTTCACATTTGTTTCTGGTTGTGGAACTTGTCCTAAACCAAAACCGCCACCAAAACCTAAGCCTTCTTGTCCTC
TACCCCATCCACCCCATCCACCCCATCATCAAAGGGTAAGTGCCCAAAGGACACACTTAAGCTAAAAGTGTGTGCCAGC
TTATTGAATGACTTAGTGCACCTTGGTATAGGAAGTGATCCAGCCAAGACTCCATGTTGTTCTCTAATTCATGGACTTG
CTGATCTTGATGCTGCTGTTTGCCTTTGCACTGCAATTAAAGCCAATTTATTGGGAATTAACCTCAACGTACCTCTTTC
CCTCAGTTTGTTGCTCAACAATTGTGGAAAGTATGTTC

FIG. 2 continued

> SEQ ID NO: 5449 108404 9195_300301_1b
CCCACGCGTCCGCGGTTTTCAAAGGATACAGAATCAAGGGATAACGATCCTTGGAGATTTGGTTCTTAAAGACAAGATC
TTTGTCTATGATCTGGTCGGTCAGAGAATCGGATGGGCAAACTACGACTGTTCGACGTCGGTAAATGTCTCAGCGACTA
GCAGCAGCGGAAGAAGCGAATATGTGAACGCAGGACAGTTTAGTGAGAATGCTGCAGCACCGCAGAAGATATCTTTGGA
CATTGTTGGAAACACTCTAAT

> SEQ ID NO: 5450 109024 1044023_301885_1b
ATACTCTCTCTCTCTCACTCACACACACACACACACACACAGTCTCTCTCTCTCTCTCTCTCTCTCTGACCTT
GCGGAGTTTAGGAGTGGAGTGCAACCCCCCGGAAGTCCCAGTTGGCTGCGGCGCCCTCTCTCTCAGGGAATCCTTCGCA
GATGTGTGTTGAAGGAATGGAATATTCTCCGGAACAACAACAGGAGGAGGAGGAGGAGGAGGACCCGAGCGACCTCGAG
ACAGACATCGAGGGAGCTTGAGAAGCGGATATGGAGGGACCGCGTCCGTCTCCGCCGCTTGAAGGAGCGGCGGAAGTCTG
GTAGCAGCCCGAATCCGAGGCCAGAGCACTCGCAACAGCAAGGCCGGCGGAAGAAAATGGCCCGGGCTCAAGATGGAAT
ACTCAAGCACTTTCTGAAGATGATGGAGGTATGCAAAGCACAAGCGTTTGTGTACGGAATCATACCAGAAAAAGGAAAA
CCGACAAGCGGGTCCTCCGACAACATCCGAGCTTGGTGGAAAGAAAAGGTCCGATTCGATCGGAACGGCCCGGCGGCGA
TTGCCGCCTACAACAAAGAGAACGGGGTTCCAATTTCCGCCATTGAGAATTCAGCTATGGCCACTTCGACA

> SEQ ID NO: 5451 109146 1171517_302055_1b
AGCAATAGCAATAGTGATAATAGTAATAGTAATAATCAGTTGGCCTTCTTTTCTTCCATCTGCAAGATCATTTCTGTTC
TTCTCCTCGTTGTTGCTCAATTCGATTCCCCTCGTTTTTGTTTTGCGATGGCTCTTCCTGGTCAACAGCAGGTGGACTG
TCCAAGCTTTAAGCTTGTAATTGTGGGTGATGGCGGAACAGGCAAGACAACTTTTGTGAAGCGACATTTGACAGGGGAG
TTTGAGAAGAAATATGAACCCACAATTGGAGTGGAAGTTCATCCTCTTGATTTCTTCACAAACTGTGGGAAAGTCCGCT
ATTATTGTTGGGACACTGCAGGGCAGGAGAAATTTGGTGGACTTCGGGATGGCTACTATATACATGGGCAATGCGCAAT
TATCATGTTCGACGTGACGTCCCGTTTGACGTACAAAAATGTCCCAACGTGGCATCGGGATCTTTGCAGGGTGTGTGAG
AACATCCCCGTCGTTCTTTGCGGGAACAAGGTGGATGTCAAGAACAGGCAAGTGAAGGCGAAGCAGGTCACTTTCCACA
GGAAGAAAAACCTGCAGTACTACGAGATCTCTGCCAAAAGCAACTACAATTTCGAGAAGCATTCCTTTATCTCGCAAGG
AAACTTGCAGGGGATCCAAGTCTCCACTTTGTGGAGTCTCCTGCATTG

> SEQ ID NO: 5452 109146 147330_301252_1b
TTAAAACCCTCGCAGTATTCTCCTCAAAACAAACATGGCTCTTCCAGGTCAGCAAGCCGTGGATTATCCCAGTTTTAAA
CTTGTTATTGTTGGCGATGGTGGAACTGGAAAAACTACATTTGTGAAGAGGCATCTTACTGGTGAATTTGAAAAGAAAT
ATGAACCCACCATTGGAGTGGAGGTGCATCCATTGGATTTCTTCACAAATTGTGGGAAGATTAGGTTTTACTGCTGGGA
TACAGCTGGTCAAGAGAAATTTGGTGGCCTTAGGGATGGATACTACATTCATGGTCAATGTGCTATCATCATGTTTGAT
GTGACAGCTCGATTGACATACAAAAATGTCCCCACATGGCATAGGGATCTTTGCCGTGTCTGTGAAAATATTCCCATTG
TTCTTTGCGGAAACAAGGTTGATGTGAAGAACCGTCAAGTTAAGGCTAAGCAGGTTACTTTCCACCGGAAGAAGAATCT
GCAATACTATGAGATATCAGCAAAGAGTAACTACAACTTTGAGAAGCCTTTCCTTTACCTTGCCAGGAAACTTGCTGGG
GATCCTAACTTGCACTTTGTGGAGTCTCCTGCCCTCGCTCCCCCTGAAGTACAGATCGACTTGGCTGCACAACAACAAC
ATGAGGCTGAGCTTGCTGCTGCTGCCAGTCAACCCCTCCCAGATGATGATGATGAGACATTTGATTAAGAGAGAGTAAT
CAGGCTTCTCGGACAGCATTTGTGGATGCGGCTATGATTTTCTTTTTTCCTATGTACTGGTGTCCCATTTTTTTCCAC
CATTGATGGGGCTTCTGAGGACTCTCTGTTCCAGAATATGTAGGCTTTTTGAACTCTGCTCTTGTTCTATTTTCTTTC
TGGCTTGTGAGAACGATATGAAGTTTTTATTCATA

> SEQ ID NO: 5453 109146 11911_300070_1b
TGGTATCAACGCAAAGTGGCCATTACGGCCGGGGCAGTATTCTCCTCAAAACAAACATGGCTCTTCCAGGTCAGCAAG
CCGTGGATTATCCCAGTTTTAAACTTGTTATTGTTGGCGATGGTGGGACTGGAAAAACTACATTTGTGAAGAGGCATCT
TACTGGTGAATTTGAAAAGAAATATGAACCCACCATTGGAGTGGAGGTGCATCCATTGGATTTCTTCACAAATTGTGGG
AAGATTAGGTTTTACTGCTGGGATACAGCTGGTCAGGAGAAATTTGGTGGCCTTAGGGATGGATACTACATTCATGGTC
AGTGTGCTATCATCATGTTTGATGTGACAGCTCGATTGACATATAAGAATGTCCCCACATGGCATAGGGATCTTTGCCG
TGTCTGTGAAAATATTCCCATTGTTCTTTGCGGAAACAAGGTTGATGTGAAGAACCGTCAAGTTAAGGCTAAGCAGGTT
ACTTTCCACCGGAAGAAGAATCTGCAATACTATGAGATATCAGCAAAGAGTAACTACAACTTTGAGAAGCCTTTCCTTT
ACCTTGCCAGGAAACTTGCTGGGGATCCGAACTTGCACTTTGTGGAGTCTCCTGCCCTTGCTCCTCCTGAAGTACAGAT
CGACTTGGCTGCACAACAACAACATGAAGCTGAGCTTGCTGCTGCTGCCAGTCAACCCCTCCCAGATGATGATGATGAG
ACCTTTGATTAAGAGAGTAATCAGCCTTCTCGGACAGCATTTGTGGATGCTATGATTTTTCTTTTTTCCTA

> SEQ ID NO: 5454 109146 238545_301295_1b
TCGCTAGAGGGCGGCTGCTCATCAGTGCATCGTCGCGGCGGATTCGCGATGGTAAGCTTTGTGTTCTTCGATTTCTCCG
TGTGATTGATCGATTTGTGGCGCTGAGGCAGGCCTTGCCCGGTCAAGTGACACCTGGAGATGTGGTTTCGTTCAAGCTT
GTCATCGTCGGCGATGGCGGCACGGGGAAGACGACGTTTGTGAAGCGCCACTTGACTGGTGAATTCGAGAAGAAATACG
AACCGACTATGGGTGTCGAGGTTCATCCTCTCGATTTCTTTACGAACTGTGGCCGTCTACGCTTTTATTGCTGGGACAC

FIG. 2 continued

GGCCGGTCAAGAGAAGTTTGGTGGTCTTCGCGACGGCTACTATATCCATGGGCAGTGCGCTATCATCATGTTTGATGTT
ACTGCCCGCCTGACGTACAAGAACGTCCCAACCTGGCACCGGGACCTTTGCAGGGTTTGCGAGAACATCCCCATTGTTC
TGTGCGGCAACAAGGTCGACGTGAAGAACAGGCAGGTCAAGGCCAAGCAGGTCACCTTCCATAGAAAGAAGAACCTGCA
GTACTACGAGATCTCTGCCAAGAGCAACTACAACTTCGAAAAGCCCTTCCTTTTACCTCGCCAGGAAGCTTGCCGGAGAC
CCGAATCTCCACTTTGTCGAGACCCCTGCGCTGGCACCGCCCGAGGTGCACATCGATCTTGCTGCTCAGCAACTGAATG
AGCAGGAGATGCACAATGCGGCTGCTCAGCCTCTACCAGACGACGAGGACGACGCATTCGATTAAATCTTTTGCGGTGG
TTTGAGCGATGATAGGAGAGAAGAATTGAGAGGGATGTGTCATTGCCTGTGAACTTTGTCATTGAGAGGTTTCGTGTTT
TATCCGTCCCAGAAGGAAGAAATGTCATCGTCTAGGTAGTAAGTATACTTTCATGTACGTGAGTCTAAAGGAAAGAAAA
AGAAAAATAAGAGTTAT

> SEQ ID NO: 5455 109146 252743_301604_1b
GGTTGAGTTAACCAGAGGTTAGGGTTGAGTTAACCAGAGGGTTGGCCTTCCTAACATAAGTCCCGCTCTTTCGCTTGGC
CATATCTCTCTCGCCTTCTCTCTCTCTCTCCGTTTCGCGTTGCCGATCGCAGTCCTTCCGCTATGGCTCTCCCTGGA
CAGCAGGTAGCTGATTGCCCAAACTTTAAGCTGGTCATTGTAGGCGATGGAGGAACAGGGAAGACCACATTCGTGAAAA
GGCATTTGACAGGAGAGTTTGAGAAGAAATATGAACCTACCATTGGAGTTGAAGTTCATCCTCTTGATTTCTTCACCAA
CTGCGGGAAGATTCGATTCTATTGCTGGGATACAGCTGGTCAAGAAAAATTCGGAGGGCTCCGAGATGGTTACTACATT
CATGGGCAGTGTGCTATCATAATGTTTGATGTGACATCGCGATTGACCTATAAAAATGTCCCAACATGGCATAGGGATC
TCTGCAGGGTTTGTGAAAACATACCAATTGTCCTATGTGGAAATACGGTCGATGTGAAGAACAGGCAAGTGAAAGCAAA
GCAGGTTACATTCCATAGGAAGAAGAATCTCCAGTACTACGAGATCTCAGCCAAAAGCAATTCAATTTTGAGAAGCCT
TACCTATACCTTGCGAGGAAATTGGCAGGTGATCAGAATCTGCACTTTGTGGAATCTCCTGCTCTTGCACCTCCGGAAG
TGCAAATCGACCTGGCACAACAGCAACAGTATGAAGCTGAACTGGCTGCTGCTGCAGCTCAGCCATTGCCAGATGATGA
T

> SEQ ID NO: 5456 109329 1109791_301524_1b
GTTAGTTTAGAGGAAGGAGGGTAGATAGGAGGAGAAGGAGATGGCGCCAAAAGCACCGAAATCAGGCATTGCAGCGGGT
CTCAACCGAGGCCATGTCGTTACCAACAGGGACCTCGCCCCTAAGCCTTCTGCTAGGAAAGGGAAGCTTGGAAAGAGGA
CGGCCTTAGTGCGAAGCTTGATCAGGGAAGTAGTAGGGTTTGCTCCTTACGAGAAGAGAATCACTGAGCTGCTGAAGGT
TGGAAAAGACAAGAGGGCATTGAAAGTGGCCAAGAGAAAGCTTGGCACCCACTTGCGAGCCAAGAAGAAGAGAGAAGAA
ATGGCCAATGTCTTGCGGAAGATGAGGTCTGGGGGAGGAGGAGCAGAGAAGAAAAAGTGACAGGCTCGTATGATTTACCAGA
TTTTGTCTCAATCTTTGGATTATATGGTGGCTCTATTTATATCTTTGTTTCTTTGCTAAGCATAGGTTAATATCAGCAA
GACATTCTCAAGTAGAATTGAATTTTTACATACAAATTCCCAACGGAAATTTTCTTATAATGGATCTTGGTGTCATGTG
AGCTGTTGGATATCAAAATCTCATCAAATTTTA

> SEQ ID NO: 5457 109329 1119629_301899_1b
AGAGAGGGGAGGAGAGAGAAGAAGGGCAGCGATGGCACCGAAAGCTGCGAAGTCAGGGATAGCAGCGGGTTTGAACCGC
GGCCACGCGGTGACCAACAGGGACCTTGCCCCACGCCCATCCGCCAGGAAAGGGAAGCTTGGGAAGAGGACCGCCCTCG
TGCGTAGCTTGATCAGGGAGGTGGTCGGGTTCGCCCCGTATGAGAAGAGGATCACGGAGCTGCTTAAGGTTGGCAAGGA
CAAGCGTGCGCTCAAAGTGGCAAAGCGGAAGCTCGGTACCCACCTGCGCGCCAAGAAGAAGAGGGAGGAAATGGCTAAT
GTCTTGCGTAAGATGAGGTCTGGTGGAGGAGCAGAGAAGAAGAAATGATAAATTCTTTAGATTTGCAGTTTCCCAGATT
TTTGCAGTATTCTCATCATGAATCATTCAGTGAAGCGGAGGCCTTACTTGTGAAGACTTCCTTTTGGTATCTGAACTCT
GCAAACTAATTTTGTTTTTTTGGAGATTTTCTTAAAGTAGGGCCCTTAACTGTATGCTTACTGTGAGGAAATGGAAACA
TTTGAATTTCTGGCATCCTATCTAGTTCATGGC

> SEQ ID NO: 5458 109329 114495_300008_1b
CCTAATTCCTCACCGTTTCTTCCGTATCGAACTAATTGAAGAGGTGATGGCTCCGAAGCAGCCTAATACAGGGCTATCC
GTTGGGCTAAACAAAGGACATGTTGTAACCAAGAAGGAATTAGCTCCACGTCCTTCTGACAGAAAAGGGAAAACAAGCA
AAAGAGTCCACTTTGTGAGGAGCCTTATCAGAGAAGTCGCTGGATTTGCTCCATATGAGAAAAGGATTACTGAGCTTCT
TAAAGTTGGAAAGGACAAGCGTGCCTTGAAGGTAGCCAAGAGGAAGTTGGGCACTCACAAGAGGCAAGAAGAAGAGAAGAGA
GAAGAGATGTCTAGTGTTCTCCGTAAGATGAGGGCTACTGGAGGTGGTGAAAAGAAGAAATGAAACCTGTATGGTTGAT
GATTGAAGAACCCAGTTAGTTAATTCACTTGCTTTTATGTTTGCAATGTATTTTGTTTTCAAGAAAGAAGACTTGTGA
TTAAAAGCTCCCGGTTTATGTCCCATGAAGATTTTGAAATTAGTGATATTTTAGACATTTTTGCCAAGTGCATGTTT

> SEQ ID NO: 5459 109329 156357_301365_1b
TCTAAGATCGAGCAAATCGAAGGTAAGCTTTTGGAATGGCGCCGCCGAATACAGGTTTAGCTGTAGGATTAAATAAAGG
CCATGTTGTGACCAAGAAGGAGTTAGCTCCTCGCCCTTCTGACAGAAAAGGGAAAACAAGCAAAAGGGTCCATTTCGTA
AGAAGCCTCATCAGAGAAGTTGCTGGATTTGCACCATATGAGAAGAGAATTACTGAGCTGCTTAAGGTTGGAAAGGACA
AGCGGGCTTTGAAGGTAGCCAAGAGGAAGTTGGGTACTCACAAGAGAGCAAAGAAGAAGAGAGAGGAGATGTCAAGCGT
TCTCCGCAAGATGAGGGCCACCGGCGGTGCTGAAAAGAAGAAGTGAAGACTTAATCCTCATACTGATGATTGAGGAACT

GAGTTCATTAGATATACATGATCTTTTTGATTTAGCTATGTAATTCTCTCTTTTCTAGAAAGAAAACTTGTTATCAGAC
TAGTAGAAAGAAAATATGGTTTTGAATTTCATCAAGATTATTATGACATTTTGCTCAACTTTCAAGTC

> SEQ ID NO: 5460 109329 248639_301585_1b
ACGATGGCGCCCAACGTTGCGAGCAGCGGGATCGCGATCGGGCTCAACAAGGGGCATGTCGTCACCAAGCGGACGCCGG
CGAAGCGGCCGATCGCCATGAAAGGGAAAGGGCAGAAGAGGACGCTATTCGTGAGGAAGCTGATCCGGGAGGTGGTGGG
ATTCGCACCCTACGAGAAGAGGATCACTGAGCTGCTCAAGGTTGGGAAAGACAAGCGCGCGCTCAAGGTTGCCAAGCGA
AGGCTCGGGACTCATCTTAGAGCCAAGAAGAAACGCGAGGAGATGTCTACGGTTCTAAGGAAGATGAGGTCTGCGAAGT
AGGATAATCTCTTTTGTATTGGTTCTTTTAAAATCGAATTGATAAGTATTTCAACCAAG

> SEQ ID NO: 5461 109329 253653_301629_2b
GAGGAAGGAGGGTAGAAAGGAGGAGAAGGAGATGGCGCCAAAAGCACCGAAATCAGGCATTGCAGCGGGTCTCAACCGA
GGCCATGTCGTTACCAACAGGGACCTCGCCCCTAAGCCTTCTGCTAGGAAAGGGAAGCTTGGAAAGAGGACGGCCTTAG
TGCGAAGCTTGATCAGGGAAGTAGTAGGGTTTGGTCCTTACGAGAAGAGAATCACTGAGCTGCTGAAGGTTGGAAAAGA
CAAGAGGGCATTGAAAGTGGCCAAGAGAAAGCTTGGCACCCACTTGCGAGCCAAGAAGAAGAGAGAAGAAATGGCCAAT
GTCTTGCGGAAGATGAGGTCTGGGGGAGGAGCAGAGAAGAAAAAGTGACAGGCTCGTATGATTTACCAGA

> SEQ ID NO: 5462 109329 207430_300805_1b
ACCAAGAGGGTGACCTTTGTCAGGAACTTGATCAGGGAGGTTGCTGGATTTGCTCCCTATGAGAAGCGTATCACTGAGC
TTCTCAAAGTTGGCAAGGACAAGCGTGCACTGAAGGTGGCAAAGAGAAAGCTTGGCACCCACAAGAGGGCCAAGAAGAA
GAGAGAGGAGATCGCTGGTGTCCTCAGGAAGATGAGGTCTGGTGGCGGTCACGCTCACACCGAGAAGAAGAAATAGAGT
ATCTCCAAGTTCATGAAGTCCATGGCAATATTGTCTTGTTGAGTTTACTCTTGTAGAACCCTACTACTAGAATTGCACT
CTATTATCCAGCTAAACATCATGGTGTTAGTTCTGTGTTAAAAACCTCCTGTCTTGTGTTTTTGATCCTTTCAATGCAT
GGTTTGCCACCTTAAATTTGCTTGATTAA

> SEQ ID NO: 5463 109329 194023_300743_1b
CCCCCCCGGGACGCAGCCGGCGGCTTAGGGTTGGGTAGCTGTCGCCGATCCAAGGTCCGAGGAGCGAGGAGGAGATCCG
CCATGGCGCCGCCGCAGCCCAAGTCGGGGCTCTTCGTCGGCATCAACAAGGGCCACGTCGTCACCAAGCGCGAGCTGCC
ACCTCGCCCGTCCGACCGCAAGGGGAAAAGTACCAAGAGGGTGAATTTTGTCAGGGGCTTGATTAGGGAGGTTGTGGGA
TTTGCTCCATATGAGAAACGAATCACTGAGCTTCTGAAGGTTGGAAAGGACAAGCGTGCACTGAAGGTCGCTAAGAGAA
AGCTCGGTACCCACAAGAGAGCCAAACAAGAGAGAGGAGATGGTGGGTGTCATCAGGAAGATGAGGTCTGCTGGTAC
TACTGACAAGAAGAAATAGAAGTTTCAAGTTGAAGATCTTTTTGCAATCCTTATTGTAATTCATTTATATGGACCTATA
GTAAGCTCTAGATCGAGGTGCTGTATTGCCGTTGAGAACATTGCAATGCTATTGAGGAGCATTGAAATTTTGGCACATG
TTTCGATACATCGGTTTTGTCACAATTTCTCAGGGTTGTATTGCCCTTGATTCTGT

> SEQ ID NO: 5464 109369 237977_301290_1b
GGGAGAGATTTGGAGAGGAGGAATTCACAGCTTTCAATCGAGCAATCCATCAATCAATCAATCAACTCAAGTTCGAAAG
CAATCCCCGGTCAATCGATCAAGGTTTGGGTCTCTGCTTTAGCTCTCTAGATCCCGCATTGGTCGCTAGCAAAATAGCG
CGGATCAAGGCAGCATCGTCGCCGCCAATGACGGCGCCAGGAGGTACAAGGGGTGAGGATGAGGAGTTGGGGGAAAT
GGGTGACAGAGATCAGGGAGCCGAAGAAGAGATCGCGCATTTGGCTGGGATCGTACGCCACGGCGGGAGATCGCAGCCAG
GGCGTACGACGCGGCGCTCATGTGTCTCCGCGGCCCGTCCGCCCAATTCAACTTCCCGGCCTTGGCTCCACGGCATCTC
CCCTACAACCCGCAGTGCTCCCCGGCATTCGTCCAGCAGGCGGCGGCGGAGGCGGCGGCGGAGGCAGCGGAGGCGCTGG
GGACATCCAGCCCCGAGGAGGAACACTCCAATTCGTCGTCGCATCCTTCTTCATTCGAGACGAGCTCGATATCCACATC
CGGCGAGAACAATTGCTCGTCGATATCGTCGGACGAGGAGGTGAGCACTGCCAAGGGGGGATCGACCGCGATCCAGCAG
CAGGGATCACTGGCGTACGAGG

> SEQ ID NO: 5465 109369 248226_301581_1b
GAAAAATATCTCAACAGCAGTCAAAAGCTTACCTGATCGATCACACATTGAAGCTGCCGCCGCATGGGACAGAGTGAGT
GGAGACGAGAGGCAGCAGTCCAATCCCATCTGGCAGCGGAGAGCAAAGCGCCGCGCTGCCGACGGGCTCGATGAATCCA
CTTCGGCGGAGGAGACCGACTCGAGTCCGAATTACAAGGGAGTTCGTCGCCGCAGCTGGGGGAAGTGGGTGTCGGAGAT
TCGAGAGCCCCGAAAGCGTACCAGAATATGGCTAGGTTCTTTAGCCACGCCGGAGATGGCTGCCAAGGCCTACGACTAC
GCCGTCTACTGCCTGAGAGGCCCCTCCGCAATGCTCAATTTACCAGACTCGCCGACAGCAATCTCCTGGTAAGAAGC
TCACTTCCTCTAAAGAGATTCAAGC

> SEQ ID NO: 5466 109369 6656_300347_1b
CCCACGCGTCCGCCAGATCCAGTCTCAGATCCATCATCCTCTTCCTCCGACGCATCACAACAACAACTCTTTCTCG
AATCTTCTCAGCCCGAAACCGTTACTGATGAAGCAATCTGGAGTCGCTGGATCTTGTTTCGCTTACCGGTTCTGGTGTTC
CTTCGAAGCCGACGAAGCTTTACAGAGGTGTGAGGCAACGTCACTGGGGAAAATGGGTGGCTGAGATCCGTTTGCCGAG

FIG. 2 continued

AAATCGGACTCGTCTCTGGCTTGGGACTTTTGACACGGCGGAGGAAGCTGCGTTGGCCTATGATAAGGCGGCGTACAAG
CTGCGCGGCGATTTCGCCCGGCTTAACTTCCCTAACCTACGTCATAACGGATCTCACATCGGAGGCGATTTCGGTGAAT
ATAAACCTCTTCACTCCTCAGTCGACGCTAAGCTTGAAGCTATTT

> SEQ ID NO: 5467 109369 103991_300035_1b
AATGGAGCAGCTAGGCTCAATCGGATTGAATCAATTAACGGCAGCTCAGATCCAACAAATCCAAGCCCAAATCAATTTC
CAAACCCAACAACAACAACAACAGATGATGTTCCATAATGGCTCCCACCACCATACTTCTACTATGAACATGTTGGGCC
CAAAGCCCGTTCAAATGAAGCAATCGGGCTCACCACCAAAGCCCACTAAGCTCTACAGGGGCGTCAGACAACGTCACTG
GGGAAAGTGGGTAGCTGAGATCCGATTGCCCAAGAACCGGACTCGGCTTTGGCTTGGCACCTTCGACACTGCTGAAGAA
GCTGCGTTGGCCTACGACAAGGCGGCGTATATGCTACGTGGCGACTTTGCTAGACTCAACTTCCCCCATCTCCGCCATA
ACGGCTCCCTTATCGGCGGCGAATTCGGAGAGTACAATCCATTGCACTCCTCTGTTGATGCTAAGTTAAAGGAGATTTG
CGAGAGCTTGGCCCAGGGAAAGAGCATTGACTCTAAGAAGAAGAAGGCGTCCAATGTGTCTTCA

> SEQ ID NO: 5468 109420 254642_301634_1b
GGCTAGAGATGGCTAGTCTAACCCTAAGTTGCCTTCTCTTGGTACTCTTCCCCTTGGCCTCTTTCGCCCACGTTTTCTT
CGAAGAACGCTTCAATGATGGATGGGAGAACGGATGGGTGAAATCGGATTGGAAAAAGGATGAAGGTGCTGCAGGAGAC
TGGGTACACACGGCAGGGAAATGGAGTGGTGACTCCGAAGACAATTGGGATTCAAACCAGTCCAGACTTACGATTTTTT
GCCCATATCAGCTGAGTTTCCTGAATTTAGCAACAAGGGCAAGGATTTGGTTGTCCAGTTTTCTGTAAAGCATGAACAGG
ATCTTGATTGTGGTGGAGGTTATATCAAGCTTTTAAGTGGTGATGTGGATCAGAAAAAGTTTAGTGGTGATACCCCGTA
CAGCATCATGTTTGGGCCTGACTTCTGTGGCTATAGCACAAAGAAAGTCCATGTTATTTTGAACTACAATGACAAGAAT
CACCCCATTGAGAAGGAAATTTCTTGTGAAAAGGATCAACTGACACATGTCTACACTCTTGTGATAAGACCTAACAACA
CCTACAGTGTTCTAATTGATAATGAAGAGAAACAAAACGGCAGTCTGTACAAGGAC

> SEQ ID NO: 5469 109513 44094_300114_1b
GCCATTACGGCCGGGGCTCTTCAGTTTTTGGTGGATAGAGGGAGGGCCGTGAAGATCGACACCGTCCGCAATGTCGAAG
CGAGGACGAGGAGGTTCCGCTGGGAACAAGTTCAGAATGTCGCTGGGTCTGCCGGTGGCGGCGACGGTGAACTGCGCCG
ATAACACAGGTGCTAAGAACCTGTACATCATTTCAGTGAAAGGGATCAAAGGAAGGCTTAACAGGTTGCCTTCAGCTTG
TGTTGGTGACATGGTTATGGCTACTGTTAAGAAAGGTAAGCCAGATCTTAGGAAGAAGGTTATGCCAGCTGTCATTGTT
CGTCAGCGCAAGCCCTGGCGCCGAAAGGACGGTGTTTTATGTACTTCGAAGATAATGCTGGTGTGATTGTGAACCCCA
AGGGTGAAATGAAAGGGTCTGCCATCACTGGCCCTATTGGAAAAGAATGTGCTGATCTTTGGCCTAGGATTGCAGGTGC
TGCCAATGCTATTGTGTAGGAGTAGGGTTGCTAAGTAGTTTACAGTTCTCGTTTTGTTGGGTTTTCATCAAGTTTCTGA
ATATCTGAGGGCTTTGTCTTAATAAGAATTATTGCTCGGAATTTTGCAGTACTAAATGGTTTTCACCTATCAAACAAAC
AACAACAACAACCCAGTATAATCCCATAATCCCACTTAGTGGGGTCTGGGGAGGGTGGTGTGT

> SEQ ID NO: 5470 109513 1119694_301899_1b
ATTTTGGGGAGGTATCCGTCGGGACGCGAAGAAGTTCTGAAGCCATGTCGAAGCGAGGACGAGGAGGGTCCTCCGGGAA
CAAGTTCCGGATGTCTCTGGCTCTTCCAGTGGCCGCTGTTATGAACTGCGCGGACAACACCGGAGCCAAGAATCTCTAC
ATCATCTCGGTCAAGGGCGTTAAGGGAAGACTCAACCGTCTCCCTGCGGCTTGCGTTGGTGATATGGTCATGGCCACCG
TCAAGAAGGGAAAGCCTGACCTCAGGAAGAAGGTTATGCCGGCTGTCGTCGTTAGGCAGCGCAAACCTGGAGGCGAAA
GGACGGCGTCTTCATGTACTTCGAAGACAATGCCGGAGTCATTGTGAATCCCAAGGGGGAAATGAAAGGCTCGGCCATT
ACAGGACCCATTGGGAAAGAGTGCGCTGATTTGTGGCCCAGGATTGCTAGCGCAGCCAATGCAATAGTCTAACCCTGCA
CTTGCGCATCAGTTTTTGTCATTAGGGTCAATGCGGATCTTTAGTAATACAAAGTGGGCTACTGGTTTTGTGGGCTATA
TAAATGCTATATCTTTGAAAGATTTGAGTAC

> SEQ ID NO: 5471 109523 233978_301095_1b
AACAAGGGCAGTGCTTGTTTGGCTCACAAAAAAGGTGTCTCGAGAGGTCGCCAAGACAAGGAAGCCCAGCGGAGGAGGA
GCAGCAGCAGCATTAGCAGCAACAGGAGGGACAGGAGGAAGCTCAATGGGGACCGTCGCAAACAACTGGAAGCTGGAAG
CCCATCCAAACATGCCTAAAGGAAAGATTGTGGCTTTGATTGTTTTGGATGGATGGGGCGAGCAGATCAAGGACGAGTA
CAACGCCATCCATGTCGCCCCTACCCCCTGCATGCACTCGTTCCGAGAGACTGCCCCCGACAGGTGGAGACTTGTCAAA
GCCCACGGACCTGCCGTTGGACTTCCAACCGAGGACGATATGGGAAATAGTGAGGTTGGTCACAATGCTTTGGGAGCGG
GACGTATTTTTGCTCAAGGTGCGAAGCTGGTCGATGCGGCTATTGCATCCGGGAAGTTGTTTAAAGGAGAGGGATTTAA
TTACATCAAGGATGCTTTTGGTACTGGCACTCTCCACCTTATTGGATTGTTGAGTGATGGTGGTGTTCATTCGAGATAC
GACCAGCTTCAGGGTTTCATGAAAGGAGCTGTCGAGCAGGGCTGC

> SEQ ID NO: 5472 110965 201447_300716_1b
CGGACGCGTGGGTTCTCATAATGACTTCGAACGTCGGAAGCAGCGTCATCGAGAAGGGTGGTCGGAAGATAGGTTTTGA
TCTCGATTACGATGAGAAGGACAGCAGCTACAGCAGGATCAAGAGCCTTGTCGTCGAGGAGATGAAGCAGTACTTCCGC
CCCGAGTTCCTCAACCGTCTCGACGAGATGATCGTCTTCAGGCAACTCACCAAGCTGGAGGTCAAGGAGATCGCTGAGA

FIG. 2 continued

```
TCATGCTCAAGGAGGTCTTTGACAGGCTCAAGGCCAAGGACATTGATCTCCAGGTCACCGAGAAGTTCAAGGAGCGTAT
CGTCGACGAAGGCTTCAACCCGAGCTATGGTGCGAGGCCGCTAAGGAGGGCCATCATGAGGCTCCTGGAGGACAGCCTC
GCGGAGAAGATGCTATGGGGAGGTGAAGGAGGGCGATTCCGCCATTGTCGATGTGGATTCGGAGGGGAAGGTGATTGTA
CTGAATGGCCAAAGTGGGTTGCCTGAGCTTTCAACTCCGGCTGTCACTGTGTAGTTTCATATATGCTGCAGTGTTCTTT
ATCCAGATACATTTCTCCATAGTTAGCAACTTAGCATAACTGTATATATAGTGTATACAAATCA
```

> SEQ ID NO: 5473 110965 103514_300363_1b
```
TGGTATGAACGCAGAGTGGCCATTACGGCCGGGAGATAGGGTGGTTGACGAAGGATACAACCCAAGCTACGGGCACGGC
CTCTGAGAAGAGCTATCATGAGACTGCTAGAGGACAGCATGGCGGAGAAAATGCTTGCAGGTGAGATCAAAGAAGGTGA
TTCGGTTATTGTGGACGTGGATTCAGACGGCAATGTGACTGTTCTCAATGGCAGTAGTGGTACTCCCTCAAACCCCACT
CCGGAGCCTATCCCTGTGTAGATCAAGTGATCATGTTTTAGAGTTCATTTCTGTTGGCCACTAAGCTCTGGGCATATGA
AGCAATTTGTGGGTTTATCTTTGGGGCCTCTGGGTAAAATCTTACCACGTTGAGAAGGCAGCATCCTTTCTATGTTGAG
CTTCAAGGATTTTACAAAATATACGCTGTTGGATTAATTGGATCAAGATTGTAGTTCTTCCCAAGAAAGTGTTGTATTA
GCAAGACACTCCTCACCAAATACATTCTGATTATTATGGGTGGCAGTTAACATTGTCCTCAGCTTTGGTCTTGCTGTCC
TCATTTGTGATCATGTGATTTTCTTTCTTCTTTCCCTCTTTTCATTATATTTTGGCTCAGGTCACAATGGC
```

> SEQ ID NO: 5474 110965 142555_300436_1b
```
CCCTGCTACAATAGGATTAAGAGCTTGGTGACTGAAGAGGTGAAGCATTACTTCCGACCTGAGTTCTTAAACAGATTGG
ACGAAATGATTGTGTTCCGGCAGCTTACCAAGCTGGAGGTTAAGGAGATTGCTGATATTATGCTCAAAGAAGTGTTTGA
CAGGCTCAAGGCAAAGGACATCGACCTCCAGGTGACAGACAAGTTCCGGGATAGAGTTGTCGACAAAGGTTACAACCCA
AGCTATGGTGCCAGGCCTCTGCGGCGTGCTATTATGAGGCTTCTGGAGGACAGCTTGGCGGAAAACATGTTGGCTGGCG
AGGTCAAGGAAGGTGACTCTGCTATTGTTGATGTCGATTCAAAGGGCAAGGGGATAGTTCTTAACGGTGGTAGGGGTGT
TCCGGAACCACTGGCACCTGCTCTGAGTGTCTAATTGAAGGATAATATCGCCGTTCTGGAATTATGGCCTTTTCTCTTC
TCTCAGCTGGGGCGCTCATGATGGTGAAAACTAGATGGCATAAATTCTCCCTTCATTTAAGCGCTTTCACTTTTCCTCTT
TTTTTCCAACAGAGGCAGTACGAATGTTATGGAAATGAATCAACAGAGATGCATTTAGCAAACAAACT
```

> SEQ ID NO: 5475 111075 109332_300045_1b
```
CTGTCGTACAATTCTTGCTTATGATGTGTGACACATGGATGGCTTCATATGTTACTGGACTATCTCTAGAAACTCCTTT
TAATTTTTTTTAAAAAATGCGAGTAGGATCCAATGGAAGGCTATTGACAGTCAACAAAGCTGCTCCAAGAGGATCAC
GGCCAGAACGTCCACCTCGAACATTTCACCTACTTACAGATCTGGTTGGCAACATCCCGTGGGACATTGATGATGC
ACGCCTTGAGCAAGTCTTCAGTGAACATGGTAAAGTAGTAAGTGCTCGGGTGGTTTTTGACAGAGAGTCTGGACGGTCA
CGGGGCTTTGGTTTTGTGACTATGTCAAGTGAAGCTGAAATGAGTGAAGCAATCGCCAACCTTGACGGACAGACTCTGG
ATGGGAGGACAATCACGGTTAATGCTGCTGAAGAAAGACCTAGGCGCAACTCATACTGAATTGATCATACATTTATTTG
TTCCATTGACATAGCAGTCATGCAGCTATGAGCAGCTAGATTTTATCAGACCTATTCGATTTAGCTCTCTACTTCTTTG
TTTTTATTCCTTGATTGCTTATATATAGGTACGGGACTTCTTTTTTCTTTTGGTTCTT
```

> SEQ ID NO: 5476 111075 110947_300048_1b
```
CCCACGCGTCCGCCATTATATATAAAAAATATCAATGGCTGAAGTTGAATACCGTTGCTTCGTCGGTGGGCTCGCATGG
GCTACCACTGATCGAACCCTAGGCGAAGCTTTCTCTCAGTATGGCGAGGTGCTTGAATCGAAGGTCCGTTTGTCGGTCG
CAGAGCAGAGATCGGAATCCGAGCCCTGCTTTGGCTTCGTTTACCCCTCTGTTACTGTTGATTCATCTGTTACTGTTAC
TATGTCTCTATCTGTTACTGTTGATTCATCTGTTACTGTTACTATTTGATACTATTATTCGTTCTCTCTAACGATCATC
AACGACCGTGAAACCGGTAGATCTAGAGGATTTGGCTTTGTTACTTTTGGCGATGAGAAATCCATGAGGGACGCTATCG
AAGGGATGAACGGCCAAGACCTTGATGGTCGTAACATAACCGTTAACGAAGCTCAATCACGCGGAAGCGGTGGAGGCGG
CGGCGGCGGCGGTGGTTTCCGCGGTGGACGTCGTGAGGGAGGCGGCGGATACGGAGGGGGAGGA
```

> SEQ ID NO: 5477 111075 14980_300242_1b
```
CCCACGCGTCCGCACTACTCTCACTGTAATCCCTTAGATCTTCTTTTCAAATTTCAATGGCGTCCGGTGATGTTGAGTA
TCGGTGCTTCGTTGGAGGTCTAGCATGGGCCACTGATGACAGAGCTCTTGAGACTGCCTTCGCTCAATACGGCGACGTT
ATTGATTCCAAGATCATTAACGATCGTGAGACTGGAAGATCAAGGGGATTCGGATTCGTCACCTTCAAGGATGAGAAAG
CCATGAAGGATGCGATTGAGGGAATGAACGGACAAGATCTCGATGGCCCTAGCATCACTGTTAACGAGGCTCAGTCACG
```

> SEQ ID NO: 5478 111075 139067_300406_1b
```
CCCCTGGTGGTCTCTCAGAGGTGGGTTGGCTTCTCCTCCCCCTCCCGGTTCGGTTCGGGTCCGGTTCGATTTCGGTTTT
TTCTTCGGTTCGGGGGTTGGTGGGAAAGCATGGCGGCGCCGGATGTTGAGTACCGCTGCTTCGTCGGCGGCCTCGCCTG
GGCCACCGACGACCGCTCCCTCGAAGCCGCCTTCTCCACCTACGGCGAGATCCTCGAGTCCAAGGTCCGATGGATTCCC
TCTTCTCTGTGTTTTTTTGATGCGATTTGGTGGTGGTGTTCGTCAGATCTGGTTGCGTAGATCTGACTATGGGGTTG
TGGTATGCGGTGCAGATCATCAACGATCGGGAGACGGGGAGGTCGCGCGGGTTCGGGTTCGTGACGTTCTCGAGCGAGC
AGGCCATGCGCGACGCCATCGAGGGGATGAACGGCAAGGAGCTCGACGGCCGCAACATCACCGTTAACGAGGCCCAGTC
```

FIG. 2 continued

```
GCGCCGCTCCGGAGGCGGAGGCGGCGGTGGCTACGGCCAGCGCGGCGGAGGCGGAGGCTACGGTGGCGGCGGCTACGGT
GGTGGTGGCGGCGGCGGTGGCTACGGCCAGCGCCGTGAAGGCGGCTACGGCGGTGGCGGTGGCTACGGTGGCGGCCGTG
GTGGCG
```

> SEQ ID NO: 5479 111075 1100416_301460_1b
```
GGGGTTTCAGCTGCTCCTTCTCAGTTCCGGTTCGTTTCTTGGTCTGTTTTTTGTGTTCTGATACTGCAATGGCCGCTGC
CGTAGAGTATCGCTGCTTCGTCGGAGGTCTGTCATGGGGCACAGACGACCGCGCCCTCGAGCGCGCCTTCAGCACCTTT
GGGGAGGTCATCGATTCGAAGGTTGTTAACGATCGTGAATCGGGGAGATCTCGTGGGTTCGGATTCGTGACATTCACTC
AAGAACAGTCTATGCTTGACGCGATTGAGGGGATGAACGGGAAAGAGCTCGACGGGAGGAACATCACTGTGAATCAAGC
ACAAGAACGGAACTCCGGAGGTGGTGGAGGTGGGTTTCGAAGGTCCGAAGGCCGTTACGGCGGGGGCGGGGGCGGATAC
GGCGGGGGCGGTTACAGATCC
```

> SEQ ID NO: 5480 111075 272162_200041_1b
```
AAACTTTTCTCCATCTCTTCGTAGCCGCCTCCCTCTCATCTCCGAATCTTCATTATTTTCAAAGTAGCAGCGGTCTGTT
TCAGAAATGGCGGATGATGAATATCGCTGTTTTATTGGTAATTTGTCATGGTCAACTTCTGATCGAGGATTAAAAGATG
CATTTGAGAAGTTTGGAAATCTTGTTGATGCAAAGGTTGTACTTGACAAGCTCTCTGGCCGATCTCGTGGATTTGGTTT
TGTTACATTTGATGAAAAGAGAGCAATGGAAGATGCCATTGAAGCAATGAATGGAGTGGACTTAGATGGTCGTGATATT
ACTGTAGACAAAGCCCAGCCTGACAAAGGTTCAGGTAGAGATTTTGATAGTGATCGACCTCGTGACCGAGATCGGGGTC
GCGATCGTGATCGCGGTAGCCGTGATTATGGAGGTGGACGGGGATCTGGTGGTGGTGGAGACTGCTTTAACTGTGGTAA
GCCAGGACACTTTGCCAGAGAATGCCCTAATGAAGGGGGTAGAGGTGGTCGGTATGGTGGCGGAGGTGGTGGTAGTAGA
AGCAGTGGCTATGGACCTGATAGGAACGGAGATCGATATGGAAGCCGCAGCGGCA
```

> SEQ ID NO: 5481 111075 255769_301643_1b
```
GTGTTGTTGTTTAGTTCGGGTTTCCTGTTTCGTTCTTTGTGGGCCGTGGATCTAGCGGAAGACACCCCGCCGTTCTCGA
GCTTCGAACAGCCGACGTTGCCTAGCTGGGATACATGGCGGCAGTGGAGTATTCCTGTTTCGTCGGAGGCCTGGCATGG
GCCACCGACGACCGCAGCCTCGAGACCGCCTTCCGCCCCTTCGGCGGAAATGTCACAGACTCCAAGATTATCAATGATCGTG
AAACTGGAAGGTCTCGTCGGCTTTGGGTTTGTTACCTTCTCTGAGGAGCAATCCATGCTGGATGCGATAGAGGGTATGAA
TGGGAAGGAGCTCGATGGAAGAAACATTACTGTAAACCAAGCTCAGAGCCGTGGTTCTGGAGGTGGAGGTGGTGGTGGC
GGTGGTGGATTCCGCAGATCTGAAGGTGGCCGATCAGGAGGAGGAGGGGGATATGGAGGAGGAGGGTATGGAGGAGG
```

> SEQ ID NO: 5482 111075 255857_301645_1b
```
ACCCACGCGTCCGCGGACGCGTGCGGTTACAAGGGCCTCTTGCCCGGTCCGGTGTTCGATTCCCAGGTTTTCCGGCTCG
GTCTTGTTCGGTTCGTTTTTTCCGGTTCGCGTTTCGGATCTGAGGTATGTCGTCTGATGCGGAGTACCGCTGCTTCTTT
GGGGGGCTTAGCGTGGGTCACCGATGATCAAACCCTTCAGGAGGCGTTCAGTCGTTATGTGTTTTTGTTATAGACTCTA
AGGTGATTAGTGATCGGGAAACGGGGCGGTCTCGCGGGTTTGGCTTTGTCACCTTTGCAGATGAGCAGGCGATGATGGA
GGCCATTCAGGAGATGAATGGGAAGGAGCTAGATGGGCGGAATATAACCGTCAATCAAGCACAGAATCGCTC
```

> SEQ ID NO: 5483 111075 227520_301029_1b
```
CATCCGATTCGCCGCCGCCTTCGTCTTCCTCGCAGAGATGGCGGACGTGGAGGAGTACCGTTGCTTCATTGGGAATCTG
TCATGGTCCACAACTGATGAAAGCCTCAAGGATGCCTTTGGCAAATTTGCCAACCTCACTGAAGCAAAGGTGGTTTTTG
ACAAGTATTCTGGCCGTTCTCGTGGTTTTGGCTTTGTGACCTTTGATGAAGAAAAGCCATGGAAGATGCTATTGAAGG
AATGAATGGATTGGATTTGGATGGGCGGGCGATCACTGTCGATAAAGCTCAGCCACAAGGACCTGGTAGAGACCGTAAT
GGAGACCGTGATTATGATCGTGACCGTGGATCTCGTTATGACCGTGGCCGTGACTTTGGTGGTGGTGGGCGTGCACCAC
GTGGCTCAGGTGGTGGTGGGATTGCTACAAGTGTGGAAAACCTGGCCACTTTGCTAGAGAGTGCCCATCTGGAGATGG
TGGTGGTAGAGGTGATAGATATGGTGGCCGAGATGATAGGTACGGTGGTGGTGGTGGCGGTGGCGGCCGTTATGGATCT
GACCGTGGTGGTGACCGTTATTCTGGTCGTAGTCGAGATGGTGGTGGCTACG
```

> SEQ ID NO: 5484 111075 233303_301089_1b
```
AAGAAATGGCCGAGGTCGATGTGGAGTACCGTGGCTTCGTCGGCGGCCTCGCTTGGGCGACGGACGACATGAGCCTCGG
CAACGCATTCAAATCCTTCGGCGATGTCGTCGAATCCAAGGTACATATACAGTGAGTGACAAGGGCCGCTTGAATCTTT
GCTTTGCTGCCCAGCCGCCGCCCCGGATCGAGAGAATGCTGGCCAATTTACCCCAAGATCTCTCTCTCTTCTTTGTAG
GTGATCAACGACCGCGAGACGGGCAGATCCCGCGGCTTTGGATTCGTCACTTTCCGGGACGAGAAATCCATGAACGACG
CCATCGAATCGATGAACGGCAAGGATCTGGATGGCCGCAACATCACCGTCCACCAGGCACAGCAAAGGCCGACCATGAC
CAGCCGCTATAGTGGATCTAACCAAGACCGTGGTGGCGACCGCGGCAACGGCGGCGGCTACAGTGACCGTGGTGGCGAC
CGTGGTAACGGTGGCGGCTACAGTGACCGTGGTGGGTATAACAGGCGGAATTCTGGCGGGGGCGGCGGCGGTGGCGGCG
TCGGTGGCGGCGTCGGTGGTGAGGCCGGCGGAGCTGGCGTTGGTGGCGGCGGCGGTCGCCGCTACGGCGGTGCCCGGTC
AGACGGTCGGTCCGATGTTGGTAACTGGAGAAGAAGCGAGTAGTAGCAGCAGCTCGACGAGGACGGATCACGTCCAGAG
TAAACTTAATTGTCGTCCATCCAGACTTGTTATTGTCTAATTCCCCTGCTATTGTGTTGTCATACAGCTAGTGAAATAC
```

GAAACTTGTGGTTTT

> SEQ ID NO: 5485 111139 201773_300719_1b
CGGACGCGTGGGCAACGCGAAGCTCTCGTCGCGCACAACCAACTCGAGACCGCGGGGAGGCGAACCAACGGGCGGCGTG
GGCATGGGGAGGTCGCCATGCTGCGAGAAGGCGCACACGAACAAGGGGGCGTGGACGAAGGAGGAGGACCAGCGGCTGA
TCGCCTACATCAAGGCGCACGGCGAGGGTTGCTGGCGGTCGCTGCCCAAGGCGGCGGGGCTCCTCCGCTGCGGCAAGAG
CTGCCGCCTCCGCTGGATGAACTACCTCCGCCCCGACCTCAAGCGCGGGAACTTCACCGACGACGACGACGAGCTCATC
ATCAAGCTCCACGCCCTTCTCGGCAACAAGTAAGTTGTAAACGGATTTCAATGCGCTGTCATCTGTTCTTGTGTTCTTG
GTGCTGATCGATCGTTTGGTTGGTTGGCGCAAGTGGTCGTTGATTGCGGGCAGCTGCCGGGGAGGACGGACAACGAGA
TCAAGAACTACTGGAACACGCACATCAAGCGCAAGCTCCTGAGCCGGGGCATCGACCCGCAGACGCACCGGCCGGTC

> SEQ ID NO: 5486 111139 231346_301083_1b
ATGGGAGGAGTACGCGGCGGATCATCGTCGCTGCCATCCTCTCCTTCGAGTTCGGCGTCTTCGCCATCCAATTCTTGCA
CTTGCTGCGCTGAATCGCAGCTGCGGCGGGGCCATGGACGTCGGAGGAGGATGCGCTGCTGCTGCGGCATATGAGAGT
GCTTGGGGATCGAGGGAATTGGCGCAAGGTCCCAAAGGCAGCAGGCCTGATGCGCTGCGGGAAGAGCTGCCGGTTGCGA
TGGCTCAATTATCTTCGTCCTGATCTCAAGCGAGGAGGTTTCACCGAGGATGAGGACGCGTTGATCATCAAGCTGCATT
CTCTGCTAGGAAACAGGTGGTCGCTTATAGCGGGTCGAATTCCCGGTCGCAGCGACAACGAGATCAAGAACTACTGGAA
TTTCCATCTGGGAAGAAGCTCCTGAAGGTGGGCATCAATCCAAAGACACACAAGCCACTGAGCAGCAGCCCAGTGCCT
GCCAAGACCGAGATGCCATCCAGGAGAACTTCCAAGTTCTG

> SEQ ID NO: 5487 111139 316876_301427_1b
GCAGCATGGGGAGACAGCCATGCTGTGACAAGCTAGGGGTGAAGAAAGGGCCGTGGACGGTGGAGGAAGATAAGAAGCT
TATAAACTTCATACTAACCAATGGCCATTGTTGCTGGCGTGCTTTGCCGAAGCTGGCCCGTCTCCGTCGCTGTGGAAAG
AGCTGCCGCCTCCGGTGGACTAACTATCTCCGGCCTGACTTAAAACGAGGCCTTCTCTCGCATGATGAAGAACAACTTG
TCATAGATCTTCATGCTAATCTCGGCAATAAGTGGTCTAAGATAGCTTCAAGATTACCTGGAAGAACAGATAACGAAAT
AAAAAACCATTGGAATACTCATATCAAGAAGAAACTTCTTAAGATGGGAATCGATCCTATGACCCATCAACCCCTAAAT
CAAGAACCTTCTAATATCGATAATTCCAAAACCATTCCGTCCAATCCAGACGATGTCTCAGTGGAACCAAAGACAACTA
ACACGAAATACGTGGAGATAAGTGTCACGACAACAGAAGAAGAAAGTAGTAGCACGGTTACTGATCAAAACAGTTCGAT
GGATAATGAAAATCATCTAATTGACAACATTTATGATGATGATGAATTGTTTAGTTACTTATGGTCCGACGAAACTACT
AAAGATGA

> SEQ ID NO: 5488 111139 6447_300322_1b
ATTTATAAGAACAAGATCAAGAATCAAGAATCAAGATGATGGGAAGAGCACCGTGTTGTGATAAGGCCAACGTGAAGAA
AGGGCCTTGGTCTCCTGAGGAAGACGCCAAACTCAAAGATTACATCGAGAATAGTGGCACAGGAGGCAACTGGATTGCT
TTGCCTCAGAAAATTGGTTTAAGGAGATGTGGGAAGAGTTGCAGGCTAAGGTGGCTCAACTATTTGAGACCAAACATCA
AACATGGTGGCTTCTCCGAGGAAGAAGACAACATCATTTGTAACCTCTATGTTACTATTGGTAGCA

> SEQ ID NO: 5489 111175 240438_301314_1b
AAGCTGGGTGGGATTGACAAGAGGACCCAGCTTGTAGATGAGATGACCCGTGGTGGTAGACTTGCCGGAGTCGACATGA
CCAATCACCACAATGTTGATGTGAACCTTCTCCTCGAGGTTGAGGAGGTTGAAAAGAAAATTTGTAGATCTTGTGTGGC
ACTGGTGGAGGAAGCGCTCGCCATCGCTAGATCCTTGATATTTCGATCGATTCTCGCCCATGGCCGCCGCAACGATGAT
GAAATCCACACTGGCAGCGAGCTGTTCGTCGCTAGATCGAGTCGCCGCCACGAATGCGTCGCCGGCAGCGTCTTGTACC
ATGGTCGCGTCGCCAAAGGCAAAGGCTTTTAAGATGTCCAGTTTCTTTGCCGGATCCGAGGTGGGCTTGTACTCGGCTC
CATTGTCGAGTCGTGTGGCCAAGGGTTCCATGGTTCCAGTGAGGGCAGCGCTTGCGGAGGCCCCGACCAAGCCAAAATC
TGCTGGGACGAAAGAGAAGACTCGAATTGCCATCAATGGCTTTGGACGCATTGGCAGACTGGTTCTCCGGGTTGCGTTG
ACAAGAGACGACATCGAGGTTGTCGCAGTAAATGATCCATTCACCAGTTCGAAGTATATGGCTTACCTCTTTAAGTATG
ATTCCACTCACGGGATCTTCCACGAGGAAGTGAAAGCCGTCGATGACAGCACGCTTGAAGTTGGTGGTCACAAGATCAA
GGTTTTCGGACAGCGTGACCCCGCTGATATTCCATGGGGTGATGCCGGCGTCGACTTCGTCGTGGAGGCCTCTGGTGTC
T

> SEQ ID NO: 5490 111175 142670_300500_1b
CGGACGCGTGGGTTTTCACTAAGCAATTTTCTCTCCTAATTTCTTTAAACCCCTTTTTTTCTCCCCTAAGCCATGGCAT
CTGACAAGAAGATCAAGATCGGAATCAATGGATTTGGAAGGATTGGTCGTTTGGTGGCAAGAGTTGCTCTGCAGAGAGA
TGATGTTGAACTAGTTGCAGTGAACGATCCATTTATCTCTACTGATTACATGACATACATGTTTAAGTATGATTCAGTT
CATGGACAATGGAAACACCACGAGCTTAAAGTCAAGGATGAAAAGACCCTTCTTTTTGGTGAGAAGTCCGTCAGAGTCT
TCGGAATTAGGAACCCTGAAGAAATTCCATGGGCTGAAGCTGGTGCTGATTTCGTTGTGGAATCCACTGGTGTCTTCAC
TGACAAGGACAAGGCTGCTGCTCACTTGAAGGGTGGTGCCAAGAAGGTTGTGATCTCTGCTCCTAGCAAGGATGCCCCC
ATGTTTGTTGTGGGTGTCAACGAGAAGGAATACAAGCCAGAATATGACATTGTCTCCAATGCCAGTTGCACTACCAACT

FIG. 2 continued

GCCTTGCACCTTTGGCTAAGGTCATCAATGATAGGTTTGGCATTGTGGAGGGTCTCATGACTACTGTCCACTCCCTTAC
TGCCACCCAGAAGACTGTTGATGGTCCATCCATGAAGGACTGGAGAGGTGGAAGAGCTGCTTCATTCAACATCATTCCT
AGCAGCACTGGTGCTGCCAAGGCTGTTGGAAAAGTACTCCCAGCTCTTAATGGAAAATTGACTGGAATGGCCTTCAGAG
TTCCAACTGTTGATGTTTCTGTTGTGGACCTTACTGTAAGACTAGAGAAAGAGGCCTCTTATGATGAGATCAAAGCTGC
AATC

> SEQ ID NO: 5491 111223 255766_301643_1b
ACGCGTCGCGCAGAGCGATAGGTGTGGTGTGGAGAGGTAGATGGCCATGTTGAGTCGGGTGCTGAGGCGAGTGCCTGCT
TCCTTCACTGGGAGATCTCCGCGGCAGCCTCTCGAGGAGGTTTCTAAGCGCCTCGAGGAGGCCCTAGACGCCCAGACTC
CGTCCAAGGCTGCCTCCATTGTGGGGTCACAAAGCCGGGACTATTCAAGAGAATCAGCAGGGTCAAAGAGTATCAGAGC
TTTGGCATTAGCTGGAGCTGGTGTTACCGGTTTACTTGGGTTGACAGGCTTAGCGTATGCCGATGAAGCTGAGCACGGA
TTAGCTTGTCCAGATTATCCTTGGCCTCATTCTGGAGTCCTCAGCTCTTATGATCATGCATCAATTCGACGGGGCATC
AAGTGTATCAGCAAGTTTGTGCTGCTTGCCACAGCATGCAGTATGTGAAATATCGGGATTTGATTGGTGTTTCGTACAC
AGAAGAAGAGGTGAAGGCTCTGGCAGCCGAAATTGAAGTCGAAGATGGACCCAACGACGAAGGGGAAATGTACTCACGC
CCAGGCAAGCCCAGCGATGCCTTCCCGAGCCCCTATACTAATGAGCAAGCGGCCCGATATGCTAATGGTGGAGCTTACC
CTCCAGATCTAAGCTTGATTACAAAGGCTCGTCCCAACGGGCAAAATTATGTGTTCTCTTTGCTTA

> SEQ ID NO: 5492 111223 266875_200031_1b
TGGTTTTCCGGATCTCGCAGGACCTGTTGTCCTATCGCCGTCGATCAATTCTCTCTACAATCCCTGTCCGAGGGCTTGA
CTAAAAATGTTGGGAGGTAGAGCAATCCATCGGTTATTAGGCAGGAAATTTCAATCTGAATCCTCGGCCTCTCCAATTT
TATCATCCATTGTTTCCAAACAAGCCCAAGAAGAATTTGGATCTTTTGGCATGAAGTCCCTCAGATCATTGGCACTCAT
TGGAGCAGGTGTATCTGGACTCTTAGGTTTTGCGACAGTAGCATCTGCTGATGAAGCTGAACACGGATTGGAATGTCCA
AGCTATCCTTGGCCTCACGCAGGCATTCTTAGTTCATATGATCACGCTTCGATTCGTCGTGGTCACCAGGTTTATCAAC
AAGTATGTGCTTCTTGTCATTCAATGTCACTTGTTTCATATCGTGACTTGGTTGGGGTAGCATATACAGAGGAGGAAGT
AAAGGCCATGGCAGCTGAGATTGAAGTGGTTGATGGGCCTAATGATGAGGGTGAAATGTTCACTCGTCCTGGTAAACTG
AGTGATCGTTTTCCTCAGCCATATTCAAATGAAGCAGCTGCTAGATTTGCTAATGGGGGAGCCTACCCTCCGGATTTAA
GTCTTGTTACAAAAGCACGTCATAATGGTCAAAACTATGTGTTTGCCCTTCTAACTGGCTATCGTGATCCTCCTGCTGG
TGTTTCGATTCGCGAAGGACTTCACTACAATCCTTACTTCCCTGGTGGAGCTATTGCCATGCCTAAAATGCTTAATGAT
GGCGCTGTTGAATATGAAGATGGTACCCCTGCAACTGAAGCACAGATGGGGAAAGATGTGGTGTCATTTTTAACTTGGG
CTGCTGAACC

> SEQ ID NO: 5493 111223 53150_300084_1b
CCCACGCGTCCGGATGTTGACCCGCCCTGGTAAACTCAGTGACCGGTTTCCTCAGCCATATGCAAATGAATCATCTGCA
AGGTTTGCTAATGGTGGAGCGTATCCTCCTGATCTAAGTCTTATAACTAAGGCACGTCACAATGGTCCAAACTATGTCT
TTGCGCTTCTGACTGGTTACCGTGATCCCCCTGCTGGCATATCGATTAGAGAGGGGTTACACTACAATCCTTATTTCCC
TGGGGGAGCAATTGCTATGCCCAAAATGCTCAATGATGAAGCTGTTGAGTATGAAGATGGTCCCCGCCACAGAGGCA
CATATGGGTAAAGATATTGTATCATTCTTGGCCTGGGCAGCTGAACCAGAAATGGAAGAGGAAGGGAAACTGATGGGTTCA
AATGGATATTCCTACTCTCTCTCGCTCTTCTCCAAGCTGCTTACTACAGGCGACTAAAATGGTCGGTTCTCAAGTCCCG
CAAGCTGGTTCTTGACGTGGTTAACTAAAGCGCCGCTGAAAAGCTTTTGCATTGGCCTGGCCACACACAGTCGTATTTT
CAACAAAGGATGTTAAATAGAGAAGAGCCTTTCTCTGGGTAATAACGTATCATCATTTTTATGTGTCATAAAAATCTTT
GATGAGACCAGTTCTCACCTGAAGGTGAAAAGACCTCATCGGTCTTCTTTTTCCTTCGATTATTACTAGAGAGTTTTAT
GAGGATAAT

> SEQ ID NO: 5494 111223 195440_300634_1b
CCGAGATCGAGACCATCGCCCTCACTCTTTGATTGCGGCTCCCCCTGCGGCTTCGCTACAGCTTGCCAATTATGTTGGC
AAGGTCGTCTTTGCGCCCGGCGCGCCTCCTCAATGGGCTTCGAAATGGCGCCGTCAACGTCCCCAAGCGTGCTGCCTCG
ACGAGCTCGGAAGCTCCCACCGCGCGCATGAACCTCGCCGCTATTGCTTCCACCACCCTCGCCGCCGGCTCCATGGCCT
GGTACTACCATCTCTACGGACCCGTCGCTTTTGCTTCGTCCCCTGCTGAGGAGGGTCTCCACGCTACTCAGTACCCTTG
GGTTCACCAGCAGTTCTTCAAGACTTTTGACCACCAGGCTCTCCGACGTGGTTTCCAGGTCTACCGTGAGGTCTGCGCC
AGCTGCCACTCCCTGTCCCGAGTCCCCTACCGAGCTCTCGTCGGTACTGTCCTGACCGTCGACGAGGCCAAGGCCCTGG
CTGAGGAGAACGAATACCCCGATGAGCCCGATGAGCAGGGTGAGATCCCCATGCGACCCGGAAAGCTGGCCGACTACAT
TCCTCCTCCCTACAAGAACGACGAGGCTGCTCGATTTGCCAACAACGGTGCTCTTCCCCCGGATCTGAGCTTGATCGTT
AAGGCTCGCCACGGTGGCTGCGACTACATCTTCAGCTTGTTGACTGGTTACCCTGAGGAGCCCCGGCTGGTGTCCAGG
TCGCCCCCGGCATGAACTTCAACCCCTACTTCCCCGGCACTGGTATTGGTATGGCTCGTGTTCTGTACGACGGCCTCGT
CGAGTATGAGGATGGCACTCCCGCCAGCACCTCCCAGATGGCCAAGGACGTTGTCGAGTTCCTCAACTGGGCCGCCGAG
CCCGAGATGGACGACCGCAAGAAGATGGGCATGAAGGTCTTGGTTGCCACCACCGCTCTGTGGGCCATCAGCGTCTACG
TAAAGCGATACAAGTGGGCTTG

FIG. 2 continued

> SEQ ID NO: 5495 111230 194887_300767_1b
CCCCCCGAGAATTCAAACCGGATCAACCTCGCTCGCTTACTCGTGTTTAGGCATGGACGTTTCTGCTGCGCTCAGCAGC
GACTACTCGTCGGGGACGCCGTCGCCGGTGGCGGCCGACGCCGACGACGGCTCCTCCGCCTACATGACGGTGTCTTCGG
CGCCGCCCAAGCGGCGAGCGGGGCGGACCAAGTTCAAGGAGACGCGGCACCCCGTGTTCAAGGGCGTGCGCCGGAGGAA
CCCCGGGAGGTGGGTGTGCGAGGTGCGCGACCCGCACGGCAAGCAGCGGATATGGCTCGGGACGTTCGAGACAGCAGAG
ATGGCGGCGCGCGCACGACTTCGCCGCGCTCGCGCTCC

> SEQ ID NO: 5496 111230 202140_300781_1b
CCCTGGCTCAAACTCAAACACCAACACCTTCTTCCTCTTCTTCTTCTTCCAGCAGCAGCAACACACACTACTGACATGG
AGTACTACGAGCAGGAGGAGTACGCGACGGTGACGTCGGCGCCGCCGAAGCGGCCGGCGGGGAGGACCAAGTTCAGGGA
GACGAGGCACCCGGTGTACCGCGGCGTGCGGCGGCGGGGCCCGCGGGGCGGTGGGTGTGCGAGGTCAGGGAGCCCAAC
AAGAAGTCCCGCATCTGGCTCGGCACCTTCGCCACCGCCGAGGCCGCCGCGCGCGCCCACGACGTCGCCGCGCTCGCCC
TCC

> SEQ ID NO: 5497 111230 262552_301695_1b
TTGCAGCATGGGAAAACAAATCAACATAGAGAGTAGTGCTACTCATCATCAAGACAATATTGTTTCCGTTATAACAGCC
ACGATATCCTCCTCCTCCGTCGTAACGTCTTCGTCAGACTCTTGGTCTACCTCCAAAAGATCGTTAGTGCAAGACAATG
ACTCCGGAGGGAAACGGCGGAAGAGCAACGTTAGTGATGATAACAAGAATCCGACGTCGTATAGAGGAGTGAGGATGAG
GAGTTGGGGAAAATGGGTGTCGGAGATTAGAGAGCCGAGGAAGAAATCAAGAATATGGCTTGGCACTTATCCAACGGCA
GAGATGGCAGCTCGTGCTCATGATGTGGCGGCTTTAGCTATTAAAGGCAACTCCGGTTTTCTTAATTTCCCTGAATTAT
CCGGTTTGCTTCCTCGTCCGGTTAGCTGCTCTCCTAAGGATATACAAGCTGCAGCTACCAAAGCCGCCGAAGCAACCAC
GTGGCACAAACCGGTTATCGATAAGAAATTAGCTGATGAGCTAAGCCACTCTGAGTTGTTGTCTACCGCTCAGTCTTCG
ACTTCTAGTAGTTTCGTGTTTTCTTCGGACACGTCGGAGACTTCTAGTACGGACAAGGAAAGCAACGAAGAGACGGTGT
TTGATTTGCCGGACCTTTTCACGGACGGGCTTATGAACCCAAACGATGCGTTTTGTTTATGCAACGGCACCTTTACGTG
GCAGCTTTACGGAGAGGAGGATGTAGGGTTCAGGTTTGAAGAGCCGTTTAATTGGCAAAATGACTAATAA

> SEQ ID NO: 5498 111230 137787_300686_1b
CCACACTCGAGCAGAGCAAATACAGTTCAGGAATCAGGAGCAAGCAGAAACACACACACAAATCCGAAGATGTGCGGGA
TCAAGCAGGAGATGAGCGGCGAGTCGTCGGGGTCGCCGTGCAGCTCGGCGTCGGCGGAGCGGCAGCACCAGACGGTGTG
GACGGCGCCGCCGAAGAGGCCGGCGGGGCGGACCAAGTTCAGGGAGACGAGGCACCCGGTGTTCCGCGGCGTGCGGCGG
AGGGGCAATGCCGGGAGGTGGGTGTGCGAGGTGCGGGTGCCCGGGCGGCGCGGCTGCAGGCTCTGGCTCGGCACGTTCG
ACACCGCCGAGGGCGCGCGCGCGCACGACGCCGCCATGCTCGCCATCAACGCCGGCGGCGGCGGCGGCGGGGGAGC
ATGCTGCCTCAACTTCGCCGACTCCGCGTGGCTCCTCGCCGGGCCGCGCTCCTACCGCACCCTCGCCGACGTCCGCCAC
GCCGTCGCCG

> SEQ ID NO: 5499 111277 1123669_301914_1b
ATCCCAATTTGCCAATCGCCGGAGTTTGCTCTAATTTCATCCACTGGTTGCATCATGGCAGCGGCTACTGGTCTTGCAT
CACTGCAATCTCTCTCTCTCAGTTCTGTAGGACTAAGAGAGAAGAAGAAGATTGTGTCACTTCCTGCATCCACCTCTGCATT
TCTCGGCCATCAGATTGGAAGATTTCCTTTATCAGCTAAGAAGCCCATTTCGAAGGGTATAAGAGCCCAAACTGTAGCA
GCTCCTCCACCCCCAGCAGCAGCAGCACCAGTGGAGGTTGCCGAGTCTTCTGAGGCTAAAAAGATTTCCACGAAGAGCA
TCGTGGTGATCACTGGAGCATCATCTGGTCTTGGGCTGGCCACAGCCAAGGCATTAGCGGATAGTGGTGAGTGGTATGT
TGTAATGGCATGCAGGGACTTCTTGAAGGCAGAGAGAGCAGCCAGATCCGTGGGATTACCAAAGGACAGCTACCGTGTC
ATGCATTTAGACTTGGCATCCCTTGAAAGTGTCAGACAGTTTGTAGATAACTTCCGCCGATCCGGGCTGCCTCTGGATA
CCCTCGTCTGCAATGCTGCAGTCTACTTTCCAACTGCAAAAGAGCCCAGGTTTTCAGCGGAGGGGTTTGAGCTAAGCGT
TGCAACCAATCACCTTGGCCATTTTCTCTTGACTCGCTTGCTCCTTGAGGATATGGAAAAATCAAATCATGAATCGAGG
CGC

> SEQ ID NO: 5500 111277 1171324_302052_1b
GCTCGTCTCTGAAGCCGCCACACCACTCTGACAAGGAGGAAGCATGGCAGCTGTGGCAGGTCTTACCTCAGTGCAGTTT
CTCAGCTCATCATCTATCAAAGAGAATGTGTCACTTCCTTCTACTTCTCTGCGGGACTCGGCATTTATCGGCCTTCGCA
ATAAGATTCACAGTTTTGGTAGCTCAGTCTCATCACTAAACAAGGGAATATGCAAAAGAGGGGATGTTATTTCTAGGTC
TTTGAGAGTCCAGGCGGTGGCTGCCCCAGTGGAGACACTGAAGTCCTCAGAGCCGAAAAAGACATCGTTGAAGAATACG
GTCGTAATCACGGGTGCCTCGTCAGGTTTGGGCCTAGCAACTGCCAAGGCGTTGGCAGACAGTGGTGAGTGGTACGTCA
TCATGGCATGCAGAGACTTCTTGAAGGCCGAGAAGGCGGCCAAGTCCATTGGGATCCCCAAGGATAGCTACCGCATCAT
TCATCTGGACCTCGCCTCCTTTGATAGTGTAAAACAATTTGTTGATAACTTCCGGAGGCTGGAGCTCCCTCTAGATGCC
CTTGTTTGTAACGCTGCTGTGTACTTCCCGACTGACAAGCAGCCCCGATTCTCGGCCGAGGGCTTTGAGCTAAGTGTTG
CGACCAACCACCTTGGGCATTTCCTCCTAGCTCGCTTACTCCTGGAGGATTTGGAGAAATCGACCTTTGAATCGAAGCG

FIG. 2 continued

> SEQ ID NO: 5501 111277 126003_300633_1b
GAATTATTATTTAATTCTTTAGCTGACAATTTAGATAGTAAAACTCAATTCCTTATATTCATGGCTCTTCAGGCTGCTG
CACTACTTCCTTCTGCTTTCTCTATTCCCAAGGAGGGCAAAGCTGGTGCAATTTTGAAGGATTCTAATCTCTTTGGAAT
TTCCCTCTCAGACCATATTAAATCTGATTTTCGCTCCTCTTCATTTAAAGTGAAGAGCCAAAGAAGGTTGTCCCATGGA
TCTATTAGAGCCGAGACAATGGTTGCAACTCCAGGTGTTACCAACGCCACAGTATCAGGAAAGAAAACTTTAAGAAAAG
GGTGTGTAGTAGTTACTGGAGCCTCTTCAGGATTAGGCCTAGCCACAGCAAAAGCTCTAGCTGAGACAGGAAAATGGCA
TGTGATTATGGCATGTAGAGACTTTCTAAAAACTGAAAGAGCAGCAAAATCCGCAGGCATGCCTAAGGAGAACTACACA
ATAATGCACTTAGACCTTGCGTCGCTCGACAGTGTTCGCCAGTTTGTCGATAACTTCCGGAGATCAGGTCGCCCTCTTG
ATGTATTGGTTTGCAATGCAGCAGTTTATCAACCAACTGCTAAAGAGCCTTCTTTCACTGCTGATGGATTTGAGCTCAG
TGTTGGGACTAACCACCTTGGTCATTTCCTTCTTTCAAGATTGTTGCTTGATGATTTGAAGCAGTCTGATTACCCTTCA
AAGAGACTCATCATTGTTGGTTCCATTACAGGAAACACAAATACTTTGGCCGGAAATGTGCCTCCAAAAGCAAACCTTG
GGGACTTGAGGGGCTTGGCAAGGGGACTCGACGGGCTGAACAGCTCGGCCATGATCGATGGTGGAGACTTTGATGGTGC
AAAAGCATACAAAGACAGCAAAGTTTGCAATATGCTCACTATGCAGGAGTTCCACAGGCGATACCACGAGGAAACTGGC
ATTACATTTGCCTCTTTATACCCTGGCTGCATAGCAACAACAGGGCTTTTCAGGGAGCATATCCCATTGTTTAGACTCC
TTTTCCCTCCATTCCAGAAGTATATTACCAAGGGATTCGT

> SEQ ID NO: 5502 111277 142219_300433_1b
TACTAAGCAAAAGGACACCAGAAACATAGTACACTTGAGCTCACTCCAAACTCAAACACTCACACCAATGGCTCTCCAA
GTTCAGGCCGCACTCCTGCCCTCTGCTCTCTCTGTCCCCAAGAAGGGTAACTTGACCGCGGTGGTGAAGGAGCCGGGGT
TCCTTAGCGTGAGCCAGAAGGCCAAGAAGCCGTCGCTGGTGGTGAGGGCGGTGGCGACGCCGGCGGCGCCGGTGGCGAG
CCCCGGCGCGGGCACGTCGAAGGCGGACGGGAAGAAGACGCTGCGGCAGGGGGTGGTGGTGATCACCGGCGCGTCGTCG
GGGCTCGGGCTCGCGGCGGCGAAGGCGCTGGCGGAGACGGGGAAGTGGCACGTGGTGATGGCGTGCCGCGACTTCCTGA
AGGCGGCGACGGCGGCGAAGGCGGCGGGGATGGCGGCGGGGAGCTACACCGTCATGCACCTGGACCTCGCCTCCCTCGA
CAGCGTCCGCCAGTTCGTGGACAACTTCCGGCGCTCCGGCATGCCGCTCGACGCGCTGGTGTGCAACGCCGCCATCTAC
CGGCCGACGGCGCGGCAGCCGACGTTCACCGCCGACGGGTACGAGATGAGCGTCGGGGTGAACCACCTGGGCCACTTCC
TCCTCGCCCGCCTCATGCTCGACGACCTCAAGAAATCCGA

> SEQ ID NO: 5503 111277 134863_300419_1b
CCAGAAACATAGTACACTTGAGCTCACTCCAAACTCAAACACTCACACCAATGGCTCTCCAAGTTCAGGCCGCACTCCT
GCCCTCTGCTCTCTCTGTCCCCAAGAAGGGTAACTTGAGCGCGGTGGTGAAGGAGCCGGGGTTCCTTAGCGTGAGCCAG
AAGGCCAAGAAGCCGTCGCTGGTGAGGGCGGTGGCGACGCCGGCGGCGCCGGTGGCGAGCCCCGGCGCGGGCACGT
CGAAGGCGGACGGGAAGAAGACGCTGCGGCAGGGGGTGGTGGTGATCACCGGCGTCGTCGGGGCTCGGGCTCGCGGC
GGCGAAGGCGCTGGCGGAGACGGGGAAGTGGCACGTGGTGATGGCGTGCCGCGACTTCCTGAAGGCGGCGACGGCGGCG
AAGGCGGCGGGGATGGCGGCGGGGAGCTACACCGTCATGCACCTGGACCTCGCCTCCCTCGACAGCGTCCGCCAGTTCG
TGGACAACTTCCGGCGCTCCGGCATGCCGCTCGACGCGCTGGTGTGCAACGCCGCCATCTACCGGCCGACGGCGCGGCA
GCCGACGTTCACCGCCGACGGGTACGAGATGAGCGTCGGGGTGAACCACCTGGGCCACTTCCTCCTCGCCCGCCTCATG
CTCG

> SEQ ID NO: 5504 111277 240302_301313_1b
AGAGATTCTTCTTCCTTCTTCCCGGGGAGCTGGCTATGGCTGCCATCGTCGCAGCAGCAGCATCGTCCTCGGGCCTCGC
GGCGAAGAAAGAGATTCTAGCCACATCCTCGAGCAATGCGGGTGTTTCTTCTTCTTTTCTCGGGTCCAAGCTGCGCTGT
AGCCCAGCAATCCAGGGTGTAAGGCAATGCAATGCTTCGACCACGACGACGAGCATCAGAGCTGTTGCTGCGCCGGTGG
AGACGGCCCGAGCGAAGGAGGGGAAGAAGACGGCCAGGCAGTCGACGGTGGTGATCACCGGTGCCTCTTCCGGCCTCGG
ACTCGCCACGGCCAAAGTCCTGGCCGACACCGGGGAGTGGCACGTCGTCATGGCTTGTAGAGACTTTCTCAAGGCCGAG
AAGGCTGCCCGGTCGGCTGGAATTCCCAAAGGAAGCTACACCGTCATGCACCTCGACCTGGCTTCGTTCGACAGCGTGA
GGCAGTTCGCGGAGAACTTCCGGCGATCCGGGAGGCCTCTCGATTGCCTGGTCTGCAATGCGGCGGTCTACTTCCCGAC
AGCGAAAGAGCCCACGTATAGCGCGGAGGGGTTCGAGCTCAGCGTGGCGACGAATCACTTGGGACACTTCCTGCTGTCC
CGGTTGCTTCTCGAGGATATGGAGAAGTCAGATCATGCGTCGAGACGCATGATAATCGT

> SEQ ID NO: 5505 111277 262810_301719_1b
ATTTGCCAATCGCCGGAGTTGCTCTAATTTCATCCACTGGTTGCATCATGGCAGCGGCTACTGGTCTTGCATCACTGCA
ATCTCTCTCTCTCAGTTCTGTAGGACTAAGAGAGAAGAAGATTGTGTCACTTCCTGCATCCACCTCTGCATTTCTCGGC
CATCAGATTGGAAGCTTTGCTTTATCAGCTACGAAGCCCATTTCGATGGGTATAAGAGCCCAGACTGTAGCAGCTCCAC
CCCCAGCAGCACCAGTGGAGGTTGCCGAGTCTTCTGAGGCTAAAAAGATTTCCACAAAGAGCATCGTGGTGATCACTGG
AGCATCATCTGGTCTTGGGCTGGCCACAGCCAAGGCATTAGCGGATAGTGGTGAGTGGTATGTTGTAATGGCATGCAGG
GACTTCTTGAAGGCGGAGAGGGCAGCCAGATCCGTGGGATTACCAAAGGACAGCTACCGGGTCATGCATTTAGACTTGG
CATCCCTTGAAAGTGTCAGACAGTTTGTAGATAACTTCCGCCGATCCGGGCTGCCTCTGGATACCCTCGTCTGCAATGC
TGCAGTCTACTTTCCAACTGCAAAAGAGCCCAGGTTTTCA

FIG. 2 continued

> SEQ ID NO: 5506 111277 262811_301719_1b
GCTGACAAGGAGGAAGCATGGCAGCTGTGGCAGGTCTTACCTCAGTGCAGTTTCTCAGCTCATCATCTATCAAAGAGAA
TGTGTCACTTCCTTCTACTTCTCTGCGGGACTCGGCATTTATCGGCCTTCGCAATAAGATTCACAGTTTTGGTAGCTCA
GTCTCATCACTAAACAAGGCAACATGCAAAAGAGGGGATGTTATTTCTAGGTCTTTGAGAGTCCAGGCGGTGGCTGCCC
CAGTGGAGACACTGAAGTCCTCAGAGCCGAAAAAGACATCGTTGAAGAATACGGTCGTAATCACGGGTGCCTCGTCAGG
TTTGGGCCTAGCAACTGCCAAGGCGTTGGCAGACAGTGGTGAGTGGTACGTCATCATGGCATGCAGAGACTTCTTGAAG
GCCGAGAAGGCGGCCAAGTCCATTGGGATCCCCAAGGATAGCTACCGCATCATTCATCTGGACCTCGCCTCCTTTGATA
GTGTAAAACAATTTGTTGATAACTTCCGGAGGCTGGAGCTCCCTCTAGATGCCCTTGTTTGTAACGCTGCTGTGTACTT
CCCGACT

> SEQ ID NO: 5507 111277 284113_200158_1b
ATTTTTTGCTGACTTTAGACCAACCCCTTTTCTTTTCTTGAACATTTTCATGGCTCTTCAGGCTGTTGCTTTGGTTCCT
TCTGCTTTATCCATTTCCAAAGAGGTAATATTTTCCGTCCAGAAAATATATTGCTCGTGAGACAAAAAGGGTTGCTACG
ATGGTAAGCAAACTCCACTTCCAACCAAGAGGTGGTGAGTTTACCAAGAGGTGGTGAGTTTGAGTAACAGCCTCCCTAC
CTTAGGGGCAAAGCTAGTGCAAACTTGAAGAATTCTAGTCTTTTTGGAGTCTCTCTCTCTGACTATACTAAATCTGATT
TCCGCTCCTCTTCATTCAAAGTCAAGAGCCAAAGAAGATTGTCCAATGGAGCAGTAAGGGCAACAATGGTTGCATCTCC
AGATGTAACCACTAATTCTCCAGCAGGAAAGAAAACTTTAAGAAAAGGGTGTGTAATAGTCACTGGAGCCTCTTCAGGA
TTAGGCCTAGCCACAGCAAAAGCACTATCCGAGACCGGAAAATGGCATGTAATTATGGCTTGTAGGGACTTTCTAAAAG
CTGAGAAAGCTGCAAAATCAGTACGCATGCCTAAGCAGAGAATTACACCATCATGCATTTAGACCTCGCGTCGTCGACAG
TGTTCGCCAGTTTGTCGATAACTTCAGGAGGTCCGGTCGCCCTCTTGATGTGTTGGTTGCTAATGCAGCTGTGTATCAA
CCTACTGCTAAAGAGCCTTCATTTACAGCTGAAGGATTTGAGCTTAGTGTTGGCACAAATCATCTTGGACATTTCCTTC
TTTCAAGATTGTTGCTTGATGACTTGAAGCAATCTGATTACCCTTCTAAAAGACTCATAATTGTTGGTTCAATTACAGG
GAACACAAATACTTTGGCTGGAAATGTACCTCCAAAGGCGAATCTCGGTGACTTGAGAGGTATGGCCGGGGGTTTAAAT
GGTATTAACAGTTCAGCGATGATCGATGGTGGGGAATTTGATGGCGCCAAAGCATACAAAGACAGCAAGGTCTGTAACA
TGCTCACAATGCAGGAATTCCATCGTCGAT

> SEQ ID NO: 5508 111277 184228_300666_1b
GAATTCGGCTAAAAGTTTCTTCTTCTTTTTTTCGTTTTCTAGAAATGGCTCTTCAAGCAACCTCTATCCTTCCATCCAG
TCTTTCCATCCACAAGGAGGGTAAATCAAATTTGTCAGGGAAGGATTTCTATGGAGTTTCTTTTGCTGAATTCAGTCCT
CTCGTCATAAGAAACAAGAGAGAATTGAAGAGCCAAAGGTTATCTGTTGGACAAATCAGAGCCCAGACAGCAGCAACAA
CTCCAGGGGTAAATCAATCTACACAAGGAAAAAAAACTCTTAGGAAAGGAAATGTGATAATAACAGGAGCATCATCAGC
TGGAATTGACAAAGAGAATTTCACTGTTATGCACCTCGACCTCTCTTCTCTTGATAGTGTCAGACAGTTTGTTGACAAC
TTCAAGCGGTCAGGTAAACCGCTTGATGTGTTAGTATGTAACGCTGCTGTGTATCAGCCAACAGCAAAGGAACCATCAT
TCACTGCTGACGGATTTGAACTTAGTGTTGGTACTAACCACTTAGGGCACTTTCTTCTTGCTCGGTTACTCCTTGATGA
CTTGAAAACTTCTGATTACCCATCTAAGCGCCTCATCATCGTAGGTTCAATAACAGGGAATACAAACACATTGGC

> SEQ ID NO: 5509 111277 207555_300806_1b
CGGACGCGTGGGCGGACGCGTGGGCCCCCGAAGCCTCACTCACTTCGCTGCAGAGGAAAAAAAAGAGAGAAAATCTCC
GATGGCTCTCCAGGCGGCCACCACCACCTCCTTCCTCCCCTCCGCGCTCTCCGCCCGCAAGGAGGGAGCGGTGAAGGAC
TCGGCGTTCTTGGGCGTTCGTCGGCGACGGGCTCAAGCTGGAGACCAGTGCTCTCGGCCTTCGCACCAAGAGGGTGA
GCACGTCGTCGGTGGCCATCCGCGCGCAGGCGTCGGCGGCGGTGTCGTCCCCGACGGCGACGCCGGCGTCGCCGTCGGG
CAAGCAGACGCTGCGCAAGGGCACGGCGGTCATCACCGGCGCGTCGTCCGGGCTCGGCCTCGCGACGGCGAAGGCGCTG
GCGGAGACGGGCAGGTGGCACGTCGTGATGGGGTGCCGCGACTTCCTCAAGGCGTCGCGCGCCGCCAAGGCCGCCGGCA
TGGAGAAGGGCAGCTACACCATCGTCCACCTCGACCTGGCGTCGCTCGACAGCGTCAGGCAGTTCGTCGGCAACGTCCG
GCGGCTGGGGA

> SEQ ID NO: 5510 111358 1100054_301457_1b
ACTTTCGAAGGTATAGGCAAGGTAGAGGCAGGCTTCTCTCTCTCGTCGTCTCGTTCTCAGGACAGAGGGAGGACACACA
CAGCTACAGACAATGTCGGGCAGGAAGAAGGTGAGAGAGGTGAAGGAGGAGAACGTCACCCTCGGGCCCGCTGTTCGAG
AAGGGGAGCACGTCTTCGGGGTCGCTCACATCTTCGCATCCTTCAATGACACCTTTGTGCATGTGACTGATCTCTCTGG
AAAGGAAACCCTTACCCGTGTCACAGGAGGCATGAAGGTGAAGGCAGACCGAGATGAGTCCTCCCCTTATGCAGCCATG
CTTGCAGCCCAAGACGTGGCTCAGAAGTGCAAGGAGTTGGGAATAACTGCATTGCACATCAAACTTCGGGCTACTGGTG
GCAATAAAACAAAAACACCTGGACCAGGTGCACAGTCTGCCCTCCGTGCCCTTGCTCGTTCTGGCCTGCGCATTGGACG
CATTGAGGATGTGACTCCCATTCCTACAGACAGCACTAGGAGAAAGGGAGGTAGAAGAGGAAGGAGGCTCTAGAGAGTG
TGCCTTTATTTATTTCAGATCTTGAGAGCGTATGGAGTTCAAGGCCTGGCTCTCTTGAAGGAGTAGTTGTGGAACTTCA
AATGTTTTGCAGAGTTTTGTTACGTACATTTCTTGCTAATGATTGCTATTGACAGACAGATGTAGTTGCAGTTTAAAT
TGCACCCTGGATACCTATTTTGAGATATCCGAGTTTTATTGTTTTCAT

FIG. 2 continued

> SEQ ID NO: 5511 111358 1119458_301897_1b
GCGAACTATGCGTTCGGGCATGGTAAAGGCAGGATTGTCTCTCTCGTCGTCTCGTTCTCATGACAGAGGGAGGACACAC
AGAGCTACGCGACATTGTCGGGCAGGAATAAGGTGAGATGGGTGTAGGAGGAGAACGTCATCCTCGGTATCTCTGATCGA
GAAGGCGAGCACGTCTGCGTGGTCGTGCACATCTTCGCATCCTTCGATGACAGCTTAGTGCATGTGAGTGATCTCTGTG
GAAGGGAAAGCCTTATCCGTGTCACAGGAGGCGTGTAGGTGTCGGCAGACCGAGATGAGTCCTCCCCTTATGCAGCCAT
GCT

> SEQ ID NO: 5512 111358 174877_300527_1b
CCCCCCCCCCCGGGAGCTAGGGTTGGATCGCCGCCGCCGCCGCCGCCGCCGCTTCTCCACTCTCCCCTGCCCCCGT
CGCCGTCGCCACCGCCGCCGCCATGTCCGGGAGGAAGAAGACACGGGAGCCCAAGGAGGAGAACGTCACCCTCGGCCCG
ACCGTGCGCGAGGGCGAGTACGTCTTCGGCGTCGCCCACATCTTCGCCTCCTTCAACGACACCTTCATCCATGTCACCG
ATCTGTCCGGGAGGGAGACGCTCGTCCGCATCACTGGTGGCATGAAGGTTAAAGCTGATCGCGACGAATCTTCCCCTTA
TGCTGCTATGCTTGCTTCACAGGATGTTGCTCAAAGATGCAAGGAGCTTGGAATAACTGCTTTGCATATCAAGCTCCGT
GCTACTGGTGGTAACAAGACAAAAACCCCTGGTCCTGGTGCTCAGTCCGCACTTAGAGCACTTGCTCGATCTGGCATGA
AGATTGGTCGTATTGAGGATGTTACTCCAGTGCCGACTGATAGCACACGCACAAAGGGTGGTATAAGGGGTAGGAGGCT
GTAATC

> SEQ ID NO: 5513 111358 201477_300716_1b
CCACTCTCCCCTGCCCCCGTCGCCGTCGCCACCGCCGCCGCCATGTCCGGGAGGAAGAAGACACGGGAGCCCAAGGAGG
AGAACGTCACCCTCGGCCCGACCGTGCGCGAGGGCGAGTACGTCTTCGGCGTCGCCCACATCTTCGCCTCCTTCAACGA
CACCTTCATCCATGTCACCGATCTGTCCGGGAGGGAGACGCTCGTCCGCATCACTGGTGGCATGAAGGTTAAAGCTGAT
CGCGACGAATCTTCCCCTTATGCTGCTATGCTTGCTTCACAGGATGTTGCTCAAAGATGCAAGGAGCTTGGAATAACTG
CTTTGCATATCAAGCTCCGTGCTACTGGTGGTAACAAGACAAAAACCCCTGGTCCTGGTGCTCAGTCCGCACTTAGAGC
ACTTGCTCGATCTGGCATGAAGATTGGTCGTATTGAGGATGTTACTCCAGTGCCGACTGATAGCACACGCAGAAAGGGT
GGTAGAAGGGGTAGGAGGCTGTAATCTTCATGCGGCCTCAAACCGACAACACTCTGCTCTCCTAGATGTTACCGTCTGC
ATTGGACTATTTTGTTTCTGTGCTTTTCATTCGGTGGATTATTTAAACCAGTTTTGAACTCTGTTTCTGCATCAATTCA
TGCTGTCCTCAATGTAACCAACGTTATCT

> SEQ ID NO: 5514 111437 170482_300533_1b
CCCACGCGTCCGGTCTCGGACCGCCTCTCTCTCGGTATCTGAGATTTGGATCGGGCGCGAGGCCGGCGGCTCCAGTCGG
CATGGCGCTTGTGTTGCATTGCGGAAGTGGCAACAAAAATGCCTTTAAGGCACTTATTGCTGCAGAGTACACTGGAGTC
AAGGTCGAGCTGACCAAGAATTTTGAGATGGGTGTCTCAAACAAGACCCCTGAGTTTCTCAAGATGAACCCCCTTGGGA
AGATTCCTGTTCTGGAGACTCCTGAAGGTGCTGTTTTTGAGAGCAATGCTATCGCACGCTATGTTGCTCGCTTGAAGGA
CAACAGCTCTCTTTGTGGTTCTTCTCTTATCGACTATTCTCACATTGAACAATGGATGGACTTCTCAGCAACAGAGGTT
GATGCCAATATTGGAAGGTGGTTGTACCCAAGGCTTGGTTTTGGCCCTTATGTTCCTGCACTTGAGGAATTTGCTATTA
CTTCATTGAAGAGGTCATTGGGTGCTCTGAACACACACCTTGCTTCAAACACATACCTTGTTGGGCATTCAGTTACTCT
AGCTGATATTGTGATGACATGTAACCTATATTATGGGTTTGTTCGGATCTTGATCAAGAGTTTCACCTCCGAGTTCCCT
CATGTTGAGCGGTACTTCTGGACAATGGTTAACCAGCCCAACTTCAAGAAGGTCATTGGTGATTTCAAGCAAGCAGAGT
CTGTGCCTCCCGTTCAGAAAAAGGCTGCTCCCCCTAAGGAATCAAAAGCAAAGGAGGCCAAGAAGGAGGCTCCGAAGGA
GGCCCCTAAACCAAAGGTTGAGGCTTCAGAGGAAGAGGAGGCACCAAAGCCAAAGCCAAAGAATCCTCTTGATCTACTG
CCACCAAGCAAGATGATTCTTGATGAGTGGAAGAGGCTATACTCAAACACAAAAACCAACTTCCGTGAAATT

> SEQ ID NO: 5515 111437 183074_300665_1b
GAATTCACGAACAAAAATGCCTTCAAGGCACTTATCGTTGGAGAGTACTCTGGGATCAAAGTTGATCTTGCTAAGGATT
TTGAAATGGGGGTTTCCAACAAAGCTCCAGAGTTTCTTAAGATGAATCCTCTTGGAAAGGTTCCAGTACTTGAAACACC
TGAAGGTGCCATATTTGGGAGTAATGCTATTGCTCGTTATGTTGCTTCTTTGACCGAAAACAGTCCACTCTTAGGATGT
TCAGCCATTGACAAGGCTCATATTGATCAATGGATCGATTTTTCTGCCATGGAGGTTGATGCTAATATCTTGCGCTGGT
TTATCCCAAGAATTGGGTTTGCTCCATACGTCCCTCAAGCTGAAGAACATGCCGTGACCAGTTTGAAGAGGGCATTGGA
TGCCTTGAACACTCACCTTGCTTCCAACACTTTCCTTGTCGGGCATGCTGTGACTCTTGCTGACATCATAATGACATGT
AACCTGGTATTGGGATTCAGTAAAGTCATGACCTCAAGCTTCACAAAAGATTTCCCTCACGTTGAAAGGTATTTCTGGA
CCATGGTCAATCAACCAAATATCAAGAAGGTGTTGGGTGAAGTAAAGCAGACAGATTCCGTTCCACCAGTTCAAGCTGC
CCAAAAGCCAGGTGCTGCAAAGCCT

FIG. 2 continued

> SEQ ID NO: 5516 111437 228676_301242_1b
GGGTTTGTTCGGATCTTGATCAAGAGTTTCACCTCCGAGTTCCCTCATGTTGAGCGGTACTTCTGGACAATGGTTAACC
AGCCCAACTTCAAGAAGGTCATTGGTGATTTCAAGCAAGCAGAGTCTGTGCCTCCCGTTCAGAAAAAGGCTGCTCCCCC
TAAGGAATCAAAAGCAAAGGAGGCCAAGAAGGAGGCTCCGAAGGAGGCCCCTAAACCAAAGGTTGAGGCTTCAGAGGAA
GAGGAGGCACCAAAGCCAAAGCCAAAGAATCCTCTTGATCTACTGCCACCAAGCAAGATGATTCTTGATGAGTGGAAGA
GGCTATACTCAAACA

> SEQ ID NO: 5517 111437 190927_300737_1b
CCCCCGGCTGCTACTTCCACTAGGGTTTCGTCTTGCTTCTCCCGCTGCTCGCCTCGCCTCCTCGACGATCTGAGATCAT
CGAGATCGATTGAGTGGAGCTAGGCGGCGGCTAGGGCGAGATGGCGCTCGTATTGCATGCTGGCAGTGGAAACAAGAAT
GCATTCAAGGCACTCATTGCTGCCGAGTACTCTGGTGTCAAGGTTGAGTTGGTGAAGAACTTTCAGATGGGTGTCTCCA
ACAAGACACCTGAGTTTCTCAAGATGAATCCTATTGGGAAGATTCCTGTTCTAGAGACTCCTGATGGTCCTGTTTTTGA
GAGCAATGCGATTGCACGATATGTTACCCGCTCGAAGGCTGACAACCCACTCTATGGGTCTTCACTGATTGAATATGCC
CACATCGAGCAGTGGAATGACTTTTCGGCCACAGAGGTTGATGCTAATATTGGAAAATGGCTCTACCCACGGCTAGGAA
TTGCTCCCTATGTTGCTGTGAGTGAGGAAGCAGCTATTGCTGCTTTGAAGAGATCATTGGGTGCCCTCAACACACACCT
TGCATCAAACACATACCTTGTTGGCCATTCGGTGACTCTTGCTGATATTGTGATGACCTGTAACCTCTACATGGGCTTT
GCTCGGATCATGACCAAGAGTTTTACTTCTGAGTTCCCTCATGTTGAGAGGTACTTCT

> SEQ ID NO: 5518 111437 1171390_302054_1b
GGGGGACCTCGCTTCGCCCTCAGAGTTGGAGAAAGTCTGAATTTGGAAGCTCATAAAATGGCCCTGGAAATCTACTGCT
CTCCTATAAACAAGAATGGGCTGAAATCTATGATCACAGCTGAGTATAATGGGGTTAAAATTGAGTATGTTCCTGATTT
CCAAATGGGGGTTACAAACAAGACTCCAGAATATTTGAAGTTAAATCCAATGGGCAAGGTCCCTCTTCTCTTTTGACCC
CGGAGGGTCCAATTTTTGAGAGCAATGCGATTGCCAGATATGTGTGCAGGCTTAAGGAATGCTCTCTTCTTGGAACTTC
TCTTTATGAACAAGCTCTCATTGATCAGTGGATTGACTTTGCCACTACTGAGATTGATCCATACATGCTGGCCTGGTAT
GCTCCTATATTGGGTTTTCGCCCATTTGTTCCAGAGTTGCATGAGATAGCCATCACTGCATTGAAAAGGGCGCTGACTG
CGCTGAATCAGTCTCTTGCTTCAAGGACGTTTTGGTTGGAGATTCAGTAACTCTTGCTGACATAGTAGTCACTTGCAA
CTTGTCTAGCGGTTTCAGGATGTGCATGGACAAGGAGTTCACATCGGAGTTTCCTCACGTTGAGAGGTACTTCTGGACT
CTTGTCAATCAGCCAGAGTTCCGCAAACACTATGTGGACTTCAAGCAGGTTGACAAAACCCCTTCTCCCAAAGCTCCCC

> SEQ ID NO: 5519 111437 11920_300283_1b
TGGTATCAACGCAGAGTGGCCATTACGCCGGGGAAAGAGCTTAAGAAGGAAGAACCAAAGTTTGAAGAGGAGGAAGAAG
CACCCAAGCCTAAGGCAAAGAATCCTCTTGATCTCTTGCCTCCAAGTAAGATGATTCTGGATGAGTGGAAGAGGCTTTA
CTCCAACACCAAGACCAACTTCCGTGAGATTGCCATTAAAGGTTTCTGGGACATGTATGATCCCGAAGGATATTCTCTC
TGGTTCTGTGATTACAAGTACCAGGACGAGAACACAGTTTCCTTTGTAACCTTGAACAAGGTTGGCGGTTTTCTGCAGA
GAATGGATCTGGCACGCAAGTATGCTTTTGGTAAGATGTTGGTAATT

> SEQ ID NO: 5520 111437 279352_200061_1b
CCCCCTTTTTCTCTCTTTCTGCCTCTCTTTGCTTAATTTTGGGTGTAAAGGGGTGAGCAAGTTTCAACTGTGCAACCAT
GGCTCTGGTTTTGCACTCAACAAATAACAACAAAAATGCCTCAAAGGCACTCATTGCTGCTGAGTACACAGGTGTAAAG
GTTGAACTTGCAAAGAATTTCGAGATGGGTGTATCAAACAAGACACCCGAGTTTATCAAGATGAATCCAATTGGAAAGG
TTCCTGTGCTTGAAACACCTGATGGACCTGTTTTTTGAGCAATGCTATTGCACGCTATGTAACTAAATTGAAGCCCGG
CAATCCTCTCTTTGGCTCTTCGTTGATCGAATATGCTCAAATCGAGCAATGGAATGATTTTTCTGCTACTGAGATTGAT
GCAAACATTGGGCAATGGTTGTACCCGCGCCTTGGCTATCGTGCATATATTCCTCCAGCCGAGGAAGCTGCAGTAGCTG
CATTAAAGAGAGCTCTTGATGCTTTGAACACCCATCTGGCATCTAACACTTACTTGGTTGGACAATCAATTACATTGGC
TGACATCATAATGGGCTGCAACTTGAGCATTGGTTTTAGGATGATAATGACTAAGAGCTTTACCGAGGAATTCCCACAT
GTAGAGCGATACTTCTGGACTGTGGTTAATCAGCCAAATTTCTGCAAGATATTGGGTGAGGTGAAACAAGCTGAATCTG
TCCCAGCTCCCTCATCCAAGAAGCCTGCACCGGCAAAGGAAGCTGCGAAACCCAAAGCGAAGGAGGAGCCAAAGAAAGA
GCTTAAGAAGGAAGAACCAAAGTTTGAAGAGGAGGAAGAACACCCAAGCCTAAGGCAAAGAATCCTCTTGATCTCTTG
CCTCCAAGTAAGATGATTCTGGATGAGTGGAAGAGGCTCTACTCCAACACCAAGACCAACTTCCGCGAGGTTGCCATTA
AAGGTTTCTGGGACATGTATGATCCTGAAGGATATTCTCTCTGGTTCTGTGATTACAAGTACCAGGACGAGAACACAGT
TTCCTTTGTAACCTTGAACAAGGTTGGTGGTTTTCTGCAGAGAATGGATCTGGCACGCAAGTACGCTTTTGGTAAGATG
TTGGTAATTGGTTCAGAGGCCCCATATAAGGTGAAGGGCTTGTGGCTTTTCCGTGGAAAAGAAATTCCCAAGTTTGTTA
TGGATGAATGCTATGACATGGAGCTCTATGAATGCAAGGAAGTAGACATCAACGATGAAGCACAGAAGGAGCGTGTCAA
CCAAATGATTGAGGATTGCGAGCCCTTTGAGGGAGAGGCTCTGTTGGACGCAAAGTGCTTCAAGTAAACGTTTGTGTTG
CATTCGGCTTTGGTTTTGTCCTCCCAAATTTACTTAGATTCTTGTTTTGAAAACTATCTTGTCTTTTTGAGAAAGGTT
AAAACGTATGTTGTCTTA

FIG. 2 continued

> SEQ ID NO: 5521 111437 245955_301573_1b
GAGAAGGAAGCGAGCGTGATGGCGGGACTGCTACTCCATGCGAATCCCGGCAACAAGAATGCGCTCAAATCGCTCATCG
CGGCGGAGATTGTGGGCGTCAAGGTCGATCTTGTGCCCGATTTCCAGATGGGCGTCAGCAATAAGACGCCCGAGTTCTT
GAAGCTGAATCCGATGGGAAAGGTTCCAGTGCTTGAGACACCAGACGGGCCAATCTCCGAGAGCAATGCCATTGCCAGA
TACGTGGCGAATCTCAAAGGAAAACTGACCGGATCGACATTGTACGAGACTGCCCTGATCGATCAGTGGATTGACTTCG
CCACCACTGAGATCGACGCCTGTCTGGGAAGGTGGATCTATCCGCGCTTCGGTTATATTCCGTACGCACCAGAGGTTGA
AGAGCATGCAATTCAGGTGCTCCAGCGTGCTTTCGGCGGCTCTCAACGCTTACCTCGCCTCTCGGACGTACCTCGCGGGG
CACTTCGTCACGCTGGCCGACGTGATCACAATCTGCAACATGTCCTTCGGCTACCGGACTGGAGCCTTCTCGGAGGAGT
TCATGTCCGCATTCCCTCACGTCGAGAGATACTTCTGGACGCTCTGCAACCAGCCAGCATTCAAGAAGCACTTGGGAGA
GGTCGTCCGGGGCTCGGTCGAAGTCCCTGGCCCCGGTGCCAAGCCAGCAGCTGCTCAGGCACCCCGGGCGTCGCAGACG
C

> SEQ ID NO: 5522 111758 187891_300681_1b
CCCACGCGTCCGCTTGCAGCCATGAAGATCGAGCGAGATTTCCACATGATGAAAGGGGACAGTGAGTTCAGTTATGCCA
AGAATTCAAGGATCCAAAAAAGAGTTGTTCTTGCTGCCAAACCAATAGTTGAGAAAGCTGTACGGGAAGTGTGCATAGA
TCTTCATCCTCAATCAATGGTCATTGCTGACCTTGGCTGCTCCTTCGGTGCAAACACACTCCTCTTCATCTCTGAGGTG
ATCACCACAATATGTGAGGACTATAACAACACCATCAAGGAGAGCCCCATGGAGGTCCAGTTCTTCCTCAATGACCTAC
CAAGCAATGACTTTAACCACATCTTCCAATCACTAGAGCAGTTCGAGCAGTTGATAATGCAAGATTGCGCTTGCAAAGG
GTTACAACCTCCCCCGCACTTTGTCGCAGGCCTGCCAGGTTCCTGAGCAGCTTGATGGCAGCATGAATGAGGGGAACAT
TCACATAGGAGCGACTACACCACCATCCGTGGCAAAGCTCTACCAAAATCAGTTTGAGAAAGACTTCTCACGGTTCCTC
CAGATGAGATGCATGGAGATGGTGCCCGGAGGCCGGATGGTGCTGACGGTTGCTG

> SEQ ID NO: 5523 111761 274012_200147_1b
TTTCTATTTTATATCAAAGAAAAGAAAGGAAAATGACTTCTACATTTCTCTTAAGTTGATTATTAGTGTTGTCACTTT
GCTTTGCTTAATTCAGTTTTCCAGTATTTGTAATGCTAAAAGGATGCTTAGGGAGTCTAATATAGGAAAGGAAAATGAG
AATATATTTAAGGAGAAAAAGGATGATTCAACAAACATTGGTGGATTTCCTTTTCCATTCAATTTTCCACCATTTTCTG
ATGGAATTCCAAATATACCCTTCAATTTTCCTGACTTTGGATCGTCAGGAGGATTGCCTGGTTTGGAATTCC
TGGGACCGGTGGTAGTGGTACTGGTGATAATAATCCATTTCGTTTCCGATCCCTGGAGTTCCTAATGTTGCTGTTCCA
CCCCCAGCTGCCGCCCCTTAAATTCCTATACAAGTTTCTCTCTGTTATTAGCAGTTTAGCCTTTTGGCTGGGGTCATGT
AAAACATTAAAAAAAAAATGATAAAGAAGAAGGAAATCAAGGAGTAAGTTTTAGAGCCATAGGCTCAAATGAATTACTA
TTTCTTGTCCTTGTTTCTGATGTAATTAATTAGAAAATGGGAAATGACATGGATGTCAAGTAAAAAAGAACTCGTATTT
TTCTACCCGATTAACAAGGGTATCACCTTCAAACTTGACTTCAGCACGCGTGTTGTAGTTCCCGTCATCTTTGAAAGAT
ATAGTGCGTTCCTGTACATAACCTTCGGGCATGGCACTCTTGAAAAAGTCATGCCGTTTCATATGATCCGGATAACGGG
AAAAGCATTG

> SEQ ID NO: 5524 112105 267847_200119_1b
TTATTCTCTTCTTTTTTGACAAGAAAATATCATGAATTTCCTCTCATCTTTGGCAAAGAGCGCCGGCGGTCAATCCGCC
GACGAGCCTAAGAAAACCGCCGGTGAGGAAGCTTCAACTGCTGACCTTTTTTCCAGTGCGAAAGTGTTAGCATATTCAG
CTCAAAGTCAATTCAACAAAGATTCCGGCAACGTCGATAACAAAAAAGTCGCTGCTGCTGCTGCTGATGTTCTTGACGC
TGCACAGAAATACGGAAAGTTAGACGAAACTCAAGGTGTTGGACAGTATATTGAAAAAGCCGAAACTTATCTCCACCAG
TACGGTTCTGCTAACCCATCCACCACCACCGATGCCGCCGCTGCAAAGGCCCCGGCAGCCACACCAGATACCAAAGATA
CAAAGGCACCTACACCGGCTCCGGCCGGCAGCAGATACTGATGAAACAAAGGCACCGGCACCGGCTCCTGCGGCAGCAGA
TACTGAAGAAACAAAGGCATCGGCTCCGGCACCGGCGGCAGCAGATACTGAGGAAACAAAGGCACCGGCAACCGCAGAT
ACCGAAGAACCACCGGCACCGGCACCAGCACCGGCGCCGGCACCGGAAGAGAAGGGAGAAGGGTATGGGCAATACGTGA
AAATGGCAGAAGGATTTCTGAAATCAGGAGATGATGAATCAGCGAAAGCATCTGAAGGAGGATCAGATTATCTTAAGAT
GGCCGGTGACTTCTTAGGCAAGAAGTGATTAGTTTAATCAGATTCTTTTTAATAATGACTGTTATTTTCCAAGTTTTTC
TTCTTTCATTTTCTTTGCCACTGTTCAGTGTTCATTACCGGCGGCGAACTTCTTCAGTAGCCGTCGCCGGAGCTGGTTT
TTACTTGGCATGTATGTAATTTCTGTGTGTGTGTGTGTTTTTCCAGTATGATTTTTAGAGTGTAATGGAATTTGTGTTA
TATGGATAAAGTGATCCTTTATGATGTTATTGGTGTATATGATATGGTCGTGATTCTTAATTATATTCGTCTTCCTTCT
ATTC

> SEQ ID NO: 5525 112381 271066_200130_1b
TCATCCTTATCTTAACACCATTCTCTCTTAGCGTCTTTCTCCAAAAACCAAAAACCAAGTGCTCTCTGCTGCAGAAAAT
CAACAAAAGGAAGGGGAAGATCCACAAAAGACCATTTTTGTTTTCTGTAAAACTTGCTCATATTAGCCATGGCATTTGC
AGGAACCACACAGAAATGCATGGCATGTGACAAAACTGTTTATCTGGTTGACAAATTAACTGCGGATAATAGAATCTAT
CACAAAGCTTGTTTCAGATGCCATCACTGTAAGGGCACTCTCAATCTTGGCAACTACAATTCCTTTGAGGGAGTTCTAT
ACTGTAGACCACACTTTGATCAGCTCTTCAAACAAACTGGCAGTTTGGATAAAAGCTTTGAAGGTACACCAAAAATTGT
GAAACCACAGAAACCCATTGACAGTGAGAAACAACAGGTAGCTAAAGTGACAAGCATGTTTGGTGGAACAAGAGAGAAA

TGTTTTGGCTGCAAGAAAACTGTCTACCCAACAGAAAAGGTATCAGTTAATGGTACGCCATATCACAAGAGCTGCTTCA
AATGTAGCCATGGGGGTTGTGTAATTAGCCCTTCTAACTATATCGCACATGAGGGGCGCCTCTACTGTAAACATCACCA
TATTCAACTTATCAAGGAGAAAAGCAACTTAAGCAAGCTTGAGGGTGACCATGAGACGAATTCCACGACAACAACAGAA
GTTACTGCAGAGTCATAAACAGCGACCGAGTTGATTGCTCCTCAGCTCATGTCTTACCTATCTTGCTTTATG

> SEQ ID NO: 5526 112381 246511_301614_1b
TGGGGCAGCAAGGCGAAGGCGATCGATTCGATCGATCGATCTGTCGAGGCAGGGGCCCGGCAGCAGCTGTTCTACGATG
TCGTCCTTCTCTTTCGCCGGCACGCAGCAAAAATGTAAGGCATGCGACAAGACTGTCTACTTGGTAGACCAGCTCACTG
CCGATGGTGTCGTCTATCACAAAGCGTGCTTTCGATGCCATCACTGCAAAGGGACACTAAAGCTTAGCAATTATGCTTC
GCTGGAAGGGGTCTTGTATTGCAAGCCCCATTTCGATCAGCTCTTCAAGCTTACTGGAAGTTTCGACAAGAGCTTTGAG
ACAGGACTATTGCACAGACAACCTAGCGAAGAAGCGAGTAAGACGCCATCGAAGACATCGCTCTTGTTCTCTGGGACTC
AAGAAAAATGTGTTGCTTGTGGGAAAACTGTGTACCCCATAGAAAGGTGACTGTCGAGGGTACACCGTATCACAAATC
TTGTTTCAAGTGTTCTCACGGCGGCTGTACGATATCGCCATCGAATTATCAAGCTCACGAAGGCCAGCTCTACTGCAGA
CATCACTACACTCAGCTCGTCAAGGAGAAAGGAGACTTCAGCAATCTGTCCAAGACACCGGGGAAGGCAGCAGCGAAAT
AGAAATTGGATTTTGGGTGTAAGGGAGTCTACTACGATCTTCAAAGGTTTGGTGATGAGAAAACGTTGCCTGAGGTGAA
TGGAGGATTTGA

> SEQ ID NO: 5527 112381 248911_301588_1b
AAGGCGAAGGCGATCGATTCGATCGATCGATCTGTCGAGGCAGGGGCCCGGCAGCAGCTGTTCTACGATGTCGTCCTTC
TCTTTCGCCGGCACGCAGCAAAAATGTAAGGCATGCGACAAGACTGTCTACTTGGTAGACCAGCTCACTGCCGATGGTG
TCGTCTATCACAAAGCGTGCTTTCGATGCCATCACTGCAAAGGGACACTAAAGCTTAGCAATTATGCTTCGCTGGAAGG
GGTCTTGTATTGCAAGCCCCATTTCGATCAGCTCTTCAAGCTTACTGGAAGTTTCGATAAGAGCTTTGAGACAGGACTA
TTGCACAGACAACCTAGCGAAGAAGCGGTAATATCAATATCAAAGAATGATTTTTTCTTTTTCTAAATCCAACTCGTG
GTTAATATGTTTTTACAGAGTAAGACGCCATCGAAGACATCGCTCTTGTTCTCTGGGACTCAAGAAAAATGTGTTGCTT
GTGGGAAAACTGTGTACCCCATAGAAAGGTGACTGTCGAGGGTACACCGTATCACAAATCTTGTTTCAAGTGTTCTCA
CGGCGGCTGTACGATATCGCCATCGAATTATCAAGCTCACGAAGGCCAGCTCTACTGCAGACATCACTACACTC

> SEQ ID NO: 5528 112381 11958_300283_1b
TGGTATCAACGCAGAGTGGCCATTACGGCCGGGGAGAGAGGGTGCCTTTTTTGTTTGTTTAATCTCAATAACAAAGCAG
GTTAGATATAAAAAGGCAGAAGAGCTTTGTTGATAAAAGTATTTTTTTTCATCTGCCATATTTCTAACTCTGATTAGTT
ATTGAGATTGAGGATTTTCAGGCTTCTGTAAATAATAATAAGGAGAAAAAAATTAAATAAAAGATAAAAATGGCATTCA
CAGGAACTTTGGATAAATGCTCAGCTTGTGACAAGACTGTTTACTTTGTTGATTTGTTGTCTGCGGATGGTGTTACTTA
TCATAAATCCTGCTTCAAATGTAGCCATTGCAAAGGCACTCTTGTGATGAGCAATTATTCCTCAATGGATGGAGTCCTC
TACTGCAAGCCACATTTCGAACAACTTTTTAAGGAATCTGGAAATTTTAGCAAAAACTTTCAGACTGCTTCCAGACCTG
AGAGGGAAAATCGCTGACAAAGGCTCCGACCAAACTCTCAGCCTTGTTCTCTGGAACTCAAGACAAATGTGCTGCGTG
CAACAAAACTGTTTACCC

> SEQ ID NO: 5529 112381 155664_301358_1b
ATTAGAAAAGTATGTCTTTTATTGGGACACAACAACAGAAATGCAAGGCCTGTGAAAAGACAGTTTACCCGGTGGAGCTGTT
GTCAGCTGATGGGGTTAATTATCACAAGTCTTGTTTCAAATGCAGCCATTGCAAAGGAACACTTAAGCTGAGCAATTTC
TCCTCAATGGAAGGTGTTCTGTATTGCAAGCCCCATTTTGAGCAGCTTTTCAAGGAGTCGGGCAACTTCAGTAAGAACT
TTCAGTCACCTGCGAAGTCAGCTGAGAAGTTAACTCCTGAGCTGACAAGGTCGCCTAGTAAAGCTGCTGGCATGTTTTC
TGGCACGCAGGAAAAATGTGCAACTTGTGGTAAAACAGCTTACCCACTTGAGAAGGTGACAGTGGAGAACCAAAGTTAT
CATAAGACATGTTTCAAGTGTTCTCATGGTGGATGCTCTTTATCTCCTTCGAATTATGCCGCCCTAAATGGGATTTTAT
ACTGCAAACCTCATTTTTCACAGCTTTTCAAGGAAAAAGGCAGCTACAATCATTTGATCAAGTCTGCCTCGATGAAACG
TCCAGCTGCTGCAACCGTTCCAGATTCTTAAACTCCATGTTTCAGTCAACTACTGTATCCATTCACATGGACTTGATAT
TTCTTGAGTGTGTTTCTTGCTTTTTCTCTGTTCATTGGCTGGTAACCTC

> SEQ ID NO: 5530 112381 124672_300424_1b
CTCATATATAGCCATGGCATTTGCAGGAACCACACAGAAATGGATGGCATGTGACAAGACTGTTTATCTGGTTGACAAA
TTAACTGCGGATAATAGAATCTATCACAAAGCTTGTTTCAGATGCCATCACTGTAAGGGCACTCTCAAGCTTGGCAACT
ACAATTCTTTTGAGGGAGTTCTATACTGTAGACCACACTTTGATCAGCTCTTCAAACAAACTGGCAGTTTGGATAAAAG
CTTTGAAGAAACCCATTGACACTGAGAAACAACAGGTAGCTAAAGTGACAAGCATGTTTGGTGGAACAAGAGAGAAATG
TTTTGGCTGCAAGAAAACTGTCTACCCAACAGAAAAGGTATCAGTTAATGGTACGCCATATCACAAGAGCTGCTTCAA
TGTAGCCATGGGGGTTGTGTAATTAGCCCTTCTAACTATATCGCACATGAGGGGCGCCTCTACTGTAAACATCACCATA
TTCAACTTATCAAGGAGAAAAGCAACTTAAGCAAGCTTGAGGGTGACCATGAGACGAATTCCACGACAACAACAGAAGT
TACTGCAGAGTCATAAACAGCGACCGAGTTGATTGCTCCTCAGCTCATGTCTTACCTATCTTGCTTTATG

FIG. 2 continued

> SEQ ID NO: 5531 112381 137185_300502_1b
CCCCCCCCCCGGGGCGTCGACGCGAGTTGAGGGTTGAGACGCCCAAAAAATCCTCAAAATCCCATTGCTCACCCGCGTT
ATATAACCGCGGCCGGCCATTGGGAGGGACGCCGCGAGGGGTGCTCGTTTCAGCGCGGGAGGAGATCAGATCGGGCTCA
GATCTTCCAGCTCGCCGCGCCGCCTCCGCCGCCGCAGCAGGAAGAGAGAGGGTGAGGAGAGGAGGAGGCTACGATGTTT
AGCGGGACGCAGCAGAAGTGCAAGGTGTGCACCAAGACGGTGTACCCGATGGACCAGCTCTCCACCGACGGCGTCGTCT
TCCACCGCTCCTGCTTCAAGTGCCAACACTGCAAGTCCACCCTCTCCCTTGGCAACTACTCCTCGATTGAAGGAGTGCC
ATACTGCAAGCCCCATTTCGAGCAACTGTTCAAGGAGACCGGGAGCTACAACAAGAGCTTCCAATCACCCGCGAAACCC
GCATCGGAGAAGTTGACTCCTGAGCTGACAAGATCACCTAGCAAAGCCGCACGCATGTTTTCAGGGACACAGGAGAAGT
GTGCCACTTGCAGTAAAACAGCGTATCCTCT

> SEQ ID NO: 5532 112381 193944_300777_1b
CCCCCCCCCCGGCGAGGGGTGCTCGTTTCAGCGCGGGAGGAGATCAGATCGGGCTCAGATCTTCCAGCTCGCCGGGCC
GCCTCCGCCGCCGCAGCAGGAAGAGAGAGGGTGAGGAGAGGAGGAGGCTACGATGTTTAGCGGGACGCAGCAGAAGTGC
AAGGTGTGCACCAAGACGGTGTACCCGATGGACCAGCTCTCCACCGACGGCGTCGTCTTCCACCGCTCCTGGTTCAAGT
GCCAACACTGCAAGTCCACCCTCTCCCTTGGCAACTACTCCTCGATTGAAGGAGTGCCATACTGCAAGCCCCATTTCCA
GCAACTGTTCAAGGAGACCGGGAGCTACAACAAGAGCTTCCAATCACCCGCGAAACCCGCATCGGAGAAGTTGACTCCT
GAGCTGACAAGATCACCTAGCAAAGCCGCACGCATGTTTTCAGGGACACAGGAGAAGTGTGCCACTTGCAGTAAAACAG
CGTATCCTCTAGAGAAGGTGACAGTTGAAGGACAGGCCTACCACAAGTC

> SEQ ID NO: 5533 112417 167981_300552_1b
GAATTCGATCATTTTTCAGGGTTTGATTGGGGATATTCATTAGTCAAATGGAGAATAATGAAAGAGAAAATTTGACAGA
TTTTGATCTAAATCTTGATACATTTGGATTACCAGCTGAACTTGAAGATAATTTATATTATTCATTAAGAGGTGGACAA
AATCCAATCCAAGGAATATCTCCTAGACCTAGGAATCGATGGAGAAGGAGAAGACCAAGTATTACTTCATCTGAAACTA
GAAATTTTTCATTGGATTTCATTGTAAACCCTAGTTCCGCTAGTGAGAGAGTGTCTCAAGTTGGTGAAGGAAGTTTGGC
TGTTACTGACACTGATGAGAGAACAGCTGAGAGCAGTAAATCAGGGAAAGGTCTCGCCGTTGATCTTTTAGGTGATGAG
TTGAATAAAGATGAGGATAAGGAGAAGAATAACGAGGATGAAATGAGTTTCTTTGATTGTAATGTATGTTTTGAGATGG
CGAATGAGCCAGTTATTACCTTTTGCGGTCATTTGTTTTGTTGGCCATGTTTGTATCAATGGCTTCATGTTTATTCTAA
GGTTAAGTTATGCCCTGTGTGTCAAACAGAACTTACTGATGCCAATATAACCCCAATTTATGG

> SEQ ID NO: 5534 112417 105138_300371_1b
TTTCTCCATCTAAAAACCTCCATTTTTTTTAGCTTCAAGGCTTCAACTCAGTCAGCATAACAATACAAAGGAGAATATT
CTTGATTTAAATATATTCAGGCGTTAATAGCAATCTAGAAAATTACATCGAAAAGTAGGGTATGGCCCTAGATCTTCAT
TTACAAGAGCAAACAGCAGAGGCTGCCTTTGACGAGTGTCCTACTCCCTTAGAGAAGTGGAAGACGACGTTTGATTATG
AGAGTGAAGACAATCTCTCTGGTGGTTTTGAGTGTAACATATGCCTGGATCTTGTGCACGATCCTGTTGTTACATTTTG
TGGTCACCTCTATTGTTGGCCTTGCATCTACAAGTGGATTCAATTCCAGAGCATCCCTTCAGAAAATTCGGATCACCAA
CAGCCCCAGTGCCCTGTTTGCAAGGCTGAAGTTTCACAAAAAACCTTGATTCCACTCTATGGCCGCGGCCAAGCTACAA
AACCATCTAAAGACAATGTTCCAAGTAAAGGCATGGCCATACCACAAAGGCCTACTAGTCTAAGATGTGGCGGTCACAC
ACTGATGGCAACGACCGATTCAAATCCATCTTAGCAACTTCACTATCG

> SEQ ID NO: 5535 112417 244854_301562_1b
GGCGGCATCGGGGCTAGCGGCGCCACCGGGGGCACCGGCTCCACTGGCAGCGGCGGCGGCAGCGATGGCGGATCAGGTA
GCTATGACTGCAACATTTGCCTAGAGCTCGCACAGGACCCCGTGGTCACGCACTGCGGCCATCTCTTCTGCTGGCCCTG
CCTCTACCGCTGGCTGGCCTCTCGATCCAGCTGCACCGAGTGTCCGGTTTGTAAATCCGCAGTAGAGGAAGCCAAGGTC
ATCCCGATCTACGGCCGCGGCAAGGGCTCCACGGATCCACGCACAAAGGGAGTGGACAAGATCCCCAACCGGCCGCCGG
GGCAGAGGACAGATCTGCCACACCAGCACAGGCAAAACTCCCATCCCCAGGGTGGAGGAGGAGGTCCCTTCCAGCAGAT
GGGCTTTAGCTTCTTCACGGGGCCGACGACGCAGTTTGGAAACGTGACCCTCGGCTTCGGGCTGTTTCCGTTTTGTTC
GGTTTCTCCGCAACCAGCGGCGGGTTTCCCGATCTTGGGTTTGGGAGCGGCGGACGAGGCGGAGGAGGCGGCGGACAAC
TTGGTGGTGGTGGAGGGAATGGTGG

> SEQ ID NO: 5536 112417 283406_200093_1b
AGAAATTAGAGACGAAATACATAAGCAAATTTGGGAGAGAGGGTGAAAAGCCCTAGAATCATCTTTGTTGGGATCAGTAC
TTGTTCAATACTAATTGAAGGGCTCGAATTACCGCTTTTGTATCTTCGATCCATTAATTGCCTCCGAATTCCCCTTGCT
TTTCTTCAGAAACGATATATCTGAGGGAGATGCAGGACTCAACTACCAGGGTATTTGAAAGCTCTTCTTCTTCCTCTGG
GGATGGGAGCAATGATGCTGGTGATTTTGAATGCAATATCTGTTTTGAATTGGCGCAAGATCCCATTGTGACACTCTGT
GGTCACCTCTACTGTTGGCCATGCCTTTATAGATGGCTACATCTTCACTCACAATCCTATGAATGCCCTGTTTGTAAGG
CCCTTATTCAGGAGGAGAAATTGGTTCCTCTTTACGGCAGAGGAAGGACTTCTACTGATCCCAGATCGAAACCAATCCC
AGGCCTTGAAATTCCTAACAGGCCTGCAGGACAACGACCTGAAACGGCTCCTCAACCTCAATCAAACAATATTCCTAAT
CTTGGATTTGGTCATATGGGAGGATTTTTTTCCAACAGCTACTGCTAGATTTGGTAACTNTACAATGTCAGCTGGTTTT

FIG. 2 continued

```
GGTGGATTGTTCCCTTCGTTACTCAGCTTCCAGTTTCATGGATTCTCTGATCCGACAGCGTATCCTACCACATCAAATT
ACCCATTTGGATATACTCCTGC

> SEQ ID NO: 5537   113024 268422_200120_1b
TCTCTCTCTCCCTATCTCCCCCTCTATCTCAACACTCGCCGGAATCAAGAACCCGTCTGTATCTCCGGCGAAAGTTCTC
TATCCGACAAAGGGTTTTTCTCTTTTTTGAACTTTTCTTCTCTTTACCCATCAAACAAATAGTAATCCCTTTAATTCTG
TTTATAGAAATATAGATTTTCTCTTGAAGTTTCAGCAGGGAAACCTTCTAAAAGAAGCTTTTACTGGGTATCCATTTGT
TTTCTTTGTTTTTTTAAATTTAGAACTTGGCTTGAATAGCGATGGCTGATTCAGACAACGATGGTCAGGAGGACACAACGC
TGGAAACGAAGGATCAACTAGGGAACAAGACAGGTTTTTACCAATAGCAAACGTGAGCAGAATTATGAAAAAAGCCTTA
CCAGCAAACGCAAAAATCTCAAAAGACGCTAAAGAAACAGTTCAAGAATGTGTATCTGAGTTCATCAGTTTCATTACCG
GAGAAGCAAGCGATAAGTGTCAGAGAGAAAAAAGGAAAACAATCAACGGTGATGATTTGCTTTGGGCTATGACGACTTT
AGGGTTTGAAGAATACGTTGAGCCTTTGAAGATTTATTTGGCTAAGTATAGGGAGATGGAAGGGGAAAAGACTACTATG
GGGGGA

> SEQ ID NO: 5538   113024 262549_301695_1b
TTATTAAGAAAAATGATGGGAAAATTGATGTCCCATCGTAGTCACCATGCCACCACCGTACATCGGAGCTCCTCCACTT
CCACTTCCAGCTCCACCGCCTCCTCCTCCACCTTCCTTATCGCCTTGTCTCCCTGCCGTAGTAGTCTTCTCTCCTTCCA
CCTCCCTATACTTTTGCAGATAAACCTTGAGAGGCTCCACGTAGTCCTCAAACCCTGGCGTAGTCATCGCCCAAAGAAG
ATCGTCACCGTTGATTGTCTTCCTCTTCTCTGACACTTGTCAGAAGCCTCACCGGTGATGAAACTTATGAATTCC
GATACACACTCTTGAACCGTTTCTTTAGCATCCTTAGAGATTTTTGCGTTCGCAGGAAGTGCTTTCTTCATGATCCTGC
TAACGTTAGCGATCGGTAGAAACCTATCTTGCTCACGTGTCGAAGCATTTCCACCGTCTTTGTGTCCTCCTGAATCGTT
GTCCGAATCCGCCATGCTGC

> SEQ ID NO: 5539   113024 146864_301203_1b
ATGCACGTCGCCCTATTTTGAACGTTCGGTTCTGTTTCTTCCCCACTTCTCTCTGCCGTCCGATCTCTGTGTGTAACGC
AGTCAAACACCAAGCTATAGAAGCCATCACAAAGCGCGCCAAATACAAAATAAACCTCCTTTTCTCCTCCTCTTACTTG
TCCTCTCTACTGATACAGAAAACATACGAATTTTTTTTTTTTTAGAAAAAAACTCAATTTTTCTCATTCAGCTGTAGG
GTCATCTGTCAAGTAACTAAGGGTTTTGATAGTAGTGTTTGAGGATGGCGGAAGCACCGGCGAGTCCGGGAGGTGGTGG
AAGCCATGAGAGTGGGGGTGAGCGGAGCCCTCAATGTGAGGGAACATGATAGGTTCCTTCCTATAGCCAAGCATT
GGTCGCATCATGAAAAAGGATTGCCTGCTAATGCTAAGATTGCTAAGGAAGCTAAAGACACTGTTCAGGAATGTGTCT
CTGAGTTCATCAGTTTCATCACCAGCGAGGCAAGTGACAAGTGTCAGACAGAGAAGAGAAAGACAATTAATGGAGATGA
TTTAGTATGGGCACTGACCACCT

> SEQ ID NO: 5540   113024 154696_301256_1b
ACTTTCTCCAGCGTCCGATCCTCACTTTTCTCCTTCAATCCTTCATTCTCCTCTCCTCGCGCCCAAATTACAAATCCCC
AGGTATGGCGGATGGTCAAGGATCGTCAAGGTCACCGGCGACCTCCAAACGGAGGAGGAAGTCACGAGAGCGGTGGAGAC
CAAAGCCCTAGATCTAATGTACGTGAACAGGACAGGTTTCTTCCTATCGCTAATATTAGTCGAATCATGAAAAAGGCGC
TTCCTGCTAATGGAAAAATTGCTAAAGATGCTAAGGAGACTGTTCAGGAATGTGTTTCCGAGTTCATTAGCTTCATTAC
CAGCGAGGCAAGTGACAAGTGCCAGAAAGAGAAAAGAAAGACTATTAATGGTGACGATTTGCTATGGGCAATGGAAACT
CTAGGTTTTGAAGATTATATTGAGCCACTCAAGGTGTACCTCGCTCGGTACAGAGAGATGGAGGGTGACACAAAGGGAT
CTGCCAAGACTGCTGATGGGTCCGCTAAAAGAGATGGGATGCAACCGAGTCCTAGTTCACAGCTTGCACATCAAGGTTC
ATTCTCGCAAGTAATGAATTACGGAAACTCTCAGGGTCAGCATATGAT

> SEQ ID NO: 5541   113024 230772_301071_1b
CCACGCGTCGTGATCTATGCAGCGTTAGCGAAGCGATCGATCGAATCTCCTCGAAATCATGGGTGATCGAAGCCCGGAC
AACAGCTCCGACGAATCCGGCAATCCAAGCTCGCTGTCGCCGCGAGAGCAGGATCGCTTCCTCCCGATCGCGAATGTGA
GCCGGATCATGAAGCGCGGCCTGCCAGGGAACGCCAAGATCTCCAAGGATGCCAAGGAGACGGTCCAGGAATGTGTGTC
GGAATTCATCAGCTTCGTCACCGGCGAGGCGTCGGACAAGTGCCAGCGAGAGAAGCGCAAGACCGTCAACGGGACGAT
CTGCTGTGGGCGATGAGCACGCTGGGATTCGAGGACTATGTTGAGCCGCTTAGGGTTTATCTCCACAAGTACCGGGAGA
TCGAGGGGAGAAGGCAATGCTGGCCAAGGCTGGCGAGCGCGATGGCCAGTGCGATCTGATGCTCGCCAGGCCCGGCGC
TGTGATGGCTGGCTATGGATTCCACCACCGCTAAGAAGGCGGCGCTGCTGG

> SEQ ID NO: 5542   113170 1098707_301486_1b
AGCATAAGCACAGGGGGAGGCGGACAAGCAAAATTTAAGCCCTGATCGGATTGTGGAGGTTTATGCTATTTGAGAAG
CCAAAAAGCTACTACGCCCGTTTTTCCAGAAGATAATGTCCGTGACTTTGCATACGAATCTGGGAGACATCAAGTGTGA
AATCTTCTGTGACGAAGTCCCCAAGACGGCTGAGAACTTTCTGGCCTTATGTGCCAATAATTATTACGATGGAAACATC
TTCCACCGGAACATCAAAGGATTCATGATTCAAGGTGGCGATCCAACAGGGACGGGAAGAGGAGGCACTAGCATATGGG
GACGCAAATTCAGTGATGAAATCCGGGAATCTCTCAAGCATAATGCGAGGGGTATTCTTTCCATGGCAAATAGTGGTCC
```

FIG. 2 continued

AAATACCAATGGAAGTCAGTTCTTCATTTCATATGCCAAGCAGCCTCATCTAAATGGCATTTACACTGTGTNTGGACGG
GTTATTCACGGTTTTGAAGTTTTAGATCTGATGGAAAAGACTCCAACGGGAGCTGGAGACCGTCCTCTTGCTGAG

> SEQ ID NO: 5543 113170 147375_301252_1b
GCGGCAAAAAATCCAAAGGTTTTCTTTGACATATTGATTGGCAAGGCCAAGGCTGGGAGAGTTGTGATGGAACTGTTTA
AAGATAAGACTCCTAAAACTGCTGAAAATTTCCGTGCTCTCTGCACCGGTGAAAAAGGGATTGGGCAGTTAGGGAAGCC
CTTACATTACAAGGGCTCGGTGTTTCATCGTATCATTCCACACTTCATGTGCCAGGGTGGAGATTTCACCAAAGGAAAT
GGGACTGGAGGAGAATCGATATATGGTGCAAAATTTGCTGATGAGGACTTCAGTGTGATACATACTACACCCGGCCTTC
TTTCAATGGCAAATGCTGGACCAAACACCAATGGATCTCAGTTCTTTATCACCACGGTACCAACGCCTTGGCTTGATGG
GAAACACGTCGTATTTGGCAAAGTTGTAGACGGCTATAGTGTTGTCAAGGAAATGGAAAATGTGGGTTCAGATAGTGGG
AAAACATCATGCACTGTCTCCATTGAAGACTGTGGGGAGCTAAAGGAGAACTAAATGAGGAGATAATGTAGTTTTTGAG
CAACATGTCATGGTACTGGAGTTCTACTCACCT

> SEQ ID NO: 5544 113170 260049_301711_1b
ATCTCCATCTTCTCTCCCCTCCCCTCCATAGCTCCGGTAGTAAGGTATGGCTAATCCCAGAGTGTTCTTCGACATCACC
ATCGGCGGCAACTCCGCGGGGCGCATCATCATGGAGCTGTTTGCGGACACTGTGCCCAAGACGGCGGAGAACTTCCGGG
CGCTGTGCACCGGCGAGAAAGGAATCGGCAAGAGCGGCAAGCGCTACTACAAGGGATCCAAGTTCCACCGCGTCAT
CCCCGACTTTATGTGCCAGGGCGGCGACTTCACCGCCGGCAACGGCACCGGCGGCGAGTCCATCTACGGCATGAAGTTC
GCGGACGAGAACTTCCAGAGGAAGCACGCGGGGCCGGGCGTCCTGTCCATGGCCAACGCCGGGGCCAACACCAACGGAT
CCCAGTTCTTCCTGTGCACTGTTCCCTGCTCCTGGCTCGACGGCAAGCATGTCGTCTTCGGCAACGTGGTTGAAGGCAT
GAACGTTGTCAAGGACATCGAGAAGGTGGGGAGCCCCTCGGGCAGGACGAGCAAGCCCGTTGTCGTTGCCGACTGCGGC
CAGCTCTCTTAGATCTATGTGTTTGTCTGTCGCTCCCGTTGGGGATGGCGATGGTGTTCCTGCTTTCGTTTCTCCTTCA
AATCAATGAAAAAGCTTATTATCTCT

> SEQ ID NO: 5545 113170 254887_301639_1b
GGAAATTTTCTGCCCTTGCAAGCGCTCGTCTTTCTCCGTCGTCGTTTTCCGGTGAACAGCTGTTTAGGAATGGCGAACC
CCCGTGTGTTTTTTGACATCACCATCGGCGGCAACCCTGCAGGCCGCATCATAATGGAGTTGTATGCGGACAAGGTTCC
AAGGACAGCGGAGAACTTCCGTGCCCTCTGCACAGGGGAGAAGGGAATTGGAAAGAGTGGGAAGCCACTCCACTACAAG
GGTAGCTCCTTCCACAGGGTTATCAACGACTTCATGTGCCAGGGTGGTGATTTCACGCGGGGGGATGGAACAGGTGGAG
AGTCCATCTACGGGGCCAAGTTTGCCGATGAGAACTTTTCGTGCAAGCACACTGGTCCAGGCATCCTCTCCATGGCCAA
TGCAGGACCAAACACCAATGGCTCCCAGTTCTTCCTTTGCACCGTCCCCTGTGCATGGCTTGATGGAAAGCATGTTGTC
TTCGGCAAGGTCGAAAATGGAATGGACGTTGTCAAGACTATTGAGAAATACGGATCTGGGAGCGGCAAGACAAAAGCCC
CTGTTGTCGTTGCTGACTGTGGCCAGCTCTCTTGAAGTATGGTTGGTGGCTCCCCTTAGAAGAATAACCTCTTCCCCCC
CTCTAATAAGTTTTGGAGCCTATTCTTCGCTAAGCTTTATAGTATGAAGGTACAGGGTGCTCAGAGTAATGA

> SEQ ID NO: 5546 113170 245418_301568_1b
GGGCGCGAGCAACAGCCGTCACCTGCTTCAGGTGGGGGAAGCAAAAGAAAGAAGAGCCTGGAGGAGCTGCGTTTGGAAC
GACTGCAGAGGGAGGAGAGCGAACGGGCCAAGGCCCGCAAGTTACTGCCGTCAGGTGGCACTCGGAAGCACTACAACTC
GAGCTTTGGCAACAGGAGTTAGTGATTTAGGGTTGTGTTTTGTAATGGAAGAAGGCGCACCGTTAGTCACTCTGGAGA
CGTCCATGGCTCCTTCACTCTAGAGCTCTACCATAAGCATGCTCCCAAAACGTGCCGTAATTTTGGCGAGCTGGCCAG
GCAGGGCTACTACAACGACGTCAAGTTTCACCGCGTCATCAAGGGTTTTATGATTCAGGGTGGTGATCCCACTGGCACA
GGCAGGGGCGGAGAGTCCATCTACGGGCACAAGTTCGAGGACGAGCTAACGCGGGAGCTCAAGCACACGGGAGCGGGTG
TCTTATCCATGGCCAACTCGGGGCCTAACACCAACGGCAGCCAGTTCTTCGTAACGTTAGCCCCCACACCGTGGCTCGA
CGGCAAGCACACCATATTCGGGAGAGTCTGCAAAGGGATGGAAGTTATCAAGCGGCTGGGAAACGTACAGACGGACAAG
AGCGACAGGCCGGTGCACGACGTCACGATTCTCAAGGCCACCGTGGAAGACTGAGTCAAGAGCTCCTCAGA

> SEQ ID NO: 5547 113170 43473_300031_1b
GCGAATCCTAGAAACAAATTGTCTCCTTACCTTCTTATCGGGGTCTTGGTTTTATTCGGAACCCTAATTTTCATTCTGA
ACCGATTGGGTGATACCGGAGTCACGTCGGATAAAGACATTAAAATCGAGCAAAATGATGAGGCGAAACCATCAGAGGA
TTTGGAGCACGTGACGCATAAAGTGTACTTTGATGTCGAAATTAATGGAAAGCCTACAGGTCGTATTGTCATGGGCCTC
TTTGGAAAAATTGTCCCGAAGACAGCAGAAAACTTCAGAGCTCTTTGCACGGGGAAAAAGGAACTGGGAAGGCTGGAA
AGCCTCTCCATTACAAAGGTAGCACTTTCCACAGGATCATACCGAGCTTCATGATCCAGGGAGGCGATTTCACTCGTGG
TGATGGGCGAGGTGGAGAATCTATATATGGTGAAAGCTTTGCAGATGAAAACTTTTATCTAAAACACACTGTACCTGGT
ATTCTGTCAATGGCAAATGCTGGACCGGACACCAATGGGTCTCAATTCTTTATCACAACTGTAACCACTGGCTGGTTGG
ATGGGCATCATGTTGTCTTTGGCAAGGTGCTGTCTTGGCATGGATGTTGTCTACAAAATCGAAGCAGAAGGGAGAGGAAG
TGGAACCCCAAAAAGCAAAGTTATGATATCAAATAGCGGTGAACTCCTTAATGATCCAACTTTCCATGTATCAAAACAC
CTCAGATGTTTTGATAATGCTTGCCCTCGAGCAAAAGTCAGTTTCATATGCTGTCAAGAAATCTGTTATGCGACTATTG
CGGCCTGTAAAGTTAAAACAATCCTCTCAAAAGAGGATCAAGACTGCTGTGCTTAGAATAGACGGCTCGTTTTATGAAA

FIG. 2 continued

ATTGTTATAAAACCTTTGCTTCTATATGTATTTCATAAAAGATTTTGAATGAATTCATGGTAATATATACCAGAGGTAT
ATTGAAAA

> SEQ ID NO: 5548 113170 6593_300391_1b
CCCGAGGCGTCCGCTTCTTCAGTCTTTTAGAGATCTCACGTTTCAAACAACAAGAATGGCGTTCCCTAAGGTATACTTC
GACATGACCATCGACGGCCAGCCCGCGGGAAGGATCGTGATGGAGCTGTACACCGATAAGACTCCCAGGACTGCCGAGA
ATTTCAGAGCTCTCTGCACCGGAGAGAAAGGTGTTGGCGGTACCGGAAAACCCCTTCACTTCAAGGGATCTAAGTTTCA
CCGTGTGATCCCTAACTTCATGTGCCAGGGAGGAGATTTCACCGCCGGGAACGGAACAGGCGGTGAGTCGATCTACGGG
AGCAAGTTCGAGGACGAGAATTTCGAGAGGAAGCACACCGGACCGGGATCCTGTCGATGGCGAACGCCGGTGCAAACA
CGAACGGATCTCAGTTCTTCATCTGCACCGTGAAGACCGATTGGCTTGATGGGAAGCACGTGGTGTTTGGGCAGGTCGT
GGAAGGCTTAGACGTGGTAAAGGCCATCGAGAAGGTTGGATCATCATCTGGAAAGCCGACGAAGCCTGTGGTTGTTGCC
GATTGTGGTCAGCTCTCTTAGGATCTTCCTATCATCATCCTTAATTTAGCATCATCGTCGTCATTGTGGTGTCTCTTTA
TGCTTTTGCTTTTGTTATGGAGTCGTTTTAAAATTTGTAGTCATAAGTTTGGTGTGTGTTCTCATGGGAACATATATAA
ACTTGCCCCTTTAATATTAACTCCCCC

> SEQ ID NO: 5549 113170 6307_300336_1b
CCCACGCGTCCGACAGAACCTAATCTTCTTCTCCAATCAATCTCAGAGAAAAAAAGAAATGGCAACAAACCCTAAAGTC
TACTTCGACATGACCGTCGGTGGCAAATCCGCCGGTCGTATCGTGATGGAGCTTTACGCCGACACAACACCAGAAACCG
CCGAGAATTTCAGAGCACTCTGTACCGGAGAGAGAGGAATCGGTAAACAAGGTAAGCCATTACACTACAAAGGATCAAG
CTTTCACCGAGTGATTCCGAAATTCATGTGTCAAGGAGGTGATTTCACAGCCGGGAATGGTACCGGAGGTGAATCTATC
TATGGATCGAAGTTCAAAGACGAGAACTTATCAAGAAACATACAGGACCAGGTATTTTGTCTATGGCTAACGCT

> SEQ ID NO: 5550 113170 47185_300174_1b
TCGATTTCTCTCTTCCAAATCTCCCAAAAGATGTCGAACCCTAGAGTTTTCTTCGACATGAGTCTCAGCGGTACTCCCA
TCGGACGGATCGAGATGGAGCTTTTCGCTGATACAACCCCAAACACGGCGGAGAATTTCCGTGCTCTCTGTACCGGCGA
GAAAGGAATGGGAAAGCTAGGTAAGCCACTTCACTTCAAAGGATCGATCTTCCACCGTGTGATTCCCGGATTCATGTGT
CAAGGAGGTGATTTCACCGCCAAGAACGGAACCGGTGGTGAATCGATCTACGGTGCTAAGTTCAAGGACGAGAACTTTA
TCAAGAAGCATACAGGAGCTGGGATTCTCTCAATGGCTAACTCTGGTCCTAACACTAACGGATCTCAGTTCTTCATC

> SEQ ID NO: 5551 113170 53163_300090_1b
CCCACGCGTCCGCACAACAAACCTCTTCTTCAGTCTTTTAGAGATCTCACGTTTCAAACAACAAGAATGGCGTTCCCTA
AGGTATACTTCGACATGACCATCGACGGCCAGCCCGCGGGAAGGATCGTGATGGAGCTGTACACCGATAAGACTCCCAG
GACTGCCGAGAATTTCAGAGCTCTCTGCACCGGAGAGAAAGGTGTTGGCGGTACCGGAAAACCCCTTCACTTCAAGGGA
TCTAAGTTTCACCGTGTGATCCCTAACTTCATGTGCCAGGGAGGAGATTTCACCGCCGGGAACGGAACAGGCGGTGAGT
CGATCTACGGGAGCAAGTTCGAGGACGAGAATTTCGAGAGGAAGCACACCGGACCGGGGATCCTGTCGATGGCGAACGC
CGGTGCAAACACGAACGGATCTCAGTTCTTCATCTGCACCGTGAAGACCGATTGGCTTGATGGGAAGCACGTGGTGTTT
GGGCAGGTCGTGGAAGGCTTAGACGTGGTAAAGGCCATCGAGAAGGTTGGATCATCATCTGGAAAGCCGACGAAGCCTG
TGGTTGTTGCCGATTGTGGTCAGCTCTCTTAGGATCTTCCTATCATCATCCTTAATTTAGCATCATCGTCGTCATTGTG
GTGTCTCTTTATGCTTTTGCTTTTGTTATGGAGTCGTTTTAAAATTTGTAGTCATAAGTTTGGTGTGTGTTCTCATGGG
AACATATATAACCCCGCCCCTTTAATATTAACTCC

> SEQ ID NO: 5552 113170 225332_300986_1b
ATGGCGCCGAATCCGCGCTGCTACATGGACATCACCATTGGAGGCGAGCTGGAGGGGCGGATCGTCGTGGAGCTCTTCG
CGGATGTCGTGCCGCGGACTGCGGATAATTTCCGGGCGTTGTGTACTGGCGAGAAGGGCGCTGGCTCCACTGGATGCCC
GCTGCATNATTTTGGCGTGACTTTCCATCGCGTGATCAAAGGTTTCATGATCCAGGGAGGCGACTTCACCGCCGGCGAT
GGAACCGGCGGCGAGTCCATCTACGGCCTCAAGTTCGACGACGAGAACTTCAAGCTCAAGCACGAACGCAAAGGCCTGC
TGTCCATGGCCAACTCCGGGCCCAACACGAACGGCTCCCAGTTCTTCATCACCACCGCTAGAGCGTCACATCTCGACGG
CAAGCACGTCGTCTTCGGGAAAGTCCTCAAAGGCATGGGTGTGGTTCGTAGCATGGAGCATGCCATCACCGACGACAAG
GACCGGCCCGTGAATCCGCTGGTGGTGGCCGACTGTGGAGAGCTTCCACAAGGAGCTGACGATGGTGTGTCGCTCTTCT
GGAAGGATGGCGATGTGCTTCCGGACTGGCCGGCTGACTTGCCCGAGCAGCCGGAGGA

> SEQ ID NO: 5553 113595 181164_300654_1b
GAATTCAAGAGAAAAACAAGTACAGAGAGAGTGAGTTTAGTGAAGAAGTAATGGCAACTATGTATGCAGCAGCAAGTGC
ATCTTCAATGCTAGTGGCAAGACCTCGTTTGCCAAAAACCATTAGCTGCTCAGCAGGTTTACCTTATCTTCCACCTCGT
CCATCCGTTTCTTCATTCTCTACCTCCATCAAAAACTACCCAGTGTCAAGCAGCAGATTTTCAACTCTCCGAGTCAAAG
CTGAGGAGACATCATCTGTTGAGGTTAATGATATAATTGAAGACTTAAAAGAGAAGTGGGATGGACTTGAAAACAAGTC
TACCGTTCTTATCTACGGTGGTGGTGGTTTGGTTGCACTTTGGCTATCTACAGTTGTGGTTGGCGCCATCAATTCAGTT
CCTTTGCTTCCAAAGATCATGGAACTAGTAGGACTCGGTTACACTGGATGGTTTGTCTACCGATACCTTCTCTTCAAGT

FIG. 2 continued

CAAGCAGAAAAGAACTAGCAAGTGATATCGAATCCTTGAAGAAAAAGATTGCAGGAACCACCGAATAGAGTCAGACATA
AGATGGTCTTGCAGTGGGGCTATTTTGTTTATTGTCCTTAGATTTATTTGAGAATCATTATATGGCTCTTGTTTTTTA
GTTCTTCTGGATCTCATGTATAAGAGAGATTTATGTGAACCCTGTTAATGTTAATACTTCATT

> SEQ ID NO: 5554   113595   191336_300740_1b
CCCACGCGTCCGGGCCAGGGAAGAGCCAGGTAGAGCCGAAGAGGGTCCACGACTGACATGGCCGCCACGGCGTGCTCCA
CGGCGCCTCTTCTCGGTGGAGCTCGCCTCCCCGCCGTCGGCGCCGCCTTGCCGCCGCCCTCCGTTCTCCTCCTCCCCCA
GCGCAACTTCCCCTCTCCTCTCCGCCTCCATGACGCACCGAGGCTATCTCTGCTCCGGGCGAGGGCGTCGTCCGACGAC
ACCTCGTCCTCCGCCGCGACCGGCGACGAGCTCATCGAAGACCTGAAAGCTAAGTGGGACGCCGTTGAGAACAAGTCCA
CCGTCCTCACGTACGCCGGCGGCGCCATCATCGCCCTCTGGCTGTCGTCCGTCATCGTCGGCGCCGTCAACTCCGTGCC
TCTGCTTCCCAAGTTCATGGAGCTCGTCGGGCTCGGGTACACAGGCTGGTTTGTGTACCGCTACCTCCTCTTCAAGGAA
AGCAGGAAGGAATTGGCCGACGACGTCGATTCTTTGAAGAAGAGGATTGCTGGGACAGAGTAAAAAATGCCGTCGTCTG
CACCAATTTTTTGGAACGATTCTTTGGATCGCACATTGCAGAGACCAAAACCCGTTGTTTAGAGTACTAGTGTTTGGTA
CCGCGAAGCTT

> SEQ ID NO: 5555   113595   247661_301622_1b
GCGGACGCGTGGGGGGAGATTTTAGGGCGAATTCCGGGGCGCGATGGCGGCATCTATCGCGGCATTCACGGCCGCTCCA
TCTTCTTGCTGCGCGGCGGCGGTGGCGTCGGCATCGGCCTCGTCGTCATCGATTCGGCCGCTTCCACTGAAAAGATCGG
TCCTCAAGCTCCACAGCGCGGCAATGCCGGGGTCTTTGAAGTTCTCTCCGCTCACAGTGATGGCTACGACCTCGTCCGA
GGGAGAAGACAACTGGGACGACGACGTCGACGGAAGAAGTGAGCAAGCAAGTGGAGGACATTGTGTCGGATTTGAAGGAA
AAGTGGGATGGTGTGGAGAACAAGACTACTGTCTCTTGATTTACGGTGGTGGAGCGCTGGTCACGCTATGGTTCTCGGCAA
CAATCGTTGGAGCTATCAACTCGGTTCCATTGCTTCCAAAGGTAATGGAGCTTATTGGACTGGGATACACTGGCTGGTT
CGTCTACCGGTATCTTCTCTTCAAGTCGAGTAGAAAGGAGCTGCTGGAAGACGTGGAAGAGCTCAAGAAGAAGATCACG
GGCGCAACCGAGTAAGAAGACGAGTAGAGCGAGCTGTTTGATGATGTCCGAAAGAAGAAACTCTGACGTGCCTGGATGG
AACCAGGCCGGCTTTGATCGATCG

> SEQ ID NO: 5556   113595   1100690_301462_1b
GAAGTCGACACTGCCGGAACCCTAGCTCCTCTTAAGCTCGACCTCAGCTATGGCGGCGGCAGTAGCAGTAGCAGCCTCT
TCCTCCCTCTCTCTTTCCCGGCACTCTGCCGCCACGGCACCAGTGCTCGCCCCTGCGTAGGGCCCTCCCCCTGCCTGCC
CTTTCCCCGCCTCCCAAGCTCTCAAGCTCTCTACTTCGCCTTTCGTCCCAGCCACTCTAAGATTTTTGCCCTTATCTGT
CAATGCGGTTTCAACTGAGGAAAAAACGTCATCATCGGTTGAAGCCGAAGTACCGGCCGAGGATTTAGTGGCCGACTTA
AAGGAAAAGTGGGATAAGCTGGAGAACAAGTCGACAGTCTTAACCTACGGCGGAGGTGCTTTGCTTGCCATTTGGTTCT
CTTCGATAGTTGTTTCTGCCATTAACGCAGTTCCCCTGCTTCCGAAGCTTATGGAGTTTGTGGGCCTTGGATATACTGG
TTGGTTTGTCTATAGGTACCTTCTTTTCAAGGAAAGTAGGAAAGAGCTAGTCTTGGATATTGAGGATTTGAAGTCAAAG
ATAACCGGGTCTGGAAAGGAAGATTAGGCAAGGAGGGACTTATTCTATCCATGGCAAGTAAGGTGGTTTGTCTGTGTGT
GTTTAGGTAGGATAAATTT

> SEQ ID NO: 5557   113595   118050_300063_1b
CCCACGCGTCCGGAAGAAAATATACTACTTTTTGGGGATATCAAGAAACCAAAAAAGGAGATTTGAGATAGACAAGAAA
GAGAGGCCAAAGTTAAGCAATAAGCATACACCGCCAGCCCCAAAAATCTAAGCATCGGCCAAATGGCAGCAGCAGCTTC
TACTTCAATGGCAGCTACTGCCGTCTTTGCTTCTCGTTTCCCACTTTCCTCCACCACCAAAGCCGCCCCTGTTCGCTGC
TCCGCCTTGCCTTACCTCCCACCCTGTCTTTCTGCTACTGCCTTCTCATCTTCTCTCAAGTTTGCTGAACCCAAGAGGG
CTTCGCTACTCCAGGTCAAAGCCTCTTCATCAGAAGAATCCGGTGCTGTTGATACCAGTGAATTGTTGACAGATCTAAA
AGAAAAGTGGGATGCTGTTGAAAACAAGTCTACAGTTATAGTATATGGAGGTGGGGCAATTGTTGCAGTTTGGCTGTCT
TCAATTGTTGTTGGTGCTATCAACTCAGTTCCTTTGCTCCCGAAAATAATGGAGCTGGTCGGGCCCTTGGATACACCGGT
GGTTTGTCTACCGCTATCTTCTATTCAAGTCAAGTAGAAAAGAATTGGCAGAAGACATTGAGCAATTGAAGAAGAAGAT
TGCAGGAACTGAATAAATGCACATAAATGGCAATGCCAGTTCAGACTGTTAAATTTTCTGTACAAGAGGCATCTGCTCG
TGTGAAGTAGAGTAGATTTTGTTGTAATTTTCTTCTATTCTGAGCAAATCTTCAAATAAAATAATGTATTTACCTTACA
GTTCATTGTGCTTATAAATTATATAGCAGTATCCACTCTGTTTCTATG

> SEQ ID NO: 5558   113595   122187_300016_1b
CCCCCAGAGTGTGAGATCGAGCTGAAAGAAAAAGAGAGGCCACGAAGAGAGCTCAGCTGCTGCCTCTAGCTTACTTGGT
GATAAGGAGGAGGAGGAGGAGGAGGGCACCGACATGGCCGCAGCCACGGCGTACACCGTGGCGCTCCTCGGCGCCACCG
GCGCGCGCGTCCCCGCCGCTCCACGCTCCGCCGCGCTTCTGCCGCGCCGCGGCGGCGTGCTCCAACCGCTGCGCCTCCA
GGACGCGCCGCGACTGTCCCTGCTCCGCGTCAGGGCCGCCTCCGACGACACCTCCACCTCGGCCAGCGGCGACGAGCTC
GTCGCCGACCTCAAGGCAAAGTGGGAGGCGATCGAGGACAAGCCGACGTTCCTCCTCTACAGCGGCGGCGCCGTCGTCG
CCCTCTGGCTCACCACCGTCGTCGTCGGCGCCATCAACTCCGTGCCGCTGCTCCCCAAGATCCTGGAGCTCGTCGGCCT
CGGCTACACCGGCTGGTTCGTCTACCGCTACCTCCTCTTCAAGGAGAGCAGGAAAGAGTTGGCGACCGACATCGAGACC

FIG. 2 continued

TTGAAGAAGAAGATCGCTGGAACGGAGTAATTAAGCAGCTGCATTTGTCCGGGGAAGTTTTGGGGGGTGACTCTCTAGA
GTGCTTGCTGCTGCTTCCTCTGTGTGATGTTTGTATATCTCTACGAGAATATGTTCTGCTCCCATGTGCAGTAACAGCG
TAGTGCAAAAACTGTATCAAACCTACTATCAGTTGTTTCTTCG

> SEQ ID NO: 5559 113595 11820_300290_1b
GGACATAAAATTCCCAGAAGAAAATATACTACTTTTTGGGGATATCAACAAACCAAAAAGGAGATTTGAGATATACAAG
AAAGAGAGGCCCAAGTTAAGCGTACACAGCCAGCCCCAAGAATCTAAGCATCGGCCAAATGGCAGCAGCAGCAGCTTCT
ACTTCAATGGCGGCTACTGCCGCCTTTGCTTCTCGTTTCCCACTTTTCTCCACCACCAAAGCCGCCCC

> SEQ ID NO: 5560 113595 1119230_301896_1b
GGCACTCGCACGGAGAGAGAGAGAGAGAAAGGAAGAGGAGATAGATAGATAGATAGATAGATAGAGAGAGAGAAGAG
CCATGGCCACAGCTTCCATGGTTTCCTTGCAGGCCACAGCCATGGCCTTCCCCTTTTCACCTTCAACATCTCGCCACTC
CCACTCCCATTCCCCTTCACTTGCCTTCACAAGAATGCCCCCCCCCGCCAACCCTCTCAAGCCCTCCCTCTTCATCCCG
TCAGGCAGTGTAAGATTTTCACCGCTATCTATAAAAGCGGTATCGACGGAGGAAAAACAGTCAATGTCGGAAACTACAG
CCCCAGCAGAGGATTTTTTGGCGGACTTACAAGAAAAGTGGGATAAATTGGAGAACAAGTCGACTGTTTTTATCTATGG
CGGAGGTGCTTTGGCCACCATATGGATATCATCAATAGTCGCTAGTGCTGTTAATTCGGTTCCATTGCTTCCTAAGGTC
CTTGAACTCGTTGGTCTTGGCTACACTGCATGGTTTGTGTATAAGTACCTTCTGTTTAAGGAAAACAGGAAAGAGCTAG
TCTCCGACATTGAGGATTTGAAGTCAAAAATAATCGGTGGGTCCCGTAAAGAGGAGTAAGCCGAAAAGATTTAGTCCTT
GTCTAGGGGTCAGCCATTCCCTCCTTTAGTTCCTTTATTT

> SEQ ID NO: 5561 114370 159841_200026_1b
TCTTCAAAATTACTCCAAACCTTCTCTTAACCTAAAATCTCCATTTCTCTCCTCAAATGGCACCAAAAGCTGAGAAGAA
ACACGCCGAGAAAAAGCCGGCCGCTGAGAAAACCCCGGTCGCCGAGAAAGCACCAGCAGAGAAGAAGCCCAAGGCCGGA
AAGAAGCTCCCAAAGGACGCTGGTGCTGCCGGAGACAAGAAGAAGAAGAGGGCAAAGAAGTCAGTTGAGACCTACAAGA
TTTACATCTTCAAGGTTCTGAAGCAGGTTCACCCCGATATCGGTATTTCAAGCAAAGCCATGGGTATCATGAACAGTTT
CATCAACGATATCTTTGAAGAAGCTTGCTCAGGAATCTTCTAGACTCGCTCGGTACAACAAGAAGCCAACTATCACTTCT
CGGGAGATTCAGACTGCTGTGAGACTTGTACTTCCTGGTGAATTGGCTAAGCATGCTGTCTCTGAAGGAACTAAGGCCG
TTACCAAATTCACTAGCTCTTGAACAATTTTATGGTTTCAATGTTTAATTTTACTGTCTTTAGGGTTTGTGTTAGGTGT
AAAAACAGTTGCTTTTAATTAATTAGTGTCTAGTTTCCTTTGATCTGTAACGCTTGTTATGTAATCGATAGCTAAACAT
CTATGAAATTCATAAGCTTTTT

> SEQ ID NO: 5562 114370 202377_300732_1b
CCCCCCCCGACAAAATCCAATCTCCAAATCAGAAACACACTCGCCTCGCCTCCTTTCGCTCGTTTCGTCCAACACCACC
ACCACCACCACCGATCTCGATGGCGCCCAAGGCCGAGAAGAAGCCCGCGGAGAAGAAGCCGGCGAGGAGAAGGCCGGC
GAGAAGGCGCCCGCGGCCGGGAAGAAGCCCAAGGCCGAGAAGCGGCTGCCGGCGTCCAAGGGGGAGAAGGGCGGCGAGG
GCAAGAAGGAGCGCGGCAGGAAGAAGGCCAAGAAGAGCGTCGAGACCTACAAGATATACATCTTCAAGGTGCTCAAGCA
GGTGCACCCGGACATCGGGATCTCCTCCAAGGCCATGTCAATCATGAACTCGTTCATCAACGACATCTTCGAGAAGCTC
GCCGGCGAGGCCGCCAAGCTCGCCAGGTACAACAAGAAGCCCACCATCACCTCCAGGGAGATCCAGACCTCCGTCCGCC
TCGTCCTCCCCGGCGAGCTCGCCAAGCACGCCGTCTCCGAGGGCACCAAGGCCGTCACCAAGTTCACCAGCTCTTAGGC
GCTCTAGTGTAGTAGGTGTTTGGTGATTTTCTCTTCGTTTTCGTCGTAGCGAGTCCATGGCAGCGGTGGTAGTTGCCCT
GTCGATCTCTGATTTCTTTCTCTTGTGTCTAGTGTTCCTGTCTAGTGCTTGCTGATTACTGTAAGAATCTCTTGGTTGT
GCCCGTTGAGTTCTGATCTTAA

> SEQ ID NO: 5563 114370 179587_300561_1b
GCCCTTTTGCCATTTTGATTATCAACACTTGAAATCTACATCGATTGCATCAACTTAATCCAAAATGCCTCCCAAAGCT
GCCGACAAGAAGCCCGCCGCCAAGGCCCCCTCAACCGCCAGCAAGGCTCCCGAGAAGAAGGACGCTGGCAAGAAGACCG
CCGCTTCTGGCGAGAAGAAGAAGCGGTCAAAGACTCGCAAGGAGACCTACAGCTCCTACATCTACAAGGTCCTCAAGCA
GGTCCACCCTGACACCGGTATTTCCAACCGTGCCATGTCCATCCTCAACTCGTTCGTCAACGATATCTTCGAGCGCGTT
GCTACCGAGGCTTCCAAGCTGGCTGCCTACAACAAGAAGTCCACAATCTCTTCCCGAGAGATCCAGACATCTGTCCGAT
TGATCCTGCCGGGTGAATTGGCCAAGCACGCCGTCTCTGAGGGCACCAAGGCCGTCACCAAGTACTCTTCATCCACGAA
ATAAAGGGTCAAGATGGCTGGTTCTGATTTCAAATCTGAAAACTTGGGTTTTTGTTTGCGTGACTTTAGTGTCTTTACT
CGAGACGATGGGTGACTGTGTTTCGCCTTTGGGATCTCTTAATGCGTTACGGATGGTTTGCTTTATGGGGCAATGTCT
TCACGGTCAATGGGGTTCGCGGTTGTACAATAGCTATCGAGGATATCTCGAAGCAATGGTTTCTGCACATTATGCTATT
AT

FIG. 2 continued

> SEQ ID NO: 5564 114370 176031_300524_1b
CCCCCCCCCGAACCGCAAATCTTGCGATCCACACACAGCAAAAGAACCACCACCGTTTCCCCTTCCCGAGAAGAAGAGA
GCAGCATCCATGGCGCCCAAGGCGGAGAAGAAGCCGGCCGCGAAGAAGCCCGCGGAGGAGGAGCCCGCGGGGGAGAAGG
CCGAGAAGGCCCCGGCGGGGAAGAAGCCCAAGGCGGAGAAGCGTCTCCCCGCCGGCAAGGGCGAGAAGGGCAGCGGCGA
GGGGAAGAAGG

> SEQ ID NO: 5565 114370 175172_300530_1b
CCCCGACAATCCAATCTCCAAATCAGAAACACACTCGCCTCGCCTCCTTTCGCTCGTTTCGTCGAACACCACCACCACC
ACCACCACCGATCTCGATGGCGCCCAAGGCCGAGAAAAAGCCCGCGGAGAAGAAGCCGGCGGAGGAGAAGGCCGGCGAG
AAGGCGGAGAAGGCGCCCGCGGCCGGGAAGAAGCCCAAGGCCGAGAAGCGGCTGCCGGCGTCCAAGGGGGAGAAGGGCG
GCGAGGGCAAGAAGGAGCGCGGCAGGAAGAAGGCCAAGAAGAGCGTCGAGACCTACAAGATATACATCTTCAAGGTGCT
CAAGCAGGTGCACCCGGACATCGGGATCTCCTCCAAGGCCATGTCCATCATGAACTCCTTCATCAACGACATCTTCGAG
AAGCTCGCCGGCGAGGCCGCCAAGCTCGCCAGGTACAACAAGAAGCCCACCATCACCTCCCGCGAGATCCAGACCTCCG
TCCGCCTCGTCCTCCCCGGCGAGCTCGCCAAGCACGCCGTCTCCGAGGGCACCAAGGCCGTCACCAAGTTCACCTCCGC
TTAGGCTTTTCCTCTGTCCTCCTGTCTCGTCTTGTCGCTGCTAATGCTAGTTGTAGTTGTGGTAGGTTGCAGATTTGGA
TAGTTTGGTACTGTGGTGTATTTACCCTGGCTATTGACTATCTTGGTGGATAAGGAACACTATCATTGTTATTATGGAG
AAATAGTAGTTATGCTACTTTAAT

> SEQ ID NO: 5566 114370 27937_300088_1b
AAATTAAGTAGATTTCATAGCCGTGCCATAAATTAAAACCCTAATTCCCATATTACATAACCCTCAAAGATACCCAAAA
GCATAAACCCTATTTCACATTCCAACTACTACTACTACTTCTCCTCCATTACAAAACCACATTCCAAATCTAAGAACTC
GTAAACTTCGTAACCGCCTTAGTCCCTTCAGAAACAGCATGTTTCGCCAACTCTCCAGGCAACACAAGTCTCACCGCAG
TCTGAATCTCCCTAGAAGTAATCGTCGGCTTCTTGTTGTACCTCGCAAGCTTCGAAGACTCACCAGCAAGTTTCTCAAA
GATATCATTGATGAAACTGTTCATGATTCCCATGGCTTTGCTGGAGATTCCGATATCTGGATGAACTTGCTTCAACACC
TTGAAGATGTAGATCTTGTATGTCTCAACGTTCTTCTTTGATCTCTTCTTCTTCTTGTCTCCGGCGCCGGCTGGTTCCT
TCGGGAGTTTCTTTCCGGCTTTTGGTTTCTTCTCTGCCGCTGCTGCTGGTTCGGCTGCCGGAGTTTTCTCTGCCGGTTT
CTTCTCCGCTGGTTTCTTATCTGCCTTCGCCATTTTCAAACTTTTCTAGGGAGTGAGTTTTTTTTGCTGCGGACGCGTG
GG

> SEQ ID NO: 5567 114370 50580_300167_1b
TGCTTTTTCTTGTTCACCCAGAAAAGTAAAACAAAAGTCAAAACAATGGCGCCGAGAGCAGAGAAGAAGCCCGCGGAGA
AGAAACCAGCCGTCGAGAAACCAGTAGAGGAGAAATCAAAAGCCGAGAAAGCTCCGGCGGAGAAGAAACCAAAAGCCGG
CAAGAAACTCCCGAAGGAAGCCGGGGCCGGCGGCGATTAGAAGAAGAAGATGAAGAAGAAGAGTGTGGAAACTTACAAG
ATCTACATCTTCAAGGTTCTGAAACAAGTTCATCCAGATATTGGTATTTCAAGCAAGGCTATGGGTATTATGAACAGTT
TCATCAACGACATCTTCGAGAAATTGGCATCGGAATCTTCAAAGCTC

> SEQ ID NO: 5568 114370 48940_300168_1b
GGCCATTACGGCCGGGAAGAAGCTCCCAAAGGAAGGCGGAGCAGCAGGAGCTGACAAGAAGAAAAAGAGGGGAAAGAAG
AGCGTTGAAACCTACAAGATTTACATCTTCAAAGTGCTGAAGCAAGTGCACCCTGATATTGGTATTTCTAGTATAATAA
GAAGCCTACTATTACTTCAAGGGAAATTCAGACTGCTGTGAGGCTTGTGTTGCCTGGGGAGTTAGCTAAACATGCTGTT
TCTGAAGGGACTAAGGCTGTTACAAAGTTTACTAGCTCTTAGGTTCTCATTTTGGGAATTTTGGATGATTGTAAAGCTT
CTTTTAATGATGTGTCTGAT

> SEQ ID NO: 5569 114370 236353_301249_1b
GGAAAGTAAGTGGTAGTAGAAGATAGGAGATAGCTCTAGAAGGGGAGAAAAGCTCTCGTCTGTTTTGATCGATCGATCC
ATTTCCATCCATCTTTTCGACCTCGACCTCGACCTCTCACAATGGCCAAGGCGGCGGAGAAGAAGCCCGTAGCTGAGAA
GGTGCCGGCGGAGAAGAAGGCGGCGGAGAAGAAGCCGCGGGCGGAGAAGAAGACGCCGGCCAAGGACCCGTCGGCGGCG
ACGGACAAGAAGAAGCGCAAGATGAAGAAGAGCGTGGAGACGTACAAGATGTACATCTACAAGGTGCTCAAGCAGGTGC
ACCCGGAGACGGGCATCTCGTCCAAGGCCATGGGCATCATGAACAGCTTCATCAACGACATCTTTGAGAAGCTGGCGCA
GGAGGCGTCCAGGTTGGCCCGCTACAACAAGAAGCCCACCATCACGTCGCGGGAGATCCAGACGGCCGTCCGCCTCATC
CTCCCCGGGGAGCTCGCCAAGCACGCCGTGTCCGAGGGCACCAAGGCCGTGACCAAGTTCACCAGCTCTTGAGCTCTCT
CTCTCTTTTTCCGTTTGGAATTGGAATAGTTATTATAGCCTCTTTCTTTCTGTAACTCGCTTGTATACACGCATGCATT
TCGCTTTTGAAATCTACTTCCATCCA

> SEQ ID NO: 5570 114370 252704_301604_1b
TGGTTTATCCATCTTCGTCGGCTTTCTTCCTTGCACCTGCAGCTATGGCTCCTAAAGCTCCCGAGGCCGAGAAGACGT
CTGCCTCCAAGGCCGAGAAGAAGCCCGCCGAGAAGAAGCCCAAGGCCGAGAGCAAGCCGAAGCCTGCCGGGAAGAAGCC
TAAAGATTCAACCCCTAAGGTTAAGGACCCCTCCAAGAAGAAGCATAAGAAGAAGAGTACAGACGTACAAGATCTAC

FIG. 2 continued

ATTTTCAAGGTCTTGAAGCAGGTCCATCCCGACACTGGCATCTCCTCCAAGGCCATGGGCATCATGAACTCCTTCATCA
ATGATATCTTTGAGAAGATTGCGCAGGAGTCTGCTCGCCTTGCTCGCTACAACAAGAAGCCAACAATCACATCCCGGGA
GATTCAGACAGCAGTGAGACTCATCCTGCCTGGAGAATTGGCCAAACACGCAGTCTCTGAGGGTACCAAGGCTGTTACC
AAATTCACTAGTGCATAGGGTTTGGGTTTCCTTTTCCTTTCCTTCCCCTTTTTCTG

> SEQ ID NO: 5571 114370 129372_300405_1b
CGAACTCCACGCGAAGGGAAAAGGTCTTCCTCCTCCTCACGAATCCCGCCTCTCTCTCTCTCTCTCTCTCTCTCTCTCT
CTCTCTCTCTCCATTTGAGCCGATCCCTCGAGAGGCAGCTCCGATGGCGCCCAAGGCAGAGAAGAAGCCGGCGGAGAAG
AAGCCCGCAGCCGGCGAGGAGAAGTCGGCGGAGAAGGCGCCGGCGGGGAAGAAGCCCAAGGCGGAGAAGCGGCTGCCGG
CGTCGAAGGCGTCGTCCAAGGAGGGCGGCGCCGGCGACAAGAAGGGGAGGAAGAAGGCGAAGAAGAGCGTCGAGACCTA
CAAGATCTACATCTTCAAGGTCCTGAAGCAGGTGCACCCGGACATCGGAATCTCCTCCAAGGCCATGTCGATCATGAAC
TCCTTCATCAACGACATCTTCGAGAAGCTCGCGCAGGAGGCCGCCCGCCTCGCCCGCTACAACAAGAAGCCCACCATCA
CCTCCCGCGAGATCCAGACCTCCGTCCGCCTCGTCCTCCCCGGCGAGCTCGCCAAGCACGCCGTCTCCGAGGGCACCAA
GGCGGTCACCAAGTTCACCAGCAACTAGGCCTGTCTCTCTAGGGTTTCGATGCCATGCTTCTCTCCTTCCCTTTCCCCT
CGTGTGCAGTGTGCTAGGTGGCAGTAGTTGCAAACTTGTGCCTGCTTTGTAAATTGTGCTTGATCATAATGGGCAGCTT
GGATTTGAAGT

> SEQ ID NO: 5572 114370 128870_300478_1b
AAAATCTTTAAATCTTCTTTTTCTCCATTACTAAACCCGGATTTCGGTTGTAAAATTCAGTTTCAATGGCACCAAAATC
AGAGAAAAAGCCAGCGGAGAAGAAACCAGTAGCAGCGGAGGAGAAAAAGGCCGAAAAAGCACCAGCAGAGAAGAAACCA
AAGGCAGGAAAGAAGCTTCCAGAAGCAGGCGCATCTGGTGCTGACAAAAAGAAGAAGAGATTAAAGAAGAGTGTTGAGA
CTTACAAGATCTACATTTTCAAGGTGCTGAAACAAGTTCACCCTGATATTGGGATTTCAAGTAAGGCAATGGGGATAAT
GAATAGTTTTATTAATGACATATTTGAGAAACTTGCTCAGGAATCTTCTAGATTGGCTAGGTATAATAAGAAGCCGACA
ATTACATCTAGGGAAATTCAGACTGCGGTTAGGCTTGTTTTGCCTGGTGAGTTGGCTAAACATGCTGTTTCTGAAGGTA
CTAAGGCTGTCACCAAGTTTACTAGTTCTTAGATTTGGGATTTGGGCGTCTTTAGGGAATGTAAAGGTTGGGTACTGTT
GTGGGGGTTGAAAAATGTTAGGTTGTTAAGTTTTTGCTTGTTCAATGATGTATTGAATATGAATATGAATGAACCGTTT
TGATGAAATTTCTG

> SEQ ID NO: 5573 114370 126668_300465_1b
GCGATTCAAGACCTCACATTTCTCCTACTCTCTCTCATATTTCATTTCTCTCTCTAGTGTTTCCACAATGGCACCAAAA
GCCGAGAAGAAACCCGCCGAGAAGAAGCCAGCAGCTGAGAAGGCCACCAGTAGCAGCGACGGTGCAGCGGAGAAGAAGCCAA
AGGCTGGGAAGAAGCTTCCCAAGGACGGTGCCGGAGCAGCTGCAGGAGACAAGAAGAAGAAGAGGTTAAAGAAGTCTGT
TGAAACTTACAAGATCTACATCTTCAAGGTGTTGAAACAGGTTCATCCTGATATTGGTATCTCTAGTAAGGCTATGGGG
ATCATGAACAGCTTTATTAATGACATTTTCGAGAAGCTGGCTCAGGAATCTTCTAGATTGGCCCGTTACAACAAGAAGC
CTACTATCACTTCTCGGGAGATTCAGACTGCTGTGAGGCTTGTGCTTCCTGGTGAATTGGCTAAGCATGCTGTTTCTGA
GGGTACCAAGGCTGTTACTAAATTTACTAGCTCTTAATCAATTTTAGAGTTTGTGTTTTGATTAGGGTTTGTAGATGTA
AAGAATTGTCCAATTAGGGTTGCATTTGACATTTGTGGCATGTAATGGACATCTATATTATGAATGAAGAGTTTTCTGT
TTTCTTTGTTAAATTTGCTTGGTTATG

> SEQ ID NO: 5574 114370 125322_300630_1b
TCCTCACGATCACTCCAAACCTTCTCTTAACCTAAAATCTCCATTTTTCTCTCCTCAAATGGCACCAAAGGCTGAGAAA
AAACCCGCCGAGAAGAAGCCGGCCGCTGAGAAAACCCCGGTCGCCGAAAAAGCACCAGCAGAGAAGAAGCCCAAGGCCG
GAAAGAAGCTCCCAAAGGACGCAGGTGCTGCCGGAGACAAGAAGAAGAAGAGGGCAAAGAAGTCAGTTGAGACCTACAA
GATCTACATCTTCAAGGTTCTGAAGCAGGTTCACCCGATATCGGTATTTCAAGTAAAGCCATGGGTATCATGAACAGT
TTCATTAACGATATCTTTGAGAAGCTTGCTCAGGAATCTTCTAGACTAGCTAGGTACAACAAGAAGCCAACTATCACTT
CTCGGGAGATTCAGACTGCTGTGAGACTTGTACTTCCTGGTGAATTGGCTAAGCATGCTGTCTCTGAAGGAACTAAGGC
TGTTACCAAATTCACTAGCTCTTGAAGAATTTTAGGGTTTCAATGTTTAATTTTACTATATTTAAGGTTTGTATTAAGT
GTAAAAATAGTTGCTTTTAAATAATTATTGTTTAGCTTCCTTTGATTTGTAATAGCTAATTATCTATGAAATTCACCAG
CTTTTT

> SEQ ID NO: 5575 114370 121868_300003_1b
CCCCCTGATCACAAATCAAGCTCACACACCCAGCGAAATCCAAGAAGAGAGAAGCAGCCATCCATGGCGCCCAAGGCGG
AGAAGAAGCCGGCGGCGAAGAAGCCCGCGGAGGAGGAGCCCGCGGCGGAGAAGGCCCCGGCGGCGGGGAAAAAGCCCAA
GGCGGAGAAGCGGCTCCCCGCGGGGAAGGGCGAAGGGCGGCGCCGGCGAGGGGAAGAAGCCGGGGAAGAAGAAGGGG
AAGAAGAGCGTGGAGACCTACAAGATCTACATCTTCAAGGTTCTCAAGCAGGTCCACCCGGACATCGGCATCTCCTCCA
AGGCCATGTCCATCATGAACTCCTTCATCAACGACATCTTCGAGAAGCTCGCCGCCGAGGCCGCCAAGCTCGCCCGCTA
CAACAAGAAGCCCACCATCACCTCCCGCGAGATCCAGACCTCCGTCCGCCTCGTCCTCCCCGGCGAGCTCGCCAAGCAC
GCCGTCTCCGAGGGCACCAAGGCCGTCACCAAGTTCACCTCCGCTTAGGCTTTTCCTCTGTCCTCCTGTCTCGTCTTGT

FIG. 2 continued

CGCTGCTAATGCTAGTTGTAGTTGTGGTAGTTTGCAGATTTGGATAGTTTGGTACTGTGGTGTATTTACCCTGGCTATT
GACTATCTTGGTGGATAAGGAACACTATCATTGTTATTATGGAGAAATAGTAGTTATGCTACTTTAATC

> SEQ ID NO: 5576 114370 119322_300025_1b
ATTATACTTCTCTATATCAAATCTCTAAATTTTACTCTGTGTCTTTAAAATTTTCAATGGCTCCTAAGGCAGAGAAGAA
GCCCACCGAGAAGAAGCCGGCTGAGGAGAAAGCTCCGGCGGAGAAGAAGCCAAAGGCCGGGAAGAAGCTTCCGGCGAAG
GATGGCGCCAGTGGTGCAGACAAGAAGAAAAAGAAGGCTAAAAAGAGTGTTGAAACCTACAAGATCTATATCTTTAAGG
TGCTCAAGCAAGTTCATCCAGACATTGGGATCTCGAGCAAGGCTATGGGGATTATGAACAGTTTTATCAATGATATTTT
TGAGAAATTGGCTCAGGAATCTTCTAGACTTGCTAGGTATAATAAGAAGCCGACTATTACTTCCAGGGAAATTCAGACC
GCGGTCAGATTGGTGCTGCCCGGTGAATTGGCTAAGCATGCTGTTTCTGAAGGAACCAAGGCTGTGACTAAGTTTACCA
GTTCTTAATTTTTTAGCTTATGTTGGGTAATTCGAAAATTAGGGTTATTTTGGGAAATTAGAGTAAGGGTTATCTG
GTGAAATTCCGAAAGCTAGTTTCTTTCTTTCTTTTGTGTTCTGATTTTCTATTGTAACTAAACTGTTGTTGCTAAGTGA
ATGAACAAATCTACTTTTGCG

> SEQ ID NO: 5577 114370 1123657_301914_1b
TAACTTGCCCTGCCCCGTTGTGTCATCTCTATTTTTCTGCATCCGACGGAATTGTCCTCGATTAGCTGTAGTAGCTATG
GCGCCCAAAGCTCCCGCAGCGGCTGAGCCCGAGAAGGCGGCCCCGTCGAAGGCCGAGAAGAAGCCCGCCGAGAAGAAGC
CCAAGATCGAGAAGAAGCCAAAGCCTGCAGGGAAGAAGCCCAAGGATTCCACCCCTAAAGACAAGGACCCGTCAAAGAA
GAAGCATAAGAAGAAGAAGAGCACTGAGACCTACAAGATCTACATCTTCAAGGTCCTGAAGCAGGTCCATCCTGACACT
GGCATCTCCTCCAAGGCCATGGGCATCATGAACTCTTTCATCAATGACATCTTTGAGAAGATTGCGCAGGAGTCTGCGC
GCCTTGCCCGTTACAACAAGAAGCCTACAATTACATCCCGGGAAATTCAAACAGCAGTGAGGTTAATCCTGCCTGGAGA
ATTGGCCAAACATGCTGTCTCTGAGGGCACCAAGGCTGTCACCAAATTCACTAGTGCCTAGGGTACCCCCCTGCCTTCT
GCTTACATGCGATGTTTTGTCCCTTGACACTCTGCCTTTTTCTGTAAAGTTTTTTTCCCCCCTGCTCTTTGACTCTTT
ATTAGGGTTACTACTTGGAATTCTGTTAACTTGTTTAAACTTTAGCAATT

> SEQ ID NO: 5578 114370 111519_300039_1b
AATTCTTCAATTCACTATCAATAGATTCGCTTTCTCTCTATCTTTTCACTACAGAAAGTTCAGTTCTCGATTCCAAAGT
TTCAATGGCACCAAAAGCAGAGAAAAAGCCAGCGGAGAAGAAACCAGTAGCAACAGAGGAGAAAAAGGCCGAAAAAGCA
CCAGCAGAGAAGAAGCCAAAGGCCGGAAAGAAGCTACCAAAGGAAGCAGGCGCATCTGGTGCTGATAAGAAGAAGAAGA
GAGCAAAGAAGAGTGTTGAAACTTACAAGATCTACATTTTCAAGGTGTTGAAACAAGTTCACCCTGATATTGGAATTTC
AAGTAAGGCTATGGGAATAATGAACAGTTTCATTAATGATATATTTGAGAAACTTGCCCAGGAATCTTCTAGATTGGCT
AGGTATAATAAGAAGCCTACTATTACTTCTAGGGAAATTCAGACTGCTGTTAGACTTGTTTTGCCTGGGGAATTGGCTA
AACATGCTGTTTCTGAAGGGACTAAGGCTGTAACCAAATTTACTAGTTCTTAGATTTTGGATTTGGTGGATTTTGGGGA
ATGTAAAGGTTGGGTACTGTTGTTGGGGCTGAAAAATGTTAGGTTTTGAAGTTTTTGCTTGTTCAATGATGTATTGTTG
AATATGAATATGAATATGGATGAATTGTTTTTG

> SEQ ID NO: 5579 114370 156430_301366_1b
TTCTCAATACTCAAGTATCTAATCCACTTTCTGTGAAATCTCACAACAATGGCACCAAAGGCAGAGAAAAAGCCAGCTG
AGAAAAAACCAGTAGCAACAGAAGAGAAAAAGGCAGAGAAAGCCCCAGCAGAGAAGAAGGCCAAAGCCGGGAAGAAGCT
CCCAAAGGAAGGCGGAGCAGCAGGAGCTGACAAGAAGAAAAAGAGGGGAAAGAAGAGCGTTGAAACCTACAAGATTTAC
ATCTTCAAAGTGCTGAAGCAAGTGCACCCTGATATTGGTATTTCTAGTAAGGCAATGGGGATAATGAACAGTTTTATTA
ACGATATTTTTGAGAAACTTGCTCAAGAATCATCTAAATTGGCTAGGTATAATAAGAAGCCTACTATTACTTCAAGGGA
AATTCAGACTGCTGTGAGGCTTGTGTTGCCTGGGGAGTTAGCTAAACATGCTGTTTCTGAAGGGACTAAGGCTGTTACA
AAGTTTACTAGCTCTTAGGTTCTCATTTTGGGAATTTTGGATGATTGTAAAGCTTCTTTTAATGATGTGTCTGATTTGT
GTTTGTCCTTGTACGAATGAAGTAATGCAAATGAATGAATGGTTTTGTCCAACT

> SEQ ID NO: 5580 114370 156101_301363_1b
AAAAAGCAGCATTCAAATTTCCTTCACATTTTCTCTTTGTAAACACATTTTGTTTCAATGGCACCAAAGGCAGAGAAG
AAGCCAGCAGAAAGAAGCCGGTGGAGGAGAAGAAAACCACCGTCGCCGAGAAAACTCCGGCGGAGAAGAAGCCAAAGG
CCGGGAAGAAACTCCCAAAGGACGGCGGTGCCGCTGCCGGAGATAAGAAGAAGAAGAAGGCCAAGAAGAGCGTTGAGAC
TTACAAGATCTACATTTTCAAGGTGCTCAAGCAGGTTCATCCTGACATTGGGATTTCAAGCAAGGCCATGGGTATCATG
AACAGTTTCATTAACGATATCTTTGAGAAGTTGGCCCAGGAATTCTCTAGATTGGCCCGTTACAACAAGAAGCCCACAA
TCACTTCTCGGGAGATCCAGACTGCTGTGAGACTTGTACTTCCTGGAGAATTGGCTAAGCATGCTGTTTCTGAGGGTAC
TAAGGCTGTTACCAAGTTCACTAGCTCTTGAAATTCGTCCTGATGGGTTGTTGTGAGAGTAGATTATGAGTTTATGGTT
ATTTTTGCCAAGGATTAAGGTTCAGTTAAATCGGGTGGTACTTTACTGTATTTCTTTTGTTTTTGCGGGGTTCCCATG
GATCTTCTCGATCCAGTTTGTAGTTCATATTTGGAATACAATCCTATTAAAGTTATTTCAATTTCAATTTTTCTTTTGG
TGC

FIG. 2 continued

> SEQ ID NO: 5581 114380 110821_300047_1b
TTTACCCCATCTCTAAATCTATATTTGTTTGACAAAGATGATAGAAAGGAATCTTGGAAAATGTTTGTTGCTCCTTCTT
TGTTTAAACGTTGTCTCAAATATAGTGGCTGCTGGGGCTCCACCAACTTGTCCTGCTGATATTGGTAGTGATTGTGGAA
GTGATTCGGGTGAATGGGAAGGGGAGTTCTTCCCTGGAATTCCAAAAATTAAGTATGAGGGTCCATCTAGTAAGAATCC
ACTTTCCTTCAAATGGTACAATGCTGAAGAGGAAATTCTTGGCAAAAAGATGAAGGATTGGATGCGATTTAGTGTTGCG
TTCTGGCATACGTTCCGTGGCACAGGAGCTGATCCATTTGGTGCTCCTACAAAGTTGTGGCCGTGGGAAGATGGTACCA
ATTCCCTGGCTATGGCCAAGAGAAGATTGAGAGCAAACTTTGAGTTCCTGGAGAAACTTGGAGTTGATAGATGGTGTTT
CCATGATCGGGACATTGCTCCGGAGGGCAAAACCCTTGAGGAAACAAATGCAAACTTGGACGAAGTGGTGGCTCTTGCC
AAAGAGCTTCAGGGAAATAAAATTCATCTTTTGTGGGGTACCGCTCAGTTGTTCCTCCAACCTCGGTACATGCATGGTG
CTGCCACTAGCCCTGAATTAGGTGTATATGCATATGCTGCCGCTCAGGTCAAGAAAGCTCTGGAGGTTACACATTATCT
TGGGGGAGAAAATTATGTGTTTTGGGGTGGTCGAGAAGGTTACCAAAGCCTCCTAAACACAGATATGGAAAGAGAGCTT
GACCATATGGCAAGATTCATGGAAGTTGCTGTCGCTTACAAAAAGAAGATTGGCTTCAATGGAACATTACTTATTGAAC
CAAAGCCTCAGGAGCCAACAAAACACCAGTATGATTGGGATGCTGCAACATCTGCTAATTTCTTGCGCAAATATGGACT
TATAGGAGAGTTCAAATTAAACATCGAGTGCAACCATGCTACTTTGGCTGGTCACAGCTGTCATCATGAGCTTGAAACA
GCAAGAATTAATGGTTTGCTTGGAAACATTGATGCAAATACTGGCGATCCNCAAGTCGGTTGGGACACAGATCAGTTTT
TGATGGATGTTGCTGAAGCAACACTGGTGATGC

> SEQ ID NO: 5582 114380 238912_301299_1b
TTAGAGGGGCATGATGATGGGAGGGAGAAGCTGCATAGGGATCGTTGTAGGGCTTTTGTGTCTGGGCATTCCATTTGCT
ACACAGGAAAAGCTGGTTGCGGACCAAACATGTGGTTTCTCCGGCTCCGATGCCGAGTTCTTCCCAACATTTCCAACA
TAGAGTACGAGGGGCCGTCGAGCCGAAACCCATTGGCTTTCAAGTGGTACAATCCCGAAGAAGTCGTCTATGCAAACA
GATGAAGGACTGGCTGAGGTTCAGTGTTGCGTTCTGGCATACTTTCCGAGGGGATGGAAGTGATCCTTTTGGATCTCCG
ACCAAGCAGTGGCCTTGGGACGATGGGACAAACTCGCTGGACATGGCCTTCACGAGAATGCGGGCAACTTTGAGTTCC
TCAAGAAGCTTGGCGTGAATCGCTGGTGCTTTCACGATAGGGATATAGCACCCGAAGGCCGGACTCTCGAGGAATCGAA
TGCCAACCTGGATAAAGTTATTGCTCTGGCTAAGCAACTTCAGGAAGGCACAGACATCAGGCCTCTCTGGGGGACTGCG
CAGCTCTTCAAGCACCCGAGATACATGCATGGAGCTGCGACAAGTCCCGACGCTCGAATCTATGCCTATGCCGCTGCTC
AAGTGAAAAAGGCTATGGAGGTGACCGAAGAGCTCGGGGGAGAAAATTACGTTTTCTGGGGTGGCCGGGAAGGATATCA
GTCTCTTTTGAATACTGATCTCGATAAGGAGCTGAATCACACGGCACAGTTTCTAAAATCCGCTGCGGAGTGGAAAAAG
AAGATTGGTTTCGACGGAGTTCTCCTCATTGAACCAAAGCCCCAGGAACCAACAAAGCACCAATATGATTGGGATGCTG
CAACTACAATTGGCTTCCTGCTGAAATACGGTCTGAAAGACGATTTCAAGCTTAACATTGAATGCAATCACGCAACACT
CTCTGGACACAGCTGCTATCACGAGCTGGAAGTAGCTCGAATCAACGGGGTCTTGGGAAACATCGATGCGAACACTGGC
GATGCTCAGACAGGCTGGGATACCGACCAGTTCCTCATGGATATTGCGGAAACCACACAAATCAT

> SEQ ID NO: 5583 114380 46143_300176_1b
CCCACGCGTCCGTTTCTCTCTTGCGTTTTCGATTTTATTACAAGAACTTCGTTTTGGGCTTCATCCATCGTTCAAGGTT
CGTTGAAAACTATGAAGAAAGTTGAGTTTTTTATGCTCCTTCTCTGCTTCATCGCAGCGTCATCTCTAGTGTCTGCTGA
TCCACCAACATGTCCTGCTGATTTGGGAGGCAAGTGTAGTGATTCTGATGACTGGCAAGGTGATTTCTTCCCTGAAATC
CCCAAGATTAAGTATGAGGGACCTTCGAGTAAGAACCCACTTGCTTACAGGTGGTATAACGCTGAAGAAGAGATTCTTG
GGAAGAAAATGAAGGATTGGTTTAGATTCAGTGTTGCGTTTTGGCATACTT

> SEQ ID NO: 5584 114404 271487_200034_1b
GACACACAATTCTTTTGTGCTCCAAAGTATCAGAAGATGCAGCCATTCAGTGCAGAAGTTCACCAACGTATTGCTAGAA
TTTCTGCTCATCTCAACCCCCCAAATCTCCAGATGGGAGAGGGGTCTGTGTTGGAAAGATCAAGCTGCAGAGCAAAAGG
TGGGGCTCCTGGATTTAAAGTTGCTATATTGGGTGCTGCTGGAGGTATTGGCCAACCACTTGCAATGTTGATGAAGATG
AACCCTTTAGTCTCAGTTCTTCATCTCTATGATGTTGTTAATGCTCCTGGTGTTACTGCTGATGTTAGCCACATGGACA
CGGGTGCTGTTGTGAGGGGTTTTCTTGGGCAAAGTGAGCTTGAGGCTGCACTTACAGGAATGGACCTTGTGATCATACC
TGCTGGTATTCCAAGAAAACCAGGAATGACAAGAGATGATCTTTTTAAGATTAATGCTGGGATTGTGAGGACCCTCTGT
GAAGGAATTGCAAAGTGTTGTCCTAATGCTATTGTTAATTTGATTAGTAATCCGGTGAATTCCACAGTTCCTATTGCAG
CTGAAGTTTTCAAGAAAGCAGGTATTTATGATCCAAAGAAGCTTCTTGGAGTTACCTCACTAGATGTTGTGAGAGCCAA
TACTTTTGTGGCAGAAGTTTTGGGACTAGATCCTAGGGAAGTAGATGTTCCTGTTGTTGGAGGTCACGCCGGGGTGACA
ATTTTGCCTCTTCTCTCACAGGTCAAGCCTCCTTGCTCCTTCACACAGGAGGAAACAGAATATTTGACTAAGCGCATTC
AAGATGGAGGGACAGAAGTTGTTGAGGCCAAAAAAGGAGCTGGATCTGCAACTCTATCAATGGCATATGCAGCTGTAA
AATTTGCAGATGCTTGCCTCAAGGGCTTAA

> SEQ ID NO: 5585 114404 246565_301614_1b
AGTGTTGTTCTTGGAGAAGAATGGCCGCGGCGGCAGCAGCAGCAGCGACGAGCTTCGTCCAGGCGCCATCCAGCGCCAA
GCAATGCGGCGGATCTCCAGCGACCTCCACCAGGCCGGCGTTCCAGAGCTTCGTCGGCATGAAATCCGGCGGAGAGTGC
CGCCAGGCCGCATTCTTCCGGGGCGATCTGACGCTGCGGGATGGCAAGCCCCTTGCTAGAGCTGCGAGGAACGGCGATG

FIG. 2 continued

```
TTCGTCCGCGGGCTGCGGCGAGCTACAAGGCGGCTGTGCTTGGAGCTGCCGGGGGGATTGGGCAGCCGCTGTCGCTGCT
GCTCAAGATGTCGCCGCTGCTCTCGCACCTAAATCTCTACGATATTGCCAACGTCAAGGGTGTGGCTGCCGATCTGAGT
CACTGTAACACCCCATCACTGGTGACACCTTATACCGGAGCTGAGGAGCTTGCCGAGTCACTTAAAGGCGTCGATCTTA
TTATCATTCCTGCTGGAGTTCCTCGGAAGCCAGGAATGACAAGGGATGATCTTTTCAACATCAATGCCGGTATCGTCAA
GACACTTGTCGAGGCAGCAGCGGATTATGCACCAAAAGCATGGATTAACATCATCAGCAATCCCGTCAACTCCACCGTG
CCAATTGCGGCCGAGGTCCTCAAGAA

> SEQ ID NO: 5586 114404 125431_300631_1b
AATTACTTACCTTGATTTCTACTACCTCTCTTTCTCATCATAGTTCAAACACACAAATTCTCAAGCCCAATATGCAGAA
CAGTGCAGAGACCTATCGACGAATCGCCACCATCTCAGCTCACCTTAACCCCTCTCCTTCTTCTCATCAGATGGAGGGA
GGTGTGGGTTTGAGCCGAGCTAATTGCAGGGCGAAAGGGGGTTCTCCGGGATTCAAAGTCGCAATCTTGGGTGCTGCAG
GAGGTATTGGTCAGCCACTTGCTATGCTTATGAAAACGAATCCACTGGTTTCAGTTCTGCATCTTTATGATGTTGCCAA
TACTCCTGGTGTAACTGCTGACATTAGCCACATGGACACTGGTGCCGTGGTACGTGGTTTTCTAGGGCCTCAACAATTG
GAAGATGCTCTCACTGGCACGGACCTTGTAATAATCCCTGCTGGTGTTCCTAGAAAACCAGGCATGACAAGAGATGATC
TTTTCAACATTAATGCAGGAATTGTGAGGACTTTATGTGAAGGAATTGCCAAGTGCTGTCCTAAGGCCATTGTTAACAT
AATTAGTAATCCTGTTAACTCTACAGTACCAATTGCTGCAGAGGTTTTCAAGAAGGCTGGAACCTTTGATCCGAGGAGA
CTGTTGGGCGTGACAATGCTTGATATTGTCAGAGCCAGTACATTTGTGGCTGAAGTTTTGGGGCTTGATCCTAGGGAAG
TGGATGTTCCAGTTGTGGGGGGTCATGCTGGCGTTACAATTCTACCTCTTCTTTCCCAGGTTAAACCTCCTTGTTCTTT
TACGCCAGAGGAAACTGAATATTTAACATCTCGTATACAAAATGGGGGAACTGAAGTTGTTGAGGCAAAAGCTGGTGCT
GGTTCGGCAACTCTCTCTATGGCATATGCTGCGGTTAAATTTGCCGATGCATGTTTGCATGGATTGAGAGGAGATGCTG
GCATTGTAGAATGTGCCTTTGTG

> SEQ ID NO: 5587 114404 157311_301737_1b
AACTCCTCGAAACTCACGAATCTATCGCCAATAAATGCTCTCCTCATCTTCCCCTCTTTGAACATTTTCATTTTCGACT
CACATTTTCTCCGCCGTAGCATTTTCCTTTTCCTTTTCTTTGTTCATCACAAACCAACCAATTATTCAACCATGTTGAG
ATCTATTGCCCGCAGAACCTCGACCACCGGTGCATACCTCACGCGCCGGGGATTCGCGTCGGAGTCCGCTCCTGACCGG
AAAGTAGCAATTTTAGGGGCAGCTGGTGGGATCGGACAGCCTCTATCACTTCTTATGAAGTTGAATCCTTTAGTATCAC
AACTCTCACTTTACGATATTGCCGGTACCCCTGGTGTTGCCGCTGATGTCAGCCACATCAACACCAGGTCTCAGGTTTC
TGGGTTTGCAGGAGACGAACAGCTAGGACAGGCTTTGGAGGGAGCTGATGTTGTCATCATTCCTGCTGGTGTGCCACGA
AAGCCTGGTATGACCCGTGATGATCTGTTCAACATTAATGCTGGTATTGTTAAATCTCTTTGCACAGCCATCGCAAAGT
ATTGCCCTCATGCGCTTGTCAATATGATCAGCAACCCTGTTAACTCCACTGTCCCAATTGCCGCTGAGGTTTTCAAGAA
GGCTGGAACCTATGATGAAAAGAGACTCTTTGGAGTGACCACACTTGATGTTGTTAGGGCAAAGACTTTCTATGCAGGA
AAAGCTAAAGTTAATGTTGCTGACGTCATTGTCCCCGTTGTTGGTGGTCATGCTGGCATAACCATCCTCCCACTATTTT
CCCAAGCCACCCCAAAGGCAAATTTGGGAGATGAAGAAATTGAGGCACTCACCAAGCGAACCCAAGATGGTGGCACTGA
AGTTGTGGAGGCCAAGGCTGGAAAGGGTTCAGCAACCCTCTCCATGGCCTATGCTGGGGCCATCTTTGCCGATGCTTGC
TTGAAGGGGCTGAATGGGGTTCCAGATGTTGTAGAGTGTTCATTTGTGCAGTCAACTGTGACAGACCTGCCTTTCTTTG
CATCCAAGGTGAGACTTGGGAAAAATGGTGTGGAGGAAGTGCT

> SEQ ID NO: 5588 114962 112378_300001_1b
AGAAAATCAACGAAGATTGACTCAGTCTCAGACACCATTACTTGGAGGGGATAATCCTATGCTGCACCCCTCAGATTTT
TCTGGTGTCACTCCTAAGAAAAGGGAAGTTCAAACACCAAACCCACTCTTAACTCCTTCAGCGACTCCTGGAGCCACTG
GCCTTACTCCTAGAATTGGCATGACACCTTCAAGGGATTCTTATGGAATGACCCCCAAAGGAACTCCAATGAGGGATGA
GCTGCACATTAATGAGGAAATGGATATGCACAATAATGCTAAACTTGGGCAACCCAATTCAAAGAAGAATTGCTTTCT
GGTTTGAAAAGCCTTCCTCAGCCTAAGAATGAGTACCAGATAGTCGTCCAACAACCTCATGAAGAAAATGAAGAACCAC
CAGAAGAGAACATTGAAGAAGACATGTCTGATAGGATTGCAAGGGAGAAGGCAGAAGAAGAAGCAAGGCAACAAGCTTT
ACTCCGGAAAAGGTCAAAAGTATTGCAGAGAGAGCTCCCTAGACCTCCCATTGCTTCACTGGAACTAATAAGAAGTTCC
TTATTGAGAGCTGATGAAGATAAGAGCTCCTTTGTTCCTCCTACACTAATTGAGCAGGCTGATGAAATGATT

> SEQ ID NO: 5589 115121 107884_300526_1b
CCTTCTCCCTCTTCTCTCTGTCACGTGCTCGGTCTCGGTCCTTTGAGCTTCTCTCTCTGTCTCTCTCCGATTCTCGCTC
CCTGCTCCGATGCCTCGACGACCTTTCCCTTTCCTTATCTCTATCTCTATCTCTCCTTATCCTTTTCGCCGTCGCCG
CGAGACCTTTTGCTGCTACGACGATCTCTATTGTCGTCCTCGGCGGCGTATTCCTCGCTCCCGTCTCTCTCCCTTCGGC
GATAGGCTTTCTCGCTCTTCTCCTTCTCGGCGCTGCTGTTGTTGTCTTTGCTCTTTGTAGAAGGACCACCGTTGGG
CTCTTCTACAGTCTTCTCCAGATAATCGTACTCATCGAAGTCCATTTGAGGTGACTTTCTCTGCCGGACGGCCGAAGGT
TCGTTGTTCCGCCTGTGAAGAAGTGCTGGTTAGGTTTTGACAGAAACCTTAGATCAAAAAATCAGTGTATTCCTCTCAG
AAAAAAACTAAGCAGCAAAAACATTTCAAGAAAATAGCCTAAGCCATGGCCAACATGATCATGGCTTCCTCCAAAGCCC
TAATCACTTCTTCCATTCCTTCATCACCAAGAACCAAACTTTCCCTGCCGCAAATCCCAATTCCAAAACTACCCATCCC
CAAATTACCCAAATCCCCACTAACCCTTTCCCTCCCATCAAATCTCAAGTCCATTTCAGTCATTCTTGCTAGCTCATTA
```

FIG. 2 continued

```
GCCTTTGCACCTCCTTCACTTGCTGAAGAAATTGAAAAAGCTTCACTCTTTGACTTCAATTTAACTCTCCCTATCATAA
TGGCTGAGTTCCTTTTCCTCATGTTTGCTTTAGACAAACTTTACTTTTCCCCATTAGGGAAATTCATGGATGAAAGAGA
TTCTGCCATTAAAGAGAAATTAAACAGTGTGAAGGACACTTCAGCTGAAGTGAAGCAATTGGAAGATCAAGCAGCAGCA
ATAATGAAAGCTGCAAGAGCTGAGATATCCGCTGCATTGAACAAAATGAAGAAAGAGACACAGTTGGAAGTGGAACAGA
AGATTGCTGAAGGAAGGAAGAAAGTTGAAGTTGAGTTGCAAGAAGCTTTAGCTAGTTTGGACCGGCAAAAGGAAGAGAC
TATTAAGTCTCTTGATTCTCAGATTGCTGCTCTTAGTGATGAGATTGTCAAGAAGGTTCTTCCTGTTAGTAACTAAGTA
ATTAATCTCTTAAAAATTTGTAATTCGATTTTTTATTTGATTAAAGTTGCATAAATGTGACATACTTTGGTACTATCTT
ATATTGTGAATTTATCTCTACTGGTGTACATCTTGTTGGAGCATCTTATTGCTGCTCCTGATTTAATTTTCAGTTGCAT
AATTTAC

> SEQ ID NO: 5590 116435 174865_300527_1b
TTTAGGTCTTCTCCGCCGGCGGTTTCTCCCTCCGCCGCCGAAATGGTCGCCTACAGGTTCCATCAGTACCAGGTGGTGG
GTCGCGCGCTCCCGACCCCCGGCGATGAGCACCCCAAGATCTACCGCATGAAGCTCTGGGCCACCAACGAGGTCCGCGC
CAAGTCCAAGTTCTGGTACTTCCTGAGGAAGCTGAAGAAGGTGAAGAAGAGCAATGGACAGATGCTCGCCATCAACGAG
ATCTTTGAGCGTAACCCTACAACGATCAAGAACTACGGCATCTGGCTGCGTTACCAGAGCAGAACAGGTTACCACAACA
TGTACAAGGAATACCGTGACACTACTCTGAATGGTGCTGTGGAGCAGATGTACACCGAGATGGCCTCTCGTCACCGTGT
GAGGTTCCCCTGCATTCAGATCATCAAGACCGCAACAGTTCACTTCAAGCTCTGCAAGAGGGACAACACTAAGCAGTTC
CACAACTCGAATATCAAGTTCCCGCTCGTGTACCGCAAGGTCAGGCCGCCCACCAGGAAGCTGAAGACCACCTTCAAGG
CATCTAGGCCGAACTTGTTCATGTGATCTACCAGTGTGTACCCATGTTCTGCAATTTAGCCCAAGAATCAAAAGATTTT
GTCTGTGGAAGTTTTGGTGCCCTGCTGGTTAGGCATTTCCAGTTTCATATCCAAATGATGCTTAGGCATTTCCAGTTAC
CCTTCCAAATGATGCTTTGCAAACCCTTGAATTTCCTCGTATTAGTAATCAGCAGACTTCTTGTTACTTCAACCTGGCT
CACTTGGAAGTGTTGATCCCTGATGTGCTATTATTTATCTCTGTAATTTGTGATGGC

> SEQ ID NO: 5591 116435 227876_301031_1b
GTCGCGGACGCGTGGGTCCGCCTCCGGTTTCTCCCTCCGCCGTCGAAATGGTCGCCTACAGGTTCCATCAGTACCAGGT
GGTGGGTCGCGCGCTCCCGACCCCCGGCGATGAGCACCCCAAGATCTACCGCATGAAGCTCTGGGCCACCAACGAGGTC
CGCGCCAAGTCCAAGTTCTGGTACTTCCTGAGGAAGCTGAAGAAGGTGAAGAAGAGCAATGGACAGATGCTCGCCATCA
ACGAGATCTTTGAGCGTAACCCTACAACGATCAAGAACTACGGCATCTGGCTGCGTTACCAGAGCAGAACAGGTTACCA
CAACATGTACAAGGAATACCGTGACACTACTCTGAATGGTGCTGTGGAGCAGATGTACACCGAGATGGCCTCTCGTCAC
CGTGTGAGGTTCCCCTGCATTCAGATCATCAAGACCGCAACAGTTCACTTCAAGCTCTGCAAGAGGGACAACACTAAGC
AGTTCCACAACTCGAATATCAAGTTCCCGCTCGTGTACCGCAAGGTCAGGCCGCCCACCAGGAAGCTGAAGACCACCTT
CAAGGCATCTAGGCCGAACTTGTTCATGTGATCTACCAGTGTGTACCCATGTTCTGCAATTTAGCCCAAGAA

> SEQ ID NO: 5592 116461 160365_200006_1b
GATCAATAAGCCTTTTTTTCCCTCTCAGATCGCGAATCGCTTCAATACCAATTCGAAGAAAAAAAAATGGCATCGACTT
TTAGCGGCGATGAAACGGCACCGTTCTTCGGGTTCCTCGGTGCTGCAGCTGCCTTAGTCTTCTCCTGTATGGGAGCAGC
TTATGGAACAGCGAAAAGTGGGGTAGGGGTAGCATCGATGGGAGTAATGAGGCCGGAATTGGTGATGAAGTCAATTGTG
CCAGTTGTTATGGCTGGAGTTTTGGGTATTTATGGGTTAATTATAGCTGTGATTATTAGTACTGGGATTAATCCTAAAA
CAAAGTCGTATTATTTATTTGATGGATATGCTCACCTTTCATCTGGACTTGCTTGTTGGTCTTGCTGGCCTTTCTGCTGG
TATGGCTATTGGAATCGTTGGCGATGCTGGTGTTAGAGCTAATGCACAGCAGCCAAAGCTTTTTGTTGGGATGATTCTG
ATTCTTATTTTCGCTGAAGCCTTGGCTCTTTACGGCCTTATTGTCGGCATCATCCTCTCTTCCCGCGCTGGTCAATCTA
GAGCAGAGTAGAGAAAGATCTTCTCTTGTTCCATATTTGTGTAGTATCTTTGTGTTCTTCCTCGTTGGACGAGTGAGTT
TGGCTGTTAAATCACATTTTGTTTTGTTTTGGGCTCCAAGGTTATGTATTTGTTTGCGTGGCTGGA

> SEQ ID NO: 5593 116461 201454_300716_1b
AAGAGATCGATCGATCGATCAACCGATCTCGCCGGAGAAGGAAGAGGAGCAAAGATGTCGTCGGTGTTCAGCGGCGATG
AGACGGCGCCCTTCTTCGGCTTCCTCGGCGCCGCCTCCGCCCTCATCTTCTCATGCATGGGTGCGGCGTACGGGACGGC
GAAGAGCGGCGTCGGCGTGGCGTCCATGGGCGTGATGCGCCCGGAGCTCGTGATGAAGTCCATCGTGCCCGTGGTCATG
GCTGGTGTGCTCGGTATCTACGGCCTCATCATCGCCGTCATCATCAGTACAGGGATCAACCCCAAGGCTAAGCCGTACT
ACCTCTTTGACGGCTACGCGCATCTGTCGTCCGGCTCGCCTGTGGCCTCGCCGGTCTCGCTGCCGGAATGGCCATCGG
CATCGTCGGTGATGCTGGTGTCAGGGCAAATGCACAGCAACCAAAGCTTTTCGTGGGCATGATCCTCATCCTCATTTTC
GCAGAAGCGCTTGCCCTGTATGGTCTCATTGTGGGCATCATCCTCTCATCCCGTGCCGGCCAATCTCGTGCAGATTAGG
CACTTTGCGGTACCATACCGCTGTTATTCCACTGGCTATATTCTTGAGAAAACCTGAAACTTACTTGGGAGCTCTAGTT
TAATGTATTAAAAGATCGATTTGTAGCTTAAGCAAGGTGGCACTTCCAGTCCTTTTTGTTTCTTTTGTGGTGGTTCATG
CAAAGTTTTTTGGGTTAGGCTGGATTTGCTGCTCCTGAGCAAACGGATTTAATCTCATTCGTGGTGAATAAAAAACACG
GGATTGTAGCT
```

FIG. 2 continued

> SEQ ID NO: 5594 116461 139353_300409_1b
TCTAGATCGCGAGCGCCCCAATCCCACCACCGATCGATCCATTCCTGCTGCTCGCGGCCACCGGAGAAGGAGAGAGAGA
GAGCTCGACCTCGTCGGCGGGTGAAGGATCGCAGCAGCAGCAGCGGCGGTAGAGCAGGAGGAGAGGCGAAGATGTCGTC
GGTGTTCAGCGGCGATGAGACCGCCCCCTTCTTCGGCTTCCTCGGCGCCGCCTCCGCCCTCGTCTTCTCATGCATGGGG
GCGGCGTACGGGACGGCGAAGAGCGGCGTCGGGGTGGCGTCGATGGGGTGATGCGCCCGGAGCTCGTGATGAAGTCCA
TCGTGCCCGTGGTCATGGCTGGTGTGCTGGGTATCTACGGCCTCATCATCGCAGTCATCATCAGCACGGGGATCAACCC
CAAGGCCAAGCCCTACTACCTCTTCGACGGCTACGCGCACCTCTCATCTGGCCTCGCCTGTGGTCTCGCCGGTCTCGCT
GCCGGAATGGCCATTGGCATCGTTGGTGACGCCGGAGTCAGGGCGAACGCCCAGCAACCAAAGCTGTTCGTGGGTATGA
TCCTCATCCTCATTTTTGCCGAAGCGCTTGCTCTCTATGGGCTCATCGTCGGCATCATTCTGTCATCCCGCGCTGGCCA
ATCTCGTGCGGATTAGGCATGTTTCAACACGCAAACCCTTAGTGGGTTCTTGTTTCATATTCCTGAAACTACAAGCTGA
GCTCTAGGGGTTTATTCTGTCTTAGTTTCTGTTCTTCTGTTGGGTCATGAACAAAAAAACATCTGTATCCAAGGGATGT
TTGCCCTTGTGGTGCCATTCTTTTTCGCTATGGTGGTGCTGGCGGCGGTCTGAATCTTATTTATGCACAGTTTTTTTGG
GTCTGGCTAGACAGTGATGTAATCTGGTGAATAAGCAAATAATTCGTAATGCAATGGGAGCATGAGACTCTTTTGTTC

> SEQ ID NO: 5595 116461 144378_200134_1b
AGCACGTGAATATCACCGAATTATCAATTATTGCGTCAACAGCCAATCAAAGAGGGAGAGAGAACGAGGGAGGAGCAAC
CAGAAACAGATCTATTCAACTCCAAAACTCAAAAACACTGTATATTTACAGTTCTCAGATCCAAATCCTAACGACAATG
TCGACCTTCGCCGGAGATGAAACTGCTCCTTTCTTCGGCTTCCTTGGCGCCGCCGCGGCCCTCGTTTTCTCCTGTATGG
GGGCAGCTTATGGAACAGCAAAGAGTGGTGTTGGAGTGGCGTCAATGGGAGTGATGAGACCTGAGTTGGTGATGAAATC
TATTGTGCCAGTGGTTATGGCTGGTGTGTTAGGTATTTATGGGTTGATTATTGCTGTGATCATCAGTACTGGGATTAAC
CCCAAAACGAAGTCGTATTACCTATTTGATGGCTATGCTCATCTCTCCTCCGGTCTTGCTTGTGGTCTTGCTGGCCTTT
CTGCTGGAATGGCTATTGGTATTGTTGGTGATGCTGGTGTTAGGGCTAATGCACAACAACCTAAGCTTTTCGTTGGGAT
GATCCTCATTCTCATTTTCGCTGAAGCTTTGGCTCTTTATGGACTTATTGTTGGCATTATCTTGTCTTCCCGAGCTGGC
CAGTCTAGAGCTGAGTGAAGTTAACTCCATTCTTACCGCGTTGTATGTGGGACTTCAGTAGACCGAGGCAGTCAAAAGT
ATCTAATACGTGTATTGTTATTCATTATCCCACAGCTGGAACTTAATTCAGTGGTGCAATGTTCTGTCTGTAGAAATAG
GAATTAAATTTTTCTACTCAATAATAATAGCTTAAAGAGCTGTGCAATTTGGTCAGTATTTATCGTATATTTTGCGGTG
AACGGTCTGAACCATTTTGTTTATGAGATTCGTGCATGTATCATTTCATCTTGATTTATTATGTTGATTGTGCAACATC
TATGAGTTTGAGCT

> SEQ ID NO: 5596 116461 248040_301579_1b
TAAGGGATAGATCCGTGGATAGCCGGGGAGGAGAATCGGATCCATGGCGTCGACCGATGCGTTCAGCGGCGATGAGACG
GCGCCCTTCTTCGGATTCATCGGCGCCGCCGCAGCTCTGGTCTTTTCCTGCATGGGAGCTGCGTATGGGACGGCAAAGA
GTGGTGTTGGCGTCGCGTCCATGGGTGTGATGCGGCCGGAGCTGGTGATGAAATCGATCGTCCCGGTGGTCATGGCGGG
AGTGCTGGGAATTTACGGCCTCATCATCGCTGTGATCATCAGCACCGGGATCAACCCAAAGGCCAAGTCGTACTACTTG
TTCGACGGCTATGCTCATCTATCGTCGGGCCTGGCCTGCGGTCTCTCCGGTCTCTCGGCAGGCATGGCGATCGGCATTG
TCGGTGATGCGGGTGTCCGGGCCAATGCACAGCAACCCAAGCTTTTGTGGGAATGATCCTCATACTCATCTTTGCCGA
GGCTTTGGCTCTATACGGTCTCATTGTTGGAATCATTCTGTCGTCCCGTGCCGGTCAGTCCAGAGGATAAGCAGCAGCG
TTAATTTTAAGGTGGTTTATATGCGAGCATTCTTCTTAGCGTTTTTTGTTTTGCTTACTGCTTGTATTATTATTCCTTC
CAACAAATAATTCTCGCTTATTAAAAAAAA

> SEQ ID NO: 5597 116461 252921_301610_1b
GCTTTGTTTTCTCTCTCTCTTGATCCAGCTTCGGAGGTTGGCTATGGCGACGATGGACTTCAACGGGGATACGACGG
CCCCCTTCTTCGGATTTCTGGGAGCAGCCTTTGCCTTGATCTTCTCTTGTATGGGTGCGGCATATGGAACAGCAAAGAG
TGGAGTTGGGGTTGCTTCAATGGGTGTTATGAGGCCTGAGCTTGTGATGAAGTCCATAGTTCCAGTGGTTATGGCTGGT
GTCTTGGGTATTTATGGTTTGATCATAGCTGTCATTATCAGCACAGGAATCAACCCCAAAAGCAAGGCATATTACTTGT
TTGATGGATACGCCCATCTCTCGTCAGGCCTAGCTTGCTGTGGCTTTCTGGTCTTTCAGCTGGAATGGCAATCGGGATTGT
TGGTGATGCCGGTGTCAGGGCAAATGCACAGCAGCCAAAGCTTTTTGTTGGCATGATTCTTATTTTTGCGGAG
GCTCTTGCTTTGTACGGCTTGATCGTCGGCATTATTCTCTCTTCTCGTGCAGGTCAATCAAGGGAATGATTCTTCCATG
CCCTTTGATTCTACCCATTCCAACTATCCAAATTATATTGTCCTATGGTAGGACATGTTTTTCTTTCTTTTTTAACTAT
ATTTTTTTCTTCCGGATTTGACCAATAAGGAAACAAAGAAGGCAACTCTTTGTTTCAATGAGTTTTCATCTCTTAGTGG
ATGTATGCTTTCTTTCATGAGTGATAAGAAATATCATT

> SEQ ID NO: 5598 116461 56262_300126_1b
ACAAAAGCCAATTCTCTCTCTCTCCCTCCAGATTCAAACGATCCGATCCAAAACTTTGAGATCCGAGAAGATGTCTACG
TTCAGCGGCGATGAAACTGCTCCGTTCTTCGGCTTCCTTGGCGCCGCCGCCGCTCTCGTCTTCTCCTGTATGGGAGCTG
CTTATGGAACAGCAAAGAGTGGTGTTGGTGTGGCTTCAATGGGAGTGATGAGACCTGAGTTGGCTATGAAGTCTATTGT
CCCTGTGGTTATGGCTGGTGTTTTGGGTATTTATGGACTTATTATTGCTGGTATCATTAGTACCGGCATCAATCCTAAG
GCTAAGTCTTACTACCTATTTGACGGATACGCTCACCTTTCGTCT

FIG. 2 continued

> SEQ ID NO: 5599 116461 56446_300139_1b
TACTGGTATTAATCCCAAAACAAAGTCGTTTTATCTGTTTGATGGATATGCTTCTCTCCTCTGGTCTCGCTTGTGGTCT
TGCTGGACTTTCTGCTGGAATGGCTATTGGTATTGTTGGTGATGCCGGTGTTAGGGCTAATGCACAACAGCCAAAGCTT
TTTGTTGGGATGATCCTCATTCTCATTTTTGCTGAAGCTTTGGCTCTTTATGGGCTTATTGTTGGAATTATATTGTCTT
CACGAGCTGGGCAGTCCAGAGCATAGTGAAATTGGCTTATTAATACTATTCTTACTATGATGTATGTGAGACTCAGTAA
ACCCTGGCAAAACTTGATCCTTGCTAAAGTCAAAAAGCTATCTATGTCTATGTTTGTTATTCATGTTGGCACGGTTGCT
ACTGGTGCTGCTATTGTGCTGTTTGTAAAAAAAT

> SEQ ID NO: 5600 116525 50666_300172_1b
AACAGAGAAAAAAAAAAACAATGGCAACTCAAGCCGCCGGGATCTTCAACTCCGCCATAACAACCGCCGCAACCTCCGG
CGTCAAGAAACTCCACTTTTTCTCAACAACCCACCGTCCCAAATCCCTCTCCTTCACCAAAACCGCAATCCGCGCCGAG
AAAACAGATTCCTCCGCCGCCGCTGCTGCAGCCCCCGCCACGAAAGAAGCTCCCGTGGGATTCACGCCACCGCAGCTAG
ACCCAAACACACCGTCTCCGATCTTCGCTGGAAGCACCGGTGGTCTTCTACGTAAAGCGCAAGTGGAAGAGTTCTACGT
TATCACGTGGAACTCACCGAAAGAACAGATCTTTGAGATGCCGACAGGAGGAGCAGCGATCATGAGAGAAGGTCCGAAT
CTTCTGAAGCTAGCGAGGAAAGAGCAGTGTTTAGCTTTGGGGACAAGGCTTAGATCCAAGTACAAGATCACTTACCAGT
TTTACAGAGTGTTTCCTAACGGTGAGGTTCAATATCTTCATCCTAAAGATGGTGTTTATCCAGAGAAGGCGAATCCAGG
AAGAGAAGGTGTTGGTCTCAACATGAGATCTATTGGGAAAAATGTTAGTCCCATTGAAGTTAAGTTTACTGGCAAACAA
AGTTATGATTTGTAAGATCTGTAAACTAAAAAAACCAAAAACTATGT

> SEQ ID NO: 5601 116525 245554_301569_1b
GGTTGTTTCTCAGGCCCAGCATTTGATACATCAAAGATGCAGGCCTTGGCAATGCAAGCGTCTCCAATGAGCCTGCGCT
CCACGAGCAGCGCCGGCAGCAGCACCAGCAGCTTCTTCCAAGGTCAGTCCAAGATCTCCATGGCGGCGGCTCCTGCGCG
AGTGAGCATGATGGCGACGGCAGATAAGGCAGATAAGGCAGATAAGGCAGCTAAGGCAGATAAGGCAGATAAGGCAGCT
AAGGCAGATAAGGCAGATAAAGCAGCACCTGCACCCGCGGGATTTACCCCACCAGAGCTCAAGGCCGATACCCCGTCCC
CAATCTTTGGTGGCAGCACGGGCGGACTGCTGCGCAAGGCACAGATCGAGGAGTTCTACGTCATCACCTGGGAATCACC
CAAGGAGCAGATATTTGAGATGCCAACCGGAGGTGCTGCAATCATGCGCTCCGGCCCGAACTTGCTCAAGCTGGCTCGT
AAGGAGCAGTGCATGGCGCTGGGCACGCAGCTGCGCTCCAAGCTCAAGATCAACTACCAGTTCTATAGGGTGTTCCCCA
ACGGTGAGGTGCAATACTTGCATCCCAAGGACGGAGTCTACCCCGAGAAGGTTAACCCCGGGCGGAAGGGCGTGGGTGT
CACTCTCAGGTCCATTGGCAAGAATTGCAACCCCGTCGATCTCAAGTTCACAGGCAAGGCTGCATATGATGTGTAACGC
TTTTGCGCCTTTGGTGA

> SEQ ID NO: 5602 116525 129891_300482_1b
TTTTTTTTTTGGGGGGAAATTATACAGTAATCCACATGTTTAATGGTACCTTTGGAACAGGAAAATACAAATTAAGTT
CAAACAATAATTTCATTACATAACCACACAACCTACTGCAGCTCGAGGAAATCAACTACCCCTTGAATATTCCATGGCT
ATGGCAACTCAAGCAGCTCTTTTTACCCCAACTCTTTCCACCTCAAAATCAAGCAATTTAGCATGGAAACAATCCTCAA
CTGTGTCATTCGCCAGCCCTAAACCATTCAACTTTGCTGCACCACAACGTTCCATTAAGGCCTCAGCTGCTGAAGGAAA
GACAGAAGCTCCAGCGAAAGAAGCCCCAGCAGGTTTCACCCCACCAGAATTGGACCCAAACACACCATCTCCAATATTC
GGAGGTAGTACTGGTGGATTGTTGCGTAAAGCTCAAGTAGAGGAGTTTTACGTGATCACTTGGGATTCTCCTAAAGAAC
AAGTATTTGAAATGCCAACTGGAGGTGCAGCTATCATGAGACAAGGACCTAACTTGCTTAAGTTGGCAAGGAAAGAACA
GTGTTTAGCTCTTGGAACCAGATTGAGATCCAAGTACAAGATCAAGTACCAGTTTTACAGGGTTTTCCCAAATGGTGAA
GTTCAATATCTTCATCCTAAAGATGGTGTGTACCCAGAGAAGGTGAACCCAGGACGTCAAGGAGTCGGACAAAACTTCA
GGTCTATCGGAAAGAATGTCAGCCCTATTGAAGTTAAGTTCACTGGAAAACAAGCATATGATTT

> SEQ ID NO: 5603 116525 126718_300466_1b
ATTCTGCACAAATACATCTCCATTTCCTCCACTTTTGTAAGCCAATAATTCTACAATGGCCATGGCAACTCAAGCTTCT
CTCTTCACTCCAGCTCTCTCTGCCTCAAAATCTTCAGCCCCATGGAAACAATCCCTTGCTTCCTTCTCTCCTAAGCAAC
TCAAATCCACTGCTTCCACTCCCCGTCCCATTAGAGCCATGGCCGAAGAAGCCGCCGCCGCCGCCACAACAAAAGCAGA
GGCTCCAGTGGGCTTTACCCCACCACAATTGGACCCAAACACACCTTCCCCAATCTTCGGTGGCAGCACCGGCGGGCTT
CTCCGCAAGGCCCAAGTTGAGGAGTTTTACGTAATTACTTGGGAATCACCTAAAGAACAGATCTTTGAGATGCCAACTG
GTGGTGCAGCTATTATGAGGGAAGGTGCTAATTTGCTGAAATTGGCGAGGAAAGAGCAGTGTTTAGCACTTGGTACTAG
GCTTAGGTCAAAGTACAAGATTAACTACAGGTTTTACAGGGTGTTTCCTAATGGTGAGGTTCAATACCTGCACCCTAAG
GATGGTGTGTACCCAGAAAAGGTGAACGCTGGCCGTGAAGGAGTTGGACAGAACTTCAGATCCATTGGTAGGAACAAGA
GCCCAATTGAGGTCAAGTTCACTGGCAAACAAGTGTATGATTTGTAAGCTGATTATGGTATTTTGTGCCTTTTCGTGTA
ATGTGATGAATTTGTGATTATTTAGTGCATCATTTCATGTAATTTTATTTGCCACTACAAAATACAGCATGGGATTCTA
TTATTCCTCCCGTATTATC

> SEQ ID NO: 5604 116525 120173_300359_1b

FIG. 2 continued

```
CCCCCCCCGCTCTTCTCTCATTCTCATTCCGCACAAATACATCTCCATTTCCTCCACTTTTCTAAGCCAATAATTCTTC
AATGGCCATGGCAACTCAAGCTTCTCTCTTCACTCCAGCTCTCTCTGCCCCAAAATCCTCTTCCCCATGGAAACAATCC
CTCGCTTCCTTCTCTCCTAAGCAACTCAAATCCACTGTTTCCACACACCGTCCCATTAGGGCCATGGCCGAAGAAGCAG
CCGCCGCCACAAAAGAAGCAGAGGCTCCAGTGGGCTTCACCCCACCACAATTGGACCCAAACACACCTTCCCCAATCTT
CGGCGGGAGCACCGGTGGGCTTCTCCGCAAGGCCCAAGTTGAGGAATTCTACGTAATCACTTGGGAATCACCTAAAGAA
CAGATCTTTGAGATGCCAACTGGTGGTGCGGCTATTATGAGGGAAGGTGCTAATTTGCTGAAATTGGCGAGGAAAGAGC
AGTGTTTGGCACTTGGTACTAGGCTGAGGTCAAAGTACAAGATTAACTACAGGTTTTACAGGGTGTTTCCTAATGGTGA
AGTTCAATACTTGCATCCTAAGGATGGTGTGTACCCAGAAAAGGTGAACGCTGGCCGTCAAGGAGTTGGACAGAACTTC
AGATCCATTGGTAAGAACAAGAGCCCAATTGAGGTCAAGTTCACTGGCAAACAAGTGTATGATTTGTAAGCTCATTATG
TTGTGCCTTTTTATGTAATGATTTTGTGATTATTCAGGCCATCGTTTCATGTAATTTTATTTGCCACTACAAAATACAG
CACGGGATTCTATTATTTCTCTCTCTTTTTTTTGCTCTTATAGTTACTCTGTTCTTTGAGGGTGACAAAGGATGGGTAT
GCT

> SEQ ID NO: 5605 116525 1119024_301893_1b
AACTATTATTACTACTACTCTTCATCTCTACTGATTGATAGAGGAACCTCAGCTATGGCCATCCAGGCATCCTCCCAGT
CAGTCATGGCAAGAGCAGTAGCCCCGTCCATGGCCTCCACCCTCCCCCTCTCGCCCCCCTCTGTGCGCTTGTCGGCGTG
GAGTAGCTCCGCCGTCCATGGCATCCAGCTCCGCCTCCCCCGCCCTGCTTGCCGTGTCCGCATGGCTTCTGAAATCCCT
GCCCCGGCACCCAAAGAAGAGGAGAAAGATGAGGCGCCCAAAGGTTTCACCCCGCCTACTCTCAACCCGGAGACGCCCT
CGCCAATCTTCGGGGGTAGCACAGGTGGCCTCCTCCGTAAGGCCCAAGTCGAGGAATTCTACGTGATCACGTGGGAGTC
CCCGAAAGAGCAGATATTTGAGATGCCCACCGGCGGCGCCGCCATCATGAGGGAGGGACCTAACCTCCTCAAGCTCGCG
CGCAAGGAGCAATGCCTTGCACTTGGCTCCCGCCTCCGATCCAAGTTCAAAATCACCTACCAATTCTACCGCGTCTTCC
CGAATGGGGAAGTGCAATACCTCCACCCCAAGGATGGTGTCTACCCCGAAAAGGTCAACGCTGGAC

> SEQ ID NO: 5606 118051 231823_301209_1b
GTCGCCCACGCGTCGAGAAAGGCAGTGGACGTGGCGTCCATCTAGCCGTTGCCTGGCTCGTCTGCCCTAATTATCCATC
AGTGCCCCAGCCGCCCCAGTGGTTTGTCCGCGATTCAAGCTTCCATCGATCGATCGAGAGATGTCTGATGACGAGAGCA
AGGAGGAGAAAGAGCTGGATTTGTCGTCGCCTGATGTGGTGACCAAGTATAAGCTCGCCGCGGAGATTGCCAACAAGGC
TTTGCAAGCTGTGGTGACTGAGTGTAAGTCGGGAGCTAAAGTTGCGGACCTTTGCTCCATAGGTGACACATACATCAAG
ACCCACACCGCGAACGTCTACAAGAATGCCAAGAAGAAGATCACAAAGGCGTGGCATTTCCGACATGCGTCTCCGTAA
ACAACACTGTGTGCCATTTCTCGCCGCTGAATGGAGACAAGACGGCTCTCGTTGACGGGGACATCGTAAAGATTCGTTT
GGCAGCGATCTCGGCTGTCATATCGACGGCTTTGCGGCCGTAGTCGCTCACACACACGTCCTTCAGACGGGTCCGGTGA
CTGGAAGAGCAGCGGACGTCCTGGCAGCTGCAAACACCGCAGCAGAAGTTGCGCTCAGGCTCGTGAGACCAGGAAAGAA
GAGCAGGGATGTTTCCGAAGCGATCCAAAAGGTTGCTGCGGCTTACGACTGCAAGATCGCCGAAGGCGTTTTGAGCCAC
CAGATGAAGCAATTCGTGATCGATGGAAACAAAGTCATCCTGAGTGTGTCGAATCCAGACACCCGGGTTGACGACGCTG
AGTTTGAGGAGAA

> SEQ ID NO: 5607 118051 268807_200122_1b
GGGCAAAACCCTAGCTCAACCCTTTCTTGCCCCCACTCTTCCTTTCCATCAGCAAAACCCAATTTTCGCTTCGGTAAGC
TTCCTCTTCTTCTAATCCCCCCCTTCCTTTCATTTCTTCATTCATTCATTCATTTGCTCTTCTGAATTCGTTTTTCTCC
ATATTCCTTTTTCAGCAGAAATTCTGTAATTGTATTTATAGACCTGTTTGGTAACTATGTCTGACGACGAGAGAGAAGA
GAGAGAATTGGATCTCACCAGTCCTGAGGTCGTCACCAAGTACAAGAGCGCCGCTGAAATCGTTAACAAGGCTTTGCAA
TTGGTGTTGTCCGAATGCAAGCCAAAAGCAAAGATAGTTGATCTTTGTGAAAAAGGGGATGCCTTTATCAAAGAGCAAA
GTGGAAATATGTACAAGAATGTGAAGAAGAAAATTGAGAGGGTGTTGCATTTCCAACGTGTATTTCAGTTAACAACCA
CTGTGTGTCATTTCTCTCCATTGTCTAGCGATGAGACAGTACTGGAAGAAGGTGATATATTGAAGATTGATATGGGATG
TCAAATTGATGGATTTATTGCTGTAGTTGGACATACACATGTTCTTCAT

> SEQ ID NO: 5608 118051 1172015_302059_1b
TTTTCACGTGACTCTCTCTCTTTCTGTCTCTCTCTCTCTCTCTCTCTCGTTGTGTTGAAGTGTGGGCATGATGAG
TGACGAGGAGGTGAAGGAGGAGAAGGGAGCTTGACCTGACCTCTCCTGATGTGNTCACCAAGTATAAGCTTGCTGCTGAT
ATNGCTAACAAGGCCCTTCAGCTTGTCATTTCCAACTGCAAACCTGGTGCCAAGTTGGTTGACCTCTGCGAGAAAGGCG
ACTCCTTTATCCGAAGAACAAACTGGGAACATATACAAAATGCCAAGAAGAAAATTGACAAAGGAGTTGCTTTTCCCAC
GTGCATCTCTGTAAACAGTGTGATATGCCATTTTGCACCTATGGTAGGTGATGAAACTACACTTGCAGCGAATGATATT
CTGAAGATTGACCTGGGATGCCATATCGATGGGTTTGCGGCAGTTGTTGCACATACCCTAGTTTTGCAAGATGGTCCTA
TCACTGGAAGAGTAGCGGATGTTCTTGCTGCTGTTAACACTGCTGCTGAGGTGGCTCTTCGCTTAGTCAGACCAGGAAA
GAAGAACAAGGATGTTACTGAAGCTTTGCATAAAGTTGCAGCTGCTTATGACTGCAAGGTTGTGGAAGGTGTATTGAGT
CATCAAATGAAGCAAT
```

FIG. 2 continued

> SEQ ID NO: 5609 119262 155665_301358_1b
GCAAGAATGGAGATGATGAGGTGATTCTATTGAACTTTGGCCTAGTATGTTGGAATGAGAGTAAAGGTTGCACTAGCTG
AAAAGGAGATCAAATATGAATACAAGGAAGAAGATTATTTACTGCTAAAAGTCCTTTGCTACTGAAAATAAATCCAATC
CACAAAAAAGTCCCAGTTTTAATTCACAACGGTAAAACTGTTTGTGAATCTCTTATTGCAGTTCAATATATTGATGAGG
TTTGGAATGACAAAGCTTCATTGTTACCCTCTGATCCTTATGAGAGAGCACAAGCTAGGTCTGGGCTGATTACACTGA
CAAGTTGTATGATTATGGGAGAAAAATATGGGCAACCAAAAGAGAAGAGTTAGAGGAAGCTAAGAAGGAATTGATAGAT
CCACTCAAGTTACTAGAGCTAGAAGTATTGGGAGACAAACCTTACTTTGGAGGGGAAAGCTTCGGTTTTGTGGATATTG
CCTTAATTGGATTTTACTGCTGGTTTTATACCTATGAGTACTTTGCCA

> SEQ ID NO: 5610 119262 13678_300248_1b
CCCACGCGTCCGCAAAAAAACAAATGGGAGAGAAAGAGGAAGTGAAACTATTAGGAGTATGGTACAGTCCATACGCCAT
AAGACCTAAGATCGCTCTTCGTCTCAAATCAGTGGATTATGATTACGTTGAGGAAAATCTGTTTGGATCCAAGAGTGAG
CTTCTTCTCAAATCAAACCCGGTTCACAAGAAAGTCCCTGTTCTCCTCCACAACAACAAACCGATTGTCGAGTCTCTCA
ACATCGTTGAATACATTGATGAGACGTGGAACTCATCTGCACCGTCCATTCTTCCTTCACATCCTTATGATCGTGCTCT
TGCTCGCTTTTGGTCTGAC

> SEQ ID NO: 5611 119262 125287_300629_1b
ATTTAGAACCAAAGTAGTGATATCATATGGCAGGAGTGAAGTTGCTTGGTCTTTGGTATAGCCCTTTTAGTCACAGAGT
TGAGTGGGCTCTAAAGCTTAAGGGCGTGAAATATGAATTTGTAGAAGAAGATTTACAAAACAAGAGCCCTCTGCTTCTT
CAATCAAACCCTGTTCACAAGAAAATACCAGTGCTTATTCACAATGGCAAACCCATTTCTGAGTCTCTTGTCATTCTTG
AATACATTGATGAGACTTTTGAAGGTCCTTCCATTTTGCCTAAAGACCCTTATGATCGATCTTTAGCTCGTTTCTGGGC
TAAGTTCCTTGACGATAAGGTGACTGTAATAGTGAATACTTTCCTTAGCAAAGGGGAGGAACAAGAAAAAGCTAAAGAG
CAAGTTTGGGAGATGTTGAAAGTTCTTGACAATGAGCTCAAGGATAAGAAGTTTCTTGTAGGTGACAAATTTGGGTTTG
CTGATATTGCAGCAAATTTGGTGGCATTTTGGCTAGGAGTTTTCGAAGAAGCCTCTGGAATTGTTTAATGACAAGTGA
AAAATTTCCAAATTTTTCTAAGTGGAGAGATGAGTACACTAACTGCAGCCAACTCAAGGAATCTCTGCCTCCAAGAGAT
GAGTTGCTTGCTTTTTTCCGAGCTCGTTCTCAAGCTGCTACAACTTCTGCTTCCGCTCCCAAATGAACAGATTCGCATA
CATTTTATGAAGTTTCGAGATTATGTGTTAGAATAAACTTTTGAATCTAGGACGAGGTCTGTAGATTCAATTATGTATA
CTTATGCAAAGGAAAAAAATTAAATTTTATATAAGATTAAGCTCGTTCAGAACT

> SEQ ID NO: 5612 119262 11784_300294_1b
TGGTATCAACGCAGAGTGGCCATTAGGCCGGGAAAGCAAGAATCAGCAAATGGCTGATGAGGGAGTGAAATTGCTAGG
ACACTGGCCAAGCCCTTTTGCTCTAAGGGTTCATTGGGCTCTGAAACTTAAAAGGGGTTGATTATGATTACCAAGAAGA
AGATCTCCCGAACAAAAGTCCTTTGCTCCTGCAGTATAATCCAGTTCATAAAAAGATTCCAGTTCTGGTTCATAATGGG
AAACCTATTGCAGAATCATTAGTCATACTTGATATTCGACGAGACTTGGAAGCATAATCCCCTCCTCCCTGAAGATC
CTTATGAAAGAGCCAAAGCGTTTCTGGGCAAAATTTATTGATG

> SEQ ID NO: 5613 119262 271309_200033_1b
CGTTATTTATTATGCATCTTGACTACCCCTCGACCCACGCGTCCGCGGACGCGTGGGCGGACGCGTGGGTTCTGCTAGA
TTTCTGGCCAAGTTCTTTTGGTATGAGGATAAGAATTGCATTGGCCTTAAAGGGAATCAAATATGAAGCAAAGGAGGAA
AACCTATCTGATAAAAGCTCTTTGCTTCTGGAGATGAACCCTGTTCACAAAAAGATACCTATTTTGATTCACAATAGTA
AACCCATTTGTGAGTCTCTAAACATTCTTGAGTACATTGATGAAGTTTGGCATGACAAATGTCCATTACTTCCTTCTGA
TCCTTACGAAAAGTCACGAGCCAGATTCTGGGCTGACTATATTGACAAGAAGATATATAGCACAGGAAGAAGAGTGTGG
AGCGGTAAAGGTGAAGATCAAGAAGAAGCAAAGAAGGAATTCCTAGAAATATTCAAGACTTTGGAAGGAGACCTTGGAA
ATAAAACTTACTTTGGTGGTGATAATTTGGGTTTTGTGGATGTGGCTTTGGTTCCCTTTACTAGTTGGTTTTATTCTTA
TGAGACTTTTGCTAATTTTAGTATAGAAGCAGAGTGTCCAAAGCTGGTGGTATGGGCAAAAAGATGTATGGAGAACGAG
TGTGTCTC

> SEQ ID NO: 5614 119262 56388_300123_1b
CGGACGCGTGGGTGGCGAACCTACCGATTCTTTTGGATTACTGGCCAAGTATGTTTGGGATGAGGGCTAGAGTTGCGTT
GCGAGAGAAAGTTGTTGAGTTTGAATACAGAGAGGAAGATTTCTCGAACAAGAGCCCTTTACTCCTCCAGAGTAATCCC
ATTCACAAGAAAATCCCGGTTCTGGTCCACAACGGTAAACCGGTATGTGAATCTCTTAACGTTGTCCAGTACGTCGACG
AGGCTTGGCCCGAGAAGAACCCGTTCTTCCCTTCCGATCCTTACGGGAGAGCTCAGGCTCGATTCTGGGCTGATTTCGT
GGACAAGAATTTCACCGACGCCCAATTCAAGGTATGGGGAAGAAAGGTGAGGAACAAGAAGCAGGCAAGAAGGAATTT
ATTGAGGCAGTGAAGATTCTTGAATCTGAGCTAGGAGATAAACCTTACTTTGGTGGAGATAGCTTTGGGTATGTAGACA
TTTCCTTGATTACATTCTCGAGTTGGTTCCAAGCCTATGAGAAGTTT

FIG. 2 continued

> SEQ ID NO: 5615 119262 235772_301229_1b
CGTCCGGGCTTCCACTCAAGAAGTGACCCTTCTCAGCTTTTGGGCGAGCCCCTTCAACATGCGAGTCAAGTTGGCACTC
ACACTCAAAGGCATCGAGCATGAAGATCTTCCACAGGATTTCGGCAACAAGAGCAAGTTGCTGCTCGACTCCAATCCCA
TCCACAAGAAGATCCCGGTCCTCATCCACAAGGGGAAGCCAGTGCTCGAGTCAGTCATCATTGTCGAGTACATTGACGA
GGTATGGCCTGGAAAGTCGCCGCTGCTGCCTCAGGATCCATTCCTTCGTGCCGAGCACCGCTTCTGGGCCGACTTCATC
GACAAGAAGATCGGCGACTGCTTGATCCGCTTCCTGAAAACTGAGGATAATGCCGACATCAACGAAGAATTCGTCGAGA
ATCGGATGCATCTCGAGGGGCCGCTAGAGAAGCTCGGACGCGAGGAGGGGCCGTTCTTCGGCGGCGAGAGCATGTCGTT
CCTGGACGTGATTCTTGCCCCTTTCATCGTCTGGATTCCTGCCGTTGGCAATGTCCTGGGCCTCAAGACGCCACATGAG
AAATGCTCGCATCTACGCAAGTGGTTTGCTGCCATCTCTGAGCATCCCGACGCTAA

> SEQ ID NO: 5616 119262 236794_301261_1b
GCTTCCACTCAAGAAGTGACCCTTCTCAGCGCTTGGGCGAGCCCCTTCAGCATGCGAGTCAAGTTGGCACTCACACTCA
AAGGCATTGAGCACGAAGATCTTCCACAGGATCTCAGCAACAAGAGCAAGCTGCTGCTCGACTCCAATCCCATCCACAA
GAAGATCCCGGTCCTCATCCACAAGGGGAGGCCACTGCCCGAGTCAGTCACCATTGTCCAGTACATTGATGAGGTATGG
CCTGGAAAGTCCCCGCTGCTGCCTCAGGATCCATTCCTTCGTGCCGAGCACCGCTTCTGGACCGACTTCATCGACAAGA
AGTTCTTCGACTGCTTCATGCGCTTCATGCGCACTGAGGATAATGCCGGAATCAACGACCAATTGGATGCATCTCGAGA
GAGCGCTAGAGAAGCTCGGAAGCAAGAAGGGGCCGTTCTTTGGCGGCGAGAGCATGTCGTTCCTGCACGTGATTCTTGC
CCCTTTCAGCGTCTGGATCCC

> SEQ ID NO: 5617 119350 233423_301090_1b
GGAAGAAGAAGAGCAATGTCGCACTTTGGGCGATCGGGGCCGCCGGACATCCGCGACACCTATTCGCTCCTCGTCCTCA
ACATCACCTTTCGGACCGAAGAACTGGTGACTCGCGGGGATTTGCTTTTGTGCGCTACAAGCATGCCGATGAAGCTCAA
AAGGCAATCGAGAGGCTTGACGGTAAGAATGTAGATGGAAGAAATATCGTTGTGCAATTTGCCAAATATGGTCGGAACG
ATGAGTCAATTCAGCGTGGGAAAATAACATCTTCCAGTCCTATCTGGCGCAGCCGATCTAGGAGCCGGAGTCCTAGGAG
AGGAAGAAGAGATTATGACGACCACCGAGAGAGAGATAGAGACCGACGACGTAGCCGAAGCCGAGAGAGATACGAGCGT
GAAAGATACCGCGGGCGTGACAGTAGAGATTACCGCAGGCGTAGCCTTAGCCGCAGTCGCAGTCGCAGCAGAAGCAGAG
GCCGTGGCGGCCATGACTATCCCGCTCGTGACGGCCGAGATGGTCGTGATGCTCGCGATGGACGCGATGTCCGCGACGG
GCGAAGGCGATCTCGGAGCAAATCACCCGACAGACAACCGTCTTCAGCCGCTGAAAGGAGTCCGTCACCTCAGCCTCGC
CGTAGCGCATCGCCAGCTCCGAGAAGCCCGTCC

> SEQ ID NO: 5618 119350 256680_301674_1b
ATGAGAAGAAGAGCAATGTCGCACTTTGGGCGATCGGGGCCGCCGGACATCCGCGACACCTATTCGCTCCTCGTCCTCA
ACATCACCTTTCGGACCAGTGCCGACGATTTGTTTCCCTTGTTCGATAGATATGGAAAAGTGGTTGATATTTTTATTCC
CAGGGACCGAAGAACTGGTGACTCGCGGGGATTTGCTTTTGTGCGCTACAAGCATGCCGATGAAGCTCAAAAGGCAATC
GAGAGGCTTGACGGTAAGAATGTAGATGGAAGAAATATCGTTGTGCAATTTGCCAAATATGGTCGGAACGATGAGTCAA
TTCAGCGTGGGAAAATAACATCTTCCAGTCCTATCTGGCGCAGCCGATCTAGGAGCCGGAGTCCTAGGAGAGGAAGAAG
AGATTATGACGACCACCGAGAGAGAGATAGAGACCGACGACGTAGCCGAAGCCGAGAGAGATACGAGCGTGAAAGATAC
CGCGGGCGTGACAGTAGAGATTACCGCAGGCGTAGCCTTAGCCGCAGTCGCAGTCGCAGCAGAAGCAGAGGCCGTGGCG
GCCATGACTATCCCGCTCGTGACGGCCGAGATGGTCGTGATGCTCGCGATGGACGCGATGTCCGCGACGGGCGAAGGCG
ATCTCGGAGCAAATC

> SEQ ID NO: 5619 119915 238517_301295_1b
GATCATCTACAGCCTCTGCAAGGACAACCGTGTCGAAGAGGCCAAGAAACTCATGGATCAGGCAATGCAGAGGAAGTGC
ATGCCTGGAGTTCCAGTGTGCACGGTGCTGGTGGATGGCCTCTGCAAGTCTCGGCAAGTGGAGGAAGCTTACGAGATCC
TGGAACGAATGCTGGAATGCGGGGACCGAGCTCCCAGTGTGGTTACTTACAGCACTATCATCGACGGGCTTTGCAAGGC
GGACAGACTCGACGATGCCTACCTTGTGCTCCAGAAGATGAGGAGTAGCGGCTGCGTTCCGGACGTGGTGACTTACACT
GCCATCATCGACGCGTTTTGCAAAGTTGGAAGACTGGACGAGGCTCGCGAGCTGTTCCAGAGGATGCACGAGAGAGGCT
GTGCATCGGACGTGGTCGCCTACAACATCCTGATACGAGGCTACTGCCGAGCGGCCAAAGTCGACGACGCCATTGCTAT
GATCGAAGAGATGGCCGCGAGAGGAGTCCAGCCCAACGTCGTTTCGCTCAGCACCATCGTCGACGGGCTGTGCAAGGAA
TCGAGAGTGGAAGACGCGCGACTTCTTATGGAAAG

> SEQ ID NO: 5620 119915 135513_300415_1b
GGTTTCTCACCCACACCATGCACATATGGCCTCTTCTTGATGGCCTGTTAAAAGCTGGAAGGATAGAAGATGCAGAAA
ATCTTTTCAATGAGATGCTGGAGTATGGATGCAAGGCCAATTGCACTATCTATAATATACTACTGAATGGACATCGAAT
AGCTGGTAATACAGAGAAGGTCTGTCATTTGTTTCAGGATATGGTTGACCAGGGAATAAACCCAGATATAAAATCCTAC
ACGATTATTATTGACACACTCTGCAAGGCAGGACAGTTAAATGATGGTCTAACATATTTTAGGCAATTATTAGAGATGG
GTCTTGAACCTGATCTAATTACTTACAATTTGCTCATTGATGGTCTTGGAAAATCAAAAAGATTAGAGGAAGCAGTTTC
TCTATTCAATGAGATGCAGAAGAAGGGAATTGTCCCGAACTTGTACACTTATAATTCACTAATTCTCCACTTAGGAAAA

FIG. 2 continued

GCAGGGAAGGCTGCTGAAGCTGGGAAAATGTATGAAGAGCTACTGACGAAAGGCTGGAAGCCTAACGTTTTCACGTATA
ACGCTCTTATTAGGGGATACAGTGTTTCCGGCAGTACTGATAGTGCCTATGCTGCCTATGGACGGATGATT

> SEQ ID NO: 5621 120147 106107_300458_1b
CGTTCTCAGAGCTCTTCTGCTTTTTGCGATCTCTGATTTTGAAATTTCGAACTCTCTCTCATTCTCTGCAATTTCAACT
AAGAGGAAACTATGAAGGGAACTAAGATTGCTTCCGTTGCTCACAAGAAGCTCGACACTGAGACAATGAAGAAACGCAA
GGCTGAAGCGGACTTGAAAAAGAAGGAGAAAGCAATCAAAACCGCTGGAGCTCCAAAGCGTCCTCCTACCGCATTCTTC
ATTTTCATGGCTGATTTTCGCAAGAGTTACAAGGAGAATTTTCCTGATAATAAATCTGTTGCTGTGGTCGGAAAAGCTG
GCGGTGAGAAATGGAAGGCAATGTCTGAATCTGAGAAAGCTCCCTATGTGGAAAAAGCTGCTAAGCTGAAGGCTGAGTA
TGAGAAAACTAAGGAAGAGCATAGCCAGAAGCCTGTTAATGGAGAAGCAGCAAAATCTGATGATTCGGAGGTGCATGAT
GATGCTGAGCAGCAAGCTAGCTCTTAGAGTGGTACATAGTTCTTTTGCTCCAATGCTGATATGGCAAGTGAAAGCCGCT
GGGAAAATTCATATAGCTAATCAAGTGTTAATACATAGTTATAGCTAGTTATAACTCTAGTATTAGTATATTTCTTCTG
TCGCAAGTCCTATTATCAGCTTATGCTCATGTTCGCCATTTTGCACTGCAATGCAAAGCAGATTATGGATTGAGTATGC
TTTTGATTCTG

> SEQ ID NO: 5622 120147 1109873_301525_1b
TTCTTTTTTCTACTCGAATCCAAGCTTTTTTTTATCTCCGTTCTTCTCCGGCAGACAGACATTTCCTCCGTTGTTCTCC
GTCGTCCTCGACATTTCCACCTCTCGTCTCGCTTAATCGGTAAAACAAGAGAACAAAGAAAAGGGAAGTATGGCGAAGG
AGAAATCTACCGGTAAGCAGAAACGCCAGGCGAAGAAGGACACCAATAAGCCTAAACGGCCTGCCTCTGCTTTTTTTGT
ATTCATGGAGGAGTTCAGGAAATCATACAAGGAAGCTCATCCTGATGTCAAAGGAGTTTCCGAGATTGGAAGAGCCTGT
GGTGAAAAGTGGAGAGAGATGACAGATGAGGAAAAAGTTCCTTATGTATCTCGGGCTGCTGTGAGAAAGGCGGACTATG
ACAAGGCAATGTCAGCTTACAACAACGAAGAGATGAATAGGTCTGCCCAAGCGAAGACCAGTGCATCAAATGGGCACGC
TGGGAGTGAGGATGAGTCCGAATAGCCTGCCTAAGGGAGTAAATGCAGGCGATACTCTATATATGCTGTCTCACTGTTG
ACCAGCTAATGTGCTTGTGGATATAGTTTACTTAACTCGTTTTTTAGTTCTCTCAAAAGATTTCTGCTGTTAAACACAA
AAAACTGTCAAGCCTCAGATTTTCGAGCAAAGTTTGAGTAGCCTTTTTAACATTTTGAAACAGCTCCACTTTTCTTGCC
TGCCCAAGAAAATTGACATGGAAAAGAGGTACA

> SEQ ID NO: 5623 120147 145354_301059_1b
TTCTCTTTTGGCTTTTGCTCTGTTTTCTTCACTTTCCCTTCAGCCCATTACTTCTTAGCTTCCTGGCAGTTCTAAGTTA
CAATGAAGGGTGGAAAAGGAAAAGGGGCGTTGAGAAAAGAAACAAGGTCTGCACTGAAGCCTGTTGAGGACCGAAAGAT
GGGGAAGAGAAAGGCCGCATTGAAGGATGATAAACGGAAGGCCAAGAAGGACAAAAAGGCCAAGAAAGATCCTAATAAG
CCTAAGATGCCTCCCAGTGCCTTCTTCGTATTTCTTGAAGAATTCAGGAAGACATTTAAAAAGGAAAATCCTAACGTGA
AGGCCGTATCAGCTGTAGGGAAAGCTGGAGGAGAGAAGTGGAAATCTATGACGCAGCTGAAAAAGCACCATATGAAGC
CAAAGCAGCAAAAAGGAAGTCCGAGTATGAAAAGCTCATGCATGCGTACAACAACAAGCAGCCGGAAAGCTCAGACGAT
GATGGCGAAGAAGAATCTGAGAGGTCAAAATCTGAGGTACATGATGATGATGCAGAGTGCAGTGGACAGGGTGAAGAAG
AAGAGGAAGAGGAAGAGGAAGATGATGAAAACGAGGACGATGATTGAAGCTATGTGCTTCAATCACTTGGTTTTTGTAC
TTATTGCCATCTGACAAGGGTTGAGTGACTCT

> SEQ ID NO: 5624 120147 136745_300438_1b
CCCCCCCCGCTCTTCTCTTCTCTGGTGGTGTGGGTGTGTCCCTGTCTCCCCTCCTTCCTCCTCTCCTTTCCCCTCCTCT
CTTCCCCCCTCTCACAAGAGAGAGAGAGCGCCAGACTCTCCCCAGGTGAGGATTCAGCCATGAAGGGGGCCAAATCCAA
GGGCGCCGCCAAGCCCGACGCCAAGTTGGCTGTGAAGAGTAAGGGCGCGGAGAAGCCCGCCGCCAAGGGCAGGAAGGGG
AAGGCCGGCAAGGACCCCAACAAGCCCAAGAGGGCTCCCTCCGCTTTCTTCGTTTTTATGGAGGAGTTCCGTAAGGAGT
TCAAGGAGAAGAACCCCAAGAATAAATCTGTCGCTGCTGTAGGAAAAGCAGCCGGTGATAGGTGGAAATCCCTGACCGA
AGCGGACAAGGCTCCCTATGTAGCCAAGGCCAACAAGCTCAAGGCCGAGTACAACAAGGCCATTGCTGCCTACAACAAG
GGCGAGAGCACTGCCAAGAAGGCACCCGCCAAGGAGGAAGAGGAGGACGACGAGGAGGAATCTGACAAGTCCAAGTCCG
AGGTCAATGATGAGGATGACGACGAGGGCAGCGAAGAGGATGAAGACGATGACGAGTGAGCCTTCCAGTGGACAAGATG
GGAGCAGCAAGACGCTAAGGGCGGCGGGCGTCCTAAGGAGCCTATCCATCATCATCATCGTCTACTAGAATTATTC
AGTTTCACTTCACATCGTGATGTTTTACTTTTTCTCGTCCTATAACGGATAGCGCTCCTTGTTGGCGCCACTGGTGG
GTGTTGT

> SEQ ID NO: 5625 120147 113129_300022_1b
CCCACGCGTCCGCAGTCCCTCACTTGGAACCTTCTTATCGGTCGCCCCTTCGCTTACCGAATTCATCACAACGCACCAA
AGGAATATACATCTCTTTGTTTTCTCTCTCTAGAGGTTTCGCTATGAAAGGAGTTAAATCTAAGGCTGGAGCTGATTCC
AAGCTTGGAGTAAGGAAGAAGGCTACGGAGAAAGCGAAGAAAGCCACGAAGGATCCAAACAAGCCTAAGAGGC
CTCCAAGTGCCTTCTTCGTTTTCATGGAGGAGTTCAGGAAGACGTACAAGGAAAAGCACCCAAGCAACAGATCTGTTGC
CACTGTTGGTAAAGCTGGCGGAGATGCGTGGAAAAAATTGTCAGATGCTGAGAAAGCACTTTACCAGGAAAAGGCTGAT
AAAAGAAAGGCGGAATACCAAAAGAACATGGATGCCTATAACAGAAAACAGGCTGGTGATGCTGAAGAGGAGGAATCAG

FIG. 2 continued

ACAAGTCAAAGTCTGAGGTTCATGATGATGACGAGGATGATGATGGAAGTGAAGAGGAGGAGGATGATGATTAAAAACT
GAATAGCTGTTGAATTGCCGAAAATTATGGCAAAGTTGATGTAGGGAATCCCTTTCAGCCCTTTCCTTGATAAATAGAT
GCCCTCTTTTTGATGTTTCCTTTCTTTTTGTTTTGGTATTTTTCGGGGTTTAGTTGGGACGGGATAAGGGAAATTTAGA
TGAGCTGACTTGATAGCTCGAATGGCTTATGTATTTTTATTTTGGTGGTGTTTAATGAAAAATTCAGCTACGGATTACC
CTTTGTTGGTAGTATTATGAATTTCATCTAATCCGTTTCGTGATGATGCAAGTTTGATGCCAGATATATTTT

> SEQ ID NO: 5626 120147 1118044_301852_1b
TGGGTGTTATTATTATTTTAACTTTGTAGGGAGTTAGTAGTAGCAGTACTGGTTAACAGTTTTTGTTTATAATTTGAAC
TACTTTGCAAAGAAGGGAGGGGGAAGAGAGCTATTACACCTAATCACTTACCTTCAACGGGGCTTGCCATCTCCCGCAG
GCACAATGAAGGGAGCAAAAGGGTCAGCTCTTCCTGCCAAGAAGGACAACAAAGGCCTGTCAAGAAGGCTGAAGAAAC
TAACTTAAAGAGAAAGAAGTCAGTTGCAACAGAAGGGAAAGCGAAGAGGCAGTCCAAGAAACCTGCCAAGGATCCCAAC
ATGCCTAAGAGACCTCCTGGTGCTTTCTTTGTCTTCATGGAGGAGTTTAGGAAGACCTACATGGCTGAGCATCCTGGAA
CTAAATCCGTGTCTGCGGTGGGCAAGGCTGCTGGGGACAAGTGGAAGTCATTGTCTGAAGCGGAGAAAGCCCCGTACTC
TGCCAAGGCTTTGAAGAAGAAGGGCGAGTACGAGAAGTCCATGCAAGCGTATAACCAAAAAAAGAGTGCGGCGGAAGCT
AAAAAGTCTGAGGCTCAGGAAGAGGAAGATGAAGAGGAAGATGACGAGGACGAGGTCGAGGAGGATGACGACGAGTAGC
CATGTTATCTTCAACAAATCTCTCTTTAACCCATCTTTTATTCAAATCAGGCGTGCCTTCCTTGTTATTGGCAAGGAAT
GGAAGGTCTCTGTTTGTAGAAGACTATAACCTCGTAGTTATCTTTTGTAT

> SEQ ID NO: 5627 120147 1098148_301483_1b
TTCGTTGTGTTGTGTGCTGGGGTCTTTCTCTCTCTCTCTCTCTCTCTCTTTCTTCGTATTTCTCGTAATACGAAGGG
AAACTCTCTATAGTTTTTAGTAGTTACGTTTTTATTACTAACAACTAGTAGTACTACTACTACAACGAGGCGAAGCTCG
CCATCTTTACGACGATCTCCAGGCACAATGAAGGGAGCAAAAGGATCTGCCATACCTGCCAAGAAAGATAACAAAAGCC
TCTCAAGAAGGCTGAAGAAACGAACCTGAAGAAGAAGAATCAGTGGCCAAGGAAGCAAAGCCAAAGAGGCAGTCAAA
GAAAGCTGCCAAAGACCCTGACATGCCTAAGAGGCCGCCTAGTGCTTTCTTTGTCTTTATGGAGGGCTTTCGGAAGACA
TACATGGCCGAACACCCTGGTGTTAAATCTGTCTCAATAGTGGGTAAGGCTGCTGGAGACAAGTGGAAGTCACTATCTG
AAGCGGAGAAAGCCCCATATGCTTCCAAGGCTCTGAAAAAGAAGGCTGAATATGAGAAGTTGATGCAAGCGTATAAACA
AAAAAAGGTTGCAACTGAAGCTAACAAGTCTGCGGTCCATGAAGATGATGAGGAAGAGGAGGAGGAAGAGGAAGAGGAA
GAGGAAGAGGAAGATGATGAATAGAATCACACATCTTCACCATGGTTGATTCCAGATTCTTGGTTGTGATAACGGAGCG
ATGGCCCAGTCATTGCAATCCTCTTTTGGACCATCTCAAAGGCAGTTTAGGTTGT

> SEQ ID NO: 5628 120147 1101628_301528_1b
GCTCTCTCTCTCTACTCCCTCTTTCATCCTCAGCAGCCCTTTCCCTAACTTGCCTTCTTCCCCAACACTAATCAAAGCG
TTGATATGGCAAAGGAGAAGTCTGGGGGAAGGCAAAAGAGGCAACAAGCGAAGAAAGATCCAAATAAGCCCAAGAGGCC
TGCATCTGCATTCTTCATCTTTATGGAGGATTTCAGGAAATCATATAAGGAAGCCCATCCTGACGTCAAAGGGGTTTCA
GAGATAGGAAGAGCATGTGGCGAGAAATGGAGAGAGATGACAGACGAGGAAAAGGCTCCATATGCAACTAAAGCTGCTT
CAAGGAAGGCCGATTATGATAGAGCAATGTCAGCTTTCAACAATGGAGAGGTGGCAGGCAAGAGCAATGGGGCAAGTGC
TCTTGCTGAGAGTGAGGGGAGTCTGAGTAGACCAAATGATGGAATAAGTGAGGCTCTACCAGAACCCAGGAAATGTTG
AATGGTTGGTTGTGCCTTTTTTACTCCCTTCAAAACTGTCCTCTTTCATGTATCACACACCATCCCTTGCTTAATTTGC
TTTGGCAATCTTTACAACCTCCTAGAAAATCCATGTTTCTCCTCTTTAGAGAGGATTAGTTTGGACTTCATGTATTTCT
CTGGGAAACAATTGCAGCAGCTCATAATCTGTGGGAAACTATCTTGTGATCATTC

> SEQ ID NO: 5629 120147 1109461_301531_1b
TTTCTAATACAAAGAAAGAGAGAGAGAGAGAAGTTGTAATAACGAGATTACTACTACTACAACATAAAAGAAAGAGAGA
GAGAGAGAGATTTGCAAGCTTTTTTTACGACGAATTGCCAACCCACCCAGGTTTCTTCGTCCTCAGGCAGCACAATGAA
GGGAGCAAAAGGATCAGTTGCAGCACTGCCACCACCTACCAAGAAAGACAACAAAGGCATATCAAAGAAAGCGGAAGAA
ACAAATTTAAAGAAAAGGAAATCCGCAGTGAAGGAAGTGAAGCCCAAGAGACAGCCTGTAAAAGCTGTGAAGGACCCAA
ATAGGCCCAAGAAGCCTGCTACTGCTTTCTTTGTCTTTTGGAGGAGTTCAGGAAGACCTTCATGGCTGAGCACCCTGC
GGTCAAAGCTGTCTCTGTAGTTGGCAAAGCTGGTGGAGAAAGTGGAAGTCGCTAACAGAGGCGGAAAAAACTCCATAT
GTCGCCAAGGCAGCAAAAAGAAAGACTGATTATGAGAAAACTATGCAGGCATATAACCAGAAAAAGGATGTAGCAGAAG
CCGAGAA

> SEQ ID NO: 5630 120147 254925_301640_1b
ACGCGTCGGTCTCGTTGTAGCACTTGGGACGATGCTTTCTCTCTCTCTCTCGTTTTAGGACCACCTCGGTCGCCATA
GCTAGTGTCTACCCTCTTTCATCCTCAGCAGCCCACCCCCCCTTGTATTCTTCCCTAACATTACCTATCACTTATCAAA
GCGTTGATATGGCAAAGGAGAAGTCTGGGGGAAGGCAAAAGAGGCAACAAGCGAAGAAAGATCCAAATAAGCCCAAGAG
GCCTGCATCTGCATTCTTCATCTTTATGGAGGATTTCAGGAAATCATATAAGGAAGCCCATCCTGACGTCAAAGGGGTT
TCAGAGATAGGAAGAGCATGTGGCGAGAAATGGAGAGAGATGACAGACGAGGAAAAGGCTCCATATGCAACTAAAGCTG
CTTCAAGGAAGGCCGATTATGATAGAGCAATGTCAGCTTTCAACAATGGAGAGGTGGCAGGCAAGAGCAATGGGGCAAG

FIG. 2 continued

TGCTCTTGCTGAGAGTGAGGGGGAGTCTGAGTAGACCAAATGATGGAATAAGTGAGGCTCTACCAGAACCCAGGAAATG
TTGAATGGTTGGTTGTGCCTTTTTTACTCCCTTCAAAACTGTCCTCTTTCATGTATCACACACCATCC

> SEQ ID NO: 5631 120147 255274_301647_1b
TGCTGGGGTCTTTCTCTCTCTCTCTCTCTCTCTCTTTCTTCGTATTTCTCGTAATACGAAGGGAAACTCTCTATAGT
TTTTAGTAGTTACGTTTTATTACTAACAACTAGTAGTACTACTACTACAACGAGGCGAAGCTCGCCATCTTTACGACGA
TCTCCAGGCACAATGAAGGTTTCAAAAGGATCTGCCATACCTGCCAAGAAAGATAACAAAAGCCTCTCAAAGAAGGCTG
AAGAAACGAACCTGAAGAAGAAGAAATCAGTGGCCAAGGAAGCAAAGCCAAAGAGGCAGTCAAAGAAAGCTGCCAAAGA
CCCTGACATGCCTAAGAGGCCGCCTAGTGCTTTCTTTGTCTTTATGGAGGGCTTTCGGAAGACGTACATGGCCGAACAC
CCTGGTGTTAAATCTGTCTCAATAGTGGGTAAGGCTGCTGGAGACAAGTGGAAGTCACTATCTGAAGCGGAGAAAGCCC
CATATGCTTCCAAGGCTCTGAAAAAGAAGGCTGAATATG

> SEQ ID NO: 5632 120147 255223_301647_1b
TGGGTGTTATTATTATTTTAACTTTGTAGGGAGTTAGTAGTAGCAGTACTGGTTAACAGTTTTGTTTATAATTTGAACT
ACTNTGCAAAGAAGGGAGGGGGAAGAGAGCTATTACACCTAATCACTTACCTTCAACGGGGCTTGCCATCTCCCGCAGG
CACAATGAAGGGAGCAAAAGGGTCAGCTCTTCCTGCCAAGAAGGACAACAAAGGCCTGTCAAAGAAGGCTGAAGAAACT
AACTTAAAGAGAAAGAAGTCAGTTGCAACAGAAGGGAAAGCGAAGAGGCAGTCCAAGAAACCTGCCAAGGATCCCAACA
TGCCTAAGAGACCTCCTGGTGCTTTCTTTGTCTTCATGGAGGAGTTTAGGAAGACCTACATGGCTGAGCATCCTGGAAC
TAAATCCGTGTCTGCGGTGGGCAAGGCTGCTGGGGACAAGTGGAAGTCATTGTCTGAAGCGGAGAAAGCCCCGTACTCT
GCCAAGGCTTTGAAGAAGAAGGGCGAGTACGAGAAGTCCATGCAAGCGTATAACCAAAAAAAGAGTGCGGCGGAAGCTA
AAAAGTCTGAGGCTCAGGAAGAGGAAGATGAAGAGGAAGATGACGAGGACGAGGTCGAGGAGGATGACGACGAGTAGCC
ATGTTATCTTCAACAAATCTCTCTTTAACCCATCTTTTATTCAAATCAGGCGTGCCTTC

> SEQ ID NO: 5633 120147 51825_300090_1b
CCCACGCGTCCGTATTTTACAAGCCTTTCTCCACTAAGCCCTTCTCTCTTCTTCTCTTGGCCTCTCACTTGAATCTCCC
ACAAAGCGATCAATCACAAATTCCTTCTTCTCTCTCTTTCTTTTCGTCCCAAGAATCAATTATGAAAGGAGCTAAATC
AAAGACTGAAACCAGGAGCTCCAAGCTCTCTGTGACCAAGAAGCCGGCTAAAGGAGCAGGACGTGGCAAAGCCGCTGCG
AAGGACCCCAACAAACCAAAGAGGCCAGCCAGTGCTTTCTTCGTGTTCATGGAAGATTTCCGTGAGACTTTCAAGAAGG
AAAACCCCAAGAACAAGTCTGTAGCTACTGTTGGAAAAGCTGCTGGAGACAAGTGGAAGTCCTTGTCTGATTCTGAGAA
AGCTCCTTATGTTGCTAAGGCTGAGAAACGCAAGGTTGAATATGAGAAGAACATTAAAGCTTACAACAAGAAACTGGAG
GAAGGTCCAAAGGAAGATGAGGAATCTGACAAGTCAGTGTCAGAGGTCAATGACGAGGATGATGCTGAGGATGGTAGTG
AAGAGGAGGAGGACGATGACTAAGAAGCTGAATGTTGGTAGCATTAGTATAGATGGCTGCAAAAATCTCTCTGGTTTTA
TCTTTACTTGAAATGTTAACGGGGCTGATTAAAATGGGTCTTTCTTTTTATC

> SEQ ID NO: 5634 120147 6691_300347_1b
CCCACGCGTCCGTATTTTACAAGCCTTTCTCCACTAAGCCCTTCTCTCTTCTTCTCTTGGCCTCTCACTTGAATCTCCC
ACAAAGCGATCAATCACAAATTCCTTCTTCTCTCTCTTTCTTTTCGTCCCAAGAATCAATTATGAAAGGAGCTAAATC
AAAGACTGAAACCAGGAGCTCCAAGCTCTCTGTGACCAAGAAGCCGGCTAAAGGAGCAGGACGTGGCAAAGCCGCTGCG
AAGGACCCCAACAAACCAAAGAGGCCAGCCAGTGCTTTCTTCGTGTTCATGGAAGATTTCCGTGAGACTTTCAAGAAGG
AAAACCCCAAGAACAAGTCTGTAGCTACTGTTGGAAAAGCTGCAGGAGACAAGTGGAAGTCCTTGTCTGATTCTGAGAA
AGCTCCATATGTTGCTAAGGCTGAGAAACGCAAGGTTGAATATGAGAAGAACATTAAAGCTTACAACAAG

> SEQ ID NO: 5635 120147 207493_300805_1b
GGGTGTGTCCCTGGCTCCCCTCCTTCCTGCTCTCCTTTCCCCTCCTCTCTTCCCCCCTCTCACAAGAGAGAGAGAGCGC
CAGACTCTCCCCAGGTGAGGTGAGACCAGTCTTTTTGCCCGATTCGACGCGCCTTTCACGCCGCCTCGCGCGGATCTGA
CCGCTTCCCTCGCCCTTGTCGCAGGATTCAGCCATGAAGGGGGCCAAATCCAAGGGCGCCGCCAAGCCCGACGCCAAGT
TGGCTGTGAAGAGTAAGGGCGCGGAGAAGCCCGCCGCCAAGGGCAGGAAGGGGAAGGCCGGCAAGGACCCCAACAAGCC
CAAGAGGGCTCCCTCCGCTTTCTTCGTTTTTATGGAGGAGTTCCGTAAGGAGTTCAAGGAGAAGAACCCCAAGAATAAA
TCTGTCGCTGCTGTAGGAAAAGCAGCCGGTGATAGGTGGAAATCCCTGACCGAAGCGGACAAGGCTCCCTATGTAGCCA
AGGCCAACAAGCTCAAGGCCGAGTACAACAAGGCCATTGCTGCCTACAACAAGGGCGAGAGCACTGCCAAGAAGGCACC
CGCCAAGGAGGAAGAGGAGGACGACGAGGAGGAATCTGACAAGTCCAAGTCCGAGGTCAATGATGAGGATGACGACGAG
GGCAGCGAAGAGGATGAAGACGATGACGAGTGAGCCTTCCAGTGGACAAGATGGGAGCAGCAAGACGCTAAGGCGGCG
GGCGTCCTAAGGAGCCTATCCATCATCATCATCATCGTCTACTAGAATTATTCAGTTTCACTTCACATCGTGATGTTTT
ACTTTTTCTCTCGTCCTATAAC

> SEQ ID NO: 5636 120246 191478_300785_1b
CCCCCTTCCTCCCTCTCCTCTCCTCTCCGCCGCTGCCGCTGCTGCTGCGTGCTCCTCTCATCCCCGTCTCTTCCCCCTC
CGCGCGCGCCGCCCACTCGCTGGGAGGAGGAGGAAGAGGAGACCTTCCCCGGAATTCGTGCTCGCCGGATCGGGCTCGC

FIG. 2 continued

CGCAATCCATGTCGGAGGAAGCAGGTCGACCCTTGCCCAAGTTTGGTGAATGGGATGTCAACGACCCAGCTTCTGCTGA
TGGATTCACAGTGATATTCAACAAAGCCAGAGATGAGAAAAAGGGTGGGAATGGGCAAGATACTGATTCACCCTGCAAA
GAGACTAGGACTGAGAGGGTGGAATCATATGCCCCCAAAACAAACTCGAAGAAATGGTTTTGCTGTGTGACATCCAGTC
CTACACAATCTTGATGAAAACGAGTTCCATGGGTTGCAAAATTACTATCCTTTAATTTTGCTATATACATACTATCCAT
AAGACCTTGTAGAGATGCCCAGACTCTGCTGTGGTGCTTGATTGGGCATCTCTTAAAACTCTGAGGTGTGTGTATGTAT
GTGTGAGGGGTTATCAGATGCACATTCGGATAAATGAACTTCTGATTG

> SEQ ID NO: 5637 120246 282242_200073_1b
TTTCTCTCTCTTGCTGCACAGCACCAGTCATATTCTCTGAAGAACACTTCTGACTTATCCCGGATTCATGTCGCAGGAA
AAGGGTCAACCATTGCCTAAGTTTGGTGAGTGGGATGTCAATGACCCAGCTTCAGCAGAGGGATTCACAGTGATCTTCA
ACAAGGCCCGAAATGAGAAAAAAACAGGTGGCAATCCAGAATCACCTTCAAAGGATGATTCCAATACAAAGCAAGCAGC
AGACCCGTTCAAACCTCAAGCTAAAAAATGGTTTTGCTGCTTGCAAAGCCCCCATGCAGAATCCTGATAAGGTTATCTG
TCTGCCAAAGTCGAATATTGGATTCTTATTCATAACGAACTCCAGAACTTCCTTTGTGTTGGCGCTGGAGATAGAGGAA
CTGCTCGAGTCCTTTTTGTCTTGTAAACTTGTGATAGTGGGGAGAATGTGAAAAACAACATGCTTGATGTACCTATGTG
ATGTATTTTGTATTTTACATTTAGCAGACAAAGTTTTCGATTGCGTTCATATACGTGTGATTAG

> SEQ ID NO: 5638 120342 8148_300316_1b
AATTCGGCACGAGATTTGAATGGACGATCTATGTACCTTGTCGGAATGATGGGTTCTGGGAAAACAACTGTGGGAAAGT
TAATGTCCAAAGTGCTCGGTTATACGTTCTTTGACTGCGACACTTTGATTGAACAGGCGATGAATGGAACTTCTGTTGC
AGAGATATTTGTTCATCACGGAGAGAATTTTTTTAGAGGAAAGGAGACCGATGCGCTTAAGAAGCTCTCTTCGAGGTAT
CAAGTTGTTGTTTCCACAGGTGGAGGTGCAGTTATAAGACCCATTAACTGGAAGTATATGCATAAAGGAATCAGCATTT
GGCTAGATGTGCC

> SEQ ID NO: 5639 120342 248941_301588_1b
GCGTGATCAATCCATTCCGATGAGCTGCGCCATGGATTGCGTCTTGTCAGGGCCATCGCCTTCGAATTCCGTGGAGCTG
CGCGGCGGCGGCGGCGATGGATTCGCCTCGCGGAAGCTGGGGATCGAGCAGCTGCATTTCGGGCTCCAATCGCGAGCCA
GGGTCGTCTCCTCCAGGAATCGGTCAATTCATCCCCGGGCGAGGCGGGCAGTGGTTGTGTGCTCGCAAAATGGGTACAA
TGTAGCCGCCACAGACTCTGCTAACGTCAACTCTGCTCTAAAGACTAAAGGCAAAGAATTGGCCAAGGATCTCAGGGGG
ACGTGCTTGTTCCTAACTGGGATGATGGGCAGCGGGAAGAGCACTGTTGGAAAGCACTTGGCGGACGCGTTGGGATACT
ACTTCTTTGACAGTGACAAGCTTGTTGAGCAGGCAGCCGGGGGTGCCAGTGTAGCTCAGATCTTCAAGGAAAACAACGA
AGAAGGCTTCCGCGACGCCGAGAGCGAGGTCTTGAGCCAATTGTCCGGAATGTTCCGTCTGGT

> SEQ ID NO: 5640 120342 130706_300490_1b
GAATTCAAGATCTTATTTGATCTTTTAACACCTCGGATTATATCTAGAGTTTGTAAATTTTGATTTCTGTTTGGGGTTT
TAGGTTATTTGGAATTTTGGGGAAATGGATGCAACTACATGTGCTTCAAGTTTGAATTGTTATAAGCAAAATGGGTTT
AATGAGATAGGGAGGAGGAAGAAATCATCTAATGGGTTTTGAGATTATCATCTGACAGAAATGGAGAGATTGTAAGTT
TAAAGATGATTAAATCTAGGGATTTGAGATGTAATAAGAATTTGGGGCACAGGAAATTGGATGGGTTTGAGCTTTCTTG
TTCTTATAAGAATTATCAAGCTCCAGCATTGGAGTCGGAGAAAAGTCGCGGTTTAGTTGACGAGCCTTCCATTTTGAAG
AAAAAATCTCAAGATGTTGTGCCATACATGAATGGACGTTGCATATATCTTGTTGGAATGATGGGTTCTGGAAAAACAA
CCGTGGGAAAGATTTTGTCGGAAGTATTAGGTTATTCTTTCTTTGACAGTGACAAATTGATTGAACAGGCTGCTGGTGG
AACTTCTGTTGCTCAGATCTTCAAACAGTATAGTGAGAGTTTTTCAGAGATAATGAGAGTGAGGTACTGAAAGAGTTA
TCTTTAATGCGTCGGCTGGTTGTTGCCA

> SEQ ID NO: 5641 120670 103425_300026_1b
TGGTATCAACGCAGAGTGGCCATTACGGCCGGGATACCAGAATTTGTCAACACACAATTTTTCCTCTTTTTCTTGCGCT
AAATTCGAAAGGGTATGTCCTGAAATTAGGTGTAAGAGCAAATAGTTGAGATATATTAGTAATAAAGATGAAGATCCAG
TGTGATGTATGTGAGAAAGCTCAAGCTACTGTAATTTGCTGTGCTGATGAGGCTGCTTTGTGTGCTAAATGTGATATTG
AAGTTCATGCTGCAAATAAACTGGCAAGTAAGCATCAGAGGCTTCATCTTCACTGCCTCTCCAACAAGCTTCCTCCTTG
TGATATTTGCCAAGATAAAGCAGCCTTCATCTTCTGTGTTGAGGATAGAGCTCTCTTTTGCAAGGATTGTGACGAAGCA
ATTCATTCAGCTAGCAGCCTTGCTGCTAACCACCAGCGCTTCCTAGCCACTGGAATTCGAGTAGCTTTGAGCTCAAGCT
GCAATAAGGAAGCAGTAAAAACCCAATTGGAGCCACCACAACCACCTCAGCAGAACTCCCAACAAGTTGGTTTGAAAAT
GCCTCCACATCAATTGTCCGGTATCACGTCACCGTCTTGGCCTGTTGATGATTTACTAGGATTTCCGGATTATGATTCG
ACTGACAAGAAGGAACTACTTGAACTTGGTGAACTGGAGTGGTTGGGGACATTGATCTCTTTGGTGAACAAACAGCAG
CTGAAGTACCCGAGCTATCAGTATCTCAGTCGAGCAACACACATAATATTTACAAGCAAACCAGATATCAAATGTCTTA
CAAG

FIG. 2 continued

> SEQ ID NO: 5642 120859 273915_200055_1b
GGGTTACAATCAAAGGCATTCTTGGATTGTTAATGGCTAATGTAGAAACAACTGAAGATGAAGATGAAGAAAATGTTGG
AAATTTCAAGAAAAATAAGAGGAAGAAGAAGGTTATATCATTAGGAATGGGTGATCCTACAGCTTATTCTTGTTTCCAT
TCTCCTGATGTTGCACAAAATGCTGTTCTTGAAACTCTGGCTTCTCACAAATTTAATGGTTATTCTCCTACTGTTGGCC
TTCCTCAAACCAGAAGGGCAATTGCAGATTATTTGTCGCGTGACCTTCCAGAAAAATTATGTGCAGATGATGTTTATGT
CACAGCTGGTTGCACTCAAGCCATTGAAATAGCCTTGTCAATTCTGGCTCGCCCCTCTGCTAACATATTACTACCAAGG
CCTGGTTTCCCAATTTATGCACTTTGTGCTGCCTTTAGCACATCGAAGTTCGATACTTTGATCTTGTTCCGGACAAAG
GCTGGGAGATTGATCTCAATGCTGTCGAAGCTCTAGCTGATCGTAACACTATTGGCATAGTTGTTATAAATCCGGGGAA
TCCTTGTGGAAACGTTTATAGTTACCAGCATCTTCAAGAGGTTACTCTTAGTACTCTTTTTAAATGCAACGATTACTTC
CTCAGTTTTATTTCATGCCTTAGTTTGCCCGAGCATGAAGTTTAAGAATGCAAAGAAATTTTCTGCAGCTTATCGTCTT
AAACTAAAGGTGTGTATAACATACCAAAATACCCTTTGAATTTTGTGGTCTTAGACATAGTAGTGTCATTAGGGTAAAA
TGAGAATGTTGAAATTAAGAGTCTACTAAATATAGAAAGGCGACATTCCTTTTGAAACAGATTAAAAAAGGAAAGTAAG
ACATAGAAATTAAAACGTGTGGAATACTATTCTTTCCTTTCTTTTTGCAGTTTGCATTAGTTCTAAGAA

> SEQ ID NO: 5643 120870 254824_301639_1b
GTCTTCTTCAGTTTGCCGGAGTCATTTTCCCTTCGAGGGGTTAAGGTTGTCTTTTCACAGCCAATTACTTGAGAATGGC
CAACCCACATGTCTTCTTTGACATGGCCATCGGCGGCGTCAGCGCTGGTCGCATTGTGATGGAGCTGTACAGTGACACA
ACCCCAAGGACTGCGGAGAATTTCCGGGCCCTGTGCACGGGGGAGAAGGGCACTGGGAGCAGCGGGAAGCCCCTCCACT
TCAAGGGCTCCTCTTTCCACAGGGTCATCCCCAACTTCATGTGCCAGGGTGGCGACTTCACCCGTGGCAATGGGACTGG
TGGGGAGTCCATCTATGGCACTAAGTTTGCCGATGAGAACTTCTCCAGGAAGCACACAGGTGAGGGTGTCCTCTCCATG
GCCAACTCTGGGCCCAACACCAATGGGTCCCAGTTTTTCATCTGCACTGTCCCCTGCAACTGGCTCGACGGGAAGCATG
TTGTGTTTGGCCGTGTTGTCAATGGGATGGACGTAGTGAAGACCATTGAGAAGGTTGGTTCGAGCTCTGGAAAGACCAG
CAAGCCTGTTGTAGTAGCTGACTGTGGTCAGCTCTAAGCACTAGTTAGTAATATTGATGATAAAGCTTAATAAAGTTTG
CCTGGAGTTGTAATTGGACTAGTTTGGATGGTTTGGTTGGTTAGCCCAGTCTATGTACCGCTTGGCTACTAC

> SEQ ID NO: 5644 120870 104480_300410_1b
GCCATTACGGCCGGGGAAAAATTGTCCCGAAGACAGGGGAGAACTTCAGAGCTCTTTGCACGGGGGAAAAAGGAACTG
GGAAGGCTGGAAAGCCTCTCCATTACAAAGGTAGCACTTTCCACAGGATCATACCGAGCTTCATGATCCAGGAGGCGAT
TTCACTCGTGGTGATGGGCGAGGTGGAGAATCTATATATGGTGAAAGCTTTGCAGATGAAAACTTTTATCTAAAACACA
CTGTACCTGGTATTCTGTCAAATGCTGGACCGGACACCAATGGGTCTCAATTCTTTATCACAACTGTAACCAC
TGGCTGGTTGGATGGGCATCATGTTGTCTTTGGCAAGGAGCTGTCTGGCATGGATGTTGTCTACAAAATCGAAGCAGAA
GGGAGAGGAAGTGGAACCCCAAAAAGCAAAGTTATGATATCAAATAGCGGGGAACTCCTTAATGATCCAACTTTCCATG
TATCAAAACACCTCAGATGTTTTGATAATGCTTGCCCTCGAGCAAAAGGCAGTTTCATATGCTGGCAAGAAATCTGTTA
TGCGACTATTGCGGCCTGTAAAGTTAAAAC

> SEQ ID NO: 5645 120870 142964_300474_1b
CGGACGCGTGGGGTGTTTCCATATATGGAAGCAAGTTTGAGGAGGAAAACTTCATTGCCAAGCACACTGGTCCTGGCCT
ATTGTCAATGGCAAATAGTGGACCAAATACTAATGGATGTCAGTTCTTTGTCACATGTGCAAAGTGCGACTGGCTTGAC
AACAAGCATGTTGTTTTTGGGCGTGTTCTTGGAGATGGTCTTTTAGTGGTCAGAAAGATTGAGAATGTGGCTGTTGGAG
CTAATAATAAACCGAAGCTGGCATGCATGATTGCTGAATGCGGGGAGATGTAACTGGTGAAGACGAAATATACACATAG
TGATTGGTCTATTGACACTAAGGTTTCAGCACATGATATGTACCTGGTTACATTTCCTTGGCTTAGTCTAGAGGGCCTG
TTAAGTTGATTCATGAGCTCATAATGATTTTTTTGACAATAGACAGAGGCTCTATGGGTGAACTATTGGAGTAAAAAA
TTTAGTCTCAAAAGCTTTTTTGCTTGAGCTTGAGTTGGTCCTATGCTCACATTTAGTGAATCCTCTAGACTCTAGTAAT
CATACTTTTGACTTTTGAGATTCCCACTTACCATGACGGGAGAATACATCATTATCATTCTTTTTC

> SEQ ID NO: 5646 120870 143087_301075_1b
TCCGACGTAGACAGCGGTTCTCTAACAGTGAATGCGAACAAAGATGGCAAAGAATTCATTTGTTTTGCTGCTCTTCAGT
TTAGTCATTTTCGGAACTCTAACGTCTGCTCAGGGCAAAAAGTCCCAGGAAAGTCTAAAAGAAATAACTCACAAGGTTT
TCTTTGATGTTGAGATTGATGGTAAACCTGCAGGTCGTATTGTTATGGGTCTCTTTGGTAAAACAGTTCCTAAAACAGC
AGAAAATTTCAGAGCATTGTGCACAGGGGAGAAAGGTATCGGAAAGAGTGGCAAGCCTCTTCATTACAAGGGAAGCACA
TTCCATAGAATAATCCCCAGCTTCATGCTTCAAGGTGGTGATTTCACCCTTGGTGATGGACGTGGTGGTGAATCAATTT
ACGGNGAGAAGTTTGCTGATGAAAACTTCAAGATCAAGCACACTGGACCTGGGCTTTTGTCGATGGCAAATGCTGGTTC
TGACACCAATGGTTCACAATTCTTCATCACAACCGTCACAACTAGCTGGTTGGATGGTCGACATGTTGTGTTTGGA

> SEQ ID NO: 5647 120870 127733_300472_1b
CACAAATCGTACACAGCGAAAACCTCACTGAAAATCTAGAGAGATGGCAAACCCTAAGGTGTTCTTTGACCTTACTAT
CGGCGGCACACCAGCTGGCCGTGTGGTGATGGAGCTCTTTGCCGACACCGTACCCAAGACGGCGGAGAACTTCCGTGCT
CTCTGCACCGGCGAGAAAGGCGTCGGAAGGATGGGCAAGCCTTTGCACTACAAAGGTTCAACCTTCCACCGTGTGATCC

FIG. 2 continued

CAGGGTTCATGTGTCAAGGAGGTGATTTCACCGCCGGAAACGGTACCGGAGGTGAATCAATCTACGGCGCCAAATTCGC
CGACGAGAACTTCAAAAGGAAGCACACCGGCCCTGGAGTCCTCTCCATGGCTAATGCTGGACCTGGAACCAACGGTTCT
CAGTTCTTTATCTGTACCGCTAAGACAGAGTGGCTCGACGGCAAGCACGTTGTGTTCGGTCAAGTTGTTGAAGGCTATG
ATGCGATTAAGAAGGCTGAGGCTGTTGGATCTGGATCTGGCAGGTGCTCCAAGCCTGTTGTGATTGCTGACTGTGGTCA
ACTCTGCTAGATCTGAGGACGTTGATGATGATCTAGTTTATCTATATTTAAGTCGCCGTTTTTGGCTTTGTTTTTAATT
TTAATCTATCGGTTACTGCTTGCTTACTGTGGGTCTAGTTCTAGGGTTGTGCTGTAATTGGTATTGGTTCTACTTCTAC
CAGTTTATGTTTAATCTTAAGACTATGGTTTAAATAAGATAATACTCTTGTTTTCTCTGCT

> SEQ ID NO: 5648 120870 1110904_301538_1b
ATCTTCTTCAGTTTGCCGGAGTCATTTTCCCTTCGAGGGGTTAAGGTTTGTCTTTTCACAGCCAATTACTTGAGAATGG
CCAACCCACATGTCTTCTTTGACATGGCCATCGGCGGCGTCAGCGCTGGTCGCATTGTGATGGAGCTGTACAGTGACAC
AACCCCAAGGACTGCGGAGAATTTCCGGGCCCTGTGCACGGGGAGAAGGGCACTGGGAGCAGCGGGAAGCCCCTCCAC
TTCAAGGGCTCCTCTTTCCACAGGGTCATCCCCAACTTCATGTGCCAGGGTGGCGACTTCACCCGTGGCAATGGGACTG
GTGGGGAGTCCATCTATGGCACTAAGTTTGCCGATGAGAACTTCTCCAGGAAGCACACAGGTGAGGGTGTCCTCTCCAT
GGCCAACTCTGGGCCCAACACCAATGGGTCCCAGTTTTTCATCTGCACTGTCCCCTGCAACTGGCTCGACGGGAAGCAT
GTTGTGTTTGGCCGTGTTGTCAATGGGATGGACGTAGTGAAGACCATTGAGAAGGTTGGTTCGAGCTCTGGAAAGACCA
GCAAGCCTGTTGTAGTAGCTGACTGTGGTCAGCTCTAAGCACTAGTTAGTAATATTGATGATAAAGCTTAATAAAGTTT
G

> SEQ ID NO: 5649 120870 175526_300545_1b
CACGCAGCGATCTGAAGTGAAACAGCAAAAAAAATCAAACAAAAAGAAAAAATATTCCCCATCTGTGAAATTCGCAAAA
CCCTAGCGCGGCGGCGATGTCGAACACGAGGGTGTTCTTCGACATGACCGTCGGCGGAGCTCCGGCGGGCGGATCGTG
ATGGAGCTGTACGCGAAGGACGTGCCGCGGACGGCGGAGAACTTCCGCGCGCTCTGCACCGGCGAGAAGGGCGTGGGCA
AGAGCGGCAAGCCGCTGCACTACAAGGGGAGCACCTTCCACCGCGTGATCCCGGAGTTCATGTGCCAGGGCGGCGACTT
CACCCGCGGCAACGGCACGGGAGGGGAGTCGATCTACGGCGAGAAGTTCGCCGACGAGGTGTTCAAGTTCAAGCACGAC
AGCCCCGGCATCCTGTCCATGGCGAACGCCGGGCCCAACACTAACGGGTCCCAGTTCTTCATCTGCACCGTGCCCTGCA
GCTGGCTGGACGGGAAGCACGTCGTGTTCGGCCGCGTCGTCGAGGGCATGGACGTCGTCAAGGCCATCGAGAAGGTGGG
ATCCCGCGGCGGGAGCACCGCCAAGCCGGTCGTCATCGCCGACTGCGGCCAGCTCTCCGCGGCCGCTTATCCGTATGAT
GTTCCGGATTATGCCGAGCTCTACAAAC

> SEQ ID NO: 5650 120870 230478_301068_1b
GGCGGGAGAGAGATGGAGGGAATGTGGCGGGCGCTGCTGTTGCTGCTGGCGCTGGTGGTGGCGGGGATCTCGCTCTCCG
CCGCCGCGAAGAAGCCGGAGAAGAACCTGGAGGAGATCACGCACAAGGTGTTCTTCGACGTGGAGATCGGCGGCAAGCC
GGCGGGCCGGGTCGTGATGGGGCTCTACGGCAATGCGGTGCCCAAGACGGCGGAGAATTTCCGGGCGCTGTGCACGGGC
GAGAAGGGGACTGGATCCCAGGGCAAGGCGCTCCACTTCAAGGGCTCGTCCTTCCACCGGATCATCCCCAGCTTCATGA
TCCAGGGCGGGGATTTCACCCACGGCAACGGCATGGGCGGGGAATCGATCTACGGCGCCAAGTTCGCCGACGAGAATTT
CAAGCTCAAGCACACCGGCCCCGGGGTCTTGTCCATGGCCAATGCCGGATCCAACACGAACGGATCCCAGTTCTTCATC
ACCACCGTCAAGACGAGCTGGCTGGATGGCAAGCACGTCGTGTTTGGGAAGGTGATCAGCGGCATGGACGTGGTGTACA
AGGTCGAGGCGGAGGGGTCGCAAAGTGGCTCACCCAAGTCCAAGGTCACCATAGCCGACAGTGGCGAGCTTCCACTATA
GTAATTCTTATTTATATTGTACCCGTTTTCCCCCTTGTTTAATTGAAGAGATTGGGTCCA

> SEQ ID NO: 5651 120925 1043686_301884_2b
CTTTTTCTTTCTCTCTCTCTGCTATTTTCCATCCCTTGGTTTTTATATATATAGAACCCACTTCCTTTCTTTTCCTT
TATCCCCTGAATCTTCCTCCCTTTGCTTACAAAAGCCTCCTCTTTTCCTCCTTTCTCTACTTCAGAACTCTTCTTCAAA
GTTCTCTCTCTCTCTCCTTGTGGAGGGGTTGTAGTGGAGTTGGGCGGTGCCTTGAGCTTCATCCATGGCTCCTGTAACC
TCCAATCACATGCAATACCGCAACCTAGGCCGGACGGGGCTCAAGGTCAGTGCCCTCTCCTACGGATCATGGGTTAGCT
TCGGAAACCAGATCGATGTGAAAGAGGCCAAGGTCCTCCTTTCGGCGTGCCGGGCGCAGGGGATCAACTTCTTCGACAA
TGCCGGAGGTCTACGCCAACGGGCGGGCTGAGGAGATAATGGGGCAGGCCATAAAGGAGCTCGGGTGGAAACGCTCGGAC
CTCGTGATCTCCACCAAGCTCTTCTGGGGCGGACCCGGGCCGAACGACAAGGGCC

> SEQ ID NO: 5652 120925 120575_300411_1b
TCCATCCCAAATTCTCATATTCCCCACTTTTTACTCCTTTCTCCTTCCCGTTTCTTCCTTTTAAAACAACAAATCTTCAT
TTCCTCTTTTTTCTTCTTGATTTGCCCCCCAAAAAACGAAAAAAAGTGCAAATGCAGTACAAGAATTTAGGCAGATCAG
GCCTAAAAGTATCTCAACTTTCATACGGAGCATGGGTCACTTTCGGCAATCAACTCGATGTCAAAGAAGCTAAATCCCT
CTTACAAAAATGTCGTGACCACGGTGTCAATTTCTTCGATAACGCCGAGGTTTACGCTAATGGAAGAGCAGAAGAAATT
ATGGGTCAAGCAATTCGTGAATTAGGTTGGAAAAGATCAGATATTGTTATATCTACTAAGATTTTCTGGGGCGGGTCGG
GTCCAAATGATAAGGGTTTATCGAGGAAACATATAATCGAAGGGACGAAAGCTAGTTTGAAAAGACTGGATATGGCTTA
TGTGGATTTGATTTATTGTCATAGGCCTGATGCTAGTACACCTATTGAAGAAACTGTTAGGGCTATGAATTATGTGATT

FIG. 2 continued

```
GATAAAGGTTGGGCTTTTTATTGGGGGACAAGTGAATGGTCAGCTCAACAGATTACTGAAGCTTGGGGTGTTGCTCAAA
GATTGGATCTTGTGGGTCCCATTGTTGAACAGCCTGAGTACAACTTGTTGTCTAGGCACAAGGTTGAATCTGAGTACCT
CCCTCTGTATAGCAACTATGGCATTGGTCTTACCACATGGAGTCCTCTTGCTTCAGGCGTTCTGACTGGAAAATATAAT
GCAGGGAACATTCCAGCGGACAGTCGATTTGCACTGGAAAATTACAAGAATTTAGCCAACAGATCTTTGGTGGATGATG
TGTTGAGGAAAGTAGATGGATTGAAACCAATTGCTGAATCACTAGGTGTACCTCTGCCTCAACTGGCAATTGCCTGGTG
TGCTGCAAATCCTAATGTCTCATCCGTTATTACTGGTGCCACCAAAGAGTATCAGATTGAAGAGAACATGAAAGCTATC
AATGTCATTCCAATGTTAACACCTGCTGTGATGGAGAGGATTGAGGCTGTTGTTCAAAGCAAACCAAAGCGCCAAGATT
CGTATAGGTAGATAAATTTTAAGATCCATTANGTCTTAAGAGCACTACTATTTCCAGAATGAGTTTTCCTTGCTATTCG
TTTTGCACCCCCTATTGCTTGTCTTAAGTATACT

> SEQ ID NO: 5653 120952 1098732_301486_1b
GGGCGGTGTTGGTGGTGGAGGGGGGTTCGGGGTTCGAGATGTCGGATGAGGAGCACCAGTTCGAGCACAAGGCAGACGC
AGGGGCCTCCAAGACCTTCCCCCAGCAGGCCGGTACCATCCGTAAGAATGCTTACATCGTCATCAAAAATCGCCCTTGC
AAGGTTGTAGAAGTGTCGACCTCTAAGACTGGAAAGCATGGCCATGCCAAATGTCACTTTGTGGCGATTGACATCTTCA
CTGGCAACAAGCTCGAAGATATTGTCCCTTCCTCTCACAATTGTGATGTTCCGGAGGTGACTCGCACTGATTATCAGCT
CATTGACATTTCTGAAGATGGATTTGTGAGTCTTCTTCAAGAGAATGGCAGCACAAAGGATGATCTGCGTGTTCCAACT
GATGAAACTCTCCTGGTGCAGATGAAGGAGGGTTTTGCAGAAGGTAAAGATCTTGTGGTTACTGTGATGTCGGCCATGG
GAGAAGATCAAATCTGTGCCTTGAAGGACATTGGACCAAAATAGGTCTGTTCAAACCTTGACTAAGATCCCGTGTGGTG
CTCCTTGTGTGGTAGAGGGTGTGTAGGATGAACTCTTTCAACTCTTAGTTGCTTTAATGTGGATAAGACCAATTGGCCT
CTCAAATAAAAGAGAAGGATATACTGGTTTAGAATAT

> SEQ ID NO: 5654 120952 136926_300440_1b
CGCGAGCTTATCACTTATCATCAATCGGCGCCTCCCTCTCTCGCTCACCGCCTCCTTCTCCTCGCGATCTATCCAAA
CAAGGGGCTCGCTAAGATCGCCATGTCGGACTCTGAGGAGCACCATTTCGAGTCGAAGGCCGACGCTGGGGCGTCCAAG
ACCTATCCCCAGCAGGCCGGAACCATCCGCAAGAATGGGTATATTGTTATCAAGAACCGCCCCTGCAAGGTGGTGGAGG
TTTCTACCTCGAAGACTGGTAAGCACGGTCATGCCAAGTGTCACTTTGTTGCCATAGATATATTCAATGGTAAAAAGCT
TGAGGATATTGTTCCTTCGTCCCACAACTGTGATGTTCCACATGTGAACCGCACAGAGTACCAGCTGATTGACATATCA
GAGGATGGATTCGTGAGCCTTCTTACTGAGAGCGGTAACACTAAGGATGATCTTAGACTCCCAACTGATGACAGTCTCC
TGGGTCAGATCAAGACTGGATTTGGTGAAGGCAAGGATCTTGTTGTGACTGTCATGTCTGCCATGGGGGAGGAGCAGAT
CTGTGCGCTGAAGGACATTGGCCCCAAGTAACTCCCTCAAGTGGAAGGCAGAACAGAGGGATCCTTATGTATCAAACCT
AAACTAAAAAACAAAGACATGTATTGAGAAGGAATGCTACAAAAGACATCCACCCAGCTTGAAGCCGCAGTAAAAGTGC
AGTGATTGCTGGGTGTGGCATTATCTGATTACCGCTACCCCATCATGACATTTGGGATCCTGTATTTTCCATGGTTTTA
TTTGTGCCCTCTGTTTGGTATCAATAATTGATTTGGAACGGTGGAAACCATATACTGAAGCTGAAGATTATCATTGGGT
CATTTCGTGCCTATGTATTTTTCTCTGAAAATTTCCCTAGTCACTGTTTAATCTGCAACCAATTTGTTGTGTTGTGTCG
TGGCCCTGAATCCCTGTTGCGTCGCGCTTACATTGGAAAACTTATACATCAAATTTTGTTAACATTGAAAAAC

> SEQ ID NO: 5655 120952 146733_301067_1b
GAGAAAGAGAGAGAGAAAGATGTCGGACGAGGAGCACCATTTTGAGTCAAAGGCAGATGCAGGTGCCTCCAAAACTTAC
CCTCAACAAGCTGGTACTATTCGCAAAAATGGTTATATAGTCATCAAAGGCCGCCCCTGCAAGGTTGTTGAGGTCTCCA
CTTCAAAGACTGGCAAGCACGGACATGCTAAGTGTCACTTTGTGGCAATTGACATTTTCAATGGAAAAAAACTTGAAGA
TATCGTTCCTTCGTCCCACAACTGTGATGTGCCACATGTCAATCGTACGGACTATCAGCTGATTGACATCTCTGAAGAT
GGTTTTGTCTCCCTTCTTACTGAAAGTGGAAACACCAAGGATGACCTCCGGCTTCCTACTGATGAAGCTCTGCTGAAGC
AGGTTAAAGATGGGTTTCAGGAAGGAAAGGATCTTGTGGTGTCTGTTATGTCAGCAATGGGGGAAGAGCAGATTAATGC
CGTTAAGGACATTGGTACCAAGAACTAGTTGTCTCTGCAAACTTAAATCGATTGCTATTGTTAAGACATTATTATATCC
TAATGTCGTACTTCGATATCACTTGATTAAAAACTTGCGTTAAAAATCTCATATTGAGATGGCTTGAATATTTTGATTT
GCACAAAAGATAGAAGACAAGTGCTGCTGGTTAGGGAAAGAAATGGCTTTGAGCCTTTGACAACACAAGC

> SEQ ID NO: 5656 120952 7477_300314_1b
CCCACGCGTCCGCACCAGCAAGAAACTCGAAGATATTGTTCCTTCTTCCCACAATTGTGATGTTCCTCATGTCAACCGT
ACTGATTATCAGCTGATTGACATTTCTGAAGATGGATATGTCAGTTTGTTGACTGATAACGGTAGTACCAAGGATGACC
TTAAGCTCCCTAATGATGACACTCTGCTCCAACAGATCAAGAGTGGGTTTGATGATGGAAAGATCTAGTGGTGAGTGT
GATGTCAGCTATGGAGAGGAACAGATCAATGCTCTTAAGGACATCGGTCCCAAGTGAGACTAACAAAGCCTCCCCTTT
GGTATGAGATTCTTCTTCTTCTTCT

> SEQ ID NO: 5657 120952 23509_300389_1b
CCCACGCGTCCGGGTTTTTTTTCCCTTCTCCCAATCTCATCTTCTCCGAAAACCTTTCTTCTCTCAAATTTCTGTGAAA
ACATGTCTGACGACGAGCACCACTTTGAGGCCAGCGAATCCGGAGCTTCCAAGACCTATCCTCAATCAGCCGGTAACAT
CCGTAAAGGTGGTCACATCGTCATCAAAAACCGTCCCTGCAAGGTTGTTGAGGTTTCGACTTCCAAAACTGGCAAGCAC
```

FIG. 2 continued

```
GGTCACGCCAAATGTCACTTTGTTGCTATTGATATCTTCACTGCTAAGAAGCTTGAAGATATTGTTCCATCTTCCCACA
ATTGTGATGTTCCACATGTGAACCGTGTTGATTACCAGTTGATTGATATCACTGAGGATGGCTTCGTGAGCCTTCTCAC
TGACAGTGGTGGCACCAAGGATGATCTCAAGCTTCCCACCGATGATGGTCTCACCGCCCAGATGAGGCTTGGATTCGAT
GAGGGAAAGGATATTGTGGTGTCTGTCATGTCTTCCATGGGAGAGGAGCAGATCTGTGCCGTCAAGGAAGTTGGTGGTG
GCAAGTAAACAAGTATCATTCGATATATTATTACCAGTTTGACAACGGACGTCAATGTTATAAGAACCAAAAGATGTTT
TTCTTTTTCCTAATTTAGACCCTTTGTGTGTGTTTCTTGTTGCAAGACAACCATATCTATTGGTTTTGGATTGTTGGAA
AAGTTTGTGTTGAAACATTCAAAGTTTCTTATGAGATGTTATTCTTAA

> SEQ ID NO: 5658 120952 255105_301642_1b
CGACACGCGTCGCGGTGTTGGTGGTGGAGGGGGGTTCGGGGTTCGAGATGTCGGATGAGGAGCACCAGTTCGAGCACAA
GGCAGACGCAGGGGCCTCCAAGACCTTCCCCCAGCAGGCCGGTACCATCCGTAAGAATGCTTACATCGTCATCAAAAAT
CGCCCTTGCAAGGTTGTAGAAGTGTCGACCTCTAAGACTGGAAAGCATGGCCATGCCAAGTGTCACTTTGTGGCGATTG
ACATCTTCACTGGCAAGAAGCTCGAAGATATTGTCCCTTCCTCTCACAATTGTGATGTTCCGGAGGTGACTCGCACTGA
TTATCAGCTCATTGACATTTCTGAAGATGGATTTGTGAGTCTTCTTCAAGAGAATGGCAGCACAAAGGATGATCTGCGT
GTTCCAACTGATGAAACTCTCCTGGTGCAGATGAAGGAGGGTTTTGCAGAAGGTAAAGATCTTGTGGTTACTGTGATGT
CGGCCATGGGAGAAGATCAAATCTGTGCCTTGAAGGACATTGGACCAAAATAGGTCTGTTCAAACCTTGACTAAGATCC
CGTGTGGTGCTCCTTGTGTGGTAGAGGGTGTGTAGGATGAACTCTTTCAACTCTTAGTTGCTTTAATGTGGATAAGACC
AATTGCCCTCTCAAATAAAAGAGAAGGATATACTGGTTTAGAATATTTGATACATGCTTTCAGTTGTGG

> SEQ ID NO: 5659 120952 243647_301341_1b
AGTTAGGGTTGGGGCCAGCAGCGGCGACAATGTCGGACGAGGAGCATCACTTCGACAACAAGGCGGATGCCGGCGCCTC
CAAGACCTATCCCCAGCAGGCGGGCACCATCCGCAAGAATGCCTATATAGTGATCAAGCAGCGCCCCTGCAAGGTCGTT
GAGGTGTCGACCTCCAAGACGGGCAAGCACGGCCACGCTAAATGCCACTTCGTGGGGATTGACATCTTCACCGGGAAGA
AGCTCGAGGATATCGTCCCGTCATCCCACAACTGTGATGTCCCGGAAGTCACCCGCACCGACTACCAGCTGATCGATAT
CTCGGAAGACGGATTTGTGAGCCTGCTCACTGAGAATGGTGACACCAAGGATGACCTCCGTCTTCCCACCGATGACCAG
CTCAACGGGCAGATCTCCTCCGGGTTTTCGGAAGGCAAGGACCTGGTCGTGACCGTCATGTCTGCTCTGGGAGAGGAGC
AGATCTGCGCCATCAAGGACATCGGGCCCAAGTAGCCCAGCGCGCAGCATCAAAAGCCGAGGACCACTGGTTTTGTACC
TGCCTTTTTAAGTCATTTTACTCTATAGTTCGTTCTTTTTCCTTGCAACCTTGTTGTAACCAGTGGGGGACGTTCTTTT
TTCCATAGTAGGGGGGGAAAGGGGGGAGTTTGGGTCGGCTACTATTTGTATGCTTTGACGAAGTTGGACGAAATCTATT
TTTTTATTCATTGTG

> SEQ ID NO: 5660 120952 160004_200028_1b
GATCCTCCTCTCCCTAAACTTCTCTCCGGTGAAGTGTAAACAAAGAATAGTACATCAAATCAACCATGTCGGACGAAGA
GCACCACTTTGAATCAAAGGCCGACGCCGGAGCTTCAAAGACGTATCCTCAACAAGCTGGTACTATTCGTAAGAATGGT
CATATCGTCATCAAAAACCGTCCTTGCAAGGTTGTTGAAGTTTCCACTTCCAAGACAGGCAAGCACGGTCATGCTAAAT
GCCACTTTGTGGCTATTGACATTTTTACTGGAAAGAAGCTTGAAGATATTGTTCCCTCTTCTCACAACTGTGATGTTCC
TCATGTGAATAGGACTGACTATCAGCTTATTGATATCTCTGAGGATGGATTTGTGAGTCTGTTGACCGAAAATGGTAAC
ACCAAGGATGACTTGAGGCTCCCAACTGATGATAATCTTCTGGCCTGATCAAAGATGGTTTTGCTGAGGGGAAGGACC
TGGTTCTGTCAGTGATGTCTGCCATGGGAGAGGAGCAGATTTGTGGTATCAAGGACGTTGGCCCCAAGTAGCTGCAGGA
GGTGGTGGTGTATGTTATAAAGTTTCAAAAAAAGCTGTATCAAAGCTATGTAGAAGTACCAAAACTTCTTTACTTTTTG
TTATTCCAGATAACTGTTATTCAACCATATGGTATGACTGGATTCTTGTGTCCACTACGTGTTTCCTGTTTTCTGATAT
TGCTACCTGTTAGTCTGTCTGCGTGAAAAGCTCTGTTTCTGCATTATAAAGATAGATTTCTGGTTT

> SEQ ID NO: 5661 120979 175459_300542_1b
CCCCCCCGACCTCTCTCTAGTTGCAGACCATCACTTACGTAGCCCTGTGTGCAACGGCGCAAGTGCTTGTACGCTTTCA
GCTAGCGTAGCCATGGCTTCCAGGGCATTCCTCCTCGTGGCTCCTCTTCTTCACCGTGGCCAGCGCCT
GCGGCAAGTACTGCCCGACGCCTTCGACGCCGTCGACGACGCCATCGACGCCGTCCTACAACACCAAGTGCCCCAAGAA
CGCGCTCAAGTTCGCGGCGTGCGCCGACGTGCTGGGCCTCGTCAGCGCCGAGGTCGGCCAGCCGCCGTACGAGCCGTGC
TGCGGCGTCCTCGGCGGCCTCGCCGACCTTGAGGCCGCCGTCTGTCTCTGCACCGCCATCAAGGCCAACGTGCTCGGCA
TCACCCTCGACATCCCCGTCAAGCTCAGCCTCCTCGTCAACTACTGCGGCAAGAACGTCCCTAGTGGCTTCATCTGTGC
TTAAGCTACGTAACGCGCGTACGGTGTAACGACGTGCTAGCTTTGCATGCATGCAGCACGCATGCACGAACACATCGTT
CGTTCTTGAGTGCCTGCATGCATATCGGTCGAGTCTTTACTTACTCTGTTATTAGTTCTGAATGTAGAACTGCTTCAGA
TATCAATCCAGCGAGTTAACTGTACTTGATTTG

> SEQ ID NO: 5662 120979 124502_301024_1b
TCACAGTAGTGAGTGCATGCAGTACTTGCCCAGGCCCTAAACCTAAACCTAAACCAAAGCCAAAGCCAAAGCCATGCCC
CCCTCCTCCTTCTTCTCATGGTGGCAAATGCCCAACTGATGCCTTAAAACTAGGCGTTTGCGCTAATGTGCTTAACGGT
TTGCTGAATGTTACCCTGGGAACTCCTCCAGTAAAACCATGCTGCAGTCTTATTGGAAATCTTGTGGATTTGGAGGCTG
```

FIG. 2 continued

CTGTCTGCCTTTGCACTGCCCTTAAGGCTAACATTTTGGGCATCAACCTTAATCTCCCTATTTCTCTTAACTTACTGCT
CAATGTTTGTAGTAAGAAGGCTCCAAAGGGATTCACTTGTCCCTAAATGGTTCTCTCGCTTTTCGTTTTTCTTCTGAAG
TTGGTTTTTGATTTTCATTTGTTTAGCAGTTTGTGATGTTCGATTTATCTCCTGCATTAAACTTCTTGTTAGGTGCAAG
GTTGTGGTTTGTTTTGGATTGATCATTGTTGGAAAGCGCTTTTGTAAGGCCAATTGTTTGTGTACCCTTTGGAAATAAA
TATATTTCTTGGATGATTCTCTCT

> SEQ ID NO: 5663  120979  138560_300774_1b
CCCACGCGTCCGCCCACGCGTCCGCCCACGCGTCCGCAAAAGCAGCTCCAGCTTCTTCTGATCGATCGATCGAGCTGA
GCTATAGGCAGTAGCTGCTAATTAAGCTAATTAATTGCTAAGCAGTAGTAGAGCTAGCTAATTAATTAAGATGGCCGGC
AAGAAGGTGCAGGTTTGTGCGCTGTTCCTTGCCCTCAATGTGCTCTTCACCATGCAGATGGGTGCAGTAGTGCAGGCAT
GCGAGCCCTACTGCCCCACACCGACGCCGCCGGTGACGCCGCCTCCGTCGCCGCCGTCGGGTGGAGGGAATAAGTGCCC
GATCGACGCGCTGAAGCTGAGCGTGTGCGCCAACGTGCTCAACCTGCTGAAGCTGAAGATCGGCGTGCCGGAGAGCGAG
CAGTGCTGCCCGTTGCTGGGTGGCCTCGTCGACCTCGACGCCGCCGTCTGCCTCTGCACCGCCATCAAGGCCAACATCC
TCGGCATCAATCTCAACATCCCCGTCGATCTCTCTCTCCTTCTCAACTACTGCCACAAGACCTGCCCCTCCGACTTCAC
CTGCCCTCTCTAAATTAATCGATCCTCCGATCCCTTAATTACCATACCATTACACCATGCATCAATATCCATATATATA
TAAACCCTTTCGCACGTACTTATACTATGTTTTGTCATACATATATATGTGTCGAACGATCGATCTATCACTGATATGA
TATGATTGATCCATCAGCCTGATCTCTGTATCTTGTTATTTGTATACCGTCAAATAAAAGTTTCTTCCACTTGTGTT

> SEQ ID NO: 5664  120979  137838_300705_1b
CATCTCCAGAAGATCAAGAGCTCTTAATTAGCTAGCTAGTGATTAGCTGCGCTTGTGATCGATCGATCTCGGGTACGTA
GCAATGGCGTCCAAGGCGTCGCTCTGTTCCTGGCCGTGAACCTCGTCGTGCTCGGGGTGGCAAGCGCCTGCGGCGGCAG
CCCGTCGTGTGCCGACGCGACGCCGTCGACCCCGACATTGTCAACGCCGACGCCGACGCCGTCGGCGTTCGGGAGGGGG
TGGCCCNCNNCGCGACGCGCTGAAGCTGGGCGTGTGCGCCAACGTGCTGGGCNCTGATCAAGGCCAAGGTGGGCGTGCC
TCCGGCGGAGCCGTGCTGCCCGCTGCTGGAGGGGCTCGTCGACCTCGAGGCGGCGGTGTGCCTCTGCACGGCCATCAGG
GGCAACATCCTCGGAATCAACCTCAACCTCCCCATCGACCTCAGCCTCATCCTCAACTACTGCGGCAAGACCGTCCCCA
CCGGCTTCAAGTGCTAAGCAGCGTGCATATGCAATGCCTGCATGGGTTGATCCTACGTACGGTGATTAGTTGGCTTTGA
CGACTCTTGATTTGATTTGCTTGCTGCTCTGTTTATTTGCTACTACGTTACGTACGTACTTTGCATGCAACGCAACGCA
TGA

> SEQ ID NO: 5665  122182  170255_300531_1b
CCCCCGAACTAAGCTACTACTCGAAGAAGAGGAAGACCGCCATGACTACTTCCACCCTTCTCTTCCTCCTCCTCGCCGG
CCTCACCGCCGCCGCCCTCGGCACGGCGGACGACGACACCACCACCAACACCATACGCCTCCCGACCGACGGAGGATCA
GCACAGCAGGCGCCGACGAAGAAGAAGCCGTGGAAGTGCTGCGACAACATCGAGCGGCTGCCGACGAAGACCAACCCGC
CGCAGTGGCGCTGCAACGACGAGCTGGAGCCCAGCAAGTGCGTGGCACAGTGCGAGGTGTGCCAGGAGGCGCCGGGGCC
ATTCCCGGGCCCGCTCATCTGCAGCGACGTCTACTGGGGCGCCGACCCGGGTCCCTTCTGCACGCCGCGGCCGTGGGGA
GATTGCTGCACCAACACCACCTGCACCAGGTCGATCCCGCCGATCTGCCGCTGCAACGACAAGGTGAAGAAGTGCGCCG
CCGCGTGCAAGGATTGCAAGCGGGTGAAGTCGTCGAAGCCTCCTCGCTACGTCTAGCCAGTGACCAAGAGCAAAATAAA
TGAATAAATGTTGC

> SEQ ID NO: 5666  122182  202418_300784_1b
CCGAGCACAACACCACAAACCAAGATGAGTAACAACAGCATGGCTACTTCCACCATCCTGCTCTTCCTCCTCGCCGTCG
GCGGCCTCGCCGCCGCCCACGGCGACACCATCCGTCTCCCAGCGAAGGCGACGCACCACCGCAGCCCGCCAAACCCTG
GGACTGCTGCGACGATATCGAGATGTCCCCGCTAAAGATCTTCCCGCCGCTTTACCGCTGCAACGACGAGGTCAAGCAG
TGCTCGGCCGCCTGCAAGGAGTGCGTGGCGGCGCCGGCGGCCGGAGACTCCCCCTGCGGCGGCGGCGCCGCCCTCGTCT
GCCGCGACTGGTACTCGACGGAGGACCCCGGCAAGCCGTGCACGCCGGAGCGGGAATGGCCGGAGCGGACGACGAAGAA
GAGGCCGTGGAAGTGCTGCGACAACATCCGGCGGCTGCCGCCGAGGATCCACCCGCCGTTCTGGCGCTGCGACGACGAG
CTCAAGCCCGGCCAGTGCTTCGCCGCGTGCAAGGCTTGCCGGGAGGCGCCGGGGCCATTCCCGGGGCCGCTCATCTGCG
ACGACGTCTACTGGGGCGCCGACCCGGGTCCCTTCTGCACGCCGGGGCCGTGGGGGGA

> SEQ ID NO: 5667  122182  120865_300517_1b
CAAAGATGAGCAACACCACCATGGGTATTTCCACCATCCTTCTCTTCCTCCTCGCCGGCCTCGTCGCCGCCCACGGCGA
CGGCGACACCATGATCCGTCTCCCAAGCGACGGCGCCGAAGCACCACCACGCCCGCCCAAACCCTGGGACTGCTGCGAC
AACATCGAGATGTCCCCGCTCGAGATCTTCCCGCCGCTGTACCGCTGCAACGACGAGGTGAAGCAGTGCTCCGCCGCCT
GCAAGGAGTGCGTGGAGGCGCCCGGCGACTTCCCCCGCGGCGCCTTCGTGCCGCGACTGGTACTCGACGGTGGACCC
GGGCCACATGTGCACGGCGCCGGATCAGCCGACGACGAAGAGGCCGTGGAAGTGCTGTGACAGCATCGTGCAGCTGCCG
CAGAGGATCTTCCCGCCGTTCTGGCGCTGCGACGACGAGCTGAGCCCGGCAAGTGCACCGCCGCGTGCAAGTCGTGCA
GGGAGGCGCCGGGGCCGTTCCCGGGGCCGCTCATCTGCGAGGACGTCTACTGGGGCGCCGACCCGGGCCCCTTGTGCAC
GCCGCGGCCATGGGGGAAATGCTGCGACAAGGCCTTCTGCAACAAGATGAACCCGCCGACCTGCCGCT

FIG. 2 continued

> SEQ ID NO: 5668 122182 129123_300403_1b
CCCACGCGTCCGCCCACGCGTCCGAGATGAAGCGCACCATGGCTGCTACTTCCATCCTGTTCTTCTTCCTCGCCGGCCT
CGCCGCCGCCCACGGCAGCACAGCGGACGACACCACGACCACCACCACCAACACCATACGCCTCCCGATCGACGGAGCA
GTGGCGGCGCGAAGGAGGACGAGGCCGTGGAAGTGCTGCGACAACATCGTGAGGCTGCCGGAGAGGATCAACCCGCCGT
TCTGGCAGTGCGACGACGAGCTGGAGCCCGGGCAGTGCTTCCGCCAGTGCGAGGCGTGCCGGATCCGCCGGGGCGGCC
GTTCCCCGGCCGGCCGCTCATCTGCGACGACGTCTTCTGGGGCGACGACCCGGGCACCTCGTGCGCGCCGTCGTCGGAG
TGGCCGTGGGGCCCGTGCTGCGACATCGCCGTCTGCACCAAGTCGCTCCCTCCCATCTGCCACTGCTCCGACGAGGTGG
AGTCGTGCGCCGCCGCGTGCGGGCAGTGCGAGATGGTGGACTCGTGGTCGTGGCGCCCTCTCTTCGTCTGCCGTGACTC
CTTCACCGGGGACCCAGGCCCCAGGTGCACACCTGAAATGCACAACTAAGAAGAGAACTACTTCTCTGTATAACAAGCA
GAG

> SEQ ID NO: 5669 124883 155851_301360_1b
TCTTAGCAACTGCTGCTCATGATGGTGTTAAACTTGGGATTTACGCAAATGAAGAATTCCGAAATTTCTCTCTTTATGA
TGAAAATACACCGACTCAATCAGTGCAATTTGACCATAGTGGAAGTTATCTGGCCTTAGGAGGCTCAGATATACGAGTT
TTCCAAGTCGCCAGTGTTAAGGCTGAATGGAATCACATCAAAACCCTCCCCTTCTTATCAGGCACAGGTAAAGCAACAT
GTCTGAAATTTGGTCCAGATGCAAAATACATAGCTGTAGGATCTATGGACCGTAATTTAAGAATATTTGGGCTGCCTGG
CGAGGATCAAATGGAGAGTTAGGCTCATTTCCAGCATGAAAGCAAACAGTCAGCGCCACAGCTTCGAATCTGCTGAGAC
CACTGTATTATCTCTAGGGGAGAGGTTGATGGGTCCTGTTTTATTATGTAATTCTTCTGGTTTTTGCTAGATCTTTGGG
TGGTCTGGCAAATAGACATACCACCAACTTGGGATAATATCCGAAGTGCAGGGTTTATTTGGTCGTCTCAATACCATCC
TTGGGCAGTCTATTGTATCATTGTTGTAACCATTGCCTATCCTGGGAGCAAGTCTGAATGGAAACGATCAGTTACAATA
CATTGAGATGCCAAGTTAGTAGCTG

> SEQ ID NO: 5670 124883 171977_300538_1b
CGATATTCCATCAGGATCTGGCCTCACACAGGTTGGCGAGTCTTCAGGACAAGAGGGATATACATCTGCATCTTTCCAC
CCAGATGGTCTTATCCTGGGGACAGGGACCACTGAAGCTGTTGTCAAAATTTGGGATGTGAAGACGCAGTCAAATGTTG
CAAAGTTTGAGGGGCATGTTGGACCAGTGACTGCTATGTCCTTCTCTGAAAATGGTTACTTCCTTGCGACTGCTGCTCT
TGATGGAGTCAAGCTTTGGGATCTTCGAAAATTAAGAAACTTTAGGACGACGATATCACCTTATGACTCAGACAGCCAACA
AATTCTGTGGAATTTGACTTTAGCGGAAGTTATCTAGCTGTTGGTGGTTCAGATACAAGGGTTTACCAAGTAGCAAATG
TTAAGCTTGAATGGAATCTTGTCAAGACCTTACCAGATTTGTCAGGCACAGGGAAAGTGACAAACGTCAAGTTTGGCAC
CGATGCGAAGTACATTGCCGTAGGTTCTATGGATCGTAACCTACGGATATTTGGGCTTCCGGGAGAAGATGATCAAATG
GACGACGCAAAGCCATCGGAAGAGTGATGAAACCAATTGTACTTCATTTGGCCTGCGTAAATTGCTCCCTGTTTGTGTG
TTTTGACGGTGGATG

> SEQ ID NO: 5671 126149 119247_300018_1b
GCTGTTGAAACAGCGACCAAACAGGTTGAAACATCTAAGGAAGTCAAGGAGGAGAAGAAAGGAGGAGCACAGGATCTCA
AGTCAACCCTTTTGATTTCAGGGGCTGTAGTAGCTGTGGTTGGAGCACTTGTTGCTATTCTTAAGAAGGTGAAAGAGTC
AGCTAATTGAATGTAGATCCTTTGTATCTTTAACTTCATGTTCTACATTTTTTGTAAGACGAGCCTAAACTCTTGAAGG
GAAATAAATAAATTTCATAATGTTCTACTTGTAT

> SEQ ID NO: 5672 126157 1098766_301486_1b
ACGACCGCCTGCTAGCTGAGTATCTCTTTCGTCCGACCCCGAAGGTATCCCAGCTATGGCGTTCGCTCTCGAGAGGTCT
GCTCTCCTCGGCAATTCCGTCGTCGGTTTGCCTTCCCTGCCCAAGCTTAGTATAGCCTCCCCCCCTTCCACCGTCAAAA
TCTTTGCCAGCGGAGCAAAGAAGATTAAGACCAAGGCACCACTCGGTCCTTCCGGAGATACCTCTTACCGTAATGGAGC
TGATGCTTCTGGATCCAAGGGCAAGGGTAAGGGAGTGTACCAGTTTGTCAACAAGTATGGAGCCAATGTCGATGGTTAC
AGCCCAATTTTCACCCCTGATGAGTGGTCACCCAATGGAGATACCTACGTCGGCGGTACCACTGGATTGGCTATCTGGG
CTGTGACCCTCGGAGGCCTTCTCCTCGCTGGTGTCTTCCTTGTTTATAGTACCAGTGCCCTTTCACAGTAGATTGTTGT
TGAAAAGACAGACAATCCTCATTTACAATTTATCTTATGATTATATGTAAACCATTGAACATACTTCGCTGCTATCAAT
GAATGAGAGCTATCATCTCTCCATTTCATTATTGTAATTGTCGGTCATTCGAATCGGAACATTTGATCTATTTTAT

> SEQ ID NO: 5673 126157 139329_300409_1b
AATTATATTGAGCTGCCATTGCTTCTCACCTCTGCTTTGCATCCATCCATCCATCAGAGATCAGGTAGAACAGTGAGAG
TGAGGTGCAGAAAAATTTGAACTGAAGCTGAGGATGGCAACATCCATGATCACCTCGCCGCTGGTGGCGCCGGCCCGGG
CCAAGGGCCTTCCGTCCATCTCCCGCCGGGGATCCTCCTTCGCCATCGTCTGCAGCGGTGGGAAGAAGATCAAGACCGA
CAAGCCCTACGGGATTGGAGGTGGCATGTCAGTCGATATTGATGCATCTGGCAGGAAGAGCACGGGGAAGGGTGTGTAC
CAATTCGTTGACAAGTACGGCGCAAACGTCGACGGCTACAGCCCAATCTACTCGCCGGAGGAATGGTCTCCCACCGGTG
ACACCTACGTTGGTGGAACCACCGGGCTTCTGATCTGGGCCGTGACCCTCGCCGGGCTCCTCGGCGGCGGCGCCCTCCT
CGTCTACAACACCAGCGCCCTCGCCGGCTAAATTTCACCCAAATCCAGTCTATGTATGTAACACCAAGCTGGGTGTCTG

FIG. 2 continued

CATATTCATCTGTAATCTAAGATAGCCTTCCTCTGAATGCGATGTGATGATGCCCACTGCTTAATCAAACTGCATTGTG
ATTAATCTATGTAACACTGTACTTGCATGATGATGATATACTACACTTGATACTCG

> SEQ ID NO: 5674 126157 254919_301640_1b
ACCGCCTGCTAGCTGAGTATCTCTTTCGTCCGACCCCGAAGGTATCCCAGCTATGGCGTTCGCTCTCGAGAGGTCTGCT
CTCCTCGGCAATTCCGTCGTCGGTTTGCCTTCCCTGCCCAAGCTTAGTATAGCCTCCCCCCCTTCCACCGTCAAAATCT
TTGCCAGCGGAGCAAAGAAGATTAAGACCAAGGCACCACTCGGTCCTTCCGGAGATACCTCTTACCGTAATGGAGCTGA
TGCTTCTGGATCCAAGGGCAAGGGTAAGGGAGTGTACCAGTTTGTCAACAAGTATGGAGCCAATGTCGATGGTTACAGC
CCAATCTTCACCCCTGATGAGTGGTCACCCAATGGAGATACCTACGTCGGCGGTACCACTGGATTGGCTATCTGGGCTG
TGACCCTCGGAGGCCTTCTCCTCGCTGGTGTCTTCCTTGTTTATAGTACCAGTGCCCTTTCACAGTAGATTGTTGTTGA
AAAGACAGACAATCCTCATTTACAATTTATCTTATGATTATATGTAAACCATTGAACATACTTCGCTGCTATCAATGAA
TGAGAGCTATCATCTCTCCATTTCATTATTGTAATTGTCGGTCATTCGAATCGGAACATTTGATCTATTTTAGAGCT

> SEQ ID NO: 5675 126157 259831_301709_1b
GAAAGAGAGTGAGAGAGCTCGAGCAATGGCGGCAGTGTTGGAGAGCTCGGCCTTCTGCGGCTCGGCCCTGGCAGCAGCA
GCACCAGCTCGGGGCCTCCCCGCATTGAGCAGCAGCAGGCTCACCGTGAGAGCCAGCGGCGGCAAGAAGATCTCGACGA
AAACACCTCTAGGACCTTCTGGGGACCTCAGTTTTAAGTCTGGACGCGATGCTTCTGGACGTGGCACCACGGGAAAGGG
CGTGTATCAATTCACAAAGAAATACGGAGCTAACGTGGATGGATACAGTCCGATCTATACTCCGGACGAATGGTCGCCT
TCGGGAGACGTTTACACGGGTGGCCAGACTGGGCTTTTGCTATGGGCAGTAACGCTGGGAGGTATACTACTGGCCGGTG
TGTTCCTCGTATACAGTACTAGTGCTCTCGCAAGCTAAATCGTGTAAACGTTATATTGTCAAAAAGCGAGCAAAAAGGA
TTATTTCCATACATTGTCCATAGCTTGGACACGACTTCAATGTAGATAAAGGTTGTATTAATATTTACAAATATATCGT
ATTTTCTTACCAAAAAA

> SEQ ID NO: 5676 126157 18760_300241_1b
TCGGGTATCAACGCAAAGTGGCCATACGGCCGGGGGTGAGAAGAGATCGAGAGAAGAATAGTTTGATCATCTTGTGAGA
AAAATAATGGCTGCTTCAGTGATGCTATCTTCGGTGACATTGAAACCAGCTGGTTTCACGGTGGAGAAGACGGCGGCTA
GAGGATTACCGTCGCTCACAAGAGCTCGTCCCTCCTTCAAAATTGTCGCCAGTGGCGTCAAGAAGATCAAGACCGACAA
GCCCTTCGGAATTAACGGCAGCATGGACTTGAGGGACGGCGTCGACGCCTCCGGCAGAAAGGGCAAGGGATACGGTGTT
TACAAGTACGTCGACAAGTATGGAGCTAACGTCGATGGATACAGTCCTATTTACAACGAGAACGAGTGGTCAGCGAGTG
GTGACGTGTACAAGGGAGGAGTCACCGGATTGGCAATTTGGGCGGTAACTCTCGCCGGAATTCTTGCCGGAGGTGCTCT
TCTTGTGTACAACACAAGTGCTTTGGCTCAGTAAATCTTAAAGTTGTTAGCGCAT

> SEQ ID NO: 5677 126157 191562_300702_1b
CCCCGGGCCACCAAAGGTTTTTGGCGCCACAATTATATTGAGCTGCCATTGCTTCTCACCTCTGCTTTGCATCCATCCA
TCCATCAGAGATCAGGTAGAACAGTGAGAGTGAGGTGCAGAAAAATTTGAGCTGAAGCTGAGGATGGCAACATCCATGA
TCACCTCGCCGCTGGTGGCGCCGGCCCGGGCCAAGGGCCTTCCGTCCATCTCCCGCCGGGGATCCTCCTTCGCCATCGT
CTGCAGCGGTGGGAAGAAGATCAAGACCGACAAGCCCTACGGGATTGGAGGTGGCATGTCAGTCGATATTGATGCATCT
GGCAGGAAGAGCACGGGGAAGGGTGTGTACCAATTCGTTGACAAGTACGGCGCAAACGTCGACGGCTACAGCCCAATCT
ACTCGCCGGAGGAATGGTCTCCCACCGGTGACACCTACGTTGGTGGAACCACCGGGCTTCTGATCTGGGCCGTGACCCT
CGCCGGGCTCCTCGGCGGCGGCGCCCTCCTCGTCTACAACACCAGCGCCCTCGCCGGCTAAATTTCACCCAAATCCAGT
CTATGTATGTAACACCAAGCTGGGTGTCTGCATATTCATCTGTAATCTAAGATAGCCTTCCTCTGAATGCGATGTGATG
ATGCCCACTGCTTAATCAAACTGCATTGTGATTAATCTATGTAACACTGTACTTGCATGATGATGATATACTACACTTG
ATACTTGAATTTGGAGA

> SEQ ID NO: 5678 126335 187978_300682_1b
TTAGCCCCCGCCCAACCCGCCCGGAGACGAGACGCCACCGGAGTTCCCCCCACCACCGCTCGCCGCCTTCTCCGCCTCG
CCTCGCCGCCGCGTCGACCGCCATGGCTGAGACTGTTGTGCTGAGGTTGGGATGTCCTGTGAAGGTTGGTGTTGGAGCT
GTTAAGCGGGTACTGGGAAAGATGCAAGGAGTGGAGTCCTTTGACGTAGACATCAAGGAGCAGAAGGTCACTGTCAAGG
GAAATGTTACACCAGATGCCGTTCTTCAGACCGTTTCAAAGACGGGCAAGAAGACCTCGTTCTGGGATGCTGAGCCTGC
ACCTGTTGAAGCTACTGCTGCTTCATCTTAAAATGTCATTTTATCTCCTGTGATATGTAAAGGTTGATGTAACAATTTC
CCAGTGGAACTGTCTTGTGAGATCACAAAGTTGTCTGTTCTTATGATCATAACTTGAAGCTATTTCAAATAATATCAGA
CAGCTAGTTACACATATGTACATCTTTGTATTTCTCTATCCTACCAGTATTGGACTATTGGTATGATCAATTTGGTAAA
AATACATGGTTCATC

> SEQ ID NO: 5679 126335 234353_301099_1b
GGCGGATGAGACTGTGGAGCTCAAGGTGGCCATGACTTGCGAGGGCTGCGTCGGTGCAGTCAAGAGAGTTCTTGGCAAA
ATGCAAGGTGTGGAGTCGTTCGATGTCGATCTCAAGCAGCAAAAGGTAACCGTCAAAGGCGCCGTGAAGCCGGACGATG
TGCTCCAGGTGGTGTCCAAGACGGGCAAAGCCACCACCTTTTGGCCAAAGGAGGAGTGATCAATCCACTCGTCAATAAT

FIG. 2 continued

CGACTAAACTGTAGTGATCACAGCGGGATCACATGTACAGACAAGTCCACAATGATACGCACGCTATACACTTCGATCT
ATATATATACACCTTGATTTTCCTAGAANAAAAAAAAAAAA

> SEQ ID NO: 5680   126335 1102023_301478_1b
GCACCACCAAGCTTTGGATATGGCCACGGAGACTGTGGAACTGAAGGTTGAGATGACTTGTGAAGGCTGTGTTGGAGCA
GTCAAAAGAGTCTTAAACAAAATGCAAGGGGTGGAATCTTATGAAGTGGATTTGAAAGAGAAAAAGGTAATTGTGAAGG
GGAATGTTAAGCCTGAAGATGTCCTCAAAACAGTTTCCAAAACTGGCAAGGCTACTCAGTATTGGCCAAAAGAGTAGGG
AGGAAGCAAATGTCTAAAGCATAGCCTATTCTTATTTATAAATAGACTATATGCCTGAACTAAATGGAAATCTCAATTA
AGTCTTTGAATAAATTTTCTGTTGTTAATTATAAACATATAACCTAAAAGTTTGGGATTTTCTTTGATTTGGCTAACAA
AAAACCACAAC

> SEQ ID NO: 5681   126335 126579_300464_1b
GCCATTACGGCCGGGGATAACCTCAAAGGCCAAATAGATAGGTTCTTCCCACGAAAGTAAAAATCTCCCTCATTTTTCC
CCCTACTACTTTTCATCATCATGTCTCAGGTACACATTCTTTTTACCCTTCATTTTCTTTTTCAGATCATTTTGATAAT
ACTAATTACATTCATACTAATGTTACTCTATCTTTTTTGCTAGTAATTGTCATCTGTCAACTGTAATAATCTTGGAAAT
CTCTAAAGGGATTGAAATTTTTTGGTTGTAGAACCCCAATTTTAATTTGGTTTTTCTCATTTTGAGCTGAAAATTTTGG
TTATTGGTGTGTGAATTTTTTGTTACAATGTAAAGAAGAAACATAAAGCTTTGAAATGCT

> SEQ ID NO: 5682   126335 1097815_301448_1b
AGAAGAAGCACTAAGCAAGAGTCCATCCATATACAATGGCTACTCAGACTGTGGAGCTGAAGGTTACCATGAGTTGTCA
AGGATGTGTTGGGGCTGTTAAAAGGGTGCTTGATAAGATGGAAGGAGTGGAATCGTATGATATTGACTTGAAGGAGCAA
AAAGTAGTGGTGAAGGGCAATGCGAAACCAGAGGATGTGTTCAACACGGTCTCCAAGACGCGGGAAGGCCACATCATACT
GGCCTACAGAACAAGTGGTAGCAGCATGATATGTGTGTAGACCCTTTTAAGAAGTTGCTAGATTCTAGTAGCTTATAAC
CTACATGGCCTAAATGCTTCTATTGTATTGATAAGGTATAAATAATATAATTATGCAAATCTTTGTCAAAATAATTGTC
TTACACTATGAAAACAATCATTCTAGTTTTCCATAATTAATTTCCTTACTATTGAATAGCAAAAATAAATCAAAAACC
ACT

> SEQ ID NO: 5683   126367 119053_300066_1b
TATTTTTATTCCGTCAGCTGTTTAGCAAGAGAAGAGAGCAAAAAATGGTGTCAGGTTCAGGGATCTCCGCAAGGAGGGT
GGTGGTTGACGCTCGCCACCATATGTTGGGAAGATTATCTTCAATTTTGGCTAAGGAATTGTTGAATGGACAGAGAGTT
GTGGTTGTTAGGTGTGAAGAGATTTGTTTATCAGGGGGACTTGTGAGACAGAAAATGAAGTATTTGAGGTTTCTTCGTA
AGAGGATGAATACTAAGCCTTCTCATGGTCCTATTCACTTTCGTGCTCCTTCTAAGATCCTCTGGCGTACCATCCGTGG
GATGATTCCCCACAAAACTAAGCGTGGAGCTGCTGCGCTTGCCCGGTTGAAGGTTTACGAGGGCGTTCCACCACCATAT
GACAAAATCAAGAGAATGGTCATTCCTGATGCTCTTAAGGTGTTGAGGCTTCAAGCAGGACATAAATACTGTCTCTTGG
GCAAGCTTTCATCAGAGGTTGGATGGAACCATTATGACACTATTAAGGAACTTGAGAACAAGAGAAAGGAGAGAGCCCA
AGTTGCATATGAGAGGAGAAAGCAGTTGGCTAAACTGAGAGTTAAGGCCGAGAAAGCTGCCGAGGAGAAGCTCGGTCCA
CAGCTTGCTGTTATTGAACCTATCAAGTATTAGAGTGCAAATTTAGTAGTTATCTGAGGTGAAATTTTGCTGGAGATTG
AGATTTCAGCTTATCTGTTTTTTTAAAGTTGTACCGCATGGTTTGGTATTTGCTTCTAGCAATATTTGAGCAGACTT
TAAATTGTTTTAACTATCTTTTTGAAGTTACAATTCTCTCATGGTTTTATTGGTACAGCTTTGTTTTCTACTCCTTGAT
AGTTTGCATCTATAAGATGAATGACTCCATTGAGCTGAGTCTCTATTAGAAAT

> SEQ ID NO: 5684   126367 267285_200116_1b
GACGTTCAGAGCTCGAGAGAGTGTGTGTGTGTGTGAGAGGAAAAAAATGGTGTCAGGATCAGGGATTTCAGCGAGGAGG
ATAGTGGTGGACGCGCGCCACCACATGCTCGGAAGGCTATCCTCAATCTTAGCCAAAGAACTGCTCAATGGACAAAAAG
TAGTAGTTGTTAGGTGTGAAGAAATTTGCTTAAGTGGTGGACTCGTTAGGCAGAAAATGAAGTATCTTAGGTTCCTTCG
TAAGAGGATGAACACTAAACCTTCTCATGGTCCTATTCACTTTCGTGCTCCTTCTAAAATCCTCTGGCGTACTATTCGT
GGGATGATTCCCCACAAAACTAAGCGAGGAGCCGCTGCACTTGCCCGTTTGAAGGTATATGAGGGTGTTCCACCCCCAT
ATGACAAGATCAAGAGGATGGTCATTCCTGATGCTCTCAAGGTATTGAGGCTCCAGGCTGGACACAAATACTGTCTCTT
GGGAAAGCTTTCGTCCGAGGTTGGATGAACTATTATGATACTATCAAGGAACTTGAGAATAAGAGAAAGGAAAGAGCT
CAAGTAGCATATGAAAGGAGAAAGCATTTAGCAAAACTTAGGGTTAAGGCCGAGAAAGCTGCTGAGGAGAAGCTTGGTC
CTCAACTTGCCATTATTGCTCCAATCAAGTACTGAAGTCTAAATATAGTTGTTCGAACAATTTTGCTGGAGATTGATGT
TTTGGGTTAATTTGTTCCT

> SEQ ID NO: 5685   126375 44586_300427_1b
TCTAAAAACCCCTTTACTTTTTTCTCCCTCGAGAACTCCGCTTACTTTCCTTTACTTGCTTCACCCCCCAGATCAGCAG
CCAATCCCCACCTCTTCTACCGGTAAAACATGTCGACCGTGAGACTTCCTTCCACCTGCATGTTCAAAGCTGCTCCTCA
GACTCAGAAAAAGAGTGCATTTGTGAAAATCCCGTCTTCTCTGGGATCTGTGAGGAGCATTTCGATGTCCTTTGGCTTG
AAAGCTGACTCTGGTTTTAGAGCATCAGCAAATGTGTACAAGGTCAAGTTGGTTTGTCCAGATGGTACAGAACATGAGT

FIG. 2 continued

```
TCGAAGCACCATCTGATACTTACATCCTCGATGCAGCTGAGGAAGCTGGAGTCGAACTCCCTTATTCGTGCAGGGCCGG
TGCTTGCTCGACTTGTGCTGGGAAGATAGAATCGGGCCCTGTTGATCAGTCTGACGGATCGTTTCTGGACGACAACCAA
ATGAAGGAGGGTTATCTGCTTACGTGTGTTCTTACCCAACCTCTGATTGTGTGATCTACACTCACAAGGAGGGTGACC
TTTACTAGGTATCCAACTTTTAGTTATGCTTCAGATCTTGGTTTAAGGTAAAGCAGCTATATAATGCTCTTGTACTCTT
GAGTGTCAGGACTAGAGTTAAATCAAGAACATCTTCTGTTTCATAAATGCTTTTATGTAATGCAGCCTAAT
```

> SEQ ID NO: 5686 126375 246269_301611_1b
```
AGAGCTAGAGCTCATCCATTCTTTCTTCTTTTCTAGCTCGGAACTTTCGACCGGCTTGTTCGATCCAAATGGCGGCAAT
TCTCGCGGCAGCATCGCCAGCAGCGTCGACTGTTCGTCTCCCGACCGCAGCATCGACTTGTTCCAACAAGTCGGCATTG
TCTCTGACCCCAGCACCGCTCTCTCTCTCCAAGAAGTTTGGCCTGTCGAGCAGCAGAGCTAGAATAGTCGCCATGGCAT
CGTACAAAGTCACGCTCAAGCTCGAAAATGGCAGCGAGAAGACGTTCGAGTGCCCCGAGGACGTCTACATTCTGGACCA
GGCCGAGGAGGAAGCCATCGATCTGCCAAGCTCTTGCCGCGCCGGATGCTGCTCGTCGTGCACAGGAAAGGTGGTGAGC
GGCACCGTCGACCAAACCGCCCAGGACTTCTTGGACGATTCTCAGATGGACGAGGGATTCGTCCTCACTTGTGTTGCCA
AGCCAACCAGCGACTGTGTCATCATGACTCACCAGGAAGATAGTCTGTAGAAGCGAGAACTTTCCCCTTCTCGTTCTTG
GTCTGCTTGCTCTTGCTCGTCTCGAGGATATATCGTCGCTCCTCCTGCTG
```

> SEQ ID NO: 5687 126375 126068_300633_1b
```
GGGAAAGCTGAATTCCTCTGCTCAAAACTTCAGATTTTTTCCTTACTTCCGTTGTCTACTAAAAGTTGGAGTTTCTACA
GGTGCAGGTATGTCGACTATAAGCATTCCCTCAGGTTCTTTCCTCAAAGTTGCACCATCAATAAGATCATATGCCTTTA
CCAAGTCCCAATGCTCTTTGGGTTCTGTAAAGAGTATTTCTAAAGCATTTGGCTTGAAGTCGTCGTCCTCCTTCAAAGT
CTCTGCAATGACAGCATACAAGGTTAAACTGGTTGGGCCCGATGGTAATGAGACTGAAATTGAAGTCTCCGATGATCAA
TACATCCTCGATGCAGCAGAGGAAGCTGGAGTTGAGCTGCCTTATTCATGCAGGGCTGGATCTTGCTGTACATGTGCAG
GCAAGTTGGTTTCTGGAACAGTCGACCAATCCGAAGGTGCATTCCTTGACGATGATCAAATGGAGAAGGGTTATTTGCT
GACTTGTATTTCATACCCGAGATCTGACTGTGTTATTCATACACACAAGGAAGAAGAGCTCGTTTGAGCATGTTTGTTC
ATTTTGCTTCAAGTGGGGAGCTTGAAAATTGAGAGTGTAATTGTGCCGTAGACGCGTAAACGAAACAATAAGCAGAAAT
AAATGAAGAAATTGGTTTGCTGCCTCCCAGATGGAGAT
```

> SEQ ID NO: 5688 126375 136733_300438_1b
```
CCCGGGCCGCGCACTCCCAACTCCTCTCCTGTCCTTCCCACTACTCTCGCGAGGAGGAAAGCGAAGCCAAGCGAGAGAG
GCTTCCGCCGTCGCCTTCCCCTTCCGCCTTCCGATCGGTCGCGAGGTTTCAAGATGGCGACGTGCACACTTGCAACTTCA
TGTGTGTCCTTGAGCAATGCTAGAACTCAGGCCTCCAAGGTGGCGGCGGTCAAGAGCCCGGCATCTCTAAGCTTCTTCA
GCCAAGGCATGCAGTTTCCAAGCCTGAAGGCCTCCTCCAAGAAGCTTGACGTCTCGGCAATGGCTACCTACAAGGTTAA
GCTCATCACACCAGAAGGGCAAGAGCACGAGTTCGAGGCTCCGGATGACACCTACATCCTTGATGCCGCCGAGACCGCT
GGAGTAGAGCTTCCCTACTCATGCCGTGCTGGAGCATGCTCTACCTGTGCCGGTAAGATCGAGGCTGGCTCCGTCGACC
AGTCGGATGGATCATTCCTTGATGATGCGCAGCAGGAAGAAGGCTATGTGCTGACATGTGTCTCCTACCCTAAGTCCGA
CTGCGTCATCCATACTCACAAGGAAGGAGACCTTTACTAAGGTGCTTTTTCTTGAAAATTTTCTG
```

> SEQ ID NO: 5689 126375 131040_300510_1b
```
GAATTCACAACCTCAAACTTGTTAGCTACAACTTCTCCATTTCTCTCATCTTATTAGAAAAATGGCAGCAACACTTTCA
GGTCCCATGGTTAGTACCTCATTCATCAGAAAACAACCCGTAACAAGTCTTCGTTCAATCTCTAACGTAAGCCAAGCTA
TGTTCGGGCTAAAATCCAGCCGTGGTGGTAGAATAACCGCAATGGCTACATACAAAGTGACCCTAGTTACACCCGAGGG
AAAACAAGAATTCGACTGTCCAGATGATGTCTACATTCTTGACCATGCTGAAGAAGTTGGAATCGATCTTCCTTACTCA
TGCCGTGCAGGTTCCTGTTCTTCATGCGCCGGGAAAGTCACTGGAGGAACACTCGACCAATCTGATGGTAGTTTCCTTG
ATGATGAGCAGATTGAAGAGGGTTGGGTGTTGACTTGTGTCGCATACCCAACATCCGATGTCACCATTGAGACTCACAA
GGAGGAAGAACTAACTGCTTAATTAGTTGTCCCTTCTTCAATTAATTCATGACATTTTTCATTATGTTTCATTTTAAGA
CAATATGTGGTTGTGGTGGTGTTCTGAATCCTATCTAAATTTTTCTATTTGTCTTGATTGATTGTCTTATGAGAACATG
AGCTATAAGTATTATCAAGTGTGCTATGATAATTCAAAACTTTCATTGGTTTTATATA
```

> SEQ ID NO: 5690 126375 1109055_301543_1b
```
GTCTGTCGGCCACCGCACGCACTCGCGCACGCTCGCTAAGTGAAACCAAGCTCGTAAACCACGCCGCCATCCATGGCTT
CCCTCGCCTTCGCATCCCCTGCATCCACCGCCACCTCCGCGCCCGCGCCATTCAAGATGGCCGGTTTCGCCTCTGGCCC
TCGTAGCCTCCCATGTCCCACCCCCGCCTTCTTTTCGTGGCCCTCCCCCGCCGTCCGTAGAAACGTCGCGATGGCTTAC
AAGACCGTTCTGAAGACCCCTCCGGCGAGTTCACCCTCGACGTCCCCGAGGGTACCACCATCCTCGATGCCGCTGAGG
AGGCCGGCTACGACCTTCCCTTCTCCTGCCGTGCCGGCGCGTGCTCCTCCTGCCTGGGCAAGGTTGTATCGGGCTCCGT
CGACCAGTCCGAGGGCTCCTTCCTCGACGACGGCCAGATGGAGGAAGGGTTCGTCCTGACCTGCATTGCCATCCCTGAG
TCCGACCTCGTGATCGAGACCCACAAAGAGGAAGAGCTCTTTTAAGCCCCCCACACCCACATCCAAACCCACACACTCA
TACCCATTGTTTAGGACTATG
```

FIG. 2 continued

> SEQ ID NO: 5691 126375 172078_300539_1b
CCCACGCGTCCGCCCACGCGTCCGCTACCTTACCTAGCAGCAGCAGCTAGCTAGCTTAATTAGCTATAGCAGCCATGGC
GGCGACGGCACTGAGCAGCCAGGTCCGGTTGCCGATGTCCCTGCGGGTGGCGACGGCGCCGGCGCCGGCGCGCGTGTCG
GTGCTGCCGGCGAGCAACAAGCTGGGAGACAGGCTGCGGATGCAGGCGACGTACAACGTGAAGCTGATCACACCGGACG
GCGAGGTGGAGCTGCAGGTGCCGGACGACGTGTACATCCTGGACCAGGCGGAGGAGGAAGGGATCGACCTGCCTTACTC
CTGCCGCGCGGGCTCCTGCTCCTCCTGCGCCGGCAAGGTGGTCTCCGGCGAGATCGACCAGTCCGACCAGAGCTTCCTC
GACGACGACCAGGTTGCCGCCGGCTGGGTCCTCACCTGCCACGCCTACCCCAAGTCCGACGTCGTCATCGAGACCCACA
AGGAGGACGACCTCATCTAATCAATCAAGCAAGCTCCATATTTATAAATCTCTCGATCCATCTCCATGCGTTCTTGAGT
TTATCAATTAAGAATATAATGTCGTCGTCCCTATGCTATGCAAGCAAAGTATTACGTACGTATATGTTGAGCGAGATAA
CAAAACAACAGCGTGCCCGAGGGTTAATTGTTGTTGTTTAATTAATGTACGTTTTGCTGCACCTGCTTAATCATATCCA
TATCACATTTT

> SEQ ID NO: 5692 126375 182966_300664_1b
GAATTCACAACCTCAAAATTGTTATCTACTAATTCTCCATTTGTCTCATCTTATTACAAATATGGCGGTAACAATTTCA
GGTCCCATGGTTAGTACCTCATTCATCATAAAACAAACCGTAAAAATTCTTCGTTCAATCTCTAACGTAAGCCACACTA
TGTGCGGGCTAAAATCCAGCCGGGGTGGTTAAATAATCGCAATGGTTACATACGAAGTGAACCTAGTTACACCCTGTGG
AAATCAAGAATACGACTGTGCACATGATGTCTACATTCTTGACCATGCTGAATAATTAGGAATCGATCTTCCTTATTCA
TGACGTGCAGGTTCCTGTTCTTCATGCACCGGGAAAGTCACTGGAGGAACACTCCATCAATCTGATGGTATTGTCCTTG
ATGATGAGTAGATT

> SEQ ID NO: 5693 126375 201435_300716_1b
ACTACTCTCGCGAGGAGGAAAGCGAAGCCAAGCGAGAGAGGCTTCCGCCGTCGCCTTCCCCTTCGCCTTCCGATCGGTC
GCGAGGTTTCAAGATGGCGACGTGCACACTTGCAACTTCATGTGTGTCCTTGAGCAATGCTAGAACTCAGGCCTCCAAG
GTGGCGGCGGTCAAGAGCCCGGCATCTCTAAGCTTCTTCAGCCAAGGCATGCAGTTTCCAAGCCTGAAGGCCTCCTCCA
AGAAGCTTGACGTCTCGGCAATGGCTACCTACAAGGTTAAGCTCATCACACCAGAAGGGCAAGAGCACGAGTTCGAGGC
TCCGGATGACACCTACATCCTTGATGCCGCCGAGACCGCTGGAGTAGAGCTTCCCTACTCATGCCGTGCTGGAGCATGC
TCTACCTGTGCCGGTAAGATCGAGGCTGGCTCCGTCGACCAGTCGGATGGATCATTCCTTGATGATGCGCAGCAGGAAG
AAGGCTATGTGCTGACATGTGTCTCCTACCCTAAGTCCGACTGCGTCATCCATACTCACAAGGAAGGAGACCTTTACTA
AGGTGCTTTTTCTTGAAAATTTTCTGCCAAGAGGCAAAAAACTCTCAATGTCGTCGGCAAGGTCCATCGTGTGTACCAG
TTGTCTCAACTCTCAATTAAATCGGACTTTGATGGTGGTTTTGAATGTTGTCTTTCGTTAGTATGCGTTTCAAGGTTGG
GGCTAAGAGATGGGAACCCAATGGTAATACTAGCTAGTCAATAATAACCAGCTGCTATGGCGTAATACAATTCGTGGTT
TTGGATATAATTTGCAATATTATTATCTTCA

> SEQ ID NO: 5694 126611 116442_300068_1b
AAATTCTCAGCTTATAGTCAGGTGAGGTCTGAGCTGAGGTTGAGAGATGGCACAGGCAATGGCGTCCATGACCGGGCTG
TCGCAGGGCGTGCAGCTGCCGGCCGGGCCCAGGCGCGCCGGCGGCAGGTCCAGGCTCGCCGTCGTCAGGGCCGACGCCG
CCGCCGCCGACGTCCAGACCGGCCGCCGCGCCGTGCTCGGCCTCGTCGCCACCGGGATCGCCGGCGGCGCCCTCGCGCA
GGCGGCGCTCGCCGAGGCCGCCAAGCCCATCAAGCTCGGCCCCCCGCCACCGCCCTCCGGTGGACTCCCTGGGACGCTG
AACTCGGACCAGGCGAGGGACACGGACCTGCCGCTGAGGGAGAGGTTCTACCTGCAGCCGCTGCCGCCGGCGGAGGCGG
CGGCGAGGGCGAAGGAGTCGGCCCAGGACATCATCAACCTCAAGCCGCTCATCGAGAAGAAGCAGTGGCCGTTCGTCAG
GGACGACCTCCGCCTCAGGGCCTCCTACCTGCGCTACGACCTCAAAACCGTCATCAACTCCAAGCCCAAGGACGAGAAG
AAGGGCCTCAAGGACCTCACCGGCAAGCTCTTCGCCACCATTGACGGGCTTGAC

> SEQ ID NO: 5695 126611 141975_300430_1b
CCCGATCTGAAGAGAGAAATTCTCAGCTTATAGTCAGGTGAGGTCTGAGCTGAGGTTGGGAGATGGCACAGGCAATGGC
GTCCATGACCGGGCTGTCGCAGGGCGTGCAGCTGCCGGCCGGGCCCAGGCGCGCCGGCGGCAGGTCCAGGCTCGCCGTC
GTCAGGGCCGACGCCGCCGCCGCCGACGTCCAGACCGGCCGCCGCGCCGTGCTCGGCCTCGTCGCCACCGGGATCGCCG
GCGGCGCCCTCGCGCAGGCGGCGCTCGCCGAGGCCGCCAAGCCCATCAAGCTCGGCCCCCCGCCACCGCCCTCCGGTGG
ACTCCCTGGGACGCTGAACTCGGACCAGGCGAGGGACACGGACCTGCCGCTGAGGGAGAGGTTCTACCTGCAGCCGCTG
CCGCCGGCGGAGGCGGCGGCGAGGGCGAAGGAGTCGGCCCAGGACATCATCAACCTCAAGCCGCTCATCGAGAAGAAGC
AGTGGCCGTTCGTCAGGGACGACCTCCGCCTCAGGGCCTCCTACCTGCGCTACGACCTCAAAACCGTCATCAACTCCAA
GCCCAAGGCCGAGAAGAAGGGCCTCAAGGACCTCACCGGCAAGCTCTTCGCCACCATTGACGGGCTTGACCATGCAGCC
AAGATCAAGAGCCCCGAAGAGGCGGAGAAGTACTACACGTTGACCAAATCTGCTCTTGGCGATGTCCTCGCCAAGCTAG
GCTAGGATCGGCATAATGGCCATATGGGTTTCGGTGTTTTTATGTTTGTTCATATGGAACCGGCAATGTACCCTCCAT
GTTGATATTGTATCAGCAAGCACTTACGTATGATTCAATCTTGAGTTGTTGTTGACGGCTAAATCTCCAAGCAGGCGCG
ATTA

> SEQ ID NO: 5696 126611 27215_300394_1b

FIG. 2 continued

CCGGGGGCGTCCGAAAAAAAATGGCTCAAGCAGTGACTTCGATGGCTGGCTTACGTGGAGCATCTCAGGCTGTCCTTGA
AGGAAGTTTACAGATCAACGGCTCAAACCGTTTGAACATCTCAAGAGTCTCGGTTGGGTCTCAGAGAACCGGACTTGTG
ATCAGGGCTCAGCAGAACGTGTCAGTACCAGAAAGTAGTCGCCGGTCAGTGATTGGACTCGTGGCGGCTGGTTTAGCCG
GTGGTTCATTCGTTAAAGCTGTTTTCGCCGAAGCTATTCCGATCAAAGTTGGTGGTCCTCCACTTCCTTCCGGTGGCCT
ACCTGGAACAGATAACTCAGACCAAGCAAGAGACTTTTCATTGGCATTGAAAGATAGATTTTACATACAACCATTGTCA
CCAACAGAAGCTGCAGCTAGAGCCAAAGATTCTGCTAAAGAGATCATCAACGTTAAGTCATTTATCGACAAAAAGCTT
GGCCCTATGTTCAGAACGATCTCCGTTTAAGAGCATCGTACCTCCGTTACGATCTCAACACCGTTATCTCCGCTAAGCC
TAAGGAAGAGAAGCAAAGCCTTAAAGATCTCACCGCAAAGCTTTTCCAAACCATTGACAACTTGGACTATGCGGCGAGA
TCAAAGAGTAGCCCAGATGCTGAGAAGTATTACTCCAAAACTGTCTCGAGTTTGAACAATGTTCTTGCCAAGCTCGGTT
AATGAAGAAAGACTTGCGTTGTAATCTGTTGATGTCGATGTTATTATAATTAC

> SEQ ID NO: 5697 126611 183015_300665_1b
GAATTCAGTAGCTCACAAGCTGTCTTGGAAGGTAGCCTTCAACTCAACAGCTCTACCCGCTTGAGTGGAGTTAGTAACA
ACCGAGTAAGCGTGATCAGTCGATCTAGTTTCACAGTTAAAGCTCAGTCATCGGACAATGAAGCCGTAGCTCAGAGTAG
TCGCAGAGCTGTCTTGGGACTAGTAGCTACCGGATTGGTAAGTGGCTCATTCATTCAGCGTGTGCTTGCTGAAGCAAGG
CCAATTAAGGTCGGATCACCTCCCAAGCCATCCGGTGGATTGCCTGGAACTCTTAACTCAGACCAGGCTAGAGACCTTG
ATCTACCATTGAAGGAGAGGTTCTTCCTTCAACCACTGTCTCCAACAGAGGCTACACAAAGAGCTAAAGAAGCTGCTAA
AGAGATTCTTAACGTGAAGAGTAACATAGACAAGAAGGCATGGCCTTACGTTCAGAACGATCTTCGTTCCCAGGCTGGA
TATCTTCGTTATGACCTCAAAACTATAATTTCTTCAAAGTCCAAGGATGAGAAGGCTTCGCTTACAGATCTCACCAACA
AACTCTTTATTTCCCTTGACAAACTGGACAATGCAGCAAAGATCAAAAGCAGTGAAGCAGCAGCAAAGAGTTATGCCGA
TGCTGTAGTGTCTTTG

> SEQ ID NO: 5698 126632 44645_300107_1b
GCCATTACGGCCGGGGCAGAGATCGGGAAGAAAAGATGCGTAGAATGGTAGAGTATGGTTGGCAAAACACGTCGTCGAA
TGAGTATCTTGATCATATTAAACGAATGGAGAGATCGCCAACGATGCACCCTGATCTTCCTCTCTACCCAAATGTCCAC
TCCCTCTTCAAAAATGGAATAGTGAGCAACGGACAAGAAAAGAAATGCACTACACTAACACCACAGTCGCAGAAGAAAG
TTCATTTCGTGGAACCTAAAGCTGAACTTACCAAGAATGAAAAGAAGAGTATTGACATGGAGGCTGATGGCTATATAAA
GCAGAAGCACGTCAACTTTGAGCTCCACAATGGGAGAACCTTCAAAGCTTGTTAAAAAGTTTCCAACGTACTTCATACA
AGATATACTACATGATATCTTAGTATAAATAACATGTAATATATGTCTGTCTTATTAGCTTCTGTTTGTACTCTAAAGG
GAAAGATATCTCTTATATGCGCTGTGACTATATATTTCGTAGATGTGGTGTTTTGATTTCAATTTATCTAATAATAAAG
CTATAAGTATGTTTATTACG

> SEQ ID NO: 5699 126632 126627_300465_1b
GCCATTACGGCCGGGGGCAGAAAGAACAAGCTAAGGGCTAGTTACTTAAGCAAATCAAGAAAATATGAGATCCATGCAG
TATTGGGAACCAACGTCTGACGATGAATTCGTCGATCATATTAAAAGAATGGAGAAAGCCCCAACCATGCACCCTGATA
TTCCTCTCTATCCAAATGTCTATTCTGTTTTCAAAAACAAAGCAAGCTATGATCAACCACAAAAATCTAGCTTGAATCA
TCAGAAGGACCCGTCCGCAGAATCCCTGAAGAAGGTTCAGTTTGCTGAATTCAACAAGAATGAAGAGAAGAACATCAAT
ACTCAGGCTGAGGCATATATCAACCAGAAGCACAAGAATTTTGAGCTACACAAATGGAGGACCTTCAAAGTATCATGTT
AAATGGTTTCAATCTTGTTGGCTGCAGGCAGCTGTCTGGCACTGGTGCTCTTCAATAACCTACGTAATATGTTACTCTG
CGTTTGTATCCCACAAAAATAAGGGGAATTTTTTTTTCAAGATATCGTTCATGTTTATCTTATATTTCCTATAGAGAGT
AGTACATTTGCACTGTGATTTGTTCTATCTAATAAAATGTTGTCTGTTTACTTTTCTG

> SEQ ID NO: 5700 126840 1112368_301802_1b
AAAGAGGAAGGAAGGAAGGAAAGGATGTCCATCGCCGCCGACCTGCCGTTCCCTGCTATGGCGACCGTCGTCTGATCTA
CCCCTTTCCTTTCCCTCCTCCGCCGATATGGCCTGTCCCGCCCCCGTGCAGACTATGACTTCCTCGTCAAGCTCCTTCTCAT
CGGGGACAGCGGTGTTGGAAAAAGTTGCCTTCTTCTCCGATTCTCTGATGATTCTTTCACCACAAGCTTTATTACTACA
ATTGGAATTGATTTCAAGATTAGAACGGTGGAGATAGATGGGAAACGGATCAAATTGCAAATCTGGGACACAGCTGGGC
AGGAACGCTTTCGAACAATAACCACAGCATACTACAGGGGTGCCATGGGGATTATCCTTGTGTACGATGTTACAGACGA
GTCTTCATTTAACAACATTGGGAACTGGATCAGGAACATTGAGCAACATGCCTCTGAGAATGTCAACAAAATATTGGTG
GGCAACAAGGCTGATATGGATGAAAGCAAGAGGGCTGTTTCATTTGCAAAAGGCAAAGCTCTTGCCGATGAGTTTGGTA
TCAAGTTTTTTGAAACGAGTGCGAAGACAAACATGAATGTGGAGGCGTCCTTTGTCACAATTGCAAGGGATATCAAACA
GCGGCTTTCGGAGTCAGACTTCAAACCACAGCCC

> SEQ ID NO: 5701 126840 1118757_301858_1b
TTCCTCGATTCGAAGAACAAGAAGCAGAAGGAGAAGAAGAGGAAGAAGGAATAGCCCTACCCTTATCGCTCAACGGAAA
ATAATTCCTGCCCCCCATAATAATAATAATAATAATACCTTTCAATCCATTCAATTGCTTCCGATAATTCCCCTCTCTT
CCCAATTCGCCGGCCATCCGGGTTCAAAACTCCCCGTGGGGAACGCGCAGCACTGTTTTTCAGCCTACCCATCGACGAC
CCTTGTGAAGATGTCCTACCAGTATCTCTTCAAGTATATCATCATTGGCGACACAGGCATTGGCAAATCATGCCTCTTG

FIG. 2 continued

TTGCAGTTTACAGACAAGAGATTTCAACCTGTACATGATCTTACCATTGGAGTTGAGTTTGGGGCTCGTATGATCACAA
TTGGGAACAAGCCTATTAAGTTGCAGATTTGGGATACTGCAGGACAAGAATCATTTCGATCTATCACCAGATCATACTA
CCGCGGTGCTGCGGGTGCATTGCTGGTCTATGATATCACCAGGCGAGAAACTTTCAACCATCTTGCAAGCTGGCTGGAA
GATGCTCGGCAACATGCCACTACAAATATGGTTATCATG

> SEQ ID NO: 5702 126840 137923_300687_1b
GTTGCAACCTGCGAGCGGAAACCCACCTCCACCCGTCGCCGGCCTGCCGCCGCCGCCGCCGCCGCTTGCCCTCCTCCG
CCTTACTCGGCCTCCGGCGCCTCCTGACCCCCCGGCCATGGGTTGCTCTTCGTCTCTGCCAGCTAATAATGCTGGAGGG
GTAGGTACTATCAGCAACGAGAATTCTGGTACTGATCTGAAGAACTTGCGAGTGAAGTTGGTATTGCTTGGAGATTCAG
GTGTTGGGAAAAGTTGCATTGTTCTTCGCTTTGTCCGTGGTCAGTTTGACCCCACTTCAAAGGTGACTGTTGGTGCATC
ATTTTTGTCACAAACATTGGCGTTGGAGGATTCCACAACAGTAAAGTTTGAAATATGGGATACTGCTGGTCAGGAGAGG
TATGCTGCATTGGCACCTCTTTACTACCGGGGAGCTGGTGCCGCAATTGTTGTGTATGACATAACAAGTTCAGAATCAT
TTAACAAGGCACAATACTGGGTGAAGGAACTTCAGAAACACGGTAGTCCAGATATGATCATGGCTTTGGTTGGAAATAA
GGCTGATCTACATGACAATCGTAGTGTATCCTCTCAGGATGCACAAGAGTATGCAGAGAGGAACACTATGTTTTTCATC
GAGACATCAGCGAAAA

> SEQ ID NO: 5703 126840 266192_200084_1b
AATATCAAAAGGGAAAAATACAAACCTAAAAAAGGGTTCACCTTTTGTTAATTTGATTTTTTCACCATGTCTATGCGTA
GGAGAACCTTGCTTAAAGTCATCGTCCTCGGCGATAGTGGGGTTGGTAAAACGTCATTAATGAATCAATATGTTCACAA
GAAGTTCAGCCAGCAATATAAAGCTACAATTGGAGCTGATTTCGTGACAAAGGAGCTTCAAATTGATGACAGGCTTGTA
ACTCTCCAAATATGGGATACAGCTGGCCAAGAGAGATTTCAGAGTCTTGGAGTTGCATTCTATAGAGGTGCAGATTGCT
GTGTTTTGGTCTATGATGTCAATGTTATGAGATCCTTTGATAACCTTGACAATTGGCATGAAGAATTTCTCAAACAGGC
TAATCCACCAGACCCTAAAACATTTCCTTTCATATTACTGGGGAACAAGATTGATATAGATGGTGGAAATAGCAGAGTG
GTTTCTGAGAAGAAAGCAAAGGAATGGTGTGCTTCAAAAGGGATACCTTACTTTGAGACATCAGCAAAAGAGGATATAA
ACGTTGATGCTGCATTCTTGTCTATTGCAAAAACTGCTTTGGCCAATGAACACGAGCAAGATATATACTTCCAGGGCAT
TCCGGAGGCAGTTTCAGAGACAGAGCANAGAGGTGGTTGTGCATGTTAAGGTGAATGAAGCAATTTCATTGAGTGCTAT
ATGTAATCG

> SEQ ID NO: 5704 126840 281523_200071_1b
GCAAGATCCCAGCAAAGACTAGCCAAGATCTGCGTCTCCTCTCTCTCTCTCTCTCTCTCTCTCTCTAACTTTCAA
CTGCTGATTGAGTGCACAGAAGCTTAGTGTTCTGGTTTAAAAAAAGATGGCGAGTGGGTATGGGGATGCGAGCCAAAAT
ATAGATTATGTATTCAAAGTGGTGTTAATCGGCGACTCATCTGTAGGCAAGTCTCAGATACTGGCTCGATTTGCTCGTA
ATGAATTTAGCCTGGATTCTAAGGCCACGATTGGGGTTGAGTTCCACACCCGAACCCTAGTCATTCAACACAAGTCTGT
TAAAGCTCATATCTGGGATACTGCTGGTCAAGAACGATATAGAGCTGTCACAAGTGCATACTACAGGGGCGCAGTTGGA
GCTATGTTGGTTTATGACATAACGAAACGGCAAACCTTTGATCACATACCCCGTTGGCTGGAAGAGTTGCGCGCACATG
CCGATAGGAATATCGAGATCATGCTGATCGGACACAAAACAGATCTTGAACACCAACGAGCTGTCCCTACCGAAGATGC
TAAAGAATTCGCCCAGAAAGAAAGATTATTCTTCTTGGACACTTCTGCAATGGAAGCCACACACGTGGAGGATGCATTC
TTGACTGTTTTGAC

> SEQ ID NO: 5705 126840 238083_301291_2b
GATCGATCGATAGAATCGACTCTAGGGTTTAGCAGCAGCAGCAGCTCGTCGATTCTTTCCTCCTTCTTGATTGATCATG
GCGCGGCGGCCGGATGAGGACTACGACTACCTCTTCAAGGTGGTGCTCATCGGCGACTCGGGCGTCGGGAAATCCAACC
TGCTCTCCAGATTCACGCGCAACGAGTTCTGCCTCGAGTCCAAATCCACCATCGGGGTCGAGTTCGCGACCCGCACGAT
CCAAGTGGACGGCAAGACGATCAAGGCTCAGATCTGGGACACGGCCGGGCAGGAGCGTTACCGCGCCATTACCAGCGCC
TACTACCGCGGCGCCGTCGGCGCTCTCCTCGTCTACGACATCACCAAGCAGGCGACGTACGAGAACGTGGAGCGGTGGC
TCAAGGAGCTGCGCGACCACGCCGACTCCAACATCGTCATCATGCTGGTGGGCAACAAGTCGGACCTTCGCCACCTCCG
CGGCGTGACGACGGAGGACGCGCAGGCCTTCTCCGAGAGGGAGGGGCTGCTCATCGAGACGTCGGCCCTGGAGGCG
ACCAACGTGGACAAGGCGTTCCAGAGCATCCTGGGCGAGATCTACCGGATAGTGAGCAAGAAAGCGCTGGCGACGGCGG
ACGAGCTGTCGTATGTGGCTCCGGGCGAAGGCAGGCCATCCACGTCGGGCCCGAGCAGGATGGCGGCGCCGTCAAGAAG
AAGGCGTGC

> SEQ ID NO: 5706 126840 259823_301709_1b
ACGCGTCGAGGCTGGAAGCAAGCGATCTTTTATTTCTCTTCTCCTCTCGCCAGATCGATCGCCGCCGGCTCAGGCCAGT
TCTTCCGGGAGATCCAGCGCTATGGCCTACAGATCGGACGAGGACTACGACTATCTCTTCAAGGTAGTGTTGATTGGCG
ACTCGGGCGTCGGCAAATCCAACCTCCTCTCCAGATTCACGCGCAACGAATTCAGCCTCGAATCCAAGTCCACCATCGG
GGTCGAGTTCGCGACCCGTAGCATCAACGTCGACGGCAAGCTCGTCAAGGCACAGATTTGGGACACGCCGGGCAGGA
AGATATCGAGCGATCACCAGCGCCTACTACCGCGGCGCCGTTGGCGCTCTCCTCGTCTACGACATCACCCGGCCGGTGA
CGTTCGAGAACGTGGAGCGGTGGCTCAAGGAGCTCAAGGACCACACCGATTCCAACATCGTGGTGATGCTGGTGGGGAA

```
TAAGTCCGACCTGCGCCACCTCCGGGCCGTGTCCACCGAGGACGGCCAGGCCTTCTCCGAGCGCGAGGGGCTCTACTTC
ATGGAGACGTCGGCCCTCGAGTCGACCAACGTGGAGAATGCGTTCAAGCAGATACTGACGCAGATTTACCGGGTGGTGA
GCAAGAAGGCCCTGGATGTCGGCGAGGACCCCTCCGCCGCCCCGGCTAAAGGACAGACTATCAACGTTGGCGGCAAGGA
CGATGTCACGGCTACCAAGAAGGTTGGGTGCTGCTCCACCTGAATCATGGTCGACGTTTTAGCTGGTTTCGATTGATCT
GGTAGCTACAGGTGGGAAGTTTAGATCAGACAGCTGGTTCTTGATAGCTACGAATTCTTTTGCTCTACTAGGTAGCAAA
TTCTTTAAATACTTTTTCTTAACTT

> SEQ ID NO: 5707 126840 253866_301630_1b
AAGAATCATTTAGATCTATCACAAGATCTTACTATCGAGGAGCTGCCGGTGCTCTACTTGTCTATGATATCACCAGAAG
AGAAACTTTTAATCATCTTGCAAGTTGGTTGGAGGATGCTCGCACTCATGCAAACTCCAACATGACAATCATGCTCATC
GGCAACAAGTGTGATCTTTCTCATCGAAGAGCAGTCAGCACCGAGGAAGG

> SEQ ID NO: 5708 126840 249877_301596_1b
ATTGTGAGAGTAGCACAGGAGTTTAGTTTGGATTCGGGCTCGGGGCGAGAAGAATGTCGGATTTCGATGTGAAGATCGA
CTATGTGTTCAAGGTGGTATTGATTGGCGACTCCGCCGTCGGCAAATCTCAGCTGCTGTCGAGATTCGCGCGCGACGAG
TTCACCCTCGACTCCAAGTCCACAATTGGCGTCGAGTTCCAGACCCGCACCATCTCCGTCGACGGCAAGACCATCAAGG
CACAGATCTGGGACACCGCCGGCCAGGAGAGGTACAGGGCGGTCAGCGCGCTTACTACCGCGGCGCGGTCGGCGCCAT
GCTGGTTTACGACATCACGAGAAAGCAGACGTTCGAGCACGTAGCGCGGTGGCTGGAGGAGCTGCGGAACCACGCCGAC
AACAACGTGGTGATCATGATGGTCGGGAACAAGTCGGATCTGACCGACAAGCGGGCCTTGTCTTTGGAGGAGGCGCGAG
AGTTTAGCGAGAAGGAGGGGCTCTACTTCATGGAGACGTCGGCACTCGACTCGACCAACGTCGAGACAGCCTTCATCAC
CGTGCTCACGGAGATCTACAAGATCGTCAGCAAGAAGAGCCT

> SEQ ID NO: 5709 126840 247337_301619_1b
AAGAAGACCGAGTTAGAGAAGAACAGGGTAGAGAAAGAAGAAGAGTTGGAGAAGATGTCGTCAGCAGTGAGGCCGGGAC
CCGGCGCAGACCACGACTACCGCATCAAGCTGCTGCTCATCGGCGACAGCGGCGTTGGCAAGAGCTGCGTGCTGCTCCG
CTTCTCGGACGACTCGTTCACGACGAGCTTCATCACCACCATCGGCATCGACTTCAAGATCCGCACCATCGAGCTCGAC
GGCCGCCGCGTCAAGCTCCAGGTGTGGGACACCGCCGGCCAGGAGCGCTTCCGGACCATCACCACCGCCTACTACCGCG
GCGCCATGGGCATCATCCTCGTCTACGACGTGACCGACGAGTCGTCCTTCAACAACATCCGCAACTGGATCAAGAACAT
CGAGCAGAACGCGTCGGAGAACGTCTCCCGCATCCTGGTCGGGAACAAGGCCGAC

> SEQ ID NO: 5710 126840 241818_301323_1b
AGGGAAGATCATCGTGCATCGCGCGGAGGTCTGGATCGGCAGCGCTAATGGCGGCGGGGAGAGCGCGGGCGGACTATGA
CTACCTCATCAAATTGCTGCTCATCGGCGACAGCGGTAAGAGAAAGAATTTCGATCCGGCGGGGGAAGTCTTTGTCTAG
CAGCTAGATCTCTGCTCGATCTGCACGAAATATCGATGAGCTGATGGATTTGGTCGCCGCATTTCTCTCTGCCCGCAGG
TGTGGGGAAGAGCTGCCTTTTGCTGCGCTTCTCGGACGATTCCTTCACGACGAGCTTCATCACGACGATAGGCATTGAC
TTCAAAATCAGGACCGTTGACCTGGATGGCAAGAGGATCAAGCTTCAAATTTGGACACCGCTGGGCAAGAACGCTTCC
GGACGATCACAACTGCATACTACCGAGGAGCTATGGGCATTCTTCTCGTCTACGATGTGACGGATGAATCATCGTTCAA
CAACATCCGGAACTGGATCAGGAATATCGAGCAGCACGCGTCGGACAATGTGAACAAGATCCTGGTCGGCAACAAGGCC
GACATGGACGAAAGCAAGAGGGCCGTATCAACAGAAAGAGGGCAAGCTCTTGCGAACGAGTTTGGTATCAAGTTCTTCG
AAACCAGCGCGAAGACGAACATGAACGTGGAGAACGTCTTCTTCACAATCGCGGGAGACATCAAGCGGAGACTAGCGGA
AACAGACTCCAGACCCGAGCCTCCCAGGATCAACAACGTAATACTAGACCCGTCGAAGGATCAGAACAACAACAAAGAC
AAGTCATCATGTTGCACCTGAGAGCAAG

> SEQ ID NO: 5711 126840 240662_301316_1b
CTGCTTAGACTTCAGTGAGGCCAGCATATTCTGTAGGTTCCATCCAGAGGAAGAAAATGGGGTGTGCTGCTTCCAGGCC
GGTGAAAGGCTTGCAAAATCTGAACGACAGTGCTCAGGAGCACGATGCCAAACACTTGAGGGTCAAGCTGGTTCTTCTG
GGAGACTCTGGAGTAGGAAAGAGCTGCATTCTCGTCGCGTTTGTGAAGGGCCAGTTTGATCCATCATCAAAGGTCACAG
TTGGTGCTTCCTTTCTGTCGCAAACCATAGCTCTCCAAGACTCAAGTACAGTCAAGTTCGAGATATGGGACACCGCAGG
ACAAGAGAGATATGCTTCGTTAGCACCGCTCTACTACAGAGGAGCGTCTGCAGCCGTTGTAGTCTACGACCTGACGAGC
AAGGAATCGTTCCAGAAGGCTCAGTACTGGGTCAAGGAGTTGCAGAAACACGCGAACTCTGGAATTGTCCTGGCGCTCG
TTGGGAACAAAGCCGACCTTGAAGACTCGCGTGCGGTCTCGTCAGATGAAGCTCGGTCATACGCAGAGAGCAACTCCAT
GTACTTCAGCGAGGTGTCGGCAAAAACTGCCGACAACATCAACGCGCTTTTCGAGGAAATCGCAAAGAGACTTCCTCGG
CCTGGAAAGCAAT

> SEQ ID NO: 5712 126840 239387_301303_1b
GGCAACACGAGGAGGTCGTAGGGTTTGCGGGAGAGCTCTCGCCGAAGGCCTGATCTGTGCTGGGATCTACACCAGGAGC
TCAAGCATGGCATCCAGGAAGCGAACTCTCCTCAAGGCGATCATTCTCGGCGACAGCGGCGTCGGCAAGACATCGCTCA
TGAATCAATACGTGAACAAGAAATTTAGCAACCAGTACAAGGCGACCATTGGAGCTGATTTTCTCACCAAGGAAGTCCA
```

FIG. 2 continued

AGTGGAGGATAGGCTAGTGACGATGCAGATATGGGATACAGCCGGTCAGGAGCGATTCCAAAGCCTTGGTGTGGCCTTC
TATCGAGGGGCTGATTGCTGTGTGTTGGTATACGACGTGAATGTGATGAAGTCGTTCGATAATCTGGACAACTGGCGCG
ACGAGTTTCTTATCCAGGCAAGTCCTTCTGATCCAGAGAACTTCCCTTTTATTGTTCTCGGCAACAAGGTCGATGTAGA
CGGGGGGAACAGCAGAGTGGTATCCGAGAAGAAAGCCAAGGCCTGGTGCGCGTCGAAGGGAAACATTCCATACTTTGAG
ACGTCTGCCAAAGAAGACTACAACGTTGAGGCTGCTTTTCAATGTATAGCGAAGAATGCCTTGAGGAGTGAACCCGAAG
AAGACTTCTACCTTCCGGACACGAATGACCTCGCAAACAACAACAGAGTGACGAGATCATCTGGGTGT

> SEQ ID NO: 5713 126840 193939_300777_1b
GGCGGATCGGTGGGTTGCGGGCTTGCACGTAGTCGAGGCTCGAGAGGAGGGGGGATGGCGGCGGCGGCGGCGGCGGCG
GGGTACAGGGCGGAGGAGGAGTACGACTATCTGTTCAAGGTGGTGCTGATCGGGGACAGCGGCGTGGGGAAGTCGAACC
TGCTGTCGCGGTTCGCGCGGGACGAGTTCAGCCTGGAGACCAGGTCCACCATCGGCGTCGAGTTCGCCACCAAGACCGT
CCGCGTCGACGACAGGCTCGTCAAGGCCCAGATCTGGGACACCGCCGGCCAAGAGAGGTACCGCGCCATCACGAGCGCC
TACTACCGCGGCGCGGTGGGCGCTGGTGGTGTACGACGTGACGCGCCGCATCACGTTCGAGAACGCGGAGCGGTGGC
TCAAGGAGCTCCGCGACCACACGGACGCCAACATCGTCGTCATGCTCGTGGGCAACAAGGCCGACCTGCCGCCACCTCCG
CGCCGTCCCCGCGGAGGACGCCAGGGCGTTCGCCGAGGCGCACGGGACCTTCTCCATGGAGACGTCGGCGCTGGAGGCC
ACCAACGTGGAGGGCGCCTTCACCGAGGTGCTCGCGCAGATCTACCGCGTCGTCAGCCGGAACGCGCTCGACATCGGCG
ACGACCCCGCCGCGCCGCCCGGGGGCGGACCATCGACGTCAGCGCCAAGGATGACGCCGTCACCCCCGTGAACAGCTC
AGGGTGCTGCTCGTCTTGACTTTGACTCGCTCAAACTCATCGTCGTCGAGCTATGCAAATTGCCACCGTTCACAGCTTT
G

> SEQ ID NO: 5714 126840 204375_300792_1b
GAGCAAAAGCCAGCCTCGTCATTGAAGCCTCAAAGTATAGGCAGCCGGCATTCAAGGTCTCGTGACGCTTGCGACGCTG
ATTTCTTCCATCACACTACCGGACACTCTTTTTTCGATATCCATCATCACCTTTCCGCCACCAGAAGCACCCGGAGAAG
GCCTCTTCGCTCGCGGCGGCTGTGCTTTTGGCTCATATCTATCACGTCATTGGAGCCCCGAGTGTACGACGATAACCAG
TCAAGATGTCTTCGCGCAACAAGAAGGTCCTTCTCAAGGTCATCATCCTTGGAGATAGCGGTGTGGGCAAGACGAGTTT
GATGAACCAATACGTCAACAAGAAGTTCAGCACAAGCTACAAGCGACTATCGGCGCTGATTTCTTAACGCGAGAGGTC
CTGGTGGACGACCGACAAGTCACCATGCAGCTCTGGGACACAGCCGGACAAGAGAGATTCCAGTCTCTGGGCGTCGCAT
TCTACAGAGGAGCCGACTGCTGCGTTCTGGTGTACGATGT

> SEQ ID NO: 5715 126840 204974_300794_1b
CACAACCACACATCTCAGCGTCACAGCTTCCCTTGTCTGCACAGCATCAAACCACCTTTTCTCACCTGCGCGCATCGAC
TCGTTCTGCTGCTACCATGGCCAACGACGAATATGATGTAGGTTCCGCCCCCTTCTCGCACTGCAACGAAATGAACACC
TGGCGGAACGCTAACGGCGATGCTTCAACCCCCACTAGTTCCTCTTCAAAGTTGTCTTGATTGGTGACTCTGGAGTCGG
AAAGTCCAATCTTCTCAGCCGATTCACTCGCAACGAATTCAACCTCGACTCCAAGTCAACTATCGGTGTCGAGTTTGCC
ACTAGATCGATCCAGGTCGACTCCAAGACCATCAAGGCGCAGATTTGGGATACAGCCGGTCAGGAGCGTTACCGTGCCA
TTACTTCCGCATACTACCGTGGTGCAGTCGGCGCCCTCCTCGTCTATGACATCAGCAAGCACCAAACCTACGAGAACGT
CACGAGATGGCTAAAGGAGCTTCGGGACCATGCCGATGCGAACATTGTCATCATGCTGGTTGGCAACAAGAGCGATTTG
AGACACCTGAGGGCTGTGCCCACGGATGAGGCCAAGGGCTTTGCTAGCGAGAACCATCTTTCTTTCATCGAGACGTCCG
CCCTCGACGCCAGCAACGTTGAACTTGCCTTCCAGAACATCCTTACTGAGATCTACCGAATCGTAT

> SEQ ID NO: 5716 126840 208694_300807_1b
TGCAAAGAACTCGCCCGCAGCTGAGAGGGGGAATAATCCATAATCCGCCAGCCCACGCACATCGCCAGGCAAATCTGC
ACTCTTCTGCACCTCCAAGAGGAGTCGCTTTTGCTGCATCTCCAAAGTCGCAAGCAGACGCCGCCGAAACGAGCCGGTA
AAAGATGGCGGAAGCTCCCAAACCCAGCAGCAGCGTCAAGCTGGTGCTCCTCGGTGAAGCCGCAGTCGGAAAGTCATCC
CTCGTCTTGCGATTCGTCAACAACGACTTCCAAGAGAACAAGGAGCCGACTATTGGTGCGGCGTTCCTGACGCAAAAAT
GCAACCTGGCCACCCGAACCATCAAGTTTGAGATTTGGGATACCGCTGGTCAAGAGCGATTTGCCTCTCTGGCGCCCAT
GTACTACAGAAACGCCCAGGCCGCCCTTGTCGTCTACGACATCACCAAGCCCACATCCCTCGTCAAGGGCCGACACTGG
GTCGCCGAGCTCCAACGACAAGCCTCACCCGGTATCGTCATCGCCCTGGT

> SEQ ID NO: 5717 126840 209274_300813_1b
CTTTCCTAGTCTTCTTCTCCGCCACTCCGAGGCGGCAAGGAGGAAGATCTCGGAGGCGGTGCCCGGAGGAGGTGAGGCG
AGATGGGCGGGCGGGTGGATCACGAGTACTCGTACCTGTTCAAGATGGTGCTGATCGGCGACAGCGGCGTCGGCAAGTC
TAATATCCTCTCCCGCTTCACCCGCAACCACTTCTCCCTCGACTCCAAGTCCACCATCGGCGTCGAGTTCGCCACCAAA
TCCCTGCAGATGGAGGGCAAAACAATAAAGGCTCAGATCTGGGACACAGCAGGACAGGAGAGATATCGTGCCATCACAA
GTGCTTACTACCGTGGCGCTGTTGGGGCTCTCCTTGTTTACGACATCACAAAGAGGCAGAGCTTCGACAATGTCCACAG
GTGGCTTCGTGAGCTCCGCGACCATGCCGACTCGAGCATTGTTATCATGATGGTCGGTAATAAGTCTGATTTGATTCAT
CTAAGGGCTGTCTCCGAGGATGAAGGTAAGGCATTGGCTGAAAGGAGGGGCTGTTTTTTCTTGAGACATCAGCTATGG
AGGCCGTGAATGTGGAGGAAGCCTTTCAGACTATCATCACAGAGGTCTATGGCATT

FIG. 2 continued

> SEQ ID NO: 5718 126840 231343_301083_1b
AAAGAGGGAAGATCATCGTGCATCGCGCGGACGTCTGGATCGGCAGCGCTAATGGCGGCGGGGAGAGCGCGGGCGGACT
ATGACTACCTCATCAAATTGCTGCTCATCGGCGACAGCGGTGTGGGGAAGAGCTGCCTTTTGCTGCGCTTCTCGGACGA
TTCCTTCACGACGAGCTTCATCACGACGATAGGCATTGACTTCAAAATCAGGACCGTTGACCTGGATGGCAAGAGGATC
AAGCTTCAAATTTGGGACACTGCTGGGCAAGAACGCTTCCGGACGATCACAACTGCATACTACCGAGGAGCTATGGGCA
TTCTCCTCGTCTACGATGTGACGGATGAATCATCATTCAACAGAATATCGAGCAGCACGCGTCGGACAATGTGAACAAG
ATCCTGGTCGGCAACAAGGCCGACATGGACGAAAGCAAGAGGGCCGTATCAACAGAAAGAGGGCAAGCTCTTGCGAACG
AGTTTGGTATCAAGTTCTTCGAAACCAGCGCGAAGACGAACATGAACGTGGAGAACGTCTTCTTCACAATCGCGGGAGA
CATCAAGCGGAGACT

> SEQ ID NO: 5719 127269 257150_301679_1b
GTCTCCTCGACGGTTATCGATCGATCTCTCGCGGTTGATCGATCTCTCACATCGATCGCCTCGATCTGATGCGTTGCTG
GCTGCATTCCAGGTTAATCCGGCGGATCGATGAGGATTTCCGCGATCGCCGCGGCAGTTCTCGCGGCGATTCTCGCGCT
GGCTCTTTCTGGAGCTGCGGAGATCTTCTTCGAGGAGCGATTCGACGATGGTTGGGAACATAGCTGGGTCCAGTCCGAT
TGGAAGCGATCCGACGGTCTAGCGGGGAGCTGGCGACACACAGCAGGGAAATGGCATGGTGATCCAGATGATAAAGGCA
TCCAGACTTATCCCGATGCTCGATACTTCGCCATCTCCGCGCAGTTCCCCGAGCTCAACACCAAAGGAAAGACGCTCGT
AATTCAGTACTCTGTGAAGCACGAACAAAAGATCGAGTGTGGTGGCGGCTATATCAAGCTACTCAGTGGTTACGTGAAT
CAGAAACGGTTCAGTGGGGATACGCCTTACAGTATCATGTTTGGTCCGGACATTTGTGGCACTCAGACCAAGAAGGTCC
ACGCGATTTTGCAGTATAAGAGCCAGAACTATCCAATACGGAAGGAAGTTACTTGCGAGACGGACCAGCTCACTCACGT
TTACACGTTGGTAATTCGTCCCGACGCAACTTAC

> SEQ ID NO: 5720 127269 49616_300182_1b
CGGGACATGGGCTGGTGATCCTGATGACAAAGGTATCCAGACAACAAACGATGCCAAACATTTTGCTGTCTCTGCAAAG
GTACCGGAATTTAGCAATAAAAACAGAACACTGGTTGTCCAGTATTCTATAAAGTTTGAGCAAGATATTGAATGTGGAG
GGGGTTACATAAAGCTTCTCTCTGGATATGTCAATCAGAAGAAATTTGGTGGAGACACTCCATACAGTTTTATGTTTGG
GCCAGATATCTGTGGTACACAGACGAAGAAACTTCATGTTATGCTTT

> SEQ ID NO: 5721 127269 1044351_301917_1b
GTTGCCTTCTCTTGGTACTCTTCCCCTTGGCCTCTTTCGCCCACGTTTTCTTCGAAGAACGCTTCAATGATGGATGGGA
GAACGGATGGGTGAAATCGGATTGGAAAAAGGATGAAGGTGCTGCAGGAGACTGGGTACACACGGCAGGGAAATGGAGT
GGTGACTCCGAAGACAAAGGGATTCAAACCAATCCAGACTTACGATTTTTTGGCATATCAACTCAGTTTCCTGAATTTA
ACAACAAGGGCAAGGATTTGGTTGTCCAGTTTTCTGTAAAGCATGAACAGGATCTTGATTGTGGTGGAGGTTATATCAA
GCTTTTAAGTGGTGATGTGGATCAGAAAAAGTTTAATGGTGATACCCCGTACAGCATCATGTTTGGGCCTGACTTCTGT
GGCTATAGCACAAAGAAAGTCCATGTTATTTTGAACTACAATGACAAGAATCACCCCATTGAGAAGGAAATTTCTTGTG
AAAAGGATCAACTGACACATGTCTACACTCTTGTGATAAGACCTAACAACACCTACAGTGTTCTAATTGATAATGAAGA
GAAACAAAAC

> SEQ ID NO: 5722 127269 146983_200005_1b
TAAAACTAGTCTTCTCAGCTGAATCATTTCTACTAGTTTTGTTACTTTTCTCACTTCTCAGCTCTTCATTCTCTGAGAT
CTTTTTTGCAGAACAGTTCGATGATGATTGGCGGAGCAGATGGGTGAAGTCTGACTGGAAAAGGAGTGAAGGGAAAGCA
GGTTCATTTAAGCATACAGCTGGAAAATGGCTGGTGATCCTGATGATAAAGGTATTCAGACATCAAGCGATGCCAAAC
ATTTCGCCATTTCTGCTAAGGTACCAGAATTTAGCAACAAGAACAGAACTTTGGTTGTACAATATTCTATAAAGTTTGA
GCAAGACATTGAGTGTGGTGGAGGTTACATAAAGCTTCTCTCTGGATATGTCAACCAGAAGAAATTTGGGGGAGACACC
CCTTACAGTATGATGTTTGGACCGGATATCTGTGGTACACAGACAAAGAAACTTCATGTTATGCTTTCCTATCAAGGCC
AGAATTATCCCCATCAAAAAGGATCTACAATGTGAAACAGACAAATTAACCCATTTCTACACATTCATTCTTAGACCTGA
TGCATCATACAGCATCTGGATTGATGGTCGAGAAAGGGATTCTGGAAGCATGTATA

> SEQ ID NO: 5723 127645 114147_300265_1b
ATTCTTGACCAAAGAAATATGGCTCTCCCCATAGTTTCCTGCTTATTCTTTCTTCTTATGATCTCCTCTGCAACAGCGT
GCGATCGCTGTGTCCACCAATCAAAGGTTGCTTACTTTTCCAAGGCTTCTGCCCTTCAGTCTGGTGCTTGTGGTTATCG
CTCCTCAGCTATAGGCTTTAATGGGGGTCGGCTTGCAGCAGCAGTTCCTAGTCTCTACAAAGAGGGAGCTCGTTGTGGT
GCTTGTTATCAGATAAGATGCAAGAATTCAAAACTTTGTTCAAAAGAAGGCACGACGGTGACTGTAACTGATCAGAATA
CCAACAACCAGACAGATTTTGTAGTCAGTAGTAGAGCTTTCAGCGCCATGCGAAATCAAGGCAAAGCTCAAGACCTTCT
CAAACTCGCTGTCTTTGATGTCGAGTACAAAAGGGTGCCTTGTGATTTCAAAAACAAGAATTTGGCTATTCGGGTGGAA
CAATCAAGCAAAAACCCAAATTATCTAGCAATTACCTTCTTGTATCAAGGAGGTCAAACTGAAATCGTTGGTGTTGATG
TAGCTCAGGTAAACTACTAACCCAGTACTATACACATAAATTATTTTCGAGTTTAGTAGAAAAATTGGGTATTTTACGA
ATTAAG

FIG. 2 continued

> SEQ ID NO: 5724 127645 146185_200014_1b
AAAAGTTGCTTACTTTTCAGTGCCTCCGCCCTTCAGTCTGGTGCGTGTGGTTATGGAGATTTAGCAATAGGCTTTAATG
GGGGTCGACTTGCTGCTGCTATTCCTAGCCTTTACAAAGAAGGAGCTGGTTGTGGTGCTTGTTATCAGATTAGATGCAA
AGACTCAACACTCTGTTCGAAAGAGGGCACAACTGTAATTGTAACTGATCTAAATACCAATAACCAGACGGATTTTGTG
ATCAGTAGCCGAGCTTTTATGGCCATGGCCAATAAGGGAAAAGCTAAAGACGTTCTCAAATTGGGAATTGCTGATGTTG
AATATAAAAGAGTTCCATGTGATTACAAAAGCAAGAATTTGGCCATTCGTGTGGAAGAATCAAGTCAAAAACCAAATTA
TCTAGCAATCAGCTTCTTGTACCAAGGTGGTCAAACTGAAATTGTCGCTGTCGACGTAGCTCAGGTTGGATCATCGACC
TGGAATTTCCTGAGCCGAAATCACGGAGCAATTTGGGACACAAGTAGAGTGCCAACAGGGGCATTGCAATTTAGGTTTG
TGGTGACAGCAGGGTATGATGGCAAATGGTATTGGGCAAAATCAGTGTTGCCAGCAGATTGGAAAAATGGGGTAATTTA
TGACACTGGACTTCAGATCACTGACATTGCTCAAGAGGCTTGTTCTCCATGTGATGATGGAAACTGGAAACTTCATTAG
TGTTAAAAATAAAAAAATTATTTTAGCTATAATAATCTATGTGAATACACGTGGTAAAAGTAAAAGAGATCCTAAATTA
ATAAAATTGTAGATTGATGCAGT

> SEQ ID NO: 5725 127645 11938_300283_1b
TGGTATCAACGCAGAGTGGCCATTACGGCCGGGGCACCACCAACTTATTCTTATATTGCTTAACTCTCTTTCTTATGCT
CTTTAATTTTCAAATGGCTCCTCTTCAAGTTCTTGCAATATTTTTCATTTCTTTTATTTTCATGCAAATTTATTTGGGA
AATGCTCAAACATTCATCCATTCTAAAGCAGCTTATTATCCAAATTCAGAAGAAAAAGGAACGGAAACTGGGGCATGTG
GATTTGGTACTTTTGGAGCAACAATCAACGGTGGAGATGTATCAGCTGCATCAGATCTTTATCGAGATGGTCTAGGATG
TGGCGCATGCTACCAGGTGAGGTGCACAAACAGTAACTACTGCTCGGATAATGGAGTTACTATAGTTATAACTGACCAT
GGAGCAAGT

> SEQ ID NO: 5726 127750 265563_200112_1b
TCCACATTCTCTCAACTTTCTCTTTCTAAAAACTCTTCCTATCTCTTTCTCTAGCACACAGACCATCAATGGCATCGCC
GCGCGAGGAGAACGTGTACCTGGCGAAGCTGGCTGAGCAAGCCGAGCGCTACGAGGAGATGGTAGAGTTCATGGAGAAA
GTCGTCGGCGCCGGCGACGACGAACTCACCGTCGAGGAACGCAACCTCCTCTCCGTCGCGTACAAAAACGTGATCGGAG
CGAGGAGAGCGTCGTGGCGCATAATCTCATCGATCGAGCAGAAAGAAGAGAGTCGCGGTAATGAAGATCATGTTGCCTC
CATTAAAACCTACAGATCTAAGATCGAATCTGAATTGACTTCGATCTGTAACGGTATCCTTAAGTTGCTCGATTCAAAA
CTCATCGGCACCGCTGCTACCGGTGACTCTAAGGTTTTTTATTTGAAAATGAAGGGAGATTATTACAGGTACTTGGCTG
AGTTCAAAACCGGAGCTGAGAGAAAAGAAGCCGCCGAGAATACTCTTTCGGCTTACAAGTCGGCTCAGGATATTGCTAA
TGTCGAATTAGCCCCTACACATCCAATCCGATTGGGGCTAGCTCTCAATTTCTCAGTGTTTTACTATGAGATATTGAAT
TCTCCTGACCGTGCTTGTAATCTTGCCAAACAGGCATTTGATGAGGCAATTGCGGAGCTTGACACCCTTGGAGAGGAGT
CTTACAAGGATAGCACCTTGATTATGCAGCTTCTTCGTGATAACCTTACGTTGTGGACCTCGGATATGCAGGATGATGG
AACTGATGAGATCA

> SEQ ID NO: 5727 127750 285859_200107_1b
AGAGAACCAAAAAGAAAGGGGAAAGTGGAAAGAGAAGAATCTCCTTTGGCTCACAGAAATCGGACATGGCTTCCTCCAA
AGAACGCGAGAACTTCGTCTACATTGCCAAACTCGCCGAGCAAGCTGAACGATACGACGAGATGGTTGATGCAATGAAA
AAGGTTGCAAATATGGATGTTGAATTGACTGTGGAGGAGAGGAATTTGCTTTCTGTTGGATATAAGAATGTTGTTGGTT
CGAGGAGAGCATCATGGAGGATCTTATCCTCTATTGAGCAGAAGGAAGAGTCAAGAGGAAACGAGCTGAATGCTAAACG
GATCAAAGAGTACCGGCATAAGGTTGAGAAGGAGCTAACTGACATTTGCAGTGATATCATGACTGTTATCGATGAGCAT
CTAATTCCCTCATGTCCTGCTGGAGAATCATCTGTGTTCTACTACAAGATGAAAGGGGATTATTATCGCTACCTTGCAG
AGTTCAAAACTGGTACCGATAAGAAAGAGGTGTTCTGATCTTTCTTTGAAGGCATATCAGTCAGCTACAACAACTGCTGA
GACTGAATTACCACCTACCCATCCCATTAGGTTGGGTTTGGCTTTGAATTTCTCTGTTTTTTACTATGAGATCCTGAAC
TCTCCTGAAAGGGCATGCCACCTTGCAAAGCAGGCTTTTGATGAAGCAATATCAGAGTTAGATAGCCTGAAT

> SEQ ID NO: 5728 127750 256066_301646_1b
TTTCTCTCTCTCTCTCTCTCTCTCTCCCTCCGTCGACATGGGCATCGAGATGGAGCGAGAGAGCCTTGTCTACCT
ATCCAAGCTCTCCGAGCAGGCAGAACGCTATGAGAAATGGTGGAGTCGATGAAGAAAGTATTTAAGTTGGATGTAGAGC
TTACGATTGAGGAGAGGAATTTGCTCTCAGTGGGGTATAAGTATTTTATCGGAGCGCGAAGGGCCTCGTGGCGAATTCT
CTCCTCCATTGAGCAGAAAGAAGAGAGCAAGGGCAATGAGACCAATTGTAAAACGCATCAAGGAGTACCGCAACAAAGTG
GAGGAAGAGCTTTCCAAGATTTGCAGTGACATCCTAACTATCATCGATGAGCATCTTATCCCCTCATCTGGCACAGCAG
AATCTACCGTTTTCTATTACAAAATGAAAGGGGATTATTATCGCTACCTTGCTGAGTTCAAGACAGGACATGAGAGAAA
GGAAGCTGCAGATCAATCTCTGAAAGCTTATCAGACTGCAAGTGACACGGNCAACACGGCTCTGCCATCTACCCATCCG
ATCAGGCTTGGACTTGCACTCAACTTTTCAGTCTTTTACTATGAGATTTTGAGTTCGCCGGAGCGTGCGTGCCATCTTG
CCAAGCAAGC

FIG. 2 continued

> SEQ ID NO: 5729 127750 1007385_301399_1b
GTCCATCTTTGTGTTGTGAAAGAAGCTTGCAGGCCATGGGGACGGAGAAAGAGCGCGAGAAAAATGTGTACATGGCCAA
GCTTGCTGAGCAGGCAGAGCGTTATCAAGAGATGGTTGAATACATGGAAACAGTGGCCAAGCTTGATCTTGAGCTAACT
GTGGAGGAGCGCAACCTTCTGTCTGTTGGCTACAAAAATGTTATTGGAGCCCACAGAGCCTCTTGGCGTATCCTTTCTT
CCATTGAACAGAAAGAAGAGAACAAGGGCAATGAGACTAATGTGAAGCGTACCAGGGATTATAGGCATAAAGTTGAGAC
AGAACTTACCAAGATTAGCAGTGAAATTTTGACTATCCTTGATGAGCATCTCATCCCCTCATCGGGAACTGGCGAATCA
TCTGTCTTCTACTATAAAATGAAGGGCGACTACTACCGTTACCTGGCAGAGTTTCAGACAGGCGAGAAGAAAAAGGAAT
CTGCGGACGAGTCCTTCAAAGCATATCAGGCCGCATCAAGCACTGCAAACACAGATCTCCCGCCCACCCATCCAATCAG
GCTGGGGCTTGCCCTGAACTTTTCTGTTTTCTACTATGAAATTATGAATTCCCCTGAACGGGCATGCGAGCTTGCTAAA
CAAGCATTTGATGAGGCGATTGCTGAGCTTGACACTCTGAGTGAAGAGTCATACAAGGACAGCACTCTCATTATGCAGC
TACTGAGAGACA

> SEQ ID NO: 5730 127750 1008583_301417_1b
GAGGAGCTCGTCTTCATGGCCAAGCTTGCTGAGCAGGCCGAGCGCTACGATGAGATGGCTGAGTTCATGGAGAAGGTTG
CCTCCATGTCCAGCTCTGGTGACGAGCTCGCTGTCGAGGAGCGTAACCTCCTCTCCGTCGCGTACAAGAACGTTGTCGG
TGCCCGCCGCGCCTCCTGGCGTATTGTCTCCTCCATCGAGCAGAAGGAGGAGAACAAGGGCAACCAGGATCACGTCTCC
GCCATCCGCGGATACCGCACCAAGATCGAGAATGAGCTCGCCGGCATCTGTGAGGGCGTGTTGAAGGTCCTCGCCTCTG
CCCTCATCCCCGCCTGCGCCTCCAAGGAGTCCAAGGTCTTCTACCTCAAGATGAAAGGGGATTACTACCGATACCTTGC
TGAGTTCAAGACCGGCCCCGAGAGGAAAGACGCGGCTGAGTCCACACTTCTCTCATACAAGTCTGCTCAGGACATCGCA
CTCACTGAGATGCCTCCCACTCACCCGATTCGCCTTGGCCTCGCACTCAACTTCTCTGTATTCTACTACGAAATCCTAA
ACTCACCCGAACGGGCTTGCAGCCTTGCTAAGCAGGCATGTGATGAGGCCATTTCTGAGCTGGACACACTTGGTGAGGA
GTCCTACAAGGACAGCACCCTAATCATGCAGCTTCTCCGGGATAACCTCACTTTGTGGACATCAGATC

> SEQ ID NO: 5731 127750 156770_301369_1b
TACAAAACTCCCTCTCTCATTTCCTCTCTCATAGCAACATCAATGGCGTCGCCACGCGAGGAGAACGTGTACATGGCAA
AGCTTGCCGAGCAAGCCGAGCGTTACGAGGAGATGGTTGAGTTCATGGAGAAAGTCATCGCCGCCGCCGACGGCGCCGA
GGAACTTACCGTCGAAGAACGGAACCTCCTCTCCGTCGCATACAAAAATGTTATCGGAGCACGGCGAGCCTCGTGGCGT
ATCATCTCCTCCATTGAGCAAAAAGAGGAGAGCCGCGGCAACGAAGATCACGTTGCCTCCATCAAGGAGTACAGATCTA
AGATCGAGATCGAACTTACCTCGATCTGTAACGGCATTCTCAAGCTCCTCGATTTCTAAGCTCATTGGCGCCGCTGCTAC
CGGTGACTCTAAGGTGTTTTACTTGAAAATGAAAGGAGATTATCATCGCTATTTCGCTGAGTTTAAAACCGGCGCGGAG
CGAAAGGAAGCCGCCGAAAATACTCTCTCGGCTTACAAATCCGCTCAGGATATTGCAAATACCGAGCTTGCTCCTACAC
ATCCAATCCGATTGGGACTTGCTCTCAATTTCTCTGTATTTTACTACGAAATTTTGAATTCTCCTGATCGTGCTTGTAA
TCTCGCCAAACAGGCTTTTGACGAGGCAATTGCCGAGCTGGACACATTGGGCGAAGAGTCCTACAAGGATAGCACTCTG
ATCATGCAGCTTCTTCGCGATAACCTCACTTTATGGACTTCAGATATGCAGGATGATGGAACTGATGAGATCAAAGAAG
CAGCAAAACCAGATAATGAGCAGCAGTAAACCGGTGACATTTCTTTAGGATTGAAATTCATGTTGTAACTTTTTATTTT
TCAATTGTCTGAGTTCAGCTCTTTTAGTTCTAGATCTT

> SEQ ID NO: 5732 127750 134787_300418_1b
ACGAGATTCTAAACTCTCCAGACAAGGCTTGCAACCTTGCTAAGCAGGCGTTTGACGAAGCCATCTCTGAGTTGGATAC
CCTCGGGGAGGAGTCTTACAAGGACAGCACTTTGATCATGCAGCTCCTGAGGGACAACTTGACCCTCTGGACCTCTGAC
CTCACGGAGGACGGTGGTGATGAGGTGAAAGAAGCCTCCAAGGGCGACGCCGGCGAGGGCCAGTAAAATGGGAAGATCG
ATCGATCGATGGCTCCGCATGTTATTGGAGACCATTGATTTAGATGCCTCATGCTGCTGTCACCATGATGGATGGATTC
TTCTTCTGTTCTACTAGAATGTTTTTCTTCCTGTCCCCCCTTCCTCTCTCTTCTCTGGTTTTTACTAGGGTGGTAGCGG
TCGAATTAGTTCTTCCCTTTGCTTTGCATTTGGTGCTAGTGGTCCGTCTGGGCTGATTGTTTTCCTCTGGATATGACTC
TCGTGTGTGTTGTCTCCAGATAGTGTTTTATTGAGCAATATTTAAAGTTGTCGTCC

> SEQ ID NO: 5733 127750 116870_300515_1b
CCCACGCGTCCGATGGTGGCGGCAAGGCTGCTCAGGACATTGCTTTGGCTGAGCTGCCTCCTACTCATCCAATTAGGCT
TGGGCTAGCTCTTAACTTCTCAGTGTTCTACTATGAGATCCTCAACTCGCCTGATCGTGCTTGCAACCTCGCAAAGCAG
GCTTTTGATGAGGCCATCTCGGAGCTGGACACCCTGAGCGAGGAGTCCTACAAGGACAGCACTTTGATCATGCAACTCC
TCCGTGATAACCTGACCCTGTGGACTTCAGACATCTCGGAGGACACCGCGGAAGAGATCAGGGAAGCTCCGAAGCGCGA
CTCCAGCGAGGGCAGTAAAGCCGGCTTTATGTGCCCTAGAAGCTTGTAGCTAGTGCTTTGCTACTGTGTAATGACACC
TATGTGGCTGTGATTGTTGTCGGGAAATCTGGGGCTCCCCCGTATGTGAGGTTGCTAGCGATGGTTTTGCAGTCTCGCC
TTTAAGCTACTCGTAGCAGAGCAGGTGGGGGTCTGTGGAGCCAGGCCTGGTTGGGGGTGGGGAGCCTCTTGAACTGCT
TGGTGGCACTTCCTGTTTT

FIG. 2 continued

> SEQ ID NO: 5734 127750 114368_300007_1b
AGCGACAATCAGAAACCACCCGCTGTAACCCTAGGTTTTTTCACAAACAACAAATATGACTGAGTCATCGCGGGAAGAA
AATGTGTACATGGCCAAGCTTGCTGAGCAGGCCGAGCGATATGAGGAAATGATTGAGTTTATGGAGAAGGTTGCAAAGA
CAGGTGATGTCGAGGAGCTGACTGTTGAGGAAAGGAATCTCCTTTCTGTGGCATACAAAAATGTGATTGGTGCAAGAAG
GGCCTCGTGGAGAATAATCTCTTCAATTGAGCAGAAAGAGGAGAGCCGTGGAAATGAAGATCATGTCAAAACTATTAAA
GAATACAGAGCCAAAATTGAGGCTGAACTCAGCAAGATCTGTGATGGGATTTTGGGTCTCCTTGAGTCCCATTTAATAC
CATCAGCCTCCACAGCTGAGTCCAAAGTTTTTTACTTGAAGATGAAAGGTGATTACCACAGGTACTTGGCTGAGTTTAA
GACAGGGGCAGAAAGGAAAGAAGCCGCAGAGAACACTTTATTACCCTACAAGTCTGCTCAGGATATTGCTTTGGATGAA
CTGGCTCCTACTCACCCAATCAGGCTGGGACTTGCCCTCAACTTTTCAGTGTTCTACTATGAAATTCTCAACTCGTCAG
ATCGTGCTTGTAACCTTGCAAAGCAGGCCTTTGATGATGCCATCGCCGAGCTGGATACATTGGGTGAGGAATCTTACAA
GGACAGTACATTGATTATGCAGCTTCTCCGAGACAATCTTACACTTTGGACTTCTGATACCACGGATGATGCCGGGGAT
GAGATCAAGGAAGCTTCAAAATGCGAATTAGGCGAAGGAGAGCAGTAACGGCATAACATCATAGTCTTTTACTCTTTAT
TTTGTTTGATTTTAATATAGGACTACTGCGTGAAAGCTAGACTGGATATGGATATAATTCGATGATTCCTCGTATTACT
GCTGAAGTAGTTTGATATAAAAACATGTTTTAGTACGATAAGAAATATAGTCATGCCGTTGATGTATTGGCTTGTATTT
CTAGTTTCAATTGCATATGTTATTGACTGTTGAGCTTTGTATTTTCAAGTCATTCAATAATTCAATAGTTCCCAAAAA

> SEQ ID NO: 5735 127750 175041_300529_1b
GTCAGGAGCTGAGAGGAAGGAAGCAGCTGAGAACACTCTTGTGGCATACAAGTCTGCCCAGGATATTGCACTCGCTGAC
CTGCCTACAACTCACCCAATAAGGCTTGGACTTGCACTGAACTTCTCAGTGTTCTACTATGAGATCCTGAACTCACCAG
ACCGTGCTTGCAACCTTGCAAAGCAGGCGTTCGACGATGCTATTGCTGAACTGGACACTCTTGGCGAGGAGTCTTACAA
GGACAGCACCTTGATCATGCAACTTCTTCGTGACAATCTGACTCTCTGGACCTCTGACAATGCGGAGGATGGTGGTGAC
GAGATCAAGGAAGCAGCGAAGCCTGAAGGAGAGGGCCACTAATCTGTCCTGAAGTCTATTTCTGAGTCCATTTACTCAG
CTACCTGCTGTATTACTGGATCATAAGATGTACTAGGATCAATTGCTATGTGGAATCATAAGATTAGGGCTGCGTATGT
CAAAATGTGTCGAGCTGAAGTACCCAGTGGACACAGTTTATGTGCACTACATTGCTTCCGTGACTTATTTACTAGTTAA
TTAGCAACTTTCAACCACTTCCTGTATTTGCAGCACATTATTAGTATCGCTGTATTAGCGTTTTCCATGGGCTGGTTAT
GATTGAGAATACAGGCCAGGCATTGCATGTCC

> SEQ ID NO: 5736 127750 226749_301004_1b
TGCTGTCCGTGGCGTACAAGAACGTCATCGGCGCGCGCAGGGCGTCGTGGCGCATCGTGTCCTCCATCGAGCAGAAGGA
GGAAGGCCGCGGCGCCGCGGGCCACGCCGCCGGCGCGGCTCCTACCGCGCGCCGCCGTCGAGGCCGAGCTCTCCAACATC
TGCCGGGGATACTCCGCCTCCTCGACGAGCGCCTCGTCCCCGCCGCCGCCGCCGTCGACGCCAAGGTCTTCTACCTCA
AGATGAAGGGCGACTACCACCGCTACCTCGCCGAGTTCAAGACCGGAGCCGAGCGCAAGGACGCCGCCGACGCCACCCT
CGCCGGCTACCAGGCCGCGCAGGACATAGCCATGAAGGAGCTGTCGCCGACGCACCCCATCAGACTGGGCCTTGCGCTC
AACTTCTCCGTGTTCTACTACGAGATCCTCAACTCGCCCGACCGCGCGTGCACGCTCGCCAAG

> SEQ ID NO: 5737 127750 191021_300738_1b
CCCCCTGGAGGATCATCTTCTATGGAGCAGAAGGAGGAGCCGTGGGAATGAGGCATATGTTGCATCAATTAAGGA
GTACCGTAGCAGGATTGAAACTGAGCTCAGCAAGATCTGTGATGGTATCCTTAAGCTTCTGGATTCCCACCTTGTCCCA
TCTGCCACTGCTGCAGAGTCCAAGGTGTTCTACCTGAAAATGAAGGGTGACTACCACAGGTACCTTGCTGAGTTTAAGT
CAGGAGCTGAGAGGAAGGAAGCAGCTGAGAACACTCTTGTGGCATACAAGTCTGCCCAGGATATTGCACTCGCTGACCT
GCCTACAACTCACCCGATAAGGCTTGGACTTGCACTGAACTTCTCAGTGTTCTACTATGAGATACTGAACTCACCAGAC
CGTGCTTGCAACCTTGCAAAGCAGGCGTTCGACGATGCTATTGCTGAACTGGACACTCTTGGCGAGGAGTCTTACAAGG
ACAGCACCTTGATCATGCAACTTCTTCGTGACAATCTGACTCTCTGGACCTCTGACAATGCGGAGGATGGTGGTGA

> SEQ ID NO: 5738 128348 103518_300363_1b
TGTATGGCGCAGAGTGGCCATTCGGCCGGGGAAGCCAAGTTTGGGAAAATCTTAAAAGAAAGAAAGAAATGATGACGA
ATCGCCACTTCCTCTTCGCTCTTCTTTTCACTTTCTTTCTTTCAGCTGTTGCTGCAGATTCTTCTGAAGAGTGTGTATA
CACATTGTATGTTAAAACTGGATCAATCATAAAGGGTGGAACAGACTCCAAAATCAGCGTTACACTTGGCGATGCTAAA
GGAAAATCAGTATATATTCCAGATCTAGAGAAATGGGGTTTAATGGGCCCAAATTATGATTACTACGAAAGGGGTAATG
TGGATATCTTCACTGGTAGAGGCCAATGTTTAAGCCCACCAATTTGCAGGCTTAATGTTACTTCCGATGGATCAGGTGA
CCACCACGGTTGGTTTCTTGATTTTGTTGAGACTACTTTTACTGGGCCACACAAAACTTGTAGCCAATCCATATTCTAT
GTCGAACAATGGTTGGCTTCTGATGCTCCTCCTTATGAGTTATCAGTTTCTCTTGATGGTTGTAAAAGAAGACTGGGC
TTCGACATGCTCGGCGTTTTGTCGTGGGCCAGCCCAATGGGTCTGCTTCAGAATAGTTTGGCCCGTTGAAGTTCTTTTT
GTAATTTTGTCGTTGAGATGATTTTGATGTGTAGATTGCCCTGTGTTTTCCCTTCTCTTTGGTTGAAATAAATTTCTTG
TTTGGGCTTCCTTTCTTGCTTGTTTAGTCGTCATATCTTTGACTTATTGGCTCTTTTGGCAATTTGCAATCTTTTATG
TACTCAATAAG

FIG. 2 continued

> SEQ ID NO: 5739 128348 1108676_301519_1b
GTCATCACACAAGTGAAGAAGCAGTAGCAGTAGAAGGAGATAGAAGGGAACCTCTCTCTCTCTCTCTCTCTTTGCTG
ATGATGAAGACGACTATGGCTGTTTTCGCCCTTCTCTCTCTCTTCCTTCTTCTCCTCCCCCCTTTTCCTTCATCAGCTG
ATGATCCTTGTGTATACTCAATCTATGTACGAACGGGGTCAATATTCAAGGGGGGAACGGATTCGAAGATGAGTGTGGA
GCTCTACGATGCGAATGGGTACTACATTACGATCAACAATTTGGAGGAGTGGGGGGGGTTAATGGGTCCAGACCACGAC
TACTATGAGAGGGGCAATCTTGACATCTTTAGTGGTTTGGGGGACTGCCTGACCGGACCCATCTGCGCTCTCAACCTCA
CCTCGGACGGCACGGGGGCCCACCATGGGTGGTATTGCAACTACCTGGAAGTTACTGCCACGGGTGCCCACATCCCTTG
CTCCCAACAGCTCTTTACCATAGAGCAATGGCTTGCCACTGATACCTCTCCTTACTCCCTCACTGCCCTTCGATATAAT
TGCCCTGATGCTTTGTCCTCGCCTCGCTTCCCTCGCATGCCTTCCAATTCGCAACCGAAGAATGGTCAACTAATGTCCC
ATTAGTACTCTATCACCCTGCTTCGTAATAAAAAGATAGCCCCTTCTTGTGTACTATGGAGGGAGGGGGGTATCTCTCT
CA

> SEQ ID NO: 5740 128348 130994_300509_1b
GAATTCACATCTAAAGTCAACAACAAGAGCTTCTCGCTTCTCCTCGTCTCTGTTCTCCTCTCTTTTGCAATCCTCTCTC
AATCTGCTGATGATTGTGTATACACAGTATACACAAGAACAGGATCAATCATCAAAGGAGGAACGGATTCAAAATCTC
ACTAAGATTATACAGCAAATACGGTAAGTACATCGAGATCCCAAATCTTGAATCATGGGGTGGATTAATGGGTCCTGGT
TACGATTATTTCGAAAGAGGTAATCTTGATATCTTCAGCGGAAGAGGTTATTGTCTGGGTTCACCGGTTTGTGCCATGA
ATCTGACTTCCGATGGTACTGGTTCCGGTCACGGATGGTATGTGAATTATGTTGAAGTTACTACTACCGGTGCACATAT
TAATTGTGGTCAACAGAATTTTGAAGTGGAAGATTGGCTTGCTCTTGATAGATCTCCTTATAGTCTTACCGCTATCAAG
AATAATTGTAATCAGAAATTATCTGATCATGATTCTCATTCTGCTGATCAGTCTATGTAAATTTGATCTCTTGTTTGA
TTCGGTGGTGGTCTAGTATGAGTGATCGGACGGTCGTCATTGTGTGTTGTAATGTTGAAATTATTTTCTTGAATAAAAT
GATTGAGTGAGTAGTG

> SEQ ID NO: 5741 128348 11941_300283_1b
TGGTATCAACGCAAAGTGGCCTTACGGCCGGGGAAAGATAAAGAGAGTAACAGAGAAAGCTCAAGAGAAGACATGGGAA
TAGCAGCTCACTTCAACCATTTCTGGTTCCTTCTCTTCATCCTCTTCTTCTCTTTCTCCATCTCCTTCATTTCCGCATC
CGATGATGATTGCGTGTACACAGCTTATGTCCGAACGAGTTCAATAATAAAGGGTGGAACAGATTCGATTATCAGTTTG
AGTCTCTACGATGCAAACGGGTATGGTATTAGAATCAAGAACCTTGAGGCCTGGGGTGGGCTTATGGGTCCTGGTTACA
ACTATTTCGAGAGGGGAAATTTGGACATTTTCAGTGGACGAGGCCCATGTTTGACTGAGCCAGTCTGCAAAATGAATTT
GACTTCCGACGGAACAGGCAAA

> SEQ ID NO: 5742 128348 279714_200064_1b
GAGAGGAAGAAAAAGCTCAAGAGAAGACATGGGAATAGCAGCTCACTCCAACCATTTCTGGTCCCTTCTCTTCATAGTC
TTTTTCTCTTTCTCCATCTCCTCCATTTCCGGATCTGATGATGATTGCGTGTACACAGCTTACGTCCGAACGAGTTCAA
TAATAAAGGGTGGAACAGATTCGATTATCAGTTTGACTCTCTACGATGCAAACGGGTATGGTCTTAGAATCAAGAACCT
TGAGGCCTGGGGTGGGCTTATGGGTCCTGGTTACAACTATTTCGAGAGGGGAAATTTGGACATTTTCAGCGGACGAGGC
CCATGTTTGACTGGGCCTGTCTGCAAGATGAAACCTCACTTCCGACGGAACAGGCAAAGGCCATGGATGGTACTGTAACT
ACGTGGAGGTCACCGTCACCGGAGTCCATAAAGCATGCAACCAACAGAATTTCGAAGTGGAGCAGTGGCTCGCTACTGA
TGCGCCGCCTTATGAGCTTACGGCTGTTAGAGACAACTGTAAGAAGTCCAAGTCCGATGAGAAACTGTCCATTTCCGAT
GTCTACGGAACTCATCCCACTCCACATGTTTCTGTGATTTAAGTTTCTAGTTATTGGGCTTTAATGGGCCTGGGCCAAC
ATTTCCCTGTTTTACAATGACATTTGGTGTGTGCCAATGTTGCTTTCATGTTTATAGTAT

> SEQ ID NO: 5743 128348 47162_300174_1b
AAAAAAACAAAATGGCTCGTCGCGATGTTCTCCTCCCTTTCCTCCTCCTTCTCGCCACCGTCTCCGCCGTAGCTTTCGC
CGAAGATGATCCAGACTGTGTATACACATTCTACCTCAGAACCGGATCGATCTGGAAAGCCGGAACCGATTCGATCATC
AGCGCAAGAATCTACGATAAGGACGGTGACTACATCGGAATCAAAAACCTTCAAGCTTGGGCTGGATTAATGGGACCTG
ATTACAATTACTTCGAGAGGGGTAATCTCGACATTTTCAGTGGAAGAGCACCGTGTTTACCTAGTCCGATCTGTGCCTT
AAACCTAACCTCCGATGGCTCCGGCGATCACCATGGTTGGTACGTTAATTACGTTGAG

> SEQ ID NO: 5744 129204 249005_301589_1b
GGCGAGCCCTAGAGGAATGCGCCATGGCGGGCGTGCGGGTGGTCGGGGTGGTGGGCGCGGGGCAGATGGGATCTGGAAT
CGCGCAGCTCGCGGCGACAGCGCAGATCGCGGTGGTGATGGCCGATTCCGACGCCGCGGCGCTGACGAGGGGCTTGCAG
AGCATCGCGTCGTCGCTGGCGAGGTTCGTGAAGAAGGGCGGCATCAGTGAGGAAGAAGCAAATGCGACGCTTGCTCGTG
TGTCGACGACCACGTCCCTGGCGGACATGAGCTCTGCGGATGTAGTGATCGAGGCGGTGTCCGAGAGAGAAATCGTCAA
GAAAGGGATCTTCTCGGAGCTGGATAGGCTGCTTAAACCGTCCGCCATCCTTGCGTCGAACACCAGCTCCATATCGATC
ACAAGGCTGGCGGCTTCCACGCAGCGCCCTCAGCAAGTAATTGGCATGCATTTCATGAATCCACCACCAGTGATGAAAC
TCGTAGAGATCGTCCGGGGGATGGCAACCACGGATGAAGTTTTCGAGCAGACAAAGGAGCTCGCGGAGAGATTCGGCAA
GACAGTGGTGAGCTCCCGAGACTTCCCGGGCTTCGTGGTCAACCGGATCCTGATGCCGATGATCAACGAGGCATTCTAC

FIG. 2 continued

GCGCTGCTCGAGGGCGTGAGCAGCGCAGAGGAGATCGACACGGGCATGAAGCTGGGGACGAACCAGCCCATGGGGCCGC
TGGCGCTGGCCGACTTTATCGGGGCT

> SEQ ID NO: 5745 129329 175764_300544_1b
CCCCCCCCCCATCGACGTCGCCTCCTCTCGTCCTCCTCCTCGTCGCTGCATTCCGGTTGAGTGAGTTGGTGATTATCTG
TAGGGGGTGAAAATGGCGCAGGCGGTGGTGCCGGCGATGCAGTGCCAGGTCGGGGCCGTGCGGGCGAGGCCGGCGGCGG
CTGCGGCGGCGGCGGGGGGAGGGTGTGGGGAGTCAGGAGGACCGGGCGCGGCACGTCGGGGTTCANGGTGATGGCCGT
GAGCACGGAGACCACCGGGGTGGTGACGCGGATGGAGCAGCTGCTCAACATGGACACCACCCCCTTCACCGACAAGATC
ATCGCCGAGTACATCTGGGTTGGAGGAACTGGAATTGACCTCAGAAGCAAATCAAGGACAATATCAAAACCAGTGGAGG
ACCCCTCGGAGCTACCAAAATGGAACTACGATGGATCAAGCACAGGGCAAGCTCCAGGAGAAGATAGTGAAGTCATCTT
ATACCCACAGGCTATATTCAAGGACCCATTTTGAGGTGGCAACAACATATTGGTTATGTGTGATACCTACACACCAACT
GGGGAACCCCATCCCTACTAACAAACGTAAACA

> SEQ ID NO: 5746 129329 187091_300673_1b
CGGACGCGTGGGCAAATGGAGAGGTCATGCCTGGTCAGTGGGAGTACCAGGTTGGACCTAGTGTCGGTATTGAAGCTGG
AGACCACATATGGATTTCAAGATATATTCTTGAGAGAATAACGGAGCAGGCTGGTGTAGTGCTTACCCTTGACCCCAAA
CCAATTCAGGGAGACTGGAATGGAGCTGGGTGCCACACAAACTACAGCACCAAGAGTATGCGTGAAGATGGAGGATTTG
AGGTGATCAAGAAGGCAATCCTAAACCTATCACTTCGCCATGACTTGCATATAAGTGCATATGGTGAAGGAAATGAAAG
GAGGTTGACAGGTTTACACGAGACAGCTAGCATTGACAATTTCTCATGGGGTGTGGCAAACCGTGGATGCTCTATTCGG
GTGGGGAGAGACACCGAGGCGAAGGGAAAAGGCTACTTGGAAGACCGTCGCCCGGCATCAAACATGGACCCGTACGTCG
TGACAGCGCTATTGGCTGAAACCACAATTCTTTGGGAGCCAACCCTCGAAGCGGAGGTTCTTGCTGCTAAGAAGTTGGC
CCTGAAGGTATGAAGAACTTGGACGATGAATCGGGGCAAATAAATCCCAGCAAAATTTGTTTGCTGCCCACCAGTCTTG
ATCTTGTATTTCTTCTGTCTGGGGATTGGTCTGTACAAATCTGCAGTTTCTAGAAAACCACGCCACCTTCCATTCGCCA
GTTAACATTTTGGTTGAACACCACACTTGATCTGGGTCTGTATTTTGAGTCCATTTGTGAGTGACAGAACGGATGATGA
AACACATCAGGGACACTTT

> SEQ ID NO: 5747 129329 212240_300875_1b
GGTCTCGAGCAGGAGTACACTTTCCTCGACCACGATGACAGGCCCTATGGCTGGCCCGTTGGCGGTTTCCCTGCTCCTC
AGGGTCCCTACTACTGCGGTGTAGGTAGCGGCAAGGTCGTCCTCCGTGACGTCGTCGAGGCCCACTACAAGGCCTGTCT
GTATGCTGGCATCAACATCTCCGGTACCAACGCCGAGGTTCTCTCAAGTCAGTGGGAGTTCCAGGTCGGCCCTTGCGTC
GGCATCAACATGGGTGACGAGCTCTGGATCGCCCGTTTCTTCCTTGCCCGCATCGCCGAGGACTTTGGCGTCAAGATCT
CCCTGCACCCCAAGCCCATCAAGGGTGGCATGAAGTACATCGAGGAGGCCCTCAAGGCCCTCGAGCCCCACCACGCCGA
GTGTATCAAGGAGTACGGTGAGGACAACGATCTCCGTCTCACCGGTGACTGCGAGACTGGCTCCATCGAAGTTCAGC
TGGGGTGTTGCCAACCGTGGCACATCCATCCGTGTTCCTCGCGAGACTGCTGCCCGTGGCTGCGGTTACTTCGAGGATC
GCCGGCCTGCCTCCAACGCTGACCCTTACCGTGTCACCAAGATCCTGATGACTTCAATTTTCGGCAAGGCCTAAGTCTT
CTTTGTGGATGGTTGTG

> SEQ ID NO: 5748 129329 204377_300792_1b
GCATTGCATTCCATTTGATTGCTTCATTTTCAGTCCATTTGTTGGTCTTTTCTGAAATACCCATATACCGGTGTACACC
CGTATATATACAGCTGGTTGAACTGCACTCCGCTCGCATTCAATCTTCCCCACTACATCATCACATTTCTTCTTTCTCC
CACAAACAACATCACACACAACCGTCATCATGGCCAACCGAGAAATTCTGTCGTCTCGAACCGAGACTCTCAACAAGTA
CCTGAAGCTCGACCAGAAGGGCAAGATCATGGCCGAGTATGTCTGGATCGATTCTACCGGCGAGACTCGATCAAAATCC
AGGACGCTCCCTGAGCTCAAGGACAAGGAATACACCCCCGAGGATCTGCCCGTCTGGAACTTTGACGGCTCTTCAACTG
GCCAGGCTCCTGGTCACGATTCCGATGTCTACCTGCGCCCTGCCGCCGTCTACCCCGATCCTTTCCGTGGCTCTCCCAA
CATCATCGTCCTCGCCGAGTGCTGGAACGCCGACGGCACTCCCAACAAGTACAACTACCGCCATGAGTGCGCCAAGGTC
ATGGAGGCCAACGCTGCTCTCGAGCCCTGGTTCGGTCTCGAGCAGGAGTACACTTTCCTCGACCACGATGACAGGCCCT
ATGGCTGGCCCGTTGGCGGTTTCCCTGCTCCTCAGGGTCCCTACTACTGCGGTGTAGGTAGCGGCAAGGTCGTCCTCCG
TGACGTCGTCGAGGCCCACTACAAGGCCTGTCTGTATGCTGGCATCAACATCTCCGGTACCAACGCCGAGGTTCTCTCA
AGTCAGTGGGAGTTCCAGGTCGGCCCTTGCGTCGGCATCAACATGGGTGACGAGCTCTGGATCGCCCGTTTCTTCCTTG
CCCGCATCGCCGAGGACTTTGGCGTCAAGATCTCCCTGCACCCCAAGCCCATCAAGGGTGCTTGGAACGGCAGCGGTCT
GCACTCCAACTTCTCCACCAACCAGATGCGTGAGGAGGTGGCATGAAGTACATCGAGGAGGCCCTCAAGGCCCTCGAG
CCCCACCACGCCGAGTGTATCAAGGAGTACGGTGAGGACAACGATCTCCGTCTCACCGGTGACTGCGAGACTGGCTCCA
TCGAGAAGTTCAGCTGGGGTGTTGCCAACCGTGGCACATCCATCCGTGTTCCTCGCGAGACTGCTGCCCGTGGCTGCGG
TTACTTCGAGGATCGCCGCCCTGCCTCCAACGCTGACCCTTACCGTGTCA

> SEQ ID NO: 5749 129329 258070_301688_1b
GCGTTTGCGCTATTATAGTCAGTGTCGCCAAAGTTTGTGCGATCTCTCCTCCTCAGGCGCCGGAACAATGTCGAACCTC
AACGATTTGCTCAACCTCGACATCACTGACACCAAAGAGATCATCGCCGAGTACATATGGATTGGGGGGTCGGGTATGG

FIG. 2 continued

```
ACCTCCGGAGCAAGGGCCGGACTCTGAAGGGCCCAATTACCGATCCCTAGAAGCTCCCGAAATGGAACTATGATGGTTC
CAGCACTGGACAGGCTCCTGGCGAGGATAGCGAGGTCATACTATATCCGCAGGCAATTTTCAGGGATCCGTTCAGGAAA
GGAGACAACATATTGGTTATCTGCGACACTTACACTCCAAAGGGAGAGCCACTCCCCTCGAACAAGCGAGCCAAAGCCG
AGGCGATTTTCAGTCAGAAGGCAGTGAGTGACGAAGTTCCCTGGTATGGAATCGAGCAAGAGTATACATTGCTCCAGCG
GGAGGTCAAGTGGCCTCTGGGATGGCCGATTGGTGGCTATCCCGGCCCCCAGGGACCGTACTATTGCGGAACTGGAGCC
GAGAAAGCTTGGGGGAGAGATATTGTGAATGCTCACTACAAAGCATGCATCTATGCCGGCGTCCAGATCAGTGGTATCA
ACGGCGAAGTCATGCCAGGCCAGTGGGAATACCAAGTCGGTCCTGCTGTTGGAATTTCCGCTGGTGACCAGCTCTGGGT
ATCGAGATATCTGTTGGAGCGAATCACCGAGATTGCTGGAGTCGTTCTCTCCTTCGATCCGAAGCCCATCGAGGAGGGT
GATTGGAATGGCGCTGGATGCCACACAAACTACAGTACAAAGAGCATGAGGGAAGAAGGTGGCTACGAGATCATCAAGA
AGGCCATTAGCAAGCTCGGCTTGAGACACAAGGAACACATTGCTGCTTACGGAGAAGGAAACGAGCGGCGACTGACTGG
AAAGCACGAGACTGCCAATATTCATACGTTTTCTTGGGGTGTTGCCAACCGTGGAGCATCCGTTCGTGTTGGCCGCGAC
ACCGAAAAGGCAGGAAAAGGCTACTTTGAGGACCGTCGTCCAGCATCAAACATGGACCCCTAC

> SEQ ID NO: 5750 129329 146956_200005_1b
TATCTCTTTAATTGATCAGAGAATTGTTAGGCTTCTATTTTCATTATGTCTCTGCTTTCAGATCTTATCAACCTCAATC
TCTCTGATTCTACCAAGAAAATCATCGCTGAATACATATGGATCGGTGGATCAGGCATGGACATAAGGAGCAAGGCCAG
GACTCTTGATGGTCCTGTTACTGATCCTTCAGAACTACCCAAATGGAACTATGATGGATCTAGCACAGGTCAAGCTCCC
GGAGAAGATAGTGAAGTGATCTTATACCCACAAGCTATCTTTAAGGATCCATTCAGAAGAGGCAACAATATCTTGGTCA
TGTGTGATGCGTATACTCCTTCTGGTGAGCCTATCCCAACAAACAAGAGGCATGCTGCTGCCAAGATCTTCAGCAACCC
TGATGTTGTTGCTGAGGAACCATGGTATGGTATTGAGCAAGAATACACCTTGTTGCAAAGGGATATTAACTGGCCTCTG
GGCTGGCCTATTGGAGGCTTCCCTGGACCTCAGGGACCATACTACTGTGGAACCGGAGCTGATAAGGCCTTTGGACGTG
ATATTGTGGACTCCCATTACAAGGCTTGTCTTTTATGCTGGGATTAACATCAGTGGTATCAATGGAGAAGTCATGCCCGG
ACAGTGGGAATTCCAAGTTGGACCTTCTGTTGGCATTTCAGCCGGTGATGAAGTGTGGGTAGCTCGTTACATTCTTGAG
AGGATTACAGAGATTGCTGGAGTGGTTGTGTCATTTGACCCCAAGCCCATTCCGGGCGATTGGAATGGTGCAGGTGCTC
ACACAAACTACAGCACCAAGTCGATGAGGGAAGATGGAGGCTATGAAGTCATTTTGAAGGCTATTGAGAAGCTTGGCCT
GAAGCACAAAGAGCACATTGCTGCATATGGTGAAGGCAATGAGCGTCGTCTCACTGGAAAGCACGAAACAGCCAACATC
AGCACTTTCAAATGGGGGGTTGCAAACCGCGGTGCATCTGTCCGTGTAGGACGGGACACAGAGAAGGCGGGCAAGGGAT
ACTTTGAGGACAGAAGGCCAGCTTCAAATATGGACCCATACGTCGTTACTGCCATGATCGCAGACACCACGATCATCGG
GAAACCTTGAAGCTTTTTAGTATGAATTGCTTGTTTCTGGTTTGCACAATTTGGGATAGAAAAGGATTGATTTATGAAA
CAGCCCTTTCGCTTCGCCTGTGTCTTTAGTTAGGGTAGTTTGGTCTTTTGGTATTTTTCTTTTATTCCAGTTGAAGTTG
TATTTTCATACAGCAAGGCTGATTTCATTGCCTATGATTTGGCAATGGTATTA

> SEQ ID NO: 5751 129329 157722_301742_1b
ATCTCTTTAATTTATCAGAAAATTGTTAGACTTCTATTTTCATTATGTCTCTTCTTTCAGATCTTATCAACCTCAATCT
CTCTGATTCTACCGATAAAATCATCGCTGAATACATATGGATTGGTGGATCGGGCATGGACCTAAGGAGCAAGGCCAGG
ACTCTTTCTGGTCCTGTTACTGATCCTTC

> SEQ ID NO: 5752 129410 130936_300509_1b
GAATTCAGAGGAGGCACCCATATACAAATCTTGAGCGGTTCTTAGAGCCTCTCGAGCTTAGCTACAGATCCATTTGCTCT
TGTGGTGATCGAGCAATTGCTGATCGCAGCCTTCTTGATTTCTTACAGAAAGAATTCTACTTTAGGTCTCTCACTCGTG
AGACTTGATATTAGGCAAAAATC

> SEQ ID NO: 5753 129410 183222_300592_1b
GAGGAACGCCGTCAGGACTGGCTCTTGTCTGAACTCAACGGGAAGCGCCCGTTGTTTGGCCCAGACCTTCCCAAGACCG
ACGAGATTGCTGACGTTCTCGACACGTTCCGTGTGATAGCTGAGCTTCCCGCTGACAATTTTGGGGCCTATATCATTTC
CATGGCGACAGCTCCGTCAGACGTGCTTGCTGTTGAGCTCCTCCAACGTGAATGCCATGTGAAGACGCCACTTAGAGTT
GTCCCGCTGTTTGAGAAGTTGGCTGATCTTGAATCTGCCCCAGCAGCAGTGGCCAGACTGTTCTCTATAGATTGGTACA
GAGAAAGGATAAATGGCAAACAGGAGGTCATGATTGGCTATTCGGACTCGGGTAAGGACGCCGGTCGTCTCTCAGCAGC
TTGGCAGCTGTACAAGTCTCAGGAGGAGCTCATCAACGTTGCCAAGGAGTTTGGGGTGAAGTTGACAATGTTCCATGGG
CGCGGTGGGACTGTCGGAAGAGGCGGAGGTCCCACTCATCTTGCCATCTTGTCTCAGCCACCAGACACGATCCATGGAT
CTCTCCGGGTCACTGTCCAGGGTGAAGTCATTGAGCAGTCCTTTGGTGAGGAGCACCTTTGCTTCAGGACACTGCAGCG
TTTCACGGCTGCCACTCTGGAGCATGGCATGCATCCACCAATTGCGCCGAAACCAGAATGGCGTGCTCTGCTTGATGAG
ATGGCTGTGGTGGCCACAAAGGAATACCGGTCCATCGTCTTCCAGGAACCACGCTTTGGCGAGTATTTCCGCCTTGCAA
CACCAGAGATGGAGTATGGAAGGATGAACATA
```

FIG. 2 continued

> SEQ ID NO: 5754 129410 227111_301008_1b
GCTCCGAGGTCGTGCCAACGAGTTGCACCGGAAGTCCTCAAGGAAGTACGCCAAATACTAGGTGGAGTTTTGGAAGAAG
ATTTCTCCGGGAGAACCTTACCGCATTATACTCGGCGATGTGAGGGACAAGCTGTACAACACCTGCGAGCGTGCTCGCC
AGATCTTGTCGAAGGGAATTTCTAGCATTCCTGAAGACCAGACTTACACCAATGTCGAGCAGTTCTTGGAGCCGCTTGA
GCTGTGCTACCGATCGCTGTGCGACTGCGGCGACAAGCTGATCGCCGACGGCAGCCTGCTCGAGTTAATGCGGCAGGTC
TCCACCTTCGGCCTCTCCCTCGTCAAGCTCGACATCCGGCAGGAGTCGGAGCGCCACACCGACGCCATGGACGCGATCA
CCACGCACCTCGGCATCGGCTCCTACCGGGAGTGGCCCGAGGAGCGGCGCCAGGAGTGGCTCGTCTCCGAGCTCCGCGG
GAGGCGCCCGCTCTTCGGCCCCGACCTGCCGCAGTCCGAGGAGGTCGCCGACGTGCTCGGCGCGTTCCGGGTCATCGCC
GAGCTCCCCGCCGACAGCTTCGGCGCGTACATTATCTCCATG

> SEQ ID NO: 5755 129424 227659_301030_1b
GTCGCTCCGCCGCCGCCGCCGCTGTTCACTCCGCACCAACTCCGACGATCCCCCGGCGAGCTCTCGACGATGGCGACGG
CGGCGACGGCGTCGGCTACGGCGGCCACCCGCTTCACGCGGCTGGCGGGGGTCGGGCTCCGGCGCACGGCCCGCCTCCC
CACGGCCGTGCGGTTCCAGCGCCGGGTGCTCGCCACCACCGCGCTCCTCAGGACGCCGAGCTCCGGCCCAAGGAGCAG
GGCCTGCCCGAGACGCTCGACTACGCGTGTTCCTCGTCGACGGCGGGGGCCGCAAGGTTGTCGCCGTGGCACGACGTG
CCCCTGCGCGCAGGCGACGGGGTTGTTCCACTTCGTCGTGGAGAATCCCAAGGAGAGCAGCGCCAAGATGGGAGGTCGC
CACCGACGAGTCATTCACCCCCATCAAGCAGGACACCAAGAAGGGCAACCTCCGATACTACCCGTACAACATTAATTGG
AATTATGGATTATTTCCCCAAACATGGGAGGACCCAACTCTTGCAAACACCGATGTCGAAGGAGCATTTGGGGATAATG
ATCCTGTTGATGTTGTTGAGATTGGTGAAAGACGTGCTAACATTGGAGATGTTCTTAAGGTAAAACCGTTGGCAGCTTT
AGC

> SEQ ID NO: 5756 129424 1170936_302040_1b
AGAAAGAGAGAGAGACCAGAGAGAGAGAGAGAGAGAGACTGGTAACAATGGCAATGGCGTTGAGAGCAGCGTTCCAGTGCA
CGCCAAGCGCATCATCCCTTTCGTCCTCCTCCTCCTCGGCATCGCCCCTCCTCCGTCGGGGTGCTGCTGCCGCCCTGAG
GTTTGCACGCTGCTCGACCCCGGTAACGCGGGAAGCCCACTCTGCAGCCCTCCTCCCTTCAGAGCCGCCGCTCGGTCC
TGGCGCGCCCTCTCCCTCCCTGCCTCCCAGCTCACCGCCTCCCCTCCCACCCCCGCTTACACCATCAAGGAGGAGGGTA
AGCCCGAGTCCCTCGACTTCCGCCTCTTCTACTTCAGCGATGATTCCGGCAAAAAGATCTCACCATGGCACGACATACC
TTTAGAAGCCAAGGATGGCATGTTCAACTGTATTATAGAGATTCCAAAGGAAACCAGTGCGAAAATGGAAGTGGCCACC
GACGAATTCTACACCCCTATCAAGCAAGATACTAAGAAGGGC

> SEQ ID NO: 5757 129424 129116_300403_1b
CCCCCGAGTCTCCCGCCGCCGCCGCCGGGGGTCACTCCGCACCAACTCCGACGATCCCCCGGCGAGCTCTCGACGATGG
CGACGGCGGCGACGGCGTCGGCTACGGCGGCCACCCGCTTCACGCGGCTGGCGGGGGTCGGGCTCCGGCGCACGGCCCG
CCTCCCCACGGCCGTGCGGTTCCAGCGCCGCGTGCTCGCCACCACCGCGCTCCTCAGGACGCCGAGCTCCGGCCCAAG
GAGCAGGGCCTGCCCGAGACGCTCGACTACGCGTGTTCCTCGTCGACGGCGGGGGCCGCAAGGTGTCGCCGTGGCACG
ACGTGCCCCTGCGCGCAGGCGACGGGGTGTTCCACTTCGTCGTGGAGATCCCAAGGAGAGCAGCGCCAAGATGGAGGT
CGCCACCGACGAGTCATTCACCCCCATCAAGCAGGACACCAAGAAGGGCAACCTCCGATACTACCCGTACAACATTAAT
TGGAATTATGGATTATTTCCCCAAACATGGGAGGACCCAACTCTTGCAAACACCGATGTCGAAGGAGCATTTGGGGATA
ATGATCCTGTTGATGTTGTTG

> SEQ ID NO: 5758 129491 135338_300413_1b
TCGACCAGTTCAGGGAGGTGGGCCGCGTCATGGCGCTTGAGGAGGTGGACTTCCCACTACTCGAGTCTGAGGCGCTCTT
CATTCGCAGGGCCGGAGAGGAGATCACGCAACAGCTTTATGACTTCGAGGATAAAGGAGGGCGCCGTGTAGTTCTGACG
CCTGAAATCACCCCTTCCTTGGCACGCCTAGT

> SEQ ID NO: 5759 129725 105388_300373_1b
AAATTAATATTTTTGTCAAACCAACTATGCCACACAAAATAGAAAGGCAAAATTAAGATGACAAGAAAGCTAAGCACC
AACTGAGCAGCCAACGCTCTATTTCCACACTTTGGTTTCTCCTCTCTCATTTCTCGTTTTCTCCGCACTTTTCACTTAT
TAAACCATTGATTATATAATTCAACACATTTCATCTGTTTGTTAGACACAGCAATTCCATTTTTTGATTTTTCCTGTAA
TTCCTTCATCTGTGTCTCCAAAAACATGGCGACGGCTTTTCTGCAACAAAAGTTTTGCAACCTTTGCCCTTTAATTCT
ACTAGATCTGCTGAAAACCCCCTTTTGATCCAAAGTTCATCTTTTCTTGGATCATCATTTCTCATAAGCTTTCTCTCA
AGAAGCCTTTTTTGCCTCCTAATTCCCAGCGTCGATCCAATGCAGCGGTTGTTGCTGTTTCTGATGTTGTTAAGGAAAA
GAAGTCTAAGTCCAAATCGTCTCTCTCCAATCTGTTGATTACTAAAGAGGAAGGGTTGGTACTGTATGAGGACATGGTG
CTGGGAAGAGCTTTTGAGGACATGTGCGCCCAAATGTATTACAGGGGCAAAATGTTTGGTTTTGTGCATTTGTACAACG
GCCAAGAAGCTGTCTCGACTGGTTTCATTAAGCTCTTGAAGAAGGAAGACTCTGTAGTTAGCACTTACCGTGACCATGT
CCATGCATTGAGTAAAGGTGTCCCAGCTCGTCAAGTGATGAGTGAGCTATTTGGAAAGACCACGGGCTGTTGTAGAGGC
CAGGGTGGATCCATGCACATGTTCTCCAAAGAGCACAATGTTCTTGGTGGTTTCGCTTTTATCGGTGAGGGAATCCCGG
TGGCTGCAGGTGCTGCATTCACTAGCAAGTACAGAAGGGAGGTCTTGAAGGAGGCTGATTGTGATCATGTCACTCTAGC

FIG. 2 continued

CTTCTTTGGTGATGGAACTTGCAACAATGGCCAATTCTACGAGTGCTTGAACATGGCCGCATTGTGGAAATTGCCCATT
ATCTTTGTTGTTGAGAACAATCTGTGGGCAATTGGGATGTCTCACTTGAGGTCTACTTCTGATCCTGAAATTTGGAAGA
AAGGTCCTGCTTTTGGGATGCCTGGGGTTCATGTTGATGGCATGGATGTGTTAAAGGTGAGGGAGGTAGC

> SEQ ID NO: 5760   129725 256559_301673_1b
ACGCGTCGAGAGAAGAAGAACAGCTAGGAAGAGCTCCTCGTCTCTCCATGGCGTCGCGAGCTATGGCGTCGATCAGCCC
ATCGTCCATCTCCGCCGGCGCCTGCCGCGACGACGTCGGATCTTCCAGTGTAGTAGGCTTCCATAATAGAAGCGGCAAC
AGCAGCGCATTCACCGGCCGCGGCATCCGGGTCTCGACCAGATCGCTGTCCACCGCCAGCGCCAAGAAGAGGAGCTGCG
CCGTCGCCGCCACCGCCGCGCCGGTCAAGGAATCCCCGCCAAAGATCGCCGACACGCTCGTCACGCGGGAGGAAGGCCT
GGAGCTCTACGAGGACATGGTTCTTGGTCGATCCTTCGAGGATATGTGCGCCCAGATGTACTACCGCAGCAAGATGTTT
GGATTCGTCCACCTCTACAACGGCCAGGAAGCCGTCTCCACGGGATTCATCAAGGCGCTCAAGAAGGACGACTACATCT
GTAGCACGTATCGAGACCACGTCCATGCGCTGAGCAAGGGCGTCCCCGCCAGGCAAGTCATGAGCGAGCTCTTCGGGAA
GTCCACGGGATGCTGCCGCGGCCAGGGCGGATCCATGCATATGTTCTCCAAAGAGCACCGCCTGCTCGGTGGATTCGCC
TTCATCGGCGAGGGGATCCCCGTCGCCACCGGCGCGGCATTCACCACCAAGTACTCGCGGGAGGTTCTCAAGGACCAGA
GCGTTGATGCGGTGACGCTGGCCTTCTTCGGCGATGGGACGTGCAACAATGGGCAGTTTTCGAGTGCTTGAACATGGC
GGCGCTGTGGAAGTTGCCGATTGTGTACGTTGTGGAGAACAATCTGTGGGCGATTGGGATGGATCACTTCCGGGCGACG
TCGGTGCCCGACATTTGGAAGAAGGGCGAGGCGTTTGGCATGCCCGGGTTCATGTCGATGGGATGGACGTGCTTAAGG
TCCGTGAGG

> SEQ ID NO: 5761   129725 259406_301705_1b
TCGACCACGCGTCGGAAGGAAGAGCGATGGCGATAGCGATGGCTCGGCGGCGGCTTCTCTCCTCCTCCTCCTCCAC
GTCCTCGGCAGCGGCAGCCGCGGCGCCGCTTCTCCGGCGGGCGGCGGCGCTCAATCCATCCAGGTACTTCGCGTCGTCG
GGGATGGACGACACGACGCCGTTCGTGGTGGACATCCCCGTGCCCTACGCCGGGCATCGATGCGACCCCCGGAGCAGA
AGGTGGAGACGTCGGCCAAAGAGCTGGTGGACTACTTCAAGGTGATGTACGTGATGAGGCGGATGGAGATCGCCGCGGA
CAGCCTCTACAAGGCCAAGTTTATACGTGGTTTCTGCCACCTTTACGACGGCCAAGAGGCCGTGTGCGTCGGGATGGAG
GCGGCGCTCACCAAAGAGGACGCTATCATCACCGCGTATCGAGACCACTGCACGCATCTTGGACGTGGTGGAACTGTGC
TCGAGGTGATGGCCGAGTTGATGGGGAGGAAGGATGGATGCTCGCTGGGAAAGGGTGGATCGATGCATATGTACAAGAA
GGATGCCAACTTCTATGGGGAATGGGATCGTTGGTGCACAAACTGCTCTCGGTGCTGGCCTGGCCTTCGCGCAGAAG
TATAACAAGCAGGGCGCGGTGTCGCTGGCGCTGTATGGAGATGGTGCGGCCACACCAGGGCAGCTGTTTGAGGCGATGA
ATATCGCGGCGCTGTGGGACTTGCCGGCGATCTTCGT

> SEQ ID NO: 5762   129725 20042_300163_1b
GTTCTTGGAAGAGCTTTTGAGGACATGTGTGCCCAAATGTATTACAGGGGAAAAATGTTTGGTTTTGTGCATTTGTACA
ATGGCCAAGAAGCAGTCTCCACTGGCTTCATTAAGCTATTGAAGAAAGAGGACTCAGTGGTTAGCACTTATCGTGATCA
CGTTCACGCATTGAGCAAAGGGTTCCAGCACGTCAAGTGATGAGCGAGCTCTTTGGGAAGACCACTGGCTGTTGCAGA
GGCCAAGGTGGTTCCATGCACATGTTCTCGAAAGAACACAACGTTCTCGGTGGTTTCGCTTTCATTGGTGAGGGTATCC
CTGTGGCGACAGGTGCCGCCTTCACTAGCAAGTATAAAAGGGAGGTACTGAAAGAGGCTGACTGCGATCACGTAACTAT
G

> SEQ ID NO: 5763   129748 265074_301442_1b
CCCACGCGTCCGAGCACTGCTACTGGACATACTCTACTACTACTAGCCAGTAAGCTAGCTAACTAACTACGTGGCTATG
GCCCCCACCGTGATGGCCTCCTCGGCCACCTCCGTGGCTCCATTCCAAGGGCTCAAGTCCACCGCCGGCCTCCCCGTCA
GCCGCCGCTCCACCAACTCGGGCTTCGGCAACGTCAGCAATGGCGAAGGATCAAGTGCATGCAGGTGTGGCCAATTGA
GGGCATCAAGAAGTTCGAGACCCTATCCGTACCTGCCACCACTCACCGTGGAGGATCTTTTGAAGCAGATCGAGTACCTG
CTTCGATCCAAGTGGGTGCCTTGTCTCGAGTTCAGCAAGGTTGGGTTCGTCTACCGTGAGAACCACAGGTCTCCCGGAT
ACTACGATGGCAGGTATTGGACCATGTGGAAGCTGCCCATGTTCGGCTGCACCGATGCCACCCAGGTGCTCAAGGAGCT
CGAGGAGGCCAAGAAGGCCTACCCTGATGCCTTTGTCCGTATCATCGGCTTCGACAACGTCAGGCAGGTGCAGTTGATT
AGCTTCATCGCCTACAAGCCCCCAGGTTGCGAGGAGTCTGGTGGCAACTAAGCTAAGATCAAGCATCGCGCTGGTGGAT
TGCTGCCTATAATAATAGTATGCAGCTTTGTTTTGGGCTATGTTGATGATATATCAATATATAATATGCTATATATTTT
TATTTTACAGTTTGGTTATGTACCATCTCAA

> SEQ ID NO: 5764   129748 104802_300366_1b
CGCTCTTGAAAGCAAAGGTCAAGGGTAGCAATAGCTTTAAGCTTAGAAATTATTTTCAGAAATGGCTTCCTCAGTTATG
TCCTCAGCAGCTGCTGTTGCGACCGGCGCCAATGCTGCTCAAGCCAACATGGTTGCACCCTTCACTGGCCTCAAGTCCG
CCTCCTCCTTCCCTGTTACCAGGAAACAAAACCTTGACATTACCTCCATTGCTAGCAATGGTGGAAGAGTTCAATGCAT
GCAGGTGTGGCCACCAATTAACATGAAGAAGTACGAGACACTCTCATACCTTCCTGATTTGAGCCAGGAGCAATTGCTT
AGTGAAGTTGAGTACCTTTTGAAAAATGGATGGGTTCCTTGCTTGGAATTCGAGACTGAGCGTGGATTCGTCTACCGTG
AACACCACAACTCACCAGGATACTACGATGGCAGATACTGGACCATGTGGAAGTTGCCCATGTTCGGGTGCACTGATGC

FIG. 2 continued

CACTCAGGTGTTGGCTGAGGTCGAGGAGGCAAAGAAGGCTTACCCACAAGCCTGGGTTAGAATCATTGGATTCGACAAC
GTCCGTCAAGTGCAATGCATCAGTTTTATCGCCTCCAAGCCAGAAGGCTACTAAAATCTCCATTTTTAAGGCAACTTAT
CGTATGTGTTCCCCGGAGAAACTGTTTTGGTTTTCCTGCTTCATTATATTATTCAATGTATGTTTTGAATTCCAATCA
AGGTTATGAGAACTAATAATGACATTTAATTTGTCTTTGGTC

> SEQ ID NO: 5765 129748 118122_300064_1b
AAAAGAGAGAAAGAGAAATCTTTCTGTCTTAAGTGTAATTAACAATGGCTTCCTCAGTTCTTTCCTCAGCAGCAGTTGC
CACCCGCAGCAATGTTGCTCAAGCTAACATGGTTGCACCTTTCACTGGTCTTAAGTCAGCTGCCTCGTTCCCTGTTTCA
AGGAAGCAAAACCTTGACATCACTTCCATTGCCAGCAACGGCGGAAGAGTGCAATGCATGCAGGTGTGGCCACCAATTA
ACAAGAAGAAGTACGAGACTCTCTCATACCTTCCTGATCTGAGCGTGGAGCAATTGCTTAGCGAAATTGAGTACCTCTT
GAAAAATGGATGGGTTCCTTGCTTGGAATTCGAGACTGAGCACGGATTTGTCTACCGTGAACACCACAAGTCACCGGGA
TACTATGACGGCAGATACTGGACCATGTGGAAGTTGCCTATGTTCGGATGCACTGATGCCACCCAAGTGTTGGCCGAGG
TGGAAGAGGCGAAGAAGGCATACCCACAAGCCTGGATCCGTATTATTGGATTCGACAACGTGCGTCAAGTGCAGTGCAT
CAGTTTCATTGCCTACAAGCCAGAAGGCTACTAAGTTTCATATTAGGACAACTTACCCTATTGTCCGACTTTAGGGGCA
ATTTGTTTGAAATGTTACTTGGCTTCTTTTTTTTTTAATTTTCCCACAAAAACTGTTTATGTTTCCTACTTTCTATTCG
GTGTATG

> SEQ ID NO: 5766 129748 126182_300460_1b
CCCACGCGTCCGGCAAAAGCTAAATAATTAATTGCAACAATGGCTTCCTCTGTGATTTCCTCAGCTGCTGCCGTTGCCA
CCGGCGCTAATGCTGCTCAAGCCAGCATGGTTGCACCCTTCACTGGCCTCAAATCTGCTTCCTCCTTCCCTGTTACCAG
AAAACAAAACCTTGACATTACATCCATTGCTAGCAATGGTGGAAGAGTCCAATGCATGCAGGTGTGGCCACCAATTAAC
ATGAAGAAGTACGAGACACTCTCATACCTTCCTGATTGAGCCAGGAGCAATTGCTTAGTGAAGTGAGTATCTTTTGA
AAAATGGATGGGTTCCTTGCTTGGAATTCGAGACTGAGCGTGGATTTGTCTACCGTGAACATCACAGCTCACCAGGATA
CTACGATGGCAGATACTGGACCATGTGGAAGTTGCCCATGTTCGGGTGCACTGATGCCACTCAGGTGTTGGCTGAGGTC
GAGGAGGCAAAGAAGGCTTACCCACAAGCCTGGGTTAGAATCATTGGATTCGACAACGTCCGTCAAGTGCAATGCATCA
GTTTTATCGCCTCCAAGCCAGAAGGCTACTAAAATCTCCATTTTTAAGGCAACTTATCGTATGTGTTCCCCGGAGAAAC
TGTTTTGGTTTTCCTGCTTCATTATATTATTCAATGTATGTTTTGAATTCCAATCAAGGTTATGAGAACTAATAATGA
CATTTAATTTGTTTCTTTTCTAATGA

> SEQ ID NO: 5767 129748 128913_300401_1b
CGTGACTCTGCTCTAGCACCTCACCAAGCAGAAAGCTAGAGAGCTAGCAATGGCGCCCACCGTGATGGCCTCGTCGGCC
ACCTCCGTTGCTCCCTTCCAGGGGCTCAAATCCACCGCCGGGCTCCCCGTCAGCCGCCGCTCCAACAGCGCCGGCCTCG
GCAGCGTCAGCAACGGTGGAAGGATCAGCTGTATGCAGGTGTGGCCGATTGAAGGCATCAAGAAGTTTGAGACCCTGTC
GTACCTGCCACCGCTCACGGTCGAGGACCTCTTGAAGCAGATCGAGTACCTGCTCCGGTCCAAATGGGTGCCTTGCCTC
GAGTTTAGTAAGGTCGGGTTCGTCTACCGTGAGAACCACAGGTCTCCTGGGTACTATGATGGCAGGTACTGGACCATGT
GGAAGCTGCCTATGTTCGGATGCACTGATGCCACCCAGGTGCTCAAGGAGCTCGAGGAGGCCAAGAAGGCATATCCAGA
TGCATTTGTTCGCATCATCGGCTTCGACAACGTCAGGCAGGTGCAGTTGATTAGCTTCATCGCCTACAAGCCCCCGGGT
TGCGAGGAGTCTGGCGGAAACTAAGCTAGTTGGCAAGCCAGCAAGCTCACTCGTGAGCTCTATACA

> SEQ ID NO: 5768 129748 141978_300430_1b
CCTCCGAGTGCATCTCAAGAAGTACTCGAGCAAAGAAGGAGAGAGCTTGGTGAGCTGCAGAGATGGCCCCCTCCGTGAT
GGCGTCGTCGGCCACCACCGTCGCTCCCTTCCAGGGGCTCAAGTCCACCGCCGGCATGCCCGTCGCCCGCCGCTCCGGC
AACTCCAGCTTCGGCAACGTCAGCAATGGCGGCAGGATCAGGTGCATGCAGGTGTGGCCGATTGAGGGCATCAAGAAGT
TCGAGACCCTCTCCTACCTGCCACCGCTCACCGTGGAGGACCTCCTGAAGCAGATCGAGTACCTGCTCCGTTCCAAGTG
GGTGCCCTGCCTCGAGTTCAGCAAGGTCGGATTTGTCTACCGTGAGAACCACAGGTCCCCTGGATACTACGACGGCAGG
TACTGGACCATGTGGAAGCTGCCCATGTTCGGGTGCACCGACGCCACCCAGGTGCTCAAGGAGCTCGAGGAGGCCAAGA
AGGCGTACCCTGATGCATTCGTCCGTATCATCGGCTTCGACAACGTTAGGCAGGTGCAGCTCATCAGCTTCATCGCCTA
CAAGCCCCCGGGCTGCGAGGAGTCTGGTGGCAACTAAGCCGTCATCGTCATATATAGCCTCGTTTAATTGTTCATCTCT
GATTCGATGATGTCTCCCACCTTGTTTCGTGTGTTCCCAGTTTGTTCATCGTCTTTTGATTTACCGGC

> SEQ ID NO: 5769 129748 134846_300419_1b
CGAGCAAAGAAGGAGAGAGCTTGGTGAGCTGCAGAGATGGCCCCCTCCGTGATGGCGTCGTCGGCCACCACCGTCGCTC
CCTTCCAGGGGCTCAAGTCCACCGCCGGCATGCCCGTCGCCCGCCGCTCCGGCAACTCCAGCTTCGGCAACGTCAGCAA
TGGCGGCAGGATCAGGTGCATGCAGGTGTGGCCGATTGAGGGCATCAAGAAGTTCGAGACCCTCTCCTACCTGCCACCG
CTCACCGTGGAGGACCTCCTGAAGCAGATCGAGTACCTGCTCCGTTCCAAGTGGGTGCCCTGCCTCGAGTTCAGCAAGG
TCGGATTTGTCTACCGTGAGAACCACAGGTCCCCTGGATACTACGACGGCAGGTACTGGACCATGTGGAAGCTGCCCAT
GTTCGGGTGCACCGACGCCACCCAGGTGCTCAAGGAGCTCGAGGAGGCCAAGAAGGCGTACCCTGATGCATTCGTCCGT
ATCATCGGCTTCGACAACGTTAGGCAGGTGCAGCTTATCAGCTTCATCGCCTACAAGCCCCGGGCTGCGAGGAGTCTG

FIG. 2 continued

```
GTGGCAACTAAGCCGTCATCGTCATATATAGCCTCGTTTAATTGTTCATCTCTGATTCGATGATGTCTCCCACCTTGTT
TCGTGTGTTCCCAGTTTGTTCATCGTCTTTTGATTTTACCGGCCGTGCTCTGCTTTTGTTTTGTTTCACCTGATCTCT
CTCTGACTTGATGTAAGAGTGGTATCTGCTACGACTATATGTTGTTGGGTGAGGCATATGTGAATGAAATCTATGAAAG
CTCCGGCTATATATATTTA

> SEQ ID NO: 5770 129748 128935_300401_1b
CCCCAGGGCCTCAACAGCACTGCTACTGGACATACTCTACTACTACTAGCCAGTAAGCTAGCTAACTAACTACGTGCTA
TGGCCCCCACCGTGATGGCCTCCTCGGCCACCTCCGTGGCTCCATTCCAAGGGCTCAAGTCCACCGCCGGCCTCCCCGT
CAGCCGCCGCTCCACCAACTCGGGCTTCGGCAACGTCAGCAATGGCGGAAGGATCAAGTGCATGCAGGTGTGGCCAATT
GAGGGCATCAAGAAGTTCGAGACCCTATCGTACCTGCCACCACTCACCGTGGAGGATCTTTTGAAGCAGATCGAGTACC
TGCTTCGATCCAAGTGGGTGCCTTGTCTCGAGTTCAGCAAGGTTGGGTTCGTCTACCGTGAGAACCACAGGTCTCCCGG
ATACTACGATGGCAGGTATTGGACCATGTGGAAGCTGCCCATGTTCGGCTGCACCGATGCCACCCAGGTGCTCAAGGAG
CTCGAGGAGGCCAAGAAGGCCTACCCCGATGCCTTTGTCCGTATCATCGGCTTCGACAACGTCAGGCAGGTGCAGTTGA
TTAGCTTCATCGCCTACAAGCCCCCAGGTTGCGAGGAGTCTGGTGGCAACTAAGCTAAGATCAAGCATCGCGCTGGTGG
ATTGCTGCCTATAATAATAGTATGCAGCTTTGTTTGGGCTATATTGATGATATATCAATATATAATATGCTATATATT
TTTATTTTACAGTTTGGTTATGTACCATCTCAATGGCCTCTGCTCTTAACACATATGTAATAATCTCTTCCCTCCCTCT
CCGACCGGGTTTATTGTAAGAGTACTACAATTATCGTTGGGTGAGGATATGT

> SEQ ID NO: 5771 129753 127219_300469_1b
CCCCCCCGGCACCTACCTTAAGATCTAAACGTCCATTTTCAACAGCAAAACAAATTCACAGAAATATCAAAAAATGGA
TTCTGAGGGTATTCTTTTGGGTATGGGCAATCCATTGCTCGATATCTCTGCTGTTATCGATCAAGATTTCCTCAACAAG
TATGACATTAAGCCAAACAATGCAATTCTTGCTGAGGAAAAGCACTTGTCTATGTATGATGAAATGACATCCAAGTTTA
ATGTTGAATACATTGCTGGAGGTGCAACACAAAATTCAATCAGAGTAGCTCAGTGGATGCTTCAAATTCCAGGTGCAAC
AAGTTACATGGGCTCTATTGGGAAGGACAAGTATGGGGAGGAAATGAAGAAAAATGCAAAAGATGCTGGTGTCAATGTT
CACTATTATGAGGATGAGAGTCCAACGGGTACTTGTGCTGTCTGTGTGCTTGACGGCGAAGGTCGCTGGTTGCAAACT
TATCAGCTGCAAACTGCTACAAGGTTGACCATTTGAAAAAACCAGAGAACTGGGCGTTGGTGGAGAAGCCAAGTACTA
TTACATTGCTGGATTTTTTCTCACTGTTTCTCCAGAATCTATTCAGCTTGTTGCTGAGCATGCAGCTGCAAAACACAAG
GTTTTTTCAATGAACCTTTCAGCGCCATTTATCTGTGAGTTCTTCAAGGATCAACAGGAGAAAGTCTTGCCATATATGG
ACTTTGTCTTTGGCAATGAGACAGAAGCAAGAACCTTCTCTAGAGTCCACGGTTGGGAGACTGATAACGTTGAAGAAAT
AGCTTTGAGGATCTCGCAATGGCCAAAGGCATCAGGAACACACAAGAGA

> SEQ ID NO: 5772 129753 28541_300220_1b
CCCACGCGTTCGATCTGAACCTCTTCCCTTTCCTCGAAAGGGCTTCTAACATCATCATCCATGGCTTCCTCTGATTTCG
ATGGAATCCTTTTGGGAATGGGAAACCCACTCCTCGACGTCTCTGCCGTCGTCGACCAACAGTTTCTCGACAAATACGA
CATCAAATTGAACAATGCGATTCTCGCAGAGGACAAACATTTGCCCATGTACGATGAAATGAGCCAGAAGTTCAATGTT
GAATACATTGCTGGAGGTGCTAC

> SEQ ID NO: 5773 129764 175915_300523_1b
CCCCCCCCCCCGGGGGGCCGGCTCTCTCCCTGTCCCCTCTCCCCGCCTCGCCGCAGCCGAACTCCTCGCGCTAAACC
CTCGCCGCGGCGGCGGCGGGGGCGGTGCCATCTCCCCTCCATCCCCGTCTCACCGCAGCCGGGAACGTACGCTTCGCGC
TTTCCTCTCCCGTCGTCGAATCGAATCGACCCAAGTAGTTGCGGGACACGGGCGGTGAGAGAGATGCTGGTGCTGTTCG
AGACGCCCGCGGGGTTCGCCCTCTTCAAGGGGCTCGACGAGGGGAAGCTCGACAAGGTCGAGGATTTATGGAAGGAGTT
CACGACGTCTGACTCGGCGAGAAAGGTGGTTGAGCTGAAGGCTTTCAACAAGTTTGAGAACACATCTGATGCCCTTTCT
GCTGCAACCCTCATTATTGACAGCAAGCCTACCAAGGGTTTGCGCAAGTTCTTGCACAAGCCCTGGGAGGGTGAAACAT
TAGCTGTGGCTGACTCTAAACTTGGAAATGCTATAAAGG

> SEQ ID NO: 5774 129764 257523_301683_1b
AGAAAGCACAGCTTGGTCTTTCTCACAGTTACAGCAGGGCGAAAGTTAAGTTTAACGTGAATCGAATCGACAACATGAT
TATCCAGAGCATTAGTTTGCTCGACACAATCGACAAGGACATCAACACCTTCGCCATGAGAGTCAAGGAGTGGTACTCA
TGGCATTTTCCGGAGCTAGTGAAGATTGTCAACGATAACTACATATACGCAAAGCTTTGCACGTCCATCAAGGACAAGT
CCAATCTTACCGACGATGCGCTTGACGAGTTGACGGAGATAACGGGCGAGGAAGACAAGGCAAAGGAAATTCTAGCGGC
TTCCAAGTCATCCATGGGTCAGGACATTTCTCCCGTCGACTTAATCAACATCCAGGCGTTTGGAGAGCGGGTTGTACGT
CTGGTGGAGTTCCGAACCGTGCTGCATGGCTATCTCATGTCGAAGATGAATGGCATTGCACCGAACCTGGCCACTCTCA
TCGGAGAAATCGTTGGTGCTCGACTTATCTCTCGTGCCGGAAGCCTCACTAACCTGGCCAAGTGTCCTGCTTCCACAGT
TCAAATTCTTGGAGCAGAGAAAGCTCTGTTCAGGGCTTTGAAGACGAAAAGCAATACGCCGAAGTATGGCCTCATCTTC
CATTCTTCTTTCATCGGAAGGGCTTCAACAAAAAATAAAGGCCGGATTGCTCGATTCCTGGCG
```

FIG. 2 continued

> SEQ ID NO: 5775 129833 235806_301230_1b
GGCTATGGCGGCGCATCGCGACGAGGGCTGGTTCGCTATCGATCGAGAGGAGGGATGCGCGGTGGTGCCCGGCATCTAG
ATGTGGCGACGCCGCGATTCTTCTTCTTCTTCTTGTCCCAGCTTCTCCGGGCGTGGAGATTTTCGGATTTCCGGCCTCA
AGCAACTGGAGCTAGGGCGCATTGGCTGTGGGTGATCTACCGCCGGGGCAGGGTTGCACGGATCTGATTGTTCCAGCAG
CGCTAGGGTTTGTGGATTTTGGGGAGATTTCTTCTCCAAATCGTCGTCTTCTTGGATCGATCGATCCCTCTTGCTTCGT
CCATCCGCCATGCCTTCCCACGGTGATCTTGATCGGCAGATCGAGCAGCTATGGGAGTGTAAGCCGCTCTCGGAGATGG
AGGTGAAGAATCTGTGCGAGCAAGCCAGGGCCATCCTCGTCGAGGAATGGAACGTCCAGCCGGTCAAGTGCCCGGTGAC
GGTGTGCGGCGACATCCACGGCCAGTTCCACGATCTGATCGAGCTCTTTCGGATCGGCGGCAAGGCGCCCGACACGAAT
TATCTCTTCATGGGCGACTATGTCGATCGCGGGTACTACTCTGTGGAGACTGTGACGCTGC

> SEQ ID NO: 5776 129833 240214_301312_1b
GAGTAGAGAAGAGTTTAGAAATAGAGGTATAGGCGACACAGGCCCGGCCCGATCCGAGGGCTCCCTGGATGCGCATCGG
ACGGCGTCGCAGCCACTGCCCCGCCCCGCCCCGCCCGCCCAGATCCCTTCCAGGGTTAGACGATTGTATTGTTTAGGG
TTTTGTGCATTGCTAGGATGAACGTGGCACCGCCAGCAGCAAATGGCTACGGTCAGCTGGACGCACAGATCGAGCAGCT
GATGCAGTGCAAGCCGCTGGTAGAACAGGAGGTGCAGTCCTTGTGCGAGAAGGCCAAAGAAATTTTGATGGAGGAAAAT
AATGTGCAGCCAGTAAAGTGTCCGGTCACCATTTGTGGCGACATACACGGCCAGTTCCACGACCTTGCGGAGCTCTTCA
GAATCGGTGGCAAGTGTCCAGATACCAACTACTTGTTTATGGGGACTATGTGGACCGAGGATACTACTCTGTTGAGAC
CGCAACCCTTTTGGTCGCGTTGAAGGTTCGGTATCCCGACCGAATCACCATTCTACGAGGGAATCACGAAAGCCGCCAG
ATCACGCAAGTTTACGGTTTTTATGACGAGTGCTTGCGAAAGTATGGAAATGCAAACGTTTGGAAGATCTTCACCGATC
TGTTTGACTATTTTCCTTTGACGGCCTTGGTAGAGTCGGAGATATTCTGCTTGCACGGAGGGCTTT

> SEQ ID NO: 5777 129833 243754_301342_1b
AGAGGCAGAGGCGGCGGCGCAGCGTTCTAGATTGTGGAGATATTCATGGCCAGTTTTACGACATGAAGGAGCTATTTAG
AGTAGGGGGTGATTGCCCGCAGACGAATTATTTGTTTCTAGGCGATTTTGTTGATCGAGGATTCTACTCGGTGGAGACG
TTCTTGTTGTTGTTAGCTCTCAAGGTTCGTTATCCCGACAGGATCACGCTTATAAGAGGAAACCATGAAAGCCGGCAAA
TCACGCAGGTTTATGGTTTCTACGACGAATGCCTTCGAAAGTATGGATCTGTTAATGTATGGCGCTATTGCACAGACAT
TTTTGACTACTTAAGGTTTGTCAGCATTGATTGATAACAGGATATTTGGTGTGCATGGGGGCTCTCCCCCGCGATTAC
CACCATCGATCAGATCAGGACAATCGACCGAAAGCAAGAAGTTCCACGACGGTGCGATGTGCGATCTGCTGGTCG
GACCCCGAGGACATAATCGGCTGGGGGATGAGCCCGAGAGGCGCCGGTTACTTGTTCGGCGGCAACGTTGCAACGGCCT
TTAATCACGCAAACAAGACTGAGATTATCTGCCGAGCACACCAGCTGGTCATGGAAGGCTTTAAGTGGATGTTCAGAAG
CAGGTGGTGACAGTGTGGT

> SEQ ID NO: 5778 129833 266058_200083_1b
CTCTGTATAAATCTCTAGAAAATTCTAGAGAAAAAAATGCCGTCGCATGGAGATCTACATCAGCAAATCGCACAATTGA
GTGCAGTGCAAGCCGCTATCAGAAGCGGAGGTGAAAACGCTGTGTGATCAAGCGAGAGCTATACTTGTAGAGGAATGGA
ATGTTCAGCCGGTGAAATGTCCGGTGACTGTTTGCGGCGATATTCATGGACAGTTTTACGATCTCATTGAGCTCTTTCG
GATTGGCGGCAACGCTCCTGATACTAATTATCTCTTCATGGGCGATTATGTTGACCGTGGATACTATTCGGTGGAGACG
GTCACACTTTTGGTTGCTCT

> SEQ ID NO: 5779 129833 274169_200148_1b
ATCATTCATGATTTCAAGAAAACTATCCATATTAACCCATCAATATCAAATCTACAACTTTTTCTCTTGTAATAAACGA
TTCTAAGAGAAAAATACAAACACCCTTTTCTTGTTTCTTCCTTGACCTTTTGTTATTTAGTTTGTTTTGGATTGTGGGT
ATTTTTAGCTTGTTTTTAGTGTTTTCTTGAAACCCCATCAATATCAAATCTACAATTTTTTCTTCTTTCTATAAGAAAA
TACAAACACCCTTTTGCACCCTTTTCTTGTTTTTCCCTTTCCCTTTTGTTGTTTTTCTAGTGTTTGTGAAACCCCAGG
TCGAGAAAGAAACAAAGGAATGGCACAAAATAACGAGCAGCAGGTACATGTGCAGGGATTAGTAGAGGCAGGGGTTCTT
GATGATATAATAAACAGATTATTGGAGTTTAGGAATGCAAGAACAGTGAGGCAGGTTCAGCTTTCAGAAGCTGAGATCC
GTTCACTTTGTAGTGCTTCAAGGGAAATCTTCCTTCAGCAGCCTAATCTTCTTGAACTTGAAGCCCCCATCAAGATCTG
TGGTGACATTCATGGCCAATATGGTGATCTTTTGAGGCTTTTTGAATACGGTGGTTTTCCTCCCGAGGCTAATTATTTG
TTTTTAGGGGACTACGTCGACCGTGGCAAACAAAGTTTGGAAACTATATGCCTTCTACTTGCATACAAAATTAAATATC
CT

> SEQ ID NO: 5780 129833 114338_300007_1b
TTCTACACGCTTTACCAGTTTTTTTTATACTGTCACAAAGGACACGTGTCGTGTAAATGTGCTCACCAAAATTGGTGTTT
CAAACCTGTCAACTTTATTCTGCTTGATCAATCATCACACACACACACAGAGTAGAGGCAAGAAGGATATGGGTTCAG
TAGATTTGGATGATATAATAAACCGTTTAATTGAAGTTCGACATAGACCAGGGAAACAAGTCCAGCTATCCGAATACGA
AATCAGGCACCTTTGTCTCAAATCTAAAGAAATTTTCTTGCAACAGCCTAATCTTCTTGAGCTTGATGCACCTATCAAG
ATCTGTGGGGATATCCATGGCCAGTATTCTGATCTACTGAGGCTATTCGAATATGGTGGATTTCCTCCAAGATCCAATT
ACCTATTCTTGGGCGATTATGTGGATCGTGGGAAGCAGAGTCTGGAAACAATATGCCTTATACTTGCATATAAAATAAA

FIG. 2 continued

```
ATATCGTGAGAACTTTTTCCTTTTGAGGGGAAATCATGAATGTGCTTCTGTGAATCGTATATATGGATTCTATGATGAG
TGTAAACGAAGGTTCAATGTTCGACTGTGGAAGATATTCACAGATTGTTTTAACTGCATGCCTGTGGCAGCTCTGATTG
ACGA
```

> SEQ ID NO: 5781 129833 157287_301736_1b
```
TCCTCTCTCTCTCTCTCTCCTCTCCTCTCTCTGTAGAGCTGAGAGAAAATCAAATCAAATCAAACCCCCTTTGAT
TTGACCCCCTTTTCCTCTAGGGTTTCTGCACAAATTTCCCTCCAGAATCAGTAGAAAAGAAGATCAATCAGCAATGGAT
CCGGTGCCATCGAGCGCATCTCATGGAAATCTTGACGAACAAATTGCTCAGCTTATGCAGTGCAAACCCTTGTCTGAAC
AGGAGGTAAGAGGGCTATGTGAGAAAGCAAAGGAGATTCTAATGGAAGAGAGCAACGTGCAGCCTGTGAAAAGCCCTGT
GACTATATGTGGTGATATTCATGGTCAGTTCCATGATCTTGCTGAGCTTTTTCGAATTGGTGGAAAGTGTCCTGACACT
AATTATTTGTTCATGGGAGATTATGTGGATCGTGGATACTATTCTGTTGAAACAGTAACGCTTTTAGTGGCTCTCAAAG
TGCGATATCCCCAGCGAATTACAATCCTAAGGGGTAATCATGAGAGTCGCCAGATTACTCAGGTTTATGGGTTTTATGA
TGAATGCCTGCGGAAATATGGTAATGCCAATGTGTGGAAGACTTTCACAGATCTGTTCGACTACTTTCCTCTGACTGCT
TTGGTTGAGTCAGAGATTTTTTGCCTCCATGGTGGTCTGTCTCCATCTATTGAAACTCTTGATAATATTCGCAATTTTG
ACCGTGTACAAGAAGTTCCACATGAGGGTGCTATGTGTGATCTTTTATGGTCTGATCCTGATGATCGATGGTTGGGG
TATCTC
```

> SEQ ID NO: 5782 129833 153073_200044_1b
```
GGGCTCAAGGATTGCATAAGAAGATCATATCCACTTTGCTTAGGCCGCGAAATTGGAAAGCACCTGTTAATAGAAAGTT
CTTTCTCGATTCATATGAAGTGGGTGAGCTTTGTTATGCAGCTGAGCAGATCTTCATGCATGAGCCTACAGTTCTTCAA
TTGAAAGCTCCTGTCAAAGTTTTTGGTGATCTTCATGGACAGTTTGGTGATTTGATGCGGCTATTTGATGAATATGGAT
TTCCTTCAACAGCTGGAGACATTACTTACATTGACTATTTGTTTCTGGGTGATTACGTTGATCGAGGACAGCACAGCTT
GGAGACAATCACTTTACTCCTAGCTCTGAAGATTGAATATCCAGAGAATGTACATTTGATAAGGGGGAATCATGAAGCT
GCTGATATAAATGCACTTTTTGGCTTCCGTATTGAATGCATCGAGAGAATGGGAGAGAGTGATGGGATCTGGGCATGGA
CGCGTTTCAATCAACTTTTTAACTATCTTCCATTGGCTGCCCTCGTCGAAAAGAAAATCATCTGCATGCATGGTGGGAT
AGGGAGGTCAATTAATTCATTAGAGCAAATTGAGAAGATAGAGAGGCCTATAACAATGGATGCTGGTTCAATAGTCCTA
ATGGATTTGCTATGGTCTGA
```

> SEQ ID NO: 5783 129833 137956_300687_1b
```
ATACAGGCGACGCGAGCAACCACGCGGTCGCAGAAGAAAGAGAGAGAGAGAGATGGCGGCATGAGCACCTCCTCCTGGA
TCGCCACCTCCCCCGATCCCCCGCAAACCCTAGCGACCGGGCCCCCAGCGCCACCTCCCCTGGGGCGGCGCCCTGGTG
AGGAGGGAGGAGGAGGAGGGGGAGGTGGGGAGGGGGGAGGCGACTATGCCGTCGCACGCGGATCTGGACCGGCAGATCT
CGCAGCTGCGGGAGTGGAAGTTCCTGGGGGAGGCGGAGGTGAGGGCGCTGTGCGAGCAGGCGAAGGCCATCCTCATGGA
GGAGTGGAACGTGCAGCCGGTGCGGTGCCCCGTCACGGTCTGCGGCGACATCCACGGCCAGTTCTACGACCTCATCGAG
CTCTTCCGCATCGGCGGCGAGGCGCCCGACACCAACTACCTCTTCATGGGCGACTACGTCGACCGTGGCTACTACTCAG
TGGAGACTGTCTCGTTGTTGGTGGCTTTGAAAGTACGCTACAGAGATCGAATTACAATATTGAGAGGAAATCATGAGAG
CAGACAAATCACTCAAGTGTACGGCTTCTACGATGAATGCTTGAGAAAGTATGGAAA
```

> SEQ ID NO: 5784 129833 129463_300479_1b
```
GAATTCAAAGGCGATCTGAGAAGAAGAAGATAGGGGACGAGAATTGTTGTCTCGTTTTACCACCAATTCATCGCTCTCT
GTCTTACTTCCCACTCATTAATTTTAGGGTTAGGTTTCCTCGATTGTATTGCTGAAAAGTAATTTTATTTCATTTTTTT
TTTTTTGGAAGAAAATGAGTGTGGATCCGGTTCAACCAACACTCATGGCAACATCGATGAGCAGATTTCACAGCTTAT
GCAGTGCAAGCCCTTACCCGAACAAGAGGTCAGGACATTGTGTGAGAAGGCTAAAGAGATATTAATGGAAGAAAGCAAT
GTACAGCCTGTTAAAAGTCCAGTGACGATATGCGGTGACATCCATGGGCAATTTCATGATCTTGCAGAACTTTTTCGCA
TCGGAGGAAAGTGTCCAGATACCAATTATTTGTTTATGGGAGACTATGTGGATCGTGGTTATTATTCAGTGGAAACAGT
AACTCTGCTGGTCGCCCTGAAAGTGCGATACCCGCAAAGAATTACCATTCTTAGAGGAAATCATGAAAGTCGCCAGATA
ACACAAGTCTATGGGTTCTACGATGAATGTTTGCGAAAGTACGGCAATGCGAACGTGTGGAAGACTTTTACGGACCTAT
TTGACTATTTTCCATTGACAGCCTTGGTGGAATCAGAAATTTTTTGTTTGCAT
```

> SEQ ID NO: 5785 129833 1097392_301443_1b
```
GCCCCCTCCACCTATCTCTCTCCTCTCTCTCTCTTCTCTCTTTCTCTCTCTCTCTCTCTCTCTGTCTATCTGTCTGC
AGATCGACAGAGATTTAGCTGTTTTCTGGGTTAGGGGAGGAGAAGAAGGGGTAGGTCGAGATGAGTGTGCCTCCTGGTA
TCGTGGACCGCAATGCGAATCTGGATGCGCAGATCGAGCAGCTCATGAACTGCAAGCCTCTCTCCGAGACCCAGGTGCG
AGCTTTATGTGAGAAAGCGGAGGAAATTTTGATGGAGGAGAACAATGTGCAGCCTGTCAAATGTCCTGTCACGATATGT
GGTGATATTCACGGGCAGTTTCATGATCTTGCAGAACTATTTCGGATTGGTGGAAAGTGTCCGGACACTAATTATCTAT
TCATGGGTGACTATGTGGATCGTGGATACTACTCAGTAGAAACTGTTACTCTTCTAGTAGCACTGAAGGTTCGATACCC
TGAAAGAATCACCATACTTAGGGGCAACCATGAAAGTCGTCAGATTACTCAAGTGTACGGGTT
```

FIG. 2 continued

> SEQ ID NO: 5786 129833 230569_301069_1b
GGGACTTGCGGCAGGTTGCCAAAATCGTTCCCAAAGATCCGGATGCAAAGAAGAAGATTCGGGAATGCGAGAGCGCGAT
CAAGAAGTTAAGATTCGAGGAGGCGGTCGCCACCGACGAGAGGCGCTCGGTTGCAGGCACGATAGATCCCAGTACTTTT
GTAGTAGAAGACTCGTACACAGGAGCGAGGATACAAGGAGACCAACTATACTTGAAATTCGTTAAACAGATGATGCAAG
AGTTCAAGGACGAGAAACGTTTGCACAAAAGATACGCTTATCAGATAATGCGGCAGACCTTGGATCTGCTCACTAGTCT
CCCGACTCTCGTCGAAATAACTATCCCAGAGAATCGCCACATTACAGTATGTGGCGACATTCACGGCCAGTACTATGAC
CTGCTTAACATCTTTGAGATAAACGGCTTGCCTTCGAACGAGAATCCTTACCTGTTTAACGGCGATTTTGTTGATCGAG
GGTCTTTCTCCGTCGAAGTAATCCTGACGTTGTTCGCTTTCAAGTGCTTGTATCCTCAAGCCATGCACCTTGCGAGGGG
AAATCACGAGAGCCAAAGTATGAACAAAGTCTATGGTTTTGACGGTGAAGTCAAGGCCAAGTACTTCTCAGACGTAATG
CCAGAG

> SEQ ID NO: 5787 129833 234338_301099_1b
GGAGAAGAGGCAGAGGAATGGCGCAGTGAGTGAGCATCGATCGATCGATCGCGGGGCGGCGGCGGCCATGTCCGACCTG
GACCGGCAGATCGAGCAGCTCAAGCGATGCGAGCCGCTCAAGGAGTCGGAGGTCAAGGCGCTGTGCCTCAAGGCCATGG
AGATCCTCGTCGAGGAGAGCAATGTCCAGAGAGTAGACTCTCCAGTCACGATTTGTGGAGATATTCATGGCCAGTTTTA
CGACATGAAGGAGCTATTTAGAGTAGGGGGTGATTGCCCGCAGACGAATTATTTGTTTCTAGGCGATTTTGTTGATCGA
GGATTCTACTCGGTGGAGACGTTCTTGTTGTTGTTAGCTCTCAAGGATCACGCTTATAAGAGGAAACCATGAAAGCCGG
CAAATCACGCAGGTTTATGGTTTCTACGACGAATGCCTTCGAAAGTATGGATCTGTTAATGTATGGCGCTATTGCACAG
ACATTTTTGACTACTTAAGTTTGTCAGCATTGATTGATAACAGGATATTTGGTGTGCATGGGGGGCTCTCCCCCGCAAT
CACCACCATCGATCAGATCAGGACAATCG

> SEQ ID NO: 5788 129848 187826_300681_1b
CAAAACCCCCCCGACACCGAGCCCCTCCTCCTCGACCTCGCCGCAAATCCTCCGCCGCTAGGGCATAACCGCCCGCCTC
TCGCCGGCATCCGCATCTCCCGGGGAAGGGAAGGGAAGGGAAGGGAAGGAAGGAAGGTGAGGGCGGATATGTCGGCGGC
GCCGATACCCCGCGAGTGGGTGGGGCTGCAGCAGTTTCCGGCGGCTACCCAGACCAAGCTGCACGAGCTCCTCGGCAAG
CTCAAGGAGGAGAATGTGAGCACATTGACAATTCTGGTGATGGGCAAGGGCGGGGTGGGGAAGTCATCCACCGTCAACT
CCATCGTTGGCGAGAGGGTCGCTACTGTCAGCGCCTTCCAGTCCGAGGGTCTCAGGCCGATGATGTGTTCTCGCACCAG
GGCAGGCTTCACCTTGAACATTATTGACACTCCTGGGCTCATTGAAGGTGGATACATCAATGAGCAGGCTGTTGAGATC
ATAAAAAGGTTTCTTCTGGGCAAGACTATTGATGTCCTCCTTTATGTGGATCGATTGGATGCATACAGAATGGACACGT
TGGATGATCAAGTTATTAGAGCTGTCACCAATTCATTTG

> SEQ ID NO: 5789 129848 224223_300970_1b
GCCCTAAACCACTGGAGCAGCAGCATTGCCCTTATCCTCGCGGCGAATCTCTTCCCGGTACGTGATTCCTCGTCTAGAT
TCTAGCGGCGGCGCCGCTTCTCGCTATCGATTGATTGAGCCGCCGCTGCTCCGCGAAGATGGGAAGCATAAAGGAATGG
TCGGGCATCAACCAGTTCCCCGTCGCTACACAGACCGCTCTCCACGGGCTGCTTGGCAAGGTCCGGCAACAGAATGTGG
ATAGTATGACTGTTCTTGTTCTCGGTAAAGGAGGAGTTGGGAAAAGCTCTACCGTTAATTCTGTAATTGGTGAAAGAGT
AGCGGCTGTCAGTGCCTTCCAGTCTGAAACCTTGAGGCCGCTCTGCGTTTCCCGATCCAGAGCTGGATTTACTTTGAAC
ATCATCGATACACCGGGTTTGATCGAAGGTGGATGGGTGAATGACCAAGCTCTAGAGATTATCAAGAGGTTTCTCTTGG
ACAGAACTATTGATGTGGTTTTGTATGTCGATCGGCTGGACGGCTATCGAGTTGATAGCCTGGACAAGCAAGTGATCAA
GGCCATTAGTCGTGGCTTTGGTCCTCAGATCTGGAAAATTTGTCTGCTCGTTTTGACTCACGCACAGCTTCCTCCACCC
GACGGTACAAGTTACGACGATTATGTGCACCACAGGTCCGAGGGGCTTCTGGCGGCTATAAGGCATGAAGCTGGCTTCA
AGAAAACTGACCCCGACATTCCTTACGCGCTTGTGGAAAATAGTGGCCGATGCAGCACCAATGCTGGTAGCGAGAAGAT
ACTTCCGGACGGGACAGTGTGGGTGCCAAATCTGGTCGCTCGACTTGTGGAAGTGGTCACCAACGATCAGCCGTCGCTG
CTGGTGGACAAGAAGCTTATCGAAGGTCCCAACGCGAACAACCGGGGAAAGCTGTGGATTCCGCTGGTGTTGCTCGCAG
AGTATCTCTTCGTGGTGAGACCGATCCAAAGCGCAA

> SEQ ID NO: 5790 129932 28823_300151_1b
ATAAGATCCATCCATTTAGCAGCACCTTAGGATGGCATAGCCTTAAAAGTGAAGGGCGAGGTTCAAACGAGGAAAGGCT
TACGGTGGATACCTAGGCACCCAGAGACGAGGAAGGGCGTAGTAATCGACGAAATGCTTCGGGGAGTTGAAAATAAGCA
TAGATCCGGAGATTCCCGAATAGGGCAACCTTTCGAACTGCTGCTGAATCCATGGGCAGGCAAGAGACAACCTGGCGAA
CTGAAACATCTTAGTAGCCAGAGGAAAAGAAAGCAAAAGCGATTCCCGTAGTAGCGGCGAGCGAAATGGGAGCAGCCTA
AACCGTGAAAACGGGGTTGTGGGAGAGCAATACAAGCGTCGTGCTGCTAGGCGAAGCAGCCCGAATGCTGCACCCTAGA
TGGCGAAAGTCCAGTAGCCGAAAGCATCACTAGCTTATGCTCTGACCCGAGTAGCATGGGGCACGTGGAATCCCGTGTG
AATCAGCAAGGACCACCTTGCAAGGCTAAATACTCCTGGGTGACCGATAGCGAAGTAGTACCGTGAGGGAAGGGTGAAA
AGAACCCCCATCGGGGAGTGAAATAGAACATGAAACCGTAAGCTCCCAAGCAGTGGGAGGAGCCAGGGCTCTGACCGCG
TGCCTGTTGAAGAATGAGCCGGCGACTCATAGGCAGTGGCTTGGTTAAGGGAACCCACCGGAGCCGTAGCGAAAGCGAG
TCTTCATAGGGCAATTGTCACTGCTTATGGACCCGAACCTGGGTGATCTATCCATGACCAGGATGAAGCTTGGGTGAAA
CTAAGTGGAGGTCCGAACCGACTGATG

FIG. 2 continued

> SEQ ID NO: 5791 129932 238516_301295_1b
AGAGGAAGGATTGGGTGGTACAGGCGGCCATGGCGGCAGCGTCCATCACGCCGGCTTGTGCGCGATGCAATGCCGCTGC
TAGCAAGGGCTTTTCGGATTTCTCCGGCCTCAAGAGCAAGAATGCTGTCACATTCGGTCGCGGAGCCGAGGATTTGGCG
ACCAGAGTAGCTTCCCAAACTTGCAAGGTTTGAATTATTTGATTGCTATGGATGGAAGTTCGTTCTTATGTACAAGTTA
GAGAGTGTAGATCTCCAGCTCCGGTGGAGCAAAGCGCGCGGTTGCCGAGGCCAAGATCAAGGTTGCGATCAATGGATTT
GGAAGAATTGGCCGGAACTTCATCCGCTGCTGGCACGGAAGAAAGGACTCGCCATTGGACGTGATTGTCATCAACGACA
CCGGCGGCGTCAAGCAAGCCTCTCACCTCCTCAAGTATGATTCCATGCTTGGAACTTTCGATGCAGACGTCAAGGTCTC
TGGAGACAGCGCGATCTCGGTCGATGGCAAGGTCATCCAGGTTGTCTCCAACCGAGACCCTCTCAAGTTGCCATGGGGA
GAGCTTGGAGTAGACCTTGTGATCGAGGGAACTGGAGTTTTCGTGGATCAAGATGGAGCTG

> SEQ ID NO: 5792 129932 251770_301660_1b
ACTTGTGTGGAGAGGAAGGATTGGGTGGTAGAGGCGGCCATGGCGGCAGCGTCCATCACGCCGGCTTGTGCGCGATGCA
ATGCCGCTGCTAGCAAGGGCTTTTCGGATTTCTCCGGCCTCAAGAGCAAGAATGCTGTCACATTCGGTCGCGGAGCCGA
GGATTTGGCGACCAGAGTAGCTTCCCAAACTTGCAAGATCTCCAGCTCCGGTGGAGCGAAACGCGCGGTTGCCGAGGCC
AAGATCAAGGTTGCGATCAATGGATTTGGAAGAATTGGCCGGAACTTCATCCGCTGCTGGCACGGGAGAAAGGACTCGC
CATTGGACGTGATTGTCATCAACGACACCGGCGGCGTCAAGCAAGCCTCTCACCTCCTCAAGTATGATTCCATGCTTGG
AACTTTCGATGCAGACGTCAAGGTCTCTGGAGACAGCGCCATCTCGGTCGATGGCAAGGTCATCCAGGTTGTCTCCAAC
CGAGATCCTCTCAAGTTGCCATGGGGAGAGCTTGGAGTAGACCTTGTGATCGAGGGAACTGGAGTTTTCGTAGATCAAG
ATGGAGCTGGGAAGCACTTGAAAGCCGGTGCCAAGAAGGTGTTGATCACAGCCCCTGGAAAGGGTGCCATTCCAACTTA
CGTCATTGGAGTGAACGCCGAGCAATACAGCCCCAGCGAGCCGATCA

> SEQ ID NO: 5793 129932 1044136_301886_1b
TATCACTACTCATCTCAGTCGGTCTGTCATTATTACTCGACCACGCGTCGTATCGACTAGTTCATGTATCGAATCCAAT
CACTGATTCCATGGCGACCGCTTCTCTCTCCTCCTCTTCCAAGCCTGTCTCTTTCTCTCAGGTTTCTGGGAAAGGCCTT
CCAGACTACTCCGGCTTCAAGAGTTCCACCTGCATCAGCTTTCGACGGAGAAATGACGACTTCCTCTCTCAGACGTCGC
TTTTCATAGCTTCAGCTTCGAGCTCTGGTGCAAAGAGGGGGGTTACAGAGGCGAAGATCAAAGTAGCCATCAATGGATT
TGGAAGAATCGGACGGAACTTCCTTCGATGTTGGCATGGAAGCAAGGACTCCCCTCTGGAGATTGTAATCATAAATGAT
ACTGGAGGTGTGAAGCAAGCCTCTCACCTACTCAAGTATGACTCGATGCTCGGAACCTTTGACGCTGACATCCAAATCG
TTGGTGATGACAGCATTTCTGTTGATGGCAAGGTCATCAAGATTGTGTCCACCAGGAACCCGTTAAACCTTCCATGGAA
GGCCTATGGAGTTGACCTAGTGATTGAAGGAACGGGAGTCTTTGTGGACCAGGAAGGGGCAGGGAAACATATCACGGCA
GGAGCGAAGAAGGTGCTCATCACGGCGCCT

> SEQ ID NO: 5794 129932 228266_301019_1b
GGCTTGCGGTGGATACCTAGGTACCCAGAGACGAGGAAGGGCGTAGCAAGCGACGAAATGCTTCGGGGAGTTGAAAATA
AGCATAGATCCGGAGATTCCCAAATAGGTCAACCTTTTGAACTGCCTGCTGAATCCATGAGCAGGCAAGAGACAACCTG
GCGAACTGAAACATCTTAGTAGCCAGAGGAAAAGAAAGCAAAAGCGATTCCCGTAGTAGCGGCGAGCGAAATGGGAGCA
GCCTAAACCGTGAAAACGGGGTTGTGGGAGAGCAATACAAGCGTTGTGCTGCTAGGCGAAGCGGTTGAGTGCCGCACCC
TAGATGGCTAAAGTCCAGTAGCCGAAAGCATCACTAGCTTACGCTCTGACCCGAGTAGCATGGGGCACGTGGAATCCCG
TGTGAATCAGCAAGGACCACCTTGCAAGGCTAAATACTCCTGGGTGACCGATAGCGAAGTAGTACCGTGAGGGAAAGGT
GAAAAGAACCCCCAGTGGGTAGTGAAATAGAACGTGAAACCGTGCTGAGCTCCCAAGCAGTGGGAGGGGAAAGTGATCT
CTGA

> SEQ ID NO: 5795 129932 227216_301009_1b
CGAGCATACAGGCGGCAGCGACAAGCCATGGCCACACACGCAGCGCTCGCGGCGTCCCGCATTCGTGGCACCGCCCGGC
TGCACAACAAGGCGGCGTCCAAACAGAGGGTGGACTTCGCCGACTTCTCCGGACTGAGGCCGGGATCGTGCTCCATCAG
CCACGCCGCGAGGGAGGCGTCCTTCTCCGATGTCCTTGGCTCGCAGCTCGTCGCCAGGGCTACCGGAGAGAACGCCGTG
AGGGCGCCGGCTGAGGCGAAGCTCAAGGTTGCCATCAACGGCTTCGGCCGCATTGGCCGCAACTTCCTCCGGTGCTGGC
ACGAACGCGAGAACTCCCCGCTCGAGGTCGTCGTCGTCAACGACAGCGGAGGCGTCAGGAACGCATCACACCTTCTCAA
GTACGACTCGATGCTCGGCACCTTCAAGGCCGACGTCAAGATCGTCGACGACCAGACCATCAGCGTCGACGGCAAGCTG
ATCAAGGTCGTCTCCAACAGGGACCCCCTCAAGCTGCCATGGGCTGAGCTCGGCATCGACATTGTCATCGAGGGTACCG
GAGTGTTCGTCGACGGCCCCGGCGCCGGGAAGCACATCCAGGCCGGCGCGAAGAAGGTCATCATCACTGCTCCGGCGAA
GGGTGCTGACATCCCTACCTACGTCCTCGGTGTCAACGAGGGAGACTACTCCCACGAAGTGGCCAACATTATCAGCAAT
GCTTCCTGCACAACCAACTGCCTCGCTCCGTTCGTCAAGATCTTGGACGAAGAGTTCGGAATCGTAAAGGGAACCATGA
CCACAACTCACTCCTACACCGGCGACCAGAGGTTGCTGGACGCGTCGCACCGTGACCTGAGGAGGGCCCGGCGGCGGC
GCTGAACATCGTGCCGACGAGCACCGGCGCCGCGAAGGCCGTGGCGCTGGTGCTCCCGCAGCTGAAGGGGAAGCTCAAC
GGCATCGCGCTGCGCGTGCCGACCCCGAACGTGTCCGTGGTGGACCTGGTGATCAACACCGTGAAGACCGGCATCACCG
CCGACGACGTGAACGCCGCG

FIG. 2 continued

> SEQ ID NO: 5796 129932 202039_300722_1b
CGGACGCGTGGGGAAAGGCTTGCGGTGGATACCTAGGTACCCAGAGACGAGGAAGGGCGTAGCAAGCGACGAAATGCTT
CGGGGAGTTGCGTTGTTTTCTGCAGTAGTATCCCAGGTAACGGTAGAAGAAGTAAATTTGTTGTATCATATGACATCTT
TGGGTATATGTGATGATTGATGGAGTTCATTACGACGTGATCCTTGACCATGTATTTAGTGAATTCTTGCCAGTTCGAT
ATTATGGATAAAGTTAGTGTTTTCGTTTT

> SEQ ID NO: 5797 129932 181802_300657_1b
GAATTCAGGGCTTACGGTGGATACCTAGGCACCCAGAGACGAGGAAGGGCGTACCAAGCGACGAAATGCTTCGGGGAGT
TGAAAATAAGCATAGATCCGGAGATTCCCGAATAGGTCAACCTTTCGAACTGCTGCTGAATCCTAACACGGGGAGGTAG
TGACAATAAATAACAATACCGGGCTCTTCGAGTCTGGTAATTGGAATGAGTACAATCTAAATCCCTTAACGAGGATCCA
TTGGAGGGCAAGTCTGGTGCCAGCAGCCGCGGTAATTCCAGCTCCAATAGCGTATATTTAAGTTGTCGCAGTTAAAAAG
CTCGTAGTTGGACTTTGGGTTGGGTCGTCCGGTCCGCCCTTTGGGTGTGCACCGGTCGTCTCGTCCCTTCTACCGGCGA
TGCGTTCCTATCCTTAATTGGCCGGGTCGTGCCTCCGGTGCTGTTACTTTGAAGAAATTAGAGTGCTCAAAGCAAGCCC
AAGCTCTGGATACA

> SEQ ID NO: 5798 129932 170401_300533_1b
GCGGTGGATACCTAGGTACCCAGAGACGAGGAAGGGCGTAGCAAGCGACGAAATGCTTCGGGGAGTTGAAAATAAGCAT
AGATCCGGAGATTCCCAAATAGGTCAACCTTTTGAACTGCCTGCTGAATCCATGAGCAGGCAAGAGACAACCTGGCGAA
CTGAAACATCTTAGTAGCCAGAGGAAAAGAAAGCAAAAGCGATTCCCGTAGTAGCGGCGAGCGAAATGGGAGCAGCCTA
AACCGTGAAAACGGGGTTGTGGGAGAGCAATACAAGCGTTGTGCTGCTAGGCGAAGCGGTTGAGTGCCGCACCCTAGAT
GGCTAAAGTCCAGTAGCCGAAAGCATCACTAGCTTACGCTCTGACCCGAGTAGCATGGGGCACGTGGAATCCCGTGTGA
ATCAGCAAGGACCACCTTGCAAGGCTAAATACTCCTGGGTGACCGATAGCGAAGTAGTACCGTGAGGGAAAGGTGAAAA
GAACCCCCAGTGGGTAGTGAAATAGAACGTGAAACCGTGCTGAGCTCCCAAGCAGTGGGAGGGGAAAGTGATCTCTGAC
CGCGTGCCTGTTGAAGAATGAGCCGGCGACTCAT

> SEQ ID NO: 5799 130153 167446_300547_1b
GAATTCAGAAGAAGACACAAACTAGACCATTGCCTCTCTTTTTTCAGGTGGACCTAGAAAAAAAACTCTCATTTTCTTG
ATCCAATCAAACAATCAATAATCCTAGAATAACAAGGAATTATTTAGAGAAGATAGATTGATAGAGATGTCGTGTTCAT
CATCATCTGGTTCAGAGGATGAAGATGAGGGAGTTGATGCTTACAGGAAAGGAGGATATCATGCTGTTCGGATTGGAGA
TCCATTCAATGGTGGTCGATATATTGCTCAAAGGAAACTCGGTTGGGGAAATTTCTCTACTGTTTGGCTTGCTTATGAC
ACTAAATCATCTAAATTTGTTGCACTTAAAATCCAAAAGAGTGCTGCTGAATTTGCCGAGGCTGCACTTCACGAGATTC
AAGTTTTATCTGCCATTGCTAATGGGAATCCGTCGGATTCAAAATGTGTTATTCGTTTGATCGATCAATTTAAGCACTC
AGGTCCAAATGGGCAGCATTTATGTATGGTTTTGGAATTTCTTGGCGACAGCTTGCTTCGTCTAATAAAGCATAACCGT
TATAAAGGTCTTCCATTGAATAAAGTTCGAGAATTGTGCAAATCGATTCTGATGGGTCTTGATTACTTACATAGAGAAC
TCGGTATAATTCATACAGATTTGAAACCTGAAAATGTGCTTCTTGTATCCACTATTGATCCTTC

> SEQ ID NO: 5800 130153 273788_200145_1b
GGAGAGAATATGGTAATGAAGGCCACATATACCCCCTCATTAACGCACTGTCCCTTTCATTCTTAAAGCTTTTTCCACG
AGAATTCCACTTTGCTTCTTCTCTAATCGAAAATCATCAAATTTATAATCAATCAAATCAAACGATAAACATATTTAAT
AAATTTGTAGATCACACACAGTGTGTGTAAATCCGGTTTGATCCATTCACCGATCATGTCATGTTCACCGTCGTCATCG
TCGGCATCGGAAGATGAAGATGAAGGAATGGATTCATACAGAAAAGGAGGATATCATGCCGTGAGGATCGGCGATTCAT
TCTCCGGCGGCCGATATATCGCTCAGCGAAAACTCGGCTGGGGTGAATTCTCCACCGTTTGGCTCGCTTACGATACGCG
ATCGTCCGGATTTGTAGCCTTGAAGATCCAGAAAAGTGCGCCACAATTTGCTCAAGCTGCTCTTCACGAAATTGAAATC
CTTTCTGCTATTGCTGACGGTGATCCCTCTAATAGTAAATATGTTGTCAGACTTATTGACCATTTTAAGCATATAGGTC
CAAATGGACAGCATTTATGCATGGTCCTTGAATTTCTTGGTGACAGCTTATTGCACCTCGTCAAATATAATCGTTATAA
AGGCCTTGAACTGAACAAAGTTAGGGAAATATG

> SEQ ID NO: 5801 130172 51032_300116_1b
TCCGATTATGATCAAGCCTGACGGCGTCCAGAGAGGACTCATCGGTGAAGTCATCTGCAGGTTTGAGAAGAAGGGTTTC
ACGTTGAAAGGTCTGAAGTTGATCAGTGTAGAGAGATCTTTTGCTGAGAAGCACTACGAAGACTTATCTTCAAAGTCTT
TCTTCAGTGGACTCGTTGACTACATTGTATCCGGCCCTGTTGTTGCTATGATCTGGGAAGGAAAGAATGTTGTCTTGAC
CGGAAGAAAGATCATTGGAGCTACCAACCCAGCAGCTTCTGAGCCTGGAACTATCCGTGGGGACTTTGCTATTGACATT
GGCAGGAACGTGATCCATGGTAGTGACTCTGTCGAGAGTGCAAGAAAGGACATT

> SEQ ID NO: 5802 130172 30310_301000_1b
AATTGAACAATATAAATTCAAATACTAGTCATCCCATACTTATTGCTTATGCTCTGATTACTGAGTTCACCGGGGAAAA
ATCAAAACCCGGAATGTGTTTGTATCCGTAACAACTGTTTCTTGTTTTTATTGTATGGGTAAAAAAAGAAAAGAAAAAC

FIG. 2 continued

CAATGTGATTTGATTTCAAAAGACAAGAGGAAGAGGGATTTAGTTGTCACCATAAAGCCACTTCTCAAAGTTACTAGTG
TAAAAAACAAGTTCTTGAGGCTTAAACCACAGACTGATCTCATCCTTTGCAGTCTCTGGTCCATCACTTCCATGGATTA
TGTTCCTGCCAACAGTAACTGCAAAATCTCCTCGGATTGTTCCAGGCTCAAATTTCTGAGGATCAGTGGCTCCAATCAG
TTTACGTCCGTATCTGATCACACCATCCCTTCCCAAACCATGGCAATAACAGGACCAGAGCTAAGGAAGTCACACAAA
CCATTGAAAAAAGGTCTTTCCTTAAAATCATGGTAATGCTTTTGTGCGAAATCTTTAGAAGGAACAATGACTTTGATAC
CAACTAGCTTGAATCCCTT

> SEQ ID NO: 5803 130172 107545_300379_1b
TGGTATCAACGCAGAGTGGCCATTACGGCCGGGGCTGCGACTGCTATTCTAAATCCGTAGGACCATTTTTCAGAACAT
CAAAGAAGCGAAAATGGAGCAGACTTTCATCATGATCAAGCCTGATGGTGTCCAACGTGGCCTGGTTGGTGAGATTATC
GGAAGATTTGAGAAGAAAGGATTCTCTTTGAAAGGCTTGAAGCTCATCACTGTGGATCGTGCCTTTGCTGAAAAGCATT
ACGCAGACTTGTCTGCTAAGCCTTTCTTTAGTGGTCTTGTTGATTATATTATCTCTGGCCCCGTTGTTGCAATGGTCTG
GGAAGGTAAGTGTGTAGTTACCACTGGCAGGAAGATCATTGGAGCAACAAACCCATTGGAGTCTGCTCCTGGTACAATC
CGTGGTGATTATGCTATTGACATTGGCAGGAACGTTATTCATGGAAGTGATGCAGTCGAGAGTGCAAGGAAGGAAATTG
CTCTTTGGTTCCCCGAAGGAGTTGCAGAGTGGCAGAGCAGCCTTCACTCTTGGATCTATGAGTAGAAATGTTTTGTTTA
CTTTAGAACTCTATTAATGGCCTGCCTGTTTGGGTGTAACTTATGAATTTTGGATGTGATTTGAGTCTAGAAGTTTATT
GTTTGAGGTTTTCTGTTATTCCCTATTTCAAGAATATTTAATGTGATCAGTATTACTTTCGTGATATTTATAGTCCTTT
TTGTGCTT

> SEQ ID NO: 5804 130172 11804_300294_1b
TGGTATCAACGCAGGTGGCATTACGGCCGGGGGTGCTGCGACTGCTATTCTAAATCCGTAGGACCATTTTTCAGAACAT
CAAAGAAGCGAAAATGGAGCAGACTTTCATCATGATCAAGCCTGATGGTGTCCAACGTGGCCTGGTTGGTGAGATTATC
GGAAGATTTGAGAAGAAAGGATTCTCTTTGAAAGGCTTGAAGCTCATCACTGTGGATCGTGCCTTCGCTGAAAAGCATT
ACGCAGACTTGTCTGCTAAGCCTTTCTTTAGTGGTCTTGTTGATTATATTATCTCTGGCCCCGTTGTTGCAATGGTCT

> SEQ ID NO: 5805 130172 114369_300007_1b
CGGACGCGTGGGGACTTTTCTCTCTTTTTCTTGTAAAAGTCTAAGAGATGAATTCTCAGATTTACAGATCTGCTTCACG
AGCTGCTAAGTCTCTCGTTTCTGCCTCCAAACAGAGTTCTCGTGCTTTTTCTGGGGGGCGAGCAGCAGCTGCAGCAGCC
ACAGTTTCTTTGAGAGGAGTGGTGCCTTCTCTAGCCTCATATGGCAGGACAGATTCTGGAAACGCATCTAGAGCTTGGA
TTTCTGGTGTCCTTGCCCTTCCTGCAGCAGCTTACATGCTCCAAGAGCAAGAAGCACATGCTGCTCAGATGGAGCGCAC
CTTTATTGCCATCAAGCCAGATGGAGTGCAGAGGGGCCTGATTTCAGAAATCATAGCACGCTTTGAGCGCAAGGGTTTC
AAGCTGGTTGCAATCAAAATTGTGATTCCTTCCAAGGAATTCGCACAGAAGCACTATCATGACTTGTCGGAGAGACCAT
TCTTTAATGGCCTATGTGATTTCCTTAGCTCTGGCCCTGTCCTAGCTATGGTTTGGGAAGGTGAAGGAGTAATCAGATA
TGGAAGGAAGCTTATCGGAGCCACAGATCCACAGAAATCCGAACCAGGAACCATCAGAGGTGACTTAGCTGTTGTAGTC
GGAAGGAACATCATCCATGGTAGCGATGGACCAGAGACTGCCAAGGATGAGATCAACCTATGGTTTAAACCAGAAGAGT
TGGTTAACTACACAAGCAATTCAGAGAGGTGGGTATATGGTGACAACTGAGCGAACCTATTCTACCTTAATCTGAATTG
CCATTAAATCGGCATGAAGAGTAGCATACTCATAATTTATCACGAATAAATCGGATGCCATTTTCCTTAGGCTGGTAG
CAACTTTACCTCTACCATACTGAACCTCATTTTTCTTGGATTTTTCTTTCTGTTACCAGAGGAAAGATCAGTTGGCCC
TAAAAAAAAAG

> SEQ ID NO: 5806 130212 182952_300664_1b
GAATTCAAATCTATGTCGTTCAAGAGCTTTGGAAGCATTCCGATGTGATCCAGCGAAATGGGGTGTGAATGTACAGCCT
TACTCTGGTAGTCCTGCTAATTTTGCAGCGTATACTGCTTTGTTGAATCCACATGATAGAATTATGGGTCTTGATTTGC
CATCAGGTGGTCATTTGACACATGGTTATTATACATCTGGTGGTAAGAAGATTTCTGCTACTTCAATTTACTTTGAGAG
TTTGCCTTATAAGGTGAATTCTACTACTGGGTATATTGATTATGATAAGTTGGAAGAGAAAGCTTTGGATTTCAGACCT
AAATTGATTATCTGTGGTGGTAGTGCTTATCCTAGAGATTGGGATTATGCTAGATTTAGAGCTGTTGCTGATAAATGTG
GTGCTCTTTTGCTTTGTGACATGGCTCACATTANTGGTCTTGTTGCTGCTCAGGAAGCTGCCAACCCATTTGAATACTG
TGACGTTGTCACAACCACAACTCACAAGAGTTTGAGGGGACCTAGGGCTGGTATGATCTTCTTC

> SEQ ID NO: 5807 130212 1008066_301406_1b
ATATTTGCAATTATTGAGAAAGAGAAGAGTAGGCAGTTCAGGGGCCTGGAACTTATTGCCTCTGAAAACTTCACATCTC
GAGCTGTAATGGAAGCAGTCGGTTCTTGCCTGACAAACAAGTATTCTGAGGGACTACCTGGGAAAAGATATTATGGTGG
GAATGAATATATAGATGAAAGTGAGCGATTATGTCAGCAAGAGCCTTAGCTGCTTTTCATCTTGACCCAAAGTTGTGG
GGGGTGAATGTACAACCACTGTCTGGCTCCCCAGCCAATTTTGCTGTCTACACAGCCTTGCTCCGACCTCATGACAGAA
TAATGGGCCTTGACCTTCCTCACGGTGGGCATTTATCCCATGGTTTTATGACACCGAAGAGACGAGTATCGGCTACTTC
CATTTACTTTGAAATCCATGCCATATCGTCTGGACGAGGCAAAAGGTAAGATCGACTATGAAATGATGGAG

> SEQ ID NO: 5808 130212 132542_300447_1b

FIG. 2 continued

```
CTGAGAATTGTTGGATTGTGTGATTGTTTTTTCAATTACAATGGATTTGAGCCAATCGCAATCGAGTAATCTCTCGCTA
GGGTTTATTGCTCATGCGTCCCCGGCGGGAAGCGCACCTAGTCGTGCTCATATCGCCGACGACTCGATCACTTTTCAGA
TCGATTCTAGGGTTAAGGACCAATCGCATCTGATTCCGCCTGTTCCACTTCAATTGATGGACAAGCAAACGGAGGAGAA
CGAAAAGAACGGGGGAGAGAGTGGGGATGAAGAGAGGGAAGTTGAAGAATTTCGTATTCTAGGACATTCCATGTGTATA
AACGGAGGAGAGATATTGATAGCACGTCGTCTTCTTCGTCTTCAAAGTGCTTTAGGGTTACGAGTTCCAATGAGCATA
TGCTAGGGCTAGAATCGCGAATAAGCGCTGTTAGAGCTTGGGGTAATCAGGGGTTTACAGGTAGCTGACCCGGATATATT
TGAGATAATGGAGAAGGAGAAGCAGAGACAGTACAAAGGGATTGAACTGATTGCCTCTGAGAATTTTGTATGCAAGGCT
GTGATGGAGGCATTAGGGAGCCATTTAACAAACAAGTATTCTGAAGGAGCACCGGGGGCAAGGTACTATGGTGGTAATC
AGTTTATAGATGAGATTGAAACTCTATGTTGTAAGCGTGCATTAGCTGCTTTTGGACTTGACCCTGAGAATTGGGGTGT
GAATGTGCAACCATATTCTTGCACTTCAGCAAACTTTGCGGTTTATACTGGTTTGCTACTGCCTGGTGATCGGATAATG
GGATTGGATACACCGTCTGGTGGAAACACAAGTCATGGGTATTATCTTCCTAATGGAAGAAAAGTTTCAGGGGCTTCAA
TTTTCTTTGAGAGTCTGTCTTATAAGGTTGACCCCCAAACTGGGTATGTAGATTTTGATAAGCTTGAGGAAAGGGCTCT
TGATTTCCGTCCTAAGATACTTATATGTGGGGGGAGTTCGTATCCCCGGGAATGGGATTATGCAAAGTTTAGACAGATT
GCGGACAAATGTGGTGCAGTTTTGTTGTGCGATATGGCACAAATTAGCGGTCTCATTGCTGCAAAGGAATGTGCGAGTC
CCTTTGATTATTGTGATATAGTTACTTCAACAACTCATAAAAGTCTTCGAGGTCCTAGGGGAGGTATTATCTTTTATAG
GAAAGGATCAAAGCCAAG

> SEQ ID NO: 5809 130212 241141_301320_1b
GTCTGTTTCTTTTCTCACAATCCCACCAAACTACCTCACAATGTCTCCCACAAACGCTGAGTATGCGCTCTCTGAGACG
CACAAGGAGATGCTCGAGAAGTCTCTCCTCGACTCCGACCCTGAGGTTGCCACCATCATGAAGGATGAGATTCAGCGCC
AGCGCGAGTCCATTATCCTCATCGCCTCCGAGAACATCACCTCTGCGCCGTCTTCGATGCCCTTGGTTCCCCCATGTC
CAACAAGTACTCCGAGGGTTACCCTGGTGCTCGTTACTACGGTGGAAACCAGCACATCGACCAGATCGAGCTTCTCTGC
CAGCGCCGTGCCCTTGAGGCCTTCCACCTCGATTCCGAGAAGTGGGGTGTGAACGTCCAGTGCCTTTCTGGATCCCCCG
CCAACCTCCAGGTCTACCAGGCTATCATGCCTCCTCACGGCCGTCTTATGGGTCTTGACCTTCCCCATGGTGGCCATCT
TAGCCACGGTTACCAGACCCCCGCCCGCAAGATCTCTGCTGTCTCTACCTACTTCGAGACCATGCCTTACCGTGTCGAC
CTCGACACCGGCATCATCGACTATGACACCCTCCAGAAGAACGCTATCCTCTACCGNCCCAAGGTCCTCGTTGCCGGTA
CTTCCGCCTACTGCCGTCTTATCGACTACGAGCGTATGCGCAAG

> SEQ ID NO: 5810 130212 266434_200086_1b
CGGACGCGTGGGGCTCGCCAATGGAAGGGGCTCGAACTCATTCCTTCAGAAAATTTCACTTCCCTTTCGGTGATGCAAG
CAGTTGGATCGGTTATGACTAACAAGTATAGTGAAGGATATCCTGGTGCCAGATACTATGGAGGAAATGAGTACATAGA
CATGGCAGAAACTTTATGCCAGAAACGTGCTTTGGAAGCATTCAGGCTGGATCCTGCAAAGTGGGGAGTGAATGTGCAG
CCTCTATCAGGATCACCTGCTAATTTTCATGTTTACACTGCATTATTAAAACCTCATGAACGGATCATGGCTCTTGATC
TTCCTCATGGTGGACATCTTTCTCATGGATATCAGACTGATACGAAGAAGATATCTGCAGTCTCTATATTCTTTGAGAC
AATGCCTTACAGACTCAATGAGAGCACTGGCTATATTGACTATGACCAGCTTGAGAAAAGTGCCACACTCTTTAGGCCA
AAATTAATTGTTGCTGGTGCTAGTGCCTATGCACGTCTTTACGACTATGAACGAATCCGGAAGGTCTGCGACAAACAGA
AAGCTATTTTATTAGCAGATATGGCACACATTAGTGGATTGGTTGCAGCTGGAGTCATCCCATCACCATTTGATTATGC
TGATGTTGTCACTACCACAACCCAC

> SEQ ID NO: 5811 130426 156162_301363_1b
CAAAATCAGTTTTGCTCAATACCCTTTTCAAGATTCACTCAAAGTTCAAAACTTTCATTGAAAAAATCAAGAATGGTTG
TTGTTTCAGCTACAACTGCTGCTGAGAAATCCAATAAAAGGTATCCTGGTGAAGCTAAAGGGTTTGTTGAGGAGATGAG
ATTTGTGGCTATGAAATTGCATACTAAGGATCAATCTAAGGAAGGTGAAAAAGAACCTGAAGGTCAGCCTATGGCTAAA
TGGGAACCTAGTGTTGAAGGGTATTTGAAGTTTTTGGTGGATAGTAAATTGGTTTATGATACTTTGGAAAAGATTATGG
AAAAGGCTCCTTTTTCTGAGTATGCTGAGTTTCAGGAACACGGGATTAGAAAGGTCAGAGGCCTTAGCAAAAGATTTGGA
ATGGTTTAGGCTGCAAGGTTATGCCATCCCAGAACCATCAGCTCCTGGTCTCAACTATGCTCGTTACCTAGAGGAGCTA
TCAGAAAAGGATCCTCAAGCATTTATTTGCCACTTTTACAACACATACTTTGCGCATTCAGCTGGTGGTCGCATGATAG
GGAGAAAGGTGGCTGAAAAGATACTCAATAAGAAAGAGCTGGAATTCTACAAATGGGACGGTGACCTTTCTCAGCTGCT
GCAGAATGTTAGAGAGAAGCTGAATAAAGTTGCAGAAAATTGGACTAGAGAGGAGAAGAATCATTGTTTGGAAGAGACG
GAGAAGTCATTCAAGTTCTCAGGGGAAATCCTCCGATTAATATTGTCTTGATGCGCGGCTTTGCATTTGTACGTTGGAT
GGCCTAAAGCTCAAATTACTGTGAATAGTCGTGTTCATTTC

> SEQ ID NO: 5812 130430 113022_300021_1b
AGGACGCAAATTCTTTGAACTAAAATTTCCGTCTTCTTGGTTTCATTTTCATTTTTTTCCAGAGAAGGCAGGCCTTTG
CCGTCACATCATCGGAACCCTATGGCGGTCTCAAGCTGTGCTAGGGCTTTTCCATCCTTTGAATGTCGTTCGGATGCCG
AATTCTCTGGCGGTATTCCCCGCCACGACATTCCTAACTCCGGCAAGGCCAGCATTTTGAGTCACGGATCGTCCATTCA
CGGTCTGTCTTCTCTTATTTATAGGTTTCCTCCGAACTTTGTTAGGCAGTTGAGCATTAAGGCTCGGAGGAACTGCAGC
AACATCGGTGTGGCTCAAGTTGTGGCGGCTTCGTGGTCTAACAATAACTCATCTCCTGATTTCACTCCGGTGGCTAAGG
```

FIG. 2 continued

CCGTCGATGCCGCCGCCATTGCTCCTGTTGATACCACGGTAGTTAATGAGGACGTGGCGCTGGTGGAAAATGAGACTTG
TAATGATCAAAATGTACTGTTTGACAGTTTGCCAAGTGTGAAATACGCTTCGTTTTTGAATTCTGATGGGAGTGTCGCT
ATTCATGCCGGTGAAAGGTTGGGACGTGGCATTGTTACGGATGCAATTACTACCCCAGTAGTTAACACATCTGCTTATT
TCTTCAACAAGACTTCTGAGCTCATTGATTTTAAGGAGAAAAGACGTGCAAGTTTTGAATATGGGCGCTATGGGAACCC
AACTACTGTTGTTTTAGAGGAGAAGATAAGCGCACTGGAGGGTGCTGAATCAACCTTGTTAATGGCATCTGGAATGTGC
GCCAGTACTGTAATGCTGCTGGCGTTGGTTCCTGCTGGAGGCCATATTGTTACAACCACAGACTCGCTATAGGAAGACC
CGGATCTTTATTGAAACTATACTTCCTAAAATGGGGATTACGGCCACGGTCATTGACCCAGCCGATGTCGGAACTCTGG
AGTTGGCTCTAAATCAGAAGAAAGTGAATCTTTCTTTACCGAGTCTCCAACAAATCCATTCCTCAGATGTGTAGACAT
TGAGCTGGTTTCAAAGCTTTGTCATGAAAAGGAGCCTTGGTTTGCATAGATGGGACGTTTGCAACTCCTCTTAATCAA
AAGGCCCTTGCTCTTGGGGCTGACCTCGTTCTGCACTCTGCAACAAAATTCCTTGGTGGGCATAATGATGTTCTCGCTG
GTTGCATTAGTGGTCCTGTAAAGTTAGTTTCAGAAATACGTAACCTGCATCACATCCTGGGTGGTGCTCTCAATCCGAA
TGCCGCATATCTAATTATCCGAGGCATGAAGACGCTGCATCTTCGTGTACAGCAACAAAACTCTACTGCATTGAGGACG
GCCGAGATTTTAGAGGCTCATCCCAAGCTGAGACATGTCTATTATCCAGGCCTGCACAGTCATCCAGAATATCACATTG
CAAAGAAACAAATGACAGGTTTTGGTGGCGTGGTCAGTTTTGAGGTTGATGGAGAT

> SEQ ID NO: 5813  130438 115105_300012_1b
CCCACGCTCCGAAAGAAGAGGAGGTGGTAAATGTAACGTGGGAGATTGACGTCTTCCAGTTGTCCCTTGCTGCCTCATT
TGCGATTTCATCCTCCCTTCAGTCCACACCACTAGTCTTTTCACTCTAGTTTTTTCGCTGAGTTCATACATTAACTGAG
AACGAAAATGGAGGGTGAATTGAAGCCCATGGATGCAGAGCAACTGAGAGAATATGGTCACAAAATGGTGGATTTCATT
GCTGATTATTACAAAAATATCGAGAACTTTCCTGTTCTCAGTCAAGTTCAGCCCGGTTATCTACGTAAGGTACTTCCTG
AAACCGCACCTGCTCATTCTGAGACATTGGAAGACGTTCTTGAAGATGTTCAGACTAAAATATTACCGGGGGTGACTCA
TTGGCAGAGCCCAGATTACTTTGCATATTTTCCTTCTAACAGTAGTGTAGCTGGATTTTTGGGGGAGATGCTCAGTGCT
GGGATTAACATGGTTGGTTTTAGTTGGATAACTTCCCCAGCAGCAACCGAGCTCGAAATGATCGTTTTGGATTGGCTTG
CTAAAGCCCTTAAGATGCCTGATGAATTCCTTTCAACAGGTCAAGGAGGTGGAGTCATACAGGGCACAGCAAG

> SEQ ID NO: 5814  130438 158474_200018_1b
CCGCTCCGTAACCGTTTACCTGAAACTGCCCATATCGCCCCGAATCATTTGACACCATTATGAAAGATATTCAAAACCA
TATTGTCCCTGGTATGACCCACTGGTTAAGCCCTAATTTCTTTGCATTTTTTCCAGCCACCGTTAGCTCCGCTGCTTTC
GTCGGTGAAATGCTGTGCACTTGTTTCAACTCCGTTGGTTTTAACTGGCTCGCGTCACCGGCTGTTACGGAGCTAGAAA
TGGTAGTCATGGACTGGCTCGCAAATATGCTAAAACTACCAAAAGCCTTCATGTTTTCTGGCACTGGTGGTGGTGTACT
TCAAGGTACAACCAGTGAAGCTATTCTCTGTACACTAATCGCCGCTCGTGACCGAAAGCTCGAAACCCTAGGTGTTCAT
AATGTTGGAAAGCTCGTTGTCTACGGCTCTGATCAAACGCACTCTACGTATACCAAGGCTTGCAAGCTGGCTGGTATTT
TCCCATGCAATATTAGAGCTATACCTACGTCTGTTGAAAGTAATTTCTCTTTATCTCCTGTGGTCCTACGTAGAGTTAT
TGAAGCTGATGTGGCTGCCGGATTGGTCCCACTTTTCCTCTGTGCTACTGTAGGGACCACTTCAACTAC

> SEQ ID NO: 5815  130492 226918_301006_1b
ACCACCAGCCAACACTATCGGAATTGGTTCGGGAGCAGGTCAAGCAGGAGGCATGGCGGCGGCGGCGGCGAAGATA
GCGCCGTCGATGCTCTCGTCGGACTTCGCCAACCTCGCCGCGGAGGCCGACCGCATGGTCCGCCTCGGCGCCGACTGGC
TCCACATGGACATCATGGACGGGCACTTTGTTCCTAATCTTACTATTGGAGCTCCAGTGATTCAGAGCTTGAGGAAGCA
CACCAAGGCATATTTGGACTGCCATCTTATGGTGACCAATCCTTCGGATTATGTAGAACCATTAGCAAAAGCTGGTGCC
TCAGGTTTCACATTCCATATAGAAGTATCCAGAGACAATTGGCAAGAACTCATCCAAAGTATCAAAGCAAAGGGTATGC
GACCGGGTGTATCATTGAGGCCAGGCACTCCTGTGGAGGAAGTTTTTCCCCTGGTGGAGGCAGAAAATCCTGTTGAATT
GGTTCTTGTTATGACAGTTGAACCTGGCTTTGGTGGTCAGAAGTTTATGCCAGAAATGATGGAAAAGGTGCGTGCCCTG
AGAAAGAAGTACCCATCCCTTGACATCGAGGTTGATGGTGGTCTGGGTCCTTCCACCATTGATGT

> SEQ ID NO: 5816  130492 245105_301565_1b
GAAAGATGGCCAAGATTGCGCCATCCATGCTTTCCTCGGACTTCGCCAATCTCGCAGCCGAGGCACAGCGAATGCTGGA
TTGTGGAGCGGACTGGCTACACATGGACATCATGGATGGGTGAGGAAGGGATAGATGCTTTGAAAACCTCTGATCTCGT
GTGATCCCGCAGGCATTTTGTTCCAAACTTGACTATTGGAGCTCCGGTGGTAAGTTCGCTGCGAAAGCATACAAGTGCT
TATTTGGATTGCCACCTTATGGTGACGAATCCACTCGACTACGTAGAGCCTCTTGCCAAGGCCGGGGCGTCTGGCTTCA
CTTTCCACATTGAAGCTTCTCGAGATAATTGGACACAAATATCAAAGAAGGTCAAGGAATGCGGCATGAAAGTTGGAAT
TTGCCTCAAGCCTGGAACTCCAGTCGAAGAGGTGTACCCTCTAGTAAGTCTTGATACGTATGTAAAAGCTTGTGCTCAA
ACGCAACACTTCTTCCAGGTTGACAGTGGTGATATTGATTTAGTGTTGATCATGACTGTCGAGCCAGGATTTGGAGGTC
AGAAGTTCATGCCGGAAACAATGAGCAAGGTGACACAGAATTATGTTTTT

> SEQ ID NO: 5817  130492 247020_301616_1b
GGGCCAAGATTGCGCCATCCATGCTTTCCTCGGACTTCGCCAATCTCGCAGCCGAGGCACAGCGAATGCTGGATTGTGG
AGCGGACTGGCTACACATGGACATCATGGATGGGCATTTTGTTCCAAACTTGACTATTGGAGCTCCGGTGGTAAGTTCG

FIG. 2 continued

```
CTGCGAAAGCATACAAGTGCTTATTTGGATTGCCACCTTATGGTGACGAATCCACTCGACTACGTAGAGCCTCTTGCCA
AGGCCGGGGCGTCTGGCTTCACTTTCCACATTGAAGCTTCTCGAGATAATTGGACACAAATATCAAAGAAGGTCAAGGA
ATGCGGCATGAAAGTTGGAATTTGCCTCAAGCCTGGAACTCCAGTCGAAGAGGTGTACCCTCTAGTTGACAGTGGTGAT
ATTGATTTAGTGTTGATCATGACTGTCGAGCCAGGATTTGGAGGTCAGAAGTTCATGCCGGAAACAATGAGCAAGGTGA
AAGCTCTTCGAGCTCGCTATCCAAAACTAGACATCGAGGTTGATGGCGGTCTTGGCCCTTCGACGATCCAGCAAGCCGC
CGATGCTGGAGCAAACTGCATCGTCGCTGGAAGCTCGGTTTTTGGAGCTCCAGATCCGG
```

> SEQ ID NO: 5818   130492  282224_200073_1b
```
TTCAGAGGTTAAAAATATCGAAAATGCACGCCTCTTTTTCTCTCTCTCGACATCAGGCTATTTCTTCTAAAACCCATAA
CAAATTTCATCCTTCACACGTCGGATCAAGCAGCCGCCGAATCTATTTCTGGATTCAGACGTCTTAATCCTAAGAAAAA
CAAACGAGGCCTTAGTATTACTACTCCGAAATAAAGAGAGAGAAGCTACTTACGCCGGCACCGGACTTTAGATTGAATG
GAGAATTTAACGGCCGATAGGGAGGAGGAGAAGATGGTGAAAGCAATCATAGCGCCGTCGATGCTGTCATCGGACTTCG
CTAATTTGGCATCTGAAGCACAGCGCATGCTCAATTACGGTGCTGATTGGCTTCACATGGACATCATGGACGGTCACTT
TGTCCCAAATCTTACCCTTGGTGCTCCAGTTATCGAGAGTCTGCGAAAGCATACAAAGGCATATCTGGACTGCCACCTC
ATGGTCACTAACCCCCTTGATTATGTGGAACCGTTAGGCAAAGCTGGTGCCTCGGGGTTTACTTTCCATGTTGAGGCAT
CTAGAGATAACTGGCAAGAGCTTGTTCAACAGATAAAGTCTAAGGGCATGAAACCTGGAGTTTCTTTGAAGCCTGGTAC
ACCAATTGAGGAAGTGTACCCACTGCTTGATGGTGAAAACTCTGTCGAACTGGTCCTAGTGATGACTGTTGAACCTGGA
TTTGGCGGACAAAAGTTTATGCCAGAGATGATGGATAAGGTACGGACTCTCAGAAAGAAGTATCCATCGCTTGATATAG
AGGTCGATGGTGGTTTAGGACCTTCA
```

> SEQ ID NO: 5819   130646  1171901_302059_1b
```
GAAAGAGAGAGAGAGAGAGAGAGAGAGAGAGAGAAGCGTTTGGGAGCCATGGAAGCTACACTCAGCCTCCTTCCTTCATCC
CGACCCCTTCTGTTCTCCGGCAAGGCGAAATTCCCGTTGTTGTCACCTTCGGCTCCCCACAGTGGCGTTGCTCTTCTTC
ACGCTCGAGCCCAGCTCCCGTCATCGTCCTCCTCCTCCTTGGAAAGGGTCGTTCTGCCTGCCAGAGCTTCGATTGAGCA
TGCTTTCCAGAGCGTTGTCAACAACAAGGCGCTCCGGAACTCTGCCTTCCTGGCGATGAACACGCTCGTGGCGGTGCTT
CCGGCCATTGCAGAGGAGGAAGAGAAGGGGAAGATCTTTGACTTCAACCTTACGCTTCCCATCATCGTGGTGGAGTTTC
TGGTGCTGATGTACGCGCTCGACGCCATATTCATCAAGCCGGTGTCAAAGGTGATGGATGAGCGGGATGAGGCGATCCG
GCAGAAGCTGATGGGAGTCAGGGACAACTCGGGGGAAATCAAGGCGCTGCAGGAGGAGGCTGAGGGGATCCTGAAGGCC
GCCCGTGCAGAGACCACGGCCGCCCTGAACCAGATGAAGCGTGAGACAGCCGCCGCCCTCGACGAGAAAC
```

> SEQ ID NO: 5820   130646  243419_301339_1b
```
ACCAGTGGATGGCGGCGGCTATGGCGACTTGCAGTGCCGGAGCTCTGGTCGTGCGCTCGGCATCACTTCCATGCAAGGG
GGGGTTGCCGTCGAGCAGCAAAGCCAAGGTTGGTTTTCTCACTAAACTGGGGAGAGCCCTGGACAGTGGTGCGTTGCGG
AACGCAGCATTCGGGGCGCTGAACCTGGCGACGCTGAGCTTGCCCGCAGCTTTGGCACTGGCTGCCGAGGAGGAGAAGA
AGGAGCCCGGGAAGCTGTTCGACTTCGACGCCACCTTGCCCATAATTGTGGCCGAGTTCCTGTTTCTCATGGTCGCTCT
GGACAAGATCTGGTTCACGCCTGTCGGCAAGATCATGGACGAGCGGGACGAGATGATCCGGAACAAGCTCGAGAGCGTC
AAGGACAACTCGGAGGAGATAAAGAAGCTCCAGGACGAGGCCGAGGCGCTGATTCAGGCGGCTCGAGCCGAGACCACCG
CCGCGTTGAACAAGATGAAGAAGGAGACGGCCGCGGAGCTAGAGGCAAAGTTGCAACAGTCGAGGGAGAGGATCGAGCA
GGAGCTGGCCCAAGCGCTTGCCAACTTGGAAGAGCAAAAGCAGGAGACGCTCAAGAGCCTGGAGCAGCAAGTGCAGGAG
CTCAGCGACAAGATCGTGGAGAAGGTCCTTCCCGTCAAGGCCAGCAAATAAACACTCCCGCCTCGTACCTGCTCCTCCT
CCTCCTC
```

> SEQ ID NO: 5821   130646  254063_301631_1b
```
GAACCATCCGTGGATAGCTAGGTGTACAGGAGAAGAAAGAAGGGAAAGAGAGAGAGAGAGAGAGAGAGAGAAGCG
TTTGGGAGCCATGGAAGCTACACTCAGCCTCCTTCCTTCATCCCGACCCCTTCTGTTCTCCGGCAAGGCGAAATTCCCG
TTGTTGTCACCTTCGGCTCCCCACAGTGGCGTTGCTCTTCTTCACGCTCTAGCCCAGCTCCCGTCATCGTCCTCCTCCT
CCTTGGAAAGGGTCGTTCTGCCTGCCAGAGCTTCGATTGAGCATGCTTTCCAGAGCGTTGTCAACAACAAGGCGCTCCG
GAACTCTGCCTTCCTGGCGATGAACACGCTCGTGGCGGTGCTTCCGGCCATTGCAGAGGAGGAAGAGAAGGGGAAGATC
TTTGACTTCAACCTTACGCTTCCCATCATCGTGGTGGAGTTTCTGGTGCTGATGTACGCGCTCGACGCCATATTCATCA
AGCCGGTGTCAAAGGTGATGGATGAGCGGGATGAGGCGATCCGGCAGAAGCTGATGGGAGTCAGGGACAACTCGGGGGA
AATCAAGGCGCTGCAGGAGGAGGCTGAGGGGATCCTGAAGGCCGCCCGTGCAGAGACC
```

> SEQ ID NO: 5822   130646  170496_300533_1b
```
CCCACGCGTCCGCGTTCGGGGTAGATAGCCCGCTTCCTCCTCTCTCTCAGCTCACCACACCTCGAGTCGCCGCCGCC
GCCGCCGCTGCTGCTGCTTACCTCCTCCGCGCCGCGCACTCCTTGCACTAGCCCATGGCGACGGCTATGATGGCTGCGA
CCGCCACCTCGTGCTCCCCTCGCCGCGCGCCGGTCGTCGCGTCGTCGTCCGTGCAGCCGCCCAGGCGGCAGCAGCAGCA
GCAACCGCGGAGGGGATTGAAGCAGCTGCCGGGGCTCGTGGCGACGGCGGCCGTGGCCGTGGCCGCGGCGCCGCTACCG
GCGCTGGCGGAGCAGATGGAGAAGGCGGCGCTGTTCGACTTCAACCTGACGCTCCCGCTGATCGCGACCGAGTTCCTGC
```

FIG. 2 continued

TGCTGATGGTGGCGCTGGACAAGCTCTACTTCACGCCGCTGGGCAAGTTCATGGACGAGCGCGACGCCAAGATCCGTGC
CGAGCTCGGCGGCGTCAAGGACGCGTCCGAGGAGGTGCGGCAGCTGGAGGAGCAGGCCGCCGCCGTGCTGAAGGCGGCA
CGCGCCGAGATCGCCGCGGCGCTCAACAAGATGAAGAAGGAGACCACCCAGGAGCTGGAGG

> SEQ ID NO: 5823 130646 198996_300647_1b
CCCACCACACCTCGAGTCGCCGCCGCCGCCGCCGCTGCTGCTGCTTACCTCCTCCGCGCCGCGCACTCCTTGCACTAGC
CCATGGCGACGGCTATGATGGCTGCGACCGCCACCTCGTGCTCCCCTCGCCGCGCGCCGGTCGTCGCGTCGTCGTCCGT
GCAGCCGCCCAGGCGGCAGCAGCAGCAGCAACCGCGGAGGGGATTGAAGCAGCTGCCGGGGCTCGTGGCGACGGCGGCC
GTGGCCGTGGCCGCGGCGCCGCTACCGGCGCTGGCGGAGCAGATGGAGAAGGCGGCGCTGTTCGACTTCAACCTGACGC
TCCCGCTGATCGCGACCGAGTTCCTGCTGCTGATGGTGGCGCTGGACAAGCTCTACTTCACGCCGCTGGGCAAGTTCAT
GGACGAGCGCGACGCCAAGATCCGTGCCGAGCTCGGCGGCGTCAAGGACGCGTCCGAGGAGGTGCGGCAGCTGGAGGAG
CAGGCCGCCGCCGTGCTGAAGGCGGCACGCGCCGAGATCGCCGCGGCGCTCAACAAGATGAAGAAGGAGACCACCCAGG
AGCTGGAGGCGAAGCTGGACGAGGG

> SEQ ID NO: 5824 130680 175841_300522_1b
CCCCCCGGCCACCTCCTCCACTCTCGGCGGCGGGGGCCTCATCGATGGCGTCGAGGATGGCGCTCCGGCCCAACGACGT
CACGCTCCGCCTCACCCCGCCCCTCGCCGCCGCCGCGCGGCGCAACCGCCGCGCCGCCGCCGGCGGTGTCAGGGTCTAC
GCCGTCGCGTCCGGGGCCGTCTCCACCAAGGTTGAGAACAAGAAGCCATTTGCTCCTCCACGAGAGGTGCACGTCCAGG
TTACACATTCCATGCCACCCCAGAAGATTGAAATATTCAAGTCTCTTGATGATTGGGCCAGAGATAATATTTTGTCCCA
CCTTAAGCCTGTCGAGAAATGTTGGCAACCACAGGATTTTCTTCCTGATCCAGCCTCAGATGGGTTTCATGATGAAGTC
AAAGAACTTAGAGAACGTGCCAAGGAAATTCCTGATGATTATTTTGTTTGTTTGGTTGGAGACA

> SEQ ID NO: 5825 130680 257645_301684_1b
GGGTGGGCTTCGGATCCGCTCGACCTCCTCGCAGCTCTCCAGCAATGGCCGCCGTCGCCAACGTTTGCGGGATGCCTAT
GAGGAGCGCATTCGTTCCATGCCACGAAATCCACCTCGTCAAGCCGCCGGTTGTCTCCATCACTTCGGTGAGGAGCTCC
AGATTTCCCGGAATCGCCATGACTGCTACGGCTCCAGCAACGGAGAACATTGCAAAGCAAGTCAGCAAGCCTTCCCAAA
TCATGCATTCTCTTTCTCCGGAGAAGGTCGAGATGTTTAAGTCTCTCGAGAGCTGGGCCGAGGAAGCGATCCTTCCATT
CCTGCGGCCAGTGGAGAAATGCTGGCAACCTCAGGACTACCTCCCGGAGCCGTCCTCGGAGAGCTTCTACGACGAGGTT
CGCGAGCTGAGGAAGCGGGCCGAGTGCCTGCCCGGACGACTACTTCGTCTGCCTCGTCGGGGACATGATCACCGAGGAAG
CTCTGCCGACTTACTTGACAATGCTCAACACTCTGGACGGCTCCCGAGACGAGACCGGCGCGAGTCAGAGTCCCTGGGC
CGTCTGGGGACGTGCTTGGACGGCAGAGGAGAACCGTCATGGCGACCTGCTCAACAAGTATCTCTACCTCACTGGACGC
GTCGAT

> SEQ ID NO: 5826 130712 1171366_302052_1b
TCTTTAAAAGAGGGCGAGTGAGGAGAGAGAGAGGGGAAGAGAGAGAGAGAGCGAGGAGAGGGAGAGAGAAGATAAAGGT
TGGACTGCATGGCTTCATCTCTCCTGACTGACCTCCTCAACCTCGACCTTACTGATGTCACTGAGAATATCATCGCTGA
ATACATATGGATTGGTGGATCTGGGTTGGATCTACGCAGCAAGGCCATGACATTAAGCCGCCCGTGTAAAGAGCCCCAGT
GAGCTCCCAAAGTGGAATTATGATGGCTCCAGTACTGGTCAAGCTCCTGGGGAAGACAGTGAAGTCATCCTCTACCCCG
AAGCAATATTCAAGGATCCTTTCCGCCGGGGAAACAACATTTAGGTGATATGTGATTGCTACACTCCTGCTGGAGAGCC
CATCCCCACTAACAAGCGCTGCAATGCTGCCAAGATTTTCAACACCAAGGAAGTCAAGGAAGAAGAGACATGGTTTGGG
CTAGAGCAAGAGTACACACTACTGCAGAAGGATGTGAAATGGCCTCTGGGTTGGCCT

> SEQ ID NO: 5827 130712 14118_300269_1b
CCCACGCGTCCGAAACACACTGATTATTTTCTCTCCGACGCCGCCATGTCTCTGCTCTCAGATCTCGTTAACCTCAACC
TCACCGATGCCACCGGGAAAATCATCGCCGAATACATATGGATCGGTGGATCTGGAATGGATATCAGAAGCAAAGCCAG
GACACTACCAGGACCAGTGACTGATCCATCAAAGCTTCCAAGTGGAACTACGACGGATCCAGCACCGGTCAGGCTGCT
GGAGAAGACAGTGAAGTCATTCTATACCCTCAGGCAATATTCAAGGATCCCTTCAGGAAAGGCAACAACATCCTGGTGA
TGTGTGATGCTTACACACCAGCTGGTGATCCTATTCCAACCAACAAGAGGCACAACGCTGCTAAGATCTTCAGCCACCC
CGACGTTGCCAAGGAGGAGCCTTGGTATGGGATTGAGCAAGAATACACTTTGATGCAAAAGGATGTGAACTGGCCAATT
GGTTGGCCTGTTGGTGGCTACCCTGGCCCTCAGGGACCTTACTAC

> SEQ ID NO: 5828 130712 258832_301700_1b
AACAGTCCTCTGTTCTATTTATTTGCATTACGATGACCGACAACATTAACATTTCGAAAGCTTCCAACTTGTCAAAATA
CCTGGACCTCCCCCAGCACGGAGCTGTCCTGGCCGAGTACATCTGGATCGATGCCCATTTCAACATCCGATCCAAGTGC
AAGACTCTAGACAAGAAGCCCACTTCCATCGAAGACCTCCCCGAGTGGAACTTTGACGGCTCCTCCACAGATCAGGCTC
CCGGCCACGACTCGGATATCTATCCGACCCGCCGCCATCTACCCCGATCCTTTCCGACGAGGCGACAACATTATTGT
TCTGGCCGAGTGCTGGAACAACGACGGAACCCCCAACAAGTTCAACCACCGACGAGTGCGCCAAGCTCATGAGCGCC
CACGAGAAGGAGGTCATCTGGTTCGGAATCGAGCAGGAGTACACCATGTTCGACGAGAGCGATAACCCCGTCGGATGGC

CTAAGGGCGGTTTCCCCGCTCCCCAGGGCCCCTACTACTGTGGTGTCGGAACCGGCAAGGTCTTTGCTCGAGACGTTGT
TGAGGCCCACTACCGAGCCTGTCTCTACTCCGGAATCAACATCTCCGGTATCAACGCCGAGGTCATGCCTTCCCAGTGG
GAGTACCAGGTTGGTCCCTGCGAGGGTATCTCCATGGCCGATGAGCTGTGGATGTCCCGATACCTGCTGCACCGAGTTG
CCGAGGAGTTTGGCATCAAGATCTCCTTCCACCCCAAGCCCCTGCAGGGAGACTGGAACGGAGCCGGCTGTCACACCAA
CGTGTCCACCAAGTCGATGCGAGAGCCCGGTGGAATGAAGCACATTGAGGCTGCCATCGAGAAGCTTGCTGCCCGACAC
AAGGAGCACATTGCCGTCTACGGCGAGGACAACGACATGCGACTCACCGGCCGACACGAGACCGGCTCCATCGGCTCTT
TCTCTTCCGGAGTTGGCAAACGAGGCTGCTCCATCCGAATTCCTCGATCTGT

> SEQ ID NO: 5829 130712 271274_200032_1b
CGGACGCGTGGGTTCTCTCTCTTCAACACTATTTTTCCAGCATAGCATTACCAACTTAGTTGGTTAGGTGAAGATGGCT
CAGATCTTGGCTCCATCTGCGCAATGGCAGATGAGAATGACAAAGAGCTCAACAGATGCTAATCCCTTGACTTCAAAGA
TGTGGAGTTCTGTGGTGTTGAAGCAGAATAAAAGACTTGCTGTTAAAAGCTCTGCCAAATTTCGAGTCTTTGCTCTCCA
ATCTGATAGTGGCACTGTGAACAGAGTGGAACAGCTGCTAAACTTGGACGTAACTCCATATACTGACAAGATCATTGCT
GAATATATTTGGATCGGAGGATCTGGAATTGACATGCGCAGTAAATCAAGGACTATTTCAAAGCCAGTCAAGCATGCTT
CTGAGCTCCCAAAGTGGAACTACGATGGATCAAGTACTGGACAAGCACCTGGAGAAGACAGTGAAGTCATTCTATACCC
TCAGGCAATATTTAAAGACCCTTTCCGTGGTGGTAACAACATCTTGGTTATCTGTGATGCCTACACACCAGCTGGAGAG
CCAATTCCAACAAACAAACGCCATAAAGCTGCTCAAGTTTTTAGCGACTCAAAAGTTGTATCTGAAGTTCCATGGTTCG
GAATAGAACAAGAGTACACCTTACTCCAACAAAATGTGAAGTGGCCTTTAGGTTGGCCTGTTGGAGGCTACCCCGGACC
ACAGGGTCCTTACTACTGTGGTGCTGGAGCAGATAAGTCATTTGGCCGTGATATATCAGATGCTCACTACAAGGCTTGC
CTGTATGCTGGAATTAACATTAGTGGTACCAATGGAGAGGTTATGCCAGGACAGTGGGAATTTCAAGTAGGTCCTAGTG
TGGGAATTGAAGCTGGAGATCATATCTGGTGTGCTAGATACATCCTTGAGAGAATTACTGAACAAGCAGGAGTTGTTCT
CTCTCTTGATCCAAAACCAATTGAGGGTGATTGGAATGGTGCCGGATGCCACACTAACTACAGTACACTGAGTATGAGA
GAAGAGGGGGCTTTGAAGTAATAAAGAAAGCAATTCTGAATCTCTCCCTTCGTCACAAGGAGCATATAAGTGCTTATG
GAGAAGGAAATGAGAGAAGGTTGACTGGAAAGCATGAAACTGCAAGTATTGACAAATTTTCATGGGGAGTTGCCAACCG
TGGTGCCTCAATCCGTGTGGGCGTGACACCGAGAAGCAAGGCAAAGGTTATTTGGAAGACCGCCGCCCAGCTTCAAAC
ATGGACCCTTATGTTGTGACCGGATTACTTGCTGAAACTACTATTCTGTGGGAGCCAACCCTTGAGGCTGAAGCTCTTG
CTGCTCAAAAGCTCGCATTGAATGTTTAGATTATTTAAGGGCAGAATTATCCGTAATAATCTTCTTAGAGTTCATGAGC
TGCTAAGTGAAGAAATTTGTACCTTGTTTAGATTCCCTTTTAGGGAAAATCTTGTAAAGGAACCACAGTTTATCAGTTA
TTCCTATAAAAGAGGTTCCTTAAGACAATGAGACTGCTTTGGAGTTGAGGTGTAATTGTTGGACTACTTTGAACATATT
TATCTTTCATTTCTCCAGATGAATCGATTACTTCTGCCATTCTGATCTCCCGT

> SEQ ID NO: 5830 130712 46914_300175_1b
CGGACGCGTGGGACACAATCTCAAGATTTTCTACTTCTTATTACAAAGATTCAATCTTCTTGTTTCTTCTTGCAACCAT
GAGTCTTTTTGCAGATCTTGTTAACCTTGACATCTCAGACAACAGTGAAAAGATCATCGCTGAATACATATGGGTTGGT
GGTTCTGGTATGGACATGAGAAGCAAAGCCAGGACTCTCCCTGGACCTGTGACCGATCCATCAAAACTTCCAAAGTGGA
ACTATGATGGTTCAAGCACTGGTCAAGCTCCT

> SEQ ID NO: 5831 130712 50894_300186_1b
CCCACGCGTCCGAAAAGCCGGTGGAGGATCCTTCTGAGCTACCTAAGTGGAACTATGATGGTTCGAGTACCGGTCAAGC
ACCTGGTGAAGATAGTGAAGTGATTCTATACCCGCAAGCTATCTTCAGAGATCCTTTCCGTGGAGGCAATAACATCTTG
GTTATCTGTGATACTTGGACACCAGCTGGTGAGCCAATTCCAACAAACAAACGTGCTAAAGCTGCTGAGATCTTCAGTA
ACAAGAAGGTCTCTGGCGAGGTTCCATGGTTCGGCATTGAACAAGAGTACACTTTACTTCAGCAAAACGTCAAATGGCC
TTTAGGTTGGCCTGTTGGAGCGTTCCCTGGTCCTCAGGGTCCTTACTACTGTGGAGTTGGAGCTGACAAGATTTGGGGG
CGTGACATTTC

> SEQ ID NO: 5832 130712 182977_300664_1b
GAATTCGGAGGATCAGCAATTTTTGTTCTTCAATTTCATCTCCTCTCTGAATCTTCAGCTCAGATCGACAATAGTCACA
GCTTCAAGCCCTAATTTAACCAATGTCCCATCTCAGTTCTTCCATGGAAGCTTCTGCAAACCACAGAGCCCCCAAATGG
ATCCTTTACAATCCAATCAGTAGAACCCTAATTCGAATTTCACAAAATACCCATGAAAATCCTCATTGTTCTGCTTTCC
CTGCTTCATTCGATTCTGGTTCAAAACCAAAACCAAAACCAACTTCATCTCCCGGCCATTCTCCCCGATCTCCGGTGAA
GATGGCACAGATTTTAGCACCTTCACTGCAATGTCAGATGAAGTAACAAATACAACAACAAATGCTGCAAGCCCAATT
ACTACAAAGATGTGGGGTTCTCTAATGTTTAACCAGAAAAGAAGTGGACTTACTAAAAACGCTTCTAAATTCAAAGTTA
TGGTTGTTAAATCGGAAAACGGTACCATCAACAGAATGGAAGATCTATTAAATTTGGATACTACTCCCTTCACTGATAA
GATCATCGCTGAATACATCTGGATTGGTGGAACGGGAATTGATATGCGTAGCAAATCAAGGACTATCTCAAAGCCTGTT
AAATCTCCTGCTGATCTTCCTAAGTGGAATTATGACGGTTCAAGTACTGGACAAGCACCTGGAGAAGATAGTGAAGTGA
TTCTATACCCTCAAGCGATTTTTAAGGATCCTTTCAGGGGTGGTAACAATATCTTGGTTATATGTGATGCATACACACC
ACAAGGGGAGCCAATTCCAACAAACAAACGTTACAAAGCTGCTCAGATCTTTAGTGATCAGAAGGTCATTGACGAAATC
CCATGGTACGGTATTGAGCAGGAATACACCCTGCTCCAATCAAATGTGAAGTGGCCTCTTGGTTGGCCTGTTGGAGGAT

FIG. 2 continued

```
TCCCCGGTCCTCAGGGTCCTTACTACTGTGCAGCTGGAGCCGACAAATCCTTCGGAAGAGACATTTCGGATGCTCACTA
CAAAGCTTGCTTATATGCTGGTATTAACATCAGTGGCACTAATGGAGAAGTCATGCCTGGCCAGTGGGAGTATCAAGTC
GGTCCAAGTGTGGGCATTGAAGCTGGAGACCATGTATGGTGTTCTAGATACATTCTTGAGAGAATTACTGAACAAGCTG
GTGTTGTTCTGTCTCTTGATCCTAAACCAATTGAGGGTGACTGGAATGGTGCAGGATGCCATACTAACTACAGTACTAA
GAGCATGAGAGAGGAAGGAGGATTCGACGTGATAAAGAAAGCAATTCTGAATCTGTCTCTTCGCCATAAAGAGCATATT
AGTGCATACGGAGAAGGAAATGAACGAAGGTTGACCGGAAAGCATGAGACAGCCGACATTAACACCTTTTCATGGGGAG
TCGCTAATCGTGGTTGTTCAATCCGTGTTGGACGTGACACCGAGAAGAAGGAAAAGGTTACTTAGAGGACCGCCGCCC
ATCTTCAAACATGGATCCATATGTCGTGACAGGGCTGCTAGCAGAAAGTACTTTATTGTGGCGAACTGAAACATCTTAG
TAGCCAGAGGAAAAGAAAAGCAAAAGCGATTCCCGTAGTAGCGGCGAGCGAAATGGGAGCAGCCTAAACCGTGAAAACGG
GGTTGTGGGAGAGCAATACAAGCGTCGTGCTGCTAGGCGAAGCGGTGCAGTGCTGCACCCTAGATGGTGAGAGTCCAGT
AGCCGAAAGCATCACTAGCTTATGCTCTGACCCGAGTAGCATGGGGCACGTGGAATCCCGTGTGAATCAGCAAGGACCA
CCTTGCAAGGCTAAATACTCCTGGGTGACCGATAGCAAGCGACGAAATGCTTCGGGGAGTTGAAAATAAGCATAGATCC
GGAGATTCCCGAATAGGTCAACCTTTCGAACTGCTGCTGAATCCATGGGCAGGCAAGAGACAACCTGGCGAACTGAAAC
ATCTTAGTAGCCAGAGGAAAAGAAAGCAAAAGCGATTCCCGTAGTAGCGGCGAGCGAAATGGGAGCAGCCTAACACGGG
GAGGTAGTGACAATAAATAACAATACCGGGCTCTTCGAGTCTGGTAATTGGAATGAGTACAATCTAAATCCCTTAACGA
GGATCCATTGGAGGGCAAGTCTGGTGCCAGCAGCCGCGGTAATTCCAGCTCCAATAGCGTATATTTAAGTTGTTGCAGT
TAAAAAGCTCGTAGTTGGACTTTGGGTTGGGTCGTCCGGTCCGCCCTTTGGGTGTGCACCGGTCGTCTCGTCCCTTCTA
CCGGCGATGCGTTCCTAGCCTTAATTGGCCGGGTCGTGCCTCCGGTGCTGTTACTTTGAAGAAATTAGAGTGCTCAAAG
CAAGCCCAAGCTCTGGATACATTAGCATGGGATAACATCATAGGATTTCGGTCCTATTGCGTTGGCCTTCGGGATCGGA
GTAATGATTAACAGGGACAGTCGGGGGCATTCGTATTTCATAGTCAGAGGTGAAATTCTTGGATTTATGAAAGACGAAC
AACTGCGAAAGCATTTGCCAAGGATGTTTTCATTAATCAAGAGCGAAAGTTGGGGGCTCGAAGACGATCAGATACCGTC
CTAGTCTCAACCATAAACGATGCCGACCAGGGATCGGCGGATGTTGCTTTTAGGACTCCGCCGGCACCTTATGGGAAAT
CAAAGTTTACGATGGTCCCTGCGGATGCTAACGCAATGTGATTTCTGCCCAGTGCTCTGAATGTCAAAGTGAAGAAATT
CAACCAAGCGCGGGTAAACGGCGGGAGTAACTATGACTCTCTTAAGGTAGCCAAATGCCTCGTCATCTAATTAGTGACG
CGCATGAATGGATTAACGAGATTCCCACTGTCCCTGTCTACTATCCAGCGAAACCACAGCCAAGGGAACGGGCTTGGCA
GAATCAGCGGGGAAAGAAGACCCTGTTGAGCTTGACTCTAGTCCGACTTTGTGAAATGACTTGAGAGAAGAAGTCCAAA
TCGTTGAAGAAGAACAAATGGCGTCAAAGGATAACTACGAAGAAGCCATTGCTGGGCTCAAGAAGCTTCTTAGCGAGAA
CAATGGTCTGGAGGCAGTTGCCGCGGCTAAGATCGAACAGATAACAGCTGAATTACAGACTACTGCTAACGGGAAAGCC
GACGGATTCTGCCCGGTTGAAAGGATCAAGACTGGATTCGTCCAATTCAAGAAGGACAAATACGAGACTGATCCAAAAC
TGTATGGGGAACTTTCCAAGGGTCAGAGCCCCAAGTTCATGGTGTTTGCATGCTCTGACTCTCGAGTGTGCCCTTCCCA
CATCTTGGGATTCCAACCAGGAGAAGCTTTTGTTGTTAGAAACATTGCTAACATGGTTCCAGCCTATTGTCAAAACAGG
TACTCTGGAGTTGGAGCTGCCATAGAATATGCTGTCTTGCATCTCAAGGTTGAGCATATTGTGGTGATTGGACACAGCT
GTTGTGGTGGGATCAAAGGACTTATGTCTCTTTCTGACGATGGCTCCACTTCCACTGATTTCATCGAAGACTGGGTCAA
AATCGGTTTACCAGCCAAATCCAAGGTTAAGGCCACAGGCGGTGATGCACCAATTGCAGACCTTTGCGAGATGTGTGAG
AAGGAGGCAGTGAATGTATCACTTGGTAACCTTTTGTCATACCCATTCGTGAGAAATGCATGCATTAACAACATATTGA
CATTGAAGGGAGGTCATTACGATTTCGTCAAGGGATCTTTCGAGCTCTGGGACTTGGAGTTTGGACTCTCCCCTACTTC
CACCGTATGAAAAACTACTACATCTCCAGTTCCACACCATGTGTCATTGATGCTCATCAATAACATCCCCATCTCTTCG
AAAATCTTTGTTTTTCCTTCACCT

> SEQ ID NO: 5833 130712 190821_300736_1b
CCCATCCCTGCTTCCTCTTCTACACCTCATTTTCCGCTTGCATCTTGCTCATTCAGATCTCTTCTGCTTTGAGCAATGG
CCAACCTCACCGACCTCGTTAACCTCAACCTCAGCGACTGCAGCGACAAGATCATCGCCGAGTACATCTGGGTTGGAGG
ATCGGGCATAGACCTCAGGAGCAAAGCGAGGACTGTGAAAGGCCCCATCACCGATGTGAGCCAGCTGCCGAAGTGGAAC
TACGACGGCTCCAGCACCGGGCAGGCTCCCGGCGAGGACAGCGAAGTGATCCTCTACCCTCAAGCCATTTTCAAGGACC
CGTTCAGGAGGGGCGACAACATCCTTGTGATGTGCGACTGCTACACGCCACAAGGTGAGCCAATCCCCACTAACAAGAG
GCACAGTGCCGCCAAGATCTTCAGCCACCCTGATGTTGTTGCTGAGGTGCCATGGTACGGTATTGAGCAGGAGTACACA
CTCCTTCAAAAGGATGTGAACTGGCCCCTTGGCTGGCCAGTTGGTGGCTTCCCTGGCCCACAGGGACCATACTACTGCG
CTGCCGGTGCCGAAAAGGCGTTCGGCCGCGACATCGTGGACGCCCACTACAAGGCCTGCATCTACGCCGGGATCAACAT
CAGTGGCATCAACGGGGAAGTCATGCCCGGCCAGTGGGAGTTCCAAGTTGGCCCGTCAGTTGGCATCGCCGCTGCTGAC
CAAGTGTGGGTTGCCCGCTACATCCTCGAGAGGGTCACAGAGGTGGCCGGAGTCGTGCTCTCCCTTGACCCGAAGCCGA
TCCCGGGTGACTGGAATGGCGCTGGTGCCCACACCAACTTCAGCACCAAGTCGATGAGGGAGCCGGGAGGCTA

> SEQ ID NO: 5834 130712 184541_300670_1b
GAATTCAAACAGAGAGCTAGATAGATAATTGGCATTGTTAATTCATCATATTCATTCGTCAAATATGTCTCTTCTAACA
GATCTTATCAACTTAGATCTCTCAGACAAAACTGAGAAGATCATCGCTGAATACATATGGATCGGTGGATCTGGAATGG
ACCTTCGAAGCAAAGGAAGGACATTACCTGGACCTGTTAGTGATCCTTCAAAGCTACCAAAATGGAACTACGATGGTTC
TAGCACTGGACAAGCTCCAGGAGAAGATAGTGAAGTCATCCTATATCCTCAGGCTATCTTCAAAGACCCATTCAGGAGG
GGAAACAACATTCTTGTTATGTGTGATGCTTACACTCCACAAGGAGAACCGATCCCAACTAACAAGAGATGCGCTGCTG
CAAAGATCTTCAGCAATCCTATTGTTGAGAAGAAGTTCCATGGTACGGAATTGAGCAAGAATACACCCTCTTGCAGAA
```

FIG. 2 continued

GGATATTAACTGGCCTCTTGGATGGCCCCAGGGAGGCTTTCCTGGACCACAGGGACCTTACTACTGCGGTACTGGTGCG
GACAAGGCATTCGGACGTGACATTGTTGATGCCCATTACAAAGCCTGTCTCTATGCAGGAGTTAACATCAGTGGAATCA
AC

> SEQ ID NO: 5835 130722 201453_300716_1b
CCACGCGCGTCGCGGGGCGGCAATCGCGTCTCATCAAGGTTTTTCGTGTGGTGTTGAGGATCCATGGCTAGGAAGATGC
TCAAGGACGAGGAGGTGGAGGTGGCCGTCACCGACGGCGGGAGCTACGACTACGACCTGTTCGTGATCGGCGCCGGGAG
CGGCGGCGTCCGGGGCTCTCGCACCTCCGCGTCCTTCGGGGCTAAGGTTGCGATTTGCGAGCTCCCGTTCCATCCCATC
AGCTCGGATTGGCAAGGAGGGCATGGTGGGACGTGTGTGATACGTGGTTGTGTGCCTAAAAAGATACTGGTGTATGGTT
CATCTTTCCGCGGAGAATTTGAGGATGCAAAGAATTTTGGGTGGGAAATCAATGGGGACATTAACTTCAACTGGAAAAG
GCTGCTGGAAAATAAGACTCAAGAAATTGTTAGACTAAATGGAGTATACCAGAGGATTCTTGGCAATTCTGGTGTGACA
ATGATTGAAGGGGCAGGCAGTTTGGTTGATGCTCATACAGTTGAAGTCACAAAGCCAGATGGTTCAAAGCAAAGATATA
CAGCAAAGCACATATTGATAGCAACTGGTAGCCGAGCTCAACGTGTCAACATTCCTGGGAAGGAGTTAGCTATTACTTC
AGATGA

> SEQ ID NO: 5836 130722 2036_300349_1b
ATTCGGCACGAGGCAATTCCCACACGTCTTTTAGAGTATATATAGACCAGACTTGTAATCATGGCTAGGAAGATGCTGA
TTGATGGAGAGTTGGAGAAATCCGATCAAGAAGAACAGCACTATGACTTTGATTTGTTCGTAATAGGTGCTGGAAGTGG
TGGGGTTCGAGCTGGTCGATTTTCTGCCCAATATGGAGCTAAGGTTGCGATCTGTGAGCTTCCATTTCATCCTATCAGC
TCTGAACTTAGTGGGGGAGTTGGTGGAACGTGTGTTATTCGTGGTTGTGTCCCTAAAAAGATTTTGGTTTATGGAGCAG
CCTATGGGCCGGAGCTGGAGGATGCAAGGAATTATGGATG

> SEQ ID NO: 5837 130792 226626_300999_1b
AAAACACTAACAAATTCAAATGGTTAAAGCTGTCGTTGCCGGAGCCGCTGGTGGTATTGGCCAGCCCCTTTCTCTTCT
CCTCAAACTCTCTCCTTACGTGACCGAGCTTGCTCTCTACGATGTCGTCAACTCCCCCGGTGTTGCCGCTGACCTCTCC
CACATCTCCACCAAGGCTAAGGTCACTGGCTACCTTCCCAAGGATGACGGTCTCAAGAACGCTCTGACCGGCGCCAACA
TTGTCGTTATCCCCGCGGTATCCCCGAAAGCCCGGTATGACCGATCTGTTCAAGATCAACGCTGGTATCGT
CCGAGATCTCGTCACCGGTGTCGCCCAGTACGCCCTGATGCCTTTGTGCTCATCATCTCCAACCCCGTCAACTCTACC
GTCCCTATTGCTGCCGAGGTCCTCAAGAAGCACAACGTCTTCAACCCTAAGAAGCTCTTCGGTGTCACCACCCTTGACG
TTGTCCGAGCCCAGACCTTCACCGCCGCTGTTGTTGGCGAGTCTGACCCCACCAAGCTCAACATCCCCGTCGTTGGTGG
CCACTCCGGAGACACCATTGTCCCTCTCCTGTCTCTGACCAAGCCT

> SEQ ID NO: 5838 130792 285167_200103_1b
CTTTCTCCATTTCAATTCATTAACTATTCCGAATGACTTTATCCATGTTGAGATCTGTCGTCCGGAGGACCACAACTTC
AGGCGCGTCTCGCCTCACGCGCCGCCAATTCTCATCGAGGGCCGCACCGGAGAGGAAAGTCGCAATTTTGGGAGCAGCG
GGAGGAATCGGACAGCCTCTTTCACTTCTGATGAAGTTGAATCCTTTGGTATCAACGCTTTCACTCTACGATATTGCCG
GCACTCCTGGTGTTGCCGCTCGATGTTAGCCACATCAATACCAGATCTCAGGTTGCTGGGTTTGCAGGAGAAGACCAGCT
AGGGAAGGCTCTGGAAGGGTCTGACGTGGTCATCATTCCTGCTGGTGTGCCCCGCAAACCGGGTATGACCCGTGATGAT
CTGTTCAACATTAACGCTGGTATTGTTAAATCATTATGCACAGCTATCACAAAGTATTGCCCCAATGCCCTTGTCAATA
TGATCAGCAACCCTGTGAACTCCACTGTGCCAATTGCAGCTGAGGTGTTCAAGAAGGCTGGGACATATGATGAAAAGAG
GCTCTTTGGAGTCACCACACTTGATGTGGTTAGGGCAAAGACTTTCTATGCTGGAAAAGCTAAAGTCAATGTCTCCGAT
GTCATTGTCCCCGTGGTTGGCGGTCATGCTGGCATAACCATCCTCCCGCTGTTGTCCCAAGCCACTCCAAAGGCAAATT
TGTCAGATGAAGAAATTGTTGCGCTCACCAAGCG

> SEQ ID NO: 5839 130792 50979_300164_1b
CTTAAACAGCTTCCTAACGAGAGGAAACTGAGGAACACAACAATGGAGTTTCGTGGAGATGCCAACCAGAGGATTGCTA
GGATTTCAGCTCATCTCACTCCTCAGATGGAGGCCAAGAACTCTGTAATCGGACGGGAAAACTGCAGAGCTAAAGGTGG
TAATCCAGGATTCAAAGTAGCAATTCTTGGAGCTGCAGGTGGAATTGGACAATCTTTATCTTTGCTGATGAAGATGAAC
CCTCTTGTCTCTTTACTTCATCTCTACGATGTTGTCAATGCTCCTGGCGTCACTGCTGACGTCAGTCATATGGACACTG
GAGCTGTTGTCCGCGGGTTCTTGGGAGCGAAGCAGCTTGAGGACGC

> SEQ ID NO: 5840 130792 243921_301553_1b
GAGGTGATTATTAGGGCAATGGGTTTAGAGATGGCCCAGGATCGGGCGAGGGAGCGGATGGGCCGAATCTCATCACACC
TGAAGCGCAGTGATGTGTGTATGGAGGTGTGCCGTGCTAAGGGGGCCGCCACGGGGTTCAGGGTGGCTATACTGGGGGC
GGCAGGAGGCATCGGGCAGCCTCTATCGCTGCTAATGAAAATGAATCCGCTGGTTTCCACGTTGAACCTGTATGATGTG
GTCAACACTCCGGGTGTTACCGCGGACTTGAGCCACATAGACTCAACAGCAGTGGTGAGTGTGCGAGGCTTCCTGGGGA
AAGACGCGCTCCATTCGGCATTGGAAGGGGTGGATCTGGTCATAATTCCAGCAGGTATTCCCCGAAAGCCAGGGATGAG
CCGGGATGACTTGTTCAAGATAAACGCGGGCATTGTGCGAACACTTTGTGAGGGCGTTGCACGGGCATGCCCGCGGGCA

FIG. 2 continued

CTTATCAACATTATCAGCAACCCGGTGAACTCCACCGTGCCTATAGCAGCTGAGGTTTTCAAGAAGTCTGGCACGTACG
ACCCACGACGGCTGTTTGGTGTCACCACCCTTGATGTTGTTCGAGGCAACACATTTGTGGCCGAGGTCGTGGGAGTGGA
TCCAAAGCTCATCAATGTCCCTGTGGTGGGAGGGCACGCAGGCATCACTATCTT

> SEQ ID NO: 5841 130792 254585_301633_1b
ACGCGTCGTGAAAAGCCTTTCCACCGCCATTGCTAAGTACTGCCCAAATGCTATTGTAAACATGATCAGCAATCCGGTT
AATTCAACAGTACCAATAGCAGCCGAAGTATTCAAGAAGGCAAGTACTTATGACCCAAAAAAGCTCTTTGGAGTGACAA
CGCTGGATGTTGTTCGAGCTCGCACCTTTTATGCTGCCAAAAAGGGACTAAATGTCAACGAGGTGAATGTGCCTGTTAT
CGGAGGACATGCAGGCATAACGATTCTTCCTATTTTTTCCCAGGCAACTCCCCAAGTGTCTTCATCTGCTGAAGAAATT
GATGCATTGACGAAGCGCACGCAGGATGGTGGAACGGAAGTAGTGCAAGCGAAGGCTGGCAAGGGTTCTGCCACACTTT
CAATGGCATATGCTGGTGCACTTTTTGCTGAAGCTTGCCTCAAAGGACTGAATGGAGTACCCGATGTAGTGGAGTGCAG
CTATGTGGCTTCGAACTTGGTGCCTGAGCTCCCCTTCTTTGCTTCCAAGGTGGTTCTTGGACAAGGGGGACTCGAGCAG
GTTCTAGAAATAGGTAAACTAACTCCATACGAAGAAAAATGTCTAGATGCGATGAAAGCTGAGCTGAAAGGCTCGATAC
AGAAAGG

> SEQ ID NO: 5842 130792 244286_301556_1b
GTTTGATTGATCGATCGATCGATCGAGGATGTCGTCGAAGCAGCGGGCAGCGATGATCTTCAAGCGGGCTATGGCGACA
GTGCCCGGGGAAAGCCGCTGCCCGTGAGGAAGCCTCTGCCTTATCGTAGGGTCGCGGTTCTGGGGCGGCCGGCGGCA
TTGGGCAGCCGCTGAGCATGCTGCTCAAGCTCAATCCCCTCGTCTCCAAGCTCTCGCTCTACGATATCGCTGGAACCCC
CGGCGTGTCCACTGATCTATCGCACATCAACACGAGGACAGAGGTGCATGGATTTGCTGGGGATGATCAGCTCAAGGAC
GCTCTAAAAGACGCGGATCTCGTTATCATTCCTGCCGGTGTTCCCCGCAAGCCCGGGATGACGAGGGACGAGCTTTTCG
ATATCAATGCGGGGATTGTGAAGAAGCTGTGCCAAGCCATCGCGAAGCACTGCCCTCTTGCATTGATTAACATGATCAG
CAATCCCGTGAATTCCACCGTGCCAATCGCGGCAGAGATGCTCAAGGCCGAGGGAACTTACGACCACACGAGGCTTTTC
GGTGTCACCACGCTGGATGTTGTGCGAGCGAGGACTTTCTACGCCAAAGCCAAGAACCTGCCCATCGAAGATGTGGACG
TCCCTGTCGTTGGTGGACATGCCGGCAAGACCATTCTTCCACTGTTCTCACAGGCAACCCCACAAGTACCCCTCACCCA
GGAAGAGGTCGAGAACCTGACGAAGAAGGTACAGGACGGTGGAACGGAGGTGGTTCAAGCCAAAGCTGGCAAGGGCTCT
GCGACACTGTCCATGGCATATGCTGCTGCTCTTTTGCCGAGTCCTGCTTGAAGGCGATGAATGGAGAGCAAAACGTCG
TTGAGTGCGCGTACGTTGCGTCGTCAGTGACAGACTATCCCTTCTTTGCATCGAAGGTCGAGCTCGGCAAGTACGGGTT
GGTGAAAGCTCTGGAGCTGGGACCGATCTCCAAGTACGAGCAGGCATGCCTGGACGAGATGAAGGACGAGCTGATGGCC
TCCATCGACAAGGGTGTC

> SEQ ID NO: 5843 130792 1007465_301400_1b
TGGATTGGTCTTCTTGCTTTGGATATACACTTTGTGGAGTTAATCTGTTTCTCATAGAATAGAAGAAGATGGATCAATC
CTCATCAATGGTTCGCCTGGCTCGCTTTGCTGCCCATCTGGCTCCTCCCTTGAATGAAGGCGGAAGAGCAGTTCATATG
GAGAGTTGCCGAGCGAAGGGTGCAGCACCTGGCTTCAAGGTTGCTGTGCTTGGGCTTCGGGTGGCATTGGGCAGCCTC
TTTCCCTTTTGCTCAAGATGAACCCCTTAGTTTCTGTGCTCCATCTTTATGATGTTGTCAATACACTCGGAGTGACTGC
CGATATAAGCCACATGGATACTAGCACAGTGGTACGTGGCTTTGTTGGGAAAGATCAATTGGAGGCTGCTTTAGAGGGC
ATGGAGCTTGTTGTAATTCCAGCTGGTATTCCACGGAAACCAGGGATGACTAGAGATGATCTATTCAAGATCAATGCGG
GCATTGTGCGCACACTTTGTGAAGGAATTGCCAAATGTTGCCCGAATGCTATAGTGCATATCATTAGTAATCCGGTAAA
TTCCACAGTTCCAATTGCAGCTGAGGTTTTCAAGAAGGCTGGAACATACAATCCAAGACGGCTTATGGGTGTTACCCAT
CTTGATGTGGTGCGAGCAAACACCTTTGCGGCAGAGGTTATGGGAGTTGATCCAAAACTTGTCACTGTTCCTGTCGTTG
GAGGACATGCTGGCATAACCATTTTGCCACTCCTTTCTCAGATTAAGCCTGCTTTTTCCTTTACCAAGGAGGAGACTGA
ATTTTTAACAAACAGGATTCAGAATGGAGGGACGGAGGTAGTTGAGGCAAAAGCAGGCACAGGCTCAGCGACATTGTCA
ATGGCCTATGGAGCTGCTAAGTTTGCAGAGTATTGTTTACATGCCATGTGTGGTGAAGCCGGTATTTTGGTCTCTGCCC
ATGTTGCTTCACAGGTGAC

> SEQ ID NO: 5844 130826 1007672_301402_1b
GGTAGAAGAAGAAAGAGAAAGAAAGAGAAAGAGACGATATCCTTCTGTCCTGTTGCCATGGCTAGTGCCTCTTTGGCAG
CAGAATGTGCGTTTTCTCTCACCTCCCATGTGAAGAAGAGTAAGGCTGGAAGAGAGAGAGAGAGGCTTCCCTCCTCCTT
CTCCTCCTTTTCCTGCCTCAGAGGTAGTAGCCCATTGCAGAGAACCAGCTTGTTGGGCCAGGAGAGAAGCCCAGCTGAA
GCAGAAGCGGGTCGTCGTCGTCTCTCCCCGAGCCGTCTCCGATTCGCAGAACAAAGAGTTTTGTCTCAAACCCGATGTT
GGGCGAAGTGTTTTGGGAATTATTCTTGGTGGTGGAGCGGGTTCACGGCTTTATCCTTTAACAAAGAAACGGGCGAAGC
CTGCCGTCCCCCTTGGTGCTAACTATCGGCTCATCGATATCCCAGTCAGCAATTGTATAAATAGCAACATTCAAAAAAT
ATATGTGTTGACCCAATTCAACTCGGCCTCTTTGAATCGGCATGTCTCTCGAGCCTACTCAAGCAATCTGGGTGGTTAC
AAGAGTGAGGGG

> SEQ ID NO: 5845 130826 284384_200097_1b
AAATATATACAGCTTATTGCACTTTGTTTTTCTTCTCAGTTTGCATAGAAAAATGGCGGTTGCCGCCGACAGCCAATTC

FIG. 2 continued

GCCTTATCAGCGGCAGGCCAACTTCATAACACAACGGCAGCATTGACAAGGAGAAACTTGAGAGTAGTGAATTTTTGTA
ATGGAGAGTTGATGGGAAAGAAGCTCAAGTTTACAAAATTTCAGTTAAAGAGCAATGTGGTGAAGCCTAATATCTGCAT
GTCACTTACAGCTGATGTTGCAGGTGAGGCTAAGTTAAAGGATCTTGAACCGGAGAAGGCTGATACAAGGACAGTAGTA
GCAATCATTCTAGGAGGGGGAGCTGGCACTCGTCTTTTCCCCCTCACCAAGCGCCGTGCTAAGCCTGCTGTTCCAATTG
GAGGAGCATACAGGCTAATTGATGTACCAATGAGCAACTGTATCAACAGTGGCATCAACAAAGTTTACATTCTCACCCA
ATTCAACTCTGCCTCGCTTAACAGGCATATTGCTCGGGCTTACAACTTTGGCAATGGTGTCACATTTGGAGATGGGTAT
GTCGAGGTCTTAGCAGCAACTCAAACACCCGGAGAAGCAGGTAAAAGATGGTTCCAAGGTACTGCAGATGCTGTTAGGC
AATTCCACTGGCTTTTTGAGGATCAAAGAAGCCAGGACATAGAAGATGTGCTCATTC

> SEQ ID NO: 5846 130826 50037_300166_1b
GCGTCTGTATCTGCAATTGGAGTTCTCAAGGTACCTCCTGCTTCGACTTCCAATTCCACCGGAAAAGCCACGGAGGCGG
TTCCCACGAGGACTCTTTCTTTCTCCTCCTCTGTTACTTCATCCGACGACAAGATTTCACTCAAATCCACCGTCTCCCG
TCTTTGTAAATCTGTTGTTCGCAGGAATCCGATCATCGTCTCTCCCAAAGCCGTCTCAGATTCTCAAAACTCTCAAACT
TGTCTCGATCCTGATGCTAGCAGCAGTGTTTTGGGGATAATCTTAGGAGGTGGAGCTGGAACTCGTCTTTATCCACTTA
CGAAGAAGAGAGCGAAACCAGCTGTGCCTCTTGGTGCTAACTATAGGCTTATTGATATTCCTGTGAGCAACT

> SEQ ID NO: 5847 130826 159866_200026_1b
AAAGTTTGAAACTTGAGAAGAAGGAAAGCAAGATCAAACCTGGGGTTGCTTTCTCTGTTATCACTACTGACAATGGCAA
AGAGACTCTGACTGTGGAGGCTCCACGTTTTGACAGACGACGGGCAAAACCAAAGAATGTAGCTTCAGTCATACTAGGA
GGAGGTGCTGGAACCAAGTTATTCCCGCTGACAAGTAGAGCTGCCACCCCTGCTGTACCGGTTGGAGGATGCTACAGGC
TAATAGACATCCCAATGACAACTGTATCAACAGTGGCATTAACAAGATATTTGTGCTGACCCAGTACAATTCTGCTCC
CTTGAATCGTCACATTGCTCGAACATATTTTGGCAATGGTGTGAGCTTTGGAGACGGATTTGTTGAGGTGTTAGCTGCA
ACTCAGACACCTGGGGAAACAGGGAAAAATTGGTTTCAAGGAACTGCCGATGCTGTTAGACAATTTATATGGGTTTTTG
AGGATGCCAAGAACAAAGATGTTGATAATATCCTTATATTATCTGGGGATCATCTTTATAGGATGGATTATATGGACTT
GGTGCAGAACCATATTGACCGGAACTCTGATATTACTCTTTCATGTGCACCAGCTGGGGACAGCCGAGCAGCAGACTTC
GGGCTGGTCAAGATTGACAGTAGAGGCAGAGTTGTCCAGTTTGCTGAAAAACCAAAAGGTTTTGATCTAAAAGCAATGC
AAGTAGATACTACTCTCATTGGATTATCTCCACAAGAAGCGAAGAGATCCCCATATATTGCATCAATGGGGGTTTATGT
ATTCAAGACAGATGTATTGTTGAAGCTGCTGAAATGGAGATATCCTACAGCTAATGATTTTGGCTCTGAAATTATACCA
GCAGCTATAAATGAGCACAATGTTCAAGCATACATATTC

> SEQ ID NO: 5848 130864 170321_300532_1b
CCCGGGCCTTCGCCACCTTCGAATCGAAACTAATCCCCCACACCTCCGCGTGCCTCCCCCCAATCTCGAGCGCACGGAA
GCCGCCGCCAATGGCGCTCCCGAATCAGCAGACGGTGGACTACCCCAGCTTCAAGCTCGTCATCGTTGGCGACGGCGGC
ACGGGCAAAACCACCTTTGTGAAGAGGCATTTGACTGGCGAGTTCGAGAAGAAGTATGAGCCTACTATCGGTGTGGAGG
TCCACCCCTTGGATTTCTTCACTAACTGCGGCAAGATCCGCTTCTACTGCTGGGATACAGCTGGTCAGGAGAAATTTGG
TGGACTCAGGGATGGTTACTATATCCATGGGCAGTGTGCTATCATAATGTTCGATGTTACTTCTCGGCTGACGTACAAG
AATGTCCCAACTTGGCACCGTGATTTATGCAGGGTCTGTGAAAACATCCCAATTGTGCTCTGTGGTAACAAGGTTGATG
TGAAGAACAGGCAGGTTAAAGCAAAGCAGGTTACCTTCCATAGGAAGAAGAACTTGCAGTACTATGAGGTGTCAGCTAA
GAGCAACTACAACTTTGAAGCCATTCCTGTACCTTGCCAGGAAACTTGCTGGCGATGGTAACCTCCACTTTGTGGAA
ACACCTGCTCTTGCTC

> SEQ ID NO: 5849 130864 199417_300749_1b
GCGTCGTCCAAAAACCCACAAGGACCCCGCCTGTTTACATCACCTCACGCTCGTCGCTAATCACTCGAGCCGTCAATAT
GGCTGAGCAACAGACTCCTACCTTCAAGCTTGTGCTTGTCGGCGATGGTGGTACCGGCAAGACCACCTTTGTCAAGCGT
CACTTGACTGGTGAATTTGAGAAGAAGTACATGGCCACCCTCGGTGTCGAGGTTCACCCCCTTGGCTTCACCACCAACT
ACGGTCAGATCCAGTTCGATGTGTGGGATACCGCCGGTCAGGAGAAGTTTGGTGGTCTCCGTGATGGTTACTACATCAA
CGGCCAGTGCGGTATCATCATGTTCGATGTGACATCCCGTATCACATACAAGAACGTCCCCAACTGGCATCGTGATCTT
GTCCGCGTTTGCGAGAACATCCCCATCGTCCTGTGCGGTAACAAGGTTGATGTGAAGGAGCGAAAGGTTAAGGCCAAGA
CCATCACCTTCCACCGAAAGAAGAACCTCCAGTACTATGACATCTCCGCAAGTCCAACTACAACTTCGAGAAGCCCTT
CCTGTGGCTGGCCCGCAAGCTGGTTGGCAACCCCGCCCTGGAGTTCGTTGCTGCCCCCGCCCTGGCTCCTCCCACCGCC
CAGGTCGACGAGGCTCTCTTGGAGCAGTACAAGAAGGAGATGGACGAGGCCGCCGCCATGCCTCTTCCTGGTGAGCTGT
CTGACGATGATCTGTAAACGAATCGCACGACGGCGAAAAGTGTTTTATTGATGATGCTGGGACATCCCGGATTACTTGA
GGATTAAGCCATCGGCAGCTGGAATGACCGTTTATGATACAGGAAGGGGATTTCCGGGTTTACATGAGCTCGACTGGAG
AGGGCAAGGATATAATACCCTTGGTACCTCGTTGGGGGTAGATTATCGGGCGCCGCCGCAGGGAGTGCGGCAAAA

> SEQ ID NO: 5850 130864 227355_301027_1b
GGCCCCCATTCCTCCCCCACCCCGGTGTCCTCCCCTCCGCCGCTCGCGTCGCCGCCTTTTTCCCCTATGGCGCTGCCGA
ATCAGGGGACCGTGGATTACCCCAGCTTCAAGCTGGTCATCGTCGGCGATGGCGGGACTGGTAAAACTACATTTGTGAA

FIG. 2 continued

GAGGCATCTCACTGGAGAGTTTGAAAAGAAATATGAGCCAACCATTGGTGTCGAAGTTCACCCTCTAGATTTTACCACC
AACTGTGGTAAGATCCGCTTCTACTGCTGGGACACTGCTGGACAAGAGAAGTTTGGTGGACTTAGGGATGGATACTATA
TCCATGGTCAATGTGCGATAATTATGTTTGATGTCACTTCAAGGCTGACTTACAAGAATGTTCCAACATGGCATAGGGA
CTTGTGCAGGGTGTGTGAAAACATCCCCATTGTCCTGTGTGGTAACAAGGTTGATGTGAAGAACAGGCAGGTTAAAGCC
AAGCAGGTCACATTCCACAGGAAGAAGAATCTCCAGTACTATGAAATTTCTGCCAAGAGCAACTACAACTTTGAGAAGC
CCTTCCTTTATCTTGCAAGGAAGCTTGCTGGTGACCCGAACCTGCATTTCGTTGAAGCTGTTGCTCTTAAACCTCCGGA
AGTTCCCATTGACCTGGCAATGC

> SEQ ID NO: 5851 130864 55727_300141_1b
CGGACGCTGGGACGGCGCTTCATGACTGTTTGGAGACTATTGATGAGACGCTGGACGAGCTCCATGAAACGGTGGAAGA
TCTCCATTTGTATCCAACCAAAAAAACTCTCCGGGAACACGCCGGAGATCTCAAAACACTAATTAGCTCCGCCATTACC
AACCAGGAGACTTGTCTCGCCGCTTCCTTCTTAACACCATCGCCTGAATTCGCTCTCCTCTAGCTCGCGATTGCGAAAA
CATGGCTCTACCTAACCAGCAAACCGTAGATTATCCCAGCTTCAAGCTTGTCATTGTTGGTGATGGAGGCACAGGGAAG
ACTACTTTTGTTAAGAGACATCTTACTGGGGAGTTTGAGAAGAAGTATGAACCTACTATTGGTGTGGAGGTTCATCCTT
TGGATTTCTTCACAAACTGCGGAAAGATCCGTTTTTACTGCTGGGATACTGCTGGACAAGAGAAATTTGGTGGCCTTAG
GGATGGATACTACATCCATGGTCAATGTGCGATAATAATGTTTGACGTCACAGCAAGGCTCACATACAAGAATGTTCCG
ACATGGCATCGTGATCTTTGCAGGGTGTGTGAAAACATCCCGATTGTTCTGTGTGGAAACAAAGTCGATGTGAAGAACA
GGCAAGTGAAGGCAAAGCAAGTCACATTCCACAGGAAGAAGAATCTGCAGTACTATGAGATATCAGCAAAGAGCAACTA
CAACTTTGAGAAGCCTTTCTTGTACCTTGCTAGAAAACTGGCTGGAGACCAAAACCTTCACTTTGTGGAGACACCAGCG
CTTGCTCCACCAGAGGTTCACATTGACATTGCTGATCAGCAGAAGAACGAGGCCGAGCTCTTACAGGCTGCAGATGGAG
AGGCAGAAGAAGAAACAACAGATAGAAGAGGTGGAGAGGATAGTGAGGCTGAAGCAAGCAGAGGAGAGATGTTTCAGT
TAAAAGCAAACGAGGCAAAAGTGGAAGCAGAGAGAGATTGGAAAGGATTGTGAAAGCGAAAAAGGAGAAAAGAGGA
ATACGCAAGTAACTATTTGAAACTGAGGCTGAGCGAGGCGGAGGCAGAGAAAGAGTATCTGTTTGAAAAGATAAAAGAG
CAGGAAAGTGGTGGGAATGGTGGTGAAGCGTCACAAGCAGTGATGTACTCAAAGATCAGAGAAATGCTGCATGGATACA
ATGCATCGTCGCCAAGGGTAGATCCAAGATCAAACCAGCGAAATCCTTTCAGATCCAATCCTTAGATGTTTGTATTGTC
TCTCTTTGTTTGTATTAAAAAAAAAAATCCGAATCAATTAAGGTTGGATTTGTGTGTGAAGTATTGTGGTCTTTGTATTC
AAATTTTGCCCATGAAAAACAAAA

> SEQ ID NO: 5852 130864 1171429_302057_1b
AAATCGAATCGACATTGTTATCGACTTCGATCGCATTTCTGATAGCCTTCTTTGCTTAAGCCATGGCTCTTCCCGGTC
AGCAGCAGGCTGATTGCCCGAACTTCAAGCTTGTTATTGTTGGCGATGGAGGAACAGGAAAGACAACCTTTGTGAAGAG
ACACTTGACAGGAGAATTCGAGAAGAAATACGAACCTACAATTGGAGTGGAAGTTCATCCTCTTGACTTCTTTACCAAC
TGCGGGAAGATCCGCTTTTATTGCTGGGATACTGCTGGCCAGGAGAAATTCGGAGGCCTCCGAGATGGTTACTATATCC
ATGGTCAGTGTGCTATCATTATGTTTGATGTGACATCACGGCTGACCTACAAAAATGTGCCAACCTGGCACAGGGACCT
CTGCAGGGTTTGCGAGAACATTCCGATCGTTCTGTGTGGGAACAAGGTGGATGTGAAGAACAGGCAAGTGAAAGCGAAG
CAGGTTACCTTCCACAGGAAGAAGAATCTCCAGTACTACGAGATCTCAGCCAAAAGCAATTACAACTTTGAGAAGCCAT
ACCTGTACCTTGCTAGGAAATTGGCAGGTGATCCAACTCTTCACTTTGTGGAATCTCCGGCACTTGCACCTCCTGAAGT
ACAAATAGACTTGGCTCAACAGCAACAATA

> SEQ ID NO: 5853 130930 130877_300491_1b
GAATTCAAGGGACTTTACTGATCGAGCCAAAGCCTCAGGAACCAACTAAGCACCAGTATGACTGGGATGCGGCAACTAC
AGCTGCATTTCTACTAAAATATGGACTTTCTGGTGAATTCAAACTCAACATTGAGTGCAACCATGCTACACTTTCTGGT
CACAGCTGCCACCATGAGCTTGAGACCGCCAGAAATTTGGGATGCTTGGAAACATTGATGCAAACACTGGAGATCCTC
AGATTGGATGGGATACTGATCAGTTCCTTACTGACATTGGAGAAGCAACTCTGGTTATGCTCAGCGTTGTCAGGAATGG
AGGACTAGCACCAGGAGGATTCAACTTCGACGCAAAATTACGACGAGAGAGTACCGATGTCGAAGACTTGTTCATCGCT
CATATCTCAGGAATGGATACATTGGCCCGCGGACTTCGAAATGTTGCCAAGCTGCTTGAGGACGGATCACTAACTGAGC
TTGTTCGTAAACGGTATGAGAGCTTCGACACAGAATTGGTGCCCAGATAGAGGCTGGAAAGGCTGATTTTGAAGCACT
TGAGAAGAAGGCAATGGAATGGGGAGAACCAAAGGTTGGCTCTGCAAAACAGGAATTGGCTGAAATGCTTTTCCAATCA
GCACTATAGAAAGTAGCTTATGTTGAGTACAGAGCTCTTCTTTTCCTTTCAATTTTTCAAGAATTTCAGTTTCCAACAT
CAAAGTTTCTCTCTTTCTACAAACGAAGGCATTGCTACATATATAAAATGAAGATTGAGGATATTATTTGGGTTTGGT
GTGCTTAAAATGTGATCACACTTGCAGTTATTGCTAGTAGTCCCCCTACTTGTCCTGCTGATCTTGGAAAGGAATGTGC
CAGTGATGGTGAATGGAAGGGGAATTCTTCCCTGGCATTCCTGAAATCAAGTATGAGGGTCCTTCCAGCAAGAACCCA
CTTTCGTTTAAATGGTACAATGCGGAGGAAGAGATTCTTGGAAAGAAAATGAAGGATTGGATGAGATTTAGTGTTGCCT
TTTGGCACACTTTCCGTGGAACTGGAGGAGACCCTTTTGGTGCACCTACCAAGGTCTGGCCATGGGAAGACGGTACTAA
TTCATTGGCAATGGCCAAAAGAAGAATGAGAGCAAACTTTGAATTTATTCGGAAGCTTGGTGTAGATTTATGGTGCTTT
CATGATAGGGACATTGCCCCAGATGGAAAAACCTTGGAGGAGTCCAATGCGAATTTGGATGAAGTGGTCGCTTTGGCAA
AAGAGCTTCAGGGAAACAAAATCCATCCTTTGTGGGGCACAAATGAGTTGTTCATGCATCCTCGCTACATGCATGGTGC
TGCTACTAGCTCCGATGTAGGTGTCTATGCTTATGCCGCAGCC

FIG. 2 continued

> SEQ ID NO: 5854 131046 124791_300437_1b
TCGCGAGGAAGCAGGGCCTCACGAAGTACTCACCTGTGGAGAGCAAAAAGCTTTTAACCCATCCACTACCCTCCTCTCT
CTCTCTCTCTTCTCTCTCTCCTTGCGCATAAACGAAATCAATGGCCGCACTACAACAAACTCCGACAGCTTTACAGTGC
AGGTCACCGCCGCCGACTCAAATCATCACCGGACCTACGGCGAAGCTCTCATTTTCCGGCGGCCTCAAGCTCCCGAAAC
TCACAATCAAGCTCCGCTCTAATCGCACCTCCCGCCGCGGAGGCGGTGCTGCCGGAGCAAAAATGGTGGCTTCCGCTGC
CGGAAGTTACGCGAACGCACTCGCCGACGTAGCCAAGTCGAATGGAACCCTAGAACAAACCACCGCCGACCTCGAAAAA
ATCGAAAAAATCTTCGACGACGAAGCAGTGTACAACTTCTTCGTGAGCCCTATCGTCGGAGAAGAGAAGAAACGCGAAC
TCGTGGACGAGATCGTTTCATCCTCGAGCATCCAGCCGCACGTGGCGAATTTCCTCAACATTCTGGTAGACATGAAGCG
CGTGGAGCTAATCAAAGAAATCGTGAAGGAGTTCGAGAAAGTCTACAATACACTTACGGACACGGAACTTGCTGTGGTC
ACTTCTGTTGTGAAATTGGAATCGCAGCATTTGGCGCAGATAGCGAAAGGAGTGCAGCGATTGACAGGTTCGAAAAACG
TGAGAATTAAAACGGCTATCGATGAATCGCTAGTAGCTGGGT

> SEQ ID NO: 5855 131046 271667_200036_1b
TCTCTCTCTCTCTCCTAGCGCATAAACGAGATCAATGGCGGCACTACAACAAACTCCGATTGCTTTCCAGTCCAGATCA
CCCCCGACAACTCAAATCATCAGCGGACCGACGGCGAAGCTCTCCTTTTCCGGCGGCCTCAAGCTCCCGAAACTCACCA
TCAAGCTCCGCTGTAATCGCACCTCGCGCCGCGGCGGCGGTGCTGCCGGAGCAAAAATGGTGGCTTCCGCTGCCGGAAG
TTACGCGAACGCACTCGCCGACGTAGCCAAGTCGAACGGAACTCTAGAACAAACCGTCGCCGACCTCGAAAAAATCGAA
AAAATCTTCGACGACGAAGCAGTGTACAACTTCTTCGTGAGCCCTATCGTCGGCGAAGAGAAGAAACGCGAACTCGTGG
ACGAGATCGTTTCATCCTCGAGCATCCAGCCGCACGTGGCGAATTTCCTGAACATTTTAGTAGACATGAAGCGAGTGGA
GCTAATCAAAGAAATTGTAAAAGAGTTCGAGAAAGTATACAATACGATTACGGACACGGAACTTGCTGTGGTCACTTCT
GTTGTGAAATTGGAATCGCAGCATTTGGCGCAGATAGCGAAAGGAGTGCAGCGATTGACAGGTTCGAAAAATGTGAGGA
TTAAAACGGCTATTGATGAATCGCTAGTAGCTGGATTTACAATAAGGTACGGAAATTCAGGATCAAAGTTGATTGATAT
GAGTGTGAAGAAACAACTTGAGGATATTGCTGCTCAACTTGAAATTGGGGATATTCAATTAGCTGTATAATTGTTCTGT
TTTTAAAATTATATTTTTTTTCAGGGATTTATTTTTGTAATATAATTTGCTTCAAAGGC

> SEQ ID NO: 5856 131046 56703_300142_1b
TCTCTTCAACGAACTCTATTCTCTCTTCAATCCAAACTCCCACCATCCTCCTTCCAAATCGCCAGATCTCTCCCACTCC
GAAAAACCTTTCCAATCCGAATCAACAACGGTGGAAACGCCGCCGGAGCAAGAATGTCAGCCACCGCAGCATCAAGCTA
CGCGATGGCATTAGCAGACGTCGCGAAAAGAAACGACACAATGGAATTAACAGTCACAGACATCGAGAAGCTCGAACAA
GTCTTCTCAGATACACAAGTACTAAACTTCTTCGCGAATCCAACAATCACCGTCGAGAAGAAACGTCAAGTCATCGACG
ACATAGTGAAATCGTCGTCTCTTCAATCTCACACATCTAACTTTCTCAACGTCCTCGTCGACGCGAATCGGATCAATAT
CGTGAC

> SEQ ID NO: 5857 131046 230340_301056_1b
TTACTCACCACGCGTCGATCTAAGTGTTTGATCGATCGACACTCAAGCAATGGATTTGCTCCAAGGCTCGTCTTCCTCG
GCAGTGGCAGCGGCAACGCATCGCGCCGCAAGCATCGCCGCCACTCGCGCCAGAGCCGCGACGCTGTCGAGCTCGTCCC
GGATCTGCTGGAACGCTCTGGCGGCCAGAGCTCCCGAGGTAAGACCACAACACAGCAGCAGCAGCAGGGGGTGGTGGT
GATGGGTGTGGAGGAATCGTATGCCTCGGCGCTGGCCGAACCTGGCCAAATCCAAGGACTTGCTCGACACCATCTACTCC
GACACCGAGAAGCTGGCCAAGTACTTCGACAACCCAAAGGTGGCCAAGTTCTTGGCCAACCCGGTGGCGGAGGTGGCGC
GAAGGAAGTCACTGATCAAGGCCATAGCTGACGAGGAGAAGCTCCACGCATACACCACCAATCTCCTCTACGTGCTGGT
GGACAAGAGGCGAGTGGGCATTGCCAAGGACGTCTTCCAGGCGTACGAGACGAGCTACTACAAGCTGACCGACACCGAG
ATCGCCGTGGTCACCTCCGCGGTGAAGATCGAGGACTCGCAGCTGGCGGAGATCGCCAAGAAAATCCGGAGCTTGTCCA
AGGCGAAGAACGTCAAGATCAAGAATGAGGTGGATGCGTCGGTCATTGCCGGATTCA

> SEQ ID NO: 5858 131104 189611_300607_1b
GAATTCCAGCTGACCACCATGGATATAAACTCAAATGCCTCGTCATCTAATTAGTGACGCGCATGAATGGATTAACGAG
ATTCCCACTGTCCCTATCTACTATCTAGCGAAACCACAGCCAAGGGAACGGGCTTGGCAGAATCAGCGGGGAAAGAAGA
CTGAACAAACTACTTAACATGGCAATTCCCGGGGATC

> SEQ ID NO: 5859 131104 182388_300660_1b
TCAAAGCATTGCGGTGGTCCCTGCGGATGCTAACGCAATGTGATATCTGCCCAGTGCTCTGAATGTCAAAGTGAAGAAG
GGCAACCAAGCGCGGGTAAACGGCGGGAGTAACTATGACTCTCTTAAGGTAGCCAAATGCCTCGTCATCTAATTAGTGA
CGCGCATGAATGGATTAACGAGATTCCCACTGTCCCTGTCTACTATCCAGCGAAACCACAGCCAAGGGAACGGGCTTGG
CAGAATCAGCGGGGAAAGAAGACCCTGTTGAGCTTGACTCTAGTCCGACTTTGTGAAATGACTTGAGAGGTGTAGGATA
AGTGGGAGCCGTCTTTGGCGGCGAAGGTGAAATACCACTACTTTGAACGTTATATTACTTATTCCGTGAGGCGGAAGCG
GGGCATCGCCCCTCTTTTTAGATCCAAGGCTAGCTTGCTATGCCGATCCGGGCGGAAGACATTGTCAGGTTTCACCCCA
CCAGAGTGGGACCCAAACACACCATCTCCAATCTTCGGAGGTAGTACTGGTGGATTGTCGCGTAAAGCTCAAGTAGAG

FIG. 2 continued

> SEQ ID NO: 5860 131104 8112_300316_1b
CGAGAACAGAAATCTCGTGTGGAACAAAAGGGTAAAAGCTCGTTTGATTCTGATTTTCAGTACGAATACGAACCGTGAA
AGCGTGGCCTATCGATCCTTT

> SEQ ID NO: 5861 131104 130526_300488_1b
GAATTCAGGTAGAAGGCCCACGGGTCATGAACTTGGTTTTCCCGGAGAAGAAGCAATGACGGTATCTGGGGAATAAGCA
TCGGCTAACTCTGTGCCAGCAGCCGCGGTAAGACAGAGGATGCAAGCGTTATCCGGAATGATTGGGCGTAAAGCGTCTG
TAGGTGGCTTTTCAAGTCCGCTGTCAAATCCCAGGGCTCAACCCTGGACAGGCGGTGGAAACTACCAAGCTGGAGTACG
GTAGGGGCAGAGGGAATTTCCGGTGGAGCGGTGAAATGCGTAGAGATCGGAAAGAAGACCCTGTTGAGCTTGACTCTAG
TCCGACTTTGTGAAATGACTTGAGAGGTGTAGGATAAGTGGGAGCCGTCTTTGGCGGCGAAGGTGAAATACCACTACTT
TTAACGTTATTTTACTTATTCCGTGAGGCGGAAGCGGGGCATCGCCCCTCTTTTTAGATCCAAGGCCTCAGCTGCTGAA
GGAAAGACAGAAGCTCCAGCGAAAGAAGCCCCAGCAGGTTTCACCCCACCAGAATTGGACCCAAACACACCATCTCCAA
TATTCGGAGGTAGTACTGGTGGATTGTTGCGTAAAGCTCAAGTAGAGGAGTTTTACGTGATCACTTGGGATTCTCCTAA

> SEQ ID NO: 5862 131104 134777_300418_1b
GCCCCTGAACAGACTTCCCCACCTGACAATGTCTTCCGCCCGGATCGGCCCGAGGGACTCGGGCCTTAGAGCCAAAAGG
AGGGGCCAGGCCCCGCTTCCGACTCACGGAATAAGTAAAATAACGTTAAAAGTAGTGGTATTTCACTTGCGCCCGAGGG
CTCCCACTTATCCTACACCTCTCAAGTCATTTCACAAAGTCGGACTAGAGTCAAGCTCAACAGGGTCTTCTTTCCCCGC
TGATTCCGCCAAGCCCGTTCCCTTGGCTGTGGTTTCGCTGGATAGTAGACAGGGACAGTGGGAATCTCGTTAATCATT
CATGCGCGTCACTAATTAGATGACGAGGCATTTGGCTACCTTAAGAGAGTCATAGTTACTCCCGCCGTTTACCCGCGCT
TGGTTGAATTTCTTCACTTTGACATTCAGAGCACTGGGCAGAAATCACATTGCGTCAGCATCCGCGAGGACCATCGCAA
TGCTTTGTTTTAATTAAACAGTCGGATTCCCCTTGTCCGTACCAGTTCTGAGTCGGCTGTTCGACGCCCGGGGAAGGCC
CCCGAGGGGGCCGTTCCCGGTCCGTCCCCGGCCGGCACGCGGCGGCCCGCTCTCGCCGCGCGAGCAGCTCGAGCAGTC
CGCCGGCAGCCGACGGGTTCGGGGCCGGGACCCCGAGCCCAGCCCTCAGAGCCAATCCTTTTCCCGAAGTTACGGATC
CGTTTTGCCGACTTCCCTTGCCTACATTGTTCCATTGGCCAGAGGCTGTTCACCTTGGAGACCTGATGCGGTTATGAGT
ACGACCGGGCGTGGACGGTACTCGGTCCTCCGGATTTTCAAGGGCCGCCGGGGCGCACCGGACACCGCGCGACGTGCG
GTGCTCTTCCGGCCGCTGGACCCTACCTCCGGCTGAACCGTTTCCAGGGTTGGCGGCCGTTAAGCAGAAAAGATAACT
CTTCCCGAGGCCCCCGCCGGCGTCTCCGGACTTCCTAACGTCGCCGTCAACCGCCACGTCCCGGCTCGGGAAATCTTAA
CCCGATTCCCTTTCGGGGCACGCGCGTGGTCGCGCTCTCTGCCGGGGTTACCC

> SEQ ID NO: 5863 131281 247585_301621_1b
TTCCATTGCTTTAATCAGGATCGCGGAGGCGGAGGAAGAAAGAGTAGCGGCGATGGATGCCAACGGCGTGGTGGCCGTG
TACGGCAACGGCGCCATAGCGGAGCCCAAGAAGGCGTCATACGCGGTCAAGGTCGGTCTCGCCCAGATGCTCCGCGGCG
GCGTCATCATGGACGTGGTCAACGCCGAGCAGGCCCGCATCGCCGAGGAGGCCGGCGCGGTGGCGGTCATGGCCCTGGA
GCGCGTCCCGGCGGACATCCGCGCCCAGGGTGGCGTCGCACGGATGAGCGACCCGGGCATGATCAAGGACATCAAGAAG
GCGGTCACCATTCCGGTCATGGCAAAAGCCCGCATTGGGCATTTTGTCGAGGGGCAGGTGCTCGAGTCCATCGGCGTCG
ACTTCGTGGACGAGTCCGAGGTGCTCACCCCCGCCGACGACGCCAACCACATCAACAAGCACAACTTCCACGTCCCGTT
CGTGTGCGGCTGCCGCAACCTGGGCGAGGCGCTGCGGCGGATCACCGAGGGCGCGGTCATGATCCGGACCCAAGGGCGC
ACGCGGCACCGGGAACGTGATCGAGGCGGTGCGCCACGTCCGGTCGCTCATGGGGGACATCCGGCGGCTGCGCAGCCTG
GACGAGGACGAGGTG

> SEQ ID NO: 5864 131281 182915_300664_1b
TGTACTAACAGTATATGGAAATGGAGCAATAACAGAGGCAAAAACCTCACCATTCTCTGTTAAAGTACGATTACCACAG
ATGCTTAGAGGAGGAGTAATCATGGATGTTGTTAATGCAGAACAAGCCAGAATCGCTGAAGAATCAGGTGCTTGTGCTG
TCATGGCATTAGAACGTGTACCAGCAGATATTCGTGCTCAAGGTGGTGTTGCTCGTATGAGTGATCCACAGATGATTAA
AGAAATCAAACAGGCTGTTACTATTCCTGTCATGGCTAAAGCTCGGATTGCTTTGTTGAAGCTCAGATTCTCGAA
GCAATTGGTGTTGATTATATCGATGAGAGTGAGGTTTTGACCCTTGCTGATGAAGAACATCATATTAACAAGCATAATT
TCAGGATTCCATTTGTTTGTGGTTGTCGTAATCTTGGTGAAGCCCTAAGGAGGATTCGGGAAGGTGCGGCTATGATTCG
AACAAAGGGTGAAGCTGGAACTGGTAATGTTGTTGAAGCTGTTAGGCATGTGAGGTCTGTCATGGGTGATATGAGGCTT
GTGCGTAATATGGATGATGATGAGGTGTGTTCATAT

> SEQ ID NO: 5865 131313 168321_300555_1b
GAATTCGAAAACAAAAACAACAATGGCTTCAACAGCTTCACACACTACTCTATCTCTACTCAGAACAACAGCATCATCT
TCATCTGCTCGCAACAACCGTGTATCATCAACATTACAAGTTGCAGCAGCATCTCGATTGAGAAACATCGGATTACAAG
TTAGAAACCCAAAAGTCTTGGGTTTTCTGGTGTTGCAGTAGATCCTCTTCTTTCATCACACGTTTCTTCACAAATTGG
AGCTGTTAATGGTAAAGGGGTGAGAGGTGTTGTTTCAATGGCTAAGAAAAGTGTTGGGGATTTGAGTGCATCTGAATTG
AAAGGTAAAAGGGTTTTTGTTAGGGCTGATTTGAATGTCCCGTTGGATGACAATCAGAACATTACTGATGATACTAGAA
TCCGTGCTGCTATTCCAACTATCAAACATTTGATGGCCAATGGTGCTAAAGTCATTCTTACCAGTCATTTGGGAAGACC

FIG. 2 continued

AAAGGGTGTTACTCCAAAATTCAGCTTGGCCCCTCTTGTCCCTAGGCTCTCCGAGCTTCTTGGCATCACTGTTGAGAAA
GCTGATGATTGTATTGGCCCTGACGTTGAGAAATTGGTTGCTGCACTACCAGAAGGTGGTGTTCTCCTTCTTGAAAATG
TGAGATTCTACAAAGAGGAAGAGAAGAACGAACCAGAATTCGCAAAGAAACTTGCTTCCCTCGCAGACCTATATGTCAA
CGATGCCTTTGGAACAGCACACAGAGCTCATGCTTCAACTGAGGGAGTTACCAAATACTTAAAGCCATCTGTTGCTGGT
TTCCTCTTGCAGAAGGAACTGGACTATCTTGTTGGGGCAGTTTCATCCCCAAAGAGACCATTTGCTGCCATCGTTGGTG
GTTCCAAGGTGTCATCTAAGATTGGTGTGATTGAGTCGTTGCTAGAGAAGTGTGATATTCTACTTTTGGGTGGAGGTAT
GATCTTCACATTCTACAAGGCACAGGGGCTATCAGTAGGTTCTTCTCTTGTGGAGGAAGACAAGCTTGAACTTGCAACC
TCCCTCCTTGAGAAGGCCAAGGCAAAGGGTGTGTCACTTTTGTTACCCAGTGACGTAGTTATTGCCGATAAATTTGCTG
CTGATGCAAACAGCAAGATTGTACCCGCATCTGAGATCCCAGATGGTTGGATGGGATTGGATATTGGCCCAGATTCTAT
CAAGACATTCAATGATGCCTTGGACACCACCAAGACCGTTATCTGGAATGGACCTATGGGAGTTTTTGAAAT

> SEQ ID NO: 5866 131313 225349_300986_1b
TTAGTAGTAGACGGCCGCCATTCTTCCTCTTCGGTTCTATCGATCGATCGATCCATCAGCCATGGCCGCCGCAACAGCC
GCCGCATCGTCGCAGCTCCTCTCGCCGGCGGCGTCGCTGGGCTCGGCGGCGTCGCCGTCGTCGTCGTCGCCTTCCG
GCAATCGCGCCGGGTTCAGGTCATTGGGGAGGCAATGCTTCGCGGGACTCGTCGCGGGGCGCCGGGAGGTGCGGCGGCT
GGGGGGATTTCGAGCGGCAGCAGCCGGATTTCGCGGCGGCAGTGGCGGCGGCGGTGAGGTCGTCGGGGGGCAATGGGCGC
GGCAGCCGCGGCGTGGTGTGCATGGCCAAGAAGAGTGTGGGGGATCTCAAGGAGGCGGACTTGAAAGGCAAGCGTGTCT
TTGTCAGGGCTGATCTCAACGTTCCACTGGATGCCGATCTAAACATCACCGACGATACGAGGATTCGTGCTGCCGTGCC
GACGATCCAGTATCTCATTGGCAATGGGGCTAAGGTCATCCTCAGCAGCCATCTGGGGCGTCCCAAAGGAGTGACCGAG
AAGTATCGACTTACACCTCTTGTTGGAAGGCTCTCAGAGCTCTTGGGAACCAAGGTTGAGAAGGCTGACGATTCCATTG
GTCCCGAAGTCGAGAAGAAAGTTGCTGCTTTGCCCGATGGTGGACTGCTACTTCTCGAGAATCTGAGGTTTTATCCTGA
CGAGG

> SEQ ID NO: 5867 131313 237312_301286_1b
GACGATGGCATCGGTGAAGAAAAGCGTGGGCGATCTCACGGAAGGCGACCTCAAGGTGCAAGCGCGTCTTCCTGCGGGC
CGATCTCAACGTCCCCTTGGATGCGGAGTTCAACATCACCGACGATACGAGGCTCCGAGCCGCGGTGCCAACGATCCAG
CACCTCCGCCGCTACGGAGCCAAGATTATCCTCGCCAGCCACCTTGGGCTGACCAAAGGGATACACCAAGAGCTGCCGC
CTTGCTCCTCTGGTAGGAAAGCTTACGGAGCTGCTCAGTGTCAAGGTAGACAACAAGAAAATCCGGTGCTTTTCGTGCT
AATGACGCTGCTGAAAAGGTTGACATCGCCGATTGATTCCGTGGGTCCTGAAGTGGAGGCAAAGATCGCTGCTCTCGGC
GATGGCGACGTGCTGCTGCTGGAGAATCTGCGGTTCTATCCGGAGGAGGAGAAGAACGACGCGGGGCATGCAAAAAAGC
TGGCGGCGCTGGCGGATCTCTATGTCAACGATGCGTTTGGCACCGCTCACCGGGCGCATGCTTCCACCGAAGGGATTAC
AAAGTACTTGAAGCCTTCTGTGGCTGGATTTCTCATGCAAAAGGAACTTGACTACTTGGTCGGGGCAGTCTCGGAACCA
AAGCGGCCTTTCGCGGCCATTGTCGGCGGCTCAAAAGTCTCGTCCAAGATCGG

> SEQ ID NO: 5868 131313 104214_300060_1b
CTTCACTCTGTCTTCACACTCTCTGCTTTTGCCGTAGGACAGAATCGTCGAGTTTAGTGACGAAGACTGTAATCAATGG
CATCAGCTACAGCTTCTCACACTTTGTGCGGCATCCCCGCCACCTCATCCTCTACTACCAACAAGTCTATTGCCCCTTC
ATCTGCTCGCTTCCTCTCTAAAACTCCTCTCCGCCGCCTCGGCTTCGCTGGCGCCGCCGCTGATTCTCTCTTCACCAAC
CACGTGGCAACCAAGCTCCGATCCCTCAAGAGCTCCTCCAAGCCTCGTTAGGGGCGTTGCTTCTATGGCCAAGAAAAGCG
TCGGAGACCTCACCGCTGCCGAGTTGAAGGGCAAGAAAGTCTTCGTCAGGGCCGATTTGAATGTCCCACTTGATGATAG
CCAGAACATTACTGATGACACTAGAATTAGAGCTGCCGTCCCTACTATCAAGCACTTGATGGCCAATGGTGCTAAAGTT
ATTCTCTCCAGTCACTTGGGACGGCCAAAAGGAGTCACTCCTAAATACAGCTTGGCACCCCTAGTCCCCAGGCTATCCG
AACTGCTTGGAATCCAGGTTGTGAAGGCTGAGGACTGCATTGGTCCGGAAGTCGAGAAGTTGGTTGCTTCACTTCCCGA
GGGTGGTGTTCTTCTTCTCGAGAACGTGAGATTCTACAAGGAGGAAGAGAAGAACGAACCTGAGTTTGCAAAGAAACTT
GCATCATTGGCAGATCTTTACGTAAACGATGCATTTGGTACAGCTCACAGAGCACATGCCTCTACAGAGGGAGTTACTA
AATTTTTGAAGCCTTCTGTTGCAGGTTTCCTCTTACAAAAGGAATTGGACTATTTAGTCGGGGCAGTTTCAAATCCAAA
GAGGCCATTTGCTGCTATTGTGGGTGGTTCAAAAGTTTCATCCAAGATTGGAGTGATCGAATCACTTTTAGAGAAATGT
GATATATTGCTTTTGGGTGGAGGAATGATCTTTACCTTCTACAAGGCTCAGGGTCTTCAGTTGGTTCCTCCTTGGTTG
AGGAAGACAAACTAGAACTCGCTACATCACTCCTAGAAGGCCAAGGAGAAAGGAGTCAGTCTCTTGTTACCATCTGA
TGTTGTGATTGCAGATAAATTTGCTCCTGATGCAAACAGCAAGATTGTGCCGTCATCTGCTATCCCAGACGGTTGGATG
GGGTTGGACATTGGACCAGACTCTGTCAAGACTTTCAATGATGCCTTGGATACCACAAAGACAGTGATCTGGAATGGAC
CTATGGGGGTGTTTGAATTTGACAAGTTTGCTGTTGGAACAGAGGCAATTGCAAAGAAGCTCGCGGACTTAAGTGGGGA
AGGAGTGACGACTATCATTGGAGGTGGAGATTCTGTTGCAGCTGTTG

> SEQ ID NO: 5869 131313 143314_200009_1b
ATTTATACGATCCTCGATCCTTCCAATTAGTCACAGACATCGTTCCGTTCATCGTATCGATTTTCCGACGGAAAAAAC
TATAGAGAAATGGCGGTGAAGAAGAGTGTGGGATCACTGAAAGAAGCAGATCTGAAGGGGAAGAGAGTATTCGTGAGAG
TTGATCTGAACGTTCCATTGGATGACAACTTTAACATCACTGATGACACCAGAATCATAGCCGCTGTACCTACCGTTAA

FIG. 2 continued

GTACTTGATGCAACACGGTGCTCATGTCATTCTTGCCTCTCATCTTGGTCGCCCTAAAGGTGTTACTCCAAAGTACAGC
TTAAAGCCGCTTGTGCCTAGACTATCAGAACTATTGGGAGTTGAGGTCAAGATAGCAAATGATTCAATTGGTCCAGAAG
TTGAGAAATTGGTCGCTGAAATACCAGAAGGAGGAGTTCTGTTGCTGGAGAATGTCAGATTCTATAAAGAAGAGGAGAA
GAATGAGCCCGAATTTGCCAAGAAATTTGGCATCTCTTGCAGATTTGTACGTCAATGATGCATTTGGGACTGCTCATAGA
GCCCATGCTTCCACAGAAGGGGTGGCTAAGTACTTGAAACCAGCTGTTGCGGGATTTCTTATGCAAAAGGAACTTGACT
ATTTAGTAGGAGCTGTGGCAAATCCCCAGAAGCCATTTGCTGCCATTGTTGGTGGTTCAAAAGTATCATCTAAGATTGG
TGTTATAGAGTCTCTCTTGGAGAAGGTTGACGTGTTATTACTTGGCGGAGGAATGATCTTTACTTTCTACAAGGCGCAA
GGGTACGCTGTTGGATCATCACTAGTGGAGGAGGACAAGCTTGATTTGGCAACATCTCTCATGGAGAAGGCAAAGGCAA
AAGGGGTATCTCTATTGCTTCCCACTGATGTAGTGATTGCCGACAAGTTTGCTGCTGATGCGAACAGTAAGGTTGTTCC
AGCATCTGAAATTCCTGATGGCTGGATGGGATTGGATATCGGACCTGATGCAATCAAGTCATTTGGCAGCGCCTTGGAT
ACCACCAAGACTGTCATTTGGAATGGACCAATGGGTGTGTTTGAGTTTGACAAGTTTGCTGCTGGAACAGAGGCTATTG
CAAAGAAACTGGCAGAGCTTAGTGGAAAGGGAGTGACAACCATCATAGGGGGTGGTGATTCTGTAGCTGCAGTTGA

> SEQ ID NO: 5870 131361 130110_300485_1b
GAATTCTAAATCAATTGATTTACCGAAGAACGTGAGAATAATTTTAATTTAATCGATTCATCAATATTTTCTAAGTTGT
AATATCTTCAATGGCTACAATTGGGAACAACAATCTTAATGCGAAACTTGTTTTGCTTGGTGATATGGGAGCAGGTAAA
TCAAGTCTTGTTTTGCGATTCTTCAAAGGTCAATTTCTCGAGTTTCAGGAATCAACAATTGGAGCAGCGTTTTTCTCAC
AGACGTTGGCCGTGAATGATGCGACTGTTAAATTTGAGATTTGGGATACCGCTGGTCAGGAGAGATATCATAACTTGGC
TCCTATGTACTACACAGGAGCTGCTGCTGCAATAATTGTTTACGACATAACTAGCACGGAGTCTTTCACGCGTGCAAAG
AAGTGGGTGCAAGAACTACAGAAACAAGGTAATCCCAACATGGTTATGGCACTTGCTGGAAATAAAGCCGACTTATAAG
AAAAAAGGAAAGTGACAGCTGAGGAAGCACGTGTGTATGCTGAATAGAATGGTCTTTTCTTCATGGAGACCTCTGCAAA
GACTGCTATCAACGTCAACGACATATTCTATGAAAT

> SEQ ID NO: 5871 131361 119219_300018_1b
TTTTTTTTTTTTGTGGAGAAAGAAAAAAGCAGCAACTTATTTAAAGAGAATCAAAGTCAAGGGGAACCATAGTACGACT
GCATTACAACTCTCACTATCCCATCTTAAAAACCAACTTATACTGCCTGAAACAACAGAAACCAACATTGCAACTTTGG
ACCCCAGTTAAAAAAAATATCAAAGAGGAAAGAAAAATCCTAAGGAGTAACCCTTATGATTTGTACAGGCCACCAGAAT
ACTGGCAGATTAAAAAGAATATATCTGGCACAATACAACCAGGAGAAGGCCTGAAAAGTGATTCTAACTAGAACAGCAA
CCACTCTTCTGGGAAACAGGTCGACCTCGTATCTGGACCTGTTGGAGGCTTTGCATTATTCGATGCTGGCTGGCTTGCCA
TCCTATTCTTTATGTCAGCTGCCATTGCCATGAAGGCCTGCTCAACATAAGTGGCATTCTTTGCACTAGTCTCCATGAA
TGGAATACCAATTTCATCAGCAAAAGCCTTTGCTGTATCATAAGACACAGCACGGTTGTCAGCCAGGTCACACTTATTC
CCAACCAGAAGCTTGTTTACATTGTCACTTGCATAACGATCAATCTCACTCAACCATTGCTTAACATTGTTAAAGCTTT
CTTGGTCAGTTACATCATAAACTATCTGCCAGAATCACCAAAATAGTGGTTGGAGGAACTATTTTACAGAGCCAGAAAG
ACCAAATCCACCTGTTAATAGTTCTAAAAAGGAGAGAAGAGAAACCTACAATGATGCCATGTGCCCCACGGTAGTAACT
ACTGGTAATCGTCCTGAAGCGTT

> SEQ ID NO: 5872 131361 241125_301320_1b
TTATGTGGATCGATTCGTGAGCTACTTACTAGGCGAGAATCAAATGGCACTGTCTTCCTCCTCCGTCAGCGGCAACGAG
TTTGATCACCTCTTCAAGATACTGCTCGTCGGGGACTCGGGTGTCGGCAAGAGCAGCCTGTTGCTGCGATTCACCGCCG
ACACTTTCGACGATCTCTCCCCCACAATCGGTGTGGATTTCAAGCTCAAGCTTATGACGCTGGAAGGCAAGAGGCTCAA
GCTCACCATCTGGGACACAGCCGGGCAGGAAAGGTTTAGAACGCTTACGAGCTCGTACTACCGAGGGGCACAAGGCGTC
ATTCTTGTTTACGATGTTACAAGAAGAGATACGTTCACGAATCTCTCGGAAGTTTGGCTCAAGGAGGTCGAGCTCTACT
CCACCAACCAGGACTGCGTCAAGCTCTTGGTGGGGAACAAAGTCGACAGGGATTCCGAGCGTGCGGTGACGAAGCACGA
AGGCATGGCTTTCGCCCGGAAGTATGGCTGCCTGTTCCTGGAGAGCAGTGCCAAGACGAAGATCAACGTCCAACAATGC
TTTGAAGAGCTGGTCAGGAAGATTCTGGAAACTCCCAGCTTGGTAGCCGAGGCCAAGTCGGTGAAGAAAACATCATCA
GACCAAGCAACGATGAGGAGCCGCCTGCAGCTGGCGATAACTCTGGTAGCTGCGCGTGTTGATAGAGAG

> SEQ ID NO: 5873 131361 242554_301330_1b
CTCAGTCGTGTCTTGTCACTTAATTATCTCGACCACGCGTCGGGTGGATCTGGGAGATCTAGCTCGCGAATTGGTCGCG
CGATCCGCGTAGATAGATCTGGAGCTGCTCCTTGGATGTGGAATGCCGTGGTCCAAGCTTTTGGGGAATAGGTCGTGAG
CGGCAGCGCGGCAAAATAGGTCTTGATCGAGAGTGATTTGCGAGAAATGGGTGTGCCAACCGCGACGGTGTCGCCGCTC
GCCAAGTACAAGCTTGTGTTCTTGGGCGATCAATCGGTGGGAAGACGAGCATCATCACGCGTTTCATGTATGATAAGT
TTGACAACACGTACCAGGCAACCATTGGGATCGACTTCTTGTCGAAGACCATGTACCTGGAAGATCGCACTGTTCGCTT
ACAGCTCTGGGATACTGCTGGCCAGGAACGTTTTCGCAGCCTAATTCCCAGCTACATACGGGATTCGTCCGTGGCGGTG
GTCGTGTACGATGTTGCGAATCGCCAGTCGTTCCTAAACACGGCCAGATGGGTGGAAGAAGTCCGCACCGAGCGTGGTA
GCGATGTGATCATCGTTCTCGTCGGGAACAAGACCGACTTGGTTGACAAAAGGCAAGTCTCGATCGAGGAGGGGATGC
CAAAGCCCGGGAATTTGGAGTCATGTACATCGAAACCAGTGCCAAGGCCGGATTCAACATCAAGGCTCTCTTCAGAAAA
ATCGCTGCCGCA

FIG. 2 continued

> SEQ ID NO: 5874 131361 254328_301632_1b
GAACTGTCAAGCCTCTGCCTGCTCTCACCAGATCTGAAGATTTCCGTCTTACCTTCATTATGAATCCTGAATATGACTA
CCTTTTCAAGATTTTATTGGTTGGTGACTCTGGTGTGGGGAAATCATGTCTCCTCCTCCGATTTGCGGATGATAATTAT
GTGGAGAGCTATATAAGCACCATTGGTGTGGATTTTAAAATCCGAACTGTGGAACTCGATGGAAAGACTCTGAAACTTC
AGATTTGGGATACAGCAGGGCAGGAGCGCTTCCGAACCATTACTAGCAGCTACTACAGAGGAGCGCATGGCATTATTAT
TGTTTATGATGTGACAAACCAGGCAAGCTTCAATAACGTGAAGAGATGGTTGAATGAGATACAGCGATATGCAAGTGAC
AGTGTGAACAAATTGTTGGTAGGGAATAAGTGCGATATGACCGAAAAGAAAGCCGTAGATACCGAAACGGCAAAGGCAT
TTGCTGATGAGATNGGCATTCCATTTCTGGAAACAAGTGCAAAGAGCGCGACAAATGTTCAAGAGGCTTTCATCACAAT
GGCGACTGAGATAATGAAAAGGATGGCAAGTCAACCCTCAGTAACTAGTACAAAGCCCAAATTTGTCCAGATTCAAGGG
AAACCGGTTAACCAAAAAAGAGGCTGCTGCTCTTAATGCAA

> SEQ ID NO: 5875 131361 252756_301604_1b
GAGAGAGAGAGAAAGGGAGAAAGAGAGATGCACCGTCTTTCCTTCGACAAAGCACTCTAGATCTGTGTTTTAGGCAGAGAG
AGACAAAGAGAGAGAGAGAGAAAAACCAGCGACCCTTTCGAAATCCGTTGATTCCTTAAGCGGGGGCCCGGGGGCAGGT
TGCGGGGTAACTGATACTTGCTATCAGGGTTTCTTCGGAACGGCGGGGTGGAAGCATGTCCTACCGATCGGAAGATGAA
TATGATTACCTTTTCAAGGTGGTCTTGATTGGGGACTCCGGGGTCGGGAAGTCCAACCTCCTCTCCCGATTTACAAGGA
ATGAGTTTAGCCTTGAGTCCAAGTCGACAATTGGCGTGGAGTTCGCCACGCGGAGCATCAGCGTGGATGGGAAGATGAT
CAAGGCACAGATTTGGGACACCGCCGGACAAGAAAGGTACAGGGCCATCACAAGTGCCTACTACCGTGGAGCAGTGGGA
GCTCTGTTGGTTTATGACCTCACCCGGCAGGTGACATTCAGTAATGTACCTCGATGGCTGAAGGAGCTGAGGGACCACA
CAGACTCCTCGGTGGTGGTGATGCTGGTGGGGGAAC

> SEQ ID NO: 5876 131361 247978_301578_1b
GAGCAAGGCCTCCAGAGGAGAGAGATATATAGTAGAGAGAGCGCTGGTGTGATTAGATCGCCATAGCCGGATCGAGTGA
TTGGGATGAGGAATTCATAGTTTTTCTTCCGGGAGAGCAGGTTTTGGCAGCGCAATGAAGCCTGGAGGATCTCCTTTCA
AAGTTGTTCTTCTGGGAGACGGTAGAGTCGGGAAGACTTCTCTCGTCCTGCGGTACGTGAATAATCACTTCTCCGATAG
TCAAAGTGCTACGATACAGGCTTCCTACTTGACCAAGCGCTTGAGCGTCGATGGCACTGTGGCAACGCTATCAATATGG
GATACAGCAGGCCAGGAACGCTTCCATGCATTAGGTCCGATCTACTACAGGGACGCTGATGCTGCATTGCTTGTCTATG
ACATTATGGATAAAGATAGCTTTACTCGTGTGAAGAATTGGGTAAAGGAGCTGCGGAAGATGGCATCCAACAAGCACAT
CGTCCTGACGATCGCTGGAAACAAGAGTGATATGGACAAGCTGCGGCAAGTTGATCTCCAGGACTCTGAGAGATACGCT
GCGTCGATTGGAGCAAACCATTTCGTCACCTCTGCGAAGCTAAACAGTGGGATAGACGACGCTTTCATGGACATAGCTA
CACGTTGCATGGAACAGAGAAGAAAGGCTGCTGCGGACTCTAGCAATGGCAGCGTGC

> SEQ ID NO: 5877 131361 38533_300201_1b
CCCACGCGTCCGCTCTGGCTCTGTATCGCTCGCTGCTCTTCCTCCCACAGATCGAAAACCATGAATCCTGAGTACGACT
ATCTTTTCAAGCTCCTGCTTATCGGGGATTCTGGCGTAGGCAAGTCTTGTCTTCTTTTGAGATTCTCTGATGATTCTTA
TGTAGAAAGTTACATTAGCACTATTGGAGTCGATTTTAAAATTAGGACTGTGGAACAAGATGGCAAACAATTAAGCTC
CAAATTTGGGACACTGCTGGTCAAGAACGGTTCAGGACTATTACTAGCAGTTACTACCGTGGGGCACATGGAATTATTA
TTGTCTACGATGTCACAGATGAAG

> SEQ ID NO: 5878 131361 183392_300621_1b
ACCAAACACGCGCACACGCAGCCGAGATCGAGAGCGAGCTACTTGCCCTAGCAGCAGCAGCAGCGAGGAGCGCGAGGGG
GCGGCGGCGGCGGCGTGCATGGCGGGGGCTCCGTCGAGGTCGCGCGGCGACTTCGACCACCTCATCAAGCTCCTCCTCA
TCGGCGACAGCGGAGTAGGAAAGAGTTGCTTGCTTCTGAGGTTCTCAGATGACACTTTCACTACAAGTTTTATCACCAC
CATTGGCATTGATTTCAAGGTTCGGACAGTTGAGCTTGATGGAAAGCGTGTAAAATTGCAGATTTGGGATACTGCTGGT
CAAGAACGTTTCCGGACAATTACAACTGCCTACTATAGAGGTGCTATGGGCATTCTGCTTGTTTATGATGTTACAGACG
AGTCATCCTTCAACAACATTAGAAATGGGATCCGCAACATAGAACAACATGCATCTGATAATGTCAACAAGATTTGGT
GGGCAACAAGGTTGATATGGATACAAAGCGGGTGGTGTCCACAGCTCAAGGACAAAAGCTCGCACATGAGTATGGAATG
AAATTTTTTGAGACGAGTGCAAAAACAAATCAGAACG

> SEQ ID NO: 5879 131361 190764_300779_1b
CCCCCGAGCAACTCATCTCATCTTCAGAGAAGCAAAGCCAACAAAAAGAAAAAGAATTTTCAGGTTTTCTTCTCGCTTT
CACCGGAGAAGGAGAAAGAGAGGAAGGTGTTGATCGAATCCTCCTCCAATCGCGCGCGATTCGATCCCCGTTGCTGGCT
CGCTCGCTCCGCCGATCCCTCATCCGATCTGAATCCCCGATCTGATGGCGGCCAACCCCGGCAACAAGATCCGCAACGC
CAAGCTGGTTCTTCTTGGAGATGTGGGCACGGGCAAGTCGAGCCTCGTTCTCCGGTTTGTGAAGGGCCAGTTTGTTGAG
TTCCAGGAGTCCACCATCGGCGCGGCCTTCTTCTCGCAGACCTTGGCGGTTAACGACGAGACGGTGAAGTTCGAAATCT
GGGATACTGCAGGGCAGGAGAGGTATCATAGCTTGGCTCCGATGTACTATCGTGGTGCGGCTGCCGCAATAGTTGTCTA

FIG. 2 continued

CGACATCACAAATGCGGCCTCTTTCACACGTGCAAAAAAATGGGTTCAAGAACTTCAAGCGCAAGGAAACCCAAACACG
ATAATGGCTCTTGCTGGTAACAAGGCTGATATGGTACAGGCGAGGCAGGTGC

> SEQ ID NO: 5880 131361 211823_300871_1b
GAGCCAACCATCCGCTTCGATTGCCACTTTGACCAAACCTGCACCTCTTTCAACTCTCAAGCCTTCCGCTTCTATTTCT
CCCGTTCCAACACAAACACCAACAACCGCCATCATGAACCCCGAATACGACTATCTCTTCAAGCTCCTCCTCATCGGTG
ATTCCGGTGTTGGAAAGTCTTGCTTGCTGCTGCGATTTGCCGATGACACCTACACCGAGTCTTACATCTCCACCATCGG
TGTCGATTTCAAGATCCGAACGATAGAACTCGATGGCAAGACCGTGAAGCTGCAGATCTGGGATACCGCCGGCCAGGAG
CGTTTCCGAACCATCACCTCGTCTTACTACCGCGGTGCTCACGGCATCTGCGTCGTCTACGATGTCACTGATATGGACT
CCTTCAACAACGTCAAGCAGTGGCTCCAGGAGATTGACCGGTATGCCACCGAGGGCGTCAACAAGTTGCTCGTAGGCAA
CAAGAGCGATATGTCCGATAAGAAGGTTGTCGAGTACACCGTTGCCAAGGAATTCGCTGACAGCCTGGGCATCCCATTC
CTCGAGACTTCCGCCAAGAACGCCAGCAACGTTGAGCAGGCTTTCCTCACCATGGCTCGCAGATCAAGGAGCGCATGG
GCACCACGACTGCCAACAACACGAAACCCAGCGTGCACGTTGGCCCAGGGCCAGGGTGTCGGCAACTCTTCCAACAGCA
GCTGCTGTTAAATGTATTCCTCTTTGATGGTTTCGTGTGGTTCGCTTTGTCGTG

> SEQ ID NO: 5881 131361 225723_300990_1b
GAGCAACGTTGGCGAATCCACGAAGAAAGAAGGGAAAGCGGTGCCATCGCGGGCAGGAGCAGGGCCAGATCTGAGCTGC
GCCGCCATCGATCGACGACCCAATCCACTGCCGCAGCTAAGGCGCCGCGAGATCCGGAGGTCTTTTGCAGGGATTTCGG
GGATTTTCGCTGGTTTTTCTTGATCTCTTCCTCGGTTCTGCGAAGAAGACGCATCGGCAGCAATGAATCCCGAGTAGGT
TTCGATTCGCGAGCGATTGACCTCGCCCTCTTTGCAGTGACTATCTCTTCAAACTCCTCCTAATTGGCGACTCTGGCGT
CGGGAAATCGTGCCTGCTGCTACGATTCGCGGATGATTCTTACCTTGAGAGCTACATCAGCACCATCGGGGTGGACTTC
AAAATCCGAACAGTGGAGCTGGAAGGGAAGACTATCAAGCTCCAAATCTGGGACACTGCTGGGCAAGAGCGCTTCAGGA
CTATCACGAGCAGTTACTATCGTGGAGCTCATGGCATAATCGTCGTGTACGACGTGACTGACCAGGAAAGCTTCAACAA
CGTCAAGCAGTGGCTCAACGAGATTGATCGCTACGCGAGCGAGAATGTGAACAAGCTCCTCGTCGGGAACAAGTCGGAT
CTCACTGCCAAGAAGGTGGTCGACACTCAG

> SEQ ID NO: 5882 131361 234217_301098_1b
AAATTTTCGAAGGGGGAAAAAAAGGTCTATCGTTCTTGTTCGCAGCGGCGGCGTTCGCTTTGATCTGGTTCTCGATCGA
TCGACCCATCGATTGTTTCGCGGCGATGGCGACGACGGGGATCCACATGCAGGCCAAGCTTGTGCTGCTGGGCGACATG
GGAGCTGGCAAGTCCAGTCTGGTTCTTAGATTCGTCAAGGGCCAGTTCTTCGATTACCAGGAATCGACAATTGGAGCTG
CATTCTTGACGCAGACATTGGCCGTGAACGAGACGACGGTAAAGTTCGAGATTTGGGACACTGCGGGTCAAGAACGCTA
CCACAGCTTGGCTCCAATGTACTACCGCGGCGCTGCCGCCGCCATCATTGTTTATGACATCACTAACGCGGACTCTTTT
GCAAAAGCAAAAACATGGGTACAGGAACTCCAAAGGCAAGGAAGTGCCAACCTCGTCATGGCTCTTGCGGGGAAACAAA
GCTGATTTGGCTGCAAAGCGCAAGATTGAAACACAGGAGGGACAATCTTATGCGGATGAAAACGGGCTCTTCTTCATGG
AGACTTC

> SEQ ID NO: 5883 131361 194381_300762_1b
CCCCCGCCAGTGTCTCCCCACTCCATAGTGACACTGCGCCGGGCTGCGAGATCCAAAATCCGACCAGCCAGCGTTAGCT
CGGAGAGGCGAGGCGAGAATGTCGGCCGCGGCGGGCGGGTACAGGGCGGAGGACGACTACGACTACCTGTTCAAGGTGG
TGCTCATCGGCGACTCCGGCGTCGGCAAGTCCAACCTCCTCTCCCGCTTCACCAAGAACGAGTTCAGCCTCGAGTCCAA
GTCCACCATCGGCGTCGAGTTCGCCACCCGCAGCCTCCAGGTCGACGGCAAGGTCATCAAGGCCCAGATTTGGGACACC
GCCGGCCAGGAGAGGTATCGTGCTATCACTAGTGCCTATTACCGGGAGCTGTGGGAGCATTGCTCGTCGTCTACGATGTCA
CCCGTCGTGCTACATTCGACAACGTGGGACGCTGGCTAAGGGAGCTTAGAGACCACACTGATCCTAGCATTGTCTGCAT
GCTGATTGGCAACAAATCCGATCTCCGCCACTTGGTGGCTGTCTCAACCGAGGACGGCAAAGAGTTTGCTGAAGCCGAA
TCAATGTACTTCATGGAAACTTCTGCGCTCGACGCTACCAACGTCGAC

> SEQ ID NO: 5884 131361 223774_300975_1b
GCAAATACGATGAATACCGAATACGACTACCTCTTCAAGCTGCTTCTCATTGGAGATTCTGGTGTTGGCAAGTCTTGTC
TTCTGCTTCGATTCGCCGACGATACCTACACTGACTCTTACATTTCCACTATCGGTGTTGATTTAAGATCAGAACTTT
AGAGCTGGAAGGAAAGACCCGTCAAGCTGCAGATTTGGGATACTGCCGGACAGGAGCGTTTCCGAACCATCACTTCTTCA
TACTACCGAGGAGCCCACGGTATCATTGTCGTCTACGATGTGACTGACCAGGACACATTCAACAACGTCAAGACTTGGT
TCCACGAGATTGACCGATACGCCACCGAGGGCGTCAACAAGCTGCTTGTGGGTAACAAGTCCGATATCACCGACAAGAA
GGTCGTAGAGTACACTGTGGCCAAGGAGTTTGCCGACTCTCTGGGCATCCCTTTCCTGGAGACCTCGGCTAAGAACGCC
ACCAACGTTGAGCAGGCATTTTTGACCATGGCACGTCAGATCAAGGAGCGAATGGGCGGAGCTGCCGAGAACACCGCCG
CCAAGGCCAATGTCAACCTCCGAGGCCAGAATGTCTCTCAAGGTTCCAGCAGCTCTTGCTGTTAAC

FIG. 2 continued

> SEQ ID NO: 5885 131378 174902_300528_1b
GTGAAACAGCAAAAAAAATCAAACAAAAAGAAAAAAAATTCCCCATCTGTGAAATTCGCAAAACCCTAGCGCGGCGGCG
ATGTCGAACACGAGGGTGTTCTTCGACATGACCGTCGGCGGAGCTCCGGCGGGGCGGATCGTGATGGAGCTGTACGCGA
AGGACGTGCCGCGGACGGCGGAGAACTTCCGCGCGCTCTGCACCGGCGAGAAGGGCGTGGGCAAGAGCGGCAAGCCGCT
GCACTACAAGGGGAGCACCTTCCACCGCGTGATCCCGGAGTTCATGTGCCAGGGCGGCGACTTCACCCGCGGCAACGGC
ACGGGAGGGGAGTCGATCTACGGCGAGAAGTTCGCCGACGAGGTGTTCAAGTTCAAGCACGACAGCCCCGGCATCCTGT
CCATGGCGAACGCCGGGCCCAACACTAACGGGTCCCAGTTCTTCATCTGCACCGTGCCCTGCAGCTGGCTGGACGGGAA
GCACGTCGTGTTCGGCCGCGTCGTCGAGGGCATGGACGTCGTCAAGGCCATCGAGAAGGTGGGATCCCGCGGCGGGAGC
ACCGCCAAGCCGGTCGTCATCGCCGACTGCGGCCAGCTCTCCTAGATCTGTGCTGTTCCCCTTCTCCTTTCGCCAGTAT
CAGTCGTCTTGAGTCGTCGAGTCCCTAAATAACGAGGAGGTGGTGGTGGTGTTAGTCTTTTTATGAGTTCGT

> SEQ ID NO: 5886 131378 220468_300955_1b
AACAACTTTGCGACTCCTCGATTTTATTCACAGCCCGCCAAAATGCCTAACACCAAGGTTTTCTTCGACATTGCCTGGA
AGGGCCCCGTCTTCAAGGACGGCCGTCCTACCTCCGAGATCAAGGAGCAGACCGGTCGCATCAACTTCAACCTCTATGA
CGACGTTGTCCCCAAGACCGCTGAGAACTTCCGTGCTCTCTGCACCGGCGAGAAGGGCTTCGGCTACCAGGGCTCTTCT
TTCCACCGAATCATCCCCAACTTCATGCTCCAGGGTGGTGACTTCACCCGCGGTAACGGCACTGGCGGCAAGTCCATCT
ACGGCGAGAAGTTTGCCGATGAGAACTTCCAGCTGAAGCACGACCGCCCCGGTCTGCTGTCCATGGCCAACGCCGGCCC
CAACACCAACGGCTCTCAGTTCTTCATCACCACCGTCGTCACCTCTTGGTTGAACGGCCGCCACGTCGTCTTCGGCGAG
GTCGCTGACCAGGAGTCCATGGCCATTGTTGCTGCTCTTGAGGCCACCGGCCGTGATGACGGCAAGGTCAAGTACGAGC
CCCGCCCCACCATCACCGCCTCCGGTGTCCTGTAAACTTGTTGAAAAGAAGCAACATGCTCTGCATGTCCATTTGGTGG
CAGTTTT

> SEQ ID NO: 5887 131378 240976_301318_1b
AGCGTCGCAGGTAATGGCGGCTACAGGCAAGCTTTGCGCAACCATGCCGGGTATGGCCGCCGCCGCCGCGGCCTCTCGG
GCATGGCTCCGCTCTCCTTCATCCATCCTCTCGCCGCCGCCGCAGCAGCACCAGCTGCTCCTCAAGACGATTGCTCCTA
GCCACCGCCGCCGCTCTTTCGCCACCCAGGCCGCAGTGAGCGTGGAGCAGCCGCCTCTGCAAGCCAAAGTCACCAGGAG
ATGCTTCTTCGACATGAAGATTGGCAACGAACCTGTGGGCCGTATTGTCATTGGTCTCTTCGGCGAGGACGTTCCCAAG
ACCGTGGAGAACTTCCGCGCTTTGTGCGCAGGTGACAGAGGGTATGGCTACAGGGGCTCTGCCTTCCACAGGGTGATCA
AGAACTTCATGATCCAGGGAGGTGATTTCGATCGATGTGATGGAACTGGAGGCAGGAGCATCTACGGTGGGAAGTTTGA
GGATGAGAACTTCAAGCTGTGTCACACCGGGCCAGGAGTTCTCAGCATGGCCAATGCAGGTCCCAATACCAACGGCAGC
CAGTTCTTCCTCTGCACCGTCAAGACCGAGTGGCTGGACAAGAAGCACGTCGTCTTCGGTCATGTCCTCGAAGGCATGG
ACGTAG

> SEQ ID NO: 5888 131378 256022_301646_1b
CCACGCGTCGTGGAAGGAGAGAGAGAGAGAGAGAGAGAAAGAGAAACAGAAAGAGAGAGAGAGAGAGGGAGGAGAAGTCTT
CCTAGCCATGGCCGCCTCGCAGTTTCTAACCCTGGGTAGAGTTGGACATCCCATAACTACTGGGAATCATGTTCAATGT
AGTCCAATCATGTCACGAATGCCAATGCGGTCTGCTTCTATCAAAAATACCCCCTGTTTATTAAAGATGAGGTCTGTCA
AGCTTGCTTATTGTAATGTGGCAAGAAAACAGCTCTCCGTGACGTGCACAGCTCAAGAAGTTGGGGCAGTAGCAAAGGT
TACAACTAAGTGCTTCTTTGACATTACAATTGGAGGAGATCCTGCTGGAAGAATCGTGATTGGCCTATATGGTGACGAT
GTGCCAGAAACAGTGGAGAACTTCCGAGCGCTCTGCACTGGAGAGAAAGGGTTTGGATATCAAGGCTCTGCATTTCATC
GCGTCATTA

> SEQ ID NO: 5889 131378 1171386_302054_1b
TGCGGACGCTGTGGGAAATTTTCTGCCCTTGCAAGCGCTCGTCTTTCTCCGTCGTCGTTTTCCGGTGAACAGCTGTTTA
GGAATGGCGAACCCCGTGTGTTTTTTGACATCACCATCGGCGGCAACCCTGCAGGCCGCATCATAATGGAGTTGTATG
CGGACAAGGTTCCAAGGACAGCGGAGAACTTCCGTGCCCTCTGCACAGGGGAGAAGGGAATTGGAAAGAGTGGGAAGCC
ACTCCACTACAAGGGTAGCTCCTTCCACAGGGTTATCAACGACTTCATGTGCCAGGGTGGTGATTTCACGCGGGGGGAT
GGAACAGGTGGAGAGTCCATCTACGGGGCCAAGTTTGCCGATGAGAACTTTTCGTGCAAGCACACTGGTCCAGGCATCC
TCTCCATGGCCAATGCAGGACCAAACACCAATGGCTCCCAGTTCTTCCTTTGCACCGTCCCCTGTGCATGGCTTGATGG
AAAGCATGTTGTCTTCGGCAAGGTCGAAAATGGAATGGACGTTGTCAAGACTATTGAGAAATACGGATCTGGGAGCGGC
AAGACGAAAGCCCTGTTGTCGTTGCTGACTGTGGCCAGCTCTCTTGAAGTATGGTTGGTGGCTCCCCTTAGAAGAATA
ACCTCTTCCCCCCCTCTAATAAGTTTTGGAGCCTATTCTTCGCTAAGCTTTATA

> SEQ ID NO: 5890 132564 111526_300039_1b
CGGACGCGTGGGCGGACGCGTGGGCAAAAACTCCATTGAAGAGAGGCCTACATTTCCTCTTTCTCTCTCTCCTATTTTA
CTCTCTCTCTCTCTAGCCATGGCTTTGCTCGTTGAGAAAACCACCTCTGGCCGTGAGTACAAGGTCAAGGACATGTC
TCAGGCTGACTTCGGTAGGCTCGAAATCGAGCTTGCCGAAGTCGAAATGCCTGGTCTTATGGCTTGCCGTACCGAATTT
GGTCCGTCACAGCCATTTAAAGGCGCTAAAATTACCGGATCTCTACACATGACCATTCAAACCGCTGTCCTTATCGAAA

FIG. 2 continued

```
CCCTAACTGCTTTAGGCGCTGAAGTTAGATGGTGCTCTTGCAACATTTTCTCTACCCAGGACCACGCCGCCGCTGCCAT
TGCGCGTGACAGCGCTGCCGTGTTTGCGTGGAAGGGCGAGACGTTGCAAGAGTACTGGTGGTGTACTGAACGCGCCCTT
GATTGGGGCCCGGGTGGTGGACCAGATTTGATTGTTGATGATGGTGGTGATGCTACACTTTTGATTCATGAAGGTGTAA
AAGCTGAAGAGGAATATGCTAAATCTGGTAAATTACCAGATCCAAGTTCTACTGATAATGCTGAGTTTCAGCTTGTGCT
TACTATTATTAGGGATGGGTTGAAAACTGATCCTTTAAAATACACTAAGATGAAGGAGAGACTTGTTGGTGTTTCTGAG
GAAACTACTACTGGTGTTAAGAGACTTTTTAAATGCAAGCTAATGGAACTTTGCTTTTCCCTGCTATTAATGTTAATGA
CTCTGTTACCAAGAGCAAGTTTGATAACTTGTATGGATGCCGCCACTCACTTCCCGATGGTCTCATGAGGGCTACTGAT
GTTATGATTGCCGGACAGGTTGCGCTTGTTGCCGGTTACGGAGATGTTGGCAAGGGTTGTGCTGCTGCTTTGAAGCAAG
CTGGTGCACGTGTGATCGTAACCGAGATTGATCCAATCTGTGCTCTCCAGGCTACCATGGAAGGTCTTCAGGTCCTTAC
CCTTGAGGATGTCGTTTCAGATGTTGATATCTTTGTTACCACAACCGGTAACAAGGACATCATCATGGTTGACCACATG
AGGAAGATGAAGAACAACGCCATTGTCTGCAACATTGGT

> SEQ ID NO: 5891  132564  237893_301281_1b
AGCAGCAGCAGCAGCAGCCAGATGCTGCTGCCATGTCGAGTGCTGCTGCTCCGCCACCTTTCCTCACAAAGACGTATGATAT
GATCGACGATCCAGGCAGCGATGCCATCGTCTCGTGGACAGCCAAAGGCAACAGCTTCGTCGTGTGGAACCCGCTCGAC
TTCTCCAGAGATTTGCTCCCAAAGTACTTCAAGCACAACAATTTCTCCAGCTTTGTGCGTCAGCTCAACACCTATGGAT
TTCGCAAGGTGGATCCCGACCGCTGCGAGTTTGCCAACGAAGGCTTCCGCCGAGGTGAGAGAAATCTCCTCAAGAACAT
CCACAGGAAGAAGCCGACGGCTCAAGGCCAGTCGTCACAGCACCACCCGGGAGGACAACCCGGCGAGGTTGGGAAGCTC
GGCCTGGAAGGAGAAGTGGAAAGGCTCAACCGGGACAAGAATGTACTCATGCTGGAGCTTGTCCGGCTGAGGCAGCAGC
AGCAGCAGACGGAGAGAGAGCTCCAGGTCATGGGACAGAGGCTGCATGGAACCGAGCAAAGGCAGCAACACATGATATC
CTTCATGGCCAAAGCCATCCAGAACCCGGGCTTCTTGTCCAGCTTAGTTCACCAACGTAATGGCGAAGGTGGTGGTGGA
TCGTATCTACCGGGCAAGAGGAGAAAGTTGGAGCTGTGCGATCA

> SEQ ID NO: 5892  132564  241819_301323_1b
CCCACGCGTCGGGAATGCCGTCCGCACTACAGACTCGGACGATGATGGACACGGCAATGCGAATGTATCGTCTACTGCA
TCGTCTCGTGATTGTGCAGCGGCAGCAGCCGGATCTCCGCCTCCCTTCCTCACCAAGGCATACGATATGATTGACGACA
TTTCCTCGGACCCAGTTGTGTCTTGGAGCAACAGAGGCACCAGTTTCGTGGTCTGGAATCCACCGGAGTTTGCACGGGA
TCTGCTGCCCCAGTATTTCAAGCACAGCAACTTCTCCAGTTTTGTGCGTCAGCTCAACACCTATGGTTTCCGGAAAGTC
GACCCGGATCGATGGGAGTTTGCAAACGAGGAGTTCGTCCGTGGCAAGAAGAGCCTGCTCATAAACATATCTAGGAAGA
AACCGTCCTCGCAGCAACAGCCGCAGCGACATCACCAGAGAGCAGCCTCAAGTGAGTCAACGCTTGGTTTGGAAGCAGA
GGTTGAGAGACTCAATCGGGATAAGAACGTTTTAGTGCTGGAGCTTGTGAGGCTGAGGCAGCAGCAGCAGGCGGAG
AGAGAGCTGCTGGTCATGGGCCAACGCGTGCAAGGATCAGAGCAGAGGCAGAAGCACATGATATCCTTCCTGGCGAAGG
CTATACAAAGCCCACGATTTCTGTCACAAGTCCTTCAACGCGAGGGCAGTAACTGTTCGAGCATCGCCAGCCACAAGAA
ACGAAAGCAGCTGGAGGTTTCGGACGACTTTCGCG

> SEQ ID NO: 5893  132564  247843_301577_1b
AGCATCTCCTCGGCGGCGGCGGCATCGGCGCCTAGATCTAGCTCCATCTCCCGGCAGCAACAAGGATAGAAATGGCTCT
CTCCGTGGAGAAGACCGCCGCTGGCCGCGAGTACAAGGTCAAGGACATGTCCCAGGCCGACTTTGGACGGCTGGAGATC
GAGCTAGCGGAGGTGGAGATGCCCGGCCTCATGGCCTCGAGTTGGCCCGTCCCAGCCGTTCAAGGGTGCCC
GAATCACCGGCTCTCTCCACATGACCATCCAGACGGCCGTGTTGATCGAGACCCTGACCGCTCTAGGGGCCGAGGTACG
CTGGTGCTCGTGTAACATCTTCTCCACCCAGGACCACGCCGCCGCCGCCATCGCCCGCGACAGCGCCGCGGTCTTCGCC
TGGAAAGGCGAGAACTTGCAAGAGTATTGGTGGTGTACCGAGCGAGCTCTCGACTGGGGAGTTGGCGGCGGTCCGGATC
TTATCGTGGACGATGGCGGCGACGCGACTTTGCTCATCCATGAGGGTGTCAAGGCCGAGAAGGAGTACGAGAAGAATGG
GACGCTGCCGGATCCGAGCTCGACGGCCAACCAGGAGTTCCAGATCGTGCTGGGGATACTCAAGGATGGTATGCAGGCT
GACCCGAAGAAGTACCATAAGATGATGGAGAGGCTTGTTGGTGTTTCGGAGGAGACTACCACCGGTGTCAAGAGGCTGT
ACCAGATGCAGTCGAATGGATCGCTGCTC

> SEQ ID NO: 5894  132564  266801_200031_1b
CGTTATTTATTATGCATCTTGACTACCCCTCGACCCACGCGTCCGTCTTCATCAGCCCTTTGCCAATTACATATTCTCT
CACCGCCTCCTCGAAATTCTCTAGTGTCTCGTGCGTAACTTCTGCTTCTCAGTCTGTATAGAATCCCAGAGTACCTTCA
GAAGATCCGCGTCCGATATTTAGGGGCCAAAAATGGAAGCAATTCACGAGATAGGAAATTCGCCACCGCCTTTTCTGTG
CAAGACGTATGATATGGTGGACGATTTGTCGACGGATTCAGTGGTATCGTGGAGTAAGAGTAATAACAGCTTCGTCGTC
TGGAACGTGCTGGAGTTTTCGAGAGATATTTTGCCCAAGTATTTTAAGCACAATAATTTCTCCAGCTTTGTTAGGCAGT
TGAATACTTATGGTTACAGGAAGGTTGATCCAGACTGCTGGGAATTTGCAAACGAGGGATTCCTTAGAGGCCACAAACA
CCTCTTGAAGACCATAAGTAGGCGAAAACCGTCTCAAATGCAGGTCCATCAGGACACCGCCTCCCAAGTGCAAAGTGTA
TCTGC
```

FIG. 2 continued

> SEQ ID NO: 5895 132564 30880_300077_1b
CAAGAACATTCTCAGCTTCTAGAAGGTTTTCTCACCAACCCCCAAATTATGAGAAAATTACGAAATTGGCTAACCAACT
ACAAAAGAATGATTCAATTCACCAAACGAATTAAATGAAGCATTAAATTGAGAGTAAATGAGTTTTCGTTAGAGTGAAA
CTCACGTAAGTGTTGAGCTGACGAATGAAGCTTGAGAAATTATTATGCTTGAAGTATTGAGGAAGAAGATCTTTAGCAA
ACTCTGCTGTTTTCCACACGACAAAAGCTGTTCCTTCTTCGTTCCATGAAACGACGTCGTCTGTGCTATGATCATCAAC
TAGCTGATACGTTTTGCTTAAAAACGGCGCCGGAACTGATCTTTGCGCCGCCGTCACAGCCGTCATCTCCGGCGAACTT
TTTTTATTTTACCACAGAAAAATAAAACTAAAAATAATCTAATACACAAAGAGAAGAAGAAAGATTGGAAATAGAAAGT
CGAAGGAAAAAGAATCAGCAACTAAAAAGCAAGAGAGCGGTGAGAAATTCCCAATCCCAGCAATAAAAGCCAGAGAGGA
AAACACGAGAACGGAGAAGATCGGAGTTTCGTTTGGTTTCTTCCATTTAAGGAAAAATCTGATGATGGAGGAAGAAGAT
GAAGACGACGACCATACTTCGCCGGAGCTAATCCGTGTGATTAAAAAGTAAATAAATATAAAGTCTTTTTTATTTTTGT
GTGTATGTGCAAAACACGTAAAACAAATATATAAACGAGTTAAGTGTTATGTCGAACGGTCTCTATATAACGTAGTAGG
AAGATTTATAGATCACAAATGTTGGTCCTACCTTTGTAAGACAATTAAATTATA

> SEQ ID NO: 5896 132564 316958_301428_1b
GCAGCATGGGAACGGTTTGCGAATCTGTAGCGACGGCGAAATCTTCGACGGCGGTGATGAGCTCCATTCCGCCTTTTCT
GAGCAAAACGTACGATATGGTTGACGATCCATTGACGGACGACGTGGTGTCTTGGAGCAGCGGAAACAACAGCTTCGTG
GTTTGGAACGTGCCTGAGTTCGCCAAACAGTTTCTACCAAAGTATTTCAAGCACAACAATTTCTCCAGCTTCGTCAGAC
AGCTCAATACTTATGGTTTTAGAAAAGTTGATCCAGGCCGCTGGGAGTTTGCAAACGAGGGCTTTTTAAGAGGCCAAAA
GCAAATACTAAAGAGTATTGTCCGGCGAAAACCTGCACAAGTGCAGCCTCCACAACAACCTCAAGTTCAGCACTCATCT
GTGGGTGCGTGCGTTGAAGTGGGCAAATTTGGACTCGAAGAGGAAGTGGAAAGACTTCAGCGCGATAAGAACGTCCTTA
TGCAGGAACTTGTAAGGTTGAGGCAGCAACAACAAGTTACCGAACATCATCTGCAGAATGTGGGGCAGAAAGTTCATGT
GATGGAGCAGAGGCAGCAACAGATGATGTCCTTTCTAGCAAAGGCTGTCCAAAGTCCAGGTTTCTTAAACCAATTTTCT
CAGCAGAGTAATGAAGCAAACCAACACATTTCTGAAAGCAACAAAAAGAGGAGGC

> SEQ ID NO: 5897 133405 237487_301287_1b
ACGTCGATGCGTAGGCCCTGATCGATCTCTACTGGTTTCGAGATCTTCGAAGAATCGTGATGGGTATGACGCTGGTGCT
GCTCAAATCCTTGCTGCCTTATCTCGGACCGGCTGTAATGCTCGGCTATCCACTGTATCAATCAATCAAAGCTATTGAG
AGCCCTTTTAAAGACGATGACGAACAATGGCTTACTTACTGGGTTGTATATTCGTTTATAGCTCTCTTCGAGCTAGCAG
CAGAGAAAGTTCTGGATCTCATTCCATTCTGGCCTCCATTGAAGCTACTCTTAATTTGCTGGCTGGTTCTGCCACAGTT
TCGGGGTGCTTGTTTCCTCTACAGAAACTACGTGAGGACATTTGTCTTGAACTTCTTGCAGCAACATCAGGATCATCTC
GACGACGATCATAAGCACGACTACAGCGAGAAGCAGAAGGAGTTGCTCCGAATGATGAGCACTGACGCCCGAGTAGCTG
TTGCTCAGTACATTTCCGAGCATGGACCGGATGCATTCGACAAACTCATCACCACTGCTACAAGACAGTCTGCAAAGAG
CAAAACCTCGCCG

> SEQ ID NO: 5898 133405 125331_300630_1b
GGCAAGAAGTCTCTCAAACTTTACTCTTCTCTGAACAACAAAGCAGCAACTCTTAGGATCCTCATCAGCCACTGACCCA
AATCTAGACCCATCTTCTTCTGTACTCTGCTATAACTGCAAATCTCAGACTATACCTCTCTTTAGAAGTCATAATATAA
TTAATTTTGGAGTTTACAGTATGGGAGGATCTGGTGGTGTAGGAAGCTTCCTCAAGGTTATACTCAACAACTTTGACAT
TCTTGCTGGGCCTGTCGTTAGTCTGGTTTATCCTTTGTATGCCTCAATAAGGGCTATAGAGAGCAAATCTCCTGTGGAT
GATCAGCAATGGCTTACATATTGGATTTTGTACTCTATGATTACACTTTTTGAGCTGACCTTTGCCAAGCTTATTGAAT
GGCTCCCTTTCTGGTCATATGCAAAACTGATCACAACCTGCTGGTTGGTCATACCTTACTTTAATGGTGCAGCATATGT
GTATGAGCATTATGTTAGGCCTTATATCATCCAACGAAAAGCAGTTAACATCTGGTATGTGCCACGAAAGAAGGATGTC
TTTAGTAAGCCTGATGACATCCTAACTGCTGCAGAGAAATATATACAAGAACACGGAACCCAAGCATTTGAGGAGATGA
TCCACAAGGCTGAAGGAGAACGAAGGCCCCAAACCAGCAATTATGTGTTTATGATGACGACTACAGATACTGAACCTT
GTATACTACAGTTTCTTTGGTTTGGTTTTTGCTCCTCCAGTACTTTAGGAAAGGAAGAGATCTATCTGCTGTTGTAAAG
AGGTGCCCTAAAACTGATGGTTTGGCCTT

> SEQ ID NO: 5899 133507 262882_301719_1b
TTTGGTTAGGCCTTTGTCTCTCTCTCTGCTTTACAGTTTCCGGAAGGCCATAGCTGCTGTCAGATCGTTCCACTCTC
TAGGAGTTCATGGCTCTACATTTGTTACATGGGACCTTCCACATCACTATCTGCGAGGCTTCAGGGCTACCGAAGCACC
ATGCTGGGTTCTTACATAGAATCGTGGGACTTGGAGGGTCGCAACAACTATATGCGACCATAGATATGGAGAGGGCGAG
GGTGGGTCGGACAAGGATGATTGATCACGAGCCTACAAATCCCTCCTGGAACGAAAGCTTCCACGTCTACTGCGCCTAC
CATGTGTCCCATGTAGTGGTGAGTATCAAGGATGACAATGCAGTGGGTGCGGCAATCGTGGGAAGAGCAAAGATCCCCG
TGGAAGATATTTAGGCGGGGAGGAGATTGACCAGACCTATGGCCTCGTCAAAGACAATGGGGAGGTAGTGGAAGATGC
TACCATCCATCTTCGCATGCAATACTTCGATATATGCAAGTTCCCATGGTGGGGCAAGGGTGTGAGGGGGAG

FIG. 2 continued

> SEQ ID NO: 5900 133547 157005_301734_1b
AAAAGGATATGCTTTTTGTGTGTACCAGGATGTGTCTGTTACTGATATTGCTTGTGCAGCGCTTAATGGAATTAAGATG
GGCGATAAAACTCTTACTGTTAGGCGTGCTAACCAGGGCACAACACAACCCAACCCTGAGCAAGAGAGTGTATTGTTGC
ACGCACAACAGCAGATAGCTTTGCAGAGATTCATGTTACAACCTGGTGCATTAGCAACGAAGGTCTTGTGCTTGACTGA
AGTTGTCACTGTGGATGAGCTCAATGATGATGATGACTATCAAGATATTTTGGAAGATATGAGGACTGAGTGTGAGAAA
TTCGGAGCTCTAGTGAATGTTGTCATTCCACGTCCAAATCCTAATGGTGTGCCTACACCTGGACTAGGAAAGGTATTTT
TGGAGTATGCAGATGTTGACAGTTCCAGCAAAGCTCGGCAAGGACTGAATGGAAGAAAATTCGGTGGTAACCAAGTGGT
AGCTGTCTTCTACTCGGAGAACAAGTTCTCTGAGGGAGACTATGAGGCTTAGCTCTAACCACTAAAGTTATGATA

> SEQ ID NO: 5901 134744 1007359_301399_1b
GTTGGTGTTGGTGTATAGTGGAGATGGCAATGGAAGGGGGGACAAGGGAGGAATCCAAAGGCTTCTTGCAGCAGAGCA
GGAGGCTCAACATATCGTTGCAGCTGCAAGATTAGCAAAGGCAACGAGGTTAAAACAAGCGAAAGAGGAGGCTGAAAGA
GAAGTTGCTGCTTATCGAGCTCAGCGAGAAAGTGAATTCAGAAAAAGGCTTGCTGATACAAGTGGAGATTCTGGTTTAA
ACATCAAGAGATTAGAAGCAGAAACCCACTCAAAGATAGAACAGCTTAAAGAGGAAGCAGCGAATGTTTCACCTGAGGT
TGTGGAAATGATGATAAAATATGTAACAAATGTCAGAAATTGATTTGACCTTGGCTTCAGTTTACCCTAAAGTTTAAAG
CTTTTAGCAGGAAGTTCAATAGGTATAATTGGTATTTGTTTTGTATCAGTGTTTATGAATATGCACCATAAGGTTGAAA
CTAGAAGTTTGTGGACCTGCTAGAGAACTATTTTTGTCTACCATCGAACTCGAGTTTCTGCTATGTCCGATTGTAAAGG
AGATCATTGATTTGAAGTTTGTGACGAGCACTTCGATGTACACTATTTATGGTCATGTAAGTGAATGACTATGGTTTAG
TATAGTTATGTAATGGA

> SEQ ID NO: 5902 134744 1100830_301464_1b
GGGGAAAAAGAGACTCTTTTCTTGAGGGGTGCTTTTTTCATTGTTTTTCATCATCGTCACGAGAGAGAGAGGAGAGGGA
GAGGGAGAGGGAGAGAGAGAGGCAGAGAGAGAGAGAGAGAGAGAGAGAGTGGCGATGGCTTCTGACCAGGGAGGAAT
CCAGAAGCTTTTGGCTGCAGAGCAGGAAGCCCAGCAGATCATTTCCTCTGCTAGATCAGCTAAGGCAACTAGACTGAAA
CAAGCAAAAGAAGAAGCTGAGAGAGAAGTTGGTGCTTATCGTGCACAACGTGAAAGTGAATTTCGAAAAAGATTGGCTG
AGACAAGTGGAGATTCTGGTTCCAACATCAAGAGGCTAGAAGCTGAAACGCATACAAAAATTCATCATCTTAAACATGA
ATCGGCACATATATCTCCTGAGGTGGTGGCGATGCTTATTAACTACGTCACGACTGTAAAAAATTGAGGGAGGGAATAT
TTTGAGGGGGAGGAACTTGCTATGAAACTCTTATCAAAAACCTATAATTTTTATTTGTTCACCATTTTGAGATGTAGA
AAAATTTGCCTGTCATCCAAGCTTTTAGGATTTGTATGCTAATTGCAGGAAATGGGTGTCGGCAATGAGTAAATAAATT
GATCTTTTTCATATGTAGTGAAAATGACAATTTTAGTGC

> SEQ ID NO: 5903 134744 158884_200020_1b
ATCTTTCGCAGCAACGGATTCTCAACTCCGATTCTACAGAGTGTTATAGACGAGTATGGCATCTAGCAGTGGCCAGAAT
GGAATTCAACTCCTTTTAGCTGCCGAACAGGAAGCCCAACACATTGTCAATACAGCCAGGACTGCTAAACAGGCTAGAT
TGAAGCAGGCCAAGGAAGAAGCTGAGAAGGAGATAGCTGAATTTCGTGCTTACATGGAGGCTGAGTTTCAGAGAAAGCT
TGAACAGACTAGTGGTGACTCGGGCGCTAATGTCAAACGTCTTGAGCAAGAAACAGATGCAAAGATCGAGCACCTGAAA
ACTGAAGCAGAAAGAGTCTCCCCTGATGTTGTCCAGATGCTCCTGAGGCACGTAACCACAGTGAAGAACTAAGATCTTC
TGTGGGTGTAGTGGATCAAGCTTAATGTTCATTTTGCAGATTTATGCTTCCCCCTGGTTTATGGTTTCTCTTGCTTGAT
CAGTCCAATGGATGTTCTCCATTTATATTTTATTTTTATTATCATTATTTATTGTCTTGTCTGTTGAATAAAACAACTC
ACTCGGAGCTCCTTTCAACCTGTGTTGTAAACTTAGATGAGAAACCAAGGTCAGATGACTAGGCATGGCTGCTTCTTAT
TTATGTAGAACTG

> SEQ ID NO: 5904 134744 142459_300435_1b
CCCCTCCCTTGCTTTATCGCTAGCCACAAATTCTCTCCTGGGTCCTGCATGGCTGAAACCTGCAACCCCAACACCCCTT
TGAGAATTGACACGCGCGCAGAAGAAGGAAGATGGATGCTACCAGACGCCAAGGAGGAATTCATCAATTATTGGCTGCA
AAGCAAGAAGCTCAACAGATTGTTAATGCTGCTAGGAGCGGCAAAAGAGGAGGTTGAAAGAGAAATAGTTGATTACCGA
GCTCAAATGGAAGCTGAGTTCCATAGGAAGGTTGTGGAAAGTAACCGTGATTCTGGGGCAAACGTAAAACGGTTTGAGC
AAGAAACTGACACTATAATTGCCCAACTGAAGGAGCAGGTTGCAAATGTTTCCCCTGAAGTGATCCAGATGCTTCTTAG
GCATGTAACCACC

> SEQ ID NO: 5905 134744 1108722_301520_1b
ACGTTTTGAGAGAGAGAGAGAGAGAGGGGGGCAAGGAGAGAGAAAGCAAGAGAAAGACAGTAGTGGGAGAGAGAG
AGAGAGAGAGAGAGAGAGAGAGATGGCGACGAGTTCAGAGCAAGGAGGAATCCAATTGCTTCTGAGTGCAGAGCAGG
AATCACAAGAGATCTTAGCCTCCGCCAGATCAGCTAAGGCAACTAGATTGAGACAAGCAAAGAAGAAGCGGAGAGAGA
AGTTGGTGCTTATCGTGCACATCGTGAAAGTGAATTTCACAAAAAGCTAGCGGAGACTAGTGGAGATTCAGGCTCCAAC
ATCAAGAGGCTAGAGGCTGAAACTCATTCGAAAATTCACCATCTTACTCATGAATCAGCAAAAATATCCCCTGAGGTGG

FIG. 2 continued

TCGGGATGCTCATTAACTATGTGACAATGGTGAAAAATTGAAGCCGAAGATTTCAACAAAACTTGACACACAACACACT
GGAATATTGTTTGATGAATCTATGATATTTTTCCCCATTCGCTCACAGCCATTTGCAATGTAGAAATTTAGTCTGCTGT
CCAAGCTTTTAGGATATTCATGAATGC

> SEQ ID NO: 5906 134744 6712_300347_1b
CCCACGCGTCCGAAACAAAGACTTTTGTGCAATAAAGCATGGAATCCAACAGAGGTCAAGGTTCGATCCAACAGTTGCT
TGCTGCTGAGGTAGAAGCTCAACACATTGTCAATGCTGCAAGGACCGCAAAAATGGCAAGACTGAAGCAAGCTAAGGAA
GAGGCAGAGAAAGAGATTGCCGAATACAAAGCTCAAACAGAGCAAGACTTCCAGAGGAAACTTGAGGAGACAAGCGGAG
ACTCTGGTGCGAATGTGAAGAGGCTGGAGCAAGAGACTGATACCAAAATCGAGCAGTTGAAGAACGAAGCATCGAGGAT
TTCCAAAGATGTTGTCGAAATGCTTCTGAAACATGTGACCACAGTGAAGAACTGAGAGATATTTTTATAAGAAAGTAAA
AAAAAGTTTATGAAAAAAGTGGGAGTCATTTTTGAGTGATCTGCTCTCTTTCTCTTTTGTGGGTATTTCTGGATTTGA
GAGACTCATCTTATATTA

> SEQ ID NO: 5907 134744 187346_300676_1b
GGTAAATATTATCCTTTCATGTATCATTTGAACAAAATAATGGGAGATTCTTTTTGTTTATTCTC

> SEQ ID NO: 5908 134962 209272_300813_1b
GATCGATCTCGTCGTCGGCGATGGAGAAGTTGCTTTCCTCCTCCGGCGCCGCCGCCGCCGTGGCGTCGCAGGGCCAGCT
CCCGGACTGCTTCGTGTTCCCGGCCGACCGGCGCCCACCGGCCTCCACCGCGGCCGTGTCGCTCCCCGTCATCGACCTC
TCCGGCCCCCGCGACGCCGTCCGCCGCGCCGTCCTCGACGCCGGCAAGGAGCTCGGCTTCTTCCAGGTGGTGAACCACG
GCGTGCCGCCGGAGACGATGCGGGAGATGCGGCGGTGTGCGAGGAGTTCTTCCGGCTGCCGGCGGAGGACAAGGCGGC
GTTCTACTCCGACGCGGAGGAGAACCCCAACCGCCTCTTCTCCAGCACCATCTACGAGGTCGGCGACCAGCGCTACTGG
CGCGACTGCCTCCGCCTCGCCTGCGGCTTCCCCGTCGCCGACGACACCAACACCCACTGGCCCGACAAGCCCCACCATC
TCCGGGATGTCACGGAGAAGTTCTTCGTGGCGACGAGGGGATTGGGGATCGAGCTGCTGCGGCTGCTGTGCGAGGGGAT
GGGGCTCAGGCCGGACTACTTCGAGCGCGACCTCACCGCCGGCGATGTCATCATCAACGTCAACCACTACCCTCCATGC
CCGGATCCGAGCCTGACGCT

> SEQ ID NO: 5909 134962 240916_301318_1b
GATTCACAATGGCAGCCCAAGGACATGCTTGGAATACGGCAGCCGGAGTGAAGGGGCTCTCTGAAGACGGAGCGTCTGT
GCCAAGCAAATTTGTATGGCCTTTAGATTCCAGAGTCAAGAAAGAAGAGTTTTGCTTACTTGAAGGCATTCCGCTCATC
GATTTGTCTCAGTCGAATGTGAATACTGTGGAGGAGGTAGCCAACGCAGCTCAAAATTGGGGATTCTTTCAGGTTGATA
AGCATGACGTTCCTGTTGAACTCATGGAATCTATGCTCAGTGTTAGTCGTGAGTTCTTCAATATGCCATCAGAAGACAA
GATGGCCTACTACTCGGAAGACTTCAAGTCGCCTGTAGGCTATGGCAGTAGCTACAGTCCGTCCGGCGAAAATCACCTT
GAGTGGCACGACCATCTGCTTCACTGGTTCCCTTCGTTGGAAGAGAGCCACCCATGGCCTGAGAAACCAGCTTCGTACA
GGAAAATAGCTGAGAATTATTTGGAGCATGTCTCGATGTTGGCAAAGCAGATTGCGGCATTGCTCTCCGAAGGCTTAGG
ACTGGAGCCTGGATATTTATACGAGGCGATGAAAAGCCCTCAAGTCTATTTGAGGCTAAACTATTATCCACCGTGCACC
AAGTCAGAACTTGTGCTTGGGCAAACATCACACTGTGACTATGGAGTCTTCA

> SEQ ID NO: 5910 134962 248932_301588_1b
ACTGGGAAATGGCGATAGTTTTAGGAACAATGCCGACTCAGGGAGTGAAGGAGCTAGTGGAGAATTCTCAAGATCATAT
ACCAGATAAGTATATCAAGCCCGAGCGTGCCCGTGTTAGATACAACAGTTCCACAGCAGGGATTCCCCTCATTGACCTC
GCTGAAATCCATGGACAAGGAAGAAGTGATGTTCTTCGTGCCATAAGAGATGCGGCAGGAGAGTGGGGATTCTTCCAGG
TGATCAATCACAGCGTTCCACCAGCTTTGATGGAGGCTATGATGAAGGCTGCTCGTGAGTTCTTCGACCTGCCTCTAGA
GGAAAAAATGGCATATTTTTCTGAAGATTTTGAGGAGAGAATTCGTTTCTGCACCAGCTTTGTTCCTTCAACGGAAGAA
CGCTGGGACTGGCAAGACAACCTCTCGCATACTTTTCCACCTTACGGAGACGATCACCCCTGGCCAAAGAAGCCACACT
TGTACGAGGAAGTTGCGAAGGAGTATCTCCACCAGGTTTTGGAGCTGGGGAACGCAATCGCAGGTGCAATCTCTGAAAG
CTTGGGCTTAGAAAAAGACTTTCTCCTAAAGGCGTTCGGAGAGGGCAGGCACAACATGCGTCTAAACTATTATGCACCT
TGTCCAAGACCCGATCTTGCAGTGGGCTTCAGTCCTCACTCCGACTTCGGAGGTTTTACCATCCTGATGCAAGACCAAG
TAGGAGGGCTTCAGGTGAAAAGGACGACGACTGGTACTTTGTCAAACCAGTCAAGCACTCCTTCGTGGTCAATATCAG
TGATCAA

> SEQ ID NO: 5911 135016 136901_300440_1b
CCAAAAAAAAGGAAAAAAAAAACCAAAACACACCAAGCCAAATAAAAGCGACAATGGGATCGCTCACCACCAACATC
GTCCTCGCCGTCGCCGTGGTGGCCGCGCTGGTCGGCGGCGGGTCGTGCGGCCCGCCCAAGGTGCCACCCGGCCCGAACA
TCACGACCAACTACAACGCCCCGTGGCTCCCCGCCAGGGCCACCTGGTACGGCCAGTCCTACGGCTCCGGCCCCGCTGA
CAATGGTGGCGCGTGCGGGATCAAGAACGTCAACCTGCCTCCCTACAACGGCATGATCTCCTGCGGCAACGTCCCAATC
TTCAAGGACGGCAGGGGATGCGGCTCATGCTACGAGGTGAAGTGTGAGCAGCCGGCGGCGTGCTCGAAGCAGCCGGTGA
CGGTGTTCATCACGGACATGAACTACGAGCCCATCTCGGCGTACCACTTCGACTTCTCCGGCAAGGCGTTCGGCGCCAT

FIG. 2 continued

GGCTTGCCCGGGGAAGGAGACCGAGCTCCGCAAGGCCGGCATCATCGACATGCAGTTCAGGAGGGTGCGCTGCAAGTAC
CCCGGCGGCCAGAAGGTCACCTTCCACGTCGAGAAGGGCTCCAACCCCAACTACCTCGCCGTGCTCGTCAAGTTCGTCG
CC

> SEQ ID NO: 5912 135016 175541_300545_1b
CCCCCCCCGGGGGCAGTAGCAAGCAAGCAGGGCTAATATACATAAATTGATCCAGGGATCGATCGAAATTAATGGCGGG
CAGGAGCAGGAGGAGGTCGTTTTGGTCCGTGGGCGTTGCGGCTGCTCTGCTTTGTCTGCTGGCCGCCCATGGCTGCAGC
GCCAAGCATCACAAGCCCAAGCCTACTCCCGGTGGCATCAGTGGCAATGCTTCTTCTTCCTCCTCCAATTCCAGCACCC
CCAGTATTCCTCCTCCTGTTGCCCCTACTCCTACTGCTCCTACTCCTCCTATTCCCAGCCCCGGAACTGGAAGCAGCAA
CGGCAGCAGTGGCGGTGGCGGCGGCGGGTGGCTGAACGCCCGTGCGACCTGGTACGGCGCTCCCAACGGCGCTGGGCCG
GACGACAACGGCGGCGCGTGTGGGTTCAAGAATGTGAACCTGCCGCCCTTCTCGGCCATGACTTCCTGCGGAAATGAGC
CTCTCTTCAAGGACGGCAAGGGATGCGGCTCCTGCTACCAGATCCGATGCGTGGGGCACCCAGCCTGCTCGGGGCTCCC
GGAGACGGTGATCATCACGGACATGAACTACTACCCAGTGTCGCTGTACCACTTCGACCTCAGCGGCACGGCGTTCGGC
GCCATGGCCAAGGACAACCGCAACGAC

> SEQ ID NO: 5913 135016 187766_300680_1b
CAGCTATGGCTTTTTCCATCTCCAAGAAGGCTGCAGTTGCTGCACTCTTCTCCTTCCTTGTTGTCACCTGCGTCGCCGG
CGCCAGGCCGGGGAACTTCAGCGCCTCCGACTTCACCGGCGATCCCAACTGGGAAGTCGCCAGGGCCACCTGGTACGGC
GCTCCCACCGGCGCCGGCCCTGACGACGATGGCGGTGCTTGCGGGTTCAAGAACACCAACCAGTACCCGTTCTCGTCGA
TGACCTCCTGCGGCAACGAGCCTATCTTCAAGGACGGGAAGGGCTGTGGCTCATGCTACCAGATAAGATGCGTCAACCA
CCCTGCCTGCTCCGGCAACCCGGAGACGGTGATCATCACCGACATGAACTACTACCCCGTTTCCAAGTACCACTTCGAC
CTGAGCGGCACGGCGTTCGGCGCCATGGCCAAGCCGGGGCAGAACGACCAGCTCCGGCACGCCGGCATCATCGACATCC
AGTTCAAGAGGGTGCCGTGCAACTTCCCTGGGCTGAAGGTGGACGTTCCACGTGGAGGAGGGT

> SEQ ID NO: 5914 135016 227120_301008_1
CAAAAAAAAAAGGAAAAAAAAACAAAACACACCAAGCCAAATAAAAGCGACAATGGGATCGCTCACCACCAACATCGTC
CTCGCCGTCGCCGTGGTGGCAGCGCTGGTCGGCGGCGGGTCGTGCGGCCCGCCCAAGGTGCCACCCGGCCCGAACATCA
CGACCAACTACAACGCCCCGTGGCTCCCCGCCAGGGCCACCTGGTACGGCCAGCCCTACGGCTCCGGCTCCACCGACAA
TGGTGGCGCGTGCGGGATCAAGAACGTCAACCTGCCTCCCTACAACGGCATGATCTCCTGCGGCAACGTCCCAATCTTC
AAGGACGGCAGGGGATGCGGCTCATGCTACGAGGTGAAGTGTGAGCAGCCGGCGGCGTGCTCGAAGCAGCCGGTGACGG
TGTTCATCACGGACATGAACTACGAGCCCATCTCGGCGTACCACTTCGACTTCTCCGGCAAGGCGTTCGGCGCCATGGC
TTGCCCGGGGAAGGAGACCGAGCTCCGCAAGGCCGGCATCATCGACATGCAGTTCAGGAGGGTGCGCTGCAAGTACCCC
GGCGGCCAGAAGGTCACCTTCCACGTCGAGAAGGGCTCCAACCCCAACTACCTCGCCGTGCTCGTCAAGTTCGTCGCCG
ACGACGGTGACGTCATCCAGATGGAC

> SEQ ID NO: 5915 135016 189151_300613_1b
ATTCACAAATAACTAACACCCATCAGCAACAATGGCATCCTCTTGTCTCCTTCTGGCCTGTGTCGTGGCAGCGGCCATG
GTGTCTGCAGTGTCATGTGGGCCGCCCAAGGTGCCGCCTGGCCCCAACATCACTGCGGCCTACGGCAAACAGTGGCTGG
AAGCTAGGGGTACCTGGTACGGCAAGCCAAAGGGTGCCGGCCCCGACGACAACGGCGGCGCTTGTGGGTACAAGGACAT
TGACAAGGCTCCCTTCCTCGGCCATGAACTCATGTGGCAATGACCCTATCTTCAAGGATGGCAAGGGCTGCGGCTCCTGC
TTTGAGGTCAAGTGTTCCAAGCCAGAGGCCTGCTCCGACAAGCCCGTCATCATCCACATCGACATGAACACTGAGC
CTATCGCCGCCTACCACTTCGACCTCTCCGGCCATGCTTTTGGTGCCATGGCTAAGGAAGGCAAGGATGAGGAACTCCG
CAAGGCGGGAATTATCGATATGCAGTTTCGTCGCGTCCGCTGCAAGTACCCTGGTGAGACTAAGGTCACCTTCCACGTT
GAGAAGGGCTCCAACCCCAACTACTTTGCAGTGCTTGTCAAGTACGTCGGTGGTGACGGTGATGTCGTGAAGGTGGAAC
TTAAGGAGAAAGGCTCTGAGGAGTGGAAGCCACTCAACGAGTCATGGGGTGCTATCTGGAGGATAGACACT

> SEQ ID NO: 5916 135016 194491_300763_1b
CCCACGCGTCCGATCTCACTTCACTCTCTTTCTCTTCTCTTCACTTCACCACCGCCACCTCTCTCATCGGATCCCTGCA
GAGGAGGAGAGGGCAGTGGCGGCGAAAGGCCAACATGGGCTCGCTGTCCTCTCTCGCCGCCGCGGCGGTGTTTCTCTCCC
TCCTCGCCGTCGGCCACTGCGCCGCCGCCGACTTCAACGCCCACCGACGCCGACGCCGACTTCGCCGGCAACGGCGTGGA
CTTCAACTCCAGCGACGCCGCCGTCTACTGGGGCCCCTGGACCAAGGCCAGGGCCACCTGGTACGGCCAGCCCAACGGC
GCCGGCCCCGACGACAACGGCGGCGCGTGCGGGTTCAAGCACACCAACCAGTACCCGTTCATGTCGATGACCTCCTGCG
GCAACCAGCCATTGTTCAAGGACGGCAAGGGATGCGGCTCTTGCTACAAGATCAGATGCACCAAGGACCAGTCGTGCTC
CGGCAGGTCGGAGACGGTGATCATCACCGACATGAACTACTACCCGGTGGCTCCGTTCCACTTCGACCTCAGCGGCACG
GCGTTCGGCAGGCTCGCCAAGCCTGGCCTCAACGACAAGCTGCGCCACTCCGGCATCATCGACATCGAGTTCACCAGGG
TGCCATGCGAGTTCCCGGGGCTCAAGATCGGGTTCCACGTG

FIG. 2 continued

> SEQ ID NO: 5917 135016 196563_300704_1b
TCCACCAGCAATAACATTATATTGCAGCAATGGCATCCTCCTCCCTTCTACTCGCCTGTGTTGTGGTGGCGGCTATGGT
GTCCGCCGTCTCCTGCGGGCCACCCAAGGTGCCACCGGGCCCCAACATCACGACAAGCTACGGCGACAAGTGGCTGGAA
GCCAAGGCCACCTGGTATGGTGCGCCCAAGGGTGCTGGCCCCAAGGACAACGGCGGCGCCTGCGGGTACAAGGATGTCG
ACAAGGCTCCCTTCCTCGGCATGAACTCCTGCGGCAACGACCCCATCTTCAAGGACGGCAAGGGCTGCGGCTCATGCTT
CGAGATCAAGTGCTCCAAGCCGGAGGCCTGCTCCGACAAGCCCGCCCTTATCCACGTCACCGACATGAACGACGAGCCC
ATCGCTGCCTACCACTTTGACCTCTCCGGCCTTGCCTTCGGCGCCATGGCTAAGGATGGCAAGGACGAAGAGCTCCGTA
AGGCCGGCATCATCGACACGCAGTTCCGCCGCGTCAAGTGCAAGTATCCTGCCGACACCAAGATCACCTTCCACATCGA
GAAGGCCTCCAACCCCAACTACCTTGCGCTGCTAGTCAAGTACGTCGCTGGTGATGGTGACGTCGTGGAGGTGGAAATC
AAGGAG

> SEQ ID NO: 5918 135016 209350_300814_1b
CAGAATCCTACCTGACTAGTACTACCACTACTAGCTAGTAGCGAGCTACTCTCTCTGGTCATCAAGCTTTGAGTGGTTG
GAGTGGTGGCAGCTATGGCTTTTTCCATCTCCAAGAAGGCTGCAGTTGCTGCACTCTTCTCCTTCCTTGTTGTCACCTG
CGTCGCCGGCGCCAGGCCGGGGAACTTCAGCGCCTCCGACTTCACCGCCGATCCCAACTGGGAAGTCGCCAGGGCCACC
TGGTACGGCGCTCCCACCGGCGCCGGCCCTGACGACGATGGCGGTGCTTGCGGGTTCAAGAACACCAACCAGTACCCGT
TCTCGTCGATGACCTCCTGCGGCAACGAGCCTATCTTCAAGGACGGGAAGGGCTGTGGCTCATGCTACCAGATAAGATG
CGTCAACCACCCTGCCTGCTCCGGCAACCCGGAGACGGTGATCATCACCGACATGAACTACTACCCCGTTTCCAAGTAC
CACTTCGACCTGAGCGGCACGGCGTTCGGCGCCATGGCCAAGCCGGGGCAGAACGACCAGCTCCGCCACGCCGGCATCA
TCGACATCCAGTTCAAGAGGGTGCCGTGCAACTTCCCTGGGCTGAAGGTGACGTTCCACGTGGAGG

> SEQ ID NO: 5919 135085 125253_300629_1b
ATTTCTTTCTTCTATTTACTCTTCAACTCAATTTTTATTAACATTGAAAAAGAAATCTAATTAAGTAATGGCAGTGTCA
GCGGTAGCAACTCTTCTATTTCTTCTTGTTGCTTCTCCGGTTGCTTTTGCCGCCAACCATGTCGTTGGAGGCAGTGGCG
GGTGGAGCCAGACCGTAGATTACTCCACTTGGGCTGCTGGTGAAACCTTCAACGTTGGTGACACCCTTGAGTTCAACTA
TGGTGCAAGCCACAGCGTGGATGTAATAAGCAAAGATGACTATGAAATTGCAACACCGGAAACGCCCTCGAGTCTCAC
AGCGACGGCAAAACCACCATCAAACTTTCCAAGGCCGGTCCAATGTACTTCACTTGTTCCACATTTGGTCACTGTCAAT
CTGGCATGAAATTAACCGTCGATGTCAAAGATAGCTCCTCCACTCCGTCAACTCCGTCAACTCCTTCAACTCCTTCAAC
CACTCCTTCAACTCCGTCAACCACTCCTTCAACTCCTTCTGACTCACCCACCACACCCACCCCTGAGGTTGGCAACTCG
CCGTCGAAGTCGACACCTGTAGCACCTAACGGAGCAGCCGGAGTTATGGGCAAAACTGTAGTCGGATTTTCAGTTGTGT
TGGGAGCTATGTTTGCGTTCATGTGCT

> SEQ ID NO: 5920 135085 254615_301634_1b
TTCTCTCTCTCTACTAGAATAGCCTCTCCAAGAGGACAGAAGGGGATTGAAGAGGAAGAAGAGGAGGAGAGAGAGAAGA
AGAAGAAGAAGATGGGTCTAAGGCAGGGAAGTGGCAGTGCATTGTCTCTACTAGTGGTGGCTTCGGTTGCTCTTCTTCT
CATGGTAGGATCTGCTAGAGCTACTGAGCACATTGTGGGAAGCTCTGCGGGATGGCTTGTTCCGTCTGCGAACGTAAAT
TACACCACCTGGTCTTCCACAAATATCTTTCATGTCGGAGATACCCTCTTGTTTAAGTACAGCAATATCAGTCACAATG
TGGAAGAAGTGACTGAAGCCAACTACAACGGATGCAACACGGTAAGCCCCATATCTACTTACACGGATGGAAACACGAC
AATCGAACTCACCAAGACAGGCATGCATTACTTTCTATGTGGTTTCCCGAGCCACTGCCTGGGGGGTCAAAAGGTCTCT
GTAAATGTAGTTGCGGAGGGCACAACATCCAACTCAACATCCAACTCAACTGGGTCCTCAAGTGGGGTTTCGCTATTGG
ATTTTAATCTCATATTCAAGCCCTCATCACCCCTGCTAGGTATTGGGTTCTTCTTCACCCTTCTCTCTTTGATCTTTTA
AATGTAAATATAGCTCAATTTGAGCCTTTTTTCTCAAGAGAATGGTTGGAAATTTAAGA

> SEQ ID NO: 5921 135085 267893_200119_1b
CCCTCGACCACGCGTCCGGTCAAGTTAGGACAAAATCATTTTGTCACCAACATGGAGACTCTACGAAAATCTTTGTTGA
TTTTTGCTATTGTTGTGACAGTAATATACCAGAAAAAAGCAATGGCGGCACAACATGTTGTTGGGGGAAGCCAAGGATG
GGATGAATCTAGAGTTAACTACTCCTGGGCGTCTGGCGAGACATTCAAAGTTGGAGATACACTAGTATTTAGGTACAAT
CCAGGTCTTCACAGCGTTGTCGAAGTTGAGGGTGAAAGTGCATACAAGAGTTGTGATACAAGCAGTTCAGTGAACTCAA
TGAGTGCAGGTAACGATGTTGTTAAACTAAACAAACCAGGGACTAGATATTTGCTTGTGGAACAGCAGGTCATTGTGA
TCAAGGAATGAAGCTTAAGATCACAACTGTTACTGGAAATGCACCTTCTAATCAGGCTGCTACTTCTTCGAATCCTAGT
TCTTCTTCTGTGGCTGATTCGCGTCGTTTTTCTACTGCGTTCTTCACTTTCGTAGCAGCGATATTTACTATACAAATGG
CTCTAGTCTTCCAGTTATAAGATAAACTTGCTTTATTTGGTTCTATGATGAGGAGTAGCTGGTATTTATAGGGAATGGA
GTACTATGTTAA

> SEQ ID NO: 5922 135085 271427_200034_1b
AAACTAACTCTCTATCTCTCTTCCTTAAAGAACACAGTTGGTAGAAACAAGAAAACACAAGCAACATGGGAACTTTTAA
TTCTGGGATTATTTTCGTTTTCGTTTTGTTCATATGTTGTGTTGTACCAAGTTTTGCCACAGTTTATACTGTTGGAGAC
TCAGCTGGCTGGGCAATTGGCGTGGATTATAGCACTTGGGCAACTGGAAAAACGTTTAATGTTGGTGATTCACTTGTTT

FIG. 2 continued

TCAACTATCCAAGTGGTCACACAGTGGATGAAGTAAGTGCTAGTGACTATCAGTCATGCACTGTTGGAAATTCCATAAC
GTCCGATCAGAGCGGCGCCACTACTATTCCTCTCAAGACCGCCGGGACTCGTTACTTCACTTGTGGCGTAATGGGCCAT
TGCAGCGGCGGCATGAAGCTTGCCGTCACCGTTGCGGCAGCCAGTGGCGGTGGAGGAGGTTCCACCACACCATCATCCG
GCACCACCACACCATCATCCGGCACCACTACTTCTACAGCTACCCCTACACCTGAAACTACTAATACTACTACTGGGAC
AACTTCACATCCATCAGCATCAGTTACTTTGTCACCATT

> SEQ ID NO: 5923   135085 201111_300713_1b
TTTGATTCTTCCTTCAATTTCCCCTTTTCAACTCTGTCATCAACTTAATTGTTAGAAGCGACCTAAAGATTTTGCGGCC
GATCGAGCATGGCGTCCCCTTCGGCTCTGATCGCAATGCTCCTCGTCATGGTCGTCGGCTGCGCCGCCGTGGCCTCGGC
GATGGAGCTGAGTTTCATTGTCGGAGATGCGCAGGGTTGGAACACCGGCGTCGACTACACCGCTTGGGCGAAGGGCAAA
ACCTTCGAGGCTAACGACACGCTTGTATTCAGATACGCCAGGAAGCAGCACACGGTGACAGAGGTGACCAAGAGCGACT
ACGACGCCTGCACCGTCAGCGGCAAACCGATCAGTCGATTTCGAAGGAGGCGCGCTTGTGACATTCATAGCGCTCAGCC
CGGCGAGCACTACTTCATCTGCAAAATCGGCAACCATTGCGCCAGCGGCATGAAGCTCGCCGTCACCGTCTCCAACTCC
AGCGACACCCCGAGGCCGCAACCTTGGATTGGGCCTTACTCCACGCCAGCCAGCGCGTCCGCACACCTGCACGCCGGTG
GCGCCGTCGTCGCGGCGGCCGTTGGGATCCTCCTCAATCTCGCCCTCTTCTGAGATCGCATTGACGC

> SEQ ID NO: 5924   135085 202310_300732_1b
ATCGATTTCTAGCTTAGCTTCTACTGCCAATTGCTTGGAGATCGATCGACCATCATCTCCATCGATCCTCAAAGTCGAT
ATATAGCTAATTGGACCATATTCCATGGCGATCATGGCAGCCAGAGCTCTCCTCGTCGTCGCCATGGCGGCGGCGGTGC
TCGGAACGGCGCTCGGCGCCACCTACACCGTCGGAGCTCCGAGCGGCTCATGGGACTTGAGGACTAACTATGACCAGTG
GGTTTCCAACATCAACTTTCGTGCCGGAGACCAGATAGTGTTCAAGTATTCTCCAGCGGCTCATGATGTGGTGGAGGTG
AACAAGGCCGACTACGACTCATGCTCCAGCTCCAGCCCTATCGCCACCTTCAACTCCGGCGATGACACCATCCCTCTCA
CCGCTGCCGGCACCCGCTACTTCATATGTGGCTTCAATGGCCATTGCACCGGAGGGATGAAGGTCGCTGTCAAGGTTGA
GGCCGCCACCGGCAGCAACCCGGCCCATCACCGATGACCCTCGACCACGCACACCGACAGCAATGGCACCGAACGCA
ATGCCGCCAACGGCTGGTGGCCGGCCCGTGCCTCCATCTAACTCAGCAAGCCAGCCCACTGGTGTTGCATCTCTAGTTG
GTCTTAGTTTGGGTGCCATAGTTGTTGGTCTCATGGCCTTCTAAATTAGAGTAAGAAGATACT

> SEQ ID NO: 5925   135224 201035_300712_1b
CCCACGCGTCCGCCTCTCGCCGTCGCAGATCCGATCCAGGAAGAGCTCGCCGCCGCCGCTGCCATGGCGCTCTCCGTGG
AGAAGACCTCGTCGGGGAGGGAGTACAAGGTGAAGGACCTCTTCCCAGGCGGACTTCGGCCGCCTCGAGATCGAGCTCGC
CGAGGTCGAGATGCCGGGGCTCATGGCGTGCCGCGCCGAGTTCGGCCCCTCCCAGCCGTTCAAGGGCGCCCGGATCTCC
GGGTCCCTCCACATGACCATCCAGACCGCCGTCCTCATCGAGACCCTCACCGCCCTTGGCGCCGAGGTCCGCTGGTGCT
CCTGCAACATCTTCTCCACGCAGGACCACGCCGCCGCCGCCATCGCCAGGGACTCCGCCGCCGTGTTCGCCTGGAAGGG
GGAGACCCTCGAGGAGTACTGGTGGTGCACCGAGCGCTGCCTCGACTGGGGCGTCGGCGGCGGCCCCGACCTCATCGTC
GACGACGGCGGCGACGCCACGCTGCTCATCCACGAGGGCGTCAAGGCCGAGGAGGAGTTCGAGAAGTCAGGCAAGGTCC
CCGACCCGGAGTCCACCGACAACGCCGAGTTCAAGATCGTGCTCACCAT

> SEQ ID NO: 5926   135224 225917_301051_1b
CAGCGAAAATGTCTAAACCTGCATACAAAGTTGCTGACATCTCTTAGGCAGAATTCGGCCGAAAGGAGATCGTTATGGC
AGAGAACGAAATGCCTGGATTGATTTCAATCCGCAAAATATGGACCGGAAAAGCCGTTGAAAGGAGCTCGAATTGCT
GGGTGTCNATTAACTCCTATTCAAACCGCTGTCTTGATTGAAACTTTGACTGAGTTGGGTGCAACAGTTCAATGGTCTT
CTTGCAACATTTACTCGACACAAGACCATGCTGCCGCTGCTATTGCTGTCACTGGCGTACCAGTCTATGCTTGGAAGGG
CGAAACTGACGAGGAGTATGAATGGTGCA

> SEQ ID NO: 5927   135224 266883_200031_1b
CGGACGCGTGGGCTTCTCTAAAACCCTTATAGAAGAAGAGAAAAAAGCCTCTCAAATCTCATCTCAAACCACCTAATTT
CTCTCATACTCGCTCGACCCATGGCTCTATTAGTCGAGAAAACCACCTCTGGCCGCGAGTACAAGGTCAAGGACATGTC
TCAGGCCGATTTCGGCCGGCTCGAAATCGACTGGCCGAAGTTGAAATGCCTGGTCTCATGGCTTGTCGTACTGAATTT
GGCCCATCACAACCATTTAAAGGTGCTAAAATTACTGGATTCTTTACATATGACCATTCAAACTGCAGTTTTGATTGAAA
CCCTTACTGCTTTGGGTGCTGAAGTTAGATGGTGTTCTTGTAACATCTTCTCCACTCAAGATCACGCCGCTGCTGCCAT
TGCACGTGACAGCGCTGCCGTGTTCGCGTGGAAGGGTGAAACTTTGCAGGAGTACTGGTGGTGCACTGAGAGGGCACTT
GATTGGGGTCCAGGAGGTGGTCCCGACTTGATTGTCGATGATGGTGGTGATGCTACACTCTTGATTCATGAGGGTGTTA
AGGCAGAAGAAGAGTTTGCTAAGAATGGGACAATCCCAGATCCTAACTCTACCGATAATGCTGAGTTTCAGCTTGTGCT
TACTATTATTAAGGAAAGTTTAAAGACTGATCCTTTAAAGTATACTAAGATGAAGGAAAGACTCGTCGGTGTTTCTGAG
GAAACTACCACTGGGGTTAAGAGGCTTTATCAGATGCAAGCTAATGGAACTTTGCTCTTCCCCGCTATTAACGTTAACG
ACTCTGTTACCAAGAGCAAGTTCGACAACTTGTACGGATGCCGCACTCACTGCCCGATGGTCTCATGAGGGCTACTGA
TGTTATGATTGCCGGAAAGGTTGCCCTTGTTGCGGGTTACGGAGATGTCGGAAAGGGATGTGCTGCTGCCTTGAACAAG
CTGGTGCCCGTGTGATTGTGACCGAGATTGACCCGATCTGTGCTC

FIG. 2 continued

> SEQ ID NO: 5928 135224 1044981_301919_1b
TGTAAACCCCTCTCTCTTTCCACTCTCTCTCTGTCCCATTTCCGTCGTCTTTGTTGCAGCTCACTGCAAGTCTTCTT
CCTTCAGGGTGAAGAGGAACTTCTAGAGCTTTGCAACCTTAGCTCGACGGAAATGGCAGCCATGGAACTATCAGTACAG
AAGACCTCTAGCGGTCGGGAGTACAAGGTCAAGGACATGTCCCAGGCTGACTTTGGCCGTCTTGAGCTTGACTTGGCCG
AGGTGGAGATGCCGGGTCTCATGTCCTGCCGAACCGAGTTCGGGCCAAGCCAACCCTTCAAGGGGGCCCAGATCACAGG
ATCCCTCCACATGACCATCCAAACTGCAGTGCTGATTGAGACCCTGACGGCATTGGGTGCTGAAGTCCGCTGGTGCTCA
TGCAACATCTTCTCCACCCAGGACCATGCGGCGGCTGCGATTGCTCGCGACAGCGCTGCCGTTTTGCGTGGAAGGGCA
TGTCCCTCCAGGAGTACTGGTGGTGCACCGAGCGGGCCCTTGACTGGGGTGTTGGAAGCGGCCCTGACCTCATTGTCGA
TGACGGAGGA

> SEQ ID NO: 5929 135281 127764_300472_1b
TCTCTCTGTATTTGTTCTTCTTAAAAATCCCTTTTACAGAAAACCCAAAAGTAGTGCAAAAATTGAGAATTAATGGCAA
ATCTAGGAGGAATTCGTGAGGCAGGAGGATCTGAGAACAGCCTTGAGATCAATGATCTTGCTCGCTTTGCTGTTGATGA
ACACAACAAGAAACAGAATGCACTTCTGGAGTTCGGAAAGGTTGTTAATGTGAAGGAACAAGTGGTTGCTGGAACCATG
TACTACATAACACTGGAGGCAACTGAAGGTGGTAAGAAGAAAGCATACGAAGCCAAGGTCTGGGTGAAGCCGTGGCAGA
ACTTCAAGCAATTGGAAGACTTCAAGCTTATTGGGGATGCCGCTAGTGCTTAACAAGTGCTAAATGAATGCATCTTATG
CTTGTGAAAATAAAGGTAACATAGTTTCGCTTGCGAGTATTTGAATATCGTAAAGTAAGCTTTAAACTATGTCGTAGTG
TTAAGTTACAAGTAACTGTAACTTTACAATGTTCCATATTTCATATTTATATGGTCCTCCATATGATAGTTCTATGATAT
ATCTTGTATATGTACTGCTTTTCTATTGCTAATATATATCTGAGAAGCATAAGCAATTGCCTTTTTGA

> SEQ ID NO: 5930 135281 138595_300774_1b
CACGCGTCCGCCCACGCGTCCGCCCACGCGTCCGGCCGCCCTGCTCGTGCTGCATTCGCTAGCCACGCCGTCCGCTCAG
GCCGAGGCGCATCGCGCAGGGGGAGAAGGGGAGGAGAAGATGTCGAGCGACGGAGGGCCGGTGCTTGGCGGCGTCGAGC
CGGTGGGGAACGAGAACGACCTCCACCTCGTCGACCTCGCCCGCTTCGCCGTCACCGAGCACAACAAGAAGGCCAATTC
TCTGCTGGAGTTCGAGAAGCTTGTGAGTGTGAAGCAGCAAGTTGCTCGCTGGCACTTTGTACTATTTCACAATTGAGGTG
AAGGAAGGGGATGCCAAGAAGCTCTATGAAGCTAAGGCTCTGGGAGAAACCATGGATGGACTTCAAGGAGCTCCAGGAGT
TCAAGCCTGTCGATGCCAGTGCAAATGCCTAAGGCCCATCTCGTATCCTATGTGTATCAAGTTATCAAGAAGATGGGGA
ATAATATGGTGTGGATATAGCTATTGGACATGTTAATTATCCACATGATAATATGGCTTGGATATAAGGATCTCACACG
ATAATATGGCTTGGATATATAGCTATTAAAGATTTTACCTATGGCATATTTCAATGTGTATTAGTACTAAGTAAGAATG
ATTGCAAGGTGTATTAACTACAAATATTGCAATAAAAGTCCCTGTTACTAC

> SEQ ID NO: 5931 135281 159760_200141_1b
CCCACGCGTCCGGTTGAAGGAGAAAAGAGAAACGAGTGCAGTCTGAGTCTGTCCACAGATGAGAGTATCTCGAAACGCC
ACACTGCTATTTGTTTTAATTTTGTCATTAAGTTTTCTCTTCTCTGCGTTTGGGTTAAGCGAAACCGGAGGAGGATTTT
GCGGTGAAGAGGAAGAGAAAAGGAAATAATCTGATTGCAGATCGCTACTCTTGGTGGGGTTCGTGATTCGCATGCTTCGTC
CCACAACAGCGACGAGATCCATAACCTTGCCAAATTTGCTGTCGATGAGCACAACAAGAAGGAGAATGCGATGATTGAA
TTTGCCAGAGTTGTGAAGGCGCAAGAGCAAGTTGTTGCTGGTACACTGCACCATCTGACTCTTGAGGTCATAGATGCTG
GAAAAAAGAAACTCTATGAGGCTAAGGTCTGGGTCAAACCATGGTTGAATTTCAAGGAACTTCAAGAGTTCACTCATGT
TGAAGATGTTCCTACCTTAACTTCTTCAGATCTAGGTGTTAAGCAAGAAGAGGAAGGCTCTGGATTGAAGTCAGTGCCT
GTGCATGATCCGGTGGTTCAGGAAGCTGCAGAGCATGCAATTAAGACCATCCAGCAGAGATCCAACTCGCTACTTCTGT
ATGAACTCCAAGAGATTGTTCATGCAAATGCTGAGGTCATTGGGGAGGACAATATGAAGCTTCATATGCTCATCAAAAC
TAGCCGGGGAGGGAAGCGAGAAAAGTTCAAAGTTCAAGTGCACCATA

> SEQ ID NO: 5932 135281 317136_301453_3b
GTGTTCGACTTCAAGTACCCCGCATTTTGTGGTAATTTCTGCTGTGCATAGATGGAAAATATCAATTTGTTCCAGATGC
GGCAAAATTTATCACAAAATTAGGTAGAACTGATGTGAGAGATGTAGAAGTTTTGAGTGAGATTTATATCTCTATCAAT
GACAATTACAAATCTTACAAAGACTTTAAGGTGCTTGATGCTTTGGATAAGGCTTTAGTGGATAGATATCGATCCCCTT
ATAGTGCTATTTCTGCTTTGGTTTCTTTATGTTATCATATCTTTGACTTTAATAAGTTTAAGTTGCTGTTTAATTGTGA
AGGGAAATTTGTGGATAAGAAGCTGAGAAAAGACTTCGAGTGGTGAACTCTAGGTCCTGATGTTTAAATCTACTGTATT
TACCTTCGCATTAATTAAGCATGGCCGAGGAGGCGCAGAGCCACGCGGCGTGAAGGTGGGCGGCATCCACGACGCGCCG
GCCGGGCGCGAGAACGACCTCACCACCGTCGAGCTCGCCCGGTTCGCCGTCGCCGAGCACAACAGCAAGGCCAACGCGA
TGTTGGAGTTGGGGAGGGTGGTGAAGGTGAGGCAGCAGGTGGTGGGCGGGTTCATGCACTACCTCACCGTCGAGGTGAA
GGAACCCGGCGGCGCCAATAAGCTGTACGAGGCCAAGGTGTGGGAGAGGGCGTGGGAGAACTTCAAGCAGCTCCAGGAT
TTCAAGCCCCTCGACGACGCCACCGCCCGCGGCCGCTTATCCGTATGATGTTCCGGATTATGCCGAGCTCTACAAACAG
CTGTTGAATTTTGATTTGCTGAAGTTGGCGGGTGACGTGGAATCTAACCCTGGTCCTAGGTCTAGAATGGCTACTTTCT

FIG. 2 continued

```
CTTGTGTGTGTTGTGGTACCTTAACTACAAGTACTTACTGTGGTAAGAGATGTGAGCGAAAGCATGTATATTCTGAAAC
AAGAAATAAGAGATTGGAACTTTACAAGAAGTATCTATTGGAACCGCAAAAATGCGCCCTGAATGGAATCGTTGGACAC
AGTTGTGGAATGCCATGCTCCATTGCGGAAGAGGCTTGTGATCAACTGCCAATCGTGAGTAGGTTCTGTGGCCAAAAGC
ATGCGGATCTGTATGATTCACTTCTGAAACGTTCTGAACAGGAGTTACTTCTTGAATTTCTCCAGAAGAAGATGCAGGA
GCTGAA

> SEQ ID NO: 5933 135281 317344_301481_1b
TTCGCATTATTATGCATGTCGAGCGACGGAGGGCCGGTGCTTGGCGGCCTCGAGCCGGTGGGGAACGAGAACGACCTCC
ACCTCGTCGACCTCGCCCGCTTCGCCGTCACCGAGCACAACAAGAAGGCCAATTCTCTGCTGGAGTTCGAGAAGCTTGT
GAGTGTGAAGCAGCAAGTTGTCGCTGGCACTTTGTACTATTTCACAATTGAGGTGAAGGAAGGGGATGCCAAGAAGCTC
TATGAAGCTAAGGTCTGGGAGAAACCATGGATGGACTTCAAGGAGCTCCAGGAGTTCAAGCCTGTCGATGCCAGTGCAA
ATGCCGCGGCCGCTTATCCGTATGATGTTCCGGATTATGCCGAGCTCTACAAACAGCTGTTGAATTTTGATTTGCTGAA
GTTGGCGGGTGACGTGGAATCTAACCCTGGTCCTAGGTCTAGAATGGCTACTTTCTCTTGTGTGTTGTGGTACCTTA
ACTACAAGTACTTACTGTGGTAAGAGATGTGAGCGAAAGCATGTATATTCTGAAACAAGAAATAAGAGATTGGAACTTT
ACAAGAAGTATCTATTGGAACCGCAAAAATGCGCC

> SEQ ID NO: 5934 135281 8087_300316_1b
AGAGAAGACGATGATGCTAGGAGGCGTTCATGATCTCCGAGGAAATCAGAACAGTGGAGAGATCGAGAGTCTCGCTCGA
TTTGCCATTCAAGAACATAACAAACAACAGAACAAAATTCTTGAGTTCAAGAAGATTGTCAAAGCAAGGGAGCAGGTAG
TTGCAGGAACGATGTACCACTTAACCCTAGAAGCAAAAGAAGGTGATCAGACTAAGAATTTTGAAGCCAAAGTGTGGGT
GAAGCCATGGATGAACTTCAAACAGTTGCAGGAGTTCAAGGAATCATCTTCTTGAATTTCACTTGTTCAAGTTAATGAT
TACAAATGCTCTGAGAGTAATTAATTATAT

> SEQ ID NO: 5935 135357 1101328_301475_1b
CCCCTAGAGGTTGCACACTGCGCATCATCACCCTCCTCGTCTCTCCATCTCAGGTGAGACGTTACTATCTTTCTATGTT
CTTATGTCATTAGTGGTGATTGCAAGACTTAGGTCTGCATCTCAGTCATTGAGAGGCATTGGACAAAATCATACAATCA
AAGCTTGCTTCTTCCAGAGAAAATTTGCATATATTTCTGAAGCGAAGGCCATGGATGCCCCGGAGGAGATTAGTAAGAT
AAAGATGTTTGGTGGATACATTAAACGCTACAAACATCAGAGCTCTACACTTGGCTGTGCTATGAATTTCACGATATAT
TTCCCTCCTGCTGCACAAGAGAAGAAAGTTCCTGTTTTATACTGGCTGTCGGGGCTTACATGCACGGATGAAAACTTTG
TGCAAAAAGTGGAGCTCAAAGAGCAGCTGCAGCTTGTGGCATAGCTTTGGTAGCTCCAGATACATCACCAAGAGGTCT
TAACGTGGAAGGAGAATCAGAAAGTTGGGATTTTGGTGTTGGGGCTGGTTTCTATCTTAACGCTGCACAGGAGAAATGG
AAGAACTGGCGAATGTATGACTATGTGACGGTAGAGATACCGAGGCTCCTTAGTGCTAACTTTGGTGAGCTTGATACAG
CATGCGCTTCTCTCTCTGGACAC

> SEQ ID NO: 5936 135357 181796_300627_1b
GATCCGAGAACAGCAGATTCAGAGATGGAGGAAAAACCCTGTGAGATCAGCAGCGTAAAGATGTTTGGAGGTTACAATA
AGAGATATAAGCACTTCAGTCCGACTCTGGGTTGCTCCATGACCTTCCACATTTACTTCCCTCCATCCCCTTCTCCATC
CCACAAATTTCCTGTACTTTATTGGCTGTCTGGCCTAACTTGCTCCGATGAGAACTTTATTGTCAAATCTGGAGCTCAG
CGTGCAGCTTCCAGCGAAGGTGTTGCGCTAATTGCCCCAGATACATCCCCAAGAGGCCTTGGAGTGGAAGGAGAGGCAG
ACAGCTGGGATTTTGGTGTAGGTGCTGGGTTTTATCTTAATGCTACTCAAGAGAAATGGAAAAACTGGCATTCAATGGG
TGGGCATGGTGCTTTGACAATCTACTTGAAAAACCTCGACAAGTACAAGTCTGTATCCGCCTTTGCACCTATTGTTAAT
CCCATAAATTGCCCATGGGGTCAGAAGGCTTTCTCAAACTATTTGGGCGACGAAAAATCTGATTGGGAGGAATATGATG
CCACTTGCCTAATTTCTAAGTACAACAATGTTTTGGCCACCATCCTAATTGATC

> SEQ ID NO: 5937 135416 19067_300216_1b
CTCGAGCTTGCGGCCGCATCACTCCCAAGATTCGCATTACCTTTCTTATAATCGCCGAGATTGTTCGAGCCTGAATAAT
CAAAATGGTTGTGCTTGCTGCTGCCATTGTGGTCAAGTCTGGGAAAGTGATTGTTTCCAGACACTATGTGGATATGTCC
CGTATCAGAATCGAAGGTCTACTTGCAGCTTTTCCTAAGCTGGTTGGAATGGGAAAGCAGCATACCTATATCGAGACGG
AGAATGTGCGATATGTTTATCAGCCTATTGAAGCTCTGTTCCTGCTTCTTGTTACAACTAAGCAGAGTAACATTCTAGA
AGACCTGGCCACCCTTACTTTGCTCTCCAAACTTGTACCTGAGTATTCCATGTCTTTAGATGAAGAAGGGGATTTCCAGG
GCATCTTTTGAGCTCATATTTGCATTTGATGAAGTCATATCTCTTGGGCACAAGGAAAGTGTGACAG

> SEQ ID NO: 5938 135416 225845_301050_1b
GAGACACTGAGGCTGCTCTCCAAACTGATTCCTGAGTACTGCACGTCGTTGGAAGAGGAGGCTGTTTGCAAGAATGGCT
TCAAGATCATTTTCGCTTTCGACGAAGTGATATGCCAGGAACACAAGGAGGCTGTCACGGCGTCTCAAGTAAAAGAGTA
TATTGAAATGGACAGTCAGGAGGAGAGGATGCATAGGATGATGATGCAGACCAAGATCAACGAGACGAAGGATTTGATG
AAGAAGAAAGCGAACGAGATCGATAAGAGCAAGCTCGACAAAACAAGACCGGATAGAAGCGGGATCATGTCCGTGCCTA
TCACTTTTGATAACGGTTACGATGTTCCCTCGACTGGAAGAAGCAACGGGTTTGCGGCCGAGATTGAAAGCAAGACCAA
```

FIG. 2 continued

AGGCCGACCAACAACAGCGGGAGCTGCTTCTGGCAAGAAGGGAATGCAGCTGGGCAAGGGACAGAAAAATAGCCGAATT
ATAGAGTCCCTGAAGGCGGAAGGGGAGGATATCGTAGAAGACGTTCAAGCTGCGGCCGTGGTAGGCTCTTTAGCGACAA
ATATACCGACGGATCCGATCGCTGTTATAGTCGAAGAGAAAATCACTGTCCAATGTAAGAGAGACGGTGGCTTGGAATC
GTTCGATCTGCAAGGAACATTGTCTCTTGTGGT

> SEQ ID NO: 5939  135416 248866_301587_1b
TCCACCGGAGCACACGAAAATGGTAGTTCTAGCGTCGTCCATTATCAATAAGAGTGGGAAAGCACTCGTTTCCCGGCAG
TTTGTGGAGATGACGAGAATTCGAATCGAGGGACTTCTCGCTGCGTTTCCAAAGCTTGTTGGTACTGGCAAGCAGCACA
CTTTTGTGGAGACTGACCACGTCCGGTATGTGTATCAACCTATGGAGTCCTTGTATTTGATCCTCGTCACCAACAAGCA
AAGCAACATTCTACAAGACTTATAGACC

> SEQ ID NO: 5940  135416 254517_301633_1b
ACGCGTCGGAGAGAGAAGAGAGAGAGAGGGCGAGCCTGTTTAGGTCCAAGAAGTTCCATCGGCCTTTTCATACTCTGCG
CTTTCTCTCTCGTCAAAATGGTGGTCTTGGCGGCGTCCGTCATCTCCAAAACCGGCAAAGCTCTTGTTTCGCGTCAGTT
TGTTGACATGACACGGATACGGATCGAGGGCTTGCTGGCAGCATTTCCCAATCTGGTTGGCAGTGGCAAGCAACACACT
TATGTTGAGACGGAGAATGTTCGCTATGTTTACCAACCGATGGAATCTCTATACTTGCTACTCGTTACCAACAAGCAGA
GCAATATTCTTGAAGATCTTGACACACTTCGCATGCTCTCTAAAATTGTGCCGGAGTATTGCCCCTCTCTGGAAGAGGA
AGCCATCTGCAAGATGGCGTTTGAGATTATATTTGCCTTTGACGAGGTTATATCCCTAGGGCACAAGGAAAACATCACC
ATCGCGCAGGTGAAGCAGTACACGGAGATGGAGAGCCACGAAGAACGGCTACACAATCTGATTGTTCAAAGCAAGATAA
ATGAGACCAAGGATGTGATGAAGAAGAAGGCGAGTGAAATCCAAAAGAACAAGACGGAGAAAATGCGGTCAGA

> SEQ ID NO: 5941  135416 275319_200155_1b
TCTTCGTCAGCAAGTGTTCTTCACTCTGGTGGTATACGATCTATTGCCTAAGATCTGATTCAGCAAAATCTACTAAGCA
GCGAAGATGGTTGTTCTTGCGGCTTCGATAATTTCTAAATCTGGCAAAGCACTTGTCTCGAGGCAGTTTGTTGATATGT
CTCGTATAAGAATTGAAGGGTATCTTGCAGCTTTCCCCAAATTGGTTGGTACAGGAAAGCAGCATACATATATTGAGAC
TGACAATGTGCGATATGTTTATCAACCGATAGAGTCTTTGTACTTGCTACTTGTGACCAACAAACAGAGCAACATTCTT
GAAGATCTTGAGACACTGAGGCTGCTGTCTAAACTAGTGCCTGAATATTGTCATTCACTAGATGAGGAAGGAATTGGCA
GTACATCGTTTGAGCTTATTTTTGCATTTGATGAAGTGATCTCTCTTGGACACAAGGAAAATGTTACAGTTACACAAGT
CAAGCAGTATTGTGAAATGGAGAGCCATG

> SEQ ID NO: 5942  135668 39440_300196_1b
CCCACGCGTCCGACGAACACTTACAAAAAAAAATCTCTTTGTGAGCTTTAGCGATCGTAACAATGGCGAACGAGGTGAT
TCTTCTTGATTTCTGGCCGAGTATGTTCGGGATGAGGACAAGGATCGCATTGAGGGAGAAAGGTGTTGAATTTGAGTAC
AGAGAAGAAGATCTAAGGAACAAGAGTCCTTTGCTTCTCCAGATGAATCCGATTCACAAGAAGATTCCTGTTCTCATCC
ACAATGGTAAACCGGTTAACGAATCTATCATCCAGGTTCAGTACATTGACGAGGTCTGGTCTCACAAGAACCCTATCCT
TCCTTCTGATCCTTACCTGAGAGCTCAAGCTAGGTTCTGGGCTGATTTCATTGACAAGAAGCTGTATGATGCTC

> SEQ ID NO: 5943  135668 44079_300028_1b
CGGACGCGTGGGTTTTGTCAAGCAATCCTTAATTTTCAGCGAAAAAATGGCAGATGAAGTTGTCCTTTTGGATACCTA
TGTAAGCGTGTTTGGGATGAGGGTTAGGTTTGCGCTGGCCGAGAAAGGCATAAAGTATGAATACAAGGAGCAGGATTTG
CTGAACAAAACCCCTCTTCTCCTACAAATGAACCCAATTCACAAGAAAATTCCAGTCTTGATCCACAATGGAAAACCAA
TATGTGAAACCCTTATCATTGTTCAGTACATAGATGAAGTTTGGAAGGACAAATCCCCTTTAATGCCCTCCGACCCTTA
TGAGAGAGCTCAAGCTAGGTTTTGGGCTGATTATATTGACAAAAAGATTTATGATGCTGGAAGGAAAATTTGGACTACA
AAAAAGGAGGATCAAGAAGCAGCAAATAAAGAATTCATAGAGTGCTGGAAGTTATTGGAAGGGAGTTAGGAGACAAGC
CATACTTTGGAGGGGAAAGTTTTGGGTTTGTGGATATGGCCCTTATTCCTTACTATTGCTGGTTCCCTACTTATGAGAA
ATTGGCAATTTTAGCATAGAGGCAGAGTGTCCTAAGATTGTGGCATGGGCTAAGAGGTGTATGCAAAGGAGAGTGTC
TCAAAGTCTTGTTGACCCTGGCAAAGTCTATGAT

> SEQ ID NO: 5944  135668 50885_300186_1b
CCCACGCGTCCGAGAAGAAGTCATGGCTCAGAACGATACAGTGAAGCTGATAGGTTCTTGGTCTAGCCCTTATTCCCTT
AGGGCACGTGTGGCTCTACACTTGAAATCTGTCAAGTACGAGTACTTAGACGAACCTGATGTTCTTAAAGAAAAGAGTG
AACTCCTTCTCAAATCTAACCCCATCCACAAGAAAGTCCCTGTCCTCCTCCATGGTGACCTCTCCATCTCTGAGTCCCT
CAACGTTGTTCAATACGTCGACGAGGCTTGGCCCTCCGTTCCTTCAATCCTTCCTTCTGATGCCTATGATCGCGCATCT
GCTCGGTTTTGGGCTCAGTACATCGATGACAAGTGTTTTGCGGCGGTGGATGCGGTGGTCGGAGCAAAAGACGAC

> SEQ ID NO: 5945  135668 242610_301331_1b
AATCCCATCCACAAGAAGATCCCGGTCCTCAGCGCTTGGGCGAGCCCCTTCAGCATGCGAGTCAAGTTGGCACTCACAC
TCAAAGGCATCGAGCACGAAGATCTTCCACAGGATCTCAGCAACAAGAGCAAGCTGCTGCTCGACTCCAATCCCATCCA

FIG. 2 continued

```
CAAGAAGATCCCGGTCCTCATCCACAAGGGGAGGCCACTGCCCGAGTCAGTCACCATTGTCCAGTACATTGATGAGGTA
TGGCCTGGAAAGTCCCCGCTGCTGCCTCAGGATCCATTCCTTCGTGCCGAGCACCGCTTCTGGACCGACTTCATCGACA
AGAAGTTCTTCGACTGCTTCATGCGCTTCATGCGCACTGAGGATAATGCGGCAATCAACGAAGAATTTGTCGAGAATTG
GATGCATCTCGAGAGAGCGCTTGAGAAGCTCGGAAGCGAGAAGGGGCCGTTCTTTGGCGGCGAGAGCATGTCGTTCCTG
GACGTGATTCTTGCCCCTTTCAGCGTTTGGATCCCTGCCGGTGGCAATGTCCTCGGCTTCAAGACGCCCCATGAGAAAT
GCCCGCGTCTACACAAGTGGTTTGCTGCCATCTCTGAGCATCCCGATGCCAAGGCCGCTTTGCCTCCAGTCGGGAAGAT
GGAGGAGTTCATCCGAGGT

> SEQ ID NO: 5946 135668 244902_301563_1b
AGAGGGGCATTGAAGCATTAGCAGCACAGCAACAATGGCGAGCGACAGCGTGAAGGTCCTCAACTTCTGGCCGAGCATG
TTCGGCTTGCGCGTCCACTACGCTCTGGACCTCAAAGGTGTGCCTTACGAGTACAAGGAGGAGGACTTGGCGAACAAGA
GCGAAGAGCTCCTCAAGGCGAATCCCATCTACACCAAGATCCCGGTTCTCATCCACAATGGCAAGCCTGTCTCCGAATC
CCTCATCATCCTTGACTACATCGATAGCGTCTGGCCCAGTTCTCCCAAGCTGCTCCCAAAAGATCCATACGACAAGGCC
GTGGCTCTCTTCTGGGCGGATTTCGTCGATAAAAAGGTGTATGATGCTGGACATTGGATCATCAGAGCTACTGGAGAGC
AGCACAAGAAAGCCGGCGAGGATTTCAAGTGGGCGCTGATGAAGATCGATGAAGCTCTCGGCACTGTTGCTCCAGGCAA
GCCTTTCTTTGGCGGTGACGCCATGAACATTGCGGATGTGAGCCTTGCACCGTTTATATGCTGGTTCGAGGGGTACCAG
AAGGTGGGAGGATTCCAGCTTCCAGGTCCCGAGGAGTGGCCTCGTCTCTACAAGTGGATTGATGCTGTCAATTCCGTGG
AAGCGATCAAGAAATCTACTCCAAGTCGGGAGAAGATGGTTGAGTTTATCGAGCTCTATAGGAAACGAATGGCAGGGGC
TGCATAAGAGAAATATCACTGATCGGTGA

> SEQ ID NO: 5947 135668 103772_300027_1b
TGGTATCAACGCAGAGTGGCCATTAGGCCGGGGAAAGCAAGAATCAGCAAATGGCTGATGAGGGAGTGAAATTGCTAGG
ACACTGGCCAAGCCCTTTTGCTCTAAGGGTTCATTGGGCTCTGAAACTTAAAAGGGGTTGATTATGATTACCAAGAAGA
AGATCTCCCGAACAAAAGTCCTTTGCTCCTGCAGTATAATCCAGTTCATAAAAAGATTCCAGTTCTGGTTCATAATGGG
AAACCTATTGCAGAATCATTAGTCATACTTGAATACATCGACGAGACTTGGAAGCATAATCCCCTCCTCCCTGAAGATC
CTTATGAAAGAGCCAAAGCGTTTCTGGGCAAAATTTATTGATGATAAGTGTGTGCCAGGAATCTTTGGTACTTTCTCTA
AGGTCGGAGAGGAGCAGCAGCAGATAGCAAAAGAAGCTCGCGAGAACTTGAAACTTCTGGAGGGCGAGCTAGACAAGAA
AAGCTTTTTTGGAGATGCGAGGATAGGCTTCATTGACTTGCATCTGCTTGGATAATTTTTGGGCTC

> SEQ ID NO: 5948 135668 154638_301256_1b
GCGTTTTTTTCTCTCATTCAACTGAATCTCTTCTGTTTCTGATATTTTGCTTTGATATATCATGGCGGGAAATGATGTG
AAAATATTAGGAGCATGGCCTAGTCCATTTGTTATGAGGCCACGTATTGCTCTTAACATAAAATCTGTGGCCTATGATT
TTTTGGAGGAACAATTTGGTTCTAAAAGTGAACTTCTCCTTAAATCAAACCCAGTTTACAAGAAAATCCCAGTTCTAAT
TCATGACGGAAATCCCATTTCTGAATCTCTCATTATTGTTCACTATATTGATGAAGTTTGGAGTTCTGGTCCATCTATT
CTCCCTTCTGATCCTTATGATCGTGCTATTGCCCGATTTTGGGCCACTTATATCGACGATAAGTGGTTTCCAGCAATGC
GTGGCATTGCAGCAGCCCAAGGGGAGGATGCACAAAAGGCAGCAACGGAACCGGTGGTCGAAGGGCTGGTATTATTGGA
AGATGCCTTCAAGAATTGCAGCGAAGGCAACAAGTTCTTTGGTGGAGACAAAATCGGATACTTGGACATTGCCCTTGGC
TGCTTTTTGGGCTGGATGAGGGTGACTGAGAAGTTGAACAATGTAAAGCTGCTTGATGAAG

> SEQ ID NO: 5949 135668 144870_200137_1b
TCAAACATATAGAAAAGTACCACTTAATTAGTGAGATGGCAGAAGTGAAGTTGCTTGGTGTTTCACTCAGCCCTTTTAG
TCGAAGAGTTGAATGGGCTCTGAAGATTAAAGGAGTGGAATATGAATTTATAGAAGAAGACCTACAAAACAAGAGCCCT
CTGCTTCTTGAATCAAACCCTGTTCACAAGAAAATACCAGTGCTTATTCACAATGGAAAGCCCATTTCTGAATCTATGG
TCATTCTTGAATACATTGATGAGACTTTTGAAGGCCCTTCTATCTTGCCTAAAGACCCCTATGAACGAGCTTTAGCTCG
TTTCTGGGCTAATTTTCTTGATGTTAAGTGCATAACTACAATTGGAAAAGCTTTATTTGGAAAAGGAGAGGAGTCAGAC
AAAGCTATAGAGGAATGTGGTGAGCTGCTCAAGATTCTTGATAATGAGCTCAAGGACAAAAAATTCTTTGTGGGAGATA
ACTTTGGGTATGCTGATATAGCTGCAAATTTAATGCATTTTGGCTGGGAATTCTTGAAGAAGCCTCTGGAGTAATTTT
GGTGACAAATGAAAAATTTCCCAATTTTTGTGCATGGAAAGATGAGTATATTAACTGCAGCCATGTTAAGGAACATTTA
CCTTCAAGGGATGCATTACTTTCCCATTTTCAACCTCGCTTTCAAACTGCAGCAGCTCCCAAATAAAAATACTTGCGGG
ACTACACTAGATTGTTGTTGTTGTATTTGCAAATTGTCATGATTTGAATTGTGGCAATAAAACACCTACTAACGAAAAC
CAGCTTTTCACAGAGTAGGGAGTATCTTGTGTATTTGTTTTGCTGATTTGTCAATGATTTTATGTGATTGTAATTTCTT
CCAGCTATTACATGATAAGAGTCATGTTTTCC

> SEQ ID NO: 5950 135668 144244_200133_1b
CTTATTCTTCTTCTCACTTGCTTTTCATAACAATGGCGAACGAAGAGGTGATTCTGTTGGATTTCTGGCCTAGTATGTT
TGGGATGAGGCTGAGGATTGCATTAGCTGAAAAGGAGATAAAGTATGAGTACAAAGAAGAGGACTTGAGGAACAAAAGC
CCTTTGCTTTTACAAATGAATCCTATCCACAAGAAAATCCCAGTGTTGATTCACAATGGAAAACCCATTTGTGAGTCTA
TTATTGCAGTTGAGTACATTGAAGAAGTTTGGAAAGACAAAGCCCCTAATTTGCTTCCTTCTGATCCTTATGACAGAGC
```

FIG. 2 continued

TCAAGCTAGGTTCTGGGCTGACTACATTGACAAGAAGTTGTATGATGTTGGGAGGAAGTTATGGGCAACAAAAGGAGAA
GAGCAGGAGGCAGCTAAGAAAGATTTCATAGAATGCCTCAAGGTGCTGGAGGGAGCATTAGGAGACAAGCCTTACTTTG
GAGGGGAAAGTTTTGGGTTTGTGGATATTGCTCTGATTGGATACTACAGCTGGTTTTATGCCTATGAGACTTTTGGCAA
CTTCAGCACAGAGGCCGAGTGCCCAAAGTTTGTGGCTTGGGCCAAAAGGTGCATGCAGAGGGAGAGTGTTGCTAAGTCT
TTACCTGACCAATCTAAAGTCCTTGAGTTTGTAAAAGTTCTTAGGCAGAAGTTTGGACTTGAGTAAACATATGCATATT
TGGTTATGCACCATAATGTA

> SEQ ID NO: 5951 135668 142573_300436_1b
CCGGAACCAAGAAGGACACTAAAGCAGTAGTCTAGTCTCGGGGCCAAGCAAGAACCAAAAAGCAATTAAGATCGAACTC
GAGCAAACATGTCGTCGACTAACAACAGTTCAGGCGAGCCGCCGCCGGCGGTGCGCGTGCTGGGCGGTTGGGCGAGCCC
CTTCACGAACCGCGTGGTGGCGCTCGAAGCTGAAGGGCGTGGAGCACGAGATGTTGCAGGAGACGGTGGGGAAGAAG
AGCGAGCTGCTGCTCCGGTCCAACCCGGTGCACAAGAAGTTCCCCGTGCTGCTCCACCACAGGAAGCCCCTCCCCGAGT
CTCTCGTCATCGTCGAGTACATCGACGAGGTCTGGCCGGCCTCCAATGGCGGCGCCCCGGCCATTCTCCCTCGCGACCC
CCACGGCCGAGCCGTCGAGCGGTTCTGGGCACGGTACGTCGATGACAAGGTAAGGGCATGTCTTGCGTAATTTTTTTTT
GTCTCTGAACATTTTCTTCTTGTTTCTTGGAGAATTTTTGCTCTTGCTTTGATGATATTTTTGCAGATTCTACCAGGGC
TTCGGGTTTTGAGAGGATCGGTGGCCGGAGACAAGGACCAAACC

> SEQ ID NO: 5952 135668 138792_300727_1b
GATGGCCGGATCAGGAGACGAGCTGATGCTGCTCGGCAAATGGCCAAGCCCATTCGTCACCAGGGTTGAGCTCGCGCTC
GGCCTCAAGGGCCTCAGCTACGAGTACGTCAAGCAGGACCTCGTCAACAAGAGCGAGCTCCTCCTCGCCTCCAACCCGG
TGCACAAGAAGATCCCCGTGCTCATCCACAACGGCAAGCCGGTCTGCGAGTCGTCAATCATCGTGCAGTACATCGACGA
GGCCTTCCCCGACGCCGGCGCCGGCGCCGCCCTGCTCCCCGCCGACCCCTACGAGCGCGCCGTCGCTCGCTTCTGGGTC
GCCTACGTCGACGACAAGTTCGTTCCGGCATGGGTGGCGACGTTCAGAGGCAAGACGGAGGAGGAGAAGGCGGAGGGGA
TGAAGCAACTGCTCGCGGCGGTGGAGACGCTGGAGGGAGCCCTGAAGGATTGCTCCAAGGGGAAGCCCTTCTTCGGCGG
CGACACAGTCCGGATCGTGGACGTCGCGCTTGGTGGCCTCATCTCGTGGGTGAAAG

> SEQ ID NO: 5953 135668 137192_300502_1b
CCCCCGTGCCCGTGCTCATCCACAACGGCAGGGCCATCTGCGAGTCGCAGATCATCGTGGAGTACGTCGACGAGGCGTT
CCCTGACGCCGGCGAGTCCCTCCTCCCCGTCCACCCTTACGACCGCGCCGTCGCTCGCTTCTGGGCCGCCTACATCAAT
GACAAGTTCATGCCGGCGTGGCAGAAGGCGTCGTTGGGCCTCACGGAGGAGGAAGGCGGAGGCGGTGAAGCAGATGC
TCGCCGCGATCGAGAACCTGGAGACGGCCGTTCAATGAGTTGTCCAAGGGGAAGCCCTTCTTCGGCGGCGACACCGCCGG
GTACCTCGACGTCACGCTCGGCGCCGTGGTCGGCTGGGCGCGCGCCGGCGAGGTCCTGTTCGGGAGGAAGCTCTTCGAC
GCCACTAGGAGCCCTCTCCTGGCGGCGTGGATGGAGCGGTTCGTCGCGCTGGACGCTGTCAAGGCGGTGTTGCCGGACA
ATGCCGAGCTGATCGAGTATGGCAAGATGAGGATGGCGCACTACGCCAAGCTTGCTGCCGCCTTGGCTGCTGCGAACAA
GAAGTGAGCCGGCGAAGCAAACCTGTAGTTGGTGTGTGTCCGTTCTCGTTGCTCGTGGTCTC

> SEQ ID NO: 5954 135668 1098513_301485_1b
GAGAGAGAGAGAGAGAGAGAGAGAGAAGGTGAAGATGGGGGATGAGGTGAAGGTGTTGGGCTCTTGGGTGAGCGGTTTCGC
CTTGAGAGTGTGCATTGCCCTCAACGAGAAGGGCGTCCCATACGAGCTCTTAGAGGAGGACCTTCAAAACAAGAGCCAG
CTGTTGCTCCAATCCAACCCCGTCCACAAGAAGATCCCCGTCCTCCTTCACAATGGGAAACCCATCTCTGAGTCTCCCG
TCATTGTCGAATACATCGATGAAACATGGCCCTCCCCTCCCCTTTTCAACCCCCCCACCCCTCACAACCGAGCCTTGCA
TCGCTTTTGGGCAGATTTCATCGACAAAAAGTTTGCTGATGCAAGCTTGAGGATTATACATAGCCCACCTGGAGAAGTA
CAAGATGGTGGAGTGAAGGACATTGTGGAAAGTTATAGGATTCTATAGAAGGCATTGGAAGATATGGCATGTGGAAAAC
CTTTCTTTGGTGGAGAATCCATTGGGTT

> SEQ ID NO: 5955 135668 1119831_301901_1b
TGAGAGTTGAGGGTTGAGAGTTGAAAAGAGCAATAATCAACAATAATGGGTGACCTGTGAGGGAGAAGAGGAGGTGAAG
CTGTTGGGGTTCTGGCCAAGCCCATATGTCATGAGAGTGGTCTTTGCCTTGAGGTTAAAGGGGGTCAAGTATGAGGACA
TAGAGGAGATTCCGTTCGAGAAGAGCCAACGATTTGGTGGAGGCAAACCCTGTGTACAAGAAGATACCTGTCCTCATTC
ACAACGGGAAACCCATCTGTGAGTCTTCCATCATCCTGCAATACATCGATGACACATGGCCACATGAACACACAAACTT
CCTTCCTAAACAGCCCTTTGCCAGGGCTTATACTCGCTTCTGGGCTGATTTCATTGACAAGAAGGTATTCCAGCCGATG
CATACTCCTTGTGTATTTCTGATTCAATTCAATTCAACTAGTGCTTATCGTCATAAAATTGGTTTAATGGTGAT
TGCAGGTATTTGATGCGGCTTCTCGAGTTCTGAGATCGAGCGGGGAGCAACAAGAAAAGGCGTGGGACGAGTATATTGG
GTACCTTGAGGTT

> SEQ ID NO: 5956 135668 180911_300652_1b
GAATTCAGAAGGTGAGGAAGACTAGATCAAAATATTTTCTTGTGGTATCAGAAGAAAGGTAAACTCTAAATTTAGTTAT
GGCAGGATCAGGAAGTGAAGAGGTGAAGATCTTAGGTGGATGGCCAAGTCCATTTGTGATGAGGCCTAGAATTGCACTC

FIG. 2 continued

```
AACATTAAATCAGTCAAGTACGATTTTCTTGAAGAGACATTTGGTAGCAAAAGTGATCTTCTTCTGAAATCAAATCCTG
TCTACAAGAAGATGCCTGTTATGATTCATGGAGATAAACCCATCAATGAATCAATGACCATTGTTCAGTACATTGATGA
TGTCTGGGCTTCTGCCGGTCATTCTATCATCCCTTCTGATCCTTATGATGCTTCCATTGCTCGTTTCTGGGCAACCTAC
ATTGATGACAAGTTCTTTCCATCTTTAACTGGTGTTGCAAAAAGCAAGGATGCAGAACAAAGAAAAGCAGCCATTGAAC
AAGTGATTGCAGGGTTTGCTCTAATTGAAGAAGCTTATCAGAAAATTAGCAAAGGAAAAGACTTTTTCGGTGGAGAAAA
AATCGGATACCTTGATATTGCATT

> SEQ ID NO: 5957 135668 189106_300613_1b
AGAACAGTCTCAAAGCTTCGCCCAAGCAGAGAAGAATGGCCGCCGGAGGAGGAGGAGGAGACGAGCTGAAGCTGCTCGG
ATTGTGGGCGAGCCCGTACGTCCTGCGAGCGAAATTCGCGCTCAGCTTCAAGGGCCTGAGCTACGAGAACGTCGAGGAG
GACCTCCACAACAAGAGTGAGCTGCTCCTGAGCTCCAACCCGGTGCACAAGAAGGTGCCCGTGCTCATCCACAACGGCA
AGCCCATCTGCGAGTCGCAGATCATCGTGGAGTACGTCGACGAGGCGTTCCCTGACGCCGGCGAGTCCCTTCTCCCCTC
CGACCCTTACGACCGCGCCGTCGCTCGCTTCTGGGCCGCCTACATCAATGACAAGTTCATGCCGGCGTGGCAGAAGGCG
TCGTTGGGCCTCACGGAGGAGGAAGGCGGAGGCGGTGAAGCAGATGCTCGCCGCGATCGAGAACCTGGAGACGGCGT
TCAAGGAGTTGTCCAAGGGGAAGCCCTTCTTCGGCGGCGACACCGCCGGGTACCTCGACGTCACGCTCGGCGCCGTGGT
CGGCTGGGCGCGCGCCGGCGAGGTCCTGTTCGGGAGGAAGCTCTTCGACGCCACTAGG

> SEQ ID NO: 5958 135668 209369_300814_1b
CAAACATCGACACATCGTGTCCATCGGAGGCACAGGAGAGATGGCCGGCGCCGGACGCGACGAGCTGAAGCTGCTCGGC
ATGTGGGCCAGCCCGTATGTCAGCAGAGCCAAGCTCGCGCTCCAACTCAAGGGCGTGAGCTACGAGTACATCGAGGAGG
ATCTCGGCAACAAGAGCGACCTCTTCCTCCGCTCCAACCCGGTGCACAAGACGGTGCCGGTGCTCATCCACAACGGCAA
CCCCATCTGCGAGTCGAGCATCATCGTGCAGTACATCGACGAGTCCTTCCCCTCCTCCGGCGCCTCCCTCCTCCCCGCC
GACCCCTACGACCGCGCCGTCGCTCGCTTCTGGGCCGCCTACATCGACGACAAGCTAGCGGCGCCGTGGAGAATGGTGT
ACAGGGTGAANACGGAGGAGGAGAGGGACNAGCTCATGAAGCAGACGCTCGCGGCGGTGGACGTGCTGGAGGGAGGACT
GAAGGAGTGCTCCAAGGGGAAGGGATGCTTCTTCGGCGGCGACAGCGTCGGCTACGTCGACGTCGTGCTGGGTGGGCTC
GTGTCGTGGGTGCACGCCAGCGACAAGCTCTCCGGCGC

> SEQ ID NO: 5959 136763 120108_300359_1b
CCCCCCCCCCCACAAATAGACCTCTCTGGGCATTCCTCTCTGTCGACTAATTTGCTCCCCATTTTCATACCAAGAAACC
GTATCAGCAATGGCCAAGATTGTTGCAGTTTTACTTTTGGCCCTTTTTGCCATGTCCATTCTTGCTACAACAGTTCTGG
CTACAAATGGCAAACACCACCATTCTAAAAAGTATGGACCAGGGAGCTTGAACCCCTCACAATGCCTACCACAATGTAC
GAGGAGATGTAGCAAAACACAGTACCACAAACCATGCATGTTCTTCTGCCAAAAATGCTGCAACAAATGTTTGTGCGTT
CCACCTGGTTTCTATGGTAACAAAAGTGTTTGCCCCTGTTACACACAACTGGAAGACCAAGGAAGGAGGACCAAAATGCC
CTTGATTTTCTACTATTTTCTTCATCTGTCTTTAATTTGTCTACCTAATCTTGTTATTTTGTCTACTCTTGTTCCCGT
TGTATTTTTTTCTAACGACAAGTCCTTTATGTCCTTCCCCAAACACTATCCTACCCCCAAACCCTACTTGTAGGAATT
CACTAGGTTTTTGTTGTTGTAACAAAAAGATCAACATGTTCTTAGATCTTAATTTCCAGCTGAAATTGTAGTTGTGTT
GTAGTGCTCCTATAGTTTGGTGTGGCCCTATATGAGAGCTTTCTGTTCCAATTATGTTGGTATTACTATTGTTGAGTTT
TCTTTTTTCTGCAGTAATAAAATTATGTTGATTTT

> SEQ ID NO: 5960 136763 128317_300475_1b
AATTATTCTCTTTAGACAAATTATAGCAATGGCTGCGAAACTGAGCATTGTCTTGTTTGTTATTTTGGTAGTTTTTTTG
GCCCAAAATCAGGTTTCAAGGGCCAACCTAGTGCTTGATGGGAAGCAACAAATGCAGAGAAATAACCAAATGTATGGTG
TTAGTCAGGGAAGCCTCCATCCTCAAGATTGTCTCCCGAAATGCACATATCGCTGCTCACAGACTTCATTCAAGAAACC
CTGCATGTTTTTCTGCCAGAAATGTTGCTCGAAGTGTCTGTGTGTGCCCCCTGGCACCTATGGCAACAAACAAACCTGC
CCTTGCTACAATAACTGGAAAACCAAGGAAGGTGGCCCCAAGTGTCCCTGATTGTACCCTTCCTTCCACTATTATCTAT
ATATCCATCTATATATTGTGTGACAGACACCCAACTTCTGTCAGTTTTCATCTATCTGTCAAGTCTATTAGTAACTAGC
ACTTGGTTCAAGTGGTCTGTGTTAGCTAGCAAATGATCAATTTAAGCTCCAATATAACCACTTTTTGGCAAAGCCAGGA
AGATGAGTTATAATGCAATGACAGTAACTATGCGCTAGCAATTGCTCCTAGAAATCTGTATTCTCGTCATACTCCATGC
TTGTATGCAGCCTATTGACGAGCTATGTTTATGAGTAGTAGTAGTTCTTATGCTATTTAATGCAATTTCTTAAGAACTT
GTATTTTAAGATATGTAATCCATATTCTATTTGGTGTTCCTTACCAATATGTGAATGATGCCCTATATTAAAGC

> SEQ ID NO: 5961 136763 125264_300629_1b
GGTTCTTCTACATAAAACACTAACAGGCTTATTTGTTCTCAAGAAAATCAGCAATGGCCAAACTCGTTTCATTTTTCCT
TTTGGCCCTTGTTGCCATATCCATGGTTGCAACCACTGTTTTGGCTGCAGATGCCCAGTACCACCTTGATACTTCAAGG
TACGGTCCAGGGAGCTTGAAGCCATCACAATGCCTGCCACAATGCACGAGGAGATGTAGCAAGACACAGTACCACAAAC
CATGCATGTTCTTCTGCCAAAAATGCTGCAAAACATGTCTGTGTGTCCCCCCTGGTTTCTATGGAAACAAAGGTGTTTG
CCCTTGCTACAACAACTGGAAGACCCAGCAAGGAGGACCCAAGTGCCCTTAATTTTACTTTATGGAATTCGTTCCCCAA
TTTAATTTATGTTGTTGTTTGTCGGTATTGTTATTAAATTTGTCTTGAATCAAAGGTCATAAGTTGTACGACCTTGATT
```

FIG. 2 continued

```
CTAATTAAGTTACTTTTACTGTATTGCTCCTTTGGGCCGAATACTTTTTGTGTTGCCCGATGTGAGAGCTCTTTGACCA
ATTCTTTTTGGTCTATTGTACGTTTTAATTACTCTTATCTAATATAACAAAATGTTCTTCAAATTGTGATTC

> SEQ ID NO: 5962   136763   1171388_302054_1b
ATAACCACTACTACCTTCCTTCAGCAGAGAAGGGAAGAGAAGAGAAGTGGGTGCTTTTCTCTTTCATCCCTTTCTCTCT
CTCTCTCTCTCTCTCTCTCATCTATGGCTACCCTCCATGTTCTTCTCCTTGTCTTGCTTGCCCTTGTCCTAGCTGCC
ATTATGGGAACTGAGAGTGTGGAGGTCAGTAGTGGTGTGGATTCTACTGCAATTGGAGATATGAAGGCCAAGTCATGGA
GCTCTTACAAAGTGCCCCTCTCAGGCTGCCCGGGTGCTTGCAACAAGAGATGCTCTGCCACATCGAAGAAGAAGGCATG
CATGTTCTTCTGTAGCAAGTGTTGTTCCAAGTGTTTATGCGTGCCCCCTGGCACCTATGGGAACAAGCAAGTGTGCCCA
TGCTACAACAACTGGAAGACCCAACAAGGAGGACCCAAGTGCCCTTGAGCACAAAACCACCACTACTCACACATCCTAG
CCAATTACCATGAACCCCTCCCCACTCTTCCCATTTGAGTGGAGTATTGGCACAAGTGATGATGTGGCTAGCAGAGGCT
TAATATTTGCAACCACCACATAGGTGGAACCTTTAATTTCATACCACTAATGATCCGATGATCCGATCCCTTTTATATC
TATAGCTAATCCCTACTATACCTATATCTAATCCCT

> SEQ ID NO: 5963   136763   111966_300050_1b
ATTTTGGCAGGGTTACAACAATCTCCGTCCTAAAGATTGCGGGCCAAGATGTACATATCGATGCTCAGCAACATCACAC
AAAAAGCCATGTATGTTCTTTTGTCAAAAGTGCTGTGCTACTTGCTTGTGTGTGCCTCGTGGGGTTTATGGCCACAAAC
AAACGTGCCCTTGCTACAACAATTGGAAGACTCAAGATAACAAACCAAAATGCCCTTAAATATTAATTAGGGCGAAATT
CTTTTAATATAATTAATTGTCAAAAAAACAATATTGTCGTTTTTTCTTGTATCGGCGTAACTTAATTTCTTTTGCAGT
TTTAAGTATGTTTACACGTTGTACTTCTCTACTTTGTTGTTACTGATGTCTATGATGAGTTATAGTTCTGGAGCAATAT
GGTCCGTGAGGATTTATAAGCCGTAACTTGCTTGGAATTGAGTTGTTGTTGTAGTGTGTTTTTATCATCGCGAGAATAT
AATATAATAAATTATTTATT

> SEQ ID NO: 5964   136763   45806_301002_1b
CGCGGGAGATTTAGAGGAGTGTTTGGTTCTTTGGATAACAATATCCCAAACTGAAAATGGCTAAGTCATATGGAGCTAT
CTTCCTCTTGACCCTCATTGTCCTCTTCATGCTTCAAACCATGGTTATGGCCTCAAGTGGATCTAATGTGAAGTGGAGC
CAGAAACGTTATGGACCAGGAAGCCTGAAACGTACCCAATGCCCATCGGAATGTGATAGGAGGTGTAAAAAGACACAGT
ACCACAAGGCTTGCATTACGTTCTGCAACAAATGCTGCAGGAAGTGTCTCTGTGTGCCTCCGGGTTACTATGGGAACAA
ACAAGTTTGCTCCTGCTACAACAACTGGAAAACTCAAGAGGGTGGACCAAAATGCCCTTGAAAAATCTCCCTTCGTTC
CCTTTTTATAATAAAAATTTTCAACTATAACTAAATTTCCTTTGATCAATGTTTTATCTACTTTATTCCTAATGTTGTA
ATGTTATGT

> SEQ ID NO: 5965   136767   247907_301578_1b
GGGCATCATGGCGCGGTGCGGATGGCTGCTCCTCCTCGCGCTCCTCGCCCTCGTCCTCTCAGGTGGATCCCGAGGTGAG
CTGGACGAGGAGATAGATCCGTCGTCGTCTGCTGCGGGCGACGAGGCGGGAGCGGTGGACGTGGACGAGGCTGTAGTTG
ACGCATTTGATTCCGTCGGTCCCGCGCCTGGAGTCGACACTGTCTACCACTTCCTAAACAATCCGCAGAAACTCGTTCC
TGCCGGAGAGCCCGCGCAGATTCTCGTCGGGATCGCCAACACCGGCGCCTCTGTTGTCAACGTTAACTCCATCCGGGCG
TCCATTCACCTTCCGTTTGATCACAAGCTCTTGGTTCAGAACTTGACAGCCCAGGAGTTTGTGAATGCGACCGTTCCGT
CGGGTGTCCAGGCAACTTTTGCGTATCCCTTCACCGTGAGCAAGTATCTGCAACCAGGGAGTTTCTCGCTGGTTGCAAG
TGTGCTCTATGAAGTGGACGGAGATATCCACAAGACTGTCTTCTATAATGGCACGGTCGAGATTGTGGAGGCCGGTGGA
TTCTTGAGCGGGGAGACGCTTTTCCTGGTCACTCTCGGGCTTGGTCTGATGGGGCTCTTGGCCTTGTGGATCCATGGAC
AAGTCCAGCGTTTCTCAAAGACACGGAAGACGCGGGTGGTCG

> SEQ ID NO: 5966   136767   11944_300283_1b
TGGTATCAACGCAGAGTGGCCATCTAGGCCGGGGCAGCTGGTGAGGAGAGTGAGCTGTTAGTTGGAATGAAAAATGATG
GGGAATCAAATCTGAATATCATTGCCATCCAAGCCAGTGTTCACCTTCCTTTTGATCATCGCTATTTGGTTCAAAATCT
TTCTGTTCAGGCTTTTAACAATGCAACCGTTCCTCCTTCAGCTCAGGCTACCTTTCCATATATATTTGCTGTCAGCAAA
TTTATGCAGCCTGGAAGTTTTGATCTCGTGGGCACAATTATTTACGAGATAGACCAGAATGCTTATCAAAACATATTCT
ACAATGGAACTATTGAAGTGACTGAACCTGGTGGTCTTCTCAGTGTTGAGTCTGTTTTCCTGTTTTGTCTTGGAGTTGC
CCTCCTTGGCCTTCTCGGGTTCTGGATACGTGGTC

> SEQ ID NO: 5967   136767   147270_301251_1b
GTTCGTGTGCTCCGCCTTCCTCTCAAAATGAAAATTAGGGTTTTCTTCGTCCTGGCTCTTCTCCTCTTCTCTTCATCAT
TTCTCCAAGTTGCTAGAGCTCAATCCGACCCTGAAGCAGAAGTGGTTGAGAGTACCGAGGAAGGAGGGGATCTTGGAAT
TGTTGGTGAGGATGTCCAAGATTTTAGCAGTGAGAGTTATAGTCCTGCACCTGGGATTGAAACAATTTGTGTTTTCCCT
AAAAACCCTTCTAAAGTAGTGGCAGCTGGTGAGGAGAGTGAGCTTTGGTTGGAATGAAAAATGATGGGGAATCAAATCT
GAATATCATTGCCATCCAAGCCAGTGTTCACCTACCCTTTGATCATCGCTATTTGGTTCAAAATCTTTCTGTTCAGGCT
TTTAACAACGCAACAGTTCCTCCTTCTGCTCAGGCTACCTTTCCATATATATTTGCTGTCAGCAAATTTATGCAGCCTG
```

FIG. 2 continued

GAAGTTTTGATCTCGTGGGCACAATTATTTACGAGATAGACCAGAACGCTTATCAAAATGTGTTCTACAATGGAACTAT
TGAAGTGACTGAACCTGGTGGTCTTCTCAGTGTTGAGTCTGTTTTCCTGTTTTGTCTTGGAGTTGCCCTCCTTGGTCTT
CTCGGGTTCTGGATAC

> SEQ ID NO: 5968 137131 196522_300704_1b
GATTCACCTCATGTTCTGCTTGCAAAGTTTCAATACACTGGAGTGAGTCAGTGAGGTTGGTGAAGCAGAGTGAGGAAAG
GAGGATGGGAAGGGTGGCGCCTAGCGTCGAGGAGGTCGGGGGCGAGCAGCCGCCGCCCGCGCTTGGGCCCGGCGAGACC
GTGAGCGGGACGGTGGCCGAGCTGAGGGCGGCGTACGAGAGCGGCAGGACGCGGAGCCTGGAGTGGAGGCAGTCGCAGC
TCCGGGGGCTCCTCCGGCTCTTGGCGGAGGAGGAGGCCGCCGCGTTCCGGGCGCTCCGCGAGGACCTCGGCAAGCACCA
AGCCGAGGCCTACAGAGACGAGATCGGCGTGCTTGTCAAGTCGGCGAACGCCGCGCTGCGTGAGGTCGGGAAATGGATG
GCGCCGGAGAAGGTCTGGGTGCCGCTAATCGCGTTCCCGGCAAGGGCGCAGCTGGAGCCGCAGCCGCTCGGGGTCATCC
TCGTCTTCTCTTGCTGGAATGTCCCGTTGGGCCTCTCTCTGGAGCCTCTCGTTGGAGCATTGGCGGCCGGCAATGCGGT
CGCGCTGAAGCCATCGGAGCTGGCGCCGGCCACCGCTAAGTTCCTCGGCGACAACGTCGGCAAATACATGGACGCCACG
GCCGTGAAGGTCATCCAGGGCGGGCCGGAGGTTGGCGAGCAGCTCATGGAACACAGATGGGACAAGGTCCTTTTCACCG
GGAGCCCGCGCATCGCGCGCGTCGTGATGGCC

> SEQ ID NO: 5969 138843 227909_301032_1b
GCAAGTTCACAACCCAACACCCAAAAGCAAAAGAAAAGCAGCAACCCAAAGATGTGCGGCGGAGCGATCC

> SEQ ID NO: 5970 139222 193737_300742_1b
CCCCCCCGGAGCGAGAGAGAGAGAAAGGGTCTCCTCCTCAACATCAACAATGGCGGTCGCAACCTCCTTCGCCACACTC
GCCATCGCGCGGCCGGCGGCGGAGCGGGCCCTCCTCGCCTCCAAAACCCCCTCGCCGCTCCTCTCCATCCGCACCGGCA
CCGGCACCGCACGCCTCCCCTCATCGGCCGTCTTTGGAGGTTTCACTCCTGCGCTTTCCGCTGCTCACAGCCGCGCGCG
CTTCGTCTCCTCCGCCACCGCTGACCCCAAGGAAGGTGGACCTCCAGTCCAAAATCACAAACAAGGTGTACTTTGACATA
AGCATCGGAAACCCTGTTGGGAAGAACGTTGGGAGGGTCGTTATTGGCCTATACGGGGATGATGTTCCCCAGACCGCAG
AGAACTTCCGTGCTCTTTGCACTGGAGAAAAAGGGTTTGGTTACAAGGGGTCCAGTTTCCACCGTGTCATTAAGGACTT
CATGATTCAGGGAGGAGACTTTGACAAGGGCAACGGTACTGGAGGGAAAAGCATATATGGCCGGACCTTCAAAGACGAG
AACTTCAAATTGGTTCATACTGGACCTGGAGTGGTCAGCATGGCCAATGCTGGGCCAAACACCAATGGCAGCCAGTTCT
TCATCTGCACTGTCAAGACACCTTGGTTGGATGGGAGGCACGTCGTGTTTGGGCAGGTTATTGAAGGCATGGACATCGT
TAAGATGATCGAATCGCAGGAGACTGACAGAGGGGACCGCCCGAAGAAGAAGGTGGTCATCAGTGAGTGTGGGGAGCTT
CCAGTGGTCTAATAGGTGCCAGAGGGCTAATCTTCTTCCCCCGGAGACTTTGCTGTTTTTGGTTTCATAGTAAGCTGTG
AACTTATCGCATGTTCTCCGCGCAGTCAGAGATCATGCTGAGTTGAGGCCAAGATTTCTAAGTTGAGAATAATCCTCTA
TTGTTCGGCTGGAATAAAACGTTCTTACCTGTCGAGGGTCAGGAAATAATGTTGTGGTTCATGAAAGATCAAATGTCTG
TCTTTTCGTGCT

> SEQ ID NO: 5971 139222 111028_300049_1b
CTCACTTTCCACCAACCACTCCCCTTTCTCTCTATCTCTATAATTACAGTTAATTCTTCGTAGAGTCACTCCGACAAGT
ATAGAAATTACCGGATAAAAGAAATCGGCAACAATGGCAGCTACATTTGCTACAGTGTCGAATTTAGGCTCACTCTCAG
CTCCTCGAGCTGCTGTGAACCCTACATATGCTTCTCCTAAGTTGGTGAAATCTTCATTCTCATCGTCAAGTTTCTTTTC
TGGCTCGTTGCGCATTTCTAATTCATCCAACCGTTTGGTTCACAAAAAAACCAGCGCTTTATCCGGTTCCATTCAAGCC
GCAGTGCAGGTGGCCGAGGTGCAATCCAAAGTGACACACAAAGTTTATTTGATATTAGCATTGGGAATCCTGTTGGAA
AGCTTGCTGGGCGAATTGTAATTGGATTATATGGTGATGATGTGCCACAAACAGCAGAAATTTCCGTGCACTCTGCAC
AGGTGAGAAGGGCTTTGGCTACAAGGATTCTGCATTTCATCGTGTTATTAAAGATTTCATGATTCAAGGAGGTGATTTC
GATAAAGGAAATGGAACCGGTGGTAAAAGCATATATGGTCGTACCTTTAAGGATGAAAACTTCAAGTTGACTCATACTG
GACCTGGAGTTGTTAGCATGGCCAATGCAGGCCCTAATACCAATGGAAGCCAATTCTTCATTTGCACTGTCAAGACCCC
ATGGCTTGATGAGAGGCATGTTGTGTTCGGACAAGTTTTAGAAGGCATGGACATTGTGAAATTGATTGAGTCGCAGGAG
ACCGATAGGGGTGACCGTCCAAGGAAGAGGGTTGTCATCAGTGACTGCGGTGAGCTACCTGTGGCATGAGGCGGGAATA
CAAATATAAAGCACTTTATTATGTTAAGACTCGTTGCCAGATATAAGAGGATTCTCAGTACTGAGTTTTCATCCAAAAC
CCAGCTTTTTCCTGTTCCTTTTTT

> SEQ ID NO: 5972 139222 1112610_301803_1b
GAGAGAGAAAGAGAAACAGAAAGAGAGAGAGAGAGGGAGGAGAAGTCTTCCTAGCCATGGCCGCCTCGCAGTTTCTA
ACCCTGGGTAGAGTTGGACATCCCATAACTACTGGGAATCATGTTCAATGTAGTCCAATCATGTCACGAATGCCAATGC
GGTCTGCTTCTATCAAAATACCCCCTGTGGATTAAAGATGAGGTCTGTCAAGCTTGCTTATTGTAATGTGGCAAGAAA
ACAGCTCTCCGTGACGTGCACAGCTCAAGAAGTTGGGGCAGTAGCAAAGGTTACAACTAAGTGCTTCTTTGACATTACA
ATTGGAGGAGATCCTGCTGGAAGAATTGTGATTGGGCTATATGGTGACGATGTGCCAGAAACAGTGGAGAACTTCCGAG
CGCTCTGCACTGGAGAGAAAGGGTTTGGATATAAAGGCTCTGGATTTCATCGCGTCATTAAAGATTTCATGATCCAAGG
AGG

FIG. 2 continued

> SEQ ID NO: 5973 139222 145257_301058_1b
GATTCTACACCGGAACCACAGCCAAAGATGGCGACGACGAGATTACACCCGTCCGTTTTGATCCTCTGCATGGTGGTGA
TCGGAACCGTAGCTCTTGCTCAGGCCAAATCTCAGGAAAGTCTGAAAGAAGTAACTAACAAAGTTTACTTTGACGTTGA
CATAGATGGTAAACCTGCCGGTCGTATTGTTATGGGTCTCTTCGGTAAAACAGTTCCTAAAACAGCAGAGAACTTCAGA
GCATTGTGCACAGGGGAGAAAGGTGTTGGAAAGAGTAGCAAGCCTCTTCATTACAAGGGGAGCACATTCCATAGAATAA
TCCCCAGTTTCATGCTTCAAGGTGGTGATTTCACTCTTGGTGACGGGCGTGGAGGTGAATCTATTTATGGTGAAAAATT
TGCTGATGAAAATTTCAAGATCAAGCACACTGGACCAGGGCTTTTGTCAATGGCAAATGCTGGTCCCGACACCAATGGT
TCACAATTCTTCATCACAACCGTCACAACTAGCTGGTTGGATGGCCGGCATGTTGTCTTTGGGAAGGTGTTGTCTGGAA
TGGATGTCGTTTACAAGATTGAAGCTGAAGGAAGACAAAGTGGAACACCAAAAAGCAAAGTTGTCATTGCAGAC

> SEQ ID NO: 5974 139222 130704_300490_1b
GAATTCAAACCTCGCTCTACAGTCCCCCAGTTTCGCAACAATGGCGACTTCACTTGCTCCTCTGATGAAAATTAGCTTT
GCAAATGTTACCAACAAGCCCAAGTTTATAAACCCTAGTTCTTGTAATTCTCTCGGATTAAGAAAATTATCTTCTTCTT
CTAGTTTCTCTGGTTCCTTATTGCGCCTTACATCTTCATCTTCATTTCCTTCCATTCAGAGAAGATATGGTTTTGTGAC
ACATGCTTCTTCTCAGGAAGTGGCATTGCAATCAAAAGTTACACACAAAGTATATTTTGATATTGGAATTGGTAATCCT
GTTGGTAAGGATGTCGGCAGGGTTGTCATTGGTTTGTTTGGTGATGATGTCCCGCAAACTGTGGAGAACTTTCGGGCGC
TTTGCACAGGAGAGAAGGGTTTTGGGTACAAGGGTTCAGCATTCCACCGTGTTATTAAAGATTTCATGATTCAAGCGGG
AGATTTTGATAAGGGAAATGGAACTGGAGGTAAAAGCATCTATGGTCGTACATTTAAGGATGAGAACTTCAAATTGGCT
CATGTTGGACCAGGAGTTGTTAGTATGGCAAATGCAGGACCCAACACCAACGGAAGCCAGTTTTTCATTTGCACTGTCA
AGACTCCATGGTTGGATCAGAGGCATGTGGTGTTTGGGCAAGTGTTGGAGGGGATGGACATTGTAAAGATGATTGAGGC
C

> SEQ ID NO: 5975 139281 1097833_301448_1b
AGAAAGGTTTGAGGAAAAAGAAGAGGGAGGGAAGAAAGGGGAGGTTCTTCTTGCTATTGTAATGGCGACTATCCCCGTG
AACCCGAAGCCCTTCCTGAATAACCTTACCGGCAAGCCTGTTATCGTTAAGCTTAAATGGGGCATGGAGTACAAAGGTT
ATCTTGTCTCAATCGACTCATCACATGAACTTACAGCTTGCGAGCACTGAGGAATATATCGATGGAAAACTGACAGGCAA
CCTTGGAGAAGTGCTAATCAGGTGCAACAATGTGCTCTATTTACGAGGTGTTCCTGAAGATGAAGATATCGATGAAGCG
GAATAACAAGATGTAATTCTTGGTATGAAACATGAAGGATCAGCAGCTGAGTTGGGAATGATCTGGAGTGTTCCGGAAC
TTTGTGTACGATGCAAAACAATTTGGGATGCGGTTGTGAAAACCCCTATTTTAGGAGTTGGACTTAGAAAAAGACCCAT
TAACATACACATAAGAGTAGTGCTACCACATGTAAAAGACACTTTTTGAAATTTAAGTCTTTTTTATTGGGCAAAACAC

> SEQ ID NO: 5976 139281 57502_300029_1b
CTTCCCCTTCTCCCACTTTTCCTTAAACCCTTGAAAAGCTTCCATGGCGACGGTACCAGTTAATCCCAAGCCTTTTTTG
AACAATTTGACTGGAAAGCCTGTGATTGTAAAGCTAAAGTGGGGAATGGAGTACAAAGGGTATTTGGTCTCCGTGGATT
CATACATGAACTTGCAGCTTGCAAACGCAGAAGAATACATTGATGGACAATGCACTGGTTCTCTTGGAGAGATCCTGAT
TAGATGTAATAATGTCCTCTATCTTCGTGGTGTACCTGAGGATGAAGAACTGGACGATGCCGACCGCGACTAGGAAGTG
TTTTGTATTAGTGTGATCGTTCTTTTAGTGCAATCAGATGTCTGGTTCATCGATCATGATGGAACAACATATTCGTCTC
CTTGAATGTATTATCAATTATGTGTAAAATTTCCTAGATGATTACTGGAGCAAAAAGAACCAGCTCTATGACTAGAACT
AGAATGCCATATGGTCAAGTTTATT

> SEQ ID NO: 5977 139321 167849_300551_1b
GAATTCAGAAGAAGAAGAAGAAAGAAGAGCTCTGTCTTTCTCTCCATCCCCCCCTGTATACACCTCTTTCCCTGCA
AAGATGGGGCTGTCATTCACCAAGTTATTTAGTAGGCTGTTTGCCAAGAAGGAGATGAGAATTCTTATGGTAGGTCTAG
ATGCGGCTGGTAAGACTACAATATTGTATAAGCTCAAGTTGGATTTAATGTGGAGACTGTAGAGTACAAGAACATCAGT
TTCACTGTGTGGGATGTTGGAGGTCAAGACAAGATCCGACCCTTGTGGAGACATTACTTCCAAAACACCCAAGGTCTTA
TCTTCGTGGTTGACAGCAACGATCGTGATCGTGTTGTTGAAGCTAGAGATGAACTGCATAGGATGTTGAATGAGGATGA
GTTGAGAGATGCTGTGCTTCTAGTGTTTGCTAACAAACAGGATCTTCCAAATGCAATGAATGCCGCTGAGATCACTGAT
AAGCTTGGTCTTCACTCTCTTCGTCAACGACACTGGTACATCCAGAGTACATGTGCAACTTCAGGAGAAGGGTTGTATG
AAGGTCTTGACTGGCTCTCCAACAACATTGCTAACAAGGCATAGAAGTCTCAACATTGATATTTTGGCCTATGTTGGTT
GAATGTTGAATTATTTAGTATTTTCGTCATCATAAT

> SEQ ID NO: 5978 139321 180948_300652_1b
GAATTCCCGAGAGAGAGATTAATGGAAGTTCTGAGATCGACAAAGGGAAGACGTAGAAGATTAAACAATAGCTGTTGGT
GATGGTGTTATAGCCGGTTAATGTTTCAGATCGGAAAGATTAATTGAATTAGGGTTTCGTAAAGAATTGTTCTGAGAAG
ATGTTGATGATTAAATTGAAGGTTTGGGAGAAAGATTGAAGGTGGGTTTTGAGTATCTAAAGCAAAAGAGAAGAGTTAG
TGTCTGAATTAGGGATTCTGGAATTAAATTAAGGCTCATAAGAAGAACTCTAAGATGTTTCAGAAAATGAATCTGATGT
TCTAGATAGATGATTAGAAAGGGGTTCAGTTGATTGAGGATTGGGTTTTGATGATTGACGGACGAGATGAGAATTCTTA

FIG. 2 continued

TGGTAGGTCTAGATGCGGCTGGTAAGACTACAATATTGTATAAGCTCAAGTTGGGAGAGATTGTTACCACCATTCCTAC
CATTGGATTTAATGTGGAGACTGTAGAGTACAAGAACATCAGTTTCACTGTGTGGGATGTTGGAGGTCAAGACAAGATC
CGACCCTTGTGGAGACATTACTTCCAAAACACCCAAGGTCTTATCTTCGTGGTTGACAGCAACGATCGTGATCGTGTTG
TTGAAGCTAGAGATGAACTGCATAGGATGTTGAATGAGGATGAGTTGAGAGATGCTGTGCTTCTAGTGTTTGCTAACAA
ACAGGATCTTCCAAATGCAATGAATGCTGCTGAGATCACTGATAAGCTTGGTCTTCACTCTCTTCGTCAACGACACTGG
TACATCCAGAGTACATGTGCAACTTCAGGAGAAGGGTTGTATGAAGGTCTTGACTGGCTCTCCAACAACATTGCTAACA
AGGCATAGAAGTCTCAACATTGATATTTTGGCCTATGTTGGTTGAATGTTGAATTATTTAGTATTTTCGTCATCATAAA
TGTCGTTACTGTATGTGTCTTCTTGTTCGTATATTTCTCTCCCCCTGTTAATTGTTGAGAAAGGAATTGTTCTTAATAC
CTTTCTTATGTGAATGATTTCTATGTTACAGACTACATTTGTTTCTCTTTAGATCCATAATAATTGCAGAGCATATTAA
AAAAAAAA

> SEQ ID NO: 5979 139321 230754_301071_1b
ACGCGTCGGTTCTTGGCTGTCTAGGGCGATCGATCTCTCCATCGCCGCTGCGGATCGAAGCTCGCCGCCATGGGGCTCA
CCTTCACCAAGCTCTTCCAGCGCCTCTTCGCCAAGAAGGAGATGCGAATCCTCATGGTGGGTCTGGATGCCGCGGGTAA
GACCACCATCCTCTACAAGCTCAAGCTGGGCGAGATCGTGACGACCATTCCCACCATCGGGTTTAATGTGGAGACTGTC
GAGTATAAGAACATCAGCTTCACCGTGTGGGATGTCGGAGGTCAAGACAAGATCCGGCCATTGTGGAGACACTATTTCC
AGAACACTCAAGGTCTGATTTTCGTGGTGGACAGCAACGATAGAGACCGTGTTGTGGAGGCCAGGGATGAGCTCCACAG
GATGCTCAACGAGGACGAGCTGAGAGATGCGGTGTTGTTGGTGTTCGCCAACAAGCAAGATCTTCCCAACGCCATGAAC
GCGGCCGAGATCACCGACAAGCTCGGCTTGCATTCTCTCCGCCAGCGCCACTGGTACATCCAGAGCACTTGCGCCACCT
CTGGAGAGGGTCTCTACGAAGGACTCGACTGGCTGTCGAACAACATCGCGAACAAGGGCTGAGTGATCAGTACCGATCG
ATCCATTTGAAGTTTTGCGCTTTCATCATCATGACTATCTACAATATATAGATTACAAAAATGTGGCTTTTGTTCTCTT
AGCTCTAGATATAAATTTGTGCCCCAATTACTCTCTGGAAAAAAGAAATGCTGCGTCTAAT

> SEQ ID NO: 5980 139321 227264_301009_1b
GATGCGGATCCTGATGGTGGGGCTCCACGCCGCCGGAAAGACCACCATCCTCTACAAGCTCAAGCTCGGCGAGATCGTC
ACCACCATCCCCACCATTGGGTTCAATGTTGAAACTGTTGAGTACAAGAACATTAGCTTCACTGTCTGGGATGTGGGGG
GTCAAGACAAGATCAGACCTCTTTGGAGGCATTACTTCCAGAACACACAGGGTCTTATCTTTGTTGTGGATAGCAATGA
TCGCGACCGTGTTGTGGAAGCTAGAGATGAGCTGCACAGGATGCTGAATGAGGATGAGTTGCGTGATGCTGTGTTGCTT
GTGTTTGCCAACAAGCAAGATCTTCCAAACGCTATGAATGCTGCTGAGATTACTGATAAGCTTGGATTACATTCCCTTC
GTCAGCGTCACTGGTACATCCAGAGCACTTGTGCCACAACTGGCGAGGGTTTGTATGAGGGCCTGGATTGGCTGTCCAG
CAACATTGCTAGCAAGGCTTGATGCTTGATACGTGGACCTTTAAGACATGG

> SEQ ID NO: 5981 139321 225543_300988_1b
AAGAGGATGGGGCTGCTGACGATCATCCGCAAGGTAAAGCGGAAGGAGAAGGAGATGCGCATTCTCATGGTGTAAGATC
TCTGCTTTGATCTGTCGCTCGACCTCTCTTTCTTCTCGCTGTGCGGCAGAGGATTGGACAATGCGGGCAAGACGACCAT
TGTCAAGCGAATGAATGGCGAGGACATCAGCGATATCAGCCCTACTCTTGGATTTAACATCAAGACGATGCGTTATGGC
AAACTGAACATATGGGACGTTGGTGGCCAAAAGACTTTAAGATCGTACTGGAGGAACTACTATGAGCAAACAGATGGTT
TAGTGTGGGTGGTGGATAGCGCTGATTTGCGTCGCCTCGACGACTGCAAGAAGGAACTACACAATCTTCTCAAAGAGGA
GCGTCTTGCCGGAGCTTCCCTACTGATACTGGCAAACAAGCAGGACATAGATGGTGCTCTAAGCGTCGACGAAATCTCA
AAGGTGCTGCGGCTCGATCTGATGGACAAAAGCAGGCATTCCCGAACAGTCGGATGCAGTGCAGTTACTAGCGATGGAT
TACTCGAAGCATTCGACTGGCTGGTCTCGGACATAGGCTCGCGTAT

> SEQ ID NO: 5982 139321 2709_300338_1b
CCCACGCGTCCGATTGCTCTTTCAAATTTCTTCGAGTCTCTCTCGCTCTCTCCGTTTCTTCGCGGTCTCTCTCTCTCAG
ATCTCTCCGAAACATTCTTCGTAGTGAAGCAAAATGGGGTTGAGTTTCGCCAAGCTGTTTAGCAGGCTTTTTGCCAAGA
AGGAGATGAGAATTCTGATGGTTGGTCTTGATGCTGCTGGTAAGACCACAATCTTGTACAAGCTCAAGCTCGGAGAGAT
TGTCACCACCATCCCTACTATTGGTTTCAATGTGGAAACTGTGGAATACAAGAACATTAGTTTCACCGTGTGGGATGTC
GGGGGTCAGGACAAGATCCGTCCCTTGTGGAGACACTACT

> SEQ ID NO: 5983 139321 55529_300128_1b
GATTGGAAGCTTCTCTCTCTCGGTTTTGATCCCTTTCAATTCTCCAAAGGATCAACAGTTAAAAGGAAAATGGGGCT
TTCATTTGCAAAGCTTTTTAGCCGGCTTTTTGCCAAGAAGGAGATGCGAATCCTTATGGTTGGTCTTGATGCTGCTGTA
AGACCACCATTTTGTACAAGCTCAAGCTTGGTGAGATTGTCACCACCATTCCCACCATCGGGTTTAATGTGGAGACGGT
TGAGTACAAGAACATCAGCTTCACGGTTTGGGATGTCGGGGGTCAGGACAAGATCCGTCCCTTGTGGAGACACTACTTC
CAAAACACTCAAGGTCTGATATTTG

FIG. 2 continued

> SEQ ID NO: 5984 139321 103605_300362_1b
GCGAGAACAGAACATCCATAGCTTTCGCATTTTATTGTCATTTCTAAAGGGCAGAGTCTTTTCTAGATCTGCCCCTCTC
TCTCGCTCTCTCCTGATTCGTTGTTCATCACTGCATTGAGAAAAGATGGGTTTATCATTCGGGAAGCTTTTTAGTCGGC
TGTTTGCCAAGAAGGAGATGCGTATTCTGATGGTCGGTCTTGATGCAGCTGGTAAAACCACCATATTGTACAAGCTCAA
GCTGGGAGAGATTGTTACCACCATTCCTACCATTGGATTCAATGTGGGAGACTGTTGAATACAAGAACATAAGCTTCACT
GTCTGGGATGTTGGTGGTCAGGACAAGATCCGACCATTGTGGAGGCATTACTTCCAAAACACACAAGGACTTATCTTTG
TGGTCGATAGTAATGATCGTGATCGTGTTGTTGAGGCTAGAGATGAGCTGCACCGGATGTTGAATGAGGATGAACTGAG
GGATGCTGTGCTGCTTGTGTTTGCTAACAAGCAAGATCTTCCAAATGCTATGAATGCTGCTGAGATTACTGACAAGCTT
GGTCTTCATTCTCTCCGTCAACGTCACTGGTACATTCAGAGCACTTGCGCTACCTCTGGAGAAGGGTTGTATGAGGGGC
TTGACTGGCTCTCAAACAACATTGCAAACAAGGGTTGAATGCGAGATCCATGATTTTTGCAGCTATGTTTTTGTCAATA
TAGACTTCAACAATGTCTAGAGCACTTATGTACTTACTGATCTTTCTTTCGCGGGATAGATCTGCTTATCCCTATTGTT
ATCAGTACGTTTGCCCTTTCTTTTAAAGAATGGTACTCTGCAGCAACTTTAGGTTAAAATTCATGTAATATTTTACACT
TTGGCTGACATATGCTCAAGGACTTTGCCTTCAACATTTTATTTTAATTGAGAT

> SEQ ID NO: 5985 139321 1118074_301852_1b
GTAGTTCTCCTTGCCATGGGCTCACCTTCACGAAGCTCTTCCAGCGCCTTTTCGCGAAGAAGGAGATGCGGATCCTCA
TGGTCGGCCTCGATGCCGCCGGGAAGACCACCATTCTCTACAAGCTCAAGCTCGGAGAAATCGTCACCACCATACCCAC
CATTGGTTTCAATGTGGAGACTGTGGAGTACAAAAACATCAGCTTTACTGTGTGGGATGTTGGTGGCCAGGACAAGATT
AGACCTTTGTGGAGGCACTATTTCCAGAACACACAGGGGTTGATATTTGTGGTGGACAGCAATGACAGAGATCGTGCAG
TGGAGGCGCGTGACGAGCTGCATAGGATGCTCAACGAGGATGAACTTCGAGATGCAGTTCTTCTTGTTTTCGCAAACAA
GCAAGATCTTCCGAACGCTATGAGTGCGGCTGAGATCACAGACAAGCTCGGATTGCATTCGACTCGCCAGCGTCATTGG
TATATACAGAGCACCTGTGCGACATCCGGAGAAGGGTTATATGAAGGATTAGATTGGCTCTCAAGCAACATTGCAAGCA
AGGTATAAACAAACAAGTGAGTCATCTGCAAGTGAAGCTGATTACGTGTACACTTTCTCTCTGGTGGATG

> SEQ ID NO: 5986 139321 124669_300424_1b
CTTTCCGATCACTACATATTTTCCAGCGTTAATCTCAGGTTTGTCCTCTCATTAGATCCCTCCTCCAAAAGCTCTTTTC
AGGGATCATCAACAAGGAAGCTAAATGGGGCTGACATTCACCAAGCTCTTCAGTCGGCTTTTTGCCAAGAAGGAAATGC
GCATTCTAATGGTTGGTCTTGATGCAGCTGGTAAGACTACCATATTGTACAAGTTGAAGTTGGGAGAGATCGTCACTAC
CATTCCCACCATTGGTTTCAATGTGGAGACTGTTGAGTACAAGAACATCAGCTTCACTGTTTGGGATGTCGGGGGTCAG
GACAAGATCCGTCCATTGTGGAGGCACTACTTCCAGAACACTCAGGGTCTCATCTTTGTGGTTGATAGTAATGATAGAG
ACCGTGTCGTAGAAGCAAGAGATGAATTGCATAGGATGTTGAATGAGGATGAACTTCGGGATGCTGTGCTGCTAGTTTT
TGCTAACAAACAAGATCTTCCTAATGCAATGAATGCTGCTGAAATAACTGATAAGCTTGGACTGCACTCCCTTAGGCAG
CGTCACTGGTACATCCAGAGCACTTGTGCAACATCTGGAGAGGGCTTTATGAGGGACTTGATTGGCTTTCTAACAACA
TCGCTAACAAGGCCTAAATGATGCAGATTTGTTATTGCGGGTTGATCCTGGATGCAGGCGGGTTTTATCTAGTTATTT
TTTTTCTTCTCAAGTCAGTGTGGTTATGAACATCTCCTTAAAATCATTTTGCATCTTCATAGGGCTTTTTGTAATGGCT
GTAAGACGATGGTCGAATATATGTAATTGCTGTCTGTTTAGGTATATTTTCATAAATTTGTATAACAAAGACTAGCTT
TCTTATAACATAGCATTTGTTAATGATTAAAGCCTT

> SEQ ID NO: 5987 139357 139092_300406_1b
CCCATCCATCCATCATCCATCTCATCATCAGCAACCAATTCGCACCGATCGATCGATCGATCGATCCAGCAACTAGATC
AACAGTACTAGCTAGGAAGCATGGCCCGTGCACAGTTGGTGTTGGTCGCCCTGGTGGCAGCTCTGCTCCTCGCCGCCCC
GCACGCCGCCGTGGCCATCACCTGCGGCCAGGTCAACTCCGCCGTCGGGCCCTGCCTGACCTACGCCCGCGGCGGCGCC
GGGCCGTCGGCGGCCTGCTGCAGCGGCGTGAGGAGCCTCAAGGCGGCAGCAAGCACGACCGCAGACCGGCGCACCGCCT
GCAACTGCCTCAAGAACGCGGCCCGCGGCATCAAGGGGCTCAACGCCGGCAACGCCGCCAGCATCCCCTCCAAGTGCGG
CGTCAGCGTCCCCTACACCATCAGCGCTTCCATCGACTGCTCCAGGGTGAGCTGAGCCATCGATCAGAGAGACGGATCA
TATATATACAGCAGCGCGCCGGTTGCCACCTAGTAGATTCTGCCTGGGTCGATGTGTGGAGCCGAATTCTGTATCCAGT
ACTAGTAGTATCATATCTGTATTCTGGAATAAAAGATGAGCTAGCTAAGGTCTCGATCAATCACCATGCATGCATGTGT
GTGCATCCATG

> SEQ ID NO: 5988 139357 170429_300533_1b
CCCACGCGTCCGCCCACGGGTCCGCTCACCTGCAGCAGCAAACGAGCACCACACACCAGCAGCAGCAGCAAGTCGATCG
ATCGTCAGCACACACGACCAAGATCGAGATGGCCCGTGCACAGCTGGTGTTGGTCGCCCTCGTGGCAGCGGCTCTGCTC
CTGGCGGGCCCACACACCACCATGGCCGCCATCAGCTGCGGCCAGGTCAACTCCGCCGTGTCGCCCTGCCTCAGCTACG
CCCGCGGCGGCTCCGGCCCGTCGGCGGCCTGCTGCAGCGGCGTCAGGAGCCTCAACTCCGCCGCCAGCACCACCGCCGA
CCGCCGCACCGCCTGCAACTGCCTCAAGAACGTGGCCGGCAGCATCAGCGGCCTCAACGCCGGCAATGCCGCCAGCATC
CCCTCCAAGTGCGGCGTCAGCATCCCCTACACCATCAGCCCCTCCATCGACTGCTCCAGCGTGAACTAATCCGATCGAT

FIG. 2 continued

CGCTACCGGAGGATGACATGCAGCGCCGGCCGAGATGCAGCTGTCGTCTCACGCTTTGTATCTTGTGTTATCTGTGTTT
ATGCTGAATAAAATGAGAGCTAGCTAGCTAGGTCGATCCATCGCCATGCATACATGGTTGATCGCCCGGCCGGTCACTA
CGCTATCTGTTTCCTTAATTTATTCGTCGATCGAC

> SEQ ID NO: 5989  139357  190853_300736_1b
CCCCATCCATCCATCATCCATCTCATCATCAGCAACCAATTCGCACCGATCGATCGATCGATCCAGCAACTAGATCAAC
AGTACTAGCTAGGAAGCATGGCCCGTGCACAGTTGGTGTTGGTCGCCCTGGTGGCAGCTCTGCTCCTCGCCGCCCCGCA
CGCCGCCGTGGCCATCACCTGCGGCCAGGTCAACTCCGCCGTCGGGCCCTGCCTGACCTACGCCCGCGGCGGCGCCGGG
CCGTCGGCGGCCTGCTGCAGCGGCGTGAGGAGCCTCAAGGCGGCAGCAAGCACGACCGCAGACCGGCGCACCGCCTGCA
ACTGCCTCAAGAACGCGGCCCGCGGCATCAAGGGGCTCAACGCCGGCAACGCCGCCAGCATCCCCTCCAAGTGCGGCGT
CAGCGTCCCCTACACCATCAGCGCTTCCATCGACTGCTCCAGGGTGAGCTGAGCCATCGATCAGAGACGGATCATATAT
ATACAGCAGCGCGCCGGTTGCCACCTAGTAGATTCTGCCTGGGTCGATGTGTGGAGCCGAATTCTGTATCCAGTACTAG
TAGTATCATATCTGTATTCTGGAATAAAAGATGAGCTAGCTAAGGTCTCGATCAATCACCATGCATCCATGGTTGATCG
GCCCGGTCACGCTAGCTAGCTTTCTTCTTCTTGTGTGTTCGTCTCGTACGTTTTGCTCCTTTTCGAGGGGTACGTGTAC
CAGAGAGAGCTAGAGATTCTACATGCATGTACTGCAACTCCTTGTACTACGTGCTTGTTTTGGATTATTACACATACAT
ATAGCTCTTTTTCGTACATCT

> SEQ ID NO: 5990  139357  188284_300689_1b
GCCCACGCGTCGCCCACGCGTCGCCCACGCGTCGCTCATCAGCAACGAACCAAGTCACACCGATCGATCGAGCAACAGT
AGTAGGAACCATGGCCCGTGCACAGTTGGTGTTGGTCGCCGTTGTGGCAGCTCTGCTCCTCGCCGCCCCGCACGCCGCC
GTGGCCATCACCTGCGGCCAGGTCAACTCCGCCGTTGGGCCCTGCCTCACCTACGCCCGCGGCGGCGCCGGCCCGTCGG
CGGCCTGCTGCAGCGGCGTGAGGAGCCTCAAGGCCGCAGCCAGCAGCACCGCTGACAGGCGCACCGCGTGCAACTGCCT
CAAGAACGCGGCCCGCGGCATCAAGGGGCTCAACGCCGGCAACGCCGCCAGCATCCCCTCTAAGTGCGGCGTCAGCGTC
CCCTACACCATCAGCGCTTCCATCGACTGCTCCAGGGTGAGCTGAGCTATCGATCGGATGGATCATTTATATGCATACA
GAAGCGCGACGGTGGGTCGATGTGTGGAGCCGATCGAATTCTGTATCCAATATTAGTAGTATCTGTACGTATTCTGGAA
TAAAAAGATGAGCTAGCTAAGGTCGATCAATCACCATGCATGCATGTGTGCATCCATGGTTGATCGGCCCGGCCGGT
CAGGCTAGCTAGCTTTCTTCTTCTTGTGTGTTCATCTCGTACGTTTGCTC

> SEQ ID NO: 5991  141821  159833_200026_1b
AAATTTGATTGAAGCCGGAGAAAATGGCGATAGGGAGCTTAGCAAGACGAAAGGCCACAACAATTTTATCTTCTAGATA
TCTCTATAGCACATCCAAATATTCATTTTCTCTTAACAGAAATTACTCTTCGGGATCTGATGAAAACGACGTCGTTGTT
ATCGGCGGTGGACCCGGCGGCTATGTGGCGGCGATTAAAGCTGCACAGCTTGGGCTCAAAACTACTTGTATTGAGAAAC
GTGGTACCCTTGGTGGTACCTGTCTCAATGTTGGTTGTATTCCTTCTAAGGCACTTCTTCACTCCTCCCACATGTACCA
TGAAGCTCAACATTCATTTGCTAGTCATGGTGTGAAGTTCTCTTCCGTTGAGGTAGATCTTCCTGCCATGATGGGCCAA
AAAGATAAAGCTGTGGCTAACTTAACACGAGGTATTGAGGGTCTATTCAAGAAGAACAAAGTGAACTATGTTAAGGGCT
ATGGCAAATTCCTTTCTCCTTCTGAAGTTTCTGTCGACACTGTGGAAGGTGGTAATACTGTTGTTAAGGGGAAGAATAT
TATAATTGCCACTGGTTCTGATGTCAAAAGTCTACCTGGGCTAACTATTGATGAGAAGAGAATTGTATCATCCACTGGA
GCTTTAGCTTTGACCGAAGTTCCAAAAAAGCTGGTTGTTATTGGTGCTGGCTACATAGGCCTTGAAATGGGATCTGTCT
GGGGCCGTCTTGGCTCAGAGGTGACTGTTGTTGAATTTGGACCTGATATTGTTCCATCCATGGATGGTGAAGTTCGCAA
GCAATTCCAACGTTCTCTTGAGAAGCAAAAGATGAAGTTCATACTTAAAACTAAGGTAGTATCAGTTGAGACTGTTGGC
GATGGTGTGAAGTTGACCCTTGAACCTGCAGCTGGTGGTGATCAAACTACTCTTGAGGCTGATGTTGTTCTTGTTTCTG
CTGGTAGAATTCCGTTCACTTCAGGGCTTGGATTGGACAAGATAGGTGTTGAAACTGACAAGGCTGGTCGAATCTTGGT
CAATGAACGTTTTGCAACTAATGTCCCGGGGTACATGCAATTGGTGATGTCATTCCTGGGCAATGCTGGCTCACAAG
GCAGAGGAGGATGGTGTTGCTTGTGGAATTCATTGCAGGCAAGGAGGGTCATGTGGACTACGATTGGTCCCTGGTG
TTGTTTACACGCACCCAGAGGTGGCTTCTGTTGGGAAAACTGAAGAACAAGTTAAGGCACTTGGCGTTGATTATCGTGT
AGGAAAATTTCCCTTCCTTGCAAACAGTAGGGCCAAGGCAATTGATGATGCTGAGGGAATTGTAAAAGTACTTGCTGAG
AAGGAGACTGACAAATCTTGGGTGTTCATATTATGTCACCAAATGCAGGGGAGCTTATTCACGAGGCTGTCCTGGCTT
TGCATTATGGAGCATCAAGTGAGGACATTGCTCGTACATGCCATGCACATCCAACAATGAGTGAGGCTCTGAAAGAAGC
AGCCATGGCCACTTACGACAAGCCCATTCACATATAAAATAGTGTCATATATTTGTTTTTGTTTTTCCTCTGAGTATC
TTGAATACTTAGAGCATATTTTCTAATTGCCACCTCATCACTCAAGTATCTCTTGAACAGATATTTCCTCCCTCTTCTC
TAATTATCCAAAGTACTTCCAACTTAATGTTTCTGTTCTGCATATTCATATCTGTAATAAAGTCAGGAGCTGTATGTCA
AAGTTTAAATGCCATCGATTTGAGTTTCATTGAGTTTTGATCAGCGTTGAGCACAAAACAAAAAACAAAAAAAAAAAG
GGGGG

> SEQ ID NO: 5992  141821  239493_301304_1b
GATTCGCTTGGGTCCTCGCATTGCTCGGCGGCTTGCCATGGCCATGGCGGGAGGCAGGGGAGGAGCGCCGCTCTCGGA
TTGGGTCGGCTCCTGTACACGAGGAATGGCTTCATCGGTCGCTTGGGTGTGAGGGGCTTTGCGTCCGGCGGCGAAGAGA
ATGACGTAATTGTCATCGGCGGCGGACCTGGCGGATACGTTGCGGCGATCAAGGCGGCGCAGCTGGGATTCAAGACGAC

FIG. 2 continued

CTGCATCGACAAGAGAGGTTCCCTCGGCGGCACTTGCCTCAACGTCGGATGCATCCCTTCCAAAGCACTGCTCCACTCG
TCGCATATGTTCCACGAAGCCAAGCACACATTCTCCAAGCACGGCGTGAAGCTGTCCGGTGTGGACATCGACGTCGCAC
CCATGATGGCGCAGAAGGAGCAGGCCGCGTCGGGGCTGACTAAGGGAATCGAGGGCCTGTTCAAGAAGAACAAGGTGAC
GTACGTCAAAGGCAGCGGCAAGATCGTGTCCCCCAACGACGTGTCTGTGGAGACGCTCGACTCGG

> SEQ ID NO: 5993  141821  181932_300658_1b
CAATCTCGGCAAATCTTCATCATCGTCATTTAAATATTCGTTTTCAGTTTCAAGAGGTTTTGCTTCTGGATCGGCTACT
GATGAGAACGATGTTGTTATCATTGGAGGTGGTCCTGGTGGTTATGTAGCAGCGATTAAGGCTGCTCAATTAGGTCTTA
AGACCACTTGTATTGAAAAACGTGGTGCTCTTGGTGGTACTTGTCTTAATGTTGGTTGTATCCCTTCTAAGGCCCTTTT
ACACTCCTCCCACATGTACCATGAAGCCAAGCATGCATTTGCTAATCATGGTGTTAAGGTTTCAAACGTGGAAGTTGAT
TTGCCTGCAATGCTTGGTCAGAAAGATAAAGCGGTTTCCAATCTCACTCGAGGTATTGAAGGCCTCTTCAAGAAAAACA
AGGTAACATATGTCAAGGGTTATGGTAAGCTTATCTCTCCATCTGAGGTCTCTGTCGAAACCATTGAAGGGGAAAACAC
TGTTGTCAAAGGTAAAAACATTATAATTGCAACAGGGTCAGATGTGAAACCTCTTCCAGGTATAACTATTGATGAAAAG
AAGATTGTTTCATCAACCGGAGCTCTATCTTTATCAGAAATCCCCAAGAAACTTGTTGTCATTGGAGCAGGTTATATTG
GTCTCGAGTTAGGTTCCGTCTGGGCAGGCTTGGATCAGAGGTGACTGTTGTTGAGTTTGCGTCTGACATTGTCCCCTC
CATGGATGGTGAGATTCGCAAGCAATTTCAGCGTTCCCTTGAAAAACAGAAGATGAAGTTCATGCTCAAGACTAAAGTG
GTAGGAGTAGACTCATCAGGTGAAGGCGTTAAATTGACATTAGAACCATCAGCTGGTGGAGATCAGACCACACTCGAAG
CTGATGTTGTCCTCGTCTCCGCCGGTAGATCTCCATTTACAGCTGGTCTAGGACTAGATGAGATTGGTGTGGAGATGGA
TAAAATGGGTCGTATCCCTGTTAATGAGCGATTTGGAACTAATGTACCTGGTGTCTTCGCCATTGGAGATGTCATTCCT
GGACCCATGTTAGCACATAAAGCAGAAGAAGACGGAGTTGCATGTGTGGAATACAT

> SEQ ID NO: 5994  142731  55669_300134_1b
ACTTAAACTTTTTAACATATAGAACTTGATCAAATAGCTCTTCTTTGACGACAGCAGCATCTGCTGATATCTCGATTAT
CGTAGGCTCCACAAAGTTTCCTTCACCTTCGACTGCTTTACCTCCCGTTAGTATTTTACCACCCTGGGATTTGATGACT
TCAATTCCTTTCTCAAAGTTCTTTTTTGATTCAGGAGTATGTAATGGTCCTAACAATGTCCCTTTCTCAAGAGGATTGC
CGATTTTGACTTGTTTGTATGAGGTAAGCAGTTGCTCGAGTACTTTGTCATAGACACTCTCATGCAAAAGCAGCCTACG
GCAAGTTGTGCAACGTTGACCAGCAGTTCCAACCGCAGCGAATAGAACAGATCGAGCCGCTAACTGTATATCAGCATCG
TCCATGACTATGATTGCATTGTTTACACTCAA

> SEQ ID NO: 5995  167332  1110130_301527_1b
ATTCTTTGTGGGGTTAGGGGTTCGAGAGATTGTANAGGATGGGGATGCTTTCCATCGCAGCTCTTCGACGGATCCAGTC
CGTTGCTCGAGCAGGAGGAATCCGTTTGTCTTCGTCTGCTGCAGCAGTTGCCAATGAAGAGTCATACCTCCGCCTCAAA
GACAAATCACATGTCACGTGGCCAAAAGTACTAAATACATCTTTGGAAGAGATAGACCCAGAAGTCACAAATATAATTG
AACTGGAGAAGAATCGCCAATGGAAGGGTCTGGAGCTCATTCCTTCAGAGAACTTTACATCACTCTCAGTGATGCAGGC
TGTTGGTTCTGTCATGACAAATAAATACAGTGAAGGCTATCCGGGAGCCAGATATTATGGAGGAAATGAGTTTATCGAT
ATGGCAGATTCACTATGTCAAAAACGGGCACTTGAGGCTTTTCGCTTGGACCCGGCAAAGTGGGGAGTGAATGTG

> SEQ ID NO: 5996  167332  114319_300007_1b
AATTTTCTCTCTTTCATTTCTTCCTCTCAATTTTCTTCTTCTGCCACTTTTAATTTTCCTCTAATGGATCCCGTTTCAG
TTTGGGGCAACGAACCTCTCTCCGCCGTAGATCCCGAAATCCATGACCTAATCGAAAGGAAAAACGCCGCCAAAGCCG
CGGAATCGAACTAATCGCATCGGAAAATTTCACATCATTCGCCGTAATTGAAGCTCTCGGCAGTGCTTTAACCAACAAA
TACTCCGAAGGAATTCCCGGTAACCGTTACTACGGTGGAAATGAATACATTGACATAATCGAAAACTTGACCAGAAGCC
GTGCTTTAACGGCTTTTCATTTAGATCCAACAAAATGGGGAGTAAATGTTCAACCCTATTCTGGTAGCCCAGCGAATTT
CGCTGCGTATACAGCTGTTTTGAATCCACATGATAGGATTATGGGATTGGATTTACCATCTGGTGGACATTTAACTCAT
GGTTATTATACTTCTGGAGGGAAGAAAATTTCTGCTACTTCGATTTATTTTGAGAGTTTGCCTTATAAGGTGAATTCAA
CAAATGGATATATTGATTATGATAGGTTGGAAGAGAAGGCTTTGGATTTTAGGCCTAAATTGATTATTTGTGGAGGTAG
TGCTTATCCTAGAGATTGGGATTATAAGAGATTTAGAGAAATTGCTGATAAATGTGGAGCCCTTTTGCTTTGTGATATG
GCTCACATTAGTGGCCTTGTTGCTGCTCAGGAAGCCGCCGATCCCTTTGAATATTGTGACTTGGTCACTACCACCACTC
ACAAGAGCTTGAGGGGTCCAAGGGCCGGTATGATCTTCTACCGCAAGGGCCCTAAGCCACCAAAGAAGGGACAGCCTGA
GGATGCGGTCTATGACTTTGAAGACAAGATTAACTTTGCTGTTTTCCCCTCGCTCCAGGGTGGTCCTCACAACCACCAA
ATTGGTGCTCTTGCTGTTGCCCTAAAACAGGCCGCAACTCCTGGTTTTAAGGCTTATGCTAAGCAAGTTAAGGCCAATG
CAGTTGCTCTCGGCAACTACCTCATGAGCAAAGGATACAAACTTGTAACTGGTGGGACTGAGAACCATCTTGTCCTTTG
GGATCTTAGACCTCTTGGTTTGACTGG

> SEQ ID NO: 5997  167332  240949_301318_1b
AAGAAGGCTAGGGTTCTTGGCCTCGAAATATGGGCAGATCTATCTTCCAGCGCCTAGATCGCCGCATCGCCCGCATTAC
AGTCGCGCTAGATCAATGGCGGCCGTCAAGGACTGGGGCAATCAGCCGCTGGTGGCGGTGGACGAGGAGATTTCGACC
TGATCGAGCACGAGAAGGCGCGGCAGTGGCGGGGGATCGAGCTCATCGCGTCGGAGAATTTCACGTCCCAGGCGGTGAT

FIG. 2 continued

```
CGAGGCGCTGGGCAGCGCCCTCACGAACAAGTACTCGGAAGGTATGCCAGGGAATCGCTACTACGGCGGCAACGAATTC
ATCGACCAGATCGAGGAGCTGTGCCGATCCAGGGCGCTGGCGGCATTCCGGCTGGATCCGGGCAGCTGGGCGTCAATG
TCCAGCCCTACTCCGGCAGCCCCGCGAATTTCGCCGCGTATACCGCTGTGCTTGAGCCGCACGACCGGATTATGGGGCT
GGATCTTCCGTCGGTGGGCATCTCACGCATGGCTACTATACGTCCGGCGGGAAGAAGATCTCGGCCACCTCCATCTAC
TTCGAGAGCTTGCCTTACAAGGTGGATCCGAAGACTGGCTACATTGACTATGATCGGCTCGAGGAGAAGGCCATGGATT
TCCGGCCCAAGCTTATCATCTGTGGCG

> SEQ ID NO: 5998 167403 262954_301720_1b
GTTTTCTACTAGGCGAGTCCATGGGTGGAGCAGTAGCACTTCTTATTCATAGATTGCAACCCAATGAATGGAATGGAGC
AGTTTTGGTGGCTCCTATGTGCAAGATATCAAAGGAGCTTCAACCCCCTACCATTGTAAGGTTTATTTTGAGCAAGCTT
GCCTTGATTGCTCCCACTTGGAAGATTGTACCCACAAGAGCATTCTCGATGTAGGTTTTCATGATGCAGACAAACGAG
AGAAGGTACACACATGGACTCTAAATTTGACTAACTTAAATAAATGCTTATGCTCTTTTAGTTTGACTTTTCTTTTATT
CTTATTTGTTTTTCCTTCAAGTCACATGGTCACATGGTGTGCTCAAGATCCATTGGCTAGTGCACCATGGGGATATGAC
AAATGATTATTTCAATAAATCACTTGCATCATGCATGATCAGATTCGCACCAATCCTTACATATATTTGGACAAGCCTC
ATCTTAAAACAGGGTTGGAGTTGTTGAATGCTAGCTTGGACTTGCAGAAACATCTTAATGAGGTGTCATTGCCTTTCTT
GGTACTACATGGCGATAAAGATGTGGTAACAGATCCTA

> SEQ ID NO: 5999 167406 249546_301593_1b
GCAGAGCGCTGTCTGCTGCCGTGCCATGCCTGTCGCACAGATCTGCTTTCAGCAATCACAGGCGTGTGCGGAATGTTTC
AGCCAAGGCTGCGACTGCTCCGGCTGTAAGTTGCAGCTACGATCAAGAGAAGATTCTCATCGCAAACCGGGGCGAGATC
GCTGTCCGGGTGATCCGAACTGCGCACGAGATGGGGATCCAGTGCGTCGCTGTGCACTCGACGGTCGACAGGGAGTCTC
TGCATGTCGAGCTCGCGGACGAGGCCGTGTGCATCGGTGAGCCTGCCAGTGCTAAATCCTACTTGAACATTCCCAATCT
CTTGTCTGCTGCCATGACCCGGAACTGCACAATGCTGCATCCTGGATACGGGTTCTTGTCCGAGAACGCAAAGTTTGTG
GACATGTGCAAAGATCACGGCTTGAACTTCATCGGCCCAAACTCTGATAGTATTCGCACCATGGGAGACAAGGCGACTG
CGAGGGACACGATGAAAAGAGCTGGAGTTCCGACTGTTCCCGGAAGCGATGGTCTTGTCGAGACTACTGAAGAAGCCGT
CCGGCTAGCTCACGAAATTACT

> SEQ ID NO: 6000 167420 267892_200119_1b
CCCCTCGACCCACGCGTCCGGTAGCTTTGGCTCCTTCAAGAATTCCCACAAGCACAAGGCTTCCTTCCAAGAACTCATA
CTCTTTCCCTACTCAATGCCTCTTTAAGAAATTTGAAGTAGCCGAGTTCTCTGGTCTTCGATCAAGTGGATGTGTGACA
TTTTCGAACAAGGAGTCTTCCTTCTTTGATGTTGTGTCTGCTCAACTCACTCCCAAGACCACAGGATCAGCTCCTGTGA
AGGGAGAAACTGTTGCAAAATTGAAGGTTGCTATCAATGGTTTTGGACGCATTGGCAGGAATTTCCTCCGTTGTTGGCA
TGGCCGCAAAGATTCACCACTGGATGTCATCGTCGTCAATGACAGTGGTGGTGTCAAGAATGCATCTCACTTGCTTAAG
TACGATTCCATGCTCGGAACATTCAAAGCTGATGTGAAAATAGTGGATAATGAAACAATTAGCGTTGATGGAAAGCACA
TCAAGGTTGTCTCTAGCAGGGACCCTCTTAAGCTTCCTTGGGCTGAACTCGGTATTGACATTGTTATTGAGGGAACCGG
TGTGTTCGTTGATGGTCCAGGTGCTGGGAAGCACATCCAAGCTGGTGCCAAGAAAGTCATTATCACTGCTCCAGCAAAA
GGTGCTGATATTCCGACCTACGTTGTTGGAGTGAATGAACAAGACTACTCTCACGAGGTTGCCAATATCGTAAGCAATG
CCTCTTGCACCACTA

> SEQ ID NO: 6001 167420 50961_300164_1b
CCCACGCGTCCGCAAACCTTAACTTGGATTCTTTCTGGTCACCATGGCTTCGGGTACTTTCTCTGTCCCCAAGGGTTTC
ACTGAATTCTCAGGATTGCGAAGCTCCTCTGCTTCTCTTCCCTTCGGCAAGAAACTTTCTTCCGATGAGTTCGTTTCCA
TCGTCTCCTTCCAGACTTCTGCAATGGGAAGCAGTGGTGGATACAGGAAAGGTGTGACTGAGGCCAAGCTTAAGGTGGC
CATTAATGGATTCGGTAGGATCGGGAGGAACTTCCTGAGATGTTGGCATGGTCGCAAGGACTCTCCTCTTGATATCATT
GCCATTAATGACACTGGTGGCGTCAAGCAGGCTTCGCATTTACTTAAATACGACTCTACTCTCGGAATCTTTGATGCTG
ATGTCAAACCTTCTGGAGAGACTGCAATCTCTGTTGATGGAAAGATCATCCAAGTTGTCTCTAACCGAAACCCGTCTCT
TCTCCCTTGGAAGGAGCTAGGAATTGACATTGTCATCGAAGGAACCGGAGTGTTTGTGGATAGAGAAGGTGCAGGGAAA
CACATTGAAGCT

> SEQ ID NO: 6002 167420 47365_300170_1b
CCCACGCGTCCGGTAGCCATGGCTTCGGCTACTTTCTCTGTGGCCAAACCATCTCTTCAGGGTTTTTCTGAGTTCTCAG
GACTTCGAAACTCCTCTGCTCTTCCCTTTGCCAAGAGATCTTCTTCCGATGAGTTTGTTTCCTTCGTCAGTTTCCAAAC
TTCTGCAATGAGAAGCAATGGTGGATACAGGAAAGGGGTGACCGAGGCCAAGATAAAGGTAGCCATCAATGGGTTCGGT
AGGATTGGTAGGAACTTCTTGAGGTGTTGGCATGGTCGTAAGGACTCTCCTCTTGATGTCGTTGTCATTAACGACACTG
GTGGTGTTAAACAAGCATCACATCTCCTCAAATACGACTCAACTCTTGAATCTTTGACGCTGATGTCAAACCTTCAGG
AGACTCAGCTCTCTCTGTTGATGGAAAGATCATCAAGATTGTATCTGATCGTAACCCATCTAATCTCCCCTGGGGGAA
CTAGGCATTGACTTAGTTATCGAAGGAACCGGAGTG
```

FIG. 2 continued

> SEQ ID NO: 6003 167420 273119_200142_1b
GGACGCCTGGGCGGACGCGTGGGAAATAGTTCCATAAGGTTATTTAGTTGCATCCATGGCTTCCCACGCAGCTTTGGCT
TCTTCAAGAATTCCAACAACCACAAGGCTTCCTTCAAAGAACTCTCGCTCTTTCCCTACTCAATGCTTATCCAAGAAAT
TTGAAGTAACCGAATTTTCTGGTCTTCGATCAAGTCGATGTGTGACATTTTCCAACAAAGAGTCTTCTTTCTTTGATGT
TGTCTCTGCTCAACTCACTCCAAAGACCACAGGATCAACCCCTGTTAAGGGAGAAACTGTTGCTAAATTGAAGGTTGCT
ATCAATGGTTTTGGACGAATTGGTAGGAATTTCCTTCGATGCTGGCATGGGCGCAAAGACTCGCCACTAGATGTCGTGG
TTGTCAACGACAGTGGTGGTGTCAAGAATGCATCTCACCTGCTAAAGTATGATTCGATGCTGGGAACATTCAAAGCTGA
TGTGAAAATAGTGGATAATGAAACCATTAGTGTTGATGGAAAGCACATTAAGGTTGTTTCTAGCAGGGACCCCCTTAAG
CTTCCTTGGGCTGAACTTGGCATCGACATTGTTATTGAGGGAACCGGTGTGTTCGTTGATGGTCCAGGTGCTGGGAAGC
ACATCCAAGCTGGTGCCAAGAAAGTTATCATCACTGCTCCAGCAAAAGGTGCTGACATTCCTACCTATGTCGTTGGGGT
GAACGAGCAAGACTACTCTCACGAGGTTGCTGATATCATAAGCAATGCCTCTTGCACCACTAACTGCTTGGCTCCGTTT
GTAAAGGTCATGGATGAAGAACTTAGTATTGTGAAGGGTACAATGACAACAACTCACTCTTACACCGGAGATCAGAGGC
TTCTTGATGCTTCACACCGTGACTTGAGGAGAGCGAGAGCAGCAGCATTGAACATTGTCCCAACCAGCACTGGTGCAGC
CAAGGCTGTGTCTTTAGTGCTTCCTCAACTTAAGGGAAAGCTCAATGGCATCGCTCTCCGTGTGCCAACACCTAATGTA
TCAGTTGTTGACCTTGTTGTCAATGTCGCGAAGAAAGGAATTACAGCTGAGGATGTCAATGCAGCTNTCAGAAAAGCTG
CTGATGGTCCATTGAAAGGCGTATTAGCTGTGTGCGATGAACCCTCTTGTTTCAGTTGACTTCAGATGCTCTGATGTC

> SEQ ID NO: 6004 167420 1046427_301923_1b
TGGACTCAGCACTCAAGGTTTTGTTTGCCATGGCAACTGCTTCTATCTATGCCTCCCCTGCCATCTCTCAGGTGTCTGC
GAAGGGGCTTTCTGAGTACTCAGGTCTGAAGAGTGTCAATGGAAGTGCTTTCAGCAAGAGAAACGATGATTTCCTCGCA
ACTTCCTCGGTGACGAAGTCAGCACCGAAGAATGCTTTTGTAGTAGTTGCTGGGGAGGGCAAGATCAAGGTGGCAATCA
ATGGGTTTGGGCGGATTGGGCGCAATTTCATCCGGTGCTGGCACGGGCGCAAAGACTCCCCCCTTGACGTTGTCGTCGT
GAATGATACTGGCGGTGTCAAGCAGGCCTCCCACCTCCTTAAATATGACTCCATGCTTGGTACTTTTGACGCCAATGTT
GCGGCTGCCGGTGATGATGGTATCTCCATCGACGGCAAGGTTATCAAGGTTGTCTCCAGTCGCAACCCCTTGGACCTCC
CATGGAAGGAACTTGGCATAGACCTAGTGATTGAGGGCACAGGTGTGTTTGTGGACCAAGAAGGAGCCGGGAAGCATAT
CACTGCGGGAGCAAAGAAAGTTGTTGATTACTGCCCCTGGGAAAGGTGCGATCCCTACTTATGTTGTGGGTGTGAACGAG
CAACTATATAGCCATGATGATGTCATCATCAGCAACGCATCATGCACCACCAACTGCCTGGCACCATTCGTCAAGGTTC
TCGACGAGAAATTCGGAATTGTGAAGGGCACCATGACAACACCCACTCATACACTGGAGACCAACGTTTGCTTGATGC
AAGCCACCGCGATTTACGGA

> SEQ ID NO: 6005 167420 1171118_302052_1b
AGCTTTTTCAGAGCCTTGATTTGAACCCGAGACCAGGGCCGAGCTAGGCCAGCCATGGCGACTGCTTCCCTTGCTTCCT
CTCCTAAGCCCACCCCTCTTTCCCAGGTTTCTGGTAAGGGGCTTTCTGAGTACTCTGGATTGAAGAGCTCCAGCTGTGT
CCCCTTTGGAAGGAAGAATGATGACCTCCTTTCCAGAGTTGCACTTCTCACCACTGCTGTTTCTAGCTCTGGTGCAAAG
AGGGGAGTAGCTGAGGCCAAGATCAAGGTGGCCATCAACGGGTTCGGAAGAATTGGACGAAACTTTCTCAGGTGTTGGC
ATGGTCGGAAGGATTCTCCCCTCGATGTCGTCGTCATCAACGACACCGGCGGTGTGAAACAGGCCTCCCACCTCCTCAA
GTATGACTCTATGTTGGGCACCTTTGAAGCCGACGTCCAAGTTGCCGGCGAAGATGGAATTTCGGTTGATGGAAAGGTC
ATCAAGATTGTTTCTGATAGGAACCCAGCAACCTACCATGGGAGGCCTATGGAATTGACTTAGTGATTGAAGGAACTG
GTGTGTTCGTTGACCAACAGGGTGCGGGGAAGCACATCACTGCCGGAGCTAAGAAGGTGCTCATTACTGCACCTGGCAA
GGGTAATATCCCCACCTATGTTGTCGGTGTCAACGAGGAATTATACAGCCCGGAGGACACTATCATCAGCAATGCATCA
TGCACTA

> SEQ ID NO: 6006 167420 118046_300063_1b
CACCTTATACCTTCCATATTTCTTTAACTTTCCACACCAAATACCACATTCTTCTGCTGCATTTCTAAAAAGAACAATG
GCTTCGGCTGCTTTCTCAGTAGCCAACTCTTCTCTTCAGGTCAGCAACAAAGGATTCTCTGAATTCTCAGGGCTGCGCA
CGTCATCAGCTATTCCATTCGGAAGGAAAACCAACGATGACTTGCTCTCTGTTGTTGCCTTCCAAACCTCTGTTGTGAG
TGCTATTAATATTGGAGGAGGGAACAACAAGAGGGGAGTAGTGGAGGCCAAGTTGAAAGTGGCCATCAATGGATTTGGA
AGAATTGGAAGGAATTTCTTGAGGTGTTGGCATGGTAGGAAAGACTCTCCCCTTGATGTCATTGCCATCAATGACACTG
GTGGTGTCAAGCAAGCCTCTCACCTTCTCAAATATGACTCCACCCTTGGCATCTTTGATGCTGATGTCAAGCCCGTCGG
CACTGACGGCATCTCCGTCGACGGAAAAGTCATCCAAGTCGTCTCCGACCGCAACCCTGTCAACCTCCCCTGGGGAGAT
CTTGGGATTGACTTGGTGATAGAAGGTACCGGAGTGTTTGTCGACAGAGAAGGTGCCGGAAAACACATCCAGGCCGGAG
CCAAGAAGGTGCTCATCACCGCTCCAGGAAAGGTGACATCCCACATATGTTGTTGGTGTCAATGCTGATCTCTACAA
CCCTGATGAATCTATCATCAGCAATGCCTCTTGCACCACCAACTGCCTTGCTCCTTTTGTCAAGGTCTTGACCAAAAA
TTCGGCATTATCAAGGGAACCATGACAACTACTCACTCTTACACTGGTGACCAAAGGCTTCTTGATGCGAGCCACAGGG
ACCTTAGACGTGCACGAGCTGCAGCCCTCAACATAGTTCCAACCTCAACTGGTGCTGCTAAGGCCGTGGCCCTTGTCCT
CCCAAGCCTTAAGGGGAAGCTCAACGGCATTGCCCTCCGTGTGCCAACCCCTAACGTCTCGGTTGTTGACCTTGTCGTA
CAAGTCT

FIG. 2 continued

> SEQ ID NO: 6007 167420 1171666_302056_1b
GGCTCTCTCAGCTTGCCCTGCTGCTGCTGCTGCCAATGTCTCGTCCATGTTCTCCCCTTCTGTTTCTCGCATGCAGTCT
GCCTCTCTTGCCCCACCCAAGAGAGTGGACATCTCAGAGTTCACAGGATTGAAGGCCTCCCCACTTGTCTCTGCCAGCA
ATCAGAGGGATAGCAACTGCCTCTTCAATGCCGTTTCACGGCAGGTTGCAAAGGCAGGAAAGTCAGGATCAATCAAGGG
AGAGACTATGGCCACATTGAAAGTAGCCATTAATGGTTTTGGACGCATTGGGAGAAACTTTCTCCGTTGCTGGCATGGC
CGGGAAAATTCACCCCTTGAGGTGGTTGTTGTCAACGACAGTGGAGGTGTCAAGAATGCTGCTCACCTCTTGAAATATG
ACTCCATGCTCGGGACCTTCAAAGCCAATGTGAAAATTGTGGATGACAAGA

> SEQ ID NO: 6008 167420 182428_300710_1b
GAATTCAAAATGGCTACTCATGCAGCTCTTGCTTCTTCAAGAATGGCTACTAACACTAGAATTTCTTCCAAATCATCTT
CTCACTCTTACCCATCATCTCAATGCTTCTCCAAGAGAGTTGAGGTTGCAGATTTCTCAGGATTGCGATCAAGTTCGTC
CGTAACTTACGCAAAGAATGCAAGAGAAGCGTCTTTCTATGACGTTGTTGCCACACAACTCACTCCTAAGATCGCTGCA
GGGTCTGCACCTATTAGAGGAGAGACCCACTGCTAAGCTAAAGGTGGCTATCAATGGTTTTGGACGTATCGGTAGAAATT
TCCTCCGATGTTGGCACGGAAGGAAAGACTCGCCCCTCGAGGTTGTTGTTCTCAACGACAGCGGTGGTGTGAAGAATGC
ATCTCACCTTCTCAAATACGATTCCATGCTCGGAACATTCAAGGCAGAGGTGAAGATCGTAGACAACGAACACATCAGT
GTTGATGGTAAGATA

> SEQ ID NO: 6009 167420 188252_300697_1b
ATTCTTCTTGATCTGATCGTCGGACATGGCGTCGCCCATGCTCTCCGCCGCCACCGTGCCACTCCAGGGAGGCGGCTTG
TCGGAGTTCTCCGGCCTGAGGAGCTCGTCGTCGCTGCCGCTGCGGCGGAATGCCACCTCCGACGACTTCATGAACGCGG
TCTCCTTCAGGACCCACGCGGTTGGCACGAGCGGCGGGGCGCGGCGGGCGCCGACGGAGGCGAAGCTGAAGGTGGCGAT
CAACGGGTTCGGCCGCATCGGGCGCAACTTCCTGCGCGTGCTGGCCGGGCGCGGCGACAGCTCGCCCCTCGACGTCATC
GCCATCAACGACACCGGAGGCGTGAAGCAGGCGTCGCACCTCCTCAAGTACGACTCCACGCTCGGCATCTTCGACGCCG
ACGTCAAGCCCGTGGGCGACAACGCCATCTCCGTCGACGGCAAGGTCGATCAAGGTCGTCTCCGACCGCAACCCGTCCAA
CCTGCCGTGGGGCGAGCTCGGCATCGACCTCGTCATCGAGGGCACCGGTGTGTTCGTCGACCGCGACGGCGCGGGCAAG
CACATCCAGGCCGGCGCCA

> SEQ ID NO: 6010 167420 190962_300737_1b
CCCCCGAGCTTGCTGCTGCTGCATTCTTCTTGATCTGATCGTCGGACATGGCGTCGCCCATGCTCTCCGCCGCCACCGT
GCCACTCCAGGGAGGCGGCTTGTCGGAGTTCTCCGGCCTGAGGAGCTCGTCGTCGCTGCCGCTGCGGCGGAATGCCACC
TCCGACGACTTCATGAACGCGGTCTCCTTCAGGACCCACGCGGTTGGCACGAGCGGCGGGGCGCGGCGGGCGCCGACGG
AGGCGAAGCTGAAGGTGGCGATCAACGGGTTCGGCCGCATCGGGCGCAACTTCCTGCGCGTGCTGGCACGGGCGCGGCGA
CAGCTCGCCCCTCGACGTCATCGCCATCAACGACACCGGAGGCGTGAAGCAGGCGTCGCACCTCCTCAAGTACGACTCC
ACGCTCGGCATCTTCGACGCCGACGTCAAGCCCGTGGGCGACAACGCCATCTCCGTCGACGGCAAGGTGATCAAGGTCG
TCTCCGACCGCAACCCGTCCAACCTGCCGTGGGGCGAGCTCGGCATCGACCTCGTCATCGAGGGCACCGGTGTGTTCGT
CGACCGCGACGGCGCGGGCAAGCACATCCAGGCCGGCGCCAAGAAGGTGCTCATCACCGCCCCGGCAAGGGTGACATC
CCCACCTACGTCGTCGGCGTCAATGCCGACCAGTACAGCCCCGACGAGCCCATCATCAGCAACGCCTCCTGCACCACCA
ACTGCCTCGCCCCCTTCGTGAAGATCCTCGACCAGAAGTTCGGCATCATCAAGGGGACGATGACCACCACCCACTCCTA
CACCGGC

> SEQ ID NO: 6011 167420 23595_300215_1b
CCCACGCGTCCGAATCTTTGGCCAAGCACCATGGCAACAACCATGAAGACTGCCATCTCTGGCAAGACTGCGGGTCTCC
AGAAGTCTGGCGTGAGGCCCGCCAGGGCCTCCGTCAAGATGGAGGTTGTCGCCGAGAAGAAGCTCAGGGTGGCCATCAA
CGGCTTCGGCCGCATTGGTCGCAACTTCCTGCGCTGCTGGGAGGGCAGGTCCAACACCCTGCTTGACGTTGTTGCTATC
AACGACTCTGGAGGTGTCAAGCAGGCATCTCACCTGCTGAAGTACGACTCCATCCTGGGAACCTTCAACGCTGACGTGA
AGGTGGTCGATGACTCCACCATCTCCGTCAACGGCAAGCAGATCAAG

> SEQ ID NO: 6012 167420 2291_300350_1b
AATTCGGCACGAGCTCTCAGTTGCCAACTCTTCTCTTCAGGTCAGCAACAGAGGATTCTCTGAATTCTCAGGGCTGCGC
ACCTCATCAGCAATTCCATTCGGAAGGAAAACTAACGATGACTTGCTCTCTGTTGTTGCCTTTCAAACCTCTGTTATTG
GAGGAGGGAACAACAAGAGGGGAGTAGTGGAGGCCAAGTTGAAAGTGGCCATCAACGGATTTGGAAGAATTGGAAGGAA
TTTCTTGAGGTGTTGGCATGGTAGGAAAGACTCTCCCCTTGATGTCATTGCCATCAATGACACTGGTGGTGTCAAGCAA
GCCTCTCACCTTCTCAAATATGACTCCACCCTTGGCATCTTTGATGCTGATGTCAAGCCCGTCGGCACTGACGGCATCT
CCGTCGACGGAAAAGTCATCCAAGTCGTCTCCGACCGCAACCCTGTCAACCTCCCCTGGGGAGATCTTGGGATTGACTT
GGTGATAGAAGGTACCGGAGTGTTTGTCGACAGAGAAGGTGCCGGAAAACACATCCAGGCCGGAGCCAAGAAGGTGCTC
ATCACCGCTCCAGGAAAAGGTGACATCCCCACATATGTTGTTGGTGTCAATGCTGATCTCTACAACCCTGATGAATCTA

FIG. 2 continued

TCATCAGCAATGCCTCTTGCACCACCAACTGCCTTGCTCCTTTTGTCAAGGTTCTTGACCAAAAATTCGGCATTATCAA
GGGAACCATGACAACTACTCACTCTTACACTGGTGACCAAAGGCTTCTTGATGCGAGCCACAGGGACCTTAGACGTGCA
CGAGCTGCAGCCCTCAACATAGT

> SEQ ID NO: 6013 167459 174995_300528_1b
CGGCGACGCGCTCGGGGGGGCGCTCCAGTTCTTCCAGGTCCAGAAGGCGGGGAAGCTGGAGAACAACCAGATCCCGTGG
AGGGGGGACTCGGCGCTGGATGATGGGAAACCAGCGGGGCTGGATCTTTCCAAGGGAATGTATGATGCTGGTGATCATA
TCAAGTTTAGTTTCCCGATGGCCTTCACGGCAACGGTGCTCTCGTGGTCCATACTTGAGTATGGAGATCAGATGAGCGC
CGCGAAGCAGCTGGACCCTGCGCTTGATGCGCTCCGATGGATCACTGATTTCCTCGTCAATGCGCATCCATCTGACAAT
GTGTTCTACATTCAGGTTGGTGATCCTGATCTAGATCACAACTGCTGGGAAAGGCCGGAGACTATGTCTGAGAAAAGAC
CACTCACACAGATTAACACAAAGTCTCCTGGATCAGATGTTGCTGCTGAGGCAGCAGCAGCTATGGCATCAGCATCAAT
TGTTTTCAAATCCAGAGACACTACATATTCTGATTCACTTCTTCAACATGCTCA

> SEQ ID NO: 6014 167459 110831_300047_1b
TTGGGCATAGTGTAGTGTGTATACTCAGTCCAAATGGCCTGCTTTTACTACCTTTCTTGTTCCAAGCTAGCTTTACTTG
TTCTGCTCTGCTTCACTACCTCTCTGCTTCATTGCAGTGCCCACCCTGACCACCATGGCCGTCATCCTCGCTTTGCCTC
GCACAATTACAGAGATGCTCTCACCAAATCCATTCTTTTCTTTGAGGGTCAGAGATCAGGCAAGCTCCCTCCTAACCAG
AGAATCACTTGGCGTAGAAACTCTGCTCTTTCAGATGGCTCCGCATTGCATGTTGATTTGGTTGGGGGATATTATGACG
CAGGAGACAATGTGAAGTTTGGGTTCCCAATGGCATTCACTACCACAATGCTATCATGGAGTGTGATTGAGTTTGGTGG
ACTGATGAAAGGAGAGCTCCAGAATGCAAGACAAGCCATTCGCTGGGCTACTGACTATCTTCTCAAGGCCACTGCCTAT
CCAGACACCATATTTGTTCAGGTGGGGGAAGCAGGAAGTGACCATGCTTGCTGGGAGAGACCTGAGGATATGGACACCC
CAAGAAGTGTATTCAAGATTGACAAAAACACTCCAGGGTCTGAAGTTGCTGC

> SEQ ID NO: 6015 167459 120339_300384_1b
AAAAATACTCCAAATTCCGCTTTTCTTATTTATTCCTTTAACCTACATTGTCTATTTCTAATACTATAATTCTTCATTT
TGTTAAGATCACATTTTCTTTTATCCCGCATTGCTACATGCGGGGATCATTAATCAGGTAATTTCGTGAGTGAATAAGG
AAATGGGAGAGAAATCAAGAAAAGGAGGTTGGTGTGGTTGGATTATAGTTTTAATAGTGGTAGCAGCGGCTGCTGGAGC
CATTGTTGTACTTGTTAAAAAGAAGCATAATGGTTCAAGCCCAGATGCTGCTCCTGTTCCTGGACCTCCTGGTTCTCCT
ACCAAGAAATATGCAGATGCTTTGAAAACTGCAGTGCAATGCAGTTCTTTGATGTACAAAAATCTGGGAAGTTAGTAAATAATA
AAATATCATGGAGAGGTGATTCAGCTGTCAAAGATGGAAGTCCAGCAAAGTTGGATCTCAGTAAAGGAATGTATGATGC
TGGCGACCACATGAAATTTGGATTCCCTATGGCTTACACTGCCACTGTGTTATCGTGGGCCATCCTTGAGTACGGTGAT
CAGATGAAGGTTGTGGACCAACTGGAACCTGCTCAAGACTCACTCAAGTGGATTACCGACTACCTTATCAATGCTCATC
CAAAAGATAATGTTCTTTATATTCAGGTGGGTGATCCTGATGCCGACCATAGATGTTGGGATA

> SEQ ID NO: 6016 167459 146170_200014_1b
AGCAAAGCTGGCTGTTGGGTCCAACGGAGCAGAAGAAGAAGTATGTGGATCTTGGTTGTATTATTGTGAGTCGGAA
GATTTTCAAGTGGACTGTGGGCGTGTATTCTTGCCGCTGCGCTTTTAGCTGGATTCATTACTATGATTGTTAAGCTTGCA
CCTAGACACAAACACCACAACCCCCCACCTGATAATTATACCGTCGCTCTCCATAAAGCCCTCATGTTCTTCAATGCCC
AGAAATCTGGAAAATTGCCGAAGCACAACAATGTGTCATGGAGGGGGAATTCATGTTTAAAAGATGGCCAGTCAGATGA
TTCAACTATGTTCAAAAATTTGGTTGGGGGATATTATGATGCAGGAGATGCAATCAAGTTTAATTTCCCTCAGTCGTTT
GCTCTCACCATGTTAAGTTGGAGTGTGATCGAGTATAGTGCAAAATATGAAGCTGCTGGTGAGCTCGCTCATGTTAAAG
ATATTATTAAGTGGGGTACTGATTATCTCCTGAAGACCTTCAATTCCTCTGCTGATACCATAGACCGCATTGCTGCACA
GGTTGGAAAAGGGGATACTTCCGGAGGGAGTACTGATCACAATGATCACTATTGTTGGGTGCGTCCAGAAGATATTGAT
TACGATCGGCCCGTGACTGAATGTCACGGCTGCTCGGACCTTGCTGCAGAGATGGCTGCTGCTCTGGCTTCT

> SEQ ID NO: 6017 167459 273749_200145_1b
GGGCAAAAAACAGATCTACATAGTTAAGTTTTTTAGCTCACACCATATTACTTGTCGACCGCGTAACAATGAAGGGTTT
TGTGGTTTGTTTGTTTTTAGTAATTGGGGTTCTTCCTTTAGCATTTGCTGGCCATAATTATGGTGAAGCACTAAGTAAG
AGCTTTCTGTTTTATGAAGCTCAAAGATCTGGTTATCTTCCTCATAATCAAAGGGTTAATTGGAGAGGACATTCTGGTC
TTAATGATGGAAAAGCTAGTGGGATTGATTTGGTGGGAGGGTACTATGATGCAGGAGACAATGTGAAATTTGGTTTGCC
TATGGCATTTACTATAACAATGATGTCATGGAGTATTTTAGAATATGGTAGGCAAATGGGTGCTAGTGGTGAACTTGGT
CATGCTATGGATGCTGTTAAATGGGGTACTGATTATCTCCTCAAAGCTCACCCTGAACCTTATGTTCTTTATGGAGAGG
TGGGAGATGGTAACACAGACCATTACTGTTGGCAAAGACCAGAAGATATGTCTACATCAAGAGCTGCTTACAGAATTGA
CCCGAACCATCCGGGTTCGGACCTTGCCGGAGAGACTGCCGCCGCCATGGCCGCCGCTTCCATTGTCTTCCGCCGCTAC
AACCCTGGCTATGCTAATGAGCTACTTAACCATGCCCATCAGC

FIG. 2 continued

> SEQ ID NO: 6018 167459 57387_300056_1b
TAGGTAGACGTTTAGCAGGTGTGTTGTTGGTTTTGGTTTGGGGGGGCTGGGGTTTTTAGAGTATACTTTTCAGTTAGGC
AGTTTCCAAAATGGCTTCTTCTTCCACATTTGCCATAGCCACTTTCCTTTTTCTGCTATGCTTCACTACTCCTCTGTTT
CTTGCCAAACCTCAACACCATCCTCGCTTTGCTTCTCATAACTATAGAGATGCTCTCGCCAAATCCATTATTTATTTTG
AGGGTCAGAGGTCAGGGAAGCTCCCTTCTAACCAGAGGATCACTTGGCGCAAAGACTCTGGCCTTTCAGATGGCAAAGC
CATGGGTGTTGATTTGGTAGGTGGATATTACGACGCTGGAGACAATGTGAAGTTCGGTTTCCCAATGGCATTCACAACC
ACAATGCTGTCATGGAGTGTGCTTGAGTTTGGTGGATTGATGAAAGGAGAGCTACAGAATGCTAAAGAAGCCATTGGTT
GGGCTACAGAGTATCTTCTCAAGGCCACTGCCCATCCGGACACCATTTACGTTCAGGTGGGGATGC

> SEQ ID NO: 6019 167459 33330_300457_1b
GCATACTGGTCATTGATTGGTTAATCAGAGCTCTCTCTTTTCTTTTCCTATCTCTAGAGACTAGAGAAATGGCTCTCTA
TCTCTCTTCTTCACGACTCATCACCTTTCTCTCTTTCATCTTGCTTCTCTCCAATGGCTTCTCGTCCTCTTCCTCTCGC
CCTAGCATCCACCATCGTCACCACCTGGACAACCACAATTACAAAGACGCTCTCTCCAAGTCCATTCTCTTCTTCGAAG
GTCAAAGATCCGGAAAGCTTCCTCCAAACCAGAGAATGACTTGGAGAAGCAACTCTGGTCTCTCTGATGGCTCTGCTCT
CAACGTGGATTTGGTGGGAGGATACTACGATGCAGGGGACAATATGAAGTTTGGATTCCCA

> SEQ ID NO: 6020 167515 276051_200156_1b
GTCAGTTGAGAGCAATTCAAAGGATCGACGACAATGGCTTCTCAGATTGCGAGAAGACTTCTACGTAGCCGCGGTAATT
CGTCGTTTAGGTATTTGGATCGGAGCTTCAGTTCGGAGTCCAATTCGAATTTGATTCGCGCTACTCTTTTCCCCGGCGA
TGGTATTGGCCCTGAGATCGCCGATTCCGTCAGGCAGGTTTTCAAGACTGCTGAGGTACCAATTGAATGGGAAGAACAC
TATGTGGGGAAGGAGATAGACCCTAGAACCAATAGTTTTCTAACATGGGAGAGTCTTGAATCAGTGAGAAGGAATAAGG
TTGGTTTGAAAGGGCCAATGGCCACGCCTATTGGGAAAGGTCATCGTTCCTTGAACCTTACATTGAGGAAGGAGTTAAA
TCTATATGCCAATGTTAGACCTTGCTACAGCCTACCTGGATACAAGACACGCTATGATGATGTCAATCTCATCACTATC
AGGGAAAACACTGAAGGAGAGTACAGTGGCCTTGAACATCAAGTCGTAAGGGGTGTGGTCGAAAGTCTCAAGATCATCA
CTCGTCAAGCAAGCTTAAGGGGTTGCCGAGTACGCATTTCACTATGCCAAGGCTCATGGAAGAGAGAGAGTGTCTGCAAT
TCACAAAGCTAACATCATGCAAAAAACTGATGGTCTTTTCCTTAAGTGTTGCCGAGAGGTAGCAGAGAAGTACCCTGAG

> SEQ ID NO: 6021 167515 280142_200066_1b
CACACACCCTAATATCCATGCCCCAAATTTAATAGTCAAACCTCTCAACCCCATCGATCCATTTCCGATCAATGGCGAA
ACGAGCCCTACCCGTTCTCAAGCACCTCCTCAAGTCCTCATCCCCATCCCCATCCCCATCCCATGGGTTTTCCCATTCA
TTAACGTCAGCCCGATCGGTCACCTACATGCCCCGACCCGGTGATGGCACACCACGCGCCGTCACTCTCATCCCTGGTG
ACGGGATCGGGCCGCTTGTCACCGGCGCCGTCGAACAAGTCATGGATGCGATGCACGCTCCTGTGTATTTCGAGCGATA
TGAGGTTCACGGCGACATGAAGAGTGTGCCTCCGGAGGTTATGGAATCGATCCGTAAGAATAAGGTTTGTTTAAAAGGA
GGGTTGAAAACTCCGGTGGGGGTGGTGTTAGTTCCCTTAATGTTCAGCTTAGGAAAGAGCTTGATCTATATGCTTCCC
TTGTTCACTGCTTCAACTTGCAAGGATTACCGACTCGCCATGAGAACGTTGATATTGTTGTCATTAGGCGAAAACACGGA
GGGTGAATATTCCGGCCTCGAGCATGAGGTTGTTCCGGTGTCGTGGAGAGCCTAAAGGTGATGACAAAGTTTTGCTCG
GAACGAATTGCAAAATATGCCTTTGAATATGCATACCTCAACAATCGCAAGGTAGTGACTGCTGTGCACAAAGCAAACA
TTATGAAACTTGCAGATGGTTTATTTTTGGAGTCTTGTCGTGAGGTTGCAAGCAAATATCCTGATCAAGTACAATGGA
TCATTGAGGATAACTGTTGCATGCAACTTGTATCAAGGACTGAGCAATTTGATGTTATGGTCACCCCAAATCTCTACGG
AAATCTGGCGGCAAATACGGCAGCTGGTATTGCTGGAGGCACTGATGTTATGCCTGGAGGCAATGCGGGGGCTGACCAT
GCT

> SEQ ID NO: 6022 167515 238119_301292_1b
GTTCAACTACAGCACTAGGTCCGGCGGCGGGACGATCACTGCAACTTTGTTCCCCGGCGATGGAATTGGGCCGGAGATC
GCCGAATCGGTCAAGCAGATTTTCCAGGCCGCTGGCGTGCCTATCGAATGGGAAGAGCACTTCGTTGGAAAGTCAGTGG
ATCCAAAGACCGGAAGCTTTGTCACATACGATAGCATGGAGTCTGTGCGCAAGTATGGGATCGGTCTCAAGGGCCCGAT
GGCTACTCCCATTGGAAAGGGCCACAAGTCGCTCAACTTGACGCTACGGAAAGAGCTCGGGCTGTATGCCAACGTCAGA
CCGTGCCTCAGCATTCCCGGCTACAAAACACGGTATGACAACGTCGATCTGGTCACCATCAGGGAGAACACTGAAGGAG
AGTACAGTGGTTTGGAGCACCAAGTGGTGAAAGGTGTTGTGGAGAGTCTAAAGATTATCACTCGCCAAGCCAGCATGCG
TGTCGCAGAGTATGCGTTCCACTACGCCAAAAACGAACGGCAGGAAGCGTGTGTCCGCGATCCACAAGGCAAACATCATG
AAGAAAACTGATGGATTGTTTCTACAGTGTTGTCGAGAGGTGGCGGAGCAAAACCCCGAGATCGTTTACGAGGAGGTCA
TCATCGACAACTGTTGCATGATGCTTGTCAAGAACCCCGC

> SEQ ID NO: 6023 167515 199550_300750_1b
CGCTTCTTCTTCTATATATTCTCGAGATATATACGAACACTCATCGTCACAATGCTGGCCATTCGCTCTCTCTCCAACC
CTGCCAGGCACTGCCTGCGAGCAGCTCCCCGCGCTGCCGCCACCTGGTCCGTTTCGAACAAGCGATTCTACTCCCAGGA

FIG. 2 continued

GCGTGTTGCAAAGTATGAGGGAACCAAGGACTCCAACGGCAACTTCCTCGTCAGCTTAATCGAGGGTGACGGTATCGGT
CCTGAGATTGCCCAGTCCGTCAAGGACATCTTCTCCGCTGCCAAGACCCCAATTGCTTGGGAGCCCATCGATGTCACCC
CCATCATCAAGGACGGCAGGACCGCCATCCCCGACGCCGCCATTGAGAACATCAACAAGAACAAGATTGCTCTCAAGGG
TCCTCTGGCTACCCCCGTTGGCAAGGGCCACGTTTCCCTCAACCTGACTCTGCGACGAACCTTTAACCTGTTCGCCAAC
CTGCGACCTTGCCGATCCGTCGCCGGCTTCAAGACCCCCTACGACGGTGTCGACACTGTCCTGATCCGAGAGAACACCG
AGGGCGAGTACTCTGGCATTGAGCACGTTGTCGTCGACGGTGTTGTCCAGAGCATCAAGCTCATCACCGAGGAGGCTTC
CGAGCGTGTCCTGCGAT

> SEQ ID NO: 6024 167575 241092_301319_1b
AAGAGGGAAGAAGAAGGAAGCGCATCGTAAATCGAGGGCTTTACGAATGGATTCTCTTGCATGGTTTTTATTTTTGTGT
GTTGTCGAGCAGGTCCTTTTAGTTTTTTGAAAGAAAAATTATAGATGGGAGACGGAGATGATGCTCCAGATACCAGTGC
GATTCCCGCTGTGATTGCTACTTCGAGCACCACTGAAGTGTCTGTGGTGGTTCCATGCTCGATCCAAGACGGTCAAAAG
GACTCGCCTTTGGTGGTTCCGTGTGCTATTCCAGCACACCAAGAAGCTGTGCAAGACAGGGACTATAAGTTCCTCTCCA
AGGCTGTGGACGAGGCCTACAAAGGCGTCCATTGCGGCGGTCCATTTGGAGCTGTGGTCGTCCAAAACAATGA
GATCGTCGTCAGCTGCCACAACATGGTGCTCAGGCACACTGATCCCACGGCTCATGCCGAAGTCACGGCTGTTCGAGAG
GCATGCAAGAAGTTGAACCGATTCGAGCTGTCCGACTGCGAGATATTTGCCTCTTGTGAACCATGTCCGATGTGCTTCG
GAGCAATTCACTTAGCACGAATCAAACGCCTGGTGTATGGTGCCAAAGCCGAGGCCGCCATCGCGATTGGCTTCGACGA
CTTCATCGCCGACGCTATCCGGGGCACGTCTTACTACCAAAAGGCAAACTTGGAGATTAAAAGAGCGGACGGAAGCGTT
G

> SEQ ID NO: 6025 167575 12604_300273_1b
CCCACGCGTCCGGCATAATAACGAGGTTGTCGCTAGCTGCCACAATATGGTTTTGAAATATACTGACCCAACTGCACAT
GCTGAAGTCACTGCCATTAGAGAGGCATGTAAGAAACTTAACAAAATCGAGTTATCAGAATGCGAGATTTACGCATCTT
GTGAGCCATGTCCGATGTGCTTCGGAGCCATCCATCTCTCGAGACTCAAGAGGTTGGTTTATGGAGCCAAAGCCGAAGC
AGCTATAGCCATCGGGTTTGATGACTTCATAGCTGATGCTTTGAGAGGCACGGGGGTTTACCAGAAATCTAGTCTGGAG
ATCAAGAAAGCAGACGGGAATGGCGCTGCGATTGCGGAGC

> SEQ ID NO: 6026 167582 167710_300550_1b
GAATTCAAGACGAAAAGAAAGAAAAGAAGAAGGGGAAAAACAAAGATGGCGAAGAGGACAGCAAGGATGAAAAGAAGAC
TAAAGACAAAGATGAAAAATCAAAGAAGAAGGAGAAGGATGAAGGCACTGACATGAAAGAAGAAAAAAAGAAGGACAAG
GAAGGGAAGGAGAAAGATGGAAAGGAGAAGAAAGAAAAGAAAAGAAGGACAAGAGCAAAGATGAGAAAGATGGCAGCA
GCAAGAAGAAAGAAAAGGATGGGGAATCAAAGGAAAAAAAA

> SEQ ID NO: 6027 167874 176265_300520_1b
CCCCCCGGGCACCAAGACCAGGTAGCCGCAGAGAGAGGAGAGCGCGAGCAGAGCAAGCAACCAAGCAGCAGCAGCGATG
GCCGACGCAGCCACGACATCCTCCCACCTGCTCCTGCTCTCCCGCCAGCAGGCGGCGGCCTCGCTCCAATGCGGCCTCT
CCTTCCGGAGGCAGCCCGGCAGGCTCGCCGGTGGGTCGTCGGCCCCGAGCGTGCGGTGCATGGCGGCCGTCGACACGGC
CTCGGCGCCCGCCGCGACGGAGGCTAGCAAGAAGAGCAGCTACGAGATCACCACGCTGACGACGTGGCTGCTGAAGCAG
GAGCAGGCCGGGACCATCGACGGCGAGATGACCATCTGCTGGCCAGCATCTCCACGGCGTGCAAGCAGATCGCCTCGC
TGGTGCAGCGCGCGCCCATCTCCAACCTCACCGGCGTCCAGGGCGCGACAACGTGCAGGGCGAGGACCAGAAAAAACT
CGACGTCGTCTCCAACGAGGTGTTCTCCAACTGCCTCAAATAGAGCGGGCGCACCGGCGTGATCGCGTCGGAGGAGGAG
GACGCGCCGGTGGCCGTGGAGGAAAGCTACTCGGGCAA

> SEQ ID NO: 6028 167874 238917_301299_1b
TATTTCTTGGCGATGGCGGCATCGTCGGCCACGCATTGCCTCACCGATCCATCCACCAAGATCATCAATGCGCTGGCCA
AGAACACGATTCGATGCTCCGTGTCCATCGCCGGCGGCAGGGATTTCGCCAGGAATCGTGCGTTCCAGCAGCAGCATTG
TAGAAATCCAGGGATCAGGGCGGCGGTGAGCGTGGAATCGGCCACGGAGAAGAAGGCGAGCAGCGGCGGCTGGGAA
TACCAGCTCAACACCCTCACGAACTGGCTGCTCAAGCAAGAACAGGCAGGGATCATCGATGGTGAGCTCACGATCGTCC
TCTCCAGCATCACGGTCGCTTGCAAGCAAATCGCGGCGCTGGTCCAGCGGGCTGGAATCTCGAATCTCACCGGCGTCCA
GGGCGCCGTCAACGTCCAGGGCGAGGATCAAAAGAAGCTCGATGTGGTCTCCAACGAGGTCTTCTCGAATTGCCTTCGA
TCCAGTGGCCGGACGGGGATCATCGCGTCCGAGGAGGAGGACACGCCGGTGGCGGTGGAGGAGAGCTACTCGGGCAACT
ACATCGTGGTG

> SEQ ID NO: 6029 167874 226428_301034_1b
CCCCTCTCTCAACAAGTCCATCACATTTCACAATGGAAGCCAACCCCGAAGTCCAGACCGATATCATCACGCTGACCCG
GTTCATTCTGCAGGAACAGAACAAGGTGGGCGCGTCGTCCGCAATCCCCACCGGAGACTTCACTCTGCTGCTCAACTCG
CTGCAGTTTGCCTTCAAGTTCATTGCCCACAACATCCGACGATCGACCCTGGTCAACCTGATTGGCCTGTCGGGAACCG
CAAACTCCACCGGCGACGACCAGAAGAAGCTGGACGTGATCGGAGACGAGATCTTCATCAACGCCATGAAGGCCTCCGG

FIG. 2 continued

```
TAAGGTCAAGCTGGTGGTGTCCGAGGAGCAGGAGGACCTCATTGTGTTTGAGGGCGACGGCCGATACGCCGTGGTCTGC
GACCCCATCGACGGATCCTCCAACCTCGACGCCGGCGTCTCCGTCGGCACCATTTTCGGCGTCTACAAGCTCCCCGAGG
GCTCCTCCGGATCCATCAAGGACGTGCTCCGACCCGGAAAGGAGATGGTTGCCGCCGGCTACACCATGTACGGTGCCTC
CGCCAACCTGGTGC

> SEQ ID NO: 6030  167874 184580_300670_1b
GAATTCAGTATCAATCAGTTGATTCAGAGGTAATTGTCTAGCTATGGTCGGATCAATTGCAGCAACGGCTTCTCATCAG
CTTCTATTCTCTAGCACTACTACCTCTGCTCACCGCTCCTCATCATCATATGCATCATCCTCTGCTCGAGTACTCTTTG
ATGTCTCTAAGCAGTTGACGTCCCCAATCAGCAGCACCAGAAAATTATCACTGAGTAATGAAGTCAGGTGTGGCGCAGT
TGGGACAACAACACCTGAGACTGCAACGGTAACCCCAACAAGGAGCAAGTATGACATAGTGACTTTAACAAGTTGGTTA
TT

> SEQ ID NO: 6031  167874 114909_300010_1b
TTTAAGTGAAAAATTTAGCAATCACAAGTAAAAGCAATTCCATGAAAATCACAATGGCAGCATCATCAGCAACAGCAAC
AACTTCATTTCTATGTGCTTTAGATAAAAAGACTCCATTTTTATGTACTCTAGACAAAAAGGGAACTCAATTTCTATGC
CCAAAAGGCAACAGCACAAAGAGAAGGTCATTTAATGGAGGAGTGAAGTGCATGGCAATAGAAACAGCAGCAGGGGCTA
CAGAGACAAGGAAAAGAAGTGGCTATGAGTTGCAAACTTTAACAAGCTGGCTATTACGGCAAGAACAAGCTGGGACTAT
TGATGCTGAACTTACCATTGTGCTTTCAAGCATTTCTATGGCTTGTAAGCAGATTGCTTCTTTGGTCCAAAGAGCTGGA
ATTTCTAACCTTACTGGAGTTCAAGGTGCTGTCAATGTTCAAGGAGAAGACCAAAAGAAACTTGATGTTGTCTCTAATG
AGGTATTCTCGAATTGTCTAAGGTCAAGTGGAAGGACAGGGATTATAGCATCAGAGGAAGAGGATGTACCAGTGGCAGT
GGAAGAGAGTTACTCAGGCAACTACATTGTGGTGTTTGACCCTCTTGATGGATCATCAAACATTGATGCTGCTGTTTCT
ACTGGTTCTATTTTTGGAATATACAGCCCAAACGATGAGTGCCTCGCAGATCTTGGAGATGATTCCACGCTTGACAATG
TTGAACAGAGGTGTATTGTGAATGTATGCCAACC

> SEQ ID NO: 6032  167874 158952_200021_1b
AAAGAAATGACTGAAGCTATTCCAAGATTTACTTGGAACACCATATTCTCAAGCTCTTCTTCCATTTCTCGTCTCTCTC
CTAATTTCCATCTCCTTCCCACCAATACCAAGAGATCACAACAGCTGAGTAATGGCAATTTCAGTTCTAGTTCCAATTC
AAGAATTTGCTGCGAAGCAGCAAGCTTGGATGGAGCAAAAACAGCCCCAACACAGATCAAGAAACCGATAAACCGATAT
GAAATGGTTAACTTGACAACATGGCTGTTGCGGCAAGAACAAGCAGGCAACATTGATGCAGAATTAGCCATAGTTCTTT
CGAGCATATCGTTAGCCTGCAAGCAAATTGCTTCACTTTTACAAAGGTCAAGTATTGTTAACCTTACTGGAGCTCAAGG
CACTGTTAATATCCAAGGTGAAGATCAGAAAAAACTTGATGTAGTATCCAATGAGTTATTCTGCAATTGTCTAAGATCA
AGTGGAAGGACAGGAATTATAGCATCAGAGGAAGAAGATGTACCAGTTGCAGTTGAAGAAACTTATTCTGGAAATTATA
TTGTA

> SEQ ID NO: 6033  167874 115385_300013_1b
TCCGCAATATTTAATATCTGGTTGCCGGAGAGTTTGCCGGAAAATCAAGAAAAGGGTAGCGATGGATCACTCGGCGGATG
CACATAGGACTGATTTGATGACCATAACAAGGTTTGTGTTGAATGAACAGAGTAAGCATCCTGAATCCCGTGGTGACTT
CTCTATCTTGCTCAGTCACATTGTTCTTGGCTGCAAGTTCGTCTGCACTGCTGTTAACAAGGCAGGTCTGGCAAAACTC
CTAGGGCTTGCTGGTGAAACTAATGTGCAGGGAGAAGATCAAAAGAAACTGGATGTACTCTCAAATGAAGTATTTATCA
AGGCTCTGGTTAGCAGTGGCCGAACATGCGTTCTTGTATCTGAAGAAGACGAAGAGGCTACATTTGTGGAGCCAGCTAA
GCGTGGAAAATACTGTGTAGTCTTTGATCCTCTTGATGGATCCTCGAACATTGATTGTGGTGTTTCTATTGGAACGATC
TTCGGGATTTACATGATCAAAGACGGTCATCAACCAACACTAGATGATGTCTTACAACCTGGAAAGAACATGTTAGCTG
CTGGATACTGCATGTATGGAAGTTCTTGTACGCTAGTTTTGAGCACTGGATCTGGAGTTAATGGTTTTACCCTTGATCC
CTCTCTTGGCGAGTTCATTCTAACTCATCCTGACATCAAGATTCCTAAGAAAGGGAAGATCTATTCAGTAAACGAAGGG
AA

> SEQ ID NO: 6034  168151 284537_200099_1b
GAATCTCAATAAGTGAAGGGATTTTGGTGGTTAATTGTAACATGGAAGCTTGTTGCGGAGCTGCAATCATGGGTTCAGT
TCAGCAGCCTGTTTGGGTTAAAAGTTCAGCTTTTCCTTCAAAAGGGCTGCTGGTATTCCGGCTCGGGTTAAATTATGC
TCTGTAAAACCCTGCAGAGCATCTCCAATTGAAGGGAGCTTGTTAACAGGAAGCCCTACTTCTTCTGTAGGTGCTAGGA
GCAGTTTTGAAGACTATGGATTGAGTGAAGCTGATCCTGATGTCCGTGCTATAATTGACAAAGAGAAGAAAACGTCAATT
TAGGAGCTTAGAACTTATTGCATCTGAGAATTTCACATCTCGAGCAGTCATTGGAAGCAGTTGGTTCTTGCCTTACAAAC
AAATACTCCGAAGGGCTTCCAGGAAAAAGATACTATGGTGGTAATGAATACATTGATGAGTTGGAAACTCTCTGTCAAG
AAAGAGCATTGGCTGCCTTTAGTTTAGATGGAAAGCAATGGGGTGTGAACGTCCAACCATTATCTGGTTCGCCAGCAAA
TTTTGCAGTCTACACAGCTGTTCTTAATCCACATGACCGGATTATGGGATTGGACTTACCTCATGGTGGCCACTTGTCC
CATGGATTTATGACTCCTAAACGACGAGTTTCTGCCACCTCTGTTTACTTTGAGTCCATGCCTTATCGACTTGATGAAT
CTACAGGCATCCTCGATTATAAAATGCATGAGAAAA
```

FIG. 2 continued

> SEQ ID NO: 6035 168151 8240_300304_1b
CGAAAAATGGCGATGGCCATGGCTCTTCGAGAGGCTTTCTTCTTCAATTGACAAACCCATTCGTCCTCTTATTCGATCC
ACTTCATGTTACATGTCTTCTTTGCCCAGTGAAGCTGTTGATGAGAAGGAAAGATCTCGTGTCACTTGGCCAAAACAGC
TTAACGCACCTTTAGAGGAGGTTGATCCTGAGATTGCTGACATTATTGAGCATGAGAAAGCTAAACAATGGAAGGGACT
TGAACTTATTCCATCTGAAAACTTCACA

> SEQ ID NO: 6036 168151 254052_301631_1b
GCTCCATCCTCATCCAAACCTCACTTCTCACTTCTTCTTCTTCTTGTGTTCGACTACCTCTGCATTCTTGTGGGGT
TAGGGGTTCGAGAGATTGTAGAGGATGGCAATGCTTTCCATCGCAGCTCTTCGACGGATCCAGTCCGTTGCTCGAGCAG
GAGGAATCCGTTTGTCTTCGTCTGCTGCAGCAGTTGCCAATGAAGAGTCATACCTCCGCCTCAAAGACAAATCACATGT
CACGTGGCCAAAAGTACTAAATACATCTTTGGAAGAGATAGACCCAGAAGTCACAAATATAATTGAACTGGAGAAGAAT
CGCCAATGGAAGGGTCTGGAGCTCATTCCTTCAGAGAACTTTACATCACTCTCAGTGATGCAGGCTGTTGGTTCTGTCA
TGACAAATAAATACAGTGAAGGCTATCCGGGAGCCAGATATTATGGAGGAAATGAGTTTATCGATATGGCAGAGTCACT
ATGTCAAAAACGGGCACTTGAGGCTTTTCGCTTGGACCCGGCAAAGTGGGGAGTGAATGTGCAGCCATTGTCGGGTTCA
CCAGCGAACTTCCATGTTTACACTGCTCTCTTGAAACCACATGACAGAATTATGGCTCTTGATCTTCCTCATGGTGGCC
ACCTTTCCCATGGATACCAGACTGATACTAAGAAGATATCGGCTGTTTCAATATACTTTGAGACGATGCCATACCGACT
GAACGAAACCACAGGCTTCATCGACTATGAT

> SEQ ID NO: 6037 168151 128325_300475_1b
CAGGGGAGAAGCTGACAATAATTATGGCCATGGCAACGGCTCTTCGAAGACTCTCCTCTTCTGTTGACAAACCAATTAA
GCGTCTCTATAATGGCGGCTCTCTCTATTACATGTCATCGTTGCCTAATGAAGCTGTTTACGAGAAGGAAAAAAATGGT
GTCACGTGGCCAAAGCAACTGAATGCTCCTCTAGAGGAGGTTGATCCTGAAATTGCTGACATTATTGAGCTTGAGAAAG
CACGCCAGTGGAAGGGACTTGAACTCATTCCTTCAGAAAATTTCACTTCTGTGTCTGTAATGCAAGCTGTTGGATCCAT
TATGACAAACAAGTACAGTGAAGGATATCCTGGGGCTAGATACTATGGAGGAAATGAGTATATTGACATGGCGGAAACA
TTATGCCAGAAACGTGCTTTAGAAGCATTCCGGTTGGATCCTGCAAAATGGGGAGTGAATGTGCAGCCTCTATCAGGAT
CACCTGCTAATTTTCATGTTTACACTGCACTTTTAAAACCTCATGAAAGAATCATGGCCCTTGATCTTCCCCACGGTGG
ACATCTTTCTCATGGATATCAGACTGATACAAAGAAGATATCTGCCGTCTCTATATTTTTGAGACCATGCCATACAGA
CTGAATGAGAGCACTGGCTACATCGACTATGACCAGCTTGAGAAAAGTGCCACACTCTTTAGGCCAAAGTTAATTGTCG
CTGGTGCTAGTGCTTATGCACGTCTTTATGACTATGCACGTATCCGAAAGGTTTGTGACAAACAGAAGGCTGTCATGTT
GGCAGATATGGCTCATATTAGTGGGTTAGTTGCAGCTGGAGTCATCCCATCACCATTTGATTATGCAGATGTTGTGACT
ACCACAACCCACAAATCCCTTCGCGGGCCTCGTGGTGCCATGATTTTCTTCCGGAAGGGTGTGAAGGAGGTTAACAAGC
AAGGAAAGGAGGTGATGTACGACTATGAAGATAAAATTAACCAGGCAGTCTTTCCTGGACTTCAAGGTGGTCCTCACAA
TCATACAATTACTGGCTTGGCAGTTGCTTTGAAACAGGCAATGACTCCAGAATACAAAGCTTACCAAGAGCAGTGCCTT
AGCAACTGCTCAAAATTTGCCCAGACTTTAGCGGGAATGGGTTATGAACTTG

> SEQ ID NO: 6038 168151 130212_300486_1b
GAATTCGAGAGAAATCTTTTTTTGGGGTTGAGAGGAGAGAGAGAGAGACACACAGAGAGAAAAAATGGCGATGGCAATGGC
ACTTCGTAGGCTCTCATCTTCTTCAATCAACAAACCTATCCGTCCTCTCTTCAATGCCGATTCCTACTATTGCATGTCA
TCTCTTCCAAGTGAAGCTGTTGATGATTCTAAGGATAAATCTCGTGTTCAATGGCCAAAGCAATTGAATGCACCATTAG
CAGAAGTGGATCCAGAGATTGCTGACATTATTGAGCTTGAGAAAGCTAGGCAATGGAAGGGTCTGGAATTGATTCCTTC
AGAGAATTTCACATCTGTGTCGGTCATGGAAGCTGTTGGTTCTATCATGACTAACAAATACAGTGAAGGTTATCCTGGT
GCTAGATACTATGGAGGAAATGAGTACATTGATATGGCAGAAACTTTGTGCCAGAAACGTGCCTTGGAGGCTTTCCGTT
TGGATCCTGCTAAATGGGGAGTTAACGTGCAATCTTTGTCTGGGTCCCCTGCCAATTTCCAAGTCTACACTGCACTATT
GAAGCCCCACGAGAGAATTATGGCACTTGACCTTCCACATGGTGGGCATCTTTCTCATGGGTATCAGACTGACACCAAA
AAAATATCTGCTGTATCTATATTTTTGAGACAATGCCATACCGATTGGATGAGAGCACTGGTTACATTGATTACGATC
AGTTGGAGAAGAGCGCTACACTCTTCAGGCCGAAACTGATTGTTGCTGGTGCAAGTGCTTATTCACGCTTCTACGATTA
TGCACGCATTCGCCAGGTGTGCGACAAGCAAAAAGCTATATTGTTGGCAGATATGGCTCACATCAGTGGGCTTGTTGCT
GCTGGTGTCATCCCATCTCCATTTGAGTATGCCGATGTGGTGACCACTACAACACATAAATCCCTTCGTGGACCACGTG
GGGCGATGATATTTTACAGAAAGGGATTGAAGGAAGTCAACAAACAAGGCAAAGAGATCATGTACGACTATGAGGACAA
AATTAATCAAGCTGTCTTTCCTGGGCTTCAAGGAGGTCCACATAATCATACAATTACTGGATTAGCAGTTGCACTGAAA
CAGGCAACTACCCCAGAATACAAGGCTTATCAAGAACAAGTTCTCAAAAATTGCTCACAGTTTGCCAAAACCTTGAACG
CATTGGGATATGACCTTGT

> SEQ ID NO: 6039 168217 245993_301573_1b
GAGTGGCTACTTACAAACTTCGATGCTCTGCCCTGTGGGTGAAGGATTCTAGCCATCTTGTGTCAGCCCTTTCTACTAT
TCCCGAGTACCTGCGTAACAAGGCATCAGACTTGAATCAAGTGGTCGACTACAAAGACTGGCAAATACCTCTCGGCAGA
CGATTCAGGTCTTTGAAGCTGTGGTTTGTCATGCGCTTGTATGGTGCTTCTGGACTACGGAGCTACATAAGGAACCACG
TCCGGCTTGCAATGCAGTTCCAAGGCTTTGTGCGTGAAGATTCTCGGTTCCAGATCGTAGCTCCTTGCTCATTCGGGTT

FIG. 2 continued

GATCTGGTTCCGGCTGAAGCCGCCAGACAGAGATCCGGACGATGGAAGGACACTCAAAGCGACGCTGCTGGAGGCTGTC
AATTCCACTGGAAGAATGTTCATCACTCACACAGTGCTCTCTGGTATCTACACTCTGAGGATGGCTATCGGTGCTCCCA
CTCACTCAAGAAAGACATGTAGAGGCGGCGTGGAGGCTGATTCAAGAACAGGCAACCAGGATCTTATAAATTTGGTATT
CATATTCATCAACATTTTGCGAACCATACGGAACTGAGACAAAATATGACTGAAATGAGGAACATACGGGCAGCAAAAG
AATTACTATGACAAAGACGAAGAATAGATGTCCAATGCCAA

> SEQ ID NO: 6040 168217 158580_200019_1b
GTCCGCGGAAAGGATGCAATTGGAAAACTGGTGGTCTATTGTTCTGATCAAACTCATTCTGCTTTACAGAAAGCTTGCC
AGATAGGAGGAATTCATCCTGAGAATTTTCGGATGCTGAAAGCAGTCTCATGCAGGGATTATGCTCTTTCTCCTGACGC
ACTTTCAGAAGCTGTATCACATGACCTGGCCACTGGTTTAATACCCTTCTTTTTGTGCTACTATTGGTACAACATCT
TCCACTGCTGTGGATCCTTTGCTTGCCCTGGGAAAGATTACCAAGAGTAATAGCATGTGGTTTCATGTGGATGCTGCCT
ACGCTGGAAGTGCATGTATCTGTCCTGAATTCCGGCACTATATTGATGGTGTAGAAGAAGCTGATTCTTTCAACATGAA
TGCACATAAGTGGTTCCTGACAAACTTTGACTGTTCAGCTCTCTGGGTCAAGGACCGGAGTGCACTTATCCAGTCACTG
TCAACAAATCCTGAATTTCTCAAAAACAAAGCTTCTCAAGGAAACTTGGTTGTGGATTACAAAGACTGGCAAATTCCTC
TCGGGCGCAGGTTCAGATCATTGAAGCTGTGGATGGTATTGAGACTCTATGGGCTGGAAAAGCTTCAAGCTTACATAAG
AAATCATATAGAACTAGCAAGGCGTTTTGAGGAATTCGTTGCTCAAGACCAGAGGTTTGAGATTGTCACCCCTCGGAAG
TTCTCTTTGGTTTGCTTTCGCTTACG

> SEQ ID NO: 6041 168244 1007870_301404_1b
GAAAGAAGAGAGAGAGAGAGAGAGAGAGATCAATGGCAAGCATAGCCTTCGCAGCCTCCTCAGCCTCGGCCTCCCCC
TCCCTCGACCACGCTAGATCTCCCCTCATCCTCCCCCCTAAGGTCTCTTTCTTCTCATATGGGATCAAAAGCCAAGCCT
GCGATGCTAGCACTGGGTGGTCCTATACTCAAAAGGGCCGACTTTCAGGCATCCGGGCTTCTGTTTCCACAGAGGCTCC
TGCAAAGGTAGAGAAGGTATCTCGCAAGAATGATGAGGGCGTAATTGTCAACACTTTCAAGCCCAAGAATCCCTACACT
GGCCTTTGCCTTCTCAACACTAAAATTGTTGGGGATGATGCGCCTGGGGAGACGTGGCACATGGTCTTCAGCACGGAAG
GGATGGTAGAGTACAGAGAAGGGCAATCCATTGGGATCATCCCACCTGGTGTTGATGCTAATGGCAAACCTCACAAACT
GAGGCTCTACTCCATTGCTAGCAGTGCCTTGGGTGATTTTGGAGACAAGAAGACTGTCTCTCTTTGTGTAAAGAGGTTG
GTATATACCAATGACAAGGGCGAGGAGGTCAAGGGTGTATGCTCCAACTACCTTTGTGATCTGAAGTCCGGTGAGCCTG
TTTTGATAACTGGTCCTATTGGTAAAGAGATGCTTATGCCTCTAAGGATCCAAATGCCAACATCATCATGCTTGGAACAGG
AACAGGAATAGCCCCTTTCAGAGGCTTCCTGTGGAAGATGTTTTTCGAGGAACACGAGGATTACAAATTTAATGGGCTT
GCATGGCTTTTCTTAGGAGTTCCCACTAGCAGCAGTTTGCTTTACAAAGAGGAATTTGAGCTGATGAAATCAAAAAATC
CTGACAACTTTAGGCTACATTTTGCTGTAAGCCGTGAACAGAAGAACGATAAGGGGGAGAGGATGTATATACAGACGAG
AATGGGGGAATACTCGGAGGAGTTGTGGGAGCTGTTGAACAAGGACAACACCCTATGTGTACATGTG

> SEQ ID NO: 6042 168244 141974_300430_1b
CCGGCCAAACATATCCGTCCCTTTCCCTCTCCTCAGCTTCGCGTCAATTCCAGAGATCGAAACCCTAGCCAACCCCTCC
TCCTCCTCCTCTTCCTCGCGATCCACCGGCGATGGCCTCCGCCCTCGGGGCTCAGGCGTCTGTCGCGGCGCCCATCGGT
GCGGGCGCTACGGCGGAGGAGTTCCTCGAGCAAGGGTAGCAATACTGTTAACTTCTGCAACAAATCATGGATTGGAACCA
CATTAGCATGGGAAAGCAAGGCCCTAAAATCAAGCATATGAACAAGATCTTTTCCATGTCCGTTCAACAAGCAAGCAA
AAGCAAAGTTGCTGTAAAACCTCTGGAATTGGATAATGCGAAGCAGCCACCCCCTTAACTTATACAAACCAAAGGAGCCT
TACACAGCCACAATTGTCTCAGTCGAAAGGCTTGTAGGCCCTAAAGCTCCTGGTGAAACATGCCATATTGTTATTGATC
ATGGTGGCAATGTTCCATACTGGGAAGGACAAAGTTATGGTGTCATTCCTCCAGGAGAGAACCCGAAGAAACCTGGTTC
CCCAAATACTGTCCGGCTCTATTCTATTGCATCTACTAGGTACGGTGATTCTTTTGATGGAAAGACTGCCAGTTTGTGT
GTTCGTCGTGCTGTTTATTATGATCCTGAAACTGGAAAAGAAGACCCCACAAAGAAAGGTATCTGCAGTAATTTCCTAT
GCGACTCTAAACCAGGCGAC

> SEQ ID NO: 6043 168244 1008557_301416_1b
AATAAGATTGTTGCTGATGATGCTCCTGGAGAGACCTGGCATATGGTCTTCACTACTGAAGGGGAAATCAAGTACCGTG
AAGGTCAATCGATAGGTGTTATACCCCCTGGTGTTGATGCAAAAGGAAAGCCAAACAAACTTCGATTATACTCGATTGC
CAGCAGTGCACCTGGAGACTTTGGAGACTACAAGAC

> SEQ ID NO: 6044 168244 3146_300332_1b
CCCACGCGTCCGGGTTACTGTCTCTCCTATAGAGTTGGAAGACCCTAAGGATCCTCCTTTGAACTTGTACAAACCCAAG
GAGTCTTACACCGCTAAGATTGTCTCTGTGGAGCGAGTAGTTGGCCCGAAAGCCCCTGGAGAAACTTGTCATATCGTCA
TCGATCATGATGGTAACCTTCCTTACTGGGAAGGACAGAGTTACGGTGTGATTCCTCCAGGTGAGAACCCGAAGAAACC
GGGAGCGCCACACAATGTGCGCCTTTACTCAATTGCATCAACAAGGTACGGAGATTTCTTTGACGGTAAAACAGCGAGT
TTGTGTGTACGT

FIG. 2 continued

> SEQ ID NO: 6045 168244 181193_300654_1b
GAATTCAAAGATCTTCTATCTTTTCTGATACAATCATCTTCCCCAAGAACTCTGCTTACACCGGTGGTATCTCTATGGC
AAACAATGCTGTAACCATATAATCTCAAGTGACTACTAATGAATCTGCTGCACCTGTAAAGAACGTATAAAAGATCTCC
AA

> SEQ ID NO: 6046 168244 233112_301087_1b
TGGCTATAGGCAAGCGCAGCTTGTCCCTCAACCGGCAGATATGGCGGCGGTGGCGGCGATTCATTCATCGCATTCGCTG
GGGCAATTGCCGCTGGCAGAGCGAAGCGATCGACTTCCTGCCGCCATTGCAACCAAGTCATCCTTTCATGGAGGCAAGA
TCGCATTATCAGATCTAACGTACAGCTACAGGCCACTGAATGGCAAGGTCTCCGTGAGAGCATCGGCAGTGTCCACCGA
GACTGTGGAGAAGGTGAAGAAGAAAGCCGAAGAAGGTGTCGTCACAAACTTGTTTAGGCCAAAAGAACCTTACATCGGT
CGTTGCCTCCTCAATACCAAAATCGTCGGAGATGATGCACCAGGAGAGACTTGGCATATGGTTTTCAGCACTGAAGGGA
AAATTCCATACAAAGAAGGCCAATCCATCGGAATTATCCCACCAGGAGTGGATGCAAAAGGAAAGCCTCAGAAGCTCCG
GCTTTATTCCATTGCGAGCAGTGCCCCCGGGGACTTTGGTGATTATAAAACTGTCTCTCTGTGTGTGAAGCGGCTCGTC
TACTTGAATGATAAAGGAGAGGAAGTCAAGGGCGTCTGCTCGAACTTTCTCTGTGATCTAAAGCCAGGAGAGGAAGTGA
GCATAACTGGACCTGTTGGAAAGGAAATGCTCATGCCAGTTGATCCAAACGCAACCATTATCATGCTCGGTACTGGTAC
TGGTATCGCACCTTTCAGAGGCTTCTTGTGGCGGATGTTCTTCGAGAAGCATGACGATTACAAGTTTAACGGGCTTGCT
TGGTTGTTCCTGGGAGTTCCAACGAGCAGCTCACTGCTGTACAAAGAGGAGTTCGAGAAGATGAAAGAAAGTTCCCAG
ACAACTTCAAGCTCGACTTCGCAGTGAGCCGCGAGCAAACCAACGCCAAAGGCGAGAAGATGTACATCCAGACGAGAAT
GGCCGAGTATGCCGACCAGCTCTGGGAGCTGCTCAAGAAGGACAACACCTTCGTTTATATGTGCGGATTGAAAGGAATG
GAGAAAGGAATCGACGACATCATGACCGGCCTCGCAGCCAAAGACGGGATTGACTGGATGGAGTACAAGAGACAGCTAA
AGAAGGCGGAGCAGTGGAATGTTGAAGTCTACTAAAAACAGTGCTCGCATTTGTCGAAAGCTCGCAATGTAAACTACAC
CGTACAACGTAATTAATTTTGC

> SEQ ID NO: 6047 168244 230126_301054_1b
GAGTTCGATCGATCCCATGGCGCTGCATGCTGTGTTCCAGCCGGGTACAGCGTATGGTCCTTCCAGTGGTGTGAATTCC
CCGCGGTGTTCTTCGTCATGCATCACTGTCAAGATGCCCTTGGCGGCGCAGAGATTGACTCTGGACCTTGCAAGCTTTG
GCGAGGTGAAGAGAGCAGTGGCAAGGAGAGAATTTGTCTTCCGAGTCAACGCGAAGGTTGCGACGGCTGCTGCTCCAGA
TCTCGAGACCGCGAGTGACCCGCCGCTGAATCTGTTCAAGCCCAAGACCCCCTACACTGCTACCATCAAATCGGTCGAG
AGAATTGTGGGTGACAAAGCTCCTGGTGAAACTTGCCACATTGTGATCGATCATGGTGGGAACGTTCCTTACTGGGAAG
GTCAGAGCTATGGAGTCATTCCTCCCGGTGAGAATCCAAAGAAGCCTGGAACTCCCAATGCAGTTCGCTTGTACTCTAT
CGCCTCGACGAGATACGGTGACGAATTCGACGGCAAAACCGCGAGCCTTTGCGTCAGGAGAGCAGTCTACTGGGATCCA
GAAACCGGGAAGGAAGATCCAGAAAAGAAGGGCGTCTGCAGCAACTTCCTCTGCGACAGCAAACCGGGTGA

> SEQ ID NO: 6048 168244 182760_300663_1b
TAGTCATGGCAGGTGCACTCACTGCTGCTGTATCTATTCCAGCATCCAATTCATCGTCTCTCCAAACCAGAACTTCTAT
GTCTTCCTCGGAACGAGTCAGCTTCAACAAGAGCTGTTTGTATTCTAGGAATGGCTGTGCCAGCAGAAGGGTGTTTTCT
GTCAAAGCCGAGGTTACTACAGACACTACTCCACCTCCTAAAGTAGAGAAGATTTCAAAGAAGTATGAAGAAGGTGTTG
TTGTCAACAAGTTCAAACCCAAGAACCCTTACACTGGCAAGTTCTTCTCAACACCAAGATCACAGCTGATGACGCTCC
TGGAGAAACCTGGCACATGGTCTTCCACACAGACGGTGAGGTTCCATACAGAGAAGGACAATCGATTGGTATTATTCCA
GAGGGCATTGACAAAAACGGAAAGCCACACAAGCTGAGATTATACTCAATTGCCAGTAGTGCTCTTGGGGATCTGGGAG
ACTCCAAAACTGTTTCTCTTTGTGTCAAAAGGCTGGTGTACACCAACGACCAAGGCGAAGAAGTCAAGGGAGTCTGCTC
TAATTTCCTATGTGATTTGCAACCAGGGAGTGAGGTGACGATTACTGGACCTGTTGGAAAAGAAATGCTTATGCCCAAA
GACCCCAATGCCACCATTATCATGCTTGCAACAGGTACAGGTATTGCTCCTTTCCGTTCATTCTTGTGGAAAATGTTCT
TCGAGAAAGATCTCTCGCTTATCTTCGATACCGGTAGTGATTTCACTTGGATTCAGTGTAAGCCGTGCGTGGTTGAATG
TCACGAGCAAGAACAACCAGTATTTGATCCTTCACAATCAAAAACTTATTCAAATATTACTTGCAACTCAACTGAATGT
GCCCAACTTCGGTCAGCCACTTCAATTACACCTAAATGTAGTTCTCCTTCTACTTGCGTCTATGGAATTCAATATGGTG
ATCAGTCTTACTCAGTTGGATACTTTGGTTCTGAAACAATAACATT

> SEQ ID NO: 6049 168264 237641_301289_1b
CTTGGCGCCCGGCAAGAACCATGGCTGGCATGGATTCCAGAGCTCGAGGTCAGGCATCGCGAGGTTCCGGCGGAGAGAA
TGCGCGATCCATGGCGGCGGCGGCGGCGGCGTCTCAATATCGCCGCCATCGCCGGCTCTTTCCCATCCGTTCGTGA
TGCCTAGAATGCGAGGGTTTGATCTTCCATTCGTCGAGTGGTGAGGGGAGGCAGGGCAGTGAGGAGAATACGATCAGGG
CGGCGAAGAAGGGGTCGCCGCCGCTGGCCCCGGTGGTGATCACGCCGGCTGGGGTGTCGGACCTTACCAGCCTCATGTT
TCGCAATAGGATCATCTTCATTGGCCAGCCTATCAATTCGCAAGTGGCACAGCGAGTTATCTCCCAGCTCGTAAGCCTT
GCTGCCGTCGACGAGAACAAAGATATACAAATTTATATCAATTGTCCTGGAGGAAGCACGTACTCAGTGTTTGCCATTT
ACGATTGCATGTCATGGATTAAGCCAAGAATCAGCACTGTATGCTTTGGCATGGCGGCGAGCCAAGGAGCTTTGATTCT
AGCCGGTGGAACGAAAGGTCTTCGTTTCGCGATGCCGAACTCTAGAGTGATGATCCATCAACCTCAAGGAGGCTGTGGT
GGGACCATGGAGGACGTGAGGAGACAAGTGAACGAAGTCGTACAATCAAGAAACAAAATCGAT

FIG. 2 continued

> SEQ ID NO: 6050 168264 127672_300471_1b
CCCCGAGTTTCTTATCCCGTTTTTTTACCAGGGTGCTCGTGGGATAACTCTTAAATCCGCCGGCGAACACTCTCCCTCT
AGTATTCCGTCACTGAATCTCGCCGGAGCAATAAAATGGTAGCGTCTTCCATCACCGGAACGTCAATTATTCCTGCCTC
TTTCCGGAAGCAAACGTCTTCTTCGTCTTTGTTTTCTTCTAGAACAAATCAATACCAGTTACTTTTCTGCAGAAGCTTA
ACGAAGCGGGTAGTTTCTGTTCTCCGAAGTCCGTATTCTGATTCATCAGCTATTGGATTGTCTAACAAGACTCTGAAAA
CCCCGTTAAATCTCAATGAGCACGAATCCAGCGGTCTTACCAATTCAAGCTTTGGTGTTACCGAAGCAAAAAAGGGGAA
TCCACCCGTCATGCCTGCTGTGATGACACCAGGGGGGCCTTTGGATCTCTCTACTGTGTTATTCAGGAATCGAATTATC
TTCATTGGACAACCAATCAACTCCGCAGTTGCTCAGAGAGTTATATCACAACTTGTGACCCTCGCAACTATCGATGAAA
ATGCAGATATTTTGATCTATCTTAATTGTCCTGGTGGAAGTACCTATTCTGTCTTGGCAATATATGACTGCATGTCATG
GATAAAGCCT

> SEQ ID NO: 6051 168353 248951_301588_1b
GAGAGGAAGAGATTTGCAGCGTTAGGGTAGCGGCAGCTCCAAATCTCTCTCTCGCGAAGACAAGGGCCACCGCATCTCC
GGTCGCGAATCTGGAAATGGGAGAAGCCAAGGAGAACGACACCTATCAAGAGGAGCTTTTGGACTACGAGGAGGAAGAA
GAGGCGGCCCCCGACGCCGTTGCAGCTAAGGCTGCCACAGAGACTGTCAAAAAGGGATATGTTGGTATTCACAGCTCCG
GTTTTAGAGATTTCCTGCTCAAACCAGAACTTGTTCGGGCTATCGTTGATTGCGGGTTTGAGCATCCATCCGAAGTGCA
ATTTGAGTGCATCCCGCAAGCCATACTTGGAATGGACGTCATCTGCCAAGCGAAGTCCGGAATGGGAAAGACCGCCGTG
TTCGTGCTTTCGACACTGCAGCAGATAGAACCACTCAAGGGGCAAGTTGCTGCTCTGGTCCTGTGCCACACTCGAGAGC
TAGCATATCAGATTTGCCACGAGTTCGAAAGATTTAGTACATACCTTCCCGATATCAAGGTTGCGGTTTTCTACGGTGG
TGTCAACATCAAGACCCACAAGGACCTGCTGAAAAATGAATGCCCGCACATCGTGGT

> SEQ ID NO: 6052 168353 258459_301696_1b
ATTTGTGCAACAAGGTATATTTGATAAAAAACACCAATTGAAAACAAAATGGCCGACGGACTCACCGACATCGATTCTT
CCCAGATCACCACCAACTACGACGAGGTTGTTACCTCTTTCGACGACCTTGGACTCAAGGACGAGCTGCTCCGAGGTAT
CTACGGTTACGGTTTTGAGAACCCTTCCTCCATTCAGCAGCGAGCCATCCTGCCCGTCATCAAGGGTAACGATGTCCTT
GCCCAGGCCCAGTCTGGTACTGGTAAGACTGCCACCTTCTCTATCTCTGCTCTGCAGAACATTGACGAGAAGATTAAGA
AGCCCCAGGCTCTGATCATTGCCCCCACTCGAGAGCTGGCCCACCAGATCCAGAAGGTTGTCCTTGCCTTTGGCGAGTA
CATGAAGATTGAGTGCCACGCCTGCATTGGTGGTACCTCCGTCGCCGAGGACATCCGAGTCATCCAGGAGGGTGTCCAC
GTCATTGTCGGAACCCCGGTCGAATCCACGATATGATTGAGCGACGAATCCTCAAGACCGACCTCATCAAGATGTTCA
TCCTTGATGAGGCCGATGAGATGCTTTCTCGAGAGTTCAAGGACCCCATCTACGATATCTTCACCACCCTCCCCG

> SEQ ID NO: 6053 168353 215364_300880_1b
TGGACAGCCTCAGCTTCCCTCGTTCACATGCGAGCAACATCGGAACATCGTCTTCGATACGTGGCATTGCAACCCAATT
TCCATCGTCTCTATCTGTTCTCTGTCCCGGCATCTCATTCGCCCGGTCGTTTGGGATTTTTCTTCATCCCACTCATCTT
TGTCTCTTCTTTCTTCTCCCTTCAGACGCGCCCAACTCGTTAGCGCTTCTCGCAACTCAGCAAGGCTTTGTCCGAATTT
TCAAACAAACGCTCTCCACCAACCAATTCCAAAATGTCCCACGAGGAAGATCTCATTGACTACTCCGATGAGGAGATTG
GCGCCAACGAGACCGCCGCCGCCTCCAACGGAAAGAAGGGAGAAGCCGCCTCCGGTAACAATGTCGACAAGAAGGGCAG
TTACGTTGGCATCCACTCCACTGGATTCCGTGACTTCTTGCTGAAGCCCGAGCTTCTGCGCGCTATCGGCGACTGCGGT
TTCGAGCATCCTTCGGAGGTCCAACAAACATGTATCCCTCAAGCTCTTCTCGGAGGAGATATCATCTGCCAGGCCAAGT
CTGGTCTAGGAAAGACTGCCGTCTTT

> SEQ ID NO: 6054 168479 190609_301609_1b
CCCCCCCCGTTTCACTCATCCGCCGCTGAGCTCTATCTATCTACTAGTTAGTTTAGTCGTCTCGAGGGTAAATTGAGC
TTTGTGTGCGGTTTTGAGGGGAGTACATCGGCATGAGGATCCAGTGCGACGCGTGCGAGGCCGGCGGCGGCCACGGTGGT
GTGCTGCGCGGACGAGGCGGCGCTGTGCGCGCGCTGCGACGTCGAGATCCACGCCGCCAACAAGCTCGCCAGCAAGCAC
CAGCGCCTCCCGCTCGACGCCGCGCTCCCCGCCGCCCTCCCGCGCTGCGACGTCTGCCAGGAGAAGGCGGCGTTCATCT
TCTGCGTGGAGGACAGGGCGCTCTTCTGCCGGGACTGCGACGAGCCCATCCACGTCCCGGGGACGCTCTCCGGCAACCA
CCAGCGCTACCTCACCACCGGCATCCGCGTCGGGTTCAGCTCCGTCTGTAGCGCCAACGCCGACCACCTCCCGCCGCCA
GCGCCCAAGGGGAACTCCAAGCCGCCGGCAAGCGGCATCGCTGCTGCTGCTGCTCCCAAGCCGGCCGTGTCCGCGGCGG
CGCAGGAGGTGCCGTCGTCACCGTTCTTGCCGCCGTCGGGCTGGGCCGTCGAGGATCTCCTGCAGCTCTCCGACTACGA
GTCCAGCGACAAGAAGGGCTCTCCTATTGGGTTCAAGGATCTGGAGTGGCTCGATGACATCGACCTGTTCCATGTCCAG
TCGCCGGCCAAGGGAGGCAGCACGGCGGCGGAGGTGCCTGAGCTCTTCGCCTCGCCGCAGCCAGCGAGCAACATGGGGC
TCTACAAGGCGAGCGGTGCACGCCAAAGCAAGAAGCCACGGGTGGAGATACCCGATGACGACGAGGACTTCTTCATCGT
TCCTGATCTTGGATGAGATGTTGTTATGTAACAGTAATGCTATGCAAGTGATGTAATTTTGTATGTATGCAAAGAACAC
TGCCATC

> SEQ ID NO: 6055 168479 245603_301570_1b

FIG. 2 continued

AGAAAGAAAGCGTCTCGCGAAGAACAGAGCGTAGGGTTTGGAGATTCTCCGCCGCGAGGTACGATCGATCGATTGGTTC
TAGTCGCGGCATTCTGGAGTTTAGGTCTAGATCGCTACTCCGGAAGTGGAGAATGGGAGGGATTTGCTTGGCCTTCAGA
ATGTGGCCTGATTCCAGTGAGATCTAGAGTGGATTAGAGCTCGAGAGGCGCGATTAGATGCGGACTTTGTGCGATGTCT
GCGAATCAGCCCCGGCGAAGCTCTTTTGTGCGGCGGACGAGGCCGCCCTGTGCACGAAGTGTGATGAAAAGGTTCATGG
ATGTAACAAGCTAGCTAGCCGTCATGTCCGCCTCCAGCTTGCGGAAGCCCGAGCTGTGCCTCGATGTGATATCTGCGAG
AATGCTCCTGCATTTTTCTACTGCGGCATTGATGGAACCTCACTCTGCTTACAATGTGACATGGATGTACATACGGGTG
GAAAGAAAACTCACGAGAGATATCTCATGCTGGGACAAAGAGTAGAGCCAGAAGATACCGGTGTACAATCAAACGATCA
CCGCGGACGTAACCATTACCACCCGNCAAAACGGGTGGCCGTGACCAAATCCAACAACAGTGACGCCCCCGCTGTTGCC
ATCGCTGTAGGTGATGCCGAAGCGCAGCAGTCCAAGAGCGATCAAGCCGTCTCAAACATGATGGATCTTAACTCCAGAC
CTCTACGC

> SEQ ID NO: 6056 168479 246320_301612_1b
TTCGCGAGAGAGCTGGGCGATCAATCCAGATTTTGGAGGCGCTCCACGGCCGGCGCCAGCGAAATCCAGGTACTCTTGG
TGATTTCCGGGGAGAGATCTCGATCGATTCCGTGGCGTGATTTTGGGGCGGAGAGATGAGGGTCCAATGCGACGTGTGT
GAGAAGGCCGAGGCGGCGCTGGTTTGCTGCGCCGACGAAGCCGCGCTGTGTGCCGTGTGTGATGCCGAGGTCCATGCCG
CCAACAAGCTTGCCGGGAAGCACCAGCGATTGCCTTTGAGCGCCTCTGGAAATTCTCCTAGCTGCGACGTCTGCCAGGA
GAAAACTGGATGGTTTTTTTGTGTGGAGGACCGTGCTTTGCTCTGCCGGGCTTGCGATGTCTCCATACACTCGTCCAAC
GCACGGGCTTCCGGCCACAACAGGTTTCTGGTCACCGGTGTGAGAGTGGCGCTCAATGCGCTGTCTGCCCAAGACTTTC
TCGAAGCACCAATGACCCCACGATGTCGGCAACCCGGGAACGCGAACTCCTCGGCTTCTGGAGCCAGCTCGTCGGGAAA
TTCGCTTTCGGCCAATCGCACGCAGGAGGAGAGGTTTGACAGAGGAGAGCCCGAGACTGTCATGGAAAAGAG

> SEQ ID NO: 6057 168479 4415_300838_1b
AAAACACTCTCTCCCTCTTTGTTCTTTCATCTTCTCTAAGCTCTTTCTCTGAACCTACGCTTCTGCTAAGCTATTCTAA
GAGAAGCCAGACTAGCAATAAACTCTTCATTTTAAGCATTCTGTTTCCTTCTTGAGAAACCTAGATATTTTGGTTTCTT
GTATCCGGTGATGAAGATACAGTGTGATGTGTGTGAGAAAGCTCCGGCGACGGTGATTTGTTGCGCCGACGAAGCTGCT
CTCTGTCCTCAATGCGACATCGAGATTCACGCCGCTAACAAACTCGCTAGCAAGCACCAACGTCTTCATCTTAATTCCC
TCTCCACCAAATTCCCTCGTTGCGATATCTGCCAAGAGAAGGCAGCTTTCATTTTCTGTGTAGAGGATAGAGCTCTGCT
TTGCAGGGACTGCGATGAATCCATCCACGTGGCTAATTCTCGATCTGCTAATCACCAGAGGTTCTTAGCCACTGGGATC
AAAGTAGCTCTGACCTCAAC

> SEQ ID NO: 6058 168479 46851_300192_1b
AATACACTCTCTCCCTCTTTGTTCTTTCATCTTCTCTAAGCTCTTTCTCTGAACCTACGCTTCTGCTAAGCTATTCTAA
GAGAAGCCAGACTAGCAATAAACTCTTCATTTTAAGCATTCTGTTTCCTTCTTGAGAAACCTAGATATTTTGGTTTCTT
GTATCCGGTGATGAAGATACAGTGTGATGTGTGTGAGAAAGCTCCGGCGACGGTGATTTGTTGCGCCGACGAAGCTGCT
CTCTGTCCTCAATGCGACATCGAGATTCACGCCGCTAACAAACTCGCTAGCAAGCACCAACGTCTTCATCTTAATTCCC
TCTCCACCAAATTCCCTC

> SEQ ID NO: 6059 168479 11641_300291_1b
CAACACACAATTTTTCCTCTTTTTCTTGCGCTAAATTCGAAAGGGTATGTCCTGAAATTAGGTGTAAGAGCAAATAGTT
GAGATATATTAGTAATAAAGATGAAGATCCAGTGTGATGTATGTGAGAAAGCTCAAGCTACTGTAATTTGCTGTGCTGA
TGAAGCTGCTTTGTGTGCTAAATGTGATATTGAAGTTCATGCTGCAAATAAACTGGCAAGTAAGCATCAGAGGCTTCAT
CTTCACTGCCTCTCCAACAAGCTTCCTCCTTGTGATATTTGCCAAGATAAAGCAGCCTTCATCTTCTGTGTTGAGGATA
GAGCTCTCTTTTGCAAGGATT

> SEQ ID NO: 6060 168479 135306_300413_1b
CCCACGCGTCCGTATCTATCGACTAGTTAGTTTAGTCGTCTCGAGGGTAAATTGAGCTTTGTGTGCGGTTTTGAGGGGA
GTACATCGGCATGAGGATCCAGTGCGACGCGTGCGAGGCCGCGGCGGCCACGGTGGTGTGCTGCGCGGACGAGGCGGCG
CTGTGCGCGCGCTGCGACGTCGAGATCCACGCCGCCAACAAGCTCGCCAGCAAGCACCAGCGCCTCCCGCTCGACGCCG
CGCTCTCCGCCGCCCTCCCGCGCTGCGACGTCTGCCAGGAGAAGGCGGCGTTCATCTTCTGCGTGGAGGACAGGGCGCT
CTTCTGCCGGGACTGCGACGAGCCCATCCACGTCCCGGGGACGCTCTCCGGCAACCACCAGCGCTACCTCGCCACCGGC
ATCCGCGTCGGGTTCAGCTCCGTCTGTAGCGCCAACGCCGACCACCTCCCGCCGCCAGCGCCCAAGGGGAACTCCAAGC
CGCCGGCAAGCGGCATCGCTGCTGCTGCTGCTCCCAAGCCGGCCGTGTCCGCGGCGGCGCAGGAGGTGCCGTCGTCACC
GTTCTTGCCGCCGTCGGGCTGGGCCGTCGAGGATCTCCTGCAGCTCTCCGACTACGAGTCCAGCGACAAGAAGGGCTCT
CCTATTGGGTTCAAGGA

FIG. 2 continued

> SEQ ID NO: 6061 168479 1171292_302054_1b
CGACCAGCGTCGCTGTGTGAAGGTTCTTAGCTACATAATTCTCTCTCTCTCTCTCTCCATGTCTAGCAGATGCAACA
TTCTAACCAGTACCGTTATGGGTTCTTAGCGAAAGGAGGATAGGCAGATACCTTGAAGGAAGCAATGAAGGTGCAGTGC
GATGCATGTGAGAAGGCTCCAGCATCACTCTTCTGCTGTGCAGACGAGGCGGCTCTCTGTGAGGAATGTGATGTGCGCA
TCCATGCTGCCAACAAGCTTGCTGGAAAACACCAACGTGTCCCTCTCATCCTTCAACCCCCTTCCGATGCTCCCCGCTG
CGATATTTGCCAGGAGAGGTCAGCTTACATTTTCTGCTTGGAGGACCGAGCACTTCTTTGCAGGGAGTGTGATGTGCCT
ATCCATTCCTCCACCACCTTGGCGACGAAACACCAGAGGTTTCTAGTTGCGGGTATTCAAGTGGCATTAGGCACTATTG
AGGGTGGTGCTATGAAATACTAATACTAATACTAATACTAATACCACTAATCAGCAGCCAGAAATAGCGAAAATGCAAG
CCATGCCGCTAGTTTCTAGCTCTGGAACTGCCAAAAACACATATAAGAAGGAACGGAATGTGGCGGTTTC

> SEQ ID NO: 6062 168524 130619_300489_1b
GAATTCATTTTCCGCAACTCTGGTTTATTTCCGGAACTCTGGTTTACGTTCCAAGATCAAAGCAAAAGAAATATCTAAG
TGAAGGCAAACCGGAGTCATCTTGAACCCAGTTACATCCTCAAAAATACATATTTGAATCATCGTGAATGTTTTAATGG
AGTCGAAAGGTGGTAAAAAGTCTAGTAGTAGTAGTTCTTTACAATACGAAGCACCCCTCGGATACTGCATTGAAGACAT
TCGACCAAACGGAGGAATTGAAAAGTTCAGATCTGCTGCATACTCAAACTGCGTGAGGAAACCATCCTGATAGGACCTT
ATATGTTTTCAAACGTAGAGTAGGATTTCCCTATTTCCAGTTTAATCTTAAATCCTGCAAAATATAATCTTACAAATCA
ATTTCTCTGGCTTTCTTATTTTCTTCTTTTTCTTCAATAATCACACCAAGAAACAGTCTTTCTTCTTCCTCCACTTAAT
CTTTCTAAAAGCTTTCAATTTCAATCACAATGGGTGTCTACGCTAACCCACCATCTCCAATTGGTTTCGAAGGATTTGA
AAAACGTCTTGAGATTACTTTCTCTGAAGCTCCAATTTTTGTTGATCCACAAGGACTCGGTCTCCGAGCCTTGACTCGT
CCTCAGATTGATACAATCCTTGATGCTGCTAAGTGCACTATTGTCGATCAACTATCTAACTCAGAGTTTGACTCGTATG
TTCTGTCTGAGTCGAGTCTTTTTATCTACCCACTGAAGATGATCATCAAAACTTGTGGAACTACTAAACTTCTGCTGGC
G

> SEQ ID NO: 6063 168524 128996_300401_1b
CCCCTGCCACTTGAAGCTGTGAAGTACTCTCGTGGGACATTCATTTTTCCTGAAGCACAGCCCTCTCCACACAAGAACT
TCTCTGAGGAGGTTGCAGTCCTGAACCGCTACTTCAGCGGTCTCAAATCTGGTGGCAACGCATACGTGATTGGAGATCC
TGCAAAGCCAGGGCAGAAGTGGCATGTCTACTATGCCACCCAGCACCCGGAGCAACCTGTGGTCACTCTTGAGATGTGC
ATGACTGGGCTGGACAAGAAGAAGCTTCTGTCTTCTTCAAGACTTCTGCTGATGGACACACAACATGTGCTAAGGAAA
TGACCAAGCTCTCAGGTATCTCTGACATCATCCCAGAGATGGAAGTCTGCGACTTCGATTTCGAGCCCTGCGGCTACTC
CATGAATGCCATCCACGGCCCTGCTTTCTCAACCATTCATGTGACTCCTGAGGATGGCTTCAGCTATGCCAGCTACGAG
GTCATGGGCTTCAACCCTGCTTCCCTTGCCTATGGTGACCTTGTCAAGAGGGTGTTGAGATGCTTTGGCCCGTCGGAGT
TCTCTGTTGCGGTTACCATCTTTGGTGGCCGCAACCATGCAGGGACCTGGGCCAAGGGGGCTGGATGTCGGGG

> SEQ ID NO: 6064 168524 118104_300064_1b
CAAATCCTAAACAAACCCAAATTCTCTCTTCCCATCCGTTATTTTGCCCCTTAATATTCTTTAATTCACAAATTCAAAG
CTTTTTTTTCCAACAGTCTTTTCTTCAGATTTTCTTCTGTTAAAGAACAGTGAAGGAGGTCGTACTGCGATTCTACATC
TGCTTATTTCACCAATTTTTGTAGGAATCGATGAACTAATCAGGACTCTAAAGGTGGGAAGAAGAAGTCTAGTAGTAGTTC
CTTATGTTACGAAGCTCCCCTTGGTTACACTATTGAAGACGTTCGACCAAACGGAGGAATCAAGAAATTCAGATCAGCT
GCTTACTCCAACTGCACTCGCAAGCCATCCTGAGATTATCCGTGATCTAGAATAAACCACCAAAGGTGGTTCAAGTAGA
TAGTAGTTTTTGGAATTCTGTTCTTCTCAACTCTTTTTCTTCTTCATATCTCATCCTCGTGATAATCTCTTCCAAAAG
TTCTCCTTCCCAAGTACTCTCTTTCAAGCAAGATGGCCGTGCCAGTTTCTGCCATCGGATTTGAAGGATACGAAAAGCG
ACTTGAGATTACCTTTTTCGAGTTAGGAATGTCTGATGGCCCAGGATGTGGTCTACGGTCTCTCTCCATAGACCAATTG
GATGAAATTCTGACACCGGCTGCATGCACCATAGTGTCTTCATTGGCAAATGATGAAGTCGACTCTTATGTCCTTTCGG
AGTCTAGCCTCTTTGTCTACTCATACAAGATCATCATCAAAAC

> SEQ ID NO: 6065 168524 270920_200129_1b
TTCTTTCTTGTTAACTCATTCGGAATTTTCTTCCTAACAAATTTCTAAGGTTTCATCTCTTCTTCGGAATTTTCTGATT
TATTGGAGGAAAAGATCGTGATATATCGGAGAGAATAGGATTTATAACAAATTTCAAATTTATATTGCAAGTGAATGAT
CTAATGGAGTCAAAAGGTGGGAAAAAGAAGTCCAGTAGTAGTTCCTTATTTTACGAAGCTCCCCTCGGCTACAGCATTG
AAGACGTTCGACCAAACGGTGAAGTCAAGAAGTTCCGATCTGCTGCTTACTCCAACTGCGCGCGCAAACCATCCTGATA
TTCCCTAAGCTTTCGTCCTTAACGCGTCAATAGACGCAACCCAAAAAAAAACAAATTTTTTTTTCTGCGTTCAGTTTCTT
TTGTGCCCTCACTCCTTTTCTTCCTTCTTTTTACTACTTTCTGCTTTTGTGCTCATTGCTCGGAACATTTTCCTCTTTAA
CTTCTTTTGCTGCCGTGAACCATTTTCATCATGGATATGGCCTTGCCAGTCTCTGCCATTGGTTTTGAAGGTTTTGAGA
AGAGGCTTGAAATTTCTTTCTTCGAGCCTGGTCTGTTTGCTGATCCTAACGGAAAAGGACTTCGATCTCTCTCAAAGGC
ACAATTGGATGAAATTCTCGGACCTGCTGAGTGCACCATTGTTGATTCCCTATCAAATGACGATGTTGATTCCTATGTC
CTCTCCGAGTCGAGCCTCTTTGTTTATTCTTACAAGATAATCATCAAAACCTGTGGCACCACAAAGTTGCTTCTCGCAA
TTCCGCCCATCCTAAAGTTGGCTGAGACCCTGTCTCTCAAAGTACAAGACGTGAGGTATACCCGTGGGAGCTTCATTTT
CCCTGGTGCTCAGTCTTTTCCTCACCGTCACTTTTCTGAAGAAGTTGCTGTACTCGATGGCTATTTTGGAAAGCTTGCT

FIG. 2 continued

GCCGGTAGCAAGGCTGTGATTATGGGCGGTCCTGATAAAGCACAGAAATGGCATGTTTACTCTGCCTCTGCAGGACCTA
TTCAGTCTAATGACCCTGTTTACACTCTTGAGATGTGTATGACTGGTTTGGACAGGGAGAAGGCATCTGTCTTTTACAA
GACTGAAGGAAGCTCGGCTGCTCATATGACTGTTCGATCTGGAATAAGGAAGATCCTCCCCAATTCTGAGATATGTGAT
TTTGAGTTTGAACCCTGTGGTTATTCCATGAATTCGATTGAAGGAGCTGCACTCTCAACCATTCACATTACCCCAGAAG
ATGGCTTTAGCTATGCTAGCTTTGAAGCAGTTGGGTATGATATGAAAACCATGAAGCTGGGTCCCCTGGTTGAGAGGGT
GCTGGCATGTTTCGAGCCAGATGAGTTCTCTATTGCTTTGCATGCTGATGTTGCTACCAAGTTACTGGAGCGTGTTTGC
TCTGTTGATGTGAAAGGCTACTCTCTTGCTGAGTGGAGTCCAGAAGAATTTGGCAAGGGTGGTTCCATTGTCTACCAGA
AGTTCACCAGAACTCCTTGCTGTGGATCTCCCAAGTCCGTTCTGAAGGGCTGCTGGAAAGAAGATGAAGAGAAAGAAGA
AAAGGAGTAGTGTCT

> SEQ ID NO: 6066 168524 238047_301291_2b
GGGTTTGTGCGCTTCGATTCAGAAATCCGGATTTGGGCATGTTGTAATGGACGCCAAGGGAGGCGAGGACGATTCCAGC
AGTAGTAGTAGTAGTAGTTTTAGCTCCAGATTCCGCTACGAGATCCCCCTGGGCTACGTTGTGGAGGACGTTCGTCCAA
ACGGAGGATTTGAGAAGCTCCGCCGTGCTGGCTTCACTGTGTGCGTGAGGAAGCCATCCTGACATCCCCTACAGGAGCA
ACCCGAGTAAGAACTTAGCTAGAGTAGCAGCTCGAGTAGAAGAAGTCCGGGTTCTACAATTTTTTTCTAGATTTTTTTT
TCGGTTCTAGCGGATGGGACTGGAAGTAGCTTGGGTGGCGGAGCTCCAGCCCGCTGGAGCAGGCTTCGAAGGATTCGAG
AAGAGGCTGGAGATCGATTTCTCGTATGGTCCGAGCAGCGATCCATCCGGACTGCGATCGGTCTCCCGGCAAGGGTTGG
ACAGGATGCTCAAGGCGGCCGACTGCACCATCGTCTCGCAGCTCAGCAGCGACGAGTTTGATTCCTACGTGCTGTCCGA
GTCGAGCCTCTTCGTCTATCCTCTTAAGGTGGTGATCAAGACTTGCGGCACTACAAAGCTTCTGAGGAGCATTCCGGTC
TTGCTGGAGCTGGCCTCGGCTCTGGATCTCTCGGTCCGG

> SEQ ID NO: 6067 168524 226877_301005_1b
GTTCGACCTGCCGGAGGCGTGAAGAAGTTCCAGTCTGCTGCTTACTCCAACTGCGCGAAGAAGCCATCCTGATAGCCCT
TTCGGCTTCTCCATCCTAGTAGTTTAGGATTTCTTGCAATTCCATTTTGGCACTTTTCTTCTGACCTATTTCTCTGGCT
GCTGCTTCCTGATAATCGACCAGTTCTCTAGTCTTGCTCCCTGCACTCCTCCCTCCTCCATCTCCGGCACAGTGTTCTG
ACCAACCTGCTCCAATGGGTGTCTTGTCTGCTGCTGACCCTCCCCCAGTCTCAGCAATTGGGTTTGAGGGCTATGAGAA
GCGCCTTGAGATCACTTTCTCTGAGGCACCTGTCTTTGCTGACCCTGATGGTCGGGGTTTGCGCGCCCTCTCCAGGCC
CAGATTGACTCTGTTCTGGATCTTGCACGGTGCACCATTGTGTCCGAGCTGTCCAACAAGGACTTTGACTCCTATGTCC
TCTCTGAGTCCAGCCTGTTTATCTATTCTGATAAGATTGTGATTAAGACCTGTGGGACTACAAAGCTCCTGCTCACAAT
TCCAAGGATTCTTGAGCTTGCTGAAGGGCTTTGATGCCACTTGCTGCTGTGAAGTACTCCCGCGGGATGTTCATCTTC
CCCAGTGCACAGCCTGCTCCCCACAGGAGCTTCTCTGAGGAAGTTGCTGTCCTCAACCGCTACTTTGGCCATCTGAAAT
CTGGTGGTAATGCTTATGTGATTGGAGATCCAGCAAAGCCTGGCCAGAAGTGGCATATCTACTATGCTACTCAGCACCC
GGAGCAACCTATGGTTACCCTTGAAATGTGCATGACCGGACTGGACAAGGAGAAAGCTTCAGTCTTTTTCAAGACTTCT
GCTGATGGTCACACATCATGTGCTAAGGAAATGACAAAACTCTCGGGCATCTCTGACATTATCCCAGAGATGGAGATCT
GTGACTTTGACTTCGAACCCTGCGGCTACTCCATGAATGCAATCCATGGCTCAGCGTTTTCTACCATTCATGTGACCCC
TGAGGATGGCTTCAGCTACGCCAGTTATGAGGTCGTGGGCTTCGACGCCTCTACTCTTGCTTATGGCGACCTGGTGAAG
AGGGTCCTCAGGTGCTTTGGCCCTTCGGAGTTCTCTGTTGCTGTTACCATCTTTGGTGGGCATGGTCATGGTGGAACAT
GGGCAAAGGAGCTCAATGCTGATGCTTACA

> SEQ ID NO: 6068 171033 115359_300013_1b
ACGCGTGGGCACCGGCACCTATAGCTCCGCGGCCGTCGCGCGCCGTAAGTGTGTCAACTCACACGCGCCGCTGTTGGTG
GGGGACTTCAATTTCAATTCCGGCGTCCGGTGATTTTCGTCACCGCCAGAAATTGTTAGGGTTTTTGGGTAAGGGATAT
GCTAACTGTCCATTGAGAAGTATTTCTACTACTCAAATGGGCCCCGACACCTGATCACAAGGAGGATGATCTTCGCCGTG
AAAAAGCATCTCCTCCACCACAACCGCCATCGAAGTCTGAGAAGTTGCTGACATTGCCCACGATTTAACAATTGGCCG
CGTGGCTGCTGTTCCGCTTCTTGTAATCACATTCTATGTGGATAGCTGGTGGGCCCAACTGCTACAACAGCCATATTT
ATTGCAGCAGCAATAACTGACTGGCTTGATGGATACCTTGCTCGCAAGATGAACTTAGGAACTGCCCTTTGGTGCATTTC
TAGATCCAGTCGCTGACAAGCTAATGGTTGCTGCCACCTTGATCTTGTTGTGCACCAGACCATTGGAGTCCAGTGTGTT
TGGACAGTTGCCATGGCTATTAACTGTCCCTTCAATTGCGATAATAGGCAGGGAGATTACTATGTCTGCAGTTCGAGAA
TGGGCAGCTT

> SEQ ID NO: 6069 171051 121988_300014_1b
CCCGCACACCCGCGACAAGCTCAGCTCGGCTAGGCCAAGACGGTGGCGAGCGGCGGCGATCTGGTGCTCTGCTTGGGTT
GAGTTCTTGATTTTGCCGAGGTGTATCGATGGAGACGACGGCGGCGAATAAGCTGCCGCCGGGGTTCAGGTTCAGGCCC
ACCGACGAGGAGCTTGTGGTGCACTACCTCCGCCGCCGCGCTCGGCTCCCCTCTCCCCGCCGTCGACATCCCG
ATGTCCGCCTCCTCGCGCATGACCCCTCCGACCTGCTTCCTCCAGGTGAGTCATGAGCCAGCTCGCCGCTCGCGCGG
CGTCGTCGGAGCGTGGCCGGCCGGCGCTGACGAGGTCCCGTGCGTGCAGGGTGGAGTGAGCAGGAGAGGTACTTCTTCA
CGTGCAAGGAGGCCAAGTATGTCAAGGGGCGCCGCGCCAACCGCGCCACGGGCGCCGGGTACTGGAAGGCGACGGGGAA
GGAGAAGCCGGTGGCGGTGTCCGTGGCGGCGGCGCCGAGGAGCCAGGCCCGCCGCCGTCGTCGTCGGCATGAAGCGCTC

FIG. 2 continued

CCTCGTGTTCTA

> SEQ ID NO: 6070 171051 267020_200088_1b
GGGGTTATGGGTATGGAAAAGCTTAATTTTGTGAAAATTGGAGCGGTGAGATTGCCCCCTGGATTCAGGTTCCATCCAA
CTGATGAAGAACTTGTGGTTCAGTATTTAAAGCGCAAGGTCTTCTCTTTCCCTTTACCAGCCTCTATCATCCCTGACAT
AGACGTTCACAAATCTGATCCTTGGGATTTACCAGGGGATTTGGAGCAAGAAAGATACTTTTTTAGCACAAGGGAGATG
AAGCATTTAAAGGGGAACAGGTCCAATAGAGCAACCAACTCAGGGTATTGGAAGGCAACTGGACTTGACAAAGAAATTG
TGAGTTGCAGAGGCAAACAACAACAACAACTTCTTGTTGGTATGAAGAAAACTCTTCTCTTCTACAAAGGAAAGCCTCT
CCATGGTTGCAGAACTGATTGGATTATGCACGAATATCGCCTCGCCAATCTTGTACCCAACAACATTCCTACCCAGGAA
AATTGGGTTCTGTGCCGCATATTCTTGAAGAAGAGAGGAAGCAGTAAGAATGAAGAGGCGAATACAACTAGTTGTAGAG
CAGGTGCAAAGAGTAAGCTAGTTTTTTTACGATTNTATGAATAGCTGCGTACCGGCTTCTTCATCAGTGTCTGGTTCCAG
TGGGATCACTGAGTTGTCTACTAATGAATC

> SEQ ID NO: 6071 171051 191561_300702_1b
CCCCCATTCGAGAAATCCCTCACAACCCACAACATTTTCAAACAACGCAAAGCAGTAGCAGCAGCGAGAAGCAAGCAAG
AAGCGATGGGGATGGGGATGAGGAGGGAGAGGGACGCGGAGGCGGAGCTGAACCTGCCGCCGGGGTTCAGGTTCCACCC
CACGGACGACGAGCTGGTGGAGCACTACCTGTGCAGGAAGGCGGCGGGGCAGCGCCTGCCGGTGCCGATCATCGCCGAG
GTGGATCTCTACAAGTTCGACCCGTGGGATCTGCCCGAGCGCGCGCTGTTCGGCGCCAGGGAGTGGTACTTCTTCACCC
CGCGGGATCGCAAGTATCCTAATGGGTCACGCCCCAACCGCCGCCGGCAACGGGTACTGGAAGGCCACCGGCGCCGA
CAAGCCCGTCGCGCCGCGGGGCGCACGCTTGGGATCAAGAAGGCGCTCGTGTTCTACGCCGGCAAGGCGCCGCGAGGG
GTCAAGACTGATTGGATCATGCATGAGTACCGGCTCGCCGATGCTGGCCGCGCCGCCGCGGGCGCCAAGAAGGGATCTC
TCAGGTTGGATGATTGGGTGCTGTGTCGGCTGTACAACAAGAAGAACGAGTGGGAGAAGATGCAGCAGGGGAAGGAGGT
GAAGGAGGAGGCGTCCGACATGGTTACGTCGCAGTCGCACTCGCACACCCACTCGTGGGGCGAGACGCGCACGCC

> SEQ ID NO: 6072 171051 197816_300701_1b
AACACTAGTAGGATAAAGCCACAGAGAGAGCAGTAGTAGTAGCGAGCTCGCCGGAGAACGGACGATCACCGGAGAAGGG
GGAGAGAGATGAGCGGCGGTCAGGACCTGCAGCTGCCGCCGGGGTTCCGGTTCCACCCGACGGACGAGGAGCTGGTGAT
GCACTACCTCTGCCGCCGCTGCGCCGGCCTCCCCATCGCCGTCCCCATCATCGCCGAGATCGACCTCTACAAGTTCGAT
CCATGGCAGCTTCCCCGGATGGCGCTGTACGGAGAGAAGGAGTGGTACTTCTTCTCCCCGCGAGACCGCAAGTACCCGA
ACGGGTCGCGGCCGAACCGCGCCGCCGGGTCGGGGTACTGGAAGGCGACCGGCGCCGACAAGCCGGTGGGCTCGCCGAA
GCCGGTGGCGATCAAGAAGGCCCTCGTCTTCTACGCCGCCAAGGCGCCCAAGGGCGAGAAGACCAACTGGATCATGCAC
GAGTACCGCCTCGCCGACGTCGACCGCTCCGCCCGCAAGAAGAACAGCCTCAGGTTGGATGATTGGGTGCTGTGCCGGA
TTTACAACAAGAAGGGCGGGCTGGAGAAGCCGCCGCCGCGGCGGTGGCGGCGGCGGGGATGGTGAGCAACGGCGGGGG
CGTCGAGAGGAAGCCGATGGTGGGGGTGAACGCGGCGGTGAGCTCCCCGCCGGAGCAGAAGCCGGTGGTGGCGGGGCCG
GCGTTCCCGGACCTG

> SEQ ID NO: 6073 171278 233073_301275_1b
AGTTAGAGCTAGAGCTAGAGCTAGGGTAATCGCGGCAGCGGCTAGCTGGGCTTCGCCGGATCCACCGGGTGATGGCGCT
GGACAGGGCGATTTAGGGTTTATCGGATTGGGCGAAGAACGCGCTGCGATTTCAGGGTAATCGGCCTTGTTCGTCGCC
ATGGTGGAAGCTCCGGAGGGGGAAGAGAGAGCTGTTCCGGAGGAGAGGCGATGGAAGCTGGCGGATTTCGACATCGGCA
AGCCGCTAGGTCGCGGCAAGTTTGGCAACGTCTATCTCGCGAGAGAGAAGAGGAGCAAGTATGTGGTGGCGCTCAAGGT
GTTGTTTAAGAACCAGTTACAGCAGTCCCAAGTCGAGCACCAGCTACGCCGCGAGATCGAGATCCAAAGCCACTTGAGG
CATCCAAACATCCTTCGGCTGTATGGATACTTCTATGATCAGAATAGAGTGTACCTTATTCTAGAGTATGCCGCTAAAG
GCGAGCTGTACAAGGAGCTCCAACGGTGCAAAGTTTTCTCTGAGAGGAGAGCAGCCACTTACATTGCCTCATTGGCGAG
GGCGTTAATGTACTGCCACGAAAAACACGTTATTCACAGGGACATAAAGCCAGAGAATCTTCTAATCGGAATGAAGGGA
GAGCTGAAAATCGCAGACTTTGGATGGTCAGTACATACGTTTAACCGGAGGCGGAC

> SEQ ID NO: 6074 171278 198823_300685_1b
TCGACCACGCGTCCGGCCGCTCGGCCGGCTCCTCGGCCGTGGCACGTTCGCCAAGGTCTACAAGGCCTATAAGTTGGCC
ACCGGCGAGGCCGTCGCCATCAAGGTGTTCGACAAGGAGGCGGTGCAGCGGTCCGGCACGGTGGAGCAGGTGAAGCGCG
AGGTGGACGTCATGCGGCGTGTGCACCACCGCCACGTCATCCGCCTCCACGAGGTGATGGCTACGCGGTCCAGGATCTA
CTTCGTCATGGAGTACGCGAGCGGCGGCGAGCTCTTCACCCGCCTCTCCCGGAGCCCGCGGTTCCCGGAGCCCGTCGCG
CGCCGCTACTTCCAGCAGCTGATCACCGGCGTGGAGTTCTGCCACAGCCGCGGCGTGTACCACCGCGACCTCAAGCCCG
AGAACCTCCTCCTCGACGCCC

> SEQ ID NO: 6075 171278 182002_300628_1b
GAATTCGAATCTCATCACTTATCTCTCTCTCAATCTCTCTTTTAAATTTCAAAAAGTTCCTGAAAGAACTTCAAAACCA
TATTGAGATCTTAGAACCCCAGGAGAAAAAAATACATTCAGCGAGCGAATTGATTGATTTTTCAAATCAATTCGCTCGT

FIG. 2 continued

ATTCTGGTTTATTTCAGATTAACGAATCTATTTCTTGTTTGTTGAAATTATATCAATCACGCATGCCTGAATTAATCGA
GATCTCATCAGAAAATTCATTATTTGGCAAATATGAGCTCGGTAAATTGCTTGGTTGTGGCGCATTCGCTAAAGTTTAT
CACGCAAGGAATATCAAAACAGGGCAAAGCGTAGCAATAAAATGTATAAGCAAACAGAAAATCCTCAAAGGAGGATTAA
TGGCACATGTCAAGAGAGAAATCACTATTATGCGTCGTCTCCACCATAAGAATATTGTGAAGCTTTATGAAGTTTTGGC
CACGAAAACAAAGATTTATTTCGTTATGGAATTTATTAAAGGTGGTGAATTGTTTGCTAAAGTAGCTAAAGGTAAATTT
AGTGAAGATTTGAGTCGTAAATATTTCCAGCAATTAATATCAG

> SEQ ID NO: 6076 171278 187385_300676_1b
CCCACGCGTCCGGTCAATGGAGGCGAGCTCTTTGACAAGATTGCCGTAAAAGGAAAACTCTCTGAACATGAAGGAAGGA
GACTTTTCCAGCAGTTAATCGATGCTGTGAGCTATTGCCATGATAAAGGTGTCTACCACAGAGACCTTAAGCCCGAAAA
TGTTCTTGTGGATCGAAGAGGAAATATCAAGATCTCTGACTTTGGCCTAAGTGCTTTGCCTCAACATCTTGGGAATGAT
GGATTGCTGCACACAACATGTGGCAGCCCCAATTATATTGCTCCTGAGGTTTTGCAGAACCGAGGTTACGATGGCTCAT
TGTCAGATATCTGGTCTTGTGGAGTAATTCTCTATGTAATGCTCGTCGGATACCTTCCCTTTGATGACCGAAATCTTGT
TGTCCTGTACCAGAAGATTTTCAAGGGGGACACTCAAATCCCAAAGTGGCTTTCACCTAGTGCACGGGATCTTCTTCGA
AGGATTCTTGAACCGAACCCGATGAAGAGAATCAACATAGCAGGGATCAAAGAGCATGAGTGGTTTCAGAAGGATTACA
CTCCTGTTGTTCCATATGACGACGATGATGACAATTATCTTGACTCAGTTCTTCCAATCAAAGAGCAAATTGATGAAGC
AAAGCAGGAAAAGCCTACTCATATCAATGCTT

> SEQ ID NO: 6077 171278 270976_200129_1b
CTCAAACATAGCCTTTCGTATTCAGCTTCTCATATACTCTTCGATCTGAATAGTTTATTATAATATTTGAGTTCTCTTT
AATCTTTTTTAATCTTTTTATTTTGGAAAAGTTTAAGATGAGTGTATCCAAGTCCCAGGTTTGGCAACCTTGTAAAAAG
AAGAGGATTTAGCTTAAGGCTTAATCCAGAAGTAAAAAAAATAAAAGAAGATTTTTTTATAGGGAAGAAAAAAAAGAGG
ATGGTCTTTGTATTGATTTAGGGTAGGGATTTAATAAGATTGTAGGATCTGTAAGAAATAGAAAGTTTGGAGATAGATG
GGTTCAAGATCAAATAATGGAAGTGGGAGGACTACAGTGGGAAGGTATGAGATAGGGAGGACAGTTGGGGAGGGTACTT
TTGCAAAGGTCAAATTTGCAAGGAATGTTGAGACTGGTGATAATGTTGCCATTAAGATTCTTGATAAAGAGAAGGTCAT
GAAGCACAAGATGATCGGCCAGATTAAACGGGAAATATCAACGATGAAACTTATAAGACACCCCAATGTTATCCGAATG
TATGAGGTCATGGCCAGCAAGACGAAGATATATATTGTTTTGGAATTTGTTACTGGTGGCGAACTGTTTGACAAAATTT
CTAGTAGAGGTAGGCTCAAAGAAGATGAAGCAAGAAAATACTTTCAGCAACTTATAAATGCAGTTGACTACTGTCATAG
TAGAGGTGTATTCCACAGAGATCTCAAGCCTGAAAACTTGTTGCTGGATGCGAATGGTGTTCTTAAAGTTTCGGATTTT
GGACTGAGTGCACTGCCTCAGCAAGTTCGCGAAGATGGACTACTACATACAACATGTGGAACACCAAATTATGTGGCTC
CCGAGGTGATCAACAATAAAGGTTATGATGGAGCTAAGGCTGACCTGTGGTCATGTGGTGTAATCCTTTTTGTACTTAT
GGCTGGTTATTTGCCTTTTGAAGAGTCAAATCTCATGGCACTATATAAGAAGATACATAAAGCTGAATTTACATGTCCA
CCCTGGTTTTCCTCTAGTGCGAAGAAACTAATCAAAAGAATCTTGGATCCCAATCCACAGACGCGCATCACATTTTCCG
AGGTCATTGAGAACGAGTGGTTCAAGAAAGGGTATCGTCCACCTGTTTTTGAACAGGCAGATGTTAGTCTTGATGATGT
GAATGCTATTTTTAGTGAATCTGCTGACTCTTCGAACTTGTTGTGGAGAGACGGGATGAACGTCCTTCTGCACCACTG
ACTATGAATGCTTTTGAGCTTATTTCAACTTCTCAGGGTCTCAATCTCAGTTCTCTGTTTGAAAAGCAAATGGGGCTAG
TCAAAAGGGAGACAAGATTTACATCGAGATGTCCTGCGAATGAAATTGTCTCAAAAATTGAAGAAGCTGCTGTACCTTT
GGGCTTCAATGTGAGGAAAAATAACTACAAGATTAAGCTTCATGGGGAGAAGAGTGGGCGCAAAGGTCATTTATCCGTT
GCAACCGAGATTTACGAGGTGGCACCTTCACTATACATGGTTGAGCTTC

> SEQ ID NO: 6078 171278 280969_200070_1b
GAAAAATACCATTGATTCTCTGGTTTTTTCCTGTAAACCCTAGCTAAAAAATACCTTAATTCTCTTTCGGGAATGCAGA
GAGATGAGAGGTTATCGGTTTTCTGATCCCCTTTTGACTGCCGGAAAAATCCAAAAACCAGTCGCCGGCGGCAGGAATT
GCCACCGGAAACACGTAGAAGACGGGTGAATCAATCACCCATTTTCCCCCCTTTCTGTCAACCATTTCCTTTTTTCTTT
ACAGAAACAGACACCCTTTTCATTCTTTAGCCTCTTTTTTACAAATTTAACCAAAATCTTTCTCTGTTCCAAAAAATGG
CACCTGAGGAGAAATGCATGGCTTTGTACGGAAAATACGAGCTCGGCCGCCTTTTAGGCCATGGAACTTTTGCCAAAGT
TTTCCATGCACGTAACGTGCAAAATGGCAAAGTGTGGCTATGAAAGTTGTGGGCAAAGAAAAAGTGATTAAAATTGGT
ATGATGGATCAAATCAAACGAGAAATCTCTGTTATGAAAATGGTAAAACACCCAAATATCGTTGAGCTTAACGAAGTCA
TGGCGAGTAAAACAAAGATTTACTTCGCCATGGAGTTCGTTAGAGGGGGTGAATTATTTGCAAAAATAGCCAAAGGCAG
GTTAAGGGAAGATGTGGCTAGAGGCTATTTTCAGCAATTAATTTCAGCTATTGATTTCTGTCATAGCCGTGGTGTTTAT
CATAGAGATTTAAAGCCTGAAAATTTGTTGGTAGATGAAGAGGAAATCTTAAGGTAACAGATTTTGGGCTTAGTGCAT
TTACTGACCATTTAAGACAAGATGGGCTATTACATACAACATGGAACTCCTGCTTATGTTGCTCCTGAAGTGATTAT
TGGTAAAAAAGGCTATGATGGTGCAAAAGCTGATATTTGGTCATGTGGTGTAATTCTTTATGTTCTTTTAGCTGGGTTT
TTACCATTTCAAGATGAAAATATTATGGCTATGTATAAAAAAATTTATAGGGGTGATTTCAAATGTCCACCTTGGTTTT
CATCAGAGGCTAGAAGATTAATCACCAAGATGTTGGATCCGAATCCAAATTCAAGAATCACTACTTCTAAGATTATGGA
GTCAACTTGGTTTAAAAAATCACTGCCAAAGATTTTAAGAACCAAAGAGGAGGAAGAATTTTCTATAGGAGATGATATA
AATTGTGTCGAAAAGGCTAAAGATCTCGAGACATTAAATGCGTTTCATATCATTTCTTTATCAGAAGGTTTCGATTTAT
CGCCATTATTTGAAGAGAAGAAG

FIG. 2 continued

> SEQ ID NO: 6079 171278 56661_300127_1b
ATGAAGCTTCTTAACCATTCAACATTGTCCAAATACACGAGGTGATTGGAACCAAGACAAAGATCTGTATAGTTATGGA
ATACGTTTCAGGTGGTCAGCTTTCAGACAGACTTGGAAGACAGAAAATGAAAGAATCAGATGCTAGAAAACTTTTCCAA
CAATTGATTGATGCTGTTGATTATTGTCATAACAGAGGAGTTTATCATAGAGATCTTAAGCCACAAAACTTGTTACTAG
ATTCAAAGGGTAATCTCAAAGTTTCTGACTTTGGATTAAGTGCAGTTCCTAAATCGGGGGATATGCTCTCTACAGCTTG
TGGCTCTCCATGTTATATAGCACCAGAGTTGATTATGAACAA

> SEQ ID NO: 6080 171278 8138_300316_1b
AATTCGGCACGAGGTAAATGATGGGCGGATGAAAGAAGATGAGGCGCGGAGATATTTCCAACAGCTTATACATGCTGGG
GACTACTGTCATAGCAGAGGGGTCTACCATAGAGACCTCAAGCCTGAAAATTTACTATTGGACTCCTATGGAAACCTCA
AGATCTCAGATTTTGGATTAAGTGCTTTTGTCCCAACAAGTCAGGGATGATGGACTCTTGCATACATCGTGTGGAACAC
CAAACTACGTTGCTCCTGAGGTTCTCAATGATAGAGGCTATGATGGAGCAACAGCTGACATGTGGTCATGCGGTGTTGC
ACTCTATGTCCTGCTTGCAGGCTACTTACCTTTTGATGATTCTAAACTAATGAATCTTTATAAAAAAATATCATC

> SEQ ID NO: 6081 171278 284568_200099_1b
AAAAATTCAGTAAGTCAATATACTCAAGACTTGTCTGAATTCTGAAGAATCTGAGATTAAACCCCTTTTCCCTTGATTA
TGGAGCGTTATGAGATAGTAAAGGAGTTGGGTTCTGGTAATTTTGGGGTAGCCAAGCTTGTTAGTGACAAGAAATCCAA
AGAGCTCTTTGCTGTCAAGTTTATTGAAAGAGGCCACAAGATAGATGAACATGTGCAAAGAGAAATTATGAATCACAGA
TCATTGAAACATCCAAATATAGTCAGATTTAAAGAGGTCTTGCTGACACCTACTCATCTAGCTATTGTAATGGAGTATG
CTTCCGGAGGAGAACTCTTTGCCAGGATCTGTAGTGCTGGAAAATTTAATGAAGATGAGGCAAGGTTCTTCTTTCAACA
ACTGATATCAGGGGTTAGCTACTGCCATTTCATGCAAATCTGTCATAGAGATCTCAAACTGGAAAATACTTTACTAGAC
GGAAGTGCTGCACCGCGTGTCAAAATATGTGATTTTGGATACTCCAAGTCAACTATCTTTCATTCTCAACCTAAGTCCA
CTGTAGGGACGCCTGCTTATGTAGCACCAGAAATCCTAACAAAGAAAGAATATGATGGGAAGCTTGCAGATGTTTGGTC
ATGTGGAGTCACATTATATGTAATGTTAGTTGGAGCTTATCCATTTCA

> SEQ ID NO: 6082 171278 272254_200042_1b
TTAATCCATTCTATAACAATCACGCCTCCATCCCAAACAAACGGAGACCGCCAATTCGTAATCCTTACGGATTGTGAGG
AAGTTTTATTGGGCACAATGGCGACGATTCCCCAAGAATAAATAAAAAAATTCTCAATTGTAACGCCAATCTCTTCTCC
AAGATGACCAACAAGAACGAGAAGAAAGGCTACATTTTGATGCAAAGGTATGAGATTGGGAAATTGTTAGGCCAAGGGA
CATTTGCCAAGGTGTACCATGCAAAAAATCTGAAAACTGGCCAAAGTGTTGCTGTAAAGATCATTGACAAGGAGAAGGT
GATGAAAGTTGGCTTAATTGATCAAATCAAACGTGAAATCTCTGTCATGAGGCTAATCAAACACCCAAATGTTGTCCAG
CTCTATGAGGTTATGGCTAGCAAAACTAAGATATATTTCGACGGAATATGTCAGAGGTGGTGAACTTTTCAATAAGG
TTGCTAAAGGCAGGCTTAAAGAAGATGCAGCTAGAAAATACTTCCAACAATTAATCGCTGCAGTTGATTTCTGTCATAG
CCGTGGCGTCTACCACCGTGATCTCAAGCCTGAAAATCTCCTCCTCGACGAAGATGGAAACTTGAAAGTGTCAGATTTC
GGGCTGAGTGCA

> SEQ ID NO: 6083 171278 255757_301643_1b
TAGATATAGTAGTACTGTGGGAATACCCATCTTCTCTCATAAAGTGAACCTGAACCTGAAGGCCATAGTTGGACCCTGT
GCTAAGTAAGGAAGCATGGATCGTTATGAGGCAGTGAGAGATATCGGGGTTGGTAATTTTGGTGTTGCTAGATTGGTAA
GAAATAAGAAGACAAAGGAGCTTCTTGCTGTCAAGTACATCGAGCGAGGCCCCAAGATTGATGAAAATGTCCAGCGTGA
GATCATCAACCATCGCTTGCTCCGCCATCCCAACATTATTCGCTTCAAAGAGGTTTGCTTGACTGCCACTCATTTGGCC
ATCGTTATGGAATATGCAGCGGGTCGGTGAGCTTTTTGAACGCATTTGTGATGCTGGGAGGTTCAATGAAGATGAGGCTA
GGTTTTTCTTCCAGCAGTTGATATCAGGGGTTAGCTATTGCCATGATATGCAAATATGTCATCGGGATTTGAAACTTGA
GAATACTCTACTGGATGGGAGTCCTGCTCCTCGGCTGAAGATATGCGACTTTGGCTACTCAAAGTCGGCACTCTTGCAT
TCTATGCCAAAGTCCACGGTTGGAACACCGGCCTATATTGCCCCAGAAGTTCTTTCTAGAAAAGAATACGATGGCAAGC
TTGCAGATGT

> SEQ ID NO: 6084 171278 103467_300026_1b
TGGTATCAACGCAGAGGGCATTACGGCCGGGGAGCTTATAGCTCCTTTTACTTGTTATTCTATCACAAATCAAATCACA
AAATACCCTGTTCGGTTGCAAGGCATCGATCACTCTAGATCGATGCCTGAAATCGAACAATTTTCCGAGGCCACGGCCC
CTTCAGAGAGTTGCCTATTTGGTAAATATGAGCTCGGAAAGTTACTTGGGTGTGGTGCATTTGCCAAAGTGTACCACGC
TAGAGACATCAGAAATGGCCAAAGCGTTGCAGTCAAAGTTATCAACAAGAAGAGAATTGCCAATCCGACTTTGATTACA
AACGTCAAACGTGAAATCTATATTATGCGTCGATTAAGTCACCCCCATATAGTCAAACTGTTCGAAGTTCTTGCGACAA
AAACAAAGATCTATTTCATCATGGAGTTTGTCAAAGGAGGTGAATTATTCAGCAAAATTTCCAAGCTGGGTCGGTTCAA
CGAAGATCTGAGCCGCAAATATTTCCAGCAACTCATATCAGCCGTACGATATTGTCATTCTCGTGGGGTGTACCATCGT
GATTTGAAACC

FIG. 2 continued

> SEQ ID NO: 6085 171278 120277_300383_1b
GTGAATTGTTCGCGAAGGTTGCCAAAGGAAGGTTAAGAGAAGATATAGCACGTGGCTATTTTCAGCAATTGATTTCAGC
TATTGATTTTTGTCATAGCCGCGGAGTTTATCATAGGGATTTAAAGCCTGAGAATTTGTTGTTAGATGAAGAAGGTAAT
CTTAAGGTTACAGATTTTGGGCTTAGCGCGTTTTCGGATCATTTAAGGCAAGATGGTTTGTTGCATACAACTTGTGGTA
CCCCTGCTTATGTTGCACCTGAAGTAATTGGTAAAAATGGCTATAATGGTGCAACAGCTGATATTTGGTCATGTGGTGT
AATTCTTTATGTACTTATAGCTGGTTTTTTACCATTTCAAGACGAGAATATTATGGCTATGTATAAGAAAATTCATAGG
GGTGATTTTAAATGTCCACCTTGGTTTTCATCAGATGCAAGAAAGTTGATAACAAGAATGTTGGATCCGAATCCGAGTA
CTCGAATCACTGCTTCAAAAATTATGGATTCCTCTTGGTTTAAGAAATCTATGCCAAAGACATTGAAGACTAAGGAGGA
GGAAGAATTTGGCGTANGAAAGGCGAAAATGATTGAGTCTTTAAATGCTTTTCATATCATATCTTTATCGGAGGGGTTC
GATTTATCACCTTTGTTTGA

> SEQ ID NO: 6086 171278 157349_301737_1b
AAAGAAAAAAGCCAAAATCTTGTTCGTCAAGCCCAATATGCTTTCCTGAAAAACCAGAAAAGGAAAAATAATGGGTTGA
AGAAATTTGGAAGAAGAAGAAGAAGAAGAAGAAAAACGGTGTCGTGTTTGGTAGGAAAGATGGTGATAAGGAAATTAGG
CAAGTATGAAGTAGGGAGGACAATAGGGGAAGGAACATTTGCCAAAGTTAAATTTGCACAGAATACGGAAACTGGTGAA
AGTGTTGCAATGAAAGTCCTCGATCGTAGTACTATCATCAAACACAAGATGGTTGACCAGATAAAGCGGGAGATATCGA
TAATGAAGCTTGTTAGACATCCATATGTAGTTCGATTACACGAGGTTATAGCAACCCGCACTAAGATCTATATTATCTT
GGAATTTATTACAGGCGGTGAACTGTTTGATAAAATAGTTCACCTTGGGCGATTAAGTGAAGCCGAGTCCCGTAGATAC
TTTCAGCAATTGATTGATGGAGTGGATTATTGTCACATCAAAGGAGTCTATCATAGAGATTTGAAGCCTGAAAATCTTC
TGCTAGATTCCCAAGGAGATCTGAAAATATCA

> SEQ ID NO: 6087 171278 142793_300445_1b
CCCACGCGTCCGGAAAGACCGTACCTCTATAGATGACTTTGAGATAATAAAACCAATTAGTCGTGGTGCATTTGGCCGT
GTTTTCTTGGCAAAAAAGAGAGCAACTGGAGATTTCTTTGCAATTAAGGTTTTGAAGAAGGCAGATATGATACGCAAAA
ATGCCGTTGAGAGTATCTTGGCGGAACGAAATATTTAATATCGGTTCGCAATCCCTTTGTGGTTCGCTTCTTCTACTC
TTTTACTTGCCGTGAAAACTTGTACCTTGTGATGGAATACCTGAATGGGGGGGACCTGTACTCATTGTTGAGGAATCTT
GGTTGCTTGGATGAAGACGTTGCTCGTGTATATGTCGCTGAAGTAGTGCTTGCTCTGGAATATCTGCACTCTTTGCGAG
TGGTTCATCGTGATTTAAAGCCAGACAATTTGTTGATTGCTCATGATGGTCATATCAAGTTGACGGACTTTGGGCTTTC
TAAAGTTGGTCTTATCAATAGCACGGATGACTTGTCTGGTCCGGCAGTCAGTGGAGCATCCATGATGGAAGATGATGAA
TCTCAGTTATTGGCACCTGAG

> SEQ ID NO: 6088 171917 104964_300365_1b
GAGGAGAAGCGAACAATGTCGGGAGCAGAAGAAGACAAGAAGCCCGCCGGCGATCAGGCTGGTCACATCAATCTCAAAG
TCAAAGGCCAGGATGGCAATGAAGTATTCTTTAGGATCAAAAGAAGCACCCAGCTGAAGAAGCTGATGAATGCTTATTG
CGACCGACAGTCGGTGGATTTCAATTCAATTGCTTTCTTGTTTGATGGCCGTCGTCTTAGAGCAGAACAGACACCAGAT
GAGCTGGAGATGGAAGATGGTGATGAAATTGATGCGATGTTGCATCAAACTGGAGGCACAATTCTTTGAGTCTTCTCTT
CCGTTTGTGGACCTAGACTTTATGCGTGTTTCAAGGTGGTATGGACTCGGTGAAAATGTAGGTTGTTCAACTTTAGGGC
CTGTAGTGTGTAATGAATGTCATCATGTTTGCTTCGTGACTAGCTCGGCTGAACTTCATCGCTACTGTAACTTGAT
ATGAAAGTCATTACTTCCTTAACCGTTTAGTTTTCTAAAGATGACATGAATTCAAAGTCTTGGTTTGTTTCAAATAACC
CCCTCCCCCAACCTTCATGAAATAAGAAGCTTGGCAACACGAAGTAGCTCCAGTGTACCCTGCTGGGCACCTCGTATAT
CACAGTTTGGTTC

> SEQ ID NO: 6089 171917 142675_300500_1b
TGCAAACAGAGGAAGATAAGAAGCCGAGTGGAGATCAAGGTGCACATATCAATCTCAAAGTCAAAGGCCAGGATGGGAA
TGAAGTCTTCTTTAGGATCAAAAGAAGCACCCAGCTAAAGAAGCTGATGAATGCATATTGTGACCGGCAGTCGGTGGAT
TTCAACTCAATTGCATTCTTGTTTGATGGTCGTCGTTCCGAGCAGAGCAGACTCCAGATGAGCTGGAGATGGAGGATG
GTGATGAAATTGATGCAATGTTGCATCAAACTGGAGGCTCAACTGTTTGAGTGATCTCTTTTGCTTATGGACAGACTGT
ATTTCTAGGTGGTAGACCTTAATGAATGTAGCTTGTGCTACTTTAGGACCTGTAGGAGCATAGATGAGCTTTGTGATTT
TTGCTTATGTCGGACCAGCTTTGTATAAACATAATTTTTACTCACTGTTGCAAGAAGAACATTAGTTGCTTCTTGCCGT
GAAATTAAAGTACTACTTGTTCATATATATATGTATTCAAAGAAGTTTAACCAAGCAGGAGGGAATGCTCTCGGCGCAC
GTTAACGCAATAAAACAGTAAAAATTGGCGTAAGTTAGCACGAAGCTTTCTCGCTGATA

> SEQ ID NO: 6090 171917 1110457_301789_1b
TTCTTCGTCTTCCTCGTTGCGAATTACAGAGAGAGAGAGAGGAAGAGAGAGAGAGAAGAATTCCGGCAGCTATGGCGGA
GGCCACGAACAACTATGCCGGAGCTCCGAAGGCTGAGGAGGAAAAGAAGCCTCTCGACCAGCACCTCAACCTCAAGGTC
AAGGGTCAGGATGGCAACGAGGTCTTTTTCCGGATTAAGCATTCAACTCAGCTACGGAAGTTGATGCATGCTTATTGTG
AGAGGCAATCTATCGACTTCAATGCAATCGCTTTTCTATTTGATGGCCGCCGCTTGCGAGCAGAGCAGACTCCGGCAGA
GTTGGAAATGGAAGATGGTGATGAAATCGATGCGATGCTTCATCAGACTGGTGGGCCTGCTGATAATAATCTCCACCT

FIG. 2 continued

TGCCAGTGATTCTCTCTTATGTATTTTTAACTCGTATAACTGCTGCTCCTTTTTGAAATCTTAATCAACGTGGTGTACT
TGTACCAAGGATTTCTTTGTTTACTTGGGGGGCACACCAGGTCTGAAGAAAAACACTGCATTTTTCTTCTCTACAGTCA
TGATATATATTTGTGCCCAAGAGTTGAACTAAAGTTAGGAAATCCAAAGATGTACCTATGATTTAACTTGTGCACGTAA
AAGATTC

> SEQ ID NO: 6091 171917 1109264_301530_1b
GAAAGAGAAAGAGAAGAAATCGATGGCAGATGGGACGAACATGACGGGAGTCACCAACGCAGCTGATGACAAGAAGCCC
CTCGACCAGCACCTCAACCTCAAAGTCAAAGGACAGGATGGGAATGAGGTTTTCTTCCGGATCAAACGCAGTACACAGT
TGAAAAAACTTATGAATGCCTATTGTGAAAGGCAGTCGATTGACCTCAACTCGATTGCTTTCCTCTTTGATGGTCGTCG
CTTACGTGGGGAGCAGACTCCTGATGAGCTGGAGATGGAGGATGGTGACGAAATAGATGCTATGCTGCATCAGACAGGT
GGTTGTGTAAGACAACTAAATTACTAAGGTGCTTAAACAGTGACTCGCTCATCCGAATCCTGTTCTAATTGTTTGCGTT
TGACTTTATTGGGTTTCTAAAGAATTGGAAATCCAGGGACTCGACATAGTAGCCGCTAGAACTCTAATCTTATTATGAT
GGAACCAAAATGCTTGTTATCTAAAATTCCTGGTAAGATTGAAGTGAAAAAGGATCTGCCCCCTATGAAATGTTTTGTT
TGCCTATATATTGGATCGTAGGTGCTCCTTTTGTGGATGAAGTTGACATCGTAAATATACACTTTGTACTCGGTTTTAT
GGCAGTTGTTTATG

> SEQ ID NO: 6092 174804 145735_301061_1b
TAACGTTCCAACAACCCAGAACACATCTATGAAACAATTCTCTTTACTGCAATTCCACTAAAATTTTCAGCTCATTCCC
AACACAGCGCTGTAAAAATGGTATCTTCCACCATTCTAATTCAACAACCAACAAGCTTGTTCCACCAGCCAGAGTTTCA
CCATCAGTTATGGAGGCATGGGTGTGCTGCACCATTGCAAAAGCAACCCATTATTGTTTGTGGTAGTAACAAGGGAAGA
AGCAGACCCTTGAGAGTTAGTGCAAGTGCTAATGGTGCTGCAACTTCTTCCACTCTAGAGGGTTATGATTCTTCTCCAT
CTCCTTCTGCATTTCCTCTTTTTACACCCCCTTCTCAATCCCAAGATACTCCCGCTTCTCAGCTGGAACTGGCAGATCC
TGATTTCTATAAAATAGGATATGTTAGAAGTTTTCGAGCCTACGGAATTGAATTCAGGGAGGGACCGGACGGGTATGGA
GTGTTTGCTTCCAAGGACGTGGAGCCTCTCCGTCGAGCTAGGGTAATAATGGAAATTCCTCTAGAACTGATGTTAACCA
TAAGCAAAAAGCTTCCTTGGATGTTTTTTCCAGATATCATACCTGTGGGACATCCAATATTCGACATTATCA

> SEQ ID NO: 6093 174874 156478_301366_1b
AACATTTTATTGATTCTTATCATCCAAACATGGCCTTCTCCTCCTCCACTGCTCAAACAGCTTCACCTCTATCCTCCAA
ACATTGTTCCCGCCTATCTTCCTCCGCCGCCTCCTCCTCCTCTTACTTCCCTAAATTTCAAATACCCTTCAAATTCAAC
GAAATTACATCTTGCCCTTCCTCAATTTCCTGTCCTTACCAAACAGGAATCAATGGCGGCTCGAGAGGCTGCTGAAC
CGGCGGTTCCCCTGCGTCCTGATTCGTTTGGCCGGTTTGGTAAATTTGGCGGGAAATACGTACCTGAAACCCTAATGCA
CGCTCTTGACGAGCTCGAGACCGCCTTCAAATTGCTCGCTACCGATGAAGCTTTTCAGAAAGAGCTAGATGGAATATTG
AGAGATTATGTAGGCAGAGAGAGCCCTCTTTATTTTGCAGAGAGACTTACTGAGCACTACAAACGTCCAGATGGCCAAG
GGCCATTGATCTACCTGAAGAGGGAGGATCTTAACCACACTGGTGCCCACAAAATCAATAATGCGGTTGCCCAAGCTTT
GCTTGCCAAGCGCTTGGGCAAGAAGCGCATCATTGCTGAGACAGGGGCAGGTCAGCATGGTGTTGCTACTGCTACTGTT
TGTGCTCGCTTTGGTTTGGAATGTATTATCTACATGGGTGCTCAAG

> SEQ ID NO: 6094 174874 131150_300511_1b
GAATTCACTTGTAAATGGCTTTCTCATCCTCCACTGTTACTTGCAAAAACCCTAATTCCAATCTCCTTCAAAAACCATA
CTTTTCTTCGTCTTCTTCCTTTAATCCTTTACGAGTTCATTTCCAGAAATTTCCTTTACCTTCTTCTTCTTCCATTAAA
AGTTCTTCAATTTCTTGTGCAGTAACCGAAGAGAAACCCAAAATGTCGACTGTTTCGCAGAGACCTGATTCTTTTGGTA
GGTTTGGGAAATTTGGGGGAAAATATGTTCCTGAAACACTAATGTATGCACTTACGGAGCTTGAATCTGCGTTTCGGTC
ATTGGCGGCAGACCAAGATTTTCAGGAAGAATTGAGTGGAATTTTGAAGGACTATGTTGGTAGGGAGACACCTCTTTAC
TTTGCAGAGAGGTTAACGGAACACTATAAGTCTGCTAATGGTGAAGGACCTCATATATATCTTAAAAGGGAAGATCTTA
ACCACACAGGTGCCCACAAAATCAACAATGCTGTTGCCCAAGCTTTACTTGCGAAGCGATTGGGGAAAAAACGGATTAT
AGCTGAGACTGGAGCT

> SEQ ID NO: 6095 174874 276156_200157_1b
TCCACTGCTCAAACAACTTCACCTCTATCCTCCAAACATTGTTGCCGCCTATCTTCCTCCGCCTCCTCCTCCGCTTCGT
ACTTCCCTAAATTCCAAATACCCTTCAAATTCAACAAAATTACATCTGGCCCTTCCTCTATTTCCTGTGTCCTTACCAA
ACAGAAATCAATGGCAGCTCAAGAGGCTGCTGAACCGGTGGTTCCCCTGCGTCCTGATTCGTTTGGCCGGTTTGGTAAA
TTTGGCGGGAAATACGTACCTGAAACCCTAATGCACGCTCTTGACGAGCTCGAGACCGCCTTCAAATTGCTCGCTACAG
ACGAAGCTTTTCAGAAAGAGTTAGATGGAATACTGAAAGATTATGTAGGCAGAGAGAGCCCTCTTTATTTTGCAGAGCG
CCTTACTGAGCACTACAAACGTCCAGACGGCGAAGGTCCTCTGATCTACCTGAAAAGGGAAGATCTTAATCACACTGGA
GCCCACAAAATCAATAATGCCGTCGCCCAAGCTTTGCTTGCCAAGCGCTTGGGCAAGAAACGCATCATTGCTGAGACAG
GGGCAGGTCAGCATGGTGTTGCTACTGCTACTGTTTGTGCTCGCTTTGGTTTGGAATGTATTATCTACATGGGTGCTCA
AGATATGGAG

FIG. 2 continued

> SEQ ID NO: 6096 174874 245978_301573_1b
GGCACGGCGGCGGCGTCACGGCGATTCATTGCTTCTCCTCCTTCCGATCAGCTCGGCACGGAGGTGGAGTTGCCGGCGA
GGATCAATCTGCCGCGGCGCAGCGTTCGGGCAGCGATCTCGTCCCAGGGCGCCGTGGCGCCGGCGGAGGCGGAGGACGT
GTTGCATGCCGAGTATGGAGGGTTCCAGCGGCCGGATGCGTTTGGAAGGTTTGGGAAATTCGGTGGTAAGTATGTTCCG
GAGACGCTCATGGCGGCGCTGGCGGATCTGGAGGCCGCGTATCGATTGCTTGTTGGCAAGCCCGAATTTCAGCAAGAAT
TGGCTGGTATTCTCAAAGACTACGTTGGACGAGAGTCTCCACTCTACTTTGCCGAGCGCTTGACGCAGTACTACAAGAA
CGCCAATGGCAGTGGACCTGATATATATCTCAAGCGAGAAGATCTAAACCACACCGGTGCTCACAAGATCAACAATGCC
GTCGGCCAAGCCTTGCTCGCCAAGCACATTGGCAAGAAGCGCATCATCGCCGAAACTGGAGCCGGCCAGCACGGAGTTG
CCACGGCCACTGTCTGTGCTCGCTTTGGACTGGAATGCGTCGTTTACATGGGTGCACAAGACATGGAAAGGCAAGCTCT
CAACGTGTATCGTATGCGGCTTCTCG

> SEQ ID NO: 6097 174878 243454_301339_1b
ATCACTATGGCAGGAGGTAGGGTTTCCGGGATTCTCGTCCTTCTCGCGGTATGGGGCTTGATTGCTGTGGCTGCGCCGG
CGATGGCGCGGGTCGCGGTGCCGCTCAAGAAGAAGCCGCTGTCGACAGAGCGCTTGAGGCTTGCGGTGAGAGATATTCC
TCGTAGGGCGCAGGCGCTAGGCTACCCGGATGTCCGGGACGCGAATTCTCGCGCTGGAAATGGCAGCGTTCCGGATTAC
GAGCCCCTCAAGAACTACCTCGACGCGCAGTACTATGGCGAGATTGGGATTGGAACCCCTCCGCAGCTCTTCACGGTCA
TCTTCGATACCGGGAGCTCCAATCTATGGGTTCCCTCGTCACGATGCATTTTCTCGCCTGCTTGCTGGTTCCACCACCG
CTACAAGTCCAAGAGGTCTACCACATACGAGCCGGATGGTACTTCTATCGCTATCAAGTATGGAACAGGCCAGATGGCT
GGATTTTGAGCACCGATTCCGTTACTATTGGCGACATTGTGGTCAAAGATCAGACGTTTGCTGAAGCGACAAGGGAGC
CAGGACTTGTTTTCGTTATTGGCAAGTTTGATGGCATTCTCGGGCTCGGATTCAAGGCCATCTCCCAGGGACAAGTTAC
TCCCGTCTGGTATAATATGTTGTCCCAGAAATTGATATCAGAACCAGTGTTTTCCTTCTGGCTTAACCGAGATGCTTCG
GACGACGAGGATGGTGGTGAAATCGTCTTCGGAGGAGTGAACAAGAAGCGTTTTAAGGGAG

> SEQ ID NO: 6098 174878 271429_200034_1b
GTTTTCTTGCTTCATCAAACTGGTCAATATGGGAGCAAAAGCTTTTCTTGTCACCATTTTACTCTCATCGCTGTTATTT
CCTTTGGCCTTGTCTACATCAAATGATGGCTTGGTTAGAATTGGACTGAAAAAGATAAAATTTGATCAAAACAATCGAC
TTGCTGCGCGAGTCGAGTCCAAGGAGGGGGAGGCTTTGAGGGCCTCCATTAGGACGTATAATAACTTCCGTGGTAATCT
TGGGGCCTCTAAGGATACAGACATTGTAGCACTGAAGAACTATATGGATGCTCAGTACTTTGGGGAGATTGGTATAGGC
ACTCCCCCTCAGAAGTTCACTGTCATCTTTGATACTGGTAGCTCTAATTTGTGGGTGCCTTCATCAAAGTGCTACTTCT
CAGTTCCCTGTTTTTTCCATTCCAAGTATAAGTCGAGCCAATCAAGCACTTATAAGAAAAATGGGAAGTCTGCTGCCAT
ACGTTATGGTACTGGAGCAATATCTGGATTTTTCAGTCAAGATAGCGTTAAAGTTGGTGATCTGGTTGTGAAAAATCAG
GAGTTCATTGAGGCAACCAGAGAACCCAGTGTGACTTTTTTGGTAGCCAAGTTTGATGGTATATTGGGTCTTGGTTTCC
AGGAGATTTCTGTTGGAAATGCTGTTCCAGTATGGTACAACATGGTCAAACAGGGTCTTGTCAAGGAGCCTGTCTTCTC
ATTTTGGCTCAACCGAAATACAGAGGAAGATGAAGGGGGCGAAATTGTGTTTGGTGGGGTTGATCCTAACCACTATAAG
GGAAAGCACACTTTTGTCCCAGTCACACGGAAAGGTTATTGGCAGTTTGACATGGGTGATGTTCTGATTGATGGTCAAG
CTACTGGTTACTGTGACAATGGATGTTCTGCAATAGCGGATTCTGGGACTTCTCTCTTGGCTGGTCCAACGACTGTAAT
CACTATGATTAATCATGCCATTGGTGC

> SEQ ID NO: 6099 174878 2783_300338_1b
CCCACGCGTCCGCCTCTGGGTGCCATCATCAAAATGCTATTTCTCACTTGCATGTCTCTTGCATCCCAAATACAAGTCG
TCTCGTTCAAGCACATATGAGAAGAATGGAAAAGCTGCCGCAATTCATTACGGCACTGGAGCAATTGCTGGTTTTTTTA
GTAATGATGCTGTCACAGTTGGCGATTTAGTTGTCAAGGATCAGGAGTTTATCGAGGCAACCAAGGAGCCTGGTATAAC
ATTTGTTGTAGCTAAATTTGATGGTATCCTTGGTCTTGGATTCCAAGAGATCTCTGTTGGAAAAGCTGCTCCTGTTTGG
TACAACATGCTCAAGCA

> SEQ ID NO: 6100 174878 279457_200062_1b
TTTTTCTCCCGTATCGATCCTCTGTGCTAAGCATGGGTACTACATATGGAACCTGTTTAATTGCATTGTGTTTGTTGCT
TCTTTTATCCCCTATGGCGTTTTCTGTATCAAATGATGGACTGATCAGAGTTGGAATTAAGAAGAGGAAGTTGGATCAG
ATCAGCCAGGCTTTTGGGGTATTGATTCTAATGGACGCAAATTCTGCAAGAACTTATCATCTTGGCGGAAATATAGGAG
ATGCAGATACTGATATTGTTGCACTAAAGAACTACTTGGATGCTCAGTATTTTGGTGAGATTTGCGTTGGATCACCACC
TCAAAAGTTCACTGTGATCTTTGATACCGGAAGTTCTAATCTTTGGGTGCCCTCTGCAAGATGTTATTTTTCACTTGCT
TGTTATTTGCACCCCAAGTACAAGTCAAGTCATTCCAGTACCTACAAAAGGAATGGCACATCTGCTGCAATTCGCTATG
GAACTGGATCTATTTCTGGATACTTTAGCAATGACAATGTGAGAGTTGGTGATCTTATTGTCAAAGATCAGGACTTTAT
TGAGGCAACTCGAGAACCAGGCATCACCTTTTTGGCAGCCAAGTTTGATGGTATTCTTGGTCTTGGATTTCAAGAGATA
TCTGTGGGGAAAGCCGTCCCCGTCTGGTACAATATGGTAAATCAAGGTCTTGTTA

FIG. 2 continued

> SEQ ID NO: 6101 174878 253657_301629_2b
GGTGGTTCTGTGTTCGAATCTGGGTCTCCTGTCCAGCCCTCCCTAGCCCCCCAGAGTGTAGCCATGGCTGCCCAAGCCC
TTTCCCTGTGTGTTGTCGCCCTTCTCCTGCTGGTTTCCTCCGTCTCTTCCTTGCCTTCCCCGCAGCTCCGTCGCGTCGG
CCTCAAGAAGAAGCCTGTCGATGAGGACACCCTCCGTGCCGCCAAGATGCGGCTCCGCTCCAAGTACGCCCACCGAGAC
AGCGCCCTCCTCCGTAGCCCTCTCCTCAAGGAGCAGGATGTCGAGCTCGTCAACTACCTTGACGCCCAGTACTATGGCG
AGATCGGCATTGGAACCCCCCGCAGAACTTCACGGTCATCTTTGACACTGGGAGCTCCCAACCTCTGGGTCCCCTCCG
CCAAGTGCTACTTCTCGCTGTCATGTTATTTCCATCCGAATTCAAGGGGAGCAAGTCAGAGACATACAAAGTGAATGG
ACAAGAATGTGACATTCAATACGGAAGTGGGGCTGTGGCTGGGTTTCTTTCCGAGGATACTGTGAC

> SEQ ID NO: 6102 174878 115362_300013_1b
CGAGCGTGGGGGCAAATAGCAGTATCCATCCATTCTCCTGAGTACTACTCTTCTCCATACCTGTTAATTACTGCTTTCT
ACTCTCTAAAAGTTTCTCCTACATTTCTGGGGTTTCATCATTAAGACACTCCGCGAATATGGAAAGGAAACATCTCTGG
GCTGCTCTCCTTTTATGGACCATTGCGTGCTTTGTACTTCCTGTTTACTCTGATAATTTGCTTAGAGTTGGTTTGAAGA
AGCAACCCCTGGACATTAATAGCATAAATGCTGCAAGAGTAGCCAGACAACAGGACAGATATGGGAAGAATGTGAATGG
AATAGAAAAGAAATTGGGTGACTCAGATTTGGATATAGTCTCCTTAAAGAACTACTTGGATGCCCAATACTATGGAGAG
ATTGGTGTTGGTTCACCTCCTCAGAGATTCAAAGTTATCTTTGATACAGGAAGTTCTAACCTCTGGGTTCCATCATCAA
GATGCTATTTCTCTATTGCATGCTGGATCCACTCCAAGTACAAGGCGGGCAAGTCCAGTACATATACAAGAAATGGGA
ATCTTGTTCAATCCGTTATGGAACTGGATCAATCTCTGGCCATTTCAGTCAAGACAATGTTCAAGTTGGTGATCTCGTA
GTTAAAGATCAGGTGTTTATTGAGGCGACGAGAGAACCAAGTATTACATTTATAATTGCAAAGTTTGATGGTATACTAG
GGCTTGGTTTCCAGGAAATTTCTGTTGGAAATGCTACACCTGTCTGGTACAATATGGTGGGCAAGGTCTTGTGAAAGA
GCCGGTCTTCTCTTTCTGGATTAACCGTGATCAACTGCAAACGAGGGGGGTGAACTTGTTTTTGGTGGAGTTGATTCA
AATCACTTCAAGGGTAATCATACTTTATGTTCCTTTGACTCAGAAGGGCTACTGGCAGTTTAATATGGGAGATTTCCTTA
TCGGGAACGCATCAACAGGTGTTTGTGCAGGTGGTTGTGCTGCTATTGTGGACTCTGGAACATCTCTTCTTGCTGGTCC
AACAACTGTCGTGACTCAAATCAACCATGCCATTGGAGCAGAAGGAGTAGTTAGCATGGAATGTAAAACTATTGTTTCC
CAGTATGGAGAGATGATCTGGAATTTACT

> SEQ ID NO: 6103 174878 137958_300687_1b
GCTGTTGCTGCTGCTGCTCCTCCCGTTTTCCGATCGCAGCCATGGGAACCCGCAGCGTGGCCTTGGTGCTCCTCGCGGC
CGTGCTGCTCCAAGCCCTCCTCCCCGCTTCGGCGGCGGAGGGTTTGGTGCGGATCGCGCTGAAGAAGCGCCCGATCGAC
GAGAACAGCCGCGTCGCCGCGCGACTCTCCGGCGAGGAAGGGGCGCGCCGGCTGGGCCTCCGCGGCGCCAACTCCCTTG
GCGGCGGCGGGGGTGAGGGCGACATCGTGGCGCTGAAGAACTACATGAACGCGCAGTACTTCGGGGAGATTGGCGTCGG
CACTCCGCCGCAGAAATTCACCGTCATCTTCGACACTGGCAGCTCCAACCTCTGGGTGCCGTCGGCCAAGTGCTACTTC
TCGATTGCGTGCTTCCTCCACTCTCGCTACAAGTCCGGACAGTCGAGCACTTATCAGAAGAATGGAAAACCAGCTGCCA
TTCAGTATGGCACTGGTTCAATTGCTGGGTTTTTCAGCGAGGATAGTGTTACAGTAGGTGATCGGTTGTGAAAGATCA
GGAATTCATTGAAGCTACCAAGGAGCCAGGTCTTACTTTCATGGTTGCAAAATTTGATGGCATTCTTGGGCTTGGA

> SEQ ID NO: 6104 174917 116537_300078_1b
CCCACGCGTCCGCCCACGCGTCCGCCCACGCGTCCGCTCCGGCGCGCACTTCAACCCCGCGGTGACGCTGGCGTTCGCG
ACGTGCCGGAGGTTCCCTTGGCGGCAGGTGCCGGCGTACGCGGCGGCGCAGATGCTGGGCGCCACCCTCGCCGCCGGCA
CGCTCCGGCTCATGTTC

> SEQ ID NO: 6105 174917 12754_300251_1b
CCCACGCGTCCGCGCGGAGTTTCTTGGAACCTACTTTTTGGTATTCACCGGTTGTGCATCGGTGGTTGTAAACATGCAA
AACGACAATGTCGTGACTCTTCCAGGGATCGCTATCGTTTGGGGACTCACCATCATGGTCCTCATTTACTCTCTTGGTC
ACATCTCTGGTGCTCATATCAATCCTGCCGTTACCATTGCCTTCGCCTCTTGCGGCCGTTTCCCTCTCAAACAGGTTCC
AGCTTATGTCATATCACAAGTGATCGGATCAACGCTCGCGGCTGCGACATTACGGTTGTTGTTCGGACTTGATCACGAC
GTTTGTAGCGGGAAACATGATGTGTTTATCGGA

> SEQ ID NO: 6106 174917 144464_200135_1b
GTTCATTAATTCTTTGTCCTATAATATTATAGTTTTATCTTAATTTGAGCTATAGGTATGGATCCTGAAGATGGAATAT
CAGCCCCTTCAACACCAGCAACTCCAGGAACTCCTGGTGCTCCTCTTTTTGGTGGTTTCAAACATGAAAGAAACAACAA
TGGCAGAAACTCTCTCCTGAAGAGCTTAAAATGCTTCAGTGTGGAAGCATGGGCTTCAGAAGAAGGAAGCTTGCCGCCT
GTTTCATGCGCGTTACCTCCTCCTCCTGTCTCACTAGCCAGAAAGGTAGGAGCAGAGTTCATAGGTACTATGATACTAA
TTTTTGCAGGGACAGCGACAGCAATTGTGAACCAAAAGACACAGGGATCTGAAACCTTAATTGGATTGGCAGCATCCAG
TGGTCTTGCTGTAATGATTGTGATTCTGTCAACTGGCCACATTTCTGGAGCTCATCTCAACCCAGCTGTGACCATTGCT
TTTGCTGTTCTCAAGCATTTCCCATGGAAAAATGTTCCTGTGTACATTGGAGCACAAATTATAGCATCATTTTGTGCTG
TATTCACACTCAAGGTAGTTTTGCACCCAATAATGGGTGGTGGAGTCACTGTTCCTTCTGGTAGTTACCTTC

FIG. 2 continued

> SEQ ID NO: 6107 174917 120893_300517_1b
CCCACGCGTCCGCGGAGCCAGCCGAGCTAGCCAGCCAGTGTTAGAGCTTGAGCTGCTTGTTCTTCTTCTACCTCCTGCAC
TCGCGTGCTGCACAAGTAGCTCAGCTAGATAGAGCGTCAGAAATGGCCAGCAACAACTCGAGAACAAACTCCAGGGCGA
ACTACTCCAACGAGATCCACGATCTCTCCACGGTGCAGAACGGCACCATGCCTACCATGTACTACGGCGAGAAGGCCAT
CGCCGACTTCTTCCCTCCTCACCTCCTCAAGAAGGTCGTGTCGGAGGTGGTGGCCACGTTCCTGCTGGTGTTCATGACG
TGTGGGCGGCAGGGATCAGCGGCAGCGACCTGTCTCGCATATCGCAGCTGGGACAGTCGATCGCCGGTGGCCTCATCG
TGACGGTGATGATCTACGCCGTCGGCCACATCTCCGGCGCCCACATGAACCCCGCCGTGACGCTCGCGTTCGCCGTGTT
CAGGCATTTCCCCTGGATTCAGGTTCCGTTCTACTGGGCGGCGCAGTTCACCGGAGCGATATGCGCGTCGTTCGTGCTC
AAGGCGGTGATCCACCCGGTGGATGTGATCGGAACCACCACGCCCGTGGGGCCGCACTGGCACTCGCTCGTCGTCGAGG
TCATCGTGACGTTCAACATGATGTTCGTCACGCTCGCCGTCGCCACGGACA

> SEQ ID NO: 6108 174917 198813_300685_1b
GTCGACCACGCGTCCGCCTTCTTCTTCTTCTTTCTCTACTCACCTGGATCTGTAGAGAGAGAGAGAGAGAGAGAGAGAG
AGAGAGATGGCAGGAGGTGACAACAACTCCCAGACCGCAATGGCGGCTCAGGTCACGAGCAGAGAGCCATGGAGGAAGG
CAGGAAGCAGGAGGAGTTCGCCGCCGACGGCCAGGGCTGCGGCCTCGCCTTCTCCGTCCCCTTCATCCAGAAGATCATC
GCGGAGATCTTTGGGACATACTTCTTGATCTTCGCGGGGTGCGGGGCGGTGACNATCAACCAGAGCAAGAACGGGCAGA
TCACGTTCCCGGGGGTGGCGATCGTGTGGGGGCTGGCGGTGATGGTGATGGTGTACGCCGTGGGGCACATCTCCGGCGC
GCACTTCAACCCCGCGGTGACGCTGGCGTTCGCGACGTGCCGGAGGTTCCCTTGGCGGCAGGTGCCGGCGTACGCGGCG
GCGCATATGCTGGGCGCCACCCTCGCCGCCGGCACGCTCCGGGTCATGTTCG

> SEQ ID NO: 6109 174917 201716_300719_1b
GAGCGAGCGAGCTAGCCAGCCAGTGTTAGAACTTGAGCTGCTTGTTCTTCTTCTACCTCCTGCACTCGCGTGCTGCACA
AGTAGCTCAGCTAGATAGAGCGTCAGAAATGGCCAGCAACAACTCGAGAACAAACTCCAGGGCGAACTACTCCAACGAG
ATCCACGATCTCTCCACGGTGCAGAACGGCACCATGCCTACCATGTACTACGGCGAGAAGGCCATCGCCGACTTCTTCC
CTCCTCACCTCCTCAAGAAGGTCGTGTCGGAGGTGGTGGCCACGTTCCTGCTGGTGTTCATGACGTGTGGGCGGCAGG
GATCAGCGGCAGCGACCTGTCTCGCATATCGCAGCTGGGACAGTCGATCGCCGGTGGCCTCATCGTGACGGTGATGATC
TACGCCGTCGGCCACATCTCCGGCGCCCACATGAACCCCGCCGTGACGCTCGCGTTCGCCGTGTTCAGGCATTTCCCCT
GGATTCAGGTTCCGTTCTACTGGGCGGCGCAGTTCACCGGAGCGATATGCGCGTCGTTCGTGCTCAAGGCGGTGATCCA
CCCGGTGGATGTGATCGGAACCACCACGCCCGTGGGG

> SEQ ID NO: 6110 174917 228716_301036_1b
AATCCATGGCAGGAGCAGCAGCAGCAGCAGCAGCAGCAGCAGGAGGATCGGCAGGGATGAATGACTTCCAGCTCAACGA
GATCCGCGTCACCCCTGTTGCTTCTATCGCTCTCCCTTCGAACGGCCAGCTCCACCACCAGAGCGTGAATACAGTCGAC
GACTACTCCGCCGGATGCTTCCCAGCCTCGATTGTTCCCAAATCGACTCTCTTCCAGAAGATTGGTGCCGAGGTGATTA
GTACTTTCATTGTCGTCTTCGCGGGATGTGGCGCGGCTATGGTGGATGCCAAGTACAAGGATTCGGTCACTCATCTCGG
TGTGTCGGCGGCGTTTGGCTTGTTGTGATGATCATGATCTACGCTGTCGGGCATATCTCTGGAGCTCACATGAATCCTG
CCGTCACACTGGCCTTTGCGGCCGTGCGGCATTTCCCGTGGAAGCAAGTCCCTGCCTACATCGGCGCACAGATCACTGC
AGCGATCACTGCGGCATTTGCGCTGCGGCTGATCATCAGCCCCGTGGCCAACATCGGTGCCACCATTCCCGCTGGAAGT
GATCTTCAATCCTTCTTCTTGGAAGTGATCATCACCTACA

> SEQ ID NO: 6111 174917 241287_301346_1b
GGGGTAGAGAGTCATTCACCTGGCTCTCCTTCCTCGCTCAAAAGCCTCTGCCTTCCCCGCACGAGATTTCGCAAGAGGG
CTACCCTGTGCCAGAAGCTTGGTGCAGAAGTCATTGCTACCTTCATCCTGGTATTTGCAGGAGCTGGTGCGGGAATGGT
GAACCAGATCACGCAAGGCTCACTGACGTTTTTCGGCGTGGCCGCGGCAAATGGTCTCGTCGTTATGATGATGATCTAT
GCCACTGGTCACATCTCCGGAGCTCACATGAATCCTGCAGTTACTCTGGCTTTTGCAACTGTTCGACACTTTCCTTGGT
CTCAGGTGCCGCTTTATATAGGCTCCCAGATCACCGCGTCCGTGAGCGCTTGCTTTGTGCTCAGACAGCTCCTCACAGA
AGTGAATAAGATCGGAGCGACAGTCCCTGCTGCCGGAAATGTGGTCCAGGCCCTGGTTCTGGAGATCATCGTCAGCTAC
ATACTCATGTTTGTGGTGGCCGCGGTTTCCACTGACACTCGAGCCGTGGGAGAGCTGGCGGGGCTAGCTGTTGGAGCTA
CAGTCGCGCTCAACAATCTCATTGCGGGGTACTGTTTCTCTTAT

> SEQ ID NO: 6112 175484 108166_300259_1b
CCAAATATTCCTCGGACACGGTCACTTTTTTTCATCTCGGTTTCTTGCTCACTTTTTATTCATCTTAATCTTCAATAT
TAGCTACAATGTATCAAGCAGCAGAGTCATCTTGGGCTGGAAATTACCACAACAACATAACAACAAGGCGTGGATCGTT
ATCGTCGTCAGACCCGTTGGAGAGGGTTGTGAGGCTGGCGTCAGGAAGCGCGGTGGTGATATTCAGCGTGAGCACATGT
TGCATGTGTCATGCAGTGAAAAGGCTGTTTTGTGGAATGGGAGTGCACCCTACGGTGTACGAATTGGACCAAGACCCCA
AAGGCAAAGAAATGGAGAGAGCACTCTCTAGGCTTTTAGGCAATGCTCCTGCTGTCCCTGTTGTCTTCATTGGTGGAAA
ACTAATTGGGGCAATGGATAGAGTTATGGCTTCTCATATTAATGGCACTCTTGTCCCACTTCTCAAGGAAGCCGGCGCT
CTCTGGCTTTGATTTGACCAAAAAAATAGCAGGATAAGGTTGATGGATGGATTATTCCTCCATTTTTTATTTTTGGTTT

FIG. 2 continued

CCTTAATTAATGTGCTTTAAGTTTTGTAGCTAAGTATGTTATAGTTGATATAATGCGTCAATTTAACTAGTAACTGTTT
AATTTCATGGCAACCTTGTAGTTGATGCGCTGATGCATGTATTTGATGATTAACTATCTC

> SEQ ID NO: 6113  175484  49958_300189_1b
ATTGTCCTGAGCCCTCATACCAAAATCTGACCATGGACAAGGTTATGAGAATGTCATCGGAGAAAGGAGTCGTGATCTT
CACCAAAAGTTCATGTTGTCTCTGCTACGCCGTGCAAATCCTTTTCCGTGATCTTAGGGTTCAACCAACAATCCACGAG
ATCGACAACGATCCTGACTGCCGTGAGATCGAGAAGGCCTTAGTTCGTCTTGGCTGCGCCAACGCGGTTCCTGCTGTCT
TTGTAAGTGGCAAGCTCGTGGGTTCGACCAACGATGTCATGTCGCTTCACCTAAGTGGCTCCCTCGTTCCCTTGATCAA
GCCGTATCAGTCATTTCATAACTAGAAAAACAATATCGATGCTTAAGAAAGATAATTAGTATATACTATTAATTG

> SEQ ID NO: 6114  175535  267881_200119_1b
ATGGAAGGTTGGAAGGTCTCTAATTCATAATGCAGTCACCGCAGCTGATGGGACCATTAAGTTGTTAATAAAACTCGAG
GACAACCGATTGGTCGAGACTGTTGGAATTCCAGTTAAAGACAAAGATGGTTCATCTCGCTTGACTTAGGTGNNTTATC
TCAGGTGGGCTGCCCATTACGCTGTTCGTTCTGTGCCACTGGCAAAGGAGGATTCTCAAGGAACCTTAAGAGCCATGAA
ATTGTTGATCAGGTCTTGGCAATAGAAGAGCTATTCAATCAGAGAGTGACAAACGTTGTCTTTATGGGTATGGGGGAGC
CAATGTTGAACATGAAAGAAGTCCTTGAAGCACATCGTTGCCTGAATAAGGATATTTTGATTGGGCAAAGGATGATTAC
GATTTCTACTGTTGGAGTTCCAAACACCATAAAGAAGCTCGCATCTTACAAACTTCAGTCAACATTGGCTCTCAGCTTA
CATGCTCCAAATCAGAATCTTCGGGAAAAGATTGTACCAAGTGCAAAGTCCTACCCTTTGAATGCAATTATGAAGGATT
GCAGGGACTACTTCCTGGAAACTAGAAGACGGGTTTCCTTTGAATATACACTNTTAGCCGGAGTGAATGATTCGGTCGA
GCATGCGATTGAACTGGCAGAATTGCTTCATGAATGGGGTCGTGGTCATCATGTGAACTTAATACCATATAATCCAAT

> SEQ ID NO: 6115  175706  193681_300741_1b
CCCCCCGAACCATCACCTCTTTCACACCATATCCTATAATGGGGAACTCACCGACGCCGACAATGCTGGCGTTCCTGGC
TCTTGGGCTAGCGCTCCTCCTCTCCGGCACCGGCCAGGCGAGCGCGCAGAACTGGGGCTGCCAGTCGAACATGTGCTGG
AGCAAATGGGGGTACTGGGGCACGGGCAAGGGCTACTGGGGAAATGGGTGCCGCTCTGGCCCGGGCTACGGCGGCGGCG
GCGGTGGAGGAGGAGGAGGCGGAGGTGGTGGAGGCGGAAGCGGAGGCAACGGCGTGTCTGGAAAGAGCGTGGTCACCGA
GGCGTTCTTCAATGGGATCAAGAACCAGGCCCCGAACGGTTGCGCCGGCAAGAACTTTTACACACGACAGTCGTTGCTT
AACGCTGCCCACTCCTACTCGGGCTTCGCCAGGGACCGGACCAACGATGACTCCAAGCGTGAGATCGCTGCCTTCTTTG
CCCACGTCACTCATGAGACCGGACATATGTGCTACATCAACGAGATAAACGGG

> SEQ ID NO: 6116  175706  227740_301026_1b
GGCCCGCGAGGGGGTTCTACACCTACGCGTCTTCGTCAGGGCCGCGACGAGGTTCCCCCGGTTCGCCGCCACGGGCTGC
GCCGACGCCCGCAAGCGCGAGGTCGCCGCCTTCCTCGCGCAGATCTCCCACGAGACCACCGGCGGCTGGGCCACCGCGC
CCGACGGCCCCTACGCCTGGGGCCTCTGCTACAAAGAGGAGATCAACCCGCAGAGCAGCTACTGCGACGCCACCGACAA
GCAGTGGCCGTGCTACCCCGGCAAGTCCTACCATGGCCGAGGCCCCATCCAAATCTCATGGAACTTCAACTACGGGCCG
GCGGGCCAGGCCCTGGGCTTCGATGGTCTGCGCAACCCGGAGATCGTGGCCAACTGCTCGGACATAGCGTTCCAGACGG
CGCTGTGGTTCTGGATGACGCCGAGGGACACCAAGCCGTCGTGCCACCAGGTGATGGTCGGGGAGTACCGGCCCGGCCC
GGCCGACGTGGCGGCTAACCGCACGGCGGGCTTCGGGCTGGTCACCAACATCGTCAACGGCGGGCTCGAGTGCAACCGG
GCAGGCGACGCCCGGGTGAACAACCGCATCGGCTTCTACCGGCGCTACTGCCAGGTGCTCGGCGTC

> SEQ ID NO: 6117  175706  242217_301327_1b
ATATTGCAAAGCTCTCAATCCTTTCACTTGTGCTGCTCCCTCTTGTTCTAACTCTGGTCGCAGCAACCCACTGTAACTG
CGGAGAAAGAGGACGACAAGGCGGCCACGACACTACTCTGCCAGCACCGTCTATCAGCGCCAACATTGGAACCATAGTG
ACGAATTCCCTGTTTGATCATTTTGCTCGACAAGACCAAGCTCGGACTCGGCTGTGCCGGTGGATCCTTCTACACTCAC
GATTCCTTCATGGCTGCCGCAAAGGCGTACCCGAAGTATGGCTGCACCGGGTCCGAGGAGCAGCGCAAGACGGAGATCG
CTTCCTTCTTTGCGCAGACGTCTGCGCAGACCGCTGGAGGTGGATTGCAACTCCACTGGATATTGTTTGGTTGAATAAC
CAGAAAGGAACCACTACTGTAAGCCATCAGCTGCTTGGTCTTGTGCCCCAGGAAAGAGCTACCATGGTCGAGGACCTCT
GCAGCTCAAATGGAACTATAACTATGGACCTTGTGGACATGCACTTGGCTTTGATGGCG

> SEQ ID NO: 6118  175706  38484_300202_1b
CCCACGCGTCCGCCATATTCCTCAACAACATCAAAATGTTGACTCCCACCATTTCTAAATCCATCTCTTTAGTAACCAT
TCTATTAGTTCTACAAGCTTTCTCTAACACAACAAAGGCTCAAAATTGCGGTTGTTCGTCAGAGCTATGTTGTAGTCAG
TTTGGCTTTTGCGGTAACACTTCAGACTATTGTGGTGTAGGTTGCCAACAAGGACCTTGTTTTGCTCCTCCCCCTGCAA
ATGGTGTCTCTGTGGCTGAGATTGTAACGCAAGAATTCTTCAATGGAATCATCAGTCAAGCCGCGTCTAGTTGCGCCGG
CAATAGATTTTACAGTCG

FIG. 2 continued

> SEQ ID NO: 6119 175706 246948_301615_1b
ATCTTCAACTCCGAGTTCTCTTCCTCCTGCTCGCGATCTTAGCTGCCGCTGCCGAAGACTGCGGACGACAAGGCGGCGG
AAGAAGTTGTCCGCCTGGAAACTGCTGCAGCAGGTGGGGATGGTGCGGTGACACTCCCGACCACTGCGGCGAAGGCTGC
CAGAGTCAGTGCGGTGGAGTAACACCGCCGCCTGGTGACGGTGTCGGATCTATCATCACGAACTCCATCTTCGAGAGCC
TGCTCAAGCACCGCAGAGACTCGGGATGTGCCGGTGGCTTCTACACGTACAGTGCGTTCCTCACGGCTGCCAGATCTTT
CCCGCGGTTTGGAAACGAAGGCTCGTTGGAGCAGAGGAAGCGAGAGCTCGCTGCCTTCCTGGCACAGACATCCAAGGAG
ACCACAGGTGGATGGCCGACTGCTCCTGACGGGCCTTATCGATGGGGCTATTGCTTCGTTGAGGAACAAAATAAGGACA
TCTACTGCAGCGCTTCGGCGACATGGCCATGTAATGGCAGCAAAAGATACTTTGGTCGTGGTCCCATTCAGCTTACATG
GAACTACAACTATGGCCTGGCAGGATCACAAGTCGGCTTCGACGGCATCAACGATCCGGACATCGTTTCGCGAGACGCG
GTGGTGTCGTTCAAGACAGCGATCTGGTTCTGGATGACGCCACAGAACCCGAAGCCTTCGTGTCACGACGTAATTCTGG
GGAAATGGAGGCCATCCAGTGCCGACTTAGCAGCGGGAAGGACTGCGAGCTAT

> SEQ ID NO: 6120 175706 114442_300008_1b
AAAAAGGTCAAAATGAGACTTTTGGAGTTCACAGCTCTGTCTTCTCTACTAGTCTTGTTTCTGCTCCTGCCTGTCTCGG
CAGAGCAATGCGGTAGACAGGCGGGAGGTGCACGTTGTCCCTCGGGAATGTGCTGCAGCAACTTTGGATGGTGCGGAAA
CACTCAAGACTATTGTGGTCCGGGGAAGTGTCAAAGCCAGTGTCCTTCTGGCCCTGGACCTACCCCAAGACCACCCACC
CCTCCTGGTCCTAGTACTGGGGACATATCCAACATCATCAGCAGTTCCATGTTTAATCAGATGCTCAAGCATCGCAATG
ACAATGCATGCCAAGGGAAGGGCTTTTACACTTACAATGCCTTTATCACTGCAGCAAGATCATTTCGTGGCTTCGGCAC
CACGGGTGACACCACCAGGCGTAAAAGGGAGGTTGCTGCTTTCTTTGCCCAAACCTCTCATGAAACTACTGGAGGATGG
GATACAGCACCGGATGGGAGATACGCATGGGGTTACTGCTACCTTAGGGAACAAGGCAACCCTCCTAGCTACTGTGTTC
AAAGTTCTCAGTGGCCATGTGCTCCTGGCCAAAAATATTACGGAAGAGGCCCCATCCAAATTTCATAC

> SEQ ID NO: 6121 175706 107833_300526_1b
GTTAATATAATCATATATTCTTATTAAAATAAAATCATGCATAGGGGAGTCTTATTCAATTCTCACAACATATATATGT
AAGCTTCCCAACAATGGAGCAATTAATAATTAAAATCTTTGGTTATTCTTCAATTCAACTTCTTTAATTACTTGGGGTC
CTAACAAGGGAGATTATCCCCAGTCTCCACACCTAGTTGTTGACAATACTCAGTATAATACTCAACCCTTCTGGCAACA
GTCTGAGGGTTGCCGTTGTCACATTCAATCCGGCCATTAATGGCTCGAATGGTTGGGCCAAAACCTTGGCCAAAAGTGA
TGAAAGAATGGCAATTGTTCATCCAATACCACAGGGCAGTCTTGAAGGAAATAACTGCATCTTTAGCCACAATGTCCGG
GTCATTTAGGCCATCGAATCCTATGGATTTTCCAGCAGGTCCATAGTTGAAGTTCCATGATAGTTGGATGGGTCCTCGA
CCGTAGTACTTTTTGCCTGAGACACAAGGGTACTCTGGGTTTTCCTCATCACAATAGTCGCCTGAAGGACCATTTATCT
CATTTATGAAGCACATGTGTCCAGTTTCATGGGTGACATGAGCAA

> SEQ ID NO: 6122 175706 12309_300278_1b
CCCACGCGTCCGCAAAACATGGCTTTCACAAAAATCTCCTTAGTCCTTCTTCTCTGCCTCTTAGGTTTCTTTTCTGAAA
CTGTCAAGTCTCAAAACTGCGGTTGCGCTCCAAACCTCTGTTGCAGTCAGTTCGGTTACTGTGGTACCGACGATGCATA
CTGCGGTGTTGGATGCCGATCAGGTCCTTGTAGAGGTAGTGGAACCCCGACCGGAGGGTCGGTCGGTAGCATTGTGACA
CAAGGTTTCTTTAACAATATTATCAACCAAGCTGGTAATGGTTGCGCGGGGAAAAGATTCTACACCCGTGACTCTTTCG
TTAACGCCGCTAATACTTTCCCCAACTTT

> SEQ ID NO: 6123 175736 107582_300379_1b
CTTTTCTTCTTTATTGTATAGATATATACTTTACATACACATATTCTCTCTATTCATAGTCGGTATGGCAGCTAACGGC
GTTAGTTCTGGTTTAATTGTGAGCTTCGGCGAGATGTTGATCGATTTCGTGCCGACGGTCTCCGGCGTTTCCCTTGCCG
AGGCTCCGGGTTTCTTGAAGGCTCCTGGCGGTGCACCGGCAAACGTCGCCATCGCAGTGACTAGGCTCGGGGGAAAGTC
GGCGTTCGTTGGGAAACTCGGCGACGATGAGTTCGGCCACCTGCTCGCCGAGATACTCAAAAAGAACGGCGTTCAAGCC
GACGGGATCAACTTCGACAAGGGAGCGAGAACGGCATTGGCATTCGTGACCCTACGCGCCGACGGAGAGCGTGAGTTCA
TGTTCTACAGGAATCCCAGTGCTGATATGTTGCTCACTCCCGACGAGTTGAATCTTGATGTTATTAGATCTGCTAAGGT
GTTCCACTACGGTTCGATAAGTTTGATAGTGGAGCCATGCAGATCAGCACATTTGAAGGCAATGGAAGTGGCAAAGGAG
GCAGGAGCATTGCTCTCTTATGACCCAAACCTCCGTTTGCCGCTGTGGCCGTCGGCAGAGGAGGCGAGGAAGCAAATCA
AGAGCATCTGGGA

> SEQ ID NO: 6124 175736 257216_301680_1b
GCACCCCGTGCTATAGATCTTACATCGCAGCAGCTGCAACAGTAGGAAAAGAAAAACAATGGCCGCTCAGATCCCGCA
GCTCTCGCTGGGACTACAGCAGCAGCGGCAAAATCTGTTTTTGGGGATAAGCCCCAGTGCTTGAATTTCAAGAGAAAC
AGTAGCTCTGCCTCGAATTGTCTCTCGTCATCAAATCAAGGACATGTGAGCAGTGCGAGAGCGATGGATATGGCGAGGG
ATACGAGCTCCAATCTGGTGGTGTGTTTCGGAGAGATGCTTATAGACTTTGTTCCCACAGTCGGGGGTGTCTCCCTGGC
GGAGGCTCCGGCGTTTAAGAAAGCTCCCGGTGGAGCTCCGGCAAATGTTGCGGTCGGGATCTCTCGCCTTGATGGAAAC
TCCGCATTCATCGGTAAGCTTGGTGAGGATGAATTCGGCTTCATGCTTCTGGACATCCTGAAGGACAACAATGTAGAGA
GCAAAGGCATGCGTTTTGATCCCGGTGCCCGTACTGCTCTCGCGTTTGTGACGCTCCGCAAGGACGGCGAGCGTGAGTT

FIG. 2 continued

```
TATGTTTTACCGCAATCCAAGTGCCGACATGCTGCTAAAGCCGGACGAACTGGACGAAGACCTTATCAAACAGGCCTCC
ATTTCCACTACGGTTCCATCAGCCTCATCGCAGAGCCCTGCAGATCGGCCCACTTGGCCGCGATGAAAATCGCCAGAG
AAGCCGGGGCGATCCTTTCGTATGATCCCAACTTGAGGCTTCCATTGTGGAGCTCGGCAGAGGCAGCCCGGAGCGGCAT
CAAAAGCATCTGGAACGAAGCCGACATCATCAAGATAAGTGAGGAGGAGATCACTTTCCTGACTGAAGGAGGCGATGCA
TACAGCGATG

> SEQ ID NO: 6125 175736 272621_200131_1b
TCCGCTCTACTGGAACAGAACAACTGCTTCAATTCTTCCGAAAATTAGGGTTTATTGTCTACAAATTCCATGTTACCAG
CGATTACTCCAACATTTCACATCGTACTTTCCCTTTTAGTTGCTGAAATCTAACGCCTGATGTAACTGTATTAGGGTCT
CAATTTGAAATTCACTATCTCAACTAGTTTCTCAGATCAAACACTATATCCCTTTCTACCATTCTTTAAAACTTCATAC
AGATATGGCTCTTCTTCATTCTCCTACTTTCTGCTTCAGTGGAGTTTCCACTTCAAGTCAAGCTTCTAGAAGTTTCCCT
GCCCCTAGAAGATGCACTGTGAAACCAGCACCTTTTCTCTCCCAGTCTCTTCCCTTCTTTCCTCGATGCAAACTTCAAG
GAAGAGCATTGCCAAGCGACAATGGGCCATTAGAGAAGGATGAATCTTCCCTTGTTGTATGCTTTGGAGAAATGCTCAT
TGATTTTGTTCCGACCACAAGTGGGCTGTCATTAGCTGAAGCACCTGCATTTAAAAAGGCTCCTGGTGGTGCTCCAGCT
AATGTTGCTGTTGGCATTTCCCGTCTTGGTGGTTCCTCAGCTTTCATTGGGAAGGTTGGTGAAGACGAATTTGGTTACA
TGCTTGCTGATATTTTG

> SEQ ID NO: 6126 175736 187756_300680_1b
TAACTGATTTGAAACAGAGCACACGAAAAGATTTTCTTTTCCTCTGAACAAAGACATGACACAATAAATTTCGCCAAGT
AGCTGCCTCATTACACAAATTCAGACCAAAATATCCACCGCAAATCCAAGAGCTTCTTATTAATAATAATAGTAAAAAT
AAACGCCAAAAGTTCTCACACGGAAGCAACTAACTTAGCACACAAAAGACAGACATGAACACACCCAAGCCCCTCCTCT
TCCTTGTCTAAAACGAAGCAGCAACTAAATTAAATCGACCTAAAATTCCGAGGCCCCCAATGGCGGCGATCGACGACGA
AACCGAGGAGCTCTAGTTGGCTGCCTTGCTGATGAGCTCATGCGCGACGGCGACGGTGGGCAGCGCCGGGATGGCACCC
TTCTTGGTGGTGCAGATGGCTCCGCACGCGTTCGAAAACTTGAGCGCCTCCCTCAGCTTCTCCTCGTT

> SEQ ID NO: 6127 175736 190868_300736_1b
CCCCCCCCGATCGCTTCTCATCGCAAATCGCATCGACTTCGATGCGCTTCGTTTCGTTCTCGCTGTTGATTTGTTCGTG
AGATTTGAATTCTAGCAATGGCTCCTCTCGGTGACGGAGCGGCGGCGGCGGCGGCGGAGCCCAACCTGGTGGTGTC
GTTCGGGGAGATGCTGATCGACTTCGTCCCGACGTCTCCGGCGTCTCGCTGGCCGAGTCCGGCGGCTTCGTCAAGGCT
CCCGGCGGCGCCCCGCCAACGTCGCCTGCGCCATCTCCAAGCTCGGTGGCTCCTCCGCCTTCGTCGGCAAGTTTGGTG
ATGATGAGTTCGGGCACATGCTGGTGGACATCCTGAAGAAGAACGGGGTGAACGCGGAGGGGTGCCTGTTCGACGAGCA
CGCGCGCACGGCGCTGGCGTTCGTGACCTTGAAAAGCAACGGCGAGCGCGAGTTCATGTTCTACCGGAACCCGAGCGCC
GACATGCTCCTGACGGAGGCGGAGCTCAACCTGGACCTTGATCCGGCCGCCAAGATCTTCCACTACGGCTCCATCTCCC
TCATCACCGAGCCGTGCCGCTCCGCCCACGTCGCCGCCATGCGCGCCGCCAAGTCGGCCGGCATCCTCTGCTCCTACGA
CCCCAACGTCCGCCTCCCGCTCTGGCCGTCCGAGGACGCCGCCCGCGCCGGCATCCTCTCCATCTGGAAGGAGGCCGAC
TTCATCAAGGTGAGCGACGACGAGGTCGCCTTCCTCACCCAGGGCGACGCCAACGACGAGAAGAACGTGCTCTCGCTCT
GGTTCGACGGCCTCAAGCTCCTCATCGTCACCGACGGCGAGAAGGGATGCAGGTACTTCACCAAGGACTTCAAGGGCTC
CGTCCCCGGCTTCTCCGTCAACACCGTCGACACCACCCGGCGCCGGCGACGCCTTCGTCGGCTCCCTCCTCGTCAACGT
CGCCAAGGACGACTCCATCTTCCACAACGAGGAGAAGCTGAGGGAGGCGCTCAAGTTCTCGAACGCGTGCGGAGCCATC
TGCACCACCAAGAAGGGTGCCATCCGGCGCTGCCCACCGTCGCCGTCGCGCAGGAGCTCATCAGCAAGGCAGCCAAAT
AGAGCTCCTCGGTTTCGTCGTCGATCGCCGCCATTGGGGGCCTCGGAATTTTAGGTCGATTTAATTTAGTTGCTGCTTC
GTTTTAGACAAGGAAGAGGAGGGGCTTGGGTGTGTTCATGTCTGTCTTTTGTGTGCTAAGTTAGTTGCTTCCGTGTGAG
AACTTTTGGCGTTTATTTTTACTATTATTATTAATAAGAAGCTCTTGGATTTGCGGTGGATATTTTGGTCTGAATTTGT
GTAATGAGGCAGCTACTTGGCGGC

> SEQ ID NO: 6128 175912 176083_300524_1b
CCCCCCCCCGATCCCATTCCAGTGACCAATCCACACTGATCCCAGTAGCTCTCATTGTCCTCACGCTTCGACTCGCTTG
CTAGATCTTTGGGTTCTTGTGTGTTGTGATCGCGCGATGAGGACGGTGGCGCTTGGCATTGTGGCGATGGCCTGCCTGG
TGGCCATTGCGCATGGAGGCAACTTCTTCCAGGACGCGGAGGTGTCGTGGGGGCAGGGCCGCGGCAAGATCGTCGATGG
TGGCCGTGGGCTCGACCTCACGCTTGACAGGAGCTCCGGCTCTGGGTTCCAGTCCAAGAGCGAGTACCTCTTCGGCAAG
ATCGACATGCAGATCAAGCTCGTCCCCGGCAACTCCGCCGGCACCGTCACCACCTTCTACTTGTCGTCGCAGGGTTCGA
CCCACGATGAGATCGACTTCGAGTTCCTGGGGAACGTGACCGGCGAGCCGTACACGCTGCACACCAACGTGTTCACGCA
GGGGCAGGGGCAGCGCGAGCAGCAGTTCCGCCTCTGGTTCGACCCCACCCAGTCCTTCCACACCTACTCCATCATCTGG
AACCCACAGCACGTCATATTCGCGGTGGACGGGACACCGATCAGGGACTTCAAGAACCACGAGGCCCGTGGCGTGGCGT
TCCCC
```

FIG. 2 continued

> SEQ ID NO: 6129 175912 183156_300619_1b
CCCACGCGTCCGGGCAAGGCGACCGCCGACCTGAAGCTCGTGGCGGGGGATTCCGCCGGAGTTGTCACTGCTTTCTATC
TGTCGTCCGGCGGGGACAAGCACAACGAGTTCGACTTCGAGTTCCTGGGCAACGTCACCGGCGAGCCGTACCTGGTTCA
GACCAACCTGTACATCGACGGCGTCGGCAACCGGGAGCAGCGCATCGACCTGTGGTTCGACCCCACCGCCGACTTCCAC
ACCTACGCCGTGCTCTGGAACCCCAGCCAGGTCGTCTTCCTCGTCGACGACACCCCCATCCGCGTCTACGAGAACAAGA
ACGCCACCGCCGTTGTCAAGGGCCACCACCGCCACGCCGCCGCCGCCAATGCCACCAGCAACGCCACGTCGGCGTCCGC
GCCGCCGTTCCCGTCGCCGCAGCCGATGTCGGTCTACAGCTCCATCTGGAACGCGGACGACTGGGCGACGCAGGGCGGG
CGCGTGAAGACGGACTGGTCGCACGCGCCGTTCGTGGCCACGTTCCGCGACGTCCGCGTCGAGGGGTGCGCGTGGGCGG
CGAACGCCACCGACTCGGACGCCGGCGAGGTGGCGCGGTGCACGGGGAGCTCGTGGGGCAAGGAGGGGAGGTACTGGTG
GAAGGAGAAGGACATGGAGGAGCTCACCGTGCACCAGAGCCACCAGCTCGTCTGGGCGCGCGCGCACCACCTCGTCTAC
GACTACTGCGTCGA

> SEQ ID NO: 6130 175912 268421_200120_1b
AATCCCAAACAAACAAAATACACAGATACAAGAGAAACAAATAGTTGTCTCTGATTGGTTAAAGCTTTAGAACTTTCAC
CATGGGTGTAAAAGGACTTTTGTTTAGTATTGTTTTGATTAATTTGTCATTACTAGGACTTTGTGGGTATCCCAGAAAA
CCAGTGGATGTACCCTTTTGGAAAAACTATGAGCCCAGTTGGGCTAGTCACCACATCAAGTACCTCAGTGGTGGTTCCA
CTGTTGATCTTGTTCTTGACAGGTCTTCAGGTGCTGGATTTCAGTCAAAGAAATCATATTTGTTTGGGCACTTTAGCAT
GAAACTGAAGCTTGTTGGTGGAGACTCAGCTGGTGTTGTCACTGCATTTTACCTGTCATCGAATAATGCAGAGCACGAT
GAGATAGATTTTGAATTCTTAGGGAACAGGACTGGGCAACCATACATTTTGCAGACAAATGTGTTCACGGGAGGAAAAG
GAGACAGAGAACAGAGAATCTATCTCTGGTTTGACCCAACCAAGGGTTACCATTCTTATTCTGTTCTTTGGAATACCTT
CCAGATTGTGATCTTTGTGGATGACGTCCCAATTAGAGCATTCAAGAACTCAAA

> SEQ ID NO: 6131 175912 44167_300443_1b
GCCATTACGGCCGGGGACACAAACAAACATCAAACATTCTAATTACTACAAGTAAAATTTTATATAAGCTAAGGGCTAA
AATGGGGTCAAGAATTTTCTTGATTTTAGCACTTGTGTTTAGTTCTTGCATGGTTTGTTTTGGTGGAAATTTTTTTCAA
GAATTTGACTTTACTTGGGGTGGAAATAGGGCTAAGATTTTCAATGGAGGTCAGCTTATGTCTTTGTCTTTGGACAAAG
TTTCTGGTTCTGGTTTTCAATCTAAGAAAGAGTATCTCTTTGGGAGAATTGATATGCAAATCAAACTTGTTACTGGAAA
TTCTGCTGGAACTGTCACTACATACTATTTATCTTCTCAGGGACCCACGCATGATGAAATTGACTTTGAATTCTTGGGA
AATGTTACTGGTGAACCTTATATTCTCCACACAAATATTTATGCTCAAGGCAAAGGAAACAAAGAGCAGCAATTCTATC
TTTGGTTTGATCCTACCAAAAATTTTCACACCTACTCAATTATTTGGAAACCCCAACACATTATTTTCTTGGTCGACAA
CACACCGATAAGAGTTTACAAAAATGCTGAATCAATTGGTGTGCCATTTCCCAAGAATCAGCCCATGAGAATTTACTCT
AGCCTTTGGAATGCTGATGACTGGGCAACAAGAGGAGGCCTAGTGAAAACTGATTGGTCTAAAGCACCATTTACAGCCT
ACTATAGAAATTTCAATTCTCAAACTTTTGGCAGTTCACAGTTTTCAAATGAAAAATGGCAAAATCAAGAACTTGATGC
TAATGGTAGAAGAAGACTCAGATGGGTTCAGAGGAATTTCATGATTTATAATTATTGTACTGATTTTAAAAGATTTCCT
CAGGGTTTTCCTCCAGAATGCAAAAGATTCTGAGTGATATTAGTTTGTTTTTGTGAAATTCTTTTATGTGTTTGTGGTT
TTATTTTGTTAGTTTATAGCGATCAAAATAAATATTGTATTTTTCTCATTTCATTTTATATGTTATTTGAAGCTAGTCG
TTCATCTTGTA

> SEQ ID NO: 6132 175912 255795_301643_1b
ACGCGTCGATCTGCTACTACTACTGTGTACTAGCCCCATAGCTAGAAGTGTGCCGCCACTATGGCTCTCCTCCGTCCTC
TTCCTCTCATAATGATTATAGTAATAATCACAATGGCAGCCCTGCCTTCTCCTATGGTTGCCGTACCGCTACCCCCCA
TAGTAGTTTCACCTCTGATTTCTATGTCACCTGGTCTCCCTCCCAAGTACAGCTCCTTAATGCCGGTCAGGAGCTCCAC
CTTACCCTCGACACTAACTCAGGTTCTGGGTTTGCGTCGAAGAATAGCTATTTGTACGGCAACATTGACATGCAAATCA
AGCTTGTGCCAGGGAATTCAGCCGGCACAGTCACTGCTTACTATCTATCATCAGCGGGGCTAATCACGACGAGCTGGA
CTTCGAGTTTCTGGGGAACACGACGGGGAGCCGTACATAGTGCAGACTAACGTGTTCGCCAACGGAGTGGGGGCAGG
GAGCAGCGTATCTACCTCTGGTTCGACCCCACTGCTGACTTCCACACCTACTCCGTCTCCTGGAACAAACAGCGCATCA
TCTTCCTTGTTGACGGCACACCCATCCGCGTGTATACCAATAACGAAGCATTGGGCGTCCCTTATCCCAACAAGCAACC
C

> SEQ ID NO: 6133 175912 263806_301746_2b
CACGCGTCCGCCCACGCGTCCGGACAAAGCAAGCAAGTACAGTAGCCATGGCGAAGCATCTCGCGCTGTCCGTGGCCGC
CGCGGTGGCCGTGTCGTGGCTGGCGGCGTCGTCGGCGGCGGCGGCGGGGTTCTACGAGAAGTTCGACGTGGTGGGCGCC
GGCGACCACGTGAGGGTGGTGAGCGACGACGGGAAGACGCAGCAGGTGGCGCTGACGCTGGACCGGAGCTCCGGGTCCG
GGTTCACCTCCAAGGACACCTACCTGTTCGGCGAGTTCAGCGTCCAGATGAAGCTCGTCGGCGGCAACTCCGCCGGCAC
CGTCACCTCCTTCTACCTCTCCTCCGGCGAGGGCGACGGCCACGACGAGATCGACATCGAGTTCATGGGCAACCTCAGC
GGCAACCCCTACGTCATGAACACCAACGTCTGGGCTAATGGCGACGGCAAGAAGGAGCACCAGTTCTACCTCTGGTTCG
ACCCCACCGCCGACTTCCACACCTACAAGATCATCTGGAATCCCCAAAACATCATATTCCAGGTGGACGATGTGCCGGT
GAGGACGTTCAAGAAGTACGACGACCTGGCGTACCCGCAGAGCAAGCCGATGAGGCTGCACGCGACGCTGTGGGACGGC

FIG. 2 continued

AGCTACTGGGCGACGAGGCACGGCGACGTCAAGATCGACTGGAGCGGCGCGCCGTTCGTGGTGTCGTACCGCGGGTACA
GCGCCAACGCGTGCGTCAACAACAACCCCGCCGGCGGGTGGTCGTCGTCGTCGTGCCCCGAGGGCACGTCGGCGTGGAT
CCACCGCGAGCTCGACGGCGCCGAGCTCGGCACCGTCGCGTGGGCCGAGCGCAACTACATGTCCTACAACTACTGCGCC
GACGGCTGGCGCTTCCCCCAGGGCTTCCCCGCCGAGTGCTACCGCAAGTGATGATGAACAAATCCTCCATTGATGAGTT
CTTGAATGATTTGTAATTGCTTCTTGTTCTTGTTCGTCTTCGTCTTCGTCTTCTTCTTCTTGATCCATGTACATTT
TGCCATCCATTCGTTCTCCATTCGTTACAGTTACAGAGACAGGTTGATGGT

> SEQ ID NO: 6134 175912 127234_300469_1b
CCCCCCCCCCGAACCCAGTTGGTCCAGTCACCGTATCAATTACCTCAATGGTGGCACCACAGCTGAGCTTCTTCTCGAC
AAATCTTCAGGAGCTGGATTTCAATCAAAGAAATCGTATCTATTTGGGCACTTTAGTATGAAAATGAAGCTTGTTGGAG
GTGATTCTGCTGGTGTTGTCTCTGCATTTTATCTGTCATCAAACAATGCAGAACACGATGAGATAGATTTCGAATTCCT
AGGGAACAGGACAGGCGAGCCGTACATATTACAGACCAATGTGTTTACAGGAGGTAAAGGAGACAGGGAGCAGAGGATC
TATCTCTGGTTTGATCCAACCAACGACTTCCATTCATATTCCGTTCTCTGGAACACCTTTCAAATTGTGATTTTTGTGG
ACGACGTGCCAATAAGAGTATTCAAGAATTCGAAAGACATAGGTGTGGCATTCCCATTCAATCAGCCGATGAAGATCTA
TTCAAGCCTGTGGAGTGCTGACGACTGGGCTACAAGAGGAGGATTAGAGAAAACAGATTGGTCAAAAGCGCCATTCACT
GCTTCCTACACTTCATTCCACATAGATGGCTGTGAGGCATTCACCCCACAAGAAGTGCAAGTTTGTAATACAAATGGCA
TGAAATGGT

> SEQ ID NO: 6135 175912 144392_200134_1b
AATTTACAAAAAACTTTGAAAAATGTCGCCTCGTTTCTCTTTCAAAATGTTAATCCTTCCCATAGTCATGGCAAGTCTA
TGGGCAGCCGCCTCTGCTGGTAATTTTAATAATCTTGCAGAGATCACTTGGGGCGAAGGACGTGGTAAAATAACAGAAG
GAGGCAGAGGCCTCTCTCTGTCCCTTGACAAATTTTCTGGTTCGGGTTTTCAATCCAAGAATGAATATCTCTTTGGAAG
ATTTGACATGCAACTCAAACTTGTCCCTGGAAATTCTGCTGGCACTGTCACCACTTTCTTTTTATCTTCACAAGGAGCT
GGGCATGATGAGATCGATTTCGAGTTCTTAGGAAATGTTTCTGGCCAACCTTATACAGTTCATACCAACGTTTATTCAC
AAGGCAAAGGCAACAAAGAACAACAATTCCATTTGTGGTTCGACCCAACTGCTGCATTTCACACTTACTCCATTATCTG
GAACGCTCAGAAAATTATTTTCTTGGTAGATAATAATCCAATCAGAGTATACAACAACCATGAAACCGCTGGCATTCCA
TTCCCAAAAAGCCAACCAATGAAAGTGTACTGCAGCTTATGGAATGCAGATGATTGGGCTACACAAGGAGGCAGAGTCA
AGACTGATTGGACACATGCTCCTTTCACTGCTTACTACAGAAACTTCAATATTGATGGCTGCG

> SEQ ID NO: 6136 175912 157354_301737_1b
TTATCTAAACCATTCTCATTCTTTACAGTTGTGAAAAATGGTTTCTTTTTCTATGGCGTTTAGTTGTGTTGTCTTTGGT
ATTTCTCTAATGATGATGGGTTTGGTTAGCTCTTCAAGATTTGAGGAGCTGTATCAGCCCAGTTGGCTACGGATCATT
TGACAAATGAAGGAGAAATTCTCAGGATGAAATTGGACAACCTTTCTGGTGCTGGATTTTCATCAAAGAATAAGTATAT
GTTTGGGAAAGTTACTGTTCAGATTAAGCTTGTAGAAGGTGACTCTGCTGGAACTGTCACTGCTTTCTACATGTCATCA
GAGGGACCAACCCATAATGAGTTCGATTTTGAGTTTCTAGGTAACACAACTGGTGAACCATACTCCGTACAGACCAATG
TTTACGTAAATGGTGTGGGTAACAGAGAACAACGACTGAACCTTTGGTTCGACCCATCCAAGGAATTCCATTCCTATTC
CATCTTGTGGAACCAACGCCAAGTTGTATTCTTAGTAGACGACACCCCAGTTCGTGTACACTCAAATTTGGAGCACAAG
GGAATTCCATTTCCAAAGGACCAAGCCATGGGTGTGTACAGTTCAATATGGAATGCAGATGATTGGGCTACACAAGGCG
GAAGGGTCAAGACTGATTGGTCACATGCACCCTTTGTTGCATCCTACAGAGGATTTGAGATTGATGGCTGTGAATGTCC
AGCAACTGTTGCAGCTGCTGAGAATTCTAAGCGGTGCAGCAGCACTGCTGAGAAAAGGTATTGGTGGGACAGCCAACA
ATGTCTGAGCTTAGTCTGCACCAGAGCCATCAGTTGATTTGGGTCAGGGCTAACCATATGGTCTATGATTATTGCACAG
ACACTGC

> SEQ ID NO: 6137 175912 147145_301205_1b
TATAAAAGGACTCCTTACGCAACCTAAAGAATTATATATCATCTACTCATACTCTTATCTTCTCTTCATCATTTCAATG
GCTTCTTATTGCTTCTAATTTCCATTCTAATGGGCAGCCTAGTCGCTGCATCAGCTAATTTTAATAATCTTGCAGAGAT
CACTTGGGGCGAAGGACGTGGTAAAATAACAGAAGGAGGCAAAGGTCTTTCTCTGTCCCTTGACAAACTTTCTGGTTCA
GGTTTTCAATCCAAGAATGAGTATTTATTCGGGAAATTTGACATGCAACTCAAACTTGTACCTGGAAACTCTGCTGGCA
CTGTCACCACCTTCTTTTTATCTTCACAAGGAGAAGGACATGATGAGATCGACTTCGAGTTCTTGGGTAATACGACTGG
CGAGCCCTACACTGTCCACACCAACGTGTATTCTCAAGGAAAGGGAAACAAAGAACAACAATTCCACCTTTGGTTCGAC
CCAACTGCAGCATTTCACACCTACACCATTGTGTGGAACGCTAAACGTATAGTGTTCTTGGTAGATAACATCCCACTTA
GAGTATACAACAACCATGAAAGCAATGGCATTCCATTCCCAAAGAGCCAACCAATGAAAGTGTACTGCAGCTTATGGAA
TGCAGATGATTGGGCTACACAAGGAGGCAGAGTCAAGACTGATTGGACACATGCTCCTTTCACTGCTTACTACAGAAAC
TTCAATATTGATGGCTGCGCAGTTACATCCGGTGCCTCTTCATGTAAGTCCACTGACTCTGCAGGCAATGCTAACGCAT
GGCAAAATCACGAGCTTGACGCTCAGGGCAGGAATAGGGTTCGATGGGTGCAAAGTAGACACATGGTTTACAACTATTG
TGCTGATTCTAAGAGGTTTCCTCAAGGCTATTCTCACGAGTGCAAGAGCTCAAGGTTTTAATTAGGAGATGGCACTTCG
TTATATCAACTCCAAAGGTTTAAAGATTGATGCATAGCCTGGTGGTTTATGGG

FIG. 2 continued

> SEQ ID NO: 6138 175912 134948_300420_1b
CCCACGCGTCCGCCCACGCGTCCGGCCACGCGTCCGGCAAGAAGGAGCACCAGTTCTACCTCTGGTTCGACCCCACCGC
CGACTTCCACACCTACAAGATCATCTGGAATCCCCAAAACATCATATTCCAGGTGGACGACGTGCCGGTGAGGACGTTC
AAGAAGTACGACGACCTGGCGTACCCGCAGAGCAAGCCGATGAGGCTGCACGCGACGCTGTGGGACGGCAGCTACTGGG
CGACGAGGCACGGCGACGTCAAGATCGACTGGAGCGGCGCGCCGTTCGTGGTGTCGTACCGCGGGTACAGCGCCAACGC
GTGCGTCAACAACAATCCCGCCGGCGGGTGGTCGTCGTCGTGGTGCCCCGAGGGCACGTCGGCGTGGATCCACCGCGAG
CTCGACGGCGCCGAGCTCGGCACCGTCGCGTGGGCCGAGCGCAACTACATGTCCTACAACTACTGCGCCGACGGCTGGC
GCTTCCCCCAGGGCTTCCCCGCCGAGTGCTACCGCAAGTGATTTTGAACTCGATCGATTCAAATCCTCCTCCATTGATG
AGTTCTTGGCAATGATTTGTAATTGCTTCTTGTTCTTGTTTTCGTCTTCGTCTTCGTCTTCTTCTTCTTGATCCATGTA
CATTTTGCCATCCATTCGTTCTCCA

> SEQ ID NO: 6139 175912 128386_300475_1b
CCCCCGAAAACACACCATTAATTTCCAGGTTTAATTTGCAGAATTTAGAGAAGCAAGAAATCTATTACAGTTCCATTTT
CAAAATTATGGCCAGCTCTCGACTTATTTCTTTGGCTAATTTGTTCATTTTGGCAATTGCATTTCATTTGGTTTCAGTC
AATGGAATGTTCTCAGATAACATGTATATTAACTGGGGTGCCCATCATTCTTGGATGCAAGGAAATGATCTTCAGCTTG
TCCTTGATCAATCCGCAGGTTCAGGTGTACAATCAAAAGGAGCATTTCTTTTTGGAAGCATAGAAATGCAAATCAAATT
AGTATCTGGAAATTCTGCTGGAACAGTCACAGCATACTATTTGTCATCTACAGGTGACAAGCACGACGAGATCGACTTC
GAGTTTTTAGGAAATGTATCAGGGCACCCATATATTATCCACACAAATATTTTTACTCAAGGTGCAGGAGGCAGGGAAC
AACAATTCTATCCATGGTTTGATCCAACTGCTGATTACCATAACTATACCATTCATTGGAACCCCAGTGCAGTTGTATG
GTACGTTGACGGTATACCAATCAGAGTATTCAAGAACTATCAGAGCCAGGGAATTCTCTATCCAAACGCGCAAGGAATG
AAGGTTTACTCTAGCCTTTGGAACGCCGATAACTGGGCAAC

> SEQ ID NO: 6140 175912 120115_300359_1b
CCCCCCCCGACACCTCCAATTGTACAAGGTCATACAATTAACAGAAAAACAATGGGTAAATTGACTTCCTTAAAATATT
CAGCTGCAATTCTAATATTGCTATATGCCTTGACCTTTTCCTTCTCAGTGAGTGCACGACCCGCCACTTTTTTACAGGA
CTTTAAGGTCTCTTGGGCCGACTCTCACATCAAACAAATCGATGGCGGCAGGGCCATTCAGCTTATTCTCGACCAAAAC
TCAGGATGTGGGTTTGCTTCCAAAAGTAAATACCTCTTTGGACGTGTTAGCATGAAGATCAAGCTCGTGCCTGGTGACT
CTGCTGGAACCGTCACTGCCTTTTACATGAATTCAGACACAGACAACGTAAGGGACGAGCTAGACTTCGAGTTCTTGGG
AAACAGGTCAGGCCAGCCGTACACTGTCCAGACGAATGTTTATGTTCATGGAAAAGGTGACAAGGAACAAAGAGTCAAC
CTTTGGTTCGATCCATCAGCTGATTTTCACACTTATACCATTCTTTGGAATCACCACCACGCCGTATTCTACGTGGACT
CAGTACCTATTAGAGTGTATAAGAACAACGAAGCAAAAGGAATCCCATTCCCCAAATTCCAACCCATGGGAGTGTATTC
AACATTGTGGGAAGCCGATGACTGGGCAACGAGAGGTGGATTAGAGAAAATAAATTGGAGCAAATCCCCATTTTACGCA
TACTACAAGGACTTCGACATAGAGGGATGTGCAATGCCAGGACCAGCGAACTGTGCCTCAAATCCACGCAATTGGTGGG
AAGGAGCTAATTACCAACCAATCAGTGCTGTGGAAGCAAGGCAATAT

> SEQ ID NO: 6141 175912 111990_300050_1b
TTTGTTTTATACAAAAAATGATTTCCTCTTCCTTAAAATATTCAACTGTCATTGTAATATTGCTATATGCCTTGACATT
TTCATTTTCAGTGAGTGCACGACCCGCCACTTTTTACAGGACTTTAAAGTGGCATGGGCTGACTCGCACATCAAGCAA
ATCGATGGCGGCAAGGCTATTCAGCTTATACTCGACCAAAACTCAGGATGTGGGTTTGCTTCCAAAAGTAAATACCTCT
TTGGACGTGTTAGCATGAAGATCAAGCTCGTTCCTGGTGACTCTGCTGGAACTGTCACAGCCTTTTACATGAACTCGGA
CACAGATAATGTAAGGGACGAGCTAGACTTCGAGCTCTTGGGAAACAGGTCGGGTCAGCCGTACACTGTCCAAACGAAT
GTTTATGTTCATGGAAAGGGTGACAAGGAACAAAGGATCAACCTTTGGTTCGATCCATCCGCTGATTTTCATACCTACA
CAATTCTTTGGAACCACCATCACACTGTATTCTACGTGGACCAAGTACCCATTAGAGTGTACAAAAATAACGAAGCAAA
AGGAATCCCATTCCCTAAATTCCAACCCATGGGGGTGTACTCAACATTGTGGGAAGCCGATGACTGGGCAACAAGAGGT
GGATTAGAGAAAATAAATTGGAGCAAATCTCCAT

> SEQ ID NO: 6142 175977 1115046_301806_1b
GCCCTGGAGAAAGGACGGGAAAGGTTGGAGGTGCTGAGCTCTCATCTGGCACTGCCAATGGCACAAGAGGAGGCCGCTG
CCAAGCTTGCTGCCCCTCTTCACTCCCAAGAAGATTCCGAATATACACCTACCATCTTTGACAAGATTCTCAAGAAAGA
AATCCCATCAAATTCAGTCTATGAGGATGAACTAGTATATGCATTCCGAGACATAGCTCCTCAGGCTCCTACCCACATA
GTGATAATTCCCAAGAACAGGGATGGATTGACACAGTTATCAAAGGCTGAAGAGAAGCATAAGGAGATACTCGGACATC
TTCTCTATTCTGCAAAGCTGATCGCTAGTCAAGAGGGGCTCTCAAATGGCTATAGGGTGGTAATAAATGATGGACCAGA
TGGATGTCAATCGGTGTATCATATCCACCTTCATCTCATCGGAGGCAGACGAATGACCTGGCCACCGGGCTAGTGAGAC
TGTGGGGTGTATCGGTTATTGTTTTGATGCTTCCGGACTGGACAATAAAACTAGACTTTAAGCACTTAAATCAAATAT
TAGGATGCTTGAAGTGGCATTTTTGCCCATACTCTGTTGTCTCTTATATTGCTTTTTTTAGAGAGATGCTCTATGTTCT
CTATCCTGGTGTG

> SEQ ID NO: 6143 175977 246921_301615_1b

FIG. 2 continued

GAGCGCGCCAGATTGGGGAAAGAATGGCGGGCGGTGGCGGCGTCGAAGAATCTCGCCCCGGCGAGGAGGTCGCGGCGCA
GGCAGCGTCGATTTTCAAGGATACGGCAGCCCCGACGATATTCGACAAGCTCATATCGAAGGAGATCCCTTCCAAGATC
GTCTACGAGGACGATAAGGTTTTGGCGTTTAGAGACTTAAACCCACAGGCACCGACGCATATCTTGCTCATTCCCAAGC
ACAGGGATGGATTAACGCAGCTTTCCAAGGCTGAAGAGAGACACAAAGCGATTTTGGGTGAACTACTCTATGTTTCGTC
TGTGGTTGCCAAACAAGAGAAATTGGACGATGGCTACAGGATTGTTATAAACGATGGCCCTCAAGGATGCCAATCTGTG
TACCACCTTCATGTCCATCTCGTTGGAGGACGCCAGATGAAATGGCCCCCTGGCTAGACCAGTAAACGTTCAATTTTAC
AAAGAATGCCCAGGAATGGAAAGTTTCTTTTCTCTATGAACTTGGGGCAGTGGAATCCTGTGCTGCGAAATCCGGGTAC
CTTTTCTTCGTCAAGCCGTGAAGCCACCGAGCAAACACTCCCTCACTGGATTCCGTGGAAGCAATGTGGGGGTAGATCA
CCTCGGCCTTGAACTCGGCAATCTCCTTCTCGAACAACTTGAGCGACACCTCGTCGTGACTTTCCGCAAACCTCTGGTT
GTAAGCGGTGTACAAGC

> SEQ ID NO: 6144 175977 280431_200067_1b
TTTACTACTACTCATCAGAAGAAGAAACCTGCTGCCATGGCTTCCGAGAAAGAAGCTGCTCTTCTCGCCGTTCCTTCAG
ATTCACCTACCATATTTGACAAGATCATTAACAAGGAAATCCCAGCAAACATTGTCTACGAGGATGACAAGGTTTTAGC
TTTCAGAGACATAAATCCCCAAGCTCCAGTGCACATTCTGCTTATTCCCAAGGTCAGGGATGGTTTGACGGGACTTTCC
AAGGCTGAAGAAAAGCATTGTGAAATTCTTGGTCAACTTCTTTACACTGCAAAGCTTGTTGCTAAACAGGAAGGTCTGC
TGGAGAATGGGTTCAGACTTGTGATCAATGATGGGCCTAGTGGATGCCAATCTGTTTATCATCTTCACCTTCACCTTCT
TGGGGGACGTCAGATGAACTGGCCACCCGGCTAAAGGAAGCCGAGATGAATTCCTGATCTCATGGAGTATCCAGACTAC
ATGCGATCACATATGTGTAGCACCTTACTGAAAACACTATCATCTATGTGTAGTGTTCGAAGAATCAAGCTCGAAGCTT
ATCCTATGCTCCTATGGAGACACAGGTCTCATTCAGACTATTATGTTGATCATCAATAAGAGAGATCTCCTTAAACTCT
TTC

> SEQ ID NO: 6145 176047 175974_300523_1b
CCCCCCACCCAGCCAGCTCGAGCGAGCGAAGCCAGCAGCAGAAGCAGTAGAGAGAAAGTAGAGAGATGGAGGGGAAGGA
GGAGGATGTCCGGCTGGGAGCCAACAAGTTCTCGGAGAGGCAGCCGATCGGCACGGCGGCGCAGGGCTCCGACGACAAG
GACTACAAGGAGCCGCCGCCGGCGCCGCTGTTCGAGCCAGGGGAGCTCAAGTCGTGGTCCTTCTACCGCGCAGGGATCG
CCGAGTTCATGGCCACCTTCCTCTTCCTTTACATCACCGTCCTCACCGTCATGGGGGTCAACAACTCCACCTCCAAGTG
CGCCACCGTCGGCATCCAGGGCATCGCCTGGTCCTTCGGCGGCATGATCTTCGCCCTCGTCTACTGCACCGCCGGCATC
TCCGGCGGCCACATCAACCCGGCCGTCACCTTCGGCCTCTTCCTCGCCAGGAAGCTGTCCCTCACCAGGGCCCTCTTCT
ACATGGTGATGCAGTGCCTCGGCGCCCATCTGTGGCGCCGGCGTCGTCAAGGGCTTCCAGAAGGGCCTGTACGAGACCAC
CGGCGGCGGCGCCAACGTCGTCGCGCCCGGCTACACCAAGGGCGACGGCCTCGGCGCCGAGATCGTCGGCACCTTCATC
CTCGTCTACACCGTCTTCTCCGCCACCGACGCCAAGAGGAACGCCAGGGACTCCCACGTTCCGATCCTTGCCCCACTGC
CAATCGGGTTTGCGGTGTTCTTGGTTCACCTGGCCACCATCCCCATCACCGGCACCGGCATCAA

> SEQ ID NO: 6146 176047 168234_300554_1b
GAATTCAGTAACTTTCGGGCTATTTTTGGCAAGAAAAGTTTCACTACCAAGAGCAGTCTTGTACATGGTGGCTCAGTGT
TTGGGAGCAATCTGTGGTGTTGGATTAGTCAAGGTTTTCCAATCAGCATACTACGTTAAACATGGTGGTGGTGCCAATA
CACTTTCCGCTGGGTACAGTAAAGGAACCGGTCTAGCAGCTGAAATCATCGGAACTTTCGTTCTTGTGTACACAGTTTT
CTCAGCCAAAGATTATCACGACCCACCACCAACACACCATTCTTGATGCAGATGAGCTTAAGAAATGGTCTTTCTACAGA
GCTATTATTGCTGAATTTGTAGCTACTCTTTTGTTCCTTTACATCACTGTTTTGACTGTTATCGGTTACAAGGCTCAAA
GTGAAACTGATGATTGTGGTGGTGTTGGTATTTTGGGTATCGCTTGGGCTTTTGGTGGTATGATCTTCGTCCTGGTTTA
CTGCACCGCTGGTGTCTCCGGAGGACACATCAACCCAGCAGTAACTTTCGGGCTATTTTTGGCAAGAAAAGTTTCACTA
CCAAGAGCAGTCTTGTACATGGTGGCTCAGTGTTTGGGAGCAATCTGTGGTGTTGGATTAGTCAAAGCTTTCCAATCAG
CTTACTACGTTAAACATGGTGGTGGTGCCAATACACTTTCCGATGGGTACAGTAAAGGAACCGGTCTAGCTGCTGAAAT
CATCGGAACTTTCGTTCTTGTGTACACAGTTTTCTCAGCCACTGACCCAAAGAGAAACGCCAGAGACTCCCATGTTCCC
GTTTTGGCACCACTTCCAATCGGG

> SEQ ID NO: 6147 176047 194033_300743_1b
CACCATCTAGCTCACTCACACAGTCTCCACTCACACGCATTGCAGAGGAGAGGCGACAATGGAGGGGAAGGAGGAGGAC
GTGCGGCTGGGGGCGAACAGGTACTCGGAGAGGCAGCCGATAGGGACGGCGGCGCAGGGCGCCGGGGACGACAAGGACT
ACAAGGAGCCGCCGCCGGCGCCGCTGTTCGAGCCAGGGGAGCTCAAGTCGTGGTCTTTCTACCGGGCCGGGATCGCCGA
GTTCGTCGCCACCTTCCTCTTCCTCTACATCACCATCCTCACCGTCATGGGGGTCTCCAAGTCCTCCTCCAAGTGCGCC
ACCGTCGGCATCCAGGGCATCGCCTGGTCCTTCGGAGGCATGATCTTCGCGCTCGTCTACTGCACCGCCGGCATCTCCG
GAGGACACATCAACCCAGCAGTTACTTTTGGGCTGTTCTTGGCCAGGAAGCTGTCCCTGACCCGGGCCATCTTCTACAT
AGTGATGCAATGCCTAGGGGCCATCTGCGGAGCTGGAGTTGTGAAGGGCTTCCAGCAGGGTCTGTACATGGGCAATGGC
GGTGGTGCCAATGTAGTTGCCAGTGGCTACACCAAGGGTGACGGTCTTGGTGCTGAGATTGTTGGCACCTTCATCCTGG
TCTAC

FIG. 2 continued

> SEQ ID NO: 6148 176047 1956_300335_1b
TCCGTACTAAAGTTCCTGTGGATTGAGAAAACAAAATGGAGAACAAAGAAGAAGATGTAAGATTAGGAGCAAACAAATA
TTCAGAGAGGCAACCGATTGGGACGGCAGCGCAGAGTGACAAGGATTACACAGAGCCACCACCAGCGCCACTGTTTGAG
GCAGGAGAATTGGTGTCTTGGTCATTCTATCGTGCTGGAATTGCTGAGTTCATGGCCACTTTCCTCTTCCTTTACATCA
CTATCTTAACAGTGATGGGTGTTTCAAAGTCTGAATCCAAATGCTCCACTGTTGGTATTCAAGGCATTGCTTGGGCTTT
TGGGGGCATTTCTGGAGGACACATA

> SEQ ID NO: 6149 176047 194787_300766_1b
CCGCTCTCCGCATCCATCAGAGAAGAGAGAGGTAGAGAAGAGAGAGCAGAGCTAAGCTAGCTCAGAGTGAGTAGCGTGT
TGAGCTTGCTGAAGGGAGCGGCAATGTCGAAGGAGGTGAGCGAGGAGCCGGAGCACGTGCGGCCCAAGGACTACACCGA
CCCGCCGCCGGCGCCGCTGTTCGACGTCGGCGAGCTCCGGCTGTGGTCCTTCTACCGGGCGCTCATTGCGGAGTTCATC
GCCACGCTCCTGTTCCTATACATCACCGTCGCCACCGTCATTGGGTACAAGGTGCAGTCGTCCGCCGACCAGTGCGGCG
GCGTCGGCACCCTCGGCATCGCCTGGGCCTTCGGTGGCATGATCTTCATCCTCGTCTACTGCACCGCCGGCATCTCCGG
AGGGCACATTAACCCCGCGGTGACGTTCGGGCTGCTGCTGGCGAGGAAGGTGTCGGTGATTCGCGCGGTGATGTACATC
GTGGCGCAGTGCCTGGGCGGCATCGTGGGCGTGGGCATCGTGAAGGGCATCATGAAGCACCAGTACAACGCCAACGGTG
GGGGCGCCAACATGGTGGCCAGGGGGTACTCCACCGGCACCGCCCTCGGCGCCGAAATCATCGGC

> SEQ ID NO: 6150 176047 244424_301558_1b
AGCAAAGAGGTCCCCCCTCTTCTTCTCTATCGTAGTTTTCCTTTTGGAACTCATCCAATTCACGAGGGAGAGGTAGAAC
TGATCAAGAGAAAGAGATGGCGAAGGATGCAGGAAAAGAGTCCGAAGCCTTCGTCACCGCCAAGGACTACGAAGATCCA
CCGCCGGTGCGGCTCGTAGATCCAAAAGAGTTTGCTTCCTGGTCCTTCTACAGGGCCGGCATTGCCGAGTTCGTCGCCA
CGCTCTTGTTCCTCTACATCACCGTTCAGACGGTCATCGGCCACTCGCGAAACCAGGCAAACTGCGGTGGCGTCGGGTT
GCTAGGAATCGCATGGGCCTTTGGGGGCATGATCTTCGTTCTCGTCTACTGCACCGCCGGAATCTCAGGAGGACATATC
AACCCGGCTGTGACTTTCGGACTCCTCGTGGCTCGCAAGGTCTCGCTGCCTCGCGCGATCTTCTACATGATCGCGCAGT
GCCTGGGAGCGATCGTCGGCTGCGGCCTCGCCAAGGGGTTCCAGAGGAGCTTCTACGTCCAGCAAGGTGGAGGAGCAAA
CTCTGTCGCGAATGGCTACAGCATAGGAACCGGACTTGGAGCTGAGATCATTGGAACTTTCGTGCTCGTCTACACCGTC
TTCTCA

> SEQ ID NO: 6151 176047 233693_301092_1b
AGTGGGGCCAACCTCTACGTTAAAAGATGGAGCTTCTCTTTAACTTTGCTTAGGCAGCTTATCCAGCAGCAGCATCTTC
CTTTTCTCTCTCTCTTTCCCTTCTCTCTCTCATCCCTTTCCAGACACTTCTCGGGGTTTAATCAGGGCACGCGAGAG
ATATCGAGAGGTAGAGAGTTAAGTTCTTCCTGTGTTCCAAAGCTTGGAAGCTAGACTAGATCGATCATCCGATGGAAGG
CAACAGGGAGGATGTTCATGTTGGTGTGGCAAAGTATCACGAGCGAGAGCTGGGAACCGCGGCACAGGCCGAAAAGGAC
TACGTTGAGCCGGCCCCGACCCGGCTGATCGAGCCGTCCGAGTTCTCGTCCTGGTCCTTCTGGCGAGCGGAATAGCGG
AGTTCTTCGCAACCTTCCTCTTCCTCTACATCACCATTCTCACGGTTGTGGGGAACGTTAACCGTACTAGCTGCAACGG
GGTGGGGATCCAAGGCATAGCCTGGGCCTTTGGAGGCATGATCTTTGCTCTCGTCTACTGCACCGCTGGAATCTCTGGT
GGACACATCAATCCTGCGGTGACTTTCGGCCTCTTCTTGGCTCGAAAGGTGTCTCTGCCTCGAACCATTCTCTACATGG
TTGCACAGTGCCTGGGGGCGATTTGCGGTGCCGGCGTCGTCAAAGGCTTCCAGAGGGCGATGTTTAACGCTGCTGGAGG
AGGAGCGAACTTCGTCCAGCATGGTTACACACTTGGAGATGGTCTAGGAGCTGAGATTGTTGGAACTTTTGTTCTCGTC
TACACCGTCTTCTCGGCTACTGATGCTAAGAGAAGTGCCAGAGATTCCCATGTCCCGGTGCTGGCTCCACTTCCCATTG
GCTTTGCAGTGTTTCTAGTCC

> SEQ ID NO: 6152 176047 194294_300745_1b
CCCCCCCGAAGCTCTCCGCTCAGCTAAGCTCTCCACCATTGCTTGCAAAGCTGGTCGTGTCACTCCTCCCGTTAAGCTT
CCCGCGGCGGCGAGAGCAAGCTAAGCTAGGTCGGGCATGGGGAAGGACGAGGTGATGGAGAGCGGCGGCGCCGCCGGCG
AGTTCGCGGCCAAGGACTACACGGACCCGCCGCCGGCGCCGCTGATCGACGCGGCGGAGCTGGGGTCGTGGTCGCTGTA
CCGCGCCGTCATCGCCGAGTTCATCGCCACGCTCGTGTTCCTGTACATCACCGTGGCCACGGTGATCGGGTACAAGCAC
CAGACGGACGCGTCGGCCTCCGGCGCCGACGCGGCGTGCGGCGGCGTGGGCGTGCTCGGCATCGTGGGCGTTCGGCG
GCATGATCTTCATCCTGGTCTACTGCACCGCCGGCATCTCCGGCGGGCACATCAACCCGGCGGTGACGTTCGGGCTCTT
CCTGGCGCGCAAGGTGTCCCTGGTCCGCGCCATCCTCTACATCGTGGCGCAGTGCCTCGGCGCCATCTGCGGCGTCGGC
CTCGTCAAGGCGTTCCAGAGCGCCTACTTCAACAGGTACGGCGGCGGCGCCAACACCCTCGCCGCCGGCTACTCCAAGG
GCACCGGCCTCGCCGCCGAGATCATCGGCACCTTCGTGCTCGTCTACACCGTCTTCTCCG

> SEQ ID NO: 6153 176047 180840_300625_1b
GAATTCGAAACCAAAGAAAATTTTCATTTCTTGACAGAAATGGTGTTGAAATGGAGGGCAAATAAGAGGATGTTAAGTT
GGGAGCAAACAAGTTCTCAGAGAGACAACCAATAGGAACTTCAGCACAGAACACAGATAAAGATTACAAGGAACCACCA
CCAGCTCCATTTTTTGAGCCTGGTGAACTAAAATCATGGTCATTCTGGAGAGCAGGAATTGCAGAGTTCATGGCTACTT
TCTTGTTTCTTTACATCACTGTTTTGACTGTCATGGGTGTTGCTGGTAACAAGAATAAGTGTGCAACTGTTGGTATCCA

FIG. 2 continued

AGGTATTGCTTGGGCTTTTGGTGGTATGATCTTTGCTCTTGTCTACTGTACTGCTGGTATCTCTGGTGGTCACATCAAC
CCTGCTGTTACCTTTGGACTTCTATTGGCAAGGAAATTGTCTCTAACAAGAGCTGTTTTCTACATGATAATGCAATGTC
TTGGAGCAATCT

> SEQ ID NO: 6154 176047 271337_200033_1b
CCCACGCGTCCGAGCACACACAAAAAAAAAAAAACAGCAAACCAAAAACTCAAAACTCTTCTCCTTCACTGCCAACTTCT
AAACAGAAGTACTTTTACTTTCATCAAAAAAAACATGTCAAAGGACGTAATTGAAGAAGGACAAACTCATCAACATGGA
AAAGACTATGTTGACCCTCCACCAGCTCCTCTTCTTGACATGGCTGAACTTACTAAATGGTCCTTTTACAGAGCTGTTA
TTGCTGAGTTTATTGCTACTCTTCTCTTCCTTTACGTCACCGTCGCCACTGTCATTGGCCACAAGAAGTTGAACGCTGC
TGACCATTGTGATGGTGTTGGCATTCTTGGTATTGCATGGGCTTTTGGTGGCATGATTTTCGTTCTTGTTTACTGCACT
GCTGGTATTTCTGGTGGTCATATAAACCCAGCGGTGACATTTGGGTTATTCTTGGCAAGGAAAGTGTCATTAATAAGAG
CTGTTGCATACATAATAGCACAGTCACTTGGTGCTATTTGTGGTGTTGGTTTTGTTAAAGCTTTTATGAAACATTACTA
CAACTTAGAAGGTGGAGGTGCTAACTTTGTACAACCTGGTTACAACAAGGGTACAGCTTTAGGTGCTGAGATTATTGGA
ACCTTTGTTCTTGTTTACACTGTTTTCTCTGCTACTGACCCTAAGAGAAGCGCGCGTGACTCTCACGTCCCTGTTTTGG
CTCCTC

> SEQ ID NO: 6155 176047 8034_300286_1b
AAAAAAGCTATTGTTTGAAAGAAGAAGAAGTTAACTATGGCAAAGGATGTGGAAGCCGTTCCCGGAGAAGGATTTCAG
ACAAGAGACTATCAAGATCCGCCACCAGCTCCGTTTATTGATGGAGCGGAGCTAAAGAAGTGGTCTTTCTACAGAGCAG
TTATCGCAGAGTTCGTAGCCACTCTCCTCTTCTTATACATCACCGTTTTGACAGTCATCGGTTACAAGATTCAATCCGA
TACTGATGCCGGTGGCGTAAATTGCGGCGGAGTTGGAATCCTCGGTATCGCTTGGGCCTTTGGTGGTATGATCTTCATC
CTCGTATACTGCACCGCCGGTATCTCTGGTGGTCACATTAACCCAGCGGGGACATTTGGGCTATTCTTGGCACGTAAAG
T

> SEQ ID NO: 6156 176047 46981_300175_1b
AAAAAGCTCACAACTTTAACCTTTCTGGAGAGAGAAGAACAAAAGAGGGAGAGGGAGAGAAATGGAAGGCAAAGAAGAA
GATGTACGAGTGGGAGCTAACAAGTTCCCGGAGAGGCAACCCATCGGTACATCGGCTCAGTCCACCGACAAGGACTACA
AAGAGCCACCTCCTGCGCCACTGTTCGAGCCCGGCGAGCTCAGCTCATGGTCTTTCTACAGAGCCGGAATAGCTGAGTT
TATCGCTACTTTCTTGTTTCTCTACATCACTGTTTTGACTGTAATGGGAGTTAAGAGAGCACCAAACATGTGTGCTTCT
GTTGGAATCCAAGGTATCGCTTGGGCTTT

> SEQ ID NO: 6157 176047 35681_300077_1b
CCCACGCGTCCGGAGAAGCAAAAGAAAAAAAAGCTATTGTTTGAAAGAAGAAGAAGTTAACTATGGCAAAGGATGTGGA
AGCCGTTCCCGGAGAAGGATTTCAGACAAGAGACTATCAAGATCCGCCACCAGCTCCGTTTATTGATGGAGCGGAGCTA
AAGAAGTGGTCTTTCTACAGAGCAGTTATCGCAGAGTTCGTAGCCACTCTCCTCTTCTTATACATCACCGTTTTGACAG
TCATCGGTTACAAGATTCAGTCCGATACTGATGCCGGTGGCGTAGATTGCGGCGGAGTTGGAATCCTCGGTATCGCTTG
GGCCTTTGGTGGTATGATCTTCATCCTCGTCTACTGCACCGCCGGTATCTCTGGTGGTCACATTAACCCAGCGGTGACA
TTTGGGCTATTCTTGGCACGTAAAGTGTCGTTACCTAGGGCCCTATTGTACATAATCGCTCAGTGTTTGGGTGCGATTT
GTGGAGTTGGTTTTGTCAAAGCCTTCCAAAGCTCTTACTACACCCGTTACGGAGGTGGAGCCAACTCTCTAGCCGATGG
CTACAGCACAGGGACCGGTCTAGCCGCAGAGATCATTGGTACTTTCGTTCTTGTCTACACCGTCTTCTCTGCCACTGAC
CCCAAACGTAGTGCCAGAGACTCCCACGTTCCGGTGTTGGCGCCACTTCCAATCGGATTTGCCGTGTTCATGGTACATT
TGGCTACCATTCCCATTACCGGAACCGGAATTAACCCGGCAAGGAGTTTCGGAGCTGCCGTAATCTACAACAAGAGCA

> SEQ ID NO: 6158 176047 46176_300176_1b
CACAGAAAAACCTAGAAAGCTCTAGAGAGAAAGAGAGAGAGATGGAAGGTAAAGAAGAAGATGTTAGAGTCGGAGCT
AACAAGTTTCCGGAGAGGCAACCGATCGGAACTTCGGCTCAGAGTGACAAGGACTACAAAGAGCCACCACCTGCGCCGT
TGTTCGAGCCCGGCGAGCTAGCTTCATGGTCCTTCTGGAGAGCTGGGATTGCTGAGTTTATAGCTACGTTTTGTTCCT
GTACATCACTGTTTTGACTGTTATGGGTGTGAAGAGGTCACCGAACATGTGTGCTTCCGTCGGAATCCAAGGTATCGCT
TGGGCTTTCGGTGGTATGATCTTCGCTCTCGTCTACTCACCGCTGGTATCTCCGGTGGACACATCAACCCAGCG

> SEQ ID NO: 6159 176047 1008530_301416_1b
ATTGGAGTTGTTGTTGTAATGGGTATTACGGCAAGCAAAGACGTGGAACTAGATCCGACTGCAATCCCTCCTCCAGACG
GCAACGAGGAGTACTCAGATCCACCACCAGTTCCTCTCTTTGAAAGCCATGAATTCGTCCTCTGGTCTTTCTACCGTGC
TTGCATCGCCGAATTTATGGCCACTTTTCTCTTTCTCTACGTTGCCCTTGCTACTGTCATTACCGATCACCATAACAAA
GCTAATTGCGGCAGTGTCGGTGTGCTTGGCATCGCCTGGGCTTTCGGAGGAACGATCTTCATCCTCGTCTACTGCACTG
CCGGAATCTCAGGAGGGCACATTAACCC

FIG. 2 continued

> SEQ ID NO: 6160 176047 14419_300267_1b
CGACCCACGCGTCCGAAAGAACAAAGATGTCGAAAGAAGTGAGCGAAGAAGGCAAAACCCACCATGGAAAAGACTACGT
GGATCCTCCACCAGCTCCTCTTCTCGACATGGGTGAGCTCAAATCCTGGTCTTTCTACAGAGCTCTCATCGCTGAGTTC
ATCGCTACACTCCTCTTCCTCTACGTCACCGTCGCTACTGTCATCGGCCACAAGAAGCAAACCGGTCCTTGTGACGGCG
TTGGTTTACTTGGTATCGCTTGGGCTTTCGGTGGTATGATCTTCGTCCTCGTCTACT

> SEQ ID NO: 6161 176047 128856_300478_1b
AAAAAAAACAGAGCATCCTCTGTTTCTTTCTACAGAGTATTTTACTTTTTTCTTTTCTAAGTTATGACTAAAGAAGTAG
AGGCAGTATCTGAGCAGCCTGCGGAGTATTCCGCTAAGGATTACACTGATCCGCCACCAACTCCTCTTGTTGATTTTGA
GGAGTTAACTAAATGGTCACTTTACAGAGCTTGTATTGCTGAGTTTATTGCTACTTTGTTGTTTCTTTATGTAACTGTT
TTGACTGTGATTGGGTACAAGCATCAGTCGGATACTAAAGATGGAGGCGATATATGTGGCGGCGTTGGTATTCTTGGTA
TTGCTTGGGCTTTTGGTGGCATGATCTTTGTTCTTGTTTACTGCACTGCCGGTATCTCTGGTGGACACATCAACCCTGC
TGTGACATTTGGGCTATTTTTGGCAAGGAAAGTATCATTGATGAGGGCAGTATTGTACATGGTATCACAGTGCTTGGGT
GCAATATGTGGTGTGGGTTTTGTGAAGGCTTTCCAGAAAGCTTACTACCATAGATATGGTGGTGGTGTTAATGTTATGG
CAGGAGGCCACAACAAAGGTGTTGGTTTGGGTGCTGAGATTATTGGTACCTTTGTTTTGGTCTACACTGTCTTCTCTGC
TACTGACCCTAAGAGGAGTGCTAGAGACTCCCATGTCCCTGTATTGGACCACTTCCAATCGGATTCGCTGTCTTCATGG
T

> SEQ ID NO: 6162 176047 128784_300477_1b
CACTACATTCTCCTCTCTTAAAATTAGCAGGGCTCAAATTTAATTTCTTATGAGTATATTTTTGGTGAACAAATGGCT
AAAGACACTGAAGTTGGCACAGAATACGCCCCAAAGGACTACCAAGACCCACCCCCTGCACCCTTAATTGACCCTGAGG
AGCTAGGAAAATGGTCATTTTACAGAGCCATAATAGCTGAATTCATAGCCACTTTATTATTTCTCTACATTACTGTCCT
CACTGTGATTGGATACAAGAGCCAAATTGACCCTGACCATAAGGGTGAAGAATGTGGTGGTGTTGGAATTCTTGGAATT
GCATGGGCATTTGGGGGCATGATTTTTGTCCTTGTTTATTGTACTGCTGGTATTTCTGGTGGACATATTAACCCTGCTG
TTACATTTGGACTATTCTTGGCTAGGAAATTTTCATTGGTTCGTGCCATTATGTATATGTTGGCTCAGTGTTTAGGAGC
CATTTGTGGTTGTGGGTTGGTTAAGGCATTTCAGAAGGCGTACTATGTTAAGTATGGTGGTGGTGCTAATACGTTGAAT
GATGGTTATACTACAGGTACAGGTTTTGGGTGCTGAAATTATTGGAACTTTTGTTCTTGTTTACACTGTTTTTGCTGCTA
CTGATCCTAAGAGAAATGCTAGAGATTCTCATGTTCCTGTGTTGGCACCACTTCCAATTGGATTTGCTGTGTTCATGGT
TCATCTGGCTACAATTCCTGTAACTGGAACTGGTATTAAC

> SEQ ID NO: 6163 176047 12333_300278_1b
CCCACGCGTCCGAAGAAGAAGAAGAAAAAAAACAGAGCTTTACAATTTCTCTCTACAGAGATCGAAGATATGGAAGGCA
AGGAAGAAGACGTTAGAGTTGGAGCTAACAAGTTCCCGGAGAGACAACCAATCGGAACATCAGCTCAGAGTGACAAGGA
CTACAAGGAACCACCACCAGCTCCGTTTTTCGAACCTGGTGAGCTTTCTTCATGGTCTTTTTGGAGAGCTGGGATCGCT
GAGTTCATCGCTACTTTTCTCTTTCTCTACATCACTGTCTTGACTGTTATGGGAGTGAAAAGGTCACCGAACATGTGTG
CT

> SEQ ID NO: 6164 176047 120156_300359_1b
CCCATACCCAACTTCCTTTTTTGGATTCCATTTACAGAGAGAGGGAAAGCTTAGTTGAGTGACTGAAGAAAAAAATG
GCAGAGAACAAGGAAGAAGATGTCAAGCTAGGAGCAAACAAGTACAGAGAAACTCAACCCTTGGGCACAGCAGCTCAAA
CAGACAAGGATTATAAGGAGCCACCACCAGCTCCTTTGTTTGAGCCAGGAGAGTTGTCATCATGGTCTTTTTACAGAGC
TGGAATTGCAGAATTCATGGCTACTTTCTTGTTTTTGTACATCACTATCTTGACTGTTATGGGTCTCAAAAGGTCAGAT
AGTTTGTGTTCTTCTGTTGGTATTCAAGGAGTTGCTTGGGCTTTTGGTGGTATGATCTTTGCTCTTGTCTACTGCACTG
CTGGTATCTCAGGAGGACACATTAACCCAGCAGTAACATTTGGTCTGTTCTTGGCAAGAAAGTTGTCTTTAACAAGGGC
TCTGTTTTACATGGTGATGCAGTGCCTTGGTGCAATCTGTGGTGCTGGTGTTGTTAAAGGTTTTATGGTGGGTCCATAT
CAGAGACTTGGTGGTGGGGCCAACGTGGTTCAACCTGGCTACACCAAAGGTGATGGACTTGGTGCTGAGATTATTGGCA
CCTTTGTCCTTGTCTACACTGTTTTCTCTGCCACTGATGCCAAGAGAAATGCTAGAGATTCTCATGTTCCTATTTTGGC
ACCTCTTCCTATTGGATTCGCGGTGTTCTTGGTTCATTTGGCCACCATCCCAATCACTGGAACCGGCATCAACCCCGCC
CGGAGCCTTGGAGCTGCTATCATCTTCAACCACGACCAGGCATGGGATGATC

> SEQ ID NO: 6165 176047 120083_300083_1b
CCCACGCGTCCGAAACAAGAAAAATCCTTCTAGTGTGTGTCTGTGTGTGAAAAAAATGGCAGAAAACAAAGAAGAAG
ATGTGAATCTTGGAGCAAACAAATACAGAGAAACACAACCCTTAGGAACAGCAGCACAAACAGAAATAAAGATTATGT
TGAACCACCACCAGCACCATTATTTGAAGCTGGTGAATTATCATCTTGGTCATTTTACAGAGCTGGAATTGCTGAATTT
ATGGCCACTTTCTTGTTTTTGTATATTACAATCTTGACTGTAATGGGACTTAAGAGATCAGATAGTTTGTGTTCTTCTG
TTGGTATTCAAGGTGTTGCTTGGGCTTTTGGTGGTATGATCTTTGCTCTTGTTACTGCACTGCTGGTATCTCAGGAGG
CCACATTAATCCAGCTGTGACATTTGGTCTGTTCTTAGCAAGGAAACTTTCCTTAACCAGAGCAGTTTTCTACATGGTA

FIG. 2 continued

ATGCAATGCCTTGGTGCTATATGTGGTGCTGGTGTTGTTAAAGGTTTTATGAAAGGTCCATACCAAAGACTTGGTGGTG
GTGCTAATGTGGTTAACCCTGGCTATACTAAAGGTGATGGACTTGGTGCTGAAATTATTGGTACTTTTGTTCTTGTTTA
CACTGTTTTCTCTGCTACTGATGCCAAGAGAAATGCCAGAGATTCACATGTTCCTATTTTGGCACCTCTTCCTATTGGA
TTTGCTGTGTTCTTGGTTCATTTGGCCACAATCCCAATTACCGGAACTGGCATCAACCCTGCCAGGAGTCTTGGAGCTG
CTATTATCTTCAACAAAAAACAGGCATGGGATGACCATTGGATCTTTTGGGTTGGACCATTCATTGGAGCTGCTCTTGC
TGCAGTTTATCACCAAATTATTATCAGAGCCATTCCATTCAAG

> SEQ ID NO: 6166  176047  1170842_302040_1b
GTCAATCTCTCTCTCCCCTTATACAATACAAGTAGAAGGCCATGGAGTCGAAGGAGGAGGATGTGAGACTAGGTGCGAA
CAAGTACCCAGAGAGGCAGCCACTGGGCACGGCAGCGCAGACGCGGAACTACAGTGAGCCCAGCCCGGCCCCCCTCATC
GAGCCCTCGGAGTTCTCCTCCTGGTCCTTCTGGAGAGCCGGCATCGCCGAGTTCATCGCCACCCTCCTCTTCCTCTACA
TCTCCATCCAGACCGTTATGGGATGGAAGCGCTCAGTCGAGGCCGAGACCGCCAAATTCCCCAATGACCAGAACATCTG
TCCTCAGGGTGTCGGCGTCCAGGGCATTGCCTGGGCCTTTGGCGGCATGATCTTTGCCCTCGTCTACTGCACCGCCGGC
ATTTCAGGTGGGCACATAAACCCGGCAGTGACGTTTGGACTATTCCTGGCTCGGAAGCTGTCTCTACCGCGGGCGTTGC
TATACATAATAGCACAGTGCCTGGGAGCCATCTGCGGGGCGGGCATCGTGAAGGGGTTCCAGGAGGCAGACTACCAGCG
CTTTGGAGGTGGTGCTAACTCAGTGGCCCATGGCTACACCAAAGGGGATGGCTTGGGGGCTGAGATCATTGGCACTTTT
GTCCTCGTCTACACCGTCTTCTCTG

> SEQ ID NO: 6167  176047  1044914_301919_1b
GAGACTTGAGTATCGAGTGAAGAAGAAGATGGCGAGCAAAGACGTGGAATTGGTGAGTCATGGGAGTGGGAAGGATTAC
ACAGATCCTCCTCCGGCTCCGCTTTTCGACACCAGTGAATTCGCCAAGTGGTCGTTTTACAGAGCTTGCATAGCGGAAT
TCGTAGCTACTCTGCTCTTTCTCTACATCACAGTAGCTACTGTCATAGGGGATCAAAACAATGTAGCGAATTGCGGGAA
CGTAGGGGTTCTCGGCATAGCCTGGGCTTTCGGTGGAATGATCTTCATTCTCGTTTACTGCACTGCCGGAATCTCAGGT
GGGCATATCAACCCTGCTGTCACTTTTGGGTTGTTCCTCGCACGCAAGGTTTCGCTCCTTCGTGCCGTCGCCTACATCG
TGGCGCAGTGCCTTGGTGCCATTTGTGGCGCTGGTCTCGTTAAGGGGTTCCAGCAGGGTTACTATGTCCGATATGGTGG
CGGTGCTAACTCTGTGGCTGAAGGTTACAGCAAAGGTGTTGGCCTTGCTGCTGAAATTATTGGAACTTTTGTCCTTGTT
TACACCGTCTTCTCTGCCCACTGACCCCAAACGAAGTGCCCGTGACTCACATGTGCCGATATTGGCCC

> SEQ ID NO: 6168  176047  159061_200139_1b
CGACCAAACTTGGTTTTTGCACTATCCACTTAGCACAAAAAAAAGAGAAAAACAAGCTAAGTTTAGTGAGTGTTCAAAT
GGCAGAAAACAAAGAAGAAGATGTTAAGCTTGGAGCTAACAAATTCAGAGAAACACAGCCATTAGGAACAGCTGCTCAA
ACAGACAAAGATTACAAAGAACCACCACCAGCTCCATTGTTTGAACCAGGGGAGTTATCATCATGGTCTTTTTACAGAG
CTGGAATTGCAGAATTCGTGGCTACTTTCTTGTTTTTGTACATCACTATCTTGACTGTTATGGGTCTTAAGAGATCTGA
TAGTCTGTGTAGTTCAGTTGGTATTCAAGGTGTTGCTTGGGCTTTTGGTGGTATGATCTTTGCTTTGGTTTACTGCACT
GCTGGTATCTCAGGAGGACACATCAACCCAGCTGTGACCTTTGGATTGTTCTTGGCAAGGAAACTGTCCTTAACCAGAG
CTATTTTCTACATAGTGATGCAATGCCTTGGTGCAATTTGTGGTGCTGGTGTTGTGAAGGGATTCATGGTTG

> SEQ ID NO: 6169  176047  142613_300500_1b
AAACAGAGCAGCAACAGAGTGTTGAACAGTTAGTGATGGGAAAAGACGTAGAAGCAGCAACAGAGTTTTCAGCAAAGGA
CTACACAGACCCGCCACCAGCACCGTTGATTGATTTTGAGGAGCTGAAACAATGGTCCTTTTACAGAGCTGCTATTGCT
GAGTTTATTGCCACTTTGTTATTTCTGTATGTAACTGTACTGACTGTCATTGGATACAAGCACCAATCGGACGTTGATG
CTAATGGCGATGTCTGTGGCGGCGTTGGCATCCTTGGTATTGCCTGGGCATTTGGTGGCATGATCTTTGTTCTTGTTTA
CTGCACGGCCGGTATCTCTGGAGGACACATTAACCCGGCAGTGACATTTGGGTTGTTCTTGGCAAGGAAAGTGTCACTT
ATCAGGGCCTTGGTGTATATGGTAGCACAGTGCTTGGGTGCAATATGTGGTGTGGGTTTTGTGAAGGCTTTTCAGAGCG
CTTACTATGACAGATATGGTGGAGGTGCTAATCAGATGGCTCCTGGCCATACAAAGGGTGTTGGTCTTGCTGCTGAGAT
CATTGGTACCTTTGTTTTGGTCTACGTTGTCTTCTCTGCCACTGACCCCAAAGAAGCGCCCGAGACTCCCATGTTCCC
GTATTGGCTCCAC

> SEQ ID NO: 6170  176047  137136_300502_1b
CCCCCCGAAGCTCTCCGCTCAGCTAAGCTCTGCACCATTGCTTGCAAAGCTGGTCGTGTCACTCCTCCCGTTAAGCTTC
CCGCGGCGGCGAGAGCAAGCTAAGCTAGGTCGGGCATGGGGAAGGACGAGGTGATGGAGAGCGGCGGCGCCGCCGGCGA
GTTCGCGGCCAAGGACTACACGGACCCGCCGCCGGCGCCGCTGATCGACGCGGCGGAGCTGGGGTCGTGGTCGCTGTAC
CGCGCCGTCATCGCCGAGTTCATCGCCACGCTGCTGTTCCTGTACATCACCGTGGCCACGGTGATCGGGTACAAGCACC
AGACGGACGCGTCGGCCTCCGGCGCCGACGCGGCGTGCGGCGGCGTGGGCGTGCTCGGCATCGCGTGGGCGTTCGGCGG
CATGATCTTCATCCTGGTCTACTGCACCGCCGGCATCTCCGGCGGGCACATCAACCCCGGCGGTGACGTTCGGGCTCTTC
CTGGCGCGCAAGGTGTCCCTGGTCCGCGCCCATCCTCTACATCGTGGCCGATGCCTCGGCGCCATCTGCGCGTCGGCC
TCGTCAAGGCGTTCCAGAGCGCCTACTTCAACAGGTACGGCGGCGGCGCCAACACCCTCGCCGCCGGCTACTCCAAGGG
CACCGGCCTCGCCGCCGAGATCATCGGCACCTTCGTGCTCGTCTACACCGTCTTCTCCGCCACCGACCCCAAGCGCAAC

FIG. 2 continued

GCCCGCGACTCACATGTCCCGGTCTTGGCGCCGCTGCCAATCGGCTTCGCCGTGTTCATGGTCCACCTGGCGACGATCC
CGATCACCGGCACCGGCATCAACCCGGCCAGG

> SEQ ID NO: 6171 176047 128867_300478_1b
CTCATCTTCTTCAGAAAATCAGAAGAAAGGAAAAATGTCAAAGGACGTGATAGAAGAAGGACAAGTTCATCAACAACAT
GGGAAAGATTACGTGGACCCACCACCAGCTCCTTTGCTTGATTTTGCAGAACTCAAGCTCTGGTCTTTTTACAGAGCTC
TTATTGCTGAGTTCATTGCTACTCTTCTTTTCCTTTACGTTACTGTCGCCACTGTAATTGGTCACAAGAAGTTGAATGG
TGCTGATCAATGTGATGGGGTTGGTATTCTTGGTATTTCTTGGGCTTTTGGTGGCATGATATTTGTTCTTGTTTACTGC
ACTGCCGGTATCTCTGGTGGACACATTAACCCAGCAGTGACATTTGGGTTATTCTTAGCAAGAAAAGTGTCATTATTAA
GGGCAGTGGGATATATTATTGCACAATCTTTAGGTGCAATTTGTGGTGTTGGTTTGGTGAAAGGTTTCATGAAACATTA
CTACAACACGTTAGGTGGTGGTGCTAATTTTGTGCAACCTGGTTATAACAAGGGCACAGCTTTGGGTGCTGAGATTATT
GGAACTTTTGTTCTTGTTTACACTGTTTTCTCTGCTACTGACCCTAAAAGAAGTGCCCGTGACTCCCATGTCCCTGTAT
TGGCCCCACTGCCAATTGGATTTGCTGTTTTCATGGTTCATTTGGCTACTATTCCAATTACTGGAACTGGTATTAACCC
TGCTA

> SEQ ID NO: 6172 176047 1100769_301463_1b
TTCTTCATCTTCTTCTTCTTCCTCCTTGGTCCATATATACACACCAAGCTAGGTGTGGTTGGCTTGGTTGTCTGAG
TTGTGTGTTGGGTGGGTTGGTACCATAGTGTGTGTTGGTTGGTTAGTTGTGGTGTTGGCAGGAGGGGGATTATTATGGA
GTCCAAGGATGAGGATGTTAGACTCGGGGCCAACAAGTACCCCGAGCGGCAGCCCATTGGTACCGCTGCCCAGACCCGC
GATTACACCGAGCCCCGCGCTGCCCCTTTCGTTGAGTTCTCGGAATTCTCCTCCTGGTCCTTCTGGAGAGCTGGTATCG
CTGAGTTCGTCGCCACCCTCCTCTTCCTCTACATCTCCGTCCAAACCGTCATGGGATGGAAACGCTCCGTCGCGGCCTC
CAACCTGAAATTCCCCGGTGACGTCAACATTTGCCCGCAAGGTGTTGGGGTCCAAGGCATCGCTTGGGCCTTTGGTGGC
ATGATCTTCGCCCTCGTCTATTGTACCGCTGGTATATCAGGTGGACATATTAACCCAGCGGTCACCTTCGGGCTCTTCC
TAGCCAAGAAGCTGTCTCTACCCCGCGCTTTGCTTTACATCATTGCCCAATGCTTGGGTGCCATTTGTG

> SEQ ID NO: 6173 17661 104813_300366_1b
ACCAAATATAAGATCCCGGAACAGAGACCAAAATAGAAACTACTGTGAGAAGTGAGAGTAGTAGGCAGCCCATCTCGCC
GGCGCCGATCTGCAGATTCACCGGCGAATCAAATTCCCCGTTGCTGTTAGGTGGATTAAGTGGAAAGAGAGGAACCAGA
GATAAATTATGGTGTTCTCTACGGTGATGAGTTGTTCACCTCATATGTGTCTTCCAAAGAGCCGCATGGTTATGCAGAA
AACACTCCGGTGCTCTGCTTCTGTTTCAACAGCGTCTGAGTCCATCCAATTTGATCTTAAGAATTATTGGACAACTCTA
ATTCGTGATATCAACCAGAAGCTTGACGAGGCAGTTCCTGTTAAGTACCCCAATCAGATTTATGAGGCCATGCGCTACT
CCGTTCTGGCCAAGGGTGCTAAAAGGTCCCCGCCAATCATGTGTGTCGCGGCTTGTGAGCTTTTCGGTGGAAATCGCCA
GGCTGCCTTTCCCACTGCCTGTGCCTTAGAGATGGTTCATGCTGCTTCATTGATTCATGATGATCTGCCTTGCATGGAT
GATGACCCAACTCGTCGAGGGCTGCCTGCAAATCACACAGTTTTGGTGTAGATATGGCAATTTTGGCCGGGGATGCCT
TATTCCCGCTTGGGTTCCAGCATATTGTGTCTCACACTCCAAGTGATCTCGTTC

> SEQ ID NO: 6174 17661 270659_200127_1b
GGGTCGCAGGGCAATTCCTCTAAGCACGAGGCGATGGGGAATGAGTGGTTGGAGACAGGGAACTGTCCTATCGCCAAAT
CTTATAGAGCTGTGAGCAGTGTCCTCCCACTTGTGGCAACAGCTTTTCAGCTGCCTCCTGTAATGAAGCTCAAATGCCC
ATCTGCAGTTGTTGCAGCCAGGGCTGCCCTTGCCAGGACTGCCTTTGTGAAGACTCTGCGGCCACAACCGCTATCTTCA
AAGATGCTTGTTATTGGAGCCTTGGGTATGGCAGCCAATATTCCACTAGGCATATGGAGAGAGCACACTGAGAAGTTCT
CACCATCTTGGTTTGCTGCTGTCCATGCTGCTGTTCCTTTTATAGCTATGCTGAGGAAGTCGGTTGTGATGCCCAAAAC
AGCTATGGCATTAACCATTGCTGCTTCTATCTTAGGACAGGTCATTGGCTCAAGAGCAGAACGACTTCGAATGAAAGCA
AAAGCCAAGAGTCTTAAATTGGTAGCGCAGACTGGCTCAGATGGGATTATTGCAGGTCTCAACTCGATCCAGGTCAATG
GTATGCATTGTGGCAAACAGGGGATGATTAAAGATCAATCCTCGAATGATTCGGGCAACCCTATCACTCCATCTGCCAG
TCTTTGTTTCTAAAGGAGGTTTATAGAACTGGTAAATAAGCAGTAGAACCATAAGCTGCATATAAAAAGTGTCAG

> SEQ ID NO: 6175 17884 27488_300080_1b
CCATTAACCGGAAATTTATTAAGGAAACAGTCCCATTCATTTTCACACAATTTTGTAAAAGGCAACAACCGTATAAATG
TCAAAACATTGCTTGAGGGACCCCCGTAACTACTAATGTTATTAACGGGGCCCAATTAAAAAACAAAAGACCCTTTATT
TACCCTTAACAACTGGGACAGGACATGTTGCTTTTGCCACCACATGATTGCTCACACTACCCAGCAAGATCTTTTTGAA
AAAACCCAAACCTTGATTGCCAAAAACAAGGGAATCGAGTTTTAAATTTTCAACAGCATCACAAAGTTTCTCCTTTGGA
TCTCCCCAATACACCTTTGTTACAACCTTCACTTTTTTACCCCTAAAGAGAGTTTCAAAAACTTCAAAACCCTCAGGAT
CGTAAGCAAGTCCTTACTGTTTAAACAAATTAACCTTTTAAATTCCTCCAAAGGAATTAGCGGGGAACCGGTTTCCTC
AAAAAGGATTTTGCGGTTATAACCGGCGTTTTGGGGTTGGACGTAAATCAAAATAACGGGGTCCCCGTTTTAAAGGAAA
T

FIG. 2 continued

> SEQ ID NO: 6176 17884 1099144_301488_1b
GAAAGAGAGAGAGAGAGAGAGAGAGAGAGAGAGGAAGAAGAAGAGGATCCATTGAGTGAAAGAGTAGTATGGGTTGT
AGGCAGGTGGGAGTGGCGCTGGACTTCTCGGTCAGTAGTAAGAATGCGCTCAGCTGGGCTCTCCATAACATCGCAAGGC
CCGGAGATAAAGTCTTTCTCATCATCGTCTCTAAGAAGGATCGTGATATCGCTCAGTTTGACCTATGGGAAGACTCTGG
CTCTCCTCCCATTCCTGTATGTGAGTTCGAGCAACCTTCAACAGCAAGGAATTATGGCGTAGCATCAGACCAGGAAGTA
ATCAACATCTTAAAGGAATACGAAAGCAAGTGCAAGGAGGTTGAAATTCTTTTCAAGATTTATTGGGGTGATGCACGAG
AGAAGATTTGTGATGCTTGTACTGCTCTACCTCTCGATTGCATTGTGATGGGAAGTCGAGGGCTTGGAGCTCTCAAAAG
GACTTTGTTGGGTAGTGTGAGCAATTATGTGGTCAACAGTGCACCTTGCCCTGTAACAGTTGTCAAGCCACCTACTCAC
GAGTGTGAATGATATGAGTGTCCATGAAAATGAGATTATTGGAGCAAAAT

> SEQ ID NO: 6177 17884 1114890_301805_1b
TCTTCTGTTTCCCTCTATTACAGGCGACATTTCCTGTGGCTACTCAAGCAAGTAGCTGGTAGAGAAGGGCATTCTCTCT
TTCATCTCTTTGCTGCAAAATGGAGGGGAGGCGGATTGGGGTGGCTATGGACTTCTCGCCCAGCAGCAGGCACGCCCTC
AAATGGGCTCTCTGCAACATCGCCCGAAAGCACGACCATTTGATCATCATCATCGTCAACAAGAAGGAGATGGAATCGG
GTGACATGCTCCTCTGGGAGCAATCTGGTTCTCCATTGATACCCTTCTGTGATTACGCTGAACCGGCCGTCACCCACAA
GTATGGAATTCAGCATGATGTTGACCTCTTCTCACTTGTTGAAGACGAGAAAAATATGAAGGAACTCACTGTAGTTTTC
AAAGCGTATTGGGGTGATCCCCGCGAGAAGATATGCGACGCTTCTGTAGACCTTCCCCTTGATTGCCTTGTGATGGGAA
GTCGAGGACTTGGAACCTTGAAAAGAGCCCTTCTAGGGAGTGTCAGTAACTATGTAGTCAACAATTGCCCATGCCCGGT
CACTGTCGTAAAGTTTCCAGCCGACGATGTGCATTCCTCTTGACCAATTCCAACATACAAGGAGGAAATAAGAACTGAG
GTACATCAACATATAAATAAAACCTTTGATTTCATAGCTATGGGGCTA

> SEQ ID NO: 6178 17884 1119050_301893_1b
TTTCCTTCCTAGTCAGCTTCTTCTCCTTCCTAATTACCCTCTTCTCTTTTTCTTCTCTTTCCTTCCTTCCCCCTATCAA
TGGCAGAGCGGCGCATTGGAATGGCTGTTGACTTTTCTGCCTCTAGCAAATATGCGGTCGAATGGGGGCTGAAGAACAT
TGCCCGTAAGCATGACCATGTCATCATCATCGTCGTCAACAAGACCATGGACGTCGAGTCTGGCAAGATGCACCTCTGG
GAGGAGTCTGGATCTCCATTGATACCCTTCTCTGACATCGCCAATCCAAAAGTTATAGACACTTACGGAATTCCACATG
ATATTGATCTACTCTCTCATCGAGGATGAAAAAAATATAAAGGAACTCAGTGTAGTTTTCAAGGTCTATTGGGGGGA
TGCCCGTGAAAAGATATGCGATGCTGCGGTGGACGTTCCCCTTGATTGTGTTGTCATGGGAAGCAGAGGCCTTGGAACT
CTCAAAAGAGCCCTTCTCGGGAGTGTGAGTAACTACGTAGTGAACAATTGCCCATGCCCAGTCACCGTCATAAAGCTTC
CTGTGAGCGACATCGGCTCTTCTTGAATCAATTCACACACACATATATATATATATATATAATATAAATA

> SEQ ID NO: 6179 181743 104455_300364_1b
CGGGCCAAAAAGCCCATAGGATTATTCAATGAAAACTACAATCTACAACTTTTTCACATCAAAGTTTTGAAGTAGAAGT
AAATCAAAAGAAAAGAAGAATAGACATGAAACAGCCAAAGGTACCCATTGACATTCATCCTGCAGACTTTTATTCATCC
CCCTTTGCCAATTTCTCCCAACCACAAACCACGCTCATCTAGGAAAAACTAATCTTTTTTTAAGAGAAATATTATACAT
TCAAGATTTTAAGCATCTGCTGTCTCAGCATTATCCGCTGCAGCCAAGATAAGCTCCGGATGAATGGTCGACTCTGCTG
TCCCGTCGAGTGCATTGGGCAATCCCAATGCCCTTAGCGCAAGGTGGGCCGCCTTCTGCCCTGATATCATCATAGCTCC
AAAAGTTGGCCCCATTCTTGGTGCTCCGTCAATTTCAGCAACTTCCATCCCTGTGACAATCATTCCAGGTACAACCTCT
CTTGTAAGTCTAACAATAGCATCCTCAGCGGCGTTCATGTCCAAAGCTTTCATCCCAGGAACATGATTGATCATGCCAA
TGCTCTTAAGCCTCTTAACACCAGTGGCACCCATGGGACCGTCGTGGCCCACAAGAGCTGACCACAATCTTAGCCTCCAT
AACATTGGGGTCCATGCAAGATTGTGTGTCATGGTTCTGAGAAAGGAGATTTTGTTTTGAGACCTTAGAAGAATGAAAG
ATTGTTTTCCCCGGCCGTAATGGC

> SEQ ID NO: 6180 181743 135619_300416_1b
CGGACGCGTGGGCGGACGCGTGGGCGGCGGTACATGACCGACATGATCACCTACGCCGACACCGACGTCGTCGTCGTCG
GCGCCGGCTCCGCGGGGCTCTCCTGCGCGTACGAGCTCTCCAAGGACCCCTCCGTCAGCGTCGCCGTCATCGAGCAGTC
GGTGTCCCCGGCGGCGGCGCGTGGCTCGGCGGGCAGCTGTTCTCCGCCATGGTGGCGCAAGCCGGCGGCCACCTGTTC
CTCGACGAGCTCGGCGTCGCGTACGACGAGCAGGAGGACTACGTCGTCATCAAGCACGCCGCGCTCTTCACCTCCACCG
TCATGAGCCGCCTCCTGGCGCGCCCCAACGTGAAGCTGTTCAACGCCGTCGCCGTCGAGGACCTCATCGTCAAGGAGGG
CCGCGTCGGCGGCGTGGTCACCAACTGGGCGCTGGTGTCGATGAACCACGACACGCAGTCGTGCATGGACCCCAACGTG
ATGGAGTCCAGGGTGGTGGTGAGCTCCTGCGGCCACGACGGGCCGTTCGGCGCCACGGGCGTCAAGCGGCTGCAGGACA
TCGGCATGATCGACGCCGTGCCCGGCATGCGCGCCCTCGACATGAACACCGCCGAGGACGAGATCGTCCGCCTCACCCG
CGAGGTCGTCCCCGGCATGATCGTCACCGGCATGGAGGTCGCCGAGATCGACGGCGCCCCGAGAATGGGCCCGACGTTC
GGAGCCATGATGATCTCCGGCCAGAAGGCGGCGCACCTGGCGCTGAAGGCGCTCGGCCGGCCGAACGCCATCGACGGCA
CGATCAAGAAGGCGGCGGCGGCGGCGGCGCACCCGGAGCTGATCCTGGCGTCGAAGGACGACGGCGAGATCGTGGA
CGCCTGAGCGAATAGAACAGGGTAAAAAAAAATCCGCAAGACGTGGTGGTGACACGGAGGCGTTGGGGACGAGAAGAAG

FIG. 2 continued

```
ATGTGGACTTTCCCCTGTGTTTTTTTTTCGGGATTTGCTTTGATCCCCTTGTTTGTTTTAGCTCTGGATGTTGATTAG
CGTCTTGTTCATAGCAATTCCACTGCCACCGTGTGTGTGTGCTCTGCTTGCCTGATGAGGGCAAGAAAACTTCCATGGA
TCCGTCTCTCTGGGAGGA
```

> SEQ ID NO: 6181  181743  130017_301607_1b
```
TTTTTTTTTTTTGAGAACTTAAACCCTAAAATCCAAGCAAAACCAAACCACATAAAAACATCCTTCACATAAGAAAGAA
AAAACAAAAGAACAACCATGAACAGCAGACAGACTATTTGATTGACGGATTTCTCTTAACCTACAGTACTCATCAACAT
CATCATCATATCCTTGCTCTGCTCTCTTTTTATTAATTTATGCAATTTTAGATGATAATTTCCTTATCATCAACAGTCT
CAACATTACTTTATTTCTTAAGCTTCAGCAGTCTCAGCTGATTCAGCAGCTGCAAGGATAAGCTCTGGTACAATACCTC
CCATGTCACTGTAGTTTCCATCAATAACATTAGGTTGTCCCAATGCCTTCAGTGCTAAATGTGCTGCCTTTTGCCCTGA
GATCATCATGGCTCCGAATGTTGGTCCCATTCTTGGGGCACCATCAATTTCAGCCACTTCCATTCCAGTAACAATCATA
CCAGGAACAATTTCTCTAGTGAGTTTAACAATGGCATCTTCAGCGGCGTTCATGTCAAGAGCTTTCATTCCAGGAACTG
AGTCGATTAAACCAATACTCTTCAACCTTTTAACACCAGTAGCACCAAAAGGACCATCATGACCACATGAACTGACAAC
AATCTTGGCTTCCATGACATTAGGGTCCATGCAAGATTGTGTGTCATG
```

> SEQ ID NO: 6182  181743  129985_300483_1b
```
GAATTCACAACTCATCTTAAACACAGAAGCGCGGAACCTAAGAAATCTTCTTTCTAATGGCAACCATGGCAATGACCCT
TTCTTCACCCCTTTCTAAAACACCTTTCCTAGAAACTCAATCTTCTTTCCATGGGATCCAGATCCCATCAAGATTCCAA
CCCATCCGATCAACTTCCCAAAACAACACTACATCATCAATCTCTATGTCATCAACTTCCGGTTATGATCTTACAGATT
TCAAGTTTGCACCAATCAGAGAATCAATAGTTTCTCGTGAAATGACCCGTCGTTACATGATGGATATGATTACTTACGC
CGATACCGATGTTGTTGTCGTTGGTGCTGGTTCAGCTGGTTTATCATGTGCTTATGAAATCAGTAAGAACCCTAACGTT
AATGTTGCACTTATTGAACAATCAGTTTCTCCAGGTGGTGGTGCTTGGTTAGGTGGACAACTTTTCTCTGCTATGATTG
TTCGTAAACCAGCTCACAAATTCCTCGATGAACTCGAAATCGAGTACGATGAGCAAGACACCTATGTTGTCATCAAGCA
TGCTGCCTTGTTCACTTCCACCATCATGTCAAAGTTGTTGGCCAGACCAAACGTCAAGTTGTTCAATGCTGTTGCAGCA
GAGGATTTGATCGTTAAGAACAATAAAGTTGCCGGAGTTGTCACCAACTGGGCGTTAGTCTCAATGAACCATGACACAC
AATCTTGCATGGACCCTAATGTCATGGAAGCCAAGATTGTTGTCAGTTCATGTGGTCATGATGGTCCTTTTGGTGCTAC
TGGTGTTAAAAGGTTGAAGAGTATTGGTTTAATCGACTCAGTTCCTGGAATGAAAGCTCTTGACATGAACGCCGCTGAA
GATGCCATTGTTAAACTTTTCTCTGCTATGATTGTTCGTAAACCAGCTCACAAATTCCTCGATGAACTCGAAATCGAGT
ACGATGAGCAAGACACCTATGTTGTCATCAAGCATGCTGCCTTGTTCACTTCCACCATCAT
```

> SEQ ID NO: 6183  181743  1118579_301857_1b
```
TGATCGTGAAGGGCAAGAGGGTTGCAGGTGTGGTAACTAACTGGGCCTTGGTTTCGATGAACCATGACACACAGAGCTG
CATGGACCCGAATGTGATGGAGTCGAAAGTTGTCGTTAGCTCCTGTGGCCACGACGGCCCCTTCGGGGCCACCGGCGTG
AAGAGGCTCATAAGCATCGGGATGATCGACAATGTGCCGGGGATGAAGGCCTTGGACATGAACACAGCTGAAGATGCTA
TTGTTCGTTTGACTCGCGAGGTTGTTCCAGCAATGATTGTCACCGGCATGGAGGTTGCTGAGATCGATGGTGCACCCCG
CATGGGACCA
```

> SEQ ID NO: 6184  181743  246232_301611_1b
```
GAGAGGCTCAAGAGCATTGGTATGATTGATAGCGTTCCGGGGATGAAGGCCCTGGACATGAACACTGCCGAGGATGCCA
TCGTTCGATTGACTCGTGAGGTTGTTCCTGGGATGATTGTTACTGGCATGGAAGTTGCCGAGATCGATGGAGCGCCGAG
GATGGGACCGACTTTCGGCGCGATGATGGTCTCGGGCCAGAAGGCAGCTCATCTGGCTTTGAAGGCACTGGGGTTGCCA
ATGCCATAGATGGGACGCTCAAGGCTGGATATGTTCCAGAGCTTGTGCTTGCCTCGGCCGAGGACCAGGAGACCACCA
CGGCTTACTCGCTTTGCTCGAGAAAATCTTTGTATTCTCGAGTGGACGATGGTCTTCCACGCGAATG
```

> SEQ ID NO: 6185  181743  258826_301700_1b
```
TTATATCACCTACAATTAACATGGCCCCACCTCCTGCTGTCGTTGCCCACCCCCTCTCCTCTCAGGCTACTGGTCTTGA
TATGGTCCATGAGTTCAACCAGAAGCTCACTAAGTCTGATGAGCACACTTGGGAGTCTTTCAAGTTCGCCCCCATCCGT
GAGTCCACTGTCTCTCGAGCTATGACTCGACGATACTTTGAGGATCTTGACAAGTACGCTGAGTCTGATGTTGTTATCA
TTGGAGCTGGCTCCTGTGGTCTCTCTGCTGCCTATGTTCTTGCCAAGAGCCGACCCGACCTCAAGATTGCCATCGTTGA
GGCTGGTGTTGCTCCCGGAGGAGGTGCTTGGCTTGGAGGACAGCTCTTCTCTGCCATGGTTATGCGAAAGCCTGCCGAG
CAGTTCCTTGAAGAGATCGGTGTCCCTTACGAAGATGAGGGAGACTACGTCGTTGTTAAGCACGCTGCCCTTTTCACCT
CTACTCTCATGAGCCAGGTGCTCAAGTTCCCCAATGTTAAGCTCTTCAACGCTACTGCCGTTGAGGACCTCATTACCCG
AAAGGATGCCCAGGGCAACCTTCGAATTGCAGGTGTCGTCACCAACTGGACCCTAGTTTCCATGCACCATGATGACCAG
TCCTGTATGGACCCCAACACCATCAATGCTCCTATCATCATCTCCACCACTGGTCATGA
```

> SEQ ID NO: 6186  181743  248221_301581_1b
```
GATACGATCGCATGCTCTCCTTCTCGCTGCCTCTCCAAGGCCCACGAATCTCCCCTCGCATCCTCTCGCTCCTCCATCG
CGGGGACGAGGATCAAGGTAAACTCCCTTTCGGCCGCCGCCGTCCCGCGCAGCTTCTCGCATGGATCCGCCAGCGCGCG
```

FIG. 2 continued

```
CTACGACCTCAACAACTTCTCCTTCGAGCCGATCAAGGAGTCGCTGGTGGCCCGGGAGATGACCCGCCGCTACATGACC
GACATGATCACCTACGCCGACACCGACGTCGTCATCGTCGGCGCGGGCTCCGCTGGTCTCTCGTGCGCCTACGAGCTGA
GCAAGAACCCGGACGTGAATGTCGCCATCGTGGAGCAGTCCGTGAGCCCCGGCGGTGGTGCATGGCTCGGCGGCCAGCT
CTTCTCCGCTATGGTCGTTCGCAAGCCCGGTCATGTCTTCCTGGACGAGGTCGGCGTCCCCTACGACGAGCTGGAGAAC
TACGTGGTGGTAAAGCATGCCGCGCTCTTCACGTCGACGATCATGAGCAAGGTGCTGGAGAGGCCCAACGTCAAGCTCT
TCAACGCGGTGGCGGCCGAGGACTTGATCATCAAGCAGGACAAGGTTGCCGGGGTGGTGACCAACTGGGCACTGGTTTC
TATGAACCACCATACACAGAGTTGCATGGATCCCAATGTGATGGAGGC

> SEQ ID NO: 6187 181743 267058 200088 1b
AAAAAACTCATCTCTCAAGATCTCAAGCTTTGTCTATGGCAACCATGGCATCAACCTTGGCATCCTCTGTTGTTACCAA
GACCAATTTCTTGGACACCCACAAATCATCTTTCTCTGGTGTCCCTCTTTTTTCACAAGCTAGACTTAAACCTGTTAAA
TCTGCCCAGCAAAACATGACCATTTCCATGTCTGCTGATTCCTCTCCTCCACCTTATGATCTTAACGCTTTCAGTTTTA
ACCCAATTAAGGAATCCATCGTTTCTCGCGAGATGACACGTAGGTACATGACTGACATGATCACCTATGCTGACACTGA
TGTCGTCATCGTTGGCGCTGGCTCTGCTGGTCTCTCTTGTGCTTATGAGATCAGCAAGAACCCTAACGTTCAGGTGGCC
ATACTTGAGCAATCAGTGAGCCCTGGTGGAGGTGCCTGGCTAGGAGGACAACTCTTCTCAGCCATGGTTGTGAGGAAGC
CAGCACATCTCTTCTTGAACGAGCTCGGCATAGACTATGACGAGCAAGATAACTACGTGGTCATCAAGCACGCTGCCTT
GTTCACCTCAACCATCATGAGCAAGCTTTTGGCCAGGCCAAACGTGAAACTCTTCAATGCTGTTGCAACAGAGGACCTT
ATTGTGAAGAACGGAAGAGTTGGTGGTGTTGTCACTAACTGGTCTTTGGTTTCTCAGAACCATGACACACAATCCTGCA
TGGACCCCAATGTTATGGAGGCTAAGATTGTGGTCAGCTCTTGTGGCCACGACGGTCCCATGGGTGCCACTGGTGTTAA
GAGGCTTAAGAGCATTGGCATGATCAACCATGTTCCTGGGATGAAAGCTTTGGACATGAACACCGCTGAGGACGCTATT
GTTAGACTTACCCGAGAGGTTGTACCCGGAATGATCGTCACAGGGATGGAAGTCGCTGAAATCGACGGAGCACCAAGAA
TGGGACCAACTTTTGGAGCTATGATGATATCAGGGCAGAAGGCAGCCCACCTTGCGCTAAGGGCATTGGGATTGCCTAA
TGCACTCGACGGGACAGCAGAGTCAAGCATTCATCCGGAGCTTATCTTGGCTGCAGCTGATGATGCCGAGACAGCAGAT
GCTTAAAATCTTTAATGTATAAGATTTCTCTAAAAAAGAGATTAGTTTTTTCCTAGGTGAGCGTGGTTTGTGGTTGCGA
GAAATTGGCAAGGGGGATGAATAAAAGTCTG

> SEQ ID NO: 6188 181743 268491 200120 1b
GCGAACTCCTACAGCTGCAATAGTAACAAGCAATTATTGGCGCCCCACCAGCTACTGGTCGGAGATGACACATCTTTGA
GTATTTTTCTCGCAGGTATAGTTTCTTCATCTCATGATCTTTGCATTTCCTATCATCAGATTTTGTCTCCCTAACTTTC
TATGTGGCCATACTTGAGCAATCAGTGAGCCCTGGTGGAGGTGCCTGGCTAGGTGGACAACTCTTCTCAGCCATGGTTG
TGAGGAAGCCAGCACATCTCTTCTTGAACGAGCTAGGCATAGACTATGACGAGCAAGATAACTACGTGGTCATCAAGCA
CGCTGCCTTGTTCACCTCAACCATCATGAGCAAGCTTTTGGCCAGGCCAAACGTGAAACTCTTCAATGCTGTTGCAACA
GAGGACCTTATTGTGAAGAACGGAAGAGTTGGTGGTGTTGTCACGAACTGGTCTTTGGTTTCTCAGAACCATGACACAC
AATCTTGCATGGACCCCAATGTTATGGAGGCTAAGATTGTGGTCAGCTCTTGTGGCCACGACGGTCCCATGGGTGCCAC
TGGTGTTAAGAGGCTTAAGAGCATTGGCATGATCAATCATGTTCCTGGGATGAAAGCTTTGGACATGAACGCCGCTGAG
GATGCTATTGTTAGACTTACAAGAGAGGTTGTACCTGGAATGATTGTCACAGGGATGGAAGTTGCTGAAATTGACGGAG
CACCAAGAATGGGGCCAACTTTTGGAGCTATGATGATATCAGGGCAGAAGGCGCCCACCTTGCGCTAAGGGCATTGGG
ATTGCCCAATGCACTCGACGGGACAGCAGAGTCGACCATTCATCCGGAGCTTATCTTGGCTGCAGCGGATAATGCTGAG
ACAGCAGATGCTTAAAATCTTGAATGTATAATATTTCTCTTAAAAAAGATTAGTTTTTCCTAGATGAGCGTGGTTTGT
GGTTGGGAGAAATTGGCAAAGGGGGATGAATAAAAGTCTGCAGGATGAATGTCAATGTGTACCTTTGGCTGTTTCATGT
CTATTCTTCTTTTCTTTTGATTTACTTCTACTTCAAAACTTTGATGTGAAAAAGTTGTAGATTGTAGTTTTCATTGAAT
AATCCTATGGGCTTTTTGGCGTCGTTTTGGTAAAAAAA

> SEQ ID NO: 6189 181743 201528_300717 1b
TCCCAGAGCAAGAAGCTCAGCTCCTCCTCCTCTCGCATGGCAGCCATGGCCACCACCGCGTCCAGCCTCCTCAAGACCT
CCTTCGCCGGCGTGCGCCTCCCCGCCGCCGCCCGCAACCCCACCGTCTCCGTCGCGCCGCGCACCGGCGGGGCCATCTG
CAACTCCATCTCGTCGTCGTCGTCCACTCCCCCCTACGACCTCAACGCCATCAGGTTCAGCCCCATCAAGGAGTCCATC
GTGTCCCGCGAGATGACCCGGCGGTACATGACCGACATGATCACCTACGCCGACACCGACGTCGTCGTCGGCGCCG
GCTCCGCGGGGCTCTCCTGCGCGTACGAGCTCTCCAAGGACCCCTCCGTCAGCGTCGCCGTCATCGAGCAGTCGGTGTC
CCCCGGCGGCGGCGCGTGGCTCGGCGGGCAGCTGTTCTCCGCCATGGTGGTGCGCAAGCCGGCGCACCTGTTCCTCGAC
GAGCTCGGCGTCGCGTACGACGAGCAGGAGGACTACGTCGTCATCAAGCACGCCGCGCTCTTCACCTCCACCGTCATGA
GCCGCCTCCTGGCGCGCCCCAACGTGAAGCTGTTCAACGCCGTCGCCGTCGAGGACCTCATCGTCAAAGAGGGCCGCGT
CGGCGGCGTGGTCACCAACTGGGCGCTGGTGTCGATGAACCACGACACGCAGTCG

> SEQ ID NO: 6190 181759 46192_300176 1b
ATTTAGAAGGATAACAGCATTAAGAGTGACGCGTATATACGCGTCACAAGGCCCGACTAAACCGTCAAAACCATCTCCA
GGAGTAGACACAAGAATCCACTGGGAAAGCCCGGACGAAGGCTGGATCGGAGGAAGATCCGACCCGGCCAAATCGGTTG
ATGAGGACAAAACCAATCTCCTTAGTGACGAAAAATTTGCAGAACTAATCAAAGACTCTTTTGATTCTCATTACCAATT
```

FIG. 2 continued

CTTAGGTGTTTCAACGGATGCTGATCTAGAAGAGATAAAATCTGCGTACCGGAGATTATCTAAAGAGTATCATCCAGAT
ACAACTTCACTACCACTTAAAACAGCTTCAGAAAAGTTCAT

> SEQ ID NO: 6191 181971 105455_300368_1b
TCTCCCTTCTCTTTTTGCAAGACTTAATAATTCTCCAGCTTCCTCCCATCATCACCCCACTTTGAGAGAGAAGACATGG
CAAAGGGAAGTTACGAGAAGGCCATTGTTTCACTCCAGAACCTCCTCAGTGAGAAGGGAGAACTGGAACCGATTGTAGC
AGAAAGAATTGATGAAATCACAGCTGAATTACAAACGTCAGGCTTCCAATCAGTCCACCCTGTTGACAGAATCAAGACT
GGCTTTGATTATTTCAAAAAAGAGATATATGACAAAAATCCAGAACTGATTGATGAACTCAAGAAAGGACAGGAACCCA
AGTTTCTGGTGTTTGCATGCTCCGATTCACGAGTGAGCCCATCTCATGTGCTGAATTTTCAGCTCGGTGAGGCTTTTAT
GGTTCGAAACATTGCCAACATGGTCCCTCCTTATGACAAGACAAAATACTCGGGAGTAGGAGCTATAATCGAATATGCT
GTTCTCTTTCTTAAGGTAGAAAATATTTTAGTCATTGGCCATAGTGCATGTGGAGGTATTAAGGCTCTCATGGATCTCC
CAGAAAATGGTTCTGAATCAACCGATTTTATTGAGAATTGGGTGAAAATTGGACTACCAGCCAAGGCAAAGGTACTAGC
TGAACATGGGGACAAAACTTATGAAGAGAAACTCAAATACTGTGAAATGGAAGCTGTGAATGTATCACTAGCTAATTTG
CTGACATACCCATTTGTGAGTGATGCTTTGGTGAAT

> SEQ ID NO: 6192 181971 142371_300434_1b
CCCCCGGCGTGTGTAGCTACTGCTATAAGGAGCGCGCCGTGCACCGCCTCTCACAATGGCGACCGCCGCCGCCGCCGCC
GCTGCCCAGAGCTGGTGCTTCGCCACTGTCACCCCGCGCTCCCGCGCCACAGTCGTCGCCAGCCTCGCCTCCCCATCAC
CGTCCTCCTCCTCCTCCTCCAACAGCAGCAACCTCCCGGCCCCCTTCCGCCCCCGCCTCATCCGCAACACCCCCGT
CTTCGCCGCCCCCGTCGCCCCCGCCGCGATGGACGCCGCCGTCGACCGCCTCAAGGATGGGTTCGCCAAGTTCAAGACC
GAGTTCTATGACAAGAAGCCGGAGTCTCTTCGAGCCGCTCAAGGCCGGCCAGGCACCCAAGTACATGGTGTTCTCGTGCG
CCGACTCTCGCGTGTGCCCGTCGGTGACCATGGGCCTGGAGCCCGGCGAGGCCTTCACCGTCCGCAACATCGCCAACAT
GGTCCCAGCTTACTGCAAGATCAAGCACGCTGGCGTCGGGTCGGCCATCGAGTACGCCGTCTGCGCCCTCAAGGTCGAA
CTCATCGTGGTGATTGGCCACAGCCGCTGCGGTGGAATCAAGGCCCTCCTCTCACTCAAGGATGGAGCACCAGACTCCT
TCCACTTCGTCGAGGACTGGGTCAGGACCGGTTTCCCCGCCAAGAAGAAGGTTCAGACCGAGCACGCCTCGCTGCCTTT
CGATGACCAATGCGCCATCTTGGAGAAGGAGGCCGTGAACCAATCCCTGGAGAACCTCAAGACCTACCCGTTCGTCAAG
GAGGGGATCGCCAACGGCACCCTCAAGCTCTTCGGCGGCCACTACGACTTCGTCTCCGGCAACTTGGACTTATGGGAGC
CCTAAATCCGACCGTCCGTCCGTTCAGTTCGTCAGTTTACGCCAACGCTTTTGCATAAGTACTACCTGAGGATATCGTC
CCCGATCATCGATGTGAACGCGTGGAGTACTACTACGTACGTACCGGATGGTTCGATATATGTAATGCTGTATTAAGT
AATAACAAGAAATATATCTCCTCTACTTTTTCCTGACGCGGAGTTGTACT

> SEQ ID NO: 6193 181971 1119602_301899_1b
GGGCTACCCCGACACAGATCTTGAGTCCGCCATTCAAGCCCTAACCCAGCTCTTGCAGCAATCTCCGGGGTTGAAAGCA
GAAGCAGTGAAGAAGATTGAGGAAATCACGTCAGAGCTTTCCCTTGTTGAAGAACATAAGAACGGGAAGGAGATCGACC
CCGTGCTCAAGCTCAAGCATGGCTTCTCCAAGTTCAAATCCTTCTTCAAGAAAGAAGCTGAATTGTTCAAGAGTCTTGC
GGAGTCACAACACCCTAAGTTTATGATCATTGCATGCTCGGATTCAAGAGTAGATCCTGCTGTCATCCTTAATTTGGGT
CTAGGAGAAGCCTTCATTGTTCGCAATGTCGCCAATATGGTGCCACCTTACTGGGAGAGTGCTGGATCTTCCACTGCTT
CTGCCCTAGAGTACGCAGTTTTGCACTTGAAGATTGAACACCTGATGGTGATCGGCATAGTAGGTGTGGGGGCATCAA
AGCCCTCATGTCATCCAAGGAAGATGGGTCAAACAAATTCAGTGACTATATTGAAGACTGGGTCAACCATGGAAGAGGT
GCTGCTAAGAAGGTGCAAAAGTCCCTCCCCAACAACAATTTTGACGACCAATGCACCAAT

> SEQ ID NO: 6194 181971 1118735_301858_1b
GGGTTCGAACCGGAGCACCGCCAATATGAAATAGCTTTTGCGCTTCTGCAAATACTATTATGATAAACGACACGAGGTT
CGCGCAGTCTATAAATGGAGGCTGAACCCAGGAAGGCTTCAGGAATGTGGAGTTGCTGCCTTCCCTTGAAATCTTCTCG
AGAAATCAAACCCTCCACTGCAGTCTCAGCTCTCCCTGCTCAGCAGAATAAGATGGGTCAATTCGATAGCAGTGATTCT
GAATACACTTCCGCCATTGAAGCCCTCTCCACCCTCTTGAAGAAATCCCCCAGCTTGAAGGCAACAGCAGTCCAGAAGA
TTGAAGAGTTGACTAGCGAGCTAAGCCAGAACGCAGAGACCTGCAAGGACGATTTAGTCGATCCCTTGCAAAAACTCAA
GCTCGGCTTCTCCAAGTTCAAATCTTTCTACAAAAAAGAGGCGGAGATGTTCAAGAGTTTGGCAGAATCCCAGCACCCT
AAGTTCATGATAATAGCGTGCTCAGATTCGAGAGTCGATCCTGCCGTTATATTGAACCTGGGTTTGGGAGAAGCCTTCA
TAGTTCGCAATGTGGCCAATATTGTGCCACCCTTCTGGGAGAGTTCTGGATCATCCACAGCGTCTGCCCTTGAATACGC
CGTCCTCCATCTGAAGGTGGAGCATCTCATGGTCATTGGTCACAGTAGGTGCGGCGGAATCAAAGCG

FIG. 2 continued

> SEQ ID NO: 6195 181971 111306_300054_1b
CGGACGCGTGGGGTCTATTGCTAAAAGAAGGCATCACATTTCTGGTTCCTCCTTCAATATGACTTTATTCTCCACAAAT
ATACGTGAGGTTACCAAAATGGCAGAGGATTCATATGAAGACGCCATTGCAGGACTGAAAAAGCTCCTCAGTGAGAAAA
ATGAGCTGGAAGATGCAGCGGTCGCAAAAATACGGCAGTTGACGGCAGAGTTGGGAAGTGCCGGCGGGAAAAAGTCTGA
CCCGGATGAGAAGATCCGAACCGGATTCGCCCAATTCAAGGCCGAAAAATATGAGAAAAATCCTGAGTTGTTTGGGCAG
CTTGCAAAAGGTCAAAGCCCTAAGTTCTTGGTATTCGCCTGCTCCGATTCTCGAGTATGCCCATCCCACATCCTCAATT
TCCAGCCAGGTGAAGCTTTTGTGGTCCGTAATATTGCAAACATGGTCCCTCCTTTTGATCAGACAAAATATTCTGGAGT
AGGTGCCGCAGTCGAATATGCAGTTGTCCACCTAAAGGTGGAGAATATTTTGGTGATTGGACACAGCTGTTGTGGAGGT
ATTAAAGGGCTAATGTCTATCCCTGATGATGGGTCCACAAACAGTGATTTCATTGAAGAATGGGTCAAAATCTGTCTGC
CTGCCAAAGCAAAAGTAAAGGCAGAATGCTGCCATTTGGATCCCACTGAACAATGCACAAAATTGGAGAAGGAGGCAGT
GAATGTATCACTAGGCAACTTATTGACATATCCATTTGTAAGAGAAGCTGTGGTGCAGAAAAGCCTTGCGCTGAAAGGT
GGACACTACGATTTTGTGAATGGTTCTTTTGAGCTCTGGAATATTGACTTCAATCTTACCCCTTCTGTTTCACTCTAAA
CTCTTGCACACTGTAACTTGTCATGTAACCAATGCAACTCCGTTTCAAGTTTTTTTCTTCAACTTTTCATTNTGATGTA
AATGTATTCCTTACTGAACAATGTGTGTCACACAAATAATATTAACCGGCTGTTGGAGCTTTGGGC

> SEQ ID NO: 6196 181971 271361_200033_1b
AAGAGTAATAAAAGCAAGCAAAAGCTAAAAAGGAAGTTGTTGAGCCAAATGTCAACTGCTTCCATTAACAGTTGCCTTA
CTATCTCCCCTGCTCAAGCTTCCCTTAAAAAACCAACTCGTCCTGTTGCTTTTGCTAGGGTTAGCAACTCTTCTTCTTC
TCCTTTTGTTCCCAGTCTCATCAGAAACGAGCCCGTCTTCGCCGCCCCTACTCCCATCATCAACCCCATTTTGAGAGAA
GAAATGGCAAATGAATCCTACGAGCAGGCCATTGCTGCACTCGAGAAACTCCTCAGCGAGAAGGAGAACTTGGACCAA
TTGCTGCAGCAAGAGTTGACCAGATTACAGCTGAATTGCAATCATCAGATGGCAGCAAACCATTTGACCCTGTTGAGCA
CATGAAAGCTGGCTTTATTCACTTCAAAACTGAGAAATATGAGAAAAACCCAGCCTTATATGGAGAACTATCAAAAGGC
CAGAGCCCCAAGTACATGGTCTTTGCCTGCTCTGACTCACGAGTGTGCCCATCCCATATCCTGAACTTCCAACCTGGTG
AAGCTTTCGTGGTTCGGAACATTGCCAACATGGTCCCTGCTTATGACAAGACCAGATACTCTGGAGTCGGAGCAGCTAT
CGAATACGCTGTTCTCCACCTTAAGGTAGAAAACATTGTTGTCATTGGCCACAGCGCTTGTGGAGGTATCAAAGGTCTC
ATGTCTCTACCCGCAGATGGTTCTGAATCAACTGCCTTTATTGAGGATTGGGTGAAAATTGGTTTACCTGCCAAGGCCA
AGGTGCAGGGCGAACATGTGGATAAATGTTTTGCAGATCAATGCACAGCTTGTGAGAAGGAAGCTGTGAATGTATCACT
TGGAAATTTGCTGACCTATCCATTTGTGAGAGAAGGTTTGGTGAAGAAAACACTAGCATTGAAGGGAGGTCACTATGAT
TTTGTGAATGGAGGATTTGAGCTGTGGGGACTTGAGTTCGGTCTTTCTCCTTCTCTTTCCGTATGAACTTAACCACCGT
TTTAAGTGGTTTTTTCCCCTAACACTTTTGCTTTCATGTAATTTCCCAAATCGAACTGTATGTTGTTGTATGTATGTAT
TGACCAATATCAAAGAGCACCAGTTCTTACATTTCTGAATAAATAAATGCGAGTTCTTCCTTT

> SEQ ID NO: 6197 181971 55985_300129_1b
ACGAGTGTGCCCATCACACGTACTAGACTTCCATCCTGGAGATGCCTTCGTGGTTCGTAATATCGCCAATATGGTTCCT
CCTTTTGACAAGGTCAAATATGCAGGAGTTGGAGCCGCCATTGAATACGCTGTCTTGCACCTTAAGGTGGAAAACATTG
TGGTGATAGGGCACAGTGCATGTGGTGGCATCAAGGGGCTTATGTCATTTCCTCTTGACGGAAACAACTCTACTGACTT
CATAGAGGATTGGGTCAAAATCTGTTTACCAGCAAAGTCAAAGTTTTGGCAGAAAGTGAAAGTTCAGCATTTGAAGAC
CAATGTGGCCGATGCGAAAGGGAGGCAGTGAATGTGTCACTAGCAAACCTATTGACATATCCATTTGTGAGAGAAGGAG
TTGTGAAAGGAACACTTGCTTTG

> SEQ ID NO: 6198 181971 47021_300177_1b
CATTTATGCGCAAACGGAGCTTGTTTTCGGTGCACCTGCTTCAGCCACTTCAAACTTGAACTGAGAAGGATGGGAAACG
AATCATATGAAGACACCATCGAAGCTCTCAAGAAGCTTATCATTGAAGGATGATCTGAAGGATGTAGCTGCGGCCAA
GGCGAAGAAGATCACGGCGGAGCTTCAGGCAGCCTCGTCATCGGACAGCAAATCTTTTGATCCCGTCGAACGAATTAAG
GAAGGCTTCGTCACCTTCTAGAAGGAGAAATACGAGACCAATCCTGCTTTGTATGGTGAGCTCGCCAAAGGTCAAAGCC
CA

> SEQ ID NO: 6199 181971 46933_300175_1b
CGGACGCGTGGGCGGACGCGTGGGCGCAAAGGGTCAAAGTCCTAAGTACATGGTGTTTGCTTGTTCAGACTCACGTGTG
TGTCCATCACACGTTCTGGACTTTCAGCCAGGAGATGCCTTCGTGGTCCGTAACATAGCCAACATGGTTCCTCCTTTCG
ACAAGGTCAAATACGGTGGCGTTGGAGCAGCCATTGAATACGCGGTCTTACACCTTAAGGTGGAGAACATTGTGGTGAT
AGGACACAGTGCATGTGGTGGGATCAAAGGGCTTATGTCTTTCCCCTTAGATGGAAACAACTCCACTGACTTCATAGAG
GACTGGGTCAAAATC

> SEQ ID NO: 6200 181971 291672_200080_1b
TTAAAAGGAAATTCTTGAGCCAAATGTCAACTGCTTCCATTAACAGTTGCCTTACTATCTCCCCTGCTCAAGCTTCCCT
TAAAAAACCAACTCGTCCTGTTGCTTTTGCTAGGGTTAGCAACTCTTCTTCTTCTCCTTCTGTTCCCAGTCTCATCCGA
AACGAGCCCGTCTTCGCCGCCCCTACTCCCATCATCAACCCCATTTTGAGAGAAGAAATGGCAAACGAATCCTACCAGC

FIG. 2 continued

AGGCCATTGCTGCACTCGAGAAACTCCTCAGCGAGAAAGGAGAACTTGGACCAATTGCTGCAGCAAGAGTTGACCAGAT
TACAGCTGAATTGCAATCATCAGATGGCAGCAAACCATTCGACCCTGTTGAGCACATGAAAGCTGGCTTTATTCACTTC
AAAACTGAGAAATATGAGAAAAACCCAGCCTTATATGGAGAACTATCAAAAGGCCAGAGCCCCAAGACCAGATACTCTG
GAGTTGGAGCAGCTATTGAATACGCTGTTCTCCACCTTAAGGTAGAGAACATTATCGTCATTGGCCACAGTGCATGTGG
AGGTATCAAAGGTCTCATGTCTCTACCTGCAGATGGTTCTGAATCAACTGCCTTTATTGAGGATTGGGTGAAAATTGGT
TTACCTGCCAAGGCCAAGGTGCAGGGCGAACATGTGGATAAATGTTTTGCAGATCAATGCACAGCTTGTGAGAAGGAAG
CTGTGAATGTATCACTTGGAAATTTGCTGACCTATCCATTTGTG

> SEQ ID NO: 6201 181971 247023_301616_1b
ACGCGTCGCTTCCATGCCTTCGATGCAGCGGTCCCAGGGCCTCCCCAGCCCCGAATTTCCGTCCTGGGATCGTTCTTCC
GGTAGCTACGCGTCTCGGCTCTGGAATGCGGCGGCCGGATTGGGGAGAAGGACCTGTTTCTTGCAGCAGGTTGTTCATC
AGGATGGTCACCAGGTTGTTCATCACCAGAAGACGCTGGCAGCGGAAAGGATTAAGCGGGGTTTTCAAGGGTTTAAGCA
AGACACATACCGTCAAAAACCGGAGCTCTTCGGTCGATTAGCTATCGGACAGCATCCCAAGTTCATGGTGATTGCTTGC
TCTGACTCTAGAGTTTGTCCCACGACGATCCTGAGGTTCCAGCCAGGAGAGGCATTTGTCATCCGCAACATTGCAAACA
TGGTGCCTCCTCCGGAAAAGGTACACTGACCTTGCTTTGTGCTCGTTCGCTCAGCTCAAAGGCAAGGCTTTCAGGCTGG
CTATCCAGGAACCAGTGCAGCTCTCGAGTACGCAGTCATGGTTCTCAAGGTCGAGAACATTCTAGTGATTGGACATAGT
CGCTGCGCCGGTATCGAAGCTCTGATGACACGCAACACCAAGTGGAGGTCAGTCTTACGAAGCTACGTACCAAGGACTC
GGGCTCTTTCT

> SEQ ID NO: 6202 181971 254610_301634_1b
TTTCCTCTATCTCTCTCTCTCATCCTCTCTTGTTCTCTCTCTCATCCCCAAGCAATGGCTTCTCTCTCATGGTCATCAG
CTAGCCCATTTGCCTTGCCCCAACAATGGACCTCCATGTATAGAAAATTGGCCACTCTACCACCTTCTTCTACCTCATC
CTCCTCTCCATTGCCCAAGATTAGTGCAGTACAAGAGGCTCTTCACCCAATTGAGAAAATAAAGCAAGGATTTGAGACT
TTCAAGCAAACCAACCTTTTGACAAGGCCAGAAGTGCATGAACCACTGAAGTCTGGCCAAACCCCAAAGGTGATGGTGA
TCTCGTGCTCCGATTCAAGAGTATGCCCAACCCAAGTATTTGGATTGGATGCAGGTGAAGCATTTGTGGTTCGAAGTGT
CGCCAACTTGATTCCACCTTTTGGAGAGGAAGGCTTCCCTGGCACTAGTGCAGCTCTAGAGTACGGTGTTCTCCATCTC
AAGGTAGAACATATCTTTGTTGTTGGACACAGCATGTGTGGAGGAATCAAAGCTCTCATGTCAATTCCAGATGATGCAC
CTAAATCCACATTGTTCATCGAAGA

> SEQ ID NO: 6203 181971 170270_300531_1b
CCTGGTGTGTAGCTACTGCTATAAGGAGGGCGCCGTGCACCGCCTCTCACAATGTCGACCGCCGCCGCCGCCGCCGCTG
CCCAGAGCTGGTGCTTCGCCACTGTCACCCCGCGCTCCCGCGCCACAGTCGTCGCCAGCCTCGCCTCCCCATCACCGTC
CTCCTCCTCCTCCTCCTCCAACAGCAGCAACCTCCCGGCCCCCTTCCGCCCCCGCCTCATCCGCAACACCCCCGTC
TTCGCCGCCCCCGTCGCCCCCGCCGCGATGGACGCCGCCGTCGACCGCCTCAAGGATGGGTTCGCCAAGTTCAAGACCG
AGTTCTATGACAAGAAGCCGGAGCTCTTCGAGCCGCTCAAGGCCGGCCAGGCACCCAAGTACATGGTGTTCTCGTGCGC
CGACTCTCGCGTGTGCCCGTCGGTGACCATGGGCCTGGAGCCCGGCGAGGCCTTCACCGTCCGCAACATCGCCAACATG
GTCCCAGCTTACTGCAAGATCAAGCACGCTGGCGTCGGGTCGGCCATCGAGTACGCCGTCTGCGCCCTCAAGGTCGAAC
TCATCGTGGTGATTGGCCACAGCCGCTGCGGTGGAATCAAGGCCCTCCTCTCACTCAAGGATGGAGCACCAGACTCCTT
CCACTTCGTCGAGGACTGGGTCAGGACCGGTTTCCCGGCCAAGAAGAAGGTTCAGACCGAGCACGCCTCGCTGCCTTTC
GATGACCAATGCGCCATCTTGGAGAAGGAGGCCGTGAACCAATCCTGGAGAACCTCAAGACCTACCCGTTCGTCAAGG
AGGGGATCGCCAACGGCACCCTCAAGCTCGTCGGCGGCCACTACGACTTCGTCTCCGGCAACTTGGACTTATGGGAGCC
CTAAATCCGACCGTCCGTCCGTTCAGTTCGTCAGTTTACGCCAACGCTTTTGCATAAGTACTACCTGAGGATATCGTCC
CCGATCATCGATGTGAACGCGTGGAGTACTACTACGTACGTACC

> SEQ ID NO: 6204 181971 241728_301551_1b
ACGAAGAAGGAAGAAGAAGAAGGAACAAGAACGGAAAAGTGGCTGGTTCTCATGACAGCATTCTTCGTTGGAGAGAATT
TCGCTGCTGGAAGCCGTCTCCTCCGGACAAGACGATGGATCCAATCGCGCTTATCTCGATGTGGTGGTCCGGAGGTTTC
TTCCATGCCTTCGATGGGCCTCCCCAGCCCCGAATTTCCGTCCTGGGATCGTTCTTCCGGTAGCTACGCGTCTCGGCTC
TGGAATGCGGCCGGATTGGGGAGAAGGACCTGTTTCTTGCAGCAGGCTGCTCATCAGGATGGTCACCAGGTTGTTC
ATCACCAGAAGACGCTGGCAGCGGAAAGGATTAAGCGGGGTTTTCAAGGGTTTAAGCAAGACACATACCGTCAAAAACC
GGAGCTCTTCGGTCGATTAGCTATCGGACAGCATCCCAAGTTCATGGTGATTGCTTGCTCTGACTCTAGAGTTTGTCCC
ACGACGATCCTGAGGTTCCAGCCAGGAGAGGCATTTGTCATCCGCAACATTGCAAACATGGTGCCTCCTCCGGAAAAGG
CTGGCTATCCAGGAACCAGTGCAGCTCTCGAGTACGCAGTCATGGTTCTCAAGGTCGAGAACATTCTAGTGATCGGACA
TAGTCGCTGTGCCGGTATCGAAGCTCTGATGACACGCAAACACA

> SEQ ID NO: 6205 181971 237891_301281_1b
GGAGGCGGTCCAGATAGCTTCTTCGTGACCCCGGGAGCTATACTTGACCCCTTGTCTGGTCGATTCATCGAGAGAACGA
AGTCGCTGTCCAATTCAATCGGTCTTGAAAGAATGGCGCCAGAGAAAACGTTCGAGGAGGCGCAGGAGATTCTTCTCCA

```
CAAGATCAAGATCTCTCCGAATCTAAAGCCGATTGCCGCAAAGAAGCTGCTGGATCTCGCCAAGGAGCTGGATGGTGGA
GAGGACGAAGAGAAGGTGGCGGATTTATCCCTGGTCGATGTTCCAGCGGCAGAGAGAATCAAGCAGGGATTTACAAAGT
TTAAAAACGGGTTCTGGCTCAAAAATCAGAAGCTTTACGAGAAGCTTTCAACTGGCCAGTCACCGAAGTTCATGATCTT
CGCTTGCTCCGATTCGCGAGTTTCTCCAACGACGATCTTGGGTCTACAACCCGGCGAAGCATTCGTTGTTCGCAACATT
GCGAGCATGATTCCAGCTTGTGGTGAGACTGGATTTCCAAGCACTAGCGCTGCTCTCGAGTATGGAGTCTTACACCTCA
AGGTGGAACATATTCTAGTGATCGGTCACAGTCGCTGTGGAGGAATCAAAGCTTTGGTCACCACTGACCCCGAGAACAA
ATGGAGTGACTTCATCCAAGACTGGATCAAAATCTCGACTTGCATTCGTTCGAGCCAAGATTCTTCGCAGGATGTCGAC
GAGCGATGCGCCTGCGGTGAAACGGATTCAGTTAACGTTTCGCTCCGCAATCTCATGACTTTTCCATGGATCAAATCGG
CAGTGGAAGGTGGAAAGTTGGCTCTTCACGGTGGCCACTACAGCTTTGTCGCTGGAACCTTTCAGTACTGGACTCTCGG
CGGCGATAAAGCCAAGTTCTAAAAGCCACGCACAAGTCTCATATATAGATATATATACATATATCTATAAACGAAGATG
AGTGGCGAAGGAGAATCATAACAACGAACAAGATAAGAACCTTTAATTCAGGAACACATAGACTTCTCCACAATTTCCT
TGAGCTGTCCAGACTGGA

> SEQ ID NO: 6206 181971 224215_300970_1b
GGGAGAACGGAAAAGTGGCTGGTTCTCATGACAGCATTCTTTGTTGGAGAGAATTTCGCTGCTGGAAGCCGTCTCCTCC
GAACAAGACGATGGATCCAATCGCGCTTATCTCGATGTGGTGGTCCGGAGGTTTCTTCCATGCCTTCGATGCAGCGGTC
CCAGGGCCTCCCCAGCCCCGAATTTCCGTCCTGGGATCGTTCTTCCGGTAGCTACGCGTCTCGGCTCTGGAATGCGGCG
GCCGGATTGGGGAGAAGGACCTGTTTCTTGCAGCAGGTTGTTCATCAGGATGGTCACCAGGTTGTTCATCATCAGGATG
GTCACCAGGTTGTTCATCATCAGGATGGTCACCAGGTTGTTCATCACCAGAAGACGCTGGCAGCGGAAAGGATTAAGCG
GGGTTTTCAAGGGTTTAAGCAAGCACATACCGTCAAAAACCGGAGCTCTTCGGTCGATTAGCTATCGGACAGCATCCC
AAGTTCATGGTGATTGCTTGCTCTGACTCTAGATTTGTCCCACGACGATCCTGAGGTTCCAGCCAGGAGAGGCATTTG
TCATCCGCAACATTGCAAACATGGTGCCTCCTCCGGAAAAGGCTGGCTATCCAGGAACCAGTGCAGCTCTCGAGTACGC
AGTCATGGTTCTCAAGGTCGAGAACATTCTAGTGATCGGACATAGTCGCTGCGCCGGTATCGAAGCTCTGATGACACGC
AACACCAAGTGGAGTTCGTTCCTTGAAGACTGGATCGAGATTGGACATCCTGCTCGTGCCACAACGCTCAAGACATCTT
CTCAGCGAGAGAAAGAACACCAGTGCACGAGATGCGAGAAGGAATCGGTGAACGTCTCTCTG

> SEQ ID NO: 6207 182002 232875_301218_1b
GGTGAAGTCTGTGGGGAAGAAATCTAGGGTTAGAAGGCCCTGCGCCAGGAAGCGGCCCAAGGGTAGTTAGAACCAGCAC
TTCGCGGCGCACCACTGACGAGTTCTTCGCGACTTTTTTGGTAGCGTATTGGAATTTGGGGCGATTCTAGTTCTCGCAA
TGGCGGCAACGCCCAGTGGCCTCCAGACCAGGGTCGGGAAGTATGAGCTGGGAAAGACGATCGGCGAGGGCAATTTCGC
CAAGGTTCGGCGAGCCAGGAATCTCGACACTGGCGAGATCGTGGCGATCAAGGTCCTCAACAAAGAGGAGGTGATGAAG
CACAAAATGGTCGAGCAGCTCAAGCGGGAGATTTCGACCATGAAGCTAGTAAAGCATCCAAACATTGTCCAGCTCCACG
AGGTTCTGGCCAGCAAAACTAAAGTTTACATCGTTTTAGAGTACGTCACTGGTGGAGAACTTTTTGACAAGATCGTGAA
ACAAACCCGCTTGAAAGAAGACGAAGCAAGGAAGTATTTCCAGCAACTCATCAATGCAGTTGACTATTGCCACAGCAGG
GGTGTGTATCACCGCGACTTGAAGCCGGAGAATTTGCTTCTCGATAAAAATGGAAACTTGAAGATCTCTGACTTCGGTT
TGAGTGCGCTTCCGCAACATCTTCGGCCGGATGGTCTACTTCACACTACTTGCGGCACTCCAAACTACGTAGCTCCTGA
AGTCATAAACAACAAAGGATACAACGGGGCCACTGCGGACTTGTGGTCGTGCGGTGTGATTCTTTACGTCTTGATGGCT
GGATTTTTACCTTTTGAAGAGCCCAACCTGATGAATTTGTACAAAAAGATCTTCCGCGCGGATTTCAAGTGTCCAAAGT
GGTTTAGCAGTGGGGCGAAGAACCTGATTTGTAAAATACTGCATCCAAATCCAAAATCTCGGATTACGATTCCACAAAT
TCTCGAGGACGAGTGGTTCAAGGTGGGCTACAAGCCAGCAAAGTTCCTTGAGGAAGATGCTGCTCATCTGAAA

> SEQ ID NO: 6208 182002 248233_301581_1b
GGGTAGTAGCGGGAATGTGCTGGATCGTTTAGCTGGGGCTTGGAGAGGCGATGGATCAGGAGCAGCAGCTGGCGCAGCA
GCAGCCGGCCAGGAGGAATGAATTCCTGCACTACAAGCTCGGCAAAACTCTGGGCATTGGATCGTTTGGCAAGGTGAAG
ATCGCGGAGCATATACTCACCGGGCACAAGGTCGCGATCAAGATCCTCAACCGCAGGAAGATCAAAGCCATGGAAATGG
AAGAGAAAGTTCGCAGAGAGATTAAAATCCTGAGGTTGTTTATGCATCCACACATCATAAGGTTGTATGAAGTTGTGGA
GACGAGCACAGACATTTACGTGGTCATGGAGTACGTCAAGTCGGGAGAGCTCTTCGACTACATTGTTGAGAATGGTCGG
CTTCATGAAGATCAAGCTCGACGTTTCTTTCAGCAGATTATATCAGGCGTCGAGTACTGCCATAGAAACATGGTAGTTC
ATCGTGATCTCAAGCCCGGAAAATCTGCTCCTGCACTCCAAATGGAACGTAAAGATTGCGGACTTTGGCTTAAGCAACAT
TATGCGAGACGGACATTTCCTTAAAACTAGCTGTGGAAGTCCAAACTATGCTGCTCCAGAGGTTATCTCTGGCAAGCTC
TATGCTGGACCAGAGGTTGACGTATGGAGTTGCGGCGTTATTTTGTATGCACTTCTTTGCGGCAGCCTTCCATTTGACG
ATGAAAACATTCCAAACCTTTTCAAGAAAATTAAGGGTGGCATCTACACTCTACCAAGTCATCTCTCTGCCGGTGCAAA
AGATTTAATCCCGCGTATGCTAGTGGTTGATCCCATGAAACGGATGACTATAGCGGAGATTCGTGAGCATCCTTGGTTC
CAAGTCAATCTTCCTCGGTATCTTGCGGTTCCGCCCCTGGACACCGCCGAGCAAGCGAAGCGGATCGATGAAGAT

> SEQ ID NO: 6209 182002 238546_301295_1b
GCAGCAGCAACTTGATGGCACCGTGGGAAAGCTGGGGCCGGGGACTTTGAGCTGCTCAATCTCGTGGGGCAGGGGCG
TTTGGCAAGGTGTTCCAGGTCCGCCTCAAGGGGAGTACCGACATCTACGCTATGAAGGTGATGAGGAAGGATAAGGTGC
```

FIG. 2 continued

```
TGGAGAAGAACTACGCCGACTATATGAAGGCCGAGCGAGACATCATGACGAAGATAGTGCACCCGTTCATTGTTCAGCT
GCGCTGCTCCTTCCAGACCAAGACCAAACTGTACCTCATACTGGACTTCATAAACGGCGGGCATCTCTTCTTCCAGCTA
TATCGTCAAGGAACTTTCAGCGAGGATCTGTGCCGGCTTTATGCAGCTGAAATTGTGAGTGCTGTGGCACACCTTCACT
CCAAAGGCATTGTACATAGGGATTTAAAGCCTGAAAACATTCTTCTCGACGCTGATGGCCATGTGAAACTCACGGATTT
CGGGTTAGCGAAGGAAATCGAGGACTCTGGCCGAACAAATTCGTACTGCGGCACGGTTGAGTATATGGCGCCCGAAATC
CTACTTGCAAAGGGACACGGAAAGGAAGCCGACTGGTG

> SEQ ID NO: 6210  182002 241487_301348_1b
GCAAAGTGTTAGAACCAGAGTCGGTAAGTATGAGATCGGCAGGACACTCGGGGAGGGTACTTTTGCGAAAGTCAAGTTC
GCCAAGCACATCAAAACTGGACATGGTGTGGCTATCAAGATTTTGGACAGAGATAGGGTTCTCAAGCACAAGATGGTCG
AGCAGATCAAGCGAGAAATTTCGACAATGAAACTTGTGAGACATCCGAATATTGTTCAAATAAAGGAGGTTATGGCCAG
CAAGTCGAAAATCTATATTGTCTTGGAGCTTGTCACAGGCGGTGAACTCTTTGATAAGATCGTCCATCAAGGCAGGCTC
AAGGACGACGAAGCAAGGAAATATTTTCAGCAGCTGATCAACGCGGTGGACTACTGCCACAGTCGTGGAGTATACCACC
GTGATTTGAAGCCTGAGAATCTGCTGCTAGACTCAAGCGGGAATCTTAAAATATCGGATTTTGGTCTGAGCGCTCTTCC
TCAGCAACTCCGGGCCGACGGCTTGCTGCATACTACTTGTGGAACTCCAAACTACGTGTCGCCCGAGGTGATCAATGAC
AAAGGTTACGACGGAGCGAAAGCAGACTTATGGTCCTGCGGGGTTATCCTTTTTGTCCTCATGGCTGGCTATTTG

> SEQ ID NO: 6211  182002 245936_301573_1b
GGAGCTAGGGGAACGATCACAACTTTGAAGAGATGAGCTTCCAAAGCAAAGTGATGAGAACTCGCGTCGGGAAGTACGA
GCTGGGAAGAACTCTTGGAGAGGGGACGTTTGGCAAAGTTAAGTATGCCAGGAACTTTGAGAGCAACGAGAGTTTTGCG
ATCAAGATTCTGGACAAGGAGAAGATCTTGAAGCACAAGATGGTCGAGCAGATCAAGCGAGAAATCTCCACTATGAAGC
TGGTGAAACATCCCAACGTCATCCAGCTCTTTGAGGTCATAGGCAGCAAAACGAAAATTTATATGGTGATGGAGTATGT
CACAGGTGGAGAAATGTTTGACAAAATTGCACGCGAGGGAAAGCTAGATGAACATAAAGCTCGAAAGTATTTCCAGCAA
TTGATTGATGCCGTGGATTATTGTCACAGCAGAGGTGTTTGTCACCGTGACTTAAAGCCGGAGAATTTGCTCTTGGATT
CAGATGGAAATCTGAAAATCTCGGACTTCGGATTGAGTGCTCTTCCTGAGCAGTGCCGAAAAGACGGCCTTCTTCATAC
AACTTGTGGAACACCGAATTATGTAGCACCCGAGGTCGTCAGTGACAAAGGCTACGACGGTTTCAAAGCGGATATCTGG
TCTTGCGGCATCGTCTTGTACGTTATCCTGGCTGGATATTTGCCATTTGACGAGCCTAATCTGGTTGCATTGTACAAAA
AGATGCATCGAG

> SEQ ID NO: 6212  182002 256506_301673_1b
TTGTGAAGCTTTTGGCGCATTCCCAGCGGCCGGGCGAGGCATCGTGATCTGGAAAGAATGCGATCCTAGTGCCGGGCA
CAGTCGATCCATCAATCGACTTCGGCGGCGGCGGCGGGGCGGCATGGTGATGCGCAAGGTGGGCAAGTATGAGATCGGT
CGGACGATTGGCGAAGGTACGTTTGCCAAGGTCAAGTTCGCGCAAAACACCGAGACCGGGGAGAGCGTCGCCATGAAAG
TGCTCAACAAGGAGACGATCCTCAAGCACAAGATGGTCGATCAGATCAAGCGAGAGATCTCTATCATGAAACTTGTGCG
TCACCCTTATGTTGTCCGGCTTCACGAGGTTCTTGCTAGCAGAACCAAAATCTACATCATTTTGGAGTTTGTTACCGGT
GGAGAGCTGTTTGACAAAATTGTGGATCAAGGGAGACTTAGTGAGAATGAGTCGCGCAAATACTTTCAGCAGCTAATTG
ATGCTGTGGACTATTGTCACAGCAAAGGAGTTTATCACCGAGATTTGAAGCCTGAAAATCTTCTCCTTGATTCGCAAGG
AAATTTGAAGATATCAGATTTCGGCTTGAGTGCTCTGCCGCAACAAGAAGATGGACTTCTTCATACAACCTGTGGAACT
CCAAATTATGTTGCTCCAGAGGTTCTTGATAACAAGGGTTATG

> SEQ ID NO: 6213  182002 109416_300038_1b
CCCACGCGTCCGCTCTTGTCTCTCTCGGTTTCGGATCCGTCGGAAGCTCTTTAATCCCCAACAAGTGCTTGTTAAAGCA
AAATAATTGGGATGCAGAAGGATGGGGTTATATAGCAGCGATTACCTTTTGGAGGCTACTAAATTTCAGTGTGCATTGT
TGTTAGTCTTCCTCATCCTTCGTGATCTCAAATATGCAGCTCACGGCACACTTAACTTCTCGTGCCAGATGCACAATGA
AGCGACAACCCTTATACATCTCGTCATGCTGAAGCACAGTCTTGTCGGAGACGGTTGAGCTCCGTAACAAGGCCTCCTG
CCTGTTACAAACGAGCATCATCACAGCAGGAGAAAGTTACTTGTAGTTGTTACTAGGATTGTCGATTCAAATGGAGGAG
AAGAAAGGAAATGTTTTGATGCAAAAATATGAGTTGGGGAGATTATTAGGTCAAGGAAATTTTGCTAAGGTTTATTATG
GAAGGAATCTTGAAACGGGACAGAGTGTAGCCATCAAGGTAATTGATAAAGAGAAGGTTCTCAAGGCCGGACTGATCGA
ACAGACTAAGAGAGAGATATCTATTATGGCACTGGTCGAACACCCAAATGTTCTACAGCTATACGAGGTTATGGCAACT
AAATCTAAGATTTACTTAGTGATTGAACAAGCCAAAGGCGGGGAGCTTTTCAAAAAATTGACAAAGGGGAGACTCAAGG
AAAATGTAGCTAGGAAGTACTTTCAACAATTGATTAGTGCTGTTGAGTGTTGCCACAACCAAGATGTTTATCACCGTGA
TCTGAAACCAGAAAATGTGCTGCT

> SEQ ID NO: 6214  182002 1114882_301805_1b
TGCAGAGGAGGGAGGATCTTCTTCACAGCCTTTCTTAGCTCACAAGGTTTTTGATTTTTAGGTGAAGGAAAAAAAGATA
TAGAAGTTTGCCTCGAAAATATACCCTCTACTTGGAAGTGAGAAACGCTTCTCCCGCTGGTTCTCTAAGACGGCGCAAA
TGCCTGAAAGATGCTCTAGCAGTAGCAGTCAAAGTGTTAAAACAAGAGTTGGAAATTTCGAGCTCGGCCGTGTTCTTGG
GCAAGGCACCTTTGCCAAGGTGAAGATTGCCAAAAATGTTGTCACCAGCCAGATTGTGGCGATTAAAATCCTCGATAAA
```

FIG. 2 continued

GAGAGAGTGCTCAAAGACAATCTCGTTAATCAGATTAAACGGGAGATTTCGACAATGAAGCTGGTGAAGCACCCCAACG
TTGTTCAACTCTATGAGGTTACAGCAAGCAAAAGCAAAATCTATTTTGTGCTAGAGTATGTCACTGGAGGCG

> SEQ ID NO: 6215 182002 1171012_302052_1b
GGCGGAGGAGGAGAGGGGCTTCGAACTCTGTGGCGAGTCTTCGGAGAAGGGGCAGGGAGAATGAGTCTTCAGAGCGTGA
GCACGCGAGTGGGGAAGTACGAGCTGNGAAGAACCCTTGGAGAGGGAACATTTGCAAAGGTCAAATTCGCCACTAATAC
CGATTCTGGTCTTTCCGTCGCCATCAAAGTCCTTGATAAGGATAAAATCCTCAGACACAAGATGGTCGAACAGATAAAG
CGTGAAATTTCGACAATGAAGCTGATCAGGCATCCAAATGTTGTACAGTTATATGAGGTTACAGCTAGCAAAACAAAAA
TCTACATTGTTCTGGAACTCGTCACTGGGGGCGAGTTGTTCGATAAAATTGTTCATCATGGAAGACTTAAGGAGGATGA
TGCGAGGAGGTATTTCCAACAACTTATCAATGCGGTTGATTTTTGCCATAGCAGAGGAGTTTGTCACAGG

> SEQ ID NO: 6216 182007 1171010_302052_1b
GCGGACGCGTGGGCGGACGCGTGGGCGAAGAACTCTGCTTCTTCAACACAGGGCTTGCCTCTCCTTCTCTCTCCTCCGC
CATCCAAGGACCCCTTCCTGTACAAGTGAAGCGATGGCGGACGGGGCAGAAACAGACAAGAACATTGAGATATGGAAGA
TCAAGAAGCTGATAAAGGCTCTTGAGTCTGCCCGTGGCAATGGTACCAGCATGATCTCTCTCATCATGCCCCTCGTGA
CCAGATCTCCCGTGTGGCTAAGATGCTCGGCGATGAGTATGGTACTGCCTCCAACATCAAGAGCAGGGTCAACAGACAA
TCGGTATTGGGTGCCATCACCTCTGCCCAACAACGTCTCAAGCTCTACAACAAGGTCCCCCCGAACGGTCTTGTCCTCT
ACACAGGTACGATTGTTACAGACGACGGCAAGGAGAAGAAGGTTACAATCGACTTCGAGCCCTTCAAACCCATCAACGC
ATCTCTCTATCTTTGCGACAACAAGTTCCACACGGAGGCCCTCAATGAGCTCCTAGAGTCGGACGAGAAGTTAGGGTTC
ATTGTTATGGACGGAAATGGAACACTTTTTGGAACCTTGAGTGGTAACACCCGTGAGGTCCTCCACAAGTTCACGGTCG
ATCTACCAAAGAAGCACGGGAGAGGAGGGCAATCTGCGCTT

> SEQ ID NO: 6217 182007 135625_300416_1b
CGCACACGAACATCACCTCAGGCGCTCGCTCGCCGCGCCGCGGCGCCCGGCCATCTCGCTCGTTCACGCAGGCGAAGAG
AGCTGTAAACACTAGCCAAGATGGGCGAGGGACATGAAACCGACAAGAACATTGAAGTATGGAAGGTCAAGAAATTGAT
CAAGGCACTTGATGCTGCCAGGGGCAACGGAACGAGCATGATTTCGCTTATCATGCCACCTCGTGATCAGGTCTCCCGA
GTCACCAAGATGCTGGGTGATGAGTATGGAACTGCCTCTAACATCAAGAGCAGAGTCAACCGTCAGTCCGTGTTGGCCG
CCATAACTTCTGCCCAACAGAGGCTGAAGCTGTATAGTCGAGTTCCCGCGAATGGATTAGTGCTCTATACTGGGACCAT
TGTCACCGATGACGGCAAAGAGAAGAAGGTCACCTTCGACTTTGAGCCGTTCAGGCCGATTAACGCTTCGCTGTATCTG
TGTGACAACAAGTTCCACACAGAGGCACTGAATGAGCTTCTGGAGTCTGATGACAAGTTTGGTTTCATAATCATGGATG
GCAACGGAACACTGTATGGTACACTTAGTGGCAACAGCAGGGAGGTTCTTTACAAGTTCAGCGTCGATCTCCCG

> SEQ ID NO: 6218 182007 155462_301356_1b
CGCGTCGCGAATAACAAGGATGTGGCAGAAGAATATGGTACTGCGTCCAATATTAAGAGCAGAGTAAATCGTCAGTCCG
TCCTTGGTGCAATAACGTCCGCCCAGCAGAGGCTTAAGCTGTATAATAAGGTACCTCCTAATGGGTTGGTCCTTTATAC
TGGAACTATAATGACCGACGATGGGAAGGAAAAGAAGGTAACCTTTGACCTTACACCTTTTAAGCCAATAAATGCGTCT
CTGTACCTATGTGACAACAAGTTTCACACGGAGCCTCTGGGCGAGCTGTTGGAATCAGATGAGAAGTTTGGTTTCATTG
TCATGGACGGTAATGGCACTCTTTTCGGAACCTTAAGTGGCAACACTAGGGAAGTCCTTCATAAATTCACTGTTGACCT
TCCCAAGAAGCACGGAAGAGGAGGTCAATCAGCTTTGCGATTTGCTCGTCTTCGAATGGAAAAACGGCATAACTATGTG
AGGAAGACAGCAGAGCTTGCTACTCAATTCTTCATTAATCCAGCCACTAGCCAGCCAAATGTATCCGGACTAATACTTG
CTGGGTCGGCGGATTTCAAGACCGAGCTAAGCCAATCTGATATGTTTGATCCGCGCCTACAAGCAAAGATACTTAACGT
GGTCGATGTGTCCTATGGTGGGGAAAATGGCTTCAATCAGGCAATCGAGCTATCTGCTGAGATTCTGGCTAATGTGAAG
TTTATACAAGAAAAGCGCTTGATAGGGAAATTCTTTGAGGAAATCAGTCAAGATACTGGAAAGTATGTGTTCGGTGTGG
ATGACACAATAAAAGGTTTGGAGATGGGAGCTGTTGAAATTCTTATT

> SEQ ID NO: 6219 182081 1101224_301474_1b
CCTCTCCCATTCGTGGATTGGCTCTTGGAGAAGAAGGGTTTCGAGGTTTCTTGGCCAGTCTATATTCTGGCAAGCGGTT
GTGAAGGTGGGCATTGCTGTCTCTGAAGGGTCTTTACATCATCATCAGGGTAGGTAACAATGTCAGGAGCAGGGCAACG
TCTAAATGTAGTCCCGACAGTAACAGTTCTAGGTGTGATTAAAACTCGTTTGGTGGGTGCAACGAAGGGGCATCAGCTA
CTAAAGAAGAAGAGCGATGCATTAACAGTACAGTTCCGTCAAATCCTAAGGCACATCGTACAGACTAAAGAGGCCATGG
GGGACTCTATGAAAGCCGCTGCTTTTGCCCTCACAGAGGCCAAATACACCGCTGGCGACAACATCAAACACGTTGTCCT
TGAAAATGTTGACTCCGCCACAGTCAAAGTCCGGTCAAAGCAGGACAACGTGGCAGGAGTCAAACTTCCCCGTTTTGAG
TTCGTGACAGAGGCAGGGGAGTCAAAGAATGATTTGACTGGTCTTGCTCGAGGAGGTCAGCAGATCCACCTCTGTAAAT
CGGCGTTTATCAAATCAGTTGAGGTTCTTGTTGAGTTGGCCTCTCTGCAGACATCGTTTCTTACCCTTGATGTGGCCAT
TAAGACCACTAACCGGAGGGTCAACGCT

FIG. 2 continued

> SEQ ID NO: 6220 182081 125225_300629_1b
GGCCCACGCGTCCGTTAAAGGCAACGTTGATAGTTGACCCCACTCCCCCGCAAGCGCCTCTCCCATCTGATTCGTGTCT
GAAATCCTCGCTATCTTTCTCTCCCATTCTGACGAATTCGACTTCTAAAGTAGCTAAGCAAAATGTCCGGGCAAAGCCA
GCGTTTGAATGTCGTTCCTACAGTTACAATGCTTGGTGTGATCAAAGCTCGCCTTGTTGGTGCTACAAGAGGCCATGCT
CTGCTCAAGAAGAAGAGTGATGCTTTGACTGTGCAGTTCCGTCAGATTCTAAAGGACATTGTGTCAACGAAGGAATCAA
TGGGAGATGTCATGAAAACTTCCTCCTTCGCTCTGACAGAGGCAAAATATGCTTCTGGCGAGAACATTAAGCATGTTGT
CCTTGAAAATGTCCAGAATGCAACCATCAAAGTTCGATCTCGCCAAGACAATATTGCGGGTGTAAAGCTCCCTAAATTC
GAGCATTTCGCTGAAGGAGAGACAAAGAATGACCTGACTGGATTAGCTAGAGGGGGGCAACAGGTGCAAGCTTGCCGTG
CTGCTTACGTGAAATCTATTGAGTTGCTTGTTGAGCTTGCCTCTCTACAGACATCATTCTTGACGCTTGATGAGGCGAT
CAAGACCACAAATCGGAGGGTTAATGCATTGGAGAATGTTGTGAAGCCACGGTTGGAGAACACAGTGCTTTACATCAAA
GGAGAACTTGATGAACTGGAAAGGGAAGATTTCTTTCGTCTAAAGAAGATACAAGGTTACAAGAAGAGGGAGGTAGAGA
GACAGATGCTGGCTTCCAAGCAATACGCAGAGGAGAAGGCTGCAGAAGAAATTTCCTTGAAGAGAGGTATTTCGCTAGG
TACAGCCCATAACTTGCTATCCCATGCTTCACAGAAAGACGAGGACATTATTTTCTGATAAGGAGGTCAAATGATTTAT
TTAAATTGCATTGCGTGGCTTGTTTTTATGTGTCCTTTATTACGAATGGATAATTGATTAGATGGAGAGTCTTTTCGCA
TTTAATAAGAGCTCTATGCATGTTTGTATTTAAAGTTAATTTATAGACAATATGGGTGGTTACCTCTTA

> SEQ ID NO: 6221 182081 142922_300474_1b
ATTCGATCTTAGCCCCGAGAATTTTGTTCTTGGCACAGTTGAGGGAACTCTTTTCTTCTGCTGAGATATCTGAATAATC
TCCTGATCTCTTTCTTCTCCGTGCAAATCTAGTTTTTAAGTAGCTTAGCAAAATGTCCGGGCAAAGTCAGCGTTTGAA
TGTTGTACCCACAGTTACGATGCTGGGAGTTATTAAAGCTCGCCTTGTTGGAGCAACAAGAGGCCATGCTTTGCTGAAA
AAAAAAAGTGATGCTTTGACTGTGCAATTCCGTCAGATTCTAAAGAATATAGTGTCAACAAAGGAATCAATGGGAGAAG
TCATGAAAGATTCCTCCTTTGCTCTGACTGAGGCAAAATATGCTGCTGGTGAGAACATCAAGCACGTTGTCCTTGAAAA
TGTCCAGAATGCAACTCTTAAAGTTCGATCTCGGCAGGAAAATATTGCTGGGGTGAAGCTTCCCAAGTTTGAACATTTC
TCTGAAGGGGAGACCAAGAATGACCTGACTGGATTAGCTAGAGGTGGGCAACAGGTACAAGCCTGTCGTGCTGCTTATG
TGAAATCTATTGAGTTACTTGTTGAGCTTGCATCGCTGCAAACATCATTCTTGACTCTTGATGAGGCAATCAAGACCAC
AAATCGGAGGGTCAATGCCTTGGAGAATGTTGTAAAGCCTCGGCTGGAGAATACAGTTCTTTACATCAAGGGGGAACTT
GATG

> SEQ ID NO: 6222 182081 126602_300465_1b
GCCATTACGGCCGGGGAGTTCGAACTCGGACAGATATTGGGATTCGATTTTCGACCCGAGAGTTTTGTTCTTGGCACAG
TTGACCCAACTCTCTTCTTCTGCCGAGTTTATCTAATCAATCTCCTCCTGATCTCCTTCTTCTCCCTTAGTAGTTTAGC
AAAATGTCCGGGCAAAGTCAGCGTTTGAATGTTGTACCCACAGTTACGATGCTGGGGTTATTAAAGCTCGCCTTGTTG
GAGCAACAAGAGGCCATGCTTTGCTGAAAAAGAAAAGTGATGCTTTGACTGTGCAATTCCGTCAGATTCTAAAGAATAT
AGTGTCAACAAAGGAATCAATGGGAGAAGTCATGAAAGACTCCTCCTTTGCTCTGACTGAGGCAAAATATGCTGCTGGT
GAGAACATCAAGCACGTTGTCCTTGAAAATGTCCAGAATGCAACTCTTAAAGTTCGATCTCGGCAGGAAAATATTGCTG
GGGTGAAGCTTCCCAAGTTTGAACATTTCTCTGAAGGGGAGACCAAGAATGACCTGACTGGATTAGCTAGAGGTGGGCA
ACAGGTACAAGCCTGTCGTGCTGCTTATGTGAAATCTATTGAGTTACTTGTTGAGCTTGCATCGCTGCAAACATCATTC
TTGACTCTTGATGAGGCAATCAAGACCACAAATCGGAGGGTCAATGCCTTGGAGAATGTTGTAAAGCCTCGGCT

> SEQ ID NO: 6223 182081 258721_301699_1b
GAGAAGCCGTCTTTCCGACGCGAATGACCTTGGGTATGATGAAGGGAAAGCTCAAGGGAGCTACCCAGGGTCACAACCT
GCTGAAGCGAAAGTCCGAGGCCCTGACCAAGCGGGTCAGAGACATTACACGAAAGATTGACGAATCGAAGCACAAAATG
GGCAGAGTTATGCAGACCGGAGCCTTCTCTCTCGCTGAGGTCACCTACGCTACCGGGGACAACATCAACTACCAAGTGC
AGGAGTCCGGCCGATCCGGTCGTCTGGGTGTGCGTGGCAAGGAAAAAAACGTCTCCGGTGTCCAGTTGGCCTCCTTTTC
TTCTTACTACGTCGAGGAGAACTCCGACTTCTCTCTCACCGGTCTTGGTCGAG

> SEQ ID NO: 6224 182229 51132_300148_1b
GCTGCCCACCCTGGAAACGGCTCAGCCGGAGGTAGGGTCCAGCGGCTGGAAGAGCACCGCACGTCGCGTGGTGTCCGGT
GCGCCCCGGCGGCCCTTGAAAATCCGGAGGACCGAGTGCCGCTCACGCCCGGTCGTACTCATAACCGCATCAGGTCTC
CAAGGTGAACAGCCTCTGGTCGATGGAACAATGTANGCAAGGGAAGTCGGCAAAATGGATCCGTAACTTCGGGAAAAGG
ATTGGCTCTGAAGGCTGGGCTCGGGGGTCCCAGTTCCGAACCCGTCGGCTGTCAGCGGACTGCTCGAGCTGCTTCCGCG
GCGAGAGCGGGTCGCCGCGTGCCGGCCGGGGACGGACTGGGAACGGCTCTCTCGGGAGCTTTCCCCGGGCGTCGAACA
GTCAGCTCAGAACTGGTACGGACAAGGGAATCCGACTGTTTAATTAAAACAAAGCATTGCGATGGTCCCTGCGGATGC
TAACGCAATGTGATTTCTGCCCAGTGCTCTGAATGTCAAAGTGAAGAAATTCAACCAAGCGCGGGTAAACGGCGGGAGT
AACTATGACTCTCTTAAGGTAGCCAAATGCCTCGTCATCTAATTAGTGACGCGCATGAATGGATTAACGAGATTCCCAC
TGTCCCTGTCTACTATCCAGCGAAACCACAGCCAAGGGAACGGGCTTGGCAGAATCAGCGGGGAAAGAAGACCCTGTTG
AGCTTGACTCTAGTCCGACTTTGTGAAATGACTTGAGAGGTGTAGGATAAGTGGGAGCTTCGGCGCAAGTGAAATACCA
CTACTTTTAACGTTATTTTACTTACTCCGTGAATCGGAGGCGGGGTACAACCCCTGTTTTGGTCCCAAGGCTCGCTTC

FIG. 2 continued

GGCGGGTCGATCCGGGCGGAGGACATTGTCAGGTGGGGAGTTTGGCTGGGGCGGCACATCTGTTAAAAGATAACCCAGG
TGTCCTAAGATGAGCTCAACGAGAACAGAAATCTCGTGTGGAAC

> SEQ ID NO: 6225 182229 111293_300053_1b
GGGAACCCCGACAGATAGCGCGTTTCGCGCGTACTCCGAAAGGGAATCGGGTTAAAATTCCTGAACCGGGACGTGGCGG
TTGACGGCAACGTTAGGAAGTCCGGAGACGTCGGCGGGGGCCTCGGGAAGAGTTATCTTTTCTGTTTAACAGCCTGCCC
ACCCTGGAAACGACTCAGTCGGAGGTAGGGTCCAGCGGCTGGAAGAGCACCGCACGTCGCGTGGTGTCCGGTGCGCCCC
CGGCGGCCCTTGAAAATCCGGAGGACCGAGTGCCGTCCACGCCCGGTCGTACTCATAACCGCATCAGGTCTCCAAGGTG
AACAGCCTCTGGTCGATGGAACAATGTAGGCAAGGGAAGTCGGCAAAATGGATCCGTAACTTCGGGAAAAGGATTGGCT
CTGAGGGCTGGGCACGGGGGTCCCATTCCCGAACCCGTCGGCTGTCGGTGGACTGCTCGAGCTGCTCCCGCGGCGAGAG
CGGGTCGCCGCGTGCCGGCCGGGGGACGGACTGGGAACGGTTCCTTCGGGGGCCTTCCCCGGGCGTCGAACAGCCAACT
CAGAACTGGTACGGACAAGGGGAATCCGACTGTTTAATTAAAACAAAGCATTGCGATGGTCCCTGCCGATGTTTACGCA
ATGTGATTTCTGCCCAGTGCTCTGAATGTCAAAGTGAAGAAATTCAACCAAGCGCGGGTAAACGGCGGGAGTAACTATG
ACTCTCTTAAGGTAGCCAAATGCCTCGTCATCTAATTAGTGACGCGCATGAATGGATTAACGAGATTCCCACTGTCCCT
GTCTACTATCCAGCGA

> SEQ ID NO: 6226 182358 184667_300671_1b
GAATTCGAGAACCCAAAACAAAAGCTGTTTTCTGTTCTTTCTGAATAAAAATGGCAACTTGGGTCTTATCAGAATGTGG
TTTAAGACCTTTGCCTCGATTAATACCAAAACCCAGAACAGGATTGTTATCAAACAATAGAAGTAGTAGTGTTAAGCTG
CCTTTGGGTGTTGTTAATAAAAAGATTGAATCAGTTGGTTCAAGAGATCTTAATCAGATTTGGTTCAATGGGCAGCTG
TATCCGGAACCAGAAGTAAAGATTGGGGATTGAAAGTTAGCGTGCCATTACAGGTTGCATCTTTGGATGGCGAAGAGGA
AGAAGAGAAGGTGAATGGGTTTATGAAGAATTCGGAATTTGACCCAAGTGCACCACCACCATTTGGATTAGCTGATATC
AGAGCTGCTATTCCTAAACATTGTTGGGTTAAGAATACATGGAAGTCTATGAGTTATGTACTTAGAGATGTTGTTATTG
TCTTTGGTTTGGCTGCTGCTGCTGCTGCTCTTAATAATTGGATTGTTTGGCCGCTCTATTGGGCGGCTCAGGGAACTAT
GTTTTGGGCATTATTTGTTCTTGGTCATGACTGTGGTCATGGAAGCTTTTCTAACAACCACAAGTTAAATAGCGTGGTG
GGGCATATTCTTCACTCGTCAATTCTTGCACCATACAATGGATGGAGAATTAGTCATAGGACTCACCATCAAACCACG
GTCACGTCGAGAATGATGAATCATGGCACCCGTTGCCTGAGAAGATCTATAGGAGCCTAAACGCAGCTACAAAGAGTTT
GCGGTTTACAGTGCCTTTTCCCCTCCTTGCATATCCATTCTACTTGTGGAGTAGAAGTCCTGGAAAGACGGGTTCTCAC
TATGACCCTAACAGCGATTTATTTGTTCCGAATGAGAGAAAGATATTATCACCTCCACGCGTGTTGGATAGCTATGG
TGGGTTTGCTTGTGGGTTTATCATGTACAATTGGTCCTATGCAAGTGCTTAAGCTCTACGGGGTTCCCTACTGGATCTT
TGTCATGTGGTTGGATTTCGTAACTTACTTACATCACCATGGCCATGAGGAAAAGCTTCCATGGTATCGTGGAAAGGCA
TGGAGTTACTTAAGAGGAGGCCTCACAACAATTGATCGTGATTATGGTTGGATTAACAACATCCACCATGACATTGGAA
CTCACGTGATACATCACCTCTTCCCACAAATACCACATTACAACCTTATAGAAGCAACAGAGGCAGCTAAACCAGTGCT
CGGGAAGTACTACCG

> SEQ ID NO: 6227 182358 146376_301065_1b
GTTTCCTTCTGCATTATAAAAAATCTTGGACCTAACATTGTTATTCTCCGCTCAGAACAGGTTCAGGGTTGAAGACTCT
GGACGAAAATCAATGGGGTCTCTGGGAATAAGTGATTTATGATAAGAGCAGCTTTAACGAGATGGAGTTTGAATTCG
ACCCGAGTGCCCCTCCTCCCGTTCCAGGCTGGCCGAGATACGAAATGCCATCCCTAAACATTGCTGGGTTAAAGATCCATT
TAGGTCCTTGAGCTATGTTGTCAGGGACGTTGTATTTGTTGCTACCTTGATTGGTATAGCAATTCACTTGGATAGTTGG
TTGTTTTACCCAGTTTACTGGCTGTCCAAGGCACCATGTTTGGGCAATCTTTGTTCTTGGACATGATTGTGGCCATG
GCAGCTTTTCAGACAGCCAGTTGCTAAATAATGTGGTTGGTCACATACTTCATTCTGCCATTCTGGTACCCTACCATGG
CTGGAGAATCAGCCACAAAACTCACCATCAGAACCATGGAAATGTGGAGACTGACGAGTCTTGGGTGCCGATGCCTGAA
AAGCTATACAAAAAGTGGGTTATTCAACCAAGTTCCTAAGATACAAGATCCCTTTTCCCTTGTTAGCATATCCGATGT
ACCTGATGAAGAGAAGTCCAGGAAAATCTGGTTCTCATTTCAACCCATACAGTGATTTGTTCCAACCCCATGAGAGGAA
GTCTGTGGTTACATCAACTCTGTGCTGGACTGTCATGG

> SEQ ID NO: 6228 186849 124991_300566_1b
AAGAAAAGTAGGGGATAATGCTTTGATGTATACGGAGTATTCAACTAATTAAGGTGAAGGGGGGAAAACCCAACAGTTC
ACCCAATTGATACAATCTGGTTGCAATTCGGAAATATAAGATCCAATTGAAGAGAGTTTACAACAACTTACAAAAAGTG
AAGGTAAAATTATTTAGCCGGTGTAAACATGGACGCCAATGGCAAGGAGGAAGATAGTGATGAGGCAAAATAAATAAT
GGTATGGACCAAAATGGAGGCGCCGCTAGTTTGCATGTTCCCAAATTCAACCACTTTTCCACGGCCGGGAAGCTGGAAT
AATAGGCCCGGAGTTAACAGCACAAACAGCACCACTGCTATCAACACTGGGCCCAGTCCGCCATTGCTCCACACGATT
AACTTGTCGGTTTGAGCAGATGAAATGAATGGAAAATGGGGGTGACTGATGACAGCCCAAGATCTAGAAAAAGTCCAAA
AGTGACG

> SEQ ID NO: 6229 186860 265946_200082_1b
TGGAATTTGTTTGGTCTTCTGATGGAGAATATGCTGTGAGAGAAAGTACTTCAAGGATTAGGATTTTCAGCAAAAATTT

FIG. 2 continued

```
CCAGGAAAAGAAGAGCATCCGGCCCACTTTCTCTGCTGAGCACATCTATGGGGGTACTTTATTGGCAATGTGCTCAAAC
GATTTCATTTGTTTCTACGATTGGACTGAGTGCAGGTTGATACGACGAATTGATGTTAATGTCAAAAACCTCTATTGGG
CTGACAGTGGTGATCTGNGTAGGCTATTGACAAGTGGATTTCCTTCATTTTTTACATACTTAAATACAATCGCGATGTT
GTCTCTGCACATTTAGATAGTGGAAGATCTGGAGATGACCAAGGTGTTGAAGAAGCTTTTGAACTTCTTTATGACATAA
ATGAACGGGTCAGAACTGGAATTTGGGTTGGAGATTGTTTCATTTACAATAATTCTTCTTCGAGGCTGAACTACTGTGT
AGGCGGTGAGGTTACCACAATGTTTCACTTAGACCGACCTATGTATTTGCTGGGATATCTTGCTAATCAAAGCAGGGTT
TTCCTGGTTGACAAAGAGTTCAATGTTGTGGGATATACTTTACTGCTCAGCTTGA

> SEQ ID NO: 6230 186860 279633_200063_1b
GTCCTACTTTCTCAGCTGAGCGCATCTATGGAGGTACTCTATTGGCGATGTGCTCAAATGATTTTATTTGTTTCTATGA
TTGGGCTGACTGTAGGTTGATACGGCGAATTGATGTTAATGTGAAGAACCTCTACTGGGCTGACAGTGGTGATATGGTG
GCAATTGCAAGTGATACATCTTTCTACATACTTAAGTATAATCGTGATGTGGTTTCTGCCCATTTAGATAGTGGAAGGT
CAGTAGATGAGCAAGGTGTTGAAGAAGCTTTTGAACTTCTTTATGAGATAAATGAACGGGTCAGGACTGGAATTTGGGT
TGGCGTTTGCTTCATTTACAATAATTCTTCATGGAGACTTAACTACTGTGTTGGGGGTGAGGTGACCACAATGTTTCAT
TTAGACCGGCCTATGTACCTGCTTGGATATCTAGCTAACCAGAGTAGAGTTTTCCTGATTGACAAAGAGTTCAATGTCA
TTGGATATACTTTACTGCTCAGCTTGATCGAGTACAAGACACTTGTGATGCGTGATGACTGGGACAGAGCAAATGAGGT
GCTGCCATTGATTCCTAAGGAGCACCATAATAGTGTTGCTCGTTTCTTGGAGT

> SEQ ID NO: 6231 186860 270621_200127_1b
TTGGCTTGATTGAGTACAAGACACTTGTGATGCGTGGCGACTGGGATAGAGCAAATGAGGTCTTACCATCAATTCCTAA
GGAGCATCACAACAGTGTTGCGCGTTTCTTGGAGTCGGAATGATAGAGGAAGCATTAGAAGTTGCTACTGACCTT
GACTACAGATTTGAACTAGCCATACAGCTGGGTAAATTAGATATTGCAAAGGAAATTGCCGTAGTGGCACAGAGTGAGT
CCAAATGGAAGCAGTTGGGTGACCTAGCCATGTCTAGTGGAAGGCTTGAGACAGCAGAGGAATGTTTGAAGCATGCAAA
TGACTTGAGTGGTTTGTTGCTACTCTATTCTTCTTTAGGAGATGCTGAAGGAATAACTGAACTAGCATCTTTTGCAAAA
GAACACGGGAAAAACATGTTGCATTCCTTTGCATGTTCCTGTTGGGTAAAGTGGACGAGTGCATTCAGCTGTTGGTTG
ACAGCAATCGGGTACCTGAGGCTGCATTTATGGCACGATCTTATCTGCCTAGTAAAGTTTCTGAAATAGTATCAATTTG
GAGAAAGGACCTCAGTA

> SEQ ID NO: 6232 186860 50058_300166_1b
TTAGGACCGGTATATGGGTTGGGGACTGCTTCATTTACAACAACTCTTCTTGGAAGCTTAACTATTGTGTTGGAGGCGA
GGTAACCACAATGTATCATTTGGACCGCCCAATGTATTTGTTAGGCTATATTGCCAACCAAAGCCGGGTTTACTTGGTA
GACAAAGAATTCAATGTCATAGGATATACCCTGCTGCTTAGCCTGATTGAATACAAGACTCTTGTGATGCGAGGCGATT
TGGATAGAGCCAATCAAATTTTACCTACAATTCCTAAAGAGCAGCATAACAATGTTGCTCATTTCTTGGAATCTCGGGG
AATGATTGAAGATGCTTTAGAAATTGCGACAGATCCAGACTACAAATTTGATCTGGCCATACAACTGGGTAGACTTGAA
A

> SEQ ID NO: 6233 186963 317483_301482_1b
TTATATCTCTATCAATGACAATTACAAATCTTACAAAGACTTTAAGGTGCTTGATGCTTTGGATAAGGCTTTAGTGGAT
AGATATCGATCCCCTTATAGTGCTATTTCTGCTTTGGTTTCTTTATGTTATCATATCTTTGACTTTAATAAGTTTAAGT
TGCTGTTTAATTGTGAAGGGAAATTTGTGGATAAGAAGCTGAGAAAAGACTTCGAGTGGTGAACTCTAGGTCCTGATGT
TTAAATCTACTGTATTTACCTTCGCATTAATTAAGCATGGCCCGCACGAAGCAGACGGCGCGCAAGTCCACCGGCGGGA
AGGCGCCGAGGAAGCAGCTGGCGACCAAGGCGTGAAGAAGCCCCACCGCTTCAGGCCCGGCACCGTCGCGCTCCGTGAG
ATCCGCAAGTACCAGAAGAGCACGGAGCTGCTCATCCGCAAGCTCCCCTTCCAGCGCCTCGTCCGCGAGATCGCCCAGG
ACTTCAAGACCGACCTCCGCTTCCAGAGCTCCGCCGTCGCCGCGCTGCAGGAGGCCGCCGAGGCGTACCTCGTCGGGCT
GTTCGAGGACACCAACCTGTGTGCCATCCACGCCAAGCGCGTCACCATCATGCCCAAGGACATCCAGCTCGCGCGCCGG
ATCCGCGGCGAGCGCGCTGCGGCCGGCTTATCCGTATGATGTTCCGGATTATGCCGAGCTCTACAAACAGCTGTTGAATT
TTGATTTGCTGAAGTTGGCGGGTGACGTGGAATCTAACCCTGGTCCTAGGTCTAGAATGGCTACTTTCTCTTGTGTGTG
TTGTGGTACCTTAACTACAAGTACTTACTGTGGTAAGAGATGTGAGCGAAAGCATGTATATTCTGAAACAAGAAATAA

> SEQ ID NO: 6234 186963 104479_300364_1b
GGGGAAAATAGTACTGATATTTCATTAAAATGCACTTCATTGAACTACATAGCCAGAACTGAGAAAGTACTACACCAAA
ACACAAAAGGCTCAAAACCCTTAACAAACAATCCACTATACACCCAAAAACTAATTTAAGCTCTCTCGCCCCTAATTCT
TCTGGCAAGCTGAATGTCTTTAGGCATAATGGTAACCCTCTTAGCGTGGATAGCACAAAGGTTAGTGTCCTCAAACAAA
CCAACAAGGTATGCTTCAGCCGCCTCTTGAAGAGCTGCAACAGCAGAGCTCTGGAACCTCAGATCGGTCTTAAAATCCT
GAGCTATCTCACGAACCAAACGCTGGAACGGAAGTTTACGGAGCTCAGTTGATTTCTGGTACTTTCTGATTTC
ACGAAGCGCAACAGTTCCAGGCCTGAATCTGTGTGGCTTCTTCACTCCACCGGTCGCCGGAGCTGATTTCCGAGCAGCT
TTTGTGGCGAGTTGCTTCCTTGGTGCTTTGCCACCAGTGGACTTACGAGCAGTTTGCTTGGTACGTGCCATTGAGAAAA
TTGAAAAATTCAGAGAACTTTCGGACTTGTAGGGTTTTCTGCTTTGAAAT
```

FIG. 2 continued

> SEQ ID NO: 6235 186963 144859_200137_1b
AGTAAAACACCACATCCCAAGTCAATACACATTAACCCAGCCATACAAACGACTCCAAAACACCAACCAAAATCACAAC
TTTCACAGCATTCTCGACCTTCTCCCCTCTTGCAAAAAATCCTTTAAAAATGGCAAGAACAAAACAAACAGCACGTAAA
TCCACTGGAGGAAAGGCACCAAGGAAGCAACTCGCAACAAAAGCTGCAAGAAAATCAGCTCCGGCAACCGGAGGAGTGA
AGAAGCCCCACCGTTTCCGTCCAGGTACGGTGGCACTTCGAGAGATCCGTAAGTATCAGAAGAGTACTGAACTTTTGAT
CCGTAAGCTCCCTTTTCAGAGACTGGTAAGAGAAATAGCGCAGGATTTTAAGACTGATTTGAGGTTCCAGAGCAGTGCT
GTGGCGGCGCTTCAGGAAGCAGCAGAGGCGTACTTGGTGGGTTTGTTTGAAGATACCAACTTGTGTGCTATCCATGCTA
AGAGGGTTACCATTATGCCTAAGGATATTCAGTTGGCTAGGCGGATTAGAGGTGAAAGGGCTTAGTGTACTTTTGTTTG
CAATTGGATTTAGTTTTTAGGTTGTCTTTTTGTTGTAATGTAATGAACTATTTGATAAAGAAAATCTGGAAAAGATTGC
TGGTTGATGGTAAAGTGTTAATTTCTTCAGCTAATTATTTAATCTTACCTTATTTT

> SEQ ID NO: 6236 186963 128950_300401_1b
GCCAGTTTGGTCGCTCTCGATTTCGATTTCCCCCAAATCCACCGCAAGAGAAAGCCAAGTCGCCGCCGAGAAGCGAAGA
GGAGATGGCCCGTACGAAGCAGACCGCCCGCAAGTCCACCGGCGGCAAGGCCCCGAGGAAGCAGCTCGCCACCAAGGCG
GCGAGGAAGTCTGCTCCGACCACCGGCGGCGTGAAGAAGCCCCACCGCTACAGGCCGGGGACGGTGGCGCTCCGCGAGA
TCCGCAAGTACCAGAAGAGCACGGAGCTCCTGATCCGCAAGCTCCCCTTCCAGCGCCTCGTCCGCGAGATCGCGCAGGA
CTTCAAGACCGACCTCCGCTTCCAGAGCCACGCGGTGCTCGCCCTCCAGGAGGCCGCCGAGGCCTACCTCGTCGGGCTC
TTCGAGGACACCAACCTCTGCGCCATCCACGCCAAGCGTGTCACCATCATGCCCAAGGACATCCAGCTCGCCCGCCGCA
TCCGCGGCGAGCGCGCGTAAGCCGCCGCCTTCGACGCGGTTGCGTTGCGTAGCGCCGAAGCGATCTGGGGGGATCAACG
ACGACGACGTGACGTGGTCAACTTGTTGATTCCCCTCTCGCTTCCGCGTTTTAGATCTCGTTTTCATTAGCAGCTTTGT
AATAGGGTTTGGTCGGTTAATTAGTGTAAAAACAGGGTTCGGTTAAAGACTC

> SEQ ID NO: 6237 186963 126687_300465_1b
GTTCGCGTGGGAAGAGAGAAAAAGAACAAGATTTCATAGGAAATGGCTCGTACCAAGCAAACTGCTCGTAAGTCTACA
GGAGGAAAAGCTCCAAGGAAGCAACTTGCTACTAAGGCTGCACGCAAGTCTGCTCCTACCACTGGTGGTGTGAAGAAGC
CACATAGATACCGCCCTGGTACTGTTGCTCTTCGTGAAATCCGTAAGTACCAGAAGAGTACTGAGCTCTTGATCAGGAA
GCTTCCTTTCCAGAGGCTTGTGCGTGAAATTGCCCAGGACTTTAAGACTGATCTGCGTTTCCAGAGTCATGCAGTGCTG
GCTCTGCAGGAGGCTGCTGAGGCCTATCTGGTGGGTCTCTTTGAGGACACTAACCTTTGTGCCATTCACGCCAAGCGTG
TGACAATTATGCCTAAGGACATTCAGCTTGCCAGGCGAATCAGGGGCGAGCGTGCTTAATTTGATCTACTAGCTTGTAG
CGTTGGTGTGATCCTTGTCTTTCTTTTCTTTGTAAGACGTAAAGACAGTAACTAAATCTAGTAGTAGGGCTTGTTGCTT
TTAATTTGCTGGTGGCTGGTGGTGTGCTGTAATTTCTTGGTGTTTTCTTTTGGAGAAGGGGGAAAACATGCTATTTGT
TTGGATCTCTAATGTTTTGTTGTCACACTACTGGTGTCGAACAATGTTTTCATCTAGTGATTAGTTGAAGTTATTGTCG
AT

> SEQ ID NO: 6238 186963 125465_300631_1b
GGACAATCAAAGCATTCTCCAATCTACATAATGGCCCGTACTAAGCAAACAGCTCGGAAATCAACAGGTGGGAAGGCTC
CAAGGAAGCAGCTAGCCACTAAGGCTGCGAGAAAGTCAGCTCCGGCGACCGGAGGAGTGAAGAAGCCTCACCGTTTCCG
TCCCGGAACCGTGGCTTTGAGGGAAATCAGGAAGTACCAGAAATCAACAGAGTTGTTGATAAGGAAGTTGCCGTTTCAG
AGGCTAGTGAGGGAAATAGCACAGGATTTCAAAACAGATCTGAGGTTCCAAAGCAGTGCTGTTGCTGCCCTACAAGAGG
CTGCTGAGGCTTACCTTGTTGGCCTCTTTGAAGATACAAATCTCTGTGCCATTCACGCCAAGAGGGTCACTATCATGCC
CAAGGACATTCAGCTCGTAGGAGGATTCGTGGTGAAAGGGCTTAGGATGAAGCTTGTTTATGCTTATGTTTATGGTTA
ATTCGTGTTCTCTGATCTAGGGCATTGCTTTTGTGTCTTTTTGCTGAATGTTAGGGTTAGTGATGTTAATCAATTGACT
TGTTTCAGTCAAAGTATATGTAAAATCTCTGGTTTATTAGTATTTTGAAATCTTATTAATGAGATTTGTCATTCATTTT
GCTGTTC

> SEQ ID NO: 6239 186963 109041_300042_1b
CCCAATCTATAAAACCTTTCATATTCAAAATGGCTCGTACTGAGCAAACAGCTCGCAAATCAACAGGTGGAAAGGCTCC
AAGGAAGCAGCTAGCTACCAAGGCAGCGAGAAAGTCAGCTCCGGCGACCGGAGGAGTGAAGAAGCCTCACCGTTTCCGT
CCGGGAACTGTGGCTTTGAGAGAAATCAGGAAGTATCAGAAATCAACAGAGTTGTTGATAAGGAAGTTGCCTTTCCAGA
GGCTAGTTAGGGAAATAGCACAGGATTTCAAGACAGATCTGAGGTTTCAGAGCAGTGCTGTTGCTGCCCTGCAAGAGGC
TGCTGAGGCTTACCTTGTTGGACTCTTTGAAGATACAAATCTCTGTGCCATTCACGCCAAGAGGGTCACTATCATGCCA
AGGATATTCAGCTTGCTAGGAGGATTCGTGGTGAAAGGGCTTAGAATGAAGCTTGTTATGCTTATGGTTATGGTTAAT
TGTCTTCTCTGATCTTGGGCATCGTTTTAGTGTCTTTTGCTGAATATTAGGGTTAGCGATGTAAATCAAGTGACTTGTT
TCAATCAAAGTATATGTAAAACCTCTAATTAGTACTTTGAATTCTTATTAATGAAATTTGTCGTTCATTTTG

FIG. 2 continued

> SEQ ID NO: 6240 186963 183522_300623_1b
CCCACGCGTCCGCAAATCCAAAGAAATCACTCGCCGCCGCCGCCTCGCCTTCTCCGCCGCGCCAAGCTCTCCTCTCCTC
CTCCTCGATGGCCCGCACGAAGCAGACGGCGCGCAAGTCCACCGGCGGGAAGGCGCCGAGGAAGCAGCTGGCGACCAAG
GCGGCGCGCAAGTCGGCCCCGGCCACCGGCGGCGTGAAGAAGCCCCACCGCTTCAGGCCCGGCACCGTCGCGCTCCGTG
AGATCCGCAAGTACCAGAAGAGCACGGAGCTGCTCATCCGCAAGCTCCCCTTCCAGCGCCTCGTCCGCGAGATCGCCCA
GGACTTCAAGACCGACCTCCGCTTCCAGAGCTCCGCCGTCGCCGCGCTGCAGGAGGCCGCCGAGGCGTACCTCGTCGGG
CTGTTCGAGGACACCAACCTGTGTGCCATCCACGCCAAGCGCGTCACCATCATGCCCAAGGACATCCAGCTCGCGCGCC
GGATCCGCGGCGAGCGCGCTTAGGCGATCCGCCCTCCTTTGGTTCTTGCTTGGTTCGTAGGGACTTGTCATGTTCTACC
AGTTCTTGTTAATTATTAGATCCTTGCCTTGTCATGTCGTAGTCTTTGATTCTT

> SEQ ID NO: 6241 186963 175601_300543_1b
CCCCCCCACTGTTCGCCTTTCCACGCCAGTTTGGTCGCTCTCGATTTCGATTTCCCCCAAATCCACCGCAAGAGCCAAG
TCGCCGCCGAGAAGCGAAGAGGAGATGGCCCGTACGAAGCAGACCGCCCGCAAGTCCACCGGCGGCAAGGCCCCGAGGA
AGCAGCTCGCCACCAAGGCGGCGAGGAAGTCTGCTCCGACCACCGGCGGCGTGAAGAAGCCCCACCGCTACAGGCCGGG
GACGGTGGCGCTCCGCGAGATCCGCAAGTACCAGAAGAGCACGGAGCTCCTGATCCGCAAGCTCCCCTTCCAGCGCCTC
GTCCGCGAGATCGCGCAGGACTTCAAGACCGACCTCCGCTTCCAGAGCCACGCGGTGCTCGCCCTCCAGGAGGCCGCCG
AGGCCTACCTCGTCGGTCTCTTCGAGGACACCAACCTCTGCGCCATCCACGCCAAGCGCGTCACCATCATGCCCAAGGA
CATCCAGCTCGCCCGCCGCATCCGCGGCGAGCGCGCGTAAGCCGCCGCCTTCGACGCGGTTGCGTTGCGTAGCGCCGAA
GCGATCTGGGGGGATCAACGACGACGACGTGACGTGGTCAACTTGTTGATTCCCCTCTCGCTTCCGCGTTTTAGATCTC
GTTTTCATTAGCAGCTTTGTAATAGGGTTTGGTCGGTTAATTAGTGTAAAAACAGGGTTCGGTTAAAGACTCAAAATCA
AATGTTA

> SEQ ID NO: 6242 186963 254085_301631_1b
ACCACGCGTCGCTTTTTCTTCTATCTTTGCCATCCTCGTTCTGGTTTTGGTAGACAGACAAGAATGGCTCGGACAAAGC
AGACCGCTCGTAAGTCGACCGGGGGGAAGGCGCCCCGGAAGCAGTTGGCCACCAAGGCAGCTCGCAAGAGTGCCCCTGC
CACAGGTGGAGTGAAGAAGCCCCACAGGTTCAGGCCTGGAACTGTTGCCCTTCGTGAGATTCGCAAATACCAGAAGAGT
ACTGATCTCTTGATCCGAAAGCTCCCCTTCCAACGCTTGGTTCGTGAGATAGCTCAAGACTTCAAGACTGATCTCCGAT
TCCAAAGCTCTGCTGTCTTGGCCCTGCAGGAGGCTGCTGAAGCATACCTAGTGGGTCTCTTTGAAGACACAAATCTCTG
CGCTATTCACGCCAAGAGAGTGACAATCATGCCTAAGGATATTCAGCTGGCCAGGAGAATCAGGGGGGAGCGTGCCTAA
GTAAATATTCCTGACCTTACCTTCTTAACGGTGTATTTGTACACCACATTTTGCCTTTGAAAGTTACATTTTGGTCTAG
TAATCTATTTCTCTGTTTCAGTGGGCATTACTAGTGATGCCTAGGCTGATGGGATGATCACTTAGTGATGATAACCTTG
GTACATTTTGATTCATGTTGTAAGTTTAGAGCATCCGATTT

> SEQ ID NO: 6243 186963 252932_301610_1b
ATAATTTTGGCGGGGTTTGGAACTGCGATTTGGAATTCCTCCTGCACTTCGACGACTTCTGATTTCCTGCGATGGCTCG
TACCAAGCAGACAGCTCGTAAGTCTACTGGTGGAAAGGCACCCAGGAAGCAGCTTGCTACTAAGGCTGCAAGGAAATCT
GCTCCCACTACTGGCGGAGTAAAGAAGCCCCACAGATACAGGCCTGGAACTGTTGCTCTTAGAGAGATCCGCAAGTACC
AGAAAAGCACAGAGTTGCTGATTAGGAAGCTTCCTTTCCAGAGGCTTGTTCGTGAGATTGCCCAAGATTTTAAGACTGA
TTTGCGGTTTCAAAGCCATGCTGTGCTGGCATTGCAAGAGGCAGCAGAGGCATACCTGGTTGGACTCTTCGAGGACACC
AACCTCTGTGCCATCCATGCGAAGAGGGTCACCATTATGCCTAAAGATATCCAGCTTGCCAGGAGGATCCGTGGGGAGA
GAGCTTAACCCGTCTTTTGCTGAAAGAACTGTAGTTATTTTAGTTATTTAATTGTTGTCATCTTGTCTTGTGCTCGAAG
TAACTGCCTTGTTACTTTGCTGTTGGGCTCGTTCCCAAGAAACTTGTGGTCTTATTGGCCAATTGTACTAGCTTAATAT
ACACTGCTTGTTTTTGAACAATGT

> SEQ ID NO: 6244 186963 236373_301249_1b
ACTTGACTTAGGGTTCTTCGCGCTAGGGTTCTTCGATCGTCTTCTCTTCGAACCGGCCATGGCGCGTACCAAGCAGACC
GCTCGCAAATCCACGGGAGGCAAGGCGCCCAGGAAGCAGCTCGCAACCAAGGCTGCCAGGAAATCCGCTCCCACCACCG
GAGGAGTGAAGAAGCCCCATCGCTACCGCCCAGGAACAGTCGCTCTTCGTGAAATTCGCAAGTACCAGAAGAGCACTGA
GCTCCTCATCCGAAAGCTTCCCTTCCAGAGGCTTGTTCGCGAGATCGCTCAGGACTTCAAGACCGATTTGAGGTTCCAG
AGCCATGCGGTGCTGGCCCTCCAGGAGGCGGCGGAGGCGTACCTGGTGGGACTGTTCGAGGACACCAATCTGTGCGCGA
TTCATGCCAAGAGGGTGACCATCATGCCCAAGGACATCCAATTGGCTCGCCGGATCCGTGGAGAGAGGGCTTAAGAGAT
TCATCAATCTTAAGAAAACTAGCTTCACCAATGTAGATACTACTACTACTACTAATCCCTCTGTTTGATTTGATTT
CAGTGCAAATGCAAAGTCTTCTGGTTGTTTGT

> SEQ ID NO: 6245 186963 232825_301218_1b
GCGGACGCGTGGGTGGAGAGGGGAAGATTTCGTCGCGCTAGGGTTTTCTGATTCGTCGTCCATGGCGCGTACTAAGCA
GACTGCTCGCAAATCCACGGGAGGCAAGGCGCCGAGGAAGCAGCTCGCGACCAAGGCCGCCAGGAAGTCGGCTCCCACC
ACCGGTGGAGTGAAAAAGCCCCATCGCTACCGCCCGGGAACAGTCGCTCTTCGTGAAATCCGCAAGTACCAGAAGAGTA

FIG. 2 continued

CCGAGCTGCTCATCCGCAAGCTGCCCTTCCAGAGGCTTGTGCGTGAGATTGCTCAGGACTTCAAGACGGATCTGAGGTT
CCAGAGCCACGCGGTGCTGGCGCTGCAGGAGGCGGCGGAGGCATACCTGGTGGGTCTTTTCGAGGACACGAACTTGTGC
GCGATCCATGCCAAGCGGGTGACCATCATGCCCAAGGACATCCAGTTGGCTCGCCGCATTCGTGGAGAGAGGGCGTAAG
CCACAGGGTGCTATTCATGACCCGTTCGCTGCTACTGATGAAGGACATAGAAAAGTCTTAGAAGGATCACTTTGTTTTG
TAATATACTATTAGAACAGCAATTCAAGTTGCTTTTGCTGTGATTTAGTCAAATAAATTTCGTGGTGTATGATTGCATT
AGCTCAATCGTTATATTTGTCACACTACTAAACTTCTATTTAATCCAAGTTCACACCC

> SEQ ID NO: 6246 186963 191076_300738_1b
CCCCCCGAATTTTTCTGCGGTTTCTTCTTCTTCTTCCTCCTCCTCGCGCTCCCCCGATTCGAAGCGTGAAGAGAGGAAC
GGCGCTTGCGAGAGGAGAGAGATGGCCCGTACCAAGCAGACCGCTCGTAAGTCCACAGGAGGAAAGGCTCCCAGGAAGC
AGCTTGCCACCAAGGCTGCTCGTAAGTCTGCTCCCACCACTGGAGGAGTTAAGAAGCCCCACCGTTACCGCCCTGGAAC
TGTTGCCCTCCGTGAGATTCGCAAGTACCAGAAGAGTACTGAGCTTTTGATCAGGAAGCTGCCCTTCCAGAGGCTTGTT
AGGGAAATTGCACAGGACTTCAAGACCGATCTGCGTTTCCAGAGCCATGCTGTCCTTGCCCTCCAGGAGGCTGCGGAGG
CATACCTTGTTGGTCTCTTCGAGGACACCAACCTGTGCGCCATTCATGCCAAGCGTGTGACCATCATGCCTAAGGACAT
TCAGCTGGCTAGGAGGATTCGTGGTGAGAGGGCTTAAATTCCCCTCGGCGATTCCTTTGACAAATGAAGCATGCGTCGT
AGTGTTAGTAGTGGGTTTTAATCTTTTGCTTATAAGAACAATCTGAGTAGGGTGTATTTTGTGGAACAATATGTTTCTC
ATGATGGTGCTGTATTCGTCTTATTGGTGGATCTGTCAAAAATACTCAGCATATTGTCAGTGTGTCTGGTGACTCTTA

> SEQ ID NO: 6247 188836 196117_300724_1b
CTACATTTACACCATCTAGTAATCTTGTTAAGCATCTCCCATACGCTGTCAACAATGGCATCATACAAGATCTTGGTTG
TCTTTGCTTTGCTAGCTCTTTCTGCAAGTGCAGCTACCGCAATCACCACCACTATACCATCTTCCCATCAACACTAGC
AATGGGCACCATGAATCCCTGTAAGCTGTACATGATGCAAACTTTGGGCATGGGTAGCTACGCAACCATGTTCATGTCA
CAACCAATTGCTCTCCTGCAACAACAATGTTGCATGCAACTACAAGGCATGATACCACAAGTGCCTTTGTGGTGCTAGT
TGTCAAATGATGCAGAACATGCAAAATGCTATTTGTGGTGGACTCGGGCAACAACAAATGATGATGAAGATGGTGATGC
AACTGCCATATGTGTGCAACATGGCACCCGCCAACTTTCAAACTCTTTCCTTATGGTTGTTGTTGATCGAATTTCAATT
ACTTTGTATAGTCAAATAACAAGTGTATGATGCATACTATCGTGTGCATCTCACACTGGTGGAGAAACCGTTTGTAGTC
CCGGTTGATAACCCCCCTTTAGTCCCGGTTTCCAACCGGGACTACGAATCCGGGACTAAAGATCGCTAT

> SEQ ID NO: 6248 188836 264911_301440_2b
GAACTGATGTGAGAGATGTAGAAGTTTTGAGTGAGATTTATATCTCTATCAATGACAATTACGAATCTTACAAAGACTT
TAAGGTGCTTGATGCTTTGGATAAGGCTTTAGTGGATAGATATCGATCCCCTTATAGTGCTATTTCTGCTTTGGTTTCT
TTATGTTATCATATCTTTGACTTTAATAAGTTTAAGTTGCTGTTTAATTGTGAAGGGAAATTTGTGGATAAGAAGCTGA
 GAAAAGACTTCGAGTGGTGAACTCTAGGTCCTGATGTTTAAATCTACTGTATTTACCTTCGCATTAATTAAGCATGGCA
GCATACACCAGCAAGATCTTTGCCCTGTTTGCCTTAATTGCTCTTTCTGCAAGTGCCACTACTGCAATCACCACTATGC
AGTATTTCCCACCAACATTAGCCATGGGCACCATGGATCCGTGTAGGCAGTACATGATGCAAACGTTGGGCATGGGTAG
CTCCACAGCCATGTTCATGTCGCAGCCAATGGCGCTCCTGCAGCAGCAATGTTGCATGCAGCTACAAGGCATGATGCCT
CAGTGCCACTGTGGCACCAGTTGCCAGATGATGCAGAGCATGCAACAAGTTATTTGTGCTGGACTCGGGCAGCAGCAGA
TGATGAAGATGGCGATGCAGATGCCATACATGTGCAACATGGCCCCTGTCAACTTCCAACTCTCTTCCTGTGGTTGTTG
TGCGGCCGCTTATCCGTATGATGTTCCGGATTATGCCGAGCTCTACAAACAGCTGTTGAATTTGATTTGCTGAAGTTG
GCGGGTGACGTGGAATCTAACCCTGGTCCTAGGTCTAGAATGGCTACTTTCTCTTGTGTGTGTTGTGGTACCTTAACTA
CAAGTACTTACTGTGGTAAGAGATGTGAGCGAAAGCATGTATATTCTGAAACAAGAAATAAGAGATTGGAACTTTAATT
AAGCATGGAGAAGGCGATCAACAGGCAGAGGGTGCTTCTCGCCCACCTGGAGCCCGCCGCGAGTCCCGCCGCCGCCGCG
CCGGCCATCACCGCGAGCGCGTGCGCCGCGGGGACAGCGCCGCGTACCACCGCGGGCGTGCTTCGCAGACGACGTCG
TCATCGTCGCTGCCTATAGGACAGCAATTTGCAAGTCCAAGAGAGGTGGTTTCAAGGATACTCCCGCAGAGGACCTCTT
GGTTCCAGTATTCAAGGCTTTGATAGATAAAACGAAGTTGAACCCAAGTGAAGTTGGTGATATTGTTGTTGGTACTGTT
TTAGCTCCTGGGTCCCAAAGGGCAATTGAATGCAGAATGGCTGCATTTTATGCTGGATTCCCTGATACCGTTCCTCTTA
TGACTGTAAACAGGCAATGTTCGTCTGGGCTTCAAGCAGTTGCAAATGTTGCTTCTAACATTAAAGCAGGACTTTATGA
CATTGGTATTGCTGCTGGCCTAGAGTCCATGACAGTGAACCAAGTTCGCCTTGATGGGCAAGTGAACCCCAAAGTTGAG
CTGTTTTCTCAAGCACGCGATTGCCTTCTCCCAATGGGCCTCACGTCCGAGAA

> SEQ ID NO: 6249 188837 190526_300693_1b
CCCCCCACCCAACTACTAACAGGCAGCTGCCAGCCATGGCTTCCTCCCCGCCGTTTCGTCTACCTCTCGCCGTTGTGCT
CCTACTCGCAATAATATGTGTCCTTTTGGCTTCTCCTAGCTGCCATGCGGACGATCTCCCCGCCACCATGACAAACGAG
CACGAGAAAGAGCATCAGCTGATGATGATGATGATGGACAGGTTCCATAGGTGGATGGCGACGCACAACCGGTCGTACG
CCTCCGCCGACGAGAAGCTGCGGCGATTCGAGGTATACCGGAGCAACATGGAGTTCATCGAGGCGACCAACCGGAACGG
GAGCCTCACCTTCAAGCTCGGTGAAACGCCGTGCACCGACCTCACCCACGAGGAGTTCCTCGCGACCTACACCGGCGAC
GTACGCCTTCCGCCGGAGCGGCGGGGGATGCAAGACGACTCCGACGAGGAGGATGCAGTGATTACAACCAGTGCTGGGT
ACGTCGCCGGCGCCGGCGCCGGTAGGCGTACGGCTGGGGTGCCGGAGTCC

FIG. 2 continued

> SEQ ID NO: 6250 188876 175162_300530_1b
CCCCCCCCGGTGGTCTCTCAGAGGTGGGTTGGCTTCTCCTCCCCCTCCCGGTTCGGTTCGGGTCCGGTTCGATTTCGGT
TTTTTCTTCGGTTCGGGGGTTGGTGGGAAAGCATGGCGGCGCCGGATGTTGAGTACCGCTGCTTCGTCGGCGGCCTCGC
CTGGGCCACCGACGACCGCTCCCTCGAAGCCGCCTTCTCCACCTACGGCGAGATCCTCGAGTCCAAGATCATCAACGAT
CGGGAGACGGGGAGGTCGCGCGGGTTCGGGTTCGTGACGTTCTCGAGCGAGCAGGCCATGCGCGACGCCATCGAGGGGA
TGAACGGCAAGGAGCTCGACGGCCGCAACATCACCGTTAACGAGGCCCAGTCGCGCCGCTCCGGAGGCGGAGGCGGCGG
TGGCTACGGCCAGCGCGGCGGAGGCGGAGGCTACGGTGGCGGCGGCTACGGTGGTGGTGGCGGCGGCGGTGGCTACGGC
CAGCGCCGTGAAGGCGGCTACGGCGGTGGCGGTGGCTACGGTGGCGGCCGTGGTGGCGGCAGCTACGGTGGTGGCTACG
GCAGCCGCGGCGGCGGCAACTCCGACGGGAACTGGAGGAACTGAGCGGTGGGGCCCTCATGGCCAAGTTATCTATCTAT
CTAATCGAGCTACCATCATCATCATCCGATCGTTATCATCGTTAGTTTTGTGTGGAACTATCTAGTTTGT

> SEQ ID NO: 6251 188876 233960_301095_1b
AATCCCTTAAACCCTAGTGCAGCAGCGGCCATGGCGATGTCTTCGTCGCTCGGCAGCGCCCTGAGGAAGGCCGCAAGCA
AGGGATCCTTGGTGCCGCCGGTACCCTCGCCGTGGCCGCCGCAGTGCCCGCCATTCAGCTGCTGAGCCGCTGTTTCTC
GACCAAGCTTTTCATCGGCGGCCTTGCTTGGGGCGTGGATGATGGTAGCTTGAGGAGCTCATTCGCTAACTATGGAGAA
GTCACTGAAGCGAGAGTTATAATGGATCGTGAGACTGGAAGGTCGAGGGGATTCGGCTTTGTGACCTTTGAGAATGATA
GCGAAGCGAAAGCAGCGGTGCAAGGAATGGACGGAAAGGAGCTTGGTGGCCGCAGCATCCGCGTGGACTACGCCTCAGA
CCGGCCAGCGGCACCAAGGCAAGACTTTGGTGGCGGTGGCGGCTACGGCGGCGGCGGTGGGAGCTATGGCGGTGGCGGT
GGCGGCTACGGCGGCGGTGGTGGGAGCTATGGCGGTGATGGCGGTGGCGGTGGCTATTGAGTGATCGAAGATCAAAGAA
GATACAGGACTTTTGCAGTGTCTGTTTAACATAAGAAAGGGGG

> SEQ ID NO: 6252 188876 251492_301657_1b
GTTCCGGATCTCTGCCCCAAAACTTGTCTTGGCCATGGCGGCAGTGGATGAATACCGATGCTTCGTTGGCGGCCTGTCG
TGGTCGACCACGGACAGCAACTTGGAGACGCATTCCGGCCGTATGGCACCGTGATCGAAGCCAAGGTGGTGCTTGACA
GGGACACCGAAAAATCACGCGGCTTTGGCTTCGTGACTTTCGAGGACGAGACTTCGATGCAAGATGCGATCGATAGCAT
GCACGGCAAGGATCTTGATGGCCGCTCCATCACCGTGAGCAAAGCTCAGCCAAAGTCCGGAGGTGGAGGCCGAGATGGT
GGCCGTGACCGAGATGGAGGCCGAGACGGGGCCGAGATGGAGGATATGGAAGGCGCGGTGGCGGCGGCGGCGGCGGCG
GCGGCGGAGGTGGAGGTGCAGGCGGAGGTGGCGGTGGTGGCTGCTTCAAGTGTGGCGAGAATGGTCACTGGGCTAGAGA
CTGTACCAGCAGCGGCGGCGGTGGCGGTGACAAGTATGGGAGCCGAGGTGGTGACCGACGTGGAAGTGGACGCTACGGC

> SEQ ID NO: 6253 188876 229011_301039_1b
AAATGGCCGAGGTCGATGTGGAGTACCGTTGGTTCGTCGGCGGCCTCGCTTGGGCGACGGACGACATGAGCCTCGGCAA
CGCATTCAAATCCTTCGGCGATGTCGTCGAATCCAAGGTGATCAACGACCGCGAGACGGGCAGATCCCGCGGCTTTGGA
TTCGTCACTTTCCGGGACGAGAAATCCATGAACGACGCCATCGAATCGATGAACGGCAAGGATCTGGATGGCCGCAACA
TCACCGTCCACCAGGCACAGCAAAGGCCGACCATGACCAGCCGCTATAGTGGATCTAACCAAGACCGCGGCGGCGACCG
TGGCAACGGCGGCGGCTACGGTGGTGCCCGGTCAGACGGTCGGTCCGATGTTGGTAACTGGAGAAGAAGCGAGTAGTAG
CAGCAGCTCGACGAGGACGGATCACGTCCAGAGTAAACTTAATTGTCGTCCATCCAGACTTGTTATTGTCTAATTCCCC
TGCTATTGTGTTGTCATACAGCTAGTGAAATACGAAACTTGTGGTTTTACCGCTNANAAAAAAAAAAAA

> SEQ ID NO: 6254 188876 176207_300520_1b
CCCCCCCCCGAAAACCCTCAGGTCGGCCTCCCTCCTCTCCTCGTCCCTCCTCCCCGCCGCCGCCGCAGCAGATTTAATC
CTCAATGGCGGCCTTCAACAAGCTCGGTAGCTTCCTCAGGCACAGTGGCTTGACAAGCAGTGCCTCGGCCGGCTCTTCC
CCTGCCATGTACAATGCTGCTCGTCTGATGTCCACCAAGCTTTTCGTTGGTGGTCTTTGGAATACTAATGACGATT
CGCTGAAAGAGGCATTCACCAGCTTCGGGGATGTGACTGAAGCTCGGGTGATCAATGACAGAGAATCTGGAAGGTCAAG
AGGGTTTGGCTTTGTTAGCTTTGCCAATGGCGATGATGCCAAGAGTGCCATGGATGCCATGGACGGTAAGGAACTTGAG
GGACGGAGTATCCGCGTGAACTTCGCGAATGAGAGACCTCCAGGGAACCGAGGTGGCGGCGGGTATGGTGGTGGTGGCG
GTGGTTATGGCAACCAAGGAGGCTATGGTGATGGCAACCGAGGCTATGGAGGGCAGTACTAAAGTGGGCACTGACTTGC
TTAAATAATGAGCTTAGGACCTGATGTGGCTTATGTGAAGCC

> SEQ ID NO: 6255 188876 271938_200039_1b
TTTACTTCGTTTTTAGGGTTTCTTCTTATTCTTATTAATCAGAAAAGAATGGCAGAAGTTGAATACAGGTGCTTCGTCG
GTGGGCTAGCATGGGCTACCACCGACCAAACACTTGGGGATGCTTTTTCTCAGTTCGGCGAAATTCTCGACTCGAAGAT
CATCAATGACAGAGAAACTGGTAGATCTAGAGGATTTGGATTTGTTACCTTCAAGGATGAGAAATCCATGAGGGACGCT
ATTGAAGGGATGAACGGTCAAGACCTTGACGGCCGTAACATCACCGTCAACGAAGCTCAGTCTCGCGGTAGCGGCGGAG
GCGGTGGTGGTGGTGGCGGTTACCGTGGTGGTGGCGGTGGAGGCTACGGAGGTGGTGGCCGTCGTGAAGGTGGATACGG
TGGTGGTGGTGGTTACGGAGGTGGCCGACGTGAAGGTGGTTATGGTGGTGGCGGCGGTTATGGAGGTGGTCGTCGTGAA
GGTGGTTACGGTGGTGGTTCTGAAGGAAACTGGAGGAGTTAGATTTCCGTTGCCTTTAGATTTATTTTTTTGTTTGAAA

FIG. 2 continued

TTTATGGTTCTACGTTTGGTTGAAGTTCCGTTATGGTTTACTTTGGTTCCTGTTACTGTCCTCGTTTTGACCGCGAGAT
TGTTACCGTGATGTTACTTGTGGATCTGTATTTACAAAGTTCTCTGGAATGAAGTGAATTAAGATTTACAGTCT

> SEQ ID NO: 6256  188876  284358_200097_1b
TTCATTCCAGCAAAGGGTTAAAAGTATGGCCTTTTTAATAGAGTTGGGAGTATTCTTAAACATAGTGTAAGCAAACACT
CAAACTTGGAACTCTCTGCCTCAAATGCGTCACTTTTCCAGGCTATAAGAAGCATGTCTTCCTCTAAGCAAATGAATGG
GGTCTCTCGTATGGCACTGATGAGAGCTCCCTGAAGGAGGCGTTTTCCCAATACGGTGAATTGATCGAAGCTAGAGTTA
TTATGGATCGTGATACTGGGAGGTCCAGAGGCTTTGGTTTTATCAGTTTTCCATCAAGTGAAGAAGCAGCAAGTGCATT
GCAGGCCATGGATGGCCAGGATCTTCATGGAAGACGGATAAGAGTGAATTATGCAACAGAAAGCGTCGTGCTGGATTT
GGAGGTGGCTTTAACTATGGTGGTGAAGGTGGAAATTTTGCAGGTGGTGGAGGTTATGCAGCCAGCAATTATGGAGGCG
GAGGAGGTGGTTATGGTAACAGTAGTGGCTTTAACTATGGTGGGGAAGGTGGAAATTCTGCAGGTGCTGGAGGTTACCC
AACCAGTAATTACGGTGGTGGATTTTCTGGTGGTAACAGTTCTACTGGTGGATATGGTAGTTATGGAGGTGGCAGTGAC
TATGGAAATGACAACAGTTC

> SEQ ID NO: 6257  188876  280167_200066_1b
TCTGTATCTGCATTGAGAAGTGGCTTAAACCCTAGCCGCTCCTCATTTGTTTCTCTCTCTCCTTAAACCCTCAAAGATT
CTCCTTCCTCAGATTTGTCAATTTATCTGTACAAATGGCTTTCTACAACAAACTCGGTGGTCTTTTGAGGCAGAACATT
TCTGGAAATGCAGTAAGTGCAACAACACCAATGCCGTCAATGCTTGATGCCTTCCGGTGCATGTCGACAAAGCTTTTCG
TTGGTGGTCTTTCATGGGGAACTGATGATCAGTCACTGAGAGATGCCTTTGCTACCTTTGGTGATGTTGTTGATGCAAG
GGTAATCGTTGACAGAGATTCTGGCAGATCAAGGGGATTTGGATTTGTGAACTTCTCAGATGATGAAAGTGCCAATGAG
GCTATTAAAGCAATGGATGGTCAGGAACTCCAAGGAAGGAATATTCGTGTTAGTATTGCCCAAGAGAGAGCTCCTCGAA
GTGGTGGTTTTGGTGGCTCTGGTGGTGGATTTGGTGGCGGCTATGGTCAAGCTAGAGACAATGATGGATACTAAGTCAC
TTTTATTTTTGATAAGCTGTCAATGTGTGCATGATAACTTTTATCTAAGTAGAGGACTTTGGTGGGATAGCTTTGTTGA
GTTTATCTATATTAAGACTTCTTTTCGTGCAAGGTTTTGGTATCAATAATTTTTCCTGATTTATGGGTAAAAA

> SEQ ID NO: 6258  188876  43324_300152_1b
AGGTTAAAGATGGCTTTTTTAGTAGAGTCGGGAGTATTCTTAAACATAGTGTAAGCAAACACTCAAACTTGGAAGTCTC
TGCCTCAAATGCGTCACTTTTCCAGGCTATAAGAAGCATGTCTTCGTCTAAGCTTTTTGTTGGGGGTCTCTCGTATGGC
ACTGATGAGAGCTCTCTGAAGGAGGCATTTTCCCAATATGGTGATGTGATCGAAGCTAAAGTTATTATGGATCGTGATA
CTGGGAGGTCCAGAGGTTTTGGTTTTATCAGTTTTCCATCAAGTGAAGAAGCAGCAAGTGCATTGCAGGCCATGGATGG
CCAGGATCTTCACGGAAGACGGATAAGGGTGAATTATGCAACAGAAAGCGTCGTCGTGGATTTGGAGGTGGCTACGGT
GGAGGTGGTGGTGGCTTTAACTACGGTGGTGAAGGTGGAAATTTTGCAGGTGGTGGAGGTTATGCAGCCAGCAATTATG
GACGCGGAGGTGGCTATGGTAACAGTAGTGGCTTTAATTATGGTGGGGAAGGTGGAAATTCTGCAGGTGCTGGAGGTTA
CCCAACCAACAATTACGGTGGTGGATTTTCTGCTGGAACACTTCTGCTGGTGGATACGGTAGCTATGGAGGTGGCAGTA
ACTATGGAAATGACA

> SEQ ID NO: 6259  188876  255654_301644_1b
GCTGCTCCTTCTCAGTTCCGGTTCGTTTCTTGGTCTGTTTTTTGTGTTCTGATACTGCAATGGCCGCTGCCGTAGAGTA
TCGCTGCTTCGTCGGAGGTCTGTCATGGGGCACAGACGACCGCGCCCTCGAGCGCGCCTTCAGCACCTTTGGGGAGGTC
ATCGATTCGAAGGTTGTTAACGATCGTGAATCGGGGAGATCTCGTGGTTTCGGATTCGTGACATTCACTCAAGAACAGT
CTATGCTTGACGCGATTGAGGGGATGAACGGGAAAGAGCTCGACGGGAGGAACATCACTGTGAATCAAGCACAAGAACG
GAACTCCGGAGGTGGTGGAGGCGGGTTTCGAAGGTCCGAAGGCCGTTACGGCGGGGGCGGGGGCGGATACGGCGGGGGC
GGTTACAGATCCGGCGGTGGAGGCAGTGGCGGATACGGCGGAGGCAGCGGTGGCTATGGCGGTGGTGGCCAAAGAAGGG
ACTCCGGCGGCTACAACGGCGGAGGTGGTGGTGGCTATGGCGGTGGAGGCCGCTACGAGTGAGAACGGATACCAGTCGG
GATTCGAACTACCGGCCTCGCTGCCAGTGGGAAATTAACTCTGTCGGGTCTCGAACTCCCGACCGGTTTCTTTTTCCTG
CCTTTTTCTTTGGAC

> SEQ ID NO: 6260  188876  255783_301643_1b
GGGAGGAGACTCCTCCGACATTTTCCCCTTTGTTCTGGTTCGTTTTTCTCTGTTTGGTTTCTCTGTTCGGGGTTCGGAA
ACATGGGGTCTGAGTACCGTTGCTTCGTCGGGGGTCTGGCTTGGTCCACTAATGACCAGGCTTTGGAATCCGCTTTCAG
TCAATTCGGAACTGTCATCGAATCGAAGGTTATCAATGACCGTGAGACTGGAAGGTCTCGTGGATTCGGGTTTGTTACA
TTCGAGGATGAGCAAGCCATGAGGGATGCAATTGAAGGGATGAATGGAAAGGATCTAGATGGCAGGAACATTACTGTAA
ATCAGGCTCAGGACAGGTCATCAAGTGGTGGTGGTGGTGGCGGCTACCGAGGAGGTGGTGGTGGCGGTGGAGGTTACCG
TGGTGGTGGTGGTGGTTACGGTGGCGGTGGCAGTGGATACCGCTCAGGTGGTGGTGGATATGGTGGTGGCGGCCAACGT
AGGGATTCTGGGTACGGTGGAGAAGGTGGTGGCTACTCTGGCGGTGGGGCTACGGTGGTGGTGGTGGATACGGTG
GAAGTGGTGGTGGTGGTGGTAACAACAGGTGGAGGGACAATTAACCAACCTATCAAAGGATGTGTAACTAGCTATT

> SEQ ID NO: 6261 188876 103793_300027_1b
TGGTATCAACGCAGAGTGGCCATTACGGCCGGGGGTTTTGGTTTTGTGACAATGTCCTCCAAAGAGGAAGTTGAAGCTG
CCTGTCAACAATTTAATGGATATGAACTTGACGGGAGGGAACTAAGGGTGAATTCTGGGCCACCACCAGAGAAGAGGGA
GAATTCTTCTTTCCGTGGAGGCAACAGGGGTGGCGGAAGTTTTGATAGCTCCAATAGAGTCTATGTAGGAAACCTCTCA
TGGGGTGTTGACCAAGACGCACTTGAGACCTTATTCAGTGAGCAAGGTAAGGTTGTGGATGCCAAAGTAGTCTATGATA
GAGATAGCGGTAGATCAAGGGGCTTCGGATTTGTAACATACAGTTCCGCTGAGGAGGTCAACAATGCAATTGAAAGCTT
GGACGGAGTTGACCTCAATGGCAGGGCCATCCGTGTAAGCCTTGCTGAAGCTCGGCCACCCAGGCGTCAATTCTGAAGG
TTGTAATCAACATCTTTTTGACAGAGAAAACGCTTGGGGGTCCAGGAGATGACAATAGTTGCAACAATGATGAGTTGGT
AAATCTGCAACTTCTACCCCAAACTTGCGCGGACGAAACACTCTCTGCTTCTGGACTAACTAGAGTTCTCAAGTAAATT
AGCTTTCGTAATGTATGTTCTGAAATTGCCCCGGGAAAAATTCTTGATCTTGTAATATGCTATCCATCCCTTGTTGAAG
G

> SEQ ID NO: 6262 188876 1098179_301483_1b
GGGTGTTGTTGTTTAGTTCGGGTTTCCTGTTTCGTTCTTTGTGGGCCGTGGATCTAGCGGAAGACACCCCGCCGTTCTC
GAGCTTCGAACAGCCGACGTTGCCTAGCTGGGATACATGGCGGCAGTGGAGTATTCCTGTTTCGTCGGAGGCCTGGCAT
GGGCCACCGACGACCGCAGCCTCGAGACCGCCTTCCGCCCCTTCGGAAATGTCACAGACTCCAAGATTATCAATGATCG
TGAAACTGGAAGGTCTCGTGGCTTTGGGTTTGTTACCTTCTCTGAGGAGCAATCCATGCTGGATGCGATAGAGGGTATG
AATGGGAAGGAGCTCGATGGAAGAAACATTACTGTAAACCAAGCTCAGAGCCGTGGTTCTGGAGGTGGAGGTGGTGGTG
GCGGTGGTGGATTCCGCAGATCTGAAGGTGGCCGATCAGGAGGAGGAGGGGGATATGGAGGAGGAGGGTATGGAGGAGG
AGGAGGGTA

> SEQ ID NO: 6263 188876 147049_200015_1b
CGTCCGATTCTCTTTAAAAATAAAAATATGGCAGCTGAGGTTGAGTCAGGTGCTTTGTAGGTGGGCTGGCATGGGCTAC
CACCGATAGAACTTTAGGAGATGCTTTTGCTCACTACGGCCAAGTTGTCGACTCGAAGATCATCAACGATCGTGAAACT
GGAAGATCAAGGGGATTTGGCTTTGTTACCTTCAGTGATGAGAAAGCTATGAGGGACGCAATTGAAGGAATGAACGGTC
AGAACCTTGACGGTCGTAACATCACCGTTAATGAAGCTCAATCACGCGGCAGCGGTGGTGGCGGCGGTGGTTTCGGAGG
TGGCAGACGCCGTGAGGGCGGATACAGTGGTGGTGGCGGATACGGTGGTGGTAGTGCGGCTATGGAGGTGGCAGACGT
GAGGGTGGCTACAGCGGTGGTGGCGGCGGCTATGGTGGTGGTTACGGAGGTGGCCGTAACCGTGGATATGGTGGCGGTT
ATGGTGGTGGTGGTGGTGATGGTGGGTCCCGCTACTCAAGAGGTGGCGGTGCATCCGAGGGAAGCTGGAGGAATTAATA
ATTTTGATTTTTAAAAAAAAAATGGTGATTATGCTTCTGGGTTGGGTAAGAGTCTATTTTTGTTACT

> SEQ ID NO: 6264 188876 142833_300444_1b
GCGTCCGTTCTTTTTTAGGGTTTCTTCTTATTAATCAGAAAAAAATGGCAGAAGGTGAATACAGGTGCTTCGTCGGTGG
GTTAGCATGGGCTACTACCGACCAAACACTTGGGGAGGCTTTTTCTCAGTTCGGCGAAATTCTTGACTCGAAGATTATC
AATGACAGAGAAACTGGTCGATCTAGAGGGTTTGGATTTGTTACATTCAAGGACGAGAAATCTATGAGGGACGCTATTG
AAGGGATGAACGGCCAGGACCTTGACGGTCGTAACATCACCGTCAACGAAGCTCAGTCTCGCGGAAGCGGTGGAGGCGG
TGGCGGTTACCGTGGTGGTGGCGGTGGAGGCTACGGAGGCGGTGGCCGTCGTGAAGGTGGTTATGGCGGCGGTGGTGGT
TACGGAGGTGGCCGTCGTGAAGGTGGTTATGGCGGCGGTGGCGGCTATGGAGGTGGCCGCCGTGAAGGTGGTTACGGTG
GTGGCTCTGAAGGAAACTGGAGGAGTTAGATTTTCCGGTTCCTTTAGATTTAATTTTTGTTTGAATTTATGGTTCTA
AGTTTGGTTGAAGTTCCGTTATGGTTTACTGTGGTTCCTGTTACTGTTCTTGTTTTTGACCGCGAGATTGTTACCGTGA
TGTTACCTAGTGGATCTGTATTTACAAAGTTCTCTGGAATCAAGTGAATTAAGATTTACAGTCT

> SEQ ID NO: 6265 188876 1109683_301523_1b
TCTTCTTATCATCCTCATCACCATCACTATCGACGTTATCGTCATCTTCAACGTCATCCTCGTCGCCATCCTCGACGCT
GTGTATCCTGCGTCGTGCATCGTCGTCGTCGTCACCATGAGTGTGGGTGGTGGAGCCGACGGGAATATAGATGCTTCG
TAGGAGGGCTCGCTTGGGCTACCGATGACCGTGCCCTTCAAGCTGCCTTCCGTCAGTTTGGCGAAGTTGTCGAATCCAA
GGTGATTAGTGATCGCGAAACTGGTCGATCTCGAGGGTTTGGATTTGTTACGTTTGGTGAGGAGAAAGCGATGAGGGAT
GCGATAGAATGCATGAATGGGAAGGATTTGGATGGGAGGAGCATCACGGTCAACCAGGCCCAAAGCCGCTCATCAGGCG
GTGGCGGGGCCGCGGTGGCCTTTCGTCGTCCAGAAGGTGGAGGTTTGGAAATGGGGGATATAATGAGGAGAGGAGAGG
CTATGGTGGTAGAGGAGGAGGAGGTAGCTATGGGGGTAAAGAGCGTGGCTGGCTATGGTGGTGGAGGTGCTCGTACAACCTAC
TCTGTTGGAGGAGGTGGCGGTGGTAAATATGGAGGACCCCTTGACCAAGGAAATTGGCGAAAGTGAATTAGGATAGATG
GATAGATAGATAGATAGATATATAGATA

> SEQ ID NO: 6266 188876 1110445_301789_1b
GCTCCCGCGTTTCGATCCGGTATCTGGTTCCGTAGTTCTAAGTTCTGTAGTTTAGTTGTAAGTAGTATTTTCTAGGTCT
AGAGTTCGAGGATGGCTGGCGGCGTCGAGTACCGTTGCTTTGTTGGAGGCCTTTCTTGGAACACTGATGACCGAAGCCT
TGAGACTGCCTTTAGCTCTTACGGCGAGGTTATCGACTCCAAGATCATAAACGACCGGGAACCGGTAGGTCTCGTGGT
TTTGGCTTTGTGACATTCGCCTTGGAGCAATCCATGTTCGATGCCATCGAGGGGATGAACGGGAAGGAGCTTGACGGCC

FIG. 2 continued

GAAGCATTACAGTGAACCAGGCCCAGGATCGTTCCAGTGGAGGTGGCGGTGGCGGCGGCGGTGGGGGTTACAGATCAGG
GCGTTCTGGTGGAGGTGGAGGAGGGTATGATGGTGAGCGAACAAGCTATGGCGGAGGGGGCCGGTCTGGTGGCGGCGGT
GGGTATGGTGGT

> SEQ ID NO: 6267 188876 1099870_301451_1b
TTCTTCTTCTTTCGAGGGGACGGCACAATAGTGTAAAGCCCAGTAGCATCTTCTTCAATGGCGCTAGCTTCTCGGTTCG
GTTCGCTCCTCCGTCGTCTGGGGGCACCGTCCTCTGCTTCGAACCAGGGATCAGCAGCACTTGCGGTAACCTCTCCTTT
CTCGCAGGTCCTCTCCAGGGGTTTCTGCGATGCGGCCGATGCCTCCCCCAAGCTTTTCATTGGCGGACTGCCATGGATT
ACTGATGATTCTTCTTTGAGGGATGCCTTTTCCTCTTTTGGTGTTGTTACTGATGCCCGTGTTATAACAGATCGTGAGA
CTGGCAGATCTAGGGGTTTTGGATTTGTTACCTTCTCTACTACTTCTGAGGCTGAGAGTGCCCTTAACTCAATGAATGG
CCGGGATCTGAATGGGAGAGCAATCAGAGTCAACTTTGCAACAGAAAGGCCGTCTGGTGGTATGGGTATGGGCAGGTTT
GGAGGTGGATGGGGGGGCTCTGGTGGAGGCGGCGGCGGTTTTGGTGGAGGGAATCGCGACGGCGGTGGTTTTGGTGGCG
GTGGTGGTGGCGGTGGTTTTGGTAGTGGTAGTGGTGGTTATGGTGGTGGTGATGACCTCAGATAGAAATGAGTACATTA
ATATAGACTGAGAGATTGGATCTTTTTATAAGAAGAGAGTGCTTTGGTGCAAAACATGAATGAC

> SEQ ID NO: 6268 188876 1097922_301456_1b
AAGGGTTTTGGTTTTCGGAAGGCTAACAACAATGGCGGAAGGGGAGTACCGATGCTTCGTGGGAGGTCTGGCCTGGGTT
ACAGATGATAGGGCTCTCGAAGATGCCTTCCGGTCCTACGGGAGGGTCACTGATTCCAAGGTCATCAGTGACAGAGAGA
CCGGGCGCTCCCGCGGATTTGGATTCGTGACGTNTGAAGACGAACAGTCGATGCTTGATGCGATCGAGGGGATGAATGG
GAAGGAGCTTGACGGGCGGAGCATTACTGTAAACCAAGCGCAAAGCCGCTC

> SEQ ID NO: 6269 188943 110870_300047_1b
AATATCTTCTCTACTCAATAATAATAATCATGGGTTTTAGCTGGCTCTCTTTCTCCTTGAGTTTCCTTCTGGTGTTGCA
CGGTACCTTTGCTCAGCAGAGATACCAACAGCAGCAAGGCGAGTGCCAACTCCATAGACTTAGCCCTCAGGAACCCACC
GTCCGCATTCAAGCCGAAGCTGGAGTCACTGAGTTATGGGATCCAAATAACCAGCAGTTCCAATGTGCTGGTGTCTCCC
TAATTCGCCACGTCATCCAGTCTAGGGGAATGCTGTTGCCTTCCTATGTTAACACACCCCTACTTGCCTATGTTGAACG
AGGTCAGGGATTTTATGGCATCATGCAATCTGGATGCCCGGAAACATTCCAGTCATCCCAGCAATTGCAGCAAGGTGAA
AGGGGTGCCGGTTCAAGATTTCAAGATCGCCACCAGAGGATTGGACAGTTTAGGCAGGGTGACATTATTGCCTTCCCTG
CTGGAGCTGCTCACTGGGTTTATAACGAAGGAAATGAGGAGCTTGTTCTTGTTGTTCTTGAAGATAGCAGTAACAATGC
CAACCAGCTTGGTCGAACTTCAAGGAGGTTCTTCATAGCTGGAAACCCACAACAAGGACAGCAACAACAGCAACAAGGA
CAATACGGTGGCCGCAGCTTGCGCAGGGAACAATTCCAATCTGGAAATGTTTTCAATGGCTTTGACGTACAGGTCTTGG
CTGAGGCATTTGGCGTAGACCAGGAGACAGCCAGGAGACTTCAGGGACAGGAAGACCAGGAGAGGCCACATTGTAAACAT
TCAGAAAGGACTCAGAGTTGTGAGGCCACCATTCTCACAGGAACAAGAGGAGCGCGAGGAGAGACAAGAGCAAGGACAA
TACGGTCCTCGCATGAACGGAATTGANGAAACCATCTGCTCCGCTAAAGTCAGGCAGAACATTGACAACCCCTCACGTG
CTGATATCTACAACCCACATGCCG

> SEQ ID NO: 6270 188943 109361_300045_1b
ATCTCTCCTAATTAGCCATGGCAGTCACTACTAGACTCCTCTTAGCTTTACTCCTCTCTGCTTTTCTCTTGTCTGCAAC
AAATGCAGTCAGAGATTTTCAGGGTCGGCAAGCTGGCCAGCGGGGTGAGAGAGGCACTCGTCTGACTGAAGCTCAACAA
TGCCGTTTAACAAGGCTCACTGCCACTCAGCCCACTAACCGAATTGAGTCCGAGGGCGGTGTCACTGAGCTGTGGGACG
AGAACGAGGAACAATTCCAGTGCGCTGGAGTTGCTCCCATAAGGAGTGTCATCCGCCGCAACTCCCTTTCTCTGCCTAA
TTTCCATCCCATGCCGCGCTTAGTTTACATTGAGCGTGGCCAGGGAATGATTGGCATTACTTACCCTGGCTGTGCTGAG
ACTTTCCAGTCTCAGTCCCAGACCTTCCAGGCTGGCCGAGAGCCATGGGAAGAGAGGGGCCAAGGCCGCAGAAGTGACC
AACACCAGAAGGTTCACCGCATTCGTCAAGGTGATGTCGTGGCACTTCCAGCTGGCGCAGCTCATTGGTGCTATAATGA
TGGTGAGGAAGAGCTTGTTGCCATCTCTGTCAACGACCTCAACCATCGCTCCAACCAACTTGATCAGAACTTGAGGGCA
TTCTACTTGGCTGGTGGAGTACCAGAAAGTGGAAGGCAACAAACTCAAGCAGGCCAAAGACTACAGAGTAGGCAGCGGT
TCCAGAACATTTTCCGTGCTTTCGATACAGAACTAATGGCTGAGGCCTTCAACATCCCTGCCGAGATTGTAAGGAGGAT
GCAAGAAGAGCAGAGCGAACGTGGCCTAATTGTCAATGTGAGGGAAGAAATGAGAATGA

> SEQ ID NO: 6271 188943 266814_200031_1b
GGGCGGACGCGTGGGAATTAGCCATGGCGGTCACTACTAGACTCCTCTTAGCTTTACTCCTCTCTGCTTTTCTCTTGTC
TGCAACAAATGCAGTTAGAGACTATCAGGGCCAGCAAGGCCGTCAGGAGGGTCTGAGAGGCACTCGTCTCACTGTAGCT
CAACAATGCCGTTTAACAAGGCTCACTGCTAGCCAACCCACTAACCGAATTGAGTCAGAGGGCGGCGTCACTGAACTGT
GGGATGAGAATGAGGAGCAATTCCAGTGCGCTGGAGTTGCTCCCATGAGGAATGTCATCCGTCGCAACTCTCTTTCTCT
TCCCAATTTCCATCCCATGCCTCGCTTGGTTTACATTGAGCGCGGCCAGGGATTGATTGGCATTACTTACCCTGGCTGT
GCTGAGACTTTCCAGTCTCAGTCCCAGACCTTCCAGGCTGGCCGAGAGCCAAGGGAAGAGAGGGGCCAAGGCCGCAGAA
GTGACCAACACCAGAAGATCCACCGCATTCGTCAAGGAGATGTCGTGGCACTTCCAGCTGGCGCTGCTCATTGGTGCTA
TAATGATGGTGAGGAAGAGCTTGTCGCCGTCTCTATCAACGACCTCAACCACCGGTCCAACCAGCTTGATCAGAACTTG

FIG. 2 continued

AGGGCATTCTACTTGGCTGGTGGAGTACCAGAAAGTGGAAGGCAACAAACCCAAGCAGGTCAAAGACTACAGAGCAGGC
AGAGGTTCCAGAACATTTTCCGTGCTTTCGACACAGAACTGATGGCTGAGGCCTTCAACATACCAGCCGAGATTGTAAG
GAGGATGCAAGAAGGTCAGAGCGAGCGTGGGCTAATTGTGAATGTGAGGGAAGGAATGACAATGATTAGGCCCGACGAA
GAAGAAGGAGAATTCGAAGAAGAGCAAGGGCGACCACGACGAGGACAGCAATGGTGGGAGGAAGCAACCGGAAATGGGT
TGGAAGAAAACATTTGCACAATGAAAATCCGCACCAACCTTGAACACCGAACACAAGCTGATATCTTC

> SEQ ID NO: 6272  188943 274469_200057_1b
GGGAAAAATGGCTTCTAACTCCTCTCTCATTTGTTTTAGCCTTTGTTTCCTCTTTCTTTTTCATGGTACTTTTGCTCAG
ATCTTTGAGCACCAGCAAGTTTGGCAGAGGATGCAACAGCAGCAGCAACATCGGGCGCTCAGGTCCAGAACTGAGTGTC
GGATCGAGCGCCTGAATGCTCAAGAGCCTACTCGTAGGTTTGAGTCTGAGGCTGGTGTCACCGAGTTCTGGGATCACAC
TCAGGAACAATTTGAGTGCGCCGGAGTCCAAGCAGTTAGGCATGAAATCCGACGAAATGGGCTTTTGTTGCCTTACTAC
AGCAACACTCCCCAGCTCATCTATATAATTCAAGGAAATGGAGTGCATTCGGCTGTGTTCCCGGGTTGTGCTGAGACAT
TCGAGACAGAGTCAGCACAATCGAGGAGGGGAGAAAGGGGAGAAAGAGGAGAAGCAGGACAAAGATTCAATGACCGTCA
CCAGAAAGTTAGACGTTTTAGAGCTGGTGATATTCTTGCTTTGCCTGCTGGTGTTACACACTGGACTTACAATGATGGT
GAAGAACCAATTATCAGTGTCTCTCTTATTGACACTTCTAACCAGGCCAATCAACTTGATCTCACCTTCAGGAAATTTT
TCCTTGCTGGAAATCCTCAACGTGGTGTACAACAACAAATGTTAGGAAGGCAACAGGAGGGAGCTCCTGGCCTAGGAAG
AAGAGGTAGTGAACAAGAGAGAGGAAGCAACATCTTGAG

> SEQ ID NO: 6273  188943 283454_200093_1b
CAAACAATGGCTACTTTCTCCTCAGTCCTCTCTCTCAGCCTTTGCTTCCTCGTTCTCTCCCACAGCTGTTTTGCTCAGC
TCTTAGAGCAACAGCAACAGAACGTATGGCAGAGACTTCAACAGCAGCAACACCGCGCTCTCAGGTCAAAAACCGA
GTGCCAAATTGAGCGTTTGAACGCTCAAGAACCAACCCGGAGATTTGAGTCTGAGGCCGGTGTTATTGAGTTCTGGGAT
GCTACCCAAGAGCAGTTTGAGTGTGCCGGAGTTCAAGCCGTTCGCCATCAAATTAGGCGAAATGGACTTTTGCTTCCTT
ACTATACCAACACTCCTCTGCTCATGTACATTATTCAAGGACGCGGTATTCACTCGACTGTGATACCGGGATGTGCTGA
GACATACGAAACAGAATCTGGAGAATCCAGAACCGGAGAAAGACGCCGGAGTTTCAATGATAGGCACCAGAAACTCAGA
CGTTTCAGAGCCGGTGATGTTCTTGCTTTGCCGGCGGGAGTCACTTTCTGGATGTACAATGATGCTGAGGAACCAATTG
TCACTGTCTCACTTCTTGACACTTCTAACCACGCTAATCAACTTGATCTCACTTTCAGGAGCTTCTTCCTAGCTGGAAA
CCCACAGCGTGGAGTACAACAACAATCTGTAGGAAGACAAGGAGAAACAACAATGCAAGAAAGGAGATCAGAACAAGAG
AGAACATCTAAAGGAGGCAACATTTTCAACGGTTTCGACACTGAAATTTTGTCCGAAGCATTCAACGTGGACGTCGAAA
CTATAAGAAGACTTCAAGGACAGAACGAAGAGAGAGGTGTAATTGTTAGAGC

> SEQ ID NO: 6274  188943 188835_300610_1b
GGCTTCCATGTCTACCATTCTTCCATTGTGCCTTGGCCTCCTTCTCTTCTTCCAAGTGTCCATGGCACAATTTTCATTT
GGGGGAAGCCCACTTCAGAGCCCACGTGGATTTAGGGGAGACCAAGATAGTCGTCATCAATGTCGTTTTGAGCACCTCA
CCGCCCTTGAGGCAACACACCAGCAGAGATCTGAAGCTGGATTCACTGAGTACTACAACATTGAGGCAAGAAATGAGTT
CCGTTGTGCCGGAGTGAGCGTGAGGCGCTTAGTCGTCGAGAGCAAGGGCTTAGTTTTACCAATGTATGCTAATGCTCAC
AAGCTTGTCTACATCGTCCAAGGTCGGGGAGTGTTTGGGATGGCACTGCCTGGTTGTCCAGAGACGTTCCAGTCAGTTA
GGTCTCCCTTTGAGCAAGAGGTGGCAACAGCTGGTGAGGCTCAATCATCAATCCAAAAAATGAGAGACGAGCACCAGCA
ACTTCACCAATTCCACCAAGGTGATGTAATCAGCAGTGCCAGCTGGAGTAGCCCACTGGCTATATAACAATGGTGATTCT
CCTGTGGTTGCTTTCACTGTCATCGACACCAGCAACAATGCCAACCAGCTCGATCCTAAAAGAAGGGAGTTTTCTTGG
CTGGAAAGCCTAGAAGTAGCTGGCAGCAGCAATCGTACTCATACCAGACAGAACAACTGAGCAGAAATCAGAACATCTT
TGCTGGGTTCAGCCCAGATTTACTTTCTGAAGCCCTGAGTGTGAGCAAGCAAACTGTGTTGAGGCTCCAAGGCCTGAGT
GACCCAAGAGGTGCCATCATTAGAGTTGAAAATGGGCTCCAGGCACT

> SEQ ID NO: 6275  188943 197846_300701_1b
TCAACCAGCCCAAGTTTCCAATAACATCCTCAAATAGCTATGGCGACCATAGCTTTCTCTCGGTTATCTATCTACTTTT
GTGTTCTTCTCCTATGCCATGGCTCTATGGCCCAGCTATTTGGTCCGAACGTAAATCCATGGCACAACCCTCGGCAAGG
AGGTTTTAGGGAGTGTAGATTTGATAGACTACAAGCATTTGAACCACTTCGGAGAGTGAGGTCAGAAGCCGGGGTTACA
GAGTACTTTGATGAGAAGAATGAACAATTCCAGTGCACAGGTACATTTGTCATCCGACGTGTCATTGAGCCTCAAGGCC
TTCTGGTACCTCGATACAGCAATACTCCTGGCATGGTCTACATCATCCAAGGGAGAGGTTCTATGGGATTAACTTTCCC
CGGCTGCCCAGCAACCTACCAACAACAATTCCAACAATTCTTGCCTGAAGGCCAAAGCCAGAGCCAAAAATTTAGGGAT
GAGCACCAAAAGATCCACCAATTTAGACAAGGAGATATCGTTGCACTGCCAGCTGGTGTTGCGCATTGGTTCTACAATG
AAGGCGATGCACCAGTTGTTGCTCTATATGTCTTCGACTTAAACAACAACGCTAATCAGCTTGAACCAAGGCAGAAGGA
GTTCTTATTGGCGGGTAACAACAACAGGGAGCAACAAATGTATGGTCGCTCAATCGAGCAACACTCTGGGCAAAACATA
TTTAGCGGTTTCAACAATGAGCTACTAAGTGAGGCCTTAGGCGTCAATGCATTGGTAGCAAAGAGGCTACAAGGCCAAA
ACGACCAAAGAGGAGAGATCATACGGGTAAA

FIG. 2 continued

> SEQ ID NO: 6276 188943 196016_300708_1b
CTATTAGCTTAAGTTTCCATAAGCAAGTACAAATAGCTATGGCGAGTTCCGTTTTCTCTCGGTTTTCTATATACTTTTG
TGTTCTTCTATTATGCCATGGTTCTATGGCCCAGCTATTTAATCCCAGCACAAACCCATGGCATAGTCCTCGGCAAGGA
AGTTTTAGGGAGTGTAGATTTGATAGACTACAAGCATTTGAACCACTTCGGAAAGTGAGGTCAGAAGCTGGGGTGACTG
AGTACTTCGATGAGAAGAATGAATTATTCCAGTGCACGGGTACTTTTGTGATCCGACGTGTCATTCAGCCTCAAGGCCT
TTTGGTACCTCGATACACAAATATTCCTGGCGTGGTCTACATCATCCAAGGGAGAGGTTCTATGGGTTTAACCTTCCCC
GGTTGCCCTGCGACTTACCAGCAACAATTCCAACAATTTTCATCTCAAGGCCAAAGTCAGAGCCAAAAGTTTAGGGATG
AGCACCAAAAGATTCATCAATTTAGGCAAGGAGACATTGTTGCACTCCCAGCTGGTGTTGCACATTGGTTCTACAATGA
TGGTGATGCACCTGTTGTTGCCGTATATGTTTATGACGTAAACAACAACGCCAATCAGCTTGAACCCAGGCAAAAGGAG
TTCCTATTAGCCGGCAACAACAATCGGGCTCAACAACAAGTATATGGTAGCTCAATTGAGCAACACTCTGGGCAAAACA
TATTCAGCGGATTTGGTGTTGAGATGCTAAGTGAGGCTTTAGGCATCAACGCAGTAGCAGCAAAGAGGCTACAGAGCCA
AAATGATCAAAGAGGAGAGATCATACATGTGAAGAATGGCCTTCAATTGTTGAAACCGACTTTGACACAACAGCAAGAA
CAAGCACAAGCACAAGATCAATATCAACAAGTTCAATACAGTGAACGACAGCAAACATCTTCTCGATGGAACGGATTGG
AGGAGAACTTTTGCACGATCAAGGCGAGAGTAAACATTGAAAATCCTAGTCGTGCTGATTCATACAACCCACGTGCCGG
AAGGATAACAAGTGTCAATAGTCAGAAGTTCCCCATCCTTAACCTCATCCAAATGAGCGCTACCAGAGTAAACCTATAC
CAGAATGCTATTCTCTCGCCGTTCTGGAACGTCAATGCTCAT

> SEQ ID NO: 6277 188959 217634_300910_1b
TCCTGCACACACGCACAACTGCAGCCATGCTCTCTTTTATCCTCATCCAGAACAGACAGGGCAAGACCCGTCTCGCCAA
ATGGTACGCCCCCTACAGCGACGACGAAAAGATCAAGCTCAAGGGCGAGGTCCACCGCCTCGTCGCCCCCGCGACCAA
AAGTACCAGTCCAACTTCGTCGAGTTCCGCAACAACAAGATCGTCTACCGCCGCTACGCAGGGCTCTTCTTCTGCGCCT
GCGTCGACACAAACGACAACGAGCTCGCCTTCCTCGAGGCTATCCACTTCTTCGTCGAGGTCCTCGACGCCTTCTTCGG
AAACGTCTGCGAGCTCGACCTCGTCTTCAACTTTTACAAGGTGTATGCTATTCTTGACGAGGTCTTTCTTGCGGGCGAG
ATTGAGGAGACGAGTGAAACAGGTGTTTTGACGCGGCTGGAGCATCTGGATAAGCTGGAATAGTAGCGCGTGGGAGGGA
CGCGTCTTTTTTTTTACAAAAACCCTTTTTTTTCTGGCGTTATATATTCTCCCCCCTTACACTTCTTCCTTTGTCCTCT
TTAATGAAGAGAAG

> SEQ ID NO: 6278 188959 233995_301095_1b
GGGGGAGATTATGGCGATTCGATTCGTGTTGCTGGTGAACAAGCAAGGTCAGACGCGATTGGCGCAGTACTACGAGCAG
CTGACGATCGACGAGCGCCGGGCGCTGGAGGGCGAGATCGTGAGGAAATGCCTGGCGAGGACGGAAAATCAGTGCTCGT
TTGTAGAGCACCGGAATTACAAGGTCGTGTATCGGCGCTACGCTTCTCTCTTCTTCCTCGTTGGAGTAGACAGCGAAGA
GAATGAGCTAGCGATACTGGAATTCATCCATTGCGTCGTGGAGACAATGGATCGCTACTTTGGCAATGTGTGCGAGCTG
GATATAATGTACCATTTGGAGAAGGCCCATTTTATCCTGGAAGAGATGGTGATGAATGGCTGCATTCTAGAGACCAACA
AGAGTAATATTCTGGGGCCTATACAGCTTATGGACAAATCGTCCTAGTAACAAAGTACGTGTCGTCCCCAAGGTAGATT
TCTGACGACCTGGATTTGGAAATCTCGACGAGCTATGGCTGGAAATAAAGGAGACTTTG

> SEQ ID NO: 6279 188959 257918_301687_1b
GCGATCTCGACGAGATGATCAGATTTATTCTGCTGCAAAATCGGCAGGGAAAGACTCGTCTCGCCAAGTACTACGTCCC
ACTCGAAGACTCTGAGAAGCAAAAGCTCCAGTATGAGGTCCACAGGCTCGTTGTCAATCGGGATCCAAAATTCACGAAC
TTTGTCGAGTTTCGCACACACAAGGTGATCTATCGACGCTATGCCGGGCTCTTCCTTTCAATGTGTGTGGACATCACCG
ATAACGAGCTGGCCTATCTGGAGAGCATCCACCTCTTTGTGGAAATTCTAGACCATTTCTTCAGCAACGTCTGCGAGCT
TGATCTGGTTTTCAAACTTCCACAAGGTTTACTTGATCCTCGACGAGTTCATTCTCGCTGGCGAGTTACAAGAAACCAG
CAAAAAGGCAATAATCGAGCGCATGGCAGCGTAGAGCGGCAGGAATAAGCATACTCGATCGTCTCAGTTTTTCAAAAC
GCGATAGGCAGCCTCCGGGCACGCACAAAGGCATCGAGTNTATCCCAAAACTCGAGAACTGCCGTTCGGTCCTGGTGCC
TCTTGTGCTTGCTCAGCTGTTTAAGCAAACAAAGAAGTGTAAGAAGTCATTCGAATTC

> SEQ ID NO: 6280 188959 1114040_301842_1b
GTTGGAAGGGATTCGGGAGAGAAGAAGAGAGAGAGAGAGAGAGAGAGAGGGGGGATGACGATCCGATTCATACTA
CTGGTGAATAAGCAGGGGCAGACAAGGCTCGCACAGTACTACGAGTACCTCACCATCGACGAGCGTCGCGCCCTTGAAG
CTGAGATCGTCCGTAAATGGCTCGCTCGCACCGATTCGCAGTGGTCTTTTGGAGAGCATCGCAACTACAAAGTTATTTA
CAGGCGTTACGCATCTCTCTTTTCTTGGTTGGAGTGGATATGGATGAGAATGAGCTGGCCATATTGGAGTTTATACAT
TTCATGGTGGAGACAATGGACCGCTATTTTGGAAATGTGTGCGAGCTTGATATAATGATCCACTTGGAGAAGGCGCATA
TTATGTTGGAAGAAATGGTTATGAATGGGTG

> SEQ ID NO: 6281 188959 127534_300470_1b
CCCCACACCCCTATTGGTTGTTGTACTAGGGGATCCTGGTTACATTGAAGATCCATCTTTCAACCGGAAGAACGTCAA
TTCCAAAAACCCAAGCAAACCAAAACCAGGCAAAGTTCTCTTTTCAATTGAATAAAGTCAAAGTAATCTATTGCTGATT
CCTTAATCAAAATCGAGAAGAAATATGGGGATCAGATTCGTATTAATGGTAAATAAGCAAGGGCAAACTCGGCTGGCTC

FIG. 2 continued

AGTACTACGAGTACCTCACTTTAGAAGAAAGGCGTGCTCTTGAGGGTGAAATTGTGCGTAAATGCCTTGCTCGCAATGA
ACAGCAGTGTTCATTTGTGGAGCATCGTAATTACAAAATCGTGTACAGGCGGTATGCATCACTCTTTTTCCTGGTTGGA
GTTGATAATGAAGAAAATGAACTTGCTATTTTGGAATTCATTCACCTGTTAGTTGAAACCATGGATCGTCATTTTGGCA
ATGTGTGCGAGCTGGATATAATGTTTCATCTTGAAAAAGCACACTTCATGCTGGAGGAGATGGTAATGAATGGGTGTGT
TGTTGAGACAAGCAAGGCAAACATTCTGGCTCCAATTCAGCTAATGGAAAAGGCATCATAAGTAGTACACTCTGATCCA
TGGAATTCGTAATAAACCGATTTGCTTGTGTAGTGTTTACGTTTTGGGATTTGTGCT

> SEQ ID NO: 6282  188984  196092_300708_1b
GGACCCACGCGTCCGCAAAAAAAGAAAGATCTAGTGTCCCGTAGCAATGAAGATCATTTTCGTCTTTGCTCTTCTTGCT
ATTGCTGCTTGCAGCGCCTCTGCGCAGTTTGATGTTTTAGGTCAAAGTTATAGGCAATATCAGCTGCAGTCGCCTCTCC
TGCTACAGCAACAGGTTCTTAGCCCATATAATGAGTTCGTAAGGCAGGAGTATGGCATAGCGGCAAGCCCCTTATTGCA
ATCAGCTGCGTTTCAACTGAGAAACAACCAAGTCTGGCAACAGCTCAGGCTGGTGGCGCAACAGTCTCACTATCAGGAT
ATTAAAATTGTTCAGGCCATAGCGCAGCAGCTGCAACTCCAGCAGTTTGATGATCTCTACTTTGATCGGAATCTGGCTC
AAGCTCAAGCTCAAGCTCTGTTGGCTTTGAACTTGCCATCTAGATATGGTATCTACCATAGGTACTATAGTGCACCTAG
TAGCATTACCACCCTTGGCAGTGTATTGTACTGAGTTTTAACAATATAGTGGTTCGGAAGTTGAAAATAGGCTCAGATA
TCATCATATTCGACATGTGGAACTCAGGTTGATATATCCTAGTACATCATCGTAACTAATTACCATCGTTGGTACTCT

> SEQ ID NO: 6283  188984  197266_300700_1b
CCCACGCGTCCGCCTTACTGAAAAATCACAAACATCAAAACGTTATAAGAGTTCTCTAGCATCCATCACATAGCCATGA
AGATCTTTGTCATCCTCTCTCCTCGCCCTCGCAGCGAGCAGCGCCTCGGCACAGTTTGATGCTTGCACCTATGGGCA
ATGCCAGCAGCAGCCGTTTATGCAACCGATCATGAACCCGTGCAATGAGTTCGTGAGGCAACAGTGCAGCCCGATGAGC
CTACCTTGGGAGCAGTCACGCAGGCTACAACTGAGCAGCTGCCAGGTGATGCGGCAGCAATGCTGTCAGCAGATGAGGT
TGATGGCGCAACAATATCATTGCCAGGCTATTTGCACCATGGTGCAGTCTATCATGCAGCAAGTGCAGTTTGATGCTGG
CTTTGTTGGCGAGCCCCAAGCTCAGGCCCAGGCCCAGGTGGCTCTCAATTTGCCCTCCATGTGTGGAGTCTACCCTAGG
TACTGCAGCACTCCATGCAAAGTTGCTACTGGTCATTGCGGTTCTTGGTAGTGTGTACCATCATATATATATAGTTGGA
TAAATAAAGTGTCACACATCATCGTGTGTGTCATGT

> SEQ ID NO: 6284  194652  234837_301221_1b
TGCACCAACACCATCAGCACCATCAACACCATCAGCAGCAGCAGCAGCAGCTGCAGCATCAACTCCAGCAGCAGCAGCA
GCAGCAGCAGCAGGAGCACGCTCGAGGAGGCTGGCAGGACTATTATGCTCGGAGGGCAAGGCCCTCTGAACACGATCAC
GCCGTGTGCTGCATGCAAGCTGCTCCGACGGAGGTGCGCGCAAGAGTGTCCCTTTGCTCCCTACTTCTCTCCCCACGAG
CCGCAGAAATTCGCTGCCGTGCACAAAGTTTTTGGCGCCAGCAACGTCTCCAAGATGCTCTCGGAAGTTCCCGAGGCGC
AGCGAACGGACGTTTGCAAACAGCCTGGTCTATGAAGCCAACGCTCGGATCCGAGACCCCGTATACGGCTGCACGGGGA
CGATCTCTGGCGCTGCAGCAGCAATCTCAGACGCTCCAGGCGGAGCTGAGCGCAATGAGGGAGGAGATCGTGAGGTACC
GGGTGCACG

> SEQ ID NO: 6285  194652  120435_300385_1b
ATGCTTCAGGAGTTACCGGAACATCAACGGGGCGATGCCGGGAGTTCAATGGTGTATGAGGCAAATGCTAGAGTTAGAG
ATCCAGTTTATGGTTGTGTTGGAGCTATATCATCTTTGCAACAACAAATTGACCATCTCCAAACACAATTGGCAATTGC
ACAAGCTGAGGTTGTACACATGAGGATGCGACAATTTTCATCCATGTCTAGAGGCGGCGGCACAGCCGGAAACTCGCCG
GAAACGTGTCACCATCGTCCCGACACACTCAAACTCAACCAACCATGTCCCTTTTTACCATGGACATGGTGGTTGATC
ATGCTAATGTGGGGGAGTCCTTATGGTCATGCTAGCTTGTAATTTATATAGTTCAGACTCTTTAAAATATCGTTGGATG
CGGGTCGGATCCATATAAATACTTCAATATTTTTGAAGCGTTTGAATAGTTAGTAATTATTTAGCTAGCTAGTTGCTTG
ACTAGCATGCTTAACTAGTCTTTTCTTATATTTGCTATCAATATCTTACTTTATTGTCTGCTTCAATTTTTTTTTTTT
TTCTTACTATACATCTTTATATAGCACATCTCTAGCTGACCCCTCAAGAGATGATGATGACCATTATTAACCATA

> SEQ ID NO: 6286  200602  226438_301034_1b
ACAAGACACACAAAAATGGACCGACTTAACAACCTCGCCACCCAGCTCGAGCAGAACCCCGCCAAGGGCCTCGACGCTA
TCACCTCCAAGAACCCCGATGACGTTGTCATCACCGCCGCCTACCGAACTGCCCACACCAAGGGAGGCAAGGGTCTGTT
CAAGGACACCTCTTCTTCCGAGCTGCTCGCCTCTCTGCTGGAGGGCCTCGTCAAGGAGTCCAAGATCGACCCCAAGCTC
ATCGGTGATGTCGTCTGCGGGAAACGTTCTCGCTGCCGCTGGTGCCTGCCACTGAGCACCGAGCTGCCTGCCTTGTTGCCG
GCATCCCCGAGACCGTTCCCTTCGTCGCTCTCAACGACAGTGCTCCTCTGGTCTGATGGCCGTCAACGACGTTGCCAA
CAAGATCCGAGCCGGCCAGATTGACATTGGTATCGGCTGTGGTGTCGAGTCCATGTCCAACCAGTACGGTCCCAACTCC
GTCACCCCCTTCTCCAACAAGTTCCAGAACAACGAGGAGGCTAAGAAGTGCCTGATCCCCATGGGTATCACTTCCGAGA
ACGTTGCCGCCAAGTACAACGTGTCCCGAAAGGCCCAGGACGCCTTTGCTGCCAAGTCCTACGAGAAGGCCGCCGCTGC
CCAGGCCG

> SEQ ID NO: 6287  200622  103458_300026_1b

FIG. 2 continued

TGGTATCAACGCAGAGTGGCCATTACGGCCGGGGCTTCCATTCACCAAAAAGCCTCGTTTCCTCCGTAGACACCCTCAG
CCTTCTCTCTCTTCTAGCCTTTTGTCTTGAAGAGACAAAATCAAGCCAATTTTGATCTTTGTTTCATCTTTGCTCTACA
GTCTTTCTTTTTTGTTTGTTGAATAATGGGGGGCTGAAACTAAGGTGTTTACTTTGGCTGAGGTCTCCCAGCACAACAA
CGCCAAGGATTGTTGGTTGGTTATTAGTGGCAAGGTATATGATGTGACAAAATTCTTGGATGACCACCCAGGAGGTGAT
GAGGTTTTGTTGTCTGCAACTGGAAAGGATGCAACAGATGATTTTGAGGACGTTGGCCACAGCAGCAGTGCTCGAGCGA
TGTTGGATGAGTATTACGTAGGTGATATTGATTCAGCGACCATCCCCACCAAGACCAAGTACACTCCTCCCAATCAGCC
ACATTACAACCAGGACAAAACATCAGAGTTTGTCGTCAAGCTCCTCCAATTCTTAGTTCCCCTGATTATTTTGGGTGTT
GCTTTTGGCATCCGCTTCTATATCAAACAGTCATCAGCTTGAAGATGGAGTTCGTGGTGAAGTCATAAGAAGTGTCCAG
AAGAAAGGTTGTGTGTGTGTGTGGGGGGGGGG

> SEQ ID NO: 6288 200622 158558_200019_1b
CCTTTCTTCTCTTCACTCTTCAATTCTTGTGTTAGTAGTCTTGACACCCAATTCAAGATTCATTACATCTTTCATTTCT
CCATTCCAATTGAGGAGTAATTTTTTTGCTGTGTCCATAAATGGGTGGTGAAACTAAGGTTTATACGTTGGCTGAAGTT
GCCCCTCACAACAATAACAAAGATTGTTGGCTTGTTATTAGTGGCAAGGTGTACGATGTGACAAAATTCTTGGACGACC
ACCCAGGTGGCGATGAGGTTTTGTTGGCTGCTACGGGAAAGGATGCAACTGATGATTTTGAGGATGTCGGCCACAGCAC
CAGTGCTCGAGCAATGTTGGATGAGTATTACGTAGGCAATATTGATTCAGCAACCATCCCTACAAAAACCAAGTACACT
CCTCCTAATCAGCCTCATTACAACCAGGACAAAACATCCGAGTTTGTAATTAAGCTCCTCCAGTTCTTAGTTCCCCTGA
TAATATTGGGTGTAGCTGTTGGCATCCGCTTCTACACCAAACAACAATCAGCTTGAAGATTGAGTACGCGATGAATTCA
TAATAAGTGTCCACATTTCCGAAATGTGACCCTTACCCACCCCAAAGAAAACCCCCCACCAAAGATAAGCTAGAGAAG
AAAAAAAAAAATGCTTTTTATTTTTCTATTTCTGTGACTTCATAGTTACACTGTTCGTGTT

> SEQ ID NO: 6289 200622 154693_301256_1b
GCACGAACGGAGAGAGAAAGAGAATCCGAAGAAACTCTGTTTCTCTCTCTTGTAGCAGGAAAAGATGGCATCAGATGGG
AAACTTCATGGATTTGAGGAGGTTGCCAAACACAACAAGACCAAAGATTGCTGGCTTATTATCAGCGGAAAGGTGTATG
ATATAACTCCATTTATGGATGATCATCCTGGTGGTGATGAAGTTTTGCTTTCAGCAACTGGGAAAGATGCAACCAATGA
CTTTGAAGATGTTGGCCACAGTGATTCTGCTAGAGAGATGATGGATAAGTATTACATTGGGGATATCGATGTGTCAACA
GTTCCCCTAAAACGTTCTTATGTTCCACCGCAACAAGCCCCATACAATCCAGACAAGACTCCAGAATTCATTATCAAAA
TTCTACAGTTCCTTGTACCCCTCTTGATCTTGGGCTTGGCCTTTGCAGTACGACACTACACCAAGGAGAAGTAAATTCT
TCTGGATTCCAGTTTGCATCAGTCCACTTATTCTTGATTTATGTAGTTGTTTAACGAACACTTGGTTTATCTTGTTTTA
GTTCATTATCGAGCTACAACAACTGAATGTGATCATCAATTTTGTGCTGTCCTTTGCAACTGCTTTGTCTGGTAAAAAA
A

> SEQ ID NO: 6290 200622 144719_200013_1b
AGCGTGGGGCTGTTGGCAGCGGGCGAAAGTTCAGAGGCAAGCTGAGTTTCTGTTTTGCAACCTGATTGTATCCGGTGAT
CGGCGACGATGAGCAAAGTTCATGCTTTTAATGAGGTGGCGGAGCATAACAAGAAAGAGGATTGCTGGCTTATCATCTT
TGGAAAGGTTTATAATGTAACCTCATTTCTGGATGATCATCCTGGAGGTGATGATGTCTTGCTGACTGCAACAGGGAAG
GATGCAACAGATGATTTTGAAGATGTTGGTCACAGTGATGATGCAAGAGAGATGATGAAGAAATACTACGTTGGTGAGA
TTGACAGTTCTACCCTTCCTGTTAAGCACAAATATACTCCGCCTGTAACTCCACCACCCCCTGGAAACCTTGGTTCTGG
AAATTTATCTAAGATATTGCAATTCTTGTTACCATTGTTGATATTGGGCGTAGCGCTTGCCTTGCGTTCCTTTTATCAG
AAAGAGTAGATCAACTGTCATATTTCAAGCTGCAATGCTTATGGAATACAATACAACTTTCTCATAAGCTGCTTGCCA
TTTTCATATGTTGTGTTTTAGTCTTACGGATTAGTATCCTTTATTCAGCTTATGTGTATTTGCTACCCTTTGTTGGATG
TTCTACTGGGATGC

> SEQ ID NO: 6291 200622 274477_200057_1b
GTTTCCCTCTCTTTTTATTGAACCCAACAACTTTCTGCCACTCCACTCACCTCGTTTCCTCCTCTAAAATCATAATCTA
ATTTATCTTTCAGTTTTATTTTTCTTAGAAAAATTGTGTAATAAATGGGTGGTCAATCTAAGGTCTACACTTTAGCTGA
GGTTTCTAATCACAACAATGTCAAAGATTGTTGGCTTATTATCAGTGGCAAGGTGTATAATGTGACGAAGTTCTTGGAA
GATCACCCAGGTGGGGATGAGGTTTTATTGTCCGCAACAGGAAAGGATGCTACTGATGATTTTGAGGATGTTGGTCACA
GCACTAGTGCTCGAGCAATGTTGAACGAGTATTATGTAGGTGATATTGATTCTTCCACCATACCAACAAAGGTCAAGTA
CACTCCTCCAAAGCAACCTCATTACAACCAGGACAAAACACCAGAGTTCATCGTCAAGCTCCTCCAATTCTTGGTTCCT
CTGATTATTCTAGGTGTGGCTTTTGGCGTTCGCTTCTACACTAAACAGTCAGCTTGAAGATTGATTATGGTGATCTCAT
AATAAGGATCCAAATTAGCGCAACGTTAGAAGAACAAAAAAAGAAAAGAAAAGAAAAGAAAAAGAGCTTTTACTTTG
TTAACCAGGCAAATTATCTTGTTTAAGTTCTATTCTGGGACC

> SEQ ID NO: 6292 200622 8227_300304_1b
CGCGTTTGAGTGAAGATGTCTTCAGATCGGAAGGTTCTAAGTTTTGAAGAAGTTTCAAAGCACAACAAAACTAAGGATT
GTTGGCTTATTATTTCCGGCAAGGTGTATGATGTGACTCCATTCATGGATGATCATCCTGGAGGCGATGAAGTCTTGTT
GTCCTCAACAGGGAAAGATGCTACAAATGATTTTGAAGACGTTGGTCACAGCGACACTGCAAGGGACATGATGGACAAA

FIG. 2 continued

TATTTCATTGGTGAGATTGATTCGTCTAGTGTTCCAGCAACTAGGACATACGTTGCACCACAGCAACCAGCCTACAACC
AAGACAAGACACCAGAATTCATTATCAAGATTCTTCAGTTCCTTGTTCCGATCTTGATCTTGGGATTGGCTCTTGTCGT
CCGTCACTAT

> SEQ ID NO: 6293 200622 171742_300536_1b
AGATCGCGTGACTCCCCCACACTCCGCTCCGCTCCCCCCGCGGCCACGCGCTCCTCGTCGGCTTCCGCTTCCTCCCACC
ACCTCGCAGCGTTGCAGGGCGTGGGCGTGGGCGGCGGACATGGCCGGCGAGAAGAAGGTGTTCGGGTTCGAGGAGGTGG
CCGGCCACAACGTCACCAAGGATTGCTGGCTCATCATCGCCGGGAAGGTATATGATGTTACTTCTTTTATGGATGAGCA
CCCTGGTGGCGATGAAGTGTTGCTAGCAGTAACTGGCAAAGACGCAACCAATGATTTTGAAGACATTGGCCACAGTGAA
TCAGCAAGGGAGATGATGGAGAAGTATCTCATTGGGGAGATTGATGCTTCAACCATCCCAGTAAAGCGTACTCATGTCA
CTCCCCAGCAAGCGCCCGGCAACCCAGACAAGGGCGATGACATGCTCATTAAGATCTTGCAGTTTCTTGTCCCCATCTT
GATCTTGGGGCTTGCATTTGCTATCCGGCAGTACACCAAATCTGAGTAGATCTGTTATTACAATGTTGATAATCAATAT
GGTCCATGAAGCTATATTAGGTGAAATGATTTGGATCAAAAGAACTAAATAATGATATTTGTTGAGGGGAACGGTATG

> SEQ ID NO: 6294 200622 201905_300721_1b
CGGACGCGTGGGTTGTTTCAGTGGCTCAGAAATTTTCTTCTTTTCGTATTATTGTTTTCCTTTATTTAAGGAAGGAGTT
GGGCTCTCTCTCTAAGTCTGAATCCCCACGAGACGAGAAACCTAGCAAAAATCTCGTCTTTCGCCGCTCTCTCCCTCCT
CTGATTCCTGCTGTTCTTGATCTTGGATCTCAATTCCCAACCAAGAACACACAGACAGAGAAAGGAAGGAGAAGAAGAT
GTCGAACGACAACAAGAAGGTGTATACCCTGGAGGAGGTCGCCAAGCACAACTCCAAGGACGACTGCTGGCTCATCATC
GGCGGAAAGGTATACAATGTGTCGAAATTCCTTGAGGACCATCCAGGAGGTGATGATGTCTTGCTATCTTCAACTGGCA
AGGACGCGACTGACGATTTTGAGGATGTCGGGCACAGCACGACTGCTCGTGCGATGATGGATGAGTATTACGTTGGCGA
CATCGACACATCCACAATACCCGCGAGGACGAAGTACGTTCCCCAAAGCAACCACACTACAACCAGGACAAGACCCCG
GAGTTCATCATCAAGATCCTCCAGTTCTTGGTTCCCCTCGCCATATTGGGCCTGGCTGTTGCAATTAGGATCTACACCA
AGTCGGAGTCCGCTGCGGCCGCTTATCCGTATGATGTTCCGGATTATGCCGAGCTCTACAAACAG

> SEQ ID NO: 6295 200632 285160_200103_1b
GGGCTTCTCTGCAAATTAACCAACAAACACACACACACTCTCTCTCTGGAAAAATGAGCGATCTCAAGTCCAAGTTTTT
GGATGTGTACGCTGTCCTCAAATCTGAGCTGCTTAGTGACCCAGATTTCGAATTTACTGATGATTCTTGNCTATGGGTC
GACAAGATGTTGGACTACAATGTACCTGGAGGGAAGCTTAATCGGGGGCTCTCCGTTATTGACAGCTACAGTTTGTTGA
ATGATGGGAGAGAACTAACCAGTGAGGAAATCTTTCAAGCACTCTGCACTTGGCTGGTGCATTGAATGGCTTCAAGCATA
TTTCCTTGTTCTTGATGATATAATGGATAACTCTCATACACGTCGAGGTCAGCCATGCTGGTACAAATTACCTAAGGTT
GGCATGATTGCTGTTAATGATGGCATACTTCTTCGCAACCACATCACGAGAATTCTGAAGAACCACTTCAGAGCAAAGC
CTTATTATGTTGATCTTCTCGATTTGTTTAATGAGGTTGAGTTCCAGACTGCCTCTGGACAAATGATAGATTTGATCAC
AACACTTGTTGGAGAGAAAGATTTATCAAAGTACTCATTGCCAATTCATCGCCGGATTGTCCAGTATAAAACTGCTTAT
TATTCATTCTACCTCCCGGTGGCATGTGCACTTCTAATGGC

> SEQ ID NO: 6296 200632 8147_300316_1b
AATTCGGCACCAGATCAACCGTGCTGGTTCAGAGTTCCTAAGGTTGGTATGGTTGCCATCAATGATGGGATTCTACTTC
GCAATCACATCCACAGGATTCTCATAAAGCATTTCCGTGATAAGCCTTACTATGTTGACCTTGTTGATTTGTTTAATGA
GGTTGAGTTGCAAACAGCTTGTGGCCAGATGATAGATTTGATCACCACCTTTGAAGGAGAAAAGGATTTGTCCAAGTAC
TCATTGTCAATCCACCGTCGTATTGTCCAGTACAAAACGGCTTATTACTCATTGTATCTCCCTGTTGCTTGTGCGTTGC
TTATGGCCGGCGAAAATTTGGAAAACCATATTGATGTG

> SEQ ID NO: 6297 200646 107783_300258_1b
ACTACGCCTTCTTTTCAAATCTGGCGGAGGTTCATCGCAGCCTCCCCTATAACTTGTCCTTCATCCCTCTCACTTGTAT
CCGTATCCGTATCCAAATCCCCTCTTCTTAAAAGCCATAGAAGAGCTGCCTCTCTCCGCTGCTATTGTGCTACAAGAAT
GGGTGACGCCATTGCTGATGCTAACATGGACGCTGTTCAGCGCCGTCTCATGTTTGAAGACGAATGTATTCTGGTGGAT
GAGAATGACCGTGTTGTTGGTCATGACACAAAGTATAATTGTCATTTAATGGAAAAGATCGAAGCTGAAAATTTGCTGC
ATAGAGCTTTCAGTGTATTTCTATTTAACTCAAAATATGAATTGCTTCTTCAGCAACGATCAGCAACAAAGGTAACCTT
TCCTTTGGTATGGACTAACACCTGCTGTAGCCATCCACTCTACCGAGAGTCTGAGCTCATTGAGGAGAATGCTCTTGGG
GTAAGAAATGCTGCACAAAGGAAGCTTCTTGACGAATTGGGCATTCCTGCTAAAGATGTCCCAGTTGACCAGTTCACCC
CATTGGGTCGTATACTTTATAAAGCTCCATCTGATGGAAAGTGGGGAGAACATGAACTTGATTATCTTCTATTCACTGT
CCGTGAAGTTAACATGAAACCGAACCCGGATGAAGTTGCTGATGTTAAATACGTGAACCGAGAACAACTGAAAGAGCTT
TTGAGGAAAGCAGATGCTGGCGAGGGAGGTCTGAAGCTATCCCCTTGGTTCAGACTTGTCGTTGACAACTTCTTGTTTA
AGTGGTGGGATCATCTTGA

FIG. 2 continued

> SEQ ID NO: 6298 200646 1119481_301897_1b
ATCTTTCTGAAGAATGGAGGAAATCATGGATCCTCTCCAAAAGCGCCTCATGTTTGAAGATGAGTGCATTTTGGTTGAT
GAAGATGATAAGGTTGTGGGTCATGATTCAAAGTACAATTGTCATCTGATGGAGACAATAGTTAAAGGAAAAGCACTGC
ACCGGGCATTCAGTGTCTTCCTTTTCAACACCAAGCATGAGTTGTTACTACAGAAGCGGTCGGCTACCAAGGTAACTTT
TCCTTTGGTGTGGACAAATACATGCTGCAGTCATCCTTTGTATCGAGAATCCGAATTGATTTCGGACAACTGCTTAGGG
GTAAGAAATGCCGCTCAAAGGAAGCTTTTCGACGAGCTTGGGATTGTAGCCTCCGAGGTTCCTGTTGATGACTTCACCA
TCCTTGGCCGCATTTTGTACAAGGCTCCTTCAGATGGGAAGTGGGGCGAACATGAACTGGATTACCTTCTCTTTATTGT
CGGTGATGTGACGACGCATCCTAACCCTGAGGAGGTTGACGACATTCGGTATGTTACCAAGGAGCAACTTAAGGAGTTG
CTCGACCAAGCCGAGGCACCAGGCCAAGACAGTGTCA

> SEQ ID NO: 6299 200649 204962_300794_1b
CGTTTCTTCTCTCGCTTGTGATTGTGAGCATTCTATCGCCTTTCTTACTCTCTCTCTTCTGGATTTCCATCCGGATTGT
TTACTTTCTTCCTTCCAGTCCGCCAAAATACCTAGACACACGTAGCCCGCAATGGCGTCATCATTCAACGTTGCCGACC
TGGCCGAGTATATCGATCTGGACAAGCAGAGCCTATTGATCTCGGCCGGGTCAATCATCTTCAACCCGCTCTTCTGGAA
CATTGTCGCTCGTCAAGAATACCACAACAAGATCCTGACAAGGCTGTTCGGGGGCAGACCCTACCCGGCCTGCTATGCC
CTCGCCATAACCATCTTCTCGCTGGGCCTTCTCCGCGATTGGCTGCTGTACAAGACGGCCCTGTCCGAGCAGCCATCGCACC
CGCTCCTGGAGACGCTGTATTCGCAGGCTGCCGGATACACCCTGTTCATCATCGGCAACATCCTTGTCGTCGTCGAC
GTGGCGCCTGGGCATCACGGGCACCTTCCTGGGCGACTACTTTGGCATCCTGATGGACGAGATGGTGACGGGCTTCCCC
TTCAACGTGACATCGGCCCCGATGTACTGGGGCTCGACGATGAACTTTCTGGGAACCGCGCTCGTCTTTGGCAAGCCCG
CTGGTCTTGCGCTGACCGTCGGCGTGCTCGTCGTGTACATCATCGCCCT

> SEQ ID NO: 6300 200669 242265_301327_1b
TTTCATTCCGATTCTGCTTATGAAATCTTGGAAGAGAGCCTTGTAGGATTCACTGCAACAGAATCGATTCTCAACGGCG
CGACAAAGAGTGCACACCCTGCCGATATCATTCCATTACCGCCGTCCGCTGCCGGCCAAGCCGAACTCAACCAGCTGAA
AGAGAACTCGAAGCCTCTATATGCAGCTACTGGCATGTCATCGAACAGATCTTTCAAAGGAGACCGATCCAGCCAAG
GACTATACGGAACACAAGTTTCTCGATCTCAGCAAACCTCTCCTAATGCAGGTCTGGAATGGTGGTTTTCCAAGAAGT
TCTATCTGGAACAGGTGCACCGACCCCGCCATTATAAGGGCGGCGACTCGGCGCCGCTCTTTGGTAACTTCCTAGAGCC
GTTGAGCAAAACTCCCTGGTGGGTTGTGCCCACATTGTGGTGGCCATGTGTTGCTGTTGGCACAAGTATTGCCATGCAT
GGACTCTCTGCACCCGCAACAGTTGGCTTCTGGATTTTTGGGTTGTGCTTCTGGACTATCATTGAATATGTCCTTCATA
GATGCCTGTTTCACTTGGACGAGCACCTGCCAGATAACCGTGTTGGTATCACATTAC

> SEQ ID NO: 6301 200669 258818_301700_1b
GACACCATGACCAATCTGCCCCTTCTCACCCGAAAAGAGGTGGAGAGCCACAACACCAAGAGCTCGTGCTACGTGACCG
TCGACAACCTCAAGGTCTACGATGTGTCTTCTTTCCTGGAGGAGCACCCCGGAGGAGGAGACCTGATTGTGGATTTTGC
CGGTAAAGACGTGACGGAGATTATGGGCGACCTGGTGTCCCACGAGCACCTCGGAGGCTGCCTACGAGATGCTGGACGAG
CTCTATCTGGTGGGAATTCTCGCTACCCCCGAACGGAGGCCAAGTTGCTCACCAGAGAAAACCGACACGACTTCAAGC
TGGAAAAGAACGCCGAAGACGAACTCACTGTCACCACTGACTTCACCCGAGACTACAAGACCAATCAGTTCCTGGACCT
CAACAAACCCCTGCTGATGCAGGTGCTGCGCGCCAAGTGGACCAAGGAGTTCTACCTGGAACAGGTCCACAAGCCCCGA
CATTACGGCAACGGAAGTGCGCCCATCTTCGGAAACATCCTCGAGCCTC

> SEQ ID NO: 6302 200672 271843_200038_1b
ACTCCCACAGTCCCACTAATGGACTCTCTCACTCTCATTTGTACCGCCGCTCTTCTAGCTGCCGGTGGACTTTACTGGT
TCGTTTGCATCCTTGGCTCCGCCGAGGTTAAAGGGAAACGCGCCGTCCAACTTTCCGGCGGGTCAATCGAGAAAGAGAA
TGTCCAAGACAATTATAAACAATACTGGTCTTTCCGCCGCCCTAAAGAAATCGAAACCGCCGATAAAGTTCCGGCC
TTCGTCGATACGTTCTATAATCTCGTCACTGATATTTACGAATGGGGTTGGGGTCAGTCTTTTCACTTTTCCCCTTCTA
TCCCTGGGAAATCTCACCGTGAAGCCACACGTATTCACGAAGAAATGGCTGTAGATCTAATAGGTGTTAAGCCCGGGGC
TCGCATTCTGGATGCAGGTTGTGGCGTTGGCGGGCCGATGCGGGCTATTGCGGCCCATTCACAGGCTAAAGTTGTTGGC
ATCACAATTAATGAGTATCAGGTGAAACGAGCCCGGATGCACAACAAAAAGCTGGCCTCGATTCCTTGTGTGAAGTTG
TTTGCGGCAATTTCCTGCAAATGCCCTTTCCGGACAACAGTTTCGACGGAGCTTATTCAATTGAAGCTACATGTCACGC
CCCTAAGCTTGAAGAAGTGTACAAGGAGATCTACCGGGTAA

> SEQ ID NO: 6303 200672 286318_200108_1b
AAGAGAGCATTAAGAGGCACGAGCACTTTCTTGCCTTGCAACTGGGATTGAAACCAGGACAAAAGGTCTTGGACGTAGG
ATGTGGCATTGGTGGGCCGTTAAGAGAAATTGCTCGATTCAGCTCTACATCAGTTACAGGCCTCAACAATAATGAATAT
CAGATATCAAGGGGACAGGTGTTGAACCGCAAAGTAGGATTGGATCAGACTTGCAACTTTGTAAAGGGTGATTTCATGA
AAATGCCATTCCCTGACAATAGCTTTGATGCAGTGTACGCAATAGAAGCTACCTGCCATGCACCAGATCCAGTTGGATG
CTATAAAGAGATTTACCGGGTGCTGAAGCCTGGTCAATGTTTCGCTGTGTATGAGTGGTGCATGACCGATTCTTACAAC
CCCAATAACGAAGAGCACAAGAGGATCAAGGCCGAAATTGAGCTCGGAAATGGCCTCCCTGAGGTTAGATTGACAACAC

FIG. 2 continued

AGTGCCTCGAAGCAGCCAAACAAGCTGGTTTTGAAGTTGTATGGGACAAGGATCTGGCTGATGACTCACCTGTTCCATG
GTACTTGCCTTTGGATACGAGTCACTTCTCGCTCAGTAGTTTCCGCCTAACAGCAGTTGGCAGACTTTTCACCAGAAAT
CTGGTTTCGGCACTTGAATATGTGGGACTTGCTCCTAAAGGTAGTCAAAGGGTTCAAGC

> SEQ ID NO: 6304 200673 139331_300409_1b
CCCCCCCACCTCTATCAGGGTCACCTGCCAGACTTCCATGTTTACACTGCCCTATTGAAACCACATGAGAGAATCATGG
CTTTGGATCTTCCTCATGGTGGACATCTTTCTCACGGCTACCAGACTGATACTAAGAAGATTTCAGCAGTTTCGATATT
CTTTGAGACAATGCCCTACAGATTGGATGAAAGCACTGGCTTGATTGATTATGATCAGATGGAGAAAAGTGCCGTTCTT
TTTAGGCCAAAGTTGATCGTTGCGGGTGCAAGTGCATATGCGCGTCTTTATGACTATGACCGCATGCGGAAGGTTTGTG
ACAAGCAGAAGGCAATACTTCTAGCAGATATGGCACATATCAGTGGGCTTGTCGCAGCTGGTGTTGTTCCATCTCCTTT
TGATTATGCAGATGTAGTGACTACCACTACTCACAAGTCACTCCGTGGACCACGTGGAGCCATGATCTTTTACAGGAAG
GGGGTGAAAGGAGTAAACAAGCAAGGCAAAGAGGTTATGTATGACTTTGAGGACAAGATCAATGCTGCTGTCTTCCCAG
GTCTGCAAGGTGGACCACATAATCATACCATTACTGG

> SEQ ID NO: 6305 200677 200676_300746_1b
GAATTCCAGCTGACCACCATGGCTCTCAATAAACTAAAGAATATACCTTCTTTAACAAACAGTTCTCATAGCTCAATTA
ACGGCATTGCATCCAATGCTGCAAATTCCAAACCAAGCGGAGCAGACACGGATGATATCGATGAGAATGATGAATCTGG
GCAAAGTATTCTATTAAATATTATTTCCCAGCTGAAGCCAGGTTGTGATTTATCTAGAATCACACTTCCGACATTTATT
CTGGAAAAAAAATCGATGTTGGAGAGAATCACTAATCAATTACAATTCCCAGATGTTCTTTTAGAAGCACACTCCAATA
AAGACGGGCTGCAAAGGTTCGTTAAAGTGGTAGCATGGTACCTAGCAGGTTGGCACATTGGGCCCAGGGCTGTGAAGAA
GCCCCGAAATCCCATTCTTGGAGAACACTTTACAGCTTATTGGGATTTGCCTAACAAGCAACAAGCCTTTTACATTGCA
GAACAAACGAGTCACCATCCTCCTGAATCTGCGTATTTTTACATGATTCCAGAATCGAATATTAGAGTTGATGGAGTTG
TTGTGCCAAAATCGAAATTTTTAGGAAACTCAAGTGCTGCAATGATGGAGGGGTTAACTGTATTGCAATTCCTTGATAT
C

> SEQ ID NO: 6306 200680 120403_300385_1b
TTTAGATAGAGAAAAGATTCCCATTGTTCTAAAGCTATAGGGGGAGTTTTTGATGGAGAGAACCAATTCCGTCGCCGTT
TGCCGTCGCAGACAATGGTGGATATGGGTCTTTCCGGATCTGTATTTGCGGTGGTGTTTGGTTTCGTGGCGGTTTTGTG
GTTTTTCATTCAGAGAAACAGTGTCCGCAAAGATAAAAATAATGACCCCGACACCACCAGCACCACTACCACAACGGTG
TATGATGGAGAATGCAGATCAAAGGACGCAAACGACGACGCTGACATCATCATCGTCGGTGCTGGCGTTGCTGGTGCCG
CTCTTGCTCACACCCTTGGCAAAGAGGGGCGTCATGTAAAAGTGATTGAAAGAGATTTGACAGAGCCTGATCGAATTGT
TGGAGAACTCCTACAACCAGGTGGCTTCCTCAAATTGCAGGAGTTGGGCTTGGAAGATTGTGTGGAGAACATTGATGCT
CAGCGAGTGTTCGGGTATGCTCTTTTCAAGGATGGAAAGAGCACTCGTCTTTCTTATCCCCTGGAGAAGTTTCACACTG
ATGTATCTGGGAGGAGCTTTCATAATGGGCGTTTCATTCAAAGAATGAGAGAGAAAGCTGCATCTCTTCCCAATGTGAA
ACTGGAGCAAGGCACTGTTACTTCTCTGCTAGAAGAAAACGGGACCATTAGAGGTGTTCAGTACAAAACAAATCTGGG
GAAGAGTTGAAAGCCTATGCACCATTGACCATAGTGTGTGATGGTTGTTTCTCGAATCTACGGCGAACCCTTTGCGACC
CAAAGGTAGAAGTGCCTTCCTGTTTTGTTGGTCTGGTCCTGGAGAACTGCCAGCTTCCACATGCAA

> SEQ ID NO: 6307 212346 200288_300757_1b
ATTTGATGTCCATCTAATAAGAGAGAAATGATTCATTCATCATGACTGCCTGAGGTTCCATGTTTGTCTCTCGCCTTAC
CTTGGCCTCTCTCTGCCTTATCTTTCCGACTTTGTTCTTCCATTGTTCACCTGATCACCACCGACCGCGCGACATATCG
CAATAGAAGGCTGCGGAATTTGGACATTGCAAACAACCCCAGCGCATCCGAACTTGTGTATGCGACTACGACTGCAAAT
CAGCACCAAAGAATTTAGGCGGTACTGGATATTGATTGGTCGCATCCCAAGAAACGTGGTTCCTCTTTCATAAGACGCT
CAAAGCGCAAAATCTCGACCGGAACAAAGCAGCATCGCTCTCCCTCTCTCACACATCGCGACAAGACATTCTGCGATCT
GAATCTTCGCTTTCAGAGCCCGACACATTTACACCGGTCGGCGACTGCTTCGCATCGAAATGTTGGACTCGTACGGAG
TCCGGAGGTCGGACACCACCAAAGGGCCGCCTCTGCGCATTCTGTCTCTCGATGGAGGAGGCGTTCGTGGTTACTCCAT
GCTCATCATCATCCAGGAACTCATGCATCGCGCATTTGTCGACATCGAAGGGCGCGCGCCTCGCAGGCATGAAATTCCA
AAGCCCTGCGATCATTTCGACCTAATCGTCGGTACCGGCACGGGCGGACTCATCGCAATCATGCTAGGCCGGCTGCGTC
TGGACTTGGAGACCTGCAAGGAGCTGTACGTTCGCATGACCAAGATGGTGTTCGAAACCGACAAGACGATTGCCGGCTT
CCCATACCGATCTACGCTGTTCAAGGCCAGCAGGCTGGAAGACGCCATCAAGC

> SEQ ID NO: 6308 212363 218010_300914_1b
CCCACGCGTCCGCCCACGCGTCCGACATTCGTTGTCTGAACACTAAACCAAAAAACTCCAAAAAAAACAACTTAATACA
CACCCCCCCAACAACACTTAATACCGACAAGATGAAGGCCGCTTTCGTTGCTGTTGCTCTCGCCGCTCTGGCCCAGGCT
CAGACCCGCGCTGATATCCCATCCTGCGCTCTGCCCTGCCTCGACGACGCCGTCAAGGCCAACACCAAGTGCTCCACCA
CCGACTACGCCTGTATCTGCAAGGACTTCAACGCTGTTCAGGGCGCTGCCACCGGCTGTGTCGTTGAAGTGCGGTAC
CGACGTTGCCATCAACAAGGTCCTCCCCGCCACTCAGGCTCTCTGCGCCGCCAACTCTGGATCCGGCTCTGGCTCTTCT
TCTGCTGCCAACACCACTCCCGCCCAGCAGACCACCTCTGCCGCCCAGTCTTCTTCTGCTGCCCAGTCTTCCTCTGCTG

FIG. 2 continued

CTCAGTCCTCTGTCGCCAGCGCTCCCCCCAGCTCTGCCCCCGCCCAGACCACCTCTGCTGCCCAGACCACTCCCGTCAT
TCCCGTTGGCACTGGCACTGGCGTTCCCCCCGCTGGCAACAAGACCACCACCGGTGCTCCCACCGCCCCTACCAGCGGC
GCTTCCACCATCCTGCCCGGCCTTGCCTTCATCGCCGCTCTCTGCGCCTTTGCCCTGTAAGGGGTTTGACAATGAACGA
CGA

> SEQ ID NO: 6309  212363  218769_300936_1b
TTTCACAGTCCAGCTACATTCGTTGTCTGAACACTAAACCAAAAAACTCCAAAAAAACAACTTAATACACACCCCCCA
ACAACACTTAATACCGACAAGATGAAGGCCGCTTTCGTTGCTGTTGCTCTCGCCGCTCTGGCCCAGGCTCAGACCCGCG
CTGATATCCCATCCTGCGCTCTGCCCTGCCTCGACGACGCCGTCAAGGCCAACACCAAGTGCTCCACCACCGACTACGC
CTGTATCTGCAAGGACTTCAACGCTGTTCAGGGCGCTGCCACCGGCTGTGTCGTTGAGAAGTGCGGTACCGACGTTGCC
ATCAACAAGGTCCTCCCCGCCACTCAGGCTCTCTGCGCCGCCAACTCTGGATCCGGCTCTGGCTCTTCTTCTGCTGCCA
ACACCACTCCCGCCCAGCAGACCACTCCCGTCATTCCCGTTGGCACTGGCACTGGCGTTCCCCCCGCTGGCAACAAGAC
CACCAACGGTGCTCCCACCGACCCTACCAGCGGCGCTTCCACCATCCTGCCCGGCCTTGCCTTCATCGCCGCTCTCTGC
GCCTTTGCCCTGTA

> SEQ ID NO: 6310  212374  195916_300639_1b
GGCACTCAACCAGGTTTACGACTCCCAATATGGCCCTCTTCACAGTGGGAGATTATCTTGCCGAAAGGCTCGCTCAAAT
TGGGATTCGCCATCATTTCATCGTCCCGGGCGACTACAACCTCATTCTCCTCGACAAGCTTGAGGCGCACCCAGCATTA
ACTGAGGTTGGCTGTACAAACGAACTCAATTGTTCTCTGGCCGCCGAAGGCTATGCACGCGCTTGCGGCGTAGGAGTCT
GCGTTGTTACTTACAGCGTAGGCGCCTTCTCGGCCTTCAACGGCATCGGCAGCGCATATGCAGAGAACCTCCCCGTTAT
CCTAGTCAGTGGAGCACCTAACACGAATGATGTTGATCAACATCTCCTGCACCACACGCTCGGGGAGCACGACTTTATC
TACCAGTTTGAGATGGCCAAGAGGATCACTTGCTGCGCCGTGGCCATCCGGCGAGCATCTCATGCCCCGGAACTGATCG
ACCGCGCTATTCGAACGGCGCTTCTAAAGCGGAAGCCGTTTACATCGAAGTTCCCACGAACTTATCTGGCGAGCCATG
TGCACAGCCCGGACCTATTAGTGCTGTAGTCAAGCCGTTCCCGAGCGATGCGCCAGCCCTTGACGCTGCTGTTACCGGT
GCCTCTGAA

> SEQ ID NO: 6311  212412  183342_300621_1b
AGCGATTTCAGATCTCCCCAAGTAGTAGACTTCTCTCTTCTTCCATCTCGGATTCGTCTCGGTCTCGTCTCGGTCTCCG
GCGATGTCTGGGCGCGGCAAGGGAGGCAAGGGGCTGGGCAAGGGCGGGGCGAAGCGCCACCGCAAGGTGCTCCGCGACA
ACATCCAGGGGATCACCAAGCCGGCGATCCGGAGGCTGGCGAGGAGGGCGGCGTGAAGCGCATCTCCGGGCTGATCTA
CGAGGAGACCCGCGGCGTGCTTAAGATCTTCCTCGAGAACGTCATCCGCGACGCCGTCACCTACACGGAGCACGCCCGC
CGCAAGACCGTCACCGCCATGGACGTCGTCTACGCGCTCAAGCGCCAGGGCCGCACCCTCTACGGCTTCGGCGGCTGAG
CCCTCCGGTCCTCCCTCGCCCTCGCGCTGGCCGCCTCTGCCGCCGCCGCCTCCTGGACTGGCTGTTGCTGGTGTTTTAG
CTCTTGTTGTGTCCTTTTGCTTTGCTGGTGTAAAGAGACCCGGATGTGCCACGGGTGGGTTTTTAGTAGTAGGATTAGT
AGTATCCCAACTCCTGGTTGTGATTTGCTCATTTCCATAGATGTAATGACATTACGATTTCAATCGTAGCAAAATTATT
TG

> SEQ ID NO: 6312  212412  240610_301316_1b
GTCGATAGCACTAGCAGCGCCTTCTCTCCTCTCCTCTCCAAGTAAGTAGCTCTTCTTCGATCGGCTAGAGGCAATGTCT
GGGCGCGGCAAGGGCGGCAAGGGATTGGGCAAGGGCGGGGCCAAGCGCCACCGCAAGCATCTCCGCGATAACATCCAGG
GCATCACCAAGCCCGCGATCCGGCGCCTTGCCCGGCGTGGCGGCGTGAAGCGCATCAGCGGCTTGATCTACGAGGAGAC
CCGGGGCGTGCTCAAGATCTTCCTGGAGAACGTCATCCGCGACGCCGTCACCTACACAGAGCATGCCCGCCGCAAGACC
GTCACCGCCATGGACGTGGTATATGCGCTCAAGAGGCAGGGCCGGACCTTGTACGGATTTGGCGGCTAGAAAAATTCTT
CTTTTGGATAGGGAAGAAACTGCCATAGCTCTTCCTGGCATTGGAATTTGTAAATTTTGTTCTCTTTGACTATCTTTCT
GGAAATTTAAAGTATGATCTTGTACTGTTC

> SEQ ID NO: 6313  212412  234261_301098_1b
TATTGGTTGTCTAGGGTGCTAGAGCAGCAGCAGCAGCTAGGAAATCTCTCGTCGTCGCGGCAATGTCTGGAAGAGGCAAGGG
AGGTAAGGGATTGGGCAAGGGCGGCGCCAAGCGCCACCGCAAGCATCTCCGCGATAACATCCAGGGCATCACCAAGCCG
GCGATCCGGCGCCTTGCCCGGCGTGGCGGCGTCAAGCGTATCAGCGGCTTGATCTACGAGGAGACCCGAGGCGTCCTCA
AGATCTTCCTGGAGAACGTCATCAGGGATGCGGTCACCTACACCGAGCACGCCAGAAGGAAGACCGTCACCGCCATGGA
CGTCGTCTATGCGCTCAAGAGGCAAGGCAGGACGCTCTACGGATTTGGCGGCTAGAAGAAGAAATTAGAAGCTCTCCA
TCTCCTTGGAAAATTTCTAGTTTTCCTCGATTTCTAACTGGTAGACAAGGAAGAAATATTTTCCTTTGCATTCCATCCA
CCACTTTGTAATATTCGAATCTAATGTAGAATCTTAAATCGGAAAAAAA

> SEQ ID NO: 6314  212412  194290_300745_1
CCCCGCACCTCATCACCACCGCCGCCAACCACTCCTCACCAAGTCAAAGTTTCTTCCTCGCGACCGGCGGCGAGCGGCG
GCGGCGGCGATGTCTGGGAGAGGCAAGGGCGGCAAGGGGCTCGGGAAGGGCGGCGCGAAGAGGCACAGGAAGGTGCTGC

FIG. 2 continued

```
GCGACAACATCCAGGGGATCACGAAGCCGGCGATCCGGAGGCTGGCGAGGAGGGGCGGCGTGAAGCGCATCTCCGGGCT
GATCTACGAGGAGACCCGCGGCGTGCTCAAGATCTTCCTCGAGAACGTCATCCGCGACGCCGTCACCTACACGGAGCAC
GCCCGCCGCAAGACCGTCACCGCCATGGACGTCGTCTACGCGCTCAAGCGCCAGGGCCGCACCCTCTACGGATTCGGCG
GCTAGGCGAGGCGATGCGAGGCCACGCGATTGGATAGGGATTCGATTAGTGCCATGTTCTTCAGTTCGTCGTAGTAGCC
TAGCCTCTTCTCCTGTAGCTGTTGTTTCATCTCGTCTCCTGTTCCTTCATTAATTAGGGATGTATGAACTACTGGTTCG
TTCGTTCGAATGGAATAGGAAATCTGCAGTGATTTACCCTCTAAATTCAGT

> SEQ ID NO: 6315   212412 193633_300741_1b
CCCGACTCCAATCACCACCACCTCTTCTCCAATTCCACTCGCTTTTCTCTCTCTCGTGCGTCGAGCCACCGGAATCG
TCGTCGTCGGCGGCCATGTCGGGGCGCGGCAAGGGAGGCAAGGGGCTCGGCAAGGGCGGCGCCAAGCGTCACCGGAAGG
TGCTCCGCGACAACATCCAGGGGATCACCAAGCCGGCGATCCGGAGGCTGGCGAGGAGGGGCGGGGTGAAGCGCATCTC
GGGGCTCATCTACGAGGAGACCCGCGGGGTGCTCAAGATCTTCCTCGAGAACGTCATCCGCGACGCCGTCACCTACACC
GAGCACGCCCGCCGCAAGACCGTCACCGCCATGGACGTCGTCTACGCGCTCAAGCGCCAGGGCCGCACCCTCTACGGCT
TCGGCGGCTGATCGATCTTGCCTCCCTCCGCCATCTCTCCCATGTCGTCTGGCCGTGCCCACAAGTCTTGCGGTCAAGA
AAAAAAGTTTGATGGAAAGCCGTGGAATCCACCTTGTTCAGTTCGCTGTTTAGTTTTTCTAGTGTTTACCTGAATCATG
AAATTGTGAAGCAAATGATGTTTGCAACTGGGATTTGAATTGAAACATGTTTCAGAGCCTAA

> SEQ ID NO: 6316   212412 266314_200030_1b
GCTCGTTCCTCTCTTTTAAATTCAAAACCCTTGAATTCACTTTCAATTATCTCTTTCTCAAGCTTTTGAAAAATGTCTG
GACGTGGCAAGGGAGGCAAGGGATTGGGGAAAGGAGGAGGAGCAAAGAGACACAGGAAGGTGCTGAGAGATAACATCCAGGG
AATTACAAAGCCAGCTATTCGCAGGCTTGCTCGTAGGGGTGGTGTGAAGCGTATTTCTGGGTTGATTTACGAGGAGACT
CGTGGAGTTCTTAAGATCTTTTTGGAGAATGTGATTCGCGATGCTGTGACCTACACTGAGCACGCTAGGAGGAAGACTG
TTACTGCCATGGATGTTGTTTACGCTCTCAAGAGGCAGGGAAGGACCTTGTACGGATTTGGAGGTTAAATATTGGCGGT
TAGGGTTTATTGTATTTTGTTGTTAGTGATTGTAGATTTTATGTTTGTGCTTTCTGTTTGTGTTAGTGGTCAGTTTAAG
CTAGGGTATTTTAATTTCCGTTGTTAAGGTCTGGACATTGTAATACCTCGTTATACAATTAAGTAAAACAGACCATTTC
CTAAAAAAAAAAG

> SEQ ID NO: 6317   212412 57715_300036_1b
GCCATTACGGCCGGGGACAATATTCCGAATCAAGAACATATCTTCCCATATCGAGCTCAAATTTCAAAATCCCCATAAT
CGTTTCACAAAATGTCAGGAAGAGGCAAGGGAGGTAAAGGATTGGGTAAAGGAGGAGCAAAGAGGCACAGAAAAGTATT
AAGGGACAACATTCAGGGAATCACTAAGCCTGCAATTCGGCGTTTGGCTCGTAGGGGTGGAGTAAAGCGTATTTCTGGT
TTAATTTACGAGGAGACTCGTGGGGTGTTGAAGATATTTTGGAGAATGTGATTCGTGATGCAGTGACATACACTGAAC
ACGCTAGGAGAAAGACTGTTACTGCCATGGATGTTGTTTATGCGCTCAAAAGGCAGGGCAGGACTCTTTACGGATTTGG
GGGTTAAATTTTTCAAATTAGGGTTTTTGTGGGTAACTTTTATTATAGATTTGTACTTTTGCTGCCGTTGTGTTTTAGG
GTTGCTTAGATTTTGGTAAGGTCGATGATGTAATTCTCGTTACATATTCAAGGAATAGTAATTGCTTGGTCCTCAAA

> SEQ ID NO: 6318   212412 48634_300033_1b
GCCATTACGGCCGGGGATCGCCCTAATCATTATCTCTCGCACAATTTTTCAGCTTCAGGGTCTTTAATTTGCAGAGAAA
CTAAAGGTTGATTGAAAATGTCTGGACGTGGAAAGGGAGGAAAGGGATTAGGAAAGGGAGGAGCAAAACGACACCGTAA
AGTCCTCCGCGATAACATCCAAGGTATCACAAAGCCAGCAATCCGGCGTTTGGCACGTAGAGGAGGAGTGAAGCGTATC
AGTGGTCTGATCTACGAGGAGACACGTGGCGTGCTGAAGATCTTTCTAGAGAATGTGATTCGTGATGCTGTAACTTACA
CTGAGCACGCTAGGAGGAAGACTGTGACTGCTATGGATGTTGTGTACGCGCTCAAGAGGCAAGGCCGTACTCTCTATGG
TTTTGGTGGTTAGAATATTGGAATTAATTAATGTTGGTTTTACGTTTAATGTAATTATGTTCTTATAAGAGTAGTTTTG
GCAAGAAACGTTGTTGCTTAAATTAATGAAATTGCACACTACATTTTTCTCACTATTGATTTGTCAATTTGACC

> SEQ ID NO: 6319   212412 36933_300084_1b
TTTGGTAAAAAACCAGGAGACAAGATATGGAGTAAATTGTTCATCCTCATTAGATTTTCTTAGCTTTAAGTTTGCAAAG
ATTTTCAACTACACCGCATTGGCTAACAACGACATCACAATAGAAAACAAAAGCAGTAGCTAACACTCCTAGATTTACT
TTAGACTAATTCAAACCATTTAACACAGATCTCAGAAACAAGAAGAAATCCCCAAACTTGCATAAACCCTAATCCCCCA
AATCGGATTAACCTCCGAAACCGTAGAGAGTACGACCTTGCCTCTTCAAAGCGTAGACAACATCCATGGCGGTCACCGT
CTTCCTTCTAGCGTGCTCAGTGTAAGTAACGGCGTCACGGATGACATTCTCGAGGAAGATCTTGAGGACACCTCTGGTC
TCTTCGTAGATGAGACCACTGATACGCTTGACACCACCTCTACGAGCAAGACGACGAATGGCAGGCTTGGTGATTCCTT
GAATGTTATCCCTCAGAACCTTCCTGTGCCTCTTCGCTCCTCCCTTTCCCAATCCTTTTCCTCCCTTTCCTCTTCCCGA
CATCACTTCACAGTTTTACTTGATACCCAAAGATCTGTGACTGTGAAGAACAGAAGAAAATTATTCAGTGAATGGTAA
CGAACAGAAACGCTAGATTTCCAAATCAATCAATTGAATTGACGATCGAACAATAAACCAGATGGAGAAGAAGAAGATA
CTTTTAAGATGATTTGGCGGACGCGTGGG
```

FIG. 2 continued

> SEQ ID NO: 6320 212412 104458_300364_1b
GGGGAAATGGTCTGTTTTACTTAATTGTATAACGAGGTATTACAATGTCCAGACCTTAACAACGGAAATTAAAATACCC
TAGCTTAAACTGACCACTAACACAAACAGAAAGCACAAACATAAAATCTACAATCACTAACAACAAAATACAATAAACC
CTAACCGCCAATATTTAACCTCCAAATCCGTACAAGGTCCTTCCCTGCCTCTTGAGAGCGTAAACAACATCCATGGCAG
TAACAGTCTTCCTCCTAGCGTGCTCAGTGTAGGTCACAGCATCGCGAATCACATTCTCCAAAAAGATCTTAAGAACTCC
ACGAGTCTCCTCGTAAATCAACCCAGAAATACGCTTCACACCACCCCTACGAGCAAGCCTGCGAATAGCTGGCTTTGTA
ATTCCCTGGATGTTATCTCTCAGCACTTTCCTGTGTCTCTTTGCTCCTCCTTTCCCCAATCCCTTGCCTCCCTTGCCAC
GTCCAGACATTTTTCAAAAGCTTGAGAAAGAGATAATTGAAAGTGAATTCAAGGGTTTTGAATTTAAAAGAGAGGAACG
AGCTTCGATTGTTTTGATGCCCCGGCCGTAATGGC

> SEQ ID NO: 6321 212412 108313_300381_1b
CGGACGCGTGGGCAAAGCTCAGTTTCTCTCTTTTAAATTCAATTTCTATTTTCTCTCTCTCAAACTATTGAAAAATGTC
TGGACGTGGCAAGGGAGGTAAGGGATTGGGCAAAGGAGGAGCAAAGAGGCACAGGAAAGTGCTGAGAGATAACATACAG
GGAATTACAAAGCCAGCTATTCGTAGGCTTGCTCGTAGGGGTGGTGTGAAGCGTATTTCTGGTTTGATTTATGAGGAGA
CACGTGGAGTGCTTAAGATCTTTTTGGAGAATGTCATTCGTGATGCTGTGACCTACACTGAGCACGCAAGAAGGAAGAC
TGTAACTGCTATGGATGTTGTGTACGCTCTCAAGAGGCAGGGAAGGACCTTGTACGGATTTGGAGGTTAAATATTGGGG
GTTAGGGTTCATAGTATTTTGTTGTTAGTGATTGTGGATTTCATGTTTGTGCTTTCTGGTTGAGCTAGTGGTCAGTTTA
AGGTAGGTTAGTTTAATTTCTGTTGTTAAGGTCTGGATATTGTAATTCCGCGTTATACAATCAAGTAAAACAGACCATT
TTACCCTATTG

> SEQ ID NO: 6322 212412 1099114_301488_1b
TCTGTTTTTGTGTTAGGGAGGAATATCCATAGCCGTAGCCATGTCTGGTCGAGGCAAAGGAGGGAAGGGTCTGGGCAAG
GGGGGTGCGAAGCGGCATCGCAAGGTCTTTCGTGATAACATTCAGGGTATCACTAAGCCTGCCATTCGCCGTCTTGCCA
GGAGGGGTGGTGTCAAGCGTATCAGTGGTCTCATCTACGAGGAGACACGTGGCGTCCTGAAAATCTTCTTGGAGAATGT
GATCCGTGATGCTGTCACCTACACTGAGCATGCCCGCAGGAAGACTGTCACAGCCATGGATGTCGTCTATGCCCTCAAG
AGACAGGGAAAGACCCTCTACGGATTTGGGGGTTGAAACACCTTCTCTCTCTCTCTCTTATACTGGTGTTCTTCAAC
ACCACCATTCTGTAGAAATTGGAAGCTTGGTTGAACTGCTTTATGTGATGAGACATGCTGATGGGATTTAGGGGTTCGG
ATCCTTCTGTAAATATCTATGGTTTTCTATGCTGATACTCTCTATGCAATGAAAAAGCATGAACTCGGTCTCTGTAGCT
CTGTTGGTTAATTCTAGATTAAATTGCCCGTTTCTCTATTTGTATCTCTCTCTGGA

> SEQ ID NO: 6323 212412 155494_301356_1b
ACCACGCGTCGTTCAAATCTAAAACCCTAAAGCTTCTTTTATCTTCAAATTTCTGTGTGAAAATGTCTGGTCGTGGAAA
GGGAGGAAAGGGATTGGGCAAGGGAGGAGCTAAGAGGCACAGGAAGGTGCTGAGGGATAACATCCAAGGAATTACGAAG
CCCGCAATTCGTCGGTTGGCTCGTAGGGGAGGTGTGAAGCGTATATCTGGTCTGATCTACGAAGAGACACGTGGAGTGC
TGAAGATCTTTCTAGAGAACGTGATTCGTGATGCTGTTACCTACACCGAGCACGCCAGGAGAAAGACTGTTACTGCTAT
GGATGTCGTTTATGCACTCAAGAGGCAGGGCAGGACTCTCTATGGATTTGGTGGTTAGGTTGTTTAGGTGTGATTTTAG
GTAACTGTATTTGTAGTAATTGTAGATTTTCTGGAATTTCTGTTGTCTCTTTGTTGGTTTCTCCGCAGCTTTGTTCTAG
TTGTTGTTCTTAAGGTCTTGATAATGTAATTTCTCATTACAGATTCAAGGAACAAAGTTCATTTTCTAGAAAAAAAACA
ACC

> SEQ ID NO: 6324 212412 155187_301353_1b
CTACCCTCGACCACGCGTCGCTGATTTCAGTTCACATCAAAACTTGGAAGGTCTTTAATCTTCAAGTTCCTGTGTGAAA
ATGTCTGGTCGTGGAAAGGGAGGCAAGGGATTGGGCAAAGGAGGAGCGAAGAGGCACAGGAAGGTGCTAAGGGATAACA
TTCAGGGATTTACGAAGCCAGCAATTCGTCGGTTGGCTCGTAGGGGAGGCGTGAAGCGTATTTCTGGTCTGATATATGA
GGAGACACGTGGTGTGCTAAAGATCTTTCTAGAGAACGTGATTCGTGATGCTGTTACCTACACTGAGCACGCCAGGAGA
AAGACTGTTACTGCTATGGATGTTGTGTATGCACTCAAGAGGCAGGGTAGGACTCTCTACGGTTTTGGTGGTTAAGGAA
TTTGTGTTTGTGTTTTTGACTTTTGTTTGTTCTTCAAAAGTCTTGCGGTCAAGAAATTGAATGAAGTATTATTAAAATA
GTTGATGTAATTAGGGTTCCTTATTAGTATTTGTAGTAGTTGTTGTAAGAAAAGCATTCTCAGGTATTCTGGAATTTGC
TCAACTTAATGGCAGAAGAATTCAAGTTTCAACT

> SEQ ID NO: 6325 212412 147533_301253_1b
CTAGAAATCAACTTTTCTCCTTTCAATTACTCTATAAAAAATGTCAGGTCGTGGAAAGGGAGGCAAAGGTTTGGGTAAA
GGAGGAGCAAAACGACACCGTAAGGTGCTCCGTGATAACATTCAGGGAATCACGAAACCTGCCATTCGGAGATTAGCGA
GAAGAGGTGGAGTGAAGAGAATCAGCGGGCTGATTTATGAAGAAACAAGAGGAGTGTTGAAGATATTTTGGAGAATGT
GATTCGTGATGCTGTGACTTACACTGAGCACGCCAGAAGAAAGACTGTCACTGCAATGGATGTTGTTTACTCTTTGAAG
AGACAAGGCAGGACTCTTTATGGATTTGGTGGTTAAAGTTTGGGAAATTGTTGTTAACTTCTGTGTTACTATTTGGTGT

FIG. 2 continued

TATTGTTAATGTAGTTGACTAGATTTTCGTATTAATGAAATGAAATCCGTTGGTTTTATTCTCATTCTTGTGTCCATTT
GATTTTGAGTCTCCGAGTTTTTGATTGAGTGGGAATTGTAGTATTTTTGTTTGTTTGTGTTGCTTTACCTTATGAGTTT
GCACAATGTTTATTCAAAATTCA

> SEQ ID NO: 6326 212412 126606_300465_1b
GCCATTACGGCCGGGGAGAATCCGAATCAACCACATTTTTGCTCATTTCAAATTCAAAAATCCCCAAAAATCTAGTTTC
ACAATGTCAGGAAGAGGAAAGGGTGGAAAAGGATTGGGCAAAGGAGGAGCTAAACGACACCGTAAGGTGCTTCGTGATA
ACATCCAGGGAATCACGAAACCTGCAATTCGGCGTTTGGCTCGTAGAGGAGGAGTGAAACGTATTTCTGGTTTGATTTA
CGAGGAGACACGAGGTGTATTGAAGATATTTTTGGAGAATGTGATTCGTGATGCTGTGACTTACACCGAACATGCCAGG
AGAAAGACTGTTACTGCTATGGATGTTGTTTATGCCCTCAAGAGGCAGGGAAGGACTCTCTACGGATTTGGGGGTTAGA
TTTGTCTAATTAGAGTTTTTGTGGGGTAATGATTGTAGATTTGTTCTTTACTATCTGATGTATTAGGGTTGGTTAGTTT
TTGTTGAGATTTTATAATGTAATTCTCTATTACATACTCAGGAATAGTAATTGCCCAAAAAAAATCTAACAAGCTTCTA
GTAGTATATATAACAAGCTCGCATTCTTAAAATCATAAATCTTGGAACAAGGTTTTTTCTTTTCTTTCTAG

> SEQ ID NO: 6327 212412 122243_300017_1b
CCCCCCCCCCTGAAACCAAAAAAATCCCCAAATCTCAAATCCTCCTCCGTCTCCAAGCTCTCGTCGTCGTCGTCAGACA
TGTCGGGCCGTGGCAAGGGAGGCAAGGGGCTGGGCAAGGGAGGCGCGAAGAGGCACAGGAAGGTGCTGCGCGACAACAT
CCAGGGGATCACGAAGCCCGCGATCCGGAGGCTGGCGAGGAGGGGCGGCGTGAAGCGCATCTCCGGGCTGATCTACGAG
GAGACCCGCGGCGTGCTCAAGATCTTCCTCGAGAACGTCATCCGCGACGCCGTCACCTACACCGAGCACGCCCGCCGCA
AGACCGTCACCGCCATGGACGTCGTCTACGCGCTCAAGCGCCAGGGCCGCACCCTCTACGGCTTCGGCGGCTGATTCCT
TCCTTCCTTCCTTCCTGGTGGCGTGCGGGTGGTGGTGGTGTAGGAGCTAGGGTTTCGATGGGATTCGGGGGGAATT
TCTGCTTTGTGTTGGCTTCTGTGTAGCGACTCTTCTGTTTAAATGAATTCGATGAATCTGAACTGAAGATTTGGTTCAA
AAAAAACAAAAAAAAAC

> SEQ ID NO: 6328 212412 120756_300516_1b
CCCACGCGTCCGCGATTTCAGGGCTCCCCAAGTAGTAGACTTCTCTCTTCTTCCATCTCGGATTCGTCTCGGTCTCCGG
CGATGTCTGGGCGCGGCAAGGGAGGCAAGGGGCTGGGCAAGGGCGGGGCGAAGCGCCACCGCAAGGTGCTCCGCGACAA
CATCCAGGGGATCACCAAGCCGGCGATCCGGAGGCTGGCGAGGAGGGGCGGCGTGAAGCGCATCTCCGGGCTGATCTAC
GAGGAGACCCGCGGCGTGCTCAAGATCTTCCTCGAGAACGTCATCCGCGACGCCGTCACCTACACCGAGCACGCCCGCC
GCAAGACCGTCACCGCCATGGACGTCGTCTACGCGCTCAAGCGCCAGGGCCGCACCCTCTACGGATTCGGCGGCTAGGC
GAGGCGATGCGAGGCCACGCGATTGGATAGGGATTCGATTAGTGCCATGTTCTTCAGTTCGTCGTAGTAGCTTAGCCTC
TTCTCCTGTAGCTGTTGTTTCATCTCGTCTCCTGTTCCTTCATTAATTAGGGATGTATGAACTACTGGTTCGTTCGTTC
GAATGGAATAGGAAATCTGCAGTGATTTACCCTC

> SEQ ID NO: 6329 212412 1112643_301803_1b
ACATAGACAAGTTAGATTTGAATTTAAGATTGACAGAAAGATGTCGGGCAGAGGCAAAGGAGGGAAGGGTTTGGGAAAG
GGAGGGGCCAAGCGACATCGCAAGGTCTTTCGAGATAACATCCAGGGCATCACTAAGCCTGCCATTCGAAGGCTTGCTC
GTCGAGGGGGTGTCAAGCGTATCTCTGGTTTGATCTATGAAGAAACGAGAGGTGTTCTCAAGATCTTCCTCGAGAATGT
CATCAGAGATGCAGTTACCTACACAGAGCATGCCGAAAGGAAGACTCTCACGGCCATGGATGTTGTCTATGCCCTCAAG
AGACAGGGAAAGACCCTCTACGGTTTTGGGGGTTGAACTTTCCTTTCTTACTTTTTGGTCTTCTTTTACGGTGTTTGTTA
ACACCACTGCCTTTATGATCTGAGTTACTTTTGGCGAACTTAATGTCATATACATGTCTGTTTTATGTTTCTTGAACTT
GTAGATGTTTTGAAAATTAGTAAAGATTGGTGTTGATTTATGGTGGA

> SEQ ID NO: 6330 212454 205633_300800_1b
ACGCCCACGCGTACGATTTGGCAATTCCTCAAGCTCACCCATTTGTTGACTACTGGCAGTGTAGCACACAGTCTGCTAC
AACAAACCACATCACCAT

> SEQ ID NO: 6331 212475 195541_300635_1b
CCCACGCGTCCGGGGAATTAAATCCCCTCGCTGCACTACCGCAACCACCGTCAACCTCGCTGCTACCTCTCAATTGAAC
TCGACTCGAGCTCCGTCAATC

> SEQ ID NO: 6332 212492 200281_300757_1b
GTTTCGGAGGCTGATTGAGTCGGAGGGGCTGCCTTATTGCGGCAGAGGAATAGTGACGTCATGACTATCAAGGACCCTG
GAGGTTACCTAAAAGAAAAGCATCTGGACGAGTGTTAGAGTGTGCGAATGGATCTCATTGTTTGAATTGATGAATCTCG
GAAGATCTGAGCTAGCTGCAAGATGCCTCAAGCCATGCGCAAGGCACGTGTGGATGGAGGCAAGATTGGATGGAGATTT
ACTGTAAATCTTCCAACTTTAACTATAGAAGGGAAAGGGGAAAGAGGCGATCGCTATACCGCTGGTTGGATTCAGCTC
CAGGGACAGATTTCATCAAAACAAGCGATGAACTGTGTGGTGACATATATATACGAGTACGGGTTTGATCAT

FIG. 2 continued

> SEQ ID NO: 6333 212504 205464_300798_1b
ATCCTCTTCAAGAAGGGGAAACTCCCCGAGATGCATAGAGGAGCAGAATCTCTCGTCGTTTGTCGGGATTTTGCGCTCT
CTGTCAACTGTGCCACCACTTAGATTGCCTTCTATTGCTTGCCAAAATCCGGTTGTCAAATGAACCGCAGTGCCCATGT
TGATTGTCCAGTGACTTGAACTCGAAGCGGGCGCCAGGCATTCCAGCCAGAAACAGTGCTCTGCATCGGCTCTCATTAT
GTAGCAGAGGGTGTGG

> SEQ ID NO: 6334 212714 238123_301292_1b
GGGAAAGAGGGACTTGGCGCATGGGGAAGATCATCCAGGAATATTTGTCGGGCGATCGAATCTACTGCTGCAGCAATTG
CCATACCCATGCCGCCGATCACGAGCAGGTTGTGTCCAAGAATTTCAATGGGCGATTTGGCCGTGCCTACCTCTTCAAC
AAAGTGGTGAATGTGTTTCTGGGGCCCAAGGAAGAGCGAATGCTCATCACTGGATTGCACACGGTGAACGATATCTACT
GCATTTGCTGCCAGCAAGTCCTCGGCTGGAAATATGATACTGCGCAGGAAGAGAGGGAGAAGTACAAGGAGGGCAAGTA
TATCATTGAGAAGAAAAGATGACCAAAGAGAATTGGTAACGTGTGAATACGATAACATTCATGTATTTAATAATAAGA
ATCCTATTTTAATTC

> SEQ ID NO: 6335 212714 1119636_301899_1b
AGAGAAAGAGAGAGAATGGGAAGACTATTCTTGATCCACCTTGAGGGTAAGATATACAAATGCCGCATCTGCAACTGCC
ACTTGGCAAAGTGCAGCGACCTTTTTTCGAAGAACTTTCACTCCAAGAATGGAAAGGCTTATCTGTTCAACACAGTAGT
AAATGTCTCAGTTGGGCCAAAAGAAGATCGGATGATGACTACTGGCTTGCATACAGTATTGGATATTCACTGCTCTTCC
TGTAATCAGATTGTTGGTTGGAAATATGAAACGGCCTATGAAAAAGCCAGAAATACAAGGAAGGAAAGTTCATTTTGG
AGAGGGCTAAGGTGATAGATGGACATGGGCGGACTAATTTATCGGCGGAAATTAATCTTATTTGAATCGATGCTGACGA
TTCATGATACGTCGGTAACTAAGCACCCATTTGTAAATAATCTTCTAATTTTTTTGCCATTGCACTGCCTCAATTTTTT
GGTGGGCGAATTTGGTTCGAGAAAAATAGAAGCATTTTTTCTCATTCAATGCCAAATGATTCAAACTTGTAAATGGTG

> SEQ ID NO: 6336 212714 146948_301204_1b
CATCTTTTGTAATCATAAACTCACCAAACTCCGACACCCCTCTTTGCTTTACCCCACTGTACAGACAGCCCCGCAAAAC
ACACACACTCTCACTCTCTCTCTGTGGCAACCAGCTGATCAATCTGCGATTGCTTACCTTGACACTATGACCAGATA
AAAACAGATACACTTNTTTGGTCAAAGAAGAAAGGCTGTGTAGATAACAGATTGTAGTTTTTTGAAGGATATAAAGAAG
AGTGTCACAGCTATTGAGAAAACTTGTGCTTATTTTGATCATCAAATGGCTGAAATTATTGGCCCTAGATTGTACAGTT
GCTGCAATTGTAAAAATGAAGTTGCACTACACGATGACATCATTTCTAAGGCTTTTCAGGGAAGAAATGGTCGAGCATT
TTTGTTTTCTCATGCAATGAACATAGTCGTGGGGCCAAAAGAGGATAGACAGCTAATGACGGGCCTCCATACAGTTGCT
GATGTCCATTGCTGCGACTGTCGTGAGGTTCTTGGCTGGAAATATGAACGCGCTTATGAAGAGACGCAGAAGTACA

> SEQ ID NO: 6337 212714 265956_200082_1b
TTTTGATCCTATCTTTCTTTACTGAGTTGTTTTAGTTGTCAACCTTAATTCCGAGTCTTCAATTTAATACTGATCCAAA
AGTCTTCTAAGGCAAAGATGGGGAGACTATTTGTGTTGACTCTTGAAGGCAAGATCTATAGCTGCAAGCACTGTGGAAC
TCATCTTGCTCTTTCTGAAAGCATTGTTTCTAAGTCTTTCCACTGCCGACATGGGAAGGCTTATCTCTTCAGTAAGGTA
GTGAATGTCACTTCTGGCGAGATAGAGAATAGAATGATGATGACTGGTATGCAC

> SEQ ID NO: 6338 212714 50790_300156_1b
AAATGGGAAGGATATTCACGGTGGAGCTTGAAGGAAGATCTTACAGATGCAGGTTCTGCAGAACCCATCTCGCTCTTCC
CGATGATCTTGTCTCTCGGTCGTTTCATTGCCGTAGAGGAAAGGCTTACCTCTTCAACCGTTCGGGGAACATAAGTATG
GGTCCTCTAAAGGAAAGACTGATGCTTTCCGGTATGCACACCGTAGCTGACATTTTCTGCTGCTGTTGTGGACAGAATG
TTGGCTGGAAATACGAATCAGCGCACGAGAAAGCTCAGAAGTATAAAGA

> SEQ ID NO: 6339 212725 210656_300891_1b
GGGGGAATGCCTCCGCCGATACTAACCATTAAGCCAAACTTAATAGATAGAAAGGTGTAGATCATTCAGGTCGCGAACG
TTGCTGCGCAGGCTATAATAATGTTATACTTGCTGATCGACCCCAAGGTGTATGGATTTGGGTCATTCGGCGGTTTTGG
AAGACAGATGTGTCTATCGTCCAGCATAGCCGTCGCCACAGCCTGCTCTTTGGATGAGCACATACCCATCCAACAGTGT
ATTCATCATGAGTTTTAGTCTTAGTAGCTAGTTATCAGTAGTAAGAACAAATAATTCTTTCCAACT

> SEQ ID NO: 6340 212777 209023_300811_1b
GCCCCCATACAATCTCCAACTCAACTCAACCATGCTATCTGTGGACCACAACTACAACTCATCACAACAATATCAGCGC
TTTCAACAACAGCAACAGCACCAGTATAACAACAACATCACCAACAACAACAACAACCTGAACAACCATCATCAGACAA
AGCTGGACGACTTCACCTTTGGCAACTCGACCGACTTTGACTTCTCGACCTCGACCTTCCCCTCAACCGAGCTCTCTGT
GTCCAATCTCGAGTATCTCAACGCCGCAATCGCCTCTGCGTTTTCGTCTGACTCGATGCGGCCCGAATCCTGGGACGCC
GCCGCTCGCTTCTCAACTCCCAAGTTTGGTCGTCTTCCCCATCAACGAGAATCCTCTCTGTCTTCTCTGGGATCTACGG

FIG. 2 continued

GGCCGGCGTCGCCCTTCAACTCGCACATCGCGAACCCCCACATCGCCGTCACTGACGCCAATGGTGACGGCTTCATGGA
CATGCACTCGCACGACATGACCATGAGCTCAGGCCCTTACTACCAGCTGGCCGCCAAGACGATGCCTCCCTACTCAAAC
TTCCATCATCTCGACAACGCCTCTGTCAGCGAGATGGCATATCCAGTCTCCATCCCGACCAACAGCCACCACAAGCTGC
GACAGGATCGCAACCTCCTCCC

> SEQ ID NO: 6341 212785 1098773_301486_1b
TCAAAACACAGCACATTCGACACCATGCTCGGCCTCCGTACCGCTACGCGCGCCTCGCAAGCGCTCCCCGCTTTCCGCA
ACACCGCTGCCCGCCGCTGGACCTCGGGCATTGGCGCGAAGGGCTTCGAGGGCGCCGCCGACAACGCCTTCAACCGCGA
GAGGGCCGCTGTCAAGCAACACGCCGCCGACACTTCTGGCACCTGGCGCAAGCTCTCGATCTACGTCGTGATCCCCTCC
ATCATCCTCGCCGGCGTCAACGCCTACAGGCTGTGGATCGAGCACTGGGAGCACGTTGCTCACGGCCCCGCTCTCGAGG
ACAAGCCCGAGTACCCCTTCCAGAACATCAGGACCAAGAACTACTTCTGGGGAGACGGTGACAAGACCCTCTTCTGGAA
CCCCAAGGTCAACTACCACAAGAAGGAGTAAAGTAGAAGCCTTTGGAACTTGAGAAGTATGCGCCGGTGATTTGGGTCT
AGAGGACGGAACACGCAAGTCCACCCGACGGGACCGCTGCTACAGCAGCAGTGTG

> SEQ ID NO: 6342 212792 195561_300635_1b
TTATTACTCGACCACGCGTCGGTTTGCTGGCAGGACGACATCTCCACCATAGAGTCGACTCATTGCTGGCATACGGAGC
ATTCCAATCTTACTCGTAGTAGTGTTATTGCCATCGCTCATCATGCTGCCCAAGGCGATCATCGCGATTGCCGCATTGG
CTTTCAGCCCAGCAAATGCGCTGTGGCCCATTCCTCAGAAGATCTCGACCGGAGACAGCGTGCTCTTTATTGACCAGGC
TGTCAGGGTAACTTACAATGGAGTGCCGATCATCCCTATCGGCTATAACCCACCGGCCAGCTCCAACTTCGACAGCAGG
CAAATCGTCCAAGGCGCTGTCTCGCGTGCCTTTCAATCCATCTTCAACACCAACTATGTGCCATGGAAGCTTCACCCGC
GTAACAGCAACTTTGAGCCGAAGGTGGCCCCTCTGAACCGAATCCAGTCCATCTCAATTCAGCAGACTGGAAAGGACAC
TTCCAAGACGTTCAAGCCGCGCCGGAGATGTTGATGAGTCGTACTCTCTGACCATTTCCAAGAATGGACAGGTCAAC
ATCAGTGCCAAGTCCTCCACTGGTGTGCTGCACGCCCTCGAGACCTTCTCGCAGCTTTTCTACAAGCACTCTGCTGGAC
CTTTCTACTACACGACACAGGCACCCGTGTCCATCACAGACGCACCCAAATACCCCCACCGTGGCATCATGCTTGACCT
TGCCCGTAACTATCAAACCATCGATGACATCAAGAGGACCATTGACGCCATGT

> SEQ ID NO: 6343 212892 211493_300899_1b
CGCATCTTCACCAAGGCGCCGTCATCGCGCGGCATCATCGTCATTGACTTGAGCTTGGAAAGCTCAGCAAGATGCCAGC
AACCATGGCCCCTCCAACGCAGACTTTCAACCTCGATGTTGAGGCAATCTCGGGCATTTGCGGATCTATCTCTATAGCC
TGTTGGGTGGTCGTGTTCTCTCCGCAAATCATACAAAATTTCCAACGCAGCAGCGCCGACGCTCTTTCGATTCAATTCA
TCATTGCTTGGCTCCTAGGAGATGTCTTCAATATCCTCGGAGCCGTTTTACAGGGAGTTCTCCCCACCATGATCATCCT
AGCCATCTACTACACCATTGCCGATCTCGTACTGCTCTGCCAGCTGTTTTACTATCGCGGATTTACGTGGCGCGACGAG
CCGACTCCATCCCCGCCCAAGACAAATGGCCACTCTTCGACATCA

> SEQ ID NO: 6344 212892 258836_301700_1b
ACAACCACAGACACGCACACGACGACTCGATATGGACGCCGTGTACACCGCAGTACAACCTCCAATTCATGGCCTAGAC
TCATCAGCCCTCAGCGGCATTATGGGATGCATTTCCATCGCCTGCTGGATCATTGTTTTCACGCCCCAGATTTATGAGA
ATTTCAAACGACAATCGTCAGAAGGACTGTCTCTCTCCTTCGTCGTCATCTGGCTCATTGGAGACATCTTCAATGTGCT
CGGAGCCATCCTCCAAAAGATCATCCCCACCATGATCATCCTCGCCATCTACTACACCCTGGCCGACATTCTGCTGCTC
TTGCAATGTCTGGTGTACACACACAGAAACAAGATGGTTGATCTCAAGCACCTGTCTCCCGCCACACCTCTTCTTGAGG
CCGATCCCAGCCACGATGCCGAGCCCGTCCTGCTCCCGTGACCGAACCCGTGCCGCGAGCCAAGGTCATCTTCTACCG
TCTGCTGATGGTGGCCACCGTCATCGCTGCCGGCATTCTGGGCTACGTCTTCTCGTCCAACAACCACAAGGACGGTAAG
CCCGAGAAGCCCCACGACGATCCTTTGGAGATGAACATGCTGGGTCAGTTTTTCGGCTGGCTATGTGCT

> SEQ ID NO: 6345 212959 208338_300834_1b
AAAAGGTAGGGCACACGACAAACTTGGCCCCGTCAGCAACCAGCGCACGGCATGCCTCAGGGAAGGCCAAGTCCCAGCA
GATGATGAGTCCGACACGACCCCAGGGAGTATCAAACGCCCTGTGCGGCGTCAATCCATCGGCTGTCAGATGATCTCTC
TCGGGGTGCCACAAGTTCTTCTTCTGGTAGCGTCCCAGAACGGCGCCGTCCGGACCGATAAAGTACGCCGCATTCGCAA
TTCCTTCAGTCATGGAGGCATTGCCTTCCTCCGCAGGGATGGGCTCTAGGATCGTGCCCGGAGCAATGGCGATGCCGAG
CTCCTTGGCAATGGCCTGATATTTGCAAGATACGGCGTCTGCTCCTTGGCCGTTGCGAGGAGGATCTTGGAGTCGGGC
TTCCATGAGCCGAGATGGTACTCAGGAAGGACGACCAGGTTCGCGCCCTGGGAGGCGGCCTTGCGGATGTATGACTCTG
CGCGAGCAAAGTTGCCAGCTACATCGAGCGGCTAGAGTTGGTGAACAATTAGGAGACAAGATCAGCCTTCATAATTGCT
TCAGCTGCAGCAGGGGTTGTTGGTGGCACACGGGCGACGAATGCCAAGCAATACGTCAGATACGCAAACTCACCTTGGA
ATACAGCTGAACCAGCGCAATCTTCAAATTCGACGCCATTGTCACAGAAAATCAAATGCTAACACAAGTCAAAGTGTAC

> SEQ ID NO: 6346 212959 212985_300845_1b
AATCATCTTACAAAAGCTTCCCAAAATGGCCCCGGTATTAAAGATTGCACTTATTCAGTTTCAGGCCAAGCCTCTTTGT
GTGCAAGAAAACTTTGACAAAGCGGTTTCAGAAATCCGATCCGCTGCCTCTCAAGGAAGCCATTTAGTTGTATTGCCAG

FIG. 2 continued

AATATCACCTCACATCATGGGTTCCAGAGGACCCTTCCTTTGCTACAGCCTGTGCAGCTTCCACGCAATATCTTTCACA
GTATCAAAAGCTAGCTAGGGAGTTAAATGTTCACATCGTTCCAGGTACCATTGTTGAACCTGTTACTATCCAACCATCA
AATGTCGTTGCTACTTCTCATGCAGAGCAAGACGTACTTGCAGGTGATCTCATAGTGGAGCTACACAACAAGACATACT
TCATCGCTGCAACTTCTGGAGATATCCTAGGAACATACCAAAAGAAAAACTTGTGGCACGTCGAGCGCGGCGTTTTGAC
CGCTGATAGGCGAACGCCGCACAAGGCGTTTGATGTTCCACTCCCCGGTGGCCATATCGTGCGAGTCGGTCTGCTTATA
TGCTGGGATCTCGCCTTTCCGGAAGCCTTGAGACAATTAGCTGCGGATGGTGCAAAGATTGTCGTTATTCCTGCCTACT
G

> SEQ ID NO: 6347 212960 212993_300845_1b
ATAGAGGCGCTGTGTTTAATTAAACGCCTGAGGGCCGAAGTCATTCTTGCATCAATTTTAGTGCGGTATAGGGAACTCG
TCAACGCAATCTCGCTCGAAGCAAATCACCAAGTTCGGGTGTAGAGATATGTGCGTAGGTTATAAGAAGTGGACAATAA
GATACTGTTGCGTACCTGTACCGAGTAGAAATGCAGGATATGGCTGCCGGTAGGGCTCGTTCTTCGGATGGTAAAAGTC
GTGCCGGTCGATCAATAAACAGAGGCAGGAGCATGGATTTCACACGCGTGGCTAGTCAAACGAAGGCGGGAGAGGAAAG
CACCAGGAGAACCTGTTGTAGTATTCTGGGACTGCGATAGGGTCGCTTCTCAGGCGACAGGAATGGCTTCGTCTGGCGA
GCTTTCCGCGTCCCGCGGATGGAACACAGCATAGTACAACACATCCTTCGGAATATGCCCCTGGTAGGGAGACCAATGG
TAAATCGGGCTCAGTAGG

> SEQ ID NO: 6348 213004 219506_300946_1b
TGTAAAACGGGTGTGTCCGGTGCACACTGTCACGGCATAATGGCAACCAAGGCGGCCAAGGCGGCAAAGAGCCACGAGC
ATGACAAGCGCAAAGGCGAATCAGCCCTCAGCGACTTTGCGGAATATGTAGAGCAACAGCAGAACCTCCGGTATCCATC
CTCGAACAAGAAGCCCGTTCCCGACTCGGCAGAGCACGATGCGGAGCTGGACGAGCTTCTAGACAGTCTCAATCTAGTC
GACTCTGCGCCGCGGATAAAGCTCAGAGACCTTGTGCTCGGAACGGACGATGACACGTTGCGGAAGCTCGGGGATGTCA
TCACGGAGCGGATAGAAGAGGGCGCCGGGGAGACTGTCTTTGATCTTGGATTCGAGAACAGCGGCGAATCAATGCAGCT
GACACTGGACGAGTGGAATATTGCGTATCCAAGACTGGTCGAGGCTGCGAAAAAGGTGCGCGCAGATTGTCAGCTTCTC
CTGACGACCAATGTCGGCGGCAAGGAAGAGGCTGAGAGCACGGCCACCAATCCGACCAAGGACAAGAGCTGTAGCGGCA
AGATTCTTATCCGGAGGATACCAGACAAAATAGAAGACGTCATTGAGACTCGGATAGCTGTAGTTGGCAATGGTAAGCT
TCCCGTATGG

> SEQ ID NO: 6349 213011 205666_300800_1b
GTGCCTTGTTGCAGCATCCCGTAACCCCTGCAGGATACCGCCCTAAGCCGCCCAATTTCTCGTCACTGGCTCTAGCTTT
TTGCTGTTTATCCCGAAATGGGCATCGAATGGCTTCTGTTCCCTCCCCCCCTATGATGTGTGGCTTGACCAGTCGATGA
CGCAAACATGGAAGCCGGCTTCCTTTCTCCTTCTTGGTCGGAATGCCTGGGAAGGGCCAAGATGACGAGCCACGGCAAT
AAATAGTACAAGCTTCGCAGAAACCTTCTTGTCCGCTCTTCTCCCTTTTGTGTCTCACACAGCTTTTCTTCATCTTTAC
TCCGCGATCTTCTTGATCTTCACCAAAACAACATCATTGCGCCCTTGAAGCCCTCTTAGCAAATATTCGATATACCCAA
AAGGCATTGAGCCCTTGAGCCTTACGAGAAACACATATATCCAACATGCCTTTCACCGCTAGCGATATCTGCAAGATTA
TTCTTGCCATCATTCTGCCACCCGTCGGTGTCTTCCTCGAGCGAGGCTGCGGTGCAGACCTCTTGATCAACATCCTCCT
CACAATCCTGGGTTACTTCCCTGGTATCATCCACGCTCTGTACATCATATTGAAATACTAAGCCCGCCTTCCGCTCCCG
TATCCCGCCGGATTCAAAGCGTCATGTCGTCGCACCGCATCATGTTGTGCAGACACCAATTACTCCCACGTTTGACCGG
CAATTGTCGTTTTAGAATGGATGCGTCAGTGGAGGAGTGAAGGTTACGGTCGCCGGCTCACCACGTGGCCGGTCATAGA
CGCCATAATGACAGTGGGCTTTCCTTTATGGCTTTTCTTTTGTTTTTTCTTTTCCTCTCTTGTTGGCTGGAGGCAGATG
CACCCTATTTGAAAGGGGGCGT

> SEQ ID NO: 6350 213011 224168_300979_1b
ATATGTTGCTGGTTATGGTACAATTAATACTTGAAGATGATGTAGAGGGCATGGATGATACCGGGAATGTATCCAAGAC
AACAGAGGAGGACGTTGATGAGCAGGTCAGCGGTGCATCCTCGCTCCATGAAAACTCCAACGGGGGGGAGGAAGATAGC
AACGATGATCTTGAGAATGTCGGAAGAGGTGAAAGCCATTGTGTTTGTGTTTGCGGACGCGTGGGT

> SEQ ID NO: 6351 213011 1100450_301460_1b
GCTACCCATCTATCAACAATAAACCTATCAACCAAGACACATGACACCACCCCCAAAACAAACCCCACACACAAACCGC
CACAATGCCTTTCACCGGATCCGACATCATCAAGATCATCTGCGCCGTCGTGCTCCCGCCCCTCGGTGTCTTCCTCGAG
CGCGGCTGCGGTGCTGACCTCCTCATCAACATCCTCCTGACCGTCCTCGGTTACATCCCCGGCATCATCACGCCCTCGT
ACATCATCCTCAAGTATTAGATGCGTCGCCATCAGGCACCAGCATGAGCGCGCACCACCACCCGCCACCTGCTACGCG
GAGCAAACTCTACGTGAACCCACCAAACATACGATACCCCAAAGCGAGAGGAAAGGAAGCATGCAGCGGCGGCATAAT
TTACACATTGTGTTGAATTACGGAACGGATCGCCGAGCTTTGACAGCGAGGCGAGGCAACCCTTTTTTACGAGCTTGCT
TTTATGAGATTGAGTAGTAATGTCTGTACTACAATTCTGAAAAATCATCCACCTA

> SEQ ID NO: 6352 213037 19202_300214_1b
CTCGAGCTTGCGGCCGCTAAAAGTTAAAGCCATGGCTGCATCTTTCTCTGTCCCCTCTATGATAATGGAAGAAGAAGGG

AGATTCGAAGCGGAGGTTGCGGAAGTGCAGACTTGGTGGAGCTCAGAGAGGTTCAAGCTAACAAGGCGCCCTTACACTG
CCCGTGACGTGGTGGCTCTACGTGGCCATCTCAAGCAAGGCTATGCTTCGAACGAGATGGCTAAGAAGCTGTGGAGAAC
GCTCAAAAGCCATCAAGCCAACGGTACGGCCTCTCGCACCTTCGGAGCGTTGGACCCTGTTCAGGTGACCATGATGGCT
AAACATTTGGACACCATCTATGTCTCTGGTTGGCAGTGCTCGTCCACTCACACATCCACTAATGAGCCTGGTCCTGATC
TTGCTGATTATCCGTACGACACCGTTCCTAACAAGGTTGAACACCTCTTCTTCGCTCAGCAGTACCATGACAGAAAGCA
GAGGGAGGCAAGAATGAGCATGAGCAGAGAAGAGAGGACAAAAACT

> SEQ ID NO: 6353 213037 212726_300843_1b
CGGTAATCGAATTATCAGCATCCGCCTGTCTTGTCTGTTTCGGTATCTTGATAGTGGCAGCGACAGTACATATCAAAAG
ATGATGCGAATAGCTTCACGAGCTCCCCAGCGGGCGTGCTCTCTGGCCTCCTCTTCTGCATCCGCCGTTCTTCGTCGAT
CCATCCCGCGCTCTGTTGCCATCCGCGCCATTGCAACAACCGCTCGCATGGCTGCTCCCACTCAGACCATCGCTCACGC
AGCGCCGGCCGACGCCTATCAGCTGCTGCCCGAGTCGCAAAAGGCCGGCCAGGCCGAGGATGCTCTCTACGAGCCCAG
GTCAAGGAGATTGAGGAGTGGTGGGCATCGCCTCGTTATGCCGGCATTCGACGCCCGTACAGCGCCGCAGATGTCGCAT
CCAAGCGCGGCACGCAGTTGATCAAGTACCCCAGCTCCGTCATGGCCACCAAGCTGTTTAACCTGATCCGCGAGCGCGA
GGCCAAGGGCGAGCCTATTCACACAATGGGCGCCATCGATCCCGTGCAAATGACCCAGCAGGCCCCTCACCAGGAAGTC
CTCTACATCTCCGGCTGGGCTTGCTCCTCCGTCCTGACCAGCACCAACGAAGTGTCTCCCGACTTTGGCGACTACCCCT
ACAACACCGTCCCCAACCAGGTCCAGCGCCTCGCCAAGGCCCAGTCCATGCA

> SEQ ID NO: 6354 213037 205080_300795_1b
TTAGTCTTCTGGATCTCCTTGTTTCTTCATCCTCTATTCAATTGACTTGATTCACTCTTGTCTAACAAGCAGTGACCAC
TTGCATCATTCATCATGGCCTCCAACAACATGGTGACGCTGGCTGTGAATCCAGACAAAGAAGACGACCTCTTCCTCCA
AGAAGTCCAGCAGGTCAAAGATTGGTGGCGCGATTCACGATGGAGGCACACCAAGCGTCCCTTCACTGCTGAGCAGATC
GTTTCTAAGAGAGGCCATCTGAAAATTGAGTATCCCAGCAATGCCCAGGCCAAGAAGCTATGGAACATCCTGGAGAACC
GTTTTCAGAACAAAGATGCTAGCTATACCTATGGCTGCTTAGAGCCTACAATGGTCACTCAGATGGCCAAGTACCTCGA
CACCGTCTATGTCTCTGGCTGGCAGTCGTCTTCAACCGCCTCTGCGTCAGACGAGCCCGGCCCTGACTTGGCAGACTAC
CCATACACCACTGTGCCCAACAAAGTTGGCCACCTCTTCACGGCCCAGCTCTTCCATGATCGAAAGCAACGCCAGGAAC
GCTTGAGCACCCCCAAGGCTCAGCGTGCCAATGTGGCCAATATTGACTATCTACGACCCATCATCGCCGATGCCGATAC
TGGCCATGGCGGTTTAACTGCCGTCATGAAG

> SEQ ID NO: 6355 213037 144975_301079_1b
AGCATTTGTATAGAAACAAACTTGTATCCACTAAACAAAAAATTGAGTTCTAGCCATGGCTGCATCTTTCTCAGTTCC
ATCAATGATAATGGAAGAGGAAAGGAGATTTGAATCAGAGGTAGCAGGGTGCAAGCATGGTGGAACTCAGAGAGGTTC
CAGCTAACCAAGAGGCCATATTCAGCTAGGGATGTGGTGGCACTAAGAGGGTACTATGAGACAAAGCTATGCATCCAATG
AGTTAGCCAAGAAACTGTGGAGAACACTCAAAACTCACCAAGTCAATGGCACTGCCTCTAGAACTTTTGGTGCACTTGA
CCCTGTTCAAGTCACTATGATGGCCAAACATTTGGACTCTATCTATGTTTCTGGTTGGCAGTGTTCTTCCACTCACACC
ACATCCAATGAACCAGGCCCTGATCTTGCTGATTACCCTTATGACACTGTTCCAAACAAAGTGGAACATCTGTTCATGG
CTCAACAGTATCATGATAGGAAACAAAGGGAAGCAAGAATGAGCATGAGCAGAGAAGAGAGGGCTAGAACTCCATTTAT
TGATTATTTGAAGCCGATTATTGCTGATGGTGATACTGGATTTGGTGGTGCTACTGCTACTGTGAAGCTTTGCAAGCTT
TTCGTCGAGCGCGGTGCTGCTGGTGTCCACATTGAGGATCAGTCATCTGTGACCAAGAAATGTGGTCATATGGCTGGTA
AAGTTCTTGTTGCTATTAGTGAACACATTAACAGGTTGGTGGCTGCAAGATTGCAGTTTGATGTGATGGGAACGGAGAC
GGTTCTCGTCGCTCGTACTGATGCAGTAGCAGCAACCCTGATCCAAACCAATGTGGATACGAGGGATCACCAGTTTATC
TTGGGGGTATCGAACCCGAATCTGAAGGGGAAAAGTTTGGCTACTCTTATGTCCGAAGCCATGGCAGCGGGCAAAACCG
GGCCTGAACTTCAAGCCCTTGAGGATAAATGGCTGGCAATGGCTGAACTCAAGACATTCTCTCAATGCGTTATTGATGC
AATCAAGAAAATGAACGTTACGGAGTCCGAAAAGCAGAGGA

> SEQ ID NO: 6356 213052 213043_300846_1b
CCCACGCGTCCGGCACCAATTCCCAATTCATCTATATAATCTTCTATATCCCGATCGACACCACATCACATCCCGCCAT
GGCCGCTCCGACAGAAGCGCAGCTCGCGCATATCCAGCTCCTCGAACAGCTCGACATCCACTCCATCCACAAGAACTTC
CGCAACCCCAACTGGAAGCCCAACCAGCGCCGAAACAAGAACCTCAAGGCCATCGTAGGCGACGCGTCGAAACGAGAAG
CCTCTGCCCTTGCGACTCCACAAGACGTCAGCGGCGATGCGACCCCAGCCGCCGACGATGGCCTCTCGACCAGCGGCAC
CTCGACGCCGGCCACAAGCACCAATGGGAACCCGCCGCCGCCGAATCTTGCGCAGGCTTCGCGTAGTTTGTCGAAGCTC
GTGCTGGAAAAGACGTTGAAGCCGCCTGTGGGAGGGGCTGGAGCTGTGTCGGCACCAAACGCGACGTACACAAATATTG
AGTCGGCGCCTTCATTAGCACATTCGAAGCACTACTGCGATATTACGGGCCTTCCGGCGCCTTACTTGGATCCCAAGAC
CAGGCTGCGGTATCACAACAAGGAAGTGTTTGGGTTGATCAGAGCATTGCCCCAGAGCTCTGCGGAGCAGTTCCTGGCT
GCTCGTGGCGCGCATACGGTGCTGAAGTGAGCGCGCTGGTGGATGATTATACG

FIG. 2 continued

> SEQ ID NO: 6357 213058 213077_300846_1b
ACATTCTCCCATACCCCAAGCACCTCTACAAGGAAAAAGAAATAACCCCCATGGCAACCCACGTCATCCAAGGTCGGA
GTTACAAGTAGAAACTTACTCGCACACGTTAGACTGACTGTTAGTACTACAATAAGATGGAGGGAAAACACAGAGACCG
CACGTTGTTACAGGATACAGACCAGACAGCGCCAGCCGCGAGCTGATAAAGCTAGAGAGAGGGAAAAAAGTGTTGGCAGA
GAAGTGAGCGATCCTGGAGGCGCCGAGGGCATTGTAGGATCCAAGTATTTGAGCCCTGACCAAGCTAGGTCAGCATTGC
CTCAAACCACCAAGAGTCGGTCCATGGGCCGGCATGGGGGAAGAAACAGAGATTCCAGGATGGCATCTTGATCGAAGAG
GATAATTCTGGGGCAAAGACGGCCTTGAGCCAGCAAGAGATTCCGCCTCCACGGCGGCGGCGGCGGCAGCAATTACGGC
AGCAGCATGACGAGCAGCCGGAGCCAAAGAAAGGCAATGACAATAGTGCTCTAAGGTTGCGGCTGGACCTAAACCTCGA
CATAGAGATTGAACTCAAGGCGAAGATCCACGGAGATATCACTCTGACCCTACTGTAAGTATCTTCTTCTGTGAATGAG
CTATCCAACTGTGCTAACATGTCATTAA

> SEQ ID NO: 6358 213059 206719_300825_1b
AACGGGCCTCCATCGACTCCAGACCATCCACGACCTACACGGAAGTGGCAAGAGATCGAAATCGTCTGCAGCTTACCCC
TGCAACGGCCTTAACAAGCTCCCGACTCGGCGGGAAGCTATAGCGATCCAAGCCGCTCTTGTCTCGTATATAACCAAGA
GCTAGACTTCGCATTAGATAGTTCTTCGTCCTTGTGTCTGAGGACAACTCCCTTCTTCATTACATACAATTGATTCAAC
CTGACCACAATGGCTGACGTTCAGTCCATTCGGGCATTCGGCAAAGCCCGCTCCACCATCGAGGGCAAGCCCCTGTCTG
ACGAAGAAATCAAGCAATACAATGATTATTTCAAAGCCAGCTGCTACCTTTCTCTGGGTATGATCTACCTGCGAGAGAA
CCCTCTCCTTCGCGAGCCCCTCAAGAAGGAGCACTTGAAATCTCGTCTTCTTGGACACTTTGGTTCAGCTCCCGGACAA
ATCTTCACATATATGCACTTCAACCGTCTCATCAAAAAGTACGATCTGGATGCCTATTTCGTGTCCGGCCCCGGTCACG
GTGCCCCCGCCGTTCTTTCGCAGTCTTATCTCGAAGGTGTCTATTCGGAAGTCTAC

> SEQ ID NO: 6359 213072 208951_300810_1b
ATCTCAATATATATCCACAATGAATCGAAAACATTCCGAGACTGGCATCACCGACGAGGCGGCTATTGAAGGCCATGAC
CTCATTCACAACGCCGAGATTGAGGAGCAGAGGGTATATTTCAACCACTAATGTCGTATCTTGGGTTACACGATTCTAA
TAATGTTTTAAAGGCTCATGGCGACCAGGCATTGACGCAGCCAGACGAGGGAGATGCGCCGCTCAACGCAACGAAGCAG
TCCGAGCCCGCCATGGCGGGACAAACCGGACGCCGCCATTCAGCGATGGACAAGATAAAGGAGACACTGCATCTCAAGA
AATAAATGAGAGATGAAAAAGATGAGGTCGGAAATAATTACAAAAAAATGGTCAAACTGATGATACCTGGCGGATGGGC
AGTCTGGATGGTGGGACGAAAACAAAAGAAAACCACAAATAAAGAGGAAGGGCACGTGTGTGTCACGTTTCGTCAAAGT
GTATTATATGAATTCCCCACATCCGCCCTCGAATTTCGTTGTCTGATTCGGTCGCCGCAGTAGGATATTTATCTTTTTC
TCAATACATGAATTATTATTTTTA

> SEQ ID NO: 6360 213072 220385_300954_1b
GGGTGACAGCTCAACTGAACAATCTCAATATATATCCACAATGAATCGAAAACATTCCGAGACTGGCATCACCGACGAG
GCGGCTATTGAAGGCCATGACCTCATTCACAACGCCGAGATTGAGGAGCAGAGGGCTCATGGCGACCAGGCATTGACGC
AGCCAGACGAGGGAGATGCGCCGCTCAACGCAACGAAGCAGTCCGAGCCCGCCATGGCGGGGACAAACCGGACGCCGCCA
TTCAGCGATGGACAAGATAAAGGAGACACTGCATCTCAAGAAATAAATGAGAGATGAAAAAGATGAGGTCGGAAATAAT
TACAAAAAAATGGTCAAACTGATGATACCTGGCGGATGGGCAGTCTGGATGGTGGGACGAAAACAAAAGAAAACCACAA
ATAAAGAGGAAGGGCACGTGTGTGTCACGTTTCGTCAAAGTGTATTATATGAATTCCCCACATCCGCCCTCGAATTTCG
TTGTCTGATTCGGTCGCCGCAGTAGGATATTTATCTTTTTCTCAATACATGAATTATTATTATTTCT

> SEQ ID NO: 6361 213115 217739_300911_1b
AAGTTGCTGACTGACCAGGTGTAACTAGGAGCGGGCAGTAGTACACAGTCTTTGTCTTGTCTTTGTCTTGTTTCTTCGT
TGATATACCGCCGCCTATCATGCGCCGTCTCCTCTCCGTCAGCGCCTCTGCCAGTGCCCGCGGATTGACTGCCGCTTCC
CCTCGGTCTACCATTGCCCTTGCCAAGATGGCTCCAAGGCTCAGGCTGCCACAGCCGTCAGGAGGATTCATGCCACGG
CTCAGCAGCTCAAGCCAATGGACGCCCTGTCGTCCACGGCCACCAGCTTCCCCACGACGCACGAGCAGATCGAGAATGT
GCAGAACACGCCCTACTTCATCAACAACAAGTTTGTCCAGTCGACGACGGACAAGTTCATCGACCTGCCCGACCCGGCC
ACCAACAACCTGGTGACCCGCGTGCCGCAGATGACGCAGGCCGAGATGAAGGCCGTCATCGAGAGCTCCGAGAAGGCCT
TCCAGTCGTGGAAGAACACCACCGTGCTGTTCCGCCAGCAGATCATGTTCCGCTACGTGCAGCTGATCAAGGACAACTG
GGACAGACTGGCCGCCAGTATCACGCTCGAGCCAGGGCAAGACCTTTGCTGATGCCAAGGGCGATGTGCTCCGTGGACT
GCAGGTCGCCGAGGCTGCCGTTGGCGCCCCCGAGCTGCTCAAGGGCGAGGTTC

FIG. 2 continued

> SEQ ID NO: 6362 213118 200064_300755_1b
GCAATCACTTGATCTTTCATTAACAAGTGTAATATCAAAAGTCACTTCAGTCTATTCGGACTCACATCCACACCAAACC
AAGTCACCGTCATAAGATATCAACATGAAAGCTATCTGGGCCACTCTACTTGTCGTGGCCACGTCCGCCCTCGCCAGCC
CCGTCGCCGAGGCTGCTCCAAACGCTGATCCTGGCGGTTACGGGGATTATGGAGACTACGGAGGATATGGAAAATACGG
CGATTACGGAAAATACAAACCCCCGACGCCGCCAAAGGGAGGAGGATACGGAGATTATAAGACATACCCACCACCGAAG
GGAGGCTATGGCGATTATGGAAAGTATCCACGGGAAGAGGTACCCGAGTAACACGGCGTGGGTCAGGCTACAAGACAGC
TTACAGTAGTTGACAGCTAAAGAAGCTTGAAAACCCAAGTCAGAATTTACTTATTCGGGAAATTCTACCCTATATGGAT
TGCTGTGACTGTTTTCATGATGACAATATTTCATGTACGTGAAATATACGTTGCTCACTAGATGTCTAATGTAGCATTT
ACACTATCAATGGGGTGTTCTCCGATAATGTCTCGCTTGATAACGTCCAACTTCC

> SEQ ID NO: 6363 213120 220480_300955_1b
GGTTTGGCTTGCAGTAAGACCGGCTTATGAGAAAGACCATTGTGAGAGATGTAAGGCTGATCCGGAGCTCTACGTCATC
TGAGACATGACATTGGCATGATGAGGGTCCAGTAACTACCTGATGATTGGGGTAATCGAAAGAGATGCAGAGAGAAACA
CGCAACTCTGAGAAAGCGTCCCGTTACACACGGAACACACTGCCTCCGGACAGCGGCTTGTGGCTCATTGCTTGAGTCC
CTTAATCAGCAATCCCCAGGTTCTCTTGACAGCTCAGCGGTGCAGTTTTGCGGGCACAGCTGATCCACCCGTCAACGGG
GCGGGACGCCGGGAAGCCGGGACTCCGGGGCTAAAATGACATCGCCATGACATCCGCACCGTCCGACCAGAACTGCTAC
TACTCAAGACGGTAAGCAAGTGCTAGCAAAAGTGAGTTTTACGAGGTAAGCAAGTAGGAACGTGGCTTATAAAGCCACA
GCTAGCTTGAGGCGAAGGCTGCTAGTAGGAACTAAAGTCAGCTTATACTATTTATAAGCTCACTGCATGGGCTAGTAAT
AATAGCTC

> SEQ ID NO: 6364 213123 226621_300999_1b
GAGCTGATTTAACAAATTTTAACAAAATATTAACGCTTACAATTTCCTGATGCGGTATTTTCTCCTTACGCATCTGTGC
GGTATTTCACACCGCATCAGGTGGCACTTTTCGGGGAAATGTGCGCGGAACCCCTATTTGTTTATTTTTCTAAATACAT
TCAAATATGTATCCGCTCATGAGACAATAACCCTGATAAATGCTTCAATAATAGCACGTGAGGAGGGCCACCATGGCCA
AGTTGACCAGTGCCGTTCCGGTGCTCACCGCGCGCGACGTCGCCGGAGCGGTCGAGTTCTGGACCGACCGGCTCGGGTT
CTCCCGGGACTTCGTGGAGGACGACTTCGCCGGTGTGGTCCGGGACGACGTGACCCTGTTCATCAGCGCGGTCCAGGAC
CAGGTGGTGCCGGACAACACCCTGGCCTGGGTGTGGGTGCGCGGCCTGGACGAGCTGTACGCCGAGTGGTCGGAGGTCG
TGTCCACGAACTTCCGGGACGCCTCCGGGCCGGCCATGACCGAGATCGGCGAGCAGCCGTGGGGCGGGAGTTCGCCCT
GCGCGACCCGGCCGGCAACTGCGTGCACTTCGTGGCCGAGGAGCAGGACTGACACGT

> SEQ ID NO: 6365 213123 189720_300608_1b
GCTGATTTAACAAATTTTAACAAAATATTAACGCTTACAATTTCCTGATGCGGTATTTTCTCCTTACGCATCTGTGCGG
TATTTCACACCGCATCAGGTGGCACTTTTCGGGGAAATGTGCGCGGAACCCCTATTTGTTTATTTTTCTAAATACATTC
AAATATGTATCCGCTCATGAGACAATAACCCTGATAAATGCTTCAATAATAGCACGTGAGGAGGGCCACCATGGCCAAG
TTGACCAGTGCCGTTCCGGTGCTCACCGCGCGCGACGTCGCCGGAGCGGTCGAGTTCTGGACCGACCGGCTCGGGTTCT
CCCGGGACTTCGTGGAGGACGACTTCGCCGGTGTGGTCCGGGACGACGTGACCCTGTTCATCAGCGCGGTCCAGGACCA
GGTGGTGCCGGACAACACCCTGGCCTGGGTGTGGGTGCGCGGCCTGGACGAGCTGTACGCCGAGTGGTCGGAGGTCGTG
TCCACGAACTTCCGGGACGCCTCCGGGCCGGCCATGACCGAGATCGGCGAGCAGCCGTGGGGCGGGAGTTCGCCCTGC
GCGACCCGGCCGGCAACTGCGTGCACTTCGTGGCCGAGGAGCAGGACTGACACGTGCGGC

> SEQ ID NO: 6366 213124 212388_300848_1b
AATTCTGGATCTGCTTGAGCCTTCTTTCTTCACTGTCCGCTCCCAATTGTCGCCTCGGTTCCACGGCTTCGGATTGGAA
CACGCGCCCACAGACAGAAC

> SEQ ID NO: 6367 213128 219564_300946_1b
CTCAAATAAACCACTCAATCGATTCCTTGATACCCCTTGGGACAAATCTACTTGTTCTCTCCAAACTTACCCCTCCAAA
TACCATCATCACCATCACCAT

> SEQ ID NO: 6368 213133 208416_300835_1b
GCGGACGCGTGGGCGGACGCGTGGGCGGACGCGTGGGCGGACGCGTGGGAAGGAATCAGCCAAAGCTCGCGCGTTACCC
CGGGGGTTTGGTTCTCCATCTGACTGCTTTGTACTGCTACTACTGCCCGGAGTGCGAGTAACACCCGCTCGTATTATCG
CGACGCCTTTACACTTTTGATTACTCGAGTTGGTCCCTCCGATCTTCAGGGACCGTTTAATGCGGCTATTCTCCCAAGC
GGAGCTTCGTGGTCTTAACGGTTGTTGCGTTGCCGAGCCAGTCTGTGTATTAGTTGTGTCCCGAGCTTATTGAACCTGC
TGCACGCACTTAATCCGCTTCTTTGCCCTTGATACCTACATGCCTGCATTTGGCAGCACACGCCACCTGGTACGTTGTA
TTTAGTTACTCTTAGTCTATGCAGACAACAACTTCTCTCTCCCAACC

FIG. 2 continued

> SEQ ID NO: 6369 213169 199522_300750_1b
GTGCAGCTGATAAATTCCATCGATTGGTTTCTTTGGGAGCATTAATCGACCTTTCTCATTCTTCATACCATCGGCGTCG
TTGGCATTTATACGGCATCTCGTCTTGTTTCCTTCGTACTCGAGGTACGGTACCCTGACCGCGTCGTCATACGAATTTG
CAGCATCGGCGAATTGACAGTATAAGGCAGACATCATGGCTGGGTGGCAGTCCTGGAACCCCTTCAGTAAGAGGGAGAC
GCACAGCAATGGCTCCATCGTCGCATACAAGATTTTAACCTTGCTCTCATGGCTTTTGTCCGTCGTCGTCACTGTCTAC
TATGCCGTTGACGAGCCTCACGATGGCTTCCACATCCGCCGGCGCATATGGGATCAGAACTATCTGTATCCCAGCGCCT
TTACCATGAACCACATCCTCGCTGATATCTACTGGATTGTTCTCTTCATCCTCCAGTTTGGATACGTCACATCGCTCTT
CTCCAGCAGTGCCGACGTCGTTGCCGCAGCTGCTGGTGTCGGCAGCCACTTCATCCTCAACAACTTGCTTCACTCTGCA
TTCGTCATGCTCTTTGTGAACTCGCACTTCCACATCGCCGAGGTCATACTGATTCTCAACTTCTTCAACCTCAGCTCAC
TGTATTTCCGCCACAACACGGTCCCGCGCTTCATTCACGTCCCTGTTGCTACAGGCCCGTTGGCATGGA

> SEQ ID NO: 6370 213171 220902_300940_1b
CCATGTACCTCTGGGATCCTTCACAAGGCACAAAGCCGGTTGCACGGCTTCTGGGACACCAAAAGGCCATTAACCACGT
GACATTTTCCCCTGATGGCAGTCTCATCGCGAGTGCCGGATGGGACAATCATACCAAAATCTGGAGCGCAAGGGATGGC
AAATTCATCAACACACTCCGTGGCCATGTCGCGCCCATATACCAGTGTGCCTTTTCTGCCGATAGTCGGCTCCTTGTGA
CGGCATCCAAAGATACCACATTGAAAGTGTGGTCGATGGCTACGTGTAAGCTGGCCGTTGATCTACCGGGACACCAAGA
TGAAGTTTTTGCCGTATGTTTGCCCCCTTGCCCTTCCAATTTTGTTAACCCCCGAGCCTGTGGCTGACAGCGTGCTAGG
TTGATTGGAGTCCTGATGGACAACGAGTAGGCAGCGGAGGAAAAGACAAGGCCGTACGCCTTTGGATGAACTGATGACG
ATGATGGGAGCGAATCAAAAAAGGATAAATCATGTGTGTTATCGGCGTCCAGTCAGGGATTGATTACGTGTATGTTCTA
GGTCTAGACTCTGTAGAGCTGTTTGTGCAGCATCCGCTAATGATAGAGAGCAAATGTGGCATTTGCCCAAGGGCACGGC
TGATGCAATTTACATGAAGCACTTGTGAACAAGGCTCAATGGAC

> SEQ ID NO: 6371 213206 175595_300545_1b
CCGTTTCTTCTCACATCGGCGAGTTCGCGGCCTCCTCCCTCCAGGCTCCACTTCCCAGACGAATCGGCGGCAGCGGCGG
CGGCGGCGGTGATGGAGTGCGTTATCGGGGTCGTCGGCCGCGACTTCGCGGTGGTGGCCGCCGACACATCGGCGGTGCA
GAGCATCCTGGTCCACAAGACCGACGAGGACAAGGTGATGGTGCTCGACAGCCACAAGCTGATGGGCGCGTCCGGAGAG
CCCGGCGACCGGGTGCAGTTCACCGAGTTCATCCAGAAGAATCTCCACCTGTATCAGTTCCGCAACAACATCCCGCTCA
GCACCGCCGCCACCGCCAATTTCACCCGCGGCGAGCTCGCCACCGCCCTGCGGAAGAATCCGTACTATGTCAACGTGTT
GCTTGCTGGATATGATTCGGATGTTGGTGCCTCTTTGTATTACATTGACTACATCGCAACATTCCATAAGATCGAAAAG
GGTGCCTTTGGGTATGGCTCCTACTTCTGTCTCTCGCTGATGGACAAGTTATATCGTCCAGACATGTCAGTCGAGGAAG
CTGTTGATCTTGTTGACAAGTGCATTAAAGAAATT

> SEQ ID NO: 6372 213206 238570_301295_1b
GCAATGGAGACGATCTTCGGATTCGTGGGCGATGGCTACGTCATCCTGGGCGCCGACACCTCCGTGGTGCAGAGCATCG
TCGTCCAGAAGACGACCGAGGACAAGATCATGCAGCTGGATTCACACAAGCTCATGGCGACGAGCGGCGAGTCCGGCGA
TAGGGTCCAGTTCGCCGAGTACATCCAGAAGAATATAAATCTCTACCAGTTCCGGAACGGGATTCCGCTGTCCACCACC
GCGGCCGCGAATTTTACACGAAACGAGCTGGCTGTGGCACTTCGAAAGAACCCATACTACGTGAATTTGATGCTTGGAG
GCTTTGACAAAGGCAAGGGACCGTCGCTTTACTTCATGGACTACATTGCTACTCTTCACCTGTTGGAGAAGGGAGCCGT
CGGCTATGGCGGCTACTTCGTGTTGTCAGTCATGGACAAGTTCTACCGCAAAGGGATGTCGGTGGAAGAAGGCATTGCT
CTTGCTGACAAGTGCATCGCGGAGATCCGCAAGAGGTTGATTGCATCGCCACACACTTTCGTACTCAAGATCGTGGACA
AGGATGGTACCCGGGACCTTGCCTGGAGGAGCTTGGATGCTGCTGTTCCAGCGGGACCGCCTCCGGTGATCAATCCGGG
AGACGCCTCCACATCCATGCAAG

> SEQ ID NO: 6373 213206 145794_301061_1b
AACTCTGCTTAACGCTGCTTGTTCTCCAAGACAGACGCCTCAAAGCTCTTATTCGAAACCAAACCTCAGATTTGTGTG
TGAGAAATCCTCAGAACTTTTTCCTAGAAGAAGATGGAGTGCGTGTTCGGGATGGTGGGCAATGGATTTGCACTGGTGG
TGGCGGATTCATCCGCGGTGCACAGTATACTGGTTCACAAATCCAACGAAGATAAAATCATGATCCTCGATTCGCACAA
GCTCATGGGAGCGAGCGGTGAAGCCGGCGACAGAGCTCAGTTCACGGAGTATGTACAAAAAAATGTGGCGTTGTACCAG
TTCCGTAATGGTATTCCGTTGACTACGGCTGCTGCGGCTAATTTTACAAGAGGCGAGCTTGCTACAGCCTTACGAAAGA
ATCCTTACATGGTGAACATTATCCTGGCTGGCTATGACAAGGAGACAGGCCCCTCTCTTTATTCGTTGATTATATCGC
TACTCTTCACAAAGTGGACAAGGCAGCATTTGGTTATGGTTCCTATTTCTCTCTTGCCATGATGGATAGGCACTACCGG
AAGGACATGACAGTTGAAGAAGCTGTTGATTTAGCTGATAAGTGCATCTTGGAGATCCGATCT

> SEQ ID NO: 6374 213226 176268_300520_1b
TGCAGATAACAGGTTCAGTAGTTCTGACCACATCAGTTCTTTTTTTCCTGGATAGAACTTAACCATTTAACCAACTAAA
CGTGCACATGAACCCCCATCGGACTCCAAAATACTTACAACCAGCACGACATATAAAAGCAGAGCATACGTAGATACGG
AGTAAGGATCTAAGCACCAAGACATCAGAGGCCTTGATGCCTTCTACTCAAAAGCCCACTGGTTCTCCCTGCGGATCTC
CTCTTCCTCCTCAGGGGTGAAGTCGTTCTTGATGTTGAAGGTCTTGCGGATCTCCTCAGGAGTCTTCCCCTTGATCATG

FIG. 2 continued

TCAGCAACAGTCTGGCAAGTAAGGTCCAGCAACCCCTTGATGTTGAGGTAGTTCGCGGCCAGGATGAGGTCGAAGAGGG
TGGCCTGGTCGACCTTGACGAAGTCGGCGTCCCAGTTCTTGAGGTCCTCGCCGGAGGGCGGCGGCACGGCTGCGGCGGC
GGACGCGGCGTCGTCGGCGGCCTTGGAGGCCGC

> SEQ ID NO: 6375 213226 232085_301236_1b
AAAGAGCATAGAGGGCATGGCGACGAAGGTGAAGCTCCGCAGCAGCGATGGTGAGATGTTCGAGGTTGATGAGGCCGTG
GCGCTTGAGTCCCAGACGGTCAAGAACATGATCGAGGATACGGGGTCGGATGCGCCGATACCCTTGCCCAACGTGCCCA
GCAAGATCCTGGCCAAGGTGATCGAGTACTCGAAGTACCACGTCGACGCGCAGAAGAGCGGCGGCGACGAGTCCAAGCC
CACCGAGGAGGAGATTAAGGCGTGGGACGCGGAGTTCGTCAAGGTGGACCAGGCGACGCTCTTCGACCTGATACTGGCG
GCGAACTACCTCAACATCAAAAACCTGCTGGACCTGACGTGCCAGACGGTTGCGGATATGATCAAGGGCAAGACGCCGG
AGGAGATTCGCAAGACGTTCAACATCAAGAACGACTTCACGCCTGAAGAGGAGGAGGAGGTGCGGAGGGAGAACCAGTG
GGCCTTTGAGTAGATCATAATTATTTTTATAAAGTATTTGTGTTCATTAAATTATTCTCAATTATAAAATTTAAATTTC
T

> SEQ ID NO: 6376 213226 1097749_301447_1b
TTTTCTCTCTCTCTCTCGTTCTCTCTCTCTGTGTTTTCTCTCTCTCTCTCATCCTCGTGATGGCGAATTCGAGGT
TGAAGCTGAGGTCTGCGGACGAGGAGATGTTCGAGGTGGAGGAGGAGGTGGGGCTCGAATCCCAGACCATCCGCAACAT
GGTTGAAGACATCGGGAAGGACACAACCATCCCCCTCCCCAACGTCAGTGCCAAGATCCTTGCCAAGGTCATCGAGTAC
TGCACGTACCACGTCCACGCACGCGGTGGGAGCGCCGCTGGAGCCAGTGGGAGCGCTAGCGGTGGCGGTGACGAAGCCA
AGGTCCCCGAGGAGTCTGTCAAGGCCTGGGACGCTGAGTTTGTCAAAGTCGACCAGAGCACCCTCTTTGACCTTATCCT
GGCCGGCGAACTATTTGAATATCAAAAGTCTGCTGGACCTTACTTGTCAGACGGTGGCTGATATGATAAAAGGAAAGACG
CCAGAAGAGATTCGCAAAACGTTCAATATCAAGAATGATTTCACTCCGGAAGAGGAGGAGGAAGTGAGGCGCGAAAACC
AGTGGGCG

> SEQ ID NO: 6377 213226 157493_301738_1b
TTCGTCTCAGGGTTAGGGTTTGTCAATCTGGTCAGCAATTCACAATTCCTCTTTCCTCGAAGATGAAGATGATTGTGCT
AAGGAGTTCCGACGGCGAGACTTTCGAGGTAGAAGAGTCAGTTGCCCTTGAGTCGCAGACAATCAAGCATATGATCGAA
GACGACTGCGCCGACACCAGCATCCCCTTTACCTAACGTGACGAGCAAGATCTTAGCTAAGGTGATTGAGTACTGCAAGC
GCCACGTGGACGCCGCCTCTAAGACAGAAGATAAGGCCGTCGAGGACGATCTCAAGGCTTTCGATTCTGACTTTGTCAA
AGTTGACCAGAGTACCCTCTTCGATCTCATCCTGGCTGCCAACTATTTGAACATAAAGAGCTTGCTTGATCTGACATGC
CAGACAGTTGCAGACATGATCAAAGGGAAGACCCCGGAGGAGATCCGTAAGACATTCAACATTAAGAATGACTTCACTC
CTGAGGAAGAGGAAGAAGTCAGGAGGGAGAATGCCTGGGCCTTCGAGTGAATTTGAGTCTGTTAAGCGTCAATATTCTG
CTGATAGATTTGCAATATCTTAGTAGATGTTATAAATAATCTTTTATATTAGTAAATATGTGACTGTTGTTTCTGGGAT
CTTTGACCTTGTCAGTTGAAGGGAGACAGTTGAACCTCG

> SEQ ID NO: 6378 213226 145395_301059_1b
ATTATCTCTCTCTCTCTCTCTCAATATATCTCAAAAAATCTCAATTCTAGGGTTAGTGTTGCTACGATGTCGTCC
TCTAAGATGATCGTATTGAAGAGCTCGAACGGCGAGACTTTCGAGGTGGAGGAAGCGGTGGCTTTGGAATCTCAGACGA
TAAAGCATATGATTGAAGATGATTGCGCCGACACCAGCATCCCCCTTCCTAATGTGACCAGCAAGATCTTGGCTAAGGT
TATCGAGTATTGCAAGCGCCATGTTGATGCTACCAAAGCTGAGGATAAGGCTTCTGAGGATGAGCTTAAGGCCTTTGAT
TCTGATTTTGTTAAAGTTGACCAGGCCACCCTCTTTGATCTCATCTTGGCTGCCAACTACTTGAACATCAAGAGCCTGC
TTGATCTCACATGTCAAACTGTGGCTGACATGATTAAAGGGAAGACACCAGAGGAGATCCGGAAGACCTTTAACATCAA
GAATGACTTCACTCCAGAGGAAGAGGAGGAGGTTAGGAGGGAGAATGCTTGGGCATTTGAGTGAGCTTTAAATCTCATA
ATCTGGGGATAAATTTGGAATATATCTTACTAGATCGTATGAAAAATCTTTTGTGTTAGTAAATATGTGAGTACGGTAT
TTGCTTTGGATCCCTGACTTTGTTATTCAATGAAGTGGCTTGAACCTCCTTTTGCTATTATGAACTCTTGGTTTAATGT
G

> SEQ ID NO: 6379 213226 1099410_301508_1b
TGCCTCTCTCCTCTCTCTTTCTGGTTCTTTGGTTTCTGAGCATATAAGCAGTATTCCCGCCCTTTTTGGGGGATCTAAG
CCTGAGCCGAAGCAGAGGCCATAGCCGTAGCCATGTCGAGCAGTGACAGTAAGGTGAAGCTGCGGTCCTCGGATGGGGA
GATGTTCGAGGTCGAGGAGGCAGTTGCCCTAGAGGCGCAGACCATCAAGAACATGGTTGAGGACACCGGCTCTGACGCC
CCCATCCCCCTCCCCAACGTTAACAGCAAGATTCTTGCCAAAGTCATCGAGTACTGCAAGTTCCACGTTGACGCCCGCC
GGCGCGGTGATGATGACAAGCTCCCCACCGTCTGCGTTTCCGAGGAGGAGGCCAAAGCTTGGGATGCAGAGTTCGTTAA
AGTTGACCAGGCTACTCTTTTTGATCTCATCCTGGCTGCCAACTATCTGAATATAAAGAATCTGTTAGACCTGACCTGC
CAAACTGTTGCGGACATGATAAAGGGCAAGACACCTGAAGAGATCCGCAAGACCTTCAACATCAAGAACGACTTCACAC

FIG. 2 continued

> SEQ ID NO: 6380 213242 214447_300858_1b
CCCACGCGTCCGCCCACGCGTCCGGAAACACAAACAAGCAAATCAATTCCCGAGCAAGAAAAAAAGAAGAAGCCCATCA
TGAAGATGCTTTCGTTTGCCGCCCTCTCGGTGCTCGTGTTGGGCGCTTCGGCCCTGGCTGCGCCGCCGGCCCACCCCCC
GGCCGACAATGGGTGCTGCTGCTGCGACATCAACAAGAAGAGAATCGACTGCGACAGGTCGATCCCGGCGTCGGAGTGC
ATCTGCCCCCAGGTCATCTGCCCCGCCGACTTACAAGCAGTGCTGCTGCTGCAATCCCAACATTAACAAGATTGTGTGC
TCGCTGAGGCTCGTGGAGGACTGTATCTGCTTGGCCGTGATGTGTCCGACGGATGCAAAGACCATCTTTGTCAGGCCAA
CTGGCGTTCCGACTGTCGCTTAAGAGTATTCGTTGGCGAGCCGACTTGCCTGAATCCTGGACCGGGGACATGACATGGG
GGGAGGGAAAATACAGGGCAAGGCATTGCTGATGGTGAATGCACAACACGCGTGGCAGACTGGCCGAAAATTGATGATT
TACTGATGGGCGACTTTGGACTTGAAATGGGGCATGCCGGATGGGTTACTTGACAGTATTTACACCATTTCTATTCAAC
AATAAATG

> SEQ ID NO: 6381 213243 212806_300844_1b
TACTCTTGCCTTCCCAACGACAGCGGTGGGCAAGTGTGCAGCACTGTCGGTCAGTGGGTGTTGGCTGGCACCTGCCCTC
CCAAGACTGTGTG

> SEQ ID NO: 6382 213249 221147_300942_1b
TTTGACAAAGAAAGGAGCAAGGAAAAACAAGAAACCCAATCCGCTCATCAGCCCTGGTTCCCACCTCAGCGAGACACTT
ACACGAGATACCCTAAGCGAATCTGTCCATCCACACCCATCATGGCTGCCGGAACCACCATCAGAGTGCCGCATCTCGG
CGGAATCGATGCCGGCTACCGTCTCTCCAACGGTGCCGTCGACCCCGCAAAGCCTACCGTCGTACTCGTCAACTCCATG
TGCATGACTTCAGCTCTGTACGACATTCAGTTCGGCAACAAGGCCCTCACTGACGTTGCCAACCTGCTCGCCATTGAGC
CTCTCGGCCATGGAGCCACTGAGACCTCGGCGGAGAACTACACCTACTGGGACACTGCCATCATGGCCGTCCAGGTCCT
GGATGCTCTCAACATCAAGAAGGCTTTTGCCCTTGGAACCAGCCAAGGAGGCTGGATTGTCACCAGAATGGCCCTTGTA
GCCCCCGAGAAGATCCAGGGTCTCTTGCTCCTGGGCACTTCGCTCGACTACGAGTCCGCTGCCTCCCGTGAAAGGGAT
GCTGGGATCCCGAAACTATGCTGGGTCCCGTTGTCGACAGCCTGTACAGCACTGAGCCGACCCCAGATTTCCTCATTGA
CG

> SEQ ID NO: 6383 213256 212062_300873_1b
AACAGCGGGAAGCAAAACAATTCAATTTCTACTTTTCCTTTCAAGTACAACATTGTTTGTAAAATACTCCAAAATCAAT
CGTATCACCAATTCTATCAACTGCATCGCCAAATCGCCATGCCTGAGGGACGTCAATCTCCTCCTCCCGAGCGCCAATC
CGCCGCCCAAGTAGGGAACACTGGATCCGGCAAGGCCTCAGATATCAGCAAGACCAGCCAAAAGGACCCAAAATCCCAG
CTCGACTGTCTCACATCGAACCCCAAGGGACCGATGGACGATGTGCTTAAACACAAGTTTTCCAGGGAGCCTGGAAACT
GTGAGCGCTAATTAGAGCGACTCGTCTTCCGCAGTTCGCGACTAATGAATTATCATAGACACTCCGTTGAACGCTTAGG
GAGAATAAATCGTCATGTTGTACAATAGTCATTCATAGCATCAATTATTGCATCGCTATACTATAACAAAAAAAAAAAA

> SEQ ID NO: 6384 213257 190803_300736_1b
CTGAATCCCCAAATCGAAGCACTCCTCTCCTCTCCTCTCCTCAGATCGGATCGCGAGAGCCCCAATCCCACCACCGATC
GATCCATTCCTGCTGCTCGCGGCCACCGGAGAAGGAGAGAGAGAGAGAGCTCGACCTCGTCGGCGGGTGAAGGATCGCA
GCAGCAGCAGCGGCGGTAGAGCAGGAGGAGAGGCGAAGATGTCGTCGGTGTTCAGCGGCGATGAGACCGCCCCCTTCTT
CGGCTTCCTCGGCGCCGCCTCCGCCCTCGTCTTCTCATGCATGGGGGCGGCGTACGGGACGGCGAAGAGCGGCGTCGGG
GTGGCGTCGATGGGGGTGATGCGCCCGGAGCTCGTGATGAAGTCCATCGTGCCCGTGGTCATGGCTGGTGTGCTGGGTA
TCTACGGCCTCATCATCGCAGTCATCATCAGCAGGGGATCAACCCCAAGGCCAAGCCCTACTACCTCTTCGACGGCTA
CGCCCACCTCTCATCTGGCCTCGCCTGTGGTCTCGCCGGTCTCGCTGCCGGAATGGCCATTGGCATCGTTGGTGACGCC
GGAGTCAGGGCGAACGCCCAGCAACCAAAGCTGTTCGTGGGTATGATCCTCATCCTCATTTTTGCCGAAGCGCTTGCTC
TCTATGGGCTCATCGTCGGCATCATCCTGTCATCCCGCGCTGGCCAATCTCGTGCGGATTAGGCATGTTTCAACACGCA
AACCCTTAGTGGGTTCTTGTTTCATATTCCTGAAACTACAAGCTGAGCTCTAGGGGTTTATTCTGTCTTAGTTTCTGTT
CTTCTGTTGGGTCATGAACAAAAAAACATCTGTATCCAAGGGATGTTTGCCCTTGTGGTGCCATTCTTTTTCGCTATGG
TGGTGCTGGCGGCGGTCTGAATCTTATTTATGCACAGTTTTTTGGGTCTGGCTAGACAGTGATGTAATCTGGTGAATA
AGCAAATAATTCGTAATGCAATGGGAGCATGAGACTCTTTGTTCACT

> SEQ ID NO: 6385 213257 1099603_301449_1b
ATTTGTGTGGATCGATCTGATCGAAGGACAACAATGGCCGACTCAGACTTCAATGGCGACACCACTGCCCCCTTCTTCG
GCTTCTTGGGAGCCGCCTTTGCCCTCATCTTCTCTTGTATGGGTGCGGCATATGGAACAGCAAAGAGTGGAGTTGGGGT
TGCTTCAATGGGTGTTATGAGGCCTGAGCTTGTGATGAAGTCCATAGTTCCAGTGGTTATGGCTGGTGTCTTGGGTATT
TATGGTTTGATCATAGCTGTCATTATCAGCACAGGAATCAACCCCAAAAGCAAGGCATATTACTTGTTTGATGGATACG
CCCATCTCTCGTCAGGCCTAGCTTGTGGCTTTCTGGTCTTTCAGCTGGAATGGCAATCGGGATTGTTGGTGATGCCGG
TGTCAGGGCAAATGCACAGCAGCCAAAGCTTTTTGTTGGCATGATTCTGATTCTTATTTTTGCGGAGGCTCTTGCTTTG

FIG. 2 continued

TACGGCTTGATCGTCGGCATTATTCTCTCTTCTCGTGCAGGTCAATCAAGGGAATGATTCTTCCATGCCCTTTGATTCT
ACCCATTCCAACTATCCAAATTATATTGTCCTATGGTAGGACATGTTTTTCTTTCTTTTTTAACTATATTTTTTCTTC
CGGATTTGACCAATAAGGA

> SEQ ID NO: 6386 213257 108386_300381_1b
AGATCCATACACAAATACTCGATAAAACTCTCCTTGTATCTGAATCTAATCAACTTCTCAGATCCAAACTCCGATCGGA
ACAATGTCCTCGACTTTCAGCGGCGATGAAACTGCTCCTTTCTTCGGCTTCCTCGGCGCCGCTGCGGCTCTCGTCTTCT
CCTGCATGGGAGCAGCGTACGGAACAGCAAAGAGCGGTGTAGGAGTGGCGTCTATGGGAGTGATGAGACCAGAGCTGGT
GATGAAATCCATTGTTCCGGTGGTTATGGCTGGTGTGTTGGGTATTTATGGTCTGATTATTGCTGTTATTATTAGTACT
GGTATTAATCCCAAAACAAAGTCGTATTACCTGTTTGATGGATATGCTCATCTCTCCTCTGGTCTCGCTTGTGGTCTTG
CTGGACTTTCTGCTGGAATGGCTATTGGTATTGGTTGATGCCGGTGTTAGGGCTAATGCACAACAGCCAAAGCTTTT
TGTTGGGATGATCCTCATTCTCATTTTTGCTGAAGCTTTGGCTCTTTATGGGCTTATTGTTGGAATTATATTGTCTTCA
CGAGCTGGGCAGTCCAGAGCAGAGTGAAGTTGGCTTATTAATACTATTCTTACTATGATGTATGTGAGACTCAGTAAAC
CCTGGCAAAACTTGATCCTTGCTAAAGTCAAAAAGTTATCTATGTCTATGTTTGTTATTCATGTTGGCACGGTTGCTAC
TGGTGCTGCTATGTGCTGTTTGTANAAAAATAGGAGTGAGTATTTATTTTAATAATAACTTAAGAAGTTTTCGTATTTG
ACC

> SEQ ID NO: 6387 213279 211609_300901_2b
GCAATCATCAGCTACAAAGACATCTACTCATCTACACACAAACAAACATTCAAAAAGCATCATCACACAAAGCTTCCAA
AGCTCCAGCTTCTCAACAATCCACTATTCTCTACACTTCAAACCACAACAACCACAACCAAAACCTTCAAAATGTTCGT
CGGTGACCTCGTCCACTTCCGCGCTGCTCTCAGCAACGGCATCACCCACGAGATGATTCTCTGCCCCTCAGCCGCCACT
TCTCCCGCCACCTCCGCCGCAAACACCCCAGACAACCGCTCCCTCGCCTCGGAGAAGAAGAAGAAGCGTTTCTCCTCTT
TCTTCTCCCGCCCTCGCCCTTCTGTCAAGGCCGCCAACGTCGGTGCTGGCATGAAGCTGCCCATGAACATTGCCTAAAT
AAAACCAATCTTTCACACCAACAAAACAACTACAACAATGTGCTCCTGAACTGCGGATATAAAGAGGAATGGATGAACC
GGTCTATGCCCAGCACGATGGAATAAAATACACAAAACACACAAACACAAAAAACACACTCCTTTAAGAGACGACGACC
AACGAAACAACAACACCTAAAAGTTTTTTTGCTTTTTTCCGACACTACTTTTTTCTTTCTCTTTTGTCACAAGTTTTTTT
GGGCATGGATTTTTTTTACACACAGGGCAGGCTGGGAGCACAAAACAGTTTTTATGAGTATTAGATTCTATACCCATTT
GATTCGAGAAAACGCAATGATAC

> SEQ ID NO: 6388 213281 213271_300923_1b
GTGATTTTGAGGCGCTGAGGAATGACGAGAGAGTTGCGTGAAAGATGCTGTGCTTACCCATCAAAGGACGGATCGGAAT
ATTCACATGTCATTGAATGCATTTATACAGGCACATGTAAGTATGCGGAGAAGCCCGATTGAAAGACAGCGATCTACGG
AAGGAGCACTGCAAGACCCCATGCAGGGACGTAATAAGAGGCTATGGATACCTTTATAATCTAAATTTAGCTCATCAAA
ATCAACAATCGCAT

> SEQ ID NO: 6389 213331 211593_300900_1b
TCTTAACGTGTCAATGGCCTAAAGGCGCCAGTAGTATACTCCGTACTGGTAGTATATCGTGGAATCATTAGGTAGCTTT
CCTCATACGGCCTGGCGCTCCCTGTAAACGACCTGTGACCAAACTTCGAACACGAGTATCGTCGTAGCTTCATTTCATC
GAGTTTTTCAGAATTTCGAAAACAATCAATTCAGTTTGGTGAAGGATGACAATGTGTACAGAATACTACACGCCACGTG
TTGATTGCATCTACCTCCGCCGGCGTCTCTTGTGCAATAACTCATCCTCCACATCGGGTTTGCTAGCTGGCTTACACTA
GACTGCCTTTGTATAATCATCGCGATACAAATGGATCCTGCGTGACACTGAACACACAATTCTCAAAGAAGTGTCCCCT
TGGCTTCCCAATTCTTTTTTCGGACTTTGGCCCCCAGACGCTGGTATATNGGATATTTCTGTTCATCCCACATCTGGCCA
TTGCTTCGATCCCCTGACGCTCTGACAAAAGAAAGACACCCAACCCTTTACGACTGGCTGCGAGTAGTTCGCTTGGTAG
CCTCTCCCTTGGACTTGTCAGCACCGCTGGCAACAGCCTCGGACTTGTCCTTTGCCTTGTCCTTGGAGGTGGCAGCGGG
CTTCTTGGGGGCAGCGGAAGAACCACCAAGGCCGACAAGAGCGGTGATGATGGCAA

> SEQ ID NO: 6390 213352 199770_300752_1b
AATGTCTTGAAGTGTAATTTTCGAAGAACTATTTATTATCCATCACCAGCTCGAGATTGACCGATTTCTCTTACACAAA
GTACTTGCATTGCTAGCTCTGCTGGAGAAAGTAAACAAAGTAGCACAGCTAAAATAGCCCTAGCAGATCTCACTGCCAC
TATTGCTTCTACCTGCCTATATCCATTGGCTTTAATACTCCAGTCGCCTGCTTCTCTTTTCCCTCCTACAATGTCCACG
GCTGTTGTTATAAATCCGCAGTCTCACAACCGCCCTCTGCCTTCAGTCGGCTCACATACACACCGACATATCAGCAACA
GCAGCAATAACACTACCAGCAACAACAACACCAAACTTGCTGCAGACACGATGCCTCACGCTCACGAGACGAAGCCTCT
CTGGCTCATCCAGCCACGCCTCGACGCCGGCGTGTATCGCGACAAGCTGATCGGCAGCGTCGTCAAATACCCAGACCTT
CCCACCGAACGCCACATCCCCTACCGAACGGGCGCAAAGCTGCCCCGAGACATTGTCCAAGACCTCGATCCCAAGCCCA
TCCAGGTGCGCAACGTCAAGTTCTGGACCCGTCGCATCAAAGATGCCGGCGTGTCGGCGTCGCTAACGAGATTCTCGA
GGCCTTTGTGGACCGGGCCAAGGAGGACAGCAGCGAGAAGATGGCCACGGTAGCGAGGATATGGCACATGGATTCGCCG
GGCGAGA

FIG. 2 continued

> SEQ ID NO: 6391 213734 258632_301698_1b
ATCTAGTCATCTCACGACATTTGACTAACGACTCTATTTATTAACCTGACGGTGCACCCCAACCCAGTAACACGTTACT
AACTACCCCGTCTCTATCACCACGTGACTCTGAACCAAATCTTTGGCTTTATTTTCACGTTCCCAACACAAAATCCAAA
CCGCCAATCACCCCATCTTTTTAATCAGCAACTCTCCCCTCAACACTACGGTTTTCGAAGTAGTTATTTATTCATATTT
ATAATGTCATACTTTGCATCAGTCCCCGCAGCTCCCGCAGATGCCCTTTTCGGCCTCATGGCCAAGTACAAGGCCGATA
CCTTCGACAAGAAGGTCGACCTCGGAGTCGGAGCCTACCGAGATAACACCGGAAAACCCTGGGTCCTCCCTGTCGTCTC
CAAGGTCGATTCTCTGATTGTCGCCGACCCCACTGCCAACCACGAGTACCTCCCCATCACTGGTCTGCCAGACTTCACC
AAGTCTGCCGCCAAGCTGATTCTGGGGCCTGACTCTCCTGCCATCAAGGAGAACCGAGTTGCCTCTTGCCAGACAATCT
CTGGAACTGGAGCAAACCATCTGGGATCTCTCTTCCTGTCGCGGTTCCCCTCCTCCGCCGCTCCCCCCAAGAGCGTCTT
CCTCAGCCGTTCTCCCCCTTCCCCTGGAGCAACCGGAGATACTCCTCCCCGAGCTGCTGGCGGCCGAATCTGGATCTCC
AACCCCACCTGGGCCAACCACAAGCAGATCTTCGAGAACGTCGGTCTGACCG

> SEQ ID NO: 6392 213742 253007_301648_1b
GTCTCTCCACTACTTCCCCCCCATCAAGCCCTCCGCCCTTGCCGTCGGCACCATCTTCTCCCACTTCTCCTCTTTGATT
GGTTTCGCCCCCGTCATTGGCGACACCATCAAGCGAGCCAAGGCCGCTGACACCCCCGAGGAGTTTGCCCGACAGAAGG
AGAACAACGGCGTCCTCGCCCTCTACGGATCTTCTCTGCTCGGCTCCGGTCTGCAGTCTTACGCCGTGTCGGCCCTGAT
TGTCCTCACCGGCACCACCACCACTAAGGGTGCTGCCTACCTCGGAGGTCTCATCTTCGCCGTCAACTCCATCCCCACC
CTCGTCACCGGAATCTTCCAGGAGAACCGACCCGTCGAGTACCTCGTTGGCAAGACCCTCTCTGCTCTGCTGGAGACCG
TTGGTCTTACTCTCACTCTGAACTGGTGGGGAACCCGAAACGAGACTCTTTCTCTCGCCAAGTAAGCTGTATATTAATG
CATTATGATGATTC

> SEQ ID NO: 6393 213749 199467_300749_1b
CTTGTCATTATTACTCGATCCCACGCGTCCGTCGACCCACGCGTCGCAGATACACAGCAAACACCCAAGCAACAACAAA
AGCAAAGCACTCCAGCAACAAACATCTACCCACCTCACAACAACATCAACCAACCTGACAACTTCTTCAC

> SEQ ID NO: 6394 213781 210630_300891_1b
ATGCCTCGAGACAGCGGCAGAAACCGACAACCACGAACCCCAAACTCGAATTCGAGCGCAAACCAGAGCACAGGAAGAG
GGCAAATGTCGAACCCAAACAACTGGCAGGAGGAGGCGATGCGGCGTCTGCGCCAGATGCAGACGCGGGGCGGGTATCC
CGGACGAGGAGGACCGCAGATGCCCAGAGGAGCAAACGGCGCCTTGATTGGAGGAATCTTGCTGGCGGGCGGCGCTTGG
TTGCTGTCGAACTCGCTGTTCAACGTGGACGGTGGTCACCGAGCGATCAAGTACCAGCGATTAAGAGGCGTGAGCAAGG
AGATTTACAGCGAAGGAACACACATCAACATTCCTTGGTTCGAGACACCCATCATCTACGATGTACGAGCGAAGCCGCG
CAATGTTGCTTCGCTGACTGGCACCAAAGACTTGCAGATGGTCAACATCACCTGCCGTGTTCTGTCAAGACCGAATGTC
GAAGCTCTGCCTCAGATTTACCGAACACTTGGAACCGACTACGATGAGCGAGTGCTGCCATCAATTGTGAACGAGGTCC
TGAAGAGCGTAGTCGCTCAATTCAATGCCAGTCAGTCATTACACAGCGAGAGATGGTTGCCCGATTAGTACGGGAGAA
TCTGTCTCGTCGAGCTGCGCGATTCAATATCCTGATCGATGATGTGTCTCTGACGCATCTT

> SEQ ID NO: 6395 213793 215409_300881_1b
GGGAGACCATGGCCTCTGTCCGATCGGCTGTGAGAGCATTGCCCCGCAAAACGGCAGCAGGATACCAGTCCAGCTATTA
CCCCTCCATCCCCAGACCCAGATCTCTGTCTTCATTTTCATCTTTGTCTTTGTCTTCATCTTTGCATCGTTCGGGCCCT
CCGTCCTTTTCTCCGAGTCACGCACAGAGACACCAGCTAGCCACGATGTCTACGCAAGCCGCGCACCCGGCCCTGCTCA
TCCCAGGGCCCATTGAGTTTGACGATGCTGTGCTCCAGTCCATGAGCCACTTCAGCGAGTCTCATGTTGGCCCTGGCTT
CGTGGCCACCTTTGGCGAGACTCTGAGCATGCTCCGCCAGCTCTTCCAGACCACCGATCCTGCCTCTCAGCCCTTCATC
CTCAGCGGTTCCGGCACCTTGGGTGGGATTTGGTGTCTGCTAACTTGATTGAGCCGGCCGAGGACGCTTTGGTTCTAA
GCACCGGCTACTTTGGCGACAGCTTCGCCGACTGCCTGGCTACCTACGGAGCCAAGCCCACCAAGCTTGAGGGACCAAT
TGGCGGACGACCCCAGTTCCCGGAGATCGAAAGGCATTGTCGGAGAAGAAGTACAAGCTCGTCACCGTCACCCATGTC
GACACCTCTACTGGCGTTGTGAGCGACCTGAAGGGCCTTGTCCAGGCTGTCAAGAAGGTCTCTCCCGAAACATTGGTCG
TCGCCGATGGCGTCTGCAGTGTAGCTTGCGAGGAGATTGCTTTCGACGACTGGGGCTTGGACGGTGTCATCACTGCAAG
CCAAAA

> SEQ ID NO: 6396 213809 200495_300759_1b
AGAGGACAAAAGGGAAATGATGTTCCCTCTCCTTAAACAGTCGAACCTTGTGTCAGGGGGGGGGGGAAGTGAAGAGGG
TTTGTATTCATGAAAGGAGATTTGCGCCTAAGCTCAAGCGCAAAATGAATCCT

> SEQ ID NO: 6397 213816 211010_300895_1b
TCAGCTCACACTCTCCAGGCTCACACAAAACTCACTACAATAAAAACACAATCTTCAATTCTTTGAACCTTTTTCAAGT
TTCGCCAACATGAAGTTCACCACTACTGCCGTTCTTGCCATTGCCGCATTCGTTGAATCGGCCACTGCTCTGGGCAAGG
CCCGTGTCGTCAACAAGTGCCCCTTCAGCGTCACCACCTGGTCCGTTGGCAGCGCCATCTCCAACCCAACAACCCTTGC

FIG. 2 continued

TCAAGGCGGTTCCTATGGCGAGACCTTCTCACGAGACCCCGTAACCGGCGGTCGTGCCATCAAGGTCACCGTCCAGCCC
GATGGCCTCTACACTGGCAAGCCCCAGACCAACTTCGCCATCAACCTTGAGGGCAACACCATCTGGTACGATCTTTCAG
ATGTCTTTGGCGATGCCTTCAACGGCCACAAGGTCGTTGTTTCCAGCGCCAACACTGCTTGCCCCCAGATTGTTTGGGG
CAGCGGAATCCCTCCTGCCGGAAGCCAGGTCAAGAACTGCGGTGCGGATAAGGATGTGACTTTGACTCTGTGTGCTTAG
AGTTAAGGGAGGACGGAATCATGTCAAGGGAAAGGTTTAAATCAAGTTTATGATAGAATTTCAAGTCCTAGCTATGTTT
AAGACTTATGACAGTATGAATTGATGAGTTTACTCC

> SEQ ID NO: 6398 213825 220306_300954_1b
GAGCCCCAACTCTTTTTTGTTTTCTGTATTTCTCTCTCTCACTTTCACTCTCTCTTCTCTCTTGTTTCTTCTCCTTCTT
TCTCTTGGTTACCCAGCTAAGTGAAGCTCAACAACCGCAAACATGGCTGCCCCCTCGAGCAAGACCACCAAGAACCTCA
ATGGCAAATGGACCATGAACAAGACGCTCTCCGACTCCTCGGAGCCGGTGCTCTCCCTGCAGGGCGTTGGCTACCTGAT
CCGCAAGGGCATCAGCCTGGCCACCATCACCCTCGAGGTCGAGCAGTACGAGGGCCCGCCCAAGCCGCCCAACACCGCC
GCCGACGTCGTCACGCACATCGACATCAAGCAGTCCGCGTCGGGCCTGTCGAGCACGCAGGAGAACCGCTGCTTCGACA
ACTTCCCGCGCGACCACACCGACTGGCTGTTTGGCACCGTGACGGGCCGCAGCCGCTGGGTGAGCCTGGACGAGGTCAC
CGACGAGTTCCTCAAGAAGGGCTGGGAGGTCGAGGGTGAGGGTCAGAGCTTCATCACCAACATTGCTGAGAACAAGGAG
AAGGGCTGGGTTGCCGAGCAGGTCTGGGGATTCCAGATTGTTGATGGCGAGCGCAGATACTGCAGACATATTGTTGTGA
CCAAGGGAGCGGAGCGGGCTCAGATCCGACTCGTCTACGACTTCAACGAAGAGTAAGGGGGGGGGTTTGTGTGACAGGT
CTCATTTTGATATCATATAGAAGAGCTGACG

> SEQ ID NO: 6399 213845 208217_300833_1b
GGGCAATCTTAACGGAATGAAGCTTTCCTGGTCGCCATGAGAGACATATGCGGAGAAACCGAAATGTGCAATTGTCCAG
CAATTGCTTTTATTCTAGGGTCTACGAGAGCCTGGGTCAACGCCACCGTCAGGATTTGTGGCGGCGCCTCAGCAGTTAC
GAACCAGTCTTCTGCTCATGCTCCCGCCTGGGGTCGCCCTTCACAACTGCAGTAGCATTGGCGTCCGGATAGAGCATCA
AATCTTTCGCGAGACAAGATCGACGGATACACAAACATGAGCTACGAAGATACTTTAATTCGATCGAGAATAACGGGTT
TATCCTATATAACCAGGAGAAATTCCACGAGTGACACATCAACAGGAGGCACCAGTCATGACTACGTCCCCATAATTGT
TATGACTGTTATTGTCGTGGCGATCGTTCTGGTACTCCTTATCCTTGCTCAATACACAAAGGTGCTTGATCGGAAAAAG
CCAGCCAACGGATTTGATGATCCAGAAAGCGCACAGAATGCCGGCAAAATCGAGAAACTGAACCAAAAAGCTCCGACTC
AATCCTACAAGAGCTGGAAGGAGAAGAGCGAGGAAGCGACTGGTTCCGTTAAACAAAGTACTACTCATGTCGTATGTGC
AATATGTTTGGAGACCCTACAAGAAGACGATACAATTCGCCTGCTATCATGCGCGCACATTTTCCACTCTCTTTGTTTG
GCAAAATGGTTTTTGAAGAGGCATAATACTTGTCCGCTTTGTAAGGCGTGCTTCATGTCTTCGTCGGAGAAATCCTCGA
TACCTGTACAGGTTCCAGAAAGAACACATGCCCGATGAGAAATCTCAAACAATAATATATTTGA

> SEQ ID NO: 6400 213868 219333_300944_1b
GATCTATCAACCCGCTGCTCAAACTATTACCGGGCTCTCCATCTGCTCTTGATACGTCGACACACCTCGTAAAACTAAC
TCCAGCTCAGCACCCTCAGCCGCCTTCACCATGTCAGGCTGGCCGACCACTCAGCATCCGCCAGGCGTTGTTTCTCAAC
ACGCTCCGCCACCTGCATACGGCTATCCACCCAACCCTGCCTTTATTCCAGTCCAAGTGCGACAGGGCTTTAGTCCGTA
TGGTGCACCTCCGCCACCGCTATACAACCCGTACGCATCAAGTCCAGCTCAGAGCCAGGCCTCTACTCCTGGAACTACG
ACAAATGCATCTCCATCAGCACCTGTAGAACAACCTAAGGGAGCCAAGACCGAGTGGCCAGAATCAGTCCGACGTTATG
TCCAGCGGTCTTTTCATCCCGAAAACGACGACGCCTCTGTCTCTCGCGCGGAGCTTGAGGCCAAGCTGAAAGACACAAT
CGGCAGTGCTAAAGAGAACAACTCACTCTACACTATTGATTGGGATAACATGCCTCTGCCCCAAGCCTTGGTGAGAGCT
GACCGTGAGGCACTGCTTAAGCTTCGCCATACCTCGTTGACCACGCCGATATATGCCGACGACTCT

> SEQ ID NO: 6401 213909 212092_300873_1b
ATCATCTAATTCAAGTATGTCATATCCCGCGGTGTGTGATGCGATGTGATGTGATTGACTGATGCTGATCTTTGTCGAT
TGTTTTACTTGTAGCAAACTCAAGTATAACTTATACCTACTATTTATACCTACTCAACAGTATACTCGACCTTGTCCAA
CAAAATCAAAACAAAACAACAACCGAGGCAAATCAAATAACAAACTACCTCAAAAATGGACTCTTCACCACCAACAACC
CCAACCAAAACTCAACAATCACAAAACCTCCAGCAATCTTCCTCACCCCCAAGACTCCTCCCCCGCCTGCCAATCCG
CCATCAAACACTCCTCATCGTGGAAGCCCAGCTCGCTCGACCGCCGCCTCAGCTGGAGCTCCCAGGACCAGAAGCACGC
GCTGCAGATGAGCGGCATTGACGGCGTGCAGTCGGGACACCAGGGCTTTACGGAGCGATGAATGCCTTTCCATCCAGTC
GGGGTCTTTCTTTCTTTTTTATTCTATGGAGAGAAGGTGTAGATTGGGAATGAAAGAGGGGGAAAGAAGATGAATTCA
TAAAACTCTATATGAGCGTGGTTTTCTTCTTCTTCTTTCTTTTCAATGATTTGATGAAACAAAAGGGCTATTG
GGAAAATTTGGGAAATTGGGTCACTGGCATTGCATGGCAACGGAGCGAAAAAGAAAAAAACAATAGGCATAATGCACGC
GACTTTGTGTGT

> SEQ ID NO: 6402 213914 258431_301696_1b
AGTAGTTGCACCCATTGCCCAATTGCACAAAAGCACACACAATGTCGATCACGGCGCAAAACCTCTCCTACACCTTCCC
CAATGGGCTTGTGGGCATCCATCCCACCTCGTTCGACCTGCCTCCCGGGTCTAGAACGTTGCTGATCGGAGCCAATGGA
GCTGGAAAGTCGACGTTGCTGCGAATTCTGGCGGGAAAGACCCTCGCCAAGGCCGACAGTCTCATTGTCCAGGGCTTTG

FIG. 2 continued

```
ATCCCTTCCGAGACTGTTCTCCTCCTGGAATCCGGTACCTGGGCACCGAATGGGCCGGCAATCCAATCGTGAGACACGA
CATTGAGGTCACCCAGCTGCTAAAGTACGCCGGAGGAGATGCCTATCCTGACCGACGAGACCATCTTGTGCAGCTGCTG
GACGTGGATCCCACCTGGCACATGCACGAGGTGTCTGACGGAGAGCGTCGGCGAGTGCAGCTAGTCATGGGACTGCTGG
TGCCGTGGGAAACTCTTCTGCTGGACGAGGTGACGGTTGATCTGGACGTTCTGGCCCGAACTAACCTGCTCAACTTCCT
CAAGGAGGAGACCGAGACCCGACAAGCCACCATTGTTTACGCCACCCATA

> SEQ ID NO: 6403 213922 208006_300831_1b
AAAGAAAATAGAGAAGGGGGAGAAAAGAAGAGAGCCTCTTAGAGGATGATGCTGAATGACGCTGTGGATGGTGAAATGT
GAGATGAGCAAGGTTTGTGTTACATGTATATTAAGAGGATTTTTTCTTTTTGTGGACGGTTTTTTATATGTGATATTAT
GGAGAAACTAGCAAGGATGGAGAAAAGGGGGAGAAAAGGAACGATAAGTTTATCTCTGTTTGGGCATGTATGGGTGTTA
ATATGATTGACTTGTCAT

> SEQ ID NO: 6404 213923 207604_300827_3b
GTCCTCAGACGCTTGCATTAAGTAGACATCATTGTGTCTACTCCCAGTCATCGTCGACAACTTCTTTGATACAAGATTG
CAAGACTCTATCCAAGTATGGCTACCCCAGGTACCGACCCCATCGAGGGACAATACAACAAAGAATCCGCGGCCGACGT
GCCCACCAACGGGCACTATGTTTCCAATGGCATGGGCTCTGGACAGCAATTCCAGCCCCAGCAGTATCAGCAGTATCCG
GGCTATGGACAATTTGTTCCGTTTAGCAACACCCAAGATCCTCGGGCTGGGCCTCACCAGGCCATGATCTCCCAGGTCT
ACCAACCTACCCTTGGTAAGATTGGTAACCCAGGTCCTCTTGGTCTGATCGGTTTCGCTTTGACGACCTTCGTGCTCGG
ACTTTACCAGTGCGGTGCTGGTCTCCCTAATTCCAACCCATTGGGCAACGTCGGCCCTGATCAAGCTGTCTTCGGTGTG
GCTGTCTTCTTCGGAGGCATGGCTCAGTTTGTTGCTGGTGTCATGGAATTTGTCCTTGGCAATACCTTCGGTTGTACTC
TCCACTGTTCATACGGGGCTTTCTGGCTTGCCTTTGCCATGTTCTCAGTCCCTACACTGGGCATCCAGGCCGCTTATAA
CGGAGATCAACGTGCCTTTAGCTTTGCTGTTGGCATTTTCCTCATCATATG

> SEQ ID NO: 6405 213950 217549_300909_1b
GGCGTCTCCTACAAGAAATCGTTCGTTTCCCTCTGTCATTGCGAGCCTGTTGAGCAACACAACAAAAAGGCGTCAACAC
ACAAAGATCCAATCGCCAGATCTAAAGCCTCTGTGCTACTCAGTCCAACAATTGCACAAAGCGACACAACATACCGAAA
TCTGCAAACAATGTGTTTCCGCGTGGAGCCAAAGGCCAAATACTACTACCAGGAGGAAATCATTCCCTCACGGCCGTAC
CGCCATCACCATCACCATCACCATTCTTCCCACCACTCGCCGCGAGCGAGCTACTCGGCGGTTGAGCGCTACAGCCCGC
GGGTCAGCACCAGCAGCTACAGACGCAGCGTGCCGTCGAGGGTCGTGTATGAGGAGACAACGCGGAGTCGGTACTGAAT
GGGCTTTTGATTAGGACCAGGAATATCCTGTGATTTTCTTACTCTTTGTTTTTTAACGACTCTATGGTACTGGTTATG
GGAAATGAGACACATGTTAGAGGCTAGAATAATGGGCGGATTGGGATGGAAACTCGAGGCAGGCGATGGTTTCATGAGG
ATATGAGAACCTGGAATGCGGTGACGGCGTTGGTAACATATATTTCGCCTTTACGATTTGAATGAATGAGATACATAAA
ACACATTCTAGATGTCTCGC

> SEQ ID NO: 6406 213958 179614_300562_1b
TTGCAAGTTCCATTCCCTGTTCTTCTCTCTCAACGAAGCATCAACCCCCCTTTTCTCCCAGAACCGCGTCTCATCGCAC
CTGCCATAAAACTCCAAAAAATCTCAAAAACCAACCGTCAAAATGGGTCACGAAGATGCTGTTTATCTGGCCAAGCTCG
CCCAGCAGGCCGAGCGATATGAGGAGATGGTCGAGAACATGAAGATCGTCGCCTCCGAGGACGCGCGACCTGACCGTCGA
GGAGCGCAACCTCCTCCGTCGCCTACAAGACGTCATTGGTGCCCGCCGTGCCTCTTGGAGAATAGTCACTTCCATC
GAGCAGAAGGAGGAGTCTAAGGGCAACTCTTCCCAGGTTACCCTTATCAAGGAGTACCGCCAGAAGATTGAGGCCGAGC
TTGCCAAGATCTGCGATGACATTCTCGATGTTCTTGACAAGCACCTGATTCCTTCTGCCAAGTCTGGAGAGTCCAAGGT
CTTCTACCACAAGATGAAGGGTGACTACCACCGTTACCTTGCCGAGTTCGCCATTGGCGACCGCCGCAAGGACTCCGCC
GACAAGTCTCTCGAGGCTTACAAGGCTGCTACCGAGGTTGCCCAGACCGAGCTGCCTCCTACCCACCCTATCCGCCTGG
GTCTTGCGCTCAACTTCTCCGTCTTCTACTACGAGATCCTCAACGCCCCTGACCAGGCTTGCCACCTCGCTAAGCAGGC
ATTTGACGATGCTATT

> SEQ ID NO: 6407 213958 191394_300740_1b
GTACGAGACCACTCGAACCCGACCCGCCTCGCCGCCGCCGCCACCGAAGTAATCCCTTAATTGGTCAAAATGTCTCGGG
AGGAGAATGTCTACATGGCCAAGCTGGCCGAGCAGGCTGAAAGGTATGAGGAGATGGTTGAGTACATGGAGAAGGTTGC
AAAGACTGTAGATGTGGAAGAGCTCACTGTTGAGGAGCGCAACCTCTTGTCTGTTGCTTACAAGAATGTGATTGGTGCC
CGCCGTGCCTCCTGGCGTATTGTCTCATCCATTGAACAGAAGGAGGAGGTCGTGGCAATGAGGAACATGTTACTCTGA
TCAAGGAGTACCGTGGCAAGATTGAAGCTGAGCTGAGCAAGATTTGCGATGGTATCCTGAAGTTGCTTGACTCACACCT
TGTGCCCTCATCTACTGCTGCAGAATCTAAGGTGTTTTACCTCAAGATGAAGGGTGATTACCACAGGTACCTTGCGGAA
TTTAAGACTGGTGCCGAGAGAAAGGAAGCTGCTGAGAGCACAATGGTGGCTTACAAGGCTGCTCAGGATATTGCTCTGG
CGGATCTTGCTCCCACCCATCCCATAAGGCTTGGACTGGCACTTAACTTCTCTGTTCTACTACGAGATTCTAAACTC
TCCAGACAAGGCTTGCAACCTTGCTAAGCAGGCGTTTGACGAAGCCATCTCCGAGTTGGATACCCTCGGGGAGGAGTCT
TACAAGGACAGCACTTTGATCATGCAGCTCCTGAGGGACAACTTGACCCTCTGGACCTCTGACCTCACGGAGGACGGTG
GTGATGAGGTGAAAGAAGCCTCCAAGGGCGACGCCTGCGAGGGCCAGTAAAATGGAAGATCGATCGATCGATGGCTCC
```

FIG. 2 continued

GCATGTTATTGGAGACCATCGATTTAGATGCCTCATGCTGCTGTCACCATGATGGATGGATTCTTCTCCTGTTCTACTA
GAATGTTTTTCTTCCTGTCCCCCCTTCCTCTCTCTTCTCTGGTTTTTACTAGGGTGGTAGCGGTCGAATTAGTTCTTCC
CATTGCTTTGCATTTGGTGCTAGTGGTCCGTCTGGGCTGATTGTTTTCCTCTGGATATGACTCTCGTGTGTGTTGTCTC
CAGATAGTGTTTTATTGAGCAATATTTAAAGTTGTCGTCCACCTCCTCGATGTT

> SEQ ID NO: 6408  213958  258531_301697_1b
AACCATGACGCGACAAGACAACATCTACCTGGCTCGTCTTTCCGAGCAGGCCGACCGTTACGAATACATGGTGGACTAC
ATGAAGGAGATTGCCACCGGCGACCAGGAGCTGTCTGTGGAGGAGCGAAACCTGCTCTCCGTGGCATACAAGAACGTGA
TTGGCGCTCACCGAGCATGGTGGCGACTGGTCAGCAGCTGCGATCAGAAGGAGGAGCAAAAGGGCAAGGAGACCAAGAT
CATCCACGACTTCCGTCAGAAGATTGATGCCGGTCTGCACGACATTTGCCATGACATTCTCAACGTGCTTGACAAGCAC
CTGATCCCCAAGCTCGAGAAGCCCTCGGCCGAGGCCACTGACGCTGCTGCCAAGGATGGCGCCGACCCC

> SEQ ID NO: 6409  213958  257978_301687_1b
AGGAGCTTAGATCGATCGACGACGCCATCGCCGCCGGAGCTGCCATGGGAATGGAGAAGGAGAGGGAATGCTTCGTCTA
CATGGCCAAGCTCGCGGAGCAAGCCGAGCGTTACGATGAAATGGTTGAATCGATGAAGAAAGTCGCGAAGCTGGACGTG
GAGCTGACCGTGGAGGAGAGGAATCTCCTGTCCGTGGGCTACAAGATCGTGATTGGGGCGCGGCGGGCGTCGTGGCGGA
TCTTGTCCTCGATCGAGCAAAAGGAGGAGAGCAAAGGCAACGAGCAGAACGTCAAGAGGATTGGAGAGTACCAGCAAAA
GGTCGAGGACGAGCTCTCCAAGATTTGCAATGACATTCTCACGATCATTGACGAGCATCTAGTGCCGGCTTCCAGCACT
GGCGAATCCACGGTCTTTTACTACAAGATGAAAGGTGACTACTTTCGATACCTTGCAGAGTTTAAGACCGGGAACGAAA
GAAAAGAAGCTGCCGATCAATCGTTCAAGGCTTACCAGGCTGCGAGCGATACTGCTTCAAGCGATCTTCCCCCAACACA
TCCTATCCGGCTGGGACTGGCATTGAATTTCTCTGTTTTCTACTACGAGATTCTAAACTCGCCAGACCGCGCTTGCCAG
CTAGCGAAGCAAGCTTTTGACGATGCGATTGCGGAGCTGGACACGCTCAGCGAAGAATCCTACAAAGACAGCACCTTGA
TCATG

> SEQ ID NO: 6410  213958  256490_301672_1b
TTCGCATCTCTCCATCGCCGCCGCCGCCGTTTCTGCCGCCGCATAGGCATCCGTCGCCAGGTAGCGCAGCCGCAGCCGC
AGCCGCCGCCGCAAAGCTAGGTTGTTTCTCGCCGAAATGCCGGAATCCAAGGAGGAGAATGTCTACATGGCCAAGCTCG
CGGAGCAGGCCGAGCGCTACGACGAGATGGTGGAGTACATGGAGAAGGTGGCCAAGGCCGTGGAGGCGGAGGAGCTGAG
CGTGGAGGAGAGGAATCTCCTGTCGGTGGCGTACAAGAATGTGATTGGGGCGCGGCGGGCTTCGTGGCGGATCATCTCG
TCGATCGAGCAGAAGGAGGAGTCCAAGGGCAACGAGGAGCATGTAGGCTTGATCAAGAACTACAGGTCCAAGGTGGAGA
CGGAGCTGAGCAACATCTGCCACGGGATCTTGGGGCTGCTGGATTCGCACCTCATCGGATCCTGCTCCACGGGCGAATC
CAAGGTCTTCTACCTCAAGATGAAGGGCGACTACAATCGCTACCTTGCCGAGTTTAAGACGGGGCAGGAGAGGCAGGAG
GCAGCCGAGGCCACCTTGATGGCCTACAAGTCGGCACAGGACATTGCGCTGGCGGAGCTTGCTCCAACTCACCCCATTC
GACT

> SEQ ID NO: 6411  213958  255750_301643_1b
ACGCGTCGCCCTAACTAACCCTAACCGCCAAATATTGGGGGATTTATCATTTGGGTTTGGATCGAGTCAGTGCAGTCTA
CGGTCTGCAAGCATGTCCGGGCACGATGAGCACGTGTTCATGGCTAAGCTCGCCGAACAGGCCGAGCGCTATGAGGAGA
TGGCCGAGTTCATGGAGAAGGTTGCTGGCCATGGGGACGACCTCACTGCCGAAGAGCGCAACCTCCTCTCTGTCGCCTA
CAAGAACGTGGTGGGTGCTAGACGTGCCTCCTGGCGCATCATCTCCTCCATTGAGCAGAAGGAGGAGGGCAAGGGCAAC
CAGGACCATGTCAGTGCCATCCGTACCGGGCCAAGATCGAGGCCGAGCTTTGCACTATATGTGGGGGTGTCCTCA
AGATCCTGGACACGCACCTCATCCCGGCCGGAGAAGCTGCTGAGTCGAAGGTCTTCTACCTCAAGATGAAGGGTGATTA
CCATCGTTACGTGGCTGAATTCAAGACTGGTTCTGAAAGGAAGGAGTCTGCTGAGAACACCATGTCTGCCTATAAGTCT
GCCCAGGATATTGCCCTTGCAGAGCTTGCTTCAACTCATCCTATTCGCCTGGGACTTGCGCTCAATTTCTCGGTAT

> SEQ ID NO: 6412  213958  253819_301630_1b
CACGCGTCGCGACAGTCGAAACGGGGTCCCGGGAGGAGAGTGTGTACATGGCCAAGCTCGCGGAGCAGGCCGAGCGCTA
CGAGGAGATGGCCGAGTTCATGGACGCTGTCTCCAAGGGCGCCGGTGCTGAGGAGATGTCCGTTGAGGAGCGTAACCTC
CTCTCTGTCGCCTACAAGAATGTCATTGGTGCCCGTAGAGCCTCCTGGCGCATTGTCTCCTCCATCGAGCAGAAGGAGG
AGAGCAAGGGCAATGAAGACCACGTCGCCGCCATCCGCACCGGCGTCAAAGTTGAGGCTGAGCTCACCAAGATCTG
CCAGCGCATTCTCGACCTCCTTGACAGCCACCTTGTCCCCTCTGCGCTCAACCCCGAGTGCAAGGTCTTCTACCTGAAG
ATGAAGGGGATTACCACCGTTACCTTGCCGAGTTCAAGACCGGTGCTGACCGCAAGGAAGCGGCTGAGAGTACGCTCG
TCGCTTACAAATCTGCCGAGGAAATTGCCCTGGCTGAGCTGCCTTCGACACACCCCATTCGTTTAGGCCTTGCTCTGAA
TTTTTCAGTTTTTTACTATGAAATTTTGAACTCCCCAGACAGAGCTTGCAATCTAGCTAAGCAGGCTTTTGATGAGGCC
ATTGCTGAACTGGACACTCTGGGGGAAGATTCCTATAAGGACAGTACTTTGATAATGCAACTTC

> SEQ ID NO: 6413  213958  232468_301215_1b
TCGACCCACGCGTCCGGGCGGCAGCGCACGGCGAGGAACAGGTGAGTGCCCGTGGATGTGATCTAGATCTACCCTCCAA

FIG. 2 continued

GCCCCAAAATCTCAGTAGAAATCCTCCAAATCGCGCCGCCGGAAGAGAGATCCAATCCACCACTGTCCCCATTTCTCGG
CTTGTTCCAGGGATGTCGAATCTTCGCGAGGAGAATGTCTACATGGCCAAGCTCGCGGAGCAGGCCGAGCGCTACGACG
AGATGGTGGAATTCATGGAGAAGGTGGTCAAGGCCGTGGACGTGGAGGAGCTGACGGTCGAGGAGCGGAATCTCCTGTC
GGTGGCCTACAAGAACGTGATCGGCGCCCGCCGGGCATCGTGGAGGATAATCTCCTCCATCGAGCAAAAGGAGGAATCC
AAGGGCAACGACGACCACGTCTCGATGATCAAGGAGTACCGTGCCAAGGTGGAGTCGGAGCTGAGCACCATTTGCGACA
GCATCCTCAAGCTGCTGGACAGCCATCTCATCCCCTCATCGTCCAGTGGCGAGTCCAAGGTCTTCTACTTGAAGATGAA
GGGTGACTACCACCGATACTTGGCCGAGTTTAAGACGGGGCCGAGAGGAAAGAGGCCGCGGAGAACACTCTCCTCGCC
TACAAGTCGGCCCAGGACATCGCTCTCACACAGCTGCCGCCGACGCATCCCATCCGGCTGGGTCTCGCTCTCAATTTTT
CGGTCTTCTACTACGAGATTTTGAATTCGCCCGATCGAGCTTGTACGCTTGCCAAGCAGGCATTTGACGAGGCCATAGC
CGAGCTGGACACTTTGGGAGAGGAATCTTACAAGGATAGTACTCTGATCATGCAGCTGCTGCGCGATAATCTAACGCTG
TGGACCTCAGACATGCAGGAGGAAGGTGCCGGCGAGGGGAAGGACGACAAGCCGTGAGTAAAATAATACGTTCGAATTT
CGTTTTCTATGCTACTAGCTAGCTGTTTAGACGCCTTCTCTCAACACCTTGGTACTGTTGATTCTTTCGTTCCTGAA
TACATTATTTGGCTTG

> SEQ ID NO: 6414 213958 202218_300731_1b
CCAAAATTTCCGACGCCAGAGCGCGAGGAGACGCACACAGAGACTTGGCATTTGTAGAGTTTTTAGATTTATAGATAGC
AAAGATGTCGGCACAGGCGGAGCTTTCCCGTGAGGAGAATGTGTACATGGCCAAGCTCGCTGAGCAAGCCGAGAGGTAC
GAGGAGATGGTCGAATTCATGGAGAAGGTGGCCAAGACGGTTGACTCTGAGGAGCTCACCGTGGAGGAGCGCAACCTCC
TGTCTGTTGCATACAAGAATGTGATTGGAGCCCGCCGTGCGTCATGGCGCATTATCTCCTCCATTGAGCAGAAGGAGGA
AAGCCGTGGTAACGAGGACCGTGTCACACTCATCAAGGACTACCGTGGCAAGATCGAGACTGAGCTCACCAAGATTTGC
GACGGCATTCTCAAGCTGCTTGAATCCCACCTTGTCCCCTCTTCCACTGCCCCTGAGTCCAAGGTCTTCTACCTCAAAA
TGAAGGGTGACTACTACAGGTACCTT

> SEQ ID NO: 6415 213958 258777_301699_1b
AAATCCTGAATTGCACCAACTAGTACAACGACAACAATGTCTTCTGAGAGAGAAACCAAGACCTTCCTTGCCCGGCTCT
GTGAGCAGGCTGACCGATACGACGAGATGGTCAACTACATGAAGGACGTCGCTAAGTCCGGTGAGGAGCTTACTGTCGA
CGAGCGAAATCTGGTTTCCGTCGCTTACAAGAACGTTATCGGCGCTCGACGAGCCAGCTGGAGAGTCATTTTCCCCATA
GAGCAGAAGGAGGAGGCCAAGGGTGGCACCCACCATCTCGAGCTTCTCAAGACCTACAGAGCCCAGATTGAGGGAGAGC
TCGAAGACATCTGGAGCGATGTTCTTGATATTCTCAACAAACAACTCCTCCCCAAAGGCGAGAACGCCGAGTCTAAGGT
CTTCTACTACAAGATGAAGGGTGACTACCATCGATACCTTGCCGAGTTCACCTCCGGCGAGAAGCGAAAAGAGGCTGCC
ACTGCCGCTCACGAGTCATACAAGAGCGCCACTGATGTTGCCCAGACTGAGCTCAGCTCAACTCACCCCATCCGACTTG
GTCTCGCTCTCAACTTCTCCGTCTTCTACTACGAGATTCTCAACTCGCCAGACCGTGCTTGCCACCTTGCCAAGCAGGC
TTTCGATGATGCCATCGCTGAGCTCGACACTCTCTCCGAGGAGTCTTTCCGAGACTCTACCGTCATTATGCAGCTTCTG
CGAGACAACCTCGACCCTCTGGAAGAACGACCTCGAAGAGTCTCTGCAAGCCCAGCAGTCTGAGGAGACCCCTGCCACCG
ATGCTGCCGCTGCTTCCACCGAGGCTGCTGCCCCCAAGGAGGAGGCCAAGCCCGCTGCTGAGGAGCCCAAGGAGTAGAG
TAGT

> SEQ ID NO: 6416 213958 190737_300779_1b
GAATTTGAACTCCACCTGAGCACAGGAGAAGCCGCAGCCACTGAGATTTGACCTTCTGTTTCTACCAGAAAAACACAAA
CAGTGAAGATGTCGCAGCCTGCTGAGCTTTCCCGTGAGGAGAATGTGTACATGGCTAAGCTTGCAGAGCAGGCCGAGAG
GTATGAGGAGATGGTTGAGTTCATGGAGAAGGTTGCTAAGACAGTTGACTCTGAGGAGCTCACTGTTGAGGAGCGCAAC
CTTCTATCAGTTGCTTACAAGAATGTTATTGGTGCTCGCCGTGCGTCATGGCGCATCATATCATCCATTGAACAGAAGG
AAGAGAGCCGTGGTAATGAGGATCGTTGCACGCTCATCAAGGAATACAGGGGAAAGATTGAAACTGAGCTCTCCAAGAT
CTGTGATGGCATCCTCAAGCTTCTTGACTCCCACCTTGTGCCTTCATCCACTGCTCCAGAGTCCAAGGTCTTCTACCTC
AAGATGAAAGGCGACTACTACAGGTACCTCGCAGAGTTTAAGACTGGAGCTGAGAGGAAGGATGCTGCTGAGAACACCA
TGGTGGCATACAAAGCCGCTCAGGATATTGCCCTGGCAGAGTTGCCCCAACTCATCCTATCAGACTTGGGCTGGCCCT
CAACTTCTCGGTGTTTTATTACGAGATCCTCAACTCTCCTGACCGTGCTTGCAATCTTGCAAAGCAGGCTTTCGATGAG
GCTATCTCAGAGCTGGACACTCTGAGTGAGGAATCCTACAAGGACAGCACTTTGATCATGCAGCTTCTGCGTGATAACC
TGACGCTGTGGACTTCCGATATCTCGGAGGATGCTGCTGAGGAAATCAAGGAGGCCCCAAGGGCGAATCAGGAGATGG
ACAGTGAACATGATCGAATGCGTGCGCCCACAAACTAGAATAGTGACGCTGCAAATGTGCTGTGGGTTATCGTTTCATT
TTATA

> SEQ ID NO: 6417 213958 1098561_301485_1b
AAAAAATCAGAGAAGTGAAGAGAAGAGATCAAGGGATCGATCCTTGAGAAGGCAATGGGAATCGAGAAGGAACGTGAGA
CCCTCGTCTACCTCTCTAAGCTCGCTGAGCAAGCTGAGCGCTATGACGAAATGGTGGAGTCAATGAAGAAAGTGGCTAA
GTTGGACATTGAGTTGAGTGTGGAGGAAAGAAATCTGCTCTCCGTTGGATACAAGAATGTGATCGGAGCACGCAGGGCC
TCCTGGCGCATCCTCTCTTCCATTGAGCAGAAGGAAGAGAGCAAGGGCAATGAGACAAATGTGAAGCGCATTAAGGACT
ATCGCTTCAAGGTGGAGGAAGAGCTCTCCAAGATATGCAGCGACATCCTAACCATCATCGATGAGCACCTCATCCCCTC

FIG. 2 continued

ATCCAACACCGCTGAATCCACTGTTTTCTATTACAAAATGAAAGGGGATTATTATCGATACCTTGCGGAGTTCAAGTCT
GGGCATGAGAGGAAGGAGGCTGCCGATCAATCTCTGAAAGCTTATCAGGCGGCTAGTAACACTGCGAACACGGATCTAC
CATCCACCCACCCAATCAGGCTTGG

> SEQ ID NO: 6418 213958 1099978_301489_1b
TCTTGTTTTTTGTTTTGGTTGTTGACGGAAGAAGAGGAGGGAGAAGGCATGGGTGTGGAGAAGGATCGCGATGGCCATA
TCTACATGGCCAAGCTCGCTGAGCAGGCCGAACGATACGATGAGATGGTCGATTTTATGAAAAAGGTGGCAAACATGGA
TGTGGAGCTCACTGTGGAGGAGCGGAATCTTTTATCAGTAGGCTACAAAAATGTGATTGGGGCCCGCAGGGCTTCGTGG
CGTATTCTCTCCTCAATTGAGCAAAAGGAGGAAGCCAAAGGCAATGAGCAGAATGTGGGCGTATCAAAGACTACAAGG
AAAAGGTTGAGGAAGAGCTCTCAAAGATCTGCATTGACATCTTGTCGACTATCGATGATCATCTTATCCCTGCATCCAG
CACTGACGAGTCTTCTGTGTTTTATTACAAAATGAAAGGGGATTACTTCCGCTATTTAGCAGAGTTCAAAGCCTCAAGC
GAGAAAAAAGATGCTGCAGAGCAGTCTCTGAAAGCATACCAGGTTGCAGCAGATAAAGCAGCCAAGAGTCTTCCAACAA
CTAATCCGATCAGGCTTGGGCTTGCTTTGAACTTTTCAGTTTTCTACTATGAAATCATGAACTCCCCTGAAAA

> SEQ ID NO: 6419 213958 125521_300632_1b
CAAAAGTCCAAAATTTCCCCCACAAAAGCTCTCCTCTCTGAATTATTAAATCCCCATTCAGAAAATCGAAAAACTCCCT
CATTCAGATCTCCCAAAAAAATACAGAGAAACAAATCTAAACATGGCGGTGGCACCGACGGCGCGTGAGGAGAACGTGT
ACATGGCAAAGCTTGCAGAGCAAGCTGAGAGGTACGAAGAAATGGTTGAATTCATGGAAAAGGTCTCCAACTCCCTCGG
CTCAGAAGAACTCACCGTGGAGGAACGAAACCTCCTTTCCGTGGCGTACAAGAACGTGATCGGAGCGCGTAGGGCATCG
TGGCGTATTATCTCATCGATTGAGCAAAAGGAAGAGTCCAGAGGGAACGAGGAACACGTGAACTCTATCCGCGAGTACA
GATCTAAGATTGAGAATGAGCTCTCTAAGATCTGTGATGGTATTCTGAAATTGCTCGATGCAAAGCTTATCCCTTCTGC
AGCATCTGGTGATTCTAAGGTGTTTTACCTGAAAATGAAAGGAGATTACCACCGCTATTTGGCTGAGTTCAAGACCGGT
GCTGAACGTAAGGAGGCTGCTGAGAGTACACTCACTGCCTACAAAGCTGCTCAGGACATTGCAACTACTGAACTTGCCC
CAACACATCCCATCCGACTTGGACTGGCTCTTAACTTCTCTGTGTTTTACTATGAGATCTTGAACTCTCCTGACCGTGC
TTGCAATCTTGCTAAACAGGCCTTTGATGAAGCAATTGCTGAGCTGGATACATTGGGCGAGGAGTCTTACAAGGATAGC
ACTTTGATCATGCAACTTCTTCGTGACAATCTCACTCTCTGGACTTCTGATATGCAGGATGATGGGGCTGATGAAATCA
AGGAAGATCCCAAACCTGATGAAGCCAAAAATTGAAGGAAATGAAACTCTCTAATTTGCTTTTCACTTCTTCCTGGTTG
TTTTTATTGGAAGAAGCTGATTATCGTAATTTCCTTACTATTATGGTTCTCCACTAGGGGGTTGTCATCTTATTGGAAA
TGAACAACTTTTAATATTGATGTTTCAGAGTTCCATCTTTGATTTAATGTGGTTTTCTGGTGATTAGTTTTCTTCT

> SEQ ID NO: 6420 213958 119981_300361_1b
CCCCCCCCCCCCGGAAAAATCGTTGGGGGAGTAAGAACATTTGACAGCGCCCCAAAACCAAAAAAGAAAAAGGGGGAAA
AATTCTTCTCTTTTTCAACACACAGAAAAAAATCTTCCGAAAGAGAGAGAGAGATCAGAAAATGGGTGAACGTGAGAAC
TTCGGATACATCGCTAAGCTTGCCGAGCAAGCTGAACGCTATGATGAGATGGTTGATGCGATGAAGAATCTTGCAAATA
TGGATGTTGAATTGACAGCGGAAGAGAGGAATTTGTTTTCTGTTGGTTATAAGAATGTGGTTGGAGCTAGGAGAGCATC
GTGGAGGATCTTGTCTTCCATCGAGCAGAAGGAAGAGTCTAGAGGAAATGAGCAGAACGTGAAGCGGATTAAGGAGTAC
CAGCAAAAAGTGGAGTCAGAGCTCACCGACATTTGCAATAATATCATGACCGCGAT

> SEQ ID NO: 6421 213958 118303_300065_1b
CGGACGCGTGGGCCCAAAGAGAGAGAGCGAGAGAGAGAGCGGAGAAATGGAGAAGGAAAGAGAGAAACAGGTTTACTTG
GCAAGGCTAGCTGAGCAAGCTGAGAGATATGATGAAATGGTAGAAGCAATGAAGACGGTTGCTAAGATGGATGTTGAAC
TGACTGTTGAGGAGAGGAATTTGGTGTCAGTTGGGTATAAGAATGTTATTGGAGCAAGAAGGGCTTCATGGCGGATATT
GTCTTCAATTGAACAAAAGGAGGAGAGTAAGGGTCATGACCAGAATGTTACGAGAATAAAGACTTACCAACAGAGGGTC
GAAGATGAGCTTACAAAAATATGCATTGACATTTTGTCGGTGATCGATGAGCACCTTGTTCCTTCTTCCACTACCGGAG
AATCTACTGTCTTCTACTATAAGATGAAGGGAGATTACTATCGCTATTTAGCAGAGTTCAAATCAGGGGATGATCGTAA
AGAGGCAGCTGATCAGTCACTTAAAGCTTATGAGGCTGCTACTTCCACAGCTAGTGCAGATCTTGCTCCTACTCATCCA
ATTAGACTTGGACTTGCATTGAACTTCTCAGTCTTCTACTATGAG

> SEQ ID NO: 6422 213958 1171669_302055_1b
GAACAATGGGTGCCGAGAAGGAGAGGGAGGGTCATGTCTACCTGGCCAAGCTTGCAGAGCAGGCTGAGCGTTACGATGA
GATGGTCGAGTTCATGAAGAAGGTAGCCAAGCTTGACATTGAGCTGACTGTGGAGGAGCGCAATCTTCTCTCAGTGGCC
TATAAGAATGTGATTGGAGCACGTAGGGCCTCTTGGCGTATTCTCTCCTCCATTGAGCAGAAGGAGGAGAGCAAGGGA
ATGAGGTTAACGTGAAGCGTATAAAGGATTACAGGCAAAAGGTCGATGAGGAACTCTCGAAGATCTGCCATGACATTTT
GACTATCATAGATGAGCATCTCATCCCCTCTTCTGGGACTGGCGAATCGTCTGTCTTCTACTACAAAATGAAGGGAGAT
TACTACCGCTACCTCGCAGAGTTCAAAGCTGGTCCGCAGAAAAGGAAGACGCAGATGAGTCCTTCAAAGCCTACCAAG
CTGCGTCGAGCACCGCGGTACTGATCTGCCACCTACCCATCCCATCAGGCTTGGACTCGCCTTGAATTTCTCCGTTTT
CTACTATGAAATTTTGAATTCGCCCGAGCAGGCATGCCAATTAGCAAAACAAGCATTCGATGAGGCGATTGCAGAGCTC
GATACTCTGAGCGAGGAGTCATACAAGGACAGCACCCTTATTATGCAGCTTCTAAGAGACAACCTGACCTTGTGGACTT

FIG. 2 continued

CAGATCTGCAAGAAGATGGAGGTGATGAGCACTCCAAGGGAGAGGATCTGAAAGTAGGAGATGCAGAGGAATCGTAGTG
CCAGTTTGATTGTTCGAGCTGAGTTTTGAAGGAGTCGAGCCGGATATGCATCCTTGGTACAAAATTTGACATGTGTTAG
ATTCTGTGTGGCATTTGTTTGAAGGAATATCCTATGTAGATTGTTATGTTCTTGTTCTGCTCTATTGCTACAAGGGCTG
TTGTTACAATTACAAGTTATACATTTTCTATTTGAGGGAA

> SEQ ID NO: 6423 213958 1110178_301527_1b
GGGTTTGGATCGAGTCAGTGCAGTCTACGGTCTGCAAGCATGTCCGGGCACGATGAGCACGTGTTCATGGCTAAGCTCG
CCGAACAGGCCGAGCGCTATGAGGAGATGGCCGAGTTCATGGAGAAGGTTGCTGGCCATGGGGACGACCTCACTGCCGA
AGAGCGCAACCTCCTCTCTGTCGCCTACAAGAACGTGGTGGGTGCTAGACGTGCCTCCTGGCGCATCATCTCCTCCATT
GAGCAGAAGGAGGAGGGCAAGGGCAACCAGGACCATGTCAGTGCCATCCGTGACTACCGGGCCAAGATCGAGGCCGAGC
TTTGCACTATATGTGGGGGTGTCCTCAAGATCCTGGACACGCACCTCATCCGGCCGGAGAAGCTGCTGAGTCGAAGGT
CTTCTACCTCAAGATGAAGGGTGATTACCATCGTTACGTGGCTGAATTCAAGACTGGTTCTGAAAGGAAGGAGTCTGCT
GAGAACACCATGTCTGCCTATAAGTCTGCCCAGGATATTGCCCTTGCAGAGCTTGCTTCAACTCATCCTATTCGCCTGG
GACTTGCGCTCA

> SEQ ID NO: 6424 213958 1098550_301485_1b
ACCTCTAAGCCTTGCAGATAACCCGTCTTGTTCATCTCTCTTTCTCTCTCTCTCTCTCATCTTCTCTAGCTCTCTCT
CTGTGTGTCCCCTGTTTCCCTGTCTTAGACCATGACTCCGTCGATGGAGGGGGCAAGCGGGAGGAGAATGTGTACATG
GCGAAGCTTGCGGAGCAGGCCGAGCGGTACGAGGAGATGGCGGAGTTCATGGATGCCGTCGTCAAGGACGGTGCTGACG
AGATGTCGGTGGAGGAGCGGAACCTCCTCTCCGTCGCGTACAAGAACGTGATTGGCGCGCGTCGCGCCTCCTGGCGCAT
CGTCTCCTCCATTGAGCAGCGCGAGGAGAGCAAGGGCAACCAGGAGCACGTCTCTGCCATCCGCGACTACCGTGCCTCC
GTCGAAACCGAGCTCACCAAGATCTGCAAAAGCATCCTTAGCCTCCTCGAGATGCACCTTGTCCCTTCCGCCACCACCC
CCGAATCCAAAGTCTTCTACCTCAAAATGAAGGGCGACTACCACCGCTACCTTGCGGAGTTCAAAATCGGGGCGGACCG
CAAAAAACTGGCGATAAATACTCTCACCGCCTACAAATCTGCTCAGGAAATAGCCTTGGCTGAGCTGCCTTCAACACAC
CCCATTCGTTTGGGGCTTGCTCTAAAT

> SEQ ID NO: 6425 213958 105222_300372_1b
AAAAATCTCATAAACGAAACACAAAAAAAAAAACCCTCTCTCGAAAATTAAAAATAAAAAATACCCGGCGAATCTCCGAC
GATGGCTTTGCCGGAAAATTTAACCAGAGAGCAGTGCCTATACTTAGCAAAGCTCGCCGAGCAAGCCGAGCGTTACGAG
GAGATGGTAAAATTCATGGACCGACTCGTAGCTGTCTCGACTGTCTCCTCTGAACTAACCGTAGAAGAGCGAAACCTCCTCT
CGGTAGCTTATAAGAACGTCATCGGTTCACTTCGAGCCGCGTGGAGGATAGTATCGTCAATTGAGCAAAAGGAAGAAGG
TAGGAAGAACGAGGAACACGTGGTTCTAGTGAAGGATTATAGATCTAAGGTTGAATCTGAGCTTAGTGATGTATGTGCT
GGAATTTTGAAGATTTTGGATCAGTATTTGATTCCTTCGGCTTCGGCTGGTGAATCGAAGGTGTTTTACTTGAAGATGA
AGGGAGATTATTATCGTTATTTGGCTGAATTTAAAGTTAGTAATGAACGTAAGGAGGCTGCTGAGGCCACTATGCTTGC
CTACAAAGCTGCTCAGGACATTGCGCTTGCTGAGCTTGCCCCAACACATCCTATACGACTTGGGCTAGCTCTCA

> SEQ ID NO: 6426 213958 159293_200022_1b
ACGCACTCTGTCGAGAATCCATTCTATTTCGCCTAAACTTTCTCTCTCTACAACAACAACAATGGCGGCTCTGCTCACA
GACAATCTCAACCGCGAACAATACCTCTACTTAGCCACAATCGCCGAACAAGCCGAACGCTATGAAGAAATGGTCCAGT
ACATGGACAAACTAGTACTCAGTTCCACTCCCGCCGCCGAACTCACCGTCGAGGACGAAACCTCCTTTCCGTCGCTTA
CAAAAACGTGATCGGCTCTCTTCGTGCCGCGTGGCGTATCGTATCCTCCATTGAGCAGAAAGAGGAATCGCGTAAGAAC
GAAGAACACGTTTCGCTCGTTAAGGAGTACAGAGGTAAAGTTGAGAATGAGTTAACGGAGGTTTGTGCTGGTATCCTCA
AGTTGCTTGAGTCAAATCTCGAGCCGTCTGCTTCTACGGGTGAATCGAGGGTGTTTTACCTCAAAATGAAAGGTGATTA
TTACCGGTATCTAGCGGAGTTTAAGGTTGGAGATGAGCGGAAGCAGGCTGCTGAAGACACTATGAATTCTTATAAGGCT
GCTCAGGAAATTGCACTAGCAGATCTGCCTCCAACACATCCTATAAGGCTGGGTCTTGCACTTAATTTCTCAGTCTTCT
ACTTTGAGATTCTGAACTCATCTGACAAAGCTTGTAGTATGGCAAAACAGGGCTTTTGAGGAAGCCATAGCTGAGC

> SEQ ID NO: 6427 213958 157176_301735_1b
AGCCAAGTGAAAGCAAAAAGGGAGAGGAAAAGCGCAAAATCTCCCTTCGATTATCAGTACAAAACCTCTGATTTGAGAG
ATCGGAAATGGCTTCCTCCAAAGAACGCGAGAACTTCGTCTACGTCGCTAAGCTTGCTGAGCAGGCCGAACGCTACAAT
GAAATGGTTGATGCAATGAAGAGTGTAGCAAATATGGATGTTGAATTGACTGTTGAGGAAAGGAATCTGCTTTCTGTTG
GTTATAAAAATGTGGTAGGTTCTAGGAGAGCATCTTGGAGGATCTTATCCTCTATTGAGCAGAAGGAAGAATCTAGAGG
AAATGAGCAAAATGTCAAGCGAATTAAGGAGTACCGACAAAAGGTGGAGACAGAGCTCACCAGCATTTGCAACGATATC
ATGGTGGTCATTGATCAGCATCTAATTCCTTCATGCACTGCAGGCGAATCAACTGTGTTTTACCACAAGATGAAGGGAG
ACTATTATCGTTATCTTGCAGAATTTAAATCTGGCAATGACAAGAAAGAGGTTGCAGAGCTTTCATTGAAAGCATATCA
GTCAGCTACAACTGCTGCAGAGGCGGAATTACCACCCACTCATCCCATTCGGTTGGGATTGGCTTTGAATTTCTCTGTG
TTCTATTATGAGATCATGAATTCACCTGAAAGGGCATGCCATCTGGCAAAGCAGGCCTTTGATGAAGCAATATCTGAGT
TGGATAGCCTGAACGAGGATTCCTACAAAGACAGCACCTTGATTATGCAGCTTCTAAGGGACAATCTCACCTTGTGGAC

FIG. 2 continued

TTCTGATCTTCCAGAGGATGCAGAAGATGCCCAAAAGGGAGATGCCACAAACAAAGCAAGTGGAGGTGAAGATGCAGAG
TGAATGGGCCTAATGGTTAGAACTACCTTGTGCATTTGGAGCTGTGAGGACGGTGATACACCAAAGGGATGTGTGTGTG
TTAAGTCCTAGTAGATTCTTATCTTATGGGCATGTCGTGTCAGTTTCTTTACATGTTAATTGGGTGTTGCAATTCAGCA
TGTGTGTGATTTGTATCCCTGTGCTATTTCCTCTCCGTAAAGTGAGTTGTTTCAGTCTTTAGATGATTGGTCTGGTCCA
TAGGTGGTTTTATTTTTCAGAGGACT

> SEQ ID NO: 6428 213958 139182_300407_1b
CGGCCGAACAAAAAGCATTCGCATCCACGAGACCACTCGAACCCGACCCGCCTCGCCGCCGCCGCCACCGAAGTAATCC
CTTAATTGGTCAAAATGTCTCGGGAGGAGAATGTCTACATGGCCAAGCTGGCCGAGCAGGCTGAAAGGTATGAGGAGAT
GGTTGAGTACATGGAGAAGGTTGCAAAGACTGTAGATGTGGAAGAGCTCACTGTTGAGGAGCGCAACCTCTTGTCTGTT
GCTTACAAGAATGTGATTGGTGCCCGCCGTGCCTCCTGGCGTATTGTCTCATCCATTGAACAGAAGGAGGAGGGTCGTG
GCAATGAGGAACATGTTACTCTGATCAAGGAGTACCGTGGCAAGATTGAAGCTGAGCTGAGCAAGATTTGCGATGGTAT
CCTGAAGTTGCTTGACTCACACCTTGTGCCCTCATCTACTGCTGCAGAATCTAAGGTGTTTTACCTCAAGATGAAGGGT
GATTACCACAGGTACCTTGCGGAATTTAAGACTGGTGCCGAGAGAAAGGAAGCTGCTGAGAGCACAATGGTGGCTTACA
AGGCTGCTCAGGATATTGCTCTGGCGGATCTTGCTCCCACCCATCCCATAAGGCTTGGACTGGC

> SEQ ID NO: 6429 213958 128752_300477_1b
CCCCCCGAGATCTCAAAAATTCAACATTGGCACAACCAAAAAGAAAAGAGATCCCTAAATTGGAATTCATTATGGCGCG
TGAGGAGAACGTGTACATGGCGAAGCTTGCCGAGCAAGCCGAGAGATACGAGGAAATGGTGTCGTTCATGGAGAAAGTC
TCTACTTCCTTAGGGACGTCAGAGGAACTCACGGTAGAGGAGAGAAATCTCCTCTCGGTGGCGTACAAAAATGTTATCG
GGGCTCGTAGAGCCTCGTGGCGTATAATCTCCTCCATCGAACAGAAGGAGGAGTCGAGGGGAAACGAGGACCATGTGAA
ATGCATTCAGGAGTACAGATCTAAGATTGAATCTCTAGTATCTGTGATGGCATTCTCAAGCTCCTTGATTCT
TGTCTTATTCCTTCTGCTTCAGCTGGTGATTCTAAGGTGTTTTACCTTAAAATGAAGGGTGATTATCATCGTTATTGG
CTGAGTTTAAGACTGGTGCTGAACGTAAGGAAGCCGCTGAGAGTACTCTCTCCGCCTACAAAGCCGCTCAGGATATTGC
AAATGCTGAACTTGCCCCAACTCACCCAATCCGACTTGGACTGGCTCTCAACTTCTCTGTGTTTTATTATGAGATTTTG
AACTCTCCTGATCGTGCCTGCAATCTTGCTAAACAGGCCTTTGACGAAGCAATTGCTGAATTGGACACACTGGGAGAGG
AGTCTTACAAGGATAGCACTTTGATCATGCAACTGCTTCGTGACAATCTTACTCTCTGGACCTCTGATATGCAGGATGA
TGGCGCTGATGAAATCAAGGAAACCAAAGCTGACAATGAACAACAGTGAGGAAACTGCCCCTCATATTGTCTTTTGACT
TCTTCCTGTTGGTTTTATTGGGAGAAGCTGTTTCCTTTTATTTCCTTTTTAATGTGGTTTCCCTTCAGCGTTCTCTTA
TCCGTCGCAATAACAACTTTGACAATTGATGTTCAATGATTTATCTTTATTTT

> SEQ ID NO: 6430 213958 47376_300170_1b
CGGACGCGTGGGAAAAAAATCAAATCTCTCTCTTTCTCTCTCTAATGGCGGCGACATTAGGCAGAGACCAGTATGTGTA
CATGGCGAAGCTCGCCGAGCAGGCGGAGCGTTACAAGAGATGGTTCAATTCATGGAACAGCTCGTTACAGGCGCTACT
CCAGCGGAAGAGCTCACCGTTGAAGAGAGGAATCTCCTCTCTGTTGCTTACAAAAACGTGATCGGATCTCTACGCGCCG
CCTGGAGGATCGTGTCTTCGATTGAGCAGAAGGAAGAGAGTAGGAAGAACGACGAGCACGTGTCGCTTGTCAAGGATTA
CAGATCTAAAGTTGAGTCTGAGCTTTCTTCTGTTTGCTCTGGAATCCTTAAGCTCCTTGACTCGCATCTGATCCCATCT
GCTGGAGC

> SEQ ID NO: 6431 214014 206406_300822_1b
GCAACCTAAGCGCACCTAGATATCATGGCGGACAACACTAACCCCGGAAACTTTGCCAACCGGTATGATATCAACAGCG
GTTTTAAAAGTAAATCATTGACCAATTGTTGTTAGCCCCAAGGAGGAAGTGCAGTCGATTGCATCCAAGGGTGGACAGG
CGAGTCACCAGGGCGGCTTCGCTTCCATGGATCCTGACAAGCAGCGCGAGATTGCGTCCAAGGGCGGCCAGGCCTCTGG
AGGATCTTTTGAGCCCGGAAGCAAGAAAGCTCAAGAGGCGGGCCGCAAGGGTGGTTTGCAGTAAAGCATGACCGTAACT
CTAGTGTCGATTCACTGGTAGACGGTGTGATTATCTCTTATTGTAGATAAACATACACTAGCAATTTTGCTCTAATACA
AACTAATTGGTCCTAC

> SEQ ID NO: 6432 214067 213223_300851_1b
TCGACCCACGCGTCCGCAACCAACAGCCAAGGCGTTGAAAAGAGCATCACATGAAAATTTGCAGAGAACTGCTTCGCGA
CACATTACGTTGCCAAAAACGTACTTCGACGCTCACATCTTCAAGACGTCTCACTGCAACGCCCAGCCGCAAAATGGCA
TTCTCCCAGCGTCACTTTTACACCCCCGAGACATCCTTCACTCCCCTCTTCCGCCTTCTTGATGACTTTGACAATTATT
CTCGTCCAGGCAACGCGGAGCAACAGGGTCGTCGCTCTGGCCTAGCGCACTGGCAACCGAAATTTGACATGCGCGAGAC
TGACTCCGCGTATGAGCTCCATGGCGAGCTACCCGGCATGAGCAAGGAGAATGTGAACGTTGAATTCACCGATCCTCAA
AATATGCTCGTAAGCGGTAAAATTGAGAGGACATACACTTCTGGTACCCCACCTGCTGGAGCCCTGGAGGGAATTGCAT
CGAGAGGCAAGATCGCCGAGGGCGGCGAAGGACAGGCCAAGACATCTTCCCGCGAAGCAACCGCCAAAGATGCGACTGA
AGATACAGCCAAGTACTGGCTCACTGAGCGCAGTGTTGGCGAGTTCTCGCGCAACTTCAGTTTCCCTACGCGTATCAAC
CAAGAAAACGTGACAGCGAGTTTTAAGGATGGCATCCTCAACATTACTGTTCCCAAGGCTGCCAAACATGAGTCACGCC
GCATTACCGTCAACTAATTGACGTTT

FIG. 2 continued

> SEQ ID NO: 6433 214086 191128_300739_1b
CGGTCTCCTCAGCTGCTTGCGCCAAGACGAGTCGCGGCTCAACAGGGGGAGGGGCGGCGATCTCCATCCATCCGGCGAG
CAGAGCAGGGGAGGGGAGGGGATCCTGGAAAATGCTAAACCTTATTAAGATAAAGGGTCAAAAGAAGGAAGATGCAGCC
AATGCAAATGGAAAGCCTCCTGCCAAAAAGCAAAGTCCAGGGGAGTTGCGTCTTCACAAAGATATTGCTGAACTTAACC
TTCCTAAGTCGACTAGAATTTCTTTTCCTAATGGCAAGGATGATTTGATGAACTTTGAAGTTACTATTCGACCTGATGA
GGGATACTATGTAGGTGGTAAATTTATTTTTACTTTCCAAGTTCCTCCTGCCTATCCTCATGAACCACCCAAAGTCAAG
TGCAAGACTAAGGTCTATCATCCCAATATTGACTTGGAGGGAAATGTCTGCCTTAACATTCTGCGTGAAGATTGGAAGC
CTGTCCTGAATGTCAACACGATTGTATATGGCTTGAATCTTCTTTTCTCACAACCTAATGATGAGGACCCTCTAAATCA
TG

> SEQ ID NO: 6434 214086 208615_300807_1b
GGCAACGAGCACCGAATCTCCCCGCGGATAAGGCTTCTTTTTTTCCGTCTACAAAACGTCACCTGTGCAACAACTGAAA
GCTCTCTGGCTTCTCCGATTCGGCGGTCCAGGCCTCTCTTTCCACCTCTTCCAACGTTTCTTTCAACCCTCTCCCTTTG
ATCAGGCATTTCAGGATACCGCTTCTCGTCCTCACCGGCGATCTCCGACGAGCCAAGATGTTGAACATATGGTCTATGA
AAAAAAGCAAAAGGAGGCTGAAAATGCCGAAGGTCAGGCTGCTGGAGGGAAGAGGAAGAAGGTGACGGCGGCACAGCT
ACGAGTACAAAAAGATTTGTCAGAACTATCTCTCGGCGCAACGATGAAGACTGACTTCCCTGACCCCGACAATATCCTC
AACTTTATCCTGTCGATCGAGCCGGACGAGGGCATGTACCGAGGCGGAAAATTCACATTCGACTTTGCCATCAACCAGA
ACTTCCCGCACGAGCCTCCTAAGGTGCTGTGCAGGGAGAAGATATATCATCCCAACATTGATCTCGAGGGCAAGGTCTG
CCTTAACATTCTGCGGGAGGACTGGAAGCCGGTGTTGAACTTGAATGCTGTCATTGTGGGG

> SEQ ID NO: 6435 214135 218626_300935_1b
ATCAACACTCGACTTGAACACATACAACAGCCAATCACCTCTTTACATCCTCACTCAAACAATCAACAAACAAACCAAC
ACAAAAACTCAACCATCTAATCTACATTTTTAAATAAAAACCCTCACACGACCATCCTCAAACAGCTCCAATACACACT
TCCGAGGAGAACCAGTCATCTGCTACCGATCGGCCCATAACTCGCTGCCTCTTGCTGCTTTGGGATCCACCACAGCTTT
TCTGACACCACCCCTCTCCCATCTGAGTTCCTCTGGGGTATCAAATCTCGCCCGACTACCTAGAACCAGGCCTTTTTTT
CTCCTTAAACAGCCCCGACAGCCATCACAGTTACCGCTCGAGCCGGCCTTAATCAGCCTACTTCAACTGGAGAGATAGC
CTTTTCGCGGCCTTTTCGCAACCCCGCTTTCCGCACAGTAGAAACCAGAAGCTTCGAAGCTCTCGAGATATATATTCGC
TACTGAGCCACATCCCTCCACTCTAGCTTCCCATAGCTATCACCACCGCACTCCCCTACACAACCAACCCCCAACAGTC
ATCATGAAGGTCGTCACCAAAGAAGAAGAAGCCGCCCACTACGGCGCTGTCGTCAAGGGCGGACTCATTGGTGGTACTC
TTGGTCTTGCCATTGGTGTCTCTGGTGTTGTCTACGCCTCAAGGCGCTACCCCAGCTTCCGTGGCTTGACACTCCCCTT
CCGAACTTTCCTCGTCACATCCACCGCCACCTTTGGAGCCATTGTCCAGGCTGATCGAGCTGGCATCAAGTTCCAGCAG
GGCAAGGACCCCATGAAGACCTACCGCGATGCCTCTCAGCGTGCTCAGGAGGTTATCCGTGAGAACGAGACTGCATACG
AGCGATTCATGAACTATGGACGCGAGCACCGCTACAGCATTGTCTGCGCCTCATGGCTTGCTAGTTTGGCCGTTGCCTT
TGCCATTGTCAGCCGCGCGCCTATGAGCACACCCCAGAAGATCGTGCAGGCTCGTGTCTACGCTCAGGGCCTGACTCTT
GCTGTGCTCATCGTCTCAGCTGCCTTTGAGATGAACGACGCCAAGAACGCAAAGGGCCGCTGGGAGACCGTCATGGTCC
TCGACCCCAACGACCCCGAGCACAAGCACCTCATTGAGAAGAGAATCCACCACGAGGAGTACGAGGGACAAGATCTGTG
GATGGATATGGTTGAGGCTGAGGAGAAGAGAATGGCTGCCCGCAAAGCTGAGCAGGAGCGCGAGCAGCAGCAGGCCCAG
TAAGCAAGCTGCTGAATGCATTTCATTCTCCCGCCCATGT

> SEQ ID NO: 6436 214157 142494_300435_1b
CCCCCCCCAGAAACCCCTCCTTTTCTTTTCCCCTTCCTGGGGGGGTCTAGGGTTTTGCCTCCCAGCGGCGACTGGGGGA
GCGAGACCACCGGCAAGCTCGTCGGCGATGGACCCCACCTCGTCGGCGGCGATGGCGAGGCACACGTGGGAGCTGGAGA
ACAACATCCCGGGGGGGGCCTTCCGACCCGGACGCCCTGGACGCGATCTACCGTTACGACGAGGCGGCGCAGGCGCGGT
GCAACAGGAGAAGCCCTGGGCGAACGACCCCCACCCCTTTCGCCGCGCCAAGATCTCCGCCCTCGCGCTCCTCAAGATG
GTCGTCCACGCCCGCGCCGGGGGCACTATCGAGGTCATGGGCCTCATGCAGGGCAAGTGCGAGGGCGACGCCATGGTGG
TCATGGACGCCTTCGCGCTCCCCGTCGAGGGCACCGAGACCAGGGTCAACGCCCAGGCCGACGCCTACGAGTATATGGG
CG

> SEQ ID NO: 6437 214157 263013_301721_1b
GCAGCATGGAGGGTTCGTCGTCGACGATAGCAAGGAAGACATGGGAACTAGAGAACAGCATTCTAACAGTAGACTCACC
TGATTCAACCTCCGACAACATCTTCTACTACGACATACTTCACAGACTAGGTTCCAGCAAGAGAAACCGTGGGAGAAT
GATCCTCACTACTTTAAACGAGTCAAGATCTCAGCGCTCGCTCTTCTTAAGATGGTGGTTCACGCTCGCTCTGGTGGTA
CAATTGAAATAATGGGTCTTATGCAAGGTAAGACCGATGGTGATACTATCATTGTTATGGATGCTTTTGCTTTACCAGT
GGAAGGTACTGAGACAAGGGTTAATGCTCAGGATGATGCTTATGAGTACATGGTTGAGTATTCACAGACCAACAAGCTC
GCGGGGCGGCTGGAGAATGTTGTTGGATGGTATCACTCTCACCCTGGATATGGATGCTGGCTCTCCGGTATTGATGTTT
CTACGCAGAGGCTTAACCAACAGCATCAGGAGCCATTTTTAGCTGTTGTTATTGATCCCACAAGGACTGTTTCAGCTGG
TAAGGTTGAGATTGGTGCTTTCAGAACATACTCTAAAGGATATAAGCCTCCAGACGAACCTG

FIG. 2 continued

> SEQ ID NO: 6438 214157 263049_301721_1b
GCAGCATGGAAGGTTCCTCGTCAGCCATCGCGAGGAAGACATGGGAGCTAGAGAACAACATTCTCCCAGTGGAACCAAC
CGATTCAGCCTCCGACAGTATATTCCACTACGACGACGCTTCACAAGCCAAAATCCAGCAGGAGAAGCCATGGGCCTCC
GATCCTAACTACTTCAAGCGCGTTCACATCTCAGCCCTTGCTCTTCTCAAGATGGTGGTTCACGCTCGCTCCGGTGGCA
CAATCGAGATCATGGGTCTTATGCAGGGTAAAACCGAGGGTGATACAATCATCGTTATGGATGCTTTTGCTTTGCCTGT
TGAAGGTACTGAGACTAGGGTTAATGCTCAGTCTGATGCCTATGAGTATATGGTTGAATACTCTCAGACCAGCAAGCTG
GCTGGGAGGTTGGAGAACGTTGTTGGATGGTATCACTCTCACCCTGGGTATGGATGTTGGCTCTCGGGTATTGATGTTT
CGACACAGATGCTTAACCAACAGTATCAGGAGCCATTCTTAGCTGTTGTTATTGATCCAACAAGGACTGTTTCGGCTGG
TAAGGTTGAGATTGGGGCATTCAGAACATATCCAGAGGGACATAAGATCTCGGATGATCATG

> SEQ ID NO: 6439 214221 218585_300967_1b
TGTCAAAGTCCGCAGTTCCCTTTACGAAATCAACCATTCGCCGTGCTTCGTCCAGCTAATTGACCCCGTCTAGATGCTC
TCCCGCGCCGCCACTCGCACCACCTCCGTGGTCGCCCGCCGAGGCTTCCACACCACCCGCCCTCGCATGTCCTCTCCTT
ACCACTACCCCGAGGGTCCTTACTCCAACTTGCCCTTCAACCCTCGCAGCAAGTGGTTCGGCGCCGGCTACTGGGCCTT
CATGGCCACCGGCTTCTTCGCTCCCTTTGGCATTGCCGTCTACCAAACCTACAAGACCCAGTAAACGGATGCTTCGATT
ACAAAAGGCTTATATGGGCTGGACGCTTGGTGCTATGAATGGGTGGTGGACTGTTGCGACAGAGTAAATAGCTCGAATT
AGACGTGGGACCAATTCACAAGTCACATACATCACAAAACTTGTTCTGTGCCGGCTCCATTTTGCATTCACCCTTGGAA
CTACCATATGGATATGATTCAAACTTGTCATAAAATCATTGCTGCATTCCATGATGATCCCCATCGACGTAGGATAGGG
CTAGTCTATATGTTTGGCAAATGTTATCTAACGTACATGAACACTTAAAAAAAAAAAAG

> SEQ ID NO: 6440 214235 208640_300807_1b
GAAGCAACCAAGAATCTGCACCTCACTCGATAATAAAAAGAAATCGGTACTCAAGGTTTATAACTCATTCAAAATGCGT
TATACTGCTGTCCTCGCTGTCCTCGGCTTCTCCGGAGTCATGGCCAACAAAAACTTCGGACCCTTCGGATTTTTCGGAC
CCTGGTTCGATGGCGACTTAACTATCGATGACCTCGCTGACTTTCAGTTTCCTGAGAACCCTTGTGAGTTCATTGGTGG
TACTTGCGAGATCGCCACTTCCCTTACATTCTGCGCTGGTCGGGGCGACTTCAGCGTTGATTTGCCTTGTGGCGTTGGC
CTCGGCTGCTGCTGGCACCAGGACACCAGCAATGTTTGGTTTGAGCAATGGAAGGAGTGGCTCGAGCTACACAGCCGCA
TCAACTAAAGCCGCTTTAATGTCTTGACGCTTTGATGGCTTGACGCTTCTATGGCTTGACGCTTCTATGGCTTGATGCT
TTAATGGCTTGACGGAGTCTTCAATTGGCACGGTAGTGGGTGATGGAGAAATTAGCCGTACTGAACTCAATGAGAGATT
GTTAACCCCGATTAAGTAGT

> SEQ ID NO: 6441 214250 211757_300870_1b
TCTCTCCCCTCTGCGGCATCTTCACCATGGCTGAACCAACCCCCGGCCTCACTCCCGAGCAGCTCTCGGCCTTCCAAAA
AGACGGCTATCTCATCATCCGCAACGCCCTCAAGCCAGAAACCGTCTCATCGCTCCTTAGCGAAACAAAGGGCCTGCTC
GAGGGCTTCTCCCTCAAGGACCACCCGCTGACTCGCTTCTCCACGGGCGAGAAGTCGGACCACGTGGGCGACGACTACT
TCCTCACGTCGGGCGACAAGATCCGCTTCTTCTTCGAGGAGGACGCCTTTGACGACGCGGGCAACCTGACCAAGCCCAA
GGAGCGCGCCGTCAACAAAATCGGACACGGCCTGCACGTGCACTCGCCGCCGTTTGCGCGGCTCATTGACGAGGCGTCG
ACGCGGGCCGCGGGCGAAGTGAGTCCTGCGGCTGTGGCTCGTGATCTCGGGTTCAAGGATGCGCGGTGTCTGCAGAGCA
TGGTGATTTGCAAGCAGCCCGAGATCGGGGCGCGGTGCCGCCGCACCAGGACTCGACGTTTTTGTACACGAGCGCGCC
GTCGGCCGTGGGCTTCTGGTATGCGCTGGAGGACGCGACGCTGGAGAATGGGTGCTTGAGTTTCTTGCCGGGGTCGCAT
CGCTGGGCGCCCGTGGA

> SEQ ID NO: 6442 214275 211211_300897_1b
GGTGATCTGAAGAGAATGGGTCGACCAGCGCTACTTGTACAGTATCGAATGCACGATGCGTCTTATGATCAGCGCGTGT
CTTGCACATATGCATACGTCAAACAATGCATCCTCCACAATCTTCATCATCACTCCACAAATAGCTTCCATGTTACTTT
CCGCATTCTAGGTACCGCCTCAGTGTTGGCTGAGGTTTGCCACATGCACACCATTGTTGACGTACCATGTGGCTCAGTT
CAGCCATCGACATCTCCAGACAAGCCTACCAAAGAAAGTCAGCCTCAGCCTTAACTGCTCTCGAGGGTTTCAGTCATCA
ATTAGCCCTACAGCTCCGCCTTCCCTCGGCCCGTGCGGCAAAAGACGACTGGAGATCTAGATTGTGAGAAATACGAAGA
TATTAGTGGATTTCTCGTACCAGGAACGAGGAC

> SEQ ID NO: 6443 214293 195493_300634_1b
CGTCGCTTCATCTAGAATAGCCATATAGAACTTTTGTTTACTGTGTGCGCCGTATCTGTGCACCCTGCAGCCATCATGA
AGCTCTCAAATGCCGTGGCCTTTAGCCTCGTCTCCCTGCCAGGGGCCATGGCTTGGGAGGTCTGGGCCACATCACGAC
TGCCTACATAGCAAGCCAGTTTGTCAGCAACTCCACAGAGGCCTACCTCAAGCACCTTCTGCGAAGCAATGAGCCCGAC
TACATGGCCAAGGTAGCCAGCTGGGCCGACTCGATCCGATACACAAAATGGGGCAGATTCACGAGCACGTTCCATTTCA
TCGATGCCCACGATAGCCCGCCCGAGTCGTGCAACGTCGACTTTGAGCGCGACTGCAAGGGGACCGGCTGTGTCATCAC
CGCCCTAGCCAACTACACCGAGCAGTCTCTCGACCCGTCGCTGCCGCCATGGCAACGTGCCCAGGCTGCCAAGTTTGTC
ATTCACTTTGTCGGCGACTTGCACCAGCCATTGCATAACGAAAATGTTGCGAGGGGCGGAAATGGTATCCACGTCAAGT

FIG. 2 continued

GGAATGGACGAGACTTTAACCTGCATCACGTCTGGGATAGCTCCATT

> SEQ ID NO: 6444 214339 214387_300857_1b
ACCCCATCATCTGCTTCACATATTCATTATGGGGGCATCTGTCGAGCACCAAAATGGCTCCCCCGATTCACTTCATCAC
CGGCAATGCGAATAAGCTGAGAGAAGTCAAAGCGATCCTCGAGCCGCAAATTGAGATTGACAGCCAGTCGCTGGATCTC
GAGGAAATCCAAGGAACGATTGAAGAGGTTGCCGAGTCAAAATGTCGTCGATCTGCCGACTTGGTAAACGGCCCGGTGC
TGGTTGAACACACGGCGCTCTGTTTTAATGCTCTCGGAGGCCTACCTGGGCCTTACATCAAATGGTTCCTGGATAAGAC
TGGGCACCAAGGTCTCAACAAACTTCTTGCGGCATACGAAGATCAATCTGCAGAAGCAGTTGGTACATTTGCATACTCA
CCACGACCTGGCCGCGACCCAATCATCTTCCAAGGACGGACGCCGGGTCCCATTGTACCTGCGCGAGGCCCTTCGAACT
TTGGCTGGGACC

> SEQ ID NO: 6445 214339 231396_301083_1b
CCCACGCGTCCGAATGGCGCTAGTGAGGGCGGAGGTGGTGCTCAAGAAGCCCGTCACCTTCGTCACGGGCAATGCCAAG
AAGCTCGAGGAGGTGAAGATGATCCTCGGCAATTCCATTCCTTTCTCGACGCTGCGAATAGATTGTAGATTTGTATTAA
ATAGTTTTGTATTCTTTTTATAATTTTTGTATAGTGCCGGAGCTTCAAGGTGAGCCCGAGGAGATCTCCAAGGAAAAAG
CTCGCATTGCTGCCAAGCAGATTGATGGAGCAGTGCTCGTCGAGGATACATGCTTGTGTTTCAATGCCCTGCATGGCCT
TCCAGGGCCTTATGTGTAAGCTTGGAACAAACTTCATTATAGAAAATGCTTGTGTCGTTGCAGGAAGTGGTTTCTTCAA
AAGCTTGGCCATGGAGGCCTCAACAACATGCTTGCAGCGTACAAAGATAAATCAGCCTATGCACTCTGCGTCTTCTCTC
TAGCTCTTGGACCTGACTCGGAACCGATAACGTTTGTTGGACGCACCGAGGGGAAGATCGTTCCAGCGAGA

> SEQ ID NO: 6446 214339 137180_300502_1b
CCCCCCCCGGCTGGGCTAATCAATCTCTTCCGCCGGTCCGCCGCATCACCGTTCCTCCCGGCGGAAGCAGCGGCCAACA
CCGGAGCGCAGCAAGCATGTCCGGGGCGGCGGCGCGGGCGCTGCCCAAGGCGGTGACCTTCGTGACGGGCAACGCCAAG
AAGCTGGAGGAAGTCCGCGCCATCCTCGGCTCCTCCATCCCCTTCCAGTCCCTCAAGCTCGACCTCCCTGAATTGCAAG
GTGAGCCGGAGGACATATCTAAAGAGAAAGCACGAATGGCTGCATCCCAGGTGAATGGGCCTGTCCTTGTTGAGGACAC
CTGCCTATGCTTCAATGCACTCAAAGGCTTACCAGGGCCCTACATAAAATGGTTCCTTGAGAAAACTGGGCATGAAGGT
TTGAACAATTTGTTGCTAGCCTATGAAGATAAATCTGCTTTTGCTATGTGCATCTTTTCTCTTGCTCTTGGACCAGGAG
AAGAACCAATGACATTCGTTGGGAAAACAGCAGGAAAGATTGTGCCTGCTAGAGGACCTGCTGATTTTGGATGGGACCC
AGTATTCCAACCAGATGGTTTTGATCAAACCTACGCTGAGATGCCCAAGTCA

> SEQ ID NO: 6447 214356 206692_300824_1b
AACTTCCCATATCCGCACAGACAAATCTCACACAATGTCTACCGCCGAGCTCGCATCTTCCTACGCGGCCCTGATCCTT
GCCGACGATGGCATTGAGATCACCGCCGACAAGCTCCAGACCCTGATCGCCGCCGCCAAGGTCGAGGTTGAGCCCATCT
GGACATCAATCTTCGCCAAGGCTCTTGAGGGCAAGGACATTAAGGACCTCCTGGTCAACGTCGGCTCCGGTGGTGGTGC
CGCCGCTGCCCCTGGCGCTGCCGCCGCTGCTGGCGGTGCCGTCGCTGACGCTCCTGCTGAGGAGGCAAAGGAGGAGGAG
AAGGAGGAGTCCGACGAGGACATGGGTTTCGGTCTCTTCGACTAAACGGCCAGCTCCACCTGTTGCGGCGACTGTTTTT
TCTCTTGCTTCTTTGTACTTCAACTGCATGGCACTTCGGGGTCTTTATACACATCGATGGATGCATACAGGATGGAGTG
GGCGCCTATATCCTGCGTCCTGGGCAGAGTAGCTTCGTTCATAAGGATAATATGATGAATGCTCTCACACGACGGAGTT
CACGCGGGGAGGGGACAAATAGTCAATTAAATGACTTGGGAAGAACAAAAAGAAATTTTTGACAAATGTTGAACTTTT
GAAAAAAAA

> SEQ ID NO: 6448 214370 217004_300904_1b
GGGGGGAGAAGAAAAGCCAGAAGATGCGAGGGGGCCGTGAGTTTGAGTGTGAGTATTGCGGCGTTGTCCAGGTACAACG
GGGGGACGAAATGCGAAAAGCGCACAAGACAAGGTAAAGGAAACGGCTAAAAGAACAGACAGGGCGTGAGGATAGGAA
AAGGAAACAAAAACGAAGAGATTCCCAGTATTAAATGAAACGAATATGCGCCGTAGAGTAGAGAGGCACCAGAGCAGAC
TTCGAGAGTCGCTGGCGAGCTTACAATGCGGTACCGAACTTCATCGCGACGTTCGATGGGGAAAGAAGAGCAGAATCGA
TGACGGCCATGGGGGTCGTGGCATAGCT

> SEQ ID NO: 6449 214407 1100515_301461_1b
TGAAGAGTGAAGAGAGACACGGCCCTGGTTCCCCCCTTCACAAGAGAGAGTGCCCTGGCCAAGGTTCAACGGGCCGAGG
ATCTATGGAACACCAGGGACCCCGAAAAGGTGGCCCAGGCCTACGCTCCCGATTCCATCTGGCGTAACCGCAACGAGTT
CTTCCAAGGCAGAGCGGCAATTGTTGAGTTCTTGAGGCGTAAATGGGACGAGGAGAAGGAGTACCGTCTGAAGAAACGT
CTCTTTTGCTTCGAGGCAAATAAGATTGCGGTGGAATTCGAATACGAGTTTGTTGATGGAAGCGGGGTGCAATGGTGGA
GAGCTTATGGCCTTGAACATTGGACCTTCGACGATAATGGCTTGATGACCAATCGTGACATGTCTGCTAATAATGTGCC
CATCAAGGAGGAGGATAGGTTGTTCAAGTGAGATTATTTTATCCTTGCAAGTGCAATACTCCCAGGCACTAGGACCACT
TTTTTTTATTTCATCTTTTTTTCTTTTCAAACTTTTGTTGTTGTTTTTGTAAAAAGGAAGCTTTCTTTTATTAAATAA
AGGATCAATGTTGCATAGGGCAAAA

FIG. 2 continued

> SEQ ID NO: 6450 214414 199588_300750_1b
CACCCTTAGAAAAAGACACAGACAGACACATCCACCATGTCCAAGGAATCCGGCGTNTCACTCCCACGGAGAAGGGCGA
CAATGTCGTCGACTACCAGGCCAGCACCGTGGTCAACACCAAGGAGGGCCTTGAGTGTCGACCCCAACTGGTTCACCCG
CAACGGTCTCAATGCCGACTCCTTCAAGAAGAAGCACTATGTTTAANGCATGGTGGAGCTCGAGCGTCCCATGAAAGCT
CGCCATCTGCACATGATTGCCATTGGTGGTTCCATTGGTGCTGGTTTCTTCGTCGGTTCGGGTGGTGCTCTCAGCAGAG
GTGGCCCTGGTTCTCTCTTCATTGATTTCCTCATCATCGGTATCATGATGTTCAACGTCGTGTATGCTCTCGGTGAACT
CGCCATCATGTATCCCGTCTCTGGTTCTTTCTACACATACTCTGCTCGTTTCATCGATCCTGCCTGGGGTTTCGCCATG
GGCTGGAACTATGTTCTTCAGTGGGCTGCCGTTCTTCCGCTTGAGTTGACCGTCTGTGGTATTACGATTTCGTATTGGA
ATGCCAACATCTCGACTGCCGTGTGGATCACCATCTTCCTCGTCGCCATCATCATCATCAACCTGTTTGGTGCTCTGGG
TTACGCCGAAGAGGAGTTTTGGGCATCTTGCTTCAAGC

> SEQ ID NO: 6451 214414 241183_301320_1b
ACCTCTCACCCTCTTCATCACTTCCACCACTCTTGTGTGAACGTGTGAACCCTCGCCAAAATGACTACCAAAGTCGAAC
ACGACCACCACGGTCACCACACTATGGACGAGAAGCACATCGATGGCTCTCCAGGTTATACACACGATAAGCCCGACCC
GGAGCACCCTGGCACTGCTCCAGTTGTCGCCTCTAATGAGCTGCACAAGAGCCTGAAGGGCAGACACATGCAGATGATT
GCTATTGGTGGTGCGATCGGTGCTGGTCTGTTCATCAACTCTGGAAGCGCTTTCCAGACCGGTGGTCCAGCCAGTGTTG
TCCTCGGTTTCCTCATTGTCGGTATAATGATCTACTTGATGATGCAAGCTCTTGCAGAGTTGGCTGTCATGTACCCAAT
TAACGGCGCATTCACCATGTACATTTGCCGCTTCGTTGATCCATCCTCTGGGGTTTCGCCTGTGGTTGGCAATACGCTCTC
TCCTGGTTGACTGTCCTGCCATTCGAGATTTCAGCCGCCTGCAACATTATCCACTTCTGGCCCGGTTCTGAAGGAATCA
ACAACTCTGCCTGGATTGTTCCCCTTCTTGTTGCGCTCGTTGGTATTCAGTACTTCGGCGTCAAGGGTTACGGAGAGGT
TGAGTTCGTTCTTTCTCTCATGAAGATTA

> SEQ ID NO: 6452 214415 126625_300465_1b
AAGAGCTCTCCCTTCACCTCAGGTTGTTAAAGCTTGATCTGAGTATTCAGAAACACTAGCCAAGATGCAGAACGAAGAG
GGACAAAACGTTGATCTTTACATCCCCAGGAAATGTTCTGCTACCAACAGGGTGATCACTTCAAAGGATCATGCTTCTG
TTCAACTTAATGTAGGCCATTTGGATGATAAGGGCTTGTATATTCCTGGCAGTTTCACTACTTTTGCTCTCTGCGGTTT
CATCCGTGCTCAGGGCGATGCTGACAGCGCACTGGATCGCCTCTGGCAGAAGAAGAAAGTCGAAGCGAGACAACAGTAG
AAAAATAGATTTGCTATTTGAGATTATCTTGTGATGGAGGATTTATGATAACTATTTCAATTTCATCTGAGTTTGACAC
TGTTTTTCCTCTACATATGGGATAGCTTTTCATCTTTGGATATTTCACTTGCCTTTCATGGTTTTGAGCA

> SEQ ID NO: 6453 214415 159013_200139_1b
TTCACCTCAGGTTGTTAAAGCTTGATCGGAGTATTCAGAAACGCTAGCCAAGATGCAGAATGAAGAGGGACAAAACGTT
GATCTTTACATCCCCAGGAAATGCTCTGCTACCAACAGGGTGATCACTTCAAAGGATCATGCCTCTGTTCAACTTAATG
TTGGCCATTTGGATGATAAGGGCTTGTATATACCTGGCAGTTTCACCACTTTTGCTCTCTGTGGTTTCATCCGTGCTCA
GGGTGATGCTGACAGCGCACTGGATCGCCTCTGGCAAAAGAAGAAAGTTGAAGCGAGGCAACAGTAGAAAAATAGATTT
GCAATTTGAGATTATTTTCTTATGATGGAGGATTTATGATAACTATTTGAATTTCATCTGAGTTTGACACTGTTTTCCC
TGCTACACATGGGATAGCTTTTCATCTTTGGATATTTCACTTGCCTTATGGTTTTGATCCC

> SEQ ID NO: 6454 214417 199983_300754_1b
GCCCACGCGTCGCCCACGCGTCCGCCCACGCGTCCGCCCACGCGTCCGCCCACGCGTCCGCCCACGCGTCCGAACTTAC
AAAGCCAAGAAACCATTGAAGCACATAACAAACGCGGGTTCGAAAACCGGCAACAAGTGGTCTATCGTCCAGCCACAAG
AATACCAGACCGTTGACGACGTGCCGTATCAGCGAGGCCGTCCTCTCCCAACAGTCACCCCCGTCTTCCAGAACAAGCT
GCCCAACTCGCCTGGCAAGACGTCCATCGGCCCTCCTCGTCGACTTCCCGCCCAACTCGTCGACGCCCCCCACACGCAC
GGCGGCGCGGCCATCTCCGTCTTCGTCATCAAGGGCACCGTGCTCAACAAGATGAACGATGGCCCGACTCGTGTGATCC
CGGCGGGCGGCACGTGGTTCGAGGCCCCCGGCTGCCACCACCGGACCAGCGACAACTTCAGCACCACGGAGCCGGCGCA
GATTCTGGCGACGATGGTGGTTGACACAAAGACTGTTGAAGAGGAGGGATGGCGGCTCTTGTTGTGCTCGACCCGGAG
TATGCTGATATCAGACTTGGTTAAATTGATATGGATGCTGCAGTGAAGAGAACCGGAAGCTCGGAAAGGGTGTGGGTGT
TGTCAATATCAGAAGTGGCCAGCGGAGGCTCGGATTGCTGTTAGTAAACGGGGCATCTCAGCAGGAAGGCAAAATGAAT
ATGTAAAGCAATCAATGGCAACGAATCGTTT

> SEQ ID NO: 6455 214437 175882_300522_1b
CCCCCCCCCACCGTGGTCTCCGTCACTACTGGGGTCTCCGTGTCCGCGGTCAGCACACCAAGACTACTGGCAGGAGGGG
AAAGACTGTCGGTGTCTCCAAGAAGAGATAAATTCCATGCCCATCGGCTCAGCAAATTCATTTTGCTTGTCTTATGAGC
GTTTCAATGATGTCAGTCTTGATAGGCAGTTTTGTTGGATGATGCTTTTGTCTAAGAAGATAGATCGTGCGTTGCAGGA
ATCTCAAAACTTTTATATATTGTAACTTGGTTGTTTGGTACCGCAAATTCTGAAGCCTAATTTTTTTACTGGATGTGTT
TCTGGT

FIG. 2 continued

> SEQ ID NO: 6456 214437 245406_301568_1b
ACGCGTCGGTTTGTAGGCGGCTCGGCGGCGAAGATGTCTCTGGTGAGCAATGAGGAGTTTCAGCACATTCTTCGTGTGC
TCAACACCAACGTGGATGGGCGGCAGAAGATCATGTTTGCGCTCACCTCCATCAAGGGTATCGGCCGCCGCTTCGCCAA
CATTGTCTGCAAGAAGGCCGATGTGGACATGAACAAGAGGGCTGGTGAGCTGACCGCTACCGAGCTCGAGAACCTGATG
CTGATCGTTGCCAACCCGCGGCAGTTCAAGATCCCCGAGTGGTTCCTCAACAGGAAGAAGGACTACAAGGACGGGAGGT
ACTCCCAGGTTGTGGCCAACGCTCTCGACATGAAGCTCAGGGACGACCTGGAGAGGCTCAAGAAGATCAGAAACCACCG
TGGTCTTCGTCACTACTGGGGTCTCCGCGTCCGCGGGCAGCACACCAAGACCACTGGACGCCGTGGAAGAACTGTGGGA
GTGTCCAAGAAGCGATAGATAGCCGCAGCTTTTGTTTGGTCTCTTAATTTCCAATATGTTTTAAGTGCAAATTTTAAAA
TTCATTAAGAAAATTAATTT

> SEQ ID NO: 6457 214437 1100335_301459_1b
GGGAGAGGGAGAGGGAGAGGGAGAGAGAGAAGTCGAAAACCGGCTAATCTTCTCCTCTAATCATGTCGCTGATCGCCAA
CGAGGATTTCCAGCACATTCTTCGTGTTCTCAACACGAACGTAGATGGGAGGCAGAAGATCATGTTCGCCCTCACGGCG
ATCAAGGGTATCGGCCGACGTTTCGCCAATCTCGTCTGCAAGAAGGCAGACGTCGACGTCAACAAAAGAGCTGGAGAAC
TCTCTGCTGCAGAGTTGGAAAGCCTTATGGTGATTGTTGCAAATCCTAGACAGTTCAAGATCCCCGACTGGTTCCTGAA
CAGAAAGAAGGACTACAAAGATGGACGCTTCTCTCAAGTTGTGTCCAATGCTTTGGATATGAAGCTCAGGGATGACCTT
GAGAGGCTCAAAAAGATCAGGAATCACCGAGGTCTTCGCCACTACTGGGGCCTTCGTGTTCGAGGGCAGCACACAAAGA
CCACTGGCCGCCGAGGAAGGACTGTTGGTGTCTCTAAAAAGCGTTAGGGGGGTAATTCTAGTTTCTTGTTGTGGCTGGC
ATTTTGAAATGTCTCAATTTTATTTAGTTTTGGAGATGCGGCATGTAACCCATGTCCAG

> SEQ ID NO: 6458 214437 1109442_301531_1b
GTTCTTTCTTCTTGGAGGGTGTGTCGTAGTTTAGCTATTGGGGAGGGGTAGGGATAGGATAGAGGCAGAAAGAGAACAG
GAAGAAGAAAGAAGCCGGCGAAGGGTAAGAAGGGGTTTTCCTCAGCTCTCAACCATGTCTCTGATCGCCAATGAGGATT
TCCAGCATATCCTGCGTGTCCTGAACACGAACGTGGATGGGCGGCAGAAGATCATGTTCGCCCTCACGGCCATTAAGGG
TATCGGGCGTCGCTTCGCCAACCTCGTTTGCAAGAAGGCCGACGTCGATGTCAACAAGAGAGCTGGGGAGCTTTCGGCG
GCTGAACTTGAAAGCTTGATGGTGATTGTTGCCAACCCAAGGCAATTCAAAATCCCTGATTGGTTCTTGAATAGAAAGA
AGGACTACAAAGATGGTCGTTTCTCCCAAGTTGTATCCAATGCCTTGGACATGAAGCTCAGGGATGATCTGGAGCGGCT
TAAGAAGATCAGGAACCACCGAGGTCTTCGTCACTACTGGGGCCTTCGTGTGAGGGACAGCACACAAAGACCACTGGC
CGCAGAGGAAGGACAGTTGGTGTCTCCAAGAAGCGATAGTCACCTATATTCTTCTTGCTGGCGGATTTTTTTTATACAT
GTTTTGTCAATCTTGATATCAGAAATCGATGCAGACGGACAGNCCCCCCTTCTTTGACCGTATCGCATTGGCAGGATCC
TTTAGTTTCTAATGAACACAACGGAAGT

> SEQ ID NO: 6459 214437 130954_300509_1b
GAATTCAAGAAAGAGTTCCACTCGAGATCCCTTCAGCAAAATGTCTTTGGTTGCTAACGAAGATTTTCAACACATTCTT
CGTGTGTTGAACACTAACGTTGATGGAAAGCAAAAGATTATGTTTGCTATGACCTCTATCAAGGGTATTGGTAGGAGAT
TCGCCAATATTGTCTGCAAGAAAGCTGATGTTGACATGAACAAGAGGGCTGGTGAACTATCTGCAGCGGAGTTGGAGAA
TTTGATGACAATTGTTGCTAACCCACGTCAATTCAAAATTCCAGACTGGTTTTTGAACAGAAAGAAGGATTACAAGGAT
GGAAGATACTCACAAGTTGTATCAAATGCTCTTGACATGAAACTCAGAGATGATTTGGAGCGTTTGAAGAAGATCAGGA
ACCATCGTGGTTTGAGGCATTACTGGGGTCTCAGAGTCCGTGGACAGCACACCAAGACTACTGGTCGCAGAGGTAAGAC
TGTTGGTGTCTCCAAGAAGCGTTGAAGACTGGTTGTTATTCTTTGATCAAAGAAGTTCTTGTGGTGAGGAGTTTGTCA
TTCTGCTTTATAGTTGGAACCTAGAAGGACTTAAATTATGATACTAGTATAGTTTAGGATTTTGAATATCTCGGAATTT
TAATGTCCTCCA

> SEQ ID NO: 6460 214437 4893_300396_1b
GATCTTTCTCGGCATCCAAAAATGTCTCTAGTTGCGAACGAGGAGTTTCAGCATATTCTGCGTGTGCTCAATACTAATG
TCGATGGGAAGCAAAAAATTATGTTTGCTTTGACCTCAATCAAGGGTATTGGAAGGCGATTGGCTAACATTGTGTGCAA
GAAGGCTGATGTTGACATGAACAAGAGGGCTGGAGAACTAAGTGCTGCTGAGATTGATAACCTCATGACAATCGTTGCT.
AACCCTCGCCAGTTCAAGATCCCAGACTGGTTTCTTAACAGACAAAAGGATTACAAGGATGGGAAATACTCCCAAGTTG
TTTCCAATGCTCTTGACATGAAGTTGAGAGATGATCTTGAGCGTCTCAAGAAGATCAGAAACCATCGTGGTCTGAGGCA
CTACTGGGGTCTCCGTGTACGTGGACAGCACACCAAAACCACCGGACGCCGTGGAAAGACTGTTGGTGTTTCCAAGAAG
CGTTAAAAAGAGTTTGAGCTTGGTTCAATGGCTTTGTTTGTTTTTTTGTATTGTTGTTTTTGCGGCCGCAATTCTC
GAGC

> SEQ ID NO: 6461 214437 49984_300189_1b
AAACCTCATCTCTGCTAATCAAAATGTCTCTGGTTGCAAATGAGGAGTTTCAACACATTCTTCGTGTGTTGAATACTAA
TGTTGATGGTAAGCAGAAGATTATGTTTGCCCTTACCTCTATCAAAGGTATTGGTAGGCGATTGGCTAACATTGTCTGC
AAGAAGGCTGATGTCGACATGAACAAAGGGCTGGTGAGTTATCTGCTGCTGAGATTGATAACCTCATGACAATCGTTG
CAAACCCACGTCAGTTCAAGAT

FIG. 2 continued

> SEQ ID NO: 6462 214441 218691_300920_1b
GTCGCAATCGATCAAACAAACACCAGCACAAACCGGCAAAGAAATACCCTGCAGTCCTCGAGACTCGCGATAGAGCAGA
AGTACATCAGTCTTATTTACTAGCGAGCAAGACAGTCAAAATGTCGTGGGCGGGATTCAAGAAGAATGTGAACCGCGCG
ACGACGCAGGTGATGATGAAGACGGGGCATGTGGAAAAGACAAACGATCGCGATTACGAGGTCGAAGAGAGACGGTTCA
AGACGATGGAAACAGCTGCACTGCGGCTGCAGAAAGAATCAAAGGGCTACCTTGACTCTTTGAGAGCCATGACAGCTTC
ACAGATGCGAATCGCCGAGACGATAGATGCGTTTTACGGCGACTCCGGTGCGAAGGATGGCGTGAGCAGGAGCTACAAG
CAGGCCGTCGAAGATCTCGACGCCGAAACCATCAAGGCCCTCGACGGGCCTTACCGAATGACGGTGCTCGACCCCATTG
GCCGGTTCTGCGCCTACTTCCCCGACGTCAACGAATGCATCAAGAAGCGCTCGCACAAGCTTCTCGACTACGATGCTCT
CCGAGCTAAAGTGAAGAAG

> SEQ ID NO: 6463 214452 187931_300682_1b
CCCACGCGTCCGCCCACGCGTCCGCCCACGCGTCCGTTCTCCTCCAGGTTGCAGCAAAAGCACAGGAAGCAGCGAGATG
GAAGGCAAGAGCCGGCGACCGGAGATAACCGTCGTGCCGGCGGCAGGCGGCGGCGCCGCCGCCGCCGTTGATGCGGTGA
AGGCGGCGAACAAGGAGCCCATCAGCCCGGGCTCGCCGTCCCTGGCGAGCGGCGCCGGCAAGGAGAGCCTGAGCCGCCA
TGAGGCCGCCGTCGTGTCCCTGCCCGCGTGGAAGCTCGACGCGCTCTGCCAGGAGTCCGGCTCGTCGCCGGCGGTGATG
AGGGCGCGCTTCCCCTACTTCTGAATTTCTGAATTTCTGATGAAGCCATGAGCTTTTTGCCATCTTCGTACGTGTGTGT
GTGTGTGTGTGTGATTGTAACTGTGTTGTTCATGGCTGAGTAAAGAATTATACTTCCTACAAGCGGCTGTGATGTAT
ATGTGAGCTGCTTTAGCTGACGCGTTCATCTTTGGACGCTGTAAAAACTAAAAACTGCCAGTTTTTCATGTAGCATCAT
TGCAAAAACATAGCCATCTGTTTGCGTTG

> SEQ ID NO: 6464 214466 179867_300564_1b
ACGGGTTGTACGCCGAGTAGTAGATAACAATTTCTGTATTGGGGATCTAGGCCTATCTGTTTTCTTATACCTATTTT
TCTTTTCCTCCTCCCTGGCTTAGTTTTTGCACCTCGGGATTTGTATACATACACGGCCGGATTTAATTCTTTCCCCACC
ACCACCACCACAACAACAACAACAACAAACATCGCCGTCACAATGCGCTTCTCCGCAGCTGCTCTCGTCGCGGCCCTGC
CCGCTCTCTCTGCCGCGCAAGAGAATCCTCTGGACCAATACATTGCTCAGGCCCAGCAGATCTTGGGCCAGGTCAGCTC
TTACATCCCGACTCCCAACAAGTATGATGCCGCTGCCGCCGAAGCGTCCAAGACGGGCCCCATGAAGCTCTCCGTCTTG
GCCCAGCACAACTGGGAGGACACTCTCTATGCGCCTGTGGCCGCCGGCGCAAAGACGCCCGAGGAGTGGTGGATCTTGA
TCACTGGTGGAAACAAGACGTGCTTTGGCCGATGTGACCGGCTTGAAAGCGCTTTTTACGGTGCTGCTGCCCAGTTTGC
GGAGCTCCCAAC

> SEQ ID NO: 6465 214478 208832_300809_1b
ATCCCCGGATTCAACACTCAATGCCGCCTCCATGAACGACTCGAGCTTCGTCCAAGCCCAACAGCGCGTCGCTGAGCGA
CGAGCGGCCCGCGAGGTCGAACAACGGGCCCGAATCGCGGCTCAGCGCGAATCGTCTCGCGTGAACAACCAGCTGCAGC
GTCTGCCATACCCCCTCAATCGCCTCGCCGGTGTCTGGGATGCAGCCGCCTCTATAGAAAACACCCGGCCTGCGTTTCG
CGTTGCGCAGGTTGATGCCGAGCTGCTGGATGAAGAGCTGCTGGAGCTCCTCAAGGGGCAGGTTGGCGACGCCCTCAGA
TACTATGCCGGCGGGCATCTCAAAGACGACTGGTCTTCCGAGATTCAGCTGGCGCTCAGGGCCATCCTGTTCAAACTGA
CCGTCTGGGATAACGATGCAACGTACGGAGCGGCTCTACAAAACCTCAAATACACCGACGCCAGAAAAGGGGGCCCCGT
GCTGTCACCCCGACGAGGCTACAAAAGTCACTATACGGGCTGGTAAC

> SEQ ID NO: 6466 214527 220492_300955_1b
TCTATCCTTTACAGTTCAAAATGGCCAGTTCAATTCTTCGAGGGAGGGCGCTGGGAGCCGTGCGCCAGGCCCGTTGCTT
CAGCTCTACTCCAAGGCAATATGCCGCTGATGTCAAGAGCGTCGGTGTTCTCGGCGCCGGCCAGATGGGTCTGGGTATC
GCTCTTGTTGCTGCGCAAAAGGCGCAAGTTCCGGTTACTCTCGTCGATGCTTCTGAGCAGGCATTGAGTAAAGGCATTG
CTTTTGCCGAGAAGCTGCTGGCCAAGGACGTGTCCAAGTCTAGAATTACTCAGGAACAGGCTGATCAAGCCCGCTCCCT
GCTGAAGACTAGTACCAAGATTGAGGACTTCTCTTCTGTCGACTTCATTATCGAAGCTGTGCCTGAGATCCCTCAGCTC
AAGTTTGACATCTTCAGCAAGCTGGCCAAGGTAGCTCCCGCTCACGCAATCTTGGCGACCAATACCTCTTCAATCTCCA
TCACGCGCATTGCTGCCGCCACTACCAACGATCCTAATGACACCTCGGCTTCATCGAGAGTTGTTTCTACTCACTTCAT
GAACCCGGTCCCTGTTCAGAAGGGTGTAGAGATCATTAGCGGCTTGCAAACCAGCAAGGAGACGCTTGATACGGCAGTT
GAGTTCTGCAAGCGGATGGGCAAGGTCACTTCCGTTTCGGCTGACTCTCCTGGATTCCTCGCCAATCGAATTCTTATGC
CTTACATCAACGAAGCCATCATCTGCCTTGAGACGGCAGTGGGCGACAGAGACTCAATCGATGCCATTATGAAGAACGG
AACCAATGTCCCCATGGGTCCTCTGCAGCTTGCGGACTTCATCGGCCTTGATACTTGCTTGTCCATCAT

> SEQ ID NO: 6467 214547 218073_300914_1b
GGGTTTTTTTCGGGAAGTTTCAGCATTAGCATTACACCAGTAACCCTCCAGGGCAGCTAGCGAAGAGAGCAGGCCCAG
TTCCGGGTGACAGGTCGGGCAACGCCGCGACGGCTGCGATTCCGAGCGAACGGCGCTGGCGTTCCAGACGGCACAGCAG
CAAGCACAGCAACAGCACAGCACAGCTACGAACATCGAGGATCCCGCTCCAGGAACCGGTGCTATCCAGAACAAGGCCC
CGGCGCTAGGACCCGCGGTTGGCAGTGGTGGATCGCAAGGCTCCAGTCATGCCATGCAAGCGAGGGAAAAACGCTTGCA

FIG. 2 continued

TGCTCATGCTTTGCTCTGGCTCTAGATGAGTCTGAATCTCATCCATCCTCGACCTGCTGCTGTGTCTCCCCGTCCCGCA
CGAGGCTTCGGTCGGCGAGAGCCGGGATCGAGGCGTTGGGGGATGGCGTCTGTGAGCCAGACATGACCTGTCACAGCGC
TGCGTCGATGATGAAAATGGCCTGATTTCTTGCTCGCGGAGCTATGCCGGGACCCTGCAACCGCGAAATGGGCTGCCAC
CGGCCACAGAGAAAA

> SEQ ID NO: 6468 214613 174890_300527_1b
CTCTCCGCGACGGTCTGGGCTTCCCCACCCCTCGCCTCCTCGCGCGCTCGGTGAGAGAAGCGAAGAAGAAGAAGAAGAG
GAGGAGGAAGAAGCCAGGCTAAGCCCCGCGGCATGGCGGACCAGCTCACCGACGACCAGATCGCCGAGTTCAAGGAGGC
CTTCAGCCTCTTCGACAAGGACGGCGATGGTTGCATCACAACCAAGGAGTTGGGAACTGTCATGCGTTCACTAGGGCAG
AACCCAACGGAAGCTGAGCTCCAGGACATGATCAACGAGGTTGATGCTGATGGCAATGGAACCATTGATTTTCCTGAGT
TTCTCAATCTGATGGCTCGCAAGATGAAGGACACTGATTCAGAGGAAGAACTCAAGGAGGCCTTCCGGGTTTTGACAAG
GACCAAAATGGCTTCATCTCCGCTGCTGAGCTCCGCCATGTGATGACAAATCTTGGCGAGAAGCTAACTGACGAGGAGG
TGGATGAGATGATCCGTGAGGCTGATGTTGATGGTGATGGTCAGATAAACTATGAGGAGTTTGTGAAGGTCATGATGGC
CAAGTGAGCCATGGAACCATACTCTAAAGCAGAGGAGATTGTGTGTTGCATAGTCCTAGCTAAGATGCAACACTTGTTT
TATCAATTTCCAGTGAAGCATCCTACTAGCTGTAGTCGCTAAAAAGGATTTTCCTGCTATGTTCCTCTG

> SEQ ID NO: 6469 214613 176172_300519_1b
CGCCACTCGTTCCCCTTCCTTCCTCTCCTCCTCTCGCGGAACCTTCTCGAAGCTTCCACACCCCCAACCTCGCCTCCAC
CACCAACCCCCCATGGCGGACCAGCTCACCGACGAGCAGATCGCCGAGTTCAAGGAGGCGTTCAGCCTCTTCGACAAGG
ACGGCGACGGTTGCATCACTACTAAGGAGCTTGGAACCGTGATGCGGTCCCTTGGTCAGAACCCAACTGAGGCGGAGCT
GCAGGACATGATCAACGAGGTTGATGCTGATGGCAATGGGACCATTGACTTCCCAGAGTTCCTGAACCTGATGGCGAAG
AAGATGAAGGATACCGACTCTGAGGAGGAGCTCAAGGAGGCCTTCCGTGTGTTTGACAAGGACCAGAACGGTTTCATCT
CGGCTGCTGAGCTCCGCCACGTCATGACCAACCTTGGTGAGAAGCTGACCGACGAGGAAGTCGACGAGATGATCCGTGA
GGCTGACGTCGATGGCGATGGCCAGATCAACTACGAGGAGTTCGTTAAGGTCATGATGGCCAAGTGAGGAGGGTTCCCA
TTAAATAAGTTCTGTCTGAAGTGAACTAAAACTGTCAGGGCCTACAACAAAGCTGTACTTTGTGATG

> SEQ ID NO: 6470 214613 201036_300712_1b
GTCTCTCCTCCTCCCATCTCCGCTTCCCTTCTTCTTCTTCGTTGATCCACTCACCCGCCGCGCGCAGAGGAGGCCA
TGGCGGATCAGCTCACCGACGACCAGATCGCCGAGTTCAAGGAGGCCTTCAGCCTCTTCGACAAGGACGGCGATGGTTG
CATCACAACCAAGGAGTTGGGAACTGTCATGCGTTCACTAGGGCAGAACCCAACGGAAGCTGAGCTCCAGGACATGATC
AACGAGGTTGATGCTGATGGCAATGGAACCATTGATTTTCCTGAGTTTCTCAATCTGATGGCTCGCAAGATGAAGGACA
CTGATTCAGAGGAAGAACTCAAGGAGGCCTTCCGGGTGTTTGACAAGGACCAAAATGGCTTCATCTCCGCTGCTGAGCT
CCGCCATGTGATGACAAATCTTGGCGAGAAGCTAACTGACGAGGAGGTGGATGAGATGATCCGTGAGGCTGATGTTGAT
GGTGATGGTCAGATAAACTATGAGGAGTTTGTGAAGGTCATGATGGCCAAGTGAGCCATGGAACCATACTCTAAGGCAG
AGGAGATTGTGTGTTGCATAGTCCTAGTTAAGATGCAACACTTGTTTTATCAATTTCCAGTGAAGCATCCTACTAGCT

> SEQ ID NO: 6471 214613 259107_301666_1b
TGATGTTTAAATCTACTGTATTTACCTTCGCATTAATTAAGCATGGCGGACCAGCTCACCGACGACCAGATCGCCGAGT
TCAAGGAGGCCTTCAGCCTCTTCGACAAGGACGGCGATGGTTGCATCACAACCAAGGAGCTGGGAACCGTGATGCGTTC
GCTGGGGCAGAACCCAACGGAGGCCGAGCTCCAGGACATGATCAACGAGGTCGACGCGGACGGCAACGGCACCATCGAC
TTCCCGGAGTTCCTCAACCTGATGGCACGCAAGATGAAGGACACCGACTCGGAGGAGGAGCTCAAGGAGGCGTTCAGGG
TGTTCGACAAAGACCAGAACGGCTTCATCTCCGCCGCCGAGCTCCGCCACGTCATGACCAACCTCGGCGAGAAGCTGAC
CGACGAGGAGGTCGACGAGATGATCCGCGAAGCCGACGTCGACGGTGACGGCCAGATCAACTACGAGGAGTTCGTCAAG
GTCATGATGGCCAAGGCGGCCGCTTATCCGTATGATGTTCCGGATTATGCCGAGCTCTACAAACAGCTGTTGAATTTTG
ATTTGCTGAAGTTGGCGGGTGACGTGGAATCTAACCCTGGTCCTAGGTCTAGAATGGCTACTTTCTCTTGTGTGTGTTG
TGGTACCTTAACTAC

> SEQ ID NO: 6472 214613 225436_301049_1b
GCTCCATCGATCCATCCACCGATCGATCGAGCTCTACATCCTGCGCAAGAACACACGATGGTAGAGGAGCTCACCGAGG
AGCAGATTGCAGAGTTTAAGGAGGCATTCAGCCTCTTCGACAAGGACGGCGATGGCTGCATTACCACCAAAGAGCTCGG
AACGGTGATGCGATCGCTGGGACAGAACCCGACGGAGGCAGAGCTCCAAGACATGATCAATGAGATCGATGCCGACGGC
AGCGGCACGGTCGATTTCCCAGAGTTCTTAAACCTCATGGCCAGGAAGATGAAAGACACCGACTCCGAGGAAGAGCTCA
AGGAGGCGTTCCGAGTCTTCGACAAGGAACAGAACGGCTTCATCTCCGCGGCGGAGCTGCGGCACGTCATGACCAACCT
CGGCGAGAAGCTCACCGACGACGAGGTTGACGAGATGATCCGCGAGGCAAACGTCGACGGCGATGGACAGATCAACTAC
GAAGACTTTGTAAAGATGATGATGTCCAAGTGATCCAGGGAAGTCGCCATTGATTGCTCTGCTCGCTCTATAGATCAAG
GGAATGCGACCACGATGTATTGCTCTGTCTCTATTGTGCAATTCCTTGCCACCTCTGTCTTGTATGGAATA

FIG. 2 continued

> SEQ ID NO: 6473 214613 109275_300044_1b
CCCGGAAATGAATTGAAAAGACGATTATTTTGTCTGAAATTCCAGAACAATCTTCTCTCTTAAGTTTTCTCTGTTGTTG
AATTGAAGAAGAAAATGGCAGATCAGTTAACCGATGACCAGGTCTCTGAGTTCAAGGAGGCCTTCAGCCTATTCGATAA
GGACGGAGATGGTTGCATCACGACTAAGGAGCTTGGGACTGTGATGAGGTCGCTCGGACAGAACCCCACCGAAGCAGAG
CTCCAAGACATGATAAACGAGGTGGATGCAGATGGTAACGGAACCATTGACTTCCCTGAGTTTCTAAACCTCATGGCCC
GGAAAATGAAGGATACTGACTCCGAGGAGGAACTGAAGGAGGCGTTCAGAGTGTTCGACAAGGATCAAAATGGCTTCAT
CTCCGCTGCTGAGCTTCGTCATGTGATGACTAACCTTGGGGAGAAGCTTACTGATGAAGAAGTTGATGAGATGATTAGG
GAAGCAGATGTCGATGGTGATGGTCAAATTAACTATGAGGAGTTTGTTAAGGTCATGATGGCTAAGTAATTTCACCATC
TCTTATTGAAGTTGAAGTTTAGACTTGTTAAAAATGTGAAAATTCCAAAAATATTTCATTGGATAGGATTTGCCTAGTG
TAATGTGTTCCGTTGTACCATCTTGGATGTATTGGACCTGGAATGAATGTAATGCTTTATTGT

> SEQ ID NO: 6474 214613 142414_300435_1b
AGCCATTCTCTCCGCGACGGTCTCGTCTTCCCCACCCCTCGCCTCCTCGCGCGCTCGGTGAGAGAAGCGAAGAAGAAGA
AGAAGAGGAGGAGGAAGAAGCCAGGCTAAGCCCAGCGGCATGGCGGACCAGCTCACCGACGACCAGATCGCCGAGTTCA
AGGAGGCCTTCAGCCTCTTCGACAAGGACGGCGATGGTTGCATCACAACCAAGGAGCTGGGAACCGTGATGCGTTCGCT
GGGGCAGAACCCAACGGAGGCCGAGCTCCAGGACATGATCAACGAGGTCGACGCGGACGGCAACGGCACCATCGACTTC
CCGGAGTTCCTCAACCTGATGGCACGCAAGATGAAGGACACCGACTCGGAGGAGGAGCTCAAGGAGGCGTTCAGGGTGT
TCGACAAAGACCAGAACGGCTTCATCTCCGCCGCCGAGCTCCGCCACGTCATGACCAACCTCGGCGAGAAGCTGACCGA
CGAGGAGGTCGACGAGATGATCCGCGAAGCCGACGTCGACGGTGACGGCCAGATCAACTACGAGGAGTTCGTCAAGGTC
ATGATGGCCAAGTGAGGCACCACTTCCCCTGCCGATGATGGCATAGTACCCTGGGAGGAGGAAACCGTGCATTGCCGTA
TTAGTAAGGGGATGCAAACACTGGTTTCAGTCGTCTTCCCTGATGAAGAAAACCGAACCGTACTAGTTGTAGTTGCTGA
ACATTTTTCTATCTCTCCAGTCTCTCCGGTGTGCCATGGAACTTCTTGCTTGATTTTTCTGTGTGAATCTGTT

> SEQ ID NO: 6475 214613 130580_300488_1b
GAATTCACAACAGAGACTCGGCCATCATAATTCCGCGTTCTCTAAAATTTACCTTTTAGAGATCCCATCTTCCTCTTGT
TCTTCGTTGATATTATATCACACAGGGAAGAAACAAAATCATGGCTGATCAATTAACTGACGACCAGATCTCTGAGTTC
AAGGAAGCTTTCAGCTTATTCGACAAGGATGGAGATGGTTGCATCACAACCAAGGAACTGGGAACTGTCATGCGTTCAC
TAGGTCAGAACCCAACAGAAGCAGAGCTCCAGGACATGATAAACGAGGTTGACGCTGATGGAAATGGAACAATTGATTT
TCCAGAGTTCCTCAACCTTATGGCACGTAAAATGAAGGATACTGACTCAGAGGAGGAACTAAAAGAGGCTTTTAGGGTA
TTCGACAAGGACCAGAATGGTTTCATTTCTGCAGCTGAGTTGCGCCATGTCATGACCAACCTAGGGGAGAAGCTTACAG
ACGAGGAAGTTGATGAGATGATTCGTGAAGCTGATGTAGATGGTGATGGTCAAATCAACTATGAGGAATTTGTCAAAGT
CATGATGGCCAAGTAAGGAGACTCATCCCCTTACCACTAAAAAGGGAAAAGAGAAACA

> SEQ ID NO: 6476 214613 1100495_301460_1b
GTTCCACGTGCTTTTCTGCTCTCTTTTGGTTTCACGACTGCCCAACTCAACCTGCCCAGCGCTCTCTCTCTCTCTCTCT
CTCTCTTCCTGGTTTGGGTTTCTATGGCCGCAGTGATGGTCGAGCAGCCCTGACAGAGGAGCAAATAGCCGAATTTAA
GGAGGCCTTTAGTCTTTTTGATAGAGATGGAGATGGGTGCATCACAACAAAGGAGTTGGGCACGGTGATGAGGTCGTTA
GGGCAGAACCCCACTGAGGCCGAGATCCAAGACATGATCAATGAAGTGGATGCAGACGGCAATGGGATCATCGACTTCA
TGGAGTTTGTGGGCCTCATGTCTAGGAAGATGAAGGATACTGACTCAGAAGAGGAGCTCAAAGAGGCCTTCAAGGTCTT
TGACAAGGATCAAAATGGCTTCATCTCAGCCCTTGAGCTCCGCCACGTCATGACCAACCTCGGTGAGAAGCTCAGTAAC
GAAGAGGTTGACGAGATGATCCGAGAAGCCGATGTGGACGGGGATGGCCAGATTAACTATGAAGAATTTGTCTTAATTA
TGATGAGTAGTAAGTAAGTAGGACCCCCATATAGAAGCCTCTTAAACCCTTCTCTAAGTCTTGTGTGTACTCATGAAAG
GAAACATCCCCAGACTGAGCCCTTTGGTGTACTAAAGCATCACCAAAGC

> SEQ ID NO: 6477 214633 55801_300130_1b
CTCTTGAACGTGTTCCCGCCGATATTCGAGCTCAAGGCGGTGTTGCTCGAATGAGCGATCCAGAGATGATCAAAGAAAT
CAAAAACGCCGTGACGATTCCGGTGATGGCGAAAGCTAGAATTGGTCATTTCGTTGAAGCTCAGATCCTGGAAGCAATC
GGAGTTGATTACGTCGACGAGAGTGAAGTTCTCACTCTCGCCGACGAAGATAATCACATCAACAAACATAATTTCAAAA
TCCCTTTTGTTTGTCGATGTAGGAATCTCGGTGAAGC

> SEQ ID NO: 6478 214665 223841_300976_1b
GATCTGCTATTGTGTCCAAGCCCTGGGCCCCATTGCTGCCACCTCTGTAGTTGCCGCCGCCGCCTCTTCCTACTACTT
CTCCAACATGGCCATCTCCAACGACGCTAAGACCGCCACCCTCAAGGGCGACGACCAGTGGGTTGATCTCAAGCTCAAG
TCCTCCAAGGACCTGTCCCACAACACCAAGGCCCTCATCTTCGAGCTCCCTACCCCCGACTCCACCCTCGGTCTTACCA
CCGCTTCCGCTCTCCTCACCAAGTACGTGACCCCTAAGGGCTCCAACGTTGTCCGACCTTACACCCCTGTTTCCGACCC
TGACTCCAAGGGCGAGTTTGAGCTCGTCGTCAAGTCCTACCCCGAGGGTAAGATGTCCAAGCACATCCACGAGCTCAAG
GAGGGTGACACTCTGTCCTTCAAGGGTCCCATCATCAAGTATCAGTGGCAGCCCAACCTCCACAAGGAGATCACCCTGA

FIG. 2 continued

TTGGTGCCGGAACCGGCATCACCCCTCTGTACCAGCTCATCTCTGCCATCAACAAGAACCCCGAGGATAAGACCAAGGT
GAACCTCTTTTACGGTAACGCCACTGAGGGTGACATTCTCCTCAAGGACGAGATTGACGCCATCGCCAAGGCCAAGCCC
CAGCAGTTCAACGTCCACTACTTCCTCGACAAGCCTTCCGACAACTGGAAGGGTGAGAACGGATTTATCTCCG

> SEQ ID NO: 6479 214672 1114826_301805_1b
GCGGGATTAGGAGTTGGAGAAGAGGTGATACGAGATGTCGTACGATGACGTGGAGATAGAGGACATGGAGTGGAACGCG
GAGCTCGAAGCGTACACCTATCCATGCCCTTGCGGAGACCTCTTCCAAATCTCTCTGCCTGACCTTCGCTTGGGAGAGG
AGATAGCCAGATGCCCTAGCTGCTCCCTCTACATCACCGTCGTCTACAACCTCGAAGACTTCCAAGACCCTCGGCCCCC
GCCTCGCCCCCAACAGCCGATCGCCGTCGCCTGATCTTTCCAGTTGCTTCGTTCAGTAAACTCGACATCTACATTCTAT
CCTAAATTGATAGTCACCAAATGTCTGGTGCACTTGAGACTGTTTATCTGACAAGATTTCATGTATCTTGGAGTTTTGC
TTAAATCAGCATGTAGAATGATAACTGTTGGCTTCTTGATGTTTCAAAGGTTAGATATTGTCATATCTCGTGTGAGTTT
TTTAAATTTTTGGTCATGCTAGATACCATGATAATATATTATGCAAGGACTATATG

> SEQ ID NO: 6480 214687 210579_300890_1b
ATCGCACTGAGACTCCCCCATCGCTGACGCAAGATGGCTTCTCAGGCGGCAGCAAAGGCTGCTGGAGGCGTTGTTTCCA
TTGCAAAGAAACAAACCCTCCAGTCCACCGGCTTGTGGGAGACCTTCCGCAAGGCCTTCGCCCTCGACCCCAATCGCTC
CAACGGCGTCCCCCTGAACCCTTACTTCCGAAACCCGACGCCCGGAGCCTTGGACCCCCTCAGCTTCGACGACCCCGTC
ACTCTTCCCGCTGGCGACATTGCCGACAACGCCTACTGGAAGCGTGATGTCCGTCGCGCGTACCCGCAGCTCAGCGTCG
TTACGCAGGGCGACGCCGTGTCGTTGTTGACGGTTGGAAGCGCCGCACAGCCCAAGGTCGAGCTGATTGGCGAGGCCGG
CGAGAAGGCTCTCGTTGCGGCGCAGAAGGAGGGCGAGACGACGGGCCTGGCCAAGTTCCTGGAGAAGGCGCCCAAGGAT
GTGGCAAAGGACGTGTTCGTCAATGGATTGCCTCCGCTGCCGAGCGGACAGGCCCTGGAGGCTGGAGGATGGGATGTGC
ACAAGTACGAGCTCAATGAGGATCAGACATATGGTGAAGGCTATCCTACCAGGACGTTCAAATAAGACGGGCAATAGGG
TCGACTTGTGTAAATACAGAT

> SEQ ID NO: 6481 214766 224152_300979_1b
ATCACAATGAACTACCCCGCTGAACCCGAATTCCAACAGGCTTACGACGAGCTCTACAACTCCATCCACGACTCGACTC
TGTTCGACAAGCACCCCGAGTTCGAGAAGGTCATCCCTGTGGTGTCTGTTCCTGAGCGAATCATCCAGTTCCGAGTTGT
GTGGGAGGACGACCAGGGCAAGCTGCAGGTCAACCGTGGCTACCGAGTCCAGTTCAACTCCGCTCTGGGCCCTTACAAG
GGAGGTCTCCGATTCCACCCTTCCGTCAACCTGTCCATTCTCAAGTTCCTCGGATACGAGCAGATCTTCAAGAACGCCC
TGACCGGCCTCAACATTGGAGGTGGTAAGGGAGGTGCTGACTTTGACCCCAAGGGCAAGTCCGACGCCGAGATTCGACG
ATTCTGCTACGCCTTCATGGGCGAGCTCCACAGACACATTGGTGCTGACACTGATGTCCCTGCCGGTGATATCGGTGTT
GGTGGTCGAGAGGTCGGTTTCCTCTTCGGCGCCTACAAGAAGTACAAGAACACCTGGGAGGGTGTTCTGACCGGTAAGG
GTCTGACCTGGGGTGGATCTCTGATCCGACCTGAGGCTACCGGTT

> SEQ ID NO: 6482 214774 207681_300827_3b
AGCACGAGGAGCTTGACGCCATCTCCGCCAAGTTGGCTGGCGACTTCCGCACCATATGAGCCTTTCCTAGAGGGACTTG
GACAAGCACCTGACGCTGCGATCCTACCTCGAGGGCTACACTCTCGGAGAACTCGAGACCAAGATTTGGCAGACTCTCC
GAGCC

> SEQ ID NO: 6483 214795 200416_300759_1b
GCTGCTTCAACTACTCTCGTCAAGATGGCTGCTGCTCAGGTTACTCTCTCCGAGCCCAAGAAGCTCGAGGGATTCTCTC
TCTACTCTCGTTTCGCCCTCGCTGGTGCCGTCTGCTGCTCCGTCACCCACGGTGGTCTTACCCCCGTTGATGTCGTTAA
GACCCGTATCCAGCTCGACCCTGTTACCTACAACCGTGGCCTGATCGGTGGTTTCCGCCAGGTCATCCAGAATGAGGGT
GCTGGCGCTCTCCTGACTGGTGCTGGCCCTACCTTTGCCGGTTACTTCCTGCAGGGTGCCTTCAAGTTCGGTGGTTACG
AGTTCTTCAAGGCCCAGTTCATCAACGGACTCGGCCAGGAGACTGCCTCCAACAACCGAACTGCCATCTACCTGGCTTC
CTCTGCCGCCGCCGAGTTCTTCGCCGACATTGCCCTCTGCCCTCTTGAGGCCACCCGTATCCGTCTCGTCTCCGAGCCC
ACCTATGCCAACGGTCTCGTTGGTGGTTTCTCCAAGATGCTCAAGAACGAGGGTGTCGGTGCCTTCTACGCCGGTTTCG
GACCCATCCTCTTCAAGCAGATCCCTTACACCATGGCCAAGTTCGTCGTCTTCGAGAAGGTTTCTGAGGGCATCTT

> SEQ ID NO: 6484 214853 195606_300636_1b
ACGATGAATACGCGGCCTGTTCCTGCAGGATCGCATCGCGGTCGCGAGAGAGCAGATCAACGACCAGCAGCTGCAGGGG
GTCTAACATCATGGACATGGCTATCTATCTCCTACACAACGGATGCATCCAAGCACGAAATAGATGGGGAATTAGGGG
GTACGGAGGCGGGTGAAACACCAGACGCTCGTCAGCGCTCAGCTTCAACATTCAAGTTCTGTATCAAGGTTGTGAAACC
TCAAAGCTGCACCGTTTCGTTGGTACAGTGGGCCGAGTTTAGAGTGCTAGCCCGAACAGATTTGAAACAGCCATTAATG
GATCTGTGGAGGCGCGTCAAAAGCCCACGATCCGAATAGAGGCAGAGCGGCAGGGCCCGACTCGACGGAAACGGCCA
AGACATGGCCGGCTGAGACAACGTCTATTGTATTGCTCGCCTCGCCAGGGAATGCTCTCCATCTGGTCGACAATGCATA
ATCTCCTTCTGTCTTACACATTAACGGTCATTGTAATGGGCACTTTAATGAGGACACTTTAACAAAGTGGCTGGCG

FIG. 2 continued

> SEQ ID NO: 6485 214854 214957_300876_1b
ATTCCCTAGTAGGTTTGGCGGGTGAGATACCTGATACGGCACGAGCGTTTGCAGGGCATCCGATTCGAGCGAATTGATG
GCTTTGGTGCACAAAGGACCGGGAGGTTGCATTTGGGCATTGATCTTAGGAGGAATGGAGATTGGGAGCAGATGGACGT
CGATTCGACCTGTGACGTTTGGTGATGGGTAAAAAATAACAGTATTGCACATCACAGAG

> SEQ ID NO: 6486 214874 215231_300879_1b
GCAGAGGATCTTTGGAGCAAAGAGAAAGAAAAAAAGCCAACCATCGCGACAACGCGCAGCCCGCCTTTCCTCCGACCTC
TGGCCCTTGTCAATCTCTCTTCCTCGTTGGACCCTCTTTCGAAGCGATAAATCAACAGCTCGCCAAGATGATTGACGAT
TTGCCCAACGATGCCAAGTCCAAGGAGGTGGTGAGACTCTGGCGCGTGGAGGACTGTTCACGAGATGGTTGCGGACC
GAGAGTACGAGCTCGCCGAAGACGAAGTCACCATCTCTCTCGACCGGTTCCGCGACGAATACTGGCATCCCGACGCAC
CGTAAACCGCGCCAAACTCCAGTTCTCCGCCCGTCCCAGCGACTCCATGCTCCGCAAAAACACCCCTCCCGGCACAGCC
TCCAACCCGGACCCCGTGCCCGACTGCGGGCCCATCTGGGTCGAGTTCCTGACGGACAAGCAGTTCGGCGTCGGCCAGA
TCCGCCAGTTTGCAAAGTACACAATCTCCAACAACTACAAGACGGGCATCATGGTCACCCACGTGCCCCT

> SEQ ID NO: 6487 214880 206714_300825_1b
GGTCTCGAAGCGCAGAACATCGGAGGAGTTGGTAGCAGCAGCTTTTCCACTTTCCAGGACAGTGTGTCCTGGGAAATAG
CGCATAAACGCCATGCGCCAAGCATGATGAGTGGTGACCAGCGCCCAGAATCGCTTCGACACCAACGCCACCGAGGAGT
GGCAGTCGGGCGGCAGATGCGAAAAGATGTGCGTCAGGATCTCTGGCAGAACACTTATCGAGACGGATTCCATCCGAGC
GGGGTTCTGAGCGCTTTATAACCTGGAAACCAGGCCCTTGCTTCGCAGCTTGAGTGTTCAAAGCTTTCTCATACTCGGA
GATTCGCTGTCCAGGCACAGAAGGGAGATCGTCGAGGCCCTTGTCCAGGCTCAATCGTCGTAGCTTCTCGTCCAGCTGG
TCGGCATTGACTCCAGCATCTTCGCCCGGGAGGGGCTGATGCTGATGCTGGTCCGG

> SEQ ID NO: 6488 214902 210550_300890_1b
ACTGCTTCAAGATGTCCATGACAACCGAAGACTGTACCAAGGTCCGGCCCGGGTTCCCGCGGCGGGTCCCGGAGACGCC
CGAGAAAGTGTTTGAACAGTTTCAAATGAGAGACAAGGTCGTCATTGTTACTGGAGCGGCAGATGGTATTGGTCTTGCT
GTGACTGAGGCGATGGCAGAGGCGGGCGCAAACGTTGCTCTGTGGTATAACTCGAATGATGCGGCCGTTGAGAAAGCAA
AGACCCTTGGCGAGACTTATAAGATCGCAGCTGCCGCATATCAAGTCGACATCTCTCAAGCTGAGCAGGTGAGCAGAAA
CATTGCTAAAGTAGTCCAAGACTTTGGCAAGATTGATGTCTTTGTTGCAAACGCGGGTATTGGCAATCTCGCGGCCCATT
CTAGAGCAGACTCTAGACGAGTACCGCAAACAGATGTCTGTAAATGTGGACGGCGTAGTCTTCTGCTCCAAGTACGCCG
GCAAAGTCTTCCAACGTCAGGGCTTCGGCAACTTCATCATCACATCCAGCATGAGCGGCCACATTGTCAACGTGCCCGT
AGACCAACCAGTGTACAACGCCACCAAGGCCTTTGTCACGCACTTTGGAAAGTCTCTAGCTCGTGAATGGCGCGAGTTT
GCCAGAGTCAACATCGTG

> SEQ ID NO: 6489 214918 224049_301394_1b
ATCTCTTATTCATTACACAAAAACAACAATGTCTCTCAAGGTCGACGGCTTCACTTCTTCTATCATCTTCGACGTCATC
CGTGACGGTCTTAACGACCCCTCTCAGGCCAAGCAGAAGGCTGAGTCCATCAAGAAGGCCAACGCCATCATTGTCTTCA
ACCTCAAGAACAAGGCTGGCAAGACCCAGTCTTGGTACCTTGACCTCAAGAACGACGGTGACGTCGGCAAGGGCAACAA
GTCCCCCAAGGGTGATGCTGACATCCACTCTCTCTTGACGACCACTTCCAGCAGCTCGTTGAGGGTAAGGCTAAC
GCCCAGCGACTCTTCATGACCGGCAAGCTCAAGGTTAAGGGCAACGTCATGAAGGCTGCCGCCATTGAGGGTATCCTCA
AGAACGCTCAGAACAACCTCTAAGCGCATCATTTATTGATTAATTGATGATTTACTATATTGAAAAAAAAGAAAAAA

> SEQ ID NO: 6490 214956 217768_300911_1b
GGATACGGTACGGTGAGCCAAACGGAAATGACGGAGGATTATTTCAGGCAAGGTGGAGGCGGGGAGGAAGATGGATAGG
AAAAGTGTCTCGGAGAGAGTGCGGTTTTGAGTTAAACGTTGTGTCACAATGTTTCTGAATTGTGAGGACGGCTGTTTTC
GGGGCTGAAAATGTCATGAAGCCGGAACATTATTTCGTCACAAGGGAGTTGAGTGTTAGTTACGCAAGGTGGTATTAAT
TAGCATCCTGTGTTTGTTGTTCATGTAATATCTGTTAATATTACGCTGTTGCTGCCTTCTATT

> SEQ ID NO: 6491 214988 218774_300936_1b
GCTCAATTGAACCATCCAGACATCATGTTTCTGCAGCGAGGATCAAGAGTGCTGAGACGGCAATGGGGGCTTCCAAGG
CCATGGGCAAGATGGCCCTGGGAAACACAGCGCCTACAGCTCCCCGGTGGTTCTCGGAGTCGAGGAGATTATATGCCGT
CAAGCCGGTGTTGCTGGCTGACATCGGCGAAGGCATTGTCGAGTGTGAGGTTATCCAGTGGTTCGTCGAGCCCGGCGCG
CACGTCGAGGAATTCTCCCCTCTATGCGAGGTCCAGAGCGACAAGGCGTCTGTAGAAATCACAAGCCGCTTCTCCGGCG
TCGTCAAGAAGCTTTACTACGAGACGGGCGAGATGGCCAAGGTGGGCAAGCCGTTTGTCGACATTGACATCCAAGGCGG
GGCCGAAGCCGACGACGCTGGCGCGCCCAAGGCGGCCGAACCCAGCAAGGACGGAGCCTCATCTTCAACACCAGCACCC
GAGCCAAAGCCGCAGCAGACTGAAACCAGTGCGCCGGCACAGGGACAGAGCAGCCAAGCCCCAAGGCCAAGGGCAAGG
CCGCGGCACTGGCGACACCGGCGGTGCGACATCTGTCCAAGGAGCTGAAGATTGATATCCTCGACATCGACGGCACGGG
CAAGGATGGCAGGGTCCTGAAAGAGGACATTTACAAGTTTGTGCAGCAGAGGGATGCCAGTGCCAGTGCATCGGCTGCT
TCACAGTCTGC

FIG. 2 continued

> SEQ ID NO: 6492 215009 255257_301647_1b
GAGAGAGGAAGGTCGAGGATAGAGGAGGAGCAGGAGATTGGAGATTAGGGTAGCTGAGGAAGAGCCATAGCCATAGCCA
GAGCCATAGCCATAGCCATGGAGGTCGCGGCAGAGAGTGCAGTGGTGGCCCCGGCAACGGCCAAGACCGTGAAGGATGT
GGCTTCCCATGACTTTGTTCGTTCTTACGCTAGTCACCTCAAACGAACCGGCAAGATTGAAGTTCCTGCGTGGGTGGAT
CTTGTCAAGACCTCAACAGCCAAGGAGCTTGCCCCGTATGATCCAGACTGGTACTACATTAGAGCAGCTTCTATGGCTC
GCAAGATTTACCTAAGAGGCGGTGTCGGTGTCGGAGCTTTCAAGAAAATCTATGGAGGATCGAAGAGAAATGGGTCAAG
ACCATCCCACTTTTGCAAGAGCAGTGGATCAATTGCCCGAGATGTTCTTAAGCAACTCGAGAAGATTGACATTGTGGAG
AAGGACCATAGAGGTGGAAGGCGTATCACCTCGAATGGACAGCGTGATCTAGATCAGGTTGCTGGAACTGTCTCAGTGA
AAGTTGTTTAATTTAATATGCATAATTCAACTTTTCGTAGTTTAGGATTTTTGTAGGCATATAGTTTAATTTAAACATA
GACCGGATTATAGCATCTTTGCTTAGTGGTTTATTGTGTTGACTTGAGTGATTAGTACTG

> SEQ ID NO: 6493 215009 223869_300976_1b
GGTGTTTCCGTTAGAGACGTTCCCGCTCAGAAGTTCATTGAGGCTTACGCTTCTTTCCTCAAGCGACAGGGTAAGCTTG
AGGTCCCCGGCTACGTTGAGATCGTCAAGACCTCTGCCGGCAACGAGCTCCCTCCCCAGGATGCTGAGGGATGGTTCTA
CATGCGAGCTGCCTCCATTGCCCGACACATCTACCTGCGAAAGGAGGTTGGTGTTGGCAAGCTCAACAAGCTCTACGGT
GGTGCTATCAACCGTGGCCAGCGACCTTCTCACCACAAGGACGCCTCCGGCTCCGTCAACCGACGTGCTCTGCAGGCTC
TTGAGAAGCTTGGTGTCCTTGAGGCCGGTCTCAAGGGTGGCCGACGAATCTCCGAGAACGGACAGCGAGATCTTGACCG
AATCGCCGCCCAGACTCTCGAGGAGGAGGAGGATGACGAGTAAATTTG

> SEQ ID NO: 6494 215009 126193_300460_1b
CCCCCACAAACCCTTGCTGCAACTCGTAGGAGAGAGACGCACGGGCGCCGCAGTAGCAGCAGAGCCAAAAAATGGAGCC
AGCGAGAAATGTGAAGGATGTTTCACCTCACGCGTTCGTGAAAGCTTACGCCGCTCACCTCAAGCGTTCCGGCAAGATG
GAGCTTCCTGAGTGGACTGACATTGTCAAGACTGGTAAACTGAAAGAGCTTGCCCCATACGACCCTGATTGGTACTACA
TTAGAGCTGCTTCCATGGCAAGAAAGATATATCTGAGAGAGGTCTTGGAGTTGGTGGATTCCGAAGAATTTATGGTGG
TAACCAGAGGAATGGAAGCCGCCCACGTCATTTCTGTAAGAGCAGTGGTTCAGTTGCTCGCAACATCCTTCAGCAATTG
CAGAACATGAACATCATTGACTTTGATCCCAAGGGTGGAAGGAGAATCACATCCAACGGCCAGAGAGATCTTGACCAAG
TTGCTGGAAGAATTGCTGTTGCCATTTAAGAGATGAAAGCAAGCGTTATTATGAATACATGAGTTGCTTCAAACTTATA
ATTTCAGCTTGCACCATATAGATGTAGGGCGATGAATCAATTTTCTGCATATTTTTGCCTTTTTTTCTTTTATCATGGG
ATTCTTTTTGCATCAGTATGCTAGTTTTGTCCTTTCAGTACTTTAAGATGTTACTTGGGCCTGCCCTCTATTTGAGCAT
AACATTCTTATTTGCGTT

> SEQ ID NO: 6495 215009 1100606_301462_1b
GAGAGAGGAAGGTCGAGGATAGAGGAGGAGCAGGAGATTGGAGATTAGGGTAGCTGAGGAAGAGCCATAGCCATAGCCA
GAGCCATAGCCATAGCCATGGAGGTCGCGGCAGAGAGTGCAGTGGTGGCCCCGGCAACGGCTAAGACCGTGAAGGATGT
GGCTTCCCATGACTTTGTTCGTTCTTACGCTAGTCACCTCAAACGAACCGGCAAGATTGAAGTTCCTGCGTGGGTGGAT
CTTGTCAAGACCTCAACAGCCAAGGAGCTTGCCCCGTATGATCCAGACTGGTACTACATTAGAGCAGCTTCTATGGCTC
GCAAGATTTACCTAAGAGGCGGTGTCGGTGTCGGAGCTTTCAAGAAAATCTATGGAGGATCGAAGAGAAATGGGTCAAG
ACCATCCCACTTTTGCAAGAGCAGTGGATCAATTGCCCGAGATGTTCTTAAGCAACTCGAGAAGATTGACATTGTGGAG
AAGGACCATAGAGGTGGAAGGCGTATCACCTCGAATGGACAGCGTGATCTAGATCAGGTTGCTGGAACTGTCTCAGTGA
AAGTTGTTTAATTTAATATGCATAATTCAACTTTTCGTAGTTTAGGATTTTTGTAGGCATATAGTTTAATTTAAACATA
GACCGGATTATAGCATCTTTGCTTAGTGGTTTATTGTGTTGACTTGAGTGATTAGTACTGAAATTATAAAGAGGGAGAT
GGTTAATGACCCTAAGACTGA

> SEQ ID NO: 6496 215009 120853_300517_1b
GGCGGCGGCGGCGGCAGGATGGGGGATTCGACGGCGAGGACGGTGAAGGACGTGAACCCTCATGAGTTCGTCAAGGCCT
ACTCCGCCCACCTCAAGCGCTCCGGCAAGATGGAGCTCCCTGAGTGGGTTGACATCGTGAAGACTGCGAGGTTCAAGGA
GCTCCCTCCTTATGATCCGGACTGGTACTACACGAGGGCTGCCTCGATTGCAAGGAAGATCTACCTGAGGCAGGGTATT
GGTGTAGGTGGCTTCCAGAAGATCTATGGTGGCCGCCAGAGGAATGGCTCACGTCCCCCGCACTTCTGCAAGAGCAGCG
GCGCTATCTCACGCAACATCCTTCAGCAGCTGCAGAAGATGGGCATCATCGATGTCGACCCCAAGGGCGGAAGACTCAT
CACCTCCCAGGGAAGGCGTGATCTGGACCAAGTGGCCGGAAGAGTTGATGTTACCATCGCCTGAACAGATCCATGGATC
TTCAACCCTTACTGCCTCTCATATGTTTGGTGGTTGAGTCGGCTACAGTTGTTTGCAGTTTTGAATTAGAACATGCCC
TATCTTTGGTTGAGTCGGCTACAGTTTGTTTGCAGTTTTGAATTAGAACATGCCCTATCTTTGCTGGCTCAGAGAATTG
GAAGTTGGATGCATCTAGGTGTGATACTGCAGTATGTGTTTGTCTTTTCCTGAATG

FIG. 2 continued

> SEQ ID NO: 6497 215021 224177_300979_1b
GCAACACACACAATGTCCTTCAACTTCAACGATTCTCTCAACAGTCTGTCCACCACCTTCTCCCCATGGGCCAAGCGAA
CCCAGCGAATGGTCCAGGAGAAGCTCGGCAACGTGGAGGACGTGACCGAGCTCCCCCAGGAGTACCTGGAGCTGGAGGC
TCGAGTTGACGCTCTCAAGATTGTCCACCAGAAGCTGCTCGCCGTCACCTCTAACTACGAAAACGAGGGCTACGACTAC
CCTCCCAACCTGCGGGAGTCCCTGTCTGACCTGTCTAAGACCATCACCGAGAAGGTGCAGGGTCTGTCCCAGGTGTCTT
CTGCTGCCGAGGCCCAGTCTGTGCTCACCANCCCCGGCTCCAAGAAGGACCCCAAGACCATGAACCATGCTCTTGGCCG
AGCTGCTCTTGGTGGTGTTGCTGCCCTCAAGGAGGCCGGTGCCGACTCTGACGANCCCCTGTCCGAGTCTCTCCAGAAG
TACGCCATTGCCGAGGAGAAGATTGGTGAGGGCCGACTGTCCCAGGAATACCTGATCGCCAACAAGTTCAACGCC

> SEQ ID NO: 6498 215032 188351_300698_1b
CCCCGGGACCTCGCAGTCGCCACCCCGAGCAGAAGCCGCCGCCGCCGCCCGAAACCCTCGCCGCCGTCGCTTCTCCTCG
GGGCGCAGCCATGGTGGCCGCAAAGAAGACGAAGAAGTCCACGGACAACATCAACAACAAGCTGCAGCTCGTGATGAAG
AGCGGCAAGTACACGCTCGGCTACAAGACCGTCCTCAGGACCCTCAGGAACTCCAAGGCGAAGCTAGTGATCATTTCTA
ACAACTGCCCACCTCTTCGGAAGTCAGAAATTGAGTACTACGCTATGTTGGCCAAGGTCACCGTCCACCACTTCCACGG
AAATAATGTCGATCTGGGGACAGCCTGTGGTAAATACTTCCGTGTTTGCTGCCTCAGCATTATTGATCCTGGTGACTCG
GATATCATCAAGACCACGGGTGAGCAGTAAGGATGAGCGGTTCCGCTGGCGCTTCAGATGCTGTCACACTGAGCTGTTC
TAGACATTGTAGTTGTTGCTGGACTTGATTTGGTCTCTCTCGTGTATCGAACAGCTTTTACCAGTCAACCAAAGTTTCG
TGGGAACATTGTTCTTGGATTGGAAAATTTTGTTCCTGGAAAAAAAAAA

> SEQ ID NO: 6499 215032 195754_300637_1b
CCCACGCGTCCGCCCCGAGCAGAAGCCGCCGGCGCCGCCCGAAACCCTCGCCGCCGTCGCTTCTCCTCGGGGCGCAGCC
ATGGTGGCCGCAAAGAAGACGAAGAAGTCCACGGACAACATCAACAACAAGCTGCAGCTCGTGATGAAGAGCGGCAAGT
ACACGCTCGGCTACAAGACCGTCCTCAGGACCCTCAGGAACTCCAAGGCGAAGCTAGTGATCATTTCTAACAACTGCCC
ACCTCTTCGGAAGTCAGAAATTGAGTACTACGCTATGTTGGCCAAGGTCACCGTCCACCATTTCCACGGAAATAATGTC
GATCTGGGGACAGCCTGTGGTAAATACTTCCGTGTTTGCTGCCTCAGCATTATTGATCCTGGTGACTCGGATATCATCA
AGACCACGGGTGAGCAGTAAGGATGAGCGGTTCCGCTGGCGCTTCAGATGCTGTCACACTGAGCTGTTCTAGACATTGT
AGTTGTTGCTGGACTTGATTTGGTCTCTCTCGTGTATCGAACAGCTTTTACCAGTCAACCAAAGTTTCGTGGGAACATT
GTCC

> SEQ ID NO: 6500 215032 252893_301605_1b
GTTATGAGATTTGGAAAACCCTAGCAAGAAGAAGAAGAAGAATATTAGTTCCATCTCTTTGCCGGAAGTTCAACAGAGA
AGGCAATCATGGTGGCCGCTAAGAAGACGAAAAAGGCCCAAGAGAGCATCAACAATAGGCTAGCCCTAGTCATGAAGAG
TGGCAAGTTCACTCTTGGATATAAGACCACATTAAAGTCTCTACGCGGTGGCAAAGGGAAGCTTATTATTATCTCCAAT
AACTGTCCCCCCTTAAGGAAATCAGAAATCGAGTACTATGCTATGCTCTCTAAAACTGGAGTTCATCAGTACAGTGGAA
ACAATGTGGACTTAGGCACAGCCTGCCGGAAGTACTATCGGGTTAGCTGTCTTAGCATCACAGATCCCGGTGATTCGGA
CATTATCAGAACTGTTGAATAGAGCTTAGAGAGGATTAAAGGCGGTAATGCTTATCATATTAGCTCATCTCGAGGGGGC
TTCTTTGGAAGACTTGCATGAATTTCCCTAGTTTTCTTTTCTTGCTTTATTGGATCAGAGAAACCAATTAATATATATG
GCTAAATTAAACATGGAAAATTAAATTTGTAGTAGCCGACTGTTTTGCCGTGTCATTGGTGTTGCAAGTAAGGTTCTCG
TTTTTGTGCCAAAAAAAAAAAACAA

> SEQ ID NO: 6501 215032 256592_301673_1b
GGCGACGAAGAGAGAGGAGAGATCCAAGATGGTGGTCGCCGGGAAGAAGCAGAAGAAGACCCAGGAGAGCATCAACAAC
AGGTTGGCGCTGGTGATGAAGAGCGGCAAGTTCACTCTGGGCTACAAGACGGTGCTCAAATCGCTGCGGAGTGGGAAAG
GCAAGCTCGTTCTCATCTCCAACAATTGCCCGCCGCTCCGCAAGTCGGAGATCGAGTACTACGCGATGCTCTCCAAAAC
CAACGTCCACCATTACAGTGGAAACAATGTGGAGCTTGGTACCGCTTGCGGCAAGTACTATCGGGTCTCTTGCCTTACC
ATCACAGATCCAGGCGATTCGGATATCATCAAATCCATGTCCGCCGAGTGAAAATCCATCCATCGATCAGCGCTCCTCT
GTTTTGTTTCGCTGTTCAACTTCTTGTAGGCCTCTTACTCTAGAAATATGGAACTTTAATGGAAAAACATTTCCTTCAT
AG

> SEQ ID NO: 6502 215032 206031_300804_1b
GCTAATCGCAAGATCGCAGCTCGCGCCCAAAATCAGTCAAAATGGCCCCTCAGAAGAAGAGCAAGAAGGATGCCAACAG
CATCAACTCCAAGTTGGCGCTTGTTATGAAGTCCGGAAAGGTCACTCTCGGCTACAAGTCTACTCTCAAGTCTCTGCGA
TCCGGCAAGGCCAAGCTGATCATCATTGCTGGCAACACTCCTCCCCTGAGAAAGAGTGAACTCGAGTACTACAGCATGC
TGTCCAAGGCTCCCATCCACCACTTCGCTGGTAACAACGTAAGTTTTGCAATCTCAGACGCCCTGGACAAGTGAAGACC
TGGAAACGGGTATATCTACTTGCGCCATTACACACTTCTCGCTTCTTTCAGAAGCTACTCTTGCTACCCGAGAATTGCC
AATTCTTGCGGAATTGCCCAGAGAAGAAGTCTTTCAGACTTTGGAGGGTTCACATTGGCTTACATTATTCGTAAAACAG
ATTGAGCTCGGCACTGCCTGCGGAAAGCTCTTCCGCTGCTCCACCCTTGCCATCCTGGATGCTGGTGACTCTGATATCC
TCAGCGACCAGCAGGCTTAAATAGCCGAAATCTAGTGCATTCAAAACGGCGTTGGGGGTAAAACGGT

FIG. 2 continued

> SEQ ID NO: 6503 215032 271222_200032_1b
CGTTATTTATTATGCATCTTGACTACCCCTCGACCACGCGTCCGCCCACGCGTCCGCCCACGCGTCCGCGCCGTCGACG
CATTTGCCTCTTCCTATAATTTCCGACTACATATCTCCAGGCCAGAGCCAACCATGGTTGCTGCAAAGAAAACCAAGAA
GACTCATGAGAGTATTAATAACAGGCTGGCTCTGGTAATGAAGAGCGGCAAATACACATTGGGATACAAGACTGTTCTC
AAAACTCTTAGAAACTCCAAAGGCAAACTCGTCATCATTGCCAACAACTGCCCTCCTCTCAGGAAGTCTGAGATAGAGT
ACTATGCTATGTTGGCAAAGATTGGAGTCCACCACTACAATGGAAACAACGTAGATTTGGGGACTGCATGTGGTAAGTA
TTTCAGAGTCTGTTGCCTCAGCATCATTGATCCAGGTGATTCTGATATCATTAAGAGCATGCCTGGTGACCAGTGAGAT
AGCAGCTGATGTTAGATCGCTCCAATGAACACTGCTCAATCATAGTGGAACTTTGCCGTTTTTCCTTATTGAGACAAAT
ATCTAGTTTAGATGAGTTTTGCTACTTTGGTGATGTTAAAAGGAAGTTTTGATGGTATTTGGAATCTTAATGACATCAA
TTTTTTTTCCTGGAGTTTTGAATCTTCTAATTGACTGTCATTTGTTGCTTA

> SEQ ID NO: 6504 215032 57491_300120_1b
GCCATTACGGCCGGGGATATAACTAACATTAGAAACCTCGGCCACTTCCCTTTCCCGTTGTTTCAGAGTGTTTTTATC
AACAAAAATGGCGACAACAGGGAAGAAAACGAAGAAGACCCATGAGAGCATCAATAACAGGTTAGCTCTGGTAATGAAG
AGTGGCAAGTACTCTCTCGGTTACAAGACCGTTCTGAAGACCCTCAGGAGCTCTAAAGGGAAGTTGATATTGATATCTA
ACAACTGCCCACCATTGAGAAAGTCAGAGATTGAGTACTATGCTATGCTTGCTAAAGTTGGTGTTCACCATTTCAATGG
AAACAATGTTGATCTTGGAACAGCATGTGGGAAGTATTTCCGTGTTTCATGCCTCAGCATCATTGACCCAGGTGATTCG
GACATCATCAAGTCTCTACCTGGTGATCACTAAGAGATATTCACCAGGGTTTTGCTAAACCATTTTAGTGAGTTGAGAA
AATCTGTACTATCTTTTTATTCTTGTATTTCAGAGTTATACCAAGATTATAGAGGATGTTGGTATTATCTAGTTTTGTT
GGTTTTATCATTTCTCCAGAAGTTTTGAGGTCAGGTACATTATGATTTTATTCACAGATCAATTTCCCTATACCATTTT
GCTTTTCTAAATGAGTTCACTAGATTTTCTTGTTGTTAAAGGAAAAAA

> SEQ ID NO: 6505 215032 1109927_301526_1b
ATTCTCTTGGAGGCAAAGGAGAGAGAGAGAGAGAGAGAGAGAGAGGTTGCAGGTTCCGGTAGCAAGGAAGGCGCAACCA
TGGTGGCAGCAAAGAAGACGAAAAAGGCTCAAGAGAGCATCAACAACAGGTTAGCCCTGGTCATGAAGAGTGGCAAATT
CACTCTTGGATACAAGACTGCCTTGAAATCTCTCCGTGGTGGCAAAGCAAAACTTGTCATCATCTCGAACAACTGCCCC
CCACTAAGGAAGTCTGAAATTGAGTACTACGCTATGCTCTCCAAGACAGGGGTGCATCAGTACAGTGGAAACAATGTGG
ACTTAGGCACAGCCTGCGGGAAGTACTATCGCGTCAGCTGTCTTAGTATCACAGACCCTGGTGATTCTGACATCATCAG
GACTGTGGAGTAGGGATGAGAGTTCAAACCAAGTTTAGTGTGGAAGTAGGACGTCTTTTAATTCCTCTGAGCATGCAAG
GGGGCCGAGTTTTGCCTCTTCACTGGAATTTATTGATTAGCCTGTTAACCTCTGCTTAAAGAGAACTTGGCTATTTGT
AGATGGCTAAGTCTTGATTGATGATGAAATATGGTCATTGCGTTTTCTTTTCC

> SEQ ID NO: 6506 215032 1121540_301876_1b
GGAAAACCCTAGCAAGAAGAAGAAGAAGAATATTAGTTCCATCTCTTTGCCGGAAGTTCAACAGAGAAGGCAATCATGG
TGGCCGCTAAGAAGACGAAAAAGGCCCAAGAGAGCATCAACAATAGGCTAGCCCTAGTCATGAAGAGTGGCAAGTTCAC
TCTTGGATATAAGACCACATTAAAGTCTCTACGCGGTGGCAAAGGGAAGCTTATTATTATCTCCAATAACTGTCCCCCC
TTAAGGAAATCAGAAATCGAGTACTATGCTATGCTCTCTAAAACTGGAGTTCATCAGTACAGTGGAAACAATGTGGACT
TAGGCACAGCCTGCGGGAAGTACTATCGGGTTAGCTGTCTTAGCATCACAGATCCCGGTGATTCGGACATTATCAGAAC
TGTTGAATAGAGCTTAGAGAGGATTAAAGGCGGTAATGCTTATCATATTAGCTCATCTCGAGGGGGCTTCTTTGGAAGA
CTTGCATGAATTTCCCTAGTTTTCTTTTCTTGCTTTATTGGATCAGAGAAACCAATTAATATATATGGCTAAATTAAAC
ATGGAAAATTAAATTTGTAGTAGCCGACTGTTTT

> SEQ ID NO: 6507 215032 138763_300727_1b
CCGACCTCGCAGTCGCCACCCCGAGCAGAAGCCGCCGCCGCCGCCCGAAACCCTCGCCGCCGTCGCTTCTCCTCGGGGC
GCAGCCATGGTGGCCGCAAAGAAGACGAATAAGTCCACGGACAACATCAACAACAAGCTGCAGCTCGTGATGAAGAGCG
GCAAGTACACGCTCGGCTACAAGACCGTCCTCAGGACCCTCAGGAACTCCAAGGCGAAGCTAGTGATCATTTCTAACAA
CTGCCCACCTCTTCGGAAGTCAGAAATTGAGTACTACGCTATGTTGGCCAAGGTCACCGTCCACCATTTCCACGGAAAT
AATGTCGATCTGGGGACAGCCTGTGGTAAATACTTCCGTGTTTGCTGCCTCAGCATTATTGATCCTGGTGACTCGGATA
TCATCAAGACCACGGGTGAGCAGTAAGGATGAGCGGTTCCGCTGGCGCTTCAGATGCTGTCACACTGAGCTGTTCTAGA
CATTGTAGTTGTTGCTGGACTTGATTTGGTCTCTCTCGTGTATCGAACAGCTTTTACCAGTCAACCAAAGTTTCGTGGG
AACATTGTTCTTGGATTGGAAAATTTTGTTCCTGGCCCGAATCATGTTTTCAATTAAAACGCTTGGCTGTTTGTTCACT
GAACTTCGCATCATTA

FIG. 2 continued

> SEQ ID NO: 6508 215043 171725_300536_1b
CGAACCCTCGCAGCCGCATCGCGCCGGCGCCTCCTCCTCCCCCTCCCCCTCCCCCTCCGGCGAGAGAGCCCGCGCCGTT
GCCGCCGCCGCCGCCGCCGCCATGTCGCTGATCGCGGGGGAGGATTTCCAGCACATCCTGCGTCTGCTGAACACGAACG
TGGATGGGAAGCAGAAGATCATGTTCGCGCTCACCTCCATCAAGGGTGTCGGCCGCCGCTTCTCCAACATCGCATGCAA
AAAGGCCGACATCGACATGAACAAGCGGGCTGGTGAACTCACTCCTGAGGAGCTTGAGCGCCTCATGACTGTGGTGGCA
AACCCTCGCCAGTTCAAGGTCCCTGACTGGTTTCTGAACAGGAAGAAGGACTACAAGGATGGGAGGTTCTCCCAGGTTG
TTTCTAACGCCCTGGACATGAAGCTCAGGGATGACCTTGAGAGGCTGAAGAAGATCAGGAACCACCGTGGTCTTCGTCA
CTACTGGGGTCTCCGTGTCCGTGGTCAGCACACCAAGACTACTGGCAGGAGGGGAAAGACTGTCGGTGTCTCCAAGAAG
AGATAAATTCCATGCCCATCAGCACAGCAAATGCGTTTTGCTTATCTTATGAGCGTTTCAATGATGTCAGTCTTGATAG
GGCATTTTGTTGGATGATGCTTTTGTCTA

> SEQ ID NO: 6509 215043 254029_301631_1b
GCAGGAGAGAGGGAGGGAGGGAGAGGGAGAGGGAGAGGGAGAGAGAAGTCGAAAACCGGCTAATCTTCTCCTCTAATCATG
TCGCTGATCGCCAACGAGGATTTCCAGCACATTCTTCGTGTTCTCAACACGAACGTAGATGGGAGGCAGAAGATCATGT
TCGCCCTCACGGCGATCAAGGGTATCGGCCGACGTTTCGCCAATCTCGTCTGCAAGAAGGCAGACGTCGACGTCAACAA
AAGAGCTGGAGAACTCTCTGCTGCAGAGTTGGAAAGCCTTATGGTGATTGTTGCAAATCCTAGACAGTTCAAGATCCCC
GACTGGTTCCTGAACAGAAAGAAGGACTACAAAGATGGACGCTTCTCTCAAGTTGTGTCCAATGCTTTGGATATGAAGC
TCAGGGATGACCTTGAGAGGCTCAAAAAGATCAGGAATCACCGAGGTCTTCGCCACTACTGGGGCCTTCGTGTTCGAGG
GCAGCACACAAAGACCACTGGCCGCCGAGGAAGGACTGTTGGTGTCTCTAAAAAGCGTTAGGGGGGTAATTCTAGTTTC
TTGTTGTGGCTGGCATTTTGAAATGTCTCAATTTTATTTAGTTTTGGAGATGCGGCATGTAACCCATGTCCAGTAGTAT
TTAGCCACATGGAAACAATCCTTTTCATCATTAGAATGCGAACACAACGGA

> SEQ ID NO: 6510 215043 253203_301624_1b
ACCGGTCGACCCATAACTACACGCCAAAATGTCCCTCGTCGTCACTGAACAAGGCAACTTCCAGCACATTCTTCGACTC
CTCAACACTAACGTTGACGGCCGAATCAAGGTCATGTACGCCATGTGCAAGATCAAGGGTGTTGGTCGACGATACGCCA
ACCTGGTCTGCAAGAAGGCCGATGTCGATCTCTCCAAGCGAGCCGGTGAGCTCACCGTCGAGGAGCTCGAGCGAATCGT
TACTATCATCCAGAACCCTGGTCAGTACAAGATTCCCGGCTGGTTCCTTAACAGACAGCGAGACTTTACCGACGGTAAG
GACTCCCAGCTGCTCGTTAACCAGCTTGATGTCAAGCTGCGAGACGATATTGAGCGACTCAAGAAGATCCGAGCCCACC
GAGGTCTCCGACACTACTGGGGCTACAAGGTCCGAGGTCAGCACACCAAGACTACCACTCGAAAGGGTAAGATCATGGC
TCACCGAGGTTAAAAACGTGCATGTACATGTAAAATTATTAAAATGCTATTGAGGACC

> SEQ ID NO: 6511 215043 126863_300467_1b
GCCATTACGGCCGGGGAGGGTTTTGGTAGTTCTGCATCTCTTCAGGAGTGAACGAAACAGCCGCACCGCGGAGCAGAAT
TCGAAACTGTAGCAATGTCGCTGGTTGCAAATGAAGAATTTCAGCACATACTTCGTGTGCAAAACACGAATGTTGATGG
GAAACAGAAGATAATGTTCGCAATGACATCTATCAAAGGTATCGGCCGTCGTTTCGCTAACATTGCCTGTAAGAAAGCC
GATATCGATATGAGCAAGAGGGCGGGTGAGCTTTCTGCTGCTGAACTCGATAGCTTGATGGTGGTTGTGGCAAATCCTC
GCCAATTCAAAATCCCCGACTGGTTTTTGAATAGGCAAAAGGATTACAAGGATGGTAAGTTTTCGCAAGTTACATCTAA
TGCTCTGGACATGAAGCTTAGGGATGATCTGGAACGCCTAAAGAAGATCAGGAATCATCGTGGTTTCGCTCATTACTGG
GGTCTTCGAGTCCGTGGTCAGCACACAAAGACCACTGGTCGTCGGGGGAAGACTGTTGGTGTCTCCAAGAAGCGATAAT
CTCCTTTCCCCTGAGCCAGTTTTGCATGGTTATGCTATTTTGTTTTTATATGCAGCAACAAAGTTTGAATGGAGTTA

> SEQ ID NO: 6512 215043 156462_301366_1b
CTCACATCTCTTGAATACAGAAGAAGCCGCCGCCGCACAGAGCAAGATTTGAAACCTAGCAATGTCGCTCGTTGCAAAT
GAAGAATTTCAGCACATTCTTCGTGTGCAAAACACCAACGTCGATGGGAAGCAAAAGATCATGTTCGCTTTGACCTCAA
TCAAAGGTATCGGTCGTCGTTTTGCCAACATTGCCTGCAAGAAAGCTGATATCGACATGAACAAGAGGGCGGGAGAACT
TACTGCTGCAGAGCTTGACAGTGTGATGGTGGTTGTTGCAAATCCCCGTCAATTCAAAATACCTGATTGGTTTTTGAAT
AGGCAGAAGGATTACAAGGATGGGAAGTTTTCACAAGTTACCTCTAATGCTCTTGACATGAAGCTTAGGGATGATCTCG
AGCGCCTGAAGAAGATCAGGAATCATCGTGGTTTACGTCACTACTGGGGTCTCCGAGTGCGTGGTCAGCACACAAAGAC
CACAGGGCGCAGGGGGAAGACTGTTGGTGTCTCCAAAAAGAGATAAATCATCTACTTGTTCAGTTTGTTATGTGCTTTC
TCTTTATGTGCTCCGGGCGATACATGTTTAAGATATTTAGGGGATTTTGTGTTGGTATGCTTAAATTTTCCTTTCCGT
TGGTGGATTACAGTATAATTTTTTCCATAGTGACAAGGATTTCTCTGCTTTATGATCTAGGTTTTGCAAGATGATCTT
GAATTAAATTGAATGAGTATTTCCTTAAATATACTC

> SEQ ID NO: 6513 215043 127831_300473_1b
GCATCTCTTTCAAACTAAAGCAGCCGCAGCCGCAGCCGCACTGTGCCGAAAGCAGTGAAACCCTAACCATGTCGCTGGT
TGCAAACGAAGAGTTTCAGCACATTCTTCGTGTGCAAAACACGAACGTTGATGGAAAGCAGAAGATCATGTTCGCTATG
ACCTCTATCAAAGGTATCGGTCGCCGTTTTGCTAACATTGCTTGCAAGAAAGCCGATATCGACATGAACAAGAGGGCCG
GAGAACTCTCTGCTGCAGAGCTTGATAGCTTGATGGTGGTTGTGGCTAATCCTCGCCAATTCAAAATCCCAGATTGGTT

FIG. 2 continued

TTTGAACAGGCAGAAGGATTACAAGGATGGCAAGTTTTCTCAAGTTACATCTAATGCACTTGATATGAAACTCAGGGAT
GATCTGGAACGGCTGAAGAAGATCAGGAATCACCGTGGTTTGCGTCACTACTGGGGCCTTCGTGTACGTGGTCAGCACA
CAAAGACCACTGGCCGCAGGGGGAAGACTGTTGGTGTCTCCAAGAAGAGATAAATCATTTACTTGCCAGTTCCTTTATG
TTTTATGCTTCTCTTTGGTATGTGGAGTCCGAACACCCGCAGGAAGTTTATTAGGTATTTTGTAATGTTTGCACTGGAA
TTTTCTAGTCTTGCCATTTGGAGGGTTATAGTTCCTATAAATCCTCTGGCGGCATTGCAAGCATTTGTTTATTGTGGGA
TCAAAGTTTTGCCGGTTTTACGCTTGAATTATTACATTGATTGAGTACTTTTTATTGAGATGC

> SEQ ID NO: 6514  215043 9161_300301_1b
CCCACGCGTCCGCTTTTGTGTTCTTCACTCTCCAGCGATCGTTTATTGCTTGAAGACGGCTTCTTCTTCTCACAAATCT
CATCTCTGCTAATCAAAATGTCTCTGGTTGCAAATGAGGAGTTTCAACACATTCTTCGTGTGTTGAATACTAATGTTGA
TGGTAAGCAGAAGATTATGTTTGCCCTTACCTCTATCAAAGGTATTGGTAGGCGATTGGCTAACATTGTCTGCAAGAAG
GCTGATGTCGACATGAACAAAAGGGCTGGTGAGTTATCTGCTGCTGAGATTGATAACCTCATGACAATCGTTGCAAACC
CACGTCAGTTCAAGATCCCAGACTGGTTCTTGAACAGGCAGAAGGATTACAAAGATGGCAAGTATTCTCAAGTTGTCTC
CAATGCTCTTGACATGAAGCTGAGAGATGATCTTGAACGTCTCAAGAAGATC

> SEQ ID NO: 6515  215047 55963_300129_1b
AAACCCGAAAACCTCAAACCATGGCCGAGGGACTCGTATTGAAGGGCATTATGCGCGCCCACACCGACATTGTCACGGC
CATCGCTACGCCGATCGACAATTCCGACATCATCGTCACAGCGTCGCGTGACAAATCCATCATCCTCTGGAAACTCACA
AAGGACGATAAGTCTTACGGTGTTGCTCAGCGTAGGCTCACAGGTCACTCTCACTTCGTGGAAGATGTTGTTCTCTCAT
CGGACGGTCAGTTTGCACTCTCCGGAAGCTGGGACGGTGAGCTCCGTCTCTGGGATCTTGCCACGGGAGAAACAACTCG
TCGATTCGTTGGTCATACGAAAGATGTGCTCTC

> SEQ ID NO: 6516  215047 6163_300329_1b
CCCACGCGTCCGGAAGGTGATGGTCACAAGGAATGGGTTAGTTGTGTTAGGTTTAGTCCTAATACTCTTGTACCAACTA
TTGTATCTGCTTCTTGGGATAAAACTGTGAAAGTTTGGAATCTCCAGAACTGTAAGCTGAGGAACTCTCTTGTTGGTCA
CTCTGGTTACCTCAACACTGTTGCTGTCTCGCCTGATGGTTCGCTATGCGCCAGTGGTGGGAAAGATGGTGTTATCTTG
TTGTGGGATTTGGCTGAAGGAAAGAAGCTTTACTCGCTTGAGGCGGGTTCGATTATTCACTCGCTTTGCTTCAGTCCTA
ACAGATACTGGTTGTGTGCTGCTACTGAGAATAGCATTAGGATTTGGGATCTTGAGAGCAAGTCTGTTGTTGAGGACTT
GAAGGTTGATCTCAAGTCTG

> SEQ ID NO: 6517  215047 1043268_301881_1b
GCTCAGGCAGAGGCGTGCTTAAGAAGAGAGAGAGAGAGAGAGAGACAGAGAGAGAGAGAGGAGAGAGAGAGAGAGAAGC
TGCAATGGCCGAGACCCTTAGTCCTGCGTGGGACCATGAAGGGGCACACTGACTGGGTCACGTCGATCAGTACGCCCATC
GACAACTCCGACATGATCATCTCGTCATCCCGCGACAAGTCGCTCCTCGTTTGGTCCCTCACCCGCGAGGAGGGCACCT
TTGGTGTCCCCAAGCGCCGCCTCACCGGCCATGCCCACTTCGTCCAGGACGTCGTCCTCTCCTCCGACGGCCAGTTCGC
GCTCTCGGGGTCGTGGGACTCCACCCTCCGCCTCTGGGACCTCAACACTGGTGCCACCACCCGACGCTTTGTCAGCCAC
ACCAAGGACGTTCTCTCTGTCGCCTTCTCCGCTGACAACCGACAGATCGTCTCCGCCTCGCGTGACCGCACCATCAAGC
TCTGGAATACCCTTGGCGAGTGCAAGTACACCATCCAGGACCAGGATGCGCACACCGGGTGGGTGTCGTGCGTGCGGTT
CTCTCCTGTGACAGCGAACCCAACTGTCGTTTCTGGATCGTGGGATCGGACTGTCAAGGTCT

> SEQ ID NO: 6518  215047 1097436_301444_1b
GACGGAGAAGAAGGGTCTAAGACCTTGAATCAGAGCAGCTATGGCGGAGACTCTAGTCCTCCGCGGCACCATGAAGGGC
CACACGGATTGGGTCACCTCCATCAGCACCCCCATCGACAACTCCGACATGATCATCTCCTCGTCCCGCGATAAGTCGC
TCATGGTCTGGAATCTCACCCGTGAGGAAGGCGTCTACGGTGTCCCCAAGCGGCGCTTGACTGGCCATGCCCACTTCGT
CCAGGATGTGGTCCTATCGTCCGACGGGCAGTTCGCCCTCTCCGGTTCGTGGGACTCGACTCTCCGCCTCTGGGACCTG
GCTACCGGCGCCACCACCCGCCGCTTTGTCAGCCATACCAAAGACGTGCTCTCCGTCGCTTTCTCTGCCGACAATCGTC
AAATCGTCTCCGCCTCCCGTGACCGCACCATCAAGCTCTGGAACACCCTTGGTGAGTGCAAGTACACCATCCAGGACCA
GGACGCGCACAACGGATGGGTCTCGTGCGTCCGGTTCTCCCCCGCCACCGCCAACCCCACCGTCGTCTCGGGATCGTGG
GACCGGACCGTCAAAGTGTGGAACCTCACCAACTGCAAGCTCAGGACCACGCTCTCCGGCCACTCGGGCTATGTCAACA
CTGTCACTGTGTCCCCCGATGGCTCACTCTGCGCCAGCGGTGGCAAGGATGGCGTCACCATGCTCTGGGACCTTGCTGA
A

> SEQ ID NO: 6519  215047 156116_301363_1b
CTCGACCACGCGTCGTATCGTTTACACTATCCTCTTCTTCTCCGCCTTCACAGCGAAACCGAGAGCAGCCACTCTCCCA
TTACCTGCCCGATAAAATGGCACAAGAATCACTAGTCCTCCGCGGAACAATGAAAGCCCACACCGATTGGGTTACAGCC
ATCGCCACCCCAATTGACAACTCCGACATGATCGTTACTTCCTCCAGGGACAAGTCCCTAATCGTCTGGTCTCTAACAA
AGGACGGCCCACAATACGGTGTCCCCCGCCGCCGTCTCACTGGGCACGGCCACTTCGTCCAAGATGTCGTCCTTTCCTC
CGACGGCATGTTTGCTCTCTCTGGTTCCTGGGACGGTGAGCTTCGTCTTTGGGATCTTCAAGCTGGGACCACCGCTCGC

FIG. 2 continued

CGTTTCGTCGGTCACACTAAGGATGTTCTGTGCGTTGCATTCTCCGTCGACAACCGTCAGATCGTTTCCGCTTCCCGTG
ACAAATCCATCAAGCTCTGGAACACTCTCGGTGAATGCAAATATACCATTCAGGATGGTGACTCACATTCTGATTGGGT
TTCATGTGTTCGTTTCAGCCCGAATACACTTCAGCCCACTATCGTTTCTGGATCCTGGGACCGTACTGTGAAAATCTGG
AACCTGACTAACTGTAAGCTGAGGTCCACTCTGGCTGGACACGCCGGCTACGTGAACACCGTGGCAGTCTCTCCTGATG
GTTCATTGTGTGCTAGTGGAGGCAAAGATGGTACAATTTTGCTTTGGGATTTGGCTGAGGGGAAGAAGCTCTACTCGCT
TGATGCTGGCTCTATCATTCACGCGCTCTGCTTTAGTCCTAACAGGTATTGGCTGTGCGCAGCTACTGAAACTAGCATT
AAGATTTGGGATTTGGAGAGCAAGAGCATTGTGGTGGATCTTAAAGTTGATCTCAAGCAAGAGAGTGAGATGGCTACTG
AAGGAACTATTGGCTCTGCCTGCAAAAACAAGATCATGTACTGCACCTGTTTGAGCTGGAGTGCTGATGGAAGCACGCT
TTTCAGTGGATATACAGATGGTTTGATTAGGGTTTGGGGTATTGGGCGTTATTAGGAGTTGGCCATAGTCATTTAAAGA
CATTTAGATTTCTCTTGAAATGTTTGAAGAATGATATCTGGATTCTCTCTGTTTCTCATGGTTTTGAGAGTTTTGTTGT
TCCAATTTTGGGATGTTATTT

> SEQ ID NO: 6520  215047  15012_300242_1b
CCCACGCGTCCGCGAAAACCCTAGTTTCAGAGGCATCTCCAGACACCGAAAATGGCGGAAGGACTCGTTTTGAAGGGCA
CCATGCGTGCACACACTGACATGGTGACGGCAATCGCCACCCCAATCGATAACGCAGACATCATCGTCTCAGCTTCCCG
CGACAAATCCATCATTTTGTGGAAACTCACCAAGGACGACAAAGCCTACGGTGTAGCTCAGAGGCGTCTCACTGGTCAC
TCTCACTTCGTTGAGGATGTTGTTCTCTCCTCCGATGGACAATTCGCGCTT

> SEQ ID NO: 6521  215047  110873_300047_1b
GGGCGGACGCGTGGGACCACCACCACCTGTTTGACGAAATGTCGGAATCGCTAGTACTCCGCGGCACAATGAGGGCCCA
CACTGACTGGGTCACAGCCATCGCCACCCCAGTTGACAACTCCGATATGATCGTCACATCCTCACGTGACAAATCCATC
ATCGTTTGGTCACTCACGAAAGACGGCCCACAATACGGCGTCCCCGCCGCCGCCTCACAGGCCATGGACACTTCGTTC
AAGATGTCGTCCTTTCATCCGACGGCATGTTCGCTCTTTCCGGATCTTGGGACGGTGAGCTCCGTTTATGGGATCTTCA
AGCTGGAACAACCGCCCGTCGTTTCGTCGGACACACTAAGGATGTTTTGTCCGTAGCATTTTCTGCTGATAACCGTCAG
ATCGTGTCAGCATCCCGTGATAAGAGCATCAGGCTTTGGAACACTTTGGGTGAGTGTAAGTACATTATTCAGGACGGAG
AGTCGCATTCTGATTGGGTCTCATGTGTTCGTTTCAGCCCAAATAATCTTCAGCCAACTATCGTATCCGGGTCGTGGGA
CAGGACTGTAAAAATATGGAACCTTACCAACTGTAAGCTCCGTGCTACGCTTGCTGGACACACTGGGTATGTGAATA

> SEQ ID NO: 6522  215047  253378_301625_1b
GCATAATACAACATGAGCCACAACGTTCTTCTTGTTCTCCGAGGAACCCTTGAGGGCCACAACGGCTGGGTTACCTCCC
TCGCTACTTCTTCCAACAACCCCGACATTCTGCTGTCCGGATCCCGAGACAAGTCCCTGATTGTCTGGTCTCTGACCCG
AGACGACACCAACTACGGTGTTCCCCGAAAGTCTCTTAAGGGCCACTCCCACATTGTCCAGGACTGTGCCATCTCTCAT
GACGGTGCTTACGCCATCTCCGGCTCTTGGGATAACACTCTCCGAGTCTGGGACCTGAAGACCGGTGTCTCCAATGACC
GATCTGTCGGGCACACCTGGTGACGTTCTTCCCGTCTCTTTCTCTCCC

> SEQ ID NO: 6523  215047  211766_300870_1b
GTCTTCACCAGCTAAAACTCTCTTTCCTCACCCATCTCTTCAATCCTTTGCGCAGAGGCGAGGCTGTACACAATGGCTG
AACAACTGATCCTCAAAGGTACCCTCGAGGGCCACAATGGCTGGGTTACCAGCTTGGCCACCTCAATGGAGAACCCCAA
CATGCTCCTGTCTGGTAGCCGAGACAAGACCCTGATCATCTGGAACCTCACACGCGACGAGACTCAATACGGATACCCC
AAGCGATCCCTCCACGGCCACTCCCACATTGTGTCGGACTGTGTCATCTCCTCTGACGGTGCCTACGCCCTCTCTGCCT
CTTGGGACAAGACCCTCCGTCTGTGGGAGCTCGCCACTGGCACCACCACCCGAAGATTCGTCGGCCACACCAACGATGT
TCTCTCCGTCTCCTTCTCCGCCGACAACCGACAGATTGTCTCCGGCTCTCGTGACCGCACCATCAAGCTGTGGAACACC
CTCGGTGACTGCAAGTACACCATCACCGACAAGGGCCACACTGAGTGGGTTTCCTGCGTCCGATTCAGCCCCAACCCCC
AGAACCCTGTGATTGTTTCCAGCGGTTGGGACAAGTTGGTCAAGGTTTGGGAGCTGCCCAGCTGCAAGCTGCAGACCGA
CCACATCGGCCACACCGGCTACATCAACA

> SEQ ID NO: 6524  215048  220046_300951_1b
CTGCCAGATTTGCCCAAGTGCAGCTGGGGGGGAGGTTGTTAGCATGTCGTCTCGGTGCCAATCACCCGGTATGTACCA
AAGGGAGATAGCCTCTTT

> SEQ ID NO: 6525  215055  219293_300929_1b
ACGGTGTCCATGCCAGGCGGAGGGGCGGGACCAGAGGGGTAAGCTCCGCGCCACCATGCCTTTACAAAAAGTATCATTG
ATG

> SEQ ID NO: 6526  215059  195707_300637_1b
AAAGAGAGCGTTTTTTTTTACTTGACTTTGGGTTTGGATGCTGGAATAGAAAGACGATACACAAGACAAGGAATCAGA
CAGGACTTGCACAAGACATAGATCACAAGAAACGCGACCTCACCTCATCCTGACGATGCCTTTCAACACAGAGCTCAC
CCGCCGCCTGGGCATTCGCGTCCCCGTCATCCAGGGCGGCCTCATGCACGTCGGCACCGCAGACCTCGCGTCCGCAGTC

FIG. 2 continued

```
TCCAACGGCGGCGGCCTGGGCATCATCACCGCCCTCATCTCCCCCACGCCCGAAGCCCTGCGCGCCGAGATCCAGCGCT
GCCGCACCCTCACCGACAAGCCCTTTGGCGTCAACCTGACCCTCCTCCCGTCCCTCCTCCCGCCCGACTACCCGGCCTA
CGCCCAGGCCATCATCGACGAGGGCGTCAAGATTGTCGAGACGGCCGGAAACTCGCCCGGCCCGGTGATTCGCCAGCTC
AAGGCCGCGGGCATCACGGTGCTGCACAAGTGTACGACGATTCGTCATGCCCAGAGCGCGATCAAGTTGGGCGTCGACT
TTTTGAGCATTGATGGGTTTGAGTGCGCCGGACATGTTGGCGAGAGCGACAT

> SEQ ID NO: 6527  215064 220374_300954_1b
GGACAAGCTCAACGCCATGATTGCCGGCACCGAGCTCGAAACCCACGACGTCAAGACCATCCTCCTCATGACGGCCCGC
GAACCCAGCCAAGCCCCCATCTTCAACCACGCCTCCATGGCGCACAACAACCACTTCTTCTTCCAGGGCATCGCCCCCC
AAGGCACCCCCATGCCCGACGAGCTGCGCCGCGAGCTCGAGGCCTCCTTCTCCTCCATCGAGTCCCTCCGCCTCGAGTT
CATCGTCACCGCCTCCGCCATGTTCGGCCCCGGATTCGTCTGGCTCGTCAAGGCCGGCCCGGGAGACTACCGCCTGCTG
CCCACCTACCTCGCCGGCTCGCCTTACCCGGGCGCTCACTGGCGCATGCAGTCCACCGACATGAACACCGTTGGCAATG
ATGGCTCTGCGCGCTCGTATCTTAGGAACCAGAGCCTCGGCGCTAGGAGGAGGGTCGGCGACTTGCCTCCGGGAGGTAT
TGAGTTGGAGCCGCTGCTGTGTCTTAATACTTGGGAGCACGCTTGGTTGCTGGACTGGGGTATGGGCGTGGATGGAAAG
GGCGGGAAGGCTGCCTATGTTGATGC

> SEQ ID NO: 6528  215074 175804_300522_1b
CCCCCCCCGGGGTCCTCGTCTCCTCGCGCCGCCGCCGCCGCCGCGGACGCCGCCATGTCGAAGCGAGGGAGGGGTGGGT
CGGCGGGGAACAAGTTCCGGATGTCGCTGGGTCTGCCGGTGGCGGCGACGGTGAACTGCGCCGACAACACCGGCGCCAA
GAACCTCTACATCATCTCCGTGAAGGGCATCAAGGGGAGGCTCAACCGGCCTGCCGTCGGCCTGCGTCGGCGACATGGTC
ATGGCCACCGTCAAGAAGGGGAAGCCCGACCTCGGAAGAAGGTCATGCCCGCCGTCATCGTCCGCCAGCGCAAGCCGT
GGCGCCGCAAGGACGGCGTCTACATGTACTTCGAAGATAATGCTGGGGTGATTGTGAATCCCAAGGGTGAGATGAAAGG
TTCTGCTATCACTGGACCCATCGGGAAGGAGTGTGCTGACCTTTGGCCTAGGATAGCTAGTGCAGCAAATGCTATTGTC
TGAGCTTGTTTGAATGAATTGTAAGACAGCTATATGACCTCAGGATCGTCTGCAAATGGTTTACTAGGACAACTGTGGA
ACTTTGTGATGCTATCGTTTGTTTGCCCGTTGCAGTTTTGTAGTGAACAGAAGTTGCCATCCATATGATATTTTATTTG
CCATCTAA

> SEQ ID NO: 6529  215074 25439_300074_1b
CCCACGCGTCCGCAAACATCAGAAGCCCTAGAGCTTGAGCCGTCGAAAATGTCGAAGCGAGGACGTGGAGGAACGTCTG
GTAACAAATTCAGGATGTCACTTGGTCTGCCCGTTGCAGCCACAGTGAACTGTGCAGACAACACTGGTGCTAAGAACCT
TTACATCATCTCTGTTAAAGGAATCAAAGGTCGTCTCAATCGGTTACCTTCTGCTTGTGTTGGTGACATGGTTATGGCC
ACTGTCAAGAAAGGTAAACCAGACCTCAGGAAAAAGGTTCTTCCTGCTGTGATTGTTAGGCAACGTAAGCCATGGCGCC
GAAAGGACGGTGTTTTCATGTACTTTGAAGATAATGCTGGAGTGATTGTGAACCCTAAGGGAGAAATGAAAGGTTCTGC
AATTACTGGACCTATTGGGAAGAGTGTGCGGATCTCTGGCCAAGGATTGCTAGTGCTGCTAACGCCATTGTCTGAAGA
TCATTTATCACTTTTGCTGGTTATGTATCTGTCTTCAACGAAACGCGAAATAGTTGGTGTTTTGAGTGTTTTAAGTAGA
GACGACAATCTTTTGTGAGCTTCAGACATATTTCCAGTTTCTAAGAGATTTTGCTTAGATTAAA

> SEQ ID NO: 6530  215074 194444_300763_1b
CCCCGGCCGCCGCCGCCGCCGCTTGTCACCCCTTCCGTTTCCAAGATGTCGAAGCGAGGGCGTGGAGGTAGTGCTGGTA
ACAAGTTCCGGATGTCACTGGGTCTGCCAGTGGCAGCCACTGTGAACTGTGCTGACAACACTGGAGCAAAGAACCTTTA
CATCATTTCTGTGAAGGGAATCAAGGGACGCCTTAACAGGCTTCCTTCTGCTTGTGTTGGGGACATGGTTATGGCTACT
GTGAAAAAAGGGAAGCCTGACCTGAGGAAGAAGGTCATGCCAGCTGTCATCGTGAGGCAGCGCAAGCCGTGGCGCCGAA
AGGATGGTGTCTACATGTACTTTGAAGACAATGCTGGAGTCATTGTGAACCCCAAGGGAGAGATGAAAGGTTCTGCCAT
CACTGGACCTATCGGAAAGGAGTGCGCTGATCTCTGGCCCAGGATTGCAAGTGCAGCAAATGCGATCGTCT

> SEQ ID NO: 6531  215074 127718_300472_1b
AGAGAGGGAGCAGCAGAGCAAGACCGTCAACAATGTCGAAGAGAGGTCGCGGAGGTTCCGCGGGGAACAAATTCAGGAT
GTCACTAGGTTTGCCGGTGGCAGCTACCATTAACTGCGCCGATAACACTGGTGCAAAGAACCTTTACATCATTTCGGTG
AAAGGTATCAAAGGAAGGCTTAACAGGTTGCCATCAGCTTGTGTGGGTGACATGGTCATGGCCACAGTGAAGAAGGGTA
AGCCTGATCTCAGGAAAAAGGTTATGCCAGCTGTCGTTGTTCGTCAGCGCAAGCCGTGGCGCCGAAAGGACGGTGTCTT
CATGTACTTCGAAGATAATGCTGGTGTAATTGTGAATCCCAAAGGCGAAATGAAAGGATCTGCAATTACAGGGCCAATC
GGGAAAGAGTGTGCTGATCTGTGGCCTAGGATTGCAAGTGCTGCTAATGCTATCGTATAGGAGAGCCTTTGAATAGTTT
GAGATTCTCGTTTTGATGGTTGATTTAAGTTTTTGGATATCAGATAGCTGTCTTATTAAGAGTTACAGAGTATTAGTTT
TGCTAGCTGTAAGAATTTTGCATCAAGAATACAGAACTAGTATCTGTTTCTACTGTTTGTTATTTACTTTTTCAGGTGA
ATGCTTTGACCAAAAAAA
```

FIG. 2 continued

> SEQ ID NO: 6532 215074 127752_300472_1b
CCCCCCCCCGCTTCTCACTGGCTAGAGGGAGAGTGAAGAGCAACGCCGTCCAACAATGTCGAAGCGAGGACGTGGAGGT
TCCGCTGGGAACAAGTTCAGGATGTCGTTGGGTTTACCGGTGGCGGCAACTATTAACTGTGCCGATAACACTGGTGCAA
AGAACCTTTACATCATTTCGGTGAAGGGTATCAAGGGAAGGCTTAATAGGTTGCCTTCAGCTTGTGTTGGTGACATGGT
TATGGCCACTGTGAAGAAGGGTAAGCCTGATCTCAGGAAGAAGGTTATGCCTGCTGTCGTTGTTCGTCAGCGCAAGCCG
TGGCGCCGAAAGGATGGTGTTTTCATGTACTTTGAAGATAATGCTGGCGTAATTGTGAATCCCAAGGGTGAAATGAAGG
GATCTGCCATTACTGGTCCCATTGGGAAGAGTGTGCTGATCTTTGGCCAAGGATTGCAAGTGCTGCCAATGCTATCGT
TTAGTTTGAGAATTGTGTTTTCCAATAGTTTATTTGAGTTTTTGAATATCAGGGAGTTCTTTTCTTGGTAAGAATTAGT
GCAACTGGCTATGAGAATTTTGCTGCACTCCAAATGTTTTTGTCTATGTAGGACATTACTGTTTCCTTTTCTTGTTGAT
GTGTTTGTTACGAGTAAAAGAAAATATGTTGAACTAATTTATTCTCT

> SEQ ID NO: 6533 215084 1170608_302038_1b
GGAAAGAAAAGCTTGACGACGGAGCTATGGCGAAGCCTGTGGGGGGAGGAGCGAAGAAGGCGAGGGCATCCCGGAATAG
GGAGGTGGTGCGGGGAGTCGGGCGGTGTAGCCGGTCCCAGATGTACCACAAGAGGGGCTTGTGGGCCATCAAGGCCAAG
AACGGTGGGTCCCTCCCTGCCCATGGTAAGACCCAGGTCGCCCCTCAAGCCCCCTTAGCCAAGGCCCCCAAGTTCTACC
CTGCCGACGATGTCAGAAAACCCTCTGCAATAAGCGCATTGCTAAGCCTACTAAGCTCAGATCCAGCATTACACCCGG
AACTGTTCTAATTCTCCTTGCTGGACATTTCAAGGGAAAGAGAGTTGTCTTCCTGAAGCAACTTGAGTCTGGATTGCTT
CTTGTCACTGGCCCTTTCAAGATTAATGGGGTTCCTATTAGGCGTGTGAATCAGGCATATGTGATTGCAACCTCGACTA
AGCTCGACACAAGTTCCGTCGACACCAGCAAGTTCACCGATGCATATTTCAAGAGGGAGGTTGAGAAAAAGAAGAAGGG
CGAGGCTGAGTTCTTTGAGGCTGAGAAGGAGAAGAAGACCCTCCCTCCTGCAAGGAAGGAGGATCAGAAAGAGCTCGAC
GCTAAGCTGGTTCCAGTCATAGAGAAGATTCCAGACATGAAGGCATATTTGATGGCTAGATTCAGTCTCAAA

> SEQ ID NO: 6534 215084 1170836_302040_1b
GGCAGGAAGAAGGAAGGAGGAGAGAGAGAGAGAGAGAGAGGGAGAGGGAGAGGGAGAGATGGCAAAGCCTGAGGGAG
GAGCGAAGGGGCCAAGGGCATCCCGGAACAAGTCACTGGTTCGAGGCGTGGGCAATGCAGCAGGTCGCAGATGTACCA
CAAGAGGGGTCTATGGGCGATAAAGGCGAAGAACGGGGCTGTCTACCGGTCCTCACCAAGCCCAAAGCGATGGACACC
TCGGACTCCAAGGCCGCCGCCAAAACCCCCAAATTCTACCCCGCCGACGACGTGCCCAAACCCCTGGTTAACAAGCGTA
TAATCAAGCCCACCAAACTCAGAGCTAGCATTACCCCTGGAACTGTGTTGATCCTCCTTGCTGGACACTTTAAGGGAAA
GCGAGTTGTATTCTTGAAGCAGCTTGAGTCTGGACTACTTCTTGTGACAGGTCCGTTCAAGATTAACGGTGTCCCCCTC
AGGCGTGTGAATCAAGCATATGTGATTGCAACCTCCACAAAGCTTGATATCAGCTGCGTCAATGCTAGCAAGATCACTG
ATGCGTACTTCAAGAGAGAGGTAGAGAAGAAGAAGAAGGGCGAAGCAGAGTTCTTCGAGGCTGAGAAGGAGAAGAAG

> SEQ ID NO: 6535 215084 120093_300083_1b
CCCCCCCCCCCGAAACCTTCACTGCTCCATATATGGATGCACATTACTAGGTTTAGGGTTTTATTGAATCAGCATTCTG
CAAAAGCAAAGGAGAACTTCTACTTTCAGCAATGGCGGCAAAGAAGAGTCCCCGTAATCCAGAGCTGATTCGTGGAGTC
GGAAAACTTTCCCGTTCCAAGATGTATCACAAAAAGGGTCTTTGGGCAATCAAGAAGAAAAACGGCGGCTCTTTCCCCG
TCCACAAAAAAGCCGCCGCCGTCGCACCACCGGCCGTCAAACCACCCAAAATTTACCCTGCCGATGACGTGGCAAAACC
CCTTGTCAACAAACACAAACCAAAACCCACGAAACTTAGAGCAAGTATTACACCTGGTACTGTTTTAATTATCCTTGCG
GGTAAGTTTAAGGGTAAGAGAGTTGTGTTTTTGAAACAGCTTAAATCTGGGCTTTTACTTGTTAGTGGACCATTTAAGC
TTAATGGTGTTCCTTTGAGGCGCGTGAATCAAGCTTATGTTATTGGTACTTCAACTAAAGTGGATATTTCTGGTGTGAG
TGTTGAGAAGTTTGACGATAAGTATTTTGCAAAGCAAGCTGAGAAGAAACAGAAGAAGGGTGAGGGAGAGTTCTTTGAA
GACAAGAAAGAGGAGAAGAAGAATGTGCTTCCACAGGAAAAGAAGGATGACCAGAAAGCTGTGGATGAAGCATTGATCA
AAGCCGTTGAATGTGTTCCTGAATTGAAGGCTTATTTGTCAGCTAGGTTCTCCCTCAAGTCGGGCATGAAACCCCATGA
GCTTGTCTTTTAGGCTGTGAGATGTTTAAAATACTCTTTATGAAATTGATTTTGTTAGATTTATTTTGGGTTATGTTCT
GTTTTGGACCT

> SEQ ID NO: 6536 215084 194843_300767_1b
CCGGCTCTCGCCCTCTCCGCACCAGCTCCCCGCCGAGAGCGCCGCGAGCTGATCCAATGGCGCCGACGTCGAAGCTGTC
GCAGGGCATCAAGAAGGCGTCGCGGTCGCACACGTACCACCGCCGCGGGCTGTGGGCCATCAAGGCCAAGCACGGCGGC
GCCTTCCCCAAGGCCGAGAAGCCCGCCGCCGCAGCCGCCGCCGCCGCGCCCAAGTTCTACCCCGCCGACGACGTCAAGC
CCGCCAGCCCAGCACCCGCAAGCCCAACCCTACCAAGCTCAGGTCGTCCATCACGCCTGGGACAGTGCTGATCCTGCT
CGCCGGGAGGTACATGGGGAAGCGCGTCGTGTTCCTCAAGCAGCTCAAGTCCGGCCTGCTCCTCATCACCGGACCTTTT
AAGATCAATGGAGTGCCCATCCGCCGTGTGAACCAGGCCTACGTCATTGCCACATCCACGAAGGTTGACATCTCTGGTG
TTAAGGTGGATAAGTTTGATGACAAGTACTTTGCCCGGGACAAGAAGGCAAAGGCCAAGAAGACCGAGGGTGAACTTTT
TGAGACAGAGAAGGAGGCAACCAAGAATCTGCCCGACTTCAAGAAGGATGACCAGAAGGCTGTGGATGCTGAGTTGATC
AAGGCTATCGAGGTTGTCCCAGACCTGAAATCCTATCTTGGTGCCCGGTTCTCTCTCAGGTACGGCGACAAGCCCCATG
AGATGACATTCTAAGTTAGTCGGTACAAGTTTCAAGTTCTGAGGAAGTCTTTTT

FIG. 2 continued

> SEQ ID NO: 6537 215084 220428_300955_1b
ATATCAGACACCCGAGAGAGTCAATATGTCGGCCAAGCCCACGACCAAGCAGTTCGGGAAGTCGACCCGGGAGGTTCCC
GCCTCCGCGGACCAGGCGAAGAAGTGGTACCCTGCCGACGACGAGAGCGCCCCGAAGAAGGTTCGCAAGTCCGCCCGAT
ACGTCATCGCCACCTCCTACAAGGTCGACATCTCCGGCCTTGACGCCGCCAAGATTGACGGAGATCTCTCAGCCCAAGT
ACTTCACCGCCGAGAAGGCCAAGGAGAAGGCTTCCGCTGAGGCTTTCTTCAAGC

> SEQ ID NO: 6538 215084 252006_301668_1b
AGCGTCGCAAATCAAAGATGCCTCCTAAGGATAAGAAAGCCGCTTCCACCGGTGCTAAGACCGAAGCCGCAGGTACTAA
AAAGGCTGGTTCCGTCAGAATCTCCAAGTGGTACCCAGCTGATGATGTCAGACGTATCCGCAAAAACCCTGCTAAAGCT
CCCAAGCCTGTCGCCCTCAGAAAGAACATTGCTCCAGGACAGGTTTTGATCCTTCTTGTAGGCAGGTTTAAGGGAAAGA
GAGTTGTCTTCTTGAGACAACTCAAGTCTGGTCTACTCTTGGTCACTGGTCCTTATAAGATTAATGGTGTTCCTCTTAG
AAGAGTTAATCAAAGCACTGTCATCCACACCTCTACTAGAGTTGACCTTGGTCAAGCTAAATTCGATAAGATTGATGAT
GATTACTTCAAGAGAATAAAGGCCAAGAGAACCAAGAAGACTGAAGAAGCTTTCTTCTCTGCTGGTACCCAAGAAAAAC
CCCAAGAAGAGAAAGACAAGCTTAATGAAGAAAAAGACTCAGGTCGAAGTAGATACTCCTATTCTAGCCGCTGTTAA
GAAGACCGAACTCTTAAGACAATATCTCAGAACAAGATTCACCCTCTCTAAATACACTAAGCCTCATGAATTGGTCTTC
TAAGGGTTCAGAGACCTGCTCCAAAAACATGTGGATATGCTTGTATGAAATAGCGAAGTATCTATCCTCG

> SEQ ID NO: 6539 215084 224010_300978_1b
ACAACACCCTAAACATCAAAAATGTCCAAGCAGATCGGAGGAGCCAAGAACGGCGGTAGCCGAACCGTCCCCACTGAGA
AGGCCCCCAAGTGGTACGTCGCTGAGCCCACTCACGTCAAGATCCCCACCGTCCAGAACAAGTCCAAGCTGCGACCTTC
TCTTGTTCCCGGTGCCGTACTCATTCTCCTTGCCGGCCGATTCCGAGGCAAGCGAGTTGTTCTCCTCAAGTCTCTTGAG
GATGGCACTCTCCTTGTGACCGGTCCCTTCAAGGTCAACGGTGTCCCTCTCCGACGAGTCAACGCCCGATACGTCATTG
CCACCTCCACTAAGGTCGATGTCTCCGGTGTCAAGGCTGACAAGTTCACCCCTGCCTACTTCGCTCGATCTTCCGCCGA
CAAGAAGGCCGAGAAGCAGTTCTTCGCCGAGGGCAAGCAGAAGGAGCTCAAGGCCGAGCGAGTCGCCGACCAGAAGGAC
GTCGATGCTGCTCTCATTGCCGAGATCAAGAAGACTCCTCTTCTCAAGCAGTACCTGGCTTCCCAGTTCTCTCTCAAGT
CTGGTGACAAGCCCCACCTGCTCAAGTTTTAAATTATAAAAACACAAAATGGAACATGGGGGTGGAAAATGGTGGACGG
TGGTGAAGCCGTCGTCTGTCAAAAGCTGTATAGCAATG

> SEQ ID NO: 6540 215084 217172_300905_1b
ACATATCAGACACCCGAGAGAGTCAATATGTCGGCCAAGCCCACGACCAAGCAGTTCGGGAAGTCGACCCGGGAGGTTC
CCGCCTCCGCGGACCAGGCGAAGAAGTGGTACCCTGCCGACGACGAGAGCGCCCCGAAGAAGGTTCGCAAGTCCGTCCG
AACTTGGGCCCCCCGAAAGACCCTCCAGCCTGGTACCGTCCTGATCCTCCTCGCTGGCCGCTTCCGCGGCAAGCGTGTC
GTCCTCCTCAAGACTCTTGACCAGGGTGTTCTCCTCGTCACTGGTCCCTTCAAGATCAACGGCGTTCCCCTGCGAAGAG
TCAACGCCCGATACGTCATCGCCACCTCCTACAAGGTCGACATCTCCGGCCTTGACGCCGCCAAGATTGAGGAGATCTC
TCAGCCCAAGTACTTCACCGCCGAGAAGGCCAAGGAGAAGGCTTCCGCTGAGGCTTTCTTCAAGCAGGGAGAGAAGCCC
CAGAAGAAGGAGATCAACAGCTACCTCGCCAGCACCTTCAGCCTGCGGAAGGGTGACAAGCCTCACGAGATGGCGTGGT
AAATTTGATTCAAACACAAAATCTCTCTGGCAGGTCCAAAGCACGGGGTGGAGTTTACTGGGGTGTTGGTCAAGATGCG
GGTTGTAAAACGGAAAGG

> SEQ ID NO: 6541 215106 217379_300907_1b
GCGCCGACCCGAGCTGTGGCCGGTGTGGCAAGCGGCCTGTCCCGGCTGGTGCCTCGTTCTCGTCCACGGCTGCCAATTG
CCTCTGTTTCTATTACAGCAAAGACGACGGCATCATCGCGATGGCACTCGGGCTTCTCGTCGGTCAACCCCAACGAGGT
CTCACACTTCAATGCCCTCGCCGCTGAGTAGGTGGGAGCCGCACGGATCGTCGCGCCTACTACACCTCATGAACCCGCT
GCGCCACGACTTCATCCGCTCCTGTCGCGAGTCCTCCGACGACCTCAATTCCATCACATACCTCGACATTGGCTGCGGC
GGCGGCATCTTCGCTGAGAGCGCCGCCCGCCTAGCCACCACCAAGCACGTCACCGCCATCGATCCCACACCGTCCGTCC
TCAACGTCGCAAAAGCACATGCCCGCAAAGACCCT

> SEQ ID NO: 6542 215107 220918_300940_1b
GATTGATTGCTCAAACATCACAACATCAGTCAATCTCTCCAAATGGCTCGGTCAGCCGCCACAACGGCCACCAAAGAGG
CCAAGCCTCAGGCTACTGCTGCTGCTGCTGCTCCTCCAGCTCCAGCTCCAACC

> SEQ ID NO: 6543 215120 227173_301008_1b
AAGAAGGGGGTGGCGAAACCTCACCCTCCATCCTCCATCCTCTCCTTTCTTCCTTCGAGGAGGAGGAGCTATATATAGA
CGGGGATGGTTCATCTAGCCTCCTCACCGGTTTTGATTTGATCTGTGTGATTTGAGTGAGTGAGTGAGATTCTTTGGAG
GAGGGATTTTGGTTTGGTTTGGTTTGGTGGTTTGTGCGGGATTTTGTGGGGAGGAGAGTAATGGCGACCGCAGGGAAGG
TGATCAAGTGCAAAGCGGCGGTGGCATGGGAGGCCGCGAAGCCGCTGGTGATCGAGGAGGTGGAGGTGGCGCCGCCGCA
GGCCATGGAGGTGCGCGTCAAGATCCTCTTCACCTCGCTCTGCCACACCGACGTCTACTTCTGGGAGGCCAAGGGACAG
ACTCCCGTGTTCCCTCGGATCTTCGGCCATGAAGCTGGAGGTATTGTGGAGAGTGTTGGAGAGGGTGTGACTGATCTTG

FIG. 2 continued

CCCCTGGTGACCATGTTCTCCCTGTGTTCACTGGGGAGTGCAAGGAGTGTGCCCACTGCAAGTCAGCAGAGAGCAACAT
GTGTGATCTGCTCAGGATCAACACTGACAGGGGTGTGATGATTGGTGATGGCAAATCACGCTTTTCCATCAA

> SEQ ID NO: 6544 215120 274355_200056_1b
AAGGGAAGAAGAAAGTGGGGAAAGAAAATAATAATTTAAGTGGGCTGGGCTTTGACATGGAAAAGAACGGCTTAGTAAT
AATTGAAGTTAGAATCGCATCTATTTGAAGTGCCACTCATCCCTCAGAAAAACACTGTTAGTATTTTCACTCACAAATT
CATTCTGTGGTCCGAATTGGAGTTCATAGATCATGGCTACACAAGGTCAAGTCATCACCTGCAAAGCTGCGGTGGCCTG
GGAACCCAACAAACCTCTGGTGATCGAGGATGTACAGGTAGCTCCACCGCAGGCCGGTGAAGTCCGTGTTAAAGTTCTC
TATACTGCTCTCTGCCACACTGATGCTTATACCTGGAGTGGCAAGGATCCTGAAGGTCTCTTCCCATGTGTGCTTGGTC
ATGAGGCTGCAGGGATTGTGGAAAGTGTCGGTGAAGGAGTGACTGAGGTTCAGCCAGGAGACCATGTTATACCTTGTTA
CCAGGCTGAATGCAGAGAATGCAAGTTCTGCAAATCAGGAAAGACCAACCTTTGTGGTAAAGTAAGGGCGGCTACTGGG
GTAGGAGTTATGATGAATGACCGCCAGAGTAGATTTTCTATCAATGGAAAGCCAATCTATCATTTCATGGGAACTTCAA
CCTTCAGTCAGTACACTGTTGTCCATGATGTTAGTGTTGCAAAGATTGACCCAGTAGCTCCTCTGGAGAAAGTCTGCCT
TCTTGGATGTGGTGTTCCAACCGGCCTTGGAGCTGTTTGGAACACTGCAAAAGTTGAACCAGGTTCCATTGTTGCTGTC
TTTGGCCTGGGCACAGTTGGTCTTGCTGTGGCG

> SEQ ID NO: 6545 215120 3904_300392_1b
CCCACGCGTCCGAACAGAGGAGAAATATGGAAACACAAGGCAAAGTAATCACTTGCAAAGCTGCTGTGGCATGGGGAGC
TGGAGAGCCTCTAGTAATGGAAGATGTAAAAGTGGATCCTCCTCAAAGATTGGAAGTGAGAATTCGAATCCTCTTCACT
TCCATCTGTCACACTGATCTCAGCGCATGGAAAGGCGAGAACGAGGCTCAGCGAGCATACCCTCGAATCCTTGGCCATG
AGGCAGCAGGGATAGTGGAGAGCCTAGGGGAAGGTGTGGAGAAGGATGATGGCAGGAGATCATGTGCTCCCTATTTTCAC
AGGAGAGTGTGGAGACTGCAGAGTGTGCAAGCGAGACGGAGCCAATCTGTGCGAGAGATTCCGAGTGGATCCGATGAAG
AAGGTGATGGTAACCGATGGAAAGACCAGATTCTTCACCAGCAAAGACAACAAACCAATCTACCATTTTCTCAACATAT
CCACCTTCTCCGAGTACACGGTCATAGACTCGGCCTGCGTGCTCAAGGTGGACCCTCTGTTTCCTCTGGAGAAGATAAG
CCTCCTCAGCTGCGGTGTCTCCACTGGAGTCGGTGCGGCGTGGAATGTGGCTGATATTCAACCTGCCTCCACCGTCGCT
ATTTTTGGACTTGGCGCTGTTGGACTTGCCGTGGCTGAAGGTGCAAGAGCCAGAGGAGCCTCTAAAATCATTGGGATCG
ACATCAACCCTGACAAGTTCCAACTAGGCAGAGAAGCAGGGATTAGTGA

> SEQ ID NO: 6546 215120 1097570_301445_1b
ATTTATTGAAGAAGGTAATCAGTTTTCATTTCTCTCCTTGCTCCTGAACTACTCCAGCTATGGCTTCCACTCAGGGCCA
AGTCATCACTTGTAAAGCGGCGGTCGCATGGGAGGCGAAGAAACCTCTCGTGGTAGAGGAGGTTCAGGTGGCCCCTCCT
GCCCAAGGAGAAGTCAGGATCAAGATTTTGTACACTGCATTATGCCATACCGATGCCTATACGCTCGACGGACTGGATC
CCGAAGGCCTTTTCCCCTGCATTCTCGGCCATGAGGCCGCAGGGATTGTTGAGAGCGTGGGGGAGGGAGTGACAGAACT
GCAACCAGGTGATCACGTGATCCCTTGCTATCAAGCAGAGTGTAGGGAGTGCAAGTTTTGCTTGTCGGGGAAGACAAAC
CTTTGCGGCAAGGTGAGGGTTGCAACAGGGGTTGGGGTCATGCTGAGCGACCGCCAGAGCCGGTTCTCTTGCAAGGGGA
AGCCCTTATATCACTTCATGGGGACGTCGACTTTTAGCCAATACACAGTAGTCCACGATGTCAGTGTCGCCAAGATCAA
GCCCGAAGCTCCCCTAGAGAAGGTTTGCCTCCTCGGATGCGGCATTCCCACAGGTTTGGGGGCAGTTTGGAATACTGCA
AAGGTTGAACC

> SEQ ID NO: 6547 215138 231946_301235_1b
GCTTTGCGAATCGAGATGTTCCGGGCAGCTGGAGCGATCGCGACGCGCGCCAGGTCCGGCGCCGCGGCAGCCGCTAGCA
CTGTAAGTATCAGGGCAAGC

> SEQ ID NO: 6548 215138 253356_301625_1b
AACTAACCCACCCATCACACAATGTTCGCGCTCCGAGCCTCAAGAAACGTTCTGAAGAGCCGACCCGTGTTCGCTCGAG
GCCTGGCCTCCACCGCCGAGGCCCCTAAGGTGCCTGCCCCCGAATCAAGAAGTTTGGCATCTACCGATGGAACCCAGA
CACCCCCGAAAAGAAGCCCGAGCTCAAGGAGTACGAGGTCGACCTGTCACAGTGTGGCCCCATGGTGCTGGACGCGCTC
ATCAAGATCAAGAACGAGCAGGACCCCACCCTGACGTTCCGACGGTCGTGCCGAGAGGGCATCTGTGGCTCCTGTGCCA
TGAACATTGAGGGCCGAAACACCCTCGCATGCTTGTGCCGAATCAATCCCGACATCGCCAAGGAGGAGAAGATCTACCC
TCTGCCTCACATGTTTGTCGTCC

> SEQ ID NO: 6549 215138 158862_200020_1b
AATCTATCCAATCTCCGCGTCTTTGGTTTCCCAAGGTTTGTCATCAATGGCGACCGGTTTAATCCGACGAGCGATTTCT
AGGGTCCACTCATCGCCGGTGGCGAAGCTAGTTGTCGCCCGAGCACACGCATCGGAGGCCCAAGCCCATCAATCAGAAT
CCAAGCAACAGCCAAACATCAAGTCATTTCAAATTTACCGTTGGAGTCCAGACAATCCAGGTAAACCCGAGCTCAAGGA
ATACAAAATCGATCTGAAAGAATGTGGCCCAATGGTCTTAGATGCTTTAATAAAAATCAAAAACGAAATCGACCCATCA
CTTACGTTTCGTAGATCCTGTAGAGAAGGGATCTGTGGGTCCTGTGCTATGAATATTGATGGTTGCAATGGACTTGCTT
GTTTGA

FIG. 2 continued

> SEQ ID NO: 6550 215150 187755_300680_1b
CCGCCGCCGCCCTCCTCTCCGGGAAGAAGAGACCAGAGCGAGCGCGCGCGCCGCCGGAGCAAACCCCTCCTCCTACCCT
TCAGCCATGGTGCTCTCCAACGACATCGACCTGCTGAACCCGCCCGCGGAGCTGGAGAAGCTCAAGCACAAGAAGAAGC
GCCTCGTCCAGTCCCCCAACTCCTTCTTCATGGATGTCAAGTGCCAGGGCTGCTTCAGCATCACTACTGTGTTCAGCCA
CTCCCAGACAGTGGTGGTCTGCCCGGGCTGCCAAACCGTGCTTTGCCAGCCTACAGGTGGAAAGGCCAGGCTAACGGAG
GGGTGTTCCTTCCGCCGCAAGAATGATTAAGATCTAAATATCTGAAAGCAAAAAAAAAGAAAAGGCTTGAACGAGCTTA
GTTTCTCCAGGATGTAGTCTGAAAATTTTGCAATGCCTGTCAAGTGAACCCCATGTTTGGTAATTTAATCTCTGGGATT
ATGTCATGACTCTGGTACTTTGTTGGTTGGTCTGGAGAGTAAGATGAGATGTAGGGCTACGTGAACAACCGTATGCTTG
GCATGAATGAATTGATATTCCTGGGT

> SEQ ID NO: 6551 215150 255094_301641_1b
CATCTCAGTCGGTCTGTCATTATTATCGACCCACGCGTCCGCGCAGGTTCGAACATCCAACCTTCCACGGACCTGCCGC
CATGGTGCTCTCTAATGATATTGATCTTCTACACCCTCCAGCTGAGCTGGAAAAGAAAAAGCATAAGCTAAAACGTCTC
GTGCAGTCCCCAAACTCATTTTTCATGGATGTGAAATGTCAGGGGTGCTTTAACATAACGACTGTATTTAGCCACTCAC
AGACAGTGGTGGTTTGTGGTAACTGCTCTACTGTTTTATGTCAACCTACTGGTGGTAAGGCTCGCCTGACAGAAGGATG
CTCTTTCAGGAGAAAGAGCGAGTAGACTGGGCATTGCTTGCCTCCTACCATTGCAAGATTTAATTGCACGGGTATTTAA
TGTCTTCGTTGAGGAGCATAGAGGATAACGAAGTATGTTGAGTCGGTCATTTCGAGTGTTGTTTCCTGTCATCATTACT
AGACACTGTTGAATCATCGGCATAGAATCTTGGCACTATGATTTTGGAAAAATGCATAGAATTTTAGAAACATGATATT
GGAGACATTTGATTGTTAGCACTTTTGAAGAATATTAAATCATATGATAGACATTTTATTGTTAGCACTAAAAACCAAA
ACACA

> SEQ ID NO: 6552 215150 196440_300703_1b
CCCGAAAAACCCTCCGGCTCATTCTTGCCCACGCCGCGCCGCCTCCTCCTCCTCCTCCTCCTCCTAGGGCTTCTTC
TTCTTCCCCTCCTCCGAGCGCCGCCGCCGCCGCCGCCGACGAGATGGTGCTATCCAACGACATCGACCTCCTCAAC
CCTCCCGCGGAGCTCGAGAAGCACAAGCACAAGAAGAAGCGCCTCGTGCAGTCCCCCAACTCATTCTTCATGGATGTCA
AGTGCCAGGGATGCTTCAACATAACAACCGTGTTCAGCCACTCCCAGACTGTTGTTGTGTGCCCAGGCTGCCAAACGGT
GCTCTGCCAGCCCACAGGAGGGAAGGCCAGGCTCACCGAGGGCTGCTCCTTCGCCGGAAGGGCGACTAGAGTGAGTCG
TTCATTCAGAAGACGATGTTTTGTGCCAAGCAAGTGTTCCACCTCCAAGGATGTAGTCTTCGAGTTTTGCTCTAGTTA
GCACAGAAATATCTATTTTGCAAGTGTTATGTTATGTATCCCGAGCTACTTCTGAACATTGTCATCTTGGAGGTCTAAT
TAGTTGGGTTTATTTGAGATTGTTCGATGAACTAAATTGGTGGTTGATAGTCTCAGGGGCAAACTGTTTGAATTATAAG
CTGGTGTGGAAGATATTTATTGACATCTCGTTTTGTGTTTGACAGTAGAAAGCTTTACCCATTCGTCGGTTTTTACT

> SEQ ID NO: 6553 215150 50084_300166_1b
TTGCCGTTGCTTGCTATCTTTCGCCGTCGTCTCTTTAGCTTCTTGCGAAGATGGTTCTTCAAAACGATATCGATCTGCT
TAACCCACCTGCTGAGCTTGAGAAGAGGAAGCACAAGCTCAAGCGTCTTGTCCAGTCTCCCAATTCCTTCTTCATGGAT
GTGAAGTGCCAAGGCTGCTTCAACATCACTACTGTTTTCAGTCACTCGCAGACTGTTGTGGTGTGCGGAAACTGCCAGA
CAATTCTGTGCCAGCCTACAGGAGGAAAGGCAAAGCTCACCGAAGGATGCTCTTTCAGGAGAAAGGGTGATTGATTGAA
GCAATCATCAAAATAATGAAGGCTGTTTCTTTTTCTTTTTTTT

> SEQ ID NO: 6554 215150 1007478_301400_1b
GCGGTCTCTTCCTGCTGAAGCTACCGCCGGCCTCCAGCCATGGTGCTCTCAAATGACATTGACCTTCTGCACCCTCCAG
CCGAGCTGGAGAAAAGAAGCACAAGCTAAAACGTCTTGTGCAGTCTCCAAACTCTTACTTCATGGATGTGAAATGCCA
GGGATGCTTCAACATAACGACTGTGTTTAGCCACTCACAGACTGTGGTGGTCTGTGGGAGCTGCTCCTCTGTCTTGTGT
CAGCCTACCGGCGGAAAGGCTCGCCTGATGGAAGGATGCTCTTTCCGAAGAAAGGGTGATTAATTTGATAGACCATCTT
TACCCCTCACCCCCGTAAGCATATTGCTAGAGATTGGTGGTGGTATTACATCTGCTGATTGTTCCCGAGGTTTGTGGGT
CTGTTGCGGTAGGATTAGGTAGATGAATTAGCATGGAATCCTGACAAACAGTTTTGGCAACATTCAAATTAATTGAAAA
ACATTACTTCATATTATGCATTGCTTAATGCAAGTGATAGCATTTAATTTTGATTTTTGGCAACATTCAAATTGACTGA
AAAACATTACTCCATATTATGCATTGTTTAATGCAAAAA

> SEQ ID NO: 6555 215150 128865_300478_1b
CCCACGCGTCCGCATCTTCGCTGCTTGTGGCGCAACACACAGCCTCCCCTCACTCTCATTTCAATTCATCTTGCGAAAA
TGGTTCTTTCAAATGATTACGATATGTTGAACCCGCCAGCAGATGTTGAAAAGAGGAAGCATAAGCTCAAACGTCTTGT
TCAGTCTCCTAACTCTTTCTTCATGGATGTTAAGTGCCAAGGCTGCTTTAACATAACAACTGTGTTCAGCCATTCTCAG
ACGGTGGTTGTTTGCGGAAACTGCCAAACAGTTTTGTGCCAACCTACTGGTGGTCGTGCTAGACTTACCGAGGGATGTT
CTTTCAGGAGAAAGGGAGATTAGAGAGATAGCATTCAATTTACATTGAAATGAATCTTCATATGGGAATTTTGATGCAG

FIG. 2 continued

TACTCTATTTTAATTTTCACTATCTAGTCTTAATTAAGAACAAGTGTTTTTGAGTCTACTATGACTTGATTATGTTATG
GTTCTAATTTGAGTTATCCCTTTTGAAATTGGATTGTTACTACAATGTTATCTCTGTGGAGGTTCCCTGAAAGTAGNTT
TCTATTCTTTTTATT

> SEQ ID NO: 6556 215150 120487_300385_1b
TTCATCTCAACAGACTCGGAGGCTAAATAAGCTTTACTGCTTGGCCAGGCTTCTCTTTTAATCTCGCGAAAATGACTCT
CCCAAATGATGTCGACTTGTTGAACCCTCCTGCCGAGCTGGAGAAGAGGAAACACAAACTCAAGCGTCTTGATGTTAAG
TGCCAGGGTTGCTTTAACATAACAACTGTGTTCAGTCACTCGCAAACTGTCGTGGTGTGCGGGAACTGCCAGACGGTGT
TGTGCCAGCCGACTGGTGGGCGTGCTAGACTCACCGAGGGTTGTTCTTTCAGGAGAAAGGGAGACTAAAGATGAGAGAA
AGACTACTTGCTTTGCTTTTAGAGTGGAAGTGAAAAGATTTTATATGGGAAACAAAAAGTCAGTTTTGATGCAATCCTG
TTTGTTTAATGGTCCTTTTTGTTTTATCTGTAGTCTTGAGTAAGAAAGAACAAGGGTTTTGAATCTGTTTTTTTTTTTT
TAAATTGGATTTTGACTANGAAAAACAATAAAG

> SEQ ID NO: 6557 215150 1110857_301539_1b
TCTCATCGATCTCATCTCACTGCGCCTGCAACCATGGCTTGTTGTAGGCTGAATTTGGAGATGCATGGAATTCGAGAGT
GAAATGATGATTGTGGCTGAAATAGTTGAAAGTTGGAACCCCAATTTCTTGGAAGGTTCTATCAAATGACATTGATCTA
CTGCACCCCCCAGCTTCTCTGGAGAAAAAGAAGCATAAATTGAAACGTCTGGTGCAATCTCCGAATTCATTCTTCATGG
ATGTCAAATGCCAGGGCTGCTTCAACATTACCACTGTGTTCAGTCATTCACAAACTGTGGTTGTATGTGGAAATTGTTC
GACTGTCCTATGCCAACCTACAGGAGGAAAAGCTAGACTAACTGAAGGCTCTTCTTTCAGAAGAAAGGGCGATTAAGCT
AAATTTCCAACGGTTCATATGATCTCTCTTTTAGCTCTGCTCGAAAAGAAACATTGATATGTTTTCAATTTCAAGGCTT
TTGTGATTTCGGTAAAATTTGTCAATCAGTTTTGGGTATATGTATGAGGCAGCTTAATGAAAATGCTTAATTAGTGTTC
AAGGGTATATTATGTTAGCCCAAATGGGCTGAGTATTG

> SEQ ID NO: 6558 215150 1119276_301896_1b
GGCTGCCCATGGTCAATTAGCATACTGCATGACTCACTGGGAGTTTATCAAGACGGTGCCTGTTTTTATGCAAACATGA
GTGGGATCAAGCCAATGCACATTCTCAAGTTTTCGAAAATTTCAGGACTCTCAAATGATATTGACCTTCTCCACCCTCC
AGTAGAGTTGGAAATGAAGAAGCATAAGCTAAAACGCCTTGTGCAGTTTCCGGACTCATATTTCATGGATGTTAAATGC
CAAGGATGCTTCAGCATGACCACTGTGTTCAGCCACTCACAGACAGTAGTGGTATGTGGAAACTGCTCTTCTGTCTTAT
GCCAACCAACCGGGGGAAGGCTCACTTGACAGAAGATCTGCTTTCAGAAGAAAGAGCGAATAGACACACCTAACTGC
AAATTATTGTTACTGATTAGGCAGTAAGCATTTTGTTACTTAGATTTGCATTCCTGTTTTAAGCACTCCACTGACATTT
GTTTCCCAGTATGAGTTGCTTCGTTTCATTTGAAAGGATTGGCGAGATGAATTAGCATAAGCCTCTTGAGAATAATACA
ATTTTGGGAATATTTGAGATTTTGAAGAGTTAATTCTAGTATG

> SEQ ID NO: 6559 215150 1096844_301434_1b
GTGCTGATTTGCCGCCATGGTGCTCTCGAACGACATTGATCTTCTGCACCCGCCAGCAGAGCTGGAAAAGAAGAAGCAC
AAGTTAAAACGTCTTGTGCAGTCCCCAAACTCTTTCTTCATGGATGTGAAATGTCAGGGGTGCTTTAACATAACAACTG
TGTTTAGTCACTCTCAGACAGTGGTGGTTTGTGGGAACTGCTCAACTGTTCTATGCCAACCGACCGGTGGTAAAGCTCG
TTTGACAGAGGGATGCTCTTTCAGAAGAAAGAGTGAATGAGAAAGGTGCTGCTATTAAACTGGTTTGATCAGTCCCCAA
TCAGCCTGATTTTGTAGCAGACCCTGTTGTACCGAGTTGATGTGAAACCAATGGTTGTGTTTTAAAGTGGCCTTATTAC
CCTGTAATTAGCTTGATTTTGTACTAAGTGTTCTTATTGAGTCCAAACAAGACCAAGGGTCATGTTCTATTTGTCCGAA
TTAGCTTGAAGCTGTACAAGTCTTATTGTCTTAAGTTCTTATGATTAATCACTGCATGATTAATTTTAGAGTATGTTGT
GATGAAGGTAAAATTATCACGACTTTGGTAGCAACGACACCTAAATAAATATATTTTTTCAC

> SEQ ID NO: 6560 215150 1097047_301436_1b
AGTGGAGTGTGCGTCGCAGGTTCGAACATCCAACCTTCCACGGACCTGCCGCCATGGTGCTCTCTAATGATATTGATCT
TCTACACCCTCCAGCTGAGCTGGAAAAGAAAAAGCATAAGCTAAAACGTCTCGTGCAGTCCCCAAACTCATTTTTCATG
GATGTGAAATGTCAGGGGTGCTTTAACATAACGACTGTATTTAGCCACTCACAGACAGTGGTGGTTTGTGGTAACTGCT
CTACTGTTTTATGTCAACCTACTGGTGGTAAGGCTCCCTGACAGAAGGATGCTCTTTCAGGAGAAAGAGCGAGTAGAC
TGGGCATTGCTTGCCTCCTACCATTGCAAGATTTAATTGCACGGGTATTTAATGTTTTTGTTGAGGAGCATAGAGGATA
ACGAAGTATGTTGAGTCGGTCATTTTGAGTGTTGTTTCCTGTCATCATTACTAGACACTGTTGAATCATCGGCATAGAA
TCTTGGCACTATGATTTTGGAAAAATGCATAGAATTTTAGAAACATGATATTGGAGACATTTGATTGTTAGCACTTTTG
AAGAATATTAAATCATATGATAGACATTTTATTGTCA

> SEQ ID NO: 6561 215208 211629_300901_2b
AGCCTTCCGCTTTTCGCATTGGATACCTATTAAAAGTCTCCGTTTCCCCCCATCAATTGAGAGCCTCTCTCTTCATCTC
GCCAAAACGATATTTATTCCGCCGTCTGCGTATTCTTGCCCGCATCTCTCACAACACCGGCGTATCCTGTCGTGTCGTG
TACCACCGGGCTGTATTTTATCGTATTGCCTTCATACTACTTACTTAATTCCCGCCAACTTTCATCGTTCGCCATGCCG
ATTCGAAATCCGTTTACTCGCCGCCCCGGCACTCTCATCACAGTCGAGGACAATGTCTACACCGACCAAGAGCGCATTT

FIG. 2 continued

CTCCCGGCTTTGAGCGAGTCGACACTGTTGGATCCAAGGCGTCGTCGGCTCTCAGCATCCGCAGCGCCAGAAGTCAGGA
TACCGGCGAGTATAAGATGAGTGTCGTCAATGATAGCGGCGTATATCTCCCTCCCTCACCGTCGGAGGAGAAGGGCCAC
TGGCCGCGCAGATACCTTTCGTCGCGAGAATCGTCAGACAGCTCTGGCGAGATTGAGCAATTTTCTATTTCTCGAGAGT
CGTTTGACTCGTACCGACGCTCATTTGATATCTCGGCACGATCCCCCATTTCTGCGTACGACGTTCCCGCTCGCATGAG
TCTCGACTCAGCTCGATTCGCTCGAATGCCTAGGTCGGCAATCAACCGTAACATAGAGCAACTGCCCACCGCTGAGGAG
AACTTTGAGGACGTCGGACTCGAGGACCAGAAGCAGCCGCCCCGCAAACGAGGTTTCTTTTCCAAACTGACAGAGACCC
AAGAGAAGGACTCCACTGCTCAGACAGGAGTCTCGAGATTCCTCATGCCCGGTCGGAAGAGGGCTCAAAGCGGCCAAGG
GGCCGAGTTAGCGGCAATGGACCAGCCGACGGTGACTTCATCAAACTGAGAAATGCCTGCCACGGGAAGCAACGACGAC
AACGACTCTGCAACTTGAAATAATTTATCGTACATACCTTTTCAAAAGTGTATCAGGCGCCCATGTTTTTTTTCTGGA
CTATGGATATGTTTTATTTCTGCAACGACGGCGTTTGGGACGGCGT

> SEQ ID NO: 6562 215243 219619_300947_1b
GAATGACAACATAGGTGGTACACAAACACATATAAGAGGGTGTGAAGAGCCAGTCTCTAGCGTAAACATCACTTCTCTT
CATTTCTCTCATCTGCATCCCAAGAAAATATTTCATCGTCTGTATCACACCATGAATCCCGATCCTACCTTTCAGGGCA
GCCAGCTCAGGCCAGGAACCGCAGCCTATGATCAGGCAAACGATATATACGCCACGTCGACCTATGGAAAAGAGCGTAA
CATGAACCCCGGAGAGATTCTACAACCTACATGTGTAGAAGACATCCAAGGTGTTGTTAGATATGCCAACAAAGTTGGT
AAGCCAATTGCCATTAGGACTGGTGGTCATCAGTACAGCGGTGCTTCTTCAACTGGACCCAATGGCATTCAATTGGACT
TGGAACTCACGTTTCGAGACCCGAAGAGGGACCTTGTCTTGATCCGCGATACCGAAAACGACAAGGTCTATATCAAAGC
AAGCGTCAGCTGGGCTCTGGCTGAGGTTTATGACTTCCTTCTTGCAAATGGCGTCTTTATGCCGACAGGCCAATGCGCC
ACGGTTCATCTCGGTGGACATGTCCAGACAGGTGGTTACGGTATGCTAGCTAGATCCTTTGGGCTTCTTGGAGATTACA
TCCGTGAGCTCCAAATCGTGGATCACAATGGCGAAGTGGTCACAGTGACCAAAGAGACGCAACCCGACTTGTTCTTTGG
TCTTCTCGGCGGCAGCCCCGGCAACATCGGAGTCTTGACGCATTTCAAAGTCGAAGTCCAAGATGACAAAAAGTACCAA
GGCTCCAAGGGACTCTGGATGGCGTTCCACTACCGCCAAGACACGTTGAAGGAGCTCCTCGACCTCTTGGTGGAGAAAG
CAGAAGACCCAAACTTCCCGCGCAGCTACGACTTCACCGTCAATGTCGTCAGTAGGGAA

> SEQ ID NO: 6563 215244 111276_300053_1b
AAAGCCCCAAAATCTCGGCAGTGAAAAACCAAAAAATGGATAGCAGCCAAGCAGCAGTGTCATTCCTCACGAACGTTG
CACGCGCCGCCTTCGGTCTAGGCATCAGCGCCACGGTTCTCAACTCCTCCCTATACACCGTCGACGGTGGACAACGCGC
CGTCCTCTTCGATAGATTCCGTGGAGTCATCGACGATACTGTCGGCGAAGGAACTCATTTCCTCGTCCCATGGCTTCAA
AAGCCTTTCATCTTCGACATCCGTACGAGGCCCCACACATTTTCCTCCGTTTCAGGCACAAAGGATCTCCAGATGGTCC
ACCTCACACTCCGGGGCCTCTCACGCCCCGAAGTTTCGCGCCTTCCCGCCATTTTCAAAACCCTAGGTCTAGAATACGA
CGAGAAAGTTCTCCCTTCGATCGGCAACGAGGTTTTGAAAGCCGTCGTAGCTCAATTCAACGCGGATCAGTTACTCACG
GAGCGTCCACAAGTATCAGCTTTAGTTCGCGAGAGCTTGATCCGACGTGCTAAGGATTTCAACATCGTGCTCGATGACG
TGGCAATTACACACTTGTCATACGGTGCGGAGTTCTCTAAAGCTGT

> SEQ ID NO: 6564 215244 147305_301252_1b
AAGATGAATCTCAACAATGTTAAGGTTCCTAAGATGCCAGGTGGTGGTGCATCTTCTGCTTTGATCAAATTGGGAGTTG
TTGCTGGTCTTGGTGTATATGGAGTTGCCAACAGTCTTTACAATGTTGAGGGCGGGCATCGTGCCATTGTTTTCAACCG
TATTCTTGGTGTTAAAGATAAGGTTTATCCAGAAGGGACACACTTCATGATTCCTTGGTTTGAAAGGCCAGTCATTTAT
GATGTTCGTGCACGACCCCACCTTGTGGAAAGCACTTCAGGAAGTCGTGACCTTCAGATGGTGAAAATTGGGCTCAGAG
TTCTCACTCGTCCAGTTCCAGACGAACTACCCACTGTTTACCGAACTCTTGGTGAAAACTACAATGAAAGGGTCCTGCC
TTCAATTATTCATGAAACGTTGAAAGCTGTGGTTGCCCAGTACAATGCTAGTCAGCTCATCACCCAGAGAGAGAACGTT
AGCAGAGAAATACGGAAGATCTTGACAGAGAGGGCAGCCAACTTCAACATTGCTCTAGATGATGTGTCCATAACAAGCC
TGACTTTTGGAAAGGAATTTACAGCTGCAATTGA

> SEQ ID NO: 6565 215244 284313_200097_1b
AACAATGTTAAGGTTCCTAAGATGCCCGGCGGTGGTGCAGCTTCCGCTTTGATCAAGTTGGGAGTGGTGGCTGGTCTTG
GTGTTTATGGAGTTGCTAACAGTCTCTACAATGTTGATGGTGGACATCGTGCAATTGTGTTCAACCGTATTATTGGTGT
TAAAGATAAGGTTTATCCAGAAGGGACACATTTCATGATCCCTTGGTTTGAAAGGCCGGTCATTTATGATGTTCGTGCA
CGCCCTCATCTAGTGGAGAGCACTTCAGGAAGTCGTGACCTTCAGATGGTCAAAATTGGTCTTCGAGTTCTCACTCGTC
CTGTTCCGGACCAACTACCCACTGTTTACCGAACACTTGGTGAGAACTATAATGAAGGGTCCTCCCTTCCATTATTCA
CGAGACTTTGAAAGCTGTGGTTGCTCAGTACAACGCAAGCCAGCTCATCACCCAGAGAGAGAATGTTAGTAGAGAAATA
CGCAAGATTTTGACAGAGAGAGCAGCTAACTTCAACATTGCGCTAGATGATGTGTCCATTACCAGTCTAACTTTTGGAA
AGGAATTTACCGCTGCAATTGAAGC

> SEQ ID NO: 6566 215244 55828_300130_1b
CGGACGCGTGGGTCGACCCACGCGTCCGTTCCTGGAGCTCCTGCTCTCTCTGCCCTTCTTAAGGTCAGCGTTATTGGTG
GGCTCGGTGTCTATGCCCTTACTAATAGTCTCTACAATGTCGATGGAGGACACCGTGCTGTCATGTTCAACCGATTAAC

FIG. 2 continued

TGGTATCAAGGAAAAGGTGTACCCAGAAGGCACACATTTTATGGTGCCATGGTTTGAAAGGCCAATCATCTATGACGTT
CGTGCACGACCTTACCTTGTAGAGAGCACCACTGGTAGTCATGATCTTCAGATGGTGAAAATTGGATTAAGGGTTCTCA
CACGTCCCATGGGTGA

> SEQ ID NO: 6567 215249 218439_300933_2b
GGCAGCTTCTCTCACAATCACCACTCTCTTACACATACATCTATCAACTCCTTGTTGTAAAACCACCACCACATTCAAA
ATGAAGTTCTTCGCCGTCGCCGCTCTCTTCGTCGCCAGCGCCATGGCCGGCCCAATGGGCAGCGAAGGATGCCCAGGTG
GTCTTACTGGCACCGTTCCGCTCTGCTGTGCCACCAACGTCCTCGGCCTCGCGACCCTCGATTGCAGCACCCCCACTGT
TCCTGTACCCAATGTCGGCATCTTCCAGGCCCACTGTGCTTCCAAGGGCAAACAGCCTGTCTGCTGCACTGTTCCCGTT
GCCGGCCAGGGCCTTCTTTGCAACAAGCCCACTGGAGCTCAGTAGAGTGCCTGTTGTACTTGGATGGTGAACCCCGTCC
ACGGCATCACGGGGTTCACAACACCGACATCGAGGGGCTCGCAAATAGGAGGAGTTGAATGGCAATGGATGGGTATGGA
TGAAAATGGATGGACATAGGTGGAACTGGATGGATACAGTTGGGCAATGGATCATGGTGGAGGACTTAATGGTATATTT
GCGAGCGGGATAAGGGTTGTATGTAGAGTCACTCATTAAATCACAGCTATCACTGAAA

> SEQ ID NO: 6568 215250 205763_300922_1b
GACGTCATTTGGCTTGTGATGACAGAATTGTTTTCCGACATAATGAGCTAGCGGACTGAATTGAGACATTCGAGTTTCA
CTGCTGGTACCAGGAAATCAGCTTCATCATCGACATCATTTGACTTGACGACATCTTCACAATGGCCAAGGATCATCTA
CGCCGGCTTCTTTCCAACGCCTCGGAGGAGTCAGATGAGGAAGGCAGCTTACCTCGACACGTGAACAAAGAAGAACCAA
GGAAGAAATACCTTGTTTCGAAATTATTTCTCAAGTCCTGCTGCTGGTTTTTACTATTCTTAATAGCCTGTATTCTGTC
TTTCTGGGCTGGGACACGTGTGGTTCATGAGGAATCAAATGCGGATGGATTATGCGCAAAACACACGACTCAGTGGTCT
CCTCTCATTAGAGATGTACCAGTTCATTACAGCTTCAAAGAGTTCAGCGGCTCTTTTATGAACGAAGACGTTTATCGAA
AAGTTGGATCACCAGAGGTTGATAAAGCCTGGGAGGATCTCGGGTCTGACTACCGAGCTGGCATTATTTCATACAAAGA
TGGTCTGGCTAGTGGGTTGGATCCATCGTTTGTTCAACGAAACGAAAAATACGGCGGAGGCTTCATAGTTAACGTCGAA
GGAATGCACCATTTGCATTGTTTGAATCTAGTGCGCAAAGCACTCTACTTCAACTACGAGCGATATAAAAAGCTAGGGG
AGCATGCGTTTGTAAACGATGACTTTATACTACGCCTACATATTACGCACTGCCTAGACACTGTTCGTCAGGTCTTAAT
GTGCA

> SEQ ID NO: 6569 215257 213756_300860_1b
GGCGAATGATGCTGATGGATTGATGATTTGACGTTCAGTCTTTTTCCCTTCTCGCTCGTCGCCACAATGTCAATTGCAG
CAGCGCCCAATGCGCTTCGAGCCTCATCAGGCTGCGCCTCAAGGCTGGGGCTGTCTCTCCAGAAAGGCCCATCATCAAG
CCTTTTCCTGCGGGTAGCAAGTTTCTCGACAACGGCGCCGCAATGCAAGCGCAAGACAAAGGACAGCAACAAGCGACGA
GGCGTCAGCAGCCTCTACGGATCGGGCCCGCGAGAGCCGCTGTCCATGTCCAACATGCCGCTGCCGAAGCCCGTCGAGT
TCAAGCCCAAGATCGAGGTCGACGAGAGCCACGGGCTGTGGGGGTTCTTCCCCGCGCCGGGGAAGCTCCTGCTGACGCC
CAAAGAGACGGAGGAGCACGGGCGAGCGTGGGAGGTGGAGGAGCTGCGGCGGAAGTCGTGGGAAGATTTACATGCTCTG
TGGTGGAAGTGCTGCAAGGAGAGGAACATGCTTGCTACGGCGAGGGCGGAGCTGTTGAGGGGGAAGCTTGGGTTTGGAG
AGCGGGAGATTGATTCACGGGATGAGGAGGTTACGAAGACGATGAGGGCGATCAAGCATGCTCTTACGGAGCGATTCTA
TACTTGGCAGGATGCCGTCGAGGTTGCCAGGTCGGACCCCGAGA

> SEQ ID NO: 6570 215258 160087_200028_1b
GTCCGGCCGCTTTCTTCTCCTTTTCTTCCTTTTTTATTTCCTTGTACGCCACAGAAAACCTATAAGCTTTCTCCTTCTT
CTTGCTTTCCACTTTCAGAAAAATCAGAAAAAGCCCCAAATTCAAACCCAAATTCAAAAAATGGCATCTTTCGCAGAGG
CACCACCGGGGAACGAAGCAACAGGGGCAAAGATCTTCAAGACCAAGTGTGCTCAATGCCATACTGTTGAACAAGGTGC
TGGTCATAAACAAGGACCTAATTTGAATGGACTTTTTGGAAGGCAGTCTGGAACCACTGCTGGTTACTTCCTACTCTGCT
GCCAATAAGAATATGGCTGTGATGTGGGAAGAAAAGACTTTGTATGATTATTTGCTCAACCCCAAGAAGTACATACCTG
GAACAAAGATGGTTTTCCCTGGTTTGAAGAAGCCACAGGAGCGTGCAGACCTCATTGCCTACCTGAAATCTGCTACTGC
GTAAGGAATTACCGACAGATATTTCTATTTTGTAGTCGATAGGCATGTTTGCTGTGCGCAGGAAGATAAACCATTG
ATTTTTTTAAAGTAATAAGTTGACCTCTTTTGGTCTTGACTCATTTGTTTCCAGAGCACTGGTATACGAAATTTTTTGT
TACCTTCTGAAGAAGAGGTGAAAAACACTTGGCAAACAATGCCAATTTTAACATCTCTCTTATGATTT

> SEQ ID NO: 6571 215258 251961_301662_1b
GAGTGGTCGTGAGCTTTGCGGCGTCGATCTGCGATTTCCAGGGTAAAGTGGAATGGCGACTTTTGGCGATGCCCCGGCT
GGGAACGTGAAGAGCGGCGAGAAAATCTTCAAGACGAAGTGCGCGCAGTGCCATGTCGTGGAGGCAGGAGCTGGGCACA
GGCAAGGCCCCAATCTCCATGGTTTGCTTGGAAGGGTGTCTGGAACCTGCGAGGGGTATAGCTACTCGACTGCGAACAA
GAACAAGGCTGTTCATTGGAGCGAGGAGACGCTCTACGAGTACCTCCTGAATCCCAAGAAGTACATCCCTGGAACCAAG
ATGGTCTTCCCCGGCCTGAAGAAGCCGCAGGACCGAGCGGATCTCATCGCCTTCCTGAAGCAGAACTCTTGACACGCGA
AACGTTTCTACTGCGGCGCGGGGATTCATGGGGGAGGGAATAAAGAGGATTTCCCAGAGCGTTTTTTCGAGATCCTTGG
ACTTTTTTGTTATAAGAAACATTTGATTCATTTGATTCATTCCCATTCCATTTCCGTGGCAG

FIG. 2 continued

> SEQ ID NO: 6572 215258 182015_300598_1b
GAATTCACAAACCCTAGAAAAGTTGAGAAGGTTGTTCCTTCTTATTCTTCCTCTCAAAATCTCTATAAGTTTTCTGTAA
AAAGAAGTTTGAAATGGCAACTTTCGAAGAAGCTCCACCTGGTGATGCTAAGGCTGGGGAAAAGATCTTCAAGACTAAG
TGCGCTCAGTGCCATACTGTTGAGAAAGGATCTGGTCACAAACAAGGGCCTAACCTGAATGGTCTGTTCGGAAGGCAGT
CTGGAACAACTGCTGGTTACTCTTACTCAGCTGCTAACAAGAACAAGGCTGTGAACTGGGAAGAGAATACACTTTACGA
TTACTTGCTTAACCCCAAAAAGTACATTCCTGGAACAAAGATGGTTTTCCCAGGGCTGAAGAAGCCTAAGGAGCGAGCC
GACCTCATTGCTTACCTGAAGGAATCAACTGCCTAATCCTTTTACTGCCCCTTGGAATTCATTTGGGAGACGCTTTTGA
GGTGTGACATGATCGGATAGCAACAAATTTTTTCTTAAATAAACCCTTATTTTAGGTTTTTATTGCTGTTTCTTTTCAA
TCAGAATAGGGAGTAGGGATATTGCTCTCTTTTGAAAAGCAAAAACACCATTTTGGGGAACAGAAATTGTGACAAATTT
TTATGGAGGCATATTTCATCAACATTCGATGGGATCAAAA

> SEQ ID NO: 6573 215258 202349_300783_1b
CCCCCCGATCAGTCATTCCAAGGTCAACCCAAACCCTACCTGGTCCGCGAGTGCGGTGGCGATGGCGACATTCTCCGAT
GCGCCGCCCGGGGACGCGGCGGCCGGCGAGAAGATCTTCAGGACCAAGTGCGCGTACTGCCATGCCGTCGACAAGGCCG
CCGGCCACAAGCATGGGCCAAACTTGAACGGTTTGTTGGGGAGGCAATCTGGTACAGCTCCTGGTTTCTCTTACCCATC
TGGCGACAAGATAGTGCCTGTGATTTGGGAAGAGAACACTTTGTATGACTACCTGCTTACTCCTAAGAAGTACACTCCT
GCCAAGATGGGGTTCAATGGACTGAAGCAGCCACAGGACCGTGCTGATCTCATCGCATACCTGAAGAACGTTTGTAACT
TGTAAGGTGAACTTTGCAACAAAACTGTGTTGTAAATTTGTAATAATAAGCAGTGGCCTCGTGGAAGAGACGATGTGCA
GCTCATCCACTTGAGCAGGTGGGAGCTATTCTT

> SEQ ID NO: 6574 215258 176121_300519_1b
CCCCGGCCCACGAGCCAGAAAAAAAGGAAAAAGAGAGAGTCGTAGTTCGCCTCTTCTTCCTCCTCTCGTTCTCGCGGC
GGCGGCGGAGATGGCGTCGTTCTCGGAGGCTCCCCCGGGCAACCCCAAGGCCGGCGAGAAGATCTTCAAGACCAAGTGC
GCCCAGTGCCACACCGTCGACAAGGGCGCCGGCCACAAGCAAGGTCCAAACTTGAATGGTCTGTTTGGAAGGCAGTCAG
GTACCACCCCTGGTTATTCCTACTCTACGGCCAACAAGAACATGGCTGTGATCTGGGAGGAGAACACACTTTATGACTA
CCTGCTTAATCCTAAGAAGTACATCCCTGGAACCAAGATGGTCTTCCCTGGGTTGAAGAAGCCACAGGAGCGTGCTGAT
CTTATTTCCTACCTGAAGGAAGCAACCTCTTAAAAGGAGTGGAGCTGTCGTAACATGAGACAATCGGACAATTCATTCT
ACAGTTAAATAAAAATATTTAGACATCTGGGTCGCTCTGGTTTTACAGAGTGCAATCCACGAGACAATTATCTTGTTAT
ATTTTGTTCTTATGGTTTATGGGTTCCATATCTTAGGTTTAGCAGGAAAAGTCTTTCACAGCTTTTGCTTTAACTGCTG
GAAAACACCAGTATTTTGATCACCAGTCGGTGAGACTGGATTGCATCCCTTTTGGAAAAATACTGAGATCCTTAAAT

> SEQ ID NO: 6575 215258 1108626_301519_1b
AGCAGAATCTATTTAGGATACTTCCGTCCAACCCAGAATCCAAACCCTAACCCTAGTTTTGAGGCTCAGTGCACATCGG
CTATGGCGACCTTTGCGGAGGCTCCGGCGGGCAACCCCAAGTCCGGCGAGAAGGTCTTCAAGACGAAGTGCGCCCAGTG
CCACGCTGTCGAGAAATCCGCTGGTCATAAGCAAGGTCCCAATTTGAATGGGCTGTTTGGTAGGCAGTCGGGGACTACA
GCTGGGTACTCCTACTCTGCATCAAACAAAAACAAAGCTGTTGTGTGGGGAGAGGATACACTCTATGGTACCTTCTCA
ATCCAAAGAAGTATATTCCTGGCACAAAGATGGTTTTCCCAGGCTTGAAGAAACCTCAAGAGCGCACGGATCTCATTGC
ATACTTGAAAGAATCTACGAGTTAATGAGGCAATTTTCGATTGCCTTTAGAATAATTAATTAATTGAGCTTAATTTAGG
GTTAGGCAATCTGCATTTTTGGACCCAATAAATAATTTGCTTAATCGGGTATTTTTCCTCGATTCCTA

> SEQ ID NO: 6576 215259 213952_300862_1b
CACTCATCCACAAGCAACAAGCAACAACAAAACACATCAACTTACAACCCAACACAATCTCTTCAATTACATCC

> SEQ ID NO: 6577 215279 187685_300679_1b
CCCACGCGTCCGCGGACGCGTGGGAAAAAAATCCTCCTCGCCTTCGACAGCAGCAGCAACCAGCTTAGCTAGGCTAGCC
ATGGACGCCGCCGGAGCCGGAGCGGGTGGGAAGTTGAAGAAGGGAGCCGCCGGGAGGAAGGCCGGTGGGCCGAGGAAGA
AGGCGGTGTCGCGCTCCGTCAAGGCCGGGCTCCAGTTCCCCGTCGGCCGTATCGGCCGCTACCTCAAGAAGGGCCGCTA
CGCCCAGCGCATCGGCACCGGCGCCCCCGTCTACCTCGCCGCCGTCCTCGAGTACCTCGCCGCCGAGGTGCTGGAGCTC
GCCGGGAACGCGGCCAGGGACAACAAGAAGAACAGGATCATCCCGCGCCACGTGCTGCTGGCGATCAGGAACGACGAGG
AGCTCGGCAAGCTGCTGGCCGGCGTGACCATCGCGCACGGAGGCGTGCTGCCCAACATCAACCCGGTGCTGCTGCCCAA
GAAGCGGCGGAGAAGGCCGCCGCCGCCGGCAAGGAGGCCAAGTCGCCCAAGAAGGCGGCCGGGAAGTCCCCAAGAAG
GCCTAGGCGTCGGCGCCTCGCTTTGCTTGTTTAGCTGGAGTAGATTGGACGGGATGTGTGTCTGTTAGTAGTCTGCTGA
TGCTGTTGATCTAATCTATA

> SEQ ID NO: 6578 215279 195978_300639_1b
CACTATCCACGCTGCACGTTTACCATTCCGACATTTGCCGCATCTCGCACCTTACATCTACTTTCGAGTAATTTTTCGT
TAACCCAAAAACCAACTTCAAAATGACTGGCGGCGGCAAATCTGGCGGCAAGGCCTCTGGCTCCAAGAACGCTCAATCC
CGATCCTCCAAGGCGGGTCTTGCGTTCCCCGTTGGTCGTGTCCACCGTCTTCTCCGAAAGGGCAACTACGCTCAGCGTG

FIG. 2 continued

```
TCGGTGCCGGTGCTCCCGTCTACCTCGCTGCCGTTCTCGAGTACCTCGCTGCCGAAATCCTCGAGTTGGCTGGTAACGC
CGCTCGTGACAACAAGAAGACCCGTATCATCCCTCGTCACCTCCAGCTCGCCATCCGAAACGATGAGGAGTTGAACAAG
CTGCTGGGACACGTCACCATCGCTCAGGGTGGTGTTCTGCCCAACATCCACCAGAACCTCCTCCCCAAGAAGACGACTG
GCAAGACTGGCAAGGGTTCCAGCCAAGAATTGTAATTTTTTCGTTGGTCGTTTGCGCTTTCTTTCGAGGTCGTTTTGGT
TGTCATAAAGGGGTCAAGGGATAAGGTTTACGGTTGCTTTTGTACGTCTGGGTTGTACATTAATCCCCCACGGCTATGA
TCATGAATCAATTAGGGTTTTTTTCAAATGCACTTCATTAAAACGT

> SEQ ID NO: 6579 215279 255104_301642_1b
GGGGAAGAGGCAGTGGCGGCGGGGCGAAGGGCGGGAGCCGGAAGAAGTCCGTGACGAAGACCACGAAGGCCGGCTTGCA
GTTCCCGGTCGGCCGGGTCGCCCGCTACCTCAAGAAGGGCCGGTATGCGCAGCGTATTGGGTCCGGTGCCCCGTCTAC
CTCGCCGCTGTCATGGAGTACCTCACTGCCGAGGTCCTGGAGCTCTCTGGGAACGCCGCCAGGGACAACAAGAAGTCGC
GCATCGTCCCGCGCCACATCCAGCTCGCCGTCAGGAACGACGACGAGTTGTCGAAGCTTCTCGGCGGGGTGACCATTGC
TCACGGCGGCGTCCTCCCCAACATCCATTCTGCTCTCCTCCCCAAGAAGAGCTCCTCCTCCTCGGCCGCCCCCGGCCCC
GAGGAGAAGCCCAAGAAGACCCCCAAATCTCCCTCTAAGCCGAAGCCTGCCAAGGAGTAGAGAGAGAGAGAGAGAGCGG
AGCTGAGCTGAGCAGGATCAGATTTGTGCCACCTTTTCCTTCTTCCTCAAGGTGTCTCTCAATGTCATCTGTATATGCA
TGCTCT

> SEQ ID NO: 6580 215279 234825_301221_1b
GGGAAAAATGTCGGGGTGCGGGAGGAAGGAAGGGGAAGAAGAAGGCGACGTCCAAATCGACCAGGGCTGGTGCTACAGT
TCCCGGTTGGAAGATTGGCTCGCTACCTCAAGAATGGGAGGTATGCCAAGCGCGTCGGCAGTGGAGCGCCCGTCTATCT
CGCCGCGGTTCTCGAGTACCTCGCCGCAGAGGTTTTGGAGCTGGCCGGCAATGCTGCTCGGGACAACAAGAAGTCTAGA
ATAATCCCGAGACACATCCAGCTCGCGATCCGGAACGACGACGAGTTGGGGAAGCTTCTCCAGGGCGTGACGATCGCGT
ATGGGGGCGTGATTCCACACATTCATGCCGTGCTTCTCCCCAAGAAATCCAGCTCCTCTTCCACCGCCGCCGCCGATTC
CAAGGCCGCGGAGAAGAGCCCTAAGGCCGAGAAGGCCGAGAAGGCGGCCAAGTAGCATTCTTCCTGAAGAAGAGAGAGG
AAACTACTCTTTGACTCTTTGTATTATATCTAATCACAACGACTTTATTGAAAAACAAAAAACACAAC

> SEQ ID NO: 6581 215279 227559_301029_1b
CACGCGTCGCGAATCACGCCGCGCCGCCTCTTGACCTAGCGCCGCCGCCGCTGCCGCTGCCCCTTCTCGCCGCCGGCTT
CTTCTTCTTCTTCCTTGTGTAGCGCGTGCGCCTCTCCTCTCCTCTCGTCGGCGAGTGATATGGCGGGACGTGGGAAGGC
GATCGGCGCGGGGGCCGCGAAGAAGGCGACGTCGAGGAGCTCCAAGGCCGGGCTGCAGTTCCCCGTGGGCAGGATCGCG
AGGTTCCTCAAGGCCGGGAAGTACGCCGAGCGCGTCGGCGCCGGGGCCCCCGTCTACCTCGCCGCCGTCCTCGAGTACC
TCGCCGCTGAGGTGCTCGAGCTCGCCGGGAACGCGGCGAGGGACAACAAGAAGACCCGCATCGTGCCGCGCCACATCCA
GCTCGCGGTGCGCAACGACGAGGAGTTGACCAAGCTGCTCGGCGGCGCCACCATCGCCAGCGGCGGCGTGATGCCCAAC
ATCCACCAGCACCTCCTCCCCAAGAAGGCCGGGTCATCCAAGGCATCCACCGTCGACGACGACGACAACTAGGCCGCCC
GGGCGCCTTCTGCATTAGTAGGATCTTTTGCTAGCTGTTCGTCTGGATTTGCATTGTGTTGTTGCGCTGAGCAGTAGGA
AGGGGAAAAGAGAGAGAGAAGTTCTTGGTTGGTGGTTTGG

> SEQ ID NO: 6582 215279 226535_300998_1b
ACTTTTATTTCCACTCCTCACTAACACTTTTATCTAACAACAACAACAACACACAATGTCTTCCGGTGGAAAGTCCGGT
GGCAAGGCCGCCTCCTCTTCTAAGACCTCCAAGTCTCGATCCGCTAAGGCCGATCTTACCTTCCCCGTTGGTCGAGTCC
ACCGACTCCTGCGAAAGGGAAACTACGCCCAGCGAATTGGTGCTGGTGCCCCCATCTACCTCGCTGCCGTCCTTGAGTA
CCTCGCCGTCGAGATTCTCGAGCTGTCCGGTAACGCTGCCCGAGACAACAAGAAGAGTCGTATCGTTCCCCGACATCTG
CAGCTCGCCATCCGAAACGATGAGGAGCTGAACAAGCTGCTTGGCCACGTCACCATTGCTCAGGGTGGTGTTCTCCCCA
ACATCCACCAGAACCTTCTGCCCCGAAAGTCCGCCAAGGGCGCCAAGGGTGCTTCTCAGGAGCTCTAAGTCTCTTGAAG
GCTTTATATTTTATCTATTGGGTTAAGGGTTGTTTTAATGTCCATTAAAACTGTTTACAGTGTACTATAATGAATGACA
TGTATTGTATTT

> SEQ ID NO: 6583 215279 194694_300765_1b
CCCCGGCGCACTCGCATTCGACGACCCAAGAAAAGGAAAAAAAAGAAAAACAATCCTCCACGCCTTCGAGCGCAGCAG
GAACCAGCTTAGCTAGACTAGCCATGGACGCCGCCGGAGCCGGAGCGGGTGGGAAGTTGAAGAAGGGAGCCGCCGGGAG
GAAGGCCGGCGGGCCGAGGAAGAAGGCGGTGTCGCGCTCCGTCAAGGCCGGGCTCCAGTTCCCCGTCGGCCGTATCGGC
CGCTACCTCAAGAAGGGCCGCTACGCCCAGCGCATCGGCACCGGCGCCCCCGTCTACCTCGCCGCCGTCCTCGAGTACC
TCGCTGCCGAGGTGCTGGAGCTCGCCGGGAACGCGGCCAGGGACAACAAGAAGAACAGGATCATCCCGCGCCACGTGCT
GCTGGCGATCAGGAACGACGAGGAGCTCGGCAAGCTGCTGGCCGGCGTGACCATCGCGCACGGAGGCGTGCTGCCCAAC
ATCAACCCGGTGCTGCTGCCCAAGAAGACGGCGGAGAAGGCCGCCGCCGGCAAGGAGGCCAAGTCGCCCAAGAAGG
CCGCCGGGAAGTCCCCCAAGAAGGCCTAGGCGTCGGCGCCTCGCTTTGCTTGTTTAGCTGGAGTAGATTGGACGGGATG
TGTGTCTGTTAGTAGTCTAATGCTGTTGATTTAATCTATGGTGGTGTCGTTGAAC
```

FIG. 2 continued

> SEQ ID NO: 6584 215279 103578_300363_1b
GCCATTACGGCCGGGGACTCAACACTCAAATTACAATCCAAAAGCTTATATTTTTTCTGTTACTTCTCTGTACTCAAGC
TTTGTTAACAGTTCGTTCACAACAATGGAAGCAGCAACCAAGACGACCAAAGGTGCCGGAGGAAGGAAAGGCGGAGGCC
CAAGAAAGAAGGCTGTAACCAAATCTGTCAAGGCTGGTCTTCAGTTCCCAGTTGGTCGTATTGCTCGTTTCCTGAAGAA
GGGTCGTTATGCTCAGCGTGTTGGAAGTGGTGCTCCAATTTACCTCGCTGCTGTTCTTGAATACCTTGCTGCTGAGGTG
TTGGAGTTGGCTGGAAATGCAGCGAGAGATAATAAGAAAAGTAGGATTGTTCCTAGGCATGTACTTTTGGCAGTAAGGA
ATGATGAAGAGTTGGGGAAATTGCTGAGTGGAGTTACCATTGCAAGTGGAGGTGTTCTTCCAAACATTAACCCAGTCTT
GTTGCCAAAGAAATCTGCTGCAGCCGAGGAGAAGGCATCAACGCCCAGGTCCACCAAGTCGCCAAAGAAGGCGTAGGAC
TATCAATTACAATTGATCTTTGGTAAAATATGGCGGGCCACTCTTTTGTCTAGTTTATTGGTACTACTTCTTGTAGTA
GGACGTAGATTATTAGTTTTCTAAATTCAGTGTAATGGTGCTTGGAAATATAATAGAAAGTAACTCTTTTT

> SEQ ID NO: 6585 215279 155536_301357_1b
CAACAATCAACTATAATATCAATTCTTTTTCACCAATCACAACTTTGCTCTTTCTCATTTCCAAATGGATACTGCCGGG
AAAGCAAAAAAGGGTGCCGGCGGCAGAAAGGCTGGTGGCCAATCGAAGAAGCCGGTTTCTCGGTCCGTCAAAGCCGGTC
TTCAATTCCCGGTCGGTAGAATTGGTCGTTATCTGAAGAAGGGTCGTTACGCTCAACGCGTTGGAAGTGGTGCTCCGGT
TTATTTGGCTGCTGTTCTTGAGTATTTGGCCGCTGAAGTGTTGGAATTGGCTGGAAATGCAGCGCGTGACAACAAGAAG
AACAGAATTATTCCAAGGCATGTTCTGTTGGCTGTGAGGAACGATGAAGAGCTAGGGAAGCTTCTTGCTGGTGTGACAA
TTGCTCATGGTGGTGTGCTTCCAAATATCAACCCGATTTTGTTGCCTAAGAAAACTGGCGGAGCTGAAAAGGAACCGAA
ATCTCCTGCTAAGGCCACAAAATCTCCCAGGAAAGCTGTAGCTTAGACCTTTTAAGTGACTGCTGAAACTCAAACTTCT
TTTGGTTTGTTTTTCTTTTGTATGTAATTGTAATTTTTGAACTTTGTGCCCGTGCCAGTTGTTCTTCATAGTCAAATCA
TTGAAACCCCTTGTTTCTAAAAA

> SEQ ID NO: 6586 215279 155144_301353_1b
GGACACTACCTTAAACATGCGTTCAACAACAGCAACCAAATCGGTGGGTGGCAGAGGAAAACTCCAAAAAGCTACAAAA
TCCATCTCCAGATCTCAAAAGGCGGGTCTCCAATTCCCTGTTGGCCGAGTTGCTCGGTTTTTGAAAAAGGGTCGTTATG
CTCAGCGAGTTGGCTCCGGTTCACCGGTTTATCTCTCAGCGGTTCTTGAGTACCTTACTGCTGAGTTGTTGGAACTTGC
TGGGAATGCTGCAAGAGACAACAAGAAGAACAGAATTGTTCCTAGGCATATACAGCTTGCTGTGAGGAACGATGAGGAA
TTGAGCAGGTTGTTGGGATCTGCTACCATTGCTAATGGTGGTGTTTTGCCCAATATTCACCAGAATTTGCTTCCTAAGA
AGATTGGCAAAGGGAAACCTGAAGTGGGTTCCGCTTCACAGGAATTTTAGATCTTTAGGTGTTGTATTAAGGGATTGGG
TAGTGAAATTTTATTTGTTCATAATGGTTCAAACGTGGGGATGTAGCTCAAATGGTGGAGCGCTCGCTTTGCATGCAAG
AGGCACGGGCGGGGTTCGATCCCCCGCATCTCCATATTTTTTGGTTTCTGCAATTTCGTTTTTCCTCAGCATTTTTCTC
GAAGCAAAGTCGTCTTTACACT

> SEQ ID NO: 6587 215279 129538_301606_1b
GAATTCAGGAGGAAAGGTTGGAAGGGGAGGAAGAAAAGGTGGTGATAGAAAGAAAGCAGTAACAAAATCAGTCAAAGCT
GGACTACAATTCCCAGTTGGTAGAATCACTCGTTTCTTGAAGAAAGGTCGTTATGCTCAACGTGTTGGTTCCGGTGCTC
CTGTTTATCTCGCGGCCGTTCTTGAATATCTAGCTGCCGAGGTTTTGGAATTGGCTGGAAATGCTGCTAGGGATAACAA
GAAATCAAGGATTGTACCAAGGCATTTACTTTTAGCAGTAAGGAACGATGAAGAATTAGGAAAGTTGCTTGCTGGTGTT
ACTATTGCTAGTGGTGGTGTTCTTCCAAATATCAACTCTGTTTTGTTGCCAAAGAAGGGTCTTGAGAAGGAATCTACAC
CCAAATCTCCTGCCGGAAAATCTCCAAGGAAAGCTGCTGCCTAAATGATAGATCTAGTTTGCTTTAACTTGTCCGAGTA
CAGTCTATTATGTAATGTAATGAAATCTAGGGACTCTTGGATCATGTTAGTGTTTGAATGATCTGTTTTTTTGGGGTT
AGTTTTATGATTGAAATCAGTTTCGGGTTTCAATGTTCATATGGTTTGTTGGAATATAGCTAATCAATGGAATCAAAAA
AAAA

> SEQ ID NO: 6588 215279 126805_300467_1b
CGGACGCGTGGGCAAGTTTTCCTTCAAATCATTCATCATTTTTGTCTAAATTCTATTATCTGCAAATGGATACCAGCGG
AAAAGCTAAGAAAGGCGCGGCCGGAAGAAGAGGCGGCGGTCCAAAGAAGAAGCCGGTTACCCGGTCCGTGAGAGCCGGT
CTTCAGTTCCCAGTCGGTAGAATTGGTCGTTACCTGAAAAAAGGCCGATACGCCCAGCGCGTTGGTACTGGTGCTCCCG
TTTACTTGGCTGCTGTGCTTGAATACTTGGCCGCTGAAGTGTTGGAATTGGCTGGAAATGCGGCACGTGACAACAAGAA
GAACAGGATTATCCCACGGCATGTGCTTTAGCTGTGAGGAATGATGAAGAGTTAGGGAAGTTGCTTGCTGGTGTGACA
ATTGCACATGGTGGTGTTCTTCCCAACATTAACCCAATTTTGTTGCCTAAGAAGACCGGAAGTGACAAGGCGGGCAAAG
ATCCTAAATCTCCTTGCCAAAGCTACCAAATCTCCTAAGAAGGCTTAGATTTAATGTCTGTTACAAGCCTTTGTTTTC
TATGTTTACTTGGATCTTCACTGTATGTAATTCTTGTTTTAGAATGTGTTTGATTTTCCTGTTGAAAAGGGAATTAGTT
GGAATTGCTAGATCTTATTAGGTTGTCCTCTATTATCAATCAATGAAACCCCTTGTTTCGAATTTAA

> SEQ ID NO: 6589 215279 119869_300360_1b
TCGCAATCCAAAAGCTTCAATTTTTCCTAATACTTCTCTGTATTCAAGCTTCGTAAACTTTCATTCACATCAATGGACG
CAGCAACAAAGACAACCAAAGGTGCCGCTGGAAGGAAAGGAGGAGGCCCAAGAAAGAAGGCTGTAACCAAATCAATCAA

FIG. 2 continued

```
AGCTGGTCTTCAGTTCCCAGTTGGTCGTATTGCTCGTTTCTTGAAGAAAGGTCGTTATGCTCAGCGTGTTGGATCTGGT
GCTCCAATTTACCTCGCAGCTGTTCTTGAATACCTTGCTGCTGAGGTGTTGGAGTTGGCTGGAAATGCGGCCAGAGATA
ACAAGAAGAGTAGGATTATTCCTAGGCATGTGCTTTTGGCAGTGAGGAATGATGAAGAGTTGGGGAAATTGCTGAGTGG
AGTTACCATTGCAAGTGGAGGTGTTCTTCCTAACATTAACCCAGTCTTGTTGCCTAAGAAAACTGCTGCAGTCGAGGAG
AAGGCATCTAAACCCAAGGCCACTAAGTCACCAAAGAAGGCCTAGGACTATCTATTAGAAATGATCTTTTCGTTAAACA
TGGTGAACCAGTCTTTTGTCTAATTTATTGGTACTACTTCTTGTAGTAGGACGTAGATTATTAGTTTTCTAATTTTGGT
GTAGTGGTGCTTGGAAATATAATAGAAAGCAACTCTTTTT

> SEQ ID NO: 6590 215279 1098184_301483_1b
TCTCCCTCTCTCATCTGCGCATCTCTTGTCGGAGAAGCTAACTCTCTAACCCTAGCTATGGCCGCTGGAGGGGGAGGTC
GTGGCAAGCCTGCCGGAAAGAAGTCCGTCTCTCGTAGCAACAAGGCGGGCCTGCAGTTTCCTGTTGGTCGAATTGCCCG
CTTCCTGAAGGCTGGGAAGTATGCAGAGAGAGTTGGGGCGGGGGCCCCTGTCTACCTTGCAGCTGTCCTTGAGTACCTC
ACTGCGGAAGTCCTGGAGCTTGCTGGGAATGCTGCGCGGGACAACAAGAAGAACAGGATAGTCCCCCGCCACATCCAGC
TTGCTGTGAGGAATGATGAGGAGCTTAGCAAGCTCCTTGGCCAGGTCACTATTGCCAATGGAGGTGTCCTCCCCAATAT
CCATAATGTCCTCCTTCCCAAGAAAGCAGGATCGAGCTCCAAGGTGGCGGCAGCAGATTCTGAAGCCTGAAAAGGGGGA
AAAAAAAAGAAGACTTACTGAAGAAACTTGGTGTTTGTTGACACCACTGATGCTCTGTGAAGATTTAGGCTCTGAGAAT
G

> SEQ ID NO: 6591 215279 109225_300044_1b
TCGAAATCTCATCTCTCTGTAAAACAAAATCCATTTAATTCCTGTGTTTAACAGTAACAACAATCAAATGGCAGGTAGA
GGAAAAAACCCTAGGATCTGGAGCAGCAAAGAAGGCTACATCCCGTAGTAGCAAAGCCGGCCTTCAATTCCCCGTCGGTC
GTATCGCCCGTTTTCTCAAAGCCGGGAAATATGCCGAGCGTGTTGGTGCCGGTGCCCCTGTTTACCTTGCTGCCGTCCT
CGAATACCTTGCTGCTGAGGTGCTTGAATTGGCTGGAAATGCTGCGAGGGACAACAAGAAGACTAGGATAGTACCAAGG
CATATACAGTTGGCAGTCAGAAATGATGAGGAATTGAGCAAGTTGCTTGGAGATGTAACTATTGCCAATGGTGGTGTTA
TGCCCAATATTCATAACCTTTTGCTGCCTAAGAAAGCTGCTGGCTCCTCAAAGCCATCTGCTGATGAAGATTAGATTGG
AAGGACAATAGGCAGTTTCAAGTGTTAAGCCTTAAATTTGGATCTGCTGGTGTTTGTTTTTTAGATTCCATAGAAATTA
TTAGGTTTCTCCAGTATGAAATCAATTGTG

> SEQ ID NO: 6592 215279 108004_300057_1b
GGGCAAAATCACAGCACAACACAACACTTCTCCTAATTATTTCGAGTTTTGTAGAGGTTAGAAATGGAGAAGAAGGGAG
CTGGAGGAAGAAAGGGTGGTCCAAAGAAGAAGGCTGTTTCCCGTTCCGTTAAGGCCGGTTTGCAGTTTCCGGTAGGTAG
AATTGGGCGTTACTTGAAAAAGGGTCGATATGCTCAGCGTGTTGGGAGTGGTGCTCCTGTTTATCTTTCTGCTGTTCTT
GAGTACCTTGCTGCTGAGGTTTTAGAGTTGGCTGGAAATGCAGCGAGGGACAACAAGAAGACTAGGATAATACCGAGGC
ATGTTTTGTTAGCTGTAAGGAATGACGAAGAGCTTGGAAAACTTCTAGCTGGTGTAACAATTGCTCATGGAGGTGTTCT
TCCTAACATCAATCCAGTTCTTCTGCCTAATAAATCCGACAAAGTTGGAAAAGAACCTACTAAATCGCCAACGAAGGCT
ACCAAGTCACCCAAGAAGGCCTAATTTGTGACGATGCAGGCTCGTGTGATGGCACAGTGTTCTACTTGAATCCATGTTG
TATGGACATTGTATTGTAGCTTTGCAATTAGGAGCTTTAATGGTGGTCGTGAAATAATCTCTACTTGTATGTAGTTTTG
GTATCTATGGGTTGCATTGCATGTAGGCAAAGTATGTTGAAAACTAGGAATGTTTGATTTCTGTTATTATGATGTGAAA
CTAATGAAATTGGTTCTGTTTCTCAAGATCTTTAATGGTGGTTACATGTGAGAATTAAAAGCTTTTATTGTCTTATGAG
CTTTTAATTTGAATTAAATTGGCAAATGTTTATGG

> SEQ ID NO: 6593 215279 103703_300027_1b
TGGTATGAACGCAGAGTGGCCATTCGCCGGGGCCCACATTACAGAGAAATTCAATTCTTTCAAGCACAAAGCAAAGAT
TGTTGTTTTACAGTAACAAAATAGTATTAATGGCTGGTAGAGGAAAAACCCTAGGTTCCGGTGCTGCAAAGAAAGCTAC
GTCCCGTAGCAGCAAAGCCGGTCTCCAATTCCCCGTTGGTCGTATCGCCCGTTTCCTCAAAGCCGGCAAGTATGCCGAG
CGTGTCGGCGCCGGCGCTCCCGTTTACCTTGCTGCCGTCCTTGAGTACCTTGCAGCTGAGGTACTTGAATTGGCTGGAA
ATGCGGCGAGGGATAACAAGAAGACGAGGATTGTACCAAGGCATATTCAGTTGGCTGTGAGAAACGATGAGGAATTGAG
CAAGTTGCTTGGAGATGTGACAATTGCTAATGGTGGTGTTATGCCCAACATTCACAACCTTTTGCTGCCTAAGAAGACT
GGTGGATCCTCAAAGCCCTCTGCTGATGAGGATTAAATAGATGGCCAATTTGGAATTGAGAGCTATATGATGTTTTTGT
TAGTCTATAGAGAGATTTAGATCATGAAATTAAGCCCCACCCCCAAATGTGGAATGTTATTTCCTTAGTTCTGCTAGT
TGTCAAGGTTTATGTTAGTATGTGAATACAAATTAAGGGATGTATGAAAACATCTTTTTTTGATTTTTGAATTCTATCT
GTTCCAGT

> SEQ ID NO: 6594 215279 266810_200031_1b
GACAACCAATTTTTTCCTTCAAAATCATTCATCATCCTGCTCTAAATTCTTCTATCTTCAAATGGATACTAGCGGCAAA
GCGAAGAAAGGTGCAGCCGGAAGAAGAGGCGGTGGTCCAAAGAAGAAGCCGGTTACCCGGTCCGTGAGAGCCGGTCTTC
AGTTCCCGGTCGGTAGAATCGGTCGGTACCTGAAAAAAGGCCGTTACGCTCAACGTGTTGGTACTGGTGCTCCCGTTTA
CTTGGCTGCTGTTCTCGAATATTTGGCTGCTGAAGTGTTGGAGTTGGCTGGAAATGCGGCACGTGACAACAAGAAGAAC
```

FIG. 2 continued

```
AGGATTATCCCAAGGCATGTGCTTTTGGCTGTGAGGAATGATGAAGAGTTAGGGAAGTTGCTTGCTGGCGTGACAATTG
CACATGGTGGCGTTCTTCCCAACATTAACCCAATTTTATTGCCTAAGAAGACTGGAGGTGATAAGGCTGGAAAAGAACC
TAAATCTCCTTCCAAAACTACCAAATCTCCTAAGAAGGCTTAGATTTAGTGGTTGTAATAGCCTTTTGTTTTTCTATCT
TTATTTAAATATTTACTGTATCTAACTGTGCTGTTAGAATGTGTTCAATCGTTCTTCGGGGATGAAAAAATGGAATTAG
TTGGAACTTGGAACTGTTGGACCTTATTAAGAGGTTGTGTTCTATTGTCAATCAATGAAGCCCCGTGTTTCGAATTTAC
```

> SEQ ID NO: 6595 215279 48682_300033_1b
```
GCCATTACGGCCGGGGATACCGGGAAAACAATTCAAATTTGAACACGTCAACATGCCTTCAACAACAGCAACCAAATCG
GTGGGTGGTAGAGGAAAACTCCAAAAAGCTACAAAATCCATCTCCAGATCTCAAAAGGCGGGTCTCCAATTCCCTGTTG
GCCGAGTTGCTCGGTTTTTGAAAAAGGGTCGTTATGCTCAGCGAGTTGGCTCCGGTTCACCGGTTTATCTCTCAGCGGT
TCTTGAGTACCTTACTGCTGAGTTGTTGGAACTTGCTGGGAATGCTGCAAGAGACAACAAGGAGAACAGAATTGTTCCT
AGGCATATACAGCTTGCTGTGAGGAACGATGAGGAATTGAGCAAGTTGTTGGGGTCTGCAACAATTGCTAATGGTGGGG
TTCTGCCCAATATTCACCAGAATTTGCTTCCTAAGAAGATTGGCAAAGGGAAACCTGAATTAGCTCTGTTTCTCAGGA
ATTTTAGATATGTAGGTGTTGTATTAAGGGATTGGGTAGTGAACTTTTATTTGTTCATAATGGTTCATGTGAATGACAA
GTTTGTACCCTAATCCTATTAAGTTGACGT
```

> SEQ ID NO: 6596 215279 47142_300174_1b
```
GCAGCATGGCGGGTCGGGGAAAACAACTTGGATCTGGTGCAGCGAAGAAGTCTACTTCTCGTAGTAGCAAGGCTGGGCT
TCAATTCCCTGTTGGTCGTATCGCTCGATTTTTGAAAGCCGGTAAGTACGCCGAGCGTGTTGGTGCCGGAGCTCCGGTC
TATCTCGCCGCCGTTCTTGAATACCTCGCCGCTGAGGTACTTGAGCTTGCTGGGAACGCAGCGAGAGACAACAAGAAGA
CCCGTATAGTTCCACGACACATTCAGCTTGCTGTGAGGAATGATGAGGAGCTAAGCAAGTTGCTTGGAGATGTGACAAT
TGCTAATGGAGGAGTGATGCCTAACATCCACAATCTCCTTCTCCCCAAGAAGGCTGGTTCATCTAAGCCTACTGAAGAA
GATTAGTAA
```

> SEQ ID NO: 6597 215279 279870_200065_1b
```
GATCAACATGAGTTCTACCGGAGAAATAAAATCTGTAGGGGGTAGAGGAAAGGCCAAAGGTTCAAAAAAATCCGTCTCG
AGATCTCTAAAAGCAGGTCTTCAATTCCCAGTTGGTCGTATTGCTCGTTATCTGAAAAAGGGTCGTTACGCTCAGCGTC
TTGGCTCTGGTTCACCAATTTACCTCTCTGCTGTTCTTGAATATCTTGCTGCTGAGGTGTTAGAGCTTGCTGGAAATGC
TGCTAGAGATAATAAGAAGACTAGGATAGTTCCAAGGCATATACAGCTTGCGGTGAGGAATGACGAGGAACTCAGTAAG
TTGTTGGGGAAGGTGACAATTGCTAATGGTGGAGTTTTGCCCAAAATTCATCCAAATTTGTTGCCTAATAAGAATGGCA
AGGGGAAACTAGAAGCTGGAACCCAGTCACAGGAATTTTAGATTATGGGGTTAAATCAGTTTGTTGGGTAGACAGGTTT
AATGTGTTTTTGTGGATTA
```

> SEQ ID NO: 6598 215279 27307_300098_-1b
```
CCGAAATATCATATCATGCGCTAATTAAACATACTTAGGCAAAAGCCAAATATACTTAGCTTTAAAACCTAATTTGATC
CCAAAAAACACCATCAGGGTCTATTTTACAAGTTCCGAATCCAAACAAGAGAACTGAACTAAGAAGTCTAAGAACCTC
AGAACTCCTGAGAAGCAGATCCAATATCTCCTTTGTTCTTGCCAACCTTGGATGGCAAAAGAGTCTGATGAATATTTGG
CAAAACTCCTCCATTCGCAATCGTCACACTTCCCAGAAGTTTGCTTAACTCTTCATCGTTCCTCACTGCAAGCTGAATG
TGTCTTGGTACTATACGTGTCTTCTTGTTATCCCTTGCTGCGTTTCCCGCCAGCTCCAACACCTCGGCGGCGAGGTACT
CGAGAACAGCGGAGAGATAGACCGGAGCTCCGGCACCGACACGCTCGGCGTATTTACCGGATTTGAGGAATCTAGCGAT
TCTTCCGACGGGGAATTGAAGACCGGCTTTAGATGATCGAGAGACGGATTTGGTGGCCTTTGGCTTTCCTCTGCCACCT
TTGGTTGTTCCGCTTCCTGCGCCTGTACTCATCGTCTTCTTCGAAATTTAGAACAGATAAACGATTTGATGAGAGTTTG
AAGAAATCGAAGAGAAATGACTATTGTAGATGATCTCCGAATTGCGGACGCGTGGG
```

> SEQ ID NO: 6599 215279 271390_200033_1b
```
CCCTCGACCACGCGTCCGCAAGCAGCAGTTGATTATCTCAGCTGACTTTCCCACAAATCGAGAGTTAGGGTTAGGGTTT
TGTGTTTCATCTGAAAATGAGTTCTGATGGAGGATCGGGTAAGGGCAAGGGTGGCGCAGGTAGAGGAAAACCTAAGGCA
TCAAAATCGGTGTCTCGGTCTTCAAAAGCGGGGCTACAATTCCCCGTTGGTAGGATCGCTCGTTTCCTTAAGGCTGGAA
AGTATGCTGAACGTGTTGGTGCTGGTGCGCCAGTTTACCTATCTGCTGTCCTTGAATACCTAGCAGCTGAGGTGTTAGA
GTTGGCAGGGAATGCAGCAAGGGATAACAAGAAGAATCGTATTGTGCCGAGGCACATTCAGTTGGCTGTGAGGAATGAT
GAGGAGCTGAGCAAGCTTTTGGGTCAAGTTACTATTGCCAATGGAGGTGTTTTGCCCAACATTCACCAGAATCTTTTGC
CTAAGAAAGCTGGCTCTGGGAAGGGTGATATTGGCTCTGCATCCCAGGAGTTTTAGATGTAAAAATGAAGCTTTTGTTT
TCCTAAAGGATTAGGGGAAATGAGTAGACTTCCTTTATGTAATATATAAAAATACCCTTTCTAGTTTGTTA
```

> SEQ ID NO: 6600 215293 211991_300872_1b
```
GCCGCTTCTCCCTACAGCCGACCCGGTGGGCTCTCTCTCACTCTCTCCTCCCTCTCCGGTCCAACCGCCAGACTTTCGC
TCCATAACCCATCATGGCCCCCTCATCGCTTGCTCGCCCCATGCTCCGCTCGCCGGCCCTGCGCCAGCTTGCCTTCCGC
CGCTTCGAGAGCTCTGCCGCCAGCAAGGCCACCGACGCCGGCAAAGATGCTGCCGGCAAGGCCAAGGAGTACCAGGCAA
```

FIG. 2 continued

AGGCTGCGCAGGGGCTGTCGCGCGTCGCGGGTGCTGCCGGCCCTGCCATTGCCGGAGCTGCTCGTGGCCTCACCAACGC
GCTCGGGAAGGTCGGTGGACGCACCGGCAAGCTCATCAGCTTCGTTGAGAAGCAAACCCCTCAG

> SEQ ID NO: 6601 215303 206846_300826_1b
GAAAAAGGATTAATCGCAACTCCGAGATCCTGCTGAATCACAATGAGACCTACTCAGGTTCGTCTGGGCGGCGGCGCCC
CTCAACCCAAGACTGGCCACTGGCTCGGTGACTGGGGCTCCTTTGGTGGTGCCAAGCAGAAGGGCATTATCGACTACGG
CCTGTCTGCCAACCGTCAGAACCCCTTTGCCGGTGCTGCCCACGATGCCATCTTCAACACCTTCCGCCGCACCAAGTCC
CAGATCTTCTACTGGCTCCCTCCTATGCTGGCTGGCTACTACCTGCTGAGCTGGGCCACCGAGCGAAACCACTACCTCA
ACTCCAAGGCTGGCCGTGCTGAGTTTGCCGACTCGGAGTAAAATGGTGCACGAATATGTTGAATTATGGGTGTCCAGGG
GACACAGTGTATATCAGCGTCTAGATTAGGAGAAAACAATAGAAACGTTTGACTCTACGAGATATTTGATTCTGTTCTT
CGTCAAGAGATTGATACACTAATTTGACGAAAACACAAAAGAAA

> SEQ ID NO: 6602 215314 212146_300874_1b
ACTCCTTGCGAGGGAATAGCATCAAACGACGAGAGCGTCATTACTAGTCGACCAACAAAGTCCTCTCCATCCTTTTTGC
CTTCATCCTCGCCTTTTCACTCCTCGACTCTCGCCCATCATGCCTGCTAAGAAGCTCCGTTGCACCGCCAAGGACTGCC
GAGAGCCCGCTCAGCGCATCGTGGGTGACTGCACCTTTTGCAACGGCCACTTCTGCGGCAAGCACCGTTTGTTGGAGGA
CCACAAGTGCAGCGGTCTGGAAGACGTACGTTTCATCTCTGTTTCCTCCCCAGGTCTTTTTTATTTCCTCAGCTAACG
CTTGGCATGCAGTGCAAGAAGCAGTCTCACGCACGTAATGCTGCTCAGCTTGAGGCTGAGCGGACGCAAGTCATCCGAG
GCGTCTAAATCGATATCCTTGCAACTCCCCCGGAATCGCCATCATCCAACACAAATCGACCGTTTAATTACCGCACCAT
CTACTTTACTACCATTCTCCTTCACATCATGAGTTGCTAGCCATCGCGGCCCAATTCATACTCACGGACCATGATTACA
TGAAACAACATATTCTTTCGAGGGGAGAGCGAACGGGGGATGCACAGACACAG

> SEQ ID NO: 6603 215314 220854_300939_1b
AAAAGGCTCAGGTTTCCTTGCTTCGTCAGTCAGCGGTTCCATCTTGCGTCCCTTTGTGTCCTTGAGTATTTAATCCACG
GCGTCCGGCCCCCCCAGTCACTTGCCTGCCATCCTCGACAAAACACTCCTTGCGAGGGAATAGCATCAAACGACAAGAG
CGTCATTACTAGTCGACCAACAAAGTCCTCTCCATCCTTTTTGCCTTCATCCTCGCCTTTTCACTCCTCGACTCTCGCC
CATCATGCCTGCTAAGAAGCTCCGTTGCACCGCCAAGGACTGCCGAGAGCCCGCTCAGCGCATCGTGGGTGACTGCACC
TTTTGCAACGGCCACTTCTGCGGCAAGCACCGTTTGTTGGAGGACCACAAGTGCAGCGGTCTGGAAGACTGCAAGAAGC
AGTCTCACGCACGTAATGCTGCTCAGCTTGAGGCTGAGCGGACGCAAGTCATCCGAGGCGTCTAAATCGATATCCTTGC
AACTCCCCCGGAATCGCCATCATCCAACACAAATCGACCGTTTAATTACCGCACCATCTACTTTACTACCATTCTCCTT
CACATCATGAGTTGCTAGCCATCGCGGCCCAATTCATACTCACGGACCATGATTACATGAAACAACATATTCTTTCGAG
GGGAGAGCGAACGGGGGATGCACAGACACAGGCGAGAGAGATTTTTGCTTCTTTTTGCCACAGAAAGAGAGGGAATCAA
CAGAGGAGAGCACTATAAGTGACCTCTCTAGTTTTTTTGTACATTTCTACCATTTATTGTT

> SEQ ID NO: 6604 215325 23975_300219_1b
CCCACGCGTCCGTGCCATCTTTTGTCACTCATCTTCACAGGAAACAATGGTGTTTGTGAAGTCCTCCAAATCGAATGCT
TACTTCAAGAGGTACCAAGTGAAGTTCAGGAGAAGGAGAGATGGGAAGACTGATTACAGGGCAAGGATCCGTCTTATCA
ATCAAGACAAGAACAAGTACAACACCCCTAAGTACCGTTTTGTTGTTCGATTTACCAACAAAGACATTGTGGCACAGAT
TGTATCTGCAAGCATAGCTGGTGACATTGTTAAAGCTTCGGCTTACGCACATGAGCTTCCTCAGTATGGACTCACTGTT
GGTCTTACCAACTATGCTGCAGCTTACTGTACTGGCCTTCTTTTGGCTCGTCGTGTTCTGAAAATGCTGGAAATGGATG
ATG

> SEQ ID NO: 6605 215325 254663_301634_1b
ACGCGTCGGCAATCGTCGTTGGAGCTCGACAGGAGGAGGAGGAGGGGCAGAGAGAGACACATCCGTCAGCGGCCATGGTG
TTCGTGAAGGCGCTGAAGAGCAAGGCCTACTTCAAGAGGTACCAGGTCAAGTATAAAAGACGCAGAGCTGGTAAGACAG
ACTACCGTGCTCGGATCCGTCTCACAACCCAGGATAAGAACAAGTACAACACTCCTAAGTACCGCTTTGTTGTTCGATT
TACCAACAAGGATATAACTGCTCAGATTACATATGCGACCTTAGCTGGCGACATTGTGCTTGCTGCTGCATATGCACAT
GAGCTTCCCCGCTATGGCCTACCCACTGGCTTCACCAACTATTCTGCTGCCTATTGCACTGGTCTTCTATTGGCCCGCC
GTGTCTTGAAGCAATTTGATTTGGACAAGGAATATGTTGGAAATGAAGAGGCTACCGGGGAAGATTACAACATTGAAGA
AGCTGGCGAAAGGCGACCATTCCGGGCTCTGCTTGATGTTGGTCTCATTCGAACCACTACAGGAAATCGAGTCTTCGGT
GCTCTCAAGGGAGCTTTAGATGGAGGTCTTGACATCCCCACAGTGAGAAGAGATTTGCTGGCTACAGCAAGGACGATA
AGTCTCTTAATGCTGACACCCACAGGAAGTACATCTTTGCTGGGCATGTTGCAGACTACATGAAGATGTTGAAAGAGCA

> SEQ ID NO: 6606 215325 226269_300995_1b
AACAATGTCGTTCAACAAGATTGTCAAGACCTCTGCCTACCACTCTCGGTTCCAGACCCCCTTCCGTCGACGACGAGAA
GGTAAGACCGACTACTATGCTCGAAAGCGACTCGTGACCCAGCACAAGGCCAAGTACAACACCCCCAAGTACCGACTTG
TTGTGCGATTCACCAACAAGGACATCATCGCCCAGATTGTCTCTTCCCAGCTCAAGGGTGACATTGTTTTCACTGCCGC
CTACGCTCACGAGCTTCCCCGATACGGTGTCAAGCACGGTCTTACCAACTGGGCCGCTGCCTACGCCGTCGGTCTTCTT

GTTGCTCGACGAGCTCTCAAGAAGCTCGGCCTCGACGAGACCTACAAGGGAGTTGAGGAGGTTGAGGGTGAGTTTGAGC
TCACCGAGGCCGTTGAGGACGGTCCTCGACCCTTCAAGGTCTTCCTTGATGTCGGTATGACCCGAACCACCACCGGTGC
CAAGTGCTTCGGTGTTCTCAAGGGTGCTTCCGATGGTGGACTTTACGTCCCCCACTCCGCTTCTCGATTCCCCGGTTGG
GATATCGAGTCCGAGGAGCTCGACTCCGAGACCCTGCGAAAGTACATCTTCGCTGGCCACGTTTCCGAGTACATGGAGG
AGCTTGCCGATGATGATGAGGAGCGATTCCGACAGATCTTCCAGTCTTACCTCGACGA

> SEQ ID NO: 6607 215325 243810_301552_1b
GCAGGCCGAGCAGCGCAGCCATGGCCGTCGCCAAGGCGCAGAAATCCAAATCCTACTACAAGCGCTACCAGGTCAAGTA
CCGCCGCCGGCGAGAGGGTAAGACCGATTACCGCGCGCGGGTGCGATTGACAAACCAGGACAAGAACAAATACAATACA
CCAAAGTATCGATATGTTGTGCGCTTCACGAACAAGGACATTGTCGCCCAGCGTCGCTTATGCAACTATTGCTGGCGAT
GTGATCATGGCCGCGGCCTACTCGCATGAACTCCCACGATACGGTCTCAAGGTCGGCCTGACGAACTACGCAGCTGCCT
ACTGCACTGGCCTGCTCTTGGCAAGGAGGTTGCTCACGAAAATGGGGATGGCCGACCTTTACGAGGGAAACGATGACGT
AAACGGTGAGGACTACAACGTCGAGGCCGTCGATGATAACAGACGTCCATTCCGGGCTCTTCTTGACGTCGGTCTTGTC
CGGACGACAACCGGGAACCGTGTCTTAGCTGCCTTGAAGGGTGCGCTGGACGGTGGCCTCGATATCCCGCACAATGAGA
AGCGCTTCGCCGGATACAGCAAGGAGGACAAGTCCCTGAACGCTGAGGTTCACCGGAAGTACATCTTTGGCGGGCATGT
CGCTGCGTACAT

> SEQ ID NO: 6608 215325 104402_300410_1b
GCCATTACGGCCGGGGACAACAGCTTCCTTTCACTCCCCGCAACCCCTAACGCCGGCGGCGGAGGCTAATCGAAGAACA
ACAATGGCCTTCATCAAAGTCCAGAAGACGAGGGCTTACTTTAAGCGTTTCCAGGTTAAATTCAAGAGAAGGAGAGAGG
GAAAGACTGACTATACAGCCAGGAATCGGCTGATCAATCAGGACAAAAATAAGTACAACACACCAAAATACCGCTGTGT
TGACCGATTTACTAATAAGGACATTATCGCACAAATTGTGTCTGCTAGCATTGCTGGTGACATGATTCTTGCCTCTGCC
TATGCTCGTGAGTTGCCTCGTTATGGACTTAAAGTCGGACTGACAAACTATGCTGCTGCATACTGTACTGGACTTCTCT
TGGCTAGACTAGTTCTCAAAAAGCTTGAAATGGACGAAGAGTATGAAGGGAACCTCGATGTCAATGGGGAAGATTACTC
CGTTGAACCTGCTGAAAGCAGGAGGCCTTTCCGTGCTCTCTTGGATGGTGGCCTTATAAGAACTACCACA

> SEQ ID NO: 6609 215325 104575_300370_1b
CACGCCCTTAACCCCCCGCCGCCGGAGGCTAATCCAGGAGGAACAATGGCATTCATCAAAGTCCAGAAGACTAGGGCTT
ACTTTAAGCGTTTCCAGGTTAAATTCAAGAGAAGGAGAGAGGGGAAGACTGACTACAGAGCAAGGAATCGCCTGATTAA
TCAGGACAAAAACAAGTACAACACTCCAAAATATCGTTTCGTTGTCCGATTTACTAACAGGGACATAATCGCCCAAATT
GTGTCTGCTAGCATAGCTGGTGACATGATTCTTGCTTCTGCATATGCTCATGAGCTACCTCAGTATGGCCTCAAAGCTG
GACTGACAAATTATGCTGCTGCTTACTGTACTGGACTTCTCTTGGCAAGACGAGTTCTCAAGAAACTTGAAATGGATGA
GGAGTATCAAGGGAACCCTGAGGCTACTGGAGAGGATTACTCAGTTGAACCCGCTGAAAGCAGGAGGCCGTTCCGTGCT
CTCTTGGATGTGGGCCTTATTAGAACTACTACTGGAAATCGTGTTTTTGGTGCTCTAAAGGGTGCATTGGATGGTGGAC
TTGATATTCCTCATAGCGAAAAGAGGTTTGCTGGGTTCAGCAAGGACTCCAAGCAACTTGATGCTGATGTTCACCGCAA
GTACATCTATGGTGGCCATGTTGCAACATATATGAAGACGTTGACTGAAGATGAGCCTGAGAAATTTCAGTCTCACTTT
AGTGAGTACATCAAGCAAGGTCTTGAGGCTGATGATCTCGAGGAGATGTACAAGAAGGTTCATGCTGCCATACGTGCCG
ATCCAAGCCCAAAGAAATCTGAGAAGCAGCCTCCCAAGCAGCACAAGAGGTACAACCTGAAGAAGCTGACTTATGAGGA
AAGGAAGGCCAA

> SEQ ID NO: 6610 215360 175669_300543_1b
CCCCCGAGGAGGCATCCAAGCCAAGAAGAGGGAGAGCACCAAGGACACGCGACTAGCAGAAGCCGAGCGACCGCCTTCT
CGATCCATATCTTCCGGTCGAGTTCTTGGTCGATCTCTTCCCTCCTCCACCTCCTCCTCACAGGTTCTTGGTGTAGCTT
GCCACTTTCACCAGCAAAGTTTCATGTCTGATCTCGACATTCAGATCCCAACTGCCTTCGATCCCTTTGCTGAGGCCAA
TGCTGGAGACTCTGGTGCGGCTGCAGGATCAAAGGACTACGTTCATGTACGCATCCAGCAGCGTAATGGCCGTAAGAGC
CTGACCACTGTCCAGGGATTGAAGAAGGAATTCAGCTACAACAAGATCCTCAAAGATCTCAAGAAAGAGTTTTGCTGCA
ATGGTACTGTTGTCCAGGACCCAGAGCTTGGCCAGGTCATTCAACTTCAGGGTGATCAGAGGAAGAACGTATCAAATTT
TCTTGTTCAGGCCGGCATTGTGAAGAAGGAACACATCAAGATTCATGGTTTCTGAGCAACTGCCAAAACCATTGCAAAG
ACTATAGTTTGGGGTGGAGTATACTTGGTTGTGTACATGCCTGCGTGTTCCATTGTACACACAAAACCTAGCCACCTCT
TGACTCTTGAGTGTATGCTTGTTATCCGTGTGTTGAAGTTTGTAAGAGGCACCATCACTATAGATGATGGCTTGTGTCC
CTCTTTCATCAAGA

> SEQ ID NO: 6611 215360 218385_300917_1b
GCGCCAGCGCATTTAAAAAGCTCGTCGAGTCACCGCATAAAAAAAAACACACAAAAGGCGCTCAGCCCCTCTCCCCGCC
GACCCTTTTTTTCCCTGTCCCGCATCACCAAAAACCAAAACACCTCAGAGACCGTCGCCTTTCGCAGCCGCCGGTTCAT
CAACCTCGCCTCCCCCAAACTTTCCTTTTTCCCACGAGAAACCCCGGAACATCCGAGTTTATGTCCATCGAAAATCTCA
AGTCCTTCGACCCCTTCGCCGAAGCCGACGACGACACCGGTGATATCAAAAAGGTCGAGAACCATATCCATATTCGTAT
TCAACAGCGAAATGGTCGCAAGTCTCTGACCACGGTTACTGGTCTTCCTGCTAAATTTGACCCCGGCAAGATTCTCACC

FIG. 2 continued

```
TTCTTCAGGAAGGAATTCGCTTGCAATGGCAACAAGGTCAATGATGAAAAGGCCGGCGAGGTGATCCAGCTCCAGGGCG
ACCAACGCAAGAAGGTCATGGATTTCCTCGTTGACAAGAAGAGCGGTCTCGGTCTCAACCCCGATAACATCACCGTTCA
CGGTGCCTAAATCGTCCTCTTTCGCGCCGCCGCCCCGGCCCGCCCTTCCAGCGACTTGGCTTCACAGCATGCTGGTGAT
GAGCGTGTCGGAATGGGGCTGCTCGAGCAGCCTGTAACCTTACACAGACGCCTACCGCAACCTCCATCGTCTAGTCGAG
ACCGCTGAACGTCCATCCTTTGCTGGGGGCTGCGAGCGGTCTCGTGTGATAGGAGGCCCTCTCCGGTACAAT
```

> SEQ ID NO: 6612 215360 255161_301642_1b
```
GGAGGAGAGAGAGAGAAGAGGTGGTGTTCTCTGTCCTCTGTTCTCTGATCTCTTGGGTCTTCTTCAAACTCTCTTTCATGT
CCGACCTCGAGATTCAAGTCCCCTCTCCCTTTGATCCGTTCAAGGAATCGGATGACAGCAGCACCCCTGGGACAGGGTC
CAAGGACTACATCCACATTCGGATCCAGCAAAGAAATGGTCGAAAGAGCTTGACCACAGTGCAGGGCCTCAGGAAGGAA
TTCAATTACAACCGCATCCTCAAAGACTTCAAGAAGGAATTCTGCTGCAATGGAACCGTGGTCGAAGATCCTGAGCTGG
GCCAGGTGATTCAGCTTCAAGGAGATCAAAGGAAGAACGTGTCGCAGTTCTTAGTGCAGGCTGGCGTTACAAAGAAGGA
CCTAATCAAAGTGCACGGATTCTGAAAGCATTTCCTATCAGATGTAGTAGTCCTACAACATTATAATATATATATATAT
ATATATATATGCTCTTGTTCTATCCCTGGTTTAATCATGCTTTAGTTGTCTCCAACCCCCATATGAGGGGGCGGAGGC
TAACTGAACTTGATCCATGACTTTACTATTATAAAAACATTTAAGAATGTTTTCTGTTAAAAAAC
```

> SEQ ID NO: 6613 215360 226650_300999_1b
```
AACAAAAAAACACCCTCCCCCTTCACTCGACAATCTGGACATAGGTCTCTAGATCGCGCCAATAACAGTTTATGTCTAC
TTCTATCGAAAACCTCAAGTCCTTTGATCCCTTCGCCGACACTGGTGACGACGATACTCAGCCTACCAACTACATCCAT
ATCCGTATCCAGCAGCGAAACGGACGAAAGACTCTGACCACAGTCCAGGGCCTTCCCGAAGAATATGACCTCAAGCGAA
TCCTGAAGGTTCTCAAGAAGGATTTTGCCTGCAACGGAAACATCGGCAAGGACGAAGAGCACGGTGAGATTATTCAGCT
CCAGGGAGACCAGCGAGACAAGATTGTCGACTTCCTGACTGCCAAGCTTCAGATTGACAAGAAGACCATCAAGAAGCAC
GGTTTCTAAATGGATCCCGCCAGTATATGTGGCTCAAACCTGCCTGACACGACTCCCATAGCGGAGTGCGATATAACGA
GATTAATTCCAATATCTGTGAAAAAAAAAAACAAAA
```

> SEQ ID NO: 6614 215360 1097022_301436_1b
```
GGAGAGAGGAGAGAGAGAAGAGGTGGTTGTTCTCTGTCCTCTGTTCTCTGATCTCTTGGGTCTTCTTCAAACTCTCTTT
CATGTCCGACCTCGAGATTCAAGTCCCCTCTCCCTTTGATCCGTTCAAGGAATCGGATGACAGCAGCACCCCTGGGACA
GGGTCCAAGGACTACATCCACATTCGGATCCAGCAAAGAAATGGTCGAAAGAGCTTGACCACGGTGCAGGGCCTCAGGA
AGGAATTCAATTACAACCGCATCCTCAAAGACTTCAAGAAGGAATTCTGCTGCAATGGAACCGTGGTCGAAGATCCTGA
GCTGGGCCAGGTGATTCAGCTTCAAGGAGATCAAAGGAAGAACGTGTCGCAGTTCTTAGTGCAGGCTGGCGTTACAAAG
AAGGACCTAATCAAAGTGCACGGATTCTGAAAGCATTTCCTATCAGATGTAGTAGTCCTACAACATTATAATATATATA
TATATATATATATGCTCTTGTTCTATCCCTGGTTTAATCATGCTTTAGTTGTCTCCAACCCCCATATGAGGGGGCG
GAGGCTAACTGAACTTGATCCATGACTTTACTATTATAAAAACATTTTAAGAATGTTTTCTGAAAAAAAAAAAACAA
```

> SEQ ID NO: 6615 215360 1120059_301861_1b
```
AATTTATCATGTGATTAATTACTTATATCCTTTCAAGGAGGCAGATGAGAGCAGTGGGACGCCCGGGACAGGATCGAAG
GACTACGTCCATATTCGAATCCAGCAAAGGAATGGTCGCAAGAGCCTCACTACGGTTCAAGGGTTGCGAAAAGAGTTCA
ATTACAACAAGATCCTCAAAGATTTCAAGAAAGAGTTTTGCTGCAATGGGACTGTAGTCCAAGACCCTGAGCTGGGCCA
GGTCATCCAACTTCAAGGAGATCAAAGGAAGAACGTGTCTCAATTCTTAGTACAGGCTGGTGTGGCAAAGAAGGAGCTG
ATCAAAATCCACGGCTTTTGATAGTACTATTGGCTATGGCTATATATATATATATATATATATATATATATAATGGA
GATCTTTTGTTTCCATATCAATAATAGATTATGATAGGTACCTTCCCATTCTCATTACCCTCCAAGGGGGGCACTGGTT
TTCATTGAGCAAAAACATAGCATTAATGTGAGACCTCTAGTGTAATGAATGCATGGAGGGGGGTTATTTGTTACATCGC
AAACCAAATCATGTTAATTATCATACTATAGTATATCAATAAAGCATGTGATAA
```

> SEQ ID NO: 6616 215360 134874_300419_1b
```
CTCCTGGTCAAGTCTTATCTGCCGTCCTCCCTCCTCTCGCCTTCCGCCTCGCGTGCGCTCCACCACCGAAAAAAAGGAC
AGGTTCCACATAAAGACCAACGAGTAAAAGCTTGATCTGTCCGGTGCCAACCAATCAACAAACAAGTTTCATGTCTGAT
CTCGACGTTCAGCTTCCATCTGCCTTCGATCCGTTTGCTGAGGCAAATGCTGAGGACTCCGGCGCTGGCCCTGGAGCAA
AGGATTATGTGCATGTGCGCATCCAGCAGCGCAACGGCAGAAAGAGTCTAACTACTGTTCAGGGCTTAAAGAAGGAGTA
CAGTTACAACAAGATCCTCAAGGATCTGAAAAAGGAGTTCTGCTGCAATGGTACTGTAGTCCAAGATCCAGAGCTTGGC
CAGGTCATTCAGCTTCAAGGTGATCAGCGTAAGAATGTTGCCACGTTCCTAGTTCAGGCTGGGATTGCTAAGAAGGACA
ACATCAAGATTCACGGTTTCTAAGCTGCCTATAGATGCTCGTATGCAATATCGTGTGCTGCCAGATATTGGAAGCCTC
TGAAGCTACCAGTTACTGTTCTCTATATTTGAAGTCATAAGACTATTTGTTGCTATTAAAGCGATTCTTGCTTGATGCA
AGTTGTGTCCTCATTATGCACTACCAGCATATTATGAGTATGGTTTGTCTGGGATATTGTCAATCTAATAAAAGTACTT
GCTATTTGAC
```

FIG. 2 continued

> SEQ ID NO: 6617 215360 159062_200139_1b
GGAATTTTGGGTCTGTTCTAATCATCCTCATCTCTCCACTCCTTAACCTTCAGATCAGGTCTGAGCATCTAAGTTTGAA
GAGTTGCGCGTTCTCTTGTTACCCTTTTTCTTCAGCCAAGTTTCATGTCTGATCTCGACCTCCAAGTTCCTAATGCTTT
TGATCCCTTTGCTGAGGCAAATGCTGATAACTCTGGTGCGGGGACAAAAGATTATGTGCACATCCGTATACAACAAAGG
AACGGTAGAAAAAGCCTGACAACTGTGCAGGGTTTGAAGAAAGAATTCAGCTACAATAAAATTCTGAAGGATCTCAAGA
AAGAATTTTGCTGCAACGGCACTGTTGTCCAGGATCCAGAATTGGGGCAGGTTATTCAACTTCAGGGTGATCAGCGAAA
GAATGTTTCAACATTTCTTGTCCAGGTTGGAATAGTGAAAAAGAGCACATCAAGATTCATGGTTTCTGATTGCCATCA
TCAATCACTGCGCAGTTACTATACTTGTGTTTGTTCCAAATAATGCTGCTATGAACTAAGTTATTGTAAACAGTAAACT
TGCTAATGTTGGCTAT

> SEQ ID NO: 6618 215360 128327_300475_1b
TGTATTTGCTTAGACTTATCCGGAATTTGGGGTCTGCTCTATCACCTTCTCTCCCAACCCAACCTTCGGATCAGCGGCT
CTAAGCTTTTCATCTGCCCAGGTCTGAGCATCCAAGTTTCGAGATTTGTGTGCGCTTGTTGTCTTCTACTACTCAACCA
AGTTTAATGTCTGATCTCGACGCCCAAATTCCTACTGCTTTTGATCCCTTTGCCGAGGCAAATGCTGATAATTCTGGGG
CTGGGTCAAAAGATTATGTGCACATCCGTATACAACAAAGGAATGGTAGGAAAAGCCTGACAACTGTGCAGGGGTTGAA
GAAAGAATTCAGCTACAACAAGATACTGAAGGATCTCAAGAAAGACTTTTGCTGCAATGGTACTGTTGTCCAGGATCCT
GAATTAGGCCAGGTTATTCAACTTCAGGGTGACCAGCGTAAGAATGTTTCTGCATTTCTTGTCCAGGCTGGAATCGTGA
AGAAAGAGCACATCAAAATTCACGGTTTCTGATTGTTATCATCAACCTTGCTGCACAGTTATCGTACTTGTTACGTCAG
TGCCAGAGATGCTATCCAAACTTAGTTCTAGTGGAACTTGCTTGTGTCTAATTTCTGCTGGTTTGATATAAAATACTGC
AGTTGCTTGCTTCTCTATGTTCTGTATGTTGAATATGAGTTATGCTATATTT

> SEQ ID NO: 6619 215360 1171566_302056_1b
GCGTCGCCCAGCGTCGCCCAGCGTCGATTTTTTCTCTCTCCTCACTCTCTTTCTGTTCTCTCTCTCTCTCTCTCTCTGC
CTCCCCTTGCCCGTCTTTCCCAAGGCCAATTTCATGTCCGAGTTGGAGATCCAAGTCCCCACCCCCTTCGATCCTTTCA
AGGAGTCGGATGACAGCAGCACCCCTGGGACAGGGTCGAATGATTACATCCACATCCGCATTCAGCAGAGGAATGGGCG
GAAGAGCCTGACAACCGTGCAGGGCCTCAGAAAGGAGTTCAACTACAACCGCATCCTCAAAGATTTCAAGAAGGAATTC
TGCTGCAATGGGACTGTCGTCCAGGATCCTGAGCTGGGACAGGTGATCCAACTTCAAGGAGATCAGAGAAGAATGTGT
CTCAGTTCTTAGTGCAGGCCGGCGTTGCGAAAAAGGACCTGATCAAAGTGCACGGCTTCTGAAAATATCCCTCGCCCCA
TGTAGTAGGTTATGCTAGATTAATGCAAAATTATCCCCGCATATTACTTACCATTCATCATCCTTTAGGCATGCTTCAC
AAGGCAGATAATCTGCCTTGTGAAGTTGATCACTTAACTAAAAAATATATATTTAAGAAGATGCCCCCATTGTCCTAT
ATAGTTTCAATTTGTAATTGCTCTCCTTGTGTTTTCGGCTCTAT

> SEQ ID NO: 6620 215360 1108619_301519_1b
GACTAGTTCTAAATAAAGAGGCCCAACTAATTTATCTTTTTTATTTTCTTATATTCTTTTCAGCATCTCTTCTCGCTCC
AGATAGTTACGAAATCTTGAGCTTCTTCTTCATTTCAGTTTCATGTCAGACGCAGATATTCAGATTCCCGGTGCCTATG
ATCCGTTTGCAGAAGCAAATGCTGAAGATTCTGATGCGGGAGCAAAGGATTATATTCATGTACGCATACAGCAAAGGAA
TGGGCGGAAAAGCTTGACCACTGTTCAAGGGGTGAAGAAAGAGTACAATTACAACAAGATTTTGAAAGATTTCAAGAAG
GAATTCTGTTGCAATGGGACAGTGGTTCAGGATCCTGAGCTGGGTCAGGTAATTCAGCTGCAAGGTGACCAAAGAAAGA
ATGTTTCACAATTTCTTGTGCAGGCTGGCATGGTGAAGAAGGATTTAATCAAACTTCATGGTTTTTAAGCCCCCCCCCA
TGTAGTTAGTTGTGAAGT

> SEQ ID NO: 6621 215360 1097402_301444_1b
AGCTTGATTTGGTGTATTGATCTTATTTATTGTTTCAATCTTCGATAAACCTAATTCATGTCAGAACTCGATATCCAAA
TCCCCACATCTTTCGACCCATTCAAGGAGGCGGACGCGAACAATCCAGGGACAGGTTCTCGCGACTACATCCACATACG
CATGCAGCAGAGGAACGGGCGTAAATGCCTGACCACTGTTCAAGGCCTCAAAAAGGAATTCAACTACAACAAGATCCTG
AAGGACGTCAAGAAGGAGTTCTGCTGCAATGGCACAGTTGTGCAAGACTCAGAACTCGGACAAGTGATACAGTTGCAAG
GAGATCAGCGAAAGAACGTGTACCAATTCCTCATTCAGGCTGGAGTATCAAAGAAGGAGAATATTAAGCTTCATGGTTT
TTAGTCAGTCAATGCTGCCGCCAGTCTGATTTATTATTTTGCATGCTGTAATTTTAAGCAAATAATATTCAGGTTGCAG
GTTATACCTGGCTTTGTAATTCGACCGCATTTTAATAATCGCGTGGTATAGCTGAAAATATGTACTGTGGCAGCAGATT
TTATCATAATAATATAGTTACAAATTTGGTTAC

> SEQ ID NO: 6622 215369 199846_300753_1b
TCGCTTTCTAGGCCCTTGTTTCATTTGAGTTCAAACGCTTCTTCTCGTCTCTCGTTCAGAATTTATTTCGCGTCCTTCA
AACAACTCAAAATGAAGTACTCTGTCGCTGCCGTCTCGGCCTTTGCCGCCGTCGTTCTCGCCAAGCCCGAGTTCCTCAA
CTCTGCTTTCCAGGTCCAGGAGGGCAAGCCTTTTACCCTCGAGTACTCTGGCTGCTCTTCTGGCTGCGAGATTGTTCTC
CAGACTGGTGCTAGCACCAACCTGAAGGACGTCAAGGTTCTTGCTTCTTCTGCCACCGGCTCCTCCACTACCGTCACCC
TGGAGGACATTCCCTCTGGCATCTACAGCTTCAAGATCACCGACAAGAGCGGCGAGAGCAACTACAGCCAGCAGTTCTC
CTACCAGGGCAGCGGCAAGGCCATCTCCAGCGCCTCATCTGCCACCAGCGCTGCTGAGTCCAACACGGCTGCTCCCACC

FIG. 2 continued

TCCGAGACCACCACGGCTGAGCCCACCAGCACCAAGGCTTCCTCCACCAAGGAGCACTCCACCACGCTGGTCAAGTCAA
CCACTGCTCACTCCACCACCGAGGAGGCCTCGAGCACCACC

> SEQ ID NO: 6623 215379 254604_301634_1b
ACGCGTCGGAGGGGGTGAGGCTCGAAGCTACTGCGGCTGCCGGAGGAGGAGGAGGACCTGCCACGCCATGGGTATCTCA
CGAGATTCAGTGCACAAGAGGAGGGCCACTGGAGGGAAGAAGAAGGCATGGAGGAAGAAGAGAAAGTACGAGATGGGCC
GTCAGCCAGCGATGACAAAGCTGTCAAGCAACAAGACAGTGCGGAGGATCCGAGTGCGTGGTGGTAACTTCAAGTTCAG
GGCTTTGCGTCTTGACACTGGAAACTACTCCTGGGGGTCAGAGGCCACCACCCGCAAGTCGAGGATCCTGGATGTGGTC
TACAATGCCTCCAACAATGAGCTTGTCAGAACCCAGACTCTGGTCAAAAGTGCCATTGTCCAAGTTGATGCGACCCCTT
TCAGACAGTGGTACAGTCAACATTATGGCCTGGATATTGGCCGCAAAAAGAAATCCAGCAGCGCTGCCAAGAAGGAGAC
TGAGGAGGGTGATGCTGGAGATGAGGAAAAGAAGAAAAGCAAGCATGTTCTGCGAAAGCTAACAAAGAGGCAGGAAGGT
CAGAAGCTTGACTCTCATCTAGAGGATCAGTTTGCAAGTGGTCGTCTCTTGGCATGCATTTCGTCCCGCCCGGGACAGT
GTGGCCGAGCTGATGGGTACA

> SEQ ID NO: 6624 215379 237706_301280_1b
GGGCGGACGCGTGGGCGGAGCGAGGAGGAGGCGCCGCATCGTCGCGGATCGATCAGTCATGGGTATCTCCCGCGATTCG
CTCCACAAGAGGAGGGCTACCGGTGGTAAGAAGAAGCAATGGAGGAAGAAGAGAAAATACGAGCTGGGGAGGCAGCCGG
CGATGACCAAACTGGCGGCCAAGACGGTGCGGCGCATTC

> SEQ ID NO: 6625 215379 211994_300872_1b
GCCGACAAGTCGATTGCCCTGGTGAGCACCATTATCATCAGAAACCGCAATCATGGGTATCTCTCGTGACTCTCGCCAC
AAGCGCTCCGCCTCCGGTGCCAAGCGCGCCTACTACCGGAAGAAGCGCGCTTTCGAGGCTGGCCGCCAGGGTGCCAACA
CCAAGATTGGCGCCAAGCGAATCCACACCGTCCGCACTCGTGGTGGTAACCACAAGTACCGTGCCCTGCGTCTCGACTC
CGGCAACTTCGCCTGGGCCTCCGAGGGCTGCACCCGCAAGACCCGTGTCATTGCCGTCGCCTACCACCCTTCCAACAAC
GAGCTGGTCCGAACCAACACCCTGACCCGTAGCGCCATCGTCCAGATCGACGCTGCTCCTTTCCGACAGTGGTACGAGT
CCCACTACGGCCAGCCCATCGGCCGTAGACGCCAGAAGGCCCAGGCCGCCAAGGAGGGCAAGGAGGTCGAGGAGGTCAA
GAAGACCAAGTCCGTCGAGAAGAAGCAGGCTGCTCGCTACGCCGCCAACGGCAAGGTCGAGTCCGCTGTTGAGAAGCAG
TTCGAGGCCGGTCGTCTGTACGCCCGTTGTCACCGACCCGTCCCGGCCAGTCCGGCCGCTGTGACGGTTACGTTCTGGAGG
GTGAGGAGCTGGCTTTCTACCAGAAGAAGCTGCACAAATAAACTCACAATGGCGTGAGTTGGATGGTGTTCAAGGATTT
TTTCGTTATCTTGGGCATTTTCAGGGCATGAAGAGCTTTCTAACACACAAAGCATCGGAACGGGTCCATAGGGAAATGA
AAAGCTTTTCTGCAATCATGTTACTTTTTTCACGTTGTTTCATTCAAGTATGATAATGATACAAGAAACAAAACAATTC
AACACACCT

> SEQ ID NO: 6626 215379 103782_300027_1b
GGGGGCTAAGCTCTCAGCAACCATGGGTATCTCACGAGATTCTATGCACAAGAGGCGTGCCACTGGTGGCAAGAAGAAA
GCTTGGAGGAAGAAGACAAAGTATGAACTTGGCCGCCAGCCTGCTAATACTAAGATCTCGGCTAACAAGACAGTCCGAC
GAATTCGTGTGCGTGGTGGCAATGTGAAGTGGAGGGCCACTGAGATTGGATACAGGAAATTATTCATGGGGTAGTGAGGC
AGTCACACGCAAGACTCGTATCCTTGATGTGGTTTACAATGCATCAAACAATGAACTTGTTCGCACACAAACTCTGGTC
AAGAGTGCTATTGTTCAAGTTGATGCTGCGCCATTTAAACAATGGTACCTCCAGCATTATGGTGTTGACATTGGTAGGA
AGAAGAAGGGCCCTGCTAACAAGGAAACTACTGAAGAGGAGAAGGTGCTGCTGCCGCTGCAGAGGAAACTAAGAAGAG
CAACCATGTTCTCCGGAAGATTGAGACACGTCAGAAGGATCGTAAACTTGATCCTCATATTGAAGAGCAATTTGGTGGT
GGTAGGCTGTTGGCCTGTATCTCTTCTCGCCCTGGTCAATGTGGCAGAGCAGATGGGTACATTTTGGAGGGAAAAGAGC
TTGAGTTCTACATGAAGAAACTACAGAAGAAGAAAGGCAAGGCTGGAGCTGGTGGTAC

> SEQ ID NO: 6627 215379 157982_301396_1b
GTCAGCTGCAAACATGGGTATCTCAAGAGATTCTATGCACAAGAGACGTGCCACTGGTGGAAAGAAGAAAGCTTGGAGG
AAGAAGCGAAAGTACGAACTTGGACGCCAACCAGCTAATACTAAGATCTCAAGCAACAAGACAGTTAGACGAATTCGTG
TTCGTGGTGGTAATGTGAAGTGGAGGGCACTGAGATTGGATACTGGAAACTATTCATGGGGTAGTGAGGCAACCACACG
CAAGACTCGTATCCTTGATGTGGTTTACAATGCCTCGAATAATGAACTTGTCCGCACACAAACACTGGTCAAGAGTGCA
ATTGTTCAAGTTGATGCTGCACCGTTTAAACAGTGGTACCTCCAGCATTATGGTGTTGACATTGGTAGGAAAAAGAAGG
GAGCTGCTAAGAAGGAAACTACTGAGGAGGAGAAGCTGCTGCTCCAGCTGAGGAAGCTAAGAAGAGCAACCATGTAGC
CCGGAAACTTGAGAAACGTCAGAAGGATCGTAAACTTGATCCTCACCTCGAAGAGCAATTTGGTTCTGGTAGGCTATAT
GCCTGCATCTCATCTCGCCCTGGTCAATGTGGCAGAGCTGATGGGTACATTTTGGAAGGGAAGAGTTGGAATTCTATA
TGAAGAAACTTCAAAAGAAGAAAGGCAAGGCTGGATCTGGTGCT

> SEQ ID NO: 6628 215379 130770_300490_1b
GAATTCATCAGGCAACGCAGTCGAGAGGTTTCTGGTTCCATCTGCAAACATGGGTATCTCTCGTGATTCTATGCACAAA
AGACGTGCAACTGGAGGAAAGAAGAAGGCTTGGAGGAAGAAGCGAAAGTACGAGCTCGGAAGACAGCCCGCAAACACCA

FIG. 2 continued

```
AACTTTCGAGCAACAAAACTGTTCGAAGAGTTAGGGTTCGTGGAGGAAACGTGAAATGGAGAGCTCTTAGACTCGATAC
AGGAAATTTCTCATGGGGAAGTGAGACTGTGACCAGGAAATCCCGTCTTCTTGATGTCGTTTACAACGCATCTAACAAC
GAGTTGGTTAGGACTCAGACTTTGGTCAAGGGTGCTATTGTTCAAGTTGATGCTGCTCCATTTAAGCAATGGTATCTTC
AACATTATGGTCTTGATATTGGACGTAAGAAGAAGACTACTGCTGCCAAGAAAGAAGGAGAGGAGGCTGAGGCTGTANC
TGAGGAAGCAAAGAAGAGCAACCATCTCCTGAGGAAAATTGAGGGTCGTCAAGTAGATCACAAGCTTGACTCACATATT
GAAGAGCAATTCAGTGGTGGACGATTATTGGCTTGTATCTCATCTCGCCCTGGGCAGTGTGGTCGTGCTGATGGATACA
TTCTG

> SEQ ID NO: 6629  215379 130406_300487_1b
GAATTCGGGCGCGCTACAGGAGGAAAGAAAAAGGGATGGAGGAAGAAGCGAAAGTACGAGCTCGGTCGTCAGCCTGCTA
ACACCAAGCTGTCAAGCAACAAGACAGTGAGGAGAGTACGTGTTAGAGGAGGTAATGTAAAGTGGAGGGCACTCCGATT
GGATACTGGAAATTACTCATGGGGAAGTGAAACCGTTACTCGTAAGACCCGTCTTCTTGATGTCGTTTACAATGCATCG
AACAATGAGCTTGTCAGGACACAGACATTAGTGAAGAGCGCTATTGTTCAAGTTGATGCTGCTCCTTTCAAGCAATGGT
ACCTTCAGCACTATGGTCTTGACATCGGAAGGAAGAAGAAGACTGCTGCTGCCAAGAAGGAAACCACTGAGGAGGGAGA
AGCTGCTGCAGCAGAAGAAGCAAAGAAGAGTAACCATGTAATCAGGAAAGTTGAGAAGCGTCAGGTGGATCACAAACTT
GACCCTCATATTGAAGAGCAGTTTAGTGGAGGCAGACTATTGGCCTGCATTTCATCTCGCCCTGGACAATGTGGTAGAG
CTGATGGGTACATCTTGGAAGGAAAGGAGCTTGAATTTTACATGAAGAAGCTACAAAAG

> SEQ ID NO: 6630  215379 1171563_302055_1b
GCTTTAGGGAGGGGGTGAGGCTCGAAGCTACTGCGGCTGCCGGAGGAGGAGGAGGAGGACCTGCCACGCCATGGGTATCTCA
CGAGATTCAGTGCACAAGAGGAGGGCCACTGAGGGAAGAAGAAGGCATGGAGGAAGAAGAGAAAGTACGAGATGGGCC
GTCAGCCAGCGATGACAAAGCTGTCAAGCAACAAGACAGTGCGGAGGATCCGAGTGCGTGGTGGTAACTTCAAGTTCAG
GGCTTTGCGTCTTGACACTGGAAACTACTCCTGGGGGTCAGAGGCCACCACCCGCAAGTCGAGGATCCTGGATGTGGTC
TACAATGCCTCCAACAATGAGCTTGTCAGAACCCAGACTCTGGTCAAAAGTGCCATTGTCCAAGTTGATGCGACCCCTT
TCAGACAGTGGTACAGTCAACATTATGGCCTGGATATTGGCCGCAAAAAGAAATCCAGCAGCGCTGCCAAGAAGGAGAC
TGAGGAGGGTGATGCTGGAGATGAGGAAAAGAAGAAAAGCAAGCATGTTCTGCGAAAGCTAACAAAGAGGCAGGAAGGT
CAGAAGCTTGACTCTCATCTAGAGGATCAGTTTGCAAGTGGTCGTCTCTTGGCATGCATTTCGTCCCGCCCGGGACAGT
GTGGCCGAGCTGATGGGTACATTTTGGAAGGAAA

> SEQ ID NO: 6631  215379 1101065_301473_1b
GAGGTTGAGGTCGCTACTCGGAGCAGGGCCAAGATGGGTATCTCTCGTGATTCGGTACATAAAAGGCGCGCAACTGGAG
GGAAGAAGAAAGCATGGCGCAAGAAGAGAAAGTACGAAATGGGAAGGCAACCTGCCATGACAAAACTCTCAAGCAACAA
AACTGTCCGAAGGATCAGAGTTCGAGGAGGGAATTTCAAGTTCAGGGCATTGAGGCTGGACACAGGAAATTACTCTTGG
GGATCTGAGGCAGCCACTCGCAAATCAAGAATCCTTGATGTTGTCTACAATGCCTCAAACAATGAGCTAGTGCGAACTC
AAACCCTTGTGAAAAGTGCCATAGTACAGGTTGATGCTACTCCTTTCAGGCAGTGGTACAAGCAACACTATGGATTGGA
CATAGGAAGAAAGAAGAAGCTTCTGGAGGAAAGAAAGAAGAGGATGTAGAGGCAGGGGAAGAAGAGAAAAAAATAAGT
AACCATGTGCAGCGCAAAGTTGCTAAAAGGGTTGAAGGCAATAAATTAGATTCTCACTTAGAAGACCAATTTGCAAGTG
GCCGTTTATTAGCCTGCATCTCATCTAGGCCTGNGCAGTGTGGGCGGGCTGATGGATATATCCTTGAAGGAAAGGAACT
TGAGTTCTATCAGAAAAAG

> SEQ ID NO: 6632  215379 284685_200100_1b
GGGCGGACGCGTGGGCGGACGCGTGGGCTTAGCTGCTTTTAGCTCTCAGCAACCATGGGTATCTCACGAGATTCTATGC
ACAAAAGACGTGCCACTGGTGCCAAGAAGAAAGCTTGGAGGAAGAAGCGAAAGTACGAGCTTGGCCGTCAACCTGGGAA
TACTAAGATCTCAAGTAACAAGACAGTCAGACGAATTCGTGTTCGTGGTGGCAATGTGAAATGGAGAGCACTGAGATTG
GATACAGGAAACTATTCATGGGGTAGTGAAGCAACCACCCGTAAGACTCGTATCCTTGATGTGGTATACAATGCCTCAA
ACAATGAACTTGTTCGCACACAAACTCTGGTGAAGAGCGCAATCGTTCAGGTTGATGCAGCACCTTTTAAACAGTGGTA
CCTCCAGCACTACGTGTTGACATTGGTAGGAAGAAGAAGGGGGCTGCTAAGAAAGAAACTGCCGAGGAGGGAGAAGGT
GCTGCTGCTGCAGAGGAAACTAAGAAGAGCAACCATGTAGCCCGAAAACTTGAGAAACGCCAGAAGGATCGCAAACTTG
ATGCTCACCTTGAAGAACAATTTGGTGCGGGTAGGCTGTTGGCCTGCATCTCATCTCGGCCCGGTCAGCGTGGCAGAGC
TGATGGGTATATCTTGGAGGG

> SEQ ID NO: 6633  215379 50242_300165_1b
CCCCTCCACCCACGCGTGCGCTTTTGGAGAAACCCTAATCGGCGACAATGGGTATTTCTCGTGACTCTATCCACAAGAG
GCGTGCCACTGGAGGCAAGCAGAAGCAATGAGGAAGAAGCGAAAGTATGAGATGGGAAGGCAGCCAGCCAACACCAAG
CTCTCAAGCAACAAGACGGTCAGAAGAATAAGAGTTCGTGGTGGAAATGTAAGTGGCGTGCGTTGAGGCTCGATACTG
GTAACTACTCGTGGGGAAGTGAAGCAACTACCCGCAAGACCAGAGTCCTTGATGTGGTCTACAATGCCTCCAACAATGA
GCTTGTACGTACTAAGACACT
```

FIG. 2 continued

> SEQ ID NO: 6634 215382 268876_200122_1b
GCCGGTAGGCAGTAGTGAGCGCAGAAGCAGGGAGAGACACAAAAAATGAAGACTATACTCTCATCAGAAACGATGGATA
TCCCCGATGGGGTGAAAATCAAGGTAAAAGCAAAGCAAATAGAAGTGGAGGGACCAAGAGGAAAGCTAACCCGCAACTT
CAAGCACTTGAATCTTGATTTTCAGCTCATAAAAGATGAAGAAACTGGAAAGAAAAAGCTCAAGATTGATGCTTGGTTT
GGATCTCGTAAAACCACAGCTGCTATTCGCACTGCTCTTAGTCACGTTGATAATCTCATAACTGGTGTCACAAAAGGGT
ACCGTTACAAGATGCGTTTTGTTTATGCCCATTTTCCTATCAATGCTTCTATCACTGGTGGGAACAAGGCTATTGAGAT
CAGGAACTTTCTGGGCGAGAAAAGGGTGAGGAAAGTCGATATGCTTGATGGGGTTACTGTTGTGAGGTCTGAGAAAGTT
AAGGATGAATTGGTATTGGATGGAAATGACATTGAGCTTGTTTCTCGGTCTGCTGCCCTCATCAATCAGAAATGCCATG
TGAAGAACAAAGATATTCGTAAGTTCCTGGATGGTATCTATGTGAGTGAGAAGGGAAGAATAGCCGAAGAAGAGTAAGT
TTTAGCAGATTGGTTGGGGGTTGTTTGGGGATCATCTGCTGATTTCATACGAACTCATATTTGAAGTTAATTCAACAAT

> SEQ ID NO: 6635 215382 48461_300376_1b
GCTGCTAGGGTTTTAGCGATCGCCATTTTCACACACACAGAAGGAGAGCGGAAGAGAGAAACTAAGACAAGATGAAGAC
CATTCTGTCATCAGAAACCATGGATATCCCCGACGGCGTGAGCATCAAGGTGAAGGCAAAGCAAATCGAAGTAGAGGGA
CCAAGGGGCAAACTTGTCCGAAACTTCAAGCATCTCAACCTCGATTTTCAGCTGATCAAGGATGAGGAAACTGGCAAGA
AGAAACTGAAGATCGACGCTTGGTTTGGATCTCGTAAGACTACCGCTGCTATCCGTACTGCTCTTAGCCATGTTGAGAA
TCTCATCACTGGTGTTACGAAAGGTTACCGCTACAAGATGCGTTTCGTGTATGCTCACTTTCCCATCAATGCCTCCATC
ACCGGTGGTAACAAGTCCATTGAGATCCGTAACTTCCTTGGCGAGAAGAGGGTTAGGAAAGTGGACATGCTTGATGGGG
TTACAGTTGTTCGATCTGAGAAGGTGAAGGATGAGCTTGTATTGGATGGAAATGACATTGAGCTCGTTTCTCGCTCTGC
TGCCCTCATCAATCAAAATGCCATGTGAAGAACAAGGATATCCGAAAGTTTCTTGATGGTATCTATGTCAGTGAGAAG
GGCAGAATTGCAGAAGAAGAATGAGCAGCTGTTTTAGAAGTAGGCATATCACTGATGATTCATATCCAGAATGCCCTTT
TTACTTTTC

> SEQ ID NO: 6636 215382 136965_300440_1b
CCCCCCCCCGCTTCCTTCTTCTTCCACGCCGGGCATCGCCGCCGCCGCCGCCGCCGCCGGAGAGGGAGAGAGAGAGAGA
GAGATCGAGAGCAAGAGATGAAAACGATCTTGGCTTCGGAGACGATGGAGATCCCGTCGGGGGTGACGGTGCACGTGGC
GGCGAAGGTGGTGACGGTGGAGGGTCCCCGTGGGAAGCTGACGCGCAACTTCAAGCACCTGAACCTGGACTTCCAGCTG
CTGGAGGTGGAGGGGGTGAGGAAGCTGCAGGTGGACGCGTGGTTCGGCACCCGCCGCACCATGGCCGCCATCCGCACCG
CCATCTCCCACGTCCAGAACCTCATCACCGGCGTCACCAAGGGCTACCGCTACAAGATGCGCTTCGTCTATGCCCATTT
CCCCATCAACGCCTCCATCACCAACTCCAACACCGCCATCGAGATCAGGAACTTCCTCGGCGAGAAGAAGGTGAGGAAA
GTGGACATGCTTGAGGGTGTGACAATTTTGCGTTCTGAGAA

> SEQ ID NO: 6637 215382 217771_300911_1b
AATTCGTGATCGCGGAAGGGACGACTCCAGATACCCTCAACGCCCCGACAACCCCCAAGTCACAGCAGCCATGAGGTAC
ATTCACTCTCAGGAGATCCTGGAAATTCCAGAGGGCGTCAAGGTCAACATCAAGACCCGTATCGTCACCGTTGAGGGTC
CCCGAGGCAAGCTCACCAAGAACCTCGGTCACTTGGCTGTCAACTTCGGTCACCCCAAGAAGAACACCATCTCCATCGA
GATCCACCACGGCAACCGTAAGAATGTCGCCACTCTCCGTACCGTCCGCTCCATCATCGAGAACTTGATCACCGGTGTC
ACCAAGGGCTTCAAGTACAAGATGCGATACGTCTACGCCCATTTTCCCATCAACGTCAACCTGGACAAGAACAAGGAGA
CCGGTCTGTTCGAGGTGGAGATCCGAAACTTCATCGGCGAGAAGATCGTCCGACGGGTTACCATGCACGAGGGTGTCGA
TGTTGAGATCTCCAAGGCCCAGAAGGATGAGCTCATCGTGACCGGCAACTCACTCGAGAACGTTTCCCAGAGCGCCGCA
GATATCCAGCAGATCTGCCGGGTGCGCAACAAGGATATCCGAAAGTTCTTGGACGGTCTGTACGTTTCCGAGAAGGGCA
ACGTTGTTGAGGAGGCTTAAATGTACCGGACAAGGATCTCTGTTTCTTTTGCGTTTCTGGGACTCCGGAGTGGCGAAGG
TTCATCATTGCATGTCACGTAGCAACGGGGCTACTCTTTTACAAAAAATACATTAAAAAGTATTTTGTAACAAAAAAAA
AAA

> SEQ ID NO: 6638 215382 258567_301697_1b
GCAATGAAGTCATCCAGTCCGACGTTCTGCTCGATATCCCCGAGGGTGTCACCGTTGACATCAAGGCCCGACGAATCAC
CGTCACCGGCCCCCGAGGTACCCTCAAGAAGAACCTGTCTCACATCAACGTTGCCTTCGAGAAGGTCTCCGATGACCAG
ATCAAGATCACCATCTTCGATGGTGACCGAAAGCACGTCGCTGCTCTGCGAACCGTCAAGACCCTCATCAACAACATGA
TCACCGGTGTCACCCGAGGTTACAAGTACAAGATGCGATACGTCTACGCCCATTTCCCCATCAACGTCAACCTCATTAA
GGACGGTTCCGTCGTTGAGATCCGAAACTTCCTCGGTGAGAAGCGAGTCCGAGAAGTCCCCATCCACGAGGGCTGCAGC
GCTGAGATCTCTACCAACCAGAAGGATGAGATCTGCATCATCGGTAACTCCATCGAGAACGTCTCTCAGACCTGTGCTG
ACATCCAGCAGATCTGGCGAGTCCGACACAAGGATATCCGAAAGTTCCTTGATGGTATCTACGTTTCCGAGAAT

> SEQ ID NO: 6639 215382 237440_301287_1b
GGGTGCGAGGAGGAGGAGGCGGGCGCGATGAAGACGATCTTGTCGGCCCAGACGATGGACATCCCCGAGGGGGTGAAGG
TAGAGATCCGGGCGAAGCAGATCCGGGTGACGGGGCCGCGGGGGGTGCTGCACAGGAATTTCAAGCACCTCAACCTCGA
CTTCCAGCTGCTGGAGAATGGGCGCAAGCTCAAGGTGGAGGCGTGGTTTGGGTCGCGCAAGACCATCGCCGCCATCCGC

FIG. 2 continued

```
ACCGCCGTGAGCCACGTGAAGAACCTCATCACCGGCGTCACCAAGGGCTTCCAGTACAAGATGAGGTTTGTCTACGCTC
ACTTCCCCATCAACGCCAACATCTCTGCCACCAAGCAAAACATCGAGATCCGGAACTTCCTCGGCGAGAAGAGGGTGAG
AACTGTCGACATGCTTCCGGGTGTGACTGTGACCAGGACGGAGAAGGTCAAGGACGAGCTTGTTCTCGAGGGGAATGAC
ATCGAGCTTGTGTCGAGATCGGCCGCTCTCATCAACCAGAAATGCCATGTCAAGAACAAGGATATCAGGAAGTTCTTGG
ATGGTATCTACGTGAGCGAGAAGGGAACGATCGCTGTGGAGGAGTAGACCTGTTGCCTGTTCTGAGTATAAT

> SEQ ID NO: 6640 215387 167771_300550_1b
GAATTCTCTGCAAAGGATTCTACCCGCCACCGGGGTGGTAATAGTACTTCAGGGCGGCCCGCGCAGCTCGTCCGCTGCG
AGGGCTACGCCCACGGCACGTGCCTCTGGGGACCCGAAGGTCCCTACTGCAGGTCGGCAATCGGGCGACGGGCGCATGC
GCCGCTTCTTTAGCCTGGATTCTGACTTAGAGGCGTTCAGTCATAATCCTGCACACGGTAGCTTCGCGCCACTGGCTTT
TCAACCAAGCGCGATGACCAATTGTGTGAATCAACGGTTCCTCTCGTACTAGGTTGAATTACTATCGCGGCACTGTCAT
CAGTAGGGTAAAACTAACCTGTCTCACGACGGTCTAACCCCAGCTCACGTTCCCTATTGGTGGGTGAACAATCCAACAC
TTGGTGAATTCTGCTTCACAATGATAGGAAGAGCCGACATCGAAGGATCAAAAAGCAACGTCGCTATGAACGCTTGGCT
GCCACAAGCCAGTTATCCCTGTGGTAACTTTTCTGACACCTCTAGCTTCAAATTCCGAAGATCTAAAGGATCGATAGGC
CACGCTTTCACGGTTCGTATTCGTACTGGAAATCAGAATCAAACGAGCTTTTACCCTTTTGTTCCACACGAGATT

> SEQ ID NO: 6641 215387 1990_300335_1b
AATTCGGCACGAGGACGGCGGGCGCATGCGTCGCTTCTAGCCCGGATTCTGACTTAGAGGCGTTCAGTCATAATCCAGC
GCACGGTAGCTTCGCGCCACTGGCTTTTCAACCAAGCGCGATGACCAATTGTGCGAATCAACGGTTCCTCTCGTACTAG
GTTGAATTACTATTGCGACACTGCCATCAGTAGGGTAAAACTAACCTGTCTCACGACGGACTAAACCCAACTCACGTTC
CCTATTG

> SEQ ID NO: 6642 215387 137761_300686_1b
GCCCGCCGCCCGTTGGGAAGGGAGCTTCGAGGCGGCCGGCCGCGGCGCGTCGGCCGGGCCGGCTTGGCCGGTGGCACGG
GCCCTTGGGGGCTTGCGCCCCTAACGTGGGTCGGGGCGGGCGGCGGGCGCAGGCGCCGCTTGCTAGCTTGGATTCTGAC
TTAGAGGCGTTCAGTCATAATCCGGCACACGGTAGCTTCGCGCCACTGGCTTTTCAACCAAGCGCGATGACCAATTGTG
TGAATCAACGGTTCCTCTCGTACTAGGTTGAATTACTATCGCGGCACGGTCATCAGTAGGGTAAAACTAACCTGTCTCA
CGACGGTCTAAACCCAGCTCACGTTCCCTATTGGTGGGTGAACAATCCAACACTTGGTGAATTCTGCTTCACAATGATA
GGAAGAGCCGACATCGAAGGATCAAAAAGCAACGTCGCTATGAACGCTTGGCTGCCACAAGCCAGTTATCCCTGTGGTA
ACTTTTCTGACACCTCTAGCTTCAAACTCCGAAGGTCTAAAGGATCGATAGGCCACGCTTTCACGGTTCGTATTCGTAC
TGGAAATCAGAATCAAACGAGCTTTTACCCTTTTGTTCCACACGAGATTTCTGTTCTCGTTGAGCTCATCTTAGGACAC
CTGCGTTATCTTTTAACAGATGTGCCGCCCCAGCCAAACTCCCCACCTGACAATGTCTTCCGCCCGGATCGGCCCGAGG
GACTCGGGCCTTAGAGCCAAAAGGAGGGGCCAGGCCCCGCTTCCGACTCACGGAATAAGTAAAATAACGTTAAAAGTAG
TGGTATTTCACTTGCGCCCGAGGGCTCCCACTTATCCTACACCTCTCAAGTCATTTCACAAAGTCGGACTAGAGTCAAG
CTCAACAGGGTCTTCTTTCCCCGCTGATTCCGCCAAGCCCGTTCCCTTGGCTGTGGTTTCGCTGGATAGTAGACAGGGA
CAGTGGGAATCTCGTTAATCCATTCATGCGCGTCACTAATTAGATGACGAGGCATTTGGCTACCTTAAGAGAGTCATAG
TTACTCCCGCCGTTTACCCGCGCTTGGTTGAATTTCTTCACTTTGACATTCAGAGCACTGGGCAGAAATCACATTGCGT
CAGCATCCGCGAGGACCATCGCAATGCTTTGTTTTAATTAAACAGTCGGATTCCCCTTGTCCGTACCAGTTCTGAGTCG
GCTGTTCGACGCCCGGGGAAGGCCCCCGAGGGGGCCGTTCCCGGTCCGTCCCCCGGCCGGCACGCGGCGGCCCGCTCTC
GCCGCGCGAGCAGCTCGAGCAGTCCGCCGGCAGCCGACGGGTTCGGGGCCGGGACCCCCGAGCCCAGCCCTCAGAGCCA
ATCCTTTTCCCGAAGTTACGGATCCGTTTTGCCGACTTCCCTTGCCTACATTGTTCCATTGGCCAGAGGCTGTTCACCT
TGGAGACCTGATGCGGTTATGAGTACGACCGGGCGTGGACGGTACTCGGTCCTCCGGATTTTCAAGGGCCGCCGGGGGC
GCACCGGACACCGCGCGACGTGCGGTGCTCTTCCGGCCGCTGGACCCTACCTCCGGCTGAACCGTTTCCAGGGTTGGCG
GGCCGTTAAGCAGAAAAGATAACTCTTCCCGAGGCCCCCGCCGGCGTCTCCGGACTTCCTAACGTCGCCGTCAACCGCC
ACGTCCCGGCTCGGGAAATCTTAACCCGATTCCCTTTCGGGCACGCGCGTGGTCGCGCTCTCTGCCGGGGTTACCCCG
TCCCTTAGGATCGGCTTACCCATGTGCAAGTGCCGTTCACATGGAACCTTTCTCCTCTTCGGCCTTCAAAGTTCTCATT
TGAATATTTGCTACTACCACCAAGATCTGCACCGACGGCCGCTCCGCCCGGGCTCGCGCCCCGGGTTTTGCG

> SEQ ID NO: 6643 215387 29693_300154_1b
CGGACGCGTGGGCGGACGCGTGGGCGGAATTCGAAGCTAGAGGTGTCAGAAAAGTTACCACAGGGATAACTGGCTTGTG
GCAGCCAAGCGTTCATAGCGACGTTGCTTTTTGATCCTTCGATGTCGGCTCTTCCTATCATTGTGAAGCAGAATTCACC
AAGTGTTGGATTGTTCACCCACCAATAGGGAACGTGAGCTGGGTTTAGACCGTCGTGAGACAGGTTAGTTTTACCCTAC
TGATGACAGTGTCGCAATAGTAATTCAACCTAGTACGAGAGGAACCGTTGATTCGCACAATTGGTCATCGCGCTTGGTT
GAAAAGCCAGTGGCGCGAAGCTACCGTGCGCTGGATTATGACTGAACGCCTCAAGTCAGAATCCGGGCTAGAAGCGAC
GCATGCGCCCGCCGTCCGATTGCCGACCCGCAGTAGGGGCCTTTGGCCCCAAGGGCACGTGTCGTTGGCTAAGTCATC
GCGGCGGAAG
```

FIG. 2 continued

> SEQ ID NO: 6644 215387 55512_300128_1b
CGCAGGTGTCCTATTATGAGCTCATTGTGAACAGAAATCTCGTGTGGAACAAAAGGGTAGAAGCTCGTTTGATTCTGAT
TTTCAGTACGAATACGAACCGTGAAAGCGTGGCCTATCGATCCTTTAGACCTTCGGAATTTGAATCTAGAGGTGTCAGA
AAAGTTACCACAGGGATAACTGGCTTGGGGCAGCCAAGCGTTCATAGCGACGTTGCTTTTTGATCCTTCGATGTAGGCT
CTTCCTATCATTGTGAAGCATAATTCACCAAGTGTTGGATTGTTCACCCACCAATAGGGAACGGGAACTGGGGTTAG

> SEQ ID NO: 6645 215420 259424_301705_1b
GATCGAGGCTTGTGCCCTCCACACTCATTTGTGCTCGTCGTCGAGAGGAGACGAGAGGCGAGAGGAGAGGACGCATTCT
TGGATCTAGATCGACAATCAGAATGGGCAAATCTTATCCTGCAGTGAGCGACGAGTACCTGGCCGCCGTCGACAAGGCC
AAGAGAAAGCTTCGCGGCTTCATCGCAGAGAAGAACTGTGCCCCATTGATGCTTCGTCTTGCATGGCATTCGGCCGGGA
CTTTCGACTGTGCGTCCAAGACGGGTGGTCCCTTTGGAACCATGAAGCACGCCGAAGAACTCGGCCACGGCGCGAATGC
CGGCCTCGACATCGCTATCAAGCTTCTCCAGCCGATTAAAGACCAGTTTCCGGTCCTGAGCTATGGCGACTTCTACCAG
CTTGCTGGGGTCGTCGCAGTGGAGATCACTGGAGGCCCGGATATTCCATTCCATCCGGGGAGAGTGGACAGGGAGACAT
GCCCCGTAGAGGGCCGGCTTCCAGACGCGACCAAGGGAGCCGATCATCTCCGTGACGTTTTTGTGAAGCAAATGGGGCT
CTCTGACAAGGACATTGTGGCTCTTTCTGGCGGTCACACTTTGGGAAGAGCACACAAGGAAAGGTCGGGTTTTGAGGGC
CCATGGACGCACAACCCTCTCCAGTTTGACAACTCCTACTTCACACTTCTGCTGAGCGGCGAGCAAGAAGGCATCCTGA
CGCTCAAGACGGACAAGGTTCTGGTG

> SEQ ID NO: 6646 215420 230081_301053_1b
GAGGAGAGGGAGAGAATGCCGGTGCCGGTGGTGGACAATGCGTACCTCAAGGCGATCGAGTCGGCGAGGCGCGATCTCC
GCGCGTTCATTGCGGAGAAGAATTCCGCGCCACTGATGCTTCGGTTGGCATGGCACGATGCCGGGACGTATGATGCTGT
GTCCAAGACTGGAGGACCGAATGGATCGATCCGGAGCGAGCGCGAGTATACCCACGCTGCCAACAATGGGATCAAAATC
GCCATAGACTTTTGTGAGCCTATCAAACAGAAATATCCCATTATCACGTATGCTGATCTCTACCAGCTTGCTGGCGTTG
TTGCTGTGGAAGTCACTGGAGGTCCTACAATAAATTTTGTTCCTGGCCGCAAGGAATCGGTCGCTACTACACCCGAAGG
ACGGCTTCCCGATGCTCATCTTGGGGCAAAGCATATCCGCGATGTCTTCTACAGAATGGGTCTATCTGACAAAGATATC
GTCGCTCTCTCTGGTGGTCACACACTGGGTAGAGGACACAAGGAAAGGTCTGGGTTTGAGGGACCCTGGACATCACAGC
CATTGAAGTTCGACAACTCATACTTCACGGAGCTTTTGAGAGGAGAATCGGAAGGCCTGTTGCAGTTGCCGACAGACAA
GTGCTTGCTTGAGGATCCATCGTTCCGTCCATACGTGGAGCTGTATGCAAAGGACGAAGACGCATTCTTCAAAGATTAC
GCCGAGTCGCACAAGAAGCTATCCGA

> SEQ ID NO: 6647 215420 226334_300996_1b
CAAGACACACTCTCAAGATGCGATCTTTCCGAGCAGTCCGAAACTTCTCCACCACCGCCAAGCGCCTCAGCCAGGCCCC
CAAGGCCTCCACTCCTAACGCCTCCTCTGGAAACGGCTTTGTGTTGGCCTTTGTGGCCTCCGCCGCTGGAGCCGGTGCC
TACTACTACTACGCCAACTCCCCTGCCGCCAAGGTCGAGACCTTTAACGCCACCAAGGCCGACTACCAGAAGGTGTACG
ACGCTATTGCCGACAAGCTGATTGAGGACGACGACTATGATGATGGATCTTACGGACCCGTCCTCCTGCGACTCGCCTG
GCACTCGTCTGGTACCTACAACAAGTCTGATAACAAGTTTGGCTCTTCCGGAGGTACCATGCGATTCAAGCCCGAGGCT
TCTCATGCTGCCAACAATGGCCTGGTTAACGCCAGAAACTTCCTCAAGCCCATCCACGAGAAGTTCCCTTGGATCTCCA
CCGGTGATCTGTACACTCTTGGTGGTGTCACCGCCGTCCAGGAGCTCGGTGGCCCTATCATCCCTGGAAGCGAGGCCG
TGTCGACGAGCCCGAGTCTGCTTCTCCTCCCGATGGATCTCTTCCCGACGCCTCTCAGGGCGCTACTCATGTGC

> SEQ ID NO: 6648 215420 189010_300612_1b
TAGAACTAGTCACACCACACGCTTGGCTTGACGCCGCACGCCTCCGCTCCGCTCCGCCGCCGCGGCCGATCTCTCTAGG
GCTTCCAACCTCGCCGGCGACGCGACGCCACGCCATGGCCGCCCCGGTCGTGGACGCCGAGTACCTCCGCCAGGTCGAC
AGGGCGCGCCGCCACCTCCGCGCCCTCATCTCCTCCAAGGGATGCGCGCCCATCATGCTCCGCCTCGCATGGCATGACG
CGGGCACTTATGACGTGAACACAAAAACTGGTGGTGCAAATGGTTCAATTAGATACGAGGAAGAGTACACTCACGGTTC
AAATGCTGGTCTAAAGATTGCTATTGATCTTCTCGAGCCTATTAAAGCCAAGAGCCCTAAGATCACATATGCTGACCTT
TATCAGCTTGCTGGAGTTGTTGCAGTTGAAGTTACTGGGGGTCCAACTGTTGAGTTCATTCCTGGAAGACGTGATTCGT
CAGTTTGCCCCGTGAAGGGCGTCTTCCTGATGCTAAGAAAGGTGCACTGCACTTGAGGGACATCTTTTACCGGATGGG
CTTATCAGACAAAGATATAGTAGCTTTATCTGGGGGTCACACTCTGGGAAGGGCACATCCTGAAAGGTCTGGA

> SEQ ID NO: 6649 215420 57123_300378_1b
CTTATCCTCATTCACCTTTCCTCCAGCAATGGCGAAGCCAATCGTCGACACGGAGTACCTCAAAGAAATTGAGAAAGCT
CGTCGCGACCTCCGCGCTCTCATCTCCAGCAAAAACTGTGCTCCTATCATGCTTCGCTTAGCATGGCACGATGCAGGAA
CGTACGATGCTAAGTCTAAGACCGGTGGACCGAATGGTTCCATCAGAAATGAGGAAGAGTTCAGTCACGGTGCTAATAA
TGGATTAAAAATCGCTCTTGACTTTTGCGAAGCAGTGAAGTCTAAACATCAAATGATAACGTATGCAGATTTGTACCAG
CTTGCAGGAGTTGTTGCAGTTGAAGTCACTGGTGGTCCGACCATTGATTTTGTCCCTGGTAGGAAGGATTCCAGTGTTT

FIG. 2 continued

CTCCAAAGGAAGGACGGCTGCCAGATGCTAAACAAGGTGTGCCACATCTGAAAGATGTATTTTATAGGATGGGTTTGTC
TGACAAAGATATAGTGGCACTATCTGGTGGTCACACACTGGGAAGGGCACATCCAGATAGATCAGGCTTTGATGGTCCA
TGGACAAAGGAGCCACTGAAATTTGACAATTCATATTTTGTGGAGCTGCTTAAGGGGGAAACTGAGGGCCTGCTGAAAC
TTGCTACAGACATAGC

> SEQ ID NO: 6650  215420  1100336_301459_1b
AAACTTACCGTCTCCCCCTTTCGTCCATTTGTGATCGAGTAGGAGAGAGAGAGAGAGAGGGAGGAAAGAGGAAGAAGAA
GAGGATGGCGCCTCCAGTTGTAGATGATGCCTACCGCGGAGCCATCGGGAAGGCCCGCCGTGACCTCCGCGCCTTCATT
GCCGAGAAGAACTGCGCTCCCATCATGCTCCGCCTTGCATGGCACGATGCTGGTACCTATGATGCCAAAACAAAAACTG
GTGGTGCAAATGGATCAATACGAAATGAGAAGGAACTTCTCCATGGGGCAAATAGTGGTTTGAAAATAGCCATTGATTT
TTGTGAAACACTGAAGGTGAAGTATCCAGCTATCACACATGCTGACTTTTACCAGCTGGCTGGTGTTGTTGCAGTTGAG
GTTACTGGAGGACCCACAGTTGAATTCATTCCTGGTCGTAAGGATTCCCTGGTTTCTCCTTCGGAAGGACGCCTTCCAG
ATGCAAATAAAGGTGCGGCACATTTGAAGGATATATTCTATCGAATGGGTCTTTCAGACAAAGATATTGTAGCTCTGTC
AGGGGCACATACACTTGGAAGAGCACATGTACAGAGGTCTGGTTTTGAAGGACCATGGACACAGCAGCCCCT

> SEQ ID NO: 6651  215422  208035_300831_1b
GCGCGTAGACGCCCGCTTATCCAGACTCTCTCTCTCTCAAATCACAGTCGAACACGTTCTTCGCACCATCCACAGCCAT
GCCTCCCAAGAAGACCGAAGGTGCTGCCCCCAAGGCCAAGTCTGGCGCTGCCCATGCCAGCTACCAGCTCAAGGATCGC
AATGGCTCTAGCCGTCAGTCTCTGAAGAAGTACGTCA

> SEQ ID NO: 6652  215422  218582_300958_1b
CCCACGCGTCCGCCCACGCGTCCGCCCACGCGTCCGCCCACGCGTCCGCCCACGCGTCCGCCCACGCGTCCGCCCACGC
GTCCGAGAAATCAATTACAATCCCTCAATCCAGTCGCGTCAGACGCCCGCTTATCCAGACTCTCTCTCTCTCAAATCAC
AGTCGAACACGTTCTTCGCACCATCCACAGCCATGCCTCCCAAGAAGACCGAAGGTGCTGCCCCCAAGGCCAAGTCTGG
CGCTGCCCATGCCAGCTACCAGGACATGATTACGGATGCCATTCTCAATCTCAAGGATCGCAATGGCTCTAGCCGTCAG
TCTCTGAAGAAGTACGTCAAGGCCAACAACACCTTGAACGTTTCGGACAACATGTTCGATTCTCTCTTCAACAAGGCCC
TCAAGGCCGGTGTTGAGAAGGGCATCTTCGCCCAGCCCAAGGGCCCCTCTGGAGGCACCAAGCTGGCCAAGAAGAAGCC
CGAGGCCAAGAAGGCTGCCGCTCCCAAGAAGGAGAAGGACGCCACTGCTAAGAAGGCCACTGCCACCAAGAAGGCCGCC
GCCCCCAAGAAGGCCAAGGAGGGCGCCGAGAAGAAGGAAAAGAAGGAAGAAGGAGGCGCTGCCACCAAGAAGGCTG
CTGCTCCCAAGAAGGCCACCGCCACCGCTAAGAAGACCAAGGAGGCTCCCGCCAAGCCCGAGAAGCCTGAGACCGTTCT
GACCAAGACCAAGTCCGGCCGTGTTGCCAAGGCCCAGAAGCCCGCTGCCACCAAGAAGGCCGCACCAAAGAAGGCTGCT
GCTCCCAAGAAGGAGAAGGCTGCTGCTGCCGCTCCCGCAGCCGCCGCTGCCACCAAGGCGTAATTGATCTCCTTGGCGT
GAGCAAAAGCAGCTTTTCTTTTACTTTTTGTATCCTTGATGAATGTGGCACGG

> SEQ ID NO: 6653  215431  236778_301261_1b
GGGTTGGAGGCGCCGCGGCATGGCGGAAAAGCAGAACCCCATGCGGGACATCAAGGTCCAGAAGCTCGTCCTCAACATC
TCCGTCGGCGAGAGCGGCGATCGTCTCACCAGGGCCGCCAAGGTCCTGGAGCAGCTCAGCGGGCAGCAACCTGTCTTCT
CCAAGGCCCCGGTTCACGGTCCGGTCTTTTGGCATCCGGCGTAACGAGAAGATCGCTTGCTACGTGACCGTTCGGGGCGA
CAAGGCGATGCAGCTACTCGAGAGCGGGCTCAAGGTCAAGGAATACGAGCTGCTGCGCCGCAACTTCAGTGACACTGGA
TGCTTTGGCTTCGGCATCCAGGAGCACATCGACCTGGGCATCAAGTACGATCCATCGACGGGCATTTACGGGATGGATT
TCTACGTAGTGCTGGAGCGGCCTGGCTACCGCGTCGCGAGGAGGCGGCGGTGCAAGTCCAAGGTTGGGATCAAGCACCG
GGTGACCAAGGAGGACGCCATGAAGTGGTTCCAGCTCAAGTACGAGGGCGTCATCCTCAACAAGTCCCAGGCCTTCTGA
CCTGCTTGACACATAAAAACCAAAGCCGGATGTAACCTCTCTTGTGGTGTGTTTTATATCAGCTTTTTTCCAATGATCT
AGAAAGTTTTCGGTCAG

> SEQ ID NO: 6654  215431  254679_301634_1b
GGGGATATTGAGGAGGAGAGTCTGTCGTTGTACCAGGAGGAGGAGGAGGACGAGTAGGAGGAGGCCTAGGGTTTAGTAG
AAGACAGCAACCATGGTGGCCGCGGAGAAGAAGCTGTTGAACCCCATGAGGGAGATCAAGGTGCAGAAGCTCGTCCTCA
ATATCTCCGTTGGTGAGAGTGGTGATCGCCTTACCAGGGCTGCTAAGGTGTTGGAGCAATTGAGTGGACAGACCCCTGT
CTTCTCGAAAGCTAGATACACTGTGCGTTCATTCGGTATCCGCCGTAATGAAAAGATTGCATGCTATGTGACTGTCAGA
GGAGAGAAGGCAATGCAATTGCTAGAGAGTGGCTTGAAAGTCAAGGAATACGAGTTGCTGCGCAGGAATTTCAGTGACA
CTGGTTGCTTTGGCTTTGGAATTCAGGAGCACATTGATTTGGGAATCAAGTATGACCCATCGACAGGTATCTATGGTAT
GGATTTCTTTGTAGTTCTGGAGAGGCCAGGATTCAGAGTTGCGAGGAGAAAGAGGGCGCAGGCACGTGTTGGCATTCAG
CAAAG

> SEQ ID NO: 6655  215431  228247_301019_1b
GATGCGGGAGATCAAGGTGCAGAAGCTCGTGCTCAACATCTCCGTCGGCGAGAGCGGCGACAGGCTCACCCGCGCCTCC
AAGGTGTTGGAGCAGCTGAGTGGGCAGAGCCCAGTTTTCTCCAAGGCGAGGTACACCGTGAGGTCATTCGGTATCCGTC

FIG. 2 continued

GTAACGAGAAGATCGCGTGCTACGTCACCGTCAGGGGCGAGAAGGCCATGCAGCTTTTGGAGAGTGGCCTCAAGGTCAA
GGAGTACGAGCTGCTGAGGAGGAACTTCAGCGAGACCGGATGCTTCGGGTTCGGTATCCAGGAGCACATTGATCTTGGC
ATCAAGTACGACCCGTCAACTGGTATTTATGGCATGGACTTCTATGTTGTTCTTGAGCGTGCTGGATACCGTGTTGCTC
GCCGGCGCAGGTGCAAGTCCCGTGTTGGAATCCAGCACAGGGTGACCAAGGAAGATGCCATGAAGTGGTTCCAGGTCAA
GTATGAGGGTGTCATCCTCAACAAGGCCCAAGCAAACACGTCGTAATTGGCAAGGGTTTAACCAGTTATCCTGTAGAAT
TAAGTGAGGGTTCATTTGAATCATGGAACTGTCTTTCTTGAAAGCCAAATGCACTGTCAATTTTGCCTCTGTTGGAGTT
GACCTGCGTCTATATTTCCATTAAATGCTTAATGATATCCTTGTTTTAAATCTTAATATTAAGGCAGACTTGGAATCAA
TCCACCCGCTTTGTTACCTGG

> SEQ ID NO: 6656 215431 1097078_301436_1b
GCTCATCCTCACATCACATACATCGTCCACAATGGCTGAGTCAGGCAAGGCAGTTAACCCTATGAAGGAGCTCCGCATC
GACAAGCTTGTCGTCAACATCTCCGTCGGAGAGTCCGGTGACAGGCTGACCCGAGCCACCAAGGTGCTTGAACAGCTCA
CTGGTCAATCGCCAGTCACCTCCAAGGCCCGCTACACCCTCCGTGGTTTCGGTATCCGACGTAACGAGAAGATCGCTTG
CCACGTCACTGTCCGAGGACCAAAGGCAGAGGAGATCCTCGAGCGCGCGCTCAAGGTCAAGGAGTACGAGCTTCGACGA
GGCAACTTCTCCGAGACTGGCAACTTCGGTTTCGGTATCACTGAGCACATTGACCTCGGCATTAAGTACGACCCGGCCA
TCGGAATCTTCGGCGCCGACTTCTACGTAGTGATGACCCGCCCAGGTGCCCGTGTCGCTCGCCGCAAGATGAGGACGTC
GCGAGTTGGTGCCCCACACCGTGTAAAGAAGGAGGACACCGCCGCTTGGTTCAAGGCCAAGTTCGACGGTATCATCATG
AAGTAATTGCGCGGTGCAGCGTGTCACATCTGTGTATTAGTTCCTGCTATCAAGCCTTTCTCATTGCTC

> SEQ ID NO: 6657 215431 1118003_301852_1b
GGGCCAGGGATAGAGAGGAGGAGAGTCTGTCGTTGTACCAGGAGGAGGAGGAGGACGAGTAGGAGGAGTCCTAGGGTTT
AGTAGAAGACAGCAACCATGGTGGCCGCGGAGAAGAAGCTGTTGAACCCCATGAGGGAGATCAAGGTGCAGAAGCTCGT
CCTCAATATCTCCGTTGGTGAGAGTGGTGATCGCCTTACCAGGGCTGCTAAGGTGTTGGAGCAATTGAGTGGACAGACT
CCTGTCTTCTCGAAAGCTAGATACACTGTGCGTTCATTCGGTATCCGCCGTAATGAAAAGATTGCATGCTATGTGACTG
TCAGAGGAGAGAAGGCAATGCAATTGCTAGAGAGTGGCTTGAAAGTCAAGGAATACGAGTTGCTGCGCAGGAATTTCAG
TGACACTGGTTGCTTTGGCTTTGGAATTCAGGAGCACATTGATTTGGGAATCAAGTATGACCCATCGACAGGTATCTAT
GGTATGGATTTCTTTGTAGTTCTGGAGAGGCCAGGATTCAGAGTTGCGAGGAGAAAGAGGGCGCAGGCACGCGTTGGCA
TTCAGCAAAGGGTAACGAAGGAGGATGCCATGAAGTGGTTCCAAGTCAAATATGAAGGAGTCATTCTCAACAAGTCCTC
CAACATCAGTTAGTTAGTTATCTATCTAACTGCCTGCAGGCTTTGTAGGACAAAATTAGTG

> SEQ ID NO: 6658 215431 15381_300239_1b
CTCGAGCTTGCGGCCGCAAAAAGGTTACCACAACACGAAATCCTTACTATCCAGAATCTTAAATATAAGAACTTGAAAC
AAAACAAAATGACAAAAAAAAGCTCTTCAACCAGTGATGTTCTGAGACTTGTTGAGGATAACTCCTTCATACTTAACTT
GGAACCACTTCATGGCATCATCCTTGGTAACTCTATGTTGAATACCAACGCGAGTCTTGCATCTACGGCGACGGGCCAC
ACGGTATCCTGGACGTTCAAGAACAACGTAGAAATCCATACCGTAGATACCGGTAGAAGGATCATACTTGATTCCAAGA
TCAATGTGCTCCTGGATACCGAATCCGAAGCAGCCAGTGTCACTGAAGTTCCTCCTCAACAGCTCGTATTCCTTCACTT
TCAAGCCAC

> SEQ ID NO: 6659 215431 120067_300083_1b
CCCCCCCCATCTCATTACCCAACAACTCTTCCAGCTACTGCTGCTGTTACATCTTCCTGCGGTAGCGCCATGGCTTCAG
AGAAGAAATTGAGCAACCCCATGAGAGAAATTAAGGTCCAGAAGCTCGTTCTCAATATCTCCGTCGGTGAGAGCGGAGA
TCGTCTCACCAGAGCAGCTAAGGTCTTGGAGCAGCTTAGCGGCCAATCCCCTGTTTTCTCCAAGGCTAGGTATACTGTG
CGGTCTTTTGGAATCAGGCGTAATGAAAAGATAGCTTGCTATGTAACTGTCAGAGGGGAGAAAGCTATGCAGCTACTTG
AGAGTGGATTGAAAGTTAAGGAATACGAGTTGTTGAGAAGGAACTTCAGTGAGACCGGCTGCTTTGGGTTTGGTATTCA
GGAGCACATTGATCTTGGAATTAAATATGATCCGTCAACTGGTATTTATGGCATGGACTTCTATGTTGTATTGGAGCGT
CCTGGATACCGTGTTGCCCGTCGGCGCAGGTGCAAGTCTCGAGTTGGGATTCAGCACAGAGTCACAAAGGAGGATGCGA
TGAAGTGGTTCCAGGTCAAATATGAAGGTGTTATCCTTAACAAGTCCTCAAACATTCAGTGATAAGCTTAGAAAGCCAA
CTTCTGGATCAGTCTGTCTCCTCGCAAGTTTATGTTTATGTATTTTGTTGACCTGCATCTATATCACTCGTAGAGGGAA
GTTTTGGAGAGTTTCTAGTAGTGGCGTATGAGGATGTTTAGTTCTCATTTTGGCTATCAGATCAATTCAATCTTTTT
TGGTCATTTTCTTTTGTTCCAATTAAATCAGATTCATTGAACTCCACAATCTAGTACAATAGATG

> SEQ ID NO: 6660 215431 41636_300197_1b
CTCGAGCTTGCGGCCGCCTAATCTTGAGATGGCATCGGAGAAGAAGCTCTCGAACCCTATGAGGGATATTAAGGTCCAG
AAGCTAGTTCTTAACATCTCTGTTGGTGAGAGTGGTGATCGTCTCACTCGTGCCTCCAAGGTGTTGGAACAGCTCAGTG
GTCAGACTCCTGTCTTCTCTAAGGCGAGGTACACTGTGAGGTCTTTCGGTATCAGGCGTAATGAAAAGATTGCGTGCTA
TGTCACCGTGAGAGGTGAGAAGGCAATGCAGCTTCTTGAGAGTGGCTTGAAAGTGAAGGAATACGAGCTGTTGAGGAGG
AACTTCAGTGACACTGGCTGCTTCGGATTCGGTATCCAGGAGCACATTGATCTTGGAATCAAGTATGATCCTTCTACCG
GTATCTACGGTATGGATTTCTACGTTGTTCTTGAACGTCCAGGATACCGTGTGGCCCGTCGCCGTAGATGCAAGACTCG

FIG. 2 continued

CGTTGGTATTCAACATAGAGTTACCAAGGATGATGCCATGAAGTGGTTCCAAGTTAAGTATGAAGGAGTTATCCTCAAC
AAGTCTCAGAACATCACTGGTTGAAGAGCTTTTTTTGTCATTTGTTTTGTTTCAAGTTCTTATATTTAAGATTCTGG
ATAGTAAGGATTTCGTGTTGTGGTAACCTTTTTGCGGCCGCAAGCTCGAG

> SEQ ID NO: 6661  215459 199838_300753_1b
CCCACGCGTCCGCACAACTCAACCACACTTTCAACTCTCAACTACACCACAACTTACAATCTCATCTCGCGACCAACCA
ACTTTCACAATGGAGACTGTCAAGCAAGCCGTCAACTACGTCGCTGAGTCCGTCCAGGGCGCTGCCTCTGGTATCAGCA
AGGAGACCAACAAGGAGATTGCCAAGGACAGCAACGTCGACGTTTCCACTCGTTTGTCCGCTGGCAAGGACGCCCTTGG
TGACAAGATCGACGAGACTGGCCACAACAACAAGGCCGAGGCTCACAAGCAGCTGGCTGAGCACAACTAGATTGGCATA
AGGAGCTTCGATTGCTTCACAGGCGTTGAACCGGATCAGAGCGAAGGGAATATATAGCCTCACTAGGCAGGAATTGATG
ATTTGAATTCGCAC

> SEQ ID NO: 6662  215459 218779_300921_1b
TCGACCCACGCGTCCGAAACAATCTCAGATCTTCATCTCAACTTTCAATCTTCCACACAAGCAAATAACCAACCAACCA
ACCAATCACAATGGATTCCATCAAGCAGGGCGCCAACTACGTCGGTGAGAAGGTTCAGCAGGCCACCTCTGGTGCCTCC
AAGGAGACCAACAAGCAGGTCGCCAAGGACTCCGATGCCTCTGTCGGCACTCGTGCCTCCGCTGCCAAGGACGCTCTCG
GTGACAAGATGGACGAGTCCAAGCACGACGCCAAGGGCGAGGCCCACAAGCAGGCCATCTAAATGGACTGAGTGAGAGG
GAACGATGACAACACTTTTGCTTCTACCCCGTCTTGAGAGACAAATAGTCGATACCCCTATGAGAACTCAATAATACAA
CTTTTTCAGCCGAAAAAAAAAAGAAAA

> SEQ ID NO: 6663  215461 1112736_301793_1b
TTACAACCATGGCTGACGTCGAGGCACTCAAGGCAAAATACGTTCTCCAAACCGCCGGCTTTGATGCCCGGTTCCCCAA
CGCTAACCAGAGCAAGCACTGCTTCCAAAACTACCTCGACTACCACAAGTGCATCAATGCCAAGGGCGAGGACTTTGCC
CCCTGCAAGCAGTTCTACCGTGCATATCGCTCGCTTTGCCCCAACGATTGGGTCTCTCGCTTTGACGAGCAAAGGGAGA
ACGGTACCTTCCCTGCTTCCCTCGAACCTTGAATGTAAACACTGTCCATTTGTTACGAACCAAGGCCAATAAAAATGTT
TCTCACAC

> SEQ ID NO: 6664  215477 171791_300536_1b
CCGCTTCCCAAACCCCAGCCACCGCCGCCGCCGCCGCCACCACCGTTGCCGTTGCCGCCTCCACCACCCGCCCTCGACC
ACAGCCATGCCGCCGAAGCTCGACCCGACCCAGGTGGTGGATGTGTTCGTCCGCGTGACCGGCGGTGAGGTCGGCGCGG
CGTCGTCGCTCGCCCCCAAGATCGGGCCGCTCGGTCTCTCCCCGAAGAAGATCGGAGAGGACATCGCCAAGGAGACCGC
CAAGGACTGGAAGGGCCTCCGCGTCACCGTGAAGCTCACCGTCCAGAACCGGCAGGCCAAGGTCTCCGTCGTCCCCTCC
GCCGCGGCGCTCGTCATCAAGGCGCTCAAGGAGCCCGAGAGGGACCGCAAGAAGGTGAAGAACATCAAGCACAGCGGCA
ACATCAGCCTCGACGACGTCATCGAGATCGCGAGGGTCATGAGGCCCAGGTCCATGGCCAAGGAGATGGCCGGCACCGT
CAAGGAGATCCTCGGCACCTGCGTCAGCGTCGGCTGCACCGTGGACGGCAAGGACCCCAAGGACCTGCAGCAGGAGATC
TCCGACGGCGAGGTCGAGATCCCCTCAGCTTAAGCAGGTTT

> SEQ ID NO: 6665  215477 190867_300736_1b
CCCCGCTACCTTCCCAAACCCCAGCCACCGCCGCCGCCGCCGCCACCACCGTTGCCGTTGCCGCCTCCACCACCCGCCC
TCGACCACAGCCATGCCGCCGAAGCTCGACCCGACCCAGGTGGTGGATGTGTTCGTCCGCGTGACCGGCGGTGAGGTCG
GCGCGGCGTCGTCGCTCGCCCCCAAGATCGGGCCGCTCGGTCTCTCCCCGAAGAAGATCGGAGAGGACATCGCCAAGGA
GACCGCCAAGGACTGGAAGGGCCTCCGCGTCACCGTGAAGCTCACCGTCCAGAACCGGCAGGCCAAGGTCTCCGTCGTC
CCCTCCGCCGCGGCGCTCGTCATCAAGGCGCTCAAGGAGCCCGAGAGGGACCGCAAGAAGGTGAAGAACATCAAGCACA
GCGGCAACATCAGCCTCGACGACGTCATCGAGATCGCGAGGGTCATGAGGCCCAGGTCCATGGCCAAGGAGATGGCCGG
CACCGTCAAGGAGATCCTCGGCACCTGCGTCAGCGTCGGCTGCACCGTGGACGGCAAGGACCCCAAGGACCTGCAGCAG
GAGATCTCCGACGGCGAGGTCGAGATCCCCTCAGCTTAAGCAGGTTTGGCATTGGGGTGGTTGTTATGTGA

> SEQ ID NO: 6666  215477 224143_300979_1b
AGAAAAAATGCCTCCTAAGTTTGACCCCAATGAGGTGAAGATCATCTACCTGCGAGCCATGGGTGGTGAGGTCGGAGCT
TCCTCCGCTCTTGCTCCCAAGATTGGTCCTCTCGGTCTGTCCCCCAAGAAGATTGGTGAGGATATCGCCAAGGCCACCA
AGGCCCACAAGGGTGTCCGAGTCACTGTCCAGCTGACCATCCAGAACCGACAGGCCACCGTCTCCGTCGTCCCCTCTGC
CTCTTCTCTGGTCATTGCTGCTCTCAAGGAGCCCCGCGTGACCGAAAGAAGGACAAGAACGTCAAGCACAACGGTAAC
ATCCCCCTGGAGGAGATCATTGAGATTGCCCGAACCATGCGATCCAAGTCTTTCTCAAGGAGCTGTCCGGAACCGTCA
AGGAGATTCTTGGTACTGCCCAGTCTGTTGGCGCCCGTGTCAACGGTAAGCCCGCTCACGTCATGATTGATGCTATCAA
CAACGGCGAGCAGGACATCCCCGATAACTAAAGTTGTCGTAAAAAATAAATTTGTTTATTATG

FIG. 2 continued

> SEQ ID NO: 6667 215477 1097247_301438_1b
GGCCCTCAAGGAGCCCGAGCGTGACCGCAAGAAGACCAAGAACATCAAGCACAACGGTAACATCTCCCTCGATGACGTC
ATCGATGTCGCGCGTATCATGCGTCCCCGGTCCATGGCTAAACACCTCACCGGCAGCGTCAAGGAAATCCTCGGTACCT
GTGTTTCCGTCGGTTGCACCGTCGATGGTAAAGACCCTAAAGACTTGCAGACCGAGATCGATGAGGGCGAAGTTGAGCT
TCCTGAGGATTGAACACCAACCTCTGCCTCACCCCCAACACCTCCCCCCGTCGTTCCCGTTTTGAGGTTTTTTTTTAA
AAACTTTTCGCGATGAAATTGCATTGCCGGAGTTGGTTAGTTCCGTCCGTCGCCGTAGTTCTTAGGCCATTTTTCTTT
AACCCCCTAGATGAGACCTGCAAAACAGTTCTTCTCGTTTAGTCGGTTGCGCGTAGCTGTGCTTGATCTCGATTTCATG
ATGAAAGCTGCTATAACAATATCGTTTCTTTCATAGTCTTTTTCCTTGAGGTCTCAAAAAAAACAACAAAC

> SEQ ID NO: 6668 215477 14019_300245_1b
CCCACGCGTCCGGAAACTCCAAAACACAGAGCCATGCCGCCGAAGTTGGACCCGAGCCAGATCGTCGATGTGTACGTCC
GTGTAACCGGAGGAGAAGTGGGAGCCGCCAGTTCTCTAGCTCCAAAGATCGGTCCTCTCGGTCTCGCACCAAAGAAGAT
CGGAGAAGACATCGCGAAAGAGACGGCCAAAGAATGGAAAGGACTTCGTGTCACCGTGAAGCTGACGGTTCAGAATCGT
CAAGCTAAGGTAACCGTGGTTCCATCTGCTGCAGCTCTCGTCATCAAGGCGTTGAAGGAGCCAGAGAGAGACCGTAAGA
AGGTGAAGAACATTAAGCATAACGGTAACATCTCTTTCGATGAT

> SEQ ID NO: 6669 215477 147539_301253_1b
AAATGCCGCCCAAGTTCGATCCATCTCAGGTTGTCGAGGTTTTCGTCCGAGTTACCGGCGGTGAAGTCGGAGCTGCGAG
TTCACTCGCTCCAAAAATCGGTCCTCTCGGTCTCTCCCCTAAAAAAATTGGTGAAGACATCGCAAAGGAGACCGCCAAG
GACTGGAAGGGTCTCCGAGTCACCGTAAAACTCACCGTCCAAAACCGTCAAGCTAAAGTCTCCGTCGTTCCCTCCGCCG
CCGCACTAGTCATCAAGGCGTTGAAGGAGCCGGAACGTGACCGTAAGAAGACCAAAAACATCAAACATAACGGTAACAT
CTCTCTCGATGACGTCATCGAGATCGCTAAGGTGATGAAGCCAAGATCGATGGCGAAGGATTTGACTGGAACAGTGAAG
GAGATTTTGGGCACGTGTGTATCTGTTGGTTGTACGGTAGATGGAAAGGATCCTAAGGATTTGCAGCAAGAGGTAGATG
ATGGTGATGTCGAGATTCCTCTCGATTGAATGCTAATTATCAACGGATGGTAATATTATGTTAATTTTATGTTA

> SEQ ID NO: 6670 215477 158347_200003_1b
GCCCTAGCTACACTCTTCCTCTACTTTTCTAAGTGTAACAAAAATGCCGCCAAAGTTCGATCCTTCTCAGGTTGTCGAA
GTCTTCGTCCGCGTCACCGGCGGCGAAGTCGGTGCGGCTAGTTCACTCGCTCCAAAAATCGGTCCACTCGGTCTCTCCC
CCAAGAAAATCGGAGAAGACATAGCTAAGGAAACCGCCAAGGATTGGAAGGGCCTTAGAGTTACCGTCAAGCTCACCGT
CCAAAACCGGCAGGCCAAAGTCTCCGTCGTACCTTCCGCAGCGGCGCTCGTAATCAAGGCTTTAAAGGAGCCTGAGAGA
GATCGCAAAAAGACGAAGAACATCAAGCACAATGGGAATATTTCGCTGGATGATGTGATTGAGATTGCGAAAGTGATGA
AGCCGAGATCTATGGCGAAGGATTTGACAGGTACTGTGAAGGAGATTTTGGGGACGTGTGTGTCCGTTGGATGTACTGT
TGATGGAAAGGATCCTAAGGATTTGCAACAGGAGATTGATGATGGTGATGTTGAGATTCCTCTGGATTGAGGAATAAGA
GGTTAATTTTAAGATGTGTTTGTTATATTTAGTATTATTATGTGATATTTTGTTTATTTGGATTTGAGGATAATTTTGG
AGAAATTGTCAGTTTTATTGGCATTGTTAGGATTTGATTATTACCTTTTTATGTTGATGAAATGCTCTATTTTGTTT

> SEQ ID NO: 6671 215477 265565_200112_1b
CCCTCGACCACGCGTCCGCTAGCCCATTCTCACTCCCTCGCTTCCTAATGCCGCCCAAGTTCGATCCATCTCAGGTGGT
CGAGGTTTTCGTCCGAGTTACCGGCGGTGAAGTCGGAGCTGCGAGTTCACTCGCTCCAAAAATCGGTCCACTTGGTCTC
TCCCCTAAAAAAATCGGTGAAGACATCGCAAAGGAAACCGCCAAGGACTGGAAGGGTCTCCGAGTCACAGTTAAACTCA
CCGTCCAAAACCGTCAAGCTAAAGTTTCCGTCGTTCCCTCTGCCGCTGCACTCGTCATCAAGGCGTTGAAGGAGCCGGA
ACGTGACCGTAAGAAGACCAAAAACATCAAGCATAACGGTAACATCTCGCTCGATGACGTCATCGAGATCGCTAAGGTG
ATGAAGCCAGATCGATGGCGAAGGATTTGACTGGAACAGTGAAGGAGATTTTGGGCACGTGTGTATCAGTTGGCTGTA
CGGTAGATGGGAAGGATCCTAAAGACTTGCAGCAAGAGATTGATGATGGTGATGTCGAGATTCCTCTCGATTGAACGCT
AATTATCAACTGATGGTAATATTATGTTAATTTTTTTTTGACGTTGTCATCTTGAGGATCATTTTGATATAACTATGAC
TAGTAAACACTGGAATTTTATATTTGGCAATGTAGTTTGGATTTTGTTTTGCTCGATGAAG

> SEQ ID NO: 6672 215477 26868_300392_1b
TTTTTTGTAGAAAATTGAACATTTTGATTAATCCCAAGAAAGGATTCAAATGGGCAAAAGCCAACAATTCTCAACTTCC
GAAATATAGTATTACTAATACCAAATCCTCAAAATCAAATACAAAAATAAAACGATAGAGAACTCAAAAGTAAAAACC
TTTATCACTCGTTAGGAATATCAATGTCACCACTGTTAATTTTCCTGAAGATCTTAGGGTCTTTACCATCAACAGTGC
AACCAAAAGAGACACAAGTTCCTAAAATCTCCTTCACTGTTCCACTCAATTCCTTAGCGATAGATCTAGGACGCATTAT
CTTAGCAATCTCAATCACATCATCAAACGAAATGTTGCCATTATGTTTGATGTTCTTCACTTTCTTCCTATCTCTCTCT
GGCTCCTTGAGGGCTTTGATGACTAGAGCCGCTGCGGATGGAACCACTGTGACCTTAGCTTGACGATTCTGTACCGTAA
GCTTCACGGTGACTCGAAGACCTTTCCATTCTTTCGCTGTCTCTTTGGCGATGTCTTCTCCGATCTTCTTTGGTGCCAG
ACCGAGTGGACCGATCTTTGGAGCGAGTGAAGACGCTGCTCCGACCTCACCTCCGGTGACTCGGACGTAGACGTCGACG
ATTTGAGATGGATCCAATTTCGGCGGCATTTTCTCTGATTCTTCTCCGGACGCGTGGG

FIG. 2 continued

> SEQ ID NO: 6673 215552 207662_300827_3b
AATCTCGTTCCCAATCAACTCCGTCTGCCTCTCTCGCCCGCATCAACAAACATTGCGAGCCACATCTCTCCAC

> SEQ ID NO: 6674 215552 256651_301674_1b
GATCAGCTATGGAGAGCGTGGCGCTCAAGCGAGTTTCTGCTGTAGCCAACCATCTCAATCCCGAGCAGCAGCAGCAGCA
GCAGCAGCAGCAACTCTCCATGGCTGTCGCCGCCAGCGCCGGCGCCTCTTCGGTGTTTGATCATCTGGAGCAGGCGCCC
GAGGATCCCATTCTGGGAATAACTGTGGCATACAACAAGGACCCTCATCCCGGGAAAGTGAACCTTGGAGTCGGAGCTT
ACCGCACAGAGGAAGGGAAACCCCTTATTTTGCATGTGGTTCATCGTGCTGAGGAACGTCTTCTAGCTGATCGCTCCAG
AAACAAGGAATACTTGTCAATCACTGGGCTGGCAGACTTTAACAAGCGAAGCGCGACGCTCATTCTTGGGAGCGATAGC
CCTGCTATCGTGGAGAAGAGATTGGTAACTGCGCAGTGCCTTCTGGAACGGGTTCCTTGCGTGTAGGAGCCGAGTTTC
TTTCAAGCACATTATGGTGTGAAGCTGGTTTTCCTTCCTACCCCGACGTGGGGAAATCACTTCAAGGTTTTCATGAATGC
TGGACTTGGTGTTAAGACGTATCGTTACTATGACAGCAAAACTCGTGGTCTTGACTATGAGGGTATGCTCGAGGACATA
AGTGCAGCTCCGACCGGATCGGTTATTCTCTTGCATGCATGTGCTCATAATCCCACTGGCGTGGATC

> SEQ ID NO: 6675 215552 284634_200100_1b
CCCTCGACCACGCGTCCGCGGACGCGTGGGTTTCATCGATCAGTTCTTCCCTTTCTCTTCGGTTCCCTGTAAAACCAAA
GCCTCCCCATTTTTCTCTTCTACCCGAGCTTTAAGATGGCTTCCACAATGTTCTCTCTAGCTTCTGCCGCTCCGTCAGC
TTCTTTTTCCTTGCTGANTATCTCAAGTCAAAGCTGAAGTTGGGGACTTCTAACCAAAGTGCCTTTTTCGGGAACGACT
TCGTGAAGGCAAAGTCAAATGGTCGTACTACTATGACTGTTGCTGCTAACGTCTCTCGATTTGAGGGAATAACTATGC
TCCTCCTGACCCCATTCTTGGAGTTTCTGAAGCATTCAAGGCTGATACAAATGAACTGAAGCTTAACCTTGGTGTTGGA
GCTTACCGCACGGAGGAGCTTCAACCATATGTCCTCAATGTTGTTAAGAAAGCAGAAAACCTTATGCTAGAAAGAGGAG
ATAACAAAGAGTATCTTCCAATAGAAGGTTTGGCTGCATTCAACAAAGTCACAGCAGAGTTATTGTTTGGAGCAGATAA
CCCAGTAATTCAGCAACAAAGGGTGGCTACTATTCAAGGCCTGTCAGGAACTGGGTCATTGCGTATTGCTGCAGCACTG
ATAGAGCGTTACTTCCCTGGCTC

> SEQ ID NO: 6676 215552 124824_300426_1b
CCCACGCGTCCGCTCCCTCAACAAATATCACACTTCCATTACATCTTTGAAGTTCTTTTCATTCATTTTATCAAAATGA
CAAATTCCTCCAATTCTGTTTTTGCCCATGTTGTTCGTGCTCCTGAAGATCCCATCTTAGGAGTCACAGTTGCTTATAA
CAAAGATACCAGCCCACTGAAGTTGAATTTGGGTGTTGGCGCATATCGCACTGAGGAAGGAAAGCCCCTTGTTCTTAAT
GTGGTGAGACGGGCTGAACAAATGCTCGTCAATGACACGTCTCGGGTGAAGGAGTATCTCTCAATTACTGGACTAGCGG
ATTTTAACAAGCTGAGTGCAAAGCTTATATTTGGTGCTGACAGCCCTGCCATTCAAGAGAACAGGGTGACTACTGTTCA
GTGCTTGTCGGGCACAGGTTCTTTGAGGGTTGGGGCTGAGTTTCTGGCTAAGCATTATCATGAACGTACTATATATATA
CCACAGCCAACATGGGGAAACCATCCGAAGGTTTTCACTTTAGCCGGGCTTTTAGTAAAATATTACCGTTACTACGACC
CAGCAGCAACACGAGGCCTGGATTTCCAAGGACTTTTGGATGATCTTGCTGCTGCACCCGCTGGAGCAATAGTTCTTCTCCA
TGCATGTGCTCATAACCCAACTGGCGTTGATCCAACAAATGACCAGTGGGAGAAAA

> SEQ ID NO: 6677 215552 147546_301253_1b
AAAAAAGGAAAGTTAGCAAGCAAAGGTTTCGTACTGTCAAAATGAACATGTCACAACAATCACCGTCACCGTCCGCTGA
CCGGAGGTTGAGTGTTCTGGCGAGACACCTTGAACCATCGTCCTGCGCCACCGTCGAATCCTCTATCGTCGCTGCTCCT
ACCTCCGGAAATGCTGGAACCAACTCTGTCTTCTCTCACATCGTTCGCGCTCCCGAAGATCCTATTCTTGGCGTCACTA
TTGCTTACAATAAAGATAGCCAGCCCCATGAAGTTGAATTTGGGAGTTGGTGCATATCGCACAGAGGAAGGAAAACCTCT
TGTTTTGAATGTTGTAAGACAAGCAGAGAAGCTACTAGTAAATGACAGGTCCCGCGTTAAAGAGTACCTATCTATTACT
GGACTGGCAGACTTCAATAAATTGAGTGCTAAGCTGATACTTGGCGCCGACAGCCCTGCTATTCAAGAGAACAGAGTAA
CAACTGTCCAGTGTTTGTCTGGCACAGGCTCATTGAGGGTTGGAGCTGAATTTTTGGCTCGACATTATCATCAACGCAC
TATTTATATTCCCCAACCAACATGGGGAAACCACCCAAAAGTTTTCACTTTAGCTGGGTTATCAGTAAAGAGTTACCGC
TACTATGATCCAGCAACTCGTGGACTCAATTTTCA

> SEQ ID NO: 6678 215579 224107_300979_1b
GACCCAAGATGCTTAGAACAATCAGATCCCAATCCATGCGAATGGCCTCCGCCTCGTCGCGAAGAATGCTGTCTTCCGC
CGCCTCCACATCCATGCTAAGACAAACGCTCAAGGCTCCCTCCATGACCGCTCAGGTCACTCGACCCACCGTCATGACC
TTCAAGCCTGTTCTGCTGTCCCGAGGATACGCCGACGTTGTTGAGGTGCCTCCCATGGCCGAGTCTCTGACTGAGGGTA
CTCTGACCGCCTTTGAGAAGGACATTGGAGACTTTGTCGAGGCCGATGAGGAGATCGCCACCATCGAGACCGATAAGAT
TGATGTTGCCGTCAACGCTCCCTTCGCCGGAACCATCACCGAGTTCCTGGTCAAGCCCGACGACACCGTCACTGTCGGC
CAGCCTCTTCTCAAGATTGAGCGAGGCGAGGGCTCCAGCAGCGGTGGCTCCAAGCCTCCCAAGGAGAAGAAGGAGGAGA
AGACGGAGGAGAAGGAGGAGCCTGCTCCCAAGGAGGAGTCTGCCCCTGCCCCTAAGAAGGAGGAGGCCCCAAGAAGGA
GGAGTCTGCCCCTGCTCCCAAGAAGGAGGAGAAGAAGCCCGCTCCCAAGGAGGAGAAGAAGACCGATGCCACCGAGGGT
CTCGGCGGCTTCCGAAAGGAGGAGCGAGTCAAGATGAACCGAATGCGACTTCGAATTGCTGAGCGACTCAAGGAGTCCC

FIG. 2 continued

> SEQ ID NO: 6679 215608 179786_300563_1b
GCTCGCTAAGCACCTGCAAAACTTACCTTGACACTTTTGTCAATTTCATTCTTTAAGAACAACCGCATCAATAATCTTA
ATCAAGCTCCCTCGAGTTTAATTCCTAATACCGACAAAATGAAGTTCACCGCTGCTGTCGCTCTCGCCGCCGTTGGCGT
TTCTGCCGTCTACGTTCCTCCTAGCAACGTCACCGTTGTTACCGATGTCGTTGACCAATACGTCACCTACTGCCCCTAC
GCTACCCAGATCACCCACGGCAGCAAGACCTACACCGTCACTGAGCCCACCACTCTGACCATCACCGACTGCCCCTGCA
CCATCACCCGCCCCGTTACCGTCACCAGCAGCGTTGTCTGCAACACCTGCGGTAACGCCGCCCCTACTGGTGCTCCCTC
CGGTGGCAACGGCGGTGGTTACACTCCTCCTGCCTTCACCAACTCCACCATCACCACCCCTACCCAGGCCCCTCCCCCC
AGCGGCCCTGCCAGCACTGGTGGTGTTGTTCCTACTGCTCCTCCCGCCGTCCCCACTGGCGGTGCCAGCAAGGCCGTCC
TCTCCGGCGCCGGCCTTGCCGGTATCGTCGGTCTGGCCGCCTTCGTCCTGTAAATCTTGTAAATTTCGACACCTCGCCA
ATTTACCGGGCTACGATTTCTTGGTTCTA

> SEQ ID NO: 6680 215610 220848_300939_1b
GACCCACGCGTCCGCAAGCATCCCTATCGTATCAACTTTCAACTCCAGGTTAGTACTCATACCATTCGATATCATGTTC
ATGCTCCGGCCCACGCTACGACTTCTGTTCGCCTGCCCCTCCTTACTGCACTCGTCGCCTTAGCTACCCCGCCAGAACT
TCCCTGCGTCACCAATTTTTTTTTCTCCCTTATTTACCCCTCCTCCCTCCCACCTCTACAAGCAGAGATTTTGAAGCTT
ACCACGCATAACCATCAATCGCAGTCACAAATCAGCTACAATGGCTCCCATCAAGGTCGGCATCAACGGCTTCGGTCGA
ATTGGACGTATCGTCTTCCGCAACGCTGTTGAGCACCCCGACATCGAGGTCGTCGCCGTCAACGACCCCTTCATCGAGA
CCACCTATGCTGTGAGCCGCGTCCCCCCTCTTTTTTTTCTCTCTGAAAATGCCCCTCCTCAGCCCAACGCAAGCAATG
CCCAATTGAGGGTAGAAAAGAGACGAATAATAAGAGTGCACTGCTTGAATGAATCTCTTGATATCATGAGATTGAAGCG
CTTCGACAATGATGCTGTCATCATGGGAGAGAAATCTTCTCAAGCAATGGCAGGAGCTGCAATGGCATTGTCGACAGAT
GAGCTACACTTAATGTCTCAAAAGTCGTCAATGTCGGACAAGATTCCAACTCCTTCGTCTCACGCCACTACCCCTCACT
ACATGTGCAGCTTCATTGTTCATCCGCTAACCCGAGACATCGCTAGGCCTACATGCTCAAGTATGATTCCTCCCACGGT
ATTTTCAAGGGCGACATCGATGTCGATGGCAAGGACCTCGTTGTGAACGGCAAGAAGGTCCGCTTCTACACCGAGCGTG
ACCCTGCCAACATCAAGTGGAGCGAGA

> SEQ ID NO: 6681 215610 226624_300999_1b
ACATCAACAATGGCCATCAAAGTCGGTATTAACGGATTCGGACGAATCGGACGAATTGTCCTGCGAAACGCTCTCAAGA
ACCCTGAGGTCGAGGTCGTCGCTGTGAACGACCCCTTCATCGACACCGAGTACGCTGCTTACATGTTCAAGTACGACTC
CACCCACGGCCGATTCAAGGGCAAGGTCGAGGCCAAGGACGGCGGTCTGATCATCGACGGCAAGCACATCCAGGTCTTC
GGTGAGCGAGACCCCTCCAACATCCCCTGGGGTAAGGCCGGTGCCGACTACGTTGTCGAGTCCACCGGTGTCTTCACCG
GCAAGGAGGCTGCCTCCGCCCACCTCAAGGGTGGTGCCAAGAAGGTCATCATCTCCGCCCCCTCCGGTGACGCCCCCAT
GTTCGTTGTCGGTGTCAACCTCGACGCCTACAAGCCCGACATGACCGTCATCTCCAACGCTTCTTGTACCACCAACTGT
CTGGCTCCCCTTGCCAAGGTTGTCAACGACAAGTACGGAATCATTGAGGGTCTCATGACCACCGTCCACTCCATCACCG
CCAACCAGAAGACCGTTGACGGTCCTTCCCACAAGGACTGGCGAGGTGGCCGAACCGACTCTGGTAACATCATCCCCTC
TTCCACTGG

> SEQ ID NO: 6682 215610 243246_301337_2b
TACTCATCTCAGTCGTGTCTGTCATTATTACCGACCCACGCGTCGGTTTTCTAAAAGCTCGTCTTCTCTTCTCTTCTTC
GATCAGCGAAAAGCTCTCTCTAGTTTCTTCGATTCTTCTACAGCGATGGGTTCCGAAGGACACAAGGTGAAGCTTGGAA
TCAATGGATTTGGCCGGATCGGGAGGCTTGTGGCCCGAGTCGCGCTGGAACGCGACGATATTGAGCTCGTGGCGGTGAA
TGATCCATTCATCAGCACAGACTATATGGCATACATGTTCAAGTATGACAGTGTCCATGGGAAATGGAAGAAGGCCGAT
ATTGAGGTCAAGGACCAGGAAACTCTGTCCTTTGGAGGCAAGGCCGTCAAGGCCTTTGGCTGCAAGGATCCCTCCGAAA
TTCCCTGGGGAAAGTGCGGTGTTGATTTCGTGGTGGAATCCACGGGTGTTTTCACCGAGAAGGAAAAGGCCTCGGCACA
TCTCAAGGGTGGAGCAAAGAAGGTGATTATCTCGGCTCCTAGCAAGGATGCTCCAATGTTCGTCGTTGGTGTCAACGAG
ACCGAGTACAAGAAGGATATGGATATTGTTTCCAACGCAAGTTGCACTACGAATTGTCTTGCTCCTCTTGCCAAGGTCA
TTCACGATAAGTTTGGCATTGTCGAGGGCCTTATGACCACTGTGCACTCCCTTACTGCCTCGCAGAAGACTGTCGATGG
GCCGTCTTCCAAGGACTGGCGCGGTGGAAGAGGTGCCGGCTTTAACATCATCCCCAGCTCAACTGGAGCTGCGAAGGCT
GTGGGAAAGGTGTTACCCGATCTGAATGGAAAGCTCACTGGAATGTCCTTCAGAGTTCCAACTCCAGATGTCTCCGTGG
TGGATCTCACTGTCCGCCTCGAGAAGGGAGCTTCTTACGACGAAATCAAGCAGGCAATGAAG

> SEQ ID NO: 6683 215610 193744_300742_1b
CCCCGACCTCTCCATATCCGGCTTCCAGACGCTTCTCTCCTGCTCTAATCTCAAGTCTCTGTCTCGTCGTCCTCGCATC
TCCACTCGCCATGGGCAAGATTAAGATCGGAATCAACGGTTTCGGAAGGATCGGGAGGCTCGTGGCCAGGGTGGCCCTC
CAGAGCGAGGATGTCGAGCTCGTCGCCGTCAACGACCCCTTCATCACCACCGACTACATGACCTACATGTTCAAGTACG
ATACCGTGCACGGCCAATGGAAGCACAGCGACATCAAGATCAAGGACTCCAAGACTCTGCTCTTGGGCGAGAAGCCGGT
CACCGTTTTCGGCATCAGGAACCCTGACGAGATTCCGTGGGCTGAGGCTGGTTCTGAGTATGTCGTGGAGTCCACCGGT

FIG. 2 continued

GTCTTCACTGACAAGGAGAAGGCTGCTGCTCACTTGAAGGGTGGTGCCAAGAAGGTTGTCATCTCAGCCCCGAGCAAAG
ATGCTCCGATGTTTGTCTGCGGTGTCAACGAGGACAAGTACACTTCAGATATTGATATTGTCTCAAATGCTAGCTGCAC
CACAAACTGCCTTGCTCCTCTTGCCAAGGTCATTCATGACAACTTTGGTATTATC

> SEQ ID NO: 6684 215610 206710_300825_1b
AGCTTACCACGCATAACCATCAATCGCAGTCACAAATCAGCTACAATGGC

> SEQ ID NO: 6685 215610 271014_200130_1b
AAACACTTACTTCTTAAAATTAATTTCTCTCGTTTAATTTATTGTTATAAGCATCATGGGCAAAGTCAAGATCGGAATC
AATGGATTTGGAAGAATTGGCAGGTTGGTTGCTAGGGTGGCACTACAGAGTGATGACTTAGAACTAGTCGCTGTCAATG
ACCCCTTCATCACCACCGACTACATGACCTACATGTTCAAATACGACACTGTTCATGGCCAATGGAAGAAACAGGAGCT
TAAAGTTAAGGATGAAAAGACTCTTCTCTTTGGCGATAAGGCCGTTAAAGTATTTGGTGCTAGGAACCCCGAAGAAATT
CCATGGGGTGAGGCTGGAGCAGAGTATGTTGTAGAATCCACTGGAGTTTTCACTGATAAAGACAAAGCTGCAGCTCACT
TGAAGGGAGGTGCAAAGAGGGTTGTCATTTCAGCCCCTAGCAAGGATGCGCCCATGTTTGTTATGGGCGTCAATGAGAA
GGAATACAAAGGAGATGTTAACATTGTCTCTAATGCTAGTTGCACTACCAACTGTCTTGCTCCATTGGCTAAGGTTATT
AACGACAAATTTGGTATTGTCGAGGGACTTATGACCACAGTCCACTCTATTACTGCAACTCA

> SEQ ID NO: 6686 215610 273392_200143_1b
TCCCGGTCTCCCTGTACCAACTAGTACTACTATTAAACCCTTCCCACCAACTTCCCCTCCACTACACCATTTCACAAGA
ACCTCTCAATTAGATCGGACTCCATTTTCCCTCTGAATTCACAAAGATCATGGCCAAGGTTAAGATTGGAATCAATGGT
TTTGGAAGAATTGGGCGATTGGTTGCCAGGGTGGCACTCCAGAGAGATTGACGTTGAGCTCGTTGCTGTTAATGACCCCT
TCATCTCCGTTGAATACATGACATACATGTTTAAGTATGACAGTGTCCATGGCCAGTGGAAGAACCATGAGCTCAAGGT
TAAGGATGATAAGACTCTTCTCTTTGGTGAGAAGCCTGTTGCTGTATTTGGCATTAGAAACCCAGAGGAGATTCCATGG
GCTGAGGCTGGAGCAGAGTACATCGTGGAGTCGACAGGAGTCTTCACTGATAAAGACAAGGCTGCTGCCCACTTGAAGG
GTGGTGCTAAGAAAGTCATCATTTCTGCTCCTAGCAAGGATGCTCCTATGTTTGTTGTTGGCGTCAATGAGAAGGAATA
CAAGCCAGACCTCAACGTTGTTTCTAACGCTAGCTGTACCACTAACTGCCTCGCGCCTTTGGCAAAGGTTATTCATGAC
AGATTTGGAATTGTTGAGGGTCTTATGACCACTGTCCACTCCATGACTGCCACCCAGAAAACTGTTGATGGACCATCCG
CCAAGGACTGGAGGGGTGGAAGGGCAGCATCCTTCAACATTATTCCTAGCAGTACTGGAGCTGCTAAGGCTGTTGGAAA
GGTGCTACCATCATTGAATGGAAAGTTAACTGGAA

> SEQ ID NO: 6687 215610 6460_300322_1b
CCCACGCGTCCGCACTATTTTCACATTCTTCTTCTCTCTCGATATCATCTAAATCTCTCTCTTGATCTCAATTTCGCAA
AATGGCTGACAAGAAGATCAGAATCGGAATCAACGGTTTCGGAAGAATCGGTCGTTTGGTTGCTAGAGTTGTTCTTCAG
AGGGATGATGTTGAGCTCGTCGCTGTTAACGATCCTTTCATCACCACCGAGTACATGACATACATGTTTAAGTATGACA
GTGTTCACGGTCAGTGGAAGCACCATGAGCTTAAGGTGAAGGATGACAAAACTCTTCTCTTCGGTGAGAAGCCAGTCAC
TGTTTTCGGCATCAGGAACCCTGAGGACATCCCATGGGGTGAGGCTGGAGCTGACTTTG

> SEQ ID NO: 6688 215610 47177_300174_1b
CGGACGCGTGGGCGATTCTACAATGGCTGACAAGAAGATTAGGATCGGAATCAACGGATTCGGAAGAATTGGTCGTTTG
GTTGCTAGAGTTGTTCTCCAGAGGGACGATGTTGAGCTCGTCGCTGTCAACGACCCCTTCATCACTACTGAGTACATGA
CCTACATGTTCAAGTACGACAGTGTTCACGGTCAATGGAAACACAATGAACTCAAGATCAAGGATGAGAAGACCCTTCT
CTTCGGTGAGAAGCCAGTCACTGTTTTCGGCATCAGGAACCCTGAGGATATCCCATGGGCCGAGGCTGGAGCTGACTAC
GTTGTTGAGTCTACTGGTGTCTTCACTGA

> SEQ ID NO: 6689 215610 120978_300518_1b
CACAGCTTTGCGTTTGCGCGTCCTCTCGATCTCCATTCGTTTTTGAGTTCCTCGTTTGCTCCGCCTCTCTTTCACTCAT
GGGCAAGATTAAGATCGGAATCAATGGGTTCGGCCGCATCGGCAGGCTGGTGGCCAGGGTGGCGCTGCAGAGCGAGGAT
GTCGAGCTCGTTGCCGTCAACGATCCCTTCATCACCACCGAGTACATGACATACATGTTCAAGTATGACACCGTCCACG
GCCAGTGGAAGCATCATGAGGTCAAGGTCAAGGACTCCAAGACCCTCATCTTTGGCACGAAAGAGGTTGCGGTGTTCGG
CTGCAGGAACCCTGAGGAGATCCCATGGGCTGCGGCTGGTGCTGAATACGTTGTTGAGTCTACTGGTGTTTTCACCGAC
AAGGACAAGGCAGCAGCTCACTTGAAGGGTGGTGCCAAGAAGGTCGTCATTTCTGCTCCCAGCAAAGACGCCCCCATGT
TCGTTGTTGGTGTCAACGAGAAGGAGTACAAGTCTGACGTTAACATTGTCTCCAACGCTAGTTGCACCACCAACTGCCT
GGCTCCTCTCGCCAAGGTCATCAATGACAGATTTGGCATCGTTGAGGGTTTGATGACCACTGTCCATGCCATCACTGCT
AC

> SEQ ID NO: 6690 215610 133702_300417_1b
CGGACGCGTGGGCGCGTCCTGGGGTGATTGATGTTTTTTTTCTGATTTTTTTGGTGAATTTTCTGGTGGTGTTTTTGGG
GACGCAGGCAAGATTAAGATCGGAATCAACGGTTTCGGAAGGATCGGGAGGCTCGTGGCCAGGGTGGCCCTCCAGAGCG

FIG. 2 continued

AGGATGTCGAGCTCGTCGCCGTCAACGACCCCTTCATCACCACCGACTACATGACCTACATGTTCAAGTACGATACCGT
GCACGGCCAATGGAAGCACAGCGACATCAAGATCAAGGACTCCAAGACTCTGCTCTTGGGCGAGAAGCCGGTCACCGTT
TTCGGCATCAGGAACCCTGACGAGATTCCGTGGGCTGAGGCTGGTGCTGAGTATGTCGTGGAGTCCACCGGTGTCTTCA
CTGACAAGGAGAAGGCTGCTGCTCACTTGAAGGGTGGTGCCAAGAAGGTTGTCATCTCAGCCCCGAGCAAAGATGCTCC
GATGTTTGTCTGCGGTGTCAACGAGGACAAGTACACTTCAGATATTGATATTGTCTCAAATGCTAGCTGCACCACAAAC
TGCCTTGCTCCTCTTGCCAAGGTCATTCATGACAACTTTGGTATTATCGAGGGTCTGATGACAACTGTTCATGCCATCA
CTGCCACCCAAAAGACCGTTGATGGACCGTCCAGCAAGGACTGGAGGGGTGGGCAGGGCGGCCAGTTTTAACATCATTC
CCAGCAGCACTGGTGCTGCCAAAGCTGTTGGGAAGGTTCTTCCTGATTTGAATGGCAAGCTTACGGGAATGTCCTTCC

> SEQ ID NO: 6691 215611 210994_300963_1b
GATCAGTCGACAATTCATTCAACATGGCTAATGAAACGCCTGTAAATATCGGTCTGGCCGTTGGCCTGAACAAGGGCCA
CTAGATCTCTGCTCTTGTCATCAAGCCCCGTGTATCTCGCAACTAGGGCCAACTGATCAAGCGAACCGCTTTCGTGCGT
GACGTCCTCAAGGACGTTGATGGCCTCTCCCCCTACAACCGTCGTGTCATCAAACT

> SEQ ID NO: 6692 215615 208692_300807_1b
ATAGCACCTGTCAACGGCTGCCCAGCATGATTGCTAGCCGCCTGATACCCCGAAGTGCCATCCGCACGCTGCCCAGCAG
GCAATTGACCCTGTCACGATGGAGTCGAGGATTTGCCTCTGCTTCTGAGGAGAAGGACCTGATCATCATCGGTGGTGGT
GTTGCCGGATATGTGGCCGCCATCAAGGCCGGACAGGAGGGCATGAAGGTGGCCTGCATTGAGAAGCGTGGCACCCTCG
GCGGTACCTGCTTGAACGTTGGCTGCATTCCCTCAAAATCGCTGCTCAACAACTCCCACCTGTACCACCAGATTCTCCA
TGACTCAAAAAACCGCGGTATCGAGGTCGGAGAGGTTAAACTCAACCTCGAGACTTTCATGAAGGCCAAGGAAACCGCC
GTTACCGGCCTGACCAAGGGTGTCGAGTTCCTCCTGAAGAAGAACGGCGCCGAGTACATCAAGGGCACCGGTTCCTTCA
TCAACGAGAACGAAATCAAGGTCGAACTCAATGACGGCGGCGAGTCCGTCATCCGCGGCAAGAACATTCTCATCGCCAC
CGGCTCTGAAGCCACTCCCTTCCCCGGCCTCACCATTGACGAGCAGCG

> SEQ ID NO: 6693 215629 167370_300546_1b
GAATTCATAATCGATCAGATTCTTCTAGGCAGTCTTATTCGGCGATCTAACCTAAATTTCTTCGACACCTCTCTGAAGA
TGCAGATTTTTGTGAAAACCCTCACTGGCAAGACCATCACACTTGAGGTTGAGAGCTCAGACACAATTGACAACGTGAA
AGCTAAGATTCAAGATAAGGAAGGAATTCCCCCGGATCAGCAGAGGTTGATCTTTGCTGGCAAACAGTTGGAAGATGGA
AGAACTCTAGCTGACTACAACATCCAGAAAGAATCCACTCTCCATCTCGTCCTCCGTCTCAGAGGTGGTATGCAAATAT
TTGTGAAAACCCTCACTGGCAAGACCATTACTTTGGAGGTTCTGATACCATCGACAATGTCAAGGCCAAGAT
CCAAGATAAGGAAGGTATTCCTCCAGACCAGCAGAGGTTGATTTTTGCTGGGAAGCAGTTGGAAGATGGGCGTACCCTT
GCTGACTACAACATCCAGAAGGAATCCACCCTTCACCTGGTTCTACGACTAAGAGGTGGTATTGCAGATCTTTGTGAAA
ACGCTTACTGGAAAGACCATCACCTTAGAAGTTGAGAGTTCAGATACCATTGACAATGTAAAAGCCAAAATTCAGGACA
AGGAAGGTATTCCTCCAGACCAGCAACGTTTGA

> SEQ ID NO: 6694 215629 255180_301642_1b
ACGCGTCGAGAGTAGAGAGAGAGAGAGAGAGAGAGAGAAGATGCAGATATTCGTGAAGACCCTGACGGGGAAGAC
CATCACCCTAGAGGTCGAGAGCAGTGACACCATCGATAATGTCAAAGCAAAGATCCAAGACAAGGAAGGAATTCCACCG
GATCAGCAGAGGCTTATTTTTGCTGGGAAACAACTGGAGGATGGTCGCACATTGGCTGACTACAATATCCAGAAAGAGT
CTACTTTGCACCTTGTTTTGAGGCTTCGAGGTGGTATCATAGAGCCTTCGCTGATGGCGCTCGCCAGGAAGTATAATCA
AGAGAAGATGATATGTCGCAAGTGCTATGCTCGTCTTCATCCTCGCGCTGTGAACTGCAGAAAAAGAAATGTGGGCAC
AGCAATCAGCTTCGACCAAAGAAGAAGATCAAGTAGGTNGTTCGGTTGCAGCCTCTCCAGATATTCAGAATCTTGTTTT
TTTGCTGATTTGAGGAAAAGTTGTTTGAGTGCCATTTACCATGTTTTGGTGCAAGTGGCACTCTTATTATGTTAATCTC
TGCGAAGTAATTACTGACGATGAGTCGTTTGCATTTGAATTTTCGGAACAAAAGGAATTTGAA

> SEQ ID NO: 6695 215629 248873_301587_1b
GTAGGGTTTCAAGTGGGCTGCCAAGATGCAGATCTTCGTGAAGACGCTCACGGGCAAGACGATCACTCTCGAGGTCGAG
AGCAGCGACACCATCGACAATGTCAAGACCAAGATCCAGGACAAAGAAGGCATTCCTCCGGATCAGCAGCGTCTCATCT
TCGCTGGCAAGCAACTCGAAGATGGCCGAACTCTCGCGGACTATAACATCCAGAAAGAGTCCACTCTCCATCTCGTGCT
GCGTCTTCGTGGAGGCATCATCGAGCCGTCCCTGATGGCCCTGGCGAGGAAGTATAATCAGGAGAAGACGATCTGCCGG
AAGTGCTATGCAAGGCTGCATCCTCGCGCTGTGAATTGCAGGAAGAAAAATGTGGCCACTCCAACCAGCTGCGACCCA
AGAAGAAATCAAATAGAGAGTTTAGGACGATCAACTTTGTTTTTCTTCATTCTCTATATGAATGAAAAAGGGAAAACC
TTTGTCTTTAAAAACCCTTGTAAAACCCGACCTTTAGGGCGGGGCGGTAGCGATGGGCGAGACGACGACGCATCCT
CCAACAATGCTCTTCGTGGAGCATCGCGCCGTGCAGGAAGCCGCGAGGACGAGTAGTAGATTCATCGTCTCCGCATCGA
CGTGCGTCAAGGTCGGGCTGGCGAGCTTCGCGATCGGC

FIG. 2 continued

> SEQ ID NO: 6696 215629 234079_301096_1b
GCGGACGCGTGGGCGGACGCGTGGGCGGACGCGTGGGCGAGGCGAGGAGAGCGGCGGCGAAGAAGGACAAGTCTGGAGC
CATGCAGATCTTCGTCAAGACATTGACTGGGAAGACAATCACCCTCGAGGTTGAGTCGTCGGACACGATCGACAATGTG
AAGACCAAGATCCAGGACAAGGAAGGGATCCCTCCCGACCAGCAGCGGCTGATCTTCGCGGGCAAGCAGCTGGAAGATG
GCCGGACGCTGGCGGACTACAACATCCAGAAGGAGTCGACCCTCCACCTTGTTCTTCGCCTCCGGGGTGGCGGCAAGAA
AAGGAAGAAGAAGACGTACACCAAGCCCAAGAAGATCAAGCACAAGAAGAAGAAGGTGAAGCTGGCGGTGCTCCAGTAC
TACAAGGTGGACGATTCGGGCAAGGTGAACAGGCTGCGCAAAGAGTGCCCGAATCCAGAGTGCGGTGCCGGGACGTTCA
TGGCGAACCACTTTGATCGGCACTACTGCGGCAAGTGTGGACTCACCTACGTCTACCAGAGAGCTGAAGCTTAGAGAGG
ATGACGAGCTTTGCTCTCTTTCCTTGTGTTTCTATCCAATTTTCTTTGAACGAAAGTATAATCTTTTCTTTTGTT

> SEQ ID NO: 6697 215629 226271_300995_1b
GAAAGACGCACAGTTTTCTTTGCAGACGACACCGAAATGCAGATTTTTGTCAAGACCCTTACCGGTAAGACTATCACCC
TCGAGGTGGAGTCTTCCGACACCATCGACAACGTCAAGTCCAAGATCCAGGACAAGGAGGGAATTCCCCCGGACCAGCA
GCGACTTATCTTCGCCGGTAAGCAGCTCGAGGACGGCCGAACCCTTTCTGACTACAACATCCAGAAGGAGTCCACTCTC
CATCTCGTCCTGCGACTTCGAGGTGGTGGTAAGAAGCGAAAGAAGAAGGTCTACACCACCCCCAAGAAGATCAAGCACA
AGCGAAAGAAGAACAAGCTTGCTGTCCTCAACCTCTACAAGGTTGACGATGACGGAAAGGTTGAGCGACTTCGACGAGA
GTGTGAGTCTGAGTCCTGCGGTGCCGGTGTCTTCATGGCTGACATGAAGGACCGACAGTACTGCGGCCGATGCCACCTC
ACCCTCAAGGCCTAAATGTATTGATTTAGTTTAGTATATTTATCTCTTGAACAAAAAAA

> SEQ ID NO: 6698 215629 220302_300954_1b
TCCGCAACATCTGAAGATTGCTTAGGACGGCAATAGGTCTATTGTCGAGGTATGTCTGAAAGATGCTGCATTTCTATCT
GCCCTCCATGAGCTCCGGGAGCTTCATGAGGGAATCATCGTTGATGTCTCCCTCTTGAGCATTCTTCTTTGTTTCCCGG
AGCTCTATTCCCCAAATCCCGAGATATTGCTCGTTGTCGCGAAGAAATTTGCAACACGGCAATTCTCGCCTTCTTCTCC
CCAAAGTCAACTCACGCAGGCAATGTATGCTGGGCAAACAAATCTAACCCTTCCAGTTAGGCAAGATGCAGATTTTCGT
CAAGACCCTCACGGGGAAGACGATCACCCTTGAGGTGGAGTCTTCCGACACCATCGACAATGTCAAGTCCAAGATCCAG
GACAAGGAGGGCATTCCCCCGGACCAGCAGCGATTGATCTTCGCTGGTAAGCAGCTGGAGGATGGCCGAACCCTCTCCG
ACTACAACATCCAGAAGGAGTCTACCCTCCACCTGGTCCTGCGCCTGCGTGGTGGTGCCAAGAAGAGAAAGAAGAAGGT
CTACACCACCCCCAAGAAGATTAAGCACAAGCGCAAGAAGACCAAGTTGGCTGTCCTCAAGTACTACAAGGTCAGCAAC
GATGGTAACATCGAGCGTCTCCGCCGCGAGTGCCCCAGCGAGACTTGCGGTGCTGGTGTCTTCATGGCTGCCATGCCTG
ACCGTCAATACTGTGGTCGTTGCCACCTGACCTACGTCTTCGACAAGCAGTAAACGACAAAACTTTCAAAAAGGGAAAA
AATTTATTGTGGATTGGACAGCTGGAGCCATGGGACTGCCATAACACACAAAGGCGTTGATGTAGCATTAGAGAGCACA
TCCGGCGGCTTCTGGTAATGAATGCTTGATTTGAGACACGTTTGG

> SEQ ID NO: 6699 215629 204284_300791_1b
ATACAAACACTTCTCACATCTCTTCCACCCTAAGGAATATCCGTTAACAGCGCATCTTCTTGCACTCTCTACGAATCTC
CCAGCGGCCAACGCTTAATCCGCCACCATGCAAATCTTCGTCAAGACCCTCACCGGCAAGACCATCACCCTCGAGGTCG
AGTCTTCCGATACCATCGACAATGTGAAGTCCAAGATCCAGGATAAGGAAGGCATTCCTCCTGACCAGCAGCGTCTGAT
TTTCGCTGGCAAGCAACTCGAGGATGGCCGAACTCTGTCCGACTACAACATCCAGAAGGAGTCCACCCTCCACCTGGTC
CTCCGCCTTCGTGGTGGTATGCAGATCTTCGTCAAGACCCTCACTGGAAAGACCATCACCCTCGAGGTGGAGTCATCTG
ATACCATCGACAACGTCAAGTCCAAGATCCAGGACAAGGAGGGTATCCCTCCTGACCAGCAGCGACTGATCTTCGCTGG
TAAGCAGCTTGAGGATGGCCGAACCCTCTCCGACTACAACATCCAGAAGGAGTCCACTCTCCACCTTGTCCTTCGTCTC
CGTGGTGGTATGCAGATCTTCGTCAAGACGTTGACCGGCAAGACCATCACATTGGAGGTTGAATCATCAGACACCATCG
ACAATGTCAAATCAAAGATTCAGGACAAGGAGGGTATTCCCCCGGATCAGCAGCGTCTTATCTTTGCTGGCAAGCAGCT
TGAGGACGGTCGCACCTTGAGCGACTACAACATTCAGAAGGAGAGCACACTTCACCTTGTCCTCCGTCTTCGTGGTGGT
ATGCAGATTTTCGTCAAGACTCTGACCGGCAAGACAATCACCCTCGAGGTGGAATCTTCCGACACCATCGACAACGTTA
AGTCCAAGATTCAGGACAAGGAGGGCATTCCTCCTGACCAGCAGCGCTTGATCTTTGCTGGTAAGCAGCTGGAAGACGG
TCGCACCTTGAGCGACTACAACATCCAGAAGGAGAGCACACTGCACTTGGTCCTGCGTCTGCGTGGTGGCCAGTAAATG
TGTCTTTTGCTTACGACCGCACTGTTACGACTGAATTGGACGGTTGGGCGTTTTTGGGAACTTTTTTTCAAAGCAGATA
TGGGAAC

> SEQ ID NO: 6700 215629 20058_300163_1b
ACGAAAATCTCAACTTTTCTCTTTACTTCAAACGCCTCTCAAGATGCAGATCTTCGTCAAAACCCTTACCGGAAAGACG
ATAACCCTTGAGGTTGAAAGCTCCGACACAATTGACAACGTTAAGGCTAAGATTCAGGACAAAGAAGGAATCCCACCGG
ACCAGCAAAGGTTGATCTTCGCCGGAAAGCAGCTCGAAGACGGCAGAACCCTAGCTGATTACAACATCCAAAAGGAATC
CACCCTTCACTTGGTGCTCCGTCTTCGTGGCGGTATGCAAATCTTTGTTAAAACCCTAACCGGGAAAACAATAACCCTT
GAAGTCGAAAGCTCTGACACAATTGACAATGTCAAGGCGAAGATTCAGGACAAGGAGGGAATCCCTCCAGACCAGCAAA
GGTTGATTTTTGCCGGAAAGCAACTCGAAGACGGCAGAACCCTAGCTGATTACAACATCCAGAAGGAATCGACCCTTCA
CTTGGTCCTTCGTCTTCGTGGTGGGATGCAGATCTTCGTCAAAACCTTAACTGGGAAAACAATCACCCTTGAAGTCGAA

FIG. 2 continued

```
AGCTCCGACACCATTGACAATGTCAAGGGTAAAATCCAGGATAAGGAGGGAATCCCACCAGACCAGCAAAGGTTGATTT
TTGCTGGTAAGCAATTGGAAGATGGCCGTACCCTAGCTGATTACAACATTCAAAAGGAGTCGACTTTGCACCTTGTGCT
CCGTCTTCGTGGTGGGATGCAGATTTTCGTGAAGACATTGACCGGGAAAACCATCACTCTTGAGGTGGAAAGCTCTGAC
ACTATTGACAACGTTAAGGCCAAAATCCAGGATAAGGAGGGAATCCCACCAGACCAGCAGAGATTGATTTTTGCTGGTA
AGCAGCTGGAGGATGGCCGAACCCTCGCTGATTACAACATTCAGAAGGAGTCTACCCTTCACTTGGTTCTCCGTCTCCG
CGGTGGGATGCAGATCTTCGTCAAAACACTCACTGGGAAGACAATCACCCTCGAAGTTGAAAGCTCCGATACTATCGAC
AATGTTAAGGCTAAGATTCAGGACAAGGAAGGTATTCCACCGGACCAGCAGAGATTGATTTTGCTGGTAAGCAGTTGG
AAGATGGGAGAACTTTAGCTGATTATAATATCCAGAAGGAATCCACACTGCATTTGGTGCTCCGTCTTCGTGGTGGGAT
GCAGATTTTTGTGAAGACGTTGACCGGGAAAACCATCACTTTGGAGGTAGAGAGTTCTGATACGATCGACAATGTGAAG
GCTAAGATTCAGGACAAGGAGGGTATCCCGCCAGATCAGCAGAGGCTGATTTTTGCTGGGAAGCAGTTGGAAGATGGAA
GGACTCTGGCTGATTATAATATTCGAAGGAGTCGACTCTGCACCTTGTCCTCCGTCTCCGTGGTGGTTTCTAAAGTGT
CCGTCAATAGTGGTGGTAATGTCTGTGTCTTGGGTCTTGGGTCTGTTCGGTGTTTGTTTGATTCATGATTTAGTAGTTT
GTGTAGTTTTTGTTAGTTGTCATCATGTTATGCCTTCAAAAGAAGGAAGGAGACTTGTCCTCTTTGTCTCTGTTTGCGA
ATAATAAAGTTCGAATTATGGTTT

> SEQ ID NO: 6701 215629 104542_300370_1b
AGGCATTGAGCTACACACTATCATAGTATCATTCCATTCTGAAGAAAGAAGAAATTCTAGCGCCGTAGTGCTCCTCGAG
TTCTCTCCTCCAAAGCGAAGATGCAGATCTTCGTGAAAACCCTAACAGGTAAAACAATCACCCTTGAGGTTGAATCTTC
CGACACAATCGACAATGTGAAAGCCAAGATCCAAGATAAGGAAGGGATTCCCCCAGATCAGCAGCGTCTGATTTTCGCC
GGAAAGCAGCTTGAAGACGGCCGAACCCTAGCTGATTACAACATCCAGAAGGAGTCGACTCTTCATCTCGTGCTCCGCC
TCCGTGGTGGTGCTAAGAAGAGGAAGAAGAAGACTTACACCAAGCCTAAGAAGATTAAGCACAAGAAGAAGAAGGTTAA
GCTCGCTGTACTTCAGTTCTATAAGGTGGATGATTCTGGAAAAGTCCAGAGGCTTCGTAAGGAGTGTCCTAATGCTGAG
TGTGGTGCTGGAACTTTTATGGCTAACCACTTTGACCGTCATTACTGTGGTAAGTGTGGGCTCACCTATGTTTACAACA
AGGCCGGCGCCGATTGAGGCTTATGCTTAGCTCTGTTTTAATGCTGTCGTCAATTTTATCCTTTTGTCGAACGGTAATT
TAGTATGGATTTTCCTTTTTAAATGGTGTGGTAACTATGGGAATTTTGAGTTATTTTAAAGTTTTTGCTTATTATTCT
TAAAGTTTTAGGTTATTATCTCAAATTTTATATCCTTAATTATCTACTTTATA

> SEQ ID NO: 6702 215629 1112390_301802_1b
GGAAGGGAGGAAGGGTGGTGTGGGTGGATTTGGAGGGGCCAAGATGCAGATCTTTGTGAAGACCCTGACAGGGAAGACC
ATCACCCTAGAGGTTGAGAGTAGTGACACCATCGATAATGTCAAGGCTAAGATCCAAGATAAGGAAGGTATCCCCCCTG
ATCAACAACGCCTGATCTTTGCTGGAAAACAGCTTGAAGATGGCAGAACCTTGGCTGACTACAACATTCAGAAAGAGTC
CACGTTGCATTTGGTTCTAAGGTTGCGAGGTGGTATCATTGAGCCATCTCTGATGGCTCTTGCCAGGAAGTACAACCAG
GAGAAAATGATCTGTCGCAAATGCTATGCTAGGCTTCATCCTCCGGCTGTGAATTGCCGCAAGAAGAAATGTGGACACA
GCAATCAGTTGCGGCCAAAGAAGAAGATTAAGTAGATTTGGAGAAGCAATCATTGCATTGGAACAGTAGATGCAGGAAG
AGGGAAATGGGAGGAATGGAGATGCAGCTTTGTTATTGTTTTACTAGGATCTGTTATACAACTGAAGTGGCTCAATGGG
AACTAGCTTTTAGGCCTTAGCCTTTGGACCTTCCATAACATTTCATCATGCGTGTATCAAGAGCTATGAGCTGATTTGA
AATTGATCAAAGCTCCCCTTCTGAATGTTGCTTGCCTGAAG

> SEQ ID NO: 6703 215629 111165_300052_1b
TCATCGCCTTCAAATTTCTCTCTCAAGGTTTGAGAAAATTTCCTCAATTTCTCGCTTTAGGAGTTCTTTTTTATTGAAT
CACCGATTTGGGTGTGTCAAGCCCTAATTTTGAAGTTCATTTTTTCAATTGTTTGTTGTTGATTTTATGTTATAACAGA
TGCAGATCTTCGTAAAAACCCTAACCGGTAAGACCATCACTCTCGAGGTTGAGAGTTCCGACACAATCGACAACGTAAA
AGCCAAAATCCAGGATAAGGAAGGAATTCCCCCAGATCAGCAAAGGCTTATCTTCGCCGGCAAGCAGCTTGAGGACGGC
CGTACTCTCGCCGATTACAACATCCAGAAGGAATCTACTCTTCACTTGGTCCTCCGTCTGCGTGGTGGGATGCAGATTT
TCGTCAAAACCCTCACTGGCAAAACAATCACCCTTGAGGTGGAAAGTTCTGACACCATCGACAATGTCAAGGCTAAAAT
TCAGGATAAGGAGGGAATTCCACCAGACCAGCAGAGGTTGATCTTCGCTGGCAAGCAGCTTGAGGATGGTCGTACCCTT
GCCGATTACAACATCCAGAAGGAGTCTACCCTTCACCTTGTCCTCCGTCTCCGTGGTGGTATGCAGATCTTTGTCAAAA
CGCTCACCGGCAAAACCATCACCCTTGAGGTCGAGAGTTCCGACACCATCGACAATGTCAAGGCCAAAATTCAGGACAA
GGAGGGCATTCCCCCAGACCAGCAGAGGTTGATTTTCGCTGGCAAGCAGCTCGAGGATGGCCGTACACTAGCTGATTAT
AACATCCAGAAGGAATCCACCCTTCACCTTGTCCTCCGTCTCCGTGGTGGTATGCAGATCTTCGTCAAAACACTCACCG
GCAAGACCATCACCCTGGAGGTTGAAAGCTCTGACACCATTGACAATGTTAAGGCCAAGATCCAGGACAAAGAGGGGAT
TCCCCCAGATCAGCAGAGGTTGATCTTCGCAGGAAAGCAGTTGGAAGATGGTCGCACCCTTGCGGACTACAACATTCAG
AAGGAGTCTACTCTGCACTTGGTGCTAAGGCTGAGGGGAGGAATGCAGATCTTCGTGAAGACATTGACCGGGAAGACCA
TCACCTTGGAGGTGGAAAGCTCTGACACCATCGACAATGTCAAAGCTAAGATCCAGGACAAGGAGGGTATCCCACCGGA
CCAGCAGAGGTTGATCTTTGCTGGTAAGCAGCTTGAGGATGGAAGGACCCTGGCCGACTACAATATCCAGAAAGAGTCA
ACCCTTCACCTTGTCCTCCGTCTCCGTGGTGGTTTCTAGGTTGCCTGTTGTTGATGTTGTTGTGTCGTGTTGATTGGCT
GTGTCTTGTTGTGGTCATGATGTGTTTTGTCTACTAAGGTCCCAAAGATGTTCAATTCTGTTTCTGTTCGCCGTTTCTT
TCATATTTTCTGTTGTGAATAAAGACACCAGATTCTGTCCTAGTGCTTAGGTTTTGTGCTCTCTGTTGGCAGTAAATGA
ACTTTCCTTTGTTTTATCCATT
```

FIG. 2 continued

> SEQ ID NO: 6704 215629 156778_301369_1b
CCCACGCGTCCGCGGAGAGATAAGATGCAGATCTTCGTGAAAACCCTAACGGGGAAGACCATCACCCTTGAAGTCGAAT
CGAGCGATACCATCGACAATGTCAAGGCCAAGATTCAGGACAAGGAAGGTATTCCACCGGACCAGCAGCGATTGATCTT
TGCTGGTAAACAGCTTGAAGATGGGCGTACACTGGCTGATTACAGTATCCAGAAAGAGTCGACTCTGCATCTTGTGTTG
AGGCTCCGTGGAGGGATCATTGAACCGTCTCTTATGGCATTGGCCAGGAAATACAACCAGGATAAGATGATTTGCCGCA
AGTGCTATGCCCGTCTGCATCCTCGTGCCGTAAACTGCAGGAAGAAGAAATGTGGCCATAGCAACCAGTTGAGGCCAAA
GAAGAAGATCAAGTAAACAGGCGGTTGCATTTGCTGTCTAGATGCTATGCCAATTGAATGATTTTGTAGTTTGGTGGGT
TTCTATTGTTGTCTGTTTAACTGCAGCACATTTGTTTCAACTTCAGTTCCATTTAGTGCTCATTTTTGAGTTTGGTATG
ATTA

> SEQ ID NO: 6705 215629 143994_301077_1b
GCGGCTGACAAACCCTAATCCCATTTCGCCATCGAACAGCGAAGATGCAGATCTTCGTGAAAACCCTGACGGGTAAGAC
CATCACCCTTGAGGTCGAATCCTCCGACACAATCGACAACGTGAAGGCAAAGATCCAGGATAAGGAAGGCATTCCACCG
GACCAGCAGCGGCTCATTTTCGCCGGAAAACAGCTTGAGGATGGACGAACCCTAGCTGATTACAACATCCAGAAGGAAT
CCACTCTCCATTTGGTGCTCCGTCTCCGTGGTGGTGCTAAGAAGAGGAAGAAGAAGACTTACACCAAGCCTAAAAAGAT
TAAGCACAAGAAGAAGAAGGTTAAGCTTGCTGTGTTACAGTTTTACAAGGTGGATGATTCTGGAAAAGTCCAGAGGCTT
C

> SEQ ID NO: 6706 215629 135673_300416_1b
AATTTCTCCCCAATCTCGCGAGGCTCTCGTCGTCGAATCGAATCCTCTCGCGTCCTCAAGATGCAGATCTTTGTGAAGA
CATTGACCGGCAAGACTATCACCCTCGAGGTGGAGTCCTCTGACACCATCGATAATGTCAAGGCTAAGATCCAAGATAA
GGAGGGCATCCCCCCGGACCAGCAGCGTCTCATCTTCGCTGGCAAGCAGCTGGAGGATGGCAGGACCCTTGCTGACTAC
AACATCCAGAAGGAGTCGACCCTTCACCTTGTCCTCCGCCTCCGTGGTGGCATGCAGATCTTTGTCAAGACTCTGACCG
GCAAGACTATCACCCTTGAGGTGGAGTCTTCTGACACCATCGACAACGTCAAGGCCAAGATCCAGGACAAAGAGGGCAT
CCCCCCAGACCAGCAGCGTCTCATCTTCGCCGGCAAGCAGCTGGAGGATGGCAGGACCCTTGCTGACTACAACATCCAG
AAGGAGTCCACCCTCCACCTTGTCCTCCGCCTCCGTGGTGGCATGCAGATCTTTGTCAAGACACTGACCGGCAAGACCA
TCACCCTCGAGGTGGAATCTTCTGACACCATCGACAACGTCAAGGCCAAGATCCAGGACAAGGAGGGCATTCCCCCGGA
CCAGCAGCGTCTCATCTTTGCCGGCAAGCAGCTTGAGGACGGCAGGACCCTTGCTGACTACAACATCCAGAAGGAGTCA
ACGCTTCACCTTGTCCTCCGTCTCAGGGGAGGCATGCAAATCTTCGTGAAGACTCTGACCGGCAAGACCATCACCCTCG
AGGTGGAGTCTTCTGATACCATCGACAATGTCAAGGCCAAGATCCAGGACAAGGAGGGCATTCCCCCGGACCAGCAGCG
CCTCATCTTTGCTGGCAAGCAGCTGGAGGATGGCAGGACCCTTGCTGACTACAACATCCAGAAGGAGTCCACCCTCCAC
CTTGTGCTCCGCCTTCGTGGTGGTATGCAGATCTTTGTCAAGACCCTCACAGGC

> SEQ ID NO: 6707 215629 1110809_301539_1b
GGGCAGGTAGAGGTGGAGGCAAGCGGGGGAAGATGCAGATATTTGTGAAGACCCTGACGGGGAAGACCATCACCCTCGA
GGTCGAGAGCAGTGACACCATCGATAATGTCAAAGCAAAGATCCAAGACAAGGAAGGAATTCCACCGGATCAGCAGAGG
CTTATTTTTGCTGGGAAACAACTGGAGGATGGTCGCACATTGGCTGACTACAATATCCAGAAAGAGTCTACTTTGCACC
TTGTTTTGAGGCTTCGAGGTGGTATCATAGAGCCTTCGCTGATGGCGCTCGCCAGGAAGTATAATCAAGAGAAGATGAT
ATGTCGCAAGTGCTATGCTCGTCTTCATCCTCGCGCTGTGAACTGCAGAAAAAAGAAATGTGGGCACAGCAATCAGCTT
CGACCAAAGAAGAAGATCAAGTAGGTTGTTCGGTTGCAGCCTCTCCAGATATTCAGAATCTTGTTTTTTTGCTGATTTG
AGGAAAAGTTGTTTGAGTGCCATTTACCATGTTTTGGTGCAAGTGGCACTCTTATTATGTTAATCTCTGCGAAGTAATT
ACTGACGATGAGTCGTTTGCATTTGAATTTTCGGAACAAAAGGAATTTGAATTGCATTTTAGCTTTCAGAATCACAATA
TCCAAACATTCTCTTG

> SEQ ID NO: 6708 215629 2834_300100_-1b
CCCACGCGTCCGGAAGACGAAACACAAAGATGCAGATCTTCGTGAAAACCTTGACCGGCAAGACCATCACTCTCGAGG
TCGAGAGCAGCGACACCATCGACAATGTCAAGGCCAAGATCCAAGACAAAGAAGGAATCCCTCCGGATCAGCAGAGATT
GATCTTCGCCGGAAAGCAGCTCGAAGATGGTCGTACTTTGGCTGACTACAACATCCAGAAAGAATCTACACTTCATCTT
GTGTTGAGGCTTAGAGGAGGTATTATTGAGCCTTCCTTGATGATGCTTGCTCGTAAGTACAATCAGGATAAGATGATAT
GCCGCAAGTGCTATGCTCGTCTTCACCCAAGAGCTGTCAACTGCAGGAAGAAGAAGTGTGGTCACAGCAACCAGTTGAG
GCCTAAGAAGAAGATCAAGTAGAGAGACTCTTATCAAGAATCCCATCTCTTGCTTGCTTCTTTTTGTTGTCTTCCCTTT
GATAGGGTTTGTTTTTCTTGTTTCAGTGACTTTCTATGTTAAACGATAATGTCAGTAAAAGGATTTGGTTTTCTATT

> SEQ ID NO: 6709 215629 55729_300141_1b
CGAACGCAAAGATGCAGATTTTCGTGAAAACGCTAACCGGCAAGACCATCACCCTCGAGGTCGAGAGCAGTGACACCAT
CGACAATGTCAAGGCCAAGATCCAGGACAAAGAAGGAATTCCTCCGGACCAGCAGAGGTTGATCTTCGCCGGAAAACAG

FIG. 2 continued

CTTGAAGATGGTCGTACCTTGGCTGACTACAACATCCAGAAAGAGTCGACTTTGCATCTTGTTCTGAGGCTTAGGGGAG
GTATCATTGAGCCTTCATTGATGATGTTGGCTCGTAAGTATAACCAAGACAAAATGATTTGTCGCAAGTGTTATGCTCG
TCTCCACCCAAGAGCTGTGAACT

> SEQ ID NO: 6710 215667 205766_300922_1b
TGGATAATTGACCGTTGATACTGATTATTCGCCTGAGTAACAAATTCTACCTACATTTACTGCCTGCCCTCTCCTATTT
CGCCATCGAAAAGGCCCGTCTGTTGTCGCCGCCGAAGCAGTTAGCAGGGGGGTCATACGCTAAACCACCCCTCCTCCTC
TTTAACGACCACCTCCTCTCTTCTCTCACTCTCACCTCCTCCTCCTCTCCATCAAACATCTCGACTCCCTACAGCCAAA
AGCTTCTCTCATGTCCGACTACGCTCCTCCCACAGGGCCTCCGCCGCCCAAGGCCCCCGAAGTTCCCGCTGGCTGGGCC
GCCCGGTGGAACGACCAATACAAAGAATGGTTCTACGTAAATATCTACACCAAAAAGTCCCAATGGGACAAGCCCACCA
GTCCTGTCTTCCCTGACGGAGACGCCCCGCCTTCCGGGCCTCCCCCAGGCTATGACGGCCACAACGCTCCCCGCACGTC
CGATGCCAAGACGAACCCCTATGGCGATCAGAGCAACAACTTTGGAGGCTCATCATCAAGGCAGACGCAGGAAGACG

> SEQ ID NO: 6711 215672 202059_300722_1b
ATAAATGGTAAACCACATTTAGTAAAGATGAAACCAGTAACAGCAGATCCGATATTTGAAAAAGAACAGGTTGGTCCTA
GATAAAGTTCAACACCCTGGTATCATGCTAGATTTAGGGAAACGACTGAAAAAAGGTTTATCACTCCGGAGACAATCAG
GTGCGAGCAACGTTGGGGGCAGGAGCAGCAGCTCCACCAGGAGCGGGAGCGCCACCACCTGGACGAGGGCCTTGGGGCC
TATCCTCCCTGCGGCGGAAGCGTTCCGGAGGCCTGCGGTCCCTCCGGTTCTCACGGGAGCGGACACGGACGATGTGAGC
ATGGATTGCACAGGACACACAGTGATGCACCTTGGCGTAAAGCTTGGGGAGAACGTATCCATCGTGCACGCACGCCTCC
TGGACGTCCCTGATGGCGGCCTGCTCCACGATGTTCCTCACCTGAAACCTCTTGATCGCCTTGTCCTTGGGGCAGCACT
TGGCGCAGTTGGAGCAGCGGATGTACTTGACGTGGCCGCGGCCGTGCTTGTT

> SEQ ID NO: 6712 215672 255704_301643_1b
GGAAGAGGTAGAGGACTCTTTGTAGGTTTTGCTTGCAGGGTAGAAGACTCTTTTACTAGGGAGCTATGACGGTTAAGCG
TAGAAGTAGGGGACGAAGTAAGCATGGCCGTGGTCATGTTAATCCCATCCGATGCTCCAACTGTGGTCGATGCTGCCCT
AAGGACAAAGCAGTGAAGAGGTTCCTTGTCCGCAACATTGTCGAGCAAGCGGCAATCAGGGATGTCCAGGAAGCATGTG
TTTATGATGGATATGTTCTTCCAAAGCTTTACACAAAGATCCAACATTGCATCTCTTGCGCTATCCACTCCCGTGTAGT
ACGTGTCCGCTCCAGAGAGGCTCGGAGGAACAGGGAGCCACCACAGCGTTTCCGTAGAAGGGAGGATAATGCCCCAGGA
CAGAACCGTCCCCCTCCCCCTCCCCGCCCTTGAGATTTGTCAGGCAGTTCATTAATCCTCGAGACTTAGTGCTTTTTAA
TATCTTAGTTGCAGCCTATATGAAGCTCCCACTGGGGCCCTTATTTTGTCTTAAAACCAATTTGTGCTCCAAAC

> SEQ ID NO: 6713 215672 226419_300997_1b
GCAAAGATGGTCAAGAAGCGAGCTTCCAACGGACGAAACAAGAAGGGTCGAGGACACGTTACCTCCATCCGATGCTCTA
ACTGTGCCCGAATGGTCCCCAAGGACAAGGCCATCAAGCGATTCACCATCCGAAACATGGTCGAGGCCGCCTCCATCCG
AGATCTTTCCGAGGCCTCCGTCTACCAGGAGTACGTGCTGCCCAAGCTCTACCTCAAGATCCAGTACTGCGTGTCTTGC
GCCATCCACTCCAAGGTTGTCCGAGTCCGATCTCGAGAGGGCCGAAAGGTTCGAACTCCTCCCCAGCGAGTCCGATTCA
ACAAGGACGGTAAGAAGATCAACCCTGCTGCCGCCGCCAAGGTTGTCGTTTAGGCGATGTATAAAAAATTGCACTGTGT
ATGAAG

> SEQ ID NO: 6714 215672 275307_200155_1b
AGAGCCGCAGATTATACTCAGAAGCTACCATCCAGAGCGAAAATGACTTTCAAGAGAAGAAACGGAGGTCGTAACAAAC
ATGGACGTGGCCACACAAAATTTATTCGTTGCTCTAATTGCGGCAAATGCTGCCCAAAGGACAAGGCCATCAAGAGGTT
TCTTGTAAGGAACATTGTTGAGCAAGCTGCTGTACGTGATGTTCAGGAAGCTTGTGCTTTTGAAACGTACACTCTTCCT
AAGCTGTACTTGAAGATGCAATATTGTGTTTCATGTGCAATTCACTCTAAGGTGGTCAGAGTTCGTTCTGTTACTGATA
GGAGAGTTCGTGAGCCCCCACACGCTTTCAGGCGCCCAAGGGATGATCTCCCAAAGCCAGGTCAAGCTCCACGCCCCGC
TGGAGGAGCCCCTGCTGCACCTCGCACTTAACTTGATAGGCTTCAGGTTTTAATTAATCTGATAGTTATTTTATCTGTT
ATATGTCGTGGTTTTGACTGTACTGTTTGATTTAGTTGATGGGACCATTTACCATTTTATGGAATTGAATTTTGAATGG
AAAATGAGAGATCTAAATTTTCATAATGAAGCGCTTTTAAG

> SEQ ID NO: 6715 215672 1097019_301436_1b
TCTTTGTGGTTCATTCACTAGGAAGAGGTAGAGGACTCTTTGTAGGTTTTCTTGCAGGGTAGAAGACTCTTTTACTAG
GGAGCTATGACGGTTAAGCGTAGAAGTAGGGGACGAAGTAAGCATGGCCGTGGTCATGTTAATCCCATCCGATGCTCCA
ACTGTGGTCGATGCTGCCCTAAGGACAAAGCAGTGAAGAGGTTCCTTGTCCGCAACATTGTCGAGCAAGCGGCAATCAG
GGATGTCCAGGAAGCATGTGTTTATGATGGATATGTTCTTCCAAAGCTTTACACAAAGATCCAACATTGCATCTCTTGT
GCTATCCACTCCCGTGTAGTACGTGTCCGCTCCAGAGAGGCTCGGAGGAACAGGGAGCCACCACAGCGTTTCCGTAGAA
GGGAGGATAATGCCCCTGGACAGAACCGTCCCCCTCCCCCTCCCCGCCCTTGAGATTTGTCAGGCAGTTCATTAATCCT
CGAGACTTAGTGCTTTTTAATATCTTAGTTGCAGCCTATATGAAGCTCCCACTGGGGCCCTTATTTTGTCTTAAAACC
AATTTGTGCTCCAAACTTGTCTGTTTTCAGTTATAAATGAAGTTTTTTATTATGGATACT

FIG. 2 continued

> SEQ ID NO: 6716 215672 111122_300052_1b
CGGACGCGTGGGCGGACGCGTGGGCGGACGCGTGGGCGGACGCGTGGGCGGACGCGTGGGGTCGAGTTCCAGCCATCTC
CGAAAATGACTTTCAAGAGAAGGAACGGAGGTCGCAACAAGCATGGACGTGGCCACGTCAAATTCGTCCGTTGCTCCAA
CTGCGGCAAATGCTGCCCTAAGGACAAAGCCATCAAGAGGTTTCTTGTGAGAAATATTGTTGAGCAAGCAGCTGTTAGG
GATGTGCAGGAAGCTTGTGCTTTTGAAACGTACACTCTGCCTAAGCTGTATCTGAAGATGCAATATTGTGTATCATGTG
CCATCCACTCAAAGGTGGTTAGGGTCCGCTCTCGAACTGATAGGAGGGTCCGTGAGCCTCCACAGCGATTCAGGCGCCC
AAGGGATGATGCTCCAAAGCCTGGTCAAGCTCCACGGGTTCCTGGAGCTGCTCCGACAGCAGCAGCTCGTACTTGAGTG
CCTGCTGTTTTGATCATGTTGTTTA

> SEQ ID NO: 6717 215672 1113974_301907_1b
ATCCACAGCTATGACTGTGAAGCGGCGGAGCCGTGGGCGTAGCAAGCATGGGCGTGGCCATGTCAATCCCATCCGATGC
TCCAATTGCGGTCGCTGCTGCCCTAAGGACAAGGCAGTGAAGAGGTTTCTTGTTCGCAACATTGTTGAGCAAGCTGCAA
TTCGGGATGTCCAGGAAGCATGCGTTTACGATGGCTATGTTCTTCCCAAGCTATATACTAAGATACAGCACTGCATCTC
ATGTGCAATCCACTCGCGCGTGGTGCGTGTTCGCTCCCGAGAGGCTCGGAGGAACAGGGAGCCACCCCAACGATTCCGC
CGAAGGGAGGACACTGCTGGACCAAACCGCCCGCCTGCACCTCCACGCCCTTGAGCATAGGGCTTACAATTGAACATCC
TTTTAATCTTTAGACTCCCAATATGCTTATTATAGAGTTTCTATTTTGTGATTCACAAAGGTTGCGTGTCTTTTGAAAG
GCTTTGCAACTAGGAATTTTCTTTGGTTTAGCAATGAGGCAAAGCTCACTCTAGTTCAATTTTAAGCTATTTCATGATT
ACTGCTATTTTGTTGCCATGATGAATATAAATATTTTCACTTCTCT

> SEQ ID NO: 6718 215672 111127_300052_1b
CCCACGCGTCCGCGCCATTAGAGTTCCATCGTATTCACTGCTCAGCAGCTGCTACAACTCGTCCGGCCAAAATGACATT
CAAGAGAAGAAACGGAGGTCGTAACAAGCATGGACGTGGCCACACTAAATTCATTCGCTGCTCTAACTGCGGCAAGTGC
TGCCCTAAGGACAAAGCAATCAAGAGGTTCCTTGTGAGGAACATCGTTGAGCAAGCAGCAGTGAGGGATGTTCAGGAAG
CTTGTGCTTTTGAATTGTACACTCTTCCTAAGCTGTACTTGAAGATGCAATATTGTGTCTCATGTGCCATCCACTCCAA
AGTTGTTAGGGTCCGCTCTGTTACTGATAGGAGGGTCCGTGAGCCTCCACAGCGCTTCAGACGCCCAAGGGATGATGCT
CCCAAGCCTGGTCAAGCTCCACGCCCTGCCGGAGCTCCTACTGCAGCTCGTTCTTAAGTGCCTACATTTTGATCAACTA
CTGTTAGGCTTTTGGGTTTTAGTTAATTTGAGATGTATTTTTGAAGTCGATTTCTCTATTTAGTTTTACTGGAACTATC
ATTAAATTTGTGTATGCAAATCTCAAGCAAACAGGCCTGTTGTTCGTCCTATAGCTTATATATCCTTTGCAATTAAACT
C

> SEQ ID NO: 6719 215676 10128_300284_1b
CTCGAGCTTGCGGCCGCTAAGCTTTTGATCCAGAACCAGGATGAGATGATTAAAGCTGGCAGGCTTTCTGAACCCTACA
AGGGTATTGGTGACTGTTTCGGCAGGACGATTAAGGATGAAGGTTTTGGTTCTCTATGGAGAGGGAAACACTGCCAATGT
TATCCGTTATTTCCCCACTCAGGCCTTGAACTTTGCCTTCAAAGATTACTTCAAAAGACTTTTCAACTTTAAGAAGGAC
AGAGATGGTTACTGGAAGTGGTTTGCTGGTAACTTGGCATCTGGAGGAGCAGCTGGTGCCTCTTCCCTTCTGTTTGTGT
ACTCCCTTGACTATGCCCGTACCCGTCTAGCTAATGATGCCAAGGCTGCAAAGAAAGGAGGTGGTGGAAGACAGTTTGA
TGGTCT

> SEQ ID NO: 6720 215676 145234_301058_1b
CCCCCCCCTCTAGCTCCTCGTTCTTCGCCCAGCTCCATTTCCTCTTTCGACTTCCAAGGCGAGTTGAACGCAGGAGTTT
ACTTAGCAATGGCGGATAACCAGCACCCAACTGTTTTTCAGAAGGTAGCTAACCAGATGCATCTGAGCTCCAGTCTTTC
CCAGGATGTCCATGCTCACTACGGGGGCATTCAAAGGCCTGCTTTCCATCAGAGGCGTTTTGCATATGGCAATTACTCT
AATGCAGGACTGCAAAACTGCCAAGCCACACAGGATCTCTCATTGATTTCTGCAAACGCTTCACCAGTGTTTGTGCAAG
CTCCCCAAGAAAAAGGATTAGCAGCTTTTGCCACTGACTTCCTTATGGGTGGTGTTTCTGCTGCTGTGTCAAAGACTGC
TGCTGCTCCTATTGAGCGTGTGAAGCTTTTGATCCAAAACCAAGATGAGATGATTAAGGCTGGTAGACTGTCAGAACCA
TACAAGGGAATTGGAGATTGTTTCGGGAGGACAATTAAAGATGAGGGATTTGGTTCTTTGTGGAGAGGGAAACACTGCTA
ATGTCATTCGTTACTTCCCTACTCAGGCCTTGAACTTTGCATTTAAGGACTACTTCAAGAGGCTCTTCAACTTCAAGAA
GGACCGTGATGGCTACTGGAAGTGGTTTGCAGGCAACCTTGCATCTGGTGGTGCTGCTGGTGCTTCTTCTTTGCTCTTT
GTTTACTCCCTTGACTATGCTCGTACTCGTCTTGCAAATGATGCCAAGGCTGCAAAGAAAGGAGGTGGGAGACAGTTCA
ACGGTTTGGTCGATGTCTACAAGAAGACTCTTGCATCTGATGGAATTGCTGGATTGTACCGTGGGTTCAACATTTCATG
TGTTGGTATCATTGTGTACCGTGGTTTGTACTTCGGAATGTACGACTCCTTGAAGCCTGTGCTCTTGACTGGAAACATG
CAGGATAGTTTCTTTGCTAGCTTTGCTCTTGGGTGGCTTATCACCAATGGTGCTGGTCTTGCATCCTACCCAATTGACA
CCGTTAGAAGAAGAATGATGATGACATCTGGTGAGGCTGTGAAGTACAAGAGCTCATTCGATGCCTTCTCCCAGATCCT
TAAGAATGAGGGTGCCAAATCTCTGTTCAAAGGTGCTGGTGCTAACATCCTCCGTGCCGTTGCTGGTGCTGGTGTGTTG
GCAGGTTATGACAAGCTTCAGGTCATAGTTTTCGGAAAGAAATATGGTTCTGGTGGTGCCTAAGTCAGACATAAACTAC
TTGTTTTTTTAGAATTAGAATATGGTGATGAAAATCCTTCAAATTCCAA

FIG. 2 continued

> SEQ ID NO: 6721 215676 122106_300016_1b
CCCCGAGGCAAGGCACGCGAGCCCTAGGCGCCAGCCGACTCGACCAGCGCCCGGAGGCGGAGCACCCGCCGCCGCCGCC
CTCGCCATCGTCGGCTTCACCCCTCATCGGCAACCTAGTGCAGGTTGTTTTCTGAAGATGGCTGACGATTTGGGCCCTC
CCACTGTGCTCCAGAAGATACATGGGCAGTCCATGATGTTCAGCAAGATCTCACCTTATTCTTTGATGAAGAATCCCGC
ACTCTACAATGCCAACACTTCTTACAGTGTGCCTCTGAAGTCATACAATGGGATGGATGGGAACAATGGGTTCTCATCT
GTCACATCTGTATCCCCAGTCTTTGCTTCTGCCCCAAAGGAGAAAGGTCTTTCTGGGTTTATGATTGACTTCATGAGGG
GTGGAGTTTCAGCTGCTGTCTCCAAGACTGCTGCTGCTCCCATTGAGCGAATCAAGCTTCTCATTCAAAACCAGGATGA
AATGATCAAGAGTGGTAGGCTCTCTCACCCATACAAAGGTATTGCGGACTGCTTTGGCCGCACAATTAAGGATGAAGGT
GTGATTGCACTGTGGAGAGGGAACACTGCTAATGTCATCCGTTACTTTCCTACCC

> SEQ ID NO: 6722 215676 1171522_302056_1b
ATTTCTCATCTCGCAGGGCAGGGATTGCAGATCTCGAACTCCCGCACCCCCCTCCCTGTAATGCGAGCACAGTCTTGCT
GAAGCAGTTGAAATGGCTGAGAGACCGCAAGCTCCGTCTGCTATGAATAGGTTCTCTGGCTACACCTACCTAGGTTCCA
AGCTTACTGAGAACCGCCAAAGAAGCCGAGGGCCAAACACCACCAGCAGCTACTATTCGTATGCAATAAGCCGCAATGG
CCAGCCCAAGCAGACCCCGATGCTTAACCTGAATGGTGCTGTTGGTTCAGTGAACCTGGACAGTTTCCAGAATGCTTCC
CCCGCCAATGCCGAGTTTTTTGCCCCTGCAGCAAAGGAGAAGGGAGTACAAGGCTTCTTGATTGATTTCATGATGGGTG
GTGTTTCTGCTGCAGTTTCCAAAACTGCTGCTGCCCCTATTGAGCGAGTGAAGCTCCTTATTCAGAACCAGGATGAAAT
GCTCAAGTCTGGCCGTCTCTCTGAACCCTACAAGGGTATCGGGGAATGTTTCTCCCGAACCATTAAGGAGGAAGGCTTC
ATCTCCCTTTACCGAGGAAATGTGGCCAACGTCATCCGTTACTTCCCTACTCAGGCTTTGAACTTTGCATTCAAAGACT
ACTTCAAGAGGATGTTCAACTTCAAGAA

> SEQ ID NO: 6723 215676 107092_300262_1b
ATTGTCTCTCTCATCACCATCTACTCCTCGTTCTCCTCTCCTCTCTATCACTACTCTCGAGGCGAGTCGAACGCAGGAC
TTCGTTCAACATTGCAATGGCAGATATGAACCAGCACCCAACTGTCTTCCAGAAGGCAGCTAACCAGCTACACTTGAGC
TCGAGTCTTTCCCAAGATGTCCATGCTCGCCATGTGGGCGTGCAACCTGCTGTTTACCAGAGGCGTTTTGCTTATGGCA
AATACTCCAATGCTGGACTACAAACTTGTCAAGCCACTCAGGATCTATCATTGATCACCTCAAATGCTTCACCAGTGTT
TGTGCAGGCTCCTCAAGAGAAAGGACTTGCAGCTTTTGCCACTGACTTCCTCATGGGTGGAGTTTCTGCTGCTGTGTCA
AAGACTGCTGCTGCCCCTATTGAACGTGTTAAACTTTTGATCCAAAATCAAGATGAGATGCTCAAGGCTGGTAGGCTCT
CAGAACCATACAAGGGAATTGGTGATTGTTTTGGGAGGACAATTAAGGAAGAAGGGATCGGGTCTTTATGGAGAGGAAA
CACAGCTAATGTTATCCGTTATTTCCCCACTCAGGCTTTGAATTTTGCATTTAAGGACTACTTCAAGAGACTCTTCAAC
TTCAAGAAGGACCGTGATGGCTACTGGAAGTGGTTTGCCGGCAACCTTGCATCTGGTGGTGCTGCTGGTGCTTCCTCAT
TGCTCTTTGTCTACTCCTTGGACTATGCTCGTACCCGTCTTGCCAATGATGCGAAGGCCTCAAAGAAGGGAGGTGAGAG
GCAGTTCAACGGTTTAGTTGATGTCTACAGGAAGACACTCAAATCTGATGGAATTGCTGGTCTGTATCGTGGATTCAAC
ATTTCATGTGTTGGTATCATTGTTTACCGTGGTTTGTACTTCGGAATGTATGACTCTTTGAAGCCTGTTCTCTTGACTG
GAAACCTGCAGGATAGTTTCTTTGCTAGTTTTGGTCTTGGTTGGCTCATCACCAATGGTGCTGGTCTTGCTTCCTACCC
AATTGATACAGTCAGAAGAAGAATGATGATGACGTCCGGTGAGGCTGTTAAGTACAAGAGTTCGTTCGATGCATTCTCC
CAGATTGTTAAGAACGAGGGTCCCAAATCCCTCTTCAAGGGTGCTGGTGCAAACATCCTCCGTGCTGTTGCTGGTGCT

> SEQ ID NO: 6724 215676 284263_200096_1b
CGATTTTCTCTTGGAAAAAGATAGAAAAACAAAAACTCATACATTCTTCAAAGAGTGAAGCAATGACAATTGATCAGCC
ACAATACCCCTCTGTTGCTCATAAGGTATCTGGCAACTTCCTGGTTAGATCTACCCAAAATCGAGATCTTCTGGCATAC
CAAAGGCAATATAAATATGGAAATCAGACGAAACCTTTGTTGCATCAATGTGAAGGAAAATATGACATGTCCGTGATTT
CGTCCTACTCATCGCCAGTTTTTGTTCAAGCTCCTTCAGAGAAAGGTTTTTCCAGCTTTGCAGTTGATTTTCTTATGGG
TGGTGTCTCAGCAGCAGTGTCAAAGACAGCAGCTGCTCCAATTGAACGCGTCAAACTCCTGATCCAAAACCAGGACGAA
ATGATCAAGGCTGGCCGGTTATCAAAACCATACAGTGGCATAACTGAATGTTTTAGCCGAACAATGAAAGAAGAAGGGA
TTATGTCATTGTGGAGAGGCAATACAGCCAACGTTATTCGTTATTTCCCAACTCAGGCCTTGAATTTTGCATTTAAAGA
TTATTTCAAGAGGCTTTTTAACTTCAAAAAGGAAAGAGACGGTTACTGGAAATGGTTCGCTGGCAACCTTGCATCAGGA
GGTGCAGCTGGTGCATCTTCCCTTTTCTTTGTGTATTCTCTTGACTATGCCCGAACAGGCTAGCAAATGATGC

> SEQ ID NO: 6725 215676 181590_300656_1b
GAATTCAGGAAACACTGCCAATGTCATCCGTTACTTCCCTACCCAGGCCTTGAACTTTGCATTTAAGGATTACTTCAAG
AGGCTCTTCAGTTTCAAGAAGGACAGAGATGGCTACTGGAAATGGTTTGCTGGTAACTTGGCATCTGGAGGTGCTGCTG
GTGCTTCTTCACTTCTCTTTGTGTACTCTCTCACTTTTCTTCTTCTTCTTCTTCTTCTTCTCTCAAAC
CCTTGGAGGAGCGAGAGGAAGAGAAACATAGCAGACGACTATTCATATCTCTCTATAGCTGAGTGTTTTAGCTTTTGG
AAGACATGATGGGGAGAGGCCTCAACATCCAACTGTTGCCCAGAAAGTAGCTGGTCAGTTTCGTCTTAGTTCCAGCCT
TTCCCAAGGTGCTGGTTCACTAAATGGAGCTTTCAACACTCCATCTATGTACCAGAGGCGATATGCCTATGGAAACAGC
AATAGGGCATTCCAGACATGCCAAGTTAGTCAAGATCTATCTTTGATTAACCACAGTGCATCACCTGTCTTTGTGCAAG
CACCTGCTGAGAAAGGATTGGCCAGCTTTGCTGTTGATTTTCTTATGGGAGGTGTCTCAGCTGCTGTCTCTAAAACTGC

FIG. 2 continued

CGCTGCTCCAATTGAGCGTGTGAAGCTTTTGATCCAGAACCAGGATGAGATGATCAAGGCTGGCAGGCTCTCTGAACCC
TACAAGGGAATTGGAGAGTGTTTTGGCCGTACAATCAAGGAGGAAGGGTTTGGATCATTGTGGAGAGGAAACACTGCCA
ATGTCATCCGTTACTTCCCTACCCAGGCCTTGAACTTTGCATTTAAGGATTACTTCAAGAGGCTCTTCAGTTTCAAGAA
GGACAGAGATGGCTACTGGAAATGGTTTGCTGG

> SEQ ID NO: 6726 215676 254041_301631_1b
TCAACCTTTGCGACTCTCATCTTTTCCCTTCCTTCAGAGTTAAAATGGCAGAGGGGCCCCGAGTTCCGGACGTGAAGCA
CAAGCTTTCTGGCTACACCTATTTAGGCTCTCAGCTAACAGGGAACTGTGGATATTATCCCCGCACCCATGGAGCCGCT
AGCTACAGCAGCAGCAGCCTTTCTCGGGTACAGAATTGGAACATGGGTTCGTCTGTGGGCCATCCCGTCTTTGTGCCTT
CGACCAAGGAGAAGGGGTTTCAGGGGTTCATGATTGACTTCCTGATGGGGGTGTGTCGGCAGCTGTGTCAAAAACTGC
GGCGGCCCCATAGAGCGAGTAAAGCTCCTCATCCAGAACCAGGACGAGATGCTTAAATCTGGTCGGCTCTCGGAGCCG
TACAAGGGTATCGGCGAGTGCTTCTCTCGTACTATCAAGGACGAAGGCTTTGTCTCGCTGTATCGTGGTAACACTGCCA
ACGTCATCCGTTACTTTCCTACCCAGGCCCTGAACTTTGCGTTCAAAGACTACTTCAAGAGGATGTTCAACTTCAAGAA
AGACAAGGATGGGTATGGACATGGTTCGCTGGTAATTTGGCTTCCGGAGGTGCAGCGGGAGCTTCGTCGCTCTTGTTT
GTTTACTCCCTTGACTACGCCCGAACGCG

> SEQ ID NO: 6727 215682 200211_300757_1b
AACTCTTCTACAACTCTAATACTTGATAACACATCCACATCCATCATCATGCCTCCCCAGCAACATCCCTTCTGGGACT
TCGTGCAGTCCCTCAACAACCCCGACCCAAACAACCGCCGCGACCCTGGCCATGGTGTCGATCACAACACTTCACCTCC
CGGTCCCTTCCCCGGCTTCCCCGGTTTCCCCTTCGGAGCTCCTCCTTCCACACGGCGGACACCCTCCACACCAGCCTCAC
CTGCCTCACCAGCCGCATCCACCTTCCGCCTCCACCTCCCGGAGCCGGGCCCGGCCCCTGGTGGGATCAAGCTCCCCGG
CTTGGGCTTACTGGTTCAACAACAACTTCAACGGCCCGCCTCGCTACGACGAACATCCCTTCTCGCAAAATGCCGGCGT
GAATGCTCCCCGAGAGGGTGAAGCCTCTCGCGAAAAGAACAATGAAGCGTCTTCTTCCCCGAAACCATGCAAGAGGGC
GAGCCATTCCCCGACCCAGCGGAAGTCACGCCCTCGGAAAGCGACGACGAAGAAGATAACAACCACCGTCGTGACGGCG
TTCCTCCTCCCCCTTCGTATCCCGCCGAGGGCGGACGACGTGGACGAGGTCGCGGAGGCCACGCTCACGCCCACGGCCG
CGGT

> SEQ ID NO: 6728 215705 199590_300750_1b
TCATCCTTTAATTCTGTTATCGCATATCCTCAACGACAGAAAATGCTGTTACGGGCCTATTTGAACGAAAACCACCGAG
ATTTTTGACGGCCCTCAGACAAAAAGATGCCTGGACGAACAAAGGCGCAGGCGGATGCCTCATCTCAGGACGCTGATAT
GCAGGACGTCCCGCCGTCTGGACAAGATGAGATCAACCAGGATGCGGAAATGAGAGAGAACGCCGAGGCCGAGGCCGAG
GAGGAAGAGGAAGAGGAAGAGGTCGAGCCTCAGAGAGTGCGAATTGTATGACCAGAGAGTTCTAGTATGGCTGAGAGAA
GCTTGATTTACTAACGGAGGCGACAGCTCCCTGGTTCAACGGACACAGCGGCTTCGTTTGAGTTTACCGATGAAGGCCA
TACTTTGGGCAATGCCCTGAGATATGTTATCATGAAGAACCCTGATGTTGAATTTTGCGCCTACTCAATTCCTCACCCA
TCTGAGCCCAAGATGAACATCAGAATACAAACTTATGGTAATATTTTATCTCCTCTATCATGTGTGAGTTTCCACTGAC
GTTCTTGTCTACAGACGGCACAGCCGTAAATGCCTTGA

> SEQ ID NO: 6729 215737 230528_301069_1b
CCCACGCGTCGCGACGACAGCAGCTGGTCCAAATGCCGCATGAGCCACCGGCAGCAGCTTCTCCACTGGGTGGACATGG
GTCGCAATTTCTTCCACCGGCTTGTTCTGCCCAACGACGACGCCCGGGGATCGAGACCTGGACCTCGCCATCTTGCCAG
CACTCAGAGATCTTTGATCAGCTCTACTGTTGCCCCTCTGCCGCCGCCATTGGAGCTGGATCATCATCACGTAAGTCTG
ATCTTCCACTGGAATCATTTCCGCAAGCAGAAGCATCTCCTGTGACAAAAGAAGATCTTGGACGAGCTACGTGGACTCT
TCTTCATACGCTCGCTGCTCAGTATCCTGACAAGCCTACACGACAGCAGCAAAGAGATGTCCGAGACTTGATGGGAATT
GTTTCCCGGATGTATCCTTGCAAAGAATGTGCAGACCATTTCAAGGAGGTGCTCAAATCGAATCCTGTTTCCGCTAACT
CGGGCGTGGAGCTATCGCAGTGGATGTGTCGAGTGCACAACATCGTCAACAGAAGCCTTGGAAAGGCAAAGTTTTCTTG
CGAACGAGTGGATGCGAGATGGGGTGCACTCC

> SEQ ID NO: 6730 215781 199752_300752_1b
GTTGCCGCCGTCAAGGGAGCCCTGCGGTCTGGCCGTCAGGTCCTGGCCATTGTCCGCAACCAGGCCTCTGCTGATAAGC
TCTACAAGCACGTCGGGTCATCCCAGGGCATCCAGGTTGTCGAGGCCAGTGTCGTGTCTGACACGGGGGTCAAGGGCGT
CGTCGACCAGGTTAAGGCCGGGAAGCTGCCAGCCTTCCAGCACGTTTACACCTGCGTTGGTGGCGAGTATACCGACGTT
CCACTTAAGGACATCACCACCGAGAGGCTCCGCAAGAACATTAACATGGCCTTTGAGTCCAACTTCTTCGCTTACCGTG
ACACCATCGAGTATCTTTATAAGCAGAACCACCCTAACAGCACATGGACTATCTGTACTGGCTCCCAGGGTGATGAGGC
TATGTTTGCCCTACCTGCCATGGGCCAAGGCCCTCTCTTCTCCATGGCCACTGCCGCCGCCCGTGAGAACGAGAAGACC
AACGTCCGCGTAAACGAGGTGTATCTGATGTTCCGCGTTGAGGTTGACGAGGCTGCCAAGGAGCATGGCGTCTCAAGCA
GCTCCGAATTCGCCTCCGTCTACGAAGGATTTCTGAACAACCCTGAGATCCGCAGCTCGCGCGTTCGTGTTGCCTCGCC
TGCTGACTTCACCGACCTGAAGTGGGCTAAGAAGTTCTAAAAAGACTGATGCGTCTTTTTTAAACCTTCGTGTTTCTCT
CCATTAAGCATTTTGAGAAATCATCTCCCTGTTGCTGGCTGATTACACATGGTTCAGTAGTTGACAATACTG

FIG. 2 continued

> SEQ ID NO: 6731 215807 199653_300751_1b
CAAAAAGGCTCCAGGCATCGTCTTTGACAAGGAGGACTACACTGCTCGCTACAACTGGTCAATTCCGCTACGTTCATAC
GCGGAAGAAAAAGAACATGTCGCTAACAGCAATCGCAACAACAATGCAGACGGCTCTGCAACGAGCAGAAACGATGGAT
CCCGCCTCTCTAAGCCTTCTCCAGAAAGGCTCTTCCCACAATTCCTCTCCCAACTATGGAGCCTCCGGAACGGTGACAA
GAGGGATATTGCAAGACTATCAGGCGGTACCGACCAGCGATGAAAGCGATGCCACCCGTCCGAGAAAGGTTTCATACAG
CGATGCGGCGAAGAAGGCCGGGAACCATGCGAAGAGCCAGAGCTCTCTGCGGCAACGAAACGGAGTCTCCGGCTCGGAG
GATACAAGATCGCCAACAAAAGCAAAGTCATCATGGACGAAGGAAACATTTCGAAAATTTCAGTCCCTTCAGTTGGAAA
ACAAGGGAAGCGTGGCTAGAGATCACCTGGCTCTCGAACGCACATTTCTAGCATGGCTTCGAACCTCTCTCGCTTTTGC
ATCGATTGGCGTCGCCGTGACGCAGCTATTCCGCCTCAACACTGATAACGCTTCCGCCTCCGATTTCGACCACACAAGG
CTACAAAGAT

> SEQ ID NO: 6732 215830 200255_300757_1b
CCCAGCAGCGTCACTATCTCCTGACCATGCGGCCACTTTTGTTTTATTACCCGAGAGAGCAAAAGTCGTCCCATCCCAT

> SEQ ID NO: 6733 215853 204434_300817_1b
TGTAACATGATGATATCGGCGCAGGGGCGTATGGACGACATGATTCTAATCTGGAGAGAAGCCGCATTGTACTGTATTA
ACTAAACATTGGATGAGGATATTATCTGGCGTTTTGGATTGGCAAACGGGAATACAAATGGCGAGTCATGAATGATCGA
AAAAAAAAAACCA

> SEQ ID NO: 6734 215855 204203_300791_1b
ATCGGTTGTCATGTCCATCATATGTAGATTCACGCAACCATGACGTAGGATGAAGTCACATATTATGTGGAGAATGGTG
CAAGCCTTTCTTAGAGAGCGATGTATATAAGTGCAACTGAACAACAACTAATTGGATCGATGTTAACTGTGCAATAATC
GTCGTACGCGCAGCAAAGAGTCGCGACTAGCAGCATCGCAACTGATATCCGAATACCGCGAAAAAGAATAGTTACCAAT
CATGTCAGGATACTCTAAAGTCGGCACATCTGGTGTCTATGAGGCAGGTGATCAGAGAAATGTTGCGAGATCAGAGATG
CCGCAACCAGAGAAATACAACGAGGGTCAACATGCATCACACATTGGACTCGATTCAAGTAAATGCATTCCCTCAATCA
CATTATGCTGTTGTTTGTACTAACTCAAGCTCAGAGGATCAACGCTCCATAAAGAATAGGCTGGCCGCAGAAGAGGTAG
GTTGTTTGATCTCGCCAGTGGAATAGTATCTGACTTGTTTAAAGCGAAGAGAAGAGGCCGGAGATGACCTTGAGACGTC
GTTATCGAAGAAGGATCCGACATTACCAGTCAGTACTCGATTCCCACACCATGAACCCATTAGCTAACAACGCAAAGGC
CAAGATGCATGGCAATGAGCCATCCAAGGGGGCCAAAGTAGACGCTGAACTACCAGCAGATGATGAAGAGTATCTCAAA
AGGA

> SEQ ID NO: 6735 215855 206668_300824_1b
GCGGACGCGTGGGGTCACGACTAGCAGCATTTCAACTGATATCCGAATACCGCGAAAAAGAATAGTTACCAATCATGTC
AGGATACTCTAAAGTCGGCACATCTGGTGTCTATGAGGCAGGTGATCAGAGAAATGTTGCGAGATCAGAGATGCCGCAA
CCAGAGAAATACAACGAGGGTCAACATGCATCACACATTGGACTCGATTCAAAGGATCAACGCTCCATAAAGAATAGGC
TGGCCGCAGAAGAGCGAAGAGAAGAGGCCGGAGATGACCTTGAGACGTCGTTATCGAAGAAGGATCCGACATTACCAGC
CAAGATGCATGGCAATGAGCCATCCAAGGGGGCCAAAGTAGACGCTGAACTAGCAGCAGATGATGAAGAGTATCTCAGA
AGGAAGGGCAAGGCTTAATTGGATTCGGTTGGGCCGATATCATGTGTATTCTTAAATCAGGATTAGAAGTGAGGCATGG
AAAAGCTGCGGTCTCCCTAAGCACATGAGGAGTTAATAACGGGGAGCAAGGTGAACAGAGACGTTTGACCATGGACATG
TCTCACTATGCCTGGCCAAAGATAAAAGAAAGAAAAGAAAAACAAAGCGTATTGCATGC

> SEQ ID NO: 6736 215859 195596_300635_1b
CAGCTGTGACATGAATTGTTCCGTCGTGAAGCCCCTCTCCTTGAACAGCCCCTGCTCTCGATACTGGCAGAAGACGGGA
TCATCCTTGTCCAGCACACTCGAGGTGCCAACGCTCACGGCTTCCTCGCCAGCGCTTACCATGTAAAAGCTTAGTCGGC
CCTGTCTCTGAGCATCAGACATGATGAGATCCATGATGGAGATGTACAGCATATCCTTGTACAGCTTGATGACGGCCTC
ATCGCTGATGTCAGGGGTGAAGGAGGGTCAACCACTTGGCCATTCTGGTCCACGACTCTGTACGTCGGCAGGGCTGTG
TATGATTCGGGCGTCTCAAACTTGAGAGAGCTGGTGAAGGAGCTCTTGAGAGCGCCGGGGAACGACACAAATCCCGAAT
TGGGCCGTTGCGAGAGGCTTCCCGCGCTCCGGATGGGATTGGAGATGACGGAGACGGACGGCTGAGCCAGTCTCCGGAT
GGAGGCCCTGCGAAGGACGCGCGAGTTGGCCTTGAGCGGACCCACGCGTCCGCCCACGCGTCCGCCCACGCGTCCGCGG
ACGCGTGGGACAAACTCCATCTGCACAGGACCGCCATCAGGGACTCTGCACCCCCGATCAGATAAAGCCTCTACCTAGC
GCTCAGGACTTGCAGACGGTCGCCTTGCATCGTCTCCAACGTCCGCCTAGGATCTTTTGATTCTTTCTTTGCCTCCTCG
ATCCGAGATCGATCTTCCACCACCCTTTTAGATACCACATACCCTCATCACAATGGCCCTGAAGCGCATCAACAAGGAG
CTCAAGGACCTCGGCACTGACCCGCCATCATCCTGCTCCGCTGGTCCTGTTGGAGAAGATCTGTTTCACTGGCAAGCTA
CAATCATGGGACCCGGTCGATTCACCATACTCAGGAGGCGTCTTCTTCCTGAAGATCCAGTTCCCTACGGATTACCCCTT
CAAGCCCCCGAAAGTCAACTTCTCCACCAGAATCTACCACCCCAACATCAACAGCAACGGCAGCATCTGCCTCGATATT
CTTCGAGACCAGTGGAGCCCTGCTCTGACCATTTCCAAAGTTCTCCTTTCCATCTGCTCTATGCTGACAGACCCGAACC
CCGATGATCCCCTTGTGCCTGAGATTGCGCACGTGTACAAGACCGACCGGCCCCGGTACGAGGCGACTGCTAGGGAATG

FIG. 2 continued

```
GACCCGCAAGTACGCCGTCTAGGCAATACCAAACGGTTTCTTTTAAGGGGTTTTGATGGCGCTGGGTGTTTGACGTCCT
CTATCACGCAATGACGGTGCGGCATGTTTGGCGAGCCTCTACGTTATAAGCGGGTGCGGGGATGATATTCGAAGGCGGA
CAGTGCAAGTTTTTTCTTTCTTCTCCTTGCTGTTCTCATCATCTCTTCGGGTGCACCGCATTTATGATGCTGGGGGTGA
GACGACGCATGGCCGGCGGACAGGTGGCAGACTAGACAGAAATATCCGCTATTCAAGGGCTTATGCGGCTGGACTTGAC
TTTGGGTTTGCATCAACAACGTGTACTCTGCATCCAACAACAGGCATCTGATTTAACGCGTCTATACG

> SEQ ID NO: 6737 215859 210355_300888_1b
TCGACCCACGCGTCGGCTCAAGGCAACTCGCGCGTCTTCGCAGTGCCTCCATCCGGAGACTGGCTCAGACGTACCGTCT
CCGTCATACTCCAATCCCATACCGGAGCGCGGGAAGCCTCTCGCAACGGCCCAA

> SEQ ID NO: 6738 215926 199646_300751_1b
TCGACCACGCGTCGGCAAAACATCCTCCGTGCAATGCACTGGCTGGTCAAGGATGCCAGACCCAATGACTCTCTCTTCT
TCCACTATTCCGGCCACGGTGGGCAAACAAAGGATCTTGACGGCGATGAGCCTGATGGATATGACGAAGTCATTTACCC
TGTTGATTTCAGGCAACATGGACATATCACAGATGACGAGATGCACCGCATCATGGTCACCCCCCTCCAGGCAGGTGTA
AGGCTGACAGCCATCTTCGATTCGTGCCATTCTGGCACAGCACTCGACCTGCCATACATCTATTCTACACAAGGTATCC
TCAAGGAGCCCAACTTGGCCAAGGAGGCCGGCCAGGGCTTGCTCGGCGTCATTTCCTCGTACAGCCAGGGAGATCTCGG
CGGTGTTGCCAACAACATCATCGGTTTCTTCAAGAAGGCCACCACTTGGCGAAAAAGCCCACAACCGGGCCCTCGCAAC
CAAGACTTCTCCTGCCGACGTCGTCATGTGGTCCGGAAGCAAAGACGACCAAACCTCTGCCGATGCTACCATTGCTTCA
CAAGCTACTGGTGCCATGTCCTGGGCGTTTGTCACGGCGCCCAGGAAGAACCCCAGCAGAGCTACGTCCAGCTGCTCAA

> SEQ ID NO: 6739 215931 219778_300948_1b
GCCCACGCGTCGATCAATTGGGAGCTTCATACCACCACTGAGCTCGTTCCGGCTTGCTCGGGCTTCTTCTTCTCGCCA

> SEQ ID NO: 6740 215966 194231_300745_1b
CCCGGCCGGTCTCCTCCGAACCCTAGCCTGCTTCTCCTCCTCCTCCCCGCCGCCGCCGCCGCGAGCACAGACGACGCAG
CCATGTCCGGGAGGAAGAAGACGCGAGAGCCCAAGGAGGAGAACGTGACGCTCGGCCCCACGGTCCGCGAGGGCGAGTA
CGTCTTCGGCGTCGCGCACATCTTCGCGTCGTTCAACGACACCTTCATCCACGTGACGGATCTGTCCGGCAGGGAGACG
CTCGTCCGCATCACCGGTGGCATGAAGGTGAAAGCTGACCGTGATGATCATCCCCTTATGCTGCCATGCTTGCATCCC
AGGATGTTGCACAGAGATGCAAGGAGCTTGGAATTACTGCTCTGCACATTAAGCTCCGTGCTACTGGTGGAAACAAGAC
AAAAACTCCTGGTCCTGGTGCTCAATCTGCGCTTAGAGCTCTTGCACGTTCTGGCATGAAGATTGGACGCATTGAGGAT
GTTACTCCAGTCCCAACTGACAGTACCCGCAGAAAGGGTGGCAGAAGAGGAAGGAGGCTGTAATTCCGTGTAGTGCCTG
TTATGGGGGGAAAGCAAAGCTATCTATCCTTGTCCTTGCAACTTGTTCTGTACTCTATTATGATCTTAGCATCGGATGT
GGATTTATAAATTTTGAGCTATGTTATGTTCTTTAGAAGATGAATGACCTCCCCCTATAAAGCCGATTATCT

> SEQ ID NO: 6741 215966 191179_300739_1b
CCCCCCCTCTTCTCTCGTGTCTCCGGCGGCGGCGAGCTCGTGATCTCAACGACCAGGAGGAAACCGGCGCTCGCCTCGA
TCTCCGCCGCCTCGTCCCACCATGTCGAAGAGGAAGACCAGGGAGCCCAAGGAGGAGAACGTCACTCTTGGACCCACTG
TCCGTGAAGGAGAGTATGTGTTCGGAGTTGCCCACATCTTCGCATCCTTCAATGACACTTTCATTCATGTCACTGACTT
GTCTGGAAGGGAAACTCTTGTTCGCATTACTGGTGGCATGAAGGTCAAAGCTGACCGTGATGATTCATCACCATATGCA
GCTATGCTTGCTTCTCAAGATGTTGCACAGCGTTGCAAGGAGCTTGGTATTACTGCTCTGGACATCAAGCTTCGTGCCA
CTGGAGGCAACAAGACAAAGACACCTGGTCCTGGTGCTCAATCTGCTCTTAGGGCTCTTGCTCGCTCTGGCATGAAGAT
TGGTCGCATTGAGGATGTGACCCCGGTTCCCACGGACAGCACCCGCAAAAAGGGAGGTAGGAGAGGAAGGAGGCTGTAA
ATGTATTGTCAGCCAACTTGTCGCCATGGAGCATCTCTTCT

> SEQ ID NO: 6742 215966 226405_301034_1b
AAGATGGCCCCCAAGTCAGACAACGTTACCCTCGGCCCCCAGGCCCGAGAGGGAGAGCTCGTTTTCGGCGTTGCCCGAA
TCTTTGCATCCTTCAACGATACTTTCGTCCACATCACCGATCTGACCGGCCGAGAGACCATCTCTCGAGTCACCGGCGG
TATGAAGGTCAAGGCTGACCGAGACGAGAACACCCCCTACGCCGCCATGCTGGCTGCCCAGGATGCCGTCGAGAAGGCT
AAGGAGGTTGGTATCAACGCTCTGCACATCCGAATCCGAGCCACCGGAGGTACTTCCACCAAGACCCCCGGCCCCGGCT
GCCAGTCTGCCGTCCGAGCTCTTGCCCGAGCCGGTATGCGAATTGGTCGAATCGAGGACGTGACCCCCGTTCCCTCCGA
CTCTACCCGACGAAAGGGTGGTCGACGAGGTCGACGACTGTAAGCGGTTTCTTTGGGGACTTGCTGGCAGTATTTATGC
CGTGTTTTCATGGTGTATGTAAAAATATAAAAGCGTAAGCGTATTTAACGA

> SEQ ID NO: 6743 215966 225055_300983_1b
GCGGAAGTCGGGGCGGCAGCGAGAATGTCGGGCAAGAAGAGGACCAAGGAGGTGAAAGAGGAGACGGTGACGTTGGGGC
CGTCTGTGCGGGAGGGCGAGATAGTCTTCGGCGTCGCGCACATCTTCGCTTCCTTCAACGATACCTTTGTGCACGTCAC
AGATCTATCGGGGAAGGAAACTCTGGCCCGAGTCACAGGTGGTATGAAGGTGAAAGCTGACAGGGACGAAGCCTCTCCT
TACGCTGCCATGCTCGCGGCCCAGGACGTCGCCGCTAAATGCAAGGACTTGGGGATCAACGCGCTCCACATCAAACTAC
```

FIG. 2 continued

GAGCAACCGGCGGCAACAAGACAAAGCAGCCAGGACCCGGGGCACAGTCTGCTCTCCGTGCTCTTGCTCGTTCCGGCAT
GAAGATTGGCCGAATCGAGGATGTGACGCCGATTCCGACTGACAGCACCAGGAGGAAGGGTGGTCGTAGGGGTCGCCGT
TTGTAGAAGGCGAAGCGTTTACTGTGATGTTTTTTTTCCTTATCTAAAAACTTCTCGAGCT

> SEQ ID NO: 6744 215966 208847_300809_1b
CAACAGCCCCGTGACGAATAACCAGACGTCGACAAATTCCTCAAAATGCCTCCCAAGAAGGTCGCCGCTCCTAAGGAGA
ACATCTCCCTGGGCCCCTCTGCCCGCGATGGCGAGCTCGTCTTCGGCGTTGCTCGTATCTTCGCCTCCTTCAACGACAC
CTTCGTCCACGTCACCGATCTGTCCGGCCGTGAAACCATCACCCGTGTCACCGGTGGAATGAAGGTCAAGGCTGACCGT
GACGAGTCCTCCCCCTACGCTGCCATGTTGGCTGCCCAGGACGTCGCCGCCCGCTGCAAGGAGCTCGGCATCAACGCTC
TGCACATCAAGATCCGTGCCACCGGTGGTAACGGCACCAAGACTCCTGGCCCCGGTGCCCAGTCTGCTCTCCGTGCCCT
GGCCCGTGCTGGCATGAAGATTGGCCGCATTGAGGACGTTACTCCTACCCCCTCCGACTCTACCCGCAGAAAGGGTGGT
CGCCGTGGTCGTCGTCTGTAATTGCTGTATTTTTTTTATACAAACAAAAAAAGTACGGCATCTGCATGCTTGGCGAAC
CTTTGGTTTGGGATCAAGGCAGGAGTTTCGCTATCTGGTTCTTTTATGTGGCGTTGAGAAAAAACGAGGAGAACGGCCC
TTAAAGCCTGGTCTCCAATTCTACCACGCTCTGCTCAGGTTCCTTTGTCCTTTTTACTACAAAGAAGGATATATGGCTT
GATGTTGATGCAGTAGACAGTTAC

> SEQ ID NO: 6745 215966 1100785_301463_1b
GACTTGAAAGGAGAGAGAGAGAGAGAGAGAGGAGAGAGAGACACAGAGAGAGAGAGCTTGTTGCAGAGAAGAAGGTGTA
CTGCAGAAAATGTCGGGCAGGAAGAAGGTAAGAGAGGTGAAGGAGGAGAATGTAACCCTTGGCCCTGCTGTCCGGGAAG
GCGAGCATGTCTTTGGGGTTGCTCACATCTTTGCGTCCTTCAATGATACATTTGTGCATGTCACAGATCTCTCTGGAAA
GGAAACCCTGACCCGAGTCACAGGTGGCATGAAAGTAAAGGCTGACAGAGATGAGTCGTCGCCATATGCGGCCATGCTT
GC

> SEQ ID NO: 6746 215966 127560_300470_1b
ATTCGCTAGCTGTTTCGGTATCTCTTGAGCTTCTCACTACCAATCCCAGCCGAAGCCATGTCGAGGAGAAAGACTAGGG
AGCCAAAGGAAGAGACTGTAACACTTGGACCAGCTACAAGGGAGGGTGAATTGGTGTTCGGTGTTGCTCACATTTTTGC
CTCTTTCAACGATACTTTTATTCATGTGACTGATTTGTCTGGAAGAGAAACTATGGTTCGCATTACTGGTGGAATGAAG
GTGAAGGCTGATAGAGATGAATCTTCTCCATATGCTGCCATGCTTGCAGCTCAGGATGTGTCACAGCGATGCAAGGAAC
TTGGAATTAATGCTCTTCACATTAAGCTTCGGGCTACAGGAGGCAACAAGACTAAGACTCCTGGTCCTGGTGCCCAGTC
TGCTCTTAGGGCTTTGGCTCGATCTGGCATGAAAATTGGACGTATAGAGGATGTGACTCCAATTCCCACAGATAGCACT
CGCAGAAAGGGTGGTAGAAGGGGAAGGAGGCTGTGAAGATGGTTCGTTTCTGCAGCATAATGCACCTTGGAGGATTTTG
TTGTTGAGGATGCTCCTTTCAATTTCTTTTTACAATTGATATCTAAATACTTTGTAGCTGAGACTTTTGGTTTCAAACC
ACTTTCATTTTGATCTGGCCAGCTTTGCGACATAATGAAGTTTTCTTGAATTTGGCTTCGTTGATGTTAGTAGGTTGAA
TGGTCAAACATATCCTTTCTTAATGTGTTGGTTAAAGCTTAATTTCATCAAATTTAAAGTTAAGTC

> SEQ ID NO: 6747 215966 56386_300123_1b
GGCCGCTCGCGATCTAGAACTAGTCTGCATCTTTCAATGACACTTTCATTCATGTGACTGATCTCTCCGGTAGAGAAAC
TCTCGTCCGCATCACCGGTGGCATGAAGGTGAAGGCTGACCGTGATGAGTCCTCTCCTTATGCTGCTATGCTTGCAGCT
CAAGATGTTGCTCAAAGATGCAAGGAGCTTGGCATCACTGCCATGCACGTGAAGCTCCGTGCTACTGGAGGAAACAAAA
CCAAGACTCCAGGTCCTGGTGCTCAGTCTGCTCTTAGAGCCCTTGCTCGTTCTGGCATGAAGATTGGTCGTATTGAGGA
TGTGACTCCGATTCCCACAGACAGTACACGCCGAAAGGGTGGACGAAG

> SEQ ID NO: 6748 215973 206792_300825_1b
CCCATCCCATCCCATCTTCCAAACCACATCATCAATCTCTAAGCGTTGCCCATTATGAAGAGCGCTTTGATCGCCGCCG
CGGCGCTTGTTGGCTCCGCCCAAGCTGGCGTCCACAAGATGAAGCTGCAGAAGGTCTCCCTCGAGCAGCAGCTGGAGGG
TTCAACCATCGAGTCCCAGGTCCAGCAGCTCGGCCAGAAGTACATGGGCATCCGCCCTACTAGCCGTGCCGATGTCATG
TTCAATGACAAGGTGCCCAAGGTCCAGGGCGGTCACCCAGTGCCCGTCACCAACTTCATGAACGCCCAATACTTCTCCG
AGATTACCATCGGTACTCCCCCTCAGACCTTCAAGGTTGTCCTTGACACTGGAAGCTCCAACCTTTGGGTTCCCTCCCA
GTCGTGCAACAGCATTGCCTGCTTCCTGCATTCCACGTACGATTCGTCCTCCTCGAAGACGTACAAGCAGAATGGATCC
GACTTCGAGATCCACTACGGATCAGGCAGCTTGACTGGCTTCATCTCCAATGATGTCGTCACCATTGGTGACCTCAAGA
TCGAGAAGCAGGACTTTGCCGAGGCTACCAGCGAGCCCGGCCTTGCCTTTGCTTTCGGTCGCTTCGACG

> SEQ ID NO: 6749 215986 205765_300801_1b
AGCTGGATAAATTTCTCCTGTCATCCTCATTTCGCTGCCCTGCGCCACGACACCGGCTGCTGCAGTCCCTTTTCTAGGC
GATACCCAGCATCTGCACTCTGCCCTTTTTATATTCTCTCCTTTGAAACTCGCATTCTCGTCGCGATAGCTATTCCAG
CGGTTGCCCTAACTTTCTATTTGCATCACATAACCTGACAAAATGGGTGAATCCAGACAAGAGCTCCTCAATTGGCTGA
ACAGCCTCCTTCAGCTTAACATGACCAAGGTCGAGCAGTGCGGAACTGGCGCTGCGCTCTGCCAGGTCTTTGACAGCAT
ATACATGGACGTGCCTATGTCCAAGGTCAAGTTCAACGTCAGCGGCGATTACGCCTACATCCAAAACTTCAAAGTTTTG

FIG. 2 continued

CAGAACACGTTCCTCAAGCACCAGGTCGATAAGCCCATCCCCGTCGAATCGTTGGTGAAATGTAAGATGCAAGACAACC
TAGAGTTCTTGCAATGGACGAAGAAGTTCTGGGACCTCAACTTCCCCGACCACGATTACGACGCTGTTGCACGAAGAAA
GGCTGGCGGTTGCGCCCGCAGCCAGT

> SEQ ID NO: 6750 215995 205803_300802_1b
ATCCTGTAGCTGCCCTCACGCACATCCCCCGGCACGGTGTGGCCCGCGCCGTCCACGGCCACAAACGCCAGCCGGCCGG
AGCTCTTCCACGACCCCGTCGCCGCCATGCTCTCCGGCAGCTCCCGCCACGGCGCGAGGCGATAGTCGGCCAGCCCGCT
CCAGCGCAGGTTCTCGTACGCCCAGATGTTGCCCGGCGTGTTGACGATGTAGTCCTCGTTGCCCTGCAGGACCAGCACG
CGGATGTCGCCCAGGTTGGGGGTTCGGTAGGCGTCGAGGATGCGGGCGACCTCGCGGGTGGTGGTCCGGAAGGGATCTT
TGGAGTGGACGAAGGCGGAGTTGAGGACCATGTCGATGTCTTCGAATATATAATATGGGGAAGCTTCAGGGCTTTCTT
GATGTGGGCTTGGTTGATGTAGGCTGACATGTTGCCTTTCCTGATGTCTGCGCAGAAGGGCCAGTTGGGACATGGAATA
TGGACTGTTTTGCAAATATTAGACAACTACGTTCAGACATTCAGGAGAAGCTTGAAAGTTTCTTCAGAAAAAACAAAAA
AAAAAC

> SEQ ID NO: 6751 216006 219444_300945_1b
ACCCACGCGTCCGAACCACTCTCAAGCAACAATAACAACCTTTACCCAACTTCAAAGACTTTCAGTCTCTCAACTCAAC
ACCTTCAAGATGTCTCCCTGGTGAGTCTTCTGAGGACCATTGGTCCATCACTTGCTCGGGAGTTCCTCTTTGCTTTACC
TTCAGCCGTTCCACTACCTGATCTATGATACCTTCTTTCCCACCACCGAGCAAAGCACTCATTAGACATGTCACTAACGA
TTTTCTTTCAATAGCGCATGCAACTCCTGTGGATGCAAGGACAACTGCTCCAGCTGCTCCTGCACCAGCTGCAGCCACT
AAATCATCGTGCTCTTTTTCCTTCGCTGGATCTATACTCTCTCGGAATGACAGCTTGAGGGCTCGGATGTGCTTAAGAC
GCCATGGGAAGGGCAAGGCATTTGGGCGAATAGACCTCCATCATGTGGGATATAGCAGAATAGGAATTTGAAGATTTTG
CCCTAACAC

> SEQ ID NO: 6752 216009 242754_301332_1b
GGAAAGAAACCCTCAATTTTGTCGTAGGAGTAGTGTGTTAGTGCGTGCAGTGATGGGTGCCGAGAGAGGCGAAGGCGGC
GGTGCGCATGGCGGCATGGTTCGGCTGCAGTGCAAGGTGCAGCACTACGACTGGGGCCGAATTGGCGGCGACAGCGAGG
TGGGTCGCCTGCACGCGCTCATGAGCGGCAGCCCCGTGGATGCCGACGCGCCCTACGCCGAGCTCTGGATGGGGACGCA
TTCGTCGGGTCCATCCGCGGTGCTGCTGCCCGAGGATGGCGGAGGAGATCAAATGCTGCTCAGGGAGTGGCTCCAGCGC
CACCCCGAGGCACTCGGCGATCAAGTACTCAGGCGCTGGAATGGAGATCTGCCTTTTCTCTTCAAGGTGTTGTCGGTGG
CAAAGGCCCTGTCGATCCAAGCGCACCCGGACAAGAAGCTGGCCGAGTATTTGCATGGGAAGTACCCCCAAGTGTACAA
GGACGATAACCACAAGCGGAATTGGCGTTGGCGCTCACTCGCTTCGGGGCATTGTGTGGATTCGTGACTTTCAAGGAG
CTCCAGGCGACGCTGGAATCCGTTCCGGAGCTGCGTGACGCTCTAGGACCGGTAGTGGTGGAGAGTGTCCTTGCCAGTA
GCTCTAGCCAAGAAGGCGGAAACA

> SEQ ID NO: 6753 216016 213790_300860_1b
AGATTCAGAATTGGGGTAGCTGCTCCGTAGAGAGTCACTGGCACGATGAATTAAACCGCCACTTGTTCGGCTTGGCAGC
GGTAATCGCTGGAGGAGACACGGAAGACATGGAACTGCAGTGAGCAACGACACAGCCATGCAGTGAGACCCACGGCCAC
GCGCGTCCTCGGGAGCATACCTGGCAACCGACCGGATAGCGGCATCTCAGGACACGAGGATCGTCTGCATTGTGTACAG
GTCGAATGCGGGTTGAAGCCAGCAGGCGCAAAACCCCATCATCTCTGTATAAGCTGTACGATAGGGTATTGCAGCCCGA
AAATCTCGTAGATTTGTATCGAACGGCATCCGTGTAGCTCGAGGCGTGGACGCCGGAGATTTCTGCAAGTCCGGGTAGC
ATCTCTCGGAAATCTTTTAGGTAGTCTTGGCTTTCATTTCGTTTTGGCAGCAAAGCCTCATATTGCCATGGATCGAATC
GTACGAGGGCG

> SEQ ID NO: 6754 216018 1119715_301900_1b
AACTTCCGGCAAGATGAAGATCGAATTGTGTGTATTTAGTGGGTCTAAAATATATCCAGGCCATGGGATGAGAATCGTC
AAAGCCGATGGCAAGACGTACCAGTTCCTTAATGGCAAATGTGCGAAGGCCCACATGGCCAAGCGTAACCCACGTAAGG
TGAACTGGACCGTGCTGTACCGTCGCAAGCACAAGAAGGGTTTGACAGAGGAGGTCACCAAGAAGAGGACACGTCGCAC
GACAAAGTACCAGCGTGCCATTCAGGGTGCTACCATCAATGACATCCTCGCCAAGCGTAACCAGAAACCCGAGGTCAGG
CAGGCTCAGCGTGAACAGGCTATCAGGGCGGCCAAGGAGAAGCAAAAGGCTAAGGATGCTACAAAGAAAGCCACCAAGC
CGGCCCAGGCGAAAACTCAGCCGAAGCAGAAAATTCAGAAGGCAGCGCCCAAGAGTCAGCCGCGTGTTGCCGTCAGGCG
ATAAACGAACTGAAAGTAAAAACGACACCTCAGTTGGACATTCACTGTTGGACATTCAGTTATCGAGGGATATAAGTGC
TCATTACACATATAACAGCAGATAGCTAAA

> SEQ ID NO: 6755 216047 212017_300873_1b
TTTGGACTGTAGGCTGTAGAGGAGTATGGAGCCGTTGTGTGCCTCTGTCTGACATTGGAGGATTCTGGATCCATTGTGT
GCCTCTATCTGGCATTGGAGGAGTCTGGAGTTGCTGTGTGCCCCTGTCTGGCAGTGGAGGAGTGCGGTGTTGCTGTGTG
CTCTTGTCTCGTCGGCGAAGCATCAGTGTAGCCTGAGCAGGTGCCGTAAAGACCGGTGCTACGGGCAACTGTGGGAGCT
TGGGAGGAAGGACAAACGGTTTTGCCGCCTCTGGATGCTTTTCCAAGAACGCTTGTTCATATTGACCAACCCCGAAGAA

FIG. 2 continued

CTCGTCCAAGTCGCTCAGAGTAGGAGAGGGTTGTTTTCGTTGCTGAGACTGAGAGCCATTAGTTGGTGAAGCAGCATTA
TACATTTCATTCATAGAGCGAGAAGGTCTTGGTTCCGCGCGCTGGGCTGCGTAGCTTGTTTGTTTGCTTAGCCCAGGCT
TGGATGGAGTGATAACGGCTGAAATTGAACTGCTTGAGTCGGAGCTACCCGATAGATTTCGCGGGATTCT

> SEQ ID NO: 6756 216062 207919_300830_1b
GCCAGTACGAACGAACATTCAGCCTTGTGCAGGGGAAGCAGAAGATCATATAGAGCATTTATCAAGCGAATAACAGACC
CTGAGACACTGAATCAGAGAAGCTTTAGAAGCTCTTCTTCTCTCTGTCTCCGCGCCTCTTATCGCAAACAGCCCCTCTA
CTGCTGCTGCTGCCTTTGTCAGGCCTGTCTTTTCAGTGTCGCATGCCCCGCCTCATCTTTCTACCTTGCACAACTCAGC
CTTTGCGCTAATCAACGACATCTGCGATCTGTGTCGGCAGCAGAAGAGTCCCAGATCACTGGTCTCTCTTTTATTCTCC
TTCTTCTAAACAGATCTGTGTTGCCCCCAAAGCAAGCGAGAATACGTCAAGATGGCTCTTCCGAAACGCATCATCAAAG
AAACCGAACGCCTTATGGCGGAACCAGTTCCCGGAATCAGCGCCGTGCCTCACGAAGATAACCTGCGATACTTTGACGT
CGAGATCCACGGCCCTGCATCGTCACCATACGAAGGCGGCATTTTCAAGCTTGAGCTCTTCCTCCCAGATGACTATCCC
ATGACTCCGCCCAAAGATTCGATTCCTTACTAAGATTTTCCACCCAAACGTTGACAAGCTGGG

> SEQ ID NO: 6757 216068 202178_300781_1b
CCCCCCCCGGACGCCACTCACGATCGCGAGCTCGACAGCTTCTACGTCTAGCATCGAGTGGATCGAACAATGGCAACTT
TGCTTCAGGAACCTGCACCGCTCGTTCAGGCGGATCAGAGCCAGGTCGACCTCGCCGAATATGATGAGGAGCAGGTCCG
TCTGATGGAAGAGCGCTGCATTCTGGTCGACCCCGAGGATGTTGCTTACGGCGAAGAGAGCAAGAAGACTTGTCATCTC
ATGAGCAACATCAAGCAAGGCTTGCTTCATCGCGCCTTTTCCGTCTTCCTCTTCCGCCCAAGCGACGGCAAGCTCTTGC
TGCAAAAGCGGGCGGACGAGAAGATCACGTTCCCAGGCATGTGGACCAACACATGCTGCAGTCATCCTCTGAGTACAAA
AGAGGACCGTGTCGAGGAGGGGCAATTGGGCGTGCGGAAAGCGGGTATTCGCAAGCTTCCGCACGAGCTCGGCATCAAG
CCGGACGCGCTCAGTCCCGAAGACTTTGTCTACTTGACTCGCATACACTACCAGGCCGGC

> SEQ ID NO: 6758 216090 207990_300830_1b
ATTGACTACACACATAAATACACCAGCAAAACATCTTCTGCGATTTCTAGTGTTTTTTCACTTACACCAGCGCGACCAT
CGCCAAAGCTACATACAACACAACACACAACACAATACATACACATCCAGACACTACCGTCTAACATAACACAAACCGC
CGAAATGGTCACTCAACCAGCCAAGATCCCCGTTGCCGCCCCAGGCCCCCTCGCTAGAGCTTTCCCAGCCGTCATCGCC
GTCGGCGTCATCTCTGCCGTCGCGCTAAACGTTCGCTCCCAACTCAAGACTCATTCAGCCACTCAGGACCGCTTCTTCT
CCCAGTACAA

> SEQ ID NO: 6759 216095 234124_301097_1b
TGGCCACCACCGTTCCCGCTCACACACACTGCAAGCAACCATGGCATTCGGCAAGCTCTACAGCTACGCGGGCAACCCG
CGCACCACGTCGCTCCTGGCTGTCGCGAAGGAGAACGGGCTCGACATCGAGTTTGTCGACACAGAGCCCGCCAAGGGCG
TGTCGGCCGAGTACCTGAAGCTCAACAAGCTCGGCAAGGTGCCCACGTTCGAGGGCACTGACGGCTTTGTGCTCTCCGA
GTCGATCGCCATCGCCGTCTACCTCGCCTCGCAGAACGAGAAGACCAGCCTCCTCGGCAAGACCAAGCAGGACTACGCC
ACCATCCTGCGATGGATGTCCTTTGCCAACTCTGAGGTCCTCTCTCCCCTCGGCGGCTGGTTCCGCCCCATCCTCGGCC
GCGACCCCTACAAGAAGAACGTCGACGAGGCCCAGAAGGCTTCTCTCAAGGCCGTCAACGTCTTCGAGGAGCACCT
CGCCACCCACACGTACCTTGTGGGCGAGCGTCTGACGCTCGCCGACCTGTTCGCTACGAGCGTCCTCGCCCGTGGCTAC
CAGTACTTCTTCGATGCGAAGTGGCGCGAGGAGAACCCCAACGTCACCCGCTGGTACGAGACCATCTACAACCAGGCCA
GCTACTTGGCT

> SEQ ID NO: 6760 216095 224075_300978_1b
ACGACCTCCAGACCCCCCGATACACTTCTATCAAGGCCCTCATCAAGCACTTCAAGCTCGATGTTGAGGTTGTCCCCAA
GGACGCCGAGTTCGAGAAGCTCTTCCCTCTCAAGAAGGTCCTGCCCTCCTGACCGCCAACGGCACTCCCATCCACGAG
TTCGTTGCCGTCTCCTACTGGCTCCTCTCCCAGATCCCCAACCACCCTCTTTGCGGAAAGAACAAGGACGAGGAGGCTG
AGGTTCTCCAGTGGGTCTCTTTTACCAACTCCGATATTGCGGATGCCACCTGGAACGTTTTCGGCCCTCTCAAGGGCTA
CCTTCCTTACAACAAGAAGGCTGTCGATGCTCTCTCTGACAAGCTCGACCAGACCGTCAAGGCTACCTTTGAGGCCCAC
CTCACCAAGAACACCTACCTTGTCGGCGAGTCTGTCACTTACGCTGATATCGCCGCTGTCGGCCTGATGTCTCTTGGAT
TTGCTAACCTCTTTGACGCCAAGTGGCGAGCTGCCTACCCCGCTACCACCCGATGGTTCACCACCGTCGCTGCCAACCC
CATCTACTCTGGCACCGACTTTAACCTCTGTGAGGAGCGAGTCAAGTACGTCGCCCCCAAGAAGGAGGAGCCTAAGAAG
GAGGC

> SEQ ID NO: 6761 216107 204302_300792_1b
GGTCACCACCGTTGCGCTTCCATCGCAGAAACTCGCTGCGGAATCAACCACTGCAATATGTCTTATCAACGGATATGGC
CAGCCCTACGGCCAACCACCGCCTCCCCAGGGCTATGGCCAGTATCCCCCTCCTCAACAGGGCAATATCCTCCTCAAC
AGCAGGGCCAGTACCCTCCTCCTCATGGGCAATATCCTCCGGCCCAGCAAGGGCAATACGGCCAGCATCCTCCCCCTCA
GCAGGGAGGTTATTACCAGTCTCCCCCGCCCCCTCCAGGCCAGTATCCCCCACCACAAGCGCCCTACGGACAGCCGCCG
CCTCAGCAATACGGGGCTCCTCCTCCTCAACACCAACAGCCCTACGGAGCGCCTCCTCCAGGCCAATATGGAGCGCCTC

FIG. 2 continued

CTCCGCAGCATGGAGGGCATTATGGTGCCCCTCCTCCGGCGCCTTACGGAGCTCCCCCAGTGCAGCCTACGCCGCCGTC
TATTGGCTATGGCGCACCCCAGATCATTCAATGGGACGGCACCCCAGATGCCCAGGCTTTGCGCGGCGCCATGAAGGGC
TTTGGAACGGACGAGAAGACACTGATTAATGTTCTCTCGCGAAAAGACCCGCTACAGATCGAGGTGATTCGATCCACTT
ACGAGCGCACCTTCAAG

> SEQ ID NO: 6762 216115 219603_300947_1b
GCGCCTATCAATCCGATACCCCGCCGCCTTCAGATTCCTTTCCTCAGCATCCGTCAAAATGGCTGACCGCGTCCACCGA
ATCACCATGTTCAAGCTCCCTAGCGAGGAGAGCCAGAAGAAGCTCATTGAGGAGTACAAGACCCTCAAGGAGAACAACC
GAAAGGACGGCCACCCTTACATCCTCTCCATAGCCGCTGGTCCCGCCGAGCCCGACCAGCGCTCCCAGGGCTTCACCTT
TGTCTCAAAGTCCGAGTTTGCCAGCCTCGAGGACATGAAGTACTACGACGAGGAGTGTGTGGCCCACCAGGCCCTCAAG
AAGGTCGCCATGACTCTGGGTGTTGAGGGCATCATGACCATCTACTTCAAGCCCCAGGTCGTCGGTGGTGTTGCGCCCT
GAAAAAAGGCCATTCTGATGGAGCCGGGGACAAAATATTCGATGCAAGTAAGCGCTTGCATTGAGATGAAAATAGACGC
CCGCCTCTAGAAGAAGACC

> SEQ ID NO: 6763 216118 17602_300227_1b
CCCACGCGTCCGCTTCTCTTCTTCTTCTTCAAGCCGCGGCTAAAGATCCCTACTTCTCTCGACACTTATAGAGTTTCAG
TCATGGCCGCCTCCGCAGAAATCGACGCTGAGATTCAACAGCAGCTTACCAATGAGGTTAAGCTCTTCAACCGTTGGAG
CTTTGATGACGTTTCGGTTACGGATATTAGTCTTGTGGACTACATTGGTGTTCAGCCATCGAAGCACGCAACTTTTGTT
CCCCATACTGCTGGACGATACTCTGTGAAGAGGTTCAGAAAGGCGCAGTGCCCAATTGTTGAGAGGCTCACTAACTCTC
TCATGATGCACGGAAGAAACAATGGTAAGAAGTTGAT

> SEQ ID NO: 6764 216118 246420_301613_1b
TAGGGTTGTGGGTTTTTAGGGTTCTTGAGCAGCTATGGCGGCGGTGGTGTTGCCCGAGAAGCAAAAGCCGATCTTGTAC
GTCGATGTGAAGCTCTTCAATCAGTGGGCTTATGATGAAGTGGAGGTCACTGACATTCCTCTACAAGACTACATCGCGT
CTCGGCAGACGACTTATGTGCCACACACGGCCGGGCGCTACTCCAAGAAGAGGTTTAGGAAGGCTCAGTGCCCCATCGT
TGAGAGGCTTACCAACTCGCTCATGATGCACGGGCGAAACAATGGAAAGAAGCTCATGGCTGGGCGCATTGTGAAGCAC
GCGATGGAGATCATTCACTTGCTCACTGACCAGAACCCGATCCAAGTTATCGTCGATGCTATCATCAACAGTGGTCCTC
GCGAAGATGCTACTCGTATCGGTTCCGCTGGTGTTATCCGGCGTCAGGCTGTGGATATCTCGCCTCTGAGGCGCGTCAA
CCAAGCGATCTATTTGCTGACCACCGGAGCTCGCGAGAGTGCTTTCCGGAACATCAAGACCATCGCGGAATGCCTTGCC
GATGAGCTCATCAATGCCGCGAAGGGATCGTCTAACAGCTATGCGATCAAGAAGAAGGACGAGATCGAGCGTGTTGCCA
AGGCAAATCGTTGAAAAGTTTTCTCCAGAGGTCTCTTTTTATTGTCGAGTATTAAACACAGAAACACA

> SEQ ID NO: 6765 216118 240834_301317_1b
GAGCAGCCATGGCGGCGGTGGTGTTGCCCGAGAAGCAAAAGCCGATCTTGTACGTCGATGTGAAGCTCTTCAATCAGTG
GGCTTATGATGAAGTGGAGGTCACTGACATTCCTCTACAAGACTACATCGCGTCTCGGCAGACGACTTATGTGCCACAC
ACGGCCGGGCGCTACTCCAAGAAGAGGTTTAGGAAGGCTCAGTGCCCCATCGTTGAGAGGCTTACCAACTCGCTCATGA
TGCACGGGCGAAACAATGGAAAGAAGCTCATGGCTGGGCGCATTGTGAAGCACGCGATGGAGATCATTCACTTGCTCAC
TGACCAGAACCCGATCCAAGTTATCGTCGATGCTATCATCAACAGTGGTCCTCGCGAAGATGCTACTCGTATCGGTTCC
GCTGGTGTTATCCGGCGTCAGGCTGTGGATATCTCGCCTCTGAGGCGCGTCAACCAAGCGATCTATTTGCTGACCACCG
GAGCTCGCGAGAGTGCTTTCCGGAACATCAAGACCATCGCGGAATGCCTTGCCGATGAGCTCATCAATGCCGCGAAGGG
ATCGTCTAACAGCTATGCGATCAAGAAGAAGGACGAGATCGAGCGTGTTGCCAAGGCAAATCGTTGAAAAGTTTTCCTC
CAGTGGTCTC

> SEQ ID NO: 6766 216118 254307_301632_1b
TGAAAACCTAGAGGGGAGGGAGCGTACGTAGGAGAGAGGGCAAGGGCATAATAGCTATGGCCGTCGTGCAGCAGCCTGA
CGTCAAGCTCTTCGGTCAATGGTCTTTCGAAGACGTCGAGATCAGTGACATTTCCCTTGGTGATTACATTGCTGTGTCT
GTTGACAAGCATGCGACATTTGTTCCCCACACCGCTGGCCGCTACTCTGCAAAGCGCTTCAGGAAGTCTCAATGCCCCA
TTGTTGAAAGGCTCACCAACTCTTTGATGATGCACGGGCGCAACAATGGAAAAAAGCTGATGGCTGTGCGTATCATCAA
GCATGCCATGGAGATCATCCACCTTCTCACTGATCAGAACCCAATCCAGGTCATTGTCGATGCAATCATCAACAGTGGA
CCTCGAGAAGATGCTACCAGAATCGGATCTGCTGGTGTTGTGAGGAGACAAGCTGTTGATATTTCGCCTTTGAGGAGAG
TGAATCAGGCCATATACTTGCTTACTACTGGTGCTCGAGAGTGCCTTCAGAAATATCAAGACAATTGCTGAATGCCT
TGCCGATGAGCTAATCAATGCAGCAAAAGGTTCCTCAAACAGCTATGCAATCAAGAAGAAAGATGAAATCGAGCGCGTT
GCAAAGGCAAACCGTTAAAGCTTCCTGATTTTTTAGTTTGGCTGAGGA

> SEQ ID NO: 6767 216118 194431_300763_1b
CGGCCGCGACTCGTTAGGCTACTCCACCCACTCTTGTTTAGGGTTTCCCTCAGCCGCCGCCGCCGCATCCACGCTCAGC
AGCCATGGCGGTGGTCGAGCAGCCGCAGCAGCAGGTGGTGAAGCTCTTCAACTGCTGGTCCTTCGAAGACGTTCAGGTG
AACGACATATCCCTCGCCGACTACCTCGCGGTGTCCTCGACGAAGCACGCCACCTACCTGCCGCACACGGCTGGCCGCT

FIG. 2 continued

ACTCGGCGAAGCGCTTCCGCAAGGCGCAGTGCCCCCTCGTGGAGCGCCTCACCAACTCCCTCATGATGCACGGCCGCAA
CAACGGCAAGAAGATCATGGCTGTCCGCATCGTCAAGCACGCCATGGAGATCATCCACCTCCTCACCGACGCCAACCCC
ATCCAGGTCATCGTAGATGCCATCATCAACAGCGGCCCGCGTGAGGACGCAACCCGTATCGGCTCTGCTGGCGCTGTGA
GGAGGCAGGCTGTGGATATCTCTCCCTTGAGGAGGGTCAACCAGGCAATCTACCTCCTCACCACTGGCGCCAGGGAGAG
TGCCTTTAGGAACATCAAGACCATTGCTGAGTGCCTTGCTGATGAGCTCATCAATGCCGCCAAGGGCTCATCCAACAGC
TATGCCATCA

> SEQ ID NO: 6768 216118 201204_300714_1b
CGGACGCGTGGGCGGACGCGTGGGCGCCGCCGCCGCCTCCCGCATCCACGCGCCTCCTCCTCCTCCGGCGGCGCCGCCG
CCACCGCAGCATCAGCCATGGCCGAAGTGGAGCTCCCGCAGCAGGAGGTCAAGCTCTTCAGCCGCTGGTCCTTCGAGGA
CGTCCAGGTGAACGACATCTCGCTGGCGGACTACCTGGCGGTGAACCCGACGAAGCACGCGACGTACCTGCCGCACACG
GCGGGGAGGTACTCGGCGAAGAGGTTCCGGAAGGCGCAGTGCCCCATCGTGGAGCGCCTGACCAACTCGCTCATGATGC
ACGGCCGCAACAACGGGAAGAAGATCATGGCCGTGCGCATCGTCAAGCACGCCATGGAGATCATCCACCTCCTCACCGA
CGCCAACCCCATTCAGGTCATCGTCGACGCCATCATCAACAGTGGCCCTCGTGAGGATGCGACCCGTATTGGGTCTGCG
GGTGCTGTGAGGAGGCAGGCTGTGGATATCTCTCCCTTGAGGAGGGTCAACCAGGCAATCTACCTCCTCACCACTGGTG
CCAGGGAGAGCGCCTTCAGGAACATCAAGACCATTGCTGAGTGCCTTGCTGACGAGCTTATTAATGCCGCCAAGGGCTC
ATCCAACAGCTATGCCATCAAGAAGAAGGATGAGATCGAGCGTGTTGCCAAGGCCAACCGTTGAGTGGTGATCCCATGT
CATTGTGCTAAAGCTCTTGCGCTGTTTGGCAGGACTATACTTTTTGCTAGTAATTTAAGCCTTTTCAGACCTACCTGTG
GTTTAATG

> SEQ ID NO: 6769 216118 223967_300977_1b
GCCAGTACCTCAACTACACAGTACGACACCATGGCCGACGAAACCGCCCCTGTTGCTCTTGCCCTCCAGCTCCCCAAGG
ACATCATCGCCGAGTCCGGCTCCGTCAAGCTCTTCAACAAGTGGACCTACGACGACGTTGAGGTCAAGGACATTTCTCT
CACCGACTATGTCCAGATCTCCCCAGCCCGTTTACATCCCCCACACCGCCGGCCGATACGCCAACAAGCGTTTCCGAAAG
GCCCAGTGCCCCATTGTCGAGCGACTCACCAACGCTCTGATGATGAACGGCCGAAACAACGGTAAGAAGCTCAAGGCTG
TCCGAATCGTCGAGCACGCTCTGGAGATCATCCACCTGCTCACCGACCTCAACCCCCTGCAGGTTGTTGTTGACGCCAT
CATCAACTGCGGTCCCCGAGAGGACTCCACCCGAATCGGTTCCTCCGGTGCCGTTCGACGACAGGCCGTCGATGTCTCT
CCTCTGCGACGAGTCAACCAGGCCATCTCTCTGCTCACCATCGGTGCCCGAGAGGCCGCTTTCCGAAACATCAAGACCA
TTGCTGAGTGTCTTGCTGAGGAGCTCATCAACGCCGGAAAGGGTTCTTCCAACTCTTACGCTATCAAGAAGAAGGACGA
GCTTGAGCGAGTCGCCAAGTCTAACCGATAAGGTGATG

> SEQ ID NO: 6770 216118 225763_300990_1b
TCCTTCCTCTAACCACCCAAATCGCAATCATGTCTGACGGAGAAATCGAGGTCGAGAGCCCCGCCGGCTACGCCGTGCT
CCCCAAGGAGGTCACCGACGAGATTGGCAGCGTCAAGCTGTTCAACAAGTGGCCTACGAGGAGGTCGAAGTTCGCGAC
ATCTCTTTGACCGACTACATCCAAATCCGCTCGCCCGTCTACATCTCACATTCCGCCGGCCGCTATGCCGTCAAGCGAT
TCAGGAAGGCGCAGTGCCCCATCATTGAGCGTCTCACCAACTCCCTCATGATGAATGGCCGCAACAACGGAAAGAAGCT
CATGGCTGTGCGCATCGTTGCTCACGCTTTCGAGATCATTCACATCATGACCGAGCAGAACCCCATCCAGGTTGCCGTT
GATGCCATCGTCAA

> SEQ ID NO: 6771 216118 218463_300933_2b
GCTCGACAATCCGCAATACTAACCGCAGTCCCGCCCAGCACCGGAATTTTCGACTGCAAATAGCCCAAGATGTCTGACG
GCGGTGAAATCGAGATCGAGAACTCTGTCGTTACCGACGTCCTCCCCAAGGACATTGTGAAGGAGGTTGGCAACGTCAA
GCTGTTCAACAAGTGGGACTACGATGTCGAGGTCCGCGACATCTCTCTGACCGACTACATTTCCCTGCGAAACCCCGTC
TACGTCACCCACTCTGCTGGCCGATATGCCGTCAAGCGATTCCGCAAGGCCAACTGCCCTATCATTGAGCGGTTGACCA
ACTCGCTCATGATGCACGGCCGCAACAACGGCAAGAAGCTGATGGCTGTCCGCATCGTCGCTCACGCCTTCGAGATCAT
TCACCTCATGACCGACCAGAACCCCATCCAGGTTGCCGTTGACTGCGGTCCCCGTGAAGACTCTACC
CGAATTGGCTCTGCCGGTACCGTCCGTCGTCAGGCCGTCGATGTCTCCCCCCTGAGGAGAGTCAACCAGGCCATTGCCC
TGCTCACCACCGGTGCCCGCGAGGCTGCTTTCCGCAACGTCAAGTCCATTGCTGAGTGCTTGGCTGAGGAGCTGATCAA
CGCCGCCAAGGGCAGCAGCAACTCATACGCTATCAAGAA

> SEQ ID NO: 6772 216118 1007537_301401_1b
TGAAAACCTAGAGGGGAGGGAGCGTACGTAGGAGAGAGGGCAAGGGCATAATAGCTATGGCCGTCGTGCAGCAGCCTGA
CGTCAAGCTCTTCGGTCAATGGTCTTTCGAAGACGTCGAGATCAGTGACATTTCCCTTGGTGATTACATTGCTGTGTCT
GTTGACAAGCATGCGACATTTGTTCCCCACACCGCTGGCCGCTACTCTGCAAAGCGCTTCAGGAAGTCTCAATGCCCCA
TTGTTGAAAGGCTCACCAACTCTTTGATGATGCACGGGCGCAACAATGGAAAAAAGCTGATGGCTGTGCGTATCATCAA
GCATGCCATGGAGATCATCCACCTTCTCACTGATCAGAACCCAATCCAGGTCATTGTCGATGCAATCATCAACAGTGGA
CCTCGAGAAGATGCTACCAGAATCGGATCTGCTGGTGTTGTGAGGAGACAAGCTGTTGATATTTCGCCTTTGAGGAGAG
TGAATCAGGCCATATACTTGCTTACTACTGGTGCTCGAGAGAGTGCCTTCAGAAATATCAAGACAATTGCTGAATGCCT

FIG. 2 continued

TGCGGATGAGCTAATCAATGCAGCAAAAGGTTCCTCAAACAGCTATGCAATCAAGAAGAAAGATGAAATCGAGCGCGTT
GCAAAGGCAAACCGTTAAAGCTTCCTGATTTTTTTAGTTTGGCTGAGGAGAACTTGGGTTCTTATTTGGTATCCCGAGG
AAGTTTTAAAAACT

> SEQ ID NO: 6773 216118 147004_200015_1b
GCAGCAGCGGCACTAGACAGCAGCAAAGACTCCTCCCCTAAGGTGAAGAATTGGAGCAGAGAAGAAAAAATGGACGCAG
GTGTAGTAGCCGCCCCAGTAGACGCAACCGCAGAGAATAAGATACACAGTGATGTTATGCTTTTCAATCGCTGGACCTA
CGACGATGTCCAGATCAATGACATCTCTGTTGAGGATTACATCACAGCAACTGCTTCCAAGCATCCAGTTTATATGCCA
CACACAGCTGGTAGATACCAGGCTAAGCGTTTCAGGAAGGCCCAGTGCCCAATTGTTGAGAGGCTCACCAACTCTCTTA
TGATGCATGGACGGAACAATGGGAAGAAGCTAATGGCTGTCCGCATCATCAAACATGCAATGGAGATCATTCATTTGTT
GACTGACCAGAACCCAATCCAAGTCATTGTTGATGCCGTCATTAACAGTGGGCCAAGGGAAGATGCAACTCGTATTGGT
TCAGCTGGTGTTGTGAGGCGTCAGGCTGTTGATATTTCTCCACTTCGCCGTGTTAACCAGGCCATTTATTTGCTGACAA
CTGGTGCACGTGAGAGTGCTTTCAGGAACATCAAGACCATAGCTGAGTGCCTTGCAGATGAACTTATCAATGCTGCCAA
GGGTTCTTCAAACAGCTATGCCATTAAAAAGAAGGATGAGATTGAAAGAGTTGCCAAGGCCAATCGTTGAGAGGTTGAC
ATTGTAACAGAATTTACAAGGTAGTTTAGGGTTATGCTATTTTCTCATTTCTGTTTTCTTTTAGCACTATAGTCTCATG
GAAATGAAAGTGGATCTGAGTAGCACCACAGCTATTGCATGTGGATTTTAATTTAGTATTTTGCTTGTTGAAACTTG

> SEQ ID NO: 6774 216118 137188_300502_1b
CCCCCGGCGACTCGTTAGGCTACTCCACCCAGTCTTGTTTAGGGTTTCCCTCAGCCGCCGCCGCCGCATCCACGCTCAG
CAGCCATGGCGGTGGTCGAGCAGCCGCAGCAGCAGGTGGTGAAGCTCTTCAACTGCTGGTCCTTCGAAGACGTTCAGGT
GAACGACATATCCCTCGCCGACTACCTCGCGGTGTCCTCGACGAAGCACGCCACCTACCTGCCGCACACGGCTGGCCGC
TACTCGGCGAAGCGCTTCCGCAAGGCGCAGTGCCCCTCGTGGAGCGCCTCACCAACTCCCTCATGATGCACGGCCGCA
ACAACGCAAGAAGATCATGGCTGTCCGCATCGTCAAGCACGCCATGGAGATCATCCACCTCCTCACCGACGCCAACCC
CATCCAGGTCATCGTAGATGCCATCATCAACAGCGGCCCGCGTGAGGACGCAACCCGTATCGGCTCTGCTGGCGCTGTG
AGGAGGCAGGCTGTGGATATCTCTCCCTTGAGGAGGGTCAACCAGGCAATCTACCTCCTCACCACTGGCGCCAGGGAGA
GTGCCTTTAGGAACATCAAGACCATTGCTGAGTGCCTTGCTGATGAGCTCATCAATGCCGCCAAGGGCTCATCCAACAG
CTATGCCATCAAGAAGAAGGATGAGATTGAGCGTGTTGCCAAGGCGAACCGTTGAGTGCTGAACCCATCTCAGTGTGCT
CGAGCTATTGCCTTGCACTGTTGCCAGTACTTTTTGCTAGTCTTTTTGGGCTTTGCCAGAGTTACCTGTGATTTTCTGT
TTAATGATAAGTGCTGAGAAAATGTAGTAGTCTGTTCGCTATCGACATTGTTTTATTACACCCCCAATCCTTGTTCCTG
C

> SEQ ID NO: 6775 216118 1109222_301530_1b
GAAAGAGGAAAGAGGAGAGAGGAGAGAGAGAGGAGGAGGAGGAGGAGGAGCGATGGCGGTCGCAACGCAGCAACCCGAT
GTCAAGCTCTTCGGACAATGGTCCTTCGAAGAAGTCGAGATCAGCGACATCTCGCTGGCGGATTACATTGCAGTATCTG
TCGACAAGCATGCGACATTCCTTCCCCATACGGCTGGACGTTACTCCGCAAAGCGCTTCAGAAAGTCACAGTGCCCTAT
TATTGAGAGGTTAACAAACTCCCTGATGATGCACGGTCGCAACAATGGTAAGAAGCTTATGGCTGTCCGGATTGTGAAG
CACGCCATGGAGATCATTCACCTCCTCACAGACCAGAACCCCATTCAAGTCATTGTTGACGCAATCATCAACAGTGGGC
CTCGGGAGGATGCTACTAGAATTGGTTCTGCTGGAGTTGTGAGAAGGCAAGCTGTTGATATTTCCCCTCTGCGAAGGGT
AAATCAGGCTATCTACTTGCTTACCACTGGTGCACGAGAAAGTGCCTTCAGAAACATCAAAACAATTGCTGAATGCCTA
GCGGATGAGCTTATCAATGCTGCAAAAGGCTCTTCCAACAGCTACGCAATTAAGAAAAAAGATGAAATTGAACGTG

> SEQ ID NO: 6776 216118 136841_300439_1b
CTCGTTTAGGGTTTCCCTCCGCCGCCGCCGCCTCCCGCATCCACGCGCCTCCTCCTCCTCCGCCGCCGCCGCCGCCACC
GCAGCATCAGCCATGGCCGAAGTGGAGCTCCCGCAGCAGGAGGTCAAGCTCTTCAGCCGCTGGTCCTTCGAGGACGTCC
AGGTGAACGACATCTCGCTGGCGGACTACCTGGCGGTGAACCCGACGAAGCACGCGACGTACCTGCCGCACACGGCGGG
GAGGTACTCGGCGAAGAGGTTCCGGAAGGCGCAGTGCCCCATTGTGGAGCGCCTGACCAACTCGCTCATGATGCACGGC
CGCAACAACGGGAAGAAGATCATGGCCGTGCGCATCGTCAAGCACGCCATGGAGATCATCCACCTCCTCACCGACGCCA
ACCCCATTCAGGTCATCGTCGACGCCATCATCAACAGTGGCCCTCGTGAGGATGCGACCCGTATTGGGTCTGCGGGTGC
TGTGAGGAGGCAGGCTGTGGATATCTCTCCCTTGAGGAGGGTCAACCAGGCAATCTACCTCCTCACCACTGGTGCCAGG
GAGAGCGCCTTCAGGAACATCAAGACCATTGCTGAGTGCCTTGCTGACGAGCTTATTAATGCCGCCAAGGGCTCATCCA
ACAGCTATGCCATCAAGAAGAAGGATGAGATCGAGCGTGTTGCCAAGGCCAACCGTTGAGTGGTGATCCCATGTCATTG
TGCTAAAGCTCTTGCGCTGTTTGGCAGGACTATACTTTTTGCTAGTAATTTAAGCCTTTTCAGACCTACCTGTGGTTTA
ATGTTTGAATGAACATCGACTAGTGCTGAGAAAAATATGTAGTGCTCTATTCTATCTATCTATCGACATGGTTTTATAT
TGAACCCGCAATTCCCGTTCCTTC

FIG. 2 continued

> SEQ ID NO: 6777 216118 3975_300330_1b
CCCACGCGTCCGGGAGGAACAACGGTAAGAAATTGATGGCTGTCAGGATCGTCAAGCACGCCATGGAGATTATCCACCT
CTTGTCTGACTTGAACCCAATTCAGGTCATCATTGACGCCATTGTCAACAGTGGTCCACGTGAAGATGCTACCAGAATT
GGATCTGCTGGTGTTGTTAGGAGACAAGCTGTTGATATCTCTCCTCTAAGACGTGTTAACCAGGCTATCTTCTTGATTA
CCACTGGTGCTCGTGAAGCTGCTTTCAGAAACATCAAGACTATAGCTGAGTGCCTTGCTGATGAATTGATCAACGCAGC
CAAGGGCTCTTCCAACAGCTATGCCATCAAGAAGAAGGATGAGATTGAAAG

> SEQ ID NO: 6778 216118 47122_300174_1b
CGATCTTCAGCCATGGCCACCGCCGCAGATGTTGACGCTGAGATTCAGCAGGCGCTCACTAACGAAGTCAAGCTCTTCA
ACCGCTGGACCTATGACGACGTTACGGTCACAGACATCAGTCTTGTTGACTACATTGGAGTTCAGGCAGCTAAACATGC
TACCTTTGTTCCCCACACCGCTGGAAGATACTCTGTGAAGAGATTCAGGAAGGCTCAGTGCCCCATTGTTGAGAGGCTC
ACCAACTCTCTCATGATGCACGGGAGGAACAACGGTAAGAAATTGATGGCTGTCAGGATCGTCAAGCACGCCATGGAGA
TTATCCACCTCTTGTCTGACTTGAACCCAATTCAGGTCATCATTGACGCCATTGTCAACAGTGGTCCACGTGAAGATGC
TACCAGAATTGGATCTGCTGGTGTTGTTAGGAGACAAGCTGTTGATATCTCTCCTCTAAGACGTGTTAACCAGGCTATC
TTCTTGATTACCACTGGTGCTCGTGAAGCTGCTTTCAGAAACATC

> SEQ ID NO: 6779 216142 204139_300790_1b
CACACCTGCAAGCCGTCGGCTCTTCCTTCCTATTCCCATTGACAGGATAAACATACGTCTAGGCTGCTTCTGCTTGGCA
GGAACTACCTTTCCGAGCATCTGCCACTGCCTATCTGGGTATTGGGCATTGCCCAACGTGGTGCGCACTTGCTCGATCC
ATACCTACAATTACGGGTACCTTGATGATCTGGGGTATCTTGTAGTTTAGTTTGTATCTGCCGGGTCACGAGCAGCCAC
CACCGCCAACATTTGGTACTAGGCAATACTTCTGGGTGCCGATATATCACCTGTCACGTCTTTTCAGGTTTTGCATCTT
TTTGCTCTCTTCATCATCATCATCTTTCTTCTTTGTCACAATCACTTTGCCGTCTTCCACGGACATTTCCGCAGATCTG
CATCACAGAGATCTGCATCAGAGAGGATTTCAAGCTTTTCCTCTTTGTTTGCCTTCCTCTCCTCTTCTCTTCTTGGATC
ACAAAACAATCGGCAAAATTGACATCTCGATATTTTCTGCCTCCAATCACAGCCGTCATACCACCTGTGGCGTCTTTGC
CATCAATTCTCTGCTGCGGTGCTACCCGCCCTGCAGCAATTTTTCCCGCTGGCCGTCTGCAGGCGTTGCCTCGGCTGTGG
GTTTTTCGTCGACCACTGAGGCTTAGTGCCCATCAGCCACTAAAGCGGCTTGACGTCGATTCTCAACTTTGAACCCTTT
TGAGCTGCCTCTGGCCTCTGCCTCATCTCTCCCACACCCTCACGCGCGCAGTCTTGAATAACACCCCTTCACGCACTC
GCCATTGCCGCGCTCCTCGTCACGCTCTGCTCGATTAGCCGTCTCTCGCCCATTGATTGAACCTGCTCTCGGCCTCTGC
AGCCACCCTCACGCAACCTACGCCTGACATCCTCTGCGTCGCTCGGCTGTCTCCCGGTTTTATCCATCAGCTGAACCTT
CACCTTCGCCTTCGCTCTCAAGAGGGAATCCGAGGGCCCGGCCGTTCTCTGCCCATCTATTGTTATTGCCATTAACGCTG
CTGCTGCTGCCACTGTCTCCTCTACTCCTGTTTCGCCCTCATATGTCTCAGCCGCCTCGCCGGATGCCTCTACTATCAC
ACCCTAAACACCGTATTAGCATACTTGATCTTACCAAACTGCCGTTGCAGTAACGCCGGCTTCATCTTCTTGACAATGC
CGTCGAAAACTAACAATGGTGTGGGAGTTCAGGTCGAGGACACAAAGATATGCGTTGTCATGGTTGGTCTCCCGGCCCG
CGGGAAGAGCTACATTGCCCAGTTAGCCCAGAGATACCTGCAATGGCTGTCGATTCCGGCAGCGACTTTCAATGTCGGC
AACTATCGGCGCAATGACGCTCCACAGCCGACTGCCGACTTCTTTGATTTTAACAATCCCGAAGGAGAGCGGAAGCGCC
GTGCGGCTGCCGAGGCCGCCGTTGCTGACATGCTTGCCTGGTTCCGCACCGGCGGCGTCGTCGGCATCCTTGACGCGAC
CAATTCTACAAAGGAGCGCCGTAAATGGGTCATGGACACGTGCACCGCTCACGGCATTGAAGTGCTCTTTGTCGAGAGC
AAATGCGATGATGAAGAGGTCATCATGGCCAATATCCGTGACGTCAAGCTAACGAGCCCCGACTATCGAGGCCAAGATC
CCGAGGCCGCGGCGCAAGACTTTCGCAATCGCATCAGCCACTACGAGAAAGTTTACAAGACCATCAACGCCGACGAGGA
TGAGGACAACTACACCTACCTAAAGCTGATGAACGTCGGCAAGCAAGTCATCA

> SEQ ID NO: 6780 216146 199427_300749_1b
CCCACGCGTCCGGCGGTACGAAGCCACCTTTGCTGTTAATGGCGCATATATAAAACTCGAAAATAGAGGAGAAAATAGG
AAAAGAGACAAAAAAACTAACAAGATATAAACAAACAACAGGCACACATTGACAGTGGCAAAACTACGGTAACGGAAC
GAGTTCTCTTCTACACTGGTCGAATCAAGGCAATCCACGAAGTCCGCGGCAAAGATGCCGTCGGCGCCAAGATGGACTC
TATGGAACTGGAACGAGAAAAGGGTATCACGATTCAGTCTGCGGCTACATTCTGCGACTGGAAGAAAACGGTAAACGGA
AAGGATGAAGAGTATCACATCAACTTGATCGACACTCCCGGCCACATTGACTTCACCATCGAGGTCGAGCGTGCTTTGC
GCGTGCTCGATGGTGCCGTCATGATTCTCTGCGCTGTCTCCGCTGTTCAGTCCCAAACGATTACGGTCGATCGCCAAAT
GAAGCGCTACGATGTTCCTAGGATTTTCATTCATCAACAAGATGGACCGCATGGGTGCCAACCCCTGGAAGGCCGTCGA
GCAGATCAACTCCAAGCTCAAGATCCCC

> SEQ ID NO: 6781 216146 245671_301570_1b
GCGATGTGGTTCACTTAGCTCATTGTCGGCGAGAGATGGCGGCGATGGCGCAATCTCTTCCGGCAGCTAGGTTCTCCTC
GCCGCGCTCATCGATTCCTTCCAGCTCGCAAGCGAGGCTATGCTGCTGCGCCGCTGCCAGATCGCGAGCGCCATTCGTG
GTGCTCGATAGCTTGTTCTTGCCAGGGCTTGGATTCTCACTCAGAAATGCGAGGATTGGCGATGCTGCCACTGTGGCGA
GGCGTGGAATCGTGTGTATGGCGGCCGATTCCGGCACACGAGAGTTTCCTCTCAGGACTACCGAAACATTGGAATCAT
GGCACACATCGACGCTGGAAAAACCACCACAACGGAACGCATCCTTTACTACACCGGCAAGAACTACAAGATCGGTGAA
GTCCACGAAGGCAACGCAACCATGGACTGGATGAACAGGAACGAGAGCGAGGCATCACCATAACTTCCGCCGGCACCA

FIG. 2 continued

CCGGCGTATGGAAAGACCACCGGATCAACATCATCGATACCCCGGGTCACGTCGACTTCACTCTCGAAGTAGAGCGAGC
CTTGCGAGTTTTGGATGGAGCTATCTGTCTCTTCGACAGCGTTGCCGGGGTGGAGCCACAGTCCGAGACGGTGTGGAGA
CAGGCAGACAAGTATGGCGTTCCAAGGATATGTTTCGTGAACAAGATGGATCGAATGGGAGCCAACTTCTTCCGGACGA
GAGACATGATC

> SEQ ID NO: 6782 216148 195807_300638_1b
GTTTTGTTAGGAGCCGTTGTATTCATCACACAAGACCTGCGTCTTTGTTGGGCAGAGATTTTCAATCCCATTCATGAAC
CAAAATACAAAGCAACTGAAAATTTCTCCCGTCCGCCGGCTTGAGCTTGACACATGCAGCGAACCTGCATCCGCAAGCC
CAAAAAGCAAATAATGGCACCCCCTGGGCTTTGGAGCTTCTGGATTTCATTGGCGCCGCTCAAGTTAGCCGCACCCACC
GGCGAACCCCAGAATGGCGGCCGGGGTTGGGACTAGAGGGACTAGGGGAATACCTTGCGCGTCTGTGAGATTGGTGAGG
CCGGGCAGAGTAGACGGCATGTATAGTACAGTACAGACGAAGTTTTCCAACCGGGATGCTGCTTGCTTGGGGGATCGTC
GTGCTGGAGATGTTGGCACTTGTAGACCCTCACCGGTGAGGAGCTGTGGGTAAAAGATGCCAGTGAGTGGATGGAGGTG
AAGAACCAGCTTTGGGACTTGAAGGATCGTAACCCGGTCCAGCCTGGAAAGCCGGCGCCCTCTTGGCAAATCACTGCC
GCAATCTAGTGAATTGACCTGCAGGCCGATGCTGTA

> SEQ ID NO: 6783 216150 207963_300830_1b
GCTCTGGCTATGGCGGCGGCGGCGGCTACGGAGGCGGTTACGGCAACGGTGGCAGCTACGGCAACCCCGGCGGTGCTGG
AGCCCAGTCCTCGTGGTGGTAAATACTCACGCTCTCTCGTGATGGGCATATCACTGTGTCTATCATTGTGGCTCAAGTT
TCAGCCACTACTCTTTTTTTTTTTCTCGTCTTCACTTTTCCCTTATCGTCATTTAT

> SEQ ID NO: 6784 216156 200449_300759_1b
GTGCATCTCACATTCACTTCCTGAGGCCGCATCTCATTCAGCTTTTACCCCACCATCTCACAGCCCATCATCTATCTCA
TCCAACCTCTCACCACAACAGCACCTACATCTACAAGAGAGAACACTTCCCTCTTGAAAAAGTAAACCTAAATAAACAC
ATCAAATCAAAATCCTCCATCATGGCCGACAAAGACCGCATCACCTGCCACGTCCTCGACACCACCGCCGGCCGCCCCG
CAAAGGGCATCCGCGTCCGCCTCGAAGGCCCCGTCCCCAGCTCTCCCAACGCCCACACTGCCGTCAACACCTTCGAGTC
CCTCACCAACGACGACGGCCGCATCACCGTCTGGCTGCCCTACTCCTCAGAGTCCTCGGCCGGCGAGGTGCCCGTCTAC
ACTCTCGAGGACGTCCTGGGCGCTATCAAGGGGCCTTCCCGGTGGACGCTGCGTTTCGACACTGCCGGCTACTTTGGCG
AGGAAAAAACATTCTTCCCAGAAGCCACCATTGTGTTTCGTGTTGAAGAGGGCCAGCATTACCATGTGCCGCTGC

> SEQ ID NO: 6785 216160 195446_300634_1b
GCGCGTGGTATATCAGCCCAATCTTACTATGGAGTCCAACATGGTGCATGTTCAGGGCGCATGTGCTGGTAGCATATCG
TCAACGGACGGGGAGAAAAGTACGGAGGACGTCCGCTGTGGTTCTCCTCGGATGCGGGCGTTGGTAGGCCACCAGCGTC
CTAAATCTTGATCCCAACGGATCTGGCAACGCAGTGGAAATGGGGCCGATGGAGAAGTTCGGAACGGGCAGCCAACATG
TCAACTACCCACTCATGCCACCAGTCCCGCTGCATCGCCAGGAACGTTGGCCCCAATGCCGAAGTAAGTGTGCGGACAG
AATGGATACCAGCGGCCACCGTGGTCCTTTCCAGCGTTACACAAAAGCCCTATTCGTGCGTTCAATTCTGCCACGATCG
ATCGGGTGGTCCCAGAAGGTTGGAATCCAGGTTGGCGTGCTAGAGCGCAAGAAGAAAAAAGGCGAGCAAAATGAATAA
AAGAGCATCCCACCCACCAACTTTGGCAAACAGCGCAACGGCGCATTTTTGATTTGTTGATTTGTCGACAATGCGATTG
TCACAGACAATATGTCTCGGATTCTCAAGAGAACCAACCACACACATGGCGGTAAACAGTATGTCATTCGGGTTCCCAA
TTTGAGCAGTTCCGGGTTGGAACAAAACACAGACGACAGGGATTTCCTGTGATTGATGCGCGTTTGAATCGTGATCCTG
CTCCGAAGGGAGCATCTGGTACCCCAAGTAGAGTACAAGTTGCAGTAGACTGCAGCCGTCTCAGGATACTCAGATGTGC
GCGCGCATTGCAAATCTTCAGCACGAAC

> SEQ ID NO: 6786 216175 212915_300845_1b
CCCACGCGTCCGCCCACGCGTCCGCCCACGCGTCCGCATCAAAGAACAAACGCATCGTTCAAGATGAGAGCCAAATGGA
GGAAGAAGCGCGTTCGTCGCCTTAAGCGCAAGAGAAGAAAGATGAGGGCTCGCTCCAAATAAACGACTCGCTCTACCAC
TTGACTTGACACATCTTTCACATTTTGAATGAGTTCACGATAAAACACGACAAGCAAAGCTGCTGCACCACGGTACCAC
TCTATGACCGATTACAGCCATCAAGTTGGAATCAGCATATTGGTGCGCCTCTCCAATTCAGCTACGGGAGTCAATGGAC
GAACGCGAGAGATGAGGACTGGACAATTTCAGTCAGGTGGAGACATCGTTTTGAGGACGCGAAGGCCATGAAGCAAAAC
GCTGCTGCAAGAAGCACGCTTAGGATCGATACGTTGCTTGACAAAGATCAAAGGCAGAATTTACTTCATTTCCAAACCA
AAAAG

> SEQ ID NO: 6787 216176 208060_300831_1b
GGGAAATTTGTTCAACCTCGACAAATCAACCCCGTCGCCCATAGTACAAGATGGTAAGTTAACAGTCAACCAAAAGACT
CTAATGGCCACAGTTTGTGAGTCAAATGCGCGAAAGCGCAATTGATGCAACAGCGTCTAGCTTTTATGCAAACCTGTTG
GAAAACATTCCGCCTGACATTCACACCTCGTGTGTGGACTGAAAGGTGAAGACTTGGCTGGAGACACAAATGTGTTGCT
GAAATATGCCACAATGTGTTCTCGTTAGAGTTCAGAGAAGACTTTTTGGCTTGAGCCCCTCGCTGATGTCTTCTTTTCT
CAATGACAGCCTCCCAAATCTGGCAAGAAGGTCGCCCCTGCTCCGTTCCCTCAGAGCAAGGCTGGCAAGAAGGGACCCA
AGAACCCCCTCATCGAGAAGCGCCCTCGCAACTATGGCATCGGCCAGGACATCCAGCCCAAGCGAAACCTGTCTCGCAT

FIG. 2 continued

```
GGTAAAGTGGCCCGAGTATGTCCGCCTCCAGCGCCAGCGCAAGATCCTTCGCCTGCGTCTCAAGGTCCCCCCCTCTCTG
GCCCAGTTCCAGCACGTCCTTGACCGCAACACTGCCGCCCAGGCTTTCAAGCTCCTCAACAAGTACCGACCTGAGACCA
AGGTCGAGAAGAAGGAGCGTCTCCTGAAGGAGGCTACCGCCGTCAAGGAGGGCAAGAAGAAGGAGGACGTCAGCAAGAA
GCCCTACACCGTCAAGTACGGTCTCAACCACGTCGTTGGCCTGATTGAGAACAAGAAGGCTTCTCTCGTCCTCATCCCC
AACGATGTTGACCCCATTGAGTTGGTTGTCTTCCTTCCTTCTCTCTGCAAGAAGATGGGCATCCCCTACGCCATCATCA
AGGGCAAGGCTCGTCTCGGCACTGTCGTCCACAAGAAGACCGCTGCCGTCCTCGCCCTCACTGAGGTCCGCTCTGAGGA
CA

> SEQ ID NO: 6788 216176 258834_301700_1b
AAGAGAAGAGCTGTGAACAGCTCTGGCTCCGATGATGATGAAAAGAATGTGAGCAGATATCTCTGCAGCTCTGTCTGCT
AGAGGAGGATTACAATGTTACTCCATTACCGAAGTGACGTTACTGATGCTCCCCTAGGGGACCAGGCTGAGTCTCTTAT
GAGACTGTAGAGTGTTATATGTGAGCAGTTCGCAAATTTTTTAAGAACTAAATCCTAACCACTCAATGACACAGCCCGC
CGCTAAAGGAAAGAAGGTTGCTCCCGCCCCCTCTGCTGCCAAGGTCTCCAAGACCGAGGATGCTAAGAACCCTCTCTTT
GAGAAGAAGGCCAAGTCTTACGGCATTGGTCAGTCCATCCAGCCTAAGCGAAACCTCTCCCGATTCGTCAAGTGGCCCG
AGTACGTTCGACTCCAGCGACAGAAGAAGATTCTGAGCATGCGACTCATGGTTCCTCCTTCTCGCTCAGTTCTCCAA
CACCCTGGACAAGAACACCGCTGCCCAGACCTTCAAGCTCCTCAACAAGTACCGACCCGAGACTAAGGAGGAGAAGAAG
GAGCGACTCACCAAGGAGGCCGAGGCTATCGCCGCCGGCAAGGACAAGAAGGACGTCTCCGAGAAGCCCTACGTTGTGA
AGTACGGTCTCAACCATGTTGTCTCTCTGGTTGAGAACAAGAAGGCCAACCTCGTCCTCATTGCCAACGATGTCGACCC
CATCGAGCTCGTTGTCTTCCTCCCTGCCCTCTGCCGAAAGATGGGTGTCCCTTACGCTATTGTCAAGGGTAAGGCCCGA
CTCGGTACTCTTGTCCACAAGAAGACCGCTGCCGTCGTTGCCGTCACCGAAGTCAAGTCCGAGGACCAGGCTACTCTTG
CCACCCTCGTCTCCACCATCGAGGCTAACTTCAACGAGAAGTACGACGAGTCTCGACGAAAG

> SEQ ID NO: 6789 216176 240116_301311_1b
ATACCAACAGCAATAACGCCCAACGACCACACGCCCAATAATCACCATGCCTCCCAAGTCCGGTAAGAAGGCCGCCCCG
GCCCCTTTCCCTGCCAACAAGGCTGGAAAGAAGGCTCCCAAGAACCCCCTCATCGAGAAGCGCACTCGCAACTTCGGTA
TCGGCCAAGACATCCAGCCCAAGCGCAACCTCTCGCGCATGGTGAAGTGGCCCGAGTATGTCCGTCTCCAACGCCAGCG
CAAGATCCTCAACATGCGCCTGAAGGTTCCTCCAGCCATTGCCCAGTTTCAGCATGTCCTTGATCGCAACACTGCCGCC
CAGGCTTTCAAGCTCCTTAACAAGTATCGCCCTGAGACCAAGGCCGAGAAGAAGGACCGTTTGACCCAGGAGGCCACTG
CCATCAAGGATGGTAAGAAGAAGGAGGACGTCAGCAAGAAACCATTCACTGTCAAGTACGGTCTTAACCACGTCGTTGG
CCTGATCGAGAACAAGAAGGCGGCCCTCGTCCTCATCCCTAACGATGTTGACCCCATTGAGCTCGTCATTTTCCTGCCC
GCTCTCTGCCGAAAGATGGGCGTTCCATTCGCCATCATTA

> SEQ ID NO: 6790 216180 208005_300831_1b
GGGGGGGACGATGCGGCGCATGTACCAGGTGTGCAAGCTGGTGCACGCCGATCTGAGCGAGTACAACATCCTCTACCAC
GACGGCAAGCTGTACATCATCGACGTTTCGCAGAGCGTGGAGCCGGACCACCCGCGGTCGCTCGAGTTCTTGCGCATGG
ATATCAAGAACGTGGGCGACTTCTTCCGGCGCAAGGGCGTCGACACGCTGCCTGACCGGGCCATTTTCAACTTCATCAC
CGTGCCTGAGGGGCCGGTCGAGGAGCCCTGAGCTGGCGGAGGCGATTGCCAAGTTATACGAGACGAGACTTCCTGCTGCG
AACGAGGAGGAGGCTGCTGCTGAGGAGGTGGACACGGAGGTTTTCCGGAACCAGTACATCCCGCAGACGCTGGAGCAGG
TGTATGACATTGAAAAGGATGTCAAGAAGCTCGGTCTTGGAGAGGGCAATGAGTTGGTGTACAGCAAGTTGCTGGCTGA
CCAGGTTGTTGCGCCCAAGGCAGACGGCGAAGGAGAGGATGAGGATGAGGAAGATTCGGACGATGAGTCGGGCGAGGGA
GCTTCCCTTGGCAGTGATGATTCTGAAGATGATGAGAGTCGGTTTGACAAGGGACGGCCGAGAGGTCGCAAGTTTGAGG
ACAAGGACGAGAAAAAGCAACATA

> SEQ ID NO: 6791 216196 226504_300998_1b
AAAATGTCTGATTCTGAAGTTATCGCTGAAGTTGAGGTTGCCGCCGCTGCTCCCTCCGGAGGACTTACCCTCGAGGATG
CCCTCAAGACCGTCCTGAAGAAGGCTGTCATTAACGACGGTCTCGTCCGAGGTCTGCGAGAGTGCTCTAAGGCCCTTTC
TCGACGAGAGGCCGAGCTCTGTGTCCTGTGTGACTCTGTCACCGACGAGTCTTACCTCAAGCTCGTTGAGGCTCTTTGC
AACGAGCCCGAGGAGAAGATCCCCCTTGTCAAGGTCCCCGATGCCAAGCAGCTCGGTGAGTGGGCTGGTCTCTGCCAGC
TCGACCGAGAGGGTAACGCCCGAAAGGTCGTCGGTGCTTCTTGTGTCGTCATCACCAACTGGGGTGAGGACTCCGAGGC
TCGACAGTTCCTCCTCGACTCCATTGCTTCTCAGTAAATGCGTTGCAATCAAAAGCGTAAGCAATAAAATGCCACATGG
CTTATTTAAAAAAAACAAAAAC

> SEQ ID NO: 6792 216196 1099056_301487_1b
GAAAGAGAAGCTCATCAGCAAGTCTGGTCCTGTTTGTCTCTCTGTTACACAGATTCAGTGAATCAAGGAGAAGCACCTT
ATTCTCTTCCTAATCATGGCTGCTATCGTTGAAGATGCTGGAGAGGTGCCCTCTCGCTCGGCGCCCACTCCTGTTCTTG
GGGAGCCAATGGATCTTTTGACGGCTTTGCAGTTGGTTTTGAAGAAGTCTCTTGCCCATGATGGGCTCTCGGAGGGCT
CCATGAATCTGCAAAGGCTATTGAGAAGCATGCTGCGCAGCTCTGTGTCCTGGCTGAGGATTGCAATCAGGCTGAGTAT
ACAAAGCTTGTCCAAGCCCTTTGTTCTGAGCACAATGTCAGCTTGATCTCGGTCCCCAGTGCCAAGAAACTTGGGGAAT
```

FIG. 2 continued

```
GGGCTGGGCTGTGCAAGATAGACCCCGAAGGGAATGCTCGCAAAGTTGTTGGATGCTCCTGTGTCGTTGTTAAGGATTA
TGGTGAGGAGACCGAAGGCCTGAACATTGTCCAGGAGTATGTAAAAAGCCACTGAGTTGAGAAGAGGAAAAGTCAATTA
TTAAGGAAAAATTACACTATTTTTGAGCGAAACTTTACTGCAATTGATTTTTCGAGTCAATGGGGTA

> SEQ ID NO: 6793 216207 254873_301639_1b
GCGCTGGTCAAGGAGGAGGAGGGAGGAAGAGGAAGAAGAGGAGGAGGAGGAGGGAGGTATCTGAGCGAGGTCTACCGCC
GATCACCATGCCTTCCCACAAGACGTTCCTGATAAAGAAGAAGCTGGCGAAGAAGCAGAAGCAGAATCGCCCCATCCCT
CACTGGATTCGTATGAGGACCGATAACACCATCAGGTACAATGCTAAGCGCAGACATTGGCGCAGAACCAAGCTTGGTC
TGTAAGCTGGATTGACAGAGATGTTTTGAATTCAGCATGCTGCAATGATGGAATGGTTCATTAATTTGAGAATTCCTGG
AATTAAGCATTTAAATTTTGGTTCACTCAGCACTGATTAAAATTTTGGAAAACAATACATTTCTTTGAATTTAGCTCAC

> SEQ ID NO: 6794 216207 233922_301095_1b
GGAGAGGAGAGCGCGAGCAGCCGCCATGCCGTCGCACAAGACGTTCCGGATCAAGCAGAAGCTGGGCAAGAAGCTGCGG
CAGAACCGACCCATCCCGCACTGGATTAGGATGCGGACAGACAATACCATCCGCTACAACGCGAAGCGCAGGCACTGGC
GAAGGACAAAGCTGGGTCTGTGAGTTTTAAGTTTGTCATCGAATGGGATCGATATTTCTTTTGACAGTAATGCTCTTAT
AAGTCGAGTTGTATTCGCATTTTTGTTTGTTGGTTCTTTTATTTTTATTTTTATTCTTTTTTTCTTGCACACTCAGGCA
TTTGGCTCTTTGGTAATGGATCTGTTCTTAGCGTCATGCCTGAAGAAGAAAAAAAAAAAAGTGTGTGCGAGACAGATTA
TTTCGTCACCACTTTGCACAGTGCAAAAGCCTCTATTTGCACTTGTGCTTTCTCAGTGACACACAGGAACGTTTTGGTT
GATTGGGTGCCAATGATGTCTAGTATGCACGTATTACCTGAAAAATCTGTGTGTAGTAAATTGACTCTACTCCTGAGGC
ATCCAATTTGTGTAACACACTATACCTAATATAAATTTTTAAAAA

> SEQ ID NO: 6795 216207 157425_301738_1b
GTCTTTCAGCTTCAGCAGCAGCAGCTCCAGCTCCCAGGAGGAATTCCCAACCGTGAAAATGCCGTCACACAAGACATTC
ATGATCAAGAAGAAGCTAGCAAAGAAGCAGAGGCAGAACAGGCCTATTCCTTATTGGATCCGAATGAGGACTGACAACA
CCATCAGGTACAATGCCAAGCGCAGGCACTGGAGGCGTACCAAGTTAGGATTTTAAGGTGGAGGATTTGAGTTTTGTTC
AACATTTTATGGAAAACTTTCTGGGGTTTTGGTATTTTCTACTTTTGTTTACTAGGAGCTTCTTCTGAAATGAAATCTA
GTAGAGTTTCTACTGATGTTTTGGTAAAAGTATTGGAGCTCAAGTTTCAGCAGAGTTTATGTATTAAATGACTATTTTT
GGATTTATTATGTTTTGTTGATC

> SEQ ID NO: 6796 216207 137068_300441_1b
CCGGGCTTCTCCGTTCCAAGGGTTTCCTCGGGCCCGCCGCCGCCATGCCGTCGCACAAGACGTTCCAGATCAAGAAG
AAGCTGGCGAAGAAGATGCGCCAGAACCGCCCCATCCCGTACTGGATCCGCATGCGCACCGACAACACCATCAGGTACA
ACGCGAAGCGCAGGCACTGGCGCCGCACCAAGCTCGGGTTCTGAGCTTGGGGAGGAGAGGAGGACGAGGCGCCGGACGC
CGCTGCCCTGGGAAGAAGAAGAAGAAGGAGAAGCTAGGGCTTATGGGTTGCGTCGTGTTCGTTTCGAGGTTTTGCCTGT
CCTGAAGAGACTATCAGTAGCTGTGTGTATCTTGGAGCATCATAATTTTGCTGATTAAAGAACCACTTTCTTATCCCNA
AAAAAAAAAAA

> SEQ ID NO: 6797 216207 121521_300358_1b
CCCACTTCACGCACCTAGGGTTTCGCCGCCGCCGCCGCCGCTTCTTCGTCCCCGCCGCGACGATGCCGTCCCACAAGAC
CTTCCGCATCAAGAAGAAGCTGGCGAAGAAGATGCGCCAGAACCGCCCCATCCCGTACTGGATCCGCATGCGGACCGAC
AACACCATCAGGTACAACGCGAAGCGCAGGCACTGGCGCCGCACCAAGCTCGGGTTCTGAGCTTGGGGAGGAGAGGAGG
ACGAGGCGCCGGACGCCGCTGCCCTGGGAAGAAGAAGAAGAAGGAGAAGCTAGGGCTTATGGGTTGCGTCGTGTTCGTT
TCGAGGTTTTGCCTGTCCTGAAGAGACTATCAGTAGCTGTGTGTATCTTGGAGCATCATAATTTTGCTGATTAAAGAAC
CACTTTCTTATCCTGCCTAAAGTTGTCTGAATTTTATCTCAGCTGCAGTGGATTGATCAGTTGAACTCCCTT

> SEQ ID NO: 6798 216207 1118248_301854_1b
GGAGGAGGGAGGAAGAGGAAGAAGAGGAGGAGGAGGAGGGAGGTATCTTAGCGAGGTCTACCGCCGATCACCATGCCTT
CCCACAAGACGTTCCTGATAAAGAAGAAGCTGGCTAAGAAGCAGAAGCAGAATCGCCCCATCCCTCACTGGATTCGTAT
GAGGACCGATAACACCATCAGGTACAATGCTAAGCGCAGACATTGGCGCAGAACCAAGCTTGGTCTGTAAGCTGGATTG
ACAGAGATGTTTTGAATTCAGCATGCTGCAATGATGGAATGGTTCATTAATTTGAGAATTCCTGGAATTAAGCATTTAA
ATTTTGGTTCACTCAGCACTGATTAAAATTTTGGAAAACAATACATTTCTTTGAATTTAGCTCTCAAATCTTTCGTGCA
ATGAACCTCTTTTAAGATGATTACTCTGGTTGCTTCATTTTCCTGCCTGCCCGGTTGAAAATTGTGTGTTTACTCATCT
AGGTTCAGATGCTCTGGATACTACTACATCAAGTGTTTGTTTTGACTCATAATCACAATTTAATGTGTTCTTTT

> SEQ ID NO: 6799 216223 231530_301206_1b
GGGTTTTGTCGCAGCTCTTGTTACCATCGTTCCAGCGCGCACAGCGCCTTTGGGCTCACCGTCCTCGCCACCCGGAGTA
GCGGCGGCGGCGGCGGCGGCGGCGGCGGCGGCATTGGATCCGCCCCGGCAACGGCGGCGGCGGCAGCAGCAGCAGT
AGCAAGAGAAGGAGGTTCGTTTTCCGCAGTAGCAACCCTGGCGCAGAAGATTGGCAAGTCGATTCGAGGGCCTGGCGCC
```

FIG. 2 continued

ATGTCCAAGGCGCGGGTCTATGCCGATGTGAACGTTCTTCGCCCCAAAGAGTACTGGGACTACGAATCGCTCTCGGTCG
AGTGGGGCGACCAAGAAGAGTATGAAGTGATTCGAAAGGTTGGCCGAGGCAAATACAGCGAGGTGTTTGAGGGCATCAA
TTGCGTCAACAACGAGCACTGCATCATAAAGATCCTCAAGCCTGTCAAGAAGAAGAAGATAAAACGAGAGATCAAAATT
CTCCAGAATCTCTGCGGTGGGCCAAACATTGTCAAGCTTTTGGACATCGTCAGGGACCAGCAATCAAAGACGCCCAGCC
TAATCTTCGAGTACGTGAATAACACAGACTTCAAGACGTTGTATCCGACGTTGACGGACTACGATATTCGCTATTATCT
GTACGAGCTGCTCAAGGCATTGGATCACTGCCACTCGCAGGGAATCATGCACAGAGACGTGAAGCCTCACAATGTGATG
ATCGACCACGAGCAGCGCAAACTGCGTCTGATCGACTGGGGCCTGGCAGAATTCTACCACCCTGGAAAGGAGTACAACG
TTCGCGTTGCTTCAAGATACTTCAAAGGCCCGGAGCTGCTTGTTGACTTGCAGGACTACGATTACTCCCTGGACATGTG
GAGTCTGGGTTGTATGTTTGCTGGAATGATATTTCGTAAGGAACCATTCTTTTATGGTCATGATAATCACGATCAGCTG
GTGAAGATTGCCAAGGTGTTGGGCACGGACGAGCTGAATGCCTATTTGAACAAATACCACCTGGAGCTCGATGCTCATT
TCGAGAGTATGGTCGGAAGACACAGCAGAAAGCCGTGGTCCAAGTTTATTAACAACGACAACCAGCACCTGGTGAATCC
TGAGGCTCTGGATTTTCTGGACAAGCTGCTCCGCTATGATCACCAAGATCGACTCACTGCTAGAGAGGCCATGGCGCAT
GCGTACTTCTATCCGGTACGTCTTGCGGAATCAAACAGCAGGAGGAGCTACCTGGAAAT

> SEQ ID NO: 6800 216223 272124_200041_1b
GGATTATGAAGCCCTTACTGTTCAATGGGGTGATCAGGATGACTATGAGGTTGTTAGGAAAGTTGGAAGAGGAAAATAT
AGTGAAGTTTTTGAAGGTGTAAATGTTAACAGCAATGAAAAGTGCATAATCAAGATCCTGAAACCCGTTAAGAAGAAAA
AGATCAAGAGAGAGATAAAAATCTTGCAGAACCTCTGTGGCGGACCAAACGTTGTCAAACTCCTTGATATCGTCAGAGA
TCAGCACTCAAAAACTCCAAGCTTAATTTTTGAGTTTGTGAACAGTACAGATTTCAAAGTACTGTACCCAACATTAACG
GATTATGACATCCGGTACTACATATATGAGCTTCTCAAGGCACTAGATTATTGTCATTCACACGGAATAATGCATAGAG
ATGTCAAGCCCCATAATGTTATGATAGACCATGAACTGCGGAAGCTTCGCTTGATAGATTGGGGTCTTGCTGAATTTTA
CCATCCAGGGAAAGAATATAATGTCCGTGTTGCTTCAAGATACTTCAAGGGCCCTGAACTTCTAGTTGACTTGCAAGAC
TATGACTATTCTTTGGACATGTGGAGCCTTGGCTGCATGTTTGCAGGAATGATCTTCCGCAAGGAACCTTTCTTTTACG
GTCATGATAATCAGGATCAGCTTGTCAAAATTGCAAAGGTACTTGGGACAGATGAGTTGAATGCATATTTGCACAAGTA
TCAATTAGAGCTTGATCCTCAGCTAGAGGCTATGGTTGNGAGACATAGTAGGAAGCCGTGGTCCAAATTTATTAATGCA
GACAATCAGCATCTAGTGTCACCAGAGGCTATAGATTTTCTTGACAAGCT

> SEQ ID NO: 6801 216223 283044_200091_1b
AATCCATTACCCAAATATATAACATTCCCTTCCCTCGTTTGATGGCCGTACGGCCATTTCACTTCTTTGTTTCATTCCG
CCACCACCACAACCATCGCCTCCTCTCTCCTTTCCCGGCCACCTCTTCTCTCTTCCCCTCTCTCCTCCGTCAGTTTTCC
TCGAAAACTCCGTCGCTCTCTCTCACCCGACTCAAACACAAATCACCTTCTTCGTTACCTCCGCCGTCACCGTCATCTC
CTTATCTTCATCGACCGTCGGCGACTTTATCCGAAACCCTGGCGCAGAAAATAGGGAAATCTATTCGGCGTCCCGGTGC
GCCGTCCAAGGCCCGGGTTTATACGGACATCAATGTGATCCGACCCAAAGAGTATTGGGATTATGAATCCCTTACTGTT
CAATGGGGAGAGCAGGATGATTACGAGGTGGTAAGGAAAGTCGGGAGAGGAAAGTACAGCGAGGTTTTTGAGGGAATTC
ACACTACTAATAATGACAAATGCATCATCAAAATCCTTAAGCCTGTCAAGAAGAAAAAGATCAAACGTGAGATTAAGAT
ACTGCAGAATCTTTGTGGTGGACCTAATATTGTGAAGTTACTCGATATCGTCAGAGATCAGCAATCGAAGACCCCAAGC
CTTATATTTGAATATGTGAATAACACAGATTTTAAAGTGCTGTATCCTAATCTTTCCGACTTCGATATTAGATATTACA
TCTATGAG

> SEQ ID NO: 6802 216234 215388_300880_1b
CCGCCCAGCGTCATCTTTCACAATGAGATCCTCCCCCCTTCACCCGATCTAGCCCTGCTCGTCTACAGCTTCTCATCTC
AAATCAAGGTTACAGATAGCCCCGTCCCGCTTCGCTAGCAAGAAGCGAGGCGCTACGGCGGGCGTCGAGGAAAAGATCT
TCGCACTCGGACACATCCTGGACGTCAATCTGAGTACGGCCATTCGCCTTGGCAAGAATGCTTGAGGGTGTCAGCAGTT
GTAGCCAGTATCTTAAGCTGACACGGACACCGTGCTCGGAAATTTTGTCAATGGCAGCGTCCGTAATAGACACACCCTC
TGTCGTGGCCCGGAGCTTGACAATCTTCTTAATCTCGTCTGCCGAGTATGGGAGGTGGGATGATGAGCATTCGGGCA
AGGAAGTCAGGAGGAATGCCATGAGCCGCGACAACGTCGTCGGTACCTCTTATTGTGGACATTCCACGGTTGGATGCCA
AAACCACAATGGGGGCGAGGTGTGATTCCAATGCTCGGTTTAAATAGGTGAAGCACTCCACGTCAAGCATGTGAGCCTA
TTGTAGTCCAGTGTTAGTATCTGATACCAGTAGATTAAAAAAAAAACAAAAAC

> SEQ ID NO: 6803 216234 244423_301558_1b
TCAACAACAAGGTGGCGGAGTGGAGAGAGGAAGGGAAGGCCGAGATCGTCCCGGGGGTTCTCTTCATCGACGAGGTACA
TATGCTCGACATGGAGTGCTTCTCGTTCCTCAACCGGGCGCTGGAGAACGAGATGTCTCCCATTCTCGTCGTCGCTACA
AACCGGGCATCACCAAGATCCGAGGGACCAACTACAAGTCCCCGCACGGGATCCCGATCGATCTCCTGGACCGGCTGC
TCATCATCTCAACGCCAGCCATACACCGAGGACGAGATGCGGCGGATCCTGGACATCCGGGCCGAGGAGGAGGACGTGGA
AATGTCCGAGGAGGCCAAGGAGCTGCTCACCAAGATCGGGCAGGAGACGTCGCTGAGGTACGCCGATCCATCTCATCACC
GCCGCGGCGCTGGCTTGCCAGAAGAGGCGGGGAAGGAAGTGGGCATCGAGGACATCAGCAAGGTCTACTCGCTCTTCA
TGGACGTGAAGAGATCGACGCAGTTCCTCATGGAGTACCAGGAGCAGTTTATGTTTAACGAGGTACCTGATGCTACCGA
TATGGTGGAAGGATAGATGGAAGTCGTCATGTCTAGCTGATTTACGTAGCTCTCTGCGAGAAGTTAGTAAAGATTTT

FIG. 2 continued

> SEQ ID NO: 6804 216241 258694_301698_1b
GGATCAAGACACACAATGCGAGCTTTCAGATCTGCCGCCAACTTCGGAGCTGCTTCTAACATCTACCGAAAGTCCTTCA
CCCCCGCTTCTATTGCCTCTAACCGATTTGTCTCTGCCAGAATGAGCTCCATCATGACCGACAACGCCCGACCTAACAC
CGACAAGGTTGTTCAGGACATTGCCGACTACATCCATGACTACAAGATCGACTCCTCCGTCGCCATGGAGACTGCTCGA
CTCTGTTTCCTTGACACTCTCGGCTGTGGTCTTGAGGGTCTCAAGTACCAGCAGTGTGCCAACATTGTTGGCCCCGTTG
TTCCCGGCACCATTGTGCCCAACGGAACCAAGGTCCCCGGTACCGACTACCAGGTTGACCCCGTCCGAGGTGCCTTCAA
CATTGGTACCATCATCCGATGGCTCGATTTCAACGACTGCTGGCTCGCCGCCGAGTGGGACACCCCTCCGATAACCTT
GGCGGTATCCTTGCCGTTGCCGACTGGCAGACTCGATCCGCCAAGGCCGGTCTTGAGGGCAAGGTCTTCAAGGTCAAGG
ATGTCCTCGAGGGCATGATCAAGGCCCACGAGATTCAGGGAGGTCTCGCCATCGAGAACTCTTTCAACCGAGTC

> SEQ ID NO: 6805 216249 212775_300843_1b
GCCCAATCGCCAAATACACAAATCCATTGAGCTACAAATAACAAGCAGCATGGACACCAAACCTGACACTTTCTCCTTG
GCCGTATGCGCCATGTTGACTTCTCCCGCAATCTCCGCTAAACGCTTCCAAACCCAAGCCGGGCTGCGTATGCTAAGAG
GAAAATTCTAACCGCGAAGAGTGAATGATCTTCTCAACG

> SEQ ID NO: 6806 216268 187871_300681_1b
CACAACCCAGCTGGTGAAAGAGAGGAACTTGAGAGTTAGCTAGCATGGCGGCAGCATTGTCGTTCCCGATCATCGACAT
GAGTCTGCTCGACGGGGCAGAGAGGCCCGCGGCGATGGGGCTGCTCCGCGACGCATGCGAGAGCTGGGGCTTCTTTGAG
ATCCTGAACCACGGCATCTCGACGGAGCTGATGGACGAGGTGGAGAAAATGACCAAGGACCACTACAAGCGTGTGCGCG
AGCAGAGGTTCCTCGAGTTCGCGAGCAAGACGCTCAAGGAAGGCTGCGACGACGTGAATAAGGCGGAGAAGCTGGACTG
GGAGAGCACCTTCTTCGTCCGCCACCTCCCGGAGTCCAACATCGCCGACATACCCGACCTCGACGACGACTACAGGCGC
CTCATGAAGCGCTTCGCGGCGGAGCTGGAGACGCTGGCGGAGCGGCTACTGGACCTGCTCTGCGAGAACCTCGGCCTCG
AGAAGGGCTACCTCACCAAGGCCTTCCGTGGCCCCGCGGGCGCACCCACCTTCGGCACCAAGGTCAGCAGCTACCCGCC
GTGCCCGCGCCCCGACCTCGTC

> SEQ ID NO: 6807 216268 1889_300334_1b
AATTCGGCACCAGGAAATTTTGAGAGTTTCCCAGTGGTTAACATGGAGTTGCTTAACACTGAACAAAGGGCTGCAACAA
TGGAGAAAATTAAGGATGCTTGTGAGAACTGGGGCTTCTTTGAGGTGGTAAATCATGGGATCTGTCATGAGCTTCTGGA
CACAGTGGAGAAGTTGACAAAGGGACACTACAAGAAGTGTATGGAACAAAGGTTTAAGGAAATGGTTGCAAGTAAAGGG
CTTGAAGCTGTTGAGACTGAAATAAAGGATTTGGATTGGGAAAGTACTTTCTTCTTGAAACACCTTCCTGTTTCAAACA
TCTCAGAAGTTCCTGATCTTGAAGATGAATACAGGAAAATCATGAAGGAGTTTGCTGAAAAGCTAGAGAAATTAGCAGA
GCAACTTTTGGACTTGCTCTGTGAAAATCTAAGACTGGAGCAAGGTTACTTAAAGAAAGCCTTTTATGGTTCAAATGGT
CCTACTTTTGGCA

> SEQ ID NO: 6808 216268 267836_200119_1b
GTCCGGGAGATTCCGGTGATTGACTTAGTAAGCTTGACGGCGAGGAGAGAAGTGCAACCATGGCACTTCTCCATACGCT
TGTGAGAAATGGGGCTTCTTTATGATAGAGAACCATGGAATTGACACTAACCTGATGGACAATGTGAAGCAGCTCGTGA
TTCAGCACTATGAAGCCAATATGAAGAAACGGTTCTATGAATCAGAGCTACCTATGAGCTTAGAGAAGAAAGAAAAACT
CAGCAACACAGACTGGGAAAGCACCTTCTTTCTTTGGCATCGTCCAAGTTCTAACATCTATGAGATTGAAGGTCTCTCA
AAGGATCTTTGCAACGCAGTAGATGGATACATTGATCAGCTGATTAATCTTGCTGAAAATCTTTCAGAACTAATGTGTG
AGAACCTTGGCCTAGAGAAGAAGTTACATTAAGGAAGCATTTTCAGGAAGCAAGGGTCCTTCTGTTGGAACAAAAGTGGC
AATATATCCTCAATGTACGCGCCCTGAATTAGTCAGGGGATTGCGTGAGCACACAGATGCTGGTGGTATCATTCTCTTA
CTCCAAGATGAACAAGTTCCTGGTCTGGAATTCTTTAAAGATGGACATTGGGTGAAAATTCCACCTTCCAAGAACAACA
GAATTTTTGTAAACACTGGTGATCAAATCGAATTTTAAGCAATGGGAT

> SEQ ID NO: 6809 216268 103453_300026_1b
TGGTATCAACGCAGAGTGCCATTACGCCGGGGACTCACAACAGAAATAGCTACTAAACAAACAGCAAAAGATAACCAGA
AAAGATGGCGACTTTCCCTGTTGTTGATTTGGGGTTGCTTCAAACTGGGAAAAGGGCTGAAACATTGGATAAAATCAAA
GATGCATGTGAAAACTGGGGTTTCTTTTGAGCTTGTGAATCATGGGATTTCCCATGAAGTGCTGGACACAGTTGAGAAGC
TTACTAAGGAGCATTACAAGAAATGCATGGAGCAAAGGTTCAAGGAAATGGTGGCAAGTAAAGGTCTTGAGGCTGTCCA
AACTGAGATTGATGATCTGGATTGGGAAAGCACTTTTTACTTGAAACACCTCCCTGTTTCCACTGTGTATGAAGTTCCA
GACTTAGAGGATAAATACAGAAATGTTATGAAAGACTTCGCGTTGAGTCTAGAGAAACTAGCTGAAGATCTTCTTGATT
TGCTGTGTGAAAATCTCGGGCTCGAGCAAGGTTATTGAAGAAAGCATTTTATGGTTCAAAGGGTCCAACTTTTGGTAC
CAAAGTTAGCAACTATCCTCCTTGCCCCAAACCAGAACTGATCAAAGGCCTACGTGCTCACACTGATGCTGGTGGCCTA
ATCCTGCTTTTCCAAGATGACAAAGTCAGTGGTCTTCAGTTACTGAAAGACGGTAATTGGATTGATGTCCCACCTATGA
AACACTCGATTGTTATCAACCTTGGCGACCAGCTGGAGGTCATAACAAATGGAAAGTACAAGAGTATTGAGCACAGAGT

FIG. 2 continued

TATTGCACAACAAGATGGCACTAGAATGTCAATTGCTTCATTTTATAATCCAGGAAGTGATGCTGTGATATTTCCAGCA
CCAGAATTGGTTGAAAAGGCAGAAGAAGAGAACAAGTTGAAGTATCCCAAATTTGTGTTTGAAGATTACATGAAGCTGT
ATGCAGGT

> SEQ ID NO: 6810 216268 11669_300291_1b
TACGCCGGGGACTCACAACAGAAATAGCTACTAAACAAACAGCAAAAGATAACCAGAAAAGATGGCGACTTTCCCTGTT
GTTGATTTGGGGCTGCTTCAAACTGGGAAAAGGGCTGAAACATTGGATAAAATCAAAGATGCATGTGAAAACTGGGGTT
TCTTTGAGCTTGTGAATCATGGGATTTCCCATGAAGTGCTGGACACAGTTGAGAAGCTTACTAAGGAGCATTACAAGAA
ATGCATGGAGCAAAGGTTCAAGGAAATGGTGGCAAGTAAAGGTCTTGAGGCTGTCCACACTGAGATTGATGATCTGGAT
TGG

> SEQ ID NO: 6811 216268 128550_300476_1b
AAAATACATAGAAAGATGGAGAGTTTCCCAGTGGTTAACATGGAGTTGCTTAACACTGAACAAAGGGCTGCAACAATGG
AGAAAATTAAGAATGCTTGTGAGAACTGGGGCTTCTTTGAGGTGGTAAATCATGGGATCTGTCATGAGCTTCTGGACAC
AGTGGAGAAGTTGACAAAGGGACACTACAAGAAGTGTATGGAACAAAGGTTTAAGGAAATGGTTGCAAGTAAAGGGCTT
GAAGCTGTTGAGACTGAAATAAAGGATTTGGATTGGGAAAGTACTTTCTTCTTGAAACACCTTCCTGTTTCAAATATCT
CAGAAGTTCCTGATCTTGAAGATGAATACAGGAATGTAGGGAAAATCATGAAGGAGTTTGCTGAAAAGCTAGAGAAATT
AGCTGAGCAACTTTTGGACTTGCTCTGTGAAAATCTAGGACTGGAGCAAGGTTACCTGAAGAAAGCCTTTTATGGTTCA
AATGGTCCTACTTTTGGCACCAAAGTTAGCAACTATCCACCATGTCCCAAGCCTGATTTGATTAAAGGCCTTAGGGCTC
ACACCGATGCTGGTGGAATCATCCTTCTATTCCAAGATGACAAAGTCAGTGGTCTCCAACTGCTCAAAGACGACAAATG
GATCGACGTTCCACCAATGCGCCACTCCATCGTCATCAACCTCGGAGACCAACTTGAGGTGATTACTAATGGAAAGTAC
AAGAGTGTGGAGCATAGGGTGATTGCTCAGCCTGATGGAAACAGAATGTCCCTAGCTTCGTTCTATAACCCGGGGAGTG
ATGCTGTCATCTATCCAGCACCAGAATTGTTGGAGAAAGAGAACAAAGTCATTTATCCTAAGTTTGTATTTGAGGACTA
TATGAAATTATATGCAGGTCTTAAGTTCCAGGCTAAAGAGCCAAGGTTTGAAGCAATGAAGGCTGTGGAAACTACTGTC
AACTCTGCCCCAATAGCTACTGTTTGAGACTTTGATGGAGTATTAATTAGAAAACTGATTAATGAGAAGAAAATGGCTT
AGTATTAAGATTATGATGATGTATTGATGAT

> SEQ ID NO: 6812 216268 132569_300447_1b
AAAAAGATAGGATCTGTCTGCTATTATTATCTAAGTCTGTTTAGGTTTTGTGTTTTTTATTACTACAACAACATAATGA
CTATTCCGGTGATTGATTTCTCAAAGCTTGATGGAGAGGAAAGAGCCCAAACTTTGGTTCAGATTTCCAAAGGTTGTGA
AGAATGGGGATTTTTTTCAGTTGGTGAATCATGGGATACCAGTGGAGCTGCTTGAGAGGGTGAAGAAAGTGTGTGCAGAA
TGCTTTAAGCTGGAAAGAGAAGAGGCTTTCAAGAATTCAACACCAGTCAAGTTGCTTAATGAGCTAGCGGAGAGCAAGA
AGAGTGGCAATTATAAGGTTGAAAATGTGGATTGGGAAGATGTCTTCCTTCTCACTGATGACAATCAATGGCCCTCCAA
CACTCCTCAATTCAAGGAGACAATGAAAGAATATAGATCAGAACTGAAGAAGCTAGCAGAGAGTGTGATGGAAGTAATG
GATGAAAACTTAGGCTTACAAAAAGGGTCAATCAAGAAAGCCTTCAATGAAGGAGAAGGTGACAATAATGCTTTTTTTG
GAACAAAAGTGAGTCACTACCCACCTTGCCCTCATCCAGAAATGGTGAATGGCCTAAGAGCTCACACTGATGCTGGAGG
TGTGATTCTACTCTTCCAAGATGATCAAGTTGATGGCCTTCAAATCCTC

> SEQ ID NO: 6813 216271 207867_300829_1b
GCAATAACACGGATACCTGGGACTGCCCTCACCATCTTTGCATTGTTGTATGCAGTTCGAAAGAGGCCCTATTTGATCA
CCTAAGTGAGATTCACAGCATTCCTACCGACTTGAAGTGGGAGGGTGGCGACAACCAGGATTCGACCAAGCGCAAACGC
AGCTCCAGTAGACGAGTATTTAGAAGCAAAGCTCCCGTTGACTTTTTGTTACAGTCCACATCTCCTACCAAGGACGCCG
ACAGCAATAATGCTATGAAATGGATAGCTGAGCCATCCAATACTCCTCTATCTGAAGAAGTTGCAACAAACGATAACAA
TTTGTTATCCCCGGCATGGGGTTATGCGAAGCCTCACAAAGACGAGATAATGATTGACCCGGAGTTATATAATACCAAG
ACCGACGACATGCCAGCTGCTGAGATACCAGAAGTTATCGATGGCCTGAATAGCCATGAAACACCCTTGGTTGATGATG
CATATGATGTTGATTGCATCCTTGCCAAATGGAAGGAAGGCCGAAGAATGTTATATCTTGTGAAATGGGGTGACGAAAC
AACGACCTGGGAACCGCATGAAGAGATTCTGAAACAAGATCTAATTACAGAGTTTGAAATAGGGTATAAGGGA

> SEQ ID NO: 6814 216276 209014_300811_1b
GACTCATCTATCGGAGGAGCTGTCACCATGAGTAAACGTGACAAGCGCAGCTCCGTCGCGGACCGAAGCGTTCTCTGGA
CCTCGCAGATGCAATCTCTTTACAAGACGGTGGAAGGGTCGCAAAAGTTTCTTCCAAACGCGATTGGGCGTCATGTGGT
TCTCAATGCTGGGCCTTGGATCGAATTGGACAATGCAACGTATAAGAGCAGAAGGGCCATGCAAATATTTCTGCTGAAC
GACCATCTCCTTATCGCCTCTCGAAAGAAACGCAAGGTGGATGCACCCAACGCAGATACCCGTGGACCCATGGTAAAGC
TCGTCGCGGACCGTTGTTGGCCCCTGCTCGACATCGAAGTCATTGAAATGCCAGGGACAGGCGATTCCATTGGCGGCCG
TACCAAGTTGGCCGACGCCATCATGGTTCGGGGTGGTGGCCAAGAGACGTTCATCTACCGCACGGAAAAGCCAGAAGCG
AGCGAGAAGAAGGCATTGATGATGAACGTGCGCAAAGCAGTGGAAGAGCTACGCAAAGGTTTGCAGTCTGAGATGGAGG
CCAATAACAA

FIG. 2 continued

> SEQ ID NO: 6815 216284 167909_300552_1b
GAATTCAGAGACTGATCCTCTCTCGCACATGGCAGTCAAATCAAGATGTTTACTGCAAGGAGAAAGATTTCGAAGGACA
AAGGTGCTGAACCAACTGAATTCGAGGAGTCAGTTGCTCAGTCGCTCTTTGATTTGGAGAACACTAACAATGAGCTCAA
AAGTGATTTGAAAGATCTATACATTAATTCAGCTGTTCAAGTTGATGTGTCTGGCAAAAAGGCAGTCGTCATCCATGTT
CCCTACAGACTACGAAAAGGTTTCAAGAAAATTCATGTGAGGCTTGTGAGAGAGCTCGAAAAGAAGTTCAGTGGAAAGG
ATGTGATTCTTATTGCTACCAGGAGAATAGTGAGGCCCCCCAAGAAGGGTGCTGCAGTTCAAAGACCCCGCAGCAGAAC
TCTTACCGCTGTACATGATGCCATGCTGGAGGATGTTGTTTATCCCGCTGAGATTGTTGGAAAGCGCATCAAGTACCGT
CTTGATGGATCAAGAATCATCAAGATCTTCTTGGACCCTAAGGAGAGGAACAACACCGAGTACAAATTGGAGACTTTCA
GCGGAGTTTACAGGAAGCTCTCTGGGAAAGATGTTGTGTTCGAGTACCCAATAACAGATGCTTAAA

> SEQ ID NO: 6816 216284 239125_301301_1b
TCTTTCGTCGCTGCGGCGCGTCTTCTCTCTCGATCTCCAGGTGATAGAGGGCCGCCGTCATGTCTGCGCGCAAGAAGATCC
AGAAGGAGGAGGGGAAAGAGCCGGATTCTTTCGAGCTCACGGTTGCCCAGGCTCTGTCTGAGCTGGAGGGCGCAAACCA
GGAGCTTCGAGGAGACCTGCGCGACCTCTCGATCAATTCGGCGATGGAGGTTGACGTCTCTAGCAACCGCAAGGCCGTC
GTGATCAACGTACCGTACCGCTTAAGAAAGGCGTACCAGAAGATTCAACCCAGACTGGTGCGAGAGCTTGAGAAGAAAT
TCAGCGGCAAGGACGTGATCTTGATCGCAACCAGGCGCATCCTGAGGCCCCCGAAGAAGGGCGCCGCCGTGTCTAGACC
GAGGAGCCGAACTCTCACCGCTGTGCACGACGCCATCCTTGAGGACCTGGTCTACCCCACTGAGATCGTCGGCAAGCGC
ATCCGGTACCGCTTGGATGGCTCCAGAATTCTGAAGGTTTACCTTGACCCGAAGGAACGCAACAGCACCGAGTACAAGG
TGGAGACGTACTCGGGCGTCTACAAGAAGCTGACTGGCAAGGATGTGGTGTTTGAGTTTCCCGTGCAAGAAACGGCCTA
GACTCGTAATGGAGCATTTCCCTTTTTTTGCTCTGATGAGTGGCTTAAGCGCTAAAAATTTTGACTTTTGGTTCTTAA
GTGGGGTTTCCAGTTTCGGGCCGGTTTGACGGCTTCTCGAATACATGGTTTTCCATTATGGGCGTC

> SEQ ID NO: 6817 216284 103410_300026_1b
TGGTATCAACGCAGAGTGGCCATTACGGCCGGGGGATCTTCTGTCAGAGCAAGTGATTCCGGCACACTCACAGATCTG
TCCGCTGTTGCCGAACACTCAGAGATCTGTGAAGATGTATACATCAAGGCAAAAGATTCACAAAGACAAAGATGCTGAA
CCTTCTGAATTTGAGGAGTCCGTTGCACAGGCTTTGTTTGACTTGGAAAACACCAACCAAGAGCTGAAAAGTGAATTGA
AGGATCTATACATTAATTCAGCAGCTCAAATTGATGTGTCAGGAAATAGGAAAGCTGTTGTTATTCACGTACCGTACAG
ACTGAGAAAAGCTTTCCGCAAGGTTCATGTCCGTCTTGTTAGGGAGCTGGAGAAGAAATTCAGTGGAAAGGATGTAATC
TTCATTGCCACCAGGAGGATAGTGAGACCCCCTAAGAGAGGCTCTGCTGCCCAGAGGCCCCGCAGCAGGACTCTTACTT
CTGTTCACGATGCTATATTGGAGGACTTGGTTGTACCAGCTGAGATTGTTGGGAAGCGAACTAGATATCGCATTGATGG
ATCCAAGATAATGAAGGTCTTCTTGGACCCGAAGGAGCGCAACAACACCGAGTACAAGCTGGAGACCTTTTCTGCAGTT
TACAGGAAGCTTTCAGGCAAAGATGTTGTGTTCGAGTACCCCATCACGGAGGCTTAAAACAAGATGTTGTGTTCGAGTA
CCCCATCATGGAATCTTAAAACATACAAAATAGTGCTCTTGATCTCTTTGATGCAGAACTATAATTAGTGGCTACTTCA
TAAAATTTTGGCATTTAAATTTTGTTTGGAAGGCAGAGGACTGTTAAAACTGTTTTTGAGTTTCTATGGAATTTTGTTG
CAATCTACTAGAAAGATAATCAACTTGTTTTAT

> SEQ ID NO: 6818 216284 111255_300053_1b
CACACACACACACACCAGCTCTGTAGTTGCCTCTTACCCGCAGATCTGTGAAGATGTACACGTCAAAGCAAAAGATTCA
CAAAGATAAAGATGCTGAACCTACTGAGTTTGAGGAGTCTGTTGCACAGGCTTTGTTTGATTGGAAAACACCAATCAA
GAGCTGAAAAGTGAATTGAAGGACCTATACATCAATTCAGCAGCTCAAATTGATGTGTCAGGAAACAGGAAAGCTGTTG
TTATCCATGTGCCCTACAGACTGAGGAAAGCTTTCCGCAAGGTTCATGTTCGCCTTGTTAGGGAGTTGGAGAAGAAATT
CAGTGGCAAGGATGTAATTTTTATCGCCACTCGGAGGATAGCTAGACCTCCCAAGAGAGGTTCAGCTGCTCAACGACCC
CGCAGCAGAACTCTTACTTCTGTTCATGATGCCATATTGGAGGACTTGGTTGTTCCTGCTGAGATAGTTGGGAAGCGCA
CTAGGTATCGCATTGATGGCTCCAAGATAATGAAGGTGTTCTTGGACCCCAAGGAACGCAACAACACCGAGTACAAGTT
GGAGATTTTTTCAGCCGTTTACAGAAAGCTTTCAGGCAAAGATGTTGTGTTCGAGTACCCCATCACTGAGGCATAAGGA
AACAAAATGCTTATCTTCATCAATTTGATGTGAAACTACAGTTTAGTGGTTCCTTTGAAATTTTGACAATTTCATTTTG
TTTAGAATGCAGAGAACCATGTGAAGTTTCTATTGATTTTCACTTATAAC

> SEQ ID NO: 6819 216284 159548_200025_1b
CTCAAACTAAACGTAGCTAGGGTTTCCCGCCGGCGCTGTTCCTTGCCTTTCTCTCACAGATCTGTGAAGATGTACACGT
CCAGGCAAAAGATTCACAAAGATAAGGATGCTGAACCTACTGAATTTGAGGAGTTTGTTGCACAGGCCTTGTTTGCTAT
GGAAAACACCAACCAAGAGCTGAAGAGCGAATTGAAGGACCTATACATCAATTCAGCCATGCAAATTGATGTGTCTGGA
AACAAGAAGGCCGTTGTTCTCCATGTCCCCTACAGGCTGAGAAAAGCTTTCCGCAAGATCCATGTCCGCCTTGTTAGGG
AGCTCGAGAAGAAATTCAGTGGGAAGGATGTAATCTTCATTGCCACCCGGAGAATAGCGAGACCTCCAAAGAGAGGTTC
TGCTGCTCAACGGCCCCGTAGCAGGACTCTTACTTCTGTTCATGATGCCATATTGGAGGATGTGGTTGTACCTGCTGAG
ATTGTTGGGAAGCGTGTTAGGTATCACGTTGATGGATCCAAGATAATGAAGGTATTCTTGGACCCAAAGGAACGAAACA
ACACCGAGTACAAGCTGGAGACTTTTTCAGCTGTTTACAGGAAGCTATCGGGCAAAGATGTTTTGTTTGAGTACCCCAT
CACTGAGGCTTA

> SEQ ID NO: 6820 216284 136857_300439_1b
CGGGAGGTGAAGGAGCGCACTGCGAAGCGAACCCTTCTCCGCCGCCTCCGCTCTTCGCTGCACGGTGCTAGCTCGCCGC
CGTCCGTCTCGCGCGCCTCAAGGGTTATCACAAGATGTATACAGCAAGGAGGAAGATCCAGAAGGACAAGGGTCTGGAG
CCAACTGAGTTTGAGGACACTGTTGCTCAGGCATTTTTTGACCTTGAGAATGGGAATCAGGAGCTGAAGAGTGACTTGA
AGGACCTTTACATCAATGGAGCAGTTCAGATGGATTTACCTGGCAACAGGAAGGCTGTTATTATTCATGTTCCATACAG
GCTGCGGAAGGCATATAAGAAGATCCATGTGAGGCTTGTTAGGGAACTTGAGAAGAAATTCAGTGGGAAGGATGTGGTT
CTGGTTGCAACTAGAAGAATAGTGAGGCCCCCAAAGAAAGGCTCAGCTGTTGTTCGCCCTCGTACCCGCACACTTACTG
CTGTTCATGATGGCATCTTGGAGGATGTTGTGTATCCAGCAGAGATTGTTGGGAAGCGTGTCAGATACCACTTGGATGG
TAGAAAAATCATGAAGATCTTCCTGGACC

> SEQ ID NO: 6821 216284 1110806_301539_1b
AGCTTTCTCTTCGGCCAGAGAAGATGTTTACCGCGATTAGGAAGATCCAGAAGGAGGCTGGGCAGGAGCCTGATGAGTT
CGAGGAGACTGTCGCTCAGGCATTGTTTGACCTCGAGAACTCCAACCAGGAGATCAAAAGCGATCTGAAGGATTTGTTC
ATCAACTCTGCCAAGCAAGTTGACATATCTGGAAGCAGGAAGGCTGTTGTTATCCACGTGCCATACAGGCTCCGCAAAG
CATACAAGAAAATCCACCCTAGACTAGTTCGGGAACTTGAGAAGAAGTTCAGTGGAAAGGATGTTGTTTTGATTGCCAC
CCGGCGGATTCTAAGGCCTCCTAAGAAGGGTTCTGCAGCCACTCGCCCACGAAGCCGAACCCTTACTTCTGTTCATGAA
GCCATTCTTGACGACTTAGTCTACCCTGCTGAGGTTGTTGGGAAACGTATCCGGTTCCGCCTTGATGGCTCTCGAATCA
TGCGGGTGTACCTAGATCCCAAGGAGAGAAACAGCACGGAAGCAAAGCTCGAGACATTTTCAGCAGTTTACAAACGTCT
CACCGGAAAAGAAGTTGTCTTCGAGTACCCTGTCCAAGAAACTGCTTGAGGCACCCTTCTTGCACATTTTTGAATGTGA
GGTAGTTGAGCTAGATAACTTTGAATGGCATCTTTCCCTAATTTTGCCATCAATTTATGATGATGAGTCATCATCATCC
TCTTTTCAACATGCATTTTATAGATGTTCAAAATCCTACTTAATATTTACTCGGCAATATTTTTCTTAATGATCCATCG
AACTGTTCTTTAGTTAGTGTGCCTAATGTTATTGTTGCTACCAAGTTTCTTCTCAATATATCAAAGAGTTCGTTTGGGA

> SEQ ID NO: 6822 216286 220209_300953_1b
CCACGCGTCGGGCCAATTGGGCGTCCCCGCCATGGAGCGCCACAAGCAGGCCGTCACCAAAATCGCCGCCGCCGTCCGC
GGCTACTTTGAGCGCGGCGAGTCCTACCGCATCTTCCACGGCTCGACAAACAGCACGCGGCCTCGCCCCGGCCCCGGCC
ACCGAGCCGTCGACATCAGCGCCCTCAGCAACGTCCTGGCCGTTGATCGAGGCGCGCTTTCGGCGCTTGTCGAGCCCAA
TGTTCCCATGGACCGCCTGGTCGAGGCGACGCTCCGCCATGGCCTGGTGCCGCCTGTGGTGATGGAGTTTCCTGGCATC
ACGGCCGGAGGCGGCTTTGCGGGCACGGCGGGCGAGAGCAGCTCGTTCCGCCACGGCTTCTTCGACGAGACGATCAATT
ATGTAGAGATGGTGCTAGGCAATGGCGAAGTCGTGCAGGCTTCGCCCACCGAGAGGGCAGATCTGTTCCGCGGCGCTGC
TGGAGCTGTGGGCACGCTGGGTGTTACAACTCTGATGGAGCTCAACTTGATCGAGGCTCGCAAGTTCGTCCAAACTACA
TATCACCGCACAAACAGCGTAGCCGAAGCAGCAGAACGTGTCCGCGTAGAGACGCAAAACCCCAGCAACGACTACGTCG
ACGGCATCCTCTTCTCCAAGGACCACG

> SEQ ID NO: 6823 216314 210560_300890_1b
ACTGGCGGGAGGCGTGCTGACCTGATCGGACGGGACGTGTTCGAGGACGATGCGCCAACGCATTTGATGGCAACGGGTG
ATCCCGAGGGCGAAAGAAGGAGGCGTGAGAGTGTGTAACTGGTGATGATGAGATGGGATGAGATGAGCTGGGAATCTGT
CCTTGGACATCTTTGCTGACTTTATGAGTTGGATGGCTGGCACTCTCTTTCGGCGCAGAGACACCAGACACGTAGATAT
ACAGCGCCGTGGTCGGTATACGGGTACTTGCAGCGCAGAGAGTAGAGCG

> SEQ ID NO: 6824 216318 215590_300882_1b
GGATGGATACTTGCAGTAATATGGGGTAAGTGAGTGAGTGAGTGAGTGATATGGATACAGCGGGATGATGATGATGGTG
GTGGTGGTGGTGTTGTCACTGATGTTGTCGAGTGAGTTGTTTGTTTTGTTTACCTTTGGAATTGATTGAAATGAAATGA
AATGAAACAGCCCAATGCACAGCCTAAGTCCAAAGAAAACAAACC

> SEQ ID NO: 6825 216352 206746_300825_1b
CCACGCGTCGCCCACGCGTCCGCAGCATCCAACAGCATCTCCAAACCTCTACTCCTTAATCTCCAATCCTCTAGTCTTC
AAGACAAACCCCAAAAACTCCATTCAAAATGAAGTTCTTCACTGTTGCCACCGTCTTCTTTACCGCTGTCCTCGCTGCC
CCAGGCGGCTACTACCCTCCTCCTCCTCCTCCTACCTATACCCTGCCTCCCAATGGCAACGGCAACGGCAACGGCAACG
GCAACGGCAATGGCAATGGCAACACCAACACTGGCGGTTCTGCCCTGTGCCCTTCTGGCCTCTACTCCAACCCCAATTG
CTGCGCCACCGATGTCCTCGGCCTCGCTGATCTCGACTGCAGCGTTCCTTCCACAACTCCACACGATGGCGCTGCTTTC
CGAAGCATCTGTGCGGCGACTGGCAAGAGAGCTCGCTGCTGTGTTCTCCCCGTTGCTGGCGTAGCTGTTCTTTGCCAGG
ACCCCATTGGCGCCAATTAAAAGGCATCGCCAATATGACTCACGAGGTCCTTTGATGAATGTGTTATTGCACATGGCTC
GGACCTACGGTATCAACACTGAACACTGACTTGAACATATGAGTCGTGAGCTTTTGGATATATGGAATATGACGGTTAC
TTATCTTCTATCTAAGTTGGATATAGATTTGTATACACATGACGTACTTAGGCATAGTGTACCTGATAATCAACTAC

FIG. 2 continued

> SEQ ID NO: 6826 216352 217660_300910_1b
AACCCGCTCTTTCAATTCACTCGCTAAGTGCAGCTTCACTTCAAATTCACTCCTTTTATAATACTTTCCCTCGTTGTAT
ACAAACAAACAAACATCAGTCAAGATGCAGTTCTTCGCCGTTGCCGCTCTTCTCTTCACCGCAGCTTTCGCTGCTCCCT
CCACCGAGGCCCCCGCGGAACTCGCTCGCCGTAACGAAGCCTGGTGCCCCAGGGGACTGTACGCGGTCCCTCAGTGCTG
TGATACCGATGTCGTTGGTGTCGCTGATCTCGATTGCGTCGTCCCCCCTTTCGCGCCCAGCAAATGCAAGTCGTTCCAT
GGTGCCTGTGCTTCCATCGGCCGTCAACCCAAGTGCTGCGTCCTCCCCGTCGCTGGCCTGGCTGTTCTCTGCACCGATG
CCCTTCCTCCCGCTTTTTAAACGCACATTTACCAACTCCTCCCGGCCGAGAGTCGGGTCAATATCTGGGACAGGCTTTG
TACATTGAGCTTTCTGTTCGTGACGTGTTAATAATTCTATGTCGGCTCTGGATAAAGGACGGATGGAGAATGGAGGCTC
GGGTTAAAGGGATAAAC

> SEQ ID NO: 6827 216356 218413_300918_1b
TCAACATCCGGCCTTTTTTGGGGGTTTCTCTTGTGCGCGCCGTCGTATTCGTCAGATGTCACTGCAGCTGCGGGTTTCT
CGGGGGTTTCGCACGGTTGTTTTATCAACTCGTGGTCACAAGGACGATGTCAATCTCTTCAGCTTTACTGCTGGAGAGG
CACAGACGCACGAATGACTCTCTCATCGGAAGAACGAAGAAAGTGCACACCAAACCTATAATATCTAGTGTTGATCTTT
TTTTATTTCCAAAGACACCTCTCGTTTATATG

> SEQ ID NO: 6828 216360 238009_301291_2b
ATCATAAGTGGGGCAAAAAAAGGGTTCATGGCGAAGGCGCACGAATCCACTGCGGCACTCCTCTTCTTGATCGATTAGG
TCAGATCGAAGTAGGTCGATCGATTGATAGATAGATTGGAAAAGGATTGGCGAAGATGCTCGATGTGTCCCGCGTCCAG
AAGGCAGCTGGTGGAGATCGAGCGCGACAAGAAGCTGTCGGGCGTGAGCATTCAAGTCTTCGACGATGGGTTGAGTCGAA
TGCGAGGAACAATCACGGGGCCTGTTGGCACCCCCTACGAGGGCGGAATCTTCACCATCGATATTCAGTTACCTTCTGC
TTATCCTTTCGAACCACCAAAGATGCAATTCATGACTAAAGTCTGGCATCCAAACATCAGCAGCCAAAACGGAGCTATC
TGCCTGGACATTCTAAAGGATCAGTGGAGTCCAGCGCTGACGCTAAAGACTGCGCTACTGTCGCTACAAGCGCTGCTTT
CGACGCCGGAGCCGGGGGACCCTCAAGACGCGGTCGTCGCAAAGCAGTACCTGAGTGAGTATCCGGTTTTCGAGAGCAC
TGCGAGATACTGGACCGAAACGTTTGCAAAGAGATCGTCCCTTGGCATGGAAGAAAGGTAGCGAAGCTAGTCGAGATG
GGATTTACGGATGAGGTTGCGACCGCTGCTCTAGAGTGCTGTGGCGGCGACGAGAATG

> SEQ ID NO: 6829 216360 226366_300996_1b
ACGACACCAATTTTAAAAAATGGCTTTGAAGCGAATCAACAAGGAACTCAGTGATCTTGGACGTGATCCCCCCTCCTCT
TGCTCTGCTGGTCCTGTTGGCCAGGATCTGTTCCACTGGCAGGCTACTATCATGGGACCCTCAGACTCTCCTTACTCCG
GAGGTGTTTCTTTCTGTCTATCCACTTCCCCACTGACTACCCCTTCAAGCCACCAAAGGTGACCTTCACTACCCGAAT
CTACCACCCCAACGTCAACACCAACGGATCCATCTGTCTGGATATTCTCAAGGAGAACTGGTCTCCCGCACTCACCATC
TCCAAGGTGCTGCTGTCCATCTGCTCCATGCTCACAGACCCCAACCCTGACGATCCTCTCGTGCCCGACATTGGCCACC
TGTACAAGAACGACCGAGCACGATACGACGCCACTGCCAAGGAGTGGACCAAGAAGTATGCCGTCTAGGATGTATATAG
GGAGCAGGCATGAGCCTATGCAAGCGAATGGCTGTGACGATACAACTAGCCAATGTTAGATTTATGGATGGTAAAACAA
TGTGTGTCGAGGAAAAA

> SEQ ID NO: 6830 216360 104744_300367_1b
CCCACGCGTCCGCCCACGCGTCCGCCCACGCGTCCGCCCACGCGTCCGGCTCAGCATCTCTAGGCTTCAGCACTGCAAT
CTTCGTCTTTCTGCAAACTCAATTAATCCCCTCTACCACTCTGCCACCTTCAGATTTGAGCTTGGGTTTGAAGGTAAGG
AAGTAACATATGGCGTCAAAGCGCATATTGAAGGAGCTGAAGGATCTGCAGAAGGACCCTCCCACATCATGCAGCGCTG
GTCCTGTGGCTGAGGACATGTTCCATTGGCAAGCAACAATCATGGGGCCTACAGATAGCCCTTATGCAGGGGGTGTATT
CTTGGTTTCTATTCATTTTCCTCCTGATTATCCGTTCAAGCCACCTAAGGTTGCATTTCGAACTAAGGTTTTCCACCCT
AACATCAATAGCAATGGAAGCATTTGTCTGGATATTCTTAAAGAGCAGTGGAGTCCAGCATTGACCATATCTAAGGTCC
TGTTGTCCATCTGCTCTCTATTGACAGACCCAAATCCAGACGATCCTCTTGTACCAGAAATTGCTCATATGTACAAGAC
TGACAGGTCCAAATATGAGGCCACTGCTCGTAGCTGGACACAGAAATATGCCATGGGATAATAGCAAAAGTGTCACCGG
GCATGTCAGAGACTTTGTAGCTGCACCGTCTTAATTGTGCTTGGGTG

> SEQ ID NO: 6831 216360 1113883_301841_1b
TCTTTCTCTCCTATCTCTCTCCTCTCTCTCTCATGGCTTCCAAAAGGATTCAGAAGGAGCTGAAAGACTTGCAGAAG
GACCCCCCCACATCATGCAGTGCAGGTCCTGTTGCGGAAGATATGTTTCACTGGCAGGCAACAATTATGGGACCAGATG
ACAGTCCTTATAGTGGTGGTGTGTTTTTGGTGACGATTCATTTCCCCCCAGATTATCCCTTCAAGCCCCCCAAGGTTGC
TTTTAGGACCAAGGTTTTCCACCCAAACATCAACAGCAATGGGAGCATTTGCCTGGATATATTAAAAGAGCAATGGAGT
CCAGCTCTGACAATATCTAAGGTCTTGCTTTCAATCTGCTCACTTCTCACTGATCCAAACCCGATGATCCTCTGGTAC
CTGAGATTGCACACATGTACAAGATAGACAGAGCAAAATATGAAGGTATTGCAAGGAGTTGGACACAGAAGTATGCAAT
GGGTTGAGCCTTTTTTTCGGCAAAAGATAACAACTTTTATCAGTCTATCTCATATCTAAAAGAATCGGTTTACAACT
TTCTGTTTCTGCATCTTGTTGGTCCAAAGCTCAAATCACACGTGTATCTTTACTTTCATAGCCAAGGAGTTGATATAGA
AGTAGTGCAAGGAACAGGTAC

FIG. 2 continued

> SEQ ID NO: 6832 216360 110920_300048_1b
CCCACGCGTCCGGTCGTTGCTTAATTACTGTTCATTCACAGGAGGATCCTAATCTCTTTCAGGAGTCGCTATGGCTTCA
AAGCGGATCTTGAAGGAGCTCAAAGATCTTCAAAAGGATCCTCCTACTTCGTGTAGTGCTGGACCTGTTGCTGAGGACA
TGTTTCATTGGCAAGCAACGATAATGGGTCCTCCAGATAGTCCTTTTTCTGGTGGTGTTTTTCTGGTGACGATTCATTT
TCCTCCAGATTATCCATTCAAGCCACCTAAGGTTGCTTTCAGGACAAAAGTTTTCCACCCAAACATAAACAGCAATGGG
AGCATATGCCTTGACATTTTAAAGGAACAGTGGAGCCCTGCCCTAACGATTTCCAAGGTGTTGCTTTCAATATGTTCTC
TTTTGACGGACGCCAATCCTGATGATCCTTTGGTCCCAGAGATTGCACACATGTACAAGACAGACAGGAACAAGTATGA
GACAACTGCAAGGAGCTGGACCCAGAAGTATGCCATGGGCTAAACGTACCTTTGTATCATGGGGTCAAGGGCATTTTAC
TTTCAGATACTTCACTATTTACATTCAATGTACTAATCTGTTCTTTGAGTTGTAACATGGAGTCCATGTCTTAAGAGGA
AAGGAAAATCATGGACGCTGCTCCTAAAAGTTTGTATGTGCAAATTGATCTTTGAAAGAAACCAATTAATTAGACTTTT
CTTTC

> SEQ ID NO: 6833 216360 6887_300090_1b
CCCACGCGTCCGCGCACGGTGATATTGAGAATCGCCGACCTGAATCGATCGGAAAACTTTCTCTGATTACCGGCGGTCA
ACACCGCTGAACACATATGTTTGTTTGACGACCTCTTCTCTCCGCGATCTTTACCTCAACAACGAGATCTGTTTCCACG
AAAGAAAGGAGGATGTCGACGCCAGCAAGGAAGAGGTTAATGAGGGATTTCAAGAGGTTGCAGCAAGACCCACCTGCGG
GTATTAGTGGTGCTCCACAGGACAACAACATTATGCTCTGGAATGCTGTCATATTTGGGCCTGATGACACACCATGGA
TGGAGGTACTTTCAAACTCTCACTGCAGTTCTCTGAAGATTATCCCAATAAACCACCAACAGTTCGGTTTGTGTCACGG
ATGTTTCATCCTAATATTTATGCAGATGGGAGTATCTGCTTGGACATTCTACAAAACCAGTGGAGTCCAATCTATGATG
TTGCTGCTATACTTACCTCCATCCAGTCCTTGCTCTGTGACCCTAATCCGAATTCTCCTGCAAACTCGGAAGCTGCTCG
GATGTACAGCGAAAGCAAGCGCGAGTACAACAGGAGAGTGCGTGATGTTGTTGAGCAAAGCTGGACTGCTGACTAGTAG
TAGTTTGTTGTAAGCGTTGTAGCTCTCTACTTTCTCTCAATCACGATTCAGCAACAGCTTCTTCTCTTTTCATTCA
TGTCTTGTGTTTCCAAAACTATTTAAGTGATTCCATGCTTTGATGTAACCCAACATCCTTAAAAAAACAACTTTGTTCC
ACAC

> SEQ ID NO: 6834 216373 6687_300347_1b
CCCACGCGTCCGCTTTACCCTTTCGAGAAAAAAGAAAAGAAAAAAGAACTTGTTTTCCTCTTCAGCAAGACACATAAAT
CGTAATCCATTTTCTCTCAACTTTAGGAATCTCAAATCTCCGATTTGGAAATCCGGCGACAATGGTGAGAGATATTGAA
GATGAGATTAGAGACGAGAAGAATCCTCGTCCTCTTGATGAAGATGATATCGCTCTCCTCAAGACTTATGGGTTAGGGC
CTTACTCTGCACCTATCAAGAAAGTGGAGAAAGAAATTAAGGATCTCGCCAAGAAGATCAACGATCTATGTGGTATCAA
GGAGTCTGATACTGGTTTAGCTCCTCCCAGTCAATGGGATCTTGTATCTGATAAGCAAATGATGCAAGAAGAGCAACCT
CTGCAGGTTGCGAGATGCACAAAGATTATAAGTCCAAACACTGAAGACGCCAAATACGTCATAAATGTCAAACAAA

> SEQ ID NO: 6835 216387 218772_300936_1b
GGGGTGCGATGTGAGGCTGATTTGGGGTGTATGATTCGTGAGCGTGTAAGAGGAGGCAGCC

> SEQ ID NO: 6836 216403 211095_300895_1b
GGCTGCAAATCCAGAGGCGAGACATTGTTAGAACCAACTCAGCGGGAGTCCGATTCCATACGAGTACTCGTATGAGGAC
ACTTGCTCACTGTCATATCTGAAGTCTTGAAGTGCTGC

> SEQ ID NO: 6837 216408 223888_300976_1b
GCTGGCAACACCCCTGCTCTGCGAAAGTCCGAGATTGAGTACTACGCCATGCTCGCCAAGTGCACCGTCCACCACTTCC
AGGGCGGCAACAACGAGCTCGGTACCTCTTGTGGTCGACTCTTCCGAGTTGGCGCCGTCACCATCATGGATGCCGGTGA
CTCCGACATTCTGACTGCTGAGCTTTCTTAAGCAGTTTGAAGACCCCCAAAATAAAAATTAATGTACTTTAGTGCCG

> SEQ ID NO: 6838 216419 206771_300825_1b
AGGGGGTGATATTGGAATACCTAGGGACGCCTCTCAAACCGGCCTGTTCCATGAAGGAAACCCTGCAGCAGCGCCGTTA
GACTGACCTGACTTGACGAAAGCACCGGTCGAGACAGGATGAATTTGCGCAGCCGGGCATCGCAGCCGCACCCGCAGCG
CATCGCATCGCATCGCATCGCAGCGCATCCAAGCACAAGGCCGGTCCGGGTCCGGCCCAGCCAGCCTGCTTTTTTT
CATCATCTTCTTTTTGTTTCGGCGCCCCTCATGATATCAGTCCAGTGACGCTAGAGCAGGTGTCACATGGCCGATGACA
ACAACGTGGTGGTGCAGCTAAGCTCCGGCTAGCTGTTATCTGGCGACGGAATGTGTGTGATGCCATTGGGTGGTGTTGC
GAATGGCTGCTGGTTCGCGCGGGCTCACACTCACACCATCCATCACCAACAGCCCAATGACCTGTTCAACGTCCCTTGC
CCCATACGGTACTGTACATACATGTACTCGTGCAGTCCAGTCCAGACAATCTCGCTGACGGAGGGGCGCGCCACAAGTG
GAATCAATGGAGTGATCCAATGTGAAGGCATTTCTGTCTTCTTGGACAGGCAGGGGGTAGCAGTACCTGCACGCACTGC
AGCGCATTTTAGCGCCGCTCCGTACTTGTACATGAGAAGGGGGTCCAGCGCGCCACTTTTGTGCAGCCAAGTGCCATCT
CGGTACTTGATTGCGAGAGGCTACTTTTGGTTGGTTCCCTGCCAGCCCAGCGTCGTGCGAAATGTGCTCCATCCCCATC
CCATACGCAATGTTGCCGCATCGCAAGCAACCCTCATCGCCTGTCCTGGTGCGTTTTCAGCAGGTAGTACTCCGTAGTT

FIG. 2 continued

GCACTGTAACGGTACGGTAGGGAGGAGCCGCGGGAGGAGGAGCATCGTGATGTTCCCCTCGCTGCGTCGAAAGAGGCAA
ACAGGGCCAGAGTGAATCGAGATGGCCCTTCGTCCCACACTGCCGGACGCGTGGGCGGACGCGTGGGCGGACGCGTGGG
CGGACGCGTGGGCGGACGCGTGGGCGGACGCGTGGG

> SEQ ID NO: 6839 216425 112451_300002_1b
CCCACGCGTCCGGTCGGATCCTCCATTGCTTCAGCGATCACACCGATGCTGGAGTGTCAACGACAAAGCAGAGAGAGGG
TTTAATGGGCAAAACCGAAAATCTATAATTCTTCAAATTTCTGGATTTTGATTTAAGTGGTATTTCAGATTGGGGATCG
TATATTGAAATTTCGAGTGGTTGATTGGGTTTACAGGAGGATGGTGCTGGTATTAGCATTGGGCGATCTTCACATCCCG
CATAGGGCTGCTGATCTTCCAGCTAAGTTTAAGTCTATGCTTGTTCCTGGAAAGATCCAACATATCATCTGTACTGGTA
ACCTATGCATTAAAGAGGTTCATGATTACTTAAAGACTCTTTGTCCTGACTTGCATATTGCTAGAGGCGAGTATGATGA
GGAGACACGTTACCCCGAGACCAAGACGCTAACAATTGGTCAATTTAAGCTTGGATTATGCCATGGCCACCAGGTTATT
CCATGGGGTGATTTGGACTCATTAGCCATGCTTCAAAGGCAATTGGATGTAGACATACTTGTGACTGGCCATACCCATC
AGTTCACAGCCTACAAACATGAAGCAGGGGTTGTTATAAATCCAGGATCTGCTACTGGTGCCTACAGTAGCATCACATA
TGATGTTAACCCTAGCTTTGTTCTAATGGACATTGATGCCCTGCGTGTTGTGGTCTATGTTTATGAACTCATCGATGGA
GAAGTCAAAGTTGACAAGATTGATTTCAAGAAGACAACAACACAGAATGCTAATTGAATAGCATAACTTGAAATTCAGC
TGATTNTAGTGGAATCCTGAAGTCGATAAGACATTATATTCCTCTGTCTGC

> SEQ ID NO: 6840 216427 1097346_301443_1b
GGAGTAAAGGAGGATCTGAGGAGGTCGAAACGATGCTTTGATTCAGTTGAAGGGCATTGAAATGTGCAGTATCCAGCCT
GAGGGTGTACACTTGTGCACTTATTGTAGATGTTGCTAAGTTGATTCCCAAGAAAAACAGAGTGGAGGTGTACAGATAC
CTCTTCAAAGAGGGAGTGCTGTATGCAAGAAAAGATTTTAATCTTCCGAAGCACCCAGAAATAGATGTGCCCAATCTTC
AAGTTATCAAGTTGATGCAGAGCTTCAAGTCAAAGGAATATGTGAAGGAGAACTTTGCATGGATGCACTACTACTGGTA
TTTGACAAATGATGGGATTGAGTACCTCAGGACGTACTTAAACTTGCCATCTGAGATTGTTCCAGACACTTTGAAGAAG
TCAGCAAGGCCTCCGGGTCGCCCCATGGGTGGCCCCCCTGGAGGGGACCGTCCTAGAGGACCACCTCGTTTTGACGGAG
ACAGGCCAAGGTTTGGTGATCGTGATGGGTATCGTGGTGGTCCTCCTCGTGACTCTGCTGGATTTGGTGACAAGGGAGG
TGCACCAGATAGTTTTCAACCATCCTTCCGGAGTCGTCCTGGCTTTGGTCGTGGCGGT

> SEQ ID NO: 6841 216427 128837_300478_1b
CGGACGGTGGGCTGCAATCGTCTGAGGCTTCAGAGTGATTTCTCTCAGTTATCCGCTCTCTTCTTGCAGCAGCCATGAT
TATTTCAGAGAAAAACCGTAGAGAGATCTCCAAATACCTCTTCCAAGAGGGAGTATGCTATGCCAAGAAGGACTACAAC
TTGGCGAAGCATCCATTGATCGATGTGCCGAACCTCCAGGTGATTAAGCTTATGCAGAGCTTCAAATCTAAGGAGTACG
TCCGCGAGACGTTCGCCTGGATGCACTACTATTGGTACCTTACCAATGATGGTATTGAGTTCCTCAGGACTTACTTGAA
CCTTCCTTCTGAAATTGTTCCTGCTACTTTGAAAAAATCTGCTAAGCCTCTTGGTCGTCCCATGGGTGGACCTCCTGGC
GATCGTCCTCGTGGACCACCAAGGTTCGAGGGTGATAGGCCAAGGTTTGGTGATAGGGAAGGCTATCGTGCTGGACCAA
GAGGTCCACCTGGTGAGTTTGGAGGTGAAAAAGGGGGAGCTCCAGCTGACTATCAGCCTGCTTTCAGGGGTTCTGGTGG
AAGACCTGGATTTGGTCGTGGATCTGGAGGTTTTGGTGGTGCACCCCCTAGTTCAAGCTTCTCTTAAGTCCTTGCTATC
TTAGGCTAGGTGGTTGCAATTTTGATTATCAGATGGAAACACTTGGTTGTTCATTTTCTTGTCAAACTTAAAATTCCAA
GCTGGGAAAGTTTATCTTTATGGGTTTTTAGAGAACTATAAGTTTTACTTCTGTTTCT

> SEQ ID NO: 6842 216427 128824_300478_1b
CCCCCAGTCCGTCCCTTTGCTGCTGCATTTGGGTGGAGGCTTCAGTTGATTTCCCACTTCTCCTCAATTTTCGAGCAGC
TATGATTATCCCAGAGAAGAACCGGAGAGAGATCTCCAAGTACCTCTTCCAAGAGGGAGTATGCTTTGCAAAGAAAGAC
TACAACCTGGCAAAGCATCCGAATATCGATGTGCCAAACCTACAGGTGATAAAATTGATGCAGAGCTTCAAGTCGAAGG
AATACGTGCGTGAGACTTTTGCTTGGATGCACTACTATTGGTATCTGACCAATGATGGCATTGAGTTCCTCAGGACTTA
CCTCAATCTTCCTTCCGAAATTGTCCCTGCTACTCTCAAAAAGTCCGCTAAGCCTCTTGGTCGTCCCATGGGTGGCCCT
CCTGGCGACCGTCCCCGTGGACCATCTAGGTTTGAGGGAGATAGGCCAAGGTTTGGTGACAGGGAAGGTTATCGTGCTG
GTCCAAGAGGTCCACCCGGTGAGTTTGGAGGTGAGAAGGGTGGAGCTCCAGCTGACTACCAGCCTGCATTCAGGGGTGG
TGGTGGAATACCTGGATTCGGGCGTGGGGCAGGAGGTTTCGGTGGTGCACCCCCTAGCTCAAGCTTCTCATAGATTGAT
CATATCTTTATTGTAGCTAGTTTTTATGCATTTTTGATAATCACATGTTGGAATTAACTTGCAGCGGTCGAAAGCACTT
GGTTCAATTGGGCATAAACTTCTTTATTGG

> SEQ ID NO: 6843 216427 1100565_301461_1b
ATTGTTTCTTCGCTCGCTTTCCGGAGTACCACGAGGATCTCAGCGAAGGAGCGATGTTGATTCCCAAGAAAAACAGGGT
TGAGGTGTACAGGTACCTCTTCAAAGAGGGGGTGCTATATGCCAGAAAAGATTTCAACCTTCCCAAACACCCTGAAATA
GATGTGCCCAACCTTCAAGTGATCAAGCTGATGCAGAGCTTCAAATCAAAGGAGTATGTGAAGGAGAACTTCGCGTGGA
TGCATTACTATTGGTATCTCACGAATGATGGTATTGAATACCTCAGGCAGTATCTCAACTTGCCTTCGGAGATTGTTCC
GGATACATTGAAAAAGTCGGCACGACCTCCTGGTCGTCCCATGGGTGGCCCTCCTGGAGATCGTCCTAGGGGACCTCCT
CGTGATGGTGACAGGCCAAGATTTGGTGACCGGGAAGGTTACCGTGGTGGTCCCCACGTGGACCTGGAGGATTCGGTG

FIG. 2 continued

ACAACAAAGGAGGTGCACCTGATAGCTTCCAACCATCATTCCGGAGTCGCCCTGGATTCGGACGAGGGGCTGGTGGCTT
TGGGAGTGGCGGTGAAAGCGGCCCTGCTTAAGCTTCTTCTCTGAGTAAAATAACCATCGGTTAGCTACTCAATAGCACT
TGGGGTACCCGACATGTCTTGCAATTGTGCTCCTTTATCAATTT

> SEQ ID NO: 6844 216427 258587_301697_1b
AAATGTTGATTCCCAAGGAAGACCGAAAGAAGATCCACCAGTACCTTTTCCAGCGTGAGTAGAGAGCGAGCGGGATTTC
GAAATTACACGACCGATATGGAGGACATGACTGACGACTTGTGGATGGATGGGACGACCTTTGATTTGCTGTGAACAGA
CAGCATACGACGACGCATAATGCAACGACCAATCTGTGGTAAAAGGGAGGAGCGATCAAAGTGAAGGAAGCCCGAATCA
GTCACAGTCGCTGTCAGAAACACCCTCCATCAATGAACATGTGGATGGTTCCGTCTTGCAACACTTTTTTGCAATTCAA
GCAGAAACAAGTTACTAACCATCAGAGGGCGTCTGTGTCGCTAAGAAGGACTTTAACCAGCCCAAGCACGAGGACATTG
ACACCAAGAACCTTTACGTCATCAAGGCTCTCCAGTCTCTGACCTCTAAGGGCTTCGTCAAGACCCAGTTCTCTTGGCA
GTACTACTACTACACCCTCACCGACGAGGGTGTTGAGTACCTCCGAGAGTACCTCCACCTTCCCGAGGGTGTTGTT

> SEQ ID NO: 6845 216427 259844_301709_1b
GGGTTCTTGATTGGCCGGCCCTAGTACAGCGGCAGCTTGGGAAGAGGCTGGAGGCGACGCCGCGAAGATGTTGATCTCC
AAGAAGAATCGCGTGGAGGTCTACAAGTATCTGTTCAAAGAGGGTGTGCTCTATGCCAAGAAGGACTACAACCTGCCCA
AGCACCCGGAGATCGATGTGCCCAATCTCCAGGTGATCAAGCTGATGCAGAGCTTCAAGTCCAAGGAGTACGTCAAGGA
GTCGTTCGCCTGGATGTACTACTACTGGTACCTGACCAACGATGGCATCGAGTACCTGAGGACCTTCTTGAACCTCCCG
TCCGAGATTGTCCCCGCCACGCTCAAGAAGTCGGCCAGGCCACCGGGCCGTCCCATGCCCCAGCAGCCTCCAAGAGGTC
CTCCACGATACGAGGGGGACAGGCCGAGGTTCGAGGACCGCAGGAGGACCAGGAGCCGCCCTCGAGGGGGTGGATTCGG
GGACAAGGGTGGAGTTCCACCAGAATTCCAACCTTCGTTCAGGGGTCCAAGAACTGGATTTGGACGTGGTGGCGGCGGC
TTTGGAGGCCCCAGTGCTCCCGGCGCTCTCACCGAGTAGAGAGTTTGTTTTTGTTGTGGATCACTCGCATGCTCTAATG
CTAAATTTGATGTGAACTT

> SEQ ID NO: 6846 216449 206630_300824_1b
GGGCGAAGATACGCAATTCCACAATCGCCATGGCGAAGCCGTATGTGCCGCATGACGTCCTTGACGAGACGGCCAAGAC
TTCATTGGTCGGCCTGGGCAGCGGCTTCTTCATTGCCGCCATCCAGAATGCCCTGTCGAAGCGCAACGTGGGCGCTATG
AGCGTCTTTACGCGGGGAGCTCCCATCATTGGCATTTGCTCCGGTGCCCTACGCCTTCTTCTCCCGGACGA
TGATGAACCTGCCGGACAAGGATGATGCTTGGGCCGCCGCCTTTGGAGGCTTCATGTGCGGCAGTGTCCTCGGACTTCC
TTTCCGACGCACACCCATCGTGCTGGCTCTTGGTGCTTTCGTTGGCACTGCCCAGGGCCTTTTCCACGTCACCGGAGGA
AAACTGGACAGCTTCTACAAGGAGGAGGATGAGTTTGAGCGCAAGGAGACTGTTAGACGGACAACCCGGTTGCCCGTTG
AGCAGACTATTGCCGAGCTGGGCGAGGGACGAGGCATCCGTCCTCCTGGATATGAGGAGAGAAGACGAGAGCGCATCAA
GGAAAAGTATGGCTTCGAAGTTAACCCTGTGAGCGCCACCGCTGAGGGTAGCCAATAAAATGATATCAAAAAAAAATAT
GAAAGAATTAAAGTCAGCTGCCAGAGATTTTTGAGGTGAGTTCTGCGGGCAGCTTGTACATATATCCCATCGCATTCCA
GTGCGGAAGAGATGCGATGCTAGATAATCGGATTTTTTTTTGTTTTCCAAAAAAAG

> SEQ ID NO: 6847 216474 211563_300900_1b
TCCTCCTCCCTGGTTCCAGACTGTTACCCGTCTCGGAATACAGCGAGACACGGACGACGGAGATCGGGAATGTGGGGCC
GGAGAATCCGATG

> SEQ ID NO: 6848 218915 218547_300967_1b
GAATCACTTATATGAAGCACTTGTCGGGACCTGGTTTGAACTCTTCCCTCTTCTTGATTCACCTCTCCCCCTACACAAC
ACTCTTCTTGCTCTTCCCAAGCCTTACTCTCCTTGGATGAGCAACGTGCTGCCCTCCCTTTACTGTCTGCTCCAGCCTT
TGAGCCCCATCGTTGCGTGCACCTGAGACGACGAAACGCCGTCATCAGCGCCCCTCTTAGTGTGCTGCACTACCACTAC
CACTTTTCTGCCGACGCATCATCGTCGACTGGGCACGTTCGCTCGCATCTCGAGGAACCACCGTCACGATTCCTCCCATA
ACAAGAAAACGAAAGGCTGCTGAGGCGACGATCACATCCACCGACTCTGAAAACACTCCCCAGAAGAAGATCGTCGCCT
CAGCTAGTCTCGCCGCTGCTCCTCCCACGCCCGTCACTACCCGCGAGATGGATTCCGAGGAAGAGTATCTGTCAAGCTC
TGATGAGTTGATGCCAGACGATAGCGGCGATGAAATGTCTGGTGCTGAAGATTTTGACGAAGATGACTTCGACGAACCA
GATCCCGATTTCGGCCTTTCCGCGAAAGATCTCGACAAGAAGAAGGTAGCCGCTCACGCGGTCTCCTTCAAAGTCTTCG
AGCCGTCCGACATTAGACGCCAACAGGATGACATGATGAATGAT

> SEQ ID NO: 6849 218932 204470_300817_1b
GGGCTTGGGAGATGAAAAGGGGCTTCTTTTTTATGTAGAGTAGAGTAAATACGTTTTGAGTTGGTCGGCGGCTACATGT
GGATTCCGGGCAAAGTTGCCAGAGCGATCAGTTCGACGATAATCAGGTTGGTGCTAAAATCACCCGCTAGCAGGGAAAA
GCATGAAACTAGCAGGATTGAAGCAAGAGAACCGAGGACTCGAGGCTTCACCCGAGAACTCACCGTGCTGTACGGGAAT
TAACGGCAGCAAGAAGACGGAAAAATAAAAAATGCAAAAGGAAAAAAAACTGTTGTGGGATCCAGTGTTCCAAGATTGT
TGAGACGGGAAATGTTGTCAATGTTGCAAAAAGCCAGGGTCTGCCACATCCCGTGCTCGAGGCGCCATCTAGGATTCGC
AGATCACATCCACTATGGAGCATATCAAGGTAGCATTAGAGCATCTCTAACACTGAATCTCGATGGATGACACATGAAA

FIG. 2 continued

GAAAAGATAAAAACAAGAAAACTTTTCAAATAATGGGGACTTCTTGATGTGGCATCAGCTTTCGAGGCGGTGGGCGATT
CAGCTTGTGATTTCCCTTATCTCTTGCGCTACTGTATTATGCCTCAAGACTTTTCGGTCTTTTGGTTTGGTTTTATTC
TCGTGCCCCCCCTT

> SEQ ID NO: 6850 218936 204339_300792_1b
GGATCACAAGACAAAGCCCTCGACGCCGAATAATCCGCATCTATACATTGCGCACATATTCCCAACATGCCGAACTCGT
GCCAGGAACTCCGCGATGCCCTCGCGCAATGCCTCCAGGAATCCGACTGCGTCATGATCTACCGCAACAAGGCCTCCGA
CTGCCTCCGCGAGCCCCTGTCGTCGACCCTCCCGACCAAGTGCCAGCAGCTCAAGAAGGGCTACGGCGAGTGCAAGCGC
GGCCTGGTCGACATGCGGAAGCGTTTTCGAGGGAACATGCCCGTGACGTATCGCTCGGTGGAGGCTTCGGAGCAGGGTA
AAGGATACCAGCTTTACGCGGGCAGGTCTGCGTTTGGAGGCGGCGTCAAGGAGACGGACGGCAATGAGCCGATTGAGCA
GGACTGGAGGGAGGCTGACAATGAAAAGTACCGGTTGGAGCAGCAGAGGCTGGCTCAGAGCGGGAAATAAAGAAACGGA
TG

> SEQ ID NO: 6851 218947 241634_301350_1b
TTGTGAGCGAGATTATGGGCCGCGAATCTGCCGCATTCATCGGGGCGATCGACCAGGGCACCACAAGCACTCGATTTAT
CCTCTACGATCGCGATGCGAAGGCCGTCGCGTCGCATCAGCTGGAGTTTGCGCAGATTTATCCCCAGGCCGGATGGGTG
GAGCATGATCCCATGGAAATCCTCAAGACCGTGAAGGTTTGCATGGAAGAAGCTTGCGGCAAGTTTGCAAGCAAGGGTG
TAAACTTCGATGTGGAAGCCATCGGGATAACGAACCAGCGCGAGACAACCATTGTGTGGAGCAAGAGCACTGGCAAGCC
TCTCTACAATGCCATTGTTTGGATGGATACTAGAACAAGCTCCATTTGCAAACGCTTGGAACAAAGTCTCTCTGGTGGA
AACAAGCACTTCGTTGAGAACTGTGGACTTCCAATAAGCACGTACTTCAGCGCTTTGAAGCTACTGTGGCTGCTGGAGA
CAGTCCCCGACGTGAAGTCCGCCGTGCTCTCCGGCGACGCTCTCTTCGGCACAGTCGATAGCTGGCTCATCTGGAACAT
GACCGGCGGCATCTCCGGCGGTCTTCACGTCACGGACTGCTCCAACGCTGCTAGAACCATGCTCATGGACCTCA

> SEQ ID NO: 6852 219006 219522_300946_1b
AGGGAGCGTCAAGGATCCAATTCCCCGTTATCGAGTACAAATCCGGAGCATGTCTTGCTGGAAGCTGAGTCTTCCTCCT
CTGTCTGTTCTTTCTCCATTCTGTGTCACTGTTGGCTGCTCTGTGATTGCCTATCCATAGCGGTCGGATATTGTCTCGT
ACTTCATCACGACCGTCACTTACATCACCTGGTATCACCAACCATCACTCCCTTTGTTTCATCCACTCCATCATCATCA
TGGCGCCCACTGGACCCATCACCACCCCCATCACCACCCTGTTGGGCATCCAGCATCCCATCCTCCTCGCCGGTATGGC
GCGCACTTCTGGAGGTCGTCTTGCTGCAGCAGTGTCCAACGCGGGCGGCCTCGGTGTCATTGGCGGGTTCCAGTACACG
CCCGAACAGCTTCGCGAGATCATTGCCGAGATGAAGGCAAACTTCAAGAGCCCGGACATGCCATTTGGTGTCGATTTGG
CGCTGCCACAAATTGGAGGCAACGCGCGTAAGACGAATCACGACTACACAAGGCGGCAAGCTGGACGAGCTGATTGACA
TCACCATCGACAGTGGCGCCAAGCTGTTC

> SEQ ID NO: 6853 219032 205877_300802_1b
GGCTAAGGGAGAGGCTCCGCCCGTTTGAGCTGGACATTTCGTCGAGCTAATGGATGATACAAGTTGGTTTTTAGTTGGT
AACGATCCAAGCTTAGGGCCCCCATCTGGCGGGAGGAAAATCTGATATGTAATGGGAATGACTTTGCACTATGGCTCTG
GTGGTACATGATAAGATGAGATGGGTGTAAGAAGAGAAAAGGAAGAAGGAGAAGAAACGACTAAGACAGTGAGAGAAAT
TGCCACATCCAATACTCCCTCTGTAAGGTTTTTTAACAAAAAAAAAAAA

> SEQ ID NO: 6854 219045 212568_300850_1b
TGCGGACGCGTGGGCGGACGCGTGGGTCCGGACGCGTGGGGACTAGATAGGTAGAGATGGTTTGGCGGTCAATGCTGTG
CTCGTTAGATGTCTCACGGGGGCCCGCATGTATCTCCATGTAGTTCCTCGCACGCAGCAAGAAAGAGGCAAAACCCGCG
CGGTGTTAGTAGCGTTTGCCATCGGAAGACGATCGCCCAGCACGTCAAAGAGGCCATTTGATCAGTTACTCGATTGGTG
CTCGCACGGGTTGGTTACG

> SEQ ID NO: 6855 219066 217602_300910_1b
CCCACGCGTCCGCAAGTATTCCTTACAATGGCTTCCGTCACCCGTCTCAGCAACTCTGCCCTGAGGGCTTCATTGCGAG
CCCCTGCCCGGGCCACGGCTTTCAATGCCACCCGCTGCTACTCCGCCAAGGCTCAGTCCCTCAAGGACCGCTTTGCCGA
GCTTCTCCCCGAGAAGATTGAGCAGATCAAGACTCTCCGAAAGGAGCACGGTTCCAAGGTCGTCGACAAGGTCACCCTC
GACCAGGTCTATGGCGGTGCCCGTGGTATCAAGTCCCTCGTCTGGGAGGGTTCCGTTCTCGACGCCGAGGAGGGTATCC
GATTCCGTGGAAAGACCATCCCTGAGTGCCAGGAGATCCTCCCTAAGGCTCCCGGTGGCAAGGAGCCTCTCCCTGAAGG
TCTCTTCTGGCTCCTTCTGACCGGTGAGGTCCCTACCGAGCAGCAGGTCCGCGACCTGTCCGCCGAGTGGGCTGCCCGC
TCCGATATCCCCAAGTTCGTCGAGGAGCTCATCGACCACTGCCCTACCGACCTCCACCCCATGGCCCAGTTCTCTCTGG
CCGTCACTGCTCTCGAGCACACCTCTTCCTTCGCCAAGGCCTACGCCAAGGGTATCAACAAGAAGGAGTACTGGCACTA
CACCTTTGAGGATTCCATGGACCTCATTGCCAAGCTGCCCAACATTGCTTCCCGCATCTACC

FIG. 2 continued

> SEQ ID NO: 6856 219066 260123_301712_1b
GGCGATGGCATTGGCGATGGCCTCCAGGGCGCGTAATGCGGCGTCCAAGCTTCGCCGCATTTCGGATGGATGCGAGTTG
TCGCCGCATTGGTTGTTTCGGCGATTGCTCACGACGGATCTTCGATCCCGGCTTATGCAACTCATTCCGGAAGAACAAG
AGAGATTGAAGAAATTGAAGAAGGAGCATGGATCGGTACCCCTCGGCCAAGTCACGATCGACATGGCTATTGGAGGAAT
GCGAGGTATCAAAGGGATGCTATGGGAGACGTCTTTACTCGACGCTGAAGAGGGAATCCGATTCCGAGGCTTGTCGATT
CCAGAATGCCAGGAGAAGCTTCCGGCTGCTGTGCCTGATGGTGAACCAATTCCAGAAGGATTGTTTTGGCTTCTTGTCA
CTGGTGAAGTTCCCAGCAAGGAGCAAGCTGCGACCTTGACGAAAGACTGGGCTTCTCGATCTGACATTCCAGGTCATGT
GTATGATGTTGTGAACGCTCTTCCAAAGAACGCGCATTCGATGACACAGTTTTCGGCTGGAGTGATGGCTTTACAAACC
GAAAGCGAGTTCCAAAAGGCCTACGAGAAAGGAATCAACAAATCCAAGTTCTGGGAGCCAGCGTACGAAGACGCAATGA
ACCTGATTGCGAGGTTGCCAGGCTTAGCTGCCTACGTATACCGGAGAAAATACCACTCTGGAGAGACGATCGAC

> SEQ ID NO: 6857 219066 258755_301699_1b
TAACCCCACACACATCAACACAATGATCCCTCTTCGAACCGCCCGTGTTGCCCGAACCTCCGTGTCCTCCATGGTCCAG
AAGCGATTTGCTTCTGACCTCAAGGGCGCCCTCAAGGAGGCCATCCCCGCCAAGCTGGAGCTCTTCAAGAAGGTCAAGT
CCGAGTACTCCCAGAAGTCTCTCGGTGATTGCAAGGTCGAGAACCTGCTCGGAGGCATGCGAGGCCTCAAGTGCATGCT
CTGGGAGGGCTCCGTTCTTGACGCTGATGAGGGTATCCGATTCCACGGCAAGACCATCAAGGAGTGCCAGGAGGTGCTC
CCCAAGGCCGTTGAGGGCGGCGAGATGCTCCCCGAGTCCATGCTGTGGTTCCTCTTCACCGGCAAGGTTCCCACTGAGG
AGCAGGTCCGAGGCCTGTCTCGAGAGCTCGCTGAGAAGGGCGAGGTCCCCGAGTTTGTCAACAAGATGCTCGACAACCT
GCCCCCTACCCTGCACCCCATGACCCAGTTCTCCATGGCCGTGTCTGCCCTTAACCACGACTCCAAGTTCGCCAAGGCC
TACGAGCGAGGTATCCCCAAGTCCGAGTACTGGGAGTACACCTTCGATGACTCCATCGACCTCATTGCCAAG

> SEQ ID NO: 6858 219066 135653_300416_1b
AACAATCGCTCTCTCTCTGTCCCTCCCCGATTCGATTCAATTCGCGACGCCTCCGTGAAATTCTCCAAAGCCAGCTT
GCCCTGTAGCCGCGTGCTCCGGCCATGGCGTTCTTCAGGGGCCTGACCGCGGTGTCGAGGCTTCGATCCCGCGTGGCAC
AGGAGGCCACCACGCTTGGTGGTGTGCGATGGCTGCAGATGCAGAGCGCATCTGATCTTGATCTCAAGTCCCAGCTGCA
GGAATTGATTCCTGAACAACAGGACCGCTTAAAGAAACTTAAATCGGAGCATGGAAAGGTCCAACTTGGAAATATAACA
GTCGATATGGTCCTTGGTGGGATGAGAGGGATGACTGGAATGCTTTGGGAAACATCATTGCTTGACCCGGATGAGGGTA
TTCGTTTTAGGGGTCTCTCGATTCCAGAGTGCCAGAAAGTGCTGCCGACAGCAGTTAAAGATGGGGAGCCTTTGCCTGA
GGGTCTACTTTGGCTTCTTTTGACCGGAAAGGTGCCAACCAAAGAGCAAGTTGATGCTCTATCAAAGGAATTGGCTAGT
CGTTCGAGTGTTCCAGGTCATGTGTATAAGGCAATCGATGCTCTCCCTGTAACTGCTCATCCGATGACCCAGTTTACCA

> SEQ ID NO: 6859 219080 206279_300820_1b
AGCCGCGTGTGTTTGATGGAACCCCTCATCTTGCCGGCATGGGGGATTGTCCTCAAGGAGGCCATTGGTTGGGACGGGCAG
AAGAAGAGGCCATTGGTTGGACGATAGGCAGAGGAAGAGATTATTGGTTTTACGATAGGCAGAGGAAGAAAGACGCCAA
GTACTCTGTACTACCTCACAAGGTAGCAGTCCCTTTTTNTCCATTCCAACGTTCTGGGATCACCCAGAACTGCCGAACG
CAACCGCGCCCTTGCCCTGGAGATGGCGGGAGAGGAAGTGGTGTTGGTTGTGAGCGCCGCCCCAAACGATGCCCCGTGC
CGATACGGAGGGGATAGATTAGGTCGGTAGTCGGGGTGGTACTTGATAGACGTCAAATATCTGAATGAATCAGTAATAT
AATTGTTAAGTAGG

> SEQ ID NO: 6860 219084 212181_300874_1b
ATTCAATCATTCATCATCCTTCTCACCTCTAGATCATCCTCATCCGTCACAATGGCTCCCTCTGGTATCCCAACCCAGG
ACGTCGACCTGACCGCCGCCAATATCCAGGTCAAGGGGGCCACTCAGCCCGTGCTAGATGATGCTACTGGCAACTCCCT
CTCCCAGACCATCTGCACCGACCACATGGTCACCGGCAACTGGACTGCCTCTGAAGGGTGGGCTACTCCCGAGCTCAAG
CCCTACGGTCCCCTGAGCCTCATGCCCACTGGCTCGGTCCTCCACTATGCCACCGAGTGCTTCGAGGGCCTCAAAGCCT
ACCGTGGTTATGATGGAAAGCTCCGCATCTTCCGTCCCGACTGGAACTGTGCCCGTATGCACCTGTCTGCCGGCCGTAT
CTCCCTGCCTCTGTTTGAGCCCGCCGAGCTGGAGAAGCTCATCATTGGCCTGGTGTCCGTCGATGGTCCCCGCTGGCTG
GCTCGCGA

> SEQ ID NO: 6861 219084 212324_300848_1b
AATCATTCATCATCCTTCTCACCTCTACATCATCCTCATCCGTCACAATGGCTCCCTCTGCTATCCCAACCCAGGACGT
CGACCTGACCGCCGCCAATATCCAGGTCAAGGAGGCCACTCAGCCCGTCAAGCCCAGCAATGGCACTACTCCTGCTCCC
CTCGATGCCTCCAAGCTCACCTACACCTACACTAAGAACCCTCAGCCCGTGCTAGATGATGCTACTGCCAACTCCCTCT
CCCAGACCATCTGCACCGACCACATGGTCACCGTCAACTGGACTGCCTCTGAAGGTTGGGCTACTCCCGAGCTCAAGCC
CTACGGTCCCCTGAGCCTCATGCCCACTGCCTCGGTCCTCCACTATGCCACCGAGTGCTTCGAGGGCCTCAAAGCCTAC
CGTGGTTATGATGGAAAGCTCCGCATCTTCCGTCCCGACTGCAACTGTGCCCGTATGCACCTGTCTGCCGGCCGTATCT
CCCTGCCTCTGTTTGAGCCCGCCGAGCTGGAGAAGCTCATCATTGCCCTGCTGTCCGTCGATGGTCCCCGCTGGCTGCC
TCGCGACCAGCCCGGCCGCTACCTGTACATCCGTCCCACCTTGATCGGAACCCAGTCCCAGCTCGGTGTCCAGGCTCCC
AAGGAGGCCATGCTGTACATCATCGTCACCTACATGCCCAAGCTCGACAGCCCCCCT

FIG. 2 continued

> SEQ ID NO: 6862 219108 204161_300790_1b
TACGTGGTCTCTTGGGGTGTAGCAATCAATACTTGTGTACACGTAGATACAGTAGTCTATGTCCGTGTGCTTCTGGGGG
TGGGCATTGATTATCTCCGTGCGGAGGAATATGGGGGTGTTCGTGTGTCTTGGTATCAATCAGGCTATGCGGGAATACG
ATGTAGTTACGACGCCTCCTCTACTGTACATTACTGACATGCCCTGTAAAGACAAGGTGAGCATACGAGACAATGCCGC
TGTCTCTTTGGGAGGGAATTCGTTAGAGTCAGCCAAGAGCGCCATGTTGAATGAAAGAATCGGACATGGCTTATCTTAG
TCCCCCGG

> SEQ ID NO: 6863 219136 182981_300664_1b
GAATTCGGAACCGGAGAAAAAGAGTCCAATTCTTATCAAAATCAAATCATCATCATCTCTCATCGCTTTGATCTGAATT
TTCATTTTATAGAGAGAAATGGAGAAAGCTATTAACAGACAAAGAGTTCTGTTAGAACATCTTCGTCCATCGTCTTCCC
AGAGAAGCGAATCTGTGATCTCTCCGTCTATTTGTTTGGCTGGAGACAGTGCTGCATATCAAAGAACTGCTGCTTTTGG
TGACGATGTTGTGATTGTTGCTGCGTACCGAACTGCCCTATGCAAGTCAAAACGTGGAGGTTTCAAAGATACCCTTCCT
GATGACATACTTGCACCTGTTCTCAGGGCTGTGATGGAAAAAACTAATGTTAACCCGGCTGAGGTTGGAGATATTGTTG
TTGGAACAGTCTTGGCACCAGGCTCCCAGAGAGCAAGTGAATGCCGTATGGCAGCATTTTATGCTGGTTTCCCTGACAC
TGTGCCCATTAGAACTGTGAACAGGCAATGCTCATCTGGTCTACAGGCAGTTGCTGATGTACCTGCTGCCATAAAAGCC
GGATTTTATGATGTTGGAATTGGAGCTGGCCTGGAGTCGATGTCAGTAAATCCCATGGCCT

> SEQ ID NO: 6864 219136 200602_300746_1b
GAATTCCAGCTGACCACCATGTCTCAAAGACTACAAAGTATCAAGGATCATGTGGTGGAGAGCGCCATGGGTAAGGGTG
AATCGAAGAGGAAGAACTCGTTGCTGGAGAAAGGACCCGAAGATGTAGTTATTGTGGCTGCTAACAGGTCTGCCATCGG
TAAAGGTTTTAAAGGTGCCTTCAAAGATGTAAACACAGACTACTTATTATACAACTTTCTCAATGAGTTCATCGGGAGG
TTTCCGGAACCTTTGAGGGCTGATTTGAACTTAATCGAAGAAGTTGCCTGTGGAAATGTTCTCAATGTTGGAGCCGGTG
CTACAGAACACAGGGCTGCATGCTTGGCAAGTGGGATTCCCTACTCGACGCCATTTGTCGCTTTAAACAGACAATGTTC
TTCAGGTTTAACGGCGGTGAACGATATTGCCAACAAGATTAAGGTTGGGCAAATTGATATTGGTTTGGCGCTGGGAGTG
GAATCAATGACCAATAACTACAAAAACGTCAATCCCTTGGGCATGATCTCCTCTGAAGAGCTGCAAAAAAACCGAGAAG
C

> SEQ ID NO: 6865 219136 259824_301709_1b
AGTACAGAGAGAGCGATCGATCGAGGAGAGATGGAGGCGGAGAGGAAATTGAGGATGCGCCAGCAAGTGCTGCTGGATC
ATCTCCGGCCGTCGGCGGCGCCTCGCCCTGTCAATCTCGTGACCTCCATTTGCTCTGCTGGGGATTCCGCGGCGTATCC
TAGAACGACTGATTTCTCCGACGATGTTGTGGTTGTAGCTGCTTATAGGACTCCTATTTGTAAAGCCAAGCGTGGTGGT
TTCAAGGACACCTACCCCGAGGACTTGCTGACTCCGGTTCTAAAGGCTGTTGTGGAGAAAGTTGGTTTGAATCCTGCGG
AAGTTGGAGACATCGTTGTTGGAAGTGTGCTTGCTCCTGGATCGCAGCGTGCGAATGAGTGCCGGATGTCGGCATTTTA
TGCTGGATTTCCAGAAACCGTCCCTGTGCGCACGGTGAACAGGCAATGCTCTTCTGGTCTTCAAGCTGTGGCTGATGTT
GCAGCTGCGATCAAGGCGGGTTTTTACGATATTGGCATTGGTGCTGGTCTGGAGTCTATGTCGGTGAACGGGATGGTCT
GGGAAGGCTCAGTAAATCCAAAGGTTGAGATGAACCAAAAGGCTCAAGACTGCTTGCTACCGATGGGCATTACCTCTGA
AAATGTTGCTGAGAGGTATGGAGTGACCAGGCAGGAGCAAGATGAAGTGGCTGTTACCTCTCATCGTCGTGCCGCGGCT
GCAACTGCAAGTGGAAGGTTTAAGGATGAGATCATTCCTATTCCAACAAAGCTTGTCGATCCGAAATCTGGGGAAGAGA
AGCAAGTTGTGATTTCTGCCGATGACGGCTTTCGCCCGAATGCAAAGGTCGCTGATCTTGC

> SEQ ID NO: 6866 219136 255665_301644_1b
GATCGTTCGCAGGAAATCAGTCGTCGGATCGAATCCGTCCCGGCCGGCCTAGGAACGAATCTGAGAATAGGAAGAATCA
GGAAGAAGAAAGAATGGAGAAAGTTCGCTCCAGACAGCAGGTTTTACTGGACCATCTCCGTCCATGCAGCACTCCTCGG
ATCTCCACTGAACTTGTGAGATCTGTCTGTTTAGCTGGAGATAGTGCAGCTTATGAAAGAAGAACCGACTCTAGCGATG
ATGTGGTGATTGTGGCAGCTTACCGCAGCGCTCTCTGCAAAGCCAAAAGAGGACGCTTCAAGGATACCTACCCTGAGGA
CTTGCTGGCACCGGTGCTCAAGGCTTTGGTAGAGAGAACTGGCGTGAATCCGGCAGAAATTGGAGATATCGTGGTAGGA
ACTGTTCTGGCTCCAGGATCTCAGCGTGCTTCCGAGTGTAGAATGGCTGCTTTCTATGCAGGTTTCCCAGAGAGTGTTC
CTGTAAGAACTGTGAATAGGCAATGTGCATCTGGCTTGCAAGCTGTGGCTGACGTTGTTTCAGCAATAAAGGCAGGATT
TTACGACATAGGAATCGGAGCTGGTTTGGAGTCAATGACAGCGAATCCTATGAGTTGGGAAGGTTCTGTGAATCCAAAG
GTTGAAATGACTCAATGCGCTCAGGATTGTCTTCTT

> SEQ ID NO: 6867 219136 142211_300433_1b
CCCCAAGTAATCGGCGCTTTCGCGAGAGAGAGCGATACGAACAAGAGAAAATCTTCTCCAGACACCGCGGCGGGCTTCC
CCACCCCATCGGAAGGAAGAAGACGACCAGCTCGCGCGCTCGGATCTCAGCCATGGAGAAGGCGATCGATCGCCAGCGC
GTCCTCCTCGCCCACCTCCTCCCCTCCTCCTCCTCCGACCAATCGCTCCTCTCCGCGTCGGCGTGCGCCGCCGGGGACA
GCGCCGCCTACCAGAGGACTTCCGCCTACGGGACGACGTCGTCGTCGCTGCCTACAGGACACCCATATGCAAGGC
CAAGCGAGGAGGTTTCAAGGATACATACCCAGAGGACCTTCTTACTGTTGTTCTAAAGGCTGTTCTGGACAACACTAAG

FIG. 2 continued

ATCAACCCTGGTGAAATTGGTGACATTGTAGTTGGCACGGTGCTAGGTCCAGGCTCGCAGCGTGCAATCGAGTGCAGGG
CTGCGGCTTTCTATGCTGGAGTTCCCGAAAACGTTCCTGTTAGAACTGTCAACCGGCAATGTTCCTCTGGATTACAGGC
AGTGGCTGATGTTGCCGCGGGCCATTAAAGCTGGGTTCTACGACATAGGGATTGGTGCAGGCCTGGAATCCATGTCAGT
AAATGCTATGGGTTGG

> SEQ ID NO: 6868 219136 279632_200063_1b
ATTTGTACTAAAAAAATAATCTTGAGATCAAATGGAGAAAGCAATTGAGAGACAAAGAGTTCTTCTTCAACACCTTCGT
CCTTCTCAAACTTCTTCTTCCTTGGAAAATATTGAATCATCCATTGCTGCATCTGTATGCTCTTCTGGAGACAGTGCTG
CTTACCAAAGGACCTCTGTCTTTGGAGATGATGTCGTCATAGTTGCTGCATATAGGACTCCTCTTTGCAAAGCAAAGAG
AGGAGGCTTCAAGGATACTTATCCTGATGATCTACTTGCTCCAGTTCTAAAGGCGTTGATGGAAAAGACTAATGTGAGC
CCTAGTGAAGTTGGGGATATCGTTGTCGGCACCGTGTTGGCCCCAGGTTCTCAGAGAGCAAGCGAGTGCAGGATGGCTG
CGTTTTATGCTGGTTTTCCTGAAACTGTGCCAGTTAGAACTGTAAACCGGCAATGTTCATCAGGCCTTCAAGCAGTTGC
TGATGTAGCTGCAGCTATTAAAGCTGGATTTTATGACATCGGTATTGGTGCTGGATTGGAGTCTATGACCACAAACCCA
ATGGCCTGGGAAGGATCAGTCAACCCAAAAGTTAAGATGATGGCACAAGCTCAAGACTGTCTTCTTCCTATGGGTATTA
CTTCTGAGAATGTAGCACATCGTTTTGGTGTGACAAGGC

> SEQ ID NO: 6869 219216 210754_300892_1b
TGCGAGCAAACAGAAAGCAGCCCGTCATCCTTCGGGAACCCGCATGATCAGCGCCTGGCCGTCTGGGGGTGGCTGAGAG
GTCGCTGGGTCGCGGGTTAATGAAACACGGGCTCTGCGTTTATTTGGTGGTGATCGACACTTTTGCCCTCGCAGCGTGA
GGACT

> SEQ ID NO: 6870 219218 199449_300749_1b
TTTCCTACCAATTCATCCCTCCATATAATAAAAACCATGTGTGGTACAGACGCCCCCGACGCCGCCGCTGGTCCCGTGT
CCAACGGGTCGCATGCCAGCAAGGCCAACCCAGCCAGCTCTCCGTATCAGAACGTCAACGACTTCATCTCCAATGTCGC
CCGATTCAAGATCATCGAGAGCACTCTTCGTGAGGGCGAGCAGTTTGCCAATGCCTTCTTTGACACTGAAACCAAGATT
AAGATCGCCAAAGCTCTTGACGAGTTTGGTGTCGACTACATAGAGCTCACAAGTCCTGTGTCTTCTCCTCAGTCATATG
AGGATTGTAAGACTATCTGCGGGCTTGGCCTGAAGGCCAAGATTCTCACTCACGTGCGATGCAACATGGAAGACGCCAA
GAAGGCCGTCGAGTGTGGTGTTGACGGCGTCGACCTCGTCATTGGTACTTCCAGCTTCCTACAAAAGTACAGCCACGGA
AAGAGTATCGCTATCATCAAGGAGACTGCCCTGGAAGTGATTCAGTATGTCAAGAGCCAGGGCGTAGAGGTCCGCTTCT
CTTCAGAGGACTCGTTCCGAAGTGACCTCGTCGACCTCCTTACTCTCTACAAGGCTGTCGATCAGGCTGGAGTT

> SEQ ID NO: 6871 219224 220453_300955_1b
ATCGCATCTACCGAACTCCGGAGTTCTCGCAAAAGGTTCGCACATTGTATTTTCGAAAGCGAAGATACACATATACACA
AACAACTACAATATGTCGGAGAACCCTACGACAAACGGGCACGACGCCCTTGAAGAGAAGCTCGGCCGCCTGGCTAGGA
AACCCGGCATCAAGGCCAGCCTCGTTTTGGACCGAGCAACCGGCGCAATCCTCAAGACGAGCGGCCAGATCGACGCGCT
CCAGACGGCGAAATCGCGAAACGCGTCAACGGCGGCCTCATTCTCCAACGACGCTCCCGCAGCGGAGGAGGGCGAGGCG
CAGGGCGTCGAAGAGTTTGCGGAAATGATCTGGAACTTTGTCAACAGCTCCGGGCACCGTAGTCGGGGACATTGACACAG
AGGACGAATTGAAATTACTGCGACTGCGAACGAAGAAGCAAGAGATTGTCATAGTGCCGGACCAGAAGTACCTACTGAC
GGTCATCCACGATACTCAGCCGGGCTGATTACACAATTTGGAGCGGACTTTCCGATACGCAAAGCAGCGGGTTTATTAA
AGGGGCTACTATGATGGAATATAATACT

> SEQ ID NO: 6872 219244 218079_300914_1b
AAAATCGCTCCCAATGAAAAAGAGACCAAAGGTGTCCAGCATCAGAAGGGGGTACCGCGCCAGGGCTTCACACACAATC
ACCACAGCGACTTCAATGAAATGACCA

> SEQ ID NO: 6873 219269 219563_300946_1b
GCGACAAAACATCACAGTGCACATCATGGCGCGAGTACTTCGCAATAGAGCGGTTGCGTCACCGAAAACCACCGACGCC
GTAAAGCCTGACAGCACCCCAAAGGGCAAGAGAAAGGCCGCCGAAGAGTCTTCTCCCGTTGTGCTGAAGAAGCAGAAAT
CCGCCAAGAAGGAAGATGTCGAGACCAAGGCAGCCAAGTCACCCAAGGCAGCCAAGTCACCAAAGACTAAGAAGGAGGA
AAAGAAGAAAGAAGAAGAAAAGAAGCAAGATGTGATTGACATGGAGGAAGATTCCGAGTCTGAGGGACAAGAAGATGAG
GGAAATCTTCAGGCTTTGGCCGTCAACATTGACCCGGAAGAAGAGGCCCCCGTGAACGACGAAGAATTCCAGCCCGGTC
AGGACGTTGGCAAGATCCCCAAGGTCTCGAAAGACGTCCAGAAGTCGATCAAGGCATCGAAGGAAGAACCTGGCGTCGT
TTACATTGGCCGAATACCCCATGGTTTCTACGAATACGAAATGAGGCAGTACCTGTCTCAATTCGGCCCCATCTCCCGG
CTGCGTCTATCACGCAACAAGAAGACTGGCGCCAGCAAGCACTTTGCCTTTGTCGAATTAACGAAGCCAGCACTGCCGA
GATTGTCTCAAAGACCATGGACAACTATTT

> SEQ ID NO: 6874 219281 212041_300873_1b
TGCAGATGCGTGAGAACTTCCTCCCATGTGTTCAAGCCGAGAGCTGCTGCAGCCACGCTCGCTTGATCTGTGAACCATT

FIG. 2 continued

CGTGGTTCCTGGTTCCAACGGTGGCCACCATGCCGACGGAAATAGCCCAGATCCCTAGTGGATCGCTGATATGATCATT
TCTCAGCAGGGCCGCCAGATGGCCCTTGAGCTGAAGAATGATGGCATTTGCTAAGCCGACGTGGGAATAATAAGTGGTG
CCATGTAAGATTAGCATATAAAGTGCGGTCGCGTATCGGAGACACTCAGAGGTGGCCGATTGCACTGGGTCTGCATTTG
CATCCAGGAATGGAGGCAGCAGCAGCAATTTGTGCATAACAAAACAGGTTAGATCATGCAGCTGCGTATTGGTCAAGCT
TGAATGCCATGAATGATGAAAGATGTTCCTGAGCCGAAGAAAAAAAAAAAA

> SEQ ID NO: 6875 23558 254343_301632_1b
ATTAAAAGATGATGATGATGGTGCAAGCATGTCCTCTCTCTCACAACTCTCTCCCAACTCCATCACACTTGCAATCTCT
CTCTCCCATGCTATCAAGCAAGGGAGGGAGGGGTAAGGGGAGCAAAAGCATAGTGAAGGCTTCCTTATTGTGGGAGCCC
AATTCAACATCAATCCTCCTAGAGAGCATAGCACACCCACACTCTTGGAGTGCCCTCCTCCCTGTGATGGTGATAGACC
CTTGGTCCCCCAACATAAAGGCAGATAGCATAGCCTCTCAGCTCTTTGCAGCCTCCCTCTTCCCCTACCTGGGCTTCCT
TTACCACTTGACAAAGTCAAAGACTTCCCCCAACCTCACCCTCTTTGGCTTCTACTTCTTGCTTGTCTTTGTGGCTGCC
ACTATTCCTGCCGGCATTTATGCAAAAGTAAAGTATGGAACATCCTTAGCAAATGTGGATTGGCTTCATGGAGGCGCTG
AGTCTTTTCTTACCCTTACAAATCTTTTCATTGTAATTGGATTGAGGAAAGCTTTACGCGGCGATGATAGTGTTCCAAA
ATCTTTCTCAGCAAAGGACGGTGAAACCATAGAAGAGAGCTCACCCCTTTCAAATAAATGTATGGCTGATGAGG

> SEQ ID NO: 6876 23558 23828_300223_1b
CCCACGCGTCCGCTCTTTCCTTCTGTCACCGCGAGAGTAACCGAGAGACATGATTCTGATAAACTCTAATTCTCCGACG
CTAATCTCAGCCGTTAGATTCGTGGGCTCATCTCCGTTCACCACTCGGGGGCTTTCTCAGTCCACTGTCTCAATCTCTA
GAAACAAAAGCTTCTTCTTCCACTTCACCGAGACGAAGGAGAAGAACGCAAGAAGAGATTATTTGAGAGTATCAATCGT
GTGTGACGCAGGAGGGATGTTTCCGGTGGATCCATGGGCTCCAACCATTGATTCACAGAGCATAGCATCACAACTCTTC
GCTGTATCTCTGTTTCCTTACATTGGCTTTCTCTATTTCCTCACTAAATCCAAATCAGCTCCAAAACTCACACTTTTCG
GTTTCTACTTCTTGCTTGCCTTCGTTGGAGCTACAATTCCAGCTGGGATTTATGCTAAGGTGCATTATGGAACATCGTT
GTCGAATGTTGATTGGTTACACGGAGGAGCTGAATCACTTCTTGCTCTTACCAATTTGTTTATCGTGTTGGGTCTTAGA
CAAGCTCTGAGGAAGTCTCAAGATGATGATGATGATAAACTTGGTAATGATGATGAAGTTCCAACAACTCAAGAACAAG
GGAAATCTTCAGTGTAGTAAAACAAATGTAAATTTTTAATTATGGAGTTTCACTTGTTTTTAATTAGATTATATATA
GTCGACGCCCATCTAATTCCCATTTTAG

> SEQ ID NO: 6877 23794 23885_300097_1b
CCCACGCGTCCGCTCGATTTCAGATTTAAGATCTCAGATACAAAACTCCGACATGTCTACGTTCAGCGGCGATGAAACA
GCTCCCTTCTTCGGCTTCCTCGGCGCTGCAGCCGCACTCGTTTTCTCCTGTATGGGAGCTGCTTATGGAACCGCAAAGA
GTGGTGTTGGTGTGGCTTCTATGGGAGTTATGAGACCTGAGTTGGTGATGAAATCTATTGTCCCTGTTGTTATGGCTGG
AGTGTTGGGTATCTATGGATTGATCATTGCTGTTATCATCAGTACCGGGATTAACCCCAAGGCTAAGTCTTACTACCTC
TTTGATGGATACGCACATCTCTCGTCTGGTCTTGCTTGTGGTCTTGCTGGTCTCTCAGCTGGAATGGCCATTGGGATTG
TTGGTGATGCCGGTGTCAGGGCAAATGCTCAGCAGCCTAAGCTCTTTGTTGGGATGATTCTTATCCTTATTTTCGCAGA
AGCGCTTGCTCTTTACGGGCTTATTGTAGGAATCATTCTTTCCTCACGAGCTGGCCAGTCTAGAGCTGAATGAGAATCT
AAACCACAAGACTGCTCAAAGGTACTTCCTTTACTTCTGTGTGCGTTTGTTTTATCGTGATTAGTATGATGTATCATC
GGGAACCAAAAATTTTACTGGATTCTTGGAAATTTGTTTCGGAAACAAAACCGCCTATCTTCATTCTCCTTTTCTTTTC
CGGTGGTTACTCTCCGATGTAGAATTTTATTGTTTGATTCTGTAATAAAGAAGCTCTGAGGAGTTTGGTATGTTTTGT
ATTCTTGTATTTGTCCTGAGGAAGTTAAATACATTTATTTGTAAAGAAGTTTGCTTTTCTGAAAAA

> SEQ ID NO: 6878 23794 157054_301734_1b
ACCGATCAGAAAAATTGTCATCAAAATTCCGATCGGTCACTGGCGAAATCTCTGATAAACTGAAAAAAATGTCATCAAC
TTTCAGCGGCGATGAAACGGCGCCCTTCTTCGGTTTCCTCGGAGCAGCTGCAGCTCTCGTTTTCTCCTGTATGGGAGCT
GCTTATGGAACGGCGAAGAGTGGGGTGGGGTAGCCTCAATGGGAGTAATGAGGCCAGAGCTTGTGATGAAGTCAATTG
TGCCGGTTGTTATGGCCGGAGTGTTAGGTATTTATGGTTTGATTATTGCGGTAATTATCAGTACGGGAATTAACCCTAA
GACCAAATCATATTACCTTTTTGATGGATATGCGCATCTTTCTTCTGGTTTGGCTTGTGGTCGGCTGGCCTTTCCGCT
GGAATGGCTATTGGAATTGTTGGTGATGCTGGTGTTAGAGCAAATGCACAACAACCAAAACTGTTTGTTGGTATGATCC
TGATTCTCATCTTTGCCGAGGCATTGGCTTTATACGGACTGATTGTCGGCATCATCCTTTCTTCCCGTGCTGGTCAATC
TAGAGCAGAATAGAAATTAATGATTTCCAGGTTCATGATGGAATCATTTTGCATCATTGTGCTGGCAGTTTGGTAACTG
ATACTGGTTTAGATGCATCTTTTCCTTTTCCGTCACACTGTGTAGATTTGGAAGCTGCTTTTTCCCTGCATGCAATCTA
GAGAACGTTCTCTTAATTTTTCAATTGCTATATTTTGCAATAATGAGGAGCATCTTGTTGGTTGAATGCTGATACAATT
GTATAATTTTTGTTGGAATGCATTTATTACCTCGGTATATG

> SEQ ID NO: 6879 258904 265567_200112_1b
GTTCTCTACAAATAGCCTAAGGTCTCTCCCCTAAATTCATTTCATCCCGGCCATCAATTGCTTTCTTTCACTCTTCTTC
TACAACTCTATAAATCCGTTAATTTCATAGAGCTGAGAAAACTAAGACGATGAATAGTTGCAGTAGCACTTANGGTANG
GGGGTCATTGCACTTGTGGTATGTTTTACAATCAAAACAATAGTAGTACTGCTTCTGCCTACTCGATGCTCTATAACCA

FIG. 2 continued

```
GAATCAGACAACTCCTTTTGAAGAAAATTATTCTGATCAGAACACGTATTCTTTTGCTTCTTCTACATCATCTAATTCA
GTGGATTGTACACTTTCATTAGGGACACCTTCCACTCGTCTTAGTACAAGCAATGACAATAATGAAAAGCGACTTCAGT
CTAATGAACGTTGCTCTAATTCTTACATGTCCAAATGCTGGAATATTTTACAGCCCAAAAATCACAAGTCCAGTCGCGG
TAGTAGCAACGGCAACACTAACTCAGGCGGTGCTGATCCTCTTGTTGCTCGCCGATGTGCTAATTGTGACACCACTTCA
ACACCTTTATGGAGAAATGGTCCTAGAGGCCCCAAGTCACTTTGCAATGCGTGCGGAATCCGTTTCAAGAAAGAAGAGA
GGAGAGCCAGTGCGGCGGCGGCCACCGTAAACGGTGGCGGAATGGATCATACTCAGCACATGATAAACG

> SEQ ID NO: 6880   258906 316970_301428_1b
GCAGCATGGCTCGTGGAAAGATTCAGCTTAAGAGGATTGAGAACCCGGTTCACAGACAAGTGACTTTTTGCAAGAGGAG
AACTGGTCTTCTCAAGAAGGCTAAGGAGCTCTCTGTGCTCTGTGATGCCGAGATCGGTGTTGTGATCTTCTCTCCTCAG
GGCAAGCTCTTTGAGCTCGCTACTAAAGGAACAATGGAGGGAATGATTGATAAGTACATGAAGTGTACTGGTGGTGGTC
GTGGTTCTTCTTCTGCTACTTTTACTGCTCAAGAACAACTTCAACCACCAAATCTTGATCCGAAAGATGAGATCAACGT
GCTTAAGCAAGAGATTGAGATGCTTCAGAAAGGGATAAGCTATATGTTTGGAGGAGGAGATGGGGCTATGAATCTTGAA
GAACTTCTTTTGCTTGAGAAGCATCTTGAGTATTGGATTTCTCAGATTCGCTCTGCTAAGATGGATGTTATGCTTCAAG
AAATTCAGTCATTGAGGAACAAGGAAGGAGTCCTCAAAAACACCAACAAGTATCTCCTCGAAAAGATAGAGGAAAACAA
CAATAGCATATTAGATGCTAACTTCGCAGTCATGGAGACAAACTATTCCTATCCGCTAACAATGCCAAGTGAAATATTT
CAGTT

> SEQ ID NO: 6881   258906 13984_300246_1b
CCCACGCGTCCGAGGAGAAACCAGTTCAGAAAATGATCCCGCTTCAGAAATTCAGTTCTGGCAAAAGGAGGCTGCGATT
CTAAAGCGTCAGCTACATAACTTGCAAGAAAACCACCGGCAAATGATGGGGAGGAGCTCTCTGGACTAAGTGTAGAAG
CTTTACAGAATTTGGAAAATCAGCTTGAATTGAGCCTTCGTGGCGTTCGAATGAAAAAGGATCAAATGTTAATCGAAGA
AATACAAGTACTTAACCGAGAGGGGAATCT

> SEQ ID NO: 6882   258915 231867_301234_1b
GCGGCACGGAGGCGTTTCCAAATCTCGGCAAGCACTGCAACCACTCCTCGTGTGGCCAGCTCGATTTCCTGCCCTTCAA
ATGCGATGCGTGTTCCAAGGTCTTTTGCCTGGATCATCGTTCCTATGCAGCTCACAGCTGCCCCAAGGCGAATTCCAAA
GACTCTACAGTGATCGTCTGCCCGTTCTGTGCCTCGGGTGTCAAGACCGTGGCAGGCGAAGATCCAAACCTTACAATCG
ACAGACATCTCCAGACTTCTTGCGATCCAAGCAACTACGAGAAGGTGATGAAGAAACCAAAGTGTTGTGTCCGAGGTTG
CAAAGATGTGTTGACCTTCTCCAACAAGTTCCACTGCAAGGTCTGCGCAAGGACACCTGCATGAAGCACAGATTCCCC
GCAGACCACGCATGCCAGGCCGCGGCATCTGCTCCCAAGTCCGCACGAAACGTTGGTGGCGAGCTGGCGACGAAGTTCT
TCCAGGCTTTGTCGATCAGGACGGGCAGCGAGTGTGGGACTAGCAGCAGCAGCAGCAACAGCAGCAGCCGAAGCGGCAA
GGTTAGTTCCTCGACGTCGAAGTGGCCAAGGATTTTCTAGCGGTGTGGGAAAATGGCATAAGTCCAGGACATTTACGGA
CTTTTACAGGGATACTATAGATGCCTAGAAAGATCGTGCCACAG

> SEQ ID NO: 6883   258924 262525_301749_1b
TTATCACCATGTTGGTCCACCACTATCACCACCTAGGATGATTCCGCTCCATAGCTCATTGCTTGAACCACCTTCTCTC
TTCTTATTACCATCATCGTGTCTCACATGGTGATGTTGTTGACGGTCTTCATGATCTCCATAAGGATACATCATCTTAC
TTCCTTCCTCATTAACAACGAAGTTATCATGATTACCAATCTCTTCCTCGTTCCTGTCTAATGAAAACCCAAGATTCTT
TTTGGGGTGCTCATGATCATACTCTTGACGAAACTGAATCATTCCCATAGGAGCTTGGAAAAGACAGTTCTGCCCTCCT
GTCACAACTTGCTCACTGAAATGACCGTAATGCCCTTGAGCTCGCTTGTCTTGCATAGGGGAGGAGAAGGATAGGCTGA
GGTCATTATTGTTTGATGCGTCTTGCTAGGGTTTGATGATGAAGCTGATGATGTGAAGACGAAAGGAGGGTTGAGATC
CGGGAGGTTCTTGGTGAAGAAGAAGTAGAGGAATTAGGAAATGGAAGCTTCTTGTTCTTTCTAGAACCTCCGCCTACG
GGGACGTTACGGAGAGAGCCACCTTCAGTCCAATATCTCCGACAAGACTTACACAAGTACCTAGGCTGTCGCTAAGCTGT
AGTTGTTGTAATAACAAAACTTGGTGTTGCTTGAGTTGCATCTTGGACAGTTTCTTGGTTCTTGTGGCCTAGTGCTCAT
TGTCGTCATCAACTTCTTCTCGTCATCCATTATCATAGTTGTTGCTGTTGTTGAATCCATTGTTGTTGTTGGTGGT
GGTTGTGTTGTGACGATGGTGTTATAGGAATTATTGTTAGTACTAGTCATGCTGC

> SEQ ID NO: 6884   258924 263342_301724_1b
GAGGTTAACTGCAGCATGGATTATTCTTCAATGCATCAGAATGTGATGGGAGTATCTTCATGTGCACCACAAGATTATC
A

> SEQ ID NO: 6885   258924 120395_300384_1b
AACTTAACAGTAAAGCAGCTGCAACTTGGACCACCCCCTTCCACCTCTCCCCCCACACAAGTCCCACCCCTGCCTTTTT
CTTCCTTCTTATTACAAGCTCAGCACCCTGCAATTCCTTTCCACTACACATATATCATACTCCCACAAAGCATATCAAT
CTTCTATCTCACTATCCCTCTATCTACTAATAAGAATACTTAGAGAGCTTATCGAGTACTGCAGTTGAAATGAGTGTCA
TACAGTAACTAATTAATTGGGATTACTTCTCTACGAGTTTGCATGGATTCCTCCAACTGGTTACAGGGCACAATTCACG
AGGAGGGTGCAGCAGGTATAGATTCTTCTTCATCGCCAATATCAGAGGAAATTCTCACATGCTCAAGGCCATTAATAGT
```

FIG. 2 continued

AGAAAGAAGGCTAAGACCCCCACATGACCATTCTATCAAATGCCCTCGTTGCGACTCTACCCACACCAAATTCTGTTAC
TACAACAATTACAGCCTTTCTCAGCCTCGCTACTTTTGCAAGACTTGCCGTAGGTACTGGACTGAAGGTGGTACTTTAC
GAAACATCCCTGTTGGTGGCGGCTGTCGCATAAACAAAAAAGTCTCCTCCAAAAAATCCAATATTGAAACAGCTAATAA
TAACCAAAATCCTACTGATATTCAGCTTTCATTCCCAGATCAAATGCCACCCTTTTCTCATCATCACTTCATG

> SEQ ID NO: 6886 258965 258993_301701_1b
GCAGCTTTCTGCAACTTCTCCAAATCTCATACTTTCCAGAAAATCATTTTCCCAAGAAAAATAAAACTTTCCCCTTTGT
TCTTCTCCCCCCAACAGGTCA

> SEQ ID NO: 6887 258966 259079_301702_1b
GCAGCATGGCGTTATCCGGGTCGGGTTCTTACTATATCCAAAGAGGAATCCCCGGTTCTGGTCCTCCTCCTCCTCAAAC
TCAACCAACGTTTCACGGATCACAAGGATTTCATCATTTCACCAATTCCATCTCTCCTTTTGGGTCAAACCCAAACCCA
AATCCAAACCCTGGAGGTGTCTCTACTGGATTCGTGTCTCCTCCTTTACCCGTTGACTCTTCTCCGGCTGATTCGTCAG
CGGCGGCGGCGGGAGCTTTGGTTGCTCCTCCTTCAGGTGACACGTCTGTGAAGCGGAAGAGAGGACGGCCTAGAAAATA
TGGACAAGATGGTGGTTCTGTTTCGTTGGCATTGTCTCCTTCTATCTCCAACGTTTCCCCGAACTCTAACAAACGTGGC
CGTGGAAGACCTCCTGGCTCCGGCAAGAAGCAACGGCTATCTTCCATTGGTGAAATGATGCCTTCATCAACTGGGATGA
GCTTCACACCGCATGTAATCGTAGTTTCCATTGGTGAAGACATTGCTTCAAAGGTTATATCGTTCTCGCATCAAGGTCC
ACGAGCGATATGTGTCTTATCCGCAAGTGGTGCTGTCTCTACTGCAACTCTTCTTCAGCCAGCACCTTCTCATGGAACT
ATTATATACGAGGGTCTATTCGAGCTCATAT

> SEQ ID NO: 6888 258967 232706_301217_1b
GCTGTGCGTCTCAAGAGGGATACCCGGATAGGGTGGAGCAGCAGCGGGATAGGGCTATTGTGGATCGATTCTTCCTCCT
CGATCTGTGGGGATCGCTTTGATCTATAGGCGCAGAGCGCGATTCGCGGTCTTATGAATGCTGGGCAGCTGGAAATGGT
AGGGTTGATGGCGAATCCAGCGCTTCCATCCGACGAAGCGGTGTCCAAGAAGATCCGGAAGCCCTACACCATCACCAAA
TCCAGGGAGAGCTGGACCGAGCAAGAGCACGACAAATTTCTAGAGGCCTTGCAGCTGTTTGATCGGGACTGGAAGAAGA
TCGAAGCGTTTGTAGGCTCTAAGACAGTAATCCAGATTAGAAGTCATGCCCAGAAATATTTTCTAAAGGTCCAAAAAAA
TGGGACCGGAGAACACGTCCCTCCCCCAAGGCCCAAGCGAAAGTCGGCTCAACCATATCCACAAAAGGCTGTCAAACCA
GCTCCCACTTCGCGGGCAACTCCACAACAGTCACCACCGGATTTTGCTTACATGGTTCCGCAGCAATGTAATATGTATG
TTCCAGCAGTCACTGGAAATCCCG

> SEQ ID NO: 6889 258967 258973_301701_1b
GCAGCATGAGTTTACCAAGCTCCGATGGATTTGGTTCGATTCCGGCCACGGGACGGACCAGTACGGTGTCGTTTTCTGA
GGATCCGACGACGAAGATTCGGAAGCCGTACACAATCAAGAAGTCGAGAGAGAATTGGACAGATCAAGAGCACGATAAA
TTTCTAGAAGCTCTTCACTTATTCGATAGGGATTGGAAGAAAATAGAAGCCTTTGTTGGATCAAAAACAGTAGTTCAGA
TACGAAGCCACGCTCAGAAATACTTTCTCAAAGTTCAGAAGAGTGGTGCTAACGAACATCTTCCACCTCCTCGACCTAA
GAGGAAAGCGAGTCATCCTTATCCTATAAAGGCTCCTAAAAATGTTGCTTATACCTCTCTCCCGTCTTCGAGTACATTA
CCGTTGCTTGAGCCTGGTTATTTGTATAGCCCTGTTCGAAGTCATTGATGGGAAACCAGGCTGTTTGTGCATCTACCT
CTTCTTCGTGGAATCATGAATCGACAAATCTGCCAAAACCGGTGATTGAAGAGGAACCGGGAGTCTCGGCCACGGCTCC
TCTCCCAAATAATCGCTGCAGACAGGAAGATACAGAGAGGGTACGAGCAGTGACAAAGCCAAATAACGAAGAAAGTTGT
GAAAAGCCACATAGAGTGATGCCGAATTTTGCTGAAGTT

> SEQ ID NO: 6890 258970 103496_300026_1b
TGGTATCAACGCAGAGTGGCCATTACGGCCGGGATGGCTTCTCGGACCATACCAAGCTCATTGGGCTCAGCTGTGAATT
TTTCATCGAAATCCCAAATTACTAGTAACCCATTGTCTTGTGTAACTTTCGGAGCGCTAAACAGACCTAGAAGCAGGAT
TTCCGTCTCAATTCGTGCGATGGGCTCCTCAGCTTCTTCTCAAAAACCAGACAGTGCTCAACGGCCAAGCAAAGTAGAT
TATAGCTCTGTAAGTGATGAGGACTGGAGGAAGCAGCTAACGAATGAACAATTTTACATTACACGGCAGAAGGGTACAG
AACGGGCATTCACTGGGGAGTACTGGAACACCAAAATCCAAGGAACATATCATTGCGTCTGCTGTGACACTCCTTTGTT
TGAATCTTCTACCAAATTTGACAGTGGGATGGGGTGGCCATCTTATTACCAACCTGTAGACAACAACGTGAAGTCAAAG
ATGGACTTGTCTATTATCTTCATGCCTCGTCAAGAAGTTCTATGTGCAGTTTGCGATGCTCGTCTTGGACACGTGTTTG
ATGATGG

> SEQ ID NO: 6891 258970 1114439_301845_1b
AGGGGATATATATATTTCTTCCACTTTTGGCTCCTCCTCCTCCTTCTTCTTCCCCCTAAGCCTAGCCATAGCCATAGCC
CTAGCCCTAGTTGTGATTCTTTAGAGCGAGCATATCCCTTTGGGATGGCTTCCTCCGGCAGTTCTCCCTTGCAAGTGCA
GAAGACAGAGGAAGAATGGCAAGCCACCCTCAACCCCGAGCAGTTCCGCATCCTCCGTCAGAAGGGCACCGAATGGGCA
GGCACAGGGAAGTACAACAAATTCTACGAGGAGGGTGTCTATGAATGTGCAGGTTGTGGCACACCAATCTACAAGTCAA
CCACTAAGTTTGACTCTGGCTGTGGATGGCCTGCTTTCTATGAAGGCTTACCTGGTGCTATTCACAGAAATGTTGACAA
AGATGGGCGCCGGATAGAGATAACATGTGCTGCTTGTGGAGGGCATCTGGGCCATGTATTTAAGGGGGAAGGCTTTCCG

FIG. 2 continued

ACTCCAACAGATGAGAGGCACTGTGTCAATAGTGTCTCTCTTAAGTTTACTGAAACCACTTCGAAGCCACATGATGCAT
CTAAAATTTAAACAGGTATTTGGTTTCTGGTTTTGGGTTTCCTTCGGTATCTAGTTTTGGGTTTGCTGTATAGTGCAAC
TGAATCCACTTCTAGCCATAAGATTCATCTAAACCGGTATCTGGTATCT

> SEQ ID NO: 6892 258970 103529_300363_1b
TGGTATCAACGCAGAGTGGCCATTACGGCCGGGGGGAAACCTAAAAAAAAAAAAGAAAATGATTCTGAAATTCTCACCA
TTTTCTCCTTCGCGAACTCTGATTTTCAACCCCAGGTTCCAACGCAGAAAAGCAATCCACATTCATGGCCTGTCCAATA
CCCAATTCAGATTTGTAGCCATGGCTGGAGGGTCCGTTCAGAAGTCAGAGGAGGAGTGGCGTGCCATCCTCTCCCCTGA
GCAATTCCGGATTCTGAGGCAGAAAGCCACAGAGAATCCAGGGAGAGGGGAGTATAACAAGTTTTTGGTGTAGGCACCT
ACCTGTGTGCTGGTTGTGGCACTCCCATCTATAGGTCTGCAACAAAATTCAACTCACCCTGTGGCTGGCCTTCTTTTTA
TGAGGGTCTCCCCGGGGCCATAAATCGCAATCCTGACCCAGATGGGGTGAGGATGGAGATAACTTGTGCTGCTTGTGGG
GGTCATCTTGGTCATGTTTTTAAAGGTGAAGGGTTTCGTACCCCAACGAATGAGCGCCATTGTGTCAATAGTATATCCC
TCAAGTTCAAACCACCAAATTTTTAATGCCTCGTGCCGAGTATGCAACGATTACTATGAACTTTAATCTTTTCTCTTGC
ATTTGTCTCGCAAAGATTGATGCTTTATTAACTGCTAATGAC

> SEQ ID NO: 6893 258970 124616_300424_1b
GACAAATGCTTTGAATCGTCTTTGCGTCAACCATTAAAAAAAATACTAAACAAATAAATACTATAGAAGCTTATCTTGA
TGGGTTCTCAGATTCTCAAAATCTCACCTTTTGCTTCTTCTTCAATTTTTAAAGCCACCCCAGTCTTGAGATTCCAAGC
CAAAACGGTAGTCACCATTTCTAAGATCCAATTCAGGTCAAATCCTCTCATTTCCTCATCTGGGTTTGTTCCTTTAAGT
AATAATAAGAGAGGTTTGAGAGGTGGGGTTGTTGCTATGGCTTCTGCAACAGGAGGGTCCGTTCAGAAAACAGAGGAGG
AGTGGCGTGCTATTCTTTCCCCTGAGCAGTTTCGTATTCTCAGACGGAAAGGCACTGAGTATCCAGGTACTGGGGAGTA
TGACAAGTTTTATGGTGAAGGAATCTACCAATGCACAGGATGTGGCACTCCTCTCTACAAGTCCACAACGAAATTCAAC
TCAGGCTGTGGTTGGCCAGCTTTCTTTGAGGGTCTTCCGGGAGCTATTAATCGCACTGCTGACCCCGACGGCAGGAGGA
TCGAGATCACTTGTGCAGCTTGTGGCGGCCACCTTGGTCATGTTTTCAAGGGTGAGGGGTTCCCTACCCCAACAGATGA
GCGCCATTGGGTCAACAGTATTTCCCTCAAGTTTACCCCAGAAAATTCATAATCCATTGCACTGATGATGTTATGATTA
TCACAGCTTTAT

> SEQ ID NO: 6894 258970 191486_300785_1b
CCCCCCCCGCTGGTCCTGTGGGCTTTTAAGCGGCGTCGCCGGTGGCCACGCACGCACCCAACTCTCACCTACTCTGCTT
CTGCTGCCCTCCTGCATCGACTCACTCCTCCACTCCCGTGTCGTCGTCGTCGTCGTCTGCTTCGTCGGCCGCCGCG
CGCCGCCCGCGATGGCGTCGTCGGGGGACAGCAGCGGCAAGCAGCGGAGCGACGAGGAGTGGCGCGCCGTCCTCTCCCC
GGAGCAGTTCCGCATCCTCCGCCTCAAGGGCACCGAGTTACCTGGAACAGGTGAGTACAACAAGTTCTATGGTGATGGG
GTCTACAACTGTGCTGGCTGTGGAACACCCCTGTACAAATCCACAACCAAGTTTGATTCTGGTTGTGGCTGGCCAGCAT
TTTTTGAGGGACTTCCTGGAGCCCATAAACCGAACACCGGATCCTGATGGAAGGAGGGTAGAAATCACGTGTGCAGCTTG
CGGTGGGCATTTGGGTCACGTGTTCAAAGGAGAAGGCTTCAAGACGCCTACTGATGAGCGTCACTGTGTGAACAGTGTT
TCGATCAAGTTCACCCCGGCCTCCTAAATCCTTTCCCAGGTCATTATTATTGGAGGTGAATTCCCCAGGGCTAAAGCTG
TGGAAAGCACTACAAAATAATGAATAAAATCACAGAGACATATCCTGTTTGTCCATATATGAATTCATCTCCTGTTAAT
TTAGCTGTAAACTTGTAACTTAACATTGCTGGGAATGGTAAATGAATGAATAAATGAATCTGGTTCATTAC

> SEQ ID NO: 6895 258970 258996_301750_1b
GCAGCATGGAAACGAAGGCGGCTCCTGAAGCTGGTATGATCAAAAGTCCAACGAGGAGTGGCGTACGGTTCTATCTCC
TGAACAGTTTAAGATTCTTAGAGAGAAATCTATTGAAAAGAGAGGGTCAGGAGAATATGTGAAGTTGTTCGAGGAAGGA
ATCTACTGTTGTGTTGGTTGTGGAAATCCGGTTTATAAATCAACCACTAAATTCGATTCCGGTTGCGGTTGGCCGGCTT
TTTTTGATGCTATTCCTGGCGCCATTAACCGAACCGAGGAGAGAGCTGGATTAAGATATGAGATAACTTGCACAAAATG
TGATGGACATCTAGGTCATGTCTTAAAAAATGAAGGTTTTCCAACACCAACTGACGAACGCCATTGCGTCAACAGCGTT
GCTCTCAAGTTCTCTTCCGCTATCACATCTCAGTGATAA

> SEQ ID NO: 6896 258970 258969_301701_1b
GCAGCATGGCGGCTTCTCCGTTGGTGGTTCAGAAAACAGAGGAGGAGGAGTGGCGTGCGGTTCTTTCTCCGGAGCAGTTTCG
TATTCTTCGTCAAAAAGGCACTGAAAAGCCAGGAACTGGAGAATATGACAAGTTTTTCGAGGAAGGAATCTTCGATTGC
GTAGGATGCAAGACTCCTCTTTATAAATCAACCACGAAGTTCGATTCCGGATGTGGCTGGCCAGCTTTCTTTGAAGGAC
TCCCTGGTGCCATAAACCGAACCCCTGATCCAGATGGGAGAAGAACTGAGATCACTTGTGCTGCGTGCGATGGACATTT
AGGCCATGTTTTCAAGGAGAAGGTTACGGTAATCCAACCGATGAACGTCATTGCGTTAACAGTGTTTCGATCAGTTTT
AACCCGGCAAAATCTTCCTCTATAATCTGATAA

> SEQ ID NO: 6897 258970 227393_301027_1b
CTTCCGTGTTCAATTATGTACGGATATGAACTTCTCTGGTTATCAGAAAAAAGTAGAACTGGAAGTGTAAATAGGTTAC
AGCCAAAAGTTTTCGACAATCATCAGACTTGGTATTTCGCATTATTGACAAACCGCAGAGTATAAATTGCTTTCTGAAA

FIG. 2 continued

```
AATCCGATACTTTTTTAATAATCACAGGTTTACTATGACTGCGCAGACTGTTCTATTGCGGGCTTATACTTCCATGCTC
AAAGCTTACTATCTTCTGAGGCTGGAATGAACTTGAGTGAGATACTGTTAACACAATGCCGCTCATCTGTAGGCGTGTT
GAACCCCTCCCCTTTGAAGACATGTCCTAAATGTCCTCCGCAAGCCGCACAGGTGATCTCTATTCGCCTGCCATCAGGA
TCAGGCGTTCGTGCGATGGCTCCGGGAAATCCTTCATAGAATGCTGGCCAACCACAACCTGAGTTGAATTTAGTAGATG
ACTTGTACAATGGAGTCCCGCATCCAGCACATTCATAAACACCCTCAGCGAAGAGCTTGTCATATTCACCTGTTCCAGG
ATACTCCGTGCCCTTGAGGCGGAGGATGCGGAACTGCTCCGGCGAGAGGATGGCCTCCCACTCCTCCTCCGACTTCTGC
ACG

> SEQ ID NO: 6898   258978   240953_301318_1b
GCGCCAATGTCGCCCGGGACGATCTATCTCGATGTCCCGGAATCGCCATCGCTCGACAGCACGGAATCCACGGCCGATG
CCGATGTGGTGTCAGTGACCGCGGTGGGGGCAGCAGCGGCAGCGGCCTCCTCGACGCCATCGGCCTCTTCCGGATCGTC
CAAGGCCTGCCCCAAATCCACCAGCAGCGTCCATGAGCTCCTGGAATGCCCGGTTTGCACCAACTCGATGTATCCACCC
ATCCACCAGTGTCCAAATGGCCATACCCTTTGTTCTACTTGCAAAGTTCGTGTTCACAATCGTTGTCCGACTTGCCGAT
ACGAGCTTGGAAACATTCGCTGCCTGGCCTTGGAGAAGGTGGCGGAATCGCTGGAGCTCCCCTGCAGGTACCAGGACTT
GGATGCCCGGATATTTTCCCTTACTACAGCAAGCTCAAGCATGAAGCTCAGTGTTGCTTCCGGCCTTACGGCTGCCCCT
ACGCGGGATCCGAGTGCTCGGTCAGCGGCAACATTCCGACTTTGGTTGCTCACTTGCGAGACGATCACAAAGTTGACAT
GCACAATGGCTGCACTTTCAACCATCGCTACGTGAAGTCGAATCCTCAGGAAGTCGAGAATGCTACTTGGATGCTCACG
GTTTTCAACTGTTATGGACAACACTTTTGCCTCCACTTTGAGGCATTCCAGCTGGGGACAATGCCGGTGTACATGGCAT
TTTTGAGATTCATGGGGACGACAACGACGCCAAGAACTTCAGCTATAGTCTCGAGGTCGGGGCAAATGGCAGGAAATT
GATGTGGCAAGGTGTCCCGAGGAGCATCCGGGACTGCCACAAGAAGGTGAGGGACAGCCACGACGGATTGATCATCCAG
AGAAACATGGCACTGTTCTTCTCCGGGGGTGACAGGAAAGAACTGAAGCTGAGGGTGACGGGAAGAATATGGAGGGAGC
AGTAGTGCAAGTTTCTTAGGCAGGGAAAACTAGAAAGGGAGCTCTGTAGCCACTATCAATTTCATGCTCTTTGAAATTG
TTGGCAATGGGAAAGGTGGGAGGATATATATTA

> SEQ ID NO: 6899   258978   108221_300261_1b
ATTGCACCAGAAAGTTCTGAATTAAAAAGCTCCCCTTTTAGAAAATCTTCAGCTATTACTGGTGGGAAGCATGGAGCGG
GATCTAATAGTGCTGTTCATGAACTACTTGAATGCCCTGTTTGTATGAATCCAATGTACCCGCCCATTCACCAGTGTCC
AAACGGCCACACATTATGCCACAAATGCAAGAAAAAGTACATGTATGCCCAATTTGCCGCCATGAGCTTGGAAACATA
AGATGTCTAGCGCTGGAGAAAATTGCTGAATCGCTGGAATTGCCATGCCGATACCAAATTTTTGGCTGTCAAGATATAT
TCACCTATCAGACTAGGCTTCTACATGAGCAGAACTGCAGATTTCGACCATACAATTGCCCGTATGCAGGATCTGAATG
CGCTGTTACTGGTGATATTCAGTACCTCGTTACACACCTAAAAGATGATCACAAAGTTGACATGCATGATGGGTGTACC
TTCAACCATCGTTATGTCAAATCTAATCCTCAAGAAGTCGAGAATGCTACATGGATGTTGACAGTTTTCAACTGTTTTG
GTCACCAGTTTTGCCTGCAC

> SEQ ID NO: 6900   258996   13823_300270_1b
CCCACGCGTCCGCATCAAAACCATTTCATCCGTAGTGGTCAATGGCGGCTTCTCCGTTGGTGGTTCAGAAAACAGAGGA
GGAGTGGCGTGCGGTTCTTTCTCCGGAGCAGTTTCGTATTCTTCGTCAAAAAGGCACTGAAAAGCCAGGAACTGGAGAA
TATGACAAGTTTTTCGAGGAAGGAATCTTCGATTGCGTAGGATGCAAGACTCCTCTTTATAAATCAACCACGAAGTTCG
ATTCCGGATGTGGCTGGCCAGCTTTCTTTGAAGGACTCCCTGGTGCCATAAACCGAACCCCTGATCCAGATGGGAGAAG
AACTGAGATCACTTGTGCTGCGTGCGATGGACA

> SEQ ID NO: 6901   258996   243570_301340_1b
AGGGTTCTTGGAGGAATGGCGCTCTGCGGAGCAGGGGCAGCGATGGCGCTGGATCTAGCGCCGCGAATGCGGCCCCTAG
TTCAGCTTGGATCGTCGTGCAGAGGCCAGCGAATGCGGGCAATGTGTTCGGTCGAGCGCATTCACCGGACGGAGGAGGA
GTGGAGAGCTGTGCTCAATCCCGAGCAGTTCCGGATATTGCGGACGAAAGGAACAGAAATGCCAGGAACTGGCGAGTAC
AACAAGTTCTACAAGGACGGTGTCTACAACTGCGGGGGCTGTGGAACACCCTTGTACAAATCGACAGCAAAGTTTGATT
CCGGTTGTGGATGGCCAGCTTTCTTTGAGGGTCTCCCGGGAGCAATCAACCAAACGGTTGATGCCGATGGCCACCGCAC
TGAAATTACTTGTGCTGCCTGCGGAGGACACCTCGGTCACGTCTTTAAAGGCGAAGGCTTTCCAACTCCGACTGATGAA
CGCCACTGCGTCAACAGCGTGTCGCTCAAGTTTGTCCCCGGCAACAAGGACGACTAAAACCGAAGGCGACGGAACTGCA
TTATATATGACTGGCAAATAAACCGTCAATGTTCTAGTCAAGGCTTAGTCCACGTACGT

> SEQ ID NO: 6902   259006   202443_300784_1b
CCCCCCCCCCGGAATCTGACACGTCCACATCGCCAGTTAGAGCAGTTCGAGGAAGGAGGAGGAGGAGGTTGATTCGATG
GGGATGGAGGCGGAGTGCGATAGGATAAAGGGGCCATGGAGCCCTGAGGAGGACGAGGCGCTGCGGCCGCTGGTGGAGC
GGCACGGGGCGAGGAACTGGACGGCGATCGGGAGGGGGATCCCGGGGAGGTCGGGGAAGTCGTGCAGGCTGCGGTGGTG
CAACCAGGTGTCTCCGAAGGTGGAGCGCCGCCCGTTCACGGCGGAGGAGGACGCCGCGATACTCCGGGCGCACGCCCGC
CTCGGCAACCGGTGGGCCGACATCGCGCGCCTCCTCCCCGGCCGGACCGACAACGCCGTCAAGAACCACTGGAACTCCT
CCCTCAAGCGCAAGCT
```

FIG. 2 continued

> SEQ ID NO: 6903 259006 316828_301427_1b
GCAGCATGGGAAGAGCACCGTGTTGTGACAAAGCAAACGTGAAGAAAGGGCCTTGGTCTCCTGAGGAAGATGCAAAACT
CAAATCTTACATTGAAAATAGTGGCACCGGAGGCAATTGGATCGCTTTGCCTCAAAAGATTGGTTTAAAGAGATGTGGA
AAGAGTTGCAGGCTGAGGTGGCTTAACTATCTTAGACCAAACATCAAACATGGTGGCTTCTCTGAGGAAGAAGAAAACA
TCATTTGTAGCCTTTACCTTACAATTGGTAGCAGGTGGTCTATAATCGCTGCTCAATTGCCGGGACGAACAGACAACGA
TATAAAAACTATTGGAACACGAGGCTCAAGAAGAAACTCATTAACAAACAACGCAAGGAGCTTCAAGAAGCTTGTATG
GAGCAGCAAGAGATGATGGTGATGATGAAGAGACAACACCAACAACAACAAATCCAAACTTCTTTTATGATGAGACAAG
ACCAAACAATGTTCACATGGCCACTACATCATCATAATGTTCAAGTTCCAGCTCTTTTCATGAATCAAACCAACTCGTT
TTGCGACCAAGAAGATGTTAAGCCAGTGCTCATCAAGAACATGGTCAAGATCGAAGATCAAGAACTGGAGAAAACAAAC
CCTCATCATCATCAAGATTCAATGACAAACGCTTTTGATCATCTCTCT

> SEQ ID NO: 6904 259006 37669_300081_1b
CCCACGCGTCCGTACCTTTTACAATTTGTTTATATATTTTACGTATCTATCTTTGTTCCATGGAGGGTTCGTCCAAAGG
GCTGCGAAAAGGTGCTTGGACTACTGAAGAAGATAGTCTCTTGAGACAGTGCATTAATAAGTATGGAGAAGGCAAATGG
CACCAAGTTCCTGTAAGAGCTGGGCTAAACCGGTGCAGGAAAAGTTGTAGATTAAGATGGTTGAACTATTTGAAGCCAA
GTATCAAGAGAGGAAAACTTAGCTCTGATGAAGTCGATCTTCTTCTTCGCCTTCATAGGCTTCTAGGGAATAGGTGGTC
TTTAATTGCTGGAAGATTACCTGGTCGGACCGCAAATGACGTCAAGAATTACTGGAACACTCATCTGAGTAAGAAACAT
GAACCGTGTTGTAAGATAAAGATGAAAAAGAGAGACATTACGCCCATTCCTACAACACCGGCACTAAAAAACAATGTTT
ATAAGCCTCGACCTCGATCCTTCACAGTTAACAACGACTGCCAACCATCTCAATGCCCCACCAAAAGTTGACGTTAATCC
TCCATGCCTTGGACTTAACATCAATAATGTTTGTGACAATAGTATCATATACAACAAAGATAAGAGAAAGACCAACTA
GTGAATAATTTGATTGATGGAGATAATATGTGGTTAGAGAAATTCCTAGAGGAAAGCCAAGAGGTAGATATTTTGGTTC
CTGAAGCGACGACAACAGAAAAGGGGGACACCTTGGCTTTTGACGTTGATCAACTTTGGAGTCTTTTCGATGGAGAGAC
TGTGAAATTTGATTAGTGTTTCGAACATTTGTTTGCGTTTGTGTATAGGTTTGCTTTCACCTTTTAATTTGTGTGTTTT
GATAAATAAGCTCATAGTTTTTAGCATTTTAATGAAATATTTCAAGTTTCCGTGTTACAAAAA

> SEQ ID NO: 6905 259006 113105_300022_1b
GAGGCTCCGCCTCCCACCGTCAAATTGTAAATTTGGTTTTTTCCTCTCCGTTAATCACCGGAAATCTCTCGATTCCG
GTTTGTCATAATCTATCTCAGTTACCTTTTTCTGTCTCTTAACCAGTTTCTATGGCGGCGATTACACAACGAAAAGAATC
GGATCGGATTAAGGGTCCATGGAGTCCTGAAGAGGACGAGCTGTTGCAGACTCTAGTGGAGAAACATGGACCCAGAAAT
TGGTCTTTAATAAGCAAATCGGTTCCGGGTCGATCCGGAAAATCCTGCAGGCTCCGATGGTGTAACCAGCTTTCCCCTC
AAGTGGAACACCGTGCTTTCACTCCAGAGGAGGATGAAACCATCATCAGGGCCCACGCTAAGTTCGGTAACAAATGGGC
TACTATTGCCCGTTTACTATCGGGTCGGACCGATAACGCTATTAAGAACCACTGGAACTCTACTCTTAAACGTAAGTGT
TGTTCCATGTCTGAAGATTTAAGCTTTGAAACTCCTCAACAGCCTTTGAAAAGATCGTCTAGTGTCGGTCCTAGTAACA
ACTTTTCTTCTGGCATGAATCCGGGTAGCCCTTCCGGATCCGACTTGAGTGATTCGATTCCTTCGGGTTTTACCCAATC
GCTTG

> SEQ ID NO: 6906 259006 13503_300249_1b
CCCACGCGTCCGCAATCCCTCAATATAAAATAACAAGTAGAATTGATCTGCCTATATATAAGATTTTGAGACGAAATAA
GATCTAAACCACAAGAAAGAAAGTAAACATAAAAGTATGGGAAGGTCACCGTGCTGTGAGAAAGCTCACACAAACAAAG
GAGCATGGACGAAAGAAGAGGACGAGAGGCTCGTCGCCTACATTAAAGCTCATGGAGAAGGCTGCTGGAGATCTCTCCC
CAAAGCCGCCGGACTTCTTCGCTGTGGCAAGAGCT

> SEQ ID NO: 6907 259006 11937_300283_1b
TGGTATCAACGCAGAGTGGCCATTACGGCCGGGGGATAATAAAAGAACATGCAATATTTCTCAAGATGTTGAAGTTAG
GAAAGGTCCTTGGACTATGGAAGAAGATTTGATTCTCATCAATTACATAGCTAATCATGGTGAAGGTGTTTGGAATTCC
CTTGCTCGATCTGCTGGTCTGAAGCGTACCGGAAAAAGTTGTAGACTCCGGTGGCTAAACTATCTCCGTCCGGATGTTC
GGAGGGGAAATATTACACCTGAAGAACAACTCTTGATTATGGAACTGCATGCCAAATGGGGAAACAGGTGGTCAAAAAT
TGTAAAGCATTTGCCAGGAAGAACAGATAATGAGATAAAGAACTATTGGAGGACAAGGATTCAAAAGCACATTAAACAA
GCAGATCAAAGCATGAATATTAGAGCATCATCAAATTCTGAGGACAACCATCATCAACAAGCTAGTA

> SEQ ID NO: 6908 259007 105364_300373_1b
AAAAACTAAAGCTAACACTTGTTTCTTTTTCTTTTCAATGGGACATTCCTCCTCGGTACTGGTCTTCTTTTCACACATA
GATGGGTAGTTTTCATGATATTTCTAGCACAGGCCTGGTTTTAGGATTAGGCTTTTCCACAACGGTTGATCAGAAATCA
ACAAAAATTCTACTGGCCGGCAAAGGGCCGTCTCTTGGCTTGAACCGTCACTAACGTTAAGCCTTCCGGTGATCATA
CCTATAATGAACAGCAGCAGGCAGCTAAGAAGGTTAAGAATGATCATCAATCGGCTGATTTGTATCGTCAAGATAGTGC
AGCTTCCTCCTACTCAAATGCTAGTGTGAAAAGGGAGAGAGACGCTGGAAGTGAAGAGATAACGACTGAGGTAGAGAGA

FIG. 2 continued

GTTTCCTCCCGAGTTAGCGATGAAGATGATGATGGTTCTAACGCTAGGAAGAAACTTAGGCTCACTAAAGCACAATCTG
CTCTTTTAGAGGAAAGCTTTAAGCAACACAGTACTCTCAATCCTAAGCAAAAACAGGACTTAGCCAGGGATCTGAATCT
AAGGCCTCGTCAGGTTGAAGTCTGGTTCCAGAACAGAAGAGCCAGAACAAAGCTGAAGCAAACAGAGGTAGACTGTGAG
TTCCTGAAGAAATGTTGCGAGACGCTAACAGAGGAAAACAGGAGGCTTCACAAGGAATTGCAAGAACTGAAGGCTGTAA
AAATAGCGCAACCTTTGTACATGCAGCTGCCGGCGGACATGTTAACCATGTGTCCTTCTTGCGAGAGGATCGGCGGCGT
CGGAGAAAATCCGTCGAAGAATCCTTTCACTTTGGCTCAGAAGTCTCACTTCTACAATTCCTTCACCAATCCATCAGCA
GCTTGTTAAGTAGAGGGCATATATAAATTAAATAATATACTCTCTAATAGTATATTATACCAATATCATCTTTACAATA
TGATCTCCCAAGGCCGCCACTTTTTTGGTTAAGGGCTTGTATGAAATCAACTGAGTAGTGCAGTAGTATGTGTAGAGT
TAGATTTAAGGTCACTAATCAATCATTTTAATTTGTTTCTTATGATCATATAATAAGTCCGTAAATAGTTAAGGAATAT
AATACATATAT

> SEQ ID NO: 6909  259007 159129_200140_1b
TGAGTCTAAGCTTATTAGGATCATCAGGAGAATCTACTACTCCTAATGATAGTACTATTCATCAACATAAAACAAGAG
AAAATTAAACCAAGATCAAGAATTAGATATTAATCCTCTCCCTTCTTTAACTCTTTGCTTATCATCTTCAGCTGTTAAT
TCGTCGGTAGTAAGTGCTGCAGTTTCTTCATTTTCTAACTCAAGTGTCAAAAGGGAAAGAGATGCTAGTTTTGAAGAAG
AAGTAGAATTGGATACCAATAAAGTAATTATTTCTCCAAAGTTAGACGATGTTGATCAGGAACAAGATGAAGATCATGA
GTTTGGTACCAGGAAGAAACTTAGACTTACTAAGGAGCAATCTGCGGTTTTAGAAGATAGCTTCAAAGAGCATAGTACT
CTTAATTCTAAGCAAAAGCGAGATCTAGCAACACGATTAAGTTTACGTCCTCGACAAGTGGAAGTATGGTTTCAGAATC
G

> SEQ ID NO: 6910  259007 120306_300384_1b
CTCTCCTATTTGAAAAAGTTGAAATCTTTTTAAGTTTATTTTGAAGAATATTATTGAAGATACAAAATGTTGGAAAATC
AAGATTTGGGATTAAGTTTGAGTCTTAGTTTTCCAGAAAACAAAACAACAAATTCATTGCAGCTGAATTTGTTCTCTTC
TTTAGCTTCTTCAACTTCTCCTTCTCCTTCACCTTTTAATCTATTTCAGAAAACTTGTTGGACTGACTCATTTCCTTCT
TCAGATCGGAACTTGGAGACATGCAGAACTTTTTTGAAGGGAATAGATGTAAACAGAATTCCAACAATTACAGATGCAG
AAGAAGAAGGTGGAGTTTCTTCACCAAATAGTACTATTTCAAGTTTGAGTGGAAATAAGAGAATTGAAAGAGAAATAAA
TTGTGAGGAAGAATTGGATTGTTGTAGAGGTATTAGTGATGAAGAAGATGGAGAAACTTGTAGAAAAAACTAAGACTT
ACTAAAGATCAATCTGCTGTTCTTGAAGAGAGTTTTAAAGAACACAACACTCTCAACCCTAAGCAAAAGCAAGCTTTGG
CAAAGAGACTAGGATTGAAACCTAGGCAAGTGGAGGTTTGGTTTCAAAACAGAAGGGCAAGGACAAAATTGAAGCAAAC
AGAAGTAGACTGTGAATTCTTG

> SEQ ID NO: 6911  259007 258949_301750_1b
TTACTAATGAGAACCAGAGCAGGTCGTTGCCGTAGAGGCATGGCAGCCCACGGACTCATCGGACCCATCGGAGACGATG
AATTCATCACAGGAGGACCCACCGATGACGAAGATGACGTAACAGCGACTCGCTCGCAAGAAGGACACATTGTGAGAGT
AGTGGGAGGTTTCATGTGCATGTATAAGTGTGGGAGAAAGCTTTAAAGCCCTAAGCTCACTCACTTCCTTTTGCAATCTC
CGATTCTCATCCGTTAGATTCTCGCAACATCTCTTAAGATATTCACAGTCTACTTCCGTTTGCTTCAGCTTCGTCCTTG
CCCTTCGGTTTTGGAACCACACTTCAACTTGTCTCGTCCTCAGATTCAATTGCTTAGCCAAAGCCATCTTTTGCTTCGG
ATTGAGTGTACTATG

> SEQ ID NO: 6912  259007 258981_301750_1b
TTATTAGGACCTAGGACGAAGAGCGTCAAAAGTCAAACCGTCGAGATATCCTCGTCGCAGGAGCCCACGCATTGACCGGC
AACGACCGGTGGTGCGCTGACGTAACAGCCTGAGGTTGTGGTGGCGGGACCGACACGTGTGCACATGAAGGGCACATGG
TCAAAGTAGTGGGTGGGCTCATGTGCATGTAGAACTGAAGAGAGAGCTTAAGTGCTCTCAATTCCGTTACTTCTTTTTG
TAACCGACGGTTCTCTTCCGTTAGATTCTCGCAGCATCTCCGTAAGAACTCGCAGTCTACCTCCGTTTGCTTCACCTAT
GTTCTTGCTCGTCTGTTCTGAAACCAAACTTCCACTTGTCTTGCTCGTAACCCTAAT

> SEQ ID NO: 6913  259007 258981_301701_1b
GCAGCATGATGTTCGAGAAATACGATCTGGGTCTAAGCTTAGGCTTGAATTTTCCAAAGAAACAGATCAATCTCAAATC
AAATCCATCTGTTTCTGTTACTCCTTCTTCTTTTGGATTATTCAGAACATCTTCATGGAACGAGAGTTTTACT
TCTTCAGTTCCAAACTCAGATTCGTCACAAAAAGAAACAAGAACTTTCATCCGAGGAATCGACGTGAACAGACCACCGT
CTACAGCGGAATACGGCGACGAAGACGCTGGAGTATCTTCACCTAACAGTACAGTCTCAAGCTCTACAGGGAAAAGAAG
CGAGAGAGAAGAAGACACAGATCCACAAGGCTCAAGAGGAATCAGTGACGATGAAGATGGTGATAACTCCAGGAAAAAG
CTTAGACTTTCCAAAGATCAATCTGCTATTCTTGAAGAGACCTTCAAAGATCACAGTACTCTCAATCCGAAGCAGAAGC
AAGCATTGGCTAAACAATTAGGGTTACGAGCAAGACAAGTGGAAGTTTGGTTTC

> SEQ ID NO: 6914  259028 183521_300623_1b
CGCCACTTCCTCACCTTGGCTTCTCCCACACGCAGCAGCAGCAGCCGCCGCCGCCTCGTTTGCTCGCCGCGTCCACGAC
CGGTGGTTGCCGCGGTGACCGGTAGCTCGGTGTCGCCCCCACCGTCCGGCCTGCGTTGCAAAGGCGTGACGCGAGCTTT

FIG. 2 continued

TATGCTCGAGGCAGCTTGCTTCTTGGACGCTAGTAGCAGCAGCATCGGCGGGAGTGGTACCCGCGTCCACGGAACTTCT
GCAAAAGAAAGATTCTCGGATGGAGGTCGAGACGTCGTCCGGGACGGCCGAGCGCGGGGCGGGCGCGGGCGCGCAGCAG
CAGCCTCCGCCGCAGCCGCAGCCGCAGCCGCCGGCCAAGAAGAAGCGTGCACTCCCCGGCATGCCAGATCCTGATGCGG
AGGTGATCGCGCTGTCGCCCAAGACGCTGCTGGCGACGAACAGGTTCGTTTGCGAGATCTGCAACAAGGGGTTCCAGCG
CGACCAGAACCTGCAGCTGCACCGGCGCGGGCACAACCTGCCGTGGAAGCTGCGGCAGCGGAGCGGGAAGGAGGTGCGG
AAGCGGGTGTACGTGTGCCCGGAGCCGACGTGCGTGC

> SEQ ID NO: 6915 259028 114396_300007_1b
CTTTTTAGAAAATTTCATTTATAGCAAAGGGTTACATATTAGAAGTAGAGGAAAAATAAGAAAAGGGGTATCAAATAGC
TCACCATGGGAGGATAATTCTCTTCCTCTTACTCACTCACTCTTCTATTTTATTAGCTCAAATCAGTTCAGCACCAACT
TGTGTTTTGAGAGGGTTTTCCATATAAGCTCAAGAATTTAGCCCAAAAGAAAGATGGCTGCAGGGCCTTCATCAGCTGT
GTTTCTTGCAATGAGAGAAGAAGAACAAAACCAACAGATGAAACAACAACACGAACTTCTCATTCAGCAGCAACCACAA
CAACAGCAAGCACCACAAAAGAAGAGAAGAAATCAGCCTGGCACACCAAATCCAGATGCAGAGATAATAGCACTATCAC
CTAAGACCCTAATGGCAACAAACAGGTTCGTATGTGAGGTATGCAACAAAGGTTTTCAAAGGGAACAAAACCTACAGCT
ACACAGAAGAGGACACAATTTACCTTGGAAGCTAAAGCAGAAGAGTACAAAAGAAGTGAAACGCAAAGTTTATTTGTGC
CCTGAGCCTACATGTGTTCACCATGACCCTTCTCGAGCCCTTGGCGATCTCACTGGTATTAAGAAACATTACTCCAGAA
AACATGGTGAGAAGAAATATAAGTGTGAAAAATGTTGTAAAAAATATGCTGTCCAGTCTGATTGGAAAGCTCATACTAA
AACCTGTGGTACTCGCGAATACAAATGTGATTGTGGCACCCTTTTCTCAAGGCGTGATAGTTTCATCACCCACAGAGCC
TTTTGTGATGCATTGGCACAAGAAAGTGCGAGAAATCCACCAAGTTTGAGCAGCATTGGGAGTCATTTATATGGGAGTA
GCAACAACATGAGTT

> SEQ ID NO: 6916 259028 285181_200103_1b
GTTCTTTTAGTTGCGAAAAAAAACTAAACCTTGTTTGTTTGGGTGATGCCAAAGTAAAGGAAGAAGAAACTAAATCAG
AAAGAGTATAGGGAATAGAAGTTTTTGAGGTTCAAACAACTACAAAAAGAAACAAGATTTTTGCCTCTATTCATGTCTA
TTTCCTTCACTTAGCTAGCTACTTTAGCTTGTTCTAGTTAGGTTTGGTTTTGTCTTTAGATCCTCCCAATCTCTCCTTT
GTTTTAGTTTTAAGCAAAAAAGCTTTTGATTCTATAGCTAGGTAACTAGATGATGAATATTCAACAAAAGCACCAACAT
GTTCATATAGTGGAGGAAAACATGTCCAATTTAACTTCTGCATCTGGTGAAGCAAGTTTATCTTCTTCTAACAACATGA
ATGATACTACTACTGGAGCCATTTTCATTCCTCATAATCAAAATCCACCCCAGCAACAAATCAAGAAAAAGAGAAACCA
AGCTGGCAATCCAGATCCTGAAGCAGAAGTGATAGTTTTGTCACCAAAGACACTACTGGCAACCAATAGATTCTTTTGT
GAAATCTGTAACAAAGGTTTTAAAAGAGATCAGAATCTGCAACTCCACAGAAGAGGACACAATTTGCCATGGAAGCTGA
AGCAAAGAACAAATAAAGAAGTGATTAGAAAGAAGGTTTATGTTTGTCCAGAGCCCAGTTGTGTGCACCATGATTCCT

> SEQ ID NO: 6917 259028 285516_200105_1b
TTCTTTTCACTTCTCTCAGCTAGGGTTTGAGACATAGCTAAATATATATAAAGTAGATTATCTCTTTTTTTAATGCAAT
GATTAAGGGCATGGTAGGAGATGATAGTATGTCAAATTTAACATCTGCATCTAATGAAGCAAGCATATCTTCAAGTAAT
AGAGCTGAAATTGGTAGTACTCTCTACCCACAGCATCTTGCACCAACAAACATTCAAACACAACCAGCTGCTAATAAGA
AGAAGAGAAATCTACCAGGCAATCCAGATCCAGAAGCAGAAGTGATAGCTTTATCTCCAAAAAGTCTATTGGCAACAAA
TAGATTTGTATGTGAGATCTGTAACAAAGGATTTCAAAGAGATCAAAATCTTCAACTACACAGAAGAGGTCATAATTTG
CCATGGAAACTAAAGCAAAGAACAAACAAGGAAGTGAAGAAGAAAGTATATGTGTGTCCAGAGCCTTCATGTGTACACC
ATCATCCTTCAAGGGCACTAGGGGATTTGACTGGAATTAAGAAGCATTTTTGTAGAAAACATGGTGAGAAGAAATGGAA
GTGTGATAAATGTTCAAAGAGATATGCAGTTCAGTCTGATTGGAAAGCTCATTCCAAGATTTGTGGTACTAGAGAGTAT
AGATGTGATTGTGGAACCC

> SEQ ID NO: 6918 259045 258931_301750_1b
TTATCAGGGGTATGACGGCCAGCCAGATGAATCAAACAGCATCGGATTGTTGGGTGGAGCGTAAACTTGATTCCCTCCG
GTGATTTGATTTGCGTTCATATTCTCCGTTCTTGGATGAGCTACCACCACCGATGAAATCTCCACCGTGTCTTCCTCAC
CGGAAACTTTGATGGTCCCGGCAGAGATTTGCTTCTTGATCAAACCCTGGTCTCTTAGTAAAGCTCTCAGCTTCTTCAC
CTCATCGTGTAACATTTGTTTCTCCCTAGAAACGACGTCGTACTCTTGTCTAAGCGAGTCGTACAACTGCTCAAGCTGC
TTCGCCTTCCACCGTGCACGGCGGTTTTGGAACCAAACTGCTATCTGACGTGGCTGCAGACCGAGCTCTCTCGACAGCT
TCACCTTCCTGTCTGAATCTAATTTGATCTCTTCTTGAAAACTTCGCTCAAGTGAAGCTAATTGTCCACTCGTTAGTCT
CTTCTTTTTTATCATCTCATTGTTGTTGTTCGGAAATCGGTACGCATTCATGATCTTTTCTGATTCCGGTACAGAGATA
ACCGGTCCGGTTTGTGTATCGCCAGGCGTATATGAATTTCCTGCGTAAGGATCAAAGTTGAAGCTGTGGAGCGAGTTAA
AGGAACTAGACTCCGGCCATGGCGGTGGCATGAAAGCTACTCTCACGTTTTATACGTTGCTCGTTGTTGACCACTCCAT
GCTGC

> SEQ ID NO: 6919 259045 42031_300147_1b
TTCGATGATGAAGATGGAGAACTCCTCAAAGAAGCGACCTTTCTTTAGCTCGCCGGAGGAACTATATGACGAGGAATAT
TACGACGAGCAGTCGCCGGAGAAGAAACGCCGTCTCACTCCCGAGCAGGTGCACTTGCTGGAGAAGAGCTTTGAGACGG

FIG. 2 continued

AGAACAAGCTGGAGCCAGAGCGTAAGACTCAGCTAGCCAAGAAGCTTGGCCTGCAGCCCAGGCAGGTGGCTGTGTGGTT
CCAAAACCGCCGTGCCCGGTGGAAGACCAAGACGCTTGAAAGAGATTATGATCAGCTCAAATCCTCTTATGACTCTCTT
CTCTCTGATTTTGACTCCATGCGCAAAGATAATGAGAAGCTCAAAGCT

> SEQ ID NO: 6920  25975  50564_300167_1b
TTTCTTTTTCTCCTTTTGTCCGTACGCGTTTTCTTACCGGTGACCTGAAAGTCTCAAAAAATGGCGGCGTATAGAGCTG
ACGATGATTACGATTTCCTCTACAAGGTGGTATTAATCGGTGATTCCGGCGTCGGTAAATCCAATCTGCTTTCTCGATT
CACGCGCAACGAGTTCAGCCTCGAGTCTAAATCCACCATCGGTGTCGAATTCGCCACCCGAAGCATTCATGTCGATGAA
AAAATCGTCAAGGCTCAGATTTGGGACACCGCCGGCCAAGAGAGATACCGAGCAATCACAAGCGCATACTATCGAGGAG
CTGTTGGGGCTTTGCTTGTTTATGATGTTACACGGCATGTGACATTTGAGAACGTTGAGAGAT

> SEQ ID NO: 6921  25975  7863_300306_1b
CCCACGCGTCCGCTACAATTCCTCTGTCGCTCTCACCAGTTAACAGCTACAGCACAAAACTGTAACCACGCTTCCGATC
TCTAAAACCTGAGAGAGAGAGAGAGAGAGAGAGAGAGACAGAGAGAAGTGTTTCAATAGTTTGGCGTGAAGATGGCCGGAG
GAGGCGGATACGGCGGCGCATCGGGGAAAGTTGATTACGTCTTCAAAGTTGTTCTAATCGGAGATTCGGCTGTTGGGAA
ATCGCAACTACTTGCTCGATTCGCTAGAGACGAATTCAGCATGGATTCTAAAGCCACCATCGGCGTCGAGTTCCAAACT
CGTACCCTCTCCATTGAACAAAAAGCATTAAGGCTCAGATCTGGGATACCGCTGGTCAGGAAAGATACAGAGCCGTTA
CAAGCGCATACTACAGAGGAGCAGTTGGCGCAATGCTGGTTTATGATATGACGAAACGTGAGACCTTTGAGCATATT

> SEQ ID NO: 6922  25975  1008561_301416_1b
TCTGATTCTTTCGCCTCTGTCGAGAATCATCATAAATGGCGGCGGCCGGCTCTACCAATCTGCAAGCTAAATTGGTGCT
TCTAGGCGATATGGGAGCGGGAAAATCCAGCCTAGTTTTGCGGTTTGTGAAAGACCAGTTTCACGAATACCAGGAGTCA
ACAATTGGTGCAGCTTTCTTTTCGCAAACTTTAACTGTGGATAGCACAACTGTGAAGTTTGAAATTTGGGATACAGCAG
GTCAGGAAAGGTATCACAGCTTGGCACCTATGTATTACCGGGGAGCTGCTGCAGCTATTATAGGATATGACATCACAAA
TCTTGATTCATTTACTCGAGCAAAGAAGTGGGTACAAGAGCTTCAAAAGCAAGGTAACCAAAATCTGGTCATGGGCCTC
GCTGGAAACAAGGGCGATCTAACATCCAAAAGAAAAGTTGAATC

> SEQ ID NO: 6923  25975  127573_300470_1b
TCCGATCCCGTATGGTTGGAGATATTCCCCTTCATCATTTTTTCCTGAGAAAATTCAAATGGCCGTTCCACCCGCTAGA
GCTCGAGCCGATTATGATTACCTAATCAAGCTCCTCTTGATCGGCGACAGCGGTGTGGGTAAGAGTTGCCTTCTTTTAC
GTTTCTCAGATGGCTCCTTCACGACCAGTTTTATTACAACTATTGGCATTGACTTCAAGATAAGGACCATAGAGCTTGA
TAGCAAACGAATCAAACTACAAATCTGGATACTGCTGGTCAGGAGCGGTTCCGAACAATTACAACTGCTTACTACCGT
GGAGCCATGGGCTATATTGCTGGTGTATGACGTGACTGATGAGTCATCTTTTAACAACATCAGGAACTGGATAAGAACA
TTGAGCAGCATGCTTCCGACAATGTCAACAAAATTCTGGTCGGCAACAAGGCTGACATGGACGAAAGCAAAAGGGCTGT
TCCTACATCAAAAGGTCAAGCACTAGCCGACGAATATGGCATTAAATTCTTTGAGACAAGTGCCAAGACAAATATGAAT
GTGGAGGAGGTTTTCTTTTCCATAGCTCGGGATATAAAGCAAAGACTTGCTGAATCTGACTCAAAGGCTGAGCCTCAGA
CTATCAGGATAAATCAACCAGACCAGGCAGCAGGAGCTGGTCAAAGCGCTCAAAAATCAGCTTGCTGTGGCTCTTGAAA
AATTGACGGCAAGAAAGACAGGATGATGGGAATACATCCTTAAAGTTACCATTTTAGTGGGAAGGGTGGAACTAATCT
TTGTTATAACATTCTCACCATCGATTGTATTTTCTCTTTACAGTTATTTTCTTCAATATCTA

> SEQ ID NO: 6924  25975  144467_200135_1b
GATCGAAGCCCCAAAAACATGCGCAGAAAAGGTCGGTTGTCCAGATAAGGGAGTAGTACATATTATGCTCAATAACAAC
TACTGGGCATCAATCATCAATTCTACTGGAAACGTCTAAAATTGCCAACTGTCTGTCTTCCTCACGCCACACACACACA
CACATACCGGCGCGGAGTTTTCTGAATTTAGTCTCGTTTTGTCAGATCGAAGTCCGCCGAAGATGCCTTCACGCCGGCG
AACTCTTTTGAAAGTCATCATCCTCGGTGATAGCGGGGTTGGGAAGACCTCGTTGATGAATCAATATGTAAATAAGAAG
TTCAGCAACCAGTACAAAGCAACTATTGGGGCTGATTTCTTGACAAAGGAAGTGCAGTTTGAAGATCGGCTCTTTACAT
TACAGATTTGGGACACAGCTGGCCAAGAGAGATTTCAAAGTCTTGGTGTTGCGTTCTACCGTGGTGCTGATTGCTGCGT
CCTTGTGTATGATGTAAATTCAATGAAGTCATTTGAAAACTTAAACAATTGGAGAGAAGAGTTTCTAATTCAGGCAAGC
CCATCGGATCCAGAAAACTTTCCATTTGTTGTGCTGGGGAACAAAGTTGATGTTGATGGTGGAAATAGTAGAGTGGTGT
CGGAGAAAAAAGCTCGGGC

> SEQ ID NO: 6925  25975  157891_301743_1b
GTTGGAAAGTCATGTCTTCTCCTGAGATTTGCTGATGATTCTTATTTGGACAGTTACATCAGCACAATTGGTGTTGACT
TCAAAATACGCACTGTGGAGCAAGATGGGAAGACAATGAAACTTCAAATTTGGGACACTGCTGGACAAGAACGCTTCAG
GACGATTACCAGTAGTTACTACCGTGGGGCACATGGCATCATTATAGTTTATGATGTAACTGACCAAGAAAGCTTTAAC
AATGTTAAGCAATGGTTGAGTGAGATTGATCGTTATGCAAGTGACAATGTAAACAAGCTTCTGGTTGGGAATAAGTGTG
ACCTGGCTGACAACCGTGCTGTGTCTTATGATACAGCAAAGGCTTTTGCTGATGAAATTGGTATTCCATTCATGGAGAC
TAGTGCAAAGAATGCCACTTATGTTGAGCAGGCCTTCATGGCAATGGCAGCTGACATAAAGAA

FIG. 2 continued

> SEQ ID NO: 6926 25975 155872_301360_1b
TCTTTTATTTACAGAAAAAACAGCATAAGTGTTCTCCTCTCACGGCCTCAAAAACTCCGAACAGTCGAAAGAAACACACA
AAGACAAAATCCTCCGGGGAAAAAGAATATGAGCAACGAATATGATTACTTGTTCAAACTATTGCTAATCGGAGATTCT
TCTGTTGGCAAATCTTGTCTTCTTCTCAGATTCGCTGATGATTCGTACGTTGAAAGTTACATAAGCACAATTGGGGTTG
ATTTCAAAATTAGGACCGTGGAGCTGGATGGAAAGACAATCAAGCTGCAAATTTGGGATACTGCTGGGCAGGAACGGTT
CCGGACTATAACAAGCAGTTACTATCGTGGAGCACATGGGATTATTATTGTTTATGATGTAACTGAAAAGGAGAGCTTC
GACAATGTCAAGCAATGGCTGAGTGAAATTGATAGATATGCAAATGAAAGTGTTTGCAAGCTTCTGGTTGGAAACAAAT
GTGATTTGGTAGAAAATAAGGTTGTGGACACACAGACAGCAAAGGCATTTGCAGATGAGTTAGGTATCCCTTTCATTGA
GACAAGTGCAAAAGATTCCATTAATGTGGAGCAGGCTTTCTTGACGATGGCTGGAGAGATTAAGAAAAAAATGGGTAGC
CAACCTGCTGGAGCAAAGAACTCAGGTGGCG

> SEQ ID NO: 6927 25975 113718_300005_1b
ATTTGGTGCAAAGCCAATCTTGGGTATTTTTGTGTGTAGAGGCAGGCATTTGTTGGTTTACAACATGAACCAAGAAATG
AGTGGCGTTATAGTTGCGGATCAGAAGCAGCAGCAAGAAATGAAAGGTGTGAATGGGGGTGTTCATGAGGATATTAAGA
TTGACTACGTGTTTAAGGTTGTGGTAATTGGGGACTCTGCTGTCGGTAAAACTCAGGTGCTGTCCAGGTTTGCCAAGAA
TGAGTTCTGTTTTGACTCCAAATCTACCATTGGTGTGGAGTTTCAGACTAGGACTGTCTCCATTCAGTCCAAAATCATC
AAAGCCCAGATCTGGGACACTGCTGGCCAAGAAAGGTACAGAGCAGTGACAAGTGCATATTATAGAGGAGCACTAGGAG
CTATGTTAGTTTACGACATAACAAAGAGACAGAGCTTTGATCATGTAGCTAGATGGGTTGATGAACTCAGGGCTCATGC
CGATAGTTCCATTGTGATCACGTTGATCGGTAACAAAGCTGATCTAGTCGACTTG

> SEQ ID NO: 6928 25975 111712_300059_1b
CCCACGCGTCCGCAACTTTCTCTCTGTATACGTCCTAATCTGGGGCGACCCTTTTCACTCCGGTCAGTTTCCCGCCGGG
AAATCTTTAATTCTTGTTGTATTGACAGCTTCCTTGCTTGTACCTTCATCTCGCTTTACCGATCTTGCACTTTACAGTA
ATCATCATGAATCCCGAATACGACTATCTTTTCAAGCTTTTGCTTATTGGAGATTCTGGTGTTGGCAAATCATGTCTCC
TCTTGAGATTTGCTGATGATTCATATCTTGAGAGTTACATTAGTACCATTGGTGTGGACTTTAAAATCCGCACAGTCGA
GCAGGATGGGAAAACCATTAAACTTCAAATTTGGGATACTGCTGGTCAAGAACGTTTTAGGACAATTACCAGCAGCTAC
TATCGCGGTGCTCACGGCATAATTGTTGTCTATGATGTAACTGATCAAGAGAGCTTCAATAATGTCAAGCAATGGTTGA
GTGAAATTGATCGATATGCAAGTGATAATGTGAACAAGCTTCTTGTCGGAAACAAGTGCGATCTCACAGCGCAGAAGGT
AGTTTCCACAGAGACAGCTCAGGCTTTTGCTGATGAGATCGGCATTCCTTTCATGGAAACTAGTGCGAAAAATGCCACC
AATGTGGAACAGGCTTTCATG

> SEQ ID NO: 6929 25975 182235_300659_1b
GAATTCGAAGACCGGATGAAGAGTATGATTATCTATTCAAGATCGTTTTAATTGGTGATTCAGGTGTTGGTAAATCCAA
TCTTCTCTCCCGTTTCACTCGTAATGAGTTTTGTTTGGAATCTAAATCTACCATTGGAGTTGAATTCGCTACTCGTACT
CTTCAGGTTGAAGGCAAGACAATCAAAGCACAAATATGGGATACAGCTGGGCAAGAGCGATACAGAGCAATTACCAGTG
CCTATTACAGAGGTGCACTAGGTGCTCTTCTAGTCTATGATGTGACAAAACCAACAACATTTGAGAATGTAACTCGGTG
GCTCAAGGAACTGCGTGATCATGCTGACTCCAACATTGTGATAATGCTCATTGGAAACAAAACTGATCTGAAGCACCTC
CGTGCAGTTGCAACAGAAGATGCTCAGAGTTTTGCTGAGAAGGAAGGGCTTTCATTCATCGAGACCTCTGCCCTTGAAG
CAATAAATGTTGAGAAGGCTTTCCAAACAATCCTTGGAGAGATATATCGTATAATTAGTAAGAAATCCCTTGCGTCAGA
GGAGTCTGCACCGTCTAGCATTAAGGAAGGCCAAACAATTGATGTCTCAGGATCAGATGGCAATTCAAAGAAATCATGC
TGTTCTACTTAAGGGGTGATTTCTTCCATTCTTTATCCTTTCTGGTGACTAATGTTCTATAGGTCTCAAGTCTTTCAAC
TATG

> SEQ ID NO: 6930 25975 245456_301568_1b
GTCAATTAGGTCTTTTGGATCAGGGAGCTCGTCCGCGATGTCGTATGCCTATCTCTTCAAGTACATCATCATCGGCGAC
ACGGGTGTAGGGAAATCGTGCCTGCTGCTCCAGTTCACGGACAAGCGATTCCAGCCGGTCCACGACTTGACGATTGGCG
TCGAGTTTGGGGCGCGGATGATCACAATCGATAACAAGCCCATCAAGCTCCAAATCTGGGACACAGCAGGCCAAGAGTC
TTTCAGATCGATCACGAGGTCGTACTACCGCCGGTCCGCCGGTGCCTTGCTTGCTTGTGTACGACATTACCAGGCGAGAGACT
TTCAGTCATCTGGCAAGCTGGCTGGACGACGCTCGGCAGCACGCGAACTCCAACATGACGATCATGCTCATTGGTAACA
AGGCCGATCTGGCTCACAGGCGAGCAGTGAGCACGAAGAAGGCGAGCAATTCGCCAAGGAACACGGGCTCATCTTCAT
GGAGACGTCGGCCAAGACCGCTCAAAACGTCGAGGAGGCTTTCATTAACACAGCATCGAAGATCCACCAGAAGATTGAA
GAAGGCGTGTTCGACGTTTCAAACGAGGCGTCGGGAATCAAGATCGGAGTTCTACCAAATAATCCCCACAGAGGTGATT
ACCCGGGTCCTCAAGGTGGTGGCTGCTGCAGCTAGAAGGCGGGTATAAGTTCTCATTAAAAAATGATTTACCATGTCGT
GAATAATTTTCCCTCCTGTACAAAGCTATCGTG

> SEQ ID NO: 6931 25975 249503_301593_1b
AGAATGAACCTGTTTGCGAATCCACGAAGAAAGAAGGGAAAGCGGTGCCATCGCGGGCAGGAGCAGGGCCAGATCTGAG

FIG. 2 continued

```
CTGCGCCGCCATCGATCGACGACCCAATCCACTGCCGCAGCTAAGGCGCCGCGAGATCCGGAGGTCTTTTGCAGGGATT
TCGGGGATTTTCGCTGGTTTTTCTTGATCTCTTCCTCGGTTCTGCGAAGAAGACGCATCGGCAGCAATGAATCCCGAGT
ATGACTATCTCTTCAAACTCCTCCTAATTGGCGATTCTGGCGTCGGGAAATCGTGCCTGCTGCTACGATTCGCGGATGA
TTCGTACCTTGAGAGCTACATCAGCACCATCGGGGTGGACTTCAAAATCCGAACAGTGGAGCTGGAAGGGAAGACTATC
AAGCTCCAAATCTGGGACACTGCTGGGCAAGAGCGCTTCAGGACTATCACGAGCAGTTACTATCGTGGAGCTCATGGCA
TAATCGTCGTGTACGACGTGACTGACCAGGAAAGCTTCAACAACGTCAAGCAGTGGCTCAACGAGATTGATCGCTACGC
GAGCGAGAATGTGAACAAGCTCCTCGTCGGGAACAAGTCGGATCTCACTGCCAAGAAGGTGGTCGACACTCAGACTGCC
AAGGCTTTTGCAGACGAGATAGGAATCCCGTTTCTAGAAACCAGTGCCAAGAACGCGACCAACGTAGAGCAGGCATTCA
TGACCATGGCTGCGGAGATCAAGAACAGGATGGCAAGCCAACCAGCGATGAGCAACAAGCCGACCAACGTGAATATCAA
CAAGGGGCAACCTCTCAACCAGAAGAATGGCTGCTGCTAGGAGGAGGAAGCAAAAGAAGCACAAGATTTACGTAGATGA
TGCTGCGATGAATGGTCGATCGTTGTTTCAATTTTTTCTTTTTCTTCTCTCCAGTGGATATTTTTAGTACTC

> SEQ ID NO: 6932 25975 184274_300666_1b
GAATTCAACGAGCCCCAGCCAGCCTTCTCGATCTGAGACTTTTTAGACAGACAGATTGCGAATCCATTATTTCTGGTGG
TGATCTGAAACCAATCACTCGGATTACTAGATGGCAGCAGCTCCGGCACGTGCTAGGGCTGATTATGATTACCTGATTA
AACTTCTTCTCATTGGTGACAGCGGAGTCGGGAAAAGTTGCCTGCTATTGCGTTTTCCTGATGATTCTTTTACAACTAG
TTTTATTACGACAATAGGGATTGACTTCAAGATTAGGACCATCGAACTTGATGGGAAGCGAATCAAACTTCAAATATGG
GATACAGCTGGTCCAAAACGTTTCCGCACTATTACTACAGCATACTACAGGGGAACCACGGGTATTCTTCTGGTGTATG
ATGTCACAGATGAATCTTCATTCAACAATATCCCGAACTGGATAATAAACATTGAACAGCACGCATCTGACAATGTAAA
CAAAATACTGGTGGGGAACAAAGCTGATATGGATGAAA

> SEQ ID NO: 6933 262505 262474_301694_1b
GCAGCATGGACGAGGCTACCGGAGAAACAGAAACTCAAGATTTCATGAACGTCGAATCCTTCTCTCAGCTTCCTTTCAT
TCGCCGTCCTAAAGATAAGAACCCTAAACCCATTCGTGTCTTCGGAAGAGATTTCACCGGCAGAGATTTCTCTATTACT
ACCGGTCAAGAAGACTACACCGATCCTTACCAGACCAAAAACAAAGAAGAAGAAGAGGAAGAAGACCAAACCGGAGACA
ACAGTACGGACAATAATAGCATCAGCCACAACAGGAGATTCGAGTGTCACTATTGCTTTAGAAATTTTCCTACTTCACA
AGCCCTAGGTGGACACCAAAACGCTCACAAACGCGAACGTCAGCTTGCCAAACGCGGTGTTTCCTCTTACTTTTATCAT
CCTGACAATAACCCTTACAGTTACCGTCATTACCCGTCGTGGACCAATGGTCCGTTAACCGCGGCTAGGTCCTATGGAG
GATTTTCTTCTGGTCCTAAGCCGTCGGGGTATTATACACGACCCAGCTATGGGAGTCAGTTAGGACTATGGCGTCTACC
GCCTCGCGTTCAAGGCGTTTATAACTCAAACGCAGCGTTTACTAGTAATGGCTCTTCTTCTTCTTCTAATTCGACTTTA
CCGTTGTTGACCCGTTCTCAAACTCAACTATCATCGCAAGTGGGTGGCTCCGCTGCTCAGAACAGAATGTCATCGTACG
GTTACGGATTGAGCCCTAACGTGCAAGATCATGTGAGTCTCGATCTTCATCTTTAATAA

> SEQ ID NO: 6934 262650 262713_301693_1b
GCAGCATGGAGAGACGAACGAACGAGACGAGTGAAGTTCACAGAGAATCGTACGGTCACAAACGTAGCAGCTACACCATCTAA
CGGGTCTCCGAGACTGGTCCGTATCACTGTTACTGATCCTTTCGCTACTGACTCGTCTAGCGACGACGACGACAACAAC
AACGTCACGGTGGTTCCAAGAGTGAAACGATACGTGAAGGAGATTAGATTCTGCCAAGGTGAATCTTCTTCCTCCACCG
CGGCGAGGAAAGGTAAGCACAAGGAGGAGGAAAGCGTAGTGGTTGAAGATGACGTGTCGACGTCGGTGAAGCCTAAAAA
GTACAGAGGCGTGAGACAGAGACCTTGGGGAAAATTCGCGGCGGAGATTAGAGATCCGTCGAGCCGTACTCGGATTTGG
CTTGGGACTTTTGTCACGGCGGAGGAAGCTGCTATAGCGTACGATAGAGCCGCGATTCATCTCAAAGGACCTAAAGCGC
TCACGAATTTCCTAACTCCGCCGACGCCAACGCCGGTTATCGATCTCCAAACGGTTTCCGCCTGCGATTACGGTAGAGA
TTCTCGGCAGAGCCTTCATTCACCGACCTCTGTTCTAAGATTCAACGTCAACGAGGAAACAGAGCATGAGATTGAAGCG
ATCGAGCTATCTCCGGAGAGAAAGTCGCCGGTTATAAAAGCAAGAAGAAGAATCGTCGCCGGTTTTGGTGTTCCCGGAT
CCGTATCTGTTACCGGATTTATCTCTCGCCGCCGAATGTTTTTGGCATACCGACATTGCCCCTGACCTTTTGTTTCTCC
GATGAAGAAACCGGATCACAATCAACTTTGTTACCATACACAGAGGTTTCGATACAAGGAGAAACCCAAACTGCAGATT
TCGAGTTTGGTTTGATTGATGATCTTCGAGTCTTCCCCATGGGATGTGGATCATTTCTTCGACCATCATCATCACTCTT
TCGATTAATAA

> SEQ ID NO: 6935 262658 135405_300414_1b
GAACCTCGCGCTCTGCCTCCTCATGCTCGCCCGCGGCGGCCACCACCGCGTCCAGGCGCCGCCTCCGCTCTCGGCTTCG
GCGCCCCGCCGGCAGGTGCGGAGTTCAAGTGCTCCGTCTGCGGCAAGTCCTTCAGCTCCTACCAGCGCTCGGCGGCC
ACAAGACGAGCCACCGGGTCAAGCTGCCGACTCCGCCCGCAGCTCCCGTCTTGGCTCCCGCCCCGTCGCCGCCCTTGCT
GCCTTCCGCCGAGGACCGCGAGCCAGCCACGTCATCCACCGCCGCGTCCTCCGACGGCATGACCAACAGAGTCCACAGG
TGTTCCATCTGCCAGAAGGAGTTCCCCACCGGGCAGGCGCTCGGCGGGCACAAGAGGAAGCACTACGACGGTGGCGTAG
GCGCCGGCGCCGGCGCATCTTCAACCGAGCTCCTGGCCACGGTGGCCGCCGAGTCCGAGGTGGGAAGCTCCGGCAACGG
CCAGTCCGCCACCCGGGCGTTCGACCTCAACCTCCCGGCCGTGCCGGAGTTCGTGTGGCGGCCGTGCTCCAAGGGCAAG
AAGATGTGGGACGAGGAGGAGGAGGTCCAGAGCCCCCTCGCCTTCAAGAAGCCCCGGCTTCTCACCGCGTAATTCAGCA
GCTGCACGGATCCGATCCGTCAGAGTTTTTGTCTAAGGAGTGAAATTCAGTCGAAACACTA
```

> SEQ ID NO: 6936 262658 138751_300727_1b
CCACACCACACAGCAACCAGCCAGCTGCCACACTAGCTTGAGGCGAGCGAGCGAAGCTTAGCTAGCGGATATAACAAGT
CGTCGATCTGCTTGCTGCTTTTGTGAATTGCGGTGGAAGCATGTCGAGCGCGTCGTCCATGGAAGCGCTCCACGCCGCG
GTGCTCAAGGAGGAGCAGCAGCAGCACGAGGTGGAGGAGGCGACGGTCGTGACGAGCAGCAGCGCCACGAGCGGGGAGG
AGGGCGGACACCTGCCGCAGGGGTGGGCGAAGCGGAAGCGGTCGCGCCGCCAGCGATCGGAGGAGGAGAACCTCGCGCT
CTGCCTCCTCATGCTCGCCCGCGGCGGCCACCACCGCGTCCAGGCGCCGCCTCCGCTCTCGGCTTCGGCGCCCCCGCCG
GCAGGTGCGGAGTTCAAGTGCTCCGTCTGCGGCAAGTCCTTCAGCTCCTACCAGGCGCTCGGCGGCCACAAGACGAGCC
ACCGGGTCAAGCTGCCGACTCCGCCCGCAGCTCCCGTCTTGGCTCCCGCCCCGTCGCCGCCTTGCTGCCTTCCGCCGA
GGACCGCGAGCCAGCCACGTCATCCACCGCCGCGTCCTCCGACGGCATGACCAACAGAGTCCACAGGTGTTCCATCTGC
CAGAAGGAGTTCCCCACCGGGCAGGCGCTCGGCGGGCACAAGAGGAAGCACTACGACGGTGGCGTAGGCGCCGGCGCCG
GCGCATCTTCAACCGAGCTCCTGGCCACGGTGGCCGCCGAGTCCGAGGTGGGAAGCTCCGGCAACGGCCAGTCCGCCAC
CCGGGCGTTCGACCTCAACCTCCCGGCCGTGCCGGAGTTCGTGTGGCGGCCGTGCTCCAAGGGCAAGAAGATGTGGGAC
GAGGAG

> SEQ ID NO: 6937 262658 53564_300092_1b
CCCACGCGTCCGCCTTTGGGCGAAGATTCTTCAGTCTTCCATGGAGTCGAGCACTGGACAAAGGGTAAGCGATCTAAGA
GATCAAGATCCGATTTCCACCACCAAAACCTCACTGAGGAAGAGTATCTAGCTTTTTGCCTCATGCTTCTCGCTCGCGA
CAACCGTCAGCCTCCTCCTCCTCCGGCGGTGGAGAAGTTGAGCTACAAGTGTAGCGTCTGCGACAAGACGTTCTCTTCT
TACCAAGCTCTCGGTGGTCACAAGGCAAGCCACCGTAAGAACTTATCACAGACTCTCTCCGGCGGAGGAGATGATCATT
CAACCTCGTCGGCGACAACCACATCCGCCGTGACTACTGGAAGTGGGAAATCACACGTTTGCACCATCTGTAACAAGTC
TTTTCCTTCCGGTCAAGCTCTCGGCGGACACAAGCGGTGCCACTACGAAGGAAACAACAACATCAACACTAGTAGCGTG
TCCAACTCCGAAGGTGCGGGGTCCACTAGCCACGTTAGCAGTAGCCACCGTGGGTTTGACCTCAACATCCCTCCGATCC
CTGAATTCTCGATGGTCAACGGAGACGACGAAGTCATGAGCCCTATGCCGGCGAAGAAGCCTCGGTTTGACTTTCCGGT
CAAACTTCAACTTTAAGGAAATTTACTTAGACGATAAGATTTCGTTTGTATACTGTTGAGAGTTGTGTAGGAATTTGTT
GACTGTACATACCAAATTGGACTTTGACTGAT

> SEQ ID NO: 6938 262715 159280_200022_1b
TAAGATTCTCCTTCCCCATCTCCCCCTTTTTTCTTCCTTTTGTGTAGGGTAGATTTTCATCAATACTTATAGAGGTTCC
TTTTTTGGGAAAGAGAAAACCAAAAGGAGGATTCTATTTGTTGTTTGTTTGATGGTTTCGATGATGGAAGGAGAAAAG
AGAAAGCAAAGGCAACACCAACAAGATAAGCCATATAGAGGTATAAGGATGAGGAAGTGGGGTAAATGGGTTGCTGAAA
TTAGAGAACCAAATAAAAGGTCTCGAATTTGGCTTGGTTCTTACTCTTCCCCTGTCGCCGCCGCTCGAGCTTATGACAC
CGCCGTATTTTATCTCAGAGGTCCTACGGCTAGGCTTAATTTCCCTGAATGTATAGTCAATGATGACCGTGAACTTCAC
GATTTATCTGCTGCTTCTATTCGCAAAAAAGCTACTGAAGTTGGTGCTAGAGTTGATGCTTTGCAAACTGCCGCCCTTC
ATAATAATTCTTCTGCAGGTTTTACTGAATCCAACAGTAATTCAAATATTAACCCGAGAAGGGTTACTATTAAACCGGA
TTTGAATGAATATCCTAGCCCTGAAAGTTGCGACGAAGATAACTGAAATCTGCAGCTTTTAATTAGTTCGATCTCCAAG
ATTTTACTGGCGAAA

> SEQ ID NO: 6939 262725 142406_300435_1b
CCCGCAAGGGCGTGCTCCTCAACTTCGAGGACGGCGAGGGGAAGGTGTGGCGATTCCGGTACTCGTACTGGAACAGCAG
CCAGAGCTACGTGCTGACCAAGGGGTGGAGCCGATTCGTGAGGGAGAAGGGCCTCCGCGCCGGCGACACCATAGTCTTC
TCCCGCTCGGCGTACGGCCCCGACAAGCTGCTCTTCATCGACTGCAAGAAGAACAACGCGGCGGCGGCGACCACCACCT
GCGCCGGCGACGAGAGGCCAACCACAAGCGGCGCCGAACCACGCGTCGTGAGGCTCTTCGGCGTCGACATCGCCGGCGG
CGATTGCCGGAAGCGGGAGAGGGCGGTGGAAATGGGGCAAGAGGTCTTCCTACTGAAGAGGCAATGCGTGGTTCATCAG
CGTACTCCTGCCCTAGGTGCCCTGCTGTTATAGCATCAAATCAAATTCATATATAGATCAAATCAAATCTTCTTCTCTT
CC

> SEQ ID NO: 6940 262725 3046_300344_1b
CCCACGCGTCCGCTAAACCGTCTCGTGATACCTAAACAACACGCCGAGAAACACTTTCCGTTACCGTCACCGTCACCGG
CAGTGACTAAAGGAGTTTTGATCAACTTCGAAGACGTTAACGGTAAAGTGTGGAGGTTCCGTTACTCATACTGGAACAG
TAGTCAAAGTTACGTGTTGACCAAGGGATGGAGTCGATTCGTCAAGGAGAAGAATCTTCGAGCCGGTGATGTTGTTACT
TTCGAGAGATCGACCGGACTAGAGCGGCAGTTATATATTGATTGGAAAGTTCGGTCTGGTCCGAGAGAAAACCCGGTTC
AGGTGGTGGTTCGGCTTTTCGGAGTTGATATCTTTAATGTGACCACC

> SEQ ID NO: 6941 262762 107018_300262_1b
GGCTACAGCCCTTCACTGCGCAATTGCTGGTGACTCTGGTGCTTTGCTTGAGGTTGTCAAGCTCTTGCTTGATGCTTCT
GCTGATGTGAATTTGGTTGATGCAAAGGGAAAACGGGCTGTTGACCTGATCTCAGCTCAGGGCTGTTGTCTCAACTCTA
GGAGGAAGATACTGGAGCACTTGCTTGGAGGAAGCAGCGACGACGGGGAAGCAAGTGGACTCATCGATCAGATTATCTC

FIG. 2 continued

```
TGAACAAGCAGAAGAACAGCTGTTATTGACTCCAAACATCTCTAAATTTGGGAGCGAGAAGAAAGAGTATCCTGTTGAT
CCCTCTCTTCCAGACATAAAGATTGGGATATATGGGACAGATGACTTCAGAATGTACATATTTAAGGTGAAACCATGCT
CAAGAGCTTACTCCCATGACTGGACAGAGTGCCCCTTTGTACACCCTGGTGAAAACGCCAGAAGGCGTGACCCTAGAAA
ATACCACTATAGTTGTGTCCCTTGTCCAGATTTTCGCAAGGGGACATGCCAGCGAGGAGACGCTTGTGAGTATGCGCAT
G

> SEQ ID NO: 6942 262783 262626_301692_1b
GCAGCATGAACAACAATCATTCCTATGATGATCGCAGTTTTCACATGCCACTTCATCCTTCTAACACAAGCAACCCTAA
TCCAAATCTCCAGTTTGCTTTATCTTCAAGCTACGATCACAGTCCTAAGAAGAAACGCACCAAAACCGTTGCTTCATCC
TCTAGTTCTTCACCAAAATCCGCGTCAAAACCAAAATACACCAAAAAACCAGACCCAAATGCCCCCAAAATCACACGTC
CATGTACTGAATGTGGCAGAAAGTTTTGGTCTTGGAAGGCTCTCTTTGGTCACATGAGATGTCACCCTGAGCGTCAATG
GCGTGGCATTAATCCTCCTCCTAACTACCGTGTGCCCACCGCGGCTTCTTCAAAACAGTTAAACCAGATATTACCAAAT
TGGGTCTCATTTATGTCCGAGGAAGACCATGAAGTCGCTTCTTGTCTCTTAATGCTGTCTAATGGTACACCATCATCAT
CGAGTATTGAACGGTTCGAGTGTGGAGGATGTAAGAAAGTGTTTGGATCACATCAGGCTTTAGGAGGACACAGAGCGAG
TCATAAAAACGTTAAAGGCTGTTTCGCTATCACAAACGTAACCGATGATCCTATGACGGTTTCTACTTCTAGTGGGCAT
GATCATCAGGGAAAAATCCTTACGTTTTCAGGGCATCATAAGTGTAATATCTGTTTTAGAGTGTTCTCGAGTGGTCAAG
CTTTAGGAGGTCACATGAGATGTCATTGGGAAAAGGAGGAGGAGCCGATGATCAGTGGTGCTTTGGATTTGAATGTTCC
TCCAACAATACAGGATCTTTCTACTTCGGACACATCAGGGTGTTGTTTAGATCTTAGGTTAGGACTCTAATAA

> SEQ ID NO: 6943 263004 262727_301693_1b
ATGCAGCAATGAACTCATTTTCTGCCTTTTCTGAAATGTTTGGCTCCGATTACGAGTCTCCGGTTTCCTCAGGCGGTGA
TTACAGTCCGAAGCTTGCCACGAGCTGCCCCAAGAAACCAGCGGGAAGGAAGAAGTTTCGTGAGACTCGTCACCCAATT
TACAGAGGAGTTCGTCAAAGAAACTCCGGTAAGTGGGTGTGTGAGTTGAGAGAGCCAAACAAGAAAACGAGGATTTGGC
TCGGGACTTTCCAAACCGCTGAGATGGCAGCTCGTGCTCACGACGTCGCCGCCATAGCTCTCCGTGGCAGATCTGCCTG
TCTCAATTTCGCTGACTCGGCTTGGCGGCTACGAATCCCGGAATCAACCTGTGCCAAGGAAATCCAAAAGGCGGCGGCT
GAAGCCGCGTTGAATTTTCAAGATGAGATGTGTCATATGACGACGGATGCTCATGGTCTTGACATGGAGGAGACCTTGG
TGGAGGCTATTTATACGCCGGAACAGAGCCAAGATGCGTTTTATATGGATGAAGAGGCGATGTTGGGGATGTCTAGTTT
GTTGGATAACATGGCCGAAGGGATGCTTTTACCGTCGCCGTCGGTTCAATGGAACTATAATTTTGATGTCGAGGGAGAT
GATGACGTGTCCTTATGGAGCTATTATAA

> SEQ ID NO: 6944 263005 228721_301036_1b
GGCGCGCAAGGTCCGGAGAAGTAGGGAGCTGTGAAAGAAGGCGAGGAAGAAAAAAGAGAATTTTATTTTTTGTTCGTGG
TTGGATCATCTTGCTCTCGAGATATTTGACGTAGAGCAAGCTTTGTCTTTCATTGCTTTGATCGTTGTATAGCTTTTTG
GTTTTGAGAGGAAGAGATGGGAAGGTCAATGGATCCTTTGGTTCTTGGACGAGTGATTGGAGATGTGTTGGATATGTTT
GTCCCGGCTGTGGACATGAGTGTTTGCTACGGAAGCAAGCAAGTCAACAATGGTTGCGAGCTCAAGCCGTCGGCGACTC
AAGCCCGACCAACCGTCCAAGTTGTATCTCCTCACGAAGAAGGCGCTCTCTACACCTTGGTGATGGTCGATCCCGATGC
TCCAAGTCCCAGCGAGCCGTCCATGAGAGAATGGGTGCACTGGATCGTCGCCGATATCCCCTCTGGTGCGGATGCGAGC
CAAGGAAGGGAGATCCTCCAGTACATCGGCCCGAAGCCACCGACTGGAATCCACAGATACGTCTTCGTTCTGTTCCGGC
AAATGGGACCAGTCCTCATGCTCCCGCCGCTGATGAGGAACAACTTCAGCACCCGCT

> SEQ ID NO: 6945 263006 263249_301723_1b
GCAGCATGACAAAGCTCCCCAACATGACGACAACACTCAACCATCTATTTGATCTGCCGGGGCAGATTTGCCATGTCCA
GTGTGGTTTTTGCACCACTATTTTGCTGGTGAGTGTACCGTTTACAAGCTTGTCAATGGTGGTGACTGTGAGATGTGGG
CATTGCACAAGCCTTCTCTCTGTCAATTTGATGAAGGCTTCCTTCATTCCTCTCCATCTCCTTGCTTCTCTCTCCCATC
TTGATGAGACCGGGAAGAGGAGGTTGCAGCTACAGATGGTGTGGAAGAAGAAGCATGGAAGGTGAATCAGGAGAAGGA
GAACAGTCCAACGACTTTGGTTTCATCTTCAGACAATGAAGATGAAGATGTGTCTCGTGTTTACCAAGTTGTCAATAAA
CCACCTGAGAAGCGACAAAGAGCTCCTTCAGCTTACAATTGCTTCATCAAGGAAGAGATCAGGAGGTTAAAGGCTCAGA
ATCCAAGCATGGCTCACAAGGAAGCTTTCAGCTTAGCTGCCAAAAATTGGGCCCATTTTCCTCCAGCTCACAACAAGAG
AGCTGCTTCAGATCAATGTTTTTGTG

> SEQ ID NO: 6946 263006 125374_300630_1b
AGGGTTTTCATCTCTCTTTCATTTCTGGCCTTTTCTTGCAGCAATTTTTGCGCTTTGTTTTCACAACTCAAATCATCA
AGAAGAAAGCAGATCCAAGGAGGGGGTGGGTAGTTTAGTTTAGTAGTTGAAACTATCAAAACATCAATCAATCAAATCA
ATCAAATCAATCAAACAGAAGCAACAGCTAATATCAGTTTGCAAAATAGTAGGAAATAGAGTATCATGTCCTCTTCAAC
TCCTAATTCTACTTTGTCATTGGACCACTTACCTCCTTCCGAGCAGCTCTGCTATGCTCATTGCAACATCTGTGACACT
GTCCTCGCGGTAAGTGTTCCGTGCACAAGTTTGTTCAAGACTGTAACGGTTCGATGTGGCCACTGCTCTAATCTTTTGC
CAGGATTGCTTTTGCCTTCAGCTAACCATCATTTTGGTCACACTTACTTCTCCTGCCCACAATCTTCTGGAAGAAAT
TACCAGCACAACCCCAAATTTCTTGATGAATCAGAGTAACTCTACTGATTTTGTTATACCTACTCGACCTGGATTTGAT
```

FIG. 2 continued

GATCTTCCTAGACCACCCGTCATTAACAGACCTCCTGAGAAGAGACAGCGAGTCCCCTCTGCTTACAACCGATTCATCA
AGGAAGAGATCCAACGCATAAAAGCAGGGAATCCTGACATTAGCCACAGAGAAGCTTTCAGCGCCGCTGCAAAAAA

> SEQ ID NO: 6947 263006 146918_200005_1b
TCAGGGGAACAACTCTGTTATGGCCAATGCAACTTTTGTGATACTGTTCTCGCGGTGAGTGTTCCTTGCTCCAGTTTGT
TCAAGACTGTGACAGTAAGATGTGGTCATTGCACCAACCTTCTGTCTGTCAACGTCAACATGCGTGGCCTGCTTCTTCC
CTCTGCTAATCAACTTCATCTCCCCCATTCTTTCTTTTCTCCTCAGAATCTTCTGGAGGAGATTCGGAATTGTCCACCA
AGTTTGTTAATCAATCAGCCAAACCCGAATGAGTCACTCATGCCAGTTCCAGGAGTTGATGAACTTCCAAAGCCACCAG
TTGCAAACAGACCCCCGGAGAAACGACAGCGTGTGCCATCTGCTTACAATCGATTCATCAAGGACGAGATCCAACGTAT
CAAAGCTGGAAATCCTGATATAAGTCACAGGGAGGCCTTCAGTGCTGCTGCAAAGAATTGGGCCCACTTTCCACACATT
CATTTCGGACTTATGCCTGATCAACCAGTGAAGAAACCCAATGCATGTCAACAGGAAGGGGAGGATGTTCTGTTGAAGG
AAGGGTTTCTTGCTCCAGCAAACGTGGGTGTATCTCCTTACTAATTAAGGAAATGAAGTCACCAGCCAATGTTCTCTCC
CTGATCTGTTGGAACTGTCTATTTGTCTAATTAATGTGCGTTAGTTTATCTACAGTTTAGA

> SEQ ID NO: 6948 263009 144837_200137_1b
GGAAAAAAAGGGAGAGGGGCTCTCTCTTTCTCTCTACTTTCCTTCACCCAAACAGACCACAAACAGTAGAGAGAGAAGC
TGTGTTTTTAGAGAGAGAAAGTTAGAGCTTCTGAATCCTAATCTCTTCCATGGCTGTATTCTAGTCCTCTCTTTATATC
CCTTGATATTTATTTTCATCTCCAAAAAGAAAAAATCTTTTTTTTTGAACCATTGGGCCGACCATGCGGAGAGCTAGAG
CAGCGGCGGCACCGGCACCGGTGACCGGAGAACCAAATGGATCTGGAGGATCTAAAGAGATAAGGTTTCGTGGAGTCCG
AAAAAGACCATGGGGTAGATTTGCGGCGGAGATCAGAGACCCTTGGAAGAAAACTAGGGTTTGGTTAGGTACTTTCGAT
TCTGCTGAGGATGCCGCGCGTGCTTATGACGCCGCAGCGCGTGCACTTCGCGGTCCTAAAGCCAAAACTAATTTCCCTT
TACCTTATGCTCATCATCACCACTTCAATCAAGGGCTTAACCCTAGTAACGATCCGTTTGTGGATTCCCGATTTTACCC
TCAGGATAATCCGATTATTTCGCAGAGACCTACCTCGAGCTCAATGAGTAGTACGGTGGAGTCCTTCAGTGGACCTC

> SEQ ID NO: 6949 263009 159370_200023_1b
ATTAGTTCATCAAATTTCAGCATAATTTGCCCAAAATTATTACTATTACAAAAATAACATAGGCGGAAAGCGTAAATGG
CGCCGAAGCAACAGGGTGGCGCGGTAGCGGTGGAGGTTACGGCGGCGGTTGGAAAAGTGAACGAAATTTCAAAAGAGGT
GCATTATAGGGGCGTAAGAAAGAGGCCATGGGGGAGGTATGCGGCGGAGATAAGAGATCCGGGGAAAAAGAGCCGGGTT
TGGCTTGGGACTTTTGATACGGCGGAGGAAGCAGCTAAAGCCTACGATGCGGCGGCGAGAGAATTTCGCGGTGCAAAGG
CGAAAACTAATTTTCCTCCGGAGGAAGAAGAGAACCTCAAAATCGCCCAAAACAATTTAGGCGTTAAGATGAATACAAA
TGTTAATGATAATAACAATCGTAGTCCGAGTCAGAGCAGTACCGTTGAGTCATCTAGCCGTGACGGTTTATCTCCTGCC
GTTATGGTTGACTCATCTCCGTTAGATCTCAGCCTCGGCGTGAAATTCCCGTTCCAGAACAATCAGTTCCGTACTTCTC
CGATTTCCGTCGGGTTCTCCGGCTGCGGATTCACCGGCGCA

> SEQ ID NO: 6950 263009 182371_300660_1b
GAATTCAGAGGAAGAGGATCTACAGCTGCAGCTGAAGTGGTGATGATGGTAGGAGGAAATGAAATGTTAAATCAAGAAG
AAGAAGTGAAAGAAATGAGATATAGAGGTGTTAGAAAAAGACCATGGGGAAGATTTGCAGCAGAAATTAGAGATCCATG
GAAGAAAACTAGAGTCTGGTTAGGTACTTTTGATTCAGCTGAGGATGCTGCTAAAGCTTACGACACTGCTGCTCGTAAT
CTGAGGGGTCCTAAAGCTAAAACCAATTTCCCATCTTCACCCATTCACCCACATCAAACAATTTATCATCAACAACAAC
AGCACAGCACCCAATTTTTATAATAATCAGCAATACGGTCAGCGAAATCACAATCAAACTCAAGTTAATGATATTCAGAC
ACCAACTAGTAGTAGTTTAAGTAGTACTGTTGAATCGTTTAGTGGTCCGAGATTTTCTTCTTCAGCCTTGATTTATCAT
GCATCATCTCAGCAGCAGCAGCATAGAAGACGGCGGCCTGATCGACAACCACTTGATCCTGATCAAGATTGTCATAGTG
ATTGTGACTCTTCTTCATCTGTGATTGATGGTGATAATCATCATGATATCACTGCAGCTTCTAGTTCATCTTCTGCTCT
TAATATCAAGAGCAAACAACCATTATCGTTTGATCTTAACTTTCCTCCTCCTAT

> SEQ ID NO: 6951 263009 190973_300737_1b
CCCAGACGCCACACACACCCAAACCCAACCTCCCAAAACACCCACCCGGTTTACCAGAGATCCGCGCCCGCCACTTGTA
AACCTGGTGCACCCATGGCGCCCAGAGCAGCTACGGTGGAGAAGGTTGCTGTGGCGCCACCCACCGGGCTTGGTCTTGG
CGTCGGCGGAGGTGTCGGAGCCGGGGGTCCTCACTACAGGGGCGTCCGCAAGCGCCCGTGGGGCGTTACGCAGCGGAG
ATCCGTGACCCTGCCAAGAAGAGCCGGGTGTGGCTCGGTACCTACGACACGGCAGAGGAGGCCGCCCGCGCCTACGACG
CCGCCGCTCGAGAGTTCCGGGGTGCCAAGGCAAAACAAACTTTCCGTTTGCATCACAGTCGATGGTCGGCTGTGGCGG
CAGCCCCAGCAGCAATAGCACGGTAGACACCGGTGGCGGCGGGGTTCAGACGCCTATGCGGGCCATGCCTCTGCCGCCG
ACTCTGGACTTGGATTTGTTCCACCGCGCGG

> SEQ ID NO: 6952 263030 231243_301082_1b
GGTTTCTCTCGCATCGATGCTCGGTGAGGAAATCCGGCAAGGCGAGGGCGATAGTGGATCATCGTCGGGAGCTGCGGCT
GCAGCGGCAGCGGCGGCGGCAGCGGCGGCATTGCCGTGGTGGGCTCCCACGGCCGCCCCAAAGACCGTGTTTGATGGTT
GCGATAGTGTAAACTTTGCTAGCACAATGCAGCCATCGCAAGCTCCACAGGATGTTTCGTCTTCTCCAGTCCAAAAGAT

FIG. 2 continued

```
ACAAGTGCCACCTTCTGGAACAGCTGTGGATGACACTGCTGCAACTGGTGAGGTAGCGAATGGAATACCACCGCCGCCG
GGAGAGTATATCATTCGGCCACCACATCTAGAGCTCGGTCACCCCATGGTTCGCGCTGGTTTCCCGTATGATCCATACT
ACGGTGGACTTGTTGCGGCTTATGGAGCTCAGGCAATGCCGATGATGCATCCTCATGTTCTAGGCATGCAACACAGCCG
GATGCCGCTGCCGTCGGAGATGATGGAAGAAGAGCCCGTGTATGTAAATGCGAAGCAGTACCACGGTATTCTTCGCAGG
AGGCAGATCCGAGCAAAGGCCGAGCTCGAAAACAAGCTTGTCAAGACCAGGAAAACTTATCTACATGAATCGCGACACC
AGCACGC

> SEQ ID NO: 6953 263030 126010_300633_1b
AGAGGATAGAGAGAGAGTTTGAAGGAAGGAGACATGCTTGATTTCAACCCAACGAGAAACAGCACTTGTGTTTATTTCT
TACTATCTTATTAACTTTACCTGATTCCACAGAAGTGGAATTTCCGTCTCCTTGTTATCACGAGATGAAGTCTTTAGAT
CCAGACTTACAAGGCGAGACATTGCGGTTGACACATTCTATTATTAATTCCCAAGACGAAATGACTACCTCGGAGAAAA
CAAATTCTCAAGATCAATGTGCCTCCTCAGAATATGTTCATGATGAAAGATATGGGAGAGATATGCAAGCTCAAATAAA
GCCTGCTCGTTTTTCGTTGCAGAATGAAGTGGCCCATTCAACTGGTTTCTCTCCTTTTGGTTACTCTGATCCCTATATG
AGTGGCTTGTATACTGCTTATGGACCTCAAGCTTTTCCACAAATGATGGGGATAGCGCCTACCCGCGTCCCACTCCCCC
TAGATCTTGCAGAGGATGGACCAATTTATGTAAATGCAAAACAGTACCATGGGATCATGAGGCGGAGACAGATACGTGC
TAAGCTTGAGGCTCAGAACAAACTTGTCAAAAATAGAAAGCCATATCTTCATGAGTCACGCATCTTCATGCAGTGAAT
AGAGTTAGAGGGTCCGGAGGACGTTTTCTTAGCTCAAAGAAAGTCAATCAATCTGATCCAAATAGTCACCCTACTAACT
CAACTT

> SEQ ID NO: 6954 263037 258956_301701_1b
GCAGCATGTCGAGCATGTCCATGTCGTCCTCCTCAGCTCCAGCTTTTCCACCGGACCACTTCTCATCTACGGACCAGCT
CTGTTACGTCCATTGCAGCTTCTGCGACACTGTCCTTGCTGTGAGTGTTCCTCCGAGTAGTTTGTTCAAGACGGTGACG
GTCAGATGCGGCCACTGTTCGAACCTTTTGTCGGTGACCGTGAGCATGAGAGCTCTTCTTCTTCCATCCGTTTCCAACC
TTGGCCATTCCTTTTTACCTCCCCCTCCTCCTCCTCCTCCAAATCTTTTGGAGGAAATGCGAAGCGGAGGGCAGAA
TATAAACATGAACATGATGATGAGCCATCACGCTTCAGCTCACCACCCGAACGAGCATTTGGTTATGGCGACTCGCAAC
GGAAGATCAGTGGATCATCTACAAGAGATGCCTCGGCCACCACCAGCCAATAGACCAGCCCCAGAGAAGCGACAAAGAG
TACCATCTGCATACAACCGATTCATCAAAGAGGAGATCCAACGTATAAAGGCAGGCAACCCTGATATCAGCCACAGAGA
GGCCTTCAGTGCTGCTGCCAAAAACTGGGCTCATTTCCCTCACATACACTTTGGACTCATGGCTGACCATCCTCCCACG
AAGAAGGCTAACGTGCGCCAACAGGAAGGAGAGGATGGGATGATGGGAAGAGAAGGGTTTTACGGTTCAGCTGCCAACG
TTGGGGTGGCCCATAACTAGTAA

> SEQ ID NO: 6955 263037 263676_301731_1b
GCAGCATGTCTGTAAATTTCTCATCTGAACGTGTTTGCTATGTCCACTGCACCTTCTGCTCCACGATT

> SEQ ID NO: 6956 263037 119990_300361_1b
CCCCCCCCCGAAAGAGAGAATAAATAGGAACCTTTTTCTCTTTAGTATTATCTAAAAAGTTCTATATATTTGTTGTTGT
TCCTTCTTCTTCCTTCTTGAATTTACCCCTTCACTCATTATTTCTTCAACTTCTTCTTTTTCTTTACTTAGCAACAAAA
ATTTTCCATTAAAATGGCAAGCTGCATCGATGTTGCTTCTGAAAAACTTTGCTATATCCCTTGCAACTTTTGCAATATT
GTTCTTGCGGTGAGTGTACCATGCAACAGCCTATTTGATATTGTGACAGTTCGATGTGTCACTGCACAAATCTGTGGT
CCGTGAATATGGCAGCTGCCTTTCACTCTTCTTCTTCTTCCTCTTGGCAAGACATTCATCATCTTCAGGTGCCAAA
CTACACTGCTCCTGAGTACAGAATGGATTTGGTTCATCAACCAAATGCAACAACAGGATGACAATGAGAACACCAATC
ACAAACAACACTCACGAGGAGAGGATTGTGAATCGACCTCCCGAGAAGAGGCAGCGAGTACCTTCTGCATATAATCAGT
TCATAAAAGAAGAGATTCAGAGGATCAAGGCTAATAAT

> SEQ ID NO: 6957 263060 137912_300687_1b
ACATCCATCCATCCATCCATCTATCCAGAGAGCACAGCAACGGCGCATATATAGTACCCCTCTACCAAAGCACAACAAC
CAGAATCTCCTGAGCTCGATCTAGCTACTAGCTTGATCTATCCGATCAATCGACTGGCCCGCGAGGATCGATCGAGACT
CGAAAGGGAGGGATTTGATCCGGATCGGTCGACGATGGACATGGCGCACGAGAGGGACGCGAGCAGCGAGGAGGAGGT
GATGGGCGGCGACCTGCGTCGCGGGCCGTGGACGGTGGAGGAGGACCTCCTGCTCGTCAACTACATCGCCGCGCACGGC
GAGGGCCGCTGGAACTCGCTCGCCCGATCAGCAGGGCTGAAACGCACAGGCAAGAGCTGCCGGCTCCGGTGGCTGAACT
ACCTCCGCCCCGACCTCCGGCGAGGCAACATCACGCCGCAGGAGCAGCTGCTCATCCTGGAGCTGCACTCGCGGTGGGG
AAACCGCTGGTCCAAGATCGCGCAGCACCTCCCGGGACGCACCGACAACGAGATCAAGAACTACTGGCGCACGCGGGTG
CAGAAGCACGCCAAGCAGCTCAAGTGCGACGTCAACAGCCAGCAGTTCAAGGACGTCATGCGCTACCTCTGGATGCCCC
GCCTCGTCGAGCGCATCCAGGCCGGCGCCGCCGGGCAGCAGCAGCAGCA

> SEQ ID NO: 6958 263060 316885_301427_1b
AAGAAATTATTGTTATAGTGTGTGTAAATGTATATAGGATTGAAGAGATGTGGAAAGAGTTGTAGATTGAGATGGGCTA
ATTACTTAAGACCCGACATTAAGAGAGGAGAGTTTAGTCCTGAAGAAGACGACACTATCATCAAGCTTCATGCTCTTAA
```

FIG. 2 continued

```
GGGTAACAAGTGGGCCGCAATCGCCACTAGCTTGGCGGGACGAACTGACAACGAAATAAAAAACTATTGGAACACAAAT
CTCAAGAAGCGGTTGAAGCAAAAAGGCATCGATGCAATCACTCACAAACCGATCAATTCAACCGGTCAAACCGGTTTCG
AACCAAAAGTAAATAAACCGGTATATTCATCCGGTTCCGCTAGGCTTCTTAACCGCGTCGCAAGCAAATACGCGGTTGA
ATTAAACCGGGACTTACTGACCGGGATCATCAGTGGAAACTCCACCGTCGCCGAAGATTCACAAAACTCCGGCGACGTT
GATTCTCCGACCTCCACATTGCTCAACAAAATGGCGGCAACATCAGTTTTGATCAACACTACGACTACATATTCCGGCT
TCTCCGACAACTGTTCTTTCACTGATGAATTCAACGAATTCTTTAACAATGAAGAGATCTCCGATA

> SEQ ID NO: 6959 263060 258976_301701_1b
GCAGCATGGGAAGACATTCATGTTGTTACAAACAGAAACTGAGGAAAGGACTTTGGTCTCCTGAAGAAGATGAGAAGCT
TCTTCGTTACATCACTAAGTATGGTCATGGTTGCTGGAGCTCTGTCCCTAAACAAGCTGGTTTACAGAGATGTGGAAAA
AGTTGTAGATTAAGATGGATAAATTATTTAAGACCAGATTTGAAGAGAGGAGCATTTTCTCAAGATGAAGAAAATCTCA
TTATTGAACTTCATGCCGTTCTTGGCAATAGATGGTCTCAGATAGCTGCACAGCTTCCTGGAAGAACCGACAATGAAAT
CAAGAATCTTTGGAATTCTTGTTTGAAGAAGAAATTGAGGCTGAGAGGAATTGACCCGGTTACACACAAGCTCTTAACC
GAAATCGAAACCGGTACAGATGACAAAACAAAACCGGTTGAGAAGAGTCAACAGACCTACCTCGTTGAGACTGATGGCT
CCTCTAGTACCACTACTTGTAGTACTAACCAAAACAACAACACTGATCATCTTTATACCGGAAATTTCGGTTTTCAACG
GTTAAGTCTATAAAACGGTTCAAGAATCGCAGCCGGTTCTGA

> SEQ ID NO: 6960 263060 263381_301724_1b
GCAGCATGATGTCATGTGGGGGAAGAAGCCAGTGTCTAAGAAAACAACGCCGTGTTGCACGAAGATGGGGATGAAGAGA
GGACCATGGACGGTGGAGGAACGAGATTCTTGTGAGTTTCATTAAGAAAGAAGGTGAAGGACGGTGGCGATCGCTTC
CTAAGAGAGCTGGTTTACTCAGATGTGGAAAGAGCTGTCGTCTACGGTGGATGAACTATCTCCGACCCTCGGTTAAACG
TGGAGGAATTACGTCGGACGAGGAAGATCTCATCCTCCGTCTTCACCGCCTCCTCGGCAACAGGTGGTCATTGATCGCG
GGAAGGATACCGGGAAGGACTGATAATGAAATTAAGAACTATTGGAACACTCATCTTCGTAAGAAACTTTTAAGGCAAG
GAATTGATCCTCAAACCCACAAGCCTCTTGATGCAAACAACATCCATAAACCAGAAGAAGAAGTTTCCGGT

> SEQ ID NO: 6961 263078 262512_301695_1b
GCAGCATGGCGGATCGTGTCAACGGTCCATGGAGTCACAAAAAAGATGAGCAGCTACTAAGGATGGTTGAGAAATACTG
ACCGAGGAATTGGTCTGCGATTAT

> SEQ ID NO: 6962 263078 262664_301692_1b
GCAGCATGGCGGATCGTGTTAAAGGTCCATGGAGTCAAGAAGAAGATGAGCAGCTACGAAGGATGGTTGAGAAATACGG
ACCGAGGAATTGGTCTGCGATTAGCAAATCGATTCCAGGTCGATCTGGTAAATCGTGTAGATTACGTTGGTGTAATCAG
TTATCTCCGGAGGTTGAGCATCGTCCTTTCTCGCCGGAGGAAGATGAGACTATTGTAACCGCCCGTGCTCAGTTTGGTA
ACAAGTGGGCGACGATTGCTCGTCTTCTTAACGGTCGTACGGATAACGCCGTTAAAAATCACTGGAACTCTACGCTTAA
GAGGAAATGCAGCGGAGGTGTGGCGGTTACGACGGTGACGGAGACGGAGGAAGATCAGGATCGGCCGAAGAAGAGGAGA
TCTGTTAGCTTTGATTCTGCTTTTGCTCCGGTGGATACTGGATTGTACATGAGTCCTGAGAGTCCTAACGGAATCGATG
TTAGTGATTCTAGCACGATTCCGTCACCGTCGTCTCCTGTTGCTCAGCTGTTTAAACCAATGCCGATTTCCGGCGGTTT
TACGGTGGTTCCGCAGCCGTTACCGGTTGAAATGTCTTCGTCTTCGGAGGATCCACCTACTTCGTTGAGTTTGTCACTA
CCTGGAGCTGAGAACACGAGTTCGAGCCATAACAATAACAACAACGCGTTGATGTTTCCGAGATTTGAGAGTCAGATGA
AGATTAATGTAGAGGAGAGAGGAGAAGGACGTAGAGGTGAGTTTATGACGGTGGTGCAGGAGATGATAAAAGCTGAAGT
GAGGAGTTACATGGCGGAAATGCAGAAAACAAGTGGTGGATTCGTCGTCGGAGGTTTATACGAATCCGGCGGCAATGGT
GGTTTTAGGGATTGTGGAGTAATAACACCTAAGGTTGAGTAGTAA

> SEQ ID NO: 6963 263078 263067_301721_1b
GCAGCATGAACTCATTTTCTGCCTTTTCTGAAATGTTTGGCTCCGATTACGAGTCTTCGGTTTCCTCAGGCGGTGATTA
TATTCCGACGCTTGCGAGCAGCTGCCCCAAGAAACCGGCGGGTCGTAAGAAGTTTCGTGAGACTCGTCACCCAATATAC
AGAGGAGTTCGTCGGAGAAACTCCGGTAAGTGGGTTTGTCAGGTTAGAGAACCAAACAAGAAAACAAGGATTTGGCTCG
GAACATTTCAAACCGCTGAGATGGCAGCTCGAGCTCACGACGTTGCCGCTTTAGCCCTTCGTGGCCGATCAGCCTGTCT
CAATTTCGCTGACTCGGCTTGGAGACTCCGAATCCCGGAATCAACTTGCGCTAAGGACATCCAAAAGGCGGCGGCTGAA
GCTGCGTTGGCGTTTCAGGATGAGATGTGTGATGCGACGACGGATCATGGCTTCGACATGGAGGAGACGTTGGTGGAGG
CTATTTACACGGCGGAACAGAGCGAAAATGCGTTTTATATGCACGATGAGGCGATGTTTGAGATGCCGAGTTTGTTGGC
TAATATGGCGAAGGGATGCTTTTGCCGCTTCCGTCCGTACAGTGGAATCATAATCATGAAGTCGACGGCGATGATGAC
GACGTATCGTTATGGAGTTATTAA

> SEQ ID NO: 6964 263078 279436_200062_1b
ATATACCTTTAGATCTACGTTACTATAACATAACCCCATAAATTGCTTCTTTTATCATTTTCCCAAATCTCGAGCATGC
GAGTGTTGAGGGAGCAGAGAAGTGAAGCATGCAACAGAATATGAAGAAAAGTTCAAATAGTTGTGAAGCTGCTAAACCT
AAAGAAAGACATATTGTTTCTTGGTCTCAAGAGGAGGATGATATACTAAGAGAGCAAATTCGAATCCATGGAACTGACA
```

FIG. 2 continued

ATTGGACGATCATAGCATCGAAGTTCAAGGATAAAACAACAAGGCAATGCAGAAGAAGATGGTTCACTTATTTAAACTC
TGATTTCAAGAAAGGGGATGGTCACCTGAAGAAGATATGCTTTTATGTGAGGCTCAAAAGATCTTTGGTAACAGATGG
ACTGAAATTGCCAAGGTGGTTTCAGGCAGAACTGATAACGCTGTGAAGAATCGATTCACTACACTGTGCAAAAAGAGAG
CTAAACATGAAGCTTTGGCTAAAGAAAACAGCAATTCATTCGTTAACCTAAATAACAAGAGGGTTATATTTCCAGATGG
TCTCAATATTGACAACATAACAGAAGCTGCTGCTCCTTTTAAAAGCTGAGGACGAG

> SEQ ID NO: 6965 263125 271354_200033_1b
CGTTATTTATTATGCATCTTGACTACCCCTCGACCCACGCGTCCGCAATAATATAATATAACTAGGGTTTCTATTTTTA
GGTCTGAAGAAAGAATGGGGAGAGGGAAAGTGCAATTAAGGCGTATAGAAAATAAGATTAACAGGCAAGTAACGTTTTC
AAAGAGGAGAGGAGGTTTAGTGAAGAAAGCGCATGAAATCTCAGTGCTTTGTGATGCTGAAGTTGCTCTGATTGTTTTT
TCTCATAAGGGAAAAATCTTTGAGTACTCTTCTGATTCTTGTATGGAACAGATTCTTGAACGATATGAGAGATACTCAT
ACGCAGAGAGACGTTTGCTTGCAAGTAATTCTGAATCTTCGGTGCAGGAAAATTGGAGCCTGGAATATGCTAAACTCAA
GGCTAAGATTGATCTCCTACAAAGGAACCACAAGCATTACATGGGAGAAAATCTTGACTCATTGAACCTAAAAGACCTG
CAAAACTTGGAACAACAACTTGATACTTCTCTTAAGCTTATTCGATCACGAAAGAACCAACTCATGCATGAGTCAATCT
CTATGCTACAGAAAAAGTACA

> SEQ ID NO: 6966 263125 187421_300677_1b
GGCAACCTCTTCCACTACGCCTCCTCCCACACCACTATGGAGCGAATCCTTGAGAAGTATGACAGACATGAGTTATTAT
CTGAAGGAAATAATGTGATTGAAGAGTTCCCTGAGCTGGAGGGAAGCATGAGCTATGACCACATCAAGCTGAGGGGCAG
GATTGAAGCTCTAAAAAAGAGCCAAAGGAATCTTATGGGGCAGGAACTTGACTCGCTGACACTGCAAGATATCCAGCAG
CTTGAGAACCAGATAGACACTTCTCTGAATAACATAAGATCAAGAAAGAACAATCTCTTGCTCAAGTCGATCGCCGAGC
TCCGACAGAAGGAAAAGTTGCTGATGGAGAAAAACACTATTCTGGAGAAGAAAATTACTGAACTGGAGACACTGCATAC
ATGCATCAGGGCGTCACCCACTAAAGCTGCTGCTCCTCCTGCCTGCAATACTGCTGATGCATTTGTTCCCAACCTCAAC
ATCTGCTGCGGCGATTCCGGCGAGCCGGAAACCGTGACGGCGCCACTTGGCTGGACCAGCAGCAACAATGGCTTGCCAT
GGTGGATGCTCCAGTCATCATCGAACGGCAAGAGCTAGAAGATGTTCAGATGAAATGATCCCTGCAG

> SEQ ID NO: 6967 263125 263268_301723_1b
GCAGCATGGCGAGAGAGAAGATAAGGATAAAGAAGATTGATAACATAACAGCGAGACAAGTTACTTTCTCAAAGAGAAG
AAGAGGAATCTTCAAGAAAGCCGATGAACTTTCAGTTCTTTGCGATGCTGATGTTGCTCTCATCATCTTCTCTGCCACC
GGAAAGCTCTTCGAGTTCTCCAGCTCAAGAATGAGAGACATATTGGGAAGGTATAGTCTTCATGCAAGTAACATCAACA
AATTGATGGATCCACCTTCTACTCATCTCCGGCTTGAGAATTGTAACCTCTCCAGACTAAGTAAGGAAGTCGAAGACAA
AACCAAGCAGCTACGGAAACTGAGAGGAGAGGATCTTGATGGATTGAACTTAGAAGAGTTGCAGCGGCTGGAGAAACTA
CTTGAATCCGGACTTAGCCGTGTGTCTGAAAAGAAGGGCGAGTGTGTGATGAGCCAAATTTTCTCACTTGAGAAACGGG
GATCGGAATTGGTGGATGAGAATAAGAGACTGAGGGATAAACTAGAGACGTTGGAAAGGGCAAAACTGACGACGCTTAA
AGAGGCTTTGGAGACAGAGTCGGTGACCACAAATGTGTCAAGCTACGACAGTGGAACTCCCCTTGAGGATGACTCCGAC
ACTTCCCTGAAGCTTGGGCTTCCATCTTGGGAATGA

> SEQ ID NO: 6968 263125 227267_301009_1b
GATAAGGGGAAGAGGAGGAAGAAGGAGGAGGTGTAGGGAGAAACCGGAGGGACCTCGAAGCTAGTCCAAACTAGTGGGA
GGTTGTCTTTCCGGCAAGCCGGAGCCCGGAGCTATCGATCATCAAGCTTTCTACCCCGACCGACGAGGAAGAAGACGAC
TGATCAATTGATCAAACCGATCTCTCCATAGCTAGGTAGACAGGAGGAGAGGAGGAAGAAGAGGGGGAGAGGAGACTTA
TCTTGATCGATGGCGCGAGGCAAGGTGCAGCTCCGTCGCATCGAGAACCCGGTTCACCGTCAGGTCACCTTCTGCAAGC
GCCGTGCCGGCCTGCTGAAGAAGGCCAGGGAGCTCTCCATCCTCTGCGAGGCCGACATCGGCATCATCATCTTCTCCGC
CCACGGCAAGCTCTACGACCTCGCCACCACCGGAACCATGGAGGAGCTGATCGAGAGGTACAAGAGTGCTAGTGGCGAA
CAGGCCAACGCCTGCGGCGACCAGAGAATGGACCCAAAACAGGAGGCAATGGTGCTCAAACAAGAAATCAATCTACTGC
AGAAGGGCCTGAGGTACATCTATGGGAACAGGGCAAATGAACACATGACTGTTG

> SEQ ID NO: 6969 263127 263513_301730_1b
GCAGCATGAACGGAGAAATCTCTCGTCCGCCGGAGCTAATATCGTCCCGGAATCCTTGCAAGAGTTTTGAAAATGCAAT
ACACAAAGCAGTTGAGGCAGAGCTCGCCGAGCTAGCGAAAAGCGACGCGAACGGCGGCGGAAAGAGTAAAGTGAAAGGA
CCTTGGTTGGCGGAGCAAGATGAGGGTCTCACGGCGCTTGTGAAAATGTGTGGGCCGAGGAACTGGAATCTAATCTCCC
GTGGAATCCCAGGTCGCTCTGGTAAATCTTGGCGATTACGTTGGTGTAATCAGCTCGATCCTATCCTCAAACGAAACC
TTTCTCTGATGAAGAGGAGCATATGATAATGTCTGGACAGGCGGTTCTTGGGAACAAATGGTCTGTGATTGCTAAACTC
TTACCTGGGAGAACAGATTATGGCATTAAGAATCATTGGAACTCTAATCTTAGACGTTAACCAGCAGAACAATGGAAGA
TTCCTCTATTGATGTCTAATACAGAGATAGTATATCAACT

> SEQ ID NO: 6970 263136 263016_301721_1b
GCAGCATGGCTACAGCTACATATCCACCTCCTCCTCCATATTACAGACTCTACAAGGATTTCTCAGAAAACACTGATTC

FIG. 2 continued

TGCTCCTGAACCTCCTCCTCCGATTGAAGGCACCTACGTCTGTTTTGGAGGCAACTATACTACTGAAGATGTTCTTCCA
AGCTTAGAAGAACAAGGAGTGCCTCAACTTTATCCAAAAGATTCTAATCTTGATTACAAGAAGGAACTCAGGTCACTGA
ATAGAGAACTACAGTTACATATATTGGAGCTTGCTGATGTTCTTGTTGACAGACCTTCTCAATATGCGAAGAGAATTGG
TGAAATTTCTTCAATCTTCAAGAACTTGCATCACCTTCTCAATTCCTTGAGGCCTCACCAAGCGAGAGCAACGCTTATT
CACATTATGGAACTTCAAATTCAACAGAGGAAACAAGCTGTGGAAGACATTAAAAGAAGAAGAGAAGAAGCACAGCGAC
TTCTAAAGGATGCTTACCTCACTTTAGATGGTCAATAGTAA

> SEQ ID NO: 6971 263136 263511_301730_1b
TTATTGACCATCTAAAGTGACGAAAGCATCCTTAAGAAGTCCTTGTGCTTCTTCTCTCCTCCTCTTAATGTCTTCCACA
GCTTGTTTCCTCTGTTGAATTTGAAGTTCCATAATGTGAATAAGCGTTGCTCTCGCTTGGTGAGGCCTCAAGGAATTGA
GAAGGTGATGCAAGTTCTTGAAGATTGAAGAAATTTCACCAATTCTCTTCGCATATTGAGAAGGTCAAGATTAGAATCT
TTTGGATAAAGTTGAGGCACTCCTTGTTCTTCTAAGCTTGGAAGAACATCTTCAGTAGTATAGTTGCCTCCAAAACAGA
CGTAGGTGCCTTCAATCGGAGGAGGAGGTTCAGGAGCAGAATCAGTGTTTTCTGAGAAATCCTTGTAGAGTCTGTAATA
TGGAGGAGGAGGTGGATATGTAGCTGTAGCCATGCTGC

> SEQ ID NO: 6972 263146 201582_300717_1b
GTCGAGCCACGCGTCCGAAGTTCACAACCCAACACCCAAAAGCAAAAGAAAAGCAGCAACCAAAGATGTGCGGCGGAGC
GATCCTTGCGGAGCTCATACCGAGCGCGCCGGCGGCGAGGCGCGTCACGGCGGGCCACGTCTGGCCGGGCGACGCCAAC
AAGGCCAAGAAGAAGGGCGCGCGCGCCGACGACTTCGAGGCCGCGTTCCGCGACTTCGACAACGACTCCGATGACGAGG
AGATGATGGTGGAGGAGGCGGAGGAGGAGGAGGCGACCTCCGAGCACAAGCCGTTCGTCTTCCGCGCCAAGAAGGCGGC
GGCGGCGGCGTCGAGCAGGCGCAGGAAGCCGGCGCAGTACAGGGGCGTGCGGCGCCGGCCGTGGGGGAAGTGGGCGGCG
GAGATCCGCGACCCCGTCGAGGGCGTCCGCGTCTGGCTCGGCACGTTCGCCACCGCCGAGGCCGCCGCCCACGCCTACG
ACGCCGCCGCCCGCGACCTCCGCGGCGCGACCGCCAAGCTCAACTTCCCCTCCTCCTCCTCCACCGCCGCCACCCC
ACGCCCCGCAAGTGCCGCCCCACCACCGNCACCGCCACCCCCAAGGCGACGACACCGAACGTCGTCGTCGTCAAC
CTCGTCGACAAAGAGGCCGAGGTCAGCGAGAGCTCCGGTGCCAGCAGCAGCGCGCTGCCGGACTTCTCGTGGCACGGCA
TG

> SEQ ID NO: 6973 263146 263160_301722_1b
GCAGCATGGCCAAGATGGGCTTGAAACCCGACCCGGCTACTACTAACCAGACCCACAATAATGCCAAGGAGATTCGTTA
CAGAGGCGTTAGGAAGCGTCCTTGGGGCCGTTATGCCGCCGAGATCCGAGATCCGGGCAAGAAAACCCGCGTCTGGCTT
GGCACTTTCGATACGGCTGAAGAGGCGGCGCGTGCTTACGATACGGCGGCGCGTGATTTTCGTGGTGCTAAGGCTAAGA
CCAATTTCCCAACTTTTTCTCGAGCTGAGTGACCAGAAGGTCCCTACCGGTTTCGCGCGTAGCCCTAGCCAGAGCAGCAC
GCTCGACTGTGCTTCTCCTCCGACGTTAGTTGTGCCTTCAGCGACGGCTGGGAATGTTCCCCGCAGCTCGAGCTTAGT
CTCGGCGGAGGAGGCGGCGGCTCGTGTTATCAGATCCCGATGTCGCGTCCTGTCTACTTTTTGGACCTGATGGGGATCG
GTAACGTAGGTCGTGGTCAGCCTCCTCCTGTGACATCGGCGTTTAGATCGCCGGTGGTGCATGTTGCGACGAAGATGGC
TTGTGGTGCCCAAAGCGACTCTGATTCGTCATCGGTCGTTGATTTCGAAGGTGGGATGGAGAAGAGATCTCAGACTGTT
AGATCTAGATCTTAA

> SEQ ID NO: 6974 263146 228439_301021_1b
GAAAAAACAAGGGGAGGAAAAGGAAGAGGGGGAAGGGAGACGCCACTGCCAAACCCTAGCCGAGCACCCCCTCCCCTCC
TCCTCCCCCATCGGAGCCTCCTCGCCTCGCCCTCGCCCACCAAGCCCCGCGCGCGCGCGTGCATCCGGCGATGCGG
AAGTCGAAGCAGCCGCAGCCGCAGCCGTCGCCGGAGATCCGGTACCGGGCGTGCGGAAGCGGCCGTCGGGGAGGTACG
CCGCCGAGATCCGGGACCCGGCGAAGAAGACCCCGATCTGGCTGGGTACCTTCGACTCCGCCGAGGTGGCGGCCCGCGC
CTACGACGACGCCGCCCGATCTCTCCGCGGGCCCACCGCGCGGACCAACTTCCCCTTGGCCGCGCCGTCCGCGCCCCCG
CCCCGGCCGCCGCCGCCGGCGGCGGCG

> SEQ ID NO: 6975 263146 202409_300784_1b
CCCCAAACTCCAACGCACCACCGGCGCCAAACCAACCACCCACCATCCACCGGTCGAACACTTGGCGCTCTCGCCCGCC
TTAGCTCGCTCTGCTCGTGGTGCTCGACCCGAACAAGAACGGACATGGCTCCCAGGAACGCCGCCGAGGCCGTCGCCGT
CGCCGTGGCGGAGGGCGGAGGAGCCGGCATGGAGCCCAGGTTCCGCGGCGTGAGGAAGCGCCCGTGGGGCAGGTACGCG
GCGGAGATCCGCGACCCGGCCAGGAAGGCGCGGGTGTGGCTCGGCACCTTCGACACCGCCGAGGCCGCGGCGCGCGCCT
ACGACAGCGCCGCGCTCCACTTCCGCGGGCCCAAGGCCAAGACCAACTTCCCCGTCGCCTTCGCGCACGCCCACCACCA
CGCCCCGCCGCCGCCGCTGCCCAAGGCGGCGGCGCTGGCCGTCGTCAGCCCGACCAGCAGCACGGTCGAGTCGTCCTCC
CGGGACACGCCCGCCGCCGCCCCGGTG

> SEQ ID NO: 6976 263146 272390_200043_1b
TTTTGAAAAAATGGCTGTCAAAAATAAGGTTAGTAATGGCGATATGAAAGGAGGAAATGTGAAAACAAATGGAGTTAAG
GAGGTTCACTACAGAGGTGTAAGGAAGAGGCCGTGGGGTCGGTATGCAGCTGAAATCCGTGACCCGGGTAAGAAGAGTC

GGGTCTGGTTGGGTACTTTTGACACGGCGGAAGAGGCGGCTAAGGCGTACGACACTGCCGCTCGCGAGTTTCGTGGACC
CAAAGCAAAAACTAACTTCCCTTTACCGACGGAGAATCAGAGCCCAAGTCACAGCAGCACCGTGGAGTCCTCTAGCGGA
GAGACTGGTGTTCACGCGCCGCAGAACGCGCCCTTCGAGCTGGATCTCACTCGCCGGCTTGGCTCCGTTACTGCTGATG
GCGGTGACAACTGTCGCCGTGCTGGTGAAGTTGGGTACCCGATTTTCCACCAGCAACCGACGGTGGCGGTTCTGCCAAA
TGGCCAACCGGTTTTGCTCTTTGATTCTTTGTGGCGACCGGGAGTTGTTAACAGGCCTCAGCCTTACCATGTAACGCCG
ATGACGATGGGGTTTAACGGCGGTAACGCCGGTGTGGGTCCTACTGTATCAGACTCATCCTCAGCGGTGGAAGAGAAAC
AAGATGATGAGAAAAGAGGAATTGATCTGGATCTTAACCTTGCTC

> SEQ ID NO: 6977 263146 274042_200147_1b
AAACAGCCCCTATTGCTCTCTCCTTTCTCTCACCCAAACACACCACAAACAGTAGAGAGAGAAAAAAGCTGAGTTCTAG
AGAGATAAACTGAGTTCTAGAGAGAGAAAGTGAGTGCTTTCGGAAGGGAAGCTAATCCTCTGGTGCTTCTCGATCTTTG
ATTGCTCTAATCGGTATCAAAGGGGTAGGTCTTTTGTTGTTTCTTTCGACTTGTGGCCATGCGGAGAGGTAGAGCAACC
GCGGCGGCGAAGCAAGCGGCGGAGGTTCCAACCGAGGCTGGATCTGGAGGATTAAAAGAGATTAGGTTTCGTGGTGTCA
GAAAACGGCCGTGGGGAAGATTTGCAGCGGAGATTACAGACCCGCGGAAAAAAACTAGGGTTTGGCTTGGCACTTTTGA
TTCTGCTGAAGAAGCCGCTAAAGCTTATGACGCTGCAGCTCGGACTCTTAGGGGACCTAAAGCCAAAACTAATTTCCCT
TTACCACCGTATTCTCACTTCAATCAAACTGTAAACCCTAACGACCCGTTTATTGACCCGAGGTTATACTCACAGGAAA
GTCACCCGATTGTTATTCAAAGACCTACATCGAGCAGCATGAGTAGTACCGTAGAATCCTTCAGTGGACCCAGGCCGGC
GCCACGTCAGCAAACGACGGTGTTGCCTTCGAGAAAACATCCCCGGT

> SEQ ID NO: 6978 263146 279234_200060_1b
ATTTCACCCTACCATGCCCCGTTGGAAAAATTCTGAGACAAATAGATCAACATCCGTAGCTTTTCGACACCCTAAAACC
GACCTAAAGCGTTATAGGGGCGTCCGTAAACAGCCGTGGGGCCGGTTTGCAGCCGAGATACGAGACCCGATAAAAAAAA
CTCGGGTCTGGCTTGGCACCTTTGACACGGCGGAGGATGCTGCACGCGCTTACGATGATGCCGCACGCGCCTTCCATGG
ACCCAAAGCGAAAACTAATTTTTCAGTTTTTCCTCCGTATGGGCAGAACCAATTTGAAAATTTCAACCGTCCGGCTTCC
AGTAGTCTGAGCAGTACGGGGGAGTCATCCAGTGGGCGCGTGATTTTCACTCGCGGGTTGAACTTACTCGCCGGATTA
CTCCGTCGGCGGTGGAGTGTTACAGTGGTTGCGATTCGTCATCGACTGTGGTGGATGATAATATTGACGGCGATTCGTC
GGCGTTTTGTAAACAGCCTCTGCCGTTTGATTTGAACTTGCTCCCTCCGTCTGATGACGTTGATGATGTCCATGTTACC
CCTTGTATTTTTAGTTATTTTAATTAATTTGATTATTTGATGTATCCATGTGGTGGATGTTGAAAAATTAATAACCAAA
TGGGTTTTTTAAAATATGCATTGATCAATTTACTGAGTCATGGTGTTATCTAAATCTGAAA

> SEQ ID NO: 6979 263146 279833_200065_1b
GGAAAATGGCCACTTGGCTAGGACGGTGGCGGTTCCGACAGCGAACGGTGGAGAGGTGCGTTCAGATGAGGTGCATTAT
AGGGGTGTGAGGAAGAGGCCATGGGGGAGGTACGCCGCTGAGATCAGAGATCCTGGCCAGAAAACACGTGTCTGGCTTG
GGACTTTTGATACGGCGGTTGAAGCTGCTAAGGCTTACGATACGGCCGCGAGGCTGATTCGTGGTAGGCGGGCCATAAC
TAATTTTTCTCCGACAACTGAGGATAACCTCATGAACAATAGAGATTTAATGGCAAAACTTAGTACTAGAAATCATGTT
AACATTAATATAAACAATCACGGTCCCATTCAGAACAGTGATATTGGGTCGTCAAGCGGCGGCGGTGGTACGGGGAGGA
TTCCTTTGGCAAATCAGAATCCTCAGTCGCGCCATTTTCCGGTTACTGGATGTTGTGCTTCGCTGCAGTTGGCGCGTGA
TAGGTACTATGTGGAGGCTTTAACTAGAGCTGGAGTGATCATTAACCGGGATACAAGTAACCCAAAGAAGACGATTGAC
TTCATTGGCTGCGGCGTTAACTGCGGCAGTGGGCGTGGGGT

> SEQ ID NO: 6980 263146 1008017_301406_1b
GGAGAGCTGTACACTATGACCGCCTGGACTCCCCTTCTCGTAATAACAACTTCATGTGTCGATTGTTTCCTTCGTCATC
GCCCGCTGCCCCCACCACGGCAACAGTGGCACTAGATGCGCCCCCCCCCTCTCCTTCCTCTCGCAATGCAGCCGCG
GTGGCGGTAGAAGAAGAGAAGGAGATTCACTACCGAGGGGTACGAAAGCGCCCTTGGGGTCGTTATGCTGCTGAGATCC
GTGACCCCTCAAGAAAACACGTGTCTGGCTGGGCACATTTGATACTGCTGAAGACGCTGCTCGTGCCTATGACACTGC
TGCTCGCTCCCTTCGCGGGGCCAAAGCAAAGACGAATTTCAACCCCTCCGCTGCTAATAGCAACAAGAGCAAGAAGATA
AAGAGTGGTAGCGAAGCAAAGCCCCCCTCCTTCTCTCGCCCAGCTTTGCAACCAACTCAAGCACCTGCCTAGGTTTGG
GTTTAAGCCTACATACCCCGAATCTACCCTATTACTACTACTATTCTGCACCAACCATGCCTGTCCCGGCCCCTCGCAC
AGGACCGGTGGGTGACTCGTTGCCCTTCGAAATCGAGAATAAAAAGAGAAGCAAGAACGAACAAGTGGAACAACAATCA
GCAACTGATTACCACAGTGGTTCATCAGATGGCGACGATGATTAACCAGTCATCACATATTT

> SEQ ID NO: 6981 263146 1044187_301886_1b
ATCTGTTCTCTCGCAGTTTTCATCTTCTCTTCTTGCCTGTTTATTCGAAGTAGTAGGTATGTCTGCCAAAGGGGTGGGG
AGTGGGGGGCCGGAGGTGCACTACCGGGGGGTCAGGAGGAGGCCCTGGGGCCGCTTTGCCGCAGAGATTCGCGACCCAT
GGAAGAAGACCCGAGTCTGGCTCGGTACCTTCGATCTGCTGAAGAGGCTGCTAGTGCTTACGATAACGCTGCCAGAGC
CCTCCGTGGCCCCAAGGCTAAAACCAACTTCGCCCAGAGTAGTAGCCTTCACCTCCAGCCTGGCTCCTGCTTCCGTCGC
TCCG

FIG. 2 continued

> SEQ ID NO: 6982 263154 279896_200065_1b
AATAATGACGTTAAACCTCTGAATAGTGGCAAGGCCATCAAGAAACGAGCAGCTGAAGCTTCAATACCGAAGCAAAAGG
CATTGAAGGTGAAGGTAGTGCAGCCACCGCCGGATGGCACTGTGAGGAAGTTCAGGGGTGTGCGTCAAAGGCCGTGGGG
CAAATGGGCCGCTGAAATCAGAGACCCAGCTCGTCGTGTGAGGCTCTGGTTGGGAACTTATGACACAGCTGAAGAAGCT
GCCATGGTTTATGACAATGCAGCCATTAAGCTCCGTGGGCCAGACGCTTTAACAAATTTCATCACTCCCCCAACTAAGC
CAGAGGAGGTCAATGTGGCTTCAAATTCGGGCTATGAATCTGGCGATGAATCCCATAATCTTTCTTCTCCCACCTCTGT
TTTGCGGTTTAGAACGAGTCAATCCAGTGAAGAAGCTGAACAACAAAGTGGGTCCGAACCAATACTCGAAGAAACTAAA
GGAGATGTATCTTGTCCATTGGTGGAAGAAGAAGCAGTTCTTGATTCGATGGACAACAGCGAGCAAACCGTGGAACCCC
TTGAGTGCCAAGGCGAGACAAGCATGATAATACCAGATTATTCAAACGACTATTTGCCGACAGATGTTCCCTTCTTAGA
TGATTTCTTCAACTTCGAAGCTGCAGAACAGACATTATTAGACGATACAACAAGTTTTGCCAATGATTTGTGCACGTCG
TACGATGACGTATCGTC

> SEQ ID NO: 6983 263154 316718_301426_1b
GCAGCATGGCTGTATATGAACAAACCGGACCGAGCAGCCGAAGAAAAGGAAATCTAGGGCTCGAGCAGGTGGTTTAACG
GTGGCTGATAGGCTAAAGAAGTGGAAAGAGTACAACGAGATTGTTGAAGCTTCGGCTGTTAAAGAAGGAGAGAAACCGA
AACGCAAAGTTCCTGCGAAAGGGTCGAACAAAGGTTGTATGAAGGGTAAAGGAGGACCAGATAATTCTCACTGTAGTTT
TAGGGGAGTTAGACAAAGGATTTGGGGTAAATGGGTTGCAGAGATTCGAGAACCGAAAATAGGAACTAGACTTTGGCTT
GGTACTTTTCCTACCGCGGAAAAAGCTGCTTCCGCTTATGATGAAGCGGCTACCGCTATGTACGGTTCATTGGCTCGTC
TTAACTTCCCTCAGTCTGTCGGGTCTGAGTTTACTAGTACGTCTAGTCAATCTGAGGTGTGTACGGTTGAAAATAAGGC
GGTTGTTTGTGGTGATGTTTGTGTGAAGCATGAACATACTGATTGTGAATCTAATCCATTT

> SEQ ID NO: 6984 263154 29920_300076_1b
TTTCTTCACCCCTCTGCGTTGTCTCTCCCTCCTCTCCCCGGTTATTACCCGGATTCAACGTTCTTGACCCAACCGTTTT
CATACGGGTCGGATCTTCAACAAACCGGGTCATTAATCGGACTCAACAACCTCTCTTCTTCTCAGATCCACCAGATCCA
GTCTCAGATCCATCATCCTCTTCCTCCGACGCATCACAACAACAACAACTCTTTCTCGAATCTTCTCAGCCCAAAGCCG
TTACTGATGAAGCAATCTGGAGTCGCTGGATCTTGTTTCGCTTACGGTTCAGGTGTTCCTTCGAAGCCGACGAAGCTTT
ACAGAGGTGTGAGGCAACGTCACTGGGGAAAATGGGTGGCTGAGATCCGTTTGCCGAGAAATCGGACTCGTCTCTGGCT
TGGGACTTTTGACAGCGCGGAGGAAGCTGCGTTGGCCTATGATAAGGCGGCGTACAAGCTGCGCGGCGATTTCGCCCGG
CTTAACTTCCCTAACCTACGTCATAACGGATCTCACATCGGAGGCGATTTCGGTGAATATAAACCTCTTCACTCCTCAG
TCGACGCTAAGCTTGAAGCTATTTGTAAAAGCATGGCGGAGACTCAGAAACAGGACAAATCGACGAAATCATCGAAGAA
ACGTGAGAAGAAGGTTTCGTCGCCAGATCTATCGGAGAAAGTGAAGGCGGAGGAGAATTCGGTTTCGATCGGTGGATCT
CCACCGGTGACGGAGTTTG

> SEQ ID NO: 6985 263154 167620_300549_1b
GAATTCAATGGAATAGATGTTTTTGATCATTGTAGTCCATCAACAGCTAGTATGTCAAGCACTGAAATTCAACAATGTC
CAATACCCATTATGGATTCTAATACCTGTGATACATGTGGAATTAGTGGTTGTTTGGGTTGTAATTTCTTTGATCAAGA
TCAAGGAAGTAAAAAGAAAGCTAAGAAACAGAGCAACAAGACCAACATTGTGATTGAGAAGAAGAAAAATTACAGAGGA
GTTAGACAGAGGCCATGGGGAAATGGGCAGCAGAAATTAGAGATCCTAGAAGAGCAACTAGAGTTTGGCTTGGGACTT
TCACTACTGCTGAAGATGCAGCTAGAGCCTATGATAAAGCTGCTATTGATTTCCGTGGTCCTCGAGCTAAACTTAATTT
CTCATTCTCAGATTATGACAATAGTACTTATAACTCATCAAGTGAACATCAGCAGCAGCAGCAAGAAATTTCTCAGAAA
ATTGACAGTAATTATCAGCAGCAACAGATTAGCAACAGCAATGTTGAGAAACCGAAGATTGATACTGATTATCAAGTGC
AAATGAATTTTACTTCATCACAGACAGAGTCATTGATGGTAGGTCCTTCTACTACACTTGATAAGCAATTTTGGGGCAT
TGATGAAGAAATTCACAGCTGGACATCA

> SEQ ID NO: 6986 263154 262707_301693_1b
GCAGCATGGAGAAATCATCCTCAATGAAACAATGGAAGAAGGGTCCTGCTCGGGGTAAAGGCGGTCCACAAAACGCTCT
TTGTCAGTACCGTGGAGTCAGGCAAAGGACTTGGGGCAAATGGGTGGCTGAGATCAGAGAGCCCAAGAAGAGGGCAAGA
CTTTGGCTTGGCTCTTTCGCTACAGCTGAAGAAGCAGCTATGGCTTATGATGAGGCTGCCTTGAAACTCTATGGGCACG
ACGCATACCTCAACTTACCTCATCTTCAGCGGAATACAAGACCTTCTCTGAGTAACTCTCAGAGGTTCAAATGGGTACC
TTCAAGGAAGTTTATATCTATGTTTCCTTCATGTGGTATGCTAAACGTGAATGCTCAGCCTAGTGTTCACATAATCCAG
CAAAGACTAGAAGAACTCAAGAAAACTGGACTTTTATCTCAATCCTATTCTTCTAGTTCTTCCTCCACCGAATCAAAAA
CTAATACTAGCTTTCTTGATGAGAAGACCAGCAAGGGAGAAACAGACAATATGTTCGAAGGTGGTGATCAGAAGAAACC
AGAGATCGACCTGACCGAGTTTCTTCAGCAACTAGGAATCTTGAAGGATGAAAATGAAGCAAAACCAAGTGAGGTAGCA
GAGTGTCATTCCCCTCCACCATGGA

> SEQ ID NO: 6987 263154 262479_301694_1b
GCAGCATGGAGACAGAGAAGAAAGTTTCTCTCCCAAGAATCTTACGAATCTCTGTTACTGATCCTTACGCAACAGATTC
GTCAAGCGACGAAGAAGAAGAAGTTGATTTTGATGCATTATCTACAAAACGACGTCGTGTTAAGAAGTACGTGAAGGAA

FIG. 2 continued

```
GTGGTGCTTGATTCGGTGGTTTCTGATAAAGAGAAGCCGATGAAGAAGAAGAGAAAGAAGCGCGTTGTTACTGTTCCAG
TGGTTGTTACGACGGCGACGAGGAAGTTTCGTGGAGTGAGGCAAAGACCGTGGGGAAAATGGGCGGCGGAGATTAGAGA
TCCGAGTAGACGTGTTAGGGTTTGGTTAGGTACTTTTGACACGGCGGAGGAAGCTGCCATTGTTTACGATAACGCAGCT
ATTCAGCTACGTGGTCCTAACGCAGAGCTTAACTTCCCTCCTCCTCCGGTGACGGAGAATGTTGAAGAAGCTTCGACGG
AGGTGAAAGGAGTTTCGGATTTTATCATTGGCGGTGGAGAATGTCTTCGTTCGCCGGTTTCTGTTCTCGAATCTCCGTT
CTCCGGCGGGTCTACTGCGGTTAAAGAGGAGTTTGTCGGTGTATCGACGGCGGAGATTGTGGTTAAAAAGGAGCCGTCT
TTTAACGGTTCAGATTTCTCGGCGCCGTTGTTCTCGGACGACGACGTTTTGGTTTCTCGACGTCGATGAGTGAAAGTT
TCGGCGGCGATTTATTTGGAGATAATCTTTTTGCGGATATGAGTTTTGGATCCGGGTTTGGATTCGGGCCTGGGTCTGG
ATTCTCCAGCTGGCACGTTGAGGACCATTTTCAAGATATTGGGGATTTATTCGGGTCGGATCCTGTCTTAACTGTTTAA
TAA

> SEQ ID NO: 6988    263154  259038_301702_1b
GCAGCATGGTCTCCGCTCTCAGCCGTGTCATAGAGAATCCGACAGACCCGCCGGTCAAACAAGAGCTTGATAAATCGGA
TCAACATCAACCAGACCAAGATCAACCAAGAAGAAGACACTATAGAGGCGTAAGGCAGAGACCATGGGGTAAATGGGCG
GCAGAAATCCGCGATCCAAAGAAAGCAGCCCGTGTCTGGCTCGGGACTTTCGAGACGGCAGAGGAAGCTGCTTTAGCCT
ATGACCGAGCTGCCCTCAAATTCAAAGGCACCAAGGCTAAACTGAACTTCCCTGAACGGGTCCAAGGCCCTACTACCAC
CACAACCATTTCTCATGCACCAAGAGGAGTTAGTGAATCCATGAACTCACCTCCTCCTCGACCTGGTCCACCTTCAACT
ACTACTACTTCGTGGCCAATGACTTATAACCAGGACATACTTCAATACGCTCAGTTGCTTACGAGTAACAATGAGGTTG
ATTTATCATACTACACGTCGACTCTCTTCAGTCAACCTTTTTCAACGCCTTCTTCATCTTCTTCTTCCTCCCAACAGAC
GCAGCAACAGCAGCTACAACAACAACAACAGCAGCGTGAAGAAGAAGAGAAGAATTATGGTTACAATTATTATAACTAC
CAAGAGAATAATAAGCGGCCGCGTCGAGGGGT

> SEQ ID NO: 6989    263154  233824_301094_1b
GAAGGTTGAGCTGAGCTCGGGAGCCGTAAAGTCGCCAGGCTGCCATGTCGTACGCTTGAGCGGCGTCTTGAGCTGTCGC
AAACGTTCCCAGCCATATTCGAGTTCGCCTCCTCGGTTCCCTGATCTCGGCCACCCAGCGTCCCCAGCTCCGTTGCCGG
ACACCTCTGTACGTGTAGAGACCGTTCTCCGGACCACCTTTTCCTTTGGCTCTCGTTCTCCTTCCTGGTTTCTGGGAAG
AAGAATTAGAAGAAGATGAAGAAGAAGATGGAGGACAAGCATTTGGAACAGCGGCAGGAGCAGCAGCCGTCTGGTTTCC
ACAAGTATCTTCCGCTCCTGCGGGCTGGATCGGTGATGTCGATGCCATCGCTGAACCAAGGGGTGACTTAGCCATGGAT
TGCAGTGGTGGTGGACTATCAGCGAAGCTGCTCGCGGATTCAAATAGAGCTCAATTTCTCTCAGTGACAACGGTACGAA
TATATAGAAAGTATGGGAAGCGAGAAGATCTACAGATTCTCCGCTGCTGCTTCGGGCGTCGAGCCTTGACCGTTCACAC
GCAGGCTGGCTTTTGGTTGC

> SEQ ID NO: 6990    263154  188248_300689_1b
CCCACGCGTCCGCCCACACGTCCGGGCAACGGCACTGGGGGAAGTGGGTGGCGGAAATCCGCCTCCCGCGGAACCGCAC
GCGGCTCTGGCTCGGCACCTTCGACACCGGCGAGGAGGCGGGGCTTGGCTACGACCAGGCGGCGTACCGCCTCCGCGGC
GACGCGGCGCGGCTCAACTTCCCCGACAACGCCGGCTCCCGCGGGCCGGTCCACGCCTCCGTCGACGCCAAGCTCCAGA
CGCTCTGGCAGAACATCGCCGCCGCCAAGAACGCCAAGAAGTCCTCTGTCTCCGCCTCCGGCGCCGGAACATCCTCCGC
GCCCACCAGCAACTGGTCGTCGCCGTCCTCCGACGACGCGTCGTCCTGCCTGGAGTCCGGCGACTCGTCGCCCTCCCT

> SEQ ID NO: 6991    263157  262675_301749_1b
GCAGCAATGAACTCATTTTCAGCTTTTTCTGAAATGTTTGGCTCCGATTACGAGCCTCAAGGCGGAGATTATTGTCCGA
CGTTGGCCACGAGTTGTCCGAAGAAACCGGCGGGCCGTAAGAAGTTTCGTGAGACTCGTCACCCAATTTACAGAGGAGT
TCGTCAAAGAAACTCCGGTAAGTGGGTTTCTGAAGTGAGAGAGCCAAACAAGAAAACCAGGATTTGGCTCGGGACTTTC
CAAACCGCTGAGATGGCAGCTCGTCGTCACGACGTCGCTGCATTAGCGCTTCCGTGGCCGATCAGCATGTCTCAACTTCG
CTGACTCGGCTTGGCGGCTACGAATCCCGGAGTCAACATGCGCCAAGGATATCCAAAAAGCGGCTGCTGAAGCGGCGTT
GGCTTTTCAAGATGAGACGTGTGATACGACGACCACGAATCATGGCCTGGACATGGAGGAGACGATGGTGGAAGCTATT
TATACACCGGAACAGAGCGAAGGTGCGTTTTATATGGATGAGGAGACAATGTTTGGATGCCGACTTTGTTGGATAATA
TGGCTGAAGGCATGCTTTTACCGCCGCCGTCTGTTCAATGGAATCATAATTATGACGGCGAAGGAGATGGTGACGTGTC
GCTTTGGAGTTACTAA

> SEQ ID NO: 6992    263177  104874_300366_1b
CTTGGCAACAGGTGGTCCAAGATTGCTTCTAATTTACCGGGACGAACTGATAATGAAATCAAGAATCACTGGAATACAC
ATATTAAGAAGAAGCTGAAGAAAATGGGGATTGATCCAGTCACACACCAGCCAATTACTGTTAACCAACCAAACATAGA
ACAGCCAACAAAAAATCAACCAATTATTCAACAAGAAAAACAAACAACAATGCCAATTTCCCCATCTCATGTTGTCCCA
GAAATAATGGATATTCTTGATCACAACAAGGAGCTGGTTGAAACTCCTATATTATCAACAATCACAGATATCAAATTAG
ACGACGACAACAACAATAACAGCAATATCAACAATAATAAGAATACGGGGACAAGCTTCTGTACTGACGAAGTCCCCGT
AATTAAACCACATGAAATTTTATTCCATTCTGAATCAACCACTTCAACATCATCATCTTCTTCACCAACATCCATTATT
CTTGAAGATACGCAGTTTGATTTCAATTGGGGAGATGATTTCAGCAGAACATTGGATTATTTACTTAATGATGATATTG
```

FIG. 2 continued

ACATGAATAATGTCATTTCCCAAGATTGGTCAAAGGTGTTGGAAGTTTGAGCAAATTTTACTTGTGATTAATTTTCAAA
GGGGGGCTGAATTAAGCTTTGTTCTTTTGATTGGCAAGTCACTTTTTC

> SEQ ID NO: 6993 263177 110845_300047_1b
CTTCTTCTTACTTCTCTCTGTAGAGCTCTGAGGATTTACTAGAATAAGAAGGAAAAAAAAAGGAAGAAGAAATTAAGAA
ATGGGAAGAAAACCATGTTGTGTAAAGAGGGATTGAGAAAAGGTCCATGGTCTTCTAAAGAAGATTTATTACTTACTA
ATTATATCAAGGAAAATGGTGAAGGACAATGGAGATCTTTGCCTAAGAATGCTGGGTTGCTTAGGTGTGGAAAAAGTTG
CAGACTAAGATGGATGAACTATTTAAGACCAGGGATTAAAAGAGGAAACTTCAGCCAAGATGAAGATGATCTTATAATG
AGACTACATTCTCTTTTGGGTAATTGTTGGTCACTAATTGCTGGAAGATTACCAGGTCGTACAGATAATGAAATCAAGA
ATTATTGGAATACACATTTAATCAAGAAGCTTAAAAGTGCTGGAATTGAACCAAAACCCCACAAAACTTTCTCCAAATG
TTCCAAAACTGAATCAAGAAAAGGACCCCAACAAGAGACATCAAGACAAAAACAGCGCAAAAGAACAACAACAAAAACA
ATAAGGGTCAAATTGTACAAGTTGAGAAAACCAAAGTATTTGCCCCCAAACCCA

> SEQ ID NO: 6994 263177 6835_300313_1b
CCCACGCGTCCGTACCTTTTACAATTTGTTTATATATTTTACGTATCTATCTTTGTTCCATGGAGGGTTCGTCCAAAGG
GCTGCGAAAAGGTGCTTGGACTACTGAAGAAGATAGTCTCTTGAGACAGTGCATTAATAAGTATGGAGAAGGCAAATGG
CACCAAGTTCCTGTAAGAGCTGGGCTAAACCGGTGCAGGAAAAGTTGTAGATTAAGATGGTTGAACTATTTGAAGCCAA
GTATCAAGAGAGGAAAACTTAGCTCTGATGAAGTCGATCTTCTTCTTCGCCTTCATAGGCTTCTAGGGAATAGGTGGTC
TTTAATTGCTGGAAGATTACCTGGTCGGACCGCAAATGACGTCAAGAATTACTGGAACACTCA

> SEQ ID NO: 6995 263177 202247_300782_1b
CCCCCCCGGAGTCTGCAGCCTCGGAGCAGCCGCCTCCCTTCCAAGAACACACAACGCAAGAGGAGCAGAGCAGTCCAAA
TCAGAGCAGGGAAGGAGCAAGCACAATGGGGAGGGCTCCGTGCTGCGAAAAGATGGGGCTCAAGAAGGGTCCATGGACG
CCGGAGGAGGACAAGGTCCTCGTCGCCCACATCCAGCGCCACGGCCACGGCAACTGGCGCGCCCTGCCCAAGCAAGCCG
GGCTGCTGCGTTGCGGCAAGAGCTGCCGGCTCCGGTGGATCAACTACCTGCGGCCGGACATCAAGCGGGGCAACTTCTC
CAAGGAGGAGGAGGACACCATCATCCATCTCCACGATCTGCTTGGCAACAGGTGGTCCGCAATTGCCGCCAGGTTGCCC
GGGAGGACGGACAACGAGATCAACAACGTGTGGCACACCCACCTCAAGAAGCGCCTCGA

> SEQ ID NO: 6996 263177 209376_300814_1b
AGGAGGAAGAAGACCTCATCATTGAGCTCCATGCTGTCCTTGGGAACAGGTGGTCTCAGATTGCAGCTCAGCTGCCTGG
GAGGACTGACAACGAGATCAAGAATCTCTGGAATTCTTGCATCAAGAAGAAGCTCCGGCAGAAAGGCATTGATCCCAAC
ACCCACAAGCCCCTCACCGAGGCTGATCGCAGGGGAGCAGCACCCACAGTCAGCACCGAGAGGACCTCAGGGTCCAGCG
ACGTCAACCCGTCAAGTGCTGGTGCTCTAGGGAACTTGAGCCACCTCCTCAGCGAGACAGCACAATCATCAATGCTGCT
GCCGGTGTATGATAAGAATCACCCTGAAACTGCAAGCTTGCCACGCCCTAAGGTGCCACCAAAGGAGTTGTTTCTTGAC
CAGCTTACTGCCGGTCACGAGAGCCCATCAAGTTGCCGCTCATCAGGTCCAACCCTGTATTTTCCTTTCCAGCAACCAT
TAGGCTACAGTAATGAATGTGGCACTGGGGATGGTGCGAGTATGAATTCACTCTGGTTCAACC

> SEQ ID NO: 6997 263180 263119_301722_1b
GCAGCATGGGTAGGCCTCCATGCTGTGACAAGATAGGATCAAGAAAGGACCATGGACTCCTGAAGAAGATATCATTCT
TGTTTCTTACATTCAAGAACATGGTCCTGGAAACTGGAGATCAGTTCCCACCAACACTGGGTTATTGAGATGCAGCAAA
AGTTGTAGACTGAGATGGACAAATTATCTGAGACCTGGAATTAAACGTGGAAACTTTACTCCTCATGAAGAAGGAATGA
TCATTCACTTGCAAGCCTTATTGGGTAACAAATGGGCGTCCATAGCTTCATACCTACCACAAAGAACGGACAATGATAT
CAAGAACTACTGGAACACACATTTAAAGAAGAAGCTCAACAAGTCTGACAGTGATGAGAGGAGCAGATCAGAGAACATT
GCGCTGCAAACTTCTTCGACAAGAAACACCATTAATCATAGATCTACCTATGCTTCAAGCACCGAAAACATTTCCCGCC
TTCTTGAGGGTTGGATGAGAGCGTCTCCAAAGAGTAGTACAAGTACTACTTTCTTGGAACACAAAATGCAGAACCGGAC
AAACAATTTCATCGATCATCACAGCGATCAGTTTCCATACGAGCAGCTTCAAGGTTCTTGGGAAGAGGGTCA

> SEQ ID NO: 6998 263180 46877_300192_1b
GCAGCATGAGGAAGCCAGAGGTAGCCATTGCAGCTAGTACTCACCAAGTAAAGAAGATGAAGAAGGGACTTTGGTCTCC
TGAGGAAGACTCAAAGCTGATGCAATACATGTTAAGCAATGGACAAGGATGTTGGAGTGATGTTGCGAAAAACGCAGGA
CTTCAAAGATGTGGCAAAAGCTGCCGTCTTCGTTGGATCAACTATCTTCGTCCTGACCTCAAGCGTGGCGCTTTCTCTC
CTCAAGAAGAGGATCTCATCATTCGCTTTCATTCCATCCTCGGCAACAGGTGGTCTCAGATTGCAGCACGATTGCCTGG
TCGGACCGATAACGAGATCAAGAATTTCTGGAACTCAACAATAAAGAAAGGCTAAAGAAGATGTCCGATACCTCCAAC
TTAATCAACAACTCATCCTCATCACCCAACACAGGAAGCGATTCCTCTTCT

> SEQ ID NO: 6999 263180 7711_300326_1b
CTCTTTAACCCTACAATTTCCTAAGCTCTCAAGCCACAAAAAACCACAAACCGTTCTTCACCAATATATATATCTGATC
ATCATCAAAGTCCTTCTCTCTGCTCATACCACAAACCGTTCCATTCTTCCCCTAATCACAAAGTGATATTTACATAGAG

FIG. 2 continued

AAGATAGAGATGGGAAGACCACCATGCTGTGACAAGATTGGAGTGAAGAAAGGACCATGGACACCAGAGGAAGATATCA
TCTTGGTTTCTTACATCCAAGAACATGGTCCTGGAAACTGGAGATCTGTGCCTACTCACACAGGTTTGAGGAGATGTAG
CAAAAGCTGTAGATTG

> SEQ ID NO: 7000 263180 142470_300435_1b
CCGTCTCCCCGCTCGCGTCCTCGCTCTGCGCCTCCTCTCCGCGCGACGGTCCACCGCCGGACCAGCGACCTCGCCTCCT
CGCTCCGCCTCAATGCCGGACCAGCGCCGAGGCACTACCGCACTGCTGCCCACGGCCAGGCACGGTCCAGCCGCCTCTG
ACCGGCACCACAGCGCCTCCGCTGCTCGCAGGGACGCCGCCGCTACCCGCCCGGCTACCTCCGTTGCCGCCGCCAACAC
GCTAGTCTCCTCCTCCCTGATCGAGATCGAGTCGACACATACACCACCAACCACCGGCCGGCCGCCGCGCACCGGCGAG
CAGGATGGGGAGGCCGCCGTGCTGCGACAAGGTTGGGTGAAGAAGGGGCCATGGACGCCGGAGGAGGACCTGATGCTGG
CCTCCTACATCCAGGAGCACGGCTCCGGCAACTGGCGCGCCGTGCCGACCAACACCGGGGTGATGCGTTGCAGCAAGAG
CTGCCGGCTCCG

> SEQ ID NO: 7001 263181 1117667_301848_1b
CTTTTTGTTTCTGGGCTGTGCCTCGTTTTGTGCTTGGTTTGTTCTTGCCCCCCCCCCTTTGGGATAGCCATGGCCTTCG
TTGGCACCACTCAGAAGTGTAAGGCGTGCTCCAAGACTGTCTACCCTGTCGATCAGCTCACTGCTGATGGTGCCTCCTT
CCATCGTGCTTGCTTTCGATGCCACCATTGCAATGGAACCCTCAAGCTCAGTAACTACTCATCATTTGAGGGAACGCTC
TATTGCAAGCCTCATTTCAATCAGCTTTTCAAGTTGACAGGCAGCTTAGAAAAAAGCTTCGAGTCAGGTAAAGCACCGA
AACATCACGATAGGGGCATTGAAAATGATTCGAAGGCACCGACTAGTAGGGTCTCATCTCTCTTTGCGGGCACACAAGA
TAAATGTGCAGCATGTGGGAAAACTGTGTATCCATTANAGAAGGTGGGTGTAGAAGGGGTATCGTATCACAAGTCATGC
TTCAAGTGCTGCTATGGGGGGTGCACTATCAGCCCTTCCAACTATGTGGCTCACGAGGGAAGGCTATATTGCAAACATC
ATCATACACAGCTTA

> SEQ ID NO: 7002 263181 111161_300052_1b
TCTCTCTCTGACCCTCAAAAAACATTCTTCTTTCGCCATTAAACTCTTCATCTGCCATTACCTCGCCGCGTCTCAAAAC
TTGAACTTTAATCCACACATATAATCTTACTTCAGTTCTAGTAGATCAATAGCTGCAACATTTTGGTTCTTCTTCCAA
TAGTCAAATATCAGATCTAGCATATATTTTGTGTTGAACTTGAAGTTATCAGTGATGTCGTTTACGGGGACACAACAG
AAATGCAAGGCATGTGAAAAGACAGTTTACCCAGTTGAGCTTTTGTCAGCAGATGGGATTAGTTATCACAAATCTTGCT
TTAAATGCACCCATTGTAAAGGAACTCTCAAGCTGAGCAGTTACTCCTCAATGGAGGGTGTTCTGTATTGCAAGCCCCA
TTTTGAGCAGCTCTACAAGGAGTCTGGCAACTTCAACAAGAACTTCCATCAGCCCTGCGAAGTCAGCTGAGAAGTTAACT
CCAGAGCTGACAAGATCTCCTAGCAAAGCTTCCAGAATGTTTTCTGGAACACAGGAAAAATGTGCTACCTGCGGTAAAA
CGGCCTATCCACTTGAGAAGCTGACAGTGGAGAACCAAAGTTACCACAAGTCATGTTTCAAGTGTTCTCATGGCGGATG
CTCTTTAAATC

> SEQ ID NO: 7003 263181 103652_300362_1b
TGGTATCAACGCAGAGTGGCCATTACGGCCGGGGGGGGGATCTGAGATTATTCATATATGTAAATTATCTCAAATCTCA
ATTCCCAAATAATAGAACAAACATAAAAAATAAAAATAAAAATCATGTCTTTTTCAGGAACTCAAACAAAATGCAAGGC
ATGTGATAAAGCTGTGTATGCTGCAGAGCTTATATCTGCAAGTGGTGTTAATTATCATAATACTTGTTTCAGATGTAGC
CATTGCAATGGAAGACTTGCTTTGAGCAACTACTCTAGCCTAGATGGAGCTTTATTTTGCAAGCCACATTTTGAACAGC
TTCTCAAGGAGAAAGGAAGTGCCTCTTTTAAGTCCACTTCACTTGGGAGGAACAGTGACCTGAGCAGAAGCTCTAGCAA
ATTGTCCTCTCTATTTTCTGGCACTCAGGAAAAATGTGCTGCATGCAAGAAAACTGTGTACCCATTGGAAAAGGTGACA
GTAGATGGAGAATTTTACCACCAATCTTGCTTCAAGTGTGCACATGGTGGATGCAAACTTACAACTTCATCATATGCAG
CATTAGATGGACTTCTCTATTGTAAACCTCATTTCTCTCAATTATTCAA

> SEQ ID NO: 7004 263182 188938_300611_1b
CTTTGGACGACGAGGTCAGTGTCGCAGCGACGAACGCCGACGAGCTAGCTCTCTCTCTCGATCGATGGCCATGGCGGCG
GAGAGCATCGACGCGGAGCTGCGCCTCGGGCTGCCCGGCAGCGGCGGCGGTGACGGCGTGGCGGCGAAGAAGCGGCGGT
CGGCGTCGTCGACGGTGAAGAGCGAGGCCTCCGGCACGGCCTGCTGCGGCGGCGCCGGCGCCCGGGACGTCGAAGACGG
CGCCTCGCCGGCGTCCAAAGTGCAGGTGGTGGGGTGGCCGCCGGTGGGGTCGTACAGGAGGAGCACGTTCCAGTCTTCG
TCGTCGTCGACGGCGGCGGCGGCGAAGGGGAAGGGCGGCGGCGAGACGGATCAAGGGAGGAAGAATAAGGGAGGAGGGC
TGTACGTGAAGGTGAGCATGGACGGGGCGCCATACCTCCGCAAGGTCGACCTCCGGATGTACGGCGGCTACAGGGAGCT
CAGGGACGCTCTCGACGCGCTCTTCGGCTGCTTCTCCGCCGACGCCTCCGCCTCCGCCGCCCACTTCGCCGTCGCCTAT
GAGGACAAGGACGGCGACCTCATGCTCGCCGGCGACGTGCCCTGGGACATGTTCATCTCTTCTTGCAAGAAGCTGCGGA
TAATGCGAGGATCTGAGGCGAAATGATATATATCGAAATCG

> SEQ ID NO: 7005 263182 23810_300104_-1b
TTTTTTGATCAAAACACAGACAATCAAAAGAAACTGAACAATGTATTTCATCGTAAGAAAAAAAAGAGCAATTAACACC
AATCAATGTGTTAATCAAATATATAATCGATACCACTTATCCTTTTAATTTGACTTCAAGCTCTGCTCTTGCACTTCTC

FIG. 2 continued

CATCGCCCTCGGAGCGAGACCAATGGCATCCGATCCTTTCATGAGACGTAAACGCTTGCATGTATCGACGAACATTGGC
CAAGGAACGTCGCCGACGAGCATCCAATCACCGTCTTTGTCTTCATAAGAGGGAACATAGTCCCAGCTATTCACCAAAT
CCATCAATTTCCTCTCATTCATGAAGTCTATCATTCCTTCTTCTCCTCCATGTTTGCCCATGGTAAAAGAGCTGAACAT
GTTGGACAAAGCATTAGAAAAGCTCATCGTAGCTTTTATACATCCTCAAATCGATTTTCCTCAAGTACGGTGCTCCGTCC
ATTGATACCTTCACGAACGCCGCCGCCTCCGGGCCACCGCTTGATTTTTGGCAGGAAACCATCACGTTCTTCCGGTATG
ATCTCACCGGTGGCCATCCCACAACTTGTGCCTTGGCCGGAGGTTTGGCTGGATCTTTAGGACAAGCACTCTTCTCCTT
GGAATCAAAAGTCACGACGTCATGAGTCGTAGATCCTTCCTTGTTTGCAGGCTCATTATTCAGATTTAGCTTCAGATCA
ACCGTCTCTGAGAACCCTCTCTTGTTTCCGGTTACCGGAGCCACTGTATCTCCACCGGGAAGACCAAGACACAGCTCAG
TCTCCCTCAGATTCAGCTCGACACTGCCCATCATTATTAACCTTTCTTCTTCTTTGGGGGTCTTCTTCTTGGGAAGGTG
ATGAGG

> SEQ ID NO: 7006 263182 207424_300805_1b
TCCAACACCTCCTAATCACCACAAAGGGGTAAAAATCTCCAGTCTCCATAGAGAGAAAGAGAGAGAAGAGAAGGCAGCT
TGATTTGGGGCGAGGAGACGCGATAGCCGCGATAGGCTAAGCAGCTGGCAGCGGCGGCTGCTGCGATGGCCGGCGCCGA
CGTGGACGTCGGGACGGAGCTCCGGCTGGGGCTGCCCGGAGGTGGCGGCGGCGCCGCCGAGGCGGCGGCCAAGGCCGCG
AAGAGGGGCTTCGAGGAGACCATTGACCTGAAGCTGAAGCTGCCCACCGCCGGCATGGAGGAGGCCGCCGCCGGCAAGG
CGGAGGCGCCGGCCGCCGAGAAGGCCAAGAGGCCGGCGGAGGCCGCCGCCGCCGACGCCGAGAAGCCACCTGCTCCCAA
GGCGCAGGCAGTGGGTTGGCCACCAGTTCGGTCGTTCCGCAGGAACATCATGACCGTCCAGTCAGTGAAGAGCAAGAAG
GAAGAGGAAGCTGACAAGCAGCAGCAGCAGCCCGCTGCCAATGCCAGCGGCAGCAACAGCTCTGCCTTCGTGAAGGTCA
GCATGGACGGGCACCCTACCTGCGCAAGGTGGACCTGAAGATGTACAACAGCTA

> SEQ ID NO: 7007 263182 197257_300700_1b
AACTGGGAACAATATGAATGAGGTGAATGGCTCTGATGCTGTTACAACTTATGAAGACAAGGATGGTGACTGGATGCTT
GTTGGAGATGTCCCGTGGCAGATGTTTGTCGAGTCATGCAAACGCTTGAGGATCATGAAGGGTTCCGAAGCCATTGGTC
TTGCACCAAGAGCAAAGGACAAGTACAAGAACAAGAGCTGAAAATGTTGCAGTATTAAGATGCTGAGCATGGTGCCATA
AGAATGGTGTTCTTGCAGTGTGTTATGGTTTCCTTAGAAATATAAGGTTTTACTTGTTTAGCTGGATTAAAAGAAGGAA
GAGTTGTCATGTTTAATTTGTTTATGGACCAGAAGCAATAATCTATTTGTGTGTAGCTGGATTGGTGTTATGTGATGTC
CCCTACCGTGTGTCCCAAGATCTACTTGATGATTTTATTCCAATGTTGTTAATTTAG

> SEQ ID NO: 7008 263182 19035_300216_1b
CTCGAGCTTGCGGCCGCCTCAAGGCCACGGAGCTCTGTCTCGGCCTCCCCGGCGGCGCTGAAGCAGTTGAGAGTCCTGC
CAAATCGGCGGTGGGAAGCAAGAGAGGCTTCTCCGAAACCGTTGATCTCATGCTCAATCTTCAATCTAACAAAGAAGGC
TCCGTTGATCTCAAAAACGTTTCTGCTGTTCCCAAGGAGAAGACTACCCTTAAAGATCCTTCTAAGCCTCCTGCTAAAG
CACAAGTGGTGGGATGGCCACCTGTGAGGAACTACAGGAAGAACATGATGACTCAGCAGAAGACCAGTAGTGGTGCGGA
GGAGGCCAGCAGTGAGAAGGCCGGGAACTTTGGTGGAGGAGCAGCCGGAGCCGGCTTGGTGAAGGTCTCCATGGACGGT
GCTCCATATCTGAGGAAAGTTGACCTCAAGATGTACAAAAGCTACCAGGATCTTTCTGATGCATTGGCCAAAATGTTCA
GCTCCTTTACTATGGGAAACTATGGAGCACAAGGAATGATAGATTTCATGAACGAG

> SEQ ID NO: 7009 263182 116869_300515_1b
GCCAAGGGCGCCAAGCGCGGGTCTCCGACGAGGCGCGTCCGCTGCCGGCGTCCGCCGCCGCCGCCGCCGCCGCCGGGA
AGGGCAAGAAGGCGGCGGCCGGCGAGGAGGATGAGGATGCGGAGGAGGAGGACAAGAAGGTCGCCGCCGCGCCGCAGGC
GCCTGCTGCCAAGGCTCAGGTGGTTGGATGGCCACCAATTCGCAGCTACCGCAAGAACACGATGGCTACTAACCAGCTG
AAGAGCAGCAAGGAGGATGCTGAAGCGAAGCAGGGCCAGGGGTTCCTGTACGTCAAGGTCAGCATGGATGGTGCCCCCT
ACCTCAGGAAGGTGGACCTCAAGACCTACAAGAACTACAAGGACCTGTCAACTGCGCTTGAGAAGATGTTCATTGGCTT
CACAACTGGCAAGGATGGCTTATCTGAGAGCCGCAAGGATGGTGAATATGTGCTGACTTATGAAGACAAGGATGGAGAC
TGGATGCTTGTTGGCGATGTTCCATGGGAGATGTTTGCCAACTCTTGTCGCAGACTCAGGATCATGAAAGGTTCAGATG
CAATTGGACTTGCTCCAAGGGCAGTTGATAAGTCCAAAAACCGCAACTAGAATGGTTTCTGCCCCACAGTCAAAAGCAA
GATGGAGATCAAATGACTGTAGGGAATTTTCTGAAAACCAAGAAGTCTAACAGTTTTAAGATGGAGTCTGCCTTATGGT
CTGTACTACATGGTTTGCTATTGTGAAAGTTAAAAAAAAAAGGTGTCTTGTTATGTTAGCTTCGCCAAATCTCCTAGGG
ACATAAACTCTATTTGATTGTGCCCAAGTCTTTGTACGTGTGTTAATGCTATTCGTGTAAATGGTTTGGTACACCATGT
GCTACTGCTATGATTGAGCACCCCTACCTACT

> SEQ ID NO: 7010 263182 142453_300435_1b
CCCCGCTCCTCCCACTCTCGCACTTCTCGCATCGCAAAGGGGGCAGCAAAAGCAAAGCAAAGCCAAGCCAAGCTTGAA
GCTCCCCGCACTGAGCCAAGAAGCCTCCACCTCAATCCGAAAGAGATCTCGTGCGCGCACGGCGATGCGGTGAATCGGG
CATGGCGCCGCCACAGGAGCGGGACTACATCGGGCTGTCGCCGGCGGCGGCGGAGGCCGAGGAGGAGGAGGAGAAA
AAGAAGGCGCAGGCGCCGGCGGCGAAGGCACAGGTGGTAGGATGGCCACCAATCCGCAGCTACAGGAAGAACACCATGG
CGATGAGCCAGCCTGCTCTGAAAGGCAAAGACGACGGCGAGGCGAAGCAGGCTCCGGCATCCGGTTGCCTCTATGTCAA

FIG. 2 continued

```
GGTGAGCATGGATGGTGCTCCTTACCTCAGGAAGGTGGACCTCAAGATGTACAAGAACTACAAGGAGCTCTCTTTGGCT
CTGGAGAAGATGTTCAGCTGCTTTACCGTCGGTCATGGTGAATCAAATGGGAAGTCAGGGAGAGATGGATTATCTGATT
GCCGCCTGATGGATCTTAAAAATGGAACAGAACTTGTGCTCACTTATGAGGACAAGGATGAAGATTGGATGCTTGTTGG
TGATGTTCCGTGGCGAATGTTCACAGACAGCTGTAGGAGGCTGAGGATTATGAAGGGGTCAGATGCAGTGGGCCTTGCT
CCAAGAGCCACTGACAAGAGCAAAAATCGGAACTGAGCAAAAGATGAACCCAATATGAATATCCGACCCCTACAATCAC
ATCACTTTTACTTGTAAGGTCCCATTCTCTAAACCACAAGGGTAATGGTCTAAGTTGCGAGAAGGGGATTACTTATACC
TATGTGTCACCCTCTTTTTTTTTGGTTTTATTTGTACCAATTATGTTAGATTTTAAGCGTAAGTTGTGTAAGTTCCTG
TAAGTTGTCTACTTAACCTTGCTTGTAGTTTCTTCTGTAAATTGTTGTGCTGTATGATGCAAACTATTTTTGGGATTTT
ACTTG

> SEQ ID NO: 7011 263182 158978_200021_1b
CTCTCTCTAAAATTTTGCAAAGTTGTCATTTTGTTAACAAGAAGTGGAAGAAAAATAAGAAGAAGAGATAATTTCATGG
ATCTGAAAGAAACTGAGCTGTGTTTGGGGTTGCCTGGTGGTGGAGAAAGAGATAAAATCAAAGGGAAAAGAGGGTTTTC
TGAAACTGTTGATTTGAAACTTAATTTTCATACCAATGATTCTTCTTCTCCTATGGATCTCAAGGAGAAAATCAAGACT
CCTACTACTAAAGAAATTGCTAATTGTAACAAGGATTCAGTCAAGCCACCTGCCAAGGCACAAGTGGTGGGTTGGCCAC
CAGTGAGATCTTTTAGGAAAAATGTAATGGCACAGAAAAACAACACTGAAGAAACTGAAAAGAGTAATGCAACTGCTGC
TGCATTTGTGAAGGTTTGCATGGATGGCGCACCTTATCTACGTAAGGTAGATTTGAAGATGTACAAAAGTTACCAGCAA
CTTTCTGATGCTTTGGCCAAGATGTTCAGCTCTTTTACTATGGGAAATTATGGGGCCCAAGGAATGATAGATTTTATGA
ATGAAAGCAAGCTGATGGATCTTCTCAATAGTTCTGAATATGTACCCACCTATGAAGATAAAGATGGAGACTGGATGCT
CGTGGGGGATGTACCTTGGGAGATGTTTGTTGATTCATGCAAGCGTTTACGCATAATGAAAGGATCAGAAGCTATTGGA
CTTGCACCAAGAGCTATGGAGAAATGCAAGCGCAGGATTTGAAAACTCCATAGAAGGCTATAAACAATATGTTGAAGAA
GCAGCTTTTGTGATTGTTGTTTCCATTTGTCTGTATTTTATTTTATAGTATATAGTTTTTAATTAAAAGAAGTGATCT
TTAATTTGGACAGTTGTAATAGAGAAGAAGCAATAAACTCAAAAACCCCCCCT

> SEQ ID NO: 7012 263182 157445_301738_1b
TGTGGCACCAAGAGAGCTGCTGATCCTATTTCACCTCCCCGTTCTAATGTCAGTCAGGTTGTTGGATGGCCTCCTGTAA
GAACTTATAGGATGAATACCCTAGTTAACCAGACAAAATCACCACCCTCAGAAGAATTTTGCGGGACAATTGAGAAATG
CAGAAGCAAACATATTATCACTAATGCGAGTAGCAGCAAGAGCAACAGTTTTGCCAAGGAGAAAGGGCTGCTCATCAAG
ACTTCCATGTTTGTGGAGGTCAATATGGATGGAGTTGCAATTGGAAGGAAGGTAGATCTGAATGCTCATAGTAGCTATG
AGAACTTGGAACAGACTTTAGATGGGATGTTCTTAAAACCCAGCAACAGTTTGTGCAAGACCGTCAAATGCCAAGA
GCTAAGTGTCATGTCAGAAACGTCATCTTCAAGATTATTAGATGGATCATCAGAATTTGTGCTGACTTATGAAGACAAA
GAAGGAGACTGGATGCTTGTTGGAGATGTTCCATGGGAGATGTTTGTCAACACTGTGAAAAGGCTAAGAATCATGAGGA
CTTGTGAGGCTAACGGACTTGCTCCAAGAATCCCTCAGAAACAGGAGAGACAAAAAGGAAAACCAATCTAATTTGCTTT
GGTGCAAGGAAAATGCATGAAATCATAGTTTGGAAGGAAAAAAAAGTAAAACAGAAATAGGGAAGTGTTAAAAGAGTTA
ATGGATCTTGTTACTTTTTCATGGTTGCATTTTTGTTTTGCACCATTTTTCTCTTCATTTTTTCTTTTTTTTTCTTT
TTGGTTGTGTTTAGGTCTCAAGCCCCTCATATAGCTGATACACCAATGTTTTGCCCAAACCTACTTTTTCTCATAATGT
AAATATGGGAATCCAAATTTTCTC

> SEQ ID NO: 7013 263182 125528_300632_1b
CTCAACTTATTAAGAAAAATACCAAAGAAACAAACAAGAGAAGAAAAGAAAAAAGGATTTTTTATTAATTATATTTTGA
AGAAGGATTTTTAAATTAAAATCTTGACAGAATTCAGATGACGAGTGTGATAGGAGTTGAGTGTGACAAAATTCGATT
GGATTATGAAGCGGAGACGGAGCTTAGGCTAGGGTTGCCTATAGCCATTAATGGAAATGAAGGTGAAATGACGTCAAAG
AATAATGGGAAGAGAGTCTTTTCAGAAACTGTTGATTTGAAACTAAATCTTTCTTCAAAGAATTCTAGGGTTGATAACA
TTAAGGAGAAGAAAAATATTGCTCCCACTGATCCTGCTAAGCCACCAGCCAAGGCACAAGTTGTGGGTTGGCCACCAGT
GAGATCATTCAGAAAGAATGTACTAACCGTCCAAAAGAACAGCACCGGCAACGGCGAAAGCTCCGGCGGCGGCGCAGCC
TTTGTGAAAGTTAGCGTGGACGGAGCTCCATACTTACGTAAAGTGGACTTAAAGATGTACAAAAGCTACCAACAACTCT
CTGATGCCCTTGGCAAAATGTTCAGCTCTTTCACCATTGGAAATTGTGGGACTCATGGATTTAAGGATTTCATGAATGA
GAGCAAATTGATAGACCTCTTAAATGGCTCAGACTATGTACCTACTTACGAAGACAAGGATGGAGACTGGATGCTTGTT
GGAGATGTACCTTGGGAGATGTTTGTTGATTCATGCAAACGCTTGAGGATAATGAAAGGATCAGAGGCCATTGGACTAG
CACCAAGAGCAGTGGAGAAATGCAAGAACAGAAGCTGAAATTGATGATCCAATTACTTGTTCATTGTATTTTT

> SEQ ID NO: 7014 263182 271494_200034_1b
AGGCTCGGGCTCCCTGGGTCTCTCTCTCCCGAAAGGGGCATAGAGACTTGCCCTTTGGCCTCGAACGAGAAGCTGCTTT
TTCCCTTGCACCCTGCCAAAGATAGTGCTTTGGCCGTATCACAGAAAACAGTTGTTACCGGCAACAAACGTGGATTTTC
AGATGCTATGGATGGATTCTCAGAGGGAAAGTTTATGCCAAATTCAGGTGTGAAAGCAGGCGAAACAAAGGAGACCTCA
CATGTTCAACCACCAAAATTGAAAGAGGCAACTAATCAGAACACAGTTCCAGAGAGGACTTCTGCTGTGAATGAGGCTT
CAAACCGTGTAGGCAGCAGTGCCCCTGCTACCAAGGCACAGGTTGTTGGTTGGCCACCCATTCGATCTTTTAGAAAGAA
TACATTAGCCTCTACCTCAAAGAACAAGGAAGAGGTGGATGGAAAAGCTGGATCACCAGCTCTTTTCATTAAGGTCAGC
```

FIG. 2 continued

```
ATGGACGGTGCTCCTTATTTGAGGAAAGTGGACCTCAGAAACTATTCTGCATATCAGGAGCTCTCTTCTGCTCTCGAGA
AGATGTTTAGCTGTTTTACGATTGGTCAATATGGATCTCATGGAGCTCCTGGGAAGGAGATGTTAAGTGAGAGCAAATT
GAAGGATTTGCTTCATGGATCTGAATATGTACTCACTTATGAGGATAAAGATGGTGACTGGATGCTTGTTGGTGATGTC
CCTTGGGAGATGTTTATTGATACCTGTAAAAGGCTGAGAATCATGAAAGGTTCAGATGCCATTGGCCTGGCCCCAAGGG
CTATGGAAAAGTGTCGGAGCAGGAATTAGCCTATCTACACATGATTAAAGCTATCCATCCAGCAGTACTGGTATGAAAG
GAAATGGAGAAAGGGTGAAGAGACTCAAAAACTTGAATCCTTTTTAAAGCATTAACAATGGCTGGTTGTTGGTCCTGGA
CAGCACAGCATGGGTAGATGGATGGTTTGCTTAGTTAACATTGGCGTTTCTCATATTCGCGTAATTAATGTCGTCTTAA
GCTCTTTATCTTGTCTATTAAAAAACCCATTTGATATTTGAGTTTGTCTGCGAACTAATGTGTGGTGAACTGAGAGTTC
TTCTAGAGGTAATTTAGTATGTTAAGTGTATTGCTTGTTGAAGTTTCTTTAAGTGTGTACTTA

> SEQ ID NO: 7015 263182 6300_300336_1b
AACACATTGGCCACTACTTGTAAAAACAGTGACGAAGTTGATGGGAGGCCAGGTTCTGGGGCTCTCTTCGTGAAGGTCA
TTATGGATGGCGCTCCTTATCTGAGGAAAGTTGACCTGAGGAGCTACACTAACTACGGGGAGCTTTTTTCAGCCTTGGA
GAAAATGTTCACCACTTTCACTCTTGGTCAATGTGGATCTAATGGAGCTGCTGTGAAGGATATGCTTATTGAGACCAAG
CTCAAGGATCTTTTGAATGGAAAAGACTATGTGCTCACTTATGAGGATAAGGATGGTGACTGGAT

> SEQ ID NO: 7016 263182 50038_300166_1b
AATAATGAAGGGATCAGAAGCAATCGGACTTGCTCCAAGGGCATTAGAAAAGTGCAAGAACAGAAGTTGAGTTCTCGAC
GACATTTCGTGTTCTTACCTAAAAAAGGAAGAAAGCCTGTTTCGATCGGTTGGATATCTCGAACCGAGAAAGCTAAACC
GGCTCGAAACTATTGTTCCGAGCAAGGAGTTTGCTTATAATATTAATTAATAATAATATTAATATTGTGGTGTATTACA
TTTTAAAAAATTAAATCGTTTTTGTTATATGTATTATATACATATATTAATATGTATATTTAATTAGGTTGCATCTATT
T

> SEQ ID NO: 7017 263184 258963_301701_1b
GCAGCATGGGAAGAGGAAAGATAGAAATAAAGAGGATAGAGAACTCAACAAATCGACAAGTGACGTTTTGCAAAAGAAG
AAATGGACTTCTGAAGAAAGCCTATGAGCTTTCGGTCCTTTGCGATGCAGAAGTTGCGCTCATTGTTTTCTCCACTCGT
GGCCGTCTCTATGAATACGCCAATAACAACATAAGATCAACCATTGAGAGGTACAAGAAAGCTTGTTCTGATAGCACCA
ACACTAGCACTGTCCAAGAAATCAATGCCGCGTACTATCAACAAGAATCTGCTAAGCTGAGACAACAGATCCAAACGAT
TCAAAACTCCAACAGGAATCTGATGGGAGACTCTTTGAGTTCCTTAAGTGTCAAGGAACTAAAACAAGTTGAGAATCGC
CTTGAGAAAGCTATCTCTAGGATCAGGTCCAAGAAGCATGAGTTGCTTTTAGTTGAAATCGAAAACGCGCAGAAAAGGG
AGATTGAGCTTGACAATGAGAACATCTATCTAAGAACTAAGGTAGCAGAAGTGGAGAGGTATCAACAACACCATCATCA
AATGGTTAGTGGTTCAGAGATTAATGCAATTGAAGCTTTAGCCTCACGCAATTACTTTGCTCATAGCATTATGACTGCT
GGTTCTGGATCTGGTAATGGAGGTTCTTACTCTGATCCCGACAAGAAAATTCTTCATCTCGGATAATAA

> SEQ ID NO: 7018 263184 263328_301724_1b
GCAGCATGGCGAGAGGGAAGATCCAGATCAAGAGGATAGAGAACCAGACAAACAGACAAGTGACGTATTCAAAGAGAAG
AAATGGTTTATTCAAGAAAGCACATGAGCTCACGGTTTTGTGTGATGCTAGGGTTTCGATTATCATGTTCTCTAGCTCC
AACAAGCTTCATGAGTATATCAGCCCTAACACCACAACGAAGGAGATCGTAGATCTGTACCAAACTATTTCTGATGTCG
ATGTTTGGGCCACTCAATATGAGCGAATGCCAAGAAACCAAGAGGAAACTGTTGGAGACAAATAGAAATCTCCGGACTCA
GATCAAGCAGAGGCTAGGTGAGTGTTTGGACGAGCTTGACATTCAGGAGCTGCGTCGTCTTGAGGATGAAATGGAAAAC
ACTTTCAAACTCGTTCGCGAGCGCAAGTTCAAATCTCTTGGGAATCAGATCGAGACCACCAAGAAAAAGAACAAAAGTC
AACAAGACATACAAAAGAATCTCATACATGAGCTGGAACTAAGAGCTGAAGATCCTCACTATGGACTAGTAGACAATGG
AGGAGATTACGACTCAGTTCTTGGATACCAAATCGAAGGGTCACGTGCTTACGCTCTTCGTTTCCACCAGAACCATCAC
CACTATTACCCCAACCATGGCCTTCATGCACCC

> SEQ ID NO: 7019 263186 263203_301393_1b
TCACTTCTTCTCACCGAATCCCAAGCCATGGATCATGTTGTGGTCTCCGGAAGTAATGGAAGTAGGAGAGTTGGGTATG
TACTTAGCCCAATTTTTGCGCAGCAGCACTGAAAGCTTCAGTGCTGGTATTTCCGGATTGGCACTTTTGATGCGTTGGA
TCTCATCCCTCATGAAGCGGTTCGTATGCAGATGGGAGCCTCTGCTTCTTCTCAGGAGGTTTGACGACAAAGGGAGGTGA
GGGAGATGGGGCTGGTCGCTGGAGGTGGAGGAAGAGGAAGAAGAAGAGCTTCCCTTCTTATAGTCACTTCCACCAAAG
CTCTGCATCTGAAGGGTGAGGCTAACATGGCCTTGAAGAGGAGGAGTTGTGGTGAGAAACGAGAGGTTACCACAATGGC
CGCATTTCACCGTTACCGTGTCAAGCATTCTCTTCAATGGTATCCCAACCGCGAGGATGGTGTTGCAGATGCTACACCG
GACGTAGTAGAGATGTTCGGCTTGAGGGGAAGCCCTTGAAGCCGTCATGGTTGGTTTCTCTTCTAGGTTCATGCTGC

> SEQ ID NO: 7020 263186 134706_300418_1b
CATGGATCTTGCTCCTTTTCACGGGCACGCACTGTTCAAGATCACCAGGTACAGAACAGAGGATTTCAAGGTAATAACT
TTGGAAGCTATGACATAGCTTCCAGAAATCAGAGGACATCGACAGCCATGTACCCAATGCCAACCAGTCAGCAGCAAGT
GTCACCTATACGTCCCCCTGAGAAAAGACAGCGTGTCCCATCTGCATACAACAGATTCATCAAGGAGGAGATACAGAGG
```

FIG. 2 continued

ATTAAAACCAGCAATCCTGAGATTAGCCACAGGGAGGCATTCAGTGCTGCTGCAAAGAACTGGGCTCATCTTCCCCGGC
TCCATTTTGGCCTCAGCGTCGCCGACGGCGGCGGCGGCGGCGGCAGCAACTAATCGCGGCGGCGCGGCCTGCCGGCCGG
CCACCGATCGCCGGCGTGCACGCCGGCGCGCGGCGGCGGCCGGTCGAGAATGCGCGCGCAGGAGGGACGACGACGATAT
ATTATTATCGCGTGTGCCCCTCTCTCTTCGCCGCGTAATTAATTAATCAGTTAATTAATTACGTACGACCTACTGTGTT
ATGCTATCGATCCGTGTTAATTAATTACCTACGTATCTTGATTAATTAGTCTCGCATTATACGTACTATTA

> SEQ ID NO: 7021 263187 1098725_301486_1b
GAAGAAAGCAAAGGGCGGTGTGCAAAAAAAAATCGAAAATCGAATGCTAGGGATTGGCAGGGATCCCCGCAAGAAGGGG
CACTGGACCGCAGAGGAGGACCGCCGTTTAATCCACATGGTACGCTTATACGGGGAAGGGCAGTGGAACAAATTAGCCC
GCGCTGCAGGGTTGCCCCGATGTGGGAAGAGTTGCCGTTTGCGATGGGTGAATTACCTCCGGCCAGGTGTGAAACGAGG
ACAAATCACAGAGGACGAAGAACGGCTTATAATACAAATGCATGGTATCTATGGCAGAAGGTAAAAATCTTAATTTTAA
TAATAATCAATCCTCCCTTAGAAAGGAAAAAAGTCCACATAACACACAAC

> SEQ ID NO: 7022 263187 143787_200011_1b
ATTAAGAGAAAATATTTCTTAGAAAATTGGCTCAAAATGGGAAGGTCACCATGTTGTGAGAAAGCTCATACAAACAAAG
GAGCATGGACTAAAGAAGAAGATGAAAGGCTTATTGCTTATATTAAAACTCACGGTGAAGGTTGTTGGAGGTCTCTTCC
TAAAGCTGCTGGCCTTCTCAGATGTGGTAAAAGTTGTCGTCTTCGTTGGATTAATTACTTAAGACCTGATCTTAAACGC
GGTAATTTCACTGAAGAAGAAGATGAACTCATTATCAAACTCCATAGCCTTCTTGGTAACAAGTGGTCACTTATAGCTG
GAAGATTACCGGGAAGAACAGATAACGAAATAAAAAATTATTGGAATACACACATAAGAAGGAAACTATTAAGTCGCGG
TATTGATCCTACTACACACAGGCCCATAAACGAGCCTAACACAACTCCAAAAGTCACAACAATTTCTTTTACCGTTCCA
AATATTAAAGATGAAGAAGATCAAAAGATGATCAATGTTAAAGGTGAATTATCTGGACTTAGTCAAGAAGATGAAATTA
GCACAAACAGCAGCCAATTTCAAGAATTACAGTGTCCTGACTTAAATCTTGAGCTCAGAATTAGCCCTCCTTATCAGCA
AAATTACCAAAATGACCAAGATTTGAAACAGAGTCCAAGGTGTTTTGCATGCAGTTTGGGCATACAAAATAGTAAAGAT
TGCAATTGCAGTAAAAATAATATGGTTAATATTGCAAGTTATGATTTTTAGGGTTAAAGACTAAAGGTGTTTTGGACT
ATAGAACTTTGGAGACTAAGTGAATTACCTTTTGGCCCCTTGTGCATTTGGGTAAAAAAGGAAAAGAGAATTGAGAAAG
AGATATTAGTTTAAGTTCTTTCGAATTTTCTCTTATTTGTAAAATTGAAAGTATTATTATTATATTAAACTGAAAGCAG
TATAGCAGTGTACCTTACGACATTTATACTAGTAGT

> SEQ ID NO: 7023 263187 273750_200145_1b
AAAAATGGCCAATAGCAGTAATAGTTCTAAGAAAGATATGGATCGTGTTAAAGGTCCATGGAGCCCCGAAGAAGACGAG
CTTCTACAGCAGCTAGTTCATAAACATGGACCACGAAATTGGTCTCTTATTAGCAAATCCATACCTGGAAGATCCGGTA
AATCTTGCCGGTTAAGGTGGTGCAATCAGTTATCTCCACAAGTAGAGCATAGGGCTTTTACTCCCGAAGAAGATGAGAC
CATTATTCGTGCACATGCTCGGTTTGGGAATAAATGGGCTACTATAGCCCGACTTCTTAATGGACGAACCGATAACGCC
ATTAAGAACCACTGGAACTCTACCTTGAAGAGGAAGTCCTCCTCTCTTAGTGCTGATGAAGGTAACGAACTGGTGGACC
AAATCTTTCAAAATCAGCAGCCGCCGTTAAAGAGATCCGTTAGTGCCGGATCCGCCATGCCGGTGTCGGGTTTCCATTT
CAGTCCCGGTAGCCCGTCGGGTTCGGACAGTGATTCCAGCCTTCATGTCACCTCATCGTCTCAATCTCACTTATTCAAG
CCTGTCGCCAGAGCCGGCGGTGTATTTCCGCCGCCGTCTATAGACACGTCATCTCCTTCCGATGATCCGCCGACTTCCC
TTAGCCTTTCGCTTCCCGGAGTTGACTTGGCCGAGTTTTCTAATCGTTCGGCAGAGTCAACTCAGTCGAAG

> SEQ ID NO: 7024 263187 243424_301339_1b
TCTGCAAAGCCAAAGCTTCGCAAAGGATTGTGGTCTCCAGAGGAAGATGAGAAATTGGTGAGGTACATTACGAAGTATG
GACACAAATGCTGGAGCATTGTACCGAAGCAAGCTGGTCTCCAAAGATGTGGCAAGAGCTGCCGCTTGAGATGGATCAA
CTATCTCCGTCCCGACTTGAAAAGGGGCCACTTCACACAGCAGGAAGAAGACTTGATCATCAAGCTACATGCGATGCTG
GGAAACAGATGGGCTCAGATTGCTACACAGCTGCCCGGTCGTACAGACAACGAGATTAAAAACTTCTGGAACTCGTGCC
TGCGGAAGAAGCTGCGCCAAGTTGGTATCGACCCGCAGAGTCACAAACCAATTCCGCTCGGCATTGCTCAATCGCGGGA
TGATCCAGGAGAAGTGATCGAATTGTCTGTCCACAGCCAGGATCAGAGCTCCAATTTCCGGTTTTGTCAACCTCAACAT
CAACAACAACAATGCGGTAGCGACCAAGTCCAAGGCAAGACAACAGCAACGGCTTCACATTGTCGATGCTGCCAGTCA
CACTGAGTCCGTCTGGTGGACAACAGCCTCATCCTTACAGGAGCATCATCGGAATGAGCTTCGTCCCGGCGACAACAGG
ATTGAATTGTCACCACCAAGCTCAGCTGCAGCCGATCGACGACGACCAGACAGCTTTCTCGCCAGAGACGTCGTCAGTG
TTCCCCTTCTGGATGG

> SEQ ID NO: 7025 263191 11910_300283_1b
TGGTATCAACGCAAAGTGGCCATTACGGCCGGGGATAACAAGCTGGAACCAGAGAGGAAAGTTCAATTGGCTCAAGAAC
TTGGCCTACAACCAAGGCAAATTGCTATTTGGTTTCAAAACAGACGTGCTAGATACAAGACTAAACTACTTGAGAAAGA
CTATGATGTTCTCAAAGCTAGCTTTGATAAACTGAAGGATGATTATGACACCCTTTTCAAAGAGAGTGACAATTTGAGA
AATGAGGTTGATTTGCTGAAAGAAAAATTGCTTACGAGGGAGAAAGGGAAGGAAATGAAGCAGTAGATGCAGAAGAGG
GTGAAAAGGCAACTCCAAATGTTGTTACCTCAGAAGTGCCAAGCATACAAAAGGTAGTATG

FIG. 2 continued

> SEQ ID NO: 7026 263202 1100736_301463_1b
TAGCAAGGAAAGATGAATAGGGAGAAGCTAATGAAATGGCTAGTGCGGTACGCACAGGAGGAAAAGGAACAGTCAGGA
GGAAGAAGAAAGCCGTACACAAAACTGCAACAACAGACGACAAAAGATTGCAAAATACCTTGAAAAGGCTCGGAGTAAA
CACTATTCCTGGAATTGAGGAGGTTAACATTTTTAATGATGACACAGTGATCCATTTTGTCAATCCAAAAGTTCAAGCT
T

> SEQ ID NO: 7027 263202 1110951_301538_1b
GTCTCTCTCTCTCTCTTCTTTCGCTGGAGGGATTCAGGAACAAAGACAACGAAAACACAGCCTTCTCTCTCTCTCTCTG
TCTCAACCTTAGCCAGGGGAAGAAGCAGCTAAGCTAAGATGAATAGAGAGAAACTTATGAAAATGGCGAGTGCAGTCCG
CACAGGAGGGAAAGGAACAGTTAGGAGAAAGAAGAAAGCTGTACACAAAACAGTAGTGACAGATGACAAAAGGTTGCAA
AGTACATTGAAACGGCTCGGAGTGAATACTATTCCTGGAATCGAAGAAGTCAACATTTTTAAGGATGACACAGTAATCC
ATTTTGTAAACCCAAAAGTTCAAGCTTCCATAGCAGCAAACACTTGGGTTGTTAGTGGGTCATCTCAAACAAAACAACT
TCAAGACTTGCTGCCGGGCATAATCAACCAACTAGGAGTTGATAATTTGATGAACCTTAGGAAAATAGCAGAAGAATAT
CAGAAACAAGGAGGTGTGGGTGTTGAGGAGGATGACGAGGTTCCAGAGCTCGTTGGAGAAAATTTCGAAGAGGCTGCAA
AAGAAACAACCCAGATACCTGGAGGGCAATCCTAAAGGCGCTTGCGATCAATCTTTTACACACGGTTGATGCTTTGTAA
TGAATGGCCTTATAAACTTAAAACTTTCAGGTTTTATTACTTCTAACCCTAGT

> SEQ ID NO: 7028 263202 1117467_301891_1b
TCTCTCTCTCTCCTTTTTTCACTTGTGCTTCATTTTGTTGCTAAGCCTGTCGGAGCTTGAAGGCTACGACACTCGTTTC
AAGATGAATCGGGAGAAATTAATGAAAATGGCCAGTGCTGTCCGCACTGGAGGAAAAGGGACAGTGAGAAGGAAGAAGA
AGGCTGTTCACAAAACAGCAACTACAGATGACAAAAGGCTGCAAAATACTTTGAAAAGATTGGGAGTGAACACTATCCC
TGCCATTGAAGAAGTGAACATATTCAAGGATGATACTGTGATTCATTTTGTGAACCCTAAAGTTCAAGCATCAATTGCT
GCTAATACCTGGGTTGTCAGTGGATCATCACAAATCAAGAAGCTGCAAGATCTCCTTCCTGGTATCATCAACCAGCTTG
GACCTGACAACTTGATCAACTTGAAGAAAATTGCCGAGCAATATCAGCAGCAGGAAAATCAGCTGCACAGGAGGATGA
TGACGATGTTCCGGAGCTTGTAGAAGGAGAAAATTTTGAGGAAGCTTCGAAAGAAGCTAATTAGCCATAAGATATATAT
GGCTGGCATAACAGTTTTGTCTCCATTTAAGTAGTGGATAGCCAAATGGGGAGTACTTATCGAATCCTTATATAGCCCA
GGTGGTTGTCCTTCACTGATTCTTGAAAATGATATCATGGACAGT

> SEQ ID NO: 7029 263202 57510_300029_1b
GCCATTACGGCCGGGATCCTTCTGCTCTTCATTTTTGGGGTGCTGACTGCTGCCTAGGGTTTTAGTTCTCTATTCTTCA
CCAAGATGAATGTAGAAAAGCTACGGAAAATGGCCGGTTCGGTCAGGACTGGTGGTAAGGGAACCATGCGAAGAAAGAA
GAAGGCCGTTCACAAGACAACTACAACTGATGACAAGAGACTTCAAAGCACCCTAAAAAGAATAGGGGTGAATGCTATT
CCTGCTATTGAAGAGGTTAACATTTTTAAGGAGGATGGTAGTTATCCAATTCATGAACCCCAAAGTTCAAGCCTCTATTG
CTGCAAACACTTGGGTTGTTAGTGGTTCCCCTCAGACCAAGAAGTTGCAGGATATTCTTCCTCAAATTATTCACCAGTT
GGGCCCTGATAATTTGGAGAATTTGAAGAAGCTAGCCGGAGCAGTTCCAGAAGCAGGCACCTAGTGCCACCGGGGCGTCT
GAAGGTGCTGCTGCACCACAGGAGGATGATGATGATGAGGTGCCGGAACTCGTGGCTGGCCAAACCTTTGAAGCAGCCG
CTGCAGAGGAGGGTCACGCTTCCTAAAGTTTCAATTTAAATTTGTATCAACGCCTCCTCCGTCTCGACGTTTTGAGATC
CGTTTAATTTAGTTGAGTGTTCTATTTGATTTTGATTGTGACAACTAAAAAAAAATTCATCAAAATGGTTTTTGTAGT

> SEQ ID NO: 7030 263202 228555_301022_1b
GAATGTTGACAAGCTCAAGAAGATGGCAGGTGCTGTGCGCACCGGGGGGAAGGGTAGCGTGCGCAGAAAGAAGAAGGCA
GTCCATAAGACTACAACCACAGATGACAAAAGACTTCAGAGCACTCTGAAAAGAGTAGGAGTAAACACCATCCCTGGCA
TTGAAGAGGTTAACATTTTCAAGGATGATGTGGTTATTCAGTTTCTGAATCCTAAAGTGCAAGCTTCAATTGGTGCTAA
TACATGGGTTGTCAGTGGAACTCCACAAACAAAGAGTATGTTCTCCATGCCCTGTACTTCATTTCTAATGTAGCTTTTA
TCAATAAATCTTAAAACAACATTTCAGCCTGTCATTTGTTCTATTTTCCTGTGTAGAGTAGATAATAGCTACCCATAG
TATGTATATGTATGAAAGACCTAATTTGGACTTTCCATTTCTCAGAGATCTTTTTTTGCTCAAGCTAATATAATATTAG
CTCTATAAAGTTGTATTATTAACTTCTTGTGTTTACATAACAATAATTTTATGTTTCCCTTTTTTTGTACAGAGCTGCA
GGATCTGCTGCCATCAATTATCAACCAACTTGGTATGCCTCTCGTTGCAATTTACAAT

> SEQ ID NO: 7031 263202 236722_301261_1b
GTAACATTTTAGCAGCGAGCTGGTTTGGCGACGTCTAGGGTTCTTGGCATCTCGTCCCCGGTTGCCACACACTGCCGCA
AAGATGAATCGAGAGAAGCTCATGAAGATGGCTAGTGCTGTGCGCACCGGTGGAAAGGGCACAGTGAGGAGGAAGAAAA
AGGCTGTACATAAGACAACGACTACTGACGATAAGCGTCTCCAAAACACGCTTAAGAGGTTGGGGGTTAACACCATCCC
CGGAATCGAGGAGGTTAACATTTTCAAGGACGACATTGTTCTCCACTTTGTCAGTCCCAAAGTGCAAGCGTCCATAGCT
GCTAACACCTGGGTCGTGAGTGGACCCGTCCAGACAAAGAAGCTTACGGAATTACTGCCCGGCCATCATCGACCAGCTCG
GCTTTACGGGGCCGGATAACTTGGAGAACCTCAAGAAGATTGCGCAGCAATTCAAGCGGCAAGAGAGCGGCGGCGGGGG
CGGCGGCGGCGCAGCTCCGCTGAGCACAATCGAAGACGACGAGGATGTCCCCGATCTCGTTCCCGGGGAGACTTTCGAG
AAGCCCGCCGCTAATCCCCCCGAGGAGGCCGTGGCCACTGCGTGATTCCCGGCAGAGCATATTCCTGCTGTGTACTTGT

FIG. 2 continued

AGCCTCCTGGGCATATTCTCCTTTTTTTGTTGCAAGTCAATCCGTCCGTC

> SEQ ID NO: 7032 263202 254325_301632_1b
GGGTTTCGCTGGAGGGATTCAGGAACAAAGACAACGAAAACACAGCCTTCTCTCTCTCTCTCTGTCTCAACCTTAGCCA
GGGGAAGAAGCAGCTAAGCTAAGATGAATAGAGAGAAACTTATGAAAATGGCGAGTGCAGTCCGCACAGGAGGGAAAGG
AACAGTTAGGAGAAAGAAGAAAGCTGTACACAAAACAGTAGTGACAGATGACAAAAGGTTGCAAAGTACATTGAAACGG
CTCGGAGTGAATACTATTCCTGGAATCGAAGAAGTCAACATTTTTAAGGATGACACAGTAATCCATTTTGTAAACCCAA
AAGTTCAAGCTTCCATAGCAGCAAACACTTGGGTTGTTAGTGGGTCATCTCAAACAAAACAACTTCAAGACTTGCTGCC
GGGCATAATCAACCAACTAGGAGTTGATAATTTGATGAACCTTAGGAAAATAGCAGAAGAATATCAGAAACAAGGAGGT
GTGGGTGTAGAGGAGGATGACGAGGTTCCAGAGCTCGTTGGAGAAAATTTCGAAGAGGCTGCAAAAGAAACAACCCAGA
TACCTGGAGGGCAATCCTAAAGGCGCTTGCGATCAATCTTTTACACACGGTTGATGCTTTGTAATGAATGGCCTTATAA
ACTTAAAACTTTCAGGTTATATTACTTCTAACCCTAGTGTGGTTTTAACTTGCTTTTTGAAAAAATCCGTTCTAATGAA
T

> SEQ ID NO: 7033 263216 201991_300721_1b
CGTGCTGTATGTCCTCTCCTTCTTTCTTCCTTTCCAAATAAGCACTCCTCTTCTTCCTCCTCCTCCTCCGCCTCCT
CTTCTCATTCCCAACTCATCGATCCATCAGTAGCTAGCTAGCTAGCTAGCTAGCTAGCTGCATTGTCCGGCGAGAGAGA
TAACTGCTGCAGGGGGCGGCCATGGGGAGGGGCAAGATCGAGATCAAGCGGATCAAGCGGATCGAGAACGCGACCAACAGGCAGGTGA
CCTACTCGAAGCGCCGCACGGGGATCATGAAGAAGGCCAGGGAGCTCACCGTGCTCTGCGACGCCCAGGTCGCCATCAT
CATGTTCTCCTCCACCGGCAAGTACCACGAGTTCTGCAGCCCTTCCACCGACATCAAGGGGATCTTTGACCGCTACCAG
CAAGCCATCGGCACCAGCCTTTGGATCGAGCAGTATGAGAATATGCAGCGCACGCTGAGCCATCTCAAGGACATCAACC
GCAACCTGCGCACCGAGATCAGGCAAAGGATGGGAGAAGATCTGGACGGGCTGGAGTTCGACGAGCTGCGCGGTCTTGA
GCAAAATGTCGATGCCGGCCTCAAGGAGGTTCGCCACAGGAAGTATCATGTGATCAGCACACAGACTGAAACCTACAAG
AAAAA

> SEQ ID NO: 7034 263216 263364_301724_1b
GCAGATGGAGGAAGGTGGGAGTAGTCACGACGCAGAGAGTAGCAAGAAACTAGGGGGAGGGAAAATAGAGATAAAGAGG
ATAGAGAACACAACAAATCGTCAAGTTACTTTCTGCAAACGACGCAATGGTCTTCTCAAGAAAGCTTATGAACTCTCTG
TCTTGTGTGATGCCGAAGTTGCCCTCGTCATCTTCTCCACTCGTGGCCGTCTCTATGAGTACGCCAACAACAGTGTGAG
GGGTACAATTGAAAGGTACAAGAAAGCTTGTTCCGATGCCGTCAACCCTCCTTCCGTCACCGAAGCTAATACTCAGTAC
TATCGGCAAGAAGCCTCTAAGCTTCGGAGGCAGATTCGAGATATTCAGAATTCAAATAGGCATATTGTTGGGGAATCAC
TTGGTTCCTTGAACTTCAAGGAACTCAAAAAC

> SEQ ID NO: 7035 263216 263125_301722_1b
GCAGCATGGGAAGGGGTAGGGTTGAATTGAAGAGGATAGAGAACAAGATCAATAGACAAGTGACATTCTCGAAAAGAAG
AACTGGTCTTTTGAAGAAAGCTCAGGAGATCTCTGTTCTTTGTGATGCCGAGGTTTCCCTTATTGTCTTCTCCCATAAG
GGCAAATTGTTCGAGTACTCCTCTGAATCTTGCATGGAGAAGGTACTAGAACGCTACGAGAGGTATTCTTACGCCGAGA
GACAGCTGATTGCACCTGACTCTCACGTTAATGCACAGACGAACTGGTCAATGGAGTATAGCAGGCTTAAGGCCAAGAT
TGAGCTTTTGGAGAGAAACCAAAGGCATTATCTGGGAGAAGAGTTGGAACCAATGAGCCTCAAGGATCTCCAAAATCTG
GAGCAGCAGCTTGAGACTGCTCTTAAGCACATTCGCTCCAGAAAAATCAACTCATGAATGAGTCCCTCAACCACCTCC
AAAGAAAGGAGAAGGAGATACAGGAGGAAAACAGCATGCTTACCAAACAGATAAAGGAGAGGGAAAACATCCTAAGGAC
AAAAACAAACCCAATGTGAGCAGCTGAACCGCAGCGTCGACGATGTACCACAGCCACAACCATTTCAACACCCCCATCTT
TACATGATCGCTCATCAGACTTCTCCTTTCCTAAATATGG

> SEQ ID NO: 7036 263216 266261_200085_1b
CGGACGCGTGGGCGGACGGTGGGATGAAAGCCAAGAAAAAAAAATTAAATGGAAAGATTATAAAAATCCCTAGAGAGGA
TGATAGTGGATATGGAACGATACAAATATTATACTCCCTAGATAAAAAAGGAATCTAAAAGATTTCCAAATTGGGCAAA
TTAATGGGGCGTAAGAAAGTAGAAATCAAACGGATCGAAGACAAGAACAGCAGGCAAGTGACGTTCTCTAAACGGAGGA
AAGGACTCCTAAAGAAAGCCAAAGAACTCTCCATTCTTTGCGATGCTGATGTTGCCGTTATTGTATTCTCCAACCGTGG
CAGACTCTATGACTTCTCCAGCACTAACAGTATCACAGAGAATGTTCAACGGTACCACAGCCATGTGGAAGCAGAAAA
GATATCTCTGCAGGAGTTTTGGACACTGAGCACTCTAAATATTCAAGCTTCATAACAGTGGGAGAACTGTTACAAACGG
TAGAAAGGCAACTCGAGGAACCTGCTGTTGATGATCTCAGTGTGACTGACCTTGTCCATTTGGAAAACAACCTGCAAAC
TGCTCTAATGCAAGCCAGATCTAGCAAGATGCATATGATGATTGAATCTATCAAAAGTCATCGTGAGAAGGAAAAACTG
CTGAGTGAAGAAAACAACATCTGGAGAACCAGATAGCTACGATGAAGAACAAGAGAGAAGTGAAGAATGGGAT

> SEQ ID NO: 7037 263216 104804_300366_1b
TCTTAATAATTGGAATTTGTGAGAGTTTTCCGAAAGGTTTTGAAGTCGCCGGAAAATAGCAATATTTTCCATTGAAGCC
AATCAGATGGGTCGAGGAAAGATAGAGATAAAGAGGATAGAGAACAACACAAACAGGCAGGTGACATTTTGCAAGAGAA

FIG. 2 continued

```
GAAATGGACTCCTCAAAAAGGCCTATGAACTTTCAGTACTATGTGAAGCTGAGATTGCTCTTATTGTTTTCTCCAGCCG
TGGCCGCGTCTATGAGTACTCTAATAACAACATTAAGGCAACTATTGATCGGTACAAGAAGGCTACTTCAGAAACCTCT
AACGCTTGCACCACTCAAGAGCTCAATGCTCAGTTTTACCACAGGAATCGAAAAAGCTGCGCCAACAGATACAGATGA
TCCAGAATTCAAACAGGCATTTGGTTGGTGAAGGCTTAAGCTCTTTGAACGTAAGGGAGCTGAAGCAGTTGGAGAATAG
ACTTGAACGAGGCATTACTAGAATTAGGTCAAAAAAGCGTGAGATGATACTAGCAGAAACTGAGAACTTGCAGAAGAGG
GAAATTCAACTTGAACAAGAAAATGCATTCCTCAGATCAAAGATAGCTGAAAATGAGAGGCTTCAGGAACTAAGCATGA
TGCCTACTGGTGGGCAAGATTACAGTGCAATTC

> SEQ ID NO: 7038    263216  103762_300027_1b
TGGTATCAACGCAGAGTGGCCATTAGGCCGGGCAATTACCACAGTCAAAAAATTAGTAGATCCAGAGCGAAGTGAATTA
TAGAGAAGATGAATCGGCGTGAGTACCATAATTAGTAACATAGTCTAATTAAAAATTTAAGGCGAAAAAGGAGGAGAG
TCCAAACACTCGGAGGTACTTTATGAAATTCGTGAAAGTGATGGAGATGGAGGTACAAATCTTATATATTTAGACATGG
AACGATAATATTGAGAAAATTGGGGTTGGGGAGATTGAAGAAATTAAGTATGGGAAGGAGAAAGTGGAAATAAAGCGA
ATCGAAGACAGGAGTAGTAGGCAAGCGACTTTCTCGAAACGGAGAAACGGACTGATGAAGAAAGCCAAACAGCTCTCTA
TTCTCTGTGACGTCGATGTCGCCGTCATCGTCTTCTCTAGCCGTGGACGCCTCTTTGAATTCTCCAGTACTAACAGTTT
GACAGGAATAATTCAACGATATCAC

> SEQ ID NO: 7039    263216  135001_300421_1b
CAACAGGCAGGTGACGTTCGCGAAGCGGAGGAATGGGCTGCTCAAGAAGGCGTACGAGCTCTCCGTGCTCTGCGACGCC
GAGGTCGCCCTCATCATCTTCTCCAACCGCGGCAAGCTCTACGAGTTCTGCAGCGGCCAAAGCATGACCAGAACTTTGG
AAAGATACCAAAAATTGAGTTATGGTGGGCCAGATACTGCAATACAGAACAAGGAAAATGAGTTAGTGCAAAGCAGCCG
CAATGAGTACCTCAAACTGAAGGCACGGGTGGAAAATTTACAGAGGACCCAAAGGAATCTTCTTGGTGAAGATCTTGGG
ACACTTGGCATAAAAGAGCTAGAGCAGCTTGAGAAACAACTTGATTCATCCTTGAGGCACATTAGATCCACAAGGACAC
AGCATATGCTTGATCAGCTCACTGATCTCCAGAGGAGGGAACAAATGTTGTGTGAAGCAAATAAGTGCCTCAGAAGAAA
ACTGGAGGAGAGCAACCAGTTGCATGGACAAGTGTGGGAGCACGGCGCCACCCTACTCGGCTACG

> SEQ ID NO: 7040    263221  240045_301310_1b
AAAAGTTTCTAGGGCTTGCCTTCTTCCGGGGTTTGCGCCGGATTCGCGATAAAAAACCCTAGCGCTAGATCTTTAAGCT
GCTGCTGCTGCGGCGCGGCGCCACGCGGATTCGGGCATTCTCTCGCTGTGATTTCCCCCTCTTCGCGGCGGCGCTGGTA
ATCTTTGTGTCGATCATCCATGGCCGAAGGGACTGAGCCGGTGGATCTTGCCAAGCATCCGTCTGGAATCATACCGACG
TTACAGAACATTGTATCGACTGTGAACATGGATTGCAAATTGGATCTTAAAACCATTGCGCTACACGCGAGGAATGCCG
AGTACAACCCAAAGCGTTTTGCTGCCGTGATCATGAGAATAAGGGAGCCCAAGACAACAGCGCTAATCTTTGCGTCGGG
AAAGATGGTTTGCACTGGTGCCAAGAGCGAACAAAAATCAAAGCTTGCAGCAAGGAAGTATGCTCGGATCATACAAAAG
CTGGGATTTCCTG

> SEQ ID NO: 7041    263246  259006_301702_1b
GCAGCATGGGAAGGTCTCCTTGCTGTGAGAAGACCACACAAACAAAGGAGCTTGGACTAAGGAAGAAGACGATAAGCT
CATCTCTTACATCAAAGCTCACGGTGAAGGTTGTTGGCGTTCTCTTCCTAGATCCGCCGGTCTTCAACGTTGCGGAAAA
AGCTGTCGTCTCCGATGGATTAACTATCTCCGACCTGATCTCAAGAGGGGTAACTTCACCCTCGAAGAAGATGATCTCA
TCATCAAACTACATAGCCTTCTCGGTAACAAGTGGTCTCTTATTGCGACGAGATTACCAGGAAGAACAGATAACGAGAT
TAAGAATTACTGGAACACACATGTTAAGAGGAAGCTATTAAGAAAAGGGATTGATCCGGCGACTCATCGACCTATCAAC
GAGACCAAAACTTCTCAAGATTCGTCTGATTCTAGTAAAACAGAGGACCCTCTTGTCAAGATTCTCTCTTTTGGTCCTC
AGCTGGAGAAAATAGCAAATTTCGGGGACCAGAGAATTCAAAAGAGAGTTGAGTACTCAGTTGTTGAAGAAAGATGTCT
GGACTTGAATCTTGAGCTTAGGATCAGTCCACCATGGCAAGACAAGCTCCATGATGAGGAACCTAAGGTTTGGGAGA
GTGAAGTATAGGTGCAGTGCGTGCCGTTTTGGATTCGGGAACGGCAAGGAGTGTAGCTGTAATAATGTGAAATGTCAAA
CAGAGGACAGTAGTAGCAGCAGTTATTCTTCAACCGACATTAGTAGTAGCATTGGTTATGACTTCTTGGGTCTAAACAA
CACTAGGGTTTTGGATTTTAGCACTTTGGAAATGAAATGATAA

> SEQ ID NO: 7042    263246  13687_300248_1b
CCCACGCGTCCGTGATCATCACATGAATAAGTAGAAGATATCTCTTACCTTCTCCTTCTTCTAATAAGATCAGAGTTTT
GGTTCTTATTTCTTTGCTCTCAAAACAATGGGTAGATCACCGTGTTGTGACAAATTGGGTTTGAAGAAAGGACCTTGGA
CACCAGAGGAGGATCAGAAACTTTTTAGCTTATATTGAAGAACATGGTCATGGAAGTTGGCGTTCATTGCCTGAGAAAGC
TGGTCTCCATCGATGCGGAAAGAGTTGTAGACTAAGATGGACTAACTACCTAAGACCTGACATCAAAAGAGGCAAATTC
AACTTACAAGAAGAACAAACCATTA

> SEQ ID NO: 7043    263262  11995_300283_1b
TGGTATCAACGCAGAGTGGCCATTACGGCCGGGGAAGAGAGAGGGGAGAGAGAGAACAGAGTGGAATGGAATTATTCAA
ATATCTCTTCTTCTCTTGCCTTGGCCTCTTTTCAAGAATAATAATCTAAGATGACGTTCGCAGGAACAACCCAAAAGTG
```

FIG. 2 continued

CAGTGCTTGTGAGAAAACGGTGTATCTGGTGGATCGTCTTGCTGCTGATAATCGCATTTATCACAAGGCTTGCTTCAGG
TGCTACCATTGCAAAAGTACTCTCAAGGCCTCACTTTGATCAGCTTTTTAAGAGAACTGGAAGTTTGGACAAGAGTTTT
GAAGGAACTCCGAAACTCACAAAGCCAGAAAAACCAGTGGAGAACGAGAATGGTAGCGGGAGCAAAGTCTCAAATTTAT
TTGCAGGAACG

> SEQ ID NO: 7044 263262 1113906_301907_1b
GGTCTGGATCTACTTACTTGTGTTCCTTCAAGAGTGGAAAAATAATAATAATAATAATAATAAAAGCAAGAATGGCGT
TCTCCGGCACAACCCAGAAGTGCAAAGCGTGCGATAAGACGGTGTACCTGGTTGACCAGCTCACTGCAGACGGCGCTTC
CTTCCACAAAGCATGCTTCCGCTGCCACCACTGCAATGGCACCCTCAACCTCAACAGTTACTCATCGTATGAAGGAACA
CTCTATTGCAAGCCCCACTTCAATCAACTCTTTAAGATGACAGGAAGTTTGGAAAAGAGCTTTGACTCAGGAAAAACAA
CGAAGATTCGAGAGAGGGGAATCGATAATGAAGGGTATAGACCGCCGAGCAAGATCTCATCTCTCTTCTCAGGCACTCA
AGAAAAATGCTTGGCGTGCGGAAAGACTGTGTATCCAATTGAGAAGGTAAGCGTGGAGGGGCAATCATATCACAGGCCA
TGTTTCAAGTGTAGCCATGGGGGTGCACTATTAGCCCTTCCAATTATGTCGCCCACGAGGGGCGATTGTACTGCCGCC
ACCATCACTCGCAGCTTTTCAAGGAGAAGGGCAATTTCAGCCAACTGGTTAAGCTACCCCCTGCAAAAGTAGATGATGC
TCAAGATGCAACTATATTAAAGGAGTGAGTATAGATCATATCTATCCTCATTAAATGATCCCCTAC

> SEQ ID NO: 7045 263262 7827_300306_1b
CCCACGCGTCCGTGGCCTGTGACAAAACAGTTTATCTTGTCGACAAGTTAACCGCCGATAACCGGGTCTACCACAAAGC
TTGTTTCCGATGTCACCATTGCAAAGGAACTCTCAAGCTTAGCAATTACAACTCCTTTGAAGGAGTTCTCTACTGCAGA
CCACATTTCGATCAAAACTTCAAGAGAACTGGAAGTCTTCAAAAGCTTCGAAGGGACACCAAAGATTGGGAAACCTG
ATAGGCCTTTGGAGGGAGAGAGACCTGCTGGAACCAAAGTTTCGAATATGTTTGGTGGAACACGAGAGAAATGCGTTGG
TTGCGACAAAACCGTGTATCCAATTGAGAAGGTATCGGTGAATGGAACATTGTACCACAAGAGCTGCTTCAAGTGTACA
CAT

> SEQ ID NO: 7046 263263 107101_300263_1b
CGCTTTTGTCTGCCCCTCCTTACCCTTTCTTCAATATGGATGGTTCTCACTGGCCACAGGGCATAGGACTAGTGAAAGC
TGTGGAACCCTCAAAACCAGTGCCAGCAACAGAACGAAAGCCAAGACCACAAAAGGAACAAGCAATAAATTGTCCAAGA
TGCAATTCAACAAACACAAAATTCTGTTATTACAACAATTATAGCCTCTCTCAACCAAGGTATTTTTGCAAAACTTGTA
GAAGGTATTGGACTGAAGGTGGTTCTTTAAGAAATGTTCCTGTTGGTGGTGGTTCAAGAAAAAACAAAAGATCAAATTC
CTCTAATAATTCTTCATCCTCCACATCATCATATAGAAAATTCCAGATATCACAATTCCAACTTCTTCTCAAAACCCT
AAAATAATAAAACGAACCCCATGATCTCAATTTAACGTTTAACCCATCTACTACTAGCAATTTCAGTAATATTTCTGAGT
TTATGACCTTACCTTTAATGAACCCTAATTCCACAACTTCATTTATGTCCTCTATTATGCCACAGCTTTCGGATTCTAA
TAATATTATGTACTCATCATCTTCAACTAGGCTA

> SEQ ID NO: 7047 263327 7977_300286_1b
CAAGTCTTGCTTCAAATGCACTCACTGCAAAAGCAGGCTTCAGCTGAGTAGTTACTCATCAATGGAAGGTGTTTTGTAC
TGTAAGCCTCATTTTGAGCAGCTCTTTAAGGAGA

> SEQ ID NO: 7048 263329 138333_300723_1b
GGGGTGGTGTGTGGCTGATGCAGGTTTGCAGCGCAGCGGGAAGAGCTGCCGTCTCCGGTGGGTGAACTACCTGCATCCA
GAGCTGAAGCGAGGGAGGATGAGCCCCGAGGAGGAGAGGATGGTGGTGCAGCTCCACGCCAAGCTCGGCAACAGGTGGT
CTCGCATCGCCAAGAGCATTCCTGGCCGCACCGACAACGAGATCAAGAACTACTGGCGCACCCACCTGCGCAAGCTCAA
GCTCAAACAGCAAAAGCAGCAGCAGTCCGACGACCACCACAACGACAACGACGACGACGACGACCGCAACTCCTCCTCC
TCTTCGTCCTCCTCCAACAGCAACAGCAACCTGCAGCAGCAGCCGCAGCCAGAGGATGAGTCGTCGGCCAGTGGCAGCC
TGCAGGCCCAACATCATGAGGACCAGCACCAACTGTTCCTTCATCCTCTCTGGAACGACGACATCATCGTCGACGTCGA
CTGCTGGAGCAGCAGCACCAACGTCGTCGCTCCGCCGCCGATGCCCGCCTCGCCGCTCTGGGATATCGATGACGCCTTC
TTCTGCTCGGATTATTCGCTACCTCTCTGGGGATAGTATATATCATCCATCAGCCGCCAAGACGATGACGACTACATCA
ACTCGATCGATCGATGCCTCCTAATCATGTGGGAGTACTCAGCTCATCTCAATTGTTACATCCTTGCTACAGCTGCTAA
TTAC

> SEQ ID NO: 7049 263342 258924_301750_1b
GTTACTACAATAAAGCACCAGTATTAATGTAGTTGACAGTACTGCTCCAAATCTCTCTCCCTGAATCAATCTGATCAAC
ATGACCATGACCATGACCACTTCCTCCTCCCATGTTCATCTGCCAGGGGAATCCCCACAAAACCCTGTTTGGATCACTT
GTCGCCATCTGCTCCATACCGCCTCCACCATTTCCAAACGCATACCCCGTGTTCTCCATCTGATGGCTCGTGGTCCCAT
ACACGCCATCCATGGCCATTGGATACTGACAGCTTCCGAACCCTATATGT

> SEQ ID NO: 7050 263367 263243_301723_1b
GCAGCATGGGAAGAAGAAAAATCGAGATCAAGCGAATCGAGAACAAAAGCAGTCGACAAGTCACTTTCTCCAAACGACG

FIG. 2 continued

CAATGGTCTCATCGACAAAGCTCGACAACTTTCGATTCTCTGTGAATCCTCCGTCGCTGTTGTCGTCGTATCTGCCTCC
GGAAAACTCTATGACTCTTCCTCCGGTGACGAGATAGAAGCGCTGTTCAAGCCGGAGAAACCTCAATGTTTTGAACTCG
ATCTTGAAGAAAAAATTCAGAATTATCTTCCACACAAGGAGTTACTAGAAACAGTCCAAAGCAAGCTTGAAGAACCAAA
TGTCGATAATGTAAGTGTAGATTCTCTAATTTCTCTGGAGGAACAACTTGAGACTGCTCTGTCCGTAAGTAGAGCTAGG
AAGGCAGAACTGATGATGGAGTATATCGAGTCCCTTAAAGAAAAGGAGAAATTGCTGAGAGAAGAGAACCAGGTTCTGG
CTAGCCAGATGGGAAAGAATACGTTGCTGGCAACAGATGATGACAGAGGAA

> SEQ ID NO: 7051  263393  194634_300765_1b
CCCCCCCTGTACCTAAGAGAAACTTTTCAAATAAAGGAGGGTGACTTCCTGACCTTCGATGCTTTGAGGCAAGCTGCGC
AATGTGTTGGCCGTGTGATCCGTTCTAAAGCAGATTATGGAATGATGATATTTGCTGACAAGAGATACAGTCGCCATGA
TAAACGGTCTAAACTGCCTGGGTGGATACTGTCACACTTACATGATGCGCACCTAAATCTGAGCACTGATATGGCTTTG
CATATAGCTCGTGAGTTCCTACGGAGGATGGCGCAGCCTTACGATAAGACGGGGAGCGGCGGCAACAAGACTCTCTTAA
CCGAAAAGGATTTGCAAAATATGGCGCAGGACGCCATGGAGATGTGAAACCATGAAAGAAATTGAAAGAGAGGGAGGGG
GAGAGAGAGTTTTCTGCTGTACAATACATTCAAAATTGAGGTAGAAGTCACTAATGTACAAAAAAATTTTGGCTACTCA
TGTGAACCAGCATGAATTCGAGCTGCACGGTTCATGCTAAATTGCTAACAAATTGGTCCTTCCAAGCACATGTGATATT
ACTCTGCATCTGATATAGGTATGTACACCTTAAAGTCCTTCCGGATAAAAAAAAA

> SEQ ID NO: 7052  263534  263137_301722_1b
GCAGCATGAAAGAGAGACAACGTTGGAGTGGTGAAGAAGATGCATTGTTACGTGCTTACGTTAGACAGTTCGGTCCGAG
AGAATGGCATCTTGTGTCTGAGCGTATGAACAAACCTTTGAACCGTGACGCCAAGTCTTGTTTAGAGAGATGGAAGAAT
TATCTTAAGCCAGGGATCAAGAAAGGGTCTTTGCACAGAGGAAGAGCAGAGGCTTGTGATCCGTCTTCAGGAGAAACACG
GCAACAAGTGGAAGAAGATTGCTGCTGAGGTTCCCGGGAGGACGGCAAAGCGGTTAGGGAAGTGGTGGGAAGTGTTTAA
GGAGAAGCAACAGAGAGAAGAGAAAGAGGAGTAACAAGAGAGTTGAGCCTATTGACGAGAGTAAGTACGATCGGATTCTC
GAGAGTTTCGCTGAGAAGCTTGTCAAAGAGCGGTCTAACGTTGTCCCTGCTGCTGCCGCTGCTGCAACGGTTGTGATGG
CTAATTCGAATGGAGGGTTTTTACATTCTGAACAACAAGTTCAGCCTCCTAACCCAGTGATCCCGCCTTGGTTAGCTAC
TTCTAACAATGGGAACAATGTTGTTGCAAGGCCTCCCTCGGTAACTTTGACATTATCGCCTTCCACAGTGGCTGCAGCT
GCGCCTCAACCGCCAATCCCGTGGCTGCAGCAGCAACAGCCT

> SEQ ID NO: 7053  263534  108016_300057_1b
CTCACAAAAAGGTAAAGCTAGAGAGGCCATAATACTTCAAAAGAGAGAGAAGCAAGCATAAAATGAGCATAAAATGGCG
CAAGAGGAAGCAAGATAAGGTCCATGGAGTGAACAAGAAGATCTCCAACTAGCATTTTATGTGAATTTATTTGGAGATC
GACGATGGGATTTCTTGTCCGAAGTTTCAGGTTTTTAAAGGTTGGAGGGAGACTCATATAATAGGTAATATTTAGGACA
TGAAATCCTTTTTTCTTGGAGCAATTTCTAACCCTAATATCTGGATTACGGTTGAAAAGAACAAGATAGAGTTGCATGG
TACATCGGTTAAATTACTTGCATCCTGGTCTTAAACGTGGTAGGATGACACCTTGAGATTAACGACTTATTCTTGAACT
CCACTCTATATGGGGAA

> SEQ ID NO: 7054  263534  154654_301256_1b
TTATGTCCAAAGAGTTAAGTATCTCTAACCCTATTCTTCTCTCCATATTCTTTTTCTTTGTAATGTTCTTTTGGTTTAG
GTTTGAAAAGAACAGGAAAGAGTTGCAGGTTACGTTGGGTTAATTACTTGAATCCTCATCTTAAACGTGGCAAGATGAC
TCCTCAAGAAGAACGTCTTGTTCTTGAACTTCACTCTAAATGGGGAAATAGGTCTGCTATTTCTTTAGATTCTTTTTTT
TTTTTTTAATTTCTCATATTAAGTATCATGCTTAACTATTCACATTTATTTAACATTTACATAAAGGTCTAAATTTAC
CTCTATATTATATACGAAATATCAAAAAGGGAGCATTAGCATTACCGATAAAGTTATTGTCATGTGACTAAGAGGAGGT
CATGGATTCAAGCCGTGAAAACAGTCACTTGCAGAAATACAGGGTGAAGCTGCGTACAGTAGACCTTTGTAGACCGGCC
CTTCCTCTAACCCTGCATGTAACAGAAGCTTAGTATATCGGACTGGCCTCCTCGTTATATACGAAATATCATAATTTTA
CTCT

> SEQ ID NO: 7055  263534  316925_301428_1b
GCAGCATGGGAAAATCTTCAAGCTCGGAGGAAAGTGAAGTGAAGAAAGGGCCATGGACTCCGGAGGAAGACGAGAAGCT
CGTAGGCTATATTCAAACGCACGGTCCCGGCAAATGGCGTACCCTTCCCAAGAACGCCGGGTTAAAAAGATGCGGGAAG
AGTTGTAGATTGCGATGGACGAATTATCTAAGACCCGATATCAAGAGAGGAGAGTTCTCTCTTCAAGAGGAAGAAACCA
TCATTCAACTTCATCGTCTTCTTGGAAACAAATGGTCCGCAATTGCTATTCACTTACCAGGAAGAACAGATAATGAAAT
CAAAAACTATTGGAACACACATATTAAAAAGAAACTCTTACGAATGGGGATTGATCCGGTGACTCATTGTCCCCGCATT
AATCTTCTCCAGCTCTCTTCGTTTCTTACCTCATCATTGTTTAAATCTATGTCACAACCGATGAATACTCCATTTGATC
TCACTACTTCAAATATTAATCCTGATATCTTGAATCATCTCACTGCCTCTCTCAACAACGTTCAGACCGAATCATACCA
ACCAAACCAACAGCTTCAAAACGACCTAAACACTGACCAAACCACTTTCACCGGTTTGCTCAACTCAACACCACCCGTT
CAATGGCAAAACAATGGAGAATACTTGGGAGA

> SEQ ID NO: 7056  263534  6048_300315_1b

FIG. 2 continued

CCCACGCATCCACGCGTTCGGAGAAGTAAAATTTTCTATTGCAGAGAGAAAGAGAGTTAGAGAAAGAGAGAGAGAGATG
AAACTTGTGCAAGAAGAATACCGTAAAGGACCGTGGACAGAACAGGAGGACATCCTCTTGGTCAACTTTGTCCACTTGT
TCGGAGATCGAAGATGGGATTTTGTAGCGAAAGTTTCAGGTTTGAAGGTGGAGGGAGAAACATAAGAATAGGTTTAAAC
AGAACAGGAAAGAGTTGCAGGTTAAGGTGGGTTAATTACCTGCATCCTGGTCTCAAACGTGGTAAGATGACTCCACAAG
AAGAGCGTTTAGTCCTTGAGCTTCACGCCAAATGGGGAAACAGGTGGTCAAAAATTGCCCGGAAATTACCGGCGAGAAC
AGATAATG

> SEQ ID NO: 7057 263617 233854_301094_1b
GATAGATCTTGCCAGACCTTCTGTCAGGCGTGAATTGGCGGTGGACAGGACCACCAACGAGCGTTCTAAGTCTCCACTT
TGATGAGAACGGCAAGAAGAGATATCTACCTCGATTTGCAGCCATGGTCGAGAAGCTCTTCCAGCACAGATTGTCTAGG
ATCGAAGATGGAAGCTACTTCCGTCGAACAGGCGGCAACAGCGGCAGCAGCAGCGGGAGTAGCGGCAACGGATCATGTG
GAAGACGAGATCACGGATTGCTTCTTCCCAGGACCAAGTACAAAGGAGTACGAAAGCGGAGCTGGGGGAACTATGTATC
GGAGATCCGGGAGCCGAGCAAGCGGTCTCGAATCTGGCTCGGCTCGTTCGAGACGCCGGAGATGGCGGGCCGAGCTTAC
GACGCCGCCGTTCTGTGCCTGAGAGGTCCACACTCCAGCTTCAACTTCCCAGAGTTCGTCCCCGGCTTGCCTCGTCCTT
TACCGAC

> SEQ ID NO: 7058 263617 263039_301721_1b
GCAGCATGATAGCTTCAGAGAGTACCAAGAGCTGGGAAGCTAGCGCAGTCAGACAAGAGAATGAAGAAGAGAAGAAGAA
ACCGGTTAAAGATTCCGGTAAGCATCCGGTTTATCGGGGTGTCCGAAAGAGGAACTGGGGAAAATGGGTGTCCGAGATA
CGTGAACCTAGGAAAAAATCCCGAATATGGCTAGGAACGTTTCCTTCCCCGGAGATGGCGGCGCGTGCACACGACGTAG
CCGCTCTTAGCATCAAAGGAGCCTCCGCTATACTCAATTTCCCTGACCTAGCCGGCTCTTTCCCACGCCCTAGCTCGCT
TAGCCCTCGAGACATCCAGGTCGCGGCTCTCAAAGCCGCACACATGGAGACCTCACAGTCTTTTTCTTCTTCTTCTTCT
TTAACGTTTTCATCTTCACAGTCTTCTTCTTCGCTAGAGTCTCTCGTGTCTTCCTCCGCGACCGGCTCCGAGGAGCTAG
GGGAGATTGTAGAGCTCCCAAGTTTGGGATCGAGCTATGATGGTTTGACTCAGCTAGGTAACGAGTTTATATTCTCTGA
CTCCGCAGACTTATGGCCTTATCCACCGCAATGGTCAGAAGGTGATTACCAAATGATTCCTGCCTCGTTATCACAAGAT
TGGGATCTTCAAGGACTGTATAATTATTAA

> SEQ ID NO: 7059 263633 104834_300366_1b
TTTTTAGCTTTCTAAATGTATGTATAGACACAAGTAGATTTCTGAGCTTTGTCATCCCCAGTGAAGAAGACTGAGCTG
CATATTACCTCACAACCAACTATCCAAATGCAATCATGGTGGCAGGGTTATGGTGATAATACTATGCCTTTGGCAAGTG
AAAATACTGTTGCCCAGGGGAATGCTGACGGTGGCAATGAAGAAAAAGAAACAAATGCCCAAGCCACAGAATCTGGATC
AAAAGGAAATAACATGCAATACAAGAACCACCTCAAGCATATTACATCCACAACTGCCGCCATCATGGGTGAGCAGCAG
AAGGGACTCACAGGTCATTCAGCTATGTTGACATCATATCCATATCCAGATCTGCAGTATGGAGGAATGATGACTTATG
GAGCTCCTGTACACCCTCACTTATTTGAAATTCATCATGCCCGAATGCCGTTGCCTCTTGACATGGAAGAGGAACCGGT
CTACGTGAATGCAAAACAGTACCATGGAATTTTAAGGCGAAGACAGATAAGAGCTAAAGCAGAGCTGGAAAAGAAAGCT
ATTAAAGCGAGAAAGCCATATTTGCATGAATCTCGGCATCAACACGCTATGAGACGGGCAAGGGGAACTGGAGGCCGTT
TTCTGAATACTAAAAAGCTCAATGACATGGACTGTACGACAGAGGAGCCTAAAAAATATGGGCTACTATTCCAACTCA
CTC

> SEQ ID NO: 7060 263679 263038_301721_1b
GCAGCATGCATAGTTTGAATGAAACAGTAATTCCTGATGTTGATTACATGCAGTCTGATAGAGGGCATATGCATGCTGC
TGCCTCTGATTCCAGTGATCGATCAAAGGATAAGTTGGATCAAAAGACCCTTCGTAGGCTTGCTCAAAATCGTGAGGCA
GCAAGAAAAGCAGATTGAGGAAGAAGGCGTATGTTCAGCAGCTGGAGAATAGTCGATTAAAGCTGACTCAACTTGAGC
AGGAGCTGCAAAGAGCAAGACAGCAGGGAGTTTTCATCTCAAGTTCAGGAGACCAAGCTCATTCTACTGGTGGCAATGG
GGCTTTGGCATTTGATGCAGAACACTCAGATTGCTTGAAGAAAAGAACAGGCAAATGAACGAGCTGAGATCTGCCCTG
AATGCTCATGCAGGTGATACTGAGCTCCGGATAATTGTGGATGGAGTGATGGCTCACTATGAGGAGCTTTTCAGGATTA
AGAGCAATGCAGCTAAGAATGATGTCTTCCACTCGTTATCTGGAATGTGGAAAACACCAGCTGAGCGATGTTCTTGTG
GCTTGGCGGGTTCCGCTCATCCGAACTTCTCAAGCTCCTTGCGAATCAGCTAGAGCCCATGACAGAACGACAGGTAATG
GGCATCAATAGCTTGCAGCAGACGTCGCAGCAGGCAGAAGATGCTTTATCTCAAGGGATGGAGAGTTTACAGCAATCCC
TAGCTGATACTTTATCCAGTGGAACTCTTGGTTCCAGTTCATCGGATAATGTCGCGAGCTACATGGGTCAGATGGCCAT
GGCAATGGGGCAGTTAGGCACCCTCGAAGGATTCATACGCCAGGCTGATAACTTGAGGCTGCAAACACTACAACAGATG
CTTCGAGTATTAACAACACGTCAGTCAGCTCGTGCTCTTCTTGCTATACACGATTATTCATCTCGATTACGTGCTCTTA
GTTCCTTGTGGCTTGCCCAGCCAAGAGAGTGA

> SEQ ID NO: 7061 263679 125538_300632_1b
GGCACATATTGTCGGGCATGTGGAAAACTCCAGCAGAGAGATGCTTCTTGTGGCTGGGTGGATTCCGTTCGTCTGAACT
GCTCAAGCTCCTCATTAACCAGCTGGAGCCTTTAACCGAACAACAATTATTGGCAATCAACAACTTGCAACAGTCATCC
CAACAGGCTGAAGATGCTTTATCCCAAGGAATGGAGGCACTGCAGCAGTCTTTGGCTGAGACTTTGGCAGGGTCCCTTG

```
GACCTTCAAGTTCCTCGGGGAATGTTGCCAATTATATGGGTCAAATGGCCATGGCAATGGGGAAGCTCGGAACTCTTGA
GGGCTTCATACGACAGGCTGATAACCTTCGGCAACAGACATTGCAGCAAATGCATCGTATATTGACAACTCGCCAATCA
GCTCGTGCTCTTCTTGCGATCAGTGATTATTTCTCTCGGCTTCGAGCACTGAGCTCTCTCTGGCTTGCTCGTCCCCGGG
AGTAACAACTGCTTTCTTCTAATACTCTGCTATGAAATATTCTTGGTAACATTTGTAAATGAGAAACCTTCTTCTGGGA
GCACTACCGAGCTTTAACGGATATAATTATTAGATTTTCAGCCACCAGTTCAGTCCTTGTTCATTTCA
```

> SEQ ID NO: 7062 263679 137845_300705_1b
```
CCCACGCGTCCGCGGAACGCCCGTGGGAAAAGCTTCTTGTGAATCAGCTCGAGCCATTAACTGAGCAGCAGTTGTGGG
ACTATCGAACCTCCAACAGTCCTCTCAGCAGGCTGAAGATGCTCTATCACAGGGAATGGAAGCGTTGCAACAATCCTTG
GCAGATACGTTGGCCGGGTCCCTTGGTCCATCAGGATCTTCAGGGAACGTGGCAAACTACATGGGTCAAATGGCTATGG
CCATGGGCAAACTTGGGACCCTTGAGAATTTCCTCCGTCAGGCTGACAATTTGCGGCAGCAGACTTTACATCAAATGCA
GCGAATTCTGACAATCCGACAAGCTGCCCGTGCTCTACTTGCAATACATGATTACTTCTCACGTTTGCGTGCCCTGAGT
TCTCTCTGGCTTGCTAGGCCACGGGAGTAACAACACATAGGGTGCATCACCGTTAATGCTTCATGAACTGATCTGGGAG
GAACGGCGGAGCGGGACTGATTGCGGATGCATTTGCAGAAGATTGGTGGCTCAGTTCCTCGGCACAAGTTGTATTGAC
ACCTTTTGGTTTCATGTTGTACCTGATGTTGTACAAGTAGGGTAAAGCTTGTAACTTGTAAGTTATGGTGAATTTATGA
TTGGCAGATTGTA
```

> SEQ ID NO: 7063 263679 316951_301428_1b
```
GCAGCATGGAGATGATGAGCTCTTCTTCTTCTACTACTCAAGTTGTATCATTCAGAGACATGGGGATGTATGAACCATT
TCAACAGTTATCTGGTTGGGAGAGTCCTTTCAAATCAGATATCAACAATATTACTAGTAATCAGAATAACAATCAGAGT
TCTTCAACAACACTTGAGGTTGATGCTAGACCAGAAGCAGATGATAACAATAGAGTGAATTATACTTCTGTGTATAATA
ACTCTCTTGAAGCAGAACCGTCGAGTAATAATGATCAGGACGAAGACCGGATCAATGATAAGATGAAAGCGGCGTTTGGC
TCAGAACCGAGAAGCTGCTCGCAAAAGTCGTTTGAGAAAGAAGGCCCATGTTCAACAGTTAGAAGAAAGCCGGTTGAAG
TTGTCACAGCTCGAGCAGGAACTTGTAAGAGCTAGGCAGCAGGGATTATGCGTACGCAATTCTTCAGATACTAGTTATC
TAGGACCAGCTGGGAATATGAACTCAGGTATTGCTGCATTTGAGATGGAATACACACACTGGCTAGAAGAGCAAAACAG
GAGAGTTAGTGAGATTCGAACAGCACTCCAAGCTCATATAGGTGACATTGAGCTCAAAATGTTGGTAGATAGTTGCTTG
AACCACTACGCAAATCTCTTCCGCATGAAAGCTGATGCTGCAAAGGCTGATGTGTCCTTCTTGATGTCGGGAATG
```

> SEQ ID NO: 7064 2658 144810_200137_1b
```
TTTTGCAGATTATTTCTCAGTTTCTCTCCATATAAAGCAACATCTTTTTTACCTTCTTCGACTCTATATATTTATTTCA
GGCTCATAACCTAAGTATTGAAAACGCCTAAAACCCCTTCTTTCCCGCCCAGAGTAAACCTGCATGTGATCTTAATTTC
AAAGATGCAAATCTCTGTAGCGACTATAATCCCAAAAGTGCCTTCATTCACCACATTTTACCAGTTCACCTCAATTCCA
GCTCAACACGGTCTTAAAATGTCGAACCATGGTCTCTCAGTACAAACACACATCGATCTTCCAGCTCCATGTGCTGTCA
AAAGTTCCTCTACTGGCTTCTTATCTGCCATTGAGAGAGCAATAGAGGAAGAAGAGTATAGAAAAGCCCCGGCTGAGGT
GAACCGGCAAGGGATTAATATTGAAGGTTATTCAATTGAAGGACACTCGATTGGTGGGCATGAGACCTGTGTTATTGTG
CCGCAACTGAAAGCTGCTTTTGATATTGGGAGATGCCCATCAAAGGCTGTTCATCAAAACTTCTTGTTTATCACTCACG
CTCATCTTGACCACATTGGTGGACTTCCTATGTATATTGCCACTCGTGGCTTGTACGGCTTGAAACCTCCGACAGTCTT
CGTACCTCCTTCCATAAA
```

> SEQ ID NO: 7065 26650 213364_300852_1b
```
AAACACTCAAGTAACGACACCGCACACCGTCGTCAAAATGGTCAACATTCCCAAGACCCGTAACACCTACTGCAAGGGC
AAGGAGTGCCGCAAGCACACCCAGCACAAGGTCACTCAGTACAAGGCCGGCAAGGCTTCCCTGTTCGCCCAGGGTAAGA
GACGTTATGACCGGAAGCAGAGCGGTTATGGTGGTCAGACCAAGCCCGTCTTCCACAAGAAGGCCAAGACCACCAAGAA
GGTCGTCCTGCGGTTGGAGTGCGTCAAGTGCAAGACCAAGTTGCAGCTGGCCCTGAAGCGATGCAAGCACTTCGAGCTG
GGTGGTGACAAGAAGACAAAGGGTGCTGCTCTGGTGTTCTAAATGCGTTGTTCTCCGGTATTATCAATTCTTATGCTTC
TCCTGGCGGCATACGGGCATCATGGAACTTGGCGAAGGGGTACTGGTCCTTGTTTAGAGGACAGCGGCTCATAGGAAA
CGAATAAAAGATTTCTTCATGGACCGCATTCACGCGTTTTTACTGGGATATGCTTTACAGTGTTATGGTGGAAAAGC
CAACCTGGGACAATATTCCAATTCACGATGGCCTGGTGTCTCTGTGCTAGGCAACTTTAGTTCATGGAGGAGGCTCAGA
CTAGCTAACATGAAAAGAAGCCGAATTTCACCCTTTT
```

> SEQ ID NO: 7066 26650 229845_301047_1b
```
GCATTTCGGCGGCATCGTCTTCCGGCACAATGGTGAACGTTCCCAAGACGAAGAAATCCTTCTGCCAAGGGAAGAACTG
CCGCAAGCACACACTGCACAAGGTCACGCAGTACAAGAAGGGCAAGGACAGCCTCTACGTCCAAGGTAAGAGGCGTTAC
GACCGCAAGCAATCTGGCTATGGAGGTCAAACCAAGCCCGTGTTTCACAAGAAGGCTAAGACGACCAAGAAGATCGTGC
TCCGGCTCCAGTGCCAGACTTGCAAGCGCGTCTCTCAGCACCCACTAAAGCGGTGCAAGCACTTTGAAATCGGTGGTGA
CAAGAAGGGCAAGGGAACGAGCTTGTTCTAAGCACCGGGTCTTTTTTCCTACTTCGATGTTCTCAAATTTTCAAGCAA
TATCATAACTTCGATACTATACTAA
```

FIG. 2 continued

> SEQ ID NO: 7067 26650 1100285_301458_1b
GAAACCTATGGTAAGGGCGTAGGCATTGACAGACGTCTGGTTAGAGGTAGCTGTTCGACTTGCAGTCATGGTGAACGTT
CCAAAAACAAAGAAAAGCTTTTGCCAGGGCAAGGACTGCAAGAAGCATACCTTGCACAAAGTTACTCAGTACAAGAAGG
GCAAGGACAGTCTCTACGTGCAAGGTAAGAGGCGTTATGACCGGAAGCAATCTGGATATGGAGGTCAAACCAAGCCAGT
CTTTCACAAGAAGGCTAAAACTACCAAAAAGATTGTACTGAAGCTTCAATGCCAGGGTTGCAAACGTGTAACTCAGCAT
CCTATCAAGAGGTGCAAGCATTTTGAAATTGGTGGTGACAAGAAGGGAAAGGGAACATCTCTGTTCTGAGCTGTTGCAT
TGCTTTTGTCTTCTTTTTAGTCTTGATCTTTATCTCGATGTAGTCCAATTAAAGCTTAATTTAAATACCCCAACGGAT
CCTATCTGGTTCTGTAGTTGCTTCAGATATCAGATTAATGACAATGTAGTTTATTTGAGAATTAATATCAACTCTTACC
ATTATTATGAATCGGATTCCCCACTGG

> SEQ ID NO: 7068 26650 127233_300469_1b
CATTTCTGTCTCACTCTTCGCCGGCGACAATGGTGAACGTTCCTAAGACAAAGAAGACCTACTGTAAGTCAAAGGAGTG
TAAGAAACACACTTTGCATAAGGTCACACAATACAAGAAGGGCAAAGATAGCTTAGCTGCTCAAGGAAAGCGTCGTTAT
GATCGCAAGCAGTCTGGATACGGGGGTCAAACAAAGCCCGTCTTCCACAAAAAGGCAAAAACGACAAAAAAGATTGTGT
TGAGATTGCAATGCCAGGGGTGCAAACATGTTTCGCAGCACCCAATCAAGAGGTGCAAGCATTTTGAGATTGGCGGGGA
CAAGAAAGGAAAGGGAACCTCTCTTTTCTAGATTGCCTGTGAAGCGGAATGTAACAGATCTTTCACCCCCTTCTGTTCT
GTTACACTGTTCAGATACTTTGGTAATATTTGATGTAGTGCAGGAGTTTCTGTTATTGAATCATGTGATCAATTTTGTG
ATGTCTTAGAGAATCTGATAAGGAGAGAAAATGAATATTTTAAGTTTTTGGTTTAGTATCTTGTTGCCTAAATCTATTG
CAAGAAAGTTATGCTGCTCTACCTCACTTGGCTGCATCAATTTGTATGTTGGGATTATATTATAGGTTGTTTTCTCCAA
ACTAGTGTATATTGAAACACT

> SEQ ID NO: 7069 26650 1117668_301848_1b
ACCTCACCGCCCTTCGACGACCGAAATACCGTCAAAATGGTCAACATCCCGAAGACGCGCAGGACCTACTGCAAGGGCA
AGGAATGCAAGAAGCACACCCAGCACAAGGTCACCCAGTACAAGGCTGGCAAGGCCTCCCTCTTCGCCCAGGGTAAGCG
TCGTTACGACCGTAAGCAGTCCGGTTACGGTGGTCAGACCAAGCCCGTCTTCCACAAGAAGGCCAAGACCACCAAGAAG
GTCGTCCTCAGATTAGAATGCACTTCGTGCAAGACCAAGGCGCAGCTCGCTCTCAAGCGCTGCAAGCACTTCGAGCTTG
GTGGTGACAAGAAGACCAAGGGTGCCGCTCTTGTCTTCTAGATGGGTGCATAACGGTTATGGCGCTAGGGATGATGATG
GAGCGGTCTGTGCATGTAGCCTCCTCGAGTACATGATCCTTGAGGGCTCGGAATCAAAGCTTCGTTTCTCCG

> SEQ ID NO: 7070 26650 158770_200049_1b
TAATCCTCGACTCGCGACAATGGTGAACGTACCTAAGACAAAGAAGACCTACTGCAAATCCAAGGAGTGCAAAAAGCAC
ACCTTGCATAAGGTCACACAATACAAGAAAGGAAAAGATAGTCTTGCTGCCCAGGGGAAGCGTCGTTATGATCGTAAGC
AGTCAGGTTATGGTGGACAGACAAAGCCCGTCTTCCACAAAAAGGCAAAAACTACAAAGAAGATTGTCTTAAGGTTGCA
ATGCCAGGGGTGCAAGCATGTCTCTCAGCACCCAATCAAGAGGTGCAAGCATTTTGAGATTGGTGGGGACAAGAAAGGA
AAGGGAACCTCTCTTTTCTAGATTGCCTGTGATGCAAAATTTGATAGTTTTCTGTTATACGTTTTTAGATATCTTTTTT
TGTTG

> SEQ ID NO: 7071 26650 1100466_301460_1b
TTTGTCATACTTTCTGATTGGGAGGGGAGGGTGAGCTCTCTTCTGAAGCAGCCATGGTGAATGTTCCGAAGACCAAGAA
GAGCTTTTGCCAAGGCAAGGATTGTAGGAAGCATACGCTTCACAAGGTCACTCAGTACAAAAAGGGGAAGGATAGCTTG
TATGTGCAAGGAAAGAGGCGTTACGACCGAAAACAGTCGGGATATGGAGGTCAAACTAAGCCTGTCTTCCATAAGAAGG
CAAAGACCACTAAGAAGATTGTCCTTAAGCTGCAATGTCAGTCTTGCAAGCGCGTGATTCAACATCCCATCAAGAGATG
CAAGCACTTTGAAATTGGAGGTGACAAGAAGGGAAAGGGAACTTCCCTGTTCTAAATCTCATCATTTTTCTATCAGTTT
TGGCTTGGGATCCCTGATCTTATTGTGTTGGAGCTCTTCCGTATTCCATATAAGAACTAATTCTTAGTCTTTCTGAGCT
CTTACTATATGAACTTATTATAGTCCAATGCACAATTATGGCTACTCTTACTATATGAACTTATTATCATCCGATGCAC
AATTATGACTACTCTTACTATATGAACTTATAATCCGATGCACAATTATGGCCAATTTTAAAAGCCGAAAA

> SEQ ID NO: 7072 27245 132511_300447_1b
GAAACCCCACTACTGCTGTTGCTGAGGAGAAGATAAGTGCACTGGAGGGTGCTGAATCAACCTTGTTAATGGCATCTGG
AATGTGTGCTAGTACTGTAATGTTGTTGGCATTAGTTCCTGCTGGTGGACATATTGTAACAACAACTGATTGCTACAGA
AAGACCCGGATATTTATTGAGACGATACTGCCTAAAATGGGAATCACGGCTACAGTCATTGATCCAGCTGATATTGGAG
CTCTAGAGTCAGTCCTAAAACAGAAGAAAGTTACTCTTTTCTTTACCGAGTCTCCAACAAATCCATTCCTGAGATGTGT
TGACATTGAGCTGGTATCAAAGATTTGCCATGAAAATGGAGCATTGGTTTGCATAGATGGGACGTTTGCAACTCCTCTT
AACCAAAAGGCCCTTGCTCTAGGGGCTGACCTCGTTGTGCACTCTGCAACAAAATATATTGGTGGCCACAATGATGTTC
TTGCTGGTTGCATTAGTGGACCTGAAAAGTTAGTTTCAGTAGTTCGTAACTTGCATCATATCCTGGGTGGTGCTATCAA
TCCGAATGCTGCGTATTTGATCATCAGAGGTATGAAGACGTCTTCGTGTACAGCAACAGAACTCAACTGCACAA
AGGATAGCCGAAATTTTAGAGGCTCATCCCAAGGTGAGATGTGTCTATTATCCAGGCTTGCCGAGTCATCCAGAACATC
AGCTGGCAAAGATACAAATGGCTGGTTTTGGTGGTGTGGTCAGCTTTGAGGTTGATGGGGATCTGCTGACTACTGCAAA

FIG. 2 continued

ATTCATTGATGCTCTGAAAATTCCTTATATTGCTCCATCATTTGGAGGCTGCGAGAGCATTGTGGATCAACCAGCAATA
ATGTCTTACTGGGATCTTAGCCAGTCAGACAGAGCAAAGTATGGGATCTTGGACAACTTGGTTCGATTCAGCTTTGGAG
TGGAAGACTTTGAGGATTTGAAAGCTGATATTCTTCAGGCTCTGGAGGCCATATAAGACCGTCTT

> SEQ ID NO: 7073 27245 187538_300678_1b
ATTGGAGGCTGCATCAGTGGCAGAGATGAGCTAGTTTCCAAAGTCCGCATCTATCACCATGTAGTTGGTGGTGTTCTAA
ATCCGAATGCTGCCTACTTGATTCTTCGAGGCATGAAGACACTGCATCTCCGTGTACAATGTCAGAATAATACTGCAAT
GCGGATGGCCCAATTTTTAGAGGAACATCCAAAGATTGCACGTGTCTACTATCCTGGTCTGCCAAGTCACCCAGAACAT
CACATTGCCAAGAGTCAGATGACCGGCTTTGGTGGTGTCGTTAGTTTTGAGGTTTCTGGAGACTTTGATGCTACTAGGA
GATTTATTGATTCTGTTAAGATACCCTATCATGCCCCATCATTTGGGGGCTGTGAGAGCATTATTGATCAGCCTGCCAT
CATGTCTTACTGGGATTCAAAGGAGCAGAGAGAAATCTATGGAATCAAGGACAACTTGATCAGGTTCAGCATTGGAGTG
GAGGATTTTGAGGATTTGAAGAATGACGTTGTTCAGGCGCTTGACAAGATCTAAGCACCTGATTGCATCCTCATCATGA
GAGTTCATCTATCTGATCTTGTTTGCCTCTGCATCACGTGGAGAACTTTGATA

> SEQ ID NO: 7074 27429 184264_300666_1b
GAATTCAGGGGCCATCTTGAGAGTAGTTAGGAACTTATTTTTGACACTATTACTAGTACTAATTGTTAGTGTTGATGCC
AAAATCCCTGGAGTTTATACAGGTGGTGATTGGCAAAGTGCTCATGCAACTTTCTATGGTGGAAGTGATGCCTCTGGAA
CCATGGGTGGAGCATGTGGATATGGAAACTTATACAGCCAAGGGTATGGTGTAAACACAGCAGCGTTAAGTACTGCTTT
GTTTAACAGTGGTTTAAGTTGTGGTGCTTGTTTTGAACTCAAGTGCGCTGATGATCCTAAATGGTGTCATTCCGGTAGT
CCTTCCATCTTAATTACAGCAACCAATTTCTGTCCACCTAATTTTGCTCAAGCTAGTGACGATGGTGGTTGGTGTAATC
CTCCTCGGCCTCATTTTGATCTTGCCATGCCTATGTTTCTCAAAATCGCCGAATACCGTGCCGGGATCGTTCCGGTTGC
TTACCGCCGGGTACCATGCCGAAAGAGCGGAGGAATAAGGTTCACAATAGACGGATTCCGTTACTTCAATTTGGTTTTG
ATATCAAACGTCGCCGG

> SEQ ID NO: 7075 27429 105159_300371_1b
AAATGGGTTCAATGGGAGTCATCACTTCCATTCTTAGTCGAATTTTCCTTGTTTCTCTTGTTGAAGCAAGAATCCCTGG
TGTTTATTCTGGTGGTTCTTGGCAGACTGCTCATGCTACATTTTATGGTGGCAGTGATGCTTCCGGAACAATGGGTGGT
GCATGTGGTTACGGCAATTTGTACAGCCAAGGGTACGGAGTGAACAATGCAGCGTTGAGCACAGCTTTGTTTAACAATG
GGTTAAGTTGTGGAGCTTGCTTTGAGATTAAATGCACAAATGATCCCAATTGGAAGTGGTGTCTCCCCGGAAGCCCATC
CATTTTAATCACTGCCACCAATTTCTGTCCACCAAACTACGCAAAGCCCAACGACAATGGTGGATGGTGCAATCCTCCA
CGTTCTCACTTTGATCTTGCCATGCCTATGTTCCTCAAGATTGCCGAGTACCGTGCTGGCATTGTTCCCGTTACTTATC
GCCGGATACCATGCCGAAAGCGAGGAGGAATGAGATTCACAATCAATGGCTTCCGTTACTTCAACTTGGTATTGATCAC
AAACGTGGCGGGGGCAGGAGACATAATAAAGGTGTGGGTGAAAGGGTCAAAGACTAACTGGATACCCCTGAGTCGCAAT
TGGGGTCAAAATTGGCAATCAAACGCTCTCTTGACAGCTCAATCCCTCTCTTTCAGAGTCAAAGCCAGTGACCATCGCT
CTTCTACTTCATGGAATATTGTCCCTTCTCATTGGCAATTTGGCCAGACTTTCACTGGAAAGAATTTCAAAGTCTAATA
TCATTCAAAACAAACATAATTGAAGATTTGAC

> SEQ ID NO: 7076 27429 145926_200138_1b
AAAGAATATATTCCTCCTTCTCAAAAGGAGCTAAAATCCATGGCCTCTTTTCACCATAGATGGAGCTTGATATTCTTCT
TCGTTGACGCGGCACTAGCACTCATCAATCAAGCAAACGCCGGGGGATATTCCACCCCTAGCGTCGCCTTTACAGCGAC
CCCTTGGAAACTCGCTCATGCCACGTTTTATGGCGATGAGACTGCACAAGAGACAATGGGTGGAGCTTGTGGATATGGG
AATTTATTCAATTCAGGTTATGGAACAGATACAGCAGCATTGAGTTCAGTGTTATATAGCAATGGATATTCATGTGGAC
AATGCTACCAAATAAAATGTACACAATCAGAAGATTGCTACTCAACCATTGTCACAGTCACTGCAACCAATCTCTGCCC
ACCAAATTGGTCACAAGACTCAGATCAGGTGGTTGGTGCAATCCACCTCGTATACATTTTGACATGGCTAAACCTGCT
TTCATGAAAATTGCCCAATGGAAAGCTGGCA

> SEQ ID NO: 7077 27429 144633_200136_1b
ATTTTCTTAACAATCTTGTTATTTCTTCTGCTATTGGCAACCACTAAGAAAAATGGCTAACAATGGCATTCTAGCACTG
GGATTCATAATTGGTTTGTGCAACCTTTTCTTAAGTGCAAATGGTTTTTCAGCAGATTCTGGATGGTCAAGTGCTCATG
CCACATTTTATGGTGGAGCTGATGCTTCTGGCACGATGGGGGGTGCTTGTGGATATGGAAACTTGTATTCAACAGGGTA
TGGAACAAGGACAGCTGCATTGAGCACTGCATTGTTCAATGATGGAGGATCCTGTGGCCAATGCTACAAGATCATATGT
GATTATAAGGCAGACCCCGCATGGTGCAAGAAGGGAGTATCTGTTACAATTACAGCTACAAATTTTTGCCCACCAAATT
ACAATCTTCCTAGTAACAATGGAGGCTGGTGTAACCCTCCTCGTCCCCATTTTGACATGGCTCAACCTGCTTGGGAAAA
GATTGGTATTTACAAAGGAGGCATTGTTCCTGTGCTCTACAAAAGGGTTCCTTGCAAGAAGAAACATGGAGTTAGATTC
ACAATCAATGGAAGGGACTATTTTGAACTAGTCTTGGTAAGCAATGTAGCAGGGGCAGGATCTGTTCAATCTGTTCAAA
TC

> SEQ ID NO: 7078 27429 130570_300488_1b

FIG. 2 continued

```
GAATTCGTGATGCATCTGGAACAATGGGTGGTGGGTGTGGTTATGGGAATCTCTACAGCCAAGGTTATGGAACAAACAC
AGCAGCTTTGAGCACAGCAATGTTCAACAATGGTTTGGCATGTGGATCTTGTTATGAAATCAAGTGTGTGAATGACCGG
AAATGGTGTTTGCCTGGTTCCATTGTGGTCACTGCTACTAATTTCTGCCCACCAAATAATGCTCTCCCTAACAATGCTG
GAGGCTGGTGTAACCCTCCTCAACACCATTTTGATCTTGCTCAGCCCGTTTACCAACACATTGCTCAGTACCGGGCCGG
AATTGTTCCTGTTGCTTACAGAAGGGTATCATGCAGGAAGAGAGGAGGAATTAGGTTCACAATCAATGGACATTCATAC
TTCAATTTGGTTTTGATAACAAATGTTGGTGGAGCTGGTGATGTTCATGCTGCATACATCAAAGGTTCAAGGACTGGAT
GGCAAGCTATGTCAAGAAACTGGGGTCAAAACTGGCAAAGCAATTCTTATCTCAATGGACAGAGTCTTTCATTCAAGGT
CATTACAAGTGATGGCAGAACTCTGACTTCGTACAATGTTGCAC

> SEQ ID NO: 7079   27429 119329_300025_1b
ATGGCATCTTTCAACTGCAGATGGATATTGAGTTTCTTCCGCATTGCGACAATGGCGCTTTTTCACCAAGCAATAGCCT
ACGGCTACTATTCCACCCCTAAGTTTAACGCCCTGCCATGGAAGCTTGCTTATGCCACGTTCTACGGAGACGAGACTGC
TTCTGAGACAATGGGTGGAGCTTGTGGATATGGGAATTTGTTCAATTCTGGCTATGGAACAGCTACAGCAGCATTGAGC
ACGGTGTTATTTAGCAATGGATATTCATGTGGGCAATGCTTCCAAATAAAATGTGTGAACTCTAAGTTTTGCTACAAAG
GATTTACCACCGTTACAGCCACAAATCTCTGCCCACCCAATTGGGCCCAAGACTCCAACCATGGTGGCTGGTGCAACCC
GCCACGTCAACACTTTGACATGGCTAAACCTGCTTTCATGAAAATTGCTCAATGGAAAGCTGGCATTGTCCCTGTTATG
TACCGCAGGGTACCTTGCATCAAGAAAGGCGGGATCCAGTTCGCGTTCCAAGGAAACGGCTACTGGTTATTAGTATACG
TGATGAATGTCGCTGGAGGGGGAGATGTGGCAACTATATGGGTGAAGGGAAGCAAAACAGGGTGGATGAAAATGAGCCA
TAATTGGGGAGCATCATACCAGGCATTTGCAACACTTTCAGGACAATCTCTTTCGTTCAAACTTACTTCCTACACAAAT
CATGAGACTATTGTAGCTTATAACGTTGCACCTTCTAA

> SEQ ID NO: 7080   27429 1171919_302059_1b
TACTCGACCCACGCGTCGTGCTGTCACCATAGTCTTTCGCTACTTCCTCATTCCCTCTCTCCAGCTTCTTTCCTTTTCT
TTTCTTTGCAAGCGTAGTTCATCATGGCTGCTACACTTTGCCTTTTCCCTCTTCGTCTCTGCCTGGCATTGTTCTTAAT
GCCTTCCTTGCTTGGACTCCTAAGCATAGTAGCCACTGCTTTTGCCCAAAGTGGATGGAACTCTGCTCATGCCACCTTC
TATGGTGGAAGTGATGCCTCCGGAACCATGGGAGGTGCTTGTGGCTATGGTAATCTGTATAGCCAGGGCTATGGGACCA
ACACTGCTGCCTTGAGCACTGCCCTCTTCAATGCAGGGATGTCATGCGGGGCGTGCTTTGAGATGAGGGGTGCTGATGA
CCCTCAGTGGTGCCTCCCTGGTTCTATCATTGTTACTGCCACCAATTTCTGCCCCCCTAATAACGCTTTGCCTAATAAT
GCTGGAGGCTGGTGCAATCCTCCCCTCCAACATTTCGACATGGCCCAACCTGCCTTCCTGCAAATTGCCAAGTACAAGG
CAGGCATTGTGCCAGTGCAATACAGAAGAGTTCCCTGTGAGAAGAAGGGCGGCGTACACTTCACTGTGAATGGGCATTC
CTACTTCAACCTAGTCCTGCTAAGCAACGTAGGAGGTGCAGGGGATGTCCACGCTGTGTCTATAAAAGGGTCAAAGACA
GGCTGGCAAGCAATGTCTCGCAACTGGGGCCAGAATTGGCAAGCAA

> SEQ ID NO: 7081   27429 1118918_301892_1b
ATTCCCTTCTTTCTCTCTTATCAGTAGTGTTGAATATAATCATGGCTATGGCTGCCTCTCTCCTAGCACTATTCTTATC
CTTGACCATAGCAATAGCAGTTCCGGCAATGGCTCAAAGCGGATGGAACTCTGCCCATGCCACATTCTACGGTGGCAGC
GATGCTTCCGGCACTATGGGAGGTGCGTGTGGCTATGGAAACCTGTACAGCCAGGGCTATGGGACCAACACTGCTGCAT
TGAGCACCGCTCTCTTCAATGAAGGGATGTCATGCGGGGCATGCTTCGAGATGAGGTGTGCAGATGATCCTCAGTGGTG
CCTTCCTGGATCTGTTATTATTACTGCCACCAATTTTTGCCCCCCAAACAATGCCTTGCCTAATAATGCCGGAGGCTGG
TGCAATCCTCCCCTTCAACATTTCGACATGGCGCCTTCCAACAAATCGCCAAGTACAAGGCAGGCATCGTGC
CAGTACAGTACAGAAGAGTTCCCTGCGAGAAGAAGGGTGGCATGCACTTCACAGTGAATGGGCATTCATACTTCAACTT
GGTGCTGCTGAGCAACATAGGAGGTGCAGGGGATGTCCATGCTGTGTCAATAAAGGGGTCGAAGACAGGATGGCAAGCA
ATGTCTCGCAACTGGGGACAGAACTGGCAAAGCAACGC

> SEQ ID NO: 7082   27429 108452_300382_1b
TTTCCTTTTCCTTTTCCCTCTTCTCTCTCTGTTTACTTGTTCACACACTGAATCACTATAGTGTGTGAGAAAATGGCTG
TAACTAAGATACTCTGCATTGCTACTACTCTTTTCTGTTTTCTCACCGCCGTCAATGCAAAAATCCCCGGCGCTTACAC
CAGTGGCCCCTGGCAAGGCGCCCATGCCACTTTCTATGGTGGCTCCGACGCCTCTGGCACTATGGGTGGAGCTTGTGGA
TATGGGAATCTGTACAGCCAAGGGTACGGAGTGAACAATGCCAGCACTGAGTACAGTCCTGTTCAACAATGGACTAAGCT
GTGGAGCTTGCTTTGAAATTAAGTGTGTTGACGATGGAAAATGGTGCCTTCCCGGTAACCCATCGATTTTCGTCACGGC
TACTAACTTTTGCCCACCAAATTTCGCTTTGCCGAACGACGACGGTGGGTGGTGCAACCCGCCACGTCCTCATTTTGAC
TTAGCTATGCCTATGTTTCTCAAAATTGGTCAGTACCGTGCCGGAATTGTCCCCGTCACTTACCGCCGAGTACCATGCC
GGAAAGCAGGAGGGATCCGATTCACAATAAACGGGTTCCGTTACTTCAATTTGCTATTGGTGACAAACGTGGCGGGTGC
AGGGGACATCCAGCAGGTTCTTATTAAAGGTACAAACACACAGTGGATAGCAATGAGCCGAAACTGGGGGCAAAATTGG
C

> SEQ ID NO: 7083   27429 271640_200036_1b
ACATTTTCGTTAAAAAATGGGTATTTTAATACTTCTGTTTATGGGAATTTCCCTCATGTTTCAATCTGTTTATGGTTAT
```

FIG. 2 continued

```
TATGGTGGTTGGATCAATGCACACGCAACATTTTACGGTGGAGGCGATGCTTCTGGAACAATGGGTGGGGCTTGTGGAT
ATGGAAATCTATATAGCACAGGCTATGGGACGAACACTGCGGCGTTGAGCACGGCTTTGTTCAACAATGGGTTGAGTTG
TGGAGCATGTTTTCAGTTAAGGTGTGTCAATGCTCGACAGTACTGCTTGCCTGGCACAATTACTGTCACAGCAACAAAT
TTTTGCCCACCAGGTGGTTGGTGTGACCCTCCCAATCACCATTTTGATCTGTCTCAGCCTGTCTACTTGCGCATTGCTC
AATATAGATCTGGCATTGTTCCTGTTGCCTACCGAAGGGTACCTTGTAGAAGAAGGGGAGGAATTAGATTTACAATCAA
TGGTCACTCTTACTTCAACTTAGTACTTGTGACCAATGTTGGCGGAGCAGGAGATGTACGATCATTGTACATCAAGGGA
TCAAGAACTCAGTGGCAACCAATGTCAAGAAATTGGGGCCAAAATTGGCAGAATAACGCTTACCTCAATGGCCAAAGCT
TATCTTTCAAAGTCACCACAAGTGATGGTCGCACTGTAGTTTCTTATAATGCAGCTCCTCGTTCCTGGTCTTTTGGCCA
GACTTTTACTGGAGGCCAGTTCCGTTAATATCAAATTTTTTCAAGTATAGTGCTTACTATATATTTAATTTAAATATTA
TTCCAAGAGTTGGCCTTAATGGCTTTTACTCACCATAATTTAAGAAAAAAAAAATGGCACTTTTTGCTTGGCCATTCAA
TTGTGGAAGAAAAGGAATTGATTCGGCCTACTTTTTTTG

> SEQ ID NO: 7084 27429 41632_300197_1b
CTCGAGCTTGCGGCCGCGTTTAGGCCTTGTGGTTTAGCTAATGGTCACGCTACATTCTATGGAGGAAGTGACGCTTCTG
GAACAATGGGTGGAGCTTGTGGTTACGGAGATCTTTACTCGGCGGGGTACGGGACAATGACGGCGGCGTTAAGCACGGG
TCTGTTCAACGACGGAGCTTCTTGCGGAGAATGCTATAGGATAACGTGTGATCACGCGGCGGACTCACGGTGGTGCTTG
AAAGGAGCTTCTGTGGTTATTACAGCCACTAACTTTTGCCCA

> SEQ ID NO: 7085 27429 33344_300457_1b
GCGAGATTACTAAAACTCCCAGCTTTTTCCGTCTGCGTTCAGGGCGGCTACCGTCGTGGCGGACACCATCCCGGCGGTC
ACATGGGACCTTGGATCAACGCTCATGCCACTTTTTACGGCGGCGGTGATGCTTCCGGCACTATGGGTGGAGCATGCGG
GTACGGCAATCTGTATAGCCAAGGTTATGGACTGGAGACGGCAGCGCTGAGCACGCGTTATTCGACCAAGGACTTAGT
TGTGGCGCATGTTTTGAGCTGATGTGTGTCAACGATCCTCAATGGTGCATAAAAGGCCGATCCATTGTGGTCACTGCCA
CTAACTTTTGTCCTCCTGGTGGTGCATGCGACCCTCCCAACCACCATTTCGATCTTTCTCAG

> SEQ ID NO: 7086 27507 268468_200120_1b
CTTTTCGTTTGAGTCATCTGAGCCTTGCACTGAGCCTTGTGGCTCTTGCACTTGCAGGTGTTGCCATATATAGGAACAC
TTATGAAGCGATGAGTAAAGGATTCCAAACACTTTCTCCAGAGTTAGATCTGCTGGGGTCAGCAGCCAGCATTTTAACC
CTAAATAATGCTGAGCAAAATTCAGACAGCAAGTTAACTCAACCATTACCTCCATCCGCATGCATCTTCTCGGCTGTTC
GAGCAGTTGTCAACAGTGCAATTGATAGAGAAAGACGCATGGGAGCTTCTCTCATTCGTCTCCACTTCCATGACTGCTT
TGTTGATGGTTGCGATGGAGGAGTTCTTCTAGACGCATATTCCCGGATCATTCCAAGGGGAAAAAACTTCACCACCCAAC
AACAACTCAGCCAGAGGTTTTGAAGTCATAGAACAAGCTAAACAAAGAGTAAAAAATACTTGTCCCAACACACCTGTAT
CTTGCGCAGACATCTTAGCTATTGCTGCTCGGGATTCTGTTGTTAAACTAGGAGGACAAGGCTATAACGTTGCACTAGG
GAGAAGAGATGCAAGAACGGCCAACTTCACTGGTGCTTTAACTCAGCTTCCAGCTCCGTTCGACAATCTAACCGTCCAA
CTAAGAAAATTTAATGACAAAAACTTTAATGCCCGGGAAATGGTGGCGCTAGCTGGTGCCCACACGGTGGGTTTCACAA
GGTGCGCCACCGCG

> SEQ ID NO: 7087 27507 286549_200110_1b
GACCAGTCCAACATCCAGTCTTTTTCTTCTTTTTCTTTTTATTCCTTCATTGTTACAGAGAACAAATTAGAAAGCTGTC
TGAAACACCAGAAATATATGGAGAAACTACAAATGTATGTTAACCAAACACTATGTTTATACAAATACAACAAACTTTT
CTTTCTTGGTTTCTTGTGTTTGTTAACACTCTTTCCAACTTCATCTTCAAACCTTTCCTTCGATTTTTATGCACTGTCT
TGCCCTACAGCTGAATTCATGGTGAAAAATACAGTGAGATCAGCTTCCTCTATGGACCCAACACTCCCTGGAAAACTTC
TTCGTCTCCTTTTCCATGACTGTTTTGTTGAGGGTTGTGATGCATCTATACTTTTAGAAGGAAATGGAACAGAGAGAAG
TGATCCAGCAAACAAGTCACTTGGAGGATTCTCAGTAATAGAATCTGCAAAAGAGTATTGGAAATCTTTTGCCCTCGA
ACTGTTTCTTGTGCCGATATTATTGCATTGGCTGCTAGAGATGCTGTTGAATTCGCAGGAGGGCCAAATGTTCAAATTC
CAACTGGGAGAAGAGATGGGAAAATTAGTTTGGCTTCAAACGTGAGACCAAATATAGTGGACACAAGTTTCTCAATAGA
TCAAATGATTGATATATTTTCTGCAAAGGGATTGTCTTTGGATGATCTT

> SEQ ID NO: 7088 27507 280802_200069_1b
GGTGTCCACTACTTCAAGTTTTCTACTTCTTGTTCTTGTTTCTTCTTCATTGTTTTTATCAGAAGCTCAGATACCTGCT
CCAGTTAAGGGTCTTTCATGGAAGTTTTATGAATCTAGTTGCCCTCAGCTTGAATCCATTATTAGGAAGAGACTTGAAA
AACAGATCAAGGATGATGTTGGCCAAGCTGCTGGCTTACTTCGTCTTCATTTCCACGATTGCTTTGTTCAGGGATGTGA
TGGTTCAGTGTTGCTTGATGGATCGGCAGGAGGGCCAAGTGAACAGACTGCAATTCCTAATTTGACCCTAAGAAAGAGA
TCATTCAAGATAATTGATGATCTTAGGAAAAGGGTTCACAATGCATGTGGGAAAGTTGTGTCTTGCTCCGATATTACAG
CAATTGCTGCTAGGGACTCTGTTTGTCTTGACTGGTGGGCCAAACTACAAAGTGCCCTTAGGAAGAAAAAGACGGACGAC
CTTTGCAACAGAACAAGCAACCTTAGACAACCTTGTTGCACCATTTGCCAATACCACAGTCGTCCTCCGTCGCCTTGCA
GCCAAGGGTTTAGACGCCACCGACGCCGTCGCTTTGTCCGGGCCCACACTATCGGAATCAGCCACTGTACTTCCTTCA
CCGACCGTCTCTTCCCTAACCAAGACCCAACCATGGACAAAACATTCGCCAACAACCTTAAACGCAGCTGCCCCACAGC
```

FIG. 2 continued

TGATTCCAACAACACTGTCAACATGGACATTCGAAGCCCTAATGTATTCGACAACAAGTACTACGTTGATCTCATGAAT
AGGCAAGGGCTAT

> SEQ ID NO: 7089 27507 103619_300362_1b
TGGTATCAACGCAGAGTGGCCATTACGGCCGGGGATTTGAGGTGATTGATACAATCAAATCTGAGGTTGATAAAGTTTG
TGGACGTCCGGTTGTATCTTGTGCGGACATCTTGGCAGTTGCTGCTCGTGACTCTGTAGTGGCTCTACATGAACCAACA
TGGGAAGTGAAACTAGGAAGGAGAGACTCCACAACAGCAAGTAGAACCAAAGCCAACAATGATATTCCATCTCCAGTTA
TGGACTTACCTGCACTTATCAACAACTTCAAGAAGCAAGGATTGGATAAGGAAGACCTCGTTGCACTCTCCGGTGGCCA
TACATTAGGGTTTGCTCAGCGTTTCACCTTCAGAAATCGCATCTACAATGAACATAACAACATTGACTCTACCTTTGCA
AGACAACGCCAAGCAAATTGTCCACGTAGTGGAGGTGATTCCAATCTTGCTTCTCTTGATCCAACACCAGCTCTTTTCG
ACTCGAAATATTTTAGTAACTTGGTGTCCAAGAAAGGGCTTTTGCATTCTGATCAGGCTCTACTTAGTGGTGGAAAAAC
TGATGATCTTGTAAAAAAATATAGTAAGAACTTAAAAACTTTCTCCAAAGATTTTGCTGAGTCTATGATTAAGATGGGT
AATATCAAGCCATTGACAGGGAAAC

> SEQ ID NO: 7090 27507 105263_300372_1b
TAAAGGGCTAGTTATAAGAAATGGGAAAGTATGAGTTGTTAGTGGTGATATTGTCGATGGATATAATAGTTAGTGGAGG
GAGGTTTGATGGAGGTGGATATGGGTTCGTAGATGGTCTAAGGATGGAATACTACGTGATGAGTTGCCCATTTGCGGAG
GGAATAGTGAAAAACACTGTCAACAGGCATTTGCAGGTGATCCCACTCTTGCTGCTGCCCTTGTTAGGATGCACTTCC
ATGATTGCTTCCTTCAGGGATGTGATGCATCTGTGTTGATAGATTCAACAAAGGGTGGTAACACAGCACAAAAGGACTC
GCCAGCAAATTTGAGCTTGAGAGGCTATGAAATCATAGACGAAGCCAAGGAAGAGCTCTAAAATCAATGCCCTGGAGTC
GTCTCTTGTGCTGATATTCTTGCAATGGCTGCTAGGGATGCTGCCTTCTTTGCTGGAGGTCCGGTGTATGACATACCAA
AAGGAAGAAAGGATGGAAGAAGGTCAAGAATAGAAGACACAATTAATTTACCTTCCCCTGCTCTCAATAGTTCTGAGCT
TATCAGAATATTTGCCCAACATGGTTTCAGTGCTCAAGAAATGGTGGCCTTATCA

> SEQ ID NO: 7091 27507 12349_300278_1b
CCCACGCGTCCGTGCGGCTCCAAACGCAAACTCGGCTCGAGGATTTCCAGTGATCGATAGAATGAAAGCAGCAGTAGAG
ACAGCATGTCCAAGGACTGTTTCATGCGCAGATATACTTACCATCGCAGCTCAACAAGCTGTAAATTTGGCAGGAGGTC
CTTCTTGGAGGGTTCCTTTGGGGAGAAGAGATAGCTTACAGCATTCTTTGCTCTCGCTAATACAAATCTTCCCGCTCC
ATTCTTCACTCTCCCACAACTTAAGGCCAGTTTTCAAAATGTTGGACTTGACCGTCCCTCTGATCTCGTTGCACTCTCT
GGTGGTCACACATTTGGTAAAAA

> SEQ ID NO: 7092 27507 128548_300476_1b
CCCCCCCGAAAGCAAGCAATTATTCAACGGTTCATTATTTCAATTGAAGCTCCCCTTCCTCAAATTTCGAAGAATGAAG
AGTTTTTCAAGTACCGCCACTTTGCTTTCACTCACGGCCTTCTTCTTGTGGCCTTCATTTCTGCTTTACCATTTGACG
ATATCGACCTTCCTTCTAAGTACTATAGCCTTAGCTGTCCCAAGCTTGAGGAAATTGTCCACAACAAAATGGAGGAATG
GGTTAAAAAAGATTATACTCTTGCTCCTGCCCTCATGAGATTGCATTTCCACGACTGCGTTGTTAGGGGATGTGATGCT
TCAATACTATTAGACCACGAAGGAAGTGAGAAGAGTGCAAAAGCAAGCAAGACATTAAGGGGATTTGAGGTAATAGAGG
ATATCAAAAGAGAAGTGGAGAGAGTGTGCCCAAGGACAGTGTCGTGTGCTGATATTTTAACAGTAGCTGCTAGAGACGC
CACACTTGCTGTAGGTGGTCCATTTTGGATGGTTCCTATGGTAGGAAAGATGGTACAGTTTCATATGCTAAGGAAGCTG
ATCAATTAGTCCCTATGGGTCACGAAGTCGTCACTGATTTGCTTGAGCTTTTCCAGTCTAAGGGCTTGAATG

> SEQ ID NO: 7093 27507 157959_301397_1b
ATAAGTGCAAAGAAAGACAAGCTTAATTTGGCAAACGTAAGTAGTTATTATGGCAGTAACAAGTTCATGTCTTATTGCT
CTAGTCCTTGCTTTTGCGTTGTTTTCCAGTAGTACAGTGAACGCACTGAGCTCCAATTACTATGACAATACATGTCCCA
AGGCCGAGTCGACCATCACCAAAGTCGTGAAGAAGCTATGTTGAATGACAAGACAGTTCCTGCTGCACTTTTAAGGAT
GCACTTCCATGATTGTTTCGTTAGAGGTTGTGATGGCTCTGTGTTGCTGGACTCAACAAGAAACAACAAAGCAGAGAAA
GATGGCCCCCCTAATATTGCATTGCACGCATTCTATGTCATCGACGCTGTTAAGAAACAAATCGAAGATTTGTGCCCTG
GAATTGTCTCTTGTGCTGATATTTTGGCTCTCGCTGCTCGGGATGCTGTTATTCTTTCCGGAGGTCCTACTTGGGATGT
GCCAAAAGGTAGAAAGATGGAAGAATCTCCAAAGCCACTGAAACCCGACAATTACCTTCTCCCACATTCAACATTTCT
CAACTGCAACAAAACTTCGCCCAAAGAGGCCTTTCTTTGGATGATTTAGTTGCGCTTTC

> SEQ ID NO: 7094 27507 152859_200052_1b
GGNGAAAAAAGCTAGTACAAAATTTACGTACTCAAAGACCATATATAGCTGAAACATAGAAAAATAAATTTAAAGACCA
TCGTTGAAACAGTAGTATTATGAGTTCCCTAAGCAAATTACTAACCATGATTATGGTCCTTGTCCTGCTATCC
ATGTCTACGAACATGGTACAAGGCCAAGGTACCCGTGTTGGATTTATTCTAGTACGTGCCCTGGAGTCGAATCCATCG
TTCAATCAACAGTGAAGTCTCATTTTCAGTCTGATCAAACGTTGGCACCAGGACTGCTGAGATTGCACTTCCACGATTG
TTTCGTACAAGGCTGTGATGGTTCTATCCTCATTGATGGTTCAGACGCTGAGAGAACTGCCACCGTGAATGGCGGCTTG
AGAGGATTCGAGGTTATTGATGATGCTAAGAAACAGATTGAAGCTGTTTGTCCTGGAGTTGTCTCTTGTGCTGACATTC

FIG. 2 continued

TTGCTCTTGCTGCACGTGATGCTGTTGTCTTGACCAACGGAGCAAGTTGGGCTGTGCCAACGGGACGTAGAGATGGGCG
AGTATCATCAGCATCTGATGTTAATAACTTTCCAAGTCCTTCTGATTCCGTTGATGTTCAAAAACAAAAGTTTGCTGAT
AAGGGTCTCACCACTCAAGATCTTGTCACCCTTC

> SEQ ID NO: 7095   27507  15009_300242_1b
CCCACGCGTCCGTGCTTAGAATGTTCTTCCACGACTGCTTCGTTCGGGGATGTGACGGATCAGTTTTGTTAGATAAACC
AAACAATCAAGGTGAGAAGAGTGCAGTTCCTAACCTAAGTCTTCGAGGGTTTGGCATCATAGACGATTCCAAGGCGGCT
CTAGAAAAAGTGTGTCCGGGAATTGTTTCTTGCTCTGATATCTTGGCACTTGTCGCTAGAGACGCAATGGTTGCACTTG
AAGGACCATCATGGGAAGTTGAAACGGGAAGAAGAGACGGTAGGGTTTCTAACATCAACGAAGTCAACTTGCCATCACC
TTTTGATAACATCACCAAGCTTATCAGTGATTTTC

> SEQ ID NO: 7096   27507  147096_200015_1b
GTTTGTAATATTAGCGCTGCTCTTTTGTTTGATTCTTTCTCTTTCTGTATTTGCTGAGGCTTCGTCGAAGAACAAACAT
AAGCCCAAACCAAAAAAATCAACGTTTGGTGTTGGATTCTATAAAGATCATGTCCAGCTGCTGAGGCCATTATTAGAA
AAGCTGTATTCAAAGCGGTTCTGAAGAATCCTGGCACTGCCGCTGGCATTATTCGCATGCATTTCCACGATTGCTTTAT
CAGGGGTTGTGATGGTTCAGTGCTGCTGGATTCAGTAAGAGGAAAGGAAACGGCTGAGAAGATAGTCCCATTAACAAC
CTAAGCCTTCGAGGGTTTGAGGTTATTGATGAAGCAAAAGCACGGCTGGAAAAACTATGTCCGCGCACAGTTTCGTGCG
CGGACATACTCGCCTATGCTGCAAGAGATAGTGCCTTGTTCGCGGGAGGCATAAGCTATGCTCTTCCAGGAGGACGTCG
CGACGGCCACGTTTCGTTGAGCTCCGAAGTCATTCAAAACCTCCCTCCACCTTTCTTCAATGCCCAACAACTTCAAGAC
AACTTCAAAAGAAAAGGGTTGTCACTTGATGAGATGGTGACTTTGTCAGGGGCTCATTCTATTGGTCGCACTCATTGCT
CTTCATTCTCTAATAGACTNTACGGTTTCAATGCTACACATCCTCAAGATCCTTCCCTTGATCATAGATATGCTTCATT
CTTGAAAAATAAGTGTCCT

> SEQ ID NO: 7097   27507  144773_200013_1b
TGCCCACAAGCAAAAGAAATGTCAAGTCTGTTGTTGCTAAGGCTGTAGGCAGAGAAGCTCGAATGGCTGCCTCTTTGCT
CAGGCTCCATTTTCATGATTGCTTTGTTAAGGGTTGTGATGCATCACTACTTCTGGACAGCAGTGGAACCATAATAAGT
GAAAAAATATCAAACACAAACAGGAATTCAGCTCGTGGATTTGAAGTTATTGATGAGATTAAATCTGCAATAGAAAAGG
AGTGCCCTCAAACTGTTTCTTGTGCTGATATCTTGGCTCTTGCTGCAAGGGATTCTACAGTTTTAGCTGGTGGACCAAG
CTGGGAAGTTCCATTGGGAAGAAGAGACTCCAAGATGTCTAGTATAAGTGGCTCCAACAATAACATTCCTGCTCCAAAC
AACACCTTCAATACCATTCTCACAAAATTCAAGTTGAAAGGACTTGATCTTGTTGACCTTGTTGCTTTATCGGGGAGCC
ACACAATTGGAAATGCAAGATGTACCAGCTTCAGGCAAAGGCTCTACAATCAATCAGGCAACAGTTTACCAGACTATAC
ATTGGATCAATCATATGCTGCTCAATTGCGGACAAGATGCCCTAAATCTGGTGGTGACCAAAACTTATTTTTCATGGAT
TTTGTTTCCCCTACAAAATTTGACAACTACTACTTCAAGAACTTGTTGGCTTCAAGGGGCTTGTTTAATTCAGACCAAG
TTCTTGTGACTAAAAATCAGGCAACATTAGCCTTGGTGAAACTGTATGCAGAAAACAATGACA

> SEQ ID NO: 7098   27507  144469_200135_1b
ATTACTAAGCAAAAAATCATAGTACAAGCTGCTATTGAGCCTTAAAAAAATGGATTCCAAGAGCTTCAACCTTTCAGCT
TTTGCACTTTTAGCTTGCCTGATTTTATCTTTTTCAGTATCATCTCTTGCCTATGGGAAACAAACAACATGGCCACCAC
TTAGAGTAGGTTTCTACAGTTATAGCTGTCCTCCTGCTGAAACAATTGTGAAGAATGTTGTATACAAAGCCGTATCGCG
TAATCCAGGAATTGCTGCTGGCCTTATCAGGCTACATTTTCATGACTGCTTCGTCAGGGGGTGTGATGCATCAGTATTA
TTGGATGGACCAAACTCAGAGAAGGAAGGTATTCCTAACAAGAACAGTTTACGTGGTTTCGAGGTTGTTGATGCAGCAA
AAGCACAACTTGAGGCTGCATGCCCTGGAATTGTATCCTGTGCTGATATTCTTGCCTTTGCTGCTCGGGACAGTTCCTA
TAAAGTTGGTAAAATATACTATAATGTTGAAGCTGGACGTCGCGATGGTCGCATTTCCATTGATTCCGAAACATTAACC
AATCTTCCTTCTCCATTCGTCGATGCCAAGGAACTCGTCAAGAGCTTTGCTAGAAAAGGTATGTCCGCTGATGAAATGG
TGACACTATCTGGTGCACATTCCATTGGTATTGCTCACTGCGCTGTTTTTG

> SEQ ID NO: 7099   27507  138746_300727_1b
CACACAATCGGATTCGCCCGGTGCGCCAACTTCCGGGACAGGATCTACGGCGACTACGAGATGACGACCAAGTACAGCC
CGATCTCCCAGCCCTACCTGAGCAAGCTCAAGGACATCTGCCCCCTGGACGGCGGCGACGACAACATCAGCGCCATGGA
CAGCCACACCGCCGCGCCTTCGACAACGCCTACTTCGGGACCCTCGTCAACGGCGAGGGCCTCCTCAACTCCGACCAG
GAGATGTGGTCCAGCGTCCTCGGCTACTCCACGGCCGACACCGTCAGCAAGTACTGGGCCGACGCCGACGCCTTCTTCA
AGCAGTTCTCCGACTCCATGGTCAAGATGGGCAACATCACCAACCCTGCAGGTGGTGAGGTCAGGAAGAACTGCAGATT
TGTCAACACATGATCATATGCATGCTCAATCAAAAGGACTGCACATTTGTTCTTTTTAATTTGATGGCTGGCTTGTCCT
AGATAGAAATAAGAAATGCTTTGATGATGAGGCCCTTGTACTGGTACATATAATACGCGTTGTTGTCATTTTGTCATCA
CTCTACAAGTATGTTACATGGAGATACACATGATAAGGTACTCCTGGCTTTTGCACAAACTTTTTATTTATATACATGA
TGAGGAATGG

> SEQ ID NO: 7100   27507  137893_300705_1b

FIG. 2 continued

```
GGCATCAGCAATGGCGTCGTCCCAGTCCCATCTGGATCTGGTACAGCTGCTAATCGTTGTGGTGATGACTATGACGATG
CTGGTGGGTGGCGGCGAGGCGCTGAGCCTGGACTACTACGCCAAGACGCTGCCCCAAGGCGGAGGCGGCGGTGGCGGCG
GCGGTGAAGCAGGCCATGGCCAAAGACCGCACGGTGCCGGCCGGCCTGCTCCGCCTGCATTTCCACGACTGCTTCGTCA
GGGGGTGCGACGGTTCCGTGCTTTTGGACTCGTCGGGGAACATGTCGGCGGAGAAGGACGGCCCACCCAACGCGTCGCT
GCACGCCTTCTACGTCATCGACAACGCCAAGGCCGCCGTCGAAGCCCTCTGCCCCGGCGTCGTCTCCTGCGCTGACATC
CTCGCGCTGGCCGCCAGGGACGCAGTCGCCATGTCCGGTGGTCCTTCTTGGCAAGTGCCGGTGGGTCGTCGTGACGGGC
GCGTGTCGCTGGCGAGCGAGACGACGACGGCGCTACCGGGGCCGACGGCGAGCTT

> SEQ ID NO: 7101 27507 136732_300438_1b
CACCGACTTAACACTTGGTCATTTCTCATTGGTGCGTCACGGAGTGAGCAGTGTACATACGTTACTAGCTCAAGGCTGC
AGCGGAGAGAGAGAGAGAGAGAGAGAGAGATGGGCGCTGTGGCTGCCGGTTCGTGCCGCGGTCCTGGTCGTGGCCGTGGCCC
TCGCCGCGGCGGCGGCCGGCGCGTCGGCGCAGCTGTGCGACAAGTACTACGACGGGACGTGCCCGGACGTGCACCGGAT
CGTGCGGCGCGTGCTGAAGAGGGCGCGGCAGGACGACCCCCGCATCTTCGCCAGCCTCACCCGCCTCCACTTTCACGAC
TGCTTCGTCCAGGGTTGCGACGCGTCGATCCTGCTGGACAACAGCACGAGCATCGTGTCGGAGAAGTTCGCGACGCCGA
ACAACAACTCGGCGCGGGGGTACCCGGTGGTGGACGACATCAAGGCGGCACTTGAGGAGGCCTGCCCCGGCGTCGTCTC
CTGCGCCGACATCCTCGCCATCGC

> SEQ ID NO: 7102 27507 1119541_301898_1b
GAGAGAGAGAAAAGAAGAAGAAGAAGAAGAAGAAGAAGGAGAAAGAGAGAGAGAGAGAGAGATGGGAATGAGAATGGGG
ATGGGAATGGTAGTAGTGGTGTTGGGTATGGTGATGATAGGGCAAGCATGGGGGCAGTTAACAGCTGATTTCTACTCGA
GTAGTTGCCCCAACGTATCAGCCATTGTAGGAGAAGTGGTGAATGCAGCTGTCGCTGCTGAGCCTCGAATGGGGGCCTC
CTTGCTCCGCCTTCACTTCCATGATTGCTTTGTTCAAGGATGTGATGCATCATTATTGTTGGACGACCCCAATGGAGAA
CAAGTAGCGCTTCCTAATTTGAACTCAATTAGAGGACTTAATGTGGTGGATAATATAAAGGCAGCAGTGGAGTCTGTTT
GCCCTGGCATTGTCTCTTGTGCAGATATTCTTGCTATTGCCGCAGAAAGATCTGTTGTTGCACTCAAAGGTTCTAGTTG
GCCAGTGCTATTGGGAAGAAGAGATGGCACTACCTTTGCATCAAATGCTACGGTACTCCAATCTCTAGTTGCGCCTACA
GAGAACTTATCCTCCATCATCCAAAAATTTGCTAATGTGGGACTTGACACTAACGATGTGGTTGTTTATCAGGGGCTC
ACACTATTGGGCGTG

> SEQ ID NO: 7103 27507 159437_200024_1b
AAAGGTTTCTTTTGAGAGAGAGGAAAAAATGGCTTCATTTAGCTATTTGAGTATTCTGGTTTTATGTATTCTTGGAATA
GTAAGTTCTGGACATGCTCAATTGCAGCTTAATTTCTATGCCAAGAGCTGTCCAAATGCAGAGAAAATCATTTTTTACT
TTGTCCAAAAGCAAGTTCCCAAAGCTCCAAATACTGCAGCTGCCCATACTTAGAGTGCATTTCCATGATTGCTTTGTTAG
GGGTTGTGATGGATCGGTACTTCTTAATTTCACTTCAAGTACAGGAAACCAAACTGAAAAACAAGCTAATCCTAATCTA
ACATTGAGAGGTTTCTCCTTCATTGATGCTGTTAAGAGATTAGTTGAAGCTGAATGCCCTGGAGTTGTTTCTTGTGCTG
ATATTATTGCCTTGGTTGCTAGAGATGCAGTTGTAGTCACAGGAGGTCCTTTTTGGAATGTGCCAACTGGTAGAAGAGA
T

> SEQ ID NO: 7104 27507 1100810_301464_1b
AATTAAGAGAGTTAGCCTTTGATTTGCCTTTGGTAGTAAGAAGGAATGGCTAGTCCCAACTACAATTGCAAGTACATAG
TGATGGTACTCCTTCAAGTCCTGTATTGGAGTTGTAAGGGTGATGCTCAATCCCTGAGCTCCACCTTCTATGCCACCAC
TTGCCCCAATGTTACGTCCATTGTTAAGGGAGTTGTTGAACAAGTGGTTGATCAGGATCCTAGAATGGCAGCTTCCTTG
TTGCGTCTCCATTTCCATGATTGCTTCCCCAATGGTTGTGATGGATCAATATTGCTAGACGACACATCAACATTTACAG
GGGAACAAACTGCACCCCCTAATAACAACTCCATTCGTGGGATGGATGTTGTTGATGATATAAAGGCTGCTATAGAGTC
AGTTTGTCCAGGAGTTGTCTCATGTGCAGATATATTGGCCATTGCTTCAGAAGTTGGTGTTTCTTATTTCTTCTAGGGA
GGAGGGATGGCACCACCGCTGCAACAACTCAACAAGTAATAGATGCTCTTCCTGCTCCAACTGATTCTTTGGATACAAT
TAAGAGCAAGTTCTCAAATGTGGGCCTTAACACACAAGATGTTGTTGTTCTTTCTGGA

> SEQ ID NO: 7105 27507 1100688_301462_1b
AGTGTGGTGTAGGAACTAAGATTGTTAGGAATTTGCCTTGCTTTGGTTTGGCTTTGGTAGGAAGAAGGAATGGGTAGCC
CCATGGACAATTGTAAGTACATAGTGATGGTACTCCTCCAAGTCCTATATTGGAGTTGCAAAAGCCATGGACAATCCTT
GAGTTCCACCTTCTATGCCACCACTTGCCCCAATGTCACTTCCATTGTCCAGGGAGTTGTTAAACAAGCGGTTGCTCAA
GACGCTAGAATGGCTGCCTCCCTCTTGCGCCTTCATTTCCATGATTGCTTCCCCAATGGCTGTGATGGGTCAATATTGC
TAGACGACACATCAACGTTTACAGGGGAGCAAACTGCCCCCCCTAATAATAACTCTATTCGCGGGATGGATGTTGTGGA
TGATATAAAGACTGCTGTAGAGTCTGTTTGTCCAGGAATTGTCTCATGTGCAGATATATTGGCCATTGCTTCAGAAGTT
GGTGTTTCTTATGTTGGGGGTCCTACATGGAAAGTTCTTCTAGGGAGGAGGGGATGGCACCACCGCTGCAACAACTCAAC
AAGTAATAGATGCTCTTCCTGCTCCAACTGATTCTTTGGATACAATTAAGAGCAAGTTCTCAAATGTGGGCCTTAACAC
AC
```

FIG. 2 continued

> SEQ ID NO: 7106 27507 159834_200026_1b
TTCACTTAGTGCTTCTTGTGTCTGTCATTTCGACAAGTAGTTGTGTTAATGCTCAGCTCCAGTGGGACTTCTATCGGAA
TTCATGTCCAAATGTGGAGTCCATCGTCCGATCAGCAGTTGAAGACAAGTTTAAACAGACAATTGTTACAGCAGCAGCA
ACACTTAGACTCTTTTTCCACGATTGCTTTATACAGGGCTGTGATGCTTCCATCATACTGAGGTCGTCAGGAAATAACA
CAGCAGAAAAGGATCATCCAGACAATCTGTCCCTTGCTGGAGATGGATTTGACACTGTTATTAAAGCCAAAGCTGCAGT
TGATAATGTGCCTTCTTGTAAGAACAAAGTCTCTTGTGCTGATATCTTGGCCATGGCCGCTAGAGATGTCATTGCATTG
GCAGGAGGACCGCACTATGCTGTTGAATTAGGAAGGAGGGACGGCAGAATGTCTTCACAAACTAGTGTGCAGAACAACC
TGCCTCACTCTAACTTCGACTTACAGAAACTCCTTCCTATGTTTGCCTCTCGTGGACTATCTATCAGACATTTGATTGC
CCTCTCAGGAGCACATACACTAGGATTTTCACATTGCAACCAGTTCTCAAGCAGGTTATACAACTTTAACAGCACACAC
AAGGTTGATCCAACAATTGATGTAACCTATGCT

> SEQ ID NO: 7107 27507 229691_301045_1b
ACGATGAAGCTCGAAAGCTTGCTCGTTCTTGTTCTTGCGATTCTAAAGACCTCACACTGCGCTTTGAGGCAAAACTTCT
ACGCGGACTCATGTCCTGTCGCCGAAGCTCTCGTTCAGTTCTCCGTTGCTCAGGCAGTGGCGAGAAACCCCGGAATCGC
GGCTGGACTTCTACGTCTCCACTTCCACGACTGCTTTGTTCGAGGATGCGATGCCTCGGTGCTGCTAGATTCAACCGGG
AACAACAAGGCCGAGAAGGATGCCATTCCAAACTTCGGTCTTCGAGGATTCGAAGTTATAGACAATGCAAAGTCCCTGC
TCGAGGACCGGTGTCCAGGAACCGTGTCTTGTGCCGATATACTAACGTATGCTGCTCGCGACGCCGTCTTCCAGGTTGG
CGGACCTCGCTGGGAAGTTGAAGGTGGCCGACGAGACGGATCGGTGTCTATAGCGGATCAAGTCGGGGCTAATCTCCCG
TCGCCGCTCTTCAACGTCGATCAGCTGACGAGAAGCTTTGCCCGCAAAGGAATGACACAAGATGAGATGATAACTCTCT
CTGGAGCTCACACGATTGGAGTCGCGCATTGTCTATCCTTCGTCAA

> SEQ ID NO: 7108 27507 227086_301025_1b
CTCCTGCTCCTCCTCGCCGTGGCGCTGGCGCTGGCGGCGCGCGCGGGCGCAGCTGTCGCCGGGGTTCTACTCGGCGA
GCTGCCCCACCGTGCACGGCGTCGTGCGGCAGGTCATGTCGCAGGCCGTCATGAACGACACGCGCGCCGGCGCCGCCGT
CCTCCGCCTCTTCTACCACGACTGCTTCGTCGGCGGCTGCGACGCGTCGGTGCTCCTCGACGACACCCCCGCGGCGCCC
GGCGAGAAGGGCGTCGGCCCCAACGCCGTCGGCTCGACGACCGTCTTCGACCTCGTCGACACCATCAAGGCCCAGGTCG
AGGCCGTCTGCCCCGCCACCGTCTCCTGCGCCGACGTCCTCGCCATCGCCGCGCGCGACAGCGTCAACCTGGTCAGTCA
CACACACTCCACACACACGCGCGCGCGCGCGCCATGTGTTCGACGCAATGACGCAAACCCTGTTGTGCGCACGTGTG
CAGCTCGGCGGGCCGAGCTGGGCGGTGCCGCTCGGCCGCCGCGACGCGCTGTCGCCGAGTCGGAGCGCGGTGTCGACCG
ACCTCCCGGGCCCCGAGGCCGACATCTCCGCGCTCGTCTCCGCCTTCGCCGCCAAGGGCCTGAGCTCGCGCGACCTCGC
CGCGC

> SEQ ID NO: 7109 27507 226811_301005_1b
GAGTACGACGAGAGCTAAGTAAACTTAGCTATATCGATCGACCATGGCGTCCAGGACTAGTGCTACTGCCGGCATGCTG
CTGCTCGCCGCCGCGGCTGCGCTGGTGTGCAGCTCGGCGGCGGCGAGGATGCCGCCGTTGGCGAAGGGGTTGTCGTTGG
GCTACTACGACGCGAGTTGCCCGCAGGCGGAGGCCGTCGTGTTCGAGTTCCTGCAGGACGCCATCGCCAAGGACGTCGG
CCTCGCCGCGGCGCTGATCCGGCTCCACTTCCACGACTGCTTCGTCCAGGGCTGCGACGCCTCCATCCTGCTCGACAGC
ACACCCACCGAGAAGAGCGAGAAGTTGGCCGCGCGCGAACAAGACCCTCCGCAAGTCGGCGTTCGACGCCATCGACGATC
TCCGCGACCTGCTCGACAGGGAATGCGGCGACACCGTCGTGTCCTCCGACATCGTCACCCTCGCCGCCCGCGACTC
CGTCCTCCTCGCCGGTGGCCCGTGGTACGATGTTCCCCTCGGCCGCCACGACGGCTCCAGTTTCGCGTCTGAGGACGCC
GTCCTGAGCGCGCTCCCGTCGCCGGACTCCAACGTCACCACGCTCCTCGAAGCGCTGGGCAAGCTCAAGCTCGACGCCC
ACGAGCTCGTCGCCCTCTCCGGCGCGCACACCGTCGGCATCGCGCACT

> SEQ ID NO: 7110 27507 225015_300983_1b
GTGTTGTGCGTCTCAGCTTTCCAGCGGCCATCTTTGATTGACGATGCCGCAAAGTTTGGCGCTTTTGGTTGTCGTGACG
ATCGCGCTGCTGAGTGCTGCTCAAGCTCAGCTCTCCGCCCGATTTCTACAGCAGGAGCTGTCCGCGAGTGGAATCCATAG
TCCAGCGCGTTGCGATCGAGAAATTCAGGCAGGCACCGACGTCTGCGGCAGCCACAGTCCGGCTCTTCTTCCACGACTG
CTTTGTTGAGGGATGTGATGCTTCGGTGATGTTGGCCTCCACTCCAGGAAACAAGGCCGAGAAGGACGCAGACATCAAC
AAATCTCTAGCTGGAGACGCATTTGATTCGGTGATAAGAGCTAAGAAAGCCGTGGAAGCAGAGTGTCCCGGCGTAGTCT
CTTGTGCGGATGTTCTAGCGATACTAACGCGGGACTTTGTGCGTCTGACAGGAGGACCAACTTGGCAAGTAAAGCAAGG
AAGACGCGACGGGAGAATCTCCAGCTCGCAATCAGCTGCTGCCAATCTCCCTGGTTCGGAATTCTCTGTAAACCAGCTT
CGGAAAAACTTTGCAGCCAAAGGACTCAATCTAGTCGATTTGGTGT

> SEQ ID NO: 7111 27507 224559_300973_1b
CGAAAGAATTTCTTTGTGGGAGCAGTCGGAGAGAATGACGAGAATTAAAACTTCTACTGTCTTCTTACTGATCATTT
TCGCTGTGGCAATGGTTGATATGTGCCAGGCTCAGCTCTCCACTACATTCTACTCCAAGTCCTGCCCGAACGTCAAGAA
AATCGTCAAGACAGCAATGGAAAAGAAATTCAAAGAGGCCAGAGTTGTAGCTGCTGGAATGCTTCGACTCTTCTTCCAC
GATTGCATCATAGAGGGATGCGATGCTTCGGTGATGATTGCCTCAACCAGCGGGAACAAAGCTGAGAAAGACGCCGATG

FIG. 2 continued

ACAATCTATCGCTCCCGGGAGATGCTTTCGACGCTGTCATCCGAGCTAAGGCCGCAGTAGACAAAGAATGCCGGAACGT
CGTCTCCTGCTCAGACATTCTCGTCATGGCGACCAGCGAACTCCTGAAGCTCATTGGAGGCCGCGGCTGGGACGTGAGA
CTGGAAGGAAAGACGGCAGAAGGTCGCGGGCTTCAGCAGTTCCCGGGAATTTGCCGGGCGTAAACATGACGGTTGCTCA
GCTCACGTCGTTCTTCAAGAACCGAGGCTTCAGCCAAAGAGAGATGGTCGTGCTGTCCGGAGGCCATAGTGCCGGCTTC
GCACACTGCGACAAGTTCAT

> SEQ ID NO: 7112 27507 256021_301646_1b
GTGGGAAGGTATAAGCATAAGCAATGGGTTTGAGAGAAGCAGTCCTAATCTCTTTGATGGTCCTAGTGTTGGAGGCAAG
ATGGTGTGAGGGTGGGGGTGAGGGGTTGAGGATGGATTTCTATGGGGAGAAATGCCCATCCCTTGAGCAGATAGTGAAG
GAGGAAGTCAATGCTCTCTACAACATACATGGCAACACGGCTGTCTCCTTCCTTAGGAGCATATTCCATGACTGTGCCG
TCCAGNGGTGTGATGCTTCCTTGCCATTGGACTCCACAGCTGAGCGTGCATCAGAGAAAGAGTCAATTAGAAACCTTGG
CATGCGCAATTACAAGTATGTCCACTCAATTAAGAAAACAGTGGAGAAACATTGTCCCAACACAGTCTCATGCGCTGAC
ATTCTAATGCTTGCTGGTCGAGAAGGTGTTATGATGCTTGGTGGCCCATATATTCCCATGAAATTGGGACGAAGAGATA
GTTTGACTAGTAGTAAAGAAGAAGCTGATGCTCAACTTCCGGAACCAGATATCCAAGTCTCTTCTCTCTTGCCTTATTT
TTCTTCAATGAATCTTCAAACTACTCACGTTGTGGCATTACTAGGTGCTCACACAGTGGGGAGAACACATTGCACTAAC
CTAGTGCCCCGTTTGTACCCAAATACCGACCCCCTCTTGGACTCTGCATATGCCGGCTACCTTAAGTTCCGTTGTCCCA
CATCCAATCCTAACCCCCATGAAGTGTTGTATGCAAGAAATGACCGCAAGACACCTATGCGCTTGACAACATGTACTA
TAAGAACATAATGGCCAACAAGGGACTCCTCAAGGTGGATCAATTCATCTCAATGGATGACCGAACCTCTAAAGAGGTA
GAACGGATGGCCAATAACCAATCCTACTTCTTTGAAAAATTTGTTGAGGCTGTCGGTATTCTTAGTGAGCACAAAACTC
TCACCGGTACTCAAGGAGAGATACGCCGTCATTGCCAATTTAGTAATTAATCTCCCATCTAAACCTCCCCATGATGTGA
AGTATTTGTATA

> SEQ ID NO: 7113 27507 243933_301553_1b
ATGACCAGTAAGTATGTGTGGCTACTAAATGGCTTCCATGTCTCAGCAGCAGCTTCTTGTCGGTCTTTTTCTACTTCTC
ATTGCGGCATTGTGTTCTTCATCTTCCTCTGCTTCTTCGCTTCACAGCTATGCTCAGTCTTGTCCGAGAGCCGAGCAAA
TCATTGCCGACACTGTGAGGGAAGCGGCTGACAGAGATCCAACCACCCCCGCCGGCATTATCCGCTTGTTCTTCCACGA
CTGCTTCGTTGAGGGATGTGATGGATCTCTGCTGTTGGAATCGACACCCACCAATGGCAGGGACGTGGAGATGTTTGCA
CTCGGGAACAACAACTCTGCGCGTGGTTTCAGATCATTGAGTTGGCGAAGACCCGGCTGGAGGCTGCCTGCCCGGGGA
CCGTGAGCTGCGCGGACACGCTCGCCATTGCTGCCAGAGACGCCACAACTCGCTTGGAGGACCTTTCTATACTGTGCC
TACGGGTCGCTTCGACGGACGGGTCTCGAGCAGGACGTTGGCCGACGCACGACTGCCGGGTCCCTCCTTCACTTTTGTT
GAGCTGAGAGACAACTTTTGGGAGAAACGCTTGTCGGTCCATGATCTCGTCGTCCTCTCTGGTGGACACACCATTGGTC
GCTCGAAGTGCAGGTTCTTCGAACAACGCGTCTACAACTTCAGCAACACCGGGAATCCGGATCCAACTCTGGAAGCTTC

> SEQ ID NO: 7114 27507 241943_301324_1
GAGCGATCATCAGTTTTATCATCCCTTTCTATCTAGAGCATACGTTCTTTCCTAGCTTTGATCATGGCCGGTTCTGGAT
CAAGGCAGTGGTCGCTTCTGGTCGCGGTGACGGTGATGGGAATCATCTCTGCAAATGCGCAGCTCTCCTCTAGCTTCTA
CTCCAGCACTTGCCCCAATCTCACTGATATCGTGAGGAACGTCATCCGATCCGCGGTGCTGGAGGAGCCGAATGGCA
GCATCCATTCTCCGCCTCCACTTCCACGATTGCTTCGTCAATGTAAGTAAGCTTCAAAGAAACTCTCCAATTCAAATTT
CAAGATTATGCGCTGAATATTCGTCCCGTTTGAAACCACAGGGTTGTGATGGATCACTTCTCCTAGAGGGCGCAGAGCG
AGACGCCATTCCAAACCGCAACTCGGCGAGAGGATTCAACGTCATCGACAATGTCAAATCCGCCGTAGAGAGCTCCTGT
CCGGGAGTTGTCTCCTGCGCAGACATCCTCGCATTGAGCGCTCATGAATCGGTCACAGCACTTGGAGGACCTTCATGGA
CTGTGGTGTTTGGCCGACGAGACAGCCTCACAGCCGGTAGCGCTGCGACTGCGAACGCAAACATCCCCGGCCCGAACTT
CACTGCGTCCGCACTCGTCTCCAACTTCCAGAA

> SEQ ID NO: 7115 27507 241727_301551_1b
GGCAGCGGCAGTATTCGTGATTGCAGTGTTGCTGTCTCTGCATGGCAGTGCTTTCGGCCAGCTGAGCTCGACCTTTTAC
AGCTCCTCTTGCCCGAACCTCATCAACATCGTGAGAAACGGCGTCCGGCAGGCAGTTCAAGCAGAGGCTCGAATTGCTG
CCTCGTTCGTTCGACTCCATTTTCACGACTGTTTTGTTAATGGATGCGATGCTTCTATCCTGCTGGATGGCTCAAGTCT
GGAGCAAAACGCATTCCCAAACGTCAACTCTGCCAGGGGTTTTGACGTTGTGGATTCCATCAAGAGCTCCGTCGAGAGC
TCGTGTCCGGGCGTTGTTTCTTGTGCCGACTTGCTAGCACTCATAGCTCGAGAATCCGTCGTCGCGCTCAATGGACCTT
CGTGGACTGTAGTGTTCGGAAGAAGAGACAGCTTATCAGCGAGCCAGGCTGCAGCAAATGCCAATCTTCCTCCACCGAC
TTTCAACGCCTCCGCACTCATCGCTAACTTTCAGAACCAGGGACTTTCAGCGACAGACATGGTAGCTCTCTCGGGTGCT
CACACTATTGGACAGGCTCAATGCAGAAACTTCAGAGCTCGGCTCTACGGACCGTTCCAAGCGGCG

> SEQ ID NO: 7116 27507 240659_301316_1b
TCATCTCAGTCGTGTCTTGTCATTATTACTCGACCCAGTCCGTGCAAGTCCACGCCTTGCTCGGCAACGATAGCGAGTA
TGTCGGCGCAAGACACGACTCCGGGACAAGCTCCTTCGACCGCTGCTTTGATGGCATCTACAACCTCGAAGCCTCTGGC
GGAATTCCTGTTCGGATTCGCGGTCTTCTCTCCGGTGAAGCCCGGCTGGTCGTCCAGAAGAACAGATCCATCAAATCCC

FIG. 2 continued

```
TGATCAACAAGAAAAGAGAACCAAGGATAATCGTCAACTTCTCATCACCAGGCGTAAAAGCGATGCCGCCATCCTTGGT
TCTCGCTCCACTGGTGGTCTCAGGACATCTTTCACGATCGACAACACATTGGGACAGGAGTAGGCGTAGAAAGTGGGGC
TCAGCTGCTGTGGAGACGAGGAAGGATGTGCCGACACACAGGAAAAGGGGAGAAGGGAATTATGCAAGAGTCATCATCA
ACAGCGCAGCCTTCGTCGTCTTCGTCGTCGATGCATTCATCTTTCTCATGCTGGAAGAAGAAGAACGAAGAAGAAGAAG
GAAGACGAGGAGGAAGAGTTCGGGGTAACGGTGTCCAAAGTCTGGGAGGCTATATAGTGAAACTTTCACGGGCAAGATT
GACACGGTCTGGCGTGGTGACCTGGTCTCGTCAAGATTTTCAACACCAACCACCACTATGTCGAAATAACTATATTATT
```

> SEQ ID NO: 7117 27507 234757_301220_1b
```
TATCTGAAAGATGGTGCTGGATAGATCGAAGGACAAGTTTAAGATGGTGAAGACGGGAGCACAAGTTTAAGATTGATGG
ATCAAAAAGAAGTTGGAGGTGAGGATGGCGGAGATAGATCGATCAAGCGACGTCAAGATGGTACTCAAGAAGAAGGAGA
GTTTCTGGACGTACCAATGCGACCGAGTCTCGGGCAGCCAGTGTCAAGATATCAGCGCAGGAGACGATTCCTCCGCAGT
GGGCCTCGACACTGGCCTTGATCGAGTCGATGACTTCGAATCCTCGGAGAGAGTTCGCATTCGGCCCCGCATTTTTCTC
GCCTTTGAACGTCTTGGTGTCATCGAGCAGCACCGAGGCATCGCATCCCTGCGGAAAAAATTTCGATTTTTTCCTTCTT
TCCGGTGGGAAACTTCGAAACAAATACTACGAAAGCTATCCTGCTTAGTGGATTGCTGGACTTACATTGACAAAGCAGT
CGTGGAAATGGAGGCGGAGTAGCGATGCCGCGATCCTCGGCTCATGCTTGAAAGCGCTCTCCACGCC
```

> SEQ ID NO: 7118 27507 233216_301088_1b
```
GCGATCATCAGTTTTATCATCCCTTTCTATCTAGAGCATACTGTTCTTTCCTAGCTTCTGATCATGGCCGGTTCTGGAT
CAAGGCAGTGGTCGCTTCTGGTCGCAGTGACGGTGATGGGAATCATCTCTGCAAATGCGCAGCTCTCCTCTAGCTTCTA
CTCCAGCACTTGCCCCAATCTCACTGATATCGTGAGGAACGTCATCCGATCCGCGGTGTTGAGCGAGAGCCGAATGGCG
GCATCCATTCTCCGCCTCCACTTCCACGATTGCTTCGTCAATGGTTGTGATGGATCACTTCTCCTAGAGGGCGCAGAGC
GAGACGCCATTCCAAACCGCAACTCGGCGAGAGGATTCAACGTCATCGACAGTGTCAAATCCGCCGTAGAGAGCTCCTG
TCCGGGAGTTGTCTCCTGCGCAGACATCCTCGCATTGAGCGCTCATGAATCGGTCACAGCACTTGGAGGACCTTCATGG
ACTGTGGTGTTTGGCCGACGAGACAGCCTCACAGCCGGTAGCGTTGCGACTGCGAACGCAAACATCCCCGGCCCGAACT
TCACTGCGTCCGCACTCGTCTCC
```

> SEQ ID NO: 7119 27507 201227_300714_1b
```
GTCTTTGGTTCCTTCTGCTTGCTTCTCTTGCTGGTTCGTCGGTCGGTGGAGTTTGAGCCTGCGCCATGGCTGTCGGCGG
GAGAGGCGAGACGGCCGCTGCTCCTGCTCCTGCTCCTCCTCGCCGTGGCGCTGGCGCTGGCGGCGCGCGCGCGGGCGCAG
CTGTCGCCGGGGTTCTACTCGGCGAGCTGCCCCACCGTGCACGGCGTCGTGCGGCAGGTCATGTCGCAGGCCGTCATGA
ACGACACGCGCGCCGCGCCGCCGTCCTCCGCCTCTTCTACCACGACTGCTTCGTCGGCGGCTGCGACGCGTCGGTGCT
CCTCGACGACACCCCCGCGGCGCCCGGCGAGAAGGGCGTCGGCCCCAACGCCGTCGGCTCGACGACCGTCTTCGACCTC
GTCGACACCATCAAGGCCCAGGTCGAGGCCGTCTGCCCCGCCACCGTCTCCTGCGCCGACGTCCTCGCCATCGCCGCGC
GCGACAGCGTCAACCTGCTCGGCGGGCCGAGCTGGGCGGTGCCGCTCGGCCGCCGCGACGCGCTGTCGCCGAGTCGGAG
CGCGGTGTCGACCGACCTCCCGGGCCCCGAGGCCGACATCTCCGCGCTCGTCTCCGCCGCCGCCAAGGGCCTGAGCTCG
CGC
```

> SEQ ID NO: 7120 27507 200970_300711_1b
```
TCTAAATCCATCCATCGATCTCTCAATTAATTAACCTCAAGAGAGAAGTAATTAATTGAGCTAGCTAGCTAGATAGTGA
GATAAATAGTGATCAATAGCTAAGCTAGCTAGCTTCGATCGATTGATCATGATGAGGTCGCCGTGGATGGTGTTTGCAT
GGGCGGCGGCGATGGTGGCCGTGGCGGCGGCGTCGCCGGTGCCGACGAAGCTGAAGGTGGGGTTCTACGAGCACAGTTG
CCCGCAGGCGGAGGAGATCGTCCGCAACGCCGTCCGCCGCGCCGTCGCCCGTGACCCCGGCCTCGCCGCCGGCCTCATC
CGCATGCATTTCCACGACTGCTTCGTCAGAGGGTGTGACGGGTCGATACTGATAAACTCGACGCCGGGACACGTGGCGG
AGAAGGATTCGGTGGCGAACAACCCTAGCATGCGAGGGTTCGAGGTGGTGGACGACGCCAAGGCCATCGTCGAGGCGCA
CTGCCCGCGCACCGTCTCCTGCGCCGACATCCTCGCCTTCGCCGCCCGCGACTCCGCCCACCTCGCCGGCGCCACCGTC
GACTACCCGGTCCCCTCCGG
```

> SEQ ID NO: 7121 27507 254867_301639_1b
```
GGCAGCAATGGCACGCATGCAGGGATTGTGTTTGAGGATTGTAGGCTTGATGTGCCTAATATGGGGTGGAGTTACATGC
TTAGCTGTTGAGCTCCACGGCAATAGCAATAGCAATAGCAATGGACTCGAAGTGGGCTTCTACAAGCACACGTGCCCTC
AAGCAGAGTCCATTGTACAATCGGTTTTAGAGAGAGCCATCCAAAGGAATGCCCGAGCGGCTGCCTTTCTTCTTCGAAT
GCATTTCCATGATTGCTTTGTCCAAGGTTGCGACGCTTCAATCATGCTTGATGACACTCCTTCTTTCAAGGGTGAGAAA
ACTGCAGTTCCTAATCTCAATTCAATCAAAGGATTTGATGTTATTGATGAGATCAAAAGTGCAGTGGAGGCAGCATGCC
CACATGTAGTCTCATGTGCAGACATTCTAGCGATAGCTGCGAGGGACTCCGTGGTTCTAACCGGTGGTCCTACATGGGA
TGTACCACTAGGAAGAAGAGATAGCCGAAGTGCAAGCTTAACAGGAGCTAACCAAAATCTCCCACCCCCTACCTCAAAC
GTTGCACAACTCATTCAATTATTTCAAAATGTAGGCCTAAATGTACAAGACATGGTAACGCTTTCAGGTGGGCACACAA
TTGGAAGATCACGATGCACGTCC
```

FIG. 2 continued

> SEQ ID NO: 7122 27507 252729_301604_1b
AAGAGATAGTACTACTTTTGCAAGCTCAAGCGTGGTAGTTCAATCCCTTGTTGCCCCTACTGAGAATTTAACATCTATA
ATCCAAAAGTTTGAAGTTGTCGGCCTTTCTCCAACAGATGTAGTTGTCTTGTCAGGGGCCCATACAATAGGCCGTGCTC
GATGTGTAACCTTTCAAGATCGACTATATAACTTTAATAACACTGGAAAACCAGATCCCACTATGAACCCTAAACTTTT
AGCTACATTGCGATCGATTTGCCCACAAGCAAATGGAAATGGAAATGCGTTGACAAATCTTGATCAAGGCTCAGGAGAT
CGATTCGATAACAAATATTTCCTAGGTTTGAAAAACAATTATGGAGTTTTACAATCTGATCAAGAATTATATTCCACAC
CTGGAGCTACTGCAATTGCCTCTTTGGTACACAAATACAGCTCTAGCCAAATCAACTTTTTCAATGCCTTTGGCATTTC
CATGATAAAGATGGGAAACAACAAGCCTCTCCTTGGA

> SEQ ID NO: 7123 27507 191367_300740_1b
ATCGATCTTTGTTAGCTAGAGTGTTGAGCAATGGCGTCCAAGCTGGGTATGGTTGTGCTACTGATCTCGGGCCTCTTTG
CTGCCCGTTGCGCGGCCGTGGTGACCACCGGCGAACCCGTCGTCGCCGGCCTCTCCTGGGGGTTCTATGACACGTCGTG
CCCGTCGGTGGAGGGCATCGTGAGGTGGCACGTCACCGAGGCCCTCCGCCGCGACATCGGCATCGCCGCCGGCCTCGTC
CGCATCTTCTTCCACGACTGCTTCCCGCAGGGGTGCGACGCGTCGGTCCTCCTGACGGGTTCCCAAAGCGAGCTGGGTG
AGATACCCAACCAGACGTGCGGCCGTCGGCGCTGAAGCTCATCGAGGACATCCGCGCCGCCGTACACTCCGCCTGCGG
CGCCAAGGTGTCCTGCGCCGACATCACCACGCTCGCCACGCGTGACGCCATCGTCGCCTCCGGCGGGCCCTACTTCGAC
GTGCCTCTGGGGCGGCGCGACGGGCTGGCACCGGCGTCGAGCGACAAGGTGGGCCTCCTGCCGGCGCCCTTCTTCGACG
TGCCCACGCTCATCCAGGCGTTCAAGGACCGAAACCTGGACAAGACGGACCTGGTGGCGCTGTCCGGCGCGCACACCAT
CGGACTAGGCCACTGCGGCAGCTTCAACGACCGCTTCGATGGCTCCAAGCCCATCATGGACCCTGTGCTGGTGAAGAAG
CTGCAGGCCAAGTGCGCCAAGGACGTGCCGGTGAACTCGGTCACGCAGGAGCTGGACGTCCGCACGCCCAACGCCTTCG
ACAACAAGTACTACTTCGACCTCATCGCCAAGCAGGGGATCTTCAAGTCCGACCAGGGCCTCATCGAGGACGCGCAGAC
CAACCGCACCGCCGTCCGCTTCGCCCCTCAACCAGGCCGCCTTCTTCGACCAGTTCGCACGCTCCATGGTCAAGATGAGC
CAGATGGACGTCCTCACCGGCAACGCCGGCGAGATCCGCAACAACTGCGCCGCTCCCAACCGCCGCTCCTCCGACCTCC
TCAACGCTGCCGACGA

> SEQ ID NO: 7124 27507 187272_300675_1b
GCCTCCACTTCCATGACTGCTTCGTCCAGGGGTGCGACGCGTCGATCTTGCTGGACAACGCCGGGAGCGAGAAGACGGC
GGGGCCGAACCTATCGGTGGGGGGATACGAGGTGATCGACGCCATCAAGACGCAGCTGGAGCAGGCGTGCCCCGGGGTG
GTGTCGTGCGCGGACATCGTGGCGCTCGCCGCGCGCGACGCCGTCGTACCAGTTCAAGGCGTCGCTGTCGTGGCAGGTGG
AGACCGGGAGGCGCGACGGGCCCGTGTCGCTGGCGTCCAACACCGGCGCGCTGCCGTCGCCGTTCGCCGGGTTCAGCAC
GCTCCTCCAGAGCTTCGCCAACCGCGGGCTCAACCTGACCGACCTCGTCGCGCTCTCCGGCGCGCACACCATCGGCAAG
GCCAGCTGCTCCAGCGTCACGCCGCGGCTGTACCAGGGGAACACCACCTCCCTCGACCCGCTGCTCGACTCCGCCTACG
CCAAGGCGCTCATGTCGTCGTGCCCCAACCCGTCGCCGTCGTCGTCCACCATCGACCTCGACGTCGCCACGCCGCTCAA
GTTCGACAGCGGTTACTACACCAACCTGCAG

> SEQ ID NO: 7125 27507 175019_300529_1b
CCCACGCGTCCGCCCACGCGTCCGCGACGTTCTACGCCTCGTCGTGCCCGACCGCGCTGTCGACGATCAGGAGCGCCGT
GAACGCGGCGGTGGCCAGGGAGCCCCGCATGGGCGCCTCCCTGCTCAGGCTCCACTTCCACGACTGCTTTGTCCAAGGA
TGCGACGCGTCGATACTGCTGGCCGACAATGCCACCTTCCGGGGGAGCAGGGTGCGTTCCCTAATGTCAACTCGCTGA
GGGGATTCGAGACTCTGTCGTACTTGCCGCCATTGACAGTGGAGGACCTTTTGAAGCAGATCGAGTACCTGCTCCGATC
TAAGTGGGTGCCTTGCTTGGAGTTCAGCAAGGTCGGATTCGTCTACCGTGAGAATCACAGATCACCCGGATACTATGAC
GGTAGGTACTGGACCATGTGGAAACTGCCCATGTTTGGATGCACCGATGCCACCCAAGTGCTCAAGGAGCTCGAGGAGG
CAAAGAAGGCATACCCTGATGCCTTCGTTCGTATCATTGGCTTTGACAACGTTAGGCAGGTGCAGTTAATCAGCTTCAT
CGCGTATAAGCCACCGGGTTGCG

> SEQ ID NO: 7126 30367 130221_300486_1b
GATCCAGTTCAAAAGTCCACCAACCCCCCCACTGCAGAAGCATCTTTGAAGTTCTTGATATATGGTAGAACAGGGTGGA
TTGGAGGTCTCCTTGGCAAGATCTGTGAGAAACAGGGTATAGCATATGAGTACGGAAGCGGGCGTCTGGAGGAAAGGTC
CACGCTGGTGCTGATATTCGGAAGGTCAAGCCTACTCATGTTTTCAATGCTGCTGGTGTGACTGGTGACCCAATGTT
GACTGGTGCGAGGATCACAGAACTGAGACAATAAAAACCAATGTTACTGGTACCTTGACCTTGGCAGATGTTTGTAGAC
AGAATGGATTGCTGATGATGAACTTTGCTACTGGCTGTATCTTTGAATATGATGCTGAACACCCAGAAGGATCAGGTAT
CGGATTCAAGGAGGAAGACACACCCAATTTCGCTGGTTCATTCTACTCAAAGACCAAGGCCATGGTTGAAGAGCTGTTG
AAGGAATATGACAATGTTTGCACTCTCAGAGTCCGCATGCCCATTTCCTCAGACCTTAGCAACCCACGTAACTTCATTA
CAAAGATCAGCCGTTACAACAAGGTTGTTAATATTCCAAACAGTATGACAGTCTTGGATGAACTTCTTCCAATTGCAGT
AGAGATGGCCAAGAGGAATTTGAGAGGTATTTATAACTTTACAAACCCTGGTGTTGTGAGTCATAACGAGATC

> SEQ ID NO: 7127 30367 155251_301354_1b
TCGACCACGCGTCGTTCTCTTCAGATTCACTCTTCTCTCTCTCTTTTTCTCCATATATTATGGGTTTCCCAGCTAACAG

FIG. 2 continued

```
CGAAAAGCCATTCAAGTTCTTGATCTATGGCCGCACCGGCTGGATTGGTGGCGTACTCGGCAAGCTCTGTGAAGCTCAA
GGTATAGACTACGTATACGGGTCGGGTCGGTTAGAAAACCGGAGCTCTTTGGAATCCGACATATCCACCATCAAACCGA
CCCATGTATTCAACGCAGCTGGAGTCACTGGCCGGCCTAACGTTGATTGGTGCGAATCCCATAAGGTGGAGACCATCAG
AACTAATGTGGTCGGCACTCTCACGCTTGCTGATGTTTGTAGAGAGAAGGGCTTGATCCTTATCAACTATGCTACTGGA
TGTATATTTGAATACGATGCGGGTCATCCGTTAGGGTCGGGTATCGGGTTCAAGGAAGAGGATACTCCTAATTTCACTG
GATCTTTCTATTCCAAGACTAAAGCTATGGTGGAGGAATTGCTGAAGAACTATGACAACGTCTGTACTTTACGAGTCAG
GATGCCCATCTCCGCTGACTTGACAAACCCGCGAAACTTCATCACCAAGATCACTCGATACGATAAGGTTGTCGATATC
CCAAACTCAATGACAATCTTGGATGAACTTCTCCCAATATCACTCGAGATGGCAAAGAGAAACTTGACTGGCATATGGA
ACTTCACAAATCCCGGTGTTGTTAGCCATAATGAGATTCTTGAAATGTACCGGGACTATGTCGACCCGAGCTTTAGTTG
GAAAAATTTCACTCTTGAGGAGCAAGCAAAGGTCATTGTTGCTCCAAGGAGTAACATGAGCTTGATGCTTCCAAACTG
AGCAAGGAATTCCCTGAAATGAAGTCAATCAAAGAGTCCCTCATTGAGTATGTTTTCAAGCCAAATAGGAAAACACCAG
TGGCTTGAAACGTTGAGAAAAACTTCATTTTATTTTTGTTTTGCCTTGTTGAACGAATCAACTATGTTTCAAGTTCTA
ATAGCTGGGTTTGCCTTGTCTTTTTCTTGTCATTTTCTTATTTTGAGTTTCTTTGGGAAGATGTGAACTCCCTGTCAT
AGGAGGTGGAGGTGCAACTTTTTCCTGTTTCTTTTCTTTTCCTTTTTTGTTGTATTGAATGTTGTAATGGTATTTATTT
CACGAATAAATTGAAAATGATATGCCAATTGGATGATAGG

> SEQ ID NO: 7128  30367  238151_301292_1b
GGAGGCGGCGCCATGGTTGTTCCTCTCAGTAGCAACGCCACCAACGGATCCGGCGGCGCCGCCTTGAAATTCCTGATCT
ACGGCCGCACGGGATGGATCGGGGGTCTCCTGGGGGACCTCTGCCGCGACCAGGGCATAGATTTCGCCTACGGATCGGG
GCGGCTGGAGGATAGGGCGGGATTGGAGGCGGACATCGCGGCGATCAAGCCGTCGCATGTGATGAATGCCGCCGGGGTC
ACCGGGCGCCCCAACGTGGATTGGTGCGAGGACCACCGGGCGGAGACGATCCGGTCCAATGTGGTGGGCACGATCAATC
TGGCGGATGTGTGCCGCAGCCATGGATTGCTGCTCGTGAATTTCGCCACGGGATGCATCTTCGAGTACGATCAGGGGCA
CCAGATCCACAGCGGCCTTGGATTCACCGAGGAGGATTCTCCAAATTTCGTGGGATCGTTCTACTCCAAGACCAAAGCC
ATGGTGGAAGAGCTGCTCAAGAACTATGAAAACGTCTGTACGCTTCGTGTGCGAATGCCGATCTCCAGCGACCTCTCCA
ATCCCCGCAACTTCATCACCAAGATCACTCGCTACGAGAAGGTGGTAAACATCCCGAATTCGATGACTGTTCTGGACGA
GCTGCTGCCGATCTCGATCGAGATGGCCAAGCGCAAC

> SEQ ID NO: 7129  30518  286371_200108_1b
GAAAACCCAAAACCTCATAAAACACAAGAGAATTAAAATTCAAAAGCAAAATGAATCATTCTATTTATACAGAGTTGCT
GCCGGCGAATTTTCCGGGAGACTTTCCGGTGTACCGCCGAAATTCAAGCTTCAGTCGTCTAATTCCATGCTTAACTGAA
ACATGGGGCGAATTACCACTAAAAGTCGACGATTCTGAAGATATGGTAATTTATACTCTCTTAAAGGACGCTCTTAACG
TCGGATGGTCGCCCTTTAATTTTACCGCCGGCGAAGTAAAATCGGAGCCAAGGGAGGAGGAAATTGTGGTTTCCCCGGC
GGAGACAACAGCCGCGCCGGCGACTGAGATACCGAGGGGAAGGCATTACAGAGGTGTTAGACGACGGCCGTGGGGGAAA
TTTGCGGCGGAGATTAGAGATCCGGCGAAGAATGGAGCTAGGGTTTGGCTTGGAACATACGAAACAGATGAAGAAGCTG
CAATTGCTTATGATAAAGCGGCTTATAGAATGCGCGGTTCAAAGGCTCATTTAAATTTCCCACATAGAATCGGTTTAAA
TGAACCGGAACCGGTTCGAGTCACGGCGAAAAGACGAGCATCGCCTGAACCGGCTAGTTCGTTGGAAAATAGTTCACCT
AAACGGAGAAGAAAAGCTGTTGCAGCTGAGAAATCTGAAGCAGTAGAAGTGGAGAGTGAATC

> SEQ ID NO: 7130  30518  55864_300130_1b
CCCACGCGTCCGCGGACGCGTGGGTTCTCTCTTTCGTAAAAATGGCGAGTTTTGAGGAAAGCTCTGATTTGGAAGCTAT
ACAGAGCCATCTCTTAGAAGACTTGTTGGTTTGTGATGGTTTCATGGGAGATTTTGACTTCGATGCTTCTTTTGTCTCA
GGACTTTGGTGTATAGAACCACACGTTCCTAAACAAGAACCTGATTCTCCAGTTCTTGATCCGGATTCTTTCGTCAACG
AGTTCTTGCAAGTGGAAGGGGAATCATCATCATCATCATCACCAGAGCTGAATTCATCGTCATCAACATATGAGACTGA
TCAGAGTGTGAAAAAGGCAGAGAGGTTCGAAGAAGAAGTAGATGCTAGACATTACCGAGGAGTGAGGCGAAGGCCGTGG
GGGAAATTTGCAGCAGAGATTCGAGATCCAGCAAAGAAAGGATCAAGAATCTGGCTAGGAACATTTGAGAGTGATGTTG
ATGCTGCAAGAGCCTATGACTGTGCAGCTTTCAAGCTCCGGGGAAGAAAAGCCGTGCTCAACTTCCCTCTTGACGCCGG
GAAATATGAAGCTCCAGCGAATTCAGGAAGGAAAGGAAGAGAAGTGATGTGCATGAAGAGCTTCAAAGAACTCAGAGC
AATTCATCTTCATCTTCCTGTGATGCATTTTAGCATATTAAGAGTGTGAGCAGTTTCCTTAAGTTGTATAAAGTAATTG
TACAGAGGAAACGAATTGTGTAGGTTTAGTGTGCTTGCAAGTTGCAACAAATGTGTATGGATGTTCTGTTTCTTCATGT
CCCTAAGATTTAGAAACATCTTCTTATTTCCA

> SEQ ID NO: 7131  30518  6495_300392_1b
TGGAAATAAGAAGATGTTTTTAAATCTTACGGACGTGAAGAAACAAAACATCCCTCCCCATTTGTTGCAACTTGCAAGC
ACACTAAACCTACACAATTCGTTTCCTCTGTACAATTACTTTATACACCTTAAGGAAACTGCTCACACTCTTAATATGC
TAAAATGCCTCACAGGAAGATCAAGATAAATCGCTCTGATTTCTTTGAAGCTCTTCATGCACATCACTTATCTTCCTTT
TCCTTCCTGAATTCACTGGAGCTTCATATTTCCCGCCGTCAAAAGGGAAGTTGAGCACGGCTTTTTTCCCCGGAGCTT
GAAAGCTGCACAGTCATAGGCTCTTGCAGCATCAACATCACTCTCAAATGTTCCTAGCCCAGATTCTTGATCCTTTCTT
TGCTGGATCTCAAATCTCTGCTGCAAATTTCCCCCACGGCCTTCGCCTCACTCCTCGGTAAT
```

FIG. 2 continued

> SEQ ID NO: 7132 30518 30874_300389_1b
ATACAATCAATAAATTTATAACATCAACAAATACAAAATTAAATTTATATTTTCAACATCCAAATATTCTACTAAAAAA
AATAATGAATAAAATGATTGGTACTAATTAAACTACTTATTTGATATTTGCACACTACCGCTACCTTTATATTATACAA
GAATAAATGAAATCATGAGAGTGACGCAAGTGAAAACGTCATCGTACGTTGACTTTTCCGAAGTTTTAAGTGACGGAGA
TAACGGAAAAGTTGGGAGACGTCGGAGATAACGGAGGAATACTGAAAATACCATCTCCTGCTCCCACATCCCAAAACCC
CATCCAACTTGACGGCGTCAATGGTACCACCGGCTCAACCTCAGCCTCCGTCGTCTCCGACGTATTACTCTCTTCTTCC
TCCACTTTAACCCTAGCCGCCTTCTCCTCTTCCGGCGGAGAACCCTTATCTCGCTTTCGTTTCCCTAATCCGATAACTC
CTTCCCCAGAACAAGTTTCTGACGTAACCCTAACATCGAGAGGGAAATTCAAGATTGCTTTTCTTCCACGTAATTGAAA
CGCCGCTTGGTCATAAGCTCTTCCAGCTTCCACGGCAGTGTCGTAAGTCCCAAGCCAGATCCTACAACCCTTTTTGTTC
GGATCCCTAATCTCCGCCGCGTATTTTCCCCACGGTCTTCGTCTCACTCCCCTGTAGTGCCTCTCTTCTTCCTCTTTCT
CTGTCTTTGTTGAAACCGTTCTCGAGACGGATAGATTCGGTAAGGGCGGTTTACGCTGGTTAAGAGTCGAATTCGGCCC
CAGGGGATTGGTTGGTGATGGTTCTAGCGGACGCGTGGG

> SEQ ID NO: 7133 3054 142217_300433_1b
AAGAAGGGTGCAAGAGTTGTAGTAGCAAATCGTACCTACGGAAAAGCAGTAAGTCTTGCTGCTGCAGTGGGTGGTCATG
CCCTGAGATTAGCCGAGCTTGAAACTTTCAGGCCTGAAGAAGGGATGATCCTTGCTAATGCGACATCATTGGGAATGTA
CCCCAATGTGGACGGCACCCCTATCCCAAAGAAAGCATTAAGCTTCTATGATGTTGTATTTGATGCGGTATATGCCCCG
AAAGTTACCCGGCTTCTACGAGAAGCAGAAGAATGTGGGATTAAAGTTGTCAGCGGTGTAGAGATGTTTGTCAGACAAG
CCATGGGTCAGTTTGAGCATTTCACAGGTGGTATTGAAGCCTCCTGAAAGCCTGATGCGTGAGATAGCTGCCAAATACAC
ATAACAGGCGAATGGCGAAGCGACGGTTGTGAGTAATTAGCCCAAATATTCCTCTGGGTTAAGTTAATAAAAGTTTTGG
ATGCCAGCCCAATTTTGTGCTAGGTGGAGATTAGTTGTTGTAATGTTCGATTTCGCCGACTTAACCTGTCAGAGATGTA
AACAGAAAGTGTTCAATCTCATCATACTTGCAATAAAGAATTTGCATGCATAACTGCGT

> SEQ ID NO: 7134 3054 156466_301366_1b
GGGGTTTCGGCTCCGGGGCAACCAACAATTAAAGATCTTTTGAATATATACAATTTCAGACAGTTGGGACCAGATACCA
GAGTATTTGGCATTATCGGGAAGCCTGTTAGCCATAGCAAATCACCTTTATTGTATAATGAAGCTTTCAGATCAGTTGG
GTTTAATGGTGTTTATATGCCTTTGCTGGTTGATGATGTTGCAAATTTCTTTCGGACTTACTCATGTTTAGATATTGCT
GGCTTCAGCTGTACAATTCCTCACAAGGAAGCCATTGTCGACTGCTGTGATGAAATTGATCCTACCGCTAAGTTAATAG
GGGCTGTCAATTGTGTCGTAAGGCGACCTGATGGGAAATTGTTTGGTTGCAATACAGACTATGTGGGTGCAATCTCCGC
CATTGAAGAAGCGTTGCAAGGCTCACAGCCTAGTATGTCTAGGTCTCCCTTAGCTGGTAAATTATTTGTGGTCATTGGT
GCTGGCGGCGCTGGCAAGGCACTTGCTTATGGTGCAAAGGAAAAGGGGGCTCGGGTGGTGATTGCTAACCGTACCTATG
AACGAGCGAGAGAACTTGCTGATGTAGTTGGAGGGCAGGCTTTGTC

> SEQ ID NO: 7135 316712 282118_200072_1b
AAAAATGTGACTTTTGGTCAAAATATTGATTCACATGCACTGAGTTCTTCCCGGATAGATCTGAAGTGCAATGCCTGCA
TCGATGGCAAAAGGTTCTCAATCCGGATCTTGTCAAAAGACCATGGACTCGGGAGGAGGATGATAAGATCATTGAACTG
GTCGCCAAGTATGGGCCTATGAAATGGTCTGTCATAGCTAAATCATTGCCTGGTCGATAGGGAAGCAATGTCGAGAGGT
GGCACAATCATTTGAATCCCAATATAAAAAAAGATGCTTGGACACTGAAGGAGGAACGAGCACTCATAGATGCTCATCG
GATCCATGGTAACAAGTGGGCTGAAATTGCTAAGGTCCTGCCCGGGAGGACTGATAATGCAATCAAGAATCACTGGAAT
AGCTCTTTAAGGAAGAATAGACTTTTATTTAGCTACTACTGGAAACCTTCCACCTGCTACCAGGGACAGCCAGGAAAAT
GGTTTTAAGGACACTACTGAAACAGCTAAAGCTGAAGAGTCACTTGTAGCTTCATCAGGAACTGCAGATATGTGTAAAA
TAGAAAATGGATGGCAGGTCACAGAAATCAGTGCT

> SEQ ID NO: 7136 316741 284786_200101_1b
GTAAGTTTCTTTCTAGGAAAATCCGCAACAAACAAATTATCCCAAGAAAATAATAACTTAGCAAAAAGAATGTGCGGTG
GTGCCATAATCTCCGACTGCATACCCCCAACCCGATCATCCCGCCGACTCACCGCCGACTTGTTATGGGGTTGCTCCGA
TCTGAACCAAAAGAAGAATCCTTTTAGTTACGAATACTCGAAGCCGTTGAGATCTGAGGTTGCTGATTTAGGTATTGAT
TTTGAGGCTGACTTTCAGGACTTTAAGGACTGCTCTGATGATGAGGAGGACTCTTACAAGGTGGACGGACTCAAGCCAT
TTGCTTTTTCTGCTCCTGAACAGTCTGGAGCTCTCGTTGGCTCCAAATCCTTGAAATCTGTTGATTCAGACATGGAAGT
TGAGAAGTCTTCCAAGAGAAAGAGGAAGAATCGGTATAGGGGGATCAGACAGCGTCCTTGGGGTAAGTGGGCAGCCGAA
ATACGTGATCCACAGAAAGGGGTCCGAGTCTGGCTTGGAACTTTCAATACTGCAGAAGAAGCTGCCAGAGCTTATGATG
TTGAAGCTCGGAGGAT

> SEQ ID NO: 7137 316741 316805_301427_1b
GCAGCATGCCCCTCTCGTCACCAAGGCCAAGGGCCGTAAACTCACGGCTGAGGAACTCTGGTCAGAGCTCGATGCTTCC
GCCGCCGACGACTTCTGGGGTTTCTATTCCACCTCCAAACTCCATCCCACCAACCAAGTGAAGAAGGAGCAGGCAACAG
AGCCGGGGAAACGGAGGAAGAGGAAGAATGTTTATAGAGGGATACGTAAGCGTCCATGGGGAAAATGGGCGGCTGAGAT

FIG. 2 continued

```
TCGAGATCCACGAAAAGGTGTTAGAGTTTGGCTTGGTACGTTCAACACGGCGGAGGAAGCTGCCATGGCTTATGATGTT
GCGGCCAAGCAGATCCGTGGTGATAAAGCCAAGCTCAACTTCCCAGATTGCACCATCCTCCTCCCCTAA
```

> SEQ ID NO: 7138 316741 263667_301731_1b
```
GCAGCATGCCCCTCTCGTCACCAAGGCCAATGGCCGTAAACTCACGGCTGATGAACTCTGGTC
```

> SEQ ID NO: 7139 316762 23975_300105_-1b
```
CCCACGCGTCCGTTTTGAAATCTCAACAAGAACCAAACCAAACAACAAAAAAACATTCTTAATAATTCTCTTTCTGTTA
TGTCGATGACGGCGGATTCTCAATCTGATTATGCTTTTCTTGAGTCCATACGACGACACTTACTAGGAGAATCGGAGCC
GATACTCAGTGAGTCGACAGCGAGTTCGGTTACTCAATCTTGTGTAACCGGTCAGAGCATTAAACCGGTGTACGGACGA
AACCCTAGCTTTAGCAAACTGTATCCTTGCTTCACCGAGAGCTGGGGAGATTTGCCGTTGAAAGAAAACGATTCTGAGG
ATATGTTAGTTTACGGTATCCTCAACGACGCCTTTCACGGCGGTTGGGAGCCGTCTTCTTCGTCTTCCGACGAAGATCG
TAGCTCTTTCCCGAGTGTTAAGATCGAGACTCCGGAGAGTTTCGCGGCGGTGGATTCTGTTCCGGTCAAGAAGGAGAAG
ACGAGTCCTGTTTCGGCGGCGGTGACGGCGGCGAAGGGAAAGCATTATAGAGGAGTGAGACAAAGGCCGTGGGGAAAT
TTGCGGCGGAGATTAGAGACCCGGCGAAGAACGGAGCTAGGGTTTGGTTAGGAACGTTTGAGACGGCGGAGGACGCGGC
GTTGGCTTACGACAGAGCTGCTTTCAGGATGCGTGGTTCCCGCGCTTTGTTGAATTTTCCGTTGAGAGTTAATTCAGGA
GAACCCGACCCGGTTCGAATCAAGTCCAAGAGATCTTCTTTTTCTTCTTCTAACGAGAACGGAGCTCCGAAGAAGAGGA
GAACGGTGGCCGCCGGTGGTGGAATGGATAAGGGGTTGACGGTGAAGTGCGAGGTTGTTGAAGTGGCACGTGGCGATCA
TTTATTGGTTTTATAATTTTGATTTTTCTTTGTTGGATTATATGATTCTTCAAAAAAGAAGAACGTTAATAAAAAAATT
CGTTTATTATT
```

> SEQ ID NO: 7140 316828 316857_301427_1b
```
GCAGCATGGGAAGAGCACCGTGTTGTGATAAGGCCAACGTGAAGAAAGGGCCTTGGTCTCCTGAGGAAGACGCCAAACT
CAAAGATTACATCGAGAATAGTGGCACAGGAGGCAACTGGATTGCTTTGCCTCAGAAAATTGGTTTAAGGAGATGTGGG
AAGAGTTGCAGGCTAAGGTGGCTCAACTATCTGAGACCAAACATCAAACATGGTGGCTTCTCCGAGGAAGAAGACAACA
TCATTTGTAACCTCTATGTTACTATCGGTAGCAGGTGGTCTATAATTGCTGCACAATTGCCGGGAAGAACCGACAACGA
TAT
```

> SEQ ID NO: 7141 316834 263246_301723_1b
```
GCAGCATGAACAAAGGAGCTTGGACTAAAGAAGAAGATCAGCTTCTTGTTGATTACATCCGTAAACACGGTGAAGGTTG
CTGGCGATCTCTCCCTCGCGCCGCTGGATTACAAAGATGTGGTAAGAGTTGTACATTGAGATGGATGAATTATCTAAGA
CCAGATCTCAAAAGAGGCAATTTTACTGAAGAAGAAGATGAACTCATCATCAAGCTCCATAGCTTGCTCGGTAACAAAT
GGTCTTTAATAGCTGGGAGATTACCAGGAAGAACAGATAACGAGATCAAGAACTATTGGAACACTCATATCAAGAGGAA
GCTTCTCAGCCGTGGGATTGATCCAAACTCTCACCGTCTGATCAACGAATCCGTCGTGTCTCCGTCGTCTCTTCAAAAC
GATGTCGTTGAGACTATACATCTTGATTTCTCTGGACCGGTTAAACCGGAACCGGTGCGT
```

> SEQ ID NO: 7142 316834 263259_301723_1b
```
GCAGCATGGTGAGGCCTCTTGTTGTGACAAAGGAGGAGTGAAGAAAGGGCCATGGACTCCTGAAGAAGATATCATTTTA
GTCACTTACATCCAAGAACATGGTCCTGGTAATTGGAGAGCTGTTCCTACCAATACTGGGCTGCTTAGATGCAGCAAGA
GTTGTAGACTTAGATGGACAAACTATTTAAGGCCAGGAATCAAAAGAGGCAATTTCACAGAACATGAAGAAAGATGAT
TGTTCATCTCCAAGCCCTCTTAGGAAATAGATGGGCTGCAATTGCGTCATATCTTCCACAAAGGACAGACAATGACATT
AAGAACTATTGGAACACTCATTTGAAGAAGAAACTCAACAAAGTCAATCAAGATTCTCATCAAGAACTTGACCGTTCCT
CGCTCTCATCTTCACCATCGTCTTCTTCTGCTAATTCCAACTCAAACATCTCAAGAGGCCAATGGGAAAGGCGACTTCA
AACCGATATCCACTTGGCGAAAAGGCTCTCTCTGAGGCTTTATCTCCTGCCGTTGCACCAATCATTACATCTACAGTG
ACAACAACGTCTT
```

> SEQ ID NO: 7143 316834 316729_301426_1b
```
GCAGCATGGGGAGACAGCCATGCTGTGACAAGCTAGGGGTGAACAAAGGGCCGTGGACGGTGGAGGAACATACTAAGCT
TATCAACTTCATACTAACCA
```

> SEQ ID NO: 7144 316834 152957_200081_1b
```
AACCCAAACACAACAAGTCCATTTTCAAAATTTCCCTTAACTATCTTTCTTGTTGTGGTTATTTTTGCAAAATGGAATT
TTTTAACAGGTGTTCGACATCTACTACTTCATCTTCATGTGAATCATCTTCATCTGAATCTTCACTTTCTGGTAAAACA
CCAAGAGATGGGAAAAAATCCGAGAGAATAAAGGGACCGTGGAGTGCTGAAGAGGACAAGATTTTAACTAAACTTGTTG
AGCGATATGGGCTAGAAATTGGTCTTTAATTAGTAAATATATAAAGGGTAGGTCTGGTAAATCTTGCCGGCTCCGATG
GTGTAATCAATTAAGTCCCAATGTGCAACACCGGCCATTTTCGCAAACTGAGGATGACACCATTTTGGCTGCTCATGCA
AAATATGGAAATCGTTGGGCTACTATTGCAAGATTACTTCCGGTCGAACCGATAATGCTGTTAAGAATCACTGGAATT
CGACACTAAAAGACGTTACCAACAGTTACTTCAGCAGCATCAGCAAAATCAGAGTTCAGTTGTTTTTTCTGATGTGAA
```

FIG. 2 continued

AATTAACGGGTCAGCATCGGGATCTGGGCCGTGCATGGATTATATGAATGCTAATGACAGTCCAATTAGAGGGAATTTT
CCTATTAATAATGCTGTTACGACTAATTGTAGCAGTGAATTTGATGACCCAATGACGA

> SEQ ID NO: 7145 316835 262516_301695_1b
GCAGCAATGAACTCATTTCAGGTTTTCCTGAAATGTCTGGCTCCGATGACGATCCTCAAGGCGGAGATCATAGTCCGAC
GTTGGGCACGAGTTGTCCGAAGAAACCGGCGGGCC

> SEQ ID NO: 7146 316835 262753_301749_1b
GCAGCATGCAAGACTCTTCCTCTCACGAATCGCAACGTAACCTCCGGTCACCGGTGCCGGAGAAAACCGGAAAGAGTTC
TAAGACTAAAAATGAGCAAAAAGGTGTTTCTAAACAACCAAATTTTCGTGGGGTCAGAATGAGACAATGGGGAAAATGG
GTGTCTGAAATTAGAGAACCAAGAAAGAAATCAAGAATATGGCTCGGTACTTTCTCTACGCCGGAGATGGCGGCGCGTG
CACACGACGTGGCGGCTTTAGCCATCAAAGGTGGCTCTGCCCACCTTAATTTCCCGGAGCTAGCTTACCATTTGCCGAG
ACCGGCTAGCGCGGACCCTAAAGACATTCAAGAAGCCGCCGCCGCAGCAGCTGCCGTTGACTGGAAAGCACCGGAGTCT
CCGTCTAGCACCGTGACGTCATCTCCAGTCGCCGACGACGCTTTCTCCGATCTTCCTGATCTTTTGCTTGACGTGAATG
ATCACAACAAAAACGATGGATTCTGGGACTCGTTTCCGTACGAAGATCCTTTCTTCTTGGAAAATTACTAGTAA

> SEQ ID NO: 7147 316847 316712_301426_1b
GCAGCATGATGTGTAGTCGAGGCCATTGGAGACCTGCAGAAGACGAGAAGCTAAGAGAACTCGTCGAACAATTTGGTCC
TCATAATTGGAACGCCATAGCTCAGAAGCTCTCTGGTCGATCTGGTAAGAGTTGTAGATTGAGATGGTTTAATCAATTG
GATCCTAGGATTAACCGAAACCCTTTCACGGAGGAAGAAGAAGAAAGGCTTTTAGCGTCTCATCGGATCCATGGGAACA
GATGGTCTGTGATCGCTAGATTTTTTCCCGGTCGAACTGATAACGCTGTTAAAAACCATTGGCACGTCATCATGGCTCG
TCGTGGCCGAGAACGGTCCAAGCTCCGTCCACGAGGCCTTGGCCATGATGGCACGGTGGCTGCGACTGGGATGATTGGT
AATTATAAAGACTGCGATAAGGAGAGAAGATTGGCAACCACAACCGCTATCAATTTTCCTTATCAATTCTCTCATATTA
ATCATTTTCAAGTCCTCAAAGAGTTCTTGACCGGAAAGATCGGGTTCAGAAATAGTACTACTCCAATACAAGAAGGAGC
AATAGACCAAACTAAACGACCGATGGAGTTCTACAATTTTCTTCAAGTAAACACGGATTCGAAGATACACGAATTGATA
GATAATTCAAGAAAAGAC

> SEQ ID NO: 7148 316847 263337_301724_1b
GCAGCATGGCTGATAGGATCAAAGGTCCATGGAGTCCTGAAGAAGACGAGCAGCTTCGTAGGCTTGTTGTGAAATACGG
TCCAAGAAACTGGACAGTGATTAGCAAATCTATTCCCGGTAGATCGGGGAAATCGTGTCGTTTACGGTGGTGCAACCAG
CTTTCGCCGCAAGTTGATCATCGGCCGTATGCGGCTGAGGAAGACGACACGATCGCACGTGCTCACGCTCAGTTCGGTA
ATAAATGGGCGACGATTGCTCGTCTTCTCAACGGTCGTACGGACAACGCCGTGAAGAATCACTGGAACTCGACGCTCAA
GAGGAAATGCGGC

> SEQ ID NO: 7149 316860 3870_300324_1b
CCCACGCGTCCGGCATCAGAATGGGTTACAATGACTTTGGAGATTTCTATTACGCATGTGGTATGCTCGGAGATGCTTT
CAAGAACTATATCCGAACACGCGACTACTGCACTACGACAAAGCACATCATTCACATGTGTATGAATGCGATTCTTGTC
AGCATCGAAATGGGTCAGTTTACTCATGTTACAAGCTATGTGAACAAGGCAGAGCAGAATCCTGAAACCCTTGAACCTA
TGGTTAATGCAAAACTGCGATGTGCATCTGGATTGGCTCATTTGGAGTTGAAGAAGTACAAGCTAGCTGCTCGTAAGTT
CTTAGATGTTAACCCAGAACTTGGAAATTCCTATAATGAAGTCATTGCTCCTCAAGATATTGCCACCTATGGTGGACTC
TGTGCCCTGGCAAGCTTTGATCGATCAGAATTGAAGCAAAAAGTCATTGACAATATCAACTTCCGGAATTTCTTGGAGC
TAGTGCCTGATGTGAGGGAACTTATCAACGATTTCTA

> SEQ ID NO: 7150 316860 183186_300619_1b
AACAGATCTACACCTACAGATCGGTGCTCTGCTCGCAGCTTCAGCTAGGGAACAGTTCCAATCACACATCGCGACTGGC
CACACCGGATGTGCTACACGCATCATTCTTCCTCTTCCTCTTCTTAGGTCGCTTCTCTTCGCTCTGCCCACTTGCTAAA
CCATACCGGCGATAAACGTGGAGCTCCATGGCGGCCTCGGCCGCGCAGAGCAACAGTGCCCGCCGTCGGATGGAAGCC
CAGAGTCGTCGGAGGCGGCGAAGAGGCTGAACACGCGCGCGGCCTTGTTCAGGGCCACCGGCTTCGACGACACCACCTC
GCCTCTCACCGCCCTCATCGCCGCCGCCGCCGCCGCCGCAGCTCGAGCACTCGTCCTCCCCAACGTTGAGACCAACCTT
ATCAAAGAGAGCATCAGAATGGGTTACAATGACATTGGTGATTTCTTCTATGCTCATGGCCACCTTTCAGATGCCTTCA
AAAGCTACATCCGTACACGTGATTATTGTACCACTTCCAAGCATATAGTTCAGATGTGTATGAATGTGATTCTGGTTAG
CATTGAGTTGGGACAATTTCCACATGTTTCCAACTATG

> SEQ ID NO: 7151 316860 257286_301680_1b
GGATGGAGGGGGGCGATGCGAGCGGCAGCGCGGGCGGTGATCAGCTGGACCTGGAGGCGTACGCGGCGCTCTACTCGGG
GCGGACCAAGGTGACGCGCCTCTTCTTCATAGCTGACCACGCCAAGTCCCAGACGCTGGAGCTGGAGGCTCTGCGCATG
GCGCACAACGAGATACGCAAGTCGGACAACACGCTGCTGTACAAGGAGGCGGTGGACAAGATTGGTGGCCGCCTGGGCG
CCGCCTATGCTCTCGACCAGGAATGGGTGGATGTCGTCGATCGCAGGTCCTTGCAGCGCCAGGAGAAGCTCGACATGGA

FIG. 2 continued

```
GCTCAATGGTTACAAGACCAACCTGATCAAGGAGAGCATTCGCATGGGCTACAACGACCTGGGGGATTTTTACTACACC
CGCGGTGACCTGCAGCAGGCGTTCAAGTGCTACGTCCGGACTCGCGACTACTGCACCACCTCCAAGCACATAATTGCGA
TGTGCCTCAACGTCATTCTCGTCAGCATCGAGTTGGGCCACTTCGTGCACGTCTCCAACTACGTGACCAAGGCTGACCA
GACGCCGGACATCCAGGATCCTATCATTTTCGCCAAGCTCAAGTGTGCTGCGGGGCTGGCGTACCTGGAGAACAAGAAG
TACAAGCTTGCTGCTCGTAAGTTTGTGGATACCAATTTCGAGCTTGG

> SEQ ID NO: 7152  316861  207567_300806_1b
AAGCAATCCACCACTGCATCGGCGGCGAGGGCTCACCGGCGGCGAGCCATGTGCGGCGGCGCCATCATCCACCACCTGA
AGGGGCACCCGGAGGGGTCGCGCCGGGCGACGGAGGGGCTCCTGTGGCCCGAGAAGAAGAAGCCCAGGTGGGGCGGCGG
CGGGAGGCGCCACTTCGGGGGGTTCGTGGAGGAGGACGACGAGGACTTCGAGGCCGACTTCGAGGAGTTCGAGGTGGAC
TCCGGGGACTCGGATTTGGAGCTCGGGGAGGAGGACGACGATGACGTCGTCGAGATCAAGCCGGCCGCCTTCAAGAGGG
CCCTCTCCAGAGATAACTTGAGCACCATTACCACTGCCGGATTTGATGGTCCTGCTGCAAAGTCTGCCAAAAGAAAGAG
AAAGAACCAATTCAGGGGCATCCGCCAGCGCCCTTGGGGTAAGTGGGCTGCTGAAATCAGAGATCCTCGCAAGGGTGTT
CGTGTCTGGCTTGGCACTTTCAACAGTGCTGAAGAAGCTGCAAGAGCTTATGATGCTGAAGCACGCAGGATTCGTGGCA
AGAA

> SEQ ID NO: 7153  316861  263178_301722_1b
GCAGCATGCCCCTCTCGTCACCAAGGCCAAGGGCCGTAAACTCACGGCTGAGGAACTCTGGTCAGAGCTCGATGCTTCC
GCCGCCGACGACTTCTGGGGTTTCTATTCCACCTCCAAACTCCATCCCACCAACCAAGTTAACGTGAAAGAGGAGGCAG
TGAAGAAGGAGCAGCAACAGAGCCGGGGAAACGGAGGAAGAGGAAGAATGTTTATAGAGGGATACGTAAGCGTCCATG
GGGAAAATGGGCGGCTGAGATTCGAGATCCACGAAAAGGTGTTAGAGTTTGGCTTGGTACGTTCAACACGGCGGAGGAA
GCTGCCATGGCTTATGATGTTGCGGCCAAGCAGATCCGTGGTGATAAAGCCAAGCTCAACTTCCCAGATCTGCACCATC
CTCCTCCTCCTAATTATACTCCTCCGCCGTCATCGCCACGATCAACCGATCAGCCTCCGGCGAAGAAGGTCTGCGTTGT
CTCTCAGAGTGAGAGCGAGTTAAGTCAGCCGAGTTTCCCGGTGGAGTGTATAGGATTTGGAAATGGGGACGAGTTTCAG
AACCTGAGTTACGGATTTGAGCCGGATTATGATCTGAAACAGCAGATATCGAGCTTGGAATCGTTCCTTGAGCTGGACG
GTAACACGGCGGAGCAACCGAGTCAGCTTGATGAGTCCGTTTCCGAGGTGGATATGTGGATGCTTGATGATGTCATTGC
GTCGTATGAGTAA

> SEQ ID NO: 7154  316861  197221_300700_1b
GGCACTTCCGAGGCATCCGGCAGCGGCCATGGGGGAAGTGGGCGGCGGAGATCCGCGACCCGCACAAGGGCACGCGCGT
CTGGCTCGGCACGTTCAACACCCCGGAGGAGGCCGCACGCGCCTACGACGTCGAGGCGCGCCGCCTCCGCGGCAGCAAG
GCCAAGGTCAACTTCCCCGCCACGCCCGCCGCCGCGCGCCCACGCCGCGGCAACACGAGAGCCACCGCCGTGCCACCGC
CGGCGACAGCACCCGCCGCCGCCCCGCCGCGCGGACTGAAGCGAGAATTCTCGCCGCCTGCTGAGACCGCGCTACCTTT
CTTCACCAACGGCTTCGTCGACCTGACGACCGCCGCGGCGCCGCCACCGGCCATGATGATGACGAGCTCCTTCACCGAC
AGCGTCGCCACGTCGGAGTCCGGCGGGAGCCCCGCCAAGAAGGCGAGGTCCGACGACGTCGACTCGTCCGAGGGCAGCG
TCGGCGGCGGCAGCGACACGCTGGGTTTCACCGACGAGCTGGAGTTCGACCCGTTCATGCTGTTCCAGCTCCCCTACTC
CGACGGCTACGAGTCCATCGACAGCCTCTTCGCCGCCGGCGACGCCAACAGCGCGAACACCGACAT

> SEQ ID NO: 7155  316861  270691_200127_1b
CAAAAAGAAAAAAATTTACAAAAACGAAACTGATTTCTGCATAAAACTTTTCTGCTGAGAGAAAACAAAAAGCATGTGT
GGTGGTGCTATAATCTCCGATTACACTGCCCCGAGCCGGACTTCTCGCCGGCTCACCGCCGAGTTGCTATGGGCCGAT
CCGATCTGAGCAATAAGCAAAATTTTTTTAACAATTATCACTCCAAGCGGTTGAGATCCCAAGTAGTTGACCTTGACGA
TGACTTCGAGGCTGATTTTCAGGACTTCAAAGATTTCTCCAATGATGAGGATGTTCAAGTCGATGTCAAGCGATTTGCC
CTCTCTGCTTCGAAAAACTCTACTGTTGAAGGCTCCAAATCTATGAAAACGGTTGATTCAGACAAGGATGCTGATAGAT
CCTCTAAGAGAAAGAGGAAGAATCAGTATAGGGGGATCAGACAGCGACCTTGGGGTAAGTGGGCAGCTGAAATACGTGA
CCCAAGAAAAGGAGTTCGGGTCTGGTTGGGAACTTTCAATACTGCAGAAGAAGCTGCCAGAGCTTATGATGTCGAGGCA
AGGAGGATCAGAGGTAATAAAGCTAAGGTAAACTTTCCCGATGAAGCTCCAGTGCCTGCCTCAAGACGTACTGTTAAGC
TGAATCATCAGAAGGGCCTTCCTAAGGAGAGCCTGGACTCTGTTCAGCCCGACTCAACTATCATGAATAACA

> SEQ ID NO: 7156  316861  6151_300329_1b
CCCACGCGTCCGCGTTCGAATTTCTTCGATTTTGACGCTGAGTTCGAAGCTGATTTCCAAGGTTTCAAAGATGATTCGT
CTATCGATTGCGATGATGATTTCGACGTCGGTGATGTTTTCGCCGATGTGAAACCATTCGTTTTCACTTCGACTCCAAA
ACCCGCCGTCTCCGCCGCTGCGGAAGGTTCAGTTTTTGGTAAGAAAGTTACTGGCTTGGATGGGGACGCTGAGAAATCT
GCAAATAGGAAGAGGAAGAATCAGTACCGAGGGATTAGGCAACGTCCTTGGGGAAAATGGGCTGCTGAGATACGTGATC
CAAGGGAAGGTGCTAGAATCTGGCTTGGAACGTTCAAGACAGCTGAGGAAGCTGCTAGAGCTTACGATGCTGCAGCGCG
GAGAATCCGTGGATCTAAAGCTAAGGTGAATTTCCCTGAAGAAAACATG

> SEQ ID NO: 7157  316861  1044152_301886_1b
```

```
TTCTTGGCCATAGCCGTATATACGAGCTGAGAAATCGTCAAAATGTGTGGTGGATCGATCATTTCGACCTTGTCGCTTC
CTGATAGGGGTAAGGCCTCCCTCGCCAAACCTCCTCTTCTTACCTTCCCCCCTGATGATGACTTGGAATGGCTCTGTGG
CCTGCCTGAATCCGAATCCATCAATGATGACGGATTCTTCCGCAAATTTCTCGATTCCAATAGTGAACTGCAGCAGGAC
ATAGCTGGCGTCTTTCCTGATCTGTGCTCTCCCGGTCTTGACAATTCTGAAGAGGTCATTCCTGTTCCCACTCCCGCTC
CCGCTCCCGTGAAAAGTAGGAGTAGGAAGCACCTGTACCGAGGCATCCGGCAGAGGCCTTGGGGGAAATGGGCTGCAGA
AATTCGTGACCCCAAAAAGGGTGTCAGGGTCTGGCTTGGCACATTTGAAACAGCCGAAGAAGCTGCCCGTGCCTATGAT
ACCGCAGNCCGAAAGATCAGGGGCAGCAAGGCCAAGGTTAATTTCACCCAAGAAATCCCC

> SEQ ID NO: 7158  316861  130071_300484_1b
GAATTCAACAAGAAAACAATTTCATTTCAACTTGCTCTTAAATAATAAAATCCTTCCTCTTAAATTGCATTCTCAAAAA
ACAAGAAAACAATTTCATTTCTAATCTTTCTCTTCTAAAAGAAAAAAAACCCTAAAAAACTCACAAAGATGTGTGGAGG
AGCTATAATTTCTGATTTCATACCACCAACTAGGATCAGAAAACTCACTGCTGATTTCTTATGGGGGCCTAATTCAAAG
ACAAAGAAGAATGCTGCTGGAAGAAGGAATTTCTATACTAAACCTTCTTCTTTGATTCAAGATGATGTTGATTTTGAAG
CTGATTTTCGAGAGTTTAAACATGAGGATGATGAATCTGATCAAGAGTATGATCAACTCAAACAGCAACAACAAGTTGT
CAAATCTTTTGCATTTAATGCTTCCAAATCTGATGTTCCTGCTCCTAAAGAAGGATCTAATGCTGCTGCAAAATCTGCG
GAAAACAATGGACCTGCTGACAAAACCGCAAAGAGAAAAAGGAAGAATCAATACCGTGGGATTCGACAGCGTCCATGGG
GAAAATGGGCAGCTGAAATTAGAGATCCAAGGAAAGGTGTTCGCGTCTGGCTTGGTACTTTCAATACTGCTGAAGAAGC
TGCACGTGCCTATGATGCT

> SEQ ID NO: 7159  316886  114322_300007_1b
AAAATTACAAAATGGCCCCAAGGAATGAAACTACCAATGGATTTAGTGGATCAGTGGCCGCAGTCACACCAGTAAATCC
AGTGAGTATGGCGACGCCATCTACAGAAATGAAGAAGAGGGGAAGGCCTAAGAAATATGGACCAGATGGTTCTGTA
AACACTGCATTGTCACCAATGCCAATATCAGCTTCAATCCCACTTTCTGGAGATTTTTCAGGTTGGAAAAACAGTGGAA
GTCGCCCGGTTGAGTCCTTCCAAAAGAAGCAGAAGTTTGAGATTTCAAGTCCAGGGGAGAGGGTGCCATACTCTGCTGC
TGCAAATCTTTCACCACATGTTGGATACTCTGGTGGTGCAAACTTTACACCACATGTGATCACTGTTAATGCTGGCGAG
GATGTTGCAATGAAATCATTTCATTTGCTCAGCAAGGGTCTAGAGCTATTTGTGTGCTCGCTGCCAATGGCGCAATTT
CAAATGTTACACTTGGTCAGCCAAATTCTTCTGGTGGAACTTTGACCTATGAGGGTCGATTTGAAATTCTCTCTCTGAC
AGGATCGTATATGTCTAGTGATAATGGAGTAACAAAAACCAGAACTGGTGGGATGAGTGTGTCCCTCTCAGGCCCTGAT
G

> SEQ ID NO: 7160  316886  1171091_302053_1b
TTCCTATCAAAATCTGCTGGTTTAGGATTCACTCCACACATCATTACTATACCAGCTGGGAGAGGATGTTTGCAACAAAA
ATCATGGCTTTCTCACAACAAGGGCCTCGCTCGATATGCATCCTATCTGCCAACGGAGCTATTTCACATGTGACACTAC
GCCAATCTGCAACTTCTGGTGGCACAGTTACTTATGAGGGTCGTTTTGAGATTTTGTCCTTGTCGGGATCCTTTCTTCT
AACAG

> SEQ ID NO: 7161  316886  280781_200068_1b
ACAAAATACACAACAAAACCCTCGGTTTAGTTTGGATTACACGTGAGGGTGGGCCGTCGTCACCTAGGGATTCTTCGCG
GGCAAGGAAGAAACGAGGGCGGCCCAGAAAGTACTCTCCTAGTCCTGATGGTAACAACATAGCTTTGGGCCTCTCTCCT
ACTCCACTACTTACTCCCATTTCTGATTCTGCTGCTGCTGGTGGGCCCGCCACTCCCACTTCTGAAAACTCCTCTAAGA
AGCTCAGAGGCAGACCTCCTACCCCTTTAAAGAAACAGCTCGATGCACTGGGTACAGGTGGAGTTGGCTTTACACCACA
TGTAATCTTGGTGAACGTTGGGGAGGACATAGCATCGAAGCTACTGGCTTTCTCAGAGCAAGGACCACGTACAGTTTGC
ATACTATCTGCACATGGAGCCATTTGTAATGTCATCCTACGGCAACCAGCCACGGGGGGTAGCACTGTAACTTGTGAGG
GCCGATTTGAAATCATCTCTTTATCAGGTTCGTTCTTGCGCTCTGAAAGTAACAGTGGCAAAACAAGTAGTCTAAGCGT
GTCACTGGCCGGGTCAGACGGTAGAGTTTTGGGCGGTGGAGTTGCAGGACTGCTCACGGCTGCAACACCAGTACAGGTG
ATTGTGGGTAGCTTCATTGCGGAAGGGAAGAAGCCGAAGTCTA

> SEQ ID NO: 7162  316886  227866_301031_1b
CCGATTTGATCCTGTGTTGCTGTTGAAAGAAAACCCGGAGTGGTTGTACGGCATCCCGCTGTGGTTGATCGGGCTGCCC
GAGTCATCGGACGATCCACTGGATGTGCCCTCCGATGGCGGGCTCGCCACCGGAGCTGGCACGTAGGTTGCCATCTGTG
GAGGCGCTGAAATCGGTTCGACCTTCCTTGTCTCGACTGGCTTCGATTTCTTACCTTCCGCGATGAAGCTAGCCACGAC
AACCTGGACAGGGGTTGCGGCCATCAGCATTCCAGCTACACATCCACCAAGAACTCGGCCATCAGATCCTGCAAGTGCG
ACACTCAGGCCACCAGTCCTGCTGCGAGTGTCGCCATCCTCTGCAAGCAGGAAAGGAAACCTGATAGAGAGATGATCTCAA
ATCGGCCCTCATAAGTCACAAGTCCACCAGATGTAGCTGGCTGCCGAAGTGTTACATTGCTTATTGCACCATTCGCTGA
GAGAATGCAAACTGTGCGAGGGCCTTGCTGTGAGAAGGCCATAATTTTTGAAGCAACATCCTCGCCGGCCTTGACGGTG
AGGATGTGAGGAGTGAAGGCGATGCCCCATGAGCCTAGGGCTTCGAACTGCTTCTTCTTGCCGGAGCCGGG

> SEQ ID NO: 7163  316903  147394_301252_1b
```

FIG. 2 continued

```
GGGGAGCAAGTGATATATATAAAAGGCTGGAAGATCAGAAGTGTACTACAAGCAGGAATCTTGATCCCTTGGTACCTGC
TTGTATCTACATTGCATGTCGTCAAGAAGGCAAACCCCGCACTGTAAAAAAAATATGCTCAATTGCCAATGGAGCTACT
AAGAAGGAAATTGGCCGAGCAAAAGAATTCATTGTGAAACAATTGAAGGTTGAAATGGGAGAATCAATGGAGATGGGAA
CTATACATGCTGGCGACTATCTGAGACGTTTTTGTTCTAACCTTGGTATGAACCATGAAGAAATTAACGTTGTCCAAGA
AACTGTTCAGAACTCGGAAGAGATTGACATAAGGAGGAGTCCTATATCAATTGCTGCAGCAATAATATACATGATAACT
CAACTTACAGATATGAGGAAACCCCTGCCAGATATCTCAATTGCAACCACAGTCGCACAAGGGACTATCAACAATGCGT
ACAGGGATCTTTATCCTCATGCTTCCAAAATAATACCACAATGGTATGT

> SEQ ID NO: 7164  316906 1110614_301541_1b
TTCTGAGCTGAGCTGAGCTAGCATCCATGGCCACCACAGCCCTCTCCTCAGCCAACTTGGCCATCTCAAAGGCCAAATC
CAGCTACACTGCTGCTGAGACCACCAAGCTGCATAGCCATGGCCTTTCTAGTAGCGCCTCGCTCGCCTCCAAGCGGATT
CCGTCGGTTGGGTCCAGTGCTCGCCGGCCTTCCCGCGTCGCTGCCATCAGAATGGATTCCACCAAAGATAAGCCCCGTG
CTGGTGCTAAGGAGGCTGCTAAGGAGTCCCTCCTCACCCCCCGCTTCTACACCACTGACTTCGAGGACATGGAGCGCAT
GTTCAACATCGAGATCAACGGGAAGCTCAACGAGGAGGAGTTCGAGGCTCTCCTTGCGGAGTTCAAGGCTGACTACAAT
CAGACCCACTTCGTCCGGAACAATGAGTTCAAGGAGGCCGCCGCCGCTATCCAGGGGCCCATGCGCCAGATCTTTGTCG
AGTTCCTTGAGAGGTCCTGCACCGCTGAGTTCTCCGGGTTCCTCCTCTACAAGGAACTGGGACGGAGATTGAAGAAAAC
CAATCCCATTGTTGCGGAAATTTTCACCCTGATGTCCCGAGATGAGGCTCGACATGCCGGTTTCCTGAACAAGGGGCTC
TCAGATTTCAACTTGGCTCTTGATCTGGGCTTCCTCACAAAAGCAAGGAAGTACACCTTCTTCAAGCCT

> SEQ ID NO: 7165  316906 230411_301068_1b
AAACCTCGCGAAGAACAAGCAGCTACATTCTCTCGAGCGCGATTCGCGGCGTCAACAGGGGGGCATGGCGGCGGCAATG
TCGGCAGCCAGCGTCGGCAATGTGAAGGTGAGTGGATTTGGCGGCCGATGGCGAGGGTTCCAGTCGAACCGCGGCGGCA
GCGTGGTGTTCTCCAGGAAGATCGTGGCCAGCGCCGCCGCCGCCACGAAAGACGCCCCCAGGAAGGGCGCCAAGGAGGC
GGTGAAGGACACGCTGCTGACGCCGCGGTTCTACACGACGGACTTCGACGAGATGGAGCAGCTCTTCAATGCGGAGATC
AACAAGAAGCTCAACATGGCGGAATTTGAGGCGCTGCTCGCGGAATTCAAGGCCGACTACAACCAGACACACTTCGTAA
GGAATCCAGAGTTTAAGGCCGCGGCCGACAAGATCACTGGACCGATGAGGAAGATCTTCGTGGAGTTTCTGGAGAGGTC
GTGCACTGCCGAGTTCTCCGGGTTCTTACTCTACAAGGAGCTGGGAAGAAGGCTCAAGAAAACCAATCCCGTGGTTGCG
GAGATTTTTACGTTGATGTCTCGAGACGAAGCACGGCATGCCAGGGTTCCTGAATAAAGGTCTATCCGACTTTAACTTGG
CGCTGGATCTTGGTTTCCTGACCAAGGCCAGGAAGTATACCTTCTTCAAGCCGCAGTTCATCTTCTACGCGACTTACCT
CTCGGAGAA

> SEQ ID NO: 7166  316934 317035_301429_1b
GAGCATGGATAAGGAGAACTCTCCATCACCTCCTTGTGGAGGTGTTCCTCCTCCATCTGCATGAGGTCGATGCTCTGCT
TTCTCATAACCTGGTCCCATAGGTCATGGTTCAGATGCTACTCGAATGAGTCATGATATTAGCCGTATGCTTGAGAACC
CACCTAAGAATATTG

> SEQ ID NO: 7167  316938 266277_200085_1b
TTTCTCTCTCTTTTATCTTCCTTTATAGCTTTACTCCTATCTTCGTCTCTCCTGCATTTAACTAAATTTAAGGGAGAGA
TGGTGAGAGGAAAAACAGAGATGAGGCGTATAGAGAACGCAACAAGCAGGCAAGTCACTTTCTCTAAACGCAGAAATGG
TTTGCTAAAGAAAGCATTTGAACTTTCAGTACTTTGTGATGCTGAGGTTGGTTTGGTTATATTTTCTCCAAGAGGAAAG
CTCTATGAATTTGCCACTTCTAGCATGCAGGAGATAATAGAGCGCTATAAGAGACATTCTAAAGACAAGGTTCAACCTG
AAAACCAAGCAGTGGGACACGATATGCAGCATTTGAAGCATGAGACAGCAAGTTTGATGAAGAAGATAGAACTTCTTGA
AACATCTAAAAGGAAACTCTTGGGAGAATGTTTAGGGTCCTGTACCCTAGAAGAATTACAGCAAATAGAAAAACAGTTG
GAGCGCAGTGTTAGCGCGATCCGGTCGCGAAAGATGCAAGTCTTTAGGGAACAAATGCAAAGATTGAAAGAAAAGGAGA
AAGCCCTTGCAGTTGAAAATGCAATGCTGAGGGAGAAGTTTGGAGGTCTTCAACAGAGACAAACATCAAGCGGAGAGAA
GGAAGGAGAAGTTATTTGTATAGAGGGAGGTAGCGATAAATCGGATGTGGAGACAGAATTGTTTATTGGACCACCTGAT
GAATGTAG

> SEQ ID NO: 7168  316938 272044_200040_1b
TTCTTCTCTCCCTCTTTCATTTCATTTAATTTGGTACCCTTTTTAATCTTTGCACTACTAAAAGTAGTACCAGCTGCTA
ACCAAGAGTGGAATAATCCCTTATATCATCTCTCTGGCAAAATACAAAGATAGAAAGAAAGAGAAAAGAGAATAAAAAT
GGGAAGAGGAAGAGTAGAACTGAAGAGAATAGAGAACAAATAAACAGGCAAGTTACTTTTGCTAAGAGAAGAAATGGA
CTTCTTAAGAAAGCCTATGAACTTTCTGTTCTCTGCGATGCTGAGGTT

> SEQ ID NO: 7169  316938 316711_301426_1b
GCAGCATGGAGGGTGGTGCGAGTAATGAAGTAGCAGAGAGCAGCAAGAAGATAGGGAGAGGGAAGATAGAGATAAAGAG
GATAGAGAACACTACGAATCGTCAAGTCACTTTCTGCAAACGACGCAATGGTTTACTCAAGAAAGCTTATGAGCTCTCT
GTCTTGTGTGACGCTGAGGTTGCTCTTGTCATCTTCTCCACTCGAGGCCGTCTCTACGAGTACGCCAACAACAGTGTGA
```

FIG. 2 continued

GAGGAACAATAGAAAGGTACAAGAAAGCTTGCTCCGACGCCGTTAACCCTCCGACCATCACCGAAGCTAATACTCAGTA
CTATCAGCAAGAGGCGTCTAAACTCCGGAGACAGATTCGGGACATTCAGAATTTGAACAGACACATTCTTGGTGAATCT
CTTGGTTCCTTGAACTTTAAGGAACTCAAGAACCTTGAAAGTAGGCTTGAGAAAGGAATCAGTCGTGTCCGATCCAAGA
AGCACGAGATGTTAGTTGCAGAGATTGAATACATGCAAAAAAGGGTAAAAGAAATCGAGCTGCAAAACGATAACATGTA
TCTCCGCTCCAAGATTTCTGAAAGAACAGGTCTACAGCAACAAGAATCGAGTGTGATACA

> SEQ ID NO: 7170 316938 316918_301428_1b
GCAGCATGGGAAGAGGGAGAGTGGAGATGAAGAGGATAGAGAACAAGATTAATAGACAAGTGACCTTCTCAAAAAGAAG
AAACGGTTTGCTGAAGAAAGCTTATGAGCTTTCTGTTCTTTGCGATGCCGAAGTTGCTCTCATCATCTTCTCAAGCCGT
GGCAAGCTCTACGAGTTTGGTAGTGTTGGAATTGAAAGCACAATCGAACGGTATAATCGTTGTTACAACTGCTCTCTAA
GCAATAATAAGCCTGAAGAGACTACACAGAGTTGGTGTCAGGAGGTGACAAAGCTTAAATCCAAATACGAATCTCTTGT
TCGTACTAACAGGAATTTGCTTGGAGAAGATCTTGGAGAAATGGGTGTGAAGGAACTGCAAGCGCTCGAGAGGCAGCTC
GAAGCCGCTCTTACCGCGACTCGACAGCGCAAGCACAAGTTATGATGGAAGAAATGGAAGACCTTAGGAAAAGGAGA
GGCAACTAGGAGACATAAACAAACAACTCAAGATTAAGTTTGAAACGGAAGGCCATGCTTTCAAAACCTTTCAAGACTT
ATGGGCAAACTCGGCGGCATCGGTGGCCGGGGATCCAAACAATTCTGAATTTCCGGTAGAGCCTTCTCATCCTAATGTA
TTGGATTGCAACACCGAACCCTTTTTACAAATAGGGTTTCAACAAC

> SEQ ID NO: 7171 316938 57292_300132_1b
AAATAATGGGAAGAGGAAGAGTTGAACTAAAGAGGATAGAGAACAAAATAAACAGGCAAGTTACTTTTGCAAAGAGAAG
AAATGGACTTCTCAAAAAAGCTTATGAACTTTCAGTTTTATGTGATGCTGAAGTTGCTCTTATCATCTTCTCTAGCCGT
GGCAAACTCTATGAATTTTGCAGCACTTCTAGCATGATGCAAACACTTGAAAAGTATCAACAATGCAGCTACGCCTCTT
TGGACCCAATGCAATCAGCTAGCGATCATACTCGGAACAATTACCATGAGTATCTGAGGCTAAAAGCTAGAGTTGAGCT
TCTTCAACGATCTCAGAGAAATCTTCTTGGGGAGGACTTGGGCACACTAAA

> SEQ ID NO: 7172 316938 29146_300184_1b
CAAAGCTATACAAAATATATAGAATTTTCTGCAAGCTTTAGAAAGGAAGATGGAGTTTCCTAATGAAGAATTTGAGTCA
TCTAATTCTCAGAGAAAATCAGGAAGAGGAAAGATTGAAATCAAGAGGATTGAAAATACTACAAATCGACAAGTTACTT
TTTGTAAGCGTAGAAATGGACTCCTTAAAAAAGCCTATGAGCCTTCTGTACTTTGTGATGCTGAAGTTGCCCTTATTGT
CTTCTCCAGCCGTGGTCGCCTCTATGAATATGCCAACAACAGTGTAAGGGCGACCATTGATAGGTACAAGAAACACCAT
GCTGATTCCACCAGTCAAGGCTCTGTTTCTGAAGCTAACACTCAGTACTACCAGCAAGAAGC

> SEQ ID NO: 7173 316938 267727_200118_1b
TTTTCTCTACCCGTGGCAAGCTTTATGAGTTCTCTAGCACATCCAACACGCTCAAAACCCTTGAAAGGTACCATAAATG
CAACTCCGGGACGTGAGAAGCTAAACACTCTGGCAGAGATTCTAATGATGAAAGTTCTATACGGAGTACTTAAAGCTT
AAAGCCGAATATGAGTCCCTGCAGCGATATCAAAGACACCTTCTTGGGGATGAACTGGGCCCTCTAAACATAGATGAGC
TCGAGCACCTTGAACTTCAG

> SEQ ID NO: 7174 316938 103840_300034_1
ACGCGTGGGTTTGAGCAAAAAGAAAAAAAAACAATGGCTCGTGGGAAGATCCAGATCAAGAGAATAGAGAACCAAACAA
ACAGACAAGTCACTTATTCTAAGAGAAGAAATGGACTTTTCAAGAAGGCAAATGAACTCACTGTTCTTTGTGATGCTAA
AGTTTCTATAATTATGATTTCAAGTACAGGAAAACTTCATGAATTTATAAGTCCTTCTGTCACGACCAAGCAGTTGTTT
GATCTGTATCAAAAGACTGTTGGAGTTGATCTTTGGAACTCCCACTATGAGAAAATGCAAGAGCAGTTGAGGAAGCTAA
AGGATGTTAATAGGAATCTCCGAAGAGAGATCAGGCAGAGGATGGGAGAAAGCCTAAACGATCTGAACTATGAGCAGTT
GGAAGAGCTCAATGAAAATGTGGACAATTCTCTGAAGCTTATTCGTGAAAGAAAGTATAAAGTGATTAGCAATCAGATT
GAAACGTACAAGAAGAAGGTCCGGAATGTGGAAGAAATACATAGAAATCTCTTGCTTGAATTTGATGCAAGACAAGAGG
AACCATATGGATTGGTTGAGCAAGAAGGGGACTATAACTCTGTGCTTGGATTCCCAAATGGAGGGCCACGCATATTA

> SEQ ID NO: 7175 316938 196131_300724_1b
AGGTCGTAAGAGAGCACGCACGTACTTAGCAAAATATAGATCAGGAATTACATTACATTACATATGCCCTGTAA
TTACTGGATTACAGGACACTGTTTGCATTGGCTTCTCTGAAGCCTGAAGCCTGAACTGAACACACACATCATATCCAGC
CGGATGGGATGTGTTCATTGGGGTGATGAGCAACCATGTCTGCTGCTTCATTGCTCAGATGGTCCATGTAGGCCTGGTG
ATGGTGAGCATGAGGGTGATGATACCCAATCTGCAGGGAATGGTCACCCTGATCTGGGTGAGGGTGGAGAAGACCCTGA
TGGTGATGAGGCTGATCAGCAAGAACAGTGCTAGAACCGCTGTGCCCACCACCATCTTGCCAGGACATATGGAGCACAT
TCTCTGCACTGGTTTCCTGTAACTTTTTCCTCAAGTCTTTGTTGAGATCTTGCAGCTGTTGCTCCTTGCTCTTCAGATC
AAACAGCTGATCAAGCAGTGCTTGGTTCTTTCTTGACCTGATTTGTTTGAGGGATACTTCTATCTGGTTCTCAAGCTGC
TCCAGCTCCTTCATGCTTAGTGGGCCCAAATCCTCACCAAGAATATTTCTCTGTGTG

> SEQ ID NO: 7176 316944 316996_301428_1b

FIG. 2 continued

```
GCAGCATGGGAAGAGGGAAAGTTGAGCTGAAGAGGATAGAGAACAAGATCAATAGACAAGTTACTTTTGCAAAGAGAAG
AAATGGTTTGCTCAAGAAGGCTTATGAGCTTTCTGTCCTTTGTGATGCTGAGATTGCTCTTCTCATTTTCTCTAACCGT
GGCAAGCTCTACGAATTCTGCAGCAGCCCTAGTGGTATGGCGAGGACGGTTGATAAGTATAGAAAACATAGTTATGCAA
CAATGGATCCAAATCAATCAGCTAAAGACTTGCAGGATAAGTATCAAGACTACTTGAAGCTTAAATCAAGAGTTGAGAT
CCTTCAACATTCACAAAGGCATTTGCTAGGTGAAGAGCTATCCGAGATGGATGTGAATGAGCTTGAGCATCTCGAACGC
CAAGTAGATGCATCACTAAGACAAATAAGATCTACCAAGGCTCGGTCTATGCTTGATCAACTATCTGACCTCAAAACTA
AGGAGGAAATGTTATTGGAAACCAATAGAGATCTTAGGAGAAAGTTGGAGGACAGTGATGCAG

> SEQ ID NO: 7177 316944 56304_300123_1b
CATATATATATAGAATTGCTTGCAAGGAAAGAGAGAGAGAGAGATTGAGATATCTTTTGGGAGAGGAGAAAGAAAAAGA
AAATGGGAAGAGGGAGAGTAGAATTGAAGAGGATAGAGAACAAGATCAATAGGCAAGTGACGTTTGCAAAGAGAAGGAA
TGGTCTTTTGAAGAAAGCATACGAGCTTTCAGTTCTATGTGATGCAGAAGTTGCTCTCATCATCTTCTCAAATAGAGGA
AAGCTGTACGAGTTTTGCAGTAGTTCGAGCATGCTTCGGACACTGGAGAGGTACCAAAAGTGTAACTATGGAGCACCAG
AACCCAATGTGCCTTCAAGAGAGGCCTTAGCAG

> SEQ ID NO: 7178 316976 271355_200033_1b
TCCGGAAAAAGTGCAAGATGGATAAAGAATTTAAAACAAGAATGAAGAGAGGATTTTGGAAACCTGAAGAGGACTTGAT
ATTGAAAAATTGTGTGGAGACTCATGGAGAGGGAAACTGGGCCACCATTTCTGAGAAGTCAGGCTTAATGAGGAGTGGT
AAGAGCTGCAGACTAAGGTGGAAAAATTACCTGAGGCCAAACATCAAGCGAGGAATGATGTCAGAAGATGAAAAGGACC
TCATCATCAGACTCCATAAGCTTCTTGGCAACCGGTCACTGCTTTCTCCTCTGCACCTGATTTCCTGTTATACAATAAG
AATGGTGAATTGATTCTTCTAGCTGTGCTTACCTACCTCAAATCTTCTTTGGAACA

> SEQ ID NO: 7179 316976 275176_200154_1b
TTTATACTCTTCTCTTCTATAGACATATGAGCAAAAACATAGTAATTATGAGTAATAATTCCTCAAATGAAGATGATCA
ATTTGAGCTAAGAAGAGGGCCATGGACTCTTGAGGAAGATAACCTTCTTATTCATTATATTTCTACCAATGGTGAAGGT
CGTTGGAATGCTCTAGCTAAATGTGCTGGATTGAAGAGAACAGGAAAAGTTGTAGACTGAGGTGGCTGAATTACTTAA
AACCTGATATTAAACGCGGAAATCTGACCCCACAAGAACAACTTTTAATCCTTGAACTTCACTCCAAATGGGGAAACAG
GCGGTCAAAAATTGCACAACATTTACCAGGAAGAACAGATAATGAAATCAAGAATTATTGGAGAACAAGGGTGCAAAAA
CAAGCAAGACAACTGAAGGTTGATTGTCATAGCAAAAAATTTGTTGAACCAATCAAGAGTCTTTGGGTGCCAAGATTAC
TTGAAAAAATGGAGCAATCTTCCTCCATTGAAAACATAATCCTTCACTACTTAC

> SEQ ID NO: 7180 316976 317052_301429_1b
GCAGGATGGGAAGAACACCTTGTTGTGACAAGATTGGTTTGAAGAAAGGTCCTTGGACGCCT

> SEQ ID NO: 7181 316976 316928_301428_1b
GCAGCATGGGAAGAACACCTTGTTGTGACAAGATTGGTTTGAAGAAAGGTCCTTGGACGCCTGAAGAAGATGAGGTTCT
TGTTGCGCATATCAAGAAAATGGACATGGAAGCTGGAGAACACTTCCTAAACTTGCTGGTTTACTTCGCTGTGGGAAG
AGTTGCAGGCTGAGATGGACAAACTATCTGAGACCAGACATAAAGAGAGGTCCTTTCACTGCTGATGAAGAGAAACTTG
TTATCCAGCTTCATGCCATTCTCGGCAACAGGTGGGCTGCTATTGCAGCACAGCTTCCAGGAAGAACAGACAACGAGAT
CAAGAACTTATGGAACACTCATTTGAAGAAACGTCTTTTATCTATGGGTCTTGATCCCAGAACTCATGAGCCATTACCT
TCATATGGGTTAGCTAAACAAGCTCCATCTTCACCAACAACTCGCCACATGGCTCAATGGGAAAGTGCTAGGGTTGAAG
CTGAGGCAAGGCTTTCTAGAGAATCAATGCTCTTTAGCCCTTCTTTTTACTCTGGTGTAGTAAAAACTGAATGTGATCA
CTTCTTACGCATTTGGAATTCCGAGATTGGTGAAGCTTTCAGGAATCTCGCTCCATTAGATGAATCAACTATTACTAGT
CAAAGCCCTTGCTCGAGGGCAACATCGACCTCATCTGCACTTCTGAAGAGCTCA

> SEQ ID NO: 7182 316976 190435_300818_1b
CCCCGGAAACAGCAGCGGCTCCAGCTCGCCGTGGTCGACTTTCCCGGCGGCGATCACCGGCAGCGGAGGAGGAGCAGTA
CGTGTGTATATATAAAGGATGGGGAGGCAGCCGTGCTGCGACAAGCTGGGGGTGAAAAGGGGGCGTGGACGGCGGAGG
AGGACAAGAAGCTGATGAGCTTCATCCTGACCAACGGCCATTGCTGCTGGCGCGCCGTGCCGAAGCTCGCCGGGCTGCT
CCGCTGCGGCAAGAGCTGCCGCCTCCGGTGGACAAACTACCTCCGCCCCGACCTCAAGCGCGGCCTCCTCACCGACGCC
GAGGAGCAGCTCGTCATCGACCTCCACGCCAAGCTCGGCAACAGATGGTCCAAGATTGCTGCCAAGCTACCGGGCAGGA
CGGACAACGAGATCAAGAACCACTGGAACACGCACATCAAGAAGAAGCTCATCAAGATGGGCATCGACCCGGTGACGCA
CGAGCCCCTCGACCGGAAGCAGGAGAGCCCGGCCACCACCTCGCAGTCCACCGTCACGGCGGAGTCGTCCAAGTCCGGC
GAGGCGACCAGGCAGCAAAGCCG

> SEQ ID NO: 7183 316976 228464_301021_1b
ACCACTCGCGAACTAGACAGAAACCGCAAGAAACCAAACACCTTTTGGCTCCTCCACTAGTAGCAACTACTCGTTGTCG
TCGTCGTCGTCGACTCGTCGTGGTAGTAGTAGTCTTCTTCGCGTGACGCCATGGGAGGAGGAGGAGGAGTTGAGGCGGA
```

FIG. 2 continued

```
TTGCGACAGGATCAGGGGGCCGTGGAGCCCCGAGGAGGACGAGGCGCTGCGGCGGCTGGTGGAGCGGCACGGCGCGAGG
AACTGGACGGCGATCGGGCGGGAGATCCCCGGGAGGTCGGGGAAGTCGTGCCGGCTGCGGTGGTGCAACCAGCTCTCGC
CGCAGGTGGAGCGGCGGCCGTTCACCGCCGAGGAGGACGCCACCATCCTCCGCGCACACGCGCGGCTCGGGAACAGGTG
GGCCGCCATCGCGCGCCTCCTCCAGGGCCGCACCGACAACGCCGTGAAGAACCACTGGAACTGCTCCCTCAAGCGCAAG
CTCGCCGTCGCCACCACCACCACCACCACCACCGGCGCCGCCGCCGCGCCGGGAGTGGTCGCCGATGCCGCCGAGC
TCGTCGAGCGGCCGTGCAAGCGGTTCAGCCCCACGCCGGACAGCCCGTCGGGGTCTGGTTCCGGGTCGGAC

> SEQ ID NO: 7184 316984 201267_300714_1b
GTCGCCTGCACGGCACCGACGAGAGAGCGCGCGCGCGTGTTCGTCCGAGCTTTTCTGCGGTCGCGCGGTGCAGGAGGCG
GGGCGACGGCCGGCGCCGCAGTTCGCGGGCGTGGACCTCCGCCGGCCGAAGGGGTACCCGGCGGCGGGGCAGCTGACGC
CGGCGGCGGAGGAGGCGGTAGCCGGGGTGGGCGACCCGTGCCCGCGGTGCGAGTCGCGGGACACCAAGTTCTGCTACTA
CAACAACTACAACACGTCGCAGCCGCGGCACTTCTGCAAGTCGTGCCGCCGCTACTGGACCAAGGGCGGCTCCCTCCGC
AACGTCCCCGTCGGCGGCGGCTCCCGCAAGAGCTCGACTTCCTCCTCCTCCGCCGCCGCCGCCGCCGCCTCATCGTCGT
CGTCGCCTTCTTCGCCAGCCAAGAGCCCCAAGCGCTCCAAGAACTCCAAGCGCCGCCGCGTCTCTCCGCCCCCTCAGCC
CGTGCCTGCGCCGCCGCCGCCCACCACCGCCGACGCTGCCGACGTAGCCGCACCGACGGCACCAGAAGCCACAACCAAG
AAAGCCCCGGAAGACCTCACCGCGGCGGCAGCGACACAGCCGGCGGTGGCGCTCGGGCTCGGCGTCGCCGACGGCGGCG
GCGGCGGGAAGGAGCACCTGGACACGAGCCCGTTCGAGTGGCCGTCGGGCTGCGACCTCGGGCCGTACTGGCCAACCGG
CGTGTTCGCCGACACCGATCCATCACTGTTCCTTAACCTGCCATGACAAGC

> SEQ ID NO: 7185 316984 259078_301702_1b
GCAGCATGATGATGGAGACTAGAGATCCAGCTATTAAGCTTTTCGGTATGAAAATCCCTTTTCCGTCGGTTTTTGAATC
GGCAGTTACGGTGGAGGATGACGAAGAAGATGACTGGAGCGGCGGAGATGACAAATCACCAGAGAAGGTAACTCCAGAG
TTATCAGATAAGAACAACAACAACTGTAACGACAACAGTTTTAACAATTCGAAACCCGAAACCTTGGACAAAGAGGAAG
CGACATCAACTGATCAGATAGAGAGTAGTGACACGCCTGAGGATAATCAGCAGACGACACCTGATGGTAAAACCCTAAA
GAAACCGACTAAGATTCTACCGTGTCCGAGATGCAAAAGCATGGAGACCAAGTTCTGTTATTACAACAACTACAACATA
AACCAGCCTCGTCATTTCTGCAAGGCTTGTCAGAGATATTGGACTGCTGGAGGGACTATGAGGAATGTTCCTGTGGGGG
CAGGACGTCGTAAGAACAAAAGCTCATCTTCTCATTACCGTCACATCACTATTTCCGAGGCTCTTGAGGCTGCGAGGCT
TGACCCGGGCTTACAGGCAAACACAAGGGTCTTGAGTTTTGGTCTCGAAGCTCAGCAGCAGCACGTTGCTGCTCCCATG
ACACCTGTGATGAAGCTACAAGAAGATCAAAAGGTCTCAAACGGTGC

> SEQ ID NO: 7186 316984 262635_301692_1b
GCAGCATGGAGAGAGCAGAGGCCTTGACATCATCGTTTATATGGCGGGCAAACGCAAACGCAAACGCGGAGATCACGCC
GAGTTGTCCAAGATGTGGATCCTCTAACACAAAGTTCTGTTACTACAACAACTATAGCCTCACTCAGCCTCGCTACTTC
TGCAAAGGCTGCCGCAGATATTGGACCAAAGGTGGTTCCCTCCGCAATGTTCCTGTAGGCGGTGGCTGTCGAAAATCCC
GCCGCCCCAAATCATCTTCTGGTAACAATACTAAAACTAGCCTAACCGCTAATTCTGGCAACCCCGGTGGTGGTTCACC
AAGCATCGATCTTGCTCTTGTTTACGCCAATTTCTTGAATCCAAAGCCTGACGAATCTATACTACAAGAAAATTGCGAC
TTAGCCACTACGGATTTTTTGGTAGATAATCCTACCGGTCACTTCCATGGACCCTTCATGGAGTATGACATCAATGATG
GTCATCATGATCATTATATTAATCCGGTGGAACACATTGTGGAGGAATGTGGTTATAATGGCTTGCCTCCATTTCCTGG
TGAAGAGCTTCTCTCTTTAGACACTAATGGTGTTTGGTCTGATGCTTTGTTGATTGGTCATAACCATGTAGACGTTGGC
GTGACTCCGGTTCAGGCTGTACACGAACCGGTGGTTCATTTCGCTGACGAATCCAATGATTCCACCAATCTCTTGTTTG
GAAGTTGGAGCCCTTTTGATTTCACTGCCGATGGATGATAA

> SEQ ID NO: 7187 316984 316909_301428_1b
GCAGCATGGTGGAACGTGCTCGGATCGCAAAAGTCCCATTGCCTGAAGCAGCTCTAAATTGCCCTAGATGTGACTCAAC
CAATACTAAGTTCTGTTACTTCAATAACTATAGCCTTACTCAACCTCGCCATTTCTGCAAAACATGTCGTCGCTATTGG
ACACGTGGCGGTTCCTTGAGGAATGTTCCTGTTGGAGGAGGCTTTAGGAGGAACAAGAGAAGCAAATCCAGATCGAAAT
CTACGGTCGTGGTCTCGACTGATAATACTACTAGTACTTCATCACTTACTTCTCGCCCAAGTTACTCAAACCCTAGCAA
GTTTCATAGCTACGGTCAAATCCCGGAGTTTAATTCCAACTTGCCCATCTTGCCTCCTCTCCAAAGCCTTGGAGATTAC
AATTCAAGCAACACTGGATTAGATTTTGGTGGAACTCAAATAAGCAACATGATAAGTGGTATGAGTTCTAGTGGTGGGA
TCTTGGATGCATGGAGAATACCTCCATCACAACAAGCTCAGCAATTCCCTTTCTTGATCAACACTACCGGATTGGTGCA
ATCTTCAAACGCGTTATATCCATTACTAGAAGGCGGGGTTAGCGCCACGCAAACAAGAAATGTGAAGGCGGAAGAGAAT
GATCAGGATCGGG

> SEQ ID NO: 7188 316996 316919_301428_1b
GCAGCATGGGAAGAGGAAGAGTAGAGCTGAAGAGGATAGAGAACAAAATCAACAGACAAGTAACGTTTGCAAAGCGTAG
GAACGGTTTGTTGAAGAAAGCTTATGAATTGTCTGTTCTCTGTGATGCTGAAGTTGCTCTCATCATCTTCTCCAACCGT
GGAAAGCTCTATGAGTTTTGCAGCTCCTCAAACATGCTCAAGACACTTGATCGGTACCAGAAATGCAGCTATGGATCCA
TTGAAGTCAACAACAAACCTGCCAAAGAACTTGAGAACAGCTACAGAGAATATCTGAAGCTTAAGGGTAGATATGAGAA
```

FIG. 2 continued

CCTTCAACGTCAACAGAGAAATCTTCTTGGGGAGGATTTAGGACCTTTGAATTCAAAGGAGTTAGAGCAGCTTGAGCGT
CAACTGGACGGCTCTCTCAAGCAAGTTCGGTCCATCAAGACACAGTACATGCTTGACCAGCTCTCGGATCTTCAAAATA
AAGAGCAAATGTTGCTTGAAACCAATAGAGCTTTGGCAATGAAGCTGGATGATATGATTGGTGTGAGAAGTCATCATAT
GGGAGGAGGAGGAGGATGGGAAGGTGGTGAACAGAATGTTACCTACGCGCATCATCAAGCTCAGTCTCAGGGACTATAC
CAGCCTCTTGAATGCAATCCAACTCTGCAAATGGGGTATGATAATCCGGTATGCTCAGAGCA

> SEQ ID NO: 7189 317021 182422_300710_1b
GAATTCGAAAGAGCTTCTTTTTATAGCAAAACTGATTCTTTTTTTCTCTCTTTCTAGAAAACAGTCCTGTTGGTGGGTT
ATAGTTTGTGTTGGATGAATCTTCAACACCACTACAACTGAAAGTTAATCCAAATACCCCAACAACAACTTAGAAGAAA
ACAGAAGATCAGGAAAATAAGAATAATGGCAAGAGAGAAGATTCAGATCAAGAAGATAGATAACACAACAGCTCGACAG
GTGACCTTCTCAAAGAGAAGAAGAGGGCTTTTTAAGAAAGCTGAAGAGCTTTCTGTTCTTTGTGATGCTGAGGTTGCGC
TCATCATCTTCTCAGCCACTGGCAAACTCTTTGAATACTCCAGCTCAAGCATGAAGGATATACTTGAAAGGCACAATCT
ACATTCTAAGAATCTTCAAAAAATGGCTCAGCCGTCCCTCGAACTGCAGCTAGAAAACAGCAGCTATGCGAGGTTGAGC
AAGGAAGTTGTAGAGAAGAGCCATCAATTGAGGCAGATGAGAGGAGAAGAACTCCGTGGTTTGAACATTGAAGATTTAC
AACAGCTAGAGAAATCACTTGAAGCAGGATTGAGCCGAGTTCTTGAAACAAAGGGTGAACGAATAATGA

> SEQ ID NO: 7190 317079 267292_200116_1b
ATTATCTTCCCTCAAGGTCATATCGAGCAGGTTGAAGCATCAACTAATCAAGTGGCTGATCAGCAGATGCCTTTGTATA
ATCTTCCTTCTAAGATCCTATGCCGCGTGGTTAACCTTCTGTTGAAGGCTGAACCAGACACTGATGAGGTGTTTGTATA
AGTGACTTTGATGCCGGAGCCAAATCAAGATGAGAATACTGTGAAGAAGGAATCTATGCGCCCTCCTCCACCACGATTT
CATGTACACTCTTTTTGTAAGACACTAACAGCATCTGATACAAGTACTCATGGCGGATTTTCCGTCTTGAGACGGCATG
CTGATGAATGCCTCCCCCCACTGGATATGCTCTCGACAGCCTCCGACACAGGAGTTGGTGGCCAAGGATTTACATGGAAA
TGAATGGCGCTTTAGGCATATATTCCGCGGCCAACCAAGGAGGCATCTTCTTCAGAGTGGTTGGAGTGTCTTCGTTAGT
TCAAAAAGGCTTGTTGCTGGAGATGCATTCATATTTCTTAGAGGTGAGAATGGGGAGCTTCGTGTTGGAGTTAGACGTG
CCATGAGACAGCAGGGAAATGCTCCATCATCGGTGATATCGAGTCATAGCATGCATCTCGGTGTACTTGCGACAGCTTG
GCATGCCATTCAAACAAA

> SEQ ID NO: 7191 317079 113003_300021_1b
CAAAAAGGAGTACTGTCGGCTTCAGCTAGGCAAAGACCATCACCAATTTTCTCTCTCCAGTTCTCTCTCTTCCTCCATC
CATAGCTTTACTCTCTGTGAAGACGAGAAAACCCTAATTAAAGCTGTGTACTAGTTCAACTAATCGATCAATTTGTAGC
TCAACCTTAGTTCTGTGATCGAGTGCTAATATTTTAAAGCTTTTTTGATTGTGTTGTACATGGAAATGAACGTATTATC
CGTGGTATATGATGACTAATAGAGAAATCCGGCTGAATACTTGAGATAATCACTTAAAGGGTTGGTGACTTCAAATTGA
TTTTCTTATGGCACATCTTGCGGCAAATCACTTCGGTGGCGGGGCTGCTCCAGTGGCTCCAAATGATGCATTATACAAG
GAACTCTGGCATGCCTGTGCTGGACCTCTTGTAACAGTTCCTCGTGAAGGGGAAAGAGTTTATTATTTCCCACAGGGTC
ACATGGAACAGCTTGAAGCATCGACACATCAGGGTTTAGACCAACAACTTCCTTCTTTCAATTTGCCAGCTAAAATATT
ATGCAAAGTGATGAATATTCAACTTCGGGCTGAGTCAGAGACTGATGAGGTGTATGCACAGATAACTCTGCTTCCTGAA
CTCGAT

> SEQ ID NO: 7192 317079 157476_301738_1b
GCTTCCGATTAACCAGAGGGAGGATAATAACGACATTGCTGTGAATATGAATGGTGACGTGGAGGATGCAGAAAAGGAA
GTCGTTTCTTTCGTTAAGATTTTAACACCTTCGGATGCGAACAATGGGGGAGGTTTTCTGTCCCACGGTTCTGCGCTG
ATTCGATATTCCCTAGGCTCAATTTCGTGGCTGAACCGCCGGTTCAGAATTTGTTTATTCGCGATATTCATGGTTGTGT
ATGGGAGTTTCGGCACATTTATCGTGGCACGCCTCGCCGGCATTTGCTAACTACCGGCTGGAGCAAGTTCGTCAACAGT
AAAAAGCTCGTCGCCGGTGATTCCGCGGTCTTCGCACGGAAAACTAACACCGGAGAACTTTACGTCGGAGTCCGACGAG
CCACACGAGGAAACGACATTTGCGAGAGGTGGAATTCTACTGTTTTGAGAAGTACTGAACAAACCAGTAGCGGTGGGGA
AGTTCGTTGGAGGACTGGGCAGGGGCGTGTGGCGACCGAGGCGATTGTGGAGGCAGCAGAAATGGCAGCACGGGGAATG
GCGTTTGAGGTGTCGTGTTATCCTCGGGCAGGCTGGGCAGATTTTGTGGTGAGGGCA

> SEQ ID NO: 7193 3442 116670_300079_1b
GGCACACGGTGGGGTTCGCACACTGCAACACATTTGCGGGCCGGATCCGTGGGTCATCGGTGGATCCAACGATGAGCCC
AAGATACGCGGCCCAGCTACAGAGATCGTGCCCGCCCAACGTGGACCCACGGATCGCCGTGACCATGGACCCGGTGACG
CCGCGGGCCTTCGACAACCAGTACTTCAAGAACCTGCAGAACGGGATGGGCCTTCTGGGCTCTGACCAGGTGCTGTACT
CGGACCCACGGTCCAGGCCCATCGTGGATTCTTGGGCCCAGAGCAGCGCCGCCTTCAACCAGGCCTTTGTCACGGCTAT
GACCAAGTTGGGCCGGGTCGGGGTCAAGACCGGGTCGCAAGGCAACATTCGTCGCAATTGTGCAGTGCTCAATTAATTA
TTAACTGATGATCATCTACATGGTTGTTCTTACACTGAGCTTAATTAATCTTGTTTTTAAATTATTGCTTTCTTTTGCA
CAAATGTAAAGGAAAATGTAAGAAAAATTCAAGCCATATATAGATGCATGTAAAGTACAATTAAAATGGTTGGTTATG
AAGTTGTTTGTGGCCGTGAG

FIG. 2 continued

> SEQ ID NO: 7194 3442 137856_300705_1b
CGACCTCGACCAGCTCAACAAGCTCTTCGCCACCAACGGCCTCACCCAGACCGACATGATCGCCCTCTCAGGAGGGCAC
ACGATAGGGGTGACGCACTGCGACAAGTTCGTGCGGCGGCTGTACCAGTTCAAGGGGGCGGCGCCGCAGTACAGCCCGC
CGATGAACCTGGCGTTCCTGCGGCAGATGAGGCAGACGTGCCCGCTCAGCTACAGCCCGACCACCGTCGCCATGCTCGA
CGCCGTCTCGCCCAACAAGTTCGACAATGGCTACTTCCAGACGCTGCAGCAGCTCAAGGGCCTCCTCGCCTCCGACCAG
GTGCTCTTCGCCGACCGCCGCTCGCGCGCCACCGTCAACTACTTCGCCGCCAACCAGACCGCCTTCTTCGACGCCTTCG
TCGCCGCCATCACCAAGCTCGGCCGCGTCGGCGTCAAGACGGCCGCCGGCTCCGACGCCGAGATCCGGCGAGTCTGCAC
CAAGGTCAACTAATAACGTAGAGCAGTATAGCTCACATTTGGGTGGTAGAGAGGGTAAATTGGTGAATTCTTCTCTGTG
TCTCTCTTCTTCTTCTTCCTCTTCTTCTCCATGATGATCTTCGATTCTCACTGTCCATGTTCACAAGTCCACCGCGCAC
AGTTGTTGT

> SEQ ID NO: 7195 3442 3108_300332_1b
TACCCACGCGTCCGAGCGTTCAAAGCCAATTGCCTCAGCCCGAGTTTAACCTAAACCAGCTCAACGGCATGTTTAGCCG
TCACGGCCTCTCTCAAACCGATATGATTGCCCTCTCAGGAGCACACACTATAGGATTTGCACATTGTGGAAAAATGTCA
AAGAGAATATACAATTTTAGCCCTACAACACGTATCGACCCGAGTATAAACCGTGGATACGTGGTTCAGCTTAAGCAAA
TGTGCCCGATCGGTGTCGACGTAAGAATCGCAATCAACATGGATCCGACCAGTCCACGTACTTTCGATAATGCTTATTT
CAAGAATCTCCAACAAGGAAAGGGTTTGTTCACGTCAGATCAAATCTTGTTCACAGATCAACGGTCAAGATCTACAGTT
AATTCG

> SEQ ID NO: 7196 3442 37637_300077_1b
ATTAAACAAGTTTAATAGAAATAAGATTATTAATATTACAGTCACGAGAAATAAAACAACGGTTTAGATTCGTTAATGT
GTTTTTCAAAAATACAAGAAGCAGAAACAAACAGAAGACAACAAAACAAAAACTCATAACATGTCAAAGAACAAATCTC
GAAAACAAAACCCAAAAAGGATGATCAGTTAAAGGCACCACAGTCACGACGAATGTTACCGTTGCGTCTAGTCTTAACG
CCAACGCGGCCGAGTTTGGTCATAGCGGTTACGAAAGCCTTGTTGAAAGCAACAGAATTCTTGGCCCAATCGTTAACGG
TGGGCTTTGAGCGACCATCGGTGAAGAGAACTTGGTCGGAAGTGAAGAGTCCTTTGCCTTGTTGCAGATTCTTGAAGTA
AATGTTGTCGAATTGTCTTGGAGTGGTTGGGTCCATGTTGATGGCGATTCTTGGGTCAACTGTCTTGGGACAAGCCAAC
TGAAGTTCTTTAGCGTAGGCTTTGTTTAGAGTTGGGTCAACGGCGTGTTGAGGTTGAAGTTGTAGATTCTGTTGAACA
CTTTGCCACAATGGGCGAATCCAAGTGTGTGAGCCGCTGAAAGAGCGATCATGTCCTCTTGGGTAAGTTTGTTTTTGGC
AAAAAGCTTGTTAAGTTCTGTAACTTTGTTATTTGGTCCGGGCAAGTTTCCGTTAACGCTAGCCGCAGTCGACACCAAA
CCATCAAACCTTCCGAGTTCCACTGCGTACGACGGACCTTTGGCGGCGACAACAACATCACGGGTGGCTAAAGCAAGAA
TATCAGCACAAGAGACTTTGTTTTTGCAACTTGGGATAGCGTCAAGAGCTTTCTTGGCTTTGATCACAACGTCAAATCC
ATCTCCGGCCAAAGAAATATTGTCTGGATGATCCTTCTCGGCTTTGTTGGTAGGCGTTGATTGAATCATGACCGACGCA
TCACATCCATTGACGAAGCAATCGTGGAAGAAGAGGCGGAGAGTAGCTGGGATGGTGACGAAGGTCTGTTTGATTTTTT
CTTGGACGACTTTTTTCACGATTTGTTCAACATTCGGACATGAGTTTCCGTAGAAATTGGTTTTGAGTTGAGCAGTGGT
TGTGTCAGGGAACATAGAGATGGCAAGACTAAGAGTCACGACTACAACCAGACTGAACCGCGCCATTTCGTTGGAAATT
ACAAGTTTTTGTGTTTACAGGAATGCGGACGCGTGGG

> SEQ ID NO: 7197 3442 34281_300389_1b
TGTCAACGAAATAAACCCATCTTATTAATTTAAGTTTCCATGTTTCACACTTATGAACTCCTTATTTTGACAACAAGAA
ATTAAATTTTATTATTAAAAAAAAAAATCCTCTTTAAGGAATAAAAGAAAGAAAACCTCAAATCACACTAATTGACACG
TGAACAATCCCTTCGAATCTCACCAGCATTACCAGTCAAAACACCAACCCGACCTAACTTCGTGATCGCTGTGATGAAA
GCTTGTCTAAAAGCTCCTTCACTATTGGCAAACGAATTAACTGTAGATCTTGACCGTTGATCTGTGAACAAGATTTGAT
CTGACGTGAACAAACCCTTTCCTTGTTGGAGATTCTTGAAATAAGCATTATCGAAAGTACGTGGACTGGTCGGATCCAT
GTTGATTGCGATTCTTACGTCGACACCGATCGGGCACATTTGCTTAAGCTGAACCACGTATCCACGGTTTATACTCGGG
TCGATACGTGTTGTAGGGCTAAAATTGTATATTCTCTTTGACATTTTTCCACAATGTGCAAATCCTATAGTGTGTGCTC
CTGAGAGGGCAATCATATCGGTTTGAGAGAGGCCGTGACGGCTAAACATGCCGTTGAGCTGGTTTAGGTTAAACTCGGG
CTGAGGCAATTGGCTTTGAACGCTCGGACGCGTGGG

> SEQ ID NO: 7198 3442 55608_300134_1b
TCGACCCACGCGTCCGTGGATCCCACGGTTAACAAAGATTATTTGACAGAGCTAATTTCGTCGTGTCCTCGAAACATAG
ATCCAAGAGGGCTATTAACATGGACCCAACAACACCAAGACAATTCGACAACGTTTACTACAAAAACTTGCTACAAGG
GAAAGGATTGTTCACGTCGGATCAAGTCTTATTCACGGATCGTCGGTCAAAGCCAACCGTTGACTTATGGGCTAATAAT
GGACAGTTGTTTAATCAAGCTTTTATTAACTCGATGATCAAGCTTGGTCGTGTTGGTGTTAAAACTGGTAGTAATGGCA
ATATCCGCCGTGATTGTGGAGCTTTTAATTGATTTAAATATATCTGTATTAGATTTTGTTTATTGTATTTGGGTATAGG
ATGGGTCATGGGTCTCATAAAGCTGGTTCAGCTAAATTGAAAATT

> SEQ ID NO: 7199 3442 202201_300731_1b
TTTTTAACTAGCTAGATTCATTCTACGAGTTGATGACGTACACTTCTTCCTGATCTCTCCTTCCTCCCCGGTGAGCACC

FIG. 2 continued

```
TGGACGTTGCCCATCTTGGTCATGGACTCGCCGAAGTCGCTGAAGAACTCGGCGTCGAACTTGCCGGTGGCGATCCGCC
GCACGTAGTCCCTGGTGGTGGCGTCGGTGAGCAGCGACGCGTCGGAGGAGAAGAGCCCCCTCCGCTTCGCGACATGGCG
GTAGTAGCTGGTGTCGAACGTCTTGTAGCTGCCCGGGTCCATCTCGGAGATCATGCCGGACTCGTCGGTGGCGCTCGCG
CACCTGGCCCTCAGCCTGCCGGCGTACTCGCCGTCCACCGACGGGTCGGCGTCGTTCTTGCCGGTGAAGTTGTAGAGCC
TGCCGGCGTAGGACGGGCAGTGCGCCGTGCCGAGGGTGTGCGCGCCGGAGAGCACGGCGAGGTCCTTGATGTCGAGGTC
GTTGGCGGCGAAGATCCTGAGGAGCGTCGCGATGTCGCCGTCGGCGGGTGGCAGGCTGGCGGCGGCCTCGCCGGCGGCG
GACACCCTGCCGTCCCTCCTCCCCAGGGCGACCGGCCAGGTGGGGCCCCGCGCCAGCACGACGGCGTCGCGCGCCATGA
GCGTGAGCAC
```

> SEQ ID NO: 7200 3442 249012_301589_1b
```
AGGTCTCCGGCAGTTGGTTCGAACCTGGCCCCTCTTCCCAGTGAGCGGCGCGATGCCGCCCATCTTGATCATCGACCGC
ACAAAGCTCTGGAAGAAGGCATCTTGATCGTAGCTGTAGTAGCGCACATAGTTCTCGGTGATGCCGCGGCCACTAAAGA
GCACTTGATCCGACCCGAAGATCCCCTTGCCATACTGGAGATTGAGGTAGTAGTTGTTGTCGAATCTCAGGGGTGTGAC
CAGGTCCAGCGGCGCCACCGTGTTGCCGTTGCCCTGCCGGGGGCAGATCTCGCGGAGAGAGCCCAAGAACTGGGACGTG
ATCGTGGGGTCCGGGGCGCCGCTGCCGCGATCATTGAACAATCGCTGGCGGAATGTGGAGCATCGGGCGAGGCCGATGC
TGTGTGCGCCTGGAAGGTGAGATTAGGGTAAATTAGCTCAAGAACACTGGACATTCCGGCTCGGAATGTGTGGGCTGAT
GGACGGACGGGATGTGATGGATTATTACGTACCGGAAAGTGTTACCATGTCCACCTCGGTG
```

> SEQ ID NO: 7201 35605 154642_301256_1b
```
GCGAATTGAAGCCATATGTAAAATCACAGCCCATCCCTGAAACCAATGACGAACCTGTTAAGGTGGTTGTTAGAGATAC
CCTCCAGGATATGGTTTTCAACTCAGGAAAAAACGTACTGTTAGAGTTCTACGCACCTTGGTGTGGCCACTGCAAGAAG
CTAGCTCCAATTTTGGATGAAGTGGCCGTATCGTTTGACAGTGATCCAGATGTTCTGATTGCAAAACTGGATGCAACCC
TGAATGATCTCCCAAAAGATCAATTCGACGTTCAGGGATTCCCTACCATGTACTTCAGATCTGCCTCCGGTAAATTGTC
ACAGTATGATGGTGATAGAACAAAAGAGGCAATCATCGAATTTATTGAAAAGAATCGCGACAAGCCTGTTCAGTCAGAC
TCTGCCAGAACCGATTCAGCAAAGGATGAACTATAGAGGTCTTTGGGACACAGTGCACTGGTGGTGGATGTAAGATTTG
TTGGGGATATGCTGTTTTGATTTCCCTACAATGTCGCACCGACTGCCTTTCTCGACTGCTCTCCCCATGTACTTTAAGC
CTCATCTGTTTCCTGTTTTAGTTTTTTGGTTCTTTTT
```

> SEQ ID NO: 7202 36934 38979_300200_1b
```
CCCACGCGTCCGCTCAATCTAGCTCTCTTCTCTATCTTTCTCTAAATCATGGGTCTTCCTGAAGATTTCATCACCGAGC
TTCAGATTCCAGGTTACATATTAAAGATACTTTACGTCATCGGTTTCTTTAGAGACATGGTCGATGCTCTTTGTCCTTA
CATCGGTCTACCAAGTTTTCTTGACCACAACGAGACCTCTCGACCCGACCCGACCCGACTCGCTCTCTCCACGTCAGCA
ACTCTTGCCAACGAGTTAATCCCGGTGGTTCGTTTCTCCGATCTCTTGACCGATCCGGAAGATTGCTGCACGGTTTGCT
TATCCGATTTTGTATCCGACGATAAGATTAGACAGCTACCGAAGTGTGGACACGTGTTTCATCATCGTTGTTTAGACCG
TTGGATCGTTGACTGTAATAAGATAACGTGCCCGATTTGTCGGAACCGGTTCTTACCGGAGGAAAAGTCCACGCCGTTT
GATTGGGGTACTTCAGATTGGTTTAGAGATGAAGTGGAGAGTACCAACTAATAATGATGGTTTTACTTTTACTTTTTAC
TTTTTTCACGGTAATATTTTTCTACTGTATAATTCTTTCTTCCAAACTACTGTATAATTCAAGTATAAGATTATGTAAT
TGTGTATATTAGCATCAATCATCTTTCTTTGTTAAAGAACCGACTGTATAAAATCATCCAATGTAATCTGCTTTTCTTT
TATTTGAATAAAAAAGTGGACAGATAAACCAAAAAAA
```

> SEQ ID NO: 7203 36934 43424_300031_1b
```
CCCACGCGTCCGATTTTTTACACACTAAATTGTTAAATTGGGTCACACAATTCGTGTGTTCGGTTCTGTTCTTCTGAAA
CCGAACATTTTAGTATTTCGATTTTCGAGAAATAATGGGTTTCCCTGTTGGTTACACGGATTTATTCCTACCCAAATTG
TTAGTCCACGTACTAACAATTCTGGGTTTTATAAGAAAGTTCATTTGCACGCTTTTCACAGTTCTGGGTCTTGGAGATT
TCCTCGAACCCGAAATGTCATTTCCGACCCGACCCGAATCTCACTCGGAGCTCCACTCAGTGTCAGCAACGTTGATCCG
GGAGCTGTTGCCGGTGGTTAAGTTCTCCGAACTTGTTAACCCGCCGGAGAGCTGTGCCGTTTGTTTTGTACGAATTTGAT
GGGGATGATGAGATCCGACGCCTCACAAATTGCAGACATATATTCCACCGGAGCTGTTTGGACCGTTGGATGGATCATG
ATCAGAAAACTTGTCCACTTTGCCGTACGCCGTTTATCCCGACGATATGCAAGATAGTTTTAATGAGAGATTATGGTT
GGCTTCCGGCATTTCTGATTTTTACGGCGAGTATTCTCCGGTCGCCGCCGGTTTGTAGCACTACCGATTTTTATTTTTC
CGGTAGTTGGGATTTGATAATGTAAAATGTATATACTACAAGAGAAAGAAAAGAAAAAAGATGAGGGAGGAAAAGATTT
TAAAAAAAATTACTCCTATTTGTATAGTGTACAATTTTGAGACTATGGAAGGAAAATCAATAGATTTTGAACT
```

> SEQ ID NO: 7204 39086 107563_300379_1b
```
CTCATATTCAGACCCTCATTTTCCTTAGTATTAGCTCTCCATTAATTTCTCACCCCCCCCCCCCCCAACCAAATCCCCA
ACTATTATACACCACACCTCTCCACTAGTTATACCCGTAACGCCCACTAATTACACAAAACTCTGTAACTCCCACAACA
GTTCATTTCTTGCTTTTCCTCCCTTTTTTCCAGGCCAAGCTTATTTGACAGAGAATACACACAAGGCAGAAAAATGGTT
TCTTCTTCCAGGCTAACCTTTACACTTGCTTCCTTGTTATGCCTTGTTTGGCTGCTCACTATTTCATCTCCGGCAACAG
CTTCCTTCGCTTGCCGTTCCGGCGGAACCTGTGACGCCATTATTGACTACATTTTACCTAACGCCACCACCTATAACGC
```

FIG. 2 continued

```
CGTTAAAAAACTGTTCCATGTCAAGAACCTCCGTTCCCTCCTCGGCGTTAACAACCTCCCTATCGACACCCCTGCTGAC
CAAAAACTCCCCGCTAATCAAACCATCAAAATCCCATTCCCTTGTCTCTGTAGAAATGGTACCGGAATGTCCAACAAGC
GACCCACTTACACCGTCGTATCCGGTGACTCCCTTTCACACATCGTCTCCGATATCTTCGCCAATTTATTTACCGTTCA
GGAACTCCAGACGGTTAACAACATAACCGACCCGAATGTGATACAACCAGGAGATAAGTTTTGGGTCCCACTTCCTTGC
AGCTGCGATGACGTTGACGGTGAAAAGGTTGTTCATTATGGTCATTTGGTGGCCGCCGGCAACACCGTGGATGCCATTG
CTCAGCAGTACAATGTTTCCCAGGATACACTTTTGAAATTAAATGGTTTATCAGATCCGAAAGAACTTATAGCTGGCTC
TGTTCTTGATGTTCCCCTTAAAGCTTGCCAATCAATGGTGAGCAATACCTCACTGGACTATCCTTTGCTCGTCCCAAAT
GACACATATGTCTTCACTGCTGCCAATTGTGTAGCATGCAAGTGTGATGCTGCAAAGAACTGGACCTTGCAATGCCAAC
CATCTCAGATAAAGTCCTCTCTTTGGAAGTCATGCCCCTTGATGCAGTGCCAAGGTCTGGATAGCTTTTACATTGGGAA
TGCCACGTC

> SEQ ID NO: 7205    39086  130567_300488_1b
GAATTCGAAATCTGATGAAGGTTTCGACTGTAAGGGCTCTACCAAATGTATATCTCTAGCTGGTTATGTAGCACCCAAC
GCTACCACCTACTCAAGCATCGCATCTCTCTTCGGGATAAAAGATTTGAATGTTTTACTGGGAGCTAATTCTTTACCAC
CTGGAACTTCAGCAAGCAAATCAGTCGCCGCGAAGGAGACTGTCAAAATCCCTTTCCCTTGTTCTTGTAATAATGGAAA
CGGTATATCCGATCAAACTCCGGTTTATACAGTAAAAGCAGGGGACGGTTTAGATCACATCGCCAGGAATATATACTCG
TTGTTGATTACATATGAAGAGATCGCTGAAGCTAATAATATTCCTGATGTTAACAAGATTGAAATTGGCCAGCGTTTGA
ATATCCCACTTCCTTGTAGCTGCGATTCTGTCGATGGAAATCCAGTCGTTCATTATGCACACAAAGTGGCTTCTAAAGA
AACTTTAGATATGATTGGGAAGAAGTTTGGGGTAGCGGAGAAGACTCTATTGCGGCTCAATGATCTTGATAATGCTAAA
GACCTCAAGGCTGAATCAGTTCTTGATGTTCCATTAAAAGTTTGTACGTCTATGGTAAACTCCACTTCGC

> SEQ ID NO: 7206    39086  38839_300194_1b
GCAGTGGCTCAACCTCGACGTGTCAATCTCTCGTTGGTTACTCAAGCAAGAACGCAACAACGTTGCGCAATATCCAAAC
CCTTTTTGCCGTCAAGAACCTCCGCTCGATCCTCGGAGCTAACAATCTCCCACTCAACACCTCACGTGACCAACGCGTG
AACCCGAATCAAGTCGTACGTGTCCCAATCCATTGCTCTTGCTCCAATGGAACCGGTGTCTCGAACCGGGACATCGAAT
ACACCATCAAGAAAGACGACATACTCTCTTTCGTCGCAACTGAGATTTTCGGTGGTCTCGTTACGTACGAGAAGATCAG
TGAGGTTAACAAAATCCCTGACCCGAACAAAATCGAAATCGGTCAAAAGTTTTGGATCCCT

> SEQ ID NO: 7207    42037  104492_300410_1b
GCCATTACGGCCGGGATCTTGGAAGTTTAAAGGAAAAGGGAGAAAGAGAAATCTTTCTGTCTTAAGAGTAATTAGCAAT
GGCTTCCTCAGTTCTTTCCTCAGCAGCAGTTGCCACCCGCAGCAATGTTGCTCAAGCTAACATGGTTGCACCTTTCACA
GGTCTTAAGTCTGCTGCCTCATTCCCTGTTTCAAGAAAGCAAAACCTTGACATCACTTCCATTGCCAGCAACGGCGGAA
GAGTGCAATGCATGCAGGTGTGGCCACCAATTAACATGAAGAAGTATGAGACTCTCTCATACCTTCCCGATTTGAGCCA
GGAGCAATTGCTCTCCGAAATTGAGTACCTTTTGAAAAATGGATGGGTTCCTTGCTTGGAATTCGAGACTGAGAAAGGA
TTTGTCTACCGTGAACACCACAAGTCACCAGGATACTATGATGGCAGATACTGGACCATGTGGAAGCTACCTATGTTCG
GATGCACTGATGCCACCCAAGTGTTGGCTG

> SEQ ID NO: 7208    42037  125341_300630_1b
GGAGGAAAAGGGAGAAAGAGAAATCTTTCTGTCTTAAGAGTAATTAGCAATGGCGGGCTCAGTTCTTTCCTCAGCAGCA
GTTGCCACCCGCAGCAATGTTGCTCAAGCTAACATGGTTGCACCTTTCACAGGTCTTAAGTCTGCTGCCTCATTCCCTG
TTTCAAGAAAGCAAAACCTTGACATCACTTCCATTGCCAGCAACGGCGGAAGAGTGCAATGCATGCAGGTGTGGCCACC
AATTAACATGAAGAAGTATGAGACTCTCTCATACCTTCCCGATTTGAGCCAGGAGCAATTGCTCTCCGAAATTGAGTAC
CTTTTGAAAAATGGATGGGTTCCTTGCTTGGAATTCGAGACTGAGAAAGGATTTGTCTACCGTGAACACCACAAGTCAC
CAGGATACTATGATGGCAGCTACCTATGTTCGGATGCACTGATGCCACCCAAGTGTTGGCTGAGGTGGGAGAGGCGAAT
AAGGAATACCCACAGGCCTGGGTCCGTATCATTGGATTTGACAACGTGCGTCAAGTGCAGTGCATCAGTTTCATTGCCT
CCAAGCCTGACGGCTACTGAGTTTCATATTAGGACAACTTACCCTATTGTCTGTCTTTAGGGGCAGTTTGTTTGAAATG
TCACTTAGCTTCTTTTTTTTCCTTCCCATAAAAACT

> SEQ ID NO: 7209    42037  107651_300380_1b
TGGTATCAACGCAGAGTGGCCATTACGGCCGGGATCTTGGAAGTTTAAAGGAAAAGGGAGAAAGAGAAATCTTTCTGT
CTTAAGAGTAATTAGCAATGGCTTCCTCAGTTCTTTCCTCAGCAGCAGTTGCCACCCGCAGCAATGTTGCTCAAGCTAA
CATGGTTGCACCTTTCACAGGTCTTAAGTCTGCTGCCTCATTCCCTGTTTCAAGAAAGCAAAACCTTGACATCACTTCC
ATTGCCAGCAACGGCGGAAGAGTGCAATGCATGCAGGTGTGGCCACCAATTAACATGAAG

> SEQ ID NO: 7210    43445  38584_300201_1b
CCCACGCGTCCGGAATGATCCTAATCCGTTTAGCTTTTAAAAAAATAAGAAGACATATTTATCAACTTGATCAACTTGA
GCAAGTTGCAGCAGATATTTTCCTCGGCCAAGATCTAGAGTTTTGAGAATGGCGATGGTATCAGGAAGACGATCTACTC
TAAACCCCGACGCACCTCTTTTATTCCGGCAGCTGTACGACAAGTGGAAGATTTCTCACCGGAGTGGTGGCAATTGGT
```

FIG. 2 continued

GACAACTTCGACTTGGTACCCTGATTACTGGATCAGTCAGCAGCAGCAAGGCGCGGATGGTTTCTATGACAACGGAGAG
AATGAGAATGGTGGAG

> SEQ ID NO: 7211 43460 115025_300011_1b
CAAATTCTTAAAACTATCTCCACTATCTCTTTCTCTCTCTAGACAAATTAAGAACCCTTAGCGTAAACTCTGCGACCGA
AGAACCCCACCCACCCAGGCAGCCTTCAATTCAATTCCAATGGCGAACAGCAATCTTCCTCGCCGAATTATCAAGGAAA
CTCAACGGCTTCTCAGCGAACCTGCACCAGGAATAAGTGCATCTCCATCGGAAGATAATATGCGATACTTTAATGTCAT
GATTCTTGGTCCTACACAGTCTCCTTATGAAGGAGGCGTCTTCAAGCTCGAACTCTTTTTGCCTGAAGAGTACCCGATG
GCTGCTCCTAAGGTTCGATTCCTCACCAAAATCTACCATCCGAACATTGATAAGCTTGGAAGGATATGTCTTGATATTC
TTAAAGACAAGTGGAGTCCTGCACTTCAGATCCGTACTGTACTTTGAGCATTCAAGCACTTTTGAGTGCTCCAAATCC
GGATGATCCACTCTCTGAGAATATCGCAAAGCACTGGAAGTCAAATGAGGCTGAAGCTGTTGAAACGGCTAAGGAGTGG
ACACGCCTATATGCAAGTGGTGCATGAAGGCATTAGCAACGAAATATTTAAAAATAACAAAAATTATGGACTGTATCCT
ATTGACTTGCTTATCAATATGGATGGCTGTTAATGCCTGGACTCTTCCGATTGCCTCCCATAATTGCTTCCCTGTCCTT
G

> SEQ ID NO: 7212 43460 3194_300098_-1b
CCCACGCGTCCGAAGGCTCTCTCTGTCTCTTTCTCAAAATCATCTGCAGGAAGTGAATCGTCAAAACCGAGTTTGGAGG
ATCTGTCTTGAGGGTTTGGTTTTTTGGATCTAGGAGTTTTTTTTTGGTTGAGAAATGGCTTCGAAACGGATCTTGAAAG
AGCTCAAGGATCTCCAGAAGGATCCTCCAACTTCCTGCAGTGCTGGCCCAGTTGCTGAAGACATGTTTCATTGGCAAGC
TACAATAATGGGTCCATCCGATAGTCCTTATTCAGGCGGAGTGTTTCTCGTAACCATCCACTTCCCACCGGATTATCCT
TTCAAACCACCAAAGGTTGCATTCAGGACAAAAGTGTTCCACCCTAATGTCAACAGCAACGGAAGCATTTGCCTTGACA
TTTTGAAAGAACAATGGAGTCCTGCACTGACCATATCGAAGGTTTTGCTTTCGATATGTTCATTGTTAACGGACCCAAA
CCCAGATGATCCATTGGTTCCAGAGATTGCTCACATGTACAAAACCGATAGAGCAAAGTATGAGTCTACTGCGAGAAGC
TGGACTCAGAAATATGCAATGGATGAAAGTTTGTGTCCTTTGATCCCTCAAAGACTCGGTTTTAATAGAGAGAAGAGA
GAAAGAGAGAGGACTTCTTCACATAGGGATCTTCCATGAAATAAGTTAGATTCCTATGTTTTATCATCTCTCTGTTTGA
AACCTCTTTAATCTCAAACAAAAACATTCCTTCTCCTAAAAAAAAAACCAAAAAAAGGGCGGCCGCACCCTAGGCCAGT

> SEQ ID NO: 7213 43460 55711_300141_1b
AACCTGATGATGGATATTACCACAATGGTACGTTTGTTTTCACATTCCAAGTCTCTCCTGTGTATCCACATGAAGCTCC
AAAAGTTAAATGCAAAACCAAGGTTTATCATCCCAATATCGATTTGGAAGGAAACGTTTGCCTGAACATCTTGCGTGAA
GATTGGAAACCTGTTCTTAACATTAACACAGTTATCTACGGACTCTTCCATCTGTTCACGGAACCCAATTCTGAAGATC
CCTTGAACCATGATGCTGCAGCAGTTTTGAGGGATAACCCAAAGCTCTTTGAGACCAATGTTCGCAGGGCCATGACCGG
TGGATATGTCGGT

> SEQ ID NO: 7214 44146 108007_300057_1b
CCCACGCGTCCGAGCTCGTCAAAGATGCTTTCCAAAACTAGCCTTTTTCTTTGCCTTTCTTTGGCTATTTTGCTAATAG
TAATATCCTCACAAGCTGATGCAAGGGAGATGTCTAAGGCCCTGCTACAATAACCCAAGCAATGAAGATGGGTGCAGG
AATCAACGGCGTCGGCAAAGGCGTTGGCAAAGCCGTTGGCAAAGCTGTTGGCAAAGTAGCCGGCAAAGCTTGTAAAATT
TGCTCATGTAAATACAAAATTTGCAGCAAATGTCCTAAATGTCATGATTAAAGTTAGGCCTCAGAGACTATGTACTTGT
GCTGGTGTGAGTTTAGTTTTGAGAATAAAGGGAAAGCTATGAATAGCCTAATATAATTCTATTCACTTTGTTTTGTTAG
TAGTTGCAACTTGCAACAAGTCTTTGGGTCAAAATGTACCTCGTCTTGTAGTCTTTCAACTGTATAACATTGTACTGTA
CTGTATTTTGTCTTTAGCCACTTG

> SEQ ID NO: 7215 44146 128962_300401_1b
CCCCCCTGCAGCTGAACGGCTTGATTGAGGCTTACGTTGAAAAAACAGGCAGCGAGAAAGGTGCCACGATTTTGAGAGA
ATGGGAGGCATATCTGCCACTCTTCTGGCAACTGGTACCACCAAGTGAAGAAGACTCTCCTGAAGCTTGTGCCGAGTTT
GAACGAGTACTTGCCAAGCAAGCAACAACAGTACAATCGGCGAAGTGATCTACTGCAATTCCCAAGTGATCAGATTAGA
CAACAGGAAGGTGTTCTTTGGTACTTTCCAGGTGATTTTTTCCTGGGACCGCATCAAGGAAAACAAAATAACAACTGGC
ATACTTGTGAAGCACCGAAGTGCCCCAAAGACTGCGATTTTGTGGAAGCTCTGCCCAAGGCATCTTTTGAAACGAAGT
TTCACATGATCGTGGAGGATTCTTCTTTGCGCCCTTGCACTTGCACGCCCTAGTTAACCACCCCCTGTAAATTGGTTT
GCTGACGCTAGGTTGCTATTTGCAGAGGCAGTGAAGACACACTTCTAAACTTCTCCATTCCTGTACAGGATTCGTGTCC
TATGTAATCGTATTTTTGGTTCTGGACACATTAGTTCTTACATTTATACCCGTCCAGTGGGGCATGCGAGTCG

> SEQ ID NO: 7216 44146 35584_300102_-1b
GCTGCAGGGGAATTGCAGCTGAAGAGCTTAATTGAAGCACATGTGGAAAAAACCGGAAGCAGCAAAGGCGCAACGATTC
TGAATGAGTGGGAAAAGTATCTACCTCTCTTCTGGCAACTGGTTCCACCGAGTGAGGAAGACACTCCTGAAGCTTCTGC
TGCTTACGTAAGAACATCCACCGGGGAAGTCACATTTCAATCGGCTTAGAGATCATTCAAGAGCAGGTTGTGGCAGTTG
AAACACAAGGATTGATATACATCAATGGTGGAGGACTATGGAGAGCAGATTAATGGAAAATCATTATCATTCACATGTA

FIG. 2 continued

GATCAAATGTGTGGGACAATATTCTTATTGTCTTGTGATCTTTACAACAATACCATGGTTGCTATAACTGTACAGTAAA
TTCAGTAAAATAACTGCTTTCAACTGTCAAAA

> SEQ ID NO: 7217 44146 44076_300028_1b
GGCACAAAAAAAATTGAAGCTTGGAATAGCTCATCAAAATGGTTTGGAAAACTAATCTTTTTATTTGTGTTTCTTTGGC
TATTTT

> SEQ ID NO: 7218 44189 38812_300194_1b
CCCACGCGTCCGGAGAGAAGAATAGTTTGATCATCTTGTGAGAAAAATAATGGCTGCTTCAGTGATGCTATCTTCGGTG
ACATTGAAACCAGCTGGTTTCACGGTGGAGAAGACGGCGGCTAGAGGATTACCGTCGCTCACAAGAGCTCGTCCCTCCT
TCAAAATTGTCGCCAGTGGCGTCAAGAAGATCAAGACCGACAAGCCCTTCGGAATTAACGGCAGCATGGACTTGAGGGA
CGGCGTCGACGCCTCCGGCAGAAAGGGCAAGGGATACGGTGTTTACAAGTACGTCGACAAGTATGGAGCTAACGTCGAT
GGATACAGTCCTATTTACAACGAGAACGAGTGGTCGCGAGTGGTGACGTGTACAAGGGAGGAGTCACCGGATTGGCAA
TTTGGGCGGTAACTCTCGCCGGAATTCTTGCCGGAGGTGCTCTTCTTGTGTACAACACAAGTGCTTTGGCTCAGTAAAT
CTTAAAGTTGTTAGCGCATGTGTAATCATGTTTCTATAAATGTTTCTGTGTTGTTCTCTTTCTCTCTAATGTTGTAAAA
CTCAGACATACTTTGAATTTATAAGACTTCTAGTGTTTGTATAA

> SEQ ID NO: 7219 44189 126679_300465_1b
GCCATTACGGCCGGGGGAGAGCCACATTTACTAGTTAGAGCAGAAGAAGAGAGTATAGGAAATGGCAAGCACAGTAATG
AGCTCATTGAGCCTCAAACCTGCAACTTTCAGTGTTGAGAAGACAGCAGTGAAAGGACTGCCATCACTTGCTAGGTCTT
CTTCTTCCTTCAGAGTTCAAGCTAGTGGTGTCAAGAAGCTTAAGACCGACAAGCCTTACGGAATTAATGGAAGCATGAG
CTTGAGAGACGGCGTTGATGCCTCAGGCAGGAAGCCAAGGGAAAGGGTGTTTACCAATTCGTTGACAAATATGGAGCA
AATGTTGATGGATACAGCCCCATCTACAACACAGATGCTGGTCTCCAAGCGGTGATGTCTATGTTGGAGGCACCACTG
GCTTAGCCATATGGGCAGTCACCTTGGTTGGCATTCTGGCTGGAGGTGCTCTCCTTGTTTTCAACACAAGTGCTTTGGC
ACAGTAGATCATTATCCTTGTACTCCTATTTCAGTTGTATTCCAGCTCGCACCATGTATCTTTTCAAGAATACTTTGTA
TTTGCTGGCATCTTGATTAATCTGTAATTGCTGTGGATATTACACATAATGTTGATTATTTAAGGTATTTGTGATC

> SEQ ID NO: 7220 44189 129549_300480_1b
GAATTCCCAACAACTCCATTCCAAGAGAAAGTTGCTAGCAGTATTCAAGGCCTTCCATCCCTAGCAAGGTCTTCCACTT
CACTCAGAATTTCTGCCAATCAAGTTAAGAAGATCAAGACTGACACACCTATGGAACTGGTGGTGGCATGAACTTGAG
GGGTGGTGTTGACGCATCTGGAAGAAAGCCCACGGGAAAGGGTGTCTACCAATACACCGACAAATACGGTGCTAACGTT
GATGGATACAGTCCAATCTACACCCCAGAGGAATGGTCCGAAAGTGGTGATAGGTACGCTGGAGGTGTAACTGGTCTAG
CAATTTGGGCAGCAACTCTTGGTGGTATTCTACTTGGAGGAGCTCTCCTTGTTTACAACACCAGTGCTCTAGCTTCTTA
GATGTCAATCAAATTGTTGTAATCCCATGTGTATGTTTTCAACAAGATTTTCTAAGTAAATGGTTGTCTAATACTCTCT
TGTACGCCCAAACTTATTTCGTAATTTGTATGAATTTGGTTGATGATATAGTACCACAATTTCT

> SEQ ID NO: 7221 44503 102972_300106_1
GCCATTACCGCCGGGGAATACAGTTTGGATTTTCTTTCTTTGTATGGGGAGAGCCAAGGCAATGGAAGGGAACACTAT
GTTCAAGTTATCTCATGTAACTGCTTTCTTGCTCCTTGCATCACTTTT

> SEQ ID NO: 7222 44503 104430_300410_1b
TTTTTAATAATACAAATTTAAAAAGCCACACTTATTTTATTTATTATATTGAAATAGTACAGTACATGAAGAGTACACT
ATAGAACACCAGTACTCTATTTATTAATTCTTGGGGCAACTTATTCTGAATCTTCCATAATAGTCCCATAGAACTATTT
AATTAACCCATGCTGGGAGTATCTCGAACAATGAGTTTCCAGTTAACAACAACAAAAACTCGACCACAAACATAATTAA
GTGGCCTAACCATACCAGGGAACAAAAACTGAACTTTGGCTATGGGATTTTCTTTCTCAATTATTCTCTTAGCAGTCGC
CGCTGGCTTTCCCACAAGTTCAGGCCCATGATTGCTTTCCTGGGCAAATTATTGAGAGAGAGGGATCATCAAGTGTTTCC
ACTTGGTTTTCTTTTGCCATTGGGAATTGCAAGACTTCTATTCCGTACTTACTTCGAATACTAGATCTCTTGCCGTAA
GAGGTTGAAAAAGCGATGCAAGGAGCAAGAAAGCAACTACATGAGATAACTTGAACATAGTCTTCCCTTCCATTGCCTT
TGCTTTGAAAAATACAAAGAAAGAAAATCCAAACTGTATTCCCCGGCCGTAATGGC

> SEQ ID NO: 7223 44508 2716_300338_1b
CCCACGCGTCCGATCGACTCATCTCTCAGCTCACCGGTGCTGCATTATCAAAACTGCAGGAAGGATTTGGTTGTGAAGA
TGGCATCGAAGTTGATACAAGTTCAATCAAAGGCATGTGAGGCTTCAAAGTTTGTGGCTAAGCATGGAACTTCCTACTA
CAGACAGCTGTTGGAGAAGAACAAGCAGTATATCCAGGAACCTGCCACTGTTGAGAAGTGCCAAGAGTTGTCTAAGCAG
TTGCTCTACACCCGTTCTTGCTAGCATTCCCGGACGCTATGAAACCTTCTGGAAGGAAGTAGACTACGCAAAGAACCTAT
GGAAGAACAGATCCGGTCTGAAGGTAGAAGATGCAGGAATCGCTGCATTGTTTGGTCTCGAATGCTTTGCATGGTATTG
CGCAGGTGAAATCGCCGGCAGAGGATTCACCTTCACAGGCTATTACCCATGAAGGAGAGTAACAATA

FIG. 2 continued

> SEQ ID NO: 7224 44508 116832_300515_1b
GCTGGCGCAGCTACGGTCCAAGGCGGCGCAGGCGTCGGAGCTCGTGTCGAAGCACGGGTGCGCCTACTACAAGGAGGTG
ATGGAGAAGAACAAGCAGCACGTGGTGCAGCCACCCACCGTGGAGAAGTGCCAGGAGCTCTCCAAGCAGCTCTTCTACA
CCCGCCTCGCCAGTTTGCCAGGCCGCTATGAGGCATTTTGGAAGGAATTTGATGGTGTCAAGCAGGTATGGAAGAATAG
AAAGGAGCTCAAGGTAGAGGACCTTGGAATTGTGACATTATTTGGAGTTGAGCTTTATGCGTGGTTCTGCGTAGGCGAG
ATTGTTGGCAGAGGATTCACCATAACCGGCTATAAGGTCTAGAAGAGTTCTGATTAAGACCTGGTTTATAAAATACACT
GTTAGCTGATGCTTGTCGAAATGACAAAGATACCTCCTGCCTTTTCACAATTTTGTTTATGGAAAGTCTTTCTAGTGCT
GGATGTCAGCCAAGACGAGCACATCGTTGCAACACTGCTTCAATAATTTGCTCGATCTCT

> SEQ ID NO: 7225 44508 128371_300475_1b
AAACATCGCCCATAGTATTACTGCAAATTGTTGACGAAAGGACTTTCTTGGTATTGATGGCATCCAAGATTCAGCAACT
GCAATCTAAGGCATGTCAAGCTTCACAGTTTCTTGCTAAGCATGGTACTGGCTACTACAAACAGATGCTGGAGCAGAAC
AAACAGTATATTGTGGAGCCACCCAGTGTTGAGAAATGCAATGAATTGTCCAAGCAGTTGCTCTACACTCGTCTTGCCA
GCATCCCTGCCCGTTATGAGTCATTTTGGAAGGAAGTCGATTCCGTCAAGCACATCTGGAGGAATAGAAAGGAATTGAA
GGTTGAAGATGCAGGTATTGCTGCTTTGTTCGGCTTGGAGTGCTTTGCATGGTATTGTGCTGGTGAGATAGTAGGAAGA
GGATTTACATTCACTGGTTACTATGTCTGAGATATCAGTTCCCAAAAATTTGTTT

> SEQ ID NO: 7226 44508 125370_300630_1b
GGCCCACGCGTCCGAAACCAAGAGGCGCAGGCAGCAAAGTCTCGCCCATCGTCTTTCCTTAACACCTATCCGTAGGTTC
ATTCATTTGCAGAGCTCAAAGGGAATTGATGGCATCCAAAATTCAGCAACTACAATCTAAGGCATGCCAAGCTTCACAA
TTCCTCACCAAGCATGGTACTACCTACTACAAACAGTTTCTGGAGCAGAACAAACAGTATATTGTTGAGCCACCCACCA
TTGAGAAGTGCAATGAATTGTCAAAGCAGTTGTTCCATACTCGTCTTGCCAGCATCCCTGGACGTTATGAGTCATTCCA
GAAAGAACTTGATTCTGTGAAGCACATGTGGCAGAATAGAAAGGATTTGAAGGTCGAAGATGCCGGTATTGCTGTTTTG
TTTGGCTTGGAATGCTTTGCATGGTATTGTGCTGGTGAGATAGTAGGAAGAGGATTTACATTCACCGGTTACTGCGTCT
GAGATCTTCAGTTTCATAAAATTTGTTCGCACGATTGACACTGCTGTAAGGTCTGTCTCATATTACGGTGTGACTGGGA
GTCTATACAAGAGTTTATGTACACCAAAAGCTTTTAAAGCTGAGAAATCAGCGCTTAAAATTGTTTCACAATAATATGC
CCATTTCGTTCTTTTCCCACTCCAGTGAAGTGGCTT

> SEQ ID NO: 7227 44508 254345_301632_1b
TCTCTCTTCCCCACCTTGGTTGAATATTCTCCATCGACGGGGAGAGACAACAACAGGCATGGCCTCACTACTGAAGCAA
CTGCAAGGCAAAGCATGCGTGGCCTCCCAGTTCGTGTCGAAACACGGATCGTCCTACTACAAATCCCTGATGGAGAGCA
ACAAGCAGTACATCGCCTCCGAGCCCACCGTTGAGAAGTGTCAGGAACTTTCCAAACAACTCTTTTACACCCGTCTTGC
CAGCTTGCCCGCTCGATATGAACACTTTTGGAAAGAGCTGGATCTCGTGAAGCAGAAAATCAAGAACAGGCAAGACTTG
AAGGTGGAGGAGGTTGGGATTGCTACATTATTTTCATTGGAGTGCTATGCATGGTATTGTGTTGGAGAAATTGCCGGAA
GAGGTTTCACTCTCACAGGCTATTATCCTTGACCTTTTTCAAGCTTCCATTTAAAAGTCTAATAGGGAACCAAGGAGAG
AGCTGTTTCAGACAAACCTTCCTAATAATGTCACCTGTGTGAATTTACATGACTGCAATTTTTGCAATTATCCGACTGA
GTCATGGTCCTTTGTCTCCTTTTCAGTCTTTTTAAAGATATTTGTTATATCATGGCA

> SEQ ID NO: 7228 4743 108496_300382_1b
GGAAATATTATTGGGAGAGAGGGGAAATTTCACCTTTGGTTTGACCCCACTCAAGCTTACCACAATTATGCTATCCTTT
GGGATCCCAATGAGATCATATTTTTTGTCGACGATGTTCCAATCAGAAGATACCCTAGGAAAAATGATGCTACATTTCC
ACAAAGACCTATGTATGTGTATGGTTCCATTTGGGATGCTTCATCTTGGGCAACAGAGGAAGGAAGAATTAAAGCCGAT
TATCGGTACCAACCATTCGTCGGAAAATATAACAATTTTAAAATTGCTGGTTGCACTGCTAACGAGAACCCTTGGTGCG
GACGCTCGCCCTCCAGCTCTCCGTCTAGAGCTGGTGGGCTGAGCCGCCAGCAGATAGCGGCCATGCTATGGGTGCAGAG
GAACTATAAGGTGTATGATTACTGTCGGGACCCCAGGAGAGACCATACCCACACTCCTGAGTGTTAGTACAATTCGTAA
AAATGCATTATTTGCATAAAATTTCATACTGTTAGTGAATATAAGCTGAAATCACGAATAAGAGGAATGAAACGTGTA
AAGGAATATTTGGTCATTTCACCAGAATTGACTTTCAATTGTACTTTATCTTTGAGTAAATGTTTTTTGTTTTTTAAT

> SEQ ID NO: 7229 4837 55863_300130_1b
TTTAAAAGATAATTGTGAGAAATAGATGATAACCCAAAGGTTTAGCAATCTCGAGAGTAAAAAAAAAGAAAACTCAAAA
CCAAAGATTATAATGGCTTCCTCAACCATGGCTTTGTCCTCCCCTGCCTTCGCCGGAAAGGCTGTGAAGCCTGCCGCAT
CAGATGTCCTCGGAAGCGGCCGTGTGACCATGAGGAAGACTGTCGCCAAGCCAAAGGGTCCATCAGGCAGCCCATGGTA
CGGATCTGACCGAGTCAAGTACTTGGGTCCATTCTCCGGCGAGCCCCCGAGCTACCTTACCGGTGAGTTCCCCGGTGAC
TACGGATGGGACACCGCTGGTCTATCCGCCGACCCAGAGACCTTCGCCAGGAACCGTGAGCTAGAAGTTATCCACAGCA
GATGGGCTATGCTCGGAGCCCTAGGCTGCGTTTTCCCTGAGCTTTTGGCTAGGAACGGAGTGAAGTTCGGAGAAGCGGT
TTGGTTCAAGGCCGGTTCACAGATCTTCAGCGACGGAGGATTGGACTACTTGGGCAACCCGAGCTTGGTCCACGCTCAG
AGCATCTTAGCCATTTGGGCTACTCAAGTTATCCTCATGGGAGCT

FIG. 2 continued

> SEQ ID NO: 7230 4837 41671_300197_1b
CTCGAGCTTGCGGCCGCCCGTATTATACATAAAATCTCATGTATCTTTACATCAAACTTCAAATCTAAATACAAAAACA
AAAAGAACATCACTAGAGATGGATCTCTCGTCGGACAAAACCCCGAAGTTTCGTCTTTCACGGTCAACTTTAGTCAAAC
TCCGATCCGAATCAAACCAAAAAGGGTTTTTCATTCATCGATCATAGTCATCATCTCCTTTTTAGACAAAAGATTCTCA
GCTTCTCTGGATCATAAGGAAGAGTCTAGAGCAGGAGCGTCGGATCCCTTCATGATTCTGAGTCTCTTACAAGAAGAAG
AGAACATGTCCCATGGAACATCACCAACCAACATCCAGTCACCATCTTTATCTTCGTAT

> SEQ ID NO: 7231 4837 47338_300170_1b
TCGCGATCTAGAACTCTTATTAACTAAAGAGCCTTTTACTTGCGCCACACTCTCACCGCAATGGCCGCCTCGACAATGG
CTCTCTCCTCTCCTGCTTTGACCGGAAAGGCCGTTAAGCTATCCCCGGCGGCCTCCGAAGTATTTGGAACCGGCCGAAT
CACCATGCGCAAAGCCTCCAAGCCCACCGGTCCATCCGGCAGCCCATGGTACGGATCCGACCGAGTCAAGTACTTGGGT
CCATTCTCCGGTGAGCCTCCGAGCTACCTCACTGGAGAGTTCCCCGGTGATTACGGGTGGGACACTGCCGGTCTATCCG
CCGATCCCGAGACCTTCGCTAGGAACCGTGAGCTAGAAGTTATCCACAGCAGATGGGCCATGCTCGGAGCCCTAGGCTG
CGTTTTCCCTGAGCTATTGGCTAGGAACGGAGTGAAGTTCGGAGAAGCGGTTTGGTTCAAGGCTGGTTCACAGATCTTC
AGCGACGGAGGATTGGACTACTTGGGCAACCCGAGCTTGGTCCACGCTCAGAGCATCTTAGCCATTTGGGCTACTCAAG
TTATCCTCATGGGAGCTGTTGAGGGCTACAGAGTCGCCGGAGATGGTCCATTGGGAGAAGCAGAGGACTTGCTTTACCC
AGGTGGGAGCTTCGACCCATTGGGCCTCGCTACTGACCCCGAGGCTTTCGCGGAGTTGAAGGTGAAGGAGCTCAAGAAC
GGAAGGTTGGCTATGTTCTCTATGTTTGGATTCTTCGTTCAGGCCATTGTCACCGGAAAGGGACCGTTGGAGAACCTCG
CGGACCACTTGGCTGATCCAGTCAACAACAATGCATGGGCCTTCGCTACCAACTTCGTCCCCGGAAAGTGAGTTTAATT
TGTGATCGAGTTGTGTGTATCCGGTTTGTTGCATCTTGGAAATGTGATGCAGATTTCATATCTTGTAAATTACTTTGTA
TGTGTGTGAAATATTTAAGAAGCTTTATGATAAAAAAAAAAAACCAAAAAAGGCGGACGCGTGGG

> SEQ ID NO: 7232 4837 103534_300363_1b
TGGTATGAACGCAGAGTGGCCATTACGGCCGGGGACAGCTATTTTCTCTATTACTTCAGCCATCAAAAAACACTTATTT
CTCCTTATTAAACCATGGCTGCTTCTACAATGGCTCTCTCTTCCTCTTCTTTTGCCGGAAAGGCAGTAAAACTATTACC
GTCTTCCTCTGAAATCACCGGAAATGGGAAAGTTACCATGAGGAAGACTGCTAGCAAGCCCAAGCCTGTATCTTCTGGC
AGCCCATGGTACGGTCCTGACCGTGTCAAGTACTTGGGCCCATTCTCTGGTGAGTCCCCAAGCTACTTGACTGGTGAGT
TCCCTGGTGACTACGGGTGGGACACTGCTGGACTTTCAGCTGATCCAGAAACTTTTGCCAAGAACCGTGAGTTGGAGGT
GATCCACTGCAGATGGGCAATGCTTGGAGCTCTTGGTTGTGTCTTCCCCGAGCTCTTGGCCCGTAACGGTGTCAAGTTT
GGTGAGGCTGTATGGTTCAAGGCTGGATCCCAAATTTTTAGCGAGGGTGGACTTGACTACTTGGGCAACCCAAGTTTGG
TCCATGCTCAAAGCATCTTGGCCATTTGGGCTTGTCAAGTTGTGTTGATGGGAGCCGTTGAGGGTTACCGTGTTGCTGG
TGGGCCTCTTGGGGAGGTTGTTGATCCACTCTACCCCGGTGGCAGCTTCGACCCATTGGGCCTCGCTGAAGACCCAGAA
GCTTTTGCTGAGCTCAAGGTAAAAGAGATCAAAAATGGTAGACTTGCCATGTTCTCCATGTTTGGATTCTTTGTTCAGG
CTATCGTAACTGGAAAGGGCCCATTGGAGAACCTTGCCGATCACCTTGCAGACCCAGTTAATAACAACGCTTGGGCCTA
CGCAACAAACTTTGTCCC

> SEQ ID NO: 7233 4837 112407_300002_1b
AGGACTTTGGTCCTACCTAGTTATTTATATACAGTTGCTGCAAGGCCATTAAACTCAAGCCATAAATCAAATATTCTTT
CTGTGTAGTAGCTGCATTTTCAAGAGCATTTCACTTTATTTCTGCAACAATGGCAGCTTCTACAATGGCTCTCTCTTCC
TCTTCTTTTGCCGGAAAGGCGCTGAAACTCTCACCATCTTCCTCTGAGATCACCGGAAATGGAAAAGTCACCATGAGGA
AGACAGTTACCAAGGCGAAGCCAGTCTCTTCTGGCAGCCCATGGTATGGTCCTGATCGCGTCAAGTATTTGGGCCCATT
CTCTGGTGAGTCTCCAAGCTACTTGACTGGTGAGTTCCCTGGTGACTACGATGGGATACTGCTGGACTTTCAGCTGAT
CCAGAAACTTTTGCTAAGAACCGTGAGCTAGAGGTGATCCACTGTAGATGGGCCATGCTTGGAGCTCTTGGTTGTGTCT
TCCCCGAGCTCTTGGCCCGTAATGGTGTCAAATTCGGTGAGGCTGTATGGTTCAAGGCTGGATCCCAGATTTTTAGCGA
TGGTGGACTTGACTACTTGGGCAACCCAAGTTTGGTCCATGCACAAAGTATCTTGGCCATTTGGGCTTGCCAAGTCGTG
TTGATGGGAGCTGTTGAGGGTTACCGTGTTGCTGGTGGGCCTCTTGGTGAGGTTGTCGACCCACTCTATCCTGGTGGTA
GCTTTGACCCATTAGGTCTTGCTGATGATCCAGAGGCTTTTGCTGAGCTCAAGGTGAAGGAGATCAAGAACGGTAGACT
TGCCATGTTCTCAATGTTTGGATTCTTCG

> SEQ ID NO: 7234 4837 158561_200019_1b
CGTCCGAAAATTCTTTCTGTGTGTAGTAGCTGCATTTTAAAGTATTTCTTTTTATTTCTACAATGGCAGCTGCTACAAT
GGCTCTCTCTTCCTCTACTTTTGTTGGAAAGGCAGTGAAACTCTCACCATTTTCCTCTGAAATCACTGGAAATGGGAAA
GTTACCATGAGGAAGACGGCTAGCAAGGCCAAGCCAGTTTCTTCTGGTAGCCCATGGTACGGTCCTGACCGTGTCAAGT
ACTTGGGACCATTTTCTGGTGAGTCCCCAAGTTACTTGACTGGTGAATTTCCCGGTGATTATGGGTGGGACACTGCCGG
ACTTTCAGCTGATCCAGAAAACTTTTGCTAAGAACCGTGAGTTGGAGGTGATCCACTGTAGATGGGCCATGCTTGGAGCT
CTTGGTTGTGTCTTCCCTGAGCTCTTGGCCCGTAACGGTGTCAAATTCGGTGAAGCTGTATGGTTTAAGGCTGGATCCC
AAATTTTTAGTGAGGGTGGACTTGACTACTTGGGCAATCCAAGTTTGGTCCATGCACAAAGCATCTTGGCCATTTGGGC
TTGTCAAGTCATGTTGATGGGAGCTGTTGAGGGTTACCGCATTGCTGGTGGGCCTCTTGGTGAAGTTGTTGACCCACTT

FIG. 2 continued

TACCCCGGTGGCAGCTT

> SEQ ID NO: 7235 4837 134970_300420_1b
AGGGCGGCGGAGGAGGAGGGACGGATGCGGCTCCGCTGACGCTCGAGCTGCTGCCCAAGGGCGGGGCCAAGCGCGGGTT
CGCGGACGCCATCGTTGGGGGTCCCGCCGGCCAGCGGCGGGAGGCGGCCGGGGGCAAGGCGGCGGCGGCGGCGGCGGCG
GCGGAGGCCGAGGAGGAGGAGGAGAAGAAGAAGGCGCAGGCGCCGGCGGCGAAGGCACAGGTGGTAGGATGGCCACCAA
TCCGCAGCTACAGGAAGAACACCATGGCGATGAGCCAGCCTGCTCTGAAAGGCAAAGACGACGGCGAGGCGAAGCAGGC
TCCGGCATCCGGTTGCCTCTATGTCAAGGTGAGCATGGATGGTGCTCCTTACCTCAGGAAGGTGGACCTCAAGATGTAC
AAGAACTACAAGGAGCTCTCTTTGGCTCTGGAGAAGATGTTCAGCTGCTTTACCGTCGGTCATGGTGAATCAAATGGGA
AGTCAGGGAGAGATGGATTATCTGATTGCCGCCTGATGGATCTTAAAAATGGAACAGAACTTGTGCTCACTTATGAGGA
CAAGGATGAAGATTGGATGCTTGTTGGTGATGTTCCGTGGCGAATGTTCACAGACAGCTGTAGGAGGCTGAGGATTATG
AAGGGGTCAGATGCAGTGGGCCTTGCTCCAAGAGCCACTGACAAGAGCAAAAATCGGACCTGAGCAAAAGATGAACCCA
ATATGAATATCCGACCCCTACAATCACATCACTTTTACTTGTAAGGTCCCATTCTCTAAACCACAAGGGTAATGGTCTA
AGTTGCGAGAAGGGGATTACTTATACCTAT

> SEQ ID NO: 7236 4837 126123_300460_1b
CCCCCCGACAGCTAACTTCTCTATTACTTCAGCCATCAAAAAACACTTATTTTTCCTTATTAAACCATGGCTGCTTCTA
CAATGGCTCTCTCTTCCACTTCTTTTGCCGGAAAGGCAGTAAAACTCTCACCATCTTCCTCTGAAATCACCGGAAATGG
GAAAGTTATCATGAGGAAGACTGCTAGCAAGCCCAAGCCTGTCTCTTCTGGCAGCCCATGGTACGGTCCTGACCGTGTC
AAATATTTGGGTCCATTCTCCGGTGAATCTCCAAGTTACTTAACTGGTGAGTTTCCTGGTGACTATGGATGGGATACCG
CTGGACTTTCAGCTGATCCAGAAACTTTTGCCAAGAATCGTGAGTTGGAGGTAATCCACTGCAGATGGGCTATGCTTGG
AGCTCTTGGTTGTGTCTTCCCTGAGCTCTTGGCTCGTAACGGTGTCAAGTTCGGTGAAGCTGTATGGTTCAAGGCTGGA
TCCCAGATTTTCAGCGAGGGTGGTCTTGACTACTTGGGCAACCCAAGTTTGGTCCATGCTCAAAGCATCTTGGCTATTT
GGGCTTGCCAAGTTATTTTGATGGGAGCTGTTGAAGGTTACCGTGTTGCCGGTGGACCTCTTGGCGAGGTTGTTGATCC
ACTTTACCCTGGTGGCAGTTTCGACCCGTTAGGCCTTGCTGAAGACCCAGAAGCTTTTGCTGAGCTAAAGGTAAAGGAG
ATCAAGAACGGCAGACTTGCCATGTTTTCCATGTTTGGATTCTTTGT

> SEQ ID NO: 7237 4837 11554_300292_1b
TGGTATCAACGCAGAGTGGCCATTACGCCGGGGACAGCTATTTTCTCTATTACTTCAGCCATCAAAAAACACTTATTTC
TCCTTATTAAACCATGGCTGCTTCTACAATGGCTCTCTCTTCCACTTCTTTTGCCGGAAAGGCAGTAAAACTATTACCG
TCTTCCTCTGAAATCACCGGAAATGGGAAAGTTACCATGAGGAAGACTGCTAGCAAGCCCAAGCCTGTATCTTCTGGCA
GCCCATGGTACGGTCCTGACCGTGTCAAGTACTTGGGCCCATTCTCTGGTGAGTCCCCAAGCTACTTGACTGGTGAGTT
CCCTGGTGACTATGGATGGGATACTGCTGGACTTTCAGCTGAT

> SEQ ID NO: 7238 4837 113054_300021_1b
CCTTTTTCGAGCACCAAAATATCAATATCAACTTCATCAGAATAATCTAAAAACTTTTTTAGCCTACCAAAGTGGAAAG
CCAAAGAAAAAATGTCATCTGAGATTTTCAAAGCAACCAATGACTTACCGGAAACAGAAATCTCCGGCCTCAATTTCA
AGGAAACTGAGCTCAGCCTCGGCTTACCCGGCGAATCACGAAAGCAAATCTCCGGCACAAAACGTGGAATCTCCGATGC
TATGGAATTAAGCCTAGGGAGCTCTACTTCTGAAGATTATCACTCCAAAAATGAAATCTCTACTGGAACCAAACCTCAA
GTGAAGGCACAAGTAGTGGGATGGCCACCTGTGAGGTCATACAGGAAAAACATGATAGACAGTGCAAGTACGTGAAAG
TGGCAGTAGATGGAGCTCCCTACTTGAGAAAAGTAGATTTGGAGTTGTACGACAGTTACCAGAAGCTGTTAAATGCTCT
ACAAAACATGTTTACTTGCCTAACTATCTGTAATTTTCAAAGCGAAAGCAAGCTTATGGATATTACAAATGGTGTGGAA
TATGTACCAACCTATGAAGATAAAGATGGAGATTGGATGCTTGTTGGAGATGTTCCTTGGAAA

> SEQ ID NO: 7239 4837 108295_300261_1b
CATTTATATACAGTTGATGCGGGCTCATTAAACTCAAGCCATAAATCAAATATTTTTCTGTATAGTAGCTGCATTTTC
AAGAGCATTTCACTTTATTTCTACAACAATGGCAGCTACTACAATGGTTCTTTCTTCCTCTTCTTTTGTGGGAAAGGCG
GTGAAACTCTCACCATCTTCCTCTGAGATCACCGGAAATGGAAAAGTTACCATGAGGAAGACTGTTACCAAGCGAAGC
CAGTCTCTTCTGGCAGCCCATGGTATGGTCCTGATCGTGTCAAGTACTTGGGCCCATTCTCCGGTGAGTCCCCAAGTTA
CTTGACTGGTGAGTTCCCTGGTGATTATGGGTGGACACTGCTGGACTTTCAGCTGATCCCGAAACTTTTGCAAAGAAT
CGTGAGCTAGAGGTGATCCACTGCAGATGGGCCATGCTTGGAGCTCTTGGTTGTGTCTTCCCTGAGCTCTTGGCCCGTA
ATGGTGTCAAATTCGGTGAGGCTGTATGGTTCAAGGCTGGATCTCAAATTTTCAGCGAGGGTGGACTTGATTACTTGGG
CAACCCAAGTTTGGTCCATGCACAAAGTATCTTGGCCATCTGGGCTTGCCAAGTCGTGTTGATGGGAGCCGTTGAGGGT
TATCGTGTTGCTGGTGGACCTCTTGGTGAGGTTGTTGACCCACTCTACCCTGGTGGTAGCTTTGACCCATTAGGCCTTG
CTGATGACCCCGAGGCTTTTGCCGAGCTCAAGGTGAAGGAG

> SEQ ID NO: 7240 4837 103543_300363_1b
TGGTATCAACGCAGAGTGGCCATTACGGCCGGGGATCACAACTAACTTTGACATCTCAAACTAGCAACCTCTCACTTTC

FIG. 2 continued

CTCTTGATAAACCATGGCTGCTTCTACAATGGCTCTTTCTTCCCCTTCTTTCGCTGGACAGGCAGTGAAACTCTCCCCA
TCTGCCTCAGAAATCACTGGAAATGGAAGGGTCTCCATGAGAAAGACTGTCGCCAAACCCGTCGCATCTAGCAGCCCAT
GGTACGGTCCAGACCGTGTTAAGTACTTGGGCCCATTCTCCGGTGAGGCCCCAAGCTACTTGACCGGTGAATTCCCAGG
TGATTACGGGTGGGATACTGCTGGACTTTCAGCAGATCCAGAAACATTTGCCAAGAACCGTGAACTCGAGGTGATCCAC
TGCAGGTGGGCTATGCTTGGAGCTCTTGGATGTGTCTTCCCTGAGCTCTTGGCTCGTAACGGTGTCAAGTTTGGTGAAG
CTGTCTGGTTCAAAGCTGGATCTCAAATCTTTAGTGAGGGTGGACTTGACTACTTGGGCAACCCAAGCTTGGTCCATGC
ACAAAGCATCTTGGCCATCTGGGCTTGCCAAGTTATCTTGATGGGAGCTGTTGAGGGTTACCGCGTTGCTGGTGGGCCT
CTTGGTGAGGTTGTCGACCCACTCTACCCTGGTGGCAGCTTTGACCCATTAGGCCTTGCTGATGACCCAGAGGCATTTG
CTGAGCTCAAAGTAAAGGAGATCAAGAATGGTAGACTTGCCATGTTCTCTATGTTCGGATTCTTTGT

> SEQ ID NO: 7241 4837 258372_301691_1b
ACGCGTCGGTTTGTTCTTGCTGTAGGGCGCGAGATTTGGATCGATCCATTGCCGCCGCGCGATGGGTGTGAAGATTAGA
TTCGCTCGTTTTGGAAGGAAAAAGCTGCCCTTCTATCGAATCTACGTCGCGGACAGCCGATGCAAGCGTGACGGCAGAT
TTTTGGAGAATGTAGGCTACTACAATCCCATTACTGGCAAGATGGTGAGAAGCAATTCGCCATCAAGTCGGACCGAGT
CAAATATTGGATCTCCGTTGGAGCACAGCCTTCCAACGCTGTTGCGAGGCTTTTGGCAAGAACAGGTAACCTTCCAACA
GCGTATCCTCAGGGGCCGACGCGATCATCACCATCTCCTTCGGCGGCGCCGGCGGCGGACGACAAGCCGGACATGACCA
TCTCCGCCAAGCTCTCCGCCTCGCCGGCTCCAATGCTGGCCGCCAGGACACTCTGCTTCTGCTGACGACGTAGACGTCG
ACGAATCGAGCAAGAGCAAAATACTACAAAGAGGTTTGACATTTTATCTAAATTATTTAAGTTAGCTCTCGAAGTAAG
CTCTGACTCTTGATAGCGATGGAGTTCTT

> SEQ ID NO: 7242 4837 182427_300710_1b
GAATTCAAGAGAAGCTCTAAAATCTGTCTCAACCAATAAGAAAGCAATTTAAGATCTCTTATTAAAAAACTCACCATTT
TGAGTACTCTATTTAAGCAACCCAACTGCAACAACCACAAACATCATCTCCTTGCAATTCTTATAGCACTTCAATTTTC
TCATCCATCCATATATCAGTTAGCCATGGCAGCTTCTACAATGGCTCTATCTTCACCTGCATTGGCTGGTAAGGCACTT
GTTCCTTCCAGCTCTGAAGTTTTCGGTGAAGGCAGAATCTCCATGAGAAAAACCGTTGCAAAGCCAAAAACCGTTTCAT
CCAGCCCATGGTACGGACCTGACCGTGTTAAGTACTTGGGACCATTCTCTGGTGAATCTCCATCGTACTTAACCGGTGA
GTTTGCCGGTGATTACGGTTGGGACACTGCCGGGCTTTCTGCTGACCCAGAAACCTTCGCCAAGAACCGTGAGCTGGAG
GTCATTCACTGCAGATGGGCTATGTTGGGAGCTCTTGGATGTGTCTTCCCGGAATTGTTGTCTCGCAATGGTGTTAAAT
TTGGTGAAGCCGTTTGGTTCAAGGCTGGTTCACAAATTTTCAGTGAAGGTGGATTGGACTACTTGGGTAACTCAAGCTT
GGTTCATGCTCAGAGCATCCTTGCCATTTGGGCAACACAAGTTATCTTGATGGGAGCAGTTGAAGGTTACAGAGTTGCT
GGAGGACCATTGGGTGAGGTGGAGGACCCACTTTACCCTGGTGGAAGCTTCGACCCATTAGGCTTAGCTGATGATCCAG
AAGCTTTTGCTGAATTAAAGGTGAAGGAAATTAAGAACGGGAGATTGGCTATGTTCTCCATGTTTGGATTCTTTGTTCA
AGCAATCGTGACCGGGAAAGGTCCTTTGGAAAATTTGGCTGACCAC

> SEQ ID NO: 7243 4845 44638_300107_1b
TCTCAGTAAGCCGGTTGATTTTTCGTAGGGTTTCACACTGTACTTAACCAAATGGCTCCAGCTAAAGCTGATCCGTCCA
AAAAATCTGATCCCAAGGCACAGGCAGCTAAGGTTGCCAAGGCCGTCAAGTCAGGATCAACCTTCAAGAAGAAGTCACA
AAAGATAAGGACAAAAGTTACATTCCACCGACCCAAGACTTTGAAGAAAGATAGAAACCCCAAGTACCCTCGTATCAGT
GCACCTGGAAGGAACAAACTTGATCAGTATGGGATTCTAAAGTATCCCCTCACCACCGAATCTGCGATGAAGAAGATTG
AGGACAACAACACCCTTGTTTTCATCGTGGACATCAAGGCTGATAAAAAGAAGATTAAGGATGCCGTGAAGAAGATGTA
TGACATCCAGACAAAGAAAGTCAATACCTTGATTAGGCCTGATGGGACGAAGAAAGCATATGTGAGGTTGACTCCTGAC
TACGATGCATTGGACGTTGCCAACAAAATTGGAATCATCTAAACTAGTTACCTGTTTAGAATTTTACGAGAATTTAAAA
TCTTGGATTTGGGTTTTTAGATACACTTGAATGGAAGTGCCTTCTATTTTTCATTTTCATTTTGTGTTTTAGAGACATG
TTTTGTTCTGTATAAGAGAAATCAACTTTAAGCTGCAGTTTTCTTTCTCGAAATTCTCTGAATCCTAACCTGTCTTCCC
AAAACCTTAAGAGTCGGAGGGG

> SEQ ID NO: 7244 4845 121212_300355_1b
CCCGGGTTTTCTCCTCAGCCGTCGTCTCCCTCCTCGCTTCGCGTCCGCCGCCGCCGTCCCGGAGAGGTAAGTTCAAGAG
GCAGCCCTGTGAAGCTCCAATGGCTCCTAAAGCTGCTCCTGCCAAGAAGGGTGATGCCAAGCCCAAGCCTTGAAGGCA
GCCAAGGCTGTTAAGTCTGGGACAGCCAAGAAGACGACCAAGAAGATCCGCACATCCGTGACATTTCACCGCCCCAAGA
CCTTGAAGAAGTCTAGGGACCCCAAGTACCCAAGAGTCAGTACCCCTGGGAGGAACAAGCTTGATCAGTACCAGATCCT
TAAGTATCCCCTTACCACTGAATCCGCAATGAAGAAGATCGAAGACAACAACACTCTGGTCTTCATTGTTGACCTTAAG
GCTGACAAGAAGAAGATCAAGGCTGCTGTCAAGAAGATGTACGACATCCAGGCAAAGAAAGTGAACACTCTGATCAGGC
CTGATGGGAAGAAGAAGGCTTACGTGAAGCTGACACCAGACTACGATGCTCTCGACGTGGCCAACAAGATTGGCATCAT
CTAAGTTAGGGTGCTGCAGTAGTCTTTTGTGTCCTGGTCTCTATGTGATTGGAGTTTTGTAGCTATTACTTAGCGAATG
CCTCAGTGGCTAAGTTATCACTATTTTGCTGCACACTTCCATGAATTTGATATAATGCAAGTGACTTATCGTGAGCTA

> SEQ ID NO: 7245 4845 187205_300675_1b

FIG. 2 continued

ATCCAGAGCAATGGCGTTGCAAACGCAGCCGGTAGCAAATGCGTCACCTCTTCATGTTCTTCGGTCCGTATGCGTCCTC
CTCCTGGCCGCGTCGGCGACGGTGGCGGCGCGGCGCCACGGCCCGGCGGCGCCCATCGCCGGGCAGAGCATGTACCTGG
CGCCGAGCTGCCGCGCGCACACGGCGTCGCTGACGGACTTCGGCGGCGTGGGCGACGGCACGACGTCGAACACGACGCC
GTCCCGGAGAGGTAAGTTCAAGAGGCAGCCCTGTGAAGCTCCAATGGCTCCTAAAGCTGCTCCTGCCAAGAAGGGTGAT
GCCAAGGCCCAAGCCTTGAAGGCAGCCAAGGCTGTTAAGTCTGGGACAGCCAAGAAGACGACCAAGAAGATCCGCACAT
CCGTGACATTTCACCGCCCCAAGACCTTGAAGAAGTCTAGGGACCCCAAGTACCCAAGAGTCAGTACCCCTGGGAGGAA
CAAGCTTGATCAGTACCAGATCCTTAAGTATCCCCTTACCACTGAATCCGCAATGAAGAAGATCGAAGACAACAACACT
CTGGTCTTCATTGTTGACCTTAAGGCTGACAAGAAGAAGATCAAGGCTGCTGTCAAGAAGATGTACGACATCCAGGCAA
AGAAAGTGAACACTCTGATCAGGCCTGATGGGAAGAAGAAGGCTTACGTGAAGCTGACACCAGACTACGATGCTCTCGA
CGTGGCCAACAAGATTGGCATCATCTAAGTTAGGGTGCTGCAGTAGTCTTTTGTGTCCTGGTCTCTATGTGATTGGAGT
TTTGTAGCTATTACTTAGCGAATGCCTCAGTGGCTAAGTTATCACTATTTTGCTGCACACTTCCATGAATTTGATATAA
TGCAAGTGACTTA

> SEQ ID NO: 7246 4845 255869_301645_1b
GCAAGGGAAGAAGGTAGGAAGGTAAGTGTCAAAGGTTCAGCCGGACTCCAGCGATGGCTCCTCCGACAAAAGGTGCAGC
GGCGAAGACAGACTCGAAGGGGCAGACCACTAAGGCTGCCAAGGCTGCTAAGGCACTGAAGTCCAATGTCCATCTGAAG
AAGAAGACACGGAAGGTGAGAACTTCCGTCACCTTCCACAGGCCTAAGACCCTGAAAAGGACTAGAACCCCCAAGTACC
CTCGTGCGAGTGCCCCACACCGCAACAGGCTGGACCATTACGAGGTCCTTAAGTACCCCTTGACCACGGAGTCTGCCAT
GAAGAAGATTGAAGACAACAACACTCTGGTCTTCATTGTGGACCTCCGTGCCAACAAGAAGTCCATCAAGGATGCCGTC
AAGAAGATGTACGACATCCAGACCAAGAAAGTCAACACCCTCATCACGCCGAAAGGATTGAAGAAAGCTTATGTAAGGT
TGACAGCTGATTATGACGGTTTGGACGTGGCTAACAAGATTGGTATTATTTAAATTAGATTTGATTAGAATAGAGTTGG
TTATATGTCTTTCTCAAGGCTTCTGGTTAAACTAAATT

> SEQ ID NO: 7247 4845 252625_301603_1b
TCCGTCGGAGGCAAGGGCAGTGAAAGTTTTGGCGATGGCTCCTCCGACCAAAGGTGCAGTTGCAAAGACGGATTCCAAG
GGCCAGGCTGTGAAGGCGGCCAAAGCACTCAAGTCAAATGTCCATTTGAAGAAGAAAACCAGGAAGGTGAGGACTTCGG
TGACCTTCCACAGGCCCAAGACCTTGAAGAGGGTGCGCACCCCCAAGTACCCCGCCTCAGTGCCCCCACCGCAACAA
GCTCGACCACTACGAAGTCCTCAAGTACCCCTTGACCACTGAATCTGCCATGAAGAAGATCGAGGACAACAACACCCTT
GTCTTCATTGTTGATCTCCGTGCCAACAAGAAACAGATCAAGGATTCCGTCAAGAAGATGTATGACATCCAGACAAAGA
AGGTTAACACCCTCATCACGCCTAAAGGATTGAAAAAAGCATATGTAAGGTTGACGGCAGACTATGATGGCTTGGACGT
TGCAAACAAGATTGGTATTATTTAATCAAGGTATTGGACTACAACCCAGGGCGAATTTTTTCTGTAGTCTTTTAGTCA
AAAGACCTCGCGTGTACTGGGCTTAACTC

> SEQ ID NO: 7248 4845 258854_301700_1b
GACTTTCAACAATGGCCGCCACTCAAGCTCAGAACGCCAAGAAGGCTGCCCTCAAGGGTACCAACGGCTCCAAGACCCT
CAAGTACCGATCCTCCACCATCTTCCGACGACCCAAGGTCCTTGAGCTCCCCAAGAAGCCCCTGTACCAGCGAAAGGCC
GTTGCTCACTACCCCCGAATGGACTCTTACGATGTCATCATCTCTCCCCTTAACACTGAGACTGCCATGAAGAAGATCG
AGGACTCCAACACCCTTGTCTTCATTGTCAACAAGAAGGCCAACAAGTACCAGATCCGAGATGCTATCAAGAAGCTCTA
CGAGGTCGAGATTGCCTCTGTCAACACCCTCATCCGACCCGACGGTAAGAAGAAGGCTTTCGTCCGACTCACCGCCGAC
CACGATGCTCTTGACATTGCCAACAAGATCGGTTACATCTAAACAACTCTTTTATTAGGGAAGTTACAAAAGGCATTTA
GCCATCTCAAAAGGTGTCATTTAGAAAATGCACTAATGAACACATTTGCGAGCAATCGATATTATTTATCGAACAAAAA
AAAAAAA

> SEQ ID NO: 7249 4845 237716_301278_1b
AGCGATGGCACCAGGTAAGCAGCGCCGCGACGACACCAAGAGCAAGGCGGCCAAGGCGGCCTTGTCGGCCAAGAGCGTC
AAGAATCCGGCCCCGAAGATGCGGCGGAGGAAGATCAGAACCTCCGTCACATTCCACCGGCCCAAGACCCTGAAGCAGG
CGAGGTCCCCAAAGTATCCCCGCCTGAGCGCCCCCAACCGCGAGAAGCTGGACCACTACAAGGTGCTCAAGTACCCGCT
CACCACCGAGTCGGCCATGAAGAAGATCGAGGACAACAACACCCTCGTCTTCATCGTCGACATCCGGGCCGACAAGAAG
AAGATCAAGAATGCCATCAAGATGATGTACGACGTCCAGACCAAGAAGGTCAATACTCTCATCAGGCCCGACGGTTTGA
AGAAGGCGTACGTGAGGCTCACCCCGGACATTGACGCTTTGGATGTCGCGAACAAGATTGGCATCATCTAGAAGAGCAA
GCTTAAAATGGGGTTTGTGTATCGCTTTAATGCAAAGTTTATGGTTTTTTC

> SEQ ID NO: 7250 4845 188338_300776_1b
CGTCCACTACTACGAATCGCCAGCCGCCACACCGAGCTCCGCCGCCGCCAACCCCACCGCGGCGAGCTCCGCCTTCCGC
CGGCCGCGATGGCTCCCAAGGCCGCTGTAAAGAAGGCTGATGGAAAGACTCAACAAGCCTTGAAGGTTGCCAAGGCAGT
GAAGTCTGGGTCAATCAAGAGAAAGTCAAAGAAGATCCGCACTTCGGTGACATTTCACAGACCAAAGACCCTGAAGAAG
GCGAGAGACCCTAAGTACCCAAGAGTCAGTGCACCTGGCAGGAACAAGCTTGATCAGTACCAAATCCTCAAGTACCCCC
TTACGACCGAATCTGCCATGAAGAAGATTGAAGACAACAACACCCTTGTCTTCATCGTCGACCTCAAGGCAGACAAGAA

FIG. 2 continued

```
GAAGATCAAGGCAGCTGTCAAGAAGATGTATGACATCCAGGCAAAGAAAGTTAACACTCTGATCAGGCCTGACGGCAAG
AAGAAGGCTTACGTGAAGCTCACTCCAGACTATGATGCTCTTGATGTGGCCAACAAAATTGGCATCATTTAAGTTAGGG
CGCTTTTTTTCATCATGTTGAACGTAAGATTTTGGTTGGCTAGTTCTTAATGTTGAACAGAACCTTATAACTTGCAAAA
GAACATCTTGAGTTTTGTTGAGCG
```

> SEQ ID NO: 7251  4845  217786_300911_1b
```
GCTCTCCGTGCAAATTCGACACCAAGCCGATACAATGGCCCCCGCTAACAAGAAAGCTGCCGCCAAGGGCTCCAAGCAG
GCCAACGCCGCTGCCAAGGCCGCCCTCAAGGGTACTCACTCCTCCAAGAACCGCAAGGTCCGCCTGACCACCTCTTTCC
ACCGCCCCAAGACTCTGGTCCTGTCCCGCGCTCCCCGCTACCCCCGCAAGGCCATCAACCACGTCCCCCGTCTTGATGA
GCACAAGATCATCATCCACCCTCTCAACACTGAGAGTGCCATGAAGAAGATGGAGGAGAACAACACCCTGGTCTTCATC
GTCGACGTCAAGGCCAACAAGGCCCAGATCAAGCTGGCCCTCAAGAAGCTCTACGACATTGACACCGTCAAGATCAACA
CCCTGATCCGCCCTGACGGCTCCAAGAAGGCCTACGCCCGCCTGACCCCCGATGTCGATGCCCTCGACATTGCCGCCAA
CAAGCTGTCCCTGGTTTAAGCTGGATAATTTGTTGAGCAGAGGTCGTTTTTTCTTTAGTCTTTCTTTTTTCTCGGCAAC
GGAATTGGTCTGGTCTTGAATGCGTGCGCACAACACAATAAAAGCATGGGCATCGGAAACTATGGGAGTT
```

> SEQ ID NO: 7252  48458  183318_300593_1b
```
CTACAACGCTCTGTGCCCGGGGTTCGTGCAGACGAGCTCGCGGATCGCCATCGGAGCCTCCATCTCGCCGGTGTCGTCG
GTGGGAGGGCCACAGTACGACATGACGCTCCTGGTGTGGAAGGACCCCAAGCTCGGCAACTGGTGGCTCAGCTACGGCG
ACGGCGCCGGCGGCCTCGTCGGCTACTGGCCGCCGAGCTCTTCACCCACCTCTCCGACCACGCCACCATGGTCGAGTG
GGGCGGCGAGGTCGTCAACACCCACCCGCCCGGCTCCGCCCACACCGCCACGCAGATGGGCTCCGCCACTTCGCCGCC
GAGGGCTTCGGCCGGGCCGCCTACTTCCGCAACCTCGAGACGGTGGACGCCGACAACAGCCTCGCCGCGGTACCCCTCG
ACGCCATCCAGACAATGGCGGAGGACGCCGGCTGCTACGACATCCGCAAGGCCTACGACGACGACGACGGCCGAGGCGG
ATGGGCGCACACTTCTACTACGGCGGCCCCAGGCCACAATACGGCCTCTTGCCCCTAAGCGCTTATTAATTAATTACC
TCATCCAATA
```

> SEQ ID NO: 7253  48493  144457_200135_1b
```
CCCACGCGTCCGCTGCCTTTTAGCTTCTTTTGAGGTCAAGGGGTTCGAGTCGACAGCGGTCACCAAAAGGCGATTTTTA
TCTCAGCTGTTCAATCGATTTCAGTATCTTGATCTATGGGAAAGAGGAAGTCAAAGTCAAAGCCACCTCCAAAGAAGAG
GATGGACAAACTTGATACTGTTTTCAGCTGTCCTTTCTGTAGTCATGGCACCAGCGTGGAATGTCGCATTGATATGAAA
AACTTGATTGGCGAGGCGAATTGCAGGATCTGCCAAGAGAGCTTCAGCACCACAGTCACTGCACTAACAGAGCCTATTG
ATATATACAGTGAATGGATTGACGAGTGTGAACGAGTCAACAACTATGAAGAAGATGATGTTTCCTACAAGTTAGATCC
TAACGAATGATCTGCTTCAAGATTGTGCAGCTTGTTGAGTAGCCAGAAATGATTTAAAGCTACCTTAAGCTTGACTTCA
ATTTTGGCAATTATTCGTCACACTGCCTAAGAAGAACCTAAACTTATCCAGGCCTCTGGAGTCCAATAAGTAGCTCCAT
TTAAGAGGCTTTCTATGTCCAAATAGTTTGAAACAGAGTCAGTTGCTATCTTGTTTATGTTATGCCCCTGCAATTATAG
CTTGCTTATATGAGACTGGCTTAATGATGTGAACCTAATGTTAAGTAGGTTTATTTCTCCC
```

> SEQ ID NO: 7254  49059  254538_301633_1b
```
ACGCGTCGGTGTACTGTTATGAAACGTATTGGTCCTAGTTGGCGTATCTGGAGCAAGTCAGACAACACATGTCTCGACT
TCCATCGATTGATCCCAATACCAGAACTTTACTGATTTGTGGATATCCTAACGTTGGCAAAAGTTCCTTCATAAACAAG
GTGACCCGGGCGGATGTTGATGTGCAACCTTATGCATTCACTACAAAATCGCTCTTTGTTGGGCACACAGATTACAAGT
ATTTGCGTTGGCAAGTCATTGACACGCCTGGCATCCTCGACCACCCTTTGGAGGACCGGAATACAATCGAGATGTTGAG
TGTTACTGCATTGGCGCACTTGCGTGCTGCTGTTTTGTTCTTCATCGACGTTTCTGGGTCGTGTGGCTACAGTATTGAG
CAGCAAGCTGCTCTCTTCCATAGCATCAAGCCTCTCTTTGCGAACAAGCCGTTGCTTATCGTTTGCAACAAGATTGATT
TGCAGCCGTTGGAGACGCTCTCGGAGGAGGAGAGCAAGCTGATTGCGGAGATGAAGGCTGAGGCGGCGCAGCTCTCGTC
AGGTGTTATGTCGAGTGATACGGTGGATGCTGATGGTTGCTTGCTTTGCATGAGTGCGCTAACAGAGGAAGGGGTGATT
TCGGTGAAGAACGCTGCGTGTGAGCGGCTACTCCAACAACGGG
```

> SEQ ID NO: 7255  49145  167506_300548_1b
```
ACCTAGACACTGAAGACAGTGAACACAGCTGCGGTGAAAGCCGAACATATTGATAATTCTGAAGATAAATCATGCTCAT
TAGGAGTTCATAAATACAAGAGTCTTATCGGAATTCATGCTAAGAAACACAGGGGTGGGTTCGCCGCGTCTCTCACGCT
GGATCCTAGTAAGGTTGAACGCCTCAGTTTGAGTGAGCAACAGCTTGAAAAGGGAGCGGAGGATTATGGAACCGAACTT
GTCAGATTCACCCAGCGGAATCTGCTGCGGATATATCCAAAAGGAACAAGGTTTAATTCATCAAATTATAACCCGATGG
TTGGGTGGATGCACGGAGCTCAAATGGTAGCATTTAACATGCAGGGATATGGCAAGAAACTGTGTTTGATGCAGGGAAT
GTTCAGATCGAACGGAGGATGTGGTTATGTGAAAAAACCTGATCTTTTAATTACAACA
```

> SEQ ID NO: 7256  4936  125449_300631_1b
```
TAGCTTTGATAGTGATCTTGGTGTTGTTGGTGGACTGGATGGACCATCTCTGTCGGATGAGACTGAGGAGGACTTCCTC
TCAATGTACCTTGACATGGATAAGTTTAATTCGTCATCCGTGTCTTCTGATTTTCAAGAGGGCGAGTCTTCGTCTTCGG
```

FIG. 2 continued

CAGCTGCAGCTTCAGGTTCATTGCAAATTCCAGCAATGGCTTCAGCAGCTTCAGGGTCAGATAATGTGGGCCCCACTGC
TAGTGCGAAGTCAAGGGTTAGACATCAGCATAGCCAGTCCATGGATGGTTCAACTACAATCAAGCCGGAGATGCTCATG
TCAGGTATAGATGAGGCATCTCCACTTGAAACTAAGAAAGCAACGTCTGCAGCGAAGCTTGCTGAACTCGCTCTTGTTG
ATCCAAAACGTGCCAAGCGGATTTGGGCCAACAGGCAATCAGCTGCAAGATCGAAGGAAAGGAAAATGAGGTATATAGC
AGAGCTTGAGAGAAAAGTGCAGACTTTGCAAACAGAAACAACTACTTTGTGTGCTCAATTGACCCTATTGCAGAGGGAT
ACAAATGGTCTGACTGCTGAAAACAGTGAACTTAAACTGCGTTTACAAACAATGGAACAACAGGTGCATCTGCAA

> SEQ ID NO: 7257 4936 19243_300104_-1b
ACCGGGTCGACCCACGCGTCCGCTCTCTATGGATATTGATATGGATAAGTTTAATATTTCTGCTACATCTTTTGCCCAA
GTTGGTGAGCCATCAGGAACTGCTTGGAAAAATGAGACAATGATGCAGACAGGCACAGGCTCAACTTCCAATCCTCAGA
ATACGGTTAATAGTCTTGGCGAAAGGCCGAGAATGATGCATCAACATAGCCAATCTATGGATGGTTCAATGAATATCAA
TGAGATGCTTATGTCGGGAAATGAAGATGATTCTGCTATTGATGCTAAGAAGTCTATGTCTGCTACTAAACTTGCTGAG
CTTGCTCTCATTGATCCTAAACGTGCTAAGAGGATATGGGCAAACAGGCAGTCCGCAGCACGATCAAAAGAAAGGAAGA
CGAGATACATATTTGAGCTTGAGAGAAAAGTACAGACTTTGCAAACAGAGGCTACAACTCTCTCAGCCCAGTTGACCCT
CTTACAGAGAGACACAAATGGCTTGACTGTTGAAAACAATGAGCTGAAGCTGCGGTTACAAACAATGGAGCAGCAGGTT
CACTTGCAGGATGAACTAAACGAAGCACTAAAGGAGGAAATCCAGCATCTGAAGGTGTTGACTGGCCAAGTTGCTCCAT
CAGCGTTGAACT

> SEQ ID NO: 7258 51719 193874_300744_1b
CCTCGCGCTGTCCAAGGACCTCATGGCGGTCGCCGGCGACGCGCTGAAGACGAACATCACGACGCTGGGTCCCCTCGTC
CTGCCGCTGTCGGAGCAGCTCCTGTTCATGGCGACGCTGGTCGCCAAAAAGCTGCTCAAGATGAAGAACGTCAAGCCCT
ACATCCCCGACTTCAAGCTGGCGTTCGAGCACTTCTGCGTGCACGCCGGCGGCAGGGCGGTGCTGGACGAAATCGAGAA
CAACTTGTCGCTGGGGGAGTGGCACATGGAGCCGTCACGGATGACGCTGTACAGGTTCGAAAAACACGACCTGGTTCGA
AGTCTCGTCCATTCTAATTATTTGATACTCCCTCTTTTCACAATGTAAGTTATTTTAGCATTTTTCATATTCATATTGA
TGTTAATGAATCTAAACATACATATTTATCTAGATTTATTGACATCAATATAAATGTGAGAAATGTTAGAATAACTTAC
ATTTTAAAATAGATCATTTTTTAATATTCACGTCTTTACTTTTTTTCGCTGTATAGGTTGGGGAACACGTCGAGCAGCT
CGCTGTGGTACGAGCTGG

> SEQ ID NO: 7259 51719 104934_300365_1b
ATAAATCATATAGATGTGTACAACAACAAGAAGATCCTGAGAGGAAAAGTTGGTATAAATTTGTGTATAAATTTAATGC
AAGTTGCAGGAGAAGCATTGAAGTCTAATATTACTACAATTGGACCCCTTGTTCTGCCTGCTTCAGAGCAACTTCTCTT
TCTTCTGACTCTCATTCGTCGAAAAATTTTCAAGAAAAATTCGAAACCATACGTTCCGGACTTTAAACTAGCGTTTGAG
CATTTCTGCATACACGCCGGAGGAAGGGCAGTGATAGATGAGCTGCAGAAAAGCCTGCAGCTATCGGCGGAGCATGTGG
AGGCTTCAAGGATGACGTTGTATCGATTCGGGAACACGTCATCGTCGTCGCTATGGTATGAGATGAGTTACATTGAGGC
AAAGGGGAGAATGAAAAAAGGTGACAGAATTTGGCAAATTGCATTTGGAAGTGGATTCAAGTGTAACAGTGCAATTTGG
AAGTGTAATAGAACAATCAAGACTCCAATAACTCATAATCCATGGGCTGATTGTATTGACAGATATCCTGTTGATATTC
CAGATGTTGTTAAGCTCTAGTCTTTATACTGTAATCAATGTATTAAGTTAATTAATTAATTCCCTCTTCT

> SEQ ID NO: 7260 51719 115314_300013_1b
AAGATTCTAGGAAATGCACGAGGCAGATTTTCATGGAGGGGTCAAAGTTGACTGGTTCGTTCCCTGATGAAACTCTTGA
GTTCCAAAGGAAAATTCTCGAGAGGTCTGGACTTGGTGAATCTACTTATCTCCCAGAAGCCGTGTTGAGGGTACCGCCA
AATCCTTGTATGGCAGAAGCAAGAAAAGAAGCTGAGATTGTTATGTTTGGTGCCATTGATGAACTCCTTGCTAAAACCG
GTATTAAGCCAAAGGATATTGGAATTCTAGTAGTAAATTGCAGTTTGTTTAATCCAACACCATCATTGTCTGCAATGAT
TGTGAACCATTACAAGCTTCGTGGAAACATTGTTAGCTACAATCTCGGTGGAATGGGTTGCAGTGCTGCTGGTTTGATCTCG
ATTGATCTTGCAAAAGATCTTCTTCAAGTCCATCCCAATACTTATGCTTTGGTGCTCAGCATGGAAAACATCACTCTGA
ACTGGTATTTTGGGACCGAGAAATCCATGCTCCTTCCGAATTGCTTATTCCGGATGGGAGGCGCTGCTGTATTGCTCTC
CAACAAAGGATCTGAGCGAAGAAGATCAAAGTACCAGTTGGTTCATACTGTCAGAACTCACAAAGGTTCTGATGACAAG
TGCTTT

> SEQ ID NO: 7261 51719 147090_200015_1b
GCGTCCGGACTTATATACCAGTAGATAAATGGATTCCATCAAATTTTTCTCTTAGTAGTAATCAACATCAAGCTAAATT
GGTTATTGTTGGTGCCATAGACGATCTGTTGGCAAAAACAGGAGTGAAAATCAGAGAGATCGGGATTGTTGTTGTTAAT
TCTAGTATGTTTAATCCAACACCTTCTCTTTCTGCTATGATTGTCAACCATTATAAGCTTGGAGTTAATGTGATTACTT
ATAATCTTGGTGGCATGGGTTGCAGTGCTGGACTTATTTCTGTGGACCTAGCTAATCGGCTTTTACAGGGGAAAGCAAA
CACCTATGCACTTATAGTAAGCACGGAAGTAGTCTCAACGGCCTTCTATACAGGGAAAGACAAATCAAAGCTAATACCA
AATATGATTTTCCGGATGGGTGCTTCTGCTGTTCTCCTTTCGAACCGTTTCTCGGATCGTTGGCGCTCAAAATATCAAC
TGATGCATGTTGTCCGCACCCATAAAGGTGCAGATGACAGAGCATTCGGTTGCGTCTACCAAGATGAGGAAGAGGATGG
AAAAAAAGGCATGTCATTGTCAAAAGACTTAATGGCAGTAGCTGGTGAGGCCTTAAAAACAAATATTACTACTTTGGGC

FIG. 2 continued

```
CCTCTAGTCCTCCCAATGTCCGAGCAGCTCCTATTTTTCGTCTCTTTAGTCGTGAGAAATGTTCTTAAAAGGAAAATAA
AGCCATATATCCCCGATTTCAAGATGGCATTCGAGCATTTCTGCATTCATGCAGGGGGGAGGGCCGTGTTGGACGAGCT
TCAGAAGAATCTTGATCTCACAGAGGAACTTATGGAACCTTCAAGAATGACTCTTTATAGGTTCGGAAACACTTCAAGT
AGTTCAGTGTGGTATAATTTGGCCTACTCTGAGGCCAAAGGGAGGATAAAAAAGGGTGACAGAGCATGGCAAATAGGTT
TTGGCTCAGGATTCAAATGTAACAGTGCTGTTTGGCGTGCGCTAAGGACCGTTGATGCAGCCATTGAAAAGAATGCTTG
GACAGATGAGATTGAGGATTTCCCTGTTCAAATTGCATATTGATGATCAGTACTGAAACCATAAAACACATTCAAAATC
ACTCTAGTATATTTGTATATGGGATTGTGCACCTAATTTTGAACAAGCGAGGAATCTGGAATTAATAAATTTAAGTAAG
ATGGGGGGCA

> SEQ ID NO: 7262 51719 283255_200092_1b
CCCACGCGTCCGCCCACGCGTCCGCACACCTAATTATTACAAAGGTTCAGAGAGAGCAATGCTTCTACCAAATTGTTTG
TTTCGTATGGGTGGTGCAGCCATACTCTTGTCCAACAAAAGGCGCGATAGATACAGAGCCAAGTACAGATTAATGCACG
TGGTCCGAACACATAAGGGTGCAGACGATAAGGCATTTAAATGTGTATTCGAACAAGAAGATCCACAAGGGAAAGTTGG
TATTAATTTATCGAAAGACCTTATGGTTATAGCAGGAGAAGCTTTAAAATCCAACATTACTACAATTGGTCCTTTAGTT
CTTCCAGCATCAGAGCAACTCCTTTTTCTCCTCACACTTATTAGTCGGAAAATTTTTAATCCCAAGTTGAAACCTTACA
TTCCGGATTTTAAACAAGCGTTTGAACATTTTGTATTCATGCGGGCGGTCGGGCTGTTATTGATGAGCTTCAAAAGAA
CCTGCAATTGTCTGCTGAACATGTTGAGGCATCAAGAATGACATTGCATAGATTTGGTAACACTTCATCTTCTTCACTA
TGGTATGAGATGAGTTACATTGAGGCTAAAGGGAGGATGAAGAAAGGTGATAGAGTTTGGCAGATTGCATTTGGGAGTG
GATTTAAGTGTAACAGTGTTGTTTGGAAATGTAACAGAACAATAAGAACACCAACTGATGGACCATGGCAAGATTGCAT
TGATAGGTA

> SEQ ID NO: 7263 51719 36438_300084_1b
AATAATCAAGAAGCGTCACATTAAGAGTACAAGAGCTTAACCAGAAAAGAAGAAAAATAAACAAGGCAGAGTCTAGTAA
GACTAGGACTAACCAAACAAATGGTTTTTCATTAAATCAGAAGTCGAGCTTAACCGGATATCGGTCGATGCAGTGTTCC
CACGGACTACTAACCGAAGGCTTGACATTGTTTAGAGCCACCCAAACTGCACTGTTACACTTAAACCCACTTCCAAAAG
CAATCTGCCAAACCCGGTTTCCTTTCTTCATCCTACCTTTAGCCTCTATGTAAGCCAGTTCATACCAAATCGAGCTCGA
AGAAGTGTTTCCAAATCTGTGCAGTGTCATTCTGGATGCCTCGACATGAGTCTGCGAAAG

> SEQ ID NO: 7264 51843 286679_200111_1b
TATTATCCACATTTTGTTGAAAAATGGGCACTCTCAACCAGACAGAGCAACCCATGTCCAAGCCTCATGCAGTATGCAT
TCCATTTCCAGCACAAGGCCATATCAATCCTATGCTTAAATTAGCCAAACTCCTCCATATACGAGGCTTTCATATCACA
TTCGTCAACACTGACTTCAACCACCGGCGATTGCTCAAATCCCGGGGTCCAATGCCCTCTCTGGCCTACCTTCCTTTC
GTTTCGAGTCCATCCCTGATGGACTCCCACCCTCTAACGATGACGCGACACAAGATGTTCCATCTTTGTGTGAGTCATG
TACGAAGTTGTGTTTGGCCCCTTTTAGAGAACTTGTCACGAGACTAAATAATTCCTTGAATTTTCCTCCTGTTACTTGC
ATAGTTTCTGATGCTGGTATGAGCTTCACCCATGAAGTTTCTGAGGAATTGGGTATTCCTAATGTTGCCTTTTGGACTG
CTAGTGGTTGTGCCTTGTGGGCTTTCCTACAATATCCTAAACTTGTGGAAGAAGGTTATTGTCCAGTGAAAGATCATAG
TTACTTGACCAACGGCCATTTAGACACCATTATAGATTGGATACCTGGCATGGAGGGCATCCGTCTTAAAAATCTGCCA
AGCTTCATCAGATCCACAGTCGACGAACCTAGCTATATGGTAATCAAATTTATAATGGAAGAAATCTTGGACAAAATTC
CCAAAGCTTCAGCACTCATTTTGAACACTTTCGATGCGTTAGAAACTGATGTTCTGAAGCCAATTTTGACCTTGTTCCC
AACGGTTTATACTCTTGGACCCTTTCACACTTCCTTGAATAATCAAACTCAAGACGAAGATTTGAAATCAATTGGTTCA
AATCTGTGGAAAGAAGATACTCACTGTCTCGAATGGCTCAACACTAAAAAACCAAATTCAGTCGTATATGTGAATTTTG
GAAGTATTACTGTATTGTCTCCCAAACAGCTGGTTGAATTGCATGGGGACTTGCTAATTCCAAATTGAATTTCTTGTG
GATTATTAGATCGGATATTGTCAAGGGTGATTCTCTCATTTTGCCACCTGAATTGCTCGCGGAGATTAAGGAAAGAGGT
TTATTATGTGGTTGGTGCCCTCAAGAACATGTTTATGTCACCCATCAGTAGGAGGATTTTAACACACT

> SEQ ID NO: 7265 51843 291394_200078_1b
GTTTTAATCAGCTAAAGAAAAGAATCTGATGATGTGGGACCTTTTACTGAAGGAAATATGCAAATCATGTTAATGAGT
ACCTCTAGAATTATTGAGGCAAAATACATAGATTATTCTTCTGAATTGAGCAATTGGAAAGTTATTCCAGTTGGTCCAT
CAGTCCAAGATTCAATGGCTAATGGCACGGATGACGTGGAGCTTTTGATTGGCTAGGAAAAAAAGATGAGAATTCAAC
TGTATTTGTCTCTTTTGGAAGTGAGTATTTTTGACAAAAGAAGATAGGGAAGAAATAGCTTTTGGATTGGAGTTTAGT
AATGTTAATTTCATATGGGTTGTAAGATTTCCAAATGGGGAAGAACAAAATCTTGAAAATGCTCTACCACAAGGTTTTC
TTGAAAGAATTGGAGAAAGGGGAAGAGTTTTGAACAAATGGGCCCCACAACCAAGAATTCTCAATAACCCGAATATCGG
AGGATTTATAAGTCATTGTGGTTGGAATTCTGTAATGGAAAGCGTAGATTTTGGAGTTCCTATAATAGCGATGCCTATG
CATCTTGATCAACCAGTGAATGCTAGGTTGATGGCAGAACTAGGAGTCGCGGTTGAGATTGTTAGAGGTGATGATGGCA
AGATTCATAGAGAAGAAATAGCGCAAGTTCTTGAAAATGTCATAGCTG

> SEQ ID NO: 7266 51843 142118_300432_1b
CCGAGTGGCTCGACACCAAGCCGGCCGGCTCGGTGGTGTACGTCGCGTTCGGGAGCTGAACCGTCATGGCGAAGGGGCA
```

FIG. 2 continued

GGTCGACGAGCTGCTCCATGGCCTCGAGGAGAGCGGGAGGCCGTACCTCTGCGTGGTGCGGAAGGACAACAAGGCCGCC
GTGGCGGAGACGGGCGACGCGACGGCGGCGGCGGCGCGCAGGAACGGCGTGGTGGTGGAGTGGTGCGACCAGGTGC
GCGTGCTGTCGCACGCGGCGGTGGGGTGCTTCGTCACGCACTGCGGCTGGAACTCGGTGCTGGAGAGCATCGCGTCGGG
CGTGCCCATGGTGGGCGTCCCGCGGATGTCGGACCAGCAGATGAACGCGCGGCTCGTCGAGCGCGACTGGCGCGTCGGC
GTGCGCGCGGAGGTGGACGGCGGCGACGGCGTGCTGCGCGCGGCGGAGCTGAGGCGGCGGGTCGAGGAGGTGATGGGAG
ACGGGGAGGCGGCGGAGGTGCGGCGCTCGGCGGCGGCGTGGAAGCGAGCGGTGGCGGAGGCTCTAGGGAAAGGAGGGTC
GTCGGATCGTAATCTGACGGCCTTCGTGGAGGGTGCCAGAAGTGTCATTTGAAAACGACATAATTTGAAAACGTTATA

> SEQ ID NO: 7267 51843 138745_300727_1b
CCCACGCGTCGCCCACGCGTCCGCGACAACCGCCTCCCGGACGACGCGTCGTACGGCTTCCACCTCCACACGCCGATGG
CGGCGGCGTGCCGGGAGTGGCTGGACGCGCGGCCGGCGGGCTCCGTGGTGTACGCCTCGTTCGGGAGCATCGCGGCGCC
GGGGCCGGAGACGATGGCCGAGGTCGCCGAGGGCCTCTACAGCAGCGGCAGCCCATTCCTCTGGGTGGTCCGCGCCACG
GAGACCGGTAAGCTCCCCGCCGGCTTCGCCGCCAGGGCGAAGAACACCGGCCTCATCGTGCCATGGTGCCCGCAGCTGG
AGGTGCTCGCGCACGCCGCCGTGGGCTGCTTCGTGACGCACTGCGGCTGGAACTCCACCGTCGAGGCGCTCAGCGCCGG
CGTGCCGATGGTGGCGGTGCCGCAGTGGTCGGACCAGACGACGAACGCCAGGTACATCGAGGACGTGTGGCGCGTCGGC
GTGCGGGTTCGCGGCGGCGGCGGCGGCGACGGCGGCGCGGTGGTGAGGAGGGAGGAGGTGGAGAGGAAGGTGAGGGAGG
TGAT

> SEQ ID NO: 7268 51843 241040_301319_1b
AAGGTGAGTCCGCCGGGCCCCAGAACGTCTTGCTGCGTGAGCAAAGCCTCGAGTCAATCCAGTGGCTCAACAAGCAGGA
GAAGTCTTCGGTGCTCTACATTTCTTTCGGAAGCCTGGCCGCCCTCACCAGGCAGCAGTTCGAGGAGCTGGCAGAATCT
CTCGAAGAGTTGAAGCAGCCATTCCTGTGGGTGGTGCGACCGGAGCTCTTCATCGACTTCATGCATGAATTTCAAACTC
TATATGACAACTTCTGTGAGAGAACGAGGCAGCTCGGCATGGTGATACATTGGGGACCGCAGCTTCAAATCCTGNAACA
CCCGTCTATTGGAGCATATCTCACACACTGCGGTTGGAACTCCCTCATCGAGAGCATCTCCAACGGCGTCCCGATGATC
GCTTGGCCGTGGGGAGCGGAGCAGAACAGCAACGCCAAACTCCTCACCGACGACTGGAAAGTTGCCTTCAAAATCCCCA
CCAAAGGCTTCTTCGATCTGGTTCCAAAAGCGGAGGTTGTCAAGGCAATCAAAACTGTGATGGACTTTGACAACGTCGA
CGGCGCTGCCATCCGAAGCAATGTACTACGTCTGAAGAAGCTGGCCAGGAAGGCCGTTGTCGGGGGTGGTC

> SEQ ID NO: 7269 51843 259894_301709_1b
GAAAGAGATGCTTCCTCTTGCCTACCGAACACCCAACGCATTTACCACGAATCTGGCAGTTGCAGCGAAGCGAACGAAA
ACTGCCGCATGCCTTCTTATCAACACGATCGAAGAGCTGGACCAGAAACTCGTGGACGTGCGCAGGTCCGAGTTTTCCA
GCTACTTAGCAGTCGGACCTCTGGTGTCCCAAGCGCTACTACAAGAACAGGATACTGCAGTCAGTTCCACAAGTGACGA
TTCTCTGAGCTGGTTGGACAAGCACGCTCACCGTTCGATTCTCTATATTGCCTACGGAAGCGTTGTGTCCCTGAAAGTT
AGCGACGCCCAGAAGATAGCCGAAGCTGTGAAAGCAAGTCGTCAGCCGGTTTTGTGGGCAGTAAGCAGGAAGTTCGCAG
GCGACGTACCTGAGAACTTCTACGAAAGCTTGCAAGAAAGAGCTGGGACGCAAGCTTTGATCGTGGAATGGGCTCCGCA
AGTGGCTGTGTTGCGCCACCCTGCAGTTGGGGCCTTCTGGACGCACTGTGGATGGAATTCGGCTCTCGGAAGCCTTGTGC
ACGGGAGTACCGATGCTTTGCTGGCCCTGCGCAGCCGATCAAAACGTCAATGCAAACACGATAGTGACCAATTGGAGAA
CTGGGATGATGGCGAGTAATGGACCACAAGATGACGCG

> SEQ ID NO: 7270 51843 168354_300555_1b
AGATGAAAGTTGTTTCACAAATGGGTATATGGACACGGGAATTGACTGGATACCTGGAATTAAAACTATCTTGTTTAAA
GATATTCCTACATTCGTTCGAACAACGGATCCTAATGACGCCATGTTGAATTATATTTAAAAGAAGCTGCCCGAACCT
ATGAAGCTACAGCATTGATTTTCAATACTTTTGATGATTTAGAAATGGAGTTATTGGATGAATTCAAGTCTCAGCTACC
AGTACCACTGCCTCCAATTTACACCGTTGGTCCTATTCACAATCTCCACAATCAAATTCCAAACCATAAATTGCAGTCT
ATCGGATCAAATCTATGGAAAGAAGATACCCAATGTCTACAATGGCTGGATTCCAAGAAACCTGATTCAGTTGTGTACG
TTAATTTTGGAAGCATAGCTGTTATGACTGCTCAACAACTAGTAGAATTTGCTTGGGGGCTGGCTAATACTAAACACAG
TTTCTTATGGATCATCCGACCCGATCTGGTAGTTGGTGCGTCAGCAATGCTGCCCCTGAGTTCTTAGAAGAAACCAAA
GAAAGAGGTCTGCTCGCAAGTTGGTGTCCACTGGAATACGTGCTGAATCACCCATCCATAGCTGGTTTCTTAACGCACT
GTGGTTGGAATTCAATTTT

> SEQ ID NO: 7271 52689 217835_300912_1b
ATCATTGGTCTTGAGATGGCTTCCGTTTGGTCACGTCTGGGAGCCAAGGTTACCGTTGTCGAGTTCCTCGGTCAGATCG
GTGGACCCGGCATGGACACCGAGATCTCCAAGGCCACTCAGCGAATCCTCAAGAAGCAGGGCATCGAGTTCAAGCTCAA
CACCAAGGTCGTCAGCGGTGACACCAGCAGCGAGCTCGTCAAGCTCGACGTCGATGCTGCCAAGGGCGGCAAGCCCGAG
AGCATTGATTCCGAGGTAGTTTTGGTCGCCATTGGACGAAGACCCTACACCCAGGGTCTGGGCCTGGAGAACATTGGCC
TCGAGACGGATGAGCGTGGCCGTGTTATCATCGACTCGGAGTACCGAACCAAGATCCCCCACATCCGCTGCATTGGTGA
CGTTACCTTTGGACCCATGCTTGCCCACAAGGCCGAAGAGGAGGCTGTTGCCGTCGTCGAGTACATGGCAAAGGGCCAC
GGCCACGTCAACTACGGATGCATCCCATCTGTCATGTACACCCACCCCGAGGTCGCTTGGGTTGGCCAGTCGGAGCAGG

FIG. 2 continued

ACCTTAAGGCTCAGAACATCCCCTACAAGAT

> SEQ ID NO: 7272 52689 6966_300321_1b
CCCACGCGTCCGTGCTGAAGGTGGAGAACAGACCACTCTAGAAGCTGATGTGGTCCTCGTCTCAGCTGGTAGAACTCCG
TTCACATCTGGACTTGATCTAGAGAAAATCGGAGTTGAGACAGACAAAGGCGGGAGAATTCTGGTGAACGAGAGATTCT
CGACAAATGTTTCAGGCGTTTATGCAATTGGAGATGTGATTCCAGGACCAATGCTGGCTCACAAAGCCGAAGAAGATGG
TGTTGCATGTGTTGAGTTTATAGCAGGCAAACACGGGCATGTGGATTACGACAAAGTCCCTGGGGTTGTCTACACGTAC
CCTGAAGTTGCGTCG

> SEQ ID NO: 7273 53564 262658_301749_1b
TTATCACAACATCGACTTTGTTTCTTCACCGGAGAGTTGACTTTTTCCAATTGTCTCATCACTAACTTGATCAGCCGGT
AAATTTAGGTCAAACTTGTGGCTATTGTCACCGTTACTGTTACCGTTACCACCATCATAGTGACAACGTTTGTGACCAC
CCAATGCTTGACCAGAGGGAAACGACTTAAAACATATAGAGCAGTTATGAGTCTTCCCACTTTGACCAACTAAACCGTT
ACTAATATTTCCGTTATTAGTAACGGTTCCGTTACTATTATTAACATCGACACTAACCGGTTTCCGGTGACTTGTTTTG
TGTCCACCTAACGCTTGGTAAGACGGGAAAGATTTGCCACAGACGGAACACTTGTAATCTTTCTGATGATCGGACAGTG
GAGAAAGAGAGTGATGATCCGACGGTGGAGAGTGATGATCGGAGGAGCCACGAGCGAGCATAAGGAGGCAAAGAGCGAG
ATACTCTTCTTCAGAAGGAGGAGGGTTTGGTTGATCTATACGGTGACGTTTTGTACGTTTTCTTTTGGTCCATGATTCG
AGGTTTTCGGGCTCGGTTTCGTCGAGGCAACGGAGGAAAGGAGGAGGAGCGGTGGTTGTGGTGGTGGAGGTGGGAGAAT
TGAGAGTGTCGAGAGCCATGCTGC

> SEQ ID NO: 7274 53564 33307_300457_1b
CTCAATTTAGAACTTAGTAGCTAGTCTTCAAGATAATGGCACTTGAAACTCTTACTTCTCCAAGATTATCTTCTCCGAT
GCCGACTCTGTTTCAAGATTCAGCACTAGGGTTTCATGGAAGCAAAGGCAAACGATCTAAGCGATCAAGATCTGAATTC
GACCGTCAGAGTCTCACGGAGGATGAATATATCGCTTTATGTCTCATGCTTCTTGCTCGCGACGGAGATAGAAACCGTG
ACCTTGACCTGCCTTCTTCTTCGTCTTCACCTCCTCTGCTTCCTCCTCTTCCTACTCCGATCTACAAGTGTAGCGTCTG
TGACAAGGCGTTTTCGTCTTACCAGGCTCTTGGTGGACACAAGGCAAGTCACCGGAAAAGCTTT

> SEQ ID NO: 7275 53564 51184_300148_1b
CGGACGCGTGGGCTTGAAGCTCTTAATTCACCAAGATTGGTCGAGGATCCCTTAAGATTCAATGGCGTTGAGCAGTGGA
CCAAATGTAAGAAACGATCCAAACGTTCGAGATCTGATCTTCATCATAACCACCGTCTCACTGAGGAAGAGTATCTAGC
TTTCTGTCTCATGCTTCTTGCTCGGGATGGCGGCGATCTTGACTCTGTGACGGTTGCGGAGAAGCCGAGTTATAAGTGT
GGCGTTTGTTACAAGACGTTTTCGTCTTACCAAGCTCTCGGCGGTCATAAAGCGAGCCACCGGAGCTTATACGGTGGTG
GAGAGAATGATAAATCGACA

> SEQ ID NO: 7276 53564 14306_300244_1b
CCCACGCGTCCGCGGACGCGTGGGAAACGATCCAAACGTTCGAGATCTGATCTTCATCATAACCACCGTCTCACTGAGG
AAGAGTATCTAGCTTTCTGTCTCATGCTTCTTGCTCGGGATGGCGGCGATCTTGACTCTGTGACGGTTGCGGAGAAGCC
GAGTTATAAGTGTGGCGTTTGTTACAAGACGTTTTCGTCTTACCAAGCTCTCGGCGGTCATAAAGCGAGCCACCGGAGC
TTATACGGTGGTGGAGAGAATGATAAATCGACACCATCCACC

> SEQ ID NO: 7277 57119 268437_200120_1b
ATTTTGTAATTGACACCTCATCACTCAAGTATCATCTTGAACAGATATTTCCTCCCTCTTGTATAATTATCCAAAGTAC
TTTCAACTTAATGTTTGTGTTGTGCATATTCATATGTGTAATAAAGTCAGGAGCTGTATGTCAAAGTGTAAATGCCATC
GGTTCGAGTTTCATTGAGTTTTGATCA

> SEQ ID NO: 7278 57119 268883_200122_1b
CCCTCGACCCACGCGTCCGGTATCGTCAAGTGAGGACATTGCTTTTACATGCCATGCACATCCAACAACGAGTGAGGCT
CTGAAAGAAGCACACATGGCGCACTTACGACAAGCCCATTCACATAT

> SEQ ID NO: 7279 57119 187070_300673_1b
GTGCTGGAGAGATAATACATGAGGCTGTCCTTGCTTTGCAGTATGGAGCATCAAGTGAGGACATAGCTCGTACATGCCA
CGCTCATCCCACCGTGAGCGAAGCCTTGAAGGAGGCCTGCCTGCAAACCTTCACAAAGGCGATTCACATTTAAGTTCTG
TTTTGCTTTTAACATCCAAACTGCTTGGCTTCACAAATTCCAAAATTTTGTAATAATTTTGGATATATGGGATCAAAAA
GCCACTGTTTGTCATTTTACTCTCGTTCGTGATGCTGTGAATTGACACTAGTTGCCACAGCCAATAGTATATGCTATTG
ATTCCATTCCCTTAGATGCT

> SEQ ID NO: 7280 57119 224960_301048_1b
GTGAAGACCAAGTTGTCAAGTGGAGGAATCCGGATCCGGGCTCAAGCTTTCCCTGGAAGCGGCAACCGGTGGCACACCA

FIG. 2 continued

```
TCGACTTTGGAAGCAGACGTGGTGTTGGTCGCGGCGGGAAGATCTCCATACACCAAGGGTCTCGGACTGGACAGCGTGG
GGATCAAGCTCGACAAAGCTGGCCGAGTGGAAGTTGACGACCACTTCCGGACTAGCGTCCCCAGCATCTACGCCATCGG
CGACGTGATCCGGGGTCCCATGCTGGCGCACAAGGCCGAGGAAGATGGGGTGGCGTGCGTGGAGCTGATCGCCGGCAAG
GCCGGGCACGTCAACTACGACACAGTGCCGGGTATCGTCTACACGCATCCGGAGGTGGCATCGGTGGGGAAGACGGAGG
AGCAAGTCAAGGCGCTGGGGATCCCGTACAACGTTGGGAAGTTCCCGATGATGGCCAACAGCCGAGCGAGGACGATCGA
TGATGCGGAGGGGATCGTCAAGGTCATTGCGGAGAAGGAGAGCGACAAGATACTGGGGATTCACATAATGGCGGCCAAT
GCCGGGGAGATGATCCACGAGGCTTGCATTGCGCTCGAGTATGGTGCTTCCAGCGAAGACA

> SEQ ID NO: 7281 57135 167847_300551_1b
GAATTCAAAATCTTTGGTTCAAGAAGTCTCTGAACTTGTCCAAATCGTTTAACATCAGGAATGAGGTAACTATCCCCAG
CGATGCTGATGCAGATTTTGATCTGTTTGTCAATGGTGGTACTATTTCTGATGCAAAGCTGGAGTTGTCAAAACCAACT
AACTTGAATGCTTTTGATATCATCTCACTTTCTGCTGGATTAGATCTCTCTGGGCTATTTGATGATAAACACAAGAGGA
CAGAAGAGCGATTCACATCGCAGCAGCCTTCCTCCGCTATTATATCTAAACTAGAAGACATTGCGAAGAATCTAAAACT
AAAGGTGCAGAAGAAAGTGGGAGGGCTGTTGAAACTAGAAGGAGAAACAGCGGGAAGGAAGGGGGTTTTGTCCATTGAA
GCCGAAATCTTCGAGGTGACTCCATCTTTTCATTTGGTAGAAGTTAAAAAGTCCAGCGGTGATACCTTGGAGTACAGAG
ATATATTAAAACAGGAAATAAGGCCTGCACTCAAAGACATTGTTTGGACATGGCAAGGTGAGCAACAGCAAAAGCAAGA
GCAAGAACAACAAGAATTGCAGCTTTCTTAGATAGTCAGAATTGTTTGTTCTTACCATTTCATATTAAGTTAATCAAAG
TTCTTATTTCCCTTTGGC

> SEQ ID NO: 7282 57135 285720_200106_1b
TGTATAACAAAATATCTGCTGCTGAATTTACTTGCCCACCTTGGATCTCTTTTGCTGCCATGAAGTTAATTACTCGCAT
CTTGGATCCAAATCCTACAACGCGTATTACCGCCCCTGAAATTTTGGAGGATGAGTGGTTTAAGAAAGATTATAGACCA
CCTGTTTTCGACGAGATAGAAGATGCAAACCTGGATGATGTTGAAGCTGTTTTCAAAGACTCTGAAGAATATCATGTAA
CAGAGAAAAAGAAGAGAAGCCAACTTCCATGAATGCATTCGAGTTGATTTCTATGTCACAAGGACTTAACCTCGGCAA
TCTCTTCGACGAACAGGGATTCAAGCGAGAAACAAGGTTCACATCTAAATGCCCGGCCAGCGAGATAATCAGTAAGATC
GAAGAAGCAGCTAAACCTCTCGGCTTTGATGTTAGCAAAAAGAACTACAAGATGAGGCTCCAAAATCTGAAAGCCGGAA
GAAAAGGGAACCTTAATGTTTCCACTGAGGTATTTCAAGTTGCTCCGTCTCTTCATATGGTTGAGGTGCGCAAGGCAAA
AGGTGACACTTTGGAATTCCACAAGTTCTACAAGAATCTTTCAACCTCCTTAGATGAAGTTGTATGGAAAACTGAAGAG
AACATGGAAAAGAAAAAGTGAAGAGCAATAGAAGTTGCATTTTTTTTAAAAATCTCTGTTGCTACCAATTGTAAGAAC
TGTTCTTTCTTTACTATTGTTTTTCTTTCATTTGTTTTTCTTTTTTCTTTTGAGACCATCTTTTCTGGGAATTTTTTCT
CTTAAGAGAATTACCATAGAAGGATTTCTCAAATTGTTTCACTAGTTATAGGTGTTAGACAGACAGCAGAGTTTGGTCC
TATTAAGGTGAAGTTTGTATAATCTGTGTCACTTTTCACAAATGTGATTGCAATTGTATACTGTATATTGGATTCTTTA
GATTTTTATTTCTTTGAAAAATAATTAATAGATTTTTATTTAGTG

> SEQ ID NO: 7283 57135 55738_300141_1b
AAACTACGTTGCCCCTGAGGTTTTGTCGGACAAAGGCTATGACGGTGCAGCAGCAGATGTCTGGTCTTGTGGTGTCATT
CTCTTTGTGCTTATGGCTGGTTACTTGCCTTTTGATGAGCCGAATCTCATGACATTATACAAACGTATATGCAAGGCTG
AGTTTAGCTGCCCACCATGGTTCTCGCAAGGTGCCAAGAGAGTCATCAAGCGTATTCTCGAACCCAACCCTATTACCAG
AATAAGTATTGCAGAGTTGCTCGAAGATGAATGGTTCAAGAAAGGGTACAAGCCGCCATCATTTGACCAAGATGACGAG
GACATAACCATAGATGATGTTGATGCTGCTTTTT

> SEQ ID NO: 7284 57135 103705_300027_1b
TGGTATGAACGCAGAGTGGCCTTTACGGCCGGGGGATATGATGGTGCCAAAGCTGACATCTGGTCTTGTGGGGTGATCT
TATTTGTCTTGTTGGCTGGTTATCTTCCGTTCCATGACTCAAATCTTATGAATATGTATAGGAAGATAAGTAGGGCGGA
ATACAAATGCCCTAATTGGTTCCCTTTAGAAGTGCGTAAACTTCTTTCTAGTATCCTCGACCCAAACCCTCATACAAGG
ATTTCGATAGCCAAAATTAAGGAAAGCTCCTGGTTTAAGAAAGGGTTGGAATCCAGACATGTGAGAACCAAACTAGTAC
AGAACCAAAATGTTAATGCAGATGGCGATGCTGTTTGCAGTTCGAGTTTGGAGAACAGCATCTCTTCCTCTGACACAAA
GCTAGAGTTGGCAAAACCTATGAATCTAAATGCATTTGATATCATCTCTCTTTCAAGTGGTTTTGACTTGTCTGGTCTA
TTTATAAGAAATGATCAAAAGGAGGAACTGCAATTCACATCAGTGAAGCCTGCCGCGGTCATCATATCTAAGCTTGAGG
AAGTTGGCAAGAATCTGAACCT

> SEQ ID NO: 7285 57135 133554_300450_1b
CTTGACCATTCACAGTGGAATTCTGATTGTTTCTCTCTTTCATGGAATCAGAATTATTATAGTATCCATTAACATATTT
ATTAACCAGTTAAATATATAAGGTGCTGGTCCTAGTTGCTTTTTTTTCTATTAAGGTGCTCGTCTTCAACTAAGATAAG
TGAAATGTGGATGCTGGCTTTACAGGATTCAATGAAGCAGCATCAAACACGCTTTCTTACGCAGAAACCAGCAAAAGTT
GTTTTATCAAGTATGGAAGTTGTGGCCCAATCCATTGGTTTCAAGACCCACATCTGCAATTTTAAGATGAGGGTAGAAG
GTCTGTCCGCGAACAAGACTTCACATTTCTCTGTAATTCTAGAGGTGTTTGAAGTTGCTCCTACATTTTTCATGGTAGA
CGTTCAGAAAGCAGCTGGTGATGCTGGCGAATTCCTTAAGTTTTACAAGAACTTTTGTGGCAATCTGGAGGATATCATC
```

FIG. 2 continued

> SEQ ID NO: 7286 57135 1114537_301846_1b
GGTTATCCTCTGGAGCAAGGCGGCTTATAACCCGCATACTGAATCCTAATCCAAAAAATCGTATCACCATTCCTCAAAT
TCTTCAGGATCCTTGGTTTCTGAAAGGATATCAACCTGCCAACTTTGAGGAGGCTCAAGAAATCAATCTAGATGATGTG
AATGCTGTTTTTAGCTCGTCGAAGGAGCATTTGTCACTGAACAGAAACAATCAAAGCCAGTTCATATGAATGCATTTG
AGCTTATTTCACTCTCGAAGGGACTAAACCTATCAGGCCTATTTGCTAATAAGCAGGAAGTGAAGAGGGAGGCTCGATT
TACCTCCCAACATCCAGCACCTGAGATCCTTTCGAAAATGGAAGAAACAGCAAAACCGCTCGGTTTCAATGTGCAAAAG
CAGGATTTCAAGATGAAGCTTCAGGGAGCTGAGAGTGGTCGTAAGGGTCATGTTTCTGTTTCAACAGAGGTGTTTGAGG
TGGCCCCTTCTCTTTTTGTTATAGAAGTTCGGAAAGCAGGCGGTGACACACTAGAATATAACAAGTTTTATCAAAACTT
CTCTACTGGGTTAAAGGATATTGTGTGGAAGACAGAAGTCGATTTGGAAGGGTAAAATATTCGGAACAATGGCAGTTTA
ATATTGCA

> SEQ ID NO: 7287 57135 141913_300430_1b
CCCAAAAAAGAGAGACAAGATTCACATCACAATGTCCTCCAAAAGAAATTATCACCAAGATTGAAGAAGCTGCAAAGCC
ACTTGGATTTGATATTCAAAAGAAAAATTACAAGATGCGCATGGAGAACCTGAAAGCAGGTAGAAAAGGCAATCTCAAT
GTTGCAACTGAGGTTTTCCAAGTAGCTCCATCCTTACATGTGGTTGAGCTCAAGAAGGCAAAGGGGGACACTCTGGAGT
TCCAAAAGTTCTACAGAACCCTGTCGACCCAGCTCAAGGACGTGGTCTGGAAGTGCGACGGCGAGGTCGAAGGCAACGG
CGCCGCGGCCGTGAACGTGGTTTTTGCCATGGCTTTCGGGGCACCGGTTCTTCGTGTACATAGCTGCTCTGCCATCATCA
ATGGGGTGTTCGCCGTAGAGTAGCTTTTTGTAACAAGGAGAAAAAGGAAAGAAAAAAAGAGAGGGAAAGATTCGTTGGTT
CGTTGATAGGTAGGCTGCTCCGATGAAACAACGGGCGCGATGCCTGCTGTGGATGAGCTTGTCGCCGTGTTAGTTCATT
TATTCTGTGGCCTCGGAAGGTTGTAACGGGACACAATCAGATGCCGCAATGCAACGGGCTGACAGTTTGTGAGTTTC

> SEQ ID NO: 7288 57135 135033_300421_1b
CCCACGCGTCCGCCCACGCGTCCGGTAGTTCTAGATCATGTCTAAAATAGAGGAAGCTTGTGGACCTCTTGGTTTCAAT
GTGCGGAAACAAAATTATAAGATGAAGTTAAAAGGTGATAAGACTGGAAGAAAAGGCCATTTATCTGTAGCAACGGAGG
TTTTCGAGGTTGCTCCATCACTCCACATGGTTGAGCTTCGTAAAACTGGAGGGGACACGCTGGAGTTTCACAATTTCTA
CAACAATTTCTCGTCAGAGTTAAAAGACATAGTGTGGAAATCTGAATCTGACGCAAAAGCAGCAAAGAAGAGGTGATCT
TTAGTATTCTAACTATCCAACGCTCCTGGATGTAGTTCCCTCTTTGTAGCGTTTGCACCATTTCTCCAGGTGACACCAA
AGGATATCGTCCTCCTGGTCTTGTGCGCATTGATGAATTTCTGGGATCACATCTTGTTGTGCCAATCCTTGTAAAAGG
GTGCGCTTCTTTTTTTCTTTTTGACCCTTAGCGCAACTGTGGACATGCTCACATACATGTATAAGGCCCTCCCGGAGA
TGCACCTTGTATTTGCAGTTGGGATGTCAAATAGGTGTCCTACATGCTTTGGTGACCA

> SEQ ID NO: 7289 57145 46852_300192_1b
CTTAGAGAGTATCAAATCAATCTCCGGCGGATGGGCGCGGCGGCGCGTTCCTGTGACGCTTGTAAATCAGTTACCGCC
GCCGTGTTCTGTCGAGTTGACTCAGCTTTCTTATGCATAGCATGTGACACAAGAATCCATTCCTTCACTCGCCACGAGC
GCGTGTGGGTTTGTGAAGTTTGTGAACAAGCTCCCGCCGCCGTCACTTGCAAAGCCGACGCCGCCGCTCTTTGCGTCAG
TTGTGATGCCGATATTCACTCTGCTAATCCTCTCGCTAGCCGTCACGAACGTGTCCCCGTCGAAACTTTCTTCGACTCA
GCCGAAACCGCCGTCGCCAAAATCTCAGCTTCTTCGACTTTTGGTATCCTTGGCTCATCCACCACCGTTGATTTAACC

> SEQ ID NO: 7290 57145 57193_300121_1b
CAACAGGCCAGAGAGAAGAAAGAAGAGAAAAATATGGGCATATTGAGAGGCGGCGCAGATTGTTTTCCAGGAGGATGGG
GTGCGGCGGC

> SEQ ID NO: 7291 57152 283628_200094_1b
TAGAATATACACTTCTCTTATCTTCACATCTCCAATCCTTCAAATCTCCTCCACCCAATCCTTTAATCCACTAGCTACC
CTCTCTAAAAAGATCCCAACTCCCCTTCTCCTTATTTTCCTTATTCACCATTACCTTATTATCAATTCCCTCCTCTTAA
TATTTTGTTCCATTTCTTGATATCTCAAACATGGCTGCTGCAGTAAGTGCTGCAGTTTCTCTTCCATCGTCCAAGTCCA
CCTCTTTTCCCACCAGAACCTCCATCATCTCCCCTGAAAAGATCAACTTTAACAAGGTGCCTTTGTACTACAGAAATGT
GTCAGCTGGTAGTAGAGTGGTTTCAATCAGAGCCCAGGTGACCACAGAGGCTCCTGCTAAAGTTGAGAAGATTTCCAAG
AAACAAGATGAGGGTGTGGTTGTGAACAAGTTCAGGCCAAAGGAACCTTACATTGGTAGATGTCTACTCAACACTAAGA
TCACGGGTGATGATGCTCCTGGTGAAACTTGGCACATGGTCTTCAGCACTGCAGGGAGAGGTCCCATACAGAGAAGGACA
ATCCATTGGTGTGATTGCTGATGGTGTTGATGCCAATGGGAAGCCTCACAAACTCAGATTGTACTCCATTGCTAGCAGT
GCCCTTGGTGACTTCGGCGACTCCAAAACCGTTTCTCTGTGTGTCAAAAGGCTTATCTACACCAATGACAAAGGGGAAG
AAGTTAAAGGAGTTTGCTCAAACTTCTTATGTGACTTGAAGCCTGGAGCAGAGGTCAAGATTACTGGACCTGTTGGGAA
AGAAATGCTCATGCCTAAGGATCCAAATGCCACCATTGTTATGCTTGCAACTGGAACTGGAATTGCTCCTTTCCGTTCA

FIG. 2 continued

TTCTTGTGGAAGATGTTCTTTGAGAAACATGAGGATTACAAGTTCAACGGTTTGGCATGGCTTTTCTTGGGTGTTCCCA
CCAGCAGCTCGCTACTTTACAAAGAGGAGTTCGAGAAAATGAAGGAGAAGGCCCCCGAAAACTTTAGACTGGACTTTGC
AGTGAGCAGAGAGCAAACAAACGAAAAAGGCGAAAAGATGTACATCCAAACCAGAATGGCACAATATGCAGAAGAACTA
TGGGGTCTGCTACAGAAAGACAACACCTTCGTCTACATGTGTGGACTCAAGGGCATGGAGTCTGGAATTGATGACATTA
TGACTTCACTTGCTGCTAGAGATGGTATTGTATGGGCGGACTACAAGAAGCAATTGAAGAAGGCAGAGCAATGGAATGT
GGAAGTCTACTAAATATTTTTGGTTTTCTTTGTATAAATATGAGCCAACTTTATGCTTCTCTACCCTTCATCCATGTAG
ATAGGTAAATTTTTCCTTTTAAATTAATTTTCATTTTTTTTTGGATTTTCCTTTTCTTGAAATTTCATCATTAAATGA
ATCAGTGTATTGACATTGGCCCTGTAAAAGGAATTGACGGCATGTATCAATAACATATAGCTGAATCAACCTCAATTGC
TGTCTGTTG

> SEQ ID NO: 7292 57152 52669_300091_1b
TTTTTTTTTTTTCATGTCTAATGATTGACTTTCTTGGTGGAGTTACACTGTGTCCATTAATTGACACGATTATTCAGTT
GCAAAAATGGCGAAAACCACAGAAAGACTATTAACTCAATACACTTCAACATGCCACTGCTTGTTCTTCCTGAGCTGAG
TAAGTTTCTGCTCCCAGCTTTCGCCTCGCTCTTCAGCGACTCTTTTAAGCGTATCTTGAATCCCGGGCATCATTCCTTT
AAGTCCGCAAAAGTAAATATGAGCTCCATTGTCCAAAAGTTTGAAAATTTCATCGCTGTATTCTTCAATCTTGTCCTGC
ACATACATTTTCCCTCCTTTCTTGTTTTTCTCTTCTCTGCTCAGCGCTTTGTCGTACCTGAAATTTTCTGGATAGTCCT
TGCGGTACCCGGCAAATTCTTCATCATAAAAAAAACTGTCTGAGTTAGCCACACCAAGGAAGAGCCAAGCAAGTCCGTC
AAACTTGAAATTGGGAACATTCTCCATAAACATACGCCGTAGGTATCCTCTGTACGGAGCAACTCCGGTTCCAGTAGCA
ATCATTATGTGAGTAGCTTTCGGGTCATCTTCAGGTAAAAGCATTACCTTTCCAGATGGACCGGTGATTTTAACTTTAT
CGCCGGGTTTGGCATTGCACAAGAAGTTACTGCATACACCAGCTTTGGAAGGATCTTCTTTTCCTGTCTCCGGATCATA
GTAAATAGCTCGACGGACACATAGACTAGCTGTTTTGCCATCAAAAGAATCTCCATACCGTGTTGATGCAATCGAATAA
AGGCGAACGTTATGAGGTGCACCAGGTTTCTTGGGATTCTCACCAGGAGGAATGACTCCATAGCTTTGTCCTTCCCAGT
AAGGAACATTACCATCATGATCAATAACAATGTGGCAAGTCTCTCCAGGTGCTTGTGGACCAACAATTCTCTCAACCGA
AACAATAGTTGCAGTATAAGGCTCCTTAGGCCTAAACAAGTTTAAGGGAGTCTCTTTGGGATCTTCAAGTTCTAGAGGA
GTAACCAAGACTTTGGATTTGCTTGATTGCTGAAGTGACATGCATATTGTGGACCTTTTTTTCACACCTAAGCTTCTAG
ATTTCGAATCTAGTCTCAGCAGAGGAGGACCCCATGACTTATCAGTGAAGCTTATACTTTGAACCTTAATCATAGATCG
GCTCGACCCATCAATTCTAGTTGGAAGTGCAACGGACATCTGAGAAGGAGTAGTTGAGAGAGCCATAGCAATGGAGAAA
AGAGACGATAATTCTCCCGGACGCGTGGG

> SEQ ID NO: 7293 57152 4090_300323_1b
TCCGCTGGGAAGGTAATGCTATTACCCGAGAGTGATCCAAACGCGCCCCCCATAATGATAGCCCCGGGAACAGGAGTGG
CTCCATACAGAGGCTACTTACGTCGAATGTTCATGGAAAACGTCCCAAACAAGACATTTAGCGGCTTAGCTTGGCTCTT
CTTAGGCGTGGCCAACACCGATAGCCTTCTCTATGACGAAGAGTTTACCAAGTACCTAAAAGACCATCCAGACAACTTT
AGGTTCGACAAGGCATTGAGCAGAGAGGAGAAGAACAAGAAAGGTGGAAAGATGTACGTGCAGGACAAGATTGAAGAAT
ATAGTGATGAGATCTTCAAGCTTTTGGACAATGGAGCTCATATTTACTTCTGTGGGCTTAAAGGAATGATGCCTGGGAT
TCAAGATACACTTAAGAGAGTTGCAGAAGAGAGAGGTGAGAGCTGGGACTTGAAGCTTTCTCAGCTCAGGAAGAACAAG
CAGTGGCACGTTGAAGTCTATTGAGCTCTTTATTTGTATTTGCTGTTTTTGATTTTTGATTTAAGAATCGTAATAAATT
TGAATTTGGTGTTTTTCTACTTTTCAAACATGATATGATGATAATATCTGAAATTTGTTGGTTTTGAGAAGAGAATATT
CTCAGAGAATAATCAATATATCATTTATGTAAAAAAAAAAAAAC

> SEQ ID NO: 7294 57152 38528_300201_1b
GCAGCAACTTCCTATGTGATTCAAAGCCCGGTGACAAGATTCAAATCACCGGTCCATCTGGGAAGGTAATGCTATTACC
CGAGAGTGATCCAAACGCGACACACATAATGATAGCCACGGGAACAGGAGTGGCTCCATACAGAGGCTACTTACGTCGA
ATGTTCATGGAAAACGTCCCAAACAAGACATTTAGCGGCTTAGCTTGGCTCTTCTTAGGCGTGGCCAACACCGATAGCC
TTCTCTATGACGAAGAGTTTACCAAGTACCTAAAAGACCATCCAGACAACTTTAGGTTCGACAAGGCATTGAGCAGAGA
GGAGAAGAACAAGAAAGGTGGAAAGATGTACGTGCAGGACAAGATTGAAGAATATAGTGATGAGATCTTCAAGCTTTTG
GACAATGGAGCTCATATTTACTTCTGTGGGCTTAAAGGAATGATGCCTGGGATTCAAGATACACTTAAGAGAGTTGCAG
AAGAGAGGTGAGAGCTGGGACTTGAAGCTTTCTCAGCTCAGGAAGAACAAGCAGTGGCACGTTGAAGTCTATTGAGC
TCTTTATTTGTATTTGCTGTTTTTGATTTTTGATTTAAGAATCGTAATAAATTTGAATTTGGTGTTTTTCTACTTTTCA
AACATGATATGATGATAATATCTGAAATTTGTTGGTTTTGAGAAGAGAATATTCTCAGAGAATAATCAATATATCATTT
ATGTAGT

> SEQ ID NO: 7295 57152 120711_300516_1b
CGGAGACGACCGCAGCGCCGGGTGCGGAGGTGACTACTAAGGTGGAGAAGCGTGTCGAAGAAGCAGGTGGATGGCGTGGT
GACGAACAAGTACAGGCCCAAGGAGCCGTACACGGGCGGTGCCTCCTGAACACGAGGATCACCGGCGACGACGCCCCC
GGTGAGACGTGGCACATGGTGTTCAGCACCGACGGCGAGATCCCCTACCGCGAGGGGCAGTCCATCGGCGTCATCCCCG
ACGGCATCGACAAGAACGGCAAGCCCCACAAGCTCCGCCTCTACTCCATCGCCAGCAGCGCCATCGGGGACTTCGCCGA
CTCCAAGACGGTATCGCTGTGCGTGAAGAGGCTGGTGTACACCAACGATCAGGGAGAGATCGTCAAAGGAGTCTGCTCC

FIG. 2 continued

AACTTCCTCTGTGACCTGAAGCCTGGTTCGGACGTGAAGATCACGGGGCCAGTGGGGAAGGAGATGCTGATGCCCAAGG
ACCCCAACGCCACCATCATCATGCTGGGCACCGGCACCGGCATCGCGCCCTTCAGGTCCTTCCTGTGGAAGATGTTCTT
CGAGGAGCACGACGACTACAGGTTCAACGGCCTGGCGTGGCTCTTCCTCGGGGTGCCCACCAGCAGCACGCTGCTGTAC
AGGGAGGAGTTCGAGCGGATGAAGGAGATCGCGCCGGAGAGGTTCCGGCTGGACTTCGCGGTGAGCCGGGAGCAGACGA
ACGCGGCGGGGGAGAAGATGTACATCCAGACGCGGATGGCGGAGTACAAGGACGAGCTGTGGGAGCTGCTCAAGAAGGA
CAACACCTACGTCTACATGTGCGGCCTCAAGGGCATGGAGAAAGGCATCGACGACATCATGATCGACCTCGCTGCAAAA
GACGGCATCGACTGGCTTGACTACAAGAAGCAGCTGAAGAAGTCGGAGCAATGGAATGTGGAAGTCTACTGATGGATAT
ATATATATATATGTTAATAATTAATTAATCCCTTTTTATCTCGATGCATGCGCAACCTGCATACGCCATCTTGCTGTAC
TCGATCTGATGAGATGCATGTAAATATTATACTGACGATTCGT

> SEQ ID NO: 7296 57152 135695_300416_1b
CCCACGCGTCCGGGCCGCCGGCACGGCTGCGGCCGTCTCCACCTCCGCCGCTGCTGCAGTCACCAAGGCATCGCCGTCC
CCCGCCCACTGCTTCCTGCCATGCCCGCCAAGAACCAGAGCCGCCCACCAGCGCGGCCTGCTGCTGCGCGCGCAGGTGT
CCACCACCGACGCCGCCGCCGTCGCCGCCGCGCCGGCCAAGAAGGAGAAGATATCCAAGAAGCAGGACGAGGGCGTCGT
CACCAACAAGTACAGGCCCAAGGAGCCCTACGTCGGCAAGTGCCTCCTCAACACCAAGATCACCGCCGACGACGCGCCC
GGCGAGACATGGCACATGGTCTTCAGCACCGAGGGTGAGATCCCCTACAGAGAGGGGCAGTCCATCGGCGTCATCGCCG
ACGGCGTCGACAAGAACGGCAAGCCGCACAAGCTCAGGCTCTACTCCATCGCCAGCAGCGCTCTCGGCGACTTCGGCGA
CTCCAAGACCGTTTCACTCTGCGTCAAGAGGCTCGTTTACACCAACGACCAGGGAGAGATTGTCAAGGAGTCTGCTCC
AACTTCCTCTGTGACTTGAAGCCTGGTTCTGATGTCAAGATAACCGGACCAGTAGGCAAAGAAATGCTCATGC

> SEQ ID NO: 7297 57152 146360_301065_1b
CGGACGCGTGGGCGGACGCGGGGGTGGGGACTCTTTTGATGGGAAAACGGCCAGCTTGTGTATCAGGCGAGCTGTCTAC
TATGATCCTGAGACAGGAAAAGAAGACCCTTCCAAAAATGGTGTTTGCAGCAACTTTCTGTGCGACTCAAAGCCTGGTG
ACAAAGTGAAGATCACAGGTCCTTCTGGTAAGATAATGCTTCTACCAGAAGATAATCCAAATGCCACACACATCATGAT
AGGAACTGGAACTGGTGTGGCTCCCTTCCGAGGCTACCTTCGTCGTATGTTCATGGAATCGGTTCCAACTAAGTTTAAT
GGCCTTGCTTGGCTTTTCCTTGGGGTTGCAAACACTGACAGCCTTCTATATGACGATGAGTTCACCAAGTATCTCAATG
ACTACCCAGGCAATTTCAGATATGACCGTGCTCTTAGCCGTGAACAAAAGAACAATAAAGGGGGAAGATGTATGTCCA
GGATAAAATCGAGGAATACAGTGATGAGATCTTCAAACTACTGGATGAAGGGGCCCACATCTATTTCTGTGGGTTGAAG
GGGATGATGCCTGGAATCCAAGATACCCTGAACAGGGTTGCTGACG

> SEQ ID NO: 7298 57152 187360_300676_1b
TACAAGTTCAATGGTCTGGCTTGGCTCTTCTTGGGAGTCCCAACTAGCAGTTCTTTACTCTACAAGGAGGAGTTTGACA
AAATGAAGGCGAAAGCGCCAGAGAACTTCCGGGTCGATTATGCTGTGAGCAGGGAGCAGACCAATGCTCAAGGAGAGAA
GATGTACATTCAGACCAGGATGGCAGAGTACAAGGAAGAGCTGTGGGAGCTCCTGAAGAAGGACAACACCTATGTGTAC
ATGTGTGGACTGAAAGGCATGGAGAAGGGTATTGATGACATTATGGTGTCATTGGCTGCAAAAGATGGAATCGACTGGG
CTGATTACAAGAAGCAACTGAAGAAGGGCGAGCAATGGAACGTGGAAGTCTACTAATTCTTCCAATTTTCCTCACATCT
GTTTCTTTTTTTTCTTCCATTTGTATCTGTGTGCACATCTGTGCCTGTGATCACTCTATAATGTTAGATAGGCGTATAT
ATATATATACTCTTTGTCATGTTGGTTAAATTCAAGCTTCATATAAGAATTACTACTTATGTCTGATCCAAATACTACT
ATGGTCAAGTCAAGAGTAATAATAATAATAATGCAATGCAGTTCACTC

> SEQ ID NO: 7299 57152 227776_301026_1b
CCGCGGACGCGTGGGATGCTGGGCACCGGCACCGGCATCGCGCCCTTCAGGTCCTTCCTGTGGAAGATGTTCTTCGAGG
AGCACGACGACTACAAGTTCAACGGCCTGGCGTGGCTCTTCCTCGGGGTGCCCACCAGCAGCACGCTGCTGTACAGGAA
GGAGTTCGAGCGGATGAAGGAGATCGCGCCGGAGAGGTTCCGGCTGGACTTCGCGGTGAGCCGGGAGCAGACGAACGCG
GCGGGGGAGAAGATGTACATCCAGACGCGGATGGCGGAGTACAAGGACGAGCTGTGGGAGCTGCTCAAGAAGGACAACA
CCTACGTCTACATGTGCGGCCTCAAGGGCATGGAGAAAGGCATCGACGACATCATGATCGACCTCGCTGCAAAAGACGG
CATCGACTGGCTTGACTACAAGAAGCAGCTGAAGAAGTCGGAGCAATGGAATGTGGAAGTCTACTGATGGATATATATA
TGTTAATAATTAATTAATCCCTTTTTATCTCGATTTTCATGCATGCATGCGCAACCTGCATACGCCATCTTGTTGTACT
CGATCTGATCTCATCTGATGAGATGCATGTAGATATTATACTGACGATTCGTCGACTA

> SEQ ID NO: 7300 57165 256414_301672_1b
AGCGGCGGAGAAGGCGCTGCGGCGGCAGCGGCAGCGGTGGTGCGTGGAGCGCCGGATTTGTCGCGTGAATCGAGGTAGC
ACTACGCAATGAGTCGATCCAGTCGGACAATTTATGTCGGGAACCTTCCCGGTGATGTTCGGGAGCGCGAAATCGAGGA
CTTGTTTCACAAGTATGGACATATTGTAGACATCGACTTGAAGCTGCCACCGAGGCCTCCGGGGTACTGTTTCATCGAA
TTCGAGGACGCTCGAGATGCCGAGGACGCCATTCGGGTCGTGATGGCTACAACTTTGATGGATACCGTCTACGTGTTG
AAATTGCTCACGGTGGCCGCGGCCCTCCGTCCTCGGATCGATACAGTAGCCATGGTGGTCGGGGCGGAAGCGTTTCCAG
GCGTTCGGAATACAGAGTTATCATCACGGGCTTGCCTTCGTCGGCGTCTTGGCAGGACTTAAAGGACCATATGCGACGA
GCTGGCGATGTTTGCTTCGCCCAAGTTTTCCGAGAGGGAAACGGAACTACAGGCATTGTTGACTTCACCAATTATGACG

FIG. 2 continued

ACATGAAATATGCGATTAAAAAGCTTGACGATTCGGAATTCCGTAATCCATTCTCGCGATCGTTCATCCGCGTCAAGGA
AGACAGGTCTCAGGGATTCACACGAAACCTTTCGCGCATTGTCAGTCGAAGCCGGAGCAAAAGTCGTACCCGCACTTAC
AGCCGTAGCAAAATCCGCAGTCGAAGTCGGAGCCGTGGGCGATCTAAGAGTCCAGGATGCAGGTCCAAGTCATGCTCGA
AGTCGGATTCGAAGTCTCCTGTGGCTCGATCGACGTCTCGGTCGTACTCGCCGCGCTCACCGGGGTCTCCTGTTGTTAA
GGAATCAAGCCGAATGCCGACTCCCCGTCGCTCCCGCTCAGATTCTCCTGCGGC

> SEQ ID NO: 7301 57165 12054_300276_1b
AATTGCGGAGGCTGAGAGATCTCAAATCGACGACCAACAGGAAGAATGAGCAGTCGTTCGAGTAGAACCGTGTACGTCG
GAAACCTTCCTGGCGATATCCGTGAGAGAGAGGTCGAAGATTTGTTCAGTAAGTATGGACCTGTTGTTCAAATTGATTT
GAAGGTTCCTCCAAGGCCTCCTGGTTATGCATTCGTTGAGTTTGATGATGCTCGGGATGCTGAAGATGCTATTCATGGT
CGTGATGGCTATGACTTTGATGGGCATCGTTTGAGGGTGGAATTGGCGCAT

> SEQ ID NO: 7302 57194 1110673_301541_1b
TGCTTACAGGCGTTAGAAGAGAAGACGGAGAGAGAGAGAGAGAAGGGAAGTCCAGGCGTCTCTATCTTTCTTACTCTGC
CCTTCTCAGCATTCCCACTGCCATGTCCACCCCTGCACGGAAGCGCTTGATGCGTGACTTCAAGCGGCTTCACCATGAT
CCCCCTGCTGGCATAAGTGGTGCTCCTCAGGACAACAACATTATGCTTTGGAATGCTGTCATCTTTGGGCCGGATGACA
CACCATGGGATGGAGGTACGTTCAAGCTGACATTACAATTTTCTGAGGACTATCCAAATAAGCCTCCGACGGTCCGTTT
TGTGTCGAGGATGTTCCACCCAAACATTTATGCCGATGGAAGTATCTGCCTGGATATTCTGCAGAACCAATGGAGCCCA
ATCTATGATGTCGCAGCAATACTTACATCCATTCAGTCTTTGCTCTGCGATCCAAACCCGAACTCTCCGGCAAATTCCG
AAGCAGCACGAATGTATAGCGAAAACCGGCGAGACTACAACCGGAAAGTGCGCGAAATAGTGGAGCAAAGCTGGACGGC
TGAATGATGGATGAACTGTCTACCTCTAGTGATATACAAGTGTGTCGAAACAGTTGCATGAGGTTGAACTAATTCTCTC
CTTTTACAAGTTTGGCACTTTCGTAAAAATTCT

> SEQ ID NO: 7303 57194 1099839_301451_1b
TAAGAGTATCTGCGTTGAATTGAAGCGAAAGGACTTTAAGGAATGGCATCCTCTGCTCAGCTTCGATTGATGTCCGATC
TGAAGGCCATTAGCCATGAGCCACCTGAGGGATGCAGTGCCAGCCCTTATAGCGATGCGGACCTTTTTGTTTGGGACGC
CACAATATTTGGTCCCGAAGATACTCCATGGGAATGTGGCATTTTCTGCCTCCGTTTGGTCTTTGGAGAGCATTACCCT
GCCAAACCACCTCGTGTCAGGTTTACTTCCGAGATATTTCACCCCAATGTGTACAATGATGGCACCTTATGCATGGACA
TTATACAAGATGCTTGGTCTCCTTGCCACAACATCTGTACAATTCTAACATCTGTTCAGTCATTGCTAACAGATCCGAA
TCCCGCAAGCCCAGCTAACTCGGAAGCTGCACATTTATATCAAACTGATATTCAAGCATATAACAGGCGAGTTCGGCGT
TGTGTGAGGAAGTCTTTGGAAAGCACATAGTATACT

> SEQ ID NO: 7304 57194 107664_300380_1b
TGCGAACTCCAGGGGCACCTCCTCCAACACAAAGCAGGAGTTCAACGCAGAATCAAACCAAAACCCTAGCTCACCGCCT
TGTTTCCTCCGTATTGGTGGTTACAATGTCGACTCCGGCTAGAAAGAGGTTGATGAGAGATTTCAAGAGGTTGCAGCAG
GACCCTCCTGCTGGTATTAGTGGTGCACCTCAAGACAACAACATTATGCTTTGGAATGCCGTGATATTTGGTCCTGATG
ACACTCCTTGGGATGGTGGTACGTTCAAGCTGACTCTTCAATTCTCTGAGGATTACCCCAATAAGCCACCAACAGTGCG
GTTTGTTTCTCGCATGTTTCATCCTAACATTTATGCAGATGGAAGTATATGTTTGGATATTCTTCAAAATCAGTGGAGT
CCAATATATGATGTTGCAGCTATACTTACATCCATTCAGTCATTGCTGTGCGATCCCAACCCCAATTCACCTGCAAATT
CGGAAGCAGCTCGGATGTTCAGCGAGAATAAAAGGGATTACAACCGCAGAGTTAGAGAAGTTGTGGAGCAGAGCTGGAC
TGCAGACTGATTCTAAGGAAGAAAGATGTCATTGCTGACCGCAATTCGGGAGCACCAGGGTTCATCTATGTTACATTTA
CGGATTGAAACCTCTTCTTGGAAATTTTATTGGAACACATTTGTTTTGGCCCTAGTATTATGGCTTGGTGCTGTTTGCC
TTACCGTTTGCTGCATTGCATTGACAAGCTCCTGTAATATATGAATG

> SEQ ID NO: 7305 57194 103561_300363_1b
TGGTATCAACGCAGAGTGGCCATTACGGCCGGGGGTTACATAGGAATAAGTAATATATTTATTGTTTTCCCCTTCGTCC
AAACTATAGGCTCAAATACCTTATCCAAGCTCAGCAGATCTCCGTTTTCACCTAATTCAATCAATCGCCTCGCATCTTC
TAGGGCTTGGATTTGAAGGTATACGAGCTAATCTATGGCGTCGAAGCGTATATTGAAGGAGCTCAAGGATTTGCAGAAG
GATCCTCCGACATCATGCAGCGCTGGTCCAGTTGCTGAGGATATGTTCCACTGGCAAGCAACTATCATGGGTCCTACGG
ATAGCCCTTATGCAGGAGGCGTATTTTGGTTTCGATTCATTTCCTCCTGATTATCCTTTCAAGCCTCCAAAGGTTGC
ATTTAGAACTAAGGTTTTCCACCCCAACATCAATAGCAATGGAAGTATATGTTTGGATATTCTTAAAGAACAGTGGAGT
CCAGCTTTGACCATATCCAAGGTCTTGTTGTCCATCTGTTCTCTGTTGACTGATCCAAATCCAGACGATCCACTTGTAC
CAGAAATTGCTCATATGTACAAGACTGACAGGGCCAAGTACGAGGCCACTGCTCGTAGCTGGACACAGAAATATGCTAT
GGGATGATGCGGAAAGTGTCCTTGGACGTGCCTGAGACACTTTTAATTGCAACAGTTTCATTGTGCTTTCACCCTTAAG
TGCAATGTCTTTGTGCTTGGATGAAAGTAAAATATTG

> SEQ ID NO: 7306 57194 104611_300369_1b
TACTGTCAAATCAGATCTCTTCAATTTGCTAGGGTTTTGGTTTCTTCTCCCTCTCTGATGGCTTCGAAACGGATATTGA

FIG. 2 continued

AGGAGCTTAAGGATCTCCAGAAAGATCCTCCTACCTCTTGCAGTGCCGGCCCCGTTGGAGAGGACATGTTTCACTGGCA
AGCTACAATAATGGGCCCTCCAGATAGCCCCTACACCGGGGGTGTATTTTTAGTCACTATCCATTTTCCTCCTGATTAT
CCATTTAAACCTCCTAAGGTTGCTTTTAGGACAAAAGTTTTGCATCCAAATATTAATAGCAATGGTAGTATATGCTTGG
ACATATTGAAGGAGCAATGGAGCCCTGCCTTGACTATTTCTAAGGTTTTGCTTTCAATATGCTCACTTTTGACGGATCC
AAATCCTGATGACCCCTTGGTGCCTGAGATTGCTCATATGTACAAGACCGACAGGGCAAAATACGAAACAACTGCCCGG
AGTTGGACCCAGAAGTATGCCATGGGTTAAACCGTTACCTATGGCACTTGAATTTATGTAAAAAGAAAGATTGCATCTG
TCCTCTACTTTCCATACAAGAAGTGTAGAATAGCATTGAACAATGCCTGTGGAGGAATGCTGATGTGTTGAATTTGTTT
ATATATATACTAATATTTG

> SEQ ID NO: 7307 57194 105318_300373_1b
CAGTTTAAGAGAGAAATATAGGACTTCTTCCAACGTACTGGGGTACTATTATTGGCCCAAAATCCTCTTCCAGCTCTGC
AATCTCCGTCTCCGTCAATTTTCAGTCAACCGAAATCCACCATCTTTCATTGTTCATCACCTTCAGGTTAGGGTTTGGA
TTTGAAGGTACAAGGGGCTAATTGATGGCGTCGAAGAGGATATTGAAGGAGCTCAAGGATCTGCAGAAGGATCCTCCTA
CATCATGCAGTGCTGGTCCAGTGGCAGAGGATATGTTCCATTGGCAAGCAACTATCATGGGGCCTACAGATAGCCCTTA
TGCCGGAGGTGTATTTTTGGTTTCAATTCATTTCCCTCCGGATTATCCTTTCAAGCCTCCAAAGGTTGCCTTTAGAACT
AAGGTTTTCCACCCTAACATCAATAGCAATGGAAGTATTTGTCTGGATATTCTAAAAGAGCAGTGGAGTCCAGCGTTAA
CCATATCTAAGGTCCTGCTCTCCATCTGCTCCCTATTGACTGACCCAAATCCAGATGATCCACTTGTACCAGAAATTGC
CCACATGTATAAGACTGAAAGGTCTAAATACGAGACCACTGCTCGTAGCTGGACTCAGAAATATGCTATGGGATAATGG
CAAAGGTGTCACCAGGCATGTCTGAGACTTTGTAACTGCAATGTCTTATTGTGCTTGTAGTGAATGAATAAATTCGGCT
AAAGAACTTAGTTTACTTCTTAATCTCCCTTAAAGTGGGTTGTCAACAGACATTTCTTTTCAATTTGTGAATATCTATT
TGGTGACTATTAGTAAGGGAGACACTTCAGTGTAATTTTACTTCGTTTGCCAGTTT

> SEQ ID NO: 7308 57194 158243_200002_1b
TGTTTTTAGTGAGACAAAGAGTGTGAAACTCTCTTACAATTTCTACTTTCTCTCTCTAGAAAAAAAGAGACCCTTAGCG
TAAATTTTCTGCGATCAAAAAAAGAATTCGATTCAATTCAATGGCCAACAGCAATCTTCCTCGAAGAATTATTAAGGAA
ACTCAACGTCTTCTCAGTGAACCCGCGCCGGGAATAAGTGCGTCTCCTTCGGAAGAAAATATGCGATACTTCAATGTCA
TGATTCTTGGTCCAACACAATCTCCTTATGAAGGAGGTGTTTTCAAACTGGAACTCTTTTTGCCTGAAGAGTACCCAAT
GGCTGCTCCGAAGGTTCGATTTCTCACCAAAATATACCATCCCAACATTGATAAGCTTGGTAGGATATGCCTTGATATT
CTCAAGGACAAGTGGAGTCCTGCTCTTCAGATTCGCACCGTTCTTTTGAGCATTCAAGCACTTCTGAGTGCACCAAATC
CAGATGATCCACTCTCAGAGAACATTGCGAAGCATTGGAAGTCGAATGAGGCTGAAGCTGTTGAAACGGCTAAAGAATG
GACACGCCTGTATGCAACCGGTGCCTGAAACGGCATGACTAAGTGATTTTGAAAAGAAAAAGAAAAAGATGTGGAATG
TAATTTATCCACTGTCTAATCAGGGGACATGGGAGGACTGAAAGCTAAATTACCATCTATAATATTTTCCCTACCCTTG
AAATTGTATAGTCAAATATTGCACCTTTTATTCCAAGTTGAAGAAACTT

> SEQ ID NO: 7309 57194 156775_301369_1b
AAAATAAAACCCCCTTTTTCCCATTCCGATCAAATTGAATCAATTGATTTAAGGTTCTTCTGAGCTGTGAAGTGCTTGT
TCTGATTATAAAGGATTGAATAAGGATGCAGGCTTCAAGGGCAAGGCTTTTCAAAGAGTACAAAGAAGTACAGAGAGAG
AAATCTGCTGATCCAGATATTCAATTAGTTTGTGATGATTCTAATATCTTTAAATGGACGGCTCTTATTAAAGGGCCAT
CTGAAACTCCTTATGATGGCGGAGTTTTCCAGCTTGCTTTCTCAGTTCCGGAGCAGTATCCTTTGCAACCTCCTCAAGT
GCGGTTCCTGACCAAAATATTTCACCCAAATGTTCATTTTAAGACTGGAGAGATTTGCCTTGATATTTGAAGAATGCA
TGGAGCCCAGCATGGACACTCCAGTCTGTTTGTCGAGCTATAATTGCTTTGATGGCTCACCCCGAAGCTGATAGTCCAC
TAAACTGTGACTCAGGCAATCTTCTTCGATCTGGTGATATCAGAGGATATCAGTCAATGGCAAGGATGTACACTAGACT
TGCAGCAATGCCCAAGAAAGGCTAAAACAATGAGCTACAACCTCGTTCGCACAGCTTGTAATAATGGCATTAACAAAAG
TTGAATTGTTGCATATCCGTGTTTAGTGTTTCTAACAGCAGTGCATGACCTATTGTTTATTAATCCTTTTGTTTTTTC
GCATATTTCTGATACAGCTCATCTCATTTAGCAGGTTTCTTGTGTGCCTTTAGCAAGTGGAATATGTATAAA

> SEQ ID NO: 7310 57194 143665_200045_1b
CGGTAGTAGTAGTGGAGGAAGAACATGGCCGTCGACGACGTCGGTGTCTAGTTCCGGTAAGAGAATACAGAAGGAAATG
GCTGAACTAAGCATAGAGGCGCCACCAGATTGTGCAGCTGGGCCTAAAGGCGATAATCTTTACCATTGGGTTGCCACCC
TCTTCGGCCCACCTGGAACACCTTATGAGGGTGGAATATATTTGTCGATATAACCTTCCCTTCTGATTATCCATTTAA
ACCTCCAAAGGTTGTATTCAAAACTCGCATATATCATTGCAATGTCGAGCCTTCTGGAAATGTTAGCTTGGACATCCTA
ACAGATAACTGGAGTCCAGCATTAACAATCTCGAAAGTACTACTTGCTCTGAGATCAATGTTCACCACTCCAGAAACCT
ATAAGCCAGTTGTTCCTGGTATTGCACACTTATACTTTGAAGATAAAGCCAAACATGATGAAATAGCTACACAATGGAC
ACTGCGATTTGCAAGGTGAAAAAAATGAATTCAATGTGGAATTTTCTTAACCAAGTTCTGGTCAGCCCCTG

> SEQ ID NO: 7311 57194 14359_300244_1b
CCCACGCGTCCGACGAGAAGAAAAAGGCGAAAACCTCGCCAATCCGATTACGCGAAAAATCAAAGGTTTTTGGATATGG
CGTCGAAGCGGATCTTGAAGGAATTGAAGGATCTCCAGAAGGATCCACCTACATCATGTAGCGCAGGTCCTGTTGCTGA

FIG. 2 continued

AGACATGTTTCACTGGCAGGCAACGATAATGGGTCCTTCAGAGAGTCCTTATGCTGGAGGTGTTTTCCTTGTAACCATC
CATTTCCCTCCGGATTACCCATTCAAGCCTCCTAAGGTGGCCTTTAGGACCAAGGTGTTCCATCCCAACATTAACAGCA
ACGGTAGCATTTGCCTCGACATCTTG

> SEQ ID NO: 7312  57194 136820_300439_1b
CCCCCCGAACGGCTGCGCGTCTTCCCGTTCGTCCTCCTGTCCGGTCCGAGCCCCTCTGACGACGCGACTTTCCCCACGC
CGGGATCGAGCTCCGGGGAGGGGAGCTGCGAGCTGAAACACTTTGTCATATCAGTCAACAGTAGAGAGGAGACCAGATG
CAGGCATCTAGAGCTAGGCTCTTTAAGGAGTATAAGGAGGTGCAGCGAGAAAAGTCAGCTGATCCAGATATCCAGTTAA
TCTGCGATGATTCAAACATATTCAAGTGGACTGCTCTTATCAAGGGCCCTTCGGAGACACCTTTTGAAGGTGGTGTATT
TCAACTTGCATTCTCTATTCCTGAGCAATACCCTCTCCTTCCTCCGCAAGTTCGCTTCTTGACCAAAATTTTCCACCCG
AATGTGCATTTCAAGACAGGTGAGATTTGCCTGGATATCTTGAAGAATGCGTGGAGCCCAGCATGGACACTACAATCCG
TTTGTAGAGCCATAATTGCATTGATGGCCCATCCTGAACCAGACAGTCCACTTAACTGTGACTCAGGCAACCTCCTGCG
CTCAGGCGACATCAGAGGCTATCAATCCATGGCAAGAATGTATACTAGGTTGGCTGCCATGCCAA

> SEQ ID NO: 7313  57194 135317_300413_1b
GTCCTCGTCCTCGCGTAGGCGCGGCGGCCGAGGAACAAGTCCGTCACGCGAACCTTCCAGAACCCCCTCCTCACACGTC
ACGCAACCTCCTCCTCCTCCTCCTCCTCTTTATTACGACTACCCCCCCCCCCCGGCGCCCCCTCCTTTTTTCAGA
TTCGGAGAGACCTACTCGTCGTTAGACCGCCATGGCGTCCAAGCGGATCCTCAAGGAGCTCAAGGACCTGCAGAAGGAT
CCCCCAACCTCCTGCAGCGCCGGCCCTGTGGCTGAAGATATGTTCCACTGGCAGGCAACACTGATGGGTCCATCAGATA
GCCCTTATGCTGGAGGCGTGTTTTTGGTTACCATTCATTTTCCTCCAGATTATCCATTCAAACCGCCTAAGGGGGCATT
CAAGACAAAGGTGTTCCACCCAAACATTAATAGCAACGGAAGCATATGCCTTGATATCTTGAAGGAGCAGTGGAGTCCT
GCATTGACT

> SEQ ID NO: 7314  57194 128340_300475_1b
ATCGAGTAGGAGGATCTCTGAGGGATATGGCATCCAAGAGAATTCTGAAAGAGCTCAAGGATCTGCAGAAAGATCCTCC
CACCTCTTGTAGCGCTGGCCCAGTTGCTGAAGATATGTTTCACTGGCAAGCAACACTTATGGGTCCATCTGACAGTCCT
TATGCTGGCGGAGTGTTTCTTGTTACCATTCATTTTCCACCTGATTATCCATTTAAGCCTCCAAAGGTAGCTTTTAGGA
CAAAAGTTTTTCACCCAAACATCAACAGCAATGGTAGCATTTGCCTCGACATTTTGAAGGAACAGTGGAGCCCGGCACT
CACAATATCTAAGGTGTTGCTGTCCATCTGTTCTCTTCTAACAGACCCAAATCCTGATGATCCTTTGGTGCCTGAGATT
GCTCATATGTACAAGACTGATAAAAGCAAGTACGAAGCCACTGCTCGGAGCTGGACTCAAAAATATGCCATGGGTTAGT
TGCTGAAACACAAATATTTGGCTTTTATCTATGATGTATTAAGAAATTGTGTTATGCATAATTAACTCAAGGGAAAGGT
TGAATTGTGGCCCTCTGTAAAACACTTAATTTTCCTCATGTTTGTAAGATTAAATGGTTTTG

> SEQ ID NO: 7315  57194 127807_300473_1b
CCCCTTTTGGCTACCCTACAACCTTCTTGAGACCCCTTTAAATTCCTCACTTTCTCTCTCTAGAATCTCTCTCTTTTTC
TCTCTCTATCTCTCTCTGAAGTCGTATGGCTTCAGGTTCTCCTTCACAAGCCAGTCTTCTCCTTCAGAAACAACTCAAA
GATCTCAATAGAAACCCAGTTGATGGATTTTCAGCAGGTTTAGTTGATGAAAATAACTTATTTGAATGGAGTGTTACAA
TTATTGGCCCCCAAGATACTCTATATGAAGGGGGTTTCTTTAATGCTATCATGAGTTTTCCTCAAAATTATCCCAACAG
TCCTCCAACTGTGAGATTTACCACAGATATCTGGCATCCTAATGTTTACTCCGACGGAAAAGTTTGCATCTCAATTCTT
CACCCGCCCGGTGATGATCCAAATGGCTATGAGCTTGCCAGTGAACGTTGGTCTCCTGTCCACACGGTAGAGAGTATAG
TTTTAAGCATCATATCCATGCTTTCGAGCCCTAACGATGAGTCTCCTGCTAACGTTGAAGCTGCTAAGGAATGGAGGGA
AAAAAGAGATGAATTCAAGAAAAGGGTCAGTCGTTGTGTAAGACGGTCACAAGAAATGTAGTAAACATGCATGCCAACC
TGCATTTCTGCGATT

> SEQ ID NO: 7316  57194 126473_300463_1b
GCCATTACGGCCGGGAATCAAAATCTATCTCAACCCTTCTGTCTTCTTCTTCCCCTTCAGTTTCTCAAAAATTCTCAAG
AAGAAGAAGAAAGAAAGAAAAAAATCGTCTCCTTTTCTGTTCAAAAAAAATATATCTTGAAATTAAAAATTCAGATGGC
TACAATGAACAGTGGAAACAACAGCAATACTCAAGCAACTGCTCAGGTTATGCCTTCACCTAAACAGAGTTTGCCTACT
GCAAAAACTGTTGATACCCAGTCTGTTCTTAAAAGGTTGCAGTCTGAATTGATGGCTCTAATGATGAGCGGTGATTCTG
GGATATCTGCATTTCCTGAAGAAGACAACATATTTGTTTGGAAAGGGACAATAACTGGTAGCAAAGATACTGTTTTTGA
AGGAACAGAATACAAGCTCTCTCTTTCATTTCCTGCTGATTACCCTTTCAAACCACCAAAGGTTAAATTTGAGACTGGT
TGCTTTCATCCCAATGTTGATGTCTATGGCAACATATGCTTAGACATTCTTCAGGATAAGTGGTCATCTGCTTATGATG
TGAGGACTATACTGATTTCCATTCAGAGTCTGCTTGGAGAGCCAAACATAAGCTCACCTCTAAACACTCAAGCTGCTGC
TCTTTGGTGCAATCAAGAAGAATACAGAAAGATG

> SEQ ID NO: 7317  57194 125232_300629_1b
GGCGTCGATTCTCTTTGACACTCGTGCCGCTTCATCACTCAGGCGGTCAGGGATGTCGACGCCAGCGAGGAAAAGATTG
ATGAGGGATTTTAAGAGGTTACAGCAGGATCCTCCTGCCGGCATCAGTGGTGCTCCGTATGACAACAATATTATGCTCT

FIG. 2 continued

```
GGAATGCCGTTATATTCGGTCCTGATGACACACCTTGGGATGGAGGTACGTTCAAGCTCACCCTTCAGTTTACGGAGGA
CTACCCCAACAAGCCTCCAACTGTGCCGGTTTATTTCCAGGATGTTCCATCCAAATATTTACGCCGATGGAAGTATATGC
TTGGACATACTGCAAAATCAGTGGAGTCCTATATATGACGTAGCTGCTATACTTACTTCAATCCAGTCTTTGCTCTGTG
ATCCAAACCCAAACTCGCCAGCAAATTCAGAAGCAGCACGCATGTTTAGTGAGAATAAGCGCGAGTACAACAGGAAGGT
GCGTGAGATTGTTGAGCAGAGCTGGACAGCAGACTAACATCTCTCAGGCTGAATCTGTTTTGGGAGATTTTCCTGGTAC
CGCCTGTGTCGAGCTGAAAACTTTTCAGTGCCGTTGCTACATTAAAAACAAATGTAGCAGGAAATTGTACTTTTATGTG
TTGTAGGAAACTCTGATTGCCTTTATCTTCATGTTCTGCTACTCGACTATGAGACGTTGTACATATGATGATCTCTTGT

> SEQ ID NO: 7318  57194 124562_300423_1b
AGAAATCAAATCGACCCCTTACTCCTCTAAATCCCCACACCCATCTCTCTCTCTCTCTCTCCTCAATCGAAGGATCC
GACAATAAAAGTTGATTGTCTTCAACATCTGTCTACCAGCAAAAACTACTTGCGTGCAGTCGCCAACTGATCCTAGGAT
TATACTTACATTTGGCTATGGCAACTAATGAAAATCTCCCACCAAACGTGATAAAACAATTGGCAAAGGAATTGAAAAA
TCTTGATGAAACTCCTCCTGAAGGCATCAAAGTAGGTGTCAACGATGATGATTTTTCAACCATATATGCTGATATCGAG
GGGCCAGCTGGGACTCCTTACGAGAATGGGGTTTTCCGCATGAAGTTGATTTTGACGCATGATTTCCCTCATTCCCCAC
CTAAAGGTTATTTTCTGACCAAGATTTTTCATCCCAACATCGCTTCCATTGGCGAAATTTGTGTCAATGCTCTGAAAAA
AGATTGGAATCCTAGTTTGGGCCTACGACATGTTCTCATGGTGGTAAGGTGTTTGCTGATCGAGCCATTTCCAGAATCT
GCGTTAAATGAGCAAGCTGGTAAAATGCTGCTTGATAATTATGATGAGTATGCTAGACATGCAAGGCTTTATACCAGTA
TTCATGCTAAACCAAAGACTAAGTTAAAAACA

> SEQ ID NO: 7319  57194 121412_300357_1b
ATTTGATCGGAGGGTGAATATGTCGACGCCAGCAAGGAAGAGGTTGATGAGGGATTTCAAACGACTGATGCAGGATCCT
CCAGCTGGCATAAGTGGGGCCCCACAGGACAACAATATAATGCTTTGGAATGCTGTAATTTTTGGCCCTGATGATACTC
CTTGGGATGGAGGTACGTTCAAGCTGACACTTCAGTTTACTGAAGATTATCCTAACAAGCCACCTACAGTGCGATTTGT
TTCTCGGATGTTTCATCCTAACATTTATGCTGATGGGAGCATATGCTTAGATATACTACAAAACCAGTGGAGCCCCATA
TATGATGTAGCTGCTATACTCACATCCATCCAGTCGCTGCTTTGCGATCCAAACCCAAATTCACCTGCCAACTCTGAAG
CTGCCCGCCTATTCAGTGAGAACAAGCGGGAATACAACCGAAAAGTTCGTGAGATAGTGGAGCAGAGCTGGACCGCGGA
CTGATCCACTCCATCTAACCATATGATGCCTGATACTTAAAACGCTCATCTTTTCAGTGTGTCGTGTACCAAACTGCTT
GTAATTAAAATGCTAAAACAGTAAAACGTGC

> SEQ ID NO: 7320  57194 120926_300518_1b
CGGACGCGTGGGCGCAAACGGCGAAGCAGAAGGGGAAGAGAGAGAGAGAGAGAGAGAGAGAGAGGGGACTCAGCGA
GCGGTGGGCGAGAGGGGGAGATCGAAACCCTAGCTAGGGTTTGCGCGCGGCGGCGGCGGGGATGTCGACGCCGGCGAGG
AAGCGGCTGATGCGGGACTTCAAGCGGCTGCAGCAGGACCCGCCCGCGGGGATCAGCGGCGCGCCGCACGACAACAACA
TCATGCTCTGGAACGCCGTCATCTTCGGGCCGGATGATACGCCGTGGGACGGAGGCACGTTCAAGCTTACCTTGCAGTT
TACAGAAGATTATCCCAACAAGCCGCCGACTGTTCGGTTTGTTTCTAGGATGTTCCACCCAAATATTTATGCAGATGGA
AGCATCTGCTTGGATATTCTACAGAACCAGTGGAGCCCTATATGATGTTGCTGCCATATTGACTTCAATTCAGTCTT
TGCTGTGTGATCCAAACCCCAACTCTCCAGCAAACTCAGAAGCTGCCAGACTGTTTAGTGAGAACAAGCGAGAGTACAA
CCGCAAGGTTCGTGAGATCGTGGAGCAGAGCTGGACAGCTGACTAGGGCATGCAGCAGGGCAACGGGTGGTATCCACCA
TGCC

> SEQ ID NO: 7321  57194 1119652_301899_1b
GGCCTCTCTCTCTCTCTCTCTCCGTTTGAGAAGAACTGTGGTGGGTGGGGGGCCATAATAATAAGAAGAGGTATTAT
TATTATTATTATTATTAGTATTATAATGAGCTTGCAGAGAGGAGGGCAGGAGGGTAGCTTGGCTATGGCGGATGGA
AAGCACTCTGGTGCCCCCGTTGATACACATTCCGTCGCTCGTAGATTGCAGTCGGAGCTCATGGCATTGATGACCTGTG
GGGGGGACCCAGGTGTATCTGCTTTTCCTGACGGAGACAACATCTTCTCTTGGCTTGGAACCATCAAAGGAAGCACCGC
AACTGTCTATGAGGGTCTCTCGTTCAAGCTTTCTTTGCGCTTTCCAAATGAGTACCCTTTCAAGCCTCCCACTGTGAAA
TTCGATACCCCTTGCTTCCACCCCAACGTGATCAGTATGGCAACATTTGCCTTGACATCTTGCAGGATAAGTGGTCAT
CTGCTTATGACGTCCGCACCATTCTCTTGTCTATTCAAAGTCTACTTGGAGAGCCCAATAATGCTAGTCCATTGAACAG
TTATGCGGCAACTCTATGGTGCAATCAAGAAGAGTTCAAGAAGGCGATGCAAAAACATCACAAAGATGCTACTGGACTT
AC

> SEQ ID NO: 7322  57194 1118324_301855_1b
ACTCTTTCTTGGCTCTCTACAAATTGTCTTCTCTCTCTCTCTCTCTCTCGTTCCTTTCGTTTCTTTGCCTTCCCT
ATAACGGCGGTGGCTATTTAAGAACTCCAAGTAGCAGAAGTTATAGTTGAAGAGGGATCTGGATCTGAATCTGAATCTG
TGTCATGGCTAGCAAGAGGATTTTAAAGGAACTCAAGGATCTGCAAAGGGATCCCCCAACCTCATGTAGTGCTGGTCCT
ATTGCAAATGATATGTTCCATTGGCAAGCCACTATCATGGGTCCCTTTGATAGTCCATATGCTGGAGGAGTTTTTCTGG
TTACCATTCATTTCCCCCCAGACTACCCATTTAAGCCTCCTAAGGTGTCCTTCAAAACCAAAGTCTTCCATCCAAATGT
CAATAGTAATGGAAGCATTTGCCTTGACATCTTGAAGGAACAATGGAGTCCTGCTCTAACAATAGCAAAGGTCCTACTC
```

FIG. 2 continued

TCGATATGCTCTCTTTTGACTGATCCCAATCCTGATGACCCTCTCGTTCCAGAAATAGCCCACATGTATAAACAGACA
GGGCAAAGTACGAGACAACTGCAAGGAGTTGGACCTTGAAGTATGCTATGCCCTAAATAAAGCTCACCTCTTGCCTTGC
ATATAGTTGAGGTATATATATTATATATATACACACACGTTATTACATATGCA

> SEQ ID NO: 7323 57194 265904_200082_1b
AATCTCCAGTGCCTTTTAAGCCGGCGACGAACATAAGGCCGCCGCCTATCATTTAACCTCCCGTCGACGTCTATCATTC
AATTCTCGCCGCTTTTTGCTCGTAGGTCAACAATTCCGTATTTCTTATGCGGTGAGGATGTCGACACCGGCGAGGAAGA
GACTGATGAGGGATTTTAAGCGATTACAGCAGGATCCCCCGGCCGGCATCAGCGGAGCTCCGTGTGACAACAATATAAT
GCTATGGAATGCA

> SEQ ID NO: 7324 57194 35521_300098_-1b
CCCGGGACGACCCACGGGGGCGGGATATTGAAAGAATTGACGGATTTGCTAAGAGACCCTCCTGTTGGGGGACCAATCA
AAACCAGACCACAAGATATGTGCCACTGGCAAGCTACTATAATGGGTCCGAATGAAAGTCCTTACTCCGGAGGTGTCTT
CCTTGTCAATATTCATTTCCCTGCTGATTATCCTTTTACACCTCCCAAGGTTGTATTCACAACCAGAGTGTTTCACGCA
AACATCAACATTCTTGGAAACATATGTTTGGACATTCTCAAAGACCAATGGAGCCCTGCCCTTACCATTTCTAAGGTTT
GAAATTCTATATATGTATTTAGTTATTTGCATGTCGCCTGTTAAGGCTTCTTTGGACAGAGCTCCAGGTTTGTCAATCT
TGTCCCCAAGAACGAGAAGAGGGATACCATTAG

> SEQ ID NO: 7325 57194 38614_300097_1b
GGATAATAAAGAGGTGAAGTAATGTTTTTGTTTGAGATTAAAGAGGTTTCAAACAAAGAGATGATAAAACATAGGAATC
TAACTTATTTCATGGAAGATCCCTATGTGAAGAAGTCCTCTCTCTTTCTCTCTCTCTCTATTAAAACCGAGTCTGTG
AGGGATCAAAGGACACAAACTTTCATCCCATTGCATATTTCTGAGTCCAGCTTCTCGCAGTAGACTCATACTTTGCTCT
ATCGGTTTTGTACATGTGAGCAATCTCTGGAACCAATGATCATCTGGGTTTGGGTCCGTTAACAATGAACATATCGAA
AGCAAAACCTTCGATATGGTGAGTGCAGGACTCCATTGTTCTTTCAAAATGTCAAGGCAAATGCTTCCATTGCTGTTGA
CATTAGGGTGGAACACTTTTGTCCTGAATGCAACCTTTGGTGGTTTGAAAGGATAATCCGGAGGGAAGTGAATGGTTAC
GAGAAAGACACCGCCTGAATAAGGACTATCAAATGGACCCATTATTGG

> SEQ ID NO: 7326 57194 52729_300086_1b
TTTTAAATCGTAATACATATATACACAAAAGTGAATAATTGAGATGGTTTGGTACAAAGTTGTTTTTTTAAGGATGTTG
GGTTACATCAAAGCATGGAATCACTTAAATAGTTTTGGAAACACAAGACATGAATGAAAAGAGAAGAAAGCTGTTGCTG
AATCGTGATTGAGAGAAAGTAGAGAGAGCTACAACGCTTACAACAAACTACTACTAGTCAGCAGTCCAGCTTTGCTCAA
CAACATCACGCACTCTCCTGTTGTACTCGCGCCTTGCTTTCGCTGTACATCCGAGCAGCTTCCGAGTTTGCAGGAGAATT
CGGATTAGGGTCACAGAGCAAGGACTGGATGGAGGTAAGTATAGCAGCAACATCATAGATTGGACTCCACTGGTTTTGT
AGAATGTCCAAGCAGATACTCCCATCTGCATAAATATTAGGATGAAACATCCGTGACACAAACCGAACTGTTGGTGGTT
TATTGGGATAATCTTCAGAGAACTGC

> SEQ ID NO: 7327 57194 50942_300164_1b
CTTCTCTCTAATACGAGACAGAAAAAGGCGAAAACCTCGCCAATCCGATTACGCGAAAAATCAAAGGTTTTTGGATATG
GCGTCGAAGCGGATCTTGAAGGAATTGAAGGATCTCCAGAAGGATCCACCTACATCATGTAGCGCAGGTCCTGTTGCTG
AAGACATGTTTCACTGGCAGGCAACGATAATGGGTCCTTCAGAGAGTCCTTATGCTGGAGGTGTTTTCCTTGTAACCAT
CCATTTCCCTCCGGATTACCCATTCAAGCCTCCTAAGGTGGCCTTTAGGACCAAGGTGTTCCATCCCAACATTAACAGC
AACGGTAGCATTTGCCTCGACATCTTG

> SEQ ID NO: 7328 57194 4666_300310_1b
CGCTTTCACCACAAGAAGAAACAACAGAAGATGATCAGATTCTAGTTTTCACAAAGATGATGTTTTTTTGTTTCGTTTA
AAACAAGACCCACTTCATTTGGTCCTGTCTTCAGAAAGTTAAAAGGACACAAAGAGATGTCTATCGAATCATACATAGA
AATTAAGGCAGATTTTTTTCTTCATAAAGAGATAATTTAGTAGGTGGGATTTTCCATTTAGCCCATGGCATACTTCTGA
GTCCAGCTTCGTGCAGTGGACTCGTACTTGTTCTTGTCAGTCTTGTACATGTGAGCTATCTCGGGCACCAAAGGATCAT
CCGGGTTTGGATCGGTTAACAAAGAACAGATCGATAGCAGCACCTTGGAAATGGTGAGCGC

> SEQ ID NO: 7329 57194 37480_300389_1b
TTGAATGGAGATCAAATAATTTCTTACTGATCCTGTCTTCACAAATTTTATAAGACAGACAAGTCTATAAAGATCATT
ACATAGAAATAAGAAGAGTTTAATTATTAGGGCTCTTCCTTAAGGACAGTATTTGTGTCAGCCCATGGCATACTTTTGG
GTCCAGGTCCGAGCAGTGGACTCGTACTTGTTCTTGTCTGTCTTGTACATGTGAGCTATCTCAGGGACCAAAGGATCAT
CTGGGTTTGGATCCGTTAACAAAGAACAGATCGATAGCAGCACCTTGGAAATTGTGAGAGCAGGACTCCACTGCTCCTT
CAAGATGTCGAGGCAGATGCTTCCATTGCTGTTAATGTTTGGATGGAACACCTTCGTCCTAAAAGCCACCTTAGGAGGC
TTAAATGGGTAATCTGGAGGGAAATGGATGGTTACAAGAAAAACTCCTCCAGAATAAGGGCTATCCGATGGACCCATTA
TAGTGGCCTGCCAATGAAACATGTCTTCCGCAACGGGTCCTGCGCTACATGAAGTAGGAGGATCCTT

FIG. 2 continued

> SEQ ID NO: 7330 57194 2747_300098_-1b
CCCACGCGTCCGGGATATTGAAAGAATTGAAGGAGTTGCAAAGAGACCCTCCTGTATCATGCAGTGCAGGTCCAACAGG
AGAAGATATGTTCCACTGGCAAGCTACTATAATGGGTCCGAATGAAAGTCCTTACTCCGGAGGTGTTTTCCTTGTCAAT
ATTCATTTCCCTCCTGATTATCCTTTTAAACCTCCCAAGGTTGTATTCAGAACCAAAGTGTTTCACGCAAACATCAACA
GTAATGGAAACATATGTTTGGACATTCTCAAAGACCAATGGAGCCCTGCCCTTACCATTTCTAAGGTTTGAAATTCTAT
ATATGTATTTAGTTATTTGTCAATATTTTCTATAATTCCATATATCAGATTTGGTATATAACCAAGAAGCTCCAATAGG
TAACACAAATTACTAACATTTTGGTATTATAGGTGCTTCTCTCTATATGCTCTCTTCTAACAGATCCAAACCCTGACGA
CCCTCTGGTGCCAGAGATAGCTCACATATACAAAACTGACAAGACCAAATATGAAGCCATGGCTCGAAGCTGGACCCAG
AAGTATGCCTTGTTTTAAAGCTCACAATTCCTCTTTTTTTCCT

> SEQ ID NO: 7331 57194 175494_300542_1b
CCCCCACACCCTCCCCGACTCCTCGCAGGGTCCTCTTGTTTTTCTTGGCCGAACCCCCCCTCGACACGCCGTCGCCGCC
GAGGGGAGAGAGAGAGAGGCCGCCGGCCGCCGCTACCACTGACCCCCCCCCTCGCCGGAGCGCCCCGTCGCCGGGTTTG
ATCGATGGCGTCCAAGAGGATCCTGAAGGAGTTGAAGGACCTGCAGAAGGACCCTCCCACCTCATGCAGCGCAGGTCCT
GTGGGTGAGGACATGTTCCATTGGCAAGCTACTATTATGGGACCCTCAGACAGCCCATTTGCTGGTGGGGTATTCTTGG
CGAACATTCATTTCCCACCGGATTATCCTTTTAAACCACCGAAGGTCTCTTTCCGCACCAAGGTTTTCCACCCGAACAT
TAATAGCAATGGCA

> SEQ ID NO: 7332 57194 197269_300700_1b
CCCACGCGTCCGCCCACGCGTCCGCTCACCTGGCGCGCCGAAGCTTCTCTCCTCTCTCTCAACTCCGGCGAGAGGAGGA
GGCGGCGGTGGGGCGTTCGTCGGGAGAGAGACCAGGGCCGGGGGGCTAGGGTTCGGCCGTTCAGAGAGGCGGCGGCTGA
GGAGGAGGAGGAGGAGGAGGAGGGGGTGAGGCAGAGATGTCGACGCCGGCGAGGAAGCGGCTGATGCGGGACTTCAAGCG
GCTGCAGCAGGACCCGCCCGCCGGAATCAGCGGCGCGCCGCACGACAACAACATCATGCTCTGGAACGCCGTCATATTC
GGACCGGATGACACGCCGTGGGATGGAGGCACGTTCAAGCTGACACTACAATTTACAGAAGATTATCCCAACAAACCAC
CAGTTGTTCGGTTTGTCTCAAGGATGTTTCACCCAAATATTTATGCAGATGGAAGTATCTGCTTGGATATCCTACAAAA
TCAATGGAGCCCTATATATGATGTTGCTGCGATATTGACCTCTATCCAGTCCCTGCTCTGTGATCCAAACCCAAACTCC
CCTGCAAACTCCGAAGCAGCCAGACTGTTCAGCGAGAACAAGCG

> SEQ ID NO: 7333 57194 237695_301289_1b
GGGAACGCGGGAAGGGGCGGCAACGGCGATGGCGCTGGCGTCGGCGGCGGCCTTGTGACAGTCAACCACAGCATGCTCG
TTGCGGCTGCCGCCACTGCCACTACAGCGTCGATCGAATTCTTGTATTCCTGCAAGCTAGGGTGGGGCGAGAATGCTGT
CGTCGGCCCAGTTGCGGCTCATGTCCGACCTCAAGGCGATTCAACAGGAGCCGCCAGAGGGATGTAGTGCTAGTCCACA
AGGCGAAGAGAATCTCTTTGTGTGGGGAGCCACTGTGTTTGGGCCGGATGAAACACCATGGGAAGGGGCGATCTTGCCT
CTTCGTCTCACCTTTGGCGAGCACTACCCGGCGAAGCCACCGCGCGTGAGATTCACGTCCGAAGTGTTCCATCCAAATG
TCTACAGTGACGGCGCACTGTGCATGGATATCATCCAGGATGCATGGTCTCCTTGCCACAACGTCAGCACCATTCTCAC
CTCGATTCAGTCTCTCCTGACTGATCCAAATCCAGCGAGTCCAGCGAATCCCGAAGCCGCGCATATGTATCAAAACGAT
CTCCAAGCATACAACAGGAGAGTGCGCCAGTGTGTGAGGAAGTCCCTAGATATATAAAACTCCAAAGTTTTATTTATCT
ATCTATCATAGTGATTATCTA

> SEQ ID NO: 7334 57194 233923_301095_1b
GCGAGAGAGAGCAGGAAGGCGATCGATCAGCTCCCGGCGGCGCTGTCGGAATCCGGATCTTGGAGCCGCTGCCATGGCC
AGTACCATCGCCAACAGCAATCTCCCGCGGCGGATCATCAAGGAAACGCAGCGATTACTGACCGAGCCAGCCGAAGGCA
TCAAAGCTTCGCCTGCCGAAGATAATTTGCGATACTTCAATGTGATGATCCTTGGCCCCGCACAGTCACCCTATGAAGG
TGGTGCTTTTAAACTGGAGCTTTTTCTTCCGGAAGAATATCCAATGGCTGCTCCAAAGAACTGCAATAGGTTCGCTTCT
TGACGAAAATTTACCATCCAAACATCGACAAGCTGGGCCGGATTTGCTTAGACATTCTAAAAGACAAATGGAGTCCTGC
TCTCCAGATTCGAACAGTGCTTTTGAGTATTCAAGCTCTTTTGAGTGCTCCCAATCCTGAGGATCCCCTGGACGAGAAC
ATCGCGAAGCACTGGAAGACAGACCAAGGAGGAGCCATCGCGACTGCAAGAGAGTGGACTCAACTCTACGCGACCCATA
ATTAAATCAAAATGCGGACCATTCGTCATCTTGGTTCGTTTAGTTTTTTCTGCTTTGGTCATATTTGT

> SEQ ID NO: 7335 57194 258580_301697_1b
GAAACCACCGTCCACCCTACCCACCCTCCGCAGACCTCTTCTCTTGCGCCGCGACCCAAAGAACAAGAGGATAGCTGAA
GAACCCGAAAAGAATGCAGATGGAAGCCCAGAATGCCGACCCCTTTGCTGAAAACCCCGCCAAGCTGCAAATGTCGGGA
TCCAACTCAAACGACGGCCACTCGGTCACCAAGCGCCTGCAAAACGAGCTGATGCAACTCATGATGTCCGACACGCCCG
GAATCTCGGCGTTCCCCGTGTCCGACGCAGATCTGCTCAACTGGACCGGCACCCTGACCGGCCCGGAGGGAACGGTCTA
CGAGGACCTGACGTTCAAAATCTCGCTGGCCTTCCCCCAAAACTACCCCTACACCGCACCCACAATCAAGTTCATCAGC
CCCATGTGGCATCCCAACGTGGACATGTCCGGCAACATCTGCCTGGACATTCTCAAGGAAAGTGGTCTGCCGTGTACA
ACGTGCAGACAATTCTCTTGTCCCTGCAGTCGCTGTTTGGCGAGCCCAACAACAAGTCGCCTCTCAACGCCCAGGCCGC

FIG. 2 continued

CCAGCTGTGGGACACGGACATGGATGAGTACAAGCGGCTGCTGATGCAGCGGTACGAGGCCCCTGACGATGA

> SEQ ID NO: 7336 57194 255882_301645_1b
ACGCGTCGGAGACCACCCCATTCTCTCTCTCTCTCTCTCTCTACCCTGTTTTCTCCCGCCCTGTGGTTTTAACACCC
CTCGAAGGCTGGTCTTTAGCCTGTGTGTGTGTGTGTGTCTCCCTCCTCTCCTTTTTCTGTTTTGCAGCGAGTTCGAA
TTGAGGAGCAGCAAGTTCGAATTGCTTAGATGGCGTCCAAGCGGATCCTGAAGGAGCTCAAGGATCTGCAGAGGGACCC
CCCCACCTCTTGCAGCGCTGGACCTGTAGCAGAGGACATGTTCTACTGGCAGGCTACAATAATGGGCCCTGACGACAGC
CCTTATGCTGGAGGTGTCTTCCTGGTGACCATTCATTTCCCCCCGGATTACCCATTCAAACCCCCAAAGGTTGCTTTTA
GGACTAAAGGTTTTCCANCCCAAACGTCAACAGCAATGGAAGTATCTGCTTGGACATCTTGAAAGAACAATGGAGTCCT
GCATTAACCATTTCACAGGTTCTGCTCTCAATTCGCTCATTGTTGACCGACCCAAACCCAGATGACCCCTAGTTCCAG
AAATTGCTCACATGTATAAAGCGGAACAGGGCGAAATATGAAGCCACTGCAAGGAGCTGGACTCAAAAATATGCCATGG
GCTAATGCTACCCCTTATATATATATAAGGCGATGGGTGGTGAGTCTGTTTCCACATCTT

> SEQ ID NO: 7337 57194 253305_301625_1b
AACCAAAAATACCATACACCATGTCGGGCAAGCGACCATCTGTGGCCCAGAAGCGGCTCATGAAGGAGTACAAGCAGTT
CATTAGTGATCCTCCCCAGGGAATCAGTGCAGGTCCTGCTGACGAAGATAACTTTCTACTCTGGGAATGTCTGATACAG
GGACCAGATGATACTCCGTACGAGGGTGGCCTGTTCCCCGCAACACTCAAATTCCCCCAGGATTACCCCCTGTCCCCTC
CAGTGATGAAGTTCACCTGCGAAATGTACCACCCCAACATTTACAAGGACGGAACCGTGTGTATTTCCATTTTGCATGC
TCCTGGTGACGATCCCAACATGTATGAGAGCGCTTCGGAACGGTGGTCGCCCATCCAGTCGGTAGACAAGATTCTGCTG
TCGGTGATGAGCATGCTAGCCGAGCCCAACGACGAGTCAGGGGCCAACATTGACGCCAGCAAAATGTGGCGA

> SEQ ID NO: 7338 57194 248560_301584_1b
GGACAGTATGTCTACTCCATCCAGGAAGCGCTTGATGCGAGATTTCAAGCGCCTCCAGCATGATCCACCCGCCGGGATC
AGCGGCGCGCCGCAGGACAACAACATCATGCTGTGGAATGCGGTGATTTTCGGGTAAGAGAGGCCGCTTCTAGGGTTTA
GAGTTTCTAAAGGACTTTTTTCGTGGTTTGCTGCAGGCCTGACGATACTCCCTGGGATGGAGGGACATTCAAGCTGACA
TTGCAGTTTACGGAGGACTACCCCAACAAACCTCCCACTGTGAGATTTGTTTCAAAGATGTTCCATCCCAATATTTATG
CTGACGGAAGTATTTGCCTCGACATCCTGCAAAATCAATGGAGTCCAATCTACGATGTCGCGGCCATTCTTACTTCCAT
ACAGTCATTGCTTTGTGATCCTAACCCGAACTCGCCGGCCAACTCCGAGGCAGCTCGGATGTACAGCGAAAACCGCCGA
GAGTACAACAGGAGAGTTCGCGACATAGTCGAGCAGAGTTGGACGGCGGAGTAGCTCCCCTTGGTTCAAGAGCTTGTAA
GAGTGGCCATCACAGAGAGATGTGTGCTGCTCCGAGCACACATAAAGAATCTTGTCAAAAAACAATCCGGAAAGCTGTC
GCCTCTACAGACCAGCGTTGAAGGTCGACCATCGAACTCGTTTGCTTCTGTTGGAACCAGGGCCAGTGTTCTGGTACTC
ACCATAGAACAGGGTGCTGAGAGCGAAGTCCCCGTTCCATTCCAACCATCCACGGGGTTGAATTATGTCACTGATGAAC
GACTTCATGAACACCGTCCGCGAGTAGAGCTTCCACGGCCTTCCGAGTTTATGAAAGACAGCCCCGTGTTCTGTCGCTT
ATCGACG

> SEQ ID NO: 7339 57194 244825_301562_1b
CGCGATTGTAGATGCTATAGATCCAGGTCGCCTCGTCGTCGTCCCGTGGCGCCGCTGTAGATAGGGTTTGATTCATCGC
GCAGCAGCGGCAGCGGCGATGTCTACGCCGGCGAGGAAGCGGCTGATGCGGGATTTCAAGCGGCTGCAGCACGATCCAC
CGGCGGGCATCAGCGGCGCTCCACAGGACAACAACATCATGCTGTGGAATGCGGTCATCTTTGGGCCGGATGATACGCC
ATGGGATGGAGGAACATTCAAGCTCACCTTGCAGTTCACAGAGGATTATCCAAACAAGCCACCAAATGTGCGGTTTGTT
TCGAAGATGTTCCATCCCAATATTTATGCGGACGGAAGCATTTGCCTGGACATTCTCCAAAACCAGTGGAGCCCGATCT
ACGATGTTGCTGCAATATTGACATCGATCCAGTCTCTACTATGCGATCCAAACCCGAACTCTCCTGCTAATTCCGAAGC
CGCACGGATGTACAACGAGAACAGGCGAGAGTACAACAAGAAAGTTCGCCAAGTCGTGGAGCAGAGCTGGACAGCGAAC
GACTGAAACCGAGAGTTCTGCTCGGCTGCTCGACATGCTGGTACGCGATTTTCTGGCGATCACGGACGGAATTCTACTA
ACCAGCAGGAGCACTGTATATCCTCTGTACTCGGATTTTTTTTCTTAGGTGATGTGGTTGCAACTAAGAAAGT

> SEQ ID NO: 7340 57194 239823_301308_1b
GGAAATATTTGCTACAGGGTAGATGCTTCCCCATTTTTAGGTCTAAAGCTTCTTTCTCCTCCCTCGATTCGATTCGATC
CATCGGCGGCGGCGGCGATGAACATGAACGGCGGCGTCGATCGCGCAGCAGCAAGCGACGAACAATCCGGCGGG
TAGCAAGCAGAGCAAACCCAATTTGCAGCCGGTGGACAGCCATTCCGTCGCCCGGAGGTTGCAGTCGGAGCTCATGCC
TTGATGACTTGCGGGGACCCGGGAATCTCAGCGTTCCCAGACGGCGACAACATCTTTACGTGGATTGGAACCATCAAAG
GGAGCGACGCGACGGTGTACGAAGGTCTCTCCTTCAAGCTCTCGTTGCGCTTCCCGACCGACTATCCATTCAAGCCGCC
ACTGGTCAAGTTTGAGACGTCGTGTTTCCATCCCAATGTCGATCAGCATGGCAACATTTGCCTCGACATCTTGCAGGAT
AAATGGTCCTCGGCCTACGATGTTAGAACCGTGTTGCTGTCCATCCAAAGCTTGCTAGGAGAACCAAACAACGATAGTC
CTCTCAACAGCTATGCGGCAGCATTGTGGCCAAACCAAGAAGAGTACAAGAAAGTGATGAACAGGCAGTGCCGCGACGG
ATCTGGTCGATGAGAAAGGGTCGATCGACAAGAGAG

> SEQ ID NO: 7341 57194 239592_301305_1b

FIG. 2 continued

ATAGGGCGCCGCATCGACTCGCCGCCTACGCCGCCGCTATGGCCGTGACCCTGGGTTTGTAGGGATTTTCCATCCAGAT
TTCGAGGAGATCGCTGCGCGTTTCTCGTTCATGGCTGAGAACTTACCCCCAAAGGTGATTCGAGCGCTTGCAAAGGAGC
TCAAGAGCTTGGACGAGAGCCCTCCAGAGGACATTCGCGTTCATGTAAATGACGACAACTTCTCGAGCATTTTCGCGGA
CATTGAGGGACCACCCGGAACACCGTACGAAAGTGGCGTCTTCCGGATCAGGCTTTTGCTTAGTCCCGATTTCCCGCAA
ACGCCACCGAAAGGTTATTTCGTCACCAAGATCTTCCATCCAAACATCGCAAAGAATGGAGAGATTTGCGTGAACGTTT
TGAAGAAGGATTGGAAGCCGACGCTCGGCCTGAGGCATGTTCTTCTTGTCGTACGGTGCTTGCTCATAGAGCCGTTTCC
AGAATCGGCACTTAACGAGGACGCTGGAAAGATGTTGATGGAGGATTACGATGGATACGCAAAGCACGCCAGATTGATG
ACAAACATCCACGCGATGAAGCCAAAGCCAAAGACCACGAAAGTCGCCATA

> SEQ ID NO: 7342 57194 230618_301070_1b
TACTCCATCCAGGAAGCGCTTGATGCGAGATTTCAAGCGCCTCCAGCATGATCCACCCGCCGGGATCAGCGGCGCGCCG
CAGGACAACAACATCATGCTGTGGAATGCGGTGATTTTCGGGCCTGACGATACTCCCTGGGATGGAGGGACGTTCAAGC
TGACATTGCAGTTTACGGAGGACTACCCCAACAAACCTCCCACTGTGAGATTTGTTTCAAAGATGTTCCACCCCAATAT
TTATGCTGACGGAAGTATTTGCCTTGACATCCTGCAAAATCAATGGAGTCCAATCTACGATGTCGCGGCCATTCTTACT
TCCATACAGTCATTGCTTTGTGATCCTAACCCGAACTCGCCGGCCAACTCGAGGCAGCTCGGATGTACAGCGAAAACC
GCCGAGAGTACAACAGGAGAGTTCGCGACATAGTGGAGCAGAGTTGGACGGCGGAGTAGCTCCCCTTGGATTTGTGGGT
AAGACAGCATTTATGGGTGATCTTTTGCAATATATATGTTGCATTGGTTAGATCACAGCACTGGCTTCTTGAGTATGTA
TATG

> SEQ ID NO: 7343 57194 211510_300900_1b
GCTTTTATCACTTTTGAGAACCACTCATTCATCCATCTCCGCAAGATCGTCTGTTTTTGTTTACAATGGATTATACCGA
GGATAACCAGAATTCTGCTCCTGGCAGCGTCCAGGCTTCCAAGCTCAATGCCGCTCGCAAGGGTCCCGATTCGCAGAGC
GTCACTAAACGACTCCAGACCGAGCTGATGACTCTCATGACATCTCCAGCACCCGGTATCTCCGCATTCCCCTCTGCCG
ACGGCAACCTTATGTCGTGGACCGCCACCATCGAGGGCCCCGAGGATACACCTTATTCCGGACTCACGTTCAAGCTGAG
CTTCGCGTTTCCTTCAAACTATCCTTATGCCGCGCCGACGGTCCTCTTCAAGACGCCCATCTACCACCCCAACGTCGAC
TTCTCTGGCCGCATCTGCCTTGACATTCTCAAGGACAAGTGGACAGCCGCCTACAACATTCAGACCGTTCTGCTGAGTC
TGCAGAGCTTACTCGGCGAGCCCAATAACGCATCTCCATTAAACGGCGAGGCAGCAGAGTTGTGGGACAAGGATATGGA
AGAGTTCAAGAAGAAGGTGTTGGGACGCCATCGCGACATCGAGGAGGAGTAATGGGATTCATAGCGTGCAGATTTTTAT
GATTTTACGTTTACGGGTATTTGGAGTCTTTGGGGCACGAATCGGTCGTTTTTGAAAGGGTATTTGGGTGTATTTTGCA
TTTCCACAGCCAGAGCTGGGAAAGGAGGGCTACCTGCCCCTTCCACAAGCGCA

> SEQ ID NO: 7344 57194 179640_300562_1b
AACAATCCCCAGCCTCACCAAAAAGGACACAAAATAACGACATTCACTCTCTCTCTCTCTCTCTTCCTCTTTTCTCC
ATTCTCTCGCGGGGTCATCCGCCCACCATCGCCCAATCCACCGCCCACCGCCGCCTCCTTCAAGAATACCGCGCCCTCA
CAAACAACCCGCCCGAAGGCATCACCGCCGGCCCCGTCTCCGAGGACGACCTGCTGCACTGGGAATGCCTCATCCAGGG
GCCTGAGGGAACTCCCTTTGAGGGCGGCGTCTTTCCCGCAGAGCTCAAGTTTCCCAAGGACTATCCGCTGGCGCCGCCG
ACGATGAAGTTTCTCGCTGACATGTGGCATCCGAACGTCTACCCCAGCGGCCTCGTCTGCATCTCCATCCTCCACCCTC
CCGGCGACGACCCCAACCACTACGAGCACGCCTCCGAGCGCTGGTCCCCCATCCAGTCCGTCGAAAAGATCCTCATCTC
TGTTATGAGCATGCTAGCTGAGCCCAACGACGAGAGCCCCGCCAACGTCGAGGCCGCCAAGATGTGGCGCGAGCGTCGG
GATGAGTACGAAAAGACGGTCCGCGACGGTGTTCGGCGCATGTTGGGTTTGTAACAGCGCATGTTGGGTTTG

> SEQ ID NO: 7345 57292 263339_301724_1b
GCAGCATGTCGTGGAAAAATCGAGATAAAGAGGATCGAGAATGCGAATAGCAGACAAGTCACTTTTTCCAAGAGGCGTT
CTGGGTTACTTAAGAAAGCTCGTGAGCTCTCTGTTCTTTGTGATGCTGAAGTTGCTGTCATCGTCTTCTCTAAGTCTGG
CAAGCTCTTCGAGTACTCCAGTACTGGAATGAAGCAAACACTTTCCAGATACGGTAATCACCAGAGTTCTTCAGCTTCT
AAAGCAGAGGAGGATTGTGCAGAGGTGGATATTTTAAAGGATCAACTTTCAAAGCTTCAAGAGAAACATTTACAACTGC
AGGGCAAGGGCTTGAATCCTCTGACCTTTAAAGAGCTGCAAAGCCTTGAGCAGCAACTATATCATGCATTGATTACTGT
CAGAGAGCGAAAGGAACGATTGCTGACTAACCAACTTGAAGAATCACGCCTCAAGGAACAACGAGCAGAGTTGGAAAAC
GAGACCTTGCGTAGACAGGTTCAAGAACTGAGGAGCTTTCTCCCGTCGTTCACCCACTATGTTCCATCCTACATCAAAT
GCTTTGCTATAGATCCAAAGAACGCTCTCATAAACCACGACAGTAAA

> SEQ ID NO: 7346 57292 137087_300441_1b
CCCCGGTGGAGATTTTTGACGTCGTGAATAGATCGGATTAATTGGTAGCGATCGTCGGCGGCGAGGGATAAGGATGGGG
AGGGTGAAGCTGCCGATCAAGAGGATCGAGAACACGACGAACAGGCAGGTGACGTTCTCGAAGCGGCGGAACGGGCTGA
TCAAGAAGGCGTACGAGCTGTCCGTGCTCTGCGACATCGACGTCGCCCTCCTCATGTTCTCCCCCTCCGGCCGCCTCAG
CCACTTCTCCGGCCGCCGCGGGGTAGAGGACGTGATTCTCCGGTACATGAACCTCTCGGAGCACGAGCAGGGGAGAAGCC
ATCCAGAATCGGGAGTATCTCATCAGCATGCTTCAGCGGCTCAAGCGAGAGAGCGACATGGCGACACAATTAGCAAACC
CAGGTGCCCTGAATGAGAAAATAGAGGAGATTCAGCAAGAGATATATTCTTCCCAGCAACAGCTGCAAATCACCGAGGA

FIG. 2 continued

CCGCCTTAGGATGTTCGAGCCAGATCCTGCGGCGTTCGGCACATCCAGCGAGGTCGACGGATGCGAGAAGTATCTCATG
GAATTGCTGACCCGAGTCGTCGAAAGGAAGAACAACTTGTTGAGCAGTCACATGGCGCCGTTCGATGC

> SEQ ID NO: 7347 57506 1110734_301540_1b
TCGACCCACGCGTCCGTATCTTGAAAAAGGAAAGAGGAGAGAGAGTGATGGACTTTCAAAGCTAGTTATCACCTAAT
GCATAACAAAGAATAATCAAAGCAGAATGGTGTCGGCGTTGAACCTGAGCATCTCCATGGCCGGATTCGGCATCCTGTT
GGTGTTGGTAATTGGAAGCCGTTTGCTTCTCTCTTGGTTGCGGCGTAGGGATAATTCCGGAAGCCAGGCCGAGCAAAGC
ACTGATGCGAATTTGGTAAAACGGAACATCCATGGCCTAGAACCTACAGTAGTGGCTTCTTTTCCAACCATATTATACA
AATCACAACAAGTTTTTACATTTCCAAAGGAAAACCATCTGTGCTCGGTGTGTCTAGGAGACTATAAGGAGAAAGAGAT
ACTTCGAGTGTTACCACATTGCGGACATTCCTTCCACATTACCTGCATTGATGCATGGCTTCGTCAACACTCCACCTGC
CCCATCTGCCGCATCTCATTGCGCTCTCTTCTTCCTGACATTCAACGGGACCCTCCACTCCAAGATGTCATCACCTTGT
AGTACCACAGAACTTCGAAAAATNTGGAGACGACTACTTTGGGTACATGTCAAGGTTTGATGCATCAATGACACGAGAA
AACCGAAAACTCAAGTGCTAAACCCGAACCATATCCTCCTT

> SEQ ID NO: 7348 57702 251823_301661_1b
GGGGCGACGCCGAAGCTCCAATGGCATTCAGTGGCGGCGCGAGAGATTGATCGATCGTAGTGGAGATGACCGACCTGGT
GAGCATACAGGCGGGGGAGCTGATATTTCCATTCGAGCTCAATAAGCAAATCTCGTGTTCCTTGAGGCTCGTCAACAAC
ACGGATGAAGCCATAGCTTTCAAAGTAAAGACTACTTCGCCGAATAACTACTGTGTGCGCCCCAACACGGGCATTATCT
CGCCGCAAGGATGCACGGATGTCACAGTGACAATGCAAGCACAGAACGAAGCGCCGCTCGACATGCAATGCAAGGATAA
GTTCTTGGTGCAAACGCTCGTGGTTTCGACAGAGACAACCAGAGACGTTACTG

> SEQ ID NO: 7349 57702 271458_200034_1b
TTTCTCTTTACCTCGAGATCCTCGCCACTAAACAACTTCCCAATCCCACCTCCGTTGCCGGAAACCGTCCAAATCCGTC
CTTAAAATAGAATCTCCGGCTGATACCTAAAATATTATATAGAGAAGATCGCTGTCGAAATGAGTAACGGAGAGCTACT
TCAAATCGAACCTATTGAGCTTCAGTTTCCCTTCGAATTGAAGAAGCAGATCTCATGCTCATTGCAATTGACCAACAAA
TCCGATAACTATGTTGCCTTCAAGGTGAAGACGACGAATCCAAAGAAGTACTGTGTAAGGCCTAACACTGGAATTGTGA
TGCCTCACTCTACCTGTGATGTCACAGTTACAATGCAAGCACAAAAGAGGCACCACCAGACATGCAATGCAAGGATAA
GTTCCTGCTTCAAAGTGTCGTGGCAGGCCCTGGAACTACGCCCAAGGATATTACTCCAGAAATGTTCAACAAGGAGTCA
GGGAATCATGTTGACGAGTGCAAGTTGAGAGTGGCTTATGTTCCACCTCAACCACCATCACCTGTGCGGGAAGGGTCTG
AG

> SEQ ID NO: 7350 57702 155486_301356_1b
CCAAAGTCTGTAATCACTAAAGCAAAGAACAAAGAAATCAAATTTCCTTTTTCTGATTCACTTTCTGAACCAAAAAAAA
GAAGAAAAACGAAAAAGAGAACTGAAAATGAGCAGTGCAGAACAAGAACTTCTCAACATCGATCCTCTTGAGCTCAAA
TTCCCATTTGAGCTGAAGAAACAGATATCTTGTTCCCTTCAATTATCAAATAAAACTGAAAATCATGTTGCTTTTAAGG
TCAAAACTACCAACCCCAAAAAATATTGTGTTCGTCCAAACACTGGCATTGTTTTGCCAAGATCCACTTGTGATGTCAT
TGTTACAATGCAAGCGCAGAAGGAGGCACCGGCTGACATGCAATGCAAGGACAAGTTTCTACTTCAGAGTGTGGTTGCA
ACTGCCGGTACCTCTCCAAAAGACATCACCCAAGAAATGTTCAATAAGGAGCCTGGACGCGTTGTGGAAGAGTGCAAAT
TGAAAGTGATTTATCTTCCCCCACCGCCACCATCTCCCGTTGCGAAGGATCAGAAGAAGGTTCTTCGCCAGGACA
GTCCTTGACAGAGAATGACAGTCAAAATGGTTCTGAGCTGACAAGAACATTCCTTGAAACTCATGACAAATCTTCAGAG
GTGAAATCAGTTATTTATAGACTGACGGAGGAGAAAGCTGCTTTTGTACATCACAGCAACAGACTTCGTCAAGAATTGG
AACTTCTG

> SEQ ID NO: 7351 57708 53221_300395_1b
CCCACGCGTCCGTCTCAGAATCCCTAGAACACACTCTGATTAACGAATCAAAGATCGATTTGGGATTGTGATCGATCGA
GGAAGAAGATGACGGAGGCGATGATAAGGAAGAAGCCAGGAATGGCGAGTGTGAAGGATATGCCGTTGCTTCAGGATGG
TCCACCACCGGGTGGATTCGCACCGGTCCGATATGCTCGCCGGATCTCCAACACGGGTCCAAGCGCCATGGCTATTTTC
CTTACCGTTTCAGGTGCTTTTGCTTGGGGGATGTACCAAGTCGGTCAGGGCAACAAAATCCGCAGGGCGTTGAAGGAAG
AGAAATACGCTGCTCGTAGAGCGATTCTACCAATTCTTCAAGCTGAAGAAGATGAAAGGTTTGTGTCTGAGTGGAAGAA
GTATCTAGAATACGAGGCGGATGTGATGAAGGATGTTCCTGGATGGAAAGTCGGTGAAAACGTGTACAATTCTGGTCGT
TGGATGCCTCCAGCTACTGGAGAGCTTCGTCCTGATGTCTGGTAAATTATCAATGGCTCCTTTTGATGATGATGAATGA
ATGTTTGTTTAAGCATTTTAGAACCTTGATGTTTCTTGTCTCTCTTTTTCCATCGTATAATAAGAGAATTGATACATAC
ACAGTTCATGTATTGCTGGTACGGTACTGAGGAACATTTTCTGTTTTTTTCCCTCAAAAAAAAAA

> SEQ ID NO: 7352 57708 56457_300139_1b
CTGCTTCAGGATGGTCCGCCACCTTTGGTTTCGCACCGGTCCGATATGCCCGCCGGATATCCAATACGGGTCCTAGTGC
AATGGCCATGTTCCTTGCCGTTTCTGGTCCCTTTGCTTGGGGAATGTACCAGGTCGGCCAGGGAAACAAAATCCGCAGG
GCATTGAAGGAAGAGAAATATGCTGCTCGTAGAACAATACTTCCCATTCTTCAAGCAGAAGAAGATGAAAGGTTTGTGT

FIG. 2 continued

CTGAGTGGAAAAAGTATCTGGAATATGAGGCTGATGTAATGAAAGAT

> SEQ ID NO: 7353  57708  175751_300544_1b
CCCCCGATCGTCGTCTCGCCTTGCCCCGTCCACTAACCCTAGCGGCAACTGCGATCTCCAACCGCTCGATCTCTCGCCG
GAGGCTCCAGATCTGCGGGAGGTAGTCGACCTCGTCGCCGGCGGTGGGGTTTCCGAATCGGGGGCGAAGATGACGGAGG
CGTGGGTGCGGCACAAGCCCGGGATGGCGAGCGTCAAGGACATGCCGGTGCTGCAGGACGGGCCGCCGCCGGGCGGCTT
CGCGCCCGTGCGCTACGCGCGCCGGATCCCCACCAAGGGGCCCAGCGCCATCGCCATCTTCCTCACTACCTTCGGCGCC
TTCGCCTGGGGGATGTACCAGGTTGGCCAGGGGAACAAGGTCCGCCGTGCACTCAAAGAGGAGAAAATTGCTGCCCGCA
CCGCTTTAGTGCCAGTGCTGCCAAGCTGAAGAAGATGAAAGATTTGTCAAAGAGTGGACAAAGTCTCTTATGTGGGAGGA
AATAATTATGAAAGATGTCCCTGGATGGAAGGTCGGCCAAAGTGTCTATAATTCCGGGAAATGGATGCCTCCTGCCACC
GGCGAGCTGCGTCGTGAAGATTGATGAAATCCAAGGGGCTTG

> SEQ ID NO: 7354  6025  201663_300718_1b
CGGACGCGTGGGCGAGCACCACCAACCCCACCCCCGAGCGAGCGGAGCGGAGAACGCGAGGCGAGGCGAAGCAAACAT
GGCGGCGGCTGCGGTGTACGGCGCCGGCGGCGCGATGAAGGGCGGGAAGCTCGGCATGGAGGAGGCGCGGGAGCTGCAG
CTCAACCGCATCCGCATCACCCTCTCCTCCAAGAACGTCAAGAACCTCGAGAAGGTTTGCGCTGATCTGGTGAAGGGCG
CCAAGGACAAGCAGCTGCGCGTCAAGGGCCCCGTCAGGATCCCCACCAAGGTGCTCCACATCACCACCCGCAAGTCGCC
GTGCGGTGAAGGAACAAACACATGGGATCGTTTCGAGTTCCGCATCCACAAGCGGGTGATCGATCTCATCAGCTCCCCA
GATGTTGTGAAGCAGATCACCTCCATCACCATCGAGCCTGGTGTCGAGGTCGAGGTGACGATCGCTGATGTGTAATGCT
GCCAAACTAGCACTACCTTAGACCTACCTGTCTTGTTTCTCTGCTGCTTAGAATCTCGGTTCCGATTGCCATGCGTGTA
ACGGACATCCAACTGGTTTAGTGTATCTGGGTCTTTTATATGTGCGCGGATGCTATGGATCTTTCTCATGTAAGAGGTG
TGTAACTCGCCAGTTTTGCTTCAACCACATGAAATTTGGTATTGGAA

> SEQ ID NO: 7355  6025  211443_300899_1b
ACTTTCCCGGCCTCATCACTTTGCCGATACGAAGATCGTCCCCTTTCAATCCAATTATAACGATCCGTTCGAGTCGTGA
AGCCGTTCAAAATGTCTTACCAGAAGAACGACAAGGATGTTCAGGAGCCGGCTAAGAGCCACAAGATCCGCATCACCCT
TTCTTCTCGCAAGGTCCAGGTCCTCGAGAAGGTCTGCTCCGAGATCATCGACCGTGCCAAGAACAAGGACCTCCGCGCC
AAGGGCCCTGTCCGTCTGCCTACCAAGTGCCTGACCGTCACTCCCCGCAAGACCCCTTGCGGTGAGGGTTCCAAGACCT
GGGACCGCTTCGAGATGCGCATTCACAAGCGTCTCATCGACCTCCACGCCCCCACTGAGGTCGTCAAGCAGATCATTGT
CAACATCGACGCTGGTGTCGAGGTTGAGGTCACCATCGCTGCTTAAGCGAATCTCCAATTTCGTAAAGATGTTGGAGTG
GCCGAGACCCTGACGTCGAGGGAGATGAAAACAGCCCTCGCAGCAGATAAGCACAAAATAAACTGGTTCAAGACATA

> SEQ ID NO: 7356  6025  258439_301696_1b
GCCAAAATGTCATTCAACAAGGATAAGGCCGACGCTGAAGCTCCCCAGCAGCTCCGAAAGATCAGAATCACTCTGACTT
CCACCAAGATGAAGTCTCTTGAGAACGTCTCCGCTGACATCATCTCTCGAGCTAAGAACTCCAACGTTGGCGTCAAGGG
CCCCGTCCGACTCCCCACCAAGGTTCTTAACATCACCACCCGAAAGACCCCTAACGGTGAGGGTTCCAAGACCTGGGAT
CACTTTGAGATGCGAATCCACAAGCGACTCATCGATCTCCACTCCCCTGCTGAGGTTGTCAAGAAGATCACCTCTATCA
ACATCGAGCCTGGTGTGGATGTTGAGGTCACCATTGCCGCTTAAGCTTGTTGACCCCAAAACTTGGTATAAAAAATTGC
ACATGTATTATTGATGTCT

> SEQ ID NO: 7357  6025  8182_300304_1b
ACACACATAAATTTAGATCAATATGGAGGATTGGGCTAAGAAGAGACTCCTTCCTTCCTTGCAGCAAAAAGCAATCCGC
CGTCGAGCTTCGTTCGTCTCTCAGAAGAAGCTGCAAATATGGCGACAGCGTATCAACCAATGAAACCAGGGAAGGCTGG
TTTGGAAGAGCCACTCTAGCAGATTCACAAGATCAGAATTACTCTCCTCCAAGAATGTCAAGAACTTGGAAAAAGTG
TGTACTGATTTGGTTCGTGGAGCTAAGGACAAGAGACTGAGAGTTAAGG

> SEQ ID NO: 7358  6025  105359_300373_1b
CGTCGAGCTAAGGTCTCCGGTCCGAAATTTTGGTTCGATGGGGATTAAAGTCATTGTTCAAAGATTCGAGTTTCCGTCA
AAGTCCGGACATATTTGTTTTTCGTTCGAGTTCATCGTTGTTCTGATCCGGTACACAGCTGGTAGACCTTGTAAGTTGA
TAACATGAAGCATGAATACGAAGTTGAAGCGGCAGCAGTTTTCAGTCTCAGTTGCATAATTCTGAGCTTCTTCTCTCCA
CTCTCTGAAAGATGGCAGCATATGCAGCAATGAAGCCGACCAAGCCAGGTCTAGAGGAGCCACAGGAGCAGATTCACAA
GATTAGGATCACTCTTTCCTCCAAAAATGTTAAGAATCTCGAGAAAGTGTGTGCTGATTTGGTTCGTGGTGCCAAGGAT
AAGAGGCTCAGGGTGAAGGGACCCGTGAGGATGCCCACAAAGGTCCTTAACATTACCACTAGAAAGTCTCCTTGTGGTG
AAGGTACAAATACATGGGACGATTCGAGCTGCGTGCTCCACAAGCGAGTCATTGACCTTTTCAGCTCTGCAGATGTTGT
CAAACAAATCACCTCAATCACCATTGAACCTGGTGTTGAGGTTGAGGTCACTATTGCTGATTCTTAGATCCTTTGTCTT
ACCTAGGTAGATGAGTTACTCTTTATATGCTGTCGTATTTTGCCCTCCAGACTTTATGTATTACGAGTTTTTTGGAATT
ACAATTTTGCTGTTAAACTAAGACTTTTGATAAAAGTAAAGTGTATGGTTTGTTTATTT

FIG. 2 continued

> SEQ ID NO: 7359 6025 111129_300052_1b
AAGAAAACCGAAGCTGCGGCTACGTCTTTTACATCTTCGTCGCATCTCCCTCAGCAAATCAAATCAAATCAAAATATGG
CGTATGCAGCAATGAAGGCAACAAAACCAGGGCTAGAGGAGCCCCAGGAGCAGATTCACAAGATTAGAATCACTCTTTC
TTCCAAAAACGTTAAGAATCTTGAGAAAGTGTGTGCTGATCTGGTTCGTGGTGCCAAGGACAAGAGGCTCAGGGTAAAA
GGACCTGTGCGAATGCCCACTAAGGTTCTCAACATTACCACTAGAAAGTCTCCCTGTGGAGAAGGCACAAATACATGGG
ACAGGTTTGAGCTGCGGGTGCACAAACGTGTGATTGACCTTTTCAGTTCCGCAGATGTTGTCAAGCAGATCACCTCAAT
CACCATTGAACCGGGTGTTGAGGTTGAGGTCACCATTGCTGATTCTTAGATTCTTCTCTGTTTTCATTAGGTTGTTGAA
TTTTTTTCAAGTACTAGTGGTTTGCAGTTGCTTTCTTGGCCGTCTAAATTATGGGCTTAAGGTTTTCTTTATTCCAATT
AAAGTTTTGCAGCTAAACCAGATACTAATACTATTTGATATTGGGAAGAGGATTTGTCCGTTAAAA

> SEQ ID NO: 7360 6025 1098115_301483_1b
TTGCGGGTGTCAACAAGCTTCTGCGCACCTTGTCTCCTTCGATCACCCTCAAGGTAGGAGATAAAACATGGCGATGGCA
ATGGGTATGAAGCCCGGAAAGCCTGGCCTCGAGGAGCCTCAAGAAGCCCTCCATCGCATCCGTATCACCCTTTCTTCCA
AGAGTGTCAAAAACCTCGAAAAAGTGTGTGCGGATTTGGTTCGAGGTGCCAAAGAAAAAAAGTTGAAGGTCAAGGGGCC
TGTTAGAATGCCCACAAAGGTGTTGCGCCACACCACCAGGAAGTCCCCTTGTGGAGAAGGTACCAACACGTGGGATTGT
TTTGAGCTGAGGATACACAAGAGAATCATTGATTTGCACAGCTCTTCAGAAGTTGTGAAGCAGATCACCTCGATTACAA
TCGAGCCTGGAGTCGAGGTGGAAGTGACAATTGCAGATGTCTGAGTGTAGTCAATTATTTCTTTTTGACCGGGAAAAGG
TTATTGACTTGGTTGAAGAGGGATGACTGGTCTTTCAATTTTAGGTTATGTTTCTCCTTATGAATATTTGTTAGGATTT
TTGACATTTAATCCTGTGTTAACGGAGAATTGAGCTGGATAGTATTTTGGAATCATTTCTTAGCAACCCATATTACCTT
TA

> SEQ ID NO: 7361 6025 139043_300406_1b
CGAAAAACCCTAACGCCACCCGCGCCGCCATCCCCGAGCACCACCAACCCCACCCCCCGAGCGAGCGGAGCGGAGAACG
CGAGGCGAGGCGAAGCAAACATGGCGGCGGCTGCGGTGTACGGCGCCGGCGGCGCGATGAAGGGCGGGAAGCTCGGCAT
GGAGGAGGCGCGGGAGCTGCAGCTCAATCGCATCCGCATCACCCTCTCCTCCAAGAACGTCAAGAACCTCGAGAAGGTT
TGCGCTGATCTGGTGAAGGGCGCCAAGGACAAGCAGCTGCGCGTCAAGGGCCCCGTCAGGATCCCCACCAAGGTGCTCC
ACATCACCACCCGCAAGTCGCCGTGCGGTGAAGGAACAAACACATGGGATCGTTTCGAGTTCCGCATCCACAAGCGGGT
GATCGATCTCATCAGCTCCCCAGATGTTGTGAAGCAGATCACCTCCATCACCATCGAGCCTGGTGTCGAGGTCGAGGTG
ACGATCGCTGATGTGTAATGCTGCCAAACTAGCACTACCTTAGACCTACCTGTCTTGTTTCTCTGCTGCTTAGAATCTC
GGTTCCGATTGCCATGCGTGTAACGGACATCCAACTGGTTTAGTGTATCTGGGTCTTTTATATGTGCGCGGATGCTATG
GATCTTTCTCATGTAAGAGGTGTGTAACTCGCCAGTTTTGCTTCAACCACATGAAATTTGGTATTGGATTCAATTTTTG
TC

> SEQ ID NO: 7362 6153 11578_300292_1b
TGGTATCAACGCAGAGTGGCCATCTGCATTGTCTACATGCATAGTACTGTCCAGAAGGAGGATAACAACCCCGGATTAA
CCATCTTGAGGTGGATCTACGAAGAGCTTCCTTCTGACCATAAGGACAGGCTTCAGGTTGTATACTTTGTGCATCCTGG
GATACGGTCAAGGCTTGTTCTTGCAACACTAGGCAGATTTTTCCTGAGTGGAGGCTTGTATTGGAAAATAAAGTATGTC
AGTCGCCTGCAATATCTTTGGGATGACATAAAGAAAGGAGAGCTCCAGATTCCTGAATTTGTTCAAAAGCATGATGACA
TTCT

> SEQ ID NO: 7363 6153 160275_200051_1b
GAAAAACTATAGACAAACTCCAAATCTTCAAGATTCAAGGTAAAGATAAACGTGGCTGCACCATCCTTCGCATCATCGG
CAAGCTTTTCCCTGCAAGAATTGTAAGTGTGGAGGCAGTAAACAAGTATCTACAAGAGAAGATTTATCCAAGTTTAGAG
CAGAGACAATTCTCAATAGTGTACGTACATACAGGAGTTAACAGAAGCGAAAATTTCCCAGGAATAGTAGCTCTCCGAT
CGATCTGTGATGCTATGCCGGAAAATGTGAGAGATCATCTGAAAGCTGTTTATTTCCTTCACCCAAGCCTACAGTCTCG
ACTCTTTCTTGCCATTTTTGGTCGTCTCACTTTCACCGGAGGGATTTATTGGAAGCTGAATTATGTAACTAGGTTAGAG
TTCTTGTGGGAACACGTAAAGAGAAAGGAGATAGAAATGCCAGAGTTCGTCTATGAATTTGAAGAAGAGCTGGATGACT
ACCGTCCGATGACGGATTATGGAATGGAGGGAGATCATCCAAGGGTTTATATTGATTCTACTGTTGAACCTGCAGTTTC
AATGTACTCAATGAGGTGTATTGCTTAGTAGTAAAAGAAGAAAAACTGTTTTAGGTGGCCTTGGATGGGCTGGACTGAT
ATGTGTGCCGGCCTCTTAGGTCACTTTGTTTTATCTTCAAGTGTTACTACTTTTAGAATGTCTGCGAAATGCTTAGTTG
GTATC

> SEQ ID NO: 7364 6477 56474_300139_1b
GAGGATGCAAGGATAGCGATTCAATTTGGTTCTTTCGGAATCATTGTATCAAACCATGGAGCTCGCCAGCTTGACTATG
TCCCAGCAACCATCTCGGCCCTTGAAGAGGTTGTCAAAGCGACACAAGGACGAATTCCTGTCTTCTTGGATGGAGGTGT
TCGACGTGGCACTGATGTCTTCAAAGCACTTGCACTTGGAGCCTCCGGGATATTTATTGGAAGACCAGTGGTATTCTCA
TTGGCAGCTGAAGGAGAGGCTGGAGTTAGAAAGGTGCTTCAAATGCTACGTGATGAGTTCGAGCTGACCATGGCACTGA
GTGGGTGTCGGTCCCTAAAGGAAATCTCCCGTAACCACATTACCACCGAATGGGACAC

FIG. 2 continued

> SEQ ID NO: 7365  6477  1007405_301399_1b
TCGGCAATGTTGATCTTAGTACAACCATTTTGGGCTTCAAGATATCCATGCCAATCATGATTGCACCTACTGCAATGCA
GAGAATGGCACACCCAGAAGGTGAATTAGCCACCGCTAGAGCTGCTGCAGCTGCTGATACAATCATGGTACTTTCATCA
TGGGCTACTAGTAGTGTGGAGGAAGTTGCAAGCACGGGACCCGGGATTCGCTTTTTCCAGCTCTACGTATACAAAGACC
GCAATGTAGTGGCCCAACTTGTCCGAAGGGCAGAACGAGCGGGCTTCAAGGCCATTGCGCTAACCGTAGACACACCTCG
CCTAGGTCGGAGGGAATCAGACATCAAGAACAGGTTTGTGCTACCTCCACACCTATCCCTGAAGAATTTTGAAGGTCTG
AATTTGGGGACGATGGAAAAGGCAGAAGATTCAGGCCTTGCCTCATACGTTGCGGGGCAAATTGACAGGTCTCTCAGCT
GGAAGGATATTAAGTGGCTGAAGACAATCACCAAGCTCCCTATCCTTGTGAAAGGTGTCCTCACAGCAGAAGACACAAG
GTTGGCCATTCAAGCTGGAGCAGCTGGTATAATTGTGTCGAACCATGGGCACGTCAGTTGGATTACGTGTCTGCCACA
ATTGATGCTCTAGA

> SEQ ID NO: 7366  6477  130411_300487_1b
GCGCGCCTTAATACCACCATTTTGGGCTTCAAGATATCAGGGCCAATCATGATTGCTCCAACTGCCATGCAAAAAAATG
GCTCACCCTGAAGGAGAGTATGCAACAGCAAGGGCAGCATCTGCAGCTAACACCATTATGACATTATCATCATGGGCTA
CTTCCAGTGTTGAAGAAGTTGCTTCAACAGGACCAGGGATTCGTTTTTTCCAACTCTATGTGTACAAGGACAGAAAAGT
TGTTGAGCAGTTGGTTAGAAGAGCGGAACGAGCCGGCTTCAAGGCAATTGCTCTCACTGTTGACACCCCAAGACTTGGG
CGTAGGGAAGCTGACATTAAGCAACAGATTCACTTTACCACCATTTTTGACTTTGAAGAATTTTGAGGGATTGGACCTTG
GACAGATGGAAAAGTCAAGTGACTCTGGACTTGCGTCATACGTTGCTGGTCAAATTGATCGAACTCTAAGCTGGAAGGA
TGTGCAATGGCTTCAGACAATTACGAAGATGCCAATTCTAGTGAAGGCGTGTTGTTACTGCTGAGGATACTAGGTTAGCT
ATACAAGCAGGAGCAGCAGGTATCATCGTGTCCAACCATGGAGCTCGTCAGCTTGACTATGCACCAGCCACCATCAGTT
GTCTTGAGGAGGTCGTGAAAGCTGCACAGGGCCGAGTCCCCGTATTCCTTGATGGTGGGGTTCGTCGTGGAACAGATGT
TTTCAAAGCATTAGCTCTAGGAGCTGCTGGCATATTTATTGGAAGACCAGTTGTGTTCTCATTGGCTGCTGAAGGTGAG
GCTGGTGTAAAAAAGGTACTCCAGATGCTTCGCGATGAATTTGAGTTGACAATGGCCCTAAGTGGATGCCGCTCACTCA
A

> SEQ ID NO: 7367  6477  127291_300469_1b
GCTGGTCAAATTGAGGGGCTCTTTGAGTTGGAAGGATGTCCAGTGGCTCCAGACAATTACTTCATTGCCAATCCTCGTA
AAGGGTGTACTTACTGCGGAGGATGCTAGGATTGCAGTTCAGGCTGGAGCACCTGGTATTATTGTGTCGAACCATGGTG
CTCGCCAACTCGACTATGTCCCCGCCACTATCATGGCTCTTGAAGAGGTTGTGAAAGCTGCACAAGGCCGTGTCCCCGT
GTTCCTGGATGGAGGTGTCCGCCGTGGAACAGATGTCTTTAAAGCTTTGGCACTTGGTGCATCAGGGGTGTTTATTGGG
CGACCAGTCGTTTTCTCATTAGCTGCTGAAGGAGAAGCTGGTATCAAAAAAGTATTGCAGATGATGCGCGATGAGTTTG
AGCTAACTATGGCATTAAGTGGTTGCCGTTCACTGAAAGAGATCACTCGTAACCACATTGTGGCCGATTGGGATGCTCC
ACGAGCTGCTCTTCCCGCGCCAAGTTTATAAAATAAAACCTTAGGTGTCAAATTGTTTCACCATGACAACGTATTAGTT
CCACATGTTTTCAATAGCTTACTTATCTTTCACGGGAACACTCA

> SEQ ID NO: 7368  6606  270645_200127_1b
TCATTTTGGCCCAACTCCCAAAAACCCCACCTTCGCACCCCTCCGTTGTTCCGCCGCCTCCGCCACGCCGGAAACCACC
ACCACGACCTCCACCACATTCCACGGCCTCTGCTACGTCGTTGGAGACAATATCGACACTGACCAAATCATCCCCGCGG
AATACCTAACCCTAGTCCCATCAAACCCAGACGAGTACAAAAAACTCGGGTCCTACGCGTTGTGCGGACTCCCTTCATC
ATACCAAACCCGTTTCATCGACCCGGATGAATTCACATCCAAGTACTCCATCATCATAGGCGGCGACAACTTCGGGTGC
GGGTCGTCGCGTGAGCACGCCCCGGTGGCTTTAGGAGCCGCGGGCGTGGCGGCGGTGGTGGCGGAGTCGTACGCGAGGA
TTTTCTTCAGGAATTCGGTTGCGACGGGCGAAGTTTATCCGCTTGAATCGGAAGTGAGGCATTTGTGAGGAGTGTAAGAC
GGGTGATGTGGTGACTGTTGAACTAGGAGAGAGTAGGTTGATTAATCATACGACTGGGAAGAATATAAATTGAAGCCA
ATTGGTGATGCTGGTCCTGTCATTGAAGCTGGTGGCATTTTGCTTATGCA

> SEQ ID NO: 7369  6681  120571_300411_1b
CGGTGCAGTTTTGACGCTGCCGTATTAACTCTCCTCCGAAATGTCTGCATATGATAATGTGGTTGGCGGGAAGTTGAAA
CTAAAGGGAAAGGCATTGGATGTAAAAGCCGCTGGAATAAAGAAAAAGAAAAGGAAAGAAAAGAAGGATTATGATCAAA
TCTCCCAGGTTACAGGAAAAGAGCTTTCAACAGATGGTGGTAGTGGATCTTTAGATGATCCCACCAAGGAAGAGAGCAC
AGATGCCACTAAATCTGTTGGTGAAGAAAATGCTGGTCGCTGGGATGATAATCTAACCCCTGCAGAGAGGCGCTACATA
GAACAAAGGGAGAGGATTGACATGCATAAGATGGCCAAGACTGCTAATAAATCACATCGTGACCGAATCGAAGATTTCA
ATCAGTACTTGGCAAACATGAGTGAGCACTATGACATTCCCAAAGTCGGTCCTTAATTAATAACAAATCAGAAATT
TGCTCCATCTCTCTATCTTGTTTATGGTTGTTTTGTTTTAGCATATTTAATAGCTACTTTTTGCAATTTGTATTATGT
AATTTAGCAGTTTCCTTTGCTAGATGGTGAACGGAAGCCTTGGAGTAATGGTAAAGTTTTCTCCGTGTGA

> SEQ ID NO: 7370  6681  193761_300742_1b
CCCCCGAACCCTCGCTTCTCGGGGACGCGGAGCGGCCAGCCGGCCACCTTCCACTGCCTCGAGCTCCTCTCCTTCTCCG

```
GGTTGGTGTGGCGTGGAGATCCATCCTGGCCGACCTCTTTCGCTAGGCGAGATGTCTGAGTACCAGAACGTCGTTGGGG
GTAGGCTCAAGCTGAAGGGGAAGGCGCTGGATGTGAAGGAAGGGGGAGTCAATAAGAAGAAAAAGAAGAAGCAGCACCG
CGAGGAGTCATCTGAAGCCGGGCACGGAGAGCTTCACCAAGGTGGAAGCTCTGAAGTACCAGCTGACCCTAATGATGAA
TTGACTGAAGCTGATAAGATGGGAGAAGAAGGAAACCTGCAAGGCGACTATGATCACCTCACCCCAGCTGAGAGGCGTT
ACATGGAGCAGAAGCAGAAGATTGACATGCATAAGCTAGCCAAAGTAGCCAACAAGTCACACAGGGACCGCATCCAGGA
CTTCAACCAATACCTGGCAAATCTTAGCGAGCACTACGACATCCCAAAAGTTGGCCCTGGTTAACTTTGCCTATTCAGA
GCTTCGCAGGAATGCTTCCTATGCTGTACCCATCCAGCCATCTGTTAGCTTGTGATGCTCCTACCTGTATTGTTCTAAA
ACATTTGGTTGTCTTCGAGTGTTGTATTTCGAAAACCCAAACCATGTTTAATTCAAGTGTTCGTATTCTGAAAAAAAAA
AAGT

> SEQ ID NO: 7371   6682 240623_301316_1b
GCGGGGAAGTCCAACAAGCACACGACCCGGATCTGGTCGTGGATTTGGCATTCCCTGGGCCAGCGCCCCAAATGCAGCG
GCTTTTCTAGATCTTGAAAGCGATTCCTTGATCGTCTCCTGCCATGGCGTCGCGCTACGATTCGAATCCATTCGACGAG
GAAGATGTCAATCCCTTCTCGGACCCTGCTGTTCGTGCTCAAATGACGGGGAAGCCATCGTATCTGGGGAACAATTTCT
ATGAATCGCAACCATACAATGTTCCTCAGGTGAACTCGATATCTCCTCTAGCACCGGAGCGGACCTCGGTTGGAGATGC
CACCGTGGAAATTCCCCTGGGCAACATGAAGGATCTGAAGAAACGGGAAAAGGAGTTGAAAGACAAGGAAGAGCAACTC
CGAAAGAGAGAAGCCGAAGTGAAAAGGCGAGAGGACGCTGCATCAAGAGCTGGAATCGTGCTCGAAGACAAGAACTGGC
CGCGCTTTCTCCCGATACTGCACCATGACATTGCGAGCGACATCCCGCAGTACTTGCAGCGCATCATGTACTACGCATA
TGGAAGCTGGCTCGGAATTCTCTTATGTTTGACGTGGAATTTTGTTGCCGTCACTGGAGCTTGGATCCAAAAGACTGTC
AGCGCTTCCTATGGTGTGCAGATATGGTTCCTCGCTATTATCTACATTCTTGCGGGCTTTCCGGGGTCCTTCTTCCTCT
GGTACAGACCTCTGTACCGTGCTATGAGGTCAGAGAGCGCGATCAAGTTTGGATGGTTTTCATCGCGTATCTGTTCCA
CATCCTGTTTTGCATCTTCTGCTGTGTCGCTCCTCCCGTCGTGTTTAAAGGACGATCAATCACGGGCATTCTACCGGCG
ATCCAGATCTTCTCAGACAGCGTCATTATCGGGATATTCTATCTCGTTGGCTTTGGTCTGTTCGTCCTGGAAACTCTCC
TCAGCCTATGGGTTCTCCGGGACGTGTACGCGTACATCCGGGGTACAGGCAAAGCGGCACAATTGAAGAGAGAGGCAGC
TCGCAACGTTGTAGGCGCTGCGATGTAGAAGTGCAAGCAACTGGCTTTTGGAGTAGTATGTATATGGGATCACATTTTT
TTGCCTGC

> SEQ ID NO: 7372   6682 156147_301363_1b
GAATTTTCTGTTCTTCTTGATTTCCTGCGAATAGTTTTGGTCTTCTCAAGACATTTCCCCTTTTTGCCTTCTCTGCTAAG
CTTCTCTTCTATTTTTGCTACTATTCAGATCTCATCTTTAAAGCAAAACTCAGAATTGGTTGAAATGGCGGGCCGTTAT
GATCGAAACCCTTTTGATGAAGAAGAAGAAGTTAATCCTTTTGCTGGTGGTGGAGGCAGAGGGAAAGCTTCAGGGCAAT
CAAATTTTAGTGGAGGTGCATTTAATATCACATCTGGTAGTGTGCCTCCAGCAACAAACTCCAGGCTTTCACCCCTTCC
ACCAGAGCCAGCTGGCTTCTATGACCGCGATGCACCAATTGATATTCCTCTTGATAGTGCTTCGGACTTGAAAAAGAAA
GAAAAGAATTACAGGCTAAAGAGAGTGAATTGCGACGAAGGGAACAGGAACTAAAAGGAGAGAAGATGCTGCAGCAA
GAGCTGGCATTGTTATCGAGGAGAAAAATTGGCCTCCGTTCTTCCCAATTATCCATCATGATATTGCAAATGAAATACC
AATTCATCTTCAAAAGCTACAATATGTTGCATTTACAACATTCTTGGGACTTGTTGCATGCCTTTTGTGGAACATCGTA
GCTACCACTACAGCATGGATTAAAGAAGGAGATGTAAAGATCTGGTTCCTTTCCATCATTTACTTCATATCGGCGGTTC
CTGGAGCCTATTTCATGTGGTATCGTCCTCTGTATCGCGCTTTTAGAACTGAGGGTGCCATGAAGTTTGCGTGGTTTTT
CTTGTTTTACATGGTTCACATTATATTCTGTATCTTCGCTG

> SEQ ID NO: 7373   6682 270361_200125_1b
GGGGTATGATACTTTCGTAAACGCGCATCTTGCTTGATAAATACATATATATACTCATTTGCCGCAAGATTCCAGTTCC
AGATCTGTGACTGCCAACATTGCTTCATTCGAAATTGCTCCAATGGCTGGCCGTTACAATGATAATCCTTTTGCTGAAG
ATGAAGTGAACCCTTTCGCGAATAATGGAAGTGTCGCCCCTGCTAGGCCTTCCCCTCTTCCTCATGAACCTGCTGGCTA
TGACCGCGGCGCATCGGTTGATATTCCTCTCGATGGGTCAAAGGACCTGAACAAGAATGATAAGGAACTCCAAGCTAAA
GAGGCTGAACTGAAAAAAGAGAACAGGAGCTTAAAAGGCAGGAGGATGCAGTAACAAGAGCTGTGGTAGTTATAGAGG
AGAAGAACTGGCCACCTTTCTTGCCCATCATTCATCATGATATCGCAAATGAAATTCCAATCCATCTACAGAAGCTGCA
ATATGTTGCATTCACTACATTATTGCGTTTGGCAGTCTGTCTTGTATGGAACCTTGTAGCT

> SEQ ID NO: 7374   6682 271863_200038_1b
GTTGCTGCTGTGGCACCTCCAATTTTCTTAAGGGGAAATCTTTGACTGGTATCTTGCCTGCAATTGATCTTTTGGGCTG
GCATGCTTTGGTTGGGATATTCTACTTCGTTGGAGCTGCATTCTTCTGTCTTGAAACACTGATGAGTATATGGGTTATC
CAGCAAGTCTACATGTATTTCCGTGGAAGTGGAAATTCTGCAGAGATGAAGAATGAGGCTGCAAGATCGACTATGATGG
CAGCATTATAATTAACATCAATGTGGGGTGCAATTTTGGGCTTCGGGTTTGTTAAATTCTTTGATTGCTTATTCCCTTA
CACCTTAACTGGATTCCTGGGTGTTTCTGAAGTACATAGTGGTGATCACAGAGCATTTGAACAACACTGATGTTAGTGT
AATACTTACCCTTGTCTGGGATTTTTCTTTACACTCATGGCCCTCTGCGAACAGCCTGACCTTATCTTGATATCAAAAT
TCTTTGAAATGCTTCATGGTTTTCCTAT
```

FIG. 2 continued

> SEQ ID NO: 7375 6682 284420_200098_1b
GCAAAAGGAACTAGCAGCTTGGGCAGAAGATCTGGAAAGAAAAGAAAGGGAGATAAAACGAAGAGAAGATGCTGTTGCT
AGTGTTGGTGTTCCGACCAATGATAAGAACTGGCCGCCATTTTTTCCAATTATTCATCACGATATAGCAAATGAAATAC
CAGTTCATGCTCAAAGGATGCAGTATTTGGCTTTTGCAAGTTGGCTAGGTATCGTGCTTTGCCTTGTGTTCAATGTTAT
TGCTGTCACTGTTTGTTGGATAAGAGATGGTGGTGTCAAAATTTTCTTGCTTGCTGTAATATATGCTTTACTTGGATGC
CCCCTTTCGTATGTATTGTGGTATAGACCCCTTTATAATGCGATGAGGACGGAGAGTGCACTAAAATTTGGTTGGTTTT
TCATGTTCTACATGCTCCACATTGGATTTTGCATACTTGCTGCTATTGCTCCTCCCATTATCTTTCACGGAAGATCCTT
AACGGGCATACTTGCGGCAATTGATGTCTTCTCTGACCATCTCTTGGTTGGGATCTTTTATCTGATTGGATTTGGCCTT
TTTTGCTTGGAAGTTTTGCTAAGCTTGTGGGTATTGCAGAAAGTCTACCTGTACTTCCGTGGGCACAAGTGAGCATGAG
TTTGGATCCAATTAGCTGCATT

> SEQ ID NO: 7376 6682 3911_300324_1b
CCCACGCGTCCGGACTGCTTGTTATTCTGATAACTAAATTTTTCAATCTTATGAACCTTTAATTTTTTCATAGCCATGG
CTAATCGCTATGATCCAAATACTTTCGCTGAGGAAGAAGAATTCAATACTTTCGCTAATGCTATAGGA

> SEQ ID NO: 7377 6686 270242_200124_1b
TTTAGTTCTCTGTCTCACACACACACACACACACACACACACATCGCAGCTGCTTCGTCTTGCATCGAGTTTTTCAGCC
ATGGAGGCTCTACAGCATTTGGAATCACTTTGCAATGCCCATCCAGAGCTCTCCGATTGGTACACTACGCTATCAGATC
TGTACCAAAGAAAGCTCTGGCACCAGCTTACTCTCAAGCTTGACCAGTTCGTTTCACTTCCCCCTTTTCAGGCTGGTGA
TGCACTAATACAGTTGTATGACAACTTCATCACTGATTTTGAGACAAAGATCAATTTTCTCAAGCTTGCACATTTTGCG
GTCATTGTTTCTCGGCAATACCCCGAGAAAGAGGCTGCTATAGGTTTCCTTGAAGGAGTGACTGAGAAACTTCGTAATA
CTAAAGAGACACGGATAGAGGAGCCAATTCTTTATATTAAGATGCAGATTGCCCTGTTTAAGCTTGAGCAAGGGGATCA
AAAAGAGTGCCAGAAACTTTTAGATGAAGGGAAGACTGCACTTGACAGTATGACTGACATTGATCCATCTGTTTATGCG
AGCTATTATTGGGTTTCATCTCAGTATCATAAAGCTCGCCAGGACTTCGCTGAGTTCTACAAGAGTTCTCTTCTTTATC
TTGCTTACACTTCAGTGGAATCTCTTTCTGAAT

> SEQ ID NO: 7378 6686 105470_300368_1b
CCGCTTTAGAGTACTTAGATTCACTTCGAAATGCACATCCAGAGCTGGGCGATTCGTACAATACGCTATCAGATCTGTA
CCAGCGCAAGCTCTGGCACCAGCTCTCTCTTAAGCTTGAACAATTCGTTGCCCTCGCCGTTTTTCAGGCAGGCGATGCA
CTGATACAGCTGTATCACAATTTCATCTCTGATTTTGAGACAAAGATCAATCTTCTCAAGCTTGCACATTTTGCAGTCA
TTGTTTCCCGGCAGTATGCAGAGAGAGAAGCTGCTATAGGTTACCTTGAAGGTGTGATCGAGAAACTTCAAAATACAAA
GGAGACACGCATAGAGGAGCCAATTCTATACATTAAGTTGCAGATTGCTCTATTTAAGCTTGAACAAGGGGATCAAAAA
GATTGCAAGATTCTTTTAGAAGAGGGGAAAACTACACTTGACAGCATGACTGACATTGATCCCTCTGTTTATGCTAGCT
ATTATTGGGTTTCGTCTCAATTCCATAAAGCTCGCCTGGAGTTCGCTGAGTTTTACAGAAGTGCTCTTCTTTATCTTGC
ATACACTTCTGTGGAATCTCTTTCTGAATCGTTTAAGCTGGATTTGGCGTTTGATTTATCCCT

> SEQ ID NO: 7379 6717 1097184_301437_1b
GGAGGGAAAAAGAAGGGAAGAGGAGAGAACAGAAGCGAAGAGGAGAGAGAGAGGGAGAGATAGATAGACAGAGGTAGAG
AGAGAGAGAAGGAGAAGGGGAGAGAGAAGATGGCAGGAGTAGGGCCCATAGTGCAGGATTGGGAGCCCGTAGTGGTCCG
AAAGAAGACCCCGAACTCGGCCTCCATGAAAGATGAGAAGGCTGTCAACGCCGCTCGCCGTGCTGGAGGACCTGTTGAG
ACCATCAAGAAACATAATGCTGGATCTAACAAGGCTACATCAAGCACTACTAGCCTCAACACAAGGAAACTGGATGATG
AGACCGAAGTGTTATCGCATGAGAAAGTTCCATCGGAAATGAAAAAAGCGATCATGCAAGCACGCTTAGAGAAAAGCT
TACACAGGCCCAGCTTGGTCAGCTTATCAATGAGAAGCCACAAATTATTCAGGAATATGAGTCAGGGAAGGCGATTCCG
AACCAACAGATTATCTCAAAGCTTGAAAGGGTTTTAGGAACGAAGCTTCGAGGCAAGAAGTCAAGTGAATTTTTAGTAG
TAGTAATTTACTCAGGGGGGGATTGCTTGGAAAGCATCTTGTACAGAAATGTAGTAGTGGCTAAGAAACAGTCTCTA
GGTACTACTACTACTACTACTACTATCACTACTA

> SEQ ID NO: 7380 6717 1114045_301842_1b
GGAGAGAGAGAAGGAGAAGGAGAAGGAGAGAGGAGAGAGAAGATGGCAGGAGTGGGGCCCGTAGTGCAAGATTGGGAGC
CGGTGGTTGTTCGGAAGAAGACCCCAAACTCAGCCTCCATGAAGGACGAGAAGGCTGTCAACGCTGCTCGCCGCGCCGG
AGGACCCGTCGAGACCATCAAAAAACATAACGCTGGATCTAACAAGGCCACATCCAGCACTACTAGCCTGAACACAAGG
AAACTGGACGATGAGACTGACGTGCTGTCACATGAGAAAGTTCCGTCAGAAATGAAAAAAGCGATCATGCAAGCACGCT
TGGAGAAAAAGCTTACACAGGCCCAGCTCGGCCAGCTTATCAATGAGAAGCCACAGATTATTCAGGAATATGAGTCCGG
GAAGGCTATTCCGAACCAGCAGATCATTGCCAAGCTCGAAAGGGTTTTAGGAACAAAACTTCGAGGCAAGAAGTGAAAT
GATAGTGTTTAAAAAACATCTTGTACAAAAATGTAGTGACTAAGAGACATAAACAAGGTACCGTTACTACTTAAGCTT
CTACTGCTAATACTACTATTACTGATACTTTATATATATAAATAATATATTATGC

FIG. 2 continued

> SEQ ID NO: 7381 6717 157938_301396_1b
TTTCTCTAAAAGAAGAAAAGATGGCTGGAATATCACAAGATTGGGAGCCGGTGGTGATTCGCAAAAAAGTGCCGACCGC
CGCCGCAAGAAAAGACGAGAAAGCAGTCAACGCCGCCCGTCGCACCGGTGCTGAGATCGAAACCGTCAGAAAAGCTACT
GCAGGGTCAAACAAGGCTGCATCTAGCAGTACAACATTGAACACCAGGAAGCTTGATGAAGATACCGAGAACTTGTCAC
ATCAAAAGGTACCAACTGAATTGAAGAAAGCCATTATGCAAGCACGACAAGATAAGAAGTTAACTCAGTCTCAACTTGC
CCAGTTGATAAACGAGAAACCACAAATCATTCAGGAGTACGAGTCTGGAAAGGCAATTCCAAACCAACAGATAATCTCT
AAACTGGAGAGAGCTCTTGGTGCTAAACTTCGCGGAAAGAAATAAAGGTTGGAATAGTGAACCTTTTGGATTAGACTGT
CTGGTTGTATCCTAAAAGTGGTCATGTACATGAGCTTTTTTACTTTAACCACTATGGTACTTGTTGTATCTGGATTCAT
GATGTGGTTTTCGTGGTTGACTTGGGTGTTTTTTCTTGTGAAAAATGAGGTGCTTA

> SEQ ID NO: 7382 6717 139271_300408_1b
CGGTGCCCATCAATTGCGACTCCAGAACCGTCTCTTCTTCCTTGTTCGTTCATCCCCTAACCCTTTCTTTGTTCATCTT
GTTCTTCCTCTTGTCGTCTCGTCGAGATGGCCGGGATTGGTCCGATCAGGCAGGACTGGGAGCCGGTGGTGGTGCGGAA
GAAGGCGCCCACCGCCGCCGCCAAGAAGGATGAGAAGGCCGTCAACGCCGCCCGCCGCTCCGGCGCCGAGATCGAGACC
ATGAAGAAGTATAACGCTGGAACAAACAAGGCGGCGTCCAGTGGCACATCCCTCAACACCAAGCGGCTGGATGACGACA
CCGAGAGCCTTGCCCATGAGCGTGTCTCAAGTGACCTGAAGAAAAACCTCATGCAAGCAAGGCTGGACAAGAAGATGAC
CCAGGCACAGCTTGCACAGATGATCAATGAGAAGCCCCAGGTGATCCAGGAGTACGAGTCAGGTAAAGCTATTCCGAAC
CAGCAGATCATCGGGAAGCTTGAAAGGGCTCTTGGAACAAAGCTGCGCGGCAAGAAATAATGTTCTACTATTAGGCCCT
GAAGCATAGTGTTGGAGCAACCAAAGCCAAAATGTTTGCGTAACCTATGCTGGGTCTTTTGATACCATGCAGGATGTTT
CTGTTGGTGCATGAGTGAATACTGAATAACTATTATGTTGTCGCAAACCTTGTAATGCTGCCGCTCTTTGTGTGTCATA
GTCCCTAGTGTGCAAGAGTTGTGCTGGACCTTAAAACTGACTTGATAACCTGCGTGGTTTATGCATGAT

> SEQ ID NO: 7383 6717 271753_200037_1b
GGGCGGACGCGTGGGAAAAAATTCATATACAAATTAGAGATATTTTCAAAGAAGAAAAAAGATGAGCGGAATAGCACAA
GATTGGGAACCGGTAGTAATCCGGAAGAAAGCGCCGACCTCCGCCGCTCGCAAGGACGAGAAAGCTGTTAACGCCGCCC
GTCGCTCCGGTGCTGAGATCGAAACTGTCAAAAAATCTCCGCTCGCAAGGAAGAAAGCCGTCAACGCCGCCCGTCGCTC
CGGTGCTGAGATCGAAACTGTCAAAAAATCTAATGCTGGCTCTAACAAGGCGGCCTCAAACAGTACATCTTTGAACACC
AGGAAACTTGATGAAGACACTGAGAATTTGTCTCATGAAAAAGTACCAACTGAACTCAAGAAAGCTATCATGCAAGCAC
GACAACATAAGAAGTTGACTCAAGCTCAACTTGCTCAATTGATAAATGAGAAGCCACAGATCATCCAAGAATACGAGTC
AGGAAAGGCAATTCCAAACCAGCAGATTATCTCTAAACTGGAGAGATCTCTTGGAGCGAAACTTCGAGGAAAGAAATAA
AGCGTAGTGGCACAAGTGAACCTTATGGATACTCACTGTCTGGTTGAATCCAAGATGCGGTCATGTACATGAACTTTTC
TTTAATCACTGTGTTGCTTATCGTTATGCCTGGATTCATGACTATGTTCCTTGTTGAATTAGCTGTTTCTTCTGTGAAA
TTTGAAGTTCCTCTTGTACGAATTTCTTTTCTGCTTATTGGATTACTCTGTCGTTTA

> SEQ ID NO: 7384 6717 273913_200055_1b
GCGAAACAAAAGCTAGGGTCAAGAGGGAGATCTTTTTCCGAGAAGAAGAAGAAAAAAAGGATGAGTGGAGGAATAGCAC
AAGACTGGGAGCCGGTGGTGATCCGGAAGAAGGCGCCTACCGCCGCCGCACGCAAGGATGAGAAAGCCGTCAACGCCGC
CCGTCGCTCCGGTGCTGAGATCGAAACCATCCGAAAATCTGCTGCTGGCACAAACAAAGCTGCCTCCAGTAGTACGACC
TTGAACACCAGGAAACTTGATGAAGATACTGAGAATTTGGCTCATCAAAAGGTACCAACTGAACTGAAGAAAGCCATCA
TGCAAGCTCGACAAGATAAGAAGCTGACCCAGGCTCAACTTGCCCAGTTGATAAATGAGAAGCCTCAAATCATCCAGGA
GTATGAGTCTGGAAAGGCGATTCCAAATCAACAGATAATCTCTAAACTGGAGAGAGCTCTTGGTGCGAAACTTAGAGGA
AAGAAATGAAGTGCCTTTTGGGTTTCTCAAATCTCCGTTCCAGTCCTAAAAGTGGTCATGTACATGAACATCTTCCTAT
GTTAGCCCTCTTTCTGTAACCACTTTGGTGCTTGTGCCTGTGTATGGATTGATGGTTGAGGATTTCCTAGCTAAACGGG
TGTTACTAATATGGAAAATAAAGGCGTTTATGCTT

> SEQ ID NO: 7385 6717 190523_300693_1b
CCCCCCGGTGCCCATCAATTGCGACTCCAGAACCTTCTCTTCTCTCAACCCTTTGTTCATCTTCTTGTTCCTCCTCTTG
TCTCGTCTCGATGGCCGGGATTGGTCCGATCAGGCAGGACTGGGAGCCGGTGGTGGTGCGGAAGAAGGCGCCCACCGCC
GCCGCCAAGAAGGATGAGAAGGCCGTCAACGCCGCCCGCCGCTCCGGCGCCGAGATCGAGACCATGAAGAAGTATAACG
CTGGAACGAACAAGGCGGCGTCAAGTGGCACATCCCTCAACACCAAGCGGCTGGATGACGACACCGAGAGCCTTGCCCA
TGAGCGTGTCTCAAGTGACCTGAAGAAAAACCTCATGCAAGCAAGGCTGGACAAGAAGATGACCCAGGCACAGCTTGCA
CAGATGATCAATGAGAAGCCCCAGGTGATCCAGGAGTACGAGTCAGGTAAAGCTATTCCGAACCAGCAGATCATCGGGA
AGCTTGAAAGGGCTCTTGGAACAAAGCTGCGCGGCAAGAAATAATGTTCTACTATTAGGCCCTGAAGCATAGTGTTGGA
GCAACCAAAGCCAAAATGTTTGCGTAACCTATGCTGGGTCTTTTGATACCATGCAGGATGTTTCTGTTGGTGCATGAGT
GAATACTGAATAACTATTATGTTGTCGCAAACCTTGTAATGCTGCCGCTCTTTGTGTGTCATAGTCCC

> SEQ ID NO: 7386 6717 255702_301643_1b
AAGAGAGAGAGAGATAAGTTGAATCGTTGATCCGTATAAGAGGGGGGGGAGAGAGAGAGAGAGAGAGAGAGAAGC

FIG. 2 continued

GGAGGGAAAAAGAAGGGAAGAGGAGAGAACAGAAGCGAAGAGGAGAGAGAGAGGGAGAGATAGATAGACAGAGGTAGAG
AGAGAGAGAAGGAGAAGGGGAGAGAGAAGATGGCAGGAGTAGGGCCCATAGTGCAGGATTGGGAGCCCGTAGTGGTCCG
AAAGAAGACCCCGAACTCGGCCTCCATGAAAGATGAGAAGGCTGTCAACGCCGCTCGCCGTGCTGGAGGACCTGTTGAG
ACCATCAAGAAACATAATGCTGGATCTAACAAGGCTACATCAAGCACTACTAGCCTCAACACAAGGAAACTGGATGATG
AGACCGAAGTGTTATCGCATGAGAAAGTTCCATCGGAAATGAACAAAGCGATCATGCAAGCACGCTTAGAGAAAAAGCT
TACACAGGCCCAGCTTGGTCAGCTTATCAATGAGAAGGCACAAATTATTCAGGAATATGAGTCAGGGAAGGCGATTCCG
AACCAACAGATTATCTCAAAGCTT

> SEQ ID NO: 7387 7393 202419_300784_1b
CCCCCGACAATCCAGTCCTCGAACTCGAACCCAGCCATGGCGACCAAGCAGAGCCTCCTCCTCCTCCTCGCCCTCCTCG
CCGCCGCCGCGGCCGTCGCCTCCGCCGTCACCGACGTCGAGTACTGCAATAAGGGCAAGAAGTACCCGGTGAAGGTGAG
CGGCGTGGAGATCGTGCCCGATCCGGTCGCCCGCGGCGAGCCCGCAACCTTCAAGATCTCCGCTTCCACTGATAAAACT
ATCGGTAAAGGGAAGCTGGTTATTGATGTGAAATACTTCTTCTTCTATGTCCACTCGGAAACTCGTGAGCTCTGTGATG
TGACTTCCTGCCCGGCAAGTGGTGACTTCTTGGTAGCTCATCAGCAAACCCTGCCATCATACACTCCACCAGGCTCTTA
CACCATCACCATGAAGATGCTGGGTGATAACGATGAGGAGCTGAGCTGCATCTCGTTCGGGTTCAGCATCGGTTTCGCT
GCATCAGAAGCCACCATCTGAATGCATCCAGAGGCAGAATTCAGAAATATCACACCATGGATGTAATTACAAAAGCACC
TATGTATCTTAGATCATAGAACTCAAATACAATGCGCATCTGCCAACACA

> SEQ ID NO: 7388 7393 1108060_301546_1b
ATTCATTGATAGATAGATAGAGAGATAGAGAGACAGAGAGAGAGAGAAAGAAAGAAAGAAAGAAGGAAAGAAAGGCCAA
GGGCACAAGTTCAAAACCATCGATCTCTTCTACAATAGAATGAGCAATCTAAGAAGGATGTGCTATCTCTTTCTGGTTT
TGATCAGTACCTTCTTTGCACTTGTGAATGCAAAGGTTACATGGCAGTCCTGCTCATCAAGAATCGACTACAAAGTGGA
TGTGCAAGGTGTCAGTGTTATTCCGGACCCTGTTGTGAAGGGAGTCGATGCAACATTTAAAATTCCTGCCATCACAAAG
GATCCAATTACCGGAGGCACAGTGGTGATAGATGTGTACTACTTTGGGATTCATGTACACTCTGAGAAAGATGATTTAT
GCAGCAAAACAGAATGCCCGGTTGCACCTGGAGAGTTTACACTTACGAACTCCCAACCTCTACCCAATTTCACACCATC
TGGATCTTATCGTCTCAACATGAATGTGTACGACACCGATGGAAGTCTGCTGACTTGTGTCAAAATCAGCTTTAAAATA
GTGGGATCAGTCAATCAGCTTGAATCCAGTGATTTGAACAGGTTTTCCGAAGATCGATTCGTGCATGAAGATTGATACA
AGGCTATGTCAGTTTCAAACAATAAATGTAAATATGGGATGAAAGTG

FIG. 2 continued

| Query Contig ID (length, bp) | Pz Score | Result |
|---|---|---|
| 103535 (665 letters) | 3e-76 | >gb\|AAF27100.1\|AC011809_9 (AC011809) Putative phospatase 2A inhibitor [Arabidopsis thaliana] |
| 103541 (667 letters) | 4e-49 | >sp\|P12301\|PSBQ_SPIOL OXYGEN-EVOLVING ENHANCER PROTEIN 3, CHLOROPLAST PRECURSOR (OEE3) (16 KDA SUBUNIT OF OXYGEN EVOLVING SYSTEM OF PHOTOSYSTEM II) (OEC 16 KDA SUBUNIT) pir\|\|S00008 photosystem II oxygen-evolving complex protein 3 precursor - spinach emb\|CAA29056.1\| (X05512) 16 kDa protein of the photosynthetic oxygen- evolving protein (OEC) [Spinacia oleracea] prf\|\|1307179B luminal protein 16kD [Spinacia oleracea] |
| 103560 (638 letters) | 3e-41 | >pir\|\|T04014 hypothetical protein F17A8.20 - Arabidopsis thaliana emb\|CAB39634.1\| (AL049482) AX110P-like protein [Arabidopsis thaliana] emb\|CAB78090.1\| (AL161515) AX110P-like protein [Arabidopsis thaliana] |
| 103619 (657 letters) | 6e-66 | >gb\|AAD43561.1\|AF155124_1 (AF155124) bacterial-induced peroxidase precursor [Gossypium hirsutum] |
| 103718 (567 letters) | 9e-42 | >dbj\|BAB13710.1\| (AB040409) elicitor resposible protein [Nicotiana tabacum] |
| 103752 (571 letters) | 5e-95 | >gb\|AAF18254.1\|AC011438_16 (AC011438) T23G18.6 [Arabidopsis thaliana] |
| 104065 (636 letters) | 4e-12 | >pir\|\|T02630 hypothetical protein T19L18.26 - Arabidopsis thaliana gb\|AAC31242.1\| (AC004747) unknown protein [Arabidopsis thaliana] |
| 104067 (608 letters) | 2e-76 | >dbj\|BAB08673.1\| (AB018109) gb\|AAF03497.1~gene_id:K17N15.12~similar to unknown protein [Arabidopsis thaliana] |

FIG. 3

| Query Contig ID (length, bp) | Pz Score | Result |
|---|---|---|
| 104254 (654 letters) | 4e-71 | >sp\|P11105\|H32_MEDSA HISTONE H3.2, MINOR pir\|\|S24346 histon H3 protein [similarity] - Arabidopsis thaliana emb\|CAA42957.1\| (X60429) histone H3.3 like protein [Arabidopsis thaliana] emb\|CAA42958.1\| (X60429) histone H3.3 like protein [Arabidopsis thaliana] gb\|AAB49538.1\| (U09458) histone H3.2 [Medicago sativa] gb\|AAB36493.1\| (U09460) histone H3.2 [Medicago sativa] gb\|AAB36494.1\| (U09461) histone H3.2 [Medicago sativa] gb\|AAB36497.1\| (U09464) histone H3.2 [Medicago sativa] gb\|AAB36498.1\| (U09465) histone H3.2 [Medicago sativa] emb\|CAA56153.1\| (X79714) histone H3 [Lolium temulentum] emb\|CAA58445.1\| (X83422) histone H3 variant H3.3 [Lycopersicon esculentum] gb\|AAB97162.1\| (AF024716) histone 3 [Gossypium hirsutum] dbj\|BAA31218.1\| (AB015760) histone H3 [Nicotiana tabacum] gb\|AAC78105.1\| (AF093633) histone H3 [Oryza sativa] gb\|AAC97380.1\| (AF109910) histone H3 [Porteresia coarctata] emb\|CAB38916.1\| (AL035708) histone H3.3 [Arabidopsis thaliana] emb\|CAB38917.1\| (AL035708) Histon H3 [Arabidopsis thaliana] dbj\|BAA84794.1\| (AP000559) EST D15300(C0425) corresponds to a region of the predicted gene.; Similar to histone H3 (AB015760) [Oryza sativa] emb\|CAB80666.1\| (AL161596) histone H3.3 [Arabidopsis thaliana] emb\|CAB80667.1\| (AL161596) Histon H3 [Arabidopsis thaliana] emb\|CAB96853.1\| (AL365234) histon H3 protein [Arabidopsis thaliana] gb\|AAK60325.1\|AF385735_1 (AF385735) AT4g40030/T5J17_200 [Arabidopsis thaliana] |
| 104407 (403 letters) | 3e-18 | >pir\|\|S65081 wound-induced protein Sn-1, vacuolar membrane - pepper emb\|CAA55812.1\| (X79230) Sn-1 [Capsicum annuum] |
| 104475 Contig A (520 letters) | 2e-16 | >gb\|AAF91284.1\|AF233527_1 (AF233527) DNA ligase IV [Arabidopsis thaliana] |
| 104702 (643 letters) | 1e-31 | >dbj\|BAB01933.1\| (AP001312) gene_id:MYF5.3~similar to unknown protein~sp\|P49224 [Arabidopsis thaliana] |
| 104765 (598 letters) | 2e-14 | >dbj\|BAB01033.1\| (AB022220) emb\|CAB36798.1~gene_id:MLN21.6~strong similarity to unknown protein [Arabidopsis thaliana] |
| 104768 (667 letters) | e-100 | >gb\|AAF07846.1\|AC010871_22 (AC010871) putative aminotransferase [Arabidopsis thaliana] |
| 104790 (699 letters) | e-122 | >pir\|\|T01931 adenylyl cyclase - common tobacco gb\|AAB87670.1\| (AF026389) adenyl cyclase [Nicotiana tabacum] |
| 105019 (628 letters) | 2e-81 | >gb\|AAG51064.1\|AC069472_4 (AC069472) 5,10-methylenetetrahydrofolate dehydrogenase:5,10-methenyltetrahydrofolate cyclohydrolase, putative; 44272-46007 [Arabidopsis thaliana] |

FIG. 3 continued

| Query Contig ID (length, bp) | Pz Score | Result |
|---|---|---|
| 105143 (553 letters) | 7e-42 | >pir\|\|S41771 glycine-rich RNA-binding protein RGP-1a - wood tobacco dbj\|BAA03741.1\| (D16204) RNA-binding glycine-rich protein-1 (RGP-1a) [Nicotiana sylvestris] |
| 105154 (501 letters) | 7e-57 | >pir\|\|T06416 cysteine proteinase (EC 3.4.22.-) precursor - tomato emb\|CAA05894.1\| (AJ003137) CYP1 [Lycopersicon esculentum] gb\|AAD48496.1\|AF172856_1 (AF172856) cysteine protease TDI-65 [Lycopersicon esculentum] |
| 105271 (610 letters) | 6e-44 | >dbj\|BAB09669.1\| (AB005237) DnaJ-like protein [Arabidopsis thaliana] |
| 105272 (629 letters) | e-118 | >sp\|P50218\|IDHC_TOBAC ISOCITRATE DEHYDROGENASE [NADP] (OXALOSUCCINATE DECARBOXYLASE) (IDH) (NADP+-SPECIFIC ICDH) (IDP) pir\|\|S65065 isocitrate dehydrogenase (NADP+) (EC 1.1.1.42), cytosolic - common tobacco emb\|CAA54912.1\| (X77944) isocitrate dehydrogenase (NADP+) [Nicotiana tabacum] |
| 105377 (610 letters) | e-109 | >gb\|AAD30173.1\|AF148448_1 (AF148448) polyubiquitin [Sporobolus stapfianus] |
| 105405 (652 letters) | e-112 | >sp\|P30173\|ACTD_SOLTU ACTIN 101 pir\|\|S20093 actin 101 - potato emb\|CAA39281.1\| (X55752) actin [Solanum tuberosum] |
| 107421 (465 letters) | 7e-44 | >dbj\|BAA97221.1\| (AB022221) gene_id:MSD23.5~pir\|\|C71447~similar to unknown protein [Arabidopsis thaliana] |
| 107594 (669 letters) | e-101 | >sp\|Q9ZRR5\|TBA3_HORVU TUBULIN ALPHA-3 CHAIN emb\|CAA10663.1\| (AJ132399) alpha-tubulin 3 [Hordeum vulgare] |
| 108256 (620 letters) | 2e-43 | >dbj\|BAA76516.1\| (AB016808) HR7 [Hyoscyamus niger] |
| 108358 (634 letters) | 8e-40 | >dbj\|BAB16428.1\| (AB041516) P-rich protein EIG-I30 [Nicotiana tabacum] |
| 108404 (554 letters) | 3e-28 | >dbj\|BAB10606.1\| (AB005243) protease-like protein [Arabidopsis thaliana] |
| 109191 (505 letters) | 3e-12 | >gb\|AAG49896.1\| (AF303458) PnFL-2 [Ipomoea nil] |
| 109274 (588 letters) | 5e-09 | >emb\|CAA05625.1\| (AJ002584) AtMRP4 [Arabidopsis thaliana] gb\|AAC63634.1\| (AC005309) glutathione-conjugate transporter AtMRP4 [Arabidopsis thaliana] gb\|AAF68441.1\|AF243509_1 (AF243509) MRP4 [Arabidopsis thaliana] |
| 109329 (566 letters) | 5e-43 | >pir\|\|T45914 60S RIBOSOMAL PROTEIN L36 homolog - Arabidopsis thaliana emb\|CAB88336.1\| (AL132960) 60S RIBOSOMAL PROTEIN L36 homolog [Arabidopsis thaliana] |
| 109411 (594 letters) | 6e-56 | >emb\|CAA71175.1\| (Y10086) putative dehydrogenase [Arabidopsis thaliana] |
| 109420 (633 letters) | e-120 | >sp\|Q40401\|CRTC_NICPL CALRETICULIN PRECURSOR pir\|\|T16968 calreticulin call - curled-leaved tobacco emb\|CAA95999.1\| (Z71395) calreticulin [Nicotiana plumbaginifolia] |

FIG. 3 continued

| Query Contig ID (length, bp) | Pz Score | Result |
|---|---|---|
| 109513 (562 letters) | 2e-76 | >gb\|AAK27802.1\|AC022457_5 (AC022457) 60S ribosomal protein L17 [Oryza sativa] |
| 109523 (590 letters) | e-102 | >pir\|\|S44373 phosphoglycerate mutase (EC 5.4.2.1), 2, 3-bisphosphoglycerate-independent - common tobacco |
| 110965 (504 letters) | 1e-55 | >sp\|P31542\|CLAB_LYCES ATP-DEPENDENT CLP PROTEASE ATP-BINDING SUBUNIT CLPA HOMOLOG CD4B PRECURSOR pir\|\|B35905 endopeptidase Clp ATP-binding chain B precursor, chloroplast - tomato gb\|AAA34161.1\| (M32604) ATP-dependent protease (CD4B) [Lycopersicon esculentum] |
| 111075 (526 letters) | 2e-41 | >pir\|\|S41771 glycine-rich RNA-binding protein RGP-1a - wood tobacco dbj\|BAA03741.1\| (D16204) RNA-binding glycine-rich protein-1 (RGP-1a) [Nicotiana sylvestris] |
| 111108 (317 letters) | 1e-13 | >gb\|AAD46036.1\|AC007519_21 (AC007519) Contains similarity to gb\|M74161 inositol polyphosphate 5-phosphatase from Homo sapiens and contains a PF\|00783 inositol polyphosphate phosphatase catalytic domain. [Arabidopsis thaliana] |
| 111175 (620 letters) | 5e-49 | >gb\|AAD30223.1\|AC007202_5 (AC007202) Is a member of the PF\|00044 glyceraldehyde 3-phosphate dehydrogenase family. ESTs gb\|T43985, gb\|N38667, gb\|N65037, gb\|AA713069 and gb\|AI099548 come from this gene. [Arabidopsis thaliana] gb\|AAK15554.1\|AF348583_1 (AF348583) putatve glyceraldehyde 3-phosphate dehydrogenase protein [Arabidopsis thaliana] |
| 111223 (610 letters) | e-100 | >gb\|AAB28813.2\| (S66866) cytochrome c1 precursor [Solanum tuberosum] |
| 111277 (539 letters) | 3e-62 | >sp\|Q41249\|PORA_CUCSA PROTOCHLOROPHYLLIDE REDUCTASE, CHLOROPLAST PRECURSOR (PCR) (NADPH-PROTOCHLOROPHYLLIDE OXIDOREDUCTASE) (POR) pir\|\|JC4146 protochlorophyllide reductase (EC 1.3.1.33) precursor - cucumber dbj\|BAA21089.1\| (D50085) NADPH-protochlorophyllide oxidoreductase [Cucumis sativus] |
| 111358 (559 letters) | 2e-58 | >sp\|P19950\|R141_MAIZE 40S RIBOSOMAL PROTEIN S14 (CLONE MCH1) pir\|\|A30097 ribosomal protein S14 (clone MCH1) - maize |
| 111437 (623 letters) | 5e-60 | >sp\|Q9ZRI7\|EF1G_ORYSA ELONGATION FACTOR 1-GAMMA (EF-1-GAMMA) (EEF-1B GAMMA) dbj\|BAA34206.1\| (D89802) elongation factor 1B gamma [Oryza sativa] |
| 111469 (516 letters) | 5e-47 | >dbj\|BAB01784.1\| (AB022215) hydroxyproline-rich glycoprotein [Arabidopsis thaliana] |
| 111751 (514 letters) | 1e-14 | >gb\|AAF04454.1\|AF000966_1 (AF000966) chitinase [Poa pratensis] |
| 111752 (528 letters) | 1e-44 | >pir\|\|T49304 hypothetical protein T16L24.180 - Arabidopsis thaliana emb\|CAB75460.1\| (AL138659) putative protein [Arabidopsis thaliana] |

FIG. 3 continued

| Query Contig ID (length, bp) | Pz Score | Result |
|---|---|---|
| 111758 (645 letters) | 2e-66 | >emb\|CAC33768.1\| (AJ308570) S-adenosyl-L-methionine:salicylic acid carboxyl methyltransferase [Stephanotis floribunda] |
| 113170 (644 letters) | 4e-84 | >sp\|P21568\|CYPH_LYCES PEPTIDYL-PROLYL CIS-TRANS ISOMERASE (PPIASE) (ROTAMASE) (CYCLOPHILIN) (CYCLOSPORIN A-BINDING PROTEIN) gb\|AAA63543.1\| (M55019) cyclophilin [Lycopersicon esculentum] |
| 113595 (596 letters) | 6e-45 | >pir\|\|T01726 hypothetical protein A_IG002N01.18 - Arabidopsis thaliana gb\|AAB61025.1\| (AF007269) A_IG002N01.18 gene product [Arabidopsis thaliana] emb\|CAB80924.1\| (AL161491) hypothetical protein [Arabidopsis thaliana] gb\|AAK63864.1\|AF389292_1 (AF389292) AT4g01150/F2N1_18 [Arabidopsis thaliana] |
| 114370 (596 letters) | 3e-44 | >sp\|O22582\|H2B_GOSHI HISTONE H2B pir\|\|T09722 histone H2B1 - upland cotton gb\|AAB97163.1\| (AF025667) histone H2B1 [Gossypium hirsutum] |
| 114380 (614 letters) | 9e-77 | >dbj\|BAB08802.1\| (AB011482) xylose isomerase [Arabidopsis thaliana] |
| 114404 (624 letters) | 4e-93 | >emb\|CAB45387.1\| (AJ006974) NAD-malate dehydrogenase [Nicotiana tabacum] |
| 114417 (619 letters) | 4e-32 | >dbj\|BAB41197.1\| (AB060000) hypothetical protein [Glycine max] |
| 120342 (637 letters) | e-103 | >sp\|Q00497\|AROK_LYCES SHIKIMATE KINASE PRECURSOR pir\|\|S21584 shikimate kinase (EC 2.7.1.71) precursor - tomato emb\|CAA45121.1\| (X63560) shikimate kinase precursor [Lycopersicon esculentum] |
| 120557 (596 letters) | 8e-24 | >pir\|\|T00451 hypothetical protein T14N5.8 - Arabidopsis thaliana gb\|AAC34348.1\| (AC004260) Unknown protein [Arabidopsis thaliana] |
| 17661 Contig A (860 letters) | e-123 | >pir\|\|T05524 hypothetical protein F13M23.170 - Arabidopsis thaliana emb\|CAB36745.1\| (AL035523) putative protein [Arabidopsis thaliana] emb\|CAB79412.1\| (AL161562) putative protein [Arabidopsis thaliana] |
| 17661 Contig B (350 letters) | 6e-41 | >gb\|AAG40013.1\|AF324662_1 (AF324662) AT4g38460 [Arabidopsis thaliana] |
| 17884 Contig B (715 letters) | 2e-81 | >dbj\|BAA94980.1\| (AB026636) gb\|AAF26101.1~gene_id:K14A17.9~similar to unknown protein [Arabidopsis thaliana] gb\|AAK55691.1\|AF378888_1 (AF378888) AT3g17020/K14A17_14 [Arabidopsis thaliana] |
| 23558 (744 letters) | 2e-88 | >gb\|AAG51710.1\|AC066689_9 (AC066689) unknown protein; 62092-56687 [Arabidopsis thaliana] |
| 23777 (559 letters) | 4e-08 | >pir\|\|T05857 hypothetical protein T29A15.10 - Arabidopsis thaliana emb\|CAB38264.1\| (AL035602) putative protein [Arabidopsis thaliana] emb\|CAB81402.1\| (AL161571) putative protein [Arabidopsis thaliana] gb\|AAG40387.1\|AF325035_1 (AF325035) AT4g27520 [Arabidopsis thaliana] |

FIG. 3 continued

| Query Contig ID (length, bp) | Pz Score | Result |
|---|---|---|
| 25975 (450 letters) | 5e-42 | >pir\|\|T06105 GTP-binding protein GB3 - Arabidopsis thaliana emb\|CAB38912.1\| (AL035708) GTP-binding protein GB3 [Arabidopsis thaliana] emb\|CAB80662.1\| (AL161596) GTP-binding protein GB3 [Arabidopsis thaliana] |
| 2658 Contig A (1026 letters) | e-157 | >gb\|AAG52354.1\|AC011765_6 (AC011765) unknown protein; 121665-123450 [Arabidopsis thaliana] |
| 26650 (510 letters) | 1e-58 | >sp\|O23290\|RL44_ARATH 60S RIBOSOMAL PROTEIN L44 pir\|\|A71405 ribosomal protein L36a.e, cytosolic - Arabidopsis thaliana emb\|CAB10211.1\| (Z97336) ribosomal protein [Arabidopsis thaliana] emb\|CAB78474.1\| (AL161538) ribosomal protein [Arabidopsis thaliana] dbj\|BAB02283.1\| (AB015474) 60S ribosomal protein L44-like [Arabidopsis thaliana] |
| 2696 (884 letters) | e-103 | >gb\|AAC62208.1\| (AF047975) putative ethylene receptor; ETR2 [Arabidopsis thaliana] |
| 27245 (895 letters) | e-144 | >gb\|AAB41235.1\| (U83500) cystathionine gamma-synthase [Arabidopsis thaliana] dbj\|BAA24699.1\| (AB010888) cystathionine gamma-synthase [Arabidopsis thaliana] gb\|AAF26162.1\|AC008261_19 (AC008261) putative cystathionine gamma-synthase [Arabidopsis thaliana] |
| 27429 (1071 letters) | e-124 | >gb\|AAF35403.1\| (AC024081) putative expansin S2 precursor [Arabidopsis thaliana] |
| 27507 (1164 letters) | 0.0 | >emb\|CAA70035.1\| (Y08782) peroxidase ATP23a [Arabidopsis thaliana] gb\|AAG51588.1\|AC011665_9 (AC011665) peroxidase ATP23a [Arabidopsis thaliana] gb\|AAG52033.1\|AC011914_3 (AC011914) peroxidase ATP23a; 12312-13683 [Arabidopsis thaliana] |
| 3033 (1237 letters) | 0.0 | >gb\|AAD26872.1\|AC007230_6 (AC007230) EST gb\|T22166 comes from this gene. [Arabidopsis thaliana] |
| 30367 (752 letters) | e-111 | >gb\|AAD30579.1\|AC007260_10 (AC007260) Similar to dTDP-D-glucose 4,6-dehydratase [Arabidopsis thaliana] gb\|AAK68773.1\| (AY042833) Similar to dTDP-D-glucose 4,6-dehydratase [Arabidopsis thaliana] |
| 30518 (812 letters) | e-106 | >pir\|\|T49897 transcription factor-like protein - Arabidopsis thaliana emb\|CAB87947.1\| (AL163912) transcription factor-like protein [Arabidopsis thaliana] dbj\|BAB11436.1\| (AB010070) transcription factor-like protein [Arabidopsis thaliana] |
| 30548 (415 letters) | 2e-13 | >sp\|O04719\|P2C2_ARATH PROTEIN PHOSPHATASE 2C ABI2 (PP2C) emb\|CAA70163.1\| (Y08966) ABI2 protein phosphatase 2C [Arabidopsis thaliana] emb\|CAA70162.1\| (Y08965) ABI2 protein phosphatase 2C [Arabidopsis thaliana] emb\|CAA72538.1\| (Y11840) ABI2 [Arabidopsis thaliana] dbj\|BAA97035.1\| (AB024035) protein phosphatase 2C ABI2 (PP2C) [Arabidopsis thaliana] |

FIG. 3 continued

| Query Contig ID (length, bp) | Pz Score | Result |
|---|---|---|
| 3054 (912 letters) | e-108 | >gb\|AAF08579.1\|AC011623_12 (AC011623) putative dehydroquinase shikimate dehydrogenase [Arabidopsis thaliana] |
| 3442 (667 letters) | 1e-94 | >pir\|\|T14077 peroxidase (EC 1.11.1.7) ATP8a - Arabidopsis thaliana emb\|CAA67361.1\| (X98855) peroxidase ATP8a [Arabidopsis thaliana] emb\|CAB52461.1\| (AL109796) peroxidase ATP8a [Arabidopsis thaliana] emb\|CAB81010.1\| (AL161576) peroxidase ATP8a [Arabidopsis thaliana] gb\|AAK44099.1\|AF370284_1 (AF370284) putative peroxidase ATP8a [Arabidopsis thaliana] |
| 35605 (529 letters) | 1e-31 | >sp\|Q9XI01\|PDI1_ARATH PROBABLE PROTEIN DISULFIDE ISOMERASE 1 PRECURSOR (PDI) gb\|AAD41430.1\|AC007727_19 (AC007727) Similar to gb\|Z11499 protein disulfide isomerase from Medicago sativa. ESTs gb\|AI099693, gb\|R65226, gb\|AA657311, gb\|T43068, gb\|T42754, gb\|T14005, gb\|T76445, gb\|H36733, gb\|T43168 and gb\|T20649 come from this gene. [Arabidopsis thaliana] gb\|AAK59601.1\| (AY035096) putative disulfide isomerase [Arabidopsis thaliana] |
| 36009 Contig A (773 letters) | 5e-81 | >sp\|P77713\|YAGH_ECOLI PUTATIVE BETA-XYLOSIDASE (1,4-BETA-D-XYLAN XYLOHYDROLASE) (XYLAN 1,4-BETA-XYLOSIDASE) pir\|\|G64752 xylan 1,4-beta-xylosidase (EC 3.2.1.37) - Escherichia coli gb\|AAB08692.1\| (U70214) similar to xylan 1,4-beta-xylosidase of Bacillus [Escherichia coli] gb\|AAC73374.1\| (AE000135) putative beta-xylosidase (EC 3.2.1.37) [Escherichia coli K12] |
| 36009 Contig B (746 letters) | 2e-71 | >sp\|P77713\|YAGH_ECOLI PUTATIVE BETA-XYLOSIDASE (1,4-BETA-D-XYLAN XYLOHYDROLASE) (XYLAN 1,4-BETA-XYLOSIDASE) pir\|\|G64752 xylan 1,4-beta-xylosidase (EC 3.2.1.37) - Escherichia coli gb\|AAB08692.1\| (U70214) similar to xylan 1,4-beta-xylosidase of Bacillus [Escherichia coli] gb\|AAC73374.1\| (AE000135) putative beta-xylosidase (EC 3.2.1.37) [Escherichia coli K12] |
| 36204 (341 letters) | 4e-21 | >sp\|P42731\|PAB2_ARATH POLYADENYLATE-BINDING PROTEIN 2 (POLY(A) BINDING PROTEIN 2) (PABP 2) pir\|\|T05425 polyadenylate-binding protein F28A23.130 - Arabidopsis thaliana gb\|AAA61780.1\| (L19418) poly(A)-binding protein [Arabidopsis thaliana] emb\|CAA17561.1\| (AL021961) poly(A)-binding protein [Arabidopsis thaliana] emb\|CAB80128.1\| (AL161584) poly(A)-binding protein [Arabidopsis thaliana] |
| 36934 (738 letters) | 2e-93 | >pir\|\|T51841 RING-H2 finger protein RHA1b [imported] - Arabidopsis thaliana gb\|AAC68670.1\| (AF078821) RING-H2 finger protein RHA1b [Arabidopsis thaliana] |

FIG. 3 continued

| Query Contig ID (length, bp) | Pz Score | Result |
|---|---|---|
| 37131 (330 letters) | 3e-32 | >sp\|P43082\|HEVL_ARATH HEVEIN-LIKE PROTEIN PRECURSOR gb\|AAA20642.1\| (U01880) pre-hevein-like protein [Arabidopsis thaliana] gb\|AAF04912.1\|AC011437_27 (AC011437) hevein-like protein precursor [Arabidopsis thaliana] gb\|AAK48963.1\|AF370536_1 (AF370536) hevein-like protein precursor [Arabidopsis thaliana] |
| 38707 (705 letters) | 1e-72 | >dbj\|BAA96968.1\| (AB020745) gene_id:MJE7.12-unknown protein [Arabidopsis thaliana] |
| 39086 (1058 letters) | e-177 | >gb\|AAB81674.1\| (AC002354) unknown protein [Arabidopsis thaliana] |
| 42037 (180 letters) | 8e-12 | >gb\|AAA34116.1\| (M32419) ribulose-1,5-bisphosphate carboxylase small subunit [Nicotiana tabacum] |
| 43460 Contig A (636 letters) | 2e-87 | >gb\|AAF19827.1\|AF202771_1 (AF202771) RUB1 conjugating enzyme [Arabidopsis thaliana] gb\|AAK82473.1\| (AY048210) AT4g36800/C7A10_560 [Arabidopsis thaliana] |
| 44067 Contig A (569 letters) | 2e-51 | >gb\|AAK43855.1\|AF370478_1 (AF370478) Unknown protein [Arabidopsis thaliana] |
| 44139 Contig A (327 letters) | 7e-10 | >gb\|AAB71965.1\| (AC002292) Similar to ATP-citrate-lyase [Arabidopsis thaliana] |
| 44139 Contig B (328 letters) | 3e-06 | >gb\|AAB71965.1\| (AC002292) Similar to ATP-citrate-lyase [Arabidopsis thaliana] |
| 44146 Contig A (600 letters) | 4e-29 | >pir\|\|S67499 glutamate synthase (ferredoxin) (EC 1.4.7.1) (clone C(35)) - common tobacco (fragment) |
| 44146 Contig B (339 letters) | 2e-08 | >pir\|\|T03933 SAR8.2m protein, TMV-inducible - common tobacco gb\|AAB49767.1\| (U89604) SAR8.2m gene product [Nicotiana tabacum] dbj\|BAB13709.1\| (AB040408) elicitor inducible protein [Nicotiana tabacum] |
| 44189 (587 letters) | 8e-62 | >sp\|Q40519\|PSBR_TOBAC PHOTOSYSTEM II 10 KD POLYPEPTIDE PRECURSOR (PII10) pir\|\|S32021 photosystem II 10K protein - common tobacco emb\|CAA49693.1\| (X70088) NtpII10 [Nicotiana tabacum] |
| 44503 (593 letters) | 2e-15 | >sp\|P20076\|IER1_LYCES ETHYLENE-RESPONSIVE PROTEINASE INHIBITOR I PRECURSOR pir\|\|A32067 ethylene-responsive proproteinase inhibitor I precursor - tomato gb\|AAA60745.1\| (J04099) proteinase inhibitor I [Lycopersicon esculentum] |
| 44508 (532 letters) | 3e-47 | >emb\|CAB79706.1\| (AL161575) putative protein [Arabidopsis thaliana] gb\|AAG41471.1\|AF326889_1 (AF326889) unknown protein [Arabidopsis thaliana] gb\|AAK00388.1\|AF339706_1 (AF339706) unknown protein [Arabidopsis thaliana] gb\|AAK62642.1\| (AY039587) AT4g29480/F17A13_300 [Arabidopsis thaliana] |
| 44558 Contig A (545 letters) | 7e-20 | >gb\|AAK50064.1\|AF372924_1 (AF372924) At1g69210/F4N2_11 [Arabidopsis thaliana] |
| 4743 (578 letters) | 4e-53 | >pir\|\|T48975 xyloglucan endo-transglycosylase - Arabidopsis thaliana emb\|CAB89314.1\| (AL353992) xyloglucan endo-transglycosylase [Arabidopsis thaliana] |

FIG. 3 continued

| Query Contig ID (length, bp) | Pz Score | Result |
|---|---|---|
| 4837 Contig A (349 letters) | 4e-53 | >sp\|P04778\|CB22_ARATH CHLOROPHYLL A-B BINDING PROTEIN 2 PRECURSOR (LHCII TYPE I CAB-2) (CAB-140) (LHCP) emb\|CAA27543.1\| (X03909) chlorophyll a/b binding protein (LHCP AB 140) [Arabidopsis thaliana] gb\|AAG10603.1\|AC008030_3 (AC008030) Putative chlorophyll a/b-binding protein [Arabidopsis thaliana] gb\|AAK74031.1\| (AY045673) At1g29930/F1N18_23 [Arabidopsis thaliana] |
| 4837 Contig B (1298 letters) | 4e-82 | >gb\|AAA16570.1\| (L15449) auxin-responsive protein [Arabidopsis thaliana] dbj\|BAB02094.1\| (AB026655) auxin-responsive protein IAA2-like [Arabidopsis thaliana] gb\|AAG48756.1\|AF332392_1 (AF332392) IAA2 [Arabidopsis thaliana] |
| 48458 Contig B (614 letters) | 3e-59 | >dbj\|BAB01758.1\| (AP000603) gb\|AAC16072.1~gene_id:MRP15.17~strong similarity to unknown protein [Arabidopsis thaliana] |
| 4845 Contig B (621 letters) | 7e-58 | >pir\|\|T47667 ribosomal L23a-like protein - Arabidopsis thaliana emb\|CAB75762.1\| (AL132954) ribosomal L23a-like protein [Arabidopsis thaliana] |
| 48602 (608 letters) | 1e-66 | >gb\|AAF14683.1\|AC011713_31 (AC011713) Is a member of the PF\|01553 Acyltransferase family. [Arabidopsis thaliana] |
| 51719 (1081 letters) | e-160 | >gb\|AAD37122.1\|AF129511_1 (AF129511) very-long-chain fatty acid condensing enzyme CUT1 [Arabidopsis thaliana] gb\|AAG52390.1\|AC011915_4 (AC011915) very-long-chain fatty acid condensing enzyme (CUT1); 56079-54227 [Arabidopsis thaliana] |
| 51843 Contig A (739 letters) | e-132 | >dbj\|BAA34687.1\| (AB016819) UDP-glucose glucosyltransferase [Arabidopsis thaliana] gb\|AAF87256.1\|AC068562_3 (AC068562) Identical to UDP-glucose glucosyltransferase from Arabidopsis thaliana gb\|AB016819 and contains a UDP-glucosyl transferase PF\|00201 domain. ESTs gb\|T46254, gb\|R83990, gb\|H37246, gb\|W43072, gb\|R90721, gb\|R90712, gb\|AA712612, gb\|AA404770 come> gb\|AAG48781.1\|AF332418_1 (AF332418) putative UDP-glucose glucosyltransferase protein [Arabidopsis thaliana] |
| 51843 Contig B (753 letters) | e-110 | >dbj\|BAA34687.1\| (AB016819) UDP-glucose glucosyltransferase [Arabidopsis thaliana] gb\|AAF87256.1\|AC068562_3 (AC068562) Identical to UDP-glucose glucosyltransferase from Arabidopsis thaliana gb\|AB016819 and contains a UDP-glucosyl transferase PF\|00201 domain. ESTs gb\|T46254, gb\|R83990, gb\|H37246, gb\|W43072, gb\|R90721, gb\|R90712, gb\|AA712612, gb\|AA404770 come> gb\|AAG48781.1\|AF332418_1 (AF332418) putative UDP-glucose glucosyltransferase protein [Arabidopsis thaliana] |

FIG. 3 continued

| Query Contig ID (length, bp) | Pz Score | Result |
|---|---|---|
| 52689 (562 letters) | 3e-90 | >gb\|AAG51522.1\|AC051631_2 (AC051631) lipoamide dehydrogenase, putative; 44693-46402 [Arabidopsis thaliana] gb\|AAF34795.3\|AF228639_1 (AF228639) lipoamide dehydrogenase precursor [Arabidopsis thaliana] |
| 53369 (476 letters) | 7e-15 | >gb\|AAK11720.1\| (AY026254) sugar-porter family protein 1 [Arabidopsis thaliana] |
| 53564 (802 letters) | 2e-99 | >gb\|AAF24959.1\|AC012375_22 (AC012375) T22C5.18 [Arabidopsis thaliana] |
| 57119 (507 letters) | 3e-42 | >gb\|AAG17888.1\| (AF295339) dihydrolipoamide dehydrogenase precursor [Solanum tuberosum] |
| 57135 (634 letters) | 1e-96 | >pir\|\|T14735 probable serine/threonine kinase (EC 2.7.1.-) SNFL1 - sorghum emb\|CAA73067.1\| (Y12464) serine/threonine kinase [Sorghum bicolor] |
| 57152 (632 letters) | e-120 | >emb\|CAB71293.1\| (AJ250378) chloroplast ferredoxin-NADP+ oxidoreductase precursor [Capsicum annuum] |
| 57194 (640 letters) | 3e-75 | >sp\|P35135\|UBC4_LYCES UBIQUITIN-CONJUGATING ENZYME E2-17 KD (UBIQUITIN-PROTEIN LIGASE) (UBIQUITIN CARRIER PROTEIN) gb\|AAA34125.1\| (L23762) ubiquitin carrier protein [Lycopersicon esculentum] |
| 57510 (541 letters) | 5e-48 | >gb\|AAG52123.1\|AC010556_5 (AC010556) putative transcription factor BTF3 (RNA polymerase B transcription factor 3); 26343-27201 [Arabidopsis thaliana] gb\|AAK44068.1\|AF370253_1 (AF370253) putative RNA polymerase B transcription factor 3 [Arabidopsis thaliana] |
| 57702 Contig A (363 letters) | 8e-25 | >pir\|\|T01345 hypothetical protein F6N15.21 - Arabidopsis thaliana gb\|AAC19312.1\| (AF069299) contains similarity to Medicago sativa corC (GB:L22305) [Arabidopsis thaliana] emb\|CAB80775.1\| (AL161471) putative proline-rich protein [Arabidopsis thaliana] |
| 57702 Contig B (199 letters) | 6e-18 | >pir\|\|T01345 hypothetical protein F6N15.21 - Arabidopsis thaliana gb\|AAC19312.1\| (AF069299) contains similarity to Medicago sativa corC (GB:L22305) [Arabidopsis thaliana] emb\|CAB80775.1\| (AL161471) putative proline-rich protein [Arabidopsis thaliana] |
| 57708 (468 letters) | 1e-35 | >gb\|AAC04901.1\| (AC002334) unknown protein [Arabidopsis thaliana] |
| 6025 (641 letters) | 2e-64 | >pir\|\|T12992 ribosomal protein S20, cytosolic - Arabidopsis thaliana emb\|CAB51209.1\| (AL096860) 40S RIBOSOMAL PROTEIN S20 homolog [Arabidopsis thaliana] |
| 6153 (809 letters) | e-104 | >pir\|\|T04685 hypothetical protein F4B14.20 - Arabidopsis thaliana emb\|CAA20045.1\| (AL031135) putative protein [Arabidopsis thaliana] emb\|CAB81484.1\| (AL161588) putative protein [Arabidopsis thaliana] |
| 6198 (638 letters) | 1e-07 | >gb\|AAF64549.1\|AF110986_1 (AF110986) proline-rich protein 2 [Arabidopsis thaliana] |

FIG. 3 continued

| Query Contig ID (length, bp) | Pz Score | Result |
|---|---|---|
| 6437 (1160 letters) | e-118 | >emb\|CAB80904.1\| (AL161491) putative protein [Arabidopsis thaliana] |
| 6477 (750 letters) | 1e-94 | >dbj\|BAB02979.1\| (AP000600) glycolate oxidase [Arabidopsis thaliana] |
| 6606 (1013 letters) | e-141 | >gb\|AAC64298.1\| (AC004450) 3-isopropylmalate dehydratase, small subunit [Arabidopsis thaliana] gb\|AAK59662.1\| (AY035158) putative 3-isopropylmalate dehydratase small subunit [Arabidopsis thaliana] |
| 6681 (607 letters) | 4e-52 | >gb\|AAF99850.1\|AC051629_17 (AC051629) Unknown protein [Arabidopsis thaliana] gb\|AAK83582.1\| (AY049240) F17F16.8/F17F16.8 [Arabidopsis thaliana] |
| 6682 (1120 letters) | e-142 | >gb\|AAF36686.1\|AF225920_1 (AF225920) secretory carrier membrane protein [Arabidopsis thaliana] gb\|AAK76462.1\| (AY045788) putative secretory carrier membrane protein [Arabidopsis thaliana] |
| 6686 (909 letters) | e-106 | >dbj\|BAB60911.1\| (AP003213) putative 26S proteasome subunit [Oryza sativa] |
| 6717 (722 letters) | 2e-68 | >pir\|\|T49151 transcription coactivator-like protein - Arabidopsis thaliana emb\|CAB88285.1\| (AL353032) transcriptional coactivator-like protein [Arabidopsis thaliana] gb\|AAG40068.1\|AF324717_1 (AF324717) AT3g58680 [Arabidopsis thaliana] gb\|AAG41491.1\|AF326909_1 (AF326909) transcriptional coactivator-like protein [Arabidopsis thaliana] gb\|AAK00410.1\|AF339728_1 (AF339728) putative transcriptional coactivator protein [Arabidopsis thaliana] gb\|AAK68790.1\| (AY042850) transcriptional coactivator-like protein [Arabidopsis thaliana] |
| 7393 (695 letters) | 9e-86 | >gb\|AAF23194.1\|AC016795_7 (AC016795) unknown protein [Arabidopsis thaliana] gb\|AAK59413.1\| (AY034906) unknown protein [Arabidopsis thaliana] |
| 104081 (639 letters) | 6e-61 | >pir\|\|T01617 hypothetical protein F19F24.9 - Arabidopsis thaliana gb\|AAC09037.1\| (AC003673) putative protein kinase [Arabidopsis thaliana] |
| 104711 (492 letters) | 2e-21 | >gb\|AAK21254.1\|AF335241_1 (AF335241) MADS-box transcription factor FBP23 [Petunia x hybrida] |
| 105187 Contig A (597 letters) | 7e-82 | >emb\|CAA69701.1\| (Y08425) small GTP-binding protein [Nicotiana plumbaginifolia] |
| 105187 Contig B (452 letters) | 6e-10 | >emb\|CAA96432.1\| (Z71750) ras-related small GTP-binding protein [Nicotiana plumbaginifolia] |
| 107101 (587 letters) | 1e-82 | >pir\|\|T02370 finger protein BBF1.1 - common tobacco (fragment) emb\|CAA66601.1\| (X97942) Zn finger protein [Nicotiana tabacum] |
| 107642 (524 letters) | 2e-47 | >pir\|\|T12634 homeotic protein - common sunflower gb\|AAA63765.1\| (L22847) HAHB-1 [Helianthus annuus] |
| 108274 (533 letters) | 2e-65 | >pir\|\|T06595 bifunctional folic acid synthesis protein precursor, mitochondrial [validated] - garden pea emb\|CAA69903.1\| (Y08611) dihydropterin pyrophosphokinase /dihydropteroate synthase [Pisum sativum] |

FIG. 3 continued

| Query Contig ID (length, bp) | Pz Score | Result |
|---|---|---|
| 109024 (626 letters) | 7e-80 | >dbj\|BAA74714.1\| (AB015855) transcription factor TEIL [Nicotiana tabacum] |
| 109138 (571 letters) | 3e-27 | >gb\|AAF87143.1\|AC002423_8 (AC002423) T23E23.16 [Arabidopsis thaliana] |
| 109146 (619 letters) | e-118 | >sp\|P41918\|RANA_TOBAC GTP-BINDING NUCLEAR PROTEIN RAN-A1 gb\|AAA73563.1\| (L16767) GTP-binding protein [Nicotiana tabacum] |
| 109175 (625 letters) | 3e-13 | >pir\|\|JE0113 zinc-finger protein S3574 [imported] - rice dbj\|BAA33206.1\| (AB001888) zinc finger protein [Oryza sativa] |
| 109369 (623 letters) | 3e-38 | >gb\|AAF97285.1\|AC010164_7 (AC010164) Hypothetical protein [Arabidopsis thaliana] |
| 109391 (273 letters) | 1e-17 | >gb\|AAB88391.1\| (U89014) early light-induced protein; ELIP [Arabidopsis thaliana] dbj\|BAB01259.1\| (AB022223) early light-inducable protein-like [Arabidopsis thaliana] |
| 110764 (324 letters) | 4e-13 | >gb\|AAC67200.1\| (AC005171) putative retroelement pol polyprotein [Arabidopsis thaliana] |
| 111139 (276 letters) | 8e-42 | >dbj\|BAB08797.1\| (AB011482) Myb-related transcription factor-like protein [Arabidopsis thaliana] |
| 111230 (652 letters) | 8e-90 | >gb\|AAG43549.1\|AF211531_1 (AF211531) Avr9/Cf-9 rapidly elicited protein 111B [Nicotiana tabacum] |
| 111312 (638 letters) | 2e-46 | >gb\|AAF79872.1\|AC000348_25 (AC000348) T7N9.25 [Arabidopsis thaliana] |
| 111758 (645 letters) | 2e-66 | >emb\|CAC33768.1\| (AJ308570) S-adenosyl-L-methionine:salicylic acid carboxyl methyltransferase [Stephanotis floribunda] |
| 112381 (658 letters) | 4e-87 | >gb\|AAF75828.1\|AF116851_1 (AF116851) LIM domain protein PLIM-2 [Nicotiana tabacum] |
| 112417 (638 letters) | 3e-49 | >gb\|AAF79455.1\|AC025808_37 (AC025808) F18O14.3 [Arabidopsis thaliana] |
| 113024 (628 letters) | 2e-50 | >dbj\|BAB09093.1\| (AB025628) contains similarity to CCAAT-box-binding trancription factor-gene_id:MNJ7.26 [Arabidopsis thaliana] |
| 113124 (658 letters) | 5e-46 | >gb\|AAK32770.1\|AF361602_1 (AF361602) AT5g19430/F7K24_180 [Arabidopsis thaliana] |
| 113183 (547 letters) | 8e-39 | >gb\|AAK43890.1\|AF370513_1 (AF370513) Unknown protein [Arabidopsis thaliana] |
| 113742 (628 letters) | 9e-49 | >pir\|\|T02706 hypothetical protein T18E12.13 - Arabidopsis thaliana gb\|AAC34482.1\| (AC005313) putative chloroplast nucleoid DNA-binding protein [Arabidopsis thaliana] |
| 114161 (635 letters) | 1e-32 | >emb\|CAA74049.1\| (Y13721) Transcription factor [Arabidopsis thaliana] |
| 114865 (706 letters) | 2e-15 | >gb\|AAB63826.1\| (AC002337) putative WRKY-type DNA-binding protein [Arabidopsis thaliana] |
| 114926 (558 letters) | 2e-76 | >dbj\|BAB11503.1\| (AB015469) dehydrogenase [Arabidopsis thaliana] |
| 116461 (947 letters) | 1e-69 | >sp\|Q40635\|VATL_ORYSA VACUOLAR ATP SYNTHASE 16 KD PROTEOLIPID SUBUNIT gb\|AAA68175.1\| (U27098) H+-ATPase [Oryza sativa] |

FIG. 3 continued

| Query Contig ID (length, bp) | Pz Score | Result |
|---|---|---|
| 116525 (583 letters) | 2e-67 | >sp\|P36213\|PSAD_HORVU PHOTOSYSTEM I REACTION CENTRE SUBUNIT II PRECURSOR (PHOTOSYSTEM I 20 KD SUBUNIT) (PSI-D) pir\|\|JQ2247 photosystem I chain D precursor - barley gb\|AAA18567.1\| (M98254) PSI-D subunit [Hordeum vulgare] |
| 116686 (671 letters) | 1e-56 | >sp\|P32518\|DUT_LYCES DEOXYURIDINE 5'-TRIPHOSPHATE NUCLEOTIDOHYDROLASE (DUTPASE) (DUTP PYROPHOSPHATASE) (P18) pir\|\|JQ1599 dUTP pyrophosphatase (EC 3.6.1.23) - tomato gb\|AAB22611.1\| (S40549) deoxyuridine triphosphatase, dUTPase, P18 {EC 3.6.1.23} [tomatoes, Tint Tim cultivar LA154, Peptide, 169 aa] [Lycopersicon esculentum] |
| 116692 (532 letters) | 8e-12 | >gb\|AAC99310.1\| (AF052585) CONSTANS-like protein 2 [Malus x domestica] |
| 116784 (631 letters) | 4e-81 | >gb\|AAF79717.1\|AC020889_25 (AC020889) T1N15.3 [Arabidopsis thaliana] gb\|AAD49754.2\|AC007932_2 (AC007932) Contains similarity to 1-aminocyclopropane-1-carboxylate deaminase from Pseudomonas gb\|M73488. ESTs gb\|Z18033 and gb\|Z34214 come from this gene. [Arabidopsis thaliana] |
| 118051 (507 letters) | 2e-72 | >gb\|AAK25936.1\|AF360226_1 (AF360226) putative nuclear DNA-binding protein G2p [Arabidopsis thaliana] |
| 119262 (881 letters) | e-107 | >sp\|Q03662\|GTX1_TOBAC PROBABLE GLUTATHIONE S-TRANSFERASE (AUXIN-INDUCED PROTEIN PGNT1/PCNT110) pir\|\|S16267 auxin-induced protein (clones pGNT1 and pCNT110) - common tobacco emb\|CAA39709.1\| (X56268) auxin-induced protein [Nicotiana tabacum] emb\|CAA39705.1\| (X56264) auxin-induced protein [Nicotiana tabacum] |
| 119350 (1100 letters) | 3e-52 | >pir\|\|T09704 probable arginine/serine-rich splicing factor - alfalfa emb\|CAA76346.1\| (Y16672) putative arginine/serine-rich splicing factor [Medicago sativa] |
| 119915 (661 letters) | 6e-49 | >gb\|AAF88093.1\|AC025417_21 (AC025417) T12C24.22 [Arabidopsis thaliana] |
| 119938 (574 letters) | 2e-17 | >gb\|AAF31170.1\|AF148498_1 (AF148498) unknown [Zea mays] |
| 120147 (616 letters) | 5e-40 | >pir\|\|T02252 high mobility group protein HMG-1 - common tobacco gb\|AAB61215.1\| (AF002226) DNA-binding protein [Nicotiana tabacum] |
| 120161 (613 letters) | 2e-76 | >pir\|\|S26605 myb-related protein 1 - garden petunia emb\|CAA78386.1\| (Z13996) protein 1 [Petunia x hybrida] |
| 120246 (557 letters) | 5e-22 | >gb\|AAB86938.1\| (AF030386) NOI protein [Arabidopsis thaliana] dbj\|BAA97284.1\| (AB018120) NOI protein, nitrate-induced [Arabidopsis thaliana] |

FIG. 3 continued

| Query Contig ID (length, bp) | Pz Score | Result |
|---|---|---|
| 120670 (482 letters) | 9e-23 | >emb\|CAA64819.1\| (X95572) salt-tolerance protein [Arabidopsis thaliana] gb\|AAF80128.1\|AC024174_10 (AC024174) Identical to salt-tolerance protein from Arabidopsis thaliana gb\|X95572 and is a member of the Constans zinc finger family PF\|01760. ESTs gb\|AV526483, gb\|AV527296, gb\|BE038943, gb\|AI995008, gb\|H36917, gb\|BE038755, gb\|N38572, gb\|AV560515, gb> |
| 120859 (568 letters) | 2e-59 | >dbj\|BAA87054.1\| (AB024006) nicotianamine aminotransferase [Hordeum vulgare] |
| 120870 (661 letters) | 1e-68 | >pir\|\|T50838 cyclophilin ROC7 [imported] - Arabidopsis thaliana gb\|AAF05760.1\|AF192490_1 (AF192490) cyclophilin [Arabidopsis thaliana] dbj\|BAA97339.1\| (AB020755) cyclophilin [Arabidopsis thaliana] |
| 120925 (657 letters) | e-105 | >pir\|\|T07394 probable potassium channel beta chain KB1 - potato emb\|CAA04451.1\| (AJ000999) putative beta-subunit of K+ channels [Solanum tuberosum] |
| 120933 (703 letters) | 1e-69 | >dbj\|BAB17350.1\| (AP002747) putative nodulin [Oryza sativa] dbj\|BAB55472.1\| (AP002541) contains ESTs D39891(S1543),D41717(S4395),AU033037(S1543)-unknown protein [Oryza sativa] |
| 120952 (625 letters) | 2e-90 | >gb\|AAK16176.1\|AC079887_8 (AC079887) translation initiation factor 5A [Oryza sativa] |
| 120979 (585 letters) | 3e-26 | >pir\|\|S53012 root-specific protein RCc3 - rice gb\|AAA65513.1\| (L27208) RCc3 [Oryza sativa] |
| 121144 (354 letters) | 9e-25 | >pir\|\|S53101 type-1 pathogenesis-related protein - barley pir\|\|S71554 pathogenesis-related protein bpr1-1 precursor - barley emb\|CAA88618.1\| (Z48728) type-1 pathogenesis-related protein [Hordeum vulgare] |
| 122182 (575 letters) | e-113 | >dbj\|BAB55525.1\| (AP003233) putative Bowman Birk trypsin inhibitor [Oryza sativa] |
| 124883 (691 letters) | 3e-86 | >gb\|AAK27816.1\|AC022457_19 (AC022457) putative WD-repeat containing protein [Oryza sativa] |
| 126157 (580 letters) | 3e-58 | >sp\|Q40519\|PSBR_TOBAC PHOTOSYSTEM II 10 KD POLYPEPTIDE PRECURSOR (PII10) pir\|\|S32021 photosystem II 10K protein - common tobacco emb\|CAA49693.1\| (X70088) NtpII10 [Nicotiana tabacum] |
| 126168 (448 letters) | 5e-20 | >dbj\|BAB17749.1\| (AP002862) putative coatmer beta subunit (beta-coat protein) (beta-COP) [Oryza sativa] dbj\|BAB44123.1\| (AP003103) putative coatmer beta subunit (beta-coat protein) (beta-COP) [Oryza sativa] |
| 126335 (641 letters) | 1e-30 | >pir\|\|T47741 copper homeostasis factor [imported] - Arabidopsis thaliana gb\|AAC33510.1\| (U88711) copper homeostasis factor [Arabidopsis thaliana] emb\|CAB87423.1\| (AL163763) copper homeostasis factor [Arabidopsis thaliana] gb\|AAK32872.1\|AF361860_1 (AF361860) AT3g56240/F18O21_200 [Arabidopsis thaliana] |

FIG. 3 continued

| Query Contig ID (length, bp) | Pz Score | Result |
|---|---|---|
| 126367 (397 letters) | 9e-10 | >gb\|AAF20235.1\|AC012395_22 (AC012395) putative 60S ribosomal protein L13A [Arabidopsis thaliana] gb\|AAG40393.1\|AF325041_1 (AF325041) AT3g07110 [Arabidopsis thaliana] |
| 126374 (493 letters) | 4e-59 | >pir\|\|T50555 delta-8 sphingolipid desaturase [imported] - rape emb\|CAA11857.1\| (AJ224160) delta-8 sphingolipid desaturase [Brassica napus] |
| 126375 (600 letters) | 6e-62 | >sp\|Q43517\|FER1_LYCES FERREDOXIN I PRECURSOR pir\|\|T07175 ferredoxin [2Fe-2S] I precursor, chloroplast - tomato emb\|CAA99756.1\| (Z75520) ferredoxin-I [Lycopersicon esculentum] |
| 126534 (665 letters) | 2e-41 | >pir\|\|T49048 hypothetical protein T5P19.120 - Arabidopsis thaliana emb\|CAB88050.1\| (AL163972) putative protein [Arabidopsis thaliana] |
| 126611 (719 letters) | 2e-57 | >emb\|CAB81060.1\| (AL161503) Oxygen-evolving enhancer protein 3 precursor-like protein [Arabidopsis thaliana] gb\|AAK49613.1\|AF372897_1 (AF372897) AT4g05180/C17L7_100 [Arabidopsis thaliana] |
| 126840 (613 letters) | 2e-77 | >sp\|Q40522\|R11D_TOBAC RAS-RELATED PROTEIN RAB11D pir\|\|T03622 GTP-binding protein Rab11d - common tobacco gb\|AAA74114.1\| (L29270) putative [Nicotiana tabacum] |
| 127269 (668 letters) | e-113 | >sp\|Q40401\|CRTC_NICPL CALRETICULIN PRECURSOR pir\|\|T16968 calreticulin cal1 - curled-leaved tobacco emb\|CAA95999.1\| (Z71395) calreticulin [Nicotiana plumbaginifolia] |
| 127645 (652 letters) | 7e-47 | >pir\|\|F71438 probable allergen - Arabidopsis thaliana emb\|CAB10483.1\| (Z97342) allergen like protein [Arabidopsis thaliana] emb\|CAB80974.1\| (AL161545) allergen like protein [Arabidopsis thaliana] |
| 127679 (652 letters) | 3e-28 | >gb\|AAF79573.1\|AC022464_31 (AC022464) F22G5.18 [Arabidopsis thaliana] |
| 127750 (576 letters) | 2e-54 | >sp\|P93342\|143A_TOBAC 14-3-3-LIKE PROTEIN A pir\|\|T02050 14-3-3 protein homolog A - common tobacco emb\|CAA72095.1\| (Y11212) 14-3-3-like protein A [Nicotiana tabacum] |
| 128348 (470 letters) | 5e-51 | >gb\|AAF63515.1\|AF242731_1 (AF242731) TMV-induced protein I [Capsicum annuum] |
| 128843 (636 letters) | 7e-68 | >gb\|AAG51798.1\|AC067754_14 (AC067754) disulfide bond formation protein, putative; 78451-75984 [Arabidopsis thaliana] |
| 129204 (678 letters) | 3e-63 | >gb\|AAF34838.1\| (AC023839) putative 3-hydroxybutyryl-CoA dehydrogenase [Arabidopsis thaliana] dbj\|BAB02158.1\| (AP000413) 3-hydroxybutyryl-CoA dehydrogenase-like protein [Arabidopsis thaliana] |

FIG. 3 continued

| Query Contig ID (length, bp) | Pz Score | Result |
|---|---|---|
| 129329 Contig A (623 letters) | e-110 | >sp\|P14656\|GLN3_ORYSA GLUTAMINE SYNTHETASE SHOOT ISOZYME (GLUTAMATE--AMMONIA LIGASE) (CLONE LAMBDA-GS28) pir\|\|AJRZQG glutamate--ammonia ligase (EC 6.3.1.2), cytosolic (clone GS28) - rice emb\|CAA32461.1\| (X14245) cytosolic glutamine synthetase (AA 1-356) [Oryza sativa] dbj\|BAA95679.1\| (AB037595) cytosolic glutamine synthethase [Oryza sativa] dbj\|BAA95678.1\| (AB037664) cytosolic glutamine synthetase [Oryza sativa] |
| 129329 Contig B (591 letters) | 6e-34 | >dbj\|BAA03431.1\| (D14577) glutamine synthetase [Zea mays] |
| 129410 (705 letters) | e-111 | >gb\|AAG17619.1\|AF248080_1 (AF248080) phosphoenolpyruvate carboxylase [Flaveria trinervia] |
| 129424 (697 letters) | 9e-86 | >pir\|\|T49933 inorganic pyrophosphatase-like protein - Arabidopsis thaliana emb\|CAB89365.1\| (AL353994) inorganic pyrophosphatase-like protein [Arabidopsis thaliana] dbj\|BAB09520.1\| (AB020752) inorganic pyrophosphatase-like protein [Arabidopsis thaliana] emb\|CAC19853.1\| (AJ252210) inorganic pyrophosphatase [Arabidopsis thaliana] |
| 129491 (657 letters) | 9e-56 | >pir\|\|T48363 histidyl-tRNA synthetase-like protein - Arabidopsis thaliana emb\|CAB83298.1\| (AL162751) histidyl-tRNA synthetase-like protein [Arabidopsis thaliana] |
| 129584 (623 letters) | 2e-04 | >dbj\|BAA95706.2\| (AB024028) contains similarity to negative regulator of vesicle formation~gene_id:K17E12.15 [Arabidopsis thaliana] |
| 129725 (627 letters) | 3e-67 | >gb\|AAF26472.1\|AC007323_13 (AC007323) T25K16.8 [Arabidopsis thaliana] |
| 129748 (629 letters) | 4e-77 | >sp\|Q08184\|RBS4_MESCR RIBULOSE BISPHOSPHATE CARBOXYLASE SMALL CHAIN 4 PRECURSOR (RUBISCO SMALL SUBUNIT 4) pir\|\|S35244 ribulose-bisphosphate carboxylase (EC 4.1.1.39) small chain precursor - common ice plant gb\|AAA33038.1\| (M38318) ribulose 1,5-bisphosphate carboxylase/oxygenase small subunit [Mesembryanthemum crystallinum] gb\|AAA03696.1\| (L10215) rubisco small subunit [Mesembryanthemum crystallinum] |
| 129753 (596 letters) | 4e-83 | >emb\|CAB40376.1\| (AJ012281) adenosine kinase [Zea mays] |
| 129764 (583 letters) | 1e-93 | >dbj\|BAB41076.1\| (AB059832) MAR-binding protein [Nicotiana tabacum] |
| 129833 (645 letters) | 2e-86 | >pir\|\|T17012 probable phosphoprotein phosphatase (EC 3.1.3.16) - apple tree emb\|CAA87385.1\| (Z47076) Ser/Thr protein phosphatase homologous to PPX [Malus x domestica] prf\|\|2202340A Ser/Thr protein phosphatase [Malus domestica] |
| 129848 (503 letters) | 8e-51 | >emb\|CAB77551.1\| (AJ271049) Toc34-2 protein [Zea mays] |

FIG. 3 continued

| Query Contig ID (length, bp) | Pz Score | Result |
|---|---|---|
| 129932 (680 letters) | 1e-49 | >gb\|AAF78494.1\|AC012187_14 (AC012187) Strong similarity to GAPDH subunit A from Pisum sativum gb\|X15190 and contains a GAPDH PF\|00044 domain. ESTs gb\|T42920, gb\|T43410, gb\|T46101, gb\|T04006, gb\|T20630, gb\|Z34677, gb\|T46805, gb\|N37754, gb\|N37754, gb\|Z26072, gb\|H37169, gb\|H76419,> |
| 130172 (645 letters) | 4e-63 | >sp\|Q01402\|NDK2_SPIOL NUCLEOSIDE DIPHOSPHATE KINASE II PRECURSOR (NDK II) (NDP KINASE II) (NDPK II) pir\|\|S28226 nucleoside-diphosphate kinase (EC 2.7.4.6) II precursor, chloroplast - spinach dbj\|BAA02018.1\| (D11465) nucleoside diphosphate kinase II [Spinacia oleracea] |
| 130212 (689 letters) | 5e-93 | >pir\|\|T05620 glycine hydroxymethyltransferase (EC 2.1.2.1) F20D10.50 - Arabidopsis thaliana emb\|CAB37533.1\| (AL035538) glycine hydroxymethyltransferase like protein [Arabidopsis thaliana] emb\|CAB71289.1\| (AJ271726) serine hydroxymethyl transferase [Arabidopsis thaliana] emb\|CAB80458.1\| (AL161592) glycine hydroxymethyltransferase like protein [Arabidopsis thaliana] |
| 130426 (616 letters) | 8e-39 | >gb\|AAD22107.1\| (AF132475) heme oxygenase 1 [Arabidopsis thaliana] gb\|AAD22108.1\| (AF132476) heme oxygenase 1 [Arabidopsis thaliana] dbj\|BAA77758.1\| (AB021857) plastid heme oxygenase [Arabidopsis thaliana] dbj\|BAA77759.1\| (AB021858) plastid heme oxygenase [Arabidopsis thaliana] gb\|AAB95301.2\| (AC003105) heme oxygenase 1 (HO1) [Arabidopsis thaliana] |
| 130430 (616 letters) | 2e-44 | >gb\|AAF74981.1\|AF082891_1 (AF082891) cystathionine gamma-synthase isoform 1 [Solanum tuberosum] |
| 130438 (615 letters) | e-103 | >gb\|AAC61842.1\| (AF025433) tyrosine/dopa decarboxylase [Papaver somniferum] |
| 130492 (606 letters) | 8e-79 | >gb\|AAF01048.1\|AF189365_1 (AF189365) D-ribulose-5-phosphate 3-epimerase [Oryza sativa] |
| 130504 (601 letters) | e-106 | >sp\|P77280\|YDJJ_ECOLI HYPOTHETICAL ZINC-TYPE ALCOHOL DEHYDROGENASE-LIKE PROTEIN IN ANSA-GAPA INTERGENIC REGION pir\|\|F64937 probable L-iditol 2-dehydrogenase (EC 1.1.1.14) b1774 - Escherichia coli (strain K-12) dbj\|BAA15572.1\| (D90821) Sorbitol dehydrogenase (EC 1.1.1.14) (L-iditol 2-dehydrogenase). [Escherichia coli] gb\|AAC74844.1\| (AE000272) putative oxidoreductase [Escherichia coli K12] |
| 130569 (628 letters) | 2e-50 | >gb\|AAF89315.1\|AF013051_1 (AF013051) maturase [Noahdendron nicholasii] |
| 130646 (629 letters) | 6e-44 | >sp\|P31853\|ATPX_SPIOL ATP SYNTHASE B' CHAIN PRECURSOR (SUBUNIT II) pir\|\|S34473 H+-transporting ATP synthase (EC 3.6.1.34) chain 9 - spinach emb\|CAA50520.1\| (X71397) CF(o)II ATP synthase subunit 9 [Spinacia oleracea] |

FIG. 3 continued

| Query Contig ID (length, bp) | Pz Score | Result |
|---|---|---|
| 130653 (726 letters) | 2e-54 | >gb\|AAD20714.1\| (AC006300) putative non-LTR retroelement reverse transcriptase [Arabidopsis thaliana] |
| 130680 (584 letters) | 2e-81 | >dbj\|BAA07681.1\| (D42086) stearoyl-acyl carrier protein desaturase [Sesamum indicum] |
| 130712 (672 letters) | 4e-96 | >pir\|\|S40110 glutamate--ammonia ligase (EC 6.3.1.2) - rape emb\|CAA54151.1\| (X76736) glutamine [Brassica napus] |
| 130722 (728 letters) | 4e-91 | >gb\|AAB70837.1\| (AF019907) glutathione reductase (NADPH) [Vitis vinifera] |
| 130792 (709 letters) | e-110 | >sp\|P46488\|MDHG_CUCSA MALATE DEHYDROGENASE, GLYOXYSOMAL PRECURSOR pir\|\|S52039 malate dehydrogenase (EC 1.1.1.37) - cucumber gb\|AAC41647.1\| (L31900) glyoxysomal malate dehydrogenase [Cucumis sativus] |
| 130826 (665 letters) | 6e-77 | >emb\|CAA65539.1\| (X96764) ADP-glucose pyrophosphorylase [Pisum sativum] |
| 130864 (593 letters) | e-105 | >gb\|AAB58478.1\| (U73810) small Ras-like GTP-binding protein [Arabidopsis thaliana] dbj\|BAB08588.1\| (AB010071) small Ras-like GTP-binding protein [Arabidopsis thaliana] |
| 130930 (620 letters) | 2e-96 | >dbj\|BAB08802.1\| (AB011482) xylose isomerase [Arabidopsis thaliana] |
| 131046 (752 letters) | 4e-64 | >sp\|P32980\|ATPD_TOBAC ATP SYNTHASE DELTA CHAIN, CHLOROPLAST PRECURSOR pir\|\|S26198 H+-transporting ATP synthase (EC 3.6.1.34) delta chain precursor, chloroplast - common tobacco emb\|CAA45153.1\| (X63607) chloroplast ATP synthase (delta subunit) [Nicotiana tabacum] |
| 131104 (624 letters) | 1e-36 | >pir\|\|T02995 unspecific monooxygenase (EC 1.14.14.1) - common tobacco dbj\|BAA10929.1\| (D64052) cytochrome P450 like_TBP [Nicotiana tabacum] |
| 131281 (615 letters) | 3e-62 | >sp\|Q39963\|ER1_HEVBR ETHYLENE-INDUCIBLE PROTEIN HEVER pir\|\|S60047 ethylene-responsive protein 1 - Para rubber tree gb\|AAA91063.1\| (M88254) ethylene-inducible protein [Hevea brasiliensis] |
| 131313 (657 letters) | e-106 | >dbj\|BAA33801.1\| (AB018410) cytosolic phosphoglycerate kinase 1 [Populus nigra] |
| 131378 (696 letters) | 6e-61 | >dbj\|BAB39968.1\| (AP003018) putative peptidyl-prolyl cis-trans isomerase, chloroplast precursor [Oryza sativa] dbj\|BAB39983.1\| (AP003020) putative peptidyl-prolyl cis-trans isomerase, chloroplast precursor [Oryza sativa] |
| 132564 Contig A (666 letters) | 3e-47 | >pir\|\|T00825 heat shock transcription factor homolog T32G6.21 - Arabidopsis thaliana gb\|AAB84350.1\| (AC002510) putative heat shock transcription factor [Arabidopsis thaliana] |

FIG. 3 continued

| Query Contig ID (length, bp) | Pz Score | Result |
|---|---|---|
| 132564 Contig B (669 letters) | e-102 | >sp\|P50248\|SAHH_TOBAC ADENOSYLHOMOCYSTEINASE (S-ADENOSYL-L-HOMOCYSTEINE HYDROLASE) (ADOHCYASE) (CYTOKININ BINDING PROTEIN CBP57) dbj\|BAA03709.1\| (D16138) S-adenosyl-L-homocystein hydrolase [Nicotiana sylvestris] dbj\|BAA08142.1\| (D45204) S-adenosyl-L-homocysteine hydrolase [Nicotiana tabacum] dbj\|BAA23164.1\| (D49804) S-adenosyl-L-homocysteine hydrolase [Nicotiana tabacum] |
| 133405 (655 letters) | 2e-27 | >gb\|AAD31879.1\| (AF141659) AtHVA22a [Arabidopsis thaliana] gb\|AAD31885.1\|AF141977_1 (AF141977) AtHVA22a [Arabidopsis thaliana] gb\|AAG52361.1\|AC011765_13 (AC011765) AtHVA22a; 65476-64429 [Arabidopsis thaliana] |
| 133507 (637 letters) | e-121 | >sp\|P93400\|PLD_TOBAC PHOSPHOLIPASE D PRECURSOR (PLD) (CHOLINE PHOSPHATASE) (PHOSPHATIDYLCHOLINE-HYDROLYZING PHOSPHOLIPASE D) pir\|\|T04092 phospholipase D (EC 3.1.4.4) - common tobacco emb\|CAB06620.1\| (Z84822) phospholipase D [Nicotiana tabacum] |
| 133537 (643 letters) | 4e-37 | >pir\|\|T49210 hypothetical protein F27K19.160 - Arabidopsis thaliana emb\|CAB87852.1\| (AL163832) putative protein [Arabidopsis thaliana] |
| 133547 (681 letters) | 1e-98 | >emb\|CAA77135.1\| (Y18350) U2 snRNP auxiliary factor, large subunit [Nicotiana plumbaginifolia] |
| 134744 (645 letters) | 2e-22 | >sp\|O82628\|VAG1_ARATH VACUOLAR ATP SYNTHASE SUBUNIT G 1 (V-ATPASE G SUBUNIT 1) (VACUOLAR PROTON PUMP G SUBUNIT 1) pir\|\|T51825 H+-transporting ATPase (EC 3.6.1.35) chain G, vacuolar [imported] - Arabidopsis thaliana emb\|CAA06758.1\| (AJ005901) vag1 [Arabidopsis thaliana] gb\|AAD54418.1\| (AF181688) vacuolar membrane ATPase subunit G [Arabidopsis thaliana] gb\|AAF24609.1\|AC010870_2 (AC010870) vacuolar membrane ATPase subunit G (AVMA10) [Arabidopsis thaliana] |
| 134962 (658 letters) | 4e-68 | >dbj\|BAB07798.1\| (AB024007) IDS3 [Hordeum vulgare] |
| 135016 (603 letters) | e-103 | >gb\|AAF72983.1\| (AF261270) beta-expansin [Oryza sativa] |
| 135042 (623 letters) | 1e-26 | >gb\|AAB81677.1\| (AC002354) putative tetracycline transporter protein [Arabidopsis thaliana] |
| 135085 (612 letters) | 8e-32 | >emb\|CAC39044.1\| (AJ307662) uclacyanin 3-like protein [Oryza sativa] |
| 135224 (625 letters) | 1e-97 | >sp\|P32112\|SAHH_WHEAT ADENOSYLHOMOCYSTEINASE (S-ADENOSYL-L-HOMOCYSTEINE HYDROLASE) (ADOHCYASE) pir\|\|T06764 adenosylhomocysteinase (EC 3.3.1.1) - wheat gb\|AAA34303.1\| (L11872) S-adenosyl-L-homocysteine hydrolase [Triticum aestivum] |

FIG. 3 continued

| Query Contig ID (length, bp) | Pz Score | Result |
|---|---|---|
| 135281 (590 letters) | 3e-44 | >sp|P09229|CYT1_ORYSA CYSTEINE PROTEINASE INHIBITOR-I (ORYZACYSTATIN-I) pir||A28464 oryzacystatin - rice pdb|1EQK|A Chain A, Solution Structure Of Oryzacystatin-I, A Cysteine Proteinase Inhibitor Of The Rice, Oryza Sativa L. Japonica gb|AAA33903.1| (J03469) oryzacystatin [Oryza sativa] gb|AAA33912.1| (M29259) oryzastatin [Oryza sativa] gb|AAB24010.1| (S49967) oryzacystatin=cysteine protease inhibitor [Oryza=rice, Peptide, 102 aa] gb|AAB66355.1| (U54702) oryzacystatin [Oryza sativa] |
| 135357 (507 letters) | 5e-52 | >pir||T00809 hypothetical protein T32G6.5 - Arabidopsis thaliana gb|AAB84335.1| (AC002510) putative esterase D [Arabidopsis thaliana] gb|AAK55678.1|AF378875_1 (AF378875) At2g41530/T32G6.5 [Arabidopsis thaliana] |
| 135416 (641 letters) | 4e-96 | >sp|P49661|COPD_ORYSA COATOMER DELTA SUBUNIT (DELTA-COAT PROTEIN) (DELTA-COP) (ARCHAIN) pir||T03598 archain/delta-COP homolog - rice emb|CAA91901.1| (Z67962) archain/delta-COP [Oryza sativa] |
| 135511 (561 letters) | 3e-33 | >pir||T02053 S-receptor kinase (EC 2.7.1.-) KIK1 precursor - maize gb|AAB93834.1| (U82481) KI domain interacting kinase 1 [Zea mays] |
| 135525 (600 letters) | 1e-77 | >dbj|BAA96951.1| (AB019233) protein carboxyl methylase-like [Arabidopsis thaliana] |
| 135668 (606 letters) | 1e-95 | >gb|AAG34844.1|AF244701_1 (AF244701) glutathione S-transferase GST 36 [Zea mays] |
| 136763 Contig A (662 letters) | 7e-28 | >gb|AAG43509.1|AF210049_1 (AF210049) gibberellin-induced protein 1 [Petunia x hybrida] |
| 136767 (561 letters) | 2e-43 | >sp|P45434|SSRA_ARATH TRANSLOCON-ASSOCIATED PROTEIN, ALPHA SUBUNIT PRECURSOR (TRAP-ALPHA) (SIGNAL SEQUENCE RECEPTOR ALPHA SUBUNIT) (SSR-ALPHA) gb|AAD29800.1|AC006264_8 (AC006264) putative signal sequence receptor, alpha subunit (SSR-alpha) [Arabidopsis thaliana] |
| 136817 (497 letters) | 3e-48 | >dbj|BAA96206.1| (AP002094) EST C73864(E20840) corresponds to a region of the predicted gene.-Similar to Beta vulgaris nonspecific lipid-transfer protein precursor (Q43748) [Oryza sativa] |
| 137131 (612 letters) | 2e-34 | >gb|AAD35089.1|AF148877_1 (AF148877) putative aldehyde dehydrogenase OS-ALDH [Oryza sativa subsp. indica] |
| 138578 (431 letters) | 8e-37 | >pir||JC5841 chitinase (EC 3.2.1.14) III C00481 - rice dbj|BAA23806.1| (D55708) chitinase [Oryza sativa] |
| 138832 (158 letters) | 1e-17 | >pir||T02765 glutathione transferase (EC 2.5.1.18) - rice gb|AAC05216.1| (AF050102) glutathione s-transferase [Oryza sativa] |
| 139222 (621 letters) | 1e-55 | >gb|AAG03106.1|AC073405_22 (AC073405) similar to Arabidopsis thaliana Peptidyl-prolyl cis-trans isomerase (P34791) [Oryza sativa] |

FIG. 3 continued

| Query Contig ID (length, bp) | Pz Score | Result |
|---|---|---|
| 139281 (224 letters) | 2e-23 | >sp\|Q9SUM2\|RUXF_ARATH PROBABLE SMALL NUCLEAR RIBONUCLEOPROTEIN F (SNRNP-F) (SM PROTEIN F) (SM-F) (SMF) pir\|\|T14082 hypothetical protein F9N11.70 - Arabidopsis thaliana emb\|CAB52466.1\| (AL109796) snRNP Sm protein F-like [Arabidopsis thaliana] emb\|CAB81015.1\| (AL161576) snRNP Sm protein F-like [Arabidopsis thaliana] |
| 139321 (569 letters) | 2e-66 | >sp\|P51823\|ARF_ORYSA ADP-RIBOSYLATION FACTOR dbj\|BAA04607.1\| (D17760) ADP-ribosylation factor [Oryza sativa] dbj\|BAB41081.1\| (AB050957) ADP-ribosylation factor [Triticum aestivum] |
| 139357 (586 letters) | 8e-30 | >pir\|\|EPRZ phospholipid transfer protein homolog - rice pdb\|1RZL\| Rice Nonspecific Lipid Transfer Protein pdb\|1BV2\| Lipid Transfer Protein From Rice Seeds, Nmr, 14 Structures |
| 141821 (642 letters) | 7e-83 | >dbj\|BAB39219.1\| (AP002869) putative dihydrolipoamide dehydrogenase precursor [Oryza sativa] |
| 142731 (597 letters) | 6e-70 | >dbj\|BAA75633.1\| (D88434) protein abundantly expressed during apple fruit development [Malus x domestica] |
| 167332 (601 letters) | 2e-91 | >pir\|\|B71400 glycine hydroxymethyltransferase (EC 2.1.2.1) - Arabidopsis thaliana emb\|CAB10172.1\| (Z97335) hydroxymethyltransferase [Arabidopsis thaliana] emb\|CAB78435.1\| (AL161537) hydroxymethyltransferase [Arabidopsis thaliana] gb\|AAK32757.1\|AF361589_1 (AF361589) AT4g13930/dl3005c [Arabidopsis thaliana] |
| 167347 (680 letters) | 1e-20 | >pir\|\|T05538 hypothetical protein F24A6.10 - Arabidopsis thaliana emb\|CAA23058.1\| (AL035396) putative protein [Arabidopsis thaliana] emb\|CAB79426.1\| (AL161562) putative protein [Arabidopsis thaliana] |
| 167403 (651 letters) | 3e-76 | >pir\|\|T00552 lysophospholipase homolog F12L6.8 - Arabidopsis thaliana gb\|AAC27833.1\| (AC004218) putative phospholipase [Arabidopsis thaliana] gb\|AAK43921.1\|AF370602_1 (AF370602) putative phospholipase [Arabidopsis thaliana] |
| 167406 (691 letters) | 2e-48 | >pir\|\|T02431 acetyl-CoA carboxylase (EC 6.4.1.2), biotin carboxylase - common tobacco gb\|AAC41659.1\| (L38260) biotin carboxylase subunit [Nicotiana tabacum] prf\|\|2118337A Ac-CoA carboxylase:SUBUNIT=biotin carboxylase [Nicotiana tabacum] |
| 167420 (624 letters) | 2e-76 | >gb\|AAF78494.1\|AC012187_14 (AC012187) Strong similarity to GAPDH subunit A from Pisum sativum gb\|X15190 and contains a GAPDH PF\|00044 domain. ESTs gb\|T42920, gb\|T43410, gb\|T46101, gb\|T04006, gb\|T20630, gb\|Z34677, gb\|T46805, gb\|N37754, gb\|N37754, gb\|Z26072, gb\|H37169, gb\|H76419,> |

FIG. 3 continued

| Query Contig ID (length, bp) | Pz Score | Result |
|---|---|---|
| 167515 (647 letters) | 3e-85 | >pir\|\|T06131 isocitrate dehydrogenase (NAD+) (EC 1.1.1.41) chain 1 - Arabidopsis thaliana emb\|CAA18743.1\| (AL022604) NAD+ dependent isocitrate dehydrogenase subunit 1 [Arabidopsis thaliana] emb\|CAB80243.1\| (AL161587) NAD+ dependent isocitrate dehydrogenase subunit 1 [Arabidopsis thaliana] |
| 167575 (738 letters) | 6e-64 | >emb\|CAA07230.1\| (AJ006764) putative deoxycytidylate deaminase [Cicer arietinum] |
| 167874 (714 letters) | 5e-70 | >pdb\|1DCU\|A Chain A, Redox Signaling In The Chloroplast: Structure Of Oxidized Pea Fructose-1,6-Bisphosphate Phosphatase pdb\|1D9Q\|B Chain B, Oxidized Pea Fructose-1,6-Bisphosphatase Form 1 pdb\|1DCU\|C Chain C, Redox Signaling In The Chloroplast: Structure Of Oxidized Pea Fructose-1,6-Bisphosphate Phosphatase pdb\|1D9Q\|C Chain C, Oxidized Pea Fructose-1,6-Bisphosphatase Form 1 pdb\|1D9Q\|A Chain A, Oxidized Pea Fructose-1,6-Bisphosphatase Form 1 pdb\|1DCU\|D Chain D, Redox Signaling In The Chloroplast: Structure Of Oxidized Pea Fructose-1,6-Bisphosphate Phosphatase pdb\|1DCU\|B Chain B, Redox Signaling In The Chloroplast: Structure Of Oxidized Pea Fructose-1,6-Bisphosphate Phosphatase pdb\|1D9Q\|D Chain D, Oxidized Pea Fructose-1,6-Bisphosphatase Form 1 |
| 168151 (618 letters) | 7e-82 | >pir\|\|T05620 glycine hydroxymethyltransferase (EC 2.1.2.1) F20D10.50 - Arabidopsis thaliana emb\|CAB37533.1\| (AL035538) glycine hydroxymethyltransferase like protein [Arabidopsis thaliana] emb\|CAB71289.1\| (AJ271726) serine hydroxymethyl transferase [Arabidopsis thaliana] emb\|CAB80458.1\| (AL161592) glycine hydroxymethyltransferase like protein [Arabidopsis thaliana] |
| 168217 (587 letters) | e-107 | >gb\|AAC61844.1\| (AF025435) tyrosine/dopa decarboxylase [Papaver somniferum] |
| 168244 (609 letters) | 4e-81 | >sp\|P41346\|FENR_VICFA FERREDOXIN--NADP REDUCTASE PRECURSOR (FNR) gb\|AAA21758.1\| (U14956) ferredoxin NADP+ reductase precursor [Vicia faba] |
| 168264 (611 letters) | 3e-54 | >gb\|AAD30248.1\|AC007296_9 (AC007296) Identical to gb\|AF016621 ATP-dependent Clp protease proteolytic subunit from Arabidopsis thaliana and is a member of the PF\|00574 CLP_protease family. ESTs gb\|F13836 and gb\|F13997 come from this gene. gb\|AAK15551.1\|AF348580_1 (AF348580) putative ATP-dependent Clp protease proteolytic subunit protein [Arabidopsis thaliana] |
| 168331 (667 letters) | 1e-62 | >emb\|CAB51026.1\| (AJ243812) glutathione synthetase [Arabidopsis thaliana] |
| 168338 (616 letters) | 3e-34 | >gb\|AAC49708.1\| (U39301) caffeic acid O-methyltransferase [Pinus taeda] |

FIG. 3 continued

| Query Contig ID (length, bp) | Pz Score | Result |
|---|---|---|
| 168353 (696 letters) | 2e-97 | >gb\|AAK55671.1\|AF378868_1 (AF378868) AT5g11200/F2I11_90 [Arabidopsis thaliana] |
| 168479 (663 letters) | 9e-62 | >emb\|CAA64819.1\| (X95572) salt-tolerance protein [Arabidopsis thaliana] gb\|AAF80128.1\|AC024174_10 (AC024174) Identical to salt-tolerance protein from Arabidopsis thaliana gb\|X95572 and is a member of the Constans zinc finger family PF\|01760. ESTs gb\|AV526483, gb\|AV527296, gb\|BE038943, gb\|AI995008, gb\|H36917, gb\|BE038755, gb\|N38572, gb\|AV560515, gb> |
| 168524 (702 letters) | 1e-90 | >sp\|Q42679\|DCAM_CATRO S-ADENOSYLMETHIONINE DECARBOXYLASE PROENZYME (ADOMETDC) (SAMDC) pir\|\|S68990 adenosylmethionine decarboxylase (EC 4.1.1.50) - Madagascar periwinkle gb\|AAC48989.1\| (U12573) S-adenosyl-L-methionine decarboxylase proenzyme [Catharanthus roseus] prf\|\|2106177A Met(S-adenosyl) decarboxylase [Catharanthus roseus] |
| 171033 (594 letters) | 5e-64 | >pir\|\|T02573 CDP-diacylglycerol--glycerol-3-phosphate 3-phosphatidyltransferase homolog T16B24.7 - Arabidopsis thaliana gb\|AAC28995.1\| (AC004697) putative CDP-diacylglycerol--glycerol-3-phosphate 3-phosphatidyltransferase [Arabidopsis thaliana] dbj\|BAB39133.1\| (AB048535) phosphatidylglycerolphosphate synthase [Arabidopsis thaliana] |
| 171051 (408 letters) | 2e-25 | >emb\|CAC05446.1\| (AL391711) NAM-like protein [Arabidopsis thaliana] |
| 171278 (655 letters) | 5e-82 | >dbj\|BAA92972.1\| (AP001551) ESTs AU056183(S20356),AU056881(S20950) correspond to a region of the predicted gene.~Similar to Arabidopsis thaliana chromosome 4 BAC clone F6I18 ; putative protein kinase. (AL022198) [Oryza sativa] |
| 171917 (549 letters) | 1e-51 | >sp\|P55857\|SMT3_ORYSA UBIQUITIN-LIKE PROTEIN SMT3 pir\|\|T04102 smt3 protein - rice emb\|CAA67922.1\| (X99608) ubiquitin-like protein [Oryza sativa] |
| 174804 (584 letters) | 6e-34 | >pir\|\|T04896 hypothetical protein F18F4.220 - Arabidopsis thaliana emb\|CAA16620.1\| (AL021637) hypothetical protein [Arabidopsis thaliana] emb\|CAB79012.1\| (AL161552) hypothetical protein [Arabidopsis thaliana] |
| 174874 (583 letters) | 2e-52 | >sp\|P43284\|TRP2_MAIZE TRYPTOPHAN SYNTHASE BETA CHAIN 2 PRECURSOR (ORANGE PERICARP 2) pir\|\|PQ0450 tryptophan synthase (EC 4.2.1.20) beta-2 chain precursor - maize (fragment) gb\|AAA33491.1\| (M76685) tryptophan synthase beta-subunit [Zea mays] |
| 174878 (584 letters) | 4e-87 | >sp\|P42211\|ASPR_ORYSA ASPARTIC PROTEINASE PRECURSOR pir\|\|JS0732 aspartic proteinase (EC 3.4.23.-) - rice dbj\|BAA02242.1\| (D12777) aspartic proteinase [Oryza sativa] |
| 174917 (508 letters) | 4e-70 | >pir\|\|S52003 major intrinsic protein - rice dbj\|BAA04257.1\| (D17443) major intrinsic protein [Oryza sativa] |

FIG. 3 continued

| Query Contig ID (length, bp) | Pz Score | Result |
|---|---|---|
| 175484 (483 letters) | 1e-52 | >gb\|AAK53837.1\|AC011806_14 (AC011806) Putative glutaredoxin [Oryza sativa] |
| 175535 (666 letters) | 2e-75 | >gb\|AAB97122.1\| (AC003674) unknown protein [Arabidopsis thaliana] |
| 175706 (616 letters) | 5e-66 | >emb\|CAA40474.1\| (X57187) chitinase [Phaseolus vulgaris] |
| 175736 Contig A (629 letters) | 1e-74 | >pir\|\|T01971 fructokinase (EC 2.7.1.4) - Arabidopsis thaliana gb\|AAC62803.1\| (AF096373) contains similarity to the pfkB family of carbohydrate kinases (Pfam: PF00294, E=1.6e-75) [Arabidopsis thaliana] emb\|CAB39779.1\| (AL049488) fructokinase-like protein [Arabidopsis thaliana] emb\|CAB78149.1\| (AL161516) fructokinase-like protein [Arabidopsis thaliana] |
| 175736 Contig B (646 letters) | 5e-39 | >pir\|\|T01971 fructokinase (EC 2.7.1.4) - Arabidopsis thaliana gb\|AAC62803.1\| (AF096373) contains similarity to the pfkB family of carbohydrate kinases (Pfam: PF00294, E=1.6e-75) [Arabidopsis thaliana] emb\|CAB39779.1\| (AL049488) fructokinase-like protein [Arabidopsis thaliana] emb\|CAB78149.1\| (AL161516) fructokinase-like protein [Arabidopsis thaliana] |
| 175912 (651 letters) | e-104 | >pir\|\|JE0156 end-xyloglucan transferase (EC 2.4.1.-) - rice |
| 175951 (265 letters) | 9e-06 | >sp\|Q42456\|APR1_ORYSA ASPARTIC PROTEINASE ORYZASIN 1 PRECURSOR pir\|\|S66516 oryzasin (EC 3.4.23.-) precursor - rice dbj\|BAA06876.1\| (D32165) aspartic protease [Oryza sativa] dbj\|BAA06875.1\| (D32144) aspartic protease [Oryza sativa] |
| 175977 (482 letters) | 1e-64 | >pir\|\|S45368 protein kinase C inhibitor - maize |
| 176047 (460 letters) | 5e-72 | >pir\|\|T04139 transmembrane protein - rice emb\|CAA70156.1\| (Y08962) transmembrane protein [Oryza sativa] gb\|AAB18817.1\| (U77297) transmembrane protein [Oryza sativa] |
| 181743 (602 letters) | 1e-85 | >sp\|O23787\|THI4_CITSI THIAZOLE BIOSYNTHETIC ENZYME, CHLOROPLAST PRECURSOR pir\|\|T10474 thiamin biosynthesis protein thi1 - sweet orange emb\|CAB05370.1\| (Z82983) thi [Citrus sinensis] |
| 181759 (606 letters) | 3e-39 | >pir\|\|T17134 hypothetical protein T30A10.110 - Arabidopsis thaliana emb\|CAB55698.1\| (AL117386) putative protein [Arabidopsis thaliana] emb\|CAB78058.1\| (AL161514) putative protein [Arabidopsis thaliana] |
| 181824 (640 letters) | 1e-07 | >dbj\|BAA94977.1\| (AB026636) transcription factor-like protein [Arabidopsis thaliana] |
| 181971 (674 letters) | 3e-80 | >dbj\|BAA25639.1\| (AB012863) NPCA1 [Nicotiana paniculata] |

FIG. 3 continued

| Query Contig ID (length, bp) | Pz Score | Result |
|---|---|---|
| 182002 (655 letters) | 5e-56 | >pir\|\|T48203 hypothetical protein T20L15.90 - Arabidopsis thaliana emb\|CAB82752.1\| (AL162351) putative protein [Arabidopsis thaliana] dbj\|BAB11737.1\| (AB035147) serine/threonine protein kinase [Arabidopsis thaliana] gb\|AAK16689.1\|AF295669_1 (AF295669) CBL-interacting protein kinase 14 [Arabidopsis thaliana] gb\|AAK25899.1\|AF360189_1 (AF360189) putative serine/threonine-protein kinase [Arabidopsis thaliana] |
| 182007 (606 letters) | 1e-69 | >dbj\|BAB11335.1\| (AB016886) eukaryotic release factor 1 homolog [Arabidopsis thaliana] |
| 182081 (603 letters) | 2e-75 | >sp\|Q9XGM1\|VATD_ARATH VACUOLAR ATP SYNTHASE SUBUNIT D (V-ATPASE D SUBUNIT) (VACUOLAR PROTON PUMP D SUBUNIT) pir\|\|T49156 v-ATPase subunit D (vATPD) - Arabidopsis thaliana emb\|CAB88290.1\| (AL353032) v-ATPase subunit D (vATPD) [Arabidopsis thaliana] |
| 182274 (611 letters) | 3e-21 | >ref\|NP_054483.1\| ATPase III subunit [Nicotiana tabacum] sp\|P06286\|ATPH_TOBAC ATP SYNTHASE C CHAIN (LIPID-BINDING PROTEIN) (SUBUNIT III) pir\|\|LWNTA H+-transporting ATP synthase (EC 3.6.1.34) lipid-binding protein - common tobacco chloroplast emb\|CAA77343.1\| (Z00044) ATPase III subunit [Nicotiana tabacum] gb\|AAA84678.1\| (M10124) ATPase subunit III [Nicotiana tabacum] prf\|\|1102209A ATPase III,H translocating [Nicotiana sp.] prf\|\|1211235G ATPase III [Nicotiana tabacum] |
| 182358 (668 letters) | 7e-73 | >gb\|AAB39387.1\| (U59477) omega-3 fatty acid desaturase [Perilla frutescens] |
| 186849 (369 letters) | 3e-16 | >dbj\|BAB08815.1\| (AB007649) emb\|CAB62355.1~gene_id:MLE2.13~similar to unknown protein [Arabidopsis thaliana] |
| 186860 (605 letters) | 3e-86 | >dbj\|BAB02664.1\| (AB012247) coatomer protein complex, beta prime; beta'-COP protein [Arabidopsis thaliana] |
| 186963 (474 letters) | 6e-17 | >gb\|AAB36496.1\| (U09463) histone H3.2 [Medicago sativa] |
| 188836 (565 letters) | 3e-37 | >pir\|\|S52392 prolamin - rice emb\|CAA59142.1\| (X84649) prolamin [Oryza sativa] |
| 188837 (632 letters) | 2e-22 | >pir\|\|T06276 benzothiadiazole-induced protein (clone WCI-4) - wheat gb\|AAC49287.1\| (U32430) thiol protease [Triticum aestivum] |
| 188873 (592 letters) | 9e-27 | >prf\|\|1208404A trypsin/amylase inhibitor pUP13 [Hordeum vulgare var. distichum] |
| 188876 (578 letters) | 9e-29 | >dbj\|BAB10366.1\| (AB006696) contains similarity to RNA binding protein-gene_id:MAF19.4 [Arabidopsis thaliana] |
| 188943 (686 letters) | e-120 | >pir\|\|FWRZ2 glutelin II precursor - rice dbj\|BAA00462.1\| (D00584) prepro-glutelin [Oryza sativa] |

FIG. 3 continued

| Query Contig ID (length, bp) | Pz Score | Result |
|---|---|---|
| 188959 (628 letters) | 5e-69 | >gb\|AAC62137.1\| (AC005169) putative clathrin assembly protein [Arabidopsis thaliana] gb\|AAK44000.1\|AF370185_1 (AF370185) putative clathrin assembly protein [Arabidopsis thaliana] |
| 188984 (589 letters) | 9e-42 | >sp\|P17048\|PRO2_ORYSA 13 KD PROLAMIN PRECURSOR emb\|CAA46197.1\| (X65064) prolamin [Oryza sativa] dbj\|BAA09940.1\| (D63901) 13kDa prolamin [Oryza sativa] |
| 194652 (569 letters) | 7e-50 | >pir\|\|T00585 hypothetical protein T27E13.13 - Arabidopsis thaliana gb\|AAC16959.1\| (AC004165) hypothetical protein [Arabidopsis thaliana] |
| 200602 (554 letters) | 4e-96 | >ref\|NP_012106.1\| peroxisomal 3-oxoacyl CoA thiolase; Pot1p [Saccharomyces cerevisiae] sp\|P27796\|THIK_YEAST 3-KETOACYL-COA THIOLASE, PEROXISOMAL PRECURSOR (BETA-KETOTHIOLASE) (ACETYL-COA ACYLTRANSFERASE) (PEROXISOMAL 3-OXOACYL-COA THIOLASE) pir\|\|S22784 acetyl-CoA C-acyltransferase (EC 2.3.1.16), peroxisomal - yeast (Saccharomyces cerevisiae) emb\|CAA37893.1\| (X53946) 3-oxoacyl-CoA thiolase [Saccharomyces cerevisiae] emb\|CAA37472.1\| (X53395) 3-oxoacyl thiolase peroxisomal [Saccharomyces cerevisiae] emb\|CAA86118.1\| (Z38059) 3-ketoacyl-coA thiolase [Saccharomyces cerevisiae] |
| 200605 (631 letters) | 7e-91 | >ref\|NP_009978.1\| Acyl-CoA cholesterol acyltransferase (sterol-ester synthetase); Are1p [Saccharomyces cerevisiae] sp\|P25628\|ARE1_YEAST STEROL O-ACYLTRANSFERASE 1 (STEROL-ESTER SYNTHASE 1) pir\|\|S19461 probable membrane protein YCR048w - yeast (Saccharomyces cerevisiae) emb\|CAA42296.1\| (X59720) YCR048w, len:610 [Saccharomyces cerevisiae] |
| 200614 (631 letters) | e-113 | >ref\|NP_009592.1\| contains 9 or 10 putative membrane spanning regions; putative Ca2+ binding protein (homology to EF-hand Ca2+ binding site); Csg2p [Saccharomyces cerevisiae] pir\|\|S45894 regulatory protein CSG2 precursor - yeast (Saccharomyces cerevisiae) emb\|CAA84978.1\| (Z35905) ORF YBR036c [Saccharomyces cerevisiae] dbj\|BAA05666.1\| (D28120) Cls2p (Ca2+-regulatory membrane protein) [Saccharomyces cerevisiae] |
| 200615 (615 letters) | e-111 | >ref\|NP_010139.1\| Cardiolipin synthase; Crd1p [Saccharomyces cerevisiae] sp\|Q07560\|CRD1_YEAST CARDIOLIPIN SYNTHETASE (CARDIOLIPIN SYNTHASE) (CLS) pir\|\|S67689 probable membrane protein YDL142c - yeast (Saccharomyces cerevisiae) emb\|CAA98715.1\| (Z74190) ORF YDL142c [Saccharomyces cerevisiae] |
| 200616 (422 letters) | 7e-49 | >ref\|NP_009420.1\| Carnitine N-acetyl transferase; Yat1p [Saccharomyces cerevisiae] pir\|\|S53485 carnitine O-acetyltransferase (EC 2.3.1.7), mitochondrial - yeast (Saccharomyces cerevisiae) gb\|AAC09495.1\| (L28920) Yat1p; carnitine N-acetyl transferase [Saccharomyces cerevisiae] |

FIG. 3 continued

| Query Contig ID (length, bp) | Pz Score | Result |
|---|---|---|
| 200617 (546 letters) | 1e-98 | >ref\|NP_010943.1\| phosphatidylserine synthase; Cho1p [Saccharomyces cerevisiae] sp\|P08456\|PSS_YEAST CDP-DIACYLGLYCEROL--SERINE O-PHOSPHATIDYLTRANSFERASE (PHOSPHATIDYLSERINE SYNTHASE) pir\|\|S00080 CDPdiacylglycerol--serine O-phosphatidyltransferase (EC 2.7.8.8) CHO1 - yeast (Saccharomyces cerevisiae) emb\|CAA29376.1\| (X05944) phosphatidylserine synthetase (AA 1-276) [Saccharomyces cerevisiae] gb\|AAB64559.1\| (U18778) Cho1p: phosphatidylserine synthetase [Saccharomyces cerevisiae] prf\|\|1313296A phosphatidylserine synthase [Saccharomyces cerevisiae] |
| 200619 (627 letters) | e-108 | >ref\|NP_013234.1\| choline kinase; Cki1p [Saccharomyces cerevisiae] sp\|P20485\|KICH_YEAST CHOLINE KINASE pir\|\|A32034 choline kinase (EC 2.7.1.32) - yeast (Saccharomyces cerevisiae) gb\|AAA34499.1\| (J04454) choline kinase [Saccharomyces cerevisiae] emb\|CAA62646.1\| (X91258) choline kinase [Saccharomyces cerevisiae] gb\|AAB82396.1\| (U53881) Cki1p: choline kinase [Saccharomyces cerevisiae] emb\|CAA97704.1\| (Z73305) ORF YLR133w [Saccharomyces cerevisiae] |
| 200621 (632 letters) | e-107 | >ref\|NP_011718.1\| phosphorylcholine transferase; or cholinephosphate cytidylyltransferase; Pct1p [Saccharomyces cerevisiae] pir\|\|XNBYCP choline-phosphate cytidylyltransferase (EC 2.7.7.15) - yeast (Saccharomyces cerevisiae) emb\|CAA88995.1\| (Z49133) cholinephosphate cytidylyltransferase [Saccharomyces cerevisiae] emb\|CAA97229.1\| (Z72987) ORF YGR202c [Saccharomyces cerevisiae] |
| 200622 (401 letters) | 4e-63 | >ref\|NP_014288.1\| cytochrome b5; Cyb5p [Saccharomyces cerevisiae] sp\|P40312\|CYB5_YEAST CYTOCHROME B5 pir\|\|S63052 cytochrome b5 - yeast (Saccharomyces cerevisiae) emb\|CAA93396.1\| (Z69382) Cytochrome B5 [Saccharomyces cerevisiae] emb\|CAA95990.1\| (Z71387) ORF YNL111c [Saccharomyces cerevisiae] |
| 200625 (622 letters) | e-114 | >ref\|NP_010570.1\| Diacylglycerol Pyrophosphate Phosphatase; Dpp1p [Saccharomyces cerevisiae] pir\|\|S70114 probable membrane protein YDR284c - yeast (Saccharomyces cerevisiae) gb\|AAB64475.1\| (U51031) Ydr284cp [Saccharomyces cerevisiae] |
| 200626 (627 letters) | e-118 | >ref\|NP_010580.1\| dihydrosphingosine phosphate lyase (also known as sphingosine phosphate lyase); Dpl1p [Saccharomyces cerevisiae] pir\|\|S70123 sphingosine-1-phosphate lyase (EC 4.-.-.-) [similarity] - yeast (Saccharomyces cerevisiae) gb\|AAB64470.1\| (U51031) Ydr294cp [Saccharomyces cerevisiae] |

FIG. 3 continued

| Query Contig ID (length, bp) | Pz Score | Result |
|---|---|---|
| 200628 (626 letters) | 3e-58 | >ref\|NP_009623.1\| cell wall mannoprotein; Tip1p [Saccharomyces cerevisiae] sp\|P27654\|TIP1_YEAST TEMPERATURE-SHOCK INDUCIBLE PROTEIN 1 PRECURSOR pir\|\|A40979 temperature shock-inducible protein TIP1 precursor - yeast (Saccharomyces cerevisiae) gb\|AAA35157.1\| (M71216) TIP1 [Saccharomyces cerevisiae] emb\|CAA85011.1\| (Z35936) ORF YBR067c [Saccharomyces cerevisiae] |
| 200629 (600 letters) | e-102 | >ref\|NP_010698.1\| farnesyl cysteine-carboxyl methyltransferase; Ste14p [Saccharomyces cerevisiae] sp\|P32584\|ST14_YEAST PROTEIN-S ISOPRENYLCYSTEINE O-METHYLTRANSFERASE (ISOPRENYLCYSTEINE CARBOXYLMETHYLTRANSFERASE) pir\|\|S37604 farnesyl cysteine carboxyl-methyltransferase - yeast (Saccharomyces cerevisiae) gb\|AAA16520.1\| (L07952) farnesyl cysteine carboxyl-methyltransferase [Saccharomyces cerevisiae] gb\|AAA16840.1\| (L15442) isoprenylcysteine carboxyl methyltransferase [Saccharomyces cerevisiae] gb\|AAB64880.1\| (U33007) Ste14p: farnesyl cysteine carboxyl-methyltransferase; YDR410C; CAI: 0.12 [Saccharomyces cerevisiae] |
| 200630 (623 letters) | e-114 | >ref\|NP_015153.1\| Putative farnesyl transferase required for heme A synthesis; Cox10p [Saccharomyces cerevisiae] sp\|P21592\|COXX_YEAST PROTOHEME IX FARNESYLTRANSFERASE, MITOCHONDRIAL PRECURSOR (HEME O SYNTHASE) pir\|\|COBY10 COX10 protein precursor - yeast (Saccharomyces cerevisiae) gb\|AAA34509.1\| (M55566) COX10 [Saccharomyces cerevisiae] emb\|CAA97879.1\| (Z73528) ORF YPL172c [Saccharomyces cerevisiae] |
| 200631 (597 letters) | e-103 | >ref\|NP_012060.1\| squalene synthetase; Erg9p [Saccharomyces cerevisiae] sp\|P29704\|FDFT_YEAST FARNESYL-DIPHOSPHATE FARNESYLTRANSFERASE (SQUALENE SYNTHETASE) (SQS) (SS) (FPP:FPP FARNESYLTRANSFERASE) pir\|\|S46682 farnesyl-diphosphate farnesyltransferase (EC 2.5.1.21) - yeast (Saccharomyces cerevisiae) gb\|AAB68360.1\| (U00030) Erg9p: Squalene synthetase [Saccharomyces cerevisiae] |
| 200633 (599 letters) | e-106 | >ref\|NP_015256.1\| geranylgeranyl diphosphate synthase; Bts1p [Saccharomyces cerevisiae] pir\|\|S60921 farnesyltranstransferase (EC 2.5.1.29) - yeast (Saccharomyces cerevisiae) gb\|AAB68296.1\| (U39205) Lpe1p [Saccharomyces cerevisiae] gb\|AAA83262.1\| (U31632) Bts1p [Saccharomyces cerevisiae] |

FIG. 3 continued

| Query Contig ID (length, bp) | Pz Score | Result |
|---|---|---|
| 200638 (368 letters) | 7e-58 | >ref\|NP_011174.1\| 12 kDa heat shock protein; Hsp12p [Saccharomyces cerevisiae] sp\|P22943\|HS12_YEAST 12 KDA HEAT SHOCK PROTEIN (GLUCOSE AND LIPID-REGULATED PROTEIN) pir\|\|HHBY12 heat shock protein 12 - yeast (Saccharomyces cerevisiae) emb\|CAA39306.1\| (X55785) hsp12 [Saccharomyces cerevisiae] gb\|AAA34647.1\| (M60827) 15 kD glucose and lipid regulated protein [Saccharomyces cerevisiae] emb\|CAA86349.1\| (Z46255) hsp12, glp1, len: 109, CAI: 0.65, HS12_YEAST P22943 12 KD HEAT SHOCK PROTEIN [Saccharomyces cerevisiae] dbj\|BAA09224.1\| (D50617) 12KD heat shock protein [Saccharomyces cerevisiae] dbj\|BAA14033.1\| (D89864) Sc-Hsp12p [Saccharomyces pastorianus] |
| 200641 (586 letters) | 1e-82 | >ref\|NP_011353.1\| hypoxic gene family involved in sterol transport; Sut1p [Saccharomyces cerevisiae] sp\|P53032\|SUT1_YEAST PROBABLE STEROL CARRIER pir\|\|JC4374 sterol uptake protein 1 - yeast (Saccharomyces cerevisiae) emb\|CAA54806.1\| (X77766) SUT1 [Saccharomyces cerevisiae] emb\|CAA96874.1\| (Z72684) ORF YGL162w [Saccharomyces cerevisiae] |
| 200642 (634 letters) | e-122 | >ref\|NP_011389.1\| involved in inositol biosynthesis; Scs3p [Saccharomyces cerevisiae] sp\|P53012\|SCS3_YEAST SCS3 PROTEIN pir\|\|S53293 SCS3 protein - yeast (Saccharomyces cerevisiae) emb\|CAA96835.1\| (Z72648) ORF YGL126w [Saccharomyces cerevisiae] dbj\|BAA04742.1\| (D21200) SCS3 [Saccharomyces cerevisiae] |
| 200646 (637 letters) | e-108 | >ref\|NP_015208.1\| Isopentenyl diphosphate:dimethylallyl diphosphate isomerase (IPP isomerase); Idi1p [Saccharomyces cerevisiae] sp\|P15496\|IDI1_YEAST ISOPENTENYL-DIPHOSPHATE DELTA-ISOMERASE (IPP ISOMERASE) (ISOPENTENYL PYROPHOSPHATE ISOMERASE) pir\|\|A34440 isopentenyl-diphosphate Delta-isomerase (EC 5.3.3.2) - yeast (Saccharomyces cerevisiae) gb\|AAA34708.1\| (J05090) isopentenyl diphosphate:dimethylallyl diphosphate isomerase (EC 5.3.3.2) [Saccharomyces cerevisiae] gb\|AAB68245.1\| (U43503) Idi1p,Lph10p [Saccharomyces cerevisiae] |
| 200647 (635 letters) | e-116 | >ref\|NP_010791.1\| Lipid phosphate phosphatase; Lpp1p [Saccharomyces cerevisiae] pir\|\|S69561 hypothetical protein YDR503c - yeast (Saccharomyces cerevisiae) gb\|AAB64945.1\| (U33057) Ydr503p; CAI: 0.11 [Saccharomyces cerevisiae] |

FIG. 3 continued

| Query Contig ID (length, bp) | Pz Score | Result |
|---|---|---|
| 200649 (624 letters) | e-113 | >ref\|NP_012607.1\| Methylene-fatty-acyl-phospholipid synthase (unsaturated phospholipid N-methyltransferase); Opi3p [Saccharomyces cerevisiae] sp\|P05375\|PEM2_YEAST METHYLENE-FATTY-ACYL-PHOSPHOLIPID SYNTHASE (UNSATURATED PHOSPHOLIPID METHYLTRANSFERASE) pir\|\|B28443 phosphatidyl-N-methylethanolamine N-methyltransferase (EC 2.1.1.71) - yeast (Saccharomyces cerevisiae) gb\|AAA34851.1\| (M16988) phospholipid N-methyltransferase [Saccharomyces cerevisiae] emb\|CAA89601.1\| (Z49573) ORF YJR073c [Saccharomyces cerevisiae] gb\|AAB39298.1\| (L47993) ORF YJR073c [Saccharomyces cerevisiae] |
| 200653 (629 letters) | 2e-95 | >ref\|NP_015249.1\| involved in N-acetylglucosaminylphosphatidylinositol synthesis; Gpi2p [Saccharomyces cerevisiae] sp\|P46961\|GPI2_YEAST N-ACETYLGLUCOSAMINYL-PHOSPHATIDYLINOSITOL BIOSYNTHETIC PROTEIN GPI2 pir\|\|S61111 GPI2 protein - yeast (Saccharomyces cerevisiae) dbj\|BAA06128.1\| (D29645) Gcr4p [Saccharomyces cerevisiae] gb\|AAB68262.1\| (U41849) Gpi2p [Saccharomyces cerevisiae] |
| 200659 (629 letters) | e-102 | >ref\|NP_013721.1\| Phospholipase B (lypophospholipase); Plb1p [Saccharomyces cerevisiae] sp\|P39105\|PLB1_YEAST LYSOPHOSPHOLIPASE PRECURSOR (PHOSPHOLIPASE B) pir\|\|S53037 PLB1 protein - yeast (Saccharomyces cerevisiae) emb\|CAA88523.1\| (Z48613) Plb1p [Saccharomyces cerevisiae] |
| 200665 (875 letters) | e-159 | >ref\|NP_012868.1\| 3-oxoacyl-[acyl-carrier-protein] reductase; Oar1p [Saccharomyces cerevisiae] sp\|P35731\|YKF5_YEAST HYPOTHETICAL OXIDOREDUCTASE IN NUP120-CSE4 INTERGENIC REGION pir\|\|S37877 hypothetical protein YKL055c - yeast (Saccharomyces cerevisiae) emb\|CAA53417.1\| (X75781) 3-oxoacyl-[acyl-carrier-protein] reductase homologue [Saccharomyces cerevisiae] emb\|CAA81892.1\| (Z28055) ORF YKL055c [Saccharomyces cerevisiae] prf\|\|2206495M ORF [Saccharomyces cerevisiae] |
| 200666 (636 letters) | e-112 | >ref\|NP_013200.1\| Ict1p [Saccharomyces cerevisiae] pir\|\|S64933 hypothetical protein YLR099c - yeast (Saccharomyces cerevisiae) gb\|AAB67543.1\| (U53876) Ylr099cp [Saccharomyces cerevisiae] emb\|CAA97663.1\| (Z73271) ORF YLR099c [Saccharomyces cerevisiae] |
| 200669 (631 letters) | e-118 | >ref\|NP_013999.1\| desaturase/hydroxylase enzyme; Scs7p [Saccharomyces cerevisiae] sp\|Q03529\|SCS7_YEAST INOSITOLPHOSPHORYLCERAMIDE-B C-26 HYDROXYLASE (IPC-B HYDROXYLASE) pir\|\|S54484 probable fatty acid hydroxylase (EC 1.14.15.-) YMR272c - yeast (Saccharomyces cerevisiae) emb\|CAA89255.1\| (Z49260) unknown [Saccharomyces cerevisiae] |

FIG. 3 continued

| Query Contig ID (length, bp) | Pz Score | Result |
|---|---|---|
| 200670 (632 letters) | e-122 | >ref\|NP_015268.1\| integral membrane protein, exhibits homology to YBR161w, Hoc1p, and Och1p; Sur1p [Saccharomyces cerevisiae] sp\|P33300\|SUR1_YEAST SUR1 PROTEIN pir\|\|S41798 SUR1 protein - yeast (Saccharomyces cerevisiae) gb\|AAA68909.1\| (M96648) SUR1 gene product [Saccharomyces cerevisiae] dbj\|BAA05628.1\| (D26581) Bcl21p (multicopy suppressor) [Saccharomyces cerevisiae] gb\|AAB68308.1\| (U39205) Sur1p [Saccharomyces cerevisiae] |
| 200671 (631 letters) | e-118 | >ref\|NP_010583.1\| Syringomycin response protein 2; Sur2p [Saccharomyces cerevisiae] sp\|P38992\|SUR_YEAST SUR2 PROTEIN (SYRINGOMYCIN RESPONSE PROTEIN 2) pir\|\|S48533 SUR2 protein - yeast (Saccharomyces cerevisiae) gb\|AAA16608.1\| (U07171) Sur2p [Saccharomyces cerevisiae] gb\|AAB64733.1\| (U28374) Sur2p: syringomycin response protein 2 [Saccharomyces cerevisiae] gb\|AAB41115.1\| (U10427) Syr2p [Saccharomyces cerevisiae] |
| 200672 (635 letters) | e-103 | >emb\|CAA37826.1\| (X53830) ORF (AA 1 - 258) [Saccharomyces cerevisiae] |
| 200673 (597 letters) | e-103 | >ref\|NP_013159.1\| serine hydroxymethyltransferase; Shm2p [Saccharomyces cerevisiae] sp\|P37291\|GLYC_YEAST SERINE HYDROXYMETHYLTRANSFERASE, CYTOSOLIC (SERINE METHYLASE) (GLYCINE HYDROXYMETHYLTRANSFERASE) (SHMT) pir\|\|S61632 glycine hydroxymethyltransferase (EC 2.1.2.1), cytosolic - yeast (Saccharomyces cerevisiae) emb\|CAA64305.1\| (X94607) glycine hydroxymethyltransferase [Saccharomyces cerevisiae] emb\|CAA97588.1\| (Z73230) ORF YLR058c [Saccharomyces cerevisiae] |
| 200674 (612 letters) | e-108 | >ref\|NP_012301.1\| Yir035cp [Saccharomyces cerevisiae] sp\|P40579\|YIV5_YEAST HYPOTHETICAL OXIDOREDUCTASE IN LYS1-HYR1 INTERGENIC REGION pir\|\|S48497 oxidoreductase homolog YIR035c - yeast (Saccharomyces cerevisiae) emb\|CAA86195.1\| (Z38061) orf, len 254, CAI: 0.24, 52.1% similar to orf complement(33925..34716), similar to DHII_HUMAN P28845 CORTICOSTEROID 11-BETA-DEHYDROGENASE [Saccharomyces cerevisiae] |
| 200677 (635 letters) | 3e-97 | >ref\|NP_012928.1\| Osh6p [Saccharomyces cerevisiae] sp\|Q02201\|YKY3_YEAST HYPOTHETICAL 51.6 KD PROTEIN IN PAP1-MRPL13 INTERGENIC REGION pir\|\|S25324 hypothetical protein YKR003w - yeast (Saccharomyces cerevisiae) emb\|CAA46249.1\| (X65124) homology with Human oxysterol binding protein [Saccharomyces cerevisiae] emb\|CAA82073.1\| (Z28228) ORF YKR003w [Saccharomyces cerevisiae] |

FIG. 3 continued

| Query Contig ID (length, bp) | Pz Score | Result |
|---|---|---|
| 200680 (619 letters) | e-106 | >ref\|NP_011691.1\| Squalene monooxygenase; Erg1p [Saccharomyces cerevisiae] sp\|P32476\|ERG1_YEAST SQUALENE MONOOXYGENASE (SQUALENE EPOXIDASE) (SE) pir\|\|S64489 squalene monooxygenase (EC 1.14.99.7) - yeast (Saccharomyces cerevisiae) emb\|CAA97201.1\| (Z72960) ORF YGR175c [Saccharomyces cerevisiae] |
| 212356 (590 letters) | 8e-21 | >sp\|P34480\|NAGA_CAEEL PUTATIVE N-ACETYLGLUCOSAMINE-6-PHOSPHATE DEACETYLASE (GLCNAC 6-P DEACETYLASE) pir\|\|S31124 hypothetical protein F59B2.3 - Caenorhabditis elegans emb\|CAA77585.1\| (Z11505) predicted using Genefinder-sequence similarity to N-acetyl-glucosamine-6-phosphate deacetylase-cDNA EST CEMSE43F comes from this gene-cDNA EST yk322a5.5 comes from this gene [Caenorhabditis elegans] |
| 212363 (373 letters) | 2e-13 | >emb\|CAC28576.1\| (AL513410) conserved hypothetical protein [Neurospora crassa] |
| 212412 (529 letters) | 3e-46 | >sp\|P23750\|H41_EMENI HISTONE H4.1 pir\|\|S11939 histone H4.1 - Emericella nidulans emb\|CAA39155.1\| (X55549) H4.1 [Aspergillus nidulans] gb\|AAA20820.1\| (U12630) histone H4.1 [Aspergillus nidulans] dbj\|BAB12238.1\| (AB033943) histone H4 [Aspergillus oryzae] prf\|\|1707275C histone H4.1 [Emericella nidulans] |
| 212475 (605 letters) | 9e-44 | >emb\|CAB76570.1\| (AJ245552) cytochrome c oxidase subunit V [Podospora anserina] |
| 212616 (585 letters) | 6e-45 | >emb\|CAA21972.1\| (AL033497) unknown possible membrane protein [Candida albicans] |
| 212714 (565 letters) | 1e-27 | >dbj\|BAB23301.1\| (AK004431) putative [Mus musculus] |
| 212738 (439 letters) | 1e-06 | >sp\|P34054\|INA1_TRIHA AMINO-ACID PERMEASE INDA1 pir\|\|S33212 INDA1 protein - fungus (Trichoderma harzianum) emb\|CAA80308.1\| (Z22594) INDA1 [Trichoderma harzianum] |
| 212755 (431 letters) | 3e-17 | >pir\|\|B82434 probable NADH oxidase VCA0644 [imported] - Vibrio cholerae (group O1 strain N16961) gb\|AAF96545.1\| (AE004394) NADH oxidase, putative [Vibrio cholerae] |
| 212785 (483 letters) | 1e-19 | >sp\|O74471\|COXE_SCHPO PROBABLE CYTOCHROME C OXIDASE POLYPEPTIDE VIA PRECURSOR pir\|\|T41117 probable Cytochrome C oxidase subunit via - fission yeast (Schizosaccharomyces pombe) emb\|CAA20783.1\| (AL031540) putative Cytochrome C oxidase subunit via [Schizosaccharomyces pombe] |
| 212792 Contig A (151 letters) | 3e-04 | >gb\|AAB47060.1\| (S80069) exochitinase [Trichoderma harzianum, T 25-1, Peptide, 578 aa] |
| 212824 (436 letters) | 2e-15 | >dbj\|BAA33217.1\| (AB017593) MBF1 [Saccharomyces cerevisiae] |

FIG. 3 continued

| Query Contig ID (length, bp) | Pz Score | Result |
|---|---|---|
| 212892 (452 letters) | 1e-21 | >ref\|NP_009705.1\| Ybr147wp [Saccharomyces cerevisiae] sp\|P38279\|YBZ7_YEAST HYPOTHETICAL 33.5 KD PROTEIN IN MRPS9-YSW1 INTERGENIC REGION pir\|\|S46018 probable membrane protein YBR147w - yeast (Saccharomyces cerevisiae) emb\|CAA85105.1\| (Z36016) ORF YBR147w [Saccharomyces cerevisiae] |
| 212996 (592 letters) | 7e-29 | >ref\|NP_011459.1\| similar to S. pombe sds23; Sds23p [Saccharomyces cerevisiae] sp\|P53172\|YGF6_YEAST HYPOTHETICAL 58.1 KD PROTEIN IN UBC2-OLE1 INTERGENIC REGION pir\|\|S64060 probable membrane protein YGL056c - yeast (Saccharomyces cerevisiae) emb\|CAA96759.1\| (Z72578) ORF YGL056c [Saccharomyces cerevisiae] |
| 213013 (528 letters) | 7e-55 | >sp\|Q00616\|NOR1_CYLTO CYTOCHROME P450 55A2 (CYTOCHROME P450NOR1) dbj\|BAA11408.1\| (D78511) cytochrome P450nor1 [Cylindrocarpon lichenicola] |
| 213037 (617 letters) | 5e-81 | >emb\|CAC18302.1\| (AL451022) isocitrate lyase (acu-3) [Neurospora crassa] |
| 213052 (600 letters) | 1e-10 | >pir\|\|T50145 hypothetical protein SPAC222.04c [imported] - fission yeast (Schizosaccharomyces pombe) emb\|CAB60696.1\| (AL132798) hypothetical protein [Schizosaccharomyces pombe] |
| 213112 (615 letters) | 2e-91 | >pir\|\|T49574 probable carnitine acetyl transferase FacC [imported] - Neurospora crassa emb\|CAB91375.1\| (AL355930) probable carnitine acetyl transferase FacC [Neurospora crassa] |
| 213122 (608 letters) | 4e-35 | >sp\|P77243\|PRPD_ECOLI PRPD PROTEIN pir\|\|F64760 membrane protein prpD - Escherichia coli gb\|AAB18058.1\| (U73857) similar to yqiP of B. subtilis [Escherichia coli] gb\|AAC73437.1\| (AE000140) orf, hypothetical protein [Escherichia coli K12] |
| 213128 (368 letters) | 1e-27 | >pir\|\|T46646 pyridoxine biosynthesis protein pdx1 [imported] - Cercospora nicotianae gb\|AAD13386.1\| (AF035619) pyridoxine biosynthesis protein [Cercospora nicotianae] |
| 213137 (603 letters) | 1e-51 | >emb\|CAC18233.1\| (AL451017) conserved hypothetical protein [Neurospora crassa] |
| 213171 (642 letters) | 3e-44 | >ref\|NP_009997.2\| regulatory protein; Ycr072cp [Saccharomyces cerevisiae] |
| 213179 (639 letters) | 2e-09 | >pir\|\|T39303 hypothetical protein SPBC119.05c - fission yeast (Schizosaccharomyces pombe) pir\|\|T43336 csh3 protein - fission yeast (Schizosaccharomyces pombe) dbj\|BAA25107.1\| (AB011825) CSH3 [Schizosaccharomyces pombe] emb\|CAA17920.1\| (AL022117) SH3 domain containing protein [Schizosaccharomyces pombe] |
| 213206 (570 letters) | 6e-89 | >pir\|\|T48798 probable multicatalytic endopeptidase complex chain PRE1 [imported] - Neurospora crassa emb\|CAB88637.1\| (AL353822) probable multicatalytic endopeptidase complex chain PRE1 [Neurospora crassa] |

FIG. 3 continued

| Query Contig ID (length, bp) | Pz Score | Result |
|---|---|---|
| 213226 (701 letters) | 8e-49 | >gb\|AAB18274.2\| (U75874) sconCp [Aspergillus nidulans] |
| 213246 (650 letters) | 1e-19 | >pir\|\|T25654 hypothetical protein C47D2.2 - Caenorhabditis elegans gb\|AAB04993.1\| (U64861) Similar to cytidine deaminase [Caenorhabditis elegans] |
| 213257 (614 letters) | 6e-58 | >sp\|P31413\|VATL_NEUCR VACUOLAR ATP SYNTHASE 16 KD PROTEOLIPID SUBUNIT pir\|\|S43893 H+-transporting ATPase (EC 3.6.1.35) lipid-binding protein - Neurospora crassa gb\|AAA19974.1\| (L07105) ATPase proteolipid subunit [Neurospora crassa] emb\|CAC18222.1\| (AL451017) H+-transporting ATPase lipid-binding protein [Neurospora crassa] |
| 213260 (565 letters) | 1e-31 | >dbj\|BAB12208.1\| (AB030248) fructose-1,6-bisphosphatase [Aspergillus oryzae] |
| 213315 (611 letters) | 1e-20 | >pir\|\|T40430 conserved hypothetical NifU-like protein - fission yeast (Schizosaccharomyces pombe) emb\|CAB52604.1\| (AL109822) conserved hypothetical NifU-like protein [Schizosaccharomyces pombe] |
| 213318 (524 letters) | 2e-09 | >gb\|AAF27029.1\|AC009177_19 (AC009177) unknown protein [Arabidopsis thaliana] |
| 213340 (555 letters) | 5e-54 | >pir\|\|T51222 hypothetical protein B24M22.180 [imported] - Neurospora crassa emb\|CAB99386.1\| (AL390354) conserved hypothetical protein [Neurospora crassa] |
| 213354 (509 letters) | 3e-21 | >emb\|CAC18268.1\| (AL451020) probable alpha-1, 2-mannosyltransferase [Neurospora crassa] |
| 213369 (630 letters) | 5e-07 | >ref\|NP_075706.1\| RIKEN cDNA 2810003H13 gene [Mus musculus] emb\|CAC03615.1\| (AJ278829) putative pyroglutamyl-peptidase I [Mus musculus] dbj\|BAB22746.1\| (AK003373) putative [Mus musculus] dbj\|BAB28388.1\| (AK012658) putative [Mus musculus] |
| 213377 (551 letters) | 1e-12 | >sp\|Q09686\|YA14_SCHPO HYPOTHETICAL 28.0 KD PROTEIN C13C5.04 IN CHROMOSOME I pir\|\|S58096 hypothetical protein SPAC13C5.04 - fission yeast (Schizosaccharomyces pombe) pir\|\|T37617 hypothetical protein SPAC13C5.04 - fission yeast (Schizosaccharomyces pombe) emb\|CAA90455.1\| (Z50112) hypothetical protein [Schizosaccharomyces pombe] |
| 213734 (516 letters) | 4e-34 | >pir\|\|T06136 aspartate transaminase (EC 2.6.1.1) AAT1 peroxisomal/ glyoxysomal precursor - soybean gb\|AAC50014.1\| (AF034210) aspartate aminotransferase glyoxysomal isozyme AAT1 precursor [Glycine max] |
| 213742 (425 letters) | 3e-12 | >pir\|\|T37717 hypothetical protein SPAC15E1.02c - fission yeast (Schizosaccharomyces pombe) emb\|CAB52421.1\| (AL109770) hypothetical protein [Schizosaccharomyces pombe] |

FIG. 3 continued

| Query Contig ID (length, bp) | Pz Score | Result |
|---|---|---|
| 213749 (571 letters) | 9e-29 | >sp|P19752|HS30_NEUCR 30 KD HEAT SHOCK PROTEIN pir||A38360 heat shock protein 30 - Neurospora crassa gb|AAA33589.1| (M55672) heat shock protein 30 [Neurospora crassa] |
| 213754 (644 letters) | 3e-29 | >sp|P33280|ARGI_NEUCR ARGINASE pir||T47229 arginase (EC 3.5.3.1), isoform 36K [imported] - Neurospora crassa gb|AAC82503.1| (L20687) arginase 36 kDa isoform [Neurospora crassa] |
| 213756 (676 letters) | 9e-16 | >pir||T41370 hypothetical protein SPCC4G3.06c - fission yeast (Schizosaccharomyces pombe) emb|CAB09773.1| (Z97052) hypothetical protein [Schizosaccharomyces pombe] |
| 213758 (578 letters) | 4e-17 | >gb|AAA34414.1| (M94535) ATPase [Saccharomyces cerevisiae] gb|AAB23997.1| (S47813) AFG1p [Saccharomyces cerevisiae, Peptide, 377 aa] |
| 213764 (652 letters) | 8e-16 | >sp|Q10068|YAN2_SCHPO HYPOTHETICAL 117.4 KD PROTEIN C3H1.02C IN CHROMOSOME I pir||T38734 hypothetical protein SPAC3H1.02c - fission yeast (Schizosaccharomyces pombe) emb|CAA92255.1| (Z68144) possible zinc metallopeptidase [Schizosaccharomyces pombe] |
| 213783 (549 letters) | 1e-13 | >pir||T11644 hypothetical protein SPAC3G9.08 - fission yeast (Schizosaccharomyces pombe) emb|CAA15917.1| (AL021046) conserved protein PHD finger domain [Schizosaccharomyces pombe] |
| 213789 (278 letters) | 3e-15 | >emb|CAB65612.1| (AL136078) probable succinate-semialdehyde dehydrogenase [Schizosaccharomyces pombe] |
| 213802 (554 letters) | 3e-22 | >ref|NP_003159.1| suppressor of Ty (S.cerevisiae) 4 homolog 1 [Homo sapiens] ref|NP_033322.1| suppressor of Ty 4 homolog (S. cerevisiae) [Mus musculus] ref|XP_008158.2| suppressor of Ty (S.cerevisiae) 4 homolog 1 [Homo sapiens] sp|Q16550|SPT4_HUMAN TRANSCRIPTION INITIATION PROTEIN SPT4 HOMOLOG 1 gb|AAB07814.1| (U43923) similar to Saccharomyces cerevisiae Spt4; protein has potential N-terminal zinc-finger [Homo sapiens] gb|AAB18674.1| (U38818) SUPT4H [Homo sapiens] gb|AAB18675.1| (U38817) SUPT4H [Homo sapiens] gb|AAB18730.1| (U43154) Supt4h [Mus musculus] gb|AAC71659.1| (U96809) chromatin structural protein homolog [Mus musculus] gb|AAH02802.1|AAH02802 (BC002802) suppressor of Ty (S.cerevisiae) 4 homolog 1 [Homo sapiens] |
| 213803 (615 letters) | 2e-09 | >pir||T38520 hypothetical conserved protein - fission yeast (Schizosaccharomyces pombe) emb|CAB16369.1| (Z99259) hypothetical conserved protein [Schizosaccharomyces pombe] |
| 213814 (428 letters) | 5e-16 | >ref|NP_058135.1| Component of H/ACA-box snoRNPs; Nop10p [Saccharomyces cerevisiae] pir||S78745 protein YHR072w-a - yeast (Saccharomyces cerevisiae) |

FIG. 3 continued

| Query Contig ID (length, bp) | Pz Score | Result |
|---|---|---|
| 213826 (695 letters) | 2e-45 | >pir\|\|T49696 related to peroxisomal membrane protein PER10 [imported] - Neurospora crassa emb\|CAB91677.1\| (AL356172) related to PEROXISOMAL MEMBRANE PROTEIN PER10 [Neurospora crassa] |
| 213829 (672 letters) | 2e-10 | >gb\|AAF89579.1\|AF165891_1 (AF165891) phosphatidic acid phosphatase alpha [Vigna unguiculata] |
| 213863 (107 letters) | 6e-08 | >pir\|\|T37507 aspartate transaminase (EC 2.6.1.1), cytosolic SPAC10F6.13c [similarity] - fission yeast (Schizosaccharomyces pombe) emb\|CAA15726.1\| (AL009197) putative aspartate aminotransferase [Schizosaccharomyces pombe] |
| 213868 (605 letters) | 4e-31 | >pir\|\|T40104 conserved hypothetical protein SPBC2D10.01c - fission yeast (Schizosaccharomyces pombe) (fragment) emb\|CAA21159.1\| (AL031788) conserved hypothetical protein. [Schizosaccharomyces pombe] |
| 213877 (629 letters) | 7e-44 | >ref\|NP_010769.1\| repressible alkaline phosphatase; Pho8p [Saccharomyces cerevisiae] sp\|P11491\|PPB_YEAST REPRESSIBLE ALKALINE PHOSPHATASE PRECURSOR pir\|\|S69648 alkaline phosphatase (EC 3.1.3.1) - yeast (Saccharomyces cerevisiae) gb\|AAB64930.1\|AAB64930 (U33050) Pho8p: repressible alkaline phosphatase; CAI: 0.16 [Saccharomyces cerevisiae] |
| 213895 (529 letters) | 1e-28 | >pir\|\|T50078 hypothetical protein SPAC1486.09 [imported] - fission yeast (Schizosaccharomyces pombe) emb\|CAB62419.1\| (AL133357) hypothetical protein [Schizosaccharomyces pombe] |
| 213914 (418 letters) | 1e-40 | >pir\|\|T38115 probable ATP-dependent transporter - fission yeast (Schizosaccharomyces pombe) (fragment) emb\|CAB11251.1\| (Z98600) probable ATP-dependent transporter [Schizosaccharomyces pombe] |
| 213919 (447 letters) | 2e-05 | >ref\|NP_011180.1\| Yfl010cp [Saccharomyces cerevisiae] sp\|P43582\|YFB0_YEAST HYPOTHETICAL 22.7 KDA PROTEIN IN AUA1-CDC4 INTERGENIC REGION pir\|\|S48311 probable membrane protein YFL010c - yeast (Saccharomyces cerevisiae) emb\|CAA86342.1\| (Z46255) orf, len: 211, CAI: 0.16 [Saccharomyces cerevisiae] dbj\|BAA09228.1\| (D50617) YFL010C [Saccharomyces cerevisiae] |
| 213942 (300 letters) | 3e-37 | >emb\|CAC18231.1\| (AL451017) related to U1 SMALL NUCLEAR RIBONUCLEOPROTEIN C [Neurospora crassa] |
| 213958 (324 letters) | 3e-48 | >emb\|CAC20377.1\| (AJ297910) 14-3-3-like protein [Hypocrea jecorina] |
| 213967 (626 letters) | 9e-19 | >ref\|NP_075207.1\| Ybl071w-ap [Saccharomyces cerevisiae] |
| 213981 (423 letters) | 8e-33 | >gb\|AAB47060.1\| (S80069) exochitinase [Trichoderma harzianum, T 25-1, Peptide, 578 aa] |

FIG. 3 continued

| Query Contig ID (length, bp) | Pz Score | Result |
|---|---|---|
| 214014 (368 letters) | 9e-30 | >sp\|P10713\|CONX_NEUCR CONIDIATION-SPECIFIC PROTEIN 10 pir\|\|A31849 conidiation-specific protein - Neurospora crassa gb\|AAA33572.1\| (M20005) conidiation-specific protein con-10 [Neurospora crassa] |
| 214067 (626 letters) | 8e-11 | >sp\|P19752\|HS30_NEUCR 30 KD HEAT SHOCK PROTEIN pir\|\|A38360 heat shock protein 30 - Neurospora crassa gb\|AAA33589.1\| (M55672) heat shock protein 30 [Neurospora crassa] |
| | 1e-26 | >gb\|AAF50468.1\|(AE003556) CG7375 gene product [Drosophila melanogaster] /appl/egenomics/apache/htdocs/blast/db/nrprotein |
| 214087 (512 letters) | 2e-13 | >sp\|P78980\|PEXG_YARLI PEROXISOMAL MEMBRANE PROTEIN PEX16 (PEROXIN-16) gb\|AAB41724.1\| (U75433) Pex16p [Yarrowia lipolytica] |
| 214105 (559 letters) | 3e-09 | >ref\|NP_014616.1\| Yol026cp [Saccharomyces cerevisiae] pir\|\|S66709 probable membrane protein YOL026c - yeast (Saccharomyces cerevisiae) emb\|CAA99026.1\| (Z74768) ORF YOL026c [Saccharomyces cerevisiae] |
| 214138 (500 letters) | 9e-15 | >pir\|\|H83291 conserved hypothetical protein PA2839 [imported] - Pseudomonas aeruginosa (strain PAO1) gb\|AAG06227.1\|AE004710_9 (AE004710) conserved hypothetical protein [Pseudomonas aeruginosa] |
| 214146 (563 letters) | 9e-12 | >sp\|Q9XWE6\|FTHC_CAEEL PUTATIVE 5-FORMYLTETRAHYDROFOLATE CYCLO-LIGASE (5,10-METHENYL-TETRAHYDROFOLATE SYNTHETASE) (METHENYL-THF SYNTHETASE) (MTHFS) pir\|\|T26418 hypothetical protein Y106G6E.4 - Caenorhabditis elegans emb\|CAA21728.1\| (AL032656) predicted using Genefinder-contains similarity to Pfam domain: PF01812 (5-formyltetrahydrofolate cyclo-ligase), Score=129.9, E-value=1.5e-35, N=1 [Caenorhabditis elegans] |
| 214162 (654 letters) | 5e-18 | >pir\|\|T41383 hypothetical protein SPCC550.08 - fission yeast (Schizosaccharomyces pombe) emb\|CAA19112.1\| (AL023592) hypothetical protein [Schizosaccharomyces pombe] |

FIG. 3 continued

| Query Contig ID (length, bp) | Pz Score | Result |
|---|---|---|
| 214201 (483 letters) | 2e-40 | >pir\|\|T38797 probable siroheme synthase - fission yeast (Schizosaccharomyces pombe) emb\|CAB11278.1\| (Z98602) putative siroheme synthase [Schizosaccharomyces pombe] |
| 214221 (383 letters) | 2e-24 | >gb\|AAK55436.1\| (AF378567) cytochrome-c oxidase chain VIIc-like protein [Ophiostoma ulmi] |
| 214250 (591 letters) | 5e-25 | >pir\|\|T26383 hypothetical protein Y105C5B.g - Caenorhabditis elegans emb\|CAB54355.1\| (AL110479) predicted using Genefinder~cDNA EST yk187c2.3 comes from this gene~cDNA EST yk524f8.3 comes from this gene~cDNA EST yk524f8.5 comes from this gene~cDNA EST yk631e2.5 comes from this gene [Caenorhabditis elegans] |
| 214256 (484 letters) | 2e-08 | >dbj\|BAB24969.1\| (AK007336) putative [Mus musculus] |
| 214259 (531 letters) | 6e-19 | >ref\|NP_107561.1\| putative oxidoreductase [Mesorhizobium loti] dbj\|BAB53347.1\| (AP003011) putative oxidoreductase [Mesorhizobium loti] |
| 214264 (595 letters) | 9e-27 | >sp\|Q92373\|RFA2_SCHPO REPLICATION FACTOR-A PROTEIN 2 (SINGLE-STRANDED DNA-BINDING PROTEIN P30 SUBUNIT) pir\|\|T41124 single-stranded DNA binding protein 30k chain [validated] - fission yeast (Schizosaccharomyces pombe) gb\|AAC49438.1\| (U59386) single-stranded DNA binding protein p30 subunit [Schizosaccharomyces pombe] emb\|CAA22775.1\| (AL035210) replication factor-a protein 2 [Schizosaccharomyces pombe] |
| 214270 (553 letters) | 8e-23 | >pir\|\|T41387 actin-like protein - fission yeast (Schizosaccharomyces pombe) emb\|CAA19116.1\| (AL023592) actin-like protein [Schizosaccharomyces pombe] |
| 214279 (596 letters) | 5e-76 | >pir\|\|T47217 tetrahydrofolylpolyglutamate synthase (EC 6.3.2.17) [imported] - Neurospora crassa gb\|AAB61730.1\| (AF005040) folylpolyglutamate synthetase; FPGS [Neurospora crassa] |
| 214283 (595 letters) | 5e-07 | >pir\|\|T33880 hypothetical protein H14E04.2a - Caenorhabditis elegans gb\|AAD12814.1\| (AF125448) H14E04.2a gene product [Caenorhabditis elegans] |
| 214339 (601 letters) | 1e-54 | >gb\|AAF52191.1\| (AE003608) CG8891 gene product [Drosophila melanogaster] |
| 214356 (538 letters) | 8e-06 | >sp\|P50344\|RLA1_CLAHE 60S ACIDIC RIBOSOMAL PROTEIN P1 (ALLERGEN CLA H 12) (CLA H XII) emb\|CAA59463.1\| (X85180) ribosomal protein P1 [Cladosporium herbarum] |
| 214402 (674 letters) | 5e-16 | >pir\|\|T41250 probable transthyretin precursor - fission yeast (Schizosaccharomyces pombe) emb\|CAA20843.1\| (AL031545) putative transthyretin precursor [Schizosaccharomyces pombe] |
| 214407 (536 letters) | 9e-43 | >pir\|\|C82971 conserved hypothetical protein PA5395 [imported] - Pseudomonas aeruginosa (strain PAO1) gb\|AAG08780.1\|AE004952_2 (AE004952) conserved hypothetical protein [Pseudomonas aeruginosa] |

FIG. 3 continued

| Query Contig ID (length, bp) | Pz Score | Result |
|---|---|---|
| 214414 (625 letters) | 6e-56 | >ref\|NP_015058.1\| dicarboxylic amino acid permease; Dip5p [Saccharomyces cerevisiae] sp\|P53388\|DIP5_YEAST DICARBOXYLIC AMINO ACID PERMEASE pir\|\|S65298 dicarboxylic amino acid permease DIP5 - yeast (Saccharomyces cerevisiae) emb\|CAA65074.1\| (X95802) dicarboxylic amino acids Dip5p permease [Saccharomyces cerevisiae] emb\|CAA98000.1\| (Z73621) ORF YPL265w [Saccharomyces cerevisiae] |
| 214415 (384 letters) | 9e-37 | >dbj\|BAA35061.1\| (AB015207) ribosomal protein CRP7 [Neurospora crassa] |
| 214421 (668 letters) | 4e-14 | >ref\|NP_062357.1\| RNA and export factor binding protein 2; RNA and export factor binding protein 2-I [Mus musculus] emb\|CAB76384.1\| (AJ252141) RNA and export factor binding protein 2-I [Mus musculus] |
| 214423 (630 letters) | 2e-96 | >sp\|P19117\|IPYR_SCHPO INORGANIC PYROPHOSPHATASE (PYROPHOSPHATE PHOSPHO-HYDROLASE) (PPASE) pir\|\|S11496 inorganic pyrophosphatase (EC 3.6.1.1) - fission yeast (Schizosaccharomyces pombe) emb\|CAA38199.1\| (X54301) inorganic pyrophosphatase [Schizosaccharomyces pombe] emb\|CAB11158.1\| (Z98559) inorganic pyrophosphatase (EC 3.6.1.1) [Schizosaccharomyces pombe] |
| 214437 (639 letters) | 2e-57 | >ref\|NP_010738.1\| Ribosomal protein S18A; Rps18ap [Saccharomyces cerevisiae] ref\|NP_013686.1\| Ribosomal protein S18B; Rps18bp [Saccharomyces cerevisiae] sp\|P35271\|RS18_YEAST 40S RIBOSOMAL PROTEIN S18 pir\|\|S50886 ribosomal protein S18.e, cytosolic - yeast (Saccharomyces cerevisiae) emb\|CAA86629.1\| (Z46659) 40S ribosomal protein gene, len: 146, CAI: 0.74 [Saccharomyces cerevisiae] gb\|AAB64891.1\| (U33007) Ydr450wp [Saccharomyces cerevisiae] |
| 214452 (439 letters) | 2e-23 | >dbj\|BAA94531.1\| (AP001800) EST AU057948(S21932) corresponds to a region of the predicted gene.~hypothetical protein [Oryza sativa] |
| 214460 (650 letters) | 2e-51 | >gb\|AAF52395.1\| (AE003613) CG9547 gene product [Drosophila melanogaster] |
| 214476 (628 letters) | 7e-55 | >sp\|Q02854\|NUXM_NEUCR NADH-UBIQUINONE OXIDOREDUCTASE 21 KD SUBUNIT (COMPLEX I-21KD) (CI-21KD) pir\|\|S27171 NADH dehydrogenase (ubiquinone) (EC 1.6.5.3) 20.9K chain - Neurospora crassa emb\|CAA43221.1\| (X60829) NADH dehydrogenase, 21 kDa subunit [Neurospora crassa] |
| 214504 (511 letters) | 1e-19 | >gb\|AAF51238.1\| (AE003582) CG3214 gene product [Drosophila melanogaster] |
| 214527 (287 letters) | 4e-09 | >gb\|AAK22063.1\| (AE005681) fatty oxidation complex, alpha subunit [Caulobacter crescentus] |
| 214532 (536 letters) | 1e-46 | >dbj\|BAA33011.1\| (AB016807) flavohemoglobin [Fusarium oxysporum] |
| 214545 (575 letters) | 5e-10 | >emb\|CAA80973.1\| (Z25485) ACR1-protein [Saccharomyces cerevisiae] |

FIG. 3 continued

| Query Contig ID (length, bp) | Pz Score | Result |
|---|---|---|
| 214572 (579 letters) | 9e-08 | >pir\|\|T51224 related to small s protein [imported] - Neurospora crassa emb\|CAB99388.1\| (AL390354) related to small s protein [Neurospora crassa] |
| 214593 (323 letters) | 8e-33 | >pir\|\|T49593 hypothetical protein B3E4.60 [imported] - Neurospora crassa emb\|CAB91394.1\| (AL355931) conserved hypothetical protein [Neurospora crassa] |
| 214613 (659 letters) | 2e-44 | >pdb\|1GGW\|A Chain A, Cdc4p From Schizosaccharomyces Pombe |
| 214620 (608 letters) | 2e-07 | >pir\|\|T38632 probable phosphatidylserine decarboxylase proenzyme - fission yeast (Schizosaccharomyces pombe) emb\|CAB11699.1\| (Z98979) phosphatidylserine decarboxylase proenzyme 2 precursor [Schizosaccharomyces pombe] |
| 214633 (520 letters) | 5e-49 | >pir\|\|T46646 pyridoxine biosynthesis protein pdx1 [imported] - Cercospora nicotianae gb\|AAD13386.1\| (AF035619) pyridoxine biosynthesis protein [Cercospora nicotianae] |
| 214634 (561 letters) | 4e-94 | >dbj\|BAB40590.1\| (AB041752) endochitinase-HAR2 [Trichoderma harzianum] |
| 214639 (477 letters) | 1e-18 | >pir\|\|T49825 hypothetical protein B24H17.110 [imported] - Neurospora crassa emb\|CAB92633.1\| (AL356815) putative protein [Neurospora crassa] |
| 214643 (308 letters) | 8e-08 | >sp\|P14010\|GATA_EMENI 4-AMINOBUTYRATE AMINOTRANSFERASE (GAMMA-AMINO-N-BUTYRATE TRANSAMINASE) (GABA TRANSAMINASE) (GABA AMINOTRANSFERASE) (GABA-AT) pir\|\|JQ0197 4-aminobutyrate transaminase (EC 2.6.1.19) - Emericella nidulans emb\|CAA33674.1\| (X15647) gamma-amino-n-butyrate transaminase [Aspergillus nidulans] |
| 214664 (454 letters) | 6e-19 | >emb\|CAB46745.1\| (AJ007636) maltose permease [Kluyveromyces lactis] |
| 214665 (590 letters) | 1e-18 | >ref\|NP_012772.1\| NADH-cytochrome b5 reductase; Mcr1p [Saccharomyces cerevisiae] sp\|P36060\|MCR1_YEAST NADH-CYTOCHROME B5 REDUCTASE PRECURSOR (P34/P32) pir\|\|S37800 cytochrome-b5 reductase (EC 1.6.2.2), mitochondrial outer membrane form - yeast (Saccharomyces cerevisiae) emb\|CAA81503.1\| (Z26877) unknown [Saccharomyces cerevisiae] emb\|CAA81991.1\| (Z28150) ORF YKL150w [Saccharomyces cerevisiae] emb\|CAA57227.1\| (X81474) NADH-cytochrome b5 reductase [Saccharomyces cerevisiae] prf\|\|2118404Q ORF [Saccharomyces cerevisiae] |
| 214672 (655 letters) | 1e-18 | >ref\|NP_075207.1\| Ybl071w-ap [Saccharomyces cerevisiae] |
| 214676 (659 letters) | 1e-26 | >pir\|\|T22443 hypothetical protein F49E12.9 - Caenorhabditis elegans emb\|CAA91383.1\| (Z66520) contains similarity to Pfam domain: PF01598 (Sterol desaturase), Score=307.6, E-value=4.7e-89, N=1 [Caenorhabditis elegans] |

FIG. 3 continued

| Query Contig ID (length, bp) | Pz Score | Result |
|---|---|---|
| 214687 (233 letters) | 5e-12 | >sp\|P19968\|NUZM_NEUCR NADH-UBIQUINONE OXIDOREDUCTASE 21.3 KD SUBUNIT pir\|\|A34051 NADH dehydrogenase (ubiquinone) (EC 1.6.5.3) 29/21K chain precursor - Neurospora crassa gb\|AAA33570.1\| (M32244) complex I 29/21-kDa subunit (EC 1.6.5.3) [Neurospora crassa] |
| 214756 (670 letters) | 2e-39 | >gb\|AAA77678.1\| (U18061) CAP20 [Glomerella cingulata] |
| 214766 (647 letters) | 2e-91 | >gb\|AAC95390.1\| (AF109684) NADP-dependent glutamate dehydrogenase [Botryotinia fuckeliana] |
| 214809 (234 letters) | 1e-05 | >gb\|AAG28884.1\| (AY008837) CGRA [Aspergillus fumigatus] |
| 214826 (606 letters) | 3e-29 | >ref\|NP_009515.1\| Mitochondrial ribosomal protein MRPL16; Mrpl16p [Saccharomyces cerevisiae] sp\|P38064\|RM16_YEAST 60S RIBOSOMAL PROTEIN L16, MITOCHONDRIAL PRECURSOR (YML47) pir\|\|S50292 ribosomal protein L16 precursor, mitochondrial - yeast (Saccharomyces cerevisiae) emb\|CAA55056.1\| (X78214) L16 ribosomal protein [Saccharomyces cerevisiae] emb\|CAA84858.1\| (Z35799) ORF YBL038w [Saccharomyces cerevisiae] |
| 214828 (564 letters) | 2e-47 | >gb\|AAK22675.1\| (AE005744) acyl-CoA dehydrogenase family protein [Caulobacter crescentus] |
| 214837 (198 letters) | 3e-18 | >pir\|\|G69896 conserved hypothetical protein yoaN - Bacillus subtilis gb\|AAB84450.1\| (AF027868) YoaN [Bacillus subtilis] emb\|CAB13759.1\| (Z99114) similar to hypothetical proteins [Bacillus subtilis] |
| 214840 (600 letters) | 8e-67 | >gb\|AAF72527.1\|AF252630_1 (AF252630) delta-1-pyrroline-5-carboxylate dehydrogenase [Aspergillus nidulans] |
| 214873 (561 letters) | 9e-41 | >pir\|\|C83395 probable acyl-CoA carboxyltransferase beta chain PA2014 [imported] - Pseudomonas aeruginosa (strain PAO1) gb\|AAG05402.1\|AE004627_10 (AE004627) probable acyl-CoA carboxyltransferase beta chain [Pseudomonas aeruginosa] |
| 214888 (606 letters) | 1e-48 | >pir\|\|T50997 related to UDP N-ACETYLGLUCOSAMINE TRANSPORTER (MNN2) [imported] - Neurospora crassa emb\|CAB97317.1\| (AL389891) related to UDP N-ACETYLGLUCOSAMINE TRANSPORTER (MNN2) [Neurospora crassa] |
| 214902 (617 letters) | 5e-34 | >sp\|P87218\|SOU2_CANAL SORBITOL UTILIZATION PROTEIN SOU2 gb\|AAC24462.1\| (AF002134) Sou2p [Candida albicans] |
| 214918 (552 letters) | 3e-18 | >dbj\|BAA85152.1\| (D86472) PXP-18 [Candida tropicalis] |
| 214919 (569 letters) | 6e-23 | >gb\|AAD31027.1\|AF132597_1 (AF132597) signal sequence receptor alpha subunit [Yarrowia lipolytica] |
| 214922 (639 letters) | 5e-20 | >emb\|CAC27324.1\| (AJ290426) aldehyde reductase 6 [Colletotrichum gloeosporioides f. sp. aeschynomene] |

FIG. 3 continued

| Query Contig ID (length, bp) | Pz Score | Result |
|---|---|---|
| 214931 (574 letters) | 1e-08 | >pir\|\|T48715 hypothetical protein 1A9.190 [imported] - Neurospora crassa emb\|CAB88512.2\| (AL353817) hypothetical protein [Neurospora crassa] |
| 215009 (528 letters) | 6e-67 | >sp\|P27073\|RS19_EMENI 40S RIBOSOMAL PROTEIN S19 (S16) pir\|\|JQ1349 ribosomal protein S19.e, cytosolic - Emericella nidulans gb\|AAA33322.1\| (M65259) ribosomal protein S16 [Aspergillus nidulans] |
| 215021 (635 letters) | 2e-19 | >ref\|NP_012223.1\| Yil041wp [Saccharomyces cerevisiae] sp\|P40531\|YIE1_YEAST 36.7 KD PROTEIN IN CBR5-NOT3 INTERGENIC REGION pir\|\|S49937 hypothetical protein YIL041w - yeast (Saccharomyces cerevisiae) emb\|CAA86910.1\| (Z46861) unknown [Saccharomyces cerevisiae] |
| 215032 (659 letters) | 1e-26 | >sp\|P52808\|RL30_SCHPO 60S RIBOSOMAL PROTEIN L30 (L32) pir\|\|T39226 60s ribosomal protein L30 - fission yeast (Schizosaccharomyces pombe) gb\|AAB17132.1\| (U52080) ribosomal protein Rpl32p [Schizosaccharomyces pombe] emb\|CAB11499.1\| (Z98763) 60s ribosomal protein L30/L30A [Schizosaccharomyces pombe] |
| 215033 (355 letters) | 2e-05 | >pir\|\|T41058 ubiquinol-cytochrome c reductase complex 7.2 kd protein - fission yeast (Schizosaccharomyces pombe) emb\|CAA20667.1\| (AL031525) ubiquinol-cytochrome c reductase complex 7.2 kd protein [Schizosaccharomyces pombe] |
| 215043 (655 letters) | 2e-57 | >ref\|NP_010738.1\| Ribosomal protein S18A; Rps18ap [Saccharomyces cerevisiae] ref\|NP_013686.1\| Ribosomal protein S18B; Rps18bp [Saccharomyces cerevisiae] sp\|P35271\|RS18_YEAST 40S RIBOSOMAL PROTEIN S18 pir\|\|S50886 ribosomal protein S18.e, cytosolic - yeast (Saccharomyces cerevisiae) emb\|CAA86629.1\| (Z46659) 40S ribosomal protein gene, len: 146, CAI: 0.74 [Saccharomyces cerevisiae] gb\|AAB64891.1\| (U33007) Ydr450wp [Saccharomyces cerevisiae] |
| 215047 (700 letters) | e-128 | >sp\|Q01369\|GBLP_NEUCR GUANINE NUCLEOTIDE-BINDING PROTEIN BETA SUBUNIT-LIKE PROTEIN (CROSS-PATHWAY CONTROL WD-REPEAT PROTEIN CPC-2) pir\|\|S57839 CPC2 protein - Neurospora crassa emb\|CAA57460.1\| (X81875) CPC2 protein [Neurospora crassa] |
| 215059 (562 letters) | 4e-47 | >pir\|\|A83519 hypothetical protein PA1024 [imported] - Pseudomonas aeruginosa (strain PAO1) gb\|AAG04413.1\|AE004534_11 (AE004534) hypothetical protein [Pseudomonas aeruginosa] |
| 215060 (642 letters) | 2e-09 | >pir\|\|T40200 ubiquitin-like protein - fission yeast (Schizosaccharomyces pombe) emb\|CAB39137.1\| (AL049190) ubiquitin-like protein [Schizosaccharomyces pombe] |

FIG. 3 continued

| Query Contig ID (length, bp) | Pz Score | Result |
|---|---|---|
| 215074 (670 letters) | 2e-59 | >ref|NP_009466.1| Ribosomal protein L23A (L17aA) (YL32); Rpl23ap [Saccharomyces cerevisiae] ref|NP_011042.1| Ribosomal protein L23B (L17aB) (YL32); Rpl23bp [Saccharomyces cerevisiae] sp|P04451|RL23_YEAST 60S RIBOSOMAL PROTEIN L23 (L17) pir||R5BY17 ribosomal protein L23.e, cytosolic - yeast (Saccharomyces cerevisiae) emb|CAA25841.1| (X01694) ribosomal protein L17 [Saccharomyces cerevisiae] emb|CAA56018.1| (X79489) L23 B x-137 [Saccharomyces cerevisiae] emb|CAA84908.1| (Z35848) ORF YBL087c [Saccharomyces cerevisiae] gb|AAC03215.1|AAC03215 (U18916) Rpl17bp: Ribosomal protein, large subunit [Saccharomyces cerevisiae] gb|AAA61906.1| (U15653) ribosomal protein L17B [Saccharomyces cerevisiae] |
| 215084 (702 letters) | 9e-46 | >ref|NP_013553.1| 60S ribosomal subunit protein L6B (L17B) (rp18) (YL16); Rpl6bp [Saccharomyces cerevisiae] sp|P05739|RL6B_YEAST 60S RIBOSOMAL PROTEIN L6-B (L17) (YL16) (RP18) pir||S55970 ribosomal protein L6.e.B, cytosolic - yeast (Saccharomyces cerevisiae) gb|AAB67529.1| (U22382) Rpl16bp: 60S ribosomal protein YL16B [Saccharomyces cerevisiae] |
| 215087 (488 letters) | 1e-04 | >emb|CAA09913.1| (AJ012090) ferredoxin [Xanthobacter sp. Py2] |
| 215106 (577 letters) | 2e-25 | >sp|O74421|COQ3_SCHPO HEXAPRENYLDIHYDROXYBENZOATE METHYLTRANSFERASE PRECURSOR (DIHYDROXYHEXAPRENYLBENZOATE METHYLTRANSFERASE) (3,4-DIHYDROXY-5-HEXAPRENYLBENZOATE METHYLTRANSFERASE) (DHHB METHYLTRANSFERASE) (DHHB-MT) (DHHB-MTASE) pir||T41026 probable methyltransferase - fission yeast (Schizosaccharomyces pombe) emb|CAA19585.1| (AL023860) putative ubiquinone biosynthesis pathway methyltransferase [Schizosaccharomyces pombe] |
| 215107 (585 letters) | 2e-49 | >pir||T40333 probable fatty acid desaturase - fission yeast (Schizosaccharomyces pombe) emb|CAA18296.1| (AL022244) putative fatty acid desaturase [Schizosaccharomyces pombe] |
| 215108 (513 letters) | 1e-06 | >emb|CAC28818.1| (AL513466) hypothetical protein [Neurospora crassa] |
| 215120 (562 letters) | 4e-89 | >sp|Q06099|FADH_CANMA GLUTATHIONE-DEPENDENT FORMALDEHYDE DEHYDROGENASE (FDH) (FALDH) (FLD) pir||JN0447 alcohol dehydrogenase (EC 1.1.1.1) FDH1 - yeast (Candida maltosa) gb|AAA34344.1| (M58332) encoding formaldehyde resistance [Candida maltosa] |
| 215138 (591 letters) | 8e-75 | >sp|O42772|DHSB_MYCGR SUCCINATE DEHYDROGENASE [UBIQUINONE] IRON-SULFUR PROTEIN, MITOCHONDRIAL PRECURSOR (IP) gb|AAB97419.1| (AF042062) succinate dehydrogenase iron-sulphur protein [Mycosphaerella graminicola] |

FIG. 3 continued

| Query Contig ID (length, bp) | Pz Score | Result |
|---|---|---|
| 215150 (568 letters) | 5e-34 | >sp\|O74330\|RS27_SCHPO 40S RIBOSOMAL PROTEIN S27 pir\|\|T39526 40s ribosomal protein s27 type - fission yeast (Schizosaccharomyces pombe) emb\|CAA20058.1\| (AL031154) 40s ribosomal protein s27 [Schizosaccharomyces pombe] |
| 215163 (576 letters) | 1e-17 | >gb\|AAK47605.1\| (AE007140) hydrolase, alpha/beta hydrolase fold family [Mycobacterium tuberculosis CDC1551] |
| 215211 (458 letters) | 1e-36 | >emb\|CAC18233.1\| (AL451017) conserved hypothetical protein [Neurospora crassa] |
| 215244 (573 letters) | 6e-45 | >ref\|NP_011747.1\| mitochondrial protein, prohibitin homolog; homolog of mammalian BAP37 and S. cerevisiae Phb1p; Phb2p [Saccharomyces cerevisiae] sp\|P50085\|YG4W_YEAST HYPOTHETICAL 34.9 KD PROTEIN IN SMI1-PHO81 INTERGENIC REGION pir\|\|S57696 prohibitin PHB2 - yeast (Saccharomyces cerevisiae) emb\|CAA61181.1\| (X87941) ORF 315 [Saccharomyces cerevisiae] emb\|CAA97259.1\| (Z73016) ORF YGR231c [Saccharomyces cerevisiae] |
| 215249 (441 letters) | 5e-18 | >sp\|P79073\|HYP2_TRIRE HYDROPHOBIN II PRECURSOR (HFBII) emb\|CAA72636.1\| (Y11894) hydrophobin [Hypocrea jecorina] |
| 215258 (586 letters) | 5e-51 | >dbj\|BAA85768.1\| (AB033762) cytochrome c549 [Fusarium oxysporum] |
| 215259 (532 letters) | 4e-05 | >ref\|NP_107357.1\| hypothetical protein [Mesorhizobium loti] dbj\|BAB53143.1\| (AP003010) hypothetical protein [Mesorhizobium loti] |
| 215303 (471 letters) | 3e-39 | >sp\|P48503\|UCRQ_NEUCR UBIQUINOL-CYTOCHROME C REDUCTASE COMPLEX UBIQUINONE-BINDING PROTEIN QP-C PRECURSOR (UBIQUINOL-CYTOCHROME C REDUCTASE COMPLEX 11 KDA PROTEIN) (COMPLEX III SUBUNIT VII) pir\|\|T46746 ubiquinol--cytochrome-c reductase (EC 1.10.2.2) chain VIII [imported] - Neurospora crassa gb\|AAC49654.1\| (U20790) ubiquinol-cytochrome c oxidoreductase subunit VIII [Neurospora crassa] |
| 215308 (415 letters) | 1e-09 | >emb\|CAC34571.1\| (AJ409217) putative ARM-1 protein [Gallus gallus] |
| 215325 (528 letters) | 3e-75 | >sp\|O59953\|RL5_NEUCR 60S RIBOSOMAL PROTEIN L5 gb\|AAC09000.1\| (AF054907) putative 5S rRNA binding ribosomal protein [Neurospora crassa] |
| 215347 (517 letters) | 1e-12 | >ref\|NP_011086.1\| Transcriptional regulator which functions in modulating the activity of the general transcription machinery in vivo; Bur6p [Saccharomyces cerevisiae] sp\|P40096\|NCB1_YEAST CLASS 2 TRANSCRIPTION REPRESSOR (NC2) pir\|\|S50662 hypothetical protein YER159c - yeast (Saccharomyces cerevisiae) gb\|AAB64686.1\| (U18917) Yer159cp [Saccharomyces cerevisiae] emb\|CAA70460.1\| (Y09265) transcription factor [Saccharomyces cerevisiae] |

FIG. 3 continued

| Query Contig ID (length, bp) | Pz Score | Result |
|---|---|---|
| 215360 (627 letters) | 5e-30 | >ref\|NP_014155.1\| translation initiation factor 3 (eIF3); Sui1p [Saccharomyces cerevisiae] sp\|P32911\|SUI1_YEAST PROTEIN TRANSLATION FACTOR SUI1 pir\|\|S31245 translation initiation factor SUI1 [validated] - yeast (Saccharomyces cerevisiae) gb\|AAA35131.1\| (M77514) SUI1 protein [Saccharomyces cerevisiae] emb\|CAA65499.1\| (X96722) ORF N0905 [Saccharomyces cerevisiae] emb\|CAA96150.1\| (Z71520) ORF YNL244c [Saccharomyces cerevisiae] |
| 215373 (575 letters) | 4e-57 | >sp\|Q02854\|NUXM_NEUCR NADH-UBIQUINONE OXIDOREDUCTASE 21 KD SUBUNIT (COMPLEX I-21KD) (CI-21KD) pir\|\|S27171 NADH dehydrogenase (ubiquinone) (EC 1.6.5.3) 20.9K chain - Neurospora crassa emb\|CAA43221.1\| (X60829) NADH dehydrogenase, 21 kDa subunit [Neurospora crassa] |
| 215379 (512 letters) | 2e-59 | >pir\|\|T49800 probable ribosomal protein Rps8bp [imported] - Neurospora crassa emb\|CAB92705.1\| (AL356834) probable ribosomal protein Rps8bp [Neurospora crassa] |
| 215382 (613 letters) | 5e-27 | >ref\|NP_014332.1\| Ribosomal protein L9B (L8B) (rp24) (YL11); Rpl9bp [Saccharomyces cerevisiae] sp\|P51401\|RL9B_YEAST 60S RIBOSOMAL PROTEIN L9-B (L8) (YL11) (RP25) pir\|\|S53915 ribosomal protein L9.e.B, cytosolic - yeast (Saccharomyces cerevisiae) emb\|CAA60195.1\| (X86470) putative second copy of ribosomal protein gene YL9A, SWISS_PROT:RL9_YEAST [Saccharomyces cerevisiae] gb\|AAA99644.1\| (U12141) ribosomal protein YL9 [Saccharomyces cerevisiae] emb\|CAA95940.1\| (Z71343) ORF YNL067w [Saccharomyces cerevisiae] |
| 215387 (501 letters) | 4e-45 | >dbj\|BAB33421.1\| (AB049723) putative senescence-associated protein [Pisum sativum] |
| 215405 (615 letters) | 3e-46 | >emb\|CAC18162.1\| (AL451013) conserved hypothetical protein [Neurospora crassa] |
| 215420 (615 letters) | 4e-29 | >pdb\|1BEK\| Effect Of Unnatural Heme Substitution On Kinetics Of Electron Transfer In Cytochrome C Peroxidase |
| 215422 (542 letters) | 8e-23 | >sp\|Q9P8F8\|H1_EMENI HISTONE H1 emb\|CAB72936.1\| (AJ011780) histone H1 [Aspergillus nidulans] |
| 215431 (674 letters) | 2e-68 | >sp\|Q10157\|RL11_SCHPO 60S RIBOSOMAL PROTEIN L11 pir\|\|T38395 ribosomal protein L11 - fission yeast (Schizosaccharomyces pombe) pir\|\|T39733 60s ribosomal protein L11 - fission yeast (Schizosaccharomyces pombe) emb\|CAA93230.1\| (Z69240) 60s ribosomal protein L11 [Schizosaccharomyces pombe] dbj\|BAA31552.1\| (AB016005) ribosomal protein L11 homolog [Schizosaccharomyces pombe] emb\|CAB52808.1\| (AL109846) 60s ribosomal protein L11 [Schizosaccharomyces pombe] |
| 215445 (685 letters) | 4e-76 | >dbj\|BAB18098.1\| (AB038708) uricase [Tolypocladium inflatum] |

FIG. 3 continued

| Query Contig ID (length, bp) | Pz Score | Result |
|---|---|---|
| 215459 (397 letters) | 2e-16 | >sp\|P22151\|GRG1_NEUCR GLUCOSE-REPRESSIBLE GENE PROTEIN pir\|\|T50483 glucose-repressible protein 1 [imported] - Neurospora crassa emb\|CAA32907.1\| (X14801) grg1 [Neurospora crassa] emb\|CAC28672.1\| (AL513443) glucose-repressible protein grg-1 [Neurospora crassa] |
| 215477 (602 letters) | 4e-78 | >emb\|CAC28787.1\| (AL513464) probable ribosomal protein L12 [Neurospora crassa] |
| 215480 (475 letters) | 2e-06 | >pir\|\|T41448 hypothetical protein SPCC594.04c - fission yeast (Schizosaccharomyces pombe) emb\|CAA20663.1\| (AL031523) hypothetical protein [Schizosaccharomyces pombe] |
| 215494 (577 letters) | 4e-31 | >emb\|CAB99177.1\| (AL390189) related to ribosomal protein MRP49 [Neurospora crassa] |
| 215552 (530 letters) | 2e-36 | >pdb\|1YAA\|A Chain A, Aspartate Aminotransferase From Saccharomyces Cerevisiae Cytoplasm pdb\|1YAA\|B Chain B, Aspartate Aminotransferase From Saccharomyces Cerevisiae Cytoplasm pdb\|1YAA\|C Chain C, Aspartate Aminotransferase From Saccharomyces Cerevisiae Cytoplasm pdb\|1YAA\|D Chain D, Aspartate Aminotransferase From Saccharomyces Cerevisiae Cytoplasm |
| 215570 (521 letters) | 8e-63 | >gb\|AAC03564.2\| (AF047689) subtilisin-like serine protease [Podospora anserina] |
| 215575 (495 letters) | 6e-28 | >gb\|AAF80454.1\|AF162269_1 (AF162269) secreted protein tbSP1 [Tuber borchii] |
| 215579 (338 letters) | 2e-25 | >gb\|AAD47296.1\| (AF017140) dihydrolipoamide succinyltransferase [Aspergillus fumigatus] |
| 215586 (382 letters) | 8e-06 | >ref\|NP_107120.1\| dehydrogenase [Mesorhizobium loti] dbj\|BAB52906.1\| (AP003009) dehydrogenase [Mesorhizobium loti] |
| 215601 (566 letters) | 2e-39 | >dbj\|BAB33417.1\| (AB049719) putative senescence-associated protein [Pisum sativum] |
| 215610 (521 letters) | 1e-69 | >sp\|P17730\|G3P2_TRIKO GLYCERALDEHYDE 3-PHOSPHATE DEHYDROGENASE 2 (GAPDH2) dbj\|BAA03391.1\| (D14518) glyceraldehydephosphate dehydrogenase [Trichoderma koningii] |
| 215611 (593 letters) | 2e-38 | >gb\|AAG28787.1\|AF308443_1 (AF308443) 60S ribosomal protein [Trichoderma hamatum] |
| 215629 (542 letters) | 3e-68 | >gb\|AAC13689.1\| (AF056623) ubiquitin fusion protein [Magnaporthe grisea] |
| 215667 (535 letters) | 4e-12 | >emb\|CAB99172.1\| (AL390189) related to rna-binding protein fus/tls [Neurospora crassa] |
| 215672 (515 letters) | 1e-43 | >sp\|P21772\|RS26_NEUCR 40S RIBOSOMAL PROTEIN S26E (CRP5) (13.6 KD RIBOSOMAL PROTEIN) pir\|\|R4NC26 ribosomal protein S26.e - Neurospora crassa emb\|CAA39162.1\| (X55637) ribosomal protein [Neurospora crassa] |

FIG. 3 continued

| Query Contig ID (length, bp) | Pz Score | Result |
|---|---|---|
| 215676 (557 letters) | 2e-79 | >sp\|P02723\|ADT_NEUCR ADP,ATP CARRIER PROTEIN (ADP/ATP TRANSLOCASE) (ADENINE NUCLEOTIDE TRANSLOCATOR) (ANT) pir\|\|XWNC ADP,ATP carrier protein - Neurospora crassa emb\|CAA25104.1\| (X00363) ADP/ATP carrier protein [Neurospora crassa] |
| 215678 (558 letters) | 2e-04 | >emb\|CAC28735.1\| (AL513462) putative protein [Neurospora crassa] |
| 215685 (495 letters) | 2e-11 | >gb\|AAD28474.1\|AF133671_1 (AF133671) coproporphyrinogen III oxidase precursor [Chlamydomonas reinhardtii] gb\|AAD28475.1\|AF133672_1 (AF133672) coproporphyrinogen III oxidase precursor [Chlamydomonas reinhardtii] |
| 215692 (422 letters) | 7e-04 | >emb\|CAC28593.1\| (AL513411) conserved hypothetical protein [Neurospora crassa] |
| 215716 (604 letters) | 7e-53 | >sp\|P19968\|NUZM_NEUCR NADH-UBIQUINONE OXIDOREDUCTASE 21.3 KD SUBUNIT pir\|\|A34051 NADH dehydrogenase (ubiquinone) (EC 1.6.5.3) 29/21K chain precursor - Neurospora crassa gb\|AAA33570.1\| (M32244) complex I 29/21-kDa subunit (EC 1.6.5.3) [Neurospora crassa] |
| 215730 (201 letters) | 9e-04 | >gb\|AAD26563.1\|AF124243_1 (AF124243) ribosomal protein homolog [Cryptosporidium parvum] |
| 215737 (630 letters) | 2e-27 | >ref\|NP_011543.2\| involved in mitochondrial biogenesis; Erv1p [Saccharomyces cerevisiae] sp\|P27882\|ERV1_YEAST ERV1 PROTEIN, MITOCHONDRIAL PRECURSOR (14 KDA REGULATORY PROTEIN) emb\|CAA97017.1\| (Z72814) ORF YGR029w [Saccharomyces cerevisiae] |
| 215817 (504 letters) | 3e-18 | >pir\|\|T06297 hypothetical protein T9E8.140 - Arabidopsis thaliana emb\|CAB40775.1\| (AL049608) putative protein [Arabidopsis thaliana] emb\|CAB78382.1\| (AL161536) putative protein [Arabidopsis thaliana] |
| 215823 (593 letters) | 3e-04 | >pir\|\|T39461 hypothetical protein SPBC1539.02 - fission yeast (Schizosaccharomyces pombe) emb\|CAB51334.1\| (AL096874) hypothetical protein [Schizosaccharomyces pombe] |
| 215827 (621 letters) | 5e-49 | >emb\|CAA05043.1\| (AJ001836) fumarylacetoacetate hydrolase [Aspergillus nidulans] |
| 215859 (508 letters) | 2e-25 | >gb\|AAF54398.1\| (AE003683) CG8199 gene product [Drosophila melanogaster] |
| 215864 (551 letters) | 5e-29 | >sp\|O13349\|ATPF_KLULA ATP SYNTHASE SUBUNIT 4, MITOCHONDRIAL PRECURSOR gb\|AAC64860.1\| (AF019222) F1Fo-ATP synthase subunit 4 [Kluyveromyces lactis] |
| 215926 (691 letters) | 7e-48 | >ref\|NP_014840.1\| Yor197wp [Saccharomyces cerevisiae] pir\|\|S67089 hypothetical protein YOR197w - yeast (Saccharomyces cerevisiae) emb\|CAA99410.1\| (Z75105) ORF YOR197w [Saccharomyces cerevisiae] |

FIG. 3 continued

| Query Contig ID (length, bp) | Pz Score | Result |
|---|---|---|
| 215934 (550 letters) | 2e-15 | >pir||T40466 probable acetyltransferase protein - fission yeast (Schizosaccharomyces pombe) emb|CAA22289.1| (AL034382) putative acetyltransferase protein [Schizosaccharomyces pombe] |
| 215961 (536 letters) | 8e-55 | >emb|CAC18179.1| (AL451014) conserved hypothetical protein [Neurospora crassa] |
| 215966 (645 letters) | 8e-56 | >pir||S11667 ribosomal protein S14.e - Neurospora crassa emb|CAA37766.2| (X53734) ribosomal protein crp-2 [Neurospora crassa] |
| 215973 (345 letters) | 6e-17 | >sp|Q01294|CARP_NEUCR VACUOLAR PROTEASE A PRECURSOR pir||T47207 aspartic proteinase (EC 3.4.23.-) [imported] - Neurospora crassa gb|AAA79878.1| (U36471) vacuolar protease A [Neurospora crassa] |
| 215995 (528 letters) | 5e-07 | >pir||T37997 carboxypeptidase y - fission yeast (Schizosaccharomyces pombe) pir||T43236 carboxypeptidase C (EC 3.4.16.5) precursor [validated] - fission yeast (Schizosaccharomyces pombe) emb|CAB10121.1| (Z97209) carboxypeptidase y [Schizosaccharomyces pombe] dbj|BAA25568.1| (D86560) carboxypeptidase Y [Schizosaccharomyces pombe] |
| 216005 (664 letters) | 1e-39 | >ref|NP_011259.1| high-affinity zinc transport protein; Zrt1p [Saccharomyces cerevisiae] sp|P32804|ZRT1_YEAST ZRT1 PROTEIN pir||S33654 zinc transport protein, high affinity - yeast (Saccharomyces cerevisiae) emb|CAA47997.1| (X67787) ORF1 [Saccharomyces cerevisiae] emb|CAA64132.1| (X94357) ORF NRC376; EMBL:SCFZF1;X67787; PIR:DEBY4;S07614 [Saccharomyces cerevisiae] emb|CAA96975.1| (Z72777) ORF YGL255w [Saccharomyces cerevisiae] |
| 216009 (684 letters) | 6e-70 | >sp|P29951|MANA_EMENI MANNOSE-6-PHOSPHATE ISOMERASE (PHOSPHOMANNOSE ISOMERASE) (PMI) (PHOSPHOHEXOMUTASE) pir||A56239 mannose-6-phosphate isomerase (EC 5.3.1.8) - Emericella nidulans gb|AAA33319.1| (M85239) phosphomannose isomerase [Aspergillus nidulans] |
| 216013 (700 letters) | 3e-23 | >emb|CAC08232.1| (AJ250992) fructose symporter [Saccharomyces pastorianus] |
| 216018 (645 letters) | 1e-33 | >sp|P38665|RL24_KLULA 60S RIBOSOMAL PROTEIN L24 (L30) gb|AAA35269.1| (L05777) ribosomal protein L30 [Kluyveromyces lactis] |

FIG. 3 continued

| Query Contig ID (length, bp) | Pz Score | Result |
|---|---|---|
| 216068 (644 letters) | 3e-53 | >sp\|Q10132\|IDI1_SCHPO ISOPENTENYL-DIPHOSPHATE DELTA-ISOMERASE (IPP ISOMERASE) (ISOPENTENYL PYROPHOSPHATE ISOMERASE) pir\|\|A56442 isopentenyl-diphosphate Delta-isomerase (EC 5.3.3.2) - fission yeast (Schizosaccharomyces pombe) pir\|\|T37986 isopentenyl-diphosphate delta-isomerase - fission yeast (Schizosaccharomyces pombe) pir\|\|T39272 isopentenyl-diphosphate delta-isomerase - fission yeast (Schizosaccharomyces pombe) gb\|AAA80596.1\| (U21154) isopentenyl diphosphate isomerase [Schizosaccharomyces pombe] emb\|CAA93797.1\| (Z69909) isopentenyl-diphosphate delta-isomerase [Schizosaccharomyces pombe] emb\|CAB53731.1\| (AL110295) isopentenyl-diphosphate delta-isomerase [Schizosaccharomyces pombe] |
| 216079 (514 letters) | 6e-27 | >gb\|AAK11532.1\|AF279808_7 (AF279808) PaxU [Penicillium paxilli] |
| 216095 (576 letters) | 5e-34 | >gb\|AAA53573.1\| (L27825) similarity to elongation factor 1 gamma subunit [Aspergillus nidulans] |
| 216103 (573 letters) | 9e-14 | >pir\|\|T39896 probable nucleic acid-binding protein - fission yeast (Schizosaccharomyces pombe) emb\|CAA22120.1\| (AL033534) hypothetical protein [Schizosaccharomyces pombe] |
| 216105 (573 letters) | 6e-45 | >emb\|CAA21972.1\| (AL033497) unknown possible membrane protein [Candida albicans] |
| 216109 (525 letters) | 2e-21 | >pir\|\|T50403 probable succinate dehydrogenase membrane anchor subunit precursor [imported] - fission yeast (Schizosaccharomyces pombe) emb\|CAB66444.1\| (AL136535) putative succinate dehydrogenase membrane anchor subunit precursor [Schizosaccharomyces pombe] |
| 216131 (459 letters) | 7e-45 | >sp\|P42114\|NB4M_NEUCR NADH-UBIQUINONE OXIDOREDUCTASE 14.8 KD SUBUNIT (COMPLEX I-14.8KD) (CI-14.8KD) pir\|\|S43840 NADH dehydrogenase (ubiquinone) (EC 1.6.5.3) - Neurospora crassa emb\|CAA53963.1\| (X76344) NADH dehydrogenase (ubiquinone) [Neurospora crassa] |
| 216176 (555 letters) | 7e-16 | >sp\|O13672\|RL8_SCHPO 60S RIBOSOMAL PROTEIN L8 (L7A) (L4) pir\|\|T40075 60s ribosomal protein l8 - fission yeast (Schizosaccharomyces pombe) emb\|CAA18381.1\| (AL022299) 60s ribosomal protein L7a (L8) [Schizosaccharomyces pombe] emb\|CAA04548.1\| (AJ001133) ribosomal protein L7 [Schizosaccharomyces pombe] |
| 216180 (492 letters) | 2e-47 | >gb\|AAC26079.1\| (AF013590) extragenic suppressor of the bimD6 mutation [Aspergillus nidulans] |
| 216195 (268 letters) | 3e-08 | >sp\|Q00717\|STCT_EMENI PUTATIVE STERIGMATOCYSTIN BIOSYNTHESIS PROTEIN STCT gb\|AAC49204.1\| (U34740) putative translation elongation factor 1 gamma [Aspergillus nidulans] |

FIG. 3 continued

| Query Contig ID (length, bp) | Pz Score | Result |
|---|---|---|
| 216196 (337 letters) | 2e-35 | >sp\|O59936\|RS12_ERYGR 40S RIBOSOMAL PROTEIN S12 gb\|AAC15834.1\| (AF052483) 40S ribosomal protein S12 [Blumeria graminis f. sp. hordei] |
| 216207 (511 letters) | 9e-19 | >sp\|P05767\|RL39_SCHPO 60S RIBOSOMAL PROTEIN L39 (YL36) pir\|\|T41535 60s ribosomal protein L46 - fission yeast (Schizosaccharomyces pombe) emb\|CAA20364.1\| (AL031307) 60s ribosomal protein 139 [Schizosaccharomyces pombe] |
| 216211 (587 letters) | 4e-05 | >dbj\|BAB21200.1\| (AP002913) putative phosphatidic acid phosphatase alpha [Oryza sativa] |
| 216219 (529 letters) | 2e-29 | >emb\|CAB88645.2\| (AL353822) conserved hypothetical protein [Neurospora crassa] |
| 216223 (602 letters) | 4e-67 | >dbj\|BAB21589.1\| (AB036786) casein kinase II alpha subunit [Oryza sativa] dbj\|BAB21591.1\| (AB036788) casein kinase II alpha subunit [Oryza sativa] |
| 216230 (581 letters) | 4e-36 | >pir\|\|T39419 hypothetical coiled-coil protein - fission yeast (Schizosaccharomyces pombe) emb\|CAB46758.1\| (AL096797) hypothetical coiled-coil protein [Schizosaccharomyces pombe] |
| 216234 (391 letters) | 3e-33 | >emb\|CAC37428.1\| (AL590902) Putative 3' to 5' DNA/RNA helicase involved in ribosomal RNA processing; by similarity to S. cerevisiae RVB1 [Schizosaccharomyces pombe] |
| 216238 (554 letters) | 9e-43 | >pir\|\|C82971 conserved hypothetical protein PA5395 [imported] - Pseudomonas aeruginosa (strain PAO1) gb\|AAG08780.1\|AE004952_2 (AE004952) conserved hypothetical protein [Pseudomonas aeruginosa] |
| 216241 (551 letters) | 1e-33 | >gb\|AAG54682.1\|AE005212_7 (AE005212) orf, hypothetical protein [Escherichia coli O157:H7 EDL933] dbj\|BAB33810.1\| (AP002551) hypothetical protein [Escherichia coli O157:H7] |
| 216242 (596 letters) | 6e-07 | >pir\|\|S75700 GDP-mannose pyrophosphorylase - Synechocystis sp. (strain PCC 6803) dbj\|BAA18261.1\| (D90912) GDP-mannose pyrophosphorylase [Synechocystis sp.] |
| 216256 (406 letters) | 3e-15 | >ref\|NP_010709.1\| Aro80p [Saccharomyces cerevisiae] pir\|\|S69704 hypothetical protein YDR421w - yeast (Saccharomyces cerevisiae) gb\|AAB64863.1\| (U33007) Ydr421wp; CAI: 0.12 [Saccharomyces cerevisiae] |
| 216262 (249 letters) | 1e-07 | >pir\|\|T49708 probable 3-methyl-2-oxobutanoate dehydrogenase (lipoamide)E1 beta chain precursor [imported] - Neurospora crassa emb\|CAB91689.1\| (AL356172) probable 3-methyl-2-oxobutanoate dehydrogenase (lipoamide)E1 beta chain precursor [Neurospora crassa] |
| 216268 (596 letters) | 2e-98 | >pir\|\|T02754 probable 1-aminocyclopropane-1-carboxylate oxidase (EC 1.4.3.-) - rice gb\|AAC05507.1\| (AF049889) 1-aminocyclopropane-1-carboxylate oxidase [Oryza sativa] |
| 216283 (595 letters) | 1e-27 | >dbj\|BAB23301.1\| (AK004431) putative [Mus musculus] |

FIG. 3 continued

| Query Contig ID (length, bp) | Pz Score | Result |
|---|---|---|
| 216284 (576 letters) | 4e-86 | >sp\|O43105\|RS7_NEUCR 40S RIBOSOMAL PROTEIN S7 pir\|\|T46586 ribosomal protein [imported] - Neurospora crassa gb\|AAB94301.1\| (U73847) ribosomal protein [Neurospora crassa] |
| 216286 (596 letters) | 6e-12 | >ref\|NP_055577.1\| seladin-1; KIAA0018 gene product [Homo sapiens] ref\|XP_015571.1\| seladin-1 [Homo sapiens] gb\|AAG17288.1\|AF261758_1 (AF261758) seladin-1 [Homo sapiens] gb\|AAH04375.1\|AAH04375 (BC004375) Unknown (protein for MGC:10569) [Homo sapiens] |
| 216287 (572 letters) | 4e-04 | >pir\|\|T37686 hypothetical protein SPAC14C4.01c - fission yeast (Schizosaccharomyces pombe) |
| 216319 (637 letters) | 8e-16 | >gb\|AAF53953.1\| (AE003669) CG9265 gene product [Drosophila melanogaster] |
| 216338 (577 letters) | 2e-10 | >sp\|P42116\|NURM_NEUCR NADH-UBIQUINONE OXIDOREDUCTASE 17.8 KD SUBUNIT PRECURSOR (COMPLEX I-17.8KD) (CI-17.8KD) pir\|\|S35057 NADH dehydrogenase (EC 1.6.99.3) 17.8K chain - Neurospora crassa emb\|CAA50537.1\| (X71414) NADH dehydrogenase [Neurospora crassa] |
| 216345 (594 letters) | 6e-30 | >emb\|CAC28857.1\| (AL513467) conserved hypothetical protein [Neurospora crassa] |
| 216349 (627 letters) | 9e-36 | >pir\|\|JC4376 beta-glucosidase (EC 3.2.1.21) precursor - yeast (Candida molischiana) gb\|AAA91297.1\| (U16259) beta-glucosidase [Pichia capsulata] |
| 216352 (623 letters) | 4e-28 | >sp\|P52755\|QID3_TRIHA CELL WALL PROTEIN QID3 PRECURSOR pir\|\|S42579 QID3 protein - fungus (Trichoderma harzianum) emb\|CAA50728.1\| (X71913) QID3 [Trichoderma harzianum] |
| 216358 (653 letters) | 4e-22 | >gb\|AAH01898.1\|AAH01898 (BC001898) Similar to mannose-P-dolichol utilization defect 1 [Homo sapiens] |
| 216360 (611 letters) | 8e-43 | >pir\|\|T48741 probable ubiquitin--protein ligase [imported] - Neurospora crassa emb\|CAB88557.1\| (AL353819) probable ubiquitin--protein ligase [Neurospora crassa] |
| 216365 (487 letters) | 4e-18 | >emb\|CAA63364.1\| (X92680) allelic to VPS4 [Saccharomyces cerevisiae] |
| 216373 (600 letters) | 3e-55 | >pir\|\|T49507 probable 26S proteasome regulatory particle chain RPT1 [imported] - Neurospora crassa |
| 216384 (538 letters) | 1e-19 | >gb\|AAF51238.1\| (AE003582) CG3214 gene product [Drosophila melanogaster] |
| 216406 (688 letters) | 1e-26 | >ref\|NP_011832.1\| Golgi SNARE protein; Gos1p [Saccharomyces cerevisiae] sp\|P38736\|YHD1_YEAST HYPOTHETICAL 25.4 KD PROTEIN IN GUT1-RIM1 INTERGENIC REGION pir\|\|S48937 hypothetical protein YHL031c - yeast (Saccharomyces cerevisiae) gb\|AAB65043.1\| (U11583) YHL031c gene product [Saccharomyces cerevisiae] |

FIG. 3 continued

| Query Contig ID (length, bp) | Pz Score | Result |
|---|---|---|
| 216408 (585 letters) | 1e-39 | >sp\|P52808\|RL30_SCHPO 60S RIBOSOMAL PROTEIN L30 (L32) pir\|\|T39226 60s ribosomal protein L30 - fission yeast (Schizosaccharomyces pombe) gb\|AAB17132.1\| (U52080) ribosomal protein Rpl32p [Schizosaccharomyces pombe] emb\|CAB11499.1\| (Z98763) 60s ribosomal protein L30/L30A [Schizosaccharomyces pombe] |
| 216425 (657 letters) | 2e-42 | >pir\|\|T37721 vacuolar sorting protein VPS29/PEP11 homolog - fission yeast (Schizosaccharomyces pombe) emb\|CAB52425.1\| (AL109770) similar to yeast vacuolar sorting protein VPS29/PEP11 [Schizosaccharomyces pombe] |
| 216427 (638 letters) | 9e-36 | >ref\|NP_014936.1\| Ribosomal protein S10A; Rps10ap [Saccharomyces cerevisiae] sp\|Q08745\|RS1A_YEAST 40S RIBOSOMAL PROTEIN S10-A pir\|\|S67197 ribosomal protein S10.e.A, cytosolic - yeast (Saccharomyces cerevisiae) emb\|CAA99521.1\| (Z75201) ORF YOR293w [Saccharomyces cerevisiae] |
| 216433 (305 letters) | 7e-04 | >pir\|\|T48786 tRNA-splicing endonuclease beta chain related protein [imported] - Neurospora crassa emb\|CAB88602.1\| (AL353820) related to tRNA-splicing endonuclease beta chain [Neurospora crassa] |
| 216449 (563 letters) | 7e-24 | >sp\|P25710\|NUJM_NEUCR NADH-UBIQUINONE OXIDOREDUCTASE 21.3 KD SUBUNIT pir\|\|S14277 NADH dehydrogenase (ubiquinone) (EC 1.6.5.3) 21.3K chain - Neurospora crassa emb\|CAA39949.1\| (X56612) NADH dehydrogenase [Neurospora crassa] |
| 216495 (530 letters) | 1e-34 | >emb\|CAC28656.1\| (AL513443) related to BCS1 protein [Neurospora crassa] |
| 218801 (608 letters) | 6e-47 | >dbj\|BAB33417.1\| (AB049719) putative senescence-associated protein [Pisum sativum] |
| 218813 (565 letters) | 5e-06 | >sp\|Q99144\|PEX5_YARLI PEROXISOMAL TARGETING SIGNAL RECEPTOR (PEROXISOMAL PROTEIN PAY32) (PEROXIN-5) (PTS1 RECEPTOR) gb\|AAA85166.1\| (U28155) Pay32p [Yarrowia lipolytica] prf\|\|2204319A Pay32 gene [Yarrowia lipolytica] |
| 218922 (507 letters) | 2e-43 | >emb\|CAC27836.1\| (AJ310443) glutamine synthetase [Gibberella fujikuroi] |
| 218924 (508 letters) | 2e-17 | >emb\|CAB55552.1\| (AJ243538) Fox2 protein [Glomus mosseae] |
| 218926 (284 letters) | 2e-27 | >emb\|CAB43936.1\| (AJ131668) GABA permease [Aspergillus nidulans] |
| 218947 (502 letters) | 2e-19 | >gb\|AAK34440.1\| (AE006598) putative glycerol kinase [Streptococcus pyogenes] |
| 218985 (500 letters) | 6e-11 | >emb\|CAB89767.1\| (AL354616) putative hydrolase. [Streptomyces coelicolor A3(2)] |
| 219006 (565 letters) | 3e-68 | >pir\|\|T49534 hypothetical protein B21J21.130 [imported] - Neurospora crassa emb\|CAB91335.1\| (AL355929) conserved hypothetical protein [Neurospora crassa] |
| 219066 (545 letters) | 7e-51 | >emb\|CAB53336.1\| (AJ249117) methylcitrate synthase [Aspergillus nidulans] |

FIG. 3 continued

| Query Contig ID (length, bp) | Pz Score | Result |
|---|---|---|
| 219090 (615 letters) | 7e-06 | >sp\|Q01663\|AP1_SCHPO AP-1-LIKE TRANSCRIPTION FACTOR pir\|\|S15664 transcription factor pap1 - fission yeast (Schizosaccharomyces pombe) emb\|CAA40363.1\| (X57078) AP-1-like transcription factor [Schizosaccharomyces pombe] |
| 219136 (513 letters) | 6e-33 | >sp\|Q05493\|THIK_YARLI 3-KETOACYL-COA THIOLASE, PEROXISOMAL PRECURSOR (BETA-KETOTHIOLASE) (ACETYL-COA ACYLTRANSFERASE) (PEROXISOMAL 3-OXOACYL-COA THIOLASE) pir\|\|S36838 acetyl-CoA C-acyltransferase (EC 2.3.1.16), peroxisomal - yeast (Yarrowia lipolytica) emb\|CAA49605.1\| (X69988) acetyl-CoA acyltransferase [Yarrowia lipolytica] |
| 219159 (317 letters) | 2e-30 | >ref\|NP_005580.1\| methylmalonate-semialdehyde dehydrogenase [Homo sapiens] ref\|XP_012348.2\| methylmalonate-semialdehyde dehydrogenase [Homo sapiens] sp\|Q02252\|MMSA_HUMAN METHYLMALONATE-SEMIALDEHYDE DEHYDROGENASE [ACYLATING], MITOCHONDRIAL PRECURSOR (MMSDH) gb\|AAF04489.1\|AF148505_1 (AF148505) methylmalonate-semialdehyde dehydrogenase [Homo sapiens] emb\|CAB76468.1\| (AJ249994) methylmalonate semialdehyde dehydrogenase [Homo sapiens] gb\|AAF80380.1\|AF159889_1 (AF159889) methylmalonate semialdehyde dehydrogenase [Homo sapiens] gb\|AAG29581.1\|AF148855_1 (AF148855) methylmalonate-semialdehyde dehydrogenase [Homo sapiens] gb\|AAH04909.1\|AAH04909 (BC004909) methylmalonate-semialdehyde dehydrogenase [Homo sapiens] |
| 219218 (345 letters) | 2e-17 | >sp\|Q12726\|HOSM_YARLI HOMOCITRATE SYNTHASE, MITOCHONDRIAL PRECURSOR emb\|CAA88928.1\| (Z49114) homocitrate synthase (acetyl-coenzyme A:2-Ketoglutarate C-acetyltransferase) [Yarrowia lipolytica] |
| 219244 (515 letters) | 3e-20 | >ref\|NP_009936.1\| Ady2p [Saccharomyces cerevisiae] sp\|P25613\|YCQ0_YEAST HYPOTHETICAL 30.7 KD PROTEIN IN RVS161-ADP1 INTERGENIC REGION pir\|\|S19420 hypothetical protein YCR010c - yeast (Saccharomyces cerevisiae) emb\|CAA42327.1\| (X59720) YCR010c, len:283 [Saccharomyces cerevisiae] |

FIG. 3 continued

| Query Contig ID (length, bp) | Pz Score | Result |
|---|---|---|
| 23794 (857 letters) | 6e-59 | >pir\|\|S60129 H+-transporting ATPase (EC 3.6.1.35), vacuolar, 16K chain (clone AVA-P1) - Arabidopsis thaliana pir\|\|S60130 H+-transporting ATPase (EC 3.6.1.35) 16K chain P1/P3, vacuolar - Arabidopsis thaliana gb\|AAA99933.1\| (L44581) vacuolar H+-pumping ATPase 16 kDa proteolipid [Arabidopsis thaliana] gb\|AAA99935.1\| (L44583) vacuolar H+-pumping ATPase 16 kDa proteolipid [Arabidopsis thaliana] emb\|CAA18851.1\| (AL023094) vacuolar H+-transporting ATPase 16K chain [Arabidopsis thaliana] emb\|CAB38812.1\| (AL035679) H+-transporting ATPase 16K chain P2, vacuolar [Arabidopsis thaliana] gb\|AAD26493.1\|AC007195_7 (AC007195) putative vacuolar proton-ATPase 16 kDa proteolipid [Arabidopsis thaliana] emb\|CAB80189.1\| (AL161586) vacuolar H+-transporting ATPase 16K chain [Arabidopsis thaliana] emb\|CAB80555.1\| (AL161594) H+-transporting ATPase 16K chain P2, vacuolar [Arabidopsis thaliana] gb\|AAK49588.1\|AF372872_1 (AF372872) AT4g34720/T4L20_300 [Arabidopsis thaliana] |
| 258904 Contig A (664 letters) | e-112 | >pir\|\|T08408 transcription factor homolog F18B3.150 - Arabidopsis thaliana emb\|CAB42916.1\| (AL049862) transcription factor-like protein [Arabidopsis thaliana] |
| 258904 Contig B (208 letters) | 1e-36 | >pir\|\|T08408 transcription factor homolog F18B3.150 - Arabidopsis thaliana emb\|CAB42916.1\| (AL049862) transcription factor-like protein [Arabidopsis thaliana] |
| 258906 (731 letters) | e-113 | >gb\|AAG37899.1\| (AF312662) MADS-box protein AGL16 [Arabidopsis thaliana] |
| 258915 (758 letters) | e-138 | >pir\|\|T46184 hypothetical protein T8H10.80 - Arabidopsis thaliana emb\|CAB66105.1\| (AL133248) putative protein [Arabidopsis thaliana] |
| 258924 Contig A (543 letters) | e-103 | >pir\|\|T47501 dof6 zinc finger protein - Arabidopsis thaliana emb\|CAB75490.1\| (AL138657) dof6 zinc finger protein [Arabidopsis thaliana] |
| 258924 Contig B (139 letters) | 2e-13 | >pir\|\|T47501 dof6 zinc finger protein - Arabidopsis thaliana emb\|CAB75490.1\| (AL138657) dof6 zinc finger protein [Arabidopsis thaliana] |
| 258965 (865 letters) | e-148 | >pir\|\|T05033 floral homeotic protein agamous - Arabidopsis thaliana (fragment) emb\|CAA16753.1\| (AL021711) floral homeotic protein agamous [Arabidopsis thaliana] emb\|CAB78898.1\| (AL161549) floral homeotic protein agamous [Arabidopsis thaliana] |
| 258966 Contig A (654 letters) | 6e-61 | >pir\|\|T47923 probable DNA-binding protein - Arabidopsis thaliana emb\|CAB71061.1\| (AL137898) putative DNA-binding protein [Arabidopsis thaliana] |
| 258966 Contig B (448 letters) | 2e-59 | >pir\|\|T47923 probable DNA-binding protein - Arabidopsis thaliana emb\|CAB71061.1\| (AL137898) putative DNA-binding protein [Arabidopsis thaliana] |

FIG. 3 continued

| Query Contig ID (length, bp) | Pz Score | Result |
|---|---|---|
| 258967 (498 letters) | 3e-75 | >pir\|\|T01715 hypothetical protein A_IG002N01.20 - Arabidopsis thaliana gb\|AAB61027.1\| (AF007269) contains weak similarity to MYB-related proteins [Arabidopsis thaliana] |
| 258970 (428 letters) | 3e-81 | >gb\|AAD03444.1\| (AF118223) contains similarity to Methanobacterium thermoautotrophicum transcriptional regulator (GB:AE000850) [Arabidopsis thaliana] emb\|CAB80848.1\| (AL161501) putative protein [Arabidopsis thaliana] |
| 258978 (956 letters) | 0.0 | >pir\|\|T47971 seven in absentia-like protein - Arabidopsis thaliana emb\|CAB71109.1\| (AL132959) seven in absentia-like protein [Arabidopsis thaliana] |
| 258996 (434 letters) | 2e-81 | >emb\|CAB80849.1\| (AL161501) putative protein [Arabidopsis thaliana] |
| 259006 (653 letters) | e-118 | >pir\|\|T05769 myb-related protein M4E13.50 - Arabidopsis thaliana emb\|CAA17764.1\| (AL022023) MYB-like protein [Arabidopsis thaliana] emb\|CAB80216.1\| (AL161586) MYB-like protein [Arabidopsis thaliana] |
| 259007 (845 letters) | e-143 | >sp\|P46604\|HT22_ARATH HOMEOBOX-LEUCINE ZIPPER PROTEIN HAT22 (HD-ZIP PROTEIN 22) pir\|\|T06026 homeobox protein HAT22 - Arabidopsis thaliana gb\|AAA56902.1\| (U09336) homeobox protein [Arabidopsis thaliana] gb\|AAA56903.1\| (U09337) homeobox protein [Arabidopsis thaliana] emb\|CAB38927.1\| (AL035709) homeobox protein HAT22 [Arabidopsis thaliana] emb\|CAB80444.1\| (AL161592) homeobox protein HAT22 [Arabidopsis thaliana] |
| 259018 (1067 letters) | e-160 | >pir\|\|T04270 hypothetical protein F20B18.260 - Arabidopsis thaliana emb\|CAB39680.1\| (AL049483) putative transcription factor [Arabidopsis thaliana] emb\|CAB79470.1\| (AL161564) putative transcription factor [Arabidopsis thaliana] |
| 259028 Contig A (663 letters) | e-121 | >pir\|\|T48336 hypothetical protein F15A17.180 - Arabidopsis thaliana emb\|CAB86082.1\| (AL163002) putative protein [Arabidopsis thaliana] |
| 259028 Contig B (157 letters) | 4e-24 | >pir\|\|T48336 hypothetical protein F15A17.180 - Arabidopsis thaliana emb\|CAB86082.1\| (AL163002) putative protein [Arabidopsis thaliana] |
| 259033 (549 letters) | 9e-73 | >pir\|\|T06056 hypothetical protein F19H22.60 - Arabidopsis thaliana emb\|CAB38816.1\| (AL035679) putative zinc finger protein [Arabidopsis thaliana] emb\|CAB80559.1\| (AL161594) putative zinc finger protein [Arabidopsis thaliana] |
| 259045 (719 letters) | e-126 | >pir\|\|T48406 homeodomain-like protein - Arabidopsis thaliana emb\|CAB82944.1\| (AL162506) homeodomain-like protein [Arabidopsis thaliana] dbj\|BAB08604.1\| (AB005235) homeodomain-like protein [Arabidopsis thaliana] |

FIG. 3 continued

| Query Contig ID (length, bp) | Pz Score | Result |
|---|---|---|
| 262408 (437 letters) | 3e-75 | >pir\|\|T45922 probable C2H2-type zinc finger protein - Arabidopsis thaliana emb\|CAB88344.1\| (AL132960) putative C2H2-type zinc finger protein [Arabidopsis thaliana] |
| 262505 (770 letters) | e-136 | >pir\|\|T46029 CCHH finger protein T10K17.280 - Arabidopsis thaliana emb\|CAB67635.1\| (AL132977) zinc finger-like protein [Arabidopsis thaliana] |
| 262509 (926 letters) | e-141 | >pir\|\|T06020 transcription factor homolog T28I19.10 - Arabidopsis thaliana emb\|CAB38921.1\| (AL035709) bZIP transcription factor-like protein [Arabidopsis thaliana] emb\|CAB80438.1\| (AL161592) bZIP transcription factor-like protein [Arabidopsis thaliana] |
| 262648 Contig A (512 letters) | 3e-97 | >pir\|\|A71431 hypothetical protein - Arabidopsis thaliana emb\|CAB10419.1\| (Z97341) transcription factor like protein [Arabidopsis thaliana] emb\|CAB78685.1\| (AL161544) transcription factor like protein [Arabidopsis thaliana] |
| 262648 Contig B (598 letters) | e-109 | >pir\|\|A71431 hypothetical protein - Arabidopsis thaliana emb\|CAB10419.1\| (Z97341) transcription factor like protein [Arabidopsis thaliana] emb\|CAB78685.1\| (AL161544) transcription factor like protein [Arabidopsis thaliana] |
| 262650 (607 letters) | 8e-83 | >pir\|\|T47955 hypothetical protein F15G16.20 - Arabidopsis thaliana emb\|CAB71093.1\| (AL132959) putative protein [Arabidopsis thaliana] |
| 262658 (656 letters) | 1e-80 | >pir\|\|T45846 zinc-finger-like protein - Arabidopsis thaliana emb\|CAB62101.1\| (AL132978) zinc-finger-like protein [Arabidopsis thaliana] |
| 262715 Contig A (548 letters) | 6e-93 | >emb\|CAB46040.1\| (Z97341) apetala2 domain TINY like protein [Arabidopsis thaliana] emb\|CAB78717.1\| (AL161544) apetala2 domain TINY like protein [Arabidopsis thaliana] |
| 262715 Contig B (173 letters) | 9e-10 | >gb\|AAC99371.1\| (AF076155) CRT/DRE binding factor 2 [Arabidopsis thaliana] |
| 262725 (995 letters) | e-174 | >pir\|\|T01944 hypothetical protein F1I04.9 - Arabidopsis thaliana gb\|AAC62776.1\| (AF096370) contains similarity to Arabidopsis thaliana AP2 domain containing protein RAP2.8 (GB:AF003101) emb\|CAB77720.1\| (AL161492) putative DNA-binding protein [Arabidopsis thaliana] |
| 262762 (1079 letters) | 0.0 | >pir\|\|T13430 hypothetical protein T17A13.10 - Arabidopsis thaliana emb\|CAB79677.1\| (AL161574) putative protein [Arabidopsis thaliana] |
| 262783 (863 letters) | e-150 | >pir\|\|T06129 zinc finger protein F23E12.160 - Arabidopsis thaliana emb\|CAA18741.1\| (AL022604) putative zinc-finger protein [Arabidopsis thaliana] emb\|CAB80245.1\| (AL161587) putative zinc-finger protein [Arabidopsis thaliana] |
| 263004 (640 letters) | e-110 | >emb\|CAB81358.1\| (AL161563) transcriptional activator CBF1-like protein [Arabidopsis thaliana] |

FIG. 3 continued

| Query Contig ID (length, bp) | Pz Score | Result |
|---|---|---|
| 263005 (538 letters) | e-100 | >pir\|\|T48411 Terminal flower1 (TFL1) - Arabidopsis thaliana gb\|AAB41624.1\| (U77674) terminal flower 1 [Arabidopsis thaliana] dbj\|BAA20483.1\| (D86932) terminal flower1 [Arabidopsis thaliana] dbj\|BAA20484.1\| (D87130) terminal flower1 [Arabidopsis thaliana] dbj\|BAA20485.1\| (D87519) terminal flower1 [Arabidopsis thaliana] emb\|CAB85504.1\| (AL162873) Terminal flower1 (TFL1) [Arabidopsis thaliana] dbj\|BAB08610.1\| (AB005235) terminal flower 1 [Arabidopsis thaliana] |
| 263006 (695 letters) | e-125 | >pir\|\|T51587 filamentous flower protein FIL [validated] - Arabidopsis thaliana gb\|AAB82644.1\| (AC002387) unknown protein [Arabidopsis thaliana] gb\|AAC69834.1\| (AF074948) FIL [Arabidopsis thaliana] gb\|AAD16053.1\| (AF087015) abnormal floral organs protein [Arabidopsis thaliana] gb\|AAD33715.1\|AF136538_1 (AF136538) YABBY1 [Arabidopsis thaliana] |
| 263009 (450 letters) | 2e-68 | >gb\|AAC49771.1\| (AF003098) AP2 domain containing protein RAP2.5 [Arabidopsis thaliana] |
| 263030 (1028 letters) | e-179 | >gb\|AAD55630.1\|AC008017_3 (AC008017) Transcription Factor [Arabidopsis thaliana] |
| 263033 (665 letters) | 7e-92 | >gb\|AAD41726.1\| (AF104900) homeobox protein ATHB6 [Arabidopsis thaliana] |
| 263037 Contig A (376 letters) | 3e-68 | >gb\|AAD33716.1\|AF136539_1 (AF136539) YABBY2 [Arabidopsis thaliana] |
| 263037 Contig B (298 letters) | 3e-40 | >gb\|AAD33716.1\|AF136539_1 (AF136539) YABBY2 [Arabidopsis thaliana] |
| 263050 (641 letters) | 3e-74 | >gb\|AAF32292.1\| (AF216581) AP2/EREBP-like transcription factor LEAFY PETIOLE [Arabidopsis thaliana] dbj\|BAB11119.1\| (AB005230) AP2/EREBP-like transcription factor LEAFY PETIOLE [Arabidopsis thaliana] |
| 263060 Contig A (325 letters) | 6e-54 | >pir\|\|T51659 myb-related transcription factor MYB51 [imported] - Arabidopsis thaliana gb\|AAC83609.1\| (AF062887) putative transcription factor [Arabidopsis thaliana] gb\|AAF98417.1\|AC026238_9 (AC026238) Putative transcription factor MYB51 [Arabidopsis thaliana] |
| 263060 Contig B (649 letters) | e-105 | >pir\|\|T51659 myb-related transcription factor MYB51 [imported] - Arabidopsis thaliana gb\|AAC83609.1\| (AF062887) putative transcription factor [Arabidopsis thaliana] gb\|AAF98417.1\|AC026238_9 (AC026238) Putative transcription factor MYB51 [Arabidopsis thaliana] |
| 263070 Contig A (566 letters) | 9e-67 | >gb\|AAC32924.1\| (AC004138) homeodomain transcription factor (AGL30) [Arabidopsis thaliana] |
| 263070 Contig B (597 letters) | 4e-57 | >gb\|AAC32924.1\| (AC004138) homeodomain transcription factor (AGL30) [Arabidopsis thaliana] |

FIG. 3 continued

| Query Contig ID (length, bp) | Pz Score | Result |
|---|---|---|
| 263078 Contig A (255 letters) | 3e-36 | >pir\|\|T45859 R2R3-MYB transcription factor - Arabidopsis thaliana emb\|CAB62114.1\| (AL132978) R2R3-MYB transcription factor [Arabidopsis thaliana] |
| 263078 Contig B (394 letters) | 3e-68 | >pir\|\|T51830 transcription factor DREB1A [imported] - Arabidopsis thaliana dbj\|BAA33791.1\| (AB007787) DREB1A [Arabidopsis thaliana] gb\|AAC78646.1\| (AF062924) transcriptional activator CBF1 homolog [Arabidopsis thaliana] gb\|AAC99370.1\| (AF076155) CRT/DRE binding factor 3 [Arabidopsis thaliana] gb\|AAD15977.1\| (AF074602) CRT/DRE binding factor 3 [Arabidopsis thaliana] |
| 263078 Contig C (665 letters) | e-100 | >emb\|CAA74604.1\| (Y14208) R2R3-MYB transcription factor [Arabidopsis thaliana] |
| 263110 (656 letters) | e-119 | >pir\|\|JE0299 transcrition factor DREB1C [imported] - Arabidopsis thaliana dbj\|BAA33436.1\| (AB013817) DREB1C [Arabidopsis thaliana] dbj\|BAA33793.1\| (AB007789) DREB1C [Arabidopsis thaliana] gb\|AAC78647.1\| (AF062925) transcriptional activator CBF1 homolog [Arabidopsis thaliana] gb\|AAD15976.1\| (AF074601) CRT/DRE binding factor 2 [Arabidopsis thaliana] emb\|CAB51470.1\| (AL022197) DRE/CRT-binding protein DREB1C [Arabidopsis thaliana] emb\|CAB81357.1\| (AL161563) DRE/CRT-binding protein DREB1C [Arabidopsis thaliana] |
| 263114 Contig A (192 letters) | 7e-27 | >gb\|AAC99371.1\| (AF076155) CRT/DRE binding factor 2 [Arabidopsis thaliana] |
| 263114 Contig B (169 letters) | 1e-25 | >pir\|\|T05800 probable transcription regulator M7J2.160 - Arabidopsis thaliana |
| 263125 (773 letters) | e-144 | >gb\|AAA64789.1\| (L36925) amino acid feature: K-box, bp 283..480; amino acid feature: MADS box; codes for a putative DNA-binding domain, bp 3 .. 171 [Arabidopsis thaliana] |
| 263127 (1109 letters) | 0.0 | >pir\|\|T01017 hypothetical protein T5I7.18 - Arabidopsis thaliana gb\|AAB95273.1\| (AF002109) putative MYB family transcription factor [Arabidopsis thaliana] gb\|AAD53093.1\|AF175988_1 (AF175988) putative transcription factor [Arabidopsis thaliana] |
| 263136 Contig A (508 letters) | 3e-83 | >pir\|\|T48375 transcription co-activator-like protein [imported] - Arabidopsis thaliana emb\|CAB83310.1\| (AL162751) transcriptional co-activator-like protein [Arabidopsis thaliana] |
| 263136 Contig B (165 letters) | 1e-06 | >pir\|\|T48375 transcription co-activator-like protein [imported] - Arabidopsis thaliana emb\|CAB83310.1\| (AL162751) transcriptional co-activator-like protein [Arabidopsis thaliana] |

FIG. 3 continued

| Query Contig ID (length, bp) | Pz Score | Result |
|---|---|---|
| 263146 (302 letters) | 9e-51 | >sp\|O80340\|ERF4_ARATH ETHYLENE RESPONSIVE ELEMENT BINDING FACTOR 4 (ATERF4) dbj\|BAA32421.1\| (AB008106) ethylene responsive element binding factor 4 [Arabidopsis thaliana] gb\|AAF34830.1\| (AC023839) ethylene responsive element binding factor 4 [Arabidopsis thaliana] dbj\|BAB02150.1\| (AP000413) ethylene responsive element binding factor 4 -like protein [Arabidopsis thaliana] |
| 263154 (1015 letters) | e-168 | >gb\|AAD20907.1\| (AC006234) AP2 domain transcription factor [Arabidopsis thaliana] |
| 263157 (647 letters) | e-111 | >pir\|\|JE0298 transcription factor DREB1B, low-temperature induced [validated] - Arabidopsis thaliana emb\|CAA18177.1\| (AL022197) transcriptional activator CBF1/ CRT/CRE binding factor 1 [Arabidopsis thaliana] dbj\|BAA33435.1\| (AB013816) DREB1B [Arabidopsis thaliana] dbj\|BAA33792.1\| (AB007788) DREB1B [Arabidopsis thaliana] emb\|CAB81359.1\| (AL161563) transcriptional activator CBF1/ CRT/CRE binding factor 1 [Arabidopsis thaliana] |
| 263177 (842 letters) | e-130 | >gb\|AAG51765.1\|AC066691_5 (AC066691) myb-related transcription factor, putative; 17635-18559 [Arabidopsis thaliana] |
| 263180 (976 letters) | e-169 | >pir\|\|T51621 myb-like protein [imported] - Arabidopsis thaliana emb\|CAA07433.1\| (AJ007289) myb-like protein [Arabidopsis thaliana] dbj\|BAB02134.1\| (AP000386) MYB family transcription factor-like protein [Arabidopsis thaliana] gb\|AAG10145.1\|AF250339_1 (AF250339) Myb30 [Arabidopsis thaliana] |
| 263181 (526 letters) | e-102 | >pir\|\|T47716 transcription factor L2 - Arabidopsis thaliana emb\|CAB81602.1\| (AL161667) transcription factor L2 [Arabidopsis thaliana] |
| 263182 (715 letters) | e-115 | >sp\|O24407\|AXIG_ARATH AUXIN-RESPONSIVE PROTEIN IAA16 (INDOLEACETIC ACID-INDUCED PROTEIN 16) gb\|AAB84353.1\| (U49072) IAA16 [Arabidopsis thaliana] gb\|AAF04899.1\|AC011437_14 (AC011437) auxin-induced protein [Arabidopsis thaliana] gb\|AAG48764.1\|AF332400_1 (AF332400) IAA16 [Arabidopsis thaliana] gb\|AAK53004.1\|AF375420_1 (AF375420) AT3g04730/F7O18_22 [Arabidopsis thaliana] |
| 263184 (627 letters) | e-106 | >sp\|O22456\|AGL9_ARATH AGAMOUS-LIKE MADS BOX PROTEIN AGL9 pir\|\|T00656 MADS box protein AGL9 - Arabidopsis thaliana gb\|AAB67832.1\| (AF015552) AGL9 [Arabidopsis thaliana] gb\|AAC00586.1\| (AC002396) AGL9 [Arabidopsis thaliana] |
| 263186 (551 letters) | 1e-90 | >gb\|AAD30526.1\|AF132606_1 (AF132606) transcription factor CRC [Arabidopsis thaliana] gb\|AAG52485.1\|AC018364_3 (AC018364) transcription factor CRC; 87968-89174 [Arabidopsis thaliana] |

FIG. 3 continued

| Query Contig ID (length, bp) | Pz Score | Result |
|---|---|---|
| 263187 Contig A (99 letters) | 3e-04 | >dbj\|BAB11448.1\| (AB010070) transcription factor-like protein [Arabidopsis thaliana] |
| 263187 Contig C (497 letters) | 9e-87 | >dbj\|BAB11448.1\| (AB010070) transcription factor-like protein [Arabidopsis thaliana] |
| 263191 Contig B (458 letters) | 1e-66 | >gb\|AAD41726.1\| (AF104900) homeobox protein ATHB6 [Arabidopsis thaliana] |
| 263194 (604 letters) | 8e-81 | >gb\|AAK37527.1\|AF342808_1 (AF342808) MADS affecting flowering 1 [Arabidopsis thaliana] |
| 263202 (502 letters) | 3e-67 | >emb\|CAB56149.1\| (AJ242970) BTF3b-like factor [Arabidopsis thaliana] gb\|AAF97268.1\|AC034106_11 (AC034106) Strong similarity (practically identical) to BTF3b-like factor from Arabidopsis thaliana gb\|AJ242970 and contains a NAC PF\|01849 domain. ESTs gb\|AV530384, gb\|AV533391, gb\|AV521165, gb\|AV554398, gb\|AV527846, gb\|BE038323, gb\|T76806, gb\|AI9982> gb\|AAG48770.1\|AF332407_1 (AF332407) putative BTF3b factor protein [Arabidopsis thaliana] |
| 263216 (761 letters) | e-125 | >sp\|P29382\|AGL2_ARATH AGAMOUS-LIKE MADS BOX PROTEIN AGL2 pir\|\|B39534 MADS box protein AGL2 - Arabidopsis thaliana gb\|AAA32732.1\| (M55551) transcription factor [Arabidopsis thaliana] |

FIG. 3 continued

| Query Contig ID (length, bp) | Pz Score | Result |
|---|---|---|
| 263221 (607 letters) | e-110 | >sp\|P28147\|TF21_ARATH TRANSCRIPTION INITIATION FACTOR TFIID-1 (TATA-BOX FACTOR 1) (TATA SEQUENCE-BINDING PROTEIN 1) (TBP-1) pir\|\|S10946 transcription initiation factor IID (clone At-2) - Arabidopsis thaliana pdb\|1VOK\|A Chain A, Arabidopsis Thaliana Tbp (Dimer) pdb\|1QNE\|B Chain B, Crystal Structure Of The Adenovirus Major Late Promoter Tata Box Bound To Wild-Type Tbp (Arabidopsis Thaliana Tbp Isoform 2). pdb\|1VOK\|B Chain B, Arabidopsis Thaliana Tbp (Dimer) pdb\|1QN6\|B Chain B, Crystal Structure Of The T(-26) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QNB\|B Chain B, Crystal Structure Of The T(-25) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1VOL\|B Chain B, Tfiib (Human Core Domain)TBP (A.THALIANA)TATA ELEMENT Ternary Complex pdb\|1QNE\|A Chain A, Crystal Structure Of The Adenovirus Major Late Promoter Tata Box Bound To Wild-Type Tbp (Arabidopsis Thaliana Tbp Isoform 2). pdb\|1QN8\|B Chain B, Crystal Structure Of The T(-28) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QNC\|B Chain B, Crystal Structure Of The A(-31) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QNA\|B Chain B, Crystal Structure Of The T(-30) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QN5\|B Chain B, Crystal Structure Of The G(-26) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QN4\|B Chain B, Crystal Structure Of The T(-24) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QN9\|B Chain B, Crystal Structure Of The C(-29) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. |

FIG. 3 continued

| Query Contig ID (length, bp) | Pz Score | Result |
|---|---|---|
| 263224 Contig A (486 letters) | 5e-83 | >sp\|P47927\|AP2_ARATH FLORAL HOMEOTIC PROTEIN APETALA2 gb\|AAC13770.1\| (U12546) APETALA2 protein [Arabidopsis thaliana] emb\|CAB16765.1\| (Z99707) APETALA2 protein [Arabidopsis thaliana] emb\|CAB80358.1\| (AL161590) APETALA2 protein [Arabidopsis thaliana] |
| 263224 Contig B (378 letters) | 4e-56 | >sp\|P47927\|AP2_ARATH FLORAL HOMEOTIC PROTEIN APETALA2 gb\|AAC13770.1\| (U12546) APETALA2 protein [Arabidopsis thaliana] emb\|CAB16765.1\| (Z99707) APETALA2 protein [Arabidopsis thaliana] emb\|CAB80358.1\| (AL161590) APETALA2 protein [Arabidopsis thaliana] |
| 263234 (442 letters) | 5e-60 | >sp\|O24407\|AXIG_ARATH AUXIN-RESPONSIVE PROTEIN IAA16 (INDOLEACETIC ACID-INDUCED PROTEIN 16) gb\|AAB84353.1\| (U49072) IAA16 [Arabidopsis thaliana] gb\|AAF04899.1\|AC011437_14 (AC011437) auxin-induced protein [Arabidopsis thaliana] gb\|AAG48764.1\|AF332400_1 (AF332400) IAA16 [Arabidopsis thaliana] gb\|AAK53004.1\|AF375420_1 (AF375420) AT3g04730/F7O18_22 [Arabidopsis thaliana] |

FIG. 3 continued

| Query Contig ID (length, bp) | Pz Score | Result |
|---|---|---|
| 263245 (168 letters) | 1e-19 | >sp\|P28147\|TF21_ARATH TRANSCRIPTION INITIATION FACTOR TFIID-1 (TATA-BOX FACTOR 1) (TATA SEQUENCE-BINDING PROTEIN 1) (TBP-1) pir\|\|S10946 transcription initiation factor IID (clone At-2) - Arabidopsis thaliana pdb\|1VOK\|A Chain A, Arabidopsis Thaliana Tbp (Dimer) pdb\|1QNE\|B Chain B, Crystal Structure Of The Adenovirus Major Late Promoter Tata Box Bound To Wild-Type Tbp (Arabidopsis Thaliana Tbp Isoform 2). pdb\|1VOK\|B Chain B, Arabidopsis Thaliana Tbp (Dimer) pdb\|1QN6\|B Chain B, Crystal Structure Of The T(-26) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QNB\|B Chain B, Crystal Structure Of The T(-25) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1VOL\|B Chain B, Tfiib (Human Core Domain)TBP (A.THALIANA)TATA ELEMENT Ternary Complex pdb\|1QNE\|A Chain A, Crystal Structure Of The Adenovirus Major Late Promoter Tata Box Bound To Wild-Type Tbp (Arabidopsis Thaliana Tbp Isoform 2). pdb\|1QN8\|B Chain B, Crystal Structure Of The T(-28) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QNC\|B Chain B, Crystal Structure Of The A(-31) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QNA\|B Chain B, Crystal Structure Of The T(-30) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QN5\|B Chain B, Crystal Structure Of The G(-26) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QN4\|B Chain B, Crystal Structure Of The T(-24) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. pdb\|1QN9\|B Chain B, Crystal Structure Of The C(-29) Adenovirus Major Late Promoter Tata Box Variant Bound To Wild-Type Tbp (Arabidopsis Thaliana Tbp Isoform 2). Tata Element Recognition By The Tata Box-Binding Protein Has Been Conserved Throughout Evolution. |

FIG. 3 continued

| Query Contig ID (length, bp) | Pz Score | Result |
|---|---|---|
| 263246 (745 letters) | e-146 | >pir\|\|T51631 probable transcription factor MYB3 [imported] - Arabidopsis thaliana gb\|AAC83581.1\| (AF062859) putative transcription factor [Arabidopsis thaliana] gb\|AAF18515.1\|AC006551_1 (AC006551) Putative DNA binding protein [Arabidopsis thaliana] |
| 263249 (701 letters) | e-128 | >gb\|AAF79582.1\|AC007945_2 (AC007945) F28C11.6 [Arabidopsis thaliana] gb\|AAF87002.1\|AC005292_11 (AC005292) F26F24.29 [Arabidopsis thaliana] |
| 263255 (323 letters) | 3e-58 | >pir\|\|T47501 dof6 zinc finger protein - Arabidopsis thaliana emb\|CAB75490.1\| (AL138657) dof6 zinc finger protein [Arabidopsis thaliana] |
| 263262 (578 letters) | e-115 | >gb\|AAK49575.1\|AF370569_1 (AF370569) similar to transcription factor SF3 (pir\|IS37656) [Arabidopsis thaliana] |
| 263263 Contig A (393 letters) | 1e-74 | >pir\|\|T47977 transcription factor BBFa [similarity] - Arabidopsis thaliana emb\|CAB40190.1\| (AJ224122) DNA-binding protein [Arabidopsis thaliana] emb\|CAB71892.1\| (AL138642) transcription factor BBFa [Arabidopsis thaliana] emb\|CAA66600.2\| (X97941) Zn finger protein [Arabidopsis thaliana] |
| 263263 Contig B (172 letters) | 7e-25 | >pir\|\|T47977 transcription factor BBFa [similarity] - Arabidopsis thaliana emb\|CAB40190.1\| (AJ224122) DNA-binding protein [Arabidopsis thaliana] emb\|CAB71892.1\| (AL138642) transcription factor BBFa [Arabidopsis thaliana] emb\|CAA66600.2\| (X97941) Zn finger protein [Arabidopsis thaliana] |
| 263276 (709 letters) | e-118 | >gb\|AAD25638.1\|AC007210_3 (AC007210) putative MADS-box protein ANR1 [Arabidopsis thaliana] |
| 263320 Contig B (148 letters) | 2e-04 | >gb\|AAF20996.1\|AF208044_1 (AF208044) homeodomain leucine-zipper protein ATHB13 [Arabidopsis thaliana] gb\|AAG52541.1\|AC013289_8 (AC013289) homeobox gene 13 protein; 11736-10437 [Arabidopsis thaliana] |
| 263327 Contig A (324 letters) | 9e-58 | >dbj\|BAA33196.1\| (AB017564) dof zinc finger protein [Arabidopsis thaliana] gb\|AAG50875.1\|AC025294_13 (AC025294) dof zinc finger protein [Arabidopsis thaliana] |
| 263327 Contig B (278 letters) | 2e-31 | >pir\|\|T47716 transcription factor L2 - Arabidopsis thaliana emb\|CAB81602.1\| (AL161667) transcription factor L2 [Arabidopsis thaliana] |
| 263329 (340 letters) | 4e-60 | >gb\|AAG51765.1\|AC066691_5 (AC066691) myb-related transcription factor, putative; 17635-18559 [Arabidopsis thaliana] |
| 263342 Contig A (226 letters) | 3e-30 | >pir\|\|T47501 dof6 zinc finger protein - Arabidopsis thaliana emb\|CAB75490.1\| (AL138657) dof6 zinc finger protein [Arabidopsis thaliana] |
| 263342 Contig B (80 letters) | 2e-04 | >pir\|\|T47501 dof6 zinc finger protein - Arabidopsis thaliana emb\|CAB75490.1\| (AL138657) dof6 zinc finger protein [Arabidopsis thaliana] |
| 263367 (464 letters) | 6e-64 | >gb\|AAG37902.1\| (AF312665) MADS-box protein AGL27-I [Arabidopsis thaliana] |

FIG. 3 continued

| Query Contig ID (length, bp) | Pz Score | Result |
|---|---|---|
| 263393 Contig A (449 letters) | 4e-81 | >gb\|AAF14582.1\|AF188623_1 (AF188623) nucleotide excision repair protein XP-D homolog [Arabidopsis thaliana] |
| 263393 Contig B (253 letters) | 5e-41 | >gb\|AAC72116.1\| (AC005278) Strong similarity to gb\|U04968 nucleotide excision repair protein (ERCC2) from Cricetulus grisseus. [Arabidopsis thaliana] |
| 263514 (559 letters) | 1e-78 | >gb\|AAD41726.1\| (AF104900) homeobox protein ATHB6 [Arabidopsis thaliana] |
| 263534 (744 letters) | e-119 | >dbj\|BAB09515.1\| (AB006705) Myb-related transcription factor-like protein [Arabidopsis thaliana] |
| 263550 Contig A (481 letters) | 2e-76 | >sp\|P48007\|PIST_ARATH FLORAL HOMEOTIC PROTEIN PISTILLATA (TRANSCRIPTION FACTOR PI) pir\|\|A53839 B function floral homeotic protein PI - Arabidopsis thaliana dbj\|BAA06465.1\| (D30807) PI protein [Arabidopsis thaliana] gb\|AAD51985.1\| (AF115816) floral homeotic protein PI [Arabidopsis thaliana] gb\|AAD51986.1\| (AF115817) floral homeotic protein PI [Arabidopsis thaliana] gb\|AAD51987.1\| (AF115818) floral homeotic protein PI [Arabidopsis thaliana] gb\|AAD51989.1\| (AF115820) floral homeotic protein PI [Arabidopsis thaliana] gb\|AAD51990.1\| (AF115821) floral homeotic protein PI [Arabidopsis thaliana] gb\|AAD51992.1\| (AF115823) floral homeotic protein PI [Arabidopsis thaliana] gb\|AAD51996.1\| (AF115827) floral homeotic protein PI [Arabidopsis thaliana] gb\|AAD51998.1\| (AF115829) floral homeotic protein PI [Arabidopsis thaliana] gb\|AAD51999.1\| (AF115830) floral homeotic protein PI [Arabidopsis thaliana] dbj\|BAA87000.1\| (AB035137) transcription factor PI [Arabidopsis thaliana] |
| 263550 Contig B (86 letters) | 5e-05 | >gb\|AAF25591.1\| (AF143382) pistillata [Arabidopsis lyrata] |
| 263557 Contig A (598 letters) | 2e-75 | >pir\|\|T45859 R2R3-MYB transcription factor - Arabidopsis thaliana emb\|CAB62114.1\| (AL132978) R2R3-MYB transcription factor [Arabidopsis thaliana] |
| 263557 Contig B (342 letters) | 2e-54 | >pir\|\|T45859 R2R3-MYB transcription factor - Arabidopsis thaliana emb\|CAB62114.1\| (AL132978) R2R3-MYB transcription factor [Arabidopsis thaliana] |
| 263611 Contig A (280 letters) | 2e-47 | >gb\|AAF97274.1\|AC034106_17 (AC034106) Contains similarity to myb homologue from Arabidopsis thaliana gb\|D10936 and contains two Myb-like DNA-binding PF\|00249 domains |
| 263611 Contig B (366 letters) | 4e-53 | >gb\|AAF97274.1\|AC034106_17 (AC034106) Contains similarity to myb homologue from Arabidopsis thaliana gb\|D10936 and contains two Myb-like DNA-binding PF\|00249 domains |

FIG. 3 continued

| Query Contig ID (length, bp) | Pz Score | Result |
|---|---|---|
| 263617 (428 letters) | 6e-59 | >pir\|\|T01076 transcription factor TINY - Arabidopsis thaliana emb\|CAA64359.1\| (X94698) TINY [Arabidopsis thaliana] gb\|AAC29139.1\| (AC005405) TINY [Arabidopsis thaliana] |
| 263633 (824 letters) | e-136 | >pir\|\|T49898 CCAAT box binding factor/ transcription factor Hap2a - Arabidopsis thaliana emb\|CAB88248.1\| (AL353013) CCAAT box binding factor/ transcription factor Hap2a [Arabidopsis thaliana] |
| 263636 Contig A (177 letters) | 3e-10 | >pir\|\|T05279 transcription factor ATB2 - Arabidopsis thaliana emb\|CAA18838.1\| (AL023094) bZIP transcription factor ATB2 [Arabidopsis thaliana] emb\|CAB80176.1\| (AL161585) bZIP transcription factor ATB2 [Arabidopsis thaliana] |
| 263679 (998 letters) | e-147 | >sp\|P43273\|HBPB_ARATH TRANSCRIPTION FACTOR HBP-1B pir\|\|S35439 transcription factor HBP-1b homolog - Arabidopsis thaliana dbj\|BAA00933.1\| (D10042) AHBP-1b [Arabidopsis thaliana] dbj\|BAB11153.1\| (AB010697) transcription factor HBP-1b homolog [Arabidopsis thaliana] |
| 263681 (209 letters) | 6e-32 | >pir\|\|T01076 transcription factor TINY - Arabidopsis thaliana emb\|CAA64359.1\| (X94698) TINY [Arabidopsis thaliana] gb\|AAC29139.1\| (AC005405) TINY [Arabidopsis thaliana] |
| 316712 (315 letters) | 3e-56 | >gb\|AAF97274.1\|AC034106_17 (AC034106) Contains similarity to myb homologue from Arabidopsis thaliana gb\|D10936 and contains two Myb-like DNA-binding PF\|00249 domains |
| 316731 (519 letters) | 4e-69 | >gb\|AAF97274.1\|AC034106_17 (AC034106) Contains similarity to myb homologue from Arabidopsis thaliana gb\|D10936 and contains two Myb-like DNA-binding PF\|00249 domains |
| 316741 (407 letters) | 3e-61 | >gb\|AAC49769.1\| (AF003096) AP2 domain containing protein RAP2.3 [Arabidopsis thaliana] dbj\|BAB02769.1\| (AB022217) AP2 domain transcription factor RAP2.3 [Arabidopsis thaliana] |
| 316762 (390 letters) | 1e-60 | >sp\|O80338\|ERF2_ARATH ETHYLENE RESPONSIVE ELEMENT BINDING FACTOR 2 (ATERF2) dbj\|BAA32419.1\| (AB008104) ethylene responsive element binding factor 2 [Arabidopsis thaliana] dbj\|BAA97155.1\| (AB018117) ethylene responsive element binding factor 2 (ATERF2) [Arabidopsis thaliana] |
| 316804 (447 letters) | 5e-63 | >gb\|AAD49979.1\|AC008075_12 (AC008075) Identical to gb\|AF111711 transcription factor PERIANTHIA from Arabidopsis thaliana |
| 316820 (105 letters) | 2e-12 | >pir\|\|T04563 myb-related protein homolog T12H17.70 - Arabidopsis thaliana emb\|CAA16553.1\| (AL021635) myb-like protein [Arabidopsis thaliana] gb\|AAD53098.1\|AF175993_1 (AF175993) putative transcription factor [Arabidopsis thaliana] emb\|CAB79223.1\| (AL161557) myb-like protein [Arabidopsis thaliana] |

FIG. 3 continued

| Query Contig ID (length, bp) | Pz Score | Result |
|---|---|---|
| 316828 (377 letters) | 2e-64 | >emb\|CAA74605.1\| (Y14209) R2R3-MYB transcription factor [Arabidopsis thaliana] |
| 316833 (145 letters) | 5e-17 | >emb\|CAA71073.1\| (Y09942) EBP [Arabidopsis thaliana] |
| 316834 (637 letters) | 2e-73 | >gb\|AAD53104.1\|AF175999_1 (AF175999) putative transcription factor [Arabidopsis thaliana] |
| 316835 (380 letters) | 8e-61 | >pir\|\|JE0298 transcription factor DREB1B, low-temperature induced [validated] - Arabidopsis thaliana emb\|CAA18177.1\| (AL022197) transcriptional activator CBF1/ CRT/CRE binding factor 1 [Arabidopsis thaliana] dbj\|BAA33435.1\| (AB013816) DREB1B [Arabidopsis thaliana] dbj\|BAA33792.1\| (AB007788) DREB1B [Arabidopsis thaliana] emb\|CAB81359.1\| (AL161563) transcriptional activator CBF1/ CRT/CRE binding factor 1 [Arabidopsis thaliana] |
| 316837 (488 letters) | 4e-92 | >pir\|\|E71444 probable EREBP-4 - Arabidopsis thaliana emb\|CAB10530.1\| (Z97343) EREBP-4 like protein [Arabidopsis thaliana] emb\|CAB78752.1\| (AL161546) EREBP-4 like protein [Arabidopsis thaliana] |
| 316847 (680 letters) | e-132 | >gb\|AAF97274.1\|AC034106_17 (AC034106) Contains similarity to myb homologue from Arabidopsis thaliana gb\|D10936 and contains two Myb-like DNA-binding PF\|00249 domains |
| 316850 (155 letters) | 6e-13 | >gb\|AAC49769.1\| (AF003096) AP2 domain containing protein RAP2.3 [Arabidopsis thaliana] dbj\|BAB02769.1\| (AB022217) AP2 domain transcription factor RAP2.3 [Arabidopsis thaliana] |
| 316857 (319 letters) | 5e-60 | >pir\|\|T05891 myb-related protein homolog F6H11.100 - Arabidopsis thaliana emb\|CAA16681.1\| (AL021684) myb - related protein [Arabidopsis thaliana] dbj\|BAB10686.1\| (AB010075) transcription factor-like protein [Arabidopsis thaliana] |
| 316860 (550 letters) | e-105 | >sp\|P45432\|FUS6_ARATH FUSCA PROTEIN FUS6 gb\|AAA32792.1\| (L26498) FUS6 [Arabidopsis thaliana] |
| 316861 (395 letters) | 5e-60 | >gb\|AAC49769.1\| (AF003096) AP2 domain containing protein RAP2.3 [Arabidopsis thaliana] dbj\|BAB02769.1\| (AB022217) AP2 domain transcription factor RAP2.3 [Arabidopsis thaliana] |
| 316870 (507 letters) | 2e-56 | >emb\|CAA11837.1\| (AJ224119) AT-hook protein 2 [Arabidopsis thaliana] |

FIG. 3 continued

| Query Contig ID (length, bp) | Pz Score | Result |
|---|---|---|
| 316883 (639 letters) | e-112 | >pir\|\|JE0298 transcription factor DREB1B, low-temperature induced [validated] - Arabidopsis thaliana emb\|CAA18177.1\| (AL022197) transcriptional activator CBF1/ CRT/CRE binding factor 1 [Arabidopsis thaliana] dbj\|BAA33435.1\| (AB013816) DREB1B [Arabidopsis thaliana] dbj\|BAA33792.1\| (AB007788) DREB1B [Arabidopsis thaliana] emb\|CAB81359.1\| (AL161563) transcriptional activator CBF1/ CRT/CRE binding factor 1 [Arabidopsis thaliana] |
| 316886 (665 letters) | 1e-92 | >emb\|CAA10857.1\| (AJ222585) AT-hook protein 1 [Arabidopsis thaliana] |
| 316902 (587 letters) | 3e-36 | >pir\|\|T45710 H-protein promoter binding factor-2a - Arabidopsis thaliana gb\|AAC28390.1\| (AF079503) H-protein promoter binding factor-2a [Arabidopsis thaliana] emb\|CAB61976.1\| (AL132955) H-protein promoter binding factor-2a [Arabidopsis thaliana] |
| 316903 (644 letters) | e-113 | >sp\|P48512\|TF2B_ARATH TRANSCRIPTION INITIATION FACTOR IIB (TFIIB) pir\|\|T00819 transcription initiation factor IIB - Arabidopsis thaliana gb\|AAB09755.1\| (U31096) transcription factor TFIIB [Arabidopsis thaliana] gb\|AAB84344.1\| (AC002510) transcription factor IIB (TFIIB) [Arabidopsis thaliana] |
| 316906 (657 letters) | e-115 | >gb\|AAF63476.1\| (AF236101) putative dicarboxylate diiron protein [Arabidopsis thaliana] |
| 316924 (630 letters) | e-119 | >pir\|\|T50007 transcription factor OBF4 - Arabidopsis thaliana emb\|CAB92044.1\| (AL356332) transcription factor OBF4 [Arabidopsis thaliana] |
| 316934 (379 letters) | 4e-48 | >sp\|Q04088\|PF21_ARATH POSSIBLE TRANSCRIPTION FACTOR POSF21 pir\|\|S21883 DNA-binding protein POSF21 - Arabidopsis thaliana emb\|CAA43366.1\| (X61031) posF21 [Arabidopsis thaliana] gb\|AAD26486.1\|AC007169_18 (AC007169) bZIP transcription factor (POSF21) [Arabidopsis thaliana] |
| 316938 (683 letters) | e-119 | >sp\|P29382\|AGL2_ARATH AGAMOUS-LIKE MADS BOX PROTEIN AGL2 pir\|\|B39534 MADS box protein AGL2 - Arabidopsis thaliana gb\|AAA32732.1\| (M55551) transcription factor [Arabidopsis thaliana] |
| 316941 (654 letters) | e-105 | >sp\|P42774\|GBF1_ARATH G-BOX BINDING FACTOR 1 emb\|CAA68197.1\| (X99941) G-box binding factor 1 [Arabidopsis thaliana] emb\|CAB16806.1\| (Z99708) G-box-binding factor 1 [Arabidopsis thaliana] emb\|CAB80339.1\| (AL161589) G-box-binding factor 1 [Arabidopsis thaliana] |
| 316944 (523 letters) | 2e-39 | >sp\|P29382\|AGL2_ARATH AGAMOUS-LIKE MADS BOX PROTEIN AGL2 pir\|\|B39534 MADS box protein AGL2 - Arabidopsis thaliana gb\|AAA32732.1\| (M55551) transcription factor [Arabidopsis thaliana] |

FIG. 3 continued

| Query Contig ID (length, bp) | Pz Score | Result |
|---|---|---|
| 316947 (651 letters) | e-102 | >sp\|P42774\|GBF1_ARATH G-BOX BINDING FACTOR 1 emb\|CAA68197.1\| (X99941) G-box binding factor 1 [Arabidopsis thaliana] emb\|CAB16806.1\| (Z99708) G-box-binding factor 1 [Arabidopsis thaliana] emb\|CAB80339.1\| (AL161589) G-box-binding factor 1 [Arabidopsis thaliana] |
| 316970 (637 letters) | e-109 | >sp\|Q38841\|AG12_ARATH AGAMOUS-LIKE MADS BOX PROTEIN AGL12 gb\|AAF43220.1\|AC012654_4 (AC012654) Identical to the Arabidopsis thaliana MADS-box protein AGL12 gb\|ATU20193; It contains a SRF-type transcription factor domain PF\|00319 and a k-box region PF\|01486. EST gb\|AW004480 comes from this gene. gb\|AAG51837.1\|AC016163_26 (AC016163) MADS-box protein AGL12; 21134-23170 [Arabidopsis thaliana] |
| 316974 (639 letters) | e-108 | >sp\|P29386\|AGL6_ARATH AGAMOUS-LIKE MADS BOX PROTEIN AGL6 pir\|\|F39534 floral homeotic protein AGL6 - Arabidopsis thaliana gb\|AAA79328.1\| (M55554) transcription factor [Arabidopsis thaliana] gb\|AAC06173.1\| (AC003680) MADS-box protein (AGL6) [Arabidopsis thaliana] |
| 316976 (686 letters) | e-126 | >pir\|\|T47917 probable transcription factor (MYB17) - Arabidopsis thaliana emb\|CAB71055.1\| (AL137898) putative transcription factor (MYB17) [Arabidopsis thaliana] |
| 316984 (574 letters) | 1e-96 | >pir\|\|T45710 H-protein promoter binding factor-2a - Arabidopsis thaliana gb\|AAC28390.1\| (AF079503) H-protein promoter binding factor-2a [Arabidopsis thaliana] emb\|CAB61976.1\| (AL132955) H-protein promoter binding factor-2a [Arabidopsis thaliana] |
| 316996 (537 letters) | 1e-95 | >sp\|P29383\|AGL3_ARATH AGAMOUS-LIKE MADS BOX PROTEIN AGL3 pir\|\|S57793 MADS box protein AGL3 - Arabidopsis thaliana gb\|AAB38975.1\| (U81369) MADS box protein [Arabidopsis thaliana] gb\|AAD20073.1\| (AC006836) MADS-box protein (AGL3) [Arabidopsis thaliana] |
| 317014 (374 letters) | 4e-57 | >pir\|\|S71365 ovule development protein aintegumenta - Arabidopsis thaliana gb\|AAA91040.1\| (U40256) AINTEGUMENTA [Arabidopsis thaliana] gb\|AAB17364.1\| (U41339) ANT [Arabidopsis thaliana] emb\|CAB38923.1\| (AL035709) ovule development protein aintegumenta (ANT) [Arabidopsis thaliana] emb\|CAB80440.1\| (AL161592) ovule development protein aintegumenta (ANT) [Arabidopsis thaliana] |
| 317021 (227 letters) | 2e-29 | >pir\|\|T04167 MADS box protein - rice gb\|AAB64250.1\| (U78782) MADS box protein [Oryza sativa] |
| 317069 (330 letters) | 4e-35 | >pir\|\|T51409 MADS box protein AGL2 - Arabidopsis thaliana emb\|CAC01779.1\| (AL391144) MADS box protein AGL2 [Arabidopsis thaliana] |

FIG. 3 continued

| Query Contig ID (length, bp) | Pz Score | Result |
|---|---|---|
| 317079 (567 letters) | 3e-97 | >pir\|\|T08917 auxin response factor 9 - Arabidopsis thaliana gb\|AAD24427.1\|AF082176_1 (AF082176) auxin response factor 9 [Arabidopsis thaliana] emb\|CAB43898.1\| (AL078468) auxin response factor 9 (ARF9) [Arabidopsis thaliana] emb\|CAB81316.1\| (AL161560) auxin response factor 9 (ARF9) [Arabidopsis thaliana] gb\|AAK06863.1\|AF344312_1 (AF344312) ARF9 [Arabidopsis thaliana] |
| 43445 Contig A (631 letters) | 3e-62 | >gb\|AAF75749.1\|AF261139_1 (AF261139) dehydration-induced protein ERD15 [Lycopersicon esculentum] |
| 43445 Contig B (163 letters) | 5e-09 | >gb\|AAD51854.1\|AF178990_1 (AF178990) stress related protein [Vitis riparia] |
| 48423 (623 letters) | 9e-30 | >pir\|\|T00834 hypothetical protein T13L16.8 - Arabidopsis thaliana gb\|AAD03568.1\| (AC003952) putative SET-domain transcriptional regulator [Arabidopsis thaliana] |
| 49059 (403 letters) | 2e-49 | >gb\|AAG50935.1\|AC079284_10 (AC079284) GTP-binding protein, putative [Arabidopsis thaliana] |
| 49145 (374 letters) | 1e-66 | >emb\|CAA72681.1\| (Y11931) 1-phosphatidylinositol-4,5-bisphosphate phosphodiesterase [Nicotiana rustica] |
| 49360 (420 letters) | 3e-41 | >pir\|\|T06089 hypothetical protein T9A14.180 - Arabidopsis thaliana emb\|CAB38624.1\| (AL035656) putative protein [Arabidopsis thaliana] emb\|CAB80553.1\| (AL161594) putative protein [Arabidopsis thaliana] |
| 57145 (267 letters) | 5e-21 | >dbj\|BAB09583.1\| (AB018118) CONSTANS-like B-box zinc finger protein-like [Arabidopsis thaliana] |
| 57165 (619 letters) | 9e-66 | >gb\|AAB71386.1\| (AF001035) ASF/SF2 homolog [Arabidopsis thaliana] |
| 57292 (367 letters) | 1e-61 | >gb\|AAF76381.1\|AF068723_1 (AF068723) MADS-box protein MADS4 [Nicotiana tabacum] |
| 57319 (576 letters) | 1e-14 | >gb\|AAD32810.1\|AC007660_11 (AC007660) putative non-LTR retroelement reverse transcriptase [Arabidopsis thaliana] |
| 57374 Contig A (645 letters) | 5e-32 | >dbj\|BAA97070.1\| (AP000370) RING-finger protein (C-terminal)-like [Arabidopsis thaliana] |
| 57506 (661 letters) | 1e-17 | >dbj\|BAB55713.1\| (AP003104) contains EST C72833(E2340)~unknown protein [Oryza sativa] |
| 103896 (509 letters) | 3e-54 | >gb\|AAC79595.1\| (AC005727) unknown protein [Arabidopsis thaliana] |
| 104005 (526 letters) | 8e-06 | >pir\|\|T03810 hypothetical protein (clone NF4) - common tobacco gb\|AAC49973.1\| (U66267) ORF; able to induce HR-like lesions [Nicotiana tabacum] |
| 108274 (533 letters) | 2e-65 | >pir\|\|T06595 bifunctional folic acid synthesis protein precursor, mitochondrial [validated] - garden pea emb\|CAA69903.1\| (Y08611) dihydropterin pyrophosphokinase /dihydropteroate synthase [Pisum sativum] |

FIG. 3 continued

| Query Contig ID (length, bp) | Pz Score | Result |
|---|---|---|
| 108496 (631 letters) | 2e-58 | >pir\|\|T48975 xyloglucan endo-transglycosylase - Arabidopsis thaliana emb\|CAB89314.1\| (AL353992) xyloglucan endo-transglycosylase [Arabidopsis thaliana] |
| 109562 (575 letters) | 3e-70 | >pir\|\|T09882 heat shock protein 90 homolog T22A6.20 - Arabidopsis thaliana emb\|CAB45054.1\| (AL078637) HSP90-like protein [Arabidopsis thaliana] emb\|CAB79329.1\| (AL161561) HSP90-like protein [Arabidopsis thaliana] gb\|AAK63999.1\| (AY039895) AT4g24190/T22A6_20 [Arabidopsis thaliana] |
| 111048 (583 letters) | 1e-59 | >gb\|AAK76493.1\| (AY045819) putative phosphatase 2C [Arabidopsis thaliana] |
| 113072 (649 letters) | 1e-68 | >pir\|\|T07780 remorin - potato gb\|AAB49425.1\| (U72489) remorin [Solanum tuberosum] |
| 120624 (345 letters) | 8e-48 | >pir\|\|T07612 cellulase (EC 3.2.1.4) Cel3, membrane-anchored - tomato gb\|AAC49704.1\| (U78526) endo-1,4-beta-glucanase [Lycopersicon esculentum] |
| 20072 (310 letters) | 2e-25 | >dbj\|BAA96072.1\| (AB042860) ribosomal protein L29 [Panax ginseng] |
| 43449 Contig A (626 letters) | 2e-45 | >pir\|\|T51505 hypothetical protein F5E19_70 - Arabidopsis thaliana emb\|CAC01837.1\| (AL391147) putative protein [Arabidopsis thaliana] |
| 44526 (881 letters) | 8e-41 | >gb\|AAK74009.1\| (AY045651) AT4g17010/dl4535w [Arabidopsis thaliana] |
| 52817 (630 letters) | 3e-79 | >gb\|AAC79594.1\| (AC005727) putative membrane channel protein [Arabidopsis thaliana] gb\|AAK73951.1\| (AY045593) At2g28900/F8N16.19 [Arabidopsis thaliana] |
| 53376 (895 letters) | e-122 | >sp\|P93830\|AXIH_ARATH AUXIN-RESPONSIVE PROTEIN IAA17 (INDOLEACETIC ACID-INDUCED PROTEIN 17) gb\|AAB84354.1\| (U49073) IAA17 [Arabidopsis thaliana] gb\|AAC39439.1\| (AF040631) IAA17/AXR3 protein [Arabidopsis thaliana] gb\|AAB70451.2\| (AC000104) Identical to Arabidopsis gb\|AF040632 and gb\|U49073 IAA17/AXR3 gene. ESTs gb\|H36782 and gb\|F14074 come from this gene. [Arabidopsis thaliana] gb\|AAG53997.1\|AF336916_1 (AF336916) IAA17 [Arabidopsis thaliana] |
| 57142 Contig B (608 letters) | 7e-99 | >sp\|P50433\|GLYM_SOLTU SERINE HYDROXYMETHYLTRANSFERASE, MITOCHONDRIAL PRECURSOR (SERINE METHYLASE) (GLYCINE HYDROXYMETHYLTRANSFERASE) (SHMT) pir\|\|S40218 glycine hydroxymethyltransferase (EC 2.1.2.1) - potato emb\|CAA81082.1\| (Z25863) glycine hydroxymethyltransferase [Solanum tuberosum] |
| 57744 (504 letters) | 6e-69 | >emb\|CAB16914.1\| (Z99765) H-Protein precursor [Flaveria pringlei] |

FIG. 3 continued

| Query Contig ID (length, bp) | Pz Score | Result |
|---|---|---|
| 103535 (665 letters) | 7e-77 | >gnl\|Derwent\|AAG23010 256 AA.Arabidopsis thaliana protein fragment SEQ ID NO: 26156.EP1033405-A2. |
| 103541 (667 letters) | 1e-48 | >gnl\|Derwent\|AAG17334 249 AA.Arabidopsis thaliana protein fragment SEQ ID NO: 18314.EP1033405-A2. |
| 103560 (638 letters) | 7e-42 | >gnl\|Derwent\|AAG43373 351 AA.Arabidopsis thaliana protein fragment SEQ ID NO: 54204.EP1033405-A2. |
| 103619 (657 letters) | 4e-63 | >gnl\|Derwent\|AAB16437 318 AA.Pinus radiata peroxidase protein sequence SEQ ID NO:389.WO200022099-A1. |
| 103752 (571 letters) | 1e-95 | >gnl\|Derwent\|AAG53668 372 AA.Arabidopsis thaliana protein fragment SEQ ID NO: 68348.EP1033405-A2. |
| 104065 (636 letters) | 9e-13 | >gnl\|Derwent\|AAY45097 695 AA.Arabidopsis thaliana early-flowering protein, ELF3.WO200009658-A2. |
| 104067 (608 letters) | 6e-77 | >gnl\|Derwent\|AAG48750 292 AA.Arabidopsis thaliana protein fragment SEQ ID NO: 61596.EP1033405-A2. |
| 104254 (654 letters) | 2e-72 | >gnl\|Derwent\|AAG53144 166 AA.Arabidopsis thaliana protein fragment SEQ ID NO: 67633.EP1033405-A2. |
| 104407 (403 letters) | 6e-05 | >gnl\|Derwent\|AAG38899 272 AA.Arabidopsis thaliana protein fragment SEQ ID NO: 48056.EP1033405-A2. |
| 104702 (643 letters) | 7e-32 | >gnl\|Derwent\|AAG09600 198 AA.Arabidopsis thaliana protein fragment SEQ ID NO: 7597.EP1033405-A2. |
| 104765 (598 letters) | 7e-16 | >gnl\|Derwent\|AAY99750 637 AA.Soybean phosphatidylinositol-4-phosphate kinase EST contig, protein.WO200036119-A2. |
| 104768 (667 letters) | 6e-95 | >gnl\|Derwent\|AAG30120 405 AA.Arabidopsis thaliana protein fragment SEQ ID NO: 35952.EP1033405-A2. |
| 105019 (628 letters) | 6e-82 | >gnl\|Derwent\|AAG22173 299 AA.Arabidopsis thaliana protein fragment SEQ ID NO: 25001.EP1033405-A2. |
| 105143 (553 letters) | 3e-36 | >gnl\|Derwent\|AAG24082 153 AA.Arabidopsis thaliana protein fragment SEQ ID NO: 27621.EP1033405-A2. |
| 105154 (501 letters) | 8e-48 | >gnl\|Derwent\|AAW19542 464 AA.Soybean thiol protease D3-beta.JP09121870-A. |
| 105271 (610 letters) | 1e-44 | >gnl\|Derwent\|AAG45027 326 AA.Arabidopsis thaliana protein fragment SEQ ID NO: 56476.EP1033405-A2. |
| 105272 (629 letters) | e-111 | >gnl\|Derwent\|AAG53359 461 AA.Arabidopsis thaliana protein fragment SEQ ID NO: 67926.EP1033405-A2. |
| 105377 (610 letters) | e-110 | >gnl\|Derwent\|AAP93422 533 AA.Sequence of polyubiquitin.EP342926-A. |
| 105405 (652 letters) | e-112 | >gnl\|Derwent\|AAG54487 419 AA.Zea mays protein fragment SEQ ID NO: 69480.EP1033405-A2. |
| 107421 (465 letters) | 5e-46 | >gnl\|Derwent\|AAG35410 270 AA.Zea mays protein fragment SEQ ID NO: 43251.EP1033405-A2. |
| 107594 (669 letters) | e-102 | >gnl\|Derwent\|AAG37623 477 AA.Arabidopsis thaliana protein fragment SEQ ID NO: 46292.EP1033405-A2. |
| 108256 (620 letters) | 5e-08 | >gnl\|Derwent\|AAY49930 96 AA.2A11 genomic DNA cloned into pCGN1273 protein sequence.US5981839-A. |
| 108358 (634 letters) | 2e-25 | >gnl\|Derwent\|AAG39253 137 AA.Arabidopsis thaliana protein fragment SEQ ID NO: 48541.EP1033405-A2. |
| 108404 (554 letters) | 1e-28 | >gnl\|Derwent\|AAG45118 305 AA.Arabidopsis thaliana protein fragment SEQ ID NO: 56601.EP1033405-A2. |

FIG. 4

| Query Contig ID (length, bp) | Pz Score | Result |
|---|---|---|
| 109191 (505 letters) | 6e-11 | >gnl\|Derwent\|AAG44408 249 AA.Arabidopsis thaliana protein fragment SEQ ID NO: 55624.EP1033405-A2. |
| 109274 (588 letters) | 3e-09 | >gnl\|Derwent\|AAG10060 468 AA.Arabidopsis thaliana protein fragment SEQ ID NO: 8231.EP1033405-A2. |
| 109329 (566 letters) | 1e-43 | >gnl\|Derwent\|AAG37290 112 AA.Arabidopsis thaliana protein fragment SEQ ID NO: 45828.EP1033405-A2. |
| 109420 (633 letters) | e-100 | >gnl\|Derwent\|AAB66343 415 AA.Castor bean calreticulin.US6171864-B1. |
| 109513 (562 letters) | 1e-77 | >gnl\|Derwent\|AAG23470 144 AA.Arabidopsis thaliana protein fragment SEQ ID NO: 26790.EP1033405-A2. |
| 109523 (590 letters) | 1e-93 | >gnl\|Derwent\|AAW28501 530 AA.Birch pollen co-factor-independent phosphoglycerate mutase.WO9705258-A2. |
| 110965 (504 letters) | 1e-48 | >gnl\|Derwent\|AAG54776 201 AA.Arabidopsis thaliana protein fragment SEQ ID NO: 69953.EP1033405-A2. |
| 111075 (526 letters) | 3e-35 | >gnl\|Derwent\|AAG23205 169 AA.Arabidopsis thaliana protein fragment SEQ ID NO: 26425.EP1033405-A2. |
| 111108 (317 letters) | 5e-05 | >gnl\|Derwent\|AAB95181 749 AA.Human protein sequence SEQ ID NO:17247.EP1074617-A2. |
| 111175 (620 letters) | 2e-50 | >gnl\|Derwent\|AAG51763 420 AA.Arabidopsis thaliana protein fragment SEQ ID NO: 65729.EP1033405-A2. |
| 111223 (610 letters) | 3e-89 | >gnl\|Derwent\|AAG47023 307 AA.Arabidopsis thaliana protein fragment SEQ ID NO: 59223.EP1033405-A2. |
| 111277 (539 letters) | 1e-54 | >gnl\|Derwent\|AAG42507 401 AA.Arabidopsis thaliana protein fragment SEQ ID NO: 53021.EP1033405-A2. |
| 111358 (559 letters) | 2e-59 | >gnl\|Derwent\|AAG18755 156 AA.Zea mays protein fragment SEQ ID NO: 20290.EP1033405-A2. |
| 111437 (623 letters) | 4e-59 | >gnl\|Derwent\|AAG35430 382 AA.Zea mays protein fragment SEQ ID NO: 43278.EP1033405-A2. |
| 111469 (516 letters) | 1e-47 | >gnl\|Derwent\|AAG49607 532 AA.Arabidopsis thaliana protein fragment SEQ ID NO: 62773.EP1033405-A2. |
| 111751 (514 letters) | 3e-15 | >gnl\|Derwent\|AAB11489 319 AA.Wheat chitinase protein homologous to spring wheat chitinase.JP2000270866-A. |
| 111752 (528 letters) | 3e-10 | >gnl\|Derwent\|AAY43640 534 AA.Amino acid sequence of the DPH2 gene product.WO9953762-A1. |
| 111758 (645 letters) | 9e-45 | >gnl\|Derwent\|AAG22189 389 AA.Arabidopsis thaliana protein fragment SEQ ID NO: 25023.EP1033405-A2. |
| 113170 (644 letters) | 5e-73 | >gnl\|Derwent\|AAG42686 174 AA.Arabidopsis thaliana protein fragment SEQ ID NO: 53263.EP1033405-A2. |
| 113595 (596 letters) | 2e-45 | >gnl\|Derwent\|AAG43286 151 AA.Arabidopsis thaliana protein fragment SEQ ID NO: 54086.EP1033405-A2. |
| 114370 (596 letters) | 2e-48 | >gnl\|Derwent\|AAG25548 170 AA.Arabidopsis thaliana protein fragment SEQ ID NO: 29658.EP1033405-A2. |
| 114380 (614 letters) | 2e-77 | >gnl\|Derwent\|AAG47141 338 AA.Arabidopsis thaliana protein fragment SEQ ID NO: 59384.EP1033405-A2. |
| 114404 (624 letters) | 7e-51 | >gnl\|Derwent\|AAG53830 403 AA.Arabidopsis thaliana protein fragment SEQ ID NO: 68571.EP1033405-A2. |
| 114417 (619 letters) | 3e-04 | >gnl\|Derwent\|AAB54170 249 AA.Human pancreatic cancer antigen protein sequence SEQ ID NO:622.WO200055320-A1. |

FIG. 4 continued

| Query Contig ID (length, bp) | Pz Score | Result |
|---|---|---|
| 120342 (637 letters) | 1e-70 | >gnl\|Derwent\|AAG50010 250 AA.Arabidopsis thaliana protein fragment SEQ ID NO: 63329.EP1033405-A2. |
| 120557 (596 letters) | 6e-07 | >gnl\|Derwent\|AAB93247 438 AA.Human protein sequence SEQ ID NO:12259.EP1074617-A2. |
| 17661 Contig A (860 letters) | e-123 | >gnl\|Derwent\|AAG60942 344 AA.Arabidopsis thaliana protein fragment SEQ ID NO: 78992.EP1033405-A2. |
| 17661 Contig B (350 letters) | 2e-41 | >gnl\|Derwent\|AAG08493 326 AA.Arabidopsis thaliana protein fragment SEQ ID NO: 6053.EP1033405-A2. |
| 17884 Contig B (715 letters) | 4e-35 | >gnl\|Derwent\|AAG04659 159 AA.Arabidopsis thaliana protein fragment SEQ ID NO: 769.EP1033405-A2. |
| 20019 (324 letters) | 2e-12 | >gnl\|Derwent\|AAG59207 196 AA.Arabidopsis thaliana protein fragment SEQ ID NO: 76560.EP1033405-A2. |
| 23558 (744 letters) | 6e-86 | >gnl\|Derwent\|AAG58058 169 AA.Arabidopsis thaliana protein fragment SEQ ID NO: 74898.EP1033405-A2. |
| 23777 (559 letters) | 7e-06 | >gnl\|Derwent\|AAG24173 221 AA.Arabidopsis thaliana protein fragment SEQ ID NO: 27745.EP1033405-A2. |
| 25975 (450 letters) | 1e-42 | >gnl\|Derwent\|AAG32525 224 AA.Arabidopsis thaliana protein fragment SEQ ID NO: 39254.EP1033405-A2. |
| 2658 Contig A (1026 letters) | 6e-65 | >gnl\|Derwent\|AAG26254 324 AA.Arabidopsis thaliana protein fragment SEQ ID NO: 30643.EP1033405-A2. |
| 26650 (510 letters) | 4e-72 | >gnl\|Derwent\|AAG19472 138 AA.Arabidopsis thaliana protein fragment SEQ ID NO: 21288.EP1033405-A2. |
| 2696 (884 letters) | e-103 | >gnl\|Derwent\|AAR74628 757 AA.Q8 ethylene response (ETR) protein from Arabidopsis thaliana.WO9501439-A2. |
| 27245 (895 letters) | e-144 | >gnl\|Derwent\|AAG19996 307 AA.Arabidopsis thaliana protein fragment SEQ ID NO: 22012.EP1033405-A2. |
| 27429 (1071 letters) | 8e-61 | >gnl\|Derwent\|AAE00413 257 AA.Tomato seed expansin, LeExp8, for controlling seed germination.WO200123530-A1. |
| 27507 (1164 letters) | 1e-78 | >gnl\|Derwent\|AAB16443 323 AA.Pinus radiata peroxidase protein sequence SEQ ID NO:395.WO200022099-A1. |
| 3033 (1237 letters) | 4e-39 | >gnl\|Derwent\|AAG17907 270 AA.Arabidopsis thaliana protein fragment SEQ ID NO: 19110.EP1033405-A2. |
| 30367 (752 letters) | e-112 | >gnl\|Derwent\|AAG29123 669 AA.Arabidopsis thaliana protein fragment SEQ ID NO: 34595.EP1033405-A2. |
| 30518 (812 letters) | e-107 | >gnl\|Derwent\|AAE02554 207 AA.A. thaliana transcription factor G43 homolog, G46.WO200135725-A1. |
| 30548 (415 letters) | 4e-14 | >gnl\|Derwent\|AAE01349 423 AA.Arabidopsis thaliana ABA (abscisic acid)-insensitive 2, abi2 mutant.WO200136596-A2. |
| 3054 (912 letters) | 5e-16 | >gnl\|Derwent\|AAW70265 268 AA.Amino acid sequence of Staphylococcus aureus aroE protein.EP861895-A2. |
| 3442 (667 letters) | 3e-95 | >gnl\|Derwent\|AAG42369 234 AA.Arabidopsis thaliana protein fragment SEQ ID NO: 52833.EP1033405-A2. |
| 35605 (529 letters) | 3e-32 | >gnl\|Derwent\|AAG35569 516 AA.Arabidopsis thaliana protein fragment SEQ ID NO: 43472.EP1033405-A2. |
| 36009 Contig B (746 letters) | 8e-11 | >gnl\|Derwent\|AAP91895 456 AA.Protein sequence of glucuronide permease gene on plasmid pRAJ285.WO8903880-A. |

FIG. 4 continued

| Query Contig ID (length, bp) | Pz Score | Result |
|---|---|---|
| 36204 (341 letters) | 1e-21 | >gnl\|Derwent\|AAG40000 639 AA.Arabidopsis thaliana protein fragment SEQ ID NO: 49571.EP1033405-A2. |
| 36934 (738 letters) | 3e-98 | >gnl\|Derwent\|AAG17063 174 AA.Arabidopsis thaliana protein fragment SEQ ID NO: 17943.EP1033405-A2. |
| 37131 (330 letters) | 9e-33 | >gnl\|Derwent\|AAG36136 212 AA.Arabidopsis thaliana protein fragment SEQ ID NO: 44242.EP1033405-A2. |
| 38707 (705 letters) | 2e-73 | >gnl\|Derwent\|AAB25082 166 AA.Plant SDF encoded polypeptide sequence SEQ List 2 NO:142.WO200040695-A2. |
| 39086 (1058 letters) | e-178 | >gnl\|Derwent\|AAG24797 350 AA.Arabidopsis thaliana protein fragment SEQ ID NO: 28608.EP1033405-A2. |
| 42037 (180 letters) | 2e-12 | >gnl\|Derwent\|AAR74174 478 AA.Chloroplast transit peptide, tyrosinase activator protein andtyrosinase fusion protein.WO9513386-A. |
| 43460 Contig A (636 letters) | 5e-88 | >gnl\|Derwent\|AAG26482 184 AA.Arabidopsis thaliana protein fragment SEQ ID NO: 30954.EP1033405-A2. |
| 44067 Contig A (569 letters) | 4e-52 | >gnl\|Derwent\|AAG51698 302 AA.Arabidopsis thaliana protein fragment SEQ ID NO: 65641.EP1033405-A2. |
| 44139 Contig A (327 letters) | 1e-10 | >gnl\|Derwent\|AAG44694 139 AA.Zea mays protein fragment SEQ ID NO: 56014.EP1033405-A2. |
| 44139 Contig B (328 letters) | 4e-08 | >gnl\|Derwent\|AAG44694 139 AA.Zea mays protein fragment SEQ ID NO: 56014.EP1033405-A2. |
| 44146 Contig A (600 letters) | 2e-18 | >gnl\|Derwent\|AAR20460 1564 AA.Glutamine 2-oxo-glutarate amino transferase.JP03272690-A. |
| 44189 (587 letters) | 5e-48 | >gnl\|Derwent\|AAG55033 140 AA.Arabidopsis thaliana protein fragment SEQ ID NO: 70467.EP1033405-A2. |
| 44503 (593 letters) | 2e-10 | >gnl\|Derwent\|AAG48212 89 AA.Arabidopsis thaliana protein fragment SEQ ID NO: 60860.EP1033405-A2. |
| 44508 (532 letters) | 6e-48 | >gnl\|Derwent\|AAG04753 122 AA.Arabidopsis thaliana protein fragment SEQ ID NO: 899.EP1033405-A2. |
| 44558 Contig A (545 letters) | 2e-35 | >gnl\|Derwent\|AAG22347 330 AA.Arabidopsis thaliana protein fragment SEQ ID NO: 25240.EP1033405-A2. |
| 44558 Contig B (669 letters) | 8e-12 | >gnl\|Derwent\|AAG22347 330 AA.Arabidopsis thaliana protein fragment SEQ ID NO: 25240.EP1033405-A2. |
| 4743 (578 letters) | 5e-36 | >gnl\|Derwent\|AAR41349 190 AA.NXG2 encoded xyloglucanase.WO9317101-A. |
| 4837 Contig A (349 letters) | 1e-53 | >gnl\|Derwent\|AAG36854 161 AA.Arabidopsis thaliana protein fragment SEQ ID NO: 45223.EP1033405-A2. |
| 4837 Contig B (1298 letters) | 4e-88 | >gnl\|Derwent\|AAG51596 261 AA.Arabidopsis thaliana protein fragment SEQ ID NO: 65502.EP1033405-A2. |
| 48458 Contig B (614 letters) | 6e-60 | >gnl\|Derwent\|AAG53327 419 AA.Arabidopsis thaliana protein fragment SEQ ID NO: 67882.EP1033405-A2. |
| 4845 Contig B (621 letters) | 2e-58 | >gnl\|Derwent\|AAG54070 154 AA.Arabidopsis thaliana protein fragment SEQ ID NO: 68904.EP1033405-A2. |
| 48602 (608 letters) | 2e-80 | >gnl\|Derwent\|AAB08468 251 AA.Amino acid sequence of a lysophosphatidic acid acetyltransferase.WO200049156-A2. |
| 51719 (1081 letters) | e-161 | >gnl\|Derwent\|AAG37220 460 AA.Arabidopsis thaliana protein fragment SEQ ID NO: 45729.EP1033405-A2. |
| 51843 Contig A (739 letters) | e-106 | >gnl\|Derwent\|AAG53393 489 AA.Arabidopsis thaliana protein fragment SEQ ID NO: 67974.EP1033405-A2. |

FIG. 4 continued

| Query Contig ID (length, bp) | Pz Score | Result |
|---|---|---|
| 51843 Contig B (753 letters) | 1e-88 | >gnl\|Derwent\|AAG53394 462 AA.Arabidopsis thaliana protein fragment SEQ ID NO: 67975.EP1033405-A2. |
| 52689 (562 letters) | 2e-83 | >gnl\|Derwent\|AAG39652 384 AA.Arabidopsis thaliana protein fragment SEQ ID NO: 49092.EP1033405-A2. |
| 53369 (476 letters) | 2e-15 | >gnl\|Derwent\|AAG50065 415 AA.Arabidopsis thaliana protein fragment SEQ ID NO: 63404.EP1033405-A2. |
| 53564 (802 letters) | e-100 | >gnl\|Derwent\|AAE02513 227 AA.Arabidopsis thaliana transcription factor G545.WO200135726-A1. |
| 57119 (507 letters) | 2e-40 | >gnl\|Derwent\|AAG09836 124 AA.Arabidopsis thaliana protein fragment SEQ ID NO: 7923.EP1033405-A2. |
| 57135 (634 letters) | e-101 | >gnl\|Derwent\|AAB03423 441 AA.Soybean putative carbon catabolite repression protein SNF1 #5.WO200036115-A2. |
| 57152 (632 letters) | e-121 | >gnl\|Derwent\|AAY51157 362 AA.Tobacco FNR protein.EP967211-A1. |
| 57194 (640 letters) | 2e-75 | >gnl\|Derwent\|AAG47509 148 AA.Arabidopsis thaliana protein fragment SEQ ID NO: 59889.EP1033405-A2. |
| 57510 (541 letters) | 5e-50 | >gnl\|Derwent\|AAB32730 162 AA.Eucalyptus grandis transcription factor protein sequence #188.WO200053724-A2. |
| 57702 Contig A (363 letters) | 4e-27 | >gnl\|Derwent\|AAG24292 250 AA.Arabidopsis thaliana protein fragment SEQ ID NO: 27912.EP1033405-A2. |
| 57702 Contig B (199 letters) | 1e-18 | >gnl\|Derwent\|AAG24292 250 AA.Arabidopsis thaliana protein fragment SEQ ID NO: 27912.EP1033405-A2. |
| 57708 (468 letters) | 3e-36 | >gnl\|Derwent\|AAG43296 143 AA.Arabidopsis thaliana protein fragment SEQ ID NO: 54100.EP1033405-A2. |
| 6025 (641 letters) | 4e-65 | >gnl\|Derwent\|AAG52531 122 AA.Arabidopsis thaliana protein fragment SEQ ID NO: 66787.EP1033405-A2. |
| 6153 (809 letters) | e-113 | >gnl\|Derwent\|AAG43299 229 AA.Arabidopsis thaliana protein fragment SEQ ID NO: 54104.EP1033405-A2. |
| 6477 (750 letters) | 8e-96 | >gnl\|Derwent\|AAG27849 312 AA.Arabidopsis thaliana protein fragment SEQ ID NO: 32846.EP1033405-A2. |
| 6606 (1013 letters) | e-146 | >gnl\|Derwent\|AAG42501 261 AA.Arabidopsis thaliana protein fragment SEQ ID NO: 53013.EP1033405-A2. |
| 6681 (607 letters) | 8e-53 | >gnl\|Derwent\|AAG05299 144 AA.Arabidopsis thaliana protein fragment SEQ ID NO: 1653.EP1033405-A2. |
| 6682 (1120 letters) | e-142 | >gnl\|Derwent\|AAG45399 289 AA.Arabidopsis thaliana protein fragment SEQ ID NO: 56992.EP1033405-A2. |
| 6686 (909 letters) | e-127 | >gnl\|Derwent\|AAG52723 386 AA.Arabidopsis thaliana protein fragment SEQ ID NO: 67054.EP1033405-A2. |
| 6717 (722 letters) | 5e-69 | >gnl\|Derwent\|AAG55005 142 AA.Arabidopsis thaliana protein fragment SEQ ID NO: 70411.EP1033405-A2. |
| 7393 (695 letters) | 8e-87 | >gnl\|Derwent\|AAG22856 155 AA.Arabidopsis thaliana protein fragment SEQ ID NO: 25943.EP1033405-A2. |
| 104081 (639 letters) | 1e-61 | >gnl\|Derwent\|AAG29480 278 AA.Arabidopsis thaliana protein fragment SEQ ID NO: 35084.EP1033405-A2. |
| 104711 (492 letters) | 6e-09 | >gnl\|Derwent\|AAB33230 92 AA.Eucalyptus grandis transcription factor protein sequence #387.WO200053724-A2. |
| 105187 Contig A (597 letters) | 3e-79 | >gnl\|Derwent\|AAG07763 202 AA.Arabidopsis thaliana protein fragment SEQ ID NO: 5040.EP1033405-A2. |

FIG. 4 continued

| Query Contig ID (length, bp) | Pz Score | Result |
|---|---|---|
| 105187 Contig B (452 letters) | 1e-08 | >gnl\|Derwent\|AAG30499 203 AA.Arabidopsis thaliana protein fragment SEQ ID NO: 36473.EP1033405-A2. |
| 107101 (587 letters) | 6e-32 | >gnl\|Derwent\|AAG43434 342 AA.Arabidopsis thaliana protein fragment SEQ ID NO: 54288.EP1033405-A2. |
| 107642 (524 letters) | 1e-46 | >gnl\|Derwent\|AAG08395 288 AA.Arabidopsis thaliana protein fragment SEQ ID NO: 5913.EP1033405-A2. |
| 108274 (533 letters) | 6e-18 | >gnl\|Derwent\|AAB80018 284 AA.Corynebacterium glutamicum MP protein sequence SEQ ID NO:770.WO200100843-A2. |
| 109024 (626 letters) | 2e-80 | >gnl\|Derwent\|AAY82086 615 AA.Tobacco ethylene insensitive 3-like (TEIL) protein SEQ ID NO:2.WO200009712-A1. |
| 109138 (571 letters) | 4e-17 | >gnl\|Derwent\|AAG32012 1225 AA.Arabidopsis thaliana protein fragment SEQ ID NO: 38541.EP1033405-A2. |
| 109146 (619 letters) | e-116 | >gnl\|Derwent\|AAG46648 253 AA.Arabidopsis thaliana protein fragment SEQ ID NO: 58710.EP1033405-A2. |
| 109369 (623 letters) | 3e-28 | >gnl\|Derwent\|AAG08950 192 AA.Arabidopsis thaliana protein fragment SEQ ID NO: 6687.EP1033405-A2. |
| 109391 (273 letters) | 3e-18 | >gnl\|Derwent\|AAG49669 150 AA.Arabidopsis thaliana protein fragment SEQ ID NO: 62858.EP1033405-A2. |
| 110764 (324 letters) | 5e-13 | >gnl\|Derwent\|AAG14222 322 AA.Arabidopsis thaliana protein fragment SEQ ID NO: 14001.EP1033405-A2. |
| 111139 (276 letters) | 2e-42 | >gnl\|Derwent\|AAY77980 374 AA.A. thaliana environmental stress tolerance related protein.WO200008187-A2. |
| 111230 (652 letters) | 3e-56 | >gnl\|Derwent\|AAB32700 229 AA.Eucalyptus grandis transcription factor protein sequence #158.WO200053724-A2. |
| 111312 (638 letters) | 5e-42 | >gnl\|Derwent\|AAB25494 612 AA.Eucalyptus grandis cell signalling involved protein SEQ ID NO:813.WO200042171-A1. |
| 111758 (645 letters) | 8e-45 | >gnl\|Derwent\|AAG22189 389 AA.Arabidopsis thaliana protein fragment SEQ ID NO: 25023.EP1033405-A2. |
| 112381 (658 letters) | 4e-69 | >gnl\|Derwent\|AAG29776 226 AA.Arabidopsis thaliana protein fragment SEQ ID NO: 35485.EP1033405-A2. |
| 112417 (638 letters) | 7e-50 | >gnl\|Derwent\|AAG11062 226 AA.Arabidopsis thaliana protein fragment SEQ ID NO: 9637.EP1033405-A2. |
| 113024 (628 letters) | 3e-63 | >gnl\|Derwent\|AAY96217 214 AA.Veronia mespilifolia LEC1.WO200028058-A2. |
| 113124 (658 letters) | 8e-45 | >gnl\|Derwent\|AAG08876 254 AA.Arabidopsis thaliana protein fragment SEQ ID NO: 6585.EP1033405-A2. |
| 113183 (547 letters) | 3e-16 | >gnl\|Derwent\|AAB25204 105 AA.Eucalyptus grandis cell signalling involved protein SEQ ID NO:523.WO200042171-A1. |
| 113742 (628 letters) | 2e-49 | >gnl\|Derwent\|AAG42610 461 AA.Arabidopsis thaliana protein fragment SEQ ID NO: 53160.EP1033405-A2. |
| 114161 (635 letters) | 7e-31 | >gnl\|Derwent\|AAG13640 269 AA.Arabidopsis thaliana protein fragment SEQ ID NO: 13209.EP1033405-A2. |
| 114865 (706 letters) | 4e-16 | >gnl\|Derwent\|AAG45752 337 AA.Arabidopsis thaliana protein fragment SEQ ID NO: 57480.EP1033405-A2. |
| 114926 (558 letters) | 2e-74 | >gnl\|Derwent\|AAR97422 551 AA.Fis1 gene product.WO9634949-A1. |

FIG. 4 continued

| Query Contig ID (length, bp) | Pz Score | Result |
|---|---|---|
| 116461 (947 letters) | 5e-70 | >gnl\|Derwent\|AAG43945 165 AA.Zea mays protein fragment SEQ ID NO: 54987.EP1033405-A2. |
| 116525 (583 letters) | 2e-61 | >gnl\|Derwent\|AAG46793 208 AA.Arabidopsis thaliana protein fragment SEQ ID NO: 58907.EP1033405-A2. |
| 116686 (671 letters) | 7e-57 | >gnl\|Derwent\|AAG30341 166 AA.Arabidopsis thaliana protein fragment SEQ ID NO: 36255.EP1033405-A2. |
| 116692 (532 letters) | 4e-13 | >gnl\|Derwent\|AAG39582 216 AA.Arabidopsis thaliana protein fragment SEQ ID NO: 48998.EP1033405-A2. |
| 116784 (631 letters) | 9e-82 | >gnl\|Derwent\|AAG52621 402 AA.Arabidopsis thaliana protein fragment SEQ ID NO: 66913.EP1033405-A2. |
| 118051 (507 letters) | 1e-39 | >gnl\|Derwent\|AAB23261 394 AA.Human cell division regulator HCDR-3.US6121019-A. |
| 119262 (881 letters) | 5e-65 | >gnl\|Derwent\|AAB66742 220 AA.Soybean type III GST protein #6.US6171839-B1. |
| 119350 (1100 letters) | 1e-51 | >gnl\|Derwent\|AAG15788 247 AA.Arabidopsis thaliana protein fragment SEQ ID NO: 16177.EP1033405-A2. |
| 119915 (661 letters) | 3e-25 | >gnl\|Derwent\|AAG38618 1236 AA.Arabidopsis thaliana protein fragment SEQ ID NO: 47669.EP1033405-A2. |
| 119938 (574 letters) | 8e-18 | >gnl\|Derwent\|AAG27450 160 AA.Arabidopsis thaliana protein fragment SEQ ID NO: 32291.EP1033405-A2. |
| 120147 (616 letters) | 5e-30 | >gnl\|Derwent\|AAG14142 141 AA.Arabidopsis thaliana protein fragment SEQ ID NO: 13893.EP1033405-A2. |
| 120246 (557 letters) | 5e-24 | >gnl\|Derwent\|AAG32127 73 AA.Arabidopsis thaliana protein fragment SEQ ID NO: 38700.EP1033405-A2. |
| 120670 (482 letters) | 2e-23 | >gnl\|Derwent\|AAW01605 248 AA.Arabidopsis STO polypeptide.WO9639020-A1. |
| 120859 (568 letters) | 4e-60 | >gnl\|Derwent\|AAB69049 550 AA.Hordeum vulgare L. var. Igri NAAT-B protein sequence.WO200101762-A1. |
| 120870 (661 letters) | 3e-69 | >gnl\|Derwent\|AAG08982 204 AA.Arabidopsis thaliana protein fragment SEQ ID NO: 6734.EP1033405-A2. |
| 120925 (657 letters) | e-114 | >gnl\|Derwent\|AAG35919 328 AA.Zea mays protein fragment SEQ ID NO: 43946.EP1033405-A2. |
| 120933 (703 letters) | 7e-58 | >gnl\|Derwent\|AAG33189 329 AA.Zea mays protein fragment SEQ ID NO: 40176.EP1033405-A2. |
| 120952 (625 letters) | 1e-82 | >gnl\|Derwent\|AAG40637 192 AA.Zea mays protein fragment SEQ ID NO: 50449.EP1033405-A2. |
| 120979 (585 letters) | 2e-23 | >gnl\|Derwent\|AAG13594 144 AA.Arabidopsis thaliana protein fragment SEQ ID NO: 13146.EP1033405-A2. |
| 121144 (354 letters) | 1e-25 | >gnl\|Derwent\|AAY29943 214 AA.Zea mays pathogenesis-related class I PR-1#93 protein.WO9943819-A1. |
| 124883 (691 letters) | 1e-42 | >gnl\|Derwent\|AAB68546 504 AA.Human GTP-binding associated protein #46.WO200105970-A2. |
| 126157 (580 letters) | 1e-47 | >gnl\|Derwent\|AAG55033 140 AA.Arabidopsis thaliana protein fragment SEQ ID NO: 70467.EP1033405-A2. |
| 126168 (448 letters) | 6e-11 | >gnl\|Derwent\|AAB53343 81 AA.Human colon cancer antigen protein sequence SEQ ID NO:883.WO200055351-A1. |
| 126335 (641 letters) | 3e-31 | >gnl\|Derwent\|AAG10507 121 AA.Arabidopsis thaliana protein fragment SEQ ID NO: 8859.EP1033405-A2. |
| 126367 (397 letters) | 2e-10 | >gnl\|Derwent\|AAG38626 206 AA.Arabidopsis thaliana protein fragment SEQ ID NO: 47680.EP1033405-A2. |

FIG. 4 continued

| Query Contig ID (length, bp) | Pz Score | Result |
|---|---|---|
| 126374 (493 letters) | 3e-61 | >gnl\|Derwent\|AAY71554 450 AA.Soybean sphingolipid desaturase #2.WO200032790-A2. |
| 126375 (600 letters) | 4e-43 | >gnl\|Derwent\|AAG24319 165 AA.Arabidopsis thaliana protein fragment SEQ ID NO: 27948.EP1033405-A2. |
| 126534 (665 letters) | 2e-36 | >gnl\|Derwent\|AAG28158 233 AA.Arabidopsis thaliana protein fragment SEQ ID NO: 33273.EP1033405-A2. |
| 126611 (719 letters) | 5e-58 | >gnl\|Derwent\|AAG17334 249 AA.Arabidopsis thaliana protein fragment SEQ ID NO: 18314.EP1033405-A2. |
| 126840 (613 letters) | 2e-72 | >gnl\|Derwent\|AAG47544 226 AA.Arabidopsis thaliana protein fragment SEQ ID NO: 59937.EP1033405-A2. |
| 127269 (668 letters) | 7e-99 | >gnl\|Derwent\|AAG47932 421 AA.Arabidopsis thaliana protein fragment SEQ ID NO: 60469.EP1033405-A2. |
| 127645 (652 letters) | 1e-29 | >gnl\|Derwent\|AAG30180 265 AA.Arabidopsis thaliana protein fragment SEQ ID NO: 36037.EP1033405-A2. |
| 127679 (652 letters) | 7e-29 | >gnl\|Derwent\|AAG09945 375 AA.Arabidopsis thaliana protein fragment SEQ ID NO: 8074.EP1033405-A2. |
| 127750 (576 letters) | 2e-50 | >gnl\|Derwent\|AAG44532 249 AA.Arabidopsis thaliana protein fragment SEQ ID NO: 55794.EP1033405-A2. |
| 128348 (470 letters) | 3e-36 | >gnl\|Derwent\|AAG57595 193 AA.Arabidopsis thaliana protein fragment SEQ ID NO: 74241.EP1033405-A2. |
| 128843 (636 letters) | 2e-26 | >gnl\|Derwent\|AAY70814 467 AA.Extended human zsig49 protein.WO200023591-A2. |
| 129204 (678 letters) | 7e-64 | >gnl\|Derwent\|AAG08735 294 AA.Arabidopsis thaliana protein fragment SEQ ID NO: 6390.EP1033405-A2. |
| 129329 Contig A (623 letters) | e-111 | >gnl\|Derwent\|AAR06491 356 AA.Glutamine synthase in cytosol of rice plant leaves.JP02182190-A. |
| 129329 Contig B (591 letters) | 1e-33 | >gnl\|Derwent\|AAR06491 356 AA.Glutamine synthase in cytosol of rice plant leaves.JP02182190-A. |
| 129410 (705 letters) | e-110 | >gnl\|Derwent\|AAR67429 967 AA.Soybean phosphoenolpyruvate carboxylase.JP06319567-A. |
| 129424 (697 letters) | 2e-86 | >gnl\|Derwent\|AAG49336 300 AA.Arabidopsis thaliana protein fragment SEQ ID NO: 62404.EP1033405-A2. |
| 129491 (657 letters) | 6e-46 | >gnl\|Derwent\|AAG14829 170 AA.Arabidopsis thaliana protein fragment SEQ ID NO: 14840.EP1033405-A2. |
| 129725 (627 letters) | 6e-68 | >gnl\|Derwent\|AAG52625 466 AA.Arabidopsis thaliana protein fragment SEQ ID NO: 66919.EP1033405-A2. |
| 129748 (629 letters) | 8e-72 | >gnl\|Derwent\|AAG29772 170 AA.Arabidopsis thaliana protein fragment SEQ ID NO: 35479.EP1033405-A2. |
| 129753 (596 letters) | 8e-70 | >gnl\|Derwent\|AAG33852 193 AA.Arabidopsis thaliana protein fragment SEQ ID NO: 41098.EP1033405-A2. |
| 129764 (583 letters) | 3e-56 | >gnl\|Derwent\|AAY32200 529 AA.Human receptor molecule (REC) encoded by Incyte clone 2024312.WO9957270-A2. |
| 129833 (645 letters) | 4e-86 | >gnl\|Derwent\|AAG44221 303 AA.Arabidopsis thaliana protein fragment SEQ ID NO: 55365.EP1033405-A2. |
| 129848 (503 letters) | 1e-48 | >gnl\|Derwent\|AAG45687 313 AA.Arabidopsis thaliana protein fragment SEQ ID NO: 57389.EP1033405-A2. |
| 129932 (680 letters) | 1e-48 | >gnl\|Derwent\|AAP82997 392 AA.Encodes Tobacco GapA gene including transit peptide.EP264067-A. |
| 130172 (645 letters) | 1e-62 | >gnl\|Derwent\|AAG05812 224 AA.Arabidopsis thaliana protein fragment SEQ ID NO: 2357.EP1033405-A2. |

FIG. 4 continued

| Query Contig ID (length, bp) | Pz Score | Result |
|---|---|---|
| 130212 (689 letters) | 1e-93 | >gnl\|Derwent\|AAG43405 517 AA.Arabidopsis thaliana protein fragment SEQ ID NO: 54248.EP1033405-A2. |
| 130426 (616 letters) | 2e-39 | >gnl\|Derwent\|AAG16795 282 AA.Arabidopsis thaliana protein fragment SEQ ID NO: 17576.EP1033405-A2. |
| 130430 (616 letters) | 4e-35 | >gnl\|Derwent\|AAG13817 569 AA.Arabidopsis thaliana protein fragment SEQ ID NO: 13449.EP1033405-A2. |
| 130438 (615 letters) | 2e-61 | >gnl\|Derwent\|AAR34135 490 AA.C.roseus TDC with mutated N-terminus.WO9306220-A. |
| 130492 (606 letters) | 3e-78 | >gnl\|Derwent\|AAG35384 225 AA.Zea mays protein fragment SEQ ID NO: 43216.EP1033405-A2. |
| 130504 (601 letters) | 4e-28 | >gnl\|Derwent\|AAG47840 352 AA.Arabidopsis thaliana protein fragment SEQ ID NO: 60343.EP1033405-A2. |
| 130646 (629 letters) | 2e-43 | >gnl\|Derwent\|AAG42451 219 AA.Arabidopsis thaliana protein fragment SEQ ID NO: 52945.EP1033405-A2. |
| 130653 (726 letters) | 7e-52 | >gnl\|Derwent\|AAG32014 1200 AA.Arabidopsis thaliana protein fragment SEQ ID NO: 38543.EP1033405-A2. |
| 130680 (584 letters) | 2e-79 | >gnl\|Derwent\|AAW44350 396 AA.Ricinus communis desaturase from clone pCGN3230.US5723595-A. |
| 130712 (672 letters) | 3e-96 | >gnl\|Derwent\|AAR27164 356 AA.Glutamine synthetase.US5145777-A. |
| 130722 (728 letters) | 8e-87 | >gnl\|Derwent\|AAR70999 562 AA.Pea glutathione-reductase.WO9508633-A. |
| 130792 (709 letters) | e-106 | >gnl\|Derwent\|AAG48860 354 AA.Arabidopsis thaliana protein fragment SEQ ID NO: 61746.EP1033405-A2. |
| 130826 (665 letters) | 2e-76 | >gnl\|Derwent\|AAR66220 489 AA.ADP-glucose-pyrophosphorylase, small subunit.DE4317596-A. |
| 130864 (593 letters) | e-105 | >gnl\|Derwent\|AAG46648 253 AA.Arabidopsis thaliana protein fragment SEQ ID NO: 58710.EP1033405-A2. |
| 130930 (620 letters) | 5e-97 | >gnl\|Derwent\|AAG47133 477 AA.Arabidopsis thaliana protein fragment SEQ ID NO: 59373.EP1033405-A2. |
| 131046 (752 letters) | 6e-58 | >gnl\|Derwent\|AAG53066 252 AA.Arabidopsis thaliana protein fragment SEQ ID NO: 67527.EP1033405-A2. |
| 131104 (624 letters) | 7e-24 | >gnl\|Derwent\|AAB66394 760 AA.Human prostate ECGI protein sequence.WO200078955-A1. |
| 131281 (615 letters) | 1e-62 | >gnl\|Derwent\|AAG04441 309 AA.Arabidopsis thaliana protein fragment SEQ ID NO: 470.EP1033405-A2. |
| 131313 (657 letters) | e-105 | >gnl\|Derwent\|AAG50333 481 AA.Arabidopsis thaliana protein fragment SEQ ID NO: 63773.EP1033405-A2. |
| 131378 (696 letters) | 8e-59 | >gnl\|Derwent\|AAG16461 260 AA.Arabidopsis thaliana protein fragment SEQ ID NO: 17117.EP1033405-A2. |
| 132564 Contig A (666 letters) | 2e-41 | >gnl\|Derwent\|AAG30645 284 AA.Arabidopsis thaliana protein fragment SEQ ID NO: 36674.EP1033405-A2. |
| 132564 Contig B (669 letters) | e-103 | >gnl\|Derwent\|AAR26500 486 AA.Prod. of Nicotiana tabacum gene expressing at floral differentiation.JP04258292-A. |
| 133405 (655 letters) | 3e-24 | >gnl\|Derwent\|AAG11963 184 AA.Arabidopsis thaliana protein fragment SEQ ID NO: 10887.EP1033405-A2. |
| 133507 (637 letters) | e-106 | >gnl\|Derwent\|AAW32911 808 AA.Castor bean phospholipase D.US5670366-A. |
| 133537 (643 letters) | 6e-37 | >gnl\|Derwent\|AAG31641 597 AA.Arabidopsis thaliana protein fragment SEQ ID NO: 38031.EP1033405-A2. |

FIG. 4 continued

| Query Contig ID (length, bp) | Pz Score | Result |
|---|---|---|
| 133547 (681 letters) | 1e-96 | >gnl\|Derwent\|AAG28681 373 AA.Arabidopsis thaliana protein fragment SEQ ID NO: 33991.EP1033405-A2. |
| 134744 (645 letters) | 4e-23 | >gnl\|Derwent\|AAG18575 110 AA.Arabidopsis thaliana protein fragment SEQ ID NO: 20040.EP1033405-A2. |
| 134962 (658 letters) | 1e-26 | >gnl\|Derwent\|AAR15347 344 AA.Hyoscyamine 6 beta-hydroxylase.JP03247277-A. |
| 135016 (603 letters) | 3e-81 | >gnl\|Derwent\|AAY25612 263 AA.Phleum sp. allergen Phl p 1 protein fragment #1.WO9934826-A1. |
| 135042 (623 letters) | 2e-06 | >gnl\|Derwent\|AAB50899 396 AA.Protein encoded by tet resistance marker of integration vector pLO12306.WO200071729-A2. |
| 135085 (612 letters) | 1e-21 | >gnl\|Derwent\|AAG10455 181 AA.Arabidopsis thaliana protein fragment SEQ ID NO: 8785.EP1033405-A2. |
| 135224 (625 letters) | 1e-97 | >gnl\|Derwent\|AAG34059 510 AA.Zea mays protein fragment SEQ ID NO: 41386.EP1033405-A2. |
| 135281 (590 letters) | 2e-42 | >gnl\|Derwent\|AAR98006 101 AA.Oryzacystatin-I del-D86 protease-inhibitor.WO9616173-A2. |
| 135357 (507 letters) | 1e-52 | >gnl\|Derwent\|AAG06741 302 AA.Arabidopsis thaliana protein fragment SEQ ID NO: 3626.EP1033405-A2. |
| 135416 (641 letters) | 3e-72 | >gnl\|Derwent\|AAG45684 527 AA.Arabidopsis thaliana protein fragment SEQ ID NO: 57385.EP1033405-A2. |
| 135511 (561 letters) | 5e-10 | >gnl\|Derwent\|AAB25302 280 AA.Eucalyptus grandis cell signalling involved protein SEQ ID NO:621.WO200042171-A1. |
| 135525 (600 letters) | 5e-58 | >gnl\|Derwent\|AAW97119 281 AA.S-adenosyl-L-methyltransferase (SAM-MT) protein.US5876996-A. |
| 135668 (606 letters) | 3e-96 | >gnl\|Derwent\|AAB22132 222 AA.Maize glutathione-S-transferase fragment SEQ ID NO: 66.US6096504-A. |
| 136763 Contig A (662 letters) | 6e-27 | >gnl\|Derwent\|AAG10148 101 AA.Arabidopsis thaliana protein fragment SEQ ID NO: 8352.EP1033405-A2. |
| 136767 (561 letters) | 6e-44 | >gnl\|Derwent\|AAG42675 257 AA.Arabidopsis thaliana protein fragment SEQ ID NO: 53248.EP1033405-A2. |
| 136817 (497 letters) | 3e-16 | >gnl\|Derwent\|AAW22508 91 AA.Sugar beet antifungal protein.WO9723617-A1. |
| 137131 (612 letters) | 3e-24 | >gnl\|Derwent\|AAY67415 433 AA.Arabidopsis aldehyde dehydrogenase (ALDH)-4.WO200000619-A2. |
| 138578 (431 letters) | 3e-32 | >gnl\|Derwent\|AAB18895 301 AA.A maize chitinase polypeptide designated ZmCh6.WO200056908-A2. |
| 138832 (158 letters) | 9e-10 | >gnl\|Derwent\|AAY05537 222 AA.Wheat glutathione transferase subunit TaGST1.WO9914337-A2. |
| 139222 (621 letters) | 1e-48 | >gnl\|Derwent\|AAG05073 254 AA.Arabidopsis thaliana protein fragment SEQ ID NO: 1339.EP1033405-A2. |
| 139281 (224 letters) | 6e-26 | >gnl\|Derwent\|AAG33259 86 AA.Zea mays protein fragment SEQ ID NO: 40271.EP1033405-A2. |
| 139321 (569 letters) | 1e-66 | >gnl\|Derwent\|AAR89384 181 AA.Barley ADP ribosylation factor.JP08009978-A. |
| 139357 (586 letters) | 2e-22 | >gnl\|Derwent\|AAR69598 93 AA.Non-specific lipid transfer protein Zm-nsLTP from Z. mays seedlings.WO9504754-A. |
| 141821 (642 letters) | 8e-49 | >gnl\|Derwent\|AAW29772 507 AA.Malassezia fungus MF-5 antigenic protein.WO9721817-A1. |

FIG. 4 continued

| Query Contig ID (length, bp) | Pz Score | Result |
|---|---|---|
| 142731 (597 letters) | 2e-59 | >gnl\|Derwent\|AAG50639 503 AA.Arabidopsis thaliana protein fragment SEQ ID NO: 64195.EP1033405-A2. |
| 167332 (601 letters) | 3e-92 | >gnl\|Derwent\|AAG16500 497 AA.Arabidopsis thaliana protein fragment SEQ ID NO: 17170.EP1033405-A2. |
| 167347 (680 letters) | 2e-21 | >gnl\|Derwent\|AAG06302 330 AA.Arabidopsis thaliana protein fragment SEQ ID NO: 3026.EP1033405-A2. |
| 167403 (651 letters) | 2e-60 | >gnl\|Derwent\|AAG46122 351 AA.Arabidopsis thaliana protein fragment SEQ ID NO: 57993.EP1033405-A2. |
| 167406 (691 letters) | 1e-42 | >gnl\|Derwent\|AAG36914 537 AA.Arabidopsis thaliana protein fragment SEQ ID NO: 45305.EP1033405-A2. |
| 167420 (624 letters) | 7e-73 | >gnl\|Derwent\|AAP82997 392 AA.Encodes Tobacco GapA gene including transit peptide.EP264067-A. |
| 167515 (647 letters) | 9e-87 | >gnl\|Derwent\|AAG39962 397 AA.Arabidopsis thaliana protein fragment SEQ ID NO: 49519.EP1033405-A2. |
| 167575 (738 letters) | 1e-62 | >gnl\|Derwent\|AAG39029 281 AA.Arabidopsis thaliana protein fragment SEQ ID NO: 48234.EP1033405-A2. |
| 167874 (714 letters) | 2e-68 | >gnl\|Derwent\|AAG41241 422 AA.Arabidopsis thaliana protein fragment SEQ ID NO: 51287.EP1033405-A2. |
| 168151 (618 letters) | 2e-82 | >gnl\|Derwent\|AAG43405 517 AA.Arabidopsis thaliana protein fragment SEQ ID NO: 54248.EP1033405-A2. |
| 168217 (587 letters) | 2e-67 | >gnl\|Derwent\|AAR34135 490 AA.C.roseus TDC with mutated N-terminus.WO9306220-A. |
| 168244 (609 letters) | 7e-79 | >gnl\|Derwent\|AAY51157 362 AA.Tobacco FNR protein.EP967211-A1. |
| 168264 (611 letters) | 2e-33 | >gnl\|Derwent\|AAG33518 154 AA.Arabidopsis thaliana protein fragment SEQ ID NO: 40627.EP1033405-A2. |
| 168331 (667 letters) | 9e-57 | >gnl\|Derwent\|AAB62218 499 AA.Glycine max homoglutathione synthetase.WO200121770-A2. |
| 168338 (616 letters) | 2e-25 | >gnl\|Derwent\|AAY24396 347 AA.Coptis japonica norcoclaurine 6-O-methyltransferase.JP11178577-A. |
| 168353 (696 letters) | 4e-98 | >gnl\|Derwent\|AAG08668 458 AA.Arabidopsis thaliana protein fragment SEQ ID NO: 6298.EP1033405-A2. |
| 168479 (663 letters) | 2e-62 | >gnl\|Derwent\|AAW01605 248 AA.Arabidopsis STO polypeptide.WO9639020-A1. |
| 168524 (702 letters) | 2e-87 | >gnl\|Derwent\|AAG28816 366 AA.Arabidopsis thaliana protein fragment SEQ ID NO: 34176.EP1033405-A2. |
| 171033 (594 letters) | 2e-75 | >gnl\|Derwent\|AAY95314 208 AA.Corn phosphatidylglycerophosphate synthase.WO200036117-A1. |
| 171051 (408 letters) | 2e-25 | >gnl\|Derwent\|AAG29116 268 AA.Arabidopsis thaliana protein fragment SEQ ID NO: 34586.EP1033405-A2. |
| 171278 (655 letters) | 2e-81 | >gnl\|Derwent\|AAG13200 212 AA.Arabidopsis thaliana protein fragment SEQ ID NO: 12606.EP1033405-A2. |
| 171917 (549 letters) | 2e-45 | >gnl\|Derwent\|AAG41138 99 AA.Zea mays protein fragment SEQ ID NO: 51144.EP1033405-A2. |
| 174804 (584 letters) | 4e-11 | >gnl\|Derwent\|AAG52706 357 AA.Arabidopsis thaliana protein fragment SEQ ID NO: 67030.EP1033405-A2. |
| 174874 (583 letters) | 6e-48 | >gnl\|Derwent\|AAG07307 486 AA.Arabidopsis thaliana protein fragment SEQ ID NO: 4412.EP1033405-A2. |
| 174878 (584 letters) | 4e-44 | >gnl\|Derwent\|AAG17818 506 AA.Arabidopsis thaliana protein fragment SEQ ID NO: 18983.EP1033405-A2. |

FIG. 4 continued

| Query Contig ID (length, bp) | Pz Score | Result |
|---|---|---|
| 174917 (508 letters) | 4e-32 | >gnl\|Derwent\|AAG52735 294 AA.Arabidopsis thaliana protein fragment SEQ ID NO: 67070.EP1033405-A2. |
| 175484 (483 letters) | 1e-30 | >gnl\|Derwent\|AAG25642 102 AA.Arabidopsis thaliana protein fragment SEQ ID NO: 29787.EP1033405-A2. |
| 175535 (666 letters) | 4e-76 | >gnl\|Derwent\|AAG29798 428 AA.Arabidopsis thaliana protein fragment SEQ ID NO: 35514.EP1033405-A2. |
| 175706 (616 letters) | 9e-84 | >gnl\|Derwent\|AAB18936 271 AA.Amino acid sequence of a maize chitinase polypeptide.WO200056908-A2. |
| 175736 Contig A (629 letters) | 2e-69 | >gnl\|Derwent\|AAW81786 328 AA.Tomato fructokinase (frk2).WO9845412-A1. |
| 175736 Contig B (646 letters) | 1e-33 | >gnl\|Derwent\|AAG17114 310 AA.Arabidopsis thaliana protein fragment SEQ ID NO: 18012.EP1033405-A2. |
| 175912 (651 letters) | 2e-51 | >gnl\|Derwent\|AAG52653 269 AA.Arabidopsis thaliana protein fragment SEQ ID NO: 66957.EP1033405-A2. |
| 175977 (482 letters) | 1e-66 | >gnl\|Derwent\|AAG44631 157 AA.Zea mays protein fragment SEQ ID NO: 55930.EP1033405-A2. |
| 176047 (460 letters) | 1e-63 | >gnl\|Derwent\|AAG36842 295 AA.Arabidopsis thaliana protein fragment SEQ ID NO: 45207.EP1033405-A2. |
| 181743 (602 letters) | 3e-82 | >gnl\|Derwent\|AAG36260 280 AA.Arabidopsis thaliana protein fragment SEQ ID NO: 44411.EP1033405-A2. |
| 181759 (606 letters) | 2e-10 | >gnl\|Derwent\|AAY11105 278 AA.H. pylori ORF hp7e10192_23712780_f2_5 cytoplasmic protein.WO9824475-A1. |
| 181971 (674 letters) | 1e-77 | >gnl\|Derwent\|AAG36256 381 AA.Arabidopsis thaliana protein fragment SEQ ID NO: 44406.EP1033405-A2. |
| 182002 (655 letters) | 1e-49 | >gnl\|Derwent\|AAG39523 439 AA.Arabidopsis thaliana protein fragment SEQ ID NO: 48915.EP1033405-A2. |
| 182007 (606 letters) | 4e-70 | >gnl\|Derwent\|AAG48328 436 AA.Arabidopsis thaliana protein fragment SEQ ID NO: 61017.EP1033405-A2. |
| 182081 (603 letters) | 4e-43 | >gnl\|Derwent\|AAB12846 247 AA.Human V-type ATPase D subunit pRb-BP76 protein SEQ ID NO:4.CN1254013-A. |
| 182358 (668 letters) | 5e-71 | >gnl\|Derwent\|AAR60500 435 AA.Linoleic-acid-desaturase fadE.WO9418337-A. |
| 186849 (369 letters) | 2e-21 | >gnl\|Derwent\|AAG22601 122 AA.Zea mays protein fragment SEQ ID NO: 25594.EP1033405-A2. |
| 186860 (605 letters) | 8e-87 | >gnl\|Derwent\|AAG43632 835 AA.Arabidopsis thaliana protein fragment SEQ ID NO: 54558.EP1033405-A2. |
| 186963 (474 letters) | 1e-17 | >gnl\|Derwent\|AAG47929 158 AA.Arabidopsis thaliana protein fragment SEQ ID NO: 60465.EP1033405-A2. |
| 188836 (565 letters) | 7e-38 | >gnl\|Derwent\|AAY25165 134 AA.Rice RIP-10 protein.WO9904024-A2. |
| 188837 (632 letters) | 1e-14 | >gnl\|Derwent\|AAB65766 500 AA.Cysteine protease #7.WO200075331-A1. |
| 188873 (592 letters) | 1e-13 | >gnl\|Derwent\|AAR28122 143 AA.Alpha-amylase/trypsin inhibitor with OmpA signal peptide.EP510658-A. |
| 188876 (578 letters) | 2e-29 | >gnl\|Derwent\|AAG36618 309 AA.Arabidopsis thaliana protein fragment SEQ ID NO: 44902.EP1033405-A2. |
| 188943 (686 letters) | e-115 | >gnl\|Derwent\|AAP82755 499 AA.Rice storage protein.JP63071181-A. |
| 188959 (628 letters) | 1e-69 | >gnl\|Derwent\|AAG41359 143 AA.Arabidopsis thaliana protein fragment SEQ ID NO: 51448.EP1033405-A2. |

FIG. 4 continued

| Query Contig ID (length, bp) | Pz Score | Result |
|---|---|---|
| 194652 (569 letters) | 2e-50 | >gnl\|Derwent\|AAG43249 193 AA.Arabidopsis thaliana protein fragment SEQ ID NO: 54036.EP1033405-A2. |
| 200602 (554 letters) | 4e-19 | >gnl\|Derwent\|AAB20005 443 AA.Arabidopsis 3-ketoacyl-CoA thiolase AtPED1.WO200075350-A2. |
| 200605 (631 letters) | 2e-91 | >gnl\|Derwent\|AAW38417 610 AA.Yeast acyl-coenzyme A:cholesterol acyltransferase 1.WO9745536-A1. |
| 200615 (615 letters) | 2e-19 | >gnl\|Derwent\|AAY13941 301 AA.Human transmembrane protein, HP01606.WO9918203-A2. |
| 200617 (546 letters) | 1e-07 | >gnl\|Derwent\|AAW20601 241 AA.H. pylori membrane protein, 01cp11710orf34.WO9640893-A1. |
| 200621 (632 letters) | 7e-37 | >gnl\|Derwent\|AAG32600 332 AA.Arabidopsis thaliana protein fragment SEQ ID NO: 39361.EP1033405-A2. |
| 200622 (401 letters) | 2e-63 | >gnl\|Derwent\|AAB11409 120 AA.S. cerevisiae cytochrome b5 protein.WO200065061-A2. |
| 200625 (622 letters) | e-101 | >gnl\|Derwent\|AAB70691 235 AA.Saccharomyces cerevisiae DPP1 protein sequence.CN1271009-A. |
| 200626 (627 letters) | e-119 | >gnl\|Derwent\|AAY05829 589 AA.Yeast sphingosine-1-phosphate lyase.WO9916888-A2. |
| 200628 (626 letters) | 6e-59 | >gnl\|Derwent\|AAW10528 210 AA.Saccharomyces cerevisiae temp. inducible protein, TIP1.US5470971-A. |
| 200629 (600 letters) | 9e-31 | >gnl\|Derwent\|AAB32052 223 AA.Human secreted protein BLAST search protein SEQ ID NO: 110.WO200058350-A1. |
| 200631 (597 letters) | e-104 | >gnl\|Derwent\|AAW01737 444 AA.S. cerevisiae squalene synthetase.US5589372-A. |
| 200633 (599 letters) | 1e-36 | >gnl\|Derwent\|AAY68909 300 AA.A geranylgeranyl pyrophosphate synthetase (hGGPPS).WO200005382-A2. |
| 200638 (368 letters) | 6e-49 | >gnl\|Derwent\|AAR91993 108 AA.Saccharomyces cerevisiae p12 protein.JP08009977-A. |
| 200646 (637 letters) | e-106 | >gnl\|Derwent\|AAW00280 288 AA.Peptide used to increase carotenoid yield.WO9628545-A1. |
| 200647 (635 letters) | 9e-10 | >gnl\|Derwent\|AAG22001 299 AA.Arabidopsis thaliana protein fragment SEQ ID NO: 24764.EP1033405-A2. |
| 200649 (624 letters) | 2e-41 | >gnl\|Derwent\|AAY79216 205 AA.Human transferase TRNSFS-8.WO200014251-A2. |
| 200653 (629 letters) | 1e-95 | >gnl\|Derwent\|AAW05525 280 AA.Yeast cell wall protein Cly4.EP735138-A2. |
| 200659 (629 letters) | 7e-25 | >gnl\|Derwent\|AAY71236 654 AA.Fusarium venenatum lysophospholipase protein.WO200028044-A1. |
| 200665 (875 letters) | 2e-13 | >gnl\|Derwent\|AAY54422 248 AA.Amino acid sequence of a beta-ketoacyl-ACP reductase protein.EP955375-A2. |
| 200666 (636 letters) | 1e-05 | >gnl\|Derwent\|AAB42143 294 AA.Human ORFX ORF1907 polypeptide sequence SEQ ID NO:3814.WO200058473-A2. |
| 200669 (631 letters) | 2e-12 | >gnl\|Derwent\|AAG37798 140 AA.Arabidopsis thaliana protein fragment SEQ ID NO: 46535.EP1033405-A2. |
| 200670 (632 letters) | 2e-07 | >gnl\|Derwent\|AAW01748 404 AA.Alpha-1,6-mannosyltransferase.JP08336387-A. |
| 200671 (631 letters) | e-119 | >gnl\|Derwent\|AAY98038 349 AA.Yeast SYR2, conferring syringomycin-resistance.WO200031142-A2. |
| 200672 (635 letters) | e-103 | >gnl\|Derwent\|AAW70836 383 AA.Yeast SMT enzyme.WO9845457-A1. |

FIG. 4 continued

| Query Contig ID (length, bp) | Pz Score | Result |
|---|---|---|
| 200673 (597 letters) | 4e-64 | >gnl\|Derwent\|AAG45411 497 AA.Arabidopsis thaliana protein fragment SEQ ID NO: 57008.EP1033405-A2. |
| 200674 (612 letters) | 1e-15 | >gnl\|Derwent\|AAR77866 247 AA.S. clavuligerus ORF9 product.CA2108113-A. |
| 200677 (635 letters) | 3e-37 | >gnl\|Derwent\|AAB18076 134 AA.Pinus radiata oxysterol-binding protein SEQ ID NO:237.WO200036081-A2. |
| 200680 (619 letters) | 4e-21 | >gnl\|Derwent\|AAR82026 573 AA.Squalene epoxidase.JP07194381-A. |
| 212356 (590 letters) | 8e-21 | >gnl\|Derwent\|AAY58170 386 AA.Human hydrolase homologue HHH-6.WO9961626-A2. |
| 212412 (529 letters) | 3e-44 | >gnl\|Derwent\|AAY05481 102 AA.Human histone 4 protein sequence.WO9919502-A1. |
| 212714 (565 letters) | 2e-27 | >gnl\|Derwent\|AAB64519 101 AA.Gene 30 human secreted protein homologous amino acid sequence #157.WO200077255-A1. |
| 212755 (431 letters) | 3e-06 | >gnl\|Derwent\|AAY75582 119 AA.Neisseria meningitidis ORF 768 protein sequence SEQ ID NO:2638.WO9957280-A2. |
| 212785 (483 letters) | 4e-09 | >gnl\|Derwent\|AAB43876 173 AA.Human cancer associated protein sequence SEQ ID NO:1321.WO200055350-A1. |
| 212792 Contig A (151 letters) | 8e-05 | >gnl\|Derwent\|AAW85604 578 AA.A hexosaminidase enzyme.WO9850512-A1. |
| 212824 (436 letters) | 2e-05 | >gnl\|Derwent\|AAG01715 124 AA.Human secreted protein, SEQ ID NO: 5796.EP1033401-A2. |
| 212892 (452 letters) | 1e-08 | >gnl\|Derwent\|AAB18972 291 AA.Amino acid sequence of a human transmembrane protein.WO200056891-A2. |
| 212996 (592 letters) | 4e-06 | >gnl\|Derwent\|AAE00223 464 AA.Human AMPK gamma subunit muscle-specific isoform, complete PRKAG3.WO200120003-A2. |
| 213013 (528 letters) | 7e-17 | >gnl\|Derwent\|AAW54389 411 AA.Actinomadura hibisca polyketide synthase protein 10.WO9811230-A1. |
| 213037 (617 letters) | 2e-52 | >gnl\|Derwent\|AAR72576 550 AA.Candida tropicalis pK233 isocitrate lyase.JP07059576-A. |
| 213112 (615 letters) | 4e-05 | >gnl\|Derwent\|AAY06783 608 AA.M. grisea PTH2 gene product.WO9913094-A2. |
| 213123 (228 letters) | 2e-06 | >gnl\|Derwent\|AAR04031 2458 AA.Full length T4 encoded by plasmid p170-2.WO8911860-A. |
| 213128 (368 letters) | 3e-28 | >gnl\|Derwent\|AAY99880 343 AA.Cercospora nicotianae sor1 photosensitiser resistance protein.US6063987-A. |
| 213137 (603 letters) | 1e-13 | >gnl\|Derwent\|AAB36622 165 AA.Human FLEXHT-44 protein sequence SEQ ID NO:44.WO200070047-A2. |
| 213171 (642 letters) | 2e-41 | >gnl\|Derwent\|AAR85881 514 AA.WD-40 domain-contg. YCW2 protein.WO9521252-A2. |
| 213179 (639 letters) | 2e-09 | >gnl\|Derwent\|AAY95048 648 AA.Candida albicans polypeptide sequence # 16.EP982401-A2. |
| 213206 (570 letters) | 7e-41 | >gnl\|Derwent\|AAG34057 210 AA.Zea mays protein fragment SEQ ID NO: 41383.EP1033405-A2. |
| 213222 (627 letters) | 4e-18 | >gnl\|Derwent\|AAG11644 124 AA.Arabidopsis thaliana protein fragment SEQ ID NO: 10439.EP1033405-A2. |

FIG. 4 continued

| Query Contig ID (length, bp) | Pz Score | Result |
|---|---|---|
| 213226 (701 letters) | 9e-39 | >gnl\|Derwent\|AAB48311 163 AA.Human SKP1 protein.WO200075184-A1. |
| 213246 (650 letters) | 1e-18 | >gnl\|Derwent\|AAW13658 146 AA.Human cytidine deaminase.WO9705254-A1. |
| 213257 (614 letters) | 1e-42 | >gnl\|Derwent\|AAB43446 198 AA.Human cancer associated protein sequence SEQ ID NO:891.WO200055350-A1. |
| 213260 (565 letters) | 2e-21 | >gnl\|Derwent\|AAR43911 348 AA.Sequence encoded by yeast fructose-1,6-diposphatase (FDPase) gene.US5268285-A. |
| 213318 (524 letters) | 4e-10 | >gnl\|Derwent\|AAG10804 167 AA.Arabidopsis thaliana protein fragment SEQ ID NO: 9272.EP1033405-A2. |
| 213340 (555 letters) | 9e-30 | >gnl\|Derwent\|AAY39328 134 AA.PEGen42 protein.WO9943844-A1. |
| 213377 (551 letters) | 5e-11 | >gnl\|Derwent\|AAG52095 250 AA.Arabidopsis thaliana protein fragment SEQ ID NO: 66186.EP1033405-A2. |
| 213734 (516 letters) | 2e-33 | >gnl\|Derwent\|AAG26632 328 AA.Arabidopsis thaliana protein fragment SEQ ID NO: 31161.EP1033405-A2. |
| 213749 (571 letters) | 3e-20 | >gnl\|Derwent\|AAR43654 181 AA.c424 gene product.JP05268964-A. |
| 213754 (644 letters) | 4e-06 | >gnl\|Derwent\|AAY82326 357 AA.Human arginase I SEQ ID NO:17.US6054308-A. |
| 213756 (676 letters) | 2e-07 | >gnl\|Derwent\|AAY94965 250 AA.Human secreted protein clone rj214_14 protein sequence SEQ ID NO:136.WO200009552-A1. |
| 213758 (578 letters) | 6e-10 | >gnl\|Derwent\|AAG05890 497 AA.Arabidopsis thaliana protein fragment SEQ ID NO: 2464.EP1033405-A2. |
| 213783 (549 letters) | 5e-05 | >gnl\|Derwent\|AAB00124 433 AA.p33 tumour suppressor polypeptide.WO200055178-A1. |
| 213789 (278 letters) | 8e-14 | >gnl\|Derwent\|AAG51348 548 AA.Arabidopsis thaliana protein fragment SEQ ID NO: 65161.EP1033405-A2. |
| 213802 (554 letters) | 7e-23 | >gnl\|Derwent\|AAG03760 117 AA.Human secreted protein, SEQ ID NO: 7841.EP1033401-A2. |
| 213814 (428 letters) | 3e-11 | >gnl\|Derwent\|AAG58504 64 AA.Zea mays protein fragment SEQ ID NO: 75531.EP1033405-A2. |
| 213829 (672 letters) | 8e-10 | >gnl\|Derwent\|AAY58791 343 AA.Soybean phosphatidic acid phosphatase soyPAP1.WO200005385-A1. |
| 213868 (605 letters) | 4e-17 | >gnl\|Derwent\|AAB42362 352 AA.Human ORFX ORF2126 polypeptide sequence SEQ ID NO:4252.WO200058473-A2. |
| 213877 (629 letters) | 4e-25 | >gnl\|Derwent\|AAW17830 455 AA.Thermophilic alkaline phosphatase.EP770678-A2. |
| 213895 (529 letters) | 3e-04 | >gnl\|Derwent\|AAB36604 412 AA.Human FLEXHT-26 protein sequence SEQ ID NO:26.WO200070047-A2. |
| 213914 (418 letters) | 1e-23 | >gnl\|Derwent\|AAG09553 328 AA.Arabidopsis thaliana protein fragment SEQ ID NO: 7531.EP1033405-A2. |
| 213942 (300 letters) | 8e-17 | >gnl\|Derwent\|AAG03909 112 AA.Human secreted protein, SEQ ID NO: 7990.EP1033401-A2. |
| 213958 (324 letters) | 2e-39 | >gnl\|Derwent\|AAY06930 264 AA.C. albicans antigenic protein 6.WO9916881-A1. |
| 213967 (626 letters) | 2e-19 | >gnl\|Derwent\|AAY43641 82 AA.Amino acid sequence of the DPH3 gene product.WO9953762-A1. |

FIG. 4 continued

| Query Contig ID (length, bp) | Pz Score | Result |
|---|---|---|
| 213981 (423 letters) | 2e-33 | >gnl\|Derwent\|AAW85604 578 AA.A hexosaminidase enzyme.WO9850512-A1. |
| 214014 (368 letters) | 1e-18 | >gnl\|Derwent\|AAB38580 53 AA.Gene 8 human secreted protein homologous amino acid sequence #117.WO200056882-A1. |
| 214067 (626 letters) | 4e-07 | >gnl\|Derwent\|AAR43654 181 AA.c424 gene product.JP05268964-A. |
| 214087 (512 letters) | 5e-14 | >gnl\|Derwent\|AAB19719 391 AA.Yarrowia lipolytica Pex16 protein.WO200061735-A1. |
| 214146 (563 letters) | 5e-07 | >gnl\|Derwent\|AAW24470 164 AA.Human methenyltetrahydrofolate synthetase.US5631131-A. |
| 214201 (483 letters) | 3e-04 | >gnl\|Derwent\|AAY03790 206 AA.S. aureus polypeptide.EP905243-A2. |
| 214250 (591 letters) | 5e-20 | >gnl\|Derwent\|AAG23049 304 AA.Arabidopsis thaliana protein fragment SEQ ID NO: 26210.EP1033405-A2. |
| 214256 (484 letters) | 5e-09 | >gnl\|Derwent\|AAY94934 102 AA.Human secreted protein clone yd137_1 protein sequence SEQ ID NO:74.WO200009552-A1. |
| 214259 (531 letters) | 5e-08 | >gnl\|Derwent\|AAG31795 257 AA.Arabidopsis thaliana protein fragment SEQ ID NO: 38244.EP1033405-A2. |
| 214264 (595 letters) | 9e-20 | >gnl\|Derwent\|AAG21074 261 AA.Arabidopsis thaliana protein fragment SEQ ID NO: 23497.EP1033405-A2. |
| 214270 (553 letters) | 7e-19 | >gnl\|Derwent\|AAG23302 421 AA.Arabidopsis thaliana protein fragment SEQ ID NO: 26560.EP1033405-A2. |
| 214279 (596 letters) | 8e-15 | >gnl\|Derwent\|AAG22272 470 AA.Arabidopsis thaliana protein fragment SEQ ID NO: 25136.EP1033405-A2. |
| 214339 (601 letters) | 5e-61 | >gnl\|Derwent\|AAG17776 206 AA.Arabidopsis thaliana protein fragment SEQ ID NO: 18925.EP1033405-A2. |
| 214356 (538 letters) | 2e-06 | >gnl\|Derwent\|AAR99961 110 AA.Cladosporium herbarum allergen Clah12.WO9627005-A2. |
| 214402 (674 letters) | 2e-13 | >gnl\|Derwent\|AAG49129 182 AA.Arabidopsis thaliana protein fragment SEQ ID NO: 62119.EP1033405-A2. |
| 214414 (625 letters) | 3e-18 | >gnl\|Derwent\|AAW98444 519 AA.H. pylori GHPO 534 protein.WO9843478-A1. |
| 214415 (384 letters) | 1e-33 | >gnl\|Derwent\|AAY95059 87 AA.Candida albicans polypeptide sequence # 27.EP982401-A2. |
| 214421 (668 letters) | 3e-12 | >gnl\|Derwent\|AAG26374 237 AA.Arabidopsis thaliana protein fragment SEQ ID NO: 30806.EP1033405-A2. |
| 214423 (630 letters) | 2e-63 | >gnl\|Derwent\|AAW70806 289 AA.A human inorganic pyrophosphatase designated HPYP.US5843665-A. |
| 214437 (639 letters) | 1e-52 | >gnl\|Derwent\|AAG35984 152 AA.Zea mays protein fragment SEQ ID NO: 44035.EP1033405-A2. |
| 214460 (650 letters) | 2e-18 | >gnl\|Derwent\|AAG33306 433 AA.Zea mays protein fragment SEQ ID NO: 40336.EP1033405-A2. |
| 214504 (511 letters) | 7e-18 | >gnl\|Derwent\|AAG00840 142 AA.Human secreted protein, SEQ ID NO: 4921.EP1033401-A2. |
| 214527 (287 letters) | 2e-07 | >gnl\|Derwent\|AAG08735 294 AA.Arabidopsis thaliana protein fragment SEQ ID NO: 6390.EP1033405-A2. |
| 214532 (536 letters) | 5e-05 | >gnl\|Derwent\|AAY96261 352 AA.R. eutropha toluene monooxygenase TomP polypeptide.EP1006191-A2. |
| 214613 (659 letters) | 3e-27 | >gnl\|Derwent\|AAG36787 160 AA.Arabidopsis thaliana protein fragment SEQ ID NO: 45133.EP1033405-A2. |

FIG. 4 continued

| Query Contig ID (length, bp) | Pz Score | Result |
|---|---|---|
| 214620 (608 letters) | 9e-07 | >gnl\|Derwent\|AAG39905 664 AA.Arabidopsis thaliana protein fragment SEQ ID NO: 49442.EP1033405-A2. |
| 214633 (520 letters) | 1e-49 | >gnl\|Derwent\|AAY99880 343 AA.Cercospora nicotianae sor1 photosensitiser resistance protein.US6063987-A. |
| 214634 (561 letters) | 3e-83 | >gnl\|Derwent\|AAY68728 424 AA.Amino acid sequence of a Trichoderma harzianum endochitinase.WO200001812-A1. |
| 214665 (590 letters) | 1e-18 | >gnl\|Derwent\|AAG07547 328 AA.Arabidopsis thaliana protein fragment SEQ ID NO: 4743.EP1033405-A2. |
| 214672 (655 letters) | 2e-19 | >gnl\|Derwent\|AAY43641 82 AA.Amino acid sequence of the DPH3 gene product.WO9953762-A1. |
| 214676 (659 letters) | 5e-24 | >gnl\|Derwent\|AAY57936 310 AA.Human transmembrane protein HTMPN-60.WO9961471-A2. |
| 214756 (670 letters) | 5e-04 | >gnl\|Derwent\|AAW06798 425 AA.Murine p154.US5541068-A. |
| 214766 (647 letters) | 9e-89 | >gnl\|Derwent\|AAY94438 451 AA.Rice NADP-specific glutamate dehydrogenase.WO200028006-A2. |
| 214826 (606 letters) | 3e-11 | >gnl\|Derwent\|AAB16027 136 AA.E. coli proliferation associated protein sequence SEQ ID NO:385.WO200044906-A2. |
| 214828 (564 letters) | 8e-37 | >gnl\|Derwent\|AAB19933 563 AA.Human oxidoreductase OXRD-8.WO200071679-A2. |
| 214837 (198 letters) | 5e-26 | >gnl\|Derwent\|AAW79948 458 AA.Aspergillus phoenices oxalate decarboxylase (APOXD) enzyme.WO9842827-A2. |
| 214840 (600 letters) | 1e-11 | >gnl\|Derwent\|AAW98508 1185 AA.H. pylori GHPO 1231 protein.WO9843478-A1. |
| 214873 (561 letters) | 1e-29 | >gnl\|Derwent\|AAG31200 481 AA.Arabidopsis thaliana protein fragment SEQ ID NO: 37428.EP1033405-A2. |
| 214888 (606 letters) | 2e-21 | >gnl\|Derwent\|AAW41512 328 AA.Golgi membrane UDP N-acetylglucosamine transporter.WO9747641-A1. |
| 214902 (617 letters) | 2e-26 | >gnl\|Derwent\|AAW64777 283 AA.C. magnoliae carbonyl reductase.WO9835025-A1. |
| 214918 (552 letters) | 3e-08 | >gnl\|Derwent\|AAB70387 735 AA.Human host cell protein NP1I-1 protein sequence SEQ ID NO:13.WO200111335-A2. |
| 214919 (569 letters) | 8e-16 | >gnl\|Derwent\|AAG52091 545 AA.Arabidopsis thaliana protein fragment SEQ ID NO: 66180.EP1033405-A2. |
| 214922 (639 letters) | 7e-16 | >gnl\|Derwent\|AAG41867 422 AA.Arabidopsis thaliana protein fragment SEQ ID NO: 52144.EP1033405-A2. |
| 215009 (528 letters) | 7e-38 | >gnl\|Derwent\|AAG05522 143 AA.Arabidopsis thaliana protein fragment SEQ ID NO: 1959.EP1033405-A2. |
| 215032 (659 letters) | 2e-27 | >gnl\|Derwent\|AAG21154 144 AA.Zea mays protein fragment SEQ ID NO: 23606.EP1033405-A2. |
| 215043 (655 letters) | 1e-52 | >gnl\|Derwent\|AAG35984 152 AA.Zea mays protein fragment SEQ ID NO: 44035.EP1033405-A2. |
| 215047 (700 letters) | e-104 | >gnl\|Derwent\|AAB50038 317 AA.RACK1 protein.WO200073427-A2. |
| 215059 (562 letters) | 3e-12 | >gnl\|Derwent\|AAY85822 193 AA.S. pneumoniae derived protein #31.WO9806734-A1. |
| 215060 (642 letters) | 2e-08 | >gnl\|Derwent\|AAG41924 96 AA.Arabidopsis thaliana protein fragment SEQ ID NO: 52221.EP1033405-A2. |

FIG. 4 continued

| Query Contig ID (length, bp) | Pz Score | Result |
|---|---|---|
| 215074 (670 letters) | 6e-58 | >gnl\|Derwent\|AAG03817 140 AA.Human secreted protein, SEQ ID NO: 7898.EP1033401-A2. |
| 215084 (702 letters) | 8e-46 | >gnl\|Derwent\|AAY95058 176 AA.Candida albicans polypeptide sequence # 26.EP982401-A2. |
| 215087 (488 letters) | 4e-04 | >gnl\|Derwent\|AAB19929 157 AA.Human oxidoreductase OXRD-4.WO200071679-A2. |
| 215106 (577 letters) | 1e-18 | >gnl\|Derwent\|AAG42733 322 AA.Arabidopsis thaliana protein fragment SEQ ID NO: 53328.EP1033405-A2. |
| 215107 (585 letters) | 2e-31 | >gnl\|Derwent\|AAB08974 350 AA.Human secreted protein sequence encoded by gene 27 SEQ ID NO:131.WO200017222-A1. |
| 215120 (562 letters) | 8e-90 | >gnl\|Derwent\|AAY53588 381 AA.Hepatitis B virus surface antigen S.RU2115730-C1. |
| 215138 (591 letters) | 7e-60 | >gnl\|Derwent\|AAG39725 279 AA.Arabidopsis thaliana protein fragment SEQ ID NO: 49197.EP1033405-A2. |
| 215150 (568 letters) | 3e-32 | >gnl\|Derwent\|AAR40847 84 AA.Metallopanstimulin-I.US5243041-A. |
| 215163 (576 letters) | 1e-05 | >gnl\|Derwent\|AAR10975 283 AA.Polyhydroxyalkanoate depolymerase enzyme.WO9100917-A. |
| 215211 (458 letters) | 1e-13 | >gnl\|Derwent\|AAB36622 165 AA.Human FLEXHT-44 protein sequence SEQ ID NO:44.WO200070047-A2. |
| 215244 (573 letters) | 3e-34 | >gnl\|Derwent\|AAG43338 286 AA.Arabidopsis thaliana protein fragment SEQ ID NO: 54157.EP1033405-A2. |
| 215258 (586 letters) | 8e-46 | >gnl\|Derwent\|AAY77943 112 AA.A. thaliana environmental stress tolerance related protein.WO200008187-A2. |
| 215259 (532 letters) | 8e-05 | >gnl\|Derwent\|AAG14147 333 AA.Arabidopsis thaliana protein fragment SEQ ID NO: 13900.EP1033405-A2. |
| 215325 (528 letters) | 2e-47 | >gnl\|Derwent\|AAB56789 238 AA.Human prostate cancer antigen protein sequence SEQ ID NO:1367.WO200055174-A1. |
| 215347 (517 letters) | 3e-13 | >gnl\|Derwent\|AAW46784 142 AA.Yeast NC2-alpha/DRAP1 gene.WO9804704-A1. |
| 215360 (627 letters) | 3e-23 | >gnl\|Derwent\|AAG31565 113 AA.Arabidopsis thaliana protein fragment SEQ ID NO: 37928.EP1033405-A2. |
| 215379 (512 letters) | 3e-40 | >gnl\|Derwent\|AAG24412 222 AA.Arabidopsis thaliana protein fragment SEQ ID NO: 28074.EP1033405-A2. |
| 215382 (613 letters) | 3e-19 | >gnl\|Derwent\|AAG34199 181 AA.Zea mays protein fragment SEQ ID NO: 41573.EP1033405-A2. |
| 215387 (501 letters) | 1e-32 | >gnl\|Derwent\|AAB66395 753 AA.Human mammastatin C protein sequence.WO200078955-A1. |
| 215420 (615 letters) | 2e-21 | >gnl\|Derwent\|AAG25637 136 AA.Arabidopsis thaliana protein fragment SEQ ID NO: 29780.EP1033405-A2. |
| 215422 (542 letters) | 3e-04 | >gnl\|Derwent\|AAB56586 300 AA.Human prostate cancer antigen protein sequence SEQ ID NO:1164.WO200055174-A1. |
| 215431 (674 letters) | 2e-65 | >gnl\|Derwent\|AAB58805 202 AA.Breast and ovarian cancer associated antigen protein sequence SEQ ID 513.WO200055173-A1. |
| 215445 (685 letters) | 1e-65 | >gnl\|Derwent\|AAR12811 302 AA.A.flavus urate oxidase.EP435776-A. |

FIG. 4 continued

| Query Contig ID (length, bp) | Pz Score | Result |
|---|---|---|
| 215459 (397 letters) | 4e-17 | >gnl\|Derwent\|AAR32874 71 AA.grg-1 protein.US5187079-A. |
| 215477 (602 letters) | 3e-66 | >gnl\|Derwent\|AAG03810 165 AA.Human secreted protein, SEQ ID NO: 7891.EP1033401-A2. |
| 215552 (530 letters) | 3e-35 | >gnl\|Derwent\|AAG26632 328 AA.Arabidopsis thaliana protein fragment SEQ ID NO: 31161.EP1033405-A2. |
| 215570 (521 letters) | 2e-57 | >gnl\|Derwent\|AAW31629 495 AA.Aspergillus oryzae protease PepC.WO9722705-A1. |
| 215579 (338 letters) | 5e-12 | >gnl\|Derwent\|AAW97700 417 AA.Staphylococcus aureus mutant P10B2 virulence gene product.WO9901473-A2. |
| 215586 (382 letters) | 4e-19 | >gnl\|Derwent\|AAB37672 543 AA.Choline oxidase.US6146864-A. |
| 215601 (566 letters) | 9e-39 | >gnl\|Derwent\|AAR52699 1221 AA.Sequence translated from reading frame b of plasmid pASK46.GB2272698-A. |
| 215610 (521 letters) | 2e-65 | >gnl\|Derwent\|AAR65965 338 AA.T. niveum GAPDH.WO9425606-A. |
| 215611 (593 letters) | 9e-16 | >gnl\|Derwent\|AAG03935 105 AA.Human secreted protein, SEQ ID NO: 8016.EP1033401-A2. |
| 215629 (542 letters) | 9e-64 | >gnl\|Derwent\|AAG36187 264 AA.Arabidopsis thaliana protein fragment SEQ ID NO: 44313.EP1033405-A2. |
| 215665 (438 letters) | 1e-04 | >gnl\|Derwent\|AAB80999 327 AA.Barley iron absorption improver.JP2001017181-A. |
| 215672 (515 letters) | 3e-27 | >gnl\|Derwent\|AAG03891 122 AA.Human secreted protein, SEQ ID NO: 7972.EP1033401-A2. |
| 215676 (557 letters) | 2e-67 | >gnl\|Derwent\|AAG28188 312 AA.Arabidopsis thaliana protein fragment SEQ ID NO: 33314.EP1033405-A2. |
| 215685 (495 letters) | 1e-08 | >gnl\|Derwent\|AAG29182 371 AA.Arabidopsis thaliana protein fragment SEQ ID NO: 34677.EP1033405-A2. |
| 215737 (630 letters) | 1e-27 | >gnl\|Derwent\|AAR79452 205 AA.Human Augmenter of Liver Regeneration (ALR) variant-1 protein.EP668291-A2. |
| 215827 (621 letters) | 3e-43 | >gnl\|Derwent\|AAG36499 302 AA.Arabidopsis thaliana protein fragment SEQ ID NO: 44738.EP1033405-A2. |
| 215859 (508 letters) | 3e-22 | >gnl\|Derwent\|AAG17040 432 AA.Arabidopsis thaliana protein fragment SEQ ID NO: 17911.EP1033405-A2. |
| 215864 (551 letters) | 8e-05 | >gnl\|Derwent\|AAB53623 100 AA.Human colon cancer antigen protein sequence SEQ ID NO:1163.WO200055351-A1. |
| 215926 (691 letters) | 3e-25 | >gnl\|Derwent\|AAG20258 348 AA.Arabidopsis thaliana protein fragment SEQ ID NO: 22375.EP1033405-A2. |
| 215934 (550 letters) | 4e-06 | >gnl\|Derwent\|AAY99484 396 AA.Yeast acyltransferase YSCAT2, SEQ ID NO:218.WO200018889-A2. |
| 215961 (536 letters) | 6e-45 | >gnl\|Derwent\|AAY38828 201 AA.Neisseria meningitidis strain A antigen encoded by ORF6.WO9924578-A2. |
| 215966 (645 letters) | 1e-51 | >gnl\|Derwent\|AAG18755 156 AA.Zea mays protein fragment SEQ ID NO: 20290.EP1033405-A2. |
| 215973 (345 letters) | 4e-12 | >gnl\|Derwent\|AAW31628 397 AA.Aspergillus oryzae protease PepE.WO9722705-A1. |
| 215995 (528 letters) | 4e-09 | >gnl\|Derwent\|AAR48059 491 AA.Sequence of protease C encoded by gene K1.PRC1.WO9400579-A. |
| 216005 (664 letters) | 2e-40 | >gnl\|Derwent\|AAW41170 376 AA.Metal-regulated transporter polypeptide ZRT2.WO9745000-A1. |

FIG. 4 continued

| Query Contig ID (length, bp) | Pz Score | Result |
|---|---|---|
| 216009 (684 letters) | 2e-38 | >gnl\|Derwent\|AAW26603 428 AA.Guar phosphomannose isomerase.WO9720937-A2. |
| 216013 (700 letters) | 2e-08 | >gnl\|Derwent\|AAG29528 582 AA.Arabidopsis thaliana protein fragment SEQ ID NO: 35150.EP1033405-A2. |
| 216018 (645 letters) | 1e-26 | >gnl\|Derwent\|AAG03829 121 AA.Human secreted protein, SEQ ID NO: 7910.EP1033401-A2. |
| 216068 (644 letters) | 2e-51 | >gnl\|Derwent\|AAW00280 288 AA.Peptide used to increase carotenoid yield.WO9628545-A1. |
| 216095 (576 letters) | 2e-21 | >gnl\|Derwent\|AAW15774 199 AA.Protein cognate of protein kinase C-theta (clone 1-22 product).WO9714038-A1. |
| 216103 (573 letters) | 2e-04 | >gnl\|Derwent\|AAY58608 379 AA.Protein regulating gene expression PRGE-1.WO9964596-A2. |
| 216131 (459 letters) | 1e-11 | >gnl\|Derwent\|AAG03979 128 AA.Human secreted protein, SEQ ID NO: 8060.EP1033401-A2. |
| 216176 (555 letters) | 4e-15 | >gnl\|Derwent\|AAG01424 221 AA.Human secreted protein, SEQ ID NO: 5505.EP1033401-A2. |
| 216180 (492 letters) | 4e-29 | >gnl\|Derwent\|AAB41748 347 AA.Human ORFX ORF1512 polypeptide sequence SEQ ID NO:3024.WO200058473-A2. |
| 216196 (337 letters) | 1e-15 | >gnl\|Derwent\|AAG35953 120 AA.Zea mays protein fragment SEQ ID NO: 43992.EP1033405-A2. |
| 216207 (511 letters) | 1e-18 | >gnl\|Derwent\|AAG12538 70 AA.Zea mays protein fragment SEQ ID NO: 11690.EP1033405-A2. |
| 216211 (587 letters) | 2e-04 | >gnl\|Derwent\|AAG13500 333 AA.Arabidopsis thaliana protein fragment SEQ ID NO: 13018.EP1033405-A2. |
| 216219 (529 letters) | 6e-07 | >gnl\|Derwent\|AAG27118 105 AA.Zea mays protein fragment SEQ ID NO: 31831.EP1033405-A2. |
| 216223 (602 letters) | 1e-67 | >gnl\|Derwent\|AAG31788 432 AA.Arabidopsis thaliana protein fragment SEQ ID NO: 38234.EP1033405-A2. |
| 216234 (391 letters) | 1e-31 | >gnl\|Derwent\|AAY73986 418 AA.Human prostate tumor EST fragment derived protein #173.DE19820190-A1. |
| 216242 (596 letters) | 5e-06 | >gnl\|Derwent\|AAW88332 473 AA.Salmonella enterica O antigen gene cluster manC protein product.WO9850531-A1. |
| 216262 (249 letters) | 5e-05 | >gnl\|Derwent\|AAG53345 336 AA.Arabidopsis thaliana protein fragment SEQ ID NO: 67906.EP1033405-A2. |
| 216268 (596 letters) | 1e-64 | >gnl\|Derwent\|AAW52819 318 AA.Coffee-fruit specific ACC oxidase.WO9806852-A1. |
| 216283 (595 letters) | 2e-27 | >gnl\|Derwent\|AAB64519 101 AA.Gene 30 human secreted protein homologous amino acid sequence #157.WO200077255-A1. |
| 216284 (576 letters) | 1e-39 | >gnl\|Derwent\|AAG40892 192 AA.Zea mays protein fragment SEQ ID NO: 50800.EP1033405-A2. |
| 216286 (596 letters) | 1e-12 | >gnl\|Derwent\|AAY70123 516 AA.Human hypoxia regulatory protein 2-2-83.WO200012139-A1. |
| 216319 (637 letters) | 4e-16 | >gnl\|Derwent\|AAY97999 309 AA.Human SCAD family molecule HSFM-1, SEQ ID NO:1.US6057140-A. |
| 216349 (627 letters) | 4e-30 | >gnl\|Derwent\|AAY56548 744 AA.Trichoderma reesei beta-glucosidase.US5997913-A. |
| 216352 (623 letters) | 9e-06 | >gnl\|Derwent\|AAY49972 51 AA.Nigrospora sp. hydrophobin partial N-terminal sequence.WO9954725-A1. |

FIG. 4 continued

| Query Contig ID (length, bp) | Pz Score | Result |
|---|---|---|
| 216358 (653 letters) | 9e-23 | >gnl\|Derwent\|AAG02146 138 AA.Human secreted protein, SEQ ID NO: 6227.EP1033401-A2. |
| 216360 (611 letters) | 6e-34 | >gnl\|Derwent\|AAG04759 192 AA.Arabidopsis thaliana protein fragment SEQ ID NO: 908.EP1033405-A2. |
| 216365 (487 letters) | 7e-14 | >gnl\|Derwent\|AAY08327 444 AA.Human CBFAIE10 protein.WO9922007-A1. |
| 216373 (600 letters) | 6e-28 | >gnl\|Derwent\|AAG44853 110 AA.Zea mays protein fragment SEQ ID NO: 56234.EP1033405-A2. |
| 216384 (538 letters) | 8e-18 | >gnl\|Derwent\|AAG00840 142 AA.Human secreted protein, SEQ ID NO: 4921.EP1033401-A2. |
| 216406 (688 letters) | 1e-15 | >gnl\|Derwent\|AAY29097 255 AA.Human CBLALG01 polypeptide.WO9936523-A1. |
| 216408 (585 letters) | 1e-37 | >gnl\|Derwent\|AAG21155 112 AA.Zea mays protein fragment SEQ ID NO: 23607.EP1033405-A2. |
| 216425 (657 letters) | 3e-34 | >gnl\|Derwent\|AAG51440 190 AA.Arabidopsis thaliana protein fragment SEQ ID NO: 65287.EP1033405-A2. |
| 216427 (638 letters) | 4e-31 | >gnl\|Derwent\|AAW22493 140 AA.Phaffia derived glyceraldehyde-3-phosphate dehydrogenase PRcDNA78.WO9723633-A1. |
| 216495 (530 letters) | 6e-12 | >gnl\|Derwent\|AAB58197 276 AA.Lung cancer associated polypeptide sequence SEQ ID 535.WO200055180-A2. |
| 218801 (608 letters) | 7e-43 | >gnl\|Derwent\|AAB00117 2502 AA.M. tuberculosis polypeptide sequence comprising Mtb-81 antigen.WO200055194-A2. |
| 218904 (490 letters) | 6e-04 | >gnl\|Derwent\|AAG41115 120 AA.Zea mays protein fragment SEQ ID NO: 51112.EP1033405-A2. |
| 218922 (507 letters) | 4e-20 | >gnl\|Derwent\|AAG47525 688 AA.Arabidopsis thaliana protein fragment SEQ ID NO: 59911.EP1033405-A2. |
| 218924 (508 letters) | 8e-08 | >gnl\|Derwent\|AAB20185 736 AA.Human multifunctional enzyme type 2 (MFE-2) mutant G16S.WO200109364-A1. |
| 218926 (284 letters) | 7e-13 | >gnl\|Derwent\|AAY72636 525 AA.Exophiala spinifera permease, a fumonisin degradative enzyme.WO200105980-A1. |
| 218947 (502 letters) | 8e-20 | >gnl\|Derwent\|AAG15486 219 AA.Arabidopsis thaliana protein fragment SEQ ID NO: 15757.EP1033405-A2. |
| 218977 (369 letters) | 1e-09 | >gnl\|Derwent\|AAG51111 101 AA.Arabidopsis thaliana protein fragment SEQ ID NO: 64836.EP1033405-A2. |
| 218985 (500 letters) | 4e-07 | >gnl\|Derwent\|AAY08557 281 AA.B. subtilis hydrolase protein YCLE.WO9927081-A2. |
| 219066 (545 letters) | 4e-37 | >gnl\|Derwent\|AAY95051 466 AA.Candida albicans polypeptide sequence # 19.EP982401-A2. |
| 219136 (513 letters) | 5e-26 | >gnl\|Derwent\|AAB20004 462 AA.Arabidopsis 3-ketoacyl-CoA thiolase.WO200075350-A2. |
| 219159 (317 letters) | 2e-11 | >gnl\|Derwent\|AAG35661 532 AA.Arabidopsis thaliana protein fragment SEQ ID NO: 43598.EP1033405-A2. |
| 23794 (857 letters) | 3e-60 | >gnl\|Derwent\|AAG34824 190 AA.Arabidopsis thaliana protein fragment SEQ ID NO: 42436.EP1033405-A2. |
| 258904 Contig A (664 letters) | e-113 | >gnl\|Derwent\|AAG42638 294 AA.Arabidopsis thaliana protein fragment SEQ ID NO: 53198.EP1033405-A2. |
| 258904 Contig B (208 letters) | 3e-37 | >gnl\|Derwent\|AAG42637 295 AA.Arabidopsis thaliana protein fragment SEQ ID NO: 53197.EP1033405-A2. |

FIG. 4 continued

| Query Contig ID (length, bp) | Pz Score | Result |
|---|---|---|
| 258906 (731 letters) | 1e-69 | >gnl\|Derwent\|AAG31142 228 AA.Arabidopsis thaliana protein fragment SEQ ID NO: 37350.EP1033405-A2. |
| 258915 (758 letters) | 2e-36 | >gnl\|Derwent\|AAG11892 186 AA.Arabidopsis thaliana protein fragment SEQ ID NO: 10787.EP1033405-A2. |
| 258924 Contig A (543 letters) | 4e-53 | >gnl\|Derwent\|AAG19662 259 AA.Arabidopsis thaliana protein fragment SEQ ID NO: 21548.EP1033405-A2. |
| 258924 Contig B (139 letters) | 3e-07 | >gnl\|Derwent\|AAG19662 259 AA.Arabidopsis thaliana protein fragment SEQ ID NO: 21548.EP1033405-A2. |
| 258965 (865 letters) | e-149 | >gnl\|Derwent\|AAG52721 300 AA.Arabidopsis thaliana protein fragment SEQ ID NO: 67050.EP1033405-A2. |
| 258966 Contig A (654 letters) | 1e-37 | >gnl\|Derwent\|AAG40512 348 AA.Arabidopsis thaliana protein fragment SEQ ID NO: 50276.EP1033405-A2. |
| 258966 Contig B (448 letters) | 1e-26 | >gnl\|Derwent\|AAG40514 264 AA.Arabidopsis thaliana protein fragment SEQ ID NO: 50278.EP1033405-A2. |
| 258967 (498 letters) | 8e-76 | >gnl\|Derwent\|AAG45426 303 AA.Arabidopsis thaliana protein fragment SEQ ID NO: 57030.EP1033405-A2. |
| 258970 (428 letters) | 7e-82 | >gnl\|Derwent\|AAG43242 139 AA.Arabidopsis thaliana protein fragment SEQ ID NO: 54026.EP1033405-A2. |
| 258978 (956 letters) | 0.0 | >gnl\|Derwent\|AAG53801 360 AA.Arabidopsis thaliana protein fragment SEQ ID NO: 68531.EP1033405-A2. |
| 258996 (434 letters) | 3e-56 | >gnl\|Derwent\|AAG46939 143 AA.Arabidopsis thaliana protein fragment SEQ ID NO: 59106.EP1033405-A2. |
| 259006 (653 letters) | e-119 | >gnl\|Derwent\|AAG31297 274 AA.Arabidopsis thaliana protein fragment SEQ ID NO: 37561.EP1033405-A2. |
| 259007 (845 letters) | e-143 | >gnl\|Derwent\|AAG40208 292 AA.Arabidopsis thaliana protein fragment SEQ ID NO: 49858.EP1033405-A2. |
| 259018 (1067 letters) | 5e-53 | >gnl\|Derwent\|AAG23402 349 AA.Arabidopsis thaliana protein fragment SEQ ID NO: 26695.EP1033405-A2. |
| 259028 Contig A (663 letters) | 2e-63 | >gnl\|Derwent\|AAY32114 436 AA.Maize Id protein.WO9951728-A2. |
| 259033 (549 letters) | 8e-10 | >gnl\|Derwent\|AAG50676 299 AA.Arabidopsis thaliana protein fragment SEQ ID NO: 64245.EP1033405-A2. |
| 259045 (719 letters) | 7e-24 | >gnl\|Derwent\|AAB32575 360 AA.Eucalyptus grandis transcription factor protein sequence #33.WO200053724-A2. |
| 262408 (437 letters) | 6e-11 | >gnl\|Derwent\|AAY42374 213 AA.Amino acid sequence of the PetSPL3 protein.EP945509-A2. |
| 262505 (770 letters) | 2e-10 | >gnl\|Derwent\|AAB33127 206 AA.Pinus radiata transcription factor protein sequence #254.WO200053724-A2. |
| 262509 (926 letters) | e-141 | >gnl\|Derwent\|AAG31383 305 AA.Arabidopsis thaliana protein fragment SEQ ID NO: 37679.EP1033405-A2. |
| 262648 Contig A (512 letters) | 1e-16 | >gnl\|Derwent\|AAG50561 662 AA.Arabidopsis thaliana protein fragment SEQ ID NO: 64089.EP1033405-A2. |
| 262648 Contig B (598 letters) | 2e-44 | >gnl\|Derwent\|AAG43913 525 AA.Arabidopsis thaliana protein fragment SEQ ID NO: 54943.EP1033405-A2. |
| 262650 (607 letters) | 7e-84 | >gnl\|Derwent\|AAG44120 251 AA.Arabidopsis thaliana protein fragment SEQ ID NO: 55224.EP1033405-A2. |
| 262658 (656 letters) | 8e-28 | >gnl\|Derwent\|AAW01604 227 AA.Arabidopsis STZ polypeptide.WO9639020-A1. |
| 262715 Contig A (548 letters) | 1e-32 | >gnl\|Derwent\|AAG08011 306 AA.Arabidopsis thaliana protein fragment SEQ ID NO: 5383.EP1033405-A2. |

FIG. 4 continued

| Query Contig ID (length, bp) | Pz Score | Result |
|---|---|---|
| 262715 Contig B (173 letters) | 2e-10 | >gnl\|Derwent\|AAG30735 207 AA.Arabidopsis thaliana protein fragment SEQ ID NO: 36798.EP1033405-A2. |
| 262725 (995 letters) | 2e-42 | >gnl\|Derwent\|AAG11135 299 AA.Arabidopsis thaliana protein fragment SEQ ID NO: 9739.EP1033405-A2. |
| 262762 (1079 letters) | 0.0 | >gnl\|Derwent\|AAG10560 356 AA.Arabidopsis thaliana protein fragment SEQ ID NO: 8931.EP1033405-A2. |
| 262783 (863 letters) | 1e-17 | >gnl\|Derwent\|AAG38761 268 AA.Arabidopsis thaliana protein fragment SEQ ID NO: 47867.EP1033405-A2. |
| 263004 (640 letters) | e-111 | >gnl\|Derwent\|AAG29540 314 AA.Arabidopsis thaliana protein fragment SEQ ID NO: 35166.EP1033405-A2. |
| 263005 (538 letters) | e-100 | >gnl\|Derwent\|AAW13945 177 AA.Arabidopsis terminal flower 1 protein.WO9710339-A1. |
| 263006 (695 letters) | e-125 | >gnl\|Derwent\|AAG29301 274 AA.Arabidopsis thaliana protein fragment SEQ ID NO: 34839.EP1033405-A2. |
| 263009 (450 letters) | 1e-43 | >gnl\|Derwent\|AAG19714 112 AA.Arabidopsis thaliana protein fragment SEQ ID NO: 21619.EP1033405-A2. |
| 263030 (1028 letters) | e-180 | >gnl\|Derwent\|AAG35673 340 AA.Arabidopsis thaliana protein fragment SEQ ID NO: 43614.EP1033405-A2. |
| 263033 (665 letters) | 2e-57 | >gnl\|Derwent\|AAG53103 294 AA.Arabidopsis thaliana protein fragment SEQ ID NO: 67577.EP1033405-A2. |
| 263037 Contig A (376 letters) | 8e-69 | >gnl\|Derwent\|AAG05011 256 AA.Arabidopsis thaliana protein fragment SEQ ID NO: 1254.EP1033405-A2. |
| 263037 Contig B (298 letters) | 7e-41 | >gnl\|Derwent\|AAG05012 184 AA.Arabidopsis thaliana protein fragment SEQ ID NO: 1255.EP1033405-A2. |
| 263050 (641 letters) | 4e-13 | >gnl\|Derwent\|AAB33011 174 AA.Pinus radiata transcription factor protein sequence #138.WO200053724-A2. |
| 263060 Contig B (649 letters) | 2e-57 | >gnl\|Derwent\|AAG34523 345 AA.Arabidopsis thaliana protein fragment SEQ ID NO: 42020.EP1033405-A2. |
| 263070 Contig B (597 letters) | 3e-53 | >gnl\|Derwent\|AAG13277 345 AA.Arabidopsis thaliana protein fragment SEQ ID NO: 12715.EP1033405-A2. |
| 263078 Contig A (255 letters) | 7e-37 | >gnl\|Derwent\|AAG41485 301 AA.Arabidopsis thaliana protein fragment SEQ ID NO: 51620.EP1033405-A2. |
| 263078 Contig B (394 letters) | 9e-69 | >gnl\|Derwent\|AAY82475 216 AA.A. thaliana transcription factor DREB1A SEQ ID NO:2.JP2000060558-A. |
| 263078 Contig C (665 letters) | e-101 | >gnl\|Derwent\|AAG41484 318 AA.Arabidopsis thaliana protein fragment SEQ ID NO: 51619.EP1033405-A2. |
| 263110 (656 letters) | e-119 | >gnl\|Derwent\|AAY82478 216 AA.A. thaliana transcription factor DREB1C SEQ ID NO:8.JP2000060558-A. |
| 263114 Contig A (192 letters) | 2e-27 | >gnl\|Derwent\|AAG30735 207 AA.Arabidopsis thaliana protein fragment SEQ ID NO: 36798.EP1033405-A2. |
| 263114 Contig B (169 letters) | 3e-26 | >gnl\|Derwent\|AAY82478 216 AA.A. thaliana transcription factor DREB1C SEQ ID NO:8.JP2000060558-A. |
| 263125 (773 letters) | e-145 | >gnl\|Derwent\|AAY78884 255 AA.A. thaliana cauliflower (CAL) amino acid sequence.US6025483-A. |
| 263127 (1109 letters) | 0.0 | >gnl\|Derwent\|AAG46455 367 AA.Arabidopsis thaliana protein fragment SEQ ID NO: 58446.EP1033405-A2. |
| 263136 Contig A (508 letters) | 4e-81 | >gnl\|Derwent\|AAG18081 168 AA.Arabidopsis thaliana protein fragment SEQ ID NO: 19347.EP1033405-A2. |

FIG. 4 continued

| Query Contig ID (length, bp) | Pz Score | Result |
|---|---|---|
| 263136 Contig B (165 letters) | 7e-06 | >gnl\|Derwent\|AAG45072 168 AA.Arabidopsis thaliana protein fragment SEQ ID NO: 56538.EP1033405-A2. |
| 263146 (302 letters) | 3e-50 | >gnl\|Derwent\|AAG19714 112 AA.Arabidopsis thaliana protein fragment SEQ ID NO: 21619.EP1033405-A2. |
| 263154 (1015 letters) | 3e-41 | >gnl\|Derwent\|AAB32713 125 AA.Eucalyptus grandis transcription factor protein sequence #171.WO200053724-A2. |
| 263157 (647 letters) | e-111 | >gnl\|Derwent\|AAY82477 213 AA.A. thaliana transcription factor DREB1B SEQ ID NO:6.JP2000060558-A. |
| 263177 (842 letters) | e-129 | >gnl\|Derwent\|AAG27683 282 AA.Arabidopsis thaliana protein fragment SEQ ID NO: 32617.EP1033405-A2. |
| 263180 (976 letters) | e-170 | >gnl\|Derwent\|AAG52567 323 AA.Arabidopsis thaliana protein fragment SEQ ID NO: 66838.EP1033405-A2. |
| 263181 (526 letters) | e-102 | >gnl\|Derwent\|AAG12978 199 AA.Arabidopsis thaliana protein fragment SEQ ID NO: 12300.EP1033405-A2. |
| 263182 (715 letters) | e-116 | >gnl\|Derwent\|AAG36227 298 AA.Arabidopsis thaliana protein fragment SEQ ID NO: 44367.EP1033405-A2. |
| 263184 (627 letters) | e-108 | >gnl\|Derwent\|AAG17603 260 AA.Arabidopsis thaliana protein fragment SEQ ID NO: 18687.EP1033405-A2. |
| 263186 (551 letters) | 3e-91 | >gnl\|Derwent\|AAG52907 181 AA.Arabidopsis thaliana protein fragment SEQ ID NO: 67305.EP1033405-A2. |
| 263187 Contig C (497 letters) | 5e-56 | >gnl\|Derwent\|AAG44280 156 AA.Arabidopsis thaliana protein fragment SEQ ID NO: 55447.EP1033405-A2. |
| 263191 Contig B (458 letters) | 1e-46 | >gnl\|Derwent\|AAG53103 294 AA.Arabidopsis thaliana protein fragment SEQ ID NO: 67577.EP1033405-A2. |
| 263194 (604 letters) | 1e-81 | >gnl\|Derwent\|AAG20371 210 AA.Arabidopsis thaliana protein fragment SEQ ID NO: 22532.EP1033405-A2. |
| 263202 (502 letters) | 6e-68 | >gnl\|Derwent\|AAG27544 165 AA.Arabidopsis thaliana protein fragment SEQ ID NO: 32423.EP1033405-A2. |
| 263216 (761 letters) | e-126 | >gnl\|Derwent\|AAY84909 248 AA.Amino acid sequence of the Arabidopsis AGL2 protein.WO200023578-A2. |
| 263221 (607 letters) | e-109 | >gnl\|Derwent\|AAG53347 201 AA.Arabidopsis thaliana protein fragment SEQ ID NO: 67909.EP1033405-A2. |
| 263224 Contig A (486 letters) | 1e-83 | >gnl\|Derwent\|AAG54870 293 AA.Arabidopsis thaliana protein fragment SEQ ID NO: 70141.EP1033405-A2. |
| 263224 Contig B (378 letters) | 1e-56 | >gnl\|Derwent\|AAG29464 432 AA.Arabidopsis thaliana protein fragment SEQ ID NO: 35063.EP1033405-A2. |
| 263234 (442 letters) | 9e-61 | >gnl\|Derwent\|AAG36227 298 AA.Arabidopsis thaliana protein fragment SEQ ID NO: 44367.EP1033405-A2. |
| 263245 (168 letters) | 3e-20 | >gnl\|Derwent\|AAG14204 200 AA.Arabidopsis thaliana protein fragment SEQ ID NO: 13977.EP1033405-A2. |
| 263246 (745 letters) | e-147 | >gnl\|Derwent\|AAG30441 257 AA.Arabidopsis thaliana protein fragment SEQ ID NO: 36393.EP1033405-A2. |
| 263249 (701 letters) | e-125 | >gnl\|Derwent\|AAG42290 225 AA.Arabidopsis thaliana protein fragment SEQ ID NO: 52724.EP1033405-A2. |
| 263255 (323 letters) | 6e-36 | >gnl\|Derwent\|AAG19662 259 AA.Arabidopsis thaliana protein fragment SEQ ID NO: 21548.EP1033405-A2. |
| 263262 (578 letters) | e-115 | >gnl\|Derwent\|AAG49242 190 AA.Arabidopsis thaliana protein fragment SEQ ID NO: 62274.EP1033405-A2. |
| 263263 Contig A (393 letters) | 3e-75 | >gnl\|Derwent\|AAG19449 218 AA.Arabidopsis thaliana protein fragment SEQ ID NO: 21255.EP1033405-A2. |

FIG. 4 continued

| Query Contig ID (length, bp) | Pz Score | Result |
|---|---|---|
| 263263 Contig B (172 letters) | 3e-22 | >gnl\|Derwent\|AAG19448 132 AA.Arabidopsis thaliana protein fragment SEQ ID NO: 21254.EP1033405-A2. |
| 263276 (709 letters) | e-119 | >gnl\|Derwent\|AAG30615 234 AA.Arabidopsis thaliana protein fragment SEQ ID NO: 36633.EP1033405-A2. |
| 263320 Contig B (148 letters) | 6e-05 | >gnl\|Derwent\|AAG08394 294 AA.Arabidopsis thaliana protein fragment SEQ ID NO: 5912.EP1033405-A2. |
| 263327 Contig A (324 letters) | 5e-15 | >gnl\|Derwent\|AAG41701 194 AA.Arabidopsis thaliana protein fragment SEQ ID NO: 51917.EP1033405-A2. |
| 263327 Contig B (278 letters) | 4e-32 | >gnl\|Derwent\|AAG12978 199 AA.Arabidopsis thaliana protein fragment SEQ ID NO: 12300.EP1033405-A2. |
| 263329 (340 letters) | 1e-60 | >gnl\|Derwent\|AAG27683 282 AA.Arabidopsis thaliana protein fragment SEQ ID NO: 32617.EP1033405-A2. |
| 263342 Contig A (226 letters) | 6e-12 | >gnl\|Derwent\|AAG19662 259 AA.Arabidopsis thaliana protein fragment SEQ ID NO: 21548.EP1033405-A2. |
| 263367 (464 letters) | 1e-64 | >gnl\|Derwent\|AAG20371 210 AA.Arabidopsis thaliana protein fragment SEQ ID NO: 22532.EP1033405-A2. |
| 263393 Contig B (253 letters) | 4e-09 | >gnl\|Derwent\|AAY12014 115 AA.Human 5' EST secreted protein SEQ ID NO: 327.WO9906554-A2. |
| 263514 (559 letters) | 8e-56 | >gnl\|Derwent\|AAG53103 294 AA.Arabidopsis thaliana protein fragment SEQ ID NO: 67577.EP1033405-A2. |
| 263534 (744 letters) | 2e-39 | >gnl\|Derwent\|AAG36348 269 AA.Arabidopsis thaliana protein fragment SEQ ID NO: 44532.EP1033405-A2. |
| 263550 Contig A (481 letters) | 4e-77 | >gnl\|Derwent\|AAG21899 208 AA.Arabidopsis thaliana protein fragment SEQ ID NO: 24625.EP1033405-A2. |
| 263550 Contig B (86 letters) | 1e-05 | >gnl\|Derwent\|AAG21899 208 AA.Arabidopsis thaliana protein fragment SEQ ID NO: 24625.EP1033405-A2. |
| 263557 Contig A (598 letters) | 4e-76 | >gnl\|Derwent\|AAG41486 282 AA.Arabidopsis thaliana protein fragment SEQ ID NO: 51621.EP1033405-A2. |
| 263557 Contig B (342 letters) | 2e-55 | >gnl\|Derwent\|AAG41484 318 AA.Arabidopsis thaliana protein fragment SEQ ID NO: 51619.EP1033405-A2. |
| 263611 Contig A (280 letters) | 7e-47 | >gnl\|Derwent\|AAG22462 148 AA.Arabidopsis thaliana protein fragment SEQ ID NO: 25399.EP1033405-A2. |
| 263611 Contig B (366 letters) | 3e-54 | >gnl\|Derwent\|AAG22460 249 AA.Arabidopsis thaliana protein fragment SEQ ID NO: 25397.EP1033405-A2. |
| 263617 (428 letters) | 1e-31 | >gnl\|Derwent\|AAG18333 221 AA.Arabidopsis thaliana protein fragment SEQ ID NO: 19696.EP1033405-A2. |
| 263633 (824 letters) | 1e-36 | >gnl\|Derwent\|AAG28961 298 AA.Arabidopsis thaliana protein fragment SEQ ID NO: 34375.EP1033405-A2. |
| 263636 Contig A (177 letters) | 8e-11 | >gnl\|Derwent\|AAG37500 159 AA.Arabidopsis thaliana protein fragment SEQ ID NO: 46120.EP1033405-A2. |
| 263679 (998 letters) | e-148 | >gnl\|Derwent\|AAB26756 330 AA.Arabidopsis thaliana bZIP protein encoded by AHBP-1b gene.WO200053741-A1. |
| 263681 (209 letters) | 2e-14 | >gnl\|Derwent\|AAB25835 68 AA.AP2 domain amino acid sequence of Arabidopsis RAP2 protein.US6093874-A. |
| 316712 (315 letters) | 2e-57 | >gnl\|Derwent\|AAG22460 249 AA.Arabidopsis thaliana protein fragment SEQ ID NO: 25397.EP1033405-A2. |
| 316731 (519 letters) | 2e-70 | >gnl\|Derwent\|AAG22460 249 AA.Arabidopsis thaliana protein fragment SEQ ID NO: 25397.EP1033405-A2. |
| 316741 (407 letters) | 7e-62 | >gnl\|Derwent\|AAG49621 268 AA.Arabidopsis thaliana protein fragment SEQ ID NO: 62792.EP1033405-A2. |

FIG. 4 continued

| Query Contig ID (length, bp) | Pz Score | Result |
|---|---|---|
| 316762 (390 letters) | 3e-61 | >gnl\|Derwent\|AAG08167 243 AA.Arabidopsis thaliana protein fragment SEQ ID NO: 5599.EP1033405-A2. |
| 316804 (447 letters) | 1e-63 | >gnl\|Derwent\|AAG35828 452 AA.Arabidopsis thaliana protein fragment SEQ ID NO: 43823.EP1033405-A2. |
| 316820 (105 letters) | 4e-13 | >gnl\|Derwent\|AAG31302 153 AA.Arabidopsis thaliana protein fragment SEQ ID NO: 37569.EP1033405-A2. |
| 316828 (377 letters) | 5e-65 | >gnl\|Derwent\|AAG36520 176 AA.Arabidopsis thaliana protein fragment SEQ ID NO: 44767.EP1033405-A2. |
| 316833 (145 letters) | 2e-16 | >gnl\|Derwent\|AAG49621 268 AA.Arabidopsis thaliana protein fragment SEQ ID NO: 62792.EP1033405-A2. |
| 316834 (637 letters) | e-115 | >gnl\|Derwent\|AAG40124 266 AA.Arabidopsis thaliana protein fragment SEQ ID NO: 49744.EP1033405-A2. |
| 316835 (380 letters) | 2e-61 | >gnl\|Derwent\|AAY82477 213 AA.A. thaliana transcription factor DREB1B SEQ ID NO:6.JP2000060558-A. |
| 316837 (488 letters) | 1e-92 | >gnl\|Derwent\|AAG30054 618 AA.Arabidopsis thaliana protein fragment SEQ ID NO: 35862.EP1033405-A2. |
| 316847 (680 letters) | e-132 | >gnl\|Derwent\|AAG22460 249 AA.Arabidopsis thaliana protein fragment SEQ ID NO: 25397.EP1033405-A2. |
| 316850 (155 letters) | 1e-13 | >gnl\|Derwent\|AAG49621 268 AA.Arabidopsis thaliana protein fragment SEQ ID NO: 62792.EP1033405-A2. |
| 316857 (319 letters) | 1e-60 | >gnl\|Derwent\|AAY77980 374 AA.A. thaliana environmental stress tolerance related protein.WO200008187-A2. |
| 316860 (550 letters) | 4e-29 | >gnl\|Derwent\|AAB57084 355 AA.Human prostate cancer antigen protein sequence SEQ ID NO:1662.WO200055174-A1. |
| 316861 (395 letters) | 1e-60 | >gnl\|Derwent\|AAG49621 268 AA.Arabidopsis thaliana protein fragment SEQ ID NO: 62792.EP1033405-A2. |
| 316883 (639 letters) | e-112 | >gnl\|Derwent\|AAY82477 213 AA.A. thaliana transcription factor DREB1B SEQ ID NO:6.JP2000060558-A. |
| 316886 (665 letters) | 1e-93 | >gnl\|Derwent\|AAG46019 351 AA.Arabidopsis thaliana protein fragment SEQ ID NO: 57849.EP1033405-A2. |
| 316902 (587 letters) | 7e-37 | >gnl\|Derwent\|AAG53808 447 AA.Arabidopsis thaliana protein fragment SEQ ID NO: 68540.EP1033405-A2. |
| 316903 (644 letters) | e-114 | >gnl\|Derwent\|AAG46423 312 AA.Arabidopsis thaliana protein fragment SEQ ID NO: 58403.EP1033405-A2. |
| 316906 (657 letters) | e-114 | >gnl\|Derwent\|AAG10914 248 AA.Arabidopsis thaliana protein fragment SEQ ID NO: 9429.EP1033405-A2. |
| 316924 (630 letters) | 4e-97 | >gnl\|Derwent\|AAG47571 368 AA.Arabidopsis thaliana protein fragment SEQ ID NO: 59974.EP1033405-A2. |
| 316934 (379 letters) | 9e-49 | >gnl\|Derwent\|AAG29401 398 AA.Arabidopsis thaliana protein fragment SEQ ID NO: 34977.EP1033405-A2. |
| 316938 (683 letters) | e-119 | >gnl\|Derwent\|AAY84909 248 AA.Amino acid sequence of the Arabidopsis AGL2 protein.WO200023578-A2. |
| 316941 (654 letters) | e-106 | >gnl\|Derwent\|AAG29476 315 AA.Arabidopsis thaliana protein fragment SEQ ID NO: 35079.EP1033405-A2. |
| 316944 (523 letters) | 4e-40 | >gnl\|Derwent\|AAY84909 248 AA.Amino acid sequence of the Arabidopsis AGL2 protein.WO200023578-A2. |
| 316947 (651 letters) | e-102 | >gnl\|Derwent\|AAG29476 315 AA.Arabidopsis thaliana protein fragment SEQ ID NO: 35079.EP1033405-A2. |

FIG. 4 continued

| Query Contig ID (length, bp) | Pz Score | Result |
|---|---|---|
| 316970 (637 letters) | 3e-33 | >gnl\|Derwent\|AAB33237 98 AA.Eucalyptus grandis transcription factor protein sequence #394.WO200053724-A2. |
| 316974 (639 letters) | e-109 | >gnl\|Derwent\|AAG29742 252 AA.Arabidopsis thaliana protein fragment SEQ ID NO: 35439.EP1033405-A2. |
| 316976 (686 letters) | 2e-68 | >gnl\|Derwent\|AAG34523 345 AA.Arabidopsis thaliana protein fragment SEQ ID NO: 42020.EP1033405-A2. |
| 316984 (574 letters) | 4e-97 | >gnl\|Derwent\|AAG53807 448 AA.Arabidopsis thaliana protein fragment SEQ ID NO: 68539.EP1033405-A2. |
| 316996 (537 letters) | 3e-96 | >gnl\|Derwent\|AAG30517 258 AA.Arabidopsis thaliana protein fragment SEQ ID NO: 36499.EP1033405-A2. |
| 317014 (374 letters) | 1e-57 | >gnl\|Derwent\|AAG31380 555 AA.Arabidopsis thaliana protein fragment SEQ ID NO: 37675.EP1033405-A2. |
| 317021 (227 letters) | 3e-29 | >gnl\|Derwent\|AAG27216 118 AA.Zea mays protein fragment SEQ ID NO: 31967.EP1033405-A2. |
| 317069 (330 letters) | 1e-35 | >gnl\|Derwent\|AAY84909 248 AA.Amino acid sequence of the Arabidopsis AGL2 protein.WO200023578-A2. |
| 317079 (567 letters) | 6e-61 | >gnl\|Derwent\|AAB33024 331 AA.Pinus radiata transcription factor protein sequence #151.WO200053724-A2. |
| 43445 Contig A (631 letters) | 3e-31 | >gnl\|Derwent\|AAG49271 163 AA.Arabidopsis thaliana protein fragment SEQ ID NO: 62314.EP1033405-A2. |
| 43445 Contig B (163 letters) | 8e-09 | >gnl\|Derwent\|AAG46757 240 AA.Arabidopsis thaliana protein fragment SEQ ID NO: 58859.EP1033405-A2. |
| 48423 (623 letters) | 3e-07 | >gnl\|Derwent\|AAB21007 428 AA.Human nucleic acid-binding protein, NuABP-11.WO200044900-A2. |
| 49059 (403 letters) | 4e-24 | >gnl\|Derwent\|AAW70562 634 AA.A human chronic renal failure gene-1a (CRFG-1a).EP875572-A2. |
| 49145 (374 letters) | 3e-46 | >gnl\|Derwent\|AAR91932 561 AA.Phosphatidylinositol-4,5-diphosphate specific phospholipase C.JP08084585-A. |
| 49360 (420 letters) | 2e-28 | >gnl\|Derwent\|AAG14378 361 AA.Arabidopsis thaliana protein fragment SEQ ID NO: 14217.EP1033405-A2. |
| 57145 (267 letters) | 1e-21 | >gnl\|Derwent\|AAG39581 355 AA.Arabidopsis thaliana protein fragment SEQ ID NO: 48997.EP1033405-A2. |
| 57165 (619 letters) | 2e-66 | >gnl\|Derwent\|AAG09881 303 AA.Arabidopsis thaliana protein fragment SEQ ID NO: 7985.EP1033405-A2. |
| 57292 (367 letters) | 9e-49 | >gnl\|Derwent\|AAW48621 245 AA.Pinus radiata cone-specific PrMADS1 protein.WO9813503-A1. |
| 57319 (576 letters) | 1e-07 | >gnl\|Derwent\|AAG43627 1612 AA.Arabidopsis thaliana protein fragment SEQ ID NO: 54552.EP1033405-A2. |
| 57374 Contig A (645 letters) | 8e-26 | >gnl\|Derwent\|AAG40439 494 AA.Arabidopsis thaliana protein fragment SEQ ID NO: 50176.EP1033405-A2. |
| 57506 (661 letters) | 4e-17 | >gnl\|Derwent\|AAG42360 356 AA.Arabidopsis thaliana protein fragment SEQ ID NO: 52821.EP1033405-A2. |
| 103896 (509 letters) | 7e-55 | >gnl\|Derwent\|AAG49265 332 AA.Arabidopsis thaliana protein fragment SEQ ID NO: 62306.EP1033405-A2. |
| 108274 (533 letters) | 6e-18 | >gnl\|Derwent\|AAB80018 284 AA.Corynebacterium glutamicum MP protein sequence SEQ ID NO:770.WO200100843-A2. |
| 108496 (631 letters) | 4e-59 | >gnl\|Derwent\|AAR41347 295 AA.Nastertium xyloglucanase.WO9317101-A. |

FIG. 4 continued

| Query Contig ID (length, bp) | Pz Score | Result |
|---|---|---|
| 109562 (575 letters) | 7e-71 | >gnl\|Derwent\|AAG31359 735 AA.Arabidopsis thaliana protein fragment SEQ ID NO: 37646.EP1033405-A2. |
| 111048 (583 letters) | 2e-60 | >gnl\|Derwent\|AAG39774 420 AA.Arabidopsis thaliana protein fragment SEQ ID NO: 49264.EP1033405-A2. |
| 113072 (649 letters) | 4e-55 | >gnl\|Derwent\|AAG45706 202 AA.Arabidopsis thaliana protein fragment SEQ ID NO: 57416.EP1033405-A2. |
| 120624 (345 letters) | 2e-39 | >gnl\|Derwent\|AAY51874 621 AA.A. thaliana ACW1 protein.JP2000041685-A. |
| 20072 (310 letters) | 3e-22 | >gnl\|Derwent\|AAG12116 61 AA.Arabidopsis thaliana protein fragment SEQ ID NO: 11103.EP1033405-A2. |
| 43449 Contig A (626 letters) | 6e-11 | >gnl\|Derwent\|AAG53096 584 AA.Arabidopsis thaliana protein fragment SEQ ID NO: 67567.EP1033405-A2. |
| 44526 (881 letters) | 1e-41 | >gnl\|Derwent\|AAG59912 214 AA.Arabidopsis thaliana protein fragment SEQ ID NO: 77549.EP1033405-A2. |
| 52817 (630 letters) | 3e-80 | >gnl\|Derwent\|AAG12178 148 AA.Arabidopsis thaliana protein fragment SEQ ID NO: 11189.EP1033405-A2. |
| 53376 (895 letters) | e-137 | >gnl\|Derwent\|AAG07532 270 AA.Arabidopsis thaliana protein fragment SEQ ID NO: 4723.EP1033405-A2. |
| 57142 Contig B (608 letters) | 2e-94 | >gnl\|Derwent\|AAG07493 344 AA.Arabidopsis thaliana protein fragment SEQ ID NO: 4668.EP1033405-A2. |
| 57744 (504 letters) | 5e-65 | >gnl\|Derwent\|AAG48610 210 AA.Arabidopsis thaliana protein fragment SEQ ID NO: 61405.EP1033405-A2. |

FIG. 4 continued

| Query Contig ID (length, bp) | Pz Score | Result |
|---|---|---|
| 103535 (665 letters) | 4e-24 | >gnl\|Derwent\|AAC39856 1108 BP.Arabidopsis thaliana DNA fragment SEQ ID NO: 26155.EP1033405-A2. |
| 103541 (667 letters) | 2e-13 | >gnl\|Derwent\|AAZ33693 254 BP.Tobacco plant resistance-associated cDNA fragment 18.DE19813048-A1. |
| 103718 (567 letters) | 2e-07 | >gnl\|Derwent\|AAT35095 660 BP.Up-regulated senescence clone, SENU1.WO9507993-A1. |
| 103752 (571 letters) | 4e-42 | >gnl\|Derwent\|AAC51390 1579 BP.Arabidopsis thaliana DNA fragment SEQ ID NO: 68345.EP1033405-A2. |
| 104065 (636 letters) | 2e-10 | >gnl\|Derwent\|AAZ51053 4221 BP.Arabidopsis thaliana early-flowering protein, ELF3 genomic DNA.WO200009658-A2. |
| 104067 (608 letters) | 2e-25 | >gnl\|Derwent\|AAC49556 1198 BP.Arabidopsis thaliana DNA fragment SEQ ID NO: 61595.EP1033405-A2. |
| 104254 (654 letters) | 9e-65 | >gnl\|Derwent\|AAC51198 714 BP.Arabidopsis thaliana DNA fragment SEQ ID NO: 67629.EP1033405-A2. |
| 104765 (598 letters) | 3e-06 | >gnl\|Derwent\|AAC39354 1146 BP.Arabidopsis thaliana DNA fragment SEQ ID NO: 24326.EP1033405-A2. |
| 104768 (667 letters) | 3e-09 | >gnl\|Derwent\|AAC42542 1704 BP.Arabidopsis thaliana DNA fragment SEQ ID NO: 35949.EP1033405-A2. |
| 105019 (628 letters) | 5e-14 | >gnl\|Derwent\|AAC39538 1182 BP.Arabidopsis thaliana DNA fragment SEQ ID NO: 25000.EP1033405-A2. |
| 105143 (553 letters) | 4e-20 | >gnl\|Derwent\|AAC44284 717 BP.Arabidopsis thaliana DNA fragment SEQ ID NO: 42297.EP1033405-A2. |
| 105154 (501 letters) | 1e-04 | >gnl\|Derwent\|AAC44888 1083 BP.Arabidopsis thaliana DNA fragment SEQ ID NO: 44507.EP1033405-A2. |
| 105271 (610 letters) | 6e-04 | >gnl\|Derwent\|AAC48165 1456 BP.Arabidopsis thaliana DNA fragment SEQ ID NO: 56496.EP1033405-A2. |
| 105272 (629 letters) | 3e-89 | >gnl\|Derwent\|AAC51277 1551 BP.Arabidopsis thaliana DNA fragment SEQ ID NO: 67925.EP1033405-A2. |
| 105377 (610 letters) | 2e-87 | >gnl\|Derwent\|AAC38843 1225 BP.Arabidopsis thaliana DNA fragment SEQ ID NO: 22434.EP1033405-A2. |
| 105405 (652 letters) | 5e-94 | >gnl\|Derwent\|AAC43755 1716 BP.Zea mays DNA fragment SEQ ID NO: 40391.EP1033405-A2. |
| 107421 (465 letters) | 5e-13 | >gnl\|Derwent\|AAC44551 1348 BP.Zea mays DNA fragment SEQ ID NO: 43250.EP1033405-A2. |
| 107594 (669 letters) | e-110 | >gnl\|Derwent\|AAC45379 1438 BP.Arabidopsis thaliana DNA fragment SEQ ID NO: 46291.EP1033405-A2. |
| 108358 (634 letters) | 4e-05 | >gnl\|Derwent\|AAA31921 455 BP.Plant microsatellite marker #882.WO9967421-A1. |
| 109329 (566 letters) | 3e-33 | >gnl\|Derwent\|AAC49200 579 BP.Arabidopsis thaliana DNA fragment SEQ ID NO: 60297.EP1033405-A2. |
| 109420 (633 letters) | 2e-93 | >gnl\|Derwent\|AAC49247 1530 BP.Arabidopsis thaliana DNA fragment SEQ ID NO: 60467.EP1033405-A2. |
| 109513 (562 letters) | 1e-97 | >gnl\|Derwent\|AAC40030 566 BP.Arabidopsis thaliana DNA fragment SEQ ID NO: 26789.EP1033405-A2. |
| 109523 (590 letters) | 5e-60 | >gnl\|Derwent\|AAT86242 1593 BP.cDNA for birch pollen co-factor-independent phosphoglycerate mutase.WO9705258-A2. |
| 110965 (504 letters) | 4e-20 | >gnl\|Derwent\|AAC51887 959 BP.Arabidopsis thaliana DNA fragment SEQ ID NO: 69952.EP1033405-A2. |

FIG. 5

| Query Contig ID (length, bp) | Pz Score | Result |
|---|---|---|
| 111075 (526 letters) | 1e-07 | >gnl\|Derwent\|AAC37293 719 BP.Arabidopsis thaliana DNA fragment SEQ ID NO: 16862.EP1033405-A2. |
| 11175 (620 letters) | 3e-27 | >gnl\|Derwent\|AAC50529 1605 BP.Arabidopsis thaliana DNA fragment SEQ ID NO: 65183.EP1033405-A2. |
| 111223 (610 letters) | 3e-64 | >gnl\|Derwent\|AAC33178 1361 BP.Arabidopsis thaliana DNA fragment SEQ ID NO: 2074.EP1033405-A2. |
| 111277 (539 letters) | 6e-07 | >gnl\|Derwent\|AAC47224 1263 BP.Arabidopsis thaliana DNA fragment SEQ ID NO: 53019.EP1033405-A2. |
| 111358 (559 letters) | 1e-57 | >gnl\|Derwent\|AAC32794 706 BP.Arabidopsis thaliana DNA fragment SEQ ID NO: 671.EP1033405-A2. |
| 111437 (623 letters) | 3e-27 | >gnl\|Derwent\|AAC44045 1701 BP.Zea mays DNA fragment SEQ ID NO: 41417.EP1033405-A2. |
| 111469 (516 letters) | 3e-05 | >gnl\|Derwent\|AAC49876 1964 BP.Arabidopsis thaliana DNA fragment SEQ ID NO: 62772.EP1033405-A2. |
| 113170 (644 letters) | e-110 | >gnl\|Derwent\|AAF85228 382 BP.Nucleotide sequence of a tomato cyclophilin protein.US6204373-B1. |
| 113595 (596 letters) | 8e-28 | >gnl\|Derwent\|AAC52095 727 BP.Arabidopsis thaliana DNA fragment SEQ ID NO: 70368.EP1033405-A2. |
| 114370 (596 letters) | 2e-65 | >gnl\|Derwent\|AAC38693 675 BP.Arabidopsis thaliana DNA fragment SEQ ID NO: 21898.EP1033405-A2. |
| 114380 (614 letters) | 1e-48 | >gnl\|Derwent\|AAC48953 1836 BP.Arabidopsis thaliana DNA fragment SEQ ID NO: 59383.EP1033405-A2. |
| 114404 (624 letters) | 1e-14 | >gnl\|Derwent\|AAC51451 1493 BP.Arabidopsis thaliana DNA fragment SEQ ID NO: 68570.EP1033405-A2. |
| 120342 (637 letters) | 1e-05 | >gnl\|Derwent\|AAC50029 1491 BP.Arabidopsis thaliana DNA fragment SEQ ID NO: 63328.EP1033405-A2. |
| 17661 Contig A (860 letters) | 0.0 | >gnl\|Derwent\|AAC54760 1346 BP.Arabidopsis thaliana DNA fragment SEQ ID NO: 78990.EP1033405-A2. |
| 17661 Contig B (350 letters) | 0.0 | >gnl\|Derwent\|AAC34270 1240 BP.Arabidopsis thaliana DNA fragment SEQ ID NO: 6052.EP1033405-A2. |
| 17884 Contig B (715 letters) | 8e-07 | >gnl\|Derwent\|AAA31930 384 BP.Plant microsatellite marker #891.WO9967421-A1. |
| 23558 (744 letters) | 0.0 | >gnl\|Derwent\|AAC53550 759 BP.Arabidopsis thaliana DNA fragment SEQ ID NO: 74897.EP1033405-A2. |
| 23777 (559 letters) | 0.0 | >gnl\|Derwent\|AAC40282 1287 BP.Arabidopsis thaliana DNA fragment SEQ ID NO: 27744.EP1033405-A2. |
| 25975 (450 letters) | e-173 | >gnl\|Derwent\|AAC32755 877 BP.Arabidopsis thaliana DNA fragment SEQ ID NO: 528.EP1033405-A2. |
| 26650 (510 letters) | 0.0 | >gnl\|Derwent\|AAC45451 534 BP.Arabidopsis thaliana DNA fragment SEQ ID NO: 46548.EP1033405-A2. |
| 2696 (884 letters) | 0.0 | >gnl\|Derwent\|AAV59041 2404 BP.A. thaliana ethylene response gene Q8 cDNA sequence.US5824868-A. |
| 27245 (895 letters) | 0.0 | >gnl\|Derwent\|AAC36342 1889 BP.Arabidopsis thaliana DNA fragment SEQ ID NO: 13448.EP1033405-A2. |
| 27507 (1164 letters) | 5e-09 | >gnl\|Derwent\|AAA68195 1522 BP.Pinus radiata peroxidase nucleotide sequence SEQ ID NO:371.WO200022099-A1. |
| 30367 (752 letters) | 0.0 | >gnl\|Derwent\|AAC42182 2158 BP.Arabidopsis thaliana DNA fragment SEQ ID NO: 34593.EP1033405-A2. |

FIG. 5 continued

| Query Contig ID (length, bp) | Pz Score | Result |
|---|---|---|
| 30518 (812 letters) | 0.0 | >gnl\|Derwent\|AAD06655 818 BP.A. thaliana transcription factor G43 homolog, G46 cDNA.WO200135725-A1. |
| 30548 (415 letters) | e-131 | >gnl\|Derwent\|AAD05668 1470 BP.Arabidopsis thaliana ABA (abscisic acid)-insensitive 2, abi2 mutant cDNA.WO200136596-A2. |
| 3442 (667 letters) | 0.0 | >gnl\|Derwent\|AAC47174 1202 BP.Arabidopsis thaliana DNA fragment SEQ ID NO: 52830.EP1033405-A2. |
| 35605 (529 letters) | e-133 | >gnl\|Derwent\|AAC44613 1552 BP.Arabidopsis thaliana DNA fragment SEQ ID NO: 43471.EP1033405-A2. |
| 36009 Contig A (773 letters) | e-116 | >gnl\|Derwent\|AAC47483 512 BP.Arabidopsis thaliana DNA fragment SEQ ID NO: 53987.EP1033405-A2. |
| 36009 Contig B (746 letters) | 0.0 | >gnl\|Derwent\|AAA81650 591 BP.N. meningitidis partial DNA sequence gnm_197 SEQ ID NO:197.WO200022430-A2. |
| 36204 (341 letters) | 0.0 | >gnl\|Derwent\|AAC45029 2090 BP.Arabidopsis thaliana DNA fragment SEQ ID NO: 45033.EP1033405-A2. |
| 36934 (738 letters) | 0.0 | >gnl\|Derwent\|AAC37590 746 BP.Arabidopsis thaliana DNA fragment SEQ ID NO: 17942.EP1033405-A2. |
| 37131 (330 letters) | 0.0 | >gnl\|Derwent\|AAC44816 790 BP.Arabidopsis thaliana DNA fragment SEQ ID NO: 44240.EP1033405-A2. |
| 38707 (705 letters) | 0.0 | >gnl\|Derwent\|AAA78623 838 BP.Plant SDF polynucleotide sequence SEQ List 2 NO:141.WO200040695-A2. |
| 39086 (1058 letters) | 0.0 | >gnl\|Derwent\|AAC40521 1280 BP.Arabidopsis thaliana DNA fragment SEQ ID NO: 28607.EP1033405-A2. |
| 42037 (180 letters) | 4e-61 | >gnl\|Derwent\|AAQ92327 1442 BP.Chloroplast transit peptide, tyrosinase activator protein andtyrosinase gene fusion.WO9513386-A. |
| 43460 Contig A (636 letters) | 3e-18 | >gnl\|Derwent\|AAC43227 558 BP.Arabidopsis thaliana DNA fragment SEQ ID NO: 38493.EP1033405-A2. |
| 44067 Contig A (569 letters) | 6e-07 | >gnl\|Derwent\|AAC50653 1149 BP.Arabidopsis thaliana DNA fragment SEQ ID NO: 65640.EP1033405-A2. |
| 44139 Contig A (327 letters) | 2e-08 | >gnl\|Derwent\|AAC44540 1626 BP.Zea mays DNA fragment SEQ ID NO: 43207.EP1033405-A2. |
| 44146 Contig B (339 letters) | 5e-40 | >gnl\|Derwent\|AAV81604 529 BP.SAR8.2a protein encoding cDNA sequence.US5847258-A. |
| 44189 (587 letters) | e-107 | >gnl\|Derwent\|AAT35108 540 BP.Down-regulated senescence clone, SEND34.WO9507993-A1. |
| 44558 Contig A (545 letters) | 4e-08 | >gnl\|Derwent\|AAC39603 1071 BP.Arabidopsis thaliana DNA fragment SEQ ID NO: 25239.EP1033405-A2. |
| 4743 (578 letters) | 0.0 | >gnl\|Derwent\|AAC36578 1261 BP.Arabidopsis thaliana DNA fragment SEQ ID NO: 14317.EP1033405-A2. |
| 4837 Contig A (349 letters) | 0.0 | >gnl\|Derwent\|AAZ98353 831 BP.A. thaliana gene involved in environmental stress tolerance.WO200008187-A2. |

FIG. 5 continued

| Query Contig ID (length, bp) | Pz Score | Result |
|---|---|---|
| 4837 Contig B (1298 letters) | 0.0 | >gnl\|Derwent\|AAC50616 786 BP.Arabidopsis thaliana DNA fragment SEQ ID NO: 65501.EP1033405-A2. |
| 48458 Contig B (614 letters) | 4e-05 | >gnl\|Derwent\|AAC51265 1786 BP.Arabidopsis thaliana DNA fragment SEQ ID NO: 67881.EP1033405-A2. |
| 4845 Contig A (214 letters) | e-118 | >gnl\|Derwent\|AAC51997 867 BP.Arabidopsis thaliana DNA fragment SEQ ID NO: 70172.EP1033405-A2. |
| 4845 Contig B (621 letters) | 0.0 | >gnl\|Derwent\|AAC51543 726 BP.Arabidopsis thaliana DNA fragment SEQ ID NO: 68901.EP1033405-A2. |
| 48602 (608 letters) | 3e-64 | >gnl\|Derwent\|AAA64177 1349 BP.Nucleotide sequence of a lysophosphatidic acid acetyltransferase.WO200049156-A2. |
| 51719 (1081 letters) | 0.0 | >gnl\|Derwent\|AAC44659 1840 BP.Arabidopsis thaliana DNA fragment SEQ ID NO: 43643.EP1033405-A2. |
| 51843 Contig A (739 letters) | e-112 | >gnl\|Derwent\|AAC51291 1470 BP.Arabidopsis thaliana DNA fragment SEQ ID NO: 67973.EP1033405-A2. |
| 51843 Contig B (753 letters) | e-116 | >gnl\|Derwent\|AAC51291 1470 BP.Arabidopsis thaliana DNA fragment SEQ ID NO: 67973.EP1033405-A2. |
| 52689 (562 letters) | 0.0 | >gnl\|Derwent\|AAC37046 484 BP.Arabidopsis thaliana DNA fragment SEQ ID NO: 15986.EP1033405-A2. |
| 53369 (476 letters) | e-126 | >gnl\|Derwent\|AAC50049 1425 BP.Arabidopsis thaliana DNA fragment SEQ ID NO: 63401.EP1033405-A2. |
| 53564 (802 letters) | 0.0 | >gnl\|Derwent\|AAD06482 890 BP.Arabidopsis thaliana transcription factor G545 cDNA.WO200135726-A1. |
| 57119 (507 letters) | 6e-19 | >gnl\|Derwent\|AAC34797 664 BP.Arabidopsis thaliana DNA fragment SEQ ID NO: 7922.EP1033405-A2. |
| 57135 (634 letters) | 4e-70 | >gnl\|Derwent\|AAA52775 1869 BP.Soybean putative catabolite repression protein SNF1 coding sequence #5.WO200036115-A2. |
| 57152 (632 letters) | 0.0 | >gnl\|Derwent\|AAZ44247 1333 BP.Tobacco FNR DNA.EP967211-A1. |
| 57194 (640 letters) | 9e-31 | >gnl\|Derwent\|AAC34315 646 BP.Arabidopsis thaliana DNA fragment SEQ ID NO: 6211.EP1033405-A2. |
| 57510 (541 letters) | 2e-56 | >gnl\|Derwent\|AAC56000 766 BP.Eucalyptus grandis transcription factor DNA sequence #131.WO200053724-A2. |
| 57702 Contig A (363 letters) | 2e-06 | >gnl\|Derwent\|AAC46436 1131 BP.Arabidopsis thaliana DNA fragment SEQ ID NO: 50132.EP1033405-A2. |
| 57702 Contig B (199 letters) | 2e-04 | >gnl\|Derwent\|AAC46436 1131 BP.Arabidopsis thaliana DNA fragment SEQ ID NO: 50132.EP1033405-A2. |
| 57708 (468 letters) | 4e-23 | >gnl\|Derwent\|AAC47514 645 BP.Arabidopsis thaliana DNA fragment SEQ ID NO: 54099.EP1033405-A2. |
| 6025 (641 letters) | 0.0 | >gnl\|Derwent\|AAC42635 614 BP.Arabidopsis thaliana DNA fragment SEQ ID NO: 36290.EP1033405-A2. |
| 6153 (809 letters) | 0.0 | >gnl\|Derwent\|AAC47515 1013 BP.Arabidopsis thaliana DNA fragment SEQ ID NO: 54103.EP1033405-A2. |

FIG. 5 continued

| Query Contig ID (length, bp) | Pz Score | Result |
|---|---|---|
| 6198 (638 letters) | 1e-08 | >gnl\|Derwent\|AAC45168 577 BP.Arabidopsis thaliana DNA fragment SEQ ID NO: 45542.EP1033405-A2. |
| 6437 (1160 letters) | 6e-15 | >gnl\|Derwent\|AAC44427 455 BP.Arabidopsis thaliana DNA fragment SEQ ID NO: 42789.EP1033405-A2. |
| 6477 (750 letters) | 0.0 | >gnl\|Derwent\|AAC45130 1372 BP.Arabidopsis thaliana DNA fragment SEQ ID NO: 45402.EP1033405-A2. |
| 6606 (1013 letters) | 0.0 | >gnl\|Derwent\|AAC41152 945 BP.Arabidopsis thaliana DNA fragment SEQ ID NO: 30843.EP1033405-A2. |
| 6681 (607 letters) | 0.0 | >gnl\|Derwent\|AAC33064 647 BP.Arabidopsis thaliana DNA fragment SEQ ID NO: 1652.EP1033405-A2. |
| 6682 (1120 letters) | 0.0 | >gnl\|Derwent\|AAC38651 1161 BP.Arabidopsis thaliana DNA fragment SEQ ID NO: 21751.EP1033405-A2. |
| 6686 (909 letters) | 0.0 | >gnl\|Derwent\|AAC51041 1161 BP.Arabidopsis thaliana DNA fragment SEQ ID NO: 67053.EP1033405-A2. |
| 6717 (722 letters) | 0.0 | >gnl\|Derwent\|AAA78527 726 BP.Plant SDF polynucleotide sequence SEQ List 1 NO:323.WO200040695-A2. |
| 7393 (695 letters) | 0.0 | >gnl\|Derwent\|AAC39797 601 BP.Arabidopsis thaliana DNA fragment SEQ ID NO: 25942.EP1033405-A2. |
| 104081 (639 letters) | 2e-31 | >gnl\|Derwent\|AAC42314 1317 BP.Arabidopsis thaliana DNA fragment SEQ ID NO: 35082.EP1033405-A2. |
| 105187 Contig A (597 letters) | 2e-56 | >gnl\|Derwent\|AAC42684 777 BP.Arabidopsis thaliana DNA fragment SEQ ID NO: 36471.EP1033405-A2. |
| 107101 (587 letters) | 2e-22 | >gnl\|Derwent\|AAC38516 1504 BP.Arabidopsis thaliana DNA fragment SEQ ID NO: 21252.EP1033405-A2. |
| 107642 (524 letters) | 1e-26 | >gnl\|Derwent\|AAC34228 1209 BP.Arabidopsis thaliana DNA fragment SEQ ID NO: 5911.EP1033405-A2. |
| 109024 (626 letters) | 0.0 | >gnl\|Derwent\|AAZ95382 2479 BP.Tobacco ethylene insensitive 3-like protein encoding cDNA SEQ ID NO:1.WO200009712-A1. |
| 109138 (571 letters) | 6e-04 | >gnl\|Derwent\|AAA55966 21636 BP.Human G713 3'-end of intron 2, exon 3 and 3'-regulatory region.WO200022122-A2. |
| 109146 (619 letters) | e-124 | >gnl\|Derwent\|AAC38804 914 BP.Arabidopsis thaliana DNA fragment SEQ ID NO: 22290.EP1033405-A2. |
| 109369 (623 letters) | 1e-05 | >gnl\|Derwent\|AAC57122 384 BP.Pinus radiata transcription factor DNA sequence #568.WO200053724-A2. |
| 111139 (276 letters) | 7e-11 | >gnl\|Derwent\|AAC57239 375 BP.Pinus radiata transcription factor DNA sequence #636.WO200053724-A2. |
| 111230 (652 letters) | 1e-11 | >gnl\|Derwent\|AAZ23496 806 BP.B. rapa CBF homologous DNA brCBF3.WO9938977-A2. |
| 112381 (658 letters) | 3e-18 | >gnl\|Derwent\|AAC42419 791 BP.Arabidopsis thaliana DNA fragment SEQ ID NO: 35484.EP1033405-A2. |
| 112417 (638 letters) | 4e-05 | >gnl\|Derwent\|AAC47388 1064 BP.Arabidopsis thaliana DNA fragment SEQ ID NO: 53629.EP1033405-A2. |
| 113024 (628 letters) | 2e-47 | >gnl\|Derwent\|AAA27457 905 BP.Veronia mespilifolia LEC1 coding sequence.WO200028058-A2. |
| 113124 (658 letters) | 7e-10 | >gnl\|Derwent\|AAC56807 524 BP.Eucalyptus grandis transcription factor DNA sequence #678.WO200053724-A2. |

FIG. 5 continued

| Query Contig ID (length, bp) | Pz Score | Result |
|---|---|---|
| 113742 (628 letters) | 3e-09 | >gnl\|Derwent\|AAC47260 1437 BP.Arabidopsis thaliana DNA fragment SEQ ID NO: 53159.EP1033405-A2. |
| 114161 (635 letters) | 2e-04 | >gnl\|Derwent\|AAC36279 1234 BP.Arabidopsis thaliana DNA fragment SEQ ID NO: 13208.EP1033405-A2. |
| 114865 (706 letters) | 1e-14 | >gnl\|Derwent\|AAC57127 527 BP.Pinus radiata transcription factor DNA sequence #573.WO200053724-A2. |
| 114926 (558 letters) | 6e-13 | >gnl\|Derwent\|AAT38769 1853 BP.Flax susceptible reaction Fis1 structural gene.WO9634949-A1. |
| 116435 (239 letters) | 1e-09 | >gnl\|Derwent\|AAC44792 744 BP.Zea mays DNA fragment SEQ ID NO: 44148.EP1033405-A2. |
| 116461 (947 letters) | e-165 | >gnl\|Derwent\|AAC47752 977 BP.Zea mays DNA fragment SEQ ID NO: 54986.EP1033405-A2. |
| 116525 (583 letters) | 1e-17 | >gnl\|Derwent\|AAQ80918 326 BP.Spruce tree psaD cDNA, (damage-associated).DE4225561-A. |
| 116692 (532 letters) | 6e-07 | >gnl\|Derwent\|AAC56196 448 BP.Eucalyptus grandis transcription factor DNA sequence #327.WO200053724-A2. |
| 116784 (631 letters) | 2e-07 | >gnl\|Derwent\|AAC51010 1336 BP.Arabidopsis thaliana DNA fragment SEQ ID NO: 66940.EP1033405-A2. |
| 119262 (881 letters) | 6e-76 | >gnl\|Derwent\|AAQ49050 1972 BP.Fungus-responsive potato gene prp-1.WO9319188-A. |
| 119350 (1100 letters) | 1e-21 | >gnl\|Derwent\|AAC41071 1387 BP.Arabidopsis thaliana DNA fragment SEQ ID NO: 30543.EP1033405-A2. |
| 120147 (616 letters) | 4e-11 | >gnl\|Derwent\|AAC36461 822 BP.Arabidopsis thaliana DNA fragment SEQ ID NO: 13892.EP1033405-A2. |
| 120246 (557 letters) | 2e-12 | >gnl\|Derwent\|AAC38427 638 BP.Arabidopsis thaliana DNA fragment SEQ ID NO: 20930.EP1033405-A2. |
| 120859 (568 letters) | 4e-51 | >gnl\|Derwent\|AAV48147 1660 BP.Nicotianamine aminotransferase 49564.15 molecular weight protein, gene.EP860499-A2. |
| 120870 (661 letters) | 6e-26 | >gnl\|Derwent\|AAC34462 780 BP.Arabidopsis thaliana DNA fragment SEQ ID NO: 6732.EP1033405-A2. |
| 120925 (657 letters) | 0.0 | >gnl\|Derwent\|AAC44737 1481 BP.Zea mays DNA fragment SEQ ID NO: 43945.EP1033405-A2. |
| 120933 (703 letters) | 8e-90 | >gnl\|Derwent\|AAC43697 1459 BP.Zea mays DNA fragment SEQ ID NO: 40173.EP1033405-A2. |
| 120952 (625 letters) | 7e-90 | >gnl\|Derwent\|AAC46522 868 BP.Zea mays DNA fragment SEQ ID NO: 50448.EP1033405-A2. |
| 120979 (585 letters) | 2e-04 | >gnl\|Derwent\|AAV28676 785 BP.Ripening banana pulp cDNA clone U-U70 SEQ ID NO:34.WO9811228-A2. |
| 121144 (354 letters) | 3e-60 | >gnl\|Derwent\|AAZ21194 806 BP.Zea mays pathogenesis-related class I PR-1#93 gene.WO9943819-A1. |
| 121146 (561 letters) | 6e-04 | >gnl\|Derwent\|AAT33007 10266 BP.Mouse SRY-related gene.JP08154685-A. |
| 122182 (575 letters) | 6e-04 | >gnl\|Derwent\|AAF15141 539 BP.Trichoderma reesei EST SEQ ID NO:7664.WO200056762-A2. |
| 126157 (580 letters) | e-107 | >gnl\|Derwent\|AAT35108 540 BP.Down-regulated senescence clone, SEND34.WO9507993-A1. |
| 126168 (448 letters) | 2e-06 | >gnl\|Derwent\|AAD03027 4305 BP.Flax 16.0 kDa oleosin protein DNA.WO200116340-A1. |
| 126335 (641 letters) | 3e-80 | >gnl\|Derwent\|AAZ33871 412 BP.Tobacco plant resistance-associated cDNA fragment 196.DE19813048-A1. |

FIG. 5 continued

| Query Contig ID (length, bp) | Pz Score | Result |
|---|---|---|
| 126374 (493 letters) | 2e-15 | >gnl\|Derwent\|AAD01352 1934 BP.Soybean sphingolipid desaturase cDNA #2.WO200032790-A2. |
| 126375 (600 letters) | e-122 | >gnl\|Derwent\|AAT35107 574 BP.Down-regulated senescence clone, SEND33.WO9507993-A1. |
| 126611 (719 letters) | 2e-47 | >gnl\|Derwent\|AAZ33693 254 BP.Tobacco plant resistance-associated cDNA fragment 18.DE19813048-A1. |
| 126840 (613 letters) | 4e-36 | >gnl\|Derwent\|AAC49103 880 BP.Arabidopsis thaliana DNA fragment SEQ ID NO: 59936.EP1033405-A2. |
| 127269 (668 letters) | e-103 | >gnl\|Derwent\|AAC49247 1530 BP.Arabidopsis thaliana DNA fragment SEQ ID NO: 60467.EP1033405-A2. |
| 127645 (652 letters) | 7e-13 | >gnl\|Derwent\|AAC51857 486 BP.Arabidopsis thaliana DNA fragment SEQ ID NO: 69892.EP1033405-A2. |
| 127679 (652 letters) | 3e-06 | >gnl\|Derwent\|AAC34839 1488 BP.Arabidopsis thaliana DNA fragment SEQ ID NO: 8073.EP1033405-A2. |
| 127750 (576 letters) | 5e-26 | >gnl\|Derwent\|AAC44227 1153 BP.Arabidopsis thaliana DNA fragment SEQ ID NO: 42090.EP1033405-A2. |
| 129204 (678 letters) | 5e-11 | >gnl\|Derwent\|AAC51140 1140 BP.Arabidopsis thaliana DNA fragment SEQ ID NO: 67418.EP1033405-A2. |
| 129329 Contig A (623 letters) | 0.0 | >gnl\|Derwent\|AAQ05727 1255 BP.Gene encoding glutamine synthase in cytosol of rice plant leaves.JP02182190-A. |
| 129329 Contig B (591 letters) | e-174 | >gnl\|Derwent\|AAQ05727 1255 BP.Gene encoding glutamine synthase in cytosol of rice plant leaves.JP02182190-A. |
| 129410 (705 letters) | 7e-38 | >gnl\|Derwent\|AAQ13351 3136 BP.C3 vegetable PEPC gene.JP03172187-A. |
| 129424 (697 letters) | 7e-41 | >gnl\|Derwent\|AAC49778 1136 BP.Arabidopsis thaliana DNA fragment SEQ ID NO: 62402.EP1033405-A2. |
| 129491 (657 letters) | 3e-12 | >gnl\|Derwent\|AAC36721 512 BP.Arabidopsis thaliana DNA fragment SEQ ID NO: 14839.EP1033405-A2. |
| 129725 (627 letters) | 6e-41 | >gnl\|Derwent\|AAC51004 1622 BP.Arabidopsis thaliana DNA fragment SEQ ID NO: 66918.EP1033405-A2. |
| 129748 (629 letters) | 2e-16 | >gnl\|Derwent\|AAA15562 10339 BP.pMON33827 plasmid.WO200026371-A1. |
| 129753 (596 letters) | 2e-07 | >gnl\|Derwent\|AAC43956 751 BP.Arabidopsis thaliana DNA fragment SEQ ID NO: 41097.EP1033405-A2. |
| 129833 (645 letters) | e-102 | >gnl\|Derwent\|AAC47706 1310 BP.Arabidopsis thaliana DNA fragment SEQ ID NO: 54816.EP1033405-A2. |
| 129848 (503 letters) | 2e-09 | >gnl\|Derwent\|AAC48412 1165 BP.Arabidopsis thaliana DNA fragment SEQ ID NO: 57388.EP1033405-A2. |
| 129932 (680 letters) | e-156 | >gnl\|Derwent\|AAQ04525 134525 BP.Total base sequence of rice plant chloroplast DNA.JP02100682-A. |
| 130172 (645 letters) | 1e-26 | >gnl\|Derwent\|AAC33255 924 BP.Arabidopsis thaliana DNA fragment SEQ ID NO: 2355.EP1033405-A2. |
| 130212 (689 letters) | 2e-96 | >gnl\|Derwent\|AAC47553 1720 BP.Arabidopsis thaliana DNA fragment SEQ ID NO: 54247.EP1033405-A2. |
| 130426 (616 letters) | 3e-15 | >gnl\|Derwent\|AAC37491 1092 BP.Arabidopsis thaliana DNA fragment SEQ ID NO: 17575.EP1033405-A2. |

FIG. 5 continued

| Query Contig ID (length, bp) | Pz Score | Result |
|---|---|---|
| 130430 (616 letters) | 2e-04 | >gnl\|Derwent\|AAC36342 1889 BP.Arabidopsis thaliana DNA fragment SEQ ID NO: 13448.EP1033405-A2. |
| 130492 (606 letters) | 8e-28 | >gnl\|Derwent\|AAA67520 410 BP.Pinus radiata ribulose-phosphate-3-epimerase DNA SEQ ID NO:521.WO200022092-A2. |
| 130569 (628 letters) | 4e-08 | >gnl\|Derwent\|AAQ04525 134525 BP.Total base sequence of rice plant chloroplast DNA.JP02100682-A. |
| 130680 (584 letters) | 9e-34 | >gnl\|Derwent\|AAZ35179 1714 BP.Corn delta-9 stearoyl-ACP desaturase cDNA in plasmid pCD520.WO9964579-A2. |
| 130712 (672 letters) | 2e-78 | >gnl\|Derwent\|AAN71176 1068 BP.Sequence encoding mutant glutamine synthetase (GS) enzyme.WO8705627-A. |
| 130722 (728 letters) | 4e-18 | >gnl\|Derwent\|AAQ87912 2029 BP.Glutathione-reductase cDNA.WO9508633-A. |
| 130792 (709 letters) | 3e-46 | >gnl\|Derwent\|AAC49596 1550 BP.Arabidopsis thaliana DNA fragment SEQ ID NO: 61745.EP1033405-A2. |
| 130826 (665 letters) | 2e-84 | >gnl\|Derwent\|AAV35053 1814 BP.Pea ADP-glucose pyrophosphorylase BT2B subunit cDNA.US5773693-A. |
| 130864 (593 letters) | e-115 | >gnl\|Derwent\|AAC38804 914 BP.Arabidopsis thaliana DNA fragment SEQ ID NO: 22290.EP1033405-A2. |
| 130930 (620 letters) | 3e-49 | >gnl\|Derwent\|AAC48950 1647 BP.Arabidopsis thaliana DNA fragment SEQ ID NO: 59371.EP1033405-A2. |
| 131104 (624 letters) | 0.0 | >gnl\|Derwent\|AAF22281 59590 BP.BAC containing repeats from centromeres 1-4 #4.WO200055325-A2. |
| 131281 (615 letters) | 3e-67 | >gnl\|Derwent\|AAC32739 1298 BP.Arabidopsis thaliana DNA fragment SEQ ID NO: 469.EP1033405-A2. |
| 131313 (657 letters) | 9e-62 | >gnl\|Derwent\|AAC50524 1296 BP.Arabidopsis thaliana DNA fragment SEQ ID NO: 65164.EP1033405-A2. |
| 131378 (696 letters) | 2e-10 | >gnl\|Derwent\|AAC37366 1056 BP.Arabidopsis thaliana DNA fragment SEQ ID NO: 17116.EP1033405-A2. |
| 132564 Contig A (666 letters) | 2e-07 | >gnl\|Derwent\|AAC56327 654 BP.Pinus radiata transcription factor DNA sequence #127.WO200053724-A2. |
| 132564 Contig B (669 letters) | 0.0 | >gnl\|Derwent\|AAT29194 1812 BP.S-adenosylhomocysteine hydrolase gene.WO9614734-A1. |
| 133507 (637 letters) | 9e-34 | >gnl\|Derwent\|AAT88222 2834 BP.Castor bean phospholipase D cDNA.US5670366-A. |
| 133547 (681 letters) | 1e-23 | >gnl\|Derwent\|AAC42020 2268 BP.Arabidopsis thaliana DNA fragment SEQ ID NO: 33990.EP1033405-A2. |
| 134962 (658 letters) | 7e-04 | >gnl\|Derwent\|AAF54825 1643 BP.Rice glutamate 1-semialdehyde (GSA) aminotransferase cDNA.WO200109304-A2. |
| 135016 (603 letters) | 3e-46 | >gnl\|Derwent\|AAQ73596 1124 BP.Lolium perenne protein allergen (Lol pI) cDNA clone 26.j.WO9421675-A. |
| 135224 (625 letters) | 0.0 | >gnl\|Derwent\|AAC44037 1865 BP.Zea mays DNA fragment SEQ ID NO: 41385.EP1033405-A2. |
| 135281 (590 letters) | 0.0 | >gnl\|Derwent\|AAT33226 596 BP.Oryzacystatin-I del-D86 protease-inhibitor DNA.WO9616173-A2. |
| 135357 (507 letters) | 3e-08 | >gnl\|Derwent\|AAC48681 1052 BP.Arabidopsis thaliana DNA fragment SEQ ID NO: 58370.EP1033405-A2. |

FIG. 5 continued

| Query Contig ID (length, bp) | Pz Score | Result |
|---|---|---|
| 135416 (641 letters) | 3e-15 | >gnl\|Derwent\|AAC48411 1735 BP.Arabidopsis thaliana DNA fragment SEQ ID NO: 57384.EP1033405-A2. |
| 135668 (606 letters) | e-170 | >gnl\|Derwent\|AAA76283 971 BP.Maize glutathione-S-transferase coding sequence fragment SEQ ID NO: 65.US6096504-A. |
| 136817 (497 letters) | e-149 | >gnl\|Derwent\|AAQ53880 2370 BP.Sequence comprising anther specific promoter of PT42 of rice.WO9325695-A. |
| 138578 (431 letters) | 5e-13 | >gnl\|Derwent\|AAA96225 1195 BP.cDNA encoding a maize chitinase polypeptide designated ZmCh9.WO200056908-A2. |
| 138832 (158 letters) | 4e-05 | >gnl\|Derwent\|AAX25144 1085 BP.Wheat glutathione transferase subunit TaGST1 cDNA.WO9914337-A2. |
| 139222 (621 letters) | 9e-28 | >gnl\|Derwent\|AAC32976 976 BP.Arabidopsis thaliana DNA fragment SEQ ID NO: 1337.EP1033405-A2. |
| 139281 (224 letters) | 2e-50 | >gnl\|Derwent\|AAC35881 476 BP.Zea mays DNA fragment SEQ ID NO: 11754.EP1033405-A2. |
| 139321 (569 letters) | e-151 | >gnl\|Derwent\|AAC38206 473 BP.Zea mays DNA fragment SEQ ID NO: 20152.EP1033405-A2. |
| 139357 (586 letters) | 4e-11 | >gnl\|Derwent\|AAQ98738 2872 BP.Barley Ltp1 gene.WO9523230-A1. |
| 141821 (642 letters) | 1e-14 | >gnl\|Derwent\|AAA31895 356 BP.Plant microsatellite marker #856.WO9967421-A1. |
| 142731 (597 letters) | 8e-25 | >gnl\|Derwent\|AAC50276 1790 BP.Arabidopsis thaliana DNA fragment SEQ ID NO: 64232.EP1033405-A2. |
| 167332 (601 letters) | 5e-60 | >gnl\|Derwent\|AAC45565 1729 BP.Arabidopsis thaliana DNA fragment SEQ ID NO: 46961.EP1033405-A2. |
| 167403 (651 letters) | 2e-07 | >gnl\|Derwent\|AAC48581 1273 BP.Arabidopsis thaliana DNA fragment SEQ ID NO: 57992.EP1033405-A2. |
| 167406 (691 letters) | 1e-45 | >gnl\|Derwent\|AAC45101 1968 BP.Arabidopsis thaliana DNA fragment SEQ ID NO: 45304.EP1033405-A2. |
| 167420 (624 letters) | 1e-29 | >gnl\|Derwent\|AAN81590 1337 BP.Encodes Tobacco GapA gene including transit peptide.EP264067-A. |
| 167515 (647 letters) | 1e-57 | >gnl\|Derwent\|AAC34732 1462 BP.Arabidopsis thaliana DNA fragment SEQ ID NO: 7691.EP1033405-A2. |
| 167575 (738 letters) | 3e-37 | >gnl\|Derwent\|AAC44789 920 BP.Zea mays DNA fragment SEQ ID NO: 44138.EP1033405-A2. |
| 167874 (714 letters) | 5e-39 | >gnl\|Derwent\|AAC46756 1271 BP.Arabidopsis thaliana DNA fragment SEQ ID NO: 51286.EP1033405-A2. |
| 168151 (618 letters) | 2e-75 | >gnl\|Derwent\|AAC47553 1720 BP.Arabidopsis thaliana DNA fragment SEQ ID NO: 54247.EP1033405-A2. |
| 168244 (609 letters) | 1e-42 | >gnl\|Derwent\|AAZ44247 1333 BP.Tobacco FNR DNA.EP967211-A1. |
| 168264 (611 letters) | 5e-60 | >gnl\|Derwent\|AAC37471 1139 BP.Arabidopsis thaliana DNA fragment SEQ ID NO: 17499.EP1033405-A2. |
| 168353 (696 letters) | 2e-75 | >gnl\|Derwent\|AAC47750 1763 BP.Zea mays DNA fragment SEQ ID NO: 54978.EP1033405-A2. |
| 168479 (663 letters) | 3e-18 | >gnl\|Derwent\|AAA31175 360 BP.Plant microsatellite marker #136.WO9967421-A1. |
| 168524 (702 letters) | 8e-10 | >gnl\|Derwent\|AAC42070 1803 BP.Arabidopsis thaliana DNA fragment SEQ ID NO: 34175.EP1033405-A2. |

FIG. 5 continued

| Query Contig ID (length, bp) | Pz Score | Result |
|---|---|---|
| 171033 (594 letters) | e-151 | >gnl\|Derwent\|AAA27931 1109 BP.Corn phosphatidylglycerophosphate synthase cDNA.WO200036117-A1. |
| 171051 (408 letters) | 3e-05 | >gnl\|Derwent\|AAV84304 1295 BP.Wheat geminivirus RepA binding protein GRAB2 cDNA.WO9856811-A2. |
| 171917 (549 letters) | 3e-73 | >gnl\|Derwent\|AAC46716 505 BP.Zea mays DNA fragment SEQ ID NO: 51143.EP1033405-A2. |
| 174874 (583 letters) | 1e-04 | >gnl\|Derwent\|AAV52324 10357 BP.Streptococcus pneumoniae genome fragment SEQ ID NO:191.WO9818931-A2. |
| 174878 (584 letters) | 2e-06 | >gnl\|Derwent\|AAC37875 1814 BP.Arabidopsis thaliana DNA fragment SEQ ID NO: 18981.EP1033405-A2. |
| 174917 (508 letters) | 1e-38 | >gnl\|Derwent\|AAV16147 139 BP.Microsatellite marker used to identify different rice grades.JP10057073-A. |
| 175484 (483 letters) | 8e-06 | >gnl\|Derwent\|AAC81463 393 BP.Rice glutaredoxin homologue 2 (GRL2) cDNA, SEQ ID NO:15.WO200063417-A2. |
| 175535 (666 letters) | 3e-15 | >gnl\|Derwent\|AAC42426 1332 BP.Arabidopsis thaliana DNA fragment SEQ ID NO: 35512.EP1033405-A2. |
| 175706 (616 letters) | e-146 | >gnl\|Derwent\|AAA96232 1048 BP.cDNA encoding a maize chitinase polypeptide designated ZmCh16.WO200056908-A2. |
| 175736 Contig A (629 letters) | 2e-16 | >gnl\|Derwent\|AAA67291 643 BP.Eucalyptus grandis D-fructokinase DNA sequence SEQ ID NO:292.WO200022092-A2. |
| 175736 Contig B (646 letters) | 3e-06 | >gnl\|Derwent\|AAA67288 361 BP.Eucalyptus grandis D-fructokinase DNA sequence SEQ ID NO:289.WO200022092-A2. |
| 175912 (651 letters) | 3e-15 | >gnl\|Derwent\|AAF57325 872 BP.T. aestivum endo-XG transferase DNA sequence.EP1083222-A2. |
| 175977 (482 letters) | e-111 | >gnl\|Derwent\|AAC48009 718 BP.Zea mays DNA fragment SEQ ID NO: 55929.EP1033405-A2. |
| 176047 (460 letters) | e-110 | >gnl\|Derwent\|AAC48092 484 BP.Zea mays DNA fragment SEQ ID NO: 56237.EP1033405-A2. |
| 181743 (602 letters) | 1e-51 | >gnl\|Derwent\|AAC44861 1220 BP.Arabidopsis thaliana DNA fragment SEQ ID NO: 44409.EP1033405-A2. |
| 181971 (674 letters) | 3e-12 | >gnl\|Derwent\|AAC48867 1215 BP.Arabidopsis thaliana DNA fragment SEQ ID NO: 59065.EP1033405-A2. |
| 182007 (606 letters) | 5e-60 | >gnl\|Derwent\|AAC49399 1311 BP.Arabidopsis thaliana DNA fragment SEQ ID NO: 61016.EP1033405-A2. |
| 182229 (75 letters) | 8e-26 | >gnl\|Derwent\|AAF22281 59590 BP.BAC containing repeats from centromeres 1-4 #4.WO200055325-A2. |
| 182274 (611 letters) | 2e-81 | >gnl\|Derwent\|AAQ04525 134525 BP.Total base sequence of rice plant chloroplast DNA.JP02100682-A. |
| 182358 (668 letters) | 1e-36 | >gnl\|Derwent\|AAQ43208 1675 BP.Sequence encoding soybean plastid delta-15 desaturase.WO9311245-A. |
| 186849 (369 letters) | 7e-58 | >gnl\|Derwent\|AAC39703 529 BP.Zea mays DNA fragment SEQ ID NO: 25593.EP1033405-A2. |
| 186860 (605 letters) | 5e-17 | >gnl\|Derwent\|AAC47636 2896 BP.Arabidopsis thaliana DNA fragment SEQ ID NO: 54555.EP1033405-A2. |
| 186919 (126 letters) | 5e-07 | >gnl\|Derwent\|AAC44811 1112 BP.Zea mays DNA fragment SEQ ID NO: 44222.EP1033405-A2. |

FIG. 5 continued

| Query Contig ID (length, bp) | Pz Score | Result |
|---|---|---|
| 186963 (474 letters) | 3e-30 | >gnl\|Derwent\|AAC51679 475 BP.Zea mays DNA fragment SEQ ID NO: 69392.EP1033405-A2. |
| 188836 (565 letters) | 0.0 | >gnl\|Derwent\|AAT04553 480 BP.Rice 10K prolamin protein signal region gene.JP07213185-A. |
| 188837 (632 letters) | 2e-04 | >gnl\|Derwent\|AAV81632 1371 BP.Wheat gene WCI-4 cDNA sequence.US5847258-A. |
| 188876 (578 letters) | 1e-04 | >gnl\|Derwent\|AAT09823 131 BP.Tomato genomic DNA, DB# 275 used as probe.WO9532288-A1. |
| 188943 (686 letters) | 0.0 | >gnl\|Derwent\|AAN82246 1646 BP.Rice storage protein gene.JP63071181-A. |
| 188959 (628 letters) | 2e-41 | >gnl\|Derwent\|AAC46799 629 BP.Arabidopsis thaliana DNA fragment SEQ ID NO: 51447.EP1033405-A2. |
| 194652 (569 letters) | 4e-05 | >gnl\|Derwent\|AAC41042 531 BP.Zea mays DNA fragment SEQ ID NO: 30439.EP1033405-A2. |
| 200605 (631 letters) | 0.0 | >gnl\|Derwent\|AAT96369 2601 BP.Yeast acyl-coenzyme A:cholesterol acyltransferase 1 DNA.WO9745536-A1. |
| 200622 (401 letters) | 3e-08 | >gnl\|Derwent\|AAT70922 42 BP.Primer N14 for testing yeast cytochrome b5 deficient cells.WO9710344-A1. |
| 200626 (627 letters) | 0.0 | >gnl\|Derwent\|AAX25569 1770 BP.Yeast sphingosine-1-phosphate lyase cDNA.WO9916888-A2. |
| 200628 (626 letters) | 0.0 | >gnl\|Derwent\|AAT60712 1584 BP.Saccharomyces cerevisiae temp. inducible protein, TIP1, gene.US5470971-A. |
| 200631 (597 letters) | 0.0 | >gnl\|Derwent\|AAT59296 2054 BP.S. cerevisiae squalene synthetase coding sequence.US5589372-A. |
| 200638 (368 letters) | 6e-83 | >gnl\|Derwent\|AAT16035 1405 BP.Saccharomyces cerevisiae p12 protein gene.JP08009977-A. |
| 200646 (637 letters) | 0.0 | >gnl\|Derwent\|AAT40218 1058 BP.Sequence encoding peptide used to increase carotenoid yield.WO9628545-A1. |
| 200653 (629 letters) | 0.0 | >gnl\|Derwent\|AAT41420 2074 BP.Yeast cell wall protein CLY4 gene.EP735138-A2. |
| 200672 (635 letters) | 0.0 | >gnl\|Derwent\|AAV70837 1320 BP.Yeast SMT gene.WO9845457-A1. |
| 200673 (597 letters) | 4e-11 | >gnl\|Derwent\|AAF13191 1621 BP.Aspergillus oryzae EST SEQ ID NO:5714.WO200056762-A2. |
| 212363 (373 letters) | 6e-06 | >gnl\|Derwent\|AAC84314 560 BP.Human EXCS encoding cDNA (clone ID 1440015CB1).WO200070049-A2. |
| 212412 (529 letters) | e-115 | >gnl\|Derwent\|AAF07884 602 BP.Fusarium venenatum EST SEQ ID NO:407.WO200056762-A2. |
| 212475 (605 letters) | 2e-40 | >gnl\|Derwent\|AAF08005 611 BP.Fusarium venenatum EST SEQ ID NO:528.WO200056762-A2. |
| 212616 (585 letters) | 2e-06 | >gnl\|Derwent\|AAA14075 1771 BP.Human SPROUTY-1 partial cDNA, SEQ ID NO:10.WO200015781-A1. |
| 212646 (212 letters) | 2e-10 | >gnl\|Derwent\|AAF14890 1478 BP.Trichoderma reesei EST SEQ ID NO:7413.WO200056762-A2. |
| 212744 (462 letters) | 8e-06 | >gnl\|Derwent\|AAA26358 1052 BP.Human secreted protein gene 13 SEQ ID NO:23.WO200006698-A1. |
| 212767 (361 letters) | 1e-10 | >gnl\|Derwent\|AAF08877 392 BP.Fusarium venenatum EST SEQ ID NO:1400.WO200056762-A2. |
| 212777 (466 letters) | 1e-16 | >gnl\|Derwent\|AAF15103 513 BP.Trichoderma reesei EST SEQ ID NO:7626.WO200056762-A2. |

FIG. 5 continued

| Query Contig ID (length, bp) | Pz Score | Result |
|---|---|---|
| 212785 (483 letters) | 3e-45 | >gnl\|Derwent\|AAF08667 537 BP.Fusarium venenatum EST SEQ ID NO:1190.WO200056762-A2. |
| 212792 Contig A (151 letters) | 1e-54 | >gnl\|Derwent\|AAV84063 2000 BP.cDNA encoding a hexosaminidase enzyme.WO9850512-A1. |
| 212824 (436 letters) | 2e-06 | >gnl\|Derwent\|AAF08357 636 BP.Fusarium venenatum EST SEQ ID NO:880.WO200056762-A2. |
| 212892 (452 letters) | 3e-05 | >gnl\|Derwent\|AAF15074 886 BP.Trichoderma reesei EST SEQ ID NO:7597.WO200056762-A2. |
| 213037 (617 letters) | 1e-14 | >gnl\|Derwent\|AAF07792 559 BP.Fusarium venenatum EST SEQ ID NO:315.WO200056762-A2. |
| 213122 (608 letters) | 1e-11 | >gnl\|Derwent\|AAF07741 593 BP.Fusarium venenatum EST SEQ ID NO:264.WO200056762-A2. |
| 213123 (228 letters) | 6e-17 | >gnl\|Derwent\|AAX29905 3018 BP.Plasmid pGEM (RTM)-T Easy Vector.WO9910361-A1. |
| 213128 (368 letters) | 2e-08 | >gnl\|Derwent\|AAA57146 2010 BP.Cercospora nicotianae sor1 cDNA.US6063987-A. |
| 213169 (146 letters) | 6e-07 | >gnl\|Derwent\|AAF18334 3013 BP.Lung cancer associated polynucleotide sequence SEQ ID 353.WO200055180-A2. |
| 213171 (642 letters) | 2e-10 | >gnl\|Derwent\|AAF07777 540 BP.Fusarium venenatum EST SEQ ID NO:300.WO200056762-A2. |
| 213206 (570 letters) | 1e-57 | >gnl\|Derwent\|AAF07953 649 BP.Fusarium venenatum EST SEQ ID NO:476.WO200056762-A2. |
| 213226 (701 letters) | 2e-56 | >gnl\|Derwent\|AAF07721 644 BP.Fusarium venenatum EST SEQ ID NO:244.WO200056762-A2. |
| 213257 (614 letters) | e-119 | >gnl\|Derwent\|AAF07778 623 BP.Fusarium venenatum EST SEQ ID NO:301.WO200056762-A2. |
| 213260 (565 letters) | 3e-55 | >gnl\|Derwent\|AAF14986 896 BP.Trichoderma reesei EST SEQ ID NO:7509.WO200056762-A2. |
| 213315 (611 letters) | 1e-05 | >gnl\|Derwent\|AAF08600 612 BP.Fusarium venenatum EST SEQ ID NO:1123.WO200056762-A2. |
| 213318 (524 letters) | 4e-08 | >gnl\|Derwent\|AAF10524 412 BP.Fusarium venenatum EST SEQ ID NO:3047.WO200056762-A2. |
| 213340 (555 letters) | 4e-11 | >gnl\|Derwent\|AAF08628 641 BP.Fusarium venenatum EST SEQ ID NO:1151.WO200056762-A2. |
| 213354 (509 letters) | 1e-10 | >gnl\|Derwent\|AAF09027 717 BP.Fusarium venenatum EST SEQ ID NO:1550.WO200056762-A2. |
| 213734 (516 letters) | 2e-16 | >gnl\|Derwent\|AAF07622 988 BP.Fusarium venenatum EST SEQ ID NO:145.WO200056762-A2. |
| 213742 (425 letters) | 1e-38 | >gnl\|Derwent\|AAF15279 349 BP.Trichoderma reesei EST SEQ ID NO:7802.WO200056762-A2. |
| 213749 (571 letters) | 1e-11 | >gnl\|Derwent\|AAF15027 1090 BP.Trichoderma reesei EST SEQ ID NO:7550.WO200056762-A2. |
| 213778 (177 letters) | 2e-13 | >gnl\|Derwent\|AAC98255 400 BP.Human colon cancer antigen nucleotide sequence SEQ ID NO:265.WO200055351-A1. |
| 213789 (278 letters) | 7e-05 | >gnl\|Derwent\|AAF11977 870 BP.Aspergillus oryzae EST SEQ ID NO:4500.WO200056762-A2. |
| 213802 (554 letters) | 2e-09 | >gnl\|Derwent\|AAF08520 487 BP.Fusarium venenatum EST SEQ ID NO:1043.WO200056762-A2. |

FIG. 5 continued

| Query Contig ID (length, bp) | Pz Score | Result |
|---|---|---|
| 213813 (505 letters) | 2e-12 | >gnl\|Derwent\|AAF09348 415 BP.Fusarium venenatum EST SEQ ID NO:1871.WO200056762-A2. |
| 213826 (695 letters) | 8e-10 | >gnl\|Derwent\|AAF08471 452 BP.Fusarium venenatum EST SEQ ID NO:994.WO200056762-A2. |
| 213831 (608 letters) | 8e-59 | >gnl\|Derwent\|AAF15197 717 BP.Trichoderma reesei EST SEQ ID NO:7720.WO200056762-A2. |
| 213868 (605 letters) | 1e-05 | >gnl\|Derwent\|AAF07956 558 BP.Fusarium venenatum EST SEQ ID NO:479.WO200056762-A2. |
| 213877 (629 letters) | 1e-05 | >gnl\|Derwent\|AAT66463 1368 BP.Thermophilic alkaline phosphatase gene.EP770678-A2. |
| 213919 (447 letters) | 3e-05 | >gnl\|Derwent\|AAC78370 195 BP.Human cancer associated gene sequence SEQ ID NO:764.WO200055350-A1. |
| 213942 (300 letters) | 7e-33 | >gnl\|Derwent\|AAF08765 563 BP.Fusarium venenatum EST SEQ ID NO:1288.WO200056762-A2. |
| 213958 (324 letters) | e-101 | >gnl\|Derwent\|AAF07620 1087 BP.Fusarium venenatum EST SEQ ID NO:143.WO200056762-A2. |
| 213981 (423 letters) | e-108 | >gnl\|Derwent\|AAV84063 2000 BP.cDNA encoding a hexosaminidase enzyme.WO9850512-A1. |
| 214067 (626 letters) | 5e-26 | >gnl\|Derwent\|AAF15008 903 BP.Trichoderma reesei EST SEQ ID NO:7531.WO200056762-A2. |
| 214087 (512 letters) | 1e-13 | >gnl\|Derwent\|AAF08641 579 BP.Fusarium venenatum EST SEQ ID NO:1164.WO200056762-A2. |
| 214135 (482 letters) | 6e-16 | >gnl\|Derwent\|AAF15136 391 BP.Trichoderma reesei EST SEQ ID NO:7659.WO200056762-A2. |
| 214201 (483 letters) | 2e-18 | >gnl\|Derwent\|AAF08078 786 BP.Fusarium venenatum EST SEQ ID NO:601.WO200056762-A2. |
| 214221 (383 letters) | 1e-47 | >gnl\|Derwent\|AAF09134 397 BP.Fusarium venenatum EST SEQ ID NO:1657.WO200056762-A2. |
| 214339 (601 letters) | 2e-04 | >gnl\|Derwent\|AAF12021 736 BP.Aspergillus oryzae EST SEQ ID NO:4544.WO200056762-A2. |
| 214346 (389 letters) | 1e-22 | >gnl\|Derwent\|AAF11245 377 BP.Fusarium venenatum EST SEQ ID NO:3768.WO200056762-A2. |
| 214356 (538 letters) | 1e-14 | >gnl\|Derwent\|AAF08205 639 BP.Fusarium venenatum EST SEQ ID NO:728.WO200056762-A2. |
| 214402 (674 letters) | 5e-14 | >gnl\|Derwent\|AAF15236 305 BP.Trichoderma reesei EST SEQ ID NO:7759.WO200056762-A2. |
| 214414 (625 letters) | 4e-05 | >gnl\|Derwent\|AAF07533 1107 BP.Fusarium venenatum EST SEQ ID NO:56.WO200056762-A2. |
| 214415 (384 letters) | 9e-70 | >gnl\|Derwent\|AAF08091 685 BP.Fusarium venenatum EST SEQ ID NO:614.WO200056762-A2. |
| 214423 (630 letters) | 0.0 | >gnl\|Derwent\|AAF13899 1141 BP.Aspergillus oryzae EST SEQ ID NO:6422.WO200056762-A2. |
| 214437 (639 letters) | 0.0 | >gnl\|Derwent\|AAF07763 669 BP.Fusarium venenatum EST SEQ ID NO:286.WO200056762-A2. |
| 214441 (293 letters) | 8e-14 | >gnl\|Derwent\|AAF08113 468 BP.Fusarium venenatum EST SEQ ID NO:636.WO200056762-A2. |
| 214476 (628 letters) | 8e-25 | >gnl\|Derwent\|AAF15146 135 BP.Trichoderma reesei EST SEQ ID NO:7669.WO200056762-A2. |
| 214527 (287 letters) | 4e-71 | >gnl\|Derwent\|AAF14982 883 BP.Trichoderma reesei EST SEQ ID NO:7505.WO200056762-A2. |

FIG. 5 continued

| Query Contig ID (length, bp) | Pz Score | Result |
|---|---|---|
| 214613 (659 letters) | 2e-25 | >gnl\|Derwent\|AAF12211 667 BP.Aspergillus oryzae EST SEQ ID NO:4734.WO200056762-A2. |
| 214633 (520 letters) | 2e-22 | >gnl\|Derwent\|AAA57150 924 BP.Alternaria alternata sor1 homologue cDNA.US6063987-A. |
| 214634 (561 letters) | e-121 | >gnl\|Derwent\|AAZ88577 1554 BP.T. harzianum strain P1 endochitinase cDNA.US6020540-A. |
| 214665 (590 letters) | 2e-04 | >gnl\|Derwent\|AAF08630 768 BP.Fusarium venenatum EST SEQ ID NO:1153.WO200056762-A2. |
| 214687 (233 letters) | 6e-05 | >gnl\|Derwent\|AAF07948 666 BP.Fusarium venenatum EST SEQ ID NO:471.WO200056762-A2. |
| 214766 (647 letters) | 5e-26 | >gnl\|Derwent\|AAZ20105 2570 BP.Aspergillus awamori glutamate dehydrogenase gdhA gene.WO9951756-A2. |
| 214809 (234 letters) | 2e-04 | >gnl\|Derwent\|AAF29453 2498 BP.Human TANGO 292 cDNA.WO200100638-A2. |
| 214826 (606 letters) | 5e-20 | >gnl\|Derwent\|AAF08591 556 BP.Fusarium venenatum EST SEQ ID NO:1114.WO200056762-A2. |
| 214828 (564 letters) | 2e-31 | >gnl\|Derwent\|AAF07518 3203 BP.Fusarium venenatum EST SEQ ID NO:41.WO200056762-A2. |
| 214840 (600 letters) | 9e-31 | >gnl\|Derwent\|AAF08000 595 BP.Fusarium venenatum EST SEQ ID NO:523.WO200056762-A2. |
| 214902 (617 letters) | 3e-15 | >gnl\|Derwent\|AAF12381 684 BP.Aspergillus oryzae EST SEQ ID NO:4904.WO200056762-A2. |
| 214918 (552 letters) | e-152 | >gnl\|Derwent\|AAF15058 772 BP.Trichoderma reesei EST SEQ ID NO:7581.WO200056762-A2. |
| 215009 (528 letters) | e-142 | >gnl\|Derwent\|AAF07728 699 BP.Fusarium venenatum EST SEQ ID NO:251.WO200056762-A2. |
| 215021 (635 letters) | 9e-34 | >gnl\|Derwent\|AAF08467 737 BP.Fusarium venenatum EST SEQ ID NO:990.WO200056762-A2. |
| 215032 (659 letters) | 6e-29 | >gnl\|Derwent\|AAF11377 500 BP.Aspergillus niger EST SEQ ID NO:3900.WO200056762-A2. |
| 215043 (655 letters) | 0.0 | >gnl\|Derwent\|AAF07763 669 BP.Fusarium venenatum EST SEQ ID NO:286.WO200056762-A2. |
| 215047 (700 letters) | 0.0 | >gnl\|Derwent\|AAF14915 880 BP.Trichoderma reesei EST SEQ ID NO:7438.WO200056762-A2. |
| 215059 (562 letters) | 7e-25 | >gnl\|Derwent\|AAF08640 630 BP.Fusarium venenatum EST SEQ ID NO:1163.WO200056762-A2. |
| 215060 (642 letters) | 2e-04 | >gnl\|Derwent\|AAF33215 5061 BP.Human secreted protein gene 3 SEQ ID NO:13.WO200076530-A1. |
| 215066 (503 letters) | 1e-04 | >gnl\|Derwent\|AAF10638 423 BP.Fusarium venenatum EST SEQ ID NO:3161.WO200056762-A2. |
| 215074 (670 letters) | 0.0 | >gnl\|Derwent\|AAF14934 648 BP.Trichoderma reesei EST SEQ ID NO:7457.WO200056762-A2. |
| 215084 (702 letters) | e-131 | >gnl\|Derwent\|AAF08052 1014 BP.Fusarium venenatum EST SEQ ID NO:575.WO200056762-A2. |
| 215120 (562 letters) | 2e-53 | >gnl\|Derwent\|AAF07764 778 BP.Fusarium venenatum EST SEQ ID NO:287.WO200056762-A2. |
| 215138 (591 letters) | 2e-74 | >gnl\|Derwent\|AAF07539 1272 BP.Fusarium venenatum EST SEQ ID NO:62.WO200056762-A2. |
| 215148 (416 letters) | 1e-04 | >gnl\|Derwent\|AAC64577 4262 BP.E. tenella cGMP dependent protein kinase cDNA sequence SEQ ID NO:10.WO200061781-A1. |

FIG. 5 continued

| Query Contig ID (length, bp) | Pz Score | Result |
|---|---|---|
| 215150 (568 letters) | 4e-88 | >gnl\|Derwent\|AAF08144 837 BP.Fusarium venenatum EST SEQ ID NO:667.WO200056762-A2. |
| 215244 (573 letters) | 6e-13 | >gnl\|Derwent\|AAF11907 673 BP.Aspergillus oryzae EST SEQ ID NO:4430.WO200056762-A2. |
| 215249 (441 letters) | 5e-13 | >gnl\|Derwent\|AAC98255 400 BP.Human colon cancer antigen nucleotide sequence SEQ ID NO:265.WO200055351-A1. |
| 215258 (586 letters) | e-111 | >gnl\|Derwent\|AAF14981 708 BP.Trichoderma reesei EST SEQ ID NO:7504.WO200056762-A2. |
| 215303 (471 letters) | 2e-22 | >gnl\|Derwent\|AAF08710 486 BP.Fusarium venenatum EST SEQ ID NO:1233.WO200056762-A2. |
| 215308 (415 letters) | 5e-13 | >gnl\|Derwent\|AAF09017 589 BP.Fusarium venenatum EST SEQ ID NO:1540.WO200056762-A2. |
| 215309 (547 letters) | 2e-13 | >gnl\|Derwent\|AAF15089 789 BP.Trichoderma reesei EST SEQ ID NO:7612.WO200056762-A2. |
| 215325 (528 letters) | e-110 | >gnl\|Derwent\|AAF07551 1084 BP.Fusarium venenatum EST SEQ ID NO:74.WO200056762-A2. |
| 215360 (627 letters) | 5e-23 | >gnl\|Derwent\|AAF08315 615 BP.Fusarium venenatum EST SEQ ID NO:838.WO200056762-A2. |
| 215369 (610 letters) | 9e-34 | >gnl\|Derwent\|AAF15051 1415 BP.Trichoderma reesei EST SEQ ID NO:7574.WO200056762-A2. |
| 215373 (575 letters) | 7e-22 | >gnl\|Derwent\|AAF15146 135 BP.Trichoderma reesei EST SEQ ID NO:7669.WO200056762-A2. |
| 215379 (512 letters) | e-154 | >gnl\|Derwent\|AAF07731 906 BP.Fusarium venenatum EST SEQ ID NO:254.WO200056762-A2. |
| 215382 (613 letters) | 6e-35 | >gnl\|Derwent\|AAF07852 794 BP.Fusarium venenatum EST SEQ ID NO:375.WO200056762-A2. |
| 215387 (501 letters) | 0.0 | >gnl\|Derwent\|AAF07946 655 BP.Fusarium venenatum EST SEQ ID NO:469.WO200056762-A2. |
| 215420 (615 letters) | 1e-32 | >gnl\|Derwent\|AAF07750 801 BP.Fusarium venenatum EST SEQ ID NO:273.WO200056762-A2. |
| 215422 (542 letters) | 5e-38 | >gnl\|Derwent\|AAF08353 1116 BP.Fusarium venenatum EST SEQ ID NO:876.WO200056762-A2. |
| 215431 (674 letters) | 0.0 | >gnl\|Derwent\|AAF07657 865 BP.Fusarium venenatum EST SEQ ID NO:180.WO200056762-A2. |
| 215445 (685 letters) | 2e-13 | >gnl\|Derwent\|AAF13330 1028 BP.Aspergillus oryzae EST SEQ ID NO:5853.WO200056762-A2. |
| 215459 (397 letters) | 2e-12 | >gnl\|Derwent\|AAF08659 510 BP.Fusarium venenatum EST SEQ ID NO:1182.WO200056762-A2. |
| 215477 (602 letters) | e-103 | >gnl\|Derwent\|AAF07711 615 BP.Fusarium venenatum EST SEQ ID NO:234.WO200056762-A2. |
| 215480 (475 letters) | 3e-11 | >gnl\|Derwent\|AAA49725 2181 BP.Human PRO362 cDNA clone DNA45416-1251.WO200037638-A2. |
| 215516 (341 letters) | 2e-45 | >gnl\|Derwent\|AAF15233 849 BP.Trichoderma reesei EST SEQ ID NO:7756.WO200056762-A2. |
| 215552 (530 letters) | 4e-17 | >gnl\|Derwent\|AAF07622 988 BP.Fusarium venenatum EST SEQ ID NO:145.WO200056762-A2. |
| 215570 (521 letters) | 4e-60 | >gnl\|Derwent\|AAF07493 2504 BP.Fusarium venenatum EST SEQ ID NO:16.WO200056762-A2. |
| 215579 (338 letters) | 1e-96 | >gnl\|Derwent\|AAF15035 391 BP.Trichoderma reesei EST SEQ ID NO:7558.WO200056762-A2. |

FIG. 5 continued

| Query Contig ID (length, bp) | Pz Score | Result |
|---|---|---|
| 215601 (566 letters) | 0.0 | >gnl\|Derwent\|AAC83524 972 BP.T7 promoter sequence PCR primer SEQ ID NO: 3.WO200066771-A2. |
| 215608 (366 letters) | 2e-49 | >gnl\|Derwent\|AAF15066 914 BP.Trichoderma reesei EST SEQ ID NO:7589.WO200056762-A2. |
| 215610 (521 letters) | e-176 | >gnl\|Derwent\|AAF14893 852 BP.Trichoderma reesei EST SEQ ID NO:7416.WO200056762-A2. |
| 215611 (593 letters) | 8e-68 | >gnl\|Derwent\|AAF08280 500 BP.Fusarium venenatum EST SEQ ID NO:803.WO200056762-A2. |
| 215629 (542 letters) | e-111 | >gnl\|Derwent\|AAF11308 601 BP.Aspergillus niger EST SEQ ID NO:3831.WO200056762-A2. |
| 215667 (535 letters) | 9e-12 | >gnl\|Derwent\|AAF09014 1085 BP.Fusarium venenatum EST SEQ ID NO:1537.WO200056762-A2. |
| 215669 (347 letters) | 9e-05 | >gnl\|Derwent\|AAF09527 645 BP.Fusarium venenatum EST SEQ ID NO:2050.WO200056762-A2. |
| 215672 (515 letters) | e-109 | >gnl\|Derwent\|AAF07779 926 BP.Fusarium venenatum EST SEQ ID NO:302.WO200056762-A2. |
| 215676 (557 letters) | 0.0 | >gnl\|Derwent\|AAF14897 691 BP.Trichoderma reesei EST SEQ ID NO:7420.WO200056762-A2. |
| 215678 (558 letters) | 2e-12 | >gnl\|Derwent\|AAQ58006 1636 BP.Sequence of plasmid pTHN3 showing the promoter and coding region of the clone cDNA 1.WO9404673-A. |
| 215729 (363 letters) | 1e-22 | >gnl\|Derwent\|AAF11245 377 BP.Fusarium venenatum EST SEQ ID NO:3768.WO200056762-A2. |
| 215730 (201 letters) | 1e-14 | >gnl\|Derwent\|AAF07852 794 BP.Fusarium venenatum EST SEQ ID NO:375.WO200056762-A2. |
| 215806 (82 letters) | 1e-06 | >gnl\|Derwent\|AAF09001 471 BP.Fusarium venenatum EST SEQ ID NO:1524.WO200056762-A2. |
| 215817 (504 letters) | 9e-09 | >gnl\|Derwent\|AAF10965 282 BP.Fusarium venenatum EST SEQ ID NO:3488.WO200056762-A2. |
| 215864 (551 letters) | 5e-66 | >gnl\|Derwent\|AAF08031 871 BP.Fusarium venenatum EST SEQ ID NO:554.WO200056762-A2. |
| 215951 (197 letters) | 8e-13 | >gnl\|Derwent\|AAF09348 415 BP.Fusarium venenatum EST SEQ ID NO:1871.WO200056762-A2. |
| 215966 (645 letters) | e-152 | >gnl\|Derwent\|AAF07729 702 BP.Fusarium venenatum EST SEQ ID NO:252.WO200056762-A2. |
| 215973 (345 letters) | 4e-10 | >gnl\|Derwent\|AAF07638 925 BP.Fusarium venenatum EST SEQ ID NO:161.WO200056762-A2. |
| 216018 (645 letters) | 2e-35 | >gnl\|Derwent\|AAF08211 974 BP.Fusarium venenatum EST SEQ ID NO:734.WO200056762-A2. |
| 216068 (644 letters) | 1e-17 | >gnl\|Derwent\|AAF14664 698 BP.Aspergillus oryzae EST SEQ ID NO:7187.WO200056762-A2. |
| 216095 (576 letters) | 2e-71 | >gnl\|Derwent\|AAF15067 294 BP.Trichoderma reesei EST SEQ ID NO:7590.WO200056762-A2. |
| 216109 (525 letters) | 1e-20 | >gnl\|Derwent\|AAF08681 626 BP.Fusarium venenatum EST SEQ ID NO:1204.WO200056762-A2. |
| 216112 (578 letters) | 5e-20 | >gnl\|Derwent\|AAF15206 637 BP.Trichoderma reesei EST SEQ ID NO:7729.WO200056762-A2. |
| 216150 (578 letters) | 9e-06 | >gnl\|Derwent\|AAF08355 1657 BP.Fusarium venenatum EST SEQ ID NO:878.WO200056762-A2. |
| 216156 (509 letters) | 2e-06 | >gnl\|Derwent\|AAF15236 305 BP.Trichoderma reesei EST SEQ ID NO:7759.WO200056762-A2. |

FIG. 5 continued

| Query Contig ID (length, bp) | Pz Score | Result |
|---|---|---|
| 216175 (460 letters) | 2e-24 | >gnl\|Derwent\|AAF09001 471 BP.Fusarium venenatum EST SEQ ID NO:1524.WO200056762-A2. |
| 216176 (555 letters) | 2e-49 | >gnl\|Derwent\|AAF07670 1020 BP.Fusarium venenatum EST SEQ ID NO:193.WO200056762-A2. |
| 216195 (268 letters) | 1e-30 | >gnl\|Derwent\|AAF15067 294 BP.Trichoderma reesei EST SEQ ID NO:7590.WO200056762-A2. |
| 216196 (337 letters) | 3e-69 | >gnl\|Derwent\|AAF07758 711 BP.Fusarium venenatum EST SEQ ID NO:281.WO200056762-A2. |
| 216207 (511 letters) | 3e-30 | >gnl\|Derwent\|AAF08435 445 BP.Fusarium venenatum EST SEQ ID NO:958.WO200056762-A2. |
| 216213 (478 letters) | 2e-22 | >gnl\|Derwent\|AAF11245 377 BP.Fusarium venenatum EST SEQ ID NO:3768.WO200056762-A2. |
| 216219 (529 letters) | 8e-34 | >gnl\|Derwent\|AAF08934 470 BP.Fusarium venenatum EST SEQ ID NO:1457.WO200056762-A2. |
| 216223 (602 letters) | 6e-78 | >gnl\|Derwent\|AAF07650 588 BP.Fusarium venenatum EST SEQ ID NO:173.WO200056762-A2. |
| 216249 (358 letters) | 1e-10 | >gnl\|Derwent\|AAF08877 392 BP.Fusarium venenatum EST SEQ ID NO:1400.WO200056762-A2. |
| 216268 (596 letters) | 2e-07 | >gnl\|Derwent\|AAV69440 809 BP.Banana fruit ripening-related clone U-7 cDNA.WO9853085-A1. |
| 216280 (177 letters) | 2e-10 | >gnl\|Derwent\|AAF75089 777 BP.Human colon associated protein cDNA sequence #13.WO200112781-A1. |
| 216284 (576 letters) | e-167 | >gnl\|Derwent\|AAF07677 875 BP.Fusarium venenatum EST SEQ ID NO:200.WO200056762-A2. |
| 216318 (182 letters) | 4e-05 | >gnl\|Derwent\|AAA96367 50000 BP.Polymorphic repeat microsatellite sequences present in the CTLA4 locus.WO200056856-A2. |
| 216338 (577 letters) | 2e-13 | >gnl\|Derwent\|AAF08808 586 BP.Fusarium venenatum EST SEQ ID NO:1331.WO200056762-A2. |
| 216360 (611 letters) | 2e-16 | >gnl\|Derwent\|AAF08003 938 BP.Fusarium venenatum EST SEQ ID NO:526.WO200056762-A2. |
| 216371 (576 letters) | 7e-13 | >gnl\|Derwent\|AAZ52450 1353 BP.HTRM clone 2775157 DNA sequence.WO9957144-A2. |
| 216373 (600 letters) | 2e-25 | >gnl\|Derwent\|AAF07847 720 BP.Fusarium venenatum EST SEQ ID NO:370.WO200056762-A2. |
| 216406 (688 letters) | 3e-15 | >gnl\|Derwent\|AAF08643 628 BP.Fusarium venenatum EST SEQ ID NO:1166.WO200056762-A2. |
| 216408 (585 letters) | 3e-49 | >gnl\|Derwent\|AAF11377 500 BP.Aspergillus niger EST SEQ ID NO:3900.WO200056762-A2. |
| 216425 (657 letters) | 3e-15 | >gnl\|Derwent\|AAF08637 300 BP.Fusarium venenatum EST SEQ ID NO:1160.WO200056762-A2. |
| 216427 (638 letters) | 0.0 | >gnl\|Derwent\|AAF08200 711 BP.Fusarium venenatum EST SEQ ID NO:723.WO200056762-A2. |
| 216492 (459 letters) | 3e-08 | >gnl\|Derwent\|AAF09809 595 BP.Fusarium venenatum EST SEQ ID NO:2332.WO200056762-A2. |
| 218801 (608 letters) | 0.0 | >gnl\|Derwent\|AAZ09716 738 BP.Plasmid pGEM DNA fragment.US5945526-A. |
| 218922 (507 letters) | 4e-11 | >gnl\|Derwent\|AAF07481 1279 BP.Fusarium venenatum EST SEQ ID NO:4.WO200056762-A2. |
| 218924 (508 letters) | e-145 | >gnl\|Derwent\|AAF15058 772 BP.Trichoderma reesei EST SEQ ID NO:7581.WO200056762-A2. |

FIG. 5 continued

| Query Contig ID (length, bp) | Pz Score | Result |
|---|---|---|
| 218977 (369 letters) | 3e-11 | >gnl\|Derwent\|AAC48207 476 BP.Arabidopsis thaliana DNA fragment SEQ ID NO: 56646.EP1033405-A2. |
| 219006 (565 letters) | 3e-70 | >gnl\|Derwent\|AAF08775 742 BP.Fusarium venenatum EST SEQ ID NO:1298.WO200056762-A2. |
| 219066 (545 letters) | 4e-11 | >gnl\|Derwent\|AAF14544 701 BP.Aspergillus oryzae EST SEQ ID NO:7067.WO200056762-A2. |
| 219136 (513 letters) | 4e-20 | >gnl\|Derwent\|AAF07554 1264 BP.Fusarium venenatum EST SEQ ID NO:77.WO200056762-A2. |
| 219159 (317 letters) | 4e-13 | >gnl\|Derwent\|AAF13368 1323 BP.Aspergillus oryzae EST SEQ ID NO:5891.WO200056762-A2. |
| 219178 (75 letters) | 4e-09 | >gnl\|Derwent\|AAV84063 2000 BP.cDNA encoding a hexosaminidase enzyme.WO9850512-A1. |
| 219218 (345 letters) | 9e-08 | >gnl\|Derwent\|AAF14471 664 BP.Aspergillus oryzae EST SEQ ID NO:6994.WO200056762-A2. |
| 219244 (515 letters) | 2e-52 | >gnl\|Derwent\|AAF15049 553 BP.Trichoderma reesei EST SEQ ID NO:7572.WO200056762-A2. |
| 23794 (857 letters) | 0.0 | >gnl\|Derwent\|AAC38627 911 BP.Arabidopsis thaliana DNA fragment SEQ ID NO: 21662.EP1033405-A2. |
| 258904 Contig A (664 letters) | 0.0 | >gnl\|Derwent\|AAC47270 1189 BP.Arabidopsis thaliana DNA fragment SEQ ID NO: 53196.EP1033405-A2. |
| 258904 Contig B (208 letters) | e-112 | >gnl\|Derwent\|AAC47270 1189 BP.Arabidopsis thaliana DNA fragment SEQ ID NO: 53196.EP1033405-A2. |
| 258906 (731 letters) | 2e-16 | >gnl\|Derwent\|AAF76445 1268 BP.Maize ZmMADS2 coding sequence SEQ ID NO: 1.WO200112798-A2. |
| 258924 Contig A (543 letters) | 4e-23 | >gnl\|Derwent\|AAC50564 1119 BP.Arabidopsis thaliana DNA fragment SEQ ID NO: 65311.EP1033405-A2. |
| 258924 Contig B (139 letters) | 9e-15 | >gnl\|Derwent\|AAC50564 1119 BP.Arabidopsis thaliana DNA fragment SEQ ID NO: 65311.EP1033405-A2. |
| 258965 (865 letters) | 0.0 | >gnl\|Derwent\|AAC51039 903 BP.Arabidopsis thaliana DNA fragment SEQ ID NO: 67049.EP1033405-A2. |
| 258966 Contig A (654 letters) | 4e-33 | >gnl\|Derwent\|AAC46474 1575 BP.Arabidopsis thaliana DNA fragment SEQ ID NO: 50275.EP1033405-A2. |
| 258966 Contig B (448 letters) | 3e-05 | >gnl\|Derwent\|AAC46474 1575 BP.Arabidopsis thaliana DNA fragment SEQ ID NO: 50275.EP1033405-A2. |
| 258967 (498 letters) | 0.0 | >gnl\|Derwent\|AAC48314 1416 BP.Arabidopsis thaliana DNA fragment SEQ ID NO: 57029.EP1033405-A2. |
| 258970 (428 letters) | 0.0 | >gnl\|Derwent\|AAC47494 609 BP.Arabidopsis thaliana DNA fragment SEQ ID NO: 54025.EP1033405-A2. |

FIG. 5 continued

| Query Contig ID (length, bp) | Pz Score | Result |
|---|---|---|
| 258978 (956 letters) | 0.0 | >gnl\|Derwent\|AAC51440 1262 BP.Arabidopsis thaliana DNA fragment SEQ ID NO: 68530.EP1033405-A2. |
| 258996 (434 letters) | 2e-86 | >gnl\|Derwent\|AAF22305 1082138 BP.Arabidopsis thaliana chromosome 4 centromere.WO200055325-A2. |
| 259006 (653 letters) | 0.0 | >gnl\|Derwent\|AAC42974 825 BP.Arabidopsis thaliana DNA fragment SEQ ID NO: 37560.EP1033405-A2. |
| 259007 (845 letters) | 0.0 | >gnl\|Derwent\|AAC33660 1274 BP.Arabidopsis thaliana DNA fragment SEQ ID NO: 3859.EP1033405-A2. |
| 259018 (1067 letters) | 1e-34 | >gnl\|Derwent\|AAC40003 1670 BP.Arabidopsis thaliana DNA fragment SEQ ID NO: 26694.EP1033405-A2. |
| 259028 Contig A (663 letters) | 8e-16 | >gnl\|Derwent\|AAC56465 333 BP.Eucalyptus grandis transcription factor DNA sequence #336.WO200053724-A2. |
| 259045 (719 letters) | 3e-06 | >gnl\|Derwent\|AAC48936 1749 BP.Arabidopsis thaliana DNA fragment SEQ ID NO: 59319.EP1033405-A2. |
| 262509 (926 letters) | 0.0 | >gnl\|Derwent\|AAC43006 918 BP.Arabidopsis thaliana DNA fragment SEQ ID NO: 37678.EP1033405-A2. |
| 262648 Contig A (512 letters) | e-117 | >gnl\|Derwent\|AAC43878 533 BP.Arabidopsis thaliana DNA fragment SEQ ID NO: 40836.EP1033405-A2. |
| 262648 Contig B (598 letters) | 2e-19 | >gnl\|Derwent\|AAC50238 2200 BP.Arabidopsis thaliana DNA fragment SEQ ID NO: 64088.EP1033405-A2. |
| 262650 (607 letters) | 0.0 | >gnl\|Derwent\|AAC47814 1327 BP.Arabidopsis thaliana DNA fragment SEQ ID NO: 55223.EP1033405-A2. |
| 262658 (656 letters) | 4e-08 | >gnl\|Derwent\|AAC45816 1140 BP.Arabidopsis thaliana DNA fragment SEQ ID NO: 47865.EP1033405-A2. |
| 262715 Contig A (548 letters) | 1e-17 | >gnl\|Derwent\|AAC47739 1151 BP.Arabidopsis thaliana DNA fragment SEQ ID NO: 54936.EP1033405-A2. |
| 262715 Contig B (173 letters) | 1e-11 | >gnl\|Derwent\|AAA08368 944 BP.A. thaliana transcription factor DREB1C nucleotide sequence SEQ ID NO:7.JP2000060558-A. |
| 262725 (995 letters) | 3e-16 | >gnl\|Derwent\|AAC45742 1584 BP.Arabidopsis thaliana DNA fragment SEQ ID NO: 47599.EP1033405-A2. |
| 262762 (1079 letters) | 0.0 | >gnl\|Derwent\|AAC35081 1432 BP.Arabidopsis thaliana DNA fragment SEQ ID NO: 8930.EP1033405-A2. |
| 263004 (640 letters) | 0.0 | >gnl\|Derwent\|AAA08365 933 BP.A. thaliana transcription factor DREB1A nucleotide sequence SEQ ID NO:1.JP2000060558-A. |
| 263005 (538 letters) | 0.0 | >gnl\|Derwent\|AAT60140 668 BP.Arabidopsis terminal flower1 (tfl1) cDNA.WO9710339-A1. |
| 263006 (695 letters) | 0.0 | >gnl\|Derwent\|AAZ49114 1024 BP.FIL protein coding sequence.JP11318462-A. |
| 263009 (450 letters) | 0.0 | >gnl\|Derwent\|AAC38615 844 BP.Arabidopsis thaliana DNA fragment SEQ ID NO: 21618.EP1033405-A2. |

FIG. 5 continued

| Query Contig ID (length, bp) | Pz Score | Result |
|---|---|---|
| 263030 (1028 letters) | 0.0 | >gnl\|Derwent\|AAC44651 1315 BP.Arabidopsis thaliana DNA fragment SEQ ID NO: 43613.EP1033405-A2. |
| 263033 (665 letters) | 2e-62 | >gnl\|Derwent\|AAC51184 1327 BP.Arabidopsis thaliana DNA fragment SEQ ID NO: 67576.EP1033405-A2. |
| 263037 Contig A (376 letters) | 0.0 | >gnl\|Derwent\|AAC32953 1148 BP.Arabidopsis thaliana DNA fragment SEQ ID NO: 1253.EP1033405-A2. |
| 263037 Contig B (298 letters) | e-120 | >gnl\|Derwent\|AAC32953 1148 BP.Arabidopsis thaliana DNA fragment SEQ ID NO: 1253.EP1033405-A2. |
| 263050 (641 letters) | 4e-05 | >gnl\|Derwent\|AAC38615 844 BP.Arabidopsis thaliana DNA fragment SEQ ID NO: 21618.EP1033405-A2. |
| 263060 Contig B (649 letters) | 8e-16 | >gnl\|Derwent\|AAC42662 774 BP.Arabidopsis thaliana DNA fragment SEQ ID NO: 36392.EP1033405-A2. |
| 263070 Contig A (566 letters) | 1e-04 | >gnl\|Derwent\|AAC76548 6523 BP.Human ORFX ORF2103 polynucleotide sequence SEQ ID NO:4205.WO200058473-A2. |
| 263078 Contig A (255 letters) | e-142 | >gnl\|Derwent\|AAC46845 959 BP.Arabidopsis thaliana DNA fragment SEQ ID NO: 51618.EP1033405-A2. |
| 263078 Contig B (394 letters) | 0.0 | >gnl\|Derwent\|AAA08365 933 BP.A. thaliana transcription factor DREB1A nucleotide sequence SEQ ID NO:1.JP2000060558-A. |
| 263078 Contig C (665 letters) | 0.0 | >gnl\|Derwent\|AAC46845 959 BP.Arabidopsis thaliana DNA fragment SEQ ID NO: 51618.EP1033405-A2. |
| 263110 (656 letters) | 0.0 | >gnl\|Derwent\|AAA08368 944 BP.A. thaliana transcription factor DREB1C nucleotide sequence SEQ ID NO:7.JP2000060558-A. |
| 263114 Contig A (192 letters) | 3e-83 | >gnl\|Derwent\|AAA08368 944 BP.A. thaliana transcription factor DREB1C nucleotide sequence SEQ ID NO:7.JP2000060558-A. |
| 263114 Contig B (169 letters) | 9e-74 | >gnl\|Derwent\|AAA08365 933 BP.A. thaliana transcription factor DREB1A nucleotide sequence SEQ ID NO:1.JP2000060558-A. |
| 263125 (773 letters) | 0.0 | >gnl\|Derwent\|AAZ92151 779 BP.A. thaliana cauliflower (CAL) gene sequence.US6025483-A. |
| 263127 (1109 letters) | 0.0 | >gnl\|Derwent\|AAC48701 1199 BP.Arabidopsis thaliana DNA fragment SEQ ID NO: 58444.EP1033405-A2. |

FIG. 5 continued

| Query Contig ID (length, bp) | Pz Score | Result |
|---|---|---|
| 263136 Contig A (508 letters) | 0.0 | >gnl\|Derwent\|AAC37976 683 BP.Arabidopsis thaliana DNA fragment SEQ ID NO: 19346.EP1033405-A2. |
| 263136 Contig B (165 letters) | 4e-36 | >gnl\|Derwent\|AAC48176 683 BP.Arabidopsis thaliana DNA fragment SEQ ID NO: 56537.EP1033405-A2. |
| 263146 (302 letters) | e-150 | >gnl\|Derwent\|AAC38615 844 BP.Arabidopsis thaliana DNA fragment SEQ ID NO: 21618.EP1033405-A2. |
| 263154 (1015 letters) | 4e-09 | >gnl\|Derwent\|AAC45825 1005 BP.Arabidopsis thaliana DNA fragment SEQ ID NO: 47899.EP1033405-A2. |
| 263157 (647 letters) | 0.0 | >gnl\|Derwent\|AAA08367 937 BP.A. thaliana transcription factor DREB1B nucleotide sequence SEQ ID NO:5.JP2000060558-A. |
| 263177 (842 letters) | 0.0 | >gnl\|Derwent\|AAC41644 849 BP.Arabidopsis thaliana DNA fragment SEQ ID NO: 32616.EP1033405-A2. |
| 263180 (976 letters) | 0.0 | >gnl\|Derwent\|AAC50981 1280 BP.Arabidopsis thaliana DNA fragment SEQ ID NO: 66837.EP1033405-A2. |
| 263181 (526 letters) | 0.0 | >gnl\|Derwent\|AAC36032 991 BP.Arabidopsis thaliana DNA fragment SEQ ID NO: 12299.EP1033405-A2. |
| 263182 (715 letters) | 0.0 | >gnl\|Derwent\|AAC44850 1140 BP.Arabidopsis thaliana DNA fragment SEQ ID NO: 44366.EP1033405-A2. |
| 263184 (627 letters) | 0.0 | >gnl\|Derwent\|AAA15014 827 BP.cDNA encoding the Arabidopsis AGL9 protein.WO200023578-A2. |
| 263186 (551 letters) | 0.0 | >gnl\|Derwent\|AAC51108 923 BP.Arabidopsis thaliana DNA fragment SEQ ID NO: 67304.EP1033405-A2. |
| 263187 Contig C (497 letters) | 8e-09 | >gnl\|Derwent\|AAC43611 1062 BP.Arabidopsis thaliana DNA fragment SEQ ID NO: 39856.EP1033405-A2. |
| 263191 Contig B (458 letters) | 9e-55 | >gnl\|Derwent\|AAC51184 1327 BP.Arabidopsis thaliana DNA fragment SEQ ID NO: 67576.EP1033405-A2. |
| 263194 (604 letters) | 0.0 | >gnl\|Derwent\|AAC38871 884 BP.Arabidopsis thaliana DNA fragment SEQ ID NO: 22531.EP1033405-A2. |
| 263202 (502 letters) | 0.0 | >gnl\|Derwent\|AAC39942 604 BP.Arabidopsis thaliana DNA fragment SEQ ID NO: 26465.EP1033405-A2. |
| 263216 (761 letters) | 0.0 | >gnl\|Derwent\|AAA15012 1303 BP.cDNA encoding the Arabidopsis AGL2 protein.WO200023578-A2. |
| 263221 (607 letters) | 0.0 | >gnl\|Derwent\|AAC36483 1132 BP.Arabidopsis thaliana DNA fragment SEQ ID NO: 13976.EP1033405-A2. |
| 263224 Contig A (486 letters) | 0.0 | >gnl\|Derwent\|AAC42309 1432 BP.Arabidopsis thaliana DNA fragment SEQ ID NO: 35062.EP1033405-A2. |
| 263224 Contig B (378 letters) | 0.0 | >gnl\|Derwent\|AAC42309 1432 BP.Arabidopsis thaliana DNA fragment SEQ ID NO: 35062.EP1033405-A2. |

FIG. 5 continued

| Query Contig ID (length, bp) | Pz Score | Result |
|---|---|---|
| 263234 (442 letters) | 0.0 | >gnl\|Derwent\|AAC44850 1140 BP.Arabidopsis thaliana DNA fragment SEQ ID NO: 44366.EP1033405-A2. |
| 263245 (168 letters) | 9e-71 | >gnl\|Derwent\|AAC51272 1132 BP.Arabidopsis thaliana DNA fragment SEQ ID NO: 67908.EP1033405-A2. |
| 263246 (745 letters) | 0.0 | >gnl\|Derwent\|AAC42662 774 BP.Arabidopsis thaliana DNA fragment SEQ ID NO: 36392.EP1033405-A2. |
| 263249 (701 letters) | 0.0 | >gnl\|Derwent\|AAC47144 725 BP.Arabidopsis thaliana DNA fragment SEQ ID NO: 52723.EP1033405-A2. |
| 263255 (323 letters) | 3e-23 | >gnl\|Derwent\|AAC50564 1119 BP.Arabidopsis thaliana DNA fragment SEQ ID NO: 65311.EP1033405-A2. |
| 263262 (578 letters) | 0.0 | >gnl\|Derwent\|AAC49742 956 BP.Arabidopsis thaliana DNA fragment SEQ ID NO: 62273.EP1033405-A2. |
| 263263 Contig A (393 letters) | 0.0 | >gnl\|Derwent\|AAC38516 1504 BP.Arabidopsis thaliana DNA fragment SEQ ID NO: 21252.EP1033405-A2. |
| 263263 Contig B (172 letters) | 2e-68 | >gnl\|Derwent\|AAC38516 1504 BP.Arabidopsis thaliana DNA fragment SEQ ID NO: 21252.EP1033405-A2. |
| 263276 (709 letters) | 0.0 | >gnl\|Derwent\|AAC42728 705 BP.Arabidopsis thaliana DNA fragment SEQ ID NO: 36632.EP1033405-A2. |
| 263320 Contig B (148 letters) | 1e-41 | >gnl\|Derwent\|AAC34228 1209 BP.Arabidopsis thaliana DNA fragment SEQ ID NO: 5911.EP1033405-A2. |
| 263327 Contig A (324 letters) | 2e-48 | >gnl\|Derwent\|AAC37285 469 BP.Arabidopsis thaliana DNA fragment SEQ ID NO: 16832.EP1033405-A2. |
| 263327 Contig B (278 letters) | 1e-83 | >gnl\|Derwent\|AAC36032 991 BP.Arabidopsis thaliana DNA fragment SEQ ID NO: 12299.EP1033405-A2. |
| 263329 (340 letters) | e-159 | >gnl\|Derwent\|AAC41644 849 BP.Arabidopsis thaliana DNA fragment SEQ ID NO: 32616.EP1033405-A2. |
| 263342 Contig A (226 letters) | 6e-05 | >gnl\|Derwent\|AAC50564 1119 BP.Arabidopsis thaliana DNA fragment SEQ ID NO: 65311.EP1033405-A2. |
| 263367 (464 letters) | 0.0 | >gnl\|Derwent\|AAC38871 884 BP.Arabidopsis thaliana DNA fragment SEQ ID NO: 22531.EP1033405-A2. |
| 263514 (559 letters) | 1e-45 | >gnl\|Derwent\|AAC51184 1327 BP.Arabidopsis thaliana DNA fragment SEQ ID NO: 67576.EP1033405-A2. |
| 263534 (744 letters) | 7e-35 | >gnl\|Derwent\|AAC57217 388 BP.Eucalyptus grandis transcription factor DNA sequence #723.WO200053724-A2. |
| 263550 Contig A (481 letters) | 0.0 | >gnl\|Derwent\|AAC39436 947 BP.Arabidopsis thaliana DNA fragment SEQ ID NO: 24624.EP1033405-A2. |

FIG. 5 continued

| Query Contig ID (length, bp) | Pz Score | Result |
|---|---|---|
| 263550 Contig B (86 letters) | 2e-27 | >gnl\|Derwent\|AAC39436 947 BP.Arabidopsis thaliana DNA fragment SEQ ID NO: 24624.EP1033405-A2. |
| 263557 Contig A (598 letters) | 0.0 | >gnl\|Derwent\|AAC46845 959 BP.Arabidopsis thaliana DNA fragment SEQ ID NO: 51618.EP1033405-A2. |
| 263557 Contig B (342 letters) | e-148 | >gnl\|Derwent\|AAC46845 959 BP.Arabidopsis thaliana DNA fragment SEQ ID NO: 51618.EP1033405-A2. |
| 263611 Contig A (280 letters) | e-147 | >gnl\|Derwent\|AAC39647 1057 BP.Arabidopsis thaliana DNA fragment SEQ ID NO: 25396.EP1033405-A2. |
| 263611 Contig B (366 letters) | e-174 | >gnl\|Derwent\|AAC39647 1057 BP.Arabidopsis thaliana DNA fragment SEQ ID NO: 25396.EP1033405-A2. |
| 263633 (824 letters) | 2e-13 | >gnl\|Derwent\|AAC42124 1262 BP.Arabidopsis thaliana DNA fragment SEQ ID NO: 34373.EP1033405-A2. |
| 263635 (132 letters) | 2e-06 | >gnl\|Derwent\|AAA93929 978 BP.Arabidopsis thaliana bZIP gene TAG6.WO200053741-A1. |
| 263636 Contig A (177 letters) | 2e-22 | >gnl\|Derwent\|AAC45330 1138 BP.Arabidopsis thaliana DNA fragment SEQ ID NO: 46119.EP1033405-A2. |
| 263636 Contig B (119 letters) | 6e-25 | >gnl\|Derwent\|AAC45330 1138 BP.Arabidopsis thaliana DNA fragment SEQ ID NO: 46119.EP1033405-A2. |
| 263679 (998 letters) | 0.0 | >gnl\|Derwent\|AAA93928 1638 BP.Arabidopsis thaliana bZIP gene AHBP-1b.WO200053741-A1. |
| 316712 (315 letters) | e-163 | >gnl\|Derwent\|AAC39647 1057 BP.Arabidopsis thaliana DNA fragment SEQ ID NO: 25396.EP1033405-A2. |
| 316731 (519 letters) | e-148 | >gnl\|Derwent\|AAC39647 1057 BP.Arabidopsis thaliana DNA fragment SEQ ID NO: 25396.EP1033405-A2. |
| 316741 (407 letters) | 0.0 | >gnl\|Derwent\|AAC49881 1041 BP.Arabidopsis thaliana DNA fragment SEQ ID NO: 62791.EP1033405-A2. |
| 316762 (390 letters) | 0.0 | >gnl\|Derwent\|AAC47651 804 BP.Arabidopsis thaliana DNA fragment SEQ ID NO: 54612.EP1033405-A2. |
| 316804 (447 letters) | e-120 | >gnl\|Derwent\|AAC44705 1359 BP.Arabidopsis thaliana DNA fragment SEQ ID NO: 43822.EP1033405-A2. |
| 316820 (105 letters) | 2e-45 | >gnl\|Derwent\|AAC46330 1152 BP.Arabidopsis thaliana DNA fragment SEQ ID NO: 49743.EP1033405-A2. |
| 316828 (377 letters) | e-175 | >gnl\|Derwent\|AAC45807 1236 BP.Arabidopsis thaliana DNA fragment SEQ ID NO: 47834.EP1033405-A2. |
| 316833 (145 letters) | 1e-54 | >gnl\|Derwent\|AAC49881 1041 BP.Arabidopsis thaliana DNA fragment SEQ ID NO: 62791.EP1033405-A2. |
| 316834 (637 letters) | 0.0 | >gnl\|Derwent\|AAC46330 1152 BP.Arabidopsis thaliana DNA fragment SEQ ID NO: 49743.EP1033405-A2. |

FIG. 5 continued

| Query Contig ID (length, bp) | Pz Score | Result |
|---|---|---|
| 316835 (380 letters) | 0.0 | >gnl\|Derwent\|AAA08367 937 BP.A. thaliana transcription factor DREB1B nucleotide sequence SEQ ID NO:5.JP2000060558-A. |
| 316837 (488 letters) | 0.0 | >gnl\|Derwent\|AAC48256 849 BP.Arabidopsis thaliana DNA fragment SEQ ID NO: 56825.EP1033405-A2. |
| 316847 (680 letters) | 0.0 | >gnl\|Derwent\|AAC39647 1057 BP.Arabidopsis thaliana DNA fragment SEQ ID NO: 25396.EP1033405-A2. |
| 316850 (155 letters) | 3e-58 | >gnl\|Derwent\|AAC49881 1041 BP.Arabidopsis thaliana DNA fragment SEQ ID NO: 62791.EP1033405-A2. |
| 316857 (319 letters) | e-103 | >gnl\|Derwent\|AAC45807 1236 BP.Arabidopsis thaliana DNA fragment SEQ ID NO: 47834.EP1033405-A2. |
| 316860 (550 letters) | 1e-60 | >gnl\|Derwent\|AAC37149 389 BP.Arabidopsis thaliana DNA fragment SEQ ID NO: 16357.EP1033405-A2. |
| 316861 (395 letters) | e-139 | >gnl\|Derwent\|AAC54301 1087 BP.Arabidopsis thaliana DNA fragment SEQ ID NO: 77399.EP1033405-A2. |
| 316883 (639 letters) | 0.0 | >gnl\|Derwent\|AAA08367 937 BP.A. thaliana transcription factor DREB1B nucleotide sequence SEQ ID NO:5.JP2000060558-A. |
| 316886 (665 letters) | 0.0 | >gnl\|Derwent\|AAC48540 1056 BP.Arabidopsis thaliana DNA fragment SEQ ID NO: 57848.EP1033405-A2. |
| 316902 (587 letters) | 0.0 | >gnl\|Derwent\|AAC51442 1347 BP.Arabidopsis thaliana DNA fragment SEQ ID NO: 68538.EP1033405-A2. |
| 316903 (644 letters) | 0.0 | >gnl\|Derwent\|AAC48690 1338 BP.Arabidopsis thaliana DNA fragment SEQ ID NO: 58402.EP1033405-A2. |
| 316906 (657 letters) | 0.0 | >gnl\|Derwent\|AAC35225 811 BP.Arabidopsis thaliana DNA fragment SEQ ID NO: 9426.EP1033405-A2. |
| 316924 (630 letters) | e-109 | >gnl\|Derwent\|AAC49113 1598 BP.Arabidopsis thaliana DNA fragment SEQ ID NO: 59973.EP1033405-A2. |
| 316934 (379 letters) | e-177 | >gnl\|Derwent\|AAC42286 1400 BP.Arabidopsis thaliana DNA fragment SEQ ID NO: 34976.EP1033405-A2. |
| 316938 (683 letters) | 0.0 | >gnl\|Derwent\|AAA15012 1303 BP.cDNA encoding the Arabidopsis AGL2 protein.WO200023578-A2. |
| 316941 (654 letters) | 0.0 | >gnl\|Derwent\|AAC42313 1268 BP.Arabidopsis thaliana DNA fragment SEQ ID NO: 35078.EP1033405-A2. |
| 316944 (523 letters) | e-137 | >gnl\|Derwent\|AAA15012 1303 BP.cDNA encoding the Arabidopsis AGL2 protein.WO200023578-A2. |
| 316947 (651 letters) | 0.0 | >gnl\|Derwent\|AAC42313 1268 BP.Arabidopsis thaliana DNA fragment SEQ ID NO: 35078.EP1033405-A2. |
| 316970 (637 letters) | 3e-06 | >gnl\|Derwent\|AAC57279 613 BP.Eucalyptus grandis transcription factor DNA sequence #753.WO200053724-A2. |
| 316974 (639 letters) | 0.0 | >gnl\|Derwent\|AAC42407 846 BP.Arabidopsis thaliana DNA fragment SEQ ID NO: 35437.EP1033405-A2. |
| 316976 (686 letters) | 1e-14 | >gnl\|Derwent\|AAC47877 1205 BP.Arabidopsis thaliana DNA fragment SEQ ID NO: 55445.EP1033405-A2. |
| 316984 (574 letters) | 0.0 | >gnl\|Derwent\|AAC51442 1347 BP.Arabidopsis thaliana DNA fragment SEQ ID NO: 68538.EP1033405-A2. |
| 316996 (537 letters) | 0.0 | >gnl\|Derwent\|AAC42692 777 BP.Arabidopsis thaliana DNA fragment SEQ ID NO: 36498.EP1033405-A2. |
| 317014 (374 letters) | 0.0 | >gnl\|Derwent\|AAA59220 2148 BP.cDNA encoding an Arabidopsis aintegumenta (ANT) polypeptide.WO200040694-A2. |

FIG. 5 continued

| Query Contig ID (length, bp) | Pz Score | Result |
|---|---|---|
| 317021 (227 letters) | 8e-75 | >gnl\|Derwent\|AAC42407 846 BP.Arabidopsis thaliana DNA fragment SEQ ID NO: 35437.EP1033405-A2. |
| 317069 (330 letters) | 2e-91 | >gnl\|Derwent\|AAA15012 1303 BP.cDNA encoding the Arabidopsis AGL2 protein.WO200023578-A2. |
| 317079 (567 letters) | 4e-05 | >gnl\|Derwent\|AAC45099 2031 BP.Arabidopsis thaliana DNA fragment SEQ ID NO: 45296.EP1033405-A2. |
| 43445 Contig A (631 letters) | 2e-07 | >gnl\|Derwent\|AAC49753 651 BP.Arabidopsis thaliana DNA fragment SEQ ID NO: 62313.EP1033405-A2. |
| | | |
| 49360 (420 letters) | 3e-05 | >gnl\|Derwent\|AAC57216 384 BP.Eucalyptus grandis transcription factor DNA sequence #722.WO200053724-A2. |
| 57165 (619 letters) | 8e-28 | >gnl\|Derwent\|AAC38528 1190 BP.Arabidopsis thaliana DNA fragment SEQ ID NO: 21293.EP1033405-A2. |
| 57292 (367 letters) | 1e-47 | >gnl\|Derwent\|AAC57279 613 BP.Eucalyptus grandis transcription factor DNA sequence #753.WO200053724-A2. |
| 103896 (509 letters) | 7e-55 | >gnl\|Derwent\|AAG49265 332 AA.Arabidopsis thaliana protein fragment SEQ ID NO: 62306.EP1033405-A2. |
| 108274 (533 letters) | 6e-18 | >gnl\|Derwent\|AAB80018 284 AA.Corynebacterium glutamicum MP protein sequence SEQ ID NO:770.WO200100843-A2. |
| 108496 (631 letters) | 4e-59 | >gnl\|Derwent\|AAR41347 295 AA.Nastertium xyloglucanase.WO9317101-A. |
| 109562 (575 letters) | 7e-71 | >gnl\|Derwent\|AAG31359 735 AA.Arabidopsis thaliana protein fragment SEQ ID NO: 37646.EP1033405-A2. |
| 111048 (583 letters) | 2e-60 | >gnl\|Derwent\|AAG39774 420 AA.Arabidopsis thaliana protein fragment SEQ ID NO: 49264.EP1033405-A2. |
| 113072 (649 letters) | 4e-55 | >gnl\|Derwent\|AAG45706 202 AA.Arabidopsis thaliana protein fragment SEQ ID NO: 57416.EP1033405-A2. |
| 120624 (345 letters) | 2e-39 | >gnl\|Derwent\|AAY51874 621 AA.A. thaliana ACW1 protein.JP2000041685-A. |
| 20072 (310 letters) | 3e-22 | >gnl\|Derwent\|AAG12116 61 AA.Arabidopsis thaliana protein fragment SEQ ID NO: 11103.EP1033405-A2. |
| 43449 Contig A (626 letters) | 6e-11 | >gnl\|Derwent\|AAG53096 584 AA.Arabidopsis thaliana protein fragment SEQ ID NO: 67567.EP1033405-A2. |
| 44526 (881 letters) | 1e-41 | >gnl\|Derwent\|AAG59912 214 AA.Arabidopsis thaliana protein fragment SEQ ID NO: 77549.EP1033405-A2. |
| 52817 (630 letters) | 3e-80 | >gnl\|Derwent\|AAG12178 148 AA.Arabidopsis thaliana protein fragment SEQ ID NO: 11189.EP1033405-A2. |
| 53376 (895 letters) | e-137 | >gnl\|Derwent\|AAG07532 270 AA.Arabidopsis thaliana protein fragment SEQ ID NO: 4723.EP1033405-A2. |
| 57142 Contig B (608 letters) | 2e-94 | >gnl\|Derwent\|AAG07493 344 AA.Arabidopsis thaliana protein fragment SEQ ID NO: 4668.EP1033405-A2. |
| 57744 (504 letters) | 5e-65 | >gnl\|Derwent\|AAG48610 210 AA.Arabidopsis thaliana protein fragment SEQ ID NO: 61405.EP1033405-A2. |

FIG. 5 continued

A list of metabolite compounds present in altered levels relative to reference samples as chararacterized by gas chromatography, liquid chromatography, and/or mass spectrometry. This list corresponds to samples transfected with nucleic acid sequence, Seq ID#103535

| Seq ID | Chemical Class | Biochemical Class | Compound Name | Modification |
|---|---|---|---|---|
| 103535 | Acids - Hydroxy Alpha | Carbohydrates | Galacturonic acid | -31% to -81% |
| 103535 | Carbohydrates | Carbohydrates | Arabinose | 5% to 543% |
| 103535 | Carbohydrates | Carbohydrates | Glucose | -21% to -99% |
| 103535 | Carbohydrates | Carbohydrates | Mannose | -17% to -91% |
| 103535 | Carbohydrates | Carbohydrates | Xylose | -12% to -61% |

FIG. 6

| A list of metabolite compounds present in altered levels relative to reference samples as chararacterized by gas chromatography, liquid chromatography, and/or mass spectrometry. This list corresponds to samples transfected with nucleic acid sequence, Seq ID#103541 ||||| 
|---|---|---|---|---|
| Seq ID | Chemical Class | Biochemical Class | Compound Name | Modification |
| 103541 | Carbohydrates | Carbohydrates | Arabinose | -11% to -77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#103560

| Seq ID | Chemical Class | Biochemical Class | Compound Name | Modification |
|---|---|---|---|---|
| 103560 | Carbohydrates | Carbohydrates | Arabinose | -1% to -77% |
| 103560 | Carbohydrates | Carbohydrates | Glucose | -19% to -53% |

FIG. 6 continued

| | | | |
|---|---|---|---|
| \multicolumn{4}{|l|}{A list of metabolite compounds present in altered levels relative to reference samples as chararacterized by gas chromatography, liquid chromatography, and/or mass spectrometry. This list corresponds to samples transfected with nucleic acid sequence, Seq ID#103619} | | | |
| Seq ID | Chemical Class | Biochemical Class | Compound Name | Modification |
| 103619 | Acids - Hydroxy Alpha | Carbohydrates | Galacturonic acid | 29% to 234% |
| 103619 | Carbohydrates | Carbohydrates | Arabinose | 85% to 538% |
| 103619 | Carbohydrates | Carbohydrates | Glucose | -12% to -99% |
| 103619 | Carbohydrates | Carbohydrates | Rhamnose | 6% to 217% |
| 103619 | Carbohydrates | Carbohydrates | Xylose | 9% to 447% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#103718

| Seq ID | Chemical Class | Biochemical Class | Compound Name | Modification |
|---|---|---|---|---|
| 103718 | Acids - Hydroxy Alpha | Carbohydrates | Galacturonic acid | 7% to 1399% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#103752 | | | | |
|---|---|---|---|---|
| Seq ID | Chemical Class | Biochemical Class | Compound Name | Modification |
| 103752 | Acids - Hydroxy Alpha | Carbohydrates | Galacturonic acid | 9% to 14437% |
| 103752 | Carbohydrates | Carbohydrates | Glucose | 71% to 177% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#103896

| Seq ID | Chemical Class | Biochemical Class | Compound Name | Modification |
|---|---|---|---|---|
| 103896 | Amino Acids and Related Compounds | Amino Acids and Related Compounds | Arginine | 10% to 640% |
| 103896 | Amino Acids and Related Compounds | Amino Acids and Related Compounds | Cysteine | 10% to 600% |
| 103896 | Amino Acids and Related Compounds | Amino Acids and Related Compounds | Glycine | 15% to 460% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104005

| Seq ID | Chemical Class | Biochemical Class | Compound Name | Modification |
|---|---|---|---|---|
| 104005 | Amino Acids and Related Compounds | Amino Acids and Related Compounds | Cysteine | 15% to 410% |
| 104005 | Amino Acids and Related Compounds | Amino Acids and Related Compounds | Glycine | 25% to 340% |
| 104005 | Amino Acids and Related Compounds | Amino Acids and Related Compounds | Methionine | 15% to 80% |
| 104005 | Amino Acids and Related Compounds | Amino Acids and Related Compounds | Phenylalanine | 10% to 100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104065

| Seq ID | Chemical Class | Biochemical Class | Compound Name | Modification |
|---|---|---|---|---|
| 104065 | Acids - Hydroxy Alpha | Carbohydrates | Galacturonic acid | -2% to -75% |
| 104065 | Carbohydrates | Carbohydrates | Arabinose | -10% to -87% |
| 104065 | Carbohydrates | Carbohydrates | Glucose | -15% to -53% |
| 104065 | Carbohydrates | Carbohydrates | Mannose | 1% to 937% |
| 104065 | Carbohydrates | Carbohydrates | Xylose | 7% to 180% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#104067 | | | | |
|---|---|---|---|---|
| Seq ID | Chemical Class | Biochemical Class | Compound Name | Modification |
| 104067 | Carbohydrates | Carbohydrates | Arabinose | -17% to -86% |
| 104067 | Carbohydrates | Carbohydrates | Galactose | -11% to -70% |
| 104067 | Carbohydrates | Carbohydrates | Rhamnose | -5% to -67% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104081

| Seq ID | Chemical Class | Biochemical Class | Compound Name | Modification |
|---|---|---|---|---|
| 104081 | Sterols, Oxygenated Terpenes, and Other Isoprenoids | Terpenoids | beta-Sitosterol | 60% to 99% |
| 104081 | Sterols, Oxygenated Terpenes, and Other Isoprenoids | Terpenoids | Campesterol | 60% to 94% |
| 104081 | Sterols, Oxygenated Terpenes, and Other Isoprenoids | Terpenoids | Fucosterol | 70% to 117% |
| 104081 | Sterols, Oxygenated Terpenes, and Other Isoprenoids | Terpenoids | Stigmasta-4,22-dien-3-ol | 135% to 225% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104254

| Seq ID | Chemical Class | Biochemical Class | Compound Name | Modification |
|--------|----------------|-------------------|---------------|--------------|
| 104254 | Carbohydrates | Carbohydrates | Arabinose | 45% to 173% |
| 104254 | Carbohydrates | Carbohydrates | Galactose | 109% to 159% |
| 104254 | Carbohydrates | Carbohydrates | Glucose | -35% to -63% |
| 104254 | Carbohydrates | Carbohydrates | Mannose | 43% to 262% |
| 104254 | Carbohydrates | Carbohydrates | Rhamnose | 89% to 257% |
| 104254 | Carbohydrates | Carbohydrates | Xylose | 71% to 227% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104407

| Seq ID | Chemical Class | Biochemical Class | Compound Name | Modification |
|---|---|---|---|---|
| 104407 | Acids - Hydroxy Alpha | Carbohydrates | Galacturonic acid | -49% to -95% |
| 104407 | Carbohydrates | Carbohydrates | Arabinose | -43% to -95% |
| 104407 | Carbohydrates | Carbohydrates | Galactose | NQ |
| 104407 | Carbohydrates | Carbohydrates | Glucose | 1% to 64% |
| 104407 | Carbohydrates | Carbohydrates | Rhamnose | -59% to -97% |
| 104407 | Carbohydrates | Carbohydrates | Xylose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104475

| Seq ID | Chemical Class | Biochemical Class | Compound Name | Modification |
|---|---|---|---|---|
| 104475 | Acids - Hydroxy Alpha | Carbohydrates | Galacturonic acid | NQ |
| 104475 | Carbohydrates | Carbohydrates | Arabinose | -73% to -97% |
| 104475 | Carbohydrates | Carbohydrates | Glucose | 1% to 62% |
| 104475 | Carbohydrates | Carbohydrates | Rhamnose | -66% to -97% |
| 104475 | Carbohydrates | Carbohydrates | Xylose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104702

| Seq ID | Chemical Class | Biochemical Class | Compound Name | Modification |
|---|---|---|---|---|
| 104702 | Carbohydrates | Carbohydrates | Arabinose | NQ |
| 104702 | Carbohydrates | Carbohydrates | Galactose | -7% to -77% |
| 104702 | Carbohydrates | Carbohydrates | Glucose | -7% to -41% |
| 104702 | Carbohydrates | Carbohydrates | Rhamnose | -51% to -87% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104711

| Seq ID | Chemical Class | Biochemical Class | Compound Name | Modification |
|---|---|---|---|---|
| 104711 | Aldehydes, Ketones and Quinones | Aldehydes, Ketones and Quinones | 3-Phytylmenadione | New |
| 104711 | Amino Acids and Related Compounds | Amino Acids and Related Compounds | Valine | 100% to 935% |
| 104711 | Esters | Esters | F1-U1.076 Fatty Acid Ester | New |
| 104711 | Esters | Esters | F1-U1.119 Fatty Acid Ester | 171% to 285% |
| 104711 | Esters - Hydroxy | Acyl acetylglycerols | 2-Eicosanoyl-1-acetylglycerol | 142% to 237% |
| 104711 | Esters - Hydroxy | Acyl acetylglycerols | 2-Octadecanoyl-1-acetylglycerol | 105% to 175% |
| 104711 | Hydrocarbons | Hydrocarbons | Triacontane, 2-methyl- | 62% to 103% |
| 104711 | NA | NA | F1-U1.119 | New |
| 104711 | Sterols, Oxygenated Terpenes, and Other Isoprenoids | Prenylquinones | alpha-Tocopherol | 169% to 281% |
| 104711 | Sterols, Oxygenated Terpenes, and Other Isoprenoids | Terpenoids | beta-Sitosterol | 138% to 231% |
| 104711 | Sterols, Oxygenated Terpenes, and Other Isoprenoids | Prenylquinones | beta-Tocopherol | New |
| 104711 | Sterols, Oxygenated Terpenes, and Other Isoprenoids | Terpenoids | Campesterol | 60% to 76% |
| 104711 | Sterols, Oxygenated Terpenes, and Other Isoprenoids | Terpenoids | Cholesterol | 60% to 89% |
| 104711 | Sterols, Oxygenated Terpenes, and Other Isoprenoids | Terpenoids | Cycloartenol | New |
| 104711 | Sterols, Oxygenated Terpenes, and Other Isoprenoids | Terpenoids | F1-U1.173 Sterol | 210% to 350% |
| 104711 | Sterols, Oxygenated Terpenes, and Other Isoprenoids | Terpenoids | F1-U1.230A Sterol | 60% to 85% |
| 104711 | Sterols, Oxygenated Terpenes, and Other Isoprenoids | Terpenoids | Fucosterol | |
| 104711 | Sterols, Oxygenated Terpenes, and Other Isoprenoids | Terpenoids | Stigmasta-5,22-dien-3-ol, acetate | 111% to 186% |
| 104711 | Sterols, Oxygenated Terpenes, and Other Isoprenoids | Terpenoids | Stigmasterol | 68% to 114% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#104765

| Seq ID | Chemical Class | Biochemical Class | Compound Name | Modification |
|---|---|---|---|---|
| 104765 | Carbohydrates | Carbohydrates | Arabinose | NQ |
| 104765 | Carbohydrates | Carbohydrates | Galactose | -31% to -83% |
| 104765 | Carbohydrates | Carbohydrates | Mannose | -49% to -87% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104768

| Seq ID | Chemical Class | Biochemical Class | Compound Name | Modification |
|---|---|---|---|---|
| 104768 | Acids - Hydroxy Alpha | Carbohydrates | Galacturonic acid | -28% to -91% |
| 104768 | Carbohydrates | Carbohydrates | Arabinose | -3% to -100% |
| 104768 | Carbohydrates | Carbohydrates | Galactose | -17% to -94% |
| 104768 | Carbohydrates | Carbohydrates | Glucose | -7% to -41% |
| 104768 | Carbohydrates | Carbohydrates | Mannose | -10% to -100% |
| 104768 | Carbohydrates | Carbohydrates | Rhamnose | -19% to -75% |
| 104768 | Carbohydrates | Carbohydrates | Xylose | -11% to -66% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#104790

| Seq ID | Chemical Class | Biochemical Class | Compound Name | Modification |
|---|---|---|---|---|
| 104790 | Acids - Hydroxy Alpha | Carbohydrates | Galacturonic acid | 4% to 4500% |
| 104790 | Carbohydrates | Carbohydrates | Arabinose | 130% to 398% |
| 104790 | Carbohydrates | Carbohydrates | Glucose | -5% to -99% |
| 104790 | Carbohydrates | Carbohydrates | Mannose | 4% to 1603% |
| 104790 | Carbohydrates | Carbohydrates | Rhamnose | 25% to 17300% |
| 104790 | Carbohydrates | Carbohydrates | Xylose | 6% to 105% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#105019

| Seq ID | Chemical Class | Biochemical Class | Compound Name | Modification |
|---|---|---|---|---|
| 105019 | Acids - Hydroxy Alpha | Carbohydrates | Galacturonic acid | 37% to 173% |
| 105019 | Carbohydrates | Carbohydrates | Arabinose | 113% to 391% |
| 105019 | Carbohydrates | Carbohydrates | Galactose | 39% to 146% |
| 105019 | Carbohydrates | Carbohydrates | Glucose | -42% to -59% |
| 105019 | Carbohydrates | Carbohydrates | Mannose | 33% to 85% |
| 105019 | Carbohydrates | Carbohydrates | Xylose | -18% to -89% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#105143

| Seq ID | Chemical Class | Biochemical Class | Compound Name | Modification |
|---|---|---|---|---|
| 105143 | Acids - Hydroxy Alpha | Carbohydrates | Galacturonic acid | 7% to 195% |
| 105143 | Carbohydrates | Carbohydrates | Arabinose | 39% to 1433% |
| 105143 | Carbohydrates | Carbohydrates | Glucose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#105154

| Seq ID | Chemical Class | Biochemical Class | Compound Name | Modification |
|---|---|---|---|---|
| 105154 | Acids - Hydroxy Alpha | Carbohydrates | Galacturonic acid | -35% to -71% |
| 105154 | Carbohydrates | Carbohydrates | Galactose | -38% to -65% |
| 105154 | Carbohydrates | Carbohydrates | Glucose | 2% to 41% |
| 105154 | Carbohydrates | Carbohydrates | Mannose | -22% to -44% |
| 105154 | Carbohydrates | Carbohydrates | Xylose | -20% to -93% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#105187

| Seq ID | Chemical Class | Biochemical Class | Compound Name | Modification |
|---|---|---|---|---|
| 105187 | Acids - Hydroxy Alpha | Acid Pathway | Butanoic acid, 2,3,4-trihydroxy- | New |
| 105187 | Acids | Acids | Carbamic acid | 63% to 105% |
| 105187 | Acids - Hydroxy Alpha | Acid Pathway | Citric acid | 60% to 98% |
| 105187 | Acids - Hydroxy Alpha | Carbohydrates | Quinic acid | 533% to 889% |
| 105187 | Alcohols | Carbohydrates | Inositol | 114% to 190% |
| 105187 | Amino Acids and Related Compounds | Amino Acids and Related Compounds | Glutamic acid | 178% to 297% |
| 105187 | Amino Acids and Related Compounds | Amino Acids and Related Compounds | Proline, 5-oxo- | 60% to 89% |
| 105187 | Carbohydrates | Carbohydrates | F3-U0.821 Carbohydrate | 60% to 98% |
| 105187 | Carbohydrates | Carbohydrates | F3-U0.846 Carbohydrate | 219% to 365% |
| 105187 | Carbohydrates | Carbohydrates | F3-U0.848 Carbohydrate | 88% to 146% |
| 105187 | Carbohydrates | Carbohydrates | F3-U0.872 Hexose | New |
| 105187 | Carbohydrates | Carbohydrates | F3-U1.189 Carbohydrate | New |
| 105187 | Carbohydrates | Carbohydrates | Glucose | 97% to 413% |
| 105187 | NA | NA | F3-U0.751 | 482% to 803% |
| 105187 | NA | NA | F3-U1.253 | 60% to 84% |
| 105187 | Phenols and Related Compounds | Phenylpropanes and Derivatives | Chlorogenic acid | 122% to 203% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#105271

| Seq ID | Chemical Class | Biochemical Class | Compound Name | Modification |
|---|---|---|---|---|
| 105271 | Acids - Hydroxy Alpha | Carbohydrates | Galacturonic acid | -3% to -67% |
| 105271 | Carbohydrates | Carbohydrates | Galactose | -26% to -58% |
| 105271 | Carbohydrates | Carbohydrates | Glucose | -4% to -81% |
| 105271 | Carbohydrates | Carbohydrates | Mannose | 2% to 45% |
| 105271 | Carbohydrates | Carbohydrates | Rhamnose | -23% to -65% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#105272

| Seq ID | Chemical Class | Biochemical Class | Compound Name | Modification |
|---|---|---|---|---|
| 105272 | Acids - Hydroxy Alpha | Carbohydrates | Galacturonic acid | NQ |
| 105272 | Carbohydrates | Carbohydrates | Arabinose | NQ |
| 105272 | Carbohydrates | Carbohydrates | Galactose | NQ |
| 105272 | Carbohydrates | Carbohydrates | Glucose | NQ |
| 105272 | Carbohydrates | Carbohydrates | Mannose | NQ |
| 105272 | Carbohydrates | Carbohydrates | Rhamnose | NQ |
| 105272 | Carbohydrates | Carbohydrates | Xylose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#105352

| Seq ID | Chemical Class | Biochemical Class | Compound Name | Modification |
|---|---|---|---|---|
| 105352 | Acids - Hydroxy Alpha | Carbohydrates | Galacturonic acid | 23% to 2317% |
| 105352 | Carbohydrates | Carbohydrates | Arabinose | 82% to 319% |
| 105352 | Carbohydrates | Carbohydrates | Galactose | 83% to 297% |
| 105352 | Carbohydrates | Carbohydrates | Glucose | -29% to -93% |
| 105352 | Carbohydrates | Carbohydrates | Mannose | 23% to 72% |
| 105352 | Carbohydrates | Carbohydrates | Rhamnose | 7% to 135% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#105377

| Seq ID | Chemical Class | Biochemical Class | Compound Name | Modification |
|---|---|---|---|---|
| 105377 | Acids - Hydroxy Alpha | Carbohydrates | Galacturonic acid | -17% to -87% |
| 105377 | Carbohydrates | Carbohydrates | Arabinose | -71% to -97% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#105405

| Seq ID | Chemical Class | Biochemical Class | Compound Name | Modification |
|--------|----------------|-------------------|---------------|--------------|
| 105405 | Carbohydrates | Carbohydrates | Arabinose | 15% to 246% |
| 105405 | Carbohydrates | Carbohydrates | Glucose | -12% to -74% |
| 105405 | Carbohydrates | Carbohydrates | Mannose | 9% to 59% |
| 105405 | Carbohydrates | Carbohydrates | Xylose | -34% to -67% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#107101

| Seq ID | Chemical Class | Biochemical Class | Compound Name | Modification |
|---|---|---|---|---|
| 107101 | Acids - Hydroxy Alpha | Carbohydrates | Quinic acid | 60% to 76% |
| 107101 | Amino Acids and Related Compounds | Amino Acids and Related Compounds | Proline, 5-oxo- | -60% to -93% |
| 107101 | Carbohydrates | Carbohydrates | F3-U0.813 Carbohydrate | -60% to -76% |
| 107101 | Carbohydrates | Carbohydrates | F3-U0.830 Carbohydrate | NQ |
| 107101 | Carbohydrates | Carbohydrates | Fructose | -60% to -92% |
| 107101 | Phenols and Related Compounds | Phenylpropanes and Derivatives | Chlorogenic acid | -60% to -94% |

FIG. 6 continued

| A list of metabolite compounds present in altered levels relative to reference samples as characterized by gas chromatography, liquid chromatography, and/or mass spectrometry. This list corresponds to samples transfected with nucleic acid sequence, Seq ID#107421 | | | | |
|---|---|---|---|---|
| Seq ID | Chemical Class | Biochemical Class | Compound Name | Modification |
| 107421 | Carbohydrates | Carbohydrates | Glucose | -1% to -47% |
| 107421 | Carbohydrates | Carbohydrates | Mannose | -8% to -71% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#107594

| Seq ID | Chemical Class | Biochemical Class | Compound Name | Modification |
|--------|----------------|-------------------|---------------|--------------|
| 107594 | Carbohydrates  | Carbohydrates     | Glucose       | -1% to -57%  |
| 107594 | Carbohydrates  | Carbohydrates     | Rhamnose      | 6% to 89%    |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#107642

| Seq ID | Chemical Class | Biochemical Class | Compound Name | Modification |
|---|---|---|---|---|
| 107642 | Acids - Fatty | Fatty Acids and Related Waxes | Eicosanoic acid | -35% to -63% |
| 107642 | Acids - Fatty Unsat | Fatty Acids and Related Waxes | 9,12,15-Octadecatrienoic acid | -3% to -8% |
| 107642 | Acids - Fatty Unsat | Fatty Acids and Related Waxes | 9,12-Octadecadienoic acid | 5% to 37% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#108256

| Seq ID | Chemical Class | Biochemical Class | Compound Name | Modification |
|---|---|---|---|---|
| 108256 | Carbohydrates | Carbohydrates | Arabinose | 139% to 879% |
| 108256 | Carbohydrates | Carbohydrates | Galactose | 13% to 249% |
| 108256 | Carbohydrates | Carbohydrates | Glucose | -27% to -75% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#108274

| Seq ID | Chemical Class | Biochemical Class | Compound Name | Modification |
|---|---|---|---|---|
| 108274 | Acids - Fatty | Fatty Acids and Related Waxes | Eicosanoic acid | -60% to -85% |
| 108274 | Amino Acids and Related Compounds | Amino Acids and Related Compounds | Alanine | 60% to 515% |
| 108274 | Amino Acids and Related Compounds | Amino Acids and Related Compounds | Arginine | 60% to 1515% |
| 108274 | Amino Acids and Related Compounds | Amino Acids and Related Compounds | Aspartic acid | -60% to -80% |
| 108274 | Amino Acids and Related Compounds | Amino Acids and Related Compounds | Cysteine | 165% to 74425% |
| 108274 | Amino Acids and Related Compounds | Amino Acids and Related Compounds | Glutamic acid | 60% to 130% |
| 108274 | Amino Acids and Related Compounds | Amino Acids and Related Compounds | Glycine | 60% to 24190% |
| 108274 | Amino Acids and Related Compounds | Amino Acids and Related Compounds | Leucine | 60% to 450% |
| 108274 | Amino Acids and Related Compounds | Amino Acids and Related Compounds | Lysine | 60% to 195% |
| 108274 | Amino Acids and Related Compounds | Amino Acids and Related Compounds | Phenylalanine | 60% to 155% |
| 108274 | Amino Acids and Related Compounds | Amino Acids and Related Compounds | Proline | -75% to -90% |
| 108274 | Amino Acids and Related Compounds | Amino Acids and Related Compounds | Serine | 60% to 825% |
| 108274 | Amino Acids and Related Compounds | Amino Acids and Related Compounds | Threonine | 60% to 2660% |
| 108274 | Amino Acids and Related Compounds | Amino Acids and Related Compounds | Tyrosine | 60% to 285% |
| 108274 | Amino Acids and Related Compounds | Amino Acids and Related Compounds | Valine | 60% to 295% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#108358

| Seq ID | Chemical Class | Biochemical Class | Compound Name | Modification |
|---|---|---|---|---|
| 108358 | Carbohydrates | Carbohydrates | Glucose | -36% to -69% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#108404

| Seq ID | Chemical Class | Biochemical Class | Compound Name | Modification |
|---|---|---|---|---|
| 108404 | Carbohydrates | Carbohydrates | Arabinose | -16% to -64% |
| 108404 | Carbohydrates | Carbohydrates | Galactose | 1% to 103% |
| 108404 | Carbohydrates | Carbohydrates | Glucose | -11% to -49% |
| 108404 | Carbohydrates | Carbohydrates | Mannose | -47% to -86% |
| 108404 | Carbohydrates | Carbohydrates | Xylose | 2% to 109% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#108496

| Seq ID | Chemical Class | Biochemical Class | Compound Name | Modification |
|---|---|---|---|---|
| 108496 | Acids | Acids | Carbamic acid | New |
| 108496 | Acids | Acids | Hexanedioic acid | -60% to -95% |
| 108496 | Acids - Fatty | Fatty Acids and Related Waxes | Eicosanoic acid | 69% to 115% |
| 108496 | Acids - Fatty Unsat | Fatty Acids and Related Waxes | 6-Octadecenoic acid | 60% to 78% |
| 108496 | Acids - Fatty Unsat | Fatty Acids and Related Waxes | 9-Octadecenoic acid | 70% to 116% |
| 108496 | Acids - Hydroxy Alpha | Acid Pathway | Butanoic acid, 2,3,4-trihydroxy- | 71% to 157% |
| 108496 | Acids - Hydroxy Alpha | Acid Pathway | Citric acid | 60% to 150% |
| 108496 | Acids - Hydroxy Alpha | Acid Pathway | Malic acid | 67% to 225% |
| 108496 | Acids - Hydroxy Alpha | Carbohydrates | Quinic acid | -60% to -100% |
| 108496 | Alcohols | Carbohydrates | Inositol | -60% to -100% |
| 108496 | Amino Acids and Related Compounds | Amino Acids and Related Compounds | Alanine | 60% to 330% |
| 108496 | Amino Acids and Related Compounds | Amino Acids and Related Compounds | Cysteine | 135% to 4845% |
| 108496 | Amino Acids and Related Compounds | Amino Acids and Related Compounds | Glutamic acid | 105% to 496% |
| 108496 | Amino Acids and Related Compounds | Amino Acids and Related Compounds | Glycine | 115% to 2280% |
| 108496 | Amino Acids and Related Compounds | Amino Acids and Related Compounds | Leucine | 60% to 265% |
| 108496 | Amino Acids and Related Compounds | Amino Acids and Related Compounds | Proline, 5-oxo- | 61% to 185% |
| 108496 | Amino Acids and Related Compounds | Amino Acids and Related Compounds | Serine | 60% to 95% |
| 108496 | Amino Acids and Related Compounds | Amino Acids and Related Compounds | Threonine | 60% to 105% |
| 108496 | Amino Acids and Related Compounds | Amino Acids and Related Compounds | Tyrosine | 60% to 325% |
| 108496 | Amino Acids and Related Compounds | Amino Acids and Related Compounds | Valine | 60% to 200% |
| 108496 | Carbohydrates | Carbohydrates | F3-U0.770 Carbohydrate | New |
| 108496 | Carbohydrates | Carbohydrates | F3-U0.846 Carbohydrate | -60% to -82% |
| 108496 | Carbohydrates | Carbohydrates | F3-U0.872 Hexose | -60% to -80% |
| 108496 | Carbohydrates | Carbohydrates | F3-U1.189 Carbohydrate | New |
| 108496 | Carbohydrates | Carbohydrates | Fructose | -60% to -100% |
| 108496 | Carbohydrates | Carbohydrates | Glucose | -60% to -100% |
| 108496 | NA | NA | F3-U0.668 | NQ |
| 108496 | NA | NA | F3-U0.727 | 90% to 150% |
| 108496 | NA | NA | F3-U0.736 | New |
| 108496 | NA | NA | F3-U0.767 | -60% to -76% |
| 108496 | NA | NA | F3-U0.882 | New |
| 108496 | NA | NA | Fumaric acid | New |
| 108496 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109024

| Seq ID | Chemical Class | Biochemical Class | Compound Name | Modification |
|---|---|---|---|---|
| 109024 | Acids - Hydroxy Alpha | Acid Pathway | Butanoic acid, 2,3,4-trihydroxy- | 426% to 710% |
| 109024 | Acids - Hydroxy Alpha | Acid Pathway | Citric acid | 191% to 319% |
| 109024 | Acids - Hydroxy Alpha | Acid Pathway | Malic acid | 76% to 126% |
| 109024 | Alkaloids and Other Bases | Polyamines | 1,4-Butanediamine | 60% to 98% |
| 109024 | Amino Acids and Related Compounds | Amino Acids and Related Compounds | Aspartic acid | 185% to 309% |
| 109024 | Amino Acids and Related Compounds | Amino Acids and Related Compounds | Proline, 5-oxo- | 214% to 356% |
| 109024 | Carbohydrates | Carbohydrates | F3-U1.150 Carbohydrate | 88% to 146% |
| 109024 | Carbohydrates | Carbohydrates | Fructose | -70% to -100% |
| 109024 | Carbohydrates | Carbohydrates | Glucose | -65% to -100% |
| 109024 | NA | NA | F3-U0.668 | 125% to 208% |
| 109024 | NA | NA | F3-U0.751 | New |
| 109024 | NA | NA | F3-U0.882 | -60% to -95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109138

| Seq ID | Chemical Class | Biochemical Class | Compound Name | Modification |
|---|---|---|---|---|
| 109138 | Acids - Fatty | Fatty Acids and Related Waxes | Octadecanoic acid | 81% to 177% |
| 109138 | Acids - Fatty Unsat | Fatty Acids and Related Waxes | 9,12,15-Octadecatrienoic acid | -3% to -9% |
| 109138 | Acids - Fatty Unsat | Fatty Acids and Related Waxes | 9,12-Octadecadienoic acid | 5% to 35% |
| 109138 | Amino Acids and Related Compounds | Amino Acids and Related Compounds | Arginine | 200% to 1585% |
| 109138 | Amino Acids and Related Compounds | Amino Acids and Related Compounds | Aspartic acid | 40% to 145% |
| 109138 | Amino Acids and Related Compounds | Amino Acids and Related Compounds | Threonine | 30% to 175% |
| 109138 | Amino Acids and Related Compounds | Amino Acids and Related Compounds | Tyrosine | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109146

| Seq ID | Chemical Class | Biochemical Class | Compound Name | Modification |
|---|---|---|---|---|
| 109146 | Amino Acids and Related Compounds | Amino Acids and Related Compounds | Arginine | 55% to 770% |
| 109146 | Amino Acids and Related Compounds | Amino Acids and Related Compounds | Threonine | 25% to 175% |
| 109146 | Amino Acids and Related Compounds | Amino Acids and Related Compounds | Valine | 80% to 1370% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109175

| Seq ID | Chemical Class | Biochemical Class | Compound Name | Modification |
|---|---|---|---|---|
| 109175 | Acids - Fatty | Fatty Acids and Related Waxes | Eicosanoic acid | -60% to -100% |
| 109175 | Acids - Fatty Unsat | Fatty Acids and Related Waxes | 9-Octadecenoic acid | 60% to 175% |
| 109175 | Acids - Hydroxy | Amino Acids and Related Compounds | Shikimic acid | 131% to 219% |
| 109175 | Acids - Hydroxy Alpha | Acid Pathway | Butanoic acid, 2,3,4-trihydroxy- | New |
| 109175 | Acids - Hydroxy Alpha | Acid Pathway | Citric acid | 367% to 611% |
| 109175 | Acids - Hydroxy Alpha | Carbohydrates | Quinic acid | 179% to 299% |
| 109175 | Alcohols | Carbohydrates | Inositol | 68% to 114% |
| 109175 | Amino Acids and Related Compounds | Amino Acids and Related Compounds | Glutamic acid | 316% to 527% |
| 109175 | Amino Acids and Related Compounds | Amino Acids and Related Compounds | Glycine | New |
| 109175 | Amino Acids and Related Compounds | Amino Acids and Related Compounds | Proline, 5-oxo- | 139% to 232% |
| 109175 | Carbohydrates | Carbohydrates | F3-U0.816 Carbohydrate | 131% to 219% |
| 109175 | Carbohydrates | Carbohydrates | F3-U0.821 Carbohydrate | 367% to 611% |
| 109175 | Carbohydrates | Carbohydrates | F3-U0.825 Carbohydrate | New |
| 109175 | Carbohydrates | Carbohydrates | F3-U0.846 Carbohydrate | 4118% to 6863% |
| 109175 | Carbohydrates | Carbohydrates | F3-U0.872 Hexose | 2574% to 4290% |
| 109175 | Carbohydrates | Carbohydrates | F3-U1.189 Carbohydrate | New |
| 109175 | Carbohydrates | Carbohydrates | Glucose | 76% to 262% |
| 109175 | NA | NA | F3-U0.751 | 777% to 1296% |
| 109175 | NA | NA | F3-U0.838 | New |
| 109175 | Phenols and Related Compounds | Phenylpropanes and Derivatives | Chlorogenic acid | 361% to 602% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109191

| Seq ID | Chemical Class | Biochemical Class | Compound Name | Modification |
|---|---|---|---|---|
| 109191 | Carbohydrates | Carbohydrates | Arabinose | -17% to -100% |
| 109191 | Carbohydrates | Carbohydrates | Mannose | -37% to -100% |
| 109191 | Carbohydrates | Carbohydrates | Xylose | -77% to -97% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#109274 | | | | |
|---|---|---|---|---|
| Seq ID | Chemical Class | Biochemical Class | Compound Name | Modification |
| 109274 | Acids - Hydroxy Alpha | Carbohydrates | Galacturonic acid | 28% to 155% |
| 109274 | Carbohydrates | Carbohydrates | Arabinose | 69% to 295% |
| 109274 | Carbohydrates | Carbohydrates | Galactose | 28% to 127% |
| 109274 | Carbohydrates | Carbohydrates | Glucose | -33% to -83% |
| 109274 | Carbohydrates | Carbohydrates | Mannose | 26% to 75% |
| 109274 | Carbohydrates | Carbohydrates | Rhamnose | 8% to 281% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109329

| Seq ID | Chemical Class | Biochemical Class | Compound Name | Modification |
|---|---|---|---|---|
| 109329 | Acids - Hydroxy Alpha | Carbohydrates | Galacturonic acid | 4% to 136% |
| 109329 | Carbohydrates | Carbohydrates | Arabinose | 11% to 190% |
| 109329 | Carbohydrates | Carbohydrates | Galactose | 17% to 109% |
| 109329 | Carbohydrates | Carbohydrates | Glucose | -6% to -46% |
| 109329 | Carbohydrates | Carbohydrates | Mannose | 9% to 62% |
| 109329 | Carbohydrates | Carbohydrates | Rhamnose | 9% to 165% |
| 109329 | Carbohydrates | Carbohydrates | Xylose | 15% to 149% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109369

| Seq ID | Chemical Class | Biochemical Class | Compound Name | Modification |
|---|---|---|---|---|
| 109369 | Acids - Fatty | Fatty Acids and Related Waxes | Eicosanoic acid | -31% to -100% |
| 109369 | Acids - Fatty | Fatty Acids and Related Waxes | Hexadecanoic acid | -1% to -7% |
| 109369 | Acids - Fatty | Fatty Acids and Related Waxes | Octadecanoic acid | -18% to -40% |
| 109369 | Acids - Fatty Unsat | Fatty Acids and Related Waxes | 9,12,15-Octadecatrienoic acid | -4% to -13% |
| 109369 | Acids - Fatty Unsat | Fatty Acids and Related Waxes | 9,12-Octadecadienoic acid | 10% to 60% |
| 109369 | Acids - Fatty Unsat | Fatty Acids and Related Waxes | 9-Hexadecenoic acid | 14% to 48% |
| 109369 | Acids - Fatty Unsat | Fatty Acids and Related Waxes | 9-Octadecenoic acid | 47% to 219% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#109391

| Seq ID | Chemical Class | Biochemical Class | Compound Name | Modification |
|---|---|---|---|---|
| 109391 | Acids - Hydroxy | Amino Acids and Related Compounds | Shikimic acid | 242% to 404% |
| 109391 | Acids - Hydroxy Alpha | Acid Pathway | Butanoic acid, 2,3,4-trihydroxy- | 596% to 993% |
| 109391 | Acids - Hydroxy Alpha | Carbohydrates | Quinic acid | 191% to 318% |
| 109391 | Alcohols | Carbohydrates | Inositol | 79% to 132% |
| 109391 | Alkaloids and Other Bases | Polyamines | 1,4-Butanediamine | 84% to 140% |
| 109391 | Amino Acids and Related Compounds | Amino Acids and Related Compounds | Leucine | New |
| 109391 | Amino Acids and Related Compounds | Amino Acids and Related Compounds | Lysine | 60% to 255% |
| 109391 | Amino Acids and Related Compounds | Amino Acids and Related Compounds | Methionine | 330% to 1075% |
| 109391 | Amino Acids and Related Compounds | Amino Acids and Related Compounds | Serine | 60% to 145% |
| 109391 | Amino Acids and Related Compounds | Amino Acids and Related Compounds | Threonine | 115% to 235% |
| 109391 | Amino Acids and Related Compounds | Amino Acids and Related Compounds | Tryptophan | New |
| 109391 | Amino Acids and Related Compounds | Amino Acids and Related Compounds | Tyrosine | New |
| 109391 | Amino Acids and Related Compounds | Amino Acids and Related Compounds | Valine | 590% to 1440% |
| 109391 | Carbohydrates | Carbohydrates | F3-U0.813 Carbohydrate | 826% to 1377% |
| 109391 | Carbohydrates | Carbohydrates | F3-U0.816 Carbohydrate | 242% to 404% |
| 109391 | Carbohydrates | Carbohydrates | F3-U0.821 Carbohydrate | 318% to 530% |
| 109391 | Carbohydrates | Carbohydrates | F3-U0.825 Carbohydrate | 218% to 364% |
| 109391 | Carbohydrates | Carbohydrates | F3-U0.846 Carbohydrate | 494% to 824% |
| 109391 | Carbohydrates | Carbohydrates | F3-U0.872 Hexose | 377% to 629% |
| 109391 | Carbohydrates | Carbohydrates | Fructose | 70% to 196% |
| 109391 | Carbohydrates | Carbohydrates | Glucose | 123% to 336% |
| 109391 | NA | NA | F3-U0.882 | 87% to 144% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109411

| Seq ID | Chemical Class | Biochemical Class | Compound Name | Modification |
|---|---|---|---|---|
| 109411 | Carbohydrates | Carbohydrates | Arabinose | 9% to 221% |
| 109411 | Carbohydrates | Carbohydrates | Galactose | 3% to 107% |
| 109411 | Carbohydrates | Carbohydrates | Glucose | -7% to -61% |
| 109411 | Carbohydrates | Carbohydrates | Xylose | -36% to -100% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#109420

| Seq ID | Chemical Class | Biochemical Class | Compound Name | Modification |
|---|---|---|---|---|
| 109420 | Carbohydrates | Carbohydrates | Glucose | -1% to -35% |
| 109420 | Carbohydrates | Carbohydrates | Xylose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109513

| Seq ID | Chemical Class | Biochemical Class | Compound Name | Modification |
|---|---|---|---|---|
| 109513 | Carbohydrates | Carbohydrates | Arabinose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109523

| Seq ID | Chemical Class | Biochemical Class | Compound Name | Modification |
|---|---|---|---|---|
| 109523 | Carbohydrates | Carbohydrates | Galactose | -86% to -97% |
| 109523 | Carbohydrates | Carbohydrates | Glucose | -39% to -65% |
| 109523 | Carbohydrates | Carbohydrates | Mannose | -23% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#109562

| Seq ID | Chemical Class | Biochemical Class | Compound Name | Modification |
|---|---|---|---|---|
| 109562 | Amino Acids and Related Compounds | Amino Acids and Related Compounds | Cysteine | 20% to 205% |
| 109562 | Amino Acids and Related Compounds | Amino Acids and Related Compounds | Glycine | 25% to 215% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#110764

| Seq ID | Chemical Class | Biochemical Class | Compound Name | Modification |
|---|---|---|---|---|
| 110764 | Acids | Acids | Carbamic acid | -60% to -92% |
| 110764 | Acids - Hydroxy | Amino Acids and Related Compounds | Shikimic acid | 173% to 289% |
| 110764 | Acids - Hydroxy Alpha | Acid Pathway | Butanoic acid, 2,3,4-trihydroxy- | 536% to 894% |
| 110764 | Acids - Hydroxy Alpha | Acid Pathway | Citric acid | 269% to 448% |
| 110764 | Acids - Hydroxy Alpha | Carbohydrates | Glyceric acid | NQ |
| 110764 | Acids - Hydroxy Alpha | Carbohydrates | Quinic acid | 159% to 266% |
| 110764 | Alkaloids and Other Bases | Polyamines | 1,4-Butanediamine | 60% to 93% |
| 110764 | Alkaloids and Other Bases | Alkaloids and Other Bases | Nicotine | NQ |
| 110764 | Amino Acids and Related Compounds | Amino Acids and Related Compounds | Asparagine | NQ |
| 110764 | Amino Acids and Related Compounds | Amino Acids and Related Compounds | Aspartic acid | -67% to -100% |
| 110764 | Amino Acids and Related Compounds | Amino Acids and Related Compounds | Glutamic acid | NQ |
| 110764 | Amino Acids and Related Compounds | Amino Acids and Related Compounds | Glycine | NQ |
| 110764 | Amino Acids and Related Compounds | Amino Acids and Related Compounds | Proline | NQ |
| 110764 | Amino Acids and Related Compounds | Amino Acids and Related Compounds | Serine | NQ |
| 110764 | Carbohydrates | Carbohydrates | F3-U0.813 Carbohydrate | 389% to 648% |
| 110764 | Carbohydrates | Carbohydrates | F3-U0.816 Carbohydrate | 173% to 289% |
| 110764 | Carbohydrates | Carbohydrates | F3-U0.821 Carbohydrate | 269% to 448% |
| 110764 | Carbohydrates | Carbohydrates | F3-U0.825 Carbohydrate | 123% to 500% |
| 110764 | Carbohydrates | Carbohydrates | F3-U0.846 Carbohydrate | 526% to 876% |
| 110764 | Carbohydrates | Carbohydrates | F3-U0.872 Hexose | 379% to 631% |
| 110764 | Carbohydrates | Carbohydrates | F3-U0.952 Carbohydrate | NQ |
| 110764 | Carbohydrates | Carbohydrates | F3-U1.150 Carbohydrate | 90% to 151% |
| 110764 | Carbohydrates | Carbohydrates | F3-U1.189 Carbohydrate | NQ |
| 110764 | Carbohydrates | Carbohydrates | Fructose | -63% to -100% |
| 110764 | Carbohydrates | Carbohydrates | Galactose or Mannose | NQ |
| 110764 | NA | NA | F3-U0.668 | 74% to 124% |
| 110764 | NA | NA | F3-U0.751 | New |
| 110764 | NA | NA | F3-U1.229 | 159% to 265% |
| 110764 | Phenols and Related Compounds | Phenylpropanes and Derivatives | Chlorogenic acid | 163% to 272% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#110965

| Seq ID | Chemical Class | Biochemical Class | Compound Name | Modification |
|---|---|---|---|---|
| 110965 | Acids - Hydroxy Alpha | Carbohydrates | Galacturonic acid | 7% to 129% |
| 110965 | Carbohydrates | Carbohydrates | Arabinose | 28% to 106% |
| 110965 | Carbohydrates | Carbohydrates | Galactose | 8% to 63% |
| 110965 | Carbohydrates | Carbohydrates | Glucose | -3% to -68% |
| 110965 | Carbohydrates | Carbohydrates | Mannose | 3% to 44% |
| 110965 | Carbohydrates | Carbohydrates | Rhamnose | 30% to 133% |
| 110965 | Carbohydrates | Carbohydrates | Xylose | 30% to 53% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111048

| Seq ID | Chemical Class | Biochemical Class | Compound Name | Modification |
|---|---|---|---|---|
| 111048 | Amino Acids and Related Compounds | Amino Acids and Related Compounds | Cysteine | 5% to 305% |
| 111048 | Amino Acids and Related Compounds | Amino Acids and Related Compounds | Glycine | 15% to 255% |
| 111048 | Amino Acids and Related Compounds | Amino Acids and Related Compounds | Methionine | 15% to 75% |
| 111048 | Amino Acids and Related Compounds | Amino Acids and Related Compounds | Phenylalanine | 5% to 105% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111075

| Seq ID | Chemical Class | Biochemical Class | Compound Name | Modification |
|---|---|---|---|---|
| 111075 | Carbohydrates | Carbohydrates | Arabinose | 47% to 82% |
| 111075 | Carbohydrates | Carbohydrates | Glucose | -6% to -98% |
| 111075 | Carbohydrates | Carbohydrates | Mannose | 1% to 24% |
| 111075 | Carbohydrates | Carbohydrates | Rhamnose | 38% to 61% |
| 111075 | Carbohydrates | Carbohydrates | Xylose | 8% to 24% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111108

| Seq ID | Chemical Class | Biochemical Class | Compound Name | Modification |
|---|---|---|---|---|
| 111108 | Acids - Hydroxy Alpha | Carbohydrates | Galacturonic acid | -21% to -69% |
| 111108 | Carbohydrates | Carbohydrates | Arabinose | -7% to -67% |
| 111108 | Carbohydrates | Carbohydrates | Glucose | 15% to 67% |
| 111108 | Carbohydrates | Carbohydrates | Mannose | -29% to -61% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111139

| Seq ID | Chemical Class | Biochemical Class | Compound Name | Modification |
|---|---|---|---|---|
| 111139 | Amino Acids and Related Compounds | Amino Acids and Related Compounds | Glutamic acid | 85% to 240% |
| 111139 | Amino Acids and Related Compounds | Amino Acids and Related Compounds | Leucine | New |
| 111139 | Amino Acids and Related Compounds | Amino Acids and Related Compounds | Methionine | 185% to 675% |
| 111139 | Amino Acids and Related Compounds | Amino Acids and Related Compounds | Valine | 265% to 710% |
| 111139 | Carbohydrates | Carbohydrates | F3-U0.825 Carbohydrate | 79% to 131% |
| 111139 | Carbohydrates | Carbohydrates | F3-U0.846 Carbohydrate | 60% to 76% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111175

| Seq ID | Chemical Class | Biochemical Class | Compound Name | Modification |
|--------|----------------|-------------------|---------------|--------------|
| 111175 | Acids - Hydroxy Alpha | Carbohydrates | Galacturonic acid | 11% to 139% |
| 111175 | Carbohydrates | Carbohydrates | Arabinose | -55% to -91% |

FIG. 6 continued

A list of metabolite compounds present in altered levels relative to reference samples as charararacterized by gas chromatography, liquid chromatography, and/or mass spectrometry. This list corresponds to samples transfected with nucleic acid sequence, Seq ID#111223

| Seq ID | Chemical Class | Biochemical Class | Compound Name | Modification |
|---|---|---|---|---|
| 111223 | Acids - Hydroxy Alpha | Carbohydrates | Galacturonic acid | -22% to -56% |
| 111223 | Carbohydrates | Carbohydrates | Arabinose | -13% to -67% |
| 111223 | Carbohydrates | Carbohydrates | Galactose | -19% to -51% |
| 111223 | Carbohydrates | Carbohydrates | Glucose | 1% to 45% |
| 111223 | Carbohydrates | Carbohydrates | Mannose | -4% to -48% |
| 111223 | Carbohydrates | Carbohydrates | Rhamnose | -16% to -59% |
| 111223 | Carbohydrates | Carbohydrates | Xylose | -22% to -59% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111277

| Seq ID | Chemical Class | Biochemical Class | Compound Name | Modification |
|---|---|---|---|---|
| 111277 | Acids - Hydroxy Alpha | Carbohydrates | Galacturonic acid | 62% to 244% |
| 111277 | Carbohydrates | Carbohydrates | Arabinose | -3% to -77% |
| 111277 | Carbohydrates | Carbohydrates | Galactose | -24% to -67% |
| 111277 | Carbohydrates | Carbohydrates | Glucose | -3% to -38% |
| 111277 | Carbohydrates | Carbohydrates | Mannose | -43% to -85% |
| 111277 | Carbohydrates | Carbohydrates | Xylose | -7% to -83% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111312

| Seq ID | Chemical Class | Biochemical Class | Compound Name | Modification |
|---|---|---|---|---|
| 111312 | Acids - Hydroxy Alpha | Acid Pathway | Citric acid | 78% to 129% |
| 111312 | Alkaloids and Other Bases | Polyamines | 1,4-Butanediamine | 60% to 84% |
| 111312 | Amino Acids and Related Compounds | Amino Acids and Related Compounds | Alanine | 60% to 125% |
| 111312 | Amino Acids and Related Compounds | Amino Acids and Related Compounds | Asparagine | New |
| 111312 | Amino Acids and Related Compounds | Amino Acids and Related Compounds | Aspartic acid | 119% to 199% |
| 111312 | Amino Acids and Related Compounds | Amino Acids and Related Compounds | Glutamic acid | 294% to 490% |
| 111312 | Amino Acids and Related Compounds | Amino Acids and Related Compounds | Methionine | 80% to 445% |
| 111312 | Amino Acids and Related Compounds | Amino Acids and Related Compounds | Proline, 5-oxo- | 163% to 271% |
| 111312 | Amino Acids and Related Compounds | Amino Acids and Related Compounds | Serine | 60% to 105% |
| 111312 | Amino Acids and Related Compounds | Amino Acids and Related Compounds | Threonine | 60% to 235% |
| 111312 | Amino Acids and Related Compounds | Amino Acids and Related Compounds | Tryptophan | New |
| 111312 | Amino Acids and Related Compounds | Amino Acids and Related Compounds | Tyrosine | New |
| 111312 | Amino Acids and Related Compounds | Amino Acids and Related Compounds | Valine | 230% to 785% |
| 111312 | Carbohydrates | Carbohydrates | F3-U0.813 Carbohydrate | 401% to 668% |
| 111312 | Carbohydrates | Carbohydrates | F3-U0.816 Carbohydrate | 69% to 115% |
| 111312 | Carbohydrates | Carbohydrates | F3-U0.821 Carbohydrate | 78% to 129% |
| 111312 | Carbohydrates | Carbohydrates | F3-U0.846 Carbohydrate | 80% to 134% |
| 111312 | Carbohydrates | Carbohydrates | F3-U0.872 Hexose | 82% to 137% |
| 111312 | Carbohydrates | Carbohydrates | F3-U1.150 Carbohydrate | 132% to 221% |
| 111312 | Carbohydrates | Carbohydrates | F3-U1.189 Carbohydrate | New |
| 111312 | Carbohydrates | Carbohydrates | Fructose | 60% to 94% |
| 111312 | Carbohydrates | Carbohydrates | Galactose or Mannose | 70% to 117% |
| 111312 | Carbohydrates | Carbohydrates | Glucose | 82% to 136% |
| 111312 | NA | NA | F3-U0.751 | 65% to 108% |
| 111312 | NA | NA | F3-U1.229 | 287% to 478% |
| 111312 | NA | NA | F3-U1.253 | 94% to 157% |
| 111312 | NA | NA | F3-U1.255 | 89% to 149% |
| 111312 | Phenols and Related Compounds | Phenylpropanes and Derivatives | Chlorogenic acid | 85% to 142% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111358

| Seq ID | Chemical Class | Biochemical Class | Compound Name | Modification |
|---|---|---|---|---|
| 111358 | Carbohydrates | Carbohydrates | Arabinose | 1% to 125% |
| 111358 | Carbohydrates | Carbohydrates | Galactose | 7% to 154% |
| 111358 | Carbohydrates | Carbohydrates | Glucose | -4% to -91% |
| 111358 | Carbohydrates | Carbohydrates | Mannose | 29% to 402% |
| 111358 | Carbohydrates | Carbohydrates | Xylose | 167% to 391% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111429

| Seq ID | Chemical Class | Biochemical Class | Compound Name | Modification |
|---|---|---|---|---|
| 111429 | Amino Acids and Related Compounds | Amino Acids and Related Compounds | Arginine | 35% to 565% |
| 111429 | Amino Acids and Related Compounds | Amino Acids and Related Compounds | Cysteine | 20% to 215% |
| 111429 | Amino Acids and Related Compounds | Amino Acids and Related Compounds | Glycine | 30% to 240% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111437

| Seq ID | Chemical Class | Biochemical Class | Compound Name | Modification |
|---|---|---|---|---|
| 111437 | Acids - Hydroxy Alpha | Carbohydrates | Galacturonic acid | -59% to -74% |
| 111437 | Carbohydrates | Carbohydrates | Arabinose | -49% to -74% |
| 111437 | Carbohydrates | Carbohydrates | Galactose | -56% to -71% |
| 111437 | Carbohydrates | Carbohydrates | Glucose | -92% to -96% |
| 111437 | Carbohydrates | Carbohydrates | Mannose | -20% to -54% |
| 111437 | Carbohydrates | Carbohydrates | Rhamnose | -46% to -73% |
| 111437 | Carbohydrates | Carbohydrates | Xylose | -48% to -72% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111469

| Seq ID | Chemical Class | Biochemical Class | Compound Name | Modification |
|--------|----------------|-------------------|---------------|--------------|
| 111469 | Carbohydrates | Carbohydrates | Arabinose | -27% to -90% |
| 111469 | Carbohydrates | Carbohydrates | Galactose | -2% to -39% |
| 111469 | Carbohydrates | Carbohydrates | Glucose | -12% to -47% |
| 111469 | Carbohydrates | Carbohydrates | Mannose | 4% to 103% |
| 111469 | Carbohydrates | Carbohydrates | Rhamnose | 51% to 251% |
| 111469 | Carbohydrates | Carbohydrates | Xylose | -43% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111490

| Seq ID | Chemical Class | Biochemical Class | Compound Name | Modification |
|---|---|---|---|---|
| 111490 | Amino Acids and Related Compounds | Amino Acids and Related Compounds | Arginine | 15% to 475% |
| 111490 | Amino Acids and Related Compounds | Amino Acids and Related Compounds | Cysteine | 110% to 435% |
| 111490 | Amino Acids and Related Compounds | Amino Acids and Related Compounds | Glycine | 105% to 415% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111751

| Seq ID | Chemical Class | Biochemical Class | Compound Name | Modification |
|---|---|---|---|---|
| 111751 | Acids - Hydroxy Alpha | Carbohydrates | Galacturonic acid | 59% to 280% |
| 111751 | Carbohydrates | Carbohydrates | Arabinose | -28% to -75% |
| 111751 | Carbohydrates | Carbohydrates | Galactose | 2% to 320% |
| 111751 | Carbohydrates | Carbohydrates | Glucose | -10% to -77% |
| 111751 | Carbohydrates | Carbohydrates | Mannose | 8% to 86% |
| 111751 | Carbohydrates | Carbohydrates | Rhamnose | 12% to 573% |
| 111751 | Carbohydrates | Carbohydrates | Xylose | -6% to -94% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111752

| Seq ID | Chemical Class | Biochemical Class | Compound Name | Modification |
|---|---|---|---|---|
| 111752 | Acids - Hydroxy Alpha | Carbohydrates | Galacturonic acid | 65% to 507% |
| 111752 | Carbohydrates | Carbohydrates | Arabinose | -67% to -92% |
| 111752 | Carbohydrates | Carbohydrates | Galactose | 27% to 281% |
| 111752 | Carbohydrates | Carbohydrates | Glucose | -1% to -51% |
| 111752 | Carbohydrates | Carbohydrates | Xylose | -35% to -91% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#111758

| Seq ID | Chemical Class | Biochemical Class | Compound Name | Modification |
|---|---|---|---|---|
| 111758 | Acids - Hydroxy Alpha | Acid Pathway | Butanoic acid, 2,3,4-trihydroxy- | New |
| 111758 | Acids - Hydroxy | Amino Acids and Related Compounds | Shikimic acid | 197% to 328% |
| 111758 | Acids - Hydroxy Alpha | Carbohydrates | Quinic acid | 253% to 422% |
| 111758 | Alcohols | Carbohydrates | Inositol | 84% to 140% |
| 111758 | Amino Acids and Related Compounds | Amino Acids and Related Compounds | Glutamic acid | 465% to 774% |
| 111758 | Amino Acids and Related Compounds | Amino Acids and Related Compounds | Proline, 5-oxo- | 103% to 172% |
| 111758 | Carbohydrates | Carbohydrates | F3-U0.813 Carbohydrate | 740% to 1233% |
| 111758 | Carbohydrates | Carbohydrates | F3-U0.816 Carbohydrate | 197% to 328% |
| 111758 | Carbohydrates | Carbohydrates | F3-U0.821 Carbohydrate | 488% to 814% |
| 111758 | Carbohydrates | Carbohydrates | F3-U0.825 Carbohydrate | New |
| 111758 | Carbohydrates | Carbohydrates | F3-U0.846 Carbohydrate | 433% to 722% |
| 111758 | Carbohydrates | Carbohydrates | F3-U0.848 Carbohydrate | 115% to 192% |
| 111758 | Carbohydrates | Carbohydrates | F3-U0.872 Hexose | 343% to 571% |
| 111758 | Carbohydrates | Carbohydrates | F3-U1.150 Carbohydrate | 147% to 246% |
| 111758 | Carbohydrates | Carbohydrates | F3-U1.189 Carbohydrate | New |
| 111758 | Carbohydrates | Carbohydrates | F3-U1.194 Carbohydrate | New |
| 111758 | Carbohydrates | Carbohydrates | Glucose | 84% to 140% |
| 111758 | NA | NA | F3-U0.751 | 307% to 512% |
| 111758 | NA | NA | F3-U0.852A | New |
| 111758 | NA | NA | F3-U0.882 | -60% to -80% |
| 111758 | Phenols and Related Compounds | Phenylpropanes and Derivatives | Chlorogenic acid | 712% to 1186% |

FIG. 6 continued

| \multicolumn{4}{l|}{A list of metabolite compounds present in altered levels relative to reference samples as chararacterized by gas chromatography, liquid chromatography, and/or mass spectrometry. This list corresponds to samples transfected with nucleic acid sequence, Seq ID#111761} | | | |
|---|---|---|---|
| Seq ID | Chemical Class | Biochemical Class | Compound Name | Modification |
| 111761 | Acids - Hydroxy Alpha | Carbohydrates | Galacturonic acid | 11% to 164% |
| 111761 | Carbohydrates | Carbohydrates | Arabinose | 59% to 250% |
| 111761 | Carbohydrates | Carbohydrates | Galactose | 9% to 221% |
| 111761 | Carbohydrates | Carbohydrates | Glucose | -17% to -86% |
| 111761 | Carbohydrates | Carbohydrates | Mannose | 25% to 116% |
| 111761 | Carbohydrates | Carbohydrates | Rhamnose | 59% to 221% |
| 111761 | Carbohydrates | Carbohydrates | Xylose | 103% to 272% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#112105

| Seq ID | Chemical Class | Biochemical Class | Compound Name | Modification |
|---|---|---|---|---|
| 112105 | Acids | Acids | Carbamic acid | New |
| 112105 | Acids - Hydroxy Alpha | Acid Pathway | Citric acid | New |
| 112105 | Acids - Hydroxy Alpha | Acid Pathway | Malic acid | 60% to 250% |
| 112105 | Acids - Hydroxy Alpha | Carbohydrates | Quinic acid | 95% to 159% |
| 112105 | Alcohols | Alcohols | Glycerol | New |
| 112105 | Amino Acids and Related Compounds | Amino Acids and Related Compounds | Proline, 5-oxo- | New |
| 112105 | Carbohydrates | Carbohydrates | F3-U0.768 Carbohydrate | New |
| 112105 | Carbohydrates | Carbohydrates | F3-U0.813 Carbohydrate | New |
| 112105 | Carbohydrates | Carbohydrates | F3-U0.816 Carbohydrate | New |
| 112105 | Carbohydrates | Carbohydrates | F3-U0.821 Carbohydrate | New |
| 112105 | Carbohydrates | Carbohydrates | F3-U0.846 Carbohydrate | 60% to 560% |
| 112105 | Carbohydrates | Carbohydrates | F3-U0.872 Hexose | 108% to 473% |
| 112105 | Carbohydrates | Carbohydrates | F3-U1.189 Carbohydrate | New |
| 112105 | Carbohydrates | Carbohydrates | Fructose | -60% to -82% |
| 112105 | Carbohydrates | Carbohydrates | Glucose | -60% to -85% |
| 112105 | NA | NA | F3-U0.736 | New |
| 112105 | NA | NA | F3-U0.882 | New |
| 112105 | Phenols and Related Compounds | Phenylpropanes and Derivatives | Chlorogenic acid | New |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#112381 ||||
|---|---|---|---|
| Seq ID | Chemical Class | Biochemical Class | Compound Name | Modification |
| 112381 | Amino Acids and Related Compounds | Amino Acids and Related Compounds | Cysteine | 110% to 900% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#112417

| Seq ID | Chemical Class | Biochemical Class | Compound Name | Modification |
|---|---|---|---|---|
| 112417 | Acids - Hydroxy Alpha | Acid Pathway | Butanoic acid, 2,3,4-trihydroxy- | New |
| 112417 | Acids - Hydroxy Alpha | Acid Pathway | Citric acid | 293% to 488% |
| 112417 | Acids - Hydroxy Alpha | Carbohydrates | Quinic acid | 265% to 442% |
| 112417 | Alcohols | Carbohydrates | Inositol | 67% to 111% |
| 112417 | Amino Acids and Related Compounds | Amino Acids and Related Compounds | Glutamic acid | 117% to 195% |
| 112417 | Carbohydrates | Carbohydrates | F3-U0.813 Carbohydrate | 1167% to 1946% |
| 112417 | Carbohydrates | Carbohydrates | F3-U0.816 Carbohydrate | 234% to 389% |
| 112417 | Carbohydrates | Carbohydrates | F3-U0.821 Carbohydrate | 293% to 488% |
| 112417 | Carbohydrates | Carbohydrates | F3-U0.825 Carbohydrate | New |
| 112417 | Carbohydrates | Carbohydrates | F3-U0.846 Carbohydrate | 452% to 753% |
| 112417 | Carbohydrates | Carbohydrates | F3-U0.848 Carbohydrate | 70% to 116% |
| 112417 | Carbohydrates | Carbohydrates | F3-U0.872 Hexose | 341% to 569% |
| 112417 | Carbohydrates | Carbohydrates | F3-U1.150 Carbohydrate | 82% to 137% |
| 112417 | Carbohydrates | Carbohydrates | F3-U1.189 Carbohydrate | New |
| 112417 | Carbohydrates | Carbohydrates | Galactose | 72% to 120% |
| 112417 | NA | NA | F3-U0.842 | New |
| 112417 | NA | NA | F3-U0.852A | New |
| 112417 | Phenols and Related Compounds | Phenylpropanes and Derivatives | Chlorogenic acid | 328% to 547% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#113024

| Seq ID | Chemical Class | Biochemical Class | Compound Name | Modification |
|---|---|---|---|---|
| 113024 | Acids | Acids | Carbamic acid | 104% to 173% |
| 113024 | Acids | Acids | omega-Aminobutyric acid | New |
| 113024 | Acids - Hydroxy | Amino Acids and Related Compounds | Shikimic acid | 90% to 150% |
| 113024 | Acids - Hydroxy Alpha | Acid Pathway | Butanoic acid, 2,3,4-trihydroxy- | New |
| 113024 | Acids - Hydroxy Alpha | Acid Pathway | Citric acid | 71% to 344% |
| 113024 | Acids - Hydroxy Alpha | Carbohydrates | Glyceric acid | 222% to 370% |
| 113024 | Acids - Hydroxy Alpha | Acid Pathway | Malic acid | 74% to 123% |
| 113024 | Acids - Hydroxy Alpha | Carbohydrates | Quinic acid | 174% to 290% |
| 113024 | Alcohols | Carbohydrates | Inositol | 60% to 83% |
| 113024 | Amino Acids and Related Compounds | Amino Acids and Related Compounds | Aspartic acid | NQ |
| 113024 | Amino Acids and Related Compounds | Amino Acids and Related Compounds | Proline | 60% to 88% |
| 113024 | Carbohydrates | Carbohydrates | Arabinose or Xylose | -60% to -85% |
| 113024 | Carbohydrates | Carbohydrates | F3-U0.813 Carbohydrate | NQ |
| 113024 | Carbohydrates | Carbohydrates | F3-U0.816 Carbohydrate | 90% to 150% |
| 113024 | Carbohydrates | Carbohydrates | F3-U0.821 Carbohydrate | 71% to 344% |
| 113024 | Carbohydrates | Carbohydrates | F3-U0.846 Carbohydrate | 263% to 594% |
| 113024 | Carbohydrates | Carbohydrates | F3-U0.872 Hexose | 88% to 372% |
| 113024 | Carbohydrates | Carbohydrates | F3-U1.104 Carbohydrate | NQ |
| 113024 | Carbohydrates | Carbohydrates | F3-U1.150 Carbohydrate | 98% to 163% |
| 113024 | Carbohydrates | Carbohydrates | F3-U1.189 Carbohydrate | -65% to -100% |
| 113024 | Carbohydrates | Carbohydrates | F3-U1.194 Carbohydrate | NQ |
| 113024 | Carbohydrates | Carbohydrates | Galactose or Mannose | -60% to -86% |
| 113024 | Carbohydrates | Carbohydrates | Glucose | 60% to 94% |
| 113024 | NA | NA | F3-U0.714 | 90% to 150% |
| 113024 | NA | NA | F3-U0.727 | -60% to -79% |
| 113024 | NA | NA | F3-U0.751 | 132% to 220% |
| 113024 | NA | NA | F3-U1.253 | -64% to -100% |
| 113024 | NA | NA | F3-U1.255 | -60% to -96% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#113072

| Seq ID | Chemical Class | Biochemical Class | Compound Name | Modification |
|---|---|---|---|---|
| 113072 | Amino Acids and Related Compounds | Amino Acids and Related Compounds | Arginine | 45% to 405% |
| 113072 | Amino Acids and Related Compounds | Amino Acids and Related Compounds | Cysteine | 50% to 390% |
| 113072 | Amino Acids and Related Compounds | Amino Acids and Related Compounds | Glycine | 50% to 300% |
| 113072 | Amino Acids and Related Compounds | Amino Acids and Related Compounds | Phenylalanine | 5% to 160% |
| 113072 | Amino Acids and Related Compounds | Amino Acids and Related Compounds | Threonine | 20% to 75% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#113124

| Seq ID | Chemical Class | Biochemical Class | Compound Name | Modification |
|---|---|---|---|---|
| 113124 | Acids - Hydroxy Alpha | Acid Pathway | Butanoic acid, 2,3,4-trihydroxy- | 173% to 288% |
| 113124 | Acids - Hydroxy Alpha | Acid Pathway | Malic acid | 136% to 226% |
| 113124 | Acids - Hydroxy Alpha | Carbohydrates | Quinic acid | 60% to 84% |
| 113124 | Amino Acids and Related Compounds | Amino Acids and Related Compounds | Aspartic acid | 72% to 120% |
| 113124 | Amino Acids and Related Compounds | Amino Acids and Related Compounds | Glutamic acid | 65% to 109% |
| 113124 | Carbohydrates | Carbohydrates | F3-U0.952 Carbohydrate | 60% to 94% |
| 113124 | Carbohydrates | Carbohydrates | Glucose | 60% to 97% |
| 113124 | NA | NA | F3-U0.727 | 67% to 112% |
| 113124 | NA | NA | F3-U0.751 | 74% to 123% |
| 113124 | NA | NA | F3-U0.945 | New |
| 113124 | Phenols and Related Compounds | Phenylpropanes and Derivatives | Chlorogenic acid | 117% to 196% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#113170

| Seq ID | Chemical Class | Biochemical Class | Compound Name | Modification |
|---|---|---|---|---|
| 113170 | Acids - Hydroxy Alpha | Carbohydrates | Galacturonic acid | 10% to 76% |
| 113170 | Carbohydrates | Carbohydrates | Galactose | 7% to 79% |
| 113170 | Carbohydrates | Carbohydrates | Mannose | 1% to 97% |
| 113170 | Carbohydrates | Carbohydrates | Xylose | -69% to -89% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#113183

| Seq ID | Chemical Class | Biochemical Class | Compound Name | Modification |
|---|---|---|---|---|
| 113183 | Acids - Hydroxy Alpha | Acid Pathway | Butanoic acid, 2,3,4-trihydroxy- | 159% to 265% |
| 113183 | Acids - Hydroxy Alpha | Acid Pathway | Citric acid | 193% to 322% |
| 113183 | Acids - Hydroxy Alpha | Acid Pathway | Malic acid | 60% to 76% |
| 113183 | Acids - Hydroxy Alpha | Carbohydrates | Quinic acid | 109% to 182% |
| 113183 | Alkaloids and Other Bases | Alkaloids and Other Bases | Nicotine | 73% to 121% |
| 113183 | Carbohydrates | Carbohydrates | Arabinose or Xylose | NQ |
| 113183 | Carbohydrates | Carbohydrates | F3-U0.813 Carbohydrate | New |
| 113183 | Carbohydrates | Carbohydrates | F3-U0.821 Carbohydrate | 193% to 322% |
| 113183 | Carbohydrates | Carbohydrates | F3-U0.846 Carbohydrate | 432% to 720% |
| 113183 | Carbohydrates | Carbohydrates | F3-U0.872 Hexose | 89% to 148% |
| 113183 | Carbohydrates | Carbohydrates | F3-U0.952 Carbohydrate | -62% to -100% |
| 113183 | Carbohydrates | Carbohydrates | F3-U1.104 Carbohydrate | NQ |
| 113183 | Carbohydrates | Carbohydrates | F3-U1.189 Carbohydrate | -60% to -81% |
| 113183 | Carbohydrates | Carbohydrates | Fructose | -63% to -100% |
| 113183 | Carbohydrates | Carbohydrates | Glucose | -60% to -100% |
| 113183 | NA | NA | F3-U0.751 | 99% to 165% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#113595

| Seq ID | Chemical Class | Biochemical Class | Compound Name | Modification |
|---|---|---|---|---|
| 113595 | Acids - Hydroxy Alpha | Carbohydrates | Galacturonic acid | -29% to -89% |
| 113595 | Carbohydrates | Carbohydrates | Arabinose | -33% to -73% |
| 113595 | Carbohydrates | Carbohydrates | Galactose | -15% to -49% |
| 113595 | Carbohydrates | Carbohydrates | Mannose | -31% to -73% |
| 113595 | Carbohydrates | Carbohydrates | Rhamnose | -41% to -71% |
| 113595 | Carbohydrates | Carbohydrates | Xylose | -39% to -71% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#113742

| Seq ID | Chemical Class | Biochemical Class | Compound Name | Modification |
|---|---|---|---|---|
| 113742 | Acids - Hydroxy Alpha | Acid Pathway | Citric acid | 265% to 442% |
| 113742 | Acids - Hydroxy Alpha | Carbohydrates | Quinic acid | 60% to 84% |
| 113742 | Alkenes and Alkynes | Terpenoids | Limonene | 120% to 200% |
| 113742 | Amino Acids and Related Compounds | Amino Acids and Related Compounds | Asparagine | 121% to 201% |
| 113742 | Carbohydrates | Carbohydrates | F3-U0.821 Carbohydrate | 265% to 442% |
| 113742 | Carbohydrates | Carbohydrates | F3-U0.846 Carbohydrate | 336% to 560% |
| 113742 | Carbohydrates | Carbohydrates | F3-U0.872 Hexose | 84% to 141% |
| 113742 | Carbohydrates | Carbohydrates | F3-U1.104 Carbohydrate | NQ |
| 113742 | Carbohydrates | Carbohydrates | F3-U1.189 Carbohydrate | -62% to -100% |
| 113742 | Carbohydrates | Carbohydrates | F3-U1.194 Carbohydrate | -60% to -100% |
| 113742 | NA | NA | F3-U0.704 | New |
| 113742 | Phenols and Related Compounds | Phenylpropanes and Derivatives | Chlorogenic acid | -60% to -99% |
| 113742 | Sterols, Oxygenated Terpenes, and Other Isoprenoids | Prenylquinones | alpha-Tocopherol | 69% to 114% |
| 113742 | Sterols, Oxygenated Terpenes, and Other Isoprenoids | Prenylquinones | alpha-Tocopherol hydroquinone | New |
| 113742 | Sterols, Oxygenated Terpenes, and Other Isoprenoids | Terpenoids | beta-Sitosterol | 92% to 153% |
| 113742 | Sterols, Oxygenated Terpenes, and Other Isoprenoids | Prenylquinones | beta-Tocopherol | New |
| 113742 | Sterols, Oxygenated Terpenes, and Other Isoprenoids | Terpenoids | Campesterol | 60% to 78% |
| 113742 | Sterols, Oxygenated Terpenes, and Other Isoprenoids | Terpenoids | F1-U1.106 Sterol | 60% to 82% |
| 113742 | Sterols, Oxygenated Terpenes, and Other Isoprenoids | Terpenoids | F1-U1.122 Sterol | 60% to 97% |
| 113742 | Sterols, Oxygenated Terpenes, and Other Isoprenoids | Terpenoids | F1-U1.136 Sterol | 60% to 97% |
| 113742 | Sterols, Oxygenated Terpenes, and Other Isoprenoids | Prenylquinones | F1-U1.174 alpha-Tocopherol Isomer | New |
| 113742 | Sterols, Oxygenated Terpenes, and Other Isoprenoids | Prenylquinones | F1-U1.176 alpha-Tocopherol Isomer | New |
| 113742 | Sterols, Oxygenated Terpenes, and Other Isoprenoids | Prenylquinones | F1-U1.179 alpha-Tocopherol Isomer | New |
| 113742 | Sterols, Oxygenated Terpenes, and Other Isoprenoids | Terpenoids | F1-U1.217 Sterol | New |
| 113742 | Sterols, Oxygenated Terpenes, and Other Isoprenoids | Terpenoids | Stigmasterol | 66% to 109% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#114161

| Seq ID | Chemical Class | Biochemical Class | Compound Name | Modification |
|---|---|---|---|---|
| 114161 | Acids | Acids | Carbamic acid | 60% to 88% |
| 114161 | Acids | Acids | omega-Aminobutyric acid | 75% to 125% |
| 114161 | Acids - Hydroxy Alpha | Acid Pathway | Butanoic acid, 2,3,4-trihydroxy- | New |
| 114161 | Acids - Hydroxy Alpha | Acid Pathway | Citric acid | 127% to 375% |
| 114161 | Acids - Hydroxy Alpha | Carbohydrates | Glyceric acid | New |
| 114161 | Acids - Hydroxy Alpha | Acid Pathway | Malic acid | 64% to 191% |
| 114161 | Acids - Hydroxy Alpha | Carbohydrates | Quinic acid | 65% to 483% |
| 114161 | Alcohols | Carbohydrates | Inositol | 60% to 159% |
| 114161 | Alkaloids and Other Bases | Alkaloids and Other Bases | Nicotine | 134% to 224% |
| 114161 | Alkenes and Alkynes | Terpenoids | Limonene | 60% to 88% |
| 114161 | Amino Acids and Related Compounds | Amino Acids and Related Compounds | Glutamic acid | 136% to 305% |
| 114161 | Amino Acids and Related Compounds | Amino Acids and Related Compounds | Proline | 89% to 149% |
| 114161 | Carbohydrates | Carbohydrates | F3-U0.813 Carbohydrate | New |
| 114161 | Carbohydrates | Carbohydrates | F3-U0.816 Carbohydrate | 123% to 206% |
| 114161 | Carbohydrates | Carbohydrates | F3-U0.821 Carbohydrate | 127% to 375% |
| 114161 | Carbohydrates | Carbohydrates | F3-U0.825 Carbohydrate | NQ |
| 114161 | Carbohydrates | Carbohydrates | F3-U0.846 Carbohydrate | 65% to 853% |
| 114161 | Carbohydrates | Carbohydrates | F3-U0.848 Carbohydrate | -62% to -100% |
| 114161 | Carbohydrates | Carbohydrates | F3-U0.872 Hexose | 64% to 497% |
| 114161 | Carbohydrates | Carbohydrates | F3-U1.104 Carbohydrate | NQ |
| 114161 | Carbohydrates | Carbohydrates | F3-U1.189 Carbohydrate | New |
| 114161 | Carbohydrates | Carbohydrates | F3-U1.194 Carbohydrate | -60% to -77% |
| 114161 | Carbohydrates | Carbohydrates | Fructose | -60% to -99% |
| 114161 | Carbohydrates | Carbohydrates | Galactose or Mannose | -60% to -100% |
| 114161 | Carbohydrates | Carbohydrates | Glucose | 60% to 212% |
| 114161 | Esters | Fatty Acids and Related Waxes | Hexadecanoic acid, glyceryl ester | New |
| 114161 | NA | NA | F3-U0.751 | 90% to 194% |
| 114161 | NA | NA | F3-U0.852A | New |
| 114161 | NA | NA | F3-U0.882 | -60% to -81% |
| 114161 | NA | NA | F3-U1.229 | NQ |
| 114161 | NA | NA | F3-U1.253 | -60% to -89% |
| 114161 | Phenols and Related Compounds | Phenylpropanes and Derivatives | Chlorogenic acid | 186% to 703% |
| 114161 | Sterols, Oxygenated Terpenes, and Other Isoprenoids | Prenylquinones | alpha-Tocopherol hydroquinone | New |
| 114161 | Sterols, Oxygenated Terpenes, and Other Isoprenoids | Terpenoids | beta-Sitosterol | 68% to 113% |
| 114161 | Sterols, Oxygenated Terpenes, and Other Isoprenoids | Terpenoids | Campesterol | 84% to 141% |
| 114161 | Sterols, Oxygenated Terpenes, and Other Isoprenoids | Terpenoids | Cholesterol | 61% to 102% |
| 114161 | Sterols, Oxygenated Terpenes, and Other Isoprenoids | Terpenoids | Fucosterol | 75% to 125% |
| 114161 | Sterols, Oxygenated Terpenes, and Other Isoprenoids | Terpenoids | Stigmasterol | 81% to 135% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#114370

| Seq ID | Chemical Class | Biochemical Class | Compound Name | Modification |
|---|---|---|---|---|
| 114370 | Acids - Hydroxy Alpha | Carbohydrates | Galacturonic acid | 42% to 120% |
| 114370 | Carbohydrates | Carbohydrates | Arabinose | 11% to 211% |
| 114370 | Carbohydrates | Carbohydrates | Galactose | 9% to 298% |
| 114370 | Carbohydrates | Carbohydrates | Glucose | -34% to -71% |
| 114370 | Carbohydrates | Carbohydrates | Mannose | 10% to 89% |
| 114370 | Carbohydrates | Carbohydrates | Rhamnose | 34% to 191% |
| 114370 | Carbohydrates | Carbohydrates | Xylose | 45% to 171% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#114380

| Seq ID | Chemical Class | Biochemical Class | Compound Name | Modification |
|---|---|---|---|---|
| 114380 | Acids - Hydroxy Alpha | Carbohydrates | Galacturonic acid | -15% to -65% |
| 114380 | Carbohydrates | Carbohydrates | Arabinose | -3% to -92% |
| 114380 | Carbohydrates | Carbohydrates | Galactose | -15% to -43% |
| 114380 | Carbohydrates | Carbohydrates | Rhamnose | -14% to -57% |
| 114380 | Carbohydrates | Carbohydrates | Xylose | -7% to -51% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#114404 | | | | |
|---|---|---|---|---|
| Seq ID | Chemical Class | Biochemical Class | Compound Name | Modification |
| 114404 | Carbohydrates | Carbohydrates | Glucose | -1% to -63% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#114417

| Seq ID | Chemical Class | Biochemical Class | Compound Name | Modification |
|---|---|---|---|---|
| 114417 | Carbohydrates | Carbohydrates | Xylose | -9% to -83% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#114865

| Seq ID | Chemical Class | Biochemical Class | Compound Name | Modification |
|---|---|---|---|---|
| 114865 | Acids - Hydroxy Alpha | Acid Pathway | Butanoic acid, 2,3,4-trihydroxy- | New |
| 114865 | Acids - Hydroxy Alpha | Acid Pathway | Citric acid | 388% to 646% |
| 114865 | Acids - Hydroxy Alpha | Carbohydrates | Quinic acid | 342% to 570% |
| 114865 | Amino Acids and Related Compounds | Amino Acids and Related Compounds | Aspartic acid | 60% to 101% |
| 114865 | Amino Acids and Related Compounds | Amino Acids and Related Compounds | Glutamic acid | 221% to 369% |
| 114865 | Amino Acids and Related Compounds | Amino Acids and Related Compounds | Proline, 5-oxo- | 60% to 93% |
| 114865 | Carbohydrates | Carbohydrates | F3-U0.813 Carbohydrate | 99% to 164% |
| 114865 | Carbohydrates | Carbohydrates | F3-U0.846 Carbohydrate | 171% to 285% |
| 114865 | Carbohydrates | Carbohydrates | F3-U0.872 Hexose | 163% to 272% |
| 114865 | Carbohydrates | Carbohydrates | Glucose | 60% to 209% |
| 114865 | NA | NA | F3-U0.751 | 132% to 219% |
| 114865 | Phenols and Related Compounds | Phenylpropanes and Derivatives | Chlorogenic acid | 127% to 211% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#114926

| Seq ID | Chemical Class | Biochemical Class | Compound Name | Modification |
|---|---|---|---|---|
| 114926 | Acids - Fatty | Fatty Acids and Related Waxes | Hexadecanoic acid | 6% to 42% |
| 114926 | Acids - Fatty Branched | Fatty Acids and Related Waxes | Heptadecanoic acid, 16-methyl- | -1% to -70% |
| 114926 | Acids - Fatty Branched | Fatty Acids and Related Waxes | Hexadecanoic acid, 14-methyl- | -67% to -87% |
| 114926 | Acids - Fatty Unsat | Fatty Acids and Related Waxes | 9,12,15-Octadecatrienoic acid | -21% to -48% |
| 114926 | Acids - Fatty Unsat | Fatty Acids and Related Waxes | 9-Octadecenoic acid | -3% to -62% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#115121

| Seq ID | Chemical Class | Biochemical Class | Compound Name | Modification |
|---|---|---|---|---|
| 115121 | Acids - Hydroxy Alpha | Acid Pathway | Citric acid | 120% to 200% |
| 115121 | Acids - Hydroxy | Amino Acids and Related Compounds | Shikimic acid | 60% to 78% |
| 115121 | Acids - Hydroxy Alpha | Acid Pathway | Malic acid | 60% to 98% |
| 115121 | Carbohydrates | Carbohydrates | Arabinose or Xylose | NQ |
| 115121 | Carbohydrates | Carbohydrates | F3-U0.821 Carbohydrate | 120% to 200% |
| 115121 | Carbohydrates | Carbohydrates | F3-U0.846 Carbohydrate | 698% to 1164% |
| 115121 | Carbohydrates | Carbohydrates | F3-U0.872 Hexose | 161% to 269% |
| 115121 | Carbohydrates | Carbohydrates | F3-U1.104 Carbohydrate | NQ |
| 115121 | Carbohydrates | Carbohydrates | F3-U1.113 Carbohydrate | -60% to -86% |
| 115121 | Carbohydrates | Carbohydrates | F3-U1.194 Carbohydrate | NQ |
| 115121 | Carbohydrates | Carbohydrates | Fructose | -60% to -85% |
| 115121 | NA | NA | F3-U1.253 | -60% to -100% |
| 115121 | Phenols and Related Compounds | Phenylpropanes and Derivatives | Chlorogenic acid | -60% to -87% |
| 115121 | Sterols, Oxygenated Terpenes, and Other Isoprenoids | Prenylquinones | alpha-Tocopherol hydroquinone | New |
| 115121 | Sterols, Oxygenated Terpenes, and Other Isoprenoids | Terpenoids | Fucosterol | 68% to 113% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#116435

| Seq ID | Chemical Class | Biochemical Class | Compound Name | Modification |
|---|---|---|---|---|
| 116435 | Acids - Fatty | Fatty Acids and Related Waxes | Octadecanoic acid | 9% to 163% |
| 116435 | Acids - Fatty Unsat | Fatty Acids and Related Waxes | 7,10,13-Hexadecatrienoic acid | -3% to -51% |
| 116435 | Acids - Fatty Unsat | Fatty Acids and Related Waxes | 9,12,15-Octadecatrienoic acid | -2% to -20% |
| 116435 | Acids - Fatty Unsat | Fatty Acids and Related Waxes | 9,12-Octadecadienoic acid | -27% to -57% |
| 116435 | Acids - Fatty Unsat | Fatty Acids and Related Waxes | 9-Hexadecenoic acid | -21% to -71% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#116461

| Seq ID | Chemical Class | Biochemical Class | Compound Name | Modification |
|---|---|---|---|---|
| 116461 | Acids - Fatty Unsat | Fatty Acids and Related Waxes | 9,12,15-Octadecatrienoic acid | -2% to -18% |
| 116461 | Acids - Fatty Unsat | Fatty Acids and Related Waxes | 9,12-Octadecadienoic acid | 2% to 92% |
| 116461 | Acids - Fatty Unsat | Fatty Acids and Related Waxes | 9-Hexadecenoic acid | -12% to -62% |
| 116461 | Acids - Fatty Unsat | Fatty Acids and Related Waxes | 9-Octadecenoic acid | 35% to 244% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#116519

| Seq ID | Chemical Class | Biochemical Class | Compound Name | Modification |
|---|---|---|---|---|
| 116519 | Acids - Fatty | Fatty Acids and Related Waxes | Eicosanoic acid | -50% to -100% |
| 116519 | Acids - Fatty | Fatty Acids and Related Waxes | Hexadecanoic acid | 5% to 32% |
| 116519 | Acids - Fatty | Fatty Acids and Related Waxes | Octadecanoic acid | 27% to 228% |
| 116519 | Acids - Fatty Unsat | Fatty Acids and Related Waxes | 7,10,13-Hexadecatrienoic acid | -16% to -63% |
| 116519 | Acids - Fatty Unsat | Fatty Acids and Related Waxes | 9,12,15-Octadecatrienoic acid | -5% to -30% |
| 116519 | Acids - Fatty Unsat | Fatty Acids and Related Waxes | 9,12-Octadecadienoic acid | 6% to 85% |
| 116519 | Acids - Fatty Unsat | Fatty Acids and Related Waxes | 9-Hexadecenoic acid | -16% to -69% |
| 116519 | Acids - Fatty Unsat | Fatty Acids and Related Waxes | 9-Octadecenoic acid | 9% to 393% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#116525

| Seq ID | Chemical Class | Biochemical Class | Compound Name | Modification |
|---|---|---|---|---|
| 116525 | Acids - Fatty | Fatty Acids and Related Waxes | Eicosanoic acid | -5% to -39% |
| 116525 | Acids - Fatty Unsat | Fatty Acids and Related Waxes | 9,12-Octadecadienoic acid | 4% to 30% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#116686

| Seq ID | Chemical Class | Biochemical Class | Compound Name | Modification |
|---|---|---|---|---|
| 116686 | Acids - Hydroxy Alpha | Acid Pathway | Butanoic acid, 2,3,4-trihydroxy- | 393% to 656% |
| 116686 | Acids - Hydroxy Alpha | Acid Pathway | Citric acid | -60% to -76% |
| 116686 | Acids - Hydroxy Alpha | Carbohydrates | Glyceric acid | New |
| 116686 | Acids - Hydroxy Alpha | Carbohydrates | Quinic acid | 155% to 258% |
| 116686 | Carbohydrates | Carbohydrates | Arabinose or Xylose | New |
| 116686 | Carbohydrates | Carbohydrates | F3-U0.816 Carbohydrate | -60% to -78% |
| 116686 | Carbohydrates | Carbohydrates | F3-U0.821 Carbohydrate | -60% to -76% |
| 116686 | Carbohydrates | Carbohydrates | F3-U0.848 Carbohydrate | 180% to 300% |
| 116686 | Carbohydrates | Carbohydrates | Fructose | 114% to 208% |
| 116686 | Carbohydrates | Carbohydrates | Galactose or Mannose | New |
| 116686 | Carbohydrates | Carbohydrates | Glucose | 159% to 712% |
| 116686 | NA | NA | F3-U0.882 | 225% to 375% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#116692

| Seq ID | Chemical Class | Biochemical Class | Compound Name | Modification |
|---|---|---|---|---|
| 116692 | Esters | Esters | F1-U1.076 Fatty Acid Ester | 60% to 88% |
| 116692 | Sterols, Oxygenated Terpenes, and Other Isoprenoids | Prenylquinones | alpha-Tocopherol | 87% to 145% |
| 116692 | Sterols, Oxygenated Terpenes, and Other Isoprenoids | Prenylquinones | alpha-Tocopherol hydroquinone | 100% to 166% |
| 116692 | Sterols, Oxygenated Terpenes, and Other Isoprenoids | Prenylquinones | beta-Tocopherol | New |
| 116692 | Sterols, Oxygenated Terpenes, and Other Isoprenoids | Terpenoids | F1-U1.244 Sterol | New |
| 116692 | Sterols, Oxygenated Terpenes, and Other Isoprenoids | Terpenoids | Fucosterol | 114% to 189% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#116784

| Seq ID | Chemical Class | Biochemical Class | Compound Name | Modification |
|---|---|---|---|---|
| 116784 | Acids - Fatty | Fatty Acids and Related Waxes | Eicosanoic acid | -22% to -75% |
| 116784 | Acids - Fatty Unsat | Fatty Acids and Related Waxes | 9-Octadecenoic acid | 5% to 154% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#118051

| Seq ID | Chemical Class | Biochemical Class | Compound Name | Modification |
|---|---|---|---|---|
| 118051 | Acids - Hydroxy | Amino Acids and Related Compounds | Shikimic acid | 223% to 372% |
| 118051 | Acids - Hydroxy Alpha | Acid Pathway | Butanoic acid, 2,3,4-trihydroxy- | New |
| 118051 | Acids - Hydroxy Alpha | Acid Pathway | Citric acid | 678% to 1130% |
| 118051 | Acids - Hydroxy Alpha | Carbohydrates | Quinic acid | 475% to 791% |
| 118051 | Alcohols | Carbohydrates | Inositol | 262% to 436% |
| 118051 | Amino Acids and Related Compounds | Amino Acids and Related Compounds | Glutamic acid | 378% to 630% |
| 118051 | Amino Acids and Related Compounds | Amino Acids and Related Compounds | Proline | New |
| 118051 | Carbohydrates | Carbohydrates | Arabinose or Xylose | New |
| 118051 | Carbohydrates | Carbohydrates | F3-U0.813 Carbohydrate | 223% to 372% |
| 118051 | Carbohydrates | Carbohydrates | F3-U0.816 Carbohydrate | 3324% to 5540% |
| 118051 | Carbohydrates | Carbohydrates | F3-U0.846 Carbohydrate | 429% to 715% |
| 118051 | Carbohydrates | Carbohydrates | F3-U0.872 Hexose | 150% to 250% |
| 118051 | Carbohydrates | Carbohydrates | F3-U1.113 Carbohydrate | 144% to 241% |
| 118051 | Carbohydrates | Carbohydrates | F3-U1.150 Carbohydrate | New |
| 118051 | Carbohydrates | Carbohydrates | F3-U1.189 Carbohydrate | New |
| 118051 | Carbohydrates | Carbohydrates | F3-U1.194 Carbohydrate | New |
| 118051 | Carbohydrates | Carbohydrates | F3-U1.241 Carbohydrate | 60% to 90% |
| 118051 | Carbohydrates | Carbohydrates | Galactose or Mannose | 94% to 424% |
| 118051 | Carbohydrates | Carbohydrates | Glucose | -60% to -94% |
| 118051 | NA | NA | F3-U0.727 | New |
| 118051 | NA | NA | F3-U0.736 | 1079% to 1798% |
| 118051 | NA | NA | F3-U0.751 | 152% to 254% |
| 118051 | NA | NA | F3-U1.253 | 75% to 125% |
| 118051 | NA | NA | F3-U1.255 | 454% to 756% |
| 118051 | Phenols and Related Compounds | Phenylpropanes and Derivatives | Chlorogenic acid | |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#119262

| Seq ID | Chemical Class | Biochemical Class | Compound Name | Modification |
|---|---|---|---|---|
| 119262 | Acids - Hydroxy Alpha | Acid Pathway | Butanoic acid, 2,3,4-trihydroxy- | New |
| 119262 | Acids - Hydroxy | Amino Acids and Related Compounds | Shikimic acid | 157% to 261% |
| 119262 | Acids - Hydroxy Alpha | Acid Pathway | Citric acid | 214% to 356% |
| 119262 | Acids - Hydroxy Alpha | Acid Pathway | Malic acid | 60% to 97% |
| 119262 | Acids - Hydroxy Alpha | Carbohydrates | Quinic acid | 98% to 163% |
| 119262 | Alcohols | Carbohydrates | Inositol | 148% to 246% |
| 119262 | Amino Acids and Related Compounds | Amino Acids and Related Compounds | Glutamic acid | 75% to 126% |
| 119262 | Carbohydrates | Carbohydrates | Arabinose or Xylose | New |
| 119262 | Carbohydrates | Carbohydrates | F3-U0.813 Carbohydrate | New |
| 119262 | Carbohydrates | Carbohydrates | F3-U0.816 Carbohydrate | 157% to 261% |
| 119262 | Carbohydrates | Carbohydrates | F3-U0.821 Carbohydrate | 214% to 356% |
| 119262 | Carbohydrates | Carbohydrates | F3-U0.846 Carbohydrate | 1165% to 1942% |
| 119262 | Carbohydrates | Carbohydrates | F3-U0.848 Carbohydrate | 68% to 114% |
| 119262 | Carbohydrates | Carbohydrates | F3-U0.872 Hexose | 152% to 253% |
| 119262 | Carbohydrates | Carbohydrates | F3-U1.189 Carbohydrate | New |
| 119262 | Carbohydrates | Carbohydrates | Fructose | 69% to 144% |
| 119262 | Carbohydrates | Carbohydrates | Galactose or Mannose | 77% to 129% |
| 119262 | Carbohydrates | Carbohydrates | Glucose | 107% to 470% |
| 119262 | NA | NA | F3-U0.751 | 388% to 647% |
| 119262 | NA | NA | F3-U1.229 | 62% to 104% |
| 119262 | NA | NA | F3-U1.253 | 79% to 132% |
| 119262 | NA | NA | F3-U1.255 | 88% to 147% |
| 119262 | Phenols and Related Compounds | Phenylpropanes and Derivatives | Chlorogenic acid | 283% to 471% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#119350

| Seq ID | Chemical Class | Biochemical Class | Compound Name | Modification |
|---|---|---|---|---|
| 119350 | Esters | Esters | F1-U1.119 Fatty Acid Ester | NQ |
| 119350 | Esters - Hydroxy | Acyl acetylglycerols | 2-Eicosanoyl-1-acetylglycerol | -64% to -100% |
| 119350 | Esters - Hydroxy | Acyl acetylglycerols | 2-Octadecanoyl-1-acetylglycerol | -61% to -100% |
| 119350 | Hydrocarbons | Hydrocarbons | Hentriacontane | New |
| 119350 | Hydrocarbons | Hydrocarbons | Nonacosane, 3-methyl | New |
| 119350 | Sterols, Oxygenated Terpenes, and Other Isoprenoids | Terpenoids | beta-Sitosterol | -60% to -94% |
| 119350 | Sterols, Oxygenated Terpenes, and Other Isoprenoids | Terpenoids | Cholesterol | -60% to -84% |
| 119350 | Sterols, Oxygenated Terpenes, and Other Isoprenoids | Terpenoids | Fucosterol | -60% to -92% |
| 119350 | Sterols, Oxygenated Terpenes, and Other Isoprenoids | Terpenoids | Stigmasterol | -60% to -77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120147

| Seq ID | Chemical Class | Biochemical Class | Compound Name | Modification |
|---|---|---|---|---|
| 120147 | Alkaloids and Other Bases | Polyamines | 1,4-Butanediamine | 60% to 87% |
| 120147 | Alkenes and Alkynes | Terpenoids | Limonene | 108% to 180% |
| 120147 | Carbohydrates | Carbohydrates | F3-U1.194 Carbohydrate | NQ |
| 120147 | Esters | Esters | F1-U1.076 Fatty Acid Ester | 60% to 79% |
| 120147 | Esters | Esters | F1-U1.113 Fatty Acid Ester | 181% to 302% |
| 120147 | Esters - Hydroxy | Acyl acetylglycerols | 2-Eicosanoyl-1-acetylglycerol | 181% to 302% |
| 120147 | Esters - Hydroxy | Acyl acetylglycerols | 2-Octadecanoyl-1-acetylglycerol | 142% to 236% |
| 120147 | NA | NA | F1-U1.042 | 115% to 191% |
| 120147 | NA | NA | F3-U0.751 | -60% to -78% |
| 120147 | NA | NA | F3-U1.229 | 60% to 99% |
| 120147 | Phenols and Related Compounds | Phenylpropanes and Derivatives | Chlorogenic acid | -67% to -100% |
| 120147 | Sterols, Oxygenated Terpenes, and Other Isoprenoids | Prenylquinones | alpha-Tocopherol hydroquinone | New |
| 120147 | Sterols, Oxygenated Terpenes, and Other Isoprenoids | Terpenoids | beta-Sitosterol | 152% to 254% |
| 120147 | Sterols, Oxygenated Terpenes, and Other Isoprenoids | Terpenoids | Campesterol | 78% to 130% |
| 120147 | Sterols, Oxygenated Terpenes, and Other Isoprenoids | Terpenoids | Cholesterol | 81% to 135% |
| 120147 | Sterols, Oxygenated Terpenes, and Other Isoprenoids | Terpenoids | F1-U1.172 Sterol | 160% to 266% |
| 120147 | Sterols, Oxygenated Terpenes, and Other Isoprenoids | Terpenoids | F1-U1.230 Cycloartenol Isomer | 60% to 90% |
| 120147 | Sterols, Oxygenated Terpenes, and Other Isoprenoids | Terpenoids | Stigmasterol | 88% to 147% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120161

| Seq ID | Chemical Class | Biochemical Class | Compound Name | Modification |
|---|---|---|---|---|
| 120161 | Acids - Hydroxy Alpha | Acid Pathway | Butanoic acid, 2,3,4-trihydroxy- | 148% to 246% |
| 120161 | Acids - Hydroxy Alpha | Acid Pathway | Malic acid | 90% to 150% |
| 120161 | Acids - Hydroxy Alpha | Carbohydrates | Quinic acid | 60% to 87% |
| 120161 | Alcohols | Carbohydrates | Inositol | 60% to 93% |
| 120161 | Alkaloids and Other Bases | Polyamines | 1,4-Butanediamine | 77% to 128% |
| 120161 | Alkaloids and Other Bases | | Nicotine | New |
| 120161 | Amino Acids and Related Compounds | | Aspartic acid | 104% to 173% |
| 120161 | Amino Acids and Related Compounds | | Glutamic acid | 209% to 348% |
| 120161 | Amino Acids and Related Compounds | | Proline | 504% to 840% |
| 120161 | Amino Acids and Related Compounds | | Proline, 5-oxo- | 66% to 110% |
| 120161 | Amino Acids and Related Compounds | | Serine | 225% to 375% |
| 120161 | Carbohydrates | | F3-U0.813 Carbohydrate | 247% to 412% |
| 120161 | Carbohydrates | | F3-U0.816 Carbohydrate | 193% to 321% |
| 120161 | Carbohydrates | | F3-U0.821 Carbohydrate | 277% to 461% |
| 120161 | Carbohydrates | | F3-U0.825 Carbohydrate | New |
| 120161 | Carbohydrates | | F3-U0.846 Carbohydrate | 342% to 571% |
| 120161 | Carbohydrates | | F3-U0.872 Hexose | 198% to 331% |
| 120161 | Carbohydrates | | F3-U1.148 Carbohydrate | 159% to 265% |
| 120161 | Esters | | F1-U1.076 Fatty Acid Ester | 60% to 77% |
| 120161 | Esters | | F1-U1.113 Fatty Acid Ester | 73% to 122% |
| 120161 | Esters | | F1-U1.119 Fatty Acid Ester | 60% to 98% |
| 120161 | Esters - Hydroxy | Acyl acetylglycerols | 2-Eicosanoyl-1-acetylglycerol | 73% to 122% |
| 120161 | Esters - Hydroxy | Acyl acetylglycerols | 2-Octadecanoyl-1-acetylglycerol | 60% to 98% |
| 120161 | NA | NA | F3-U0.727 | 91% to 152% |
| 120161 | NA | NA | F3-U0.751 | 401% to 669% |
| 120161 | NA | NA | F3-U0.785B | New |
| 120161 | NA | NA | F3-U1.229 | 72% to 120% |
| 120161 | NA | NA | F3-U1.253 | 72% to 134% |
| 120161 | Phenols and Related Compounds | Phenylpropanes and Derivatives | Chlorogenic acid | 103% to 172% |
| 120161 | Sterols, Oxygenated Terpenes, and Other Isoprenoids | Prenylquinones | alpha-Tocopherol hydroquinone | New |
| 120161 | Sterols, Oxygenated Terpenes, and Other Isoprenoids | Terpenoids | Campesterol | 82% to 137% |
| 120161 | Sterols, Oxygenated Terpenes, and Other Isoprenoids | Terpenoids | Cholesterol | 60% to 77% |
| 120161 | Sterols, Oxygenated Terpenes, and Other Isoprenoids | Terpenoids | Stigmasterol | 68% to 113% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120246

| Seq ID | Chemical Class | Biochemical Class | Compound Name | Modification |
|---|---|---|---|---|
| 120246 | Acids - Hydroxy Alpha | Acid Pathway | Citric acid | 355% to 591% |
| 120246 | Acids - Hydroxy Alpha | Carbohydrates | Quinic acid | 164% to 273% |
| 120246 | Carbohydrates | Carbohydrates | Arabinose or Xylose | -60% to -88% |
| 120246 | Carbohydrates | Carbohydrates | F3-U0.813 Carbohydrate | New |
| 120246 | Carbohydrates | Carbohydrates | F3-U0.816 Carbohydrate | 120% to 200% |
| 120246 | Carbohydrates | Carbohydrates | F3-U0.821 Carbohydrate | 355% to 591% |
| 120246 | Carbohydrates | Carbohydrates | F3-U0.846 Carbohydrate | 879% to 1464% |
| 120246 | Carbohydrates | Carbohydrates | F3-U0.872 Hexose | 218% to 364% |
| 120246 | Carbohydrates | Carbohydrates | F3-U1.104 Carbohydrate | NQ |
| 120246 | Carbohydrates | Carbohydrates | Fructose | -60% to -86% |
| 120246 | Carbohydrates | Carbohydrates | Glucose | -60% to -87% |
| 120246 | NA | NA | F3-U0.852A | New |
| 120246 | NA | NA | F3-U0.882 | -60% to -85% |
| 120246 | NA | NA | F3-U1.253 | -60% to -79% |

FIG. 6 continued

A list of metabolite compounds present in altered levels relative to reference samples as charararcterized by gas chromatography, liquid chromatography, and/or mass spectrometry. This list corresponds to samples transfected with nucleic acid sequence, Seq ID#120342

| Seq ID | Chemical Class | Biochemical Class | Compound Name | Modification |
|---|---|---|---|---|
| 120342 | Acids - Hydroxy Alpha | Carbohydrates | Galacturonic acid | 69% to 421% |
| 120342 | Carbohydrates | Carbohydrates | Arabinose | 57% to 2765% |
| 120342 | Carbohydrates | Carbohydrates | Galactose | 79% to 737% |
| 120342 | Carbohydrates | Carbohydrates | Glucose | -35% to -67% |
| 120342 | Carbohydrates | Carbohydrates | Xylose | 57% to 745% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120557

| Seq ID | Chemical Class | Biochemical Class | Compound Name | Modification |
|---|---|---|---|---|
| 120557 | Carbohydrates | Carbohydrates | Arabinose | -3% to -95% |
| 120557 | Carbohydrates | Carbohydrates | Glucose | -25% to -57% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120624

| Seq ID | Chemical Class | Biochemical Class | Compound Name | Modification |
|---|---|---|---|---|
| 120624 | Amino Acids and Related Compounds | Amino Acids and Related Compounds | Aspartic acid | 55% to 135% |
| 120624 | Amino Acids and Related Compounds | Amino Acids and Related Compounds | Cysteine | 10% to 290% |
| 120624 | Amino Acids and Related Compounds | Amino Acids and Related Compounds | Glycine | 15% to 310% |
| 120624 | Amino Acids and Related Compounds | Amino Acids and Related Compounds | Proline | 5% to 220% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120670

| Seq ID | Chemical Class | Biochemical Class | Compound Name | Modification |
|---|---|---|---|---|
| 120670 | Esters | Esters | F1-U1.121 Fatty Acid Ester | NQ |
| 120670 | Sterols, Oxygenated Terpenes, and Other Isoprenoids | Terpenoids | Campesterol | NQ |
| 120670 | Sterols, Oxygenated Terpenes, and Other Isoprenoids | Terpenoids | Stigmasterol | 97% to 161% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120859

| Seq ID | Chemical Class | Biochemical Class | Compound Name | Modification |
|---|---|---|---|---|
| 120859 | Acids | Acids | Carbamic acid | 60% to 4446% |
| 120859 | Acids - Hydroxy Alpha | Acid Pathway | Malic acid | -60% to -77% |
| 120859 | Acids - Hydroxy Alpha | Carbohydrates | Quinic acid | 60% to 422% |
| 120859 | Alcohols | Carbohydrates | Inositol | 60% to 245% |
| 120859 | Carbohydrates | Carbohydrates | F3-U0.846 Carbohydrate | New |
| 120859 | Carbohydrates | Carbohydrates | F3-U0.872 Hexose | 60% to 201% |
| 120859 | Carbohydrates | Carbohydrates | F3-U0.952 Carbohydrate | 60% to 80% |
| 120859 | Carbohydrates | Carbohydrates | F3-U1.189 Carbohydrate | 66% to 110% |
| 120859 | Carbohydrates | Carbohydrates | Fructose | 69% to 658% |
| 120859 | Carbohydrates | Carbohydrates | Galactose or Mannose | 91% to 277% |
| 120859 | Carbohydrates | Carbohydrates | Glucose | 115% to 959% |
| 120859 | Carbohydrates | Carbohydrates | Sucrose | 60% to 146% |
| 120859 | NA | NA | F3-U0.751 | 79% to 132% |
| 120859 | NA | NA | F3-U0.799 | New |
| 120859 | NA | NA | F3-U0.882 | 76% to 126% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120870

| Seq ID | Chemical Class | Biochemical Class | Compound Name | Modification |
|---|---|---|---|---|
| 120870 | Acids | Acids | Carbamic acid | New |
| 120870 | Acids - Hydroxy Alpha | Acid Pathway | Malic acid | 90% to 150% |
| 120870 | Acids - Hydroxy Alpha | Carbohydrates | Quinic acid | 426% to 710% |
| 120870 | Alcohols | Carbohydrates | Inositol | 124% to 206% |
| 120870 | Amino Acids and Related Compounds | Amino Acids and Related Compounds | Proline, 5-oxo- | 101% to 168% |
| 120870 | Carbohydrates | Carbohydrates | F3-U0.768 Carbohydrate | New |
| 120870 | Carbohydrates | Carbohydrates | F3-U0.816 Carbohydrate | New |
| 120870 | Carbohydrates | Carbohydrates | F3-U0.821 Carbohydrate | 360% to 600% |
| 120870 | Carbohydrates | Carbohydrates | F3-U0.846 Carbohydrate | New |
| 120870 | Carbohydrates | Carbohydrates | F3-U0.872 Hexose | 362% to 603% |
| 120870 | Carbohydrates | Carbohydrates | Fructose | 64% to 106% |
| 120870 | Carbohydrates | Carbohydrates | Glucose | 122% to 248% |
| 120870 | Carbohydrates | Carbohydrates | Sucrose | 122% to 204% |
| 120870 | NA | NA | F3-U0.736 | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120925

| Seq ID | Chemical Class | Biochemical Class | Compound Name | Modification |
|---|---|---|---|---|
| 120925 | Acids - Fatty | Fatty Acids and Related Waxes | Hexadecanoic acid | 8% to 56% |
| 120925 | Acids - Fatty | Fatty Acids and Related Waxes | Octadecanoic acid | 20% to 136% |
| 120925 | Acids - Fatty Unsat | Fatty Acids and Related Waxes | 7,10,13-Hexadecatrienoic acid | -19% to -54% |
| 120925 | Acids - Fatty Unsat | Fatty Acids and Related Waxes | 9,12,15-Octadecatrienoic acid | -2% to -20% |
| 120925 | Acids - Fatty Unsat | Fatty Acids and Related Waxes | 9-Hexadecenoic acid | 16% to 77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120933

| Seq ID | Chemical Class | Biochemical Class | Compound Name | Modification |
|---|---|---|---|---|
| 120933 | Acids - Fatty | Fatty Acids and Related Waxes | Eicosanoic acid | -20% to -100% |
| 120933 | Acids - Fatty | Fatty Acids and Related Waxes | Hexadecanoic acid | 8% to 52% |
| 120933 | Acids - Fatty Branched | Fatty Acids and Related Waxes | Heptadecanoic acid, 16-methyl- | -52% to -100% |
| 120933 | Acids - Fatty Branched | Fatty Acids and Related Waxes | Hexadecanoic acid, 14-methyl- | -15% to -83% |
| 120933 | Acids - Fatty Unsat | Fatty Acids and Related Waxes | 7,10,13-Hexadecatrienoic acid | -10% to -48% |
| 120933 | Acids - Fatty Unsat | Fatty Acids and Related Waxes | 9,12,15-Octadecatrienoic acid | -1% to -21% |
| 120933 | Acids - Fatty Unsat | Fatty Acids and Related Waxes | 9,12-Octadecadienoic acid | 5% to 83% |
| 120933 | Acids - Fatty Unsat | Fatty Acids and Related Waxes | 9-Octadecenoic acid | -18% to -81% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#120952

| Seq ID | Chemical Class | Biochemical Class | Compound Name | Modification |
|---|---|---|---|---|
| 120952 | Acids - Hydroxy Alpha | Acid Pathway | Citric acid | -60% to -76% |
| 120952 | Acids - Hydroxy Alpha | Acid Pathway | Malic acid | 115% to 192% |
| 120952 | Amino Acids and Related Compounds | Amino Acids and Related Compounds | Asparagine | NQ |
| 120952 | Carbohydrates | Carbohydrates | F3-U0.816 Carbohydrate | -60% to -99% |
| 120952 | Carbohydrates | Carbohydrates | F3-U0.821 Carbohydrate | -60% to -76% |
| 120952 | Carbohydrates | Carbohydrates | F3-U0.846 Carbohydrate | -60% to -100% |
| 120952 | Carbohydrates | Carbohydrates | F3-U0.872 Hexose | -60% to -94% |
| 120952 | NA | NA | F3-U0.799 | NQ |
| 120952 | NA | NA | F3-U1.253 | 69% to 115% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence,
Seq ID#120979

| Seq ID | Chemical Class | Biochemical Class | Compound Name | Modification |
|---|---|---|---|---|
| 120979 | Acids - Hydroxy Alpha | Acid Pathway | Butanoic acid, 2,3,4-trihydroxy- | 456% to 760% |
| 120979 | Acids - Hydroxy Alpha | Carbohydrates | Quinic acid | 207% to 346% |
| 120979 | Amino Acids and Related Compounds | Amino Acids and Related Compounds | Glutamic acid | 134% to 224% |
| 120979 | Carbohydrates | Carbohydrates | F3-U0.848 Carbohydrate | 134% to 224% |
| 120979 | Carbohydrates | Carbohydrates | Glucose | 60% to 130% |
| 120979 | NA | NA | F3-U0.751 | 72% to 120% |
| 120979 | NA | NA | F3-U0.882 | 100% to 166% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#121144

| Seq ID | Chemical Class | Biochemical Class | Compound Name | Modification |
|---|---|---|---|---|
| 121144 | Acids - Hydroxy Alpha | Acid Pathway | Butanoic acid, 2,3,4-trihydroxy- | 386% to 643% |
| 121144 | Acids - Hydroxy Alpha | Acid Pathway | Citric acid | 60% to 82% |
| 121144 | Acids - Hydroxy Alpha | Carbohydrates | Quinic acid | 128% to 213% |
| 121144 | Carbohydrates | Carbohydrates | F3-U0.821 Carbohydrate | 60% to 82% |
| 121144 | Carbohydrates | Carbohydrates | F3-U0.846 Carbohydrate | 250% to 417% |
| 121144 | Carbohydrates | Carbohydrates | F3-U0.872 Hexose | 145% to 242% |
| 121144 | Carbohydrates | Carbohydrates | Fructose | 60% to 97% |
| 121144 | Carbohydrates | Carbohydrates | Glucose | 85% to 235% |
| 121144 | NA | NA | F3-U0.751 | 80% to 133% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#122182

| Seq ID | Chemical Class | Biochemical Class | Compound Name | Modification |
|---|---|---|---|---|
| 122182 | Amino Acids and Related Compounds | Amino Acids and Related Compounds | Arginine | 70% to 370% |
| 122182 | Amino Acids and Related Compounds | Amino Acids and Related Compounds | Histidine | 50% to 325% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#126117

| Seq ID | Chemical Class | Biochemical Class | Compound Name | Modification |
|---|---|---|---|---|
| 126117 | Acids - Fatty | Fatty Acids and Related Waxes | Hexadecanoic acid | -15% to -33% |
| 126117 | Acids - Fatty Unsat | Fatty Acids and Related Waxes | 7,10,13-Hexadecatrienoic acid | 17% to 97% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#126149

| Seq ID | Chemical Class | Biochemical Class | Compound Name | Modification |
|--------|----------------|-------------------|---------------|--------------|
| 126149 | Acids - Fatty | Fatty Acids and Related Waxes | Hexadecanoic acid | 7% to 49% |
| 126149 | Acids - Fatty Unsat | Fatty Acids and Related Waxes | 9,12,15-Octadecatrienoic acid | -5% to -29% |
| 126149 | Acids - Fatty Unsat | Fatty Acids and Related Waxes | 9,12-Octadecadienoic acid | 17% to 74% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#126157

| Seq ID | Chemical Class | Biochemical Class | Compound Name | Modification |
|---|---|---|---|---|
| 126157 | Acids - Fatty | Fatty Acids and Related Waxes | Hexadecanoic acid | -13% to -31% |
| 126157 | Acids - Fatty Unsat | Fatty Acids and Related Waxes | 9,12,15-Octadecatrienoic acid | 1% to 15% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#126168

| Seq ID | Chemical Class | Biochemical Class | Compound Name | Modification |
|---|---|---|---|---|
| 126168 | Acids - Fatty Unsat | Fatty Acids and Related Waxes | 9,12-Octadecadienoic acid | 6% to 40% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#126335

| Seq ID | Chemical Class | Biochemical Class | Compound Name | Modification |
|---|---|---|---|---|
| 126335 | Acids - Fatty | Fatty Acids and Related Waxes | Hexadecanoic acid | 13% to 41% |
| 126335 | Acids - Fatty | Fatty Acids and Related Waxes | Octadecanoic acid | 87% to 363% |
| 126335 | Acids - Fatty Unsat | Fatty Acids and Related Waxes | 7,10,13-Hexadecatrienoic acid | -5% to -44% |
| 126335 | Acids - Fatty Unsat | Fatty Acids and Related Waxes | 9,12,15-Octadecatrienoic acid | -7% to -17% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#126358

| Seq ID | Chemical Class | Biochemical Class | Compound Name | Modification |
|---|---|---|---|---|
| 126358 | Acids - Fatty Unsat | Fatty Acids and Related Waxes | 9,12-Octadecadienoic acid | -7% to -29% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#126367

| Seq ID | Chemical Class | Biochemical Class | Compound Name | Modification |
|---|---|---|---|---|
| 126367 | Acids - Fatty | Fatty Acids and Related Waxes | Hexadecanoic acid | 12% to 41% |
| 126367 | Acids - Fatty | Fatty Acids and Related Waxes | Octadecanoic acid | 116% to 432% |
| 126367 | Acids - Fatty Branched | Fatty Acids and Related Waxes | Heptadecanoic acid, 16-methyl- | -36% to -97% |
| 126367 | Acids - Fatty Unsat | Fatty Acids and Related Waxes | 9,12,15-Octadecatrienoic acid | -7% to -18% |
| 126367 | Acids - Fatty Unsat | Fatty Acids and Related Waxes | 9,12-Octadecadienoic acid | -6% to -38% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#126374

| Seq ID | Chemical Class | Biochemical Class | Compound Name | Modification |
|---|---|---|---|---|
| 126374 | Acids - Fatty | Fatty Acids and Related Waxes | Hexadecanoic acid | -34% to -47% |
| 126374 | Acids - Fatty | Fatty Acids and Related Waxes | Octadecanoic acid | -41% to -76% |
| 126374 | Acids - Fatty Unsat | Fatty Acids and Related Waxes | 7,10,13-Hexadecatrienoic acid | 38% to 133% |
| 126374 | Acids - Fatty Unsat | Fatty Acids and Related Waxes | 9,12,15-Octadecatrienoic acid | 8% to 23% |
| 126374 | Acids - Fatty Unsat | Fatty Acids and Related Waxes | 9-Hexadecenoic acid | -23% to -52% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#126375

| Seq ID | Chemical Class | Biochemical Class | Compound Name | Modification |
|---|---|---|---|---|
| 126375 | Acids - Fatty | Fatty Acids and Related Waxes | Hexadecanoic acid | 20% to 50% |
| 126375 | Acids - Fatty | Fatty Acids and Related Waxes | Octadecanoic acid | 87% to 362% |
| 126375 | Acids - Fatty Unsat | Fatty Acids and Related Waxes | 7,10,13-Hexadecatrienoic acid | -2% to -42% |
| 126375 | Acids - Fatty Unsat | Fatty Acids and Related Waxes | 9,12,15-Octadecatrienoic acid | -9% to -20% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#126534

| Seq ID | Chemical Class | Biochemical Class | Compound Name | Modification |
|---|---|---|---|---|
| 126534 | Acids - Fatty Unsat | Fatty Acids and Related Waxes | 9,12,15-Octadecatrienoic acid | -6% to -20% |
| 126534 | Acids - Fatty Unsat | Fatty Acids and Related Waxes | 9,12-Octadecadienoic acid | 8% to 87% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#126593

| Seq ID | Chemical Class | Biochemical Class | Compound Name | Modification |
|---|---|---|---|---|
| 126593 | Acids - Fatty | Fatty Acids and Related Waxes | Eicosanoic acid | -37% to -100% |
| 126593 | Acids - Fatty | Fatty Acids and Related Waxes | Octadecanoic acid | 4% to 164% |
| 126593 | Acids - Fatty Unsat | Fatty Acids and Related Waxes | 7,10,13-Hexadecatrienoic acid | -11% to -37% |
| 126593 | Acids - Fatty Unsat | Fatty Acids and Related Waxes | 9,12,15-Octadecatrienoic acid | -9% to -31% |
| 126593 | Acids - Fatty Unsat | Fatty Acids and Related Waxes | 9,12-Octadecadienoic acid | 6% to 127% |
| 126593 | Acids - Fatty Unsat | Fatty Acids and Related Waxes | 9-Hexadecenoic acid | -5% to -36% |
| 126593 | Acids - Fatty Unsat | Fatty Acids and Related Waxes | 9-Octadecenoic acid | 24% to 474% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#126611

| Seq ID | Chemical Class | Biochemical Class | Compound Name | Modification |
|---|---|---|---|---|
| 126611 | Acids - Fatty Unsat | Fatty Acids and Related Waxes | 9,12,15-Octadecatrienoic acid | -6% to -19% |
| 126611 | Acids - Fatty Unsat | Fatty Acids and Related Waxes | 9-Hexadecenoic acid | -7% to -38% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#126632

| Seq ID | Chemical Class | Biochemical Class | Compound Name | Modification |
|---|---|---|---|---|
| 126632 | Acids - Fatty Unsat | Fatty Acids and Related Waxes | 9,12,15-Octadecatrienoic acid | -5% to -18% |
| 126632 | Acids - Fatty Unsat | Fatty Acids and Related Waxes | 9,12-Octadecadienoic acid | 7% to 86% |
| 126632 | Acids - Fatty Unsat | Fatty Acids and Related Waxes | 9-Octadecenoic acid | 3% to 373% |

FIG. 6 continued

A list of metabolite compounds present in altered levels relative to reference samples as charararacterized by gas chromatography, liquid chromatography, and/or mass spectrometry. This list corresponds to samples transfected with nucleic acid sequence, Seq ID#126840

| Seq ID | Chemical Class | Biochemical Class | Compound Name | Modification |
|---|---|---|---|---|
| 126840 | Acids - Fatty | Fatty Acids and Related Waxes | Hexadecanoic acid | 10% to 200% |
| 126840 | Acids - Fatty Unsat | Fatty Acids and Related Waxes | 7,10,13-Hexadecatrienoic acid | -18% to -43% |
| 126840 | Acids - Fatty Unsat | Fatty Acids and Related Waxes | 9,12,15-Octadecatrienoic acid | -70% to -73% |
| 126840 | Acids - Fatty Unsat | Fatty Acids and Related Waxes | 9,12-Octadecadienoic acid | -12% to -44% |
| 126840 | Acids - Fatty Unsat | Fatty Acids and Related Waxes | 9-Octadecenoic acid | 87% to 275% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#127269

| Seq ID | Chemical Class | Biochemical Class | Compound Name | Modification |
|---|---|---|---|---|
| 127269 | Acids - Fatty | Fatty Acids and Related Waxes | Octadecanoic acid | -26% to -67% |
| 127269 | Acids - Fatty Branched | Fatty Acids and Related Waxes | Heptadecanoic acid, 16-methyl- | -14% to -84% |
| 127269 | Acids - Fatty Unsat | Fatty Acids and Related Waxes | 9,12-Octadecadienoic acid | 11% to 55% |
| 127269 | Acids - Fatty Unsat | Fatty Acids and Related Waxes | 9-Hexadecenoic acid | -11% to -40% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#127270

| Seq ID | Chemical Class | Biochemical Class | Compound Name | Modification |
|---|---|---|---|---|
| 127270 | Acids - Fatty | Fatty Acids and Related Waxes | Eicosanoic acid | -13% to -100% |
| 127270 | Acids - Fatty | Fatty Acids and Related Waxes | Hexadecanoic acid | 2% to 27% |
| 127270 | Acids - Fatty | Fatty Acids and Related Waxes | Octadecanoic acid | -22% to -66% |
| 127270 | Acids - Fatty Branched | Fatty Acids and Related Waxes | Hexadecanoic acid, 14-methyl- | -28% to -66% |
| 127270 | Acids - Fatty Unsat | Fatty Acids and Related Waxes | 7,10,13-Hexadecatrienoic acid | -7% to -34% |
| 127270 | Acids - Fatty Unsat | Fatty Acids and Related Waxes | 9-Octadecenoic acid | -70% to -94% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#127645

| Seq ID | Chemical Class | Biochemical Class | Compound Name | Modification |
|---|---|---|---|---|
| 127645 | Acids - Hydroxy Alpha | Acid Pathway | Butanoic acid, 2,3,4-trihydroxy- | New |
| 127645 | Acids - Hydroxy Alpha | Carbohydrates | Quinic acid | 147% to 245% |
| 127645 | Alcohols | Carbohydrates | Inositol | 81% to 135% |
| 127645 | Amino Acids and Related Compounds | Amino Acids and Related Compounds | Glutamic acid | 265% to 442% |
| 127645 | Amino Acids and Related Compounds | Amino Acids and Related Compounds | Proline | 60% to 90% |
| 127645 | Amino Acids and Related Compounds | Amino Acids and Related Compounds | Proline, 5-oxo- | 103% to 171% |
| 127645 | Carbohydrates | Carbohydrates | F3-U0.813 Carbohydrate | 666% to 1110% |
| 127645 | Carbohydrates | Carbohydrates | F3-U0.816 Carbohydrate | 269% to 448% |
| 127645 | Carbohydrates | Carbohydrates | F3-U0.821 Carbohydrate | 465% to 775% |
| 127645 | Carbohydrates | Carbohydrates | F3-U0.825 Carbohydrate | New |
| 127645 | Carbohydrates | Carbohydrates | F3-U0.846 Carbohydrate | 494% to 823% |
| 127645 | Carbohydrates | Carbohydrates | F3-U0.848 Carbohydrate | 97% to 161% |
| 127645 | Carbohydrates | Carbohydrates | F3-U0.872 Hexose | 313% to 522% |
| 127645 | Carbohydrates | Carbohydrates | F3-U1.150 Carbohydrate | 260% to 433% |
| 127645 | NA | NA | F3-U0.751 | 244% to 406% |
| 127645 | NA | NA | F3-U0.852A | New |
| 127645 | NA | NA | F3-U0.882 | -60% to -80% |
| 127645 | NA | NA | F3-U1.229 | 239% to 399% |
| 127645 | NA | NA | F3-U1.253 | 60% to 88% |
| 127645 | Phenols and Related Compounds | Phenylpropanes and Derivatives | Chlorogenic acid | 99% to 165% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#127667

| Seq ID | Chemical Class | Biochemical Class | Compound Name | Modification |
|---|---|---|---|---|
| 127667 | Acids - Fatty | Fatty Acids and Related Waxes | Hexadecanoic acid | -2% to -26% |
| 127667 | Acids - Fatty Branched | Fatty Acids and Related Waxes | Hexadecanoic acid, 14-methyl- | -16% to -80% |
| 127667 | Acids - Fatty Unsat | Fatty Acids and Related Waxes | 7,10,13-Hexadecatrienoic acid | 8% to 121% |
| 127667 | Acids - Fatty Unsat | Fatty Acids and Related Waxes | 9,12,15-Octadecatrienoic acid | 3% to 20% |
| 127667 | Acids - Fatty Unsat | Fatty Acids and Related Waxes | 9,12-Octadecadienoic acid | -40% to -57% |
| 127667 | Acids - Fatty Unsat | Fatty Acids and Related Waxes | 9-Octadecenoic acid | -4% to -95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#127679

| Seq ID | Chemical Class | Biochemical Class | Compound Name | Modification |
|---|---|---|---|---|
| 127679 | Acids - Hydroxy Alpha | Acid Pathway | Butanoic acid, 2,3,4-trihydroxy- | 323% to 538% |
| 127679 | Acids | Acids | Carbamic acid | 60% to 75% |
| 127679 | Acids - Hydroxy Alpha | Acid Pathway | Citric acid | 204% to 340% |
| 127679 | Acids - Hydroxy Alpha | Carbohydrates | Glyceric acid | New |
| 127679 | Acids - Hydroxy Alpha | Acid Pathway | Malic acid | 95% to 159% |
| 127679 | Acids - Hydroxy Alpha | Carbohydrates | Quinic acid | 100% to 167% |
| 127679 | Alcohols | Carbohydrates | Inositol | 60% to 82% |
| 127679 | Amino Acids and Related Compounds | Amino Acids and Related Compounds | Aspartic acid | 163% to 272% |
| 127679 | Amino Acids and Related Compounds | Amino Acids and Related Compounds | Glutamic acid | 389% to 649% |
| 127679 | Amino Acids and Related Compounds | Amino Acids and Related Compounds | Proline | 288% to 481% |
| 127679 | Carbohydrates | Carbohydrates | F3-U0.816 Carbohydrate | 62% to 103% |
| 127679 | Carbohydrates | Carbohydrates | F3-U0.821 Carbohydrate | 204% to 340% |
| 127679 | Carbohydrates | Carbohydrates | F3-U0.846 Carbohydrate | 175% to 291% |
| 127679 | Carbohydrates | Carbohydrates | F3-U0.848 Carbohydrate | 74% to 123% |
| 127679 | Carbohydrates | Carbohydrates | F3-U0.872 Hexose | 148% to 246% |
| 127679 | Carbohydrates | Carbohydrates | F3-U1.189 Carbohydrate | New |
| 127679 | Carbohydrates | Carbohydrates | F3-U1.208 Carbohydrate | 60% to 95% |
| 127679 | Carbohydrates | Carbohydrates | Glucose | 60% to 80% |
| 127679 | NA | NA | F3-U0.751 | 370% to 617% |
| 127679 | Phenols and Related Compounds | Phenylpropanes and Derivatives | Chlorogenic acid | 469% to 782% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#127748

| Seq ID | Chemical Class | Biochemical Class | Compound Name | Modification |
|---|---|---|---|---|
| 127748 | Acids - Fatty | Fatty Acids and Related Waxes | Hexadecanoic acid | 9% to 46% |
| 127748 | Acids - Fatty Unsat | Fatty Acids and Related Waxes | 9-Hexadecenoic acid | -6% to -36% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#127750

| Seq ID | Chemical Class | Biochemical Class | Compound Name | Modification |
|---|---|---|---|---|
| 127750 | Acids - Fatty | Fatty Acids and Related Waxes | Hexadecanoic acid | -9% to -30% |
| 127750 | Acids - Fatty | Fatty Acids and Related Waxes | Octadecanoic acid | 14% to 158% |
| 127750 | Acids - Fatty Unsat | Fatty Acids and Related Waxes | 7,10,13-Hexadecatrienoic acid | -18% to -80% |
| 127750 | Acids - Fatty Unsat | Fatty Acids and Related Waxes | 9,12,15-Octadecatrienoic acid | -8% to -25% |
| 127750 | Acids - Fatty Unsat | Fatty Acids and Related Waxes | 9,12-Octadecadienoic acid | 16% to 75% |
| 127750 | Acids - Fatty Unsat | Fatty Acids and Related Waxes | 9-Hexadecenoic acid | -28% to -72% |
| 127750 | Acids - Fatty Unsat | Fatty Acids and Related Waxes | 9-Octadecenoic acid | 1% to 454% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#128348

| Seq ID | Chemical Class | Biochemical Class | Compound Name | Modification |
|---|---|---|---|---|
| 128348 | Acids - Fatty Unsat | Fatty Acids and Related Waxes | 7,10,13-Hexadecatrienoic acid | -16% to -43% |
| 128348 | Acids - Fatty Unsat | Fatty Acids and Related Waxes | 9,12,15-Octadecatrienoic acid | -4% to -17% |
| 128348 | Acids - Fatty Unsat | Fatty Acids and Related Waxes | 9,12-Octadecadienoic acid | 10% to 67% |
| 128348 | Acids - Fatty Unsat | Fatty Acids and Related Waxes | 9-Hexadecenoic acid | -30% to -60% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#128843

| Seq ID | Chemical Class | Biochemical Class | Compound Name | Modification |
|--------|----------------|-------------------|---------------|--------------|
| 128843 | Acids - Fatty | Fatty Acids and Related Waxes | Hexadecanoic acid | 10% to 35% |
| 128843 | Acids - Fatty Unsat | Fatty Acids and Related Waxes | 9-Hexadecenoic acid | 10% to 91% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#129204

| Seq ID | Chemical Class | Biochemical Class | Compound Name | Modification |
|---|---|---|---|---|
| 129204 | Acids | Acids | Hexanedioic acid | 306% to 509% |
| 129204 | Acids - Fatty Unsat | Fatty Acids and Related Waxes | 9-Octadecenoic acid | 60% to 151% |
| 129204 | Acids - Hydroxy Alpha | Acid Pathway | Butanoic acid, 2,3,4-trihydroxy- | 126% to 210% |
| 129204 | Acids - Hydroxy Alpha | Carbohydrates | Quinic acid | 77% to 128% |
| 129204 | Amino Acids and Related Compounds | Amino Acids and Related Compounds | Glutamic acid | 60% to 82% |
| 129204 | Amino Acids and Related Compounds | Amino Acids and Related Compounds | Histidine | 110% to 495% |
| 129204 | Amino Acids and Related Compounds | Amino Acids and Related Compounds | Proline | 117% to 194% |
| 129204 | Amino Acids and Related Compounds | Amino Acids and Related Compounds | Valine | 65% to 160% |
| 129204 | Carbohydrates | Carbohydrates | F3-U0.813 Carbohydrate | 136% to 226% |
| 129204 | Carbohydrates | Carbohydrates | F3-U0.816 Carbohydrate | 84% to 140% |
| 129204 | Carbohydrates | Carbohydrates | F3-U0.821 Carbohydrate | 184% to 306% |
| 129204 | Carbohydrates | Carbohydrates | F3-U0.846 Carbohydrate | 548% to 913% |
| 129204 | Carbohydrates | Carbohydrates | F3-U0.872 Hexose | 317% to 529% |
| 129204 | Carbohydrates | Carbohydrates | Fructose | 76% to 185% |
| 129204 | Carbohydrates | Carbohydrates | Glucose | 84% to 234% |
| 129204 | NA | NA | F3-U0.751 | 62% to 103% |
| 129204 | NA | NA | F3-U0.799 | New |
| 129204 | NA | NA | F3-U0.843 | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#129329

| Seq ID | Chemical Class | Biochemical Class | Compound Name | Modification |
|---|---|---|---|---|
| 129329 | Acids - Fatty | Fatty Acids and Related Waxes | Eicosanoic acid | -32% to -56% |
| 129329 | Acids - Fatty Branched | Fatty Acids and Related Waxes | Heptadecanoic acid, 16-methyl- | -19% to -61% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#129410

| Seq ID | Chemical Class | Biochemical Class | Compound Name | Modification |
|---|---|---|---|---|
| 129410 | Esters - Hydroxy | Acyl acetylglycerols | 2-Eicosanoyl-1-acetylglycerol | 60% to 102% |
| 129410 | Sterols, Oxygenated Terpenes, and Other Isoprenoids | Prenylquinones | alpha-Tocopherol hydroquinone | New |
| 129410 | Sterols, Oxygenated Terpenes, and Other Isoprenoids | Terpenoids | beta-Sitosterol | 67% to 112% |
| 129410 | Sterols, Oxygenated Terpenes, and Other Isoprenoids | Terpenoids | Campesterol | 60% to 75% |
| 129410 | Sterols, Oxygenated Terpenes, and Other Isoprenoids | Terpenoids | Fucosterol | 61% to 102% |
| 129410 | Sterols, Oxygenated Terpenes, and Other Isoprenoids | Terpenoids | Stigmasterol | 60% to 93% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#129424

| Seq ID | Chemical Class | Biochemical Class | Compound Name | Modification |
|---|---|---|---|---|
| 129424 | Acids - Fatty | Fatty Acids and Related Waxes | Eicosanoic acid | -37% to -55% |
| 129424 | Acids - Fatty | Fatty Acids and Related Waxes | Octadecanoic acid | 14% to 46% |
| 129424 | Acids - Fatty Branched | Fatty Acids and Related Waxes | Heptadecanoic acid, 16-methyl- | -51% to -60% |
| 129424 | Acids - Fatty Unsat | Fatty Acids and Related Waxes | 9,12,15-Octadecatrienoic acid | -2% to -7% |
| 129424 | Acids - Fatty Unsat | Fatty Acids and Related Waxes | 9-Octadecenoic acid | 27% to 112% |

FIG. 6 continued

| Seq ID | Chemical Class | Biochemical Class | Compound Name | Modification |
|---|---|---|---|---|
| 129491 | NA | NA | F3-U0.751 | -60% to -88% |

A list of metabolite compounds present in altered levels relative to reference samples as characterized by gas chromatography, liquid chromatography, and/or mass spectrometry. This list corresponds to samples transfected with nucleic acid sequence, Seq ID#129491

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#129584

| Seq ID | Chemical Class | Biochemical Class | Compound Name | Modification |
|---|---|---|---|---|
| 129584 | Sterols, Oxygenated Terpenes, and Other Isoprenoids | Prenylquinones | alpha-Tocopherol hydroquinone | 821% to 1368% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#129725

| Seq ID | Chemical Class | Biochemical Class | Compound Name | Modification |
|---|---|---|---|---|
| 129725 | Acids | Acids | Carbamic acid | 60% to 94% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#129748

| Seq ID | Chemical Class | Biochemical Class | Compound Name | Modification |
|---|---|---|---|---|
| 129748 | Acids | Acids | Carbamic acid | 104% to 174% |
| 129748 | Acids - Hydroxy Alpha | Acid Pathway | Butanoic acid, 2,3,4-trihydroxy- | 214% to 671% |
| 129748 | Acids - Hydroxy Alpha | Acid Pathway | Citric acid | 160% to 267% |
| 129748 | Acids - Hydroxy Alpha | Carbohydrates | Quinic acid | 60% to 276% |
| 129748 | Alcohols | Carbohydrates | Inositol | 92% to 153% |
| 129748 | Alkenes and Alkynes | Terpenoids | Limonene | 142% to 236% |
| 129748 | Amino Acids and Related Compounds | Amino Acids and Related Compounds | Glutamic acid | 215% to 414% |
| 129748 | Amino Acids and Related Compounds | Amino Acids and Related Compounds | Glutamine | New |
| 129748 | Amino Acids and Related Compounds | Amino Acids and Related Compounds | Proline, 5-oxo- | 88% to 147% |
| 129748 | Carbohydrates | Carbohydrates | F3-U0.768 Carbohydrate | 186% to 310% |
| 129748 | Carbohydrates | Carbohydrates | F3-U0.813 Carbohydrate | 423% to 1010% |
| 129748 | Carbohydrates | Carbohydrates | F3-U0.816 Carbohydrate | 123% to 255% |
| 129748 | Carbohydrates | Carbohydrates | F3-U0.821 Carbohydrate | 79% to 267% |
| 129748 | Carbohydrates | Carbohydrates | F3-U0.825 Carbohydrate | 273% to 609% |
| 129748 | Carbohydrates | Carbohydrates | F3-U0.846 Carbohydrate | 146% to 850% |
| 129748 | Carbohydrates | Carbohydrates | F3-U0.848 Carbohydrate | 106% to 176% |
| 129748 | Carbohydrates | Carbohydrates | F3-U0.872 Hexose | 218% to 685% |
| 129748 | Carbohydrates | Carbohydrates | F3-U0.952 Carbohydrate | New |
| 129748 | Carbohydrates | Carbohydrates | F3-U1.113 Carbohydrate | 175% to 291% |
| 129748 | Carbohydrates | Carbohydrates | F3-U1.150 Carbohydrate | 60% to 156% |
| 129748 | Carbohydrates | Carbohydrates | F3-U1.189 Carbohydrate | 101% to 622% |
| 129748 | Carbohydrates | Carbohydrates | F3-U1.194 Carbohydrate | New |
| 129748 | Carbohydrates | Carbohydrates | Fructose | 60% to 1890% |
| 129748 | Carbohydrates | Carbohydrates | Galactose or Mannose | New |
| 129748 | Carbohydrates | Carbohydrates | Glucose | 219% to 2977% |
| 129748 | Esters | Esters | F1-U1.076 Fatty Acid Ester | 195% to 325% |
| 129748 | Esters | Esters | F1-U1.078 Fatty Acid Ester | 67% to 112% |
| 129748 | Esters | Esters | F1-U1.119 Fatty Acid Ester | 136% to 226% |
| 129748 | Esters | Esters | F1-U1.121 Fatty Acid Ester | 118% to 196% |
| 129748 | Esters - Hydroxy | Acyl acetylglycerols | 2-Eicosanoyl-1-acetylglycerol | 157% to 492% |
| 129748 | Esters - Hydroxy | Acyl acetylglycerols | 2-Octadecanoyl-1-acetylglycerol | 93% to 311% |
| 129748 | NA | NA | F1-U1.042 | 60% to 258% |
| 129748 | NA | NA | F3-U0.727 | -60% to -79% |
| 129748 | NA | NA | F3-U0.736 | New |
| 129748 | NA | NA | F3-U0.751 | 491% to 818% |
| 129748 | NA | NA | F3-U0.843 | New |
| 129748 | NA | NA | F3-U0.868 | New |
| 129748 | NA | NA | F3-U0.882 | New |
| 129748 | NA | NA | F3-U1.177 | 211% to 351% |
| 129748 | NA | NA | F3-U1.229 | 60% to 93% |
| 129748 | NA | NA | F3-U1.253 | 143% to 415% |
| 129748 | NA | NA | F3-U1.255 | New |
| 129748 | Sterols, Oxygenated Terpenes, and Other Isoprenoids | Prenylquinones | alpha-Tocopherol | 101% to 168% |
| 129748 | Sterols, Oxygenated Terpenes, and Other Isoprenoids | Prenylquinones | alpha-Tocopherol hydroquinone | New |
| 129748 | Sterols, Oxygenated Terpenes, and Other Isoprenoids | Terpenoids | beta-Sitosterol | 77% to 372% |
| 129748 | Sterols, Oxygenated Terpenes, and Other Isoprenoids | Prenylquinones | beta-Tocopherol | New |
| 129748 | Sterols, Oxygenated Terpenes, and Other Isoprenoids | Terpenoids | Campesterol | 60% to 185% |
| 129748 | Sterols, Oxygenated Terpenes, and Other Isoprenoids | Terpenoids | Cholesterol | 251% to 419% |
| 129748 | Sterols, Oxygenated Terpenes, and Other Isoprenoids | Terpenoids | F1-U1.130 Sterol | 60% to 75% |
| 129748 | Sterols, Oxygenated Terpenes, and Other Isoprenoids | Terpenoids | Fucosterol | 170% to 283% |
| 129748 | Sterols, Oxygenated Terpenes, and Other Isoprenoids | Terpenoids | Stigmasterol | 105% to 175% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#129753

| Seq ID | Chemical Class | Biochemical Class | Compound Name | Modification |
|---|---|---|---|---|
| 129753 | Acids - Hydroxy | Amino Acids and Related Compounds | Shikimic acid | 75% to 125% |
| 129753 | Alkaloids and Other Bases | Polyamines | 1,4-Butanediamine | 60% to 82% |
| 129753 | Amino Acids and Related Compounds | Amino Acids and Related Compounds | Glutamic acid | 74% to 124% |
| 129753 | Carbohydrates | Carbohydrates | F3-U0.813 Carbohydrate | 350% to 584% |
| 129753 | Carbohydrates | Carbohydrates | F3-U0.816 Carbohydrate | 75% to 125% |
| 129753 | Carbohydrates | Carbohydrates | F3-U0.825 Carbohydrate | 148% to 246% |
| 129753 | Carbohydrates | Carbohydrates | F3-U0.846 Carbohydrate | 213% to 355% |
| 129753 | Carbohydrates | Carbohydrates | F3-U0.848 Carbohydrate | 63% to 105% |
| 129753 | Carbohydrates | Carbohydrates | F3-U0.872 Hexose | 182% to 304% |
| 129753 | Carbohydrates | Carbohydrates | Fructose | 158% to 320% |
| 129753 | Carbohydrates | Carbohydrates | Glucose | 384% to 695% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#129764

| Seq ID | Chemical Class | Biochemical Class | Compound Name | Modification |
|---|---|---|---|---|
| 129764 | Acids - Hydroxy Alpha | Acid Pathway | Butanoic acid, 2,3,4-trihydroxy- | New |
| 129764 | Acids - Fatty | Fatty Acids and Related Waxes | Eicosanoic acid | -60% to -74% |
| 129764 | Acids - Fatty Branched | Fatty Acids and Related Waxes | Heptadecanoic acid, 16-methyl- | -60% to -68% |
| 129764 | Acids - Fatty Branched | Fatty Acids and Related Waxes | Hexadecanoic acid, 14-methyl- | -60% to -82% |
| 129764 | Acids - Fatty Unsat | Fatty Acids and Related Waxes | 9,12,15-Octadecatrienoic acid | New |
| 129764 | Acids - Fatty Unsat | Fatty Acids and Related Waxes | 9-Octadecenoic acid | -60% to -66% |
| 129764 | Acids - Hydroxy | Amino Acids and Related Compounds | Shikimic acid | 358% to 595% |
| 129764 | Acids - Hydroxy Alpha | Acid Pathway | Citric acid | 359% to 599% |
| 129764 | Acids - Hydroxy Alpha | Carbohydrates | Quinic acid | 721% to 1202% |
| 129764 | Alcohols | Carbohydrates | Inositol | 281% to 469% |
| 129764 | Aldehydes, Ketones and Quinones | Aldehydes, Ketones and Quinones | 3-Phytylmenadione | New |
| 129764 | Alkenes and Alkynes | Terpenoids | Limonene | 60% to 96% |
| 129764 | Amino Acids and Related Compounds | Amino Acids and Related Compounds | Glutamic acid | 253% to 421% |
| 129764 | Amino Acids and Related Compounds | Amino Acids and Related Compounds | Methionine | 110% to 450% |
| 129764 | Amino Acids and Related Compounds | Amino Acids and Related Compounds | Phenylalanine | New |
| 129764 | Amino Acids and Related Compounds | Amino Acids and Related Compounds | Threonine | 65% to 265% |
| 129764 | Amino Acids and Related Compounds | Amino Acids and Related Compounds | Tyrosine | New |
| 129764 | Carbohydrates | Carbohydrates | F3-U0.813 Carbohydrate | New |
| 129764 | Carbohydrates | Carbohydrates | F3-U0.816 Carbohydrate | 358% to 595% |
| 129764 | Carbohydrates | Carbohydrates | F3-U0.821 Carbohydrate | 359% to 598% |
| 129764 | Carbohydrates | Carbohydrates | F3-U0.846 Carbohydrate | 110% to 450% |
| 129764 | Carbohydrates | Carbohydrates | F3-U0.848 Carbohydrate | 2871% to 4951% |
| 129764 | Carbohydrates | Carbohydrates | F3-U0.872 Hexose | New |
| 129764 | Carbohydrates | Carbohydrates | F3-U1.150 Carbohydrate | 1167% to 1944% |
| 129764 | Carbohydrates | Carbohydrates | F3-U1.189 Carbohydrate | 196% to 327% |
| 129764 | Carbohydrates | Carbohydrates | Fructose | New |
| 129764 | Carbohydrates | Carbohydrates | Galactose or Mannose | 202% to 493% |
| 129764 | Carbohydrates | Carbohydrates | Glucose | 72% to 120% |
| 129764 | Esters | Esters | F1-U1.076 Fatty Acid Ester | 377% to 1089% |
| 129764 | Esters | Esters | F1-U1.119 Fatty Acid Ester | 110% to 183% |
| 129764 | Esters - Hydroxy | Acyl acetylglycerols | 2-Eicosanoyl-1-acetylglycerol | 135% to 232% |
| 129764 | Esters - Hydroxy | Acyl acetylglycerols | 2-Octadecanoyl-1-acetylglycerol | 144% to 240% |
| 129764 | NA | NA | F1-U1.162 | 104% to 173% |
| 129764 | NA | NA | F3-U0.727 | New |
| 129764 | NA | NA | F3-U0.736 | -60% to -81% |
| 129764 | NA | NA | F3-U0.751 | New |
| 129764 | NA | NA | F3-U0.882 | 62% to 103% |
| 129764 | Phenols and Related Compounds | Phenylpropanes and Derivatives | Chlorogenic acid | 222% to 370% |
| 129764 | Sterols, Oxygenated Terpenes, and Other Isoprenoids | Prenyquinones | alpha-Tocopherol hydroquinone | 122% to 329% |
| 129764 | Sterols, Oxygenated Terpenes, and Other Isoprenoids | Terpenoids | beta-Sitosterol | 74% to 123% |
| 129764 | Sterols, Oxygenated Terpenes, and Other Isoprenoids | Terpenoids | Campesterol | 80% to 134% |
| 129764 | Sterols, Oxygenated Terpenes, and Other Isoprenoids | Terpenoids | Cholesterol | 60% to 224% |
| 129764 | Sterols, Oxygenated Terpenes, and Other Isoprenoids | Terpenoids | F1-U1.164 Sterol | 731% to 1218% |
| 129764 | Sterols, Oxygenated Terpenes, and Other Isoprenoids | Terpenoids | Fucosterol | 84% to 298% |
| 129764 | Sterols, Oxygenated Terpenes, and Other Isoprenoids | Terpenoids | Stigmasterol | 60% to 151% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#129833

| Seq ID | Chemical Class | Biochemical Class | Compound Name | Modification |
|---|---|---|---|---|
| 129833 | Alcohols | Alcohols | Valerenenol | New |
| 129833 | Amino Acids and Related Compounds | Amino Acids and Related Compounds | Isoleucine | New |
| 129833 | Amino Acids and Related Compounds | Amino Acids and Related Compounds | Methionine | 175% to 595% |
| 129833 | Amino Acids and Related Compounds | Amino Acids and Related Compounds | Phenylalanine | New |
| 129833 | Amino Acids and Related Compounds | Amino Acids and Related Compounds | Tryptophan | New |
| 129833 | Amino Acids and Related Compounds | Amino Acids and Related Compounds | Valine | 185% to 625% |
| 129833 | NA | NA | F1-U0.872 | New |
| 129833 | NA | NA | F1-U0.972 | New |
| 129833 | Sterols, Oxygenated Terpenes, and Other Isoprenoids | Prenylquinones | alpha-Tocopherol | 460% to 766% |
| 129833 | Sterols, Oxygenated Terpenes, and Other Isoprenoids | Prenylquinones | alpha-Tocopherol hydroquinone | 67% to 111% |
| 129833 | Sterols, Oxygenated Terpenes, and Other Isoprenoids | Prenylquinones | beta-Tocopherol | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#129848

| Seq ID | Chemical Class | Biochemical Class | Compound Name | Modification |
|---|---|---|---|---|
| 129848 | Acids - Hydroxy Alpha | Acid Pathway | Butanoic acid, 2,3,4-trihydroxy- | New |
| 129848 | Acids - Hydroxy Alpha | Acid Pathway | Citric acid | 160% to 266% |
| 129848 | Acids - Hydroxy Alpha | Carbohydrates | Quinic acid | 417% to 696% |
| 129848 | Alcohols | Carbohydrates | Inositol | 204% to 341% |
| 129848 | Alkaloids and Other Bases | Polyamines | 1,4-Butanediamine | 60% to 90% |
| 129848 | Amino Acids and Related Compounds | Amino Acids and Related Compounds | Aspartic acid | 85% to 141% |
| 129848 | Amino Acids and Related Compounds | Amino Acids and Related Compounds | Glutamic acid | 281% to 468% |
| 129848 | Carbohydrates | Carbohydrates | F3-U0.846 Carbohydrate | 802% to 1337% |
| 129848 | Carbohydrates | Carbohydrates | F3-U0.848 Carbohydrate | New |
| 129848 | Carbohydrates | Carbohydrates | F3-U0.872 Hexose | 424% to 707% |
| 129848 | Carbohydrates | Carbohydrates | F3-U1.150 Carbohydrate | 75% to 125% |
| 129848 | Carbohydrates | Carbohydrates | F3-U1.189 Carbohydrate | New |
| 129848 | Carbohydrates | Carbohydrates | Fructose | 234% to 566% |
| 129848 | Carbohydrates | Carbohydrates | Galactose or Mannose | 236% to 393% |
| 129848 | Carbohydrates | Carbohydrates | Glucose | 415% to 1250% |
| 129848 | NA | NA | F3-U0.751 | New |
| 129848 | NA | NA | F3-U0.882 | 61% to 102% |
| 129848 | Phenols and Related Compounds | Phenylpropanes and Derivatives | Chlorogenic acid | 204% to 340% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#129932

| Seq ID | Chemical Class | Biochemical Class | Compound Name | Modification |
|---|---|---|---|---|
| 129932 | Alkenes and Alkynes | Terpenoids | Limonene | 234% to 389% |
| 129932 | Esters - Hydroxy | Acyl acetylglycerols | 2-Eicosanoyl-1-acetylglycerol | 99% to 165% |
| 129932 | Esters - Hydroxy | Acyl acetylglycerols | 2-Octadecanoyl-1-acetylglycerol | 69% to 114% |
| 129932 | Sterols, Oxygenated Terpenes, and Other Isoprenoids | Prenylquinones | alpha-Tocopherol | 148% to 247% |
| 129932 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130172

| Seq ID | Chemical Class | Biochemical Class | Compound Name | Modification |
|---|---|---|---|---|
| 130172 | Alkenes and Alkynes | Terpenoids | Limonene | 651% to 1085% |
| 130172 | Amino Acids and Related Compounds | Amino Acids and Related Compounds | Arginine | 60% to 230% |
| 130172 | Amino Acids and Related Compounds | Amino Acids and Related Compounds | Histidine | 60% to 765% |
| 130172 | Amino Acids and Related Compounds | Amino Acids and Related Compounds | Isoleucine | New |
| 130172 | Amino Acids and Related Compounds | Amino Acids and Related Compounds | Methionine | 120% to 455% |
| 130172 | Amino Acids and Related Compounds | Amino Acids and Related Compounds | Proline | 80% to 660% |
| 130172 | Amino Acids and Related Compounds | Amino Acids and Related Compounds | Serine | 60% to 140% |
| 130172 | Amino Acids and Related Compounds | Amino Acids and Related Compounds | Threonine | 75% to 180% |
| 130172 | Amino Acids and Related Compounds | Amino Acids and Related Compounds | Valine | 200% to 720% |
| 130172 | Esters | Esters | F1-U1.076 Fatty Acid Ester | 566% to 943% |
| 130172 | Esters | Esters | F1-U1.078 Fatty Acid Ester | 280% to 466% |
| 130172 | Esters | Esters | F1-U1.119 Fatty Acid Ester | 535% to 892% |
| 130172 | Esters - Hydroxy | Acyl acetylglycerols | 2-Eicosanoyl-1-acetylglycerol | 495% to 826% |
| 130172 | Esters - Hydroxy | Acyl acetylglycerols | 2-Octadecanoyl-1-acetylglycerol | 466% to 776% |
| 130172 | Hydrocarbons | Hydrocarbons | Triacontane, 2-methyl- | 144% to 239% |
| 130172 | NA | NA | F1-U0.948 | 102% to 171% |
| 130172 | NA | NA | F1-U0.955 | 280% to 466% |
| 130172 | NA | NA | F1-U0.955 | 169% to 281% |
| 130172 | NA | NA | F1-U0.991 | 466% to 776% |
| 130172 | Sterols, Oxygenated Terpenes, and Other Isoprenoids | Prenylquinones | alpha-Tocopherol | 60% to 96% |
| 130172 | Sterols, Oxygenated Terpenes, and Other Isoprenoids | Prenylquinones | alpha-Tocopherol hydroquinone | 4055% to 6759% |
| 130172 | Sterols, Oxygenated Terpenes, and Other Isoprenoids | Terpenoids | beta-Sitosterol | 130% to 216% |
| 130172 | Sterols, Oxygenated Terpenes, and Other Isoprenoids | Prenylquinones | beta-Tocopherol | New |
| 130172 | Sterols, Oxygenated Terpenes, and Other Isoprenoids | Terpenoids | Campesterol | 171% to 285% |
| 130172 | Sterols, Oxygenated Terpenes, and Other Isoprenoids | Terpenoids | Cholest-7-en-3-ol | 157% to 261% |
| 130172 | Sterols, Oxygenated Terpenes, and Other Isoprenoids | Terpenoids | Cholesterol | 196% to 326% |
| 130172 | Sterols, Oxygenated Terpenes, and Other Isoprenoids | Terpenoids | Cycloartenol | 117% to 195% |
| 130172 | Sterols, Oxygenated Terpenes, and Other Isoprenoids | Terpenoids | Ergosta-5,24-dien-3-ol | 79% to 131% |
| 130172 | Sterols, Oxygenated Terpenes, and Other Isoprenoids | Terpenoids | F1-U1.106 Sterol | 163% to 284% |
| 130172 | Sterols, Oxygenated Terpenes, and Other Isoprenoids | Terpenoids | F1-U1.153 Sterol | 177% to 295% |
| 130172 | Sterols, Oxygenated Terpenes, and Other Isoprenoids | Terpenoids | F1-U1.164 Sterol | 208% to 346% |
| 130172 | Sterols, Oxygenated Terpenes, and Other Isoprenoids | Terpenoids | F1-U1.242 Sterol | 133% to 221% |
| 130172 | Sterols, Oxygenated Terpenes, and Other Isoprenoids | Terpenoids continued | Fucosterol | 97% to 161% |
| 130172 | Sterols, Oxygenated Terpenes, and Other Isoprenoids | Terpenoids | Stigmast-7-en-3-ol | New |
| 130172 | Sterols, Oxygenated Terpenes, and Other Isoprenoids | Terpenoids | Stigmasterol | 158% to 263% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130212

| Seq ID | Chemical Class | Biochemical Class | Compound Name | Modification |
|---|---|---|---|---|
| 130212 | Amino Acids and Related Compounds | Amino Acids and Related Compounds | Alanine | 270% to 1130% |
| 130212 | Amino Acids and Related Compounds | Amino Acids and Related Compounds | Serine | 45% to 280% |
| 130212 | Amino Acids and Related Compounds | Amino Acids and Related Compounds | Valine | 95% to 290% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130426

| Seq ID | Chemical Class | Biochemical Class | Compound Name | Modification |
|---|---|---|---|---|
| 130426 | Acids - Fatty | Fatty Acids and Related Waxes | Eicosanoic acid | -24% to -100% |
| 130426 | Acids - Fatty | Fatty Acids and Related Waxes | Hexadecanoic acid | 4% to 42% |
| 130426 | Acids - Fatty | Fatty Acids and Related Waxes | Octadecanoic acid | 8% to 37% |
| 130426 | Acids - Fatty Branched | Fatty Acids and Related Waxes | Heptadecanoic acid, 16-methyl- | -10% to -77% |
| 130426 | Acids - Fatty Unsat | Fatty Acids and Related Waxes | 7,10,13-Hexadecatrienoic acid | 2% to 26% |
| 130426 | Acids - Fatty Unsat | Fatty Acids and Related Waxes | 9,12,15-Octadecatrienoic acid | -2% to -19% |
| 130426 | Acids - Fatty Unsat | Fatty Acids and Related Waxes | 9,12-Octadecadienoic acid | 2% to 29% |
| 130426 | Acids - Fatty Unsat | Fatty Acids and Related Waxes | 9-Hexadecenoic acid | 1% to 55% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#130430

| Seq ID | Chemical Class | Biochemical Class | Compound Name | Modification |
|---|---|---|---|---|
| 130430 | Acids | Acids | Carbamic acid | 114% to 190% |
| 130430 | Acids - Hydroxy | Amino Acids and Related Compounds | Shikimic acid | 197% to 328% |
| 130430 | Acids - Hydroxy Alpha | Acid Pathway | Butanoic acid, 2,3,4-trihydroxy- | New |
| 130430 | Acids - Hydroxy Alpha | Acid Pathway | Citric acid | 246% to 410% |
| 130430 | Acids - Hydroxy Alpha | Carbohydrates | Quinic acid | 272% to 453% |
| 130430 | Alcohols | Carbohydrates | Inositol | 160% to 267% |
| 130430 | Alkaloids and Other Bases | Polyamines | 1,4-Butanediamine | 71% to 118% |
| 130430 | Amino Acids and Related Compounds | Amino Acids and Related Compounds | Arginine | 80% to 150% |
| 130430 | Amino Acids and Related Compounds | Amino Acids and Related Compounds | Aspartic acid | 134% to 223% |
| 130430 | Amino Acids and Related Compounds | Amino Acids and Related Compounds | Glutamic acid | 349% to 582% |
| 130430 | Amino Acids and Related Compounds | Amino Acids and Related Compounds | Methionine | 260% to 840% |
| 130430 | Amino Acids and Related Compounds | Amino Acids and Related Compounds | Proline | New |
| 130430 | Amino Acids and Related Compounds | Amino Acids and Related Compounds | Proline, 5-oxo- | 75% to 125% |
| 130430 | Amino Acids and Related Compounds | Amino Acids and Related Compounds | Serine | 60% to 235% |
| 130430 | Amino Acids and Related Compounds | Amino Acids and Related Compounds | Threonine | 70% to 295% |
| 130430 | Amino Acids and Related Compounds | Amino Acids and Related Compounds | Tryptophan | New |
| 130430 | Amino Acids and Related Compounds | Amino Acids and Related Compounds | Tyrosine | New |
| 130430 | Carbohydrates | Carbohydrates | F3-U0.816 Carbohydrate | 197% to 328% |
| 130430 | Carbohydrates | Carbohydrates | F3-U0.821 Carbohydrate | 246% to 410% |
| 130430 | Carbohydrates | Carbohydrates | F3-U0.846 Carbohydrate | 1825% to 3042% |
| 130430 | Carbohydrates | Carbohydrates | F3-U0.848 Carbohydrate | New |
| 130430 | Carbohydrates | Carbohydrates | F3-U0.872 Hexose | 646% to 1076% |
| 130430 | Carbohydrates | Carbohydrates | F3-U1.150 Carbohydrate | 532% to 886% |
| 130430 | Carbohydrates | Carbohydrates | F3-U1.189 Carbohydrate | New |
| 130430 | Carbohydrates | Carbohydrates | Fructose | 113% to 271% |
| 130430 | Carbohydrates | Carbohydrates | Galactose or Mannose | 311% to 518% |
| 130430 | Carbohydrates | Carbohydrates | Glucose | 321% to 841% |
| 130430 | NA | NA | F3-U0.736 | New |
| 130430 | NA | NA | F3-U0.751 | New |
| 130430 | NA | NA | F3-U0.882 | 71% to 119% |
| 130430 | NA | NA | F3-U1.232B | New |
| 130430 | Phenols and Related Compounds | Phenylpropanes and Derivatives | Chlorogenic acid | 269% to 448% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130438

| Seq ID | Chemical Class | Biochemical Class | Compound Name | Modification |
|---|---|---|---|---|
| 130438 | Acids | Acids | Carbamic acid | 254% to 423% |
| 130438 | Acids - Fatty | Fatty Acids and Related Waxes | Eicosanoic acid | -60% to -100% |
| 130438 | Acids - Fatty Unsat | Fatty Acids and Related Waxes | 9-Octadecenoic acid | -60% to -78% |
| 130438 | Alkaloids and Other Bases | Polyamines | 1,4-Butanediamine | 103% to 172% |
| 130438 | Amino Acids and Related Compounds | Amino Acids and Related Compounds | Glutamic acid | 77% to 129% |
| 130438 | Amino Acids and Related Compounds | Amino Acids and Related Compounds | Proline | NQ |
| 130438 | Carbohydrates | Carbohydrates | F3-U0.848 Carbohydrate | 76% to 126% |
| 130438 | Carbohydrates | Carbohydrates | F3-U1.150 Carbohydrate | 78% to 131% |
| 130438 | Carbohydrates | Carbohydrates | Fructose | 147% to 279% |
| 130438 | Carbohydrates | Carbohydrates | Galactose or Mannose | 155% to 258% |
| 130438 | Carbohydrates | Carbohydrates | Glucose | 383% to 735% |
| 130438 | NA | NA | F3-U0.736 | New |
| 130438 | Phenols and Related Compounds | Phenylpropanes and Derivatives | Chlorogenic acid | 86% to 143% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130492

| Seq ID | Chemical Class | Biochemical Class | Compound Name | Modification |
|---|---|---|---|---|
| 130492 | Amino Acids and Related Compounds | Amino Acids and Related Compounds | Isoleucine | New |
| 130492 | Amino Acids and Related Compounds | Amino Acids and Related Compounds | Methionine | 85% to 370% |
| 130492 | Amino Acids and Related Compounds | Amino Acids and Related Compounds | Phenylalanine | New |
| 130492 | Amino Acids and Related Compounds | Amino Acids and Related Compounds | Serine | 30% to 95% |
| 130492 | Amino Acids and Related Compounds | Amino Acids and Related Compounds | Threonine | 25% to 120% |
| 130492 | Amino Acids and Related Compounds | Amino Acids and Related Compounds | Valine | 135% to 500% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130569

| Seq ID | Chemical Class | Biochemical Class | Compound Name | Modification |
|---|---|---|---|---|
| 130569 | Acids | Acids | Carbamic acid | 117% to 288% |
| 130569 | Acids - Hydroxy Alpha | Acid Pathway | Citric acid | 60% to 84% |
| 130569 | Amino Acids and Related Compounds | Amino Acids and Related Compounds | Lysine | 60% to 150% |
| 130569 | Amino Acids and Related Compounds | Amino Acids and Related Compounds | Methionine | 60% to 200% |
| 130569 | Amino Acids and Related Compounds | Amino Acids and Related Compounds | Threonine | 60% to 175% |
| 130569 | Amino Acids and Related Compounds | Amino Acids and Related Compounds | Tryptophan | New |
| 130569 | Amino Acids and Related Compounds | Amino Acids and Related Compounds | Tyrosine | New |
| 130569 | Amino Acids and Related Compounds | Amino Acids and Related Compounds | Valine | 255% to 610% |
| 130569 | Carbohydrates | Carbohydrates | F3-U0.813 Carbohydrate | 244% to 406% |
| 130569 | Carbohydrates | Carbohydrates | F3-U0.816 Carbohydrate | 83% to 138% |
| 130569 | Carbohydrates | Carbohydrates | F3-U0.821 Carbohydrate | 60% to 84% |
| 130569 | Carbohydrates | Carbohydrates | F3-U0.825 Carbohydrate | 80% to 133% |
| 130569 | Carbohydrates | Carbohydrates | F3-U0.846 Carbohydrate | 131% to 219% |
| 130569 | Carbohydrates | Carbohydrates | F3-U0.872 Hexose | 109% to 182% |
| 130569 | Carbohydrates | Carbohydrates | F3-U1.150 Carbohydrate | 188% to 313% |
| 130569 | Carbohydrates | Carbohydrates | F3-U1.189 Carbohydrate | 94% to 156% |
| 130569 | Carbohydrates | Carbohydrates | Fructose | 137% to 264% |
| 130569 | Carbohydrates | Carbohydrates | Glucose | 194% to 370% |
| 130569 | NA | NA | F3-U0.736 | New |
| 130569 | Phenols and Related Compounds | Phenylpropanes and Derivatives | Chlorogenic acid | 104% to 174% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130646

| Seq ID | Chemical Class | Biochemical Class | Compound Name | Modification |
|---|---|---|---|---|
| 130646 | Acids - Fatty | Fatty Acids and Related Waxes | Hexadecanoic acid | 16% to 57% |
| 130646 | Acids - Fatty Unsat | Fatty Acids and Related Waxes | 7,10,13-Hexadecatrienoic acid | -36% to -57% |
| 130646 | Acids - Fatty Unsat | Fatty Acids and Related Waxes | 9,12-Octadecadienoic acid | -31% to -58% |
| 130646 | Acids - Fatty Unsat | Fatty Acids and Related Waxes | 9-Hexadecenoic acid | -15% to -37% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130653

| Seq ID | Chemical Class | Biochemical Class | Compound Name | Modification |
|---|---|---|---|---|
| 130653 | Acids - Fatty | Fatty Acids and Related Waxes | Eicosanoic acid | 8% to 50% |
| 130653 | Acids - Fatty Unsat | Fatty Acids and Related Waxes | 9,12,15-Octadecatrienoic acid | 1% to 6% |
| 130653 | Acids - Fatty Unsat | Fatty Acids and Related Waxes | 9-Octadecenoic acid | -31% to -59% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130712

| Seq ID | Chemical Class | Biochemical Class | Compound Name | Modification |
|---|---|---|---|---|
| 130712 | Acids | Acids | Carbamic acid | 140% to 233% |
| 130712 | Acids - Hydroxy Alpha | Acid Pathway | Butanoic acid, 2,3,4-trihydroxy- | 92% to 154% |
| 130712 | Acids - Hydroxy Alpha | Acid Pathway | Citric acid | 124% to 206% |
| 130712 | Acids - Hydroxy Alpha | Carbohydrates | Quinic acid | 67% to 111% |
| 130712 | Alkaloids and Other Bases | Polyamines | 1,4-Butanediamine | 95% to 158% |
| 130712 | Amino Acids and Related Compounds | Amino Acids and Related Compounds | Glutamic acid | 136% to 227% |
| 130712 | Carbohydrates | Carbohydrates | F3-U0.768 Carbohydrate | 371% to 619% |
| 130712 | Carbohydrates | Carbohydrates | F3-U0.813 Carbohydrate | 310% to 516% |
| 130712 | Carbohydrates | Carbohydrates | F3-U0.816 Carbohydrate | 96% to 161% |
| 130712 | Carbohydrates | Carbohydrates | F3-U0.821 Carbohydrate | 124% to 206% |
| 130712 | Carbohydrates | Carbohydrates | F3-U0.825 Carbohydrate | 154% to 257% |
| 130712 | Carbohydrates | Carbohydrates | F3-U0.846 Carbohydrate | 205% to 342% |
| 130712 | Carbohydrates | Carbohydrates | F3-U0.848 Carbohydrate | 123% to 204% |
| 130712 | Carbohydrates | Carbohydrates | F3-U0.872 Hexose | 248% to 414% |
| 130712 | Carbohydrates | Carbohydrates | F3-U1.189 Carbohydrate | New |
| 130712 | Carbohydrates | Carbohydrates | Fructose | 817% to 1463% |
| 130712 | Carbohydrates | Carbohydrates | Glucose | 1271% to 2738% |
| 130712 | NA | NA | F3-U0.727 | 146% to 243% |
| 130712 | NA | NA | F3-U0.785 | 146% to 243% |
| 130712 | NA | NA | F3-U0.852A | 136% to 226% |
| 130712 | NA | NA | F3-U0.882 | 2332% to 386% |
| 130712 | Phenols and Related Compounds | Phenylpropanes and Derivatives | Chlorogenic acid | 147% to 245% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#130722

| Seq ID | Chemical Class | Biochemical Class | Compound Name | Modification |
|---|---|---|---|---|
| 130722 | Acids - Fatty | Fatty Acids and Related Waxes | Eicosanoic acid | -56% to -68% |
| 130722 | Acids - Fatty Branched | Fatty Acids and Related Waxes | Heptadecanoic acid, 16-methyl- | -60% to -68% |
| 130722 | Acids - Fatty Unsat | Fatty Acids and Related Waxes | 7,10,13-Hexadecatrienoic acid | 23% to 51% |
| 130722 | Acids - Fatty Unsat | Fatty Acids and Related Waxes | 9-Hexadecenoic acid | 16% to 30% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130792

| Seq ID | Chemical Class | Biochemical Class | Compound Name | Modification |
|---|---|---|---|---|
| 130792 | Acids - Hydroxy Alpha | Acid Pathway | Butanoic acid, 2,3,4-trihydroxy- | 704% to 1173% |
| 130792 | Acids - Hydroxy Alpha | Carbohydrates | Quinic acid | 233% to 389% |
| 130792 | Alkenes and Alkynes | Terpenoids | Limonene | 105% to 175% |
| 130792 | Amino Acids and Related Compounds | Amino Acids and Related Compounds | Aspartic acid | 60% to 86% |
| 130792 | Amino Acids and Related Compounds | Amino Acids and Related Compounds | Proline, 5-oxo- | 103% to 172% |
| 130792 | Carbohydrates | Carbohydrates | F3-U0.813 Carbohydrate | 220% to 366% |
| 130792 | Carbohydrates | Carbohydrates | F3-U0.816 Carbohydrate | 60% to 98% |
| 130792 | Carbohydrates | Carbohydrates | F3-U0.821 Carbohydrate | 64% to 107% |
| 130792 | Carbohydrates | Carbohydrates | F3-U0.825 Carbohydrate | 102% to 169% |
| 130792 | Carbohydrates | Carbohydrates | F3-U0.846 Carbohydrate | 84% to 141% |
| 130792 | Carbohydrates | Carbohydrates | F3-U0.872 Hexose | 135% to 225% |
| 130792 | Carbohydrates | Carbohydrates | F3-U1.189 Carbohydrate | 60% to 91% |
| 130792 | Carbohydrates | Carbohydrates | Fructose | 669% to 1272% |
| 130792 | Carbohydrates | Carbohydrates | Glucose | 579% to 1812% |
| 130792 | Esters | Esters | F1-U1.076 Fatty Acid Ester | 74% to 168% |
| 130792 | Esters | Esters | F1-U1.078 Fatty Acid Ester | 71% to 118% |
| 130792 | Esters | Esters | F1-U1.119 Fatty Acid Ester | 82% to 137% |
| 130792 | Esters - Hydroxy | Acyl acetylglycerols | 2-Eicosanoyl-1-acetylglycerol | 207% to 346% |
| 130792 | Esters - Hydroxy | Acyl acetylglycerols | 2-Octadecanoyl-1-acetylglycerol | 105% to 176% |
| 130792 | NA | NA | F3-U0.843 | New |
| 130792 | NA | NA | F3-U0.882 | 178% to 296% |
| 130792 | NA | NA | F3-U1.253 | 94% to 156% |
| 130792 | NA | NA | F3-U1.255 | 83% to 138% |
| 130792 | Sterols, Oxygenated Terpenes, and Other Isoprenoids | Prenylquinones | alpha-Tocopherol hydroquinone | New |
| 130792 | Sterols, Oxygenated Terpenes, and Other Isoprenoids | Terpenoids | beta-Sitosterol | 60% to 89% |
| 130792 | Sterols, Oxygenated Terpenes, and Other Isoprenoids | Terpenoids | Campesterol | 62% to 104% |
| 130792 | Sterols, Oxygenated Terpenes, and Other Isoprenoids | Terpenoids | Cholest-7-en-3-ol | 60% to 91% |
| 130792 | Sterols, Oxygenated Terpenes, and Other Isoprenoids | Terpenoids | Cholesterol | 60% to 85% |
| 130792 | Sterols, Oxygenated Terpenes, and Other Isoprenoids | Terpenoids | F1-U1.164 Sterol | New |
| 130792 | Sterols, Oxygenated Terpenes, and Other Isoprenoids | Terpenoids | F1-U1.173 Sterol | 84% to 140% |
| 130792 | Sterols, Oxygenated Terpenes, and Other Isoprenoids | Terpenoids | Fucosterol | 81% to 135% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130826

| Seq ID | Chemical Class | Biochemical Class | Compound Name | Modification |
|---|---|---|---|---|
| 130826 | Acids | Acids | Carbamic acid | 120% to 199% |
| 130826 | Acids - Fatty Unsat | Fatty Acids and Related Waxes | 9,12,15-Octadecatrienoic acid | 133% to 222% |
| 130826 | Acids - Hydroxy Alpha | Acid Pathway | Butanoic acid, 2,3,4-trihydroxy- | 313% to 521% |
| 130826 | Acids - Hydroxy Alpha | Carbohydrates | Glyceric acid | New |
| 130826 | Acids - Hydroxy Alpha | Carbohydrates | Quinic acid | 217% to 361% |
| 130826 | Alcohols | Carbohydrates | Inositol | 66% to 110% |
| 130826 | Alkaloids and Other Bases | Polyamines | 1,4-Butanediamine | 63% to 104% |
| 130826 | Amino Acids and Related Compounds | Amino Acids and Related Compounds | Aspartic acid | 136% to 227% |
| 130826 | Amino Acids and Related Compounds | Amino Acids and Related Compounds | Glutamic acid | 60% to 86% |
| 130826 | Carbohydrates | Carbohydrates | F3-U0.768 Carbohydrate | -60% to -87% |
| 130826 | Carbohydrates | Carbohydrates | F3-U0.813 Carbohydrate | 158% to 263% |
| 130826 | Carbohydrates | Carbohydrates | F3-U0.816 Carbohydrate | 60% to 76% |
| 130826 | Carbohydrates | Carbohydrates | F3-U0.825 Carbohydrate | 400% to 667% |
| 130826 | Carbohydrates | Carbohydrates | F3-U0.846 Carbohydrate | 78% to 131% |
| 130826 | Carbohydrates | Carbohydrates | F3-U0.848 Carbohydrate | 110% to 183% |
| 130826 | Carbohydrates | Carbohydrates | F3-U0.872 Hexose | 115% to 192% |
| 130826 | Carbohydrates | Carbohydrates | Fructose | 411% to 743% |
| 130826 | Carbohydrates | Carbohydrates | Glucose | 614% to 1725% |
| 130826 | NA | NA | F3-U0.751 | 153% to 255% |
| 130826 | NA | NA | F3-U0.882 | 188% to 313% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130864

| Seq ID | Chemical Class | Biochemical Class | Compound Name | Modification |
|---|---|---|---|---|
| 130864 | Amino Acids and Related Compounds | Amino Acids and Related Compounds | Histidine | 35% to 185% |
| 130864 | Amino Acids and Related Compounds | Amino Acids and Related Compounds | Methionine | 40% to 185% |
| 130864 | Amino Acids and Related Compounds | Amino Acids and Related Compounds | Tryptophan | New |
| 130864 | Amino Acids and Related Compounds | Amino Acids and Related Compounds | Tyrosine | New |
| 130864 | Amino Acids and Related Compounds | Amino Acids and Related Compounds | Valine | 260% to 615% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130866

| Seq ID | Chemical Class | Biochemical Class | Compound Name | Modification |
|---|---|---|---|---|
| 130866 | Alkenes and Alkynes | Terpenoids | Limonene | 443% to 738% |
| 130866 | Alkenes and Alkynes | Terpenoids | Squalene | New |
| 130866 | Esters | Esters | F1-U1.076 Fatty Acid Ester | 166% to 276% |
| 130866 | Esters | Esters | F1-U1.078 Fatty Acid Ester | 137% to 228% |
| 130866 | Esters | Esters | F1-U1.119 Fatty Acid Ester | 202% to 336% |
| 130866 | Esters - Hydroxy | Acyl acetylglycerols | 2-Eicosanoyl-1-acetylglycerol | 149% to 248% |
| 130866 | Esters - Hydroxy | Acyl acetylglycerols | 2-Octadecanoyl-1-acetylglycerol | 86% to 143% |
| 130866 | Hydrocarbons | Hydrocarbons | Octacosane, 2-methyl | 112% to 187% |
| 130866 | Hydrocarbons | Hydrocarbons | Triacontane, 2-methyl- | 99% to 166% |
| 130866 | NA | NA | F1-U0.948 | 83% to 138% |
| 130866 | Sterols, Oxygenated Terpenes, and Other Isoprenoids | Prenylquinones | alpha-Tocopherol | 193% to 322% |
| 130866 | Sterols, Oxygenated Terpenes, and Other Isoprenoids | Prenylquinones | alpha-Tocopherol hydroquinone | New |
| 130866 | Sterols, Oxygenated Terpenes, and Other Isoprenoids | Terpenoids | beta-Sitosterol | 74% to 124% |
| 130866 | Sterols, Oxygenated Terpenes, and Other Isoprenoids | Prenylquinones | beta-Tocopherol | New |
| 130866 | Sterols, Oxygenated Terpenes, and Other Isoprenoids | Terpenoids | Campesterol | 86% to 143% |
| 130866 | Sterols, Oxygenated Terpenes, and Other Isoprenoids | Terpenoids | Cholesterol | 106% to 176% |
| 130866 | Sterols, Oxygenated Terpenes, and Other Isoprenoids | Terpenoids | Fucosterol | 60% to 97% |
| 130866 | Sterols, Oxygenated Terpenes, and Other Isoprenoids | Terpenoids | Lanosterol | 68% to 114% |
| 130866 | Sterols, Oxygenated Terpenes, and Other Isoprenoids | Terpenoids | Stigmasterol | 122% to 204% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#130870

| Seq ID | Chemical Class | Biochemical Class | Compound Name | Modification |
|---|---|---|---|---|
| 130870 | Acids - Fatty | Fatty Acids and Related Waxes | Hexadecanoic acid | 7% to 38% |
| 130870 | Acids - Fatty Unsat | Fatty Acids and Related Waxes | 9-Hexadecenoic acid | 4% to 41% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#130930

| Seq ID | Chemical Class | Compound Name | Biochemical Class | Modification |
|---|---|---|---|---|
| 130930 | Acids - Hydroxy Alpha | Butanoic acid, 2,3,4-trihydroxy- | Acid Pathway | New |
| 130930 | Acids - Hydroxy Alpha | Citric acid | Acid Pathway | 224% to 373% |
| 130930 | Acids - Hydroxy Alpha | Quinic acid | Carbohydrates | 185% to 308% |
| 130930 | Alcohols | Inositol | Carbohydrates | 108% to 179% |
| 130930 | Amino Acids and Related Compounds | Glutamic acid | Amino Acids and Related Compounds | 75% to 124% |
| 130930 | Carbohydrates | F3-U0.768 Carbohydrate | Carbohydrates | New |
| 130930 | Carbohydrates | F3-U0.813 Carbohydrate | Carbohydrates | 121% to 201% |
| 130930 | Carbohydrates | F3-U0.821 Carbohydrate | Carbohydrates | 224% to 373% |
| 130930 | Carbohydrates | F3-U0.825 Carbohydrate | Carbohydrates | 89% to 148% |
| 130930 | Carbohydrates | F3-U0.846 Carbohydrate | Carbohydrates | 190% to 317% |
| 130930 | Carbohydrates | F3-U0.848 Carbohydrate | Carbohydrates | 148% to 247% |
| 130930 | Carbohydrates | F3-U0.872 Hexose | Carbohydrates | 270% to 450% |
| 130930 | Carbohydrates | F3-U1.189 Carbohydrate | Carbohydrates | New |
| 130930 | Carbohydrates | Fructose | Carbohydrates | 125% to 281% |
| 130930 | Carbohydrates | Glucose | Carbohydrates | 183% to 450% |
| 130930 | NA | F3-U0.751 | NA | New |
| 130930 | NA | F3-U0.785 | NA | 95% to 159% |
| 130930 | NA | F3-U0.804 | NA | New |
| 130930 | NA | F3-U0.843 | NA | 219% to 365% |
| 130930 | NA | F3-U0.852A | NA | 277% to 461% |
| 130930 | NA | F3-U0.882 | NA | 89% to 148% |
| 130930 | Phenols and Related Compounds | Chlorogenic acid | Phenylpropanes and Derivatives | 242% to 404% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#131046

| Seq ID | Chemical Class | Biochemical Class | Compound Name | Modification |
|---|---|---|---|---|
| 131046 | Acids - Hydroxy | Amino Acids and Related Compounds | Shikimic acid | 91% to 152% |
| 131046 | Acids - Hydroxy Alpha | Acid Pathway | Citric acid | 103% to 172% |
| 131046 | Amino Acids and Related Compounds | Amino Acids and Related Compounds | Glutamic acid | 131% to 218% |
| 131046 | Carbohydrates | Carbohydrates | F3-U0.813 Carbohydrate | 263% to 438% |
| 131046 | Carbohydrates | Carbohydrates | F3-U0.816 Carbohydrate | 91% to 152% |
| 131046 | Carbohydrates | Carbohydrates | F3-U0.821 Carbohydrate | 103% to 172% |
| 131046 | Carbohydrates | Carbohydrates | F3-U0.825 Carbohydrate | 145% to 242% |
| 131046 | Carbohydrates | Carbohydrates | F3-U0.846 Carbohydrate | 197% to 328% |
| 131046 | Carbohydrates | Carbohydrates | F3-U0.872 Hexose | 150% to 250% |
| 131046 | Carbohydrates | Carbohydrates | F3-U1.189 Carbohydrate | 186% to 311% |
| 131046 | Phenols and Related Compounds | Phenylpropanes and Derivatives | Chlorogenic acid | 230% to 383% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#131104

| Seq ID | Chemical Class | Biochemical Class | Compound Name | Modification |
|---|---|---|---|---|
| 131104 | Acids - Fatty | Fatty Acids and Related Waxes | Hexadecanoic acid | 14% to 44% |
| 131104 | Acids - Fatty Unsat | Fatty Acids and Related Waxes | 9,12,15-Octadecatrienoic acid | -5% to -17% |
| 131104 | Acids - Fatty Unsat | Fatty Acids and Related Waxes | 9-Hexadecenoic acid | 1% to 27% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#131281

| SeqID | Chemical Class | Biochemical Class | Compound Name | Modification |
|---|---|---|---|---|
| 131281 | Acids - Hydroxy Alpha | Acid Pathway | Butanoic acid, 2,3,4-trihydroxy- | 83% to 139% |
| 131281 | Alcohols | Carbohydrates | Inositol | 101% to 169% |
| 131281 | Alkenes and Alkynes | Terpenoids | Limonene | 127% to 212% |
| 131281 | Amino Acids and Related Compounds | Amino Acids and Related Compounds | Aspartic acid | 149% to 249% |
| 131281 | Amino Acids and Related Compounds | Amino Acids and Related Compounds | Glutamic acid | 176% to 293% |
| 131281 | Amino Acids and Related Compounds | Amino Acids and Related Compounds | Glutamine | New |
| 131281 | Amino Acids and Related Compounds | Amino Acids and Related Compounds | Proline, 5-oxo- | 153% to 255% |
| 131281 | Carbohydrates | Carbohydrates | F3-U0.768 Carbohydrate | 60% to 93% |
| 131281 | Carbohydrates | Carbohydrates | F3-U0.813 Carbohydrate | 762% to 1270% |
| 131281 | Carbohydrates | Carbohydrates | F3-U0.816 Carbohydrate | 474% to 790% |
| 131281 | Carbohydrates | Carbohydrates | F3-U0.821 Carbohydrate | 339% to 565% |
| 131281 | Carbohydrates | Carbohydrates | F3-U0.846 Carbohydrate | 162% to 270% |
| 131281 | Carbohydrates | Carbohydrates | F3-U0.872 Hexose | 182% to 304% |
| 131281 | Carbohydrates | Carbohydrates | F3-U1.189 Carbohydrate | 274% to 456% |
| 131281 | Carbohydrates | Carbohydrates | F3-U1.194 Carbohydrate | 414% to 690% |
| 131281 | Carbohydrates | Carbohydrates | Fructose | 546% to 1060% |
| 131281 | Carbohydrates | Carbohydrates | Galactose or Mannose | New |
| 131281 | Carbohydrates | Carbohydrates | Glucose | 300% to 806% |
| 131281 | Esters - Hydroxy | Acyl acetylglycerols | 2-Eicosanoyl-1-acetylglycerol | 60% to 91% |
| 131281 | NA | NA | F1-U0.873 | New |
| 131281 | NA | NA | F3-U0.736 | 133% to 222% |
| 131281 | NA | NA | F3-U0.852A | New |
| 131281 | NA | NA | F3-U1.253 | 96% to 160% |
| 131281 | NA | NA | F3-U1.255 | 147% to 245% |
| 131281 | Phenols and Related Compounds | Phenylpropanes and Derivatives | Chlorogenic acid | 208% to 347% |
| 131281 | Sterols, Oxygenated Terpenes, and Other Isoprenoids | Prenylquinones | alpha-Tocopherol | 125% to 208% |
| 131281 | Sterols, Oxygenated Terpenes, and Other Isoprenoids | Prenylquinones | alpha-Tocopherol hydroquinone | New |
| 131281 | Sterols, Oxygenated Terpenes, and Other Isoprenoids | Terpenoids | Fucosterol | -60% to -75% |
| 131281 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#131313

| Seq ID | Chemical Class | Biochemical Class | Compound Name | Modification |
|---|---|---|---|---|
| 131313 | Acids - Fatty | Fatty Acids and Related Waxes | Hexadecanoic acid | 6% to 30% |
| 131313 | Acids - Fatty | Fatty Acids and Related Waxes | Octadecanoic acid | 12% to 133% |
| 131313 | Acids - Fatty Unsat | Fatty Acids and Related Waxes | 7,10,13-Hexadecatrienoic acid | -12% to -59% |
| 131313 | Acids - Fatty Unsat | Fatty Acids and Related Waxes | 9-Hexadecenoic acid | -27% to -57% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#132564

| Seq ID | Chemical Class | Biochemical Class | Compound Name | Modification |
|---|---|---|---|---|
| 132564 | Acids - Hydroxy | Amino Acids and Related Compounds | Shikimic acid | 135% to 224% |
| 132564 | Acids - Hydroxy Alpha | Acid Pathway | Butanoic acid, 2,3,4-trihydroxy- | New |
| 132564 | Acids - Hydroxy Alpha | Acid Pathway | Citric acid | 206% to 343% |
| 132564 | Acids - Hydroxy Alpha | Carbohydrates | Glyceric acid | 169% to 282% |
| 132564 | Acids - Hydroxy Alpha | Carbohydrates | Quinic acid | 204% to 340% |
| 132564 | Alcohols | Carbohydrates | Inositol | 60% to 77% |
| 132564 | Amino Acids and Related Compounds | Amino Acids and Related Compounds | Glutamic acid | 100% to 167% |
| 132564 | Carbohydrates | Carbohydrates | F3-U0.813 Carbohydrate | 496% to 826% |
| 132564 | Carbohydrates | Carbohydrates | F3-U0.816 Carbohydrate | 135% to 224% |
| 132564 | Carbohydrates | Carbohydrates | F3-U0.821 Carbohydrate | 206% to 343% |
| 132564 | Carbohydrates | Carbohydrates | F3-U0.825 Carbohydrate | New |
| 132564 | Carbohydrates | Carbohydrates | F3-U0.846 Carbohydrate | 402% to 670% |
| 132564 | Carbohydrates | Carbohydrates | F3-U0.872 Hexose | 299% to 499% |
| 132564 | Carbohydrates | Carbohydrates | F3-U1.150 Carbohydrate | 60% to 94% |
| 132564 | Carbohydrates | Carbohydrates | F3-U1.189 Carbohydrate | New |
| 132564 | Carbohydrates | Carbohydrates | Glucose | 95% to 158% |
| 132564 | NA | NA | F3-U0.727 | -60% to -89% |
| 132564 | Phenols and Related Compounds | Phenylpropanes and Derivatives | Chlorogenic acid | 358% to 596% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#133405

| Seq ID | Chemical Class | Biochemical Class | Compound Name | Modification |
|---|---|---|---|---|
| 133405 | Amino Acids and Related Compounds | Amino Acids and Related Compounds | Serine | -30% to -50% |
| 133405 | Amino Acids and Related Compounds | Amino Acids and Related Compounds | Valine | 75% to 370% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#133507

| SeqID | Chemical Class | Biochemical Class | Compound Name | Modification |
|---|---|---|---|---|
| 133507 | Acids - Hydroxy Alpha | Acid Pathway | Butanoic acid, 2,3,4-trihydroxy- | 210% to 350% |
| 133507 | Acids - Hydroxy Alpha | Acid Pathway | Citric acid | 353% to 589% |
| 133507 | Alcohols | Carbohydrates | Inositol | 86% to 144% |
| 133507 | Alkaloids and Other Bases | Polyamines | 1,4-Butanediamine | 98% to 164% |
| 133507 | Alkaloids and Other Bases | Alkaloids and Other Bases | Nicotine | 187% to 311% |
| 133507 | Alkenes and Alkynes | Terpenoids | Limonene | 168% to 280% |
| 133507 | Amino Acids and Related Compounds | Amino Acids and Related Compounds | Aspartic acid | 184% to 306% |
| 133507 | Amino Acids and Related Compounds | Amino Acids and Related Compounds | Glutamic acid | 299% to 498% |
| 133507 | Amino Acids and Related Compounds | Amino Acids and Related Compounds | Proline | 217% to 362% |
| 133507 | Amino Acids and Related Compounds | Amino Acids and Related Compounds | Proline, 5-oxo- | 155% to 258% |
| 133507 | Carbohydrates | Carbohydrates | Arabinose or Xylose | New |
| 133507 | Carbohydrates | Carbohydrates | F3-U0.813 Carbohydrate | 478% to 797% |
| 133507 | Carbohydrates | Carbohydrates | F3-U0.816 Carbohydrate | 179% to 298% |
| 133507 | Carbohydrates | Carbohydrates | F3-U0.821 Carbohydrate | 353% to 589% |
| 133507 | Carbohydrates | Carbohydrates | F3-U0.825 Carbohydrate | 199% to 331% |
| 133507 | Carbohydrates | Carbohydrates | F3-U0.846 Carbohydrate | 126% to 210% |
| 133507 | Carbohydrates | Carbohydrates | F3-U0.872 Hexose | 103% to 171% |
| 133507 | Carbohydrates | Carbohydrates | F3-U0.952 Carbohydrate | 94% to 157% |
| 133507 | Carbohydrates | Carbohydrates | F3-U1.069 Carbohydrate | 263% to 438% |
| 133507 | Carbohydrates | Carbohydrates | F3-U1.113 Carbohydrate | 119% to 198% |
| 133507 | Carbohydrates | Carbohydrates | F3-U1.120 Carbohydrate | New |
| 133507 | Carbohydrates | Carbohydrates | F3-U1.189 Carbohydrate | New |
| 133507 | Carbohydrates | Carbohydrates | F3-U1.194 Carbohydrate | New |
| 133507 | Carbohydrates | Carbohydrates | Galactose or Mannose | 60% to 78% |
| 133507 | Esters | Esters | F1-U1.076 Fatty Acid Ester | 258% to 430% |
| 133507 | Esters | Esters | F1-U1.113 Fatty Acid Ester | 171% to 284% |
| 133507 | Esters | Esters | F1-U1.119 Fatty Acid Ester | 118% to 197% |
| 133507 | Esters - Hydroxy | Acyl acetylglycerols | 2-Eicosanoyl-1-acetylglycerol | 171% to 284% |
| 133507 | Esters - Hydroxy | Acyl acetylglycerols | 2-Octadecanoyl-1-acetylglycerol | 144% to 240% |
| 133507 | NA | NA | F3-U0.704 | New |
| 133507 | NA | NA | F3-U0.727 | 60% to 94% |
| 133507 | NA | NA | F3-U0.751 | 424% to 706% |
| 133507 | NA | NA | F3-U0.852A | New |
| 133507 | NA | NA | F3-U1.229 | 109% to 181% |
| 133507 | NA | NA | F3-U1.253 | 125% to 209% |
| 133507 | NA | NA | F3-U1.255 | 65% to 108% |
| 133507 | Phenols and Related Compounds | Phenylpropanes and Derivatives | Chlorogenic acid | 580% to 966% |
| 133507 | Sterols, Oxygenated Terpenes, and Other Isoprenoids | Prenylquinones | alpha-Tocopherol | New |
| 133507 | Sterols, Oxygenated Terpenes, and Other Isoprenoids | Prenylquinones | alpha-Tocopherol hydroquinone | New |
| 133507 | Sterols, Oxygenated Terpenes, and Other Isoprenoids | Terpenoids | Campesterol | 85% to 142% |
| 133507 | Sterols, Oxygenated Terpenes, and Other Isoprenoids | Terpenoids | Cycloartanol, 24-methylene- | New |
| 133507 | Sterols, Oxygenated Terpenes, and Other Isoprenoids | Terpenoids | Cycloartenol | 60% to 94% |
| 133507 | Sterols, Oxygenated Terpenes, and Other Isoprenoids | Terpenoids | F1-U1.164 Sterol | New |
| 133507 | Sterols, Oxygenated Terpenes, and Other Isoprenoids | Terpenoids | F1-U1.244 Sterol | New |
| 133507 | Sterols, Oxygenated Terpenes, and Other Isoprenoids | Prenylquinones | gamma-Tocopherol | New |
| 133507 | Sterols, Oxygenated Terpenes, and Other Isoprenoids | Terpenoids | Stigmasterol | 99% to 166% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#133537

| Seq ID | Chemical Class | Biochemical Class | Compound Name | Modification |
|---|---|---|---|---|
| 133537 | Acids - Hydroxy Alpha | Acid Pathway | Butanoic acid, 2,3,4-trihydroxy- | 73% to 121% |
| 133537 | Acids - Hydroxy Alpha | Acid Pathway | Citric acid | 227% to 378% |
| 133537 | Acids - Hydroxy Alpha | Acid Pathway | Malic acid | 60% to 86% |
| 133537 | Acids - Hydroxy Alpha | Carbohydrates | Quinic acid | 69% to 115% |
| 133537 | Alkaloids and Other Bases | Alkaloids and Other Bases | Nicotine | 124% to 207% |
| 133537 | Amino Acids and Related Compounds | Amino Acids and Related Compounds | Proline, 5-oxo- | -60% to -92% |
| 133537 | Carbohydrates | Carbohydrates | F3-U0.821 Carbohydrate | 227% to 378% |
| 133537 | Carbohydrates | Carbohydrates | F3-U0.846 Carbohydrate | 402% to 669% |
| 133537 | Carbohydrates | Carbohydrates | F3-U0.872 Hexose | 111% to 184% |
| 133537 | Carbohydrates | Carbohydrates | F3-U1.104 Carbohydrate | NQ |
| 133537 | Carbohydrates | Carbohydrates | Fructose | -60% to -96% |
| 133537 | Carbohydrates | Carbohydrates | Galactose or Mannose | -67% to -100% |
| 133537 | Carbohydrates | Carbohydrates | Glucose | -60% to -81% |
| 133537 | NA | NA | F3-U0.882 | -60% to -93% |
| 133537 | NA | NA | F3-U1.253 | -60% to -78% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#133547

| Seq ID | Chemical Class | Biochemical Class | Compound Name | Modification |
|---|---|---|---|---|
| 133547 | Acids - Hydroxy Alpha | Acid Pathway | Butanoic acid, 2,3,4-trihydroxy- | New |
| 133547 | Acids - Hydroxy Alpha | Acid Pathway | Citric acid | 523% to 2153% |
| 133547 | Acids - Hydroxy Alpha | Carbohydrates | F3-U0.992 Sugar acid | 137% to 229% |
| 133547 | Alcohols | Carbohydrates | Inositol | 76% to 185% |
| 133547 | Alkaloids and Other Bases | Polyamines | 1,4-Butanediamine | 92% to 163% |
| 133547 | Alkenes and Alkynes | Terpenoids | Limonene | 60% to 169% |
| 133547 | Amino Acids and Related Compounds | Amino Acids and Related Compounds | Asparagine | New |
| 133547 | Amino Acids and Related Compounds | Amino Acids and Related Compounds | Aspartic acid | 107% to 299% |
| 133547 | Amino Acids and Related Compounds | Amino Acids and Related Compounds | Glutamic acid | 106% to 832% |
| 133547 | Amino Acids and Related Compounds | Amino Acids and Related Compounds | Proline | 60% to 599% |
| 133547 | Amino Acids and Related Compounds | Amino Acids and Related Compounds | Proline, 5-oxo- | 71% to 403% |
| 133547 | Amino Acids and Related Compounds | Amino Acids and Related Compounds | Serine | New |
| 133547 | Carbohydrates | Carbohydrates | F3-U0.813 Carbohydrate | New |
| 133547 | Carbohydrates | Carbohydrates | F3-U0.816 Carbohydrate | New |
| 133547 | Carbohydrates | Carbohydrates | F3-U0.821 Carbohydrate | 553% to 921% |
| 133547 | Carbohydrates | Carbohydrates | F3-U0.825 Carbohydrate | New |
| 133547 | Carbohydrates | Carbohydrates | F3-U0.846 Carbohydrate | New |
| 133547 | Carbohydrates | Carbohydrates | F3-U0.872 Hexose | 73% to 731% |
| 133547 | Carbohydrates | Carbohydrates | F3-U1.069 Carbohydrate | 624% to 1041% |
| 133547 | Carbohydrates | Carbohydrates | F3-U1.120 Carbohydrate | New |
| 133547 | Carbohydrates | Carbohydrates | F3-U1.148 Carbohydrate | 357% to 595% |
| 133547 | Carbohydrates | Carbohydrates | F3-U1.150 Carbohydrate | 128% to 963% |
| 133547 | Carbohydrates | Carbohydrates | F3-U1.189 Carbohydrate | New |
| 133547 | Carbohydrates | Carbohydrates | F3-U1.194 Carbohydrate | New |
| 133547 | Carbohydrates | Carbohydrates | Fructose | -60% to -93% |
| 133547 | Carbohydrates | Carbohydrates | Galactose or Mannose | NQ |
| 133547 | Carbohydrates | Carbohydrates | Glucose | 282% to 739% |
| 133547 | Esters | Esters | F1-U1.076 Fatty Acid Ester | 183% to 308% |
| 133547 | Esters | Esters | F1-U1.110 Fatty Acid Ester | 193% to 355% |
| 133547 | Esters | Esters | F1-U1.119 Fatty Acid Ester | 60% to 294% |
| 133547 | Esters - Hydroxy | Acyl acetylglycerols | 2-Eicosanoyl-1-acetylglycerol | 79% to 132% |
| 133547 | Esters - Hydroxy | Acyl acetylglycerols | 2-Octadecanoyl-1-acetylglycerol | NQ |
| 133547 | Hydrocarbons | Hydrocarbons | Octacosane, 2-methyl | 63% to 105% |
| 133547 | Hydrocarbons | Hydrocarbons | Triacontane, 2-methyl- | 85% to 142% |
| 133547 | NA | NA | F1-U0.765 | 74% to 509% |
| 133547 | NA | NA | F3-U0.727 | New |
| 133547 | NA | NA | F3-U0.751 | -60% to -100% |
| 133547 | NA | NA | F3-U0.852A | New |
| 133547 | NA | NA | F3-U0.882 | 194% to 324% |
| 133547 | NA | NA | F3-U1.003 | 76% to 419% |
| 133547 | NA | NA | F3-U1.177 | 60% to 159% |
| 133547 | NA | NA | F3-U1.229 | 61% to 200% |
| 133547 | NA | NA | F3-U1.253 | 68% to 113% |
| 133547 | NA | NA | F3-U1.255 | 104% to 1142% |
| 133547 | Phenols and Related Compounds | Phenylpropanes and Derivatives | Caffeic acid | New |
| 133547 | Sterols, Oxygenated Terpenes, and Other Isoprenoids | Prenylquinones | alpha-Tocopherol | 145% to 585% |
| 133547 | Sterols, Oxygenated Terpenes, and Other Isoprenoids | Prenylquinones | alpha-Tocopherol hydroquinone | New |
| 133547 | Sterols, Oxygenated Terpenes, and Other Isoprenoids | Terpenoids | beta-Sitosterol | 94% to 318% |
| 133547 | Sterols, Oxygenated Terpenes, and Other Isoprenoids | Prenylquinones | beta-Tocopherol | 60% to 137% |
| 133547 | Sterols, Oxygenated Terpenes, and Other Isoprenoids | Terpenoids | Campesterol | 565% to 941% |
| 133547 | Sterols, Oxygenated Terpenes, and Other Isoprenoids | Terpenoids | Cholesterol | New |
| 133547 | Sterols, Oxygenated Terpenes, and Other Isoprenoids | Terpenoids | Cycloartanol, 24-methylene- | 65% to 108% |
| 133547 | Sterols, Oxygenated Terpenes, and Other Isoprenoids | Terpenoids | Ergosta-8,24(28)-dien-3-ol, 4,14-dimethyl- | 93% to 536% |
| 133547 | Sterols, Oxygenated Terpenes, and Other Isoprenoids | Terpenoids | F1-U1.136 Sterol | 289% to 449% |
| 133547 | Sterols, Oxygenated Terpenes, and Other Isoprenoids | Terpenoids | F1-U1.217 Sterol | 60% to 443% |
| 133547 | Sterols, Oxygenated Terpenes, and Other Isoprenoids | Terpenoids | F1-U1.244 Sterol | New |
| 133547 | Sterols, Oxygenated Terpenes, and Other Isoprenoids | Terpenoids | Fucosterol | 735% to 1225% |
| 133547 | Sterols, Oxygenated Terpenes, and Other Isoprenoids | Prenylquinones | gamma-Tocopherol | 118% to 307% |
| 133547 | Sterols, Oxygenated Terpenes, and Other Isoprenoids | Terpenoids | Lophenol, 24-methylene- | |
| 133547 | Sterols, Oxygenated Terpenes, and Other Isoprenoids | Terpenoids | Stigmasterol | |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#134962

| Seq ID | Chemical Class | Biochemical Class | Compound Name | Modification |
|---|---|---|---|---|
| 134962 | Acids - Hydroxy Alpha | Acid Pathway | Butanoic acid, 2,3,4-trihydroxy- | 225% to 376% |
| 134962 | Acids - Hydroxy Alpha | Carbohydrates | Quinic acid | 101% to 169% |
| 134962 | Amino Acids and Related Compounds | Amino Acids and Related Compounds | Glutamic acid | 66% to 110% |
| 134962 | Carbohydrates | Carbohydrates | F3-U0.846 Carbohydrate | 60% to 78% |
| 134962 | Carbohydrates | Carbohydrates | F3-U0.872 Hexose | 60% to 99% |
| 134962 | Carbohydrates | Carbohydrates | Glucose | 60% to 114% |
| 134962 | NA | NA | F3-U0.634 | 67% to 111% |
| 134962 | NA | NA | F3-U0.751 | 111% to 184% |
| 134962 | NA | NA | F3-U0.882 | 60% to 77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#135042

| Seq ID | Chemical Class | Biochemical Class | Compound Name | Modification |
|---|---|---|---|---|
| 135042 | Acids - Hydroxy Alpha Acid Pathway | | Butanoic acid, 2,3,4-trihydroxy- | 87% to 145% |
| 135042 | Amino Acids and Related Compounds | Amino Acids and Related Compounds | Proline | 308% to 513% |
| 135042 | Carbohydrates | Carbohydrates | Fructose | 65% to 122% |
| 135042 | Carbohydrates | Carbohydrates | Glucose | 60% to 116% |
| 135042 | NA | NA | F3-U0.751 | 138% to 229% |
| 135042 | NA | NA | F3-U1.253 | 146% to 243% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#135085

| Seq ID | Chemical Class | Biochemical Class | Compound Name | Modification |
|---|---|---|---|---|
| 135085 | Acids | Acids | Carbamic acid | -73% to -100% |
| 135085 | Acids | Acids | Hexanedioic acid | -60% to -95% |
| 135085 | Acids - Hydroxy Alpha | Acid Pathway | Citric acid | -60% to -94% |
| 135085 | Amino Acids and Related Compounds | Amino Acids and Related Compounds | Aspartic acid | New |
| 135085 | Amino Acids and Related Compounds | Amino Acids and Related Compounds | Glutamic acid | New |
| 135085 | Amino Acids and Related Compounds | Amino Acids and Related Compounds | Histidine | 60% to 290% |
| 135085 | Amino Acids and Related Compounds | Amino Acids and Related Compounds | Serine | New |
| 135085 | Carbohydrates | Carbohydrates | F3-U0.768 Carbohydrate | NQ |
| 135085 | Carbohydrates | Carbohydrates | F3-U0.816 Carbohydrate | 120% to 199% |
| 135085 | Carbohydrates | Carbohydrates | F3-U0.821 Carbohydrate | -60% to -94% |
| 135085 | Carbohydrates | Carbohydrates | F3-U0.846 Carbohydrate | -60% to -82% |
| 135085 | Carbohydrates | Carbohydrates | F3-U1.148 Carbohydrate | 88% to 147% |
| 135085 | Carbohydrates | Carbohydrates | F3-U1.189 Carbohydrate | New |
| 135085 | Carbohydrates | Carbohydrates | F3-U1.194 Carbohydrate | New |
| 135085 | Carbohydrates | Carbohydrates | Fructose | 419% to 1984% |
| 135085 | Carbohydrates | Carbohydrates | Galactose or Mannose | New |
| 135085 | Carbohydrates | Carbohydrates | Glucose | 738% to 1739% |
| 135085 | NA | NA | F3-U0.736 | NQ |
| 135085 | NA | NA | F3-U0.882 | 198% to 414% |
| 135085 | NA | NA | F3-U1.253 | 150% to 250% |
| 135085 | Phenols and Related Compounds | Phenylpropanes and Derivatives | Chlorogenic acid | 91% to 189% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#135224

| Seq ID | Chemical Class | Biochemical Class | Compound Name | Modification |
|---|---|---|---|---|
| 135224 | Acids | Acids | Carbamic acid | -75% to -100% |
| 135224 | Acids - Hydroxy Alpha | Acid Pathway | Butanoic acid, 2,3,4-trihydroxy- | 95% to 395% |
| 135224 | Acids - Hydroxy Alpha | Carbohydrates | Quinic acid | 68% to 332% |
| 135224 | Amino Acids and Related Compounds | Amino Acids and Related Compounds | Arginine | 60% to 670% |
| 135224 | Amino Acids and Related Compounds | Amino Acids and Related Compounds | Asparagine | 109% to 181% |
| 135224 | Amino Acids and Related Compounds | Amino Acids and Related Compounds | Glutamic acid | New |
| 135224 | Carbohydrates | Carbohydrates | F3-U0.768 Carbohydrate | NQ |
| 135224 | Carbohydrates | Carbohydrates | F3-U0.813 Carbohydrate | New |
| 135224 | Carbohydrates | Carbohydrates | F3-U0.816 Carbohydrate | 63% to 528% |
| 135224 | Carbohydrates | Carbohydrates | F3-U0.821 Carbohydrate | 60% to 358% |
| 135224 | Carbohydrates | Carbohydrates | F3-U0.846 Carbohydrate | 127% to 1618% |
| 135224 | Carbohydrates | Carbohydrates | F3-U0.872 Hexose | 120% to 1730% |
| 135224 | Carbohydrates | Carbohydrates | Fructose | 1000% to 1699% |
| 135224 | Carbohydrates | Carbohydrates | Glucose | 65% to 3675% |
| 135224 | NA | NA | F3-U0.729 | NQ |
| 135224 | NA | NA | F3-U0.736 | NQ |
| 135224 | NA | NA | F3-U0.882 | 168% to 279% |
| 135224 | NA | NA | F3-U0.899 | 92% to 153% |
| 135224 | Phenols and Related Compounds | Phenylpropanes and Derivatives | Chlorogenic acid | 98% to 164% |

FIG. 6 continued

A list of metabolite compounds present in altered levels relative to reference samples as charararacterized by gas chromatography, liquid chromatography, and/or mass spectrometry. This list corresponds to samples transfected with nucleic acid sequence, Seq ID#135281

| Seq ID | Chemical Class | Biochemical Class | Compound Name | Modification |
|---|---|---|---|---|
| 135281 | Acids - Fatty | Fatty Acids and Related Waxes | Octadecanoic acid | 195% to 385% |
| 135281 | Acids - Fatty Branched | Fatty Acids and Related Waxes | Heptadecanoic acid, 16-methyl- | 125% to 1680% |
| 135281 | Acids - Fatty Branched | Fatty Acids and Related Waxes | Hexadecanoic acid, 14-methyl- | 65% to 1500% |
| 135281 | Acids - Fatty Unsat | Fatty Acids and Related Waxes | 7,10,13-Hexadecatrienoic acid | -90 to -95% |
| 135281 | Acids - Fatty Unsat | Fatty Acids and Related Waxes | 9,12,15-Octadecatrienoic acid | -65% to -100% |
| 135281 | Acids - Fatty Unsat | Fatty Acids and Related Waxes | 9-Hexadecenoic acid | 60% to 110% |
| 135281 | Acids - Hydroxy Alpha | Acid Pathway | Butanoic acid, 2,3,4-trihydroxy- | 151% to 252% |
| 135281 | Acids - Hydroxy Alpha | Acid Pathway | Citric acid | -60% to -88% |
| 135281 | Acids - Hydroxy Alpha | Carbohydrates | Quinic acid | 104% to 174% |
| 135281 | Amino Acids and Related Compounds | Amino Acids and Related Compounds | Aspartic acid | -60% to -97% |
| 135281 | Carbohydrates | Carbohydrates | F3-U0.816 Carbohydrate | -60% to -87% |
| 135281 | Carbohydrates | Carbohydrates | F3-U0.821 Carbohydrate | -60% to -88% |
| 135281 | Carbohydrates | Carbohydrates | F3-U0.825 Carbohydrate | -60% to -96% |
| 135281 | Carbohydrates | Carbohydrates | F3-U0.848 Carbohydrate | 509% to 848% |
| 135281 | Carbohydrates | Carbohydrates | Fructose | 186% to 396% |
| 135281 | Carbohydrates | Carbohydrates | Galactose or Mannose | 97% to 161% |
| 135281 | Carbohydrates | Carbohydrates | Glucose | 174% to 750% |
| 135281 | NA | NA | F3-U0.740 | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#135357

| Seq ID | Chemical Class | Biochemical Class | Compound Name | Modification |
|---|---|---|---|---|
| 135357 | Acids - Fatty Branched | Fatty Acids and Related Waxes | Hexadecanoic acid, 14-methyl- | -9% to -64% |
| 135357 | Acids - Fatty Unsat | Fatty Acids and Related Waxes | 7,10,13-Hexadecatrienoic acid | -7% to -42% |
| 135357 | Acids - Fatty Unsat | Fatty Acids and Related Waxes | 9,12-Octadecadienoic acid | -24% to -57% |
| 135357 | Acids - Fatty Unsat | Fatty Acids and Related Waxes | 9-Hexadecenoic acid | -9% to -44% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#135373

| Seq ID | Chemical Class | Biochemical Class | Compound Name | Modification |
|---|---|---|---|---|
| 135373 | Acids - Fatty | Fatty Acids and Related Waxes | Eicosanoic acid | -20% to -100% |
| 135373 | Acids - Fatty | Fatty Acids and Related Waxes | Hexadecanoic acid | 10% to 44% |
| 135373 | Acids - Fatty Unsat | Fatty Acids and Related Waxes | 7,10,13-Hexadecatrienoic acid | -11% to -51% |
| 135373 | Acids - Fatty Unsat | Fatty Acids and Related Waxes | 9,12,15-Octadecatrienoic acid | -1% to -29% |
| 135373 | Acids - Fatty Unsat | Fatty Acids and Related Waxes | 9,12-Octadecadienoic acid | 18% to 92% |
| 135373 | Acids - Fatty Unsat | Fatty Acids and Related Waxes | 9-Hexadecenoic acid | -19% to -35% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#135416

| Seq ID | Chemical Class | Biochemical Class | Compound Name | Modification |
|---|---|---|---|---|
| 135416 | Acids | Acids | Carbamic acid | 243% to 405% |
| 135416 | Acids - Hydroxy Alpha | Acid Pathway | Citric acid | 118% to 197% |
| 135416 | Acids - Hydroxy Alpha | Carbohydrates | Quinic acid | 84% to 140% |
| 135416 | Amino Acids and Related Compounds | Amino Acids and Related Compounds | Alanine | 65% to 160% |
| 135416 | Amino Acids and Related Compounds | Amino Acids and Related Compounds | Arginine | 120% to 1090% |
| 135416 | Amino Acids and Related Compounds | Amino Acids and Related Compounds | Asparagine | New |
| 135416 | Amino Acids and Related Compounds | Amino Acids and Related Compounds | Aspartic acid | -60% to -76% |
| 135416 | Amino Acids and Related Compounds | Amino Acids and Related Compounds | Lysine | 135% to 215% |
| 135416 | Amino Acids and Related Compounds | Amino Acids and Related Compounds | Methionine | 60% to 430% |
| 135416 | Amino Acids and Related Compounds | Amino Acids and Related Compounds | Proline | 215% to 358% |
| 135416 | Amino Acids and Related Compounds | Amino Acids and Related Compounds | Serine | 60% to 170% |
| 135416 | Amino Acids and Related Compounds | Amino Acids and Related Compounds | Threonine | 160% to 380% |
| 135416 | Amino Acids and Related Compounds | Amino Acids and Related Compounds | Tryptophan | New |
| 135416 | Amino Acids and Related Compounds | Amino Acids and Related Compounds | Tyrosine | New |
| 135416 | Amino Acids and Related Compounds | Amino Acids and Related Compounds | Valine | 175% to 1005% |
| 135416 | Carbohydrates | Carbohydrates | F3-U0.813 Carbohydrate | 88% to 147% |
| 135416 | Carbohydrates | Carbohydrates | F3-U0.816 Carbohydrate | 81% to 135% |
| 135416 | Carbohydrates | Carbohydrates | F3-U0.821 Carbohydrate | 118% to 197% |
| 135416 | Carbohydrates | Carbohydrates | F3-U0.846 Carbohydrate | 60% to 99% |
| 135416 | Carbohydrates | Carbohydrates | F3-U0.848 Carbohydrate | 108% to 180% |
| 135416 | Carbohydrates | Carbohydrates | F3-U0.872 Hexose | 78% to 130% |
| 135416 | NA | NA | F3-U0.736 | New |
| 135416 | NA | NA | F3-U0.852A | 77% to 128% |
| 135416 | NA | NA | F3-U0.882 | 60% to 95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#135511

| Seq ID | Chemical Class | Biochemical Class | Compound Name | Modification |
|---|---|---|---|---|
| 135511 | Amino Acids and Related Compounds | Amino Acids and Related Compounds | Alanine | 75% to 265% |
| 135511 | Amino Acids and Related Compounds | Amino Acids and Related Compounds | Arginine | 190% to 695% |
| 135511 | Amino Acids and Related Compounds | Amino Acids and Related Compounds | Glutamic acid | 60% to 180% |
| 135511 | Amino Acids and Related Compounds | Amino Acids and Related Compounds | Histidine | 105% to 475% |
| 135511 | Amino Acids and Related Compounds | Amino Acids and Related Compounds | Methionine | 300% to 3555% |
| 135511 | Amino Acids and Related Compounds | Amino Acids and Related Compounds | Threonine | 115% to 360% |
| 135511 | Amino Acids and Related Compounds | Amino Acids and Related Compounds | Tryptophan | New |
| 135511 | Amino Acids and Related Compounds | Amino Acids and Related Compounds | Tyrosine | New |
| 135511 | Amino Acids and Related Compounds | Amino Acids and Related Compounds | Valine | 1460% to 2330% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#135525

| Seq ID | Chemical Class | Biochemical Class | Compound Name | Modification |
|---|---|---|---|---|
| 135525 | Acids | Acids | Hexanedioic acid | -60% to -85% |
| 135525 | Acids - Fatty Unsat | Fatty Acids and Related Waxes | 7,10,13-Hexadecatrienoic acid | -95% to -100% |
| 135525 | Acids - Hydroxy Alpha | Acid Pathway | Butanoic acid, 2,3,4-trihydroxy- | 793% to 1322% |
| 135525 | Acids - Hydroxy Alpha | Acid Pathway | Citric acid | 691% to 1152% |
| 135525 | Acids - Hydroxy Alpha | Carbohydrates | Quinic acid | 61% to 102% |
| 135525 | Amino Acids and Related Compounds | Amino Acids and Related Compounds | Arginine | 110% to 475% |
| 135525 | Amino Acids and Related Compounds | Amino Acids and Related Compounds | Aspartic acid | -60% to -80% |
| 135525 | Amino Acids and Related Compounds | Amino Acids and Related Compounds | Glutamic acid | 60% to 218% |
| 135525 | Amino Acids and Related Compounds | Amino Acids and Related Compounds | Histidine | 60% to 325% |
| 135525 | Amino Acids and Related Compounds | Amino Acids and Related Compounds | Lysine | 60% to 295% |
| 135525 | Amino Acids and Related Compounds | Amino Acids and Related Compounds | Methionine | 200% to 2665% |
| 135525 | Amino Acids and Related Compounds | Amino Acids and Related Compounds | Proline | 449% to 748% |
| 135525 | Amino Acids and Related Compounds | Amino Acids and Related Compounds | Threonine | 60% to 235% |
| 135525 | Amino Acids and Related Compounds | Amino Acids and Related Compounds | Tryptophan | New |
| 135525 | Amino Acids and Related Compounds | Amino Acids and Related Compounds | Tyrosine | New |
| 135525 | Amino Acids and Related Compounds | Amino Acids and Related Compounds | Valine | 960% to 1550% |
| 135525 | Carbohydrates | Carbohydrates | F3-U0.813 Carbohydrate | 304% to 506% |
| 135525 | Carbohydrates | Carbohydrates | F3-U0.816 Carbohydrate | 218% to 363% |
| 135525 | Carbohydrates | Carbohydrates | F3-U0.821 Carbohydrate | 691% to 1152% |
| 135525 | Carbohydrates | Carbohydrates | F3-U0.825 Carbohydrate | New |
| 135525 | Carbohydrates | Carbohydrates | F3-U0.846 Carbohydrate | 1427% to 2379% |
| 135525 | Carbohydrates | Carbohydrates | F3-U0.848 Carbohydrate | 60% to 100% |
| 135525 | Carbohydrates | Carbohydrates | F3-U0.872 Hexose | 675% to 1125% |
| 135525 | Carbohydrates | Carbohydrates | F3-U1.150 Carbohydrate | 126% to 210% |
| 135525 | Carbohydrates | Carbohydrates | F3-U1.189 Carbohydrate | 224% to 373% |
| 135525 | Carbohydrates | Carbohydrates | F3-U1.194 Carbohydrate | 190% to 316% |
| 135525 | NA | NA | F3-U0.751 | 179% to 299% |
| 135525 | NA | NA | F3-U0.843 | New |
| 135525 | NA | NA | F3-U0.852A | New |
| 135525 | NA | NA | F3-U0.882 | -60% to -76% |
| 135525 | Phenols and Related Compounds | Phenylpropanes and Derivatives | Chlorogenic acid | 94% to 157% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#135668

| Seq ID | Chemical Class | Biochemical Class | Compound Name | Modification |
|---|---|---|---|---|
| 135668 | Acids - Fatty | Fatty Acids and Related Waxes | Docosanoic acid | New |
| 135668 | Acids - Fatty | Fatty Acids and Related Waxes | Eicosanoic acid | 60% to 289% |
| 135668 | Acids - Fatty | Fatty Acids and Related Waxes | Heptadecanoic acid | 104% to 173% |
| 135668 | Acids - Fatty | Fatty Acids and Related Waxes | Hexadecanoic acid | 60% to 120% |
| 135668 | Acids - Fatty | Fatty Acids and Related Waxes | Nonadecanoic acid | 60% to 99% |
| 135668 | Acids - Fatty | Fatty Acids and Related Waxes | Octadecanoic acid | 60% to 82% |
| 135668 | Acids - Fatty Branched | Fatty Acids and Related Waxes | Heneicosanoic acid, 20-methyl- | 60% to 167% |
| 135668 | Acids - Fatty Branched | Fatty Acids and Related Waxes | Heptadecanoic acid, 16-methyl- | 60% to 449% |
| 135668 | Acids - Fatty Branched | Fatty Acids and Related Waxes | Hexadecanoic acid, 14-methyl- | 60% to 76% |
| 135668 | Acids - Fatty Branched | Fatty Acids and Related Waxes | Octadecanoic acid, 17-methyl- | 94% to 157% |
| 135668 | Acids - Fatty Unsat | Fatty Acids and Related Waxes | 10-Octadecenoic acid | 127% to 211% |
| 135668 | Acids - Fatty Unsat | Fatty Acids and Related Waxes | 7,10-Hexadecadienoic acid | 60% to 94% |
| 135668 | Acids - Fatty Unsat | Fatty Acids and Related Waxes | 9-Octadecenoic acid | 60% to 108% |
| 135668 | Acids - Fatty Unsat | Fatty Acids and Related Waxes | F2-U1.401 Octadecatrienoic acid isomer | 60% to 99% |
| 135668 | Acids - Hydroxy Alpha | Carbohydrates | Quinic acid | 145% to 241% |
| 135668 | Amino Acids and Related Compounds | Amino Acids and Related Compounds | Arginine | 60% to 530% |
| 135668 | Amino Acids and Related Compounds | Amino Acids and Related Compounds | Glutamine | New |
| 135668 | Amino Acids and Related Compounds | Amino Acids and Related Compounds | Lysine | 60% to 110% |
| 135668 | Amino Acids and Related Compounds | Amino Acids and Related Compounds | Threonine | 60% to 130% |
| 135668 | Amino Acids and Related Compounds | Amino Acids and Related Compounds | Tryptophan | New |
| 135668 | Amino Acids and Related Compounds | Amino Acids and Related Compounds | Tyrosine | New |
| 135668 | Amino Acids and Related Compounds | Amino Acids and Related Compounds | Valine | 60% to 310% |
| 135668 | Carbohydrates | Carbohydrates | F3-U0.848 Carbohydrate | 173% to 289% |
| 135668 | Carbohydrates | Carbohydrates | F3-U0.872 Hexose | 60% to 92% |
| 135668 | Carbohydrates | Carbohydrates | F3-U1.104 Carbohydrate | New |
| 135668 | Carbohydrates | Carbohydrates | F3-U1.113 Carbohydrate | 80% to 133% |
| 135668 | Carbohydrates | Carbohydrates | F3-U1.189 Carbohydrate | 60% to 77% |
| 135668 | Carbohydrates | Carbohydrates | Fructose | 187% to 457% |
| 135668 | Carbohydrates | Carbohydrates | Galactose or Mannose | 331% to 551% |
| 135668 | Carbohydrates | Carbohydrates | Glucose | 179% to 827% |
| 135668 | Esters | Esters | F1-U1.065 Fatty Acid Ester | 60% to 131% |
| 135668 | Esters | Esters | F1-U1.076 Fatty Acid Ester | 60% to 93% |
| 135668 | Esters | Esters | F1-U1.119 Fatty Acid Ester | 60% to 325% |
| 135668 | Esters | Esters | F1-U1.121 Fatty Acid Ester | 115% to 192% |
| 135668 | Esters - Hydroxy | Acyl acetylglycerols | 2-Eicosanoyl-1-acetylglycerol | 60% to 194% |
| 135668 | Esters - Hydroxy | Acyl acetylglycerols | 2-Octadecanoyl-1-acetylglycerol | 143% to 238% |
| 135668 | Hydrocarbons | Hydrocarbons | Dotriacontane, 2-methyl- | 65% to 128% |
| 135668 | Hydrocarbons | Hydrocarbons | Hentriacontane | New |
| 135668 | Hydrocarbons | Hydrocarbons | Triacontane, 2-methyl- | 95% to 159% |
| 135668 | NA | NA | F3-U0.882 | 338% to 563% |
| 135668 | NA | NA | F3-U0.899 | 60% to 80% |
| 135668 | Phenols and Related Compounds | Phenylpropanes and Derivatives | Chlorogenic acid | 60% to 93% |
| 135668 | Sterols, Oxygenated Terpenes, and Other Isoprenoids | Prenylquinones | alpha-Tocopherol | 60% to 224% |
| 135668 | Sterols, Oxygenated Terpenes, and Other Isoprenoids | Prenylquinones | alpha-Tocopherol hydroquinone | 60% to 113% |
| 135668 | Sterols, Oxygenated Terpenes, and Other Isoprenoids | Terpenoids | beta-Sitosterol | 60% to 100% |
| 135668 | Sterols, Oxygenated Terpenes, and Other Isoprenoids | Prenylquinones | beta-Tocopherol | New |
| 135668 | Sterols, Oxygenated Terpenes, and Other Isoprenoids | Terpenoids | Cholesterol | 60% to 96% |
| 135668 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#136763

| Seq ID | Chemical Class | Biochemical Class | Compound Name | Modification |
|---|---|---|---|---|
| 136763 | Acids - Hydroxy Alpha | Acid Pathway | Butanoic acid, 2,3,4-trihydroxy- | 117% to 196% |
| 136763 | Acids - Hydroxy Alpha | Carbohydrates | Quinic acid | 114% to 190% |
| 136763 | Amino Acids and Related Compounds | Amino Acids and Related Compounds | Glutamic acid | 135% to 225% |
| 136763 | Carbohydrates | Carbohydrates | F3-U0.816 Carbohydrate | 60% to 110% |
| 136763 | Carbohydrates | Carbohydrates | F3-U0.821 Carbohydrate | 100% to 197% |
| 136763 | Carbohydrates | Carbohydrates | F3-U0.846 Carbohydrate | 262% to 740% |
| 136763 | Carbohydrates | Carbohydrates | F3-U0.872 Hexose | 235% to 699% |
| 136763 | Carbohydrates | Carbohydrates | F3-U1.189 Carbohydrate | 60% to 98% |
| 136763 | Carbohydrates | Carbohydrates | Glucose | 64% to 130% |
| 136763 | NA | NA | F3-U0.751 | 91% to 343% |
| 136763 | Phenols and Related Compounds | Phenylpropanes and Derivatives | Chlorogenic acid | 63% to 105% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#136767

| Seq ID | Chemical Class | Biochemical Class | Compound Name | Modification |
|---|---|---|---|---|
| 136767 | Amino Acids and Related Compounds | Amino Acids and Related Compounds | Alanine | 30% to 100% |
| 136767 | Amino Acids and Related Compounds | Amino Acids and Related Compounds | Arginine | 70% to 815% |
| 136767 | Amino Acids and Related Compounds | Amino Acids and Related Compounds | Glutamic acid | 70% to 170% |
| 136767 | Amino Acids and Related Compounds | Amino Acids and Related Compounds | Threonine | 85% to 245% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#136817

| Seq ID | Chemical Class | Biochemical Class | Compound Name | Modification |
|---|---|---|---|---|
| 136817 | Acids - Hydroxy Alpha | Acid Pathway | Butanoic acid, 2,3,4-trihydroxy- | 76% to 126% |
| 136817 | Acids - Hydroxy Alpha | Carbohydrates | Quinic acid | 111% to 186% |
| 136817 | Amino Acids and Related Compounds | Amino Acids and Related Compounds | Glutamic acid | 90% to 149% |
| 136817 | Carbohydrates | Carbohydrates | F3-U0.813 Carbohydrate | 65% to 108% |
| 136817 | Carbohydrates | Carbohydrates | F3-U0.846 Carbohydrate | 60% to 100% |
| 136817 | Carbohydrates | Carbohydrates | F3-U0.848 Carbohydrate | 219% to 365% |
| 136817 | Carbohydrates | Carbohydrates | F3-U0.872 Hexose | 77% to 128% |
| 136817 | Carbohydrates | Carbohydrates | F3-U1.189 Carbohydrate | NQ |
| 136817 | Carbohydrates | Carbohydrates | Glucose | 74% to 153% |
| 136817 | NA | NA | F3-U0.634 | 61% to 101% |
| 136817 | NA | NA | F3-U0.751 | 165% to 274% |
| 136817 | NA | NA | F3-U0.852A | 60% to 79% |
| 136817 | Phenols and Related Compounds | Phenylpropanes and Derivatives | Chlorogenic acid | -60% to -78% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#137131

| Seq ID | Chemical Class | Biochemical Class | Compound Name | Modification |
|---|---|---|---|---|
| 137131 | Acids - Fatty | Fatty Acids and Related Waxes | Eicosanoic acid | -58% to -100% |
| 137131 | Acids - Fatty | Fatty Acids and Related Waxes | Hexadecanoic acid | -15% to -29% |
| 137131 | Acids - Fatty Branched | Fatty Acids and Related Waxes | Hexadecanoic acid, 14-methyl- | 76% to 899% |
| 137131 | Acids - Fatty Unsat | Fatty Acids and Related Waxes | 7,10,13-Hexadecatrienoic acid | -3% to -26% |
| 137131 | Acids - Fatty Unsat | Fatty Acids and Related Waxes | 9,12,15-Octadecatrienoic acid | -6% to -15% |
| 137131 | Acids - Fatty Unsat | Fatty Acids and Related Waxes | 9,12-Octadecadienoic acid | 23% to 71% |
| 137131 | Acids - Fatty Unsat | Fatty Acids and Related Waxes | 9-Hexadecenoic acid | 46% to 249% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#138578

| Seq ID | Chemical Class | Biochemical Class | Compound Name | Modification |
|---|---|---|---|---|
| 138578 | Acids | Acids | Hexanedioic acid | New |
| 138578 | Acids - Fatty | Fatty Acids and Related Waxes | Eicosanoic acid | 60% to 96% |
| 138578 | Acids - Fatty | Fatty Acids and Related Waxes | Octadecanoic acid | 60% to 110% |
| 138578 | Acids - Fatty Branched | Fatty Acids and Related Waxes | Heptadecanoic acid, 16-methyl- | 60% to 100% |
| 138578 | Acids - Fatty Unsat | Fatty Acids and Related Waxes | 7,10,13-Hexadecatrienoic acid | -60% to -68% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#138832

| Seq ID | Chemical Class | Biochemical Class | Compound Name | Modification |
|---|---|---|---|---|
| 138832 | Acids - Fatty | Fatty Acids and Related Waxes | Eicosanoic acid | -61% to -100% |
| 138832 | Acids - Fatty | Fatty Acids and Related Waxes | Hexadecanoic acid | 3% to 19% |
| 138832 | Acids - Fatty Branched | Fatty Acids and Related Waxes | Heptadecanoic acid, 16-methyl- | -18% to -89% |
| 138832 | Acids - Fatty Unsat | Fatty Acids and Related Waxes | 9,12,15-Octadecatrienoic acid | -8% to -16% |
| 138832 | Acids - Fatty Unsat | Fatty Acids and Related Waxes | 9,12-Octadecadienoic acid | 34% to 103% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#138843

| Seq ID | Chemical Class | Biochemical Class | Compound Name | Modification |
|---|---|---|---|---|
| 138843 | Acids - Fatty | Fatty Acids and Related Waxes | Hexadecanoic acid | 40% to 60% |
| 138843 | Acids - Fatty | Fatty Acids and Related Waxes | Octadecanoic acid | 37% to 126% |
| 138843 | Acids - Fatty Branched | Fatty Acids and Related Waxes | Heptadecanoic acid, 16-methyl- | 10% to 50% |
| 138843 | Acids - Fatty Unsat | Fatty Acids and Related Waxes | 7,10,13-Hexadecatrienoic acid | -32% to -59% |
| 138843 | Acids - Fatty Unsat | Fatty Acids and Related Waxes | 9,12,15-Octadecatrienoic acid | -10% to -18% |
| 138843 | Acids - Fatty Unsat | Fatty Acids and Related Waxes | 9-Octadecenoic acid | -29% to -71% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#139222

| Seq ID | Chemical Class | Biochemical Class | Compound Name | Modification |
|---|---|---|---|---|
| 139222 | Acids - Fatty | Fatty Acids and Related Waxes | Eicosanoic acid | -63% to -100% |
| 139222 | Acids - Fatty Branched | Fatty Acids and Related Waxes | Heptadecanoic acid, 16-methyl- | -4% to -97% |
| 139222 | Acids - Fatty Unsat | Fatty Acids and Related Waxes | 7,10,13-Hexadecatrienoic acid | -3% to -40% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#139281

| Seq ID | Chemical Class | Biochemical Class | Compound Name | Modification |
|---|---|---|---|---|
| 139281 | Acids | Acids | Hexanedioic acid | New |
| 139281 | Acids - Fatty | Fatty Acids and Related Waxes | Eicosanoic acid | -60% to -70% |
| 139281 | Acids - Fatty | Fatty Acids and Related Waxes | Heptadecanoic acid | 104% to 174% |
| 139281 | Acids - Fatty | Fatty Acids and Related Waxes | Hexadecanoic acid | 60% to 99% |
| 139281 | Acids - Fatty | Fatty Acids and Related Waxes | Nonadecanoic acid | 84% to 140% |
| 139281 | Acids - Fatty | Fatty Acids and Related Waxes | Octadecanoic acid | 78% to 130% |
| 139281 | Acids - Fatty Branched | Fatty Acids and Related Waxes | Hexadecanoic acid, 14-methyl- | 60% to 88% |
| 139281 | Acids - Fatty Unsat | Fatty Acids and Related Waxes | 7,10,13-Docosatrienoic acid | 108% to 179% |
| 139281 | Acids - Fatty Unsat | Fatty Acids and Related Waxes | 7,10-Hexadecadienoic acid | 88% to 147% |
| 139281 | Acids - Fatty Unsat | Fatty Acids and Related Waxes | 9,12-Octadecadienoic acid | 71% to 119% |
| 139281 | Acids - Fatty Unsat | Fatty Acids and Related Waxes | 9-Hexadecenoic acid | 177% to 296% |
| 139281 | Acids - Fatty Unsat | Fatty Acids and Related Waxes | 9-Octadecenoic acid | 128% to 213% |
| 139281 | Acids - Fatty Unsat | Fatty Acids and Related Waxes | F2-U1.365 Octadecenoic acid Isomer | NQ |
| 139281 | Acids - Hydroxy Alpha | Acid Pathway | Butanoic acid, 2,3,4-trihydroxy- | 248% to 413% |
| 139281 | Acids - Hydroxy Alpha | Acid Pathway | Citric acid | 176% to 294% |
| 139281 | Amino Acids and Related Compounds | Amino Acids and Related Compounds | Glutamic acid | 83% to 138% |
| 139281 | NA | NA | F3-U0.751 | 141% to 236% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#139321

| Seq ID | Chemical Class | Biochemical Class | Compound Name | Modification |
|---|---|---|---|---|
| 139321 | Acids | Acids | Carbamic acid | 823% to 1372% |
| 139321 | Acids - Hydroxy Alpha | Acid Pathway | Butanoic acid, 2,3,4-trihydroxy- | 78% to 519% |
| 139321 | Acids - Hydroxy Alpha | Acid Pathway | Citric acid | 760% to 1266% |
| 139321 | Acids - Hydroxy Alpha | Acid Pathway | Malic acid | 142% to 236% |
| 139321 | Acids - Hydroxy Alpha | Carbohydrates | Quinic acid | 115% to 191% |
| 139321 | Alkaloids and Other Bases | Polyamines | 1,4-Butanediamine | 60% to 82% |
| 139321 | Amino Acids and Related Compounds | Amino Acids and Related Compounds | Glutamic acid | 119% to 198% |
| 139321 | Amino Acids and Related Compounds | Amino Acids and Related Compounds | Proline | 204% to 340% |
| 139321 | Carbohydrates | Carbohydrates | F3-U0.813 Carbohydrate | 229% to 382% |
| 139321 | Carbohydrates | Carbohydrates | F3-U0.816 Carbohydrate | 189% to 315% |
| 139321 | Carbohydrates | Carbohydrates | F3-U0.821 Carbohydrate | 760% to 1266% |
| 139321 | Carbohydrates | Carbohydrates | F3-U0.825 Carbohydrate | New |
| 139321 | Carbohydrates | Carbohydrates | F3-U0.846 Carbohydrate | 962% to 1604% |
| 139321 | Carbohydrates | Carbohydrates | F3-U0.872 Hexose | 517% to 862% |
| 139321 | Carbohydrates | Carbohydrates | F3-U1.189 Carbohydrate | 115% to 191% |
| 139321 | Carbohydrates | Carbohydrates | F3-U1.194 Carbohydrate | 101% to 168% |
| 139321 | Carbohydrates | Carbohydrates | Fructose | 68% to 113% |
| 139321 | Carbohydrates | Carbohydrates | Glucose | 60% to 146% |
| 139321 | NA | NA | F3-U0.736 | New |
| 139321 | NA | NA | F3-U0.751 | 63% to 105% |
| 139321 | NA | NA | F3-U0.791 | 110% to 183% |
| 139321 | NA | NA | F3-U0.799 | New |
| 139321 | NA | NA | F3-U0.843 | New |
| 139321 | NA | NA | F3-U0.852A | New |
| 139321 | Phenols and Related Compounds | Phenylpropanes and Derivatives | Chlorogenic acid | 81% to 134% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#139357

| Seq ID | Chemical Class | Biochemical Class | Compound Name | Modification |
|---|---|---|---|---|
| 139357 | Acids - Fatty | Fatty Acids and Related Waxes | Hexadecanoic acid | 6% to 48% |
| 139357 | Acids - Fatty Unsat | Fatty Acids and Related Waxes | 7,10,13-Hexadecatrienoic acid | -2% to -44% |
| 139357 | Acids - Fatty Unsat | Fatty Acids and Related Waxes | 9,12,15-Octadecatrienoic acid | -1% to -20% |
| 139357 | Acids - Fatty Unsat | Fatty Acids and Related Waxes | 9-Hexadecenoic acid | -31% to -45% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#141821

| Seq ID | Chemical Class | Biochemical Class | Compound Name | Modification |
|---|---|---|---|---|
| 141821 | Acids - Fatty | Fatty Acids and Related Waxes | Eicosanoic acid | -60% to -99% |
| 141821 | Acids - Fatty | Fatty Acids and Related Waxes | Hexadecanoic acid | -9% to -53% |
| 141821 | Acids - Fatty | Fatty Acids and Related Waxes | Octadecanoic acid | -43% to -92% |
| 141821 | Acids - Fatty Branched | Fatty Acids and Related Waxes | Heptadecanoic acid, 16-methyl- | -63% to -97% |
| 141821 | Acids - Fatty Unsat | Fatty Acids and Related Waxes | 7,10,13-Hexadecatrienoic acid | 30% to 133% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#142731

| Seq ID | Chemical Class | Biochemical Class | Compound Name | Modification |
|---|---|---|---|---|
| 142731 | Acids - Fatty | Fatty Acids and Related Waxes | Hexadecanoic acid | 12% to 33% |
| 142731 | Acids - Fatty | Fatty Acids and Related Waxes | Octadecanoic acid | 21% to 78% |
| 142731 | Acids - Fatty Branched | Fatty Acids and Related Waxes | Hexadecanoic acid, 14-methyl- | -3% to -25% |
| 142731 | Acids - Fatty Unsat | Fatty Acids and Related Waxes | 9,12,15-Octadecatrienoic acid | -13% to -20% |
| 142731 | Acids - Fatty Unsat | Fatty Acids and Related Waxes | 9,12-Octadecadienoic acid | 19% to 33% |
| 142731 | Acids - Fatty Unsat | Fatty Acids and Related Waxes | 9-Hexadecenoic acid | -29% to -55% |
| 142731 | Acids - Fatty Unsat | Fatty Acids and Related Waxes | 9-Octadecenoic acid | 40% to 215% |
| 142731 | Amino Acids and Related Compounds | Amino Acids and Related Compounds | Alanine | 50% to 120% |
| 142731 | Amino Acids and Related Compounds | Amino Acids and Related Compounds | Glutamic acid | 30% to 170% |
| 142731 | Amino Acids and Related Compounds | Amino Acids and Related Compounds | Proline | 25% to 355% |
| 142731 | Amino Acids and Related Compounds | Amino Acids and Related Compounds | Serine | 75% to 125% |
| 142731 | Amino Acids and Related Compounds | Amino Acids and Related Compounds | Threonine | 40% to 230% |
| 142731 | Amino Acids and Related Compounds | Amino Acids and Related Compounds | Valine | 125% to 500% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#167332

| Seq ID | Chemical Class | Biochemical Class | Compound Name | Modification |
|---|---|---|---|---|
| 167332 | Acids - Fatty | Fatty Acids and Related Waxes | Hexadecanoic acid | 36% to 66% |
| 167332 | Acids - Fatty | Fatty Acids and Related Waxes | Octadecanoic acid | 12% to 134% |
| 167332 | Acids - Fatty Branched | Fatty Acids and Related Waxes | Hexadecanoic acid, 14-methyl- | -52% to -83% |
| 167332 | Acids - Fatty Unsat | Fatty Acids and Related Waxes | 7,10,13-Hexadecatrienoic acid | -17% to -62% |
| 167332 | Acids - Fatty Unsat | Fatty Acids and Related Waxes | 9,12,15-Octadecatrienoic acid | -9% to -22% |
| 167332 | Acids - Fatty Unsat | Fatty Acids and Related Waxes | 9-Hexadecenoic acid | 4% to 76% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#167347

| Seq ID | Chemical Class | Biochemical Class | Compound Name | Modification |
|---|---|---|---|---|
| 167347 | Acids - Fatty | Fatty Acids and Related Waxes | Hexadecanoic acid | 9% to 39% |
| 167347 | Acids - Fatty | Fatty Acids and Related Waxes | Octadecanoic acid | 29% to 122% |
| 167347 | Acids - Fatty Unsat | Fatty Acids and Related Waxes | 7,10,13-Hexadecatrienoic acid | -8% to -60% |
| 167347 | Acids - Fatty Unsat | Fatty Acids and Related Waxes | 9,12,15-Octadecatrienoic acid | -17% to -29% |
| 167347 | Acids - Fatty Unsat | Fatty Acids and Related Waxes | 9-Hexadecenoic acid | -32% to -56% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#167403

| Seq ID | Chemical Class | Biochemical Class | Compound Name | Modification |
|---|---|---|---|---|
| 167403 | Acids - Fatty | Fatty Acids and Related Waxes | Eicosanoic acid | -9% to -47% |
| 167403 | Acids - Fatty | Fatty Acids and Related Waxes | Hexadecanoic acid | 8% to 66% |
| 167403 | Acids - Fatty | Fatty Acids and Related Waxes | Octadecanoic acid | 30% to 123% |
| 167403 | Acids - Fatty Branched | Fatty Acids and Related Waxes | Heptadecanoic acid, 16-methyl- | -9% to -51% |
| 167403 | Acids - Fatty Unsat | Fatty Acids and Related Waxes | 9,12,15-Octadecatrienoic acid | -3% to -35% |
| 167403 | Acids - Fatty Unsat | Fatty Acids and Related Waxes | 9,12-Octadecadienoic acid | 49% to 97% |
| 167403 | Acids - Fatty Unsat | Fatty Acids and Related Waxes | 9-Hexadecenoic acid | -6% to -70% |
| 167403 | Acids - Fatty Unsat | Fatty Acids and Related Waxes | 9-Octadecenoic acid | 5% to 126% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#167406

| Seq ID | Chemical Class | Biochemical Class | Compound Name | Modification |
|---|---|---|---|---|
| 167406 | Acids | Acids | Carbamic acid | 108% to 207% |
| 167406 | Alkaloids and Other Bases | Polyamines | 1,4-Butanediamine | 60% to 77% |
| 167406 | Carbohydrates | Carbohydrates | F3-U0.872 Hexose | 60% to 93% |
| 167406 | Carbohydrates | Carbohydrates | Fructose | 189% to 339% |
| 167406 | Carbohydrates | Carbohydrates | Glucose | 284% to 604% |
| 167406 | NA | NA | F3-U0.736 | 244% to 406% |
| 167406 | NA | NA | F3-U0.882 | 181% to 302% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#167420

| Seq ID | Chemical Class | Biochemical Class | Compound Name | Modification |
|---|---|---|---|---|
| 167420 | NA | NA | F1-U0.966 | New |
| 167420 | Alkenes and Alkynes | Terpenoids | Limonene | 60% to 78% |
| 167420 | Sterols, Oxygenated Terpenes, and Other Isoprenoids | Prenylquinones | alpha-Tocopherol | 196% to 326% |
| 167420 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#167575

| Seq ID | Chemical Class | Biochemical Class | Compound Name | Modification |
|---|---|---|---|---|
| 167575 | Acids - Fatty | Fatty Acids and Related Waxes | Hexadecanoic acid | 5% to 30% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#167582

| Seq ID | Chemical Class | Biochemical Class | Compound Name | Modification |
|--------|----------------|-------------------|---------------|--------------|
| 167582 | Acids - Fatty | Fatty Acids and Related Waxes | Eicosanoic acid | New |
| 167582 | Acids - Fatty | Fatty Acids and Related Waxes | Hexadecanoic acid | 4% to 14% |
| 167582 | Acids - Fatty | Fatty Acids and Related Waxes | Octadecanoic acid | New |
| 167582 | Acids - Fatty Branched | Fatty Acids and Related Waxes | Heptadecanoic acid, 16-methyl- | New |
| 167582 | Acids - Fatty Branched | Fatty Acids and Related Waxes | Hexadecanoic acid, 14-methyl- | New |
| 167582 | Acids - Fatty Unsat | Fatty Acids and Related Waxes | 7,10,13-Hexadecatrienoic acid | New |
| 167582 | Acids - Fatty Unsat | Fatty Acids and Related Waxes | 9,12,15-Octadecatrienoic acid | New |
| 167582 | Acids - Fatty Unsat | Fatty Acids and Related Waxes | 9,12-Octadecadienoic acid | New |
| 167582 | Acids - Fatty Unsat | Fatty Acids and Related Waxes | 9-Hexadecenoic acid | New |
| 167582 | Acids - Fatty Unsat | Fatty Acids and Related Waxes | 9-Octadecenoic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#167874

| Seq ID | Chemical Class | Biochemical Class | Compound Name | Modification |
|---|---|---|---|---|
| 167874 | Amino Acids and Related Compounds | Amino Acids and Related Compounds | Isoleucine | New |
| 167874 | Amino Acids and Related Compounds | Amino Acids and Related Compounds | Lysine | 45% to 115% |
| 167874 | Amino Acids and Related Compounds | Amino Acids and Related Compounds | Tyrosine | New |
| 167874 | Amino Acids and Related Compounds | Amino Acids and Related Compounds | Valine | 25% to 660% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#168151

| Seq ID | Chemical Class | Biochemical Class | Compound Name | Modification |
|---|---|---|---|---|
| 168151 | Acids | Acids | Carbamic acid | 66% to 109% |
| 168151 | Acids - Hydroxy Alpha | Acid Pathway | Citric acid | 156% to 259% |
| 168151 | Acids - Hydroxy Alpha | Acid Pathway | Malic acid | 67% to 111% |
| 168151 | Alkaloids and Other Bases | Polyamines | 1,4-Butanediamine | -60% to -81% |
| 168151 | Amino Acids and Related Compounds | Amino Acids and Related Compounds | Glutamine | NQ |
| 168151 | Carbohydrates | Carbohydrates | F3-U0.816 | 62% to 103% |
| 168151 | Carbohydrates | Carbohydrates | F3-U0.821 | 156% to 259% |
| 168151 | Carbohydrates | Carbohydrates | F3-U0.825 | 240% to 399% |
| 168151 | Carbohydrates | Carbohydrates | F3-U0.846 | 107% to 178% |
| 168151 | Carbohydrates | Carbohydrates | F3-U1.113 | -60% to -80% |
| 168151 | Carbohydrates | Carbohydrates | F3-U1.189 | -64% to -100% |
| 168151 | Carbohydrates | Carbohydrates | F3-U1.194 | -60% to -80% |
| 168151 | Carbohydrates | Carbohydrates | Fructose | -66% to -100% |
| 168151 | Carbohydrates | Carbohydrates | Galactose or Mannose | NQ |
| 168151 | Carbohydrates | Carbohydrates | Glucose | -60% to -100% |
| 168151 | NA | NA | F3-U0.727 | 61% to 101% |
| 168151 | NA | NA | F3-U0.843 | 181% to 301% |
| 168151 | NA | NA | F3-U1.253 | -60% to -82% |
| 168151 | NA | NA | F3-U1.255 | -60% to -81% |
| 168151 | Phenols and Related Compounds | Phenylpropanes and Derivatives | Chlorogenic acid | -60% to -93% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#168217

| Seq ID | Chemical Class | Biochemical Class | Compound Name | Modification |
|---|---|---|---|---|
| 168217 | Acids - Fatty | Fatty Acids and Related Waxes | Eicosanoic acid | -5% to -100% |
| 168217 | Acids - Fatty | Fatty Acids and Related Waxes | Hexadecanoic acid | 4% to 63% |
| 168217 | Acids - Fatty | Fatty Acids and Related Waxes | Octadecanoic acid | 51% to 301% |
| 168217 | Acids - Fatty Unsat | Fatty Acids and Related Waxes | 7,10,13-Hexadecatrienoic acid | -44% to -62% |
| 168217 | Acids - Fatty Unsat | Fatty Acids and Related Waxes | 9,12,15-Octadecatrienoic acid | -24% to -34% |
| 168217 | Acids - Fatty Unsat | Fatty Acids and Related Waxes | 9,12-Octadecadienoic acid | -5% to -53% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#168219

| Seq ID | Chemical Class | Biochemical Class | Compound Name | Modification |
|---|---|---|---|---|
| 168219 | Acids - Fatty | Fatty Acids and Related Waxes | Eicosanoic acid | 61% to 200% |
| 168219 | Acids - Fatty | Fatty Acids and Related Waxes | Hexadecanoic acid | -51% to -58% |
| 168219 | Acids - Fatty | Fatty Acids and Related Waxes | Octadecanoic acid | -40% to -52% |
| 168219 | Acids - Fatty Branched | Fatty Acids and Related Waxes | Heptadecanoic acid, 16-methyl- | -30% to -64% |
| 168219 | Acids - Fatty Unsat | Fatty Acids and Related Waxes | 7,10,13-Hexadecatrienoic acid | -36% to -52% |
| 168219 | Acids - Fatty Unsat | Fatty Acids and Related Waxes | 9,12,15-Octadecatrienoic acid | 31% to 47% |
| 168219 | Acids - Fatty Unsat | Fatty Acids and Related Waxes | 9,12-Octadecadienoic acid | -27% to -48% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#168244

| Seq ID | Chemical Class | Biochemical Class | Compound Name | Modification |
|---|---|---|---|---|
| 168244 | Amino Acids and Related Compounds | Amino Acids and Related Compounds | Arginine | 75% to 285% |
| 168244 | Amino Acids and Related Compounds | Amino Acids and Related Compounds | Histidine | 35% to 370% |
| 168244 | Amino Acids and Related Compounds | Amino Acids and Related Compounds | Isoleucine | New |
| 168244 | Amino Acids and Related Compounds | Amino Acids and Related Compounds | Lysine | 115% to 215% |
| 168244 | Amino Acids and Related Compounds | Amino Acids and Related Compounds | Methionine | 205% to 640% |
| 168244 | Amino Acids and Related Compounds | Amino Acids and Related Compounds | Tyrosine | New |
| 168244 | Amino Acids and Related Compounds | Amino Acids and Related Compounds | Valine | 85% to 1020% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#168264

| Seq ID | Chemical Class | Biochemical Class | Compound Name | Modification |
|---|---|---|---|---|
| 168264 | Acids - Hydroxy Alpha | Acid Pathway | Butanoic acid, 2,3,4-trihydroxy- | New |
| 168264 | Acids - Hydroxy Alpha | Acid Pathway | Citric acid | 362% to 604% |
| 168264 | Acids - Hydroxy Alpha | Acid Pathway | Malic acid | 63% to 105% |
| 168264 | Acids - Hydroxy Alpha | Carbohydrates | Quinic acid | 174% to 290% |
| 168264 | Alcohols | Carbohydrates | Inositol | 60% to 83% |
| 168264 | Amino Acids and Related Compounds | Amino Acids and Related Compounds | Glutamic acid | 111% to 185% |
| 168264 | Carbohydrates | Carbohydrates | F3-U0.813 Carbohydrate | 318% to 530% |
| 168264 | Carbohydrates | Carbohydrates | F3-U0.816 Carbohydrate | 225% to 375% |
| 168264 | Carbohydrates | Carbohydrates | F3-U0.821 Carbohydrate | 362% to 604% |
| 168264 | Carbohydrates | Carbohydrates | F3-U0.825 Carbohydrate | 497% to 828% |
| 168264 | Carbohydrates | Carbohydrates | F3-U0.846 Carbohydrate | 357% to 596% |
| 168264 | Carbohydrates | Carbohydrates | F3-U0.872 Hexose | 248% to 414% |
| 168264 | Carbohydrates | Carbohydrates | F3-U1.189 Carbohydrate | 60% to 85% |
| 168264 | Carbohydrates | Carbohydrates | Fructose | -60% to -86% |
| 168264 | NA | NA | F3-U0.751 | 166% to 277% |
| 168264 | NA | NA | F3-U0.843 | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#168331

| Seq ID | Chemical Class | Biochemical Class | Compound Name | Modification |
|---|---|---|---|---|
| 168331 | Acids - Fatty | Fatty Acids and Related Waxes | Eicosanoic acid | -55% to -84% |
| 168331 | Acids - Fatty | Fatty Acids and Related Waxes | Hexadecanoic acid | 17% to 28% |
| 168331 | Acids - Fatty Branched | Fatty Acids and Related Waxes | Heptadecanoic acid, 16-methyl- | -13% to -65% |
| 168331 | Acids - Fatty Branched | Fatty Acids and Related Waxes | Hexadecanoic acid, 14-methyl- | 14% to 30% |
| 168331 | Acids - Fatty Unsat | Fatty Acids and Related Waxes | 7,10,13-Hexadecatrienoic acid | 23% to 45% |
| 168331 | Acids - Fatty Unsat | Fatty Acids and Related Waxes | 9,12,15-Octadecatrienoic acid | -4% to -8% |
| 168331 | Acids - Fatty Unsat | Fatty Acids and Related Waxes | 9-Hexadecenoic acid | -24% to -76% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#168338

| Seq ID | Chemical Class | Biochemical Class | Compound Name | Modification |
|---|---|---|---|---|
| 168338 | Acids - Hydroxy Alpha | Acid Pathway | Citric acid | 171% to 284% |
| 168338 | Acids - Hydroxy Alpha | Acid Pathway | Malic acid | 77% to 129% |
| 168338 | Acids - Hydroxy Alpha | Carbohydrates | Quinic acid | 65% to 109% |
| 168338 | Alcohols | Carbohydrates | Inositol | 88% to 146% |
| 168338 | Carbohydrates | Carbohydrates | F3-U0.813 Carbohydrate | 117% to 195% |
| 168338 | Carbohydrates | Carbohydrates | F3-U0.816 Carbohydrate | 60% to 88% |
| 168338 | Carbohydrates | Carbohydrates | F3-U0.821 Carbohydrate | 171% to 284% |
| 168338 | Carbohydrates | Carbohydrates | F3-U0.825 Carbohydrate | 345% to 576% |
| 168338 | Carbohydrates | Carbohydrates | F3-U0.846 Carbohydrate | 434% to 723% |
| 168338 | Carbohydrates | Carbohydrates | F3-U0.872 Hexose | 252% to 421% |
| 168338 | Carbohydrates | Carbohydrates | F3-U1.150 Carbohydrate | 85% to 142% |
| 168338 | Carbohydrates | Carbohydrates | Galactose or Mannose | -60% to -85% |
| 168338 | NA | NA | F3-U0.751 | 676% to 1126% |
| 168338 | NA | NA | F3-U0.843 | 100% to 166% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#168479

| Seq ID | Chemical Class | Biochemical Class | Compound Name | Modification |
|---|---|---|---|---|
| 168479 | NA | NA | F1-U0.873 | New |
| 168479 | Alkenes and Alkynes | Terpenoids | Limonene | 88% to 146% |
| 168479 | Sterols, Oxygenated Terpenes, and Other Isoprenoids | Prenylquinones | alpha-Tocopherol | 94% to 157% |
| 168479 | Sterols, Oxygenated Terpenes, and Other Isoprenoids | Terpenoids | Cycloartanol, 24-methylene- | 104% to 173% |
| 168479 | Sterols, Oxygenated Terpenes, and Other Isoprenoids | Prenylquinones | gamma-Tocopherol | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#168524

| Seq ID | Chemical Class | Biochemical Class | Compound Name | Modification |
|---|---|---|---|---|
| 168524 | Acids - Hydroxy | Amino Acids and Related Compounds | Shikimic acid | 119% to 199% |
| 168524 | Acids - Hydroxy Alpha | Acid Pathway | Butanoic acid, 2,3,4-trihydroxy- | New |
| 168524 | Acids - Hydroxy Alpha | Acid Pathway | Citric acid | 276% to 460% |
| 168524 | Acids - Hydroxy Alpha | Carbohydrates | Quinic acid | 133% to 221% |
| 168524 | Amino Acids and Related Compounds | Amino Acids and Related Compounds | Aspartic acid | 103% to 171% |
| 168524 | Amino Acids and Related Compounds | Amino Acids and Related Compounds | Glutamic acid | 192% to 320% |
| 168524 | Amino Acids and Related Compounds | Amino Acids and Related Compounds | Proline, 5-oxo- | 93% to 155% |
| 168524 | Carbohydrates | Carbohydrates | F3-U0.816 Carbohydrate | 119% to 199% |
| 168524 | Carbohydrates | Carbohydrates | F3-U0.821 Carbohydrate | 276% to 460% |
| 168524 | Carbohydrates | Carbohydrates | F3-U0.846 Carbohydrate | 522% to 869% |
| 168524 | Carbohydrates | Carbohydrates | F3-U0.872 Hexose | 202% to 336% |
| 168524 | Carbohydrates | Carbohydrates | F3-U1.189 Carbohydrate | 122% to 203% |
| 168524 | Carbohydrates | Carbohydrates | Fructose | -62% to -100% |
| 168524 | Carbohydrates | Carbohydrates | Galactose or Mannose | NQ |
| 168524 | Carbohydrates | Carbohydrates | Glucose | -60% to -83% |
| 168524 | NA | NA | F3-U0.751 | New |
| 168524 | Phenols and Related Compounds | Phenylpropanes and Derivatives | Chlorogenic acid | 109% to 181% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#171033

| Seq ID | Chemical Class | Biochemical Class | Compound Name | Modification |
|---|---|---|---|---|
| 171033 | Acids | Acids | Carbamic acid | -61% to -100% |
| 171033 | Acids - Fatty | Fatty Acids and Related Waxes | Eicosanoic acid | 80% to 186% |
| 171033 | Acids - Fatty Unsat | Fatty Acids and Related Waxes | 9-Octadecenoic acid | -60% to -70% |
| 171033 | Acids - Fatty Unsat | Fatty Acids and Related Waxes | Hexadecadienoic acid | -60% to -88% |
| 171033 | Acids - Hydroxy Alpha | Acid Pathway | Citric acid | 61% to 102% |
| 171033 | Acids - Hydroxy Alpha | Acid Pathway | Malic acid | -60% to -94% |
| 171033 | Acids - Hydroxy Alpha | Carbohydrates | Quinic acid | -60% to -84% |
| 171033 | Amino Acids and Related Compounds | Amino Acids and Related Compounds | Arginine | 60% to 595% |
| 171033 | Amino Acids and Related Compounds | Amino Acids and Related Compounds | Asparagine | New |
| 171033 | Amino Acids and Related Compounds | Amino Acids and Related Compounds | Glutamine | New |
| 171033 | Amino Acids and Related Compounds | Amino Acids and Related Compounds | Histidine | 60% to 200% |
| 171033 | Amino Acids and Related Compounds | Amino Acids and Related Compounds | Isoleucine | New |
| 171033 | Amino Acids and Related Compounds | Amino Acids and Related Compounds | Leucine | New |
| 171033 | Amino Acids and Related Compounds | Amino Acids and Related Compounds | Methionine | 60% to 200% |
| 171033 | Amino Acids and Related Compounds | Amino Acids and Related Compounds | Phenylalanine | 78% to 890% |
| 171033 | Amino Acids and Related Compounds | Amino Acids and Related Compounds | Threonine | 60% to 265% |
| 171033 | Amino Acids and Related Compounds | Amino Acids and Related Compounds | Tryptophan | New |
| 171033 | Amino Acids and Related Compounds | Amino Acids and Related Compounds | Tyrosine | New |
| 171033 | Amino Acids and Related Compounds | Amino Acids and Related Compounds | Valine | 60% to 610% |
| 171033 | Carbohydrates | Carbohydrates | F3-U0.770 Carbohydrate | NQ |
| 171033 | Carbohydrates | Carbohydrates | F3-U0.813 Carbohydrate | 115% to 513% |
| 171033 | Carbohydrates | Carbohydrates | F3-U0.816 Carbohydrate | 80% to 353% |
| 171033 | Carbohydrates | Carbohydrates | F3-U0.821 Carbohydrate | 61% to 102% |
| 171033 | Carbohydrates | Carbohydrates | F3-U0.825 Carbohydrate | 127% to 276% |
| 171033 | Carbohydrates | Carbohydrates | F3-U0.846 Carbohydrate | 188% to 401% |
| 171033 | Carbohydrates | Carbohydrates | F3-U0.872 Hexose | 60% to 360% |
| 171033 | Carbohydrates | Carbohydrates | F3-U1.189 Carbohydrate | 85% to 142% |
| 171033 | Carbohydrates | Carbohydrates | F3-U1.194 Carbohydrate | 126% to 210% |
| 171033 | Carbohydrates | Carbohydrates | Fructose | 70% to 242% |
| 171033 | Carbohydrates | Carbohydrates | Glucose | 60% to 135% |
| 171033 | NA | NA | F3-U0.736 | NQ |
| 171033 | NA | NA | F3-U0.858 | NQ |
| 171033 | NA | NA | F3-U0.868 | New |
| 171033 | NA | NA | F3-U0.882 | 80% to 134% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#171051

| Seq ID | Chemical Class | Biochemical Class | Compound Name | Modification |
|---|---|---|---|---|
| 171051 | Acids - Fatty | Fatty Acids and Related Waxes | Hexadecanoic acid | 2% to 57% |
| 171051 | Acids - Fatty | Fatty Acids and Related Waxes | Octadecanoic acid | 5% to 228% |
| 171051 | Acids - Fatty Unsat | Fatty Acids and Related Waxes | 7,10,13-Hexadecatrienoic acid | -14% to -71% |
| 171051 | Acids - Fatty Unsat | Fatty Acids and Related Waxes | 9,12,15-Octadecatrienoic acid | -2% to -23% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#171278

| Seq ID | Chemical Class | Biochemical Class | Compound Name | Modification |
|---|---|---|---|---|
| 171278 | Acids - Hydroxy Alpha | Carbohydrates | Quinic acid | -60% to -76% |
| 171278 | Amino Acids and Related Compounds | Amino Acids and Related Compounds | Arginine | 60% to 350% |
| 171278 | Amino Acids and Related Compounds | Amino Acids and Related Compounds | Cysteine | 60% to 770% |
| 171278 | Amino Acids and Related Compounds | Amino Acids and Related Compounds | Glycine | 60% to 580% |
| 171278 | Amino Acids and Related Compounds | Amino Acids and Related Compounds | Isoleucine | 95% to 385% |
| 171278 | Amino Acids and Related Compounds | Amino Acids and Related Compounds | Leucine | 80% to 545% |
| 171278 | Amino Acids and Related Compounds | Amino Acids and Related Compounds | Phenylalanine | 60% to 455% |
| 171278 | Amino Acids and Related Compounds | Amino Acids and Related Compounds | Tyrosine | 80% to 730% |
| 171278 | Amino Acids and Related Compounds | Amino Acids and Related Compounds | Valine | 60% to 475% |
| 171278 | Carbohydrates | Carbohydrates | F3-U0.768 Carbohydrate | -60% to -86% |
| 171278 | Carbohydrates | Carbohydrates | F3-U0.770 Carbohydrate | NQ |
| 171278 | Carbohydrates | Carbohydrates | F3-U0.816 Carbohydrate | 60% to 80% |
| 171278 | Carbohydrates | Carbohydrates | F3-U0.825 Carbohydrate | 84% to 304% |
| 171278 | Carbohydrates | Carbohydrates | F3-U0.846 Carbohydrate | 125% to 813% |
| 171278 | Carbohydrates | Carbohydrates | F3-U0.872 Hexose | 137% to 1009% |
| 171278 | Carbohydrates | Carbohydrates | F3-U1.189 Carbohydrate | NQ |
| 171278 | Carbohydrates | Carbohydrates | Fructose | 60% to 323% |
| 171278 | Carbohydrates | Carbohydrates | Galactose or Mannose | 244% to 406% |
| 171278 | Carbohydrates | Carbohydrates | Glucose | 88% to 2179% |
| 171278 | NA | NA | F3-U0.858 | NQ |
| 171278 | NA | NA | F3-U0.882 | NQ |
| 171278 | Phenols and Related Compounds | Phenylpropanes and Derivatives | Chlorogenic acid | -60% to -76% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#171917

| Seq ID | Chemical Class | Biochemical Class | Compound Name | Modification |
|---|---|---|---|---|
| 171917 | Acids - Fatty Unsat | Fatty Acids and Related Waxes | 7,10,13-Hexadecatrienoic acid | -19% to -61% |
| 171917 | Acids - Fatty Unsat | Fatty Acids and Related Waxes | 9,12-Octadecadienoic acid | -36% to -63% |
| 171917 | Acids - Fatty Unsat | Fatty Acids and Related Waxes | 9-Hexadecenoic acid | -10% to -53% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#174804

| Seq ID | Chemical Class | Biochemical Class | Compound Name | Modification |
|---|---|---|---|---|
| 174804 | Acids - Fatty | Fatty Acids and Related Waxes | Eicosanoic acid | -40% to -51% |
| 174804 | Acids - Fatty | Fatty Acids and Related Waxes | Octadecanoic acid | -6% to -25% |
| 174804 | Acids - Fatty Branched | Fatty Acids and Related Waxes | Heptadecanoic acid, 16-methyl- | -39% to -62% |
| 174804 | Acids - Fatty Unsat | Fatty Acids and Related Waxes | 9-Octadecenoic acid | 34% to 76% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#174874

| Seq ID | Chemical Class | Biochemical Class | Compound Name | Modification |
|---|---|---|---|---|
| 174874 | Acids - Fatty | Fatty Acids and Related Waxes | Eicosanoic acid | 131% to 218% |
| 174874 | Acids - Fatty | Fatty Acids and Related Waxes | Octadecanoic acid | -60% to -90% |
| 174874 | Acids - Fatty Unsat | Fatty Acids and Related Waxes | 7,10,13-Hexadecatrienoic acid | 60% to 125% |
| 174874 | Acids - Fatty Unsat | Fatty Acids and Related Waxes | 9-Hexadecenoic acid | 60% to 95% |
| 174874 | Acids - Fatty Unsat | Fatty Acids and Related Waxes | 9-Octadecenoic acid | -60% to -80% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#174878

| Seq ID | Chemical Class | Biochemical Class | Compound Name | Modification |
|---|---|---|---|---|
| 174878 | Acids - Hydroxy | Amino Acids and Related Compounds | Shikimic acid | 143% to 238% |
| 174878 | Acids - Hydroxy Alpha | Acid Pathway | Butanoic acid, 2,3,4-trihydroxy- | New |
| 174878 | Acids - Hydroxy Alpha | Carbohydrates | Quinic acid | 527% to 878% |
| 174878 | Amino Acids and Related Compounds | Amino Acids and Related Compounds | Glutamic acid | 105% to 175% |
| 174878 | Amino Acids and Related Compounds | Amino Acids and Related Compounds | Proline | New |
| 174878 | Carbohydrates | Carbohydrates | F3-U0.846 Carbohydrate | 124% to 207% |
| 174878 | Carbohydrates | Carbohydrates | F3-U0.848 Carbohydrate | 208% to 346% |
| 174878 | Carbohydrates | Carbohydrates | F3-U0.872 Hexose | 194% to 324% |
| 174878 | Carbohydrates | Carbohydrates | F3-U1.189 Carbohydrate | 60% to 87% |
| 174878 | Carbohydrates | Carbohydrates | Fructose | 120% to 262% |
| 174878 | Carbohydrates | Carbohydrates | Glucose | 411% to 1209% |
| 174878 | NA | NA | F3-U0.751 | New |
| 174878 | NA | NA | F3-U0.882 | 100% to 167% |
| 174878 | Phenols and Related Compounds | Phenylpropanes and Derivatives | Chlorogenic acid | 83% to 138% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#174917

| Seq ID | Chemical Class | Biochemical Class | Compound Name | Modification |
|---|---|---|---|---|
| 174917 | Acids - Fatty | Fatty Acids and Related Waxes | Hexadecanoic acid | 3% to 29% |
| 174917 | Acids - Fatty Branched | Fatty Acids and Related Waxes | Hexadecanoic acid, 14-methyl- | -70% to -90% |
| 174917 | Acids - Fatty Unsat | Fatty Acids and Related Waxes | 9,12-Octadecadienoic acid | -16% to -47% |
| 174917 | Acids - Fatty Unsat | Fatty Acids and Related Waxes | 9-Octadecenoic acid | -24% to -94% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#175484

| Seq ID | Chemical Class | Biochemical Class | Compound Name | Modification |
|---|---|---|---|---|
| 175484 | Acids | Acids | Carbamic acid | -72% to -100% |
| 175484 | Acids - Hydroxy Alpha | Acid Pathway | Butanoic acid, 2,3,4-trihydroxy- | New |
| 175484 | Acids - Hydroxy Alpha | Acid Pathway | Citric acid | 90% to 319% |
| 175484 | Acids - Hydroxy Alpha | Acid Pathway | Malic acid | 157% to 261% |
| 175484 | Acids - Hydroxy Alpha | Carbohydrates | Quinic acid | 60% to 983% |
| 175484 | Alkaloids and Other Bases | Polyamines | 1,4-Butanediamine | 60% to 81% |
| 175484 | Amino Acids and Related Compounds | Amino Acids and Related Compounds | Glutamic acid | 60% to 203% |
| 175484 | Amino Acids and Related Compounds | Amino Acids and Related Compounds | Proline | 103% to 171% |
| 175484 | Carbohydrates | Carbohydrates | F3-U0.768 Carbohydrate | NQ |
| 175484 | Carbohydrates | Carbohydrates | F3-U0.846 Carbohydrate | 92% to 1013% |
| 175484 | Carbohydrates | Carbohydrates | F3-U0.848 Carbohydrate | 159% to 433% |
| 175484 | Carbohydrates | Carbohydrates | F3-U0.872 Hexose | 160% to 650% |
| 175484 | Carbohydrates | Carbohydrates | F3-U1.189 Carbohydrate | 90% to 149% |
| 175484 | Carbohydrates | Carbohydrates | Galactose or Mannose | New |
| 175484 | Carbohydrates | Carbohydrates | Glucose | 494% to 2179% |
| 175484 | NA | NA | F3-U0.736 | NQ |
| 175484 | NA | NA | F3-U0.751 | New |
| 175484 | NA | NA | F3-U0.871 | 181% to 302% |
| 175484 | NA | NA | F3-U0.882 | 80% to 424% |
| 175484 | NA | NA | F3-U1.229 | 129% to 214% |
| 175484 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#175535

| Seq ID | Chemical Class | Biochemical Class | Compound Name | Modification |
|---|---|---|---|---|
| 175535 | Acids - Hydroxy Alpha | Acid Pathway | Butanoic acid, 2,3,4-trihydroxy- | New |
| 175535 | Acids - Hydroxy Alpha | Acid Pathway | Citric acid | 69% to 115% |
| 175535 | Acids - Hydroxy Alpha | Carbohydrates | Quinic acid | 171% to 286% |
| 175535 | Alcohols | Carbohydrates | Inositol | 103% to 171% |
| 175535 | Alkaloids and Other Bases | Polyamines | 1,4-Butanediamine | 147% to 246% |
| 175535 | Amino Acids and Related Compounds | Amino Acids and Related Compounds | Cysteine | 85% to 490% |
| 175535 | Amino Acids and Related Compounds | Amino Acids and Related Compounds | Glutamic acid | 261% to 435% |
| 175535 | Amino Acids and Related Compounds | Amino Acids and Related Compounds | Glycine | 60% to 1135% |
| 175535 | Amino Acids and Related Compounds | Amino Acids and Related Compounds | Isoleucine | New |
| 175535 | Amino Acids and Related Compounds | Amino Acids and Related Compounds | Leucine | New |
| 175535 | Amino Acids and Related Compounds | Amino Acids and Related Compounds | Methionine | 60% to 160% |
| 175535 | Amino Acids and Related Compounds | Amino Acids and Related Compounds | Proline | 351% to 585% |
| 175535 | Amino Acids and Related Compounds | Amino Acids and Related Compounds | Tyrosine | New |
| 175535 | Amino Acids and Related Compounds | Amino Acids and Related Compounds | Valine | 130% to 570% |
| 175535 | Carbohydrates | Carbohydrates | Arabinose or Xylose | New |
| 175535 | Carbohydrates | Carbohydrates | F3-U0.848 Carbohydrate | 200% to 333% |
| 175535 | Carbohydrates | Carbohydrates | F3-U0.872 Hexose | 115% to 191% |
| 175535 | Carbohydrates | Carbohydrates | F3-U1.150 Carbohydrate | 106% to 177% |
| 175535 | Carbohydrates | Carbohydrates | F3-U1.189 Carbohydrate | 129% to 216% |
| 175535 | Carbohydrates | Carbohydrates | Fructose | 278% to 585% |
| 175535 | Carbohydrates | Carbohydrates | Galactose or Mannose | 162% to 270% |
| 175535 | Carbohydrates | Carbohydrates | Glucose | 500% to 1454% |
| 175535 | NA | NA | F3-U0.751 | 421% to 702% |
| 175535 | NA | NA | F3-U0.882 | 119% to 199% |
| 175535 | Phenols and Related Compounds | Phenylpropanes and Derivatives | Chlorogenic acid | 60% to 89% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#175706

| Seq ID | Chemical Class | Biochemical Class | Compound Name | Modification |
|---|---|---|---|---|
| 175706 | Acids | Acids | Carbamic acid | NQ |
| 175706 | Acids - Fatty | Fatty Acids and Related Waxes | Eicosanoic acid | -60% to -75% |
| 175706 | Acids - Hydroxy Alpha | Acid Pathway | Butanoic acid, 2,3,4-trihydroxy- | New |
| 175706 | Acids - Hydroxy Alpha | Acid Pathway | Citric acid | 88% to 146% |
| 175706 | Acids - Hydroxy Alpha | Acid Pathway | Malic acid | 60% to 83% |
| 175706 | Acids - Hydroxy Alpha | Carbohydrates | Quinic acid | 187% to 312% |
| 175706 | Amino Acids and Related Compounds | Amino Acids and Related Compounds | Glutamic acid | 157% to 262% |
| 175706 | Amino Acids and Related Compounds | Amino Acids and Related Compounds | Proline | New |
| 175706 | Carbohydrates | Carbohydrates | F3-U0.821 Carbohydrate | 88% to 146% |
| 175706 | Carbohydrates | Carbohydrates | F3-U0.846 Carbohydrate | 152% to 253% |
| 175706 | Carbohydrates | Carbohydrates | F3-U0.848 Carbohydrate | 130% to 216% |
| 175706 | Carbohydrates | Carbohydrates | F3-U0.872 Hexose | 197% to 328% |
| 175706 | Carbohydrates | Carbohydrates | F3-U1.150 Carbohydrate | 60% to 100% |
| 175706 | Carbohydrates | Carbohydrates | Fructose | 60% to 77% |
| 175706 | Carbohydrates | Carbohydrates | Glucose | 217% to 528% |
| 175706 | NA | NA | F3-U0.751 | New |
| 175706 | Phenols and Related Compounds | Phenylpropanes and Derivatives | Chlorogenic acid | 127% to 211% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#175736

| Seq ID | Chemical Class | Biochemical Class | Compound Name | Modification |
|---|---|---|---|---|
| 175736 | Amino Acids and Related Compounds | Amino Acids and Related Compounds | Isoleucine | New |
| 175736 | Amino Acids and Related Compounds | Amino Acids and Related Compounds | Leucine | New |
| 175736 | Amino Acids and Related Compounds | Amino Acids and Related Compounds | Tryptophan | New |
| 175736 | Amino Acids and Related Compounds | Amino Acids and Related Compounds | Valine | 115% to 530% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#175912

| Seq ID | Chemical Class | Biochemical Class | Compound Name | Modification |
|---|---|---|---|---|
| 175912 | Acids - Fatty Branched | Fatty Acids and Related Waxes | Hexadecanoic acid, 14-methyl- | -10% to -26% |
| 175912 | Acids - Fatty Unsat | Fatty Acids and Related Waxes | 7,10,13-Hexadecatrienoic acid | 21% to 40% |
| 175912 | Acids - Fatty Unsat | Fatty Acids and Related Waxes | 9-Octadecenoic acid | -14% to -57% |
| 175912 | Amino Acids and Related Compounds | Amino Acids and Related Compounds | Arginine | 65% to 340% |
| 175912 | Amino Acids and Related Compounds | Amino Acids and Related Compounds | Isoleucine | New |
| 175912 | Amino Acids and Related Compounds | Amino Acids and Related Compounds | Leucine | New |
| 175912 | Amino Acids and Related Compounds | Amino Acids and Related Compounds | Methionine | 85% to 270% |
| 175912 | Amino Acids and Related Compounds | Amino Acids and Related Compounds | Threonine | 40% to 305% |
| 175912 | Amino Acids and Related Compounds | Amino Acids and Related Compounds | Tryptophan | New |
| 175912 | Amino Acids and Related Compounds | Amino Acids and Related Compounds | Tyrosine | New |
| 175912 | Amino Acids and Related Compounds | Amino Acids and Related Compounds | Valine | 95% to 1300% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#175951

| Seq ID | Chemical Class | Biochemical Class | Compound Name | Modification |
|---|---|---|---|---|
| 175951 | Acids - Fatty | Fatty Acids and Related Waxes | Docosanoic acid | 60% to 83% |
| 175951 | Acids - Fatty | Fatty Acids and Related Waxes | Heptadecanoic acid | 95% to 158% |
| 175951 | Acids - Fatty | Fatty Acids and Related Waxes | Hexadecanoic acid | 60% to 80% |
| 175951 | Acids - Fatty Branched | Fatty Acids and Related Waxes | Heptadecanoic acid, 16-methyl- | -60% to -95% |
| 175951 | Acids - Fatty Unsat | Fatty Acids and Related Waxes | 7,10,13-Hexadecatrienoic acid | 60% to 210% |
| 175951 | Acids - Fatty Unsat | Fatty Acids and Related Waxes | 9,12-Octadecadienoic acid | -95% to -100% |
| 175951 | Acids - Fatty Unsat | Fatty Acids and Related Waxes | 9-Hexadecenoic acid | 60% to 328% |
| 175951 | Acids - Fatty Unsat | Fatty Acids and Related Waxes | 9-Octadecenoic acid | -60% to -85% |
| 175951 | Acids - Hydroxy Alpha | Acid Pathway | Butanoic acid, 2,3,4-trihydroxy- | 2527% to 4211% |
| 175951 | Acids - Hydroxy Alpha | Acid Pathway | Citric acid | 60% to 93% |
| 175951 | Acids - Hydroxy Alpha | Carbohydrates | Quinic acid | 215% to 359% |
| 175951 | Amino Acids and Related Compounds | Amino Acids and Related Compounds | Glutamic acid | 60% to 983% |
| 175951 | Amino Acids and Related Compounds | Amino Acids and Related Compounds | Histidine | 60% to 215% |
| 175951 | Amino Acids and Related Compounds | Amino Acids and Related Compounds | Isoleucine | New |
| 175951 | Amino Acids and Related Compounds | Amino Acids and Related Compounds | Leucine | New |
| 175951 | Amino Acids and Related Compounds | Amino Acids and Related Compounds | Methionine | 175% to 435% |
| 175951 | Amino Acids and Related Compounds | Amino Acids and Related Compounds | Proline | 105% to 175% |
| 175951 | Amino Acids and Related Compounds | Amino Acids and Related Compounds | Tyrosine | New |
| 175951 | Amino Acids and Related Compounds | Amino Acids and Related Compounds | Valine | 320% to 520% |
| 175951 | Carbohydrates | Carbohydrates | F3-U0.846 Carbohydrate | 60% to 76% |
| 175951 | Carbohydrates | Carbohydrates | F3-U0.872 Hexose | 86% to 143% |
| 175951 | Carbohydrates | Carbohydrates | F3-U1.150 Carbohydrate | 133% to 222% |
| 175951 | Carbohydrates | Carbohydrates | F3-U1.189 Carbohydrate | New |
| 175951 | Carbohydrates | Carbohydrates | Glucose | 82% to 245% |
| 175951 | NA | NA | F3-U0.751 | New |
| 175951 | Phenols and Related Compounds | Phenylpropanes and Derivatives | Caffeic acid | New |
| 175951 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#175977

| Seq ID | Chemical Class | Biochemical Class | Compound Name | Modification |
|---|---|---|---|---|
| 175977 | Acids | Acids | Carbamic acid | -72% to -100% |
| 175977 | Acids - Hydroxy Alpha | Acid Pathway | Butanoic acid, 2,3,4-trihydroxy- | New |
| 175977 | Acids - Hydroxy Alpha | Acid Pathway | Citric acid | 70% to 117% |
| 175977 | Acids - Hydroxy Alpha | Acid Pathway | Malic acid | -60% to -100% |
| 175977 | Acids - Hydroxy Alpha | Carbohydrates | Quinic acid | 65% to 319% |
| 175977 | Alcohols | Carbohydrates | Inositol | 60% to 100% |
| 175977 | Alkaloids and Other Bases | Polyamines | 1,4-Butanediamine | 88% to 241% |
| 175977 | Amino Acids and Related Compounds | Amino Acids and Related Compounds | Asparagine | New |
| 175977 | Amino Acids and Related Compounds | Amino Acids and Related Compounds | Glutamic acid | 60% to 149% |
| 175977 | Amino Acids and Related Compounds | Amino Acids and Related Compounds | Glutamine | New |
| 175977 | Carbohydrates | Carbohydrates | Arabinose or Xylose | New |
| 175977 | Carbohydrates | Carbohydrates | F3-U0.768 Carbohydrate | NQ |
| 175977 | Carbohydrates | Carbohydrates | F3-U0.821 Carbohydrate | 70% to 117% |
| 175977 | Carbohydrates | Carbohydrates | F3-U0.846 Carbohydrate | 218% to 363% |
| 175977 | Carbohydrates | Carbohydrates | F3-U0.848 Carbohydrate | 143% to 324% |
| 175977 | Carbohydrates | Carbohydrates | F3-U0.952 Carbohydrate | 93% to 155% |
| 175977 | Carbohydrates | Carbohydrates | F3-U1.189 Carbohydrate | 168% to 280% |
| 175977 | Carbohydrates | Carbohydrates | Fructose | 173% to 740% |
| 175977 | Carbohydrates | Carbohydrates | Galactose or Mannose | 265% to 688% |
| 175977 | Carbohydrates | Carbohydrates | Glucose | 175% to 2118% |
| 175977 | NA | NA | F3-U0.736 | NQ |
| 175977 | NA | NA | F3-U0.799 | New |
| 175977 | NA | NA | F3-U0.871 | 77% to 129% |
| 175977 | NA | NA | F3-U0.882 | 110% to 290% |
| 175977 | NA | NA | F3-U1.229 | 60% to 100% |
| 175977 | NA | NA | F3-U1.253 | 61% to 101% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#176047

| Seq ID | Chemical Class | Biochemical Class | Compound Name | Modification |
|---|---|---|---|---|
| 176047 | Acids - Fatty | Fatty Acids and Related Waxes | Eicosanoic acid | -6% to -53% |
| 176047 | Acids - Fatty Branched | Fatty Acids and Related Waxes | Hexadecanoic acid, 14-methyl- | -24% to -60% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#17661

| Seq ID | Chemical Class | Biochemical Class | Compound Name | Modification |
|---|---|---|---|---|
| 17661 | Carbohydrates | Carbohydrates | Arabinose | 81% to 877% |
| 17661 | Carbohydrates | Carbohydrates | Galactose | 13% to 269% |
| 17661 | Carbohydrates | Carbohydrates | Glucose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#17884

| Seq ID | Chemical Class | Biochemical Class | Compound Name | Modification |
|---|---|---|---|---|
| 17884 | Acids - Hydroxy Alpha | Carbohydrates | Galacturonic acid | -29% to -89% |
| 17884 | Carbohydrates | Carbohydrates | Arabinose | -5% to -79% |
| 17884 | Carbohydrates | Carbohydrates | Glucose | -1% to -57% |
| 17884 | Carbohydrates | Carbohydrates | Mannose | -13% to -79% |
| 17884 | Carbohydrates | Carbohydrates | Xylose | -1% to -93% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#181039

| Seq ID | Chemical Class | Biochemical Class | Compound Name | Modification |
|---|---|---|---|---|
| 181039 | Acids - Fatty | Fatty Acids and Related Waxes | Hexadecanoic acid | -3% to -28% |
| 181039 | Acids - Fatty Unsat | Fatty Acids and Related Waxes | 9-Hexadecenoic acid | -10% to -39% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#181056

| Seq ID | Chemical Class | Biochemical Class | Compound Name | Modification |
|--------|---------------|-------------------|---------------|--------------|
| 181056 | Acids - Fatty | Fatty Acids and Related Waxes | Hexadecanoic acid | 4% to 47% |
| 181056 | Acids - Fatty | Fatty Acids and Related Waxes | Octadecanoic acid | 7% to 182% |
| 181056 | Acids - Fatty Branched | Fatty Acids and Related Waxes | Heptadecanoic acid, 16-methyl- | -5% to -95% |
| 181056 | Acids - Fatty Unsat | Fatty Acids and Related Waxes | 7,10,13-Hexadecatrienoic acid | -13% to -35% |
| 181056 | Acids - Fatty Unsat | Fatty Acids and Related Waxes | 9,12-Octadecadienoic acid | -21% to -41% |
| 181056 | Acids - Fatty Unsat | Fatty Acids and Related Waxes | 9-Hexadecenoic acid | 1% to 54% |
| 181056 | Acids - Fatty Unsat | Fatty Acids and Related Waxes | 9-Octadecenoic acid | -5% to -56% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#181743

| Seq ID | Chemical Class | Biochemical Class | Compound Name | Modification |
|---|---|---|---|---|
| 181743 | Acids - Fatty Unsat | Fatty Acids and Related Waxes | 7,10,13-Hexadecatrienoic acid | -10% to -38% |
| 181743 | Acids - Fatty Unsat | Fatty Acids and Related Waxes | 9,12,15-Octadecatrienoic acid | -6% to -17% |
| 181743 | Acids - Fatty Unsat | Fatty Acids and Related Waxes | 9,12-Octadecadienoic acid | 14% to 72% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#181759

| Seq ID | Chemical Class | Biochemical Class | Compound Name | Modification |
|---|---|---|---|---|
| 181759 | Acids - Fatty Unsat | Fatty Acids and Related Waxes | 7,10,13-Hexadecatrienoic acid | -15% to -41% |
| 181759 | Acids - Fatty Unsat | Fatty Acids and Related Waxes | 9,12,15-Octadecatrienoic acid | -5% to -16% |
| 181759 | Acids - Fatty Unsat | Fatty Acids and Related Waxes | 9,12-Octadecadienoic acid | 8% to 63% |
| 181759 | Acids - Fatty Unsat | Fatty Acids and Related Waxes | 9-Hexadecenoic acid | -6% to -25% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#181824

| Seq ID | Chemical Class | Biochemical Class | Compound Name | Modification |
|---|---|---|---|---|
| 181824 | Acids - Fatty | Fatty Acids and Related Waxes | Eicosanoic acid | -64% to -97% |
| 181824 | Acids - Fatty | Fatty Acids and Related Waxes | Hexadecanoic acid | -38% to -66% |
| 181824 | Acids - Fatty | Fatty Acids and Related Waxes | Octadecanoic acid | 42% to 185% |
| 181824 | Acids - Fatty Unsat | Fatty Acids and Related Waxes | 7,10,13-Hexadecatrienoic acid | -4% to -78% |
| 181824 | Acids - Fatty Unsat | Fatty Acids and Related Waxes | 9,12,15-Octadecatrienoic acid | 10% to 41% |
| 181824 | Acids - Fatty Unsat | Fatty Acids and Related Waxes | 9,12-Octadecadienoic acid | 25% to 77% |
| 181824 | Acids - Fatty Unsat | Fatty Acids and Related Waxes | 9-Hexadecenoic acid | -52% to -69% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#181971

| Seq ID | Chemical Class | Biochemical Class | Compound Name | Modification |
|---|---|---|---|---|
| 181971 | Acids - Fatty | Fatty Acids and Related Waxes | Octadecanoic acid | 2% to 105% |
| 181971 | Acids - Fatty Unsat | Fatty Acids and Related Waxes | 9,12,15-Octadecatrienoic acid | -5% to -15% |
| 181971 | Acids - Fatty Unsat | Fatty Acids and Related Waxes | 9,12-Octadecadienoic acid | 11% to 58% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#182007

| Seq ID | Chemical Class | Biochemical Class | Compound Name | Modification |
|---|---|---|---|---|
| 182007 | Amino Acids and Related Compounds | Amino Acids and Related Compounds | Isoleucine | New |
| 182007 | Amino Acids and Related Compounds | Amino Acids and Related Compounds | Lysine | 80% to 170% |
| 182007 | Amino Acids and Related Compounds | Amino Acids and Related Compounds | Methionine | 35% to 225% |
| 182007 | Amino Acids and Related Compounds | Amino Acids and Related Compounds | Tyrosine | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#182081

| Seq ID | Chemical Class | Biochemical Class | Compound Name | Modification |
|---|---|---|---|---|
| 182081 | Acids - Fatty | Fatty Acids and Related Waxes | Hexadecanoic acid | -32% to -46% |
| 182081 | Acids - Fatty | Fatty Acids and Related Waxes | Octadecanoic acid | 14% to 91% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#182229

| Seq ID | Chemical Class | Biochemical Class | Compound Name | Modification |
|--------|----------------|-------------------|---------------|--------------|
| 182229 | Acids - Fatty | Fatty Acids and Related Waxes | Hexadecanoic acid | 9% to 59% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#182274

| Seq ID | Chemical Class | Biochemical Class | Compound Name | Modification |
|---|---|---|---|---|
| 182274 | Acids - Fatty Unsat | Fatty Acids and Related Waxes | 7,10,13-Hexadecatrienoic acid | 11% to 95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#182358

| Seq ID | Chemical Class | Biochemical Class | Compound Name | Modification |
|---|---|---|---|---|
| 182358 | Acids - Fatty Unsat | Fatty Acids and Related Waxes | 9,12-Octadecadienoic acid | -49% to -67% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#186849

| Seq ID | Chemical Class | Biochemical Class | Compound Name | Modification |
|---|---|---|---|---|
| 186849 | Acids - Fatty | Fatty Acids and Related Waxes | Octadecanoic acid | 19% to 185% |
| 186849 | Acids - Fatty Unsat | Fatty Acids and Related Waxes | 9,12,15-Octadecatrienoic acid | -6% to -22% |
| 186849 | Acids - Fatty Unsat | Fatty Acids and Related Waxes | 9,12-Octadecadienoic acid | 10% to 67% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#186860

| Seq ID | Chemical Class | Biochemical Class | Compound Name | Modification |
|---|---|---|---|---|
| 186860 | Acids - Fatty | Fatty Acids and Related Waxes | Hexadecanoic acid | 15% to 56% |
| 186860 | Acids - Fatty | Fatty Acids and Related Waxes | Octadecanoic acid | 14% to 174% |
| 186860 | Acids - Fatty Unsat | Fatty Acids and Related Waxes | 7,10,13-Hexadecatrienoic acid | -19% to -48% |
| 186860 | Acids - Fatty Unsat | Fatty Acids and Related Waxes | 9,12,15-Octadecatrienoic acid | -4% to -21% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#186919

| Seq ID | Chemical Class | Biochemical Class | Compound Name | Modification |
|---|---|---|---|---|
| 186919 | Acids - Fatty | Fatty Acids and Related Waxes | Octadecanoic acid | 60% to 92% |
| 186919 | Acids - Fatty Branched | Fatty Acids and Related Waxes | Octadecanoic acid, 17-methyl- | 62% to 104% |
| 186919 | Acids - Fatty Unsat | Fatty Acids and Related Waxes | 6-Octadecenoic acid | -60% to -99% |
| 186919 | Acids - Fatty Unsat | Fatty Acids and Related Waxes | 9,12-Octadecadienoic acid | 60% to 80% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#186963

| Seq ID | Chemical Class | Biochemical Class | Compound Name | Modification |
|---|---|---|---|---|
| 186963 | Acids - Fatty | Fatty Acids and Related Waxes | Hexadecanoic acid | 70% to 131% |
| 186963 | Acids - Fatty | Fatty Acids and Related Waxes | Octadecanoic acid | 43% to 243% |
| 186963 | Acids - Fatty Unsat | Fatty Acids and Related Waxes | 7,10,13-Hexadecatrienoic acid | -55% to -71% |
| 186963 | Acids - Fatty Unsat | Fatty Acids and Related Waxes | 9,12,15-Octadecatrienoic acid | -35% to -47% |
| 186963 | Acids - Fatty Unsat | Fatty Acids and Related Waxes | 9-Hexadecenoic acid | 56% to 110% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#188836

| Seq ID | Chemical Class | Biochemical Class | Compound Name | Modification |
|---|---|---|---|---|
| 188836 | Acids - Fatty Branched | Fatty Acids and Related Waxes | Hexadecanoic acid, 14-methyl- | -8% to -52% |
| 188836 | Acids - Fatty Unsat | Fatty Acids and Related Waxes | 7,10,13-Hexadecatrienoic acid | -27% to -59% |
| 188836 | Acids - Fatty Unsat | Fatty Acids and Related Waxes | 9,12,15-Octadecatrienoic acid | -4% to -20% |
| 188836 | Acids - Fatty Unsat | Fatty Acids and Related Waxes | 9,12-Octadecadienoic acid | -4% to -46% |
| 188836 | Acids - Fatty Unsat | Fatty Acids and Related Waxes | 9-Hexadecenoic acid | -18% to -66% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#188837

| Seq ID | Chemical Class | Biochemical Class | Compound Name | Modification |
|---|---|---|---|---|
| 188837 | Acids | Acids | Carbamic acid | 628% to 1047% |
| 188837 | Acids - Fatty | Fatty Acids and Related Waxes | Eicosanoic acid | -60% to -100% |
| 188837 | Acids - Fatty | Fatty Acids and Related Waxes | Octadecanoic acid | -60% to -88% |
| 188837 | Acids - Fatty Branched | Fatty Acids and Related Waxes | Heptadecanoic acid, 16-methyl- | -60% to -94% |
| 188837 | Acids - Fatty Unsat | Fatty Acids and Related Waxes | 7,10,13-Hexadecatrienoic acid | 60% to 169% |
| 188837 | Acids - Fatty Unsat | Fatty Acids and Related Waxes | 9-Octadecenoic acid | -60% to -88% |
| 188837 | Acids - Hydroxy Alpha | Acid Pathway | Butanoic acid, 2,3,4-trihydroxy- | 112% to 261% |
| 188837 | Acids - Hydroxy Alpha | Acid Pathway | Citric acid | 117% to 194% |
| 188837 | Acids - Hydroxy Alpha | Carbohydrates | Glyceric acid | 79% to 162% |
| 188837 | Acids - Hydroxy Alpha | Carbohydrates | Malic acid | 60% to 148% |
| 188837 | Acids - Hydroxy Alpha | Acid Pathway | Quinic acid | 79% to 202% |
| 188837 | Acids - Hydroxy Alpha | Carbohydrates | Aspartic acid | New |
| 188837 | Amino Acids and Related Compounds | Amino Acids and Related Compounds | Glutamine | 212% to 354% |
| 188837 | Amino Acids and Related Compounds | Amino Acids and Related Compounds | Glycine | 175% to 291% |
| 188837 | Carbohydrates | Carbohydrates | F3-U0.770 Carbohydrate | New |
| 188837 | Carbohydrates | Carbohydrates | F3-U0.813 Carbohydrate | 77% to 129% |
| 188837 | Carbohydrates | Carbohydrates | F3-U0.816 Carbohydrate | 83% to 139% |
| 188837 | Carbohydrates | Carbohydrates | F3-U0.821 Carbohydrate | 66% to 194% |
| 188837 | Carbohydrates | Carbohydrates | F3-U0.825 Carbohydrate | 91% to 172% |
| 188837 | Carbohydrates | Carbohydrates | F3-U0.846 Carbohydrate | 156% to 288% |
| 188837 | Carbohydrates | Carbohydrates | F3-U0.872 Hexose | 167% to 333% |
| 188837 | Carbohydrates | Carbohydrates | F3-U1.189 Carbohydrate | 79% to 131% |
| 188837 | Carbohydrates | Carbohydrates | F3-U1.194 Carbohydrate | 60% to 90% |
| 188837 | Carbohydrates | Carbohydrates | Glucose | 60% to 115% |
| 188837 | NA | NA | F3-U0.736 | New |
| 188837 | NA | NA | F3-U0.799 | 104% to 173% |
| 188837 | Phenols and Related Compounds | Phenylpropanes and Derivatives | Chlorogenic acid | 63% to 105% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#188873

| Seq ID | Chemical Class | Biochemical Class | Compound Name | Modification |
|---|---|---|---|---|
| 188873 | Acids - Fatty | Fatty Acids and Related Waxes | Eicosanoic acid | -51% to -99% |
| 188873 | Acids - Fatty | Fatty Acids and Related Waxes | Octadecanoic acid | -33% to -91% |
| 188873 | Acids - Fatty Branched | Fatty Acids and Related Waxes | Heptadecanoic acid, 16-methyl- | -48% to -96% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#188876

| Seq ID | Chemical Class | Biochemical Class | Compound Name | Modification |
|---|---|---|---|---|
| 188876 | Acids - Fatty | Fatty Acids and Related Waxes | Eicosanoic acid | -40% to -60% |
| 188876 | Acids - Fatty | Fatty Acids and Related Waxes | Hexadecanoic acid | 1% to 10% |
| 188876 | Acids - Fatty Branched | Fatty Acids and Related Waxes | Heptadecanoic acid, 16-methyl- | -30% to -60% |
| 188876 | Acids - Fatty Unsat | Fatty Acids and Related Waxes | 7,10,13-Hexadecatrienoic acid | 20% to 40% |
| 188876 | Acids - Fatty Unsat | Fatty Acids and Related Waxes | 9,12,15-Octadecatrienoic acid | -5% to -10% |
| 188876 | Acids - Fatty Unsat | Fatty Acids and Related Waxes | 9,12-Octadecadienoic acid | 5% to 25% |
| 188876 | Acids - Fatty Unsat | Fatty Acids and Related Waxes | 9-Octadecenoic acid | 15% to 110% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#188943

| Seq ID | Chemical Class | Biochemical Class | Compound Name | Modification |
|---|---|---|---|---|
| 188943 | Acids - Fatty | Fatty Acids and Related Waxes | Eicosanoic acid | -60% to -100% |
| 188943 | Acids - Fatty Branched | Fatty Acids and Related Waxes | Heptadecanoic acid, 16-methyl- | -60% to -90% |
| 188943 | Acids - Fatty Unsat | Fatty Acids and Related Waxes | 9,12-Octadecadienoic acid | 60% to 70% |
| 188943 | Acids - Fatty Unsat | Fatty Acids and Related Waxes | 9-Octadecenoic acid | -60% to -65% |
| 188943 | Acids - Hydroxy | Amino Acids and Related Compounds | Shikimic acid | 75% to 125% |
| 188943 | Acids - Hydroxy Alpha | Acid Pathway | Butanoic acid, 2,3,4-trihydroxy- | New |
| 188943 | Acids - Hydroxy Alpha | Acid Pathway | Citric acid | 340% to 566% |
| 188943 | Acids - Hydroxy Alpha | Acid Pathway | Malic acid | 63% to 105% |
| 188943 | Acids - Hydroxy Alpha | Carbohydrates | Quinic acid | 157% to 262% |
| 188943 | Alcohols | Carbohydrates | Inositol | 124% to 207% |
| 188943 | Amino Acids and Related Compounds | Amino Acids and Related Compounds | Arginine | 60% to 230% |
| 188943 | Amino Acids and Related Compounds | Amino Acids and Related Compounds | Glutamic acid | 192% to 320% |
| 188943 | Amino Acids and Related Compounds | Amino Acids and Related Compounds | Isoleucine | New |
| 188943 | Amino Acids and Related Compounds | Amino Acids and Related Compounds | Leucine | New |
| 188943 | Amino Acids and Related Compounds | Amino Acids and Related Compounds | Methionine | 75% to 255% |
| 188943 | Amino Acids and Related Compounds | Amino Acids and Related Compounds | Proline | 596% to 994% |
| 188943 | Amino Acids and Related Compounds | Amino Acids and Related Compounds | Tryptophan | New |
| 188943 | Amino Acids and Related Compounds | Amino Acids and Related Compounds | Tyrosine | New |
| 188943 | Amino Acids and Related Compounds | Amino Acids and Related Compounds | Valine | 300% to 1070% |
| 188943 | Carbohydrates | Carbohydrates | F3-U0.816 Carbohydrate | 75% to 125% |
| 188943 | Carbohydrates | Carbohydrates | F3-U0.846 Carbohydrate | New |
| 188943 | Carbohydrates | Carbohydrates | F3-U0.848 Carbohydrate | 200% to 334% |
| 188943 | Carbohydrates | Carbohydrates | F3-U0.872 Hexose | New |
| 188943 | Carbohydrates | Carbohydrates | F3-U1.150 Carbohydrate | 90% to 150% |
| 188943 | Carbohydrates | Carbohydrates | F3-U1.189 Carbohydrate | 343% to 571% |
| 188943 | Carbohydrates | Carbohydrates | F3-U1.194 Carbohydrate | New |
| 188943 | Carbohydrates | Carbohydrates | Fructose | 109% to 249% |
| 188943 | Carbohydrates | Carbohydrates | Galactose or Mannose | 138% to 230% |
| 188943 | Carbohydrates | Carbohydrates | Glucose | 385% to 898% |
| 188943 | NA | NA | F3-U0.751 | 632% to 1053% |
| 188943 | NA | NA | F3-U0.882 | 92% to 153% |
| 188943 | Phenols and Related Compounds | Phenylpropanes and Derivatives | Chlorogenic acid | 228% to 380% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#188959

| Seq ID | Chemical Class | Biochemical Class | Compound Name | Modification |
|---|---|---|---|---|
| 188959 | Acids - Fatty | Fatty Acids and Related Waxes | Eicosanoic acid | -21% to -61% |
| 188959 | Acids - Fatty Branched | Fatty Acids and Related Waxes | Heptadecanoic acid, 16-methyl- | -36% to -60% |
| 188959 | Acids - Fatty Branched | Fatty Acids and Related Waxes | Hexadecanoic acid, 14-methyl- | -61% to -68% |
| 188959 | Acids - Fatty Unsat | Fatty Acids and Related Waxes | 7,10,13-Hexadecatrienoic acid | 22% to 42% |
| 188959 | Amino Acids and Related Compounds | Amino Acids and Related Compounds | Isoleucine | New |
| 188959 | Amino Acids and Related Compounds | Amino Acids and Related Compounds | Leucine | New |
| 188959 | Amino Acids and Related Compounds | Amino Acids and Related Compounds | Methionine | 100% to 285% |
| 188959 | Amino Acids and Related Compounds | Amino Acids and Related Compounds | Threonine | 75% to 160% |
| 188959 | Amino Acids and Related Compounds | Amino Acids and Related Compounds | Valine | 240% to 405% |

FIG. 6 continued

| \multicolumn{5}{l}{A list of metabolite compounds present in altered levels relative to reference samples as chararacterized by gas chromatography, liquid chromatography, and/or mass spectrometry. This list corresponds to samples transfected with nucleic acid sequence, Seq ID#188984} |
|---|---|---|---|---|
| Seq ID | Chemical Class | Biochemical Class | Compound Name | Modification |
| 188984 | Acids - Fatty | Fatty Acids and Related Waxes | Heptadecanoic acid | 98% to 163% |
| 188984 | Acids - Fatty Branched | Fatty Acids and Related Waxes | Hexadecanoic acid, 14-methyl- | -60% to -87% |
| 188984 | Acids - Fatty Branched | Fatty Acids and Related Waxes | Octadecanoic acid, 17-methyl- | -60% to -75% |
| 188984 | Acids - Fatty Unsat | Fatty Acids and Related Waxes | 11,14,17-Eicosatrienoic acid | -60% to -75% |
| 188984 | Acids - Fatty Unsat | Fatty Acids and Related Waxes | 7,10-Hexadecadienoic acid | -60% to -99% |
| 188984 | Acids - Fatty Unsat | Fatty Acids and Related Waxes | 9-Hexadecenoic acid | -60% to -77% |
| 188984 | Acids - Fatty Unsat | Fatty Acids and Related Waxes | 9-Octadecenoic acid | -60% to -94% |
| 188984 | Acids - Fatty Unsat | Fatty Acids and Related Waxes | F2-U1.365 Octadecenoic acid Isomer | -70% to -99% |
| 188984 | Acids - Hydroxy Alpha | Acid Pathway | Malic acid | -65% to -100% |
| 188984 | Amino Acids and Related Compounds | Amino Acids and Related Compounds | Asparagine | New |
| 188984 | Amino Acids and Related Compounds | Amino Acids and Related Compounds | Aspartic acid | 60% to 365% |
| 188984 | Amino Acids and Related Compounds | Amino Acids and Related Compounds | Glutamic acid | 60% to 1641% |
| 188984 | Amino Acids and Related Compounds | Amino Acids and Related Compounds | Histidine | 95% to 385% |
| 188984 | Amino Acids and Related Compounds | Amino Acids and Related Compounds | Isoleucine | New |
| 188984 | Amino Acids and Related Compounds | Amino Acids and Related Compounds | Leucine | New |
| 188984 | Amino Acids and Related Compounds | Amino Acids and Related Compounds | Lysine | 135% to 355% |
| 188984 | Amino Acids and Related Compounds | Amino Acids and Related Compounds | Proline, 5-oxo- | 127% to 212% |
| 188984 | Amino Acids and Related Compounds | Amino Acids and Related Compounds | Serine | 60% to 170% |
| 188984 | Amino Acids and Related Compounds | Amino Acids and Related Compounds | Threonine | 100% to 205% |
| 188984 | Amino Acids and Related Compounds | Amino Acids and Related Compounds | Tyrosine | New |
| 188984 | Amino Acids and Related Compounds | Amino Acids and Related Compounds | Valine | 165% to 300% |
| 188984 | Carbohydrates | Carbohydrates | F3-U0.816 Carbohydrate | -60% to -77% |
| 188984 | Carbohydrates | Carbohydrates | F3-U0.846 Carbohydrate | -60% to -86% |
| 188984 | Carbohydrates | Carbohydrates | F3-U0.872 Hexose | -60% to -84% |
| 188984 | Carbohydrates | Carbohydrates | F3-U1.150 Carbohydrate | 60% to 89% |
| 188984 | Carbohydrates | Carbohydrates | Fructose | -60% to -99% |
| 188984 | Carbohydrates | Carbohydrates | Glucose | -63% to -99% |
| 188984 | NA | NA | F3-U0.634 | 247% to 411% |
| 188984 | NA | NA | F3-U0.789 | New |
| 188984 | NA | NA | F3-U0.852A | NQ |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#194652

| Seq ID | Chemical Class | Biochemical Class | Compound Name | Modification |
|---|---|---|---|---|
| 194652 | Acids - Fatty | Fatty Acids and Related Waxes | Hexadecanoic acid | 5% to 20% |
| 194652 | Acids - Fatty | Fatty Acids and Related Waxes | Octadecanoic acid | 10% to 45% |
| 194652 | Acids - Fatty Branched | Fatty Acids and Related Waxes | Hexadecanoic acid, 14-methyl- | -56% to -70% |
| 194652 | Acids - Fatty Unsat | Fatty Acids and Related Waxes | 7,10,13-Hexadecatrienoic acid | -35% to -37% |
| 194652 | Acids - Fatty Unsat | Fatty Acids and Related Waxes | 9,12,15-Octadecatrienoic acid | -1% to -10% |
| 194652 | Acids - Fatty Unsat | Fatty Acids and Related Waxes | 9,12-Octadecadienoic acid | 5% to 55% |
| 194652 | Acids - Fatty Unsat | Fatty Acids and Related Waxes | 9-Hexadecenoic acid | -10% to -35% |
| 194652 | Acids - Fatty Unsat | Fatty Acids and Related Waxes | 9-Octadecenoic acid | -35% to -70% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#20019 | | | | |
|---|---|---|---|---|
| Seq ID | Chemical Class | Biochemical Class | Compound Name | Modification |
| 20019 | Carbohydrates | Carbohydrates | Arabinose | 2% to 201% |
| 20019 | Carbohydrates | Carbohydrates | Glucose | -4% to -98% |
| 20019 | Carbohydrates | Carbohydrates | Mannose | 9% to 70% |
| 20019 | Carbohydrates | Carbohydrates | Rhamnose | 11% to 98% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200602

| Seq ID | Chemical Class | Biochemical Class | Compound Name | Modification |
|---|---|---|---|---|
| 200602 | Acids - Hydroxy Alpha | Acid Pathway | Malic acid | 120% to 201% |
| 200602 | Alcohols | Carbohydrates | Inositol | 60% to 82% |
| 200602 | Amino Acids and Related Compounds | Amino Acids and Related Compounds | Glutamic acid | New |
| 200602 | Amino Acids and Related Compounds | Amino Acids and Related Compounds | Histidine | 250% to 735% |
| 200602 | Amino Acids and Related Compounds | Amino Acids and Related Compounds | Lysine | 180% to 465% |
| 200602 | Amino Acids and Related Compounds | Amino Acids and Related Compounds | Methionine | 85% to 165% |
| 200602 | Amino Acids and Related Compounds | Amino Acids and Related Compounds | Phenylalanine | 60% to 1490% |
| 200602 | Amino Acids and Related Compounds | Amino Acids and Related Compounds | Proline, 5-oxo- | 180% to 299% |
| 200602 | Amino Acids and Related Compounds | Amino Acids and Related Compounds | Threonine | 65% to 225% |
| 200602 | Amino Acids and Related Compounds | Amino Acids and Related Compounds | Tyrosine | New |
| 200602 | Amino Acids and Related Compounds | Amino Acids and Related Compounds | Valine | 315% to 710% |
| 200602 | Carbohydrates | Carbohydrates | F3-U0.813 Carbohydrate | 108% to 180% |
| 200602 | Carbohydrates | Carbohydrates | F3-U0.821 Carbohydrate | 137% to 228% |
| 200602 | Carbohydrates | Carbohydrates | F3-U0.825 Carbohydrate | 315% to 526% |
| 200602 | Carbohydrates | Carbohydrates | F3-U0.846 Carbohydrate | 169% to 281% |
| 200602 | Carbohydrates | Carbohydrates | F3-U0.848 Carbohydrate | 167% to 278% |
| 200602 | Carbohydrates | Carbohydrates | F3-U0.872 Hexose | 248% to 413% |
| 200602 | Carbohydrates | Carbohydrates | F3-U0.952 Carbohydrate | 117% to 195% |
| 200602 | Carbohydrates | Carbohydrates | Fructose | 199% to 510% |
| 200602 | Carbohydrates | Carbohydrates | Galactose or Mannose | New |
| 200602 | Carbohydrates | Carbohydrates | Glucose | 176% to 607% |
| 200602 | NA | NA | F3-U0.882 | 60% to 76% |
| 200602 | NA | NA | F3-U1.253 | 68% to 114% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#200614

| Seq ID | Chemical Class | Biochemical Class | Compound Name | Modification |
|---|---|---|---|---|
| 200614 | Acids - Fatty | Fatty Acids and Related Waxes | Hexadecanoic acid | -11% to -28% |
| 200614 | Acids - Fatty | Fatty Acids and Related Waxes | Octadecanoic acid | -25% to -65% |
| 200614 | Acids - Fatty Branched | Fatty Acids and Related Waxes | Hexadecanoic acid, 14-methyl- | -9% to -36% |
| 200614 | Acids - Fatty Unsat | Fatty Acids and Related Waxes | 9,12,15-Octadecatrienoic acid | -4% to -15% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200615

| Seq ID | Chemical Class | Biochemical Class | Compound Name | Modification |
|---|---|---|---|---|
| 200615 | Acids - Hydroxy Alpha | Acid Pathway | Butanoic acid, 2,3,4-trihydroxy- | New |
| 200615 | Acids - Hydroxy Alpha | Acid Pathway | Citric acid | 88% to 146% |
| 200615 | Acids - Hydroxy Alpha | Acid Pathway | Malic acid | 79% to 132% |
| 200615 | Acids - Hydroxy Alpha | Carbohydrates | Quinic acid | 287% to 479% |
| 200615 | Alcohols | Carbohydrates | Inositol | 86% to 143% |
| 200615 | Alkenes and Alkynes | Terpenoids | Limonene | 352% to 586% |
| 200615 | Amino Acids and Related Compounds | Amino Acids and Related Compounds | Glutamic acid | New |
| 200615 | Carbohydrates | Carbohydrates | F3-U0.813 Carbohydrate | 60% to 91% |
| 200615 | Carbohydrates | Carbohydrates | F3-U0.825 Carbohydrate | New |
| 200615 | Carbohydrates | Carbohydrates | F3-U0.846 Carbohydrate | 237% to 395% |
| 200615 | Carbohydrates | Carbohydrates | F3-U0.848 Carbohydrate | 207% to 344% |
| 200615 | Carbohydrates | Carbohydrates | F3-U0.872 Hexose | 312% to 520% |
| 200615 | Carbohydrates | Carbohydrates | F3-U0.956 Carbohydrate | New |
| 200615 | Carbohydrates | Carbohydrates | F3-U1.189 Carbohydrate | New |
| 200615 | Carbohydrates | Carbohydrates | Fructose | 329% to 839% |
| 200615 | Carbohydrates | Carbohydrates | Galactose or Mannose | -68% to -100% |
| 200615 | Carbohydrates | Carbohydrates | Glucose | 327% to 1359% |
| 200615 | Esters | Esters | F1-U1.076 Fatty Acid Ester | 63% to 105% |
| 200615 | Esters | Esters | F1-U1.119 Fatty Acid Ester | 67% to 111% |
| 200615 | Esters - Hydroxy | Acyl acetylglycerols | 2-Eicosanoyl-1-acetylglycerol | 125% to 208% |
| 200615 | Esters - Hydroxy | Acyl acetylglycerols | 2-Octadecanoyl-1-acetylglycerol | 103% to 172% |
| 200615 | NA | NA | F3-U0.882 | 162% to 270% |
| 200615 | NA | NA | F3-U1.253 | 220% to 366% |
| 200615 | NA | NA | F3-U1.255 | New |
| 200615 | Phenols and Related Compounds | Phenylpropanes and Derivatives | Chlorogenic acid | 306% to 510% |
| 200615 | Sterols, Oxygenated Terpenes, and Other Isoprenoids | Prenylquinones | alpha-Tocopherol hydroquinone | New |
| 200615 | Sterols, Oxygenated Terpenes, and Other Isoprenoids | Terpenoids | Cycloartenol | 111% to 185% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200616

| Seq ID | Chemical Class | Biochemical Class | Compound Name | Modification |
|---|---|---|---|---|
| 200616 | Acids - Hydroxy | Amino Acids and Related Compounds | Shikimic acid | 60% to 84% |
| 200616 | Amino Acids and Related Compounds | Amino Acids and Related Compounds | Glutamic acid | 64% to 107% |
| 200616 | Carbohydrates | Carbohydrates | F3-U0.813 Carbohydrate | 60% to 97% |
| 200616 | Carbohydrates | Carbohydrates | F3-U0.816 Carbohydrate | 60% to 84% |
| 200616 | Carbohydrates | Carbohydrates | F3-U0.846 Carbohydrate | 102% to 170% |
| 200616 | Carbohydrates | Carbohydrates | F3-U0.872 Hexose | 63% to 105% |
| 200616 | NA | NA | F3-U0.751 | 111% to 185% |
| 200616 | NA | NA | F3-U1.229 | 75% to 125% |
| 200616 | NA | NA | F3-U1.253 | 136% to 227% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200621

| Seq ID | Chemical Class | Biochemical Class | Compound Name | Modification |
|---|---|---|---|---|
| 200621 | Acids - Hydroxy | Amino Acids and Related Compounds | Shikimic acid | 84% to 140% |
| 200621 | Acids - Hydroxy Alpha | Acid Pathway | Butanoic acid, 2,3,4-trihydroxy- | 263% to 1640% |
| 200621 | Acids - Hydroxy Alpha | Acid Pathway | Citric acid | 127% to 523% |
| 200621 | Acids - Hydroxy Alpha | Acid Pathway | Malic acid | 257% to 429% |
| 200621 | Acids - Hydroxy Alpha | Carbohydrates | Quinic acid | 107% to 441% |
| 200621 | Alcohols | Carbohydrates | Inositol | 75% to 126% |
| 200621 | Amino Acids and Related Compounds | Amino Acids and Related Compounds | Glutamic acid | 162% to 270% |
| 200621 | Carbohydrates | Carbohydrates | F3-U0.813 Carbohydrate | 155% to 258% |
| 200621 | Carbohydrates | Carbohydrates | F3-U0.816 Carbohydrate | 84% to 140% |
| 200621 | Carbohydrates | Carbohydrates | F3-U0.825 Carbohydrate | New |
| 200621 | Carbohydrates | Carbohydrates | F3-U0.846 Carbohydrate | 532% to 887% |
| 200621 | Carbohydrates | Carbohydrates | F3-U0.848 Carbohydrate | 193% to 321% |
| 200621 | Carbohydrates | Carbohydrates | F3-U0.872 Hexose | 455% to 759% |
| 200621 | Carbohydrates | Carbohydrates | F3-U1.189 Carbohydrate | 94% to 168% |
| 200621 | Carbohydrates | Carbohydrates | F3-U1.194 Carbohydrate | 81% to 135% |
| 200621 | Carbohydrates | Carbohydrates | Fructose | 60% to 148% |
| 200621 | Carbohydrates | Carbohydrates | Glucose | 225% to 470% |
| 200621 | NA | NA | F3-U0.751 | 161% to 268% |
| 200621 | NA | NA | F3-U0.852A | New |
| 200621 | Phenols and Related Compounds | Phenylpropanes and Derivatives | Chlorogenic acid | 83% to 186% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200622

| Seq ID | Chemical Class | Biochemical Class | Compound Name | Modification |
|---|---|---|---|---|
| 200622 | Acids - Fatty | Fatty Acids and Related Waxes | Eicosanoic acid | 40% to 155% |
| 200622 | Acids - Fatty | Fatty Acids and Related Waxes | Heptadecanoic acid | 90% to 150% |
| 200622 | Acids - Fatty | Fatty Acids and Related Waxes | Octadecanoic acid | 60% to 420% |
| 200622 | Acids - Fatty Branched | Fatty Acids and Related Waxes | Heptadecanoic acid, 16-methyl- | 60% to 95% |
| 200622 | Acids - Fatty Branched | Fatty Acids and Related Waxes | Isoeicosanoic acid | -60% to -90% |
| 200622 | Acids - Fatty Unsat | Fatty Acids and Related Waxes | 9,12,15-Octadecatrienoic acid | -63% to -100% |
| 200622 | Acids - Fatty Unsat | Fatty Acids and Related Waxes | 9-Hexadecenoic acid | -64% to -100% |
| 200622 | Acids - Hydroxy Alpha | Acid Pathway | Citric acid | 464% to 773% |
| 200622 | Amino Acids and Related Compounds | Amino Acids and Related Compounds | Asparagine | 4425% to 7375% |
| 200622 | Amino Acids and Related Compounds | Amino Acids and Related Compounds | Glutamic acid | 60% to 83% |
| 200622 | Amino Acids and Related Compounds | Amino Acids and Related Compounds | Glutamine | New |
| 200622 | Amino Acids and Related Compounds | Amino Acids and Related Compounds | Lysine | New |
| 200622 | Amino Acids and Related Compounds | Amino Acids and Related Compounds | Proline, 5-oxo- | 89% to 148% |
| 200622 | Carbohydrates | Carbohydrates | F3-U0.846 Carbohydrate | -60% to -87% |
| 200622 | Carbohydrates | Carbohydrates | F3-U0.872 Hexose | -60% to -77% |
| 200622 | Carbohydrates | Carbohydrates | Fructose | -60% to -84% |
| 200622 | Carbohydrates | Carbohydrates | Glucose | -63% to -100% |
| 200622 | Esters | Esters | F1-U1.076 Fatty Acid Ester | 85% to 142% |
| 200622 | Esters | Esters | F1-U1.113 Fatty Acid Ester | 60% to 90% |
| 200622 | Esters | Esters | F1-U1.119 Fatty Acid Ester | 150% to 250% |
| 200622 | NA | NA | F3-U0.704 | New |
| 200622 | NA | NA | F3-U0.799 | New |
| 200622 | NA | NA | F3-U0.886 | New |
| 200622 | Phenols and Related Compounds | Phenylpropanes and Derivatives | Chlorogenic acid | -60% to -86% |
| 200622 | Sterols, Oxygenated Terpenes, and Other Isoprenoids | Prenylquinones | alpha-Tocopherol hydroquinone | New |
| 200622 | Sterols, Oxygenated Terpenes, and Other Isoprenoids | Terpenoids | beta-Sitosterol | 129% to 215% |
| 200622 | Sterols, Oxygenated Terpenes, and Other Isoprenoids | Terpenoids | Ergosta-4,6,22-trien-3-ol | 68% to 114% |
| 200622 | Sterols, Oxygenated Terpenes, and Other Isoprenoids | Terpenoids | Ergosta-8,24(28)-dien-3-ol, 4,14-dimethyl- | New |
| 200622 | Sterols, Oxygenated Terpenes, and Other Isoprenoids | Terpenoids | F1-U1.130 Sterol | New |
| 200622 | Sterols, Oxygenated Terpenes, and Other Isoprenoids | Prenylquinones | gamma-Tocopherol | New |
| 200622 | Sterols, Oxygenated Terpenes, and Other Isoprenoids | Terpenoids | Stigmasta-5,22-dien-3-ol, acetate | 71% to 118% |
| 200622 | Sterols, Oxygenated Terpenes, and Other Isoprenoids | Terpenoids | Stigmasterol | 60% to 85% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200625

| Seq ID | Chemical Class | Biochemical Class | Compound Name | Modification |
|---|---|---|---|---|
| 200625 | Acids - Hydroxy Alpha | Acid Pathway | Citric acid | 2374% to 3957% |
| 200625 | Acids - Hydroxy Alpha | Carbohydrates | Quinic acid | 153% to 255% |
| 200625 | Amino Acids and Related Compounds | Amino Acids and Related Compounds | Asparagine | New |
| 200625 | Amino Acids and Related Compounds | Amino Acids and Related Compounds | Glutamic acid | New |
| 200625 | Carbohydrates | Carbohydrates | F3-U1.189 Carbohydrate | New |
| 200625 | Carbohydrates | Carbohydrates | F3-U1.194 Carbohydrate | New |
| 200625 | Carbohydrates | Carbohydrates | Sucrose | -63% to -99% |
| 200625 | Esters | Esters | F1-U1.113 Fatty Acid Ester | 97% to 161% |
| 200625 | Esters - Hydroxy | Acyl acetylglycerols | 2-Octadecanoyl-1-acetylglycerol | 69% to 115% |
| 200625 | Hydrocarbons | Hydrocarbons | Triacontane, 2-methyl- | -60% to -84% |
| 200625 | NA | NA | F1-U0.873 | New |
| 200625 | NA | NA | F1-U0.972 | New |
| 200625 | NA | NA | F3-U0.704 | New |
| 200625 | NA | NA | F3-U1.253 | 195% to 325% |
| 200625 | Phenols and Related Compounds | Phenylpropanes and Derivatives | Chlorogenic acid | 428% to 714% |
| 200625 | Sterols, Oxygenated Terpenes, and Other Isoprenoids | Prenylquinones | alpha-Tocopherol | 60% to 78% |
| 200625 | Sterols, Oxygenated Terpenes, and Other Isoprenoids | Prenylquinones | alpha-Tocopherol hydroquinone | New |
| 200625 | Sterols, Oxygenated Terpenes, and Other Isoprenoids | Prenylquinones | beta-Tocopherol | New |
| 200625 | Sterols, Oxygenated Terpenes, and Other Isoprenoids | Terpenoids | Ergosta-8,24(28)-dien-3-ol, 4,14-dimethyl- | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200626

| Seq ID | Chemical Class | Biochemical Class | Compound Name | Modification |
|---|---|---|---|---|
| 200626 | Acids - Fatty | Fatty Acids and Related Waxes | Eicosanoic acid | -71% to -99% |
| 200626 | Acids - Fatty Unsat | Fatty Acids and Related Waxes | 7,10,13-Hexadecatrienoic acid | -60% to -99% |
| 200626 | Acids - Hydroxy Alpha | Acid Pathway | Malic acid | 67% to 112% |
| 200626 | Amino Acids and Related Compounds | Amino Acids and Related Compounds | Glutamine | New |
| 200626 | Amino Acids and Related Compounds | Amino Acids and Related Compounds | Lysine | New |
| 200626 | Amino Acids and Related Compounds | Amino Acids and Related Compounds | Proline, 5-oxo- | 69% to 115% |
| 200626 | Carbohydrates | Carbohydrates | F3-U0.848 Carbohydrate | 117% to 195% |
| 200626 | Carbohydrates | Carbohydrates | F3-U0.872 Hexose | 71% to 81% |
| 200626 | Carbohydrates | Carbohydrates | F3-U0.952 Carbohydrate | 191% to 318% |
| 200626 | Carbohydrates | Carbohydrates | F3-U1.189 Carbohydrate | 99% to 164% |
| 200626 | Carbohydrates | Carbohydrates | F3-U1.194 Carbohydrate | 72% to 120% |
| 200626 | Carbohydrates | Carbohydrates | Fructose | 115% to 286% |
| 200626 | Carbohydrates | Carbohydrates | Galactose or Mannose | 440% to 773% |
| 200626 | Carbohydrates | Carbohydrates | Glucose | 111% to 491% |
| 200626 | NA | NA | F1-U1.119 | New |
| 200626 | Sterols, Oxygenated Terpenes, and Other Isoprenoids | Prenylquinones | alpha-Tocopherol hydroquinone | New |
| 200626 | Sterols, Oxygenated Terpenes, and Other Isoprenoids | Terpenoids | beta-Sitosterol | 61% to 90% |
| 200626 | Sterols, Oxygenated Terpenes, and Other Isoprenoids | Terpenoids | Cholest-5-en-3-ol, 23-ethylidene- | New |
| 200626 | Sterols, Oxygenated Terpenes, and Other Isoprenoids | Terpenoids | Cholesterol | 60% to 86% |
| 200626 | Sterols, Oxygenated Terpenes, and Other Isoprenoids | Terpenoids | Cycloartenol | 60% to 91% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200628

| Seq ID | Chemical Class | Biochemical Class | Compound Name | Modification |
|---|---|---|---|---|
| 200628 | Acids - Fatty | Fatty Acids and Related Waxes | Eicosanoic acid | -14% to -58% |
| 200628 | Acids - Fatty | Fatty Acids and Related Waxes | Hexadecanoic acid | 5% to 24% |
| 200628 | Acids - Fatty | Fatty Acids and Related Waxes | Octadecanoic acid | 14% to 48% |
| 200628 | Acids - Fatty Unsat | Fatty Acids and Related Waxes | 9,12,15-Octadecatrienoic acid | -4% to -15% |
| 200628 | Acids - Fatty Unsat | Fatty Acids and Related Waxes | 9,12-Octadecadienoic acid | 3% to 45% |
| 200628 | Acids - Fatty Unsat | Fatty Acids and Related Waxes | 9-Octadecenoic acid | 35% to 275% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200629

| Seq ID | Chemical Class | Biochemical Class | Compound Name | Modification |
|---|---|---|---|---|
| 200629 | Acids - Hydroxy Alpha | Acid Pathway | Citric acid | 547% to 912% |
| 200629 | Acids - Hydroxy Alpha | Acid Pathway | Malic acid | 128% to 214% |
| 200629 | Aldehydes, Ketones and Quinones | Aldehydes, Ketones and Quinones | 3-Phytylmenadione | New |
| 200629 | Amino Acids and Related Compounds | Amino Acids and Related Compounds | Glycine | New |
| 200629 | Carbohydrates | Carbohydrates | F3-U0.816 Carbohydrate | NQ |
| 200629 | Carbohydrates | Carbohydrates | F3-U0.846 Carbohydrate | -60% to -99% |
| 200629 | Carbohydrates | Carbohydrates | F3-U0.872 Hexose | -60% to -91% |
| 200629 | Carbohydrates | Carbohydrates | Fructose | -60% to -87% |
| 200629 | Carbohydrates | Carbohydrates | Glucose | -68% to -99% |
| 200629 | Esters | Esters | F1-U1.076 Fatty Acid Ester | 60% to 93% |
| 200629 | Esters | Esters | F1-U1.113 Fatty Acid Ester | 102% to 170% |
| 200629 | Esters | Esters | F1-U1.121 Fatty Acid Ester | 60% to 280% |
| 200629 | Esters - Hydroxy | Acyl acetylglycerols | 2-Eicosanoyl-1-acetylglycerol | 171% to 285% |
| 200629 | Esters - Hydroxy | Acyl acetylglycerols | 2-Octadecanoyl-1-acetylglycerol | 75% to 125% |
| 200629 | Phenols and Related Compounds | Phenylpropanes and Derivatives | Chlorogenic acid | -60% to -79% |
| 200629 | Sterols, Oxygenated Terpenes, and Other Isoprenoids | Prenylquinones | alpha-Tocopherol | 197% to 329% |
| 200629 | Sterols, Oxygenated Terpenes, and Other Isoprenoids | Prenylquinones | alpha-Tocopherol hydroquinone | New |
| 200629 | Sterols, Oxygenated Terpenes, and Other Isoprenoids | Prenylquinones | beta-Tocopherol | New |
| 200629 | Sterols, Oxygenated Terpenes, and Other Isoprenoids | Terpenoids | Stigmasta-5,22-dien-3-ol, acetate | 74% to 123% |
| 200629 | Sterols, Oxygenated Terpenes, and Other Isoprenoids | Terpenoids | Stigmasterol | 73% to 138% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200631

| Seq ID | Chemical Class | Biochemical Class | Compound Name | Modification |
|---|---|---|---|---|
| 200631 | Acids - Fatty | Fatty Acids and Related Waxes | Eicosanoic acid | -57% to -100% |
| 200631 | Acids - Fatty | Fatty Acids and Related Waxes | Hexadecanoic acid | 10% to 56% |
| 200631 | Acids - Fatty | Fatty Acids and Related Waxes | Octadecanoic acid | 16% to 204% |
| 200631 | Acids - Fatty Branched | Fatty Acids and Related Waxes | Hexadecanoic acid, 14-methyl- | -3% to -96% |
| 200631 | Acids - Fatty Unsat | Fatty Acids and Related Waxes | 7,10,13-Hexadecatrienoic acid | -5% to -48% |
| 200631 | Acids - Fatty Unsat | Fatty Acids and Related Waxes | 9,12,15-Octadecatrienoic acid | -3% to -31% |
| 200631 | Acids - Fatty Unsat | Fatty Acids and Related Waxes | 9,12-Octadecadienoic acid | 8% to 106% |
| 200631 | Acids - Fatty Unsat | Fatty Acids and Related Waxes | 9-Hexadecenoic acid | -53% to -67% |
| 200631 | Amino Acids and Related Compounds | Amino Acids and Related Compounds | Arginine | 120% to 355% |
| 200631 | Amino Acids and Related Compounds | Amino Acids and Related Compounds | Histidine | 155% to 300% |
| 200631 | Amino Acids and Related Compounds | Amino Acids and Related Compounds | Isoleucine | New |
| 200631 | Amino Acids and Related Compounds | Amino Acids and Related Compounds | Leucine | New |
| 200631 | Amino Acids and Related Compounds | Amino Acids and Related Compounds | Methionine | 20% to 75% |
| 200631 | Amino Acids and Related Compounds | Amino Acids and Related Compounds | Threonine | 70% to 230% |
| 200631 | Amino Acids and Related Compounds | Amino Acids and Related Compounds | Tryptophan | New |
| 200631 | Amino Acids and Related Compounds | Amino Acids and Related Compounds | Tyrosine | New |
| 200631 | Amino Acids and Related Compounds | Amino Acids and Related Compounds | Valine | 95% to 495% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200633

| Seq ID | Chemical Class | Biochemical Class | Compound Name | Modification |
|---|---|---|---|---|
| 200633 | Amino Acids and Related Compounds | Amino Acids and Related Compounds | Arginine | 40% to 185% |
| 200633 | Amino Acids and Related Compounds | Amino Acids and Related Compounds | Histidine | 380% to 650% |
| 200633 | Amino Acids and Related Compounds | Amino Acids and Related Compounds | Isoleucine | New |
| 200633 | Amino Acids and Related Compounds | Amino Acids and Related Compounds | Leucine | New |
| 200633 | Amino Acids and Related Compounds | Amino Acids and Related Compounds | Methionine | 55% to 125% |
| 200633 | Amino Acids and Related Compounds | Amino Acids and Related Compounds | Threonine | 40% to 175% |
| 200633 | Amino Acids and Related Compounds | Amino Acids and Related Compounds | Tryptophan | New |
| 200633 | Amino Acids and Related Compounds | Amino Acids and Related Compounds | Valine | 165% to 425% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200638

| Seq ID | Chemical Class | Biochemical Class | Compound Name | Modification |
|---|---|---|---|---|
| 200638 | Acids - Hydroxy Alpha | Acid Pathway | Butanoic acid, 2,3,4-trihydroxy- | New |
| 200638 | Acids - Hydroxy Alpha | Acid Pathway | Citric acid | New |
| 200638 | Acids - Hydroxy Alpha | Acid Pathway | Malic acid | 60% to 295% |
| 200638 | Acids - Hydroxy Alpha | Carbohydrates | Quinic acid | 153% to 581% |
| 200638 | Alcohols | Carbohydrates | Inositol | 66% to 109% |
| 200638 | Alkenes and Alkynes | Terpenoids | Limonene | 60% to 158% |
| 200638 | Amino Acids and Related Compounds | Amino Acids and Related Compounds | Glutamic acid | New |
| 200638 | Amino Acids and Related Compounds | Amino Acids and Related Compounds | Proline, 5-oxo- | 70% to 117% |
| 200638 | Carbohydrates | Carbohydrates | F3-U0.821 Carbohydrate | NQ |
| 200638 | Carbohydrates | Carbohydrates | F3-U0.846 Carbohydrate | 118% to 197% |
| 200638 | Carbohydrates | Carbohydrates | F3-U0.872 Hexose | 151% to 252% |
| 200638 | Carbohydrates | Carbohydrates | F3-U0.952 Carbohydrate | New |
| 200638 | Carbohydrates | Carbohydrates | F3-U1.189 Carbohydrate | New |
| 200638 | Carbohydrates | Carbohydrates | F3-U1.194 Carbohydrate | New |
| 200638 | Carbohydrates | Carbohydrates | Fructose | 119% to 379% |
| 200638 | Carbohydrates | Carbohydrates | Galactose or Mannose | New |
| 200638 | Carbohydrates | Carbohydrates | Glucose | 121% to 804% |
| 200638 | Esters | Esters | F1-U1.076 Fatty Acid Ester | 65% to 270% |
| 200638 | Esters | Esters | F1-U1.078 Fatty Acid Ester | 60% to 81% |
| 200638 | Esters | Esters | F1-U1.119 Fatty Acid Ester | 60% to 150% |
| 200638 | Esters | Esters | F1-U1.121 Fatty Acid Ester | 169% to 281% |
| 200638 | Esters - Hydroxy | Acyl acetylglycerols | 2-Eicosanoyl-1-acetylglycerol | 79% to 347% |
| 200638 | Esters - Hydroxy | Acyl acetylglycerols | 2-Octadecanoyl-1-acetylglycerol | 77% to 251% |
| 200638 | Hydrocarbons | Hydrocarbons | Triacontane, 2-methyl- | -60% to -78% |
| 200638 | NA | NA | F3-U1.232 | 138% to 231% |
| 200638 | NA | NA | F3-U1.253 | 195% to 325% |
| 200638 | NA | NA | F3-U1.255 | 200% to 333% |
| 200638 | Phenols and Related Compounds | Phenylpropanes and Derivatives | Chlorogenic acid | 428% to 714% |
| 200638 | Sterols, Oxygenated Terpenes, and Other Isoprenoids | Prenylquinones | alpha-Tocopherol | 100% to 167% |
| 200638 | Sterols, Oxygenated Terpenes, and Other Isoprenoids | Prenylquinones | alpha-Tocopherol hydroquinone | New |
| 200638 | Sterols, Oxygenated Terpenes, and Other Isoprenoids | Terpenoids | beta-Sitosterol | 63% to 105% |
| 200638 | Sterols, Oxygenated Terpenes, and Other Isoprenoids | Terpenoids | Cycloartenol | 133% to 221% |
| 200638 | Sterols, Oxygenated Terpenes, and Other Isoprenoids | Terpenoids | Ergosta-5,24-dien-3-ol | New |
| 200638 | Sterols, Oxygenated Terpenes, and Other Isoprenoids | Terpenoids | F1-U1.130 Sterol | New |
| 200638 | Sterols, Oxygenated Terpenes, and Other Isoprenoids | Terpenoids | F1-U1.164 Sterol | New |
| 200638 | Sterols, Oxygenated Terpenes, and Other Isoprenoids | Terpenoids | F1-U1.228A Sterol | 77% to 129% |
| 200638 | Sterols, Oxygenated Terpenes, and Other Isoprenoids | Terpenoids | Stigmasterol | 60% to 77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200641

| Seq ID | Chemical Class | Biochemical Class | Compound Name | Modification |
|---|---|---|---|---|
| 200641 | Acids - Fatty Branched | Fatty Acids and Related Waxes | Hexadecanoic acid, 14-methyl- | 148% to 291% |
| 200641 | Acids - Fatty Unsat | Fatty Acids and Related Waxes | 9,12,15-Octadecatrienoic acid | -7% to -19% |
| 200641 | Acids - Fatty Unsat | Fatty Acids and Related Waxes | 9,12-Octadecadienoic acid | 2% to 86% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#200642

| Seq ID | Chemical Class | Biochemical Class | Compound Name | Modification |
|---|---|---|---|---|
| 200642 | Acids - Hydroxy | Amino Acids and Related Compounds | Shikimic acid | 471% to 785% |
| 200642 | Acids - Hydroxy | Acid Pathway | Butanoic acid, 2,3,4-trihydroxy- | 542% to 904% |
| 200642 | Acids - Hydroxy Alpha | Acid Pathway | Citric acid | 378% to 1261% |
| 200642 | Acids - Hydroxy Alpha | Carbohydrates | Quinic acid | 130% to 216% |
| 200642 | Alcohols | Carbohydrates | Inositol | 69% to 229% |
| 200642 | Aldehydes, Ketones and Quinones | Aldehydes, Ketones and Quinones | 3-Phytylmenadione | New |
| 200642 | Alkaloids and Other Bases | Polyamines | 1,4-Butanediamine | 155% to 260% |
| 200642 | Alkenes and Alkynes | Terpenoids | Limonene | 132% to 220% |
| 200642 | Amino Acids and Related Compounds | Amino Acids and Related Compounds | Asparagine | New |
| 200642 | Amino Acids and Related Compounds | Amino Acids and Related Compounds | Glutamic acid | New |
| 200642 | Amino Acids and Related Compounds | Amino Acids and Related Compounds | Tryptophan | New |
| 200642 | Amino Acids and Related Compounds | Amino Acids and Related Compounds | Tyrosine | New |
| 200642 | Carbohydrates | Carbohydrates | Arabinose or Xylose | New |
| 200642 | Carbohydrates | Carbohydrates | F3-U0.781 Carbohydrate | New |
| 200642 | Carbohydrates | Carbohydrates | F3-U0.813 Carbohydrate | 1150% to 1916% |
| 200642 | Carbohydrates | Carbohydrates | F3-U0.825 Carbohydrate | New |
| 200642 | Carbohydrates | Carbohydrates | F3-U1.113 Carbohydrate | 75% to 125% |
| 200642 | Carbohydrates | Carbohydrates | F3-U1.150 Carbohydrate | 68% to 113% |
| 200642 | Carbohydrates | Carbohydrates | F3-U1.189 Carbohydrate | 154% to 256% |
| 200642 | Carbohydrates | Carbohydrates | F3-U1.194 Carbohydrate | 219% to 365% |
| 200642 | Carbohydrates | Carbohydrates | Fructose | 466% to 1099% |
| 200642 | Carbohydrates | Carbohydrates | Galactose or Mannose | 563% to 938% |
| 200642 | Carbohydrates | Carbohydrates | Glucose | 303% to 899% |
| 200642 | Carbohydrates | Carbohydrates | Sucrose | -50% to -94% |
| 200642 | Esters | Esters | F1-U1.076 Fatty Acid Ester | 225% to 375% |
| 200642 | Esters | Esters | F1-U1.121 Fatty Acid Ester | 131% to 218% |
| 200642 | Esters | Carbohydrates | Gluconic acid, lactone | New |
| 200642 | Esters - Hydroxy | Acyl acetylglycerols | 2-Eicosanoyl-1-acetylglycerol | 260% to 434% |
| 200642 | Esters - Hydroxy | Acyl acetylglycerols | 2-Octadecanoyl-1-acetylglycerol | 147% to 245% |
| 200642 | NA | NA | F3-U0.751 | 336% to 559% |
| 200642 | NA | NA | F3-U0.791 | New |
| 200642 | NA | NA | F3-U0.852A | New |
| 200642 | NA | NA | F3-U0.882 | 60% to 76% |
| 200642 | NA | NA | F3-U1.229 | 153% to 255% |
| 200642 | NA | NA | F3-U1.253 | 207% to 345% |
| 200642 | NA | NA | F3-U1.255 | 90% to 150% |
| 200642 | Phenols and Related Compounds | Phenylpropanes and Derivatives | Chlorogenic acid | NQ |
| 200642 | Sterols, Oxygenated Terpenes, and Other Isoprenoids | Prenylquinones | alpha-Tocopherol | 332% to 554% |
| 200642 | Sterols, Oxygenated Terpenes, and Other Isoprenoids | Prenylquinones | alpha-Tocopherol hydroquinone | New |
| 200642 | Sterols, Oxygenated Terpenes, and Other Isoprenoids | Terpenoids | beta-Sitosterol | 170% to 284% |
| 200642 | Sterols, Oxygenated Terpenes, and Other Isoprenoids | Prenylquinones | beta-Tocopherol | New |
| 200642 | Sterols, Oxygenated Terpenes, and Other Isoprenoids | Terpenoids | Stigmasta-5,22-dien-3-ol, acetate | 82% to 137% |
| 200642 | Sterols, Oxygenated Terpenes, and Other Isoprenoids | Terpenoids | Stigmasterol | 76% to 127% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200646

| Seq ID | Chemical Class | Biochemical Class | Compound Name | Modification |
|---|---|---|---|---|
| 200646 | Acids - Fatty Branched | Fatty Acids and Related Waxes | Hexadecanoic acid, 14-methyl- | -28% to -50% |
| 200646 | Acids - Fatty Unsat | Fatty Acids and Related Waxes | 9,12-Octadecadienoic acid | -16% to -38% |
| 200646 | Acids - Fatty Unsat | Fatty Acids and Related Waxes | 9-Octadecenoic acid | -5% to -66% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200647

| Seq ID | Chemical Class | Biochemical Class | Compound Name | Modification |
|---|---|---|---|---|
| 200647 | Acids - Fatty | Fatty Acids and Related Waxes | Octadecanoic acid | 25% to 108% |
| 200647 | Acids - Fatty Branched | Fatty Acids and Related Waxes | Heptadecanoic acid, 16-methyl- | 82% to 246% |
| 200647 | Acids - Fatty Unsat | Fatty Acids and Related Waxes | 7,10,13-Hexadecatrienoic acid | 6% to 173% |
| 200647 | Acids - Fatty Unsat | Fatty Acids and Related Waxes | 9,12-Octadecadienoic acid | -36% to -71% |
| 200647 | Acids - Fatty Unsat | Fatty Acids and Related Waxes | 9-Hexadecenoic acid | -27% to -64% |
| 200647 | Acids - Fatty Unsat | Fatty Acids and Related Waxes | 9-Octadecenoic acid | -36% to -71% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200649

| Seq ID | Chemical Class | Biochemical Class | Compound Name | Modification |
|---|---|---|---|---|
| 200649 | Acids - Fatty | Fatty Acids and Related Waxes | Octadecanoic acid | 96% to 318% |
| 200649 | Acids - Fatty Branched | Fatty Acids and Related Waxes | Hexadecanoic acid, 14-methyl- | -60% to -100% |
| 200649 | Acids - Fatty Unsat | Fatty Acids and Related Waxes | 7,10,13-Hexadecatrienoic acid | -60% to -84% |
| 200649 | Acids - Fatty Unsat | Fatty Acids and Related Waxes | 9,12-Octadecadienoic acid | 64% to 201% |
| 200649 | Acids - Fatty Unsat | Fatty Acids and Related Waxes | 9-Octadecenoic acid | 60% to 303% |
| 200649 | Amino Acids and Related Compounds | Amino Acids and Related Compounds | Histidine | 125% to 250% |
| 200649 | Amino Acids and Related Compounds | Amino Acids and Related Compounds | Isoleucine | New |
| 200649 | Amino Acids and Related Compounds | Amino Acids and Related Compounds | Leucine | New |
| 200649 | Amino Acids and Related Compounds | Amino Acids and Related Compounds | Methionine | 40% to 105% |
| 200649 | Amino Acids and Related Compounds | Amino Acids and Related Compounds | Tryptophan | New |
| 200649 | Amino Acids and Related Compounds | Amino Acids and Related Compounds | Valine | 85% to 270% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200653

| Seq ID | Chemical Class | Biochemical Class | Compound Name | Modification |
|---|---|---|---|---|
| 200653 | Acids - Fatty | Fatty Acids and Related Waxes | Hexadecanoic acid | 19% to 49% |
| 200653 | Acids - Fatty | Fatty Acids and Related Waxes | Octadecanoic acid | 21% to 158% |
| 200653 | Acids - Fatty Unsat | Fatty Acids and Related Waxes | 7,10,13-Hexadecatrienoic acid | -13% to -51% |
| 200653 | Acids - Fatty Unsat | Fatty Acids and Related Waxes | 9,12,15-Octadecatrienoic acid | -12% to -23% |
| 200653 | Acids - Fatty Unsat | Fatty Acids and Related Waxes | 9-Hexadecenoic acid | -6% to -40% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#200659

| Seq ID | Chemical Class | Biochemical Class | Compound Name | Modification |
|--------|----------------|-------------------|---------------|--------------|
| 200659 | Acids - Fatty Unsat | Fatty Acids and Related Waxes | 9,12-Octadecadienoic acid | -25% to -44% |
| 200659 | Acids - Fatty Unsat | Fatty Acids and Related Waxes | 9-Hexadecenoic acid | -21% to -42% |
| 200659 | Acids - Fatty Unsat | Fatty Acids and Related Waxes | 9-Octadecenoic acid | -48% to -81% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#200665

| Seq ID | Chemical Class | Biochemical Class | Compound Name | Modification |
|---|---|---|---|---|
| 200665 | Acids | Acids | Carbamic acid | 566% to 943% |
| 200665 | Acids | Acids | omega-Aminobutyric acid | New |
| 200665 | Acids - Fatty | Fatty Acids and Related Waxes | Octadecanoic acid | 60% to 450% |
| 200665 | Acids - Fatty Branched | Fatty Acids and Related Waxes | Heptadecanoic acid, 16-methyl- | -90% to -95% |
| 200665 | Acids - Fatty Branched | Fatty Acids and Related Waxes | Hexadecanoic acid, 14-methyl- | -60% to -95% |
| 200665 | Acids - Fatty Unsat | Fatty Acids and Related Waxes | Isoeicosanoic acid | 75% to 123% |
| 200665 | Acids - Fatty Unsat | Fatty Acids and Related Waxes | 6-Octadecenoic acid | 60% to 96% |
| 200665 | Acids - Fatty Unsat | Fatty Acids and Related Waxes | 7,10,13-Hexadecatrienoic acid | -60% to -78% |
| 200665 | Acids - Fatty Unsat | Fatty Acids and Related Waxes | 9,12-Octadecadienoic acid | 60% to 90% |
| 200665 | Acids - Fatty Unsat | Fatty Acids and Related Waxes | 9-Hexadecenoic acid | -60% to -70% |
| 200665 | Acids - Hydroxy Alpha | Fatty Acids and Related Waxes | 9-Octadecenoic acid | 60% to 110% |
| 200665 | Acids - Hydroxy Alpha | Acid Pathway | Citric acid | New |
| 200665 | Acids - Hydroxy Alpha | Carbohydrates | Malic acid | 60% to 85% |
| 200665 | Alcohols | Carbohydrates | Quinic acid | 60% to 138% |
| 200665 | Amino Acids and Related Compounds | Amino Acids and Related Compounds | Inositol | -60% to -100% |
| 200665 | Amino Acids and Related Compounds | Amino Acids and Related Compounds | Alanine | New |
| 200665 | Amino Acids and Related Compounds | Amino Acids and Related Compounds | Arginine | 60% to 3005% |
| 200665 | Amino Acids and Related Compounds | Amino Acids and Related Compounds | Asparagine | New |
| 200665 | Amino Acids and Related Compounds | Amino Acids and Related Compounds | Glutamic acid | New |
| 200665 | Amino Acids and Related Compounds | Amino Acids and Related Compounds | Glutamine | New |
| 200665 | Amino Acids and Related Compounds | Amino Acids and Related Compounds | Glycine | New |
| 200665 | Amino Acids and Related Compounds | Amino Acids and Related Compounds | Histidine | 120% to 890% |
| 200665 | Amino Acids and Related Compounds | Amino Acids and Related Compounds | Isoleucine | New |
| 200665 | Amino Acids and Related Compounds | Amino Acids and Related Compounds | Leucine | New |
| 200665 | Amino Acids and Related Compounds | Amino Acids and Related Compounds | Lysine | 190% to 480% |
| 200665 | Amino Acids and Related Compounds | Amino Acids and Related Compounds | Methionine | 60% to 230% |
| 200665 | Amino Acids and Related Compounds | Amino Acids and Related Compounds | Proline, 5-oxo- | 60% to 897% |
| 200665 | Amino Acids and Related Compounds | Amino Acids and Related Compounds | Serine | 60% to 420% |
| 200665 | Amino Acids and Related Compounds | Amino Acids and Related Compounds | Threonine | 110% to 520% |
| 200665 | Amino Acids and Related Compounds | Amino Acids and Related Compounds | Tryptophan | New |
| 200665 | Amino Acids and Related Compounds | Amino Acids and Related Compounds | Tyrosine | New |
| 200665 | Amino Acids and Related Compounds | Amino Acids and Related Compounds | Valine | 570% to 1820% |
| 200665 | Carbohydrates | Carbohydrates | F3-U0.816 Carbohydrate | NQ |
| 200665 | Carbohydrates | Carbohydrates | F3-U0.821 Carbohydrate | NQ |
| 200665 | Carbohydrates | Carbohydrates | F3-U0.846 Carbohydrate | New |
| 200665 | Carbohydrates | Carbohydrates | F3-U0.848B Carbohydrate | NQ |
| 200665 | Carbohydrates | Carbohydrates | F3-U0.872 Hexose | New |
| 200665 | Carbohydrates | Carbohydrates | F3-U1.148 Carbohydrate | 65% to 108% |
| 200665 | Carbohydrates | Carbohydrates | F3-U1.150 Carbohydrate | 84% to 189% |
| 200665 | Carbohydrates | Carbohydrates | F3-U1.189 Carbohydrate | New |
| 200665 | Carbohydrates | Carbohydrates | F3-U1.194 Carbohydrate | New |
| 200665 | Carbohydrates | Carbohydrates | Fructose | -83% to -99% |
| 200665 | Carbohydrates | Carbohydrates | Galactose or Mannose | New |
| 200665 | Carbohydrates | Carbohydrates | Glucose | -64% to -100% |
| 200665 | Carbohydrates | Carbohydrates | Sucrose | -60% to -100% |
| 200665 | NA | NA | F3-U0.602 | NQ |
| 200665 | NA | NA | F3-U0.704 | New |
| 200665 | NA | NA | F3-U0.882 | 122% to 259% |
| 200665 | NA | NA | F3-U0.886 | New |
| 200665 | NA | NA | F3-U1.253 | 100% to 166% |
| 200665 | NA | NA | F3-U1.255 | New |
| 200665 | Phenols and Related Compounds | Phenylpropanes and Derivatives | Chlorogenic acid | NQ |
| 200665 | Sterols, Oxygenated Terpenes, and Other Isoprenoids | Prenylquinones | alpha-Tocopherol | 60% to 150% |
| 200665 | Sterols, Oxygenated Terpenes, and Other Isoprenoids | Prenylquinones | alpha-Tocopherol hydroquinone | 545% to 908% |
| 200665 | Sterols, Oxygenated Terpenes, and Other Isoprenoids | Prenylquinones | beta-Tocopherol | New |
| 200665 | Sterols, Oxygenated Terpenes, and Other Isoprenoids | Terpenoids | Cycloartenol | NQ |
| 200665 | Sterols, Oxygenated Terpenes, and Other Isoprenoids | Terpenoids | Fucosterol | -60% to -90% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200666

| Seq ID | Chemical Class | Biochemical Class | Compound Name | Modification |
|---|---|---|---|---|
| 200666 | Acids - Fatty | Fatty Acids and Related Waxes | Eicosanoic acid | -60% to -100% |
| 200666 | Acids - Fatty Branched | Fatty Acids and Related Waxes | Heptadecanoic acid, 16-methyl- | -60% to -92% |
| 200666 | Acids - Fatty Unsat | Fatty Acids and Related Waxes | 9-Octadecenoic acid | 60% to 272% |
| 200666 | Amino Acids and Related Compounds | Amino Acids and Related Compounds | Alanine | 85% to 300% |
| 200666 | Amino Acids and Related Compounds | Amino Acids and Related Compounds | Arginine | 70% to 245% |
| 200666 | Amino Acids and Related Compounds | Amino Acids and Related Compounds | Isoleucine | New |
| 200666 | Amino Acids and Related Compounds | Amino Acids and Related Compounds | Tryptophan | New |
| 200666 | Amino Acids and Related Compounds | Amino Acids and Related Compounds | Valine | 60% to 185% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200669

| Seq ID | Chemical Class | Biochemical Class | Compound Name | Modification |
|---|---|---|---|---|
| 200669 | Acids - Fatty | Fatty Acids and Related Waxes | Eicosanoic acid | 31% to 261% |
| 200669 | Acids - Fatty | Fatty Acids and Related Waxes | Octadecanoic acid | 10% to 83% |
| 200669 | Acids - Fatty Branched | Fatty Acids and Related Waxes | Heptadecanoic acid, 16-methyl- | 32% to 151% |
| 200669 | Acids - Fatty Unsat | Fatty Acids and Related Waxes | 7,10,13-Hexadecatrienoic acid | -18% to -32% |
| 200669 | Acids - Fatty Unsat | Fatty Acids and Related Waxes | 9,12-Octadecadienoic acid | -21% to -40% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200670

| Seq ID | Chemical Class | Biochemical Class | Compound Name | Modification |
|---|---|---|---|---|
| 200670 | Acids - Fatty Unsat | Fatty Acids and Related Waxes | 9,12,15-Octadecatrienoic acid | -7% to -18% |
| 200670 | Acids - Fatty Unsat | Fatty Acids and Related Waxes | 9-Hexadecenoic acid | 6% to 31% |
| 200670 | Acids - Fatty Unsat | Fatty Acids and Related Waxes | 9-Octadecenoic acid | 28% to 256% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200671

| Seq ID | Chemical Class | Biochemical Class | Compound Name | Modification |
|---|---|---|---|---|
| 200671 | Acids - Fatty Branched | Fatty Acids and Related Waxes | Hexadecanoic acid, 14-methyl- | -60% to -83% |
| 200671 | Acids - Hydroxy Alpha | Acid Pathway | Citric acid | 64% to 106% |
| 200671 | Acids - Hydroxy Alpha | Carbohydrates | Quinic acid | 98% to 163% |
| 200671 | Amino Acids and Related Compounds | Amino Acids and Related Compounds | Asparagine | New |
| 200671 | Amino Acids and Related Compounds | Amino Acids and Related Compounds | Aspartic acid | 142% to 236% |
| 200671 | Amino Acids and Related Compounds | Amino Acids and Related Compounds | Glutamic acid | 275% to 459% |
| 200671 | Amino Acids and Related Compounds | Amino Acids and Related Compounds | Lysine | New |
| 200671 | Amino Acids and Related Compounds | Amino Acids and Related Compounds | Phenylalanine | New |
| 200671 | Amino Acids and Related Compounds | Amino Acids and Related Compounds | Proline | 91% to 152% |
| 200671 | Amino Acids and Related Compounds | Amino Acids and Related Compounds | Proline, 5-oxo- | 150% to 251% |
| 200671 | Carbohydrates | Carbohydrates | F3-U0.781 Carbohydrate | New |
| 200671 | Carbohydrates | Carbohydrates | F3-U0.813 Carbohydrate | 60% to 94% |
| 200671 | Carbohydrates | Carbohydrates | F3-U1.150 Carbohydrate | NQ |
| 200671 | Carbohydrates | Carbohydrates | F3-U1.189 Carbohydrate | NQ |
| 200671 | NA | NA | F3-U0.704 | New |
| 200671 | NA | NA | F3-U0.738B | New |
| 200671 | NA | NA | F3-U0.799 | New |
| 200671 | NA | NA | F3-U0.852A | New |
| 200671 | NA | NA | F3-U0.886 | 593% to 988% |
| 200671 | Sterols, Oxygenated Terpenes, and Other Isoprenoids | Prenylquinones | alpha-Tocopherol hydroquinone | New |
| 200671 | Sterols, Oxygenated Terpenes, and Other Isoprenoids | Terpenoids | beta-Sitosterol | 212% to 353% |
| 200671 | Sterols, Oxygenated Terpenes, and Other Isoprenoids | Prenylquinones | beta-Tocopherol | New |
| 200671 | Sterols, Oxygenated Terpenes, and Other Isoprenoids | Terpenoids | Cholesterol | 60% to 96% |
| 200671 | Sterols, Oxygenated Terpenes, and Other Isoprenoids | Terpenoids | Stigmasterol | 71% to 118% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#200672

| Seq ID | Chemical Class | Biochemical Class | Compound Name | Modification |
|---|---|---|---|---|
| 200672 | Acids - Fatty | Fatty Acids and Related Waxes | Octadecanoic acid | 9% to 128% |
| 200672 | Acids - Fatty Branched | Fatty Acids and Related Waxes | Hexadecanoic acid, 14-methyl- | -52% to -100% |
| 200672 | Acids - Fatty Unsat | Fatty Acids and Related Waxes | 9,12,15-Octadecatrienoic acid | -6% to -17% |
| 200672 | Acids - Fatty Unsat | Fatty Acids and Related Waxes | 9-Hexadecenoic acid | -14% to -45% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200673

| Seq ID | Chemical Class | Biochemical Class | Compound Name | Modification |
|---|---|---|---|---|
| 200673 | Acids - Hydroxy Alpha | Acid Pathway | Citric acid | 77% to 128% |
| 200673 | Acids - Hydroxy Alpha | Acid Pathway | Malic acid | 154% to 257% |
| 200673 | Acids - Hydroxy Alpha | Carbohydrates | Quinic acid | 162% to 269% |
| 200673 | Alcohols | Carbohydrates | Inositol | 89% to 149% |
| 200673 | Alkenes and Alkynes | Terpenoids | Limonene | 273% to 455% |
| 200673 | Amino Acids and Related Compounds | Amino Acids and Related Compounds | Glutamic acid | New |
| 200673 | Amino Acids and Related Compounds | Amino Acids and Related Compounds | Glutamine | New |
| 200673 | Amino Acids and Related Compounds | Amino Acids and Related Compounds | Lysine | New |
| 200673 | Amino Acids and Related Compounds | Amino Acids and Related Compounds | Proline, 5-oxo- | 138% to 230% |
| 200673 | Carbohydrates | Carbohydrates | F3-U0.813 Carbohydrate | 122% to 204% |
| 200673 | Carbohydrates | Carbohydrates | F3-U0.821 Carbohydrate | 203% to 338% |
| 200673 | Carbohydrates | Carbohydrates | F3-U0.825 Carbohydrate | 576% to 960% |
| 200673 | Carbohydrates | Carbohydrates | F3-U0.846 Carbohydrate | 337% to 561% |
| 200673 | Carbohydrates | Carbohydrates | F3-U0.872 Hexose | 409% to 682% |
| 200673 | Carbohydrates | Carbohydrates | F3-U1.189 Carbohydrate | 261% to 435% |
| 200673 | Carbohydrates | Carbohydrates | F3-U1.194 Carbohydrate | 174% to 290% |
| 200673 | Carbohydrates | Carbohydrates | Fructose | 187% to 474% |
| 200673 | Carbohydrates | Carbohydrates | Glucose | 194% to 728% |
| 200673 | Esters | Esters | F1-U1.076 Fatty Acid Ester | 182% to 303% |
| 200673 | Esters | Esters | F1-U1.078 Fatty Acid Ester | 86% to 144% |
| 200673 | Esters | Esters | F1-U1.113 Fatty Acid Ester | 302% to 503% |
| 200673 | Esters | Esters | F1-U1.121 Fatty Acid Ester | 102% to 170% |
| 200673 | Esters - Hydroxy | Acyl acetylglycerols | 2-Octadecanoyl-1-acetylglycerol | 177% to 295% |
| 200673 | NA | NA | F3-U0.852A | 122% to 204% |
| 200673 | Phenols and Related Compounds | Phenylpropanes and Derivatives | Chlorogenic acid | 97% to 162% |
| 200673 | Sterols, Oxygenated Terpenes, and Other Isoprenoids | Prenylquinones | alpha-Tocopherol hydroquinone | New |
| 200673 | Sterols, Oxygenated Terpenes, and Other Isoprenoids | Terpenoids | beta-Sitosterol | 75% to 125% |
| 200673 | Sterols, Oxygenated Terpenes, and Other Isoprenoids | Terpenoids | Campesterol | 60% to 91% |
| 200673 | Sterols, Oxygenated Terpenes, and Other Isoprenoids | Terpenoids | Cycloartenol | 557% to 929% |
| 200673 | Sterols, Oxygenated Terpenes, and Other Isoprenoids | Terpenoids | Stigmasta-3,5,22-triene | 60% to 99% |
| 200673 | Sterols, Oxygenated Terpenes, and Other Isoprenoids | Terpenoids | Stigmasterol | 76% to 127% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200674

| Seq ID | Chemical Class | Biochemical Class | Compound Name | Modification |
|---|---|---|---|---|
| 200674 | Acids - Hydroxy Alpha | Acid Pathway | Butanoic acid, 2,3,4-trihydroxy- | 1590% to 2650% |
| 200674 | Acids | Acids | Carbamic acid | 60% to 87% |
| 200674 | Acids - Hydroxy | Amino Acids and Related Compounds | Shikimic acid | 261% to 435% |
| 200674 | Acids - Hydroxy Alpha | Acid Pathway | Citric acid | 137% to 228% |
| 200674 | Acids - Hydroxy Alpha | Carbohydrates | Quinic acid | 228% to 381% |
| 200674 | Alcohols | Carbohydrates | Inositol | 66% to 110% |
| 200674 | Alkaloids and Other Bases | Polyamines | 1,4-Butanediamine | 125% to 208% |
| 200674 | Amino Acids and Related Compounds | Amino Acids and Related Compounds | Glutamic acid | 155% to 259% |
| 200674 | Carbohydrates | Carbohydrates | F3-U0.813 Carbohydrate | 483% to 805% |
| 200674 | Carbohydrates | Carbohydrates | F3-U0.816 Carbohydrate | 261% to 435% |
| 200674 | Carbohydrates | Carbohydrates | F3-U0.821 Carbohydrate | 137% to 228% |
| 200674 | Carbohydrates | Carbohydrates | F3-U0.825 Carbohydrate | New |
| 200674 | Carbohydrates | Carbohydrates | F3-U0.846 Carbohydrate | 716% to 1193% |
| 200674 | Carbohydrates | Carbohydrates | F3-U0.848 Carbohydrate | 166% to 276% |
| 200674 | Carbohydrates | Carbohydrates | F3-U0.872 Hexose | 532% to 887% |
| 200674 | Carbohydrates | Carbohydrates | F3-U1.150 Carbohydrate | 60% to 85% |
| 200674 | Carbohydrates | Carbohydrates | F3-U1.189 Carbohydrate | 138% to 230% |
| 200674 | Carbohydrates | Carbohydrates | F3-U1.194 Carbohydrate | 81% to 135% |
| 200674 | Carbohydrates | Carbohydrates | F3-U1.241 Carbohydrate | New |
| 200674 | Carbohydrates | Carbohydrates | Fructose | 87% to 213% |
| 200674 | Carbohydrates | Carbohydrates | Glucose | 172% to 316% |
| 200674 | NA | NA | F3-U0.751 | 233% to 388% |
| 200674 | NA | NA | F3-U0.843 | New |
| 200674 | NA | NA | F3-U0.852A | New |
| 200674 | NA | NA | F3-U1.229 | 125% to 208% |
| 200674 | NA | NA | F3-U1.253 | 191% to 319% |
| 200674 | Phenols and Related Compounds | Phenylpropanes and Derivatives | Chlorogenic acid | 148% to 247% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200677

| Seq ID | Chemical Class | Biochemical Class | Compound Name | Modification |
|---|---|---|---|---|
| 200677 | Acids - Hydroxy Alpha | Acid Pathway | Malic acid | 87% to 145% |
| 200677 | Acids - Hydroxy Alpha | Carbohydrates | Quinic acid | 102% to 169% |
| 200677 | Carbohydrates | Carbohydrates | F3-U0.813 Carbohydrate | 164% to 273% |
| 200677 | Carbohydrates | Carbohydrates | F3-U0.816 Carbohydrate | 88% to 146% |
| 200677 | Carbohydrates | Carbohydrates | F3-U0.821 Carbohydrate | 85% to 141% |
| 200677 | Carbohydrates | Carbohydrates | F3-U0.825 Carbohydrate | 147% to 245% |
| 200677 | Carbohydrates | Carbohydrates | F3-U0.846 Carbohydrate | 75% to 125% |
| 200677 | Carbohydrates | Carbohydrates | F3-U0.848 Carbohydrate | 82% to 136% |
| 200677 | Carbohydrates | Carbohydrates | F3-U0.872 Hexose | 87% to 145% |
| 200677 | Carbohydrates | Carbohydrates | F3-U0.952 Carbohydrate | 108% to 180% |
| 200677 | Carbohydrates | Carbohydrates | F3-U1.189 Carbohydrate | 85% to 142% |
| 200677 | Carbohydrates | Carbohydrates | F3-U1.194 Carbohydrate | 60% to 78% |
| 200677 | Carbohydrates | Carbohydrates | Fructose | 120% to 278% |
| 200677 | Carbohydrates | Carbohydrates | Galactose or Mannose | 132% to 220% |
| 200677 | Carbohydrates | Carbohydrates | Glucose | 80% to 298% |
| 200677 | Esters | Esters | F1-U1.076 Fatty Acid Ester | 145% to 242% |
| 200677 | Esters | Esters | F1-U1.113 Fatty Acid Ester | 172% to 287% |
| 200677 | Esters - Hydroxy | Acyl acetylglycerols | 2-Octadecanoyl-1-acetylglycerol | 104% to 173% |
| 200677 | NA | NA | F3-U0.852A | 144% to 240% |
| 200677 | NA | NA | F3-U1.253 | 60% to 88% |
| 200677 | Sterols, Oxygenated Terpenes, and Other Isoprenoids | Prenylquinones | alpha-Tocopherol hydroquinone | New |
| 200677 | Sterols, Oxygenated Terpenes, and Other Isoprenoids | Terpenoids | F1-U1.153 Sterol | 151% to 252% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200680

| Seq ID | Chemical Class | Biochemical Class | Compound Name | Modification |
|---|---|---|---|---|
| 200680 | Acids | Acids | Carbamic acid | NQ |
| 200680 | Acids - Hydroxy Alpha | Acid Pathway | Malic acid | 189% to 316% |
| 200680 | Acids - Hydroxy Alpha | Carbohydrates | Quinic acid | 155% to 258% |
| 200680 | Alcohols | Carbohydrates | Inositol | 97% to 162% |
| 200680 | Amino Acids and Related Compounds | Amino Acids and Related Compounds | Glutamic acid | New |
| 200680 | Amino Acids and Related Compounds | Amino Acids and Related Compounds | Histidine | 145% to 485% |
| 200680 | Amino Acids and Related Compounds | Amino Acids and Related Compounds | Lysine | New |
| 200680 | Amino Acids and Related Compounds | Amino Acids and Related Compounds | Proline, 5-oxo- | 135% to 255% |
| 200680 | Amino Acids and Related Compounds | Amino Acids and Related Compounds | Threonine | 60% to 195% |
| 200680 | Amino Acids and Related Compounds | Amino Acids and Related Compounds | Valine | 100% to 295% |
| 200680 | Carbohydrates | Carbohydrates | F3-U0.813 Carbohydrate | 306% to 511% |
| 200680 | Carbohydrates | Carbohydrates | F3-U0.816 Carbohydrate | 130% to 216% |
| 200680 | Carbohydrates | Carbohydrates | F3-U0.821 Carbohydrate | 312% to 520% |
| 200680 | Carbohydrates | Carbohydrates | F3-U0.825 Carbohydrate | 849% to 1415% |
| 200680 | Carbohydrates | Carbohydrates | F3-U0.830 Carbohydrate | New |
| 200680 | Carbohydrates | Carbohydrates | F3-U0.846 Carbohydrate | 485% to 809% |
| 200680 | Carbohydrates | Carbohydrates | F3-U0.848 Carbohydrate | 196% to 326% |
| 200680 | Carbohydrates | Carbohydrates | F3-U0.872 Hexose | 505% to 841% |
| 200680 | Carbohydrates | Carbohydrates | F3-U1.189 Carbohydrate | 86% to 143% |
| 200680 | Carbohydrates | Carbohydrates | F3-U1.194 Carbohydrate | 92% to 154% |
| 200680 | Carbohydrates | Carbohydrates | Fructose | 161% to 405% |
| 200680 | Carbohydrates | Carbohydrates | Galactose or Mannose | New |
| 200680 | Carbohydrates | Carbohydrates | Glucose | 182% to 690% |
| 200680 | NA | NA | F3-U0.852A | 382% to 636% |
| 200680 | NA | NA | F3-U1.253 | 146% to 243% |
| 200680 | NA | NA | F3-U1.255 | 60% to 100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200704

| Seq ID | Chemical Class | Biochemical Class | Compound Name | Modification |
|---|---|---|---|---|
| 200704 | Fatty Acids and Related Waxes | Acids - Fatty Unsat | 9-Octadecenoic acid | -60% to -63% |
| 200704 | Acid Pathway | Acids - Hydroxy Alpha | Butanoic acid, 2,3,4-trihydroxy- | 60% to 95% |
| 200704 | Acid Pathway | Acids - Hydroxy Alpha | Citric acid | 392% to 653% |
| 200704 | Amino Acids and Related Compounds | Amino Acids and Related Compounds | Glutamic acid | 129% to 214% |
| 200704 | Carbohydrates | Carbohydrates | F3-U0.813 Carbohydrate | New |
| 200704 | Carbohydrates | Carbohydrates | F3-U0.816 Carbohydrate | 319% to 531% |
| 200704 | Carbohydrates | Carbohydrates | F3-U0.821 Carbohydrate | 392% to 653% |
| 200704 | Carbohydrates | Carbohydrates | F3-U0.825 Carbohydrate | New |
| 200704 | Carbohydrates | Carbohydrates | F3-U0.846 Carbohydrate | 1422% to 2370% |
| 200704 | Carbohydrates | Carbohydrates | F3-U0.872 Hexose | 734% to 1224% |
| 200704 | Carbohydrates | Carbohydrates | F3-U1.150 Carbohydrate | 201% to 335% |
| 200704 | Carbohydrates | Carbohydrates | F3-U1.189 Carbohydrate | 156% to 260% |
| 200704 | Carbohydrates | Carbohydrates | Glucose | 60% to 121% |
| 200704 | Carbohydrates | Acids - Hydroxy Alpha | Quinic acid | 60% to 95% |
| 200704 | NA | NA | F3-U0.843 | New |
| 200704 | NA | NA | F3-U0.852A | New |
| 200704 | NA | NA | F3-U1.229 | 60% to 94% |
| 200704 | NA | NA | F3-U1.255 | 93% to 155% |
| 200704 | Phenylpropanes and Derivatives | Phenols and Related Compounds | Chlorogenic acid | 81% to 135% |
| 200704 | Polyamines | Alkaloids and Other Bases | 1,4-Butanediamine | 60% to 92% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#200705

| Seq ID | Chemical Class | Biochemical Class | Compound Name | Modification |
|---|---|---|---|---|
| 200705 | Acid Pathway | Acids - Hydroxy Alpha | Butanoic acid, 2,3,4-trihydroxy- | 101% to 169% |
| 200705 | Acid Pathway | Acids - Hydroxy Alpha | Citric acid | 486% to 810% |
| 200705 | Acids | Acids | Carbamic acid | 69% to 115% |
| 200705 | Acyl acetylglycerols | Esters - Hydroxy | 2-Eicosanoyl-1-acetylglycerol | 282% to 470% |
| 200705 | Acyl acetylglycerols | Esters - Hydroxy | 2-Octadecanoyl-1-acetylglycerol | 148% to 247% |
| 200705 | Amino Acids and Related Compounds | Amino Acids and Related Compounds | Arginine | 85% to 1230% |
| 200705 | Amino Acids and Related Compounds | Amino Acids and Related Compounds | Asparagine | New |
| 200705 | Amino Acids and Related Compounds | Amino Acids and Related Compounds | Aspartic acid | 60% to 150% |
| 200705 | Amino Acids and Related Compounds | Amino Acids and Related Compounds | Glutamic acid | 63% to 510% |
| 200705 | Amino Acids and Related Compounds | Amino Acids and Related Compounds | Isoleucine | New |
| 200705 | Amino Acids and Related Compounds | Amino Acids and Related Compounds | Leucine | New |
| 200705 | Amino Acids and Related Compounds | Amino Acids and Related Compounds | Lysine | 145% to 290% |
| 200705 | Amino Acids and Related Compounds | Amino Acids and Related Compounds | Serine | 60% to 155% |
| 200705 | Amino Acids and Related Compounds | Amino Acids and Related Compounds | Threonine | 60% to 185% |
| 200705 | Amino Acids and Related Compounds | Amino Acids and Related Compounds | Valine | 315% to 725% |
| 200705 | Carbohydrates | Carbohydrates | F3-U0.816 Carbohydrate | 60% to 80% |
| 200705 | Carbohydrates | Acids - Hydroxy Alpha | F3-U0.992 Sugar acid | New |
| 200705 | Carbohydrates | Carbohydrates | F3-U1.150 Carbohydrate | 76% to 126% |
| 200705 | Carbohydrates | Carbohydrates | F3-U1.189 Carbohydrate | 60% to 76% |
| 200705 | Carbohydrates | Carbohydrates | F3-U1.194 Carbohydrate | New |
| 200705 | Carbohydrates | Carbohydrates | Fructose | 67% to 112% |
| 200705 | Carbohydrates | Carbohydrates | Glucose | 64% to 106% |
| 200705 | Carbohydrates | Carbohydrates | Sucrose | -65% to -100% |
| 200705 | Esters | Esters | F1-U1.076 Fatty Acid Ester | 161% to 269% |
| 200705 | Esters | Esters | F1-U1.119 Fatty Acid Ester | 243% to 405% |
| 200705 | Fatty Acids and Related Waxes | Acids - Fatty Branched | Heptadecanoic acid, 16-methyl- | 60% to 120% |
| 200705 | Fatty Acids and Related Waxes | Acids - Fatty Branched | Hexadecanoic acid, 14-methyl- | -60% to -77% |
| 200705 | Fatty Acids and Related Waxes | Acids - Fatty | Octadecanoic acid | 60% to 96% |
| 200705 | Hydrocarbons | Hydrocarbons | Octacosane, 2-methyl | 67% to 112% |
| 200705 | NA | NA | F1-U0.875 | New |
| 200705 | NA | NA | F1-U0.972 | New |
| 200705 | NA | NA | F3-U0.751 | 92% to 153% |
| 200705 | NA | NA | F3-U0.781 Carbohydrate | New |
| 200705 | NA | NA | F3-U0.799 | New |
| 200705 | NA | NA | F3-U0.882 | 516% to 860% |
| 200705 | NA | NA | F3-U1.229 | 102% to 170% |
| 200705 | NA | NA | F3-U1.253 | 135% to 225% |
| 200705 | NA | NA | F3-U1.255 | 428% to 713% |
| 200705 | Prenylquinones | Sterols, Oxygenated Terpenes, and Other Isoprenoids | alpha-Tocopherol hydroquinone | New |
| 200705 | Prenylquinones | Sterols, Oxygenated Terpenes, and Other Isoprenoids | beta-Tocopherol | 1114% to 1856% |
| 200705 | Terpenoids | Sterols, Oxygenated Terpenes, and Other Isoprenoids | beta-Sitosterol | 163% to 272% |
| 200705 | Terpenoids | Sterols, Oxygenated Terpenes, and Other Isoprenoids | Campesterol | 109% to 182% |
| 200705 | Terpenoids | Sterols, Oxygenated Terpenes, and Other Isoprenoids | Cholesterol | 160% to 267% |
| 200705 | Terpenoids | Sterols, Oxygenated Terpenes, and Other Isoprenoids | Ergosta-8,24(28)-dien-3-ol, 4,14-dimethyl- | New |
| 200705 | Terpenoids | Sterols, Oxygenated Terpenes, and Other Isoprenoids | F1-U1.136 Sterol | 134% to 223% |
| 200705 | Terpenoids | Sterols, Oxygenated Terpenes, and Other Isoprenoids | F1-U1.145 Sterol | 60% to 96% |
| 200705 | Terpenoids | Sterols, Oxygenated Terpenes, and Other Isoprenoids | Fucosterol | 89% to 149% |
| 200705 | Terpenoids | Sterols, Oxygenated Terpenes, and Other Isoprenoids | Stigmasterol | 191% to 319% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200709

| Seq ID | Chemical Class | Biochemical Class | Compound Name | Modification |
|---|---|---|---|---|
| 200709 | Acids - Fatty Unsat | Fatty Acids and Related Waxes | 9-Octadecenoic acid | 9% to 119% |
| 200709 | Acids - Fatty | Fatty Acids and Related Waxes | Eicosanoic acid | -26% to -77% |
| 200709 | Acids - Fatty Branched | Fatty Acids and Related Waxes | Heptadecanoic acid, 16-methyl- | -31% to -72% |
| 200709 | Acids - Fatty Unsat | Fatty Acids and Related Waxes | 9,12-Octadecadienoic acid | 6% to 38% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200713

| Seq ID | Chemical Class | Biochemical Class | Compound Name | Modification |
|---|---|---|---|---|
| 200713 | Acids - Fatty | Fatty Acids and Related Waxes | Eicosanoic acid | -60% to -64% |
| 200713 | Acids - Fatty Branched | Fatty Acids and Related Waxes | Heptadecanoic acid, 16-methyl- | -60% to -61% |
| 200713 | Acids - Hydroxy Alpha | Acid Pathway | Butanoic acid, 2,3,4-trihydroxy- | 142% to 236% |
| 200713 | Acids - Hydroxy Alpha | Acid Pathway | Citric acid | 250% to 416% |
| 200713 | Acids - Hydroxy Alpha | Carbohydrates | Quinic acid | 210% to 349% |
| 200713 | Alcohols | Carbohydrates | Inositol | 145% to 242% |
| 200713 | Amino Acids and Related Compounds | Amino Acids and Related Compounds | Glutamic acid | 187% to 311% |
| 200713 | Carbohydrates | Carbohydrates | F3-U0.813 Carbohydrate | 575% to 959% |
| 200713 | Carbohydrates | Carbohydrates | F3-U0.816 Carbohydrate | 227% to 378% |
| 200713 | Carbohydrates | Carbohydrates | F3-U0.821 Carbohydrate | 250% to 416% |
| 200713 | Carbohydrates | Carbohydrates | F3-U0.825 Carbohydrate | 272% to 453% |
| 200713 | Carbohydrates | Carbohydrates | F3-U0.846 Carbohydrate | 240% to 400% |
| 200713 | Carbohydrates | Carbohydrates | F3-U0.872 Hexose | 305% to 508% |
| 200713 | Carbohydrates | Carbohydrates | F3-U1.113B Carbohydrate | 60% to 97% |
| 200713 | Carbohydrates | Carbohydrates | F3-U1.150 Carbohydrate | 77% to 128% |
| 200713 | Carbohydrates | Carbohydrates | F3-U1.189 Carbohydrate | 160% to 266% |
| 200713 | Carbohydrates | Carbohydrates | F3-U1.194 Carbohydrate | 220% to 366% |
| 200713 | Carbohydrates | Carbohydrates | Fructose | 480% to 1000% |
| 200713 | Carbohydrates | Carbohydrates | Glucose | 639% to 1531% |
| 200713 | NA | NA | F3-U0.836 | New |
| 200713 | NA | NA | F3-U0.843 | New |
| 200713 | NA | NA | F3-U0.852A | 764% to 1274% |
| 200713 | NA | NA | F3-U0.882 | 107% to 178% |
| 200713 | NA | NA | F3-U1.253 | 68% to 113% |
| 200713 | Phenols and Related Compounds | Phenylpropanes and Derivatives | Chlorogenic acid | 60% to 95% |

FIG. 6 continued

A list of metabolite compounds present in altered levels relative to reference samples as chararacterized by gas chromatography, liquid chromatography and/or mass spectrometry. This list corresponds to samples transfected with nucleic acid sequence, Seq ID#200716

| Seq ID | Chemical Class | Biochemical Class | Compound Name | Modification |
|---|---|---|---|---|
| 200716 | Acids - Fatty | Fatty Acids and Related Waxes | Octadecanoic acid | 60% to 96% |
| 200716 | Acids - Fatty Unsat | Fatty Acids and Related Waxes | 9-Octadecenoic acid | -60% to -68% |
| 200716 | Acids - Hydroxy Alpha | Acid Pathway | Citric acid | 1175% to 1958% |
| 200716 | Alkaloids and Other Bases | Polyamines | 1,4-Butanediamine | 69% to 115% |
| 200716 | Alkenes and Alkynes | Terpenoids | Limonene | 146% to 244% |
| 200716 | Amino Acids and Related Compounds | Amino Acids and Related Compounds | Asparagine | New |
| 200716 | Amino Acids and Related Compounds | Amino Acids and Related Compounds | Glutamic acid | 220% to 367% |
| 200716 | Carbohydrates | Carbohydrates | F3-U0.794 Carbohydrate | New |
| 200716 | Carbohydrates | Carbohydrates | F3-U0.813 Carbohydrate | New |
| 200716 | Carbohydrates | Carbohydrates | F3-U0.816 Carbohydrate | 619% to 1031% |
| 200716 | Carbohydrates | Carbohydrates | F3-U0.821 Carbohydrate | 1175% to 1958% |
| 200716 | Carbohydrates | Carbohydrates | F3-U0.825 Carbohydrate | New |
| 200716 | Carbohydrates | Carbohydrates | F3-U0.846 Carbohydrate | 870% to 1450% |
| 200716 | Carbohydrates | Carbohydrates | F3-U0.872 Hexose | 477% to 795% |
| 200716 | Carbohydrates | Carbohydrates | F3-U1.189 Carbohydrate | 115% to 192% |
| 200716 | Carbohydrates | Carbohydrates | Fructose | 65% to 109% |
| 200716 | Esters | Esters | F1-U1.076 Fatty Acid Ester | 60% to 88% |
| 200716 | Esters - Hydroxy | Acyl acetylglycerols | 2-Eicosanoyl-1-acetylglycerol | New |
| 200716 | Esters - Hydroxy | Acyl acetylglycerols | 2-Octadecanoyl-1-acetylglycerol | New |
| 200716 | NA | NA | F3-U0.801 | New |
| 200716 | NA | NA | F3-U0.852A | New |
| 200716 | Phenols and Related Compounds | Phenylpropanes and Derivatives | Chlorogenic acid | 73% to 121% |
| 200716 | Sterols, Oxygenated Terpenes, and Other Isoprenoids | Prenylquinones | alpha-Tocopherol | 211% to 351% |
| 200716 | Sterols, Oxygenated Terpenes, and Other Isoprenoids | Terpenoids | beta-Sitosterol | New |
| 200716 | Sterols, Oxygenated Terpenes, and Other Isoprenoids | Prenylquinones | beta-Tocopherol | New |
| 200716 | Sterols, Oxygenated Terpenes, and Other Isoprenoids | Terpenoids | Campesterol | New |
| 200716 | Sterols, Oxygenated Terpenes, and Other Isoprenoids | Terpenoids | Cholesterol | 115% to 191% |
| 200716 | Sterols, Oxygenated Terpenes, and Other Isoprenoids | Terpenoids | F1-U1.106 Sterol | -60% to -75% |
| 200716 | Sterols, Oxygenated Terpenes, and Other Isoprenoids | Terpenoids | F1-U1.153 Sterol | -60% to -75% |
| 200716 | Sterols, Oxygenated Terpenes, and Other Isoprenoids | Terpenoids | Fucosterol | New |
| 200716 | Sterols, Oxygenated Terpenes, and Other Isoprenoids | Terpenoids | Stigmasterol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#20072

| Seq ID | Chemical Class | Biochemical Class | Compound Name | Modification |
|---|---|---|---|---|
| 20072 | Amino Acids and Related Compounds | Amino Acids and Related Compounds | Cysteine | 35% to 275% |
| 20072 | Amino Acids and Related Compounds | Amino Acids and Related Compounds | Glycine | 30% to 210% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200721

| Seq ID | Chemical Class | Biochemical Class | Compound Name | Modification |
|---|---|---|---|---|
| 200721 | Acids - Hydroxy | Amino Acids and Related Compounds | Shikimic acid | 68% to 113% |
| 200721 | Acids - Hydroxy Alpha | Acid Pathway | Butanoic acid, 2,3,4-trihydroxy- | 121% to 201% |
| 200721 | Acids - Hydroxy Alpha | Acid Pathway | Citric acid | 115% to 192% |
| 200721 | Acids - Hydroxy Alpha | Carbohydrates | Quinic acid | 63% to 106% |
| 200721 | Alkaloids and Other Bases | Polyamines | 1,4-Butanediamine | 162% to 270% |
| 200721 | Amino Acids and Related Compounds | Amino Acids and Related Compounds | Aspartic acid | 117% to 195% |
| 200721 | Amino Acids and Related Compounds | Amino Acids and Related Compounds | Glutamic acid | 115% to 447% |
| 200721 | Carbohydrates | Carbohydrates | F3-U0.816 Carbohydrate | 68% to 113% |
| 200721 | Carbohydrates | Carbohydrates | F3-U0.821 Carbohydrate | 115% to 192% |
| 200721 | Carbohydrates | Carbohydrates | F3-U0.846 Carbohydrate | 127% to 212% |
| 200721 | Carbohydrates | Carbohydrates | F3-U0.848 Carbohydrate | 107% to 179% |
| 200721 | Carbohydrates | Carbohydrates | F3-U0.872 Hexose | 191% to 318% |
| 200721 | Carbohydrates | Carbohydrates | F3-U0.876 Hexose | 162% to 270% |
| 200721 | Carbohydrates | Carbohydrates | F3-U0.948 | 130% to 216% |
| 200721 | Carbohydrates | Carbohydrates | F3-U1.150 Carbohydrate | 135% to 226% |
| 200721 | Carbohydrates | Carbohydrates | F3-U1.189 Carbohydrate | 283% to 471% |
| 200721 | Carbohydrates | Carbohydrates | Fructose | 249% to 598% |
| 200721 | Carbohydrates | Carbohydrates | Glucose | 172% to 692% |
| 200721 | NA | NA | F3-U0.738B | New |
| 200721 | NA | NA | F3-U0.751 | 60% to 76% |
| 200721 | NA | NA | F3-U0.882 | 60% to 97% |
| 200721 | NA | NA | F3-U1.229 | 81% to 135% |
| 200721 | NA | NA | F3-U1.253 | 124% to 206% |
| 200721 | Phenols and Related Compounds | Phenylpropanes and Derivatives | Chlorogenic acid | 154% to 257% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200733

| Seq ID | Chemical Class | Biochemical Class | Compound Name | Modification |
|--------|----------------|-------------------|---------------|--------------|
| 200733 | Acids - Fatty Unsat | Fatty Acids and Related Waxes | 9,12-Octadecadienoic acid | 7% to 50% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200741

| Seq ID | Chemical Class | Biochemical Class | Compound Name | Modification |
|---|---|---|---|---|
| 200741 | Acids - Fatty | Fatty Acids and Related Waxes | Hexadecanoic acid | -1% to -36% |
| 200741 | Acids - Fatty | Fatty Acids and Related Waxes | Octadecanoic acid | -44% to -65% |
| 200741 | Acids - Fatty Branched | Fatty Acids and Related Waxes | Hexadecanoic acid, 14-methyl- | -12% to -50% |
| 200741 | Acids - Fatty Unsat | Fatty Acids and Related Waxes | 7,10,13-Hexadecatrienoic acid | 4% to 156% |
| 200741 | Acids - Fatty Unsat | Fatty Acids and Related Waxes | 9,12-Octadecadienoic acid | -4% to -46% |
| 200741 | Acids - Fatty Unsat | Fatty Acids and Related Waxes | 9-Octadecenoic acid | -74% to -94% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200748

| Seq ID | Chemical Class | Biochemical Class | Compound Name | Modification |
|---|---|---|---|---|
| 200748 | Acids | Acids | Carbamic acid | 60% to 92% |
| 200748 | Acids - Fatty | Fatty Acids and Related Waxes | Eicosanoic acid | 60% to 96% |
| 200748 | Acids - Fatty Branched | Fatty Acids and Related Waxes | Hexadecanoic acid, 14-methyl- | -60% to -73% |
| 200748 | Acids - Fatty Unsat | Fatty Acids and Related Waxes | 9-Hexadecenoic acid | -60% to -66% |
| 200748 | Acids - Fatty Unsat | Fatty Acids and Related Waxes | 9-Octadecenoic acid | -60% to -68% |
| 200748 | Acids - Hydroxy Alpha | Carbohydrates | Quinic acid | 212% to 354% |
| 200748 | Alkaloids and Other Bases | Polyamines | 1,4-Butanediamine | 116% to 193% |
| 200748 | Carbohydrates | Carbohydrates | F3-U0.794 Carbohydrate | New |
| 200748 | Carbohydrates | Carbohydrates | F3-U0.872 Hexose | 98% to 163% |
| 200748 | Carbohydrates | Carbohydrates | F3-U0.876 Hexose | 138% to 230% |
| 200748 | Carbohydrates | Carbohydrates | F3-U0.948 | 122% to 203% |
| 200748 | Carbohydrates | Carbohydrates | Fructose | 223% to 522% |
| 200748 | Carbohydrates | Carbohydrates | Glucose | 344% to 574% |
| 200748 | NA | NA | F3-U0.727 | -60% to -77% |
| 200748 | NA | NA | F3-U1.229 | 76% to 126% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200749

| Seq ID | Chemical Class | Biochemical Class | Compound Name | Modification |
|---|---|---|---|---|
| 200749 | Acids - Fatty Unsat | Fatty Acids and Related Waxes | 9-Octadecenoic acid | 24% to 437% |
| 200749 | Acids - Fatty | Fatty Acids and Related Waxes | Octadecanoic acid | 46% to 134% |
| 200749 | Acids - Fatty Branched | Fatty Acids and Related Waxes | Hexadecanoic acid, 14-methyl- | -16% to -44% |
| 200749 | Acids - Fatty Unsat | Fatty Acids and Related Waxes | 7,10,13-Hexadecatrienoic acid | -39% to -62% |
| 200749 | Acids - Fatty Unsat | Fatty Acids and Related Waxes | 9,12,15-Octadecatrienoic acid | -1% to -24% |
| 200749 | Acids - Fatty Unsat | Fatty Acids and Related Waxes | 9-Hexadecenoic acid | -44% to -65% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200751

| Seq ID | Chemical Class | Biochemical Class | Compound Name | Modification |
|---|---|---|---|---|
| 200751 | Esters | Esters | F1-U1.078 Fatty Acid Ester | 60% to 82% |
| 200751 | NA | NA | F1-U0.872 | New |
| 200751 | Sterols, Oxygenated Terpenes, and Other Isoprenoids | Prenylquinones | alpha-Tocopherol | 195% to 325% |
| 200751 | Sterols, Oxygenated Terpenes, and Other Isoprenoids | Prenylquinones | alpha-Tocopherol hydroquinone | 107% to 179% |
| 200751 | Sterols, Oxygenated Terpenes, and Other Isoprenoids | Terpenoids | F1-U1.153 Sterol | 79% to 132% |
| 200751 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200759

| Seq ID | Chemical Class | Biochemical Class | Compound Name | Modification |
|---|---|---|---|---|
| 200759 | Acids - Fatty Unsat | Fatty Acids and Related Waxes | 9,12,15-Octadecatrienoic acid | -7% to -16% |
| 200759 | Acids - Fatty Unsat | Fatty Acids and Related Waxes | 9,12-Octadecadienoic acid | 15% to 61% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200773

| Seq ID | Chemical Class | Biochemical Class | Compound Name | Modification |
|---|---|---|---|---|
| 200773 | Acids - Fatty | Fatty Acids and Related Waxes | Eicosanoic acid | -63% to -100% |
| 200773 | Acids - Fatty Unsat | Fatty Acids and Related Waxes | 7,10,13-Hexadecatrienoic acid | -5% to -43% |
| 200773 | Acids - Fatty Unsat | Fatty Acids and Related Waxes | 9,12,15-Octadecatrienoic acid | -8% to -17% |
| 200773 | Acids - Fatty Unsat | Fatty Acids and Related Waxes | 9,12-Octadecadienoic acid | 15% to 61% |
| 200773 | Acids - Fatty Unsat | Fatty Acids and Related Waxes | 9-Octadecenoic acid | 30% to 240% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200786

| Seq ID | Chemical Class | Biochemical Class | Compound Name | Modification |
|---|---|---|---|---|
| 200786 | Acids - Fatty | Fatty Acids and Related Waxes | Hexadecanoic acid | -7% to -37% |
| 200786 | Acids - Fatty | Fatty Acids and Related Waxes | Octadecanoic acid | -25% to -85% |
| 200786 | Acids - Fatty Branched | Fatty Acids and Related Waxes | Heptadecanoic acid, 16-methyl- | -53% to -100% |
| 200786 | Acids - Fatty Branched | Fatty Acids and Related Waxes | Hexadecanoic acid, 14-methyl- | -24% to -48% |
| 200786 | Acids - Fatty Unsat | Fatty Acids and Related Waxes | 7,10,13-Hexadecatrienoic acid | 57% to 164% |
| 200786 | Acids - Fatty Unsat | Fatty Acids and Related Waxes | 9,12,15-Octadecatrienoic acid | 1% to 16% |
| 200786 | Acids - Fatty Unsat | Fatty Acids and Related Waxes | 9-Hexadecenoic acid | -12% to -45% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#200788

| Seq ID | Chemical Class | Biochemical Class | Compound Name | Modification |
|---|---|---|---|---|
| 200788 | Acids | Acids | Carbamic acid | 227% to 379% |
| 200788 | Acids - Fatty | Fatty Acids and Related Waxes | Eicosanoic acid | -60% to -99% |
| 200788 | Acids - Fatty | Fatty Acids and Related Waxes | Octadecanoic acid | 60% to 64% |
| 200788 | Acids - Hydroxy Alpha | Acid Pathway | Butanoic acid, 2,3,4-trihydroxy- | New |
| 200788 | Acids - Hydroxy Alpha | Acid Pathway | Citric acid | 166% to 276% |
| 200788 | Acids - Hydroxy Alpha | Carbohydrates | Quinic acid | 322% to 537% |
| 200788 | Alcohols | Carbohydrates | Inositol | 73% to 121% |
| 200788 | Amino Acids and Related Compounds | Amino Acids and Related Compounds | Alanine | 655% to 1180% |
| 200788 | Amino Acids and Related Compounds | Amino Acids and Related Compounds | Arginine | 620% to 3470% |
| 200788 | Amino Acids and Related Compounds | Amino Acids and Related Compounds | Aspartic acid | -60% to -86% |
| 200788 | Amino Acids and Related Compounds | Amino Acids and Related Compounds | Cysteine | 1415% to 11465% |
| 200788 | Amino Acids and Related Compounds | Amino Acids and Related Compounds | Glycine | 1970% to 8060% |
| 200788 | Amino Acids and Related Compounds | Amino Acids and Related Compounds | Isoleucine | New |
| 200788 | Amino Acids and Related Compounds | Amino Acids and Related Compounds | Leucine | New |
| 200788 | Amino Acids and Related Compounds | Amino Acids and Related Compounds | Lysine | 165% to 460% |
| 200788 | Amino Acids and Related Compounds | Amino Acids and Related Compounds | Methionine | 305% to 1410% |
| 200788 | Amino Acids and Related Compounds | Amino Acids and Related Compounds | Serine | 240% to 420% |
| 200788 | Amino Acids and Related Compounds | Amino Acids and Related Compounds | Threonine | 310% to 525% |
| 200788 | Amino Acids and Related Compounds | Amino Acids and Related Compounds | Tryptophan | New |
| 200788 | Amino Acids and Related Compounds | Amino Acids and Related Compounds | Tyrosine | New |
| 200788 | Amino Acids and Related Compounds | Amino Acids and Related Compounds | Valine | 800% to 1645% |
| 200788 | Carbohydrates | Carbohydrates | F3-U0.813 Carbohydrate | New |
| 200788 | Carbohydrates | Carbohydrates | F3-U0.816 Carbohydrate | 223% to 372% |
| 200788 | Carbohydrates | Carbohydrates | F3-U0.821 Carbohydrate | 166% to 276% |
| 200788 | Carbohydrates | Carbohydrates | F3-U0.846 Carbohydrate | 431% to 718% |
| 200788 | Carbohydrates | Carbohydrates | F3-U0.872 Hexose | 407% to 678% |
| 200788 | Carbohydrates | Carbohydrates | F3-U0.876 Hexose | 315% to 525% |
| 200788 | Carbohydrates | Carbohydrates | F3-U1.189 Carbohydrate | 85% to 142% |
| 200788 | Carbohydrates | Carbohydrates | Fructose | 585% to 1266% |
| 200788 | Carbohydrates | Carbohydrates | Glucose | 982% to 2740% |
| 200788 | Esters - Hydroxy | Acyl acetylglycerols | 2-Eicosanoyl-1-acetylglycerol | -60% to -77% |
| 200788 | NA | NA | F3-U0.714 | New |
| 200788 | NA | NA | F3-U0.736 | New |
| 200788 | NA | NA | F3-U0.882 | 132% to 220% |
| 200788 | Phenols and Related Compounds | Phenylpropanes and Derivatives | Chlorogenic acid | 165% to 275% |
| 200788 | Sterols, Oxygenated Terpenes, and Other Isoprenoids | Prenylquinones | alpha-Tocopherol | 150% to 249% |
| 200788 | Sterols, Oxygenated Terpenes, and Other Isoprenoids | Prenylquinones | alpha-Tocopherol hydroquinone | 153% to 255% |
| 200788 | Sterols, Oxygenated Terpenes, and Other Isoprenoids | Terpenoids | beta-Sitosterol | 167% to 278% |
| 200788 | Sterols, Oxygenated Terpenes, and Other Isoprenoids | Prenylquinones | beta-Tocopherol | 165% to 275% |
| 200788 | Sterols, Oxygenated Terpenes, and Other Isoprenoids | Terpenoids | F1-U1.136 Sterol | 131% to 219% |
| 200788 | Sterols, Oxygenated Terpenes, and Other Isoprenoids | Terpenoids | F1-U1.153 Sterol | 60% to 87% |
| 200788 | Sterols, Oxygenated Terpenes, and Other Isoprenoids | Terpenoids | Stigmasterol | 60% to 85% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200806

| Seq ID | Chemical Class | Biochemical Class | Compound Name | Modification |
|---|---|---|---|---|
| 200806 | Acids | Acids | Carbamic acid | -60% to -76% |
| 200806 | Acids - Hydroxy Alpha | Acid Pathway | Butanoic acid, 2,3,4-trihydroxy- | New |
| 200806 | Acids - Hydroxy Alpha | Acid Pathway | Citric acid | 378% to 630% |
| 200806 | Acids - Hydroxy Alpha | Carbohydrates | Quinic acid | 278% to 463% |
| 200806 | Amino Acids and Related Compounds | Amino Acids and Related Compounds | Arginine | 60% to 405% |
| 200806 | Amino Acids and Related Compounds | Amino Acids and Related Compounds | Cysteine | 60% to 880% |
| 200806 | Amino Acids and Related Compounds | Amino Acids and Related Compounds | Glutamic acid | 173% to 288% |
| 200806 | Amino Acids and Related Compounds | Amino Acids and Related Compounds | Glycine | 200% to 1075% |
| 200806 | Amino Acids and Related Compounds | Amino Acids and Related Compounds | Proline | 60% to 190% |
| 200806 | Carbohydrates | Carbohydrates | F3-U0.813 Carbohydrate | New |
| 200806 | Carbohydrates | Carbohydrates | F3-U0.816 Carbohydrate | 312% to 520% |
| 200806 | Carbohydrates | Carbohydrates | F3-U0.821 Carbohydrate | 378% to 630% |
| 200806 | Carbohydrates | Carbohydrates | F3-U0.825 Carbohydrate | New |
| 200806 | Carbohydrates | Carbohydrates | F3-U0.846 Carbohydrate | 995% to 1658% |
| 200806 | Carbohydrates | Carbohydrates | F3-U0.872 Hexose | 701% to 1168% |
| 200806 | Carbohydrates | Carbohydrates | F3-U0.952 Carbohydrate | 451% to 751% |
| 200806 | Carbohydrates | Carbohydrates | F3-U1.189 Carbohydrate | 82% to 137% |
| 200806 | Carbohydrates | Carbohydrates | Fructose | 60% to 142% |
| 200806 | Carbohydrates | Carbohydrates | Glucose | 464% to 773% |
| 200806 | NA | NA | F3-U0.714 | New |
| 200806 | NA | NA | F3-U0.751 | 72% to 120% |
| 200806 | NA | NA | F3-U0.935 | 62% to 104% |
| 200806 | Phenols and Related Compounds | Phenylpropanes and Derivatives | Chlorogenic acid | 220% to 367% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200818

| Seq ID | Chemical Class | Biochemical Class | Compound Name | Modification |
|---|---|---|---|---|
| 200818 | Acids - Fatty | Fatty Acids and Related Waxes | Eicosanoic acid | -19% to -53% |
| 200818 | Acids - Fatty Branched | Fatty Acids and Related Waxes | Heptadecanoic acid, 16-methyl- | -9% to -44% |
| 200818 | Acids - Fatty Branched | Fatty Acids and Related Waxes | Hexadecanoic acid, 14-methyl- | 11% to 25% |
| 200818 | Acids - Fatty Unsat | Fatty Acids and Related Waxes | 9,12-Octadecadienoic acid | 11% to 28% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#200884

| Seq ID | Chemical Class | Biochemical Class | Compound Name | Modification |
|---|---|---|---|---|
| 200884 | Amino Acids and Related Compounds | Amino Acids and Related Compounds | Alanine | 60% to 220% |
| 200884 | Amino Acids and Related Compounds | Amino Acids and Related Compounds | Arginine | 105% to 2250% |
| 200884 | Amino Acids and Related Compounds | Amino Acids and Related Compounds | Glutamic acid | 60% to 140% |
| 200884 | Amino Acids and Related Compounds | Amino Acids and Related Compounds | Glycine | 60% to 500% |
| 200884 | Amino Acids and Related Compounds | Amino Acids and Related Compounds | Histidine | 60% to 1190% |
| 200884 | Amino Acids and Related Compounds | Amino Acids and Related Compounds | Isoleucine | New |
| 200884 | Amino Acids and Related Compounds | Amino Acids and Related Compounds | Leucine | New |
| 200884 | Amino Acids and Related Compounds | Amino Acids and Related Compounds | Lysine | 75% to 320% |
| 200884 | Amino Acids and Related Compounds | Amino Acids and Related Compounds | Methionine | 85% to 590% |
| 200884 | Amino Acids and Related Compounds | Amino Acids and Related Compounds | Serine | 60% to 165% |
| 200884 | Amino Acids and Related Compounds | Amino Acids and Related Compounds | Threonine | 60% to 510% |
| 200884 | Amino Acids and Related Compounds | Amino Acids and Related Compounds | Tryptophan | New |
| 200884 | Amino Acids and Related Compounds | Amino Acids and Related Compounds | Tyrosine | New |
| 200884 | Amino Acids and Related Compounds | Amino Acids and Related Compounds | Valine | 85% to 1635% |
| 200884 | Esters | Esters | F1-U1.076 Fatty Acid Ester | 199% to 331% |
| 200884 | Esters - Hydroxy | Acyl acetylglycerols | 2-Eicosanoyl-1-acetylglycerol | 75% to 125% |
| 200884 | Esters - Hydroxy | Acyl acetylglycerols | 2-Octadecanoyl-1-acetylglycerol | 81% to 136% |
| 200884 | Sterols, Oxygenated Terpenes, and Other Isoprenoids | Prenylquinones | alpha-Tocopherol | 141% to 236% |
| 200884 | Sterols, Oxygenated Terpenes, and Other Isoprenoids | Prenylquinones | alpha-Tocopherol hydroquinone | 157% to 261% |
| 200884 | Sterols, Oxygenated Terpenes, and Other Isoprenoids | Terpenoids | beta-Sitosterol | 221% to 369% |
| 200884 | Sterols, Oxygenated Terpenes, and Other Isoprenoids | Prenylquinones | beta-Tocopherol | 265% to 441% |
| 200884 | Sterols, Oxygenated Terpenes, and Other Isoprenoids | Terpenoids | Campesterol | 60% to 97% |
| 200884 | Sterols, Oxygenated Terpenes, and Other Isoprenoids | Terpenoids | F1-U1.130 Sterol | New |
| 200884 | Sterols, Oxygenated Terpenes, and Other Isoprenoids | Terpenoids | F1-U1.153 Sterol | 106% to 177% |
| 200884 | Sterols, Oxygenated Terpenes, and Other Isoprenoids | Terpenoids | Lophenol, 24-methylene- | New |
| 200884 | Sterols, Oxygenated Terpenes, and Other Isoprenoids | Terpenoids | Stigmasterol | 60% to 100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212301

| Seq ID | Chemical Class | Biochemical Class | Compound Name | Modification |
|---|---|---|---|---|
| 212301 | Acids - Hydroxy Alpha | Acid Pathway | Malic acid | -60% to -75% |
| 212301 | Acids - Hydroxy Alpha | Carbohydrates | Quinic acid | 120% to 201% |
| 212301 | Amino Acids and Related Compounds | Amino Acids and Related Compounds | Proline | 65% to 109% |
| 212301 | Carbohydrates | Carbohydrates | F3-U0.813 Carbohydrate | 454% to 756% |
| 212301 | Carbohydrates | Carbohydrates | F3-U0.816 Carbohydrate | 417% to 695% |
| 212301 | Carbohydrates | Carbohydrates | F3-U0.821 Carbohydrate | 250% to 417% |
| 212301 | Carbohydrates | Carbohydrates | F3-U0.825 Carbohydrate | 638% to 1063% |
| 212301 | Carbohydrates | Carbohydrates | F3-U0.846 Carbohydrate | 361% to 601% |
| 212301 | Carbohydrates | Carbohydrates | F3-U0.848 Carbohydrate | 128% to 214% |
| 212301 | Carbohydrates | Carbohydrates | F3-U0.872 Hexose | 289% to 481% |
| 212301 | Carbohydrates | Carbohydrates | F3-U1.150 Carbohydrate | 60% to 78% |
| 212301 | Carbohydrates | Carbohydrates | Fructose | 85% to 303% |
| 212301 | Carbohydrates | Carbohydrates | Galactose or Mannose | -73% to -99% |
| 212301 | Carbohydrates | Carbohydrates | Glucose | 108% to 461% |
| 212301 | NA | NA | F3-U0.736 | NQ |
| 212301 | NA | NA | F3-U0.852A | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212347

| Seq ID | Chemical Class | Biochemical Class | Compound Name | Modification |
|---|---|---|---|---|
| 212347 | Acids - Fatty | Fatty Acids and Related Waxes | Eicosanoic acid | -60% to -80% |
| 212347 | Acids - Hydroxy | Amino Acids and Related Compounds | Shikimic acid | -60% to -94% |
| 212347 | Acids - Hydroxy Alpha | Acid Pathway | Butanoic acid, 2,3,4-trihydroxy- | -60% to -89% |
| 212347 | Acids - Hydroxy Alpha | Carbohydrates | Quinic acid | -60% to -88% |
| 212347 | Amino Acids and Related Compounds | Amino Acids and Related Compounds | Proline, 5-oxo- | 60% to 95% |
| 212347 | Carbohydrates | Carbohydrates | F3-U0.813 Carbohydrate | 335% to 559% |
| 212347 | Carbohydrates | Carbohydrates | F3-U0.816 Carbohydrate | 206% to 343% |
| 212347 | Carbohydrates | Carbohydrates | F3-U0.821 Carbohydrate | 147% to 245% |
| 212347 | Carbohydrates | Carbohydrates | F3-U0.846 Carbohydrate | 76% to 127% |
| 212347 | Carbohydrates | Carbohydrates | F3-U1.120 Carbohydrate | 136% to 226% |
| 212347 | Carbohydrates | Carbohydrates | F3-U1.143 Carbohydrate | 60% to 88% |
| 212347 | Carbohydrates | Carbohydrates | Galactose or Mannose | 88% to 146% |
| 212347 | NA | NA | F3-U0.852A | 282% to 470% |
| 212347 | NA | NA | F3-U0.882 | 140% to 233% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212356

| Seq ID | Chemical Class | Biochemical Class | Compound Name | Modification |
|---|---|---|---|---|
| 212356 | Amino Acids and Related Compounds | Amino Acids and Related Compounds | Alanine | 140% to 335% |
| 212356 | Amino Acids and Related Compounds | Amino Acids and Related Compounds | Aspartic acid | -25% to -45% |
| 212356 | Amino Acids and Related Compounds | Amino Acids and Related Compounds | Glycine | 25% to 370% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212412

| Seq ID | Chemical Class | Biochemical Class | Compound Name | Modification |
|---|---|---|---|---|
| 212412 | Carbohydrates | Carbohydrates | F3-U1.143 Carbohydrate | 95% to 158% |
| 212412 | Carbohydrates | Carbohydrates | Galactose or Mannose | 99% to 165% |
| 212412 | NA | NA | F3-U0.843 | 121% to 202% |
| 212412 | NA | NA | F3-U0.882 | 164% to 274% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212444

| Seq ID | Chemical Class | Biochemical Class | Compound Name | Modification |
|---|---|---|---|---|
| 212444 | Acids - Hydroxy Alpha | Carbohydrates | Quinic acid | 60% to 79% |
| 212444 | Carbohydrates | Carbohydrates | F3-U0.813 Carbohydrate | 473% to 789% |
| 212444 | Carbohydrates | Carbohydrates | F3-U0.821 Carbohydrate | 74% to 124% |
| 212444 | Carbohydrates | Carbohydrates | F3-U0.825 Carbohydrate | 297% to 495% |
| 212444 | Carbohydrates | Carbohydrates | F3-U0.846 Carbohydrate | 205% to 342% |
| 212444 | Carbohydrates | Carbohydrates | F3-U0.848 Carbohydrate | 60% to 85% |
| 212444 | Carbohydrates | Carbohydrates | F3-U0.872 Hexose | 159% to 266% |
| 212444 | Carbohydrates | Carbohydrates | Fructose | 91% to 152% |
| 212444 | Carbohydrates | Carbohydrates | Glucose | 65% to 178% |
| 212444 | NA | NA | F3-U0.852A | New |
| 212444 | Phenols and Related Compounds | Phenylpropanes and Derivatives | Chlorogenic acid | -60% to -81% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212454

| Seq ID | Chemical Class | Biochemical Class | Compound Name | Modification |
|---|---|---|---|---|
| 212454 | Acids - Fatty | Fatty Acids and Related Waxes | Octadecanoic acid | 19% to 33% |
| 212454 | Acids - Fatty Unsat | Fatty Acids and Related Waxes | 9,12,15-Octadecatrienoic acid | -3% to -11% |
| 212454 | Acids - Fatty Unsat | Fatty Acids and Related Waxes | 9,12-Octadecadienoic acid | 17% to 35% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212475

| Seq ID | Chemical Class | Biochemical Class | Compound Name | Modification |
|---|---|---|---|---|
| 212475 | Amino Acids and Related Compounds | Amino Acids and Related Compounds | Alanine | 35% to 190% |
| 212475 | Amino Acids and Related Compounds | Amino Acids and Related Compounds | Aspartic acid | -55% to -70% |
| 212475 | Amino Acids and Related Compounds | Amino Acids and Related Compounds | Cysteine | 20% to 780% |
| 212475 | Amino Acids and Related Compounds | Amino Acids and Related Compounds | Glutamic acid | 25% to 70% |
| 212475 | Amino Acids and Related Compounds | Amino Acids and Related Compounds | Glycine | 20% to 640% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212492

| Seq ID | Chemical Class | Biochemical Class | Compound Name | Modification |
|---|---|---|---|---|
| 212492 | Acids - Fatty | Fatty Acids and Related Waxes | Eicosanoic acid | 21% to 139% |
| 212492 | Acids - Fatty | Fatty Acids and Related Waxes | Hexadecanoic acid | 3% to 17% |
| 212492 | Acids - Fatty | Fatty Acids and Related Waxes | Octadecanoic acid | 37% to 63% |
| 212492 | Acids - Fatty Branched | Fatty Acids and Related Waxes | Heptadecanoic acid, 16-methyl- | 23% to 127% |
| 212492 | Acids - Fatty Branched | Fatty Acids and Related Waxes | Hexadecanoic acid, 14-methyl- | -21% to -75% |
| 212492 | Acids - Fatty Unsat | Fatty Acids and Related Waxes | 9,12-Octadecadienoic acid | -7% to -27% |
| 212492 | Acids - Fatty Unsat | Fatty Acids and Related Waxes | 9-Hexadecenoic acid | -25% to -45% |
| 212492 | Amino Acids and Related Compounds | Amino Acids and Related Compounds | Arginine | 70% to 475% |
| 212492 | Amino Acids and Related Compounds | Amino Acids and Related Compounds | Leucine | 15% to 415% |
| 212492 | Amino Acids and Related Compounds | Amino Acids and Related Compounds | Lysine | 95% to 395% |
| 212492 | Amino Acids and Related Compounds | Amino Acids and Related Compounds | Methionine | New |
| 212492 | Amino Acids and Related Compounds | Amino Acids and Related Compounds | Phenylalanine | 15% to 1230% |
| 212492 | Amino Acids and Related Compounds | Amino Acids and Related Compounds | Threonine | 50% to 200% |
| 212492 | Amino Acids and Related Compounds | Amino Acids and Related Compounds | Tyrosine | 155% to 1600% |
| 212492 | Amino Acids and Related Compounds | Amino Acids and Related Compounds | Valine | 35% to 425% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212584

| Seq ID | Chemical Class | Biochemical Class | Compound Name | Modification |
|---|---|---|---|---|
| 212584 | Acids - Hydroxy | Amino Acids and Related Compounds | Shikimic acid | 75% to 125% |
| 212584 | Acids - Hydroxy Alpha | Acid Pathway | Butanoic acid, 2,3,4-trihydroxy- | 93% to 155% |
| 212584 | Acids - Hydroxy Alpha | Acid Pathway | Citric acid | 198% to 329% |
| 212584 | Acids - Hydroxy Alpha | Carbohydrates | Quinic acid | 60% to 117% |
| 212584 | Amino Acids and Related Compounds | Amino Acids and Related Compounds | Proline, 5-oxo- | 73% to 122% |
| 212584 | Carbohydrates | Carbohydrates | F3-U0.813 Carbohydrate | 177% to 295% |
| 212584 | Carbohydrates | Carbohydrates | F3-U0.819 Carbohydrate | 308% to 513% |
| 212584 | Carbohydrates | Carbohydrates | F3-U0.821 Carbohydrate | 71% to 119% |
| 212584 | Carbohydrates | Carbohydrates | F3-U0.846 Carbohydrate | 136% to 381% |
| 212584 | Carbohydrates | Carbohydrates | F3-U0.872 Hexose | 109% to 257% |
| 212584 | Carbohydrates | Carbohydrates | F3-U0.952 Carbohydrate | NQ |
| 212584 | Carbohydrates | Carbohydrates | F3-U1.189 Carbohydrate | 60% to 92% |
| 212584 | Carbohydrates | Carbohydrates | Fructose | -60% to -99% |
| 212584 | Carbohydrates | Carbohydrates | Glucose | -60% to -76% |
| 212584 | NA | NA | F3-U0.852A | New |
| 212584 | Phenols and Related Compounds | Phenylpropanes and Derivatives | Chlorogenic acid | 60% to 138% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212616

| Seq ID | Chemical Class | Biochemical Class | Compound Name | Modification |
|---|---|---|---|---|
| 212616 | Acids - Hydroxy Alpha | Acid Pathway | Malic acid | 106% to 176% |
| 212616 | Acids - Hydroxy Alpha | Carbohydrates | Quinic acid | 60% to 78% |
| 212616 | Amino Acids and Related Compounds | Amino Acids and Related Compounds | Asparagine | 160% to 266% |
| 212616 | Amino Acids and Related Compounds | Amino Acids and Related Compounds | Glutamic acid | 137% to 229% |
| 212616 | Amino Acids and Related Compounds | Amino Acids and Related Compounds | Glutamine | New |
| 212616 | Amino Acids and Related Compounds | Amino Acids and Related Compounds | Lysine | New |
| 212616 | Amino Acids and Related Compounds | Amino Acids and Related Compounds | Proline, 5-oxo- | 74% to 182% |
| 212616 | Carbohydrates | Carbohydrates | F3-U0.813 Carbohydrate | 293% to 488% |
| 212616 | Carbohydrates | Carbohydrates | F3-U0.816 Carbohydrate | 60% to 79% |
| 212616 | Carbohydrates | Carbohydrates | F3-U0.825 Carbohydrate | 173% to 288% |
| 212616 | Carbohydrates | Carbohydrates | F3-U0.846 Carbohydrate | 60% to 217% |
| 212616 | Carbohydrates | Carbohydrates | F3-U0.872 Hexose | 203% to 338% |
| 212616 | Carbohydrates | Carbohydrates | F3-U1.104 Carbohydrate | 101% to 169% |
| 212616 | Carbohydrates | Carbohydrates | F3-U1.120 Carbohydrate | 134% to 223% |
| 212616 | Carbohydrates | Carbohydrates | F3-U1.143 Carbohydrate | 87% to 145% |
| 212616 | Carbohydrates | Carbohydrates | F3-U1.189 Carbohydrate | 84% to 140% |
| 212616 | Carbohydrates | Carbohydrates | Fructose | 311% to 726% |
| 212616 | Carbohydrates | Carbohydrates | Galactose or Mannose | 84% to 1000% |
| 212616 | Carbohydrates | Carbohydrates | Glucose | 236% to 979% |
| 212616 | NA | NA | F3-U0.852A | 213% to 356% |
| 212616 | NA | NA | F3-U0.882 | 83% to 138% |
| 212616 | NA | NA | F3-U1.092 | 131% to 219% |
| 212616 | NA | NA | F3-U1.253 | 62% to 104% |
| 212616 | Phenols and Related Compounds | Phenylpropanes and Derivatives | Chlorogenic acid | 60% to 100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212623

| Seq ID | Chemical Class | Biochemical Class | Compound Name | Modification |
|--------|---------------|-------------------|---------------|--------------|
| 212623 | NA | NA | F3-U0.882 | 102% to 169% |
| 212623 | Acids - Hydroxy | Amino Acids and Related Compounds | Shikimic acid | -60% to -76% |
| 212623 | Carbohydrates | Carbohydrates | Galactose or Mannose | 61% to 101% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212646

| Seq ID | Chemical Class | Biochemical Class | Compound Name | Modification |
|---|---|---|---|---|
| 212646 | Acids - Hydroxy Alpha | Carbohydrates | Quinic acid | 89% to 148% |
| 212646 | Alkenes and Alkynes | Terpenoids | Limonene | 120% to 200% |
| 212646 | Amino Acids and Related Compounds | Amino Acids and Related Compounds | Asparagine | New |
| 212646 | Amino Acids and Related Compounds | Amino Acids and Related Compounds | Glutamic acid | 119% to 198% |
| 212646 | Amino Acids and Related Compounds | Amino Acids and Related Compounds | Glutamine | New |
| 212646 | Amino Acids and Related Compounds | Amino Acids and Related Compounds | Lysine | New |
| 212646 | Amino Acids and Related Compounds | Amino Acids and Related Compounds | Proline, 5-oxo- | 162% to 269% |
| 212646 | Carbohydrates | Carbohydrates | F3-U0.848 Carbohydrate | 155% to 258% |
| 212646 | Carbohydrates | Carbohydrates | F3-U0.872 Hexose | 103% to 172% |
| 212646 | Carbohydrates | Carbohydrates | F3-U0.952 Carbohydrate | 473% to 788% |
| 212646 | Carbohydrates | Carbohydrates | F3-U1.104 Carbohydrate | New |
| 212646 | Carbohydrates | Carbohydrates | F3-U1.189 Carbohydrate | 481% to 801% |
| 212646 | Carbohydrates | Carbohydrates | F3-U1.194 Carbohydrate | 209% to 349% |
| 212646 | Carbohydrates | Carbohydrates | Fructose | 323% to 702% |
| 212646 | Carbohydrates | Carbohydrates | Galactose or Mannose | New |
| 212646 | Carbohydrates | Carbohydrates | Glucose | 234% to 977% |
| 212646 | Esters | Esters | F1-U1.065 Fatty Acid Ester | 165% to 274% |
| 212646 | Esters | Esters | F1-U1.078 Fatty Acid Ester | 185% to 308% |
| 212646 | Esters | Esters | F1-U1.119 Fatty Acid Ester | 123% to 205% |
| 212646 | Esters - Hydroxy | Acyl acetylglycerols | 2-Eicosanoyl-1-acetylglycerol | 177% to 296% |
| 212646 | NA | NA | F3-U0.799 | New |
| 212646 | NA | NA | F3-U0.882 | 200% to 334% |
| 212646 | NA | NA | F3-U1.253 | 280% to 467% |
| 212646 | NA | NA | F3-U1.255 | 60% to 84% |
| 212646 | Phenols and Related Compounds | Phenylpropanes and Derivatives | Chlorogenic acid | 266% to 443% |
| 212646 | Sterols, Oxygenated Terpenes, and Other Isoprenoids | Prenylquinones | alpha-Tocopherol | 165% to 275% |
| 212646 | Sterols, Oxygenated Terpenes, and Other Isoprenoids | Prenylquinones | alpha-Tocopherol hydroquinone | New |
| 212646 | Sterols, Oxygenated Terpenes, and Other Isoprenoids | Terpenoids | beta-Sitosterol | 66% to 109% |
| 212646 | Sterols, Oxygenated Terpenes, and Other Isoprenoids | Terpenoids | Cholesterol | 60% to 90% |
| 212646 | Sterols, Oxygenated Terpenes, and Other Isoprenoids | Terpenoids | F1-U1.130 Sterol | New |
| 212646 | Sterols, Oxygenated Terpenes, and Other Isoprenoids | Terpenoids | Stigmasta-5,22-dien-3-ol, acetate | 79% to 131% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212661

| Seq ID | Chemical Class | Biochemical Class | Compound Name | Modification |
|---|---|---|---|---|
| 212661 | Acids - Hydroxy Alpha | Carbohydrates | Quinic acid | 149% to 248% |
| 212661 | Amino Acids and Related Compounds | Amino Acids and Related Compounds | Asparagine | New |
| 212661 | Amino Acids and Related Compounds | Amino Acids and Related Compounds | Glutamic acid | New |
| 212661 | Amino Acids and Related Compounds | Amino Acids and Related Compounds | Lysine | New |
| 212661 | Amino Acids and Related Compounds | Amino Acids and Related Compounds | Proline, 5-oxo- | 215% to 359% |
| 212661 | Carbohydrates | Carbohydrates | F3-U0.825 Carbohydrate | 122% to 203% |
| 212661 | Carbohydrates | Carbohydrates | F3-U0.846 Carbohydrate | 83% to 138% |
| 212661 | Carbohydrates | Carbohydrates | F3-U0.848 Carbohydrate | 225% to 375% |
| 212661 | Carbohydrates | Carbohydrates | F3-U0.872 Hexose | 168% to 280% |
| 212661 | Carbohydrates | Carbohydrates | F3-U0.952 Carbohydrate | 398% to 663% |
| 212661 | Carbohydrates | Carbohydrates | F3-U1.189 Carbohydrate | 295% to 492% |
| 212661 | Carbohydrates | Carbohydrates | F3-U1.194 Carbohydrate | 134% to 224% |
| 212661 | Carbohydrates | Carbohydrates | Fructose | 331% to 769% |
| 212661 | Carbohydrates | Carbohydrates | Galactose or Mannose | New |
| 212661 | Carbohydrates | Carbohydrates | Glucose | 262% to 1231% |
| 212661 | NA | NA | F3-U0.799 | New |
| 212661 | NA | NA | F3-U0.882 | 107% to 178% |
| 212661 | NA | NA | F3-U1.253 | 161% to 269% |
| 212661 | Phenols and Related Compounds | Phenylpropanes and Derivatives | Chlorogenic acid | 166% to 276% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212682

| Seq ID | Chemical Class | Biochemical Class | Compound Name | Modification |
|---|---|---|---|---|
| 212682 | Acids - Hydroxy Alpha | Acid Pathway | Butanoic acid, 2,3,4-trihydroxy- | -60% to -99% |
| 212682 | Acids - Hydroxy Alpha | Acid Pathway | Malic acid | -60% to -75% |
| 212682 | Amino Acids and Related Compounds | Amino Acids and Related Compounds | Arginine | 375% to 900% |
| 212682 | Amino Acids and Related Compounds | Amino Acids and Related Compounds | Asparagine | 285% to 475% |
| 212682 | Amino Acids and Related Compounds | Amino Acids and Related Compounds | Glutamine | New |
| 212682 | Amino Acids and Related Compounds | Amino Acids and Related Compounds | Histidine | 110% to 390% |
| 212682 | Amino Acids and Related Compounds | Amino Acids and Related Compounds | Isoleucine | New |
| 212682 | Amino Acids and Related Compounds | Amino Acids and Related Compounds | Proline, 5-oxo- | 63% to 105% |
| 212682 | Amino Acids and Related Compounds | Amino Acids and Related Compounds | Tryptophan | New |
| 212682 | Carbohydrates | Carbohydrates | F3-U0.813 Carbohydrate | 227% to 379% |
| 212682 | Carbohydrates | Carbohydrates | F3-U0.816 Carbohydrate | 120% to 200% |
| 212682 | Carbohydrates | Carbohydrates | F3-U0.846 Carbohydrate | 98% to 164% |
| 212682 | Carbohydrates | Carbohydrates | F3-U0.872 Hexose | 60% to 89% |
| 212682 | Carbohydrates | Carbohydrates | F3-U1.104 Carbohydrate | 60% to 91% |
| 212682 | Carbohydrates | Carbohydrates | F3-U1.143 Carbohydrate | 99% to 165% |
| 212682 | Carbohydrates | Carbohydrates | Galactose or Mannose | 76% to 127% |
| 212682 | NA | NA | F3-U0.852A | 94% to 156% |
| 212682 | NA | NA | F3-U0.882 | 207% to 346% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212714

| Seq ID | Chemical Class | Biochemical Class | Compound Name | Modification |
|---|---|---|---|---|
| 212714 | Amino Acids and Related Compounds | Amino Acids and Related Compounds | Alanine | 85% to 750% |
| 212714 | Amino Acids and Related Compounds | Amino Acids and Related Compounds | Arginine | 180% to 850% |
| 212714 | Amino Acids and Related Compounds | Amino Acids and Related Compounds | Aspartic acid | -20% to -85% |
| 212714 | Amino Acids and Related Compounds | Amino Acids and Related Compounds | Serine | 85% to 315% |
| 212714 | Amino Acids and Related Compounds | Amino Acids and Related Compounds | Threonine | 60% to 185% |
| 212714 | Amino Acids and Related Compounds | Amino Acids and Related Compounds | Valine | 125% to 585% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212719

| Seq ID | Chemical Class | Biochemical Class | Compound Name | Modification |
|---|---|---|---|---|
| 212719 | Amino Acids and Related Compounds | Amino Acids and Related Compounds | Alanine | 85% to 335% |
| 212719 | Amino Acids and Related Compounds | Amino Acids and Related Compounds | Aspartic acid | -5% to -45% |
| 212719 | Amino Acids and Related Compounds | Amino Acids and Related Compounds | Glutamic acid | 20% to 160% |
| 212719 | Amino Acids and Related Compounds | Amino Acids and Related Compounds | Histidine | -20% to -65% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212738

| Seq ID | Chemical Class | Biochemical Class | Compound Name | Modification |
|---|---|---|---|---|
| 212738 | Acids - Hydroxy Alpha | Acid Pathway | Citric acid | 68% to 113% |
| 212738 | Carbohydrates | Carbohydrates | F3-U0.813 Carbohydrate | 186% to 310% |
| 212738 | Carbohydrates | Carbohydrates | F3-U0.816 Carbohydrate | 91% to 151% |
| 212738 | Carbohydrates | Carbohydrates | F3-U0.821 Carbohydrate | 68% to 113% |
| 212738 | Carbohydrates | Carbohydrates | Galactose or Mannose | 60% to 80% |
| 212738 | NA | NA | F3-U0.843 | 610% to 1017% |
| 212738 | NA | NA | F3-U0.852A | 168% to 281% |
| 212738 | NA | NA | F3-U0.882 | 60% to 84% |
| 212738 | Sterols, Oxygenated Terpenes, and Other Isoprenoids | Prenylquinones | alpha-Tocopherol | 76% to 127% |
| 212738 | Sterols, Oxygenated Terpenes, and Other Isoprenoids | Terpenoids | beta-Sitosterol | 83% to 138% |
| 212738 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212744

| Seq ID | Chemical Class | Biochemical Class | Compound Name | Modification |
|---|---|---|---|---|
| 212744 | Acids - Fatty | Fatty Acids and Related Waxes | Eicosanoic acid | 5% to 310% |
| 212744 | Acids - Fatty | Fatty Acids and Related Waxes | Octadecanoic acid | 23% to 81% |
| 212744 | Acids - Fatty Unsat | Fatty Acids and Related Waxes | 7,10,13-Hexadecatrienoic acid | 19% to 51% |
| 212744 | Acids - Fatty Unsat | Fatty Acids and Related Waxes | 9,12,15-Octadecatrienoic acid | 2% to 7% |
| 212744 | Acids - Fatty Unsat | Fatty Acids and Related Waxes | 9,12-Octadecadienoic acid | -11% to -39% |
| 212744 | Acids - Fatty Unsat | Fatty Acids and Related Waxes | 9-Hexadecenoic acid | -41% to -59% |
| 212744 | Acids - Fatty Unsat | Fatty Acids and Related Waxes | 9-Octadecenoic acid | -39% to -61% |
| 212744 | Amino Acids and Related Compounds | Amino Acids and Related Compounds | Arginine | 75% to 500% |
| 212744 | Amino Acids and Related Compounds | Amino Acids and Related Compounds | Aspartic acid | -55% to -70% |
| 212744 | Amino Acids and Related Compounds | Amino Acids and Related Compounds | Cysteine | 30% to 850% |
| 212744 | Amino Acids and Related Compounds | Amino Acids and Related Compounds | Glycine | 35% to 730% |
| 212744 | Amino Acids and Related Compounds | Amino Acids and Related Compounds | Lysine | -40% to -80% |
| 212744 | Amino Acids and Related Compounds | Amino Acids and Related Compounds | Threonine | 70% to 205% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212755

| Seq ID | Chemical Class | Biochemical Class | Compound Name | Modification |
|---|---|---|---|---|
| 212755 | Acids - Hydroxy Alpha | Acid Pathway | Butanoic acid, 2,3,4-trihydroxy- | 152% to 253% |
| 212755 | Acids - Hydroxy Alpha | Acid Pathway | Citric acid | 60% to 76% |
| 212755 | Acids - Hydroxy Alpha | Carbohydrates | Glyceric acid | New |
| 212755 | Acids - Hydroxy Alpha | Carbohydrates | Quinic acid | 193% to 321% |
| 212755 | Amino Acids and Related Compounds | Amino Acids and Related Compounds | Glutamic acid | 214% to 357% |
| 212755 | Amino Acids and Related Compounds | Amino Acids and Related Compounds | Proline, 5-oxo- | 92% to 154% |
| 212755 | Carbohydrates | Carbohydrates | F3-U0.813 Carbohydrate | 175% to 292% |
| 212755 | Carbohydrates | Carbohydrates | F3-U0.821 Carbohydrate | 60% to 76% |
| 212755 | Carbohydrates | Carbohydrates | F3-U0.825 Carbohydrate | 156% to 259% |
| 212755 | Carbohydrates | Carbohydrates | F3-U0.846 Carbohydrate | 134% to 223% |
| 212755 | Carbohydrates | Carbohydrates | F3-U0.848 Carbohydrate | 244% to 406% |
| 212755 | Carbohydrates | Carbohydrates | F3-U0.872 Hexose | 210% to 350% |
| 212755 | Carbohydrates | Carbohydrates | F3-U0.952 Carbohydrate | 154% to 256% |
| 212755 | Carbohydrates | Carbohydrates | F3-U1.150 Carbohydrate | 60% to 95% |
| 212755 | Carbohydrates | Carbohydrates | Fructose | 347% to 772% |
| 212755 | Carbohydrates | Carbohydrates | Galactose or Mannose | 319% to 531% |
| 212755 | Carbohydrates | Carbohydrates | Glucose | 253% to 1155% |
| 212755 | NA | NA | F3-U0.852A | 60% to 98% |
| 212755 | NA | NA | F3-U0.882 | 118% to 196% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212756

| Seq ID | Chemical Class | Biochemical Class | Compound Name | Modification |
|---|---|---|---|---|
| 212756 | Acids - Hydroxy Alpha | Acid Pathway | Butanoic acid, 2,3,4-trihydroxy- | -60% to -83% |
| 212756 | Acids - Hydroxy Alpha | Acid Pathway | Citric acid | 195% to 324% |
| 212756 | Acids - Hydroxy Alpha | Carbohydrates | F3-U0.992 Sugar acid | 156% to 260% |
| 212756 | Amino Acids and Related Compounds | Amino Acids and Related Compounds | Arginine | 210% to 550% |
| 212756 | Amino Acids and Related Compounds | Amino Acids and Related Compounds | Asparagine | 955% to 1591% |
| 212756 | Amino Acids and Related Compounds | Amino Acids and Related Compounds | Glutamine | New |
| 212756 | Amino Acids and Related Compounds | Amino Acids and Related Compounds | Histidine | 135% to 440% |
| 212756 | Amino Acids and Related Compounds | Amino Acids and Related Compounds | Isoleucine | New |
| 212756 | Amino Acids and Related Compounds | Amino Acids and Related Compounds | Leucine | New |
| 212756 | Amino Acids and Related Compounds | Amino Acids and Related Compounds | Lysine | 65% to 480% |
| 212756 | Amino Acids and Related Compounds | Amino Acids and Related Compounds | Proline, 5-oxo- | 78% to 130% |
| 212756 | Amino Acids and Related Compounds | Amino Acids and Related Compounds | Tryptophan | New |
| 212756 | Amino Acids and Related Compounds | Amino Acids and Related Compounds | Tyrosine | New |
| 212756 | Amino Acids and Related Compounds | Amino Acids and Related Compounds | Valine | 120% to 515% |
| 212756 | Carbohydrates | Carbohydrates | Arabinose or Xylose | New |
| 212756 | Carbohydrates | Carbohydrates | F3-U0.813 Carbohydrate | 549% to 915% |
| 212756 | Carbohydrates | Carbohydrates | F3-U0.816 Carbohydrate | 231% to 385% |
| 212756 | Carbohydrates | Carbohydrates | F3-U0.821 Carbohydrate | 195% to 324% |
| 212756 | Carbohydrates | Carbohydrates | F3-U0.825 Carbohydrate | New |
| 212756 | Carbohydrates | Carbohydrates | F3-U0.846 Carbohydrate | 112% to 186% |
| 212756 | Carbohydrates | Carbohydrates | F3-U1.037 Carbohydrate | 119% to 198% |
| 212756 | Carbohydrates | Carbohydrates | F3-U1.104 Carbohydrate | 102% to 170% |
| 212756 | Carbohydrates | Carbohydrates | F3-U1.119 Carbohydrate | 102% to 170% |
| 212756 | Carbohydrates | Carbohydrates | F3-U1.143 Carbohydrate | 79% to 131% |
| 212756 | Carbohydrates | Carbohydrates | Galactose or Mannose | 98% to 164% |
| 212756 | NA | NA | F3-U0.782 | New |
| 212756 | NA | NA | F3-U0.836 | New |
| 212756 | NA | NA | F3-U0.852A | 208% to 346% |
| 212756 | NA | NA | F3-U0.882 | 60% to 93% |
| 212756 | NA | NA | F3-U1.092 | 145% to 242% |
| 212756 | NA | NA | F3-U1.228 | 84% to 140% |
| 212756 | NA | NA | F3-U1.253 | 62% to 103% |
| 212756 | NA | NA | F3-U1.255 | 93% to 155% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212767

| Seq ID | Chemical Class | Biochemical Class | Compound Name | Modification |
|---|---|---|---|---|
| 212767 | Acids - Fatty Branched | Fatty Acids and Related Waxes | Heptadecanoic acid, 16-methyl- | -55% to -70% |
| 212767 | Acids - Fatty Unsat | Fatty Acids and Related Waxes | 9,12-Octadecadienoic acid | 13% to 37% |
| 212767 | Acids - Fatty Unsat | Fatty Acids and Related Waxes | 9-Octadecenoic acid | -81% to -89% |
| 212767 | Amino Acids and Related Compounds | Amino Acids and Related Compounds | Arginine | 195% to 520% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212775

| Seq ID | Chemical Class | Biochemical Class | Compound Name | Modification |
|---|---|---|---|---|
| 212775 | Acids - Hydroxy Alpha | Carbohydrates | Quinic acid | 84% to 139% |
| 212775 | Amino Acids and Related Compounds | Amino Acids and Related Compounds | Glutamic acid | 108% to 181% |
| 212775 | Carbohydrates | Carbohydrates | F3-U0.846 Carbohydrate | 110% to 183% |
| 212775 | Carbohydrates | Carbohydrates | F3-U0.848 Carbohydrate | 86% to 143% |
| 212775 | Carbohydrates | Carbohydrates | F3-U0.872 Hexose | New |
| 212775 | Carbohydrates | Carbohydrates | F3-U0.952 Carbohydrate | 266% to 444% |
| 212775 | Carbohydrates | Carbohydrates | F3-U0.956 Carbohydrate | 227% to 378% |
| 212775 | Carbohydrates | Carbohydrates | F3-U1.189 Carbohydrate | 223% to 371% |
| 212775 | Carbohydrates | Carbohydrates | F3-U1.194 Carbohydrate | 135% to 225% |
| 212775 | Carbohydrates | Carbohydrates | Fructose | 359% to 815% |
| 212775 | Carbohydrates | Carbohydrates | Galactose or Mannose | 191% to 318% |
| 212775 | Carbohydrates | Carbohydrates | Glucose | 60% to 978% |
| 212775 | Phenols and Related Compounds | Phenylpropanes and Derivatives | Chlorogenic acid | 144% to 240% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212777

| Seq ID | Chemical Class | Biochemical Class | Compound Name | Modification |
|---|---|---|---|---|
| 212777 | Amino Acids and Related Compounds | Amino Acids and Related Compounds | Arginine | 25% to 555% |
| 212777 | Amino Acids and Related Compounds | Amino Acids and Related Compounds | Glutamic acid | 20% to 100% |
| 212777 | Amino Acids and Related Compounds | Amino Acids and Related Compounds | Histidine | 10% to 315% |
| 212777 | Amino Acids and Related Compounds | Amino Acids and Related Compounds | Isoleucine | 150% to 230% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212785

| Seq ID | Chemical Class | Biochemical Class | Compound Name | Modification |
|--------|----------------|-------------------|---------------|--------------|
| 212785 | Amino Acids and Related Compounds | Amino Acids and Related Compounds | Alanine | 35% to 110% |
| 212785 | Amino Acids and Related Compounds | Amino Acids and Related Compounds | Aspartic acid | -75% to -80% |
| 212785 | Amino Acids and Related Compounds | Amino Acids and Related Compounds | Glycine | 5% to 285% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212792

| Seq ID | Chemical Class | Biochemical Class | Compound Name | Modification |
|---|---|---|---|---|
| 212792 | Acids - Hydroxy Alpha | Acid Pathway | Butanoic acid, 2,3,4-trihydroxy- | 76% to 126% |
| 212792 | Acids - Hydroxy Alpha | Carbohydrates | Quinic acid | 95% to 159% |
| 212792 | Amino Acids and Related Compounds | Amino Acids and Related Compounds | Asparagine | New |
| 212792 | Amino Acids and Related Compounds | Amino Acids and Related Compounds | Aspartic acid | 62% to 104% |
| 212792 | Amino Acids and Related Compounds | Amino Acids and Related Compounds | Glutamic acid | New. |
| 212792 | Amino Acids and Related Compounds | Amino Acids and Related Compounds | Proline, 5-oxo- | 160% to 267% |
| 212792 | Carbohydrates | Carbohydrates | F3-U0.825 Carbohydrate | 64% to 106% |
| 212792 | Carbohydrates | Carbohydrates | F3-U0.848 Carbohydrate | 141% to 235% |
| 212792 | Carbohydrates | Carbohydrates | F3-U0.872 Hexose | 115% to 192% |
| 212792 | Carbohydrates | Carbohydrates | F3-U0.952 Carbohydrate | 233% to 388% |
| 212792 | Carbohydrates | Carbohydrates | F3-U1.150 Carbohydrate | 60% to 86% |
| 212792 | Carbohydrates | Carbohydrates | F3-U1.189 Carbohydrate | 151% to 252% |
| 212792 | Carbohydrates | Carbohydrates | Fructose | 297% to 657% |
| 212792 | Carbohydrates | Carbohydrates | Galactose or Mannose | New |
| 212792 | Carbohydrates | Carbohydrates | Glucose | 233% to 899% |
| 212792 | NA | NA | F3-U0.882 | 101% to 168% |
| 212792 | NA | NA | F3-U1.253 | 100% to 166% |
| 212792 | Phenols and Related Compounds | Phenylpropanes and Derivatives | Chlorogenic acid | 86% to 144% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212794

| Seq ID | Chemical Class | Biochemical Class | Compound Name | Modification |
|---|---|---|---|---|
| 212794 | Acids - Hydroxy Alpha | Acid Pathway | Citric acid | 60% to 85% |
| 212794 | Amino Acids and Related Compounds | Amino Acids and Related Compounds | Glycine | New |
| 212794 | Carbohydrates | Carbohydrates | F3-U0.813 Carbohydrate | 252% to 420% |
| 212794 | Carbohydrates | Carbohydrates | F3-U0.821 Carbohydrate | 60% to 95% |
| 212794 | Carbohydrates | Carbohydrates | F3-U0.825 Carbohydrate | 163% to 271% |
| 212794 | Carbohydrates | Carbohydrates | F3-U0.846 Carbohydrate | 72% to 120% |
| 212794 | Carbohydrates | Carbohydrates | F3-U1.189 Carbohydrate | -60% to -75% |
| 212794 | NA | NA | F3-U0.634 | 60% to 90% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212808

| Seq ID | Chemical Class | Biochemical Class | Compound Name | Modification |
|---|---|---|---|---|
| 212808 | Acids - Fatty | Fatty Acids and Related Waxes | Eicosanoic acid | 67% to 205% |
| 212808 | Acids - Fatty | Fatty Acids and Related Waxes | Octadecanoic acid | 9% to 57% |
| 212808 | Acids - Fatty Branched | Fatty Acids and Related Waxes | Heptadecanoic acid, 16-methyl- | -97% to -99% |
| 212808 | Amino Acids and Related Compounds | Amino Acids and Related Compounds | Arginine | 60% to 235% |
| 212808 | Amino Acids and Related Compounds | Amino Acids and Related Compounds | Isoleucine | New |
| 212808 | Amino Acids and Related Compounds | Amino Acids and Related Compounds | Leucine | New |
| 212808 | Amino Acids and Related Compounds | Amino Acids and Related Compounds | Tryptophan | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212824

| Seq ID | Chemical Class | Biochemical Class | Compound Name | Modification |
|---|---|---|---|---|
| 212824 | Acids - Hydroxy Alpha | Acid Pathway | Butanoic acid, 2,3,4-trihydroxy- | 74% to 123% |
| 212824 | Acids - Hydroxy Alpha | Acid Pathway | Citric acid | 110% to 184% |
| 212824 | Acids - Hydroxy Alpha | Acid Pathway | Malic acid | 214% to 357% |
| 212824 | Acids - Hydroxy Alpha | Carbohydrates | Quinic acid | 189% to 315% |
| 212824 | Amino Acids and Related Compounds | Amino Acids and Related Compounds | Arginine | 60% to 470% |
| 212824 | Amino Acids and Related Compounds | Amino Acids and Related Compounds | Glutamic acid | 72% to 535% |
| 212824 | Amino Acids and Related Compounds | Amino Acids and Related Compounds | Proline, 5-oxo- | 94% to 156% |
| 212824 | Carbohydrates | Carbohydrates | F3-U0.813 Carbohydrate | 177% to 294% |
| 212824 | Carbohydrates | Carbohydrates | F3-U0.821 Carbohydrate | 87% to 145% |
| 212824 | Carbohydrates | Carbohydrates | F3-U0.825 Carbohydrate | 386% to 644% |
| 212824 | Carbohydrates | Carbohydrates | F3-U0.846 Carbohydrate | 246% to 410% |
| 212824 | Carbohydrates | Carbohydrates | F3-U0.848 Carbohydrate | 15000% to 25000% |
| 212824 | Carbohydrates | Carbohydrates | F3-U0.872 Hexose | 321% to 534% |
| 212824 | Carbohydrates | Carbohydrates | F3-U1.150 Carbohydrate | 60% to 98% |
| 212824 | Carbohydrates | Carbohydrates | F3-U1.189 Carbohydrate | 120% to 200% |
| 212824 | Carbohydrates | Carbohydrates | F3-U1.194 Carbohydrate | 94% to 156% |
| 212824 | Carbohydrates | Carbohydrates | Fructose | 217% to 499% |
| 212824 | Carbohydrates | Carbohydrates | Galactose or Mannose | 137% to 229% |
| 212824 | Carbohydrates | Carbohydrates | Glucose | 249% to 1056% |
| 212824 | NA | NA | F3-U0.852A | 294% to 491% |
| 212824 | NA | NA | F3-U0.882 | 74% to 123% |
| 212824 | Phenols and Related Compounds | Phenylpropanes and Derivatives | Chlorogenic acid | 132% to 221% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#212830

| Seq ID | Chemical Class | Biochemical Class | Compound Name | Modification |
|---|---|---|---|---|
| 212830 | Acids - Fatty | Fatty Acids and Related Waxes | Eicosanoic acid | -41% to -65% |
| 212830 | Acids - Fatty | Fatty Acids and Related Waxes | Octadecanoic acid | 8% to 29% |
| 212830 | Acids - Fatty Branched | Fatty Acids and Related Waxes | Heptadecanoic acid, 16-methyl- | -91% to -95% |
| 212830 | Acids - Fatty Branched | Fatty Acids and Related Waxes | Hexadecanoic acid, 14-methyl- | 23% to 85% |
| 212830 | Acids - Fatty Unsat | Fatty Acids and Related Waxes | 7,10,13-Hexadecatrienoic acid | 33% to 55% |
| 212830 | Acids - Fatty Unsat | Fatty Acids and Related Waxes | 9,12,15-Octadecatrienoic acid | -3% to -7% |
| 212830 | Acids - Fatty Unsat | Fatty Acids and Related Waxes | 9,12-Octadecadienoic acid | 5% to 23% |
| 212830 | Acids - Fatty Unsat | Fatty Acids and Related Waxes | 9-Octadecenoic acid | 9% to 75% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212833

| Seq ID | Chemical Class | Biochemical Class | Compound Name | Modification |
|---|---|---|---|---|
| 212833 | Acids - Hydroxy Alpha | Acid Pathway | Citric acid | 146% to 243% |
| 212833 | Amino Acids and Related Compounds | Amino Acids and Related Compounds | Proline, 5-oxo- | 94% to 156% |
| 212833 | Carbohydrates | Carbohydrates | F3-U0.813 Carbohydrate | 928% to 1547% |
| 212833 | Carbohydrates | Carbohydrates | F3-U0.816 Carbohydrate | 231% to 385% |
| 212833 | Carbohydrates | Carbohydrates | F3-U0.821 Carbohydrate | 146% to 243% |
| 212833 | Carbohydrates | Carbohydrates | F3-U0.825 Carbohydrate | New |
| 212833 | Carbohydrates | Carbohydrates | F3-U0.846 Carbohydrate | 127% to 211% |
| 212833 | NA | NA | F3-U0.852A | 444% to 740% |
| 212833 | NA | NA | F3-U0.882 | 70% to 117% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212858

| Seq ID | Chemical Class | Biochemical Class | Compound Name | Modification |
|---|---|---|---|---|
| 212858 | Acids - Hydroxy Alpha | Acid Pathway | Butanoic acid, 2,3,4-trihydroxy- | NQ |
| 212858 | Amino Acids and Related Compounds | Amino Acids and Related Compounds | Proline, 5-oxo- | 70% to 117% |
| 212858 | Carbohydrates | Carbohydrates | F3-U0.813 Carbohydrate | 629% to 1049% |
| 212858 | Carbohydrates | Carbohydrates | F3-U0.816 Carbohydrate | 175% to 291% |
| 212858 | Carbohydrates | Carbohydrates | F3-U0.821 Carbohydrate | 148% to 246% |
| 212858 | Carbohydrates | Carbohydrates | F3-U0.825 Carbohydrate | New |
| 212858 | Carbohydrates | Carbohydrates | F3-U0.846 Carbohydrate | 107% to 179% |
| 212858 | Carbohydrates | Carbohydrates | F3-U1.143 Carbohydrate | 60% to 77% |
| 212858 | Carbohydrates | Carbohydrates | F3-U1.189 Carbohydrate | -60% to -94% |
| 212858 | NA | NA | F3-U0.852A | 459% to 765% |
| 212858 | NA | NA | F3-U0.882 | 62% to 103% |
| 212858 | Phenols and Related Compounds | Phenylpropanes and Derivatives | Chlorogenic acid | -60% to -77% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#212877

| Seq ID | Chemical Class | Biochemical Class | Compound Name | Modification |
|---|---|---|---|---|
| 212877 | Amino Acids and Related Compounds | Amino Acids and Related Compounds | Histidine | 90% to 255% |
| 212877 | Amino Acids and Related Compounds | Amino Acids and Related Compounds | Isoleucine | New |
| 212877 | Amino Acids and Related Compounds | Amino Acids and Related Compounds | Leucine | New |
| 212877 | Amino Acids and Related Compounds | Amino Acids and Related Compounds | Methionine | 70% to 130% |
| 212877 | Amino Acids and Related Compounds | Amino Acids and Related Compounds | Tryptophan | New |
| 212877 | Amino Acids and Related Compounds | Amino Acids and Related Compounds | Valine | 45% to 200% |

FIG. 6 continued

| Seq ID | Chemical Class | Biochemical Class | Compound Name | Modification |
|---|---|---|---|---|
| | | A list of metabolite compounds present in altered levels relative to reference samples as chararacterized by gas chromatography, liquid chromatography, and/or mass spectrometry. This list corresponds to samples transfected with nucleic acid sequence, Seq ID#212892 | | |
| 212892 | Acids - Hydroxy | Amino Acids and Related Compounds | Shikimic acid | 60% to 84% |
| 212892 | Acids - Hydroxy Alpha | Acid Pathway | Citric acid | 140% to 233% |
| 212892 | Acids - Hydroxy Alpha | Carbohydrates | F3-U0.992 Sugar acid | New |
| 212892 | Acids - Hydroxy Alpha | Acid Pathway | Malic acid | 212% to 354% |
| 212892 | Acids - Hydroxy Alpha | Carbohydrates | Quinic acid | 255% to 425% |
| 212892 | Alcohols | Carbohydrates | Inositol | 60% to 80% |
| 212892 | Amino Acids and Related Compounds | Amino Acids and Related Compounds | Proline, 5-oxo- | 60% to 94% |
| 212892 | Carbohydrates | Carbohydrates | F3-U0.781 Carbohydrate | New |
| 212892 | Carbohydrates | Carbohydrates | F3-U0.813 Carbohydrate | 115% to 192% |
| 212892 | Carbohydrates | Carbohydrates | F3-U0.816 Carbohydrate | 60% to 84% |
| 212892 | Carbohydrates | Carbohydrates | F3-U0.821 Carbohydrate | 140% to 233% |
| 212892 | Carbohydrates | Carbohydrates | F3-U0.825 Carbohydrate | 301% to 501% |
| 212892 | Carbohydrates | Carbohydrates | F3-U0.846 Carbohydrate | 177% to 295% |
| 212892 | Carbohydrates | Carbohydrates | F3-U0.872 Hexose | 143% to 238% |
| 212892 | Carbohydrates | Carbohydrates | F3-U1.037B Carbohydrate | New |
| 212892 | Carbohydrates | Carbohydrates | F3-U1.150 Carbohydrate | 92% to 154% |
| 212892 | Carbohydrates | Carbohydrates | F3-U1.189 Carbohydrate | 110% to 183% |
| 212892 | Carbohydrates | Carbohydrates | F3-U1.194 Carbohydrate | 69% to 115% |
| 212892 | Carbohydrates | Carbohydrates | F3-U1.196 Carbohydrate | New |
| 212892 | Carbohydrates | Carbohydrates | Fructose | 518% to 1262% |
| 212892 | Carbohydrates | Carbohydrates | Galactose or Mannose | New |
| 212892 | Carbohydrates | Carbohydrates | Glucose | 700% to 1344% |
| 212892 | NA | NA | F1-U1.119 | 212% to 354% |
| 212892 | NA | NA | F3-U0.779 | New |
| 212892 | NA | NA | F3-U0.852A | 87% to 144% |
| 212892 | NA | NA | F3-U0.882 | New |
| 212892 | NA | NA | F3-U1.229 | 114% to 189% |
| 212892 | NA | NA | F3-U1.253 | 71% to 118% |
| 212892 | NA | NA | F3-U1.255 | 69% to 115% |
| 212892 | Sterols, Oxygenated Terpenes, and Other Isoprenoids | Prenylquinones | alpha-Tocopherol hydroquinone | New |
| 212892 | Sterols, Oxygenated Terpenes, and Other Isoprenoids | Terpenoids | beta-Sitosterol | 62% to 104% |
| 212892 | Sterols, Oxygenated Terpenes, and Other Isoprenoids | Terpenoids | Campesterol | 60% to 88% |
| 212892 | Sterols, Oxygenated Terpenes, and Other Isoprenoids | Terpenoids | Cholesterol | 60% to 76% |
| 212892 | Sterols, Oxygenated Terpenes, and Other Isoprenoids | Prenylquinones | gamma-Tocopherol | New |
| 212892 | Sterols, Oxygenated Terpenes, and Other Isoprenoids | Terpenoids | Stigmasterol | 76% to 127% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212902

| Seq ID | Chemical Class | Biochemical Class | Compound Name | Modification |
|---|---|---|---|---|
| 212902 | Amino Acids and Related Compounds | Amino Acids and Related Compounds | Isoleucine | 170% to 590% |
| 212902 | Amino Acids and Related Compounds | Amino Acids and Related Compounds | Methionine | 110% to 375% |
| 212902 | Amino Acids and Related Compounds | Amino Acids and Related Compounds | Phenylalanine | 205% to 815% |
| 212902 | Amino Acids and Related Compounds | Amino Acids and Related Compounds | Valine | 100% to 370% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212943

| Seq ID | Chemical Class | Biochemical Class | Compound Name | Modification |
|---|---|---|---|---|
| 212943 | Acids | Acids | Carbamic acid | 60% to 96% |
| 212943 | Acids - Hydroxy Alpha | Carbohydrates | Quinic acid | 172% to 287% |
| 212943 | Carbohydrates | Carbohydrates | F3-U1.189 Carbohydrate | -60% to -83% |
| 212943 | Carbohydrates | Carbohydrates | F3-U1.194 Carbohydrate | NQ |
| 212943 | Carbohydrates | Carbohydrates | Glucose | 60% to 82% |
| 212943 | NA | NA | F3-U0.602 | New |
| 212943 | NA | NA | F3-U0.678 | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#212987

| Seq ID | Chemical Class | Biochemical Class | Compound Name | Modification |
|---|---|---|---|---|
| 212987 | Acids - Hydroxy | Amino Acids and Related Compounds | Shikimic acid | 113% to 188% |
| 212987 | Acids - Hydroxy Alpha | Acid Pathway | Citric acid | 70% to 117% |
| 212987 | Acids - Hydroxy Alpha | Acid Pathway | Malic acid | 87% to 145% |
| 212987 | Carbohydrates | Carbohydrates | F3-U0.813 Carbohydrate | New |
| 212987 | Carbohydrates | Carbohydrates | F3-U0.816 Carbohydrate | 113% to 188% |
| 212987 | Carbohydrates | Carbohydrates | F3-U0.846 Carbohydrate | 255% to 426% |
| 212987 | Carbohydrates | Carbohydrates | F3-U0.872 Hexose | 151% to 252% |
| 212987 | NA | NA | F3-U0.852A | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212995

| Seq ID | Chemical Class | Biochemical Class | Compound Name | Modification |
|---|---|---|---|---|
| 212995 | Amino Acids and Related Compounds | Amino Acids and Related Compounds | Arginine | 165% to 580% |
| 212995 | Amino Acids and Related Compounds | Amino Acids and Related Compounds | Tryptophan | New |
| 212995 | Amino Acids and Related Compounds | Amino Acids and Related Compounds | Tyrosine | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#212996

| Seq ID | Chemical Class | Biochemical Class | Compound Name | Modification |
|--------|----------------|-------------------|---------------|--------------|
| 212996 | Acids | Acids | Carbamic acid | 62% to 104% |
| 212996 | Acids - Hydroxy | Amino Acids and Related Compounds | Shikimic acid | 96% to 160% |
| 212996 | Acids - Hydroxy Alpha | Acid Pathway | Citric acid | 60% to 87% |
| 212996 | Acids - Hydroxy Alpha | Acid Pathway | Malic acid | 67% to 111% |
| 212996 | Acids - Hydroxy Alpha | Carbohydrates | Quinic acid | 64% to 107% |
| 212996 | Carbohydrates | Carbohydrates | F3-U0.816 Carbohydrate | 96% to 160% |
| 212996 | Carbohydrates | Carbohydrates | F3-U0.821 Carbohydrate | 60% to 87% |
| 212996 | Carbohydrates | Carbohydrates | F3-U0.846 Carbohydrate | 121% to 202% |
| 212996 | Carbohydrates | Carbohydrates | F3-U0.872 Hexose | 60% to 96% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213005

| Seq ID | Chemical Class | Biochemical Class | Compound Name | Modification |
|---|---|---|---|---|
| 213005 | Acids - Fatty | Fatty Acids and Related Waxes | Octadecanoic acid | 5% to 19% |
| 213005 | Amino Acids and Related Compounds | Amino Acids and Related Compounds | Arginine | 35% to 365% |
| 213005 | Amino Acids and Related Compounds | Amino Acids and Related Compounds | Isoleucine | 95% to 390% |
| 213005 | Amino Acids and Related Compounds | Amino Acids and Related Compounds | Lysine | 5% to 490% |
| 213005 | Amino Acids and Related Compounds | Amino Acids and Related Compounds | Valine | 20% to 185% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213037

| Seq ID | Chemical Class | Biochemical Class | Compound Name | Modification |
|---|---|---|---|---|
| 213037 | Acids - Fatty | Fatty Acids and Related Waxes | Eicosanoic acid | 60% to 211% |
| 213037 | Acids - Fatty | Fatty Acids and Related Waxes | Octadecanoic acid | 60% to 97% |
| 213037 | Acids - Hydroxy Alpha | Acid Pathway | Citric acid | 60% to 90% |
| 213037 | Acids - Hydroxy Alpha | Acid Pathway | Malic acid | 60% to 91% |
| 213037 | Carbohydrates | Carbohydrates | F3-U0.821 Carbohydrate | 60% to 90% |
| 213037 | Carbohydrates | Carbohydrates | F3-U0.825 Carbohydrate | 73% to 121% |
| 213037 | Carbohydrates | Carbohydrates | F3-U0.846 Carbohydrate | 137% to 228% |
| 213037 | Carbohydrates | Carbohydrates | F3-U0.872 Hexose | 118% to 197% |
| 213037 | NA | NA | F3-U0.852A | 66% to 109% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213048

| Seq ID | Chemical Class | Biochemical Class | Compound Name | Modification |
|---|---|---|---|---|
| 213048 | Amino Acids and Related Compounds | Amino Acids and Related Compounds | Alanine | 40% to 335% |
| 213048 | Amino Acids and Related Compounds | Amino Acids and Related Compounds | Arginine | 35% to 1250% |
| 213048 | Amino Acids and Related Compounds | Amino Acids and Related Compounds | Aspartic acid | 20% to 80% |
| 213048 | Amino Acids and Related Compounds | Amino Acids and Related Compounds | Glutamic acid | 40% to 165% |
| 213048 | Amino Acids and Related Compounds | Amino Acids and Related Compounds | Serine | 15% to 180% |
| 213048 | Amino Acids and Related Compounds | Amino Acids and Related Compounds | Threonine | 5% to 135% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213052

| Seq ID | Chemical Class | Biochemical Class | Compound Name | Modification |
|---|---|---|---|---|
| 213052 | Amino Acids and Related Compounds | Amino Acids and Related Compounds | Arginine | 75% to 500% |
| 213052 | Amino Acids and Related Compounds | Amino Acids and Related Compounds | Aspartic acid | 15% to 110% |
| 213052 | Amino Acids and Related Compounds | Amino Acids and Related Compounds | Isoleucine | 90% to 300% |
| 213052 | Amino Acids and Related Compounds | Amino Acids and Related Compounds | Leucine | 140% to 280% |
| 213052 | Amino Acids and Related Compounds | Amino Acids and Related Compounds | Phenylalanine | 10% to 100% |
| 213052 | Amino Acids and Related Compounds | Amino Acids and Related Compounds | Threonine | 10% to 125% |
| 213052 | Amino Acids and Related Compounds | Amino Acids and Related Compounds | Valine | 60% to 200% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213063

| Seq ID | Chemical Class | Biochemical Class | Compound Name | Modification |
|---|---|---|---|---|
| 213063 | Acids - Hydroxy | Amino Acids and Related Compounds | Shikimic acid | 102% to 169% |
| 213063 | Amino Acids and Related Compounds | Amino Acids and Related Compounds | Proline | 201% to 334% |
| 213063 | Carbohydrates | Carbohydrates | F3-U0.813 Carbohydrate | 100% to 166% |
| 213063 | Carbohydrates | Carbohydrates | F3-U0.816 Carbohydrate | 102% to 169% |
| 213063 | Carbohydrates | Carbohydrates | F3-U0.821 Carbohydrate | 116% to 193% |
| 213063 | Carbohydrates | Carbohydrates | F3-U0.825 Carbohydrate | 120% to 200% |
| 213063 | Carbohydrates | Carbohydrates | F3-U0.846 Carbohydrate | 205% to 342% |
| 213063 | Carbohydrates | Carbohydrates | F3-U0.872 Hexose | 165% to 275% |
| 213063 | Carbohydrates | Carbohydrates | Fructose | 166% to 293% |
| 213063 | Carbohydrates | Carbohydrates | Glucose | 133% to 240% |
| 213063 | NA | NA | F3-U0.751 | New |
| 213063 | NA | NA | F3-U0.843 | 265% to 441% |
| 213063 | NA | NA | F3-U0.852A | 212% to 353% |
| 213063 | NA | NA | F3-U0.882 | 102% to 170% |
| 213063 | NA | NA | F3-U1.228 | 67% to 111% |
| 213063 | NA | NA | F3-U1.253 | 60% to 97% |
| 213063 | NA | NA | F3-U1.255 | 69% to 114% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213084

| Seq ID | Chemical Class | Biochemical Class | Compound Name | Modification |
|---|---|---|---|---|
| 213084 | Acids | Acids | Carbamic acid | 121% to 201% |
| 213084 | Acids - Hydroxy | Amino Acids and Related Compounds | Shikimic acid | 60% to 80% |
| 213084 | Acids - Hydroxy Alpha | Acid Pathway | Citric acid | 60% to 78% |
| 213084 | Acids - Hydroxy Alpha | Acid Pathway | Malic acid | 60% to 90% |
| 213084 | Carbohydrates | Carbohydrates | F3-U0.816 Carbohydrate | 60% to 80% |
| 213084 | Carbohydrates | Carbohydrates | F3-U0.821 Carbohydrate | 60% to 78% |
| 213084 | Carbohydrates | Carbohydrates | F3-U0.825 Carbohydrate | 114% to 190% |
| 213084 | Carbohydrates | Carbohydrates | F3-U0.846 Carbohydrate | 108% to 180% |
| 213084 | Carbohydrates | Carbohydrates | F3-U0.872 Hexose | 76% to 127% |
| 213084 | NA | NA | F3-U0.727 | 130% to 217% |
| 213084 | NA | NA | F3-U0.843 | 340% to 566% |
| 213084 | NA | NA | F3-U0.852A | 80% to 133% |
| 213084 | NA | NA | F3-U1.253 | 84% to 139% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213112

| Seq ID | Chemical Class | Biochemical Class | Compound Name | Modification |
|---|---|---|---|---|
| 213112 | Amino Acids and Related Compounds | Amino Acids and Related Compounds | Arginine | 120% to 585% |
| 213112 | Amino Acids and Related Compounds | Amino Acids and Related Compounds | Histidine | 42% to 165% |
| 213112 | Amino Acids and Related Compounds | Amino Acids and Related Compounds | Proline | 35% to 225% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213119

| Seq ID | Chemical Class | Biochemical Class | Compound Name | Modification |
|---|---|---|---|---|
| 213119 | Amino Acids and Related Compounds | Amino Acids and Related Compounds | Arginine | 5% to 330% |
| 213119 | Amino Acids and Related Compounds | Amino Acids and Related Compounds | Cysteine | 130% to 275% |
| 213119 | Amino Acids and Related Compounds | Amino Acids and Related Compounds | Glycine | 35% to 175% |
| 213119 | Amino Acids and Related Compounds | Amino Acids and Related Compounds | Isoleucine | 550% to 750% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213122

| Seq ID | Chemical Class | Biochemical Class | Compound Name | Modification |
|---|---|---|---|---|
| 213122 | Acids - Hydroxy Alpha | Acid Pathway | Citric acid | 67% to 112% |
| 213122 | Acids - Hydroxy Alpha | Acid Pathway | Malic acid | 170% to 284% |
| 213122 | Acids - Hydroxy Alpha | Carbohydrates | Quinic acid | 137% to 229% |
| 213122 | Amino Acids and Related Compounds | Amino Acids and Related Compounds | Proline, 5-oxo- | 62% to 104% |
| 213122 | Carbohydrates | Carbohydrates | F3-U0.813 Carbohydrate | 70% to 117% |
| 213122 | Carbohydrates | Carbohydrates | F3-U0.821 Carbohydrate | 67% to 112% |
| 213122 | Carbohydrates | Carbohydrates | F3-U0.825 Carbohydrate | 63% to 104% |
| 213122 | Carbohydrates | Carbohydrates | F3-U0.846 Carbohydrate | 182% to 303% |
| 213122 | Carbohydrates | Carbohydrates | F3-U0.872 Hexose | 173% to 288% |
| 213122 | Carbohydrates | Carbohydrates | Fructose | 113% to 220% |
| 213122 | Carbohydrates | Carbohydrates | Glucose | 305% to 718% |
| 213122 | NA | NA | F3-U0.852A | 141% to 235% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213123

| Seq ID | Chemical Class | Biochemical Class | Compound Name | Modification |
|---|---|---|---|---|
| 213123 | Acids - Fatty | Fatty Acids and Related Waxes | Octadecanoic acid | 60% to 115% |
| 213123 | Acids - Fatty Branched | Fatty Acids and Related Waxes | Heptadecanoic acid, 16-methyl- | 60% to 90% |
| 213123 | Acids - Fatty Unsat | Fatty Acids and Related Waxes | 6-Octadecenoic acid | 75% to 126% |
| 213123 | Acids - Fatty Unsat | Fatty Acids and Related Waxes | 7,10,13-Docosatrienoic acid | 60% to 84% |
| 213123 | Acids - Fatty Unsat | Fatty Acids and Related Waxes | 7,10-Hexadecadienoic acid | 121% to 202% |
| 213123 | Acids - Fatty Unsat | Fatty Acids and Related Waxes | 9-Hexadecenoic acid | 66% to 110% |
| 213123 | Esters | Esters | F1-U1.119 Fatty Acid Ester | 109% to 182% |
| 213123 | Sterols, Oxygenated Terpenes, and Other Isoprenoids | Prenylquinones | alpha-Tocopherol | 69% to 114% |
| 213123 | Sterols, Oxygenated Terpenes, and Other Isoprenoids | Prenylquinones | alpha-Tocopherol hydroquinone | 70% to 116% |
| 213123 | Sterols, Oxygenated Terpenes, and Other Isoprenoids | Prenylquinones | beta-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213124

| Seq ID | Chemical Class | Biochemical Class | Compound Name | Modification |
|---|---|---|---|---|
| 213124 | Acids - Hydroxy Alpha | Acid Pathway | Citric acid | 202% to 337% |
| 213124 | Acids - Hydroxy Alpha | Acid Pathway | Malic acid | 161% to 268% |
| 213124 | Acids - Hydroxy Alpha | Carbohydrates | Quinic acid | 227% to 378% |
| 213124 | Alcohols | Carbohydrates | Inositol | 60% to 79% |
| 213124 | Amino Acids and Related Compounds | Amino Acids and Related Compounds | Arginine | 60% to 980% |
| 213124 | Amino Acids and Related Compounds | Amino Acids and Related Compounds | Proline | 60% to 215% |
| 213124 | Amino Acids and Related Compounds | Amino Acids and Related Compounds | Proline, 5-oxo- | 87% to 145% |
| 213124 | Carbohydrates | Carbohydrates | F3-U0.821 Carbohydrate | 202% to 337% |
| 213124 | Carbohydrates | Carbohydrates | F3-U0.846 Carbohydrate | 377% to 628% |
| 213124 | Carbohydrates | Carbohydrates | F3-U0.872 Hexose | 133% to 222% |
| 213124 | Carbohydrates | Carbohydrates | F3-U1.189 Carbohydrate | 119% to 199% |
| 213124 | Carbohydrates | Carbohydrates | Fructose | -60% to -75% |
| 213124 | NA | NA | F3-U0.852A | New |
| 213124 | Phenols and Related Compounds | Phenylpropanes and Derivatives | Chlorogenic acid | 90% to 150% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213128

| Seq ID | Chemical Class | Biochemical Class | Compound Name | Modification |
|---|---|---|---|---|
| 213128 | Amino Acids and Related Compounds | Amino Acids and Related Compounds | Arginine | 365% to 1090% |
| 213128 | Amino Acids and Related Compounds | Amino Acids and Related Compounds | Histidine | 115% to 795% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213133

| Seq ID | Chemical Class | Biochemical Class | Compound Name | Modification |
|---|---|---|---|---|
| 213133 | Acids | Acids | Carbamic acid | 60% to 90% |
| 213133 | Acids - Hydroxy | Amino Acids and Related Compounds | Shikimic acid | 248% to 414% |
| 213133 | Acids - Hydroxy Alpha | Acid Pathway | Citric acid | 192% to 320% |
| 213133 | Acids - Hydroxy Alpha | Acid Pathway | Malic acid | 200% to 333% |
| 213133 | Acids - Hydroxy Alpha | Carbohydrates | Quinic acid | 133% to 222% |
| 213133 | Amino Acids and Related Compounds | Amino Acids and Related Compounds | Proline, 5-oxo- | 138% to 231% |
| 213133 | Carbohydrates | Carbohydrates | F3-U0.816 Carbohydrate | 248% to 414% |
| 213133 | Carbohydrates | Carbohydrates | F3-U0.846 Carbohydrate | 338% to 564% |
| 213133 | Carbohydrates | Carbohydrates | F3-U0.848B Carbohydrate | 261% to 434% |
| 213133 | Carbohydrates | Carbohydrates | F3-U0.872 Hexose | 143% to 238% |
| 213133 | Carbohydrates | Carbohydrates | F3-U1.069 Carbohydrate | 146% to 243% |
| 213133 | NA | NA | F3-U0.852A | New |

FIG. 6 continued

A list of metabolite compounds present in altered levels relative to reference samples as charracterized by gas chromatography, liquid chromatography, and/or mass spectrometry. This list corresponds to samples transfected with nucleic acid sequence, Seq ID#213137

| Seq ID | Chemical Class | Biochemical Class | Compound Name | Modification |
|---|---|---|---|---|
| 213137 | Acids - Hydroxy | Amino Acids and Related Compounds | Shikimic acid | 81% to 135% |
| 213137 | Acids - Hydroxy Alpha | Acid Pathway | Citric acid | 223% to 371% |
| 213137 | Acids - Hydroxy Alpha | Acid Pathway | Malic acid | 94% to 157% |
| 213137 | Acids - Hydroxy Alpha | Carbohydrates | Quinic acid | 232% to 386% |
| 213137 | Amino Acids and Related Compounds | Amino Acids and Related Compounds | Arginine | 255% to 815% |
| 213137 | Amino Acids and Related Compounds | Amino Acids and Related Compounds | Glycine | 35% to 395% |
| 213137 | Amino Acids and Related Compounds | Amino Acids and Related Compounds | Proline, 5-oxo- | 145% to 242% |
| 213137 | Carbohydrates | Carbohydrates | F3-U0.816 Carbohydrate | 81% to 135% |
| 213137 | Carbohydrates | Carbohydrates | F3-U0.846 Carbohydrate | 155% to 258% |
| 213137 | Carbohydrates | Carbohydrates | F3-U0.872 Hexose | 60% to 85% |
| 213137 | Carbohydrates | Carbohydrates | F3-U1.143 Carbohydrate | 105% to 175% |
| 213137 | Carbohydrates | Carbohydrates | F3-U1.189 Carbohydrate | 93% to 155% |
| 213137 | Carbohydrates | Carbohydrates | F3-U1.194 Carbohydrate | 79% to 132% |
| 213137 | Phenols and Related Compounds | Phenylpropanes and Derivatives | Chlorogenic acid | 78% to 130% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#213138

| Seq ID | Chemical Class | Biochemical Class | Compound Name | Modification |
|---|---|---|---|---|
| 213138 | Acids - Fatty | Fatty Acids and Related Waxes | Octadecanoic acid | -11% to -31% |
| 213138 | Acids - Fatty Unsat | Fatty Acids and Related Waxes | 9,12-Octadecadienoic acid | -3% to -21% |
| 213138 | Acids - Fatty Unsat | Fatty Acids and Related Waxes | 9-Hexadecenoic acid | -9% to -25% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213144

| Seq ID | Chemical Class | Biochemical Class | Compound Name | Modification |
|---|---|---|---|---|
| 213144 | Acids - Hydroxy Alpha | Acid Pathway | Citric acid | 248% to 413% |
| 213144 | Acids - Hydroxy Alpha | Acid Pathway | Malic acid | 114% to 190% |
| 213144 | Acids - Hydroxy Alpha | Carbohydrates | Quinic acid | 212% to 353% |
| 213144 | Carbohydrates | Carbohydrates | F3-U0.813 Carbohydrate | New |
| 213144 | Carbohydrates | Carbohydrates | F3-U0.816 Carbohydrate | 202% to 336% |
| 213144 | Carbohydrates | Carbohydrates | F3-U0.821 Carbohydrate | 248% to 413% |
| 213144 | Carbohydrates | Carbohydrates | F3-U0.825 Carbohydrate | New |
| 213144 | Carbohydrates | Carbohydrates | F3-U0.846 Carbohydrate | 473% to 789% |
| 213144 | Carbohydrates | Carbohydrates | F3-U0.848B Carbohydrate | 79% to 131% |
| 213144 | Carbohydrates | Carbohydrates | F3-U0.872 Hexose | 174% to 290% |
| 213144 | NA | NA | F3-U0.852A | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213149

| Seq ID | Chemical Class | Biochemical Class | Compound Name | Modification |
|---|---|---|---|---|
| 213149 | Acids - Fatty Unsat | Fatty Acids and Related Waxes | 9,12,15-Octadecatrienoic acid | 130% to 216% |
| 213149 | Acids - Hydroxy | Amino Acids and Related Compounds | Shikimic acid | 60% to 89% |
| 213149 | Acids - Hydroxy Alpha | Acid Pathway | Malic acid | 90% to 184% |
| 213149 | Acids - Hydroxy Alpha | Carbohydrates | Quinic acid | 94% to 157% |
| 213149 | Amino Acids and Related Compounds | Amino Acids and Related Compounds | Proline | 77% to 129% |
| 213149 | Amino Acids and Related Compounds | Amino Acids and Related Compounds | Proline, 5-oxo- | 89% to 148% |
| 213149 | Carbohydrates | Carbohydrates | F3-U0.813 Carbohydrate | 61% to 203% |
| 213149 | Carbohydrates | Carbohydrates | F3-U0.816 Carbohydrate | 60% to 186% |
| 213149 | Carbohydrates | Carbohydrates | F3-U0.821 Carbohydrate | 77% to 301% |
| 213149 | Carbohydrates | Carbohydrates | F3-U0.825 Carbohydrate | 66% to 129% |
| 213149 | Carbohydrates | Carbohydrates | F3-U0.846 Carbohydrate | 84% to 412% |
| 213149 | Carbohydrates | Carbohydrates | F3-U0.872 Hexose | 79% to 326% |
| 213149 | Carbohydrates | Carbohydrates | F3-U1.194 Carbohydrate | 60% to 99% |
| 213149 | Carbohydrates | Carbohydrates | Fructose | 60% to 135% |
| 213149 | Carbohydrates | Carbohydrates | Glucose | 75% to 251% |
| 213149 | NA | NA | F3-U0.843 | 175% to 292% |
| 213149 | NA | NA | F3-U0.852A | 105% to 583% |
| 213149 | NA | NA | F3-U1.232 | 60% to 99% |
| 213149 | NA | NA | F3-U1.253 | 60% to 78% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213177

| Seq ID | Chemical Class | Biochemical Class | Compound Name | Modification |
|---|---|---|---|---|
| 213177 | Carbohydrates | Carbohydrates | F3-U0.813 Carbohydrate | 202% to 337% |
| 213177 | Carbohydrates | Carbohydrates | F3-U0.816 Carbohydrate | 118% to 196% |
| 213177 | Carbohydrates | Carbohydrates | F3-U0.821 Carbohydrate | 105% to 175% |
| 213177 | Carbohydrates | Carbohydrates | F3-U0.825 Carbohydrate | 248% to 414% |
| 213177 | Carbohydrates | Carbohydrates | F3-U0.846 Carbohydrate | 174% to 290% |
| 213177 | Carbohydrates | Carbohydrates | F3-U0.872 Hexose | 147% to 245% |
| 213177 | Carbohydrates | Carbohydrates | F3-U1.189 Carbohydrate | -60% to -94% |
| 213177 | Carbohydrates | Carbohydrates | F3-U1.194 Carbohydrate | -60% to -83% |
| 213177 | Carbohydrates | Carbohydrates | Fructose | 60% to 91% |
| 213177 | Carbohydrates | Carbohydrates | Glucose | 60% to 131% |
| 213177 | NA | NA | F3-U0.852A | 110% to 184% |
| 213177 | Phenols and Related Compounds | Phenylpropanes and Derivatives | Chlorogenic acid | -60% to -89% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213179

| Seq ID | Chemical Class | Biochemical Class | Compound Name | Modification |
|---|---|---|---|---|
| 213179 | Acids | Acids | Carbamic acid | 60% to 94% |
| 213179 | Acids - Hydroxy Alpha | Acid Pathway | Citric acid | 60% to 99% |
| 213179 | Amino Acids and Related Compounds | Amino Acids and Related Compounds | Glycine | New |
| 213179 | Carbohydrates | Carbohydrates | F3-U0.821 Carbohydrate | 60% to 99% |
| 213179 | Carbohydrates | Carbohydrates | F3-U1.189 Carbohydrate | -60% to -95% |
| 213179 | Carbohydrates | Carbohydrates | F3-U1.194 Carbohydrate | -60% to -83% |
| 213179 | Carbohydrates | Carbohydrates | Fructose | -63% to -100% |
| 213179 | Carbohydrates | Carbohydrates | Glucose | -65% to -100% |
| 213179 | NA | NA | F3-U0.882 | NQ |
| 213179 | NA | NA | F3-U1.229 | 167% to 279% |
| 213179 | Phenols and Related Compounds | Phenylpropanes and Derivatives | Chlorogenic acid | -60% to -95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213206

| Seq ID | Chemical Class | Biochemical Class | Compound Name | Modification |
|---|---|---|---|---|
| 213206 | Acids - Fatty | Fatty Acids and Related Waxes | Docosanoic acid | 60% to 85% |
| 213206 | Acids - Fatty | Fatty Acids and Related Waxes | Octadecanoic acid | 60% to 75% |
| 213206 | Acids - Fatty Branched | Fatty Acids and Related Waxes | Heptadecanoic acid, 16-methyl- | 60% to 85% |
| 213206 | Acids - Fatty Branched | Fatty Acids and Related Waxes | Isoeicosanoic acid | 60% to 90% |
| 213206 | Acids - Fatty Unsat | Fatty Acids and Related Waxes | 9-Octadecenoic acid | 60% to 155% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213208

| Seq ID | Chemical Class | Biochemical Class | Compound Name | Modification |
|---|---|---|---|---|
| 213208 | Acids - Fatty Unsat | Fatty Acids and Related Waxes | 9,12,15-Octadecatrienoic acid | -3% to -5% |
| 213208 | Acids - Fatty Unsat | Fatty Acids and Related Waxes | 9,12-Octadecadienoic acid | 7% to 31% |
| 213208 | Acids - Fatty Unsat | Fatty Acids and Related Waxes | 9-Octadecenoic acid | 21% to 83% |
| 213208 | Amino Acids and Related Compounds | Amino Acids and Related Compounds | Histidine | 70% to 330% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213226

| Seq ID | Chemical Class | Biochemical Class | Compound Name | Modification |
|---|---|---|---|---|
| 213226 | Amino Acids and Related Compounds | Amino Acids and Related Compounds | Aspartic acid | -50% to -70% |
| 213226 | Amino Acids and Related Compounds | Amino Acids and Related Compounds | Isoleucine | 25% to 270% |
| 213226 | Amino Acids and Related Compounds | Amino Acids and Related Compounds | Leucine | 20% to 150% |
| 213226 | Amino Acids and Related Compounds | Amino Acids and Related Compounds | Phenylalanine | 25% to 115% |
| 213226 | Amino Acids and Related Compounds | Amino Acids and Related Compounds | Serine | -50% to -75% |
| 213226 | Amino Acids and Related Compounds | Amino Acids and Related Compounds | Valine | 10% to 140% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213237

| Seq ID | Chemical Class | Biochemical Class | Compound Name | Modification |
|---|---|---|---|---|
| 213237 | Amino Acids and Related Compounds | Amino Acids and Related Compounds | Tryptophan | New |
| 213237 | Amino Acids and Related Compounds | Amino Acids and Related Compounds | Tyrosine | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213242

| Seq ID | Chemical Class | Biochemical Class | Compound Name | Modification |
|---|---|---|---|---|
| 213242 | Carbohydrates | Carbohydrates | Fructose | 60% to 94% |
| 213242 | Carbohydrates | Carbohydrates | Galactose or Mannose | 60% to 84% |
| 213242 | Carbohydrates | Carbohydrates | Glucose | 60% to 181% |
| 213242 | NA | NA | F3-U0.882 | 60% to 84% |
| 213242 | NA | NA | F3-U1.253 | 60% to 89% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213243

| Seq ID | Chemical Class | Biochemical Class | Compound Name | Modification |
|---|---|---|---|---|
| 213243 | Amino Acids and Related Compounds | Amino Acids and Related Compounds | Cysteine | 40% to 220% |
| 213243 | Amino Acids and Related Compounds | Amino Acids and Related Compounds | Glycine | 45% to 315% |
| 213243 | Amino Acids and Related Compounds | Amino Acids and Related Compounds | Isoleucine | 30% to 175% |
| 213243 | Amino Acids and Related Compounds | Amino Acids and Related Compounds | Leucine | 105% to 225% |
| 213243 | Amino Acids and Related Compounds | Amino Acids and Related Compounds | Phenylalanine | 25% to 80% |
| 213243 | Amino Acids and Related Compounds | Amino Acids and Related Compounds | Valine | 60% to 195% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213246

| Seq ID | Chemical Class | Biochemical Class | Compound Name | Modification |
|---|---|---|---|---|
| 213246 | Alkaloids and Other Bases | Polyamines | 1,4-Butanediamine | 182% to 303% |
| 213246 | Amino Acids and Related Compounds | Amino Acids and Related Compounds | Aspartic acid | 85% to 142% |
| 213246 | Amino Acids and Related Compounds | Amino Acids and Related Compounds | Glutamic acid | 60% to 89% |
| 213246 | Amino Acids and Related Compounds | Amino Acids and Related Compounds | Proline, 5-oxo- | 76% to 126% |
| 213246 | Carbohydrates | Carbohydrates | F3-U0.813 Carbohydrate | 228% to 380% |
| 213246 | Carbohydrates | Carbohydrates | F3-U0.816 Carbohydrate | 81% to 135% |
| 213246 | Carbohydrates | Carbohydrates | F3-U0.825 Carbohydrate | 94% to 156% |
| 213246 | Carbohydrates | Carbohydrates | F3-U0.846 Carbohydrate | 158% to 263% |
| 213246 | Carbohydrates | Carbohydrates | F3-U0.872 Hexose | 124% to 207% |
| 213246 | Carbohydrates | Carbohydrates | F3-U1.189 Carbohydrate | -60% to -94% |
| 213246 | Carbohydrates | Carbohydrates | Fructose | 90% to 196% |
| 213246 | Carbohydrates | Carbohydrates | Galactose or Mannose | 60% to 83% |
| 213246 | Carbohydrates | Carbohydrates | Glucose | 103% to 346% |
| 213246 | NA | NA | F3-U0.727 | 117% to 195% |
| 213246 | NA | NA | F3-U0.843 | 307% to 512% |
| 213246 | NA | NA | F3-U0.882 | 60% to 86% |
| 213246 | Phenols and Related Compounds | Phenylpropanes and Derivatives | Chlorogenic acid | -60% to -99% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#213257

| Seq ID | Chemical Class | Biochemical Class | Compound Name | Modification |
|---|---|---|---|---|
| 213257 | Amino Acids and Related Compounds | Amino Acids and Related Compounds | Arginine | 145% to 675% |
| 213257 | Amino Acids and Related Compounds | Amino Acids and Related Compounds | Aspartic acid | 20% to 115% |
| 213257 | Amino Acids and Related Compounds | Amino Acids and Related Compounds | Threonine | 20% to 80% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213260

| Seq ID | Chemical Class | Biochemical Class | Compound Name | Modification |
|---|---|---|---|---|
| 213260 | Acids - Fatty Unsat | Fatty Acids and Related Waxes | 9-Octadecenoic acid | 17% to 67% |
| 213260 | Amino Acids and Related Compounds | Amino Acids and Related Compounds | Arginine | 160% to 725% |
| 213260 | Amino Acids and Related Compounds | Amino Acids and Related Compounds | Aspartic acid | 20% to 60% |
| 213260 | Amino Acids and Related Compounds | Amino Acids and Related Compounds | Cysteine | 60% to 1675% |
| 213260 | Amino Acids and Related Compounds | Amino Acids and Related Compounds | Glutamic acid | 5% to 13% |
| 213260 | Amino Acids and Related Compounds | Amino Acids and Related Compounds | Glycine | 70% to 590% |
| 213260 | Amino Acids and Related Compounds | Amino Acids and Related Compounds | Lysine | -35% to -75% |
| 213260 | Amino Acids and Related Compounds | Amino Acids and Related Compounds | Threonine | 10% to 55% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213279

| Seq ID | Chemical Class | Biochemical Class | Compound Name | Modification |
|---|---|---|---|---|
| 213279 | Acids - Fatty | Fatty Acids and Related Waxes | Hexadecanoic acid | 9% to 17% |
| 213279 | Acids - Fatty | Fatty Acids and Related Waxes | Octadecanoic acid | 11% to 47% |
| 213279 | Amino Acids and Related Compounds | Amino Acids and Related Compounds | Isoleucine | 10% to 480% |
| 213279 | Amino Acids and Related Compounds | Amino Acids and Related Compounds | Phenylalanine | 135% to 410% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213287

| Seq ID | Chemical Class | Biochemical Class | Compound Name | Modification |
|---|---|---|---|---|
| 213287 | Carbohydrates | Carbohydrates | F3-U0.813 Carbohydrate | 60% to 82% |
| 213287 | Carbohydrates | Carbohydrates | F3-U0.872 Hexose | 60% to 91% |
| 213287 | Carbohydrates | Carbohydrates | Fructose | 113% to 188% |
| 213287 | Carbohydrates | Carbohydrates | Galactose or Mannose | 94% to 156% |
| 213287 | Carbohydrates | Carbohydrates | Glucose | 98% to 334% |
| 213287 | NA | NA | F3-U0.857 | 146% to 243% |
| 213287 | NA | NA | F3-U0.882 | 66% to 110% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213315

| Seq ID | Chemical Class | Biochemical Class | Compound Name | Modification |
|---|---|---|---|---|
| 213315 | Amino Acids and Related Compounds | Amino Acids and Related Compounds | Alanine | 15% to 130% |
| 213315 | Amino Acids and Related Compounds | Amino Acids and Related Compounds | Arginine | 45% to 520% |
| 213315 | Amino Acids and Related Compounds | Amino Acids and Related Compounds | Cysteine | 40% to 540% |
| 213315 | Amino Acids and Related Compounds | Amino Acids and Related Compounds | Glutamic acid | 15% to 90% |
| 213315 | Amino Acids and Related Compounds | Amino Acids and Related Compounds | Glycine | 25% to 430% |
| 213315 | Amino Acids and Related Compounds | Amino Acids and Related Compounds | Phenylalanine | 30% to 180% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213318

| Seq ID | Chemical Class | Biochemical Class | Compound Name | Modification |
|---|---|---|---|---|
| 213318 | Acids - Fatty | Fatty Acids and Related Waxes | Hexadecanoic acid | -5% to -17% |
| 213318 | Acids - Fatty | Fatty Acids and Related Waxes | Octadecanoic acid | -6% to -43% |
| 213318 | Acids - Fatty Branched | Fatty Acids and Related Waxes | Heptadecanoic acid, 16-methyl- | -21% to -35% |
| 213318 | Acids - Fatty Branched | Fatty Acids and Related Waxes | Hexadecanoic acid, 14-methyl- | 23% to 79% |
| 213318 | Acids - Fatty Unsat | Fatty Acids and Related Waxes | 7,10,13-Hexadecatrienoic acid | 21% to 95% |
| 213318 | Acids - Fatty Unsat | Fatty Acids and Related Waxes | 9-Hexadecenoic acid | -11% to -97% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213330

| Seq ID | Chemical Class | Biochemical Class | Compound Name | Modification |
|--------|----------------|-------------------|---------------|--------------|
| 213330 | Sterols, Oxygenated Terpenes, and Other Isoprenoids | Prenylquinones | alpha-Tocopherol | 86% to 144% |
| 213330 | Sterols, Oxygenated Terpenes, and Other Isoprenoids | Prenylquinones | beta-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213333

| Seq ID | Chemical Class | Biochemical Class | Compound Name | Modification |
|---|---|---|---|---|
| 213333 | Acids - Hydroxy Alpha | Acid Pathway | Citric acid | 93% to 155% |
| 213333 | Amino Acids and Related Compounds | Amino Acids and Related Compounds | Asparagine | 503% to 839% |
| 213333 | Amino Acids and Related Compounds | Amino Acids and Related Compounds | Phenylalanine | 110% to 1560% |
| 213333 | Amino Acids and Related Compounds | Amino Acids and Related Compounds | Tyrosine | New |
| 213333 | Carbohydrates | Carbohydrates | F3-U0.813 Carbohydrate | 107% to 178% |
| 213333 | Carbohydrates | Carbohydrates | F3-U0.816 Carbohydrate | 78% to 130% |
| 213333 | Carbohydrates | Carbohydrates | F3-U0.821 Carbohydrate | 93% to 155% |
| 213333 | Carbohydrates | Carbohydrates | F3-U0.825 Carbohydrate | 213% to 355% |
| 213333 | Carbohydrates | Carbohydrates | F3-U0.846 Carbohydrate | 113% to 189% |
| 213333 | Carbohydrates | Carbohydrates | F3-U0.872 Hexose | 98% to 164% |
| 213333 | Carbohydrates | Carbohydrates | F3-U1.189 Carbohydrate | -60% to -83% |
| 213333 | NA | NA | F3-U0.852A | 90% to 150% |
| 213333 | NA | NA | F3-U1.229 | 60% to 82% |
| 213333 | NA | NA | F3-U1.253 | 64% to 106% |
| 213333 | Phenols and Related Compounds | Phenylpropanes and Derivatives | Chlorogenic acid | -60% to -92% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213340

| Seq ID | Chemical Class | Biochemical Class | Compound Name | Modification |
|---|---|---|---|---|
| 213340 | Carbohydrates | Carbohydrates | F3-U0.813 Carbohydrate | 80% to 134% |
| 213340 | Carbohydrates | Carbohydrates | F3-U0.846 Carbohydrate | 60% to 81% |
| 213340 | Carbohydrates | Carbohydrates | F3-U0.872 Hexose | 60% to 97% |
| 213340 | Carbohydrates | Carbohydrates | Fructose | 60% to 142% |
| 213340 | Carbohydrates | Carbohydrates | Galactose or Mannose | 60% to 98% |
| 213340 | Carbohydrates | Carbohydrates | Glucose | 60% to 169% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213354

| Seq ID | Chemical Class | Biochemical Class | Compound Name | Modification |
|---|---|---|---|---|
| 213354 | Sterols, Oxygenated Terpenes, and Other Isoprenoids | Prenylquinones | alpha-Tocopherol hydroquinone | 221% to 369% |
| 213354 | Sterols, Oxygenated Terpenes, and Other Isoprenoids | Terpenoids | beta-Sitosterol | 106% to 177% |
| 213354 | Sterols, Oxygenated Terpenes, and Other Isoprenoids | Terpenoids | Cholesterol | 80% to 133% |
| 213354 | Sterols, Oxygenated Terpenes, and Other Isoprenoids | Terpenoids | Stigmasterol | 60% to 93% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213363

| Seq ID | Chemical Class | Biochemical Class | Compound Name | Modification |
|---|---|---|---|---|
| 213363 | Acids - Hydroxy Alpha | Acid Pathway | Citric acid | -60% to -84% |
| 213363 | Acids - Hydroxy Alpha | Acid Pathway | Malic acid | 60% to 76% |
| 213363 | Amino Acids and Related Compounds | Amino Acids and Related Compounds | Glutamic acid | 146% to 244% |
| 213363 | Carbohydrates | Carbohydrates | F3-U0.848 Carbohydrate | 344% to 574% |
| 213363 | Carbohydrates | Carbohydrates | F3-U0.952 Carbohydrate | 105% to 174% |
| 213363 | Carbohydrates | Carbohydrates | F3-U1.189 Carbohydrate | New |
| 213363 | Carbohydrates | Carbohydrates | Fructose | 410% to 1033% |
| 213363 | Carbohydrates | Carbohydrates | Galactose or Mannose | 455% to 758% |
| 213363 | Carbohydrates | Carbohydrates | Glucose | 255% to 1564% |
| 213363 | Esters | Esters | F1-U1.076 Fatty Acid Ester | 60% to 93% |
| 213363 | NA | NA | F3-U0.882 | 304% to 507% |
| 213363 | NA | NA | F3-U0.899 | 60% to 85% |
| 213363 | Sterols, Oxygenated Terpenes, and Other Isoprenoids | Prenylquinones | alpha-Tocopherol | -60% to -75% |
| 213363 | Sterols, Oxygenated Terpenes, and Other Isoprenoids | Prenylquinones | alpha-Tocopherol hydroquinone | New |
| 213363 | Sterols, Oxygenated Terpenes, and Other Isoprenoids | Terpenoids | beta-Sitosterol | 60% to 78% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213369

| Seq ID | Chemical Class | Biochemical Class | Compound Name | Modification |
|---|---|---|---|---|
| 213369 | Acids - Hydroxy | Amino Acids and Related Compounds | Shikimic acid | 121% to 201% |
| 213369 | Acids - Hydroxy Alpha | Acid Pathway | Butanoic acid, 2,3,4-trihydroxy- | 67% to 111% |
| 213369 | Acids - Hydroxy Alpha | Carbohydrates | Glyceric acid | New |
| 213369 | Acids - Hydroxy Alpha | Acid Pathway | Malic acid | 71% to 118% |
| 213369 | Acids - Hydroxy Alpha | Carbohydrates | Quinic acid | 159% to 265% |
| 213369 | Alcohols | Carbohydrates | Inositol | 60% to 100% |
| 213369 | Carbohydrates | Carbohydrates | F3-U0.846 Carbohydrate | 60% to 92% |
| 213369 | Carbohydrates | Carbohydrates | F3-U0.848 Carbohydrate | 115% to 191% |
| 213369 | Carbohydrates | Carbohydrates | F3-U0.872 Hexose | 82% to 136% |
| 213369 | Carbohydrates | Carbohydrates | Fructose | 101% to 229% |
| 213369 | Carbohydrates | Carbohydrates | Galactose or Mannose | 97% to 161% |
| 213369 | Carbohydrates | Carbohydrates | Glucose | 210% to 576% |
| 213369 | NA | NA | F3-U0.751 | 60% to 87% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213387

| Seq ID | Chemical Class | Biochemical Class | Compound Name | Modification |
|---|---|---|---|---|
| 213387 | Acids - Hydroxy | Amino Acids and Related Compounds | Shikimic acid | 156% to 260% |
| 213387 | Acids - Hydroxy Alpha | Acid Pathway | Butanoic acid, 2,3,4-trihydroxy- | 255% to 425% |
| 213387 | Acids - Hydroxy Alpha | Carbohydrates | Glyceric acid | New |
| 213387 | Acids - Hydroxy Alpha | Acid Pathway | Malic acid | 60% to 84% |
| 213387 | Acids - Hydroxy Alpha | Carbohydrates | Quinic acid | 193% to 322% |
| 213387 | Alcohols | Carbohydrates | Inositol | 64% to 106% |
| 213387 | Carbohydrates | Carbohydrates | F3-U0.846 Carbohydrate | 300% to 500% |
| 213387 | Carbohydrates | Carbohydrates | F3-U0.848 Carbohydrate | 225% to 375% |
| 213387 | Carbohydrates | Carbohydrates | F3-U0.872 Hexose | 311% to 519% |
| 213387 | Carbohydrates | Carbohydrates | F3-U0.952 Carbohydrate | 60% to 86% |
| 213387 | Carbohydrates | Carbohydrates | Fructose | 60% to 144% |
| 213387 | Carbohydrates | Carbohydrates | Glucose | 149% to 497% |
| 213387 | NA | NA | F3-U0.751 | 122% to 203% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213388

| Seq ID | Chemical Class | Biochemical Class | Compound Name | Modification |
|---|---|---|---|---|
| 213388 | Acids - Hydroxy Alpha | Carbohydrates | Glyceric acid | New |
| 213388 | Acids - Hydroxy Alpha | Carbohydrates | Quinic acid | 103% to 172% |
| 213388 | Carbohydrates | Carbohydrates | F3-U0.846 Carbohydrate | 138% to 231% |
| 213388 | Carbohydrates | Carbohydrates | F3-U0.848 Carbohydrate | 137% to 228% |
| 213388 | Carbohydrates | Carbohydrates | F3-U0.872 Hexose | 143% to 238% |
| 213388 | Carbohydrates | Carbohydrates | Fructose | 117% to 262% |
| 213388 | Carbohydrates | Carbohydrates | Galactose or Mannose | 95% to 159% |
| 213388 | Carbohydrates | Carbohydrates | Glucose | 172% to 530% |
| 213388 | NA | NA | F3-U0.882 | 78% to 131% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213396

| Seq ID | Chemical Class | Biochemical Class | Compound Name | Modification |
|---|---|---|---|---|
| 213396 | Acids - Hydroxy | Amino Acids and Related Compounds | Shikimic acid | 60% to 587% |
| 213396 | Acids - Hydroxy Alpha | Acid Pathway | Butanoic acid, 2,3,4-trihydroxy- | 193% to 725% |
| 213396 | Acids - Hydroxy Alpha | Acid Pathway | Citric acid | 130% to 216% |
| 213396 | Acids - Hydroxy Alpha | Carbohydrates | Glyceric acid | New |
| 213396 | Acids - Hydroxy Alpha | Acid Pathway | Malic acid | 60% to 185% |
| 213396 | Acids - Hydroxy Alpha | Carbohydrates | Quinic acid | 101% to 401% |
| 213396 | Alcohols | Carbohydrates | Inositol | 89% to 149% |
| 213396 | Amino Acids and Related Compounds | Amino Acids and Related Compounds | Glutamic acid | 79% to 264% |
| 213396 | Amino Acids and Related Compounds | Amino Acids and Related Compounds | Proline | 111% to 184% |
| 213396 | Carbohydrates | Carbohydrates | F3-U0.813 Carbohydrate | New |
| 213396 | Carbohydrates | Carbohydrates | F3-U0.816 Carbohydrate | 60% to 587% |
| 213396 | Carbohydrates | Carbohydrates | F3-U0.821 Carbohydrate | 60% to 89% |
| 213396 | Carbohydrates | Carbohydrates | F3-U0.825 Carbohydrate | New |
| 213396 | Carbohydrates | Carbohydrates | F3-U0.846 Carbohydrate | 232% to 1577% |
| 213396 | Carbohydrates | Carbohydrates | F3-U0.848 Carbohydrate | 87% to 507% |
| 213396 | Carbohydrates | Carbohydrates | F3-U0.872 Hexose | 233% to 1256% |
| 213396 | Carbohydrates | Carbohydrates | F3-U0.952 Carbohydrate | 67% to 121% |
| 213396 | Carbohydrates | Carbohydrates | F3-U1.189 Carbohydrate | 63% to 105% |
| 213396 | Carbohydrates | Carbohydrates | Fructose | 60% to 188% |
| 213396 | Carbohydrates | Carbohydrates | Glucose | 99% to 437% |
| 213396 | NA | NA | F3-U0.736 | 99% to 166% |
| 213396 | NA | NA | F3-U0.751 | 219% to 366% |
| 213396 | NA | NA | F3-U0.852A | 131% to 219% |
| 213396 | NA | NA | F3-U1.229 | 110% to 184% |
| 213396 | Phenols and Related Compounds | Phenylpropanes and Derivatives | Chlorogenic acid | 60% to 98% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213728

| Seq ID | Chemical Class | Biochemical Class | Compound Name | Modification |
|---|---|---|---|---|
| 213728 | NA | NA | F1-U0.948 | 60% to 84% |
| 213728 | NA | NA | F1-U0.996 | 60% to 85% |
| 213728 | NA | NA | F1-U1.047 | 153% to 255% |
| 213728 | Sterols, Oxygenated Terpenes, and Other Isoprenoids | Terpenoids | beta-Sitosterol | 108% to 180% |
| 213728 | Sterols, Oxygenated Terpenes, and Other Isoprenoids | Terpenoids | Cholesterol | 102% to 170% |
| 213728 | Sterols, Oxygenated Terpenes, and Other Isoprenoids | Terpenoids | Stigmasterol | 60% to 85% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#213734

| Seq ID | Chemical Class | Biochemical Class | Compound Name | Modification |
|---|---|---|---|---|
| 213734 | Acids - Hydroxy Alpha | Acid Pathway | Butanoic acid, 2,3,4-trihydroxy- | 321% to 536% |
| 213734 | Acids - Hydroxy Alpha | Carbohydrates | Glyceric acid | New |
| 213734 | Acids - Hydroxy Alpha | Acid Pathway | Malic acid | 149% to 249% |
| 213734 | Acids - Hydroxy Alpha | Carbohydrates | Quinic acid | 269% to 449% |
| 213734 | Alcohols | Carbohydrates | Inositol | 117% to 194% |
| 213734 | Amino Acids and Related Compounds | Amino Acids and Related Compounds | Glutamic acid | 123% to 300% |
| 213734 | Carbohydrates | Carbohydrates | F3-U0.813 Carbohydrate | New |
| 213734 | Carbohydrates | Carbohydrates | F3-U0.816 Carbohydrate | 139% to 231% |
| 213734 | Carbohydrates | Carbohydrates | F3-U0.825 Carbohydrate | New |
| 213734 | Carbohydrates | Carbohydrates | F3-U0.846 Carbohydrate | 135% to 866% |
| 213734 | Carbohydrates | Carbohydrates | F3-U0.872 Hexose | 170% to 555% |
| 213734 | Carbohydrates | Carbohydrates | F3-U0.952 Carbohydrate | 135% to 225% |
| 213734 | Carbohydrates | Carbohydrates | F3-U1.194 Carbohydrate | NQ |
| 213734 | Carbohydrates | Carbohydrates | Fructose | 110% to 234% |
| 213734 | Carbohydrates | Carbohydrates | Galactose or Mannose | 62% to 103% |
| 213734 | Carbohydrates | Carbohydrates | Glucose | 355% to 1006% |
| 213734 | Esters | Esters | F1-U1.076 Fatty Acid Ester | -60% to -92% |
| 213734 | Esters - Hydroxy | Acyl acetylglycerols | 2-Eicosanoyl-1-acetylglycerol | -60% to -98% |
| 213734 | Esters - Hydroxy | Acyl acetylglycerols | 2-Octadecanoyl-1-acetylglycerol | -60% to -90% |
| 213734 | Hydrocarbons | Hydrocarbons | Isononacosane | 116% to 194% |
| 213734 | NA | NA | F3-U0.736 | 610% to 1017% |
| 213734 | NA | NA | F3-U0.882 | 76% to 126% |
| 213734 | Phenols and Related Compounds | Phenylpropanes and Derivatives | Chlorogenic acid | -60% to -88% |
| 213734 | Sterols, Oxygenated Terpenes, and Other Isoprenoids | Prenylquinones | alpha-Tocopherol | -60% to -92% |
| 213734 | Sterols, Oxygenated Terpenes, and Other Isoprenoids | Terpenoids | beta-Sitosterol | 121% to 201% |
| 213734 | Sterols, Oxygenated Terpenes, and Other Isoprenoids | Terpenoids | Fucosterol | 107% to 179% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213738

| Seq ID | Chemical Class | Biochemical Class | Compound Name | Modification |
|---|---|---|---|---|
| 213738 | Esters - Hydroxy | Acyl acetylglycerols | 2-Eicosanoyl-1-acetylglycerol | -60% to -80% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213742

| Seq ID | Chemical Class | Biochemical Class | Compound Name | Modification |
|---|---|---|---|---|
| 213742 | Acids - Hydroxy Alpha | Acid Pathway | Butanoic acid, 2,3,4-trihydroxy- | 122% to 204% |
| 213742 | Acids - Hydroxy Alpha | Acid Pathway | Citric acid | 187% to 311% |
| 213742 | Acids - Hydroxy Alpha | Acid Pathway | Malic acid | 66% to 110% |
| 213742 | Aldehydes, Ketones and Quinones | Aldehydes, Ketones and Quinones | 3-Phytylmenadione | 64% to 107% |
| 213742 | Carbohydrates | Carbohydrates | F3-U0.816 Carbohydrate | 104% to 173% |
| 213742 | Carbohydrates | Carbohydrates | F3-U0.846 Carbohydrate | 96% to 160% |
| 213742 | Carbohydrates | Carbohydrates | F3-U0.872 Hexose | 60% to 76% |
| 213742 | Carbohydrates | Carbohydrates | Fructose | -60% to -91% |
| 213742 | Carbohydrates | Carbohydrates | Glucose | -60% to -88% |
| 213742 | NA | NA | F1-U0.948 | 69% to 173% |
| 213742 | NA | NA | F1-U1.047 | 205% to 341% |
| 213742 | Sterols, Oxygenated Terpenes, and Other Isoprenoids | Prenylquinones | alpha-Tocopherol hydroquinone | 107% to 178% |
| 213742 | Sterols, Oxygenated Terpenes, and Other Isoprenoids | Terpenoids | beta-Sitosterol | 121% to 201% |
| 213742 | Sterols, Oxygenated Terpenes, and Other Isoprenoids | Terpenoids | Cholesterol | 70% to 117% |
| 213742 | Sterols, Oxygenated Terpenes, and Other Isoprenoids | Terpenoids | Stigmasta-4,22-dien-3-ol | 67% to 112% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213754

| Seq ID | Chemical Class | Biochemical Class | Compound Name | Modification |
|---|---|---|---|---|
| 213754 | Acids | Acids | Carbamic acid | 89% to 148% |
| 213754 | Alcohols | Carbohydrates | Inositol | 60% to 83% |
| 213754 | Alkaloids and Other Bases | Alkaloids and Other Bases | Nicotine | 101% to 169% |
| 213754 | Amino Acids and Related Compounds | Amino Acids and Related Compounds | Asparagine | -62% to -100% |
| 213754 | Amino Acids and Related Compounds | Amino Acids and Related Compounds | Glutamine | -65% to -100% |
| 213754 | Carbohydrates | Carbohydrates | F3-U0.825 Carbohydrate | -60% to -93% |
| 213754 | Carbohydrates | Carbohydrates | F3-U0.872 Hexose | -60% to -78% |
| 213754 | Carbohydrates | Carbohydrates | F3-U1.150 Carbohydrate | -60% to -91% |
| 213754 | Carbohydrates | Carbohydrates | F3-U1.189 Carbohydrate | 133% to 221% |
| 213754 | Carbohydrates | Carbohydrates | F3-U1.194 Carbohydrate | 67% to 111% |
| 213754 | NA | NA | F3-U0.736 | 111% to 186% |
| 213754 | NA | NA | F3-U0.751 | 121% to 202% |
| 213754 | NA | NA | F3-U0.899 | 188% to 313% |
| 213754 | NA | NA | F3-U1.253 | 63% to 106% |
| 213754 | Phenols and Related Compounds | Phenylpropanes and Derivatives | Chlorogenic acid | 190% to 317% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213756

| Seq ID | Chemical Class | Biochemical Class | Compound Name | Modification |
|---|---|---|---|---|
| 213756 | Aldehydes, Ketones and Quinones | Aldehydes, Ketones and Quinones | 3-Phytylmenadione | 60% to 85% |
| 213756 | Sterols, Oxygenated Terpenes, and Other Isoprenoids | Prenylquinones | alpha-Tocopherol hydroquinone | 125% to 209% |
| 213756 | Sterols, Oxygenated Terpenes, and Other Isoprenoids | Terpenoids | Fucosterol | 83% to 139% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213758

| Seq ID | Chemical Class | Biochemical Class | Compound Name | Modification |
|---|---|---|---|---|
| 213758 | Amino Acids and Related Compounds | Amino Acids and Related Compounds | Alanine | 155% to 1635% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213764

| Seq ID | Chemical Class | Biochemical Class | Compound Name | Modification |
|---|---|---|---|---|
| 213764 | Acids - Hydroxy Alpha | Acid Pathway | Malic acid | 115% to 192% |
| 213764 | Acids - Hydroxy Alpha | Carbohydrates | Quinic acid | 97% to 162% |
| 213764 | Carbohydrates | Carbohydrates | F3-U0.846 Carbohydrate | 685% to 1141% |
| 213764 | Carbohydrates | Carbohydrates | F3-U0.872 Hexose | 737% to 1228% |
| 213764 | Carbohydrates | Carbohydrates | F3-U1.189 Carbohydrate | 89% to 148% |
| 213764 | Carbohydrates | Carbohydrates | Fructose | 88% to 239% |
| 213764 | Carbohydrates | Carbohydrates | Glucose | 165% to 763% |
| 213764 | NA | NA | F3-U1.253 | 84% to 141% |
| 213764 | Phenols and Related Compounds | Phenylpropanes and Derivatives | Chlorogenic acid | 78% to 131% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213767

| Seq ID | Chemical Class | Biochemical Class | Compound Name | Modification |
|---|---|---|---|---|
| 213767 | Acids - Hydroxy Alpha | Acid Pathway | Citric acid | 60% to 95% |
| 213767 | Amino Acids and Related Compounds | Amino Acids and Related Compounds | Aspartic acid | 60% to 87% |
| 213767 | Amino Acids and Related Compounds | Amino Acids and Related Compounds | Glutamic acid | 132% to 219% |
| 213767 | Amino Acids and Related Compounds | Amino Acids and Related Compounds | Proline | 60% to 83% |
| 213767 | Carbohydrates | Carbohydrates | F3-U0.821 Carbohydrate | 60% to 95% |
| 213767 | Carbohydrates | Carbohydrates | F3-U0.846 Carbohydrate | 80% to 133% |
| 213767 | Carbohydrates | Carbohydrates | F3-U0.872 Hexose | 60% to 93% |
| 213767 | Carbohydrates | Carbohydrates | F3-U1.150 Carbohydrate | 60% to 78% |
| 213767 | NA | NA | F3-U0.751 | 120% to 200% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213769

| Seq ID | Chemical Class | Biochemical Class | Compound Name | Modification |
|---|---|---|---|---|
| 213769 | Acids - Fatty | Fatty Acids and Related Waxes | Octadecanoic acid | 7% to 33% |
| 213769 | Acids - Fatty Unsat | Fatty Acids and Related Waxes | 7,10,13-Hexadecatrienoic acid | -15% to -29% |
| 213769 | Acids - Fatty Unsat | Fatty Acids and Related Waxes | 9,12,15-Octadecatrienoic acid | -4% to -9% |
| 213769 | Acids - Fatty Unsat | Fatty Acids and Related Waxes | 9,12-Octadecadienoic acid | 5% to 41% |
| 213769 | Acids - Fatty Unsat | Fatty Acids and Related Waxes | 9-Octadecenoic acid | 22% to 163% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213777

| Seq ID | Chemical Class | Biochemical Class | Compound Name | Modification |
|---|---|---|---|---|
| 213777 | Acids | Acids | Carbamic acid | 81% to 221% |
| 213777 | Carbohydrates | Carbohydrates | F3-U0.846 Carbohydrate | 60% to 89% |
| 213777 | Carbohydrates | Carbohydrates | F3-U0.848 Carbohydrate | 169% to 281% |
| 213777 | Carbohydrates | Carbohydrates | F3-U0.872 Hexose | 103% to 172% |
| 213777 | Carbohydrates | Carbohydrates | Fructose | 229% to 579% |
| 213777 | Carbohydrates | Carbohydrates | Galactose or Mannose | 286% to 476% |
| 213777 | Carbohydrates | Carbohydrates | Glucose | 135% to 641% |
| 213777 | NA | NA | F3-U0.882 | 85% to 141% |
| 213777 | NA | NA | F3-U1.229 | 78% to 130% |
| 213777 | NA | NA | F3-U1.253 | 100% to 167% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213778

| Seq ID | Chemical Class | Biochemical Class | Compound Name | Modification |
|---|---|---|---|---|
| 213778 | Acids | Acids | Carbamic acid | 180% to 543% |
| 213778 | Carbohydrates | Carbohydrates | F3-U0.813 Carbohydrate | 119% to 199% |
| 213778 | Carbohydrates | Carbohydrates | F3-U0.816 Carbohydrate | 60% to 98% |
| 213778 | Carbohydrates | Carbohydrates | F3-U0.825 Carbohydrate | 81% to 135% |
| 213778 | Carbohydrates | Carbohydrates | F3-U0.846 Carbohydrate | 72% to 120% |
| 213778 | Carbohydrates | Carbohydrates | F3-U0.848B Carbohydrate | 62% to 104% |
| 213778 | Carbohydrates | Carbohydrates | F3-U0.872 Hexose | 68% to 114% |
| 213778 | Carbohydrates | Carbohydrates | Fructose | 60% to 100% |
| 213778 | Carbohydrates | Carbohydrates | Galactose or Mannose | 62% to 103% |
| 213778 | Carbohydrates | Carbohydrates | Glucose | 60% to 130% |
| 213778 | NA | NA | F3-U0.736 | New |
| 213778 | NA | NA | F3-U0.751 | 128% to 214% |
| 213778 | NA | NA | F3-U0.852A | 92% to 153% |
| 213778 | NA | NA | F3-U1.228 | 60% to 97% |
| 213778 | NA | NA | F3-U1.253 | 60% to 94% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213781

| Seq ID | Chemical Class | Biochemical Class | Compound Name | Modification |
|---|---|---|---|---|
| 213781 | Acids - Fatty | Fatty Acids and Related Waxes | Eicosanoic acid | -77% to -91% |
| 213781 | Acids - Fatty | Fatty Acids and Related Waxes | Hexadecanoic acid | 9% to 27% |
| 213781 | Acids - Fatty | Fatty Acids and Related Waxes | Octadecanoic acid | 23% to 55% |
| 213781 | Acids - Fatty Branched | Fatty Acids and Related Waxes | Hexadecanoic acid, 14-methyl- | -17% to -35% |
| 213781 | Acids - Fatty Unsat | Fatty Acids and Related Waxes | 9,12,15-Octadecatrienoic acid | -5% to -11% |
| 213781 | Acids - Fatty Unsat | Fatty Acids and Related Waxes | 9-Octadecenoic acid | 77% to 217% |
| 213781 | Amino Acids and Related Compounds | Amino Acids and Related Compounds | Alanine | 155% to 1635% |
| 213781 | Amino Acids and Related Compounds | Amino Acids and Related Compounds | Arginine | 80% to 250% |
| 213781 | Amino Acids and Related Compounds | Amino Acids and Related Compounds | Glutamic acid | 40% to 90% |
| 213781 | Amino Acids and Related Compounds | Amino Acids and Related Compounds | Leucine | 50% to 265% |
| 213781 | Amino Acids and Related Compounds | Amino Acids and Related Compounds | Methionine | 30% to 150% |
| 213781 | Amino Acids and Related Compounds | Amino Acids and Related Compounds | Serine | 85% to 240% |
| 213781 | Amino Acids and Related Compounds | Amino Acids and Related Compounds | Threonine | 40% to 125% |
| 213781 | Amino Acids and Related Compounds | Amino Acids and Related Compounds | Valine | 30% to 365% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213783

| Seq ID | Chemical Class | Biochemical Class | Compound Name | Modification |
|---|---|---|---|---|
| 213783 | Acids | Acids | Carbamic acid | 141% to 425% |
| 213783 | Acids - Fatty Unsat | Fatty Acids and Related Waxes | 9,12,15-Octadecatrienoic acid | 60% to 77% |
| 213783 | Acids - Hydroxy | Amino Acids and Related Compounds | Shikimic acid | 88% to 146% |
| 213783 | Acids - Hydroxy Alpha | Acid Pathway | Butanoic acid, 2,3,4-trihydroxy- | 85% to 142% |
| 213783 | Acids - Hydroxy Alpha | Acid Pathway | Citric acid | 356% to 594% |
| 213783 | Acids - Hydroxy Alpha | Acid Pathway | Malic acid | 82% to 136% |
| 213783 | Acids - Hydroxy Alpha | Carbohydrates | Quinic acid | 137% to 228% |
| 213783 | Amino Acids and Related Compounds | Amino Acids and Related Compounds | Asparagine | NQ |
| 213783 | Amino Acids and Related Compounds | Amino Acids and Related Compounds | Aspartic acid | 80% to 133% |
| 213783 | Amino Acids and Related Compounds | Amino Acids and Related Compounds | Glutamic acid | 102% to 170% |
| 213783 | Amino Acids and Related Compounds | Amino Acids and Related Compounds | Glutamine | NQ |
| 213783 | Amino Acids and Related Compounds | Amino Acids and Related Compounds | Glycine | New |
| 213783 | Carbohydrates | Carbohydrates | F3-U1.150 Carbohydrate | 60% to 95% |
| 213783 | Carbohydrates | Carbohydrates | F3-U1.189 Carbohydrate | 131% to 219% |
| 213783 | Carbohydrates | Carbohydrates | Fructose | -60% to -100% |
| 213783 | NA | NA | F3-U0.634 | 80% to 134% |
| 213783 | NA | NA | F3-U0.751 | 136% to 227% |
| 213783 | NA | NA | F3-U0.882 | -60% to -76% |
| 213783 | Phenols and Related Compounds | Phenylpropanes and Derivatives | Chlorogenic acid | 234% to 390% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213789

| Seq ID | Chemical Class | Biochemical Class | Compound Name | Modification |
|---|---|---|---|---|
| 213789 | Acids | Acids | Carbamic acid | 60% to 88% |
| 213789 | Acids - Hydroxy Alpha | Acid Pathway | Butanoic acid, 2,3,4-trihydroxy- | 65% to 108% |
| 213789 | Acids - Hydroxy Alpha | Carbohydrates | Glyceric acid | 91% to 151% |
| 213789 | Acids - Hydroxy Alpha | Carbohydrates | Quinic acid | 71% to 118% |
| 213789 | Carbohydrates | Carbohydrates | F3-U0.848 Carbohydrate | 107% to 178% |
| 213789 | Carbohydrates | Carbohydrates | F3-U0.872 Hexose | 60% to 98% |
| 213789 | Carbohydrates | Carbohydrates | Fructose | 197% to 455% |
| 213789 | Carbohydrates | Carbohydrates | Galactose or Mannose | 209% to 348% |
| 213789 | Carbohydrates | Carbohydrates | Glucose | 190% to 798% |
| 213789 | NA | NA | F3-U0.882 | 127% to 212% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213794

| Seq ID | Chemical Class | Biochemical Class | Compound Name | Modification |
|---|---|---|---|---|
| 213794 | Acids | Acids | Carbamic acid | 60% to 96% |
| 213794 | Acids - Hydroxy Alpha | Acid Pathway | Butanoic acid, 2,3,4-trihydroxy- | 68% to 114% |
| 213794 | Carbohydrates | Carbohydrates | Fructose | -60% to -92% |
| 213794 | Carbohydrates | Carbohydrates | Glucose | -60% to -82% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213802

| Seq ID | Chemical Class | Biochemical Class | Compound Name | Modification |
|---|---|---|---|---|
| 213802 | Acids | Acids | Carbamic acid | 73% to 232% |
| 213802 | Acids - Hydroxy | Amino Acids and Related Compounds | Shikimic acid | 244% to 500% |
| 213802 | Acids - Hydroxy Alpha | Acid Pathway | Butanoic acid, 2,3,4-trihydroxy- | 283% to 1434% |
| 213802 | Acids - Hydroxy Alpha | Acid Pathway | Citric acid | 70% to 1036% |
| 213802 | Acids - Hydroxy Alpha | Carbohydrates | Glyceric acid | New |
| 213802 | Acids - Hydroxy Alpha | Acid Pathway | Malic acid | 87% to 248% |
| 213802 | Acids - Hydroxy Alpha | Carbohydrates | Quinic acid | 181% to 408% |
| 213802 | Alkenes and Alkynes | Terpenoids | Limonene | 96% to 160% |
| 213802 | Amino Acids and Related Compounds | Amino Acids and Related Compounds | Glutamic acid | 68% to 113% |
| 213802 | Amino Acids and Related Compounds | Amino Acids and Related Compounds | Glutamine | NQ |
| 213802 | Amino Acids and Related Compounds | Amino Acids and Related Compounds | Glycine | New |
| 213802 | Amino Acids and Related Compounds | Amino Acids and Related Compounds | Lysine | New |
| 213802 | Amino Acids and Related Compounds | Amino Acids and Related Compounds | Proline, 5-oxo- | 642% to 1070% |
| 213802 | Amino Acids and Related Compounds | Amino Acids and Related Compounds | Tyrosine | NQ |
| 213802 | Carbohydrates | Carbohydrates | Arabinose or Xylose | -60% to -85% |
| 213802 | Carbohydrates | Carbohydrates | F3-U0.813 Carbohydrate | New |
| 213802 | Carbohydrates | Carbohydrates | F3-U0.816 Carbohydrate | 300% to 500% |
| 213802 | Carbohydrates | Carbohydrates | F3-U0.821 Carbohydrate | 70% to 116% |
| 213802 | Carbohydrates | Carbohydrates | F3-U0.825 Carbohydrate | New |
| 213802 | Carbohydrates | Carbohydrates | F3-U0.846 Carbohydrate | 351% to 585% |
| 213802 | Carbohydrates | Carbohydrates | F3-U0.848 Carbohydrate | 340% to 566% |
| 213802 | Carbohydrates | Carbohydrates | F3-U0.872 Hexose | 363% to 605% |
| 213802 | Carbohydrates | Carbohydrates | F3-U0.956 Carbohydrate | New |
| 213802 | Carbohydrates | Carbohydrates | F3-U1.104 Carbohydrate | NQ |
| 213802 | Carbohydrates | Carbohydrates | F3-U1.143 Carbohydrate | 60% to 97% |
| 213802 | Carbohydrates | Carbohydrates | F3-U1.150 Carbohydrate | 90% to 149% |
| 213802 | Carbohydrates | Carbohydrates | F3-U1.189 Carbohydrate | 174% to 290% |
| 213802 | Carbohydrates | Carbohydrates | F3-U1.194 Carbohydrate | 70% to 116% |
| 213802 | Carbohydrates | Carbohydrates | Fructose | 286% to 679% |
| 213802 | Carbohydrates | Carbohydrates | Glucose | 244% to 848% |
| 213802 | NA | NA | F3-U0.736 | 60% to 130% |
| 213802 | NA | NA | F3-U0.751 | 78% to 418% |
| 213802 | Phenols and Related Compounds | Phenylpropanes and Derivatives | Chlorogenic acid | 341% to 568% |
| 213802 | Sterols, Oxygenated Terpenes, and Other Isoprenoids | Prenylquinones | alpha-Tocopherol | 71% to 118% |
| 213802 | Sterols, Oxygenated Terpenes, and Other Isoprenoids | Terpenoids | Stigmasterol | 60% to 83% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213803

| Seq ID | Chemical Class | Biochemical Class | Compound Name | Modification |
|---|---|---|---|---|
| 213803 | Acids | Acids | Carbamic acid | 110% to 183% |
| 213803 | Acids - Hydroxy | Amino Acids and Related Compounds | Shikimic acid | 244% to 433% |
| 213803 | Acids - Hydroxy Alpha | Acid Pathway | Butanoic acid, 2,3,4-trihydroxy- | 168% to 625% |
| 213803 | Acids - Hydroxy Alpha | Acid Pathway | Citric acid | 60% to 142% |
| 213803 | Acids - Hydroxy Alpha | Carbohydrates | Glyceric acid | New |
| 213803 | Acids - Hydroxy Alpha | Acid Pathway | Malic acid | 79% to 132% |
| 213803 | Acids - Hydroxy Alpha | Carbohydrates | Quinic acid | 202% to 454% |
| 213803 | Alcohols | Carbohydrates | Inositol | 84% to 139% |
| 213803 | Amino Acids and Related Compounds | Amino Acids and Related Compounds | Asparagine | NQ |
| 213803 | Amino Acids and Related Compounds | Amino Acids and Related Compounds | Aspartic acid | 60% to 91% |
| 213803 | Amino Acids and Related Compounds | Amino Acids and Related Compounds | Glutamic acid | 83% to 138% |
| 213803 | Amino Acids and Related Compounds | Amino Acids and Related Compounds | Glutamine | -60% to -90% |
| 213803 | Amino Acids and Related Compounds | Amino Acids and Related Compounds | Proline | 60% to 107% |
| 213803 | Amino Acids and Related Compounds | Amino Acids and Related Compounds | Proline, 5-oxo- | 77% to 129% |
| 213803 | Amino Acids and Related Compounds | Amino Acids and Related Compounds | Serine | 84% to 140% |
| 213803 | Carbohydrates | Carbohydrates | Arabinose or Xylose | -60% to -88% |
| 213803 | Carbohydrates | Carbohydrates | F3-U0.813 Carbohydrate | 66% to 110% |
| 213803 | Carbohydrates | Carbohydrates | F3-U0.825 Carbohydrate | New |
| 213803 | Carbohydrates | Carbohydrates | F3-U0.846 Carbohydrate | 90% to 744% |
| 213803 | Carbohydrates | Carbohydrates | F3-U0.848 Carbohydrate | 61% to 655% |
| 213803 | Carbohydrates | Carbohydrates | F3-U0.872 Hexose | 80% to 689% |
| 213803 | Carbohydrates | Carbohydrates | F3-U1.189 Carbohydrate | 148% to 247% |
| 213803 | Carbohydrates | Carbohydrates | F3-U1.194 Carbohydrate | 60% to 78% |
| 213803 | Carbohydrates | Carbohydrates | Galactose or Mannose | 60% to 91% |
| 213803 | Carbohydrates | Carbohydrates | Glucose | 60% to 960% |
| 213803 | NA | NA | F3-U0.736 | 72% to 252% |
| 213803 | NA | NA | F3-U0.751 | 84% to 461% |
| 213803 | NA | NA | F3-U0.843 | 304% to 506% |
| 213803 | NA | NA | F3-U0.852A | 73% to 122% |
| 213803 | NA | NA | F3-U0.882 | -60% to -82% |
| 213803 | Phenols and Related Compounds | Phenylpropanes and Derivatives | Chlorogenic acid | 60% to 405% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213804

| Seq ID | Chemical Class | Biochemical Class | Compound Name | Modification |
|---|---|---|---|---|
| 213804 | Acids - Hydroxy Alpha | Acid Pathway | Citric acid | 136% to 226% |
| 213804 | Acids - Hydroxy Alpha | Acid Pathway | Malic acid | 247% to 411% |
| 213804 | Acids - Hydroxy Alpha | Carbohydrates | Quinic acid | 108% to 180% |
| 213804 | Amino Acids and Related Compounds | Amino Acids and Related Compounds | Proline, 5-oxo- | 195% to 325% |
| 213804 | Carbohydrates | Carbohydrates | F3-U0.813 Carbohydrate | New |
| 213804 | Carbohydrates | Carbohydrates | F3-U0.816 Carbohydrate | 244% to 406% |
| 213804 | Carbohydrates | Carbohydrates | F3-U0.821 Carbohydrate | 136% to 226% |
| 213804 | Carbohydrates | Carbohydrates | F3-U0.846 Carbohydrate | 943% to 1572% |
| 213804 | Carbohydrates | Carbohydrates | F3-U0.872 Hexose | 877% to 1461% |
| 213804 | Carbohydrates | Carbohydrates | F3-U1.189 Carbohydrate | 155% to 258% |
| 213804 | Carbohydrates | Carbohydrates | F3-U1.194 Carbohydrate | 173% to 288% |
| 213804 | Carbohydrates | Carbohydrates | Fructose | 71% to 118% |
| 213804 | Carbohydrates | Carbohydrates | Glucose | 123% to 386% |
| 213804 | NA | NA | F3-U0.852A | New |
| 213804 | Phenols and Related Compounds | Phenylpropanes and Derivatives | Chlorogenic acid | 138% to 230% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213809

| Seq ID | Chemical Class | Biochemical Class | Compound Name | Modification |
|---|---|---|---|---|
| 213809 | Acids | Acids | Carbamic acid | -60% to -82% |
| 213809 | Amino Acids and Related Compounds | Amino Acids and Related Compounds | Aspartic acid | 60% to 80% |
| 213809 | Amino Acids and Related Compounds | Amino Acids and Related Compounds | Lysine | -60% to -75% |
| 213809 | Amino Acids and Related Compounds | Amino Acids and Related Compounds | Proline, 5-oxo- | 60% to 78% |
| 213809 | Amino Acids and Related Compounds | Amino Acids and Related Compounds | Serine | 60% to 77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213811

| Seq ID | Chemical Class | Biochemical Class | Compound Name | Modification |
|---|---|---|---|---|
| 213811 | Aldehydes, Ketones and Quinones | Aldehydes, Ketones and Quinones | 3-Phytylmenadione | 60% to 97% |
| 213811 | Esters | Esters | F1-U1.076 Fatty Acid Ester | 60% to 78% |
| 213811 | Hydrocarbons | Hydrocarbons | Nonacosane, 3-methyl | 60% to 76% |
| 213811 | Sterols, Oxygenated Terpenes, and Other Isoprenoids | Terpenoids | beta-Sitosterol | 60% to 95% |
| 213811 | Sterols, Oxygenated Terpenes, and Other Isoprenoids | Prenylquinones | beta-Tocopherol | New |
| 213811 | Sterols, Oxygenated Terpenes, and Other Isoprenoids | Terpenoids | Cycloartenol | 64% to 107% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213812

| Seq ID | Chemical Class | Biochemical Class | Compound Name | Modification |
|---|---|---|---|---|
| 213812 | Acids - Hydroxy Alpha | Acid Pathway | Malic acid | 101% to 169% |
| 213812 | Amino Acids and Related Compounds | Amino Acids and Related Compounds | Proline, 5-oxo- | 89% to 148% |
| 213812 | Carbohydrates | Carbohydrates | F3-U0.846 Carbohydrate | 70% to 116% |
| 213812 | Carbohydrates | Carbohydrates | F3-U0.872 Hexose | 142% to 237% |
| 213812 | Carbohydrates | Carbohydrates | F3-U1.150 Carbohydrate | 111% to 185% |
| 213812 | Carbohydrates | Carbohydrates | F3-U1.189 Carbohydrate | 135% to 225% |
| 213812 | Carbohydrates | Carbohydrates | Fructose | 262% to 731% |
| 213812 | Carbohydrates | Carbohydrates | Galactose or Mannose | New |
| 213812 | Carbohydrates | Carbohydrates | Glucose | 203% to 1117% |
| 213812 | Phenols and Related Compounds | Phenylpropanes and Derivatives | Chlorogenic acid | 116% to 193% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213813

| Seq ID | Chemical Class | Biochemical Class | Compound Name | Modification |
|---|---|---|---|---|
| 213813 | Amino Acids and Related Compounds | Amino Acids and Related Compounds | Cysteine | New |
| 213813 | Amino Acids and Related Compounds | Amino Acids and Related Compounds | Glycine | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213814

| Seq ID | Chemical Class | Biochemical Class | Compound Name | Modification |
|---|---|---|---|---|
| 213814 | Acids - Hydroxy Alpha | Acid Pathway | Butanoic acid, 2,3,4-trihydroxy- | 144% to 241% |
| 213814 | Acids - Hydroxy Alpha | Acid Pathway | Citric acid | 69% to 115% |
| 213814 | Acids - Hydroxy Alpha | Carbohydrates | Glyceric acid | New |
| 213814 | Acids - Hydroxy Alpha | Acid Pathway | Malic acid | 60% to 100% |
| 213814 | Acids - Hydroxy Alpha | Carbohydrates | Quinic acid | 217% to 362% |
| 213814 | Alcohols | Carbohydrates | Inositol | 72% to 120% |
| 213814 | Alkaloids and Other Bases | Alkaloids and Other Bases | Nicotine | 148% to 246% |
| 213814 | Carbohydrates | Carbohydrates | F3-U0.813 Carbohydrate | New |
| 213814 | Carbohydrates | Carbohydrates | F3-U0.816 Carbohydrate | 236% to 394% |
| 213814 | Carbohydrates | Carbohydrates | F3-U0.821 Carbohydrate | 69% to 115% |
| 213814 | Carbohydrates | Carbohydrates | F3-U0.846 Carbohydrate | 744% to 1240% |
| 213814 | Carbohydrates | Carbohydrates | F3-U0.872 Hexose | 620% to 1034% |
| 213814 | Carbohydrates | Carbohydrates | Fructose | 132% to 220% |
| 213814 | Carbohydrates | Carbohydrates | Glucose | 216% to 523% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213816

| Seq ID | Chemical Class | Biochemical Class | Compound Name | Modification |
|---|---|---|---|---|
| 213816 | Acids - Fatty | Fatty Acids and Related Waxes | Octadecanoic acid | 60% to 130% |
| 213816 | Acids - Fatty Unsat | Fatty Acids and Related Waxes | 6-Octadecenoic acid | 60% to 87% |
| 213816 | Acids - Fatty Unsat | Fatty Acids and Related Waxes | 7,10,13-Docosatrienoic acid | 60% to 108% |
| 213816 | Acids - Fatty Unsat | Fatty Acids and Related Waxes | 7,10,13-Hexadecatrienoic acid | 60% to 150% |
| 213816 | Acids - Fatty Unsat | Fatty Acids and Related Waxes | 9-Hexadecenoic acid | 60% to 91% |
| 213816 | Amino Acids and Related Compounds | Amino Acids and Related Compounds | Alanine | 150% to 415% |
| 213816 | Amino Acids and Related Compounds | Amino Acids and Related Compounds | Glutamic acid | 60% to 110% |
| 213816 | Hydrocarbons | Hydrocarbons | Nonacosane, 3-methyl | New |
| 213816 | Sterols, Oxygenated Terpenes, and Other Isoprenoids | Prenylquinones | alpha-Tocopherol | 118% to 197% |
| 213816 | Sterols, Oxygenated Terpenes, and Other Isoprenoids | Terpenoids | beta-Sitosterol | 67% to 111% |
| 213816 | Sterols, Oxygenated Terpenes, and Other Isoprenoids | Prenylquinones | beta-Tocopherol | New |
| 213816 | Sterols, Oxygenated Terpenes, and Other Isoprenoids | Terpenoids | F1-U1.130 Sterol | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213817

| Seq ID | Chemical Class | Biochemical Class | Compound Name | Modification |
|---|---|---|---|---|
| 213817 | Acids - Hydroxy Alpha | Acid Pathway | Malic acid | 60% to 81% |
| 213817 | Carbohydrates | Carbohydrates | F3-U0.813 Carbohydrate | 364% to 607% |
| 213817 | Carbohydrates | Carbohydrates | F3-U0.816 Carbohydrate | 131% to 219% |
| 213817 | Carbohydrates | Carbohydrates | F3-U0.825 Carbohydrate | New |
| 213817 | Carbohydrates | Carbohydrates | F3-U0.846 Carbohydrate | 279% to 465% |
| 213817 | Carbohydrates | Carbohydrates | F3-U0.848 Carbohydrate | 117% to 195% |
| 213817 | Carbohydrates | Carbohydrates | F3-U0.872 Hexose | 264% to 440% |
| 213817 | Carbohydrates | Carbohydrates | Fructose | 141% to 353% |
| 213817 | Carbohydrates | Carbohydrates | Galactose or Mannose | 75% to 125% |
| 213817 | Carbohydrates | Carbohydrates | Glucose | 60% to 348% |
| 213817 | NA | NA | F3-U0.852A | 257% to 428% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213825

| Seq ID | Chemical Class | Biochemical Class | Compound Name | Modification |
|---|---|---|---|---|
| 213825 | Acids - Hydroxy | Amino Acids and Related Compounds | Shikimic acid | 91% to 152% |
| 213825 | Acids - Hydroxy Alpha | Acid Pathway | Butanoic acid, 2,3,4-trihydroxy- | 191% to 318% |
| 213825 | Acids - Hydroxy Alpha | Carbohydrates | Glyceric acid | New |
| 213825 | Acids - Hydroxy Alpha | Acid Pathway | Malic acid | 179% to 298% |
| 213825 | Acids - Hydroxy Alpha | Carbohydrates | Quinic acid | 97% to 161% |
| 213825 | Amino Acids and Related Compounds | Amino Acids and Related Compounds | Aspartic acid | 60% to 82% |
| 213825 | Amino Acids and Related Compounds | Amino Acids and Related Compounds | Glutamic acid | 60% to 75% |
| 213825 | Carbohydrates | Carbohydrates | F3-U0.813 Carbohydrate | 151% to 252% |
| 213825 | Carbohydrates | Carbohydrates | F3-U0.816 Carbohydrate | 91% to 152% |
| 213825 | Carbohydrates | Carbohydrates | F3-U0.825 Carbohydrate | New |
| 213825 | Carbohydrates | Carbohydrates | F3-U0.846 Carbohydrate | 218% to 364% |
| 213825 | Carbohydrates | Carbohydrates | F3-U0.848 Carbohydrate | 183% to 305% |
| 213825 | Carbohydrates | Carbohydrates | F3-U0.872 Hexose | 262% to 436% |
| 213825 | Carbohydrates | Carbohydrates | F3-U0.956 Carbohydrate | 60% to 93% |
| 213825 | Carbohydrates | Carbohydrates | Fructose | 60% to 145% |
| 213825 | Carbohydrates | Carbohydrates | Glucose | 70% to 116% |
| 213825 | Esters | Esters | F1-U1.119 Fatty Acid Ester | -60% to -89% |
| 213825 | NA | NA | F1-U1.117 | New |
| 213825 | NA | NA | F1-U1.156B | New |
| 213825 | NA | NA | F3-U0.751 | 117% to 196% |
| 213825 | NA | NA | F3-U0.843 | New |
| 213825 | NA | NA | F3-U0.852A | 219% to 365% |
| 213825 | Sterols, Oxygenated Terpenes, and Other Isoprenoids | Prenylquinones | alpha-Tocopherol | 103% to 172% |
| 213825 | Sterols, Oxygenated Terpenes, and Other Isoprenoids | Terpenoids | Cycloartenol | 329% to 548% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213826

| Seq ID | Chemical Class | Biochemical Class | Compound Name | Modification |
|---|---|---|---|---|
| 213826 | Amino Acids and Related Compounds | Amino Acids and Related Compounds | Cysteine | New |
| 213826 | Amino Acids and Related Compounds | Amino Acids and Related Compounds | Glycine | New |

FIG. 6 continued

A list of metabolite compounds present in altered levels relative to reference samples as charararacterized by gas chromatography, liquid chromatography, and/or mass spectrometry. This list corresponds to samples transfected with nucleic acid sequence, Seq ID#213827

| Seq ID | Chemical Class | Biochemical Class | Compound Name | Modification |
|---|---|---|---|---|
| 213827 | Acids | Acids | Carbamic acid | 134% to 248% |
| 213827 | Acids - Hydroxy Alpha | Acid Pathway | Malic acid | 108% to 179% |
| 213827 | Acids - Hydroxy Alpha | Carbohydrates | Quinic acid | 60% to 87% |
| 213827 | Carbohydrates | Carbohydrates | F3-U0.846 Carbohydrate | 127% to 212% |
| 213827 | Carbohydrates | Carbohydrates | F3-U0.848 Carbohydrate | 146% to 244% |
| 213827 | Carbohydrates | Carbohydrates | F3-U0.872 Hexose | 157% to 261% |
| 213827 | Carbohydrates | Carbohydrates | Fructose | 161% to 489% |
| 213827 | Carbohydrates | Carbohydrates | Galactose or Mannose | 134% to 223% |
| 213827 | Carbohydrates | Carbohydrates | Glucose | 177% to 726% |
| 213827 | NA | NA | F3-U0.882 | 60% to 96% |
| 213827 | NA | NA | F3-U1.229 | 72% to 120% |
| 213827 | NA | NA | F3-U1.253 | 87% to 145% |
| 213827 | NA | NA | F3-U1.255 | 105% to 175% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213829

| Seq ID | Chemical Class | Biochemical Class | Compound Name | Modification |
|---|---|---|---|---|
| 213829 | Acids - Hydroxy | Amino Acids and Related Compounds | Shikimic acid | 64% to 360% |
| 213829 | Acids - Hydroxy Alpha | Acid Pathway | Butanoic acid, 2,3,4-trihydroxy- | New |
| 213829 | Acids - Hydroxy Alpha | Acid Pathway | Citric acid | 176% to 294% |
| 213829 | Acids - Hydroxy Alpha | Acid Pathway | Malic acid | 74% to 124% |
| 213829 | Acids - Hydroxy Alpha | Carbohydrates | Quinic acid | 115% to 283% |
| 213829 | Alkaloids and Other Bases | Alkaloids and Other Bases | Nicotine | 60% to 91% |
| 213829 | Amino Acids and Related Compounds | Amino Acids and Related Compounds | Asparagine | New |
| 213829 | Amino Acids and Related Compounds | Amino Acids and Related Compounds | Glutamic acid | 117% to 195% |
| 213829 | Amino Acids and Related Compounds | Amino Acids and Related Compounds | Glutamine | New |
| 213829 | Amino Acids and Related Compounds | Amino Acids and Related Compounds | Proline, 5-oxo- | 61% to 85% |
| 213829 | Carbohydrates | Carbohydrates | F3-U0.813 Carbohydrate | New |
| 213829 | Carbohydrates | Carbohydrates | F3-U0.816 Carbohydrate | 216% to 360% |
| 213829 | Carbohydrates | Carbohydrates | F3-U0.821 Carbohydrate | 176% to 294% |
| 213829 | Carbohydrates | Carbohydrates | F3-U0.825 Carbohydrate | New |
| 213829 | Carbohydrates | Carbohydrates | F3-U0.846 Carbohydrate | 60% to 1407% |
| 213829 | Carbohydrates | Carbohydrates | F3-U0.848 Carbohydrate | 88% to 154% |
| 213829 | Carbohydrates | Carbohydrates | F3-U0.872 Hexose | 92% to 713% |
| 213829 | Carbohydrates | Carbohydrates | F3-U1.069 Carbohydrate | 68% to 114% |
| 213829 | Carbohydrates | Carbohydrates | F3-U1.104 Carbohydrate | New |
| 213829 | Carbohydrates | Carbohydrates | F3-U1.189 Carbohydrate | 67% to 112% |
| 213829 | Carbohydrates | Carbohydrates | F3-U1.194 Carbohydrate | 79% to 132% |
| 213829 | Carbohydrates | Carbohydrates | Fructose | 60% to 358% |
| 213829 | Carbohydrates | Carbohydrates | Galactose or Mannose | 203% to 339% |
| 213829 | Carbohydrates | Carbohydrates | Glucose | 60% to 595% |
| 213829 | Esters | Esters | F1-U1.120 Fatty Acid Ester | 61% to 101% |
| 213829 | Hydrocarbons | Hydrocarbons | Dotriacontane, 2-methyl- | 122% to 204% |
| 213829 | NA | NA | F3-U0.736 | 168% to 281% |
| 213829 | NA | NA | F3-U0.751 | 95% to 158% |
| 213829 | NA | NA | F3-U0.882 | 64% to 107% |
| 213829 | NA | NA | F3-U0.899 | 80% to 133% |
| 213829 | NA | NA | F3-U1.253 | 61% to 101% |
| 213829 | Sterols, Oxygenated Terpenes, and Other Isoprenoids | Prenylquinones | alpha-Tocopheral hydroquinone | 74% to 124% |
| 213829 | Sterols, Oxygenated Terpenes, and Other Isoprenoids | Terpenoids | F1-U1.130 Sterol | 60% to 95% |
| 213829 | Sterols, Oxygenated Terpenes, and Other Isoprenoids | Terpenoids | F1-U1.136 Sterol | 60% to 94% |
| 213829 | Sterols, Oxygenated Terpenes, and Other Isoprenoids | Terpenoids | Solanesol | 190% to 316% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213831

| Seq ID | Chemical Class | Biochemical Class | Compound Name | Modification |
|---|---|---|---|---|
| 213831 | Acids - Hydroxy | Amino Acids and Related Compounds | Shikimic acid | 79% to 131% |
| 213831 | Acids - Hydroxy Alpha | Acid Pathway | Butanoic acid, 2,3,4-trihydroxy- | New |
| 213831 | Acids - Hydroxy Alpha | Acid Pathway | Citric acid | 118% to 861% |
| 213831 | Acids - Hydroxy Alpha | Carbohydrates | Glyceric acid | New |
| 213831 | Acids - Hydroxy Alpha | Acid Pathway | Malic acid | 150% to 327% |
| 213831 | Amino Acids and Related Compounds | Amino Acids and Related Compounds | Asparagine | 155% to 258% |
| 213831 | Amino Acids and Related Compounds | Amino Acids and Related Compounds | Glutamic acid | New |
| 213831 | Amino Acids and Related Compounds | Amino Acids and Related Compounds | Proline | 60% to 96% |
| 213831 | Amino Acids and Related Compounds | Amino Acids and Related Compounds | Proline, 5-oxo- | 69% to 115% |
| 213831 | Carbohydrates | Carbohydrates | F3-U0.813 Carbohydrate | New |
| 213831 | Carbohydrates | Carbohydrates | F3-U0.816 Carbohydrate | New |
| 213831 | Carbohydrates | Carbohydrates | F3-U0.821 Carbohydrate | 339% to 861% |
| 213831 | Carbohydrates | Carbohydrates | F3-U0.825 Carbohydrate | New |
| 213831 | Carbohydrates | Carbohydrates | F3-U0.846 Carbohydrate | 449% to 1903% |
| 213831 | Carbohydrates | Carbohydrates | F3-U0.848 Carbohydrate | 349% to 581% |
| 213831 | Carbohydrates | Carbohydrates | F3-U0.872 Hexose | 256% to 914% |
| 213831 | Carbohydrates | Carbohydrates | F3-U1.150 Carbohydrate | 60% to 85% |
| 213831 | Carbohydrates | Carbohydrates | F3-U1.194 Carbohydrate | 60% to 82% |
| 213831 | Carbohydrates | Carbohydrates | Fructose | 321% to 706% |
| 213831 | Carbohydrates | Carbohydrates | Glucose | 60% to 1496% |
| 213831 | Hydrocarbons | Hydrocarbons | Isononacosane | 60% to 84% |
| 213831 | NA | NA | F3-U0.858 | New |
| 213831 | NA | NA | F3-U0.882 | 130% to 217% |
| 213831 | NA | NA | F3-U0.899 | 83% to 138% |
| 213831 | NA | NA | F3-U1.253 | 142% to 237% |
| 213831 | Sterols, Oxygenated Terpenes, and Other Isoprenoids | Prenylquinones | alpha-Tocopherol | 103% to 171% |
| 213831 | Sterols, Oxygenated Terpenes, and Other Isoprenoids | Prenylquinones | alpha-Tocopherol hydroquinone | 667% to 1111% |
| 213831 | Sterols, Oxygenated Terpenes, and Other Isoprenoids | Terpenoids | F1-U1.136 Sterol | 66% to 109% |
| 213831 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213832

| Seq ID | Chemical Class | Biochemical Class | Compound Name | Modification |
|---|---|---|---|---|
| 213832 | Acids - Hydroxy | Amino Acids and Related Compounds | Shikimic acid | New |
| 213832 | Acids - Hydroxy Alpha | Acid Pathway | Butanoic acid, 2,3,4-trihydroxy- | New |
| 213832 | Acids - Hydroxy Alpha | Acid Pathway | Citric acid | 432% to 720% |
| 213832 | Acids - Hydroxy Alpha | Acid Pathway | Malic acid | 60% to 304% |
| 213832 | Acids - Hydroxy Alpha | Carbohydrates | Quinic acid | 222% to 371% |
| 213832 | Carbohydrates | Carbohydrates | F3-U0.813 Carbohydrate | New |
| 213832 | Carbohydrates | Carbohydrates | F3-U0.816 Carbohydrate | 490% to 816% |
| 213832 | Carbohydrates | Carbohydrates | F3-U0.821 Carbohydrate | 432% to 720% |
| 213832 | Carbohydrates | Carbohydrates | F3-U0.825 Carbohydrate | New |
| 213832 | Carbohydrates | Carbohydrates | F3-U0.846 Carbohydrate | 1118% to 1863% |
| 213832 | Carbohydrates | Carbohydrates | F3-U0.848B Carbohydrate | 296% to 493% |
| 213832 | Carbohydrates | Carbohydrates | F3-U0.872 Hexose | 86% to 870% |
| 213832 | Carbohydrates | Carbohydrates | F3-U1.104 Carbohydrate | New |
| 213832 | Carbohydrates | Carbohydrates | F3-U1.113 Carbohydrate | New |
| 213832 | Carbohydrates | Carbohydrates | F3-U1.150 Carbohydrate | 60% to 91% |
| 213832 | Carbohydrates | Carbohydrates | F3-U1.189 Carbohydrate | 87% to 144% |
| 213832 | Carbohydrates | Carbohydrates | F3-U1.194 Carbohydrate | 123% to 205% |
| 213832 | Carbohydrates | Carbohydrates | Fructose | 107% to 804% |
| 213832 | Carbohydrates | Carbohydrates | Galactose or Mannose | 278% to 464% |
| 213832 | Carbohydrates | Carbohydrates | Glucose | 86% to 1495% |
| 213832 | NA | NA | F3-U0.736 | -60% to -92% |
| 213832 | NA | NA | F3-U0.852A | New |
| 213832 | NA | NA | F3-U0.882 | 79% to 132% |
| 213832 | NA | NA | F3-U1.253 | 80% to 134% |
| 213832 | NA | NA | F3-U1.255 | 60% to 173% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213836

| Seq ID | Chemical Class | Biochemical Class | Compound Name | Modification |
|---|---|---|---|---|
| 213836 | Acids - Fatty Branched | Fatty Acids and Related Waxes | Hexadecanoic acid, 14-methyl- | 67% to 115% |
| 213836 | Acids - Fatty Unsat | Fatty Acids and Related Waxes | 9-Octadecenoic acid | -79% to -87% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#213839

| Seq ID | Chemical Class | Biochemical Class | Compound Name | Modification |
|---|---|---|---|---|
| 213839 | Acids - Fatty Unsat | Fatty Acids and Related Waxes | 9,12-Octadecadienoic acid | 7% to 45% |
| 213839 | Acids - Fatty Unsat | Fatty Acids and Related Waxes | 9-Octadecenoic acid | 13% to 89% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213845

| Seq ID | Chemical Class | Biochemical Class | Compound Name | Modification |
|---|---|---|---|---|
| 213845 | Acids - Fatty | Fatty Acids and Related Waxes | Octadecanoic acid | 19% to 83% |
| 213845 | Acids - Fatty Unsat | Fatty Acids and Related Waxes | 9,12,15-Octadecatrienoic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213851

| Seq ID | Chemical Class | Biochemical Class | Compound Name | Modification |
|---|---|---|---|---|
| 213851 | Acids - Hydroxy Alpha | Carbohydrates | Glyceric acid | New |
| 213851 | Acids - Hydroxy Alpha | Acid Pathway | Malic acid | 119% to 199% |
| 213851 | Acids - Hydroxy Alpha | Carbohydrates | Quinic acid | 143% to 239% |
| 213851 | Amino Acids and Related Compounds | Amino Acids and Related Compounds | Glutamic acid | 60% to 78% |
| 213851 | Carbohydrates | Carbohydrates | F3-U0.825 Carbohydrate | 60% to 96% |
| 213851 | Carbohydrates | Carbohydrates | F3-U0.846 Carbohydrate | 85% to 141% |
| 213851 | Carbohydrates | Carbohydrates | F3-U0.848 Carbohydrate | 290% to 483% |
| 213851 | Carbohydrates | Carbohydrates | F3-U0.872 Hexose | 98% to 343% |
| 213851 | Carbohydrates | Carbohydrates | F3-U1.150 Carbohydrate | 60% to 311% |
| 213851 | Carbohydrates | Carbohydrates | F3-U1.194 Carbohydrate | 60% to 90% |
| 213851 | Carbohydrates | Carbohydrates | Fructose | 203% to 659% |
| 213851 | Carbohydrates | Carbohydrates | Galactose or Mannose | New |
| 213851 | Carbohydrates | Carbohydrates | Glucose | 201% to 973% |
| 213851 | NA | NA | F3-U0.882 | 140% to 233% |
| 213851 | NA | NA | F3-U1.253 | 69% to 115% |
| 213851 | NA | NA | F3-U1.255 | 71% to 118% |
| 213851 | Phenols and Related Compounds | Phenylpropanes and Derivatives | Chlorogenic acid | 60% to 78% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213858

| Seq ID | Chemical Class | Biochemical Class | Compound Name | Modification |
|---|---|---|---|---|
| 213858 | Aldehydes, Ketones and Quinones | Aldehydes, Ketones and Quinones | 3-Phytylmenadione | 313% to 522% |
| 213858 | Alkenes and Alkynes | Terpenoids | Limonene | 60% to 95% |
| 213858 | Sterols, Oxygenated Terpenes, and Other Isoprenoids | Prenylquinones | alpha-Tocopherol | New |
| 213858 | Sterols, Oxygenated Terpenes, and Other Isoprenoids | Prenylquinones | alpha-Tocopherol hydroquinone | 108% to 180% |
| 213858 | Sterols, Oxygenated Terpenes, and Other Isoprenoids | Prenylquinones | beta-Tocopherol | NQ |
| 213858 | Sterols, Oxygenated Terpenes, and Other Isoprenoids | Terpenoids | Cycloartenol | 66% to 109% |
| 213858 | Sterols, Oxygenated Terpenes, and Other Isoprenoids | Terpenoids | F1-U1.136 Sterol | 82% to 137% |
| 213858 | Sterols, Oxygenated Terpenes, and Other Isoprenoids | Terpenoids | F1-U1.145 Sterol | 70% to 269% |
| 213858 | Sterols, Oxygenated Terpenes, and Other Isoprenoids | Terpenoids | F1-U1.153 Sterol | 85% to 142% |
| 213858 | Sterols, Oxygenated Terpenes, and Other Isoprenoids | Prenylquinones | gamma-Tocopherol | New |
| 213858 | Sterols, Oxygenated Terpenes, and Other Isoprenoids | Terpenoids | Solanesol | 594% to 990% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213861

| Seq ID | Chemical Class | Biochemical Class | Compound Name | Modification |
|---|---|---|---|---|
| 213861 | Acids - Fatty | Fatty Acids and Related Waxes | Eicosanoic acid | 9% to 83% |
| 213861 | Acids - Fatty Unsat | Fatty Acids and Related Waxes | 9,12,15-Octadecatrienoic acid | -1% to -7% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213863

| Seq ID | Chemical Class | Biochemical Class | Compound Name | Modification |
|---|---|---|---|---|
| 213863 | Acids - Hydroxy Alpha | Acid Pathway | Malic acid | 79% to 131% |
| 213863 | Carbohydrates | Carbohydrates | F3-U0.846 Carbohydrate | 319% to 532% |
| 213863 | Carbohydrates | Carbohydrates | F3-U0.872 Hexose | 185% to 309% |
| 213863 | Carbohydrates | Carbohydrates | Fructose | 119% to 363% |
| 213863 | Carbohydrates | Carbohydrates | Galactose or Mannose | 97% to 162% |
| 213863 | Carbohydrates | Carbohydrates | Glucose | 142% to 459% |
| 213863 | NA | NA | F3-U1.253 | 66% to 111% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213868

| Seq ID | Chemical Class | Biochemical Class | Compound Name | Modification |
|---|---|---|---|---|
| 213868 | Amino Acids and Related Compounds | Amino Acids and Related Compounds | Arginine | 85% to 265% |
| 213868 | Amino Acids and Related Compounds | Amino Acids and Related Compounds | Threonine | 55% to 150% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213877

| Seq ID | Chemical Class | Biochemical Class | Compound Name | Modification |
|---|---|---|---|---|
| 213877 | Acids - Fatty | Fatty Acids and Related Waxes | Heptadecanoic acid | 146% to 243% |
| 213877 | Acids - Fatty | Fatty Acids and Related Waxes | Hexadecanoic acid | 60% to 86% |
| 213877 | Acids - Fatty | Fatty Acids and Related Waxes | Octadecanoic acid | 101% to 169% |
| 213877 | Acids - Fatty Branched | Fatty Acids and Related Waxes | Hexadecanoic acid, 14-methyl- | 60% to 98% |
| 213877 | Acids - Fatty Branched | Fatty Acids and Related Waxes | Octadecanoic acid, 17-methyl- | 60% to 254% |
| 213877 | Acids - Fatty Unsat | Fatty Acids and Related Waxes | 7,10-Hexadecadienoic acid | -60% to -84% |
| 213877 | Acids - Fatty Unsat | Fatty Acids and Related Waxes | 9,12-Octadecadienoic acid | 60% to 110% |
| 213877 | Acids - Fatty Unsat | Fatty Acids and Related Waxes | 9-Hexadecenoic acid | -60% to -70% |
| 213877 | Acids - Fatty Unsat | Fatty Acids and Related Waxes | 9-Octadecenoic acid | -60% to -81% |
| 213877 | Acids - Hydroxy Alpha | Acid Pathway | Citric acid | 118% to 1220% |
| 213877 | Acids - Hydroxy Alpha | Acid Pathway | Malic acid | 197% to 328% |
| 213877 | Acids - Hydroxy Alpha | Carbohydrates | Quinic acid | -63% to -100% |
| 213877 | Aldehydes, Ketones and Quinones | Aldehydes, Ketones and Quinones | 3-Phytylmenadione | 76% to 126% |
| 213877 | Amino Acids and Related Compounds | Amino Acids and Related Compounds | Asparagine | New |
| 213877 | Amino Acids and Related Compounds | Amino Acids and Related Compounds | Histidine | 125% to 425% |
| 213877 | Amino Acids and Related Compounds | Amino Acids and Related Compounds | Tyrosine | New |
| 213877 | Amino Acids and Related Compounds | Amino Acids and Related Compounds | Valine | 80% to 295% |
| 213877 | Carbohydrates | Carbohydrates | F3-U0.813 Carbohydrate | 164% to 273% |
| 213877 | Carbohydrates | Carbohydrates | F3-U0.816 Carbohydrate | 472% to 786% |
| 213877 | Carbohydrates | Carbohydrates | F3-U0.821 Carbohydrate | 118% to 1220% |
| 213877 | Carbohydrates | Carbohydrates | F3-U0.825 Carbohydrate | New |
| 213877 | Carbohydrates | Carbohydrates | F3-U0.846 Carbohydrate | 414% to 690% |
| 213877 | Carbohydrates | Carbohydrates | F3-U0.872 Hexose | 170% to 283% |
| 213877 | Carbohydrates | Carbohydrates | F3-U0.948 Carbohydrate | NQ |
| 213877 | Carbohydrates | Carbohydrates | Fructose | -60% to -88% |
| 213877 | Carbohydrates | Carbohydrates | Galactose or Mannose | -60% to -89% |
| 213877 | Carbohydrates | Carbohydrates | Glucose | -60% to -100% |
| 213877 | NA | NA | F1-U1.199 | New |
| 213877 | NA | NA | F3-U0.727 | 96% to 161% |
| 213877 | NA | NA | F3-U1.253 | 61% to 102% |
| 213877 | Sterols, Oxygenated Terpenes, and Other Isoprenoids | Prenylquinones | alpha-Tocopherol | 241% to 507% |
| 213877 | Sterols, Oxygenated Terpenes, and Other Isoprenoids | Terpenoids | beta-Sitosterol | 60% to 100% |
| 213877 | Sterols, Oxygenated Terpenes, and Other Isoprenoids | Prenylquinones | beta-Tocopherol | New |
| 213877 | Sterols, Oxygenated Terpenes, and Other Isoprenoids | Terpenoids | Cholest-7-en-3-ol | -60% to -77% |
| 213877 | Sterols, Oxygenated Terpenes, and Other Isoprenoids | Terpenoids | Cycloartenol | -60% to -79% |
| 213877 | Sterols, Oxygenated Terpenes, and Other Isoprenoids | Terpenoids | Ergosta-5,24-dien-3-ol | NQ |
| 213877 | Sterols, Oxygenated Terpenes, and Other Isoprenoids | Terpenoids | F1-U1.136 Sterol | 62% to 104% |
| 213877 | Sterols, Oxygenated Terpenes, and Other Isoprenoids | Terpenoids | F1-U1.153 Sterol | 135% to 232% |
| 213877 | Sterols, Oxygenated Terpenes, and Other Isoprenoids | Terpenoids | Fucosterol | 60% to 94% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213881

| Seq ID | Chemical Class | Biochemical Class | Compound Name | Modification |
|---|---|---|---|---|
| 213881 | Acids - Fatty | Fatty Acids and Related Waxes | Octadecanoic acid | -60% to -87% |
| 213881 | Acids - Hydroxy Alpha | Acid Pathway | Butanoic acid, 2,3,4-trihydroxy- | New |
| 213881 | Acids - Hydroxy Alpha | Acid Pathway | Malic acid | 240% to 400% |
| 213881 | Acids - Hydroxy Alpha | Carbohydrates | Quinic acid | 97% to 193% |
| 213881 | Alkaloids and Other Bases | Alkaloids and Other Bases | Nicotine | 131% to 219% |
| 213881 | Amino Acids and Related Compounds | Amino Acids and Related Compounds | Glutamic acid | 60% to 90% |
| 213881 | Amino Acids and Related Compounds | Amino Acids and Related Compounds | Proline | New |
| 213881 | Carbohydrates | Carbohydrates | F3-U0.813 Carbohydrate | New |
| 213881 | Carbohydrates | Carbohydrates | F3-U0.816 Carbohydrate | New |
| 213881 | Carbohydrates | Carbohydrates | F3-U0.821 Carbohydrate | 280% to 467% |
| 213881 | Carbohydrates | Carbohydrates | F3-U0.825 Carbohydrate | New |
| 213881 | Carbohydrates | Carbohydrates | F3-U0.846 Carbohydrate | 1069% to 1781% |
| 213881 | Carbohydrates | Carbohydrates | F3-U0.848 Carbohydrate | 106% to 176% |
| 213881 | Carbohydrates | Carbohydrates | F3-U0.872 Hexose | 65% to 806% |
| 213881 | Carbohydrates | Carbohydrates | Fructose | 60% to 469% |
| 213881 | Carbohydrates | Carbohydrates | Galactose or Mannose | 225% to 375% |
| 213881 | Carbohydrates | Carbohydrates | Glucose | 60% to 889% |
| 213881 | NA | NA | F3-U0.751 | 99% to 166% |
| 213881 | NA | NA | F3-U0.852A | New |
| 213881 | NA | NA | F3-U0.882 | 132% to 220% |
| 213881 | NA | NA | F3-U0.899 | 61% to 114% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213882

| Seq ID | Chemical Class | Biochemical Class | Compound Name | Modification |
|---|---|---|---|---|
| 213882 | Acids - Hydroxy Alpha | Acid Pathway | Butanoic acid, 2,3,4-trihydroxy- | 60% to 83% |
| 213882 | Acids - Hydroxy Alpha | Acid Pathway | Malic acid | 60% to 84% |
| 213882 | Acids - Hydroxy Alpha | Carbohydrates | Quinic acid | 95% to 159% |
| 213882 | Amino Acids and Related Compounds | Amino Acids and Related Compounds | Asparagine | New |
| 213882 | Amino Acids and Related Compounds | Amino Acids and Related Compounds | Aspartic acid | 60% to 240% |
| 213882 | Amino Acids and Related Compounds | Amino Acids and Related Compounds | Cysteine | 65% to 990% |
| 213882 | Amino Acids and Related Compounds | Amino Acids and Related Compounds | Glycine | 360% to 980% |
| 213882 | Amino Acids and Related Compounds | Amino Acids and Related Compounds | Histidine | 85% to 330% |
| 213882 | Amino Acids and Related Compounds | Amino Acids and Related Compounds | Lysine | 60% to 150% |
| 213882 | Amino Acids and Related Compounds | Amino Acids and Related Compounds | Threonine | 60% to 155% |
| 213882 | Carbohydrates | Carbohydrates | F3-U0.872 Hexose | 65% to 108% |
| 213882 | Carbohydrates | Carbohydrates | F3-U1.150 Carbohydrate | 60% to 84% |
| 213882 | Carbohydrates | Carbohydrates | F3-U1.189 Carbohydrate | 174% to 290% |
| 213882 | Carbohydrates | Carbohydrates | F3-U1.194 Carbohydrate | 112% to 186% |
| 213882 | Carbohydrates | Carbohydrates | Fructose | 60% to 88% |
| 213882 | Carbohydrates | Carbohydrates | Glucose | 60% to 192% |
| 213882 | NA | NA | F3-U0.736 | 213% to 355% |
| 213882 | NA | NA | F3-U0.899 | 92% to 153% |
| 213882 | Phenols and Related Compounds | Phenylpropanes and Derivatives | Chlorogenic acid | 163% to 272% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213889

| Seq ID | Chemical Class | Biochemical Class | Compound Name | Modification |
|---|---|---|---|---|
| 213889 | Acids - Hydroxy Alpha | Acid Pathway | Butanoic acid, 2,3,4-trihydroxy- | 228% to 380% |
| 213889 | Acids - Hydroxy Alpha | Acid Pathway | Malic acid | 108% to 180% |
| 213889 | Acids - Hydroxy Alpha | Carbohydrates | Quinic acid | 60% to 83% |
| 213889 | Amino Acids and Related Compounds | Amino Acids and Related Compounds | Glutamic acid | 113% to 188% |
| 213889 | Amino Acids and Related Compounds | Amino Acids and Related Compounds | Glutamine | New |
| 213889 | Carbohydrates | Carbohydrates | F3-U0.848 Carbohydrate | 164% to 274% |
| 213889 | Carbohydrates | Carbohydrates | F3-U1.189 Carbohydrate | 73% to 122% |
| 213889 | Carbohydrates | Carbohydrates | F3-U1.194 Carbohydrate | 75% to 124% |
| 213889 | NA | NA | F3-U0.882 | New |
| 213889 | NA | NA | F3-U1.229 | 60% to 95% |
| 213889 | Phenols and Related Compounds | Phenylpropanes and Derivatives | Chlorogenic acid | 74% to 124% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213894

| Seq ID | Chemical Class | Biochemical Class | Compound Name | Modification |
|---|---|---|---|---|
| 213894 | Acids - Hydroxy Alpha | Acid Pathway | Citric acid | 66% to 110% |
| 213894 | Acids - Hydroxy Alpha | Acid Pathway | Malic acid | 67% to 112% |
| 213894 | Amino Acids and Related Compounds | Amino Acids and Related Compounds | Alanine | 120% to 690% |
| 213894 | Amino Acids and Related Compounds | Amino Acids and Related Compounds | Cysteine | New |
| 213894 | Amino Acids and Related Compounds | Amino Acids and Related Compounds | Glutamic acid | New |
| 213894 | Amino Acids and Related Compounds | Amino Acids and Related Compounds | Glycine | New |
| 213894 | Amino Acids and Related Compounds | Amino Acids and Related Compounds | Isoleucine | New |
| 213894 | Amino Acids and Related Compounds | Amino Acids and Related Compounds | Proline, 5-oxo- | 60% to 78% |
| 213894 | Amino Acids and Related Compounds | Amino Acids and Related Compounds | Valine | 25% to 205% |
| 213894 | Carbohydrates | Carbohydrates | F3-U0.821 Carbohydrate | 66% to 110% |
| 213894 | Carbohydrates | Carbohydrates | Fructose | -60% to -100% |
| 213894 | Carbohydrates | Carbohydrates | Glucose | -62% to -100% |
| 213894 | NA | NA | F3-U0.882 | NQ |
| 213894 | NA | NA | F3-U1.253 | 74% to 123% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213895

| Seq ID | Chemical Class | Biochemical Class | Compound Name | Modification |
|---|---|---|---|---|
| 213895 | Acids - Hydroxy Alpha | Acid Pathway | Butanoic acid, 2,3,4-trihydroxy- | 123% to 205% |
| 213895 | Acids - Hydroxy Alpha | Acid Pathway | Malic acid | 75% to 124% |
| 213895 | Amino Acids and Related Compounds | Amino Acids and Related Compounds | Glutamic acid | 76% to 127% |
| 213895 | Carbohydrates | Carbohydrates | F3-U0.813 Carbohydrate | 260% to 434% |
| 213895 | Carbohydrates | Carbohydrates | F3-U0.816 Carbohydrate | 67% to 111% |
| 213895 | Carbohydrates | Carbohydrates | F3-U0.846 Carbohydrate | 229% to 382% |
| 213895 | Carbohydrates | Carbohydrates | F3-U0.848 Carbohydrate | 78% to 130% |
| 213895 | Carbohydrates | Carbohydrates | F3-U0.872 Hexose | 213% to 355% |
| 213895 | Carbohydrates | Carbohydrates | F3-U1.150 Carbohydrate | 60% to 95% |
| 213895 | Carbohydrates | Carbohydrates | Fructose | 102% to 223% |
| 213895 | Carbohydrates | Carbohydrates | Galactose or Mannose | 105% to 175% |
| 213895 | Carbohydrates | Carbohydrates | Glucose | 136% to 332% |
| 213895 | NA | NA | F3-U0.852A | 148% to 246% |
| 213895 | NA | NA | F3-U0.882 | 69% to 115% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213896

| Seq ID | Chemical Class | Biochemical Class | Compound Name | Modification |
|---|---|---|---|---|
| 213896 | Amino Acids and Related Compounds | Amino Acids and Related Compounds | Proline, 5-oxo- | 60% to 83% |
| 213896 | Carbohydrates | Carbohydrates | F3-U0.846 Carbohydrate | -60% to -94% |
| 213896 | Carbohydrates | Carbohydrates | F3-U0.848 Carbohydrate | 127% to 211% |
| 213896 | Carbohydrates | Carbohydrates | F3-U1.150 Carbohydrate | 60% to 80% |
| 213896 | Carbohydrates | Carbohydrates | Fructose | 177% to 455% |
| 213896 | Carbohydrates | Carbohydrates | Galactose or Mannose | 329% to 548% |
| 213896 | Carbohydrates | Carbohydrates | Glucose | 127% to 663% |
| 213896 | NA | NA | F3-U0.736 | 219% to 365% |
| 213896 | NA | NA | F3-U0.882 | 127% to 212% |
| 213896 | NA | NA | F3-U0.899 | 64% to 106% |
| 213896 | NA | NA | F3-U1.232 | 78% to 130% |
| 213896 | NA | NA | F3-U1.253 | 61% to 101% |
| 213896 | NA | NA | F3-U1.255 | 126% to 211% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213903

| Seq ID | Chemical Class | Biochemical Class | Compound Name | Modification |
|---|---|---|---|---|
| 213903 | Acids - Hydroxy Alpha | Acid Pathway | Citric acid | 60% to 86% |
| 213903 | Carbohydrates | Carbohydrates | F3-U0.821 Carbohydrate | 60% to 86% |
| 213903 | Carbohydrates | Carbohydrates | F3-U0.848 Carbohydrate | 69% to 115% |
| 213903 | Carbohydrates | Carbohydrates | F3-U1.189 Carbohydrate | 75% to 124% |
| 213903 | Carbohydrates | Carbohydrates | F3-U1.194 Carbohydrate | 110% to 184% |
| 213903 | Carbohydrates | Carbohydrates | Fructose | 88% to 218% |
| 213903 | Carbohydrates | Carbohydrates | Galactose or Mannose | 80% to 134% |
| 213903 | Carbohydrates | Carbohydrates | Glucose | 60% to 211% |
| 213903 | NA | NA | F3-U0.736 | 123% to 204% |
| 213903 | NA | NA | F3-U0.899 | 127% to 211% |
| 213903 | NA | NA | F3-U1.232 | 156% to 261% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213909

| Seq ID | Chemical Class | Biochemical Class | Compound Name | Modification |
|---|---|---|---|---|
| 213909 | Acids | Acids | Carbamic acid | NQ |
| 213909 | Acids - Hydroxy | Amino Acids and Related Compounds | Shikimic acid | 273% to 455% |
| 213909 | Acids - Hydroxy Alpha | Acid Pathway | Butanoic acid, 2,3,4-trihydroxy- | 171% to 286% |
| 213909 | Acids - Hydroxy Alpha | Acid Pathway | Citric acid | 60% to 430% |
| 213909 | Acids - Hydroxy Alpha | Acid Pathway | Malic acid | 84% to 222% |
| 213909 | Acids - Hydroxy Alpha | Carbohydrates | Quinic acid | 60% to 160% |
| 213909 | Amino Acids and Related Compounds | Amino Acids and Related Compounds | Aspartic acid | 98% to 163% |
| 213909 | Amino Acids and Related Compounds | Amino Acids and Related Compounds | Glutamic acid | 103% to 204% |
| 213909 | Amino Acids and Related Compounds | Amino Acids and Related Compounds | Proline | 90% to 171% |
| 213909 | Amino Acids and Related Compounds | Amino Acids and Related Compounds | Proline, 5-oxo- | 81% to 135% |
| 213909 | Carbohydrates | Carbohydrates | F3-U0.813 Carbohydrate | 60% to 599% |
| 213909 | Carbohydrates | Carbohydrates | F3-U0.816 Carbohydrate | 104% to 455% |
| 213909 | Carbohydrates | Carbohydrates | F3-U0.821 Carbohydrate | 60% to 430% |
| 213909 | Carbohydrates | Carbohydrates | F3-U0.825 Carbohydrate | New |
| 213909 | Carbohydrates | Carbohydrates | F3-U0.846 Carbohydrate | 146% to 2688% |
| 213909 | Carbohydrates | Carbohydrates | F3-U0.848 Carbohydrate | 79% to 131% |
| 213909 | Carbohydrates | Carbohydrates | F3-U0.872 Hexose | 175% to 938% |
| 213909 | Carbohydrates | Carbohydrates | F3-U1.150 Carbohydrate | 60% to 78% |
| 213909 | Carbohydrates | Carbohydrates | F3-U1.189 Carbohydrate | 60% to 87% |
| 213909 | Carbohydrates | Carbohydrates | F3-U1.194 Carbohydrate | 70% to 117% |
| 213909 | Carbohydrates | Carbohydrates | Fructose | 79% to 458% |
| 213909 | Carbohydrates | Carbohydrates | Galactose or Mannose | 80% to 133% |
| 213909 | Carbohydrates | Carbohydrates | Glucose | 183% to 578% |
| 213909 | NA | NA | F3-U0.843 | New |
| 213909 | NA | NA | F3-U0.852A | 99% to 309% |
| 213909 | NA | NA | F3-U0.899 | NQ |
| 213909 | NA | NA | F3-U1.229 | 161% to 268% |
| 213909 | Phenols and Related Compounds | Phenylpropanes and Derivatives | Chlorogenic acid | 71% to 119% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213914

| Seq ID | Chemical Class | Biochemical Class | Compound Name | Modification |
|---|---|---|---|---|
| 213914 | Acids - Fatty Unsat | Fatty Acids and Related Waxes | 9,12-Octadecadienoic acid | 60% to 63% |
| 213914 | Acids - Hydroxy Alpha | Acid Pathway | Citric acid | 179% to 298% |
| 213914 | Acids - Hydroxy Alpha | Acid Pathway | Malic acid | 142% to 237% |
| 213914 | Acids - Hydroxy Alpha | Carbohydrates | Quinic acid | -60% to -80% |
| 213914 | Amino Acids and Related Compounds | Amino Acids and Related Compounds | Alanine | 75% to 190% |
| 213914 | Amino Acids and Related Compounds | Amino Acids and Related Compounds | Cysteine | New |
| 213914 | Amino Acids and Related Compounds | Amino Acids and Related Compounds | Glycine | 80% to 325% |
| 213914 | Carbohydrates | Carbohydrates | F3-U0.821 Carbohydrate | 179% to 298% |
| 213914 | Carbohydrates | Carbohydrates | F3-U0.846 Carbohydrate | 488% to 814% |
| 213914 | Carbohydrates | Carbohydrates | F3-U0.872 Hexose | 155% to 258% |
| 213914 | Carbohydrates | Carbohydrates | F3-U0.952 Carbohydrate | -60% to -93% |
| 213914 | Carbohydrates | Carbohydrates | Fructose | -67% to -100% |
| 213914 | Carbohydrates | Carbohydrates | Glucose | -60% to -100% |
| 213914 | NA | NA | F3-U0.882 | -60% to -91% |
| 213914 | NA | NA | F3-U1.253 | -60% to -98% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213919

| Seq ID | Chemical Class | Biochemical Class | Compound Name | Modification |
|---|---|---|---|---|
| 213919 | Acids - Hydroxy Alpha | Acid Pathway | Butanoic acid, 2,3,4-trihydroxy- | 215% to 358% |
| 213919 | Acids - Hydroxy Alpha | Acid Pathway | Malic acid | 371% to 618% |
| 213919 | Amino Acids and Related Compounds | Amino Acids and Related Compounds | Glutamic acid | 79% to 132% |
| 213919 | Carbohydrates | Carbohydrates | F3-U0.813 Carbohydrate | New |
| 213919 | Carbohydrates | Carbohydrates | F3-U0.816 Carbohydrate | New |
| 213919 | Carbohydrates | Carbohydrates | F3-U0.821 Carbohydrate | 458% to 764% |
| 213919 | Carbohydrates | Carbohydrates | F3-U0.872 Hexose | 192% to 320% |
| 213919 | Carbohydrates | Carbohydrates | F3-U0.952 Carbohydrate | NQ |
| 213919 | Carbohydrates | Carbohydrates | Fructose | -67% to -100% |
| 213919 | Carbohydrates | Carbohydrates | Glucose | -60% to -100% |
| 213919 | NA | NA | F3-U1.253 | -60% to -95% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#213922

| Seq ID | Chemical Class | Biochemical Class | Compound Name | Modification |
|---|---|---|---|---|
| 213922 | Acids | Acid Pathway | Carbamic acid | 139% to 411% |
| 213922 | Acids - Hydroxy Alpha | | Malic acid | 60% to 78% |
| 213922 | Carbohydrates | Carbohydrates | F3-U0.848 Carbohydrate | 106% to 177% |
| 213922 | Carbohydrates | Carbohydrates | F3-U0.872 Hexose | 101% to 168% |
| 213922 | Carbohydrates | Carbohydrates | Fructose | 145% to 406% |
| 213922 | Carbohydrates | Carbohydrates | Galactose or Mannose | 208% to 346% |
| 213922 | Carbohydrates | Carbohydrates | Glucose | 158% to 596% |
| 213922 | NA | NA | F3-U0.882 | 78% to 130% |
| 213922 | NA | NA | F3-U1.253 | 60% to 86% |
| 213922 | NA | NA | F3-U1.255 | 68% to 113% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213923

| Seq ID | Chemical Class | Biochemical Class | Compound Name | Modification |
|---|---|---|---|---|
| 213923 | Acids - Hydroxy Alpha | Acid Pathway | Butanoic acid, 2,3,4-trihydroxy- | New |
| 213923 | Acids - Hydroxy Alpha | Acid Pathway | Malic acid | 75% to 125% |
| 213923 | Acids - Hydroxy Alpha | Carbohydrates | Quinic acid | 132% to 219% |
| 213923 | Amino Acids and Related Compounds | Amino Acids and Related Compounds | Proline, 5-oxo- | 70% to 117% |
| 213923 | Carbohydrates | Carbohydrates | F3-U0.813 Carbohydrate | New |
| 213923 | Carbohydrates | Carbohydrates | F3-U0.816 Carbohydrate | 86% to 143% |
| 213923 | Carbohydrates | Carbohydrates | F3-U0.846 Carbohydrate | 543% to 904% |
| 213923 | Carbohydrates | Carbohydrates | F3-U0.872 Hexose | 385% to 642% |
| 213923 | Carbohydrates | Carbohydrates | F3-U1.189 Carbohydrate | 90% to 150% |
| 213923 | Carbohydrates | Carbohydrates | F3-U1.194 Carbohydrate | 150% to 250% |
| 213923 | Carbohydrates | Carbohydrates | Fructose | 60% to 123% |
| 213923 | Carbohydrates | Carbohydrates | Glucose | 151% to 394% |
| 213923 | Phenols and Related Compounds | Phenylpropanes and Derivatives | Chlorogenic acid | 61% to 101% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213935

| Seq ID | Chemical Class | Biochemical Class | Compound Name | Modification |
|---|---|---|---|---|
| 213935 | Acids - Hydroxy Alpha | Acid Pathway | Citric acid | 74% to 123% |
| 213935 | Acids - Hydroxy Alpha | Carbohydrates | Quinic acid | 60% to 82% |
| 213935 | Carbohydrates | Carbohydrates | F3-U0.813 Carbohydrate | 99% to 165% |
| 213935 | Carbohydrates | Carbohydrates | F3-U0.816 Carbohydrate | 66% to 111% |
| 213935 | Carbohydrates | Carbohydrates | F3-U0.821 Carbohydrate | 74% to 123% |
| 213935 | Carbohydrates | Carbohydrates | F3-U0.825 Carbohydrate | 102% to 170% |
| 213935 | Carbohydrates | Carbohydrates | F3-U0.846 Carbohydrate | 131% to 219% |
| 213935 | Carbohydrates | Carbohydrates | F3-U0.872 Hexose | 152% to 254% |
| 213935 | Carbohydrates | Carbohydrates | Fructose | 76% to 144% |
| 213935 | Carbohydrates | Carbohydrates | Glucose | 137% to 286% |
| 213935 | NA | NA | F3-U0.843 | 303% to 505% |
| 213935 | NA | NA | F3-U0.852A | 144% to 240% |
| 213935 | NA | NA | F3-U1.229 | 60% to 90% |
| 213935 | NA | NA | F3-U1.253 | 60% to 82% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#213942

| Seq ID | Chemical Class | Biochemical Class | Compound Name | Modification |
|---|---|---|---|---|
| 213942 | Acids - Fatty Unsat | Fatty Acids and Related Waxes | 9,12,15-Octadecatrienoic acid | 60% to 81% |
| 213942 | Acids - Hydroxy Alpha | Acid Pathway | Malic acid | 60% to 455% |
| 213942 | Acids - Hydroxy Alpha | Carbohydrates | Quinic acid | 64% to 119% |
| 213942 | Amino Acids and Related Compounds | Amino Acids and Related Compounds | Glutamic acid | 108% to 180% |
| 213942 | Amino Acids and Related Compounds | Amino Acids and Related Compounds | Proline | 97% to 161% |
| 213942 | Carbohydrates | Carbohydrates | F3-U0.813 Carbohydrate | New |
| 213942 | Carbohydrates | Carbohydrates | F3-U0.821 Carbohydrate | 452% to 753% |
| 213942 | Carbohydrates | Carbohydrates | F3-U0.825 Carbohydrate | New |
| 213942 | Carbohydrates | Carbohydrates | F3-U0.846 Carbohydrate | 177% to 1300% |
| 213942 | Carbohydrates | Carbohydrates | F3-U0.872 Hexose | 161% to 588% |
| 213942 | Carbohydrates | Carbohydrates | F3-U1.189 Carbohydrate | 125% to 268% |
| 213942 | Carbohydrates | Carbohydrates | F3-U1.194 Carbohydrate | 99% to 341% |
| 213942 | Carbohydrates | Carbohydrates | Fructose | -60% to -83% |
| 213942 | Carbohydrates | Carbohydrates | Glucose | 73% to 121% |
| 213942 | NA | NA | F3-U0.736 | 60% to 169% |
| 213942 | NA | NA | F3-U0.852A | 96% to 160% |
| 213942 | NA | NA | F3-U0.899 | 60% to 76% |
| 213942 | Phenols and Related Compounds | Phenylpropanes and Derivatives | Chlorogenic acid | 99% to 197% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#213950 ||||
|---|---|---|---|
| Seq ID | Chemical Class | Biochemical Class | Compound Name | Modification |
| 213950 | Acids - Hydroxy | Amino Acids and Related Compounds | Shikimic acid | 90% to 149% |
| 213950 | Acids - Hydroxy Alpha | Acid Pathway | Butanoic acid, 2,3,4-trihydroxy- | 93% to 155% |
| 213950 | Acids - Hydroxy Alpha | Acid Pathway | Citric acid | 60% to 76% |
| 213950 | Acids - Hydroxy Alpha | Carbohydrates | Glyceric acid | New |
| 213950 | Acids - Hydroxy Alpha | Acid Pathway | Malic acid | 91% to 152% |
| 213950 | Acids - Hydroxy Alpha | Carbohydrates | Quinic acid | 116% to 193% |
| 213950 | Amino Acids and Related Compounds | Amino Acids and Related Compounds | Aspartic acid | 60% to 79% |
| 213950 | Amino Acids and Related Compounds | Amino Acids and Related Compounds | Proline | 131% to 219% |
| 213950 | Amino Acids and Related Compounds | Amino Acids and Related Compounds | Proline, 5-oxo- | 60% to 88% |
| 213950 | Carbohydrates | Carbohydrates | F3-U0.813 Carbohydrate | New |
| 213950 | Carbohydrates | Carbohydrates | F3-U0.816 Carbohydrate | 90% to 149% |
| 213950 | Carbohydrates | Carbohydrates | F3-U0.821 Carbohydrate | 60% to 76% |
| 213950 | Carbohydrates | Carbohydrates | F3-U0.846 Carbohydrate | 150% to 249% |
| 213950 | Carbohydrates | Carbohydrates | F3-U0.848 Carbohydrate | 60% to 107% |
| 213950 | Carbohydrates | Carbohydrates | F3-U0.872 Hexose | 147% to 245% |
| 213950 | Carbohydrates | Carbohydrates | F3-U1.189 Carbohydrate | 92% to 153% |
| 213950 | Carbohydrates | Carbohydrates | F3-U1.194 Carbohydrate | 93% to 155% |
| 213950 | Carbohydrates | Carbohydrates | Fructose | 60% to 173% |
| 213950 | Carbohydrates | Carbohydrates | Galactose or Mannose | 76% to 127% |
| 213950 | Carbohydrates | Carbohydrates | Glucose | 69% to 212% |
| 213950 | NA | NA | F3-U0.727 | 93% to 155% |
| 213950 | NA | NA | F3-U0.852A | 188% to 313% |
| 213950 | NA | NA | F3-U0.899 | 100% to 166% |
| 213950 | NA | NA | F3-U1.229 | 60% to 87% |
| 213950 | NA | NA | F3-U1.253 | 69% to 115% |
| 213950 | Phenols and Related Compounds | Phenylpropanes and Derivatives | Chlorogenic acid | 78% to 130% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#213951

| Seq ID | Chemical Class | Biochemical Class | Compound Name | Modification |
|---|---|---|---|---|
| 213951 | Acids - Hydroxy Alpha | Acid Pathway | Butanoic acid, 2,3,4-trihydroxy- | 142% to 237% |
| 213951 | Acids - Hydroxy Alpha | Acid Pathway | Malic acid | 103% to 172% |
| 213951 | Acids - Hydroxy Alpha | Carbohydrates | Quinic acid | 70% to 117% |
| 213951 | Carbohydrates | Carbohydrates | F3-U0.813 Carbohydrate | 109% to 181% |
| 213951 | Carbohydrates | Carbohydrates | F3-U0.816 Carbohydrate | 72% to 120% |
| 213951 | Carbohydrates | Carbohydrates | F3-U0.846 Carbohydrate | 145% to 242% |
| 213951 | Carbohydrates | Carbohydrates | F3-U0.872 Hexose | 139% to 232% |
| 213951 | Carbohydrates | Carbohydrates | F3-U1.194 Carbohydrate | 69% to 116% |
| 213951 | Carbohydrates | Carbohydrates | F3-U1.241 Carbohydrate | 70% to 117% |
| 213951 | NA | NA | F3-U0.736 | 76% to 127% |
| 213951 | NA | NA | F3-U0.852A | 130% to 217% |
| 213951 | NA | NA | F3-U1.228 | 66% to 109% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213958

| Seq ID | Chemical Class | Biochemical Class | Compound Name | Modification |
|---|---|---|---|---|
| 213958 | Acids | Acids | Carbamic acid | 216% to 360% |
| 213958 | Acids - Hydroxy Alpha | Acid Pathway | Butanoic acid, 2,3,4-trihydroxy- | 123% to 205% |
| 213958 | Amino Acids and Related Compounds | Amino Acids and Related Compounds | Asparagine | NQ |
| 213958 | Amino Acids and Related Compounds | Amino Acids and Related Compounds | Aspartic acid | 172% to 287% |
| 213958 | Amino Acids and Related Compounds | Amino Acids and Related Compounds | Proline, 5-oxo- | 60% to 80% |
| 213958 | Carbohydrates | Carbohydrates | F3-U0.813 Carbohydrate | New |
| 213958 | Carbohydrates | Carbohydrates | F3-U0.816 Carbohydrate | New |
| 213958 | Carbohydrates | Carbohydrates | F3-U0.821 Carbohydrate | 336% to 560% |
| 213958 | Carbohydrates | Carbohydrates | F3-U0.825 Carbohydrate | New |
| 213958 | Carbohydrates | Carbohydrates | F3-U0.846 Carbohydrate | 1963% to 3271% |
| 213958 | Carbohydrates | Carbohydrates | F3-U0.872 Hexose | 627% to 1044% |
| 213958 | Carbohydrates | Carbohydrates | Fructose | -60% to -78% |
| 213958 | Carbohydrates | Carbohydrates | Glucose | -60% to -78% |
| 213958 | Carbohydrates | Carbohydrates | Sucrose | 68% to 113% |
| 213958 | NA | NA | F3-U0.727 | 150% to 250% |
| 213958 | NA | NA | F3-U1.253 | -60% to -96% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213962

| Seq ID | Chemical Class | Biochemical Class | Compound Name | Modification |
|---|---|---|---|---|
| 213962 | Acids - Hydroxy Alpha | Acid Pathway | Butanoic acid, 2,3,4-trihydroxy- | 111% to 185% |
| 213962 | Acids - Hydroxy Alpha | Acid Pathway | Citric acid | 71% to 118% |
| 213962 | Acids - Hydroxy Alpha | Acid Pathway | Malic acid | 110% to 184% |
| 213962 | Acids - Hydroxy Alpha | Carbohydrates | Quinic acid | 139% to 232% |
| 213962 | Amino Acids and Related Compounds | Amino Acids and Related Compounds | Proline | 94% to 156% |
| 213962 | Amino Acids and Related Compounds | Amino Acids and Related Compounds | Threonine | 60% to 295% |
| 213962 | Carbohydrates | Carbohydrates | F3-U0.821 Carbohydrate | 71% to 118% |
| 213962 | Carbohydrates | Carbohydrates | F3-U0.825 Carbohydrate | 93% to 155% |
| 213962 | Carbohydrates | Carbohydrates | F3-U0.846 Carbohydrate | 162% to 269% |
| 213962 | Carbohydrates | Carbohydrates | F3-U0.872 Hexose | 182% to 303% |
| 213962 | Carbohydrates | Carbohydrates | Glucose | 118% to 257% |
| 213962 | NA | NA | F3-U0.852A | 62% to 103% |
| 213962 | Phenols and Related Compounds | Phenylpropanes and Derivatives | Chlorogenic acid | 60% to 77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#213967

| Seq ID | Chemical Class | Biochemical Class | Compound Name | Modification |
|---|---|---|---|---|
| 213967 | Acids | Acids | Carbamic acid | 161% to 393% |
| 213967 | Acids - Hydroxy Alpha | Acid Pathway | Butanoic acid, 2,3,4-trihydroxy- | 210% to 349% |
| 213967 | Acids - Hydroxy Alpha | Acid Pathway | Citric acid | 352% to 586% |
| 213967 | Acids - Hydroxy Alpha | Acid Pathway | Malic acid | 211% to 352% |
| 213967 | Amino Acids and Related Compounds | Amino Acids and Related Compounds | Glutamic acid | 77% to 129% |
| 213967 | Amino Acids and Related Compounds | Amino Acids and Related Compounds | Proline | 97% to 162% |
| 213967 | Amino Acids and Related Compounds | Amino Acids and Related Compounds | Proline, 5-oxo- | 65% to 109% |
| 213967 | Carbohydrates | Carbohydrates | F3-U0.813 Carbohydrate | New |
| 213967 | Carbohydrates | Carbohydrates | F3-U0.816 Carbohydrate | 512% to 853% |
| 213967 | Carbohydrates | Carbohydrates | F3-U0.821 Carbohydrate | 352% to 586% |
| 213967 | Carbohydrates | Carbohydrates | F3-U0.825 Carbohydrate | New |
| 213967 | Carbohydrates | Carbohydrates | F3-U0.846 Carbohydrate | 2559% to 4265% |
| 213967 | Carbohydrates | Carbohydrates | F3-U0.872 Hexose | 854% to 1424% |
| 213967 | Carbohydrates | Carbohydrates | F3-U1.150 Carbohydrate | 60% to 96% |
| 213967 | Carbohydrates | Carbohydrates | Fructose | 92% to 153% |
| 213967 | Carbohydrates | Carbohydrates | Glucose | 110% to 263% |
| 213967 | NA | NA | F3-U0.736 | New |
| 213967 | Phenols and Related Compounds | Phenylpropanes and Derivatives | Chlorogenic acid | 60% to 89% |

FIG. 6 continued

A list of metabolite compounds present in altered levels relative to reference samples as charararacterized by gas chromatography, liquid chromatography, and/or mass spectrometry. This list corresponds to samples transfected with nucleic acid sequence, Seq ID#213981

| Seq ID | Chemical Class | Biochemical Class | Compound Name | Modification |
|---|---|---|---|---|
| 213981 | Sterols, Oxygenated Terpenes, and Other Isoprenoids | Prenylquinones | beta-Tocopherol | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#213983

| Seq ID | Chemical Class | Biochemical Class | Compound Name | Modification |
|---|---|---|---|---|
| 213983 | Amino Acids and Related Compounds | Amino Acids and Related Compounds | Alanine | 280% to 1090% |
| 213983 | Amino Acids and Related Compounds | Amino Acids and Related Compounds | Isoleucine | New |
| 213983 | Amino Acids and Related Compounds | Amino Acids and Related Compounds | Phenylalanine | New |
| 213983 | Amino Acids and Related Compounds | Amino Acids and Related Compounds | Serine | 60% to 235% |
| 213983 | Amino Acids and Related Compounds | Amino Acids and Related Compounds | Tyrosine | New |
| 213983 | Amino Acids and Related Compounds | Amino Acids and Related Compounds | Valine | 90% to 470% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214001

| Seq ID | Chemical Class | Biochemical Class | Compound Name | Modification |
|---|---|---|---|---|
| 214001 | Acids - Hydroxy Alpha | Acid Pathway | Butanoic acid, 2,3,4-trihydroxy- | 185% to 308% |
| 214001 | Acids - Hydroxy Alpha | Acid Pathway | Citric acid | 164% to 274% |
| 214001 | Acids - Hydroxy Alpha | Carbohydrates | Quinic acid | 97% to 161% |
| 214001 | Alkaloids and Other Bases | Polyamines | 1,4-Butanediamine | 105% to 175% |
| 214001 | Amino Acids and Related Compounds | Amino Acids and Related Compounds | Aspartic acid | 70% to 116% |
| 214001 | Amino Acids and Related Compounds | Amino Acids and Related Compounds | Glutamic acid | New |
| 214001 | Carbohydrates | Carbohydrates | F3-U0.813 Carbohydrate | 522% to 870% |
| 214001 | Carbohydrates | Carbohydrates | F3-U0.816 Carbohydrate | 148% to 246% |
| 214001 | Carbohydrates | Carbohydrates | F3-U0.821 Carbohydrate | 164% to 274% |
| 214001 | Carbohydrates | Carbohydrates | F3-U0.825 Carbohydrate | 290% to 483% |
| 214001 | Carbohydrates | Carbohydrates | F3-U0.846 Carbohydrate | 274% to 457% |
| 214001 | Carbohydrates | Carbohydrates | F3-U0.848 Carbohydrate | 167% to 279% |
| 214001 | Carbohydrates | Carbohydrates | F3-U0.872 Hexose | 300% to 500% |
| 214001 | Carbohydrates | Carbohydrates | Fructose | 624% to 1201% |
| 214001 | Carbohydrates | Carbohydrates | Glucose | 736% to 2019% |
| 214001 | NA | NA | F3-U0.751 | 643% to 1071% |
| 214001 | NA | NA | F3-U0.852A | New |
| 214001 | NA | NA | F3-U0.882 | New |
| 214001 | NA | NA | F3-U1.253 | 60% to 90% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214003

| Seq ID | Chemical Class | Biochemical Class | Compound Name | Modification |
|---|---|---|---|---|
| 214003 | Acids - Hydroxy Alpha | Carbohydrates | Glyceric acid | New |
| 214003 | Acids - Hydroxy Alpha | Carbohydrates | Quinic acid | 94% to 157% |
| 214003 | Carbohydrates | Carbohydrates | F3-U0.813 Carbohydrate | 60% to 89% |
| 214003 | Carbohydrates | Carbohydrates | F3-U0.846 Carbohydrate | 60% to 97% |
| 214003 | Carbohydrates | Carbohydrates | F3-U0.848B Carbohydrate | 63% to 104% |
| 214003 | Carbohydrates | Carbohydrates | F3-U0.872 Hexose | 88% to 146% |
| 214003 | Carbohydrates | Carbohydrates | F3-U0.952 Carbohydrate | 148% to 246% |
| 214003 | Carbohydrates | Carbohydrates | F3-U1.143 Carbohydrate | 123% to 205% |
| 214003 | Carbohydrates | Carbohydrates | F3-U1.150 Carbohydrate | 60% to 100% |
| 214003 | Carbohydrates | Carbohydrates | F3-U1.189 Carbohydrate | 78% to 131% |
| 214003 | Carbohydrates | Carbohydrates | Fructose | 204% to 377% |
| 214003 | Carbohydrates | Carbohydrates | Glucose | 234% to 676% |
| 214003 | NA | NA | F3-U0.736 | 161% to 268% |
| 214003 | NA | NA | F3-U0.843 | New |
| 214003 | NA | NA | F3-U0.852A | 60% to 84% |
| 214003 | NA | NA | F3-U0.882 | 183% to 305% |
| 214003 | NA | NA | F3-U0.899 | 74% to 123% |
| 214003 | NA | NA | F3-U1.172 | 243% to 405% |
| 214003 | Phenols and Related Compounds | Phenylpropanes and Derivatives | Chlorogenic acid | 60% to 92% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214010

| Seq ID | Chemical Class | Biochemical Class | Compound Name | Modification |
|---|---|---|---|---|
| 214010 | Acids - Hydroxy Alpha | Acid Pathway | Butanoic acid, 2,3,4-trihydroxy- | -60% to -89% |
| 214010 | Carbohydrates | Carbohydrates | F3-U0.813 Carbohydrate | 62% to 104% |
| 214010 | Carbohydrates | Carbohydrates | F3-U0.872 Hexose | 60% to 99% |
| 214010 | Carbohydrates | Carbohydrates | Fructose | 261% to 482% |
| 214010 | Carbohydrates | Carbohydrates | Glucose | 232% to 658% |
| 214010 | NA | NA | F3-U0.843 | New |
| 214010 | NA | NA | F3-U0.882 | 225% to 375% |
| 214010 | NA | NA | F3-U0.899 | 83% to 138% |
| 214010 | NA | NA | F3-U1.253 | 60% to 82% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214014

| Seq ID | Chemical Class | Biochemical Class | Compound Name | Modification |
|---|---|---|---|---|
| 214014 | Alkenes and Alkynes | Terpenoids | Limonene | 127% to 211% |
| 214014 | Esters | Esters | F1-U1.076 Fatty Acid Ester | 60% to 89% |
| 214014 | Esters | Esters | F1-U1.078 Fatty Acid Ester | 104% to 174% |
| 214014 | NA | NA | F1-U1.156B | New |
| 214014 | Sterols, Oxygenated Terpenes, and Other Isoprenoids | Prenylquinones | alpha-Tocopherol | 60% to 88% |
| 214014 | Sterols, Oxygenated Terpenes, and Other Isoprenoids | Prenylquinones | alpha-Tocopherol hydroquinone | 60% to 97% |
| 214014 | Sterols, Oxygenated Terpenes, and Other Isoprenoids | Terpenoids | Cycloartanol, 24-methylene- | New |
| 214014 | Sterols, Oxygenated Terpenes, and Other Isoprenoids | Terpenoids | Cycloartenol | 83% to 138% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214017

| Seq ID | Chemical Class | Biochemical Class | Compound Name | Modification |
|---|---|---|---|---|
| 214017 | Amino Acids and Related Compounds | Amino Acids and Related Compounds | Arginine | 30% to 520% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214023

| Seq ID | Chemical Class | Biochemical Class | Compound Name | Modification |
|---|---|---|---|---|
| 214023 | Acids | Acids | Carbamic acid | 60% to 95% |
| 214023 | Acids - Hydroxy Alpha | Carbohydrates | Quinic acid | -62% to -100% |
| 214023 | Alcohols | Carbohydrates | Inositol | -60% to -77% |
| 214023 | Amino Acids and Related Compounds | Amino Acids and Related Compounds | Aspartic acid | -60% to -81% |
| 214023 | Amino Acids and Related Compounds | Amino Acids and Related Compounds | Proline | NQ |
| 214023 | Carbohydrates | Carbohydrates | F3-U0.816 Carbohydrate | -64% to -100% |
| 214023 | Carbohydrates | Carbohydrates | F3-U0.821 Carbohydrate | NQ |
| 214023 | Carbohydrates | Carbohydrates | F3-U0.825 Carbohydrate | NQ |
| 214023 | Carbohydrates | Carbohydrates | F3-U0.846 Carbohydrate | -67% to -100% |
| 214023 | Carbohydrates | Carbohydrates | F3-U0.872 Hexose | -66% to -100% |
| 214023 | Carbohydrates | Carbohydrates | Fructose | -71% to -100% |
| 214023 | Carbohydrates | Carbohydrates | Glucose | NQ |
| 214023 | NA | NA | F3-U0.751 | -60% to -83% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214047

| Seq ID | Chemical Class | Biochemical Class | Compound Name | Modification |
|---|---|---|---|---|
| 214047 | Acids - Hydroxy Alpha | Acid Pathway | Butanoic acid, 2,3,4-trihydroxy- | 585% to 975% |
| 214047 | Acids - Hydroxy Alpha | Acid Pathway | Citric acid | 98% to 164% |
| 214047 | Amino Acids and Related Compounds | Amino Acids and Related Compounds | Glutamic acid | New |
| 214047 | Carbohydrates | Carbohydrates | F3-U0.813 Carbohydrate | 60% to 76% |
| 214047 | Carbohydrates | Carbohydrates | F3-U0.821 Carbohydrate | 98% to 164% |
| 214047 | Carbohydrates | Carbohydrates | F3-U0.825 Carbohydrate | 60% to 93% |
| 214047 | Carbohydrates | Carbohydrates | F3-U0.846 Carbohydrate | 71% to 118% |
| 214047 | Carbohydrates | Carbohydrates | F3-U0.872 Hexose | 72% to 120% |
| 214047 | Carbohydrates | Carbohydrates | Fructose | -60% to -99% |
| 214047 | Carbohydrates | Carbohydrates | Glucose | -60% to -86% |
| 214047 | NA | NA | F3-U0.751 | 124% to 207% |
| 214047 | NA | NA | F3-U1.229 | 209% to 349% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214052

| Seq ID | Chemical Class | Biochemical Class | Compound Name | Modification |
|---|---|---|---|---|
| 214052 | Alkaloids and Other Bases | Polyamines | 1,4-Butanediamine | 115% to 191% |
| 214052 | Amino Acids and Related Compounds | Amino Acids and Related Compounds | Aspartic acid | 60% to 91% |
| 214052 | Amino Acids and Related Compounds | Amino Acids and Related Compounds | Glutamic acid | New |
| 214052 | Carbohydrates | Carbohydrates | F3-U0.821 Carbohydrate | -60% to -93% |
| 214052 | Carbohydrates | Carbohydrates | F3-U1.113 Carbohydrate | -60% to -80% |
| 214052 | Carbohydrates | Carbohydrates | F3-U1.189 Carbohydrate | 60% to 99% |
| 214052 | Carbohydrates | Carbohydrates | Fructose | 811% to 1509% |
| 214052 | Carbohydrates | Carbohydrates | Galactose or Mannose | New |
| 214052 | Carbohydrates | Carbohydrates | Glucose | 693% to 1892% |
| 214052 | NA | NA | F3-U0.882 | New |
| 214052 | NA | NA | F3-U1.228 | 60% to 100% |
| 214052 | NA | NA | F3-U1.253 | 100% to 166% |
| 214052 | NA | NA | F3-U1.255 | 87% to 145% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214087

| Seq ID | Chemical Class | Biochemical Class | Compound Name | Modification |
|---|---|---|---|---|
| 214087 | Acids - Hydroxy Alpha | Acid Pathway | Butanoic acid, 2,3,4-trihydroxy- | -60% to -94% |
| 214087 | Acids - Hydroxy Alpha | Carbohydrates | Quinic acid | -67% to -100% |
| 214087 | Alcohols | Carbohydrates | Inositol | -60% to -95% |
| 214087 | Alkaloids and Other Bases | Polyamines | 1,4-Butanediamine | NQ |
| 214087 | Amino Acids and Related Compounds | Amino Acids and Related Compounds | Glycine | New |
| 214087 | Carbohydrates | Carbohydrates | F3-U0.813 Carbohydrate | -67% to -100% |
| 214087 | Carbohydrates | Carbohydrates | F3-U0.816 Carbohydrate | -60% to -90% |
| 214087 | Carbohydrates | Carbohydrates | F3-U0.825 Carbohydrate | -60% to -95% |
| 214087 | Carbohydrates | Carbohydrates | F3-U0.846 Carbohydrate | -60% to -97% |
| 214087 | Carbohydrates | Carbohydrates | F3-U0.848 Carbohydrate | -65% to -100% |
| 214087 | Carbohydrates | Carbohydrates | F3-U0.872 Hexose | -60% to -99% |
| 214087 | Carbohydrates | Carbohydrates | F3-U0.952 Carbohydrate | NQ |
| 214087 | Carbohydrates | Carbohydrates | Fructose | -70% to -100% |
| 214087 | Carbohydrates | Carbohydrates | Glucose | -69% to -100% |
| 214087 | NA | NA | F3-U0.740 | 60% to 98% |
| 214087 | NA | NA | F3-U0.751 | -60% to -96% |
| 214087 | NA | NA | F3-U0.791 | NQ |
| 214087 | NA | NA | F3-U1.253 | -60% to -78% |
| 214087 | NA | NA | F3-U1.255 | -61% to -100% |
| 214087 | Phenols and Related Compounds | Phenylpropanes and Derivatives | Chlorogenic acid | -60% to -78% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214105

| Seq ID | Chemical Class | Biochemical Class | Compound Name | Modification |
|---|---|---|---|---|
| 214105 | Acids - Hydroxy Alpha | Acid Pathway | Butanoic acid, 2,3,4-trihydroxy- | NQ |
| 214105 | Acids - Hydroxy Alpha | Acid Pathway | Citric acid | 195% to 325% |
| 214105 | Alcohols | Carbohydrates | Inositol | -60% to -75% |
| 214105 | Amino Acids and Related Compounds | Amino Acids and Related Compounds | Glutamic acid | New |
| 214105 | Amino Acids and Related Compounds | Amino Acids and Related Compounds | Glycine | New |
| 214105 | Amino Acids and Related Compounds | Amino Acids and Related Compounds | Proline, 5-oxo- | 68% to 133% |
| 214105 | Carbohydrates | Carbohydrates | F3-U0.813 Carbohydrate | 231% to 386% |
| 214105 | Carbohydrates | Carbohydrates | F3-U0.816 Carbohydrate | 166% to 276% |
| 214105 | Carbohydrates | Carbohydrates | F3-U0.821 Carbohydrate | 195% to 325% |
| 214105 | Carbohydrates | Carbohydrates | F3-U0.825 Carbohydrate | 163% to 272% |
| 214105 | Carbohydrates | Carbohydrates | F3-U0.846 Carbohydrate | 106% to 176% |
| 214105 | Carbohydrates | Carbohydrates | F3-U0.872 Hexose | 91% to 151% |
| 214105 | Carbohydrates | Carbohydrates | F3-U1.189 Carbohydrate | 154% to 257% |
| 214105 | Carbohydrates | Carbohydrates | F3-U1.194 Carbohydrate | 60% to 99% |
| 214105 | NA | NA | F3-U0.634 | 118% to 197% |
| 214105 | NA | NA | F3-U0.736 | -60% to -84% |
| 214105 | NA | NA | F3-U0.751 | 229% to 381% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214110

| Seq ID | Chemical Class | Biochemical Class | Compound Name | Modification |
|---|---|---|---|---|
| 214110 | Acids - Hydroxy Alpha | Acid Pathway | Butanoic acid, 2,3,4-trihydroxy- | 107% to 178% |
| 214110 | Acids - Hydroxy Alpha | Carbohydrates | Quinic acid | 72% to 120% |
| 214110 | Alkaloids and Other Bases | Alkaloids and Other Bases | Nicotine | 239% to 399% |
| 214110 | Amino Acids and Related Compounds | Amino Acids and Related Compounds | Glutamic acid | NQ |
| 214110 | Amino Acids and Related Compounds | Amino Acids and Related Compounds | Proline, 5-oxo- | -60% to -80% |
| 214110 | Carbohydrates | Carbohydrates | F3-U0.813 Carbohydrate | -60% to -100% |
| 214110 | Carbohydrates | Carbohydrates | F3-U0.816 Carbohydrate | -60% to -81% |
| 214110 | Carbohydrates | Carbohydrates | F3-U0.848 Carbohydrate | 71% to 119% |
| 214110 | Carbohydrates | Carbohydrates | Fructose | -65% to -100% |
| 214110 | Carbohydrates | Carbohydrates | Glucose | -61% to -100% |
| 214110 | Esters | Esters | F1-U1.078 Fatty Acid Ester | 76% to 127% |
| 214110 | NA | NA | F3-U0.727 | -60% to -76% |
| 214110 | Phenols and Related Compounds | Phenylpropanes and Derivatives | Chlorogenic acid | NQ |
| 214110 | Sterols, Oxygenated Terpenes, and Other Isoprenoids | Terpenoids | Cycloartenol | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214117

| Seq ID | Chemical Class | Biochemical Class | Compound Name | Modification |
|---|---|---|---|---|
| 214117 | Acids - Hydroxy Alpha | Acid Pathway | Butanoic acid, 2,3,4-trihydroxy- | 130% to 216% |
| 214117 | Acids - Hydroxy Alpha | Acid Pathway | Citric acid | 73% to 122% |
| 214117 | Acids - Hydroxy Alpha | Carbohydrates | Glyceric acid | New |
| 214117 | Acids - Hydroxy Alpha | Acid Pathway | Malic acid | 60% to 80% |
| 214117 | Alkaloids and Other Bases | Alkaloids and Other Bases | Nicotine | 138% to 230% |
| 214117 | Carbohydrates | Carbohydrates | F3-U0.821 Carbohydrate | 73% to 122% |
| 214117 | Carbohydrates | Carbohydrates | F3-U1.189 Carbohydrate | 60% to 79% |
| 214117 | Esters | Esters | F1-U1.078 Fatty Acid Ester | 60% to 75% |
| 214117 | Sterols, Oxygenated Terpenes, and Other Isoprenoids | Terpenoids | Cycloartenol | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214135

| Seq ID | Chemical Class | Biochemical Class | Compound Name | Modification |
|--------|----------------|-------------------|---------------|--------------|
| 214135 | Carbohydrates | Carbohydrates | F3-U0.821 Carbohydrate | 60% to 100% |
| 214135 | Carbohydrates | Carbohydrates | F3-U1.118 Carbohydrate | 133% to 222% |
| 214135 | Carbohydrates | Carbohydrates | Glucose | 4547% to 7578% |
| 214135 | NA | NA | F3-U0.751 | -60% to -76% |
| 214135 | NA | NA | F3-U1.229 | 94% to 157% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214138

| Seq ID | Chemical Class | Biochemical Class | Compound Name | Modification |
|---|---|---|---|---|
| 214138 | Acids - Fatty Unsat | Fatty Acids and Related Waxes | 9,12,15-Octadecatrienoic acid | 149% to 248% |
| 214138 | Acids - Hydroxy | Amino Acids and Related Compounds | Shikimic acid | 60% to 99% |
| 214138 | Acids - Hydroxy Alpha | Acid Pathway | Butanoic acid, 2,3,4-trihydroxy- | 138% to 229% |
| 214138 | Acids - Hydroxy Alpha | Acid Pathway | Citric acid | 155% to 258% |
| 214138 | Acids - Hydroxy Alpha | Carbohydrates | Glyceric acid | New |
| 214138 | Acids - Hydroxy Alpha | Carbohydrates | Quinic acid | 60% to 179% |
| 214138 | Alkaloids and Other Bases | Polyamines | 1,4-Butanediamine | 60% to 99% |
| 214138 | Alkaloids and Other Bases | Alkaloids and Other Bases | Nicotine | 141% to 235% |
| 214138 | Amino Acids and Related Compounds | Amino Acids and Related Compounds | Aspartic acid | 76% to 127% |
| 214138 | Amino Acids and Related Compounds | Amino Acids and Related Compounds | Glutamic acid | New |
| 214138 | Amino Acids and Related Compounds | Amino Acids and Related Compounds | Glycine | New |
| 214138 | Amino Acids and Related Compounds | Amino Acids and Related Compounds | Proline | 63% to 104% |
| 214138 | Amino Acids and Related Compounds | Amino Acids and Related Compounds | Proline, 5-oxo- | 60% to 81% |
| 214138 | Carbohydrates | Carbohydrates | F3-U0.813 Carbohydrate | 70% to 117% |
| 214138 | Carbohydrates | Carbohydrates | F3-U0.816 Carbohydrate | 60% to 99% |
| 214138 | Carbohydrates | Carbohydrates | F3-U0.821 Carbohydrate | 155% to 258% |
| 214138 | Carbohydrates | Carbohydrates | F3-U0.825 Carbohydrate | 76% to 171% |
| 214138 | Carbohydrates | Carbohydrates | F3-U0.846 Carbohydrate | 82% to 260% |
| 214138 | Carbohydrates | Carbohydrates | F3-U0.872 Hexose | 106% to 245% |
| 214138 | Carbohydrates | Carbohydrates | F3-U1.113 Carbohydrate | 60% to 88% |
| 214138 | Carbohydrates | Carbohydrates | F3-U1.189 Carbohydrate | 60% to 175% |
| 214138 | Carbohydrates | Carbohydrates | F3-U1.194 Carbohydrate | 60% to 95% |
| 214138 | Carbohydrates | Carbohydrates | Fructose | 60% to 199% |
| 214138 | Carbohydrates | Carbohydrates | Glucose | 165% to 582% |
| 214138 | NA | NA | F3-U0.751 | 135% to 225% |
| 214138 | NA | NA | F3-U0.882 | 140% to 233% |
| 214138 | NA | NA | F3-U1.253 | 60% to 77% |
| 214138 | NA | NA | F3-U1.255 | 64% to 107% |
| 214138 | Phenols and Related Compounds | Phenylpropanes and Derivatives | Chlorogenic acid | 60% to 174% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214144

| Seq ID | Chemical Class | Biochemical Class | Compound Name | Modification |
|---|---|---|---|---|
| 214144 | Acids - Hydroxy Alpha | Acid Pathway | Butanoic acid, 2,3,4-trihydroxy- | New |
| 214144 | Acids - Hydroxy Alpha | Acid Pathway | Citric acid | 109% to 181% |
| 214144 | Acids - Hydroxy Alpha | Carbohydrates | Quinic acid | 91% to 329% |
| 214144 | Alkaloids and Other Bases | Polyamines | 1,4-Butanediamine | 162% to 269% |
| 214144 | Amino Acids and Related Compounds | Amino Acids and Related Compounds | Glutamic acid | New |
| 214144 | Amino Acids and Related Compounds | Amino Acids and Related Compounds | Glutamine | New |
| 214144 | Carbohydrates | Carbohydrates | Arabinose or Xylose | New |
| 214144 | Carbohydrates | Carbohydrates | F3-U0.813 Carbohydrate | 250% to 1287% |
| 214144 | Carbohydrates | Carbohydrates | F3-U0.816 Carbohydrate | 92% to 273% |
| 214144 | Carbohydrates | Carbohydrates | F3-U0.821 Carbohydrate | 109% to 181% |
| 214144 | Carbohydrates | Carbohydrates | F3-U0.825 Carbohydrate | 115% to 935% |
| 214144 | Carbohydrates | Carbohydrates | F3-U0.846 Carbohydrate | 96% to 826% |
| 214144 | Carbohydrates | Carbohydrates | F3-U0.848 Carbohydrate | 87% to 596% |
| 214144 | Carbohydrates | Carbohydrates | F3-U0.872 Hexose | 117% to 1027% |
| 214144 | Carbohydrates | Carbohydrates | F3-U1.104 Carbohydrate | New |
| 214144 | Carbohydrates | Carbohydrates | F3-U1.113 Carbohydrate | 107% to 178% |
| 214144 | Carbohydrates | Carbohydrates | F3-U1.150 Carbohydrate | 60% to 98% |
| 214144 | Carbohydrates | Carbohydrates | F3-U1.189 Carbohydrate | New |
| 214144 | Carbohydrates | Carbohydrates | F3-U1.194 Carbohydrate | New |
| 214144 | Carbohydrates | Carbohydrates | Fructose | 428% to 2864% |
| 214144 | Carbohydrates | Carbohydrates | Galactose or Mannose | New |
| 214144 | Carbohydrates | Carbohydrates | Glucose | 272% to 6206% |
| 214144 | NA | NA | F3-U0.727 | -60% to -80% |
| 214144 | NA | NA | F3-U0.740 | New |
| 214144 | NA | NA | F3-U0.751 | 277% to 461% |
| 214144 | NA | NA | F3-U0.838 | New |
| 214144 | NA | NA | F3-U0.852A | New |
| 214144 | NA | NA | F3-U0.882 | New |
| 214144 | NA | NA | F3-U0.899 | 73% to 122% |
| 214144 | NA | NA | F3-U1.253 | 66% to 109% |
| 214144 | NA | NA | F3-U1.255 | 60% to 95% |
| 214144 | Phenols and Related Compounds | Phenylpropanes and Derivatives | Chlorogenic acid | 225% to 375% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214146

| Seq ID | Chemical Class | Biochemical Class | Compound Name | Modification |
|---|---|---|---|---|
| 214146 | Acids - Hydroxy Alpha | Acid Pathway | Butanoic acid, 2,3,4-trihydroxy- | 111% to 185% |
| 214146 | Acids - Hydroxy Alpha | Acid Pathway | Citric acid | 338% to 564% |
| 214146 | Amino Acids and Related Compounds | Amino Acids and Related Compounds | Aspartic acid | 116% to 193% |
| 214146 | Amino Acids and Related Compounds | Amino Acids and Related Compounds | Glutamic acid | New |
| 214146 | Amino Acids and Related Compounds | Amino Acids and Related Compounds | Glycine | New |
| 214146 | Amino Acids and Related Compounds | Amino Acids and Related Compounds | Isoleucine | New |
| 214146 | Amino Acids and Related Compounds | Amino Acids and Related Compounds | Proline | 63% to 105% |
| 214146 | Amino Acids and Related Compounds | Amino Acids and Related Compounds | Valine | 100% to 270% |
| 214146 | Carbohydrates | Carbohydrates | F3-U0.813 Carbohydrate | 60% to 84% |
| 214146 | Carbohydrates | Carbohydrates | F3-U0.816 Carbohydrate | 85% to 141% |
| 214146 | Carbohydrates | Carbohydrates | F3-U0.821 Carbohydrate | 338% to 564% |
| 214146 | Carbohydrates | Carbohydrates | F3-U0.825 Carbohydrate | 162% to 271% |
| 214146 | Carbohydrates | Carbohydrates | F3-U0.846 Carbohydrate | 163% to 272% |
| 214146 | Carbohydrates | Carbohydrates | F3-U0.872 Hexose | 157% to 262% |
| 214146 | Carbohydrates | Carbohydrates | F3-U1.194 Carbohydrate | 60% to 96% |
| 214146 | Carbohydrates | Carbohydrates | Glucose | 73% to 153% |
| 214146 | NA | NA | F3-U0.736 | New |
| 214146 | NA | NA | F3-U0.751 | 174% to 290% |
| 214146 | NA | NA | F3-U0.838 | New |
| 214146 | Phenols and Related Compounds | Phenylpropanes and Derivatives | Chlorogenic acid | 95% to 158% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214158

| Seq ID | Chemical Class | Biochemical Class | Compound Name | Modification |
|---|---|---|---|---|
| 214158 | Acids | Acids | Carbamic acid | 80% to 133% |
| 214158 | Acids - Hydroxy | Amino Acids and Related Compounds | Shikimic acid | 60% to 76% |
| 214158 | Acids - Hydroxy Alpha | Acid Pathway | Citric acid | -60% to -96% |
| 214158 | Acids - Hydroxy Alpha | Acid Pathway | Malic acid | 64% to 106% |
| 214158 | Acids - Hydroxy Alpha | Carbohydrates | Quinic acid | 77% to 129% |
| 214158 | Carbohydrates | Carbohydrates | F3-U0.816 Carbohydrate | 60% to 76% |
| 214158 | Carbohydrates | Carbohydrates | F3-U0.821 Carbohydrate | -60% to -96% |
| 214158 | Carbohydrates | Carbohydrates | F3-U0.846 Carbohydrate | -60% to -97% |
| 214158 | Carbohydrates | Carbohydrates | Fructose | 279% to 673% |
| 214158 | Carbohydrates | Carbohydrates | Galactose or Mannose | 308% to 513% |
| 214158 | Carbohydrates | Carbohydrates | Glucose | 112% to 609% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214162

| Seq ID | Chemical Class | Biochemical Class | Compound Name | Modification |
|---|---|---|---|---|
| 214162 | Acids - Hydroxy | Amino Acids and Related Compounds | Shikimic acid | New |
| 214162 | Acids - Hydroxy Alpha | Acid Pathway | Butanoic acid, 2,3,4-trihydroxy- | 417% to 696% |
| 214162 | Acids - Hydroxy Alpha | Acid Pathway | Citric acid | 60% to 84% |
| 214162 | Acids - Hydroxy Alpha | Carbohydrates | Glyceric acid | New |
| 214162 | Acids - Hydroxy Alpha | Carbohydrates | Quinic acid | 181% to 302% |
| 214162 | Alcohols | Carbohydrates | Inositol | 97% to 162% |
| 214162 | Alkaloids and Other Bases | Polyamines | 1,4-Butanediamine | 60% to 82% |
| 214162 | Amino Acids and Related Compounds | Amino Acids and Related Compounds | Aspartic acid | -60% to -88% |
| 214162 | Amino Acids and Related Compounds | Amino Acids and Related Compounds | Glutamic acid | New |
| 214162 | Carbohydrates | Carbohydrates | Arabinose or Xylose | New |
| 214162 | Carbohydrates | Carbohydrates | F3-U0.816 Carbohydrate | New |
| 214162 | Carbohydrates | Carbohydrates | F3-U0.821 Carbohydrate | 60% to 84% |
| 214162 | Carbohydrates | Carbohydrates | F3-U0.825 Carbohydrate | 225% to 375% |
| 214162 | Carbohydrates | Carbohydrates | F3-U0.846 Carbohydrate | 1310% to 2183% |
| 214162 | Carbohydrates | Carbohydrates | F3-U0.848 Carbohydrate | 469% to 781% |
| 214162 | Carbohydrates | Carbohydrates | F3-U0.872 Hexose | 704% to 1174% |
| 214162 | Carbohydrates | Carbohydrates | F3-U1.104 Carbohydrate | New |
| 214162 | Carbohydrates | Carbohydrates | F3-U1.118 Carbohydrate | 184% to 306% |
| 214162 | Carbohydrates | Carbohydrates | F3-U1.189 Carbohydrate | 60% to 77% |
| 214162 | Carbohydrates | Carbohydrates | Fructose | 268% to 690% |
| 214162 | Carbohydrates | Carbohydrates | Galactose or Mannose | 323% to 538% |
| 214162 | Carbohydrates | Carbohydrates | Glucose | 219% to 1110% |
| 214162 | NA | NA | F3-U0.736 | New |
| 214162 | NA | NA | F3-U0.740 | 206% to 344% |
| 214162 | NA | NA | F3-U0.751 | 60% to 88% |
| 214162 | NA | NA | F3-U0.791 | 93% to 154% |
| 214162 | NA | NA | F3-U0.807 | New |
| 214162 | NA | NA | F3-U0.882 | 159% to 266% |
| 214162 | NA | NA | F3-U0.899 | 104% to 173% |
| 214162 | NA | NA | F3-U1.253 | 60% to 95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214172

| Seq ID | Chemical Class | Biochemical Class | Compound Name | Modification |
|---|---|---|---|---|
| 214172 | Aldehydes, Ketones and Quinones | Aldehydes, Ketones and Quinones | 3-Phytylmenadione | 60% to 85% |
| 214172 | Amino Acids and Related Compounds | Amino Acids and Related Compounds | Arginine | 495% to 1010% |
| 214172 | Amino Acids and Related Compounds | Amino Acids and Related Compounds | Asparagine | -60% to -77% |
| 214172 | Amino Acids and Related Compounds | Amino Acids and Related Compounds | Histidine | New |
| 214172 | Amino Acids and Related Compounds | Amino Acids and Related Compounds | Isoleucine | New |
| 214172 | Amino Acids and Related Compounds | Amino Acids and Related Compounds | Leucine | New |
| 214172 | Amino Acids and Related Compounds | Amino Acids and Related Compounds | Lysine | 210% to 1040% |
| 214172 | Amino Acids and Related Compounds | Amino Acids and Related Compounds | Proline | 305% to 875% |
| 214172 | Amino Acids and Related Compounds | Amino Acids and Related Compounds | Serine | 115% to 390% |
| 214172 | Amino Acids and Related Compounds | Amino Acids and Related Compounds | Threonine | 355% to 1060% |
| 214172 | Amino Acids and Related Compounds | Amino Acids and Related Compounds | Tryptophan | New |
| 214172 | Amino Acids and Related Compounds | Amino Acids and Related Compounds | Tyrosine | New |
| 214172 | Amino Acids and Related Compounds | Amino Acids and Related Compounds | Valine | 805% to 1560% |
| 214172 | NA | NA | F3-U1.253 | -60% to -76% |
| 214172 | NA | NA | F3-U1.255 | -60% to -89% |
| 214172 | Sterols, Oxygenated Terpenes, and Other Isoprenoids | Prenylquinones | alpha-Tocopherol hydroquinone | 323% to 539% |
| 214172 | Sterols, Oxygenated Terpenes, and Other Isoprenoids | Terpenoids | beta-Sitosterol | 172% to 287% |
| 214172 | Sterols, Oxygenated Terpenes, and Other Isoprenoids | Terpenoids | Campesterol | 60% to 94% |
| 214172 | Sterols, Oxygenated Terpenes, and Other Isoprenoids | Terpenoids | Cholesterol | 100% to 167% |
| 214172 | Sterols, Oxygenated Terpenes, and Other Isoprenoids | Terpenoids | F1-U1.136 Sterol | 66% to 110% |
| 214172 | Sterols, Oxygenated Terpenes, and Other Isoprenoids | Terpenoids | Stigmasterol | 74% to 123% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214178

| Seq ID | Chemical Class | Biochemical Class | Compound Name | Modification |
|---|---|---|---|---|
| 214178 | Acids - Hydroxy Alpha | Acid Pathway | Malic acid | -60% to -87% |
| 214178 | Alcohols | Carbohydrates | Inositol | 60% to 85% |
| 214178 | Alkaloids and Other Bases | Polyamines | 1,4-Butanediamine | 246% to 410% |
| 214178 | Amino Acids and Related Compounds | Amino Acids and Related Compounds | Glutamic acid | New |
| 214178 | Carbohydrates | Carbohydrates | Arabinose or Xylose | New |
| 214178 | Carbohydrates | Carbohydrates | F3-U0.846 Carbohydrate | 172% to 286% |
| 214178 | Carbohydrates | Carbohydrates | F3-U0.848 Carbohydrate | 158% to 263% |
| 214178 | Carbohydrates | Carbohydrates | F3-U0.872 Hexose | New |
| 214178 | Carbohydrates | Carbohydrates | F3-U1.118 Carbohydrate | 131% to 219% |
| 214178 | Carbohydrates | Carbohydrates | Fructose | 225% to 609% |
| 214178 | Carbohydrates | Carbohydrates | Galactose or Mannose | 406% to 676% |
| 214178 | Carbohydrates | Carbohydrates | Glucose | 219% to 652% |
| 214178 | NA | NA | F3-U0.736 | New |
| 214178 | NA | NA | F3-U0.740 | 197% to 329% |
| 214178 | NA | NA | F3-U0.751 | 84% to 141% |
| 214178 | NA | NA | F3-U0.882 | 213% to 355% |
| 214178 | NA | NA | F3-U0.899 | 155% to 258% |
| 214178 | NA | NA | F3-U1.229 | 85% to 141% |
| 214178 | NA | NA | F3-U1.253 | 71% to 118% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214188

| Seq ID | Chemical Class | Biochemical Class | Compound Name | Modification |
|---|---|---|---|---|
| 214188 | Acids - Hydroxy Alpha | Acid Pathway | Butanoic acid, 2,3,4-trihydroxy- | 216% to 360% |
| 214188 | Acids - Hydroxy Alpha | Acid Pathway | Citric acid | 80% to 133% |
| 214188 | Acids - Hydroxy Alpha | Carbohydrates | Quinic acid | 132% to 220% |
| 214188 | Amino Acids and Related Compounds | Amino Acids and Related Compounds | Asparagine | 358% to 596% |
| 214188 | Amino Acids and Related Compounds | Amino Acids and Related Compounds | Glutamic acid | 65% to 108% |
| 214188 | Carbohydrates | Carbohydrates | Arabinose or Xylose | 131% to 218% |
| 214188 | Carbohydrates | Carbohydrates | F3-U0.813 Carbohydrate | 199% to 331% |
| 214188 | Carbohydrates | Carbohydrates | F3-U0.816 Carbohydrate | 112% to 186% |
| 214188 | Carbohydrates | Carbohydrates | F3-U0.821 Carbohydrate | 80% to 133% |
| 214188 | Carbohydrates | Carbohydrates | F3-U0.825 Carbohydrate | 185% to 308% |
| 214188 | Carbohydrates | Carbohydrates | F3-U0.846 Carbohydrate | 197% to 329% |
| 214188 | Carbohydrates | Carbohydrates | F3-U0.848 Carbohydrate | 77% to 128% |
| 214188 | Carbohydrates | Carbohydrates | F3-U0.872 Hexose | 191% to 318% |
| 214188 | Carbohydrates | Carbohydrates | Fructose | 60% to 127% |
| 214188 | Carbohydrates | Carbohydrates | Galactose or Mannose | 109% to 181% |
| 214188 | Carbohydrates | Carbohydrates | Glucose | 131% to 218% |
| 214188 | NA | NA | F3-U0.736 | 215% to 359% |
| 214188 | NA | NA | F3-U0.740 | 60% to 85% |
| 214188 | NA | NA | F3-U0.751 | 314% to 523% |
| 214188 | NA | NA | F3-U0.882 | 60% to 90% |
| 214188 | NA | NA | F3-U0.899 | 74% to 123% |
| 214188 | NA | NA | F3-U1.253 | 60% to 95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214194

| Seq ID | Chemical Class | Biochemical Class | Compound Name | Modification |
|---|---|---|---|---|
| 214194 | Acids - Hydroxy | Amino Acids and Related Compounds | Shikimic acid | -60% to -88% |
| 214194 | Acids - Hydroxy Alpha | Acid Pathway | Citric acid | -63% to -100% |
| 214194 | Carbohydrates | Carbohydrates | F3-U0.816 Carbohydrate | -60% to -88% |
| 214194 | Carbohydrates | Carbohydrates | F3-U0.821 Carbohydrate | -63% to -100% |
| 214194 | Carbohydrates | Carbohydrates | F3-U0.846 Carbohydrate | -67% to -100% |
| 214194 | Carbohydrates | Carbohydrates | F3-U0.872 Hexose | -60% to -88% |
| 214194 | Carbohydrates | Carbohydrates | F3-U0.952 Carbohydrate | 83% to 138% |
| 214194 | Carbohydrates | Carbohydrates | Fructose | 230% to 504% |
| 214194 | Carbohydrates | Carbohydrates | Galactose or Mannose | 367% to 611% |
| 214194 | Carbohydrates | Carbohydrates | Glucose | 76% to 394% |
| 214194 | NA | NA | F3-U0.899 | 79% to 131% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214201

| Seq ID | Chemical Class | Biochemical Class | Compound Name | Modification |
|---|---|---|---|---|
| 214201 | Acids - Hydroxy | Amino Acids and Related Compounds | Shikimic acid | 269% to 448% |
| 214201 | Acids - Hydroxy Alpha | Acid Pathway | Butanoic acid, 2,3,4-trihydroxy- | 218% to 363% |
| 214201 | Acids - Hydroxy Alpha | Carbohydrates | Quinic acid | 99% to 165% |
| 214201 | Alcohols | Carbohydrates | Inositol | 82% to 137% |
| 214201 | Alkaloids and Other Bases | Polyamines | 1,4-Butanediamine | 162% to 270% |
| 214201 | Amino Acids and Related Compounds | Amino Acids and Related Compounds | Asparagine | New |
| 214201 | Amino Acids and Related Compounds | Amino Acids and Related Compounds | Aspartic acid | -60% to -76% |
| 214201 | Amino Acids and Related Compounds | Amino Acids and Related Compounds | Glutamic acid | New |
| 214201 | Amino Acids and Related Compounds | Amino Acids and Related Compounds | Proline, 5-oxo- | 60% to 86% |
| 214201 | Carbohydrates | Carbohydrates | Arabinose or Xylose | New |
| 214201 | Carbohydrates | Carbohydrates | F3-U0.816 Carbohydrate | 269% to 448% |
| 214201 | Carbohydrates | Carbohydrates | F3-U0.825 Carbohydrate | 125% to 209% |
| 214201 | Carbohydrates | Carbohydrates | F3-U0.846 Carbohydrate | 1096% to 1826% |
| 214201 | Carbohydrates | Carbohydrates | F3-U0.848 Carbohydrate | 191% to 319% |
| 214201 | Carbohydrates | Carbohydrates | F3-U0.872 Hexose | 404% to 673% |
| 214201 | Carbohydrates | Carbohydrates | F3-U1.118 Carbohydrate | 65% to 108% |
| 214201 | Carbohydrates | Carbohydrates | F3-U1.150 Carbohydrate | 127% to 212% |
| 214201 | Carbohydrates | Carbohydrates | F3-U1.189 Carbohydrate | 99% to 275% |
| 214201 | Carbohydrates | Carbohydrates | F3-U1.194 Carbohydrate | 112% to 186% |
| 214201 | Carbohydrates | Carbohydrates | Fructose | 185% to 522% |
| 214201 | Carbohydrates | Carbohydrates | Galactose or Mannose | 339% to 565% |
| 214201 | Carbohydrates | Carbohydrates | Glucose | 156% to 681% |
| 214201 | NA | NA | F3-U0.740 | New |
| 214201 | NA | NA | F3-U0.751 | 262% to 437% |
| 214201 | NA | NA | F3-U0.791 | 86% to 143% |
| 214201 | NA | NA | F3-U0.899 | 188% to 313% |
| 214201 | NA | NA | F3-U1.253 | 165% to 275% |
| 214201 | NA | NA | F3-U1.255 | 93% to 155% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214221

| Seq ID | Chemical Class | Biochemical Class | Compound Name | Modification |
|---|---|---|---|---|
| 214221 | Amino Acids and Related Compounds | Amino Acids and Related Compounds | Arginine | 135% to 285% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214235

| Seq ID | Chemical Class | Biochemical Class | Compound Name | Modification |
|--------|---------------|-------------------|---------------|--------------|
| 214235 | Amino Acids and Related Compounds | Amino Acids and Related Compounds | Arginine | 75% to 190% |
| 214235 | Amino Acids and Related Compounds | Amino Acids and Related Compounds | Methionine | 70% to 105% |
| 214235 | Amino Acids and Related Compounds | Amino Acids and Related Compounds | Phenylalanine | 60% to 890% |
| 214235 | Amino Acids and Related Compounds | Amino Acids and Related Compounds | Valine | 20% to 525% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214242

| Seq ID | Chemical Class | Biochemical Class | Compound Name | Modification |
|---|---|---|---|---|
| 214242 | Acids - Hydroxy Alpha | Acid Pathway | Butanoic acid, 2,3,4-trihydroxy- | 97% to 162% |
| 214242 | Acids - Hydroxy Alpha | Carbohydrates | Quinic acid | 188% to 313% |
| 214242 | Amino Acids and Related Compounds | Amino Acids and Related Compounds | Glutamic acid | 60% to 98% |
| 214242 | Amino Acids and Related Compounds | Amino Acids and Related Compounds | Proline | New |
| 214242 | Carbohydrates | Carbohydrates | F3-U0.813 Carbohydrate | 78% to 131% |
| 214242 | Carbohydrates | Carbohydrates | F3-U0.816 Carbohydrate | 90% to 150% |
| 214242 | Carbohydrates | Carbohydrates | F3-U0.825 Carbohydrate | 132% to 220% |
| 214242 | Carbohydrates | Carbohydrates | F3-U0.846 Carbohydrate | 143% to 239% |
| 214242 | Carbohydrates | Carbohydrates | F3-U0.848 Carbohydrate | 117% to 195% |
| 214242 | Carbohydrates | Carbohydrates | F3-U0.872 Hexose | 151% to 251% |
| 214242 | Carbohydrates | Carbohydrates | Fructose | 60% to 128% |
| 214242 | Carbohydrates | Carbohydrates | Galactose or Mannose | 76% to 127% |
| 214242 | Carbohydrates | Carbohydrates | Glucose | 60% to 259% |
| 214242 | NA | NA | F3-U0.751 | 392% to 653% |
| 214242 | NA | NA | F3-U0.791 | 143% to 239% |
| 214242 | NA | NA | F3-U0.882 | 136% to 226% |
| 214242 | NA | NA | F3-U0.899 | 142% to 236% |
| 214242 | Phenols and Related Compounds | Phenylpropanes and Derivatives | Chlorogenic acid | 60% to 101% |

FIG. 6 continued

A list of metabolite compounds present in altered levels relative to reference samples as chararcterized by gas chromatography, liquid chromatography, and/or mass spectrometry. This list corresponds to samples transfected with nucleic acid sequence, Seq ID#214250

| Seq ID | Chemical Class | Biochemical Class | Compound Name | Modification |
|---|---|---|---|---|
| 214250 | Acids - Fatty Unsat | Fatty Acids and Related Waxes | 9,12-Octadecadienoic acid | 5% to 37% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214256

| Seq ID | Chemical Class | Biochemical Class | Compound Name | Modification |
|--------|----------------|-------------------|---------------|--------------|
| 214256 | Amino Acids and Related Compounds | Amino Acids and Related Compounds | Serine | 70% to 135% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214259

| Seq ID | Chemical Class | Biochemical Class | Compound Name | Modification |
|---|---|---|---|---|
| 214259 | Acids | Acids | Carbamic acid | 131% to 613% |
| 214259 | Acids - Hydroxy Alpha | Acid Pathway | Citric acid | 112% to 187% |
| 214259 | Acids - Hydroxy Alpha | Carbohydrates | F3-U0.992 Sugar acid | NQ |
| 214259 | Acids - Hydroxy Alpha | Acid Pathway | Malic acid | 338% to 563% |
| 214259 | Acids - Hydroxy Alpha | Carbohydrates | Quinic acid | 60% to 96% |
| 214259 | Amino Acids and Related Compounds | Amino Acids and Related Compounds | Asparagine | NQ |
| 214259 | Amino Acids and Related Compounds | Amino Acids and Related Compounds | Glycine | New |
| 214259 | Carbohydrates | Carbohydrates | F3-U0.813 Carbohydrate | 230% to 384% |
| 214259 | Carbohydrates | Carbohydrates | F3-U0.821 Carbohydrate | 112% to 187% |
| 214259 | Carbohydrates | Carbohydrates | F3-U0.846 Carbohydrate | 64% to 173% |
| 214259 | Carbohydrates | Carbohydrates | F3-U0.848 Carbohydrate | 138% to 230% |
| 214259 | Carbohydrates | Carbohydrates | F3-U0.872 Hexose | 131% to 218% |
| 214259 | Carbohydrates | Carbohydrates | F3-U1.104 Carbohydrate | NQ |
| 214259 | Carbohydrates | Carbohydrates | F3-U1.189 Carbohydrate | -60% to -99% |
| 214259 | Carbohydrates | Carbohydrates | F3-U1.194 Carbohydrate | -60% to -94% |
| 214259 | Carbohydrates | Carbohydrates | Galactose or Mannose | 134% to 224% |
| 214259 | NA | NA | F3-U0.602 | New |
| 214259 | NA | NA | F3-U0.727 | 155% to 259% |
| 214259 | NA | NA | F3-U0.751 | 193% to 322% |
| 214259 | NA | NA | F3-U0.852A | 234% to 389% |
| 214259 | NA | NA | F3-U0.881 | New |
| 214259 | NA | NA | F3-U1.229 | -60% to -89% |
| 214259 | Phenols and Related Compounds | Phenylpropanes and Derivatives | Chlorogenic acid | -60% to -80% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214262

| Seq ID | Chemical Class | Biochemical Class | Compound Name | Modification |
|---|---|---|---|---|
| 214262 | Acids | Acids | Carbamic acid | 125% to 208% |
| 214262 | Acids - Hydroxy Alpha | Acid Pathway | Butanoic acid, 2,3,4-trihydroxy- | 83% to 138% |
| 214262 | Acids - Hydroxy Alpha | Acid Pathway | Citric acid | 103% to 172% |
| 214262 | Acids - Hydroxy Alpha | Carbohydrates | F3-U0.992 Sugar acid | NQ |
| 214262 | Acids - Hydroxy Alpha | Acid Pathway | Malic acid | 66% to 110% |
| 214262 | Acids - Hydroxy Alpha | Carbohydrates | Quinic acid | 60% to 81% |
| 214262 | Carbohydrates | Carbohydrates | F3-U0.813 Carbohydrate | New |
| 214262 | Carbohydrates | Carbohydrates | F3-U0.816 Carbohydrate | 98% to 163% |
| 214262 | Carbohydrates | Carbohydrates | F3-U0.821 Carbohydrate | 103% to 172% |
| 214262 | Carbohydrates | Carbohydrates | F3-U0.846 Carbohydrate | 108% to 181% |
| 214262 | Carbohydrates | Carbohydrates | F3-U1.104 Carbohydrate | NQ |
| 214262 | Carbohydrates | Carbohydrates | Fructose | -60% to -98% |
| 214262 | Carbohydrates | Carbohydrates | Galactose or Mannose | -69% to -100% |
| 214262 | Carbohydrates | Carbohydrates | Glucose | 89% to 148% |
| 214262 | Carbohydrates | Carbohydrates | Xylose | NQ |
| 214262 | NA | NA | F3-U0.852A | 12075% to 20125% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214264

| Seq ID | Chemical Class | Biochemical Class | Compound Name | Modification |
|---|---|---|---|---|
| 214264 | Acids - Hydroxy Alpha | Acid Pathway | Butanoic acid, 2,3,4-trihydroxy- | 607% to 1012% |
| 214264 | Acids - Hydroxy Alpha | Acid Pathway | Citric acid | 245% to 409% |
| 214264 | Acids - Hydroxy Alpha | Carbohydrates | Quinic acid | 145% to 241% |
| 214264 | Alcohols | Carbohydrates | Inositol | 73% to 121% |
| 214264 | Alkaloids and Other Bases | Polyamines | 1,4-Butanediamine | 117% to 196% |
| 214264 | Amino Acids and Related Compounds | Amino Acids and Related Compounds | Aspartic acid | -60% to -90% |
| 214264 | Amino Acids and Related Compounds | Amino Acids and Related Compounds | Glutamic acid | New |
| 214264 | Carbohydrates | Carbohydrates | Arabinose or Xylose | New |
| 214264 | Carbohydrates | Carbohydrates | F3-U0.813 Carbohydrate | New |
| 214264 | Carbohydrates | Carbohydrates | F3-U0.816 Carbohydrate | New |
| 214264 | Carbohydrates | Carbohydrates | F3-U0.821 Carbohydrate | 245% to 409% |
| 214264 | Carbohydrates | Carbohydrates | F3-U0.825 Carbohydrate | New |
| 214264 | Carbohydrates | Carbohydrates | F3-U0.846 Carbohydrate | 5741% to 9568% |
| 214264 | Carbohydrates | Carbohydrates | F3-U0.848 Carbohydrate | 135% to 225% |
| 214264 | Carbohydrates | Carbohydrates | F3-U0.872 Hexose | 1444% to 2406% |
| 214264 | Carbohydrates | Carbohydrates | F3-U1.189 Carbohydrate | 60% to 93% |
| 214264 | Carbohydrates | Carbohydrates | Fructose | 189% to 544% |
| 214264 | Carbohydrates | Carbohydrates | Galactose or Mannose | 250% to 416% |
| 214264 | Carbohydrates | Carbohydrates | Glucose | 144% to 530% |
| 214264 | NA | NA | F3-U0.736 | New |
| 214264 | NA | NA | F3-U0.852A | New |
| 214264 | NA | NA | F3-U0.882 | 121% to 202% |
| 214264 | NA | NA | F3-U0.899 | 91% to 152% |
| 214264 | NA | NA | F3-U1.253 | 73% to 121% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214270

| Seq ID | Chemical Class | Biochemical Class | Compound Name | Modification |
|---|---|---|---|---|
| 214270 | Amino Acids and Related Compounds | Amino Acids and Related Compounds | Aspartic acid | 45% to 55% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214275

| Seq ID | Chemical Class | Biochemical Class | Compound Name | Modification |
|---|---|---|---|---|
| 214275 | Amino Acids and Related Compounds | Amino Acids and Related Compounds | Alanine | 70% to 170% |
| 214275 | Amino Acids and Related Compounds | Amino Acids and Related Compounds | Arginine | 160% to 325% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214276

| Seq ID | Chemical Class | Biochemical Class | Compound Name | Modification |
|---|---|---|---|---|
| 214276 | Acids - Hydroxy Alpha | Carbohydrates | F3-U0.992 Sugar acid | NQ |
| 214276 | Acids | Acids | Carbamic acid | 114% to 189% |
| 214276 | Carbohydrates | Carbohydrates | F3-U1.104 Carbohydrate | NQ |
| 214276 | Carbohydrates | Carbohydrates | F3-U1.189 Carbohydrate | -60% to -91% |
| 214276 | Carbohydrates | Carbohydrates | F3-U1.194 Carbohydrate | -60% to -84% |
| 214276 | Carbohydrates | Carbohydrates | Glucose | 291% to 484% |
| 214276 | NA | NA | F3-U0.899 | 60% to 91% |
| 214276 | NA | NA | F3-U1.253 | -60% to -84% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214279

| Seq ID | Chemical Class | Biochemical Class | Compound Name | Modification |
|---|---|---|---|---|
| 214279 | Acids | Acids | Carbamic acid | 170% to 284% |
| 214279 | Acids - Hydroxy Alpha | Acid Pathway | Butanoic acid, 2,3,4-trihydroxy- | New |
| 214279 | Acids - Hydroxy Alpha | Acid Pathway | Citric acid | 89% to 148% |
| 214279 | Acids - Hydroxy Alpha | Acid Pathway | Malic acid | 509% to 849% |
| 214279 | Amino Acids and Related Compounds | Amino Acids and Related Compounds | Asparagine | New |
| 214279 | Carbohydrates | Carbohydrates | Arabinose or Xylose | New |
| 214279 | Carbohydrates | Carbohydrates | F3-U0.813 Carbohydrate | 528% to 879% |
| 214279 | Carbohydrates | Carbohydrates | F3-U0.816 Carbohydrate | 60% to 88% |
| 214279 | Carbohydrates | Carbohydrates | F3-U0.821 Carbohydrate | 89% to 148% |
| 214279 | Carbohydrates | Carbohydrates | F3-U0.825 Carbohydrate | 143% to 238% |
| 214279 | Carbohydrates | Carbohydrates | F3-U0.846 Carbohydrate | 128% to 214% |
| 214279 | Carbohydrates | Carbohydrates | F3-U0.872 Hexose | 207% to 344% |
| 214279 | Carbohydrates | Carbohydrates | F3-U1.189 Carbohydrate | 70% to 117% |
| 214279 | Carbohydrates | Carbohydrates | F3-U1.194 Carbohydrate | 114% to 190% |
| 214279 | Carbohydrates | Carbohydrates | Fructose | 299% to 498% |
| 214279 | Carbohydrates | Carbohydrates | Galactose or Mannose | 586% to 977% |
| 214279 | Carbohydrates | Carbohydrates | Glucose | 93% to 539% |
| 214279 | NA | NA | F3-U0.751 | 279% to 465% |
| 214279 | NA | NA | F3-U0.838 | New |
| 214279 | NA | NA | F3-U0.852A | 400% to 667% |
| 214279 | NA | NA | F3-U1.228 | -60% to -77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214283

| Seq ID | Chemical Class | Biochemical Class | Compound Name | Modification |
|---|---|---|---|---|
| 214283 | Amino Acids and Related Compounds | Amino Acids and Related Compounds | Alanine | 125% to 260% |
| 214283 | Amino Acids and Related Compounds | Amino Acids and Related Compounds | Glutamic acid | 60% to 190% |
| 214283 | Amino Acids and Related Compounds | Amino Acids and Related Compounds | Serine | 60% to 180% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214295

| Seq ID | Chemical Class | Biochemical Class | Compound Name | Modification |
|---|---|---|---|---|
| 214295 | Acids - Hydroxy Alpha | Acid Pathway | Malic acid | 532% to 886% |
| 214295 | Carbohydrates | Carbohydrates | Glucose | 60% to 82% |
| 214295 | NA | NA | F3-U0.740 | 100% to 166% |
| 214295 | NA | NA | F3-U0.785B | New |
| 214295 | NA | NA | F3-U0.850 | 132% to 220% |
| 214295 | NA | NA | F3-U1.067 | New |
| 214295 | NA | NA | F3-U1.229 | 60% to 79% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214307

| Seq ID | Chemical Class | Biochemical Class | Compound Name | Modification |
|---|---|---|---|---|
| 214307 | Acids - Hydroxy Alpha | Acid Pathway | Malic acid | 149% to 249% |
| 214307 | Acids - Hydroxy Alpha | Carbohydrates | Quinic acid | 546% to 910% |
| 214307 | Alcohols | Carbohydrates | Inositol | 60% to 88% |
| 214307 | Carbohydrates | Carbohydrates | F3-U0.848 Carbohydrate | 684% to 1140% |
| 214307 | Carbohydrates | Carbohydrates | Fructose | 302% to 754% |
| 214307 | Carbohydrates | Carbohydrates | Glucose | 384% to 640% |
| 214307 | NA | NA | F3-U0.740 | 83% to 139% |
| 214307 | NA | NA | F3-U0.785B | New |
| 214307 | NA | NA | F3-U0.850 | New |
| 214307 | NA | NA | F3-U1.067 | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214309

| SeqID | Chemical Class | Biochemical Class | Compound Name | Modification |
|---|---|---|---|---|
| 214309 | Acids - Hydroxy Alpha | Acid Pathway | Butanoic acid, 2,3,4-trihydroxy- | New |
| 214309 | Acids - Hydroxy Alpha | Acid Pathway | Malic acid | 232% to 387% |
| 214309 | Acids - Hydroxy Alpha | Carbohydrates | Quinic acid | 121% to 202% |
| 214309 | Carbohydrates | Carbohydrates | F3-U0.848 Carbohydrate | 150% to 250% |
| 214309 | Carbohydrates | Carbohydrates | Glucose | New |
| 214309 | NA | NA | F3-U0.785B | New |
| 214309 | Sterols, Oxygenated Terpenes, and Other Isoprenoids | Terpenoids | beta-Sitosterol | 61% to 101% |
| 214309 | Sterols, Oxygenated Terpenes, and Other Isoprenoids | Terpenoids | F1-U1.173 Sterol | 86% to 144% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214326

| Seq ID | Chemical Class | Biochemical Class | Compound Name | Modification |
|---|---|---|---|---|
| 214326 | Acids | Acids | Carbamic acid | New |
| 214326 | Acids - Hydroxy Alpha | Acid Pathway | Butanoic acid, 2,3,4-trihydroxy- | New |
| 214326 | Acids - Hydroxy Alpha | Acid Pathway | Citric acid | New |
| 214326 | Acids - Hydroxy Alpha | Acid Pathway | Malic acid | 4062% to 6769% |
| 214326 | Acids - Hydroxy Alpha | Carbohydrates | Quinic acid | 1253% to 2088% |
| 214326 | Amino Acids and Related Compounds | Amino Acids and Related Compounds | Proline, 5-oxo- | New |
| 214326 | Carbohydrates | Carbohydrates | F3-U0.768 Carbohydrate | NQ |
| 214326 | Carbohydrates | Carbohydrates | F3-U0.825 Carbohydrate | NQ |
| 214326 | Carbohydrates | Carbohydrates | F3-U0.848 Carbohydrate | -60% to -95% |
| 214326 | Carbohydrates | Carbohydrates | F3-U0.872 Hexose | New |
| 214326 | Carbohydrates | Carbohydrates | F3-U0.891 Carbohydrate | New |
| 214326 | Carbohydrates | Carbohydrates | F3-U1.150 Carbohydrate | 66% to 110% |
| 214326 | Carbohydrates | Carbohydrates | F3-U1.189 Carbohydrate | New |
| 214326 | Carbohydrates | Carbohydrates | F3-U1.194 Carbohydrate | New |
| 214326 | Carbohydrates | Carbohydrates | Glucose | 282% to 606% |
| 214326 | NA | NA | F3-U0.736 | New |
| 214326 | NA | NA | F3-U0.751 | New |
| 214326 | NA | NA | F3-U0.764 | New |
| 214326 | NA | NA | F3-U0.785B | NQ |
| 214326 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214329

| Seq ID | Chemical Class | Biochemical Class | Compound Name | Modification |
|---|---|---|---|---|
| 214329 | Acids | Acids | Carbamic acid | New |
| 214329 | Acids - Hydroxy Alpha | Acid Pathway | Butanoic acid, 2,3,4-trihydroxy- | New |
| 214329 | Acids - Hydroxy Alpha | Acid Pathway | Citric acid | New |
| 214329 | Acids - Hydroxy Alpha | Acid Pathway | Malic acid | 792% to 1321% |
| 214329 | Acids - Hydroxy Alpha | Carbohydrates | Quinic acid | 368% to 613% |
| 214329 | Amino Acids and Related Compounds | Amino Acids and Related Compounds | Proline, 5-oxo- | New |
| 214329 | Carbohydrates | Carbohydrates | F3-U0.891 Carbohydrate | New |
| 214329 | Carbohydrates | Carbohydrates | F3-U1.189 Carbohydrate | New |
| 214329 | Carbohydrates | Carbohydrates | Glucose | 69% to 116% |
| 214329 | NA | NA | F3-U0.602 | New |
| 214329 | NA | NA | F3-U0.727 | New |
| 214329 | NA | NA | F3-U0.736 | New |
| 214329 | NA | NA | F3-U0.899 | New |
| 214329 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214339

| Seq ID | Chemical Class | Biochemical Class | Compound Name | Modification |
|---|---|---|---|---|
| 214339 | Aldehydes, Ketones and Quinones | Aldehydes, Ketones and Quinones | 3-Phytylmenadione | 100% to 166% |
| 214339 | Alkenes and Alkynes | Fatty Acids and Related Waxes | 1-Decene, 4-methyl- | 113% to 188% |
| 214339 | Esters | Esters | F1-U1.076 Fatty Acid Ester | 92% to 153% |
| 214339 | Esters | Esters | F1-U1.078 Fatty Acid Ester | 60% to 90% |
| 214339 | Esters | Fatty Acids and Related Waxes | Hexadecanoic acid, glyceryl ester | 376% to 626% |
| 214339 | Esters - Hydroxy | Acyl acetylglycerols | 2-Eicosanoyl-1-acetylglycerol | 63% to 105% |
| 214339 | Esters - Hydroxy | Acyl acetylglycerols | 2-Octadecanoyl-1-acetylglycerol | 60% to 94% |
| 214339 | Hydrocarbons | Hydrocarbons | Nonacosane, 3-methyl | 60% to 81% |
| 214339 | NA | NA | F1-U1.119 | 71% to 118% |
| 214339 | Sterols, Oxygenated Terpenes, and Other Isoprenoids | Prenylquinones | alpha-Tocopherol hydroquinone | 318% to 530% |
| 214339 | Sterols, Oxygenated Terpenes, and Other Isoprenoids | Terpenoids | beta-Sitosterol | 235% to 392% |
| 214339 | Sterols, Oxygenated Terpenes, and Other Isoprenoids | Terpenoids | Campesterol | 93% to 154% |
| 214339 | Sterols, Oxygenated Terpenes, and Other Isoprenoids | Terpenoids | Cholesterol | 137% to 228% |
| 214339 | Sterols, Oxygenated Terpenes, and Other Isoprenoids | Terpenoids | F1-U1.136 Sterol | 73% to 122% |
| 214339 | Sterols, Oxygenated Terpenes, and Other Isoprenoids | Terpenoids | F1-U1.164 Sterol | 204% to 339% |
| 214339 | Sterols, Oxygenated Terpenes, and Other Isoprenoids | Terpenoids | F1-U1.173 Sterol | 181% to 302% |
| 214339 | Sterols, Oxygenated Terpenes, and Other Isoprenoids | Terpenoids | F1-U1.236 Sterol | 272% to 454% |
| 214339 | Sterols, Oxygenated Terpenes, and Other Isoprenoids | Terpenoids | Stigmasterol | 116% to 194% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214346

| Seq ID | Chemical Class | Biochemical Class | Compound Name | Modification |
|---|---|---|---|---|
| 214346 | Amino Acids and Related Compounds | Amino Acids and Related Compounds | Alanine | 90% to 285% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214356

| Seq ID | Chemical Class | Biochemical Class | Compound Name | Modification |
|---|---|---|---|---|
| 214356 | Acids - Hydroxy Alpha | Carbohydrates | Quinic acid | 416% to 693% |
| 214356 | Alcohols | Carbohydrates | Inositol | 60% to 91% |
| 214356 | Carbohydrates | Carbohydrates | F3-U0.744 Carbohydrate | 154% to 256% |
| 214356 | Carbohydrates | Carbohydrates | F3-U0.797 Carbohydrate | New |
| 214356 | Carbohydrates | Carbohydrates | F3-U0.825 Carbohydrate | New |
| 214356 | Carbohydrates | Carbohydrates | F3-U0.848 Carbohydrate | 684% to 1140% |
| 214356 | Carbohydrates | Carbohydrates | F3-U1.032 Carbohydrate | New |
| 214356 | Carbohydrates | Carbohydrates | Fructose | 60% to 164% |
| 214356 | Carbohydrates | Carbohydrates | Glucose | 427% to 854% |
| 214356 | NA | NA | F3-U0.740 | 894% to 1490% |
| 214356 | NA | NA | F3-U0.785B | New |
| 214356 | NA | NA | F3-U0.850 | New |
| 214356 | NA | NA | F3-U1.067 | New |
| 214356 | NA | NA | F3-U1.080 | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214370

| Seq ID | Chemical Class | Biochemical Class | Compound Name | Modification |
|---|---|---|---|---|
| 214370 | Acids | Acids | Carbamic acid | NQ |
| 214370 | Acids - Hydroxy Alpha | Acid Pathway | Butanoic acid, 2,3,4-trihydroxy- | 192% to 320% |
| 214370 | Acids - Hydroxy Alpha | Acid Pathway | Malic acid | 60% to 91% |
| 214370 | Acids - Hydroxy Alpha | Carbohydrates | Quinic acid | 60% to 92% |
| 214370 | Amino Acids and Related Compounds | Amino Acids and Related Compounds | Proline | 165% to 275% |
| 214370 | Carbohydrates | Carbohydrates | F3-U0.816 Carbohydrate | 60% to 89% |
| 214370 | Carbohydrates | Carbohydrates | F3-U0.825 Carbohydrate | New |
| 214370 | Carbohydrates | Carbohydrates | F3-U0.846 Carbohydrate | 191% to 430% |
| 214370 | Carbohydrates | Carbohydrates | F3-U0.848 Carbohydrate | 167% to 279% |
| 214370 | Carbohydrates | Carbohydrates | Fructose | 237% to 546% |
| 214370 | Carbohydrates | Carbohydrates | Galactose or Mannose | 98% to 164% |
| 214370 | Carbohydrates | Carbohydrates | Glucose | 84% to 658% |
| 214370 | NA | NA | F3-U0.882 | 82% to 137% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214382

| Seq ID | Chemical Class | Biochemical Class | Compound Name | Modification |
|---|---|---|---|---|
| 214382 | Aldehydes, Ketones and Quinones | Aldehydes, Ketones and Quinones | 3-Phytylmenadione | 150% to 250% |
| 214382 | Amino Acids and Related Compounds | Amino Acids and Related Compounds | Arginine | 240% to 425% |
| 214382 | Amino Acids and Related Compounds | Amino Acids and Related Compounds | Isoleucine | New |
| 214382 | Amino Acids and Related Compounds | Amino Acids and Related Compounds | Leucine | New |
| 214382 | Amino Acids and Related Compounds | Amino Acids and Related Compounds | Tryptophan | New |
| 214382 | Amino Acids and Related Compounds | Amino Acids and Related Compounds | Tyrosine | New |
| 214382 | Amino Acids and Related Compounds | Amino Acids and Related Compounds | Valine | 195% to 465% |
| 214382 | Esters | Esters | F1-U1.076 Fatty Acid Ester | 98% to 163% |
| 214382 | Esters | Fatty Acids and Related Waxes | Hexadecanoic acid, glyceryl ester | 60% to 86% |
| 214382 | Esters - Hydroxy | Acyl acetylglycerols | 2-Eicosanoyl-1-acetylglycerol | 69% to 115% |
| 214382 | Esters - Hydroxy | Acyl acetylglycerols | 2-Octadecanoyl-1-acetylglycerol | 67% to 111% |
| 214382 | Sterols, Oxygenated Terpenes, and Other Isoprenoids | Prenylquinones | alpha-Tocopherol hydroquinone | 323% to 538% |
| 214382 | Sterols, Oxygenated Terpenes, and Other Isoprenoids | Terpenoids | beta-Sitosterol | 165% to 276% |
| 214382 | Sterols, Oxygenated Terpenes, and Other Isoprenoids | Terpenoids | Campesterol | 65% to 108% |
| 214382 | Sterols, Oxygenated Terpenes, and Other Isoprenoids | Terpenoids | Cholesterol | 104% to 173% |
| 214382 | Sterols, Oxygenated Terpenes, and Other Isoprenoids | Terpenoids | F1-U1.136 Sterol | 94% to 156% |
| 214382 | Sterols, Oxygenated Terpenes, and Other Isoprenoids | Terpenoids | F1-U1.164 Sterol | 181% to 302% |
| 214382 | Sterols, Oxygenated Terpenes, and Other Isoprenoids | Terpenoids | F1-U1.173 Sterol | 91% to 152% |
| 214382 | Sterols, Oxygenated Terpenes, and Other Isoprenoids | Terpenoids | Stigmasterol | 77% to 129% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214388

| Seq ID | Chemical Class | Biochemical Class | Compound Name | Modification |
|---|---|---|---|---|
| 214388 | Amino Acids and Related Compounds | Amino Acids and Related Compounds | Arginine | 390% to 655% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214394

| Seq ID | Chemical Class | Biochemical Class | Compound Name | Modification |
|---|---|---|---|---|
| 214394 | Acids | Acids | Carbamic acid | New |
| 214394 | Acids - Hydroxy Alpha | Acid Pathway | Butanoic acid, 2,3,4-trihydroxy- | New |
| 214394 | Acids - Hydroxy Alpha | Acid Pathway | Malic acid | 436% to 726% |
| 214394 | Acids - Hydroxy Alpha | Carbohydrates | Quinic acid | 63% to 924% |
| 214394 | Alcohols | Carbohydrates | Inositol | 60% to 77% |
| 214394 | Alkaloids and Other Bases | Polyamines | 1,4-Butanediamine | 73% to 122% |
| 214394 | Amino Acids and Related Compounds | Amino Acids and Related Compounds | Proline, 5-oxo- | New |
| 214394 | Carbohydrates | Carbohydrates | F3-U0.744 Carbohydrate | NQ |
| 214394 | Carbohydrates | Carbohydrates | F3-U0.848 Carbohydrate | 164% to 273% |
| 214394 | Carbohydrates | Carbohydrates | F3-U0.872 Hexose | 68% to 113% |
| 214394 | Carbohydrates | Carbohydrates | F3-U1.150 Carbohydrate | 60% to 88% |
| 214394 | Carbohydrates | Carbohydrates | F3-U1.189 Carbohydrate | 64% to 107% |
| 214394 | Carbohydrates | Carbohydrates | F3-U1.194 Carbohydrate | 91% to 151% |
| 214394 | Carbohydrates | Carbohydrates | Fructose | 295% to 546% |
| 214394 | Carbohydrates | Carbohydrates | Galactose or Mannose | New |
| 214394 | Carbohydrates | Carbohydrates | Glucose | 346% to 963% |
| 214394 | NA | NA | F3-U0.727 | New |
| 214394 | NA | NA | F3-U0.736 | New |
| 214394 | NA | NA | F3-U0.740 | NQ |
| 214394 | NA | NA | F3-U0.850 | New |
| 214394 | NA | NA | F3-U0.882 | 60% to New |
| 214394 | NA | NA | F3-U1.253 | 94% to 157% |
| 214394 | Phenols and Related Compounds | Phenylpropanes and Derivatives | Chlorogenic acid | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214401

| Seq ID | Chemical Class | Biochemical Class | Compound Name | Modification |
|---|---|---|---|---|
| 214401 | Acids - Hydroxy Alpha | Acid Pathway | Malic acid | 187% to 311% |
| 214401 | Acids - Hydroxy Alpha | Carbohydrates | Quinic acid | 252% to 419% |
| 214401 | Alcohols | Carbohydrates | Inositol | 60% to 98% |
| 214401 | Carbohydrates | Carbohydrates | F3-U0.872 Hexose | 117% to 195% |
| 214401 | Carbohydrates | Carbohydrates | F3-U0.891 Carbohydrate | 691% to 1151% |
| 214401 | Carbohydrates | Carbohydrates | F3-U1.032 Carbohydrate | New |
| 214401 | Carbohydrates | Carbohydrates | F3-U1.060 Carbohydrate | 93% to 154% |
| 214401 | Carbohydrates | Carbohydrates | F3-U1.150 Carbohydrate | 92% to 153% |
| 214401 | Carbohydrates | Carbohydrates | Glucose | 138% to 342% |
| 214401 | NA | NA | F3-U1.067 | 310% to 516% |
| 214401 | NA | NA | F3-U1.080 | 263% to 439% |
| 214401 | NA | NA | F3-U1.229 | 69% to 115% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214402

| Seq ID | Chemical Class | Biochemical Class | Compound Name | Modification |
|---|---|---|---|---|
| 214402 | Acids | Acids | Carbamic acid | New |
| 214402 | Acids - Hydroxy Alpha | Acid Pathway | Citric acid | New |
| 214402 | Acids - Hydroxy Alpha | Acid Pathway | Malic acid | 658% to 1096% |
| 214402 | Acids - Hydroxy Alpha | Carbohydrates | Quinic acid | 584% to 973% |
| 214402 | Amino Acids and Related Compounds | Amino Acids and Related Compounds | Proline, 5-oxo- | New |
| 214402 | Carbohydrates | Carbohydrates | F3-U1.150 Carbohydrate | 131% to 218% |
| 214402 | Carbohydrates | Carbohydrates | F3-U1.189 Carbohydrate | New |
| 214402 | Carbohydrates | Carbohydrates | F3-U1.194 Carbohydrate | New |
| 214402 | Carbohydrates | Carbohydrates | Glucose | 209% to 411% |
| 214402 | NA | NA | F3-U0.736 | New |
| 214402 | NA | NA | F3-U0.785B | NQ |
| 214402 | NA | NA | F3-U0.882 | New |
| 214402 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214403

| Seq ID | Chemical Class | Biochemical Class | Compound Name | Modification |
|---|---|---|---|---|
| 214403 | Acids - Hydroxy Alpha | Acid Pathway | Citric acid | 60% to 75% |
| 214403 | Carbohydrates | Carbohydrates | F3-U0.813 Carbohydrate | 60% to 83% |
| 214403 | Carbohydrates | Carbohydrates | F3-U0.816 Carbohydrate | 60% to 94% |
| 214403 | Carbohydrates | Carbohydrates | F3-U0.821 Carbohydrate | 60% to 75% |
| 214403 | Carbohydrates | Carbohydrates | F3-U0.846 Carbohydrate | 127% to 212% |
| 214403 | Carbohydrates | Carbohydrates | F3-U0.848 Carbohydrate | 65% to 108% |
| 214403 | Carbohydrates | Carbohydrates | F3-U0.872 Hexose | 140% to 233% |
| 214403 | Carbohydrates | Carbohydrates | F3-U1.189 Carbohydrate | 60% to 88% |
| 214403 | Carbohydrates | Carbohydrates | F3-U1.194 Carbohydrate | 79% to 131% |
| 214403 | Carbohydrates | Carbohydrates | Glucose | 86% to 165% |
| 214403 | NA | NA | F3-U0.852A | New |
| 214403 | NA | NA | F3-U1.253 | 60% to 89% |
| 214403 | Phenols and Related Compounds | Phenylpropanes and Derivatives | Chlorogenic acid | 60% to 91% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214404

| Seq ID | Chemical Class | Biochemical Class | Compound Name | Modification |
|---|---|---|---|---|
| 214404 | Acids - Hydroxy Alpha | Acid Pathway | Malic acid | 246% to 411% |
| 214404 | Acids - Hydroxy Alpha | Carbohydrates | Quinic acid | 191% to 319% |
| 214404 | Alcohols | Carbohydrates | Inositol | 74% to 123% |
| 214404 | Carbohydrates | Carbohydrates | F3-U0.768B Carbohydrate | New |
| 214404 | Carbohydrates | Carbohydrates | F3-U0.848B Carbohydrate | 225% to 375% |
| 214404 | Carbohydrates | Carbohydrates | Fructose | 229% to 398% |
| 214404 | Carbohydrates | Carbohydrates | Glucose | 314% to 686% |
| 214404 | NA | NA | F3-U0.740 | 376% to 627% |
| 214404 | NA | NA | F3-U0.785B | New |
| 214404 | NA | NA | F3-U0.850 | New |
| 214404 | NA | NA | F3-U1.067 | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214407

| Seq ID | Chemical Class | Biochemical Class | Compound Name | Modification |
|---|---|---|---|---|
| 214407 | Acids - Hydroxy | Amino Acids and Related Compounds | Shikimic acid | 88% to 147% |
| 214407 | Acids - Hydroxy Alpha | Acid Pathway | Butanoic acid, 2,3,4-trihydroxy- | 252% to 420% |
| 214407 | Acids - Hydroxy Alpha | Acid Pathway | Malic acid | 70% to 117% |
| 214407 | Carbohydrates | Carbohydrates | F3-U0.813 Carbohydrate | 176% to 294% |
| 214407 | Carbohydrates | Carbohydrates | F3-U0.816 Carbohydrate | 88% to 147% |
| 214407 | Carbohydrates | Carbohydrates | F3-U0.825 Carbohydrate | 170% to 283% |
| 214407 | Carbohydrates | Carbohydrates | F3-U0.825 Carbohydrate | New |
| 214407 | Carbohydrates | Carbohydrates | F3-U0.846 Carbohydrate | 481% to 802% |
| 214407 | Carbohydrates | Carbohydrates | F3-U0.848 Carbohydrate | 154% to 257% |
| 214407 | Carbohydrates | Carbohydrates | F3-U0.872 Hexose | 481% to 802% |
| 214407 | Carbohydrates | Carbohydrates | F3-U0.948 Carbohydrate | 106% to 177% |
| 214407 | Carbohydrates | Carbohydrates | F3-U1.113 Carbohydrate | 60% to 89% |
| 214407 | Carbohydrates | Carbohydrates | F3-U1.189 Carbohydrate | 95% to 159% |
| 214407 | Carbohydrates | Carbohydrates | Fructose | 1733% to 383% |
| 214407 | Carbohydrates | Carbohydrates | Galactose or Mannose | 109% to 181% |
| 214407 | Carbohydrates | Carbohydrates | Glucose | 71% to 589% |
| 214407 | NA | NA | F3-U0.882 | 100% to 167% |
| 214407 | NA | NA | F3-U0.899 | 95% to 159% |
| 214407 | NA | NA | F3-U1.229 | 60% to 93% |
| 214407 | NA | NA | F3-U1.253 | 65% to 108% |
| 214407 | NA | NA | F3-U1.255 | 123% to 205% |
| 214407 | Phenols and Related Compounds | Phenylpropanes and Derivatives | Chlorogenic acid | 74% to 124% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214411

| Seq ID | Chemical Class | Biochemical Class | Compound Name | Modification |
|---|---|---|---|---|
| 214411 | Acids | Acids | Carbamic acid | New |
| 214411 | Acids - Hydroxy | Amino Acids and Related Compounds | Shikimic acid | 60% to 83% |
| 214411 | Acids - Hydroxy Alpha | Carbohydrates | Quinic acid | 149% to 249% |
| 214411 | Alkaloids and Other Bases | Polyamines | 1,4-Butanediamine | 60% to 89% |
| 214411 | Amino Acids and Related Compounds | Amino Acids and Related Compounds | Glutamic acid | 60% to 94% |
| 214411 | Amino Acids and Related Compounds | Amino Acids and Related Compounds | Proline, 5-oxo- | 60% to 95% |
| 214411 | Carbohydrates | Carbohydrates | F3-U0.816 Carbohydrate | 60% to 83% |
| 214411 | Carbohydrates | Carbohydrates | F3-U0.825 Carbohydrate | 84% to 140% |
| 214411 | Carbohydrates | Carbohydrates | F3-U0.846 Carbohydrate | 198% to 330% |
| 214411 | Carbohydrates | Carbohydrates | F3-U0.848 Carbohydrate | 82% to 136% |
| 214411 | Carbohydrates | Carbohydrates | F3-U0.872 Hexose | 212% to 353% |
| 214411 | Carbohydrates | Carbohydrates | F3-U1.150 Carbohydrate | 101% to 169% |
| 214411 | Carbohydrates | Carbohydrates | F3-U1.189 Carbohydrate | 70% to 117% |
| 214411 | Carbohydrates | Carbohydrates | F3-U1.194 Carbohydrate | 73% to 121% |
| 214411 | Carbohydrates | Carbohydrates | Glucose | 60% to 109% |
| 214411 | NA | NA | F3-U0.736 | New |
| 214411 | NA | NA | F3-U0.751 | 66% to 111% |
| 214411 | NA | NA | F3-U0.852A | New |
| 214411 | NA | NA | F3-U1.229 | 60% to 88% |
| 214411 | NA | NA | F3-U1.253 | 60% to 85% |
| 214411 | Phenols and Related Compounds | Phenylpropanes and Derivatives | Chlorogenic acid | 89% to 149% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214414

| Seq ID | Chemical Class | Biochemical Class | Compound Name | Modification |
|---|---|---|---|---|
| 214414 | Acids - Hydroxy Alpha | Acid Pathway | Butanoic acid, 2,3,4-trihydroxy- | 60% to 420% |
| 214414 | Acids - Hydroxy Alpha | Acid Pathway | Citric acid | 77% to 129% |
| 214414 | Acids - Hydroxy Alpha | Acid Pathway | Malic acid | 60% to 174% |
| 214414 | Acids - Hydroxy Alpha | Carbohydrates | Quinic acid | 252% to 707% |
| 214414 | Alcohols | Carbohydrates | Inositol | 129% to 215% |
| 214414 | Alkenes and Alkynes | Terpenoids | Squalene | New |
| 214414 | Amino Acids and Related Compounds | Amino Acids and Related Compounds | Glutamic acid | 84% to 140% |
| 214414 | Amino Acids and Related Compounds | Amino Acids and Related Compounds | Glycine | New |
| 214414 | Amino Acids and Related Compounds | Amino Acids and Related Compounds | Proline | New |
| 214414 | Amino Acids and Related Compounds | Amino Acids and Related Compounds | Proline, 5-oxo- | 107% to 179% |
| 214414 | Carbohydrates | Carbohydrates | F3-U0.813 Carbohydrate | 759% to 1265% |
| 214414 | Carbohydrates | Carbohydrates | F3-U0.816 Carbohydrate | 60% to 717% |
| 214414 | Carbohydrates | Carbohydrates | F3-U0.821 Carbohydrate | 77% to 642% |
| 214414 | Carbohydrates | Carbohydrates | F3-U0.825 Carbohydrate | 75% to 2465% |
| 214414 | Carbohydrates | Carbohydrates | F3-U0.846 Carbohydrate | 183% to 1749% |
| 214414 | Carbohydrates | Carbohydrates | F3-U0.848 Carbohydrate | 431% to 719% |
| 214414 | Carbohydrates | Carbohydrates | F3-U0.872 Hexose | 220% to 1704% |
| 214414 | Carbohydrates | Carbohydrates | F3-U1.150 Carbohydrate | 89% to 149% |
| 214414 | Carbohydrates | Carbohydrates | F3-U1.189 Carbohydrate | 126% to 210% |
| 214414 | Carbohydrates | Carbohydrates | F3-U1.194 Carbohydrate | 169% to 281% |
| 214414 | Carbohydrates | Carbohydrates | Fructose | 129% to 251% |
| 214414 | Carbohydrates | Carbohydrates | Glucose | 616% to 1198% |
| 214414 | Carbohydrates | Carbohydrates | Sucrose | 97% to 161% |
| 214414 | Esters | Esters | F1-U1.076 Fatty Acid Ester | NQ |
| 214414 | Esters | Esters | F1-U1.121 Fatty Acid Ester | 199% to 332% |
| 214414 | Esters | Fatty Acids and Related Waxes | Hexadecanoic acid, glyceryl ester | 114% to 190% |
| 214414 | Esters - Hydroxy | Acyl glycerols | 2-Eicosanoyl-1-acetylglycerol | 60% to 86% |
| 214414 | Hydrocarbons | Hydrocarbons | Nonacosane, 3-methyl | 60% to 78% |
| 214414 | NA | NA | F1-U0.875 | New |
| 214414 | NA | NA | F1-U0.996 | 60% to 90% |
| 214414 | NA | NA | F1-U1.009 | NQ |
| 214414 | NA | NA | F3-U0.740 | 173% to 288% |
| 214414 | NA | NA | F3-U0.751 | 80% to 868% |
| 214414 | NA | NA | F3-U0.852A | New |
| 214414 | NA | NA | F3-U1.253 | 60% to 87% |
| 214414 | Phenols and Related Compounds | Phenylpropanes and Derivatives | Chlorogenic acid | 136% to 227% |
| 214414 | Sterols, Oxygenated Terpenes, and Other Isoprenoids | Prenylquinones | alpha-Tocopherol hydroquinone | 180% to 300% |
| 214414 | Sterols, Oxygenated Terpenes, and Other Isoprenoids | Terpenoids | beta-Sitosterol | 118% to 195% |
| 214414 | Sterols, Oxygenated Terpenes, and Other Isoprenoids | Terpenoids | Cholesterol | 60% to 98% |
| 214414 | Sterols, Oxygenated Terpenes, and Other Isoprenoids | Terpenoids | Cycloartanol, 24-methylene- | 771% to 1285% |
| 214414 | Sterols, Oxygenated Terpenes, and Other Isoprenoids | Terpenoids | Cycloartenol | 690% to 1150% |
| 214414 | Sterols, Oxygenated Terpenes, and Other Isoprenoids | Terpenoids | Ergosta-8,24(28)-dien-3-ol, 4,14-dimethyl- | New |
| 214414 | Sterols, Oxygenated Terpenes, and Other Isoprenoids | Terpenoids | F1-U1.136 Sterol | 60% to 99% |
| 214414 | Sterols, Oxygenated Terpenes, and Other Isoprenoids | Terpenoids | F1-U1.173 Sterol | 60% to 88% |
| 214414 | Sterols, Oxygenated Terpenes, and Other Isoprenoids | Terpenoids | F1-U1.244 Sterol | New |
| 214414 | Sterols, Oxygenated Terpenes, and Other Isoprenoids | Prenylquinones | gamma-Tocopherol | New |
| 214414 | Sterols, Oxygenated Terpenes, and Other Isoprenoids | Terpenoids | Lophenol, 24-methylene- | 71% to 118% |
| 214414 | Sterols, Oxygenated Terpenes, and Other Isoprenoids | Terpenoids | Stigmasterol | 90% to 150% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214415

| Seq ID | Chemical Class | Biochemical Class | Compound Name | Modification |
|---|---|---|---|---|
| 214415 | Acids | Acids | Carbamic acid | New |
| 214415 | Acids - Hydroxy Alpha | Acid Pathway | Butanoic acid, 2,3,4-trihydroxy- | New |
| 214415 | Acids - Hydroxy Alpha | Acid Pathway | Malic acid | 480% to 800% |
| 214415 | Acids - Hydroxy Alpha | Carbohydrates | Quinic acid | 177% to 296% |
| 214415 | Alcohols | Carbohydrates | Inositol | 113% to 188% |
| 214415 | Alkaloids and Other Bases | Polyamines | 1,4-Butanediamine | New |
| 214415 | Amino Acids and Related Compounds | Amino Acids and Related Compounds | Aspartic acid | New |
| 214415 | Amino Acids and Related Compounds | Amino Acids and Related Compounds | Proline, 5-oxo- | New |
| 214415 | Carbohydrates | Carbohydrates | F3-U0.744 Carbohydrate | NQ |
| 214415 | Carbohydrates | Carbohydrates | F3-U0.768B Carbohydrate | New |
| 214415 | Carbohydrates | Carbohydrates | F3-U0.848 Carbohydrate | 84% to 140% |
| 214415 | Carbohydrates | Carbohydrates | F3-U0.872 Hexose | 310% to 516% |
| 214415 | Carbohydrates | Carbohydrates | F3-U0.891 Carbohydrate | New |
| 214415 | Carbohydrates | Carbohydrates | F3-U1.189 Carbohydrate | New |
| 214415 | Carbohydrates | Carbohydrates | Fructose | 109% to 207% |
| 214415 | Carbohydrates | Carbohydrates | Galactose or Mannose | New |
| 214415 | Carbohydrates | Carbohydrates | Glucose | 328% to 584% |
| 214415 | NA | NA | F3-U0.602 | New |
| 214415 | NA | NA | F3-U0.727 | New |
| 214415 | NA | NA | F3-U0.740 | NQ |
| 214415 | NA | NA | F3-U0.882 | New |
| 214415 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214417

| Seq ID | Chemical Class | Biochemical Class | Compound Name | Modification |
|---|---|---|---|---|
| 214417 | Esters - Hydroxy | Acyl acetylglycerols | 2-Octadecanoyl-1-acetylglycerol | 159% to 265% |
| 214417 | Amino Acids and Related Compounds | Amino Acids and Related Compounds | Isoleucine | New |
| 214417 | Amino Acids and Related Compounds | Amino Acids and Related Compounds | Leucine | New |
| 214417 | Amino Acids and Related Compounds | Amino Acids and Related Compounds | Tryptophan | New |
| 214417 | Esters | Esters | F1-U1.076 Fatty Acid Ester | 113% to 189% |
| 214417 | Esters | Esters | F1-U1.113 Fatty Acid Ester | 195% to 325% |
| 214417 | Esters | Esters | F1-U1.121 Fatty Acid Ester | New |
| 214417 | Sterols, Oxygenated Terpenes, and Other Isoprenoids | Prenylquinones | alpha-Tocopherol | 72% to 119% |
| 214417 | Sterols, Oxygenated Terpenes, and Other Isoprenoids | Prenylquinones | alpha-Tocopherol hydroquinone | 219% to 365% |
| 214417 | Sterols, Oxygenated Terpenes, and Other Isoprenoids | Terpenoids | beta-Sitosterol | 143% to 238% |
| 214417 | Sterols, Oxygenated Terpenes, and Other Isoprenoids | Prenylquinones | beta-Tocopherol | New |
| 214417 | Sterols, Oxygenated Terpenes, and Other Isoprenoids | Terpenoids | Cycloartenol | 80% to 133% |
| 214417 | Sterols, Oxygenated Terpenes, and Other Isoprenoids | Terpenoids | F1-U1.136 Sterol | 60% to 85% |
| 214417 | Sterols, Oxygenated Terpenes, and Other Isoprenoids | Terpenoids | Solanesol | New |
| 214417 | Sterols, Oxygenated Terpenes, and Other Isoprenoids | Terpenoids | Stigmasterol | 60% to 96% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214421

| Seq ID | Chemical Class | Biochemical Class | Compound Name | Modification |
|---|---|---|---|---|
| 214421 | Acids - Hydroxy Alpha | Carbohydrates | Glyceric acid | New |
| 214421 | Acids - Hydroxy Alpha | Carbohydrates | Quinic acid | 78% to 129% |
| 214421 | Amino Acids and Related Compounds | Amino Acids and Related Compounds | Proline | NQ |
| 214421 | Carbohydrates | Carbohydrates | F3-U0.816 Carbohydrate | 133% to 221% |
| 214421 | Carbohydrates | Carbohydrates | F3-U0.825 Carbohydrate | 67% to 111% |
| 214421 | Carbohydrates | Carbohydrates | F3-U0.846 Carbohydrate | 204% to 339% |
| 214421 | Carbohydrates | Carbohydrates | F3-U0.848 Carbohydrate | 101% to 168% |
| 214421 | Carbohydrates | Carbohydrates | F3-U0.872 Hexose | 306% to 511% |
| 214421 | Carbohydrates | Carbohydrates | F3-U1.189 Carbohydrate | 96% to 159% |
| 214421 | Carbohydrates | Carbohydrates | F3-U1.194 Carbohydrate | 115% to 191% |
| 214421 | Carbohydrates | Carbohydrates | Fructose | 238% to 445% |
| 214421 | Carbohydrates | Carbohydrates | Galactose or Mannose | 141% to 235% |
| 214421 | Carbohydrates | Carbohydrates | Glucose | 440% to 896% |
| 214421 | NA | NA | F3-U0.852A | New |
| 214421 | NA | NA | F3-U0.882 | 67% to 112% |
| 214421 | NA | NA | F3-U0.899 | 60% to 94% |
| 214421 | Phenols and Related Compounds | Phenylpropanes and Derivatives | Chlorogenic acid | 76% to 126% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214423

| Seq ID | Chemical Class | Biochemical Class | Compound Name | Modification |
|---|---|---|---|---|
| 214423 | Acids - Hydroxy Alpha | Acid Pathway | Malic acid | NQ |
| 214423 | Alcohols | Carbohydrates | Inositol | 60% to 76% |
| 214423 | Amino Acids and Related Compounds | Amino Acids and Related Compounds | Arginine | 165% to 550% |
| 214423 | Carbohydrates | Carbohydrates | F3-U0.797 Carbohydrate | 61% to 102% |
| 214423 | Carbohydrates | Carbohydrates | F3-U0.872 Hexose | 66% to 110% |
| 214423 | Carbohydrates | Carbohydrates | F3-U0.891 Carbohydrate | 154% to 256% |
| 214423 | Carbohydrates | Carbohydrates | F3-U1.060 Carbohydrate | 62% to 104% |
| 214423 | Carbohydrates | Carbohydrates | Fructose | -60% to -88% |
| 214423 | NA | NA | F3-U0.748 | 62% to 103% |
| 214423 | NA | NA | F3-U1.067 | 196% to 327% |
| 214423 | NA | NA | F3-U1.080 | 206% to 343% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214425

| Seq ID | Chemical Class | Biochemical Class | Compound Name | Modification |
|---|---|---|---|---|
| 214425 | Acids - Hydroxy Alpha | Acid Pathway | Malic acid | 60% to 98% |
| 214425 | Acids - Hydroxy Alpha | Carbohydrates | Quinic acid | 206% to 343% |
| 214425 | Alcohols | Carbohydrates | Inositol | 144% to 240% |
| 214425 | Alkaloids and Other Bases | Polyamines | 1,4-Butanediamine | New |
| 214425 | Carbohydrates | Carbohydrates | F3-U0.744 Carbohydrate | 177% to 295% |
| 214425 | Carbohydrates | Carbohydrates | F3-U0.797 Carbohydrate | New |
| 214425 | Carbohydrates | Carbohydrates | F3-U0.813 Carbohydrate | 303% to 506% |
| 214425 | Carbohydrates | Carbohydrates | F3-U0.816 Carbohydrate | 137% to 229% |
| 214425 | Carbohydrates | Carbohydrates | F3-U0.825 Carbohydrate | New |
| 214425 | Carbohydrates | Carbohydrates | F3-U0.846 Carbohydrate | 404% to 673% |
| 214425 | Carbohydrates | Carbohydrates | F3-U0.848 Carbohydrate | 88% to 1045% |
| 214425 | Carbohydrates | Carbohydrates | F3-U0.872 Hexose | 344% to 574% |
| 214425 | Carbohydrates | Carbohydrates | F3-U1.060 Carbohydrate | New |
| 214425 | Carbohydrates | Carbohydrates | Fructose | 214% to 485% |
| 214425 | Carbohydrates | Carbohydrates | Galactose or Mannose | 178% to 297% |
| 214425 | Carbohydrates | Carbohydrates | Glucose | 87% to 1071% |
| 214425 | Carbohydrates | Carbohydrates | Sucrose | 60% to 95% |
| 214425 | NA | NA | F3-U0.740 | New |
| 214425 | NA | NA | F3-U0.785B | New |
| 214425 | NA | NA | F3-U0.850 | New |
| 214425 | NA | NA | F3-U0.882 | 141% to 235% |
| 214425 | NA | NA | F3-U1.067 | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214437

| Seq ID | Chemical Class | Biochemical Class | Compound Name | Modification |
|--------|---------------|-------------------|---------------|--------------|
| 214437 | Acids - Fatty | Fatty Acids and Related Waxes | Octadecanoic acid | 47% to 243% |
| 214437 | Acids - Fatty Unsat | Fatty Acids and Related Waxes | 9,12-Octadecadienoic acid | 13% to 29% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214438

| Seq ID | Chemical Class | Biochemical Class | Compound Name | Modification |
|---|---|---|---|---|
| 214438 | Acids - Hydroxy Alpha | Acid Pathway | Malic acid | NQ |
| 214438 | Acids - Hydroxy Alpha | Carbohydrates | Quinic acid | 125% to 208% |
| 214438 | Carbohydrates | Carbohydrates | Glucose | 60% to 125% |
| 214438 | NA | NA | F3-U0.748 | 83% to 138% |
| 214438 | NA | NA | F3-U0.799 | 89% to 149% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214439

| Seq ID | Chemical Class | Biochemical Class | Compound Name | Modification |
|---|---|---|---|---|
| 214439 | Acids - Hydroxy Alpha | Acid Pathway | Butanoic acid, 2,3,4-trihydroxy- | New |
| 214439 | Acids - Hydroxy Alpha | Acid Pathway | Malic acid | 692% to 1154% |
| 214439 | Acids - Hydroxy Alpha | Carbohydrates | Quinic acid | 246% to 409% |
| 214439 | Alcohols | Carbohydrates | Inositol | 210% to 350% |
| 214439 | Carbohydrates | Carbohydrates | Arabinose or Xylose | New |
| 214439 | Carbohydrates | Carbohydrates | F3-U0.744 Carbohydrate | 247% to 411% |
| 214439 | Carbohydrates | Carbohydrates | F3-U0.768B Carbohydrate | New |
| 214439 | Carbohydrates | Carbohydrates | F3-U0.797 Carbohydrate | New |
| 214439 | Carbohydrates | Carbohydrates | F3-U0.825 Carbohydrate | New |
| 214439 | Carbohydrates | Carbohydrates | F3-U0.872 Hexose | 125% to 209% |
| 214439 | Carbohydrates | Carbohydrates | F3-U0.907 Carbohydrate | New |
| 214439 | Carbohydrates | Carbohydrates | F3-U0.952 Carbohydrate | 135% to 225% |
| 214439 | Carbohydrates | Carbohydrates | Fructose | 209% to 1086% |
| 214439 | Carbohydrates | Carbohydrates | Galactose or Mannose | 65% to 109% |
| 214439 | Carbohydrates | Carbohydrates | Glucose | 88% to 2948% |
| 214439 | NA | NA | F3-U0.727 | 60% to 92% |
| 214439 | NA | NA | F3-U0.740 | 1523% to 2538% |
| 214439 | NA | NA | F3-U0.771 | New |
| 214439 | NA | NA | F3-U0.785B | New |
| 214439 | NA | NA | F3-U0.850 | 896% to 1493% |
| 214439 | NA | NA | F3-U1.067 | New |
| 214439 | NA | NA | F3-U1.229 | 88% to 146% |
| 214439 | NA | NA | F3-U1.253 | 110% to 183% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214441

| Seq ID | Chemical Class | Biochemical Class | Compound Name | Modification |
|---|---|---|---|---|
| 214441 | Acids - Hydroxy Alpha | Carbohydrates | Quinic acid | 79% to 131% |
| 214441 | Carbohydrates | Carbohydrates | F3-U0.846 Carbohydrate | 66% to 110% |
| 214441 | Carbohydrates | Carbohydrates | F3-U0.848 Carbohydrate | 60% to 95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214443

| Seq ID | Chemical Class | Biochemical Class | Compound Name | Modification |
|---|---|---|---|---|
| 214443 | Acids | Acids | Carbamic acid | New |
| 214443 | Acids - Hydroxy | Amino Acids and Related Compounds | Shikimic acid | New |
| 214443 | Acids - Hydroxy Alpha | Acid Pathway | Butanoic acid, 2,3,4-trihydroxy- | New |
| 214443 | Acids - Hydroxy Alpha | Acid Pathway | Malic acid | 308% to 513% |
| 214443 | Acids - Hydroxy Alpha | Acid Pathway | Quinic acid | 566% to 943% |
| 214443 | Alcohols | Carbohydrates | Inositol | 98% to 163% |
| 214443 | Carbohydrates | Carbohydrates | F3-U0.813 Carbohydrate | New |
| 214443 | Carbohydrates | Carbohydrates | F3-U0.816 Carbohydrate | New |
| 214443 | Carbohydrates | Carbohydrates | F3-U0.821 Carbohydrate | 125% to 208% |
| 214443 | Carbohydrates | Carbohydrates | F3-U0.846 Carbohydrate | 3741% to 6236% |
| 214443 | Carbohydrates | Carbohydrates | F3-U0.848B Carbohydrate | 72% to 120% |
| 214443 | Carbohydrates | Carbohydrates | F3-U0.872 Hexose | 209% to 348% |
| 214443 | Carbohydrates | Carbohydrates | F3-U1.113 Carbohydrate | 62% to 104% |
| 214443 | Carbohydrates | Carbohydrates | F3-U1.189 Carbohydrate | 74% to 124% |
| 214443 | Carbohydrates | Carbohydrates | Fructose | 160% to 424% |
| 214443 | Carbohydrates | Carbohydrates | Galactose or Mannose | -60% to -77% |
| 214443 | Carbohydrates | Carbohydrates | Glucose | 60% to 247% |
| 214443 | NA | NA | F3-U0.852A | New |
| 214443 | NA | NA | F3-U1.253 | 98% to 163% |
| 214443 | Phenols and Related Compounds | Phenylpropanes and Derivatives | Chlorogenic acid | 78% to 129% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214452

| Seq ID | Chemical Class | Biochemical Class | Compound Name | Modification |
|---|---|---|---|---|
| 214452 | Acids - Hydroxy. | Amino Acids and Related Compounds | Shikimic acid | New |
| 214452 | Acids - Hydroxy Alpha | Acid Pathway | Butanoic acid, 2,3,4-trihydroxy- | New |
| 214452 | Acids - Hydroxy Alpha | Acid Pathway | Citric acid | 110% to 184% |
| 214452 | Acids - Hydroxy Alpha | Acid Pathway | Malic acid | 135% to 225% |
| 214452 | Acids - Hydroxy Alpha | Carbohydrates | Quinic acid | 335% to 559% |
| 214452 | Alcohols | Carbohydrates | Inositol | 78% to 130% |
| 214452 | Carbohydrates | Carbohydrates | F3-U0.813 Carbohydrate | New |
| 214452 | Carbohydrates | Carbohydrates | F3-U0.816 Carbohydrate | New |
| 214452 | Carbohydrates | Carbohydrates | F3-U0.821 Carbohydrate | 110% to 184% |
| 214452 | Carbohydrates | Carbohydrates | F3-U0.846 Carbohydrate | 5170% to 8616% |
| 214452 | Carbohydrates | Carbohydrates | F3-U0.872 Hexose | New |
| 214452 | NA | NA | F3-U0.852A | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214460

| Seq ID | Chemical Class | Biochemical Class | Compound Name | Modification |
|---|---|---|---|---|
| 214460 | Acids - Hydroxy Alpha | Acid Pathway | Citric acid | 216% to 361% |
| 214460 | Acids - Keto | Acid Pathway | 2-Ketoglutaric acid | New |
| 214460 | Alcohols | Carbohydrates | Inositol | -60% to -76% |
| 214460 | Amino Acids and Related Compounds | Amino Acids and Related Compounds | Proline, 5-oxo- | 70% to 116% |
| 214460 | Carbohydrates | Carbohydrates | F3-U0.821 Carbohydrate | 216% to 361% |
| 214460 | Carbohydrates | Carbohydrates | F3-U0.846 Carbohydrate | 548% to 914% |
| 214460 | Carbohydrates | Carbohydrates | F3-U1.194 Carbohydrate | New |
| 214460 | Carbohydrates | Carbohydrates | Fructose | -65% to -100% |
| 214460 | Carbohydrates | Carbohydrates | Glucose | NQ |
| 214460 | NA | NA | F3-U0.882 | -60% to -81% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214471

| Seq ID | Chemical Class | Biochemical Class | Compound Name | Modification |
|---|---|---|---|---|
| 214471 | Acids - Hydroxy Alpha | Carbohydrates | Quinic acid | 88% to 147% |
| 214471 | Carbohydrates | Carbohydrates | F3-U0.848 Carbohydrate | 66% to 110% |
| 214471 | Carbohydrates | Carbohydrates | F3-U1.032 Carbohydrate | NQ |
| 214471 | Carbohydrates | Carbohydrates | Fructose | 79% to 139% |
| 214471 | Carbohydrates | Carbohydrates | Glucose | 83% to 249% |
| 214471 | NA | NA | F3-U0.602 | NQ |
| 214471 | NA | NA | F3-U0.727 | 77% to 128% |
| 214471 | NA | NA | F3-U0.740 | 85% to 142% |
| 214471 | NA | NA | F3-U0.785B | New |
| 214471 | NA | NA | F3-U1.080 | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214472

| Seq ID | Chemical Class | Biochemical Class | Compound Name | Modification |
|---|---|---|---|---|
| 214472 | Acids - Fatty Unsat | Fatty Acids and Related Waxes | 9,12-Octadecadienoic acid | 7% to 25% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214473

| Seq ID | Chemical Class | Biochemical Class | Compound Name | Modification |
|---|---|---|---|---|
| 214473 | Acids | Acids | Carbamic acid | -60% to -96% |
| 214473 | Acids - Hydroxy Alpha | Acid Pathway | Butanoic acid, 2,3,4-trihydroxy- | 67% to 112% |
| 214473 | Acids - Hydroxy Alpha | Acid Pathway | Malic acid | 67% to 112% |
| 214473 | Acids - Hydroxy Alpha | Carbohydrates | Quinic acid | 100% to 167% |
| 214473 | Amino Acids and Related Compounds | Amino Acids and Related Compounds | Proline, 5-oxo- | New |
| 214473 | Carbohydrates | Carbohydrates | F3-U0.891 Carbohydrate | 122% to 204% |
| 214473 | Carbohydrates | Carbohydrates | F3-U0.952 Carbohydrate | 64% to 106% |
| 214473 | Carbohydrates | Carbohydrates | F3-U1.032 Carbohydrate | NQ |
| 214473 | Carbohydrates | Carbohydrates | F3-U1.189 Carbohydrate | New |
| 214473 | Carbohydrates | Carbohydrates | Fructose | 87% to 176% |
| 214473 | Carbohydrates | Carbohydrates | Glucose | 73% to 238% |
| 214473 | NA | NA | F3-U0.727 | 113% to 188% |
| 214473 | NA | NA | F3-U0.871 | 144% to 240% |
| 214473 | NA | NA | F3-U0.882 | New |
| 214473 | NA | NA | F3-U1.080 | NQ |
| 214473 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214476

| Seq ID | Chemical Class | Biochemical Class | Compound Name | Modification |
|---|---|---|---|---|
| 214476 | Acids | Acids | Carbamic acid | 348% to 580% |
| 214476 | Acids - Hydroxy Alpha | Acid Pathway | Butanoic acid, 2,3,4-trihydroxy- | NQ |
| 214476 | Acids - Hydroxy Alpha | Acid Pathway | Citric acid | 341% to 569% |
| 214476 | Acids - Hydroxy Alpha | Acid Pathway | Malic acid | NQ |
| 214476 | Acids - Hydroxy Alpha | Carbohydrates | Quinic acid | NQ |
| 214476 | Alcohols | Carbohydrates | Inositol | -60% to -92% |
| 214476 | Amino Acids and Related Compounds | Amino Acids and Related Compounds | Glutamic acid | New |
| 214476 | Amino Acids and Related Compounds | Amino Acids and Related Compounds | Isoleucine | New |
| 214476 | Amino Acids and Related Compounds | Amino Acids and Related Compounds | Lysine | 260% to 735% |
| 214476 | Amino Acids and Related Compounds | Amino Acids and Related Compounds | Methionine | 265% to 695% |
| 214476 | Amino Acids and Related Compounds | Amino Acids and Related Compounds | Proline, 5-oxo- | New |
| 214476 | Amino Acids and Related Compounds | Amino Acids and Related Compounds | Threonine | 160% to 505% |
| 214476 | Amino Acids and Related Compounds | Amino Acids and Related Compounds | Tryptophan | New |
| 214476 | Amino Acids and Related Compounds | Amino Acids and Related Compounds | Tyrosine | New |
| 214476 | Amino Acids and Related Compounds | Amino Acids and Related Compounds | Valine | 430% to 1400% |
| 214476 | Carbohydrates | Carbohydrates | F3-U0.744 Carbohydrate | New |
| 214476 | Carbohydrates | Carbohydrates | F3-U0.768B Carbohydrate | New |
| 214476 | Carbohydrates | Carbohydrates | F3-U0.781 Carbohydrate | New |
| 214476 | Carbohydrates | Carbohydrates | F3-U0.797 Carbohydrate | New |
| 214476 | Carbohydrates | Carbohydrates | F3-U0.819 Carbohydrate | New |
| 214476 | Carbohydrates | Carbohydrates | F3-U1.032 Carbohydrate | NQ |
| 214476 | Carbohydrates | Carbohydrates | F3-U1.189 Carbohydrate | 119% to 199% |
| 214476 | Carbohydrates | Carbohydrates | Glucose | -64% to -100% |
| 214476 | Carbohydrates | Carbohydrates | Sucrose | -60% to -77% |
| 214476 | Hydrocarbons | Hydrocarbons | Nonacosane, 3-methyl | 61% to 102% |
| 214476 | NA | NA | F3-U0.602 | NQ |
| 214476 | NA | NA | F3-U0.678 | NQ |
| 214476 | NA | NA | F3-U0.709 | NQ |
| 214476 | NA | NA | F3-U0.740 | 69% to 115% |
| 214476 | NA | NA | F3-U0.748 | New |
| 214476 | NA | NA | F3-U0.785B | New |
| 214476 | NA | NA | F3-U1.067 | New |
| 214476 | NA | NA | F3-U1.080 | NQ |
| 214476 | Sterols, Oxygenated Terpenes, and Other Isoprenoids | Prenylquinones | alpha-Tocopherol | 250% to 519% |
| 214476 | Sterols, Oxygenated Terpenes, and Other Isoprenoids | Terpenoids | beta-Sitosterol | 72% to 120% |
| 214476 | Sterols, Oxygenated Terpenes, and Other Isoprenoids | Prenylquinones | beta-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214478

| Seq ID | Chemical Class | Biochemical Class | Compound Name | Modification |
|---|---|---|---|---|
| 214478 | Acids | Acids | Carbamic acid | New |
| 214478 | Acids - Hydroxy | Amino Acids and Related Compounds | Shikimic acid | New |
| 214478 | Acids - Hydroxy Alpha | Acid Pathway | Butanoic acid, 2,3,4-trihydroxy- | New |
| 214478 | Acids - Hydroxy Alpha | Acid Pathway | Citric acid | 99% to 173% |
| 214478 | Acids - Hydroxy Alpha | Acid Pathway | Malic acid | 371% to 618% |
| 214478 | Alcohols | Carbohydrates | Inositol | 104% to 173% |
| 214478 | Amino Acids and Related Compounds | Amino Acids and Related Compounds | Aspartic acid | 67% to 111% |
| 214478 | Amino Acids and Related Compounds | Amino Acids and Related Compounds | Proline, 5-oxo- | 65% to 178% |
| 214478 | Carbohydrates | Carbohydrates | F3-U0.813 Carbohydrate | New |
| 214478 | Carbohydrates | Carbohydrates | F3-U0.816 Carbohydrate | New |
| 214478 | Carbohydrates | Carbohydrates | F3-U0.821 Carbohydrate | 104% to 173% |
| 214478 | Carbohydrates | Carbohydrates | F3-U0.846 Carbohydrate | 2790% to 4650% |
| 214478 | Carbohydrates | Carbohydrates | F3-U0.872 Hexose | 484% to 806% |
| 214478 | Carbohydrates | Carbohydrates | Fructose | -60% to -100% |
| 214478 | Carbohydrates | Carbohydrates | Galactose or Mannose | -67% to -100% |
| 214478 | Carbohydrates | Carbohydrates | Glucose | -60% to -100% |
| 214478 | Phenols and Related Compounds | Phenylpropanes and Derivatives | Chlorogenic acid | 75% to 126% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214504

| Seq ID | Chemical Class | Biochemical Class | Compound Name | Modification |
|---|---|---|---|---|
| 214504 | Acids | Acids | Carbamic acid | New |
| 214504 | Amino Acids and Related Compounds | Amino Acids and Related Compounds | Proline, 5-oxo- | 106% to 176% |
| 214504 | Carbohydrates | Carbohydrates | F3-U0.768 Carbohydrate | New |
| 214504 | Carbohydrates | Carbohydrates | F3-U0.816 Carbohydrate | 60% to 90% |
| 214504 | Carbohydrates | Carbohydrates | Fructose | 88% to 155% |
| 214504 | Carbohydrates | Carbohydrates | Galactose or Mannose | New |
| 214504 | Carbohydrates | Carbohydrates | Glucose | 65% to 109% |
| 214504 | NA | NA | F3-U0.736 | New |
| 214504 | NA | NA | F3-U0.882 | 98% to 163% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214519

| Seq ID | Chemical Class | Biochemical Class | Compound Name | Modification |
|---|---|---|---|---|
| 214519 | Acids - Hydroxy Alpha | Acid Pathway | Malic acid | -60% to -87% |
| 214519 | Acids - Hydroxy Alpha | Carbohydrates | Quinic acid | 72% to 120% |
| 214519 | Amino Acids and Related Compounds | Amino Acids and Related Compounds | Proline, 5-oxo- | New |
| 214519 | Carbohydrates | Carbohydrates | F3-U0.846 Carbohydrate | 139% to 231% |
| 214519 | Carbohydrates | Carbohydrates | F3-U0.872 Hexose | 244% to 407% |
| 214519 | Carbohydrates | Carbohydrates | F3-U1.189 Carbohydrate | 15900% to 26500% |
| 214519 | Carbohydrates | Carbohydrates | Fructose | 1066% to 2138% |
| 214519 | Carbohydrates | Carbohydrates | Galactose or Mannose | New |
| 214519 | Carbohydrates | Carbohydrates | Glucose | 1398% to 4898% |
| 214519 | NA | NA | F3-U0.882 | New |
| 214519 | NA | NA | F3-U1.253 | 60% to 84% |
| 214519 | NA | NA | F3-U1.255 | 66% to 110% |
| 214519 | Phenols and Related Compounds | Phenylpropanes and Derivatives | Chlorogenic acid | 224% to 373% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214527

| Seq ID | Chemical Class | Biochemical Class | Compound Name | Modification |
|---|---|---|---|---|
| 214527 | Acids - Fatty | Fatty Acids and Related Waxes | Hexadecanoic acid | 5% to 13% |
| 214527 | Acids - Fatty Unsat | Fatty Acids and Related Waxes | 7,10,13-Hexadecatrienoic acid | 23% to 43% |
| 214527 | Acids - Fatty Unsat | Fatty Acids and Related Waxes | 9-Hexadecenoic acid | 5% to 17% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214529

| Seq ID | Chemical Class | Biochemical Class | Compound Name | Modification |
|---|---|---|---|---|
| 214529 | Acids - Hydroxy Alpha | Carbohydrates | Quinic acid | 60% to 85% |
| 214529 | Carbohydrates | Carbohydrates | F3-U0.846 Carbohydrate | 79% to 131% |
| 214529 | Carbohydrates | Carbohydrates | F3-U1.113 Carbohydrate | 94% to 157% |
| 214529 | Carbohydrates | Carbohydrates | F3-U1.143 Carbohydrate | 87% to 145% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214530

| Seq ID | Chemical Class | Biochemical Class | Compound Name | Modification |
|---|---|---|---|---|
| 214530 | Acids | Acids | Carbamic acid | NQ |
| 214530 | Alcohols | Carbohydrates | Inositol | 79% to 132% |
| 214530 | Carbohydrates | Carbohydrates | F3-U0.744 Carbohydrate | New |
| 214530 | Carbohydrates | Carbohydrates | F3-U0.768B Carbohydrate | New |
| 214530 | Carbohydrates | Carbohydrates | F3-U0.781 Carbohydrate | New |
| 214530 | Carbohydrates | Carbohydrates | F3-U0.797 Carbohydrate | New |
| 214530 | Carbohydrates | Carbohydrates | F3-U0.825 Carbohydrate | New |
| 214530 | Carbohydrates | Carbohydrates | F3-U0.848 Carbohydrate | 131% to 218% |
| 214530 | Carbohydrates | Carbohydrates | F3-U0.872 Hexose | 179% to 298% |
| 214530 | Carbohydrates | Carbohydrates | F3-U0.891 Carbohydrate | New |
| 214530 | Carbohydrates | Carbohydrates | F3-U1.060 Carbohydrate | New |
| 214530 | Carbohydrates | Carbohydrates | Fructose | 60% to 79% |
| 214530 | NA | NA | F3-U0.602 | NQ |
| 214530 | NA | NA | F3-U0.727 | NQ |
| 214530 | NA | NA | F3-U0.740 | 158% to 263% |
| 214530 | NA | NA | F3-U0.748 | New |
| 214530 | NA | NA | F3-U0.785B | 155% to 258% |
| 214530 | NA | NA | F3-U1.067 | New |
| 214530 | NA | NA | F3-U1.080 | New |
| 214530 | NA | NA | F3-U1.096 | New |
| 214530 | NA | NA | F3-U1.253 | -60% to -79% |
| 214530 | Phenols and Related Compounds | Phenylpropanes and Derivatives | Chlorogenic acid | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214532

| Seq ID | Chemical Class | Biochemical Class | Compound Name | Modification |
|---|---|---|---|---|
| 214532 | Acids - Hydroxy Alpha | Acid Pathway | Citric acid | 264% to 440% |
| 214532 | Acids - Hydroxy Alpha | Carbohydrates | Quinic acid | 168% to 279% |
| 214532 | Amino Acids and Related Compounds | Amino Acids and Related Compounds | Proline, 5-oxo- | New |
| 214532 | Carbohydrates | Carbohydrates | F3-U0.813 Carbohydrate | New |
| 214532 | Carbohydrates | Carbohydrates | F3-U0.816 Carbohydrate | 176% to 294% |
| 214532 | Carbohydrates | Carbohydrates | F3-U0.821 Carbohydrate | 264% to 440% |
| 214532 | Carbohydrates | Carbohydrates | F3-U0.846 Carbohydrate | 702% to 1170% |
| 214532 | Carbohydrates | Carbohydrates | F3-U0.872 Hexose | 635% to 1058% |
| 214532 | Carbohydrates | Carbohydrates | F3-U1.189 Carbohydrate | New |
| 214532 | Carbohydrates | Carbohydrates | F3-U1.194 Carbohydrate | New |
| 214532 | Carbohydrates | Carbohydrates | Fructose | 481% to 846% |
| 214532 | Carbohydrates | Carbohydrates | Glucose | 773% to 1794% |
| 214532 | Carbohydrates | Carbohydrates | Sucrose | 60% to 83% |
| 214532 | NA | NA | F3-U0.843 | New |
| 214532 | NA | NA | F3-U0.852A | New |
| 214532 | NA | NA | F3-U0.882 | New |
| 214532 | NA | NA | F3-U1.136 | 82% to 136% |
| 214532 | NA | NA | F3-U1.253 | 61% to 102% |
| 214532 | Phenols and Related Compounds | Phenylpropanes and Derivatives | Chlorogenic acid | 764% to 1274% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214533

| Seq ID | Chemical Class | Biochemical Class | Compound Name | Modification |
|---|---|---|---|---|
| 214533 | Acids - Hydroxy Alpha | Acid Pathway | Butanoic acid, 2,3,4-trihydroxy- | 73% to 122% |
| 214533 | Acids - Hydroxy Alpha | Carbohydrates | Quinic acid | 227% to 379% |
| 214533 | Carbohydrates | Carbohydrates | F3-U0.813 Carbohydrate | 60% to 88% |
| 214533 | Carbohydrates | Carbohydrates | F3-U0.816 Carbohydrate | 61% to 101% |
| 214533 | Carbohydrates | Carbohydrates | F3-U1.143 Carbohydrate | 60% to 89% |
| 214533 | Carbohydrates | Carbohydrates | Fructose | 70% to 116% |
| 214533 | NA | NA | F3-U1.253 | 60% to 87% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214539

| Seq ID | Chemical Class | Biochemical Class | Compound Name | Modification |
|---|---|---|---|---|
| 214539 | Acids | Acids | Carbamic acid | New |
| 214539 | Acids - Hydroxy Alpha | Acid Pathway | Butanoic acid, 2,3,4-trihydroxy- | New |
| 214539 | Acids - Hydroxy Alpha | Acid Pathway | Citric acid | 235% to 391% |
| 214539 | Acids - Hydroxy Alpha | Acid Pathway | Malic acid | New |
| 214539 | Acids - Hydroxy Alpha | Carbohydrates | Quinic acid | New |
| 214539 | Alkaloids and Other Bases | Polyamines | 1,4-Butanediamine | New |
| 214539 | Amino Acids and Related Compounds | Amino Acids and Related Compounds | Proline, 5-oxo- | New |
| 214539 | Carbohydrates | Carbohydrates | F3-U0.744 Carbohydrate | NQ |
| 214539 | Carbohydrates | Carbohydrates | F3-U0.768B Carbohydrate | NQ |
| 214539 | Carbohydrates | Carbohydrates | F3-U0.781 Carbohydrate | NQ |
| 214539 | Carbohydrates | Carbohydrates | F3-U0.813 Carbohydrate | New |
| 214539 | Carbohydrates | Carbohydrates | F3-U0.816 Carbohydrate | 237% to 394% |
| 214539 | Carbohydrates | Carbohydrates | F3-U0.821 Carbohydrate | 235% to 391% |
| 214539 | Carbohydrates | Carbohydrates | F3-U0.846 Carbohydrate | 964% to 1606% |
| 214539 | Carbohydrates | Carbohydrates | F3-U0.848 Carbohydrate | New |
| 214539 | Carbohydrates | Carbohydrates | F3-U0.872 Hexose | 60% to 1215% |
| 214539 | Carbohydrates | Carbohydrates | F3-U1.065 Carbohydrate | NQ |
| 214539 | Carbohydrates | Carbohydrates | F3-U1.143 Carbohydrate | 60% to 79% |
| 214539 | Carbohydrates | Carbohydrates | F3-U1.150 Carbohydrate | 83% to 138% |
| 214539 | Carbohydrates | Carbohydrates | F3-U1.189 Carbohydrate | New |
| 214539 | Carbohydrates | Carbohydrates | F3-U1.194 Carbohydrate | New |
| 214539 | Carbohydrates | Carbohydrates | Fructose | 60% to 718% |
| 214539 | Carbohydrates | Carbohydrates | Glucose | 81% to 2875% |
| 214539 | Carbohydrates | Carbohydrates | Sucrose | 60% to 100% |
| 214539 | NA | NA | F3-U0.602 | New |
| 214539 | NA | NA | F3-U0.668 | New |
| 214539 | NA | NA | F3-U0.678 | New |
| 214539 | NA | NA | F3-U0.727 | 71% to 118% |
| 214539 | NA | NA | F3-U0.736 | New |
| 214539 | NA | NA | F3-U0.740 | New |
| 214539 | NA | NA | F3-U0.748 | NQ |
| 214539 | NA | NA | F3-U0.882 | New |
| 214539 | NA | NA | F3-U1.080 | NQ |
| 214539 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214545

| Seq ID | Chemical Class | Biochemical Class | Compound Name | Modification |
|---|---|---|---|---|
| 214545 | Acids | Acids | Carbamic acid | New |
| 214545 | Acids - Hydroxy Alpha | Acid Pathway | Butanoic acid, 2,3,4-trihydroxy- | 131% to 218% |
| 214545 | Acids - Hydroxy Alpha | Acid Pathway | Citric acid | 164% to 274% |
| 214545 | Acids - Hydroxy Alpha | Acid Pathway | Malic acid | 61% to 102% |
| 214545 | Acids - Hydroxy Alpha | Carbohydrates | Quinic acid | 187% to 312% |
| 214545 | Acids - Keto | Acid Pathway | 2-Ketoglutaric acid | New |
| 214545 | Amino Acids and Related Compounds | Amino Acids and Related Compounds | Glycine | New |
| 214545 | Amino Acids and Related Compounds | Amino Acids and Related Compounds | Proline, 5-oxo- | New |
| 214545 | Carbohydrates | Carbohydrates | F3-U0.816 Carbohydrate | 106% to 176% |
| 214545 | Carbohydrates | Carbohydrates | F3-U0.821 Carbohydrate | 164% to 274% |
| 214545 | Carbohydrates | Carbohydrates | F3-U1.150 Carbohydrate | 60% to 99% |
| 214545 | Carbohydrates | Carbohydrates | F3-U1.189 Carbohydrate | New |
| 214545 | Carbohydrates | Carbohydrates | F3-U1.194 Carbohydrate | New |
| 214545 | Carbohydrates | Carbohydrates | Sucrose | 60% to 77% |
| 214545 | NA | NA | F3-U0.767 | New |
| 214545 | NA | NA | F3-U0.882 | -60% to -99% |
| 214545 | NA | NA | F3-U1.253 | 60% to 93% |
| 214545 | Phenols and Related Compounds | Phenylpropanes and Derivatives | Chlorogenic acid | 775% to 1291% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214548

| Seq ID | Chemical Class | Biochemical Class | Compound Name | Modification |
|---|---|---|---|---|
| 214548 | Acids - Hydroxy | Amino Acids and Related Compounds | Shikimic acid | New |
| 214548 | Acids - Hydroxy Alpha | Acid Pathway | Citric acid | 235% to 391% |
| 214548 | Acids - Hydroxy Alpha | Acid Pathway | Malic acid | 635% to 1058% |
| 214548 | Acids - Hydroxy Alpha | Carbohydrates | Quinic acid | 228% to 380% |
| 214548 | Alcohols | Carbohydrates | Inositol | 211% to 352% |
| 214548 | Carbohydrates | Carbohydrates | F3-U0.813 Carbohydrate | New |
| 214548 | Carbohydrates | Carbohydrates | F3-U0.816 Carbohydrate | New |
| 214548 | Carbohydrates | Carbohydrates | F3-U0.821 Carbohydrate | 235% to 391% |
| 214548 | Carbohydrates | Carbohydrates | F3-U0.846 Carbohydrate | 8897% to 14828% |
| 214548 | Carbohydrates | Carbohydrates | F3-U0.872 Hexose | New |
| 214548 | Carbohydrates | Carbohydrates | F3-U1.113 Carbohydrate | 60% to 92% |
| 214548 | Carbohydrates | Carbohydrates | F3-U1.143 Carbohydrate | 71% to 118% |
| 214548 | Carbohydrates | Carbohydrates | Fructose | 60% to 91% |
| 214548 | Carbohydrates | Carbohydrates | Galactose or Mannose | -60% to -81% |
| 214548 | Carbohydrates | Carbohydrates | Glucose | 60% to 101% |
| 214548 | NA | NA | F3-U0.852A | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214553

| Seq ID | Chemical Class | Biochemical Class | Compound Name | Modification |
|---|---|---|---|---|
| 214553 | Amino Acids and Related Compounds | Amino Acids and Related Compounds | Isoleucine | New |
| 214553 | Amino Acids and Related Compounds | Amino Acids and Related Compounds | Threonine | 100% to 360% |
| 214553 | Amino Acids and Related Compounds | Amino Acids and Related Compounds | Tryptophan | New |
| 214553 | Amino Acids and Related Compounds | Amino Acids and Related Compounds | Tyrosine | New |
| 214553 | Amino Acids and Related Compounds | Amino Acids and Related Compounds | Valine | 260% to 915% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214554

| Seq ID | Chemical Class | Biochemical Class | Compound Name | Modification |
|---|---|---|---|---|
| 214554 | Acids - Hydroxy Alpha | Acid Pathway | Butanoic acid, 2,3,4-trihydroxy- | 145% to 242% |
| 214554 | Acids - Hydroxy Alpha | Carbohydrates | Quinic acid | 100% to 166% |
| 214554 | Carbohydrates | Carbohydrates | Glucose | 61% to 112% |
| 214554 | NA | NA | F3-U0.602 | NQ |
| 214554 | NA | NA | F3-U0.709 | NQ |
| 214554 | NA | NA | F3-U0.727 | 114% to 190% |
| 214554 | NA | NA | F3-U0.856 | 60% to 80% |
| 214554 | NA | NA | F3-U0.882 | New |
| 214554 | NA | NA | F3-U0.899 | New |
| 214554 | Phenols and Related Compounds | Phenylpropanes and Derivatives | Chlorogenic acid | 84% to 140% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214557

| Seq ID | Chemical Class | Biochemical Class | Compound Name | Modification |
|---|---|---|---|---|
| 214557 | Acids - Hydroxy Alpha | Acid Pathway | Citric acid | 231% to 385% |
| 214557 | Acids - Hydroxy Alpha | Acid Pathway | Malic acid | 75% to 125% |
| 214557 | Acids - Hydroxy Alpha | Carbohydrates | Quinic acid | 484% to 807% |
| 214557 | Alcohols | Carbohydrates | Inositol | 75% to 126% |
| 214557 | Amino Acids and Related Compounds | Amino Acids and Related Compounds | Proline, 5-oxo- | New |
| 214557 | Carbohydrates | Carbohydrates | F3-U0.813 Carbohydrate | New |
| 214557 | Carbohydrates | Carbohydrates | F3-U0.816 Carbohydrate | 239% to 399% |
| 214557 | Carbohydrates | Carbohydrates | F3-U0.821 Carbohydrate | 231% to 385% |
| 214557 | Carbohydrates | Carbohydrates | F3-U0.825 Carbohydrate | New |
| 214557 | Carbohydrates | Carbohydrates | F3-U0.846 Carbohydrate | 1101% to 1834% |
| 214557 | Carbohydrates | Carbohydrates | F3-U0.848 Carbohydrate | 338% to 563% |
| 214557 | Carbohydrates | Carbohydrates | F3-U0.872 Hexose | 965% to 1608% |
| 214557 | Carbohydrates | Carbohydrates | F3-U1.150 Carbohydrate | 60% to 90% |
| 214557 | Carbohydrates | Carbohydrates | F3-U1.189 Carbohydrate | New |
| 214557 | Carbohydrates | Carbohydrates | F3-U1.194 Carbohydrate | New |
| 214557 | Carbohydrates | Carbohydrates | Fructose | 499% to 887% |
| 214557 | Carbohydrates | Carbohydrates | Glucose | 1273% to 3530% |
| 214557 | NA | NA | F3-U0.852A | New |
| 214557 | NA | NA | F3-U0.856 | -61% to -100% |
| 214557 | NA | NA | F3-U0.882 | New |
| 214557 | NA | NA | F3-U1.253 | 60% to 83% |
| 214557 | Phenols and Related Compounds | Phenylpropanes and Derivatives | Chlorogenic acid | 754% to 1256% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214558

| Seq ID | Chemical Class | Biochemical Class | Compound Name | Modification |
|---|---|---|---|---|
| 214558 | Acids - Hydroxy Alpha | Acid Pathway | Citric acid | 193% to 321% |
| 214558 | Acids - Hydroxy Alpha | Carbohydrates | Quinic acid | 302% to 503% |
| 214558 | Amino Acids and Related Compounds | Amino Acids and Related Compounds | Proline, 5-oxo- | New |
| 214558 | Carbohydrates | Carbohydrates | F3-U0.816 Carbohydrate | 153% to 255% |
| 214558 | Carbohydrates | Carbohydrates | F3-U0.821 Carbohydrate | 193% to 321% |
| 214558 | Carbohydrates | Carbohydrates | F3-U0.846 Carbohydrate | 533% to 889% |
| 214558 | Carbohydrates | Carbohydrates | F3-U0.872 Hexose | 527% to 879% |
| 214558 | Carbohydrates | Carbohydrates | F3-U1.150 Carbohydrate | 69% to 115% |
| 214558 | Carbohydrates | Carbohydrates | F3-U1.189 Carbohydrate | New |
| 214558 | Carbohydrates | Carbohydrates | F3-U1.194 Carbohydrate | New |
| 214558 | Carbohydrates | Carbohydrates | Fructose | 301% to 537% |
| 214558 | Carbohydrates | Carbohydrates | Glucose | 478% to 978% |
| 214558 | Carbohydrates | Carbohydrates | Sucrose | 60% to 88% |
| 214558 | NA | NA | F3-U0.852A | New |
| 214558 | NA | NA | F3-U1.253 | 94% to 157% |
| 214558 | NA | NA | F3-U1.255 | 66% to 109% |
| 214558 | Phenols and Related Compounds | Phenylpropanes and Derivatives | Chlorogenic acid | 611% to 1018% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214563

| Seq ID | Chemical Class | Biochemical Class | Compound Name | Modification |
|---|---|---|---|---|
| 214563 | Hydrocarbons | Hydrocarbons | Nonacosane, 3-methyl | 60% to 98% |
| 214563 | Sterols, Oxygenated Terpenes, and Other Isoprenoids | Prenylquinones | alpha-Tocopherol | 97% to 162% |
| 214563 | Sterols, Oxygenated Terpenes, and Other Isoprenoids | Terpenoids | Cycloartenol | New |
| 214563 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214564

| Seq ID | Chemical Class | Biochemical Class | Compound Name | Modification |
|---|---|---|---|---|
| 214564 | Acids - Hydroxy Alpha | Acid Pathway | Butanoic acid, 2,3,4-trihydroxy- | 246% to 410% |
| 214564 | Acids - Hydroxy Alpha | Acid Pathway | Citric acid | New |
| 214564 | Acids - Hydroxy Alpha | Carbohydrates | Quinic acid | 225% to 376% |
| 214564 | Alcohols | Carbohydrates | Inositol | 60% to 82% |
| 214564 | Alkaloids and Other Bases | Polyamines | 1,4-Butanediamine | New |
| 214564 | Alkaloids and Other Bases | Amino Acids and Related Compounds | 1H-Indole-3-butanoic acid, 1-methyl-oxo-, methyl ester | New |
| 214564 | Amino Acids and Related Compounds | Amino Acids and Related Compounds | Aspartic acid | NQ |
| 214564 | Amino Acids and Related Compounds | Amino Acids and Related Compounds | Proline, 5-oxo- | 141% to 235% |
| 214564 | Carbohydrates | Carbohydrates | F3-U0.891 Carbohydrate | New |
| 214564 | Carbohydrates | Carbohydrates | Fructose | 120% to 200% |
| 214564 | NA | NA | F3-U0.602 | 122% to 203% |
| 214564 | NA | NA | F3-U0.678 | New |
| 214564 | NA | NA | F3-U0.882 | New |
| 214564 | Phenols and Related Compounds | Phenylpropanes and Derivatives | Chlorogenic acid | 182% to 304% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214569

| Seq ID | Chemical Class | Biochemical Class | Compound Name | Modification |
|---|---|---|---|---|
| 214569 | Acids - Hydroxy Alpha | Acid Pathway | Butanoic acid, 2,3,4-trihydroxy- | New |
| 214569 | Acids - Hydroxy | Amino Acids and Related Compounds | Shikimic acid | New |
| 214569 | Acids - Hydroxy Alpha | Acid Pathway | Citric acid | 90% to 151% |
| 214569 | Acids - Hydroxy Alpha | Acid Pathway | Malic acid | 429% to 716% |
| 214569 | Acids - Hydroxy Alpha | Carbohydrates | Quinic acid | 272% to 454% |
| 214569 | Alcohols | Carbohydrates | Inositol | 91% to 151% |
| 214569 | Amino Acids and Related Compounds | Amino Acids and Related Compounds | Aspartic acid | 70% to 150% |
| 214569 | Amino Acids and Related Compounds | Amino Acids and Related Compounds | Histidine | 35% to 2600% |
| 214569 | Amino Acids and Related Compounds | Amino Acids and Related Compounds | Lysine | 160% to 500% |
| 214569 | Amino Acids and Related Compounds | Amino Acids and Related Compounds | Methionine | 155% to 455% |
| 214569 | Amino Acids and Related Compounds | Amino Acids and Related Compounds | Proline, 5-oxo- | 125% to 209% |
| 214569 | Amino Acids and Related Compounds | Amino Acids and Related Compounds | Threonine | 225% to 650% |
| 214569 | Amino Acids and Related Compounds | Amino Acids and Related Compounds | Tryptophan | New |
| 214569 | Amino Acids and Related Compounds | Amino Acids and Related Compounds | Tyrosine | New |
| 214569 | Amino Acids and Related Compounds | Amino Acids and Related Compounds | Valine | 240% to 870% |
| 214569 | Carbohydrates | Carbohydrates | F3-U0.816 Carbohydrate | New |
| 214569 | Carbohydrates | Carbohydrates | F3-U0.821 Carbohydrate | 90% to 151% |
| 214569 | Carbohydrates | Carbohydrates | F3-U0.846 Carbohydrate | 2205% to 3675% |
| 214569 | Carbohydrates | Carbohydrates | F3-U0.848 Carbohydrate | 66% to 110% |
| 214569 | Carbohydrates | Carbohydrates | F3-U0.872 Hexose | 387% to 645% |
| 214569 | Carbohydrates | Carbohydrates | F3-U1.113 Carbohydrate | 76% to 127% |
| 214569 | Carbohydrates | Carbohydrates | F3-U1.143 Carbohydrate | 75% to 125% |
| 214569 | Carbohydrates | Carbohydrates | F3-U1.189 Carbohydrate | 134% to 223% |
| 214569 | Carbohydrates | Carbohydrates | Fructose | -60% to -92% |
| 214569 | NA | NA | F3-U0.751 | New |
| 214569 | Phenols and Related Compounds | Phenylpropanes and Derivatives | Chlorogenic acid | 279% to 465% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214572

| Seq ID | Chemical Class | Biochemical Class | Compound Name | Modification |
|---|---|---|---|---|
| 214572 | Acids - Hydroxy | Amino Acids and Related Compounds | Shikimic acid | New |
| 214572 | Acids - Hydroxy Alpha | Acid Pathway | Butanoic acid, 2,3,4-trihydroxy- | New |
| 214572 | Acids - Hydroxy Alpha | Acid Pathway | Citric acid | 102% to 170% |
| 214572 | Acids - Hydroxy Alpha | Acid Pathway | Malic acid | 182% to 304% |
| 214572 | Acids - Hydroxy Alpha | Carbohydrates | Quinic acid | 115% to 192% |
| 214572 | Amino Acids and Related Compounds | Amino Acids and Related Compounds | Proline, 5-oxo- | 114% to 191% |
| 214572 | Carbohydrates | Carbohydrates | F3-U0.816 Carbohydrate | New |
| 214572 | Carbohydrates | Carbohydrates | F3-U0.821 Carbohydrate | 102% to 170% |
| 214572 | Carbohydrates | Carbohydrates | F3-U0.846 Carbohydrate | 1674% to 2791% |
| 214572 | Carbohydrates | Carbohydrates | F3-U0.872 Hexose | New |
| 214572 | Carbohydrates | Carbohydrates | F3-U1.143 Carbohydrate | 69% to 114% |
| 214572 | Carbohydrates | Carbohydrates | Fructose | -63% to -100% |
| 214572 | Carbohydrates | Carbohydrates | Galactose or Mannose | -66% to -100% |
| 214572 | Carbohydrates | Carbohydrates | Glucose | -64% to -100% |
| 214572 | NA | NA | F3-U0.882 | -60% to -77% |
| 214572 | Phenols and Related Compounds | Phenylpropanes and Derivatives | Chlorogenic acid | 72% to 120% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214575

| Seq ID | Chemical Class | Biochemical Class | Compound Name | Modification |
|---|---|---|---|---|
| 214575 | Acids | Acids | Carbamic acid | 2234% to 3724% |
| 214575 | Acids - Hydroxy Alpha | Acid Pathway | Butanoic acid, 2,3,4-trihydroxy- | 71% to 119% |
| 214575 | Acids - Hydroxy Alpha | Acid Pathway | Citric acid | 166% to 276% |
| 214575 | Acids - Hydroxy Alpha | Acid Pathway | Malic acid | 203% to 338% |
| 214575 | Acids - Hydroxy Alpha | Carbohydrates | Quinic acid | 160% to 267% |
| 214575 | Amino Acids and Related Compounds | Amino Acids and Related Compounds | Proline, 5-oxo- | 1094% to 1823% |
| 214575 | Carbohydrates | Carbohydrates | F3-U0.770 Carbohydrate | 64% to 106% |
| 214575 | Carbohydrates | Carbohydrates | F3-U0.813 Carbohydrate | 494% to 824% |
| 214575 | Carbohydrates | Carbohydrates | F3-U0.821 Carbohydrate | 166% to 276% |
| 214575 | Carbohydrates | Carbohydrates | F3-U0.825 Carbohydrate | 152% to 254% |
| 214575 | Carbohydrates | Carbohydrates | F3-U0.846 Carbohydrate | 750% to 1251% |
| 214575 | Carbohydrates | Carbohydrates | F3-U0.848 Carbohydrate | 134% to 223% |
| 214575 | Carbohydrates | Carbohydrates | F3-U0.872 Hexose | 670% to 1116% |
| 214575 | Carbohydrates | Carbohydrates | F3-U1.143 Carbohydrate | 60% to 88% |
| 214575 | Carbohydrates | Carbohydrates | F3-U1.189 Carbohydrate | 668% to 1113% |
| 214575 | Carbohydrates | Carbohydrates | F3-U1.194 Carbohydrate | New |
| 214575 | Carbohydrates | Carbohydrates | Fructose | 617% to 1054% |
| 214575 | Carbohydrates | Carbohydrates | Glucose | 1221% to 2621% |
| 214575 | Carbohydrates | Carbohydrates | Sucrose | 60% to 84% |
| 214575 | NA | NA | F3-U0.727 | 97% to 161% |
| 214575 | NA | NA | F3-U0.736 | 212% to 353% |
| 214575 | NA | NA | F3-U0.852A | New |
| 214575 | NA | NA | F3-U0.856 | -60% to -99% |
| 214575 | NA | NA | F3-U0.882 | 125% to 209% |
| 214575 | NA | NA | F3-U1.229 | 75% to 125% |
| 214575 | Phenols and Related Compounds | Phenylpropanes and Derivatives | Chlorogenic acid | 1125% to 1875% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214579

| Seq ID | Chemical Class | Biochemical Class | Compound Name | Modification |
|---|---|---|---|---|
| 214579 | Acids - Hydroxy Alpha | Acid Pathway | Citric acid | 206% to 344% |
| 214579 | Acids - Hydroxy Alpha | Acid Pathway | Malic acid | 108% to 180% |
| 214579 | Acids - Hydroxy Alpha | Carbohydrates | Quinic acid | 253% to 422% |
| 214579 | Amino Acids and Related Compounds | Amino Acids and Related Compounds | Proline, 5-oxo- | New |
| 214579 | Carbohydrates | Carbohydrates | F3-U0.813 Carbohydrate | New |
| 214579 | Carbohydrates | Carbohydrates | F3-U0.816 Carbohydrate | 199% to 331% |
| 214579 | Carbohydrates | Carbohydrates | F3-U0.821 Carbohydrate | 206% to 344% |
| 214579 | Carbohydrates | Carbohydrates | F3-U0.846 Carbohydrate | 671% to 1118% |
| 214579 | Carbohydrates | Carbohydrates | F3-U0.872 Hexose | 587% to 978% |
| 214579 | Carbohydrates | Carbohydrates | F3-U1.150 Carbohydrate | 69% to 115% |
| 214579 | Carbohydrates | Carbohydrates | F3-U1.189 Carbohydrate | New |
| 214579 | Carbohydrates | Carbohydrates | F3-U1.194 Carbohydrate | New |
| 214579 | Carbohydrates | Carbohydrates | Fructose | 316% to 565% |
| 214579 | Carbohydrates | Carbohydrates | Glucose | 541% to 1155% |
| 214579 | Carbohydrates | Carbohydrates | Sucrose | 60% to 88% |
| 214579 | NA | NA | F3-U0.856 | -64% to -100% |
| 214579 | Phenols and Related Compounds | Phenylpropanes and Derivatives | Chlorogenic acid | 882% to 1470% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214593

| Seq ID | Chemical Class | Biochemical Class | Compound Name | Modification |
|---|---|---|---|---|
| 214593 | Acids - Fatty | Fatty Acids and Related Waxes | Eicosanoic acid | -21% to -49% |
| 214593 | Acids - Fatty Unsat | Fatty Acids and Related Waxes | 9-Octadecenoic acid | 27% to 83% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214602

| Seq ID | Chemical Class | Biochemical Class | Compound Name | Modification |
|---|---|---|---|---|
| 214602 | Acids | Acids | Carbamic acid | 265% to 442% |
| 214602 | Acids - Hydroxy Alpha | Acid Pathway | Malic acid | -69% to -100% |
| 214602 | Aldehydes, Ketones and Quinones | Aldehydes, Ketones and Quinones | 3-Phytylmenadione | New |
| 214602 | Alkenes and Alkynes | Terpenoids | Limonene | 118% to 197% |
| 214602 | Amino Acids and Related Compounds | Amino Acids and Related Compounds | Proline, 5-oxo- | -60% to -89% |
| 214602 | Carbohydrates | Carbohydrates | F3-U0.825 Carbohydrate | -60% to -80% |
| 214602 | Carbohydrates | Carbohydrates | F3-U0.872 Hexose | 104% to 174% |
| 214602 | Carbohydrates | Carbohydrates | F3-U0.907 Carbohydrate | NQ |
| 214602 | Carbohydrates | Carbohydrates | Fructose | 60% to 2691% |
| 214602 | Carbohydrates | Carbohydrates | Glucose | 2014% to 4190% |
| 214602 | Esters | Esters | F1-U1.076 Fatty Acid Ester | 105% to 175% |
| 214602 | Esters | Esters | F1-U1.078 Fatty Acid Ester | 83% to 139% |
| 214602 | Esters | Esters | F1-U1.121 Fatty Acid Ester | 140% to 234% |
| 214602 | Esters - Hydroxy | Acyl acetylglycerols | 2-Eicosanoyl-1-acetylglycerol | 149% to 248% |
| 214602 | Esters - Hydroxy | Acyl acetylglycerols | 2-Octadecanoyl-1-acetylglycerol | 145% to 242% |
| 214602 | NA | NA | F1-U1.119 | New |
| 214602 | NA | NA | F3-U0.727 | NQ |
| 214602 | NA | NA | F3-U0.882 | 321% to 534% |
| 214602 | Phenols and Related Compounds | Phenylpropanes and Derivatives | Chlorogenic acid | -60% to -83% |
| 214602 | Sterols, Oxygenated Terpenes, and Other Isoprenoids | Prenylquinones | alpha-Tocopherol hydroquinone | 152% to 254% |
| 214602 | Sterols, Oxygenated Terpenes, and Other Isoprenoids | Terpenoids | F1-U1.130 Sterol | 147% to 245% |
| 214602 | Sterols, Oxygenated Terpenes, and Other Isoprenoids | Terpenoids | F1-U1.136 Sterol | 66% to 110% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214613

| Seq ID | Chemical Class | Biochemical Class | Compound Name | Modification |
|---|---|---|---|---|
| 214613 | Acids | Acids | Carbamic acid | -62% to -100% |
| 214613 | Acids - Hydroxy Alpha | Acid Pathway | Butanoic acid, 2,3,4-trihydroxy- | 253% to 421% |
| 214613 | Acids - Hydroxy Alpha | Carbohydrates | Glyceric acid | New |
| 214613 | Acids - Hydroxy Alpha | Carbohydrates | Quinic acid | 322% to 537% |
| 214613 | Alcohols | Carbohydrates | Inositol | 80% to 133% |
| 214613 | Alkaloids and Other Bases | Polyamines | 1,4-Butanediamine | 143% to 238% |
| 214613 | Amino Acids and Related Compounds | Amino Acids and Related Compounds | Aspartic acid | 380% to 634% |
| 214613 | Amino Acids and Related Compounds | Amino Acids and Related Compounds | Glutamic acid | New |
| 214613 | Carbohydrates | Carbohydrates | F3-U0.768 Carbohydrate | NQ |
| 214613 | Carbohydrates | Carbohydrates | F3-U0.813 Carbohydrate | 278% to 464% |
| 214613 | Carbohydrates | Carbohydrates | F3-U0.816 Carbohydrate | 108% to 180% |
| 214613 | Carbohydrates | Carbohydrates | F3-U0.825 Carbohydrate | 224% to 373% |
| 214613 | Carbohydrates | Carbohydrates | F3-U0.846 Carbohydrate | 246% to 411% |
| 214613 | Carbohydrates | Carbohydrates | F3-U0.848 Carbohydrate | 147% to 245% |
| 214613 | Carbohydrates | Carbohydrates | F3-U0.872 Hexose | 290% to 483% |
| 214613 | Carbohydrates | Carbohydrates | Fructose | 246% to 505% |
| 214613 | Carbohydrates | Carbohydrates | Galactose or Mannose | New |
| 214613 | Carbohydrates | Carbohydrates | Glucose | 288% to 982% |
| 214613 | NA | NA | F3-U0.634 | New |
| 214613 | NA | NA | F3-U0.751 | 278% to 463% |
| 214613 | NA | NA | F3-U0.882 | 315% to 526% |
| 214613 | NA | NA | F3-U0.899 | 77% to 129% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214620

| Seq ID | Chemical Class | Biochemical Class | Compound Name | Modification |
|--------|----------------|-------------------|---------------|--------------|
| 214620 | Acids - Fatty | Fatty Acids and Related Waxes | Hexadecanoic acid | 3% to 17% |
| 214620 | Acids - Fatty Unsat | Fatty Acids and Related Waxes | 9,12,15-Octadecatrienoic acid | -3% to -13% |
| 214620 | Acids - Fatty Unsat | Fatty Acids and Related Waxes | 9,12-Octadecadienoic acid | 9% to 43% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214623

| Seq ID | Chemical Class | Biochemical Class | Compound Name | Modification |
|---|---|---|---|---|
| 214623 | Acids - Hydroxy Alpha | Carbohydrates | Quinic acid | 135% to 225% |
| 214623 | Alcohols | Carbohydrates | Inositol | 60% to 82% |
| 214623 | Carbohydrates | Carbohydrates | F3-U0.846 Carbohydrate | 207% to 345% |
| 214623 | Carbohydrates | Carbohydrates | F3-U0.872 Hexose | 165% to 276% |
| 214623 | Carbohydrates | Carbohydrates | F3-U1.150 Carbohydrate | 60% to 87% |
| 214623 | Carbohydrates | Carbohydrates | Fructose | 872% to 1568% |
| 214623 | Carbohydrates | Carbohydrates | Glucose | 1161% to 2321% |
| 214623 | NA | NA | F3-U0.882 | 60% to 82% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214633

| Seq ID | Chemical Class | Biochemical Class | Compound Name | Modification |
|---|---|---|---|---|
| 214633 | Acids | Acids | Carbamic acid | -63% to -100% |
| 214633 | Acids - Hydroxy Alpha | Acid Pathway | Butanoic acid, 2,3,4-trihydroxy- | 319% to 531% |
| 214633 | Acids - Hydroxy Alpha | Acid Pathway | Citric acid | -60% to -85% |
| 214633 | Acids - Hydroxy Alpha | Carbohydrates | Glyceric acid | New |
| 214633 | Acids - Hydroxy Alpha | Carbohydrates | Quinic acid | 590% to 983% |
| 214633 | Alkaloids and Other Bases | Polyamines | 1,4-Butanediamine | 167% to 279% |
| 214633 | Amino Acids and Related Compounds | Amino Acids and Related Compounds | Aspartic acid | New |
| 214633 | Amino Acids and Related Compounds | Amino Acids and Related Compounds | Glutamic acid | New |
| 214633 | Carbohydrates | Carbohydrates | F3-U0.768 Carbohydrate | NQ |
| 214633 | Carbohydrates | Carbohydrates | F3-U0.821 Carbohydrate | -60% to -85% |
| 214633 | Carbohydrates | Carbohydrates | F3-U0.825 Carbohydrate | New |
| 214633 | Carbohydrates | Carbohydrates | F3-U0.846 Carbohydrate | 65% to 108% |
| 214633 | Carbohydrates | Carbohydrates | F3-U0.872 Hexose | 177% to 294% |
| 214633 | Carbohydrates | Carbohydrates | Fructose | 329% to 693% |
| 214633 | Carbohydrates | Carbohydrates | Galactose or Mannose | New |
| 214633 | Carbohydrates | Carbohydrates | Glucose | 386% to 1925% |
| 214633 | NA | NA | F3-U0.740 | 89% to 149% |
| 214633 | NA | NA | F3-U0.882 | 498% to 831% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214634

| Seq ID | Chemical Class | Biochemical Class | Compound Name | Modification |
|---|---|---|---|---|
| 214634 | Aldehydes, Ketones and Quinones | Aldehydes, Ketones and Quinones | 3-Phytylmenadione | 233% to 389% |
| 214634 | Alkenes and Alkynes | Terpenoids | Limonene | 105% to 175% |
| 214634 | Esters | Esters | F1-U1.076 Fatty Acid Ester | 331% to 551% |
| 214634 | Esters | Esters | F1-U1.113 Fatty Acid Ester | 513% to 856% |
| 214634 | Esters | Esters | F1-U1.119 Fatty Acid Ester | 450% to 750% |
| 214634 | Esters - Hydroxy | Acyl acetylglycerols | 2-Octadecanoyl-1-acetylglycerol | 478% to 797% |
| 214634 | Sterols, Oxygenated Terpenes, and Other Isoprenoids | Prenylquinones | alpha-Tocopherol | 82% to 136% |
| 214634 | Sterols, Oxygenated Terpenes, and Other Isoprenoids | Prenylquinones | alpha-Tocopherol hydroquinone | 445% to 741% |
| 214634 | Sterols, Oxygenated Terpenes, and Other Isoprenoids | Terpenoids | beta-Sitosterol | 342% to 571% |
| 214634 | Sterols, Oxygenated Terpenes, and Other Isoprenoids | Terpenoids | Cholesterol | 60% to 90% |
| 214634 | Sterols, Oxygenated Terpenes, and Other Isoprenoids | Terpenoids | Cycloartenol | New |
| 214634 | Sterols, Oxygenated Terpenes, and Other Isoprenoids | Prenylquinones | F1-U1.176 alpha-Tocopherol Isomer | New |
| 214634 | Sterols, Oxygenated Terpenes, and Other Isoprenoids | Terpenoids | F1-U1.236 Sterol | New |
| 214634 | Sterols, Oxygenated Terpenes, and Other Isoprenoids | Prenylquinones | gamma-Tocopherol | New |
| 214634 | Sterols, Oxygenated Terpenes, and Other Isoprenoids | Terpenoids | Stigmasta-5,22-dien-3-ol, acetate | 178% to 296% |
| 214634 | Sterols, Oxygenated Terpenes, and Other Isoprenoids | Terpenoids | Stigmasterol | 143% to 238% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214637

| Seq ID | Chemical Class | Biochemical Class | Compound Name | Modification |
|---|---|---|---|---|
| 214637 | Acids - Hydroxy Alpha | Acid Pathway | Citric acid | -60% to -81% |
| 214637 | Alcohols | Carbohydrates | Inositol | 86% to 143% |
| 214637 | Carbohydrates | Carbohydrates | F3-U0.846 Carbohydrate | 618% to 1031% |
| 214637 | Carbohydrates | Carbohydrates | F3-U0.872 Hexose | 691% to 1151% |
| 214637 | Carbohydrates | Carbohydrates | Fructose | 199% to 5020% |
| 214637 | Carbohydrates | Carbohydrates | Galactose or Mannose | New |
| 214637 | Carbohydrates | Carbohydrates | Glucose | 2393% to 11724% |
| 214637 | NA | NA | F3-U0.882 | 90% to 150% |
| 214637 | NA | NA | F3-U1.253 | 78% to 130% |
| 214637 | Phenols and Related Compounds | Phenylpropanes and Derivatives | Chlorogenic acid | -60% to -75% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214639

| Seq ID | Chemical Class | Biochemical Class | Compound Name | Modification |
|---|---|---|---|---|
| 214639 | Acids - Hydroxy Alpha | Acid Pathway | Citric acid | 131% to 219% |
| 214639 | Acids | Acids | Carbamic acid | 515% to 859% |
| 214639 | Aldehydes, Ketones and Quinones | Aldehydes, Ketones and Quinones | 3-Phytylmenadione | 60% to 91% |
| 214639 | Amino Acids and Related Compounds | Amino Acids and Related Compounds | Glutamic acid | 124% to 206% |
| 214639 | Amino Acids and Related Compounds | Amino Acids and Related Compounds | Methionine | 60% to 145% |
| 214639 | Amino Acids and Related Compounds | Amino Acids and Related Compounds | Phenylalanine | 345% to 910% |
| 214639 | Carbohydrates | Carbohydrates | F3-U0.821 Carbohydrate | 131% to 219% |
| 214639 | Carbohydrates | Carbohydrates | F3-U1.189 Carbohydrate | NQ |
| 214639 | Carbohydrates | Carbohydrates | F3-U1.194 Carbohydrate | NQ |
| 214639 | Carbohydrates | Carbohydrates | Glucose | -65% to -100% |
| 214639 | Phenols and Related Compounds | Phenylpropanes and Derivatives | Chlorogenic acid | -72% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214664

| Seq ID | Chemical Class | Biochemical Class | Compound Name | Modification |
|---|---|---|---|---|
| 214664 | Amino Acids and Related Compounds | Amino Acids and Related Compounds | Alanine | 115% to 385% |
| 214664 | Amino Acids and Related Compounds | Amino Acids and Related Compounds | Arginine | NQ |
| 214664 | Amino Acids and Related Compounds | Amino Acids and Related Compounds | Aspartic acid | NQ |
| 214664 | Amino Acids and Related Compounds | Amino Acids and Related Compounds | Cysteine | NQ |
| 214664 | Amino Acids and Related Compounds | Amino Acids and Related Compounds | Glutamic acid | 75% to 195% |
| 214664 | Amino Acids and Related Compounds | Amino Acids and Related Compounds | Glycine | NQ |
| 214664 | Amino Acids and Related Compounds | Amino Acids and Related Compounds | Histidine | NQ |
| 214664 | Amino Acids and Related Compounds | Amino Acids and Related Compounds | Isoleucine | NQ |
| 214664 | Amino Acids and Related Compounds | Amino Acids and Related Compounds | Leucine | NQ |
| 214664 | Amino Acids and Related Compounds | Amino Acids and Related Compounds | Lysine | 15% to 270% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214665

| Seq ID | Chemical Class | Biochemical Class | Compound Name | Modification |
|---|---|---|---|---|
| 214665 | Acids | Acids | Carbamic acid | 92% to 154% |
| 214665 | Acids - Hydroxy Alpha | Acid Pathway | Malic acid | 60% to 76% |
| 214665 | Acids - Hydroxy Alpha | Carbohydrates | Quinic acid | 368% to 613% |
| 214665 | Acids - Keto | Acid Pathway | 2-Ketoglutaric acid | New |
| 214665 | Alcohols | Carbohydrates | Inositol | 133% to 222% |
| 214665 | Amino Acids and Related Compounds | Amino Acids and Related Compounds | Alanine | 55% to 250% |
| 214665 | Amino Acids and Related Compounds | Amino Acids and Related Compounds | Glycine | 95% to 715% |
| 214665 | Amino Acids and Related Compounds | Amino Acids and Related Compounds | Phenylalanine | 120% to 395% |
| 214665 | Carbohydrates | Carbohydrates | F3-U0.813 Carbohydrate | 439% to 731% |
| 214665 | Carbohydrates | Carbohydrates | F3-U0.813 Carbohydrate | 60% to 90% |
| 214665 | Carbohydrates | Carbohydrates | F3-U0.816 Carbohydrate | 105% to 175% |
| 214665 | Carbohydrates | Carbohydrates | F3-U0.846 Carbohydrate | 607% to 1012% |
| 214665 | Carbohydrates | Carbohydrates | F3-U0.848 Carbohydrate | 87% to 144% |
| 214665 | Carbohydrates | Carbohydrates | F3-U0.872 Hexose | 1428% to 2380% |
| 214665 | Carbohydrates | Carbohydrates | Fructose | 4009% to 7259% |
| 214665 | Carbohydrates | Carbohydrates | Galactose or Mannose | New |
| 214665 | Carbohydrates | Carbohydrates | Glucose | 2405% to 7335% |
| 214665 | NA | NA | F3-U0.843 | New |
| 214665 | NA | NA | F3-U0.852A | New |
| 214665 | NA | NA | F3-U0.882 | 138% to 230% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214666

| Seq ID | Chemical Class | Biochemical Class | Compound Name | Modification |
|---|---|---|---|---|
| 214666 | Acids - Fatty | Fatty Acids and Related Waxes | Eicosanoic acid | 151% to 415% |
| 214666 | Acids - Fatty | Fatty Acids and Related Waxes | Octadecanoic acid | 60% to 93% |
| 214666 | Acids - Fatty Unsat | Fatty Acids and Related Waxes | 9-Hexadecenoic acid | -60% to -61% |
| 214666 | Hydrocarbons | Hydrocarbons | Nonacosane, 3-methyl | 60% to 77% |
| 214666 | Hydrocarbons | Hydrocarbons | Octacosane, 2-methyl | 68% to 114% |
| 214666 | Sterols, Oxygenated Terpenes, and Other Isoprenoids | Prenylquinones | alpha-Tocopherol | 108% to 180% |
| 214666 | Sterols, Oxygenated Terpenes, and Other Isoprenoids | Prenylquinones | gamma-Tocopherol | New |
| 214666 | Sterols, Oxygenated Terpenes, and Other Isoprenoids | Terpenoids | Stigmasterol | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214672

| Seq ID | Chemical Class | Biochemical Class | Compound Name | Modification |
|---|---|---|---|---|
| 214672 | Acids - Hydroxy Alpha | Acid Pathway | Butanoic acid, 2,3,4-trihydroxy- | 123% to 205% |
| 214672 | Acids - Hydroxy Alpha | Acid Pathway | Malic acid | 331% to 551% |
| 214672 | Amino Acids and Related Compounds | Amino Acids and Related Compounds | Aspartic acid | New |
| 214672 | Amino Acids and Related Compounds | Amino Acids and Related Compounds | Proline, 5-oxo- | 75% to 125% |
| 214672 | Carbohydrates | Carbohydrates | F3-U0.846 Carbohydrate | -60% to -84% |
| 214672 | Carbohydrates | Carbohydrates | Fructose | 185% to 309% |
| 214672 | Carbohydrates | Carbohydrates | Glucose | 195% to 575% |
| 214672 | NA | NA | F3-U0.727 | 140% to 233% |
| 214672 | NA | NA | F3-U0.882 | 90% to 149% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214676

| Seq ID | Chemical Class | Biochemical Class | Compound Name | Modification |
|---|---|---|---|---|
| 214676 | Acids | Acids | Carbamic acid | New |
| 214676 | Acids - Hydroxy Alpha | Acid Pathway | Butanoic acid, 2,3,4-trihydroxy- | 61% to 101% |
| 214676 | Acids - Hydroxy Alpha | Acid Pathway | Malic acid | 60% to 95% |
| 214676 | Acids - Hydroxy Alpha | Carbohydrates | Quinic acid | 209% to 348% |
| 214676 | Alcohols | Carbohydrates | Inositol | 119% to 198% |
| 214676 | Carbohydrates | Carbohydrates | F3-U0.846 Carbohydrate | 364% to 607% |
| 214676 | Carbohydrates | Carbohydrates | F3-U0.872 Hexose | 241% to 402% |
| 214676 | Carbohydrates | Carbohydrates | F3-U1.189 Carbohydrate | -60% to -84% |
| 214676 | Carbohydrates | Carbohydrates | Fructose | 340% to 639% |
| 214676 | Carbohydrates | Carbohydrates | Galactose or Mannose | New |
| 214676 | Carbohydrates | Carbohydrates | Glucose | 614% to 674% |
| 214676 | NA | NA | F3-U0.882 | 126% to 209% |
| 214676 | Phenols and Related Compounds | Phenylpropanes and Derivatives | Chlorogenic acid | -60% to -86% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214687

| Seq ID | Chemical Class | Biochemical Class | Compound Name | Modification |
|---|---|---|---|---|
| 214687 | Acids | Acids | Carbamic acid | -62% to -100% |
| 214687 | Acids - Hydroxy Alpha | Acid Pathway | Butanoic acid, 2,3,4-trihydroxy- | NQ |
| 214687 | Acids - Hydroxy Alpha | Acid Pathway | Citric acid | NQ |
| 214687 | Acids - Hydroxy Alpha | Acid Pathway | Malic acid | -60% to -100% |
| 214687 | Acids - Hydroxy Alpha | Acid Pathway | Quinic acid | -60% to -78% |
| 214687 | Alcohols | Carbohydrates | Inositol | -60% to -100% |
| 214687 | Amino Acids and Related Compounds | Amino Acids and Related Compounds | Glycine | New |
| 214687 | Carbohydrates | Carbohydrates | F3-U0.821 Carbohydrate | NQ |
| 214687 | Carbohydrates | Carbohydrates | F3-U0.846 Carbohydrate | -70% to -100% |
| 214687 | Carbohydrates | Carbohydrates | F3-U0.872 Hexose | -72% to -100% |
| 214687 | Carbohydrates | Carbohydrates | F3-U0.952 Carbohydrate | NQ |
| 214687 | Carbohydrates | Carbohydrates | F3-U1.189 Carbohydrate | -60% to -97% |
| 214687 | Carbohydrates | Carbohydrates | Fructose | -63% to -100% |
| 214687 | Carbohydrates | Carbohydrates | Glucose | -63% to -100% |
| 214687 | NA | NA | F3-U0.843 | NQ |
| 214687 | NA | NA | F3-U0.852A | -60% to -100% |
| 214687 | Phenols and Related Compounds | Phenylpropanes and Derivatives | Chlorogenic acid | -60% to -92% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214707

| Seq ID | Chemical Class | Biochemical Class | Compound Name | Modification |
|--------|----------------|-------------------|---------------|--------------|
| 214707 | Acids | Acids | Carbamic acid | 494% to New |
| 214707 | Acids - Hydroxy Alpha | Acid Pathway | Butanoic acid, 2,3,4-trihydroxy- | 88% to 146% |
| 214707 | Acids - Hydroxy Alpha | Acid Pathway | Malic acid | 155% to 259% |
| 214707 | Acids - Hydroxy Alpha | Carbohydrates | Quinic acid | 122% to 204% |
| 214707 | Carbohydrates | Carbohydrates | F3-U0.846 Carbohydrate | 547% to 912% |
| 214707 | Carbohydrates | Carbohydrates | F3-U0.872 Hexose | 325% to 542% |
| 214707 | Carbohydrates | Carbohydrates | Fructose | 191% to 372% |
| 214707 | Carbohydrates | Carbohydrates | Glucose | 543% to 1526% |
| 214707 | NA | NA | F3-U0.882 | 63% to 105% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214715

| Seq ID | Chemical Class | Biochemical Class | Compound Name | Modification |
|---|---|---|---|---|
| 214715 | Acids - Fatty | Fatty Acids and Related Waxes | Octadecanoic acid | 9% to 43% |
| 214715 | Acids - Fatty Branched | Fatty Acids and Related Waxes | Hexadecanoic acid, 14-methyl- | 13% to 31% |
| 214715 | Acids - Fatty Unsat | Fatty Acids and Related Waxes | 9,12,15-Octadecatrienoic acid | -7% to -9% |
| 214715 | Acids - Fatty Unsat | Fatty Acids and Related Waxes | 9,12-Octadecadienoic acid | 25% to 43% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214724

| Seq ID | Chemical Class | Biochemical Class | Compound Name | Modification |
|---|---|---|---|---|
| 214724 | Acids | Acids | Carbamic acid | -60% to -77% |
| 214724 | Acids - Hydroxy Alpha | Acid Pathway | Butanoic acid, 2,3,4-trihydroxy- | 60% to 79% |
| 214724 | Acids - Hydroxy Alpha | Acid Pathway | Malic acid | 85% to 141% |
| 214724 | Acids - Hydroxy Alpha | Carbohydrates | Quinic acid | 278% to 463% |
| 214724 | Alkaloids and Other Bases | Polyamines | 1,4-Butanediamine | 134% to 224% |
| 214724 | Amino Acids and Related Compounds | Amino Acids and Related Compounds | Aspartic acid | 60% to 89% |
| 214724 | Amino Acids and Related Compounds | Amino Acids and Related Compounds | Glutamic acid | 60% to 168% |
| 214724 | Amino Acids and Related Compounds | Amino Acids and Related Compounds | Proline, 5-oxo- | 60% to 89% |
| 214724 | Amino Acids and Related Compounds | Amino Acids and Related Compounds | Serine | 66% to 110% |
| 214724 | Carbohydrates | Carbohydrates | F3-U0.813 Carbohydrate | 139% to 363% |
| 214724 | Carbohydrates | Carbohydrates | F3-U0.816 Carbohydrate | 92% to 154% |
| 214724 | Carbohydrates | Carbohydrates | F3-U0.825 Carbohydrate | 345% to 576% |
| 214724 | Carbohydrates | Carbohydrates | F3-U0.846 Carbohydrate | 301% to 501% |
| 214724 | Carbohydrates | Carbohydrates | F3-U0.848 Carbohydrate | 106% to 177% |
| 214724 | Carbohydrates | Carbohydrates | F3-U0.872 Hexose | 282% to 470% |
| 214724 | Carbohydrates | Carbohydrates | Fructose | 98% to 374% |
| 214724 | Carbohydrates | Carbohydrates | Galactose or Mannose | NQ |
| 214724 | Carbohydrates | Carbohydrates | Glucose | 397% to 763% |
| 214724 | NA | NA | F3-U0.727 | NQ |
| 214724 | NA | NA | F3-U0.751 | 159% to 264% |
| 214724 | NA | NA | F3-U0.843 | 127% to 212% |
| 214724 | NA | NA | F3-U0.852A | 112% to 276% |
| 214724 | NA | NA | F3-U1.253 | 60% to 99% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214740

| Seq ID | Chemical Class | Biochemical Class | Compound Name | Modification |
|---|---|---|---|---|
| 214740 | Amino Acids and Related Compounds | Amino Acids and Related Compounds | Cysteine | 40% to 220% |
| 214740 | Amino Acids and Related Compounds | Amino Acids and Related Compounds | Glutamic acid | 5% to 120% |
| 214740 | Amino Acids and Related Compounds | Amino Acids and Related Compounds | Glycine | 30% to 280% |
| 214740 | Amino Acids and Related Compounds | Amino Acids and Related Compounds | Lysine | -35% to -65% |
| 214740 | Amino Acids and Related Compounds | Amino Acids and Related Compounds | Methionine | 15% to 55% |
| 214740 | Amino Acids and Related Compounds | Amino Acids and Related Compounds | Phenylalanine | 10% to 155% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214746

| Seq ID | Chemical Class | Biochemical Class | Compound Name | Modification |
|---|---|---|---|---|
| 214746 | Acids | Acids | Carbamic acid | 67% to 111% |
| 214746 | Acids - Hydroxy Alpha | Acid Pathway | Butanoic acid, 2,3,4-trihydroxy- | 71% to 419% |
| 214746 | Acids - Hydroxy Alpha | Acid Pathway | Citric acid | 133% to 461% |
| 214746 | Acids - Hydroxy Alpha | Carbohydrates | Quinic acid | 64% to 331% |
| 214746 | Alkaloids and Other Bases | Alkaloids and Other Bases | Nicotine | New |
| 214746 | Amino Acids and Related Compounds | Amino Acids and Related Compounds | Aspartic acid | 87% to 146% |
| 214746 | Amino Acids and Related Compounds | Amino Acids and Related Compounds | Proline, 5-oxo- | 63% to 132% |
| 214746 | Carbohydrates | Carbohydrates | F3-U0.813 Carbohydrate | New |
| 214746 | Carbohydrates | Carbohydrates | F3-U0.816 Carbohydrate | 125% to 638% |
| 214746 | Carbohydrates | Carbohydrates | F3-U0.821 Carbohydrate | 133% to 806% |
| 214746 | Carbohydrates | Carbohydrates | F3-U0.846 Carbohydrate | 107% to 1398% |
| 214746 | Carbohydrates | Carbohydrates | F3-U0.872 Hexose | 123% to 931% |
| 214746 | Carbohydrates | Carbohydrates | F3-U1.143 Carbohydrate | 60% to 128% |
| 214746 | Carbohydrates | Carbohydrates | F3-U1.150 Carbohydrate | 62% to 103% |
| 214746 | Carbohydrates | Carbohydrates | F3-U1.189 Carbohydrate | 97% to 161% |
| 214746 | Carbohydrates | Carbohydrates | Fructose | 98% to 619% |
| 214746 | Carbohydrates | Carbohydrates | Galactose or Mannose | 92% to 300% |
| 214746 | Carbohydrates | Carbohydrates | Glucose | 75% to 676% |
| 214746 | NA | NA | F3-U0.852A | New |
| 214746 | NA | NA | F3-U0.882 | 83% to 162% |
| 214746 | Phenols and Related Compounds | Phenylpropanes and Derivatives | Chlorogenic acid | 60% to 192% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214756

| Seq ID | Chemical Class | Biochemical Class | Compound Name | Modification |
|---|---|---|---|---|
| 214756 | Amino Acids and Related Compounds | Amino Acids and Related Compounds | Arginine | 90% to 490% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214762

| Seq ID | Chemical Class | Biochemical Class | Compound Name | Modification |
|---|---|---|---|---|
| 214762 | Amino Acids and Related Compounds | Amino Acids and Related Compounds | Alanine | 35% to 95% |
| 214762 | Amino Acids and Related Compounds | Amino Acids and Related Compounds | Lysine | 10% to 105% |
| 214762 | Amino Acids and Related Compounds | Amino Acids and Related Compounds | Methionine | 30% to 70% |
| 214762 | Amino Acids and Related Compounds | Amino Acids and Related Compounds | Threonine | 15% to 105% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214766

| Seq ID | Chemical Class | Biochemical Class | Compound Name | Modification |
|---|---|---|---|---|
| 214766 | Amino Acids and Related Compounds | Amino Acids and Related Compounds | Cysteine | 40% to 550% |
| 214766 | Amino Acids and Related Compounds | Amino Acids and Related Compounds | Glutamic acid | 10% to 140% |
| 214766 | Amino Acids and Related Compounds | Amino Acids and Related Compounds | Glycine | 35% to 470% |
| 214766 | Amino Acids and Related Compounds | Amino Acids and Related Compounds | Methionine | 10% to 45% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214771

| Seq ID | Chemical Class | Biochemical Class | Compound Name | Modification |
|---|---|---|---|---|
| 214771 | Acids - Fatty | Fatty Acids and Related Waxes | Octadecanoic acid | 9% to 25% |
| 214771 | Acids - Fatty Unsat | Fatty Acids and Related Waxes | 9,12,15-Octadecatrienoic acid | -1% to -5% |
| 214771 | Acids - Fatty Unsat | Fatty Acids and Related Waxes | 9,12-Octadecadienoic acid | 5% to 33% |
| 214771 | Acids - Fatty Unsat | Fatty Acids and Related Waxes | 9-Octadecenoic acid | 33% to 123% |
| 214771 | Amino Acids and Related Compounds | Amino Acids and Related Compounds | Arginine | 30% to 1335% |
| 214771 | Amino Acids and Related Compounds | Amino Acids and Related Compounds | Cysteine | 15% to 445% |
| 214771 | Amino Acids and Related Compounds | Amino Acids and Related Compounds | Glycine | 25% to 70% |
| 214771 | Amino Acids and Related Compounds | Amino Acids and Related Compounds | Leucine | 5% to 235% |
| 214771 | Amino Acids and Related Compounds | Amino Acids and Related Compounds | Methionine | 20% to 35% |
| 214771 | Amino Acids and Related Compounds | Amino Acids and Related Compounds | Phenylalanine | 15% to 225% |
| 214771 | Amino Acids and Related Compounds | Amino Acids and Related Compounds | Proline | 30% to 290% |
| 214771 | Amino Acids and Related Compounds | Amino Acids and Related Compounds | Threonine | 5% to 95% |
| 214771 | Amino Acids and Related Compounds | Amino Acids and Related Compounds | Valine | 40% to 175% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214787

| Seq ID | Chemical Class | Biochemical Class | Compound Name | Modification |
|---|---|---|---|---|
| 214787 | Amino Acids and Related Compounds | Amino Acids and Related Compounds | Lysine | -50% to 80% |
| 214787 | Amino Acids and Related Compounds | Amino Acids and Related Compounds | Proline | 30% to 205% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214794

| Seq ID | Chemical Class | Biochemical Class | Compound Name | Modification |
|---|---|---|---|---|
| 214794 | Amino Acids and Related Compounds | Amino Acids and Related Compounds | Arginine | 145% to 675% |
| 214794 | Amino Acids and Related Compounds | Amino Acids and Related Compounds | Cysteine | 145% to 2600% |
| 214794 | Amino Acids and Related Compounds | Amino Acids and Related Compounds | Glutamic acid | 20% to 155% |
| 214794 | Amino Acids and Related Compounds | Amino Acids and Related Compounds | Glycine | 150% to 920% |
| 214794 | Amino Acids and Related Compounds | Amino Acids and Related Compounds | Leucine | 90% to 1400% |
| 214794 | Amino Acids and Related Compounds | Amino Acids and Related Compounds | Methionine | 100% to 165% |
| 214794 | Amino Acids and Related Compounds | Amino Acids and Related Compounds | Phenylalanine | 300% to 805% |
| 214794 | Amino Acids and Related Compounds | Amino Acids and Related Compounds | Proline | 35% to 395% |
| 214794 | Amino Acids and Related Compounds | Amino Acids and Related Compounds | Threonine | 15% to 180% |
| 214794 | Amino Acids and Related Compounds | Amino Acids and Related Compounds | Valine | 110% to 755% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214809

| Seq ID | Chemical Class | Biochemical Class | Compound Name | Modification |
|---|---|---|---|---|
| 214809 | Amino Acids and Related Compounds | Amino Acids and Related Compounds | Alanine | 5% to 135% |
| 214809 | Amino Acids and Related Compounds | Amino Acids and Related Compounds | Arginine | 90% to 1400% |
| 214809 | Amino Acids and Related Compounds | Amino Acids and Related Compounds | Aspartic acid | 30% to 70% |
| 214809 | Amino Acids and Related Compounds | Amino Acids and Related Compounds | Cysteine | 10% to 1900% |
| 214809 | Amino Acids and Related Compounds | Amino Acids and Related Compounds | Glutamic acid | 15% to 100% |
| 214809 | Amino Acids and Related Compounds | Amino Acids and Related Compounds | Glycine | 100% to 715% |
| 214809 | Amino Acids and Related Compounds | Amino Acids and Related Compounds | Lysine | 40% to 140% |
| 214809 | Amino Acids and Related Compounds | Amino Acids and Related Compounds | Serine | 20% to 110% |
| 214809 | Amino Acids and Related Compounds | Amino Acids and Related Compounds | Threonine | 25% to 170% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214819

| Seq ID | Chemical Class | Biochemical Class | Compound Name | Modification |
|---|---|---|---|---|
| 214819 | Amino Acids and Related Compounds | Amino Acids and Related Compounds | Leucine | 5% to 160% |
| 214819 | Amino Acids and Related Compounds | Amino Acids and Related Compounds | Lysine | 70% to 215% |
| 214819 | Amino Acids and Related Compounds | Amino Acids and Related Compounds | Methionine | 10% to 45% |
| 214819 | Amino Acids and Related Compounds | Amino Acids and Related Compounds | Phenylalanine | 30% to 295% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214824

| Seq ID | Chemical Class | Biochemical Class | Compound Name | Modification |
|---|---|---|---|---|
| 214824 | Amino Acids and Related Compounds | Amino Acids and Related Compounds | Alanine | 25% to 165% |
| 214824 | Amino Acids and Related Compounds | Amino Acids and Related Compounds | Arginine | 5% to 2350% |
| 214824 | Amino Acids and Related Compounds | Amino Acids and Related Compounds | Cysteine | 5% to 2000% |
| 214824 | Amino Acids and Related Compounds | Amino Acids and Related Compounds | Glutamic acid | 10% to 110% |
| 214824 | Amino Acids and Related Compounds | Amino Acids and Related Compounds | Glycine | 50% to 540% |
| 214824 | Amino Acids and Related Compounds | Amino Acids and Related Compounds | Histidine | 20% to 180% |
| 214824 | Amino Acids and Related Compounds | Amino Acids and Related Compounds | Serine | New |
| 214824 | Amino Acids and Related Compounds | Amino Acids and Related Compounds | Threonine | 5% to 295% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214826

| Seq ID | Chemical Class | Biochemical Class | Compound Name | Modification |
|---|---|---|---|---|
| 214826 | Amino Acids and Related Compounds | Amino Acids and Related Compounds | Alanine | 135% to 3600% |
| 214826 | Amino Acids and Related Compounds | Amino Acids and Related Compounds | Arginine | 155% to 705% |
| 214826 | Amino Acids and Related Compounds | Amino Acids and Related Compounds | Cysteine | 395% to 11000% |
| 214826 | Amino Acids and Related Compounds | Amino Acids and Related Compounds | Glycine | 270% to 4200% |
| 214826 | Amino Acids and Related Compounds | Amino Acids and Related Compounds | Isoleucine | 60% to 2500% |
| 214826 | Amino Acids and Related Compounds | Amino Acids and Related Compounds | Leucine | 120% to 2200% |
| 214826 | Amino Acids and Related Compounds | Amino Acids and Related Compounds | Lysine | 65% to 370% |
| 214826 | Amino Acids and Related Compounds | Amino Acids and Related Compounds | Phenylalanine | 120% to 1000% |
| 214826 | Amino Acids and Related Compounds | Amino Acids and Related Compounds | Threonine | 90% to 385% |
| 214826 | Amino Acids and Related Compounds | Amino Acids and Related Compounds | Tryptophan | 250% to 930% |
| 214826 | Amino Acids and Related Compounds | Amino Acids and Related Compounds | Tyrosine | New |
| 214826 | Amino Acids and Related Compounds | Amino Acids and Related Compounds | Valine | 75% to 1450% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214828

| Seq ID | Chemical Class | Biochemical Class | Compound Name | Modification |
|--------|---------------|-------------------|---------------|--------------|
| 214828 | Acids - Fatty | Fatty Acids and Related Waxes | Octadecanoic acid | -9% to -19% |
| 214828 | Acids - Fatty Unsat | Fatty Acids and Related Waxes | 9,12,15-Octadecatrienoic acid | -3% to -7% |
| 214828 | Acids - Fatty Unsat | Fatty Acids and Related Waxes | 9,12-Octadecadienoic acid | 9% to 36% |
| 214828 | Amino Acids and Related Compounds | Amino Acids and Related Compounds | Arginine | 10% to 430% |
| 214828 | Amino Acids and Related Compounds | Amino Acids and Related Compounds | Cysteine | 75% to 300% |
| 214828 | Amino Acids and Related Compounds | Amino Acids and Related Compounds | Glutamic acid | 35% to 185% |
| 214828 | Amino Acids and Related Compounds | Amino Acids and Related Compounds | Glycine | 30% to 275% |
| 214828 | Amino Acids and Related Compounds | Amino Acids and Related Compounds | Leucine | 5% to 230% |
| 214828 | Amino Acids and Related Compounds | Amino Acids and Related Compounds | Methionine | 5% to 15% |
| 214828 | Amino Acids and Related Compounds | Amino Acids and Related Compounds | Proline | 5% to 120% |
| 214828 | Amino Acids and Related Compounds | Amino Acids and Related Compounds | Threonine | 10% to 45% |
| 214828 | Amino Acids and Related Compounds | Amino Acids and Related Compounds | Valine | 25% to 145% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214837

| Seq ID | Chemical Class | Biochemical Class | Compound Name | Modification |
|---|---|---|---|---|
| 214837 | Amino Acids and Related Compounds | Amino Acids and Related Compounds | Methionine | 10% to 45% |
| 214837 | Amino Acids and Related Compounds | Amino Acids and Related Compounds | Phenylalanine | 5% to 165% |
| 214837 | Amino Acids and Related Compounds | Amino Acids and Related Compounds | Threonine | 5% to 45% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214840

| Seq ID | Chemical Class | Biochemical Class | Compound Name | Modification |
|---|---|---|---|---|
| 214840 | Amino Acids and Related Compounds | Amino Acids and Related Compounds | Alanine | 20% to 160% |
| 214840 | Amino Acids and Related Compounds | Amino Acids and Related Compounds | Aspartic acid | 5% to 80% |
| 214840 | Amino Acids and Related Compounds | Amino Acids and Related Compounds | Glutamic acid | 5% to 120% |
| 214840 | Amino Acids and Related Compounds | Amino Acids and Related Compounds | Glycine | 60% to 810% |
| 214840 | Amino Acids and Related Compounds | Amino Acids and Related Compounds | Threonine | 20% to 105% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214847

| Seq ID | Chemical Class | Biochemical Class | Compound Name | Modification |
|---|---|---|---|---|
| 214847 | Acids | Acids | Carbamic acid | 70% to 296% |
| 214847 | Acids - Hydroxy Alpha | Acid Pathway | Butanoic acid, 2,3,4-trihydroxy- | 112% to 418% |
| 214847 | Acids - Hydroxy Alpha | Acid Pathway | Citric acid | 74% to 422% |
| 214847 | Acids - Hydroxy Alpha | Carbohydrates | Quinic acid | 67% to 523% |
| 214847 | Alcohols | Carbohydrates | Inositol | 129% to 214% |
| 214847 | Alkaloids and Other Bases | Polyamines | 1,4-Butanediamine | New |
| 214847 | Carbohydrates | Carbohydrates | F3-U0.813 Carbohydrate | New |
| 214847 | Carbohydrates | Carbohydrates | F3-U0.816 Carbohydrate | 172% to 287% |
| 214847 | Carbohydrates | Carbohydrates | F3-U0.821 Carbohydrate | 74% to 422% |
| 214847 | Carbohydrates | Carbohydrates | F3-U0.846 Carbohydrate | 60% to 752% |
| 214847 | Carbohydrates | Carbohydrates | F3-U0.872 Hexose | 132% to 517% |
| 214847 | Carbohydrates | Carbohydrates | F3-U0.952 Carbohydrate | 89% to 148% |
| 214847 | Carbohydrates | Carbohydrates | F3-U1.143 Carbohydrate | 60% to 198% |
| 214847 | Carbohydrates | Carbohydrates | F3-U1.189 Carbohydrate | 254% to 423% |
| 214847 | Carbohydrates | Carbohydrates | Fructose | 76% to 1641% |
| 214847 | Carbohydrates | Carbohydrates | Galactose or Mannose | 60% to 527% |
| 214847 | Carbohydrates | Carbohydrates | Glucose | 123% to 2156% |
| 214847 | NA | NA | F3-U0.882 | 89% to 211% |
| 214847 | NA | NA | F3-U1.253 | 154% to 257% |
| 214847 | Phenols and Related Compounds | Phenylpropanes and Derivatives | Chlorogenic acid | 60% to 152% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214873

| Seq ID | Chemical Class | Biochemical Class | Compound Name | Modification |
|---|---|---|---|---|
| 214873 | Acids - Fatty | Fatty Acids and Related Waxes | Hexadecanoic acid | 2% to 7% |
| 214873 | Acids - Fatty | Fatty Acids and Related Waxes | Octadecanoic acid | -11% to -29% |
| 214873 | Acids - Fatty Branched | Fatty Acids and Related Waxes | Heptadecanoic acid, 16-methyl- | -27% to -51% |
| 214873 | Acids - Fatty Unsat | Fatty Acids and Related Waxes | 9,12-Octadecadienoic acid | -5% to -17% |
| 214873 | Acids - Fatty Unsat | Fatty Acids and Related Waxes | 9-Hexadecenoic acid | 5% to 43% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214888

| Seq ID | Chemical Class | Biochemical Class | Compound Name | Modification |
|---|---|---|---|---|
| 214888 | Amino Acids and Related Compounds | Amino Acids and Related Compounds | Cysteine | 135% to 530% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214904

| Seq ID | Chemical Class | Biochemical Class | Compound Name | Modification |
|---|---|---|---|---|
| 214904 | Acids - Fatty | Fatty Acids and Related Waxes | Octadecanoic acid | 39% to 69% |
| 214904 | Acids - Fatty Unsat | Fatty Acids and Related Waxes | 9,12-Octadecadienoic acid | 46% to 65% |
| 214904 | Acids - Fatty Unsat | Fatty Acids and Related Waxes | 9-Hexadecenoic acid | -51% to -65% |
| 214904 | Amino Acids and Related Compounds | Amino Acids and Related Compounds | Alanine | 275% to 480% |
| 214904 | Amino Acids and Related Compounds | Amino Acids and Related Compounds | Arginine | 5% to 350% |
| 214904 | Amino Acids and Related Compounds | Amino Acids and Related Compounds | Aspartic acid | -50% to -80% |
| 214904 | Amino Acids and Related Compounds | Amino Acids and Related Compounds | Cysteine | 55% to 1700% |
| 214904 | Amino Acids and Related Compounds | Amino Acids and Related Compounds | Glycine | 100% to 1790% |
| 214904 | Amino Acids and Related Compounds | Amino Acids and Related Compounds | Serine | 60% to 265% |
| 214904 | Amino Acids and Related Compounds | Amino Acids and Related Compounds | Threonine | 5% to 90% |
| 214904 | Amino Acids and Related Compounds | Amino Acids and Related Compounds | Tyrosine | 5% to 340% |
| 214904 | Amino Acids and Related Compounds | Amino Acids and Related Compounds | Valine | 5% to 165% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214907

| Seq ID | Chemical Class | Biochemical Class | Compound Name | Modification |
|---|---|---|---|---|
| 214907 | Acids - Fatty | Fatty Acids and Related Waxes | Octadecanoic acid | -7% to -20% |
| 214907 | Acids - Fatty Branched | Fatty Acids and Related Waxes | Heptadecanoic acid, 16-methyl- | 14% to 33% |
| 214907 | Acids - Fatty Unsat | Fatty Acids and Related Waxes | 9,12-Octadecadienoic acid | -6% to -17% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214918

| Seq ID | Chemical Class | Biochemical Class | Compound Name | Modification |
|---|---|---|---|---|
| 214918 | Acids - Fatty Unsat | Fatty Acids and Related Waxes | 9,12,15-Octadecatrienoic acid | -8% to -15% |
| 214918 | Acids - Fatty Unsat | Fatty Acids and Related Waxes | 9-Hexadecenoic acid | -29% to -52% |
| 214918 | Acids - Fatty Unsat | Fatty Acids and Related Waxes | 9-Octadecenoic acid | 56% to 118% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#214919

| Seq ID | Chemical Class | Biochemical Class | Compound Name | Modification |
|---|---|---|---|---|
| 214919 | Acids - Fatty | Fatty Acids and Related Waxes | Eicosanoic acid | -51% to -74% |
| 214919 | Acids - Fatty | Fatty Acids and Related Waxes | Octadecanoic acid | -13% to -21% |
| 214919 | Acids - Fatty Unsat | Fatty Acids and Related Waxes | 9,12-Octadecadienoic acid | 4% to 20% |
| 214919 | Acids - Fatty Unsat | Fatty Acids and Related Waxes | 9-Octadecenoic acid | 21% to 73% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214920

| Seq ID | Chemical Class | Biochemical Class | Compound Name | Modification |
|---|---|---|---|---|
| 214920 | Acids - Fatty | Fatty Acids and Related Waxes | Eicosanoic acid | -32% to -64% |
| 214920 | Acids - Fatty | Fatty Acids and Related Waxes | Hexadecanoic acid | 5% to 40% |
| 214920 | Acids - Fatty Unsat | Fatty Acids and Related Waxes | 9,12,15-Octadecatrienoic acid | -4% to -9% |
| 214920 | Acids - Fatty Unsat | Fatty Acids and Related Waxes | 9-Octadecenoic acid | 24% to 77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214922

| Seq ID | Chemical Class | Biochemical Class | Compound Name | Modification |
|---|---|---|---|---|
| 214922 | Acids - Fatty | Fatty Acids and Related Waxes | Hexadecanoic acid | 3% to 10% |
| 214922 | Acids - Fatty Branched | Fatty Acids and Related Waxes | Hexadecanoic acid, 14-methyl- | -54% to -69% |
| 214922 | Acids - Fatty Unsat | Fatty Acids and Related Waxes | 9,12,15-Octadecatrienoic acid | 4% to 9% |
| 214922 | Acids - Fatty Unsat | Fatty Acids and Related Waxes | 9,12-Octadecadienoic acid | -25% to -44% |
| 214922 | Acids - Fatty Unsat | Fatty Acids and Related Waxes | 9-Hexadecenoic acid | -16% to -53% |
| 214922 | Acids - Fatty Unsat | Fatty Acids and Related Waxes | 9-Octadecenoic acid | -25% to -36% |
| 214922 | Amino Acids and Related Compounds | Amino Acids and Related Compounds | Glutamic acid | 15% to 50% |
| 214922 | Amino Acids and Related Compounds | Amino Acids and Related Compounds | Isoleucine | 1000% to 2600% |
| 214922 | Amino Acids and Related Compounds | Amino Acids and Related Compounds | Leucine | 40% to 1655% |
| 214922 | Amino Acids and Related Compounds | Amino Acids and Related Compounds | Lysine | 25% to 200% |
| 214922 | Amino Acids and Related Compounds | Amino Acids and Related Compounds | Phenylalanine | 60% to 905% |
| 214922 | Amino Acids and Related Compounds | Amino Acids and Related Compounds | Proline | 50% to 490% |
| 214922 | Amino Acids and Related Compounds | Amino Acids and Related Compounds | Threonine | 110% to 415% |
| 214922 | Amino Acids and Related Compounds | Amino Acids and Related Compounds | Tryptophan | 105% to 635% |
| 214922 | Amino Acids and Related Compounds | Amino Acids and Related Compounds | Valine | 385% to 1450% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214928

| Seq ID | Chemical Class | Biochemical Class | Compound Name | Modification |
|---|---|---|---|---|
| 214928 | Amino Acids and Related Compounds | Amino Acids and Related Compounds | Alanine | 130% to 255% |
| 214928 | Amino Acids and Related Compounds | Amino Acids and Related Compounds | Histidine | 55% to 340% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214931

| Seq ID | Chemical Class | Biochemical Class | Compound Name | Modification |
|---|---|---|---|---|
| 214931 | Amino Acids and Related Compounds | Amino Acids and Related Compounds | Glutamic acid | 25% to 130% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214938

| Seq ID | Chemical Class | Biochemical Class | Compound Name | Modification |
|---|---|---|---|---|
| 214938 | Acids - Hydroxy Alpha | Acid Pathway | Butanoic acid, 2,3,4-trihydroxy- | 60% to 98% |
| 214938 | Acids - Hydroxy Alpha | Carbohydrates | Quinic acid | 203% to 338% |
| 214938 | Alcohols | Carbohydrates | Inositol | 60% to 91% |
| 214938 | Amino Acids and Related Compounds | Amino Acids and Related Compounds | Glutamic acid | 155% to 258% |
| 214938 | Carbohydrates | Carbohydrates | F3-U0.813 Carbohydrate | 138% to 231% |
| 214938 | Carbohydrates | Carbohydrates | F3-U0.816 Carbohydrate | 60% to 92% |
| 214938 | Carbohydrates | Carbohydrates | F3-U0.825 Carbohydrate | 106% to 176% |
| 214938 | Carbohydrates | Carbohydrates | F3-U0.846 Carbohydrate | 333% to 555% |
| 214938 | Carbohydrates | Carbohydrates | F3-U0.848 Carbohydrate | 116% to 193% |
| 214938 | Carbohydrates | Carbohydrates | F3-U0.872 Hexose | 465% to 776% |
| 214938 | Carbohydrates | Carbohydrates | F3-U1.118 Carbohydrate | 60% to 80% |
| 214938 | Carbohydrates | Carbohydrates | Fructose | 431% to 1055% |
| 214938 | Carbohydrates | Carbohydrates | Glucose | 483% to 2043% |
| 214938 | NA | NA | F3-U0.882 | 72% to 119% |
| 214938 | Phenols and Related Compounds | Phenylpropanes and Derivatives | Chlorogenic acid | -60% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#214953

| Seq ID | Chemical Class | Biochemical Class | Compound Name | Modification |
|---|---|---|---|---|
| 214953 | Amino Acids and Related Compounds | Amino Acids and Related Compounds | Aspartic acid | 20% to 65% |
| 214953 | Amino Acids and Related Compounds | Amino Acids and Related Compounds | Glutamic acid | 30% to 110% |
| 214953 | Amino Acids and Related Compounds | Amino Acids and Related Compounds | Phenylalanine | 30% to 95% |
| 214953 | Amino Acids and Related Compounds | Amino Acids and Related Compounds | Threonine | 30% to 225% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215021

| Seq ID | Chemical Class | Biochemical Class | Compound Name | Modification |
|---|---|---|---|---|
| 215021 | Amino Acids and Related Compounds | Amino Acids and Related Compounds | Alanine | 70% to 180% |
| 215021 | Amino Acids and Related Compounds | Amino Acids and Related Compounds | Cysteine | 20% to 290% |
| 215021 | Amino Acids and Related Compounds | Amino Acids and Related Compounds | Leucine | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215033

| Seq ID | Chemical Class | Biochemical Class | Compound Name | Modification |
|---|---|---|---|---|
| 215033 | Amino Acids and Related Compounds | Amino Acids and Related Compounds | Alanine | 30% to 500% |
| 215033 | Amino Acids and Related Compounds | Amino Acids and Related Compounds | Cysteine | 15% to 4630% |
| 215033 | Amino Acids and Related Compounds | Amino Acids and Related Compounds | Glutamic acid | 5% to 125% |
| 215033 | Amino Acids and Related Compounds | Amino Acids and Related Compounds | Glycine | 20% to 3210% |
| 215033 | Amino Acids and Related Compounds | Amino Acids and Related Compounds | Isoleucine | 70% to 125% |
| 215033 | Amino Acids and Related Compounds | Amino Acids and Related Compounds | Leucine | New |
| 215033 | Amino Acids and Related Compounds | Amino Acids and Related Compounds | Lysine | 25% to 210% |
| 215033 | Amino Acids and Related Compounds | Amino Acids and Related Compounds | Serine | 20% to 190% |
| 215033 | Amino Acids and Related Compounds | Amino Acids and Related Compounds | Threonine | 5% to 170% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215047

| Seq ID | Chemical Class | Biochemical Class | Compound Name | Modification |
|---|---|---|---|---|
| 215047 | Amino Acids and Related Compounds | Amino Acids and Related Compounds | Alanine | 160% to 335% |
| 215047 | Amino Acids and Related Compounds | Amino Acids and Related Compounds | Isoleucine | 300% to 430% |
| 215047 | Amino Acids and Related Compounds | Amino Acids and Related Compounds | Leucine | New |
| 215047 | Amino Acids and Related Compounds | Amino Acids and Related Compounds | Phenylalanine | 60% to 240% |
| 215047 | Amino Acids and Related Compounds | Amino Acids and Related Compounds | Tyrosine | 230% to 1250% |
| 215047 | Amino Acids and Related Compounds | Amino Acids and Related Compounds | Valine | 120% to 270% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215055

| Seq ID | Chemical Class | Biochemical Class | Compound Name | Modification |
|---|---|---|---|---|
| 215055 | Acids | Acids | Carbamic acid | 2436% to 4061% |
| 215055 | Acids - Hydroxy Alpha | Acid Pathway | Butanoic acid, 2,3,4-trihydroxy- | 214% to 356% |
| 215055 | Acids - Hydroxy Alpha | Carbohydrates | Glyceric acid | New |
| 215055 | Acids - Hydroxy Alpha | Acid Pathway | Malic acid | 60% to 88% |
| 215055 | Amino Acids and Related Compounds | Amino Acids and Related Compounds | Aspartic acid | NQ |
| 215055 | Carbohydrates | Carbohydrates | F3-U0.770 Carbohydrate | New |
| 215055 | Carbohydrates | Carbohydrates | F3-U0.813 Carbohydrate | 60% to 89% |
| 215055 | Carbohydrates | Carbohydrates | F3-U0.825 Carbohydrate | 89% to 149% |
| 215055 | Carbohydrates | Carbohydrates | F3-U0.846 Carbohydrate | 294% to 489% |
| 215055 | Carbohydrates | Carbohydrates | F3-U0.872 Hexose | 432% to 721% |
| 215055 | Carbohydrates | Carbohydrates | Fructose | 382% to 810% |
| 215055 | Carbohydrates | Carbohydrates | Galactose or Mannose | 135% to 226% |
| 215055 | Carbohydrates | Carbohydrates | Glucose | 485% to 1749% |
| 215055 | NA | NA | F3-U0.736 | New |
| 215055 | NA | NA | F3-U0.882 | 72% to 120% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215059

| Seq ID | Chemical Class | Biochemical Class | Compound Name | Modification |
|---|---|---|---|---|
| 215059 | Amino Acids and Related Compounds | Amino Acids and Related Compounds | Alanine | 30% to 120% |
| 215059 | Amino Acids and Related Compounds | Amino Acids and Related Compounds | Cysteine | 35% to 330% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215066

| Seq ID | Chemical Class | Biochemical Class | Compound Name | Modification |
|--------|----------------|-------------------|---------------|--------------|
| 215066 | Acids - Fatty | Fatty Acids and Related Waxes | Octadecanoic acid | 12% to 24% |
| 215066 | Acids - Fatty Unsat | Fatty Acids and Related Waxes | 9-Octadecenoic acid | 22% to 74% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215074

| Seq ID | Chemical Class | Biochemical Class | Compound Name | Modification |
|---|---|---|---|---|
| 215074 | Acids - Fatty | Fatty Acids and Related Waxes | Hexadecanoic acid | -7% to -16% |
| 215074 | Acids - Fatty | Fatty Acids and Related Waxes | Octadecanoic acid | -5% to -22% |
| 215074 | Acids - Fatty Unsat | Fatty Acids and Related Waxes | 7,10,13-Hexadecatrienoic acid | 16% to 39% |
| 215074 | Acids - Fatty Unsat | Fatty Acids and Related Waxes | 9,12,15-Octadecatrienoic acid | -2% to -7% |
| 215074 | Acids - Fatty Unsat | Fatty Acids and Related Waxes | 9,12-Octadecadienoic acid | 5% to 25% |
| 215074 | Acids - Fatty Unsat | Fatty Acids and Related Waxes | 9-Hexadecenoic acid | 4% to 53% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215084

| Seq ID | Chemical Class | Biochemical Class | Compound Name | Modification |
|---|---|---|---|---|
| 215084 | Acids - Fatty | Fatty Acids and Related Waxes | Eicosanoic acid | -34% to -64% |
| 215084 | Acids - Fatty | Fatty Acids and Related Waxes | Hexadecanoic acid | 12% to 62% |
| 215084 | Acids - Fatty Unsat | Fatty Acids and Related Waxes | 7,10,13-Hexadecatrienoic acid | 20% to 55% |
| 215084 | Acids - Fatty Unsat | Fatty Acids and Related Waxes | 9,12,15-Octadecatrienoic acid | -8% to -12% |
| 215084 | Acids - Fatty Unsat | Fatty Acids and Related Waxes | 9,12-Octadecadienoic acid | -8% to -14% |
| 215084 | Acids - Fatty Unsat | Fatty Acids and Related Waxes | 9-Hexadecenoic acid | -21% to -56% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215087

| Seq ID | Chemical Class | Biochemical Class | Compound Name | Modification |
|---|---|---|---|---|
| 215087 | Acids - Fatty | Fatty Acids and Related Waxes | Eicosanoic acid | -30% to -69% |
| 215087 | Acids - Fatty | Fatty Acids and Related Waxes | Octadecanoic acid | 21% to 31% |
| 215087 | Acids - Fatty Unsat | Fatty Acids and Related Waxes | 7,10,13-Hexadecatrienoic acid | 17% to 41% |
| 215087 | Acids - Fatty Unsat | Fatty Acids and Related Waxes | 9-Octadecenoic acid | 23% to 76% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215090

| Seq ID | Chemical Class | Biochemical Class | Compound Name | Modification |
|---|---|---|---|---|
| 215090 | Amino Acids and Related Compounds | Amino Acids and Related Compounds | Cysteine | 35% to 340% |
| 215090 | Amino Acids and Related Compounds | Amino Acids and Related Compounds | Isoleucine | 20% to 60% |
| 215090 | Amino Acids and Related Compounds | Amino Acids and Related Compounds | Leucine | New |
| 215090 | Amino Acids and Related Compounds | Amino Acids and Related Compounds | Proline | 40% to 240% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215091

| Seq ID | Chemical Class | Biochemical Class | Compound Name | Modification |
|---|---|---|---|---|
| 215091 | Amino Acids and Related Compounds | Amino Acids and Related Compounds | Aspartic acid | 25% to 45% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215095

| Seq ID | Chemical Class | Biochemical Class | Compound Name | Modification |
|---|---|---|---|---|
| 215095 | Acids - Fatty | Fatty Acids and Related Waxes | Octadecanoic acid | 9% to 23% |
| 215095 | Acids - Fatty Branched | Fatty Acids and Related Waxes | Hexadecanoic acid, 14-methyl- | -51% to -58% |
| 215095 | Acids - Fatty Unsat | Fatty Acids and Related Waxes | 7,10,13-Hexadecatrienoic acid | 13% to 39% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215106

| Seq ID | Chemical Class | Biochemical Class | Compound Name | Modification |
|---|---|---|---|---|
| 215106 | Amino Acids and Related Compounds | Amino Acids and Related Compounds | Alanine | 20% to 100% |
| 215106 | Amino Acids and Related Compounds | Amino Acids and Related Compounds | Cysteine | 65% to 445% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215107

| Seq ID | Chemical Class | Biochemical Class | Compound Name | Modification |
|---|---|---|---|---|
| 215107 | Amino Acids and Related Compounds | Amino Acids and Related Compounds | Cysteine | 95% to 540% |
| 215107 | Amino Acids and Related Compounds | Amino Acids and Related Compounds | Isoleucine | 25% to 65% |
| 215107 | Amino Acids and Related Compounds | Amino Acids and Related Compounds | Leucine | New |
| 215107 | Amino Acids and Related Compounds | Amino Acids and Related Compounds | Threonine | 50% to 130% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215117

| Seq ID | Chemical Class | Biochemical Class | Compound Name | Modification |
|---|---|---|---|---|
| 215117 | Acids - Fatty | Fatty Acids and Related Waxes | Octadecanoic acid | 6% to 26% |
| 215117 | Acids - Fatty Unsat | Fatty Acids and Related Waxes | 9,12-Octadecadienoic acid | -12% to -19% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215119

| Seq ID | Chemical Class | Biochemical Class | Compound Name | Modification |
|---|---|---|---|---|
| 215119 | Acids | Acids | Carbamic acid | 653% to 1089% |
| 215119 | Acids - Hydroxy Alpha | Acid Pathway | Butanoic acid, 2,3,4-trihydroxy- | 134% to 223% |
| 215119 | Acids - Hydroxy Alpha | Acid Pathway | Citric acid | 60% to 76% |
| 215119 | Acids - Hydroxy Alpha | Acid Pathway | Malic acid | 408% to 680% |
| 215119 | Alcohols | Carbohydrates | Inositol | 107% to 179% |
| 215119 | Amino Acids and Related Compounds | Amino Acids and Related Compounds | Aspartic acid | New |
| 215119 | Amino Acids and Related Compounds | Amino Acids and Related Compounds | Proline | 60% to 460% |
| 215119 | Amino Acids and Related Compounds | Amino Acids and Related Compounds | Proline, 5-oxo- | New |
| 215119 | Carbohydrates | Carbohydrates | F3-U0.813 Carbohydrate | 180% to 299% |
| 215119 | Carbohydrates | Carbohydrates | F3-U0.821 Carbohydrate | 60% to 76% |
| 215119 | Carbohydrates | Carbohydrates | F3-U0.846 Carbohydrate | 158% to 263% |
| 215119 | Carbohydrates | Carbohydrates | F3-U0.872 Hexose | 271% to 451% |
| 215119 | Carbohydrates | Carbohydrates | Fructose | 492% to 1074% |
| 215119 | Carbohydrates | Carbohydrates | Glucose | 285% to 715% |
| 215119 | NA | NA | F3-U0.727 | New |
| 215119 | NA | NA | F3-U0.751 | New |
| 215119 | NA | NA | F3-U0.882 | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215150

| Seq ID | Chemical Class | Biochemical Class | Compound Name | Modification |
|---|---|---|---|---|
| 215150 | Amino Acids and Related Compounds | Amino Acids and Related Compounds | Arginine | 254% to 475% |
| 215150 | Amino Acids and Related Compounds | Amino Acids and Related Compounds | Aspartic acid | 20% to 60% |
| 215150 | Amino Acids and Related Compounds | Amino Acids and Related Compounds | Glutamic acid | 25% to 95% |
| 215150 | Amino Acids and Related Compounds | Amino Acids and Related Compounds | Proline | 30% to 405% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215163

| Seq ID | Chemical Class | Biochemical Class | Compound Name | Modification |
|---|---|---|---|---|
| 215163 | Acids - Fatty | Fatty Acids and Related Waxes | Hexadecanoic acid | 15% to 66% |
| 215163 | Acids - Fatty | Fatty Acids and Related Waxes | Octadecanoic acid | 10% to 107% |
| 215163 | Acids - Fatty Branched | Fatty Acids and Related Waxes | Hexadecanoic acid, 14-methyl- | -18% to -33% |
| 215163 | Acids - Fatty Unsat | Fatty Acids and Related Waxes | 7,10,13-Hexadecatrienoic acid | 15% to 48% |
| 215163 | Acids - Fatty Unsat | Fatty Acids and Related Waxes | 9,12,15-Octadecatrienoic acid | -3% to -20% |
| 215163 | Acids - Fatty Unsat | Fatty Acids and Related Waxes | 9-Hexadecenoic acid | -11% to -59% |
| 215163 | Acids - Fatty Unsat | Fatty Acids and Related Waxes | 9-Octadecenoic acid | 36% to 175% |
| 215163 | Amino Acids and Related Compounds | Amino Acids and Related Compounds | Cysteine | 10% to 495% |
| 215163 | Amino Acids and Related Compounds | Amino Acids and Related Compounds | Glycine | 40% to 535% |
| 215163 | Amino Acids and Related Compounds | Amino Acids and Related Compounds | Isoleucine | 95% to 1035% |
| 215163 | Amino Acids and Related Compounds | Amino Acids and Related Compounds | Leucine | 55% to 490% |
| 215163 | Amino Acids and Related Compounds | Amino Acids and Related Compounds | Lysine | 30% to 250% |
| 215163 | Amino Acids and Related Compounds | Amino Acids and Related Compounds | Phenylalanine | 15% to 515% |
| 215163 | Amino Acids and Related Compounds | Amino Acids and Related Compounds | Proline | 10% to 550% |
| 215163 | Amino Acids and Related Compounds | Amino Acids and Related Compounds | Serine | 15% to 315% |
| 215163 | Amino Acids and Related Compounds | Amino Acids and Related Compounds | Threonine | 5% to 210% |
| 215163 | Amino Acids and Related Compounds | Amino Acids and Related Compounds | Tyrosine | 85% to 865% |
| 215163 | Amino Acids and Related Compounds | Amino Acids and Related Compounds | Valine | 85% to 1085% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215176

| Seq ID | Chemical Class | Biochemical Class | Compound Name | Modification |
|---|---|---|---|---|
| 215176 | Acids - Fatty | Fatty Acids and Related Waxes | Octadecanoic acid | 3% to 12% |
| 215176 | Acids - Fatty Unsat | Fatty Acids and Related Waxes | 7,10,13-Hexadecatrienoic acid | 16% to 40% |
| 215176 | Acids - Fatty Unsat | Fatty Acids and Related Waxes | 9,12,15-Octadecatrienoic acid | -1% to -5% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215208

| Seq ID | Chemical Class | Biochemical Class | Compound Name | Modification |
|--------|---------------|-------------------|---------------|--------------|
| 215208 | Acids - Fatty | Fatty Acids and Related Waxes | Hexadecanoic acid | 9% to 33% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215211

| Seq ID | Chemical Class | Biochemical Class | Compound Name | Modification |
|---|---|---|---|---|
| 215211 | Acids - Fatty | Fatty Acids and Related Waxes | Hexadecanoic acid | 2% to 10% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215241

| Seq ID | Chemical Class | Biochemical Class | Compound Name | Modification |
|---|---|---|---|---|
| 215241 | Acids - Fatty | Fatty Acids and Related Waxes | Eicosanoic acid | -50% to -78% |
| 215241 | Acids - Fatty | Fatty Acids and Related Waxes | Hexadecanoic acid | 6% to 18% |
| 215241 | Acids - Fatty Unsat | Fatty Acids and Related Waxes | 7,10,13-Hexadecatrienoic acid | 16% to 47% |
| 215241 | Amino Acids and Related Compounds | Amino Acids and Related Compounds | Alanine | 5% to 285% |
| 215241 | Amino Acids and Related Compounds | Amino Acids and Related Compounds | Cysteine | 5% to 710% |
| 215241 | Amino Acids and Related Compounds | Amino Acids and Related Compounds | Glutamic acid | 5% to 95% |
| 215241 | Amino Acids and Related Compounds | Amino Acids and Related Compounds | Glycine | 15% to 570% |
| 215241 | Amino Acids and Related Compounds | Amino Acids and Related Compounds | Phenylalanine | 10% to 95% |
| 215241 | Amino Acids and Related Compounds | Amino Acids and Related Compounds | Tyrosine | 5% to 135% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215244

| Seq ID | Chemical Class | Biochemical Class | Compound Name | Modification |
|---|---|---|---|---|
| 215244 | Acids | Acids | Carbamic acid | 1358% to 22263% |
| 215244 | Acids - Fatty Unsat | Fatty Acids and Related Waxes | 9-Octadecenoic acid | 60% to 246% |
| 215244 | Acids - Hydroxy Alpha | Acid Pathway | Citric acid | 336% to 560% |
| 215244 | Acids - Hydroxy Alpha | Acid Pathway | Malic acid | 60% to 96% |
| 215244 | Amino Acids and Related Compounds | Amino Acids and Related Compounds | Alanine | 230% to 5650% |
| 215244 | Amino Acids and Related Compounds | Amino Acids and Related Compounds | Arginine | 60% to 370% |
| 215244 | Amino Acids and Related Compounds | Amino Acids and Related Compounds | Cysteine | 60% to 3370% |
| 215244 | Amino Acids and Related Compounds | Amino Acids and Related Compounds | Glycine | 60% to 2375% |
| 215244 | Amino Acids and Related Compounds | Amino Acids and Related Compounds | Isoleucine | 110% to 600% |
| 215244 | Amino Acids and Related Compounds | Amino Acids and Related Compounds | Leucine | 60% to 925% |
| 215244 | Amino Acids and Related Compounds | Amino Acids and Related Compounds | Lysine | 60% to 400% |
| 215244 | Amino Acids and Related Compounds | Amino Acids and Related Compounds | Phenylalanine | 60% to 350% |
| 215244 | Amino Acids and Related Compounds | Amino Acids and Related Compounds | Proline, 5-oxo- | 389% to 649% |
| 215244 | Amino Acids and Related Compounds | Amino Acids and Related Compounds | Serine | 100% to 270% |
| 215244 | Amino Acids and Related Compounds | Amino Acids and Related Compounds | Threonine | 60% to 190% |
| 215244 | Amino Acids and Related Compounds | Amino Acids and Related Compounds | Tyrosine | New |
| 215244 | Amino Acids and Related Compounds | Amino Acids and Related Compounds | Valine | 80% to 530% |
| 215244 | Carbohydrates | Carbohydrates | F3-U0.813 Carbohydrate | 400% to 667% |
| 215244 | Carbohydrates | Carbohydrates | F3-U0.816 Carbohydrate | 101% to 169% |
| 215244 | Carbohydrates | Carbohydrates | Fructose | -60% to -88% |
| 215244 | Carbohydrates | Carbohydrates | Glucose | -60% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215249

| Seq ID | Chemical Class | Biochemical Class | Compound Name | Modification |
|---|---|---|---|---|
| 215249 | Acids - Fatty | Fatty Acids and Related Waxes | Hexadecanoic acid | 2% to 11% |
| 215249 | Acids - Fatty Unsat | Fatty Acids and Related Waxes | 9,12,15-Octadecatrienoic acid | -1% to -5% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215258

| Seq ID | Chemical Class | Biochemical Class | Compound Name | Modification |
|---|---|---|---|---|
| 215258 | Amino Acids and Related Compounds | Amino Acids and Related Compounds | Alanine | 30% to 115% |
| 215258 | Amino Acids and Related Compounds | Amino Acids and Related Compounds | Arginine | 180% to 630% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215259

| Seq ID | Chemical Class | Biochemical Class | Compound Name | Modification |
|---|---|---|---|---|
| 215259 | Acids - Fatty | Fatty Acids and Related Waxes | Eicosanoic acid | 6% to 81% |
| 215259 | Acids - Fatty | Fatty Acids and Related Waxes | Hexadecanoic acid | 3% to 13% |
| 215259 | Acids - Fatty | Fatty Acids and Related Waxes | Octadecanoic acid | 4% to 37% |
| 215259 | Acids - Fatty Unsat | Fatty Acids and Related Waxes | 7,10,13-Hexadecatrienoic acid | 9% to 43% |
| 215259 | Acids - Fatty Unsat | Fatty Acids and Related Waxes | 9,12,15-Octadecatrienoic acid | 1% to 7% |
| 215259 | Acids - Fatty Unsat | Fatty Acids and Related Waxes | 9,12-Octadecadienoic acid | -8% to -29% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215270

| Seq ID | Chemical Class | Biochemical Class | Compound Name | Modification |
|---|---|---|---|---|
| 215270 | Amino Acids and Related Compounds | Amino Acids and Related Compounds | Glutamic acid | 25% to 135% |
| 215270 | Amino Acids and Related Compounds | Amino Acids and Related Compounds | Glycine | 25% to 960% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215283

| Seq ID | Chemical Class | Biochemical Class | Compound Name | Modification |
|---|---|---|---|---|
| 215283 | Acids | Acids | Carbamic acid | 126% to 4739% |
| 215283 | Acids - Hydroxy Alpha | Acid Pathway | Butanoic acid, 2,3,4-trihydroxy- | 193% to 322% |
| 215283 | Acids - Hydroxy Alpha | Acid Pathway | Malic acid | 154% to 257% |
| 215283 | Acids - Hydroxy Alpha | Carbohydrates | Quinic acid | 68% to 326% |
| 215283 | Alcohols | Carbohydrates | Inositol | 244% to 407% |
| 215283 | Amino Acids and Related Compounds | Amino Acids and Related Compounds | Aspartic acid | NQ |
| 215283 | Amino Acids and Related Compounds | Amino Acids and Related Compounds | Proline, 5-oxo- | NQ |
| 215283 | Carbohydrates | Carbohydrates | F3-U0.744 Carbohydrate | 473% to 788% |
| 215283 | Carbohydrates | Carbohydrates | F3-U0.781 Carbohydrate | New |
| 215283 | Carbohydrates | Carbohydrates | F3-U0.813 Carbohydrate | New |
| 215283 | Carbohydrates | Carbohydrates | F3-U0.816 Carbohydrate | New |
| 215283 | Carbohydrates | Carbohydrates | F3-U0.821 Carbohydrate | 123% to 205% |
| 215283 | Carbohydrates | Carbohydrates | F3-U0.825 Carbohydrate | New |
| 215283 | Carbohydrates | Carbohydrates | F3-U0.846 Carbohydrate | 513% to 4763% |
| 215283 | Carbohydrates | Carbohydrates | F3-U0.872 Hexose | 353% to 2706% |
| 215283 | Carbohydrates | Carbohydrates | F3-U1.060 Carbohydrate | New |
| 215283 | Carbohydrates | Carbohydrates | F3-U1.065 Carbohydrate | New |
| 215283 | Carbohydrates | Carbohydrates | F3-U1.113 Carbohydrate | NQ |
| 215283 | Carbohydrates | Carbohydrates | Fructose | 350% to 848% |
| 215283 | Carbohydrates | Carbohydrates | Galactose | 543% to 905% |
| 215283 | Carbohydrates | Carbohydrates | Glucose | 383% to 968% |
| 215283 | Carbohydrates | Carbohydrates | Sucrose | 62% to 103% |
| 215283 | NA | NA | F3-U0.709 | New |
| 215283 | NA | NA | F3-U0.727 | NQ |
| 215283 | NA | NA | F3-U0.852A | New |
| 215283 | NA | NA | F3-U0.882 | NQ |
| 215283 | NA | NA | F3-U1.080 | New |
| 215283 | NA | NA | F3-U1.096 | New |
| 215283 | NA | NA | F3-U1.172 | New |
| 215283 | Phenols and Related Compounds | Phenylpropanes and Derivatives | Chlorogenic acid | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215293

| Seq ID | Chemical Class | Biochemical Class | Compound Name | Modification |
|---|---|---|---|---|
| 215293 | Acids - Fatty | Fatty Acids and Related Waxes | Hexadecanoic acid | 5% to 11% |
| 215293 | Acids - Fatty Unsat | Fatty Acids and Related Waxes | 9,12,15-Octadecatrienoic acid | -5% to -9% |
| 215293 | Acids - Fatty Unsat | Fatty Acids and Related Waxes | 9-Octadecenoic acid | 42% to 153% |
| 215293 | Amino Acids and Related Compounds | Amino Acids and Related Compounds | Glycine | 65% to 750% |
| 215293 | Amino Acids and Related Compounds | Amino Acids and Related Compounds | Phenylalanine | 5% to 390% |
| 215293 | Amino Acids and Related Compounds | Amino Acids and Related Compounds | Threonine | 30% to 215% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215296

| Seq ID | Chemical Class | Biochemical Class | Compound Name | Modification |
|---|---|---|---|---|
| 215296 | Amino Acids and Related Compounds | Amino Acids and Related Compounds | Alanine | 25% to 265% |
| 215296 | Amino Acids and Related Compounds | Amino Acids and Related Compounds | Cysteine | 5% to 2860% |
| 215296 | Amino Acids and Related Compounds | Amino Acids and Related Compounds | Glycine | 5% to 1860% |
| 215296 | Amino Acids and Related Compounds | Amino Acids and Related Compounds | Leucine | 40% to 140% |
| 215296 | Amino Acids and Related Compounds | Amino Acids and Related Compounds | Lysine | 45% to 755% |
| 215296 | Amino Acids and Related Compounds | Amino Acids and Related Compounds | Phenylalanine | 5% to 290% |
| 215296 | Amino Acids and Related Compounds | Amino Acids and Related Compounds | Serine | 40% to 155% |
| 215296 | Amino Acids and Related Compounds | Amino Acids and Related Compounds | Threonine | 30% to 115% |
| 215296 | Amino Acids and Related Compounds | Amino Acids and Related Compounds | Tyrosine | New |
| 215296 | Amino Acids and Related Compounds | Amino Acids and Related Compounds | Valine | 25% to 285% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215303

| Seq ID | Chemical Class | Biochemical Class | Compound Name | Modification |
|---|---|---|---|---|
| 215303 | Acids - Fatty | Fatty Acids and Related Waxes | Hexadecanoic acid | 6% to 13% |
| 215303 | Acids - Fatty | Fatty Acids and Related Waxes | Octadecanoic acid | 14% to 52% |
| 215303 | Acids - Fatty Unsat | Fatty Acids and Related Waxes | 7,10,13-Hexadecatrienoic acid | 16% to 31% |
| 215303 | Acids - Fatty Unsat | Fatty Acids and Related Waxes | 9,12,15-Octadecatrienoic acid | -4% to -9% |
| 215303 | Acids - Fatty Unsat | Fatty Acids and Related Waxes | 9-Octadecenoic acid | 24% to 122% |
| 215303 | Amino Acids and Related Compounds | Amino Acids and Related Compounds | Arginine | 50% to 350% |
| 215303 | Amino Acids and Related Compounds | Amino Acids and Related Compounds | Cysteine | 5% to 6550% |
| 215303 | Amino Acids and Related Compounds | Amino Acids and Related Compounds | Glutamic acid | 5% to 65% |
| 215303 | Amino Acids and Related Compounds | Amino Acids and Related Compounds | Glycine | 5% to 3920% |
| 215303 | Amino Acids and Related Compounds | Amino Acids and Related Compounds | Leucine | 40% to 140% |
| 215303 | Amino Acids and Related Compounds | Amino Acids and Related Compounds | Lysine | 15% to 400% |
| 215303 | Amino Acids and Related Compounds | Amino Acids and Related Compounds | Phenylalanine | 5% to 290% |
| 215303 | Amino Acids and Related Compounds | Amino Acids and Related Compounds | Serine | 45% to 380% |
| 215303 | Amino Acids and Related Compounds | Amino Acids and Related Compounds | Tyrosine | New |
| 215303 | Amino Acids and Related Compounds | Amino Acids and Related Compounds | Valine | 25% to 285% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215309

| Seq ID | Chemical Class | Biochemical Class | Compound Name | Modification |
|---|---|---|---|---|
| 215309 | Amino Acids and Related Compounds | Amino Acids and Related Compounds | Alanine | 100% to 270% |
| 215309 | Amino Acids and Related Compounds | Amino Acids and Related Compounds | Arginine | 185% to 745% |
| 215309 | Amino Acids and Related Compounds | Amino Acids and Related Compounds | Aspartic acid | 10% to 95% |
| 215309 | Amino Acids and Related Compounds | Amino Acids and Related Compounds | Glutamic acid | 20% to 70% |
| 215309 | Amino Acids and Related Compounds | Amino Acids and Related Compounds | Histidine | 20% to 255% |
| 215309 | Amino Acids and Related Compounds | Amino Acids and Related Compounds | Lysine | 75% to 595% |
| 215309 | Amino Acids and Related Compounds | Amino Acids and Related Compounds | Methionine | 5% to 850% |
| 215309 | Amino Acids and Related Compounds | Amino Acids and Related Compounds | Proline | 210% to 480% |
| 215309 | Amino Acids and Related Compounds | Amino Acids and Related Compounds | Serine | 205% to 380% |
| 215309 | Amino Acids and Related Compounds | Amino Acids and Related Compounds | Threonine | 15% to 575% |
| 215309 | Amino Acids and Related Compounds | Amino Acids and Related Compounds | Tyrosine | New |
| 215309 | Amino Acids and Related Compounds | Amino Acids and Related Compounds | Valine | 740% to 1675% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215325

| Seq ID | Chemical Class | Biochemical Class | Compound Name | Modification |
|---|---|---|---|---|
| 215325 | Amino Acids and Related Compounds | Amino Acids and Related Compounds | Alanine | 35% to 150% |
| 215325 | Amino Acids and Related Compounds | Amino Acids and Related Compounds | Cysteine | 10% to 390% |
| 215325 | Amino Acids and Related Compounds | Amino Acids and Related Compounds | Glycine | 30% to 300% |
| 215325 | Amino Acids and Related Compounds | Amino Acids and Related Compounds | Tryptophan | 195% to 320% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215331

| Seq ID | Chemical Class | Biochemical Class | Compound Name | Modification |
|---|---|---|---|---|
| 215331 | Amino Acids and Related Compounds | Amino Acids and Related Compounds | Alanine | 90% to 760% |
| 215331 | Amino Acids and Related Compounds | Amino Acids and Related Compounds | Glycine | 20% to 265% |
| 215331 | Amino Acids and Related Compounds | Amino Acids and Related Compounds | Serine | 25% to 130% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215347

| Seq ID | Chemical Class | Biochemical Class | Compound Name | Modification |
|---|---|---|---|---|
| 215347 | Amino Acids and Related Compounds | Amino Acids and Related Compounds | Isoleucine | 75% to 880% |
| 215347 | Amino Acids and Related Compounds | Amino Acids and Related Compounds | Leucine | 85% to 500% |
| 215347 | Amino Acids and Related Compounds | Amino Acids and Related Compounds | Methionine | 45% to 220% |
| 215347 | Amino Acids and Related Compounds | Amino Acids and Related Compounds | Phenylalanine | 30% to 305% |
| 215347 | Amino Acids and Related Compounds | Amino Acids and Related Compounds | Threonine | 40% to 190% |
| 215347 | Amino Acids and Related Compounds | Amino Acids and Related Compounds | Valine | 90% to 415% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215372

| Seq ID | Chemical Class | Biochemical Class | Compound Name | Modification |
|---|---|---|---|---|
| 215372 | Acids - Fatty | Fatty Acids and Related Waxes | Eicosanoic acid | -25% to -52% |
| 215372 | Acids - Fatty | Fatty Acids and Related Waxes | Octadecanoic acid | 44% to 91% |
| 215372 | Acids - Fatty Branched | Fatty Acids and Related Waxes | Hexadecanoic acid, 14-methyl- | 57% to 103% |
| 215372 | Acids - Fatty Unsat | Fatty Acids and Related Waxes | 7,10,13-Hexadecatrienoic acid | 12% to 52% |
| 215372 | Acids - Fatty Unsat | Fatty Acids and Related Waxes | 9,12,15-Octadecatrienoic acid | -4% to -12% |
| 215372 | Acids - Fatty Unsat | Fatty Acids and Related Waxes | 9-Hexadecenoic acid | 8% to 18% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215373

| Seq ID | Chemical Class | Biochemical Class | Compound Name | Modification |
|---|---|---|---|---|
| 215373 | Acids - Hydroxy Alpha | Acid Pathway | Butanoic acid, 2,3,4-trihydroxy- | 130% to 216% |
| 215373 | Acids - Hydroxy Alpha | Acid Pathway | Citric acid | 919% to 1532% |
| 215373 | Acids - Keto | Acid Pathway | 2-Ketoglutaric acid | New |
| 215373 | Amino Acids and Related Compounds | Amino Acids and Related Compounds | Alanine | 60% to 2350% |
| 215373 | Amino Acids and Related Compounds | Amino Acids and Related Compounds | Arginine | 310% to 850% |
| 215373 | Amino Acids and Related Compounds | Amino Acids and Related Compounds | Cysteine | 75% to 12000% |
| 215373 | Amino Acids and Related Compounds | Amino Acids and Related Compounds | Glutamic acid | 60% to 140% |
| 215373 | Amino Acids and Related Compounds | Amino Acids and Related Compounds | Glycine | 60% to 7900% |
| 215373 | Amino Acids and Related Compounds | Amino Acids and Related Compounds | Isoleucine | 130% to 865% |
| 215373 | Amino Acids and Related Compounds | Amino Acids and Related Compounds | Leucine | 425% to 1330% |
| 215373 | Amino Acids and Related Compounds | Amino Acids and Related Compounds | Methionine | New |
| 215373 | Amino Acids and Related Compounds | Amino Acids and Related Compounds | Phenylalanine | 120% to 605% |
| 215373 | Amino Acids and Related Compounds | Amino Acids and Related Compounds | Serine | 110% to 415% |
| 215373 | Amino Acids and Related Compounds | Amino Acids and Related Compounds | Threonine | 60% to 2560% |
| 215373 | Amino Acids and Related Compounds | Amino Acids and Related Compounds | Tyrosine | New |
| 215373 | Amino Acids and Related Compounds | Amino Acids and Related Compounds | Valine | 60% to 910% |
| 215373 | Carbohydrates | Carbohydrates | F3-U0.813 Carbohydrate | 108% to 180% |
| 215373 | Carbohydrates | Carbohydrates | F3-U0.816 Carbohydrate | 86% to 143% |
| 215373 | Carbohydrates | Carbohydrates | F3-U0.821 Carbohydrate | 919% to 1532% |
| 215373 | Carbohydrates | Carbohydrates | F3-U0.846 Carbohydrate | 107% to 178% |
| 215373 | Carbohydrates | Carbohydrates | F3-U0.872 Hexose | 60% to 91% |
| 215373 | Carbohydrates | Carbohydrates | Fructose | -61% to -100% |
| 215373 | NA | NA | F3-U0.727 | 60% to 90% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215379

| Seq ID | Chemical Class | Biochemical Class | Compound Name | Modification |
|---|---|---|---|---|
| 215379 | Acids - Fatty Unsat | Fatty Acids and Related Waxes | 9,12-Octadecadienoic acid | 15% to 38% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215382

| Seq ID | Chemical Class | Biochemical Class | Compound Name | Modification |
|---|---|---|---|---|
| 215382 | Acids - Fatty | Fatty Acids and Related Waxes | Hexadecanoic acid | 4% to 29% |
| 215382 | Acids - Fatty | Fatty Acids and Related Waxes | Octadecanoic acid | 117% to 180% |
| 215382 | Acids - Fatty Unsat | Fatty Acids and Related Waxes | 9,12,15-Octadecatrienoic acid | -6% to -10% |
| 215382 | Acids - Fatty Unsat | Fatty Acids and Related Waxes | 9,12-Octadecadienoic acid | 9% to 34% |
| 215382 | Acids - Fatty Unsat | Fatty Acids and Related Waxes | 9-Hexadecenoic acid | -10% to -18% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215405

| Seq ID | Chemical Class | Biochemical Class | Compound Name | Modification |
|---|---|---|---|---|
| 215405 | Amino Acids and Related Compounds | Amino Acids and Related Compounds | Alanine | 35% to 150% |
| 215405 | Amino Acids and Related Compounds | Amino Acids and Related Compounds | Aspartic acid | NQ |
| 215405 | Amino Acids and Related Compounds | Amino Acids and Related Compounds | Cysteine | 400% to 2130% |
| 215405 | Amino Acids and Related Compounds | Amino Acids and Related Compounds | Glycine | 350% to 1300% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215431

| Seq ID | Chemical Class | Biochemical Class | Compound Name | Modification |
|---|---|---|---|---|
| 215431 | Hydrocarbons | Hydrocarbons | Nonacosane, 3-methyl | 91% to 151% |
| 215431 | NA | NA | F1-U1.053 | 288% to 480% |
| 215431 | Sterols, Oxygenated Terpenes, and Other Isoprenoids | Prenylquinones | alpha-Tocopherol hydroquinone | 105% to 367% |
| 215431 | Sterols, Oxygenated Terpenes, and Other Isoprenoids | Terpenoids | beta-Sitosterol | 81% to 366% |
| 215431 | Sterols, Oxygenated Terpenes, and Other Isoprenoids | Terpenoids | Campesterol | 62% to 103% |
| 215431 | Sterols, Oxygenated Terpenes, and Other Isoprenoids | Terpenoids | Cholesterol | 82% to 137% |
| 215431 | Sterols, Oxygenated Terpenes, and Other Isoprenoids | Terpenoids | Fucosterol | 80% to 134% |
| 215431 | Sterols, Oxygenated Terpenes, and Other Isoprenoids | Terpenoids | Stigmasterol | 62% to 104% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#215477

| Seq ID | Chemical Class | Biochemical Class | Compound Name | Modification |
|---|---|---|---|---|
| 215477 | Acids - Fatty Unsat | Fatty Acids and Related Waxes | 7,10,13-Hexadecatrienoic acid | 11% to 24% |
| 215477 | Acids - Fatty Unsat | Fatty Acids and Related Waxes | 9,12,15-Octadecatrienoic acid | 3% to 11% |
| 215477 | Acids - Fatty Unsat | Fatty Acids and Related Waxes | 9,12-Octadecadienoic acid | -16% to -30% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215480

| Seq ID | Chemical Class | Biochemical Class | Compound Name | Modification |
|---|---|---|---|---|
| 215480 | Acids | Acids | Carbamic acid | 90% to 151% |
| 215480 | Carbohydrates | Carbohydrates | F3-U0.846 Carbohydrate | 95% to 158% |
| 215480 | Carbohydrates | Carbohydrates | Fructose | -65% to -100% |
| 215480 | Carbohydrates | Carbohydrates | Glucose | -67% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215528

| Seq ID | Chemical Class | Biochemical Class | Compound Name | Modification |
|---|---|---|---|---|
| 215528 | Amino Acids and Related Compounds | Amino Acids and Related Compounds | Alanine | 30% to 115% |
| 215528 | Amino Acids and Related Compounds | Amino Acids and Related Compounds | Arginine | 180% to 630% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215538

| Seq ID | Chemical Class | Biochemical Class | Compound Name | Modification |
|---|---|---|---|---|
| 215538 | Amino Acids and Related Compounds | Amino Acids and Related Compounds | Methionine | 52% to 95% |
| 215538 | Amino Acids and Related Compounds | Amino Acids and Related Compounds | Phenylalanine | 65% to 560% |
| 215538 | Amino Acids and Related Compounds | Amino Acids and Related Compounds | Proline | NQ |
| 215538 | Amino Acids and Related Compounds | Amino Acids and Related Compounds | Serine | NQ |
| 215538 | Amino Acids and Related Compounds | Amino Acids and Related Compounds | Threonine | 3% to 205% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215552

| Seq ID | Chemical Class | Biochemical Class | Compound Name | Modification |
|---|---|---|---|---|
| 215552 | Amino Acids and Related Compounds | Amino Acids and Related Compounds | Alanine | 245% to 610% |
| 215552 | Amino Acids and Related Compounds | Amino Acids and Related Compounds | Cysteine | 210% to 1065% |
| 215552 | Amino Acids and Related Compounds | Amino Acids and Related Compounds | Phenylalanine | 60% to 210% |
| 215552 | Amino Acids and Related Compounds | Amino Acids and Related Compounds | Serine | 30% to 320% |
| 215552 | Amino Acids and Related Compounds | Amino Acids and Related Compounds | Valine | 55% to 240% |

FIG. 6 continued

A list of metabolite compounds present in altered levels relative to reference samples as chararcterized by gas chromatography, liquid chromatography, and/or mass spectrometry. This list corresponds to samples transfected with nucleic acid sequence, Seq ID#215570

| Seq ID | Chemical Class | Biochemical Class | Compound Name | Modification |
|---|---|---|---|---|
| 215570 | Acids - Fatty Unsat | Fatty Acids and Related Waxes | 7,10,13-Hexadecatrienoic acid | 9% to 63% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215575

| Seq ID | Chemical Class | Biochemical Class | Compound Name | Modification |
|---|---|---|---|---|
| 215575 | Amino Acids and Related Compounds | Amino Acids and Related Compounds | Alanine | 230% to 585% |
| 215575 | Amino Acids and Related Compounds | Amino Acids and Related Compounds | Cysteine | 230% to 1140% |
| 215575 | Amino Acids and Related Compounds | Amino Acids and Related Compounds | Glycine | 135% to 1525% |
| 215575 | Amino Acids and Related Compounds | Amino Acids and Related Compounds | Leucine | 55% to 205% |
| 215575 | Amino Acids and Related Compounds | Amino Acids and Related Compounds | Valine | 35% to 185% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215579

| Seq ID | Chemical Class | Biochemical Class | Compound Name | Modification |
|---|---|---|---|---|
| 215579 | Amino Acids and Related Compounds | Amino Acids and Related Compounds | Alanine | 10% to 245% |
| 215579 | Amino Acids and Related Compounds | Amino Acids and Related Compounds | Cysteine | 80% to 1090% |
| 215579 | Amino Acids and Related Compounds | Amino Acids and Related Compounds | Glycine | 60% to 935% |
| 215579 | Amino Acids and Related Compounds | Amino Acids and Related Compounds | Serine | 80% to 185% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215586

| Seq ID | Chemical Class | Biochemical Class | Compound Name | Modification |
|---|---|---|---|---|
| 215586 | Amino Acids and Related Compounds | Amino Acids and Related Compounds | Alanine | 25% to 110% |
| 215586 | Amino Acids and Related Compounds | Amino Acids and Related Compounds | Cysteine | 2% to 690% |
| 215586 | Amino Acids and Related Compounds | Amino Acids and Related Compounds | Glycine | 15% to 640% |
| 215586 | Amino Acids and Related Compounds | Amino Acids and Related Compounds | Phenylalanine | 50% to 165% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215595

| Seq ID | Chemical Class | Biochemical Class | Compound Name | Modification |
|---|---|---|---|---|
| 215595 | Hydrocarbons | Hydrocarbons | 2,3-Dinonylanthracene | 154% to 257% |
| 215595 | Sterols, Oxygenated Terpenes, and Other Isoprenoids | Prenylquinones | alpha-Tocopherol | 180% to 300% |
| 215595 | Sterols, Oxygenated Terpenes, and Other Isoprenoids | Prenylquinones | alpha-Tocopherol hydroquinone | New |
| 215595 | Sterols, Oxygenated Terpenes, and Other Isoprenoids | Terpenoids | beta-Sitosterol | 141% to 235% |
| 215595 | Sterols, Oxygenated Terpenes, and Other Isoprenoids | Prenylquinones | beta-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215608

| Seq ID | Chemical Class | Biochemical Class | Compound Name | Modification |
|---|---|---|---|---|
| 215608 | Amino Acids and Related Compounds | Amino Acids and Related Compounds | Arginine | 35% to 320% |
| 215608 | Amino Acids and Related Compounds | Amino Acids and Related Compounds | Serine | 25% to 95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215610

| Seq ID | Chemical Class | Biochemical Class | Compound Name | Modification |
|---|---|---|---|---|
| 215610 | Amino Acids and Related Compounds | Amino Acids and Related Compounds | Alanine | 20% to 110% |
| 215610 | Amino Acids and Related Compounds | Amino Acids and Related Compounds | Arginine | 130% to 625% |
| 215610 | Amino Acids and Related Compounds | Amino Acids and Related Compounds | Cysteine | 15% to 650% |
| 215610 | Amino Acids and Related Compounds | Amino Acids and Related Compounds | Glycine | 5% to 55% |
| 215610 | Amino Acids and Related Compounds | Amino Acids and Related Compounds | Phenylalanine | 50% to 165% |
| 215610 | Amino Acids and Related Compounds | Amino Acids and Related Compounds | Serine | 30% to 105% |
| 215610 | Amino Acids and Related Compounds | Amino Acids and Related Compounds | Threonine | 30% to 95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215611

| Seq ID | Chemical Class | Biochemical Class | Compound Name | Modification |
|---|---|---|---|---|
| 215611 | Acids - Fatty | Fatty Acids and Related Waxes | Eicosanoic acid | -35% to -62% |
| 215611 | Acids - Fatty | Fatty Acids and Related Waxes | Octadecanoic acid | -9% to -27% |
| 215611 | Acids - Fatty Unsat | Fatty Acids and Related Waxes | 9,12,15-Octadecatrienoic acid | 2% to 8% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215629

| Seq ID | Chemical Class | Biochemical Class | Compound Name | Modification |
|---|---|---|---|---|
| 215629 | Acids - Fatty | Fatty Acids and Related Waxes | Eicosanoic acid | -88% to -100% |
| 215629 | Acids - Fatty | Fatty Acids and Related Waxes | Hexadecanoic acid | 2% to 12% |
| 215629 | Acids - Fatty Unsat | Fatty Acids and Related Waxes | 7,10,13-Hexadecatrienoic acid | 9% to 24% |
| 215629 | Acids - Fatty Unsat | Fatty Acids and Related Waxes | 9,12,15-Octadecatrienoic acid | -3% to -10% |
| 215629 | Acids - Fatty Unsat | Fatty Acids and Related Waxes | 9,12-Octadecadienoic acid | 6% to 29% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215642

| Seq ID | Chemical Class | Biochemical Class | Compound Name | Modification |
|---|---|---|---|---|
| 215642 | Acids - Fatty | Fatty Acids and Related Waxes | Octadecanoic acid | 9% to 73% |
| 215642 | Acids - Fatty Unsat | Fatty Acids and Related Waxes | 9,12,15-Octadecatrienoic acid | -3% to -9% |
| 215642 | Acids - Fatty Unsat | Fatty Acids and Related Waxes | 9,12-Octadecadienoic acid | 14% to 39% |
| 215642 | Amino Acids and Related Compounds | Amino Acids and Related Compounds | Alanine | 25% to 155% |
| 215642 | Amino Acids and Related Compounds | Amino Acids and Related Compounds | Aspartic acid | 25% to 65% |
| 215642 | Amino Acids and Related Compounds | Amino Acids and Related Compounds | Cysteine | 145% to 815% |
| 215642 | Amino Acids and Related Compounds | Amino Acids and Related Compounds | Glycine | 75% to 1100% |
| 215642 | Amino Acids and Related Compounds | Amino Acids and Related Compounds | Isoleucine | 35% to 490% |
| 215642 | Amino Acids and Related Compounds | Amino Acids and Related Compounds | Leucine | 45% to 185% |
| 215642 | Amino Acids and Related Compounds | Amino Acids and Related Compounds | Phenylalanine | 70% to 220% |
| 215642 | Amino Acids and Related Compounds | Amino Acids and Related Compounds | Serine | 25% to 300% |
| 215642 | Amino Acids and Related Compounds | Amino Acids and Related Compounds | Threonine | 85% to 270% |
| 215642 | Amino Acids and Related Compounds | Amino Acids and Related Compounds | Valine | 85% to 295% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215667

| Seq ID | Chemical Class | Biochemical Class | Compound Name | Modification |
|---|---|---|---|---|
| 215667 | Amino Acids and Related Compounds | Amino Acids and Related Compounds | Arginine | 160% to 725% |
| 215667 | Amino Acids and Related Compounds | Amino Acids and Related Compounds | Aspartic acid | 30% to 90% |
| 215667 | Amino Acids and Related Compounds | Amino Acids and Related Compounds | Cysteine | 10% to 620% |
| 215667 | Amino Acids and Related Compounds | Amino Acids and Related Compounds | Glycine | 10% to 610% |
| 215667 | Amino Acids and Related Compounds | Amino Acids and Related Compounds | Phenylalanine | 50% to 160% |
| 215667 | Amino Acids and Related Compounds | Amino Acids and Related Compounds | Serine | 30% to 105% |
| 215667 | Amino Acids and Related Compounds | Amino Acids and Related Compounds | Threonine | 45% to 160% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215672

| Seq ID | Chemical Class | Biochemical Class | Compound Name | Modification |
|---|---|---|---|---|
| 215672 | Amino Acids and Related Compounds | Amino Acids and Related Compounds | Isoleucine | 45% to 545% |
| 215672 | Amino Acids and Related Compounds | Amino Acids and Related Compounds | Leucine | 45% to 185% |
| 215672 | Amino Acids and Related Compounds | Amino Acids and Related Compounds | Phenylalanine | 75% to 230% |
| 215672 | Amino Acids and Related Compounds | Amino Acids and Related Compounds | Valine | 60% to 240% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215678

| Seq ID | Chemical Class | Biochemical Class | Compound Name | Modification |
|---|---|---|---|---|
| 215678 | Amino Acids and Related Compounds | Amino Acids and Related Compounds | Cysteine | 70% to 525% |
| 215678 | Amino Acids and Related Compounds | Amino Acids and Related Compounds | Glycine | 5% to 610% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215679

| Seq ID | Chemical Class | Biochemical Class | Compound Name | Modification |
|---|---|---|---|---|
| 215679 | Amino Acids and Related Compounds | Amino Acids and Related Compounds | Glutamic acid | 5% to 70% |
| 215679 | Amino Acids and Related Compounds | Amino Acids and Related Compounds | Lysine | 25% to 170% |
| 215679 | Amino Acids and Related Compounds | Amino Acids and Related Compounds | Phenylalanine | 30% to 125% |
| 215679 | Amino Acids and Related Compounds | Amino Acids and Related Compounds | Threonine | 30% to 100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215680

| Seq ID | Chemical Class | Biochemical Class | Compound Name | Modification |
|---|---|---|---|---|
| 215680 | Amino Acids and Related Compounds | Amino Acids and Related Compounds | Arginine | 40% to 350% |
| 215680 | Amino Acids and Related Compounds | Amino Acids and Related Compounds | Glutamic acid | 10% to 85% |
| 215680 | Amino Acids and Related Compounds | Amino Acids and Related Compounds | Methionine | 30% to 310% |
| 215680 | Amino Acids and Related Compounds | Amino Acids and Related Compounds | Phenylalanine | 35% to 520% |
| 215680 | Amino Acids and Related Compounds | Amino Acids and Related Compounds | Proline | 5% to 315% |
| 215680 | Amino Acids and Related Compounds | Amino Acids and Related Compounds | Threonine | 35% to 225% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215685

| Seq ID | Chemical Class | Biochemical Class | Compound Name | Modification |
|---|---|---|---|---|
| 215685 | Amino Acids and Related Compounds | Amino Acids and Related Compounds | Cysteine | 145% to 815% |
| 215685 | Amino Acids and Related Compounds | Amino Acids and Related Compounds | Glycine | 45% to 895% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215691

| Seq ID | Chemical Class | Biochemical Class | Compound Name | Modification |
|---|---|---|---|---|
| 215691 | Acids - Fatty | Fatty Acids and Related Waxes | Hexadecanoic acid | 14% to 40% |
| 215691 | Acids - Fatty | Fatty Acids and Related Waxes | Octadecanoic acid | 292% to 402% |
| 215691 | Acids - Fatty Branched | Fatty Acids and Related Waxes | Hexadecanoic acid, 14-methyl- | -49% to -69% |
| 215691 | Acids - Fatty Unsat | Fatty Acids and Related Waxes | 7,10,13-Hexadecatrienoic acid | -44% to -65% |
| 215691 | Acids - Fatty Unsat | Fatty Acids and Related Waxes | 9,12,15-Octadecatrienoic acid | -20% to -29% |
| 215691 | Acids - Fatty Unsat | Fatty Acids and Related Waxes | 9,12-Octadecadienoic acid | 38% to 88% |
| 215691 | Acids - Fatty Unsat | Fatty Acids and Related Waxes | 9-Hexadecenoic acid | -42% to -73% |
| 215691 | Acids - Fatty Unsat | Fatty Acids and Related Waxes | 9-Octadecenoic acid | 29% to 166% |
| 215691 | Amino Acids and Related Compounds | Amino Acids and Related Compounds | Alanine | 35% to 130% |
| 215691 | Amino Acids and Related Compounds | Amino Acids and Related Compounds | Arginine | 375% to 1400% |
| 215691 | Amino Acids and Related Compounds | Amino Acids and Related Compounds | Aspartic acid | 5% to 165% |
| 215691 | Amino Acids and Related Compounds | Amino Acids and Related Compounds | Glutamic acid | 30% to 75% |
| 215691 | Amino Acids and Related Compounds | Amino Acids and Related Compounds | Isoleucine | 90% to 400% |
| 215691 | Amino Acids and Related Compounds | Amino Acids and Related Compounds | Leucine | 495% to 605% |
| 215691 | Amino Acids and Related Compounds | Amino Acids and Related Compounds | Lysine | 60% to 235% |
| 215691 | Amino Acids and Related Compounds | Amino Acids and Related Compounds | Phenylalanine | 4% to 235% |
| 215691 | Amino Acids and Related Compounds | Amino Acids and Related Compounds | Threonine | 85% to 395% |
| 215691 | Amino Acids and Related Compounds | Amino Acids and Related Compounds | Valine | 65% to 325% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215716

| Seq ID | Chemical Class | Biochemical Class | Compound Name | Modification |
|---|---|---|---|---|
| 215716 | Amino Acids and Related Compounds | Amino Acids and Related Compounds | Alanine | 30% to 175% |
| 215716 | Amino Acids and Related Compounds | Amino Acids and Related Compounds | Aspartic acid | 10% to 55% |
| 215716 | Amino Acids and Related Compounds | Amino Acids and Related Compounds | Cysteine | 50% to 405% |
| 215716 | Amino Acids and Related Compounds | Amino Acids and Related Compounds | Glutamic acid | 15% to 35% |
| 215716 | Amino Acids and Related Compounds | Amino Acids and Related Compounds | Glycine | 40% to 265% |
| 215716 | Amino Acids and Related Compounds | Amino Acids and Related Compounds | Methionine | 20% to 100% |
| 215716 | Amino Acids and Related Compounds | Amino Acids and Related Compounds | Threonine | 15% to 80% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215727

| Seq ID | Chemical Class | Biochemical Class | Compound Name | Modification |
|---|---|---|---|---|
| 215727 | Acids - Fatty | Fatty Acids and Related Waxes | Eicosanoic acid | -25% to -61% |
| 215727 | Acids - Fatty Unsat | Fatty Acids and Related Waxes | 7,10,13-Hexadecatrienoic acid | 19% to 47% |
| 215727 | Acids - Fatty Unsat | Fatty Acids and Related Waxes | 9,12,15-Octadecatrienoic acid | 2% to 8% |
| 215727 | Acids - Fatty Unsat | Fatty Acids and Related Waxes | 9,12-Octadecadienoic acid | -15% to -33% |
| 215727 | Acids - Fatty Unsat | Fatty Acids and Related Waxes | 9-Octadecenoic acid | -30% to -60% |
| 215727 | Amino Acids and Related Compounds | Amino Acids and Related Compounds | Lysine | 15% to 135% |
| 215727 | Amino Acids and Related Compounds | Amino Acids and Related Compounds | Valine | 20% to 175% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215729

| Seq ID | Chemical Class | Biochemical Class | Compound Name | Modification |
|---|---|---|---|---|
| 215729 | Acids | Acids | Carbamic acid | 100% to 167% |
| 215729 | Acids - Hydroxy Alpha | Acid Pathway | Citric acid | 636% to 1665% |
| 215729 | Alcohols | Carbohydrates | Inositol | -60% to -87% |
| 215729 | Alkaloids and Other Bases | Polyamines | 1,4-Butanediamine | New |
| 215729 | Amino Acids and Related Compounds | Amino Acids and Related Compounds | Glutamic acid | New |
| 215729 | Amino Acids and Related Compounds | Amino Acids and Related Compounds | Glycine | New |
| 215729 | Amino Acids and Related Compounds | Amino Acids and Related Compounds | Proline, 5-oxo- | 436% to 727% |
| 215729 | Carbohydrates | Carbohydrates | F3-U0.813 Carbohydrate | New |
| 215729 | Carbohydrates | Carbohydrates | F3-U0.816 Carbohydrate | 220% to 673% |
| 215729 | Carbohydrates | Carbohydrates | F3-U0.821 Carbohydrate | 636% to 1665% |
| 215729 | Carbohydrates | Carbohydrates | F3-U0.846 Carbohydrate | 413% to 821% |
| 215729 | Carbohydrates | Carbohydrates | F3-U0.848 Carbohydrate | 645% to 1075% |
| 215729 | Carbohydrates | Carbohydrates | F3-U0.872 Hexose | 235% to 638% |
| 215729 | Carbohydrates | Carbohydrates | Glucose | -60% to -84% |
| 215729 | NA | NA | F3-U0.852A | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215730

| Seq ID | Chemical Class | Biochemical Class | Compound Name | Modification |
|---|---|---|---|---|
| 215730 | Amino Acids and Related Compounds | Amino Acids and Related Compounds | Alanine | 35% to 265% |
| 215730 | Amino Acids and Related Compounds | Amino Acids and Related Compounds | Cysteine | 20% to 325% |
| 215730 | Amino Acids and Related Compounds | Amino Acids and Related Compounds | Glycine | 10% to 370% |
| 215730 | Amino Acids and Related Compounds | Amino Acids and Related Compounds | Histidine | 5% to 445% |
| 215730 | Amino Acids and Related Compounds | Amino Acids and Related Compounds | Isoleucine | 10% to 395% |
| 215730 | Amino Acids and Related Compounds | Amino Acids and Related Compounds | Phenylalanine | 25% to 260% |
| 215730 | Amino Acids and Related Compounds | Amino Acids and Related Compounds | Proline | 40% to 560% |
| 215730 | Amino Acids and Related Compounds | Amino Acids and Related Compounds | Serine | 40% to 180% |
| 215730 | Amino Acids and Related Compounds | Amino Acids and Related Compounds | Threonine | 40% to 140% |
| 215730 | Amino Acids and Related Compounds | Amino Acids and Related Compounds | Valine | 60% to 360% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215744

| Seq ID | Chemical Class | Biochemical Class | Compound Name | Modification |
|---|---|---|---|---|
| 215744 | Acids - Fatty Unsat | Fatty Acids and Related Waxes | 10-Nonadecenoic acid | NQ |
| 215744 | Acids - Fatty | Fatty Acids and Related Waxes | Docosanoic acid | 63% to 178% |
| 215744 | Acids - Fatty | Fatty Acids and Related Waxes | Eicosanoic acid | 124% to 207% |
| 215744 | Acids - Fatty | Fatty Acids and Related Waxes | Heptadecanoic acid | 141% to 235% |
| 215744 | Acids - Fatty | Fatty Acids and Related Waxes | Hexadecanoic acid | 60% to 80% |
| 215744 | Acids - Fatty | Fatty Acids and Related Waxes | Octadecanoic acid | 121% to 202% |
| 215744 | Acids - Fatty Branched | Fatty Acids and Related Waxes | Heptadecanoic acid, 16-methyl- | 66% to 378% |
| 215744 | Acids - Fatty Branched | Fatty Acids and Related Waxes | Hexadecanoic acid, 14-methyl- | 115% to 192% |
| 215744 | Acids - Fatty Branched | Fatty Acids and Related Waxes | Pentadecanoic acid, 13-methyl- | 204% to 340% |
| 215744 | Acids - Fatty Unsat | Fatty Acids and Related Waxes | 11,14,17-Eicosatrienoic acid | 308% to 513% |
| 215744 | Acids - Fatty Unsat | Fatty Acids and Related Waxes | 7,10,13-Docosatrienoic acid | 78% to 130% |
| 215744 | Acids - Fatty Unsat | Fatty Acids and Related Waxes | 9,12,15-Octadecatrienoic acid | New |
| 215744 | Acids - Fatty Unsat | Fatty Acids and Related Waxes | 9,12-Octadecadienoic acid | 60% to 89% |
| 215744 | Acids - Fatty Unsat | Fatty Acids and Related Waxes | 9-Hexadecenoic acid | 80% to 250% |
| 215744 | Acids - Fatty Unsat | Fatty Acids and Related Waxes | 9-Octadecenoic acid | 70% to 116% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215751

| Seq ID | Chemical Class | Biochemical Class | Compound Name | Modification |
|---|---|---|---|---|
| 215751 | Amino Acids and Related Compounds | Amino Acids and Related Compounds | Alanine | 14% to 65% |
| 215751 | Amino Acids and Related Compounds | Amino Acids and Related Compounds | Aspartic acid | 5% to 100% |
| 215751 | Amino Acids and Related Compounds | Amino Acids and Related Compounds | Cysteine | 25% to 600% |
| 215751 | Amino Acids and Related Compounds | Amino Acids and Related Compounds | Glutamic acid | 5% to 70% |
| 215751 | Amino Acids and Related Compounds | Amino Acids and Related Compounds | Glycine | 20% to 405% |
| 215751 | Amino Acids and Related Compounds | Amino Acids and Related Compounds | Isoleucine | 35% to 855% |
| 215751 | Amino Acids and Related Compounds | Amino Acids and Related Compounds | Leucine | 70% to 750% |
| 215751 | Amino Acids and Related Compounds | Amino Acids and Related Compounds | Lysine | 50% to 265% |
| 215751 | Amino Acids and Related Compounds | Amino Acids and Related Compounds | Methionine | 20% to 100% |
| 215751 | Amino Acids and Related Compounds | Amino Acids and Related Compounds | Phenylalanine | 30% to 535% |
| 215751 | Amino Acids and Related Compounds | Amino Acids and Related Compounds | Threonine | 15% to 130% |
| 215751 | Amino Acids and Related Compounds | Amino Acids and Related Compounds | Valine | 105% to 570% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#215803

| Seq ID | Chemical Class | Biochemical Class | Compound Name | Modification |
|---|---|---|---|---|
| 215803 | Acids - Fatty | Fatty Acids and Related Waxes | Hexadecanoic acid | 4% to 11% |
| 215803 | Acids - Fatty | Fatty Acids and Related Waxes | Octadecanoic acid | 2% to 10% |
| 215803 | Acids - Fatty Unsat | Fatty Acids and Related Waxes | 9,12,15-Octadecatrienoic acid | -2% to -7% |
| 215803 | Acids - Fatty Unsat | Fatty Acids and Related Waxes | 9,12-Octadecadienoic acid | 4% to 26% |
| 215803 | Acids - Fatty Unsat | Fatty Acids and Related Waxes | 9-Hexadecenoic acid | -10% to -32% |
| 215803 | Amino Acids and Related Compounds | Amino Acids and Related Compounds | Arginine | 10% to 240% |
| 215803 | Amino Acids and Related Compounds | Amino Acids and Related Compounds | Histidine | 15% to 475% |
| 215803 | Amino Acids and Related Compounds | Amino Acids and Related Compounds | Isoleucine | 30% to 470% |
| 215803 | Amino Acids and Related Compounds | Amino Acids and Related Compounds | Lysine | 5% to 115% |
| 215803 | Amino Acids and Related Compounds | Amino Acids and Related Compounds | Proline | 40% to 345% |
| 215803 | Amino Acids and Related Compounds | Amino Acids and Related Compounds | Threonine | 45% to 120% |
| 215803 | Amino Acids and Related Compounds | Amino Acids and Related Compounds | Tryptophan | 65% to 345% |
| 215803 | Amino Acids and Related Compounds | Amino Acids and Related Compounds | Valine | 30% to 340% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215810

| Seq ID | Chemical Class | Biochemical Class | Compound Name | Modification |
|---|---|---|---|---|
| 215810 | Amino Acids and Related Compounds | Amino Acids and Related Compounds | Alanine | -15% to -40% |
| 215810 | Amino Acids and Related Compounds | Amino Acids and Related Compounds | Cysteine | 125% to 590% |
| 215810 | Amino Acids and Related Compounds | Amino Acids and Related Compounds | Glycine | 105% to 400% |
| 215810 | Amino Acids and Related Compounds | Amino Acids and Related Compounds | Histidine | 80% to 310% |
| 215810 | Amino Acids and Related Compounds | Amino Acids and Related Compounds | Isoleucine | 25% to 260% |
| 215810 | Amino Acids and Related Compounds | Amino Acids and Related Compounds | Lysine | 5% to 150% |
| 215810 | Amino Acids and Related Compounds | Amino Acids and Related Compounds | Methionine | 60% to 125% |
| 215810 | Amino Acids and Related Compounds | Amino Acids and Related Compounds | Threonine | 45% to 120% |
| 215810 | Amino Acids and Related Compounds | Amino Acids and Related Compounds | Tryptophan | 45% to 1150% |
| 215810 | Amino Acids and Related Compounds | Amino Acids and Related Compounds | Valine | 15% to 315% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215817

| Seq ID | Chemical Class | Biochemical Class | Compound Name | Modification |
|---|---|---|---|---|
| 215817 | Amino Acids and Related Compounds | Amino Acids and Related Compounds | Cysteine | 185% to 890% |
| 215817 | Amino Acids and Related Compounds | Amino Acids and Related Compounds | Glycine | 120% to 845% |
| 215817 | Amino Acids and Related Compounds | Amino Acids and Related Compounds | Threonine | 35% to 90% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215852

| Seq ID | Chemical Class | Biochemical Class | Compound Name | Modification |
|---|---|---|---|---|
| 215852 | Acids - Fatty | Fatty Acids and Related Waxes | Eicosanoic acid | 1% to 152% |
| 215852 | Acids - Fatty Branched | Fatty Acids and Related Waxes | Heptadecanoic acid, 16-methyl- | -92% to -96% |
| 215852 | Acids - Fatty Unsat | Fatty Acids and Related Waxes | 9,12,15-Octadecatrienoic acid | 2% to 10% |
| 215852 | Acids - Fatty Unsat | Fatty Acids and Related Waxes | 9,12-Octadecadienoic acid | -8% to -24% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215859

| Seq ID | Chemical Class | Biochemical Class | Compound Name | Modification |
|---|---|---|---|---|
| 215859 | Amino Acids and Related Compounds | Amino Acids and Related Compounds | Proline | 30% to 320% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#215864 | | | | |
|---|---|---|---|---|
| Seq ID | Chemical Class | Biochemical Class | Compound Name | Modification |
| 215864 | Acids - Fatty | Fatty Acids and Related Waxes | Eicosanoic acid | 7% to 93% |
| 215864 | Acids - Fatty | Fatty Acids and Related Waxes | Octadecanoic acid | 12% to 79% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215885

| Seq ID | Chemical Class | Biochemical Class | Compound Name | Modification |
|---|---|---|---|---|
| 215885 | Amino Acids and Related Compounds | Amino Acids and Related Compounds | Aspartic acid | 5% to 90% |
| 215885 | Amino Acids and Related Compounds | Amino Acids and Related Compounds | Cysteine | 20% to 555% |
| 215885 | Amino Acids and Related Compounds | Amino Acids and Related Compounds | Glutamic acid | 20% to 60% |
| 215885 | Amino Acids and Related Compounds | Amino Acids and Related Compounds | Glycine | 20% to 265% |
| 215885 | Amino Acids and Related Compounds | Amino Acids and Related Compounds | Methionine | 5% to 45% |
| 215885 | Amino Acids and Related Compounds | Amino Acids and Related Compounds | Threonine | 5% to 60% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215922

| Seq ID | Chemical Class | Biochemical Class | Compound Name | Modification |
|---|---|---|---|---|
| 215922 | Acids | Acids | Carbamic acid | -60% to -97% |
| 215922 | Acids - Hydroxy Alpha | Acid Pathway | Butanoic acid, 2,3,4-trihydroxy- | 73% to 140% |
| 215922 | Acids - Hydroxy Alpha | Acid Pathway | Citric acid | 371% to 647% |
| 215922 | Acids - Hydroxy Alpha | Acid Pathway | Malic acid | 60% to 83% |
| 215922 | Alcohols | Carbohydrates | Inositol | -60% to -79% |
| 215922 | Carbohydrates | Carbohydrates | F3-U0.813 Carbohydrate | New |
| 215922 | Carbohydrates | Carbohydrates | F3-U0.816 Carbohydrate | New |
| 215922 | Carbohydrates | Carbohydrates | F3-U0.821 Carbohydrate | 371% to 647% |
| 215922 | Carbohydrates | Carbohydrates | F3-U0.825 Carbohydrate | New |
| 215922 | Carbohydrates | Carbohydrates | F3-U0.846 Carbohydrate | 977% to 1876% |
| 215922 | Carbohydrates | Carbohydrates | F3-U0.872 Hexose | 432% to 893% |
| 215922 | Carbohydrates | Carbohydrates | Fructose | -61% to -100% |
| 215922 | Carbohydrates | Carbohydrates | Glucose | -60% to -91% |
| 215922 | NA | NA | F3-U0.751 | 60% to 77% |
| 215922 | NA | NA | F3-U0.882 | -60% to -91% |
| 215922 | Phenols and Related Compounds | Phenylpropanes and Derivatives | Chlorogenic acid | 84% to 140% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215926

| Seq ID | Chemical Class | Biochemical Class | Compound Name | Modification |
|---|---|---|---|---|
| 215926 | Acids - Fatty Unsat | Fatty Acids and Related Waxes | 9,12-Octadecadienoic acid | 8% to 24% |
| 215926 | Acids - Fatty Unsat | Fatty Acids and Related Waxes | 9-Octadecenoic acid | 38% to 104% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215931

| Seq ID | Chemical Class | Biochemical Class | Compound Name | Modification |
|---|---|---|---|---|
| 215931 | Amino Acids and Related Compounds | Amino Acids and Related Compounds | Aspartic acid | 20% to 75% |
| 215931 | Amino Acids and Related Compounds | Amino Acids and Related Compounds | Cysteine | 100% to 530% |
| 215931 | Amino Acids and Related Compounds | Amino Acids and Related Compounds | Glycine | 55% to 550% |
| 215931 | Amino Acids and Related Compounds | Amino Acids and Related Compounds | Threonine | 5% to 65% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215934

| Seq ID | Chemical Class | Biochemical Class | Compound Name | Modification |
|---|---|---|---|---|
| 215934 | Amino Acids and Related Compounds | Amino Acids and Related Compounds | Aspartic acid | 10% to 100% |
| 215934 | Amino Acids and Related Compounds | Amino Acids and Related Compounds | Cysteine | 150% to 305% |
| 215934 | Amino Acids and Related Compounds | Amino Acids and Related Compounds | Glutamic acid | 5% to 85% |
| 215934 | Amino Acids and Related Compounds | Amino Acids and Related Compounds | Glycine | 95% to 495% |
| 215934 | Amino Acids and Related Compounds | Amino Acids and Related Compounds | Methionine | 120% to 690% |
| 215934 | Amino Acids and Related Compounds | Amino Acids and Related Compounds | Phenylalanine | 15% to 345% |
| 215934 | Amino Acids and Related Compounds | Amino Acids and Related Compounds | Proline | 5% to 325% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215938

| Seq ID | Chemical Class | Biochemical Class | Compound Name | Modification |
|---|---|---|---|---|
| 215938 | Amino Acids and Related Compounds | Amino Acids and Related Compounds | Alanine | 20% to 150% |
| 215938 | Amino Acids and Related Compounds | Amino Acids and Related Compounds | Cysteine | 120% to 395% |
| 215938 | Amino Acids and Related Compounds | Amino Acids and Related Compounds | Glycine | 65% to 410% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215951

| Seq ID | Chemical Class | Biochemical Class | Compound Name | Modification |
|---|---|---|---|---|
| 215951 | Amino Acids and Related Compounds | Amino Acids and Related Compounds | Cysteine | 190% to 560% |
| 215951 | Amino Acids and Related Compounds | Amino Acids and Related Compounds | Glycine | 120% to 570% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215961

| Seq ID | Chemical Class | Biochemical Class | Compound Name | Modification |
|---|---|---|---|---|
| 215961 | Acids | Acids | Carbamic acid | New |
| 215961 | Acids - Hydroxy | Amino Acids and Related Compounds | Shikimic acid | 190% to 317% |
| 215961 | Acids - Hydroxy Alpha | Acid Pathway | Butanoic acid, 2,3,4-trihydroxy- | 78% to 233% |
| 215961 | Acids - Hydroxy Alpha | Carbohydrates | Quinic acid | 205% to 609% |
| 215961 | Alcohols | Carbohydrates | Inositol | 60% to 266% |
| 215961 | Alkenes and Alkynes | Alkenes and Alkynes | 1,3-Butadiene, 2-methyl- | New |
| 215961 | Alkenes and Alkynes | Fatty Acids and Related Waxes | 2-Hexadecene, 3,7,11,15-tetramethyl- | New |
| 215961 | Carbohydrates | Carbohydrates | F3-U0.768 Carbohydrate | 288% to 481% |
| 215961 | Carbohydrates | Carbohydrates | F3-U0.813 Carbohydrate | New |
| 215961 | Carbohydrates | Carbohydrates | F3-U0.816 Carbohydrate | 190% to 567% |
| 215961 | Carbohydrates | Carbohydrates | F3-U0.825 Carbohydrate | New |
| 215961 | Carbohydrates | Carbohydrates | F3-U0.846 Carbohydrate | 814% to 3564% |
| 215961 | Carbohydrates | Carbohydrates | F3-U0.872 Hexose | 646% to 2147% |
| 215961 | Carbohydrates | Carbohydrates | Fructose | 279% to 1247% |
| 215961 | Carbohydrates | Carbohydrates | Galactose or Mannose | 143% to 239% |
| 215961 | Carbohydrates | Carbohydrates | Glucose | 487% to 1978% |
| 215961 | NA | NA | F3-U0.736 | NQ |
| 215961 | Sterols, Oxygenated Terpenes, and Other Isoprenoids | Prenylquinones | alpha-Tocopherol | New |
| 215961 | Sterols, Oxygenated Terpenes, and Other Isoprenoids | Terpenoids | beta-Sitosterol | 60% to 90% |
| 215961 | Sterols, Oxygenated Terpenes, and Other Isoprenoids | Terpenoids | Fucosterol | -60% to -85% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#215966

| Seq ID | Chemical Class | Biochemical Class | Compound Name | Modification |
|---|---|---|---|---|
| 215966 | Acids - Fatty | Fatty Acids and Related Waxes | Hexadecanoic acid | -4% to -9% |
| 215966 | Acids - Fatty Unsat | Fatty Acids and Related Waxes | 7,10,13-Hexadecatrienoic acid | 24% to 49% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#215973 ||||
|---|---|---|---|
| Seq ID | Chemical Class | Biochemical Class | Compound Name | Modification |
| 215973 | Acids - Fatty | Fatty Acids and Related Waxes | Hexadecanoic acid | -4% to -9% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215981

| Seq ID | Chemical Class | Biochemical Class | Compound Name | Modification |
|---|---|---|---|---|
| 215981 | Acids | Acids | Carbamic acid | -60% to -100% |
| 215981 | Acids - Hydroxy Alpha | Acid Pathway | Butanoic acid, 2,3,4-trihydroxy- | 60% to 90% |
| 215981 | Acids - Hydroxy Alpha | Acid Pathway | Citric acid | 206% to 344% |
| 215981 | Acids - Hydroxy Alpha | Acid Pathway | Malic acid | 112% to 275% |
| 215981 | Acids - Hydroxy Alpha | Carbohydrates | Quinic acid | 107% to 179% |
| 215981 | Alkaloids and Other Bases | Polyamines | 1,4-Butanediamine | 96% to 266% |
| 215981 | Amino Acids and Related Compounds | Amino Acids and Related Compounds | Aspartic acid | New |
| 215981 | Amino Acids and Related Compounds | Amino Acids and Related Compounds | Glutamic acid | New |
| 215981 | Amino Acids and Related Compounds | Amino Acids and Related Compounds | Proline, 5-oxo- | 134% to 347% |
| 215981 | Carbohydrates | Carbohydrates | F3-U0.768 Carbohydrate | New |
| 215981 | Carbohydrates | Carbohydrates | F3-U0.770 Carbohydrate | New |
| 215981 | Carbohydrates | Carbohydrates | F3-U0.813 Carbohydrate | New |
| 215981 | Carbohydrates | Carbohydrates | F3-U0.816 Carbohydrate | 193% to 664% |
| 215981 | Carbohydrates | Carbohydrates | F3-U0.821 Carbohydrate | 206% to 457% |
| 215981 | Carbohydrates | Carbohydrates | F3-U0.825 Carbohydrate | 871% to 1474% |
| 215981 | Carbohydrates | Carbohydrates | F3-U0.846 Carbohydrate | 112% to 962% |
| 215981 | Carbohydrates | Carbohydrates | F3-U0.848 Carbohydrate | 73% to 211% |
| 215981 | Carbohydrates | Carbohydrates | F3-U0.872 Hexose | 117% to 1122% |
| 215981 | Carbohydrates | Carbohydrates | Fructose | 148% to 1596% |
| 215981 | Carbohydrates | Carbohydrates | Galactose or Mannose | 110% to 183% |
| 215981 | Carbohydrates | Carbohydrates | Glucose | 95% to 1524% |
| 215981 | NA | NA | F3-U0.736 | New |
| 215981 | NA | NA | F3-U0.751 | NQ |
| 215981 | NA | NA | F3-U0.852A | New |
| 215981 | NA | NA | F3-U0.856 | New |
| 215981 | NA | NA | F3-U0.882 | 60% to 217% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#215982

| Seq ID | Chemical Class | Biochemical Class | Compound Name | Modification |
|---|---|---|---|---|
| 215982 | Acids | Acids | Carbamic acid | 641% to 1327% |
| 215982 | Acids - Hydroxy Alpha | Acid Pathway | Butanoic acid, 2,3,4-trihydroxy- | 67% to 112% |
| 215982 | Acids - Hydroxy Alpha | Acid Pathway | Citric acid | 99% to 309% |
| 215982 | Amino Acids and Related Compounds | Amino Acids and Related Compounds | Proline, 5-oxo- | 60% to 144% |
| 215982 | Carbohydrates | Carbohydrates | F3-U0.813 Carbohydrate | 71% to 269% |
| 215982 | Carbohydrates | Carbohydrates | F3-U0.816 Carbohydrate | 81% to 276% |
| 215982 | Carbohydrates | Carbohydrates | F3-U0.821 Carbohydrate | 99% to 309% |
| 215982 | Carbohydrates | Carbohydrates | F3-U0.825 Carbohydrate | 60% to 432% |
| 215982 | Carbohydrates | Carbohydrates | F3-U0.846 Carbohydrate | 60% to 397% |
| 215982 | Carbohydrates | Carbohydrates | F3-U0.848B Carbohydrate | 163% to 271% |
| 215982 | Carbohydrates | Carbohydrates | F3-U0.872 Hexose | 73% to 517% |
| 215982 | Carbohydrates | Carbohydrates | F3-U1.143 Carbohydrate | 77% to 128% |
| 215982 | Carbohydrates | Carbohydrates | Fructose | 73% to 525% |
| 215982 | Carbohydrates | Carbohydrates | Glucose | 192% to 391% |
| 215982 | NA | NA | F3-U0.736 | 64% to 187% |
| 215982 | NA | NA | F3-U0.852A | 413% to 688% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216008

| Seq ID | Chemical Class | Biochemical Class | Compound Name | Modification |
|---|---|---|---|---|
| 216008 | Acids - Fatty | Fatty Acids and Related Waxes | Octadecanoic acid | -10% to -26% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#216013

| Seq ID | Chemical Class | Biochemical Class | Compound Name | Modification |
|---|---|---|---|---|
| 216013 | Acids - Fatty | Fatty Acids and Related Waxes | Octadecanoic acid | -12% to -37% |
| 216013 | Acids - Fatty Unsat | Fatty Acids and Related Waxes | 9,12-Octadecadienoic acid | 5% to 26% |
| 216013 | Acids - Fatty Unsat | Fatty Acids and Related Waxes | 9-Octadecenoic acid | 9% to 79% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#216036

| Seq ID | Chemical Class | Biochemical Class | Compound Name | Modification |
|---|---|---|---|---|
| 216036 | Acids - Fatty | Fatty Acids and Related Waxes | Hexadecanoic acid | -3% to -7% |
| 216036 | Acids - Fatty Unsat | Fatty Acids and Related Waxes | 9-Hexadecenoic acid | 10% to 33% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216040

| Seq ID | Chemical Class | Biochemical Class | Compound Name | Modification |
|---|---|---|---|---|
| 216040 | Acids | Acids | Carbamic acid | -60% to -94% |
| 216040 | Acids - Hydroxy Alpha | Acid Pathway | Butanoic acid, 2,3,4-trihydroxy- | 99% to 164% |
| 216040 | Acids - Hydroxy Alpha | Acid Pathway | Citric acid | 225% to 374% |
| 216040 | Acids - Hydroxy Alpha | Carbohydrates | Quinic acid | 116% to 193% |
| 216040 | Alcohols | Carbohydrates | Inositol | 60% to 87% |
| 216040 | Carbohydrates | Carbohydrates | F3-U0.813 Carbohydrate | 223% to 371% |
| 216040 | Carbohydrates | Carbohydrates | F3-U0.816 Carbohydrate | 124% to 207% |
| 216040 | Carbohydrates | Carbohydrates | F3-U0.821 Carbohydrate | 225% to 374% |
| 216040 | Carbohydrates | Carbohydrates | F3-U0.825 Carbohydrate | 273% to 455% |
| 216040 | Carbohydrates | Carbohydrates | F3-U0.846 Carbohydrate | 534% to 890% |
| 216040 | Carbohydrates | Carbohydrates | F3-U0.872 Hexose | 556% to 927% |
| 216040 | Carbohydrates | Carbohydrates | F3-U1.113 Carbohydrate | 60% to 94% |
| 216040 | Carbohydrates | Carbohydrates | F3-U1.189 Carbohydrate | 92% to 154% |
| 216040 | Carbohydrates | Carbohydrates | Fructose | 447% to 775% |
| 216040 | Carbohydrates | Carbohydrates | Glucose | 523% to 1234% |
| 216040 | Phenols and Related Compounds | Phenylpropanes and Derivatives | Chlorogenic acid | 60% to 89% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216042

| Seq ID | Chemical Class | Biochemical Class | Compound Name | Modification |
|---|---|---|---|---|
| 216042 | Acids - Fatty Unsat | Fatty Acids and Related Waxes | 9-Hexadecenoic acid | 13% to 33% |
| 216042 | Acids - Fatty Unsat | Fatty Acids and Related Waxes | 9-Octadecenoic acid | 29% to 166% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216043

| Seq ID | Chemical Class | Biochemical Class | Compound Name | Modification |
|---|---|---|---|---|
| 216043 | Amino Acids and Related Compounds | Amino Acids and Related Compounds | Arginine | 130% to 685% |
| 216043 | Amino Acids and Related Compounds | Amino Acids and Related Compounds | Cysteine | 10% to 710% |
| 216043 | Amino Acids and Related Compounds | Amino Acids and Related Compounds | Glycine | 15% to 600% |
| 216043 | Amino Acids and Related Compounds | Amino Acids and Related Compounds | Lysine | 55% to 450% |
| 216043 | Amino Acids and Related Compounds | Amino Acids and Related Compounds | Methionine | 50% to 430% |
| 216043 | Amino Acids and Related Compounds | Amino Acids and Related Compounds | Phenylalanine | 30% to 415% |
| 216043 | Amino Acids and Related Compounds | Amino Acids and Related Compounds | Serine | 45% to 225% |
| 216043 | Amino Acids and Related Compounds | Amino Acids and Related Compounds | Threonine | 25% to 195% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216049

| Seq ID | Chemical Class | Biochemical Class | Compound Name | Modification |
|---|---|---|---|---|
| 216049 | Acids | Acids | Carbamic acid | 744% to 1241% |
| 216049 | Acids - Hydroxy Alpha | Carbohydrates | Glyceric acid | New |
| 216049 | Acids - Hydroxy Alpha | Acid Pathway | Malic acid | 262% to 437% |
| 216049 | Amino Acids and Related Compounds | Amino Acids and Related Compounds | Alanine | 60% to 70% |
| 216049 | Amino Acids and Related Compounds | Amino Acids and Related Compounds | Glutamic acid | 164% to 274% |
| 216049 | Amino Acids and Related Compounds | Amino Acids and Related Compounds | Methionine | 60% to 165% |
| 216049 | Amino Acids and Related Compounds | Amino Acids and Related Compounds | Valine | 60% to 415% |
| 216049 | Carbohydrates | Carbohydrates | F3-U0.813 Carbohydrate | 217% to 361% |
| 216049 | Carbohydrates | Carbohydrates | F3-U0.816 Carbohydrate | 61% to 101% |
| 216049 | Carbohydrates | Carbohydrates | F3-U0.846 Carbohydrate | 352% to 586% |
| 216049 | Carbohydrates | Carbohydrates | F3-U0.872 Hexose | 427% to 712% |
| 216049 | Carbohydrates | Carbohydrates | Fructose | 842% to 1811% |
| 216049 | Carbohydrates | Carbohydrates | Glucose | 818% to 3729% |
| 216049 | NA | NA | F3-U0.751 | 116% to 193% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#216055

| Seq ID | Chemical Class | Biochemical Class | Compound Name | Modification |
|---|---|---|---|---|
| 216055 | Acids - Fatty | Fatty Acids and Related Waxes | Hexadecanoic acid | 2% to 8% |
| 216055 | Acids - Fatty Branched | Fatty Acids and Related Waxes | Heptadecanoic acid, 16-methyl- | 23% to 107% |
| 216055 | Acids - Fatty Unsat | Fatty Acids and Related Waxes | 9,12-Octadecadienoic acid | -5% to -26% |
| 216055 | Acids - Fatty Unsat | Fatty Acids and Related Waxes | 9-Hexadecenoic acid | 6% to 28% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216057

| Seq ID | Chemical Class | Biochemical Class | Compound Name | Modification |
|---|---|---|---|---|
| 216057 | Acids - Fatty | Fatty Acids and Related Waxes | Eicosanoic acid | 8% to 134% |
| 216057 | Acids - Fatty | Fatty Acids and Related Waxes | Octadecanoic acid | -8% to -22% |
| 216057 | Acids - Fatty Branched | Fatty Acids and Related Waxes | Heptadecanoic acid, 16-methyl- | 14% to 36% |
| 216057 | Acids - Fatty Unsat | Fatty Acids and Related Waxes | 9,12-Octadecadienoic acid | -6% to -18% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216062

| Seq ID | Chemical Class | Biochemical Class | Compound Name | Modification |
|---|---|---|---|---|
| 216062 | Acids - Fatty | Fatty Acids and Related Waxes | Eicosanoic acid | -24% to -56% |
| 216062 | Acids - Fatty Branched | Fatty Acids and Related Waxes | Heptadecanoic acid, 16-methyl- | -33% to -52% |
| 216062 | Acids - Fatty Unsat | Fatty Acids and Related Waxes | 9,12-Octadecadienoic acid | 4% to 29% |
| 216062 | Acids - Fatty Unsat | Fatty Acids and Related Waxes | 9-Hexadecenoic acid | -12% to -28% |
| 216062 | Acids - Fatty Unsat | Fatty Acids and Related Waxes | 9-Octadecenoic acid | -29% to -55% |
| 216062 | Amino Acids and Related Compounds | Amino Acids and Related Compounds | Glutamic acid | 20% to 145% |
| 216062 | Amino Acids and Related Compounds | Amino Acids and Related Compounds | Leucine | 5% to 405% |
| 216062 | Amino Acids and Related Compounds | Amino Acids and Related Compounds | Phenylalanine | 10% to 175% |
| 216062 | Amino Acids and Related Compounds | Amino Acids and Related Compounds | Threonine | 15% to 70% |
| 216062 | Amino Acids and Related Compounds | Amino Acids and Related Compounds | Tyrosine | 5% to 600% |
| 216062 | Amino Acids and Related Compounds | Amino Acids and Related Compounds | Valine | 10% to 340% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216074

| Seq ID | Chemical Class | Biochemical Class | Compound Name | Modification |
|---|---|---|---|---|
| 216074 | Acids | Acids | Carbamic acid | 741% to 1793% |
| 216074 | Acids - Hydroxy Alpha | Acid Pathway | Butanoic acid, 2,3,4-trihydroxy- | 68% to 184% |
| 216074 | Acids - Hydroxy Alpha | Acid Pathway | Citric acid | 70% to 403% |
| 216074 | Acids - Hydroxy Alpha | Acid Pathway | Malic acid | 71% to 167% |
| 216074 | Acids - Hydroxy Alpha | Carbohydrates | Quinic acid | 60% to 245% |
| 216074 | Amino Acids and Related Compounds | Amino Acids and Related Compounds | Proline, 5-oxo- | 60% to 171% |
| 216074 | Carbohydrates | Carbohydrates | F3-U0.768 Carbohydrate | New |
| 216074 | Carbohydrates | Carbohydrates | F3-U0.813 Carbohydrate | 90% to 637% |
| 216074 | Carbohydrates | Carbohydrates | F3-U0.816 Carbohydrate | 60% to 353% |
| 216074 | Carbohydrates | Carbohydrates | F3-U0.821 Carbohydrate | 70% to 403% |
| 216074 | Carbohydrates | Carbohydrates | F3-U0.825 Carbohydrate | 91% to 432% |
| 216074 | Carbohydrates | Carbohydrates | F3-U0.846 Carbohydrate | 62% to 553% |
| 216074 | Carbohydrates | Carbohydrates | F3-U0.848 Carbohydrate | 181% to 302% |
| 216074 | Carbohydrates | Carbohydrates | F3-U0.872 Hexose | 79% to 929% |
| 216074 | Carbohydrates | Carbohydrates | F3-U1.143 Carbohydrate | 60% to 97% |
| 216074 | Carbohydrates | Carbohydrates | F3-U1.189 Carbohydrate | 80% to 133% |
| 216074 | Carbohydrates | Carbohydrates | F3-U1.194 Carbohydrate | 93% to 155% |
| 216074 | Carbohydrates | Carbohydrates | Fructose | 102% to 2152% |
| 216074 | Carbohydrates | Carbohydrates | Glucose | 60% to 1874% |
| 216074 | NA | NA | F3-U0.736 | 67% to 280% |
| 216074 | NA | NA | F3-U0.852A | 180% to 1300% |
| 216074 | NA | NA | F3-U0.882 | New |
| 216074 | Phenols and Related Compounds | Phenylpropanes and Derivatives | Chlorogenic acid | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216079

| Seq ID | Chemical Class | Biochemical Class | Compound Name | Modification |
|---|---|---|---|---|
| 216079 | Acids - Fatty | Fatty Acids and Related Waxes | Octadecanoic acid | 12% to 138% |
| 216079 | Acids - Fatty Unsat | Fatty Acids and Related Waxes | 9,12,15-Octadecatrienoic acid | -3% to -8% |
| 216079 | Acids - Fatty Unsat | Fatty Acids and Related Waxes | 9,12-Octadecadienoic acid | 46% to 65% |
| 216079 | Acids - Fatty Unsat | Fatty Acids and Related Waxes | 9-Hexadecenoic acid | -51% to -65% |
| 216079 | Amino Acids and Related Compounds | Amino Acids and Related Compounds | Alanine | 50% to 270% |
| 216079 | Amino Acids and Related Compounds | Amino Acids and Related Compounds | Glutamic acid | 20% to 140% |
| 216079 | Amino Acids and Related Compounds | Amino Acids and Related Compounds | Phenylalanine | 25% to 180% |
| 216079 | Amino Acids and Related Compounds | Amino Acids and Related Compounds | Threonine | 10% to 70% |
| 216079 | Amino Acids and Related Compounds | Amino Acids and Related Compounds | Tryptophan | 25% to 200% |
| 216079 | Amino Acids and Related Compounds | Amino Acids and Related Compounds | Valine | 10% to 180% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216082

| Seq ID | Chemical Class | Biochemical Class | Compound Name | Modification |
|---|---|---|---|---|
| 216082 | Amino Acids and Related Compounds | Amino Acids and Related Compounds | Glutamic acid | 5% to 60% |
| 216082 | Amino Acids and Related Compounds | Amino Acids and Related Compounds | Methionine | 20% to 35% |
| 216082 | Amino Acids and Related Compounds | Amino Acids and Related Compounds | Serine | 5% to 95% |
| 216082 | Amino Acids and Related Compounds | Amino Acids and Related Compounds | Valine | 20% to 75% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#216095

| Seq ID | Chemical Class | Biochemical Class | Compound Name | Modification |
|---|---|---|---|---|
| 216095 | Amino Acids and Related Compounds | Amino Acids and Related Compounds | Alanine | 95% to 1020% |
| 216095 | Amino Acids and Related Compounds | Amino Acids and Related Compounds | Cysteine | 5% to 5400% |
| 216095 | Amino Acids and Related Compounds | Amino Acids and Related Compounds | Glutamic acid | 5% to 110% |
| 216095 | Amino Acids and Related Compounds | Amino Acids and Related Compounds | Glycine | 410% to 5000% |
| 216095 | Amino Acids and Related Compounds | Amino Acids and Related Compounds | Isoleucine | 75% to 310% |
| 216095 | Amino Acids and Related Compounds | Amino Acids and Related Compounds | Leucine | New |
| 216095 | Amino Acids and Related Compounds | Amino Acids and Related Compounds | Lysine | 25% to 145% |
| 216095 | Amino Acids and Related Compounds | Amino Acids and Related Compounds | Phenylalanine | 105% to 410% |
| 216095 | Amino Acids and Related Compounds | Amino Acids and Related Compounds | Serine | 30% to 420% |
| 216095 | Amino Acids and Related Compounds | Amino Acids and Related Compounds | Valine | 5% to 170% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216103

| Seq ID | Chemical Class | Biochemical Class | Compound Name | Modification |
|---|---|---|---|---|
| 216103 | Amino Acids and Related Compounds | Amino Acids and Related Compounds | Aspartic acid | 15% to 125% |
| 216103 | Amino Acids and Related Compounds | Amino Acids and Related Compounds | Cysteine | 25% to 350% |
| 216103 | Amino Acids and Related Compounds | Amino Acids and Related Compounds | Glutamic acid | 10% to 95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216108

| Seq ID | Chemical Class | Biochemical Class | Compound Name | Modification |
|---|---|---|---|---|
| 216108 | Amino Acids and Related Compounds | Amino Acids and Related Compounds | Alanine | 15% to 75% |
| 216108 | Amino Acids and Related Compounds | Amino Acids and Related Compounds | Cysteine | 10% to 380% |
| 216108 | Amino Acids and Related Compounds | Amino Acids and Related Compounds | Glutamic acid | 20% to 55% |
| 216108 | Amino Acids and Related Compounds | Amino Acids and Related Compounds | Glycine | 15% to 520% |
| 216108 | Amino Acids and Related Compounds | Amino Acids and Related Compounds | Lysine | -35% to -70% |
| 216108 | Amino Acids and Related Compounds | Amino Acids and Related Compounds | Methionine | 10% to 30% |
| 216108 | Amino Acids and Related Compounds | Amino Acids and Related Compounds | Serine | 13% to 30% |
| 216108 | Amino Acids and Related Compounds | Amino Acids and Related Compounds | Threonine | 5% to 55% |
| 216108 | Amino Acids and Related Compounds | Amino Acids and Related Compounds | Valine | 5% to 50% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216114

| Seq ID | Chemical Class | Biochemical Class | Compound Name | Modification |
|---|---|---|---|---|
| 216114 | Amino Acids and Related Compounds | Amino Acids and Related Compounds | Alanine | 80% to 950% |
| 216114 | Amino Acids and Related Compounds | Amino Acids and Related Compounds | Cysteine | 155% to 805% |
| 216114 | Amino Acids and Related Compounds | Amino Acids and Related Compounds | Glycine | 10% to 855% |
| 216114 | Amino Acids and Related Compounds | Amino Acids and Related Compounds | Leucine | 65% to 185% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216130

| Seq ID | Chemical Class | Biochemical Class | Compound Name | Modification |
|---|---|---|---|---|
| 216130 | Amino Acids and Related Compounds | Amino Acids and Related Compounds | Alanine | 5% to 110% |
| 216130 | Amino Acids and Related Compounds | Amino Acids and Related Compounds | Cysteine | 65% to 830% |
| 216130 | Amino Acids and Related Compounds | Amino Acids and Related Compounds | Glutamic acid | 20% to 70% |
| 216130 | Amino Acids and Related Compounds | Amino Acids and Related Compounds | Glycine | 45% to 1190% |
| 216130 | Amino Acids and Related Compounds | Amino Acids and Related Compounds | Lysine | -45% to -70% |
| 216130 | Amino Acids and Related Compounds | Amino Acids and Related Compounds | Methionine | 15% to 35% |
| 216130 | Amino Acids and Related Compounds | Amino Acids and Related Compounds | Threonine | 5% to 100% |
| 216130 | Amino Acids and Related Compounds | Amino Acids and Related Compounds | Valine | 25% to 75% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216131

| Seq ID | Chemical Class | Biochemical Class | Compound Name | Modification |
|---|---|---|---|---|
| 216131 | Amino Acids and Related Compounds | Amino Acids and Related Compounds | Alanine | 10% to 1630% |
| 216131 | Amino Acids and Related Compounds | Amino Acids and Related Compounds | Cysteine | 5% to 855% |
| 216131 | Amino Acids and Related Compounds | Amino Acids and Related Compounds | Glutamic acid | 10% to 85% |
| 216131 | Amino Acids and Related Compounds | Amino Acids and Related Compounds | Glycine | 135% to 1710% |
| 216131 | Amino Acids and Related Compounds | Amino Acids and Related Compounds | Leucine | New |
| 216131 | Amino Acids and Related Compounds | Amino Acids and Related Compounds | Lysine | 5% to 110% |
| 216131 | Amino Acids and Related Compounds | Amino Acids and Related Compounds | Methionine | 5% to 30% |
| 216131 | Amino Acids and Related Compounds | Amino Acids and Related Compounds | Serine | 5% to 160% |
| 216131 | Amino Acids and Related Compounds | Amino Acids and Related Compounds | Valine | 15% to 245% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216142

| Seq ID | Chemical Class | Biochemical Class | Compound Name | Modification |
|---|---|---|---|---|
| 216142 | Amino Acids and Related Compounds | Amino Acids and Related Compounds | Aspartic acid | 5% to 55% |
| 216142 | Amino Acids and Related Compounds | Amino Acids and Related Compounds | Glutamic acid | 5% to 80% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216156

| Seq ID | Chemical Class | Biochemical Class | Compound Name | Modification |
|---|---|---|---|---|
| 216156 | Acids - Fatty | Fatty Acids and Related Waxes | Hexadecanoic acid | -4% to -11% |
| 216156 | Acids - Fatty | Fatty Acids and Related Waxes | Octadecanoic acid | 8% to 128% |
| 216156 | Acids - Fatty Unsat | Fatty Acids and Related Waxes | 9,12,15-Octadecatrienoic acid | -2% to -8% |
| 216156 | Amino Acids and Related Compounds | Amino Acids and Related Compounds | Arginine | 50% to 165% |
| 216156 | Amino Acids and Related Compounds | Amino Acids and Related Compounds | Glutamic acid | 10% to 115% |
| 216156 | Amino Acids and Related Compounds | Amino Acids and Related Compounds | Threonine | 25% to 80% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216166

| Seq ID | Chemical Class | Biochemical Class | Compound Name | Modification |
|---|---|---|---|---|
| 216166 | Amino Acids and Related Compounds | Amino Acids and Related Compounds | Alanine | 5% to 495% |
| 216166 | Amino Acids and Related Compounds | Amino Acids and Related Compounds | Arginine | 5% to 645% |
| 216166 | Amino Acids and Related Compounds | Amino Acids and Related Compounds | Cysteine | 20% to 290% |
| 216166 | Amino Acids and Related Compounds | Amino Acids and Related Compounds | Glycine | 25% to 235% |
| 216166 | Amino Acids and Related Compounds | Amino Acids and Related Compounds | Leucine | 30% to 320% |
| 216166 | Amino Acids and Related Compounds | Amino Acids and Related Compounds | Lysine | -15% to -60% |
| 216166 | Amino Acids and Related Compounds | Amino Acids and Related Compounds | Methionine | 10% to 90% |
| 216166 | Amino Acids and Related Compounds | Amino Acids and Related Compounds | Phenylalanine | 5% to 190% |
| 216166 | Amino Acids and Related Compounds | Amino Acids and Related Compounds | Serine | 5% to 100% |
| 216166 | Amino Acids and Related Compounds | Amino Acids and Related Compounds | Threonine | 15% to 75% |
| 216166 | Amino Acids and Related Compounds | Amino Acids and Related Compounds | Valine | 25% to 265% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216175

| Seq ID | Chemical Class | Biochemical Class | Compound Name | Modification |
|---|---|---|---|---|
| 216175 | Amino Acids and Related Compounds | Amino Acids and Related Compounds | Arginine | 180% to 405% |
| 216175 | Amino Acids and Related Compounds | Amino Acids and Related Compounds | Aspartic acid | 20% to 80% |
| 216175 | Amino Acids and Related Compounds | Amino Acids and Related Compounds | Glutamic acid | 10% to 95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216176

| Seq ID | Chemical Class | Biochemical Class | Compound Name | Modification |
|---|---|---|---|---|
| 216176 | Amino Acids and Related Compounds | Amino Acids and Related Compounds | Arginine | 55% to 180% |
| 216176 | Amino Acids and Related Compounds | Amino Acids and Related Compounds | Cysteine | 15% to 235% |
| 216176 | Amino Acids and Related Compounds | Amino Acids and Related Compounds | Glycine | 15% to 195% |
| 216176 | Amino Acids and Related Compounds | Amino Acids and Related Compounds | Methionine | 5% to 60% |
| 216176 | Amino Acids and Related Compounds | Amino Acids and Related Compounds | Phenylalanine | 15% to 140% |
| 216176 | Amino Acids and Related Compounds | Amino Acids and Related Compounds | Serine | 5% to 85% |
| 216176 | Amino Acids and Related Compounds | Amino Acids and Related Compounds | Threonine | 15% to 60% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216195

| Seq ID | Chemical Class | Biochemical Class | Compound Name | Modification |
|---|---|---|---|---|
| 216195 | Acids - Fatty Unsat | Fatty Acids and Related Waxes | 9,12-Octadecadienoic acid | -8% to -27% |
| 216195 | Amino Acids and Related Compounds | Amino Acids and Related Compounds | Arginine | 45% to 160% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216196

| Seq ID | Chemical Class | Biochemical Class | Compound Name | Modification |
|---|---|---|---|---|
| 216196 | Acids - Hydroxy Alpha | Acid Pathway | Citric acid | 223% to 372% |
| 216196 | Acids | Acids | Carbamic acid | -65% to -100% |
| 216196 | Acids - Fatty | Fatty Acids and Related Waxes | Octadecanoic acid | 60% to 70% |
| 216196 | Acids - Hydroxy Alpha | Acid Pathway | Malic acid | 61% to 101% |
| 216196 | Acids - Hydroxy Alpha | Carbohydrates | Quinic acid | 143% to 238% |
| 216196 | Alcohols | Carbohydrates | Inositol | 140% to 233% |
| 216196 | Amino Acids and Related Compounds | Amino Acids and Related Compounds | Arginine | 110% to 275% |
| 216196 | Amino Acids and Related Compounds | Amino Acids and Related Compounds | Proline | 60% to 275% |
| 216196 | Amino Acids and Related Compounds | Amino Acids and Related Compounds | Proline, 5-oxo- | 146% to 244% |
| 216196 | Amino Acids and Related Compounds | Amino Acids and Related Compounds | Tryptophan | New |
| 216196 | Carbohydrates | Carbohydrates | F3-U0.816 Carbohydrate | 407% to 678% |
| 216196 | Carbohydrates | Carbohydrates | F3-U0.821 Carbohydrate | 223% to 372% |
| 216196 | Carbohydrates | Carbohydrates | F3-U0.825 Carbohydrate | 465% to 775% |
| 216196 | Carbohydrates | Carbohydrates | F3-U0.846 Carbohydrate | 698% to 1164% |
| 216196 | Carbohydrates | Carbohydrates | F3-U0.872 Hexose | 717% to 1194% |
| 216196 | Carbohydrates | Carbohydrates | Fructose | 537% to 1014% |
| 216196 | Carbohydrates | Carbohydrates | Galactose or Mannose | 117% to 196% |
| 216196 | Carbohydrates | Carbohydrates | Glucose | 541% to 1613% |
| 216196 | NA | NA | F3-U1.253 | 60% to 81% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216204

| Seq ID | Chemical Class | Biochemical Class | Compound Name | Modification |
|---|---|---|---|---|
| 216204 | Amino Acids and Related Compounds | Amino Acids and Related Compounds | Arginine | 60% to 185% |
| 216204 | Amino Acids and Related Compounds | Amino Acids and Related Compounds | Tryptophan | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216207

| Seq ID | Chemical Class | Biochemical Class | Compound Name | Modification |
|---|---|---|---|---|
| 216207 | Amino Acids and Related Compounds | Amino Acids and Related Compounds | Arginine | 100% to 260% |
| 216207 | Amino Acids and Related Compounds | Amino Acids and Related Compounds | Threonine | 30% to 220% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#216212

| Seq ID | Chemical Class | Biochemical Class | Compound Name | Modification |
|--------|---------------|-------------------|---------------|--------------|
| 216212 | Acids - Fatty Unsat | Fatty Acids and Related Waxes | 9-Octadecenoic acid | -38% to -64% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216216

| Seq ID | Chemical Class | Biochemical Class | Compound Name | Modification |
|---|---|---|---|---|
| 216216 | Acids | Acids | Carbamic acid | 60% to 98% |
| 216216 | Acids | Acids | omega-Aminobutyric acid | 321% to 651% |
| 216216 | Acids - Hydroxy Alpha | Acid Pathway | Butanoic acid, 2,3,4-trihydroxy- | 72% to 208% |
| 216216 | Acids - Hydroxy Alpha | Acid Pathway | Citric acid | 206% to 541% |
| 216216 | Acids - Hydroxy Alpha | Carbohydrates | Glyceric acid | 153% to 255% |
| 216216 | Acids - Keto | Acid Pathway | 2-Ketoglutaric acid | 385% to 641% |
| 216216 | Amino Acids and Related Compounds | Amino Acids and Related Compounds | Glutamic acid | New |
| 216216 | Amino Acids and Related Compounds | Amino Acids and Related Compounds | Glycine | 433% to 2553% |
| 216216 | Carbohydrates | Carbohydrates | F3-U0.813 Carbohydrate | 98% to 163% |
| 216216 | Carbohydrates | Carbohydrates | F3-U0.816 Carbohydrate | 110% to 184% |
| 216216 | Carbohydrates | Carbohydrates | F3-U0.821 Carbohydrate | 206% to 344% |
| 216216 | Carbohydrates | Carbohydrates | F3-U0.825 Carbohydrate | 67% to 112% |
| 216216 | Carbohydrates | Carbohydrates | F3-U0.846 Carbohydrate | 86% to 143% |
| 216216 | Carbohydrates | Carbohydrates | F3-U0.872 Hexose | 70% to 116% |
| 216216 | Carbohydrates | Carbohydrates | F3-U1.189 Carbohydrate | -60% to -91% |
| 216216 | Carbohydrates | Carbohydrates | Fructose | -60% to -88% |
| 216216 | Carbohydrates | Carbohydrates | Galactose or Mannose | -60% to -81% |
| 216216 | Carbohydrates | Carbohydrates | Glucose | -66% to -100% |
| 216216 | NA | NA | F3-U0.785B | 185% to 309% |
| 216216 | NA | NA | F3-U0.852A | 147% to 245% |
| 216216 | Phenols and Related Compounds | Phenylpropanes and Derivatives | Chlorogenic acid | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216227

| Seq ID | Chemical Class | Biochemical Class | Compound Name | Modification |
|---|---|---|---|---|
| 216227 | Alkenes and Alkynes | Fatty Acids and Related Waxes | 2-Hexadecene, 3,7,11,15-tetramethyl- | New |
| 216227 | Sterols, Oxygenated Terpenes, and Other Isoprenoids | Terpenoids | beta-Sitosterol | 60% to 103% |
| 216227 | Sterols, Oxygenated Terpenes, and Other Isoprenoids | Prenylquinones | beta-Tocopherol | New |
| 216227 | Sterols, Oxygenated Terpenes, and Other Isoprenoids | Terpenoids | Stigmastan-3-ol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216230

| Seq ID | Chemical Class | Biochemical Class | Compound Name | Modification |
|---|---|---|---|---|
| 216230 | Amino Acids and Related Compounds | Amino Acids and Related Compounds | Arginine | 40% to 155% |
| 216230 | Amino Acids and Related Compounds | Amino Acids and Related Compounds | Histidine | 70% to 650% |
| 216230 | Amino Acids and Related Compounds | Amino Acids and Related Compounds | Lysine | 50% to 665% |
| 216230 | Amino Acids and Related Compounds | Amino Acids and Related Compounds | Methionine | 40% to 180% |
| 216230 | Amino Acids and Related Compounds | Amino Acids and Related Compounds | Serine | 45% to 185% |
| 216230 | Amino Acids and Related Compounds | Amino Acids and Related Compounds | Threonine | 45% to 260% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216237

| Seq ID | Chemical Class | Biochemical Class | Compound Name | Modification |
|---|---|---|---|---|
| 216237 | Amino Acids and Related Compounds | Amino Acids and Related Compounds | Alanine | 10% to 95% |
| 216237 | Amino Acids and Related Compounds | Amino Acids and Related Compounds | Arginine | 70% to 205% |
| 216237 | Amino Acids and Related Compounds | Amino Acids and Related Compounds | Cysteine | 10% to 335% |
| 216237 | Amino Acids and Related Compounds | Amino Acids and Related Compounds | Glycine | 10% to 115% |
| 216237 | Amino Acids and Related Compounds | Amino Acids and Related Compounds | Lysine | -25% to -75% |
| 216237 | Amino Acids and Related Compounds | Amino Acids and Related Compounds | Phenylalanine | 5% to 120% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216238

| Seq ID | Chemical Class | Biochemical Class | Compound Name | Modification |
|---|---|---|---|---|
| 216238 | Amino Acids and Related Compounds | Amino Acids and Related Compounds | Arginine | 85% to 230% |
| 216238 | Amino Acids and Related Compounds | Amino Acids and Related Compounds | Tryptophan | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216240

| Seq ID | Chemical Class | Biochemical Class | Compound Name | Modification |
|---|---|---|---|---|
| 216240 | Acids | Acids | Carbamic acid | 269% to 448% |
| 216240 | Acids - Hydroxy Alpha | Acid Pathway | Butanoic acid, 2,3,4-trihydroxy- | 473% to 788% |
| 216240 | Acids - Hydroxy Alpha | Carbohydrates | Glyceric acid | 2206% to 3677% |
| 216240 | Acids - Hydroxy Alpha | Acid Pathway | Malic acid | 689% to 1149% |
| 216240 | Acids - Hydroxy Alpha | Carbohydrates | Quinic acid | 407% to 678% |
| 216240 | Amino Acids and Related Compounds | Amino Acids and Related Compounds | Aspartic acid | 60% to 68% |
| 216240 | Amino Acids and Related Compounds | Amino Acids and Related Compounds | Glutamic acid | New |
| 216240 | Amino Acids and Related Compounds | Amino Acids and Related Compounds | Glycine | 129% to 215% |
| 216240 | Amino Acids and Related Compounds | Amino Acids and Related Compounds | Proline, 5-oxo- | 60% to 94% |
| 216240 | Carbohydrates | Carbohydrates | F3-U0.825 Carbohydrate | 214% to 357% |
| 216240 | Carbohydrates | Carbohydrates | F3-U0.846 Carbohydrate | 479% to 798% |
| 216240 | Carbohydrates | Carbohydrates | F3-U0.848 Carbohydrate | 334% to 557% |
| 216240 | Carbohydrates | Carbohydrates | F3-U0.872 Hexose | 792% to 1320% |
| 216240 | Carbohydrates | Carbohydrates | Fructose | 544% to 1413% |
| 216240 | Carbohydrates | Carbohydrates | Glucose | 376% to 2029% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216241

| Seq ID | Chemical Class | Biochemical Class | Compound Name | Modification |
|---|---|---|---|---|
| 216241 | Acids - Fatty | Fatty Acids and Related Waxes | Eicosanoic acid | -31% to -62% |
| 216241 | Acids - Fatty | Fatty Acids and Related Waxes | Hexadecanoic acid | -6% to -29% |
| 216241 | Acids - Fatty | Fatty Acids and Related Waxes | Octadecanoic acid | -21% to -31% |
| 216241 | Acids - Fatty Unsat | Fatty Acids and Related Waxes | 9,12-Octadecadienoic acid | 6% to 37% |
| 216241 | Acids - Fatty Unsat | Fatty Acids and Related Waxes | 9-Hexadecenoic acid | -58% to -89% |
| 216241 | Acids - Fatty Unsat | Fatty Acids and Related Waxes | 9-Octadecenoic acid | 24% to 112% |
| 216241 | Amino Acids and Related Compounds | Amino Acids and Related Compounds | Arginine | 65% to 1480% |
| 216241 | Amino Acids and Related Compounds | Amino Acids and Related Compounds | Glycine | 75% to 380% |
| 216241 | Amino Acids and Related Compounds | Amino Acids and Related Compounds | Phenylalanine | 1% to 150% |
| 216241 | Amino Acids and Related Compounds | Amino Acids and Related Compounds | Threonine | 20% to 120% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216242

| Seq ID | Chemical Class | Biochemical Class | Compound Name | Modification |
|---|---|---|---|---|
| 216242 | Acids - Fatty | Fatty Acids and Related Waxes | Hexadecanoic acid | -3% to -10% |
| 216242 | Acids - Fatty Unsat | Fatty Acids and Related Waxes | 7,10,13-Hexadecatrienoic acid | -17% to -31% |
| 216242 | Acids - Fatty Unsat | Fatty Acids and Related Waxes | 9,12,15-Octadecatrienoic acid | -7% to -14% |
| 216242 | Acids - Fatty Unsat | Fatty Acids and Related Waxes | 9,12-Octadecadienoic acid | 8% to 38% |
| 216242 | Acids - Fatty Unsat | Fatty Acids and Related Waxes | 9-Octadecenoic acid | 7% to 237% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216246

| Seq ID | Chemical Class | Biochemical Class | Compound Name | Modification |
|---|---|---|---|---|
| 216246 | Acids - Fatty Unsat | Fatty Acids and Related Waxes | 9,12-Octadecadienoic acid | 5% to 17% |
| 216246 | Amino Acids and Related Compounds | Amino Acids and Related Compounds | Lysine | 5% to 215% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216249

| Seq ID | Chemical Class | Biochemical Class | Compound Name | Modification |
|---|---|---|---|---|
| 216249 | Amino Acids and Related Compounds | Amino Acids and Related Compounds | Alanine | 90% to 395% |
| 216249 | Amino Acids and Related Compounds | Amino Acids and Related Compounds | Arginine | 60% to 190% |
| 216249 | Amino Acids and Related Compounds | Amino Acids and Related Compounds | Serine | 25% to 140% |
| 216249 | Amino Acids and Related Compounds | Amino Acids and Related Compounds | Valine | 20% to 185% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216257

| Seq ID | Chemical Class | Biochemical Class | Compound Name | Modification |
|---|---|---|---|---|
| 216257 | Amino Acids and Related Compounds | Amino Acids and Related Compounds | Arginine | 50% to 165% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216259

| Seq ID | Chemical Class | Biochemical Class | Compound Name | Modification |
|--------|----------------|-------------------|---------------|--------------|
| 216259 | Acids - Fatty | Fatty Acids and Related Waxes | Eicosanoic acid | -54% to -81% |
| 216259 | Acids - Fatty | Fatty Acids and Related Waxes | Hexadecanoic acid | 5% to 24% |
| 216259 | Acids - Fatty | Fatty Acids and Related Waxes | Octadecanoic acid | -18% to -41% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216262

| Seq ID | Chemical Class | Biochemical Class | Compound Name | Modification |
|---|---|---|---|---|
| 216262 | Amino Acids and Related Compounds | Amino Acids and Related Compounds | Arginine | 115% to 290% |
| 216262 | Amino Acids and Related Compounds | Amino Acids and Related Compounds | Isoleucine | 140% to 465% |
| 216262 | Amino Acids and Related Compounds | Amino Acids and Related Compounds | Leucine | 60% to 905% |
| 216262 | Amino Acids and Related Compounds | Amino Acids and Related Compounds | Phenylalanine | 60% to 295% |
| 216262 | Amino Acids and Related Compounds | Amino Acids and Related Compounds | Tyrosine | 55% to 190% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216268

| Seq ID | Chemical Class | Biochemical Class | Compound Name | Modification |
|---|---|---|---|---|
| 216268 | Amino Acids and Related Compounds | Amino Acids and Related Compounds | Alanine | 5% to 130% |
| 216268 | Amino Acids and Related Compounds | Amino Acids and Related Compounds | Arginine | 245% to 1840% |
| 216268 | Amino Acids and Related Compounds | Amino Acids and Related Compounds | Aspartic acid | 5% to 105% |
| 216268 | Amino Acids and Related Compounds | Amino Acids and Related Compounds | Cysteine | 10% to 480% |
| 216268 | Amino Acids and Related Compounds | Amino Acids and Related Compounds | Glutamic acid | 10% to 75% |
| 216268 | Amino Acids and Related Compounds | Amino Acids and Related Compounds | Glycine | 10% to 360% |
| 216268 | Amino Acids and Related Compounds | Amino Acids and Related Compounds | Methionine | 10% to 80% |
| 216268 | Amino Acids and Related Compounds | Amino Acids and Related Compounds | Phenylalanine | 5% to 225% |
| 216268 | Amino Acids and Related Compounds | Amino Acids and Related Compounds | Threonine | 5% to 110% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216272

| Seq ID | Chemical Class | Biochemical Class | Compound Name | Modification |
|---|---|---|---|---|
| 216272 | Amino Acids and Related Compounds | Amino Acids and Related Compounds | Alanine | 5% to 90% |
| 216272 | Amino Acids and Related Compounds | Amino Acids and Related Compounds | Arginine | 25% to 605% |
| 216272 | Amino Acids and Related Compounds | Amino Acids and Related Compounds | Aspartic acid | 5% to 90% |
| 216272 | Amino Acids and Related Compounds | Amino Acids and Related Compounds | Cysteine | 90% to 270% |
| 216272 | Amino Acids and Related Compounds | Amino Acids and Related Compounds | Glutamic acid | 10% to 75% |
| 216272 | Amino Acids and Related Compounds | Amino Acids and Related Compounds | Glycine | 85% to 220% |
| 216272 | Amino Acids and Related Compounds | Amino Acids and Related Compounds | Methionine | 10% to 65% |
| 216272 | Amino Acids and Related Compounds | Amino Acids and Related Compounds | Phenylalanine | 15% to 135% |
| 216272 | Amino Acids and Related Compounds | Amino Acids and Related Compounds | Threonine | 20% to 65% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216274

| Seq ID | Chemical Class | Biochemical Class | Compound Name | Modification |
|---|---|---|---|---|
| 216274 | Acids - Fatty | Fatty Acids and Related Waxes | Octadecanoic acid | 7% to 38% |
| 216274 | Acids - Fatty Unsat | Fatty Acids and Related Waxes | 9-Hexadecenoic acid | -15% to -27% |
| 216274 | Acids - Fatty Unsat | Fatty Acids and Related Waxes | 9-Octadecenoic acid | 21% to 72% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216280

| Seq ID | Chemical Class | Biochemical Class | Compound Name | Modification |
|---|---|---|---|---|
| 216280 | Amino Acids and Related Compounds | Amino Acids and Related Compounds | Cysteine | 220% to 1025% |
| 216280 | Amino Acids and Related Compounds | Amino Acids and Related Compounds | Glycine | 275% to 820% |
| 216280 | Amino Acids and Related Compounds | Amino Acids and Related Compounds | Isoleucine | 40% to 295% |
| 216280 | Amino Acids and Related Compounds | Amino Acids and Related Compounds | Threonine | 25% to 125% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216284

| Seq ID | Chemical Class | Biochemical Class | Compound Name | Modification |
|---|---|---|---|---|
| 216284 | Amino Acids and Related Compounds | Amino Acids and Related Compounds | Glycine | 25% to 205% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216286

| Seq ID | Chemical Class | Biochemical Class | Compound Name | Modification |
|---|---|---|---|---|
| 216286 | Acids - Fatty | Fatty Acids and Related Waxes | Hexadecanoic acid | 6% to 12% |
| 216286 | Acids - Fatty Unsat | Fatty Acids and Related Waxes | 9,12,15-Octadecatrienoic acid | -2% to -6% |
| 216286 | Acids - Fatty Unsat | Fatty Acids and Related Waxes | 9,12-Octadecadienoic acid | 4% to 19% |
| 216286 | Amino Acids and Related Compounds | Amino Acids and Related Compounds | Cysteine | 75% to 570% |
| 216286 | Amino Acids and Related Compounds | Amino Acids and Related Compounds | Glycine | 25% to 765% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#216287

| Seq ID | Chemical Class | Biochemical Class | Compound Name | Modification |
|---|---|---|---|---|
| 216287 | Acids - Fatty | Fatty Acids and Related Waxes | Hexadecanoic acid | 4% to 22% |
| 216287 | Acids - Fatty | Fatty Acids and Related Waxes | Octadecanoic acid | 32% to 96% |
| 216287 | Acids - Fatty Unsat | Fatty Acids and Related Waxes | 9,12,15-Octadecatrienoic acid | -1% to -8% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216304

| Seq ID | Chemical Class | Biochemical Class | Compound Name | Modification |
|---|---|---|---|---|
| 216304 | Acids - Fatty Unsat | Fatty Acids and Related Waxes | 9,12-Octadecadienoic acid | 5% to 19% |
| 216304 | Acids - Fatty Unsat | Fatty Acids and Related Waxes | 9-Octadecenoic acid | 28% to 121% |
| 216304 | Amino Acids and Related Compounds | Amino Acids and Related Compounds | Arginine | 50% to 450% |
| 216304 | Amino Acids and Related Compounds | Amino Acids and Related Compounds | Cysteine | 10% to 450% |
| 216304 | Amino Acids and Related Compounds | Amino Acids and Related Compounds | Glycine | 10% to 650% |
| 216304 | Amino Acids and Related Compounds | Amino Acids and Related Compounds | Phenylalanine | 15% to 185% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216315

| Seq ID | Chemical Class | Biochemical Class | Compound Name | Modification |
|---|---|---|---|---|
| 216315 | Acids - Fatty Unsat | Fatty Acids and Related Waxes | 9,12-Octadecadienoic acid | 4% to 28% |
| 216315 | Amino Acids and Related Compounds | Amino Acids and Related Compounds | Alanine | 25% to 160% |
| 216315 | Amino Acids and Related Compounds | Amino Acids and Related Compounds | Glycine | 25% to 205% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216319

| Seq ID | Chemical Class | Biochemical Class | Compound Name | Modification |
|---|---|---|---|---|
| 216319 | Acids - Fatty | Fatty Acids and Related Waxes | Eicosanoic acid | 11% to 239% |
| 216319 | Acids - Fatty | Fatty Acids and Related Waxes | Hexadecanoic acid | 14% to 30% |
| 216319 | Acids - Fatty | Fatty Acids and Related Waxes | Octadecanoic acid | 73% to 165% |
| 216319 | Acids - Fatty Branched | Fatty Acids and Related Waxes | Hexadecanoic acid, 14-methyl- | -38% to -51% |
| 216319 | Acids - Fatty Unsat | Fatty Acids and Related Waxes | 9,12,15-Octadecatrienoic acid | -15% to -30% |
| 216319 | Acids - Fatty Unsat | Fatty Acids and Related Waxes | 9,12-Octadecadienoic acid | 4% to 20% |
| 216319 | Acids - Fatty Unsat | Fatty Acids and Related Waxes | 9-Hexadecenoic acid | -39% to -52% |
| 216319 | Acids - Fatty Unsat | Fatty Acids and Related Waxes | 9-Octadecenoic acid | 80% to 480% |
| 216319 | Amino Acids and Related Compounds | Amino Acids and Related Compounds | Lysine | 60% to 350% |
| 216319 | Amino Acids and Related Compounds | Amino Acids and Related Compounds | Methionine | 15% to 275% |
| 216319 | Amino Acids and Related Compounds | Amino Acids and Related Compounds | Phenylalanine | 10% to 2000% |
| 216319 | Amino Acids and Related Compounds | Amino Acids and Related Compounds | Threonine | 5% to 175% |
| 216319 | Amino Acids and Related Compounds | Amino Acids and Related Compounds | Valine | 200% to 630% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216332

| Seq ID | Chemical Class | Biochemical Class | Compound Name | Modification |
|---|---|---|---|---|
| 216332 | Amino Acids and Related Compounds | Amino Acids and Related Compounds | Alanine | 10% to 115% |
| 216332 | Amino Acids and Related Compounds | Amino Acids and Related Compounds | Cysteine | 10% to 345% |
| 216332 | Amino Acids and Related Compounds | Amino Acids and Related Compounds | Glutamic acid | 1% to 105% |
| 216332 | Amino Acids and Related Compounds | Amino Acids and Related Compounds | Glycine | 20% to 315% |
| 216332 | Amino Acids and Related Compounds | Amino Acids and Related Compounds | Lysine | -40% to -70% |
| 216332 | Amino Acids and Related Compounds | Amino Acids and Related Compounds | Phenylalanine | 10% to 125% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216339

| Seq ID | Chemical Class | Biochemical Class | Compound Name | Modification |
|---|---|---|---|---|
| 216339 | Amino Acids and Related Compounds | Amino Acids and Related Compounds | Alanine | 30% to 165% |
| 216339 | Amino Acids and Related Compounds | Amino Acids and Related Compounds | Arginine | 30% to 1040% |
| 216339 | Amino Acids and Related Compounds | Amino Acids and Related Compounds | Cysteine | 5% to 130% |
| 216339 | Amino Acids and Related Compounds | Amino Acids and Related Compounds | Glutamic acid | 15% to 90% |
| 216339 | Amino Acids and Related Compounds | Amino Acids and Related Compounds | Glycine | 5% to 105% |
| 216339 | Amino Acids and Related Compounds | Amino Acids and Related Compounds | Methionine | -30% to -60% |
| 216339 | Amino Acids and Related Compounds | Amino Acids and Related Compounds | Phenylalanine | 35% to 185% |
| 216339 | Amino Acids and Related Compounds | Amino Acids and Related Compounds | Serine | 10% to 90% |
| 216339 | Amino Acids and Related Compounds | Amino Acids and Related Compounds | Threonine | 10% to 205% |
| 216339 | Amino Acids and Related Compounds | Amino Acids and Related Compounds | Valine | 5% to 350% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216345

| Seq ID | Chemical Class | Biochemical Class | Compound Name | Modification |
|---|---|---|---|---|
| 216345 | Amino Acids and Related Compounds | Amino Acids and Related Compounds | Isoleucine | 130% to 550% |
| 216345 | Amino Acids and Related Compounds | Amino Acids and Related Compounds | Methionine | 35% to 340% |
| 216345 | Amino Acids and Related Compounds | Amino Acids and Related Compounds | Valine | 90% to 365% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216349

| Seq ID | Chemical Class | Biochemical Class | Compound Name | Modification |
|---|---|---|---|---|
| 216349 | Acids - Fatty Unsat | Fatty Acids and Related Waxes | 9-Octadecenoic acid | 60% to 144% |
| 216349 | Amino Acids and Related Compounds | Amino Acids and Related Compounds | Alanine | 60% to 185% |
| 216349 | Amino Acids and Related Compounds | Amino Acids and Related Compounds | Arginine | 70% to 350% |
| 216349 | Amino Acids and Related Compounds | Amino Acids and Related Compounds | Glycine | 60% to 265% |
| 216349 | Sterols, Oxygenated Terpenes, and Other Isoprenoids | Prenylquinones | alpha-Tocopherol | -60% to -82% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#216352

| Seq ID | Chemical Class | Biochemical Class | Compound Name | Modification |
|---|---|---|---|---|
| 216352 | Amino Acids and Related Compounds | Amino Acids and Related Compounds | Proline | 30% to 265% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216360

| Seq ID | Chemical Class | Biochemical Class | Compound Name | Modification |
|---|---|---|---|---|
| 216360 | Acids - Fatty Unsat | Fatty Acids and Related Waxes | 9,12-Octadecadienoic acid | -12% to -21% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216371

| Seq ID | Chemical Class | Biochemical Class | Compound Name | Modification |
|---|---|---|---|---|
| 216371 | Acids - Fatty | Fatty Acids and Related Waxes | Eicosanoic acid | -27% to -72% |
| 216371 | Acids - Fatty | Fatty Acids and Related Waxes | Hexadecanoic acid | 2% to 8% |
| 216371 | Acids - Fatty Unsat | Fatty Acids and Related Waxes | 9,12,15-Octadecatrienoic acid | -4% to -8% |
| 216371 | Acids - Fatty Unsat | Fatty Acids and Related Waxes | 9,12-Octadecadienoic acid | 4% to 28% |
| 216371 | Amino Acids and Related Compounds | Amino Acids and Related Compounds | Arginine | 40% to 1400% |
| 216371 | Amino Acids and Related Compounds | Amino Acids and Related Compounds | Aspartic acid | 10% to 175% |
| 216371 | Amino Acids and Related Compounds | Amino Acids and Related Compounds | Cysteine | 1% to 495% |
| 216371 | Amino Acids and Related Compounds | Amino Acids and Related Compounds | Glycine | 35% to 510% |
| 216371 | Amino Acids and Related Compounds | Amino Acids and Related Compounds | Histidine | 35% to 270% |
| 216371 | Amino Acids and Related Compounds | Amino Acids and Related Compounds | Phenylalanine | 1% to 155% |
| 216371 | Amino Acids and Related Compounds | Amino Acids and Related Compounds | Threonine | 30% to 140% |
| 216371 | Amino Acids and Related Compounds | Amino Acids and Related Compounds | Valine | 15% to 190% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216373

| Seq ID | Chemical Class | Biochemical Class | Compound Name | Modification |
|--------|----------------|-------------------|---------------|--------------|
| 216373 | Amino Acids and Related Compounds | Amino Acids and Related Compounds | Cysteine | 40% to 625% |
| 216373 | Amino Acids and Related Compounds | Amino Acids and Related Compounds | Glutamic acid | 5% to 60% |
| 216373 | Amino Acids and Related Compounds | Amino Acids and Related Compounds | Glycine | 40% to 500% |
| 216373 | Amino Acids and Related Compounds | Amino Acids and Related Compounds | Proline | 45% to 200% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216384

| Seq ID | Chemical Class | Biochemical Class | Compound Name | Modification |
|---|---|---|---|---|
| 216384 | Amino Acids and Related Compounds | Amino Acids and Related Compounds | Lysine | 25% to 135% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216387

| Seq ID | Chemical Class | Biochemical Class | Compound Name | Modification |
|---|---|---|---|---|
| 216387 | Acids - Fatty | Fatty Acids and Related Waxes | Octadecanoic acid | 4% to 29% |
| 216387 | Acids - Fatty Unsat | Fatty Acids and Related Waxes | 9,12-Octadecadienoic acid | 5% to 22% |
| 216387 | Acids - Fatty Unsat | Fatty Acids and Related Waxes | 9-Octadecenoic acid | 23% to 111% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#216406

| Seq ID | Chemical Class | Biochemical Class | Compound Name | Modification |
|---|---|---|---|---|
| 216406 | Acids - Fatty | Fatty Acids and Related Waxes | Hexadecanoic acid | 8% to 28% |
| 216406 | Acids - Fatty | Fatty Acids and Related Waxes | Octadecanoic acid | 34% to 191% |
| 216406 | Acids - Fatty Unsat | Fatty Acids and Related Waxes | 9,12,15-Octadecatrienoic acid | -4% to -11% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216419

| Seq ID | Chemical Class | Biochemical Class | Compound Name | Modification |
|---|---|---|---|---|
| 216419 | Amino Acids and Related Compounds | Amino Acids and Related Compounds | Aspartic acid | 10% to 25% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216425

| Seq ID | Chemical Class | Biochemical Class | Compound Name | Modification |
|---|---|---|---|---|
| 216425 | Acids - Fatty Unsat | Fatty Acids and Related Waxes | 9,12,15-Octadecatrienoic acid | 2% to 5% |
| 216425 | Acids - Fatty Unsat | Fatty Acids and Related Waxes | 9-Hexadecenoic acid | 34% to 54% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216429

| Seq ID | Chemical Class | Biochemical Class | Compound Name | Modification |
|---|---|---|---|---|
| 216429 | Acids - Hydroxy Alpha | Acid Pathway | Citric acid | 64% to 106% |
| 216429 | Acids - Hydroxy Alpha | Acid Pathway | Malic acid | 79% to 131% |
| 216429 | Acids - Hydroxy Alpha | Carbohydrates | Quinic acid | 60% to 141% |
| 216429 | Amino Acids and Related Compounds | Amino Acids and Related Compounds | Proline, 5-oxo- | 69% to 114% |
| 216429 | Carbohydrates | Carbohydrates | F3-U0.846 Carbohydrate | New |
| 216429 | Carbohydrates | Carbohydrates | F3-U0.872 Hexose | 266% to 443% |
| 216429 | Carbohydrates | Carbohydrates | Fructose | 69% to 409% |
| 216429 | Carbohydrates | Carbohydrates | Glucose | 60% to 512% |
| 216429 | Carbohydrates | Carbohydrates | Xylose | 169% to 282% |
| 216429 | NA | NA | F3-U0.882 | 60% to 76% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216430

| Seq ID | Chemical Class | Biochemical Class | Compound Name | Modification |
|---|---|---|---|---|
| 216430 | Acids - Hydroxy Alpha | Carbohydrates | Quinic acid | 60% to 94% |
| 216430 | Amino Acids and Related Compounds | Amino Acids and Related Compounds | Proline, 5-oxo- | 130% to 290% |
| 216430 | Carbohydrates | Carbohydrates | F3-U0.848 Carbohydrate | New |
| 216430 | Carbohydrates | Carbohydrates | F3-U0.872 Hexose | 405% to 675% |
| 216430 | Carbohydrates | Carbohydrates | Fructose | 157% to 381% |
| 216430 | Carbohydrates | Carbohydrates | Glucose | 181% to 415% |
| 216430 | NA | NA | F3-U0.882 | 60% to 78% |
| 216430 | NA | NA | F3-U1.253 | 65% to 108% |
| 216430 | NA | NA | F3-U1.255 | 64% to 107% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216432

| Seq ID | Chemical Class | Biochemical Class | Compound Name | Modification |
|---|---|---|---|---|
| 216432 | Amino Acids and Related Compounds | Amino Acids and Related Compounds | Alanine | 15% to 265% |
| 216432 | Amino Acids and Related Compounds | Amino Acids and Related Compounds | Aspartic acid | -20% to -30% |
| 216432 | Amino Acids and Related Compounds | Amino Acids and Related Compounds | Cysteine | 35% to 285% |
| 216432 | Amino Acids and Related Compounds | Amino Acids and Related Compounds | Glutamic acid | 10% to 35% |
| 216432 | Amino Acids and Related Compounds | Amino Acids and Related Compounds | Glycine | 20% to 980% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216433

| Seq ID | Chemical Class | Biochemical Class | Compound Name | Modification |
|---|---|---|---|---|
| 216433 | Acids - Hydroxy Alpha | Acid Pathway | Butanoic acid, 2,3,4-trihydroxy- | New |
| 216433 | Acids - Hydroxy Alpha | Acid Pathway | Malic acid | 90% to 439% |
| 216433 | Acids - Hydroxy Alpha | Carbohydrates | Quinic acid | 131% to 347% |
| 216433 | Alcohols | Carbohydrates | Inositol | 169% to 281% |
| 216433 | Amino Acids and Related Compounds | Amino Acids and Related Compounds | Proline, 5-oxo- | 80% to 134% |
| 216433 | Carbohydrates | Carbohydrates | F3-U0.821 Carbohydrate | New |
| 216433 | Carbohydrates | Carbohydrates | F3-U0.846 Carbohydrate | New |
| 216433 | Carbohydrates | Carbohydrates | F3-U0.872 Hexose | 520% to 866% |
| 216433 | Carbohydrates | Carbohydrates | Fructose | 80% to 3731% |
| 216433 | Carbohydrates | Carbohydrates | Galactose or Mannose | New |
| 216433 | Carbohydrates | Carbohydrates | Glucose | New |
| 216433 | NA | NA | F3-U0.751 | 254% to 423% |
| 216433 | NA | NA | F3-U0.882 | 60% to 194% |
| 216433 | NA | NA | F3-U1.253 | 68% to 113% |
| 216433 | NA | NA | F3-U1.255 | 60% to 89% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216449

| Seq ID | Chemical Class | Biochemical Class | Compound Name | Modification |
|---|---|---|---|---|
| 216449 | Acids - Fatty | Fatty Acids and Related Waxes | Hexadecanoic acid | 2% to 41% |
| 216449 | Acids - Fatty | Fatty Acids and Related Waxes | Octadecanoic acid | 47% to 81% |
| 216449 | Acids - Fatty Unsat | Fatty Acids and Related Waxes | 9,12,15-Octadecatrienoic acid | -4% to -8% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216463

| Seq ID | Chemical Class | Biochemical Class | Compound Name | Modification |
|---|---|---|---|---|
| 216463 | Amino Acids and Related Compounds | Amino Acids and Related Compounds | Aspartic acid | -30% to -60% |
| 216463 | Amino Acids and Related Compounds | Amino Acids and Related Compounds | Cysteine | 35% to 160% |
| 216463 | Amino Acids and Related Compounds | Amino Acids and Related Compounds | Glycine | 30% to 130% |
| 216463 | Amino Acids and Related Compounds | Amino Acids and Related Compounds | Lysine | -30% to -65% |
| 216463 | Amino Acids and Related Compounds | Amino Acids and Related Compounds | Methionine | 15% to 70% |
| 216463 | Amino Acids and Related Compounds | Amino Acids and Related Compounds | Phenylalanine | 10% to 135% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216465

| Seq ID | Chemical Class | Biochemical Class | Compound Name | Modification |
|---|---|---|---|---|
| 216465 | Acids - Fatty | Fatty Acids and Related Waxes | Hexadecanoic acid | 4% to 18% |
| 216465 | Acids - Fatty | Fatty Acids and Related Waxes | Octadecanoic acid | New |
| 216465 | Acids - Fatty Unsat | Fatty Acids and Related Waxes | 7,10,13-Hexadecatrienoic acid | New |
| 216465 | Acids - Fatty Unsat | Fatty Acids and Related Waxes | 9,12,15-Octadecatrienoic acid | New |
| 216465 | Acids - Fatty Unsat | Fatty Acids and Related Waxes | 9,12-Octadecadienoic acid | New |
| 216465 | Acids - Fatty Unsat | Fatty Acids and Related Waxes | 9-Octadecenoic acid | New |
| 216465 | Amino Acids and Related Compounds | Amino Acids and Related Compounds | Arginine | New |
| 216465 | Amino Acids and Related Compounds | Amino Acids and Related Compounds | Aspartic acid | New |
| 216465 | Amino Acids and Related Compounds | Amino Acids and Related Compounds | Histidine | New |
| 216465 | Amino Acids and Related Compounds | Amino Acids and Related Compounds | Isoleucine | New |
| 216465 | Amino Acids and Related Compounds | Amino Acids and Related Compounds | Leucine | New |
| 216465 | Amino Acids and Related Compounds | Amino Acids and Related Compounds | Lysine | New |
| 216465 | Amino Acids and Related Compounds | Amino Acids and Related Compounds | Methionine | New |
| 216465 | Amino Acids and Related Compounds | Amino Acids and Related Compounds | Phenylalanine | New |
| 216465 | Amino Acids and Related Compounds | Amino Acids and Related Compounds | Threonine | New |
| 216465 | Amino Acids and Related Compounds | Amino Acids and Related Compounds | Tyrosine | New |
| 216465 | Amino Acids and Related Compounds | Amino Acids and Related Compounds | Valine | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#216469

| Seq ID | Chemical Class | Biochemical Class | Compound Name | Modification |
|---|---|---|---|---|
| 216469 | Amino Acids and Related Compounds | Amino Acids and Related Compounds | Arginine | 20% to 700% |
| 216469 | Amino Acids and Related Compounds | Amino Acids and Related Compounds | Threonine | 40% to 195% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#218821

| Seq ID | Chemical Class | Biochemical Class | Compound Name | Modification |
|---|---|---|---|---|
| 218821 | Amino Acids and Related Compounds | Amino Acids and Related Compounds | Alanine | 30% to 135% |
| 218821 | Amino Acids and Related Compounds | Amino Acids and Related Compounds | Glycine | 5% to 390% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#218859

| Seq ID | Chemical Class | Biochemical Class | Compound Name | Modification |
|---|---|---|---|---|
| 218859 | Acids - Fatty Unsat | Fatty Acids and Related Waxes | 9,12,15-Octadecatrienoic acid | 3% to 11% |
| 218859 | Acids - Fatty Unsat | Fatty Acids and Related Waxes | 9-Hexadecenoic acid | -25% to -43% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#218904

| Seq ID | Chemical Class | Biochemical Class | Compound Name | Modification |
|---|---|---|---|---|
| 218904 | Amino Acids and Related Compounds | Amino Acids and Related Compounds | Aspartic acid | 40% to 95% |
| 218904 | Amino Acids and Related Compounds | Amino Acids and Related Compounds | Threonine | 75% to 210% |
| 218904 | Amino Acids and Related Compounds | Amino Acids and Related Compounds | Valine | 55% to 1155% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#218922

| Seq ID | Chemical Class | Biochemical Class | Compound Name | Modification |
|---|---|---|---|---|
| 218922 | Amino Acids and Related Compounds | Amino Acids and Related Compounds | Alanine | 45% to 165% |
| 218922 | Amino Acids and Related Compounds | Amino Acids and Related Compounds | Cysteine | 5% to 1060% |
| 218922 | Amino Acids and Related Compounds | Amino Acids and Related Compounds | Glycine | 5% to 410% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#218924

| Seq ID | Chemical Class | Biochemical Class | Compound Name | Modification |
|---|---|---|---|---|
| 218924 | Amino Acids and Related Compounds | Amino Acids and Related Compounds | Cysteine | 155% to 590% |
| 218924 | Amino Acids and Related Compounds | Amino Acids and Related Compounds | Threonine | 25% to 120% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#218926

| Seq ID | Chemical Class | Biochemical Class | Compound Name | Modification |
|---|---|---|---|---|
| 218926 | Amino Acids and Related Compounds | Amino Acids and Related Compounds | Alanine | 50% to 170% |
| 218926 | Amino Acids and Related Compounds | Amino Acids and Related Compounds | Glycine | 25% to 485% |
| 218926 | Amino Acids and Related Compounds | Amino Acids and Related Compounds | Threonine | 25% to 105% |
| 218926 | Amino Acids and Related Compounds | Amino Acids and Related Compounds | Valine | 35% to 210% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#218947

| Seq ID | Chemical Class | Biochemical Class | Compound Name | Modification |
|---|---|---|---|---|
| 218947 | Amino Acids and Related Compounds | Amino Acids and Related Compounds | Alanine | 45% to 160% |
| 218947 | Amino Acids and Related Compounds | Amino Acids and Related Compounds | Cysteine | 90% to 410% |
| 218947 | Amino Acids and Related Compounds | Amino Acids and Related Compounds | Glutamic acid | 10% to 145% |
| 218947 | Amino Acids and Related Compounds | Amino Acids and Related Compounds | Glycine | 25% to 505% |
| 218947 | Amino Acids and Related Compounds | Amino Acids and Related Compounds | Threonine | 20% to 195% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#218977

| Seq ID | Chemical Class | Biochemical Class | Compound Name | Modification |
|---|---|---|---|---|
| 218977 | Amino Acids and Related Compounds | Amino Acids and Related Compounds | Leucine | 45% to 235% |
| 218977 | Amino Acids and Related Compounds | Amino Acids and Related Compounds | Phenylalanine | 25% to 1830% |
| 218977 | Amino Acids and Related Compounds | Amino Acids and Related Compounds | Threonine | 25% to 110% |
| 218977 | Amino Acids and Related Compounds | Amino Acids and Related Compounds | Valine | 25% to 670% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#218985

| Seq ID | Chemical Class | Biochemical Class | Compound Name | Modification |
|--------|----------------|-------------------|---------------|--------------|
| 218985 | Amino Acids and Related Compounds | Amino Acids and Related Compounds | Alanine | 35% to 140% |
| 218985 | Amino Acids and Related Compounds | Amino Acids and Related Compounds | Glycine | 45% to 595% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#218986

| Seq ID | Chemical Class | Biochemical Class | Compound Name | Modification |
|---|---|---|---|---|
| 218986 | Amino Acids and Related Compounds | Amino Acids and Related Compounds | Glycine | 15% to 460% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219006

| Seq ID | Chemical Class | Biochemical Class | Compound Name | Modification |
|---|---|---|---|---|
| 219006 | Acids - Fatty | Fatty Acids and Related Waxes | Hexadecanoic acid | 1% to 13% |
| 219006 | Acids - Fatty | Fatty Acids and Related Waxes | Octadecanoic acid | 87% to 133% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219027

| Seq ID | Chemical Class | Biochemical Class | Compound Name | Modification |
|---|---|---|---|---|
| 219027 | Acids - Fatty Unsat | Fatty Acids and Related Waxes | 9,12-Octadecadienoic acid | 9% to 27% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219045

| Seq ID | Chemical Class | Biochemical Class | Compound Name | Modification |
|---|---|---|---|---|
| 219045 | Acids - Hydroxy Alpha | Acid Pathway | Malic acid | 60% to 94% |
| 219045 | Acids - Hydroxy Alpha | Carbohydrates | Quinic acid | -60% to -93% |
| 219045 | Alcohols | Carbohydrates | Inositol | -60% to -79% |
| 219045 | Amino Acids and Related Compounds | Amino Acids and Related Compounds | Glutamic acid | NQ |
| 219045 | Amino Acids and Related Compounds | Amino Acids and Related Compounds | Proline, 5-oxo- | 414% to 691% |
| 219045 | Carbohydrates | Carbohydrates | Galactose or Mannose | 152% to 253% |
| 219045 | NA | NA | F3-U0.709 | 98% to 164% |
| 219045 | NA | NA | F3-U0.799 | New |
| 219045 | NA | NA | F3-U0.882 | 161% to 268% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#219066

| Seq ID | Chemical Class | Biochemical Class | Compound Name | Modification |
|---|---|---|---|---|
| 219066 | Amino Acids and Related Compounds | Amino Acids and Related Compounds | Alanine | 75% to 160% |
| 219066 | Amino Acids and Related Compounds | Amino Acids and Related Compounds | Glycine | 10% to 415% |
| 219066 | Amino Acids and Related Compounds | Amino Acids and Related Compounds | Leucine | 90% to 210% |
| 219066 | Amino Acids and Related Compounds | Amino Acids and Related Compounds | Threonine | 40% to 120% |
| 219066 | Amino Acids and Related Compounds | Amino Acids and Related Compounds | Valine | 75% to 270% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219090

| Seq ID | Chemical Class | Biochemical Class | Compound Name | Modification |
|---|---|---|---|---|
| 219090 | Amino Acids and Related Compounds | Amino Acids and Related Compounds | Arginine | 55% to 195% |
| 219090 | Amino Acids and Related Compounds | Amino Acids and Related Compounds | Glycine | 75% to 720% |
| 219090 | Amino Acids and Related Compounds | Amino Acids and Related Compounds | Threonine | 30% to 155% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219108

| Seq ID | Chemical Class | Biochemical Class | Compound Name | Modification |
|---|---|---|---|---|
| 219108 | Acids - Fatty | Fatty Acids and Related Waxes | Hexadecanoic acid | 3% to 13% |
| 219108 | Acids - Fatty | Fatty Acids and Related Waxes | Octadecanoic acid | 11% to 39% |
| 219108 | Acids - Fatty Unsat | Fatty Acids and Related Waxes | 7,10,13-Hexadecatrienoic acid | 9% to 33% |
| 219108 | Acids - Fatty Unsat | Fatty Acids and Related Waxes | 9,12,15-Octadecatrienoic acid | -1% to -7% |
| 219108 | Acids - Fatty Unsat | Fatty Acids and Related Waxes | 9,12-Octadecadienoic acid | 9% to 19% |
| 219108 | Amino Acids and Related Compounds | Amino Acids and Related Compounds | Alanine | 5% to 260% |
| 219108 | Amino Acids and Related Compounds | Amino Acids and Related Compounds | Aspartic acid | 20% to 65% |
| 219108 | Amino Acids and Related Compounds | Amino Acids and Related Compounds | Glutamic acid | 15% to 45% |
| 219108 | Amino Acids and Related Compounds | Amino Acids and Related Compounds | Leucine | 40% to 130% |
| 219108 | Amino Acids and Related Compounds | Amino Acids and Related Compounds | Lysine | 40% to 645% |
| 219108 | Amino Acids and Related Compounds | Amino Acids and Related Compounds | Phenylalanine | 5% to 90% |
| 219108 | Amino Acids and Related Compounds | Amino Acids and Related Compounds | Serine | 60% to 200% |
| 219108 | Amino Acids and Related Compounds | Amino Acids and Related Compounds | Threonine | 25% to 100% |
| 219108 | Amino Acids and Related Compounds | Amino Acids and Related Compounds | Valine | 30% to 180% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219136

| Seq ID | Chemical Class | Biochemical Class | Compound Name | Modification |
|---|---|---|---|---|
| 219136 | Acids - Fatty | Fatty Acids and Related Waxes | Hexadecanoic acid | 5% to 19% |
| 219136 | Amino Acids and Related Compounds | Amino Acids and Related Compounds | Alanine | 370% to 590% |
| 219136 | Amino Acids and Related Compounds | Amino Acids and Related Compounds | Cysteine | 90% to 2360% |
| 219136 | Amino Acids and Related Compounds | Amino Acids and Related Compounds | Glutamic acid | 15% to 80% |
| 219136 | Amino Acids and Related Compounds | Amino Acids and Related Compounds | Glycine | 10% to 540% |
| 219136 | Amino Acids and Related Compounds | Amino Acids and Related Compounds | Leucine | 25% to 105% |
| 219136 | Amino Acids and Related Compounds | Amino Acids and Related Compounds | Phenylalanine | 30% to 125% |
| 219136 | Amino Acids and Related Compounds | Amino Acids and Related Compounds | Serine | 220% to 510% |
| 219136 | Amino Acids and Related Compounds | Amino Acids and Related Compounds | Threonine | 20% to 115% |
| 219136 | Amino Acids and Related Compounds | Amino Acids and Related Compounds | Valine | 1% to 180% |

FIG. 6 continued

A list of metabolite compounds present in altered levels relative to reference samples as charararacterized by gas chromatography, liquid chromatography, and/or mass spectrometry. This list corresponds to samples transfected with nucleic acid sequence, Seq ID#219145

| Seq ID | Chemical Class | Biochemical Class | Compound Name | Modification |
|---|---|---|---|---|
| 219145 | Amino Acids and Related Compounds | Amino Acids and Related Compounds | Threonine | 15% to 255% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219159

| Seq ID | Chemical Class | Biochemical Class | Compound Name | Modification |
|---|---|---|---|---|
| 219159 | Amino Acids and Related Compounds | Amino Acids and Related Compounds | Cysteine | 100% to 495% |
| 219159 | Amino Acids and Related Compounds | Amino Acids and Related Compounds | Glutamic acid | 5% to 140% |
| 219159 | Amino Acids and Related Compounds | Amino Acids and Related Compounds | Glycine | 65% to 435% |
| 219159 | Amino Acids and Related Compounds | Amino Acids and Related Compounds | Leucine | 185% to 570% |
| 219159 | Amino Acids and Related Compounds | Amino Acids and Related Compounds | Phenylalanine | 60% to 380% |
| 219159 | Amino Acids and Related Compounds | Amino Acids and Related Compounds | Valine | 145% to 395% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219178

| Seq ID | Chemical Class | Biochemical Class | Compound Name | Modification |
|---|---|---|---|---|
| 219178 | Acids - Fatty | Fatty Acids and Related Waxes | Eicosanoic acid | -17% to -43% |
| 219178 | Acids - Fatty Unsat | Fatty Acids and Related Waxes | 9,12,15-Octadecatrienoic acid | -4% to -7% |
| 219178 | Acids - Fatty Unsat | Fatty Acids and Related Waxes | 9,12-Octadecadienoic acid | 13% to 23% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219188

| Seq ID | Chemical Class | Biochemical Class | Compound Name | Modification |
|---|---|---|---|---|
| 219188 | Acids - Fatty | Fatty Acids and Related Waxes | Hexadecanoic acid | 1% to 9% |
| 219188 | Acids - Fatty Branched | Fatty Acids and Related Waxes | Hexadecanoic acid, 14-methyl- | -19% to -55% |
| 219188 | Acids - Fatty Unsat | Fatty Acids and Related Waxes | 9,12-Octadecadienoic acid | -11% to -29% |
| 219188 | Acids - Fatty Unsat | Fatty Acids and Related Waxes | 9-Hexadecenoic acid | -19% to -39% |
| 219188 | Amino Acids and Related Compounds | Amino Acids and Related Compounds | Alanine | 35% to 325% |
| 219188 | Amino Acids and Related Compounds | Amino Acids and Related Compounds | Cysteine | 20% to 340% |
| 219188 | Amino Acids and Related Compounds | Amino Acids and Related Compounds | Glycine | 5% to 325% |
| 219188 | Amino Acids and Related Compounds | Amino Acids and Related Compounds | Isoleucine | 215% to 650% |
| 219188 | Amino Acids and Related Compounds | Amino Acids and Related Compounds | Leucine | 15% to 470% |
| 219188 | Amino Acids and Related Compounds | Amino Acids and Related Compounds | Phenylalanine | 65% to 460% |
| 219188 | Amino Acids and Related Compounds | Amino Acids and Related Compounds | Serine | 50% to 195% |
| 219188 | Amino Acids and Related Compounds | Amino Acids and Related Compounds | Valine | 80% to 325% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#219193

| Seq ID | Chemical Class | Biochemical Class | Compound Name | Modification |
|---|---|---|---|---|
| 219193 | Acids - Fatty Unsat | Fatty Acids and Related Waxes | 9,12,15-Octadecatrienoic acid | -3% to -9% |
| 219193 | Acids - Fatty Unsat | Fatty Acids and Related Waxes | 9,12-Octadecadienoic acid | 11% to 27% |
| 219193 | Acids - Fatty Unsat | Fatty Acids and Related Waxes | 9-Octadecenoic acid | 31% to 149% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219218

| Seq ID | Chemical Class | Biochemical Class | Compound Name | Modification |
|---|---|---|---|---|
| 219218 | Acids - Fatty | Fatty Acids and Related Waxes | Hexadecanoic acid | 1% to 15% |
| 219218 | Acids - Fatty | Fatty Acids and Related Waxes | Octadecanoic acid | 33% to 64% |
| 219218 | Acids - Fatty Branched | Fatty Acids and Related Waxes | Hexadecanoic acid, 14-methyl- | -23% to -37% |
| 219218 | Acids - Fatty Unsat | Fatty Acids and Related Waxes | 7,10,13-Hexadecatrienoic acid | 3% to 31% |
| 219218 | Acids - Fatty Unsat | Fatty Acids and Related Waxes | 9,12,15-Octadecatrienoic acid | -5% to -7% |
| 219218 | Acids - Fatty Unsat | Fatty Acids and Related Waxes | 9,12-Octadecadienoic acid | 5% to 16% |
| 219218 | Amino Acids and Related Compounds | Amino Acids and Related Compounds | Alanine | 10% to 250% |
| 219218 | Amino Acids and Related Compounds | Amino Acids and Related Compounds | Aspartic acid | -35% to -65% |
| 219218 | Amino Acids and Related Compounds | Amino Acids and Related Compounds | Glutamic acid | 5% to 70% |
| 219218 | Amino Acids and Related Compounds | Amino Acids and Related Compounds | Glycine | 1% to 380% |
| 219218 | Amino Acids and Related Compounds | Amino Acids and Related Compounds | Isoleucine | 85% to 340% |
| 219218 | Amino Acids and Related Compounds | Amino Acids and Related Compounds | Leucine | 70% to 325% |
| 219218 | Amino Acids and Related Compounds | Amino Acids and Related Compounds | Phenylalanine | 55% to 440% |
| 219218 | Amino Acids and Related Compounds | Amino Acids and Related Compounds | Threonine | 60% to 155% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219244

| Seq ID | Chemical Class | Biochemical Class | Compound Name | Modification |
|---|---|---|---|---|
| 219244 | Amino Acids and Related Compounds | Amino Acids and Related Compounds | Cysteine | 50% to 345% |
| 219244 | Amino Acids and Related Compounds | Amino Acids and Related Compounds | Glutamic acid | 5% to 135% |
| 219244 | Amino Acids and Related Compounds | Amino Acids and Related Compounds | Glycine | 30% to 315% |
| 219244 | Amino Acids and Related Compounds | Amino Acids and Related Compounds | Valine | 5% to 110% |

FIG. 6 continued

A list of metabolite compounds present in altered levels relative to reference samples as chararcterized by gas chromatography, liquid chromatography, and/or mass spectrometry. This list corresponds to samples transfected with nucleic acid sequence, Seq ID#219269

| Seq ID | Chemical Class | Biochemical Class | Compound Name | Modification |
|---|---|---|---|---|
| 219269 | Acids - Fatty Unsat | Fatty Acids and Related Waxes | 9,12,15-Octadecatrienoic acid | -3% to -9% |
| 219269 | Acids - Fatty Unsat | Fatty Acids and Related Waxes | 9,12-Octadecadienoic acid | 15% to 43% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#219290

| Seq ID | Chemical Class | Biochemical Class | Compound Name | Modification |
|---|---|---|---|---|
| 219290 | Acids - Fatty Unsat | Fatty Acids and Related Waxes | 9,12-Octadecadienoic acid | 11% to 23% |
| 219290 | Amino Acids and Related Compounds | Amino Acids and Related Compounds | Arginine | 20% to 1490% |
| 219290 | Amino Acids and Related Compounds | Amino Acids and Related Compounds | Aspartic acid | 1% to 95% |
| 219290 | Amino Acids and Related Compounds | Amino Acids and Related Compounds | Cysteine | 60% to 1490% |
| 219290 | Amino Acids and Related Compounds | Amino Acids and Related Compounds | Glutamic acid | 10% to 75% |
| 219290 | Amino Acids and Related Compounds | Amino Acids and Related Compounds | Glycine | 15% to 1360% |
| 219290 | Amino Acids and Related Compounds | Amino Acids and Related Compounds | Phenylalanine | 15% to 140% |
| 219290 | Amino Acids and Related Compounds | Amino Acids and Related Compounds | Threonine | 10% to 95% |
| 219290 | Amino Acids and Related Compounds | Amino Acids and Related Compounds | Tyrosine | 5% to 120% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#23558 | | | |
|---|---|---|---|
| Seq ID | Chemical Class | Biochemical Class | Compound Name | Modification |
| 23558 | Acids | Acids | Carbamic acid | NQ |
| 23558 | Acids - Hydroxy Alpha | Acid Pathway | Citric acid | 366% to New |
| 23558 | Acids - Hydroxy Alpha | Acid Pathway | Malic acid | NQ |
| 23558 | Acids - Hydroxy Alpha | Carbohydrates | Quinic acid | -60% to -100% |
| 23558 | Alcohols | Carbohydrates | Inositol | -60% to -100% |
| 23558 | Amino Acids and Related Compounds | Amino Acids and Related Compounds | Asparagine | New |
| 23558 | Amino Acids and Related Compounds | Amino Acids and Related Compounds | Aspartic acid | New |
| 23558 | Amino Acids and Related Compounds | Amino Acids and Related Compounds | Glutamic acid | New |
| 23558 | Amino Acids and Related Compounds | Amino Acids and Related Compounds | Glutamine | New |
| 23558 | Amino Acids and Related Compounds | Amino Acids and Related Compounds | Lysine | New |
| 23558 | Amino Acids and Related Compounds | Amino Acids and Related Compounds | Proline, 5-oxo- | 120% to 954% |
| 23558 | Amino Acids and Related Compounds | Amino Acids and Related Compounds | Tyrosine | New |
| 23558 | Carbohydrates | Carbohydrates | F3-U0.813 Carbohydrate | New |
| 23558 | Carbohydrates | Carbohydrates | F3-U0.816 Carbohydrate | New |
| 23558 | Carbohydrates | Carbohydrates | F3-U0.821 Carbohydrate | New |
| 23558 | Carbohydrates | Carbohydrates | F3-U0.825 Carbohydrate | New |
| 23558 | Carbohydrates | Carbohydrates | F3-U0.846 Carbohydrate | 340% to 3130% |
| 23558 | Carbohydrates | Carbohydrates | F3-U0.872 Hexose | 187% to 603% |
| 23558 | Carbohydrates | Carbohydrates | F3-U0.952 Carbohydrate | New |
| 23558 | Carbohydrates | Carbohydrates | F3-U0.956 Carbohydrate | New |
| 23558 | Carbohydrates | Carbohydrates | F3-U1.037 Carbohydrate | New |
| 23558 | Carbohydrates | Carbohydrates | F3-U1.148 Carbohydrate | 60% to 80% |
| 23558 | Carbohydrates | Carbohydrates | F3-U1.150 Carbohydrate | 60% to 139% |
| 23558 | Carbohydrates | Carbohydrates | F3-U1.189 Carbohydrate | 81% to 237% |
| 23558 | Carbohydrates | Carbohydrates | F3-U1.194 Carbohydrate | 392% to 654% |
| 23558 | Carbohydrates | Carbohydrates | Fructose | -60% to -100% |
| 23558 | Carbohydrates | Carbohydrates | Glucose | -60% to -100% |
| 23558 | Carbohydrates | Carbohydrates | Sucrose | -67% to -100% |
| 23558 | NA | NA | F3-U0.736 | NQ |
| 23558 | NA | NA | F3-U0.745 | New |
| 23558 | NA | NA | F3-U0.838 | New |
| 23558 | NA | NA | F3-U0.882 | -60% to -97% |
| 23558 | NA | NA | F3-U0.890 | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#23777

| Seq ID | Chemical Class | Biochemical Class | Compound Name | Modification |
|---|---|---|---|---|
| 23777 | Acids - hydroxy Alpha | Carbohydrates | Galacturonic acid | -73% to -93% |
| 23777 | Carbohydrates | Carbohydrates | Arabinose | -61% to -100% |
| 23777 | Carbohydrates | Carbohydrates | Xylose | -29% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#23794

| Seq ID | Chemical Class | Biochemical Class | Compound Name | Modification |
|---|---|---|---|---|
| 23794 | Acids - Fatty | Fatty Acids and Related Waxes | Eicosanoic acid | -25% to -70% |
| 23794 | Acids - Fatty | Fatty Acids and Related Waxes | Hexadecanoic acid | 5% to 30% |
| 23794 | Acids - Fatty | Fatty Acids and Related Waxes | Octadecanoic acid | 5% to 55% |
| 23794 | Acids - Fatty Branched | Fatty Acids and Related Waxes | Hexadecanoic acid, 14-methyl- | -50% to -65% |
| 23794 | Acids - Fatty Unsat | Fatty Acids and Related Waxes | 7,10,13-Hexadecatrienoic acid | 10% to 45% |
| 23794 | Acids - Fatty Unsat | Fatty Acids and Related Waxes | 9,12,15-Octadecatrienoic acid | -5% to -20% |
| 23794 | Acids - Fatty Unsat | Fatty Acids and Related Waxes | 9,12-Octadecadienoic acid | 5% to 50% |
| 23794 | Acids - Fatty Unsat | Fatty Acids and Related Waxes | 9-Hexadecenoic acid | -10% to -85% |
| 23794 | Acids - Fatty Unsat | Fatty Acids and Related Waxes | 9-Octadecenoic acid | 10% to 140% |
| 23794 | Amino Acids and Related Compounds | Amino Acids and Related Compounds | Cysteine | 10% to 110% |
| 23794 | Amino Acids and Related Compounds | Amino Acids and Related Compounds | Glutamic acid | 5% to 90% |
| 23794 | Amino Acids and Related Compounds | Amino Acids and Related Compounds | Glycine | -60% to -85% |
| 23794 | Amino Acids and Related Compounds | Amino Acids and Related Compounds | Isoleucine | 10% to 195% |
| 23794 | Amino Acids and Related Compounds | Amino Acids and Related Compounds | Leucine | 1% to 105% |
| 23794 | Amino Acids and Related Compounds | Amino Acids and Related Compounds | Methionine | -35% to -60% |
| 23794 | Amino Acids and Related Compounds | Amino Acids and Related Compounds | Phenylalanine | 10% to 275% |
| 23794 | Amino Acids and Related Compounds | Amino Acids and Related Compounds | Serine | 5% to 130% |
| 23794 | Amino Acids and Related Compounds | Amino Acids and Related Compounds | Threonine | 5% to 215% |
| 23794 | Amino Acids and Related Compounds | Amino Acids and Related Compounds | Tryptophan | 5% to 810% |
| 23794 | Amino Acids and Related Compounds | Amino Acids and Related Compounds | Tyrosine | 10% to 470% |
| 23794 | Amino Acids and Related Compounds | Amino Acids and Related Compounds | Valine | 5% to 350% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#258904

| Seq ID | Chemical Class | Biochemical Class | Compound Name | Modification |
|---|---|---|---|---|
| 258904 | Acids - Hydroxy Alpha | Acid Pathway | Butanoic acid, 2,3,4-trihydroxy- | 419% to 699% |
| 258904 | Acids - Fatty | Fatty Acids and Related Waxes | Eicosanoic acid | -60% to -74% |
| 258904 | Acids - Fatty | Fatty Acids and Related Waxes | Hexadecanoic acid | 6% to 12% |
| 258904 | Acids - Fatty Branched | Fatty Acids and Related Waxes | Heptadecanoic acid, 16-methyl- | -60% to -65% |
| 258904 | Acids - Hydroxy Alpha | Carbohydrates | Quinic acid | 151% to 251% |
| 258904 | Alkaloids and Other Bases | Polyamines | 1,4-Butanediamine | 63% to 105% |
| 258904 | Amino Acids and Related Compounds | Amino Acids and Related Compounds | Glutamic acid | 435% to 725% |
| 258904 | Amino Acids and Related Compounds | Amino Acids and Related Compounds | Proline | 60% to 78% |
| 258904 | Carbohydrates | Carbohydrates | F3-U0.813 Carbohydrate | 60% to 94% |
| 258904 | Carbohydrates | Carbohydrates | F3-U0.848 Carbohydrate | 102% to 171% |
| 258904 | Carbohydrates | Carbohydrates | F3-U0.872 Hexose | 88% to 147% |
| 258904 | Carbohydrates | Carbohydrates | F3-U1.113 Carbohydrate | 75% to 125% |
| 258904 | Carbohydrates | Carbohydrates | F3-U1.194 Carbohydrate | 90% to 150% |
| 258904 | Carbohydrates | Carbohydrates | Fructose | 314% to 693% |
| 258904 | Carbohydrates | Carbohydrates | Galactose or Mannose | New |
| 258904 | Carbohydrates | Carbohydrates | Glucose | 280% to 869% |
| 258904 | NA | NA | F3-U0.736 | New |
| 258904 | NA | NA | F3-U0.751 | 191% to 318% |
| 258904 | NA | NA | F3-U0.899 | 180% to 300% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#258906

| Seq ID | Chemical Class | Biochemical Class | Compound Name | Modification |
|---|---|---|---|---|
| 258906 | Acids | Acids | Carbamic acid | 104% to 173% |
| 258906 | Acids - Fatty | Fatty Acids and Related Waxes | Octadecanoic acid | 60% to 162% |
| 258906 | Acids - Fatty Branched | Fatty Acids and Related Waxes | Heptadecanoic acid, 16-methyl- | 77% to 186% |
| 258906 | Acids - Hydroxy Alpha | Acid Pathway | Citric acid | 102% to 171% |
| 258906 | Acids - Hydroxy Alpha | Acid Pathway | Malic acid | -60% to -96% |
| 258906 | Acids - Hydroxy Alpha | Carbohydrates | Quinic acid | -60% to -100% |
| 258906 | Amino Acids and Related Compounds | Amino Acids and Related Compounds | Asparagine | New |
| 258906 | Amino Acids and Related Compounds | Amino Acids and Related Compounds | Glutamic acid | 62% to 136% |
| 258906 | Amino Acids and Related Compounds | Amino Acids and Related Compounds | Lysine | 60% to 365% |
| 258906 | Amino Acids and Related Compounds | Amino Acids and Related Compounds | Phenylalanine | 60% to 260% |
| 258906 | Amino Acids and Related Compounds | Amino Acids and Related Compounds | Proline, 5-oxo- | -60% to -77% |
| 258906 | Amino Acids and Related Compounds | Amino Acids and Related Compounds | Threonine | 60% to 170% |
| 258906 | Amino Acids and Related Compounds | Amino Acids and Related Compounds | Tryptophan | 140% to 1470% |
| 258906 | Amino Acids and Related Compounds | Amino Acids and Related Compounds | Tyrosine | 60% to 1370% |
| 258906 | Amino Acids and Related Compounds | Amino Acids and Related Compounds | Valine | 60% to 205% |
| 258906 | Carbohydrates | Carbohydrates | F3-U0.768 Carbohydrate | NQ |
| 258906 | Carbohydrates | Carbohydrates | F3-U0.781 Carbohydrate | New |
| 258906 | Carbohydrates | Carbohydrates | F3-U0.813 Carbohydrate | New |
| 258906 | Carbohydrates | Carbohydrates | F3-U0.816 Carbohydrate | New |
| 258906 | Carbohydrates | Carbohydrates | F3-U0.825 Carbohydrate | New |
| 258906 | Carbohydrates | Carbohydrates | F3-U0.846 Carbohydrate | 246% to 953% |
| 258906 | Carbohydrates | Carbohydrates | F3-U0.872 Hexose | 187% to 773% |
| 258906 | Carbohydrates | Carbohydrates | Fructose | -60% to -96% |
| 258906 | Carbohydrates | Carbohydrates | Glucose | -60% to -100% |
| 258906 | Carbohydrates | Carbohydrates | Sucrose | -60% to -97% |
| 258906 | Esters | Esters | F1-U1.076 Fatty Acid Ester | 69% to 115% |
| 258906 | Esters | Esters | F1-U1.119 Fatty Acid Ester | 103% to 207% |
| 258906 | Esters | Esters | F1-U1.121 Fatty Acid Ester | 190% to 317% |
| 258906 | Esters | Fatty Acids and Related Waxes | Hexadecanoic acid, glyceryl ester | -60% to -75% |
| 258906 | Esters - Hydroxy | Acyl acetylglycerols | 2-Eicosanoyl-1-acetylglycerol | 95% to 217% |
| 258906 | Esters - Hydroxy | Acyl acetylglycerols | 2-Octadecanoyl-1-acetylglycerol | 60% to 221% |
| 258906 | NA | NA | F1-U0.873 | New |
| 258906 | NA | NA | F1-U1.119 | 74% to 162% |
| 258906 | NA | NA | F3-U0.704 | New |
| 258906 | NA | NA | F3-U0.736 | NQ |
| 258906 | NA | NA | F3-U0.785B | New |
| 258906 | NA | NA | F3-U0.858 | NQ |
| 258906 | NA | NA | F3-U1.229 | 277% to 462% |
| 258906 | NA | NA | F3-U1.253 | 116% to 193% |
| 258906 | NA | NA | F3-U1.255 | 60% to 76% |
| 258906 | Sterols, Oxygenated Terpenes, and Other Isoprenoids | Prenylquinones | alpha-Tocopherol | 69% to 167% |
| 258906 | Sterols, Oxygenated Terpenes, and Other Isoprenoids | Prenylquinones | alpha-Tocopherol hydroquinone | 93% to 1069% |
| 258906 | Sterols, Oxygenated Terpenes, and Other Isoprenoids | Prenylquinones | beta-Sitosterol | 62% to 129% |
| 258906 | Sterols, Oxygenated Terpenes, and Other Isoprenoids | Terpenoids | beta-Tocopherol | 264% to 441% |
| 258906 | Sterols, Oxygenated Terpenes, and Other Isoprenoids | Terpenoids | F1-U1.136 Sterol | 60% to 119% |
| 258906 | Sterols, Oxygenated Terpenes, and Other Isoprenoids | Terpenoids | Fucosterol | -60% to -81% |
| 258906 | Sterols, Oxygenated Terpenes, and Other Isoprenoids | Terpenoids | Stigmasta-3,5,22-triene | 112% to 187% |
| 258906 | Sterols, Oxygenated Terpenes, and Other Isoprenoids | Terpenoids | Stigmasterol | 60% to 89% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#258915

| Seq ID | Chemical Class | Biochemical Class | Compound Name | Modification |
|---|---|---|---|---|
| 258915 | Acids - Hydroxy Alpha | Acid Pathway | Butanoic acid, 2,3,4-trihydroxy- | 96% to 160% |
| 258915 | Acids - Hydroxy Alpha | Acid Pathway | Citric acid | 345% to 577% |
| 258915 | Acids - Hydroxy Alpha | Carbohydrates | F3-U0.992 Sugar acid | New |
| 258915 | Acids - Hydroxy Alpha | Acid Pathway | Malic acid | -60% to -80% |
| 258915 | Acids - Hydroxy Alpha | Carbohydrates | Quinic acid | 71% to 118% |
| 258915 | Alkaloids and Other Bases | Polyamines | 1,4-Butanediamine | 104% to 174% |
| 258915 | Alkenes and Alkynes | Terpenoids | Limonene | 72% to 120% |
| 258915 | Amino Acids and Related Compounds | Amino Acids and Related Compounds | Asparagine | New |
| 258915 | Amino Acids and Related Compounds | Amino Acids and Related Compounds | Glutamic acid | 417% to 696% |
| 258915 | Amino Acids and Related Compounds | Amino Acids and Related Compounds | Glutamine | New |
| 258915 | Amino Acids and Related Compounds | Amino Acids and Related Compounds | Proline | 67% to 111% |
| 258915 | Amino Acids and Related Compounds | Amino Acids and Related Compounds | Proline, 5-oxo- | 82% to 137% |
| 258915 | Amino Acids and Related Compounds | Amino Acids and Related Compounds | Tyrosine | New |
| 258915 | Carbohydrates | Carbohydrates | Arabinose or Xylose | New |
| 258915 | Carbohydrates | Carbohydrates | F3-U0.781 Carbohydrate | New |
| 258915 | Carbohydrates | Carbohydrates | F3-U0.813 Carbohydrate | 301% to 502% |
| 258915 | Carbohydrates | Carbohydrates | F3-U0.816 Carbohydrate | 258% to 429% |
| 258915 | Carbohydrates | Carbohydrates | F3-U0.821 Carbohydrate | 346% to 577% |
| 258915 | Carbohydrates | Carbohydrates | F3-U0.825 Carbohydrate | 250% to New |
| 258915 | Carbohydrates | Carbohydrates | F3-U0.846 Carbohydrate | 183% to 304% |
| 258915 | Carbohydrates | Carbohydrates | F3-U0.872 Hexose | 274% to 457% |
| 258915 | Carbohydrates | Carbohydrates | F3-U0.956 Carbohydrate | New |
| 258915 | Carbohydrates | Carbohydrates | F3-U1.113 Carbohydrate | New |
| 258915 | Carbohydrates | Carbohydrates | F3-U1.150 Carbohydrate | 93% to 155% |
| 258915 | Carbohydrates | Carbohydrates | Fructose | 327% to 773% |
| 258915 | Carbohydrates | Carbohydrates | Galactose or Mannose | New |
| 258915 | Carbohydrates | Carbohydrates | Glucose | 256% to 940% |
| 258915 | Esters | Esters | F1-U1.065 Fatty Acid Ester | 225% to 375% |
| 258915 | Esters | Esters | F1-U1.076 Fatty Acid Ester | New |
| 258915 | Esters - Hydroxy | Acyl acetylglycerols | 2-Eicosanoyl-1-acetylglycerol | 978% to 1629% |
| 258915 | Hydrocarbons | Hydrocarbons | Nonacosane, 3-methyl | 60% to 80% |
| 258915 | NA | NA | F3-U0.751 | 100% to 165% |
| 258915 | NA | NA | F3-U0.852A | 219% to 364% |
| 258915 | NA | NA | F3-U1.229 | 72% to 119% |
| 258915 | NA | NA | F3-U1.253 | 164% to 274% |
| 258915 | NA | NA | F3-U1.255 | 76% to 126% |
| 258915 | Phenols and Related Compounds | Phenylpropanes and Derivatives | Chlorogenic acid | -60% to -87% |
| 258915 | Sterols, Oxygenated Terpenes, and Other Isoprenoids | Prenylquinones | alpha-Tocopherol hydroquinone | 290% to 5158% |
| 258915 | Sterols, Oxygenated Terpenes, and Other Isoprenoids | Terpenoids | beta-Sitosterol | 181% to 1056% |
| 258915 | Sterols, Oxygenated Terpenes, and Other Isoprenoids | Prenylquinones | beta-Tocopherol | 338% to 563% |
| 258915 | Sterols, Oxygenated Terpenes, and Other Isoprenoids | Terpenoids | Campesterol | 62% to 177% |
| 258915 | Sterols, Oxygenated Terpenes, and Other Isoprenoids | Terpenoids | Cholesterol | New |
| 258915 | Sterols, Oxygenated Terpenes, and Other Isoprenoids | Terpenoids | Cycloartenol | NQ |
| 258915 | Sterols, Oxygenated Terpenes, and Other Isoprenoids | Terpenoids | F1-U1.105 Sterol | -60% to -94% |
| 258915 | Sterols, Oxygenated Terpenes, and Other Isoprenoids | Terpenoids | F1-U1.136 Sterol | 88% to 244% |
| 258915 | Sterols, Oxygenated Terpenes, and Other Isoprenoids | Terpenoids | Fucosterol | 256% to 426% |
| 258915 | Sterols, Oxygenated Terpenes, and Other Isoprenoids | Prenylquinones | gamma-Tocopherol | 502% to 837% |
| 258915 | Sterols, Oxygenated Terpenes, and Other Isoprenoids | Terpenoids | Stigmasterol | 63% to 549% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#258924

| Seq ID | Chemical Class | Biochemical Class | Compound Name | Modification |
|--------|----------------|-------------------|---------------|--------------|
| 258924 | Hydrocarbons | Hydrocarbons | Isononacosane | 68% to 113% |
| 258924 | NA | NA | F1-U0.972 | New |
| 258924 | Sterols, Oxygenated Terpenes, and Other Isoprenoids | Prenylquinones | alpha-Tocopherol | 67% to 112% |
| 258924 | Sterols, Oxygenated Terpenes, and Other Isoprenoids | Prenylquinones | alpha-Tocopherol hydroquinone | 70% to 116% |
| 258924 | Sterols, Oxygenated Terpenes, and Other Isoprenoids | Terpenoids | Ergosta-8,24(28)-dien-3-ol, 4,14-dimethyl- | 101% to 168% |
| 258924 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#258965

| Seq ID | Chemical Class | Biochemical Class | Compound Name | Modification |
|---|---|---|---|---|
| 258965 | Amino Acids and Related Compounds | Amino Acids and Related Compounds | Valine | 90% to 290% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#258966

| Seq ID | Chemical Class | Biochemical Class | Compound Name | Modification |
|---|---|---|---|---|
| 258966 | Acids - Fatty Branched | Fatty Acids and Related Waxes | Hexadecanoic acid, 14-methyl- | -76% to -94% |
| 258966 | Acids - Fatty Unsat | Fatty Acids and Related Waxes | 7,10,13-Hexadecatrienoic acid | -7% to -32% |
| 258966 | Acids - Fatty Unsat | Fatty Acids and Related Waxes | 9,12-Octadecadienoic acid | -24% to -46% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#258967

| Seq ID | Chemical Class | Biochemical Class | Compound Name | Modification |
|---|---|---|---|---|
| 258967 | Carbohydrates | Carbohydrates | F3-U0.825 Carbohydrate | NQ |
| 258967 | Alkenes and Alkynes | Terpenoids | Limonene | 79% to 132% |
| 258967 | Amino Acids and Related Compounds | Amino Acids and Related Compounds | Glutamic acid | 66% to 110% |
| 258967 | Carbohydrates | Carbohydrates | Arabinose or Xylose | New |
| 258967 | Carbohydrates | Carbohydrates | F3-U0.846 Carbohydrate | -60% to -85% |
| 258967 | Carbohydrates | Carbohydrates | F3-U0.848 Carbohydrate | 132% to 220% |
| 258967 | Carbohydrates | Carbohydrates | F3-U0.952 Carbohydrate | 260% to 433% |
| 258967 | Carbohydrates | Carbohydrates | F3-U1.104 Carbohydrate | New |
| 258967 | Carbohydrates | Carbohydrates | F3-U1.150 Carbohydrate | 73% to 121% |
| 258967 | Carbohydrates | Carbohydrates | F3-U1.189 Carbohydrate | 103% to 171% |
| 258967 | Carbohydrates | Carbohydrates | Fructose | 353% to 738% |
| 258967 | Carbohydrates | Carbohydrates | Galactose or Mannose | New |
| 258967 | Carbohydrates | Carbohydrates | Glucose | 151% to 1086% |
| 258967 | Esters | Esters | F1-U1.076 Fatty Acid Ester | 126% to 210% |
| 258967 | Esters | Esters | F1-U1.119 Fatty Acid Ester | 113% to 188% |
| 258967 | Esters | Fatty Acids and Related Waxes | Hexadecanoic acid, glyceryl ester | New |
| 258967 | Esters - Hydroxy | Acyl acetylglycerols | 2-Eicosanoyl-1-acetylglycerol | 120% to 200% |
| 258967 | Esters - Hydroxy | Acyl acetylglycerols | 2-Octadecanoyl-1-acetylglycerol | 119% to 199% |
| 258967 | NA | NA | F3-U0.736 | 120% to 200% |
| 258967 | NA | NA | F3-U0.882 | 196% to 327% |
| 258967 | NA | NA | F3-U0.899 | New |
| 258967 | NA | NA | F3-U1.253 | 216% to 361% |
| 258967 | NA | NA | F3-U1.255 | 158% to 263% |
| 258967 | Sterols, Oxygenated Terpenes, and Other Isoprenoids | Prenylquinones | alpha-Tocopherol hydroquinone | 479% to 799% |
| 258967 | Sterols, Oxygenated Terpenes, and Other Isoprenoids | Terpenoids | beta-Sitosterol | 60% to 77% |
| 258967 | Sterols, Oxygenated Terpenes, and Other Isoprenoids | Terpenoids | Cycloartenol | 61% to 101% |
| 258967 | Sterols, Oxygenated Terpenes, and Other Isoprenoids | Terpenoids | Ergosta-8,24(28)-dien-3-ol, 4,14-dimethyl- | 66% to 110% |
| 258967 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#258970

| Seq ID | Chemical Class | Biochemical Class | Compound Name | Modification |
|---|---|---|---|---|
| 258970 | Aldehydes, Ketones and Quinones | Aldehydes, Ketones and Quinones | 3-Phytylmenadione | 75% to 125% |
| 258970 | Alkaloids and Other Bases | Polyamines | 1,4-Butanediamine | 121% to 202% |
| 258970 | Alkenes and Alkynes | Terpenoids | Limonene | 119% to 199% |
| 258970 | Amino Acids and Related Compounds | Amino Acids and Related Compounds | Glutamic acid | 60% to 85% |
| 258970 | Amino Acids and Related Compounds | Amino Acids and Related Compounds | Glutamine | New |
| 258970 | Carbohydrates | Carbohydrates | Arabinose or Xylose | New |
| 258970 | Carbohydrates | Carbohydrates | F3-U0.848 Carbohydrate | 79% to 131% |
| 258970 | Carbohydrates | Carbohydrates | F3-U0.872 Hexose | 60% to 134% |
| 258970 | Carbohydrates | Carbohydrates | F3-U0.956 Carbohydrate | New |
| 258970 | Carbohydrates | Carbohydrates | F3-U1.113 Carbohydrate | 92% to 153% |
| 258970 | Carbohydrates | Carbohydrates | F3-U1.189 Carbohydrate | 65% to 177% |
| 258970 | Carbohydrates | Carbohydrates | F3-U1.194 Carbohydrate | 82% to 137% |
| 258970 | Carbohydrates | Carbohydrates | Fructose | 161% to 668% |
| 258970 | Carbohydrates | Carbohydrates | Galactose or Mannose | 272% to New |
| 258970 | Carbohydrates | Carbohydrates | Glucose | 150% to 933% |
| 258970 | Esters | Esters | F1-U1.076 Fatty Acid Ester | 219% to 365% |
| 258970 | Esters | Esters | F1-U1.078 Fatty Acid Ester | 110% to 183% |
| 258970 | Esters | Esters | F1-U1.119 Fatty Acid Ester | 168% to 280% |
| 258970 | Esters | Esters | F1-U1.120 Fatty Acid Ester | 232% to 386% |
| 258970 | Esters - Hydroxy | Acyl acetylglycerols | 2-Eicosanoyl-1-acetylglycerol | 136% to 227% |
| 258970 | Esters - Hydroxy | Acyl acetylglycerols | 2-Octadecanoyl-1-acetylglycerol | 117% to 194% |
| 258970 | NA | NA | F3-U0.799 | New |
| 258970 | NA | NA | F3-U0.882 | 60% to 184% |
| 258970 | NA | NA | F3-U1.229 | 88% to 184% |
| 258970 | NA | NA | F3-U1.253 | 115% to 192% |
| 258970 | Sterols, Oxygenated Terpenes, and Other Isoprenoids | Prenylquinones | alpha-Tocopherol hydroquinone | 395% to 659% |
| 258970 | Sterols, Oxygenated Terpenes, and Other Isoprenoids | Terpenoids | beta-Sitosterol | 84% to 141% |
| 258970 | Sterols, Oxygenated Terpenes, and Other Isoprenoids | Prenylquinones | beta-Tocopherol | 166% to 276% |
| 258970 | Sterols, Oxygenated Terpenes, and Other Isoprenoids | Terpenoids | Campesterol | 69% to 115% |
| 258970 | Sterols, Oxygenated Terpenes, and Other Isoprenoids | Terpenoids | Cycloartenol | 171% to 285% |
| 258970 | Sterols, Oxygenated Terpenes, and Other Isoprenoids | Terpenoids | F1-U1.172 Sterol | 280% to 466% |
| 258970 | Sterols, Oxygenated Terpenes, and Other Isoprenoids | Terpenoids | Fucosterol | New |
| 258970 | Sterols, Oxygenated Terpenes, and Other Isoprenoids | Terpenoids | Stigmasta-5,22-dien-3-ol, acetate | 91% to 151% |
| 258970 | Sterols, Oxygenated Terpenes, and Other Isoprenoids | Terpenoids | Stigmasterol | 60% to 82% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#258978

| Seq ID | Chemical Class | Biochemical Class | Compound Name | Modification |
|---|---|---|---|---|
| 258978 | Acids | Acids | Carbamic acid | 95% to 179% |
| 258978 | Acids - Hydroxy Alpha | Acid Pathway | Butanoic acid, 2,3,4-trihydroxy- | 102% to 171% |
| 258978 | Acids - Hydroxy Alpha | Carbohydrates | Quinic acid | 73% to 122% |
| 258978 | Alcohols | Carbohydrates | Inositol | 62% to 104% |
| 258978 | Amino Acids and Related Compounds | Amino Acids and Related Compounds | Glutamic acid | 70% to 116% |
| 258978 | Amino Acids and Related Compounds | Amino Acids and Related Compounds | Proline | 60% to 79% |
| 258978 | Carbohydrates | Carbohydrates | F3-U0.813 Carbohydrate | 124% to 207% |
| 258978 | Carbohydrates | Carbohydrates | F3-U0.816 Carbohydrate | 84% to 151% |
| 258978 | Carbohydrates | Carbohydrates | F3-U0.825 Carbohydrate | 117% to 194% |
| 258978 | Carbohydrates | Carbohydrates | F3-U0.846 Carbohydrate | 61% to 195% |
| 258978 | Carbohydrates | Carbohydrates | F3-U0.848 Carbohydrate | 93% to 155% |
| 258978 | Carbohydrates | Carbohydrates | F3-U0.872 Hexose | 64% to 172% |
| 258978 | Carbohydrates | Carbohydrates | F3-U1.113 Carbohydrate | 60% to 85% |
| 258978 | Carbohydrates | Carbohydrates | Fructose | 60% to 331% |
| 258978 | Carbohydrates | Carbohydrates | Galactose or Mannose | 136% to 226% |
| 258978 | Carbohydrates | Carbohydrates | Glucose | 60% to 422% |
| 258978 | NA | NA | F3-U0.736 | New |
| 258978 | NA | NA | F3-U0.751 | 60% to 82% |
| 258978 | NA | NA | F3-U0.843 | -63% to -100% |
| 258978 | NA | NA | F3-U0.852A | 120% to 199% |
| 258978 | NA | NA | F3-U0.899 | 147% to 245% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#258996

| Seq ID | Chemical Class | Biochemical Class | Compound Name | Modification |
|---|---|---|---|---|
| 258996 | Acids - Hydroxy Alpha | Acid Pathway | Citric acid | -60% to -75% |
| 258996 | Acids - Hydroxy Alpha | Carbohydrates | Quinic acid | 73% to 121% |
| 258996 | Alkaloids and Other Bases | Polyamines | 1,4-Butanediamine | 199% to 331% |
| 258996 | Amino Acids and Related Compounds | Amino Acids and Related Compounds | Glutamic acid | 60% to 91% |
| 258996 | Carbohydrates | Carbohydrates | F3-U0.821 Carbohydrate | -60% to -75% |
| 258996 | Carbohydrates | Carbohydrates | F3-U0.848 Carbohydrate | 75% to 125% |
| 258996 | Carbohydrates | Carbohydrates | Fructose | 202% to 501% |
| 258996 | Carbohydrates | Carbohydrates | Galactose or Mannose | 216% to 360% |
| 258996 | Carbohydrates | Carbohydrates | Glucose | 204% to 695% |
| 258996 | NA | NA | F3-U0.882 | 194% to 324% |
| 258996 | NA | NA | F3-U1.253 | 63% to 106% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#259006

| Seq ID | Chemical Class | Biochemical Class | Compound Name | Modification |
|---|---|---|---|---|
| 259006 | Amino Acids and Related Compounds | Amino Acids and Related Compounds | Alanine | 30% to 130% |
| 259006 | Amino Acids and Related Compounds | Amino Acids and Related Compounds | Histidine | 145% to 330% |
| 259006 | Amino Acids and Related Compounds | Amino Acids and Related Compounds | Isoleucine | New |
| 259006 | Amino Acids and Related Compounds | Amino Acids and Related Compounds | Leucine | New |
| 259006 | Amino Acids and Related Compounds | Amino Acids and Related Compounds | Methionine | 80% to 190% |
| 259006 | Amino Acids and Related Compounds | Amino Acids and Related Compounds | Phenylalanine | 525% to 2075% |
| 259006 | Amino Acids and Related Compounds | Amino Acids and Related Compounds | Threonine | 100% to 230% |
| 259006 | Amino Acids and Related Compounds | Amino Acids and Related Compounds | Tryptophan | New |
| 259006 | Amino Acids and Related Compounds | Amino Acids and Related Compounds | Tyrosine | New |
| 259006 | Amino Acids and Related Compounds | Amino Acids and Related Compounds | Valine | 510% to 890% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#259007

| Seq ID | Chemical Class | Biochemical Class | Compound Name | Modification |
|---|---|---|---|---|
| 259007 | Acids - Hydroxy Alpha | Acid Pathway | Citric acid | 430% to 717% |
| 259007 | Acids - Hydroxy Alpha | Carbohydrates | Quinic acid | -64% to -100% |
| 259007 | Alkaloids and Other Bases | Polyamines | 1,4-Butanediamine | 154% to 257% |
| 259007 | Alkaloids and Other Bases | | Nornicotine | New |
| 259007 | Amino Acids and Related Compounds | Amino Acids and Related Compounds | Glutamic acid | 195% to 326% |
| 259007 | Amino Acids and Related Compounds | Amino Acids and Related Compounds | Proline | 249% to 415% |
| 259007 | Amino Acids and Related Compounds | Amino Acids and Related Compounds | Proline, 5-oxo- | 60% to 98% |
| 259007 | Amino Acids and Related Compounds | Amino Acids and Related Compounds | Tryptophan | New |
| 259007 | Amino Acids and Related Compounds | Amino Acids and Related Compounds | Tyrosine | New |
| 259007 | Carbohydrates | Carbohydrates | Arabinose or Xylose | New |
| 259007 | Carbohydrates | Carbohydrates | F3-U0.813 Carbohydrate | 453% to 756% |
| 259007 | Carbohydrates | Carbohydrates | F3-U0.816 Carbohydrate | 142% to 236% |
| 259007 | Carbohydrates | Carbohydrates | F3-U0.825 Carbohydrate | 175% to 655% |
| 259007 | Carbohydrates | Carbohydrates | F3-U0.872 Hexose | 72% to 120% |
| 259007 | Carbohydrates | Carbohydrates | F3-U1.113 Carbohydrate | 163% to 272% |
| 259007 | Carbohydrates | Carbohydrates | F3-U1.148 Carbohydrate | New |
| 259007 | Carbohydrates | Carbohydrates | F3-U1.189 Carbohydrate | 147% to 244% |
| 259007 | Carbohydrates | Carbohydrates | F3-U1.194 Carbohydrate | 255% to 425% |
| 259007 | Carbohydrates | Carbohydrates | Fructose | 313% to 717% |
| 259007 | Carbohydrates | Carbohydrates | Galactose or Mannose | New |
| 259007 | Carbohydrates | Carbohydrates | Glucose | 122% to 397% |
| 259007 | Hydrocarbons | Hydrocarbons | Isononacosane | 88% to 146% |
| 259007 | NA | NA | F1-U0.933 | 65% to 439% |
| 259007 | NA | NA | F1-U1.119 | New |
| 259007 | NA | NA | F3-U0.736 | 278% to 464% |
| 259007 | NA | NA | F3-U0.740 | New |
| 259007 | NA | NA | F3-U0.751 | 101% to 168% |
| 259007 | NA | NA | F3-U0.791 | 160% to 267% |
| 259007 | NA | NA | F3-U0.852A | 403% to 671% |
| 259007 | NA | NA | F3-U1.085 | New |
| 259007 | NA | NA | F3-U1.229 | 85% to 142% |
| 259007 | NA | NA | F3-U1.232B | New |
| 259007 | NA | NA | F3-U1.251 | New |
| 259007 | Sterols, Oxygenated Terpenes, and Other Isoprenoids | Prenylquinones | alpha-Tocopherol | 444% to 740% |
| 259007 | Sterols, Oxygenated Terpenes, and Other Isoprenoids | Prenylquinones | alpha-Tocopherol hydroquinone | 125% to 208% |
| 259007 | Sterols, Oxygenated Terpenes, and Other Isoprenoids | Terpenoids | beta-Sitosterol | 93% to 156% |
| 259007 | Sterols, Oxygenated Terpenes, and Other Isoprenoids | Terpenoids | Campesterol | 60% to 99% |
| 259007 | Sterols, Oxygenated Terpenes, and Other Isoprenoids | Terpenoids | Cyclolaudenol | 133% to 221% |
| 259007 | Sterols, Oxygenated Terpenes, and Other Isoprenoids | Terpenoids | Ergosta-5,24-dien-3-ol | New |
| 259007 | Sterols, Oxygenated Terpenes, and Other Isoprenoids | Terpenoids | Ergosta-8,24(28)-dien-3-ol, 4,14-dimethyl- | 152% to 253% |
| 259007 | Sterols, Oxygenated Terpenes, and Other Isoprenoids | Terpenoids | F1-U1.106 Sterol | New |
| 259007 | Sterols, Oxygenated Terpenes, and Other Isoprenoids | Terpenoids | F1-U1.130 Sterol | 89% to 149% |
| 259007 | Sterols, Oxygenated Terpenes, and Other Isoprenoids | Terpenoids | F1-U1.136 Sterol | 60% to 80% |
| 259007 | Sterols, Oxygenated Terpenes, and Other Isoprenoids | Terpenoids | F1-U1.217 Sterol | 111% to 185% |
| 259007 | Sterols, Oxygenated Terpenes, and Other Isoprenoids | Terpenoids | F1-U1.244 Sterol | 60% to 80% |
| 259007 | Sterols, Oxygenated Terpenes, and Other Isoprenoids | Terpenoids | Fucosterol | 64% to 106% |
| 259007 | Sterols, Oxygenated Terpenes, and Other Isoprenoids | Prenylquinones | gamma-Tocopherol | New |
| 259007 | Sterols, Oxygenated Terpenes, and Other Isoprenoids | Terpenoids | Lophenol, 24-methylene- | 85% to 141% |
| 259007 | Sterols, Oxygenated Terpenes, and Other Isoprenoids | Terpenoids | Stigmasterol | 60% to 97% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#259028

| Seq ID | Chemical Class | Biochemical Class | Compound Name | Modification |
|---|---|---|---|---|
| 259028 | Acids - Hydroxy Alpha | Acid Pathway | Citric acid | 500% to 834% |
| 259028 | Alcohols | Carbohydrates | Inositol | 60% to 75% |
| 259028 | Amino Acids and Related Compounds | Amino Acids and Related Compounds | Asparagine | New |
| 259028 | Amino Acids and Related Compounds | Amino Acids and Related Compounds | Glutamine | New |
| 259028 | Amino Acids and Related Compounds | Amino Acids and Related Compounds | Proline | 74% to 124% |
| 259028 | Amino Acids and Related Compounds | Amino Acids and Related Compounds | Serine | 169% to 281% |
| 259028 | Carbohydrates | Carbohydrates | Arabinose or Xylose | New |
| 259028 | Carbohydrates | Carbohydrates | F3-U0.872 Hexose | 60% to 88% |
| 259028 | Carbohydrates | Carbohydrates | F3-U1.113 Carbohydrate | 104% to 173% |
| 259028 | Carbohydrates | Carbohydrates | F3-U1.150 Carbohydrate | 127% to 212% |
| 259028 | Carbohydrates | Carbohydrates | F3-U1.189 Carbohydrate | 116% to 194% |
| 259028 | Carbohydrates | Carbohydrates | F3-U1.194 Carbohydrate | New |
| 259028 | Carbohydrates | Carbohydrates | Fructose | 273% to 786% |
| 259028 | Carbohydrates | Carbohydrates | Galactose or Mannose | New |
| 259028 | Carbohydrates | Carbohydrates | Glucose | 165% to 481% |
| 259028 | Esters | Esters | F1-U1.076 Fatty Acid Ester | 253% to 422% |
| 259028 | Esters | Esters | F1-U1.119 Fatty Acid Ester | 121% to 202% |
| 259028 | Esters | Esters | F1-U1.120 Fatty Acid Ester | 188% to 313% |
| 259028 | Esters | Fatty Acids and Related Waxes | Hexadecanoic acid, glyceryl ester | 64% to 106% |
| 259028 | Esters - Hydroxy | Acyl acetylglycerols | 2-Eicosanoyl-1-acetylglycerol | 97% to 162% |
| 259028 | Esters - Hydroxy | Acyl acetylglycerols | 2-Octadecanoyl-1-acetylglycerol | 83% to 138% |
| 259028 | Hydrocarbons | Hydrocarbons | Nonacosane, 3-methyl | 90% to 149% |
| 259028 | NA | NA | F3-U0.882 | 102% to 170% |
| 259028 | NA | NA | F3-U1.229 | 77% to 128% |
| 259028 | NA | NA | F3-U1.253 | 118% to 197% |
| 259028 | NA | NA | F3-U1.255 | 103% to 171% |
| 259028 | Sterols, Oxygenated Terpenes, and Other Isoprenoids | Prenylquinones | alpha-Tocopherol | 314% to 524% |
| 259028 | Sterols, Oxygenated Terpenes, and Other Isoprenoids | Prenylquinones | alpha-Tocopherol hydroquinone | 186% to 310% |
| 259028 | Sterols, Oxygenated Terpenes, and Other Isoprenoids | Terpenoids | beta-Sitosterol | 268% to 447% |
| 259028 | Sterols, Oxygenated Terpenes, and Other Isoprenoids | Terpenoids | Campesterol | 128% to 213% |
| 259028 | Sterols, Oxygenated Terpenes, and Other Isoprenoids | Terpenoids | Cholesterol | 126% to 210% |
| 259028 | Sterols, Oxygenated Terpenes, and Other Isoprenoids | Terpenoids | Ergosta-8,24(28)-dien-3-ol, 4,14-dimethyl- | New |
| 259028 | Sterols, Oxygenated Terpenes, and Other Isoprenoids | Terpenoids | F1-U1.136 Sterol | New |
| 259028 | Sterols, Oxygenated Terpenes, and Other Isoprenoids | Terpenoids | F1-U1.173 Sterol | 232% to 386% |
| 259028 | Sterols, Oxygenated Terpenes, and Other Isoprenoids | Terpenoids | F1-U1.217 Sterol | New |
| 259028 | Sterols, Oxygenated Terpenes, and Other Isoprenoids | Prenylquinones | gamma-Tocopherol | 854% to 1423% |
| 259028 | Sterols, Oxygenated Terpenes, and Other Isoprenoids | Terpenoids | Stigmasterol | 156% to 261% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#259033

| Seq ID | Chemical Class | Biochemical Class | Compound Name | Modification |
|---|---|---|---|---|
| 259033 | Alkenes and Alkynes | Terpenoids | Squalene | 71% to 119% |
| 259033 | Hydrocarbons | Hydrocarbons | Nonacosane, 3-methyl | 60% to 94% |
| 259033 | Sterols, Oxygenated Terpenes, and Other Isoprenoids | Prenylquinones | alpha-Tocopherol | 60% to 83% |
| 259033 | Sterols, Oxygenated Terpenes, and Other Isoprenoids | Terpenoids | beta-Sitosterol | 190% to 317% |
| 259033 | Sterols, Oxygenated Terpenes, and Other Isoprenoids | Terpenoids | Lophenol, 24-methylene- | 122% to 203% |
| 259033 | Sterols, Oxygenated Terpenes, and Other Isoprenoids | Terpenoids | Stigmasterol | 60% to 78% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#259045

| Seq ID | Chemical Class | Biochemical Class | Compound Name | Modification |
|---|---|---|---|---|
| 259045 | Acids - Hydroxy Alpha | Acid Pathway | Citric acid | 242% to 403% |
| 259045 | Acids - Hydroxy Alpha | Acid Pathway | Malic acid | -60% to -82% |
| 259045 | Alkaloids and Other Bases | Polyamines | 1,4-Butanediamine | 146% to 243% |
| 259045 | Alkaloids and Other Bases | Alkaloids and Other Bases | Nicotine | 108% to 180% |
| 259045 | Amino Acids and Related Compounds | Amino Acids and Related Compounds | Asparagine | New |
| 259045 | Amino Acids and Related Compounds | Amino Acids and Related Compounds | Proline | 246% to 410% |
| 259045 | Amino Acids and Related Compounds | Amino Acids and Related Compounds | Serine | New |
| 259045 | Carbohydrates | Carbohydrates | F3-U0.816 Carbohydrate | 149% to 248% |
| 259045 | Carbohydrates | Carbohydrates | F3-U0.825 Carbohydrate | New |
| 259045 | Carbohydrates | Carbohydrates | F3-U0.846 Carbohydrate | 118% to 197% |
| 259045 | Carbohydrates | Carbohydrates | F3-U0.872 Hexose | 73% to 122% |
| 259045 | Carbohydrates | Carbohydrates | F3-U1.049B Carbohydrate | New |
| 259045 | Carbohydrates | Carbohydrates | F3-U1.091 Carbohydrate | New |
| 259045 | Carbohydrates | Carbohydrates | F3-U1.113 Carbohydrate | New |
| 259045 | Carbohydrates | Carbohydrates | F3-U1.150 Carbohydrate | 187% to 311% |
| 259045 | Carbohydrates | Carbohydrates | F3-U1.189 Carbohydrate | 106% to 177% |
| 259045 | Carbohydrates | Carbohydrates | F3-U1.194 Carbohydrate | 169% to 281% |
| 259045 | Carbohydrates | Carbohydrates | F3-U1.208 Carbohydrate | New |
| 259045 | Carbohydrates | Carbohydrates | Fructose | 65% to 108% |
| 259045 | Carbohydrates | Carbohydrates | Galactose or Mannose | New |
| 259045 | Esters | Esters | F1-U1.076 Fatty Acid Ester | New |
| 259045 | Esters | Esters | F1-U1.119 Fatty Acid Ester | 1082% to 1803% |
| 259045 | Esters - Hydroxy | Acyl acetylglycerols | 2-Eicosanoyl-1-acetylglycerol | 256% to 427% |
| 259045 | Esters - Hydroxy | Acyl acetylglycerols | 2-Octadecanoyl-1-acetylglycerol | 120% to 200% |
| 259045 | Hydrocarbons | Hydrocarbons | Nonacosane, 3-methyl | 236% to 616% |
| 259045 | Hydrocarbons | Hydrocarbons | Octacosane, 2-methyl | 60% to 92% |
| 259045 | NA | NA | F1-U1.230B | 77% to 129% |
| 259045 | NA | NA | F3-U0.751 | 89% to 148% |
| 259045 | NA | NA | F3-U0.882 | 211% to 351% |
| 259045 | Phenols and Related Compounds | Phenylpropanes and Derivatives | Chlorogenic acid | 84% to 140% |
| 259045 | Sterols, Oxygenated Terpenes, and Other Isoprenoids | Prenylquinones | alpha-Tocopherol | 121% to 201% |
| 259045 | Sterols, Oxygenated Terpenes, and Other Isoprenoids | Prenylquinones | alpha-Tocopherol hydroquinone | 117% to 515% |
| 259045 | Sterols, Oxygenated Terpenes, and Other Isoprenoids | Terpenoids | beta-Sitosterol | 120% to 200% |
| 259045 | Sterols, Oxygenated Terpenes, and Other Isoprenoids | Prenylquinones | beta-Tocopherol | 236% to 616% |
| 259045 | Sterols, Oxygenated Terpenes, and Other Isoprenoids | Terpenoids | Campesterol | New |
| 259045 | Sterols, Oxygenated Terpenes, and Other Isoprenoids | Terpenoids | Cholesterol | 138% to 529% |
| 259045 | Sterols, Oxygenated Terpenes, and Other Isoprenoids | Terpenoids | Ergosta-8,24(28)-dien-3-ol, 4,14-dimethyl- | 112% to 448% |
| 259045 | Sterols, Oxygenated Terpenes, and Other Isoprenoids | Terpenoids | F1-U1.136 Sterol | 181% to 302% |
| 259045 | Sterols, Oxygenated Terpenes, and Other Isoprenoids | Terpenoids | F1-U1.164 Sterol | 299% to 625% |
| 259045 | Sterols, Oxygenated Terpenes, and Other Isoprenoids | Terpenoids | Fucosterol | 300% to 500% |
| 259045 | Sterols, Oxygenated Terpenes, and Other Isoprenoids | Prenylquinones | gamma-Tocopherol | New |
| 259045 | Sterols, Oxygenated Terpenes, and Other Isoprenoids | Terpenoids | Lophenol, 24-methylene- | New |
| 259045 | Sterols, Oxygenated Terpenes, and Other Isoprenoids | Terpenoids | Stigmasterol | 123% to 669% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#25975

| Seq ID | Chemical Class | Biochemical Class | Compound Name | Modification |
|--------|----------------|-------------------|---------------|--------------|
| 25975  | Carbohydrates  | Carbohydrates     | Glucose       | NQ           |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#262408

| SeqID | Chemical Class | Biochemical Class | Compound Name | Modification |
|---|---|---|---|---|
| 262408 | Acids - Hydroxy Alpha | Acid Pathway | Citric acid | 526% to 877% |
| 262408 | Acids - Hydroxy Alpha | Acid Pathway | Malic acid | -60% to -77% |
| 262408 | Aldehydes, Ketones and Quinones | Aldehydes, Ketones and Quinones | 2(4H)-Benzofuranone, 5,6,7,7-tetrahydro-6-hydroxy-4,4,7-trimethyl- | 60% to 79% |
| 262408 | Alkaloids and Other Bases | Polyamines | 1,4-Butanediamine | 240% to 401% |
| 262408 | Alkenes and Alkynes | Alkenes and Alkynes | F-IU0.695 Isolongifolene, 4,5,9,10-dehydro- Isomer B | New |
| 262408 | Alkenes and Alkynes | Terpenoids | Limonene | 255% to 425% |
| 262408 | Amino Acids and Related Compounds | Amino Acids and Related Compounds | Asparagine | New |
| 262408 | Amino Acids and Related Compounds | Amino Acids and Related Compounds | Glutamic acid | 84% to 140% |
| 262408 | Carbohydrates | Carbohydrates | F3-U0.813 Carbohydrate | New |
| 262408 | Carbohydrates | Carbohydrates | F3-U0.816 Carbohydrate | 417% to 694% |
| 262408 | Carbohydrates | Carbohydrates | F3-U0.921 Carbohydrate | 526% to 877% |
| 262408 | Carbohydrates | Carbohydrates | F3-U0.825 Carbohydrate | New |
| 262408 | Carbohydrates | Carbohydrates | F3-U0.846 Carbohydrate | 182% to 304% |
| 262408 | Carbohydrates | Carbohydrates | F3-U0.872 Hexose | 94% to 156% |
| 262408 | Carbohydrates | Carbohydrates | F3-U1.120 Carbohydrate | New |
| 262408 | Carbohydrates | Carbohydrates | F3-U1.150 Carbohydrate | 240% to 415% |
| 262408 | Carbohydrates | Carbohydrates | F3-U1.189 Carbohydrate | 187% to 311% |
| 262408 | Carbohydrates | Carbohydrates | F3-U1.194 Carbohydrate | 214% to 358% |
| 262408 | Esters | Esters | F1-U1.076 Fatty Acid Ester | New |
| 262408 | Esters | Esters | F1-U1.120 Fatty Acid Ester | 133% to 221% |
| 262408 | Esters | Esters | F1-U1.121 Fatty Acid Ester | 242% to 403% |
| 262408 | Esters | Fatty Acids and Related Waxes | Hexadecanoic acid, glyceryl ester | New |
| 262408 | Esters - Hydroxy | Acyl acetylglycerols | 2-Eicosanoyl-1-acetylglycerol | 3114% to 5190% |
| 262408 | Esters - Hydroxy | Acyl acetylglycerols | 2-Octadecanoyl-1-acetylglycerol | 828% to 1380% |
| 262408 | Hydrocarbons | Hydrocarbons | Nonacosane, 3-methyl | 129% to 215% |
| 262408 | Hydrocarbons | Hydrocarbons | Octacosane, 2-methyl | 92% to 240% |
| 262408 | NA | NA | F1-U0.873 | New |
| 262408 | NA | NA | F1-U0.875 | New |
| 262408 | NA | NA | F1-U0.972 | New |
| 262408 | NA | NA | F3-U0.704 | New |
| 262408 | NA | NA | F3-U0.855 | 242% to 403% |
| 262408 | NA | NA | F3-U1.232 | 143% to 238% |
| 262408 | Phenols and Related Compounds | Phenylpropanes and Derivatives | Chlorogenic acid | 326% to 683% |
| 262408 | Sterols, Oxygenated Terpenes, and Other Isoprenoids | Prenylquinones | alpha-Tocopherol | New |
| 262408 | Sterols, Oxygenated Terpenes, and Other Isoprenoids | Prenylquinones | alpha-Tocopherol hydroquinone | 737% to 1228% |
| 262408 | Sterols, Oxygenated Terpenes, and Other Isoprenoids | Terpenoids | beta-Sitosterol | 86% to 3496% |
| 262408 | Sterols, Oxygenated Terpenes, and Other Isoprenoids | Prenylquinones | beta-Tocopherol | New |
| 262408 | Sterols, Oxygenated Terpenes, and Other Isoprenoids | Terpenoids | Campesterol | 1828% to 3080% |
| 262408 | Sterols, Oxygenated Terpenes, and Other Isoprenoids | Terpenoids | Cholesterol | New |
| 262408 | Sterols, Oxygenated Terpenes, and Other Isoprenoids | Terpenoids | Cycloartanol, 24-methylene- | New |
| 262408 | Sterols, Oxygenated Terpenes, and Other Isoprenoids | Terpenoids | Cycloartanol | New |
| 262408 | Sterols, Oxygenated Terpenes, and Other Isoprenoids | Terpenoids | Ergosta-8,24(28)-dien-3-ol, 4,14-dimethyl- | -60% to -75% |
| 262408 | Sterols, Oxygenated Terpenes, and Other Isoprenoids | Terpenoids | F1-U1.130 Sterol | 203% to 346% |
| 262408 | Sterols, Oxygenated Terpenes, and Other Isoprenoids | Terpenoids | F1-U1.217 Sterol | 285% to 476% |
| 262408 | Sterols, Oxygenated Terpenes, and Other Isoprenoids | Terpenoids | F1-U1.244 Sterol | 661% to 1101% |
| 262408 | Sterols, Oxygenated Terpenes, and Other Isoprenoids | Terpenoids | Fucosterol | New |
| 262408 | Sterols, Oxygenated Terpenes, and Other Isoprenoids | Prenylquinones | gamma-Tocopherol | New |
| 262408 | Sterols, Oxygenated Terpenes, and Other Isoprenoids | Terpenoids | Lophenol, 24-methylene- | New |
| 262408 | Sterols, Oxygenated Terpenes, and Other Isoprenoids | Terpenoids | Solanesol | New |
| 262408 | Sterols, Oxygenated Terpenes, and Other Isoprenoids | Terpenoids | Stigmast-7-en-3-ol | 296% to 493% |
| 262408 | Sterols, Oxygenated Terpenes, and Other Isoprenoids | Terpenoids | Stigmasta-5,22-dien-3-ol, acetate | 147% to 1996% |
| 262408 | Sterols, Oxygenated Terpenes, and Other Isoprenoids | Terpenoids | Stigmasterol | |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#262505

| Seq ID | Chemical Class | Biochemical Class | Compound Name | Modification |
|---|---|---|---|---|
| 262505 | Esters | Fatty Acids and Related Waxes | 9,12,15-Octadecatrienoic acid, glyceryl ester | 1848% to 3080% |
| 262505 | Hydrocarbons | Hydrocarbons | Nonacosane, 3-methyl | 87% to 145% |
| 262505 | Hydrocarbons | Hydrocarbons | Triacontane, 2-methyl- | 60% to 94% |
| 262505 | NA | NA | F1-U1.053 | 2073% to 3455% |
| 262505 | Sterols, Oxygenated Terpenes, and Other Isoprenoids | Prenylquinones | alpha-Tocopherol hydroquinone | 227% to 379% |
| 262505 | Sterols, Oxygenated Terpenes, and Other Isoprenoids | Terpenoids | beta-Sitosterol | 123% to 204% |
| 262505 | Sterols, Oxygenated Terpenes, and Other Isoprenoids | Terpenoids | Campesterol | 91% to 152% |
| 262505 | Sterols, Oxygenated Terpenes, and Other Isoprenoids | Terpenoids | Cholesterol | 139% to 232% |
| 262505 | Sterols, Oxygenated Terpenes, and Other Isoprenoids | Terpenoids | F1-U1.173 Sterol | 245% to 409% |
| 262505 | Sterols, Oxygenated Terpenes, and Other Isoprenoids | Terpenoids | Stigmasterol | 88% to 146% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#262509

| Seq ID | Chemical Class | Biochemical Class | Compound Name | Modification |
|---|---|---|---|---|
| 262509 | Acids - Hydroxy Alpha | Acid Pathway | Citric acid | 628% to 1046% |
| 262509 | Alcohols | Carbohydrates | Inositol | 72% to 119% |
| 262509 | Amino Acids and Related Compounds | Amino Acids and Related Compounds | Asparagine | New |
| 262509 | Amino Acids and Related Compounds | Amino Acids and Related Compounds | Glutamine | New |
| 262509 | Amino Acids and Related Compounds | Amino Acids and Related Compounds | Proline | 195% to 325% |
| 262509 | Amino Acids and Related Compounds | Amino Acids and Related Compounds | Threonine | New |
| 262509 | Amino Acids and Related Compounds | Amino Acids and Related Compounds | Tryptophan | New |
| 262509 | Amino Acids and Related Compounds | Amino Acids and Related Compounds | Tyrosine | New |
| 262509 | Carbohydrates | Carbohydrates | Arabinose or Xylose | New |
| 262509 | Carbohydrates | Carbohydrates | F3-U0.813 Carbohydrate | New |
| 262509 | Carbohydrates | Carbohydrates | F3-U0.816 Carbohydrate | 675% to 1125% |
| 262509 | Carbohydrates | Carbohydrates | F3-U0.821 Carbohydrate | 628% to 1046% |
| 262509 | Carbohydrates | Carbohydrates | F3-U0.825 Carbohydrate | New |
| 262509 | Carbohydrates | Carbohydrates | F3-U0.846 Carbohydrate | 440% to 734% |
| 262509 | Carbohydrates | Carbohydrates | F3-U0.872 Hexose | 303% to 505% |
| 262509 | Carbohydrates | Carbohydrates | F3-U1.189 Carbohydrate | 193% to 321% |
| 262509 | Carbohydrates | Carbohydrates | F3-U1.194 Carbohydrate | New |
| 262509 | Carbohydrates | Carbohydrates | Fructose | 96% to 312% |
| 262509 | Carbohydrates | Carbohydrates | Glucose | 92% to 153% |
| 262509 | Esters | Esters | F1-U1.076 Fatty Acid Ester | New |
| 262509 | Esters | Esters | F1-U1.113 Fatty Acid Ester | 91% to 151% |
| 262509 | Esters | Esters | F1-U1.119 Fatty Acid Ester | 158% to 263% |
| 262509 | Esters - Hydroxy | Acyl acetylglycerols | 2-Eicosanoyl-1-acetylglycerol | 91% to 2553% |
| 262509 | Esters - Hydroxy | Acyl acetylglycerols | 2-Octadecanoyl-1-acetylglycerol | 60% to 720% |
| 262509 | Hydrocarbons | Hydrocarbons | Isononacosane | 60% to 86% |
| 262509 | NA | NA | F3-U1.253 | 60% to 75% |
| 262509 | NA | NA | F3-U1.255 | 60% to 80% |
| 262509 | Phenols and Related Compounds | Phenylpropanes and Derivatives | Chlorogenic acid | 67% to 111% |
| 262509 | Sterols, Oxygenated Terpenes, and Other Isoprenoids | Prenylquinones | alpha-Tocopherol | 82% to 705% |
| 262509 | Sterols, Oxygenated Terpenes, and Other Isoprenoids | Prenylquinones | alpha-Tocopherol hydroquinone | 617% to 1028% |
| 262509 | Sterols, Oxygenated Terpenes, and Other Isoprenoids | Terpenoids | beta-Sitosterol | 149% to 793% |
| 262509 | Sterols, Oxygenated Terpenes, and Other Isoprenoids | Prenylquinones | beta-Tocopherol | New |
| 262509 | Sterols, Oxygenated Terpenes, and Other Isoprenoids | Terpenoids | Campesterol | 133% to 543% |
| 262509 | Sterols, Oxygenated Terpenes, and Other Isoprenoids | Terpenoids | Cholesterol | New |
| 262509 | Sterols, Oxygenated Terpenes, and Other Isoprenoids | Terpenoids | Cycloartanol, 24-methylene- | 192% to 320% |
| 262509 | Sterols, Oxygenated Terpenes, and Other Isoprenoids | Prenylquinones | delta-Tocopherol | 324% to 540% |
| 262509 | Sterols, Oxygenated Terpenes, and Other Isoprenoids | Terpenoids | Ergosta-8,24(28)-dien-3-ol, 4,14-dimethyl- | New |
| 262509 | Sterols, Oxygenated Terpenes, and Other Isoprenoids | Prenylquinones | F1-U1.129 beta-Tocopherol Isomer | New |
| 262509 | Sterols, Oxygenated Terpenes, and Other Isoprenoids | Terpenoids | F1-U1.244 Sterol | 70% to 1250% |
| 262509 | Sterols, Oxygenated Terpenes, and Other Isoprenoids | Terpenoids | Fucosterol | 94% to 818% |
| 262509 | Sterols, Oxygenated Terpenes, and Other Isoprenoids | Terpenoids | Lophenol, 24-methylene- | New |
| 262509 | Sterols, Oxygenated Terpenes, and Other Isoprenoids | Terpenoids | Stigmasterol | 134% to 610% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#262648

| Seq ID | Chemical Class | Biochemical Class | Compound Name | Modification |
|---|---|---|---|---|
| 262648 | Acids | Acids | Carbamic acid | New |
| 262648 | Acids - Fatty | Fatty Acids and Related Waxes | Eicosanoic acid | -60% to -75% |
| 262648 | Acids - Fatty | Fatty Acids and Related Waxes | Heptadecanoic acid | 64% to 107% |
| 262648 | Acids - Fatty Unsat | Fatty Acids and Related Waxes | 9-Octadecenoic acid | 60% to 95% |
| 262648 | Acids - Hydroxy Alpha | Acid Pathway | Citric acid | 303% to 506% |
| 262648 | Acids - Hydroxy Alpha | Carbohydrates | F3-U0.992 Sugar acid | New |
| 262648 | Acids - Hydroxy Alpha | Carbohydrates | Quinic acid | 178% to 297% |
| 262648 | Amino Acids and Related Compounds | Amino Acids and Related Compounds | Asparagine | New |
| 262648 | Amino Acids and Related Compounds | Amino Acids and Related Compounds | Glutamic acid | 60% to 140% |
| 262648 | Amino Acids and Related Compounds | Amino Acids and Related Compounds | Glutamine | New |
| 262648 | Amino Acids and Related Compounds | Amino Acids and Related Compounds | Glycine | 60% to 290% |
| 262648 | Amino Acids and Related Compounds | Amino Acids and Related Compounds | Histidine | 65% to 290% |
| 262648 | Amino Acids and Related Compounds | Amino Acids and Related Compounds | Lysine | 60% to 240% |
| 262648 | Carbohydrates | Carbohydrates | F3-U0.813 Carbohydrate | New |
| 262648 | Carbohydrates | Carbohydrates | F3-U0.816 Carbohydrate | 907% to 1511% |
| 262648 | Carbohydrates | Carbohydrates | F3-U0.821 Carbohydrate | 303% to 506% |
| 262648 | Carbohydrates | Carbohydrates | F3-U0.825 Carbohydrate | 195% to 325% |
| 262648 | Carbohydrates | Carbohydrates | F3-U0.846 Carbohydrate | 292% to 487% |
| 262648 | Carbohydrates | Carbohydrates | F3-U0.872 Hexose | 264% to 440% |
| 262648 | Carbohydrates | Carbohydrates | F3-U1.113 Carbohydrate | 60% to 79% |
| 262648 | Carbohydrates | Carbohydrates | F3-U1.143 Carbohydrate | 94% to 156% |
| 262648 | Carbohydrates | Carbohydrates | F3-U1.148 Carbohydrate | 79% to 132% |
| 262648 | Carbohydrates | Carbohydrates | F3-U1.189 Carbohydrate | 87% to 111% |
| 262648 | Carbohydrates | Carbohydrates | F3-U1.194 Carbohydrate | 88% to 147% |
| 262648 | Carbohydrates | Carbohydrates | Glucose | 100% to 166% |
| 262648 | Esters | Esters | F1-U1.076 Fatty Acid Ester | New |
| 262648 | Esters | Esters | F1-U1.078 Fatty Acid Ester | -60% to -85% |
| 262648 | Esters | Esters | F1-U1.119 Fatty Acid Ester | New |
| 262648 | Esters | Fatty Acids and Related Waxes | Hexadecanoic acid, glyceryl ester | 1232% to 2053% |
| 262648 | Esters - Hydroxy | Acyl acetylglycerols | 2-Eicosanoyl-1-acetylglycerol | 318% to 530% |
| 262648 | Esters - Hydroxy | Acyl acetylglycerols | 2-Octadecanoyl-1-acetylglycerol | New |
| 262648 | NA | NA | F3-U0.736 | -60% to -86% |
| 262648 | NA | NA | F3-U0.868 | 111% to 185% |
| 262648 | Sterols, Oxygenated Terpenes, and Other Isoprenoids | Prenylquinones | alpha-Tocopherol | 747% to 1245% |
| 262648 | Sterols, Oxygenated Terpenes, and Other Isoprenoids | Prenylquinones | alpha-Tocopherol hydroquinone | 446% to 744% |
| 262648 | Sterols, Oxygenated Terpenes, and Other Isoprenoids | Terpenoids | beta-Sitosterol | 89% to 149% |
| 262648 | Sterols, Oxygenated Terpenes, and Other Isoprenoids | Terpenoids | Campesterol | 592% to 986% |
| 262648 | Sterols, Oxygenated Terpenes, and Other Isoprenoids | Terpenoids | Cholest-7-en-3-ol | -60% to -97% |
| 262648 | Sterols, Oxygenated Terpenes, and Other Isoprenoids | Terpenoids | Cholesterol | New |
| 262648 | Sterols, Oxygenated Terpenes, and Other Isoprenoids | Terpenoids | Ergosta-4,6,22-trien-3-ol | NQ |
| 262648 | Sterols, Oxygenated Terpenes, and Other Isoprenoids | Terpenoids | Ergosta-5,24-dien-3-ol | NQ |
| 262648 | Sterols, Oxygenated Terpenes, and Other Isoprenoids | Terpenoids | F1-U1.099 Sterol | -55% to -100% |
| 262648 | Sterols, Oxygenated Terpenes, and Other Isoprenoids | Terpenoids | F1-U1.130 Sterol | New |
| 262648 | Sterols, Oxygenated Terpenes, and Other Isoprenoids | Terpenoids | F1-U1.136 Sterol | 119% to 199% |
| 262648 | Sterols, Oxygenated Terpenes, and Other Isoprenoids | Terpenoids | F1-U1.200 Sterol | 728% to 1214% |
| 262648 | Sterols, Oxygenated Terpenes, and Other Isoprenoids | Terpenoids | F1-U1.230A Sterol | NQ |
| 262648 | Sterols, Oxygenated Terpenes, and Other Isoprenoids | Terpenoids | Fucosterol | 505% to 841% |
| 262648 | Sterols, Oxygenated Terpenes, and Other Isoprenoids | Terpenoids | Stigmasta-3,5-diene | |
| 262648 | Sterols, Oxygenated Terpenes, and Other Isoprenoids | Terpenoids | Stigmasterol | |

FIG. 6 continued

A list of metabolite compounds present in altered levels relative to reference samples as chararacterized by gas chromatography, liquid chromatography and/or mass spectrometry. This list corresponds to samples transfected with nucleic acid sequence, Seq ID#262650

| Seq ID | Chemical Class | Biochemical Class | Compound Name | Modification |
|---|---|---|---|---|
| 262650 | Acids - Hydroxy Alpha | Acid Pathway | Citric acid | 197% to 328% |
| 262650 | Acids - Hydroxy Alpha | Acid Pathway | Malic acid | -60% to -76% |
| 262650 | Acids - Hydroxy Alpha | Carbohydrates | Quinic acid | -60% to -78% |
| 262650 | Alkaloids and Other Bases | Polyamines | 1,4-Butanediamine | 88% to 146% |
| 262650 | Amino Acids and Related Compounds | Amino Acids and Related Compounds | Asparagine | New |
| 262650 | Amino Acids and Related Compounds | Amino Acids and Related Compounds | Glutamic acid | 153% to 256% |
| 262650 | Amino Acids and Related Compounds | Amino Acids and Related Compounds | Proline, 5-oxo- | 60% to 81% |
| 262650 | Amino Acids and Related Compounds | Amino Acids and Related Compounds | Serine | 141% to 235% |
| 262650 | Amino Acids and Related Compounds | Amino Acids and Related Compounds | Tryptophan | New |
| 262650 | Carbohydrates | Carbohydrates | F3-U0.825 Carbohydrate | 409% to 682% |
| 262650 | Carbohydrates | Carbohydrates | F3-U1.150 Carbohydrate | 104% to 173% |
| 262650 | NA | NA | F3-U0.704 | New |
| 262650 | NA | NA | F3-U0.729 | 94% to 157% |
| 262650 | NA | NA | F3-U0.736 | 104% to 173% |
| 262650 | NA | NA | F3-U0.751 | 110% to 183% |
| 262650 | NA | NA | F3-U1.253 | 60% to 80% |
| 262650 | NA | NA | F3-U1.255 | 60% to 89% |
| 262650 | Sterols, Oxygenated Terpenes, and Other Isoprenoids | Prenylquinones | alpha-Tocopherol | New |
| 262650 | Sterols, Oxygenated Terpenes, and Other Isoprenoids | Prenylquinones | alpha-Tocopherol hydroquinone | 334% to 556% |
| 262650 | Sterols, Oxygenated Terpenes, and Other Isoprenoids | Terpenoids | beta-Sitosterol | 95% to 158% |
| 262650 | Sterols, Oxygenated Terpenes, and Other Isoprenoids | Prenylquinones | beta-Tocopherol | New |
| 262650 | Sterols, Oxygenated Terpenes, and Other Isoprenoids | Terpenoids | Ergosta-5,24-dien-3-ol | 64% to 107% |
| 262650 | Sterols, Oxygenated Terpenes, and Other Isoprenoids | Terpenoids | Ergosta-8,24(28)-dien-3-ol, 4,14-dimethyl- | 124% to 206% |
| 262650 | Sterols, Oxygenated Terpenes, and Other Isoprenoids | Terpenoids | F1-U1.172 Sterol | 95% to 158% |
| 262650 | Sterols, Oxygenated Terpenes, and Other Isoprenoids | Terpenoids | Stigmast-24(28)-en-3-one | 123% to 205% |
| 262650 | Sterols, Oxygenated Terpenes, and Other Isoprenoids | Terpenoids | Stigmasterol | 65% to 108% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#262658

| Seq ID | Chemical Class | Biochemical Class | Compound Name | Modification |
|---|---|---|---|---|
| 262658 | Esters | Esters | F1-U1.076 Fatty Acid Ester | New |
| 262658 | Esters | Esters | F1-U1.119 Fatty Acid Ester | 148% to 247% |
| 262658 | Esters | Esters | Hexadecanoic acid, glyceryl ester | New |
| 262658 | Esters - Hydroxy | Fatty Acids and Related Waxes | 2-Eicosanoyl-1-acetylglycerol | 96% to 2611% |
| 262658 | Esters - Hydroxy | Acyl acetylglycerols | 2-Octadecanoyl-1-acetylglycerol | 100% to 642% |
| 262658 | Hydrocarbons | Acyl acetylglycerols | Octacosane, 2-methyl | 60% to 88% |
| 262658 | Hydrocarbons | Hydrocarbons | Triacontane, 2-methyl- | 71% to 118% |
| 262658 | NA | Hydrocarbons | F1-U1.053 | New |
| 262658 | NA | NA | F1-U1.119 | 242% to 404% |
| 262658 | Sterols, Oxygenated Terpenes, and Other Isoprenoids | NA | alpha-Tocopherol | 64% to 106% |
| 262658 | Sterols, Oxygenated Terpenes, and Other Isoprenoids | Prenylquinones | alpha-Tocopherol hydroquinone | 136% to 334% |
| 262658 | Sterols, Oxygenated Terpenes, and Other Isoprenoids | Prenylquinones | beta-Sitosterol | 188% to 768% |
| 262658 | Sterols, Oxygenated Terpenes, and Other Isoprenoids | Terpenoids | beta-Tocopherol | New |
| 262658 | Sterols, Oxygenated Terpenes, and Other Isoprenoids | Prenylquinones | Campesterol | 99% to 676% |
| 262658 | Sterols, Oxygenated Terpenes, and Other Isoprenoids | Terpenoids | Cholesterol | 216% to 711% |
| 262658 | Sterols, Oxygenated Terpenes, and Other Isoprenoids | Terpenoids | Cycloartenol | 119% to 199% |
| 262658 | Sterols, Oxygenated Terpenes, and Other Isoprenoids | Terpenoids | Ergosta-5,24-dien-3-ol | 311% to 518% |
| 262658 | Sterols, Oxygenated Terpenes, and Other Isoprenoids | Terpenoids | Ergosta-8,24(28)-dien-3-ol, 4,14-dimethyl- | New |
| 262658 | Sterols, Oxygenated Terpenes, and Other Isoprenoids | Terpenoids | F1-U1.099 Sterol | NQ |
| 262658 | Sterols, Oxygenated Terpenes, and Other Isoprenoids | Terpenoids | F1-U1.101 Sterol | NQ |
| 262658 | Sterols, Oxygenated Terpenes, and Other Isoprenoids | Terpenoids | F1-U1.106 Sterol | -65% to -100% |
| 262658 | Sterols, Oxygenated Terpenes, and Other Isoprenoids | Terpenoids | F1-U1.122 Sterol | -60% to -93% |
| 262658 | Sterols, Oxygenated Terpenes, and Other Isoprenoids | Terpenoids | F1-U1.130 Sterol | -60% to -95% |
| 262658 | Sterols, Oxygenated Terpenes, and Other Isoprenoids | Terpenoids | F1-U1.136 Sterol | 141% to 235% |
| 262658 | Sterols, Oxygenated Terpenes, and Other Isoprenoids | Terpenoids | Fucosterol | 703% to 1171% |
| 262658 | Sterols, Oxygenated Terpenes, and Other Isoprenoids | Terpenoids | Stigmasterol | 93% to 761% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#262715

| Seq ID | Chemical Class | Biochemical Class | Compound Name | Modification |
|---|---|---|---|---|
| 262715 | Acids - Fatty Branched | Fatty Acids and Related Waxes | Hexadecanoic acid, 14-methyl- | -60% to -70% |
| 262715 | Acids - Fatty Unsat | Fatty Acids and Related Waxes | 9-Hexadecenoic acid | -60% to -89% |
| 262715 | Acids - Fatty Unsat | Fatty Acids and Related Waxes | 9-Octadecenoic acid | -60% to -65% |
| 262715 | Amino Acids and Related Compounds | Amino Acids and Related Compounds | Glutamic acid | 60% to 155% |
| 262715 | Amino Acids and Related Compounds | Amino Acids and Related Compounds | Histidine | 60% to 545% |
| 262715 | Amino Acids and Related Compounds | Amino Acids and Related Compounds | Isoleucine | New |
| 262715 | Amino Acids and Related Compounds | Amino Acids and Related Compounds | Leucine | New |
| 262715 | Amino Acids and Related Compounds | Amino Acids and Related Compounds | Phenylalanine | 75% to 510% |
| 262715 | Amino Acids and Related Compounds | Amino Acids and Related Compounds | Threonine | 60% to 130% |
| 262715 | Amino Acids and Related Compounds | Amino Acids and Related Compounds | Tyrosine | New |
| 262715 | Amino Acids and Related Compounds | Amino Acids and Related Compounds | Valine | 120% to 455% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#262725

| Seq ID | Chemical Class | Biochemical Class | Compound Name | Modification |
|---|---|---|---|---|
| 262725 | Acids - Hydroxy Alpha | Acid Pathway | Butanoic acid, 2,3,4-trihydroxy- | 163% to 272% |
| 262725 | Acids - Hydroxy Alpha | Acid Pathway | Citric acid | 356% to 594% |
| 262725 | Aldehydes, Ketones and Quinones | Aldehydes, Ketones and Quinones | 3-Phytylmenadione | 245% to 408% |
| 262725 | Alkenes and Alkynes | Terpenoids | Limonene | 69% to 116% |
| 262725 | Amino Acids and Related Compounds | Amino Acids and Related Compounds | Asparagine | New |
| 262725 | Amino Acids and Related Compounds | Amino Acids and Related Compounds | Glutamic acid | 107% to 178% |
| 262725 | Amino Acids and Related Compounds | Amino Acids and Related Compounds | Proline | 113% to 189% |
| 262725 | Carbohydrates | Carbohydrates | F3-U0.813 Carbohydrate | New |
| 262725 | Carbohydrates | Carbohydrates | F3-U0.816 Carbohydrate | 225% to 375% |
| 262725 | Carbohydrates | Carbohydrates | F3-U0.846 Carbohydrate | 182% to 303% |
| 262725 | Carbohydrates | Carbohydrates | F3-U0.848 Carbohydrate | 101% to 169% |
| 262725 | Carbohydrates | Carbohydrates | F3-U0.872 Hexose | 112% to 186% |
| 262725 | Carbohydrates | Carbohydrates | F3-U1.113 Carbohydrate | 96% to 160% |
| 262725 | Carbohydrates | Carbohydrates | F3-U1.148 Carbohydrate | 234% to 390% |
| 262725 | Carbohydrates | Carbohydrates | F3-U1.189 Carbohydrate | 236% to 394% |
| 262725 | Carbohydrates | Carbohydrates | F3-U1.194 Carbohydrate | 498% to 830% |
| 262725 | Carbohydrates | Carbohydrates | Fructose | 116% to 327% |
| 262725 | Carbohydrates | Carbohydrates | Galactose or Mannose | 221% to 368% |
| 262725 | Carbohydrates | Carbohydrates | Glucose | 101% to 214% |
| 262725 | Esters | Esters | F1-U1.076 Fatty Acid Ester | 400% to 666% |
| 262725 | Esters | Esters | F1-U1.078 Fatty Acid Ester | 103% to 172% |
| 262725 | Esters | Esters | F1-U1.119 Fatty Acid Ester | 278% to 464% |
| 262725 | Esters | Esters | F1-U1.120 Fatty Acid Ester | 399% to 665% |
| 262725 | Esters | Fatty Acids and Related Waxes | Hexadecanoic acid, glyceryl ester | New |
| 262725 | Esters - Hydroxy | Acyl acetylglycerols | 2-Eicosanoyl-1-acetylglycerol | 173% to 288% |
| 262725 | Esters - Hydroxy | Acyl acetylglycerols | 2-Octadecanoyl-1-acetylglycerol | 166% to 277% |
| 262725 | Hydrocarbons | Hydrocarbons | F1-U1.103 Hydrocarbon | New |
| 262725 | Hydrocarbons | Hydrocarbons | Nonacosane, 3-methyl | 118% to 196% |
| 262725 | Hydrocarbons | Hydrocarbons | Triacontane, 2-methyl- | 71% to 118% |
| 262725 | NA | NA | F1-U0.875 | New |
| 262725 | NA | NA | F1-U1.009 | 60% to 82% |
| 262725 | NA | NA | F3-U0.751 | 102% to 169% |
| 262725 | NA | NA | F3-U1.253 | 181% to 301% |
| 262725 | NA | NA | F3-U1.255 | 70% to 117% |
| 262725 | Phenols and Related Compounds | Phenylpropanes and Derivatives | Chlorogenic acid | 77% to 129% |
| 262725 | Sterols, Oxygenated Terpenes, and Other Isoprenoids | Prenylquinones | alpha-Tocopherol | 181% to 302% |
| 262725 | Sterols, Oxygenated Terpenes, and Other Isoprenoids | Prenylquinones | alpha-Tocopherol hydroquinone | 569% to 948% |
| 262725 | Sterols, Oxygenated Terpenes, and Other Isoprenoids | Terpenoids | beta-Sitosterol | 264% to 440% |
| 262725 | Sterols, Oxygenated Terpenes, and Other Isoprenoids | Prenylquinones | beta-Tocopherol | New |
| 262725 | Sterols, Oxygenated Terpenes, and Other Isoprenoids | Terpenoids | Campesterol | 160% to 267% |
| 262725 | Sterols, Oxygenated Terpenes, and Other Isoprenoids | Terpenoids | Cholesterol | 275% to 458% |
| 262725 | Sterols, Oxygenated Terpenes, and Other Isoprenoids | Terpenoids | F1-U1.136 Sterol | 237% to 395% |
| 262725 | Sterols, Oxygenated Terpenes, and Other Isoprenoids | Terpenoids | F1-U1.164 Sterol | 375% to 625% |
| 262725 | Sterols, Oxygenated Terpenes, and Other Isoprenoids | Terpenoids | F1-U1.173 Sterol | 477% to 795% |
| 262725 | Sterols, Oxygenated Terpenes, and Other Isoprenoids | Terpenoids | F1-U1.244 Sterol | 161% to 269% |
| 262725 | Sterols, Oxygenated Terpenes, and Other Isoprenoids | Terpenoids | Stigmasterol | 180% to 300% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#262762

| Seq ID | Chemical Class | Biochemical Class | Compound Name | Modification |
|---|---|---|---|---|
| 262762 | Esters | Esters | F1-U1.076 Fatty Acid Ester | New |
| 262762 | Esters - Hydroxy | Acyl acetylglycerols | 2-Eicosanoyl-1-acetylglycerol | 1767% to 2944% |
| 262762 | Esters - Hydroxy | Acyl acetylglycerols | 2-Octadecanoyl-1-acetylglycerol | 575% to 959% |
| 262762 | Hydrocarbons | Hydrocarbons | Isononacosane | 84% to 140% |
| 262762 | Sterols, Oxygenated Terpenes, and Other Isoprenoids | Terpenoids | beta-Sitosterol | 15131% to 25219% |
| 262762 | Sterols, Oxygenated Terpenes, and Other Isoprenoids | Terpenoids | Campesterol | New |
| 262762 | Sterols, Oxygenated Terpenes, and Other Isoprenoids | Terpenoids | Cholesterol | New |
| 262762 | Sterols, Oxygenated Terpenes, and Other Isoprenoids | Terpenoids | F1-U1.136 Sterol | 60% to 80% |
| 262762 | Sterols, Oxygenated Terpenes, and Other Isoprenoids | Terpenoids | Fucosterol | 653% to 1088% |
| 262762 | Sterols, Oxygenated Terpenes, and Other Isoprenoids | Terpenoids | Stigmasterol | 638% to 1064% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#262783

| Seq ID | Chemical Class | Biochemical Class | Compound Name | Modification |
|---|---|---|---|---|
| 262783 | Acids - Fatty | Fatty Acids and Related Waxes | Hexadecanoic acid | 23% to 30% |
| 262783 | Acids - Fatty | Fatty Acids and Related Waxes | Octadecanoic acid | 13% to 30% |
| 262783 | Acids - Fatty Branched | Fatty Acids and Related Waxes | Hexadecanoic acid, 14-methyl- | -56% to -79% |
| 262783 | Acids - Fatty Unsat | Fatty Acids and Related Waxes | 7,10,13-Hexadecatrienoic acid | 10% to 25% |
| 262783 | Acids - Fatty Unsat | Fatty Acids and Related Waxes | 9-Hexadecenoic acid | -15% to -27% |
| 262783 | Acids - Fatty Unsat | Fatty Acids and Related Waxes | 9-Octadecenoic acid | -40% to -64% |
| 262783 | Amino Acids and Related Compounds | Amino Acids and Related Compounds | Alanine | 210% to 445% |
| 262783 | Amino Acids and Related Compounds | Amino Acids and Related Compounds | Isoleucine | New |
| 262783 | Amino Acids and Related Compounds | Amino Acids and Related Compounds | Leucine | New |
| 262783 | Amino Acids and Related Compounds | Amino Acids and Related Compounds | Phenylalanine | 160% to 800% |
| 262783 | Amino Acids and Related Compounds | Amino Acids and Related Compounds | Threonine | 125% to 275% |
| 262783 | Amino Acids and Related Compounds | Amino Acids and Related Compounds | Tyrosine | New |
| 262783 | Amino Acids and Related Compounds | Amino Acids and Related Compounds | Valine | 170% to 340% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#263004

| Seq ID | Chemical Class | Biochemical Class | Compound Name | Modification |
|---|---|---|---|---|
| 263004 | Acids - Hydroxy Alpha | Acid Pathway | Citric acid | 490% to 816% |
| 263004 | Alkaloids and Other Bases | Polyamines | 1,4-Butanediamine | 155% to 258% |
| 263004 | Amino Acids and Related Compounds | Amino Acids and Related Compounds | Aspartic acid | 65% to 109% |
| 263004 | Amino Acids and Related Compounds | Amino Acids and Related Compounds | Glutamic acid | 213% to 355% |
| 263004 | Amino Acids and Related Compounds | Amino Acids and Related Compounds | Proline | 60% to 99% |
| 263004 | Carbohydrates | Carbohydrates | Arabinose or Xylose | New |
| 263004 | Carbohydrates | Carbohydrates | F3-U0.813 Carbohydrate | 646% to 1077% |
| 263004 | Carbohydrates | Carbohydrates | F3-U0.816 Carbohydrate | 374% to 624% |
| 263004 | Carbohydrates | Carbohydrates | F3-U0.821 Carbohydrate | 490% to 816% |
| 263004 | Carbohydrates | Carbohydrates | F3-U0.825 Carbohydrate | 513% to New |
| 263004 | Carbohydrates | Carbohydrates | F3-U0.846 Carbohydrate | 267% to 445% |
| 263004 | Carbohydrates | Carbohydrates | F3-U0.848 Carbohydrate | 435% to 725% |
| 263004 | Carbohydrates | Carbohydrates | F3-U0.872 Hexose | 304% to 507% |
| 263004 | Carbohydrates | Carbohydrates | F3-U1.049B Carbohydrate | New |
| 263004 | Carbohydrates | Carbohydrates | F3-U1.148 Carbohydrate | 1211% to 2018% |
| 263004 | Carbohydrates | Carbohydrates | F3-U1.194 Carbohydrate | 60% to 89% |
| 263004 | Carbohydrates | Carbohydrates | Fructose | 427% to 949% |
| 263004 | Carbohydrates | Carbohydrates | Galactose or Mannose | New |
| 263004 | Carbohydrates | Carbohydrates | Glucose | 273% to 926% |
| 263004 | Esters | Esters | F1-U1.076 Fatty Acid Ester | 60% to 93% |
| 263004 | NA | NA | F3-U0.852A | 870% to 1450% |
| 263004 | NA | NA | F3-U0.882 | 184% to 307% |
| 263004 | NA | NA | F3-U1.253 | 60% to 77% |
| 263004 | Sterols, Oxygenated Terpenes, and Other Isoprenoids | Prenylquinones | alpha-Tocopherol | New |
| 263004 | Sterols, Oxygenated Terpenes, and Other Isoprenoids | Prenylquinones | beta-Tocopherol | New |
| 263004 | Sterols, Oxygenated Terpenes, and Other Isoprenoids | Terpenoids | F1-U1.217 Sterol | New |
| 263004 | Sterols, Oxygenated Terpenes, and Other Isoprenoids | Prenylquinones | gamma-Tocopherol | New |
| 263004 | Sterols, Oxygenated Terpenes, and Other Isoprenoids | Terpenoids | Lophenol, 24-methylene- | 139% to 231% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263005

| Seq ID | Chemical Class | Biochemical Class | Compound Name | Modification |
|---|---|---|---|---|
| 263005 | Acids - Hydroxy Alpha | Acid Pathway | Citric acid | 91% to 181% |
| 263005 | Acids - Keto | Acid Pathway | 2-Ketoglutaric acid | New |
| 263005 | Alcohols | Carbohydrates | Inositol | -60% to -85% |
| 263005 | Alkaloids and Other Bases | Polyamines | 1,4-Butanediamine | 198% to 330% |
| 263005 | Amino Acids and Related Compounds | Amino Acids and Related Compounds | Glutamic acid | 101% to 320% |
| 263005 | Amino Acids and Related Compounds | Amino Acids and Related Compounds | Glycine | New |
| 263005 | Amino Acids and Related Compounds | Amino Acids and Related Compounds | Proline, 5-oxo- | 60% to 89% |
| 263005 | Amino Acids and Related Compounds | Amino Acids and Related Compounds | Serine | 195% to 325% |
| 263005 | Carbohydrates | Carbohydrates | F3-U0.816 Carbohydrate | 195% to 325% |
| 263005 | Carbohydrates | Carbohydrates | F3-U0.821 Carbohydrate | 91% to 181% |
| 263005 | Carbohydrates | Carbohydrates | F3-U0.846 Carbohydrate | 156% to 259% |
| 263005 | Carbohydrates | Carbohydrates | F3-U0.872 Hexose | 78% to 130% |
| 263005 | Carbohydrates | Carbohydrates | F3-U1.113 Carbohydrate | 75% to 125% |
| 263005 | Carbohydrates | Carbohydrates | F3-U1.150 Carbohydrate | 60% to 86% |
| 263005 | Carbohydrates | Carbohydrates | Fructose | -60% to -76% |
| 263005 | Carbohydrates | Carbohydrates | Glucose | -60% to -99% |
| 263005 | NA | NA | F3-U0.729 | 60% to 124% |
| 263005 | NA | NA | F3-U0.767 | New |
| 263005 | NA | NA | F3-U0.852A | 60% to 86% |
| 263005 | Phenols and Related Compounds | Phenylpropanes and Derivatives | Chlorogenic acid | -60% to -88% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263006

| Seq ID | Chemical Class | Biochemical Class | Compound Name | Modification |
|---|---|---|---|---|
| 263006 | Acids - Fatty | Fatty Acids and Related Waxes | Octadecanoic acid | 60% to 155% |
| 263006 | Alkenes and Alkynes | Terpenoids | Limonene | 142% to 237% |
| 263006 | Sterols, Oxygenated Terpenes, and Other Isoprenoids | Prenylquinones | alpha-Tocopherol | 160% to 266% |
| 263006 | Sterols, Oxygenated Terpenes, and Other Isoprenoids | Prenylquinones | beta-Tocopherol | New |
| 263006 | Sterols, Oxygenated Terpenes, and Other Isoprenoids | Terpenoids | Cycloartenol | New |
| 263006 | Sterols, Oxygenated Terpenes, and Other Isoprenoids | Terpenoids | F1-U1.173 Sterol | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263009

| Seq ID | Chemical Class | Biochemical Class | Compound Name | Modification |
|---|---|---|---|---|
| 263009 | Alkenes and Alkynes | Fatty Acids and Related Waxes | 1-Eicosene | New |
| 263009 | Esters | Fatty Acids and Related Waxes | 4,8,12,16-Tetramethylheptadecan-4-olide | New |
| 263009 | Esters | Esters | F1-U1.065 Fatty Acid Ester | 132% to 220% |
| 263009 | Esters | Esters | F1-U1.076 Fatty Acid Ester | New |
| 263009 | Esters - Hydroxy | Acyl acetylglycerols | 2-Eicosanoyl-1-acetylglycerol | 584% to 974% |
| 263009 | Sterols, Oxygenated Terpenes, and Other Isoprenoids | Terpenoids | beta-Sitosterol | 157% to 261% |
| 263009 | Sterols, Oxygenated Terpenes, and Other Isoprenoids | Terpenoids | Campesterol | 107% to 178% |
| 263009 | Sterols, Oxygenated Terpenes, and Other Isoprenoids | Terpenoids | F1-U1.106 Sterol | -60% to -80% |
| 263009 | Sterols, Oxygenated Terpenes, and Other Isoprenoids | Terpenoids | F1-U1.122 Sterol | -60% to -84% |
| 263009 | Sterols, Oxygenated Terpenes, and Other Isoprenoids | Terpenoids | Fucosterol | 77% to 128% |
| 263009 | Sterols, Oxygenated Terpenes, and Other Isoprenoids | Terpenoids | Stigmasterol | 127% to 211% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263030

| Seq ID | Chemical Class | Biochemical Class | Compound Name | Modification |
|---|---|---|---|---|
| 263030 | Alkenes and Alkynes | Terpenoids | Limonene | 60% to 89% |
| 263030 | Esters | Esters | F1-U1.076 Fatty Acid Ester | 87% to 145% |
| 263030 | Esters | Esters | F1-U1.119 Fatty Acid Ester | 88% to 147% |
| 263030 | Esters - Hydroxy | Acyl acetylglycerols | 2-Eicosanoyl-1-acetylglycerol | 63% to 105% |
| 263030 | Esters - Hydroxy | Acyl acetylglycerols | 2-Octadecanoyl-1-acetylglycerol | 78% to 130% |
| 263030 | Hydrocarbons | Hydrocarbons | Nonacosane, 3-methyl | 95% to 158% |
| 263030 | Sterols, Oxygenated Terpenes, and Other Isoprenoids | Prenylquinones | alpha-Tocopherol | 63% to 780% |
| 263030 | Sterols, Oxygenated Terpenes, and Other Isoprenoids | Terpenoids | beta-Sitosterol | 70% to 117% |
| 263030 | Sterols, Oxygenated Terpenes, and Other Isoprenoids | Terpenoids | Campesterol | 63% to 105% |
| 263030 | Sterols, Oxygenated Terpenes, and Other Isoprenoids | Prenylquinones | F1-U1.129 beta-Tocopherol Isomer | 437% to 728% |
| 263030 | Sterols, Oxygenated Terpenes, and Other Isoprenoids | Terpenoids | F1-U1.136 Sterol | 97% to 162% |
| 263030 | Sterols, Oxygenated Terpenes, and Other Isoprenoids | Prenylquinones | gamma-Tocopherol | New |
| 263030 | Sterols, Oxygenated Terpenes, and Other Isoprenoids | Terpenoids | Stigmasterol | 60% to 99% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263033

| Seq ID | Chemical Class | Biochemical Class | Compound Name | Modification |
|---|---|---|---|---|
| 263033 | Acids - Fatty Branched | Fatty Acids and Related Waxes | Hexadecanoic acid, 14-methyl- | -60% to -75% |
| 263033 | Acids - Fatty Unsat | Fatty Acids and Related Waxes | 7,10,13-Hexadecatrienoic acid | 60% to 90% |
| 263033 | Acids - Fatty Unsat | Fatty Acids and Related Waxes | 7,10-Hexadecadienoic acid | -60% to -82% |
| 263033 | Acids - Hydroxy Alpha | Acid Pathway | Citric acid | 86% to 238% |
| 263033 | Acids - Hydroxy Alpha | Acid Pathway | Malic acid | 115% to 204% |
| 263033 | Acids - Hydroxy Alpha | Carbohydrates | Quinic acid | 60% to 97% |
| 263033 | Amino Acids and Related Compounds | Amino Acids and Related Compounds | Glutamine | New |
| 263033 | Amino Acids and Related Compounds | Amino Acids and Related Compounds | Histidine | 325% to 640% |
| 263033 | Amino Acids and Related Compounds | Amino Acids and Related Compounds | Isoleucine | New |
| 263033 | Amino Acids and Related Compounds | Amino Acids and Related Compounds | Leucine | New |
| 263033 | Amino Acids and Related Compounds | Amino Acids and Related Compounds | Lysine | 135% to 385% |
| 263033 | Amino Acids and Related Compounds | Amino Acids and Related Compounds | Methionine | 215% to 410% |
| 263033 | Amino Acids and Related Compounds | Amino Acids and Related Compounds | Phenylalanine | 655% to 2530% |
| 263033 | Amino Acids and Related Compounds | Amino Acids and Related Compounds | Threonine | 60% to 165% |
| 263033 | Amino Acids and Related Compounds | Amino Acids and Related Compounds | Tryptophan | New |
| 263033 | Amino Acids and Related Compounds | Amino Acids and Related Compounds | Tyrosine | New |
| 263033 | Amino Acids and Related Compounds | Amino Acids and Related Compounds | Valine | 315% to 575% |
| 263033 | Carbohydrates | Carbohydrates | F3-U0.821 Carbohydrate | 86% to 143% |
| 263033 | Carbohydrates | Carbohydrates | F3-U0.825 Carbohydrate | 127% to 212% |
| 263033 | Carbohydrates | Carbohydrates | F3-U0.846 Carbohydrate | 64% to 259% |
| 263033 | Carbohydrates | Carbohydrates | F3-U0.872 Hexose | 60% to 219% |
| 263033 | Carbohydrates | Carbohydrates | F3-U1.189 Carbohydrate | 71% to 124% |
| 263033 | Carbohydrates | Carbohydrates | F3-U1.194 Carbohydrate | 79% to 143% |
| 263033 | Carbohydrates | Carbohydrates | Fructose | -60% to -85% |
| 263033 | Carbohydrates | Carbohydrates | Galactose or Mannose | NQ |
| 263033 | Carbohydrates | Carbohydrates | Glucose | -60% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263037

| Seq ID | Chemical Class | Biochemical Class | Compound Name | Modification |
|---|---|---|---|---|
| 263037 | Acids - Hydroxy Alpha | Acid Pathway | Citric acid | 851% to 1418% |
| 263037 | Acids - Hydroxy Alpha | Carbohydrates | F3-U0.992 Sugar acid | New |
| 263037 | Alkaloids and Other Bases | Polyamines | 1,4-Butanediamine | 108% to 180% |
| 263037 | Amino Acids and Related Compounds | Amino Acids and Related Compounds | Asparagine | New |
| 263037 | Amino Acids and Related Compounds | Amino Acids and Related Compounds | Glutamic acid | 321% to 534% |
| 263037 | Amino Acids and Related Compounds | Amino Acids and Related Compounds | Glutamine | New |
| 263037 | Amino Acids and Related Compounds | Amino Acids and Related Compounds | Glycine | New |
| 263037 | Amino Acids and Related Compounds | Amino Acids and Related Compounds | Proline | 104% to 173% |
| 263037 | Amino Acids and Related Compounds | Amino Acids and Related Compounds | Proline, 5-oxo- | 128% to 213% |
| 263037 | Amino Acids and Related Compounds | Amino Acids and Related Compounds | Serine | 356% to 594% |
| 263037 | Amino Acids and Related Compounds | Amino Acids and Related Compounds | Threonine | New |
| 263037 | Amino Acids and Related Compounds | Amino Acids and Related Compounds | Tyrosine | New |
| 263037 | Carbohydrates | Carbohydrates | F3-U0.813 Carbohydrate | New |
| 263037 | Carbohydrates | Carbohydrates | F3-U0.816 Carbohydrate | New |
| 263037 | Carbohydrates | Carbohydrates | F3-U0.825 Carbohydrate | New |
| 263037 | Carbohydrates | Carbohydrates | F3-U0.846 Carbohydrate | 205% to 342% |
| 263037 | Carbohydrates | Carbohydrates | F3-U0.872 Hexose | 80% to 133% |
| 263037 | Carbohydrates | Carbohydrates | F3-U1.150 Carbohydrate | 223% to 372% |
| 263037 | Carbohydrates | Carbohydrates | F3-U1.189 Carbohydrate | 197% to 329% |
| 263037 | Carbohydrates | Carbohydrates | F3-U1.194 Carbohydrate | 353% to 589% |
| 263037 | Carbohydrates | Carbohydrates | Glucose | -60% to -80% |
| 263037 | Esters | Esters | F1-U1.076 Fatty Acid Ester | 78% to 130% |
| 263037 | Esters | Esters | F1-U1.119 Fatty Acid Ester | 64% to 106% |
| 263037 | Esters - Hydroxy | Acyl acetylglycerols | 2-Eicosanoyl-1-acetylglycerol | 73% to 121% |
| 263037 | Hydrocarbons | Hydrocarbons | Isononacosane | 60% to 80% |
| 263037 | Hydrocarbons | Hydrocarbons | Nonacosane, 3-methyl | 105% to 175% |
| 263037 | NA | NA | F3-U0.704 | New |
| 263037 | NA | NA | F3-U1.253 | 60% to 89% |
| 263037 | Sterols, Oxygenated Terpenes, and Other Isoprenoids | Prenylquinones | alpha-Tocopherol | 60% to 1082% |
| 263037 | Sterols, Oxygenated Terpenes, and Other Isoprenoids | Prenylquinones | alpha-Tocopherol hydroquinone | 170% to 284% |
| 263037 | Sterols, Oxygenated Terpenes, and Other Isoprenoids | Terpenoids | beta-Sitosterol | 66% to 110% |
| 263037 | Sterols, Oxygenated Terpenes, and Other Isoprenoids | Prenylquinones | beta-Tocopherol | New |
| 263037 | Sterols, Oxygenated Terpenes, and Other Isoprenoids | Terpenoids | Campesterol | 78% to 129% |
| 263037 | Sterols, Oxygenated Terpenes, and Other Isoprenoids | Terpenoids | Cholesterol | 100% to 166% |
| 263037 | Sterols, Oxygenated Terpenes, and Other Isoprenoids | Terpenoids | F1-U1.136 Sterol | 249% to 415% |
| 263037 | Sterols, Oxygenated Terpenes, and Other Isoprenoids | Terpenoids | Fucosterol | -60% to -80% |
| 263037 | Sterols, Oxygenated Terpenes, and Other Isoprenoids | Prenylquinones | gamma-Tocopherol | New |
| 263037 | Sterols, Oxygenated Terpenes, and Other Isoprenoids | Terpenoids | Stigmasta-3,5,22-triene | New |
| 263037 | Sterols, Oxygenated Terpenes, and Other Isoprenoids | Terpenoids | Stigmasterol | 93% to 155% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263050

| Seq ID | Chemical Class | Biochemical Class | Compound Name | Modification |
|---|---|---|---|---|
| 263050 | Acids - Hydroxy Alpha | Acid Pathway | Butanoic acid, 2,3,4-trihydroxy- | 179% to 306% |
| 263050 | Acids - Hydroxy Alpha | Acid Pathway | Citric acid | 60% to 100% |
| 263050 | Acids - Hydroxy Alpha | Carbohydrates | Quinic acid | 118% to 315% |
| 263050 | Alkaloids and Other Bases | Polyamines | 1,4-Butanediamine | 117% to 195% |
| 263050 | Amino Acids and Related Compounds | Amino Acids and Related Compounds | Glutamic acid | 154% to 318% |
| 263050 | Amino Acids and Related Compounds | Amino Acids and Related Compounds | Proline | 76% to 126% |
| 263050 | Amino Acids and Related Compounds | Amino Acids and Related Compounds | Valine | 60% to 100% |
| 263050 | Carbohydrates | Carbohydrates | Arabinose or Xylose | New |
| 263050 | Carbohydrates | Carbohydrates | F3-U0.813 Carbohydrate | 60% to 79% |
| 263050 | Carbohydrates | Carbohydrates | F3-U0.816 Carbohydrate | 60% to 92% |
| 263050 | Carbohydrates | Carbohydrates | F3-U0.821 Carbohydrate | 60% to 100% |
| 263050 | Carbohydrates | Carbohydrates | F3-U0.846 Carbohydrate | 71% to 119% |
| 263050 | Carbohydrates | Carbohydrates | F3-U0.872 Hexose | 77% to 174% |
| 263050 | Carbohydrates | Carbohydrates | F3-U1.113 Carbohydrate | 216% to 360% |
| 263050 | Carbohydrates | Carbohydrates | F3-U1.150 Carbohydrate | 137% to 246% |
| 263050 | Carbohydrates | Carbohydrates | F3-U1.189 Carbohydrate | 187% to 683% |
| 263050 | Carbohydrates | Carbohydrates | F3-U1.194 Carbohydrate | 258% to 462% |
| 263050 | Carbohydrates | Carbohydrates | Fructose | 188% to 379% |
| 263050 | Carbohydrates | Carbohydrates | Glucose | 167% to 633% |
| 263050 | NA | NA | F3-U0.736 | New |
| 263050 | NA | NA | F3-U0.751 | 123% to 355% |
| 263050 | NA | NA | F3-U0.852A | 61% to 102% |
| 263050 | NA | NA | F3-U0.899 | New |
| 263050 | NA | NA | F3-U1.229 | 173% to 288% |
| 263050 | NA | NA | F3-U1.232B | New |
| 263050 | NA | NA | F3-U1.253 | 122% to 204% |
| 263050 | Phenols and Related Compounds | Phenylpropanes and Derivatives | Chlorogenic acid | 76% to 341% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263060

| Seq ID | Chemical Class | Biochemical Class | Compound Name | Modification |
|---|---|---|---|---|
| 263060 | Acids | Acids | Hexanedioic acid | New |
| 263060 | Acids - Fatty | Fatty Acids and Related Waxes | Docosanoic acid | 177% to 296% |
| 263060 | Acids - Fatty | Fatty Acids and Related Waxes | Tetracosanoic acid | 60% to 92% |
| 263060 | Acids - Fatty Branched | Fatty Acids and Related Waxes | Hexadecanoic acid, 14-methyl- | 60% to 89% |
| 263060 | Acids - Fatty Unsat | Fatty Acids and Related Waxes | 7,10,13-Docosatrienoic acid | 63% to 132% |
| 263060 | Acids - Fatty Unsat | Fatty Acids and Related Waxes | 9,12-Octadecadienoic acid | 60% to 101% |
| 263060 | Acids - Fatty Unsat | Fatty Acids and Related Waxes | 9-Hexadecenoic acid | 128% to 213% |
| 263060 | Acids - Fatty Unsat | Fatty Acids and Related Waxes | 9-Octadecenoic acid | 60% to 103% |
| 263060 | Amino Acids and Related Compounds | Amino Acids and Related Compounds | Glutamic acid | 60% to 125% |
| 263060 | Amino Acids and Related Compounds | Amino Acids and Related Compounds | Histidine | 100% to 250% |
| 263060 | Amino Acids and Related Compounds | Amino Acids and Related Compounds | Isoleucine | New |
| 263060 | Amino Acids and Related Compounds | Amino Acids and Related Compounds | Leucine | New |
| 263060 | Amino Acids and Related Compounds | Amino Acids and Related Compounds | Lysine | 60% to 250% |
| 263060 | Amino Acids and Related Compounds | Amino Acids and Related Compounds | Serine | 60% to 105% |
| 263060 | Amino Acids and Related Compounds | Amino Acids and Related Compounds | Threonine | 160% to 355% |
| 263060 | Amino Acids and Related Compounds | Amino Acids and Related Compounds | Tryptophan | New |
| 263060 | Amino Acids and Related Compounds | Amino Acids and Related Compounds | Valine | 105% to 475% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263070

| Seq ID | Chemical Class | Biochemical Class | Compound Name | Modification |
|---|---|---|---|---|
| 263070 | Alkenes and Alkynes | Terpenoids | Limonene | 223% to 372% |
| 263070 | Esters | Esters | F1-U1.076 Fatty Acid Ester | 168% to 280% |
| 263070 | Esters | Esters | F1-U1.121 Fatty Acid Ester | 145% to 242% |
| 263070 | Esters - Hydroxy | Acyl acetylglycerols | 2-Eicosanoyl-1-acetylglycerol | 99% to 165% |
| 263070 | Esters - Hydroxy | Acyl acetylglycerols | 2-Octadecanoyl-1-acetylglycerol | 60% to 87% |
| 263070 | Sterols, Oxygenated Terpenes, and Other Isoprenoids | Prenylquinones | alpha-Tocopherol hydroquinone | 1712% to 2854% |
| 263070 | Sterols, Oxygenated Terpenes, and Other Isoprenoids | Terpenoids | beta-Sitosterol | 60% to 89% |
| 263070 | Sterols, Oxygenated Terpenes, and Other Isoprenoids | Prenylquinones | beta-Tocopherol | New |
| 263070 | Sterols, Oxygenated Terpenes, and Other Isoprenoids | Terpenoids | Cycloartenol | 60% to 88% |
| 263070 | Sterols, Oxygenated Terpenes, and Other Isoprenoids | Terpenoids | F1-U1.136 Sterol | 81% to 135% |
| 263070 | Sterols, Oxygenated Terpenes, and Other Isoprenoids | Terpenoids | Stigmasterol | 60% to 90% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263110

| Seq ID | Chemical Class | Biochemical Class | Compound Name | Modification |
|---|---|---|---|---|
| 263110 | Acids - Hydroxy Alpha | Acid Pathway | Malic acid | -60% to -85% |
| 263110 | Acids - Hydroxy Alpha | Carbohydrates | Quinic acid | -60% to -98% |
| 263110 | Alkaloids and Other Bases | Polyamines | 1,4-Butanediamine | 148% to 247% |
| 263110 | Amino Acids and Related Compounds | Amino Acids and Related Compounds | Asparagine | New |
| 263110 | Amino Acids and Related Compounds | Amino Acids and Related Compounds | Glutamic acid | 77% to 128% |
| 263110 | Amino Acids and Related Compounds | Amino Acids and Related Compounds | Proline | 148% to 247% |
| 263110 | Amino Acids and Related Compounds | Amino Acids and Related Compounds | Proline, 5-oxo- | 60% to 94% |
| 263110 | Carbohydrates | Carbohydrates | Arabinose or Xylose | New |
| 263110 | Carbohydrates | Carbohydrates | F3-U0.848 Carbohydrate | 225% to 375% |
| 263110 | Carbohydrates | Carbohydrates | F3-U0.872 Hexose | 64% to 106% |
| 263110 | Carbohydrates | Carbohydrates | F3-U1.148 Carbohydrate | 1314% to 2190% |
| 263110 | Carbohydrates | Carbohydrates | Fructose | 698% to 1376% |
| 263110 | Carbohydrates | Carbohydrates | Galactose or Mannose | New |
| 263110 | Carbohydrates | Carbohydrates | Glucose | 382% to 1688% |
| 263110 | NA | NA | F3-U0.704 | New |
| 263110 | NA | NA | F3-U0.751 | 60% to 99% |
| 263110 | NA | NA | F3-U0.791 | 89% to 148% |
| 263110 | NA | NA | F3-U0.882 | 256% to 427% |
| 263110 | Phenols and Related Compounds | Phenylpropanes and Derivatives | Chlorogenic acid | -60% to -77% |
| 263110 | Sterols, Oxygenated Terpenes, and Other Isoprenoids | Prenylquinones | alpha-Tocopherol | 406% to 935% |
| 263110 | Sterols, Oxygenated Terpenes, and Other Isoprenoids | Prenylquinones | alpha-Tocopherol hydroquinone | 169% to 282% |
| 263110 | Sterols, Oxygenated Terpenes, and Other Isoprenoids | Terpenoids | beta-Sitosterol | 95% to 159% |
| 263110 | Sterols, Oxygenated Terpenes, and Other Isoprenoids | Prenylquinones | beta-Tocopherol | New |
| 263110 | Sterols, Oxygenated Terpenes, and Other Isoprenoids | Terpenoids | F1-U1.136 Sterol | 60% to 81% |
| 263110 | Sterols, Oxygenated Terpenes, and Other Isoprenoids | Terpenoids | F1-U1.217 Sterol | 73% to 121% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263114

| Seq ID | Chemical Class | Biochemical Class | Compound Name | Modification |
|---|---|---|---|---|
| 263114 | Acids - Hydroxy Alpha | Acid Pathway | Malic acid | -60% to -84% |
| 263114 | Acids - Hydroxy Alpha | Carbohydrates | Quinic acid | -60% to -85% |
| 263114 | Amino Acids and Related Compounds | Amino Acids and Related Compounds | Asparagine | New |
| 263114 | Carbohydrates | Carbohydrates | Arabinose or Xylose | 69% to 115% |
| 263114 | Carbohydrates | Carbohydrates | F3-U0.825 Carbohydrate | 143% to 238% |
| 263114 | Carbohydrates | Carbohydrates | F3-U1.150 Carbohydrate | 545% to 908% |
| 263114 | Carbohydrates | Carbohydrates | F3-U1.189 Carbohydrate | -64% to -100% |
| 263114 | Carbohydrates | Carbohydrates | Fructose | 408% to 835% |
| 263114 | Carbohydrates | Carbohydrates | Galactose or Mannose | 1275% to 2125% |
| 263114 | Carbohydrates | Carbohydrates | Glucose | 305% to 895% |
| 263114 | Hydrocarbons | Hydrocarbons | Nonacosane, 3-methyl | 60% to 77% |
| 263114 | NA | NA | F3-U0.704 | New |
| 263114 | NA | NA | F3-U0.751 | -60% to -88% |
| 263114 | Sterols, Oxygenated Terpenes, and Other Isoprenoids | Prenylquinones | alpha-Tocopherol | 114% to 489% |
| 263114 | Sterols, Oxygenated Terpenes, and Other Isoprenoids | Terpenoids | beta-Sitosterol | 82% to 191% |
| 263114 | Sterols, Oxygenated Terpenes, and Other Isoprenoids | Prenylquinones | beta-Tocopherol | New |
| 263114 | Sterols, Oxygenated Terpenes, and Other Isoprenoids | Terpenoids | Campesterol | -60% to -81% |
| 263114 | Sterols, Oxygenated Terpenes, and Other Isoprenoids | Terpenoids | Cholesterol | NQ |
| 263114 | Sterols, Oxygenated Terpenes, and Other Isoprenoids | Terpenoids | F1-U1.141 Sterol | 60% to 148% |
| 263114 | Sterols, Oxygenated Terpenes, and Other Isoprenoids | Prenylquinones | gamma-Tocopherol | New |
| 263114 | Sterols, Oxygenated Terpenes, and Other Isoprenoids | Terpenoids | Stigmasta-3,5-diene | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#263125

| Seq ID | Chemical Class | Biochemical Class | Compound Name | Modification |
|---|---|---|---|---|
| 263125 | Acids | Acids | Hexanedioic acid | New |
| 263125 | Acids - Fatty Branched | Fatty Acids and Related Waxes | Octadecanoic acid, 17-methyl- | 67% to 112% |
| 263125 | Acids - Fatty Unsat | Fatty Acids and Related Waxes | 7,10,13-Docosatrienoic acid | 60% to 86% |
| 263125 | Acids - Fatty Unsat | Fatty Acids and Related Waxes | 7,10-Hexadecadienoic acid | 86% to 144% |
| 263125 | Acids - Fatty Unsat | Fatty Acids and Related Waxes | 9,12-Octadecadienoic acid | 60% to 80% |
| 263125 | Acids - Fatty Unsat | Fatty Acids and Related Waxes | 9-Hexadecenoic acid | 65% to 108% |
| 263125 | Acids - Fatty Unsat | Fatty Acids and Related Waxes | 9-Octadecenoic acid | 60% to 2445% |
| 263125 | Alkenes and Alkynes | Terpenoids | Limonene | 60% to 80% |
| 263125 | Esters | Esters | F1-U1.076 Fatty Acid Ester | 159% to 265% |
| 263125 | Esters | Esters | F1-U1.113 Fatty Acid Ester | 122% to 204% |
| 263125 | Esters | Esters | F1-U1.121 Fatty Acid Ester | 64% to 106% |
| 263125 | Esters - Hydroxy | Acyl acetylglycerols | 2-Octadecanoyl-1-acetylglycerol | 81% to 136% |
| 263125 | Sterols, Oxygenated Terpenes, and Other Isoprenoids | Prenylquinones | alpha-Tocopherol hydroquinone | New |
| 263125 | Sterols, Oxygenated Terpenes, and Other Isoprenoids | Terpenoids | Campesterol | 60% to 84% |
| 263125 | Sterols, Oxygenated Terpenes, and Other Isoprenoids | Terpenoids | Stigmasterol | 60% to 98% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263127

| Seq ID | Chemical Class | Biochemical Class | Compound Name | Modification |
|---|---|---|---|---|
| 263127 | Acids - Hydroxy Alpha | Acid Pathway | Citric acid | 144% to 240% |
| 263127 | Acids - Hydroxy Alpha | Carbohydrates | Quinic acid | -71% to -100% |
| 263127 | Alcohols | Carbohydrates | Inositol | 60% to 82% |
| 263127 | Carbohydrates | Carbohydrates | F3-U0.813 Carbohydrate | 86% to 143% |
| 263127 | Carbohydrates | Carbohydrates | F3-U0.816 Carbohydrate | 80% to 133% |
| 263127 | Carbohydrates | Carbohydrates | F3-U0.821 Carbohydrate | 144% to 240% |
| 263127 | Carbohydrates | Carbohydrates | F3-U0.825 Carbohydrate | 196% to 327% |
| 263127 | Carbohydrates | Carbohydrates | F3-U0.846 Carbohydrate | 199% to 331% |
| 263127 | Carbohydrates | Carbohydrates | F3-U0.848 Carbohydrate | 563% to 938% |
| 263127 | Carbohydrates | Carbohydrates | F3-U0.872 Hexose | 218% to 364% |
| 263127 | Carbohydrates | Carbohydrates | F3-U1.032 Carbohydrate | New |
| 263127 | Carbohydrates | Carbohydrates | F3-U1.060 Carbohydrate | New |
| 263127 | Carbohydrates | Carbohydrates | F3-U1.189 Carbohydrate | NQ |
| 263127 | Carbohydrates | Carbohydrates | F3-U1.194 Carbohydrate | NQ |
| 263127 | Carbohydrates | Carbohydrates | Fructose | 137% to 408% |
| 263127 | Carbohydrates | Carbohydrates | Glucose | 123% to 249% |
| 263127 | NA | NA | F3-U0.852A | 95% to 158% |
| 263127 | NA | NA | F3-U1.067 | New |
| 263127 | NA | NA | F3-U1.229 | NQ |
| 263127 | Phenols and Related Compounds | Phenylpropanes and Derivatives | Chlorogenic acid | NQ |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#263146

| Seq ID | Chemical Class | Biochemical Class | Compound Name | Modification |
|---|---|---|---|---|
| 263146 | Acids - Fatty | Fatty Acids and Related Waxes | Eicosanoic acid | 20% to 181% |
| 263146 | Acids - Fatty | Fatty Acids and Related Waxes | Hexadecanoic acid | 8% to 18% |
| 263146 | Acids - Fatty | Fatty Acids and Related Waxes | Octadecanoic acid | 53% to 86% |
| 263146 | Acids - Fatty Branched | Fatty Acids and Related Waxes | Heptadecanoic acid, 16-methyl- | 5% to 185% |
| 263146 | Acids - Fatty Unsat | Fatty Acids and Related Waxes | 7,10,13-Hexadecatrienoic acid | -6% to -23% |
| 263146 | Acids - Fatty Unsat | Fatty Acids and Related Waxes | 9-Hexadecenoic acid | -14% to -36% |
| 263146 | Acids - Fatty Unsat | Fatty Acids and Related Waxes | 9-Octadecenoic acid | -16% to -52% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263154

| Seq ID | Chemical Class | Biochemical Class | Compound Name | Modification |
|---|---|---|---|---|
| 263154 | Alkenes and Alkynes | Terpenoids | Limonene | 360% to 600% |
| 263154 | Esters | Esters | F1-U1.076 Fatty Acid Ester | 132% to 220% |
| 263154 | Esters | Esters | F1-U1.121 Fatty Acid Ester | 150% to 250% |
| 263154 | Esters - Hydroxy | Acyl acetylglycerols | 2-Eicosanoyl-1-acetylglycerol | 103% to 172% |
| 263154 | Esters - Hydroxy | Acyl acetylglycerols | 2-Octadecanoyl-1-acetylglycerol | 60% to 91% |
| 263154 | Sterols, Oxygenated Terpenes, and Other Isoprenoids | Prenylquinones | alpha-Tocopherol | 406% to 676% |
| 263154 | Sterols, Oxygenated Terpenes, and Other Isoprenoids | Prenylquinones | alpha-Tocopherol hydroquinone | 404% to 674% |
| 263154 | Sterols, Oxygenated Terpenes, and Other Isoprenoids | Prenylquinones | beta-Tocopherol | New |
| 263154 | Sterols, Oxygenated Terpenes, and Other Isoprenoids | Terpenoids | F1-U1.200 Sterol | New |
| 263154 | Sterols, Oxygenated Terpenes, and Other Isoprenoids | Terpenoids | Stigmast-7-en-3-ol | New |
| 263154 | Sterols, Oxygenated Terpenes, and Other Isoprenoids | Terpenoids | Stigmasterol | 61% to 102% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263157

| Seq ID | Chemical Class | Biochemical Class | Compound Name | Modification |
|---|---|---|---|---|
| 263157 | Esters | Esters | F1-U1.076 Fatty Acid Ester | 166% to 276% |
| 263157 | Esters - Hydroxy | Acyl acetylglycerols | 2-Eicosanoyl-1-acetylglycerol | 60% to 86% |
| 263157 | Sterols, Oxygenated Terpenes, and Other Isoprenoids | Prenylquinones | alpha-Tocopherol | 181% to 429% |
| 263157 | Sterols, Oxygenated Terpenes, and Other Isoprenoids | Terpenoids | F1-U1.153 Sterol | 161% to 268% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263177

| Seq ID | Chemical Class | Biochemical Class | Compound Name | Modification |
|---|---|---|---|---|
| 263177 | Acids - Hydroxy Alpha | Acid Pathway | Citric acid | 70% to 117% |
| 263177 | Acids - Hydroxy Alpha | Carbohydrates | Quinic acid | -60% to -80% |
| 263177 | Amino Acids and Related Compounds | Amino Acids and Related Compounds | Arginine | 60% to 125% |
| 263177 | Amino Acids and Related Compounds | Amino Acids and Related Compounds | Asparagine | New |
| 263177 | Amino Acids and Related Compounds | Amino Acids and Related Compounds | Cysteine | 60% to 250% |
| 263177 | Amino Acids and Related Compounds | Amino Acids and Related Compounds | Glutamine | New |
| 263177 | Amino Acids and Related Compounds | Amino Acids and Related Compounds | Glycine | 60% to 170% |
| 263177 | Amino Acids and Related Compounds | Amino Acids and Related Compounds | Isoleucine | New |
| 263177 | Amino Acids and Related Compounds | Amino Acids and Related Compounds | Leucine | New |
| 263177 | Amino Acids and Related Compounds | Amino Acids and Related Compounds | Methionine | 60% to 365% |
| 263177 | Amino Acids and Related Compounds | Amino Acids and Related Compounds | Proline | 60% to 580% |
| 263177 | Amino Acids and Related Compounds | Amino Acids and Related Compounds | Serine | 60% to 220% |
| 263177 | Amino Acids and Related Compounds | Amino Acids and Related Compounds | Threonine | 60% to 185% |
| 263177 | Amino Acids and Related Compounds | Amino Acids and Related Compounds | Tryptophan | New |
| 263177 | Amino Acids and Related Compounds | Amino Acids and Related Compounds | Tyrosine | New |
| 263177 | Amino Acids and Related Compounds | Amino Acids and Related Compounds | Tyrosine | New |
| 263177 | Amino Acids and Related Compounds | Amino Acids and Related Compounds | Valine | 200% to 775% |
| 263177 | Carbohydrates | Carbohydrates | F3-U0.825 Carbohydrate | 278% to 463% |
| 263177 | Carbohydrates | Carbohydrates | F3-U0.952 Carbohydrate | 65% to 108% |
| 263177 | Carbohydrates | Carbohydrates | F3-U1.104 Carbohydrate | 195% to 325% |
| 263177 | Carbohydrates | Carbohydrates | F3-U1.113 Carbohydrate | 60% to 91% |
| 263177 | Carbohydrates | Carbohydrates | F3-U1.189 Carbohydrate | 82% to 136% |
| 263177 | NA | NA | F3-U1.229 | 144% to 240% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263180

| Seq ID | Chemical Class | Biochemical Class | Compound Name | Modification |
|---|---|---|---|---|
| 263180 | Amino Acids and Related Compounds | Amino Acids and Related Compounds | Glutamic acid | 60% to 195% |
| 263180 | Amino Acids and Related Compounds | Amino Acids and Related Compounds | Leucine | New |
| 263180 | Amino Acids and Related Compounds | Amino Acids and Related Compounds | Lysine | 25% to 235% |
| 263180 | Amino Acids and Related Compounds | Amino Acids and Related Compounds | Serine | 65% to 300% |
| 263180 | Amino Acids and Related Compounds | Amino Acids and Related Compounds | Valine | 20% to 225% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263181

| Seq ID | Chemical Class | Biochemical Class | Compound Name | Modification |
|---|---|---|---|---|
| 263181 | Acids - Fatty | Fatty Acids and Related Waxes | Tetracosanoic acid | 60% to 82% |
| 263181 | Acids - Fatty Branched | Fatty Acids and Related Waxes | Isoeicosanoic acid | New |
| 263181 | Acids - Fatty Unsat | Fatty Acids and Related Waxes | 9,12-Octadecadienoic acid | 60% to 35% |
| 263181 | Acids - Hydroxy Alpha | Acid Pathway | Citric acid | 170% to 284% |
| 263181 | Acids - Hydroxy Alpha | Carbohydrates | Quinic acid | -60% to -82% |
| 263181 | Alcohols | Carbohydrates | Inositol | -60% to -83% |
| 263181 | Amino Acids and Related Compounds | Amino Acids and Related Compounds | Arginine | 170% to 515% |
| 263181 | Amino Acids and Related Compounds | Amino Acids and Related Compounds | Asparagine | New |
| 263181 | Amino Acids and Related Compounds | Amino Acids and Related Compounds | Cysteine | 60% to 2060% |
| 263181 | Amino Acids and Related Compounds | Amino Acids and Related Compounds | Glutamine | New |
| 263181 | Amino Acids and Related Compounds | Amino Acids and Related Compounds | Glycine | New |
| 263181 | Amino Acids and Related Compounds | Amino Acids and Related Compounds | Histidine | 60% to 800% |
| 263181 | Amino Acids and Related Compounds | Amino Acids and Related Compounds | Lysine | New |
| 263181 | Amino Acids and Related Compounds | Amino Acids and Related Compounds | Proline, 5-oxo- | 60% to 80% |
| 263181 | Amino Acids and Related Compounds | Amino Acids and Related Compounds | Serine | 60% to 355% |
| 263181 | Amino Acids and Related Compounds | Amino Acids and Related Compounds | Threonine | 60% to 600% |
| 263181 | Amino Acids and Related Compounds | Amino Acids and Related Compounds | Tryptophan | 60% to 150% |
| 263181 | Carbohydrates | Carbohydrates | F3-U0.846 Carbohydrate | -60% to -92% |
| 263181 | Carbohydrates | Carbohydrates | F3-U0.848 Carbohydrate | NQ |
| 263181 | Carbohydrates | Carbohydrates | F3-U0.872 Hexose | -60% to -91% |
| 263181 | Carbohydrates | Carbohydrates | F3-U1.150 Carbohydrate | 60% to 100% |
| 263181 | Carbohydrates | Carbohydrates | Fructose | -60% to -100% |
| 263181 | Carbohydrates | Carbohydrates | Galactose or Mannose | NQ |
| 263181 | Carbohydrates | Carbohydrates | Glucose | -60% to -100% |
| 263181 | NA | NA | F3-U0.751 | -60% to -81% |
| 263181 | NA | NA | F3-U0.782 | New |
| 263181 | NA | NA | F3-U0.799 | New |
| 263181 | NA | NA | F3-U0.886 | 362% to 604% |
| 263181 | Phenols and Related Compounds | Phenylpropanes and Derivatives | Chlorogenic acid | -60% to -85% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#263184

| Seq ID | Chemical Class | Biochemical Class | Compound Name | Modification |
|---|---|---|---|---|
| 263184 | Acids - Fatty | Fatty Acids and Related Waxes | Octadecanoic acid | 60% to 90% |
| 263184 | Acids - Fatty Unsat | Fatty Acids and Related Waxes | 9-Octadecenoic acid | NQ |
| 263184 | Acids - Hydroxy Alpha | Acid Pathway | Citric acid | 229% to 381% |
| 263184 | Alcohols | Carbohydrates | F3-U0.764 Sugar Alcohol | New |
| 263184 | Amino Acids and Related Compounds | Amino Acids and Related Compounds | Arginine | 60% to 230% |
| 263184 | Amino Acids and Related Compounds | Amino Acids and Related Compounds | Asparagine | 444% to 740% |
| 263184 | Amino Acids and Related Compounds | Amino Acids and Related Compounds | Cysteine | 60% to 515% |
| 263184 | Amino Acids and Related Compounds | Amino Acids and Related Compounds | Glutamine | New |
| 263184 | Amino Acids and Related Compounds | Amino Acids and Related Compounds | Glycine | 60% to 175% |
| 263184 | Amino Acids and Related Compounds | Amino Acids and Related Compounds | Leucine | New |
| 263184 | Amino Acids and Related Compounds | Amino Acids and Related Compounds | Lysine | 60% to 295% |
| 263184 | Amino Acids and Related Compounds | Amino Acids and Related Compounds | Proline | 60% to 380% |
| 263184 | Amino Acids and Related Compounds | Amino Acids and Related Compounds | Serine | 60% to 290% |
| 263184 | Amino Acids and Related Compounds | Amino Acids and Related Compounds | Threonine | 116% to 750% |
| 263184 | Amino Acids and Related Compounds | Amino Acids and Related Compounds | Tyrosine | New |
| 263184 | Amino Acids and Related Compounds | Amino Acids and Related Compounds | Valine | 405% to 1265% |
| 263184 | Carbohydrates | Carbohydrates | Arabinose or Xylose | New |
| 263184 | Carbohydrates | Carbohydrates | F3-U0.813 Carbohydrate | 341% to 569% |
| 263184 | Carbohydrates | Carbohydrates | F3-U0.816 Carbohydrate | 149% to 249% |
| 263184 | Carbohydrates | Carbohydrates | F3-U0.821 Carbohydrate | 229% to 381% |
| 263184 | Carbohydrates | Carbohydrates | F3-U0.825 Carbohydrate | 153% to 255% |
| 263184 | Carbohydrates | Carbohydrates | F3-U0.846 Carbohydrate | 60% to 99% |
| 263184 | Carbohydrates | Carbohydrates | F3-U0.872 Hexose | 87% to 145% |
| 263184 | Carbohydrates | Carbohydrates | F3-U0.907 Carbohydrate | 552% to 920% |
| 263184 | Carbohydrates | Carbohydrates | F3-U0.956 Carbohydrate | New |
| 263184 | Carbohydrates | Carbohydrates | F3-U1.049B Carbohydrate | New |
| 263184 | Carbohydrates | Carbohydrates | F3-U1.113 Carbohydrate | 170% to 284% |
| 263184 | Carbohydrates | Carbohydrates | F3-U1.189 Carbohydrate | 60% to 85% |
| 263184 | Carbohydrates | Carbohydrates | F3-U1.194 Carbohydrate | 80% to 133% |
| 263184 | Carbohydrates | Carbohydrates | Fructose | 360% to 750% |
| 263184 | Carbohydrates | Carbohydrates | Glucose | 168% to 394% |
| 263184 | Hydrocarbons | Hydrocarbons | F1-U1.086 Hydrocarbon | New |
| 263184 | NA | NA | F1-U0.873 | New |
| 263184 | NA | NA | F1-U0.972 | New |
| 263184 | NA | NA | F3-U0.791 | 126% to 210% |
| 263184 | NA | NA | F3-U0.852A | 553% to 921% |
| 263184 | NA | NA | F3-U0.882 | 369% to 615% |
| 263184 | NA | NA | F3-U1.253 | 87% to 144% |
| 263184 | NA | NA | F3-U1.255 | 60% to 95% |
| 263184 | Phenols and Related Compounds | Phenylpropanes and Derivatives | Chlorogenic acid | 60% to 93% |
| 263184 | Sterols, Oxygenated Terpenes, and Other Isoprenoids | Prenylquinones | alpha-Tocopherol | 346% to 576% |
| 263184 | Sterols, Oxygenated Terpenes, and Other Isoprenoids | Prenylquinones | alpha-Tocopherol hydroquinone | 403% to 671% |
| 263184 | Sterols, Oxygenated Terpenes, and Other Isoprenoids | Terpenoids | beta-Sitosterol | 71% to 118% |
| 263184 | Sterols, Oxygenated Terpenes, and Other Isoprenoids | Prenylquinones | beta-Tocopherol | New |
| 263184 | Sterols, Oxygenated Terpenes, and Other Isoprenoids | Terpenoids | Campesterol | 90% to 151% |
| 263184 | Sterols, Oxygenated Terpenes, and Other Isoprenoids | Terpenoids | Ergosta-8,24(28)-dien-3-ol, 4,14-dimethyl- | New |
| 263184 | Sterols, Oxygenated Terpenes, and Other Isoprenoids | Terpenoids | F1-U1.122 Sterol | 86% to New |
| 263184 | Sterols, Oxygenated Terpenes, and Other Isoprenoids | Terpenoids | F1-U1.130 Sterol | New |
| 263184 | Sterols, Oxygenated Terpenes, and Other Isoprenoids | Terpenoids | F1-U1.136 Sterol | 85% to 142% |
| 263184 | Sterols, Oxygenated Terpenes, and Other Isoprenoids | Terpenoids | F1-U1.216 Sterol | 60% to 96% |
| 263184 | Sterols, Oxygenated Terpenes, and Other Isoprenoids | Terpenoids | F1-U1.245 Sterol | 162% to 270% |
| 263184 | Sterols, Oxygenated Terpenes, and Other Isoprenoids | Terpenoids | Fucosterol | New |
| 263184 | Sterols, Oxygenated Terpenes, and Other Isoprenoids | Terpenoids | Stigmasta-4,22-dien-3-ol | 83% to 138% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, SeqID#263186

| Seq ID | Chemical Class | Biochemical Class | Compound Name | Modification |
|---|---|---|---|---|
| 263186 | Amino Acids and Related Compounds | Amino Acids and Related Compounds | Glycine | New |
| 263186 | Alkenes and Alkynes | Terpenoids | Limonene | 60% to 97% |
| 263186 | Amino Acids and Related Compounds | Amino Acids and Related Compounds | Arginine | 70% to 155% |
| 263186 | Amino Acids and Related Compounds | Amino Acids and Related Compounds | Histidine | 60% to 890% |
| 263186 | Amino Acids and Related Compounds | Amino Acids and Related Compounds | Isoleucine | New |
| 263186 | Amino Acids and Related Compounds | Amino Acids and Related Compounds | Leucine | New |
| 263186 | Amino Acids and Related Compounds | Amino Acids and Related Compounds | Lysine | 60% to 315% |
| 263186 | Amino Acids and Related Compounds | Amino Acids and Related Compounds | Methionine | 105% to 335% |
| 263186 | Amino Acids and Related Compounds | Amino Acids and Related Compounds | Tryptophan | New |
| 263186 | Amino Acids and Related Compounds | Amino Acids and Related Compounds | Valine | 295% to 755% |
| 263186 | Esters | Esters | F1-U1.076 Fatty Acid Ester | New |
| 263186 | Esters | Esters | F1-U1.121 Fatty Acid Ester | New |
| 263186 | Esters - Hydroxy | Acyl acetylglycerols | 2-Eicosanoyl-1-acetylglycerol | 189% to 315% |
| 263186 | Esters - Hydroxy | Acyl acetylglycerols | 2-Octadecanoyl-1-acetylglycerol | 80% to 134% |
| 263186 | NA | NA | F1-U1.241 | New |
| 263186 | Sterols, Oxygenated Terpenes, and Other Isoprenoids | Prenylquinones | alpha-Tocopherol | 257% to 429% |
| 263186 | Sterols, Oxygenated Terpenes, and Other Isoprenoids | Prenylquinones | alpha-Tocopherol hydroquinone | 866% to 1444% |
| 263186 | Sterols, Oxygenated Terpenes, and Other Isoprenoids | Terpenoids | beta-Sitosterol | 60% to 77% |
| 263186 | Sterols, Oxygenated Terpenes, and Other Isoprenoids | Terpenoids | Cholesterol | 60% to 90% |
| 263186 | Sterols, Oxygenated Terpenes, and Other Isoprenoids | Terpenoids | F1-U1.106 Sterol | New |
| 263186 | Sterols, Oxygenated Terpenes, and Other Isoprenoids | Terpenoids | F1-U1.136 Sterol | 60% to 96% |
| 263186 | Sterols, Oxygenated Terpenes, and Other Isoprenoids | Prenylquinones | gamma-Tocopherol | New |
| 263186 | Sterols, Oxygenated Terpenes, and Other Isoprenoids | Terpenoids | Stigmasterol | 109% to 182% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263187

| Seq ID | Chemical Class | Biochemical Class | Compound Name | Modification |
|---|---|---|---|---|
| 263187 | NA | NA | F1-U1.050 | New |
| 263187 | Alkenes and Alkynes | Terpenoids | Limonene | 60% to 78% |
| 263187 | Sterols, Oxygenated Terpenes, and Other Isoprenoids | Prenylquinones | alpha-Tocopherol | 60% to 81% |
| 263187 | Sterols, Oxygenated Terpenes, and Other Isoprenoids | Prenylquinones | alpha-Tocopherol hydroquinone | 81% to 135% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263202

| Seq ID | Chemical Class | Biochemical Class | Compound Name | Modification |
|---|---|---|---|---|
| 263202 | NA | NA | F1-U0.972 | New |
| 263202 | Amino Acids and Related Compounds | Amino Acids and Related Compounds | Arginine | 165% to 295% |
| 263202 | Amino Acids and Related Compounds | Amino Acids and Related Compounds | Histidine | 60% to 555% |
| 263202 | Amino Acids and Related Compounds | Amino Acids and Related Compounds | Isoleucine | New |
| 263202 | Amino Acids and Related Compounds | Amino Acids and Related Compounds | Leucine | New |
| 263202 | Amino Acids and Related Compounds | Amino Acids and Related Compounds | Lysine | 60% to 325% |
| 263202 | Amino Acids and Related Compounds | Amino Acids and Related Compounds | Valine | 85% to 295% |
| 263202 | Esters | Esters | F1-U1.076 Fatty Acid Ester | New |
| 263202 | Esters | Esters | F1-U1.113 Fatty Acid Ester | 542% to 903% |
| 263202 | Esters | Esters | F1-U1.121 Fatty Acid Ester | New |
| 263202 | Esters - Hydroxy | Acyl acetylglycerols | 2-Octadecanoyl-1-acetylglycerol | 359% to 599% |
| 263202 | NA | NA | F1-U1.119 | New |
| 263202 | Sterols, Oxygenated Terpenes, and Other Isoprenoids | Prenylquinones | alpha-Tocopherol hydroquinone | New |
| 263202 | Sterols, Oxygenated Terpenes, and Other Isoprenoids | Terpenoids | beta-Sitosterol | 104% to 173% |
| 263202 | Sterols, Oxygenated Terpenes, and Other Isoprenoids | Prenylquinones | beta-Tocopherol | New |
| 263202 | Sterols, Oxygenated Terpenes, and Other Isoprenoids | Terpenoids | Campesterol | 60% to 99% |
| 263202 | Sterols, Oxygenated Terpenes, and Other Isoprenoids | Terpenoids | Cholesterol | 90% to 150% |
| 263202 | Sterols, Oxygenated Terpenes, and Other Isoprenoids | Terpenoids | Stigmasta-5,22-dien-3-ol, acetate | 98% to 164% |
| 263202 | Sterols, Oxygenated Terpenes, and Other Isoprenoids | Terpenoids | Stigmasterol | 150% to 251% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263216

| Seq ID | Chemical Class | Biochemical Class | Compound Name | Modification |
|---|---|---|---|---|
| 263216 | Alkenes and Alkynes | Terpenoids | Limonene | 208% to 346% |
| 263216 | Esters | Esters | F1-U1.076 Fatty Acid Ester | 396% to 660% |
| 263216 | Esters | Esters | F1-U1.113 Fatty Acid Ester | 326% to 544% |
| 263216 | Esters | Esters | F1-U1.121 Fatty Acid Ester | 300% to 499% |
| 263216 | Esters - Hydroxy | Acyl acetylglycerols | 2-Octadecanoyl-1-acetylglycerol | 317% to 528% |
| 263216 | NA | NA | F1-U1.119 | New |
| 263216 | Sterols, Oxygenated Terpenes, and Other Isoprenoids | Prenylquinones | alpha-Tocopherol | 588% to 980% |
| 263216 | Sterols, Oxygenated Terpenes, and Other Isoprenoids | Prenylquinones | alpha-Tocopherol hydroquinone | 1385% to 2308% |
| 263216 | Sterols, Oxygenated Terpenes, and Other Isoprenoids | Terpenoids | beta-Sitosterol | 61% to 101% |
| 263216 | Sterols, Oxygenated Terpenes, and Other Isoprenoids | Prenylquinones | beta-Tocopherol | New |
| 263216 | Sterols, Oxygenated Terpenes, and Other Isoprenoids | Terpenoids | Campesterol | 60% to 81% |
| 263216 | Sterols, Oxygenated Terpenes, and Other Isoprenoids | Terpenoids | Cycloartenol | 111% to 185% |
| 263216 | Sterols, Oxygenated Terpenes, and Other Isoprenoids | Terpenoids | Ergosta-8,24(28)-dien-3-ol, 4,14-dimethyl- | New |
| 263216 | Sterols, Oxygenated Terpenes, and Other Isoprenoids | Terpenoids | F1-U1.106 Sterol | New |
| 263216 | Sterols, Oxygenated Terpenes, and Other Isoprenoids | Prenylquinones | F1-U1.129 beta-Tocopherol Isomer | 380% to 633% |
| 263216 | Sterols, Oxygenated Terpenes, and Other Isoprenoids | Terpenoids | F1-U1.136 Sterol | 77% to 129% |
| 263216 | Sterols, Oxygenated Terpenes, and Other Isoprenoids | Terpenoids | F1-U1.244 Sterol | New |
| 263216 | Sterols, Oxygenated Terpenes, and Other Isoprenoids | Terpenoids | Stigmasterol | 82% to 137% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263221

| Seq ID | Chemical Class | Biochemical Class | Compound Name | Modification |
|---|---|---|---|---|
| 263221 | Acids - Hydroxy Alpha | Acid Pathway | Butanoic acid, 2,3,4-trihydroxy- | -60% to -77% |
| 263221 | Acids - Fatty | Fatty Acids and Related Waxes | Octadecanoic acid | 60% to 116% |
| 263221 | Acids - Fatty Branched | Fatty Acids and Related Waxes | Heptadecanoic acid, 16-methyl- | 60% to 181% |
| 263221 | Acids - Fatty Unsat | Fatty Acids and Related Waxes | 9-Octadecenoic acid | -60% to -68% |
| 263221 | Acids - Hydroxy Alpha | Acid Pathway | Citric acid | 402% to 670% |
| 263221 | Amino Acids and Related Compounds | Amino Acids and Related Compounds | Cysteine | 315% to 2210% |
| 263221 | Amino Acids and Related Compounds | Amino Acids and Related Compounds | Leucine | New |
| 263221 | Amino Acids and Related Compounds | Amino Acids and Related Compounds | Lysine | 60% to 250% |
| 263221 | Carbohydrates | Carbohydrates | Arabinose or Xylose | 63% to 105% |
| 263221 | Carbohydrates | Carbohydrates | F3-U0.813 Carbohydrate | 593% to 988% |
| 263221 | Carbohydrates | Carbohydrates | F3-U0.816 Carbohydrate | 317% to 529% |
| 263221 | Carbohydrates | Carbohydrates | F3-U0.821 Carbohydrate | 402% to 670% |
| 263221 | Carbohydrates | Carbohydrates | F3-U0.825 Carbohydrate | 110% to 584% |
| 263221 | Carbohydrates | Carbohydrates | F3-U0.846 Carbohydrate | 204% to 341% |
| 263221 | Carbohydrates | Carbohydrates | F3-U0.872 Hexose | 130% to 217% |
| 263221 | Carbohydrates | Carbohydrates | Glucose | 4965% to 8274% |
| 263221 | NA | NA | F3-U0.852A | New |
| 263221 | NA | NA | F3-U1.229 | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263224

| Seq ID | Chemical Class | Biochemical Class | Compound Name | Modification |
|---|---|---|---|---|
| 263224 | Alkenes and Alkynes | Terpenoids | Limonene | 67% to 181% |
| 263224 | Esters | Esters | F1-U1.076 Fatty Acid Ester | 63% to 105% |
| 263224 | Sterols, Oxygenated Terpenes, and Other Isoprenoids | Prenylquinones | alpha-Tocopherol | 113% to 189% |
| 263224 | Sterols, Oxygenated Terpenes, and Other Isoprenoids | Prenylquinones | alpha-Tocopherol hydroquinone | New |
| 263224 | Sterols, Oxygenated Terpenes, and Other Isoprenoids | Prenylquinones | beta-Tocopherol | New |
| 263224 | Sterols, Oxygenated Terpenes, and Other Isoprenoids | Terpenoids | F1-U1.136 Sterol | 60% to 88% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263234

| Seq ID | Chemical Class | Biochemical Class | Compound Name | Modification |
|---|---|---|---|---|
| 263234 | Acids - Fatty | Fatty Acids and Related Waxes | Hexadecanoic acid | 306% to 510% |
| 263234 | Acids - Fatty | Fatty Acids and Related Waxes | Octadecanoic acid | 60% to 704% |
| 263234 | Acids - Fatty Branched | Fatty Acids and Related Waxes | Heptadecanoic acid, 16-methyl- | 386% to 643% |
| 263234 | Acids - Fatty Branched | Fatty Acids and Related Waxes | Hexadecanoic acid, 14-methyl- | 60% to 95% |
| 263234 | Acids - Fatty Unsat | Fatty Acids and Related Waxes | 7,10,13-Docosatrienoic acid | 787% to 1311% |
| 263234 | Acids - Fatty Unsat | Fatty Acids and Related Waxes | 9,12,15-Octadecatrienoic acid | 191% to 380% |
| 263234 | Acids - Fatty Unsat | Fatty Acids and Related Waxes | 9,12-Octadecadienoic acid | 266% to 591% |
| 263234 | Acids - Fatty Unsat | Fatty Acids and Related Waxes | 9-Octadecenoic acid | 198% to 330% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#263245

| Seq ID | Chemical Class | Biochemical Class | Compound Name | Modification |
|---|---|---|---|---|
| 263245 | Acids - Fatty | Fatty Acids and Related Waxes | Eicosanoic acid | 60% to 586% |
| 263245 | Acids - Fatty | Fatty Acids and Related Waxes | Hexadecanoic acid | 78% to 590% |
| 263245 | Acids - Fatty | Fatty Acids and Related Waxes | Octadecanoic acid | 90% to 732% |
| 263245 | Acids - Fatty Branched | Fatty Acids and Related Waxes | Heptadecanoic acid, 16-methyl- | 108% to 474% |
| 263245 | Acids - Fatty Unsat | Fatty Acids and Related Waxes | 11-Octadecenoic acid | 131% to 219% |
| 263245 | Acids - Fatty Unsat | Fatty Acids and Related Waxes | 7,10,13-Docosatrienoic acid | 104% to 1362% |
| 263245 | Acids - Fatty Unsat | Fatty Acids and Related Waxes | 7-Hexadecenoic acid | New |
| 263245 | Acids - Fatty Unsat | Fatty Acids and Related Waxes | 9,12,15-Octadecatrienoic acid | 66% to 346% |
| 263245 | Acids - Fatty Unsat | Fatty Acids and Related Waxes | 9,12-Octadecadienoic acid | 79% to 600% |
| 263245 | Acids - Fatty Unsat | Fatty Acids and Related Waxes | 9-Hexadecenoic acid | New |
| 263245 | Acids - Hydroxy Alpha | Acid Pathway | Citric acid | 1193% to 1988% |
| 263245 | Acids - Hydroxy Alpha | Acid Pathway | Malic acid | 64% to 106% |
| 263245 | Alkaloids and Other Bases | Alkaloids and Other Bases | Nicotine | 130% to 217% |
| 263245 | Amino Acids and Related Compounds | Amino Acids and Related Compounds | Arginine | 235% to 400% |
| 263245 | Amino Acids and Related Compounds | Amino Acids and Related Compounds | Cysteine | 95% to 1115% |
| 263245 | Amino Acids and Related Compounds | Amino Acids and Related Compounds | Glutamic acid | 72% to 119% |
| 263245 | Amino Acids and Related Compounds | Amino Acids and Related Compounds | Glycine | New |
| 263245 | Amino Acids and Related Compounds | Amino Acids and Related Compounds | Histidine | 140% to 1410% |
| 263245 | Amino Acids and Related Compounds | Amino Acids and Related Compounds | Isoleucine | New |
| 263245 | Amino Acids and Related Compounds | Amino Acids and Related Compounds | Leucine | New |
| 263245 | Amino Acids and Related Compounds | Amino Acids and Related Compounds | Lysine | 60% to 260% |
| 263245 | Amino Acids and Related Compounds | Amino Acids and Related Compounds | Phenylalanine | 205% to 905% |
| 263245 | Amino Acids and Related Compounds | Amino Acids and Related Compounds | Proline, 5-oxo- | 1493% to 2488% |
| 263245 | Amino Acids and Related Compounds | Amino Acids and Related Compounds | Threonine | 60% to 180% |
| 263245 | Amino Acids and Related Compounds | Amino Acids and Related Compounds | Tryptophan | 100% to 625% |
| 263245 | Amino Acids and Related Compounds | Amino Acids and Related Compounds | Tyrosine | 160% to 2050% |
| 263245 | Amino Acids and Related Compounds | Amino Acids and Related Compounds | Valine | 125% to 680% |
| 263245 | Carbohydrates | Carbohydrates | F3-U0.813 Carbohydrate | New |
| 263245 | Carbohydrates | Carbohydrates | F3-U0.816 Carbohydrate | 192% to 320% |
| 263245 | Carbohydrates | Carbohydrates | F3-U0.821 Carbohydrate | 1193% to 1988% |
| 263245 | Carbohydrates | Carbohydrates | F3-U0.846 Carbohydrate | 719% to 1199% |
| 263245 | Carbohydrates | Carbohydrates | F3-U0.872 Hexose | 321% to 534% |
| 263245 | Carbohydrates | Carbohydrates | F3-U1.143 Carbohydrate | 144% to 240% |
| 263245 | Carbohydrates | Carbohydrates | F3-U1.148 Carbohydrate | 220% to 365% |
| 263245 | Carbohydrates | Carbohydrates | F3-U1.189 Carbohydrate | New |
| 263245 | Esters | Esters | F1-U1.065 Fatty Acid Ester | -61% to -100% |
| 263245 | Esters | Esters | F1-U1.076 Fatty Acid Ester | New |
| 263245 | Esters | Esters | F1-U1.113 Fatty Acid Ester | NQ |
| 263245 | Esters | Esters | F1-U1.119 Fatty Acid Ester | New |
| 263245 | Esters - Hydroxy | Acyl acetylglycerols | 2-Eicosanoyl-1-acetylglycerol | 174% to 290% |
| 263245 | Esters - Hydroxy | Acyl acetylglycerols | 2-Octadecanoyl-1-acetylglycerol | NQ |
| 263245 | NA | NA | F1-U0.972 | NQ |
| 263245 | NA | NA | F3-U1.253 | 86% to 143% |
| 263245 | Phenols and Related Compounds | Phenylpropanes and Derivatives | Chlorogenic acid | 488% to 814% |
| 263245 | Sterols, Oxygenated Terpenes, and Other isoprenoids | Prenylquinones | alpha-Tocopherol | 149% to 1044% |
| 263245 | Sterols, Oxygenated Terpenes, and Other isoprenoids | Prenylquinones | alpha-Tocopherol hydroquinone | 166% to 276% |
| 263245 | Sterols, Oxygenated Terpenes, and Other isoprenoids | Terpenoids | beta-Sitosterol | NQ |
| 263245 | Sterols, Oxygenated Terpenes, and Other isoprenoids | Terpenoids | beta-Tocopherol | NQ |
| 263245 | Sterols, Oxygenated Terpenes, and Other isoprenoids | Terpenoids | Cholesterol | NQ |
| 263245 | Sterols, Oxygenated Terpenes, and Other isoprenoids | Terpenoids | F1-U1.106 Sterol | New |
| 263245 | Sterols, Oxygenated Terpenes, and Other isoprenoids | Terpenoids | F1-U1.136 Sterol | New |
| 263245 | Sterols, Oxygenated Terpenes, and Other isoprenoids | Terpenoids | F1-U1.200 Sterol | New |
| 263245 | Sterols, Oxygenated Terpenes, and Other isoprenoids | Terpenoids | Fucosterol | NQ |
| 263245 | Sterols, Oxygenated Terpenes, and Other isoprenoids | Prenylquinones | gamma-Tocopherol | New |
| 263245 | Sterols, Oxygenated Terpenes, and Other isoprenoids | Terpenoids | Stigmasterol | 136% to 227% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263246

| Seq ID | Chemical Class | Biochemical Class | Compound Name | Modification |
|---|---|---|---|---|
| 263246 | Acids - Hydroxy Alpha | Acid Pathway | Butanoic acid, 2,3,4-trihydroxy- | 81% to 135% |
| 263246 | Acids - Hydroxy Alpha | Carbohydrates | Glyceric acid | 227% to 378% |
| 263246 | Acids - Hydroxy Alpha | Carbohydrates | Quinic acid | 82% to 137% |
| 263246 | Alkaloids and Other Bases | Polyamines | 1,4-Butanediamine | 60% to 77% |
| 263246 | Carbohydrates | Carbohydrates | F3-U0.825 Carbohydrate | 60% to 86% |
| 263246 | Carbohydrates | Carbohydrates | F3-U0.846 Carbohydrate | 141% to 235% |
| 263246 | Carbohydrates | Carbohydrates | F3-U0.872 Hexose | 168% to 280% |
| 263246 | Carbohydrates | Carbohydrates | F3-U1.194 Carbohydrate | -60% to -86% |
| 263246 | Carbohydrates | Carbohydrates | Fructose | 105% to 174% |
| 263246 | Carbohydrates | Carbohydrates | Galactose or Mannose | 134% to 224% |
| 263246 | Carbohydrates | Carbohydrates | Glucose | 326% to 809% |
| 263246 | NA | NA | F3-U0.668 | NQ |
| 263246 | NA | NA | F3-U0.857 | 132% to 219% |
| 263246 | NA | NA | F3-U0.882 | 118% to 196% |
| 263246 | NA | NA | F3-U1.253 | 176% to 293% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#263249

| Seq ID | Chemical Class | Biochemical Class | Compound Name | Modification |
|---|---|---|---|---|
| 263249 | Acids - Hydroxy Alpha | Acid Pathway | Citric acid | 67% to 112% |
| 263249 | Alkenes and Alkynes | Terpenoids | Limonene | 172% to 287% |
| 263249 | Amino Acids and Related Compounds | Amino Acids and Related Compounds | Asparagine | 127% to 211% |
| 263249 | Amino Acids and Related Compounds | Amino Acids and Related Compounds | Leucine | New |
| 263249 | Amino Acids and Related Compounds | Amino Acids and Related Compounds | Proline | 72% to 119% |
| 263249 | Carbohydrates | Carbohydrates | Arabinose or Xylose | New |
| 263249 | Carbohydrates | Carbohydrates | F3-U0.813 Carbohydrate | 183% to 305% |
| 263249 | Carbohydrates | Carbohydrates | F3-U0.816 Carbohydrate | 74% to 123% |
| 263249 | Carbohydrates | Carbohydrates | F3-U0.821 Carbohydrate | 67% to 112% |
| 263249 | Carbohydrates | Carbohydrates | F3-U0.825 Carbohydrate | 239% to 398% |
| 263249 | Carbohydrates | Carbohydrates | F3-U0.846 Carbohydrate | 82% to 136% |
| 263249 | Carbohydrates | Carbohydrates | F3-U0.848 Carbohydrate | New |
| 263249 | Carbohydrates | Carbohydrates | F3-U0.872 Hexose | 124% to 207% |
| 263249 | Carbohydrates | Carbohydrates | Fructose | 375% to 771% |
| 263249 | Carbohydrates | Carbohydrates | Galactose or Mannose | 429% to 715% |
| 263249 | Carbohydrates | Carbohydrates | Glucose | 248% to 765% |
| 263249 | Esters | Esters | F1-U1.076 Fatty Acid Ester | 254% to 423% |
| 263249 | Esters | Esters | F1-U1.121 Fatty Acid Ester | 177% to 295% |
| 263249 | Esters - Hydroxy | Acyl acetylglycerols | 2-Eicosanoyl-1-acetylglycerol | 233% to 388% |
| 263249 | Esters - Hydroxy | Acyl acetylglycerols | 2-Octadecanoyl-1-acetylglycerol | 156% to 259% |
| 263249 | NA | NA | F1-U1.119 | New |
| 263249 | NA | NA | F3-U0.791 | 71% to 119% |
| 263249 | NA | NA | F3-U0.852A | 214% to 357% |
| 263249 | NA | NA | F3-U1.253 | 96% to 160% |
| 263249 | NA | NA | F3-U1.255 | 60% to 95% |
| 263249 | Sterols, Oxygenated Terpenes, and Other Isoprenoids | Prenylquinones | alpha-Tocopherol | 175% to 291% |
| 263249 | Sterols, Oxygenated Terpenes, and Other Isoprenoids | Prenylquinones | alpha-Tocopherol hydroquinone | New |
| 263249 | Sterols, Oxygenated Terpenes, and Other Isoprenoids | Terpenoids | beta-Sitosterol | 139% to 231% |
| 263249 | Sterols, Oxygenated Terpenes, and Other Isoprenoids | Prenylquinones | beta-Tocopherol | New |
| 263249 | Sterols, Oxygenated Terpenes, and Other Isoprenoids | Terpenoids | Campesterol | 66% to 111% |
| 263249 | Sterols, Oxygenated Terpenes, and Other Isoprenoids | Terpenoids | F1-U1.122 Sterol | 60% to 80% |
| 263249 | Sterols, Oxygenated Terpenes, and Other Isoprenoids | Terpenoids | Solanesol | 767% to 1279% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263255

| Seq ID | Chemical Class | Biochemical Class | Compound Name | Modification |
|---|---|---|---|---|
| 263255 | Alkenes and Alkynes | Terpenoids | Limonene | 76% to 127% |
| 263255 | Esters | Esters | F1-U1.121 Fatty Acid Ester | 60% to 99% |
| 263255 | Esters - Hydroxy | Acyl acetylglycerols | 2-Eicosanoyl-1-acetylglycerol | 89% to 149% |
| 263255 | Hydrocarbons | Hydrocarbons | Triacontane, 2-methyl- | 76% to 127% |
| 263255 | Sterols, Oxygenated Terpenes, and Other Isoprenoids | Prenylquinones | alpha-Tocopherol hydroquinone | 275% to 459% |
| 263255 | Sterols, Oxygenated Terpenes, and Other Isoprenoids | Prenylquinones | beta-Tocopherol | New |
| 263255 | Sterols, Oxygenated Terpenes, and Other Isoprenoids | Terpenoids | F1-U1.230A Sterol | 120% to 200% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263262

| Seq ID | Chemical Class | Biochemical Class | Compound Name | Modification |
|---|---|---|---|---|
| 263262 | Acids | Acids | Carbamic acid | NQ |
| 263262 | Acids - Hydroxy Alpha | Acid Pathway | Citric acid | 164% to 353% |
| 263262 | Acids - Hydroxy Alpha | Acid Pathway | Malic acid | 60% to 117% |
| 263262 | Amino Acids and Related Compounds | Amino Acids and Related Compounds | Arginine | 175% to 540% |
| 263262 | Amino Acids and Related Compounds | Amino Acids and Related Compounds | Glutamic acid | 102% to 169% |
| 263262 | Amino Acids and Related Compounds | Amino Acids and Related Compounds | Glutamine | New |
| 263262 | Amino Acids and Related Compounds | Amino Acids and Related Compounds | Glycine | New |
| 263262 | Amino Acids and Related Compounds | Amino Acids and Related Compounds | Histidine | 60% to 640% |
| 263262 | Amino Acids and Related Compounds | Amino Acids and Related Compounds | Phenylalanine | 60% to 225% |
| 263262 | Amino Acids and Related Compounds | Amino Acids and Related Compounds | Proline, 5-oxo- | 697% to 1161% |
| 263262 | Carbohydrates | Carbohydrates | F3-U0.770 Carbohydrate | 296% to 494% |
| 263262 | Carbohydrates | Carbohydrates | F3-U0.816 Carbohydrate | 69% to 115% |
| 263262 | Carbohydrates | Carbohydrates | F3-U0.821 Carbohydrate | 164% to 353% |
| 263262 | Carbohydrates | Carbohydrates | F3-U0.846 Carbohydrate | 1259% to 2288% |
| 263262 | Carbohydrates | Carbohydrates | F3-U0.872 Hexose | 257% to 813% |
| 263262 | Carbohydrates | Carbohydrates | Fructose | -60% to -100% |
| 263262 | Carbohydrates | Carbohydrates | Galactose or Mannose | NQ |
| 263262 | Carbohydrates | Carbohydrates | Glucose | -60% to -100% |
| 263262 | NA | NA | F3-U0.736 | 266% to 443% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263263

| Seq ID | Chemical Class | Biochemical Class | Compound Name | Modification |
|---|---|---|---|---|
| 263263 | Acids - Hydroxy Alpha | Acid Pathway | Butanoic acid, 2,3,4-trihydroxy- | 91% to 152% |
| 263263 | Acids - Fatty | Fatty Acids and Related Waxes | Eicosanoic acid | 114% to 411% |
| 263263 | Acids - Fatty Branched | Fatty Acids and Related Waxes | Heptadecanoic acid, 16-methyl- | 60% to 86% |
| 263263 | Acids - Fatty Branched | Fatty Acids and Related Waxes | Hexadecanoic acid, 14-methyl- | -64% to -77% |
| 263263 | Acids - Fatty Unsat | Fatty Acids and Related Waxes | 9-Hexadecenoic acid | 193% to 308% |
| 263263 | Acids - Hydroxy Alpha | Carbohydrates | Quinic acid | 93% to 154% |
| 263263 | Amino Acids and Related Compounds | Amino Acids and Related Compounds | Arginine | 100% to 335% |
| 263263 | Amino Acids and Related Compounds | Amino Acids and Related Compounds | Glutamic acid | 60% to 84% |
| 263263 | Carbohydrates | Carbohydrates | F3-U0.848 Carbohydrate | New |
| 263263 | Carbohydrates | Carbohydrates | F3-U1.032 Carbohydrate | New |
| 263263 | Carbohydrates | Carbohydrates | F3-U1.150 Carbohydrate | 73% to 122% |
| 263263 | Carbohydrates | Carbohydrates | F3-U1.189 Carbohydrate | NQ |
| 263263 | Carbohydrates | Carbohydrates | Fructose | 76% to 127% |
| 263263 | Carbohydrates | Carbohydrates | Glucose | 60% to 89% |
| 263263 | NA | NA | F3-U0.751 | 60% to 90% |
| 263263 | Phenols and Related Compounds | Phenylpropanes and Derivatives | Chlorogenic acid | -60% to -84% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263276

| Seq ID | Chemical Class | Biochemical Class | Compound Name | Modification |
|---|---|---|---|---|
| 263276 | Acids - Fatty | Fatty Acids and Related Waxes | Docosanoic acid | 61% to 102% |
| 263276 | Acids - Fatty | Fatty Acids and Related Waxes | Heptadecanoic acid | 125% to 215% |
| 263276 | Acids - Fatty | Fatty Acids and Related Waxes | Hexadecanoic acid | 60% to 82% |
| 263276 | Acids - Fatty | Fatty Acids and Related Waxes | Nonadecanoic acid | 60% to 78% |
| 263276 | Acids - Fatty | Fatty Acids and Related Waxes | Octadecanoic acid | 60% to 70% |
| 263276 | Acids - Fatty Branched | Fatty Acids and Related Waxes | Heneicosanoic acid, 20-methyl- | 60% to 96% |
| 263276 | Acids - Fatty Branched | Fatty Acids and Related Waxes | Heptadecanoic acid, 16-methyl- | 60% to 120% |
| 263276 | Acids - Fatty Branched | Fatty Acids and Related Waxes | Hexadecanoic acid, 14-methyl- | New |
| 263276 | Acids - Fatty Branched | Fatty Acids and Related Waxes | Octadecanoic acid, 17-methyl- | 89% to 163% |
| 263276 | Acids - Fatty Unsat | Fatty Acids and Related Waxes | 11,14-Octadecadienoic acid | NQ |
| 263276 | Acids - Fatty Unsat | Fatty Acids and Related Waxes | 7,10,13-Docosatrienoic acid | NQ |
| 263276 | Acids - Fatty Unsat | Fatty Acids and Related Waxes | 7,10-Hexadecadienoic acid | NQ |
| 263276 | Acids - Fatty Unsat | Fatty Acids and Related Waxes | 9,12,15-Octadecatrienoic acid | NQ |
| 263276 | Acids - Fatty Unsat | Fatty Acids and Related Waxes | 9,12-Octadecadienoic acid | 61% to 129% |
| 263276 | Acids - Fatty Unsat | Fatty Acids and Related Waxes | 9-Hexadecenoic acid | -72% to -100% |
| 263276 | Acids - Fatty Unsat | Fatty Acids and Related Waxes | 9-Octadecenoic acid | 71% to 119% |
| 263276 | Acids - Fatty Unsat | Fatty Acids and Related Waxes | Octadecenoic acid Isomer | 87% to 214% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263320

| Seq ID | Chemical Class | Biochemical Class | Compound Name | Modification |
|---|---|---|---|---|
| 263320 | Esters - Hydroxy | Acyl acetylglycerols | 2-Eicosanoyl-1-acetylglycerol | 102% to 171% |
| 263320 | Amino Acids and Related Compounds | Amino Acids and Related Compounds | Histidine | 60% to 550% |
| 263320 | Amino Acids and Related Compounds | Amino Acids and Related Compounds | Isoleucine | New |
| 263320 | Amino Acids and Related Compounds | Amino Acids and Related Compounds | Leucine | New |
| 263320 | Amino Acids and Related Compounds | Amino Acids and Related Compounds | Lysine | 60% to 250% |
| 263320 | Amino Acids and Related Compounds | Amino Acids and Related Compounds | Methionine | 210% to 565% |
| 263320 | Amino Acids and Related Compounds | Amino Acids and Related Compounds | Tryptophan | New |
| 263320 | Amino Acids and Related Compounds | Amino Acids and Related Compounds | Valine | 285% to 730% |
| 263320 | Esters | Esters | F1-U1.121 Fatty Acid Ester | 137% to 228% |
| 263320 | Sterols, Oxygenated Terpenes, and Other Isoprenoids | Prenylquinones | alpha-Tocopherol hydroquinone | New |
| 263320 | Sterols, Oxygenated Terpenes, and Other Isoprenoids | Prenylquinones | beta-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263327

| Seq ID | Chemical Class | Biochemical Class | Compound Name | Modification |
|---|---|---|---|---|
| 263327 | Acids - Fatty | Fatty Acids and Related Waxes | Docosanoic acid | 88% to 495% |
| 263327 | Acids - Fatty | Fatty Acids and Related Waxes | Eicosanoic acid | 65% to 164% |
| 263327 | Acids - Fatty | Fatty Acids and Related Waxes | Heptadecanoic acid | 68% to 203% |
| 263327 | Acids - Fatty | Fatty Acids and Related Waxes | Hexadecanoic acid | 60% to 99% |
| 263327 | Acids - Fatty | Fatty Acids and Related Waxes | Octadecanoic acid | 67% to 116% |
| 263327 | Acids - Fatty Branched | Fatty Acids and Related Waxes | Heneicosanoic acid, 20-methyl- | 60% to 79% |
| 263327 | Acids - Fatty Unsat | Fatty Acids and Related Waxes | 7,10-Hexadecadienoic acid | 60% to 98% |
| 263327 | Acids - Fatty Unsat | Fatty Acids and Related Waxes | 9,12-Octadecadienoic acid | 64% to 109% |
| 263327 | Acids - Fatty Unsat | Fatty Acids and Related Waxes | 9-Hexadecenoic acid | 76% to 127% |
| 263327 | Amino Acids and Related Compounds | Amino Acids and Related Compounds | Arginine | 65% to 145% |
| 263327 | Amino Acids and Related Compounds | Amino Acids and Related Compounds | Glycine | New |
| 263327 | Amino Acids and Related Compounds | Amino Acids and Related Compounds | Histidine | 60% to 700% |
| 263327 | Amino Acids and Related Compounds | Amino Acids and Related Compounds | Isoleucine | New |
| 263327 | Amino Acids and Related Compounds | Amino Acids and Related Compounds | Leucine | New |
| 263327 | Amino Acids and Related Compounds | Amino Acids and Related Compounds | Lysine | 60% to 325% |
| 263327 | Amino Acids and Related Compounds | Amino Acids and Related Compounds | Serine | 60% to 240% |
| 263327 | Amino Acids and Related Compounds | Amino Acids and Related Compounds | Threonine | 60% to 195% |
| 263327 | Amino Acids and Related Compounds | Amino Acids and Related Compounds | Valine | 160% to 455% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#263329

| Seq ID | Chemical Class | Biochemical Class | Compound Name | Modification |
|---|---|---|---|---|
| 263329 | Acids | Acids | Carbamic acid | ND |
| 263329 | Acids - Hydroxy Alpha | Acid Pathway | Citric acid | 456% to 1185% |
| 263329 | Acids - Hydroxy Alpha | Acid Pathway | Malic acid | -60% to -95% |
| 263329 | Acids - Hydroxy Alpha | Carbohydrates | Quinic acid | -60% to -100% |
| 263329 | Alkaloids and Other Bases | Polyamines | 1,4-Butanediamine | 95% to 159% |
| 263329 | Amino Acids and Related Compounds | Amino Acids and Related Compounds | Arginine | 490% to 775% |
| 263329 | Amino Acids and Related Compounds | Amino Acids and Related Compounds | Asparagine | New |
| 263329 | Amino Acids and Related Compounds | Amino Acids and Related Compounds | Aspartic acid | -60% to -93% |
| 263329 | Amino Acids and Related Compounds | Amino Acids and Related Compounds | Cysteine | 95% to 2800% |
| 263329 | Amino Acids and Related Compounds | Amino Acids and Related Compounds | Glutamic acid | 60% to 587% |
| 263329 | Amino Acids and Related Compounds | Amino Acids and Related Compounds | Glutamine | New |
| 263329 | Amino Acids and Related Compounds | Amino Acids and Related Compounds | Glycine | New |
| 263329 | Amino Acids and Related Compounds | Amino Acids and Related Compounds | Histidine | 410% to 3150% |
| 263329 | Amino Acids and Related Compounds | Amino Acids and Related Compounds | Isoleucine | New |
| 263329 | Amino Acids and Related Compounds | Amino Acids and Related Compounds | Leucine | 60% to 350% |
| 263329 | Amino Acids and Related Compounds | Amino Acids and Related Compounds | Lysine | 580% to 1350% |
| 263329 | Amino Acids and Related Compounds | Amino Acids and Related Compounds | Methionine | 60% to 255% |
| 263329 | Amino Acids and Related Compounds | Amino Acids and Related Compounds | Phenylalanine | 60% to 1188% |
| 263329 | Amino Acids and Related Compounds | Amino Acids and Related Compounds | Proline, 5-oxo- | 115% to 360% |
| 263329 | Amino Acids and Related Compounds | Amino Acids and Related Compounds | Serine | 85% to 775% |
| 263329 | Amino Acids and Related Compounds | Amino Acids and Related Compounds | Threonine | New |
| 263329 | Amino Acids and Related Compounds | Amino Acids and Related Compounds | Tryptophan | New |
| 263329 | Amino Acids and Related Compounds | Amino Acids and Related Compounds | Tyrosine | 135% to 3485% |
| 263329 | Amino Acids and Related Compounds | Amino Acids and Related Compounds | Valine | New |
| 263329 | Carbohydrates | Carbohydrates | Arabinose or Xylose | 533% to 889% |
| 263329 | Carbohydrates | Carbohydrates | F3-U0.770 Carbohydrate | New |
| 263329 | Carbohydrates | Carbohydrates | F3-U0.781 Carbohydrate | New |
| 263329 | Carbohydrates | Carbohydrates | F3-U0.813 Carbohydrate | 74% to 304% |
| 263329 | Carbohydrates | Carbohydrates | F3-U0.816 Carbohydrate | 618% to 1030% |
| 263329 | Carbohydrates | Carbohydrates | F3-U0.821 Carbohydrate | 134% to 2501% |
| 263329 | Carbohydrates | Carbohydrates | F3-U0.825 Carbohydrate | 1085% to 2818% |
| 263329 | Carbohydrates | Carbohydrates | F3-U0.846 Carbohydrate | 60% to 688% |
| 263329 | Carbohydrates | Carbohydrates | F3-U0.872 Hexose | New |
| 263329 | Carbohydrates | Carbohydrates | F3-U1.120 Carbohydrate | 84% to 156% |
| 263329 | Carbohydrates | Carbohydrates | F3-U1.148 Carbohydrate | 60% to 97% |
| 263329 | Carbohydrates | Carbohydrates | F3-U1.150 Carbohydrate | New |
| 263329 | Carbohydrates | Carbohydrates | F3-U1.189 Carbohydrate | New |
| 263329 | Carbohydrates | Carbohydrates | F3-U1.194 Carbohydrate | 76% to 415% |
| 263329 | Carbohydrates | Carbohydrates | Fructose | 60% to 393% |
| 263329 | Carbohydrates | Carbohydrates | Galactose or Mannose | 60% to 278% |
| 263329 | Carbohydrates | Carbohydrates | Glucose | ND |
| 263329 | NA | NA | F3-U0.668 | 498% to 830% |
| 263329 | NA | NA | F3-U0.736 | New |
| 263329 | NA | NA | F3-U0.789 | New |
| 263329 | NA | NA | F3-U0.838 | 255% to 425% |
| 263329 | NA | NA | F3-U0.852A | New |
| 263329 | NA | NA | F3-U0.868 | New |
| 263329 | NA | NA | F3-U0.868B | New |
| 263329 | NA | NA | F3-U1.085 | New |
| 263329 | NA | NA | F3-U1.156 | New |
| 263329 | NA | NA | F3-U1.165 | ND |
| 263329 | Phenols and Related Compounds | Phenylpropanes and Derivatives | Chlorogenic acid | 136% to 370% |
| 263329 | Sterols, Oxygenated Terpenes, and Other Isoprenoids | Prenylquinones | alpha-Tocopherol | 1301% to 2169% |
| 263329 | Sterols, Oxygenated Terpenes, and Other Isoprenoids | Prenylquinones | alpha-Tocopherol hydroquinone | 391% to 651% |
| 263329 | Sterols, Oxygenated Terpenes, and Other Isoprenoids | Terpenoids | beta-Sitosterol | 68% to 114% |
| 263329 | Sterols, Oxygenated Terpenes, and Other Isoprenoids | Terpenoids | beta-Tocopherol | New |
| 263329 | Sterols, Oxygenated Terpenes, and Other Isoprenoids | Prenylquinones | Cyclolaudenol | New |
| 263329 | Sterols, Oxygenated Terpenes, and Other Isoprenoids | Terpenoids | Ergosta-5,24-dien-3-ol | New |
| 263329 | Sterols, Oxygenated Terpenes, and Other Isoprenoids | Terpenoids | F1-U1.217 Sterol | 269% to 448% |
| 263329 | Sterols, Oxygenated Terpenes, and Other Isoprenoids | Terpenoids | F1-U1.228A Sterol | 62% to 103% |
| 263329 | Sterols, Oxygenated Terpenes, and Other Isoprenoids | Terpenoids | F1-U1.244 Sterol | New |
| 263329 | Sterols, Oxygenated Terpenes, and Other Isoprenoids | Terpenoids | Lophenol, 24-methylene- | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263342

| Seq ID | Chemical Class | Biochemical Class | Compound Name | Modification |
|---|---|---|---|---|
| 263342 | Acids - Hydroxy Alpha | Acid Pathway | Butanoic acid, 2,3,4-trihydroxy- | 60% to 82% |
| 263342 | Acids - Hydroxy Alpha | Acid Pathway | Citric acid | 746% to 1244% |
| 263342 | Alkaloids and Other Bases | Polyamines | 1,4-Butanediamine | 60% to 91% |
| 263342 | Amino Acids and Related Compounds | Amino Acids and Related Compounds | Asparagine | New |
| 263342 | Amino Acids and Related Compounds | Amino Acids and Related Compounds | Glutamic acid | 229% to 381% |
| 263342 | Amino Acids and Related Compounds | Amino Acids and Related Compounds | Proline | 136% to 226% |
| 263342 | Carbohydrates | Carbohydrates | F3-U0.781 Carbohydrate | New |
| 263342 | Carbohydrates | Carbohydrates | F3-U0.813 Carbohydrate | 175% to 292% |
| 263342 | Carbohydrates | Carbohydrates | F3-U0.816 Carbohydrate | 94% to 157% |
| 263342 | Carbohydrates | Carbohydrates | F3-U0.825 Carbohydrate | 408% to 680% |
| 263342 | Carbohydrates | Carbohydrates | F3-U0.846 Carbohydrate | 77% to 128% |
| 263342 | Carbohydrates | Carbohydrates | F3-U0.872 Hexose | 108% to 180% |
| 263342 | Carbohydrates | Carbohydrates | F3-U1.049B Carbohydrate | New |
| 263342 | Carbohydrates | Carbohydrates | F3-U1.150 Carbohydrate | 91% to 151% |
| 263342 | Carbohydrates | Carbohydrates | Fructose | 60% to 132% |
| 263342 | Carbohydrates | Carbohydrates | Xylose | New |
| 263342 | NA | NA | F3-U0.736 | New |
| 263342 | NA | NA | F3-U0.751 | 232% to 386% |
| 263342 | NA | NA | F3-U0.852A | 248% to 414% |
| 263342 | NA | NA | F3-U1.253 | 87% to 145% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263367

| Seq ID | Chemical Class | Biochemical Class | Compound Name | Modification |
|---|---|---|---|---|
| 263367 | Acids - Hydroxy Alpha | Acid Pathway | Butanoic acid, 2,3,4-trihydroxy- | -60% to -92% |
| 263367 | Acids - Hydroxy Alpha | Acid Pathway | Citric acid | New |
| 263367 | Acids - Hydroxy Alpha | Acid Pathway | Malic acid | -60% to -83% |
| 263367 | Acids - Hydroxy Alpha | Carbohydrates | Quinic acid | -66% to -100% |
| 263367 | Amino Acids and Related Compounds | Amino Acids and Related Compounds | Asparagine | New |
| 263367 | Amino Acids and Related Compounds | Amino Acids and Related Compounds | Glutamic acid | 93% to 239% |
| 263367 | Amino Acids and Related Compounds | Amino Acids and Related Compounds | Glutamine | New |
| 263367 | Amino Acids and Related Compounds | Amino Acids and Related Compounds | Proline, 5-oxo- | 61% to 118% |
| 263367 | Amino Acids and Related Compounds | Amino Acids and Related Compounds | Serine | 213% to 356% |
| 263367 | Amino Acids and Related Compounds | Amino Acids and Related Compounds | Tryptophan | New |
| 263367 | Amino Acids and Related Compounds | Amino Acids and Related Compounds | Tyrosine | New |
| 263367 | Carbohydrates | Carbohydrates | F3-U0.781 Carbohydrate | 336% to 559% |
| 263367 | Carbohydrates | Carbohydrates | F3-U0.813 Carbohydrate | 104% to 173% |
| 263367 | Carbohydrates | Carbohydrates | F3-U0.825 Carbohydrate | 708% to 2566% |
| 263367 | Carbohydrates | Carbohydrates | F3-U1.150 Carbohydrate | 60% to 97% |
| 263367 | Carbohydrates | Carbohydrates | Fructose | 133% to 388% |
| 263367 | Esters - Hydroxy | Acyl acetylglycerols | 2-Eicosanoyl-1-acetylglycerol | -60% to -81% |
| 263367 | Hydrocarbons | Hydrocarbons | F1-U1.086 Hydrocarbon | New |
| 263367 | NA | NA | F1-U1.241 | New |
| 263367 | NA | NA | F3-U0.704 | New |
| 263367 | NA | NA | F3-U0.751 | 60% to 88% |
| 263367 | NA | NA | F3-U0.838 | New |
| 263367 | NA | NA | F3-U0.868B | New |
| 263367 | NA | NA | F3-U1.156 | New |
| 263367 | NA | NA | F3-U1.165 | New |
| 263367 | Phenols and Related Compounds | Phenylpropanes and Derivatives | Chlorogenic acid | -60% to -86% |
| 263367 | Sterols, Oxygenated Terpenes, and Other Isoprenoids | Prenylquinones | alpha-Tocopherol | 420% to 1504% |
| 263367 | Sterols, Oxygenated Terpenes, and Other Isoprenoids | Prenylquinones | alpha-Tocopherol hydroquinone | 172% to 286% |
| 263367 | Sterols, Oxygenated Terpenes, and Other Isoprenoids | Terpenoids | beta-Sitosterol | 60% to 89% |
| 263367 | Sterols, Oxygenated Terpenes, and Other Isoprenoids | Prenylquinones | beta-Tocopherol | New |
| 263367 | Sterols, Oxygenated Terpenes, and Other Isoprenoids | Terpenoids | Cholesterol | 60% to 87% |
| 263367 | Sterols, Oxygenated Terpenes, and Other Isoprenoids | Terpenoids | Cycloartanol, 24-methylene- | New |
| 263367 | Sterols, Oxygenated Terpenes, and Other Isoprenoids | Terpenoids | Ergosta-5,24-dien-3-ol | New |
| 263367 | Sterols, Oxygenated Terpenes, and Other Isoprenoids | Terpenoids | F1-U1.217 Sterol | 75% to 125% |
| 263367 | Sterols, Oxygenated Terpenes, and Other Isoprenoids | Terpenoids | Lophenol, 24-methylene- | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263393

| Seq ID | Chemical Class | Biochemical Class | Compound Name | Modification |
|---|---|---|---|---|
| 263393 | Acids - Hydroxy Alpha | Acid Pathway | Butanoic acid, 2,3,4-trihydroxy- | 147% to 245% |
| 263393 | Acids - Hydroxy Alpha | Carbohydrates | Quinic acid | 223% to 372% |
| 263393 | Alkaloids and Other Bases | Polyamines | 1,4-Butanediamine | 92% to 154% |
| 263393 | Amino Acids and Related Compounds | Amino Acids and Related Compounds | Aspartic acid | -60% to -79% |
| 263393 | Amino Acids and Related Compounds | Amino Acids and Related Compounds | Glutamic acid | 60% to 170% |
| 263393 | Amino Acids and Related Compounds | Amino Acids and Related Compounds | Threonine | 60% to 175% |
| 263393 | Carbohydrates | Carbohydrates | F3-U0.813 Carbohydrate | 170% to 284% |
| 263393 | Carbohydrates | Carbohydrates | F3-U0.816 Carbohydrate | 130% to 216% |
| 263393 | Carbohydrates | Carbohydrates | F3-U0.821 Carbohydrate | 137% to 228% |
| 263393 | Carbohydrates | Carbohydrates | F3-U0.825 Carbohydrate | 165% to 275% |
| 263393 | Carbohydrates | Carbohydrates | F3-U0.846 Carbohydrate | 298% to 497% |
| 263393 | Carbohydrates | Carbohydrates | F3-U0.848 Carbohydrate | 89% to 148% |
| 263393 | Carbohydrates | Carbohydrates | F3-U0.872 Hexose | 284% to 474% |
| 263393 | Carbohydrates | Carbohydrates | F3-U1.150 Carbohydrate | 64% to 107% |
| 263393 | Carbohydrates | Carbohydrates | F3-U1.189 Carbohydrate | NQ |
| 263393 | Carbohydrates | Carbohydrates | F3-U1.194 Carbohydrate | NQ |
| 263393 | Carbohydrates | Carbohydrates | Fructose | 106% to 204% |
| 263393 | Carbohydrates | Carbohydrates | Glucose | 202% to 402% |
| 263393 | NA | NA | F3-U0.751 | 65% to 108% |
| 263393 | NA | NA | F3-U0.843 | New |
| 263393 | NA | NA | F3-U0.852A | 223% to 371% |
| 263393 | Phenols and Related Compounds | Phenylpropanes and Derivatives | Caffeic acid | 145% to 242% |
| 263393 | Phenols and Related Compounds | Phenylpropanes and Derivatives | Chlorogenic acid | -60% to -79% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263514

| Seq ID | Chemical Class | Biochemical Class | Compound Name | Modification |
|---|---|---|---|---|
| 263514 | Acids - Fatty | Fatty Acids and Related Waxes | Docosanoic acid | -60% to -75% |
| 263514 | Acids - Fatty | Fatty Acids and Related Waxes | Heptadecanoic acid | 164% to 352% |
| 263514 | Acids - Fatty Branched | Fatty Acids and Related Waxes | Octadecanoic acid, 17-methyl- | 157% to 262% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#263534

| Seq ID | Chemical Class | Biochemical Class | Compound Name | Modification |
|---|---|---|---|---|
| 263534 | Acids - Hydroxy Alpha | Acid Pathway | Butanoic acid, 2,3,4-trihydroxy- | 60% to 86% |
| 263534 | Acids - Hydroxy Alpha | Acid Pathway | Citric acid | 206% to 344% |
| 263534 | Acids - Hydroxy Alpha | Carbohydrates | Quinic acid | 100% to 167% |
| 263534 | Alkaloids and Other Bases | Polyamines | 1,4-Butanediamine | 107% to 178% |
| 263534 | Amino Acids and Related Compounds | Amino Acids and Related Compounds | Aspartic acid | -60% to -84% |
| 263534 | Carbohydrates | Carbohydrates | F3-U0.813 Carbohydrate | 235% to 392% |
| 263534 | Carbohydrates | Carbohydrates | F3-U0.816 Carbohydrate | New |
| 263534 | Carbohydrates | Carbohydrates | F3-U0.821 Carbohydrate | 206% to 344% |
| 263534 | Carbohydrates | Carbohydrates | F3-U0.825 Carbohydrate | 309% to 516% |
| 263534 | Carbohydrates | Carbohydrates | F3-U0.846 Carbohydrate | 323% to 538% |
| 263534 | Carbohydrates | Carbohydrates | F3-U0.848 Carbohydrate | 65% to 109% |
| 263534 | Carbohydrates | Carbohydrates | F3-U0.872 Hexose | 294% to 490% |
| 263534 | Carbohydrates | Carbohydrates | Fructose | 204% to 409% |
| 263534 | Carbohydrates | Carbohydrates | Glucose | 259% to 583% |
| 263534 | NA | NA | F3-U0.668 | -60% to -79% |
| 263534 | NA | NA | F3-U0.852A | 299% to 499% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263550

| Seq ID | Chemical Class | Biochemical Class | Compound Name | Modification |
|---|---|---|---|---|
| 263550 | Acids - Hydroxy Alpha | Acid Pathway | Butanoic acid, 2,3,4-trihydroxy- | 97% to 229% |
| 263550 | Acids - Hydroxy Alpha | Carbohydrates | Quinic acid | 117% to 302% |
| 263550 | Alkaloids and Other Bases | Polyamines | 1,4-Butanediamine | 116% to 214% |
| 263550 | Amino Acids and Related Compounds | Amino Acids and Related Compounds | Glutamic acid | 84% to 164% |
| 263550 | Carbohydrates | Carbohydrates | Arabinose or Xylose | New |
| 263550 | Carbohydrates | Carbohydrates | F3-U0.813 Carbohydrate | 158% to 264% |
| 263550 | Carbohydrates | Carbohydrates | F3-U0.825 Carbohydrate | 106% to 397% |
| 263550 | Carbohydrates | Carbohydrates | F3-U0.846 Carbohydrate | 111% to 248% |
| 263550 | Carbohydrates | Carbohydrates | F3-U0.848 Carbohydrate | 173% to 315% |
| 263550 | Carbohydrates | Carbohydrates | F3-U0.872 Hexose | 205% to 364% |
| 263550 | Carbohydrates | Carbohydrates | F3-U1.113 Carbohydrate | 79% to 131% |
| 263550 | Carbohydrates | Carbohydrates | F3-U1.118 Carbohydrate | 143% to 238% |
| 263550 | Carbohydrates | Carbohydrates | F3-U1.150 Carbohydrate | 75% to 124% |
| 263550 | Carbohydrates | Carbohydrates | F3-U1.189 Carbohydrate | 92% to 154% |
| 263550 | Carbohydrates | Carbohydrates | F3-U1.194 Carbohydrate | 62% to 104% |
| 263550 | Carbohydrates | Carbohydrates | F3-U1.208 Carbohydrate | 60% to 94% |
| 263550 | Carbohydrates | Carbohydrates | Fructose | 428% to 1005% |
| 263550 | Carbohydrates | Carbohydrates | Galactose or Mannose | New |
| 263550 | Carbohydrates | Carbohydrates | Glucose | 377% to 2019% |
| 263550 | NA | NA | F3-U0.668 | NQ |
| 263550 | NA | NA | F3-U0.736 | New |
| 263550 | NA | NA | F3-U0.751 | 165% to 275% |
| 263550 | NA | NA | F3-U0.791 | 79% to 132% |
| 263550 | NA | NA | F3-U0.852A | 94% to 156% |
| 263550 | NA | NA | F3-U0.882 | 169% to 473% |
| 263550 | NA | NA | F3-U1.228 | 11325% to 18875% |
| 263550 | NA | NA | F3-U1.229 | 60% to 92% |
| 263550 | NA | NA | F3-U1.253 | 84% to 24125% |
| 263550 | NA | NA | F3-U1.255 | 60% to 49250% |
| 263550 | Phenols and Related Compounds | Phenylpropanes and Derivatives | Chlorogenic acid | 60% to 97% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263557

| Seq ID | Chemical Class | Biochemical Class | Compound Name | Modification |
|---|---|---|---|---|
| 263557 | Acids - Fatty | Fatty Acids and Related Waxes | Octadecanoic acid | 25% to 55% |
| 263557 | Acids - Fatty Branched | Fatty Acids and Related Waxes | Hexadecanoic acid, 14-methyl- | -55% to -65% |
| 263557 | Acids - Fatty Unsat | Fatty Acids and Related Waxes | 7,10,13-Hexadecatrienoic acid | 30% to 40% |
| 263557 | Acids - Fatty Unsat | Fatty Acids and Related Waxes | 9,12-Octadecadienoic acid | 10% to 40% |
| 263557 | Acids - Fatty Unsat | Fatty Acids and Related Waxes | 9-Hexadecenoic acid | 15% to 45% |
| 263557 | Amino Acids and Related Compounds | Amino Acids and Related Compounds | Arginine | 130% to 455% |
| 263557 | Amino Acids and Related Compounds | Amino Acids and Related Compounds | Glutamic acid | 25% to 105% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263611

| Seq ID | Chemical Class | Biochemical Class | Compound Name | Modification |
|---|---|---|---|---|
| 263611 | Amino Acids and Related Compounds | Amino Acids and Related Compounds | Glutamic acid | -60% to -65% |
| 263611 | Amino Acids and Related Compounds | Amino Acids and Related Compounds | Isoleucine | New |
| 263611 | Amino Acids and Related Compounds | Amino Acids and Related Compounds | Phenylalanine | 60% to 95% |
| 263611 | Hydrocarbons | Hydrocarbons | Nonacosane, 3-methyl | New |
| 263611 | NA | NA | F1-U0.873 | NQ |
| 263611 | NA | NA | F1-U1.009 | 188% to 314% |
| 263611 | Sterols, Oxygenated Terpenes, and Other Isoprenoids | Prenylquinones | alpha-Tocopherol | New |
| 263611 | Sterols, Oxygenated Terpenes, and Other Isoprenoids | Prenylquinones | alpha-Tocopherol hydroquinone | 60% to 85% |
| 263611 | Sterols, Oxygenated Terpenes, and Other Isoprenoids | Terpenoids | beta-Sitosterol | 210% to 350% |
| 263611 | Sterols, Oxygenated Terpenes, and Other Isoprenoids | Terpenoids | Cycloartenol | 62% to 104% |
| 263611 | Sterols, Oxygenated Terpenes, and Other Isoprenoids | Terpenoids | Stigmasterol | |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263633

| Seq ID | Chemical Class | Biochemical Class | Compound Name | Modification |
|---|---|---|---|---|
| 263633 | Esters - Hydroxy | Acyl acetylglycerols | 2-Octadecanoyl-1-acetylglycerol | 286% to 779% |
| 263633 | Acids - Fatty | Fatty Acids and Related Waxes | Eicosanoic acid | 60% to 262% |
| 263633 | Acids - Fatty | Fatty Acids and Related Waxes | Octadecanoic acid | 60% to 95% |
| 263633 | Acids - Fatty Branched | Fatty Acids and Related Waxes | Heptadecanoic acid, 16-methyl- | 60% to 150% |
| 263633 | Acids - Fatty Unsat | Fatty Acids and Related Waxes | 9-Octadecenoic acid | 60% to 180% |
| 263633 | Alkenes and Alkynes | Terpenoids | Limonene | 378% to 631% |
| 263633 | Amino Acids and Related Compounds | Amino Acids and Related Compounds | Histidine | 60% to 360% |
| 263633 | Amino Acids and Related Compounds | Amino Acids and Related Compounds | Isoleucine | New |
| 263633 | Amino Acids and Related Compounds | Amino Acids and Related Compounds | Leucine | New |
| 263633 | Amino Acids and Related Compounds | Amino Acids and Related Compounds | Phenylalanine | New |
| 263633 | Amino Acids and Related Compounds | Amino Acids and Related Compounds | Threonine | 60% to 240% |
| 263633 | Amino Acids and Related Compounds | Amino Acids and Related Compounds | Tryptophan | New |
| 263633 | Amino Acids and Related Compounds | Amino Acids and Related Compounds | Tyrosine | New |
| 263633 | Amino Acids and Related Compounds | Amino Acids and Related Compounds | Valine | 180% to 590% |
| 263633 | Esters | Esters | F1-U1.076 Fatty Acid Ester | 293% to 598% |
| 263633 | Esters | Esters | F1-U1.113 Fatty Acid Ester | 540% to 922% |
| 263633 | Esters | Esters | F1-U1.121 Fatty Acid Ester | 169% to 335% |
| 263633 | Hydrocarbons | Hydrocarbons | Isononacosane | 117% to 195% |
| 263633 | NA | NA | F1-U0.972 | New |
| 263633 | NA | NA | F1-U0.991 | 60% to 95% |
| 263633 | NA | NA | F1-U1.119 | New |
| 263633 | Sterols, Oxygenated Terpenes, and Other Isoprenoids | Prenylquinones | alpha-Tocopherol | 379% to 1209% |
| 263633 | Sterols, Oxygenated Terpenes, and Other Isoprenoids | Prenylquinones | alpha-Tocopherol hydroquinone | New |
| 263633 | Sterols, Oxygenated Terpenes, and Other Isoprenoids | Terpenoids | beta-Sitosterol | 119% to 331% |
| 263633 | Sterols, Oxygenated Terpenes, and Other Isoprenoids | Prenylquinones | beta-Tocopherol | New |
| 263633 | Sterols, Oxygenated Terpenes, and Other Isoprenoids | Terpenoids | Campesterol | 87% to 227% |
| 263633 | Sterols, Oxygenated Terpenes, and Other Isoprenoids | Terpenoids | Cycloartanol, 24-methylene- | New |
| 263633 | Sterols, Oxygenated Terpenes, and Other Isoprenoids | Terpenoids | Ergosta-8,24(28)-dien-3-ol, 4,14-dimethyl- | New |
| 263633 | Sterols, Oxygenated Terpenes, and Other Isoprenoids | Terpenoids | F1-U1.106 Sterol | New |
| 263633 | Sterols, Oxygenated Terpenes, and Other Isoprenoids | Terpenoids | F1-U1.244 Sterol | 203% to 338% |
| 263633 | Sterols, Oxygenated Terpenes, and Other Isoprenoids | Terpenoids | Fucosterol | 61% to 102% |
| 263633 | Sterols, Oxygenated Terpenes, and Other Isoprenoids | Terpenoids | Lophenol, 24-methylene- | New |
| 263633 | Sterols, Oxygenated Terpenes, and Other Isoprenoids | Terpenoids | Stigmasterol | 171% to 312% |

FIG. 6 continued

| Seq ID | Chemical Class | Biochemical Class | Compound Name | Modification |
|---|---|---|---|---|
| \multicolumn{5}{|l|}{A list of metabolite compounds present in altered levels relative to reference samples as chararacterized by gas chromatography, liquid chromatography, and/or mass spectrometry. This list corresponds to samples transfected with nucleic acid sequence, Seq ID#263635} | | | | |
| 263635 | Acids | Acids | Carbamic acid | 60% to 93% |
| 263635 | Acids - Hydroxy Alpha | Carbohydrates | Glyceric acid | 124% to 206% |
| 263635 | Alkenes and Alkynes | Terpenoids | Limonene | 129% to 215% |
| 263635 | Amino Acids and Related Compounds | Amino Acids and Related Compounds | Asparagine | New |
| 263635 | Amino Acids and Related Compounds | Amino Acids and Related Compounds | Glutamic acid | 60% to 75% |
| 263635 | Amino Acids and Related Compounds | Amino Acids and Related Compounds | Glycine | 60% to 90% |
| 263635 | Carbohydrates | Carbohydrates | Arabinose or Xylose | New |
| 263635 | Carbohydrates | Carbohydrates | F3-U0.846 Carbohydrate | 60% to 92% |
| 263635 | Carbohydrates | Carbohydrates | F3-U0.872 Hexose | 124% to 207% |
| 263635 | Carbohydrates | Carbohydrates | F3-U0.952 Carbohydrate | 169% to 282% |
| 263635 | Carbohydrates | Carbohydrates | F3-U1.104 Carbohydrate | New |
| 263635 | Carbohydrates | Carbohydrates | F3-U1.113 Carbohydrate | 233% to 388% |
| 263635 | Carbohydrates | Carbohydrates | F3-U1.143 Carbohydrate | 60% to 86% |
| 263635 | Carbohydrates | Carbohydrates | F3-U1.189 Carbohydrate | 223% to 372% |
| 263635 | Carbohydrates | Carbohydrates | F3-U1.194 Carbohydrate | 133% to 221% |
| 263635 | Carbohydrates | Carbohydrates | F3-U1.241 Carbohydrate | 95% to 158% |
| 263635 | Carbohydrates | Carbohydrates | Fructose | 139% to 468% |
| 263635 | Carbohydrates | Carbohydrates | Galactose | 196% to 326% |
| 263635 | Carbohydrates | Carbohydrates | Glucose | 60% to 411% |
| 263635 | Esters | Esters | F1-U1.076 Fatty Acid Ester | 266% to 444% |
| 263635 | Esters | Esters | F1-U1.078 Fatty Acid Ester | 117% to 195% |
| 263635 | Esters | Esters | F1-U1.121 Fatty Acid Ester | 319% to 531% |
| 263635 | Esters - Hydroxy | Acyl acetylglycerols | 2-Eicosanoyl-1-acetylglycerol | 548% to 913% |
| 263635 | Esters - Hydroxy | Acyl acetylglycerols | 2-Octadecanoyl-1-acetylglycerol | 382% to 637% |
| 263635 | NA | NA | F1-U1.119 | 277% to 461% |
| 263635 | NA | NA | F3-U1.229 | 102% to 169% |
| 263635 | NA | NA | F3-U1.253 | 60% to 233% |
| 263635 | Phenols and Related Compounds | Phenylpropanes and Derivatives | Chlorogenic acid | 131% to 219% |
| 263635 | Sterols, Oxygenated Terpenes, and Other Isoprenoids | Prenylquinones | alpha-Tocopherol | -60% to -76% |
| 263635 | Sterols, Oxygenated Terpenes, and Other Isoprenoids | Prenylquinones | alpha-Tocopherol hydroquinone | 1994% to 3323% |
| 263635 | Sterols, Oxygenated Terpenes, and Other Isoprenoids | Terpenoids | beta-Sitosterol | 64% to 107% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263636

| Seq ID | Chemical Class | Biochemical Class | Compound Name | Modification |
|---|---|---|---|---|
| 263636 | Acids | Acids | Hexanedioic acid | -60% to -78% |
| 263636 | Acids - Fatty | Fatty Acids and Related Waxes | Eicosanoic acid | 60% to 190% |
| 263636 | Acids - Fatty | Fatty Acids and Related Waxes | Octadecanoic acid | 60% to 130% |
| 263636 | Acids - Fatty Unsat | Fatty Acids and Related Waxes | 7,10-Hexadecadienoic acid | -60% to -99% |
| 263636 | Acids - Fatty Unsat | Fatty Acids and Related Waxes | 9-Hexadecenoic acid | -60% to -95% |
| 263636 | Acids - Fatty Unsat | Fatty Acids and Related Waxes | 9-Octadecenoic acid | -60% to -90% |
| 263636 | Acids - Fatty Unsat | Fatty Acids and Related Waxes | F2-U1.365 Octadecenoic acid Isomer | -60% to -78% |
| 263636 | Alkenes and Alkynes | Terpenoids | Limonene | 253% to 421% |
| 263636 | Esters | Esters | F1-U1.078 Fatty Acid Ester | 258% to 430% |
| 263636 | Esters | Esters | F1-U1.121 Fatty Acid Ester | 90% to 150% |
| 263636 | NA | NA | F1-U0.875 | New |
| 263636 | Sterols, Oxygenated Terpenes, and Other Isoprenoids | Prenylquinones | alpha-Tocopherol hydroquinone | 326% to 544% |
| 263636 | Sterols, Oxygenated Terpenes, and Other Isoprenoids | Terpenoids | Fucosterol | NQ |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#263679

| Seq ID | Chemical Class | Biochemical Class | Compound Name | Modification |
|---|---|---|---|---|
| 263679 | Acids - Hydroxy Alpha | Acid Pathway | Citric acid | 147% to 362% |
| 263679 | Acids - Hydroxy Alpha | Carbohydrates | F3-U0.992 Sugar acid | New |
| 263679 | Alcohols | Carbohydrates | Inositol | 60% to -87% |
| 263679 | Alkaloids and Other Bases | Polyamines | 1,4-Butanediamine | 205% to 342% |
| 263679 | Alkenes and Alkynes | Terpenoids | Limonene | 126% to 210% |
| 263679 | Alkenes and Alkynes | Terpenoids | Squalene | New |
| 263679 | Amino Acids and Related Compounds | Amino Acids and Related Compounds | Asparagine | New |
| 263679 | Amino Acids and Related Compounds | Amino Acids and Related Compounds | Glutamine | New |
| 263679 | Amino Acids and Related Compounds | Amino Acids and Related Compounds | Threonine | 139% to 231% |
| 263679 | Amino Acids and Related Compounds | Amino Acids and Related Compounds | Tryptophan | New |
| 263679 | Amino Acids and Related Compounds | Amino Acids and Related Compounds | Tyrosine | New |
| 263679 | Carbohydrates | Carbohydrates | F3-U0.781 Carbohydrate | New |
| 263679 | Carbohydrates | Carbohydrates | F3-U0.813 Carbohydrate | 92% to 293% |
| 263679 | Carbohydrates | Carbohydrates | F3-U0.816 Carbohydrate | 94% to 157% |
| 263679 | Carbohydrates | Carbohydrates | F3-U0.821 Carbohydrate | 147% to 362% |
| 263679 | Carbohydrates | Carbohydrates | F3-U0.825 Carbohydrate | 103% to 583% |
| 263679 | Carbohydrates | Carbohydrates | F3-U0.872 Hexose | 120% to 200% |
| 263679 | Carbohydrates | Carbohydrates | F3-U0.938 Carbohydrate | New |
| 263679 | Carbohydrates | Carbohydrates | F3-U1.037 Carbohydrate | New |
| 263679 | Carbohydrates | Carbohydrates | F3-U1.049B Carbohydrate | New |
| 263679 | Carbohydrates | Carbohydrates | F3-U1.091 Carbohydrate | New |
| 263679 | Carbohydrates | Carbohydrates | F3-U1.189 Carbohydrate | 190% to 317% |
| 263679 | Carbohydrates | Carbohydrates | F3-U1.194 Carbohydrate | New |
| 263679 | Carbohydrates | Carbohydrates | F3-U1.208 Carbohydrate | New |
| 263679 | Carbohydrates | Carbohydrates | Fructose | 336% to 810% |
| 263679 | Carbohydrates | Carbohydrates | Glucose | 102% to 388% |
| 263679 | Esters | Esters | F1-U1.076 Fatty Acid Ester | NQ |
| 263679 | Esters | Esters | F1-U1.078 Fatty Acid Ester | NQ |
| 263679 | Esters | Esters | F1-U1.121 Fatty Acid Ester | 67% to 111% |
| 263679 | Esters - Hydroxy | Acyl acetylglycerols | 2-Eicosanoyl-1-acetylglycerol | 60% to 79% |
| 263679 | Esters - Hydroxy | Acyl acetylglycerols | 2-Octadecanoyl-1-acetylglycerol | 60% to 96% |
| 263679 | Hydrocarbons | Hydrocarbons | Nonacosane, 3-methyl | 60% to 123% |
| 263679 | NA | NA | F1-U1.230B | New |
| 263679 | NA | NA | F3-U0.852A | New |
| 263679 | Sterols, Oxygenated Terpenes, and Other Isoprenoids | Prenylquinones | alpha-Tocopherol | 381% to 3477% |
| 263679 | Sterols, Oxygenated Terpenes, and Other Isoprenoids | Prenylquinones | alpha-Tocopherol hydroquinone | 124% to 206% |
| 263679 | Sterols, Oxygenated Terpenes, and Other Isoprenoids | Prenylquinones | beta-Tocopherol | New |
| 263679 | Sterols, Oxygenated Terpenes, and Other Isoprenoids | Terpenoids | Campesterol | 60% to 89% |
| 263679 | Sterols, Oxygenated Terpenes, and Other Isoprenoids | Terpenoids | F1-U1.106 Sterol | New |
| 263679 | Sterols, Oxygenated Terpenes, and Other Isoprenoids | Terpenoids | F1-U1.130 Sterol | New |
| 263679 | Sterols, Oxygenated Terpenes, and Other Isoprenoids | Terpenoids | F1-U1.136 Sterol | 60% to 88% |
| 263679 | Sterols, Oxygenated Terpenes, and Other Isoprenoids | Terpenoids | Fucosterol | New |
| 263679 | Sterols, Oxygenated Terpenes, and Other Isoprenoids | Terpenoids | Stigmasterol | 77% to 322% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#263681

| Seq ID | Chemical Class | Biochemical Class | Compound Name | Modification |
|---|---|---|---|---|
| 263681 | Acids - Fatty | Fatty Acids and Related Waxes | Octadecanoic acid | 10% to 60% |
| 263681 | Acids - Fatty Branched | Fatty Acids and Related Waxes | Hexadecanoic acid, 14-methyl- | -35% to -60% |
| 263681 | Acids - Fatty Unsat | Fatty Acids and Related Waxes | 9,12,15-Octadecatrienoic acid | -15% to -55% |
| 263681 | Acids - Fatty Unsat | Fatty Acids and Related Waxes | 9-Octadecenoic acid | -17% to -55% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#2658

| Seq ID | Chemical Class | Biochemical Class | Compound Name | |
|---|---|---|---|---|
| 2658 | Acids - hydroxy Alpha | Carbohydrates | Galacturonic acid | -25% to -73% |
| 2658 | Carbohydrates | Carbohydrates | Arabinose | -47% to -95% |
| 2658 | Carbohydrates | Carbohydrates | Galactose | -35% to -89% |
| 2658 | Carbohydrates | Carbohydrates | Glucose | -19% to -63% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#26650

| Seq ID | Chemical Class | Biochemical Class | Compound Name | Modification |
|--------|----------------|-------------------|----------------|--------------|
| 26650 | Acids - hydroxy Alpha | Carbohydrates | Galacturonic acid | -1% to -68% |
| 26650 | Carbohydrates | Carbohydrates | Arabinose | -31% to -80% |
| 26650 | Carbohydrates | Carbohydrates | Glucose | -24% to -61% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#2696

| Seq ID | Chemical Class | Biochemical Class | Compound Name | Modification |
|---|---|---|---|---|
| 2696 | Carbohydrates | Carbohydrates | Arabinose | 17% to 1530% |
| 2696 | Carbohydrates | Carbohydrates | Glucose | -93% to -97% |
| 2696 | Carbohydrates | Carbohydrates | Mannose | -45% to -95% |

FIG. 6 continued

A list of metabolite compounds present in altered levels relative to reference samples as charararacterized by gas chromatography, liquid chromatography, and/or mass spectrometry. This list corresponds to samples transfected with nucleic acid sequence, Seq ID#27245

| Seq ID | Chemical Class | Biochemical Class | Compound Name | Modification |
|---|---|---|---|---|
| 27245 | Acids - hydroxy Alpha | Carbohydrates | Galacturonic acid | -9% to -99% |
| 27245 | Carbohydrates | Carbohydrates | Arabinose | -21% to -93% |
| 27245 | Carbohydrates | Carbohydrates | Galactose | -37% to -83% |
| 27245 | Carbohydrates | Carbohydrates | Mannose | -25% to -89% |
| 27245 | Carbohydrates | Carbohydrates | Rhamnose | -11% to -73% |
| 27245 | Carbohydrates | Carbohydrates | Xylose | -61% to -91% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#27429

| Seq ID | Chemical Class | Biochemical Class | Compound Name | Modification |
|---|---|---|---|---|
| 27429 | Acids - hydroxy Alpha | Carbohydrates | Galacturonic acid | -81% to -93% |
| 27429 | Carbohydrates | Carbohydrates | Arabinose | -53% to -95% |
| 27429 | Carbohydrates | Carbohydrates | Glucose | -27% to -67% |
| 27429 | Carbohydrates | Carbohydrates | Mannose | 31% to 112% |
| 27429 | Carbohydrates | Carbohydrates | Xylose | -16% to -93% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#27507 | | | |
|---|---|---|---|
| Seq ID | Chemical Class | Biochemical Class | Compound Name | Modification |
| 27507 | Carbohydrates | Carbohydrates | Arabinose | NQ |
| 27507 | Acids - hydroxy Alpha | Carbohydrates | Galacturonic acid | -10% to -95% |
| 27507 | Carbohydrates | Carbohydrates | Rhamnose | -7% to -95% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#3033

| Seq ID | Chemical Class | Biochemical Class | Compound Name | Modification |
|---|---|---|---|---|
| 3033 | Carbohydrates | Carbohydrates | Arabinose | -55% to -93% |
| 3033 | Carbohydrates | Carbohydrates | Galactose | -17% to -73% |
| 3033 | Carbohydrates | Carbohydrates | Rhamnose | -15% to -83% |
| 3033 | Carbohydrates | Carbohydrates | Xylose | -15% to -83% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#30367 ||||
|---|---|---|---|
| Seq ID | Chemical Class | Biochemical Class | Compound Name | Modification |
| 30367 | Carbohydrates | Carbohydrates | Arabinose | -29% to -91% |
| 30367 | Carbohydrates | Carbohydrates | Xylose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#30518

| Seq ID | Chemical Class | Biochemical Class | Compound Name | Modification |
|---|---|---|---|---|
| 30518 | Carbohydrates | Carbohydrates | Glucose | -79% to -97% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#3054

| Seq ID | Chemical Class | Biochemical Class | Compound Name | Modification |
|---|---|---|---|---|
| 3054 | Acids - hydroxy Alpha | Carbohydrates | Galacturonic acid | 39% to 279% |
| 3054 | Carbohydrates | Carbohydrates | Arabinose | 17% to 491% |
| 3054 | Carbohydrates | Carbohydrates | Galactose | 55% to 373% |
| 3054 | Carbohydrates | Carbohydrates | Glucose | NQ |
| 3054 | Carbohydrates | Carbohydrates | Mannose | -35% to -100% |
| 3054 | Carbohydrates | Carbohydrates | Rhamnose | 37% to 710% |
| 3054 | Carbohydrates | Carbohydrates | Xylose | 47% to 607% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#30548

| Seq ID | Chemical Class | Biochemical Class | Compound Name | Modification |
|---|---|---|---|---|
| 30548 | Acids | Acids | Carbamic acid | 759% to 1266% |
| 30548 | Acids - Hydroxy Alpha | Acid Pathway | Citric acid | 60% to 755% |
| 30548 | Acids - Hydroxy Alpha | Carbohydrates | Glyceric acid | New |
| 30548 | Acids - Hydroxy Alpha | Acid Pathway | Malic acid | 118% to 367% |
| 30548 | Acids - Hydroxy Alpha | Carbohydrates | Quinic acid | 69% to 114% |
| 30548 | Alcohols | Carbohydrates | Inositol | 60% to 88% |
| 30548 | Alcohols | Carbohydrates | Mannitol | NQ |
| 30548 | Amino Acids and Related Compounds | Amino Acids and Related Compounds | Aspartic acid | New |
| 30548 | Amino Acids and Related Compounds | Amino Acids and Related Compounds | Glutamic acid | New |
| 30548 | Amino Acids and Related Compounds | Amino Acids and Related Compounds | Glutamine | New |
| 30548 | Amino Acids and Related Compounds | Amino Acids and Related Compounds | Glycine | New |
| 30548 | Amino Acids and Related Compounds | Amino Acids and Related Compounds | Proline | New |
| 30548 | Amino Acids and Related Compounds | Amino Acids and Related Compounds | Proline, 5-oxo- | 60% to 264% |
| 30548 | Carbohydrates | Carbohydrates | F3-U0.813 Carbohydrate | 567% to 945% |
| 30548 | Carbohydrates | Carbohydrates | F3-U0.816 Carbohydrate | 228% to 381% |
| 30548 | Carbohydrates | Carbohydrates | F3-U0.821 Carbohydrate | 60% to 755% |
| 30548 | Carbohydrates | Carbohydrates | F3-U0.846 Carbohydrate | 311% to 4962% |
| 30548 | Carbohydrates | Carbohydrates | F3-U0.872 Hexose | 229% to 1579% |
| 30548 | Carbohydrates | Carbohydrates | F3-U1.143 Carbohydrate | 60% to 98% |
| 30548 | Carbohydrates | Carbohydrates | F3-U1.150 Carbohydrate | 113% to 189% |
| 30548 | Carbohydrates | Carbohydrates | F3-U1.189 Carbohydrate | 247% to 411% |
| 30548 | Carbohydrates | Carbohydrates | F3-U1.194 Carbohydrate | 397% to 661% |
| 30548 | Carbohydrates | Carbohydrates | Fructose | 60% to 92% |
| 30548 | Carbohydrates | Carbohydrates | Glucose | 73% to 160% |
| 30548 | NA | NA | F3-U1.172 | 215% to 358% |
| 30548 | NA | NA | F3-U1.253 | 90% to 151% |
| 30548 | NA | NA | F3-U1.255 | 91% to 151% |
| 30548 | Phenols and Related Compounds | Phenylpropanes and Derivatives | Chlorogenic acid | 106% to 177% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316712

| Seq ID | Chemical Class | Biochemical Class | Compound Name | Modification |
|---|---|---|---|---|
| 316712 | Amino Acids and Related Compounds | Amino Acids and Related Compounds | Alanine | 60% to 115% |
| 316712 | Amino Acids and Related Compounds | Amino Acids and Related Compounds | Arginine | 100% to 785% |
| 316712 | Amino Acids and Related Compounds | Amino Acids and Related Compounds | Asparagine | New |
| 316712 | Amino Acids and Related Compounds | Amino Acids and Related Compounds | Cysteine | 60% to 470% |
| 316712 | Amino Acids and Related Compounds | Amino Acids and Related Compounds | Glutamic acid | -60% to -81% |
| 316712 | Amino Acids and Related Compounds | Amino Acids and Related Compounds | Glutamine | New |
| 316712 | Amino Acids and Related Compounds | Amino Acids and Related Compounds | Proline | NQ |
| 316712 | Carbohydrates | Carbohydrates | F3-U0.872 Hexose | 62% to 103% |
| 316712 | Carbohydrates | Carbohydrates | F3-U1.189 Carbohydrate | 140% to 233% |
| 316712 | Carbohydrates | Carbohydrates | F3-U1.194 Carbohydrate | 139% to 231% |
| 316712 | Carbohydrates | Carbohydrates | Fructose | 337% to 839% |
| 316712 | Carbohydrates | Carbohydrates | Galactose or Mannose | New |
| 316712 | Carbohydrates | Carbohydrates | Glucose | 218% to 928% |
| 316712 | NA | NA | F3-U0.882 | 429% to 715% |
| 316712 | NA | NA | F3-U1.229 | 60% to 91% |
| 316712 | NA | NA | F3-U1.253 | 98% to 164% |
| 316712 | NA | NA | F3-U1.255 | 60% to 81% |
| 316712 | Phenols and Related Compounds | Phenylpropanes and Derivatives | Chlorogenic acid | 76% to 127% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316731

| Seq ID | Chemical Class | Biochemical Class | Compound Name | Modification |
|---|---|---|---|---|
| 316731 | Alkenes and Alkynes | Terpenoids | Limonene | 60% to 97% |
| 316731 | Esters - Hydroxy | Acyl acetylglycerols | 2-Eicosanoyl-1-acetylglycerol | 5003% to 8339% |
| 316731 | Esters - Hydroxy | Acyl acetylglycerols | 2-Octadecanoyl-1-acetylglycerol | New |
| 316731 | Hydrocarbons | Hydrocarbons | Triacontane, 2-methyl- | -60% to -76% |
| 316731 | Sterols, Oxygenated Terpenes, and Other Isoprenoids | Prenylquinones | alpha-Tocopherol | 220% to 366% |
| 316731 | Sterols, Oxygenated Terpenes, and Other Isoprenoids | Terpenoids | beta-Sitosterol | New |
| 316731 | Sterols, Oxygenated Terpenes, and Other Isoprenoids | Prenylquinones | beta-Tocopherol | New |
| 316731 | Sterols, Oxygenated Terpenes, and Other Isoprenoids | Terpenoids | Campesterol | New |
| 316731 | Sterols, Oxygenated Terpenes, and Other Isoprenoids | Terpenoids | Cholesterol | 1245% to 2075% |
| 316731 | Sterols, Oxygenated Terpenes, and Other Isoprenoids | Terpenoids | F1-U1.106 Sterol | -62% to -100% |
| 316731 | Sterols, Oxygenated Terpenes, and Other Isoprenoids | Terpenoids | F1-U1.122 Sterol | -60% to -100% |
| 316731 | Sterols, Oxygenated Terpenes, and Other Isoprenoids | Terpenoids | F1-U1.130 Sterol | -60% to -84% |
| 316731 | Sterols, Oxygenated Terpenes, and Other Isoprenoids | Terpenoids | Fucosterol | New |
| 316731 | Sterols, Oxygenated Terpenes, and Other Isoprenoids | Terpenoids | Stigmasta-5,22-dien-3-ol, acetate | -60% to -100% |
| 316731 | Sterols, Oxygenated Terpenes, and Other Isoprenoids | Terpenoids | Stigmasterol | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#316741

| Seq ID | Chemical Class | Biochemical Class | Compound Name | Modification |
|---|---|---|---|---|
| 316741 | Acids | Acids | Carbamic acid | NQ |
| 316741 | Acids - Fatty Unsat | Fatty Acids and Related Waxes | 9-Octadecenoic acid | New |
| 316741 | Acids - Hydroxy Alpha | Carbohydrates | Quinic acid | 95% to 158% |
| 316741 | Amino Acids and Related Compounds | Amino Acids and Related Compounds | Proline, 5-oxo- | 60% to 76% |
| 316741 | Carbohydrates | Carbohydrates | F3-U0.768 Carbohydrate | NQ |
| 316741 | Carbohydrates | Carbohydrates | F3-U0.813 Carbohydrate | 144% to 240% |
| 316741 | Carbohydrates | Carbohydrates | F3-U0.816 Carbohydrate | 85% to 142% |
| 316741 | Carbohydrates | Carbohydrates | F3-U0.825 Carbohydrate | 72% to 120% |
| 316741 | Carbohydrates | Carbohydrates | F3-U0.846 Carbohydrate | 148% to 247% |
| 316741 | Carbohydrates | Carbohydrates | F3-U0.872 Hexose | 122% to 203% |
| 316741 | Carbohydrates | Carbohydrates | Fructose | 61% to 122% |
| 316741 | Carbohydrates | Carbohydrates | Glucose | 101% to 247% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#316762

| Seq ID | Chemical Class | Biochemical Class | Compound Name | Modification |
|---|---|---|---|---|
| 316762 | Alkenes and Alkynes | Alkenes and Alkynes | F1-U0.690 Isolongifolene, 4,5,9,10-dehydro- Isomer A | New |
| 316762 | Alkenes and Alkynes | Alkenes and Alkynes | F1-U0.695 Isolongifolene, 4,5,9,10-dehydro- Isomer B | New |
| 316762 | Alkenes and Alkynes | Alkenes and Alkynes | Isolongifolene, 4,5,9,10-dehydro- | New |
| 316762 | Amino Acids and Related Compounds | Amino Acids and Related Compounds | Glutamic acid | 60% to 125% |
| 316762 | Amino Acids and Related Compounds | Amino Acids and Related Compounds | Histidine | 60% to 1545% |
| 316762 | Amino Acids and Related Compounds | Amino Acids and Related Compounds | Isoleucine | New |
| 316762 | Amino Acids and Related Compounds | Amino Acids and Related Compounds | Methionine | 60% to 110% |
| 316762 | Amino Acids and Related Compounds | Amino Acids and Related Compounds | Phenylalanine | New |
| 316762 | Amino Acids and Related Compounds | Amino Acids and Related Compounds | Serine | 100% to 235% |
| 316762 | Amino Acids and Related Compounds | Amino Acids and Related Compounds | Threonine | 60% to 230% |
| 316762 | Amino Acids and Related Compounds | Amino Acids and Related Compounds | Tryptophan | New |
| 316762 | Amino Acids and Related Compounds | Amino Acids and Related Compounds | Tyrosine | 265% to 670% |
| 316762 | Amino Acids and Related Compounds | Amino Acids and Related Compounds | Valine | 60% to 777% |
| 316762 | Esters | Esters | F1-U1.076 Fatty Acid Ester | 89% to 149% |
| 316762 | Esters | Esters | F1-U1.113 Fatty Acid Ester | -60% to -98% |
| 316762 | Esters | Esters | F1-U1.119 Fatty Acid Ester | 78% to 216% |
| 316762 | Esters | Esters | F1-U1.121 Fatty Acid Ester | 147% to 244% |
| 316762 | Esters - Hydroxy | Acyl acetylglycerols | 2-Eicosanoyl-1-acetylglycerol | 60% to 96% |
| 316762 | Esters - Hydroxy | Acyl acetylglycerols | 2-Octadecanoyl-1-acetylglycerol | 108% to 180% |
| 316762 | Hydrocarbons | Hydrocarbons | Isononacosane | 84% to 139% |
| 316762 | Hydrocarbons | Hydrocarbons | Nonacosane, 3-methyl- | New |
| 316762 | NA | NA | F1-U0.760 | New |
| 316762 | NA | NA | F1-U0.780 | New |
| 316762 | NA | NA | F1-U0.801 | New |
| 316762 | NA | NA | F1-U0.830 | New |
| 316762 | NA | NA | F1-U0.846 | New |
| 316762 | NA | NA | F1-U0.868 | New |
| 316762 | NA | NA | F1-U0.872 | New |
| 316762 | NA | NA | F1-U0.972 | 885% to 1961% |
| 316762 | Sterols, Oxygenated Terpenes, and Other Isoprenoids | Prenylquinones | alpha-Tocopherol | 101% to New |
| 316762 | Sterols, Oxygenated Terpenes, and Other Isoprenoids | Prenylquinones | alpha-Tocopherol hydroquinone | New |
| 316762 | Sterols, Oxygenated Terpenes, and Other Isoprenoids | Prenylquinones | beta-Tocopherol | 64% to 107% |
| 316762 | Sterols, Oxygenated Terpenes, and Other Isoprenoids | Terpenoids | Campesterol | 164% to New |
| 316762 | Sterols, Oxygenated Terpenes, and Other Isoprenoids | Terpenoids | Ergosta-5,24-dien-3-ol | 266% to 476% |
| 316762 | Sterols, Oxygenated Terpenes, and Other Isoprenoids | Terpenoids | Ergosta-8,24(28)-dien-3-ol, 4,14-dimethyl- | -71% to -100% |
| 316762 | Sterols, Oxygenated Terpenes, and Other Isoprenoids | Terpenoids | F1-U1.106 Sterol | -63% to -100% |
| 316762 | Sterols, Oxygenated Terpenes, and Other Isoprenoids | Terpenoids | F1-U1.122 Sterol | -63% to -100% |
| 316762 | Sterols, Oxygenated Terpenes, and Other Isoprenoids | Terpenoids | F1-U1.130 Sterol | -68% to -100% |
| 316762 | Sterols, Oxygenated Terpenes, and Other Isoprenoids | Terpenoids | F1-U1.136 Sterol | 60% to 211% |
| 316762 | Sterols, Oxygenated Terpenes, and Other Isoprenoids | Terpenoids | Fucosterol | 60% to 80% |
| 316762 | Sterols, Oxygenated Terpenes, and Other Isoprenoids | Terpenoids | Stigmasta-3,5,22-triene | NQ |
| 316762 | Sterols, Oxygenated Terpenes, and Other Isoprenoids | Terpenoids | Stigmasta-5,22-dien-3-ol, acetate | 69% to 276% |
| 316762 | Sterols, Oxygenated Terpenes, and Other Isoprenoids | Terpenoids | Stigmasterol | |

FIG. 6 continued

| \multicolumn{5}{l}{A list of metabolite compounds present in altered levels relative to reference samples as chararacterized by gas chromatography, liquid chromatography, and/or mass spectrometry. This list corresponds to samples transfected with nucleic acid sequence, Seq ID#316804} |
|---|---|---|---|---|

| Seq ID | Chemical Class | Biochemical Class | Compound Name | Modification |
|---|---|---|---|---|
| 316804 | Acids | Acids | Carbamic acid | 64% to 107% |
| 316804 | Acids - Hydroxy Alpha | Acid Pathway | Citric acid | 149% to 249% |
| 316804 | Acids - Hydroxy Alpha | Carbohydrates | F3-U0.992 Sugar acid | New |
| 316804 | Acids - Hydroxy Alpha | Acid Pathway | Malic acid | 61% to 102% |
| 316804 | Amino Acids and Related Compounds | Amino Acids and Related Compounds | Arginine | 60% to 200% |
| 316804 | Amino Acids and Related Compounds | Amino Acids and Related Compounds | Asparagine | 1685% to 2809% |
| 316804 | Amino Acids and Related Compounds | Amino Acids and Related Compounds | Cysteine | 60% to 640% |
| 316804 | Amino Acids and Related Compounds | Amino Acids and Related Compounds | Glutamic acid | 60% to 85% |
| 316804 | Amino Acids and Related Compounds | Amino Acids and Related Compounds | Glycine | 60% to 415% |
| 316804 | Amino Acids and Related Compounds | Amino Acids and Related Compounds | Lysine | 60% to 310% |
| 316804 | Amino Acids and Related Compounds | Amino Acids and Related Compounds | Methionine | 100% to 540% |
| 316804 | Amino Acids and Related Compounds | Amino Acids and Related Compounds | Threonine | 60% to 360% |
| 316804 | Amino Acids and Related Compounds | Amino Acids and Related Compounds | Tryptophan | 70% to 1140% |
| 316804 | Amino Acids and Related Compounds | Amino Acids and Related Compounds | Valine | 60% to 1395% |
| 316804 | Carbohydrates | Carbohydrates | F3-U0.846 Carbohydrate | -60% to -76% |
| 316804 | Carbohydrates | Carbohydrates | F3-U1.119 Carbohydrate | 416% to 693% |
| 316804 | Carbohydrates | Carbohydrates | F3-U1.189 Carbohydrate | 257% to 429% |
| 316804 | Carbohydrates | Carbohydrates | F3-U1.194 Carbohydrate | 512% to 853% |
| 316804 | Carbohydrates | Carbohydrates | Fructose | 61% to 101% |
| 316804 | Carbohydrates | Carbohydrates | Glucose | 60% to 78% |
| 316804 | Esters - Hydroxy | Acyl acetylglycerols | 2-Octadecanoyl-1-acetylglycerol | -60% to -81% |
| 316804 | NA | NA | F3-U0.855 | New |
| 316804 | NA | NA | F3-U0.891C | New |
| 316804 | NA | NA | F3-U1.085 | New |
| 316804 | NA | NA | F3-U1.229 | 60% to 83% |
| 316804 | NA | NA | F3-U1.253 | 83% to 138% |
| 316804 | NA | NA | F3-U1.255 | 66% to 110% |
| 316804 | Sterols, Oxygenated Terpenes, and Other Isoprenoids | Prenylquinones | alpha-Tocopherol | 77% to 491% |
| 316804 | Sterols, Oxygenated Terpenes, and Other Isoprenoids | Prenylquinones | beta-Tocopherol | New |
| 316804 | Sterols, Oxygenated Terpenes, and Other Isoprenoids | Terpenoids | Cycloartenol | New |
| 316804 | Sterols, Oxygenated Terpenes, and Other Isoprenoids | Terpenoids | Fucosterol | -60% to -79% |
| 316804 | Sterols, Oxygenated Terpenes, and Other Isoprenoids | Prenylquinones | gamma-Tocopherol | New |
| 316804 | Sterols, Oxygenated Terpenes, and Other Isoprenoids | Terpenoids | Lophenol, 24-methylene- | New |

FIG. 6 continued

A list of metabolite compounds present in altered levels relative to reference samples as characterized by gas chromatography, liquid chromatography and/or mass spectrometry. This list corresponds to samples transfected with nucleic acid sequence, Seq ID#316807

| Seq ID | Chemical Class | Biochemical Class | Compound Name | Modification |
|---|---|---|---|---|
| 316807 | Acids - Hydroxy Alpha | Acid Pathway | Citric acid | 263% to 439% |
| 316807 | Alkenes and Alkynes | Terpenoids | Squalene | 172% to 286% |
| 316807 | Amino Acids and Related Compounds | Amino Acids and Related Compounds | Asparagine | New |
| 316807 | Amino Acids and Related Compounds | Amino Acids and Related Compounds | Asparagine | New |
| 316807 | Amino Acids and Related Compounds | Amino Acids and Related Compounds | Glutamine | New |
| 316807 | Amino Acids and Related Compounds | Amino Acids and Related Compounds | Proline | 60% to 94% |
| 316807 | Carbohydrates | Carbohydrates | F3-U0.813 Carbohydrate | 110% to 183% |
| 316807 | Carbohydrates | Carbohydrates | F3-U0.816 Carbohydrate | 90% to 149% |
| 316807 | Carbohydrates | Carbohydrates | F3-U0.821 Carbohydrate | 263% to 439% |
| 316807 | Carbohydrates | Carbohydrates | F3-U0.825 Carbohydrate | 89% to 159% |
| 316807 | Carbohydrates | Carbohydrates | F3-U0.872 Hexose | 60% to 93% |
| 316807 | Carbohydrates | Carbohydrates | F3-U1.150 Carbohydrate | 127% to 211% |
| 316807 | Carbohydrates | Carbohydrates | F3-U1.189 Carbohydrate | 112% to 187% |
| 316807 | Carbohydrates | Carbohydrates | F3-U1.194 Carbohydrate | 193% to 322% |
| 316807 | Carbohydrates | Carbohydrates | Fructose | 78% to 130% |
| 316807 | Esters | Esters | F1-U1.121 Fatty Acid Ester | 227% to 379% |
| 316807 | Esters - Hydroxy | Acyl acetylglycerols | 2-Eicosanoyl-1-acetylglycerol | 127% to 212% |
| 316807 | NA | NA | F1-U0.873 | New |
| 316807 | NA | NA | F3-U0.634 | 60% to 76% |
| 316807 | NA | NA | F3-U0.836 | 249% to 415% |
| 316807 | NA | NA | F3-U1.253 | 60% to 84% |
| 316807 | NA | NA | F3-U1.255 | 60% to 92% |
| 316807 | Phenols and Related Compounds | Phenylpropanes and Derivatives | Chlorogenic acid | 67% to 112% |
| 316807 | Sterols, Oxygenated Terpenes, and Other Isoprenoids | Prenylquinones | alpha-Tocopherol | 270% to 451% |
| 316807 | Sterols, Oxygenated Terpenes, and Other Isoprenoids | Prenylquinones | alpha-Tocopherol hydroquinone | New |
| 316807 | Sterols, Oxygenated Terpenes, and Other Isoprenoids | Terpenoids | beta-Sitosterol | 305% to 509% |
| 316807 | Sterols, Oxygenated Terpenes, and Other Isoprenoids | Terpenoids | Campesterol | 101% to 168% |
| 316807 | Sterols, Oxygenated Terpenes, and Other Isoprenoids | Terpenoids | Cholesterol | 172% to 286% |
| 316807 | Sterols, Oxygenated Terpenes, and Other Isoprenoids | Terpenoids | Ergosta-8,24(28)-dien-3-ol, 4,14-dimethyl- | New |
| 316807 | Sterols, Oxygenated Terpenes, and Other Isoprenoids | Terpenoids | F1-U1.217 Sterol | 111% to 185% |
| 316807 | Sterols, Oxygenated Terpenes, and Other Isoprenoids | Terpenoids | F1-U1.228A Sterol | 82% to 137% |
| 316807 | Sterols, Oxygenated Terpenes, and Other Isoprenoids | Terpenoids | Fucosterol | 125% to 208% |
| 316807 | Sterols, Oxygenated Terpenes, and Other Isoprenoids | Prenylquinones | gamma-Tocopherol | New |
| 316807 | Sterols, Oxygenated Terpenes, and Other Isoprenoids | Terpenoids | Stigmasterol | 169% to 281% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316820

| SeqID | Chemical Class | Biochemical Class | Compound Name | Modification |
|---|---|---|---|---|
| 316820 | Acids | Acids | Carbamic acid | -62% to -100% |
| 316820 | Acids - Hydroxy Alpha | Acid Pathway | Citric acid | 146% to 424% |
| 316820 | Acids - Hydroxy Alpha | Carbohydrates | Quinic acid | -66% to -100% |
| 316820 | Alkenes and Alkynes | Terpenoids | Limonene | 166% to 276% |
| 316820 | Amino Acids and Related Compounds | Amino Acids and Related Compounds | Asparagine | New |
| 316820 | Amino Acids and Related Compounds | Amino Acids and Related Compounds | Asparagine | New |
| 316820 | Amino Acids and Related Compounds | Amino Acids and Related Compounds | Glutamine | New |
| 316820 | Amino Acids and Related Compounds | Amino Acids and Related Compounds | Proline | 60% to 78% |
| 316820 | Amino Acids and Related Compounds | Amino Acids and Related Compounds | Threonine | 177% to 295% |
| 316820 | Amino Acids and Related Compounds | Amino Acids and Related Compounds | Tryptophan | New |
| 316820 | Amino Acids and Related Compounds | Amino Acids and Related Compounds | Tyrosine | New |
| 316820 | Carbohydrates | Carbohydrates | Arabinose or Xylose | New |
| 316820 | Carbohydrates | Carbohydrates | F3-U0.781 Carbohydrate | New |
| 316820 | Carbohydrates | Carbohydrates | F3-U0.813 Carbohydrate | 160% to 267% |
| 316820 | Carbohydrates | Carbohydrates | F3-U0.825 Carbohydrate | New |
| 316820 | Carbohydrates | Carbohydrates | F3-U0.872 Hexose | 76% to 127% |
| 316820 | Carbohydrates | Carbohydrates | F3-U1.104 Carbohydrate | New |
| 316820 | Carbohydrates | Carbohydrates | F3-U1.108 Carbohydrate | New |
| 316820 | Carbohydrates | Carbohydrates | F3-U1.113 Carbohydrate | New |
| 316820 | Carbohydrates | Carbohydrates | F3-U1.120 Carbohydrate | New |
| 316820 | Carbohydrates | Carbohydrates | F3-U1.150 Carbohydrate | 60% to 95% |
| 316820 | Carbohydrates | Carbohydrates | F3-U1.189 Carbohydrate | 68% to 359% |
| 316820 | Carbohydrates | Carbohydrates | F3-U1.194 Carbohydrate | 103% to 509% |
| 316820 | Carbohydrates | Carbohydrates | Fructose | 106% to 1120% |
| 316820 | Carbohydrates | Carbohydrates | Galactose or Mannose | 317% to New |
| 316820 | Carbohydrates | Carbohydrates | Glucose | 60% to 633% |
| 316820 | Esters | Esters | F1-U1.076 Fatty Acid Ester | -60% to -76% |
| 316820 | Esters | Esters | F1-U1.113 Fatty Acid Ester | -61% to -100% |
| 316820 | Esters - Hydroxy | Acyl acetylglycerols | 2-Octadecanoyl-1-acetylglycerol | -60% to -100% |
| 316820 | Hydrocarbons | Hydrocarbons | Hentriacontane, 3-methyl- | 95% to 158% |
| 316820 | NA | NA | F3-U0.838 | New |
| 316820 | NA | NA | F3-U0.852A | New |
| 316820 | NA | NA | F3-U0.868B | 232% to 387% |
| 316820 | NA | NA | F3-U0.882 | 87% to 145% |
| 316820 | NA | NA | F3-U1.141 | 60% to 80% |
| 316820 | NA | NA | F3-U1.156 | New |
| 316820 | NA | NA | F3-U1.165 | New |
| 316820 | NA | NA | F3-U1.204 | New |
| 316820 | Phenols and Related Compounds | Phenylpropanes and Derivatives | Chlorogenic acid | 63% to 238% |
| 316820 | Sterols, Oxygenated Terpenes, and Other Isoprenoids | Prenylquinones | alpha-Tocopherol | 529% to 1358% |
| 316820 | Sterols, Oxygenated Terpenes, and Other Isoprenoids | Prenylquinones | alpha-Tocopherol hydroquinone | 74% to 123% |
| 316820 | Sterols, Oxygenated Terpenes, and Other Isoprenoids | Terpenoids | beta-Sitosterol | 190% to 317% |
| 316820 | Sterols, Oxygenated Terpenes, and Other Isoprenoids | Prenylquinones | beta-Tocopherol | New |
| 316820 | Sterols, Oxygenated Terpenes, and Other Isoprenoids | Terpenoids | Campesterol | |
| 316820 | Sterols, Oxygenated Terpenes, and Other Isoprenoids | Terpenoids | Cholesterol | |
| 316820 | Sterols, Oxygenated Terpenes, and Other Isoprenoids | Terpenoids | Cycloartanol, 24-methylene- | New |
| 316820 | Sterols, Oxygenated Terpenes, and Other Isoprenoids | Terpenoids | Cycloartenol | 213% to 355% |
| 316820 | Sterols, Oxygenated Terpenes, and Other Isoprenoids | Terpenoids | Ergost-7-en-3-ol | New |
| 316820 | Sterols, Oxygenated Terpenes, and Other Isoprenoids | Terpenoids | F1-U1.130 Sterol | NQ |
| 316820 | Sterols, Oxygenated Terpenes, and Other Isoprenoids | Prenylquinones | F1-U1.179 alpha-Tocopherol Isomer | 102% to 170% |
| 316820 | Sterols, Oxygenated Terpenes, and Other Isoprenoids | Terpenoids | F1-U1.230A Sterol | New |
| 316820 | Sterols, Oxygenated Terpenes, and Other Isoprenoids | Terpenoids | Lophenol, 24-methylene- | 375% to 625% |
| 316820 | Sterols, Oxygenated Terpenes, and Other Isoprenoids | Terpenoids | Stigmast-8(14)-en-3-ol | |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316833

| Seq ID | Chemical Class | Biochemical Class | Compound Name | Modification |
|---|---|---|---|---|
| 316833 | Acids | Acids | Carbamic acid | -60% to -97% |
| 316833 | Acids - Hydroxy | Amino Acids and Related Compounds | Shikimic acid | 125% to 209% |
| 316833 | Acids - Hydroxy Alpha | Carbohydrates | Quinic acid | 60% to 100% |
| 316833 | Carbohydrates | Carbohydrates | F3-U0.825 Carbohydrate | New |
| 316833 | Carbohydrates | Carbohydrates | F3-U0.846 Carbohydrate | 89% to 149% |
| 316833 | Carbohydrates | Carbohydrates | F3-U0.872 Hexose | 210% to 349% |
| 316833 | Carbohydrates | Carbohydrates | F3-U1.113 Carbohydrate | 61% to 101% |
| 316833 | Carbohydrates | Carbohydrates | Fructose | 92% to 303% |
| 316833 | Carbohydrates | Carbohydrates | Galactose or Mannose | 107% to 178% |
| 316833 | Carbohydrates | Carbohydrates | Glucose | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316834

| Seq ID | Chemical Class | Biochemical Class | Compound Name | Modification |
|---|---|---|---|---|
| 316834 | Acids | Acids | Carbamic acid | NQ |
| 316834 | Acids - Hydroxy Alpha | Acid Pathway | Citric acid | 323% to 538% |
| 316834 | Acids - Hydroxy Alpha | Carbohydrates | Quinic acid | -59% to -100% |
| 316834 | Alkenes and Alkynes | Terpenoids | Limonene | 102% to 286% |
| 316834 | Amino Acids and Related Compounds | Amino Acids and Related Compounds | Asparagine | New |
| 316834 | Carbohydrates | Carbohydrates | F3-U0.781 Carbohydrate | New |
| 316834 | Carbohydrates | Carbohydrates | F3-U0.825 Carbohydrate | 60% to 82% |
| 316834 | Carbohydrates | Carbohydrates | F3-U0.846 Carbohydrate | 93% to 155% |
| 316834 | Carbohydrates | Carbohydrates | F3-U0.872 Hexose | 139% to 231% |
| 316834 | Carbohydrates | Carbohydrates | F3-U1.113 Carbohydrate | 66% to 111% |
| 316834 | Carbohydrates | Carbohydrates | F3-U1.150 Carbohydrate | 115% to 192% |
| 316834 | Carbohydrates | Carbohydrates | F3-U1.189 Carbohydrate | 170% to 283% |
| 316834 | Carbohydrates | Carbohydrates | F3-U1.194 Carbohydrate | 86% to 253% |
| 316834 | Carbohydrates | Carbohydrates | Fructose | 234% to 390% |
| 316834 | Carbohydrates | Carbohydrates | Galactose or Mannose | 60% to 100% |
| 316834 | Carbohydrates | Carbohydrates | Glucose | 151% to 252% |
| 316834 | Esters | Esters | F1-U1.078 Fatty Acid Ester | 65% to 109% |
| 316834 | Esters | Esters | F1-U1.121 Fatty Acid Ester | New |
| 316834 | Esters - Hydroxy | Acyl acetylglycerols | 2-Eicosanoyl-1-acetylglycerol | 60% to 88% |
| 316834 | Esters - Hydroxy | Acyl acetylglycerols | 2-Octadecanoyl-1-acetylglycerol | 109% to 181% |
| 316834 | Hydrocarbons | Hydrocarbons | Isononacosane | NQ |
| 316834 | Hydrocarbons | Hydrocarbons | Triacontane, 2-methyl- | New |
| 316834 | NA | NA | F3-U0.602 | New |
| 316834 | NA | NA | F3-U0.838 | NQ |
| 316834 | NA | NA | F3-U0.868B | New |
| 316834 | NA | NA | F3-U0.882 | New |
| 316834 | NA | NA | F3-U1.701 | New |
| 316834 | NA | NA | F3-U1.141 | New |
| 316834 | NA | NA | F3-U1.156 | New |
| 316834 | NA | NA | F3-U1.165 | 166% to 277% |
| 316834 | Phenols and Related Compounds | Phenylpropanes and Derivatives | Chlorogenic acid | 428% to 1067% |
| 316834 | Sterols, Oxygenated Terpenes, and Other Isoprenoids | Prenylquinones | alpha-Tocopherol | New |
| 316834 | Sterols, Oxygenated Terpenes, and Other Isoprenoids | Prenylquinones | alpha-Tocopherol hydroquinone | New |
| 316834 | Sterols, Oxygenated Terpenes, and Other Isoprenoids | Terpenoids | beta-Sitosterol | New |
| 316834 | Sterols, Oxygenated Terpenes, and Other Isoprenoids | Prenylquinones | beta-Tocopherol | New |
| 316834 | Sterols, Oxygenated Terpenes, and Other Isoprenoids | Terpenoids | Campesterol | 66% to 110% |
| 316834 | Sterols, Oxygenated Terpenes, and Other Isoprenoids | Terpenoids | Cholest-7-en-3-ol | 306% to 510% |
| 316834 | Sterols, Oxygenated Terpenes, and Other Isoprenoids | Terpenoids | Cholesterol | New |
| 316834 | Sterols, Oxygenated Terpenes, and Other Isoprenoids | Terpenoids | Cycloloudenol | New |
| 316834 | Sterols, Oxygenated Terpenes, and Other Isoprenoids | Terpenoids | Ergosta-5,24-dien-3-ol | -66% to -100% |
| 316834 | Sterols, Oxygenated Terpenes, and Other Isoprenoids | Terpenoids | F1-U1.136 Sterol | New |
| 316834 | Sterols, Oxygenated Terpenes, and Other Isoprenoids | Terpenoids | F1-U1.244 Sterol | New |
| 316834 | Sterols, Oxygenated Terpenes, and Other Isoprenoids | Terpenoids | Fucosterol | New |
| 316834 | Sterols, Oxygenated Terpenes, and Other Isoprenoids | Terpenoids | Stigmasterol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316837

| Seq ID | Chemical Class | Biochemical Class | Compound Name | Modification |
|---|---|---|---|---|
| 316837 | Alcohols | Alcohols | Valerenenol | New |
| 316837 | Alkenes and Alkynes | Alkenes and Alkynes | F1-U0.695 Isolongifolene, 4,5,9,10-dehydro- Isomer B | New |
| 316837 | Alkenes and Alkynes | Terpenoids | Limonene | 138% to 265% |
| 316837 | Amino Acids and Related Compounds | Amino Acids and Related Compounds | Arginine | 35% to 510% |
| 316837 | Amino Acids and Related Compounds | Amino Acids and Related Compounds | Cysteine | 50% to 475% |
| 316837 | Amino Acids and Related Compounds | Amino Acids and Related Compounds | Histidine | 85% to 485% |
| 316837 | Amino Acids and Related Compounds | Amino Acids and Related Compounds | Isoleucine | New |
| 316837 | Amino Acids and Related Compounds | Amino Acids and Related Compounds | Leucine | New |
| 316837 | Amino Acids and Related Compounds | Amino Acids and Related Compounds | Phenylalanine | New |
| 316837 | Amino Acids and Related Compounds | Amino Acids and Related Compounds | Threonine | 45% to 210% |
| 316837 | Amino Acids and Related Compounds | Amino Acids and Related Compounds | Tryptophan | New |
| 316837 | Amino Acids and Related Compounds | Amino Acids and Related Compounds | Tyrosine | New |
| 316837 | Amino Acids and Related Compounds | Amino Acids and Related Compounds | Valine | 140% to 405% |
| 316837 | Esters | Esters | F1-U1.119 Fatty Acid Ester | 72% to 120% |
| 316837 | Hydrocarbons | Hydrocarbons | Nonacosane, 3-methyl | 60% to 89% |
| 316837 | NA | NA | F1-U0.765 | New |
| 316837 | NA | NA | F1-U0.766 | New |
| 316837 | NA | NA | F1-U0.774 | New |
| 316837 | NA | NA | F1-U0.826 | New |
| 316837 | NA | NA | F1-U0.830 | New |
| 316837 | NA | NA | F1-U0.845 | New |
| 316837 | NA | NA | F1-U0.868 | New |
| 316837 | NA | NA | F1-U0.873 | New |
| 316837 | NA | NA | F1-U0.972 | New |
| 316837 | Sterols, Oxygenated Terpenes, and Other Isoprenoids | Prenylquinones | alpha-Tocopherol | 213% to 455% |
| 316837 | Sterols, Oxygenated Terpenes, and Other Isoprenoids | Prenylquinones | alpha-Tocopherol hydroquinone | New |
| 316837 | Sterols, Oxygenated Terpenes, and Other Isoprenoids | Prenylquinones | beta-Tocopherol | New |
| 316837 | Sterols, Oxygenated Terpenes, and Other Isoprenoids | Terpenoids | Cholesterol | -60% to -79% |
| 316837 | Sterols, Oxygenated Terpenes, and Other Isoprenoids | Terpenoids | Ergosta-8,24(28)-dien-3-ol, 4,14-dimethyl- | New |
| 316837 | Sterols, Oxygenated Terpenes, and Other Isoprenoids | Terpenoids | F1-U1.200 Sterol | New |
| 316837 | Sterols, Oxygenated Terpenes, and Other Isoprenoids | Terpenoids | Stigmasterol | 60% to 75% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316847

| Seq ID | Chemical Class | Biochemical Class | Compound Name | Modification |
|---|---|---|---|---|
| 316847 | Alkenes and Alkynes | Terpenoids | Limonene | 106% to 470% |
| 316847 | Amino Acids and Related Compounds | Amino Acids and Related Compounds | Arginine | 150% to 495% |
| 316847 | Amino Acids and Related Compounds | Amino Acids and Related Compounds | Histidine | 60% to 1985% |
| 316847 | Amino Acids and Related Compounds | Amino Acids and Related Compounds | Isoleucine | New |
| 316847 | Amino Acids and Related Compounds | Amino Acids and Related Compounds | Leucine | New |
| 316847 | Amino Acids and Related Compounds | Amino Acids and Related Compounds | Lysine | 60% to 295% |
| 316847 | Amino Acids and Related Compounds | Amino Acids and Related Compounds | Methionine | 385% to 525% |
| 316847 | Amino Acids and Related Compounds | Amino Acids and Related Compounds | Phenylalanine | New |
| 316847 | Amino Acids and Related Compounds | Amino Acids and Related Compounds | Threonine | 115% to 465% |
| 316847 | Amino Acids and Related Compounds | Amino Acids and Related Compounds | Tryptophan | New |
| 316847 | Amino Acids and Related Compounds | Amino Acids and Related Compounds | Tyrosine | New |
| 316847 | Amino Acids and Related Compounds | Amino Acids and Related Compounds | Valine | 345% to 1365% |
| 316847 | Esters | Esters | F1-U1.076 Fatty Acid Ester | 131% to 219% |
| 316847 | Esters | Esters | F1-U1.113 Fatty Acid Ester | 68% to 113% |
| 316847 | NA | NA | F1-U0.875 | New |
| 316847 | NA | NA | F1-U0.972 | New |
| 316847 | Sterols, Oxygenated Terpenes, and Other Isoprenoids | Prenylquinones | alpha-Tocopherol | 847% to 2226% |
| 316847 | Sterols, Oxygenated Terpenes, and Other Isoprenoids | Prenylquinones | alpha-Tocopherol hydroquinone | New |
| 316847 | Sterols, Oxygenated Terpenes, and Other Isoprenoids | Prenylquinones | beta-Tocopherol | New |
| 316847 | Sterols, Oxygenated Terpenes, and Other Isoprenoids | Terpenoids | Cycloartanol, 24-methylene- | 107% to 178% |
| 316847 | Sterols, Oxygenated Terpenes, and Other Isoprenoids | Terpenoids | Cycloartenol | 201% to 335% |
| 316847 | Sterols, Oxygenated Terpenes, and Other Isoprenoids | Terpenoids | F1-U1.136 Sterol | 89% to 148% |
| 316847 | Sterols, Oxygenated Terpenes, and Other Isoprenoids | Terpenoids | F1-U1.223 Sterol | 89% to 149% |
| 316847 | Sterols, Oxygenated Terpenes, and Other Isoprenoids | Terpenoids | Lophenol, 24-methylene- | New |
| 316847 | Sterols, Oxygenated Terpenes, and Other Isoprenoids | Terpenoids | Stigmasterol | 89% to 149% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316850

| Seq ID | Chemical Class | Biochemical Class | Compound Name | Modification |
|---|---|---|---|---|
| 316850 | Acids - Fatty Unsat | Fatty Acids and Related Waxes | 9-Octadecenoic acid | 60% to 76% |
| 316850 | Acids - Hydroxy Alpha | Acid Pathway | Citric acid | 68% to 113% |
| 316850 | Acids - Hydroxy Alpha | Carbohydrates | F3-U0.992 Sugar acid | New |
| 316850 | Amino Acids and Related Compounds | Amino Acids and Related Compounds | Asparagine | New |
| 316850 | Carbohydrates | Carbohydrates | F3-U0.872 Hexose | 60% to 91% |
| 316850 | Carbohydrates | Carbohydrates | F3-U1.113 Carbohydrate | 60% to 79% |
| 316850 | Carbohydrates | Carbohydrates | F3-U1.119 Carbohydrate | New |
| 316850 | Carbohydrates | Carbohydrates | F3-U1.183 Carbohydrate | New |
| 316850 | Carbohydrates | Carbohydrates | F3-U1.189 Carbohydrate | 300% to 500% |
| 316850 | Carbohydrates | Carbohydrates | F3-U1.194 Carbohydrate | 655% to 1091% |
| 316850 | Carbohydrates | Carbohydrates | Fructose | 155% to 339% |
| 316850 | Carbohydrates | Carbohydrates | Glucose | 86% to 300% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316857

| Seq ID | Chemical Class | Biochemical Class | Compound Name | Modification |
|---|---|---|---|---|
| 316857 | Acids - Fatty | Fatty Acids and Related Waxes | Hexadecanoic acid | 13% to 25% |
| 316857 | Acids - Fatty | Fatty Acids and Related Waxes | Octadecanoic acid | 22% to 49% |
| 316857 | Acids - Fatty Branched | Fatty Acids and Related Waxes | Hexadecanoic acid, 14-methyl- | -21% to -38% |
| 316857 | Acids - Fatty Unsat | Fatty Acids and Related Waxes | 9,12-Octadecadienoic acid | -35% to -48% |
| 316857 | Acids - Fatty Unsat | Fatty Acids and Related Waxes | 9-Hexadecenoic acid | -36% to -48% |
| 316857 | Acids - Fatty Unsat | Fatty Acids and Related Waxes | 9-Octadecenoic acid | 14% to 122% |
| 316857 | Amino Acids and Related Compounds | Amino Acids and Related Compounds | Leucine | New |
| 316857 | Amino Acids and Related Compounds | Amino Acids and Related Compounds | Phenylalanine | New |
| 316857 | Amino Acids and Related Compounds | Amino Acids and Related Compounds | Proline | 55% to 180% |
| 316857 | Amino Acids and Related Compounds | Amino Acids and Related Compounds | Threonine | 40% to 105% |
| 316857 | Amino Acids and Related Compounds | Amino Acids and Related Compounds | Tryptophan | New |
| 316857 | Amino Acids and Related Compounds | Amino Acids and Related Compounds | Tyrosine | New |
| 316857 | Amino Acids and Related Compounds | Amino Acids and Related Compounds | Valine | 295% to 510% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316860

| Seq ID | Chemical Class | Biochemical Class | Compound Name | Modification |
|---|---|---|---|---|
| 316860 | Acids | Acids | Carbamic acid | -60% to -96% |
| 316860 | Acids - Hydroxy Alpha | Carbohydrates | Quinic acid | 72% to 121% |
| 316860 | Carbohydrates | Carbohydrates | F3-U0.846 Carbohydrate | 258% to 429% |
| 316860 | Carbohydrates | Carbohydrates | F3-U0.872 Hexose | 396% to 660% |
| 316860 | Carbohydrates | Carbohydrates | F3-U0.952 Carbohydrate | 60% to 79% |
| 316860 | Carbohydrates | Carbohydrates | F3-U1.113 Carbohydrate | 73% to 122% |
| 316860 | Carbohydrates | Carbohydrates | F3-U1.150 Carbohydrate | 64% to 107% |
| 316860 | Carbohydrates | Carbohydrates | Fructose | 129% to 415% |
| 316860 | Carbohydrates | Carbohydrates | Galactose or Mannose | 200% to 333% |
| 316860 | Carbohydrates | Carbohydrates | Glucose | 105% to 451% |
| 316860 | NA | NA | F3-U0.602 | NQ |
| 316860 | NA | NA | F3-U1.253 | 60% to 100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316861

| Seq ID | Chemical Class | Biochemical Class | Compound Name | Modification |
|---|---|---|---|---|
| 316861 | Acids - Hydroxy Alpha | Acid Pathway | Citric acid | 87% to 145% |
| 316861 | Acids - Hydroxy Alpha | Carbohydrates | Quinic acid | -60% to -84% |
| 316861 | Carbohydrates | Carbohydrates | F3-U0.813 Carbohydrate | 192% to 319% |
| 316861 | Carbohydrates | Carbohydrates | F3-U0.821 Carbohydrate | 87% to 145% |
| 316861 | Carbohydrates | Carbohydrates | F3-U0.825 Carbohydrate | 120% to 200% |
| 316861 | Carbohydrates | Carbohydrates | F3-U0.846 Carbohydrate | 148% to 247% |
| 316861 | Carbohydrates | Carbohydrates | F3-U0.872 Hexose | 248% to 414% |
| 316861 | Carbohydrates | Carbohydrates | F3-U1.143 Carbohydrate | 60% to 85% |
| 316861 | Carbohydrates | Carbohydrates | F3-U1.189 Carbohydrate | 167% to 279% |
| 316861 | Carbohydrates | Carbohydrates | F3-U1.194 Carbohydrate | 239% to 398% |
| 316861 | Carbohydrates | Carbohydrates | Fructose | 711% to 1420% |
| 316861 | Carbohydrates | Carbohydrates | Glucose | 386% to 1693% |
| 316861 | NA | NA | F3-U0.843 | New |
| 316861 | NA | NA | F3-U0.852A | New |
| 316861 | NA | NA | F3-U0.882 | 162% to 270% |
| 316861 | NA | NA | F3-U1.253 | 60% to 89% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316870

| Seq ID | Chemical Class | Biochemical Class | Compound Name | Modification |
|---|---|---|---|---|
| 316870 | Alkenes and Alkynes | Terpenoids | Limonene | 106% to 176% |
| 316870 | Amino Acids and Related Compounds | Amino Acids and Related Compounds | Asparagine | New |
| 316870 | Amino Acids and Related Compounds | Amino Acids and Related Compounds | Glutamine | New |
| 316870 | Amino Acids and Related Compounds | Amino Acids and Related Compounds | Proline | 90% to 150% |
| 316870 | Carbohydrates | Carbohydrates | Arabinose or Xylose | New |
| 316870 | Carbohydrates | Carbohydrates | F3-U0.813 Carbohydrate | 66% to 110% |
| 316870 | Carbohydrates | Carbohydrates | F3-U0.825 Carbohydrate | 161% to 269% |
| 316870 | Carbohydrates | Carbohydrates | F3-U0.872 Hexose | 95% to 158% |
| 316870 | Carbohydrates | Carbohydrates | Fructose | 337% to 818% |
| 316870 | Carbohydrates | Carbohydrates | Galactose or Mannose | New |
| 316870 | Carbohydrates | Carbohydrates | Glucose | 199% to 787% |
| 316870 | Esters | Esters | F1-U1.119 Fatty Acid Ester | 99% to 165% |
| 316870 | NA | NA | F3-U0.882 | 372% to 620% |
| 316870 | NA | NA | F3-U1.253 | 60% to 84% |
| 316870 | Sterols, Oxygenated Terpenes, and Other Isoprenoids | Prenylquinones | alpha-Tocopherol | 63% to 106% |
| 316870 | Sterols, Oxygenated Terpenes, and Other Isoprenoids | Prenylquinones | alpha-Tocopherol hydroquinone | New |
| 316870 | Sterols, Oxygenated Terpenes, and Other Isoprenoids | Terpenoids | beta-Sitosterol | 96% to 160% |
| 316870 | Sterols, Oxygenated Terpenes, and Other Isoprenoids | Terpenoids | F1-U1.216 Sterol | 109% to 181% |
| 316870 | Sterols, Oxygenated Terpenes, and Other Isoprenoids | Prenylquinones | gamma-Tocopherol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316883

| Seq ID | Chemical Class | Biochemical Class | Compound Name | Modification |
|---|---|---|---|---|
| 316883 | Acids | Acids | Carbamic acid | 106% to 176% |
| 316883 | Acids - Fatty | Fatty Acids and Related Waxes | Eicosanoic acid | 60% to 225% |
| 316883 | Acids - Fatty Branched | Fatty Acids and Related Waxes | Hexadecanoic acid, 14-methyl- | -60% to -92% |
| 316883 | Acids - Fatty Unsat | Fatty Acids and Related Waxes | 9-Hexadecenoic acid | -60% to -86% |
| 316883 | Acids - Fatty Unsat | Fatty Acids and Related Waxes | 9-Octadecenoic acid | 60% to 456% |
| 316883 | Acids - Hydroxy Alpha | Carbohydrates | Quinic acid | 83% to 138% |
| 316883 | Alkenes and Alkynes | Terpenoids | Limonene | 182% to 3033% |
| 316883 | Carbohydrates | Carbohydrates | F3-U0.872 Hexose | 64% to 106% |
| 316883 | Carbohydrates | Carbohydrates | F3-U1.113 Carbohydrate | 71% to 119% |
| 316883 | Carbohydrates | Carbohydrates | F3-U1.189 Carbohydrate | 182% to 304% |
| 316883 | Carbohydrates | Carbohydrates | F3-U1.194 Carbohydrate | 177% to 295% |
| 316883 | Carbohydrates | Carbohydrates | F3-U1.241 Carbohydrate | 143% to 239% |
| 316883 | Carbohydrates | Carbohydrates | Fructose | 967% to 2127% |
| 316883 | Carbohydrates | Carbohydrates | Galactose or Mannose | New |
| 316883 | Carbohydrates | Carbohydrates | Glucose | 523% to 2698% |
| 316883 | Esters | Esters | F1-U1.065 Fatty Acid Ester | 181% to 302% |
| 316883 | Esters | Esters | F1-U1.076 Fatty Acid Ester | 145% to 241% |
| 316883 | Esters | Esters | F1-U1.119 Fatty Acid Ester | 139% to New |
| 316883 | Esters - Hydroxy | Acyl acetylglycerols | 2-Eicosanoyl-1-acetylglycerol | 383% to 6179% |
| 316883 | Esters - Hydroxy | Acyl acetylglycerols | 2-Octadecanoyl-1-acetylglycerol | New |
| 316883 | NA | NA | F3-U0.882 | 456% to 760% |
| 316883 | NA | NA | F3-U0.899 | 210% to 350% |
| 316883 | NA | NA | F3-U1.228 | 60% to 96% |
| 316883 | NA | NA | F3-U1.253 | 60% to 95% |
| 316883 | NA | NA | F3-U1.255 | 60% to 86% |
| 316883 | Sterols, Oxygenated Terpenes, and Other Isoprenoids | Prenylquinones | alpha-Tocopherol | 132% to 5068% |
| 316883 | Sterols, Oxygenated Terpenes, and Other Isoprenoids | Prenylquinones | alpha-Tocopherol hydroquinone | New |
| 316883 | Sterols, Oxygenated Terpenes, and Other Isoprenoids | Terpenoids | beta-Sitosterol | New |
| 316883 | Sterols, Oxygenated Terpenes, and Other Isoprenoids | Prenylquinones | beta-Tocopherol | New |
| 316883 | Sterols, Oxygenated Terpenes, and Other Isoprenoids | Terpenoids | Campesterol | New |
| 316883 | Sterols, Oxygenated Terpenes, and Other Isoprenoids | Terpenoids | Cholesterol | New |
| 316883 | Sterols, Oxygenated Terpenes, and Other Isoprenoids | Terpenoids | F1-U1.106 Sterol | -60% to -98% |
| 316883 | Sterols, Oxygenated Terpenes, and Other Isoprenoids | Terpenoids | F1-U1.122 Sterol | -60% to -80% |
| 316883 | Sterols, Oxygenated Terpenes, and Other Isoprenoids | Terpenoids | F1-U1.130 Sterol | -60% to -91% |
| 316883 | Sterols, Oxygenated Terpenes, and Other Isoprenoids | Terpenoids | Fucosterol | New |
| 316883 | Sterols, Oxygenated Terpenes, and Other Isoprenoids | Prenylquinones | gamma-Tocopherol | New |
| 316883 | Sterols, Oxygenated Terpenes, and Other Isoprenoids | Terpenoids | Stigmasta-5,22-dien-3-ol, acetate | -63% to -100% |
| 316883 | Sterols, Oxygenated Terpenes, and Other Isoprenoids | Terpenoids | Stigmasterol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316886

| Seq ID | Chemical Class | Biochemical Class | Compound Name | Modification |
|---|---|---|---|---|
| 316886 | Esters - Hydroxy | Acyl acetylglycerols | 2-Octadecanoyl-1-acetylglycerol | 213% to 355% |
| 316886 | Alkenes and Alkynes | Terpenoids | Limonene | 443% to 738% |
| 316886 | Amino Acids and Related Compounds | Amino Acids and Related Compounds | Arginine | 60% to 450% |
| 316886 | Amino Acids and Related Compounds | Amino Acids and Related Compounds | Cysteine | 60% to 460% |
| 316886 | Amino Acids and Related Compounds | Amino Acids and Related Compounds | Histidine | 475% to 1705% |
| 316886 | Amino Acids and Related Compounds | Amino Acids and Related Compounds | Isoleucine | New |
| 316886 | Amino Acids and Related Compounds | Amino Acids and Related Compounds | Leucine | New |
| 316886 | Amino Acids and Related Compounds | Amino Acids and Related Compounds | Phenylalanine | New |
| 316886 | Amino Acids and Related Compounds | Amino Acids and Related Compounds | Proline | 70% to 215% |
| 316886 | Amino Acids and Related Compounds | Amino Acids and Related Compounds | Threonine | 165% to 465% |
| 316886 | Amino Acids and Related Compounds | Amino Acids and Related Compounds | Tryptophan | New |
| 316886 | Amino Acids and Related Compounds | Amino Acids and Related Compounds | Tyrosine | New |
| 316886 | Amino Acids and Related Compounds | Amino Acids and Related Compounds | Valine | 415% to 990% |
| 316886 | Esters | Esters | F1-U1.076 Fatty Acid Ester | 211% to 351% |
| 316886 | Esters | Esters | F1-U1.113 Fatty Acid Ester | 308% to 513% |
| 316886 | Esters | Esters | F1-U1.121 Fatty Acid Ester | 164% to 273% |
| 316886 | NA | NA | F1-U1.119 | 204% to 340% |
| 316886 | Sterols, Oxygenated Terpenes, and Other Isoprenoids | Prenylquinones | alpha-Tocopherol | 628% to 1047% |
| 316886 | Sterols, Oxygenated Terpenes, and Other Isoprenoids | Prenylquinones | alpha-Tocopherol hydroquinone | New |
| 316886 | Sterols, Oxygenated Terpenes, and Other Isoprenoids | Terpenoids | beta-Sitosterol | 189% to 315% |
| 316886 | Sterols, Oxygenated Terpenes, and Other Isoprenoids | Prenylquinones | beta-Tocopherol | New |
| 316886 | Sterols, Oxygenated Terpenes, and Other Isoprenoids | Terpenoids | Campesterol | 88% to 147% |
| 316886 | Sterols, Oxygenated Terpenes, and Other Isoprenoids | Terpenoids | Cycloartenol | 146% to 244% |
| 316886 | Sterols, Oxygenated Terpenes, and Other Isoprenoids | Prenylquinones | F1-U1.106 Sterol | New |
| 316886 | Sterols, Oxygenated Terpenes, and Other Isoprenoids | Terpenoids | F1-U1.129 beta-Tocopherol Isomer | 138% to 230% |
| 316886 | Sterols, Oxygenated Terpenes, and Other Isoprenoids | Terpenoids | F1-U1.136 Sterol | 60% to 85% |
| 316886 | Sterols, Oxygenated Terpenes, and Other Isoprenoids | Terpenoids | F1-U1.216 Sterol | New |
| 316886 | Sterols, Oxygenated Terpenes, and Other Isoprenoids | Terpenoids | Stigmasterol | 172% to 287% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316902

| Seq ID | Chemical Class | Biochemical Class | Compound Name | Modification |
|---|---|---|---|---|
| 316902 | Amino Acids and Related Compounds | Amino Acids and Related Compounds | Asparagine | New |
| 316902 | Carbohydrates | Carbohydrates | Arabinose or Xylose | 155% to 259% |
| 316902 | Carbohydrates | Carbohydrates | F3-U0.825 Carbohydrate | 177% to 295% |
| 316902 | Carbohydrates | Carbohydrates | F3-U0.848 Carbohydrate | 273% to 455% |
| 316902 | Carbohydrates | Carbohydrates | F3-U0.872 Hexose | 95% to 158% |
| 316902 | Carbohydrates | Carbohydrates | F3-U0.956 Carbohydrate | New |
| 316902 | Carbohydrates | Carbohydrates | F3-U1.110 Carbohydrate | New |
| 316902 | Carbohydrates | Carbohydrates | F3-U1.113 Carbohydrate | 161% to 269% |
| 316902 | Carbohydrates | Carbohydrates | F3-U1.143 Carbohydrate | 60% to 92% |
| 316902 | Carbohydrates | Carbohydrates | F3-U1.148 Carbohydrate | 2710% to 4516% |
| 316902 | Carbohydrates | Carbohydrates | F3-U1.189 Carbohydrate | 180% to 300% |
| 316902 | Carbohydrates | Carbohydrates | F3-U1.194 Carbohydrate | 362% to 603% |
| 316902 | Carbohydrates | Carbohydrates | F3-U1.241 Carbohydrate | 416% to 693% |
| 316902 | Carbohydrates | Carbohydrates | Fructose | 1357% to 3557% |
| 316902 | Carbohydrates | Carbohydrates | Galactose or Mannose | New |
| 316902 | Carbohydrates | Carbohydrates | Glucose | 536% to 3741% |
| 316902 | NA | NA | F3-U0.882 | 3969% to 6615% |
| 316902 | NA | NA | F3-U0.899 | 180% to 300% |
| 316902 | NA | NA | F3-U1.228 | 60% to 97% |
| 316902 | NA | NA | F3-U1.232B | 838% to 1396% |
| 316902 | NA | NA | F3-U1.253 | 141% to 235% |
| 316902 | NA | NA | F3-U1.255 | 104% to 173% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316903

| Seq ID | Chemical Class | Biochemical Class | Compound Name | Modification |
|---|---|---|---|---|
| 316903 | Acids | Acids | Carbamic acid | 146% to 244% |
| 316903 | Acids - Fatty Unsat | Fatty Acids and Related Waxes | 7,10-Hexadecadienoic acid | -60% to -85% |
| 316903 | Acids - Fatty Unsat | Fatty Acids and Related Waxes | 9-Octadecenoic acid | -60% to -77% |
| 316903 | Acids - Hydroxy Alpha | Acid Pathway | Citric acid | 181% to 302% |
| 316903 | Acids - Hydroxy Alpha | Carbohydrates | F3-U0.992 Sugar acid | New |
| 316903 | Acids - Hydroxy Alpha | Acid Pathway | Malic acid | 140% to 234% |
| 316903 | Amino Acids and Related Compounds | Amino Acids and Related Compounds | Asparagine | 463% to 6225% |
| 316903 | Amino Acids and Related Compounds | Amino Acids and Related Compounds | Glutamine | New |
| 316903 | Amino Acids and Related Compounds | Amino Acids and Related Compounds | Proline | NQ |
| 316903 | Amino Acids and Related Compounds | Amino Acids and Related Compounds | Tyrosine | New |
| 316903 | Carbohydrates | Carbohydrates | Arabinose or Xylose | New |
| 316903 | Carbohydrates | Carbohydrates | F3-U0.813 Carbohydrate | 111% to 1316% |
| 316903 | Carbohydrates | Carbohydrates | F3-U0.816 Carbohydrate | 140% to 233% |
| 316903 | Carbohydrates | Carbohydrates | F3-U0.821 Carbohydrate | 181% to 302% |
| 316903 | Carbohydrates | Carbohydrates | F3-U0.825 Carbohydrate | 65% to 420% |
| 316903 | Carbohydrates | Carbohydrates | F3-U0.846 Carbohydrate | 328% to 546% |
| 316903 | Carbohydrates | Carbohydrates | F3-U0.848 Carbohydrate | 155% to 258% |
| 316903 | Carbohydrates | Carbohydrates | F3-U0.872 Hexose | 80% to 782% |
| 316903 | Carbohydrates | Carbohydrates | F3-U0.956 Carbohydrate | 230% to 384% |
| 316903 | Carbohydrates | Carbohydrates | F3-U1.104 Carbohydrate | New |
| 316903 | Carbohydrates | Carbohydrates | F3-U1.113 Carbohydrate | 83% to 139% |
| 316903 | Carbohydrates | Carbohydrates | F3-U1.150 Carbohydrate | 60% to 94% |
| 316903 | Carbohydrates | Carbohydrates | F3-U1.189 Carbohydrate | 362% to 604% |
| 316903 | Carbohydrates | Carbohydrates | F3-U1.194 Carbohydrate | 716% to 1193% |
| 316903 | Carbohydrates | Carbohydrates | Fructose | 322% to 2233% |
| 316903 | Carbohydrates | Carbohydrates | Galactose or Mannose | New |
| 316903 | Carbohydrates | Carbohydrates | Glucose | New |
| 316903 | NA | NA | F3-U0.736 | New |
| 316903 | NA | NA | F3-U0.852A | New |
| 316903 | NA | NA | F3-U0.882 | 274% to 476% |
| 316903 | NA | NA | F3-U1.229 | 60% to 93% |
| 316903 | NA | NA | F3-U1.253 | 77% to 150% |
| 316903 | NA | NA | F3-U1.255 | 62% to 104% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316906

| Seq ID | Chemical Class | Biochemical Class | Compound Name | Modification |
|---|---|---|---|---|
| 316906 | Acids | Acids | Carbamic acid | NQ |
| 316906 | Amino Acids and Related Compounds | Amino Acids and Related Compounds | Proline, 5-oxo- | -60% to -76% |
| 316906 | Carbohydrates | Carbohydrates | F3-U0.846 Carbohydrate | 165% to 275% |
| 316906 | Carbohydrates | Carbohydrates | F3-U0.872 Hexose | 295% to 491% |
| 316906 | Carbohydrates | Carbohydrates | F3-U1.113 Carbohydrate | 77% to 129% |
| 316906 | Carbohydrates | Carbohydrates | F3-U1.189 Carbohydrate | 60% to 92% |
| 316906 | Carbohydrates | Carbohydrates | Fructose | 138% to 449% |
| 316906 | Carbohydrates | Carbohydrates | Galactose or Mannose | 130% to 216% |
| 316906 | Carbohydrates | Carbohydrates | Glucose | 94% to 444% |
| 316906 | NA | NA | F3-U0.602 | NQ |
| 316906 | NA | NA | F3-U1.228 | New |
| 316906 | NA | NA | F3-U1.253 | 60% to 93% |
| 316906 | NA | NA | F3-U1.255 | 97% to 161% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316924

| Seq ID | Chemical Class | Biochemical Class | Compound Name | Modification |
|---|---|---|---|---|
| 316924 | Alkenes and Alkynes | Terpenoids | Limonene | 309% to 604% |
| 316924 | Amino Acids and Related Compounds | Amino Acids and Related Compounds | Cysteine | 180% to 975% |
| 316924 | Amino Acids and Related Compounds | Amino Acids and Related Compounds | Glutamic acid | 60% to 80% |
| 316924 | Amino Acids and Related Compounds | Amino Acids and Related Compounds | Histidine | 285% to 1105% |
| 316924 | Amino Acids and Related Compounds | Amino Acids and Related Compounds | Isoleucine | New |
| 316924 | Amino Acids and Related Compounds | Amino Acids and Related Compounds | Leucine | New |
| 316924 | Amino Acids and Related Compounds | Amino Acids and Related Compounds | Phenylalanine | New |
| 316924 | Amino Acids and Related Compounds | Amino Acids and Related Compounds | Proline | 115% to 290% |
| 316924 | Amino Acids and Related Compounds | Amino Acids and Related Compounds | Threonine | 210% to 570% |
| 316924 | Amino Acids and Related Compounds | Amino Acids and Related Compounds | Tryptophan | New |
| 316924 | Amino Acids and Related Compounds | Amino Acids and Related Compounds | Tyrosine | New |
| 316924 | Amino Acids and Related Compounds | Amino Acids and Related Compounds | Valine | 820% to 1850% |
| 316924 | Esters | Esters | F1-U1.076 Fatty Acid Ester | 83% to 258% |
| 316924 | Esters | Esters | F1-U1.121 Fatty Acid Ester | 60% to 222% |
| 316924 | Esters - Hydroxy | Acyl acetylglycerols | 2-Eicosanoyl-1-acetylglycerol | 70% to 175% |
| 316924 | Esters - Hydroxy | Acyl acetylglycerols | 2-Octadecanoyl-1-acetylglycerol | 70% to 117% |
| 316924 | Hydrocarbons | Hydrocarbons | Triacontane, 2-methyl- | 60% to 97% |
| 316924 | NA | NA | F1-U1.241 | New |
| 316924 | Sterols, Oxygenated Terpenes, and Other Isoprenoids | Prenylquinones | alpha-Tocopherol hydroquinone | 615% to 7618% |
| 316924 | Sterols, Oxygenated Terpenes, and Other Isoprenoids | Terpenoids | beta-Sitosterol | 138% to 231% |
| 316924 | Sterols, Oxygenated Terpenes, and Other Isoprenoids | Prenylquinones | beta-Tocopherol | New |
| 316924 | Sterols, Oxygenated Terpenes, and Other Isoprenoids | Terpenoids | Campesterol | 67% to 111% |
| 316924 | Sterols, Oxygenated Terpenes, and Other Isoprenoids | Terpenoids | Cycloartanol, 24-methylene- | New |
| 316924 | Sterols, Oxygenated Terpenes, and Other Isoprenoids | Terpenoids | Cycloartenol | 338% to 563% |
| 316924 | Sterols, Oxygenated Terpenes, and Other Isoprenoids | Terpenoids | F1-U1.106 Sterol | New |
| 316924 | Sterols, Oxygenated Terpenes, and Other Isoprenoids | Terpenoids | F1-U1.130 Sterol | New |
| 316924 | Sterols, Oxygenated Terpenes, and Other Isoprenoids | Prenylquinones | F1-U1.179 alpha-Tocopherol Isomer | 79% to 131% |
| 316924 | Sterols, Oxygenated Terpenes, and Other Isoprenoids | Terpenoids | F1-U1.200 Sterol | New |
| 316924 | Sterols, Oxygenated Terpenes, and Other Isoprenoids | Terpenoids | Stigmasta-5,22-dien-3-ol, acetate | 60% to 78% |
| 316924 | Sterols, Oxygenated Terpenes, and Other Isoprenoids | Terpenoids | Stigmasterol | 184% to 307% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#316934

| Seq ID | Chemical Class | Biochemical Class | Compound Name | Modification |
|---|---|---|---|---|
| 316934 | Acids - Hydroxy Alpha | Acid Pathway | Butanoic acid, 2,3,4-trihydroxy- | NQ |
| 316934 | Acids | Acids | Carbamic acid | 73% to 122% |
| 316934 | Acids - Hydroxy Alpha | Acid Pathway | Citric acid | 114% to 888% |
| 316934 | Acids - Hydroxy Alpha | Carbohydrates | F3-U0.992 Sugar acid | New |
| 316934 | Acids - Hydroxy Alpha | Acid Pathway | Malic acid | -60% to -88% |
| 316934 | Acids - Hydroxy Alpha | Carbohydrates | Quinic acid | -52% to -10% |
| 316934 | Alkenes and Alkynes | Terpenoids | Limonene | 205% to 342% |
| 316934 | Amino Acids and Related Compounds | Amino Acids and Related Compounds | Asparagine | New |
| 316934 | Amino Acids and Related Compounds | Amino Acids and Related Compounds | Glutamic acid | 80% to 100% |
| 316934 | Amino Acids and Related Compounds | Amino Acids and Related Compounds | Glutamine | New |
| 316934 | Amino Acids and Related Compounds | Amino Acids and Related Compounds | Proline | New |
| 316934 | Carbohydrates | Carbohydrates | F3-U0.781 Carbohydrate | 400% to 567% |
| 316934 | Carbohydrates | Carbohydrates | F3-U0.813 Carbohydrate | 114% to 190% |
| 316934 | Carbohydrates | Carbohydrates | F3-U0.821 Carbohydrate | 222% to 370% |
| 316934 | Carbohydrates | Carbohydrates | F3-U0.825 Carbohydrate | 136% to 227% |
| 316934 | Carbohydrates | Carbohydrates | F3-U0.846 Carbohydrate | 137% to 228% |
| 316934 | Carbohydrates | Carbohydrates | F3-U0.848 Carbohydrate | 289% to 481% |
| 316934 | Carbohydrates | Carbohydrates | F3-U0.872 Hexose | New |
| 316934 | Carbohydrates | Carbohydrates | F3-U1.037 Carbohydrate | 91% to 151% |
| 316934 | Carbohydrates | Carbohydrates | F3-U1.049B Carbohydrate | 60% to 91% |
| 316934 | Carbohydrates | Carbohydrates | F3-U1.113 Carbohydrate | 73% to 627% |
| 316934 | Carbohydrates | Carbohydrates | F3-U1.143 Carbohydrate | 235% to 392% |
| 316934 | Carbohydrates | Carbohydrates | F3-U1.150 Carbohydrate | New |
| 316934 | Carbohydrates | Carbohydrates | F3-U1.189 Carbohydrate | New |
| 316934 | Carbohydrates | Carbohydrates | F3-U1.194 Carbohydrate | New |
| 316934 | Carbohydrates | Carbohydrates | F3-U1.208 Carbohydrate | 1089% to 2532% |
| 316934 | Carbohydrates | Carbohydrates | Fructose | -60% to -76% |
| 316934 | Carbohydrates | Carbohydrates | Galactose or Mannose | 144% to 250% |
| 316934 | Carbohydrates | Carbohydrates | Glucose | 60% to 88% |
| 316934 | Esters | Esters | F1-U1.076 Fatty Acid Ester | 60% to 79% |
| 316934 | Esters | Esters | F1-U1.113 Fatty Acid Ester | 80% to 352% |
| 316934 | Esters | Esters | F1-U1.119 Fatty Acid Ester | 130% to 265% |
| 316934 | Esters | Esters | F1-U1.121 Fatty Acid Ester | 60% to 194% |
| 316934 | Esters - Hydroxy | Acyl acetylglycerols | 2-Eicosanoyl-1-acetylglycerol | 63% to 105% |
| 316934 | Esters - Hydroxy | Acyl acetylglycerols | 2-Octadecanoyl-1-acetylglycerol | 60% to 94% |
| 316934 | Hydrocarbons | Hydrocarbons | Isononacosane | New |
| 316934 | Hydrocarbons | Hydrocarbons | Nonacosane, 3-methyl- | New |
| 316934 | NA | NA | F1-U0.972 | 327% to 546% |
| 316934 | NA | NA | F5-U0.799 | New |
| 316934 | NA | NA | F5-U0.852A | 60% to 79% |
| 316934 | NA | NA | F5-U0.882 | New |
| 316934 | NA | NA | F5-U1.124 | 89% to 183% |
| 316934 | NA | NA | F5-U1.229 | 65% to 110% |
| 316934 | NA | NA | F5-U1.232B | 104% to 173% |
| 316934 | NA | NA | F5-U1.253 | 157% to 494% |
| 316934 | NA | NA | F5-U1.255 | New |
| 316934 | Phenols and Related Compounds | Phenylpropanes and Derivatives | Caffeic acid | 63% to 560% |
| 316934 | Sterols, Oxygenated Terpenes, and Other Isoprenoids | Prenylquinones | alpha-Tocopherol | New |
| 316934 | Sterols, Oxygenated Terpenes, and Other Isoprenoids | Prenylquinones | alpha-Tocopherol hydroquinone | 136% to 227% |
| 316934 | Sterols, Oxygenated Terpenes, and Other Isoprenoids | Terpenoids | beta-Sitosterol | 135% to 224% |
| 316934 | Sterols, Oxygenated Terpenes, and Other Isoprenoids | Terpenoids | beta-Tocopherol | New |
| 316934 | Sterols, Oxygenated Terpenes, and Other Isoprenoids | Terpenoids | Campesterol | 81% to 174% |
| 316934 | Sterols, Oxygenated Terpenes, and Other Isoprenoids | Terpenoids | Cholesterol | New |
| 316934 | Sterols, Oxygenated Terpenes, and Other Isoprenoids | Terpenoids | Cycloartanol, 24-methylene- | New |
| 316934 | Sterols, Oxygenated Terpenes, and Other Isoprenoids | Terpenoids | Cycloartenol | 60% to 78% |
| 316934 | Sterols, Oxygenated Terpenes, and Other Isoprenoids | Terpenoids | Ergosta-8,24(28)-dien-3-ol, 4,14-dimethyl- | 323% to 538% |
| 316934 | Sterols, Oxygenated Terpenes, and Other Isoprenoids | Terpenoids | F1-U1.106 Sterol | 101% to 169% |
| 316934 | Sterols, Oxygenated Terpenes, and Other Isoprenoids | Terpenoids | F1-U1.130 Sterol | 184% to 306% |
| 316934 | Sterols, Oxygenated Terpenes, and Other Isoprenoids | Terpenoids | F1-U1.138 Sterol | New |
| 316934 | Sterols, Oxygenated Terpenes, and Other Isoprenoids | Terpenoids | F1-U1.216 Sterol | 95% to 160% |
| 316934 | Sterols, Oxygenated Terpenes, and Other Isoprenoids | Terpenoids | F1-U1.217 Sterol | 60% to 483% |
| 316934 | Sterols, Oxygenated Terpenes, and Other Isoprenoids | Terpenoids | Fucosterol | |
| 316934 | Sterols, Oxygenated Terpenes, and Other Isoprenoids | Prenylquinones | gamma-Tocopherol | |
| 316934 | Sterols, Oxygenated Terpenes, and Other Isoprenoids | Terpenoids | Stigmasta-5,22-dien-3-ol, acetate | |
| 316934 | Sterols, Oxygenated Terpenes, and Other Isoprenoids | Terpenoids | Stigmasterol | |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316938

| Seq ID | Chemical Class | Biochemical Class | Compound Name | Modification |
|---|---|---|---|---|
| 316938 | Acids - Fatty | Fatty Acids and Related Waxes | Octadecanoic acid | 60% to 91% |
| 316938 | Acids - Fatty Branched | Fatty Acids and Related Waxes | Heptadecanoic acid, 16-methyl- | 60% to 110% |
| 316938 | Acids - Fatty Unsat | Fatty Acids and Related Waxes | 9-Octadecenoic acid | 60% to 133% |
| 316938 | Alkenes and Alkynes | Terpenoids | Limonene | 162% to 269% |
| 316938 | Esters | Esters | F1-U1.076 Fatty Acid Ester | 293% to 489% |
| 316938 | Esters | Esters | F1-U1.113 Fatty Acid Ester | 352% to 586% |
| 316938 | Esters | Esters | F1-U1.121 Fatty Acid Ester | 199% to 331% |
| 316938 | Esters - Hydroxy | Acyl acetylglycerols | 2-Octadecanoyl-1-acetylglycerol | 219% to 364% |
| 316938 | NA | NA | F1-U0.972 | New |
| 316938 | NA | NA | F1-U1.119 | 192% to 320% |
| 316938 | NA | NA | F1-U1.241 | New |
| 316938 | Sterols, Oxygenated Terpenes, and Other Isoprenoids | Prenylquinones | alpha-Tocopherol | 1358% to 2264% |
| 316938 | Sterols, Oxygenated Terpenes, and Other Isoprenoids | Prenylquinones | alpha-Tocopherol hydroquinone | New |
| 316938 | Sterols, Oxygenated Terpenes, and Other Isoprenoids | Terpenoids | Cycloartenol | 1245% to 2075% |
| 316938 | Sterols, Oxygenated Terpenes, and Other Isoprenoids | Terpenoids | Ergosta-8,24(28)-dien-3-ol, 4,14-dimethyl- | New |
| 316938 | Sterols, Oxygenated Terpenes, and Other Isoprenoids | Terpenoids | F1-U1.106 Sterol | New |
| 316938 | Sterols, Oxygenated Terpenes, and Other Isoprenoids | Terpenoids | Fucosterol | 80% to 133% |
| 316938 | Sterols, Oxygenated Terpenes, and Other Isoprenoids | Prenylquinones | gamma-Tocopherol | New |
| 316938 | Sterols, Oxygenated Terpenes, and Other Isoprenoids | Terpenoids | Stigmasterol | 73% to 122% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316941

| Seq ID | Chemical Class | Biochemical Class | Compound Name | Modification |
|---|---|---|---|---|
| 316941 | Acids - Fatty | Fatty Acids and Related Waxes | Eicosanoic acid | 104% to 626% |
| 316941 | Acids - Fatty | Fatty Acids and Related Waxes | Octadecanoic acid | 60% to 110% |
| 316941 | Acids - Fatty Branched | Fatty Acids and Related Waxes | Heptadecanoic acid, 16-methyl- | 60% to 261% |
| 316941 | Amino Acids and Related Compounds | Amino Acids and Related Compounds | Histidine | 295% to 1130% |
| 316941 | Amino Acids and Related Compounds | Amino Acids and Related Compounds | Isoleucine | New |
| 316941 | Amino Acids and Related Compounds | Amino Acids and Related Compounds | Leucine | New |
| 316941 | Amino Acids and Related Compounds | Amino Acids and Related Compounds | Phenylalanine | New |
| 316941 | Amino Acids and Related Compounds | Amino Acids and Related Compounds | Proline | 60% to 170% |
| 316941 | Amino Acids and Related Compounds | Amino Acids and Related Compounds | Proline, 5-oxo- | -60% to -80% |
| 316941 | Amino Acids and Related Compounds | Amino Acids and Related Compounds | Threonine | 130% to 390% |
| 316941 | Amino Acids and Related Compounds | Amino Acids and Related Compounds | Tryptophan | New |
| 316941 | Amino Acids and Related Compounds | Amino Acids and Related Compounds | Tyrosine | New |
| 316941 | Amino Acids and Related Compounds | Amino Acids and Related Compounds | Valine | 900% to 2015% |
| 316941 | Esters | Esters | F1-U1.076 Fatty Acid Ester | 115% to 788% |
| 316941 | Esters | Esters | F1-U1.078 Fatty Acid Ester | New |
| 316941 | Esters | Esters | F1-U1.113 Fatty Acid Ester | 1899% to 3165% |
| 316941 | Esters | Esters | F1-U1.119 Fatty Acid Ester | New |
| 316941 | Esters | Esters | F1-U1.121 Fatty Acid Ester | 159% to 265% |
| 316941 | Esters - Hydroxy | Acyl acetylglycerols | 2-Eicosanoyl-1-acetylglycerol | 128% to 214% |
| 316941 | Esters - Hydroxy | Acyl acetylglycerols | 2-Octadecanoyl-1-acetylglycerol | 75% to 1403% |
| 316941 | NA | NA | F1-U1.119 | New |
| 316941 | Sterols, Oxygenated Terpenes, and Other Isoprenoids | Prenylquinones | alpha-Tocopherol | 3656% to 6094% |
| 316941 | Sterols, Oxygenated Terpenes, and Other Isoprenoids | Prenylquinones | alpha-Tocopherol hydroquinone | New |
| 316941 | Sterols, Oxygenated Terpenes, and Other Isoprenoids | Terpenoids | beta-Sitosterol | 94% to 157% |
| 316941 | Sterols, Oxygenated Terpenes, and Other Isoprenoids | Prenylquinones | beta-Tocopherol | New |
| 316941 | Sterols, Oxygenated Terpenes, and Other Isoprenoids | Terpenoids | Campesterol | 60% to 144% |
| 316941 | Sterols, Oxygenated Terpenes, and Other Isoprenoids | Terpenoids | Cholesterol | 60% to 253% |
| 316941 | Sterols, Oxygenated Terpenes, and Other Isoprenoids | Terpenoids | Cycloartenol | 60% to 81% |
| 316941 | Sterols, Oxygenated Terpenes, and Other Isoprenoids | Terpenoids | Ergosta-5,24-dien-3-ol | New |
| 316941 | Sterols, Oxygenated Terpenes, and Other Isoprenoids | Terpenoids | F1-U1.106 Sterol | 62% to 103% |
| 316941 | Sterols, Oxygenated Terpenes, and Other Isoprenoids | Prenylquinones | F1-U1.129 beta-Tocopherol Isomer | New |
| 316941 | Sterols, Oxygenated Terpenes, and Other Isoprenoids | Terpenoids | F1-U1.130 Sterol | 60% to 94% |
| 316941 | Sterols, Oxygenated Terpenes, and Other Isoprenoids | Terpenoids | F1-U1.135 Sterol | 60% to 253% |
| 316941 | Sterols, Oxygenated Terpenes, and Other Isoprenoids | Prenylquinones | F1-U1.174 alpha-Tocopherol Isomer | 75% to 125% |
| 316941 | Sterols, Oxygenated Terpenes, and Other Isoprenoids | Prenylquinones | F1-U1.174 alpha-Tocopherol Isomer | New |
| 316941 | Sterols, Oxygenated Terpenes, and Other Isoprenoids | Prenylquinones | F1-U1.179 alpha-Tocopherol Isomer | 60% to 76% |
| 316941 | Sterols, Oxygenated Terpenes, and Other Isoprenoids | Terpenoids | F1-U1.223 Sterol | 164% to 273% |
| 316941 | Sterols, Oxygenated Terpenes, and Other Isoprenoids | Terpenoids | Stigmasterol | 87% to 194% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316944

| Seq ID | Chemical Class | Biochemical Class | Compound Name | Modification |
|---|---|---|---|---|
| 316944 | Acids | Acids | Carbamic acid | 93% to 155% |
| 316944 | Acids - Hydroxy Alpha | Acid Pathway | Citric acid | 451% to 751% |
| 316944 | Acids - Hydroxy Alpha | Carbohydrates | F3-U0.992 Sugar acid | New |
| 316944 | Acids - Hydroxy Alpha | Acid Pathway | Malic acid | 302% to 504% |
| 316944 | Alkenes and Alkynes | Terpenoids | Limonene | 106% to 177% |
| 316944 | Amino Acids and Related Compounds | Amino Acids and Related Compounds | Asparagine | New |
| 316944 | Amino Acids and Related Compounds | Amino Acids and Related Compounds | Proline | New |
| 316944 | Amino Acids and Related Compounds | Amino Acids and Related Compounds | Proline, 5-oxo- | 74% to 123% |
| 316944 | Carbohydrates | Carbohydrates | F3-U0.813 Carbohydrate | 526% to 877% |
| 316944 | Carbohydrates | Carbohydrates | F3-U0.816 Carbohydrate | 436% to 726% |
| 316944 | Carbohydrates | Carbohydrates | F3-U0.846 Carbohydrate | 92% to 153% |
| 316944 | Carbohydrates | Carbohydrates | F3-U0.848 Carbohydrate | 141% to 235% |
| 316944 | Carbohydrates | Carbohydrates | F3-U0.872 Hexose | 177% to 296% |
| 316944 | Carbohydrates | Carbohydrates | F3-U1.039 Carbohydrate | New |
| 316944 | Carbohydrates | Carbohydrates | F3-U1.143 Carbohydrate | 79% to 132% |
| 316944 | Carbohydrates | Carbohydrates | F3-U1.150 Carbohydrate | 90% to 151% |
| 316944 | Carbohydrates | Carbohydrates | F3-U1.189 Carbohydrate | 573% to 954% |
| 316944 | Carbohydrates | Carbohydrates | F3-U1.194 Carbohydrate | 1234% to 2057% |
| 316944 | Carbohydrates | Carbohydrates | Fructose | 254% to 484% |
| 316944 | Carbohydrates | Carbohydrates | Glucose | 99% to 300% |
| 316944 | Esters | Esters | F1-U1.076 Fatty Acid Ester | 117% to 195% |
| 316944 | Esters | Esters | F1-U1.113 Fatty Acid Ester | New |
| 316944 | Esters | Esters | F1-U1.121 Fatty Acid Ester | 61% to 101% |
| 316944 | Esters - Hydroxy | Acyl acetylglycerols | 2-Octadecanoyl-1-acetylglycerol | New |
| 316944 | NA | NA | F1-U0.991 | New |
| 316944 | NA | NA | F3-U0.602 | 1148% to 1913% |
| 316944 | NA | NA | F3-U0.678 | New |
| 316944 | NA | NA | F3-U0.736 | New |
| 316944 | NA | NA | F3-U0.852A | New |
| 316944 | NA | NA | F3-U1.229 | 85% to 142% |
| 316944 | NA | NA | F3-U1.253 | 227% to 378% |
| 316944 | NA | NA | F3-U1.255 | 209% to 348% |
| 316944 | Phenols and Related Compounds | Phenylpropanes and Derivatives | Caffeic acid | 110% to 183% |
| 316944 | Phenols and Related Compounds | Phenylpropanes and Derivatives | Chlorogenic acid | 160% to 266% |
| 316944 | Sterols, Oxygenated Terpenes, and Other Isoprenoids | Prenylquinones | alpha-Tocopherol | 157% to 261% |
| 316944 | Sterols, Oxygenated Terpenes, and Other Isoprenoids | Terpenoids | Campesterol | New |
| 316944 | Sterols, Oxygenated Terpenes, and Other Isoprenoids | Terpenoids | Cholesterol | New |
| 316944 | Sterols, Oxygenated Terpenes, and Other Isoprenoids | Terpenoids | Cycloartenol | New |
| 316944 | Sterols, Oxygenated Terpenes, and Other Isoprenoids | Prenylquinones | gamma-Tocopherol | New |
| 316944 | Sterols, Oxygenated Terpenes, and Other Isoprenoids | Terpenoids | Stigmasterol | New |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#316947

| Seq ID | Chemical Class | Biochemical Class | Compound Name | Modification |
|---|---|---|---|---|
| 316947 | Acids - Hydroxy Alpha | Acid Pathway | Citric acid | 107% to 179% |
| 316947 | Acids - Hydroxy Alpha | Carbohydrates | F3-U0.992 Sugar acid | New |
| 316947 | Acids - Hydroxy Alpha | Acid Pathway | Malic acid | 124% to 207% |
| 316947 | Alcohols | Carbohydrates | Inositol | 60% to 85% |
| 316947 | Alkenes and Alkynes | Terpenoids | Limonene | 291% to 484% |
| 316947 | Amino Acids and Related Compounds | Amino Acids and Related Compounds | Asparagine | 425% to 708% |
| 316947 | Amino Acids and Related Compounds | Amino Acids and Related Compounds | Proline, 5-oxo- | 60% to 98% |
| 316947 | Carbohydrates | Carbohydrates | Arabinose or Xylose | 129% to 214% |
| 316947 | Carbohydrates | Carbohydrates | F3-U0.813 Carbohydrate | 1310% to 2183% |
| 316947 | Carbohydrates | Carbohydrates | F3-U0.816 Carbohydrate | 226% to 377% |
| 316947 | Carbohydrates | Carbohydrates | F3-U0.821 Carbohydrate | 107% to 179% |
| 316947 | Carbohydrates | Carbohydrates | F3-U0.825 Carbohydrate | 247% to 412% |
| 316947 | Carbohydrates | Carbohydrates | F3-U0.846 Carbohydrate | 397% to 661% |
| 316947 | Carbohydrates | Carbohydrates | F3-U0.848 Carbohydrate | 110% to 184% |
| 316947 | Carbohydrates | Carbohydrates | F3-U0.872 Hexose | 575% to 959% |
| 316947 | Carbohydrates | Carbohydrates | F3-U0.956 Carbohydrate | 537% to 894% |
| 316947 | Carbohydrates | Carbohydrates | F3-U1.104 Carbohydrate | New |
| 316947 | Carbohydrates | Carbohydrates | F3-U1.113 Carbohydrate | 316% to 526% |
| 316947 | Carbohydrates | Carbohydrates | F3-U1.148 Carbohydrate | 194% to 323% |
| 316947 | Carbohydrates | Carbohydrates | F3-U1.189 Carbohydrate | 763% to 1271% |
| 316947 | Carbohydrates | Carbohydrates | F3-U1.194 Carbohydrate | New |
| 316947 | Carbohydrates | Carbohydrates | Fructose | 1163% to 3093% |
| 316947 | Carbohydrates | Carbohydrates | Galactose or Mannose | New |
| 316947 | Carbohydrates | Carbohydrates | Glucose | 591% to 3660% |
| 316947 | Esters | Esters | F1-U1.076 Fatty Acid Ester | 475% to 792% |
| 316947 | Esters | Esters | F1-U1.078 Fatty Acid Ester | 116% to 193% |
| 316947 | Esters | Esters | F1-U1.121 Fatty Acid Ester | 592% to 986% |
| 316947 | Esters - Hydroxy | Acyl acetylglycerols | 2-Eicosanoyl-1-acetylglycerol | 1309% to 2182% |
| 316947 | Esters - Hydroxy | Acyl acetylglycerols | 2-Octadecanoyl-1-acetylglycerol | 585% to 975% |
| 316947 | NA | NA | F1-U1.119 | 421% to 701% |
| 316947 | NA | NA | F3-U0.852A | New |
| 316947 | NA | NA | F3-U1.253 | 350% to 583% |
| 316947 | NA | NA | F3-U1.255 | 316% to 527% |
| 316947 | Phenols and Related Compounds | Phenylpropanes and Derivatives | Chlorogenic acid | 126% to 210% |
| 316947 | Sterols, Oxygenated Terpenes, and Other Isoprenoids | Prenylquinones | alpha-Tocopherol | 60% to 91% |
| 316947 | Sterols, Oxygenated Terpenes, and Other Isoprenoids | Prenylquinones | alpha-Tocopherol hydroquinone | New |
| 316947 | Sterols, Oxygenated Terpenes, and Other Isoprenoids | Terpenoids | beta-Sitosterol | 64% to 107% |
| 316947 | Sterols, Oxygenated Terpenes, and Other Isoprenoids | Prenylquinones | beta-Tocopherol | New |
| 316947 | Sterols, Oxygenated Terpenes, and Other Isoprenoids | Terpenoids | Campesterol | 60% to 76% |
| 316947 | Sterols, Oxygenated Terpenes, and Other Isoprenoids | Terpenoids | Cholesterol | 60% to 76% |
| 316947 | Sterols, Oxygenated Terpenes, and Other Isoprenoids | Terpenoids | F1-U1.136 Sterol | 60% to 97% |
| 316947 | Sterols, Oxygenated Terpenes, and Other Isoprenoids | Terpenoids | Stigmasterol | 73% to 122% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316970

| Seq ID | Chemical Class | Biochemical Class | Compound Name | Modification |
|---|---|---|---|---|
| 316970 | Acids | Acids | Carbamic acid | 1346% to 2243% |
| 316970 | Acids - Fatty | Fatty Acids and Related Waxes | Eicosanoic acid | 60% to 82% |
| 316970 | Acids - Fatty Branched | Fatty Acids and Related Waxes | Hexadecanoic acid, 14-methyl- | New |
| 316970 | Acids - Fatty Branched | Fatty Acids and Related Waxes | Hexadecanoic acid, 14-methyl- | -60% to -90% |
| 316970 | Acids - Fatty Unsat | Fatty Acids and Related Waxes | 7,10-Hexadecadienoic acid | -60% to -100% |
| 316970 | Acids - Fatty Unsat | Fatty Acids and Related Waxes | 9,12-Octadecadienoic acid | -60% to -95% |
| 316970 | Acids - Fatty Unsat | Fatty Acids and Related Waxes | 9-Hexadecenoic acid | -60% to -75% |
| 316970 | Acids - Fatty Unsat | Fatty Acids and Related Waxes | 9-Octadecenoic acid | -60% to -84% |
| 316970 | Acids - Fatty Unsat | Fatty Acids and Related Waxes | 9-Octadecenoic acid | -60% to -80% |
| 316970 | Acids - Hydroxy Alpha | Acid Pathway | Citric acid | 323% to 539% |
| 316970 | Acids - Hydroxy Alpha | Carbohydrates | F3-U0.992 Sugar acid | New |
| 316970 | Acids - Hydroxy Alpha | Carbohydrates | Quinic acid | -64% to -100% |
| 316970 | Alcohols | Carbohydrates | F3-U0.784 Sugar Alcohol | New |
| 316970 | Alkenes and Alkynes | Terpenoids | Limonene | 77% to 129% |
| 316970 | Amino Acids and Related Compounds | Amino Acids and Related Compounds | Asparagine | New |
| 316970 | Amino Acids and Related Compounds | Amino Acids and Related Compounds | Glutamine | 783% to 1306% |
| 316970 | Amino Acids and Related Compounds | Amino Acids and Related Compounds | Phenylalanine | 60% to 410% |
| 316970 | Amino Acids and Related Compounds | Amino Acids and Related Compounds | Proline | NQ |
| 316970 | Amino Acids and Related Compounds | Amino Acids and Related Compounds | Proline, 5-oxo- | 79% to 132% |
| 316970 | Amino Acids and Related Compounds | Amino Acids and Related Compounds | Serine | 100% to 325% |
| 316970 | Amino Acids and Related Compounds | Amino Acids and Related Compounds | Threonine | 60% to 1590% |
| 316970 | Amino Acids and Related Compounds | Amino Acids and Related Compounds | Threonine | 239% to 398% |
| 316970 | Amino Acids and Related Compounds | Amino Acids and Related Compounds | Valine | 105% to 1780% |
| 316970 | Carbohydrates | Carbohydrates | F3-U0.768 Carbohydrate | New |
| 316970 | Carbohydrates | Carbohydrates | F3-U0.781 Carbohydrate | New |
| 316970 | Carbohydrates | Carbohydrates | F3-U0.813 Carbohydrate | New |
| 316970 | Carbohydrates | Carbohydrates | F3-U0.816 Carbohydrate | 136% to 226% |
| 316970 | Carbohydrates | Carbohydrates | F3-U0.825 Carbohydrate | 1038% to 1730% |
| 316970 | Carbohydrates | Carbohydrates | F3-U0.846 Carbohydrate | 136% to 227% |
| 316970 | Carbohydrates | Carbohydrates | F3-U0.872 Hexose | 186% to 311% |
| 316970 | Carbohydrates | Carbohydrates | F3-U1.148 Carbohydrate | 131% to 219% |
| 316970 | Carbohydrates | Carbohydrates | F3-U1.189 Carbohydrate | 132% to 219% |
| 316970 | Carbohydrates | Carbohydrates | F3-U1.194 Carbohydrate | 199% to 332% |
| 316970 | Carbohydrates | Carbohydrates | Fructose | 89% to 200% |
| 316970 | Carbohydrates | Carbohydrates | Glucose | 60% to 81% |
| 316970 | NA | NA | F3-U0.736 | New |
| 316970 | NA | NA | F3-U0.799 | New |
| 316970 | NA | NA | F3-U0.858 | New |
| 316970 | NA | NA | F3-U0.868 | New |
| 316970 | NA | NA | F3-U0.895 | New |
| 316970 | NA | NA | F3-U0.909 | 60% to 99% |
| 316970 | NA | NA | F3-U1.253 | 68% to 113% |
| 316970 | NA | NA | F3-U1.255 | New |
| 316970 | Phenols and Related Compounds | Phenylpropanes and Derivatives | Caffeic acid | 72% to 119% |
| 316970 | Phenols and Related Compounds | Phenylpropanes and Derivatives | Chlorogenic acid | 409% to 681% |
| 316970 | Sterols, Oxygenated Terpenes, and Other Isoprenoids | Prenylquinones | alpha-Tocopherol | 102% to 170% |
| 316970 | Sterols, Oxygenated Terpenes, and Other Isoprenoids | Terpenoids | F1-U1.122 Sterol | 89% to 149% |
| 316970 | Sterols, Oxygenated Terpenes, and Other Isoprenoids | Terpenoids | F1-U1.136 Sterol | New |
| 316970 | Sterols, Oxygenated Terpenes, and Other Isoprenoids | Terpenoids | F1-U1.244 Sterol | 78% to 130% |
| 316970 | Sterols, Oxygenated Terpenes, and Other Isoprenoids | Terpenoids | Fucosterol | New |
| 316970 | Sterols, Oxygenated Terpenes, and Other Isoprenoids | Prenylquinones | gamma-Tocopherol | |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316974

| Seq ID | Chemical Class | Biochemical Class | Compound Name | Modification |
|---|---|---|---|---|
| 316974 | Acids - Fatty | Fatty Acids and Related Waxes | Docosanoic acid | 66% to 110% |
| 316974 | Acids - Fatty | Fatty Acids and Related Waxes | Eicosanoic acid | 75% to 138% |
| 316974 | Acids - Fatty | Fatty Acids and Related Waxes | Octadecanoic acid | 60% to 107% |
| 316974 | Acids - Fatty Branched | Fatty Acids and Related Waxes | Hexadecanoic acid, 14-methyl- | 60% to 99% |
| 316974 | Acids - Fatty Unsat | Fatty Acids and Related Waxes | 9,12-Octadecadienoic acid | 60% to 83% |
| 316974 | Acids - Fatty Unsat | Fatty Acids and Related Waxes | 9-Octadecenoic acid | 50% to 138% |
| 316974 | Acids - Fatty Unsat | Fatty Acids and Related Waxes | 9-Octadecenoic acid | 60% to 95% |
| 316974 | Acids - Hydroxy Alpha | Acid Pathway | Citric acid | 181% to 302% |
| 316974 | Acids - Hydroxy Alpha | Acid Pathway | Malic acid | -60% to -91% |
| 316974 | Alkenes and Alkynes | Terpenoids | Limonene | NQ |
| 316974 | Amino Acids and Related Compounds | Amino Acids and Related Compounds | Asparagine | New |
| 316974 | Amino Acids and Related Compounds | Amino Acids and Related Compounds | Glutamic acid | -60% to -77% |
| 316974 | Amino Acids and Related Compounds | Amino Acids and Related Compounds | Glutamine | 307% to 511% |
| 316974 | Amino Acids and Related Compounds | Amino Acids and Related Compounds | Histidine | 60% to 390% |
| 316974 | Amino Acids and Related Compounds | Amino Acids and Related Compounds | Isoleucine | New |
| 316974 | Amino Acids and Related Compounds | Amino Acids and Related Compounds | Leucine | New |
| 316974 | Amino Acids and Related Compounds | Amino Acids and Related Compounds | Phenylalanine | New |
| 316974 | Amino Acids and Related Compounds | Amino Acids and Related Compounds | Serine | 60% to 240% |
| 316974 | Amino Acids and Related Compounds | Amino Acids and Related Compounds | Threonine | 90% to 315% |
| 316974 | Amino Acids and Related Compounds | Amino Acids and Related Compounds | Tryptophan | New |
| 316974 | Amino Acids and Related Compounds | Amino Acids and Related Compounds | Tyrosine | New |
| 316974 | Amino Acids and Related Compounds | Amino Acids and Related Compounds | Valine | 400% to 955% |
| 316974 | Carbohydrates | Carbohydrates | F3-U0.846 Carbohydrate | 100% to 166% |
| 316974 | Carbohydrates | Carbohydrates | F3-U0.872 Hexose | 162% to 271% |
| 316974 | Carbohydrates | Carbohydrates | F3-U1.049B Carbohydrate | New |
| 316974 | Carbohydrates | Carbohydrates | F3-U1.148 Carbohydrate | 325% to 542% |
| 316974 | Carbohydrates | Carbohydrates | F3-U1.189 Carbohydrate | 111% to 185% |
| 316974 | Carbohydrates | Carbohydrates | F3-U1.194 Carbohydrate | 161% to 269% |
| 316974 | Carbohydrates | Carbohydrates | Fructose | 171% to 287% |
| 316974 | Carbohydrates | Carbohydrates | Galactose | 124% to 206% |
| 316974 | Carbohydrates | Carbohydrates | Glucose | 132% to 220% |
| 316974 | Carbohydrates | Carbohydrates | Sucrose | New |
| 316974 | Esters | Esters | F1-U1.076 Fatty Acid Ester | 75% to 125% |
| 316974 | Esters | Esters | F1-U1.119 Fatty Acid Ester | 121% to 201% |
| 316974 | Esters - Hydroxy | Acyl acetylglycerols | 2-Eicosanoyl-1-acetylglycerol | 185% to 308% |
| 316974 | Esters - Hydroxy | Acyl acetylglycerols | 2-Octadecanoyl-1-acetylglycerol | 94% to 156% |
| 316974 | NA | NA | F1-U0.873 | New |
| 316974 | NA | NA | F3-U1.232B | 100% to 167% |
| 316974 | NA | NA | F3-U1.253 | 107% to 178% |
| 316974 | Phenols and Related Compounds | Phenylpropanes and Derivatives | Chlorogenic acid | 468% to 780% |
| 316974 | Sterols, Oxygenated Terpenes, and Other Isoprenoids | Prenylquinones | alpha-Tocopherol | New |
| 316974 | Sterols, Oxygenated Terpenes, and Other Isoprenoids | Prenylquinones | beta-Tocopherol | 73% to 121% |
| 316974 | Sterols, Oxygenated Terpenes, and Other Isoprenoids | Terpenoids | Stigmasterol | |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#316976

| Seq ID | Chemical Class | Biochemical Class | Compound Name | Modification |
|---|---|---|---|---|
| 316976 | Acids - Hydroxy Alpha | Acid Pathway | Citric acid | 273% to 455% |
| 316976 | Acids - Fatty | Fatty Acids and Related Waxes | Octadecanoic acid | 60% to 66% |
| 316976 | Acids - Fatty Unsat | Fatty Acids and Related Waxes | 9-Octadecenoic acid | 60% to 142% |
| 316976 | Amino Acids and Related Compounds | Amino Acids and Related Compounds | Arginine | 70% to 305% |
| 316976 | Amino Acids and Related Compounds | Amino Acids and Related Compounds | Asparagine | 1330% to 2216% |
| 316976 | Amino Acids and Related Compounds | Amino Acids and Related Compounds | Cysteine | 60% to 335% |
| 316976 | Amino Acids and Related Compounds | Amino Acids and Related Compounds | Histidine | 80% to 2420% |
| 316976 | Amino Acids and Related Compounds | Amino Acids and Related Compounds | Isoleucine | New |
| 316976 | Amino Acids and Related Compounds | Amino Acids and Related Compounds | Leucine | New |
| 316976 | Amino Acids and Related Compounds | Amino Acids and Related Compounds | Methionine | 345% to 475% |
| 316976 | Amino Acids and Related Compounds | Amino Acids and Related Compounds | Phenylalanine | New |
| 316976 | Amino Acids and Related Compounds | Amino Acids and Related Compounds | Serine | 60% to 120% |
| 316976 | Amino Acids and Related Compounds | Amino Acids and Related Compounds | Threonine | 450% to 700% |
| 316976 | Amino Acids and Related Compounds | Amino Acids and Related Compounds | Tryptophan | New |
| 316976 | Amino Acids and Related Compounds | Amino Acids and Related Compounds | Tyrosine | New |
| 316976 | Amino Acids and Related Compounds | Amino Acids and Related Compounds | Valine | 80% to 1575% |
| 316976 | Carbohydrates | Carbohydrates | F3-U0.813 Carbohydrate | 241% to 402% |
| 316976 | Carbohydrates | Carbohydrates | F3-U0.872 Hexose | 108% to 181% |
| 316976 | Carbohydrates | Carbohydrates | F3-U0.952 Carbohydrate | 155% to 259% |
| 316976 | Carbohydrates | Carbohydrates | F3-U1.049B Carbohydrate | New |
| 316976 | Carbohydrates | Carbohydrates | F3-U1.113 Carbohydrate | 75% to 125% |
| 316976 | Carbohydrates | Carbohydrates | F3-U1.143 Carbohydrate | 60% to 97% |
| 316976 | Carbohydrates | Carbohydrates | F3-U1.150 Carbohydrate | 185% to 308% |
| 316976 | Carbohydrates | Carbohydrates | F3-U1.189 Carbohydrate | 520% to 866% |
| 316976 | Carbohydrates | Carbohydrates | F3-U1.194 Carbohydrate | 634% to 1056% |
| 316976 | Carbohydrates | Carbohydrates | Fructose | 398% to 756% |
| 316976 | Carbohydrates | Carbohydrates | Glucose | 211% to 513% |
| 316976 | Hydrocarbons | Hydrocarbons | Triacontane, 2-methyl- | -67% to -100% |
| 316976 | NA | NA | F1-U1.050 | New |
| 316976 | NA | NA | F3-U0.852A | 60% to 81% |
| 316976 | NA | NA | F3-U1.229 | 419% to 699% |
| 316976 | NA | NA | F3-U1.232B | 77% to 128% |
| 316976 | NA | NA | F3-U1.253 | 68% to 114% |
| 316976 | NA | NA | F3-U1.255 | 204% to 340% |
| 316976 | Phenols and Related Compounds | Phenylpropanes and Derivatives | Chlorogenic acid | 115% to 633% |
| 316976 | Sterols, Oxygenated Terpenes, and Other Isoprenoids | Prenylquinones | alpha-Tocopherol | 116% to 400% |
| 316976 | Sterols, Oxygenated Terpenes, and Other Isoprenoids | Prenylquinones | alpha-Tocopherol hydroquinone | 137% to 229% |
| 316976 | Sterols, Oxygenated Terpenes, and Other Isoprenoids | Terpenoids | beta-Sitosterol | New |
| 316976 | Sterols, Oxygenated Terpenes, and Other Isoprenoids | Prenylquinones | beta-Tocopherol | New |
| 316976 | Sterols, Oxygenated Terpenes, and Other Isoprenoids | Terpenoids | Ergost-22-en-3-one | |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316984

| Seq ID | Chemical Class | Biochemical Class | Compound Name | Modification |
|---|---|---|---|---|
| 316984 | Acids - Hydroxy Alpha | Carbohydrates | Glyceric acid | New |
| 316984 | Acids - Hydroxy Alpha | Carbohydrates | Quinic acid | 169% to 282% |
| 316984 | Amino Acids and Related Compounds | Amino Acids and Related Compounds | Asparagine | New |
| 316984 | Amino Acids and Related Compounds | Amino Acids and Related Compounds | Glutamine | New |
| 316984 | Carbohydrates | Carbohydrates | Arabinose or Xylose | New |
| 316984 | Carbohydrates | Carbohydrates | F3-U0.848 Carbohydrate | 60% to 85% |
| 316984 | Carbohydrates | Carbohydrates | F3-U0.872 Hexose | 75% to 124% |
| 316984 | Carbohydrates | Carbohydrates | F3-U1.189 Carbohydrate | 151% to 252% |
| 316984 | Carbohydrates | Carbohydrates | F3-U1.194 Carbohydrate | 168% to 280% |
| 316984 | Carbohydrates | Carbohydrates | Fructose | 242% to 544% |
| 316984 | Carbohydrates | Carbohydrates | Galactose or Mannose | New |
| 316984 | Carbohydrates | Carbohydrates | Glucose | 179% to 637% |
| 316984 | NA | NA | F3-U0.882 | 173% to 289% |
| 316984 | NA | NA | F3-U1.229 | 93% to 155% |
| 316984 | NA | NA | F3-U1.253 | 167% to 279% |
| 316984 | NA | NA | F3-U1.255 | 75% to 125% |
| 316984 | Phenols and Related Compounds | Phenylpropanes and Derivatives | Chlorogenic acid | 101% to 168% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#316996

| Seq ID | Chemical Class | Biochemical Class | Compound Name | Modification |
|---|---|---|---|---|
| 316996 | Acids - Hydroxy Alpha | Acid Pathway | Butanoic acid, 2,3,4-trihydroxy- | NQ |
| 316996 | Acids | Acids | Carbamic acid | NQ |
| 316996 | Acids - Hydroxy Alpha | Acid Pathway | Citric acid | 829% to 1382% |
| 316996 | Acids - Hydroxy Alpha | Acid Pathway | Malic acid | -60% to -85% |
| 316996 | Acids - Hydroxy Alpha | Carbohydrates | Quinic acid | -61% to -100% |
| 316996 | Alcohols | Carbohydrates | Inositol | -60% to -88% |
| 316996 | Alkenes and Alkynes | Terpenoids | Limonene | NQ |
| 316996 | Amino Acids and Related Compounds | Amino Acids and Related Compounds | Asparagine | New |
| 316996 | Amino Acids and Related Compounds | Amino Acids and Related Compounds | Tryptophan | New |
| 316996 | Amino Acids and Related Compounds | Amino Acids and Related Compounds | Tyrosine | New |
| 316996 | Carbohydrates | Carbohydrates | F3-U0.813 Carbohydrate | 388% to 647% |
| 316996 | Carbohydrates | Carbohydrates | F3-U0.816 Carbohydrate | 170% to 283% |
| 316996 | Carbohydrates | Carbohydrates | F3-U0.821 Carbohydrate | 829% to 1382% |
| 316996 | Carbohydrates | Carbohydrates | F3-U0.846 Carbohydrate | 198% to 330% |
| 316996 | Carbohydrates | Carbohydrates | F3-U0.872 Hexose | 1833% to 305% |
| 316996 | Carbohydrates | Carbohydrates | F3-U1.049B Carbohydrate | New |
| 316996 | Carbohydrates | Carbohydrates | F3-U1.091 Carbohydrate | New |
| 316996 | Carbohydrates | Carbohydrates | F3-U1.189 Carbohydrate | 86% to 143% |
| 316996 | Carbohydrates | Carbohydrates | F3-U1.194 Carbohydrate | 98% to 164% |
| 316996 | Carbohydrates | Carbohydrates | F3-U1.208 Carbohydrate | New |
| 316996 | Esters | Esters | F1-U1.076 Fatty Acid Ester | 60% to 76% |
| 316996 | NA | NA | F3-U0.602 | NQ |
| 316996 | NA | NA | F3-U0.852A | New |
| 316996 | Sterols, Oxygenated Terpenes, and Other Isoprenoids | Prenylquinones | alpha-Tocopherol | 293% to 1765% |
| 316996 | Sterols, Oxygenated Terpenes, and Other Isoprenoids | Prenylquinones | alpha-Tocopherol hydroquinone | 82% to 274% |
| 316996 | Sterols, Oxygenated Terpenes, and Other Isoprenoids | Terpenoids | beta-Sitosterol | 60% to 102% |
| 316996 | Sterols, Oxygenated Terpenes, and Other Isoprenoids | Prenylquinones | beta-Tocopherol | New |
| 316996 | Sterols, Oxygenated Terpenes, and Other Isoprenoids | Terpenoids | F1-U1.122 Sterol | 70% to 117% |
| 316996 | Sterols, Oxygenated Terpenes, and Other Isoprenoids | Terpenoids | F1-U1.130 Sterol | New |
| 316996 | Sterols, Oxygenated Terpenes, and Other Isoprenoids | Terpenoids | Stigmasterol | 60% to 85% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#317014

| Seq ID | Chemical Class | Biochemical Class | Compound Name | Modification |
|---|---|---|---|---|
| 317014 | Acids - Fatty | Fatty Acids and Related Waxes | Eicosanoic acid | NQ |
| 317014 | Acids - Fatty | Fatty Acids and Related Waxes | Octadecanoic acid | 60% to 98% |
| 317014 | Acids - Fatty Branched | Fatty Acids and Related Waxes | Heptadecanoic acid, 16-methyl- | 60% to 135% |
| 317014 | Acids - Fatty Unsat | Fatty Acids and Related Waxes | 9,12,15-Octadecatrienoic acid | New |
| 317014 | Acids - Fatty Unsat | Fatty Acids and Related Waxes | 9-Octadecenoic acid | 90% to 150% |
| 317014 | Acids - Fatty Unsat | Fatty Acids and Related Waxes | Hexadecadienoic acid | -60% to -75% |
| 317014 | Amino Acids and Related Compounds | Amino Acids and Related Compounds | Alanine | 60% to 260% |
| 317014 | Amino Acids and Related Compounds | Amino Acids and Related Compounds | Arginine | 74% to 186% |
| 317014 | Amino Acids and Related Compounds | Amino Acids and Related Compounds | Asparagine | 320% to 905% |
| 317014 | Amino Acids and Related Compounds | Amino Acids and Related Compounds | Glutamine | 372% to 787% |
| 317014 | Amino Acids and Related Compounds | Amino Acids and Related Compounds | Glycine | 60% to 380% |
| 317014 | Amino Acids and Related Compounds | Amino Acids and Related Compounds | Methionine | New |
| 317014 | Amino Acids and Related Compounds | Amino Acids and Related Compounds | Phenylalanine | 60% to 775% |
| 317014 | Amino Acids and Related Compounds | Amino Acids and Related Compounds | Serine | 60% to 1215% |
| 317014 | Amino Acids and Related Compounds | Amino Acids and Related Compounds | Threonine | 60% to 290% |
| 317014 | Amino Acids and Related Compounds | Amino Acids and Related Compounds | Valine | 60% to 545% |
| 317014 | Carbohydrates | Carbohydrates | F3-U0.813 Carbohydrate | New |
| 317014 | Carbohydrates | Carbohydrates | F3-U0.816 Carbohydrate | 268% to 446% |
| 317014 | Carbohydrates | Carbohydrates | F3-U0.821 Carbohydrate | 102% to 170% |
| 317014 | Carbohydrates | Carbohydrates | F3-U0.846 Carbohydrate | 302% to 503% |
| 317014 | Carbohydrates | Carbohydrates | F3-U0.872 Hexose | 379% to 631% |
| 317014 | Carbohydrates | Carbohydrates | F3-U1.113 Carbohydrate | 83% to 139% |
| 317014 | Carbohydrates | Carbohydrates | F3-U1.148 Carbohydrate | 89% to 148% |
| 317014 | Carbohydrates | Carbohydrates | F3-U1.189 Carbohydrate | 60% to 79% |
| 317014 | Carbohydrates | Carbohydrates | F3-U1.194 Carbohydrate | 125% to 209% |
| 317014 | Carbohydrates | Carbohydrates | Fructose | 60% to 2395% |
| 317014 | Carbohydrates | Carbohydrates | Glucose | 409% to 707% |
| 317014 | Esters | Fatty Acids and Related Waxes | 9,12,15-Octadecatrienoic acid, glyceryl ester | NQ |
| 317014 | Esters | Esters | F1-U1.065 Fatty Acid Ester | 71% to 119% |
| 317014 | Esters | Esters | F1-U1.076 Fatty Acid Ester | 133% to 222% |
| 317014 | Esters | Esters | F1-U1.113 Fatty Acid Ester | 110% to 184% |
| 317014 | Esters | Esters | F1-U1.119 Fatty Acid Ester | 104% to 376% |
| 317014 | Esters | Fatty Acids and Related Waxes | Hexadecanoic acid, glyceryl ester | 159% to 265% |
| 317014 | Esters - Hydroxy | Acyl acetylglycerols | 2-Eicosanoyl-1-acetylglycerol | 68% to 184% |
| 317014 | Hydrocarbons | Hydrocarbons | Dotriacontane, 2-methyl- | 106% to 177% |
| 317014 | NA | NA | F1-U0.955 | 85% to 141% |
| 317014 | NA | NA | F1-U1.119 | New |
| 317014 | NA | NA | F3-U1.253 | 149% to 249% |
| 317014 | NA | NA | F3-U1.255 | 123% to 205% |
| 317014 | Sterols, Oxygenated Terpenes, and Other Isoprenoids | Prenylquinones | alpha-Tocopherol | 60% to 140% |
| 317014 | Sterols, Oxygenated Terpenes, and Other Isoprenoids | Prenylquinones | alpha-Tocopherol hydroquinone | 212% to 398% |
| 317014 | Sterols, Oxygenated Terpenes, and Other Isoprenoids | Terpenoids | beta-Sitosterol | New |
| 317014 | Sterols, Oxygenated Terpenes, and Other Isoprenoids | Terpenoids | beta-Tocopherol | 96% to 469% |
| 317014 | Sterols, Oxygenated Terpenes, and Other Isoprenoids | Terpenoids | Campesterol | 373% to 1035% |
| 317014 | Sterols, Oxygenated Terpenes, and Other Isoprenoids | Terpenoids | Cholesterol | 85% to 150% |
| 317014 | Sterols, Oxygenated Terpenes, and Other Isoprenoids | Terpenoids | Cycloartenol | 347% to 578% |
| 317014 | Sterols, Oxygenated Terpenes, and Other Isoprenoids | Terpenoids | Ergosta-8,24(28)-dien-3-ol, 4,14-dimethyl- | New |
| 317014 | Sterols, Oxygenated Terpenes, and Other Isoprenoids | Terpenoids | F1-U1.136 Sterol | New |
| 317014 | Sterols, Oxygenated Terpenes, and Other Isoprenoids | Prenylquinones | gamma-Tocopherol | 149% to 818% |
| 317014 | Sterols, Oxygenated Terpenes, and Other Isoprenoids | Terpenoids | Stigmasterol | 68% to 321% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#317021

| Seq ID | Chemical Class | Biochemical Class | Compound Name | Modification |
|---|---|---|---|---|
| 317021 | Amino Acids and Related Compounds | Amino Acids and Related Compounds | Leucine | New |
| 317021 | Amino Acids and Related Compounds | Amino Acids and Related Compounds | Lysine | 60% to 385% |
| 317021 | Amino Acids and Related Compounds | Amino Acids and Related Compounds | Methionine | 70% to 120% |
| 317021 | Amino Acids and Related Compounds | Amino Acids and Related Compounds | Threonine | 60% to 120% |
| 317021 | Amino Acids and Related Compounds | Amino Acids and Related Compounds | Tryptophan | New |
| 317021 | Amino Acids and Related Compounds | Amino Acids and Related Compounds | Tyrosine | New |
| 317021 | Amino Acids and Related Compounds | Amino Acids and Related Compounds | Valine | 260% to 460% |
| 317021 | Esters | Esters | F1-U1.076 Fatty Acid Ester | 93% to 155% |
| 317021 | Esters | Esters | F1-U1.113 Fatty Acid Ester | 263% to 439% |
| 317021 | Esters | Esters | F1-U1.121 Fatty Acid Ester | 225% to 375% |
| 317021 | Esters - Hydroxy | Acyl acetylglycerols | 2-Octadecanoyl-1-acetylglycerol | 142% to 237% |
| 317021 | NA | NA | F1-U0.972 | New |
| 317021 | Sterols, Oxygenated Terpenes, and Other Isoprenoids | Prenylquinones | alpha-Tocopherol | New |
| 317021 | Sterols, Oxygenated Terpenes, and Other Isoprenoids | Prenylquinones | alpha-Tocopherol hydroquinone | New |
| 317021 | Sterols, Oxygenated Terpenes, and Other Isoprenoids | Terpenoids | beta-Sitosterol | 111% to 184% |
| 317021 | Sterols, Oxygenated Terpenes, and Other Isoprenoids | Prenylquinones | beta-Tocopherol | New |
| 317021 | Sterols, Oxygenated Terpenes, and Other Isoprenoids | Terpenoids | Cholesterol | 60% to 89% |
| 317021 | Sterols, Oxygenated Terpenes, and Other Isoprenoids | Prenylquinones | F1-U1.179 alpha-Tocopherol Isomer | 60% to 88% |
| 317021 | Sterols, Oxygenated Terpenes, and Other Isoprenoids | Terpenoids | Stigmasterol | 99% to 165% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence,
Seq ID#317069

| Seq ID | Chemical Class | Biochemical Class | Compound Name | Modification |
|---|---|---|---|---|
| 317069 | Esters - Hydroxy | Acyl acetylglycerols | 2-Eicosanoyl-1-acetylglycerol | New |
| 317069 | Esters - Hydroxy | Acyl acetylglycerols | 2-Octadecanoyl-1-acetylglycerol | 472% to 786% |
| 317069 | Sterols, Oxygenated Terpenes, and Other Isoprenoids | Prenylquinones | alpha-Tocopherol | 122% to 204% |
| 317069 | Sterols, Oxygenated Terpenes, and Other Isoprenoids | Terpenoids | beta-Sitosterol | New |
| 317069 | Sterols, Oxygenated Terpenes, and Other Isoprenoids | Prenylquinones | beta-Tocopherol | New |
| 317069 | Sterols, Oxygenated Terpenes, and Other Isoprenoids | Terpenoids | Campesterol | New |
| 317069 | Sterols, Oxygenated Terpenes, and Other Isoprenoids | Terpenoids | Cholesterol | New |
| 317069 | Sterols, Oxygenated Terpenes, and Other Isoprenoids | Terpenoids | F1-U1.106 Sterol | -60% to -88% |
| 317069 | Sterols, Oxygenated Terpenes, and Other Isoprenoids | Terpenoids | Stigmasta-5,22-dien-3-ol, acetate | -60% to -84% |
| 317069 | Sterols, Oxygenated Terpenes, and Other Isoprenoids | Terpenoids | Stigmasterol | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#317079

| Seq ID | Chemical Class | Biochemical Class | Compound Name | Modification |
|---|---|---|---|---|
| 317079 | Acids | Acids | Carbamic acid | 60% to 77% |
| 317079 | Acids - Hydroxy Alpha | Carbohydrates | Quinic acid | 78% to 131% |
| 317079 | Carbohydrates | Carbohydrates | F3-U0.813 Carbohydrate | 289% to 482% |
| 317079 | Carbohydrates | Carbohydrates | F3-U0.846 Carbohydrate | 140% to 234% |
| 317079 | Carbohydrates | Carbohydrates | F3-U0.872 Hexose | 236% to 394% |
| 317079 | Carbohydrates | Carbohydrates | F3-U1.113 Carbohydrate | 60% to 93% |
| 317079 | Carbohydrates | Carbohydrates | F3-U1.143 Carbohydrate | 72% to 120% |
| 317079 | Carbohydrates | Carbohydrates | F3-U1.150 Carbohydrate | 62% to 104% |
| 317079 | Carbohydrates | Carbohydrates | F3-U1.189 Carbohydrate | 133% to 221% |
| 317079 | Carbohydrates | Carbohydrates | F3-U1.194 Carbohydrate | 239% to 398% |
| 317079 | Carbohydrates | Carbohydrates | Fructose | 547% to 1044% |
| 317079 | Carbohydrates | Carbohydrates | Glucose | 339% to 1054% |
| 317079 | NA | NA | F3-U0.785B | New |
| 317079 | NA | NA | F3-U0.843 | 580% to 966% |
| 317079 | NA | NA | F3-U0.882 | 178% to 297% |
| 317079 | NA | NA | F3-U1.228 | 60% to 95% |
| 317079 | NA | NA | F3-U1.253 | 86% to 143% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#3442

| Seq ID | Chemical Class | Biochemical Class | Compound Name | Modification |
|---|---|---|---|---|
| 3442 | Carbohydrates | Carbohydrates | Galactose | 5% to 293% |
| 3442 | Carbohydrates | Carbohydrates | Glucose | -37% to -77% |
| 3442 | Carbohydrates | Carbohydrates | Rhamnose | 49% to 573% |
| 3442 | Carbohydrates | Carbohydrates | Xylose | 33% to 829% |

FIG. 6 continued

| Seq ID | Chemical Class | Biochemical Class | Compound Name | Modification |
|---|---|---|---|---|
| 35605 | Acids - hydroxy Alpha | Carbohydrates | Galacturonic acid | -59% to -96% |
| 35605 | Carbohydrates | Carbohydrates | Arabinose | -25% to -82% |
| 35605 | Carbohydrates | Carbohydrates | Mannose | -55% to -89% |
| 35605 | Carbohydrates | Carbohydrates | Rhamnose | -7% to -77% |
| 35605 | Carbohydrates | Carbohydrates | Xylose | -33% to -89% |

A list of metabolite compounds present in altered levels relative to reference samples as chararacterized by gas chromatography, liquid chromatography, and/or mass spectrometry. This list corresponds to samples transfected with nucleic acid sequence, Seq ID#35605

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#36009

| Seq ID | Chemical Class | Biochemical Class | Compound Name | Modification |
|---|---|---|---|---|
| 36009 | Acids - hydroxy Alpha | Carbohydrates | Galacturonic acid | 31% to 385% |
| 36009 | Carbohydrates | Carbohydrates | Arabinose | 29% to 1017% |
| 36009 | Carbohydrates | Carbohydrates | Glucose | -19% to -99% |
| 36009 | Carbohydrates | Carbohydrates | Mannose | NQ |
| 36009 | Carbohydrates | Carbohydrates | Rhamnose | 3% to 395% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#36204

| Seq ID | Chemical Class | Biochemical Class | Compound Name | Modification |
|---|---|---|---|---|
| 36204 | Acids - hydroxy Alpha | Carbohydrates | Galacturonic acid | NQ |
| 36204 | Carbohydrates | Carbohydrates | Arabinose | -45% to -95% |
| 36204 | Carbohydrates | Carbohydrates | Glucose | NQ |
| 36204 | Carbohydrates | Carbohydrates | Rhamnose | -67% to -93% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#36934 | | | | |
|---|---|---|---|---|
| Seq ID | Chemical Class | Biochemical Class | Compound Name | Modification |
| 36934 | Carbohydrates | Carbohydrates | Arabinose | -33% to -93% |
| 36934 | Carbohydrates | Carbohydrates | Galactose | NQ |
| 36934 | Carbohydrates | Carbohydrates | Xylose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#37131

| Seq ID | Chemical Class | Biochemical Class | Compound Name | Modification |
|---|---|---|---|---|
| 37131 | Acids - hydroxy Alpha | Carbohydrates | Galacturonic acid | 53% to 317% |
| 37131 | Carbohydrates | Carbohydrates | Galactose | 34% to 361% |
| 37131 | Carbohydrates | Carbohydrates | Glucose | NQ |
| 37131 | Carbohydrates | Carbohydrates | Mannose | 57% to 717% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#38707

| Seq ID | Chemical Class | Biochemical Class | Compound Name | Modification |
|---|---|---|---|---|
| 38707 | Acids - Hydroxy Alpha | Carbohydrates | Galacturonic acid | 14% to 220% |
| 38707 | Carbohydrates | Carbohydrates | Arabinose | 14% to 471% |
| 38707 | Carbohydrates | Carbohydrates | Galactose | 57% to 192% |
| 38707 | Carbohydrates | Carbohydrates | Glucose | -56% to -99% |
| 38707 | Carbohydrates | Carbohydrates | Mannose | 38% to 125% |
| 38707 | Carbohydrates | Carbohydrates | Rhamnose | 63% to 259% |
| 38707 | Carbohydrates | Carbohydrates | Xylose | 65% to 264% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#39086

| Seq ID | Chemical Class | Biochemical Class | Compound Name | Modification |
|--------|----------------|-------------------|---------------|--------------|
| 39086 | Carbohydrates | Carbohydrates | Xylose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#42023

| Seq ID | Chemical Class | Biochemical Class | Compound Name | Modification |
|---|---|---|---|---|
| 42023 | Amino Acids and Related Compounds | Amino Acids and Related Compounds | Cysteine | 95% to 440% |
| 42023 | Amino Acids and Related Compounds | Amino Acids and Related Compounds | Glycine | 140% to 495% |
| 42023 | Amino Acids and Related Compounds | Amino Acids and Related Compounds | Threonine | 35% to 85% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#42037

| Seq ID | Chemical Class | Biochemical Class | Compound Name | Modification |
|---|---|---|---|---|
| 42037 | Carbohydrates | Carbohydrates | Arabinose | -17% to -72% |
| 42037 | Carbohydrates | Carbohydrates | Galactose | -22% to -61% |
| 42037 | Carbohydrates | Carbohydrates | Glucose | 3% to 59% |
| 42037 | Carbohydrates | Carbohydrates | Mannose | -9% to -42% |
| 42037 | Carbohydrates | Carbohydrates | Rhamnose | 3% to 470% |
| 42037 | Carbohydrates | Carbohydrates | Xylose | -25% to -67% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#43341

| Seq ID | Chemical Class | Biochemical Class | Compound Name | Modification |
|---|---|---|---|---|
| 43341 | Acids - hydroxy Alpha | Carbohydrates | Galacturonic acid | -13% to -59% |
| 43341 | Carbohydrates | Carbohydrates | Arabinose | -7% to -68% |
| 43341 | Carbohydrates | Carbohydrates | Galactose | -11% to -56% |
| 43341 | Carbohydrates | Carbohydrates | Glucose | -29% to -51% |
| 43341 | Carbohydrates | Carbohydrates | Mannose | -3% to -38% |
| 43341 | Carbohydrates | Carbohydrates | Rhamnose | -7% to -48% |
| 43341 | Carbohydrates | Carbohydrates | Xylose | -7% to -54% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#43445

| Seq ID | Chemical Class | Biochemical Class | Compound Name | Modification |
|---|---|---|---|---|
| 43445 | Acids - Hydroxy Alpha | Acid Pathway | Butanoic acid, 2,3,4-trihydroxy- | 121% to 201% |
| 43445 | Acids - Hydroxy Alpha | Carbohydrates | Glyceric acid | NQ |
| 43445 | Aldehydes, Ketones and Quinones | Aldehydes, Ketones and Quinones | 3-Phytylmenadione | New |
| 43445 | Alkaloids and Other Bases | Alkaloids and Other Bases | Nicotine | 65% to 109% |
| 43445 | Alkenes and Alkynes | Terpenoids | Limonene | 103% to 172% |
| 43445 | Amino Acids and Related Compounds | Amino Acids and Related Compounds | Aspartic acid | -60% to -87% |
| 43445 | Amino Acids and Related Compounds | Amino Acids and Related Compounds | Glutamic acid | -60% to -100% |
| 43445 | Amino Acids and Related Compounds | Amino Acids and Related Compounds | Glycine | NQ |
| 43445 | Amino Acids and Related Compounds | Amino Acids and Related Compounds | Proline, 5-oxo- | -60% to -83% |
| 43445 | Amino Acids and Related Compounds | Amino Acids and Related Compounds | Serine | NQ |
| 43445 | Carbohydrates | Carbohydrates | Arabinose or Xylose | NQ |
| 43445 | Carbohydrates | Carbohydrates | F3-U0.813 Carbohydrate | 77% to 129% |
| 43445 | Carbohydrates | Carbohydrates | F3-U0.816 Carbohydrate | 94% to 157% |
| 43445 | Carbohydrates | Carbohydrates | F3-U0.821 Carbohydrate | 104% to 173% |
| 43445 | Carbohydrates | Carbohydrates | F3-U0.825 Carbohydrate | 131% to 218% |
| 43445 | Carbohydrates | Carbohydrates | Fructose | -60% to -82% |
| 43445 | Carbohydrates | Carbohydrates | Glucose | -60% to -91% |
| 43445 | Esters | Esters | F1-U1.119 Fatty Acid Ester | 102% to 170% |
| 43445 | Esters | Esters | F1-U1.120 Fatty Acid Ester | New |
| 43445 | Esters - Hydroxy | Acyl acetylglycerols | 2-Eicosanoyl-1-acetylglycerol | 60% to 92% |
| 43445 | NA | NA | F3-U0.882 | -60% to -76% |
| 43445 | Sterols, Oxygenated Terpenes, and Other Isoprenoids | Prenylquinones | alpha-Tocopherol | 100% to 167% |
| 43445 | Sterols, Oxygenated Terpenes, and Other Isoprenoids | Terpenoids | beta-Sitosterol | 82% to 137% |
| 43445 | Sterols, Oxygenated Terpenes, and Other Isoprenoids | Terpenoids | F1-U1.130 Sterol | 77% to 129% |
| 43445 | Sterols, Oxygenated Terpenes, and Other Isoprenoids | Terpenoids | F1-U1.136 Sterol | 97% to 161% |
| 43445 | Sterols, Oxygenated Terpenes, and Other Isoprenoids | Terpenoids | F1-U1.230A Sterol | 144% to 240% |
| 43445 | Sterols, Oxygenated Terpenes, and Other Isoprenoids | Terpenoids | Stigmasterol | 60% to 90% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#43449

| Seq ID | Chemical Class | Biochemical Class | Compound Name | Modification |
|---|---|---|---|---|
| 43449 | Amino Acids and Related Compounds | Amino Acids and Related Compounds | Cysteine | 15% to 270% |
| 43449 | Amino Acids and Related Compounds | Amino Acids and Related Compounds | Glycine | 35% to 275% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#43460

| Seq ID | Chemical Class | Biochemical Class | Compound Name | Modification |
|---|---|---|---|---|
| 43460 | Acids - hydroxy Alpha | Carbohydrates | Galacturonic acid | 3% to 159% |
| 43460 | Carbohydrates | Carbohydrates | Arabinose | 29% to 497% |
| 43460 | Carbohydrates | Carbohydrates | Galactose | 25% to 243% |
| 43460 | Carbohydrates | Carbohydrates | Glucose | -3% to -57% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#44067

| Seq ID | Chemical Class | Biochemical Class | Compound Name | Modification |
|---|---|---|---|---|
| 44067 | Acids - hydroxy Alpha | Carbohydrates | Galacturonic acid | 33% to 363% |
| 44067 | Carbohydrates | Carbohydrates | Galactose | 21% to 467% |
| 44067 | Carbohydrates | Carbohydrates | Glucose | -83% to -93% |
| 44067 | Carbohydrates | Carbohydrates | Mannose | NQ |
| 44067 | Carbohydrates | Carbohydrates | Xylose | -65% to -99% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#44139

| Seq ID | Chemical Class | Biochemical Class | Compound Name | Modification |
|---|---|---|---|---|
| 44139 | Acids - hydroxy Alpha | Carbohydrates | Galacturonic acid | -6% to -66% |
| 44139 | Carbohydrates | Carbohydrates | Arabinose | 11% to 428% |
| 44139 | Carbohydrates | Carbohydrates | Galactose | -7% to -54% |
| 44139 | Carbohydrates | Carbohydrates | Mannose | -1% to -38% |
| 44139 | Carbohydrates | Carbohydrates | Rhamnose | -16% to -55% |
| 44139 | Carbohydrates | Carbohydrates | Xylose | -7% to -58% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#44146

| Seq ID | Chemical Class | Biochemical Class | Compound Name | Modification |
|---|---|---|---|---|
| 44146 | Acids - hydroxy Alpha | Carbohydrates | Galacturonic acid | 5% to 185% |
| 44146 | Carbohydrates | Carbohydrates | Arabinose | 29% to 387% |
| 44146 | Carbohydrates | Carbohydrates | Galactose | 23% to 265% |
| 44146 | Carbohydrates | Carbohydrates | Glucose | NQ |
| 44146 | Carbohydrates | Carbohydrates | Xylose | 11% to 339% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#44189

| Seq ID | Chemical Class | Biochemical Class | Compound Name | Modification |
|---|---|---|---|---|
| 44189 | Acids - hydroxy Alpha | Carbohydrates | Galacturonic acid | 21% to 121% |
| 44189 | Carbohydrates | Carbohydrates | Arabinose | 156% to 259% |
| 44189 | Carbohydrates | Carbohydrates | Galactose | 38% to 99% |
| 44189 | Carbohydrates | Carbohydrates | Glucose | -39% to -54% |
| 44189 | Carbohydrates | Carbohydrates | Mannose | 29% to 71% |
| 44189 | Carbohydrates | Carbohydrates | Rhamnose | 87% to 129% |
| 44189 | Carbohydrates | Carbohydrates | Xylose | 1% to 28% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#44503

| Seq ID | Chemical Class | Biochemical Class | Compound Name | Modification |
|---|---|---|---|---|
| 44503 | Acids - hydroxy Alpha | Carbohydrates | Galacturonic acid | 12% to 132% |
| 44503 | Carbohydrates | Carbohydrates | Arabinose | 53% to 229% |
| 44503 | Carbohydrates | Carbohydrates | Galactose | 11% to 109% |
| 44503 | Carbohydrates | Carbohydrates | Glucose | -6% to -61% |
| 44503 | Carbohydrates | Carbohydrates | Mannose | 13% to 71% |
| 44503 | Carbohydrates | Carbohydrates | Rhamnose | 54% to 157% |
| 44503 | Carbohydrates | Carbohydrates | Xylose | 1% to 53% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#44508

| Seq ID | Chemical Class | Biochemical Class | Compound Name | Modification |
|---|---|---|---|---|
| 44508 | Acids - hydroxy Alpha | Carbohydrates | Galacturonic acid | 4% to 103% |
| 44508 | Carbohydrates | Carbohydrates | Arabinose | 41% to 135% |
| 44508 | Carbohydrates | Carbohydrates | Galactose | 5% to 85% |
| 44508 | Carbohydrates | Carbohydrates | Glucose | -8% to -71% |
| 44508 | Carbohydrates | Carbohydrates | Mannose | 5% to 50% |
| 44508 | Carbohydrates | Carbohydrates | Rhamnose | 24% to 98% |
| 44508 | Carbohydrates | Carbohydrates | Xylose | 2% to 82% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#44526

| Seq ID | Chemical Class | Biochemical Class | Compound Name | Modification |
|---|---|---|---|---|
| 44526 | Amino Acids and Related Compounds | Amino Acids and Related Compounds | Alanine | 15% to 270% |
| 44526 | Amino Acids and Related Compounds | Amino Acids and Related Compounds | Arginine | 1% to 390% |
| 44526 | Amino Acids and Related Compounds | Amino Acids and Related Compounds | Cysteine | 25% to 730% |
| 44526 | Amino Acids and Related Compounds | Amino Acids and Related Compounds | Glycine | 1% to 1020% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#44558

| Seq ID | Chemical Class | Biochemical Class | Compound Name | Modification |
|---|---|---|---|---|
| 44558 | Acids - hydroxy Alpha | Carbohydrates | Galacturonic acid | 9% to 103% |
| 44558 | Carbohydrates | Carbohydrates | Arabinose | 31% to 135% |
| 44558 | Carbohydrates | Carbohydrates | Galactose | 9% to 84% |
| 44558 | Carbohydrates | Carbohydrates | Glucose | -6% to -99% |
| 44558 | Carbohydrates | Carbohydrates | Mannose | 5% to 424% |
| 44558 | Carbohydrates | Carbohydrates | Rhamnose | 38% to 124% |
| 44558 | Carbohydrates | Carbohydrates | Xylose | 6% to 707% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#4743

| Seq ID | Chemical Class | Biochemical Class | Compound Name | Modification |
|---|---|---|---|---|
| 4743 | Carbohydrates | Carbohydrates | Arabinose | -3% to -97% |
| 4743 | Carbohydrates | Carbohydrates | Glucose | -13% to -81% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#4837

| Seq ID | Chemical Class | Biochemical Class | Compound Name | Modification |
|---|---|---|---|---|
| 4837 | Carbohydrates | Carbohydrates | Glucose | -17% to -59% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#48423

| Seq ID | Chemical Class | Biochemical Class | Compound Name | Modification |
|---|---|---|---|---|
| 48423 | Acids - Hydroxy Alpha | Acid Pathway | Butanoic acid, 2,3,4-trihydroxy- | New |
| 48423 | Acids - Hydroxy Alpha | Acid Pathway | Citric acid | 86% to 143% |
| 48423 | Acids - Hydroxy Alpha | Carbohydrates | Quinic acid | 153% to 255% |
| 48423 | Alkaloids and Other Bases | Polyamines | 1,4-Butanediamine | 61% to 102% |
| 48423 | Amino Acids and Related Compounds | Amino Acids and Related Compounds | Leucine | New |
| 48423 | Amino Acids and Related Compounds | Amino Acids and Related Compounds | Methionine | 75% to 380% |
| 48423 | Amino Acids and Related Compounds | Amino Acids and Related Compounds | Proline, 5-oxo- | 312% to 521% |
| 48423 | Amino Acids and Related Compounds | Amino Acids and Related Compounds | Threonine | 70% to 170% |
| 48423 | Amino Acids and Related Compounds | Amino Acids and Related Compounds | Tryptophan | New |
| 48423 | Amino Acids and Related Compounds | Amino Acids and Related Compounds | Valine | 160% to 480% |
| 48423 | Carbohydrates | Carbohydrates | F3-U0.846 Carbohydrate | 121% to 201% |
| 48423 | Carbohydrates | Carbohydrates | F3-U0.848 Carbohydrate | 60% to 89% |
| 48423 | Carbohydrates | Carbohydrates | F3-U0.872 Hexose | 130% to 217% |
| 48423 | Carbohydrates | Carbohydrates | Galactose or Mannose | 82% to 137% |
| 48423 | Carbohydrates | Carbohydrates | Glucose | 60% to 224% |
| 48423 | NA | NA | F3-U1.253 | 110% to 184% |
| 48423 | NA | NA | F3-U1.255 | 147% to 244% |
| 48423 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#4845

| Seq ID | Chemical Class | Biochemical Class | Compound Name | Modification |
|---|---|---|---|---|
| 4845 | Carbohydrates | Carbohydrates | Glucose | -79% to -97% |
| 4845 | Carbohydrates | Carbohydrates | Rhamnose | -21% to -100% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#48458 | | | | |
|---|---|---|---|---|
| Seq ID | Chemical Class | Biochemical Class | Compound Name | Modification |
| 48458 | Carbohydrates | Carbohydrates | Arabinose | -15% to -89% |
| 48458 | Carbohydrates | Carbohydrates | Glucose | -7% to -59% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#48493

| Seq ID | Chemical Class | Biochemical Class | Compound Name | Modification |
|---|---|---|---|---|
| 48493 | Carbohydrates | Carbohydrates | Arabinose | -17% to -91% |
| 48493 | Carbohydrates | Carbohydrates | Glucose | -11% to -61% |
| 48493 | Carbohydrates | Carbohydrates | Xylose | -1% to -81% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#48602

| Seq ID | Chemical Class | Biochemical Class | Compound Name | Modification |
|--------|----------------|-------------------|---------------|--------------|
| 48602 | Acids - hydroxy Alpha | Carbohydrates | Galacturonic acid | -57% to -95% |
| 48602 | Carbohydrates | Carbohydrates | Glucose | -1% to -39% |
| 48602 | Carbohydrates | Carbohydrates | Xylose | -7% to -79% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#48673 | | | | |
|---|---|---|---|---|
| Seq ID | Chemical Class | Biochemical Class | Compound Name | Modification |
| 48673 | Carbohydrates | Carbohydrates | Arabinose | 163% to 2439% |
| 48673 | Carbohydrates | Carbohydrates | Glucose | NQ |
| 48673 | Carbohydrates | Carbohydrates | Rhamnose | 1% to 225% |
| 48673 | Carbohydrates | Carbohydrates | Xylose | 5% to 815% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#49059

| Seq ID | Chemical Class | Biochemical Class | Compound Name | Modification |
|---|---|---|---|---|
| 49059 | Amino Acids and Related Compounds | Amino Acids and Related Compounds | Asparagine | NQ |
| 49059 | Acids - Hydroxy Alpha | Carbohydrates | Glyceric acid | NQ |
| 49059 | Amino Acids and Related Compounds | Amino Acids and Related Compounds | Aspartic acid | -60% to -79% |
| 49059 | Amino Acids and Related Compounds | Amino Acids and Related Compounds | Glutamic acid | NQ |
| 49059 | Amino Acids and Related Compounds | Amino Acids and Related Compounds | Glycine | NQ |
| 49059 | Amino Acids and Related Compounds | Amino Acids and Related Compounds | Proline | NQ |
| 49059 | Amino Acids and Related Compounds | Amino Acids and Related Compounds | Proline, 5-oxo- | -60% to -92% |
| 49059 | Carbohydrates | Carbohydrates | Arabinose or Xylose | -60% to -80% |
| 49059 | Carbohydrates | Carbohydrates | F3-U0.907 Carbohydrate | -60% to -76% |
| 49059 | Carbohydrates | Carbohydrates | F3-U1.189 Carbohydrate | NQ |
| 49059 | NA | NA | F3-U0.634 | NQ |
| 49059 | NA | NA | F3-U0.668 | 73% to 121% |
| 49059 | Phenols and Related Compounds | Phenylpropanes and Derivatives | Chlorogenic acid | -64% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#49145

| Seq ID | Chemical Class | Biochemical Class | Compound Name | Modification |
|---|---|---|---|---|
| 49145 | Acids - Hydroxy Alpha | Acid Pathway | Butanoic acid, 2,3,4-trihydroxy- | New |
| 49145 | Acids - Fatty | Fatty Acids and Related Waxes | Hexadecanoic acid | 60% to 87% |
| 49145 | Acids - Fatty | Fatty Acids and Related Waxes | Octadecanoic acid | 60% to 155% |
| 49145 | Acids - Fatty Unsat | Fatty Acids and Related Waxes | 7,10,13-Hexadecatrienoic acid | -60% to -61% |
| 49145 | Acids - Fatty Unsat | Fatty Acids and Related Waxes | 9-Octadecenoic acid | 60% to 149% |
| 49145 | Acids - Hydroxy | Amino Acids and Related Compounds | Shikimic acid | 128% to 214% |
| 49145 | Acids - Hydroxy Alpha | Acid Pathway | Citric acid | 421% to 701% |
| 49145 | Acids - Hydroxy Alpha | Carbohydrates | Quinic acid | 396% to 660% |
| 49145 | Amino Acids and Related Compounds | Amino Acids and Related Compounds | Proline, 5-oxo- | 98% to 164% |
| 49145 | Carbohydrates | Carbohydrates | F3-U0.813 Carbohydrate | 303% to 505% |
| 49145 | Carbohydrates | Carbohydrates | F3-U0.816 Carbohydrate | 128% to 214% |
| 49145 | Carbohydrates | Carbohydrates | F3-U0.821 Carbohydrate | 421% to 701% |
| 49145 | Carbohydrates | Carbohydrates | F3-U0.846 Carbohydrate | 1141% to 1902% |
| 49145 | Carbohydrates | Carbohydrates | F3-U0.848 Carbohydrate | 89% to 149% |
| 49145 | Carbohydrates | Carbohydrates | F3-U0.872 Hexose | 688% to 1146% |
| 49145 | Carbohydrates | Carbohydrates | Glucose | 60% to 94% |
| 49145 | NA | NA | F3-U0.668 | 60% to 95% |
| 49145 | Phenols and Related Compounds | Phenylpropanes and Derivatives | Chlorogenic acid | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#49360

| Seq ID | Chemical Class | Biochemical Class | Compound Name | Modification |
|---|---|---|---|---|
| 49360 | Alkenes and Alkynes | Terpenoids | Limonene | 63% to 104% |
| 49360 | Amino Acids and Related Compounds | Amino Acids and Related Compounds | Methionine | 60% to 370% |
| 49360 | Amino Acids and Related Compounds | Amino Acids and Related Compounds | Tryptophan | New |
| 49360 | Amino Acids and Related Compounds | Amino Acids and Related Compounds | Tyrosine | New |
| 49360 | Amino Acids and Related Compounds | Amino Acids and Related Compounds | Valine | 100% to 435% |
| 49360 | Sterols, Oxygenated Terpenes, and Other Isoprenoids | Prenylquinones | alpha-Tocopherol | 93% to 155% |
| 49360 | Sterols, Oxygenated Terpenes, and Other Isoprenoids | Prenylquinones | alpha-Tocopherol hydroquinone | 66% to 110% |
| 49360 | Sterols, Oxygenated Terpenes, and Other Isoprenoids | Prenylquinones | F1-U1.174 alpha-Tocopherol Isomer | 92% to 154% |
| 49360 | Sterols, Oxygenated Terpenes, and Other Isoprenoids | Prenylquinones | gamma-Tocopherol | New |

FIG. 6 continued

| A list of metabolite compounds present in altered levels relative to reference samples as characterized by gas chromatography, liquid chromatography, and/or mass spectrometry. This list corresponds to samples transfected with nucleic acid sequence, Seq ID#51719 | | | | |
|---|---|---|---|---|
| Seq ID | Chemical Class | Biochemical Class | Compound Name | Modification |
| 51719 | Carbohydrates | Carbohydrates | Glucose | -11% to -59% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#51843

| Seq ID | Chemical Class | Biochemical Class | Compound Name | Modification |
|---|---|---|---|---|
| 51843 | Acids - hydroxy Alpha | Carbohydrates | Galacturonic acid | -13% to -79% |
| 51843 | Carbohydrates | Carbohydrates | Galactose | -9% to -73% |
| 51843 | Carbohydrates | Carbohydrates | Mannose | -12% to -58% |
| 51843 | Carbohydrates | Carbohydrates | Rhamnose | -20% to -78% |
| 51843 | Carbohydrates | Carbohydrates | Xylose | -14% to -77% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#52689

| Seq ID | Chemical Class | Biochemical Class | Compound Name | Modification |
|--------|----------------|-------------------|---------------|--------------|
| 52689  | Carbohydrates  | Carbohydrates     | Arabinose     | NQ           |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#52817

| Seq ID | Chemical Class | Biochemical Class | Compound Name | Modification |
|---|---|---|---|---|
| 52817 | Amino Acids and Related Compounds | Amino Acids and Related Compounds | Alanine | 45% to 310% |
| 52817 | Amino Acids and Related Compounds | Amino Acids and Related Compounds | Arginine | 45% to 695% |
| 52817 | Amino Acids and Related Compounds | Amino Acids and Related Compounds | Tyrosine | 115% to 1340% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#53369

| Seq ID | Chemical Class | Biochemical Class | Compound Name | Modification |
|---|---|---|---|---|
| 53369 | Carbohydrates | Carbohydrates | Arabinose | -41% to -99% |
| 53369 | Carbohydrates | Carbohydrates | Galactose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#53376

| Seq ID | Chemical Class | Biochemical Class | Compound Name | Modification |
|---|---|---|---|---|
| 53376 | Amino Acids and Related Compounds | Amino Acids and Related Compounds | Arginine | 155% to 810% |
| 53376 | Amino Acids and Related Compounds | Amino Acids and Related Compounds | Lysine | 30% to 530% |
| 53376 | Amino Acids and Related Compounds | Amino Acids and Related Compounds | Tryptophan | 15% to 200% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#53564

| Seq ID | Chemical Class | Biochemical Class | Compound Name | Modification |
|---|---|---|---|---|
| 53564 | Carbohydrates | Carbohydrates | Glucose | -81% to -95% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57119

| Seq ID | Chemical Class | Biochemical Class | Compound Name | Modification |
|---|---|---|---|---|
| 57119 | Acids - hydroxy Alpha | Carbohydrates | Galacturonic acid | 9% to 491% |
| 57119 | Carbohydrates | Carbohydrates | Arabinose | 9% to 335% |
| 57119 | Carbohydrates | Carbohydrates | Galactose | 15% to 219% |
| 57119 | Carbohydrates | Carbohydrates | Glucose | NQ |
| 57119 | Carbohydrates | Carbohydrates | Mannose | 123% to 359% |
| 57119 | Carbohydrates | Carbohydrates | Rhamnose | 51% to 393% |
| 57119 | Carbohydrates | Carbohydrates | Xylose | 77% to 773% |

FIG. 6 continued

| Seq ID | Chemical Class | Biochemical Class | Compound Name | Modification |
|---|---|---|---|---|
| 57135 | Carbohydrates | Carbohydrates | Arabinose | -21% to -81% |
| 57135 | Carbohydrates | Carbohydrates | Mannose | 31% to 167% |

A list of metabolite compounds present in altered levels relative to reference samples as chararacterized by gas chromatography, liquid chromatography, and/or mass spectrometry. This list corresponds to samples transfected with nucleic acid sequence, Seq ID#57135

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57142

| Seq ID | Chemical Class | Biochemical Class | Compound Name | Modification |
|---|---|---|---|---|
| 57142 | Amino Acids and Related Compounds | Amino Acids and Related Compounds | Cysteine | 10% to 760% |
| 57142 | Amino Acids and Related Compounds | Amino Acids and Related Compounds | Glycine | 5% to 520% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57145

| Seq ID | Chemical Class | Biochemical Class | Compound Name | Modification |
|---|---|---|---|---|
| 57145 | Acids - Fatty | Fatty Acids and Related Waxes | Hexadecanoic acid | 22% to 53% |
| 57145 | Acids - Fatty Unsat | Fatty Acids and Related Waxes | 7,10,13-Hexadecatrienoic acid | -39% to -57% |
| 57145 | Acids - Fatty Unsat | Fatty Acids and Related Waxes | 9,12,15-Octadecatrienoic acid | -3% to -23% |
| 57145 | Acids - Fatty Unsat | Fatty Acids and Related Waxes | 9,12-Octadecadienoic acid | 1% to 48% |
| 57145 | Acids - Fatty Unsat | Fatty Acids and Related Waxes | 9-Hexadecenoic acid | 14% to 86% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57152

| Seq ID | Chemical Class | Biochemical Class | Compound Name | Modification |
|---|---|---|---|---|
| 57152 | Acids - hydroxy Alpha | Carbohydrates | Galacturonic acid | -10% to -82% |
| 57152 | Carbohydrates | Carbohydrates | Glucose | -3% to -51% |
| 57152 | Carbohydrates | Carbohydrates | Mannose | 3% to 186% |
| 57152 | Carbohydrates | Carbohydrates | Rhamnose | -1% to -72% |
| 57152 | Carbohydrates | Carbohydrates | Xylose | -21% to -85% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57165

| Seq ID | Chemical Class | Biochemical Class | Compound Name | Modification |
|---|---|---|---|---|
| 57165 | Acids - Hydroxy | Amino Acids and Related Compounds | Shikimic acid | 150% to 250% |
| 57165 | Acids - Hydroxy Alpha | Acid Pathway | Butanoic acid, 2,3,4-trihydroxy- | 674% to 1124% |
| 57165 | Acids - Hydroxy Alpha | Carbohydrates | Quinic acid | 361% to 602% |
| 57165 | Alcohols | Carbohydrates | Inositol | 68% to 113% |
| 57165 | Alkaloids and Other Bases | Polyamines | 1,4-Butanediamine | 61% to 101% |
| 57165 | Amino Acids and Related Compounds | Amino Acids and Related Compounds | Aspartic acid | 90% to 150% |
| 57165 | Amino Acids and Related Compounds | Amino Acids and Related Compounds | Proline, 5-oxo- | 103% to 171% |
| 57165 | Carbohydrates | Carbohydrates | F3-U0.848 Carbohydrate | 122% to 204% |
| 57165 | Carbohydrates | Carbohydrates | F3-U0.872 Hexose | 136% to 316% |
| 57165 | Carbohydrates | Carbohydrates | F3-U1.150 Carbohydrate | 64% to 106% |
| 57165 | Carbohydrates | Carbohydrates | Fructose | 106% to 291% |
| 57165 | Carbohydrates | Carbohydrates | Galactose or Mannose | 272% to 453% |
| 57165 | Carbohydrates | Carbohydrates | Glucose | 190% to 768% |
| 57165 | NA | NA | F3-U0.882 | 118% to 196% |
| 57165 | Phenols and Related Compounds | Phenylpropanes and Derivatives | Chlorogenic acid | 68% to 113% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57194

| Seq ID | Chemical Class | Biochemical Class | Compound Name | Modification |
|---|---|---|---|---|
| 57194 | Acids | Acids | Carbamic acid | New |
| 57194 | Acids - Hydroxy Alpha | Acid Pathway | Citric acid | 70% to 339% |
| 57194 | Acids - Hydroxy Alpha | Acid Pathway | Malic acid | 62% to 365% |
| 57194 | Alcohols | Alcohols | Glycerol | 138% to 245% |
| 57194 | Amino Acids and Related Compounds | Amino Acids and Related Compounds | Proline, 5-oxo- | 60% to 172% |
| 57194 | Carbohydrates | Carbohydrates | F3-U0.813 Carbohydrate | 106% to 177% |
| 57194 | Carbohydrates | Carbohydrates | F3-U0.816 Carbohydrate | 60% to 122% |
| 57194 | Carbohydrates | Carbohydrates | F3-U0.821 Carbohydrate | 63% to 339% |
| 57194 | Carbohydrates | Carbohydrates | F3-U0.846 Carbohydrate | 66% to 291% |
| 57194 | Carbohydrates | Carbohydrates | F3-U0.872 Hexose | 60% to 188% |
| 57194 | Carbohydrates | Carbohydrates | F3-U1.189 Carbohydrate | 73% to 141% |
| 57194 | Carbohydrates | Carbohydrates | Fructose | -60% to -79% |
| 57194 | Carbohydrates | Carbohydrates | Galactose | -60% to -80% |
| 57194 | Carbohydrates | Carbohydrates | Glucose | -60% to -80% |
| 57194 | NA | NA | F3-U0.736 | New |
| 57194 | NA | NA | F3-U0.882 | 60% to 150% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57292

| Seq ID | Chemical Class | Biochemical Class | Compound Name | Modification |
|---|---|---|---|---|
| 57292 | Acids - Fatty | Fatty Acids and Related Waxes | Eicosanoic acid | -76% to -100% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57374

| Seq ID | Chemical Class | Biochemical Class | Compound Name | Modification |
|---|---|---|---|---|
| 57374 | Acids - Fatty | Fatty Acids and Related Waxes | Eicosanoic acid | -52% to -81% |
| 57374 | Acids - Fatty | Fatty Acids and Related Waxes | Hexadecanoic acid | 5% to 19% |
| 57374 | Acids - Fatty | Fatty Acids and Related Waxes | Octadecanoic acid | -12% to -30% |
| 57374 | Acids - Fatty Branched | Fatty Acids and Related Waxes | Heptadecanoic acid, 16-methyl- | -34% to -66% |
| 57374 | Acids - Fatty Unsat | Fatty Acids and Related Waxes | 7,10,13-Hexadecatrienoic acid | 4% to 19% |
| 57374 | Acids - Fatty Unsat | Fatty Acids and Related Waxes | 9,12,15-Octadecatrienoic acid | -3% to -11% |
| 57374 | Acids - Fatty Unsat | Fatty Acids and Related Waxes | 9,12-Octadecadienoic acid | 8% to 26% |
| 57374 | Acids - Fatty Unsat | Fatty Acids and Related Waxes | 9-Octadecenoic acid | 6% to 83% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57506

| Seq ID | Chemical Class | Biochemical Class | Compound Name | Modification |
|---|---|---|---|---|
| 57506 | Acids - Hydroxy | Amino Acids and Related Compounds | Shikimic acid | -60% to -81% |
| 57506 | Acids - Hydroxy Alpha | Acid Pathway | Butanoic acid, 2,3,4-trihydroxy- | -60% to -83% |
| 57506 | Acids - Hydroxy Alpha | Acid Pathway | Citric acid | -60% to -92% |
| 57506 | Alkaloids and Other Bases | Alkaloids and Other Bases | Nicotine | 60% to 77% |
| 57506 | Amino Acids and Related Compounds | Amino Acids and Related Compounds | Aspartic acid | 68% to 113% |
| 57506 | Carbohydrates | Carbohydrates | Arabinose or Xylose | 121% to 202% |
| 57506 | Carbohydrates | Carbohydrates | F3-U0.813 Carbohydrate | NQ |
| 57506 | Carbohydrates | Carbohydrates | F3-U0.816 Carbohydrate | -60% to -81% |
| 57506 | Carbohydrates | Carbohydrates | F3-U0.821 Carbohydrate | -60% to -92% |
| 57506 | Carbohydrates | Carbohydrates | F3-U0.846 Carbohydrate | -66% to -100% |
| 57506 | Carbohydrates | Carbohydrates | F3-U0.872 Hexose | -60% to -89% |
| 57506 | Carbohydrates | Carbohydrates | F3-U1.150 Carbohydrate | -60% to -78% |
| 57506 | Carbohydrates | Carbohydrates | Galactose or Mannose | 125% to 208% |
| 57506 | NA | NA | F3-U0.882 | 60% to 85% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57510

| Seq ID | Chemical Class | Biochemical Class | Compound Name | Modification |
|---|---|---|---|---|
| 57510 | Acids - hydroxy Alpha | Carbohydrates | Galacturonic acid | 28% to 178% |
| 57510 | Carbohydrates | Carbohydrates | Arabinose | 13% to 233% |
| 57510 | Carbohydrates | Carbohydrates | Galactose | 18% to 156% |
| 57510 | Carbohydrates | Carbohydrates | Glucose | -5% to -99% |
| 57510 | Carbohydrates | Carbohydrates | Mannose | 5% to 91% |
| 57510 | Carbohydrates | Carbohydrates | Rhamnose | 20% to 184% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57702

| Seq ID | Chemical Class | Biochemical Class | Compound Name | Modification |
|---|---|---|---|---|
| 57702 | Carbohydrates | Carbohydrates | Arabinose | NQ |
| 57702 | Acids - hydroxy Alpha | Carbohydrates | Galacturonic acid | -23% to -79% |
| 57702 | Carbohydrates | Carbohydrates | Rhamnose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57707

| Seq ID | Chemical Class | Biochemical Class | Compound Name | Modification |
|---|---|---|---|---|
| 57707 | Acids - hydroxy Alpha | Carbohydrates | Galacturonic acid | -44% to -85% |
| 57707 | Carbohydrates | Carbohydrates | Galactose | -9% to -84% |
| 57707 | Carbohydrates | Carbohydrates | Glucose | 8% to 83% |
| 57707 | Carbohydrates | Carbohydrates | Mannose | -52% to -67% |
| 57707 | Carbohydrates | Carbohydrates | Rhamnose | -55% to -83% |
| 57707 | Carbohydrates | Carbohydrates | Xylose | -2% to -94% |

FIG. 6 continued

| Seq ID | Chemical Class | Biochemical Class | Compound Name | Modification |
|---|---|---|---|---|
| 57708 | Acids | Acids | Carbamic acid | New |
| 57708 | Acids - Hydroxy Alpha | Acid Pathway | Citric acid | NQ |
| 57708 | Acids - Hydroxy Alpha | Carbohydrates | Galacturonic acid | -61% to -84% |
| 57708 | Acids - Hydroxy Alpha | Acid Pathway | Malic acid | NQ |
| 57708 | Alcohols | Carbohydrates | Inositol | 354% to 590% |
| 57708 | Carbohydrates | Carbohydrates | Arabinose | -60% to -78% |
| 57708 | Carbohydrates | Carbohydrates | F3-U0.781 Carbohydrate | New |
| 57708 | Carbohydrates | Carbohydrates | F3-U0.821 Carbohydrate | NQ |
| 57708 | Carbohydrates | Carbohydrates | F3-U0.872 Hexose | 186% to 310% |
| 57708 | Carbohydrates | Carbohydrates | F3-U0.891 Carbohydrate | New |
| 57708 | Carbohydrates | Carbohydrates | F3-U0.907 Carbohydrate | New |
| 57708 | Carbohydrates | Carbohydrates | F3-U1.010 Carbohydrate | New |
| 57708 | Carbohydrates | Carbohydrates | F3-U1.065 Carbohydrate | New |
| 57708 | Carbohydrates | Carbohydrates | F3-U1.189 Carbohydrate | 68% to 214% |
| 57708 | Carbohydrates | Carbohydrates | Fructose | 251% to 547% |
| 57708 | Carbohydrates | Carbohydrates | Galactose | -60% to -78% |
| 57708 | Carbohydrates | Carbohydrates | Galactose or Mannose | 81% to 324% |
| 57708 | Carbohydrates | Carbohydrates | Glucose | 86% to 685% |
| 57708 | Carbohydrates | Carbohydrates | Rhamnose | -60% to -81% |
| 57708 | Carbohydrates | Carbohydrates | Xylose | -60% to -97% |
| 57708 | NA | NA | F3-U0.736 | New |
| 57708 | NA | NA | F3-U0.748 | New |
| 57708 | NA | NA | F3-U0.882 | 195% to 682% |
| 57708 | NA | NA | F3-U1.136 | New |
| 57708 | NA | NA | F3-U1.172 | New |
| 57708 | Phenols and Related Compounds | Phenylpropanes and Derivatives | Chlorogenic acid | NQ |

A list of metabolite compounds present in altered levels relative to reference samples as chararacterized by gas chromatography, liquid chromatography, and/or mass spectrometry. This list corresponds to samples transfected with nucleic acid sequence, Seq ID#57708

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57744

| Seq ID | Chemical Class | Biochemical Class | Compound Name | Modification |
|---|---|---|---|---|
| 57744 | Amino Acids and Related Compounds | Amino Acids and Related Compounds | Alanine | New |
| 57744 | Amino Acids and Related Compounds | Amino Acids and Related Compounds | Arginine | New |
| 57744 | Amino Acids and Related Compounds | Amino Acids and Related Compounds | Cysteine | New |
| 57744 | Amino Acids and Related Compounds | Amino Acids and Related Compounds | Glutamic acid | New |
| 57744 | Amino Acids and Related Compounds | Amino Acids and Related Compounds | Glycine | New |
| 57744 | Amino Acids and Related Compounds | Amino Acids and Related Compounds | Leucine | New |
| 57744 | Amino Acids and Related Compounds | Amino Acids and Related Compounds | Lysine | New |
| 57744 | Amino Acids and Related Compounds | Amino Acids and Related Compounds | Methionine | New |
| 57744 | Amino Acids and Related Compounds | Amino Acids and Related Compounds | Serine | New |
| 57744 | Amino Acids and Related Compounds | Amino Acids and Related Compounds | Threonine | New |
| 57744 | Amino Acids and Related Compounds | Amino Acids and Related Compounds | Tyrosine | New |
| 57744 | Amino Acids and Related Compounds | Amino Acids and Related Compounds | Valine | New |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#57804

| Seq ID | Chemical Class | Biochemical Class | Compound Name | Modification |
|---|---|---|---|---|
| 57804 | Acids - hydroxy Alpha | Carbohydrates | Galacturonic acid | -26% to -87% |
| 57804 | Carbohydrates | Carbohydrates | Arabinose | -47% to -92% |
| 57804 | Carbohydrates | Carbohydrates | Galactose | -39% to -80% |
| 57804 | Carbohydrates | Carbohydrates | Glucose | 4% to 115% |
| 57804 | Carbohydrates | Carbohydrates | Mannose | -16% to -89% |
| 57804 | Carbohydrates | Carbohydrates | Rhamnose | -52% to -84% |
| 57804 | Carbohydrates | Carbohydrates | Xylose | -6% to -86% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#6025 | | | | |
|---|---|---|---|---|
| Seq ID | Chemical Class | Biochemical Class | Compound Name | Modification |
| 6025 | Carbohydrates | Carbohydrates | Glucose | -35% to -71% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#6153

| Seq ID | Chemical Class | Biochemical Class | Compound Name | Modification |
|---|---|---|---|---|
| 6153 | Carbohydrates | Carbohydrates | Glucose | -27% to -99% |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#6198

| Seq ID | Chemical Class | Biochemical Class | Compound Name | Modification |
|---|---|---|---|---|
| 6198 | Carbohydrates | Carbohydrates | Arabinose | NQ |
| 6198 | Carbohydrates | Carbohydrates | Rhamnose | NQ |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#6437 | | | | |
|---|---|---|---|---|
| Seq ID | Chemical Class | Biochemical Class | Compound Name | Modification |
| 6437 | Carbohydrates | Carbohydrates | Rhamnose | NQ |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#6477

| Seq ID | Chemical Class | Biochemical Class | Compound Name | Modification |
|---|---|---|---|---|
| 6477 | Carbohydrates | Carbohydrates | Glucose | -37% to -71% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#6606 | | | | |
|---|---|---|---|---|
| Seq ID | Chemical Class | Biochemical Class | Compound Name | Modification |
| 6606 | Carbohydrates | Carbohydrates | Arabinose | -43% to -93% |
| 6606 | Carbohydrates | Carbohydrates | Glucose | -9% to -67% |

FIG. 6 continued

| A list of metabolite compounds present in altered levels relative to reference samples as chararacterized by gas chromatography, liquid chromatography, and/or mass spectrometry. This list corresponds to samples transfected with nucleic acid sequence, Seq ID#6681 | | | |
|---|---|---|---|
| Seq ID | Chemical Class | Biochemical Class | Compound Name | Modification |
| 6681 | Carbohydrates | Carbohydrates | Arabinose | 5% to 707% |
| 6681 | Carbohydrates | Carbohydrates | Glucose | NQ |

FIG. 6 continued

A list of metabolite compounds present in altered levels relative to reference samples as characterized by gas chromatography, liquid chromatography, and/or mass spectrometry. This list corresponds to samples transfected with nucleic acid sequence, Seq ID#6682

| Seq ID | Chemical Class | Biochemical Class | Compound Name | Modification |
|---|---|---|---|---|
| 6682 | Acids - hydroxy Alpha | Carbohydrates | Galacturonic acid | 27% to 253% |
| 6682 | Carbohydrates | Carbohydrates | Arabinose | 7% to 556% |
| 6682 | Carbohydrates | Carbohydrates | Galactose | 31% to 337% |
| 6682 | Carbohydrates | Carbohydrates | Glucose | NQ |
| 6682 | Carbohydrates | Carbohydrates | Mannose | 1% to 337% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#6686

| Seq ID | Chemical Class | Biochemical Class | Compound Name | Modification |
|---|---|---|---|---|
| 6686 | Carbohydrates | Carbohydrates | Arabinose | NQ |
| 6686 | Acids - hydroxy Alpha | Carbohydrates | Galacturonic acid | 205% to 1585% |
| 6686 | Carbohydrates | Carbohydrates | Glucose | -93% to -97% |
| 6686 | Carbohydrates | Carbohydrates | Rhamnose | NQ |
| 6686 | Carbohydrates | Carbohydrates | Xylose | 197% to 1129% |

FIG. 6 continued

A list of metabolite compounds present in altered levels relative to reference samples as charararacterized by gas chromatography, liquid chromatography, and/or mass spectrometry. This list corresponds to samples transfected with nucleic acid sequence, Seq ID#6717

| Seq ID | Chemical Class | Biochemical Class | Compound Name | Modification |
|---|---|---|---|---|
| 6717 | Acids - hydroxy Alpha | Carbohydrates | Galacturonic acid | 523% to 3347% |
| 6717 | Carbohydrates | Carbohydrates | Glucose | -35% to -97% |
| 6717 | Carbohydrates | Carbohydrates | Rhamnose | 62% to 505% |
| 6717 | Carbohydrates | Carbohydrates | Xylose | 5% to 426% |

FIG. 6 continued

A list of metabolite compounds present in altered levels relative to reference samples as chararacterized by gas chromatography, liquid chromatography, and/or mass spectrometry. This list corresponds to samples transfected with nucleic acid sequence, Seq ID#7393

| Seq ID | Chemical Class | Biochemical Class | Compound Name | Modification |
|---|---|---|---|---|
| 7393 | Acids - hydroxy Alpha | Carbohydrates | Galacturonic acid | 49% to 515% |
| 7393 | Carbohydrates | Carbohydrates | Arabinose | 7% to 691% |
| 7393 | Carbohydrates | Carbohydrates | Glucose | -11% to -99% |
| 7393 | Carbohydrates | Carbohydrates | Rhamnose | 27% to 371% |

FIG. 6 continued

A list of metabolite compounds present in altered levels relative to reference samples as chararacterized by gas chromatography and mass spectrometry. This list corresponds to samples transfected with nucleic acid sequence, Seq ID#48674

| Seq ID | Chemical Class | Biochemical Class | Compound Name | Modification |
|--------|----------------|-------------------|---------------|--------------|
| 48674 | Carbohydrates | Carbohydrates | Arabinose | 187% to 2683% |
| 48674 | Carbohydrates | Carbohydrates | Glucose | -66% to -77% |
| 48674 | Carbohydrates | Carbohydrates | Rhamnose | 5% to 233% |
| 48674 | Carbohydrates | Carbohydrates | Xylose | 43% to 537% |

FIG. 6 continued

FIG. 7A
GC/FID Conditions for the Analysis of Tobacco Metabolites in Fraction 1

Column:          Chrompack CPSil 8CB, 50 m x 0.32 mm i.d. with 0.25 micron film thickness

Oven
Equilibration Time:    0.50 minute
Initial Temperature:    50°C          Initial Time:        3.0 minutes

| Ramps: | Rate (°C/min) | Final Temp(°C) | Final Time (min.) |
|---|---|---|---|
| #1 | 30 | 250 | 0.00 |
| #2 | 25 | 340 | 5.50 |
| #3 | 0 | | |

Front and Back Inlet
Mode:            Split               Initial Temperature:    250°C
Pressure:          15 psig             Split Ratio:           5:1
Split Flow:        23.7 mL/min       Total Flow:           35.2 mL/min
Gas Saver:         Off                  Gas:                   Hydrogen
Mode:            Ramped pressure
Initial Pressure:    15 psig             Initial Time:      0.0 minutes

| Rate (psig/min) | Final Pres. (psig) | Final Time (min.) |
|---|---|---|
| 5 | 40 | 10.0 |
| 10 | 50 | 3.0 |

Post Pressure:      15 psig
Nominal Initial Flow:   4.7 mL/min        Average velocity:       68 cm/sec

Detector (Flame Ionization Detector; FID)
Temperature:      350°C            Hydrogen Flow:        40.0 mL/min
Air Flow:           400 mL/min       Mode:                 Constant column flow
Makeup Flow:      25.0 mL/min      Makeup Gas Type:       Nitrogen Electrometer:      On                  Lit offset:             2.0
Flame:              On                  Signal Data Rate:       10 Hz
Zero:                0                    Range:                 0
Fast Peaks:        Off                Attenuation:        0

APEX Injector
Injector Mode Program

| | Mode | Front Minutes | Back Minutes |
|---|---|---|---|
| Initial | GC Split | 0.00 | 0.00 |
| 1 | Splitless | 0.20 | 1.25 |
| 2 | Prosep Split | 45.00 | 6.00 |
| 3 | GC Split | 6.00 | 8.00 |

Precolumn Temperature Program

| Rate (C/min) | Target (C) | Front Minutes | Back Minutes |
|---|---|---|---|
| | 50 | 0.20 | 1.20 |
| 150 | 400 | 17.00 | 16.50 |

FIG. 7B
GC/FID Conditions for the Analysis of Tobacco Metabolites in Fraction 2

| | |
|---|---|
| Liners: | Restek split/splitless single-taper liner 4 mm i.d (borosilicate) without silanized glass wool. |
| Column: | DB23 from J & W, 15 m x 0.25 mm i.d. with 0.15 micron film thickness |

Oven

| | | | |
|---|---|---|---|
| Equilibration Time: | 0.1 minute | | |
| Initial Temperature: | 70°C | Initial Time: | 2.15 minutes |

| Ramps: | Rate (°C/min) | Final Temp(°C) | Final Time (min.) |
|---|---|---|---|
| #1 | 25 | 170 | 0.00 |
| #2 | 10 | 220 | 1.15 |

| | |
|---|---|
| Dual injection mode: | Start program with front injection. |

Front Inlet

| | | | |
|---|---|---|---|
| Mode: | Splitless | Temperature: | 230°C |
| Pressure: | 12.9 psi | Split Ratio: | NA |
| Split vent | time: 1.00 min | Flow: 35 mL/min | |
| Gas Saver: | On (5 minutes) | Flow: 20 mL/min | |
| Gas: | Helium | | |
| Mode: | 2 mL/min constant flow | | |
| Total Flow: | 24.5 mL/min | Average velocity: 53 cm/sec | |

Back Inlet

| | | | |
|---|---|---|---|
| Mode: | Splitless | Temperature: | 230°C |
| Pressure: | 12.9 psi | Split Ratio: | NA |
| Split vent | time: 2.15 min | Flow: 35 mL/min | |
| Gas Saver: | On (5 minutes) | Flow: 20 mL/min | |
| Gas: | Helium | | |
| Mode: | 2 mL/min constant flow | | |
| Total Flow: | 24.5 mL/min | Average velocity: 53 cm/sec | |

Detectors (Flame Ionization Detector; FID)

| | | | |
|---|---|---|---|
| Temperature: | 240°C | Hydrogen Flow: | 40.0 mL/min |
| Air Flow: | 400 mL/min | Mode: | Constant column flow |
| Makeup Flow: | 25.0 mL/min | Makeup Gas Type: | Nitrogen |
| Electrometer: | On | Lit offset: | 2.0 |
| Flame: | On | Signal Data Rate: | 10 Hz |
| Zero: | 0 | Range: | 0 |
| Fast Peaks: | Off | Attenuation: | 0 |

FIG. 7C
GC/FID Conditions for the Analysis of Tobacco Metabolites in Fraction 3

| Column: | Chrompack CPSil 8CB, 50 m x 0.32 mm i.d. with 0.25 micron film thickness |
|---|---|

Oven
Equilibration Time: 1 minute
Initial Temperature: 50°C          Initial Time:          2.0 minutes

| Ramps: | Rate (°C/min) | Final Temp(°C) | Final Time (min.) |
|---|---|---|---|
| #1 | 30 | 250 | 0.00 |
| #2 | 25 | 325 | 3.00 |
| #3 | 0 | | |

Front and Back Inlet
| Mode: | Split | Initial Temperature: | 290°C |
|---|---|---|---|
| Pressure: | 15 psig | Split Ratio: | 5:1 |
| Split Flow: | 23.7 mL/min | Total Flow: | 35.2 mL/min |
| Gas Saver: | Off | Gas: | Hydrogen |
| Mode: | Ramped pressure | | |
| Initial Pressure: | 15 psig | Initial Time: | 0.0 minutes |

| Rate (psig/min) | Final Pres. (psig) | Final Time (min.) |
|---|---|---|
| 5 | 40 | 10.0 |

Post Pressure:      15 psig
Nominal Initial Flow:   4.7 mL/min          Average velocity:        68 cm/sec

Detector (Flame Ionization Detector; FID)
| Temperature: | 350°C | Hydrogen Flow: | 40.0 mL/min |
|---|---|---|---|
| Air Flow: | 400 mL/min | Mode: | Constant column+makeup |
| Combined Flow: | 20 mL/min | Makeup Flow: | 25.0 mL/min |
| Makeup Gas Type: | Nitrogen | | |

| Electrometer: | On | Lit offset: | 2.0 |
|---|---|---|---|
| Flame: | On | Signal Data Rate: | 20 Hz |
| Zero: | 0 | Range: | 0 |
| Fast Peaks: | Off | Attenuation: | 0 |

APEX Injector
Inj Volume:      2.5 ul
Injector Mode Program

| | Mode | Front Minutes | Back Minutes |
|---|---|---|---|
| Initial | | | |
| 1 | Splitless | 0.00 | 0.00 |
| 3 | GC Split | 5.00 | 5.00 |

Precolumn Temperature Program

| Rate (C/min) | Target (C) | Front Minutes | Back Minutes |
|---|---|---|---|
| | 100 | 0.80 | 0.87 |
| 300 | 400 | 10.00 | 10.00 |

FIG. 7D
LC/FLD Parameters for the Analysis of Tobacco Metabolites in Fraction 4

Column: Aminoquant Hypersil ODS 5-μm column (200 mm x 2.1 mm)
Guard Column: Hypersil ODS 5 μm (20 mm x 2.1 mm)
Column Temperature: 45 °C Agilent 1100 Binary Pump Program Mobile Phase A: Aqueous Acetate Buffer pH7.2 containing EDTA (4ug/mL), triethylamine (0.18uL/mL), THF (0.3%) (v:v)
Mobile Phase B: Aqueous Acetate Buffer pH7.2:methanol:acetonitrile (2:4:4) (v:v:v)
Pump Program

| Time (min) | % B | Flow (mL) |
|---|---|---|
| 0.0 | 0 | 0.6 |
| 9.5 | 60 | 0.6 |
| 10 | 100 | 0.6 |
| 10.5 | 100 | 1.1 |
| 13.1 | 100 | 0.6 |
| 14 | 0 | 0.6 |

Agilent 1100 Autosampler Program

Step 1. Draw 5 uL borate buffer
Step 2. Draw 1 uL OPA reagent
Step 3. Draw 0 uL water (Needle Wash)
Step 4. Draw 1 uL sample
Step 5. Mix 7 uL air 5 times
Step 6. Draw 0 uL water (Needle Wash)
Step 7. Draw 1 uL FMOC reagent
Step 8. Draw 0 uL water (Needle Wash)
Step 9. Draw 1 uL borate buffer
Step 10. Mix 9 uL air 3 times
Step 11. Inject Agilent 1100 Fluorescent Detector Time 0.0
    Excitation: 340 nm
    Emission: 450 nm
    PMT Gain: 10
Time 9.6 min
    Excitation: 266 nm
    Emission: 305 nm
    PMT Gain: 8

A list of Seq. IDs determined to modify metabolites observed in the neutral fraction of non-polar compounds. The neutral fraction is comprised of, but not limited to, hydrocarbons, long chain alcohols, sesquiterpenes, diterpenes, sterols, waxes, and sometimes branched and long chain fatty acid esters. The observed modifications are based exclusively upon a pattern recognition automated data analysis (ADA) technique. Details pertaining to the ADA technique can be found in Example 14, "*Metabolic Screens*", Section G, "*Data Analysis and Hit Detection*".

| Fraction 1 Seq IDs |
|---|
| 111230 |
| 119915 |
| 119938 |
| 134744 |
| 167515 |
| 168353 |
| 182002 |
| 200617 |
| 200619 |
| 212363 |
| 213126 |
| 213131 |
| 213169 |
| 213963 |
| 214291 |
| 214345 |
| 214367 |
| 215032 |
| 215043 |
| 215308 |
| 215494 |
| 215665 |
| 215737 |
| 215772 |
| 215781 |
| 215952 |
| 216050 |
| 216180 |
| 216302 |
| 216450 |

FIG. 8

A list of Seq. IDs determined to modify metabolites observed in the fatty acid fraction. The fatty acid fraction is comprised of, but not limited to, saturated, unsaturated, polyunsaturated, branched and other unusual fatty acids. The observed modifications are based exclusively upon a pattern recognition automated data analysis (ADA) technique. Details pertaining to the ADA technique can be found in Example 14, "*Metabolic Screens*", Section G, "*Data Analysis and Hit Detection*".

| Fraction 2 Seq IDs |
|---|
| 111230 |
| 130504 |
| 130680 |
| 131378 |
| 200860 |
| 212871 |
| 212883 |
| 213120 |
| 213131 |
| 213171 |
| 213377 |
| 215085 |
| 215194 |
| 215669 |
| 215806 |
| 215980 |
| 216053 |
| 216068 |
| 216455 |
| 216488 |
| 218813 |
| 263182 |
| 263191 |
| 263194 |
| 263617 |

FIG. 8 continued

A list of Seq. IDs determined to modify metabolites observed in the aqueous fraction. The aqueous fraction are water soluble compounds comprised of, but not limited to, sugars, sugar acids and alcohols, carboxylic acids, alcohols, amino acids, and amines. The observed modifications are based exclusively upon a pattern recognition automated data analysis (ADA) technique. Details pertaining to the ADA technique can be found in Example 14, "*Metabolic Screens*", Section G, "*Data Analysis and Hit Detection*".

| Fraction 3 Seq IDs | | |
|---|---|---|
| 135016 | 214643 | 216150 |
| 167151 | 215995 | 216152 |
| 213013 | 216109 | 216160 |
| 213806 | 215995 | 216180 |
| 213911 | 213356 | 216187 |
| 213963 | 215601 | 216211 |
| 214067 | 215655 | 216213 |
| 214267 | 215661 | 216219 |
| 214502 | 215670 | 216223 |
| 214547 | 215676 | 216234 |
| 214902 | 215692 | 216256 |
| 214908 | 215772 | 216283 |
| 214942 | 215807 | 216302 |
| 215009 | 215813 | 216318 |
| 215023 | 215823 | 216329 |
| 215024 | 215825 | 216338 |
| 215032 | 215827 | 216347 |
| 215043 | 215830 | 216355 |
| 215048 | 215863 | 216357 |
| 215060 | 215872 | 216358 |
| 215085 | 215880 | 216362 |
| 215108 | 215888 | 216365 |
| 215110 | 215929 | 216403 |
| 215114 | 215935 | 216408 |
| 215116 | 215952 | 216427 |
| 215120 | 215953 | 216438 |
| 215124 | 216004 | 216455 |
| 215138 | 216005 | 216461 |
| 215139 | 216006 | 216471 |
| 215148 | 216009 | 216474 |
| 215308 | 216010 | 216488 |
| 215360 | 216018 | 216489 |
| 215369 | 216020 | 216492 |
| 215387 | 216068 | 216495 |
| 215420 | 216072 | 218801 |
| 215422 | 216087 | 263194 |
| 215445 | 216090 | 263617 |

FIG. 8 continued

| Fraction 3 Seq IDs | | |
|---|---|---|
| 215459 | 216105 | 316828 |
| 215474 | 216107 | 316835 |
| 215516 | 216136 | |
| 215566 | 216147 | |

A list of Seq. IDs determined to modify metabolites observed in the amino acid fraction. The amino acid fraction is comprised of, but not limited to, free amino acid compounds. The observed modifications are based exclusively upon a pattern recognition automated data analysis (ADA) technique. Details pertaining to the ADA technique can be found in Example 14, *"Metabolic Screens"*, Section G, *"Data Analysis and Hit Detection"*.

| Fraction 4 Seq IDs |
|---|
| 21466 |
| 57319 |
| 119938 |
| 121146 |
| 124883 |
| 131361 |
| 182002 |
| 200605 |
| 200630 |
| 212990 |
| 213169 |
| 213749 |
| 214342 |
| 216112 |
| 216362 |
| 259018 |
| 263078 |
| 263136 |

FIG. 8 continued

| Homolog Seq Ids:996 (258970) and 998 (258996) | | | |
|---|---|---|---|
| Chemical Class | Biochemical Class | Compound Name | Modification |
| Amino Acids and Related Compounds | Amino Acids and Related Compounds | Glutamic acid | Up-regulated |
| Carbohydrates | Carbohydrates | F3-U0.848 Carbohydrate | Up-regulated |
| Carbohydrates | Carbohydrates | Fructose | Up-regulated |
| Carbohydrates | Carbohydrates | Glucose | Up-regulated |

| Homolog Seq Ids:1118 (316924) and 1093 (263679) | | | |
|---|---|---|---|
| Chemical Class | Biochemical Class | Compound Name | Modification |
| Amino Acids and Related Compounds | Amino Acids and Related Compounds | Glutamic acid | Up-regulated |
| Amino Acids and Related Compounds | Amino Acids and Related Compounds | Cysteine | Up-regulated |
| Amino Acids and Related Compounds | Amino Acids and Related Compounds | Tyrosine | Up-regulated |
| Alkenes and Alkynes | Terpenoids | Limonene | Up-regulated |
| Sterols, Oxygenated Terpenes, and other Isoprenoids | Prenylquinones | alpha-Tocopherol hydroquinone | Up-regulated |
| Sterols, Oxygenated Terpenes, and other Isoprenoids | Prenylquinones | beta-Tocopherol | Up-regulated |
| Sterols, Oxygenated Terpenes, and other Isoprenoids | Terpenoids | Campesterol | Up-regulated |
| Sterols, Oxygenated Terpenes, and other Isoprenoids | Terpenoids | Stigmasterol | Up-regulated |
| Sterols, Oxygenated Terpenes, and other Isoprenoids | Terpenoids | beta-Sitosterol | Up-regulated |
| Esters | Fatty Acids and Related Waxes | 2-Octadecanoyl-1-acetylglycerol | Up-regulated |
| Esters | Fatty Acids and Related Waxes | 2-Eicosanoyl-1-acetylglycerol | Up-regulated |

FIG. 9

| Homolog Seq Ids: 1022 (263030) and 164 (114161) | | | |
|---|---|---|---|
| Chemical Class | Biochemical Class | Compound Name | Modification |
| Alkenes and Alkynes | Terpenoids | Limonene | Up-regulated |
| Sterols, Oxygenated Terpenes, and other Isoprenoids | Terpenoids | Campesterol | Up-regulated |
| Sterols, Oxygenated Terpenes, and other Isoprenoids | Terpenoids | Stigmasterol | Up-regulated |
| Sterols, Oxygenated Terpenes, and other Isoprenoids | Terpenoids | beta-Sitosterol | Up-regulated |

| Homolog Seq Ids: 1045 (263180) and 1028 (263060) | | | |
|---|---|---|---|
| Chemical Class | Biochemical Class | Compound Name | Modification |
| Amino Acids and Related Compounds | Amino Acids and Related Compounds | Glutamic acid | Up-regulated |
| Amino Acids and Related Compounds | Amino Acids and Related Compounds | Leucine | Up-regulated |
| Amino Acids and Related Compounds | Amino Acids and Related Compounds | Lysine | Up-regulated |
| Amino Acids and Related Compounds | Amino Acids and Related Compounds | Serine | Up-regulated |
| Amino Acids and Related Compounds | Amino Acids and Related Compounds | Valine | Up-regulated |

FIG. 9 continued

| Homolog Seq Ids: 1126 (316976) and 1044 (263177) | | | |
|---|---|---|---|
| Chemical Class | Biochemical Class | Compound Name | Modification |
| Amino Acids and Related Compounds | Amino Acids and Related Compounds | Asparagine | Up-regulated |
| Amino Acids and Related Compounds | Amino Acids and Related Compounds | Tyrosine | Up-regulated |
| Amino Acids and Related Compounds | Amino Acids and Related Compounds | Leucine | Up-regulated |
| Amino Acids and Related Compounds | Amino Acids and Related Compounds | Methionine | Up-regulated |
| Amino Acids and Related Compounds | Amino Acids and Related Compounds | Valine | Up-regulated |
| Amino Acids and Related Compounds | Amino Acids and Related Compounds | Threonine | Up-regulated |
| Amino Acids and Related Compounds | Amino Acids and Related Compounds | Tryptophane | Up-regulated |
| Amino Acids and Related Compounds | Amino Acids and Related Compounds | Isoleucine | Up-regulated |
| Amino Acids and Related Compounds | Amino Acids and Related Compounds | Arginine | Up-regulated |
| Acids – Hydroxy Alpha | Acid Pathway | Citric acid | Up-regulated |

| Homolog Seq Ids: 1074 (263329) and 154 (111139) | | | |
|---|---|---|---|
| Chemical Class | Biochemical Class | Compound Name | Modification |
| Amino Acids and Related Compounds | Amino Acids and Related Compounds | Glutamic acid | Up-regulated |
| Amino Acids and Related Compounds | Amino Acids and Related Compounds | Leucine | Up-regulated |
| Amino Acids and Related Compounds | Amino Acids and Related Compounds | Valine | Up-regulated |
| Amino Acids and Related Compounds | Amino Acids and Related Compounds | Threonine | Up-regulated |

| Homolog Seq Ids: 1125 (316974) and 1122 (316944) | | | |
|---|---|---|---|
| Chemical Class | Biochemical Class | Compound Name | Modification |
| Sterols, Oxygenated Terpenes, and other Isoprenoids | Prenylquinones | alpha-Tocopherol | Up-regulated |
| Sterols, Oxygenated Terpenes, and other Isoprenoids | Terpenoids | Stigmasterol | Up-regulated |
| Ester | Fatty Acids and Related Waxes | 2-Octadecanoyl-1-acetylglycerol | Up-regulated |
| Ester | Fatty Acids and Related Waxes | 2-Eicosanoyl-1-acetylglycerol | Up-regulated |

NUCLEIC ACID COMPOSITIONS CONFERRING ALTERED METABOLIC CHARACTERISTICS

FIELD OF THE INVENTION

This invention relates to deoxyribonucleic acid (DNA) and amino acid sequences that confer altered metabolic characteristics in plants.

BACKGROUND OF THE INVENTION

Plants are photosynthetic organisms able to fix inorganic carbon ($CO_2$) in organic matter via energy from light and minerals contained in water. All carbons fixed primarily via the pentose/triose phosphate cycle are converted in numerous anabolic pathways necessary to sustain life (primary metabolism). To survive plants must adapt to their environment and synthesize an extremely wide range of organic compounds required to interact with the elements of their microenvironment (secondary metabolism). To capture the biochemical diversity of this particular kingdom both primary and secondary metabolism have to be taken into account. The primary metabolism is represented by the biosynthesis of building blocks of macromolecules such as amino acids, fatty acids, carbohydrates, and sterols.

Each of these groups of compounds is of economic importance. Fatty acids can also be used as a raw material for industrial applications in a variety of products, including soaps, lubricants, paints, detergents, adhesives, and plasticizers. Furthermore, fatty acids are the major components of edible oils. For example, fatty acid compounds are involved in building blocks for protection (cell membrane, epicuticular polymers), storage of energy in the plant seeds and as secondary messengers in the plant cell. As another example, carbohydrates are intermediates in the biosynthesis of energy reserves (starch, cellulose) and building blocks of the cell wall giving the plant shape and structure. The carbohydrates are the carbon skeletons of many biosynthetic reactions. As such, the ability to alter carbohydrate metabolism could lead to many improvements in plants, including increased transport and accumulation of starch by accumulation of hexose phosphate that could improve starch yield in the seed and the plant; alterations in the cell wall for better resistance to pest and drought; better digestibility for forage plants; and better processivity for pulp production in paper industry (e.g., less lignin and hemicellulose).

The advent of modern biology, particularly molecular biology and genetics, has opened up new avenues for altering the production of compounds of economic importance by plants. Scientists have focused on utilizing recombinant DNA (rDNA) methods, that allow new varieties of plants to be produced much faster than by conventional breeding. rDNA techniques allow the introduction of genes from distantly related species or even from different biological kingdoms into crop plants, conferring traits that provide significant agronomic advantages. Furthermore, detailed knowledge of the traits being introduced, such as cellular function and localization, can lead to less variability in offspring, and fine-tuning of secondary effects (e.g., permitting variation from what is customarily observed). After a trait has been introduced into a plant by transgenic methods, conventional breeding can be used to hybridize the transgenic line with useful varieties and elite germplasms, resulting in crops containing numerous advantageous properties.

Most efforts to engineer plants with specific traits thus far have been based on the rational design paradigm of transforming a plant with a gene of known function with the intent of introducing a known trait. As agricultural biotechnology hurtles into the genomics and post-genomics era, the massive amounts of genetic and functional data being generated are being used to direct the search for genes that can be utilized with recombinant methods. However, if the use of this information is limited to the rational design paradigm, the identification of genes with truly profound effects on the production of desired compounds by plants could be extremely time-consuming and slow.

Accordingly, what is needed in the art are methods for rapidly screening and identifying gene sequences and polypeptide sequences of previously unknown function whose expression causes altered metabolic characteristics in biological systems, including, but not limited to, plants.

SUMMARY OF THE INVENTION

This invention relates to deoxyribonucleic acid (DNA) and amino acid sequences that confer altered metabolic characteristics in plants. In some embodiments, the present invention provides polynucleotides and polypeptides that confer altered metabolic characteristics when expressed in plants. The present invention is not limited to the alteration of amounts or levels of any particular metabolite. Indeed, the alteration of the levels or amounts of a variety of metabolites is contemplated, including, but not limited to acids, fatty acids, amino acids, hydroxy fatty acids, branched fatty acids, carbohydrates, hydrocarbons, glycerides, phenols, strerols, oxygenated terpenes, and other isoprenoids, alcohols, alkenes and alkynes. The present invention is not limited to any particular polypeptide or polynucleotide sequences that confer altered metabolic characteristics. Indeed, a variety of such sequences are contemplated. Accordingly, in some embodiments the present invention provides an isolated nucleic acid selected from the group consisting of SEQ ID NOs: 1-7554 and nucleic acid sequences that hybridize to any thereof under conditions of low stringency, wherein expression of the isolated nucleic acid in a plant results in a altered metabolic characteristic.

In some embodiments, the present invention provides an isolated nucleic acid selected from SEQ ID NOs: 162, 212, 3781, 3970, 3990, 492, 3796, 3975, and 4028, wherein expression of the nucleic acid in a plant results in altered acid metabolism. In other embodiments, the present invention provides an isolated nucleic acid selected from SEQ ID NOs: 4049, 210, 4045, 229, 3825, 4015, 3835, 4039, 1048 and 1106, wherein expression the nucleic acid in a plant results in altered alcohol metabolism. In still other embodiments, the present invention provides an isolated nucleic acid selected from SEQ ID NOs: 7548, 283, 3957, 3734, 3739, 3797, 7516, 3762, 4020 and 1062, wherein expression of the nucleic acid in a plant results in altered fatty acid metabolism. In further embodiments, the present invention provides an isolated nucleic acid of selected from SEQ ID NOs: 1148, 4147, 273, 281, 299, 3920, 450, 7463 and 4074, wherein expression of the nucleic acid in a plant results in altered branched fatty acid metabolism.

In still further embodiments, the present invention provides an isolated nucleic acid selected from SEQ ID NOs: 258, 456, 3859, 3817, 4018, 3848, 3862, 4008 and 1000, wherein expression of the nucleic acid in a plant results in altered alkaloid or other base metabolism. In some embodiments, the present invention provides an isolated nucleic acid selected from SEQ ID NOs: 372, 3714, 3717, 3963, 3775, 3757, 7462, 3743, 3744 and 7480, wherein expression of the nucleic acid in a plant results in altered amino acid metabolism.

In some other embodiments, the present invention provides an isolated nucleic acid selected from SEQ ID NOs: 7404, 180, 181, 225, 231, 366, 3983, 3833, 1121 and 1062, wherein expression of the nucleic acid in a plant results in altered ester metabolism. In some further embodiments, the present invention provides an isolated nucleic acid selected from SEQ ID NOs: 3773, 583, 3821, 7403, 988, 1002, 1007 and 1129, wherein expression of the nucleic acid in a plant results in altered glyceride metabolism. In still other embodiments, the present invention provides an isolated nucleic acid selected from SEQ ID NOs: 150, 7410, 175, 7553, 619, 1078, 1122 and 1124, wherein expression of the nucleic acid in a plant results in altered phenolic compound metabolism.

In further embodiments, the present invention provides an isolated nucleic acid selected from SEQ ID NOs: 3891, 7545, 7551, 4121, 157, 159, 7411, 3792, 3799 and 3997, wherein expression of the nucleic acid in a plant results in altered carbohydrate metabolism. In other embodiments, the present invention provides an isolated nucleic acid selected from SEQ ID NOs: 7405, 7406, 173, 183, 220, 227, 3778, 3803, 3847 and 1005, wherein expression of the nucleic acid in a plant results in altered sterol, oxygenated terpene, or isoprenoid metabolism. In still other embodiments, the present invention provides an isolated nucleic acid selected from SEQ ID NOs: 7408, 351, 378, 3864, 4103, 996, 1006 and 1098, wherein expression of the nucleic acid in a plant results in altered alkene or alkyne metabolism.

In further embodiments, the present invention provides an isolated nucleic acid selected from SEQ ID NOs: 177, 7442, 4038, 3836, 3855, 1012, 1015, 1119 and 1024, wherein expression of the nucleic acid in a plant results in altered hydrocarbon metabolism. In still further embodiments, the present invention provides an isolated nucleic acid selected from SEQ ID NOs: 360, 4001, 3703, 7399, 645, 3849 and 7552, wherein expression of the nucleic acid in a plant results in altered ketone or quinone metabolism.

In further preferred embodiments, the present invention provides vectors comprising the foregoing polynucleotide sequences. In still further embodiments, the foregoing sequences are operably linked to an exogenous promoter, most preferably a plant promoter. However, the present invention is not limited to the use of any particular promoter. Indeed, the use of a variety of promoters is contemplated, including, but not limited to, 35S, 19S, heat shock, and Rubisco promoters, subgenomic promoters such as the CaMV promoter and TMV coat protein promoter, and dual promoters systems such as DHSPES (see U.S. Pat. No. 6,303,848, incorporated herein by reference). In some embodiments, the nucleic acid sequences of the present invention are arranged in sense orientation, while in other embodiments, the nucleic acid sequences are arranged in the vector in antisense orientation. In still further embodiments, the present invention provides a plant comprising one of the foregoing nucleic acid sequences or vectors, as well as seeds, leaves, roots, stems and fruit from the plant. In some particularly preferred embodiments, the present invention provides at least one of the foregoing sequences for use in conferring altered metabolism in a plant.

In still other embodiments, the present invention provides processes for making a transgenic plant comprising providing a vector as described above and a plant, and transfecting the plant with the vector. In other preferred embodiments, the present invention provides processes for providing an altered metabolic characteristic in a plant or population of plants comprising providing a vector as described above and a plant, and transfecting the plant with the vector under conditions such that an altered metabolic characteristic is conferred by expression of the isolated nucleic acid from the vector. In still further embodiments, the present invention provides an isolated nucleic acid selected from the group consisting of SEQ ID NOs: 1-7554 and nucleic acid sequences that hybridize to any thereof under conditions of low stringency for use in producing a plant with altered metabolism. In other embodiments, the present invention provides an isolated nucleic acid, composition or vector substantially as described herein in any of the examples or claims.

DESCRIPTION OF THE DRAWINGS

FIG. 1 presents the contig sequences corresponding to SEQ ID NOs:1-1165, 3703-4153, and 7389-7554.

FIG. 2 presents homologous sequences 1166-3702 and 4154-7388.

FIG. 3 is a table of BLAST search results from public databases.

FIG. 4 is a table of BLAST search results from the Derwent™ amino acid database.

FIG. 5 is a table of BLAST search results from the Derwent™ nucleotide database.

FIG. 6 provides a summary of the metabolic alterations caused by expression of the indicated sequences. NQ=present in reference, but not detected or below the limit of quantification in the sample.

FIGS. 7a-d summarizes the gas chromatography flame ionization detection (GC/FD) parameters used to analyze metabolite samples.

FIG. 8 provides a list of SEQ IDs, grouped by the respective fractionation chemistry, observed to confer altered metabolic characteristic in plants based exclusively upon a pattern recognition automated data analysis technique (ADA).

FIG. 9 provides tables exemplifying the functional correlation between sequences that share homology.

DEFINITIONS

Before the present proteins (including their fragments and peptides), nucleotide sequences, and methods are described, it should be noted that this invention is not limited to the particular methodology, protocols, cell lines, vectors, and reagents described herein as these may vary. It should also be understood that the terminology used herein is for the purpose of describing particular aspects of the invention, and is not intended to limit its scope.

It must be noted that as used herein and in the appended claims, the singular forms "a", "an", and "the" include plural reference unless the context clearly dictates otherwise. Thus, for example, reference to "a host cell" includes a plurality of such host cells, reference to the "antibody" is a reference to one or more antibodies and equivalents thereof known to those skilled in the art, and so forth.

Unless defined otherwise, all technical and scientific terms used herein have the same meanings as commonly understood by one of ordinary skill in the art to which this invention belongs. Although any methods and materials similar or equivalent to those described herein can be used in the practice or testing of the present invention, the preferred methods, devices, and materials are now described. All publications mentioned herein are incorporated herein by reference for the purpose of describing and disclosing the cell lines, vectors, and methodologies that are reported in the publications that might be used in connection with the invention. Nothing herein is to be construed as an admission that the invention is not entitled to antedate such disclosure by virtue of prior invention.

"Acylate", as used herein, refers to the introduction of an acyl group into a molecule, (for example, acylation).

"Adjacent", as used herein, refers to a position in a nucleotide sequence immediately 5' or 3' to a defined sequence.

"Agonist", as used herein, refers to a molecule that, when bound to a polypeptide (for example, a polypeptide encoded by a nucleic acid of the present invention), increases the biological or immunological activity of the polypeptide. Agonists may include proteins, nucleic acids, carbohydrates, or any other molecules that bind to the protein.

"Allele" or "allelic sequence", as used herein, refers an alternative form of the gene that may result from at least one mutation in the nucleic acid sequence.

"Altered", as used herein, refers to modification in the metabolic profile compared to a reference or control where the amount of biochemical and/or chemical compound is increased or decreased.

"Alterations" in a polynucleotide (for example, a polypeptide encoded by a nucleic acid of the present invention), as used herein, comprise any deletions, insertions, and point mutations in the polynucleotide sequence. Included within this definition are alterations to the genomic DNA sequence that encodes the polypeptide.

"Amino acid sequence", as used herein, refers to an oligopeptide, peptide, polypeptide, or protein sequence, and fragments or portions thereof, and to naturally occurring or synthetic molecules. "Amino acid sequence" and like terms, such as "polypeptide" or "protein" as recited herein are not meant to limit the amino acid sequence to the complete, native amino acid sequence associated with the recited protein molecule.

"Amplification", as used herein, refers to the production of additional copies of a nucleic acid sequence and is generally carried out using polymerase chain reaction (PCR) technologies well known in the art (Dieffenbach, C. W. and G. S. Dveksler (1995) PCR Primer, a Laboratory Manual, Cold Spring Harbor Press, Plainview, N.Y.).

"Antibody" refers to intact molecules as well as fragments thereof that are capable of specific binding to a epitopic determinant. Antibodies that bind a polypeptide (for example, a polypeptide encoded by a nucleic acid of the present invention) can be prepared using intact polypeptides or fragments as the immunizing antigen. These antigens may be conjugated to a carrier protein, if desired.

"Antigenic determinant", "determinant group", or "epitope of an antigenic macromolecule", as used herein, refer to any region of the macromolecule with the ability or potential to elicit, and combine with, specific antibody. Determinants exposed on the surface of the macromolecule are likely to be immunodominant, that is, more immunogenic than other (immunorecessive) determinants that are less exposed, while some (for example, those within the molecule) are non-immunogenic (immunosilent). As used herein, "antigenic determinant" refers to that portion of a molecule that makes contact with a particular antibody (for example, an epitope). When a protein or fragment of a protein is used to immunize a host animal, numerous regions of the protein may induce the production of antibodies that bind specifically to a given region or three-dimensional structure on the protein; these regions or structures are referred to as antigenic determinants. An antigenic determinant may compete with the intact antigen (the immunogen used to elicit the immune response) for binding to an antibody.

"Antisense", as used herein, refers to a deoxyribonucleotide sequence whose sequence of deoxyribonucleotide residues is in reverse 5' to 3' orientation in relation to the sequence of deoxyribonucleotide residues in a sense strand of a DNA duplex. A "sense strand" of a DNA duplex refers to a strand in a DNA duplex that is transcribed by a cell in its natural state into a "sense mRNA". Thus an "antisense" sequence is a sequence having the same sequence as the non-coding strand in a DNA duplex. The term "antisense RNA" refers to a RNA transcript that is complementary to all or part of a target primary transcript or mRNA and that blocks the expression of a target gene by interfering with the processing, transport and/or translation of its primary transcript or mRNA. The complementarity of an antisense RNA may be with any part of the specific gene transcript, for example, at the 5' non-coding sequence, 3' non-coding sequence, introns, or the coding sequence. In addition, as used herein, antisense RNA may contain regions of ribozyme sequences that increase the efficacy of antisense RNA to block gene expression. "Ribozyme" refers to a catalytic RNA and includes sequence-specific endoribonucleases.

"Anti-sense inhibition", as used herein, refers to a type of gene regulation based on cytoplasmic, nuclear, or organelle inhibition of gene expression due to the presence in a cell of an RNA molecule complementary to at least a portion of the mRNA being translated. It is specifically contemplated that DNA molecules may be from either an RNA virus or mRNA from the host cell genome or from a DNA virus.

"Antagonist" or "inhibitor", as used herein, refer to a molecule that, when bound to a polypeptide (for example, a polypeptide encoded by a nucleic acid of the present invention), decreases the biological or immunological activity of the polypeptide. Antagonists and inhibitors may include proteins, nucleic acids, carbohydrates, or any other molecules that bind to the polypeptide.

"Biologically active", as used herein, refers to a molecule having the structural, regulatory, or biochemical functions of a naturally occurring molecule.

"Biological material", as used herein, refers to: a portion or portions of one or more cells, organs, or organisms; a whole cell, organelle, organ, or organism; or a group of cells, organelles, organs, or organisms. For example, if the organism(s) supplying the biological material is a garden variety carrot, a single leaf of one carrot plant could be used, or one or more whole carrot plant(s) could be used, or partial or whole taproots from a number of different individuals could be used, or mitochondria extracted from the crown of one carrot plant could be used.

"Cell culture", as used herein, refers to a proliferating mass of cells that may be in either an undifferentiated or differentiated state.

"Chimeric plasmid", as used herein, refers to any recombinant plasmid formed (by cloning techniques) from nucleic acids derived from organisms that do not normally exchange genetic information (for example, *Escherichia coli* and *Saccharomyces cerevisiae*).

"Chimeric sequence" or "chimeric gene", as used herein, refer to a nucleotide sequence derived from at least two heterologous parts. The sequence may comprise DNA or RNA.

"Chromatogram", as used herein, refers to an electronic and/or graphic record of data representing the absolutely or relatively quantitative detection of a plurality of separated chemical species obtained or derived from a group of metabolites, whether or not such separation has been performed by chromatography or some other method (e.g., electrophoresis).

"Control chromatogram", as used herein, refers to an individual chromatogram, or an average chromatogram based on multiple individual chromatograms or a mathematical model based on multiple individual chromatograms, of chemical species obtained from a group of metabolites extracted from "control" biological material.

"Subject chromatogram", as used herein, refers to an individual chromatogram, or an average or model chromatogram based on multiple individual chromatograms, of chemical species obtained from a group of metabolites extracted from "subject" biological material. In either case, a model chromatogram may contain data including, e.g.: peak migration distance (or elution time) ranges and averages; peak height and peak area ranges and averages; and other parameters.

"Chromatographic data", as used herein, refers to chromatograms (e.g., including, but not limited to, total ion chromatograms or chromatograms generated from flame ionization detection) corresponding to individual biological or reference samples. Data such as retention time, retention index, peak areas, and peak areas normalized to internal standards can be extracted from total ion chromatograms to generate "peak tables."

"Coding sequence", as used herein, refers to a deoxyribonucleotide sequence that, when transcribed and translated, results in the formation of a cellular polypeptide or a ribonucleotide sequence that, when translated, results in the formation of a cellular polypeptide.

"Compatible", as used herein, refers to the capability of operating with other components of a system. A vector or plant viral nucleic acid that is compatible with a host is one that is capable of replicating in that host. A coat protein that is compatible with a viral nucleotide sequence is one capable of encapsidating that viral sequence.

"Coding region", as used herein, refers to that portion of a gene that codes for a protein. The term "non-coding region" refers to that portion of a gene that is not a coding region.

"Complementary" or "complementarity", as used herein, refer to the Watson-Crick base-pairing of two nucleic acid sequences. For example, for the sequence 5'-AGT-3' binds to the complementary sequence 3'-TCA-5'. Complementarity between two nucleic acid sequences may be "partial", in which only some of the bases bind to their complement, or it may be complete as when every base in the sequence binds to it's complementary base. The degree of complementarity between nucleic acid strands has significant effects on the efficiency and strength of hybridization between nucleic acid strands.

"Contig", as used herein, refers to a nucleic acid sequence that is derived from the contiguous assembly of two or more nucleic acid sequences.

"Control biological material" and "subject biological material", as used herein, both refer to biological material taken from (cultivated/domesticated or uncultivated/non-domesticated wild-type or genetically modified) individual(s) of any taxonomic category or categories, i.e. kingdom, phylum, subphylum, class, subclass, order, suborder, family, subfamily, genus, subgenus, species, subspecies, variety, breed, or strain. The "control" and "subject" biological material may be, and typically are, taken from individual(s) of the same taxonomic category, preferably from the same species, subspecies, variety, breed, or strain. However, when comparison between different types of organisms is desired, the "control" and "subject" biological material may be taken from individual(s) of different taxonomic categories. The "control" and "subject" biological materials differ from each other in at least one way. This difference may be that the "control" and "subject" biological materials were obtained from individual(s) of different taxonomic categories. Alternatively, or additionally, they may be different parts of the same organ(s), they may be different organelles or different groups of organelles, different cells or different groups of cells, different organs or different groups of organs, or different whole organisms or different groups of whole organisms. The difference may be that the organisms providing the biological materials are identical, but for, e.g., their growth stages.

"Correlates with expression of a polynucleotide", as used herein, indicates that the detection of the presence of ribonucleic acid that is similar to a nucleic acid (for example, SEQ ID NOs:1-7554) and is indicative of the presence of mRNA encoding a polypeptide (for example, a polypeptide encoded by a nucleic acid of the present invention) in a sample and thereby correlates with expression of the transcript from the polynucleotide encoding the protein.

"Customized reporting", as used herein, refers to the modification of a preliminary analyst report to generate an interim report (e.g., including, but not limited to, a modified analyst report and a cross-referenced modified analyst report) and a final report. In some embodiments, modifications include, but are not limited to, substitution of underivatized compound names for derivatized compound names and generation of a hit score. In other embodiments, customized reporting includes data mining of databases to generate biochemical profiling and genetic expression information and/or reports.

"Data analysis and reporting software", as used herein, refers to software configured for the analysis of spectroscopic and chromatographic data corresponding to biological subject and reference samples. Data analysis and reporting software is configured to perform data reduction, two-dimensional peak matching, quantitative peak differentiation, peak identification, querying, data mining, and customized reporting functions.

"Data reduction", as used herein, refers to the process of organizing, compiling, and normalizing data (for example, chromatographic and spectroscopic data). In some embodiments, data reduction includes the normalization of raw chromatogram peak areas and the generation of peak tables. In some embodiments, data reduction also includes the process of filtering peaks based on their normalized area. This step removes peaks that are considered to be background.

"Data sorting", as used herein, refers to the generation of a preliminary analyst report. In some embodiment, the preliminary analyst report can include equivalence value, retention time, retention index, normalized peak area, peak identification status, compound name or other unique identifier, compound identification number (e.g., a CAS number), mass spectral library name, ID number, MS-XCR value, relative % change, notes, and other information about the biological sample.

"Data mining", as used herein, refers to the process of querying and mining databases to analyze and to obtain information (e.g., to use in the generation of customized reports of information pertaining to biochemical profiling and gene function and expression).

"Deletion", as used herein, refers to a change made in either an amino acid or nucleotide sequence resulting in the absence of one or more amino acids or nucleotides, respectively.

"Encapsidation", as used herein, refers to the process during virion assembly in which nucleic acid becomes incorporated in the viral capsid or in a head/capsid precursor (for example, in certain bacteriophages).

"Exon", as used herein, refers to a polynucleotide sequence in a nucleic acid that encodes information for protein synthesis and that is copied and spliced together with other such sequences to form messenger RNA.

"Expression", as used herein, is meant to incorporate transcription, reverse transcription, and translation.

"Expressed sequence tag (EST)" as used herein, refers to relatively short single-pass DNA sequences obtained from one or more ends of cDNA clones and RNA derived therefrom. They may be present in either the 5' or the 3' orientation. ESTs have been shown to be useful for identifying particular genes.

"Fractionated biological sample", as used herein, refers to a biological sample that has been fractionated into two or more fractions based on one or more properties of the sample. For example, in some embodiments, leaf extracts are fractionated based on extraction with organic solvents.

"Industrial crop", as used herein, refers to crops grown primarily for consumption by humans or animals or use in industrial processes (for example, as a source of fatty acids for manufacturing or sugars for producing alcohol). It will be understood that either the plant or a product produced from the plant (for example, sweeteners, oil, flour, or meal) can be consumed. Examples of food crops include, but are not limited to, corn, soybean, rice, wheat, oilseed rape, cotton, oats, barley, and potato plants.

"Foreign gene", as used herein, refers to any sequence that is not native to the organism.

"Fusion protein", as used herein, refers to a protein containing amino acid sequences from each of two distinct proteins; it is formed by the expression of a recombinant gene in which two coding sequences have been joined together such that their reading frames are in phase. Hybrid genes of this type may be constructed in vitro in order to label the product of a particular gene with a protein that can be more readily assayed (for example, a gene fused with lacZ in E. coli to obtain a fusion protein with β-galactosidase activity). Alternatively, a protein may be linked to a signal peptide to allow its secretion by the cell. The products of certain viral oncogenes are fusion proteins.

"Gene", as used herein, refers to a discrete nucleic acid sequence responsible for a discrete cellular product. The term "gene", as used herein, refers not only to the nucleotide sequence encoding a specific protein, but also to any adjacent 5' and 3' non-coding nucleotide sequence involved in the regulation of expression of the protein encoded by the gene of interest. These non-coding sequences include terminator sequences, promoter sequences, upstream activator sequences, regulatory protein binding sequences, and the like. These non-coding sequence gene regions may be readily identified by comparison with previously identified eukaryotic non-coding sequence gene regions. Furthermore, the person of average skill in the art of molecular biology is able to identify the nucleotide sequences forming the non-coding regions of a gene using well-known techniques such as a site-directed mutagenesis, sequential deletion, promoter probe vectors, and the like.

"Genetically modified" and "genetically unmodified" when used in relation to subject biological material and control biological material, respectively, refer to the fact that the subject biological material has been treated to produce a genetic modification thereof, whereas the control biological material has not received that particular genetic modification. In this context, the term "genetically unmodified" does not imply that the "control" biological material must be, e.g., a naturally-occurring, wild-type plant; rather, both the control and subject biological materials may be (but need not be) the result of, e.g., hybridization, selection, or genetic engineering.

"Growth cycle", as used herein, is meant to include the replication of a nucleus, an organelle, a cell, or an organism.

"Heterologous", as used herein, refers to the association of a molecular or genetic element associated with a distinctly different type of molecular or genetic element.

"HIT" and/or "hit", as used herein, refers to the result of a test or series of tests that meets a defined criteria for each test. "Hit Detection", as used herein, refers to the process of determining a hit using a mathemetical or statistical model.

"Host", as used herein, refers to a cell, tissue or organism capable of replicating a vector or plant viral nucleic acid and that is capable of being infected by a virus containing the viral vector or plant viral nucleic acid. This term is intended to include prokaryotic and eukaryotic cells, organs, tissues or organisms, where appropriate.

The term "homolog" as in a "homolog" of a given nucleic acid sequence, as used herein, refers to a nucleic acid sequence (for example, a nucleic acid sequence from another organism), that shares a given degree of "homology" with the nucleic acid sequence.

"Homology", as used herein, refers to a degree of complementarity. There may be partial homology or complete homology (identity). A partially complementary sequence is one that at least partially inhibits a completely complementary sequence from hybridizing to a target nucleic acid and is referred to using the functional term "substantially homologous". The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (the hybridization) of a completely homologous sequence to a target under conditions of low stringency. This is not to say that conditions of low stringency are such that non-specific binding is permitted; low stringency conditions require that the binding of two sequences to one another be a specific (selective) interaction. The absence of non-specific binding may be tested by the use of a second target that lacks even a partial degree of complementarity (for example, less than about 30% identity); in the absence of non-specific binding the probe will not hybridize to the second non-complementary target.

Numerous equivalent conditions may be employed to comprise low stringency conditions; factors such as the length and nature (DNA, RNA, base composition) of the probe and nature of the target (DNA, RNA, base composition, present in solution or immobilized, etc.) and the concentration of the salts and other components (for example, the presence or absence of formamide, dextran sulfate, polyethylene glycol) are considered and the hybridization solution may be varied to generate conditions of low stringency hybridization different from, but equivalent to, the above listed conditions. In addition, the art knows conditions that promote hybridization under conditions of high stringency (for example, increasing the temperature of the hybridization and/or wash steps, the use of formamide in the hybridization solution, etc.).

When used in reference to a double-stranded nucleic acid sequence such as a cDNA or genomic clone, the term "substantially homologous" refers to any probe that can hybridize to either or both strands of the double-stranded nucleic acid sequence under conditions of low stringency as described above.

A gene may produce multiple RNA species that are generated by differential splicing of the primary RNA transcript. cDNAs that are splice variants of the same gene will contain regions of sequence identity or complete homology (representing the presence of the same exon or portion of the same exon on both cDNAs) and regions of complete non-identity (for example, representing the presence of exon "A" on cDNA 1 wherein cDNA 2 contains exon "B" instead). Because the two cDNAs contain regions of sequence identity they will both hybridize to a probe derived from the entire gene or portions of the gene containing sequences found on both cDNAs; the two splice variants are therefore substantially homologous to such a probe and to each other.

When used in reference to a single-stranded nucleic acid sequence, the term "substantially homologous" refers to any probe that can hybridize (it is the complement of) the single-stranded nucleic acid sequence under conditions of low stringency as described above.

The term "hybridization" is used in reference to the pairing of complementary nucleic acids. Hybridization and the strength of hybridization (for example, the strength of the association between the nucleic acids) is impacted by such factors as the degree of complementary between the nucleic acids, stringency of the conditions involved, the $T_m$ of the formed hybrid, and the G:C ratio within the nucleic acids.

"Hybridization complex", as used herein, refers to a complex formed between nucleic acid strands by virtue of hydrogen bonding, stacking or other non-covalent interactions between bases. A hybridization complex may be formed in solution or between nucleic acid sequences present in solution and nucleic acid sequences immobilized on a solid support (for example, membranes, filters, chips, pins or glass slides to which cells have been fixed for in situ hybridization).

"Immunologically active", as used herein, refers to the capability of a natural, recombinant, or synthetic polypeptide, or any oligopeptide thereof, to bind with specific antibodies and induce a specific immune response in appropriate animals or cells.

"Induction" and the terms "induce", "induction" and "inducible", as used herein, refer generally to a gene and a promoter operably linked thereto which is in some manner dependent upon an external stimulus, such as a molecule, in order to actively transcribed and/or translate the gene.

"Infection", as used herein, refers to the ability of a virus to transfer its nucleic acid to a host or introduce viral nucleic acid into a host, wherein the viral nucleic acid is replicated, viral proteins are synthesized, and new viral particles assembled. In this context, the terms "transmissible" and "infective" are used interchangeably herein.

"Insertion" or "addition", as used herein, refers to the replacement or addition of one or more nucleotides or amino acids, to a nucleotide or amino acid sequence, respectively.

"In cis", as used herein, indicates that two sequences are positioned on the same strand of RNA or DNA.

"In trans", as used herein, indicates that two sequences are positioned on different strands of RNA or DNA.

"Intron", as used herein, refers to a polynucleotide sequence in a nucleic acid that does not encode information for protein synthesis and is removed before translation of messenger RNA.

"Isolated", as used herein, refers to a polypeptide or polynucleotide molecule separated not only from other peptides, DNAs, or RNAs, respectively, that are present in the natural source of the macromolecule. "Isolated" and "purified" do not encompass either natural materials in their native state or natural materials that have been separated into components (for example, in an acrylamide gel) but not obtained either as pure substances or as solutions.

"Kinase", as used herein, refers to an enzyme (for example, hexokinase and pyruvate kinase) that catalyzes the transfer of a phosphate group from one substrate (commonly ATP) to another.

"Marker" or "genetic marker", as used herein, refer to a genetic locus that is associated with a particular, usually readily detectable, genotype or phenotypic characteristic (for example, an antibiotic resistance gene).

"Metabolic characteristics", as used herein, refers to a biochemical/chemical trait/metabolite that is genetically expressed in a biological system. "Altered metabolic characteristic", as used herein, refers to the production of a given metabolite that has been altered (for example, increased or decreased) in a biological system, especially plants. Examples of metabolites that can be altered in a plant include, but are not limited to, acids, fatty acids, amino acids, hydroxy fatty acids, branched fatty acids, carbohydrates, hydrocarbons, glycerides, phenols, strerols, oxygenated terpenes, and other isoprenoids, alcohols, ketones, quinones, alkenes and alkynes.

"Metabolome", as used herein, indicates the complement of relatively low molecular weight molecules that is present in a plant, plant part, or plant sample, or in a suspension or extract thereof. Examples of such molecules include, but are not limited to: acids and related compounds; mono-, di-,and tri-carboxylic acids (saturated, unsaturated, aliphatic and cyclic, aryl, alkaryl); aldo-acids, keto-acids; lactone forms; gibberellins; abscisic acid; alcohols, polyols, derivatives, and related compounds; ethyl alcohol, benzyl alcohol, methanol; propylene glycol, glycerol, phytol; inositol, furfuryl alcohol, menthol; aldehydes, ketones, quinones, derivatives, and related compounds; acetaldehyde, butyraldehyde, benzaldehyde, acrolein, furfural, glyoxal; acetone, butanone; anthraquinone; carbohydrates; mono-, di-, tri-saccharides; alkaloids, amines, and other bases; pyridines (including nicotinic acid, nicotinamide); pyrimidines (including cytidine, thymine); purines (including guanine, adenine, xanthines/hypoxanthines, kinetin); pyrroles; quinolines (including isoquinolines); morphinans, tropanes, cinchonans; nucleotides, oligonucleotides, derivatives, and related compounds; guanosine, cytosine, adenosine, thymidine, inosine; amino acids, oligopeptides, derivatives, and related compounds; esters; phenols and related compounds; heterocyclic compounds and derivatives; pyrroles, tetrapyrroles (corrinoids and porphines/porphyrins, w/w/o metal-ion); flavonoids; indoles; lipids (including fatty acids and triglycerides), derivatives, and related compounds; carotenoids, phytoene; and sterols, isoprenoids including terpenes.

"Modulate", as used herein, refers to a change or an alteration in the biological activity of a polypeptide (for example, a polypeptide encoded by a nucleic acid of the present invention). Modulation may be an increase or a decrease in protein activity, a change in binding characteristics, or any other change in the biological, functional or immunological properties of the polypeptide.

"Movement protein", as used herein, refers to a noncapsid protein required for cell to cell movement of replicons or viruses in plants.

"Multigene family", as used herein, refers to a set of genes descended by duplication and variation from some ancestral gene. Such genes may be clustered together on the same chromosome or dispersed on different chromosomes. Examples of multigene families include those that encode the histones, hemoglobins, immunoglobulins, histocompatibility antigens, actins, tubulins, keratins, collagens, heat shock proteins, salivary glue proteins, chorion proteins, cuticle proteins, yolk proteins, and phaseolins.

"Non-native", as used herein, refers to any RNA sequence that promotes production of subgenomic mRNA including, but not limited to, 1) plant viral promoters such as ORSV and brome mosaic virus, 2) viral promoters from other organisms such as human Sindbis viral promoter, and 3) synthetic promoters.

"Nucleic acid sequence", as used herein, refers to a polymer of nucleotides in which the 3' position of one nucleotide sugar is linked to the 5' position of the next by a phosphodiester bridge. In a linear nucleic acid strand, one end typically has a free 5' phosphate group, the other a free 3' hydroxyl group. Nucleic acid sequences may be used herein to refer to oligonucleotides, or polynucleotides, and fragments or portions thereof, and to DNA or RNA of genomic or synthetic origin that may be single- or double-stranded, and represent the sense or antisense strand.

"Polypeptide", as used herein, refers to an amino acid sequence obtained from any species and from any source whether natural, synthetic, semi-synthetic, or recombinant.

"Principal component analysis", as used herein, refers to algorithms designed to represent large and complex data sets by linear combinations of the original variables. These linear combinations of variables are extracted to maximize the explained variance and are mutually orthogonal. Principal component analysis is designed to represent large complex data sets by linear combinations of the original variables that maximize the explained variance and are mutually orthogonal.

"Oil-producing species", as used herein, refers to plant species that produce and store triacylglycerol in specific organs, primarily in seeds. Such species include soybean (*Glycine max*), rapeseed and canola (including *Brassica napus* and *B. campestris*), sunflower (*Helianthus annus*), cotton (*Gossypium hirsutum*), corn (*Zea mays*), cocoa (*Theobroma cacao*), safflower (*Carthamus tinctorius*), oil palm (*Elaeis guineensis*), coconut palm (*Cocos nucifera*), flax (*Linum usitatissimum*), castor (*Ricinus communis*) and peanut (*Arachis hypogaea*). The group also includes non-agronomic species that are useful in developing appropriate expression vectors such as tobacco, rapid cycling *Brassica* species, and *Arabidopsis thaliana*, and wild species that may be a source of unique fatty acids.

"Operably linked", as used herein, refers to a juxtaposition of components, particularly nucleotide sequences, such that the normal function of the components can be performed. Thus, a coding sequence that is operably linked to regulatory sequences refers to a configuration of nucleotide sequences wherein the coding sequences can be expressed under the regulatory control, that is, transcriptional and/or translational control, of the regulatory sequences.

"Origin of assembly", as used herein, refers to a sequence where self-assembly of the viral RNA and the viral capsid protein initiates to form virions.

"Ortholog", as used herein, refers to genes that have evolved from an ancestral locus.

"Outlier peak", as used herein, indicates a peak of a chromatogram of a test sample, or the relative or absolute detected response data, or amount or concentration data thereof. An outlier peak: 1) may have a significantly different peak height or area as compared to a like chromatogram of a control sample; or 2) be an additional or missing peak as compared to a like chromatogram of a control sample.

"Overexpression", as used herein, refers to the production of a gene product in transgenic organisms that exceeds levels of production in normal or non-transformed organisms.

"Cosuppression", as used herein, refers to the expression of a foreign gene that has substantial homology to an endogenous gene resulting in the suppression of expression of both the foreign and the endogenous gene. As used herein, the term "altered levels" refers to the production of gene product(s) in transgenic organisms in amounts or portions that differ from that of normal or non-transformed organisms.

"Peak identification", as used herein, refers to the characterization and identification of a chemical compound represented by a given chromatographic peak. In some embodiments, the chemical compound corresponding to a given peak is identified by searching mass spectral libraries. In other embodiments, the chemical compounds are identified by searching additional libraries or databases (for example, biotechnology databases).

"Quantitative peak differentiation", as used herein, refers to the process of confirming matched peaks by calculating their relative quantitative differentiation, which is expressed as a percent change of the subject peak area relative to the area of the reference peak. A predetermined threshold for change is used to confirm that the peaks are of significant biological alteration.

"Plant", as used herein, refers to any plant and progeny thereof. The term also includes parts of plants, including seed, cuttings, tubers, fruit, flowers, etc.

"Plant cell", as used herein, refers to the structural and physiological unit of plants, consisting of a protoplast and the cell wall.

"Plant organ", as used herein, refers to a distinct and visibly differentiated part of a plant, such as root, stem, leaf or embryo.

"Plant tissue", as used herein, refers to any tissue of a plant in planta or in culture. This term is intended to include a whole plant, plant cell, plant organ, protoplast, cell culture, or any group of plant cells organized into a structural and functional unit.

"Portion", as used herein, with regard to a protein ("a portion of a given protein") refers to fragments of that protein. The fragments may range in size from four amino acid residues to the entire amino acid sequence minus one amino acid (10 nucleotides, 20, 30, 40, 50, 100, 200, etc.). A "portion" is preferably at least 25 nucleotides, more preferably at least 50 nucleotides, and even more preferably at least 100 nucleotides.

"Positive-sense inhibition", as used herein, refers to a type of gene regulation based on cytoplasmic inhibition of gene expression due to the presence in a cell of an RNA molecule substantially homologous to at least a portion of the mRNA being translated.

"Production cell", as used herein, refers to a cell, tissue or organism capable of replicating a vector or a viral vector, but which is not necessarily a host to the virus. This term is intended to include prokaryotic and eukaryotic cells, organs, tissues or organisms, such as bacteria, yeast, fungus, and plant tissue.

"Promoter", as used herein, refers to the 5'-flanking, non-coding sequence adjacent a coding sequence that is involved in the initiation of transcription of the coding sequence.

"Protoplast", as used herein, refers to an isolated plant cell without cell walls, having the potency for regeneration into cell culture or a whole plant.

"Purified", as used herein, when referring to a peptide or nucleotide sequence, indicates that the molecule is present in the substantial absence of other biological macromolecular, for example, polypeptides, polynucleic acids, and the like of the same type. The term "purified" as used herein preferably means at least 95% by weight, more preferably at least 99.8% by weight, of biological macromolecules of the same type present (but water, buffers, and other small molecules, especially molecules having a molecular weight of less than 1000 can be present).

"Pure", as used herein, preferably has the same numerical limits as "purified" immediately above. "Substantially purified", as used herein, refers to nucleic or amino acid sequences that are removed from their natural environment, isolated or separated, and are at least 60% free, preferably 75% free, and most preferably 90% free from other components with which they are naturally associated.

"Recombinant plant viral nucleic acid", as used herein, refers to a plant viral nucleic acid that has been modified to contain non-native nucleic acid sequences. These non-native nucleic acid sequences may be from any organism or purely synthetic, however, they may also include nucleic acid sequences naturally occurring in the organism into which the recombinant plant viral nucleic acid is to be introduced.

"Recombinant plant virus", as used herein, refers to a plant virus containing a recombinant plant viral nucleic acid.

"Reference sample", as used herein, refers to a sample taken from an individual receiving treatment that is not believed to alter the chemistry thereof.

"Regulated", as used herein, refers to an alteration that occurs in an expressed metabolite in a biological system. "Up-regulated", as used herein, refers to an increase in a give metabolite level relative to a control or reference. "Down-regulated", as used herein, refers to a decrease in a given metabolite level relative to a control or reference.

"Regulatory region" or "regulatory sequence", as used herein, in reference to a specific gene refers to the non-coding nucleotide sequences within that gene that are necessary or sufficient to provide for the regulated expression of the coding region of a gene. Thus the term regulatory region includes promoter sequences, regulatory protein binding sites, upstream activator sequences, and the like. Specific nucleotides within a regulatory region may serve multiple functions. For example, a specific nucleotide may be part of a promoter and participate in the binding of a transcriptional activator protein.

"Replication origin", as used herein, refers to the minimal terminal sequences in linear viruses that are necessary for viral replication.

"Replicon", as used herein, refers to an arrangement of RNA sequences generated by transcription of a transgene that is integrated into the host DNA that is capable of replication in the presence of a helper virus. A replicon may require sequences in addition to the replication origins for efficient replication and stability.

"Sample", as used herein, is used in its broadest sense. A biological sample suspected of containing nucleic acid encoding a polypeptide (for example, a polypeptide encoded by a nucleic acid of the present invention) or fragments thereof may comprise a tissue, a cell, an extract from cells, chromosomes isolated from a cell (for example, a spread of metaphase chromosomes), genomic DNA (in solution or bound to a solid support such as for Southern analysis), RNA (in solution or bound to a solid support such as for northern analysis), cDNA (in solution or bound to a solid support), and the like.

"Site-directed mutagenesis", as used herein, refers to the in-vitro induction of mutagenesis at a specific site in a given target nucleic acid molecule.

"Subgenomic promoter", as used herein, refers to a promoter of a subgenomic mRNA of a viral nucleic acid.

"Subject sample", as used herein, refers to a sample taken from an individual that has been treated in order to alter the chemistry thereof.

"$T_m$" is used in reference to the "melting temperature". The melting temperature is the temperature at which a population of double-stranded nucleic acid molecules becomes half-dissociated into single strands. The equation for calculating the $T_m$ of nucleic acids is well known in the art. As indicated by standard references, a simple estimate of the $T_m$ value may be calculated by the equation: $T_m=81.5+0.41(\% \text{ G+C})$, when a nucleic acid is in aqueous solution at 1 M NaCl [See for example, Anderson and Young, Quantitative Filter Hybridization, in *Nucleic Acid Hybridization* (1985)]. Other references include more sophisticated computations that take structural as well as sequence characteristics into account for the calculation of $T_m$.

"Stringency" is used in reference to the conditions of temperature, ionic strength, and the presence of other compounds such as organic solvents, under which nucleic acid hybridizations are conducted. Those skilled in the art will recognize that "stringency" conditions may be changed by varying the parameters just described either individually or in concert. With "high stringency" conditions, nucleic acid base pairing will occur only between nucleic acid fragments that have a high frequency of complementary base sequences (for example, hybridization under "high stringency" conditions may occur between homologs with about 85-100% identity, preferably about 70-100% identity). With medium stringency conditions, nucleic acid base pairing will occur between nucleic acids with an intermediate frequency of complementary base sequences (for example, hybridization under "medium stringency" conditions may occur between homologs with about 50-70% identity). Thus, conditions of "weak" or "low" stringency are often required with nucleic acids that are derived from organisms that are genetically diverse, as the frequency of complementary sequences is usually less.

"High stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4$ $H_2O$ and 1.85 g/l EDTA, pH adjusted to 7.4 with NaOH), 0.5% SDS, 5× Denhardt's reagent and 100 µg/mL denatured salmon sperm DNA followed by washing in a solution comprising 0.1×SSPE, 1.0% SDS at 42° C. when a probe of about 500 nucleotides in length is employed.

"Medium stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4$ $H_2O$ and 1.85 g/l EDTA, pH adjusted to 7.4 with NaOH), 0.5% SDS, 5× Denhardt's reagent and 100 µg/mL denatured salmon sperm DNA followed by washing in a solution comprising 1.1×SSPE, 1.0% SDS at 42° C. when a probe of about 500 nucleotides in length is employed. "Low stringency conditions" when used in a reference to nucleic acid hybridization comprise conditions equivalent to binding or hybridization at 42° C. in a solution consisting of 5×SSPE (43.8 g/l NaCl, 6.9 g/l $NaH_2PO_4$ $H_2O$ and 1.85 g/l EDTA, pH adjusted to 7.4 with NaOH), 0.1% SDS, 5× Denhardt's reagent [50× Denhardt's contains per 500 mL: 5 g Ficoll (Type 400, Pharamcia), 5 g BSA (Fraction V; Sigma)] and 100 µg/mL denatured salmon sperm DNA followed by washing in a solution comprising 5×SSPE, 0.1% SDS at 42° C. when a probe of about 500 nucleotides in length is employed.

"Substitution", as used herein, refers to a change made in an amino acid of nucleotide sequence that results in the replacement of one or more amino acids or nucleotides by different amino acids or nucleotides, respectively.

"Symptom", as used herein refers to a visual condition resulting from the action of the GENEWARE™ (trademark of Large Scale Biology Corporation) vector or the clone insert. The GENEWARE™ vector is described in U.S. application Ser. No. 09/008,186 (incorporated herein by reference).

"Systemic infection", as used herein, denotes infection throughout a substantial part of an organism including mechanisms of spread other than mere direct cell inoculation but rather including transport from one infected cell to additional cells either nearby or distant.

"Transcription", as used herein, refers to the production of an RNA molecule by RNA polymerase as a complementary copy of a DNA sequence.

"Transformation", as used herein, describes a process by which exogenous DNA enters and changes a recipient cell. It may occur under natural or artificial conditions using various methods well known in the art. Transformation may rely on any known method for the insertion of foreign nucleic acid sequences into a prokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells that transiently express the inserted DNA or RNA for limited periods of time.

"Transfection", as used herein, refers to the introduction of foreign nucleic acid into eukaryotic cells. Transfection may be accomplished by a variety of means known to the art including calcium phosphate-DNA co-precipitation, DEAE-dextran-mediated transfection, polybrene-mediated transfection, electroporation, microinjection, liposome fusion, lipofection, protoplast fusion, retroviral infection, and biolistics. Transfection may, for example, result in cells in which the inserted nucleic acid is capable of replication either as an autonomously replicating molecule or as part of the host chromosome, or cells that transiently express the inserted nucleic acid for limited periods of time.

"Transgenic plant", as used herein, refers to a plant that contains a foreign nucleotide sequence inserted into either its nuclear genome or organellar genome.

"Transgene", as used herein, refers to the DNA sequence coding for the replicon that is inserted into the host DNA.

"Two-dimensional peak matching", as used herein, refers to the pairing or matching of peaks in reference and subject biological samples. Peaks are first paired based on their retention index. A match is then confirmed by spectral matching.

"Unmatched peak", as used herein, refers to a peak reported in the chromatographic and/or spectroscopic data corresponding to reference biological sample but missing from chromatographic and/or spectroscopic data corresponding to subject biological sample, based upon the criteria for quantitation and reporting, or a peak reported in chromatographic and/or spectroscopic data corresponding to subject biological sample but missing from chromatographic and/or spectroscopic data corresponding to reference biological sample, based upon criteria for quantitation and reporting.

"Variants" of a polypeptide (for example, a polypeptide encoded by a nucleic acid of the present invention), as used herein, refers to a sequence resulting when a polypeptide is modified by one or more amino acids. The variant may have "conservative" changes, wherein a substituted amino acid has similar structural or chemical properties, for example, replacement of leucine with isoleucine. More rarely, a variant may have "nonconservative" changes, for example, replacement of a glycine with a tryptophan. Variants may also include sequences with amino acid deletions or insertions, or both. Guidance in determining which amino acid residues may be substituted, inserted, or deleted without abolishing biological or immunological activity may be found using computer programs well known in the art.

"Vector", as used herein, refers to a self-replicating DNA or RNA molecule that transfers a nucleic acid segment between cells.

"Virion", as used herein, refers to a particle composed of viral RNA and viral capsid protein.

"Virus", as used herein, refers to an infectious agent composed of a nucleic acid encapsidated in a protein. A virus may be a mono-, di-, tri- or multi-partite virus.

DESCRIPTION OF THE INVENTION

I. Identification of Nucleotide and Amino Acid Sequences

The invention is based on the discovery of deoxyribonucleic acid (DNA) and amino acid sequences that confer altered metabolic characteristics when expressed in plants. In particular, the present invention encompasses the nucleic acid sequences encoded by SEQ ID NOs:1-1165, 3703-4153 and 7389-7554 and variants and portions thereof. These sequences are contiguous sequences prepared from a database of 5' single pass sequences and are thus referred to as contig sequences.

Nucleic acids of the present invention were identified in clones generated from a variety of cDNA libraries. The cDNA libraries were constructed in the GENEWARE™ vector. The GENEWARE™ vector is described in U.S. application Ser. No. 09/008,186 (incorporated herein by reference). Each of the complete set of clones from the GENEWARE™ library was used to prepare an infectious viral unit. An infectious unit corresponding to each clone was used to inoculate *Nicotiana benthamiana* (a dicotyledonous plant). The plants were grown under identical conditions and a phenotypic analysis of each plant was carried out. The altered metabolic characteristic was observed in the plants that had been infected by an infectious unit created from the nucleic acids of the present invention.

Following the identification of the altered metabolic characteristic in plant samples, further analyses of the sequences were carried out. In particular, the nucleotide sequences of the present invention were analyzed using bioinformatics methods as described below.

II. Bioinformatics Methods

A. Phred, Phrap and Consed

Phred, Phrap and Consed are a set of programs that read DNA sequencer traces, make base calls, assemble the shotgun DNA sequence data and analyze the sequence regions that are likely to contribute to errors. Phred is the initial program used to read the sequencer trace data, call the bases and assign quality values to the bases. Phred uses a Fourier-based method to examine the base traces generated by the sequencer. The output files from Phred are written in FASTA, phd or scf format. Phrap is used to assemble contiguous sequences from only the highest quality portion of the sequence data output by Phred. Phrap is amenable to high-throughput data collection. Finally, Consed is used as a finishing tool to assign error probabilities to the sequence data. Detailed descriptions of the Phred, Phrap and Consed software and its use can be found in the following references: Ewing et al., Genome Res., 8:175 [1998]; Ewing and Green, Genome Res. 8:186 [1998]; Gordon et al., Genome Res. 8: 195 [1998].

B. BLAST

The BLAST set of programs may be used to compare the large numbers of sequences and obtain homologies to known protein families. These homologies provide information regarding the function of newly sequenced genes. Detailed descriptions of the BLAST software and its uses can be found in the following references Altschul et al., J. Mol. Biol., 215:403 [1990]; Altschul, J. Mol. Biol. 219:555 [1991].

Generally, BLAST performs sequence similarity searching and is divided into 5 basic subroutines: (1) BLASTP compares an amino acid sequence to a protein sequence database; (2) BLASTS compares a nucleotide sequence to a nucleic acid sequence database; (3) BLASTX compares translated protein sequences done in 6 frames to a protein sequence database; (4) TBLASTN compares a protein sequence to a nucleotide sequence database that is translated into all 6 reading frames; (5) TBLASTX compares the 6 frame translated protein sequence to the 6-frame translation of a nucleotide sequence database. Subroutines (3)-(5) may be used to identify weak similarities in nucleic acid sequence.

The BLAST program is based on the High Segment Pair (HSP), two sequence fragments of arbitrary but equal length whose alignment is locally maximized and whose alignment meets or exceeds a cutoff threshold. BLAST determines multiple HSP sets statistically using sum statistics. The score of the HSP is then related to its expected chance of frequency of occurrence, E. The value, E, is dependent on several factors such as the scoring system, residue composition of sequences, length of query sequence and total length of database. In the output file will be listed these E values, typically in a histogram format, which are useful in determining levels of statistical significance at the user s predefined expectation threshold. Finally, the Smallest Sum Probability, P(N) is the probability of observing the shown matched sequences by chance alone and is typically in the range of 0-1.

BLAST measures sequence similarity using a matrix of similarity scores for all possible pairs of residues and these specify scores for aligning pairs of amino acids. The matrix of choice for a specific use depends on several factors: the length of the query sequence and whether or not a close or distant relationship between sequences is suspected. Several matrices are available including PAM40, PAM120, PAM250, BLOSUM 62 and BLOSUM 50. Altschul et al. (1990) found PAM120 to be the most broadly sensitive matrix (for example point accepted mutation matrix per 100 residues). However, in some cases the PAM120 matrix may not find short but strong or long but weak similarities between sequences. In these cases, pairs of PAM matrices may be used, such as PAM40 and PAM 250, and the results compared. Typically, PAM 40 is used for database searching with a query of 9-21 residues long, while PAM 250 is used for lengths of 47-123.

The BLOSUM (Blocks Substitution Matrix) series of matrices are constructed based on percent identity between two sequence segments of interest. Thus, the BLOSUM62 matrix is based on a matrix of sequence segments in which the members are less than 62% identical. BLOSUM62 shows very good performance for BLAST searching. However, other BLOSUM matrices, like the PAM matrices, may be useful in other applications. For example, BLOSUM45 is particularly strong in profile searching.

C. FASTA

The FASTA suite of programs permits the evaluation of DNA and protein similarity based on local sequence alignment. The FASTA search algorithm utilizes Smith/Waterman- and Needleman/Wunsch-based optimization methods. These algorithms consider all of the alignment possibilities between the query sequence and the library in the highest-scoring sequence regions. The search algorithm proceeds in four basic steps:

1. The identities or pairs of identities between the two DNA or protein sequences are determined. The ktup parameter, as set by the user, is operative and determines how many consecutive sequence identities are required to indicate a match.
2. The regions identified in step I are re-scored using a PAM or BLOSUM matrix. This allows conservative replacements and runs of identities shorter than that specified by ktup to contribute to the similarity score.
3. The region with the single best scoring initial region is used to characterize pairwise similarity and these scores are used to rank the library sequences.
4. The highest scoring library sequences are aligned using the Smith-Waterman algorithm. This final comparison takes into account the possible alignments of the query and library sequence in the highest scoring region.

Further detailed description of the FASTA software and its use can be found in the following reference: Pearson and Lipman, Proc. Natl. Acad. Sci., 85: 2444 [1988].

D. Pfam

Despite the large number of different protein sequences determined through genomics-based approaches, relatively few structural and functional domains are known. Pfam is a computational method that utilizes a collection of multiple alignments and profile hidden Markov models of protein domain families to classify existing and newly found protein sequences into structural families. Detailed descriptions of the Pfam software and its uses can be found in the following references: Sonhammer et al., Proteins: Structure, Function and Genetics, 28:405 [1997]; Sonhammer et al., Nucleic Acids Res., 26:320 [1998]; Bateman et al., Nucleic Acids Res., 27: 260 [1999].

Pfam 3.1, the latest version, includes 54% of proteins in SWISS_PROT [For a recent reference see: Barker W. C., Garavelli J. S., Hou Z., Huang H., Ledley R. S., McGarvey P. B., Mewes H.-W., Orcutt B. C., Pfeiffer F., Tsugita A., Vinayaka C. R., Xiao C., Yeh L. S., Wu C.; Nucleic Acids Res. 29:29-32(2001)] and SP-TrEMBL-5 (A supplement to SWISS_PROT) as a match to the database and includes expectation values for matches. Pfam consists of parts A and B. Pfam-A contains a hidden Markov model and includes curated families. Pfam-B uses the Domainer program to cluster sequence segments not included in Pfam-A. Domainer uses pairwise homology data from BLASTP to construct aligned families.

Alternative protein family databases that may be used include PRINTS and BLOCKS. Both are based on a set of ungapped blocks of aligned residues. However, these programs typically contain short conserved regions whereas Pfam represents a library of complete domains that facilitates automated annotation. Comparisons of Pfam profiles may also be performed using genomic and EST (An abbreviation for expressed sequence tag which are defined as single pass sequencing of cDNAs usually 5') data with the programs, Genewise and ESTwise, respectively. Both of these programs allow for introns and frame shifting errors.

E. BLOCKS

The determination of sequence relationships between unknown sequences and those that have been categorized can be problematic because background noise increases with the number of sequences, especially at a low level of similarity detection. One recent approach to this problem has been tested that efficiently detects and confirms weak or distant relationships among protein sequences based on a database of blocks. The BLOCKS database provides multiple alignments of sequences and contains blocks or protein motifs found in known families of proteins.

Other programs such as PRINTS [The PRINTS database of protein fingerprints prepared under the supervision of Terri Attwood at the University of Manchester. Reference: Attwood T. K., Croning M. D. R., Flower D. R., Lewis A. P., Mabey J. E., Scordis P., Selley J. N. and Wright W.; Nucleic Acids Res. 28:225-227(2000)] and Prodom also provide alignments, however, the BLOCKS database differs in the manner in which the database was constructed. Construction of the BLOCKS database [S. Henikoff & J. G. Henikoff, "Protein family classification based on searching a database of blocks", Genomics 19:97-107 (1994). S. Henikoff, J. G. Henikoff, W. J. Alford & S. Pietrokovski, "Automated construction and graphical presentation of protein blocks from unaligned sequences", Gene-COMBIS, Gene 163 (1995) GC 17-26. S. Pietrokovski, "Searching Databases of Conserved Seqeuence Regions by Aligning Protein Multiple-Alignments", NAR 24:3836-3845 (1996)] proceeds as follows: one starts with a group of sequences that presumably have one or motifs in common, such as those from the PROSITE database [Hofmann K., Bucher P., Falquet L. and Bairoch A.; Nucleic Acids Res. 27:215-219(1999)]. The PROTOMAT program [S Henikoff & J G Henikoff, "Automated assembly of protein blocks for database searching", NAR (1991) 19:6565-6572) using the MOTIF algorithm (H O Smith, et al, "Finding sequence motifs in groups of functionally related proteins", PNAS (1990) 87:826-830] then uses a motif finding program to scan sequences for similarity looking for spaced triplets of amino acids. The located blocks are then entered into the MOTOMAT program [The first step (PROTOMAT) finds candidate alignments and the second step (MOTOMAT) extends the alignments, then sorts them in such a way that a best set is chosen] for block assembly. Weights are computed for all sequences. Following construction of a BLOCKS database one can use BLIMPS [this is a tool to search BLOCKS. I believe the reference is Henikoff S, Henikoff J G, Alford W J and Pietroskouski S (1995) Gene 163 GC17-26] to performs searches of the BLOCKS database. Detailed descriptions of the construction and use of a BLOCKS database can be found in the following references: Henikoff, S. and Henikoff, J. G., Genomics, 19:97 [1994]; Henikoff, J. G. and Henikoff, S., Meth. Enz., 266:88 [1996].

F. PRINTS

The PRINTS database of protein family fingerprints can be used in addition to BLOCKS and PROSITE. These databases are considered to be secondary databases because they diagnose the relationship between sequences that yield function information. Presently, however, it is not recommended that these databases be used alone. Rather, it is strongly suggested that these pattern databases be used in conjunction with each other so that a direct comparison of results can be made to analyze their robustness.

Generally, these programs utilize pattern recognition to discover motifs within protein sequences. However, PRINTS goes one step further, it takes into account not simply single motifs but several motifs simultaneously that might characterize a family signature. Other programs, such as PROSITE, rely on pattern recognition but are limited by the fact that query sequences must match them exactly. Thus, sequences that vary slightly will be missed. In contrast, the PRINTS database fingerprinting approach is capable of identifying distant relatives due to its reliance on the fact that sequences do not have to match the query exactly. Instead they are scored according to how well they fit each motif in the signature. Another advantage of PRINTS is that it allows the user to search both PRINTS and PROSITE simultaneously. A detailed description of the use of PRINTS can be found in the following reference: Attwood et al., Nucleic Acids Res. 25: 212 [1997].

III. Nucleic Acid Sequences, Including Related, Variant, Modified and Extended Sequences This invention encompasses nucleic acids, polypeptides encoded by the nucleic acid sequences, and variants that retain at least one biological or other functional activity of the polynucleotide or polypeptide of interest. A preferred polynucleotide variant is one having at least 80%, and more preferably 90%, sequence identity to the sequence of interest. A most preferred polynucleotide variant is one having at least 95% sequence identity to the polynucleotide of interest.

In particularly preferred embodiments, the invention encompasses the polynucleotides comprising a polynucleotide encoded by SEQ ID NOs:1-7554. In particularly preferred embodiments, the nucleic acids are operably linked to an exogenous promoter (and in most preferred embodiments to a plant promoter) or present in a vector.

It will be appreciated by those skilled in the art that as a result of the degeneracy of the genetic code, a multitude of nucleotide sequences encoding a given polypeptide (for example, a polypeptide encoded by a nucleic acid of the present invention), some bearing minimal homology to the nucleotide sequences of any known and naturally occurring gene, may be produced. Thus, the invention contemplates each and every possible variation of nucleotide sequence that could be made by selecting combinations based on possible codon choices. These combinations are made in accordance with the standard triplet genetic code as applied to the nucleotide sequence of the naturally occurring polypeptide, and all such variations are to be considered as being specifically disclosed.

Although nucleotide sequences that encode a given polypeptide (for example, a polypeptide encoded by a nucleic acid of the present invention) and its variants are preferably capable of hybridizing to the nucleotide sequence of the naturally occurring polypeptide under appropriately selected conditions of stringency, it may be advantageous to produce nucleotide sequences encoding the polypeptide or its derivatives possessing a substantially different codon usage. Codons may be selected to increase the rate at which expression of the peptide occurs in a particular prokaryotic or eukaryotic host in, accordance with the frequency with which particular codons are utilized by the host. Other reasons for substantially altering the nucleotide sequence encoding a polypeptide and its derivatives without altering the encoded amino acid sequences include the production of RNA transcripts having more desirable properties, such as a greater half-life, than transcripts produced from the naturally occurring sequence.

The invention also encompasses production of DNA sequences, or portions thereof, that encode a polynucleotide and its variants, entirely by synthetic chemistry. After production, the synthetic sequence may be inserted into any of the many available expression vectors and cell systems using reagents that are well known in the art. Moreover, synthetic chemistry may be used to introduce mutations into a sequence encoding a polynucleotide of the present invention or any portion thereof.

Also encompassed by the invention are polynucleotide sequences that are capable of hybridizing to SEQ ID NOs:1-7554 under various conditions of stringency (for example, conditions ranging from low to high stringency). Hybridization conditions are based on the melting temperature $T_m$ of the nucleic acid binding complex or probe, as taught in Wahl and Berger, Methods Enzymol., 152:399 [1987] and Kimmel, Methods Enzymol., 152:507 [1987], and may be used at a defined stringency.

Modified nucleic acid sequences encoding a polynucleotide of the present invention include deletions, insertions, or substitutions of different nucleotides resulting in a polynucleotide that encodes the same polypeptide or a functionally equivalent polynucleotide or polypeptide. The encoded protein may also contain deletions, insertions, or substitutions of amino acid residues that produce a silent change and result in a functionally equivalent polypeptide. Deliberate amino acid substitutions may be made on the basis of similarity in polarity, charge, solubility, hydrophobicity, hydrophilicity, and/or the amphipathic nature of the residues as long as the biological activity of the polypeptide is retained. For example, negatively charged amino acids may include aspartic acid and glutamic acid; positively charged amino acids may include lysine and arginine; and amino acids with uncharged polar head groups having similar hydrophilicity values may include leucine, isoleucine, and valine; glycine and alanine; asparagine and glutamine; serine and threonine; phenylalanine and tyrosine.

Also included within the scope of the present invention are alleles of the genes encoding polypeptides. As used herein, an "allele" or "allelic sequence" is an alternative form of the gene that may result from at least one mutation in the nucleic acid sequence. Alleles may result in modified mRNAs or polypeptides whose structure or function may or may not be modified. Any given gene may have none, one, or many allelic forms. Common mutational changes that give rise to alleles are generally ascribed to natural deletions, additions, or substitutions of nucleotides. Each of these types of changes may occur alone, or in combination with the others, one or more times in a given sequence.

Methods for DNA sequencing that are well known and generally available in the art may be used to practice any embodiments of the invention. The methods may employ such enzymes as the Klenow fragment of DNA polymerase I, SEQUENASE (US Biochemical Corporation; Cleveland, Ohio), TAQ polymerase (U.S. Biochemical Corporation, Cleveland, Ohio), thermostable T7 polymerase (Amersham Pharmacia Biotech; Chicago, Ill.), or combinations of recombinant polymerases and proofreading exonucleases such as the ELONGASE amplification system (Life Technologies, Inc.; Rockville, Md.). Preferably, the process is automated with machines such as the MICROLAB 2200 (Hamilton Company; Reno, Nev.), PTC200 DNA Engine thermal cycler (MJ Research; Watertown, Mass.) and the ABI 377 DNA sequencer (Perkin Elmer).

The nucleic acid sequences encoding a polynucleotide of the present invention may be extended utilizing a partial nucleotide sequence and employing various methods known in the art to detect upstream sequences such as promoters and regulatory elements. For example, one method that may be employed, "restriction-site" PCR, uses universal primers to retrieve unknown sequence adjacent to a known locus [Sarkar, PCR Methods Applic. 2:318 (1993)]. In particular, genomic DNA is first amplified in the presence of primer to linker sequence and a primer specific to the known region. The amplified sequences are then subjected to a second round of PCR with the same linker primer and another specific primer internal to the first one. Products of each round of PCR are transcribed with an appropriate RNA polymerase and sequenced using reverse transcriptase.

Inverse PCR may also be used to amplify or extend sequences using divergent primers based on a known region [Triglia et al., Nucleic Acids Res. 16:8186 (1988)]. The primers may be designed using OLIGO 4.06 primer analysis software (National Biosciences Inc.; Plymouth, Minn.), or another appropriate program, to be 22-30 nucleotides in length, to have a GC content of 50% or more, and to anneal to the target sequence at temperatures about 68-72° C. The method uses several restriction enzymes to generate a suitable fragment in the known region of a gene. The fragment is then circularized by intramolecular ligation and used as a PCR template.

Another method that may be used is capture PCR which involves PCR amplification of DNA fragments adjacent to a known sequence in human and yeast artificial chromosome DNA [Lagerstrom et al., PCR Methods Applic. 1:111 (1991)]. In this method, multiple restriction enzyme digestions and ligations may also be used to place an engineered double-stranded sequence into an unknown portion of the DNA molecule before performing PCR.

Another method that may be used to retrieve unknown sequences is that of Parker et al., Nucleic Acids Res., 19:3055 [1991]. Additionally, one may use PCR, nested primers, and PROMOTERFINDER DNA Walking Kits libraries (Clontech; Palo Alto, Calif.) to walk in genomic DNA. This process avoids the need to screen libraries and is useful in finding intron/exon junctions.

When screening for full-length cDNAs, it is preferable to use libraries that have been size-selected to include larger cDNAs. Also, random-primed libraries are preferable, in that they will contain more sequences that contain the 5' regions of genes. Use of a randomly primed library may be especially preferable for situations in which an oligo d(T) library does not yield a full-length cDNA. Genomic libraries may be useful for extension of sequence into the 5' and 3' non-transcribed regulatory regions.

Capillary electrophoresis systems that are commercially available (for example, from PE Biosystems, Inc.; Foster City, Calif.) may be used to analyze the size or confirm the nucleotide sequence of sequencing or PCR products. In particular, capillary sequencing may employ flowable polymers for electrophoretic separation, four different fluorescent dyes (one for each nucleotide) that are laser activated, and detection of the emitted wavelengths by a charge coupled device camera. Output/light intensity may be converted to electrical signal using appropriate software (for example, GENOTYPER and SEQUENCE NAVIGATOR from PE Biosystems; Foster City, Calif.) and the entire process from loading of samples to computer analysis and electronic data display may be computer controlled. Capillary electrophoresis is especially preferable for the sequencing of small pieces of DNA that might be present in limited amounts in a particular sample.

It is contemplated that the nucleic acids disclosed herein can be utilized as starting nucleic acids for directed evolution. In some embodiments, artificial-evolution is performed by random mutagenesis (for example, by utilizing error-prone PCR to introduce random mutations into a given coding sequence). This method requires that the frequency of mutation be finely tuned. As a general rule, beneficial mutations are rare, while deleterious mutations are common. This is because the combination of a deleterious mutation and a beneficial mutation often results in an inactive enzyme. The ideal number of base substitutions for a targeted gene is usually between 1.5 and 5 [Moore and Arnold, Nat. Biotech., 14, 458-67 (1996); Leung et al., Technique, 1:11-15 (1989); Eckert and Kunkel, PCR Methods Appl., 1:17-24 (1991); Caldwell and Joyce, PCR Methods Appl., 2:28-33 (1992); and Zhao and Arnold, Nuc. Acids. Res., 25:1307-08 (1997)]. After mutagenesis, the resulting clones are selected for desirable activity. Successive rounds of mutagenesis and selection are often necessary to develop enzymes with desirable properties. It should be noted that only the useful mutations are carried over to the next round of mutagenesis.

In other embodiments of the present invention, the polynucleotides of the present invention are used in gene shuffling or sexual PCR procedures (for example, Smith, Nature, 370: 324-25 [1994]; U.S. Pat. Nos. 5,837,458; 5,830,721; 5,811,238; and 5,733,731, each of which is herein incorporated by reference). Gene shuffling involves random fragmentation of several mutant DNAs followed by their reassembly by PCR into full length molecules. Examples of various gene shuffling procedures include, but are not limited to, assembly following DNase treatment, the staggered extension process (STEP), and random priming in vitro recombination. In the DNase mediated method, DNA segments isolated from a pool of positive mutants are cleaved into random fragments with DNaseI and subjected to multiple rounds of PCR with no added primer. The lengths of random fragments approach that of the uncleaved segment as the PCR cycles proceed, resulting in mutations in present in different clones becoming mixed and accumulating in some of the resulting sequences. Multiple cycles of selection and shuffling have led to the functional enhancement of several enzymes [Stemmer, Nature, 370:398-91 (1994); Stemmer, Proc. Natl. Acad. Sci. USA, 91, 10747-51 (1994); Crameri et al., Nat. Biotech., 14:315-19 (1996); Zhang et al., Proc. Natl. Acad. Sci. USA, 94:4504-09 (1997); and Crameri et al., Nat. Biotech., 15:436-38 (1997)].

IV. Vectors, Engineering, and Expression of Sequences

In another embodiment of the invention, the polynucleotide sequences of the present invention and fragments and portions thereof, may be used in recombinant DNA molecules to direct expression of an mRNA or polypeptide in appropriate host cells. Due to the inherent degeneracy of the genetic code, other DNA sequences that encode substantially the same or a functionally equivalent mRNA or amino acid sequence may be produced and these sequences may be used to clone and express polypeptides (for example, a polypeptide encoded by a nucleic acid of the present invention).

As will be understood by those of skill in the art, it may be advantageous to produce nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life that is longer than that of a transcript generated from the naturally occurring sequence.

The nucleotide sequences of the present invention can be engineered using methods generally known in the art in order to alter the polypeptide sequences for a variety of reasons, including but not limited to, alterations that modify the cloning, processing, and/or expression of the gene product. DNA shuffling by random fragmentation and PCR reassembly of gene fragments and synthetic oligonucleotides may be used to engineer the nucleotide sequences. For example, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences encoding a polypeptide may be ligated to a heterologous sequence to encode a fusion protein. For example, to screen peptide libraries for inhibitors of the polypeptides activity (for example, enzymatic activity), it may be useful to encode a chimeric protein that can be recognized by a commercially available antibody. A fusion protein may also be engineered to contain a cleavage site located between the polypeptide encoding sequence and the heterologous protein sequence, so that the polypeptide of interest may be cleaved and purified away from the heterologous moiety.

In another embodiment, sequences encoding a polypeptide (for example, a polypeptide encoded by a nucleic acid of the present invention) may be synthesized, in whole or in part, using chemical methods well known in the art [See for example, Caruthers et al., Nucl. Acids Res. Symp. Ser. 215 (1980); Horn et al., Nucl. Acids Res. Symp. Ser. 225 (1980)]. Alternatively, the protein itself may be produced using chemical methods to synthesize the amino acid sequence of the polypeptide of interest (for example, a polypeptide encoded by a nucleic acid of the present invention), or a portion thereof. For example, peptide synthesis can be performed using various solid-phase techniques [Roberge et al., Science 269:202 (1995)] and automated synthesis may be achieved, for example, using the ABI 431A peptide synthesizer (PE Corporation, Norwalk, Conn.).

The newly synthesized peptide may be substantially purified by preparative high performance liquid chromatography [See for example, Creighton, T. (1983) Proteins, Structures and Molecular Principles, WH Freeman and Co., New York, N.Y.]. The composition of the synthetic peptides may be confirmed by amino acid analysis or sequencing (for example, the Edman degradation procedure; or Creighton, supra). Additionally, the amino acid sequence of the polypeptide of interest or any part thereof, may be changed during direct synthesis and/or combined using chemical methods with sequences from other proteins, or any part thereof, to produce a variant polypeptide.

In order to express a biologically active polypeptide (for example, a polypeptide encoded by a nucleic acid of the present invention) or RNA, the nucleotide sequences encoding the polypeptide or functional equivalents, may be inserted into appropriate expression vector, that is, a vector that contains the necessary elements for the transcription and translation of the inserted coding sequence.

Methods that are well known to those skilled in the art may be used to construct expression vectors containing sequences encoding polypeptides (for example, a polypeptide encoded by a nucleic acid of the present invention) and appropriate transcriptional and translational control elements. These methods include in vitro recombinant DNA techniques, synthetic techniques, and in vivo genetic recombination. Such techniques are described in Sambrook. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York, N.Y.

A variety of expression vector/host systems may be utilized to contain and express sequences encoding a polypeptide of interest. These include, but are not limited to, microorganisms such as bacteria transformed with recombinant bacteriophage, plasmid, or cosmid DNA expression vectors; yeast transformed with yeast expression vectors; insect cell systems infected with virus expression vectors (for example, baculovirus); plant cell systems transformed with virus expression vectors (for example, cauliflower mosaic virus, CaMV; tobacco mosaic virus, TMV; brome mosaic virus) or with bacterial expression vectors (for example, Ti or pBR322 plasmids); or animal cell systems.

The "control elements" or "regulatory sequences" are those non-translated regions of the vector (for example, enhancers, promoters, 5' and 3' untranslated regions) that interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the BLUESCRIPT phagemid (Stratagene; LaJolla, Calif.) or PSPORT1 plasmid (Life Technologies, Inc.; Rockville, Md.) and the like may be used. The baculovirus polyhedrin promoter may be used in insect cells. Promoters or enhancers derived from the genomes of plant cells (for example, heat shock, RUBISCO; and storage protein genes) or from plant viruses (for example, viral promoters or leader sequences) may be cloned into the vector. In mammalian cell systems, promoters from mammalian genes or from mammalian viruses are preferable. If it is necessary to generate a cell line that contains multiple copies of the sequence encoding a polypeptide, vectors based on SV40 or EBV may be used with an appropriate selectable marker.

In bacterial systems, a number of expression vectors may be selected depending upon the use intended for the polypeptide of interest. For example, when large quantities of the polypeptide are needed for the induction of antibodies, vectors that direct high level expression of fusion proteins that are readily purified may be used. Such vectors include, but are not limited to, the multifunctional *E. coli* cloning and expression vectors such as BLUESCRIPT phagemid (Stratagene; La Jolla, Calif.), in which the sequence encoding the polypeptide of interest may be ligated into the vector in frame with sequences for the amino-terminal Met and the subsequent 7 residues of beta-galactosidase so that a hybrid protein is produced; pIN vectors (Van Heeke and Schuster, J. Biol. Chem. 264:5503 [1989]; and the like. pGEMX vectors (Promega Corporation; Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast *Saccharomyces cerevisiae*, a number of vectors containing constitutive or inducible promoters such as alpha factor, alcohol oxidase, and PGH may be used. For reviews, See for example, Ausubel et al. (supra) and Grant et al., Methods Enzymol. 153:516 [1987].

In cases where plant expression vectors are used, the expression of sequences encoding polypeptides may be driven by any of a number of promoters. In a preferred embodiment, plant vectors are created using a recombinant plant virus containing a recombinant plant viral nucleic acid, as described in PCT publication WO 96/40867. Subsequently, the recombinant plant viral nucleic acid that contains one or more non-native nucleic acid sequences may be transcribed or expressed in the infected tissues of the plant host and the product of the coding sequences may be recovered from the plant, as described in WO 99/36516.

An important feature of this embodiment is the use of recombinant plant viral nucleic acids that contain one or more non-native subgenomic promoters capable of transcribing or expressing adjacent nucleic acid sequences in the plant host and that result in replication and local and/or systemic spread in a compatible plant host. The recombinant plant viral nucleic acids have substantial sequence homology to plant viral nucleotide sequences and may be derived from an RNA, DNA, cDNA or a chemically synthesized RNA or DNA. A partial listing of suitable viruses is described below.

The first step in producing recombinant plant viral nucleic acids according to this particular embodiment is to modify the nucleotide sequences of the plant viral nucleotide sequence by known conventional techniques such that one or more non-native subgenomic promoters are inserted into the plant viral nucleic acid without destroying the biological, function of the plant viral nucleic acid. The native coat protein coding sequence may be deleted in some embodiments, placed under the control of a non-native subgenomic promoter in other embodiments, or retained in a further embodiment. If it is deleted or otherwise inactivated, a non-native coat protein gene is inserted under control of one of the non-native subgenomic promoters, or optionally under control of the native coat protein gene subgenomic promoter. The non-native coat protein is capable of encapsidating the recombinant plant viral nucleic acid to produce a recombinant plant virus. Thus, the recombinant plant viral nucleic acid contains a coat protein coding sequence, that may be native or a nonnative coat protein coding sequence, under control of one of the native or non-native subgenomic promoters. The coat protein is involved in the systemic infection of the plant host.

Some of the viruses that meet this requirement include viruses from the tobamovirus group such as Tobacco Mosaic virus (TMV), Ribgrass Mosaic Virus (RGM), Cowpea Mosaic virus (CMV), Alfalfa Mosaic virus (AMV), Cucumber Green Mottle Mosaic virus Watermelon Strain (CGMMV-W) and Oat Mosaic virus (OMV) and viruses from the brome mosaic virus group such as Brome Mosaic virus (BMV), Broad Bean Mottle virus and Cowpea Chlorotic mottle virus. Additional suitable viruses include Rice Necrosis virus (RNV), and geminiviruses such as Tomato Golden Mosaic virus (TGMV), Cassava Latent virus (CLV) and Maize Streak virus (MSV). However, the invention should not be construed as limited to using these particular viruses, but rather the method of the present invention is contemplated to include all plant viruses at a minimum.

Other embodiments of plant vectors used for the expression of sequences encoding polypeptides include, for example, viral promoters such as the 35S and 19S promoters of CaMV used alone or in combination with the omega leader sequence from TMV [Takamatsu, EMBO J. 6:307 (1987)]. Alternatively, plant promoters such as the small subunit of RUBISCO or heat shock promoters may be used [Coruzzi et al., EMBO J. 3:1671 (1984); Broglie et al., Science 224:838 (1984); and Winter et al., Results Probl. Cell Differ. 17:85 (1991)]. These constructs can be introduced into plant cells by direct DNA transformation or pathogen-mediated transfection. Such techniques are described in a number of generally available reviews (See for example, Hobbs, S. or Murry, L. E. in McGraw Hill Yearbook of Science and Technology (1992) McGraw Hill, New York, N.Y.; pp. 191-196.

The present invention further provides transgenic plants comprising the polynucleotides of the present invention. In some preferred embodiments, *Agrobacterium* mediated transfection is utilized to create transgenic plants. Since most dicotyledonous plant are natural hosts for *Agrobacterium*, almost every dicotyledonous plant may be transformed by *Agrobacterium* in vitro. Although monocotyledonous plants, and in particular, cereals and grasses, are not natural hosts to *Agrobacterium*, work to transform them using *Agrobacterium* has also been carried out [Hooykas-Van Slogteren et al. (1984) Nature 311:763-764]. Plant genera that may be transformed by *Agrobacterium* include *Arabidopsis, Chrysanthemum, Dianthus, Gerbera, Euphorbia, Pelaronium, Ipomoea, Passiflora, Cyclamen, Malus, Prunus, Rosa, Rubus, Populus, Santalum, Allium, Lilium, Narcissus, Ananas, Arachis, Phaseolus* and *Pisum*.

For transformation with *Agrobacterium*, disarmed *Agrobacterium* cells are transformed with recombinant Ti plasmids of *Agrobacterium tumefaciens* or Ri plasmids of *Agrobacterium rhizogenes* (such as those described in U.S. Pat. No. 4,940,838, the entire contents of which are herein incorporated by reference). The nucleic acid sequence of interest is then stably integrated into the plant genome by infection with the transformed *Agrobacterium* strain. For example, heterologous nucleic acid sequences have been introduced into plant tissues using the natural DNA transfer system of *Agrobacterium tumefaciens* and *Agrobacterium rhizogenes* bacteria [for review, see Klee et al. (1987) Ann. Rev. Plant Phys. 38:467-486].

There are three common methods to transform plant cells with *Agrobacterium*. The first method is co-cultivation of *Agrobacterium* with cultured isolated protoplasts. This method requires an established culture system that allows culturing protoplasts and plant regeneration from cultured protoplasts. The second method is transformation of cells or tissues with *Agrobacterium*. This method requires (a) that the plant cells or tissues can be transformed by *Agrobacterium* and (b) that the transformed cells or tissues can be induced to regenerate into whole plants. The third method is transformation of seeds, apices or meristems with *Agrobacterium*. This method requires micropropagation.

The efficiency of transformation by *Agrobacterium* may be enhanced by using a number of methods known in the art. For example, the inclusion of a natural wound response molecule such as acetosyringone (AS) to the *Agrobacterium* culture has been shown to enhance transformation efficiency with *Agrobacterium tumefaciens* [Shahla et al., (1987) Plant Molec. Biol. 8:291-298]. Alternatively, transformation efficiency may be enhanced by wounding the target tissue to be transformed. Wounding of plant tissue may be achieved, for example, by punching, maceration, bombardment with microprojectiles, etc. [See e.g., Bidney et al., (1992) Plant Molec. Biol. 18:301-313].

In still further embodiments, the plant cells are transfected with vectors via particle bombardment (i.e., with a gene gun). Particle mediated gene transfer methods are known in the art, are commercially available, and include, but are not limited to, the gas driven gene delivery instrument descried in McCabe, U.S. Pat. No. 5,584,807, the entire contents of which are herein incorporated by reference. This method involves coating the nucleic acid sequence of interest onto heavy metal particles, and accelerating the coated particles under the pressure of compressed gas for delivery to the target tissue.

Other particle bombardment methods are also available for the introduction of heterologous nucleic acid sequences into plant cells. Generally, these methods involve depositing the nucleic acid sequence of interest upon the surface of small, dense particles of a material such as gold, platinum, or tungsten. The coated particles are themselves then coated onto either a rigid surface, such as a metal plate, or onto a carrier sheet made of a fragile material such as mylar. The coated sheet is then accelerated toward the target biological tissue. The use of the flat sheet generates a uniform spread of accelerated particles that maximizes the number of cells receiving particles under uniform conditions, resulting in the introduction of the nucleic acid sample into the target tissue.

An insect system may also be used to express polypeptides (for example, a polypeptide encoded by a nucleic acid of the present invention). For example, in one such system, *Autographa californica* nuclear polyhedrosis virus (AcNPV) is used as a vector to express foreign genes in *Spodoptera frugiperda* cells or in *Trichoplusia* larvae. The sequences encoding a polypeptide of interest may be cloned into a non-essential region of the virus, such as the polyhedrin gene, and placed under control of the polyhedrin promoter. Successful insertion of the nucleic acid sequence encoding the polypeptide of interest will render the polyhedrin gene inactive and produce recombinant virus lacking coat protein. The recombinant viruses may then be used to infect, for example, *S. frugiperda* cells or *Trichoplusia* larvae in which the polypeptide may be expressed [Engelhard et al., Proc. Nat. Acad. Sci. 91:3224 (1994)].

In mammalian host cells, a number of viral-based expression systems may be utilized. In cases where an adenovirus is used as an expression vector, sequences encoding polypeptides may be ligated into an adenovirus transcription/translation complex consisting of the late promoter and tripartite leader sequence. Insertion in a non-essential E1 or E3 region of the viral genome may be used to obtain a viable virus that is capable of expressing the polypeptide in infected host cells [Logan and Shenk, Proc. Natl. Acad. Sci., 81:3655 (1984)]. In addition, transcription enhancers, such as the Rous sarcoma virus (RSV) enhancer, may be used to increase expression in mammalian host cells.

Specific initiation signals may also be used to achieve more efficient translation of sequences encoding the polypeptide of interest. Such signals include the ATG initiation codon and adjacent sequences. In cases where sequences encoding the polypeptide of interest, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers that are appropriate for the particular cell system that is used, such as those described in the literature [Scharf et al., Results Probl. Cell Differ., 20:125 (1994)].

In addition, a host cell strain may be chosen for its ability to modulate the expression of the inserted sequences or to process the expressed protein in the desired fashion. Such modifications of the polypeptide include, but are not limited to, acetylation, carboxylation, glycosylation, phosphorylation, lipidation, and acylation. Post-translational processing that cleaves a "prepro" form of the protein may also be used to facilitate correct insertion, folding and/or function. Different host cells such as CHO, HeLa, MDCK, HEK293, and WI38, that have specific cellular machinery and characteristic mechanisms for such post-translational activities, may be chosen to ensure the correct modification and processing of the foreign protein.

For long-term, high-yield production of recombinant proteins, stable expression is preferred. For example, cell lines that stably express the polypeptide of interest (for example, a polypeptide encoded by a nucleic acid of the present invention) may be transformed using expression vectors that may contain viral origins of replication and/or endogenous expression elements and a selectable marker gene on the same or on a separate vector. Following the introduction of the vector, cells may be allowed to grow for 1-2 days in an enriched media before they are switched to selective media. The purpose of the selectable marker is to confer resistance to selection, and its presence allows growth and recovery of cells that successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase [Wigler et al., Cell 11:223 (1977)] and adenine phosphoribosyltransferase [Lowy et al., Cell 22:817 (1980)] genes that can be employed in tk⁻ or aprt⁻ cells, respectively. Also, antimetabolite, antibiotic, or herbicide resistance can be used as the basis for selection; for example, dhfr, which confers resistance to methotrexate [Wigler et al., Proc. Natl. Acad. Sci., 77:3567 (1980)]; npt, which confers resistance to the aminoglycosides neomycin and G-418 [Colbere-Garapin et al., J. Mol. Biol., 150:1 (1981)]; and als or pat, which confer resistance to chlorsulfuron and phosphinotricin acetyltransferase, respectively (Murry, supra). Additional selectable genes have been described, for example, trpB, which allows cells to utilize indole in place of tryptophan, or hisD, which allows cells to utilize histinol in place of histidine [Hartman and Mulligan, Proc. Natl. Acad. Sci., 85:8047 (1988)]. Recently, the use of visible markers has gained popularity with such markers as anthocyanins, α-glucuronidase and its substrate GUS, and luciferase and its substrate luciferin, being widely used not only to identify transformants, but also to quantify the amount of transient or stable protein expression attributable to a specific vector system [Rhodes et al., Methods Mol. Biol., 55:121 (1995)].

Although the presence/absence of marker gene expression suggests that the gene of interest is also present, its presence and expression may need to be confirmed. For example, if the sequence encoding a polypeptide is inserted within a marker gene sequence, recombinant cells containing sequences encoding the polypeptide can be identified by the absence of marker gene function. Alternatively, a marker gene can be placed in tandem with a sequence encoding the polypeptide under the control of a single promoter. Expression of the marker gene in response to induction or selection usually indicates expression of the tandem gene as well.

Alternatively, host cells that contain the nucleic acid sequence encoding the polypeptide of interest (for example, a polypeptide encoded by a nucleic acid of the present invention) and express the polypeptide may be identified by a variety of procedures known to those of skill in the art. These procedures include, but are not limited to, DNA-DNA or DNA-RNA hybridizations and protein bioassay or immunoassay techniques that include membrane, solution, or chip based technologies for the detection and/or quantification of nucleic acid or protein.

The presence of polynucleotide sequences encoding a polypeptide of interest (for example, a polypeptide encoded by a nucleic acid of the present invention) can be detected by DNA-DNA or DNA-RNA hybridization or amplification using probes or portions or fragments of polynucleotides encoding the polypeptide. Nucleic acid amplification based assays involve the use of oligonucleotides or oligomers based on the sequences encoding the polypeptide to detect transformants containing DNA or RNA encoding the polypeptide. As used herein "oligonucleotides" or "oligomers" refer to a nucleic acid sequence of at least about 10 nucleotides and as many as about 60 nucleotides, preferably about 15 to 30 nucleotides, and more preferably about 20-25 nucleotides, that can be used as a probe or amplimer.

A variety of protocols for detecting and measuring the expression of a polypeptide (for example, a polypeptide encoded by a nucleic acid of the present invention), using either polyclonal or monoclonal antibodies specific for the protein are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on the polypeptide is preferred, but a competitive binding assay may be employed. These and other assays are described, among other places, in Hampton et al., 1990; Serological Methods, a Laboratory Manual, APS Press, St Paul, Minn. and Maddox et al., J. Exp. Med., 158:1211 (1983).

A wide variety of labels and conjugation techniques are known by those skilled in the art and may be used in various nucleic acid and amino acid assays. Means for producing labeled hybridization or PCR probes for detecting sequences related to polynucleotides encoding a polypeptide of interest include oligonucleotide labeling, nick translation, end-labeling or PCR amplification using a labeled nucleotide. Alternatively, the sequences encoding the polypeptide, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits from Pharmacia & Upjohn (Kalamazoo, Mich.), Promega Corporation (Madison, Wis.) and U.S. Biochemical Corp. (Cleveland, Ohio). Suitable reporter molecules or labels, that may be used, include radionuclides, enzymes, fluorescent, chemiluminescent, or chromogenic agents as well as substrates, cofactors, inhibitors, magnetic particles, and the like.

Host cells transformed with nucleotide sequences encoding a polypeptide of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides that encode the polypeptide of interest (for example, a polypeptide encoded by a nucleic acid of the present invention) may be designed to contain signal sequences that direct secretion of the polypeptide through a prokaryotic or eukaryotic cell membrane. Other recombinant constructions may be used to join sequences encoding the polypeptide to nucleotide sequence encoding a polypeptide domain that will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). The inclusion of cleavable linker sequences such as those specific for Factor XA or enterokinase (available from Invitrogen; San Diego, Calif.) between the purification domain and the polypeptide of interest may be used to facilitate purification. One such expression vector provides for expression of a fusion protein containing the polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath et al., Prot. Exp. Purif., 3:263 [1992] while the enterokinase cleavage site provides a means for purifying the polypeptide from the fusion protein. A discussion of vectors that contain fusion proteins is provided in Kroll et al., DNA Cell Biol., 12:441 (1993).

In addition to recombinant production, fragments of the polypeptide of interest may be produced by direct peptide synthesis using solid-phase techniques [Merrifield, J. Am. Chem. Soc., 85:2149 (1963)]. Protein synthesis may be performed using manual techniques or by automation. Automated synthesis may be achieved, for example, using the Applied Biosystems 431A peptide synthesizer (Perkin Elmer). Various fragments of the polypeptide may be chemically synthesized separately and combined using chemical methods to produce the full-length molecule.

V. Alteration of Gene Expression

It is contemplated that the polynucleotides of the present invention (for example, SEQ ID NOs:1-7554) may be utilized to either increase or decrease the level of corresponding mRNA and/or protein in transfected cells as compared to the levels in wild-type cells. Accordingly, in some embodiments, expression in plants by the methods described above leads to the overexpression of the polypeptide of interest in transgenic plants, plant tissues, or plant cells. The present invention is not limited to any particular mechanism. Indeed, an understanding of a mechanism is not required to practice the present invention. However, it is contemplated that overexpression of the polynucleotides of the present invention will alter the expression of the gene comprising the nucleic acid sequence of the present invention. In some embodiments, more than one of SEQ ID NOs:1-7554 are expressed in a given plant. The sequences may be contained in the same vector or in different vectors. The sequences can influence the same metabolic trait (e.g., fatty acid metabolism or one of the other traits discussed in more detail below) or multiple metabolic traits (e.g., fatty acid and carbohydrate metabolism).

In other embodiments of the present invention, the polynucleotides are utilized to decrease the level of the protein or mRNA of interest in transgenic plants, plant tissues, or plant cells as compared to wild-type plants, plant tissues, or plant cells. One method of reducing protein expression utilizes expression of antisense transcripts (for example, U.S. Pat. Nos. 6,031,154; 5,453,566; 5,451,514; 5,859,342; and 4,801,340, each of which is incorporated herein by reference). Antisense RNA has been used to inhibit plant target genes in a tissue-specific manner [for example, Van der Krol et al., Biotechniques 6:958-976 (1988)]. Antisense inhibition has been shown using the entire cDNA sequence as well as a partial cDNA sequence [for example, Sheehy et al., Proc. Natl. Acad. Sci. USA 85:8805-8809 (1988); Cannon et al., Plant Mol. Biol. 15:39-47 (1990)]. There is also evidence that 3' non-coding sequence fragment and 5' coding sequence fragments, containing as few as 41 base-pairs of a 1.87 kb cDNA, can play important roles in antisense inhibition [Ch'ng et al., Proc. Natl. Acad. Sci. USA 86:10006-10010 (1989)].

Accordingly, in some embodiments, the nucleic acids of the present invention (for example, SEQ ID NOs:1-7554, and fragments and variants thereof) are oriented in a vector and expressed so as to produce antisense transcripts. To accomplish this, a nucleic acid segment from the desired gene is cloned and operably linked to a promoter such that the antisense strand of RNA will be transcribed. The expression cassette is then transformed into plants and the antisense strand of RNA is produced. The nucleic acid segment to be introduced generally will be substantially identical to at least a portion of the endogenous gene or genes to be repressed. The sequence, however, need not be perfectly identical to inhibit expression. The vectors of the present invention can be designed such that the inhibitory effect applies to other proteins within a family of genes exhibiting homology or substantial homology to the target gene.

Furthermore, for antisense suppression, the introduced sequence also need not be full length relative to either the primary transcription product or fully processed mRNA. Generally, higher homology can be used to compensate for the use of a shorter sequence. Furthermore, the introduced sequence need not have the same intron or exon pattern, and homology of non-coding segments may be equally effective. Normally, a sequence of between about 30 or 40 nucleotides and up to about the full length of the coding region should be used, although a sequence of at least about 100 nucleotides is preferred, a sequence of at least about 200 nucleotides is more preferred, and a sequence of at least about 500 nucleotides is especially preferred.

Catalytic RNA molecules or ribozymes can also be used to inhibit expression of the target gene or genes. It is possible to design ribozymes that specifically pair with virtually any target RNA and cleave the phosphodiester backbone at a specific location, thereby functionally inactivating the target RNA. In carrying out this cleavage, the ribozyme is not itself changed, and is thus capable of recycling and cleaving other molecules, making it a true enzyme. The inclusion of ribozyme sequences within antisense RNAs confers RNA-cleaving activity upon them, thereby increasing the activity of the constructs.

A number of classes of ribozymes have been identified. One class of ribozymes is derived from a number of small circular RNAs that are capable of self-cleavage and replication in plants. The RNAs replicate either alone (viroid RNAs) or with a helper virus (satellite RNAs). Examples include RNAs from avocado sunblotch viroid and the satellite RNAs from tobacco ringspot virus, lucerne transient streak virus, velvet tobacco mottle virus, Solanum nodiflorum mottle virus and subterranean clover mottle virus. The design and use of target RNA-specific ribozymes is described in Haseloff, et al., Nature 334:585-591 (1988).

Another method of reducing protein expression utilizes the phenomenon of cosuppression or gene silencing (for example, U.S. Pat. Nos. 6,063,947; 5,686,649; and 5,283,184; each of which is incorporated herein by reference). The phenomenon of cosuppression has also been used to inhibit plant target genes in a tissue-specific manner. Cosuppression of an endogenous gene using a full-length cDNA sequence as well as a partial cDNA sequence (730 bp of a 1770 bp cDNA) are known [for example, Napoli et al., Plant Cell 2:279-289 [1990]; van der Krol et al., Plant Cell 2:291-299 (1990); Smith et al., Mol. Gen. Genetics 224:477-481 (1990]). Accordingly, in some embodiments the nucleic acids (for example, SEQ ID NOs: 1-7554, and fragments and variants thereof) from one species of plant are expressed in another species of plant to effect cosuppression of a homologous gene. Generally, where inhibition of expression is desired, some transcription of the introduced sequence occurs. The effect may occur where the introduced sequence contains no coding sequence per se, but only intron or untranslated sequences homologous to sequences present in the primary transcript of the endogenous sequence. The introduced sequence generally will be substantially identical to the endogenous sequence intended to be repressed. This minimal identity will typically be greater than about 65%, but a higher identity might exert a more effective repression of expression of the endogenous sequences. Substantially greater identity of more than about 80% is preferred, though about 95% to absolute identity would be most preferred. As with antisense regulation, the effect should apply to any other proteins within a similar family of genes exhibiting homology or substantial homology.

For cosuppression, the introduced sequence in the expression cassette, needing less than absolute identity, also need not be full length, relative to either the primary transcription product or fully processed mRNA. This may be preferred to avoid concurrent production of some plants that are overexpressers. A higher identity in a shorter than full length sequence compensates for a longer, less identical sequence. Furthermore, the introduced sequence need not have the same intron or exon pattern, and identity of non-coding segments will be equally effective. Normally, a sequence of the size ranges noted above for antisense regulation is used.

VI. Expression of Sequences Producing Altered Metabolic Characteristics

The present invention provides nucleic sequences involved in providing altered metabolic characteristics in plants. Plants transformed with viral vectors comprising the nucleic acid sequences of the present invention were screened for an altered metabolic characteristic. The results are presented in FIG. 6. Accordingly, in some embodiments, the present invention provides nucleic acid sequences that produce an altered metabolic characteristic when expressed in a plant (SEQ ID NOs:1-1165, 3703-4153 and 7389-7554, FIG. 1). The present invention is not limited to the particular nucleic acid sequences listed. Indeed, the present invention encompasses nucleic acid sequences (including sequences of the same, shorter, and longer lengths) that hybridize to the listed nucleic sequences under conditions ranging from low to high stringency and that also cause the altered metabolic characteristic. These sequences are conveniently identified by insertion into GENEWARE™ vectors and expression in plants as detailed in the examples.

The present invention is not limited to any particular mechanism. Indeed, an understanding of a mechanism is not required to practice the present invention. However, it is contemplated that the expression of genes comprising the nucleic acid sequences of the present invention effect biochemical pathways that lead to the alteration of metabolic characteristics of the present invention. For example, the expression of genetic function that effects the acyl acetylglycerol pathway that leads to the production of the altered esters such as 2-steroyl-1-acetylglycerol and 2-eicosanoyl-1-acetylglycerol. The present invention is not limited to alterations of any particular metabolic pathway. Indeed, the alteration of a variety of metabolic pathways is contemplated, including, but not limited to the pathways involved in the production of the following compounds: acids, fatty acids, branched fatty acids, alcohols, alkaloids, aleknes, alkynes, amino acids, carbohydrates, esters, glycerol, phenols, sterols, terpenes, isoprenoids, ketones, and quinones.

In some embodiments, the sequences are operably linked to a plant promoter or provided in a vector as described in more detail above. This present invention also contemplates plants transformed or transfected with these sequences, as well as seeds, fruit, leaves, stems and roots from such transfected plants. Furthermore, the sequences can be expressed in either sense or antisense orientation. In particularly preferred embodiments, the sequences are at least 30 nucleotides in length up to the length of the full-length of the corresponding gene. It is contemplated that sequences of less than full length (for example, greater than about 30 nucleotides) are useful for down regulation of gene expression via antisense or cosuppression. Suitable sequences are selected by chemically synthesizing the sequences, cloning into GENEWARE™ expression vectors, expressing in plants, and selecting plants with an altered metabolic characteristic.

In some embodiments, the present invention provides methods and compositions for increasing, decreasing, or otherwise altering the production of acids in plants. Examples of acids that can be altered according to the present invention include, but are not limited to, fumaric acid, malic acid, carbamic acid, glyceric acid, citric acid, ketoglutaric acid, quinic acid, shikimic acid, and sugar acids, such as, gluconic acid and galacturonic acid. The alterations in metabolic profiles are preferably accomplished by expressing, in a plant, one or more of the nucleic acid sequences in FIG. 1 or 2 (or sequences that hybridize thereto) shown to alter the production of acids in plants. In preferred embodiments, expression in plants of the sequences that hybridize to the preceding sequences also results in an increase, decrease, or alteration of acid production in a plant.

In some embodiments, the present invention provides methods and compositions for increasing, decreasing, or otherwise altering the production of fatty acids in plants. Examples of fatty acids that can be altered according to the present invention include, but are not limited to, tetradecanoic acid, hexadecanoic acid, heptadecanoic acid, octadecanoic acid, eicosanoic acid, docosanoic acid, 9-hexadecenoic acid, 6-octadecenoic acid, 9-octadecanoic acid, 7,10-hexadecadienoic acid, 9,12-octadecadienoic acid, 9,12,15-octadecatrienoic acid, and 7,10,13-docosatrienic acid. The alterations in metabolic profiles are preferably accomplished by expressing, in a plant, one or more of the nucleic acid sequences in FIG. 1 or 2 (or sequences that hybridize thereto) shown to alter the production of fatty acids in plants. In preferred embodiments, expression in plants of the sequences that hybridize to the preceding sequences also results in an increase, decrease, or alteration of fatty acid production in a plant.

In some embodiments, the present invention provides methods and compositions for increasing, decreasing, or otherwise altering the production of branched fatty acids in plants. Examples of branched fatty acids that can be altered according to the present invention include, but are not limited to, 14-methylhexadecanoic acid, 16-methylheptadecanoic acid, 17-methylheptadecanoic acid, 20-methylheneicosanoic acid, and 3,7,11,15-tetramethylhexadecanoic acid. The alterations in metabolic profiles are preferably accomplished by expressing, in a plant, one or more of the nucleic acid sequences in FIG. 1 or 2 (or sequences that hybridize thereto) shown to alter the production of branched fatty acids in plants. In preferred embodiments, expression in plants of the sequences that hybridize to the preceding sequences also results in an increase, decrease, or alteration of branched fatty acid production in a plant.

In some embodiments, the present invention provides methods and compositions for increasing, decreasing, or otherwise altering the production of alcohols in plants. Examples of alcohols that can be altered according to the present invention include, but are not limited to, octadecanol, phytol, valereneol, and sugar alcohols, such as, inositol and mannitol. The alterations in metabolic profiles are preferably accomplished by expressing, in a plant, one or more of the nucleic acid sequences in FIG. 1 or 2 (or sequences that hybridize thereto) shown to alter the production of alcohols in plants. In preferred embodiments, expression in plants of the sequences that hybridize to the preceding sequences also results in an increase, decrease, or alteration of alcohol production in a plant.

In some embodiments, the present invention provides methods and compositions for increasing, decreasing, or otherwise altering the production of alkaloids and other bases in plants. Examples of alkaloids and other bases that can be altered according to the present invention include, but are not limited to, nicotine, nornicotine, and 1,4-butanediamine. The alterations in metabolic profiles are preferably accomplished by expressing, in a plant, one or more of the nucleic acid sequences in FIG. 1 or 2 (or sequences that hybridize thereto) shown to alter the production of alkaloids (or other bases) in plants. In preferred embodiments, expression in plants of the sequences that hybridize to the preceding sequences also results in an increase, decrease, or alteration of alkaloid and other base production in a plant.

In some embodiments, the present invention provides methods and compositions for increasing, decreasing, or otherwise altering the production of alkenes and alkynes (unsaturated hydrocarbons) in plants. Examples of alkenes and alkynes that can be altered according to the present invention include, but are not limited to, limonene, dimethylcyclooctadiene, 4-methyldecene, eicosene, tetramethylhexadecene, dehydroisolongifolene, and squalene. The alterations in metabolic profiles are preferably accomplished by expressing, in a plant, one or more of the nucleic acid sequences in FIG. 1 or 2 (or sequences that hybridize thereto) shown to alter the production of alkenes and alkynes in plants. In preferred embodiments, expression in plants of the sequences that hybridize to the preceding sequences also results in an increase, decrease, or alteration of alkene and alkyne production in a plant.

In some embodiments, the present invention provides methods and compositions for increasing, decreasing, or otherwise altering the production of amino acids and related compounds in plants. Examples of amino acids and related compounds that can be altered according to the present invention include, but are not limited to, proline, glycine, alanine, serine, aspartic acid, glutamic acid, lysine, tyrosine, phenylalanine, valine, threonine, arginine, glutamine, tryptophan, isoleucine, and 5-oxo-proline. The alterations in metabolic profiles are preferably accomplished by expressing, in a plant, one or more of the nucleic acid sequences in FIG. 1 or 2 (or sequences that hybridize thereto) shown to alter the production of amino acids in plants. In preferred embodiments, expression in plants of the sequences that hybridize to the preceding sequences also results in an increase, decrease, or alteration of amino acid and related compounds production in a plant.

In some embodiments, the present invention provides methods and compositions for increasing, decreasing, or otherwise altering the production of carbohydrates in plants. Examples of carbohydrates that can be altered according to the present invention include, but are not limited to, arabinose, xylose, glucose, fructose, galactose, fructose, mannose, rhamnose, and sucrose. The alterations in metabolic profiles are preferably accomplished by expressing, in a plant, one or more of the nucleic acid sequences in FIG. 1 or 2 (or sequences that hybridize thereto) shown to alter the production of carbohydrates in plants. In preferred embodiments, expression of the sequences that hybridize to the preceding sequences also results in an increase, decrease, or alteration of carbohydrate production in a plant.

In some embodiments, the present invention provides methods and compositions for increasing, decreasing, or otherwise altering the production of esters in plants. Examples of esters that can be altered according to the present invention include, but are not limited to, acylates, such as 2-steroyl-1-acetylglycerol and 2-eicosanoyl-1-acetylglycerol. The alterations in metabolic profiles are preferably accomplished by expressing, in a plant, one or more of the nucleic acid sequences in FIG. 1 or 2 (or sequences that hybridize thereto) shown to alter the production of esters in plants. In preferred embodiments, expression in plants of the sequences that hybridize to the preceding sequences also results in an increase, decrease, or alteration of ester production in a plant.

In some embodiments, the present invention provides methods and compositions for increasing, decreasing, or otherwise altering the production of glycerides in plants. Examples of glycerides that can be altered according to the present invention include, but are not limited to, glycerol palmitate, and glycerol linoleate, and glyceryl linolenate. The alterations in metabolic profiles are preferably accomplished by expressing, in a plant, one or more of the nucleic acid sequences in FIG. 1 or 2 (or sequences that hybridize thereto) shown to alter the production of glycerides in plants. In preferred embodiments, expression in plants of the sequences that hybridize to the preceding sequences also results in an increase, decrease, or alteration of glyceride production in a plant.

In some embodiments, the present invention provides methods and compositions for increasing, decreasing, or otherwise altering the production of hydrocarbons (saturated) in plants. Examples of hydrocarbons that can be altered according to the present invention include, but are not limited to, eicosane, hentriacontane, 2-methyloctacosane, 3-methylnonacosane, 2-methyltriacontane, 3-methylhentriacontane, and 2-methyldotriacontane. The alterations in metabolic profiles are preferably accomplished by expressing, in a plant, one or more of the nucleic acid sequences in FIG. 1 or 2 (or sequences that hybridize thereto) shown to alter the production of hydrocarbons in plants. In preferred embodiments, expression in plants of the sequences that hybridize to the preceding sequences also results in an increase, decrease, or alteration of hydrocarbon production in a plant.

In some embodiments, the present invention provides methods and compositions for increasing, decreasing, or otherwise altering the production of phenols and related compounds in plants. Examples of phenols and related compounds that can be altered according to the present invention include, but are not limited to, caffeic acid and chlorogenic acid. The alterations in metabolic profiles are preferably accomplished by expressing, in a plant, one or more of the nucleic acid sequences in FIG. 1 or 2 (or sequences that hybridize thereto) shown to alter the production of phenols (and related compounds) in plants. In preferred embodiments, expression in plants of the sequences that hybridize to the preceding sequences also results in an increase, decrease, or alteration of phenol and related compounds in a plant.

In some embodiments, the present invention provides methods and compositions for increasing, decreasing, or otherwise altering the production of sterols, oxygenated terpenes, and other isoprenoids in plants. Examples of sterols, oxygenated terpenes, and other isoprenoids that can be altered according to the present invention include, but are not limited to, solanesol, cycloartenol, alpha-tocopherol, alpha-tocopherol quinone, beta-tocopherol, gamma-tocopherol, stigmastenol, cycloartenol, stigmastatriene, campesterol, cholesterol, sitosterol, stigmasterol, methylene-lophenol, methylene-cycloartenol, dimethylergostadienol, fucosterol, ergostenone, fucosterol, stigmastadienol, and lanosterol. The alterations in metabolic profiles are preferably accomplished by expressing, in a plant, one or more of the nucleic acid sequences in FIG. 1 or 2 (or sequences that hybridize thereto) shown to alter the production of sterols, oxygenated terpenes, or other isoprenoids, in plants. In preferred embodiments, expression in plants of the sequences that hybridize to the preceding sequences also results in an increase, decrease, or alteration of sterol, oxygenated terpene, and other isoprenoid production in a plant.

In some embodiments, the present invention provides methods and compositions for increasing, decreasing, or otherwise altering the production of ketones and quinones in plants. Examples of ketones and quinones that can be altered according to the present invention include, but are not limited to, 3-phytolmenadione and alpha-tocopherol quinone. The alterations in metabolic profiles are preferably accomplished by expressing, in a plant, one or more of the nucleic acid sequences in FIG. 1 or 2 (or sequences that hybridize thereto) shown to alter the production of ketones and quinones. In preferred embodiments, expression in plants of the sequences that hybridize to the preceding sequences also results in an increase, decrease, or alteration of ketone and quinone production in a plant.

VII. Identification of Homologs to Sequences

The present invention also provides homologs and variants of the sequences described above, but which may not hybridize to the sequences described above under conditions ranging from low to high stringency. In some preferred embodiments, the homologous and variant sequences are operably linked to an exogenous promoter. FIG. 3 provides BLASTX search results from publicly available databases. The relevant sequences are identified by Accession numbers in these databases. FIG. 4 contains the top BLASTX hits (identified by Accession number) versus all the amino acid sequences in the Derwent™ biweekly database. FIG. 5 contains the top BLASTN hits (identified by Accession number) versus all the nucleotide sequences in the Derwent™ biweekly database.

In some embodiments, the present invention comprises homologous nucleic acid sequences (SEQ ID NOs:1166-3702 and 4154-7388) identified by screening an internal database with SEQ ID NOs.1-1165, 3703-4153 and 7389-7554 at a confidence level of Pz<1.00E-20. These sequences are provided in FIG. 2. The headers list the sequence identifier for the sequence that produced the actual phenotypic hit first and the sequence identifier for the homologous contig second.

As will be understood by those skilled in the art, the present invention is not limited to the particular sequences of the homologs described above. Indeed, the present invention encompasses portions, fragments, and variants of the homologs as described above. Such variants, portions, and fragments can be produced and identified as described in Section III above. In particularly preferred embodiments, the present invention provides sequences that hybridize to SEQ ID NOs:1166-3702 and 4154-7388 under conditions ranging from low to high stringency. In other preferred embodiments, the present invention provides nucleic acid sequences that inhibit the binding of SEQ ID NOs:1166-3702 and 4154-7388 to their complements under conditions ranging from low to high stringency. Furthermore, as described above in Section IV, the homologs can be incorporated into vectors for expression in a variety of hosts, including transgenic plants.

Homolog contigs, FIG. 2 (as described in Example 16, Section D: *Identification of Homologous Sequences*) are formed from individual sequence runs belonging to clones whose sequences share a predefined level of nucleotide identity to each other and are presumably independent isolates of a single gene sequence. This list of clones composing any one homolog contig are the actual entities that are screened. If clones sharing homology to a particular hit sequence, FIG. 1, perform a very similar or identical function within the organism, then these clones should also result in metabolic alterations when tested in the metabolic screen. The data contained in FIG. 9 are provided as examples of the metabolic phenotype correlation between homolog clones. FIG. 9 shows the correlation between the homolog sequence pairs and the metabolic alterations observed in this invention. Biochemicals, common to both clones, are listed with the corresponding chemical and biochemical classes. The alterations, up-regulated or down-regulated, observed for these biochemicals are also reported.

EXAMPLES

Example 1

Construction of Tissue-Specific *N. benthamiana* cDNA Libraries

A. mRNA Isolation: Leaf, root, flower, meristem, and pathogen-challenged leaf cDNA libraries were constructed. Total RNA samples from 10.5 µg of the above tissues were isolated by TRIZOL reagent (Life Technologies, Inc.; Rockville, Md.). The typical yield of total RNA was 1 mg PolyA+ RNA and was purified from total RNA by DYNABEADS oligo $(T)_{25}$. Purified mRNA was quantified by UV absorbance at $OD_{260}$ The typical yield of mRNA was 2% of total RNA. The purity was also determined by the ratio of $OD_{260}/OD_{280}$. The integrity of the samples had OD values of 1.8-2.0.

B. cDNA Synthesis: cDNA was synthesized from mRNA using the SUPERSCRIPT plasmid system (Life Technologies, Inc.; Rockville, Md.) with cloning sites of NotI at the 3' end and SalI at the 5' end. After fractionation through a gel column to eliminate adapter fragments and short sequences, cDNA was cloned into both GENEWARE™ vector p1057 NP and phagemid vector PSPORT in the multiple cloning region between NotI and XhoI sites. Over 20,000 recombinants were obtained for all of the tissue-specific libraries.

C. Library Analysis: The quality of the libraries was evaluated by checking the insert size and percentage from representative 24 clones. Overall, the average insert size was above 1 kb, and the recombinant percentage was >95%.

Example 2

Construction of Normalized *N. benthamiana* cDNA Library in GENEWARE™ Vectors

A. cDNA synthesis. A pooled RNA source from the tissues described above was used to construct a normalized cDNA library. Total RNA samples were pooled in equal amounts first, then polyA+RNA was isolated by DYNABEADS oligo $(dT)_{25}$. The first strand cDNA was synthesized by the Smart III system (Clontech; Palo Alto, Calif.). During the synthesis, adapter sequences with Sfi1a and Sfi1b sites were introduced by the polyA priming at the 3' end and 5' end by the template switch mechanism (Clontech; Palo Alto, Calif.). Eight µg first strand cDNA was synthesized from 24 µg mRNA. The yield and size were determined by UV absorbance and agarose gel electrophoresis.

B. Construction of Genomic DNA driver. Genomic DNA driver was constructed by immobilizing biotinylated DNA fragments onto streptavidin-coated magnetic beads. Fifty µg genomic DNA was digested by EcoR1 and BamH1 followed by fill-in reaction using biotin-21-dUTP. The biotinylated fragments were denatured by boiling and immobilized onto DYNABEADS by the conjugation of streptavidin and biotin.

C. Normalization Procedure. Six µg of the first strand cDNA was hybridized to 1 µg of genomic DNA driver in 100 µl of hybridization buffer (6×SSC, 0.1% SDS, 1× Denhardt's buffer) for 48 hours at 65° C. with constant rotation. After hybridization, the cDNA bound on genomic DNA beads was washed 3 times by 20 µl 1×SSC/0.1% SDS at 65° C. for 15 min and one time by 0.1×SSC at room temperature. The cDNA bound to the beads was then eluted in 10 µl of fresh-made 0.1N NaOH from the beads and purified by using a QIAGEN DNA purification column (QIAGEN GmbH; Hilden, Germany), which yielded 110 ng of normalized cDNA fragments. The normalized first strand cDNA was converted to double strand cDNA in 4 cycles of PCR with Smart primers annealed to the 3' and 5' end adapter sequences.

D. Evaluation of normalization efficiency. Ninety-six non-redundant cDNA clones selected from a randomly sequenced pool of 500 clones of a previously constructed whole seedling library were used to construct a nylon array. One hundred ng of the normalized cDNA fragments versus the non-normalized fragments were radioactively labeled by $^{32}P$ and hybridized to DNA array nylon filters. The hybridization images and intensity data were acquired by a PHOSPHORIMAGER (Amersham Pharmacia Biotech; Chicago, Ill.). Since the 96 clones on the nylon arrays represent different abundance classes of genes, the variance of hybridization intensity among these genes on the filter were measured by standard deviation before and after normalization. The results indicated that by using this type of normalization approach, a 1000-fold reduction in variance among this set of genes could be achieved.

E. Cloning of normalized cDNA into GENEWARE™ vector. The normalized cDNA fragments were digested by Sfi1 endonuclease, which recognizes 8-bp sites with variable sequences in the middle 4 nucleotides. After size fractionation, the cDNA was ligated into GENEWARE™ vector p1057 NP in antisense orientation and transformed into DH5α cells. Over 50,000 recombinants were obtained for this normalized library. The percentage of insert and size were evaluated by Sfi digestion of randomly picked 96 clones followed by electrophoresis on 1% of agarose gel. The average insert size was 1.5 kb, and the percentage of insert was 98% with vector only insertions of >2%.

F Sequence analysis of normalized cDNA library. Two plates of 96 randomly picked clones have been sequenced from the 5' end of cDNA inserts. One hundred ninety-two quality sequences were obtained after trimming of vector sequences and other standard quality checking and filtering procedure, and subjected to BLASTX search in DNA and protein databases. Over 40% of these sequences had no hit in the databases. Clustering analysis was conducted based on accession numbers of BLASTX matches among the 112 sequences that had hits in the databases. Only three genes (tumor-related protein, citrin, and rubit) appeared twice. All other members in this group appeared only once. This was a strong indication that this library is well-normalized. Sequence analysis also revealed that 68% of these 192 sequences had putative open reading frames using the ORF finder program (as described above), indicating possible full-length cDNA.

Example 3

Rice cDNA Library Construction in GENEWARE™ Vectors

*Oryzae sativa* var. Indica IR-7 was grown in greenhouses under standard conditions (12/12 photoperiod, 29° C. daytime temp., 24° C. night temp.). The following types of tissue were harvested, immediately frozen on dry ice and stored at −80° C.: young leaves (20 days post sowing), mature leaves and panicles (122 days post sowing). Mature and immature root tissue (either 122 or 20 days post sowing) was harvested, rinsed in ddH$_2$O to remove soil, frozen on dry ice and stored at −80° C.

The following standard method (Life Technologies) was used for generation of cDNA and cloning. High quality total RNA was purified from target tissues using Trizol (LTI) reagent. mRNA was purified by binding to oligo (dT) and subsequent elution. Quality of mRNA samples is essential to cDNA library construction and was monitored spectrophotmetrically and via gel electrophoresis. 2-5 µg of mRNA was primed with an oligo (dT)-NotI primer and cDNA was synthesized (no isotope was used in cDNA synthesis). SalI adaptors were ligated to the cDNA, which was then subjected to digestion with NotI. Restriction fragments were fractionated based on size and the first 10 fractions were measured for DNA quantity and quality. Fractions 6 to 9 were used for ligations. 100 ng of GENEWARE™ vector was ligated to 20 ng synthesized cDNA. Following ligations, the mixtures were kept at −20° C. For transformation, 1 µl to 10 µl ligation reaction mixture was added to 100 µl of competent *E. coli* cells (strain DH5α) and transformed using the heat shock method. After transformation, 900 µl SOC medium was added to the culture and it was incubated at 37° C. for 60 minutes. Transformation reactions were plated out on 22×22 cm LB/Amp agar plates and incubated overnight at 37° C.

Example 4

Poppy cDNA Library Construction in GENEWARE™ Vectors

A. Plant Growth. A wild population of *Papaver rhoeas* resistant to auxin 2,4-Dichlorophenoxyacetic acid (2,4-D) was identified from a location in Spain and seed was collected. The seed was germinated and yielded a morphologically heterogeneous population. Leaf shape varied from deeply to shallowly indented. Latex color in some individuals was pure white when freshly cut, slowly changing to light orange then brown. Latex in other individuals was bright yellow or orange and rapidly changed to dark brown upon exposure to air. A single plant (PR4) with the white latex phenotype was used to generate the library.

B. RNA extraction. Approximately 1.5 g of leaves and stems were collected and frozen on liquid nitrogen. The tissue was ground to a fine powder and transferred to a 50 mL conical polypropylene screw cap centrifuge tube. Ten mL of TRIZOL reagent (Life Technologies, Inc.; Rockville, Md.) was added and vortexed at high speed for several minutes of short intervals until an aqueous mixture was attained. Two mL of chloroform was added and the suspension was again vortexed at high speed for several minutes. The tube was centrifuged 15 minutes at 3100 rpm in a tabletop centrifuge (GP Centrifuge, Beckman Coulter, Inc; Fullerton, Calif.) for resolution of the phases. The aqueous supernatant was then carefully transferred to diethylpyrocarbonate (DEPC)-treated 1.5 mL microtubes and total RNA was precipitated with 0.6 volumes of isopropanol. To facilitate precipitation, the solution was allowed to stand 10 minutes at room temperature after thorough mixing. Following centrifugation for 10 minutes at 8000 rpm in a microcentrifuge (model 5415C, Eppendorf AG, Hamburg), the pellet of total RNA was washed with 70% ethanol, briefly dried and resuspended in 200 µL DEPC-treated deionized water. A 10 µL aliquot was examined by non-denaturing agarose gel electrophoresis.

C. cDNA synthesis. To generate cDNA, approximately 50 µg of total RNA was primed with 250 pmole of first strand oligo (TAIL: 5'-GAG-GAT-GTT-AAT-TAA-GCG-GCC- GCT-GCA-G(T)$_{23}$-3')(SEQ ID NO:7555) in a volume of 250 µL using 1000 units of Superscript reverse transcriptase (Life Technologies, Inc.; Rockville, Md.) for 90 minutes at 42° C. Phenol extraction was performed by adding an equal volume of phenol:chloroform:isoamyl alcohol (25:24:1 v/v), vortexing thoroughly, and centrifuging 5 minutes at 14,000 rpm in an Eppendorf microfuge. The aqueous supernatant phase was transferred to a fresh microfuge tube and the first strand cDNA:mRNA hybrids were precipitated with ethanol by adding 0.1 volume of 3 M sodium acetate and 2 volumes of absolute ethanol. After 5 minutes at room temperature, the tube was centrifuged 15 minutes at 14,000 rpm. The pellet was washed with 80% ethanol, dried briefly and resuspended in 100 µL TE buffer (10 mM TrisCl, 1 mM EDTA, pH 8.0). After adding 10 µL Klenow buffer (RE buffer 2, Life Technologies, Inc.; Rockville, Md.) and dNTPs (Life Technologies, Inc.; Rockville, Md.) to a final concentration of I MM, second strand cDNA was generated by adding 10 units of Klenow enzyme (Life Technologies, Inc.; Rockville, Md.), 2 units of RNase H (Life Technologies, Inc.; Rockville, Md.) and incubating at 37° C. for 2 hrs. The buffer was adjusted with β-nicotinamide adenine dinucleotide β-NAD) by addition of E. coli ligase buffer (Life Technologies, Inc.; Rockville, Md.) and adenosine triphosphate (ATP, Sigma Chemical Company, St. Louis, Mo.) added to a final concentration of 0.6 mM. Double stranded phosphorylated cDNA was generated by addition of 10 units of E. coli DNA ligase (Life Technologies, Inc.; Rockville, Md.), 10 units of T4 polynucleotide kinase (Life Technologies, Inc.; Rockville, Md.) and incubating for 20 minutes at ambient temperature.

The double stranded cDNA was isolated through phenol extraction and ethanol precipitation, as described above. The pellet was washed with 80% ethanol, dried briefly and resuspended in a minimal volume of TE. The resuspended pellet was ligated overnight at 16° C. with 50 pmole of kinased AP3-AP4 adapter (AP-3: 5'-GAT-CTT-AAT-TAA-GTC-GAC-GAA-TTC-3'/AP-4: 5'-GAA-TTC-GTCGAC-TTA-ATT-AA-3 ')(SEQ ID NOs:7556-7557) and 2 units of T4 DNA ligase (Life Technologies, Inc.; Rockville, Md.). Ligation products were amplified by 20 cycles of PCR using AP-3 primer and examined by agarose gel electrophoresis.

Expanded adapter-ligated cDNA was digested overnight at 37° C. with PacI and NotI restriction endonucleases. The GENEWARE™ vector pBSG1056 (Large Scale Biology Corporation, Vacaville, Calif.) was similarly treated. Digested cDNA and vector were electrophoresed a short distance through low-melting temperature agarose. After visualizing with ethidium bromide and excising the appropriate fraction(s), the fragments were then isolated by melting the agarose and quickly diluting 5: I with TE buffer to keep from solidifying. The diluted fractions were mixed in the appropriate ratio (approximately 10:1 vector:insert ratio) and ligated overnight at 16° C. using T4 DNA ligase. Characterization of the ligation revealed an average insert size of 1.27 kb. The ligation was transferred to LSBC, Inc. where large scale arraying was carried out. Random sequencing of nearly 100 clones indicated that about 40% of the inserts had full length open frames.

Example 5

ABRC Library Construction in GENEWARE™ Expression Vectors

Expressed sequence tag (EST) clones were obtained from the Arabidopsis Biological Resource Center (ABRC; The Ohio State University, Columbus, Ohio 43210). These clones originated from Michigan State University (from the labs of Dr. Thomas Newman of the DOE Plant Research Laboratory and Dr. Chris Somerville, Carnegie Institution of Washington) and from the Centre National de la Recherche Scientifique Project (CNRS project; donated by the Groupement De Recherche 1003, Centre National de la Recherche Scientifique, Dr. Bernard Lescure et al.). The clones were derived from cDNA libraries isolated from various tissues of Arabidopsis thaliana var Columbia. A clone set of 11,982 clones was received as glycerol stocks arrayed in 96 well plates, each with an ABRC identifier and associated EST sequence.

An ORF finding algorithm was performed on the EST clone set to find potential full-length genes. Approximately 3,200 full-length genes were found and used to make GENEWARE™ constructs in the sense orientation. Five thousand of the remaining clones (not full-length) were used to make GENEWARE™ constructs in the antisense orientation.

Full-length clones used to make constructs in the sense orientation were grown and DNA was isolated using Qiagen (Qiagen Inc.; Valencia, Calif. 91355) mini-preps. Each clone was digested with NotI and Sse 8387 eight base pair enzymes. The resultant fragments were individually isolated and then combined. The combined fragments were ligated into pGTN P/N vector (with polylinker extending from PstI to NotI—5' to 3'). For each set of 96 original clones approximately 192 colonies were picked from the pooled GENEWARE™ ligations, grown until confluent in deep-well 96-well plates, DNA prepped and sequenced. The ESTs matching the ABRC data was bioinformatically checked by BLAST and a list of missing clones was generated. Pools of clones found to be missing were prepared and subjected to the same process. The entire process resulted in greater than 3,000 full-length sense clones.

The negative sense clones were processed in the same manner, but ligated into pGTN N/P vector (with polylinker extending from NotI to PstI—5' to 3'). For each set of 96 original clones approximately 192 colonies were picked from the pooled GENEWARE™ ligations and DNA prepped. The DNA from the GENEWARE™ ligations was subjected to RFLP analysis using TaqI 4 base cutter. Novel patterns were identified for each set. The RFLP method was applied and only applicable for comparison within a single ABRC plate. This procedure resulted in greater than 6,000 negative sense clones.

The identified clones were re-arrayed, transcribed, encapsidated and used to inoculate plants.

Example 6

Regulatory Factors cDNA Library Construction in GENEWARE™ Vectors

Transcription factors represent a class of genes that regulate and control many aspects of plant physiology, including growth, development, metabolism and response to the environment. In order to analyze a collection of regulatory factor genes, the PCR-based methods described below were used to construct a library of such genes from Arabidopsis thaliana and Saccharomyces cerevisiae. In addition, clones containing genes corresponding to regulatory factors from N. benthamiana, Oryzae sativa and Papaver rhoeas were selected, based on cDNA sequence, from the libraries generated in GENEWARE™ vectors as described above.

A. Regulatory Factor Gene Targeting. Publicly accessible databases of genome sequence include data on a wide range of organisms, from microbes to human. Many of these databases include annotation along with gene sequences that predict function of the genes based on either experimental data or homology to characterized genes. The MIPS (Munich Information Center for Protein Sequences) database contains sequence information and annotation for both *Arabidopsis thaliana* and *Saccharomyces cerevisiae* genomes. Based on this annotation, open reading frame sequences of predicted yeast and *Arabidopsis* transcription factors were downloaded from MIPS and used for PCR primer design.

B. PCR Primer Design 18-20 base pairs of nucleotide sequences at both ends of each downloaded ORF were extracted and used to design the gene-specific portion of individual primers. In addition, flanking sequence and restriction sites were added to the ends of primers as shown in the following example:

```
                                              SEQ ID NO:7558
5' primer
GCCTTAATTAACTGCAGC atgtcgggtcgtgaagatgaag
    PacI   -------
              PstI  5' gene-specific sequence SEQ ID NO:7559
3' primer
TTGATATCTAGAGCGGCCGCTTA tcatgtttcatcatcgaaatcatca
   EcoRV    NotI
            ------      3' gene-specific sequence
            XbaI
```

C. *Arabidopsis* and Yeast Template Preparation. Total RNA was isolated from flowers and apical meristems of the Arabidopsis ecotype Columbia using the Qiagen RNA-easy kit (Cat. no. 75162). mRNA was subsequently isolated from total RNA using the MACS mRNA isolation kit from Miltenyl Biotec (cat. no. 751-02). First strand cDNA was synthesized from 10 μg of mRNA in the presence of Superscript II reverse transcriptase (Gibco BRL cDNA synthesis kit; cat. no. 18248-013) and NotI primer (5'-GACTAGTTCTAGATCGC-GAGCGGCCGCCC(T)$_{30}$VN-3')(SEQ ID NO:7560). The second strand was synthesized based on the manufacturers instructions. This cDNA was diluted 1:5 prior to DNA amplification.

Since most yeast genes do not contain introns, genomic DNA was used directly as a template for PCR. Genomic DNA from *S. cerevisiae* S288C was obtained directly from Research Genetics (ResGen, an Invitrogen company, Huntsville Ala., catalog #40802).

D. PCR Amplification. 1 μl of template DNA was subjected to PCR using the Hi Fi Platinum (hot start) DNA polymerase (Gibco-BRL cat. no. 11304-011) and gene-specific primers for each ORF. Each 50 μl reaction contained: 5 μl 10× buffer, 1 μl of 10 mM dNTP, 2 μl of 50 mM MgSO$_4$, 1 μl of template cDNA, 10 pmoles of each primer and 0.2 unit of Platinum Hi Fi DNA polymerase. PCR reactions were carried out in a MJ Research (Model PTC 200) thermal cycler programmed with the following conditions:

3 min at 95° C.

30 cycles [95° C. 30 sec., 50° C. 30 sec., 72° C. 3 min.]

72° C. 10 min.

Following PCR, reactions were stored at −20° C. until ready for ligation.

D. Subcloning ORFs into GENEWARE™ Vectors. To minimize cost and the labor involved in cloning of individual ORF, PCR products containing different ORFs were cloned into the GENEWARE™ vectors as pooled DNAs. 30-75 PCR products were pooled, digested with PacI and NotI and purified from an agarose gel. Purified DNA was subsequently ligated into the GENEWARE™ vector (5PN-Cap digested with PacI and NotI). Single colonies were selected, grown and their DNA analyzed for the presence of insert. Inserts were gel purified and sequenced, and the sequence compared to the MIP protein database to confirm that they covered the complete ORF. Unique sequences representing various related genes were selected to cover different genes within a multi-gene family. The efficiency of pooled cloning ranged from 30-50% (i.e., 30-50 clones were identified from analysis of 100 pooled PCR products). Following sequence identification of the clones, PCR products that were not represented in the first round of cloning were subsequently pooled together and subjected to a second round.

Example 7

Other Libraries: Regulatory Gene Selection

For each of the cDNA libraries generated from *N. benthamiana*, *Oryzae sativa* and *Papaver Rhoeas*, a unigene set of clones was established. Following basic library construction, all DNA sequences were subjected to BLASTN analysis against each other. Sequences that showed perfect homology across a minimum of 50 base pairs were clustered together. At this level each cluster putatively represents a unique gene. The size of cluster varies depends on the size and complexity of sequence population (sequenced library). A cluster may have only one sequence member, or consist of hundreds of member sequences. The clone with 5'-most sequence in a cluster was then selected to represent the gene. A collection of all the 5'-most sequences or clones was established as the unigene set for that particular library. In the example illustrated below, 4 EST sequences were clustered, representing a putative gene. The EST Seq I contained the most sequence information toward the 5'-end, indicating that this clone had the longest insert relative to other cluster members. This process allows removal of redundant clones and selection of the longest and most-likely full-length clones for subsequent screens.

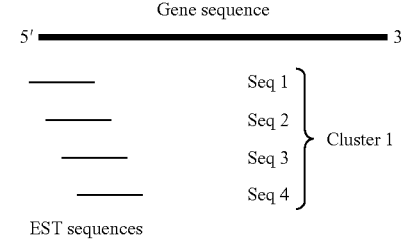

Based on the analysis of the sequence, and annotations of each unigene from each library, all clones that were homologous to known regulatory genes/transcription factors were targets for selection. Depending on the level of homology, some of the clones represented well characterized regulatory genes; however, many of the selected clones had only a modest level of homology to known genes or genes of very distantly related organisms. It is believed that this selection process can increase the probability of gene discovery, and by eliminating non-relevant clones, increase screen efficiency.

Example 8

Trichoderma cDNA Library Construction in GENEWARE™ Vectors

A. Growth and Induction of *Trichoderma harzianum rifai* 1295-22. Cultures of *Trichoderma harzianum* rifai 1295-22 were obtained from ATCC (cat.# 20847) and propagated on PDA. Liquid cultures were inoculated and induced using a protocol derived from Vasseur et al. (*Microbiology* 141:767-774, 1995) and Cortes et al. (*Mol. Gen. Genet.* 260:218-225, 1998): agar-grown cells were used to inoculate a 100 mL culture in PDB and grown 48 hours at 29° C. with agitation. Mycelia were harvested by centrifugation, transferred to Minimal Media (MM) +0.2% glucose, and incubated overnight at 29° C. with agitation. Mycelia were harvested again by centrifugation, washed with MM, resuspended in MM and incubated 2 hours at 29° C. with agitation. Mycelia were harvested again by centrifugation, divided into 2 aliquots, and used to inoculate 1)125 mL MM+0.2% glucose or 2) 125 mL MM +1mg/mL elicitor. Elicitor is a preparation of cell walls from *Rhizoctonia solani* grown in liquid culture and isolated according to Goldman et al. (*Mol. Gen. Genet.* 234:481-488, 1992). Induced and uninduced cultures were incubated at 29° C. with agitation, harvested after 24 and 48 hours by filtration and immediately frozen in liquid nitrogen. Aliquots were assayed for induction using 2-D gel SDS-PAGE to compare induced and uninduced cultures. Both induced and uninduced (24 hours) tissue was used for subsequent RNA isolation and library construction.

B. RNA Isolation and Library Construction. mRNA isolation was accomplished by magnetically labeling polyA$^+$RNA with oligo (dT) microbeads and selecting the magnetically labeled RNA over a column. The purified polyA$^+$RNA was then used for cDNA synthesis using a modified version of the full-length enrichment reactions (cap-capture method) described by Seki et al. (*Plant J.* 15:707-720, 1998). Specifically, isolated mRNA was primed with NotI-oligo d(T) primer to synthesize the first strand cDNA. After the synthesis reaction, a biotin group was chemically introduced to the diol residue of the cap structure of the mRNA molecule. RNase I treatment was then used to digest the mRNA/cDNA hybrids, followed by binding of streptavidin magnetic beads. After this step, the full-length cDNAs were then removed from the beads by RNaseH and tailed with oligo dG by terminal transferase or used directly in the $2^{nd}$ strand synthesis. For the oligo dG tailed samples, the second strand cDNAs were then synthesized with PacI-oligo dC primers and DNA polymerase. Additional modifications to the published procedure include: addition of trehalose and BSA as enzyme stabilizers in the reverse transcriptase reaction, a temperature of 50 to 60° C. for the first strand cDNA synthesis reaction, high stringency binding and washing conditions for capturing biotinylated cap-RNA/cDNA hybrids and substitution of the cDNA poly (dG) tailing step with a Sal-I linker ligation. The cDNA was size-fractionated over a column and the largest 2-3 fractions were collected and used to ligate with GENEWARE™ vector pBSG1057. The ligation reaction was transformed into *E. coli* DH5α and plated, the transformation efficiency was calculated and the DNA from the transformants was subjected to the quality control steps described below:

1. cDNA synthesis/cloning: The cloning efficiency must be greater than $8\times10^5$ cfu/μg.
2. Restriction enzyme digestion and sequencing: 500 to 1,000 transformants were picked and DNA isolated. cDNA inserts were digested out by appropriate restriction enzymes and checked by gel electrophoresis. The average insert size was calculated from 100 random clones. If the average size was >0.9 kbp, the DNA preps were then passed on to the sequencing group to obtain 5'-end sequences. Those sequences were used to further evaluate the of the library. Libraries that did not meet QC standards, such as high vector background (>5%), low full-length percentage (<60%), or short average insert size (<0.7kbp), were discarded, and the entire procedure repeated.

C. Library Subtraction. The induced Trichoderma library in GENEWARE™ was constructed as above and a large number of clones were arrayed on a nylon membrane at high density (HD array). Based on the genomic size and expression levels of *S. cerevisiae*, 18,000 colonies were imprinted to provide 3-fold coverage of the expressed genes. Freshly grown colonies were plated out and picked into 384 well plates and then imprinted on Nylon membranes in 3×3 format at duplicated locations. First strand cDNAs to use as probes were synthesized from mRNAs isolated from both induced and uninduced tissue and used to hybridize the HD arrays. The intensity of each clone after hybridization was quantitated by phosphoimage scanning. The locations of all 18,000 spots were tracked by Array Vision software, which also determined the local background and calculated the signal/noise ratio for every clone on the membrane. The data generated were then converted to Excel format and analyzed to obtain the fold of induction or down-regulation. Based on the measured noise level, a 5-fold increase or decrease, relative to controls, was used as a cutoff value. Clones displaying ≧5-fold induction or reduction on duplicated samples were chosen. These clones were robotically re-arrayed using a Qbot device (see below, Colony Array) DNA was prepped as described below and sequenced. Based on the clustering results, 5'-most unigenes were selected and re-arrayed using the procedures described for the Poppy library above: the total number of clones that were selected was 1,019 for the up-regulated library (Th03), and 851 for the down-regulated library (Th04). These clones were prepared as described below (DNA Preparation, Transcription, Inoculation) and tested in a functional genomic screens for modified visual phenotypes.

Example 9

Colony Array

A. Colony Array—Picking. Ligations were transformed into *E. coli* DH5α cells and plated onto 22×22 cm Genetix "Q Trays" prepared with 200 mL agar, Amp$^{100}$. A Qbot device (Genetix, Inc., Christchurch, Dorset UK) fitted with a 96 pin picking head was used to pick and transfer desired colonies into 384-well plates according to the manufacturers specifications and picking program SB384.SC1, with the following parameters:

Source

Container: Genetix bioassay tray
Color: White
Agar Volume: 200 mL

Destination

Container: Hotel (9 High)
Plate: Genetix 384 well plate
Time In Wells (sec): 2
Max Plates to use: # of 384 well plates 1st Plate: 1
Dips to Inoculate: 10
Well Offset: 1

Head

Head: 96 Pin Picking Head
First Picking Pin: 1
Pin Order: A1-H1, H2-A2 . . . (snaking)
Sterilizing
Qbot Bath #1
Bath Cycles: 4
Seconds in Dryer: 10
Wait After Drying: 10
(approximate picking time: 8 hrs /20,000 colonies)

Following picking, 384 well plates containing bacterial inoculum were grown in a HiGro chamber fitted with $O_2$ at 30° C., speed 6.5 for 12-14 hours. Following growth, plates were replicated using the Qbot with the following parameters, 2 replication runs per plate:
Source
Container: Hotel (9 High)
Plate: Genetix Plate 384 Well
Plates to replicate: 24
Start plate No.: 1
No. of copies: 1
Destination
Container: Universal Dest Plate Holder
Plate: Genetix Plate 384 Well
No. of Dips: 5
Head
Head: 384 Pin Gravity Gridding Head
Sterilizing
Qbot Bath #1
Bath cycles: 4
Seconds in Dryer: 10
Wait After Drying: 10

Airpore tape was placed over the replicated 384 well plates and the replicated plates were grown in the HiGro as above for 18-20 hours, sealed with foil tapes and stored at −80° C.

B. Colony Array—Gridding. Membrane filters were soaked in LB/Ampicillin for 10 minutes. Filters were aligned onto fresh 22×22 cm agar plates and allowed to dry on the plates 30 min. in a Laminar flowhood. Plates and filters were placed in the Qbot and UV sterilized for 20 minutes. Following sterilization, plates/filters were gridded from 384 well plates using the Qbot according to the manufacturers specifications with the following parameters:
Gridding Routine
Name: 3×3
Source
Container: Hotel (9 High)
Plate: Genetix Plate 384 Well
Max Plates: 8
Inking time (ms): 1000
Destination
Filter holder: Qtray
Gridding Pattern: 3×3, non-duplicate, 8
Field Order: front 6 fields
No. Filters: up to 15
Max stamps per ink: 1
Max stamps per spot: 1
Stamp time (ms): 1000
No. Fields in Filter: 2
No. Identical Fields: 2
Stamps between sterilize: 1
Head: 384 pin gravity gridding head
Pin Height Adjustment: No change
Qbot Bath #1
Bath cycles: 4
Dry time: 10 (Seconds)
Wait After Drying: 10 (Seconds)

C. Plate Rearray. 384 well plates were rearrayed into deep 96 well block format using the Qbot according to the manufacturers instructions and the following rearray parameters X2 per plate:
Source
Container: Hotel (9 High)
Plate: Genetix Plate 384 Well
1st Plate: 1
Destination
Container: Universal Dest Plate Holder
Plate: Beckman 96 Deep Well Plate
1st plate: 1
Dips to Inoculate: 5
Well offset: 1
Max plates to use: 12 (or less)
Time in wells (sec): 2
Qbot Bath #1
Head: 96 pin picking head
First Picking Pin: 1
Pin Order: A1-H1, A2-H2, A3-H3 . . .
Bath cycles: 4
Sec. In dryer: 10
Wait after drying: 10

Following rearray, the 96-well blocks were covered with airpore tape and placed in incubator shakers at 37° C., 500 rpm for a total of 24 hours. Plates were removed and used for DNA preparation.

Example 10

DNA Preparation

Plasmid DNA was prepared in a 96-well block format using a Qiagen Biorobot 9600 instrument (Qiagen; Valencia; Calif.) according to the manufacturers specifications. In this 96-well block format, 900 µl of cell lysate was transferred to the Qiaprep filter and vacuumed 5 min. at 600 mbar. Following this vacuum, the filter was discarded and the Qiaprep Prep-Block was vacuumed for 2 min at 600 mbar. After adding buffer, samples were centrifuged for 5 min at 600 rpm (Eppendorf benchtop centrifuge fitted with 96-wp rotor) and subsequently washed ×2 with PE. Elution was carried out for 1 minute, followed by a 5 min. centrifugation at 6000 rpm. Final volume of DNA product was approximately 75 µl.

Example 11

Generation of Raw Sequence Data and Filtering Protocols

High-throughput sequencing was carried out using the PCT200 and TETRAD PCR machines (MJ Research; Watertown, Mass.) in 96-well plate format in combination with two ABI 377 automated DNA sequencers (PE Corporation; Norwalk, Conn.). The throughput at present is six 96-well plates per day. The quality of sequence data is improved by filtering the raw sequence output from sequencer. One criteria is to make sure that the unreadable bases are less than 10% of the total number of bases for any sequence and that there are no more than ten consecutive Ns in the middle part of the sequence (40-450). The sequences that pass these tests are defined as being of high quality. The second step for improving the quality of a sequence is to remove the vectors from the sequence. There are two advantages of this process. First, when locating the vector sequence, its position can be used to align to the input sequence. The quality of the sequence can be evaluated by the alignment between the vector sequence and the target sequence. Second, the removal of the vector sequence greatly improves the signal-to-noise ratio and makes the analysis of the resulting database search much easier. A third important pre-filtering step is to eliminate the duplicates in a library so it will speed up the analysis and reduce redundant analyses.

Example 12

Automated Transcriptions and Encapsidations

Plasmid DNA preparations were subjected to automated transcription reactions in a 96-well plate format using a Tecan Genesis Assay Workstation 200 robotic liquid handling system (Tecan, Inc.; Research Triangle Park, N.C.) according to the manufacturers specifications, operating on the Gemini Software (Tecan, Inc.) program "Automated_Txns.gem. For these reactions, reagents from Ambion, Inc. (Austin, Tex.) were used according to the manufacturers specifications at 0.4× reaction volumes. Following the robotic set-up of transcription reactions, 96-well plates were removed from the Tecan, shaken on a platform shaker for 30 sec., centrifuged in an Eppendorf tabletop centrifuge fitted with a 96-well plate rotor at 700 rcf for 1 minute and incubated at 37° C. for 1.5 hours.

During the transcription reaction incubation, encapsidation mixture was prepared according to the following recipe:

|  | 1X Solution |
| --- | --- |
| Sterile ddi $H_2O$ | 100.5 µL |
| 1 M Sodium Phosphate | 13.0 µL |
| TMV Coat Protein (20 mg/mL) | 6.5 µL |
|  | 120 µL per well |

This mixture was placed in a reservoir of the Tecan and added to the 96-well plates containing transcription reaction following the incubation period using Gemini software program "9_Plates.gem". After adding encapsidation mixture, plates were shaken for 30 sec. on a platform shaker, briefly centrifuged as described above, and incubated at room temperature overnight. Prior to inoculation, encapsidated transcript was sampled and subjected to agarose gel analysis for QC.

Example 13

Infection of N. benthamiana Plants with GENEWARE™ Viral Transcripts

Plant Growth

N. benthamiana seeds were sown in 6.5 cm pots filled with Redi-earth medium (Scotts) that had been pre-wetted with fertilizer solution (147 kg Peters Excel 15-5-15 Cal-Mag (The Scotts Company; Marysville, Ohio), 68 kg Peters Excel 15-0-0 Cal-Lite, and 45 kg Peters Excel 10-0-0 MagNitrate in 596L hot tap $H_2O$, injected (H. E. Anderson; Muskogee, Okla.) into irrigation water at a ratio of 200:1). Seeded pots were placed in the greenhouse for 1 d, transferred to a germination chamber, set to 27° C., for 2 d (Carolina Greenhouses; Kinston, N.C.), and then returned to the greenhouse. Shade curtains (33% transmittance) were used to reduce solar intensity in the greenhouse and artificial lighting, a 1:1 mixture of metal halide and high pressure sodium lamps (Sylvania) that delivered an irradiance of approximately 220 µmol $m^2s^{-1}$ was used to extend day length to 16 h and to supplement solar radiation on overcast days. Evaporative cooling and steam heat were used to regulate greenhouse temperature, maintaining a daytime set point of 27° C. and a nighttime set point of 22° C. At approximately 7 days post sowing (dps), seedlings were thinned to one seedling per pot and at 17 to 21 dps, the pots were spaced farther apart to accommodate plant growth. Plants were watered with Hoagland nutrient solution as required. Following inoculation, waste irrigation water was collected and treated with 0.5% sodium hypochlorite for 10 minutes to neutralize any viral contamination before discharging into the municipal sewer.

Inoculation of Plants

For each GENEWARE™ clone, 180 µL of inoculum was prepared by combining equal volumes of encapsidated RNA transcript and FES buffer [0.1M glycine, 0.06 M $K_2HPO_4$, 1% sodium pyrophosphate, 1% diatomaceous earth (Sigma), and either 1% silicon carbide (Aldrich), or 1% Bentonite (Sigma)]. The inoculum was applied to three greenhouse-grown Nicotiana benthamiana plants at 14 or 17 days post sowing (dps) by distributing it onto the upper surface of one pair of leaves of each plant (~30 µL per leaf). Either the first pair of leaves or the second pair of leaves above the cotyledons was inoculated on 14 or 17 dps plants, respectively. The inoculum was spread across the leaf surface using one of two different procedures. The first procedure utilized a Cleanfoam swab (Texwipe Co, NJ) to spread the inoculum across the surface of the leaf while the leaf was supported with a plastic pot label (3/4×5 2M/RL, White Thermal Pot Label, United Label). The second implemented a 3" cotton tipped applicator (Calapro Swab, Fisher Scientific) to spread the inoculum and a gloved finger to support the leaf. Following inoculation the plants were misted with deionized water and maintained in a greenhouse.

Infection Scoring

At 13 days post inoculation (dpi), the plants were examined visually and a numerical score was assigned to each plant to indicate the extent of viral infection symptoms based on phenotypic characteristics. 0=no infection, 1=possible infection, 2=infection symptoms limited to leaves <50-75% fully expanded, 3=typical infection, 4=atypically severe infection, often accompanied by moderate to severe wilting and/or necrosis.

Example 14

Metabolic Screens

A. Sample Generation. Individual dwarf tobacco Nicotiana benthamiana, (Nb) plants were manually transfected with an unique DNA sequence at 14 or 17 days post sowing using the GENEWARE™ viral vector technology, Example 13. Plants were grown and maintained under greenhouse conditions.

Samples were grouped into sets of up to 96 samples per set for inoculation, harvesting and analysis. Each sample set included 8 negative control (reference samples), up to 80 unknown (test) samples, and 8 quality control samples.

B. Harvesting. At 14 days after infection, infected leaf tissue, excluding stems and petioles, was harvested from plants with an infection score of 3. Infected tissue was placed in a labeled, 50-milliliter (mL), plastic centrifuge tube containing a tungsten carbide ball approximately 1 cm in diameter. The tube was immediately capped, and dipped in liquid nitrogen for approximately 20 seconds to freeze the sample as quickly as possible to minimize degradation of the sample due to biological processes triggered by the harvesting process. Harvested samples were maintained at −80° C. between harvest and analysis. Each sample was assigned a unique identifier, which was used to correlate the plant tissue to the DNA sequence that the plant was transfected with. Each sample set was assigned a unique identifier, referred to as the harvest or meta rack ID.

C. Extraction. Prior to analysis, the frozen sample was homogenized by placing the centrifuge tube on a mechanical shaker. The action of the tungsten carbide ball during approximately 30 seconds of vigorous shaking reduced the frozen whole leaf tissue to a finely homogenized frozen powder. Approximately 1 gram of the frozen powder was extracted with approximately 7.5 mL of a solution of isopropanol (IPA):water 70:30 (v:v), to achieve a 0.133 g/ml ratio, containing pentadecanoic acid ethyl ester (C 15:0 EE) and p-hydroxybenzioc acid as surrogate standards by shaking at room temperature for 30 minutes.

D. Fractionation. A 200 μL aliquot of the IPA:water extract was transferred to a clean glass container and referred to as Fraction 2 (F2). A 1200 microliter (μL) aliquot of the IPA:water extract was partitioned with 1200 μL of hexane. The hexane layer was removed to a clean glass container. This hexane extract is referred to as Fraction 1 (F1). A 90 μL aliquot of the hexane extracted IPA:water extract was removed to a clean glass container. This aliquot is referred to as Fraction 4 (F4). The remaining hexane extracted IPA:water extract is referred to as Fraction 3 (F3). Each fraction for each sample was assigned a unique fraction aliquot ID (sample name).

E. Sample Preparation & Data Generation

Fraction 1: The hexane extract was evaporated to dryness under nitrogen at room temperature. The sample containers were sealed and stored at 4° C. prior to analysis, if storage was required. Immediately prior to capillary gas chromatographic analysis using flame ionization detection (GC/FID), the F1 residue was reconstituted with 180 μL of hexane containing pentacosane and hexatriacontane which were used as internal standards for the F1 analyses. The chromatographic data files generated following GC separation and flame ionization detection were named with the Fraction 1 aliquot ID for each sample and stored in a folder named after the harvest rack (sample set) ID. FIG. 7a summarizes the GC/FID parameters used to analyze Fraction 1 samples.

Fraction 2: The F2 aliquot was evaporated to dryness under nitrogen at room temperature and reconstituted in heptane containing 2 internal standards, undecanoate methyl ester (C11:0) and lignoceroate methyl ester (C24:0). In general, Fraction 2 is designed to analyze esterified fatty acids, such as phospholipids, triacylglycerides, and thioesters. In order to analyze these compounds by GC/FED, they were transmethylated to their respective methyl esters by addition of sodium methoxide in methanol and heat. Excess reagent was quenched by the addition of a small amount of water, which results in phase separation. The fatty acid methyl esters (FAMEs) were contained in the organic phase. FIG. 7b summarizes the GC/FID parameters used to analyze Fraction 2 samples.

Fraction 3: The remaining hexane extracted IPA:water extract (F3) was evaporated under nitrogen at 55° C. The residue was reconstituted with 400 μL of pyridine containing hydroxylamine hydrochloride and the internal standards, n-octyl-β-D-glucopyranoside and tetraclorobenzene (OXIME solution). The derivatization was completed by the addition of 400 μL of the commercially available reagent (N,O-bis[trimethylsily]trifluoroacetamide)+1% trimethylchlorosilane (BSTFA +1% TMCS). The chromatographic data files generated following GC separation and flame ionization detection were named with the Fraction 3 aliquot ID for each sample and stored in a folder named after the harvest rack (sample set) ID. FIG. 7c summarizes the GC/FID parameters used to analyze Fraction 3 samples.

Fraction 4: The F4 aliquot was diluted with 90 μL of distilled water and 20 μL of an 0.1 N hydrochloric acid solution containing norvaline and sarcosine, which are amino acids that are used as internal standards for the amino acids analysis. Immediately prior to high performance liquid chromatographic analysis using fluorescence detection (HPLC/FLD), the amino acids in F4 are mixed in the HPLC injector at room temperature with buffered orthophtaldehyde solution, which derivatizes primary amino acids, followed by fluorenyl methyl chloroformate, which derivatizes secondary amino acids. Following HPLC separation and fluorescence detection, chromatographic data files were generated for each sample, named with a sequential number which can be tracked back to the F4 aliquot ID, and stored in a folder named after the harvest rack (sample set) ID. FIG. 7d summarizes the HPLC/FLD parameters used to analyze Fraction 4 samples.

F. Carbohydrate analysis by digestion of the Dionex extracted plant residue. Approximately 1 gram of frozen homogenized plant tissue was weighed into stainless steel extraction cartridges sandwiched between fiberglass filters. The samples were extracted with approximately 12 mL of 50:50 (v:v) isopropanol:water containing 0.1 N potassium hydroxide at 120° C. and 2000 psi. The extracted sample residue was dried for 2 hours at 100° C. The dry residue, 10 to 20 mg, was transferred from the extraction cartridge into a 13×100 mm glass tube containing 0.5 mL of 0.5 N hydrochloric acid in methanol and 0.12 mL of methyl acetate, blanketed with nitrogen, then sealed with TEFLON coated screw cap and heated for 16 hours at 80° C. The liquid phase was then transferred (using an 8 channel pipetor) to a glass insert supported by a 96 well aluminum block plate containing 10 uL of t-butanol, which was then evaporated to dryness under hot flowing nitrogen. The methyl-glycosides and methyl-glycosides methyl ester residues generated by the methanolysis were silylated in 0.1 mL pyridine and 0.1 mL of the commercially available reagent (N,O-bis[Trimethylsily]trifluoroacetamide)+1% Trimethylchlorosilane (BSTFA+1% TMCS) at room temperature for one hour. The derivatized sample is analyzed by GC/FID using a DB1 capillary column (15 meters, 250 microns I.D., 0.25 microns film thickness) with an 11 minute temperature program (160° C. to 190° C. at 5° C./min, then 190° C. to 298° C. at 36° C. /minute followed by a 2 minute hold). The dual injection GC analyzes 192 samples/day from two 96 well plates. Table 1 lists the carbohydrates that have been identified and quantitated in the sample extracts.

G. Data Analysis & Hit Detection. Two complementary methods were used to identify modifications in the metabolic profile of samples. These data analysis methods are called automated data analysis (ADA) and quantitative data analysis (QUANT. ADA was used to identify hits in Fractions 1, 2, 3, and 4; whereas, QUANT was used to identify hits in the Carbohydrate Fraction and Fractions 2 and 4. If either method identified a fraction as a hit, the nucleic acid sequence used to transfect the plant tissue from which that fraction was obtained is classified as a hit.

ADA employs a qualitative pattern recognition approach using ABNORM (The Dow Chemical Company). ABNORM is described in the U.S. Pat. No. 5,592,402 (incorporated herein by reference). ADA was performed on chromatograms from Fractions 1 through 4. The ADA process developed a statistical model from a subset of all the available chromatograms within an analysis group. The chromatograms in this subset are defined to be "normal" and a chromatogram cannot be part of the normal subset if it fails any one of the following three tests. The first test involves alignment. A chromatogram may fail to aligned if, A) correlation is too small in any one of the correlation windows, B) extrapolation is too great as defined by the user, or C) maximum correlation is found too near the edge of the correlation window. The second test involves the internal standard. If a chromatogram has any one of the user selected internal standards with an area count more than 5 median absolute deviations (MADs) from the median area count of the chromatograms in the analysis group it is marked as "bad" and can not be included in the normal subset. The third test involves the total area count. If a chromatogram has a total area count more than 5 MADs below the median total area count of the chromatograms in the analysis Chromatograms that pass the above three tests are defined as "good" samples. The normal subset was further determined as a certain percent (user defined) of the "good" samples that are nearest in terms of the 2-norm. The model developed on the "normal" subset was then used to test all of the chromatograms in the analysis group for statistically significant differences from the model.

Updated models for each fraction were generated for each sample set. Detection limits were generated for each of the fractions.

Quantitative data analysis was based on individual peak areas. Quantitative data analysis was applied to specific compounds of interest in Fraction 2 (fatty acids), Fraction 4 (amino acids) and carbohydrate analysis. Peaks for these compounds were identified based on retention time. The peak areas corresponding to these compounds were generated. For Fraction 2 and the Carbohydrate Fraction, the relative percent of the peak areas for the compounds in Table I were calculated. The average ($\bar{x}$) and standard deviation (STD) of the relative % of the peak areas for the individual compounds were calculated from the reference chromatograms generated with the sample set. The average and STD were used to calculate a range for each compound. Depending on the compound, this range was typically $\bar{x}+/-3$ or 5 STDs. If the relative percent of the peak area from a sample was outside this range, the compound was considered to be significantly different from the 'normal' level and the sample was identified as a hit for F2 or the Carbohydrate Fraction. For Fraction 4, the concentration, in micrograms/gram was calculated for each of the amino acids listed in Table 1 from calibration standards analyzed within the same sample set. The amino acid concentrations from references were used to calculate the 'normal' range from the $\bar{x}$ and STD for each amino acid. If the amino acid concentration for a sample fell outside this range, the amino acid was considered to be different from 'normal' and the sample was identified as a hit for F4.

TABLE 1

Tobacco Metabolites Monitored in Fractions 2, 4 & Carbohydrates by Quantitative Analysis

| Fraction 2 (Fatty Acids) | | Fraction 4 (Amino Acids) | | Carbohydrates |
|---|---|---|---|---|
| undecanoic acid methyl ester* | C11:0 | Aspartic Acid | ASP | Arabinose |
| Pentadecanoic acid methyl ester** | C15:0 | Glutamic Acid | GLU | Rhamnose |
| Pentadecanoic acid ethyl ester** | C15:0 | Serine | SER | Xylose |
| palmitic acid methyl ester | C16:0 | Histidine | HIS | Mannose |
| palmitoleic acid methyl ester | C16:1 | Glycine | GLY | Galactose |
| iso methylpentadecanoic acid methyl ester | C16:0:Me | Threonine | THR | Galacturonic Acid |
| palmitoleic acid methyl ester | C16:2 | Alanine | ALA | Glucose |
| palmitolenic acid methyl ester | C16:3 | Arginine | ARG | |
| iso methylhexadecanoic acid methyl ester | C17:0Me | Tyrosine | TYR | |
| Stearic acid methyl ester | C18:0 | Cystine | CY2 | |
| Oleic acid methyl ester | C18:1 | Valine | VAL | |
| Linoleic acid methyl ester | C18:2 | Methionine | MET | |
| Linolenic acid methyl ester | C18:3 | Norvaline* | NVA | |
| Arachidic acid methyl ester | C20:0 | Tryptohane | TRP | |
| Lignoceric acid methyl ester* | C24:0 | Phenylalanine | PHE | |
| | | Isoleucine | ILE | |
| | | Leucine | LEU | |
| | | Lysine | LYS | |
| | | Sarcosine* | SAR | |
| | | Proline | PRO | |

H. Shipping Hits. Shipping Hits. Any F1, F2, F3, or Carbohydrate Fractions identified as hits by ADA and/or quantitative analysis, and the most typical null for each fraction for each sample set as identified by ADA, were sent to the Function Discovery Laboratory of Analytical Sciences Capability within Corporate R&D (The Dow Chemical Company; Midland, Mich.) for structural characterization and quantification of relative change of the specific biochemical compounds altered (see Example 15). Samples were sealed, packaged on dry ice and shipped for overnight delivery.

Example 15

Identification of Metabolic Changes

This Example describes the identification of the chemical nature of genetic modifications made in tobacco plants using GENEWARE™ viral vector technology. The protocols involved the use of gas chromatography/mass spectrometry (GC/MS) for the analyses of three primary fractions obtained from extraction and fractionation processes.

A. Methods. Major instruments and accessories used included bioinformatics computer programs (see the description of the Maxwell program in WO 02/10486, hereby incorporated by reference); mass spectral libraries [includes, Biotech FDL, which is also described in WO 02/10486, and two commercial libraries: NIST Standard Reference Database-NIST98-(National Institute of Standards and Technology) and the Wiley Registry of Mass Spectral Data-WILEY275-(John Wiley and Sons, Inc.)]; biotechnology database (FDL is described in WO 02/10486)-the FDL Biotechnology Database is based on the MICROSOFT ACCESS database program from MICROSOFT (Redmond, Wash.) and utilizes ACCORD FOR ACCESS (available from Accelrys Inc.; San Diego, Calif.) to incorporate chemical structures; BLIMS, a customized LIMS (Nautilus 99; Thermo LabSystems Ltd., Manchester, England) for sample tracking and information transfer; biotechnology database (eBRAD; Dow/DAS/LSBC) an ORACLE (Redwood Shore, Calif.) based rational database that is a depository containing data from various screens and associated sequencing data; HP Model 6890 capillary gas chromatograph (GC; Agilent Technologies); HP Model 5973 Mass Selective Detector (MSD; Agilent Technologies); auto-sampler and sample preparation station (LEAP Technologies); large volume injector system (APEX); Ultra Freezer (Revco); and ChemStation GC/MS Software (Agilent Technologies).

Subject samples (those exhibiting an altered metabolic characteristic) and corresponding References (also referred to as controls or nulls) were shipped via overnight mail from the Metabolic Screening Laboratory (Indianapolis, Ind.) to the Function Discovery Laboratory (Midland, Mich.). Samples were removed from the shipping container, inspected for damage, and then placed in a freezer until analysis by GC/MS.

Samples were received in vials or in titer plates with a titer plate (TP) number, also referred to as a Rack Identification number that was used to track the sample in the BLIMS system. The titer plate number was used by the FDL to extract from BLIMS pertinent information from ADA (Automated Data Analysis chromatographic pattern recognition software) HIT reports and/or QUANT (a quantitative data analysis approach that makes use of individual peak areas of select peaks corresponding to specific compounds of interest in the fatty acid Fraction 2) HIT reports generated by the Metabolic Screening Laboratory. The information in these reports included the well position of the respective HITs (Subject), the corresponding well position of the Reference, and other pertinent information, such as, aliquot identification. This information was used to generate ChemStation and LEAP sequences for FDL analyses.

Samples were sequenced for analysis in the following order:

TABLE 2

Analysis Order

Solvent Blank
Instrument Performance Standard
Subjects and Associated Reference
.
.
.
Performance Standard
Solvent Blank Samples were analyzed on GC/MS systems using the following procedures. Fraction 1 samples were shipped dry and required a hexane reconstitution step. Fraction 2 and Fraction 3 samples were analyzed as received. Internal standards and surrogate standards were added to the samples prior to GC/FD analysis (see Example 14).

B. Fraction 1 Analysis. The name of the GC/MS method used is BIONEUTx (where x is a revision number of the core GC/MS method). The method is retention-time locked to the retention time of pentacosane, an internal standard, using the ChemStation RT Locking algorithm.

Internal/Surrogate* Standard(s)
Pentacosane
Hexatriacontane
*Pentadeconoic acid, ethyl ester

| Chromatography | |
|---|---|
| Column: | J&W DB-5MS |
| | 50M × 0.320 mm × 0.25 μm film |
| | Mode: constant flow |
| | Flow: 2.0 mL/min |
| | Detector: MSD |
| | Outlet psi: vacuum |
| Oven: | 40° C. for 2.0 min |
| | 20° C./min to 350° C., hold 15.0 min |
| | Equilibration time: 1 min |
| Inlet: | Mode: split |
| | Inj Temp: 250° C. |
| | Split ratio: 50:1 |
| | Gas Type: Helium |

| LEAP Injector: | |
|---|---|
| Injector: | Inj volume: optimized to pentacosane peak intensity (typically 20 μL) |
| | Sample pumps: 2 |
| | Wash solvent A: Hexane |
| | Wash solvent B: Acetone |
| | Preinj Solvent A washes: 2 |
| | Preinj Solvent B washes: 2 |
| | Postinj Solvent A washes: 2 |
| | Postinj Solvent B washes: 2 |

| APEX Injector | |
|---|---|
| Method Name: | BIONEUTx (where x is a revision number of the core APEX method). |
| Modes: | Initial: Standby (GC Split) |
| | Splitless: (Purge Off) 0.5 min |
| | GC Split: (Standby) 4 min |
| | ProSep Split: (Flow Select) 23 min |
| Temps: | 50° C. for 0.0 min. |
| | 300° C./min to 350° C., hold for 31.5 min |

| Mass Spectrometer | |
|---|---|
| Scan: | 35-800 Da at sampling rate 2 (1.96 scans/sec) |
| Solvent delay: | 4.0 min |
| Detector: | EM absolute: False |
| | EM offset: 0 |
| Temps: | Transfer line: 280° C. |
| | Ion source: 150° C. |
| | MS Source: 230° C. |

C. Fraction 2 Analysis: The name of the GC/MS method used is BIOFAMEx (where x is a revision number of the core GC/MS method). The method is retention-time locked to RT of undecanoic acid, methyl ester, an internal standard, using the ChemStation RT Locking algorithm.

Internal/Surrogate* Standard(s)
Undecanoic acid, methyl ester
Tetracosanoic acid, methyl ester
*Pentadecanoic acid, methyl ester
*Pentadecanoic acid, ethyl ester

| Chromatography | |
|---|---|
| Column: | J & W DB-23 FAME |
| | 60M × 0.250 mm × 0.15 µm film |
| | Mode: constant flow |
| | Flow: 2.0 mL/min |
| | Detector: MSD |
| | Outlet psi: vacuum |
| Oven: | 50° C. for 2.0 min |
| | 20° C./min to 240° C., hold 10.0 min |
| | Equilibration time: 1 min |
| Inlet: | Mode: split |
| | Inj Temp: 240° C. |
| | Split ratio: 50:1 |
| | Gas Type: Helium |

| LEAP Injector: | |
|---|---|
| Injector: | Inj volume: optimized to undecanoic acid, methyl ester peak intensity (Typically 10 µL) |
| | Sample pumps: 2 |
| | Wash solvent A: Methanol |
| | Wash solvent B: Methanol |
| | Preinj Solvent A washes: 2 |
| | Preinj Solvent B washes: 2 |
| | Postinj Solvent A washes: 2 |
| | Postinj Solvent B washes: 2 |

| APEX Injector | |
|---|---|
| Method Name: | BIOFAMEx (where x is a revision number of the core APEX method). |
| Modes: | Initial: GC Split |
| | Splitless: 0.5 min |
| | GC Split: 4 min |
| | ProSep Split: 21 min |
| Temps: | 60° C. for 0.5 min. |
| | 300° C./min to 250° C., hold for 20 min |
| | 300° C./min to 260° C., hold for 5 min |

| Mass Spectrometer | |
|---|---|
| Scan: | 35-800 Da at sampling rate 2 (1.96 scans/sec) |
| | Solvent delay: 4.5 min |
| Detector: | EM absolute: False |
| | EM offset: 0 |
| Temps: | Transfer line: 200° C. |
| | Ion source: 150° C. |
| | MS Source: 230° C. |

D. Fraction 3 Analysis. The name of the GC/MS method used is BIOAQUAx (where x is a revision number of the core GC/MS method). Method is retention-time locked to the RT of n-octyl-β-D-glucopyranoside, an internal standard, using the ChemStation RT Locking algorithm.

Internal/Surrogate* Standard(s)
n-Octyl-β-D-glucopyranoside
*Tetrachlorobenzene
*p-Hydroxybenzoic acid

| Chromatography | |
|---|---|
| Column: | Chrompack 7454 CP-SIL 8 |
| | 60M × 0.320 mm × 0.25 µm film |
| | Mode: constant flow |
| | Flow: 2.0 mL/min |
| | Detector: MSD |
| | Outlet psi: vacuum |
| Oven: | 40° C. for 2.0 min |
| | 20° C./min to 350° C., hold 10.0 min |
| | Equilibration time: 1 min |
| Inlet: | Mode: split |
| | Inj Temp: 250° C. |
| | Split ratio: 50:1 |
| | Gas Type: Helium |

| LEAP Injector: | |
|---|---|
| Injector: | Inj volume: Optimized to n-octyl-β-D-glucopyranoside peak intensity (Typically 2.5 µL) |
| | Sample pumps: 2 |
| | Wash solvent A: Hexane |
| | Wash solvent B: Acetone |
| | Preinj Solvent A washes: 2 |
| | Preinj Solvent B washes: 2 |
| | Postinj Solvent A washes: 2 |
| | Postinj Solvent B washes: 2 |

| APEX Injector | |
|---|---|
| Method Name: | BIOAQUAx (where x is a revision number of the core APEX method). |
| Modes: | Initial: GC Split |
| | Splitless: 0.5 min |
| | GC Split: 4 min |
| | ProSep Split: 20 min |
| Temps: | 60° C. for 0.5 min. |
| | 300° C./min to 350° C., hold for 21.1 min |

| Mass Spectrometer | |
|---|---|
| Scan: | 35-800 Da at sampling rate 2 (1.96 scans/sec) |
| | Solvent delay: 4.0 min |
| Detector: | EM absolute: False |
| | EM offset: 0 |
| Temps: | Transfer line: 280° C. |
| | Ion source: 150° C. |
| | MS Source: 230° C. |

E. Performance Standard: Two mixtures were used as instrument performance standards. One standard was run with Fraction 1 and 3 samples and the second was run with Fraction 2 samples. Below is the composition of the standards as well as approximate retention time values observed when run under the GC/MS conditions previously described. These retention time values are subject to change depending upon specific instrument and chromatographic conditions.

TABLE 3

Fraction 1 and 3 Performance Standard

| Time | Compound |
|---|---|
| 6.25 | dimethyl malonate |
| 7.25 | dimethyl succinate |
| 8.15 | dimethyl glutarate |
| 8.98 | dimethyl adipate |
| 11.06 | dimethyl azelate |
| 11.42 | hexadecane |
| 11.70 | dimethyl sebacate |
| 13.57 | eicosane |
| 15.36 | tetracosane |
| 16.88 | octacosane |
| 18.26 | dotriacontane |
| 19.95 | hexatriacontane |

TABLE 4

Fraction 2 Performance Standard

| Time | Compound |
|---|---|
| 8.82 | undecanoic acid, methyl ester |
| 9.32 | dodecanoic acid, methyl ester |
| 10.24 | tetradecanoic acid, methyl ester |
| 11.07 | hexadecanoic acid, methyl ester |
| 11.84 | octadecanoic acid, methyl ester |
| 11.90 | oleic acid, methyl ester |
| 12.14 | linoleic acid, methyl ester |
| 12.39 | linolenic acid, methyl ester |
| 12.60 | eicosanoic acid, methyl ester |
| 13.42 | docosanoic acid, methyl ester |

F. Data Analysis. Subject and Reference data sets were processed using the Bioinformatics computer program Maxwell. The principal elements of the program are 1) Data Reduction, 2) Two-Dimensional Peak Matching, 3) Quantitative Peak Differentiation (Determination of Relative Quantitative Change), 4) Peak Identification, 5) Data Sorting, and 6) Customized Reporting.

The program queries the user for the filenames of the Reference data set and Subject data set(s) to compare against the Reference. A complete listing of user inputs with example input is shown below.

TABLE 5

Bioinformatics Analysis

| USER QUERY | EXAMPLE USER INPUT |
|---|---|
| Operator Name | M. Maxwell |
| Total number of data files to process | 5 |
| Which Fraction | 3 |
| Reference (Control) File Name | AAPR0020.D |
| Process a specific RT Range | Y |
| Specific RT range | 6.5-23 |
| Internal Standard Retention Time | 14.902 |
| +/− variation in Internal Std. RT | .004 |
| Variation in peak RI, ChemStation | .005 |
| Percent variation in peak RI, Biotech Database | .010 |
| Threshold for determining Area % change | 60 |
| Spectral Matching Value (Threshold MS-XCR for peaks to be a match) | .95 |
| Percent to determine LOP-PM* Value | 1 |
| Percent to determine LOP-SRT** Value | 3 |
| Quality Level for Library (Library match) | 80 |
| Subtract Background | Y |
| Time Range for Background | 21.5-22.6 |
| SHORT SUMMARY (y/n, y = no chromatograms) | Y |

*LOP-PM - Limit of Processing for Peak Matching
**LOP-SRT - Limit of Processing for Sorting The program integrates the Total Ion Chromatogram (TIC) of the data sets using Agilent Technologies HP ChemStation RTE integrator parameters determined by the analyst. The corresponding raw peak areas are then normalized to the respective Internal Standard peak area. It should be noted that before the normalization is performed, the program chromatographically and spectrally identifies the Internal Standard peak. Should the identification of the Internal Standard not meet established criteria for a given Fraction, then the data set will not be further processed and it will be flagged for analyst intervention.

Peak tables from the Reference and each Subject were generated. The peak tables are comprised of retention time (RT), retention index (RI)—the retention time relative to the Internal Standard RT, raw peak areas, peak areas normalized to the Internal Standard, and other pertinent information.

The first of two filtering criteria, established by the analyst was then invoked and must be met before a peak is further processed. The criterion is based upon a peak's normalized area. All normalized peaks having values below the *Limit of Processing for Peak Matching* (LOP-PM), were considered to be "background". These "peaks" were not carried forth for any type of mathematical calculation or spectral comparison.

In the initial peak-matching step, the Subject peak table was compared to the Reference peak table and peaks between the two were paired based upon their respective RI values matching one another (within a given variable window). The next step in the peak matching routine utilized mass spectral data. Subject and Reference peaks that have been chromatographically matched were then compared spectrally. The spectral matching was performed using a mass spectral cross-correlation algorithm within the Agilent Technologies HP ChemStation software. The cross-correlation algorithm generates an equivalence value based upon spectral "fit" that was used to determine whether the chromatographically matched peaks are spectrally similar or not. This equivalence value is referred to as the MS-XCR value and must meet or exceed a predetermined value for a pair of peaks to be "MATCHED", which means they appear to be the same compound in both the Reference and the Subject. The MS-XCR value can also be used to judge peak purity. This two-dimensional peak matching process was repeated until all potential peak matches were processed. At the end of the process, peaks are categorized into two categories, MATCHED and UNMATCHED.

A second filtering criterion was next invoked, again based upon the normalized area of the MATCHED or UNMATCHED peak. For a peak to be reported and further processed, its normalized area must meet or exceed the predetermined Limit of Processing for Sorting (LOP-SRT).

Peaks that are UNMATCHED are immediately flagged as different. UNMATCHED peaks are of two types. There are those that are reported in the Reference but appear to be absent in the Subject (based upon criteria for quantitation and reporting). These peaks were designated in the Analyst Report with a percent change of "−100 percent" and the description "UNMATCHED IN SAMPLE". The second types of peaks are those that were not reported in the Reference (again, based upon criteria for quantitation and reporting) but were reported in the Subject, thus appearing to be "new" peaks. These peaks were designated in the Analyst Report with a percent change of "100 percent" and the description "NEW PEAK UNMATCHED IN NULL".

MATCHED peaks were processed further for relative quantitative differentiation. This quantitative differentiation is expressed as a percent change of the Subject peak area relative to the area of the Reference peak. A predetermined threshold for change must be observed for the change to be determined biochemical and statistically significant. The change threshold is based upon previously observed biological and analytical variability factors. Only changes above the threshold for change were reported.

Peaks were then processed through the peak identification process as follows. The mass spectra of the peaks were first searched against mass spectral plant metabolite libraries. The equivalence value assigned to the library match was used as an indication of a proper identification.

To provide additional confirmation to the identity of a peak, or to suggest other possibilities, library hits were searched further against a Biotechnology database (FDL; Dow). The Biotechnology database is based on the MICROSOFT ACCESS database program from MICROSOFT and utilizes ACCORD FOR ACCESS (available from Accelrys Inc.) to incorporate chemical structures into the database.

The Compound Identification Number (CIN) of the compound from the library was searched against those contained in the database. If a match was found, the CIN in the database was then correlated to the data acquisition method for that record. If the method was matched, the program then compared the retention index (RI), in the Peak Table, of the component against the value contained in the database for that given method. Should the RI's match (within a given window of variability) then the peak identity was given a high degree of certainty. Components in the Subject that are not identified by this process were assigned a unique Compound Identification Number based upon Fraction Number and RI (example: F1-U0.555). The unique identifier was used to track unknown components. The program then sorts the data and generates an Analyst Report.

An Analyst Report is an interim report consisting of PBM algorithm match quality value (equivalence value), RT, Normalized Peak Area, RI (Sample), RI (database) Peak Identification status [peak identity of high certainty (peaks were identified by the program based on the pre-established criteria) or criteria not met (program did not positively identify the component)], Component Name, CIN (a unique identifier, which could be a CAS number), Mass Spectral Library (containing spectrum most closely matched to that of the component), Unknown ID (unique identifier used to track unidentified components), MS-XCR value, Relative % Change, Notes (MATCHED/UNMATCHED), and other miscellaneous information. The Analyst Report was reviewed manually by the analyst who determined what further analysis was necessary. The analyst also generated a modified report, for further processing by the program, by editing the Analyst Report accordingly.

For Fractions 2 and 3, derivatization procedures were performed prior to analysis to make the certain components more amenable to gas chromatography. Thus, the compound names in the modified analyst report (MAR) were those of the derivatives. To accurately reflect the true components of these fractions, the MAR was further processed using information contained in an additional database. This database cross-references the observed derivatized compound to that of the original, underivatized "parent" compound by way of their respective compound identification numbers and replaces derivatives with parent names and information for the final report.

The Modified Analyst Report also contains a HIT Score of 0, 1, or 2. The value is assigned by the analyst to the data set of the Subject aliquot based on the following criteria:

| 0 | No FDL data on Subject |
| 1 | FDL data collected; Subject not FDL HIT |
| 2 | FDL data collected; Subject is FDL HIT |

An FDL HIT is defined as a reportable percent change (modification) observed in a Subject relative to Reference in a component of biochemical significance.

An electronic copy of the final report is entered into the Nautilus LIMS system (BLIMS) and subsequently into eBRAD (Biotech database). The program also generated a hardcopy of the pinpointed TIC and the respective mass spectrum of each component that was reported to have changed.

"NQ" and "NEW" are two terms used in the final report. Both terms refer to UNMATCHED peaks whose percent changes cannot be reported in a numerically quantitative fashion. These terms are defined as follows:

"NQ" is used in the case where there was a peak reported in the Reference for which there was no match in the Subject (either because there was no peak in the Subject or, if there was, the area of the peak did not satisfy the Limit of Processing for Peak Matching). The percent change designation of "−100%" used in the Analyst report is replaced with "NQ".

"NEW" is used in those situations where a peak was reported in the Subject but for which there was no corresponding match in the Reference (either because there was no peak in the Reference or, if there was, the area of the peak did not satisfy the Limit of Processing for Peak Matching). For these situations, the percent change designation of "100%" used in the Analyst Report is replaced with "NEW". The designation of "NEW" in the final report to a component that is present in the Sample but not in the Reference was necessary to eliminate any ambiguity with the appearance of "100%" for MATCHED peaks. A "100%" designation in the final report exclusively refers to a component with modification that doubled in the Subject relative to the Reference.

G. Results. The results of the identification of metabolic changes are shown in FIG. 6.

Example 16

Bioinformatic Analysis of Hits

A. Phred and Phrap: Phred is a UNIX based program that can read DNA sequencer traces and make nucleotide base calls independent of any software provided by the DNA sequencer manufacturer. Phred also provides a quality score for each base that can be used by the investigator to trim those sequences or preferably by Phrap to help its assembly process.

Phrap is another UNIX based program which takes the output of Phred and tries to assemble the individual sequencing runs into larger contiguous segments on the assumption that they all belong to a single DNA molecule. While this is clearly not the case with collections of Expressed Sequence Tags (ESTs) or with heterogeneous collections of sequencing runs belonging to more than one contiguous segment, the program does a very good job of uniquely assembling these collections with the proper manipulation of its parameters (mainly-penalty and -minscore; settings of 15 and 40 respectively provide contiguous sequences with exact homology approaching 95% over lengths of approximately 50 nucleotide base pairs or more). As with all assemblies it is possible for proper assemblies to be missed and for improper assemblies to be constructed, but the use of the above parameters and judicious-use of input sequences will keep these to a minimum.

Detailed descriptions of the Phred and Phrap software and it's use can be found in the following references which are hereby incorporated herein by reference: Ewing et al., Genome Res. 8:175 [1998]; Ewing & Green, Genome Res. 8:186 [1998]; Ewing et al., Genome Res. 8:195 [1998].

BLAST

The BLAST set of programs may be used to compare a set of sequences against databases composed of large numbers of nucleotide or protein sequences and obtain homologies to sequences with known function or properties. Detailed description of the BLAST software and its uses can be found in the following references which are hereby incorporated herein by reference: Altschul et al., J. Mol. Biol. 215:403 [1990]; Altschul et al., J. Mol. Biol. 219:555 [1991].

Generally, BLAST performs sequence similarity searching and is divided into 5 basic subroutines of which 3 were used: (1) BLASTN compares a nucleotide sequence to a nucleic acid sequence database; (2) BLASTX compares translated protein sequences from a nucleotide sequence done in six frames to a protein sequence database; (3) TBLASTX compares translated protein sequences from a nucleotide sequence done in six frames to the six frame translation of a nucleotide database. BLASTX and TBLASTX are used to identify homologies at the protein level of the nucleotide sequence.

B. Contig Sequence Assembly for Hits. Phred sequence calls and quality data for the individual sequencing runs associated with the above SEQ IDs are stored in a relational database. All the sequence runs stored in the database for the SEQ IDs to be assembled were extracted from the database and the files needed by Phrap recreated with the aid of a Perl script. Perl is an interpreted computer language useful for data manipulation. The same script ran Phrap on the assembled files and then stored the assembled contiguous sequences and singletons in a relational database. The script then assembled two files. One file was a FASTA format file of the sequences of the assembled contigs and singletons. The other file was a record of the assembled sequences and which sequencing runs they contained. FASTA format is a standard DNA sequence format recognized by the BLAST suite of programs as well as by Phrap. Both of these files were then inspected manually to detect incorrect assemblies or to add sequence information not present in the relational database. Any incorrect assemblies found were corrected before this file was used in BLAST searches to identify function and well as other homologous sequences in our databases. Correct assemblies that contained more than one SEQ ID were separated. Although these represent parts of the same sequence, since these are ESTs and contain limited gene sequence data, a one-to-one nucleotide match cannot be predicted at this time for the entire length of a contig representing a single SEQ ID with those containing multiple SEQ IDs. Some full length sequences were obtained and are designated with an FL.

C. Identification of Function. The FASTA formatted file obtained as described above was used to run a BLASTX query against the GenBank non-redundant protein database using a Perl script. The data from this analysis was parsed out by the Perl script such that the following information was extracted:the query sequence name, the level of homology to the hit and the description of the hit sequence (the highest scoring hit from the analysis). The script filtered all hits less than 1.00E-04, to eliminate spurious homologies. The data from this file was used to identify putative functions and properties for the query sequences D. Identification of Similar Sequences in Derwent™. The FASTA formatted file obtained as described above was used to run a BLASTN query against the Derwent™ non-redundant nucleotide database as well as a BLASTX against the Derwent™ non-redundant protein database using Perl scripts. These Derwent™ non-redundant databases were created by extracting all the sequence information in the Derwent™ database. The data from this analysis was parsed out by the Perl script such that the following information was extracted, the query sequence name, the level of homology to the hit and the description of the hit sequence (the highest scoring hit from the analysis). The script filtered all hits less than 1.00E-04, to eliminate spurious homologies.

E. Identification of Homologous Sequences. An internal relational database contains sequences from a large number of SEQ IDs belonging to a diverse group of organisms. In order to identify sequences in the database with high levels of homology to the sequences functionally identified as hits and contained in the FASTA formatted file described above, the following analysis was performed.

All the sequences were extracted in FASTA format from our relational database with standard SQL commands and converted into a searchable BLAST database using tools provided in the BLAST download from the National Center for Biotechnology Information (NCBI). A Perl script then ran a BLASTN search of our query file against our internal nucleotide database containing all relevant sequences. The script then extracted from all hits the following information: the query name, the level of homology and the hit seqID. The script then filtered all homologies less than 1.00E-04 as well as all the redundant seqIDs.

This analysis was repeated again using a TBLASTX query. Both files were then combined and the redundancies eliminated. Since the query sequences are also present in the database, these redundancies were manually eliminated from the results file. Lastly, all hit SEQ IDs with homology scores less than 1.00E-20 were filtered from the results list.

These results were used to extract the sequence and quality score data from the relational database in order to repeat the analysis described in "Contig Sequence Assembly for Hits". The final product consisted of two files. One file (FIG. 1) contains a record of the assembled sequences and the sequencing runs they include. The other file (FIG. 2) lists the search hits with homologies better than 1.00E-20 to the query contigs and singletons.

All publications and patents mentioned in the above specification are herein incorporated by reference. Various modifications and variations of the described compositions and methods of the invention will be apparent to those skilled in the art without departing from the scope and spirit of the invention. Although the invention has been described in connection with particular preferred embodiments, it should be understood that the inventions claimed should not be unduly limited to such specific embodiments. Indeed, various modifications of the described modes for carrying out the invention which are obvious to those skilled in the art and in fields related thereto are intended to be within the scope of the following claims.

SEQUENCE LISTING (7560 sequences)

SEQ ID NO: 1 - DNA, 665 bp, Nicotiana benthamiana
tggtatgaacgcagagtggccattacggccggggagggtttaaggcagtagcactccaacaaagagcacttctgcacttgcaagctctgttgcctatttttccagagaagagaaaaatatgggtgctgacaaagggaagaagcaaaaagttgatgaagagaacaacatcattgatggtgagctcgttttttccattgagaaattgcaagaaatacaagacgagcttgagaagatcaatgaggaagcaagtgataaagtattggaagtggaacagaagtacaatgagatccgcaagcctgtctatgacaaacgaaatgacatcattaaagctatcccggacttctggttgactgcttttttgagtcatcctgtcctaggtgagcttctaactgaagaagaccaaaagatcttcaagtttctaagttctattgaagttgaagactctaaagatgtgaagtcgggctactcgataacctttaacttcaatgcgaatccttattttgaaaatacaaagctggcaaagacctataccttccttgaagatggacccacaaagatttctgctacaacaataaaatggaaagaaggcatggccattcctaatggagttgcacatgagaagaaaggaaacaagcgatctcatgctgaggaaagcttcttcacat

SEQ ID NO: 2 - DNA, 667 bp, Nicotiana benthamiana
tggtatgaacgcagatggccattacggccgggggcctgaaacaaatttcagaaagttcaccaaaatggctcatgctatggcttcaatgggtggcctaattggttcttctcaaactgtgttggatggtcagctcagtggctcagcccgtttgagcactgttagcaccagcagaattgccttggctagaccaggactcagcattagagcccaacaggggtctgctgacactgaaactagccgtagagccgtcatcggtcttgttgctgctggccttgctggttcctttgctcaagcagcctttgctgcagctaaatcaatcaagattgggggcgctcctcctccctctggtggattacctggaactttgaactcggatgaggcaagggactttggtctaccattgaagaagaggttttaccttcaaccattgactccagctgaagcagcccagagagttaaggattcagccaaggagattgttagcgtcaagaatttcatcgacaagaaggcctggccatatgtccagaatgaccttcgtctcagagcagaataccttcgctatgaccttaaaaccgtcatctctgctaagccaaaagaagaaaagggaaaactccaggacctgactggaaagctcttcaagaccattagtgatctggaccatgcagca

SEQ ID NO: 3 - DNA, 638 bp, Nicotiana benthamiana
tggtatcaacgcagagtggccattacgccgggggtatcatcatcctagaactgctaaaatgaaggagttcatttctgatcctaatctctttggacaagtcaaagcaattcacagctcatcatcatattcacctggtccggtatttcttgaaaacaacatcagagtaaagccagacttggatgcccttggggcgctgggagatgcgggttggtactgcattggcgcaatattatgggctatgaaccaaaacctgccaacaactgtgacagcactgcctactgttgcaagaaactcggctggcgttatcttgacatgcagtgcctccctgcattgggaaaaagaggaaactgtcgctacattttactgctctttcgtttcacatgaaacgatggacttgatagtttatggctccaacggtaccttttatctctacgacttcattatccccatggacgagaactctgcttcgttcagctttacttctggtgccaagttcgtggatcgccatatcggatggaacatgaaacctcgggcagttgaagtaacttctaagtttccgcaagaggcttctatgattcaagaattttctaggctggttaaggctattgaagtttcgagaagcaaaccggaaagcaaat

SEQ ID NO: 4 - DNA, 657 bp, Nicotiana benthamiana
tggtatcaacgcagagtggccattacggccggggatttgaggtgattgatacaatcaaatctgaggttgataaagtttgtggacgtccggttgtatcttgtgcggacatcttggcagttgctgctcgtgactctgtagtggctctacatgaaccaacatgggaagtgaaactaggaaggagagactccacaacagcaagtagaaccaaagccaacaatgatattccatctccagttatggacttacctgcacttatcaacaacttcaagaagcaaggattggataaggaagacctcgttgcactctccggtggccatacattagggtttgctcagcgtttcaccttcagaaatcgcatctacaatgaaactaacaacattgactctacctttgcaagacaacgccaagcaaattgtccacgtagtggaggtgattccaatcttgcttctcttgatccaacaccagctcttttcgactcgaaatattttagtaacttggtgtccaagaaagggcttttgcattctgatcaggctctacttagtggtggaaaaactgatgatcttgtaaaaaaatatagtaagaacttaaaaactttctccaaagattttgctgagtctatgattaagatgggtaatatcaagccattgacagggaaac

SEQ ID NO: 5 - DNA, 567 bp, Nicotiana benthamiana
tggtatcaacgcagagtggccattacggccggggaccaagcaaaaactcaaaacttcacatctttagtagtagcatcaatattcaagatggttctccaaactcaacttgggttgaacaagccccaatcctacgctcacgagcaaaattattattgcgacggcagccatggcggctctatgcaaatgacaaggccatcgggctattccaccatgccatatggccagtccactcacaatcacatgatgatgggtcatggtggccaacatcatggcggacactatggtggtcatggccatggctacggcggtcatgaacatcatggggcgcatatgccccatgactccactaacttttcaagcagcaccaatatggtccatagtgatgctggctatggcagtggaatgcaacaatctacccatatgttgtcagccatgggcatgggatcgaccaattatcatggccatggttatggtggcagccaccctagtcagtacagccagagccaaaagttcaactgggctcttaaggatctggaggaataaatatatgataaattttatgctatc

SEQ ID NO: 6 - DNA, 571 bp, Nicotiana benthamiana
tggtatgaacgcagagtggccattacggccgggggtggtcctacgcatgtgcaaagcaattgattgagaggttgatctatgctgagggtgctgagaatggcttagaattcaccattgttaggcccttcaactggattggtccgaggatggatttcatacctgggattgatggtcctagcgaaggtgttccgagagtgttggcttgctttagtaataatcttttaagacatgaaccactaaagctagtggatggcggacactcgcaaagaaccttcatatatattaaggatgctattgaagctgttctcctgatgattgaaaatcctgcacgggctaatggccagatctttaatgtcggcaatcctaataatgaagttacagttaggcagctagctgaaatgatgactcaggtgtactcaaaggtgagtggagaatctcctcctgaaacacccaccatcgatgtaagttctaaagaattttacggcgaggggtacgatgacagtgacaagcgaattccagacatgaccttaattaacagacaactcggttggaacccgaagacatccctatg

SEQ ID NO: 7 - DNA, 636 bp, Nicotiana benthamiana
agaaaaaggaggtccaagagcacctccaaggaacaagatggctgtatatgagcagctcagtataccttctcagagattcaattcaggggttttgcctgttaaccccaacaataacactgcaaagggtggtgggcacgaaagagttgtatatttccccgtacaacaccctccatctggacatctagctgataaaccacctggccacagttcagatcccaatacgcacttgcaacaatttgagttgaataagagaactgaagaggatgactttacggtccctgtctttgttaactccatgccggatcatgccaatgggagtcataatctgggtatggagaagcttactccctctggtcctgtcttttcagggtgtaccaataaagacttggaaggacttacagatcgaattctgaggcaacagcgcaagagcaagaatgaggagaatcccaaatgtattccagctagtagagagcatagaacaacctcgaactctccatccaaggaatgcagattcgaacgtcaggttggttataccatcatatctgaacctgttacgggtatagatgatgatgattcttatcccagaaaagaatttgcatcagaagagcagataattactaacaatctcattaatgg

SEQ ID NO: 8 - DNA, 608 bp, Nicotiana benthamiana
caaggcggtcttcgtctgtaagaggcaatacaaaaacgcgctgatcctgaattcataaccaacatcaatttactagaaccctaattggcaatacgaagcgatggggaatgctaattgtgtattctgtggatgcatagaacaagcgagcgtcggtgtggttgagaaatggggacgttttgacaggctagcagaaccggggcttaacttcttcaatcctttcgccggcgaatgcctttctggtattctctccaccaggatcagttctctcgatgtcaaaatcgagactaaaaccaaggacaatgtctttgttcatttagtgtgctcgatccaatatagagtgatcaagcaaaatgctgatgatgctttctatgagttgcaaaatccaaaggagcagattcaggcttatgtatttgatgttgttcgtgcccatgtccccaaaatgaatttggatgaacttttcgagcaaaaggatgaagttgctaaggctgtgttggaggaacttgagaaggtaatgggtgcatatggatataacatcgagcacatactgatggttgacattattcctgatgcttctgtgcgaaaggcgatgaacgagataaatgcagctc

SEQ ID NO: 9 - DNA, 654 bp, Nicotiana benthamiana
aaaaatcataaagttcctcttctccttctgtagtttcctctgtaatttcaaggtttcctcacacccttcaaactcgagcaatcttaaggaactcagatggctcgtacgaagcaaacggctcgtaaatctactggaggcaaggctccaaggaagcaacttgcaacaaaggctgcccgtaagtctgccccaacaacaggaggagttaagaagcctcacagatacagacctggaaccgttgctcttcgtgaaattcgcaagtaccagaagagtactgagctgttgatcaggaaattgccattccaaaggcttgttcgtgaaattgcacaggacttcaagactgatttgcgtttccagagtcacgctgtattggctttgcaagaagcagctgaggcctaccttgttggattgtttgaggacacaaatctgtgcgccattcacgccaagcgtgtcactatcatgcccaaggatatccagttggcccgaagaattaggggagaaagagcttagaatgatctgttctgccgtatcgtgcttagattgttgatttttttttttgaattgccgtctttctgcatttttcttcttctttgttcttcatataggtagtttttactagatatgaatggctgtggcatactggaaatttgatactct

SEQ ID NO: 10 - DNA, 403 bp, Artificial
  Synthetic
caaaatatcttacatatattcaccattagaaatacatccatagaaggagagtgcatatatataatatatatcttcaaacacaacagtctttatttcacacgtagctagctagagcttgccaatattgccaaatactcatcacacacatagatatatatgtgtattgacatacgtataaatggctataagccattgaatagcatagattatattacttgagaaggtgaccctctatatctttggtcacatgtaggacaaaacccaagagaacgagaggctctggggtgtcttcagttttcttctcgtacacaaatgtccatgtagtccactggtggtcggggaatgtggaaattgtaaaggaattgtacaactttaacaaatctcctcccccggccgaaatggc

SEQ ID NO: 11 - DNA, 520 bp, Artificial
  Synthetic
gggccacaaaagctaattctcccatccattcttaaggcagaataaacttaagaaacaactgacaaaattctctgttctatgatacaaatcatgtatgatatgacccattgaccagactaaagcaaaaaaaaaggaccaaaattacaaagtacatcttacagttaaaactacaagacaggttagtaccaaagtatatttttgctttgacatcatagatgaggatacagaacaccatgttagagaatattgacgtttcacccttgacgtgagacacgtcagtctgaacaaaatgagaaggaactgcagaaacattctttttccctcgttttcttgatgacctaatggtttttggctcatgatcctgcccaactccattatctgcctccctctgtgtagtaccattgctcgaatgtaccaggtcaacaaaagctcagatcttattgttctaatgtcacttgtaatcgaaacaatgatggatttctctggactttcaacccaccccggccgaggcggccgacat

SEQ ID NO: 12 - DNA, 546 bp, Artificial
  Synthetic
  misc_feature (546)..(546): The residue at this position can be any nucleotide.
gccattacggccggggaaggctgtaatgttcgcatccatggagtattgcctgcgaatgaagttctcccaacgcaaggctgaaaaagtttgtccagggtgtgggacagaatggcattataacattgcaaaagcagaagttgtagatgaagaagaggatgcatgtgctcctcctgaaagtcagcagcctggtgaacctttaatgagaaagaggcggaggacctgtggagggaccgattcagatactctcaagcctggatcatctcagagtatgagggtgactcggggccggctgaggaatgcaagttaagaaatttgttttgctagttttggcacttatgcacctctaactatatgaaaatggctgtccatatatttttgcatcccgtgaaggtttacttatttggtagacctatttaacttatgattgtagattataggagcatccagaatagtatcttaatcatctctattctcttggtgttctccaattgccattatcgcgcagatgatttcttgctattatatagtagtgaaatattttatcan

SEQ ID NO: 13 - DNA, 643 bp, Nicotiana benthamiana
caatttctcaaatggcagtctcatccatagccaatctcttctccttcttcaccccctccaaacccccaccccccagagcttcccccctccaattctctcttcctgctgttgattccctctcttcttcaacacctatcaacaatcacaaatacccattatcactatcgtgttctaattctgatgttacggccgccgtttacccctcacttgcaaatgcaaacactctttacttcaggtcgggatacaatgttcaggtaattgtggatgataatgagcacgaagagaagcttgttggacggtttcgtagggaggttatgagagctggagtcatacaggaatgcaagcgtaggagatatttcgagaacaagcacgacaaattgaagcgcaagtcacgtgaggctgctaaacgcaaccgcaagagacgtggcccaccaagaaatttctcagatgataagcaagaggcatctaagagcaagagggatgacgaaggggaagataactgggaacttcctgatggaggtcttccctattgattttattgtagttcctttttccttttttttggggtcctgtagaaatgtggtttatttccactttggagaaaatctattcatataattccccatgggaatcattttccttg

SEQ ID NO: 14 - DNA, 598 bp, Nicotiana benthamiana
tcgcccactataatctcacctaagcagtacaaaaagaggttgcgcaaggccatgaccacctattttctcatggtcccagatcaatggtcaccaccgtctatcattcccagtaaatcacagactgatttatgtgaagagaacatgcaagatggatgatctgccaagtgattttgtacatctgttcgtatattgagcacatatttgggtttctcgcattggttatcccaggttcatacatctcccatattttcgattcccattcttttggaacgcagttccggttgcattctccctaaagtgggagaacacatgatttcttgtcagagcacttggtaagaggtttgtatttcagtgaaagtctccattgcacagaatataggtggctctccgtggaaatatttttgtaaatctttttcttttaattacaattttctttgggtgtaaaatccaaggtatacatgagttccgaaggatcattggcaattttatacaatgcatgattttggagcaatttagctggtgtagtttcaagtgtatcgcgattctttcctctgtaatttttgtaattgtgattttgaaaggtgaatcttcttacctt

SEQ ID NO: 15 - DNA, 667 bp, Nicotiana benthamiana
gacgttgaagatcttatccaatttggaacatctggaaaaggtgctgcgtttatgtctgaattcatacagggagttggtggaatagttgaattggctccaggttacttgcctgctgtatacaacattatacgaaaagcaggaggcctttgtatcgcggatgaggttcaagctggatttgctcgcactggaagctatttctggggatttgagaaccaaggagtagctcctgacatagtgacaatggcaaaaggcattggaaatggaataccacttggggctgtggtaacaactcctgagattgcacaggtcttgactcatcataattacttcaacacatttggtggaaaccctgtatgtactgctgctggacttgctgttcttaaagtgatcgaaaaagaaaagcttcaagaaaatgctcgtggtgttggttcatacttaaaagagcgccttttggctatcaaggataagtatgaaattgttggtgatgtgaggggaaaaggactgatgcttggcgttgaactagttactgaccgtgaactgaaaactcctgcgagagcagaaactctgcatatcatggacaagataaaagatatgggagtattagttggcaagggtggattctatggaaatgtcttcaggattacacctccactatgtttcactaaag

SEQ ID NO: 16 - DNA, 699 bp, Nicotiana benthamiana
tgattcgattaggcaaagcaaaaatgcaaagggttttgaaggctcgccagctcgttagggttttgagaaactcgtcatctcctattctgctcaactcagtgtcacgaattcaatctcattgtacctatgaatctactgaatcatgcctcaatttttctttacggcgtggttactttacctctggtactgcaatttgtggaaattatattcaaacaaaacacaatattcagagaaatgtatgtcaatgtgaaaaatgctctatgatgctcaaggcatcattttctacagaagcagggacagttgaaagtagtgtggcaacagagtctgtgaaggaattgtatgataagatgctgaaatctgtcgtggaacaaagatctgctccgccaaatgcttggttgtggtccctaatacaaagttgtgcaaaccgtgaagatgttaattttttacacgacattttgcagagacttcggatatttagactttcaaatctccgtatccatgagaacttcaattgtgccctctgccaggacattacaaaggcttgtgtacgtgttggcgccattgacttgggtaagaaggtgttgtggaagcataatgtgtacggattgactcctaatattggatctgctcaccatttactgttgtttgctaaacagcataatgatgttaaactgttggtagaaattatgaaactggtga

SEQ ID NO: 17 - DNA, 628 bp, Nicotiana benthamiana
tttctctgctacaacttcaagattttctttactcagccctgggattatagggaagttatctctcgtttgaagaagcaatggcatcgccatcagatcacaaggctaacatcattgatggtaaagcaattgctcaaactattcgttccgagattgcttctgaagtccaactcctttcagaaaagtacggcaaggtccctgggttggccgtagtcattgtaggaaataggaaagattctcaaagttatgtgaatatgaagagaaaatcatgtgctgagcttcacattaagtcttttgacatagacctgctagaggacgtagctgaagctgaattaattagcaaggtccacgagctgaatgctgatcccgatgtacatggtatactggtacaacttccgttaccaaaacacattaatgaagagagagttcttggtgaaatcagtctggaaaacgatgtagatggctttcatcctctgaatattggcaagcttgcaatgaaaggcagacaacctctgttcctcccttgcacgcccaagggatgcatcgagcttttgcatcgaagtgggattagcataaaagggaagaatgccgttgtggttggtcgaagtaacattgttggattaccagtgtc

SEQ ID NO: 18 - DNA, 553 bp, Nicotiana benthamiana
gtttcttcttattcttattaatcagaaaagaatggcagaagttgaatacaggtgcttcgtcggtgggctagcatgggctaccaccgaccaaacacttggggatgctttttctcagttcggcgaaattctcgactcgaagatcatcaatgacagagaaactggtagatctagaggatttggatttgttaccttcaaggatgagaaatccatgagggacgctattgaagggatgaacggtcaagaccttgacggccgtaacatcaccgtcaacgaagctcagtctcgcggtagcggcggaggcggtggtggtggtggcggttaccgtggtggtggcggtggaggctacggaggtggtggccgtcgtgaaggtggatacggtggtggtggtggttacggaggtggccgacgtgaaggtggttatggtggtggcggcggttatggaggtggtcgtcgtgaaggtggttacggtggtggttctgaaggaaactggaggagttagatttccgttgcctttagatttatttttttgtttgaaatttatggttctacgttt

SEQ ID NO: 19 - DNA, 501 bp, Nicotiana benthamiana
aaacaaccaaacatggcgattcatacttccactctctccaggtccatgcttgtaatgctcatgttctccgccgtaatatcatcggcggaggacatgtccattataagctacaacgaaaaacatcacacgaacggcgagtcaacggtctggcgaacaaacgatgaagtcatgtctttatatgaatcttggctagttgaacataaaaaagtgtacaacgccttaggagaaagggacaaacgctttcagatctttaaagataaccttagatacatcgatgaacataactctgtgcctgaaaaaagttacaagctgggtttgactcagtttgctgatttgaccaacgaggagtacaagtccatctacttgggtactaaacccgatggtcgtagcacgttattaaatacccaaagtgaccgttatgcctctaaggtcggagatagtttgccggattccgttgactggaggaagaaaggtgttcttgttgacgtcaaaaatcaaggg

SEQ ID NO: 20 - DNA, 610 bp, Nicotiana benthamiana
cgtttagacccttcacttgaaattgatcatcttttatcccagactgaatcatcccaatctgaaaaccctagttctaaggtaccaacacctgatttttcatctgaaaatgggccccgccatagggtttcgggtagtggtgggtcatcggtggcgtatagtgaggagcaagtgacagttgtgaaagaaattaagaggaaaaaggattactatgagattctcgggttggagaaaagtagttgtagtgttgaggatgtacgcaaggcgtataggaagttgtcgttgaaagtccatcctgataagaataaagcaccgggagctgaggatgcttttaagatggtgtctaaggcgtttcaatgtttgagcgacgaggagagtcgaagtaggtatgatcttgttggatctgaggaatctgtttacgaaagacgcgctcataggcatgcaggtggtgctagaatgaatacatttaatgggttctatgatgacggtaatgttgacgcggaagagattttcaggaatttcttctttggtggaatgcgtccggcaacgactactacacattttagctttggccctagagtggatgtgagatatcaaggaccgactgggtggc

SEQ ID NO: 21 - DNA, 629 bp, Nicotiana benthamiana
tgaacatggcataccaaaagaaatggccactctatcttagggcaaagaataccattcttaagaaatatgatgggaggttcaaggatattttccaagaagtttatgaagcaaattggaaatccaagtatgaggaagcaggaatttggtacgaacaccgtcttatcgacgatatggttgcttatgctttaaagagtgaaggtggttatgtatgggcctgcaagaactatgatggggatgtacagagtgatttcttagcacaaggttttggatcccttgggttgatgacatctgtcctggtgtgtcctgatggaaagaccattgaggctgaagcagcccatggaactgtcacccgccactacagggttcaccagaaaggaggtgaaaccagcacaaatagtattgcgtcaatctttgcctggactcgtggacttgcacacagggcaacattagacaagaatgaaaggctgttggattttactgagaaactagaggcagcatgcatcggtgcagtggaatctggaaagatgaccaaagatcttgcactcatcatccatggatccaagctctcaagagaacattatctcaacacggaagagttcatcgacactgtggcggatgagctcaaagca

SEQ ID NO: 22 - DNA, 622 bp, Nicotiana benthamiana
aagatgatgatgagagggctgccggttatctttcaattgttgtcaggtcagcaaaacagaaggcaagtaatttcaagtggcctcagttagagtctggagaatctcgaccagccaggagtgaaccatctttatcgaacagggacgagccatctgtagcgcatacaaatgacgcgctattagctgcagatgcgagctcttcttcctcacttggacaggccaatagtgaagacttaagattgtcaagtcaagttgctgatgagatgcaacaagaacaggtaaacaaaagtatgtctcatgatcaagtgctgtctttatctgaaaattatgaagaatttaaagctgataaagaggctaaattagaagagtggttggaagaataaaggatttgtgaagtcctttagcttgataaatctctgaacctcaacaagactattcttatgaacgacacttattttgtattatgattcagatattttatactagatgaatatatgtagaggagtttatagcagacaggaaagagaaaaaatagtcttcaatttatgaccattcaagttgtgtttgtacattgaggaatgtattgtttgtaaacttaaactgttgtccaaaataagtaaatttt

SEQ ID NO: 23 - DNA, 610 bp, Nicotiana benthamiana
ggtatgcaaatctttgttaaaaccctaaccgggaaaacaataacccttgaagtcgaaagctctgacacaattgacaatgtcaaggcgaagattcaggacaaggagggaatccctccagaccagcaaaggttgatttttgccggaaagcaactcgaagacggcagaaccctagctgattacaacatccagaaggaatcgacccttcacttggtccttcgtcttcgtggtgggatgcagatcttcgtcaaaaccttaactgggaaaacaatcacccttgaagtcgaaagctccgacaccattgacaatgtcaagggtaaaatccaggataaggagggaatcccaccagaccagcaaaggttgatttttgctggtaagcaattggaagatggccgtaccctagctgattacaacattcaaaaggagtcgactttgcaccttgtgctccgtcttcgtggtgggatgcagattttcgtgaagacattgaccgggaaaaccatcactcttgaggtggaaagctctgacactattgacaacgttaaggccaaaatccaggataaggagggaatcccaccagaccagcagagattgatttttgctggtaagcagctgg

SEQ ID NO: 24 - DNA, 652 bp, Nicotiana benthamiana
  misc_feature (16)..(16): The residue at this position can be any nucleotide.
cttcctcttctctacnttctccttccttagctccaccgtaatgtttaactggttttaagagatggctgattcagaagatattcaaccccttgtctgtgataacggaacaggaatggttaaggctggatttgctggtgatgatgctccgagggctgtttttcctagtattgttggtcgacctcgacacaccggtgttatggttggtatgggtcaaaaggatgcatatgttggtgacgaagctcagtccaaaaggggtattctcaccttgaagtatcccattgagcatggaatagtaagcaactgggacgatatggagaagatctggcatcataccttttacaatgagttacgtgttgctcctgatgagcatcctgtgctacttactgaagcacccttgaatccaaaggccaatagagagaagatgacgcagatcatgtttgagactttcaatgtgcctgccatgtatgttgctattcaagctgtgttgtccctatacgccagtggccgtacaacaggtattgtgttggattctggcgatggtgtctcacatacagtaccaatttatgaaggttacgcccttcctcatgcaattcttcggttggatcttgctggtcgtgatcttactgattgtttgatgaaaatcttgacggaa

SEQ ID NO: 25 - DNA, 465 bp, Nicotiana benthamiana
cggacgcgtggttctgatcttcttgtgattcgatgtcggttagaacagtgaaagtgagcaatgtctctcttggtgtgtcagagcaagatatcaaggagttcttctcattctccggggatattgagtatgttgagatgataagtgagaatgagcgatctcaaattgcatatgtgacattcaaggatccccagggtgcagaaactgcagttcttctttctggagccacaattgttgatcagtctgtcacagtagctctggaacctgactacgagctgcctcctacagctccagtgccaatcaaggcaaccgagagggctaatgcagctggtggtggatctgctattcaaaaggcagaagatgttgtgagcagcatgctggcaaagggcttcatcttgggcaaggatgcagttaacaaagcaaagacatttgatgagaaacaccagttcatatccactgcctcagcca

SEQ ID NO: 26 - DNA, 669 bp, Nicotiana benthamiana
gcgtcttgataaacgccgtttcctattccaatctccatctacactttctctttctgaattcaaaacaaaaacaagtgtgaaaatgagagagtgcatttcaatccacattggccaggccggtattcaggtcggaaatgcatgctgggaactttactgcctcgaacacggcattcagcctgatggccagatgccgggtgacaagactattggaggtggtgatgatgcattcaacaccttcttcagtgaaactggagctggaaagcatgttccacgtgctgtttttgtagatcttgagcctactgtcattgatgaagtcaggacgggaacatacagacagctctttcaccctgagcagctcatcagtggcaaagaagatgcagccaacaacttcgcccgtggccactacacaattgggaaagaaatagttgatctttgtttggaccgcattaggaagcttgcagacaactgcactggccttcaaggttttctggttttcaatgctgttggtggtggcactggttctggccttgggtcacttttactggaacgtctctcagttgactatggcaagaaatcgaaacttggattcacaatttatccctcaccacaggtctcaacgtctgttgtggagccttacaacagtgtgctttcaactcactcgctgcttga

SEQ ID NO: 27 - DNA, 620 bp, Nicotiana benthamiana
cacacttctatcttacatatgtagccaaagcatcgttaaaatggcgtacattaagcaagcttttctcttgattgctctctttgttgcaattacagttaatctctctggatctcctaagttgcaagtgatggctttacgagacttacccgaagaggttgcaatgatgaaagataaattacttccattaggtgatatagtaacttgcttgaaatactgcaatgtcgaaagcgattgcagtgatggttggatttgctccaattgtgttccatctgcatttcagggatggagatctcaatgtgactcgcttactgctactggtgaaggttattttggaactatactccgcgctaagcacaacaaaatataaattatattgctgcaatatatgaactatttataaatgcttgatctcgtgttatattcaagcattttaaataatataatgttgtgtttcctacttgtccaagtttatgtaagaaaatgaatatgtaaccatgtttcttgttgttgtcatcttatatgcagttattatgaaatatatgttctctattatcccaattaaagtggcacgaaacttaatgggagataatatttactatatatgatatgaatagtgtcat

SEQ ID NO: 28 - DNA, 634 bp, Nicotiana benthamiana
tagctctagtaatacacacatgagccgcacttcccacatttttagtctgaataaaatggccaaggctactgtatcatccattgtcctcctcctcactttgaacattctcttcttcgcaatggttagttcaacttacatcccatgcccaccaaaaacaaagaatcaaccccatcccactaccccatcatccaagggttataagaagtgccaaaaggacacactaaaattgaaggtgtgtgccaatttattgaatgacttggtgcatgttgttattggaagctcatcaaagagttcatgctgctctctcattgagaatcttgctgatgttgatgctgcagtttgcctttgcactgccattaaagctaagctcttgggaactaaccttgataccgctctttccctcagcttattgctcaacaattgtggaaagactgttcctaaagacttccaatgtgcataaatggccatcttcccaccccaacttgtttggtaatgaggcgtagttgtctgtttgtggtgtttgttttctccataagattttcgtcggagatttcaactaaaaaataatcagtactgagtgtgtttgtgcacggttgcttattttctcaggaaatatgtggaattattctagtgc

SEQ ID NO: 29 - DNA, 554 bp, Nicotiana benthamiana
atctacttgtcaaagttatcgattgcatttaattagttttgctctcagttagacagtttcttttgtagggtggtgccgctgtctggtgcatgggctttcagaaaattccgggccaaggattgacaattttaggagatcttgttctaaaagacaagattattgtttacgatttggctggacaacgggttggatgggccaattacgattgttcgcaggcggttaatgtttcagctaccacaagcagagggaaaactgagtatgtcaatgcaggacagatcggtaacaacagttcgccgtgtagcgactcttacaagctgttactaagcttcattctaacttctgtcttacatgtattagtgcgtggcacaaactcaatctcgtaacggcttaggcaaactgctcaactttttctcatttttttctcttttttttttctgtatagctgactgtcctgtagttatttatttacaggtgtcgatgaagatctgtcttcagatctggattgcaaaaattttaggtgcctttaatggtagccttagatatgttgtttgttc

SEQ ID NO: 30 - DNA, 505 bp, Nicotiana benthamiana
tactactcagattcaaaaaacagctgaatctgctttagaggtggtataccagcctattatttctggagatttaccaattgcgagacgagcttcacttactaggtttttagagaaaagaaaagataggctgactgcaaaagcaccgtaccaattaagcaacccaaataaacaagcagcagtttctgaaaacaaggcgtggcttggattgggtgctcaatttccagtgaaagctgagcaattctagtactctacttaattgttttggctttcattacttgttattaggcctaaatacactactagtactgcttaatcctttatctaaaccaaaaattattagatctgactactctggattcattactagtaatagatttttgtattgaaaccagagatggttattcagtgcccttttgtgtaggtattcaattcgtctgaggcttaagtttttatttcctattgtactgcaaatggaatgtttatcacaacagcaatttctatgttt

SEQ ID NO: 31 - DNA, 588 bp, Nicotiana benthamiana
aaataggctgctttgaataccagcagaagaagaactggctgcttctagtgttagtgaagcagcaaggaaactgcaaaatagatttcttgagctgagatatgtgaatttttctcaagaaattctatctctttggctttctgtagtgggtatataaagacataaaggttgaatcttttatggtttaacatggatataaggaacaatctctccacagaatcttggttagcatcagtttcttgttctgcctccacactacaatcttcagcagtggttaaatggttaagattcatcttcctctctccatgtccacaaaggactcttctatcttccattgatgtgctgcttttgcttactttcattgtgtttgccgtacaaaagttttactcaaagttgaggtccaatgagcactctaattctggcattgataagcctcttattgcacacaacaggacttctgttaaaaccaatctatggtttaagctgtctctgattttgtcagctattttagccttatcttctatagttttatgcattttggttattgtgggaaatccccagtcgtcttggaaagtcatcgatgggctgtat

SEQ ID NO: 32 - DNA, 566 bp, Nicotiana benthamiana
ccgtatcaaacgaattgaagaggtgatggctccgaagcagcggaatacagggctatctgttgggctaaacaagggccatgttgtgaccaagaaggaattagctccacgtccttccgacagaaaagggaaaacaagcaaaagagtccactttgtgaggagccttattagagaagtcgctggatttgctccatacgagaaaaggattactgagcttcttaaagttggaaaggacaagcgtgccttgaaggtagctaagaggaagttgggcactcacaagagggcaaagaagaagagagaagagatgtctagtgttctccgtaagatgagggccactggaggtggtgaaaagaagaaatgaaacctgtatctgcggttgatgattgaagaacccagttagttaattcactagcttttatgtttgcaatgtatttttgctttcaagaaagaggacttgtgattaaaagctcccgatctatgttccatgaagattttgaaattagtgatattgtagacatttttgccaagtgcatgttttttctggtaatactagtgttaattatctgcta

SEQ ID NO: 33 - DNA, 594 bp, Nicotiana benthamiana
aggatggttatattatagctttacatgcaagacatcaccctgctttgcatgtctccagacaaagagttaaagggggtggttggttcctcgacacaatgtcagatgttacaaaaagagacccagcagcacagttccttgtggtttttagaagcaaggatacaattgggttgagatcatttactgctggtgggaagttattacagataaataggaggatggaatttgtatttgcgagtcacagttttgatgtttgggaaagctggacatttgaaggtactatggaagaatgtcgactagtgaactgtaggaatcctctggccgttttggatgttcgtgttgaagtactagcagcggttggagaagatggtatcaccagatggcttgactaggcagtgtcagagccgttgcacatgatttttaaaatatgctatgctgatttgtttggaatatttaccacaagtagttttgtaaggcattgagtctcactcgaagcaagagttgtatgtttttaatgtaactttcattattgcctcctatcagggatcttttccccccatgaaaatggctgattgtatttcgaggattcaaaatagc

SEQ ID NO: 34 - DNA, 633 bp, Nicotiana benthamiana
cgacagtggccatggctactcaacgaagggcaaaccctagctctctccatctaattactgtgttctctctgcttgtcactgttgtctccgctgaggtcttcttcgaggagagtttcaacgatggttgggaaagcaggtgggtgaaatctgaatggaagaaagatgaaaacatggctggagagtggaatcacacatctggcaagtggaatggagacgctaatgacaaaggtatccaaaccagtgaggactacaggttctatgccatttcagctgagttccctgaatttagcaacaagggaaaaaacttagtgttccagttctcggtgaagcatgagcagaagcttgactgtggtggtgggtacatgaagttgcttagtggggacgttgaccaaaagaaattcggtggtgacactccctacagcatcatgtttggcccagacatctgtggctacagcaccaagaaggtccatgctattatcacttataatgacacaaaccacttgatcaagaaggaagtaccttgtgagactgatcaacttacccatgtttacactttcatcctccaccctgatgctacatacagcattctcattgataatgtggagaaacagtctggtagcttgtactctgact

SEQ ID NO: 35 - DNA, 562 bp, Nicotiana benthamiana
ggccgtgaagatcgacaccgtccgcaatgtcgaagcgaggacgaggaggttccgctgggaacaagttcagaatgtcgctgggtctgccggtggcggcgacggtgaactgcgccgataacacaggtgctaagaacctgtacatcatttcagtgaaagggatcaaaggaaggcttaacaggttgccttcagcttgtgttggtgacatggttatggctactgttaagaaaggtaagccagatcttaggaagaaggttatgccagctgtcattgttcgtcagcgcaagccctggcgccgaaaggacggtgtttttatgtacttcgaagataatgctggtgtgattgtgaaccccaagggtgaaatgaaagggtctgccatcactggccctattggaaaagaatgtgctgatctttggcctaggattgcaagtgctgccaatgctattgtgtaggagtagggttgctaagtagtttacagttctcgttttgttgggttttcatcaagtttctgaatatctgagggctttgtcttaataagaattattgctcggaattttgcagtaaa

SEQ ID NO: 36 - DNA, 590 bp, Nicotiana benthamiana
cccacgcatccggttggtcacaatgctcttggtgctggaaggatctttgctcaaggtgcaaagcttgttgatctggcccttgcctctggtaaaatatatgagggagcaggtttcaagtacgttaaagaatgctttgaaaaaggaactttacaccttattgggctcttgagtgatgggggtgtccactccaggcttgaccaagtgcagttgttgctgaaaggtgctgctgagcatggtgccaaaagaattcgtgtccatgccctcactgatggacgtgatgttctagatggttctagtgtggacttcatggagactcttgataattctcttgcacaattacgtgaaaaaggtattgattcccaggttgcatctggcggaggtcgcatgtatgttaccatggatcgatatgagaatgactgggatgtcgtaaaaagaggctgggatgctcaagttcttggtgaggctccacacaagttcaaggatcccgttgaagcagttaaaaagttgaggcaggaacccaacaccagtgatcaatacttggccccttttgttattgttgacgattatggaaagcccgttgggcctatttt

SEQ ID NO: 37 - DNA, 504 bp, Nicotiana benthamiana
ttgaaacagtacttcaggccagagttcttgaacagattggatgagatgattgtattccgtcagctaactaagttagaggtgaaggagatagctgatatcatgcttaaggaggtctttgagaggttgaaaaataaggagatagaacttcaagtgacagagaggtttagagacagggtggttgatgaagggtacaacccaagctacggagcaagaccgttgaggagagctattatgagactgctggaagacagcatggctgagaagatgcttgccggtgagatcaaagaaggtgattcagtaattgtggacgtggactctgatggcaatgtgaccgtcctcaatggcactagcagaactccctcagatccagctcccgagcctatccctgtgtagatccgcttcttgctttagctctgcaaatttgttgtttgtaatgttgctttcatttgtcgtggccactaagccctcctggggttatgaagcaacttgtgagtaatttatggg

SEQ ID NO: 38 - DNA, 526 bp, Nicotiana benthamiana
aaaaaaatggcagaaggtgaatacaggtgcttcgtcggtgggttagcatgggctactaccgaccaaacacttggggaggctttttctcagttcggcgaaattcttgactcgaagattatcaatgacagagaaactggtcgatctagagggtttggatttgttacattcaaggacgagaaatctatgagggacgctattgaagggatgaacggccaggaccttgacggtcgtaacatcaccgtcaacgaagctcagtctcgcggaagcggtggaggcggtggcggttaccgtggtggtggcggtggaggctacggaggcggtggccgtcgtgaaggtggttatggcggcggtggtggttacagaggtggccgtcgtgaaggtggttatggcggcggtggcggctatggaggtggccgccgtgaaggtggttacggtggtggctctgaaggaaactggaggagttagattttccgggtcctttagatataattttttgtttgaattttatgggtctaagtttgggtga

SEQ ID NO: 39 - DNA, 317 bp, Nicotiana benthamiana
aaaccaatgacccaggctttcatctcctgtggtgttggggtttggcccggtcacatggcaacaactttgctggttacaccaagattctaactagcaaagatcaactattacaaaaagcaaaaagaggaaaaatttttaaggggtattgcgagggtgcattacctttcaaaccaacttacaaatatgatattggaagcaccagctatgatacctgtcacagggtaattaattaggctaatcttattggtccttttatttaatcatttgaggcgccacgtttaaaatgttaatttaacttgcgtaattgtgaaaaaaag

SEQ ID NO: 40 - DNA, 620 bp, Nicotiana benthamiana
cggacgcgtgggttcgtattttcctaacaccaacctcaggaggctcttcgtattttcctgaatctatggctttctcttctcttctcaaacctaccgcctccattgttcgaccttcccatcgttcccaggtatcatgtgcaggtcttcaccagagtgctaactctgtcaaattacaatcgtccatcttcggagatgctgtctcagtcatgcaatgttcgtccttacaaaaatctggtgcctgtagcattcaacctgttagagcaactgctactgagttgcctccgacagttccaaagtcacggaccagtgggaagacaaggattggtataaatggttttggacggattgggagattggtattacgaattgcaacattcagggatgatattgaagttgtggcagttaatgacccatttatcgatgcaaagtacatggcttacatgttcaagtatgactccactcacggggtctacaactcatccatcagtgtcctggatgagtctactttggaaatcaatgggaagcagattaaagtcagtagcaaaagggatcccgcagatattccatggggtgatttaggtgcagattacgttgttgaatcttccggtgtcttcacaact

SEQ ID NO: 41 - DNA, 610 bp, Nicotiana benthamiana
agcagctcgccccagagacgaaaccaagctttcaaataccagtgatatgcttaagacctccactactaagcatgactcagatgggtttggatctgctggcttaaagtctttcagagcattagcagtcattggtgctggagtctctgggctccttagcttcacaagtgttgcttattctgatgaagcagaacatgggttagagtgtcccagctatccttggcctcaccaaggcatcctcagttcttatgaccatgcttcgatacgtcgaggtcaccaggtttaccagcaagtgtgtgcgtcgtgccactcgatgtcactaatttcgtaccgtgatcttgttggtgtggcatacactgaagaagaaactaaggccatggcagcagaaattgaggtggttgatggtcctaatgacgagggtgagatgttcagccgccctgggaagttgagtgatcgttttccacagccttatgcaaatgaagcagctgcaaggtttgctaatggcggagcctatcctcctgatctaagtcttatcactaaggcccgacataatggtcaaaactatgtttttgctcttttaactggctatcgggaccctcctgctggtgtctcg

SEQ ID NO: 42 - DNA, 539 bp, Nicotiana benthamiana
caaaaatggctctccaagcagcatctctgcttccttctgcattttccatgcacaaagagggtaaatcatgtgctactctcaaggacagtagcctctttggagttacattatcttacaatcaaaaatctaagttcattcctcctgctgcatcgaacaaggaattgacaaagaaaatagcagctgtacctattagagcacaaacagctgctaccacaccagcagtcaaccagtctacctcagaacagaagaaaatcctcaggaaaggcaatgtgataattaccggagcctcctctggtttaggactagctacagcaaaggctataggtgaaacaggagagtggcacgttataatggcctgcagagacttccttaaggctgagaaagcagcaaaatctgtgggcattccaaaggaaaactacactgtcatgcatctggacctcgcttcccttgaaagtgtccgccaatttgtagatactttccgacgttcagggaggccacttgatgcactagtctgcaatgctgcagtgtacttgccgact

SEQ ID NO: 43 - DNA, 559 bp, Nicotiana benthamiana
cggacgcgtggggtcgaggagaaagactagggagccaaaggaagagacagtaacacttggaccagtaaccagggagggtgaattggtgttcggtgttgctcacatttttgcctctttcaacgatacttttattcatgtgactgatttgtctggaagagaaactatggttcgcattactggtggaatgaaggtaaaggctgatagagatgaatcttctccatatgctgccatgcttgcagctcaagatgtgtcacagcgatgcaaggaacttggaattaatgctcttcacattaagcttcgggctacaggaggcaacaagactaagactcctggtcctggtgcccagtctgctcttagggctttggctcgatctggcatgaaaattggacgtatagaggatgtgactccaattcccacagatagcactcgcagaaagggtggtagaaggggaaggaggctgtgaagatggttcgtttctgcagcataatgcaccttggaggattttggtgttgaggatgctcctttcaatttctttttacaattgatatctaaatacttt

SEQ ID NO: 44 - DNA, 623 bp, Nicotiana benthamiana
ctcaaatcgagcaatggaacgatttttctgccactgagattgatgcaaacattgggcaatggttgtacccacgtctcggctatcgtgtattcattcctccagccgaggaagctgcagtagctgcattaaagagagctcttgctgctttaaacatccatcttgcgtctaacacttacttggttggacattcaatcacattggccgacattataatggcctgcaacttgagccatggttttaggtatataatgactaagacctttaccaaggaattcccacatgtagagagatacttctggactgtggttaatcagccaaatttctgcaagatattgggcgaggtgaaacaagctgaatctatcccggcgcccccgtccaagaagcctgcaccagcgaaggaacctgcaaaacccaaagcaaaggaggagccaaagaaagaggttaagaaggaagaaccaaagtttgaagaggaggaagaagcacccaagcctaaggcaaagaatcctcttgatctcttgcctccaagtaagatgattctggatgagtggaagaggctttactccaataccaagaccaacttccgtgaggttgccattaaaggtttctgggacatgtatgatcct

SEQ ID NO: 45 - DNA, 516 bp, Nicotiana benthamiana
catgggttcactcgccgatcccggcgaactcgactcggtggcgccgccaccgagttttgatgacttccagcgccaaacttccttaatgacaagctgcactctcctctggaaagagctctccgatcacttcaattcactcgaacaagacatcctcaagaaatccgaagccttaaaagctaaaatccaaaccctagattccgaaaccaaagcttccctcgacgccctcgaaaaacgcgagatttcaatgaatgtttcactctcaatttctcttcagaaggttctcgaaaacaagcaagctgctattttagctctagatgagggtgcagaacaacccgaagtcgatgactctactggattgtatctaaaattgaagagcttttgtgttaagatggattctagaagcttctggaggtttttaattgtgaaaaagaaggatttggattcacttagggttgagataccgaaagcattaggagactgcgtggatccgccgaggttcgtgttggaatcgatatc

SEQ ID NO: 46 - DNA, 514 bp, Nicotiana benthamiana
tttcccaatattccatagagagaaaaaaagtaagaaccaaaaggatgagattttcagttgtaattgtctttgtgatgttggctttgttgctaaccacaacttatgcagaacaatgtggtaaacaaaaccataagcgcaagtgtcccaacaagttgtgttgtagcaagtttggttggtgtggcactagttgtgactactgtggatctggctgccagagcaactgtcacaaaggctgtgccaccgccatgttcgccaatgaaacagccaataataacgatgctaatttcaactgatcgatcacgaccatattactaaaagtttgtcgtacaacatacacttaagggtgatatgctataagttatgaaaaaaataaaggaaggtgtgttgtgtatgtaaaaataagtaagaatataagtgatgcacactatgtgagcttcacaagttgaatattgtgtaagatcagtgatccccactatgtaataaataatactaatattatattttacataacccc

SEQ ID NO: 47 - DNA, 528 bp, Nicotiana benthamiana
aaaacttgccaactttcctgagtgcgatgtcttcatttatgtttcttgtgcacaaactgctctattggatagtaaagagttcttagctccagttattactccttttgaagcaatgattgctttcggcagaggaagtgaatggactggagcttatgtgacagaatttcgggatttgattacttcttcccctgtggaagtgaaagaccagtcagaagcgcggttttctttcgttcagggtggatatgtggaagattttgaacagcaagatgttgaagaagatgtcgaagatggagtttctgctttagtgaacatcacagagaaagctctgcgtgttcgtgacaaggactcgcaaactcttatgaatggaacagctaaatctggggcagaatacttcgcagctaggtcgtttcacggccttgacattcatactgacaataattttcccgagccatttttaattggtaaaagtgggagagcatcagggtacaagaatgagactacagagtaaaagtaaatttgtgatgattc

SEQ ID NO: 48 - DNA, 645 bp, Nicotiana benthamiana
cccacgcgtccggccaaaactagtatcccacctactatatttgtataatatggaagttgccaaagttcttcacctgaatgaaggaattggaaaggctagctatgccaaaaattctctgtttcagcaaaaggtgatcctaatgacaaagtcaataagagatgaagccatatatgcactataccgcagcctttccccagaagccatttgtattgcagacttaggatgttcctctggacctaatactttccttactatttccgaactcattaaaactatttatgaagaaagcaaaatcaatggcaaaaaacagtcgccggaattccaagttttcttgaatgatcttcccggaaatgatttcaataccattttccggtcgttgccagagttctacgaagatttgaggaaacatatgggagatggatttggtacaaattgctttgttgcaggagttgctggttcattttataatagacttttcccttccaacagtgtgcactttgtccactcctcatacagtctccactggctttctcgagtacctcatggaatagagaataacaaaggaaatattcacgtggcaagtacaagcccacaagatgtggttgaagcatactacgagcaatatgaaagagattttgtgaattt

SEQ ID NO: 49 - DNA, 580 bp, Nicotiana benthamiana
atttaatatcaaagaaaagaaaggaaaatgacttgtacattggctctcaaattgattgttagtgttgtcactttgctttgtttaattcacttttcctgtgtttgtgatgctaaaaggatgcttagggaggaaaatgagaagttatttaaggtaaaaaaggatgattcggcttctccttctccagattcaacaaacattggtggatttccttttccattcaattttccaccattttctgatggaattccaaatatacccttcaattttccatttcctgactttggatcatcaggaggattgcctggttttggaattcctggtactggtgataataacccatttacttttccaatccctggagttcctaatgttgctgttccacccccagctgccgccccttaaattcctatacaactttctctctgttattatcagtttaattttgtaagaagaaggaaatcaaggagtaagttttagagccataggctcaaatgaattactatttcttgtccttgtttaattagaaaatgggaaatgacatatatatcaagtaaaaaagaactcgtattctcctaccatt

SEQ ID NO: 50 - DNA, 477 bp, Nicotiana benthamiana
tccggcggcagcagatactgatgaaacaaaggcaccggcagcggctcctgcggcagcagatactgaagaaacaaaggcatcggctccggcaccggcggcagcagatactgaggaaacaaaggcaccggcaaccgcagataccgaagaaccaccggcaccggcaccagcaccggcgccggcaccggaagagaagggagaagggtatgggcaatacgtgaaaatggcagaaggatttctgaaatcaggagatgatgaatcagcgaaagcatctgaaggaggatcagattatcttaagatggccggtgacttcttaggcaagaagtgattagtttaatcagattctttttaataatgactgttattttccaagtttttcttctttcattttctttgccactgttcagtgttcattaccggcggcgaacttcttcagtagccgtcgccggagctggtttttacttggcatgtatgtaattt

SEQ ID NO: 51 - DNA, 644 bp, Nicotiana benthamiana
cgaaaacctcactgaaatatttagagagatggcaaacccgaaggtgttctttgaccttactatcggcggcacaccagctggccgtgtggtgatggagctctttgccgacaccgttcccaagacggcggagaacttccgtgctctctgcaccggcgagaaaggcgtcggaaggatgggcaagcctttgcactacaaaggctcaaccttccaccgtgtgatcccagggttcatgtgtcaaggaggtgatttcaccgccggaaacggtaccggaggtgaatcaatctacggcgccaaattcgccgacgagaacttcaaaaggaagcacaccggccctggagtcctctccatggctaatgctggacctggaaccaacggttctcagttctttatctgtaccgctaagacagagtggctcgacggcaagcacgttgtgttcggtcaagttgttgaaggctatgatgcgattaagaaggctgaggctgttggatctggatctggcaggtgctccaagcctgttgtgattgctgactgtggtcaactctgctagatctgaggacgttgatgatgatctagtttatctatatttaactcgccgtttttggctttgtttttaattttaatctatcggttactgcttgcttact

SEQ ID NO: 52 - DNA, 596 bp, Nicotiana benthamiana
taagcatacaccgccagccccaaaaatctaagcatcggccgaatggcagcagcagcttctacttcaatggcagctactgccgtctttgcttctcgtttcccactttcctccaccaccaaagccgcccctgttcgctgctccgctttgccttaccttccaccccgcctttctgctaccgcgttctctacttccttccagtttgctgaacccaagaaggcttcgctactccaggtcaaagcctcttcatcagaagaatccggtgctgttgataccagtgaattgttgacagatctaaaagaaaagtgggatgctgttgaaaataagtctacagttatagtatatggaggtggggcaattgttgcagtttggctgtcttcaattgttgttggtgctatcaactcagttcctttgctcccaaaaattatggagctggtgggccttggatatactgggtggtttgtctaccgctatcttctattcaagtcaagtagaaaagaattggcagaagacattgagcaattgaagaagaagattgcaggaactgaataaatgcacacaaatggcaatgccagttcagactgttaattttctgtatg

SEQ ID NO: 53 - DNA, 596 bp, Nicotiana benthamiana
tctccatcttactaacaatggcaccaaaagctgagaaaaagcccgccgagaagaaaccagcagcagaaaaaatccccgccgcagagaaagctccgaagccaaaggccggcaaaaaactacctaaggacggcggagctgccgctgccggagacaaaaagaagaagagagccaaaaaatcggttgaaacttacaagatctacatcttcaaggtgctgaaacaagtacatcctgatataggtatctcaagtaaagctatgggtataatgaacagtttcatcaacgatatcttcgagaagcttgctcaagaatcttccagacttgccaggtacaacaagaagccaaccattacttctcgggaaattcagactgctgtgagacttgtacttcctggtgaattggctaagcacgccgtttctgaaggcactaaggctgttacgaaattcactagctcttgaatgttgttagggtttgcgttctcttttcatgtcttaatcaagggttttatggatgtaaaaatagtttaattagtttgttttaagtaaatcttttgtattcgactgccagttatgaatggaattgctaagttttctactttg

SEQ ID NO: 54 - DNA, 614 bp, Nicotiana benthamiana
tcgactcaacaaacctttaccccatctctaaatctatattggtttgacaaagatgatagaaaggaatcttggaaaatgtttgttgctccttctttgtttaaacgttgtctcaaatatagtggctgctggggctccaccaacttgtcctgctgatattggtagtgattgtggaagtgattcaggtgaatgggaaggggagttcttccctggaattccaaaaattaagtatgagggtccatctagtaagaatccactttccttcaaatggtacaatgctgaagaggaaattcttggcaaaaagatgaaggattggatgcgatttagcgttgcgttctggcatacgttccgtggcacaggagctgatccatttggtgctcctacaaagttgtggccgtgggaagatggtaccaattccctggctatggccaagacaagattgagagcaaactttgagttcctggagaaacttggagtagatagatggtgtttccatgatcgggacattgctccggagggcaaaacccttgaggaaacaaatgcaaacttggacgaagtggtggctcttgccaaagagcttcagggaaataaaattcatcttttgtggggtaccgctc

SEQ ID NO: 55 - DNA, 624 bp, Nicotiana benthamiana
cttttcctaatttcttccgacccctccatttccctttccagctccgccgtatttttctattagggtgcgacatggcagcaacatcagcaactactttctcagttggctcagccacatctctgggctgcaaaggaagctcagtatcgcaatcaaaagccattggtgtgaaattcaactccaaaaacaaccttagaagtttcagcggtttgaaggctgccacaactgtaagctgtgaatcagaatcgtcctttttaggaaaagaaagtgttgccgtccttaaacaatctattactccaaaggctcaaaaagaaaacaaggtatgtgggaactgtgttcagcctcaagcatcttacaaagtagccgttcttggagcgagcggcggtataggccagcccctgtctcttctggtcaagatgtcaccgttagtttcagagctgaacctttatgatatagctaatgttaaaggagttgcggctgatctcagtcactgcaacactccctccaaggtttcagatttcactggagcttctgaattggccaactgtttgaaaggtgtaaatgtggtggtcatacctgctggtgttccaagaaagccaggtatgacacgtgatgacctgttcaaca

SEQ ID NO: 56 - DNA, 619 bp, Nicotiana benthamiana
acgttacaacaactacagagggcgtggcggaagagggatgggggtttcaagaccagttacaaaatttgaagaggattttgattttatggccatgaatgagaagttcaagaaagacgaagtgtggggtcatcttggcaaaagtaacagagaaggagatggaaatggcagcgatgaagatatctctttcaataaatatgatgatgatcttcctaagattgatgtgaagcctgtttacaacaaggatgattttttcgactctttgtcaagtaatgcacttgataatgacccaagtcatggaaggaccaggttctctgagcaaaggaagatagacgttgagacatttggagatttctcaagatacaggggtggccgcggtggccgtggtcctggacgtggtggacgttctcgaggttcgtattatggaagaggaggatatggaggatacggtggaaatagaggaaatgggtatgtttatggttatggtggtagaggcagaggccgtggtatgccatcccgtgcttcgtaaaagcgtttgctgtattatctcgagcttgagctagaagaaactatctgcctcttttaggcaagatagtgttagtactatctgatcctgtaacgt

SEQ ID NO: 57 - DNA, 637 bp, Nicotiana benthamiana
ttgatgaatatctagatggacgatgtatatacctcgttggagtgatgggctctggcaaaacaactgtgggccgtattttggcagaaacactgggatattccttttttgactgtgacaggctgatagagcaggctgttggtggaactacagtagctgaaatcttcaagcttcgtggagagagcttctttagggacaatgagacggaggtattgcacaagctgtctgcgatgcatcggcttgttgtttcaacaggtggaggtgcagttgttcgtcccattaattggagacatatgcacaagggtattagtgtttggttagatgttcctttagatgctttggccaagagagttactgctgaaggaactaaatctcgacccctattacatgaagaatcaggagacatttatgataagactttgaagcggttaactactttaatggagacaaggggtgaaaactatgccaatgcaagtgtcagggtttcactagaaaatattgcagtgaaaaggggaaaagatgtctgccatattacacctactgaaattactctagaggttcttatacaaattcagaacttcttaaagaaacaagagagcgtagttgtgctataagattttttacttcccaatggggggcg

SEQ ID NO: 58 - DNA, 596 bp, Nicotiana benthamiana
aacattgagaatttgatcgtccccattcagcatcagtgtttgtatgggtatgaagtattatgcaggatccttctgatgccaggcttctaattcatggttctggtggagataacttgtcaagagactcaggcaacctgctttattaaagtattggaaagttcttccagaaaagaagctaaagtgattaattctatctgaggtgacatggaagcttcttgttgagttttgaatcatcctgattgtaggccatatttcctggagatcctgagaagcagtgttttaaaaagtggaatgggatgggggggaattttggttccgttactattctccatcactttggtcgaatcatcaagaaatgctgaaaaaatgtggtcgctaaacgtagtctcaggatcatctccactttatagctgggctttgtacagtgctggtttttctgtactggtggctgtagtcctgtctatgtatctaatcgtcgagcatctagctgcataccatcagcctgaggagcagaagtttttgattggactaatcttgatggttcctgtttatgcactggaatcgttcttatccttactggactcaaatgcccgcat

SEQ ID NO: 59 - DNA, 860 bp, Artificial
  Synthetic
acttctctttccttttattcaatcaaacaagtcttttacattaaaatacaattaacagtttaaaaaatggctttattcttgtttttctcaaacattaaaaaactttttaaatacaatcagccgaaaaaaatacaagaaaaacaattatatatataaatcctcgaagagaattacaaaatccttttagcaaacaacagtagctgctccggaagacacagggcttgcaacatcaagcatcatgggattccacttcatcaccactttatcaccgcatcttccatctgatgaaactccggcaaattgcatctgatctgcttcaacagaagacggatttggtacctccaatgtcaacttcttctcagctacagacttgagtctccgcctctctgctcttgacccaatcacctgtcccaaaactgatgctgctatggtgaataccatagctgttttaggcatcaacactgactttctcagtattcctatgaatggaaacgctgcgtgaagagctataaaccaagatgccgaaaacttttcagtgtgctctctccagacccctaaaggcacatttaacgccatgcccagcatcccgatcactagtactttagctggtaaaggttgtggacggaggttcttggcgaaaggtgtttttgatatcgctgctcgagctgtgactattgcttgagggcatttaaatttcatgcctggagggggttgcaggatctttgccacaagtggtgccacaccacttacagctcgatatgattttgctattgggcagtttcctgttttaagccattcgtcgcccatggcttcgtggtttcctcccttatttttggatgaatctgaccggacgcgtgggc

SEQ ID NO: 60 - DNA, 350 bp, Artificial
  Synthetic
cccacgcgtccgaattatcattatctcaaacacaacaaggatagatcatcctcataggcgatgttgtttagtggttcagcgatcccattaagcagcttctgctctcttccggagaaaccccacactcttcctatgaaactctctcccgctgcaatccgatcttcatcctcatctgccccggggtcgttgaacttcgatctgaggacgtattggacgactctgatcaccgagatcaaccagaagctggatgaggccataccggtcaagcaccctgcggggatctacgaggctatgagatactctgtactcgcacaaggcgccaagcgtgcccctcctgtgatgtgtgtggc

SEQ ID NO: 61 - DNA, 69 bp, Artificial
  Synthetic
cccacgcgtccgctttgagcgagagaatcagctttcagagaaaaaagcatacctacagagagagttatg

SEQ ID NO: 62 - DNA, 715 bp, Artificial
  Synthetic
cccacgcgtccgctttgagtgagagaatcagctttcagagaaaaaagtatacctacagagagagttatggcggagagtggtggacgaaggatcggagtggcggtggatttctcggactgcagtaagaaggctctgagctgggcgatcgataacgtggttcgcgatggagatcatctgatcctaatcactattgctcacgatatgaattacgaggaaggcgagatgcagctctgggagaccgttggatcaccttttattcctatgagtgaattctctgacgctgctgtgatgaaaaagtatgcattgaagccagatgctgaaacccttgacattgtcaatactgccgctaggaagaaaacgattacagtagtgatgaagatatattggggagatcctcgtgagaagatttgtgcagcagctgaacagattcctctctcaagccttgtgatgggtaacagaggccttggtggtcttaagaggatgattatgggaagtgtaagcaaccatgttgtcaacaacgttgcatgccctgttaccgttgtcaaggctcacatctgagtttgctcggagaactctaaataacaccaccgtgtattctataatttgtgtttttgtggtcggaatttctattgttaactgttgtgtgactggtgttttgttcatctgtaccgataaacaacactccaccttctaataaatacagactcttttgatt

SEQ ID NO: 63 - DNA, 324 bp, Arabidopsis thaliana
aaagggtagccatgtcttccttaacaaccagacaacttttccacagaacaagtagtaattcccaagtgcaaatttgtccttctaggtgtattcctgttttcatcaccaacaagaccaacaacagtaatagattctttaacatcagtaagttttcaggtttcaagaatttgagtgttgtggtaaaggcagctgctggggatggaggaatttcacctaagaatcaagatgatgaagatggtgtgtctttgggaaccatgaaattgcctctggatattgatgttgcaagatttgaaactctactttttcagtgggctaacagtcttt

SEQ ID NO: 64 - DNA, 744 bp, Arabidopsis thaliana
gtcgacccacgcgtccgctctttccttctctcaccgcgagagtaaccgagagacatgattctgataaactctaattctccgacgctaatctcagccgttagattcgtgggctcatctccgttcaccactcgggggctttctcagtccactgtctcaatctctagaaacaaaagcttcttcttccacttcaccgagacgaaggagaagaacgcaagaagagattatttgagagtatcaatcgtgtgtgacgcaggagggatgtttccggtggatccatgggctccaaccattgattcacagagcatagcatcacaactcttcgctgtatctctgtttccttacattggctttctctatttcctcactaaatccaaatcagctccaaaactcacacttttcggtttctacttcttgcttgccttcgttggagctacaattccagctgggatttatgctaaggtgcattatggaacatcgttgtcgaatgttgattggttacacggaggagctgaatcacttcttgctcttaccaatttgtttatcgtgttgggtcttagacaagctctgaggaagtctcaagatgatgatgatgataaacttggtaatgatgatgaagttccaacaactcaagaacaagggaaatcttcagtgtagtaaaacaaatgtaaattttttaattatggagtttcacttgttttttaattagattatatatagtcgacgcccatctaattcccattttag

SEQ ID NO: 65 - DNA, 559 bp, Arabidopsis thaliana
cccacgcgtccgggtcaaaagcttaatgtcgttgtcatatctgctaggattccatcaacggctcagtctcctcacgccgctgcaccgggaagctctacgccgggatcaatgactccgccgggaggagcccactcgcctaaatcttcctcccctgtttctccgacgacttctcctccgggatcgactactccgcctggaggagctcactcgcctaaatcttcatcagctgtctctccggcgacttctcctccaggatcaatggcgcctaaatccggctcccctgtttctccgacgacttcaccaccggcaccacctaaatccacgtcccctgtttccccatcctctgctccgatgacttcaccgccggcaccaatggcacctaaatcatcttcaactattcctccgtcttctgctccgatgacttcaccacctggatcaatggcacctaaatcttcatcccctgtttcaaactcacccaccgtttctccatcgttggctccgggaggctctacttcttcttcaccgtcagattctccgtcaggctcggcgatgggtcctt

SEQ ID NO: 66 - DNA, 450 bp, Arabidopsis thaliana
cccacgcgtccgctacagggcctctgtcgctctcaccagttaacagctacagcacaaaactgtaaccacgcttccgatctctaaaacctgagagagagagagagagagagagagacagagagaagtgtttcaatagtttggcgtgaagatggccggaggaggcggatacggcggcgcatcggggaaagatgattacgtcttcaaagttgttctaatcggagattcggctgtagggaaatcacaactacttgctcgattcgctagagacgaattcagcatggattctaaagccaccatcggcgtcgagttccaaactcgtaccctctccattgaacaaaaaagcattaaggctcagatctgggataccgctggtcaggaaagatacagagccgttacaagcgcatactacagaggagcagttggcgcaatgctggtttatgatatgacgaa

SEQ ID NO: 67 - DNA, 1026 bp, Artificial
  Synthetic
cccacgcgtccgatttcatcgaacacttggtgatcaatatttgaaaacgaagagcacagccaaaattcgataaaccctaaggaacagtgagatggagaagaagaaagcaatgcaaattgaaggttacccgatcgagggattgtcgattggtgggcacgagacgtgcatcatatttccatctcttcggatagctttcgacattggtcgttgcccacatcgcgcaatttctcaagacttcctcttcatctctcactctcacatggatcatatcggtggattaccaatgtatgttgctactagaggcttgtacaaaatgaagcctccaacgattatagtacccgcatccattaaagaaactgttgagagtttattcgaagttcacagaaagttagattcttcagagctaaagcacaatcttgttggcttggacataggggaggagtttattataaggaaagatctcaaagtcaaagcctttaagacataccatgtcatccaaagccagggttatgtagtgtattcaactaaatataaactcaagaaggaatatattggcctatctggaaatgaaattaagaacttgaaggcttcaggtgttgagattacagacagcataataactcctgaagttgcttttacgggagatacaacgtcggattttgtagttgatgaaactaatgctgatgctctcaaggcaaaggttctcgtcatggagagcacatttcttgatgattcggtatcggtagagcatgcgagagattatggacatatccatatatctgagatagtaaatcatgctgaaaagtttgaaaacaaagcaatcctgctaatccacttttcggctcggtatacagtgaaggaaatcgaagatgcggtttctgcattgcctccacctttagagggacgtgtgtttgcactaacacaaggattctaaacattataacactcttataggttttacatacttttgtttttgtattccacatgtaaacattgtattctgttgttaattttaagatttcttct

SEQ ID NO: 68 - DNA, 94 bp, Artificial
  Synthetic
cccacgcgtccgatatcatcgaccacttgtggatcaatattagaaagctaatagcgcaaccctaattctataaaccctagcgaacagtgagatg

SEQ ID NO: 69 - DNA, 510 bp, Arabidopsis thaliana
aacagcaaaaccatatcttgatgattcaaaatatagagttaacaagcaaagatgagacaatcttgtacgagagagctaaaacaaatggattccaaatccagcaagtacaaaaatcgcagaaaataagatgaaaccaacttaaaacagagatgttccctttcccttcttgtcaccaccgatctcgaaatgcttgcacctcttgataggacgctgcgaaaagtgcttgcagctttgacactgaagcctcaaaacaatcttcttcgtggtcttagcctttttgtggaagacaggcttagtctgaccaccataaccagattgtttacggtcataacgacgctttccttgagcagcaagactgtctttacccttcttgtattgggtaaccttgtgcaaagtatgctttttgcattccttgttcttacagtaagtgttctttgtctttggaatgttcaccattttcgcgtctctgatctccggtgaagcttttgtgccgtcgtccggacgcgtggg

SEQ ID NO: 70 - DNA, 884 bp, Artificial
  Synthetic
cccacgcgtccggaatgtagagaatgatgattcaagttctcaatcatttgcttctgtttcctccagagatcaagaagttggtgatgttagattctccggcggctatgggttaggacaagatctaagctttggtgtttgtaagaaagtggtgcagttgattcatgggaatatctcggtggtccctggctcggatggttcaccggagaccatgtcgttgctccttcggtttcgacgtagaccctccatatctgtccatggatccagcgagtcgccagctcctgaccaccacgctcacccacattcgaattctctgttacgtggcttacaagttttattggtagacaccaacgattcgaaccgggcagttacacgtaaactcttagagaaactcgggtgcgatgtaaccgcggtttcctctggattcgattgccttaccgccattgctcccggctcgtcctcgccttctacttcgtttcaagtggtggtgcttgatcttcaaatggcagagatggacggttatgaagtggccatgaggatcaggagtcgattttggccgttgattgtggcgacgacagtgagcttggatgaaaaaatgtgggacaagtgtgcccagattggaatcaatggagttgtgagaaagccagtggtgttaagagctatggagagtgagctccgaagagtattgttgcaagctgaccaacttctttaagttgttatttcaactttttttttacattcaaaatttttaccccatagatttatgtcaaatatatcaaaatgaaattttgaaattgttattatatataccacccatatctttatgatttggacatcctggttttttttgttctttttctcattttgaaccccccgaaattgcattg

SEQ ID NO: 71 - DNA, 895 bp, Arabidopsis thaliana
tttttaatagtacacgattatttcggaacgtaaatgtcgcggaacaatagttcaaagacatcattattacggtgactgaaaacagcaaagagagataaataaaggacaaagaaacgacagcgtttttgtgtgatgtgtcattttcagatggcttcgagagcttgaagaatgtcagctttgacatcttcaaagtcttcaactccaaagctgaaacgaaccaagttatctttgattccatactttagtctctcctcttgcggcagatcccagtaggacatgatagcaggttggtcaacaatgctttcgcagccaccgaaggatggtgcaatgtaaggaatctttagagaatccacaaacttgattgtcgtttcaatgtctccatcaatctcgaaactgaccacacctccaaaaccagtcatttgtcgcttggcgagttcatgttcgggatgacttggaaggcctggatagtacacatgactcaccttaggatgtgcctctaaaatttcggccattctaaaagcggtcgaattctgttgctgtacacgaagatgcaatgtcttcatgcctcggatgattaggtacgcagcgtttgggttaagtgttcctcccaacacatgatgcagattgcgaatttctgaaaccaacttcagtgaaccacagatgcatccagcaagaacatcattgtgtcctccaatgtactttgtagcagagtgcacgacaagatcagcaccaagagcaagggctttctgattcagaggtgttgcaaaggtgccatcaatgcaaaccagagttcccctcttgtggcatatttttgaaactagctcaatgtcgacacatctaaggaatgggtttgtcggggactcagtgaagaacagagataccttgaactcattca

SEQ ID NO: 72 - DNA, 1071 bp, Arabidopsis thaliana
ttgtaaaaaatgttatttccattaatataaattctgcaaaactctttaacttgtcgagtaatgcttcatacataaatgagaaaccgttccgttaaataaaattaagcatgaaattatttagcaataaaagagaaacaaaggaacactgcccaattaaaacaagggcaagttcagaaataagcaaagaattgcgttttgaccagagcacgacttagttttgtagttaaacgaattgtcttcctcgagaagagaaggtttggccaaaccaccaagaagaagggacaacgttcaaaaatgtctgcgttttgctgtccgtcagagtaactttgaaggagagtctctgtccccggagatcaccggagctctgccagttggcaccccaattacgggtcatctgaagccaagtctttccctttgagcctctcaccgctactgatctcaccgagccgccaccaccaacgtttgagatcattaccatattgaagttaccttgccctctcatcgtgaacctcacgcctcctcttcttttgcatcccacccggcgatagaagacggggacgatgccttcattgccgcgacgggcaatgcggaagaaagcgggggaggacatgtcaaagtgatggcgagggagattgcaccaaccattattgttattcgttgggcaaaagtttgtagccgtcaccgtcacggcggctcctcggagacaccacttaggatccgccggaaagtcgcacctcacctggtagcacccaccgcatgactcaccgcttctgaatagctcaccgcttagcgccgccgtgtgtgctccgaatccggcgtggtacggattgtcatacccacaagctcctccaagtgaagcagggctatcattgacaccataatacgttgcatgagctcttatccaaccgttagaacacatccccacacttaacgtactaaccaagagaataaccgttactaagtatgttcccttcatatccatatatatatatttttattttatttgagataagtataaatttttcgtgatgcaagaaagagaggtcgagaaaagaaagccggacgcgtggg

SEQ ID NO: 73 - DNA, 1164 bp, Arabidopsis thaliana
aacatcaaattaaattttttctttcttatataaataaagatcagaaatagattattttctccattttttagtttcgttgttgatgaatcatgtattcacaaatctgcaatttcttctaacttctccatcagccaagctttcagagttcaaaatgttccccatctttaccatcgacttcgagaattgctcgaagaaagccactggatcctccgcatacttgctcacgattcgccgcgtttgtatcccgaacaagctcgtgtacatctcctggtccgaattcagtaacccttctcctcttagcagtgtgtggtagatcgagttatcgaagagattcggcgtcacattgtctatcgccgtcacgttactatcaccttctccgctactcgccggacaaatctctcgaagacttgccaagtacgtctccgaaactggatttagggctgacgtcacttgaaaatctccataaattcgggatcggaagttgcgacattgtgcttttccgatcgtgtgcgctcctataagagcgaccatgtcttcaaccgagagaccttgagaatagaacttagcaatgatgctgattaaaccctcttctggagttggaaggtttgttgtggcaagctcgtagcttgcggtttttgaatcttttcttcccacaggaacatcccagtaaggcccacccaccaggattgtagcatctctagcaccaattgtgagaagatcagcgcatgaaacaactccaggacattcggattcgattatgttcttgattctgtcgacaattttgtatcctttcaatgaatttatgttgggagaagctttcttctctccctgtagagtttctgtctcgtctagcaacaccgatccatcacatccttggacaaagcagtcgtggaagtgaagacgaataattatggctgcatttctaggatcttccttcactatgcattccatttctttcttgatgacgtcaaatacggttggacaagtagacttgtaataatctagggttaaaggaagatccttccccggtgtatcaaaggaaaagcatgggataaagatggtgtgaaccatgaagaatacaaagaggagtctcatcatatttaatttcttctatcggaaaactctttgatccaaattttgggaaaatatgtgcggacgcgtggg

SEQ ID NO: 74 - DNA, 1237 bp, Artificial
  Synthetic
cccacgcgtccgcatcttcttcaggctcatctttcatctctattccatcccaaacatcttctctagtagcgcatttggtatgaaatgtagactcagaacacctcttacaagaatatcccccacaactccaatccattttcttacgacaaacaccacatactgaatcaataataccaagaagagaagtgcgagaaatgcgatgatcatggcggttgatattgatgacccatggaaatccagagcaattgttatgggaagtgaaattgcattgaagacagacatatgggcttcgatctccatggaggccgcaagtggtgcaagtaaaagagatcaattttggcataagggttagttcatggttgtgggtgttttggtcgtgaagatttagtggtggtggaagagaaacacatcgcaaatccaaagtaaagttacaagcggaacagtgataaaacatttcgtcaaaaatctttttcccacataaactacaattcccatcagtataagccggtggttcaccagtgatgagttttagtgtgtgtaaggagtgggaagggtggtttacctctgctccatacttttcgcaatccacatggaatgccaaatcgcattcatggcatttgtacggatatccactgcctcccttcccacaagtaaagcaggtgaaggagcttctcaccatctctagcttgagtttgtggtcatggttctggggaaaatcaatgacttccggtggtgggtacttgacacaatccaaatggatgttgaattcacagcgctgacattcatagttctggatatagggctggattgtctctttacatgtacggcatctcacactccagctggcaaaatttgtaataagagaaagattcttatcacacttgtgagaagggtggttgatctctttagggcagttgctgcaactcttatggaagaaataaccacattttctacagttgtagccatcactgatagttttgaattggagtccacaacatttaccccaccgattatctcttgcaggtgtcagccagtgctcatgaatgggtagtcgcaccatctcaggctccatggttactaagagatctagtgagaatttctcgttgaacttttggtctctgatttctcttagctcatgtgacggagataagtgaagaaaacaatagttattctattaataatcatttaatgattaattatttgtttttagtatattaataaaagaaagtttagatct

SEQ ID NO: 75 - DNA, 752 bp, Arabidopsis thaliana
ttttttttttgagaacaagctcttattacatataatattcgaactacaaatacaccccttaagcaaatctaatgaaagaaggggtaattaaacaataacaaaacaaaatacacgaaactgatattaaaggtgattatctaatgacgaatcacaatcattctcttcaggttttcttgtttggcccgtatgcatacttaatcagagactccttgatagagagtagctcagggaactctttcttgagcttggaagcatccatctcgttgttgcttcttggagccacaatgactttagcttgctcctctaatgtgaagtttgcccatttgaattcagggttgatgtagtctctgtacatctctaggatctcgttgtggctcaccacacctgggtttgtgaagttccagattcctttcaagtttcttttcgccatctcgatggagattggtaataactcgtccaacacagtcatgctgtttgggatgttcactactttgttgtacctggagatcttggtgatgaagttgcgcgggttgtttagatccgaggagatcggcatccttaccctcaatgtgcatacgttgtcatactcctttagcagctcctcgaccatggctttggttttcgagtagaaagagccagtgaagttgggtgtgtcttcctccttgaagccaattcctgaaccttccggatgcttgtcgtcatattcgaatatacaaccagtagcgaaattcatcattaggagtccgtgctct

SEQ ID NO: 76 - DNA, 812 bp, Arabidopsis thaliana
tggaaataagaagatgtttctaaatcttagggacatgaagaaacagaacatccatacacatttgttgcaacttgcaagcacactaaacctacacaattcgtttcctctgtacaattactttatacaacttaaggaaactgctcacactcttaatatgctaaaatgcatcacaggaagatgaagatgaattgctctgagttctttgaagctcttcatgcacatcacttctcttccttttccttcctgaattcgctggagcttcatatttcccggcgtcaagagggaagttgagcacggcttttcttccccggagcttgaaagctgcacagtcataggctcttgcagcatcaacatcactctcaaatgttcctagccagattcttgatcctttctttgctggatctcgaatctctgctgcaaatttcccccacggccttcgcctcactcctcggtaatgtctagcatctacttcttcttcgaacctctctgcctttttcacactctgatcagtctcatatgttgatgacgatgaattcagctctggtgatgatgatgatgatgattccccttccacttgcaagaactcgttgacgaaagaatccggatcaagaactggagaatcaggttcttgtttaggaacgtgtggttctatacaccaaagtcctgagacaaaagaagcatcgaagtcaaaatctcccatgaaaccatcacaaaccaacaagtcttctaagagatggctctgtatagcttccaaatcagagctttcctcaaaactcgccatttttacgaaagagagaaagcggacgcgtggg

SEQ ID NO: 77 - DNA, 415 bp, Arabidopsis thaliana
ttagacgaatgtagtgttattacaactaaccccaagataaaaaaaaatacaagggggctttttgtttggaagttacactattcccctgtacattatatatatcatgttagtaaaataaatataaaaagattaaataatggtgggaagactaagaaagtaaataacaaatttaagcaggaaattaatattacaatgtaattattacctgttgttttatctttcttttttcactaaagagaatttttacccaccatcaaaactttttttttcacttttcttccaaaccttctttttcaattcaaggatttgctcttgaatttccttattcccttcaaatcaaccactaccacacttatattgtctttgcttcctttttgcaaagccatcttcgacaaatactctgccgcggacattg

SEQ ID NO: 78 - DNA, 912 bp, Artificial
  Synthetic
cccacgcgtccgaagcatactcatcctctgatttcgctggattcagctgtacaattccgcacaaagaagctgcattgcaatgttgtgatgaagttgatccattggcaaagtctataggagctgtgaacactatactaaggagaaaaagtgacggaaagttgttgggttacaacacagattgtattggttccatttctgctattgaggatggcctacgaagttcaggtgatccaagcagtgtaccttcttcttcttcgccattggccagtaaaacagtggtggttattggtgctggtggagcaggcaaggctcttgcttatggtgcaaaagaaaagggggccaaagttgtaattgctaatcgaacttacgaacgagcactagaactcgcagaagcaataggaggcaaagcgttatctctgacagatttagataactatcacccagaagatggcatggttttggcaaacacaacatctatgggtatgcaaccaaatgttgaggagactccaatttctaaggatgcattgaagcactatgcactggtctttgatgcggtatacactccgagaatcaccagactgttgagggaagcagaagaaagtggagccataactgtctcagggtcagagatgtttgtcaggcaggcttacgagcagtttgagatcttcaccggtttacccgctccaaaggaactctactggcaaataatgtcaaagtactgagacatagcttaagtgtgtgtgtgtgtacttccatgaaaagtcgtcgattcaataaagctttagattgccatttgtatgttccgagaatgtccttttttgaggccataagccgaatgactggttctctctttgtatttatatatatgtataaactattaagcctaacattaatcttttttaagcttctttg

SEQ ID NO: 79 - DNA, 667 bp, Artificial
  Synthetic
cccacgcgtccgagcgttcaaagccaattgcctcagcccgagtttaacctaaaccagctcaacggcatgtttagccgtcacggcctctctcaaaccgatatgattgccctctcaggagcacacactataggatttgcacattgtggaaaaatgtcaaagagaatatacaattttagccctacaacacgtatcgacccgagtataaaccgtggatacgtggttcagcttaagcaaatgtgcccgatcggtgtcgacgtaagaatcgcaatcaacatggatccgaccagtccacgtactttcgataatgcttatttcaagaatctccaacaaggaaagggtttgttcacgtcagatcaaatcttgttcacagatcaacggtcaagatctacagttaattcgtttgccaatagtgaaggagcttttagacaagctttcatcacagcgatcacgaagttaggtcgggttggtgttttgactggtaatgctggtgagattcgaagggattgttcacgtgtcaattagtgtgatttgaggttttctttcttttattccttaaagaggatttttttttttaataataaaatttaatttcttgttgtcaaaataaggagttcataagtgtgaaacatggaaacttaaattaataagatgggtttatttcgttgac

SEQ ID NO: 80 - DNA, 529 bp, Arabidopsis thaliana
cccacgcgtccgtgtgtcgtaccaaagcgacccaagtgtagtcatagctaagctagatgcaaccgcaaacgacttcccaaaagatacctttgatgtgaagggattcccgaccatttacttcaaatcagcgagcggaaacgttgtggtttacgaaggagacaggacaaaggaagatttcataagcttcgtcgacaagaacaaggacacagttggagagcctaagaaggaggaagagacaagtgaggaagtcaaggatgagctctgaaaagagaagtgtgtttgtgtctcttagctgctagcttagtttggtagttttgaggaaaatacacagaagaagacagagctttgagtagacagagagaagacaaagagagagacgacagacagacagagaatctctttatctattcattaggtttttatatgtgcactcttcagaacaataatggctgcctccttttcttttttttggttgatgttacctttttttgtttgaattcagttctcctttaatatagtttttgaggca

SEQ ID NO: 81 - DNA, 773 bp, Arabidopsis thaliana
tttagcctccgagagattcagaaatattatattaaccaaaaaggtaatcacaacagcttatgtgatatgcatcaacaatagaacattaaagatgaattcaacaattccaaaactgaagaaaagagaattgtcgacaaagttaagaactgataacagaatacaaagcttaaaaattggtcgagtaacatagatgtcctcacatgactgcaccaagtcctatcacttgaacatagccataattccaaaacagagaagaataaaacataaaagcttaagccttgggggctactttctccttagccttttggagtttcaacactttcttcacaatcttttgctcttcgacaaggaatgcccgaatgatcctttccctgactgcagcgggttctccggcaggtgccagctggtcatcatcgttacgtccgggtgcagctcgtacggcccgtcgatatttttggaacgcagcaccacgacggcgtgctcgtagctggtgccgccctcggcggccatcaggtagtaccatcccgcgtggcgatacaggtgcgcgccttcggtgtaacagagcggcgtgccggtaaacagcgttttgcgctcgggcgagagcgtgccggtctgcgggtcaaacgcctgtaacacgatggtgttgtgcgggttgctgtggtggcgcggcccccacgggcggtagatatagtatttgcggccatcgtcgtcgtggaacagggacgggtcaaacccgccgttgcccatcgggattggctcgctccatggcccct

SEQ ID NO: 82 - DNA, 746 bp, Arabidopsis thaliana
tggctgatggcttctgacgtggtggactacgaggagagccgcagcggtcgccgcctcgacgggctggtgttctccacctacctgttcagcctgaagattggcctggcgattggcggggcggtggtgggctggatcctggcgtacgtcaactattccgccagcagcagcgtgcagccggttgaggtgctcaccaccatcaaaattctgttctgcgtggtgccggtggtgctctacgcgggcatgttcatcatgctgtcgctctacaagctcaccgatgcccgcgtggaggccatcagccggcagctgattaagcaccgcgcggcgcagggcgaggccgttcccgacgccgcgacagccgcatcccattaaccggaggcaatatggaaatcactaacccgatactcaccggcttcaacccggacccgtccctgtgccgccagggcgaggactactacatcgccacctcgaccttcgagtggttcccgggcgtgcgcatctaccactcccgtgacctgaaaaactggtcgctggtcagcaccccgttggaccgcgtgtcgatgctggacatgaagggcaacccggactccggcggcatctgggcgccgtgcctgagctacgccgacggtaaattctggctgctctacaccgacgtgaagattgtcgactcgccgtggaaaaacggccgcaacttcctcgtcaccgcgccctccatcgaggggccatggagcgagccaatcccgatgggc

SEQ ID NO: 83 - DNA, 341 bp, Arabidopsis thaliana
ttttttaagaacaaagcagataggtttttcctttgtggtttaaaaacgaaggtttaaaataacacaaacgcagttatgtggaggaatccaaattcccagggagaaaacgaatagcaaagaaacaactccaattgtatgggagagacaaaagccaaagatcaaatgataaaaagcaatttaagagaggttcaaggaagcgagctgctcggttgcaccaccagcagcgacactcctgagaacatccatagcctctgcaactttggccttgagagcttctggtgactccaacagatggagcacttcagtctggtccatctccaaaagcatcccagtcactttgg

SEQ ID NO: 84 - DNA, 738 bp, Arabidopsis thaliana
ttttttttggtttatctgtccacttttttattcaaataaaagaaaagcagattacattggatgattttatacagtcggttctttaacaaagaaagatgattgatgctaatatacacaattacataatcttatacttgaattatacagtagtttggaagaaagaattatacagtagaaaaatattaccgtgaaaaaagtaaaaagtaaaagtaaaaccatcattattagttggtactctccacttcatctctaaaccaatctgaagtaccccaatcaaacggcgtggacttttcctccggtaagaaccggttccgacaaatcgggcacgttatcttattacagtcaacgatccaacggtctaaacaacgatgatgaaacacgtgtccacacttcggtagctgtctaatcttatcgtcggatacaaaatcggataagcaaaccgtgcagcaatcttccggatcggtcaagagatcggagaaacgaaccaccgggattaactcgttggcaagagttgctgacgtggagagagcgagtcgggtcgggtcgggtcgagaggtctcgttgtggtcaagaaaacttggtagaccgatgtaaggacaaagagcatcgaccatgtctctaaagaaaccgatgacgtaaagtgtttttagtacgtaacctggaatctgaagctctttgaaatctgtaggaagacccatgagtgtgagagaaagatagagacgagagcggacgcgtggg

SEQ ID NO: 85 - DNA, 330 bp, Arabidopsis thaliana
atcgaatgataataatatttaaaatttccttattgatacgaaacatatatccctcgacaatacatatatagcggtctttattatttttatgtagaccgatcgatattgacctcaaaatcattacataatatcaaacgcgatcaatggccgaaacaagcatgtttctggaatcaggctgcccaatgagctcattgccacagtcgacaaattggtagtcaacaatgagatggccttgttgatagccaaaaccatcggtgtctatttgattgaacattgctacatccaaatccaagcctccgttgctgcattggtccactattctcacagtta

SEQ ID NO: 86 - DNA, 705 bp, Arabidopsis thaliana
agaatccgaaggtgattagcctactcgatccggtttactgattaccggattccacaaaagacaaaataaaagcataaacctaggataatagatagttttttttgttcagaaaccgacgaagaattagatccgacgacagattctaaacctctttgttctcgtcggtgatcacggtcttcttctccgcgaagatccaagtgacaccaaaaggatccgtaacttttcctttgaatcccagttcaacttctgcctccgtaacctccactttcacagctccggcgtcaacagctttcgcaacggcggcttcagcatccttagttccgagaagaaaagtcactcccgaaccttccgatttcgcagtagaaaaaccagggagagaggaaacgtcgcaaacaacgaaggaagagccagcgagattaagctcagaagagagaacatgaggaagctcttggtcaagcttacgcttagggtaaagagaatgaccagactcgatcgcaccaaaagcagatttgtagaaagtaacagcgtcaccgaccttttgagcttcaacgagcaacatctgcttgaactcagtgaagacaagatgcgtctccaccggaccagcaccgttagtagcaacagcagtaacatcttcttgagccatcgcagagagaaaataaaactttgagaagagagattcgtttacggttaagacggacgcgtggg

SEQ ID NO: 87 - DNA, 1058 bp, Arabidopsis thaliana
gcagtggctcaacctcgacgtgtcaatctctcgttggttactcaagcaagaacgcaacaacgttgcgcaatatccaaaccctttttgccgtcaagaacctccgctcgatcctcggagctaacaatctcccactcaacacctcacgtgaccaacgcgtgaacccgaatcaagtcgtacgtgtcccaatccattgctcttgctccaatggaaccggtgtctcgaaccgggacatcgaatacaccatcaagaaagacgacatactctctttcgtcgcaactgagattttcggtggtctcgttacgtacgagaagatcagtgaggttaacaaaatccctgacccgaacaaaatcgaaatcggtcaaaagttttggatccctttgccttgtagctgtgataaattgaacggtgaggatgttgttcactacgcacatgtagtcaaactaggaagctctctcggtgagatcgctgctcagtttggaacggacaacacgacgttggctcagctcaatggaatcattggtgactctcagcttcttgctgataaacctctcgacgtccctctcaaagcatgtagctcttctgtgaggaacgactcgttggatgcacctctgcttctgtctaacaactcatacgtcttcactgcaaacaattgcgtcaagtgtacttgtgacgctttgaagaattggactttaagttgtcaatcatcatctgagattaagccttcgaactggcaaacctgcccaccattttcacaatgtgatggagctttgcttaacgcctcttgcagacgacctcgtgattgcgtctatgctggttactccaaccaaaccatcttcaccacagcttccccagcttgtccagattctgctggtcctggtaactatgcatcaacgctcagctcaagcttcagtttcgtgattgtgttgattcagtgtgctctgctttgtctctgccttctctagtaatgttttgttgtgtgtttatgagtgtatctaagtactgttcggattaaaataaagacattgtttcacatgaagcatcaggtccttgtaccatta

SEQ ID NO: 88 - DNA, 180 bp, Nicotiana benthamiana
agaaagagaaatctttctgtcttaagagtaattagcaatggcttcctcagttctttcctcagcagcagttgccacccgcagcaatgttgctcaagctaacatggttgcacctttcacaggtcttaagtctgctgcctcattccctgtttcaagaaagcaaaaccttgacatcactttcat

SEQ ID NO: 89 - DNA, 155 bp, Nicotiana benthamiana
cttgaagacgagtatgatttacacattctgtcattgttattcatttactgttgggggccacataattgtgggagttgtaattctaagtagctatttaattgtagcagctgctgaccgctaaaatggagttggaacaagaacaacaacaacaaccc

SEQ ID NO: 90 - DNA, 636 bp, Nicotiana benthamiana
cgataagagagaagaaaagaacccatttgctggctcttacgctaacctgagatcacacaaatcctcttttttcttcagcttttttgtgccttctcacttaagcagggaccatgattaagttgtttaaagtaaaagaaaagcagagagagcaagctgagaatgcaaatggaaagccaccagtcaagaaacaaagtgcaggagagttgcgtcttcacaaagatataagtgagctaaatctacccaaaacatgtagcatatcatttcccaatggaaaagatgacctcatgaactttgaagtcactattcggcctgatgaaggatattatatgggtggcacatttacgttctctttcagtatttccccaatgtatcctcatgaagccccaaaggtgaagtgcaagacaaaggtttaccaccctaatattgacttagaaggaaatgtgtgtctcaacattcttcgagaagactggaaacctgtgctcaacattaacaccattatctatggtctatatcatctgttcacggagccgaatcacgaggatcccctcaatcatgacgcagctgctgtattaagagacaacccaaagttgttcgagtccaacgttagaagggcaatgcatggaggctatgttgggc

SEQ ID NO: 91 - DNA, 141 bp, Nicotiana benthamiana
atcttccaagtctgaaatgtaacttttatactagtacgttcttttatatctgatgtaaacaatgttatattgccatgtaaccacagcttataatttcaattataacttatatgatataaaaatatgtctgttaatctggtt

SEQ ID NO: 92 - DNA, 569 bp, Nicotiana benthamiana
gccattacggccggggacagcgactctctcttaggggggcgacgctgttaatcttcaactgcaaaaagttgatctcacagatatggaaatcaaggccggatgtgacggatccttgcttttaatcaaacagggagctgaggctgaggctaggtgtatgacaaaagctagacggcttggctgttactactccagtgctgtatgctgatgaccctgttacacatactctcacctttgaatatattgaaggtccttctgtgaaagatatattccttggctttggattagttggtgttgacgatgaacggatgaccgatattgcaacacagattggtaatgctattggcaaactacacgcatgtggcctagtccatggcgatttgacaacatcagatatgttaatgaggagttctgctaatcagctggttctgatagactttggtctaagctttacttcaacacttccagaagataaagcagttgatttatatgtacttgaacgtgctttgctctccatgcactcttcttgtggaaatgtgatggaccagatacttgctggatacaagaaatct

SEQ ID NO: 93 - DNA, 147 bp, Nicotiana benthamiana
ggaaactaaagtaagcaccgttgcagttcaattagcacatgctttacaagcaatcacatgattttagataggcatatttttgttaacaggcacagaaaagagggaaaaacaaactttttgcgttcagatggccaaaattgaataaga

SEQ ID NO: 94 - DNA, 327 bp, Nicotiana benthamiana
gccattacggccgggggtctcttggggaagaaattggcatcccaatagaggtatatggacctgaggcaaccatgactggtatctgcaaacaggctattgagtgcatcactgcagctgcatagaggaaccaactctgtattcttcaagcttaattgctttgcttattcttttctagctttgtgttagcatgatgttgtttgccaaagataaaagagatgtgtttgtatttttatgacttttttttacataagaaacgagccatcagcaatggcttcgtttcaaatatggctcgtttcaaatcagtttagtaacgcagaaaattgctgc

SEQ ID NO: 95 - DNA, 328 bp, Nicotiana benthamiana
ggcgggaattttctgcgttactaaactgatttgaaacgacccatatttgaaacgaacccattgctgagggctcgttttttatgtaaaaaaaagtcttaaaaatccaacccctttttttttatttttggcaaacaacatcttgctaacccaaagctagaaaagaataaccaaagcatttaaccttgaaaaatacagagttggttcctttatgcagctgcagggatgcactcaataccctgtttgcaaataccagccatggttgcctcaggtccatatacctttatggggatgccaattttttccccaaaaaacccccggccgtaagggc

SEQ ID NO: 96 - DNA, 600 bp, Nicotiana benthamiana
gctgatttacacattcatgaaattgtcaatgtcatgatacaagttacaacttattaagcacgagcatgaaaactgcctcaaagaaaaaaatgaggggcaagaactagtaacaggtccaaaacattgtacctgaatttccaagttcttcggctaagcaaatagtagaaacggcaatattatgccataatttaccaagaatttagagtttctacggcatcactgtacagctgctgaagcatcacaaagatcagccctttgttcaacaaaggtagttgcttgcacctttaagagttttgatctctcagacttcaccgtccttccgtggagacgatatcattctttcctgtacaaactgtctcctgcttaaaaccatggtcaaggctgtgctaatgtgagatttacttcaatggtatctctgcagactgcaaagtgacctgcccagcagcagcttgctcgtattcagcactggcctccggagtgtcttcttcactgggtggaaccaattgccaaaatagtggcaaatatttgtcccactccttgagaatagttgcgcctttcgtgctgcccgttttttccacatgggcttcgattaggctcttt

SEQ ID NO: 97 - DNA, 339 bp, Nicotiana benthamiana
gccattacggccggggacaaaaaaaattgaagctcggggtagctcatcaaaatgttttggaaaactaatctttttatttgggtttctttggctattttgctaatagtaatactccaactagctgatgcaagggagatgtctaaggcggttgctccaattacccaaggaatggattcaaacaacattagtgatcaagcgggttatgctcgggttttacattgcttggcttgcacatgttgggtcggttaaattttatatattttttacgatcaaatattatacaatggttttgtatgtgctaaaagtaataatactccaaaataaggcacaacattgggg

SEQ ID NO: 98 - DNA, 587 bp, Nicotiana benthamiana
tcacaaataccttaaataatcaacattatgtgtaatatccacagcaattacagattaatacaaagtattcttgaaaagatacatggtgcgagctggaatacaactaactaggagtacaaggataacgatctactgtgccaaagcacttgtgttgaaaacaaggagagcacctccagctagaatgccaaccaaggtaactgcccatatggctaagccagtggtacctccaacatagacatcaccgcttggagaccagtcatctgtgttgtagatggggctgtatccatcaacatttgctccatatttgtcaacgaattggtaaacaccctttcccttgggctttctgccagaggcatcgacgccgtctctcaagctcatgcttccattaattccataaggcttgtcagtcttaagcttcttgacaccactagcttgaactctgaaggaagaagaagacctagcaagtgatggcagtcctttcactgctgtcttctcaacactgaaagctgcaggtttgaggctcattactgtgcttgccatttcctatactctcttttcttcctgtaaatgtccccggccgtaatggc

SEQ ID NO: 99 - DNA, 593 bp, Nicotiana benthamiana
tttaaaaagccacacttattttatttattatattgaaatagtacagtacatgaagagtacactatagaacaccagtactctatttattaattcttggggcaacttattctgaatcttccataatagtcccatagaactatttaattaacccatgctgggagtatctcgaacaatgagtttccagttaacaacaacaaaaactcgaccacaaacataattaagtggcctaaccataccagggaacaaaaactgaactttggctatgggattttctttctcaattattctcttagcagtcgccgctggctttcccacaagttcaggccatgattgctttcctgggcaaattattgagagagagggatcatcaagtgtttccacttggttttcttttgccattgggaattgcaagacttctattccgtcacttacttcgaatactagatctcttgccgtaagaggttgaaaaagcgatgcaaggagcaagaaagcaactacatgagataacttgaacatagtcttcccttccattgcctttgctttgaaaaatacaaagaaagaaaatccaaactgtattccccggccgtaatggc

SEQ ID NO: 100 - DNA, 532 bp, Nicotiana benthamiana
catacattgtgtacttgctaaacatgaaaattgaaaatctgtatctcgctgatacgtgttatcccgctcaaagtagagattgacaatgacctttcatcaacagtgacataagtcattcctttcgaacctaatacttggagacattcagacataataaccagtaatcgtgaaccctcgtcctatgatctccccagcacaaaaccaagcaaaacattcaaggccaaaaagagcagcaatgccagcatcctcgattttcagctcctgtttgtgcttccacaagtgcttgacatcaagttccttccagaatgcttgatagcggcaaggaatactagctaagcgagtgtagaatacttgttttgccaaatgctggcatttctccacagtaggtggctcttgaatatattgcttgttctgttccaacgtctgcttgtagtatgcacatccatgcttggtcaagaattttgaaacttcaacagcctttgctttcactataggtagttttgaagccatagttccctaatcaacacataat

SEQ ID NO: 101 - DNA, 545 bp, Nicotiana benthamiana
gacagctgacatctgtattatgagtagcaatacgtgtaaatttgtaatacaaaatcttcaaaatgttatgatccagttacttctgaatccagtttcatacaaactttcacaacctgtaccataatgaattgtattgtccttttttcacttcttatgtaaaccttgttagcagaagaggttctttgctaaaaggacccttagtgactataaatgttggaacctctaaaattcagaatataaacgaactaaacgcagggacgtaaatgatgtctccaagcgccaatctctttgctttttgcttaaaggtttacctttccctgctttttctctattcactctaacatctgctatgccccaaatacaagcattagtttccaaattgtaggagacgagcctgagaacaccatcatgttcagatgatgatccaccctcagccacttcatcactaacatattttacatacataggacgatccttgaaccgttcgagatcttggggaatccgaataactctctcaacaccaggtgatgatacctcaagagata

SEQ ID NO: 102 - DNA, 669 bp, Nicotiana benthamiana
gccattacggccgggggccaaacgttaggtaagattgttgggtgatgaactggaacggcgttgtcaactgcagatgaattccaataacgtcgtcattacttttgtcgaccagcaaagccattagtttttatggtatttaatttgttgtttccttttcttttccatcgaataaactggccataggaatgaattcaagtaccggttggatgacatggagcccaagttcagctttcctaccaatatccatgggttctagctgtaataatagcaggatttcctgtcatacactttggaatatggcgagaaggagaagggtgtatataacggtgaataccaagaagagaagcgaaccagttttcaagccttccgttgttgaaaaagtttctttggttgatgaggctgaggatgagcttcttcttgaagatgaggacctggtggatgatgatgatggggtctttgaagagtattttgaggaagacgccgagctttgtgttggggatggatcgggaggaggagggatctctctggctgggacatcatgggacaaaagagcattagaacttgcagaagaagttgctctatcatttgatggagaattgggaatttatgcgtttaaaacattaaaaaatgccaacattcaagtacgagtggagagacttacaaataagt

SEQ ID NO: 103 - DNA, 578 bp, Artificial
  Synthetic
agatattaatatatgtgatcacacaatattacaattataagaaagataccaaatggaaacattacaaagtattgaaaaacaaaaccttttctttttaatctcaaatcatagaggaccggacgctcaactgcttcaatatagtttccagtgtggacccgtcacaagacctccaattattcatgtatgtttgataatgcaaaataaaattattataacctttcttttgtttgtttgttttaacattctggtgtttgggtatggtctcttttcggatcatggcaatagttatagaccaagaagttcctctgtgcccatgtcaatgccgccatctgctgccggctcaacccgcggttgcgcatgggtgcaggcgatggcggtctgcatgagctagagctatccgctgtgcatcccgctagcttaaagtttttgtacttagccacaaatggttggtatcgatagtcggctttgatccttccattttctgtggcccagtccgatgcatcccatatcgatccgtaaacccacatcggtcttgtggggaatatagcttcattctttcgcggccgcaattctcgagc

SEQ ID NO: 104 - DNA, 349 bp, Artificial
  Synthetic
cgcgcactactcaacctcaatggccgcctcaacaatggctctctcctcccctgccttcgccggtaaggccgtcaagctttcccccgcggcatctgaagtccttggaagcggccgtgtgacaatgaggaagactgttgccaagccaaagggcccatcaggcagcccatggtacggatctgaccgtgtcaagtacttgggtccattctctggcgaatcaccgagctaccttaccggagagttccccggagactacggatgggacaccgccggactttcagctgaccccgagacattcgcaaggaaccgtgaactagaagttatccacagcaggtgggccatgctcggagcc

SEQ ID NO: 105 - DNA, 1298 bp, Artificial
  Synthetic
tcgcgcgtcttggttgtaaacaccgacccttctatcgtgtagttgtcgccgatgaaaaatcgcgcagggacggtaaacaaatcgaggtgttaggcttttatgatccactccaaggcaaagaagatgcggatagagtgagcctcaaattcgacagaatcaagtactggttatctgttggagctcaaccaacagacacagtggaaagcatgcttttcagggccggtttgataccaccaaagcctatggtagtggtcggttcgaaaaatgggcagaagtctacgagccaacatgtttcacccattacaggtgaaatcttgaactaagagtgttgatgcgttgagcaagaaagagccttttgtgtctgtgtgaaaggagtttatgtaatgttgtttaagacttttctgtttatgtgaaaggagttaatgtaatgttgtttaagacttttgctttctatgtgaaagcagtttaatgttatgttggttaagacgcggccgcccgtattatacataaaatctcatgtatctttacatcaaacttcaaatctaaatacaaaaacaaaaagaacatcactagagatggatctctcgtcggacaaaaccccgaagtttcgtctttcacggtcaactttagtcaaactccgatccgaatcaaaccaaaaagggtttttcattcatcgatcatagtcatcatctcctttttagacaaaagattctcagcttctctggatcataaggaagagtctagagcaggagcgtcggatcccttcatgattctgagtctcttacaagaagaagagaacatgtcccatggaacatcaccaaccaacatccagtcaccatctttatcttcgtatgttggtacaaatccagatcctttgtatccttctctctcacaatattcaccaatcatgactttgaacatattctctaacgctttgagaagctcggggtagtttttgtatgtcttgagatcgatcttgcgaaggtaaggagctccgtccatactcactttcacgtagctcacactgttgttgttcttacgggaagatctcactggtggccaaccaacgatttgagttttggtaggaggtgtagattcttcttcatcacgagtttcctcaaatagacgcttgttgttacttttaacgcaagaaacctcttgttcttctttgatcttctctgttcttccgggtaatccaagacatagctctgtgtccttaaggttaagctcgttgcctttctcgtacgccattgcttttggatcaatatcaatctttgtggcggccgcaattctcgagc

SEQ ID NO: 106 - DNA, 165 bp, Nicotiana benthamiana
ggatatgctgattgagcaatacagatccaagttcactaacaacagttctaatcaaactgatagtaagcagcagggctctaaacagcttaaaaggtggttccaatcctaaatcaatagttcttctgtagcttaattttatttgatgataactgagtatcattttgg

SEQ ID NO: 107 - DNA, 614 bp, Nicotiana benthamiana
gccattacggccggggggaaactggtggatgcaatttgggaatgactatgtattgggatattggccaggctttttattttcatatttaacagacagtgcttcaatgattgaatggggtggggaagtggtgaattcagaatcagatggacttcacaccacaactcaaatggggagtggccattttccagatgaaggttttgggaaatcaagctatttcaggaatatacaagtagttgatggttcaaataatttgagagctcctcaagatcttgggatttatactgaggataacaattgctatgatgttcaactaggaaagaataatgactgggggaactacttttactatggtggacctggtagaaattctaattgtccatgaccaagattctaaatgttttttacttaattctttcactcttttaatgtagtaaaactggtaatgtacacattgagtcctttgtatggtcattgttttactctttgtaaaacttttgtttttaggggctaagttagtgcgcaacaaaatgtgtatcattgttggtctttgtgtgaaaagtttttcacctttctttttagacctccagtctctaaataaaaatattgttggggac

SEQ ID NO: 108 - DNA, 214 bp, Artificial
  Synthetic
aaaaatggcttcaagttccatagctcttttcttggctctcaatcttctctttttcacaacaatctccgcctgtggtagctgtactccgtgcggcggaggttgcccctctcccaagccaaagccaactcctaaaccaaccccaagccctagctctggctcgagcaagtgccctaaagacaccctcaagctcggtgtctgcgctaatgtgctcaac

SEQ ID NO: 109 - DNA, 621 bp, Artificial
  Synthetic
cgcagttgatgtcaccaagaaagccgaccctaaggctaaggctttgaaagctgcgaaagcagtgaaatctggccaaatcgttaaaaagcctgcgaagaagatcaggacaaaggttactttccacaggccaaagacattgaccgttcctagaaagcctaagtacccaaagatcagtgctactccaaggaacaaattggatcattaccagatcctcaagtaccctctcactactgaatctgccatgaaaaagattgaagacaacaacaccttagtcttcattgttgacatccgtgctgacaagaaaaagatcaaagatgctgtcaagaagatgtatgacattcagaccaagaaagtcaacaccctcattaggcccgatggaacaaagaaggcgtatgtgaggttgactcctgattatgatgctttggatgtggctaacaaaatcgggatcatctaatctgatcattgtcgctctgtgattttactttttctggtttttctcttccatagtctcagttttgctagagaagttaagatattactatcaccatctctttgttatgcttttatctttggattcaaaaagattatatgtttggtatttggcggccgcaattctcgagc

SEQ ID NO: 110 - DNA, 275 bp, Nicotiana benthamiana
gccattacggccggggatctgcttcaagattgtgcagcttgttgagtagccagaaatgatttaaagctaccttaagcttgacttcaattttggcaattattcgtcacactgcctaagaagaacctaaacttatccaggcctctggagtccaataagtagctccatttaagaggctttctatgtccaaatagtttgaaacagagtcagttgctatcttgtttatgttatgcccctgcaattatagcttgcttatatgagactggcttaatgatgcg

SEQ ID NO: 111 - DNA, 608 bp, Nicotiana benthamiana
gccattacggccgggcatattggtgggtggagaagggttgtgatgatgcagagtgggatgttcctttcgagagtaatgcttttcgtttttggattctattggattagcgaaacttattgccccattgatctcaatagcaactcaaataatgagcatggatcaaacgatcaggctgaagaacttgaaagaccaggggctattgtgtcaaatcgcatttcgtacttggatatcttgtatcacatgtcttcctcatttcctagctttgttgctaagagatcagtggctaagcttcctctggttggtctcatcagcaagtgccttggctgtgtctatgtccagcgagaatcgaaatcacctgactttaaaggtgtctcaggtgttgtaaatgaaaggattcatgaagctcaccagaacaaatctgcaccaatcatgctgctttttccagaagggacaaccacaaatggtgattttctccttccgttcaagtctggtgcatttctgtcaggagctccggtgcagcctgtgatattaagatatccattccagagattaagtcctgcgtgggactcgatatctggggttcgccatgtgattctccttctctgtca

SEQ ID NO: 112 - DNA, 403 bp, Nicotiana benthamiana
gccattacggccgggggtgtaggtttgaatgcttcccagtgttcctcttttattattgagggagaatcggggattatgcagatggaattacgttggggcagtaggctaattgtacatagtaggaaagaacgtaaaaattcttggaggttttactgaagtaccaagactcggatgcttcaaattccttatcttgcttctgcctcgaggatgagatgtatccgacttatgaaaggctacaagttatatgtacttaacagtgtagacaatatgagtgtaattgtttatttagtagtagtttgaaattgtagttcaacatcccatgtgaatgacgatctgagtttgtgaagcaaacagctcttatgtaagagatattttggctgcattaaaggccagttcggttact

SEQ ID NO: 113 - DNA, 1081 bp, Arabidopsis thaliana
gcagcgcgggcctgatctcagttgatctagcccgcgacttgctccaagttcatcccaattcaaatgcaatcatcgtcagcacggagatcataacgccaaattactatcaaggcaacgagagagccatgttgttacccaattgtctcttccgcatgggtgcggcagccatacacatgtcaaaccgccggtctgaccggtggcgagccaaatacaagctttcccacctcgtccggacacaccgtggcgctgacgacaagtctttctactgtgtctacgaacaggaagacaaagaaggacacgttggcatcaacttgtccaaagatctcatggccatcgccggtgaagccctcaaggcaaacatcaccacaataggtcctttggtcctaccggcgtcagaacaacttctcttcctcacgtccctaatcggacgtaaaatcttcaacccgaaatggaaaccatacataccggatttcaagctggccttcgaacacttttgcattcacgcaggaggcagagcggtgatcgacgagctccaaaagaatctacaactatcaggagaacacgttgaggcctcaagaatgacactacatcgttttggtaacacgtcatcttcatcgttatggtacgagcttagctacatcgagtctaaagggagaatgaggagaggcgatcgcgtttggcaaatcgcgtttgggagtggtttcaagtgtaactctgccgtgtggaagtgtaaccgtacgattaagacacctaaggacggaccatggtccgattgtatcgaccgttaccctgtctttattcccgaagttgtcaaactctaaactgaaaacgtctttgaacggtttagtaacggtttgattttgtgttacggtttaggtttatttggtctcgggatttggtttaaaggggattgagaaatgggaagttagagagaagaaaaagcaaagcataaatgtttgtatttaattgctctgcatatacttaaatctctgcttttcatttggggtattttttagtttctcgtgctgtaattaataacttgtggtgtactcaaataagaatatttctctctgttttatta

SEQ ID NO: 114 - DNA, 739 bp, Arabidopsis thaliana
cccacgcgtccgaaaatacaaatcgactttcatattttctctgcataagagagaaagaaaatgggatctcatgtcgcacaaaaacaacacgtagtttgcgttccttatccggctcaaggccacatcaacccaatgatgaaagtggctaaactcctttacgccaaaggcttccatattaccttcgtcaacaccgtctacaaccacaaccgtctcctccggtcccgtgggcctaacgccgttgacgggcttccttctttccggtttgagtccatccctgacggtctacccgagactgacgtggacgtcactcaggacatccctactctttgcgagtccacaatgaagcactgtctcgctccattcaaggagcttctccggcagatcaacgcaagggatgatgttcctcctgtgagctgtatcgtatccgacggttgtatgagcttcacacttgatgctgcggaggagctcggtgtcccggaggttcttttttggacaactagtgcttgtggcttcttggcttacctttactactatcgcttcatcgagaagggattatcaccaataaaagatgagagttacttaaccaaggaacacttggacacaaaaatagactggataccatcgatgaagaacctaagactaaaagacatccctagcttcatccgaacgactaatcctgacgacatcatgctcaactttatcatccgtgaggctgaccgagccaaacgcgcttcagcta

SEQ ID NO: 115 - DNA, 753 bp, Arabidopsis thaliana
tttttttttgggatgaataagaagatgtttatttgattatgagtaaatgagtaattaatttgggaaataaagaggttctttgtgagcaatggtctactcttgtgtgcttaaatcccttttttcttgaaatccatatttactagtctctactcccctaaaagaaccttattaacgagcatctcaaagttcaatttagaagaaccatgcttatgctccgtcgcttcattcgccaagcgccgccactcttccgccttctctctcatattctttcccttctcttcatccatcaactccctaaccaccgcctcaacctcttctctcttcacatctccaccaatctcaatcccaacctcccattcgtcacgagaaaacttacaattagtttgttgctctgcaaaaaacggccaacacaccattggaactccaccgcatagactttccaacgtcgagttccacccgcaatgcgtcaagaaccctccaatggccggatgagaaaggactttctcttgaggacaccaacttgccaacatcctccggtccgccgtagccgttaaaaactccggtggaaccattgcctcatccccggctactaaatccggccggatcacccacaaaaactctttccccgttgcagccaaaccccatgcaaactccacaagctgttttgcgctcaaaacagttatactcccgaagttaacgtacacaacactgtttctagctttcgtgtttagccagtccagacactcagtctcc

SEQ ID NO: 116 - DNA, 562 bp, Arabidopsis thaliana
cccacgcgtccgctcggtggagactattgatggaggaaacactattgtgaaaggtaaacatatcattgttgctactggctcggatgttaagtccttgcctggtattacgattgatgaaaagaagattgtttcgtcgactggagcgttgtctctatcggaagttccgaagaaattgattgttattggtgcggggtatattgggcttgagatgggttctgtttggggtaggcttggatctgaggttacggttgttgagtttgctggagatattgttccttcgatggatggtgaaattcgtaagcagtttcaacgttctcttgagaagcagaagatgaagttcatgctcaagactaaagttgtttctgtggattcctcctctgatggtgtgaagcttacagtggaaccggcagaaggaggagagcagtctattctggaagctgatgtggtacttgtctcagcgggaagaacaccgttcacttctggacttgatctggagaaaatcggagtggaaactgacaaagccgggaggattctggtgaatgatagattcttgagtaatgtc

SEQ ID NO: 117 - DNA, 476 bp, Arabidopsis thaliana
gcaggaagtatagttacgttagtctcattttcaagtagttcaatcgtcacttacgctttcaactttctgttcgaatggagcactcaaggaacgtttttcatattcgcgggtatcggtggagcagcgttgctttttatatggttgctcgttccagaaacgaaaggattatcactcgaagaaatacaagtttcacttattcatcagcccgatgaaagaaatcaaacttaatttgaattattttattttattataaaaatgatcaaattcagtttatggtgttatatttgtttatttacaaacaaggattttttttttcattatgtaattactactttatttttctgggtaattagccccatttttatgatgtatatttacgagatgtaaaacttggcctacgtacatgtgtattttatctctaaaattgcaaatgtaatatttttcggacatatattaaagaagagattgatttcaaa

SEQ ID NO: 118 - DNA, 802 bp, Arabidopsis thaliana
cccacgcgtccgcctttgggcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctcccattttaaaaattattaaaccgattctttaccacataaa

SEQ ID NO: 119 - DNA, 507 bp, Nicotiana benthamiana
atttcccttccttgcaaacagtagggccaaggcaattgatgatgctgagggaattgtaaaagtacttgctgagaaggagactgacaaaatcttgggtgttcatattatgtcaccaaatgcaggggagcttattcacgaggctgtcctggctttgcattatggagcatcaagtgaggacattgctcgtacatgccatgcacatccaacaatgagtgaggctctgaaagaagcagccatggccacttacgacaagcccattcacatataaaaatagtgtcatatatttgtttttgtttttcctctgagtatcttgaatacttagagcatattttctaattgccacctcatcactcaagtatctcttgaacagatatttcctccctcttctctaattatccaaagtacttccaacttaatgtttctgttctgcatattcatatctgtaataaagtcaggagctgtatgtcaaagtttaaatgccatcgatttgagtttcattgagttttg

SEQ ID NO: 120 - DNA, 634 bp, Nicotiana benthamiana
atgaacctgtataaaaaaatctccgttgctgaattttctggcccaccttggatgtcttttggcgctatgaagttaattactcgccttttggatccaaatcctatgacacgtattaccgtcccagaaattttggaggatgagtggttcaagaaagattataaacctcctgtttttgatgagaaaaaagatgccaacctggatgatgttgaagctgtattcaaggattctgaagaatatcatgtaacagagaaaaaagaagagcagccaactcctatgaatgcatttgagttgatctcaatgtcaagaggactcaaccttgggaatctcttcgatgaacaggaatttaagagagaaacaaggttcacatctaaatgctcggccaatgaaataatcagtaagattgaagaagctgcaaagccccttggttttgatgttcacaaaaagaattacaagatgaggctggaaaatgttaaagctggaagaaaagggaaccttaatgttgccactgaggtatttcaagtcgccccttctcttcatatggttgaagtgcgaaaagcaaaaggagatactttggaattccacaagttttacaagaatctttcaactagtctagaggatgtagtgtggaaaactg

SEQ ID NO: 121 - DNA, 632 bp, Nicotiana benthamiana
cttacattggtagatgtctactcaacactaagatcacgggtgatgatgctcctggtgaaacttggcacatggtcttcagcactgagggagaggtcccatacagagaaggacaatccattggtgtgattgctgatggtgttgatgccaatgggaagcctcataagctcagattatactccattgctagcagtgcccttggtgacttcggcgactccaaaaccgtttctctgtgtgtcaaaaggcttatctacaccaatgacaaaggggaagaagttaaaggagtttgctcaaacttcttatgtgacttgaagcctggagcagaggtcaagattactggacctgttgggaaagaaatgctcatgcctaaggatccaaatgccaccattgttatgcttgcaactggaactggaattgctcctttccgttcattcttgtggaaaatgttctttgagaaacatgaggattacaagttcaacggtttggcatggcttttcttgggtgttcccaccagcagctcgctactttacaaagaggagttcgagaaaatgaaggagaaggccccagaaaactttagactggactttgcagtgagcagagagcaaacaaacgaaaaaggcgaaaagatgtacatc

SEQ ID NO: 122 - DNA, 640 bp, Nicotiana benthamiana
cccacgcgtccgatctcttctattcataagttgtaaattcttattattgggattttttccctttttaattcaatccaagaattgagtaggactaatggcatccaggagaattcacaaggaactaagggagttgcaaagagaccctcctacttcatgcagtgcaggtccggtggcacaggatatgttccattggcaagcaaccattataggtccaaatgacagcccttatgcaggtggtgttttccaagtggccatccattttcctcctgattaccctttcaaacctcccaaggtggctttcaagaccaaagttttccatccaaatataaataataatggaaatatttgtttggacattcttaaggatcaatggagtcctgccctcaccatatcaaaggttttgctttccatatgttcactactaacagatccaaatccagatgatccattggttccagaaattgctcatatgtacaaatctgatcggaagaaatatgaatcaatggctcgtaattggacccaaaagtttgctatgaattgagttgttgtattcatataaagctcatgtgctataatttgtaacaaaagatcaatgattttctcctccgcaggcatgtaataaaagcacaaaattataaca

SEQ ID NO: 123 - DNA, 541 bp, Nicotiana benthamiana
gccattacggccgggatccttctgctcttcatttttggggtgctgactgctgcctagggttttagttctctattcttcaccaagatgaatgtagaaaagctacggaaaatggccggttcggtcaggactggtggtaagggaaccatgcgaagaaagaagaaggccgttcacaagacaactacaactgatgacaagagacttcaaagcaccctaaaaagaataggggtgaatgctattcctgctattgaagaggttaacatttttaaggaggatgtagttatccaattcatgaaccccaaagttcaagcctctattgctgcaaacacttgggttgttagtggttcccctcagaccaagaagttgcaggatattcttcctcaaattattcaccagttgggccctgataatttggagaatttgaagaagctagcggagcagttccagaagcaggcgcctaccggtgcgcctgaaggtggtgctgcagcacaggaggacgatgatgatgaggtgccggaacctgtggctggccaaacctttgaag

SEQ ID NO: 124 - DNA, 363 bp, Nicotiana benthamiana
gccattacggccggggatcccagataacatccctagggtattccttaaactccccatcttctcttcgcactctggcttgagacctatagccatgactgtgaccagcggcgatttcatcaatatttatcccacacagctcaaattcccattggacctgaggaaccggagtgcatgttctttgcagttaagtaccaggactgatcaatacattgcattcaaggctaagacgaccaaccccaagacgtactgtgttaggcctaatgcaggtgttgttttgcctggttcttccatgcaatgacacagttacaatgcaagcacagaaagaggtacctcctgatatgcagtgcaaggataagttcctaa

SEQ ID NO: 125 - DNA, 199 bp, Nicotiana benthamiana
aactttggtttgagacctatagccatgactatgagcagcggtgacttcatcaatatttatcccacagagctcaaattcccatttgagctgaggaagcagagtgcatgttctttgcaattaagtaacaagactgatcaatacattgcattcatgggtaagacgaccaaccccaagaagtactgtgttaggcctaatgcag

SEQ ID NO: 126 - DNA, 135 bp, Nicotiana benthamiana
gccattacggccggggcaccagaatagcacggcgtgcaaataagaattcattttacagatgtcaaagtgaaagacccttcactgtgtaatcaaatcttgatgtctttcttccaacctaattaccctgagttgggt

SEQ ID NO: 127 - DNA, 468 bp, Nicotiana benthamiana
gccattacggccgggggcgttggaaataagaagcgtagggtaataaaggaagaaaagtatgctgctcgaagggctatcttgcccatgcttcaagctgaagaggatgaaagattcgttaaagagtggaagaagtatcttgaagaagaggctagaatcatgaaggatgttcccggttggaaagttggtgaaagtgtttacaactctggaaaatggatgcctccagcaaccggagagcttcgtcctgatgtctggtaatatgttggcaggagacaacgaaaactgctttgtttcagtggagttcatacttacctttggatttctttcctcattggaataaaatgtatctgcaaaatctgtacacatgtttagaatgaagttacatgatttgctttaacgcggttagcgttctccctcctatctcatggaagttcagataatcagagacaatgctagttccatgttctctta

SEQ ID NO: 128 - DNA, 293 bp, Nicotiana benthamiana
gccattacggccggggaataaattggtagttggtgttactgttcgctgagggaccagatccagagttcaacgactgcatcgcccctcgccttttagtgtcaaaattctctattttctgactgttgctggtctttaagagtagtttgtattgcattacctgcgcatcacaatccccccatctttatttcgccttttctattgttgtatactgggggttggtaagagctagttggatgtgtgttttctctgttttgttttaattcttacacggataaatatttgggttctccatt

SEQ ID NO: 129 - DNA, 641 bp, Artificial
  Synthetic
cccacgcgtgcgcacaaattcacaaccgcaaaaaatcctctcccggcttaaaaacgagtgataaagaggtgtaacaaaacatggcgtatgaaccgatgaagcccacgaaagctggtttggaggctcctctggagcagattcataagatcaggatcactctctcttcaaaaaatgtgaagaacttggaaaaagtgtgcactgatttggtccgtggagctaaggataagagacttagagttaagggaccagtgagaatgcccactaaggttcttaagatcactaccagaaaggcaccttgtggtgaaggtaccaatacttgggacaggtttgagctcagggttcacaagcgtgtcatcgatctcttcagctcccctgacgttgttaagcaaatcacgtctatcaccattgagcccggtgttgaggtcgaggtcactattgctgactcttagacacttgttccaaaaccgcttcaaaagaatgtattttatcgtttctggtcctacatttttgtttgcaaccttgtttcttgggttttgatagttctgaggtggtttttgtctatcgaatttttttcatctataagagaccttaatgaaccaaaaaaaaaaaacccaaaaagggcggccgcaccctaggccagt

SEQ ID NO: 130 - DNA, 809 bp, Artificial
  Synthetic
cccacgcgtccgtcatcttcttcttcactcgcctcaatttttgttcccttcttcttctataattcaactgtgaatttcaccgacgaaacaaaaaagagagagagagagagagaaacgatgagttctcagatttcggagattgaacaagagcagctgatcgagaagcttgagatcttcaagatccatggcagagacaaacgtggccgtaagatccttcgtattatcggaaaattcttcccagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttcaggaggtttacttcctccatccaggtcttcaatcacgtctcttcctcgccacctgcggccgatttctattttccggcgggttgtacgggaagctgaggtacataagcagagttgattatctgtgggaacatgtgaggaggaatgagatagagatgccggagtttgtatacgatcacgatgatgatctggagtatcgtccgatgatggattacggtcaagaaagcgatcacgcgagggttttcgccggagccgccgtggattcatcagtctcaagtttctccatgaggtgtatctcatagcgtaaaaggctaaaactccacccactagatatcggatcgtatcttataaaccatataatatacgaatacgattaataatatat

SEQ ID NO: 131 - DNA, 638 bp, Artificial
  Synthetic
cccacgcgtccgcgtttcctaagatcaagaagccttgtcccccaatttacaaaccaccggtggtgatccctaagaagccgtgtccaccaaagattgcacataaacccatctacaagccgccggttcccatctacaagcctccagtgcctatctacaagccaccagtggttatccccaagaaaccgtgtccaccaaagatacacaagcccatctacaagccacccgtgcctatctacaagcctccagtggtgatcccaaagaagacatttcctccacttcacaagccgatctacaagcacccggttcctatctacaaaccaatcttcaagccgccagtggtggtgattccaaagaaaccatgtccaccacttcccaagtttccacacttcccacctaaatacattccacaccctaagttcggaaaatggcctcctttcccttctcatccttgataaagatgcaaaatcctctgtctttcttaatttaagaaaagtgatcgagtgatgccacaaaagaatgttcctttgttgctttgttgaattctacgtagatgtttcatgtttatgtatcgtaaattccagccaatcatatttgtaattttttaccgttaaaataaatctgtaatctcgtttctgttg

SEQ ID NO: 132 - DNA, 1160 bp, Artificial
  Synthetic
cccacgcgtccggagagagagagagagagagaaagaaagatccaacttccacaaagaaccatggaagctgagaaagaaacagaacaagaaggaaacttgacagtaatgaaacttccggtgttaccaactaaacccaacactcacagccactctatgtcatcaccaattcacagttccatatcagcttcagttccctttagctgggaagaagagcctggcaagcccaagcaacactctacttcttcttcctcctcttcctcttcctcaccattaacttcttattcttcatctccttttgaaactcacaagtccttagagctaccaccaaggcttcacttacttgaaaaagatggaggatcagtaaccaaacttcactcgcctataacagtctttgatggaccttatagcatgacgacatcaaaaaggatggattcaccttcctttaggatgatggtgaaaggtagtgctgattgttatgggtctttcaggagtgatatcgatggtgatttagaggatttggaagtgggctctaagcagcaggagaacttgagtagtggctctttggctgttgtgaagaagagagggagattagggttttttgggtttaggaggaggagagcattgaaagggaaaacagagtttggtagaggtagttatgtgttcccatcttctgtagacagagagagtgaatacagtagaaaggaagaggaagaagaaaaagaagacaaaaggtttggttatgatgatactgatggtattagttgcagccaaagcagcaggttttgtgatgtgaagatctcaagcattagtagaacaggcagcttctctactctgcctgcaccaccttcttcttcttcaaagtctcacttttggacgaatgtgtatgcaggactaaagcaagtggttccatggaagagcaagaagactacagtttgagattctgccatatcaaagattcgaaagataaaacaccaagtaacaagaaagcttctatggtttctacaagtatttttaagcttttgtttatgatttttttcaatatttccaagaaaatgacacgactagtaaaaccattgtgaaacccagttttttttcacgcttgttgttgtgtttgaatgtttttgagacttttgtaaagagaaacagagaatcttacgatg

SEQ ID NO: 133 - DNA, 750 bp, Artificial
  Synthetic
cccacgcgtccgccgcagctgaagaatttcgaaggtttattttcaaccgaagtccgacctagtaaaggttcaggggtacaagccttcgcctctcgtgcatttgatgcttcatttagctggaaggacattgaatggttaagatctattacagagttacctattctggtcaaagggatactcacccgagaagacgctcttaaggctgttgaagctggtgtagatggaataattgtatctaaccatgggggtcgccagctcgactattcccctgctacaataactgttttagaagaggttgttcaagttgttagaggtaggattccggttttgcttgatggaggagtaagacgagggacagatgttttcaaagccctggcacttggagcacaagctgttcttatagggaggcctatgatctatgggcttgcagctaagggtgaagatggagtgaaaaaagtgattgatatgttaaagaatgagtttgagattactatggctctttctggttgtccaaccattgatgacataaccagaaaccatgttaggacagagaatgagagacttcactctatgctctgatccaaaaaaaccaacagatatggtttgagaaacttaatcagacagctgaagaaccgtggcaaccagcagccatgttagaagaacaaggactgaagcatggattcaattcaacactcatcttttgaaaagtacatatgataaacatattgaatgcttgtctgacacaatgat

SEQ ID NO: 134 - DNA, 1013 bp, Artificial
  Synthetic
cccacgcgtccgagcaaagagaaacaaacaatggcggcttctctgcaatcagcaaaccctacattgtcacgaaccctagcttctccgaacaaaccttcctccttcgccaccttccgatctccatttctcagattcaattcaacatccgtcgcttccaatttcaaacccctagtttctcgagaagcatcctcatcgttcgtcactcgctccgccgccgagccacaagaaagaaaaaccttccatggactgtgctatgtcgtcggcgacaacatcgacactgaccaaatcattcccgcggagtttctcactctcgtcccttcgaatccagaggaatacgagaaactcggttcttacgctttagttggtcttccagcttcttacaaggaacgattcgttcagccaggtgagatgaagacgaagtactcaatcatcattggcggtgaaaactttggatgtggatcgtcacgtgaacatgctccggtttgtttaggagcagcgggagctaaagcagtggtggctcagtcttatgctagaatctttttcaggaactctgttgctactggtgaggtttatcctttggattctgaagttagggtttgtgatgagtgtacaactggtgatgttgcgactgttgagttgagggaaggagatagtattttgatcaatcatacgactgggaaagagtataagcttaagccgattggtgatgctggaccagtgattgatgctggtggtatatttgcttatgctaggaaagctggaatgattccatctgctgctgcttgattttgacttcaggtgtcaatggaagtgcatgagagtcacttcaaggatcttgatccaataataagaatatgtaatgtttccaaaagcttatgaacctaatctatgttttatgaatatatatgactatcggctttagtcttcagtatcagtttcttgtttacatttggatgtatcagctgctaaaaaaatgcatagtttcccatcccatttgaaacgccgttttctct

SEQ ID NO: 135 - DNA, 607 bp, Artificial
  Synthetic
cccacgcgtccgcgatttcagccaagagatgtcggcatacgacaatgttattggtgggaagctaaagctaaaagggaaggctttggatgtgaaagcaggtggagtaaagaagaagaagaaacataagagacaggaagaacaagctcttaaaattactgatcatgaactcatagaaggagaaagcactgaagcattgggtaaattgattgaaggagaagaaggagatgaagaaatgaacaggagtgaaaaggcaagcgaggatgcgaagttgcagcagcagctcgatgatgatgatcacttaacgccagcagaaaggcgatacatagagcagaaacaaagattggatgtgcagaagctagctaaggaagcgaacaagtctcaccgtaacaggattgaggatttcaatcagtatctggctaacatgagtgagcactacgatatccctaaagtcggacctggttaatataattctttcttgtctttgttttactctgcttatctattttgcatcgttaaacgactactttggatgtctgttatgtttagtccctttaacttttgaatgatgtgatcgcaaatctgtaatgtcaaaaacacattttcttgg

SEQ ID NO: 136 - DNA, 1120 bp, Artificial
  Synthetic
cccacgcgtccggtcttcttcttcttctgataactagatttttcaatcttctgaagctttaattttttcatagccatggctaatcgttatgatccaaatcctttcgctgaggaagaagaagtcaatcctttcgctaatgctagaggagttccacctgcgtcgaattcgagactttcgcctttgcctccagagcctgttggtttcgattatggtcgaaccgtagacattcctcttgacagagctggtacacaggatttgaagaagaaagagaaggaactccaagccaaagaagctgagctaaaacgacgagagcaggacctcaaacggaaagaagatgctgctgcacgagctggaatcgttatcgaagtgaaaaactggccgcctttcttcccgcttatccaccatgatattgcaaatgaaattccggttcatctccaaagactacagtatgttacctttgcaacgtatttggggttggttctttgtcttttctggaatatcatcgccgttactacagcttggatcaaaggagaaggagtgacgatatggcttcttgccttaatttacttcatagcgggtgttccaggaggctatgtgttatggtatcgaccactctaccgtgccttcagaactgatagtgcattgagctttggatggtttttcttgttctatatgctccacattgctttctgcgtctttgctgcagttgctccacctgtcgtcttcaaaggaaaatctcttgctgggatcttacctgcaatagatgtcttaagcggtcaagcaattgttgggatattctacttcattgggtttgcatttttctgcctcgaatcagtggttagcatctgggttatacagcaagtgtatatgtacttccgaggcagcgggaaacaagatcaaatgagacgggaagcagcgagaggagccttgagagccgctgtttgagagttctccttgtaacattctggtttgtgtatgcactgtttcttttttcagattttcttgaagtctctctctctctctctctctctgctctataaacaaaaaaaaaaagatttaatttttcctttgtacctttatgtcatgtaaatttgtttgttcaaaaatcagcgttcagatt

SEQ ID NO: 137 - DNA, 909 bp, Artificial
  Synthetic
cccacgcgtccgaaaaagcctgcttgatagtatgactgacattgatccatcagtttatgccaacttcttttgggtctcttctcagtaccataaagtccgtcaagagttctctgagttctataaaaatgctcttctttacctcgcttatacgtctgtggactcactctcggaatcatttaagctggatttggcttttgatttgtcgctttcagctctacttggggagaatatctataactttggggaactgttagcccatccaattttgaaaagtctgcttggaacaaatgtggaatggctttaccacattctacaagcattcaaccacggagatttagttcagtaccaagaactctgtcgtgtgcacaatgcatcgttgagtgctcaaccagcactggttgagaatgagaagaaactattagagaagatcaacattctctgccttattgagatcattttcagccgacctgctgaagataggaccatacctttgagtgtcattgccgagcgtactaaactttcaatcgaagatgttgagcaccttctcatgaagagcttatcggtgcacttgatagagggaatactagatcaggtgaatggaacagtttacgtctcatgggcgcaaccgagggtgttaggaataccgcagatcaagtcattgagggatcagctagacagctgggtcgataaggttcacaccacattgttatctgttgaggccgagacacctgatcttgttgcagcttaaactcttctttcctcttttttccttcactgttcgtttaagctacagattgtaacattctctgaggattaaatgcaacttccttttaagtttttaggtattacagttatacttttgaactttgttctccacagacacatgaatctatcctattaagttgagtt

SEQ ID NO: 138 - DNA, 722 bp, Artificial
  Synthetic
cccacgcgtccgcatttcttgttattatccacgaacgaagaaaaacctagaaaacagttgaagaaagaaaatcacaagagaagccatggccggaattggaccgattactcaggattgggaaccagttgtgatccgcaagagagctcctaacgctgcagctaagcgcgacgagaagactgtcaacgccgctcgtcgaagcggcgccgatattgagaccgttcgaaaattcaatgctggatcgaacaaggctgcatcaagcggcacctccttgaacacaaagaagctagatgatgatactgagaacttatctcatgatcgtgtgcccactgaattgaagaaagccatcatgcaagctagaggggagaagaagctgactcagtcccaacttgcccatctgatcaatgagaagccacaagtgatccaagaatacgagtctgggaaagcaattccgaatcaacagatcctttcaaagctggagagggcacttggtgctaaactccgtggaaagaagtagaagtgtagaacaaagctcttaaaggtaacaacaaaagctgatcgcagtttctctccagtccacatgctttaccatatcctaaaaactatatctatgtatggtttggtttaatggcgtagtagtttgttgcgaggaatctttcatgatgtaagaaaaacaaagctgtttggaaccttttgtcattataaataatctcttctctttcttt

SEQ ID NO: 139 - DNA, 695 bp, Artificial
  Synthetic
cccacgcgtccgcgcagcttttgcttcttcgatagaaaatctaattatcatcaatcatgtctaagttcacgggattctcatctctcgctatctcttattttctcttggtttcaacgattgttgcagccaccgatgttcactactgcgataataacgaagagtatgaagtaaaagtacaaggagttgatataactccttatcctatagctagaggcgagccagctactttcagaatttctgctaacacagacactgagatctcgagcggcaagttggtgatcgaagtttcctactttggatggcatattcattctgagacacatgatctttgtgatgagacaagttgtcctgtggccattggagatttcttggtagcgcactcgcaagttcttcccggatatacccctcctggttcatactcactaaaaatgaagatgcttgatggacgcaagaaggagttaacttgcatcaagttctcatttgatattggatttggatcctccgtggccgacatgtagagctgatttgctcgacgggatacaccatcttgttctataccatggaaccactctcatttattttgtataaaatacactctcctgctatacataattgttgatcaaaaaccctttgaaaattctcattctggaccattcatgaatccccccatttatagaaaaaacacagtaatgaat

SEQ ID NO: 140 - DNA, 639 bp, Nicotiana benthamiana
aattcacagggacatcaaggcttcaaacattttgttgagtgaggaatatgagccacagatatcagattttgggctagcaaaatggcttccatcacaatggacccatcattccattgttccaattgaagggacttttgggcacttagcaccagaatatttcatgcatggagtggttgatgaaaagacagatgtttttgcatttggggtgttctgcttggagctcatttctgggaaaaaaccagttgacaattcccatcaaagcatacacagctgggcaaaacctcttttgagcagaggagttatagaagaagtagtagatccaaggctagaaggcagatttgattcgacacaacttcataaacttgcttttgctgcttcactttgcattcgtgcttcttctatatggcgcccaaccatgaatgaggtgagagcttcaacagattatatacacactgtgtgacaattaatttcattgaaattaactacaatgttttttctttatctacaacattctcgtttctcatcgacgttcatggcattcatgaacttgcatttgatccagtctcaaacttcttgatgcttggtatctagttttacagtgttcgcgaacatagttctgaatttatatgtgattgcatg

SEQ ID NO: 141 - DNA, 492 bp, Nicotiana benthamiana
  misc_feature (492)..(492): The residue at this position can be any nucleotide.
cccacgcgtccgcttcgattgtgttgggaagatggaactcaagcaatgcaagtcaaccgtctccctcaaactgagggtttctttcagcctctaggattgacttcttctcctcaatttggatacaatcatgtgggtacggatgaggtgaatggaggagcttcagctcataatatgaatgggtttattccagggtggatgctgtaaatctgataaatcaagacagctgctccatcttgcttcaacgaaataaaataatagtatattgcattttctttttgtttgttgcaacttgtatttagaaactctttaagtattattgggcacggacaataatatgcattcataagttactataacatttgaatggtcctgcttgattggccattatgtatttctgattgtattccatgtaactaaattgaattgttgtattatattagttgtatctttgaatcatatagatgtgttggctttgtacgccataaatttcan

SEQ ID NO: 142 - DNA, 597 bp, Nicotiana benthamiana
ctctctctctctttatccgtcctccggcgacccttttactgcggtcaaactccgccggaaaatcttaaattcttgttttattgacggcttacttgcttgtaccttcatctcgcttcaccgatcttgcacttcacattaatcatcatgaatcccgaatacgactatcttttcaagcttttgcttattggagattctggtgttggcaaatcgtgtctcctcttaagatttgctgatgactcatatcttgagagttacattagtactattggtgtggactttaaaatccgcacagttgagcaggatgggaaaaccattaaacttcaaatttgggatactgctggtcaagaacgttttaggacaattaccagcagctactatcgcggtgctcacggcataattgttgtctatgacgtaactgatcaagatagtttcaataacgtcaagcaatggttgagtgaaattgatcgatatgcaagtgataatgtgaacaaacttcttgtcggaaataagtgcgatctcacagcgcaaaaggtagtttccacagagacagctcaggcttttgctgatgagatcggcattcctttcatggaaactagt

SEQ ID NO: 143 - DNA, 452 bp, Nicotiana benthamiana
aacactaaaatatttaaacttgccctttaaatcatttcgatgaaggtccaaaaaataaaaagcaattactatttttccccaattttcctaaatttcctactaatcgtttatccaaatacttggcaaaaaattgattttttggacagagtgccgaaaaaaattaaaatgtgataacagggaacagtcttcctatcaacccattaaaagagactatttttacttgccacatcaaaatcgtcattggggcgataaagcttcgcccttgtcctttaaaaatgaccagcaaccgctcttctggttgacaggttgtccgcggttctgcacagttggaggccgggcattgttggatgctggtgggcttgccattctgtccttgatggaaccacccatacccatgaaagcctgtcccacatggggggcattttccgcactatttcccatgaaaggaatgc

SEQ ID NO: 144 - DNA, 587 bp, Nicotiana benthamiana
cgcttttgtctgcccctccttaccctttcttcaatatggatggttctcactggccacagggcataggactagtgaaagctgtggaaccctcaaaaccagtgccagcaacagaacgaaagccaagaccacaaaaggaacaagcaataaattgtccaagatgcaattcaacaaacacaaaattctgttattacaacaattatagcctctctcaaccaaggtatttttgcaaaacttgtagaaggtattggactgaaggtggttctttaagaaatgttcctgttggtggtggttcaagaaaaaacaaaagatcaaattcctctaataattcttcatcctccacatcatcatataagaaaattccagatatcacaattccaacttcttctcaaaaccctaaaataataaacgaaccccatgatctcaatttaacgtttaacccatctactactagcaatttcagtaatatttctgagtttatgaccttacctttaatgaaccctaattccacaacttcatttatgtcctctattatgccacagctttcggattctaataatattatgtactcatcatcttcaactaggcta

SEQ ID NO: 145 - DNA, 524 bp, Nicotiana benthamiana
atttatcagatgatggttcacaagcaggagaaaagaaaagaagacttaatatggaacaagtaaaaactcttgagaagaattttgagttaggaaacaaacttgaacctgagagaaaaatgcaattggctagagctctaggcttacaaccaaggcaaattgcaatttggttccaaaatagaagagcaagatggaaaacaaagcaattggagaaagattatgaaattcttaaaagacaatttgaagctattaaagctgaaaatgatgctctccaatctcagaaccaaaaacttcatgcagaggtatgacaccaaaaaaataatcaaaatgtagtactaattatttaattataagcttttcttgttatgtaggaaataaaataatgttgcactttaatgatgtctctttctttttttggttgttaaaaattcaagaagattatgctattttggtgaaatagtaaacctttcttctctgctagttgtattttcagaaccatgatatgtatttggtgcatgatttcgcca

SEQ ID NO: 146 - DNA, 533 bp, Nicotiana benthamiana
gaggccgttaacaagatgcgggaggttgaggggaagcttttatctgtggatacctattattcaggcgttgcttcagaagcagtcaagaatggagttcatcttgtaaacgatgtatctggtggacggttggattccaacatgcacagtgtcattgcagcacttcgagtaccctttatagcaatgcatatgagaggtgatccgtcttcaatgcaaaatcccaagaacttgcagtacaacgatgtctataaggatgtggcatttgaactttatgagaggctcaaggaagcagagttagccggtatccctgcttggaggctaatacttgatccaggaatcggattctccaaaaatactgaacacaatttggatattctaacgggtttgccaacaattcgaagtgagattgcaaggaggaacttggcgttgtctcgtgcacctttcttgattggaccgtccagaaagagattcctaggcgaagtctgtgctcgccctgctgcagatgaacgagatccagcaactgttgcagctgtgac

SEQ ID NO: 147 - DNA, 626 bp, Nicotiana benthamiana
tctctttcttttcccttctacagtctgaagggtcaattattgctcatagagaagaactgttgaacagacttttggaaccaaaaaaagaaaaaaaaatcactctttgaggttgttgcttttttaaccgttaattcggggttgccaagatgatgatgtttgaagaaatggggttctgtggcgatcttgatttcttccctgctccgctaaaggaagtggaaacagctgcttcgcagatcgagcaggagcaggagccggtgatggatgatgattatagcgatgaggagattgatgtggatgagctggagaggagaatgtggagggacaagatgaagctgaaaaggctgaaagaaatgactaaggggggtaaggaaggtgtcgacgctgtcaaacaacgccaatctcaggagcaagctaggaggaagaagatgtcgagggcacaagacgggatcttgaagtacatgttgaagatgatggaggtgtgtaaagctcagggctttgtttatgggattatcccggagaaagggaaaccggttaccggggcatcggataatctcagggagtggtggaaggataaagtgaggtttgatcgaaatggacctgcagccatagcaaagtaccaagctgat

SEQ ID NO: 148 - DNA, 571 bp, Nicotiana benthamiana
tgagattcattttagcacatcttggattgaagttgaaatgaggaatatacttgaggctcttcaaagttctgctcaaatattccatcactaagacaaataagtatggggacatagggtcaccttgtctcaatcccttttttgcttgaaatccttttgtgagtcccccattgatcagtatagagtagtttgcatttgttatacattccataattcactgaactagctttatagggatcccatactccaacaacaccatttgtaagaaagaccattcaacacaatcatatgcctttcttatatctactttgataatgcatctaggtgaaatcccttttttactatgccctttcaccaattcatgagcaaggataacattgtctagtatactttttgtaacactccttaaatttataaaagtttcaagatacgttgattataaaaataaattatttttatttttgcctatagtgatatatatacatacacacacacaaaaataggaaaaatattaataattttaatattattaatggttaacagtaagtataataagatattagttaacaaaaga

SEQ ID NO: 149 - DNA, 619 bp, Nicotiana benthamiana
attctcctcaaatcaaacatggctcttccaggtcagcaaggcgtggattatcccagttttaaacttgttattgttggcgatggtggaactggaaaaactacatttgtgaagaggcatcttactggtgaattcgaaaagaaatatgaacctaccattggagtggaggtgcatccattggatttcttcacaaactgtgggaagattaggttttactgctgggacactgctggtcaagagaaatttggtggccttagggatggatactacattcatggtcaatgtgctatcatcatgtttgatgtgacagcccgattgacatacaaaaatgtccccacatggcatagggatctttgccgtgtctgtgaaaatattcccattgttctttgcggaaacaaggttgatgtgaagaaccgtcaagttaaggctaagcaggttactttccaccggaagaagaatctgcaatactatgagatatcagcaaagagtaactacaactttgagaagcctttcctttaccttgccaggaaacttgccggggatcctaacttgcactttgtggagtctcctgccctcgctccccctgaagtacagatcgacttggctgcacaacaacaacatg

SEQ ID NO: 150 - DNA, 625 bp, Nicotiana benthamiana
tttgagatgaaggacataaaaagtgcggactccaactgtcgaggtgccaatgctgccgagggatcatcaattgcacgggtgaacatggtgcagccaacatgcagcaatgcagaatttgcagattctgggatgagctgcaagacggattctatcctttactttgctagacaatctagcctttcattttccaaccaaagtggagagagcaccgctggggatcaccaagactgtggagtctccccaatgctcctaatgggagagccgccaccgtggggtcctccttgccctgaaccttcgtcgccatcgactagtaggagcaatgctgtgttgcgctacaaggaaaagaagaaaacaaggaaatttgacaagcgagtgagatatgtttcccgcaaggcaagagctgatgtcagaaggcgtgtgaagggacggtttgtcaaggctggtgatgcttatgactatgatccactcccgaccagaagctattgattgtaaactttcttatcatacatgtaaagaaacaaattatccgtattaaattgagaccaaacatttgaggtttctttcaaatagatgaaagaaatgagatatttgttgttgcgaatgataaatggtatgattatgtctc

SEQ ID NO: 151 - DNA, 623 bp, Nicotiana benthamiana
tcatcttaaaaaaactaacacaaccaagaaagaaaaaaacgtgctaatggaagatcctcaagaaaaaagcaatattcatatgtatagaggagtaaggaagagaaaatgggggaaatgggtgtcggagatacgcgaaccggggaagaaaacacgaatatggctagggagttatgagacaccggagatggctgctgcagcctatgatgttgctgcatttcatctaaaaggcgagagagcaagactcaatttccccgaattaatccatagttttccaaaaccctcaagttctaagcctgaagatgtgcaaatgtcagctcatgaagcagcaatgaggttcaaaagacaaactccagagccacccgaggggggtggctgtggcggtggtggcacggtggttccggtgagggtaggtctatcgtcgagtcaaattcaggcgattaatgagtcgccattggactcacctaaaatgtggatggagctagctggggcattgttattacgagatccagttagagaatacacttgtccctcgtattcttttaccgatcctatggtattgtgtgaagacattgctgaggttggggagtgggatgaaatgcaacagaatcatgattccatttgga

SEQ ID NO: 152 - DNA, 273 bp, Nicotiana benthamiana
ctaaccttggcctcacttatcccattgttccaaggaattagggctgagtctaaatctggtgggattatgagtgctgatgccgaaatttggaatggaagatttgccatgctgggattagttgctttagcgtttactgaatatgttaaaggaggtggcatcttccaagtctgaaatgtaacttttatactagtacgttcttttatatctgatgtaaacaatgttatattgccatgtaaccacagcttataatttcaattataacttatatgatat

SEQ ID NO: 153 - DNA, 324 bp, Nicotiana benthamiana
cccacgcgtccggcgctctcttgcttctattgatgggattattcatatcaggcacaacaagaagtaccacaggctctagcaactatgtctctcactgatcaacatgataatcatctctacatggactctggtgctacttatcacatggtgcaatcttctggtactcttgtgaattcatctccatttgaaggaactaatcttgttatggtaggtaatggtgataaaatgttgattacacatataggagataagattattgggaagaacctacatttaaaatatttctttgttgtgcctaaactcaagaagaatctcatttctgtc

SEQ ID NO: 154 - DNA, 276 bp, Nicotiana benthamiana
caaaaatggggagagctccttgttgtgataaagctaatgtggggagaggaccatggtcaccagaagaagatgctaagcttaaggaattcatacaaaaatatggcactggtggtaattggattgctcttcctcaaaaagctggattaagaagatgtggaaagagctgtacattgagatggctgaattatctaaggcctactatcaaacatggtgatttttctgatgaggaagatagagttatatgccgcttgtatgccagcattggaagcacgtggt

SEQ ID NO: 155 - DNA, 652 bp, Nicotiana benthamiana
aatacctcaaactgagacaacatccaatcctactcttctactactactactactttttactctcttaagtatatcagtgatcaagaataatggatatatttagaagctattactcggacccacttgctgaatgttcatcaatttctgacaatggtggcagctcctgtaatagagctaacctttttgatgaggaagttatattagcttcgaataaccccaagaggcgcgcagggagaaagaagtttcgagaaactcgacacccagtatacaggggagtgaggaagaggaattcagacaagtgggtttgtgaagtgagagaaccaaacaagaaatcaagaatatggctgggcactttcccttcagcagaaatggcggctagagctcatgacgtggcggctattgcattaaagggccgttctgcttgcttgaacttcgctgactctgcttggaagttgccgattcctgcttccaccgacgccaaggatattcagaaagcggcggctgaggccgcggaggcattccgatcatcggaggccgaaaacatgccggaatactcaggagaagatacgaaggaagtgaacagtactcctgaaaatatgttttatatggatgaggaagcgctattttgcatgccgggattactagcgaatat

SEQ ID NO: 156 - DNA, 638 bp, Nicotiana benthamiana
caaaaacaaccagccccattttcttcttcactctgcttctccttactttcactccaaccccatctttctccattgaaaatgatatcaaatgtcttgaaggaatcaaatctgcactttctgaccctttcaataagctctcatcttggtctttttcaaacacatctgttgctgcttcaatttgcaaacttgttggtgtttcttgttggaatgagaaagaaaaccggctcatttctcttcagctcccttctatgtctctctccggttctctacctccttctcttcagtattgtacctctcttcaatcccttgatctctctggtaactccctttccggttcactcccggttcaactctgttcttggttgccttatcttgttaatcttgatttatctggtaactctttctctggttccatacctcctgagtttatttactgcaaattcttgaatacccttttgctaaatgacaataaacttactggttcgatcccttttgagattggccggcttgaccggttgaaacggttcagtgtgtcaaacaatggtcttacaggtccggttcctgatgatttagaccggttcttgaaagatgattttgaagggaataatgggctttgtggggaaccacttggatctaaa

SEQ ID NO: 157 - DNA, 645 bp, Nicotiana benthamiana; identical to SEQ ID NO: 48

SEQ ID NO: 158 - DNA, 658 bp, Nicotiana benthamiana
cccacgcgtccgagagagggtgccttttttgtttgtttaatcggaataacaaagcaggttagatataaaaaggcagaagagctttgttgataaaagtattttttttcatctgccatatttctaactctgattagttattgagattgaggattttcaggcttctgtaaataataataaggagaaaaaaattaaataaaagataaaaatggcattcacaggaactttggataaatgctcagcttgtgacaagactgtttactttgttgatttgttgtctgcggatggtgttacttatcataaatcctgcttcaaatgtagccattgcaaaggcactcttgtgatgagcaactactcttccatggaaggagtcctctactgcaagactcatttcgaacagctttttaaggaatctggaaactttaccaagaattttcagaattctaaggctgagaggcaaaattcactgacaagggctccaagcaaactatctgctatgttctctggaacccaagataaatgtgctgcttgcgacaaaactgtttatccacttgaaaaggtgacaatggaaggagaatcattccacaagtcatgtttcaagtgtgcacatggagggtgtccacttacccatgcaacatatgcttcccttgatggaaatctc

SEQ ID NO: 159 - DNA, 638 bp, Nicotiana benthamiana
aaaaaaacccttttgggtatgccgtatgcaggtgtaaagttttagccaaacccattcttgattttcctttttttcatttggtgtcatccattttcctttctaagcccctttcaagattcctcgtcttataattccaggttttcaattctggacaggtgaatcaatggatgcgttgcgttcaactaatatgaattctgaccctggtgattttgaatgcaatatctgctttgagttagctcaagatccaattgtcactctttgtggccacctttattgttggccatgtctttacgaatggttgcaagttcattcacattcccacgagtgcccagtatgtaaggctctcgtagaagagcacaagttggttccgatatatggacgaggcaaatcaagttctgacccaagatctcggttagtacctgggatcaatatacctaagcgtccaatgggacagagacctcaaactgctccagctgtagatatggactatctccgacatgatgaattggatccaataggggcgttcaggcccgtgcccatgcccatgccaagtgcaaggtttggaaactcgatgttatctgatctttttggagctattccagctttttttaaccttcatgtacatggatttcatgatg

SEQ ID NO: 160 - DNA, 628 bp, Nicotiana benthamiana
tagagagatggataatcttgggggaggaaatggtaagggaggatttcatggctaccgcagattccctcaaccaacccctgctacggacatgagcatgggactatctgctcatctcaaccaggccattgctgccaatacaaacaataatggcaccaacaactcagaacaagattctgagtgcaccattcgggagcaagaccgattcatgccaatagcaaacgtgatcagaatcatgcgcagaatccttcctccgcatgccaagatatcggatgactccaaagagaccatccaagaatgtgtgtctgagttcataagcttcatcacgggcgaagccaacgagcgttgccagcgtgagcagcggaagaccatcactgctgaggacgttctttgggccatgagcaagcttggttttgatgactacattgaacccttgactttgtacttgcatcgttatcgtgagtttgatggtggtgaacgtggatctttgagaggggagcctttgctgatgaagcggccgatgatggatcctgcttcagctagcatgacgaccatggcgccctatcagctgcctccttttcaaattgctcatcaccatggatactttgcgtatccaccaccaatgggcaac

SEQ ID NO: 161 - DNA, 658 bp, Nicotiana benthamiana
aattatctctccgtttctctattttaaccttaccctaaggttaccttatggccacagttgccgagtttgaatttccccaactcgtcaacgaccttcaagatctatccattgaacctcagaacaaaatgaagagcacagctgagggaacacaccgagttgggtgcgagaataaccatcatgggatttgtgctatttgcttgaataagatagtgcttgaagaaactgccctggtaaaaggttgcgagcatgcgtactgcgtgacttgtatccttcggtgggcaacctataaaaaggaaccaacatgccctcagtgtaagcatccatttgagtttgtctacatccatcgtgcacttgatggaagccttcaggactacatgtttgaggagagcgtttgccttctcctcagggcttcatggtttaaacctttgattgtggaggaaagggcagaggtggatgatgatatggatgacttatacatgtatgattatgaagaagaagaagatttagcagaagattatttagttagtagttcatctagactccgtttaggcaatagacgatggggtgataatggatatgttagtgcaggaaggcaagaagcaaggcctgtttatcgacctaactctcaggaatctggggctggtccctctcgcgagcc

SEQ ID NO: 162 - DNA, 547 bp, Nicotiana benthamiana
cccacgcgtccgggaatattagaaggcatatacaaggctggtctcttgagggtcctatccctcctgctatatctttccttaagcttaattgatttaagaatcagtgacctaaaaagtggacaatctggttttccaccattagataatctagaatccatgaaagtactaattctaaggaagtgcttaattcatggtgagattcctgaatatataggggacatgaagaaattgaagacattggaccttagttttaacagcttgtctggtgagatcccgttatcttttgcagaactatccaaagtagattttatgtatttgacaggaaacaaacttactggacctgttcctgggtggattttatcaagaaataagaatgtagatgtttcgtataacaattttacacgggaaaccacagcacctattgaatgcccgcgtggaagtgtaaacttggtggagagctattctgcgttgggacaagaatcaaacaaagttcatccttgcctgaagcatgatttcccttgttcggaaccaacaaataagcaacagt

SEQ ID NO: 163 - DNA, 628 bp, Nicotiana benthamiana
ccctagtacgagaggattagcaccatggcttcatcaaactgtgtcaatttcaccatgtttctttctatatcagtcttgtttgttaatgttctgccagtgaattcaacatcaaggcatgctctgatcaacaaccataagggattcaaggtgagtctaaaacatgttgactcaggtgggaatttcaccaaattcgagcgtttacaacgcgcgatggcacgagggaaatcaagacttcaaaggttaaacctaatggctaataatttggtagcaacaacagccatagatgactctgacattgtaaagtctacaatccatgcaggaaatggtgagtttctcatgcaaatatccattggtagtccaaatgaaacctataatgttataatggatacaggaagtgacttaatttggactcaatgcaagccttgtaaagagtgttttgatcaatccacacctatttttgatccatcaaaatcatccactttttccaagatttcatgttctaacaaactttgtgaagcattgccaatgtcatcttgtggggataataattgtgaatatatgtacacatatggtgattattcatcaagtgaaggttttttagctagtgaaacattcagttttggcaaaa

SEQ ID NO: 164 - DNA, 635 bp, Nicotiana benthamiana
cttgtctctcaatctgacccttttggccaattgaaatctgcatctgtggaacacactgagttgccaaaggggaatgcaactgagttcactattttctctgtatctccttcaggtgattggaaatcttcaggatatgggcaaaaccaatcaaacattcaggctgctgctacctcagttaatatggactatcgaagtcactttgagctagggtttagtcagtccctgatttctgcaaaatatccttacggaggacagcaatccgtcgggttattttcagcttatggtcctcaaatttcgggccgtgttatgctgccattgaatttggcctctgatgaaggcccgatattcgtaaacgccaagcagtatcatgggatactgaggcgtcgaaagtcccgggctaaggaaatggagaagaaagctcttaaaccacgcaagccatacttgcacctctctcgccatctccatgcaatgcgccgacctaggggctgtggtggacgcttcttgaacacaaggaaaatgaatggaactatgaagggtggaaaaaccaacgatacagttaagactggtgatgttcacagtttttacccaactggatcccagaattctgaagtgctgcagtctgatagtagcaattt

SEQ ID NO: 165 - DNA, 706 bp, Nicotiana benthamiana
cagaagagcaacatttgaacaagtatggaaaaggaaaacaaactaaaatcagagacttcattggaaaatccgatgttttcacaacagattcaaactgaaaaggattctttaggttttttagacaacatgtttggtgctcatcttcttgatttcaatactactattccttccattttcgatttgcttcaaacttcaccacctcaatcactgactaatattccatctccaacttccacatttcaagaatcatgtgaggtggaggtggtgaattcactgtcgatctcttcatcatcaactgaagctgccgaagatgatcagcagagtaatacagtaaagcaacaagatgaagatgaagacaagtataagaaacagttaaaacctaaaaagaagaatgttcaaaagaggcaaagagagccaagatttgcattcatgaccaagagcgaaattgatcatttggatgatggttttagatggaggaaatatggccaaaaagcagtgaaaaacagcccctttccaaggtatatatgtttaaaatatgacacatttttatatttgataattcattacgaagggagtacaattaaaatgtctctaggttaattcttctaccggttaaactaataaaacacgctggtggatgcatatcatttataatatgtacatactgtactcatgtataattaatatataatctatatataccgat

SEQ ID NO: 166 - DNA, 558 bp, Nicotiana benthamiana
cgagtagccgcatacaggcagttgaagaatagagtttcttggataagttcattcaattctaccagatcaaatcatactttgccctttgctacgttaaaagctgaagaaatatcaggctctcaacctgctgaagtccacaacttggtgcaggggaagtggacaggatcttctagttggaatgcaatattggatcccttgaatgggcaaccattcattaaagttgcagaagtagatgaatcagaattgcagccatttgtggagagcttgtccaagtgcccgaaacatggtctacataatccattcaaagcaccagaaaggtacctaatgcttggagacgtatctacaaaagcagctcatatgcttggcttgcctgagggttctgacttctttgctaagctaatacaacgggtgtctcctaagagttaccaacaagctcatggtgaagtttttgtcacgcagaaatttctggaaaatttctgtggtgatcaggttcgctttctagctaggtcttttgcagtaccaggaaatcatctggggcagcagagccatgggtttcgc

SEQ ID NO: 167 - DNA, 601 bp, Nicotiana benthamiana
tttctgtcaaaacctaaccagcacttcttcccccggggcaccgaaccttcggccgtccggcagagaacgtcacctcaaatggagttcgatgagtacgattatctggagaagactgtagaagagcccaacggtggtccttctacaaagagcaaagacaacaacaacaacagcagcgctgagaaggagaagagcgagaaagcctatcgccggagggagagagacgggagcgaggaatacgctgccgaagacgacaatagagatcgccggagcagcaaaaggtctcgcggcgacggcgaaaaggataaggatagagataaagatagagatagggaaagggaaagatcttcgaggcatcggagcagggagcgagaatcggagagagacagagagagaagctcaaaggaccgagaccgagaacgtgacagagagaagagggagaaggagaaagagagggagaaggagaaggaacgagagagggagaggaagagtagagatcgggatagggagagagataaggaacgggagaaggagaaggatagagagagggagaggtcaaggaggagccggagtcgctccaggattgaacgagagcgagagcgag

SEQ ID NO: 168 - DNA, 239 bp, Oryza sativa
cccacgcgtccgcaggaagctgaagaccaccttcaaggcatctaggccgaacttgttcatgtgatctaccagtgtgtacccatgttctgcaatttagcccaagaatcaaaagattttgtctgtggaagttttggtgccctgctggttaggcatttccagtttcatatccaaatgatgcttaggcatttccagttacccttccaaatgatgctttgcaaacccttgaatttcctcgtatt

SEQ ID NO: 169 - DNA, 947 bp, Oryza sativa
tctagatcgcgagcgccccaatcccaccaccgatcgatccattcctgctgctcgcggccaccggagaaggagagagagagagctcgacctcgtcggcgggtgaaggatcgcagcagcagcagcggcggtagagcaggaggagaggcgaagatgtcgtcggtgttcagcggcgatgagaccgcccccttcttcggcttcctcggcgccgcctccgccctcgtcttctcatgcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcgcacctctcatctggcctcgcctgtggtctcgccggtctcgctgccggaatggccattggcatcgttggtgacgccggagtcagggcgaacgcccagcaaccaaagctgttcgtgggtatgatcctcatcctcatttttgccgaagcgcttgctctctatgggctcatcgtcggcatcattctgtcatcccgcgctggccaatctcgtgcggattaggcatgtttcaacacgcaaacccttagtgggttcttgtttcatattcctgaaactacaagctgagctctaggggtttattctgtcttagtttctgttcttctgttgggtcatgaacaaaaaaacatctgtatccaagggatgtttgcccttgtggtgccattctttttcgctatggtggtgctggcggcggtctgaatcttatttatgcacagtttttttgggtctggctagacagtgatgtaatctggtgaataagcaaatcattcgtaatgcaatgggagcataagactcttttgttc

SEQ ID NO: 170 - DNA, 787 bp, Oryza sativa
cgcctcctcggctccaatcccccactcaatctttccctcgacggcggaacgccgcgccggccgttgctccgtcgccagcgccggtggtccggtgaccacatcccagccggaacgagatttacattgcaagcagaggttggcgcctaaggcatcacaaaggtcgacggccatgaggcctccccaccgtcagagattgcgccaggcaccacgccggcgggtaagctcgccggcgtcctccacctcgtcgtgctcgcctcctaaaccgccgccgcgctacagcctgcgttcgactcctgctcgtcgtctccaccgcgctactacggaattgcaggacgcgaaggagcaagtggttgacagccttgaaccgaagaagaagaagaagagatcattcatcgaataccacatcggtcgcatatccaacataattcaacaatcaatcaacagaattcagagagagcgagatgagagacttcaaatgctgaagaccttaagggaggacggggttgacgcgaactcggagcagtatcatcttgccaaagagctactaaggtcacgaacacgccgcaccgtcttcaagagattcgattcgaaggaaactcgactgaagtggctgcagtggtcgtggcagaaccgaaaagcaattacggcctcgtcatcatcgtcagaagatgagtcagaggatgatctgttgttcagtagttgatcagcatgtgatgagtagcaaatgtatcaaagcttaacagtccgatcggatcaggtggcttgcacgatggcacaaaaatgctag

SEQ ID NO: 171 - DNA, 583 bp, Oryza sativa
ctcgaatcgaatccaccacacggtaccctcctctctcctcctccgaccaccatggccatggccacgcaagcctccgccgccaagtgccacctcctcgccgcctgggcaccggcgaagccgcgctcatccaccctctccatgcccacctcgagggcacccacctccctcagagcggcggcggaggatcagcccgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccggagaaggtcaacgccggcaggcagggcgtcg

SEQ ID NO: 172 - DNA, 671 bp, Oryza sativa
caccgcctgccgccgagagctctctcagccgtcgccatgggcaccgctaccaacggcaacgcctccgccgccgccgccgccgctgactccgccgtcaaggagcccccgcacaagatcgccaaggttgctcccttgctcaaggtcaagaagctctccgagaacgccgtcctgccgtcccgcggctccgccctcgccgccggctacgacctgtcgagcgcggcggaggtcgtcgtgccggcgagtgggaaggcgatggtgccgacggacctcagcatcgccatcccggagggcacctacgcgcgcgtcgcgccgaggtctgggctggcgttgaagcactcgatcgacgtgggcgccggggtgatcgacgccgactaccgtggcccggtaggggtcatcctcttcaaccactccgacaccgacttcgccgtgaagcccggcgaccggatcgcgcagatgatcatcgaggtgatcgtgacgccggaggtcgccgaggtggaggacctcgacgccaccgtcaggggagagggagggttcggatccaccggcgtctgaatgaatgaagcatcgtcgtcgttagctccaggaagttgggggagttcatttagtctgtgatggatggatgggtgatgtcgtgatgaaacacttgtatcctcttaatgcctcggatgctt

SEQ ID NO: 173 - DNA, 532 bp, Oryza sativa
cgcccttcttcggcccgctcgccgacgcgccgcagcccttgaccttctcccaggccgccgcggatgccgccgcggcgcgggaggaggatgcggacgatgaccggagcaacgaggccgaggcggcgtcgtggcttctccccgagcccgacgacaatagccacgaggatagcgccgcagccgccgacgcgttcttcgccgacaccggcgcgtacctcggcgtcgacctggacttcgcccggtccatggacggaatcaaggccatcggggtaccggtcgcgccgcccgagctggacctcaccgccggcagccttttctaccccgaacactccatggcccacagcttgtcgtcgtcggaggtcgcgatcgtaccggacgcgctgtcggcgggcgcggcggcgccgcccatggtggtggtggtggcgagcaaggggaaggagagggaggcgcggctgatgcggtacagggagaagcgcaagaaccggcggttcgacaagaccatccggtacgcgtcccgcaaggcgtacgccgagac

SEQ ID NO: 174 - DNA, 631 bp, Oryza sativa
ctcgccgccgccgccgccgccgcggggatggccggagtttccgccgcctccaccgccgggaagatcgggagcttcctctccaagaggccgtacgcgccgccgtcctgggcctcgcacctgtcccccgccccctcgcagaccttctcgctcggccatttcccgacgccgatccacaagtggaatctgcccaatttgccgaatggcacggaggtgtggatcaagcgagacgacatctcaggcatgcagttgagcgggaacaaggtccggaagctcgagttcctgatggcggatgccgtcgcgcagggcgctgactgcgttataactgtaggtggcatccagagcaatcactgccgtgccaccgcagtggctgcaaagtatataaatcttgattgttatctgatactgcgcacatccaagcttcttgtggataaggaccctggtttggttgggaatctccttgttgagagattggtgggagcgcatattgatcttgtttcaaaagaagaatatggaaaaattggcagtgtggctttagcggacttgctgaaaaagaagcttttggaagaaggccgaaaaccatatgttattcctgttggtggatcaaactctctaggaacttggggatatatag

SEQ ID NO: 175 - DNA, 507 bp, Nicotiana benthamiana
ttgcatttccaacgtgtatttcagttaacaacactgtgtgtcatttctctccattgtctagcgatgagacagtactggaagaaggtgatatattgaagattgatatgggatgtcaaattgatggatttattgctgtagttggacatacacatgttcttcatgaaggaccagttaccggtagagctgctgatgtcattgcagctgctaatacagctgctgaagttgctttgaggcttgtgagaccaggaaagaagaactcggatgtaacagaagctattcagaaagttgctgctgcctatgactgcaagattgttgagggtgtcttgagccatcaaatgaagcaatttgttattgatggaaacaaagttgtattgagtgtgaccaatcctgaaacaagagtagatgaagcagaattcgaggagaatgaggtttactcaattgatattgtgacaagcactggtgaaggaaagccaaaattgttggatgagaaacaaacaactatctaca

SEQ ID NO: 176 - DNA, 881 bp, Nicotiana benthamiana
ttttttttttttgttttaattctgaacgagcttaatcttatataaaatttaatttttttccttttgcataagtatacataattgaatctacagacctcgtcctagattcaaaattttattctaacacataatctcgaaacttcataaaatgtatgcgaatctgttcatttgggagcggaagcaaaagttgtagcagcttgagaacgagctcggaaaaaagcaagcaactcatctcttggaggcagagattccttgagttggctgcagttagtgtactcatctctccacttagaaaaatttggaaatttttcacttgtcattaaaacaattccagaggcttcttcgaaaactcctagccaaaatgccaccaaatttgctgcaatatcagcaaacccaaatttgtcacctacaagaaacttcttatccttgagctcattgtcaagaactttcaacatctcccaaacttgctctttagctttttcttgttcctcccctttgctaaggaaagtattcactattacagtcaccttatcgtcaaggaacttagcccagaaacgagctaaagatcgatcataagggtctttaggcaaaatggaaggaccttcaaaagtctcgtcaatgtattcaagaatgacaagagactcagaaatgggtttgccattgtgaataagcactggtattttcttgtgaacagggtttgattgaagaagcagagggctcttgttttgtaaatcttcttctacaaattcatatttcacgcccttaagctttagagcccactcaactctgtgactaaaagggctataccaaagaccaagcaacttcactcctgccatatgatatcactactttggttctaaatgtttttgcggacgcgtggg

SEQ ID NO: 177 - DNA, 1100 bp, Nicotiana benthamiana
tttttttttttaggcagccaagttaaaacagcatcgacagctgctgcatcttcttgccattgagctaaaaaacagtagttcgtgatcagcaacaaaattacaaccaacagcaaataaaacagcatcaacagctactgcatcatcttgctattcagccacattgacttttcacggacccaacttataaataagtcaggcgaatcagttctagcaagcagaaaatagatgaaaggtccttcatttgggaatgtcctcttgatacgcagcattgaccaaagcctgatgcaattgcggcctcctcctttgctacttaatcatcggcatcaaaacgtggcaaggggctgcgagaaccagcacgtctaccacgcggtgagacactcttgggagttggagagcgctccttgcgattacgaccatctggactagcatccctagaaggtgttgttctgcgtggagaagggctcctccgaggactggggctacgacgaacaggggaggcacttccatgagaccgacttcggctgcgcctttcttcatcatatttaccccttccacgagctttttgataatccgggctgcggcttctgttccggtgacggtaatctttgtctcttccacggtaccgatcacggtcatacctccccccacttctacttcggcttctcctttcagaatccttgtccctataatgatctcgatgccttgatctaggactacggcttcttgaccttcctcctgtcctatgtacaggctccaaaattctacctttgtcgattctctcggcatttgggccgtactttgcaaatcgaaccattatttctcgaccatctacaactcttccatcgagcttctccactgccttttgagcctcatcctgatacttgtagcgcacaaatgcaaaacctctagaatctccggtccttcggtctctagggataaagacatcgacgacttttccatacttatcgaaaagaggaaacaagtcatcagcagtggtacggaaagtaacgttgagaacgaggagagagaaggtatctttgatgtccggagggcctgttcttccgaagtgagacatcgccgttcgctggagtgaatgactg

SEQ ID NO: 178 - DNA, 661 bp, Nicotiana benthamiana
cccccatcgcgatcaacaattattgcgtaatgcatcgttctgactgcggattttcagtgttagccatttacttgaagagtggcattccatttgatattatcacatttaacaccttactaaggggactcttcgctgaaaataaaatcaaagatgcagttaacttgttcaaaaagttggtgagagagcatatttgtgagcctgatgaattcatgtattcaattgtcatgaatgggcttagcaaaaggggtcatactcaaaaaactttcgatttgcttagggtaatggaacaaggaagcactaagcccgatgcatacatctatagcattgttatagataccctatgcaaagatagaatgttagatgctgcaattagcctttttgaagagatgaaacaaaaaggcattcctccaaacgttgtcacttataattcattgattgatggttgttgtaagcttggccagtgggaaaggttatgaatttgttctctgaaatggtaagtctgaatatttatccaaatgtccgcaccttcagcatactgatagatggtctatgcaaagaagggaaagttgaagatgctgaggaggtaatgagacgcatgattgtaaaaggtgtagagctagatgtattcacctacaataccatgctcgatggatattgcttg

SEQ ID NO: 179 - DNA, 574 bp, Nicotiana benthamiana
ccccccccgataaatctacaacacctggtcatctaagttcctctctctacaaatatttcaaagagaaaaaaaagagcaaaagcttcattcataaacaatggcgtccgccattaagaaaggaaacatgattactcaaatcgtgagacttaaacaagttgtcaaacgctggaaaaataagtcccttaagcgccggggtgtcctctcgtactcctcatctgattcagatgaaccggcattatccggttcgggccggcgtacgccctcaggatcgttggcggtttacgtggggccagaacgccgccggttcgttatacccacccggttcttgaacctccccgtgttcatctcgctgctcgacaaggcagaggaggaatttgggtaccagaggacaggtgggttagttttgccttgtaaagtcgagtacttttcggagattttaaggttactggaccgggatgaggaacggttcggccatttgggtttggatgagcttgttaagctgatatctgaagtggggtttgaatctttagatcagtcttgcaaagctgcttcccatggttttgctcctcttctg

SEQ ID NO: 180 - DNA, 616 bp, Nicotiana benthamiana
ccccccccggagtccctaaccaaagccccttcttatctcttcccctttcagcccacaacacacacacacaaccacccaacgggcatataactctgttttttcctctcttgttgtcaataccatattattattctcaaccctaaaggtttaatcatgaaaggaggtaaatcaaaggctaaatctgacaataagctcggcgttaagaaggctgctcctcagactaaaaaggagaagcaggctgccaaggatcccaacaagcctaagaggccagcaagtgctttctttgttttcatggaggacttcaggaagcagtataaggaaaaacacccaaacaacaaatctgttgctgctgttggtaaagctggcggtgacaagtggaaacatttgtcagaggctgagaaagctccatatatagcaaaggcagagaaaaggaaggctgaatatgaaaagaacatggatgcttataacaggcgacaggctggtgaggctgaagaggaggaatctgacaagtcaaagtctgaggttgacgaggaagacggaagtgacgaggaggaagaggatgactaaatgaagtcttaggggatgaagaaaatgtggaggaattgtgtaatatctt

SEQ ID NO: 181 - DNA, 613 bp, Nicotiana benthamiana
cccgcccggcttgaagccgaagctaggcttgttagacaatccaaacttcggtccaatagtttccaaaattcaacatttgtatcccaagaatttactaccacttcaccttctagtcctcttgacaaaccggttgtgggtccctctcggtgtctggacgtactcaaagcgtggaatggtgtttggaccaaaccaatgaatgaacttatggcaagtggcggtgcgactatatctgtcactggactagacctggaggagtctcctacgtctacactaggctattttgatcaaaacgcgccacatatttctacaccagggattaatggaggaaattctacggttttatttgaattcgttggaaattcgtcaggatcaagcgaaggtggaattatgaataacgaggaaagtgaagaagattggaaaggatttggaaactcatcaacaggacaattacctgaatataaagatggtattaatgaaaattcagtgtcattcacttcaggacttcaagatttaactatgccaatggacaatatgtggacagctgaatctctaaggtcaaatgcagagcaaatttcccctggcaattttgtggaaacatttacagatctattgc

SEQ ID NO: 182 - DNA, 557 bp, Nicotiana benthamiana
ccacgcgtccgctttccttttttattatagcattttttctttacaaatataaataaatcaaatagcaatcccaaaagaggcataacagttttgttttccgaaagagttttctctctatttctgtctaaagaagtcatggcggaaaaagggcgaccacttcctaagtttggagagtgggatgtaaatgacccagcttcagctgagggatttacagtgatctttaataaagctcgaaatgagaagaaaggtggtaagatagactcaccacctaaaggtgattctgcatacaagaataaagcaatgcttggaaaacctcaatcaaaaaaatggttttgctgtatgcaatctactgcggccgaatcatgaactgttttagctcctacatactgaactggaaagtgatgttggttggaaccagactctacgagtgacctataacactggagctgtagtcatgatctgacgaggaatactgggatttttgctgttgtattttggaatagttgctcaatttgcaggcttttgctgccaaaatattaatgatatatatttgtttg

SEQ ID NO: 183 - DNA, 482 bp, Nicotiana benthamiana
ttgaggatagagctctcttttgcaaggactgtgacgaagcgagtcattctgccagcagccttgctgcaaaccaccagcgcttcctagccactggaattcgagtagccttgagctcaagctgtaataaggatgcagtaaaaacccaattggatccaccacaaccacctcagcagaattctcaacaagtttgcctgaaaatgcctccacatcagttgtccagtatcacatcgccatcttggcctgttgatgatttactaggatttccagattatgattcaactgacaagaaggagctacttgagctaggggaactggagtggttgggagccattgatctctttggtgaacaaacagcagcagaagtacccgagctatcagtatctcaggcgggcaacacacataatatttacaagccaaccagatatcaaatgtcttacaagaagcccaggattgaaatcccagatgacgatgagtactttaca

SEQ ID NO: 184 - DNA, 568 bp, Oryza sativa
caccaacaaaaaacagagcacgggcatggcaccgacgacggcggcggcggcggcgagcagcaacggcggcggcgagagcgacggcagcagcaaggagtggaggctgacggcgccgacgaggggcggcgcgatggcggcggcgggggacaagatgagcatccgggcggtgcggtacaagatcagcgccagcgtcgacgaccgcggcccgcgccccgtcctgccgctcgcccacggcgacccctccgtgttccccgagttccgcaccgccgccgaggccgaggacgccgtcgccgacgcgctccgctccggcgacttcaactgctaccccgccggcgtcggcctccccgccgcgcgacgtgctgtggcagatcatttgtcacgcgacctcccatacaagctatcttctgatgacatcttcctaaccgctggaggaactcacgccatcgaggtcgtaatctcaatccttgcccaacctggcacaaacatattgcttcctagaccaggctacccaaactatgaagctcgagccgcgttcaacaaccttgaagttcgccactttgatcttatt

SEQ ID NO: 185 - DNA, 661 bp, Oryza sativa
catccatcccatcctcgatcctggattcctgcccggcggcgagcgagagagaggcggaggagatccgagatggcggggagcgggtggaggaggatcccggcggcgaggaggccgcccatgtcgcgcccggcctcggtctgcctctggatcgtgctcgtcgccgccaccctggcgctcgcccaggcgaagaaatcgaaggcggatttgactgaggtcacccacaaggtctacttcgacgtcgagattgatggcaagcccgcaggacgggttgtcatgggacttttcgggaagactgttcctaaaacggcagagaacttccgagcactttgcacaggagagaaaggaactggaaagagtggcaaagcactccacttcaagggaagtgcattccacagaattatacccagctttatgatccaaggaggtgacttcacacttggtgatggaaggggtggtgaatctatctatgggacgaagttcgccgatgaaaacttcaagatcaagcacaccggaccaggcctcctgtccatggccaatgctgggagagacacaaacgggtcccagtttttcatcaccactgtaaccaccagctggttggacgggaagcacgtcgtgttcggtaaggtgctgtctggaatggatgtggtttacaagattgaag

SEQ ID NO: 186 - DNA, 657 bp, Oryza sativa
gcggcggcggcggcggagggggaggcggaggcggcgaaaatgcagtacaagaaccttgggaggtcggggctgcgggtgagccagctgtcgtacggggcgtgggtgacgttcggcaaccagctggacgtgaaggaggcgaaggcgctgctccaggcgtgccgcgacgccggcgtgaacttcttcgacaacgccgaggtgtacgcgaacgggcgcgccgaggagatcatggggcaggcgatgcgggacctcgggtggcgccgctccgacgtcgtcgtctccaccaagctcttctggggagggcagggccccaacgacaagggcctctcccggaagcacatcgtcgagggcctccgcggctcgctcaagcgcctcgacatggactacgtcgacgtcgtctactgccaccgccccgacgccaccacccccgtcgaggagaccgtgcgcgccatgaactgggtcatcgaccacggcatggccttctactggggcacctccgagtggtccgcccagcagatcaccgaggcgtggagcgtcgccaaccgcctcgacctcgtcggacccatcgtcgaacagcctgagtacaacctcttctcgcgccacaaggtggaatctgagttcttacctctttacagcacgtatggcctgggtttgactaca

SEQ ID NO: 187 - DNA, 703 bp, Oryza sativa
ctgaagaggtacccagctaggctgtcagttctatcactgacctgcatctttgggctcctccagttcctggtcattgcagccttcactgaagaagacctgagcagatggaaggtgaactccggaagcgagctgttcacaatcctctacgctggtcttgtggcatctggcgtggcgtttgctctgcagatatggtgcatcgacaggggagggccgctgttcaccgccgtgttccagccggtccagaccgtcgccgtcgccgtcatggccgccatcattctcggagatcagctatactcaggagggatcatcggagcagttctgattgtgatcgggctgtacttcgtgctgtggggcaaaagcgaggagaagaagagcaagaacaatctgcaggaccagtcatcggtgcagggaggaggaggagacgacatcaggaggcatctgctcgggcaagaagatgcatctcgcaaagacgaagaagctgcagtcactgatgaactggcatgacgatcgatcgagctgaggggcgttcttcaccagtaatatgcatgatgatgttggagttggaaaatatatgttgatgtcagtgactgtacttttcttaactatgttaatcaaagaagaagatccaagcgtgccagtgtaattaaaaacagtactgctagctggtcctcactcaccagtgatatactatatataattgcta

SEQ ID NO: 188 - DNA, 625 bp, Oryza sativa
ctcccatcctctcgcgcggcctcctccgactacctcggttgggttttgggggcggctggagatgtcggactccgaggagcaccacttcgagtcgaaggccgacgccggcgcgtccaagacctacccgcagcaggctggtactattcgcaagaacggtcatattgtcatcaagaaccgcccatgcaaggttgttgaggtctccacctccaagactggaaagcatggacatgcaaaatgccactttgtggccattgacatcttcaatgggaagaagcttgaagatattgtgccctcctcccacaactgtgacgtcccccacgtgaaccgtactgactatcagctgattgacatttctgaagatggatttgtcagcctcctgactgaaagtggaggcactaaggatgacctgaggctccctagtgatgaggctctgcttactcagatcaaggatggattcgccgaggggaaggatctgattgttaccgtgatgtctgccatgggtgaggagcagatctgcgctctgaaggatattggccccaagaactagaataccttgttaccgtgtttggctacctgtctggtcgctttaagtttggagctggtcttgagattatatataaacttt

SEQ ID NO: 189 - DNA, 585 bp, Oryza sativa
ggtcatctccatgcagatgggtgcagtgcaggcatgcgagccctactgccccaccccgacgccgccggtgacgccgcctccgtcgccgccgtcgggtggagggaataagtgcccgatcgacgcgctgaagctgggcgtgtgcgccaacgtgctcaacctgctcaagctcaaggtgggggtgccggcgagcgaggagtgctgcccgctgctgggggggctcgtcgacctcgacgccgccgtctgcctctgcaccgccatcaaggccaacgtcctcggcatcaacatcaacgtccccgtcgacctcgtcctcctcctcaactactgccacaagacctgcccttccgacttctcctgcccactcatctgattcttaatcttcattaccaccacaaccctagctacctaattaaggcttaagctttgcatggcttagtctgtgtgttgcagttgtgtcatacatatatacttatctcgatctatcagtgtgattattgatgatcagatcgatcatctaatatatgtatcttgttattttaatgcgtactgtcaaataaaagtttcctccagtgtacgtacgttctatct

SEQ ID NO: 190 - DNA, 354 bp, Oryza sativa
cagaaaatggcaccttccgaggtcagcctcgccgccgtgctcgccgtggccatctcgctggcaatggcggccaccaccaccacctcggcgcagaacacgccgcaggactacgtcaacctgcacaacagcgcgcggcgcgcggacggcgtcggcccggtgagctgggaccccaaggtcgccagcttcgcgcagagctacgcggccaagcgcgccggcgactgccggctgcagcactccggcgggccgtacggcgagaacatcttctggggctcggcggggcgcgcctggagcgccgccgacgcggtggcgtcgtgggtgggcgacaagaacaactaccactacgacaccaacacg

SEQ ID NO: 191 - DNA, 561 bp, Oryza sativa
ggccttcaaggccgcagggggcatgacaggggtgacatccgcctcgttggatggagacaagctcctcgtgatcggcgacggcgtggaccccatcgcgctgacgacgatgctccggcgcagcctcggccacgccgagctgctaagcgtctcctccggcgacgacaagaagatgggcggcggcggcggcggccacggcggcatgggcatgggcatgggcatggggttcggcggtggccacggcggcatggggttcggcggcggccacggcggcaaagaaggcaaggaaggcggcggcaaggtcttcgtcgacggtgtccaccaccaccaacagcagcagcatgcgatggcgccgccgatgcagccgtacccggcggcgccggcgtactacaacgccgccgcgccgtcctaccccgtctacccctcctaccctggctacccgcagcaagaacaggatcctagctgcagcatcatgtaaaagattgtgagtatcaatcagaggagcttaaatctggcaaaaactatggagaattattaaggtatttgagttcacaatcaggccaa

SEQ ID NO: 192 - DNA, 575 bp, Oryza sativa
cccccccccgacaagcacccacaccaaccaaagatgagcaacaccaccatggctatttccaccatccttctcttcctcctcgccggcctcgtcgccgcccacggcgacggcgacaccatgatccgtctcccaagcgacggcgccgaagcaccaccacgcccgcccaaaccctgggactgctgcgacaacatcgagatgtccccgctcgagatcttcccgccgctgtaccgctgcaacgacgaggtgaagcagtgctccgccgcctgcaaggagtgcgtggaggcgcccggcgacttcccccgcggcgccttcgtgtgccgcgactggtactcgacggtggacccgggccacatgtgcacggcgccggatcagccgacgacgaagaggccgtggaagtgctgtgacagcatcgtgcagctgccgcagaggatcttcccgccgttctggcgctgcgacgacgagctggagcccggcaagtgcaccgccgcgtgcaagtcgtgcagggaggcgccggggccgttcccggggccgctcatctgcgaggacgtctactggggcgccgacccgggcccctt

SEQ ID NO: 193 - DNA, 691 bp, Nicotiana benthamiana
agcagaggtgcaagctgtcactgtccatgcgaccaataactattttgtgactgcttctcttgatagcacatggtgcttttatgatcttgcttctggcttatgccttgcacaggtggcagatgctacagaatctgaaggctacacatccgcagctttccaccctgatggtctgatccttggaacagggacctcagggtctctggttaagatatgggatgtaaaaagtcaggcaaatgttgcaagatttgatggccatgttgggtctgtaactgctatttccttttcagaaaatggttatttcttagcaactgctgctcatgatggtgttaaactttgggatttacgcaaattgaagaatttccgaaatttctctctttatgatgaaaatacaccgactcaatcagtgcaatttgaccatagtggaagttatcttgccttaggaggctcagatatacgagttttccaagtcgccagtgttaaggctgaatggaatcacatcaaaaccctccccgacttatcaggcacaggtaaagcaacatgtctgaaatttggtccagatgcaaaatacatagctgtaggatctatggaccgtaatttaagaatatttgggctgcctggcgaggatcaaatggagagttaggctcatttccagcatgaaagcaaacagtcagcgccacagcttcgaatctgc

SEQ ID NO: 194 - DNA, 230 bp, Nicotiana benthamiana
gccattacggccggggatatgggctgatatttctcttggtgggtataggccaatgtatttgttctgcagtttactgttaattagtttggaccaaagtgcttatgtatcaatagtacatagacccgactcattacatagggaactattattttcttttttcaattaaaatatttggaagcttcaaaaaaaaacaaaatataaaaaaaaaaaacttgtcggccgccttggcc

SEQ ID NO: 195 - DNA, 409 bp, Nicotiana benthamiana
gccattacggccgggggaccaaattaagtcgaaaaaaaaagggcaactcctgaagaaaacattgcacctgcagctccaccaccgccggcggcagaaccatcagcggtggaggctttagtgaccactattgaaacagcgaccaaacaggttgaaacaccgaaggaagtcaaggaggagaagaaaggaggagcacaggatctcaagttaacccttttgattccaggggctgtagtagctgttgttggagtagttcttgccattgtcaagaaggtgaaagagtcggctaattgaatgtagatcccttgtatcgtcaactttatatttctgtacattttttccccctttttgtaagacgagcctaaactctttgtcagctttgaagggaaataaataaatttcatatgctttt

SEQ ID NO: 196 - DNA, 580 bp, Nicotiana benthamiana
gccattacggccgggataggaaatggcaagcacagtaatgagctcattgagcctcaaacctgcaactttcagtgttgagaagacagcagtgaaaggactgccatcacttgctaggtcttcttcttccttcagagttcaagctagtggtgtcaagaagcttaagaccgacaagccttacggaattaatggaagcatgagcttgagagacggcgttgatgcctcaggcaggaagcccaagggaaagggtgtttaccaattcgttgacaaatatggagcaaatgttgatggatacagccccatctacaacacagatgactggtctccaagcggtgatgtctatgttggaggcaccactggcttagccatatgggcagtcaccttggttggcattctggctggaggtgctctccttgttttcaacacaagtgctttggcacagtagatcattatccttgtactcctatttcagttgtattccagctcgcaccatgtatcttttcaagaatactttgtatttgctggcatcttgattaatctgtaattgctgtggatattacacataatgttgattatttaaggt

SEQ ID NO: 197 - DNA, 448 bp, Nicotiana benthamiana
gccattacggccggggcaaagagtgtgtttggtgaggatgctttggtgaatgtaagcattgagaaacaagcagatggtaagctgagtggttatattaggataaggagcaaaacgcaaggaattgcgcttagcttgggggacaagataacactcaagcagaagggaggcacttgatcaggccaaccggaatttagtatgacctggatatgctgattattacacttgaatttgaggctcctccagatctcccattttgcagcttggtggagtgctggggttattgagagagcatgtagatattataatactgcacttattcttaggttcggatgtaaaagattcaagtattttattttctgtgaggacagtttttgtagagaatgacttgaagaaatattgcattatttttgacatgttttgaagcggaagtttcttcttaagttcatgc

SEQ ID NO: 198 - DNA, 641 bp, Nicotiana benthamiana
gccattacggccagggataacctcaaaggccaaatagatagtttcttcccacgaaagtaaaaatctccctcatttttccccctactacttttcatcatcatgtctcagaccgttgttctcaaggttggcatgtcatgccaaggctgtgtaggagctgtgaacagagttttggggaaaatggaaggtgttgaatcttatgacattgatattaaggagcaaaaagtgactgtaaaaggaaatgtggagccagaagctgttttccagactgtttcaaagactggaaagaagacttctttctgggaagcagaaacaccagcaccagcaccagcaccaactgaacccgaaacaaagcccgttgaagtaaagcccacagaagaaaagcctgcagatacaccagctgaacccgaagctaagcccgcagacgaaaagccagcagaagctgttgcttgatgatactgatatatatatcaagcttaaagcagaatgtgatatgtaacagttaatcagctcttaaataacgtgttactaatttttgcgtttggtttttattgtaataatatagataagaagtcctgttatctactgaaaagaactacttcagtatactggagtgtattgtttaactagtctactggatttgc

SEQ ID NO: 199 - DNA, 401 bp, Nicotiana benthamiana
gccattacggccgggggtctgtttatagtcagagactgatcagttgtcctgccataactttggcacttttgacatttctgtagcagggtgcctgaaagaaaaacattctcaaggtggaaaagtcggttgaaaagataaagcattttgccatgtgaatgttatacttctactcctgctgatagacgtgaattccttctgagataacaagattaggtttacaattggtagtcagatttgaagctgtattatttagggaaaaagtagccctttctttcagttcagagttctcttttgaatcacttttgacttctctttagttttggtatgtgtacagcttaggattgttattgttgcaacaaatatacataacattttgaggcatcatatccttcattttgaaa

SEQ ID NO: 200 - DNA, 397 bp, Nicotiana benthamiana
gccattacggccggggaaaggagagagcccaagttgcatatgagaggagaaagcagttggctaaactgagagttaaggccgagaaagctgccgaggagaagctcggtccacagcttgctgttattgaacctatcaagtattagagtgcaaatttagtagttatctgaggtgaaattttgctggagattgagatttcagcttatctgtttttttaaaagttgtaccgcatggtttggtattttgcttctagcaatatttgagcagactttaaattgttttaactatctttttgaagttacaattctctcatggttttattggtacagctttgttttctactccttgatagtttgcatctataagatgaatgactccattgagctgagtctctattaga

SEQ ID NO: 201 - DNA, 493 bp, Nicotiana benthamiana
gccattacggccggggggtgttatttgtcctcataagcttggctgtcacaggaattcaacacgttcaattctgtctgaaccattttgctgcagatgtctatgttggacaacccaagggaaacgattggttcgagaaacaaacagccgggactatagatattgcttgttctcctcagatggattggttctttggaggattgcaattccagcttgagcatcatttatttccaaggttgcctaggtgccaattgaggaaaatttctcctattgtacaggagctatgcaaaaagcacaatttgccctacaggagtttgtctttctttgaggccaatagatggacaataaggacacttagggtagcggcaatgcaggctagaagtttgctatgggaagctgttaatactcgtggctaataattgttgaagatctgtttattgtgattacaattgaataatgtcttgctggattggaacaaagagggaatgtgtatgct

SEQ ID NO: 202 - DNA, 600 bp, Nicotiana benthamiana
gccattacggccggggagagcaaagcaaaacaaagaaaaaatttgtaaaaatggccagtatttcaggtaccatggttagcacctctttcctcccaaggaaaccagcagtgactagcctgaaagccataccaaatgttgggcaagctctctttggtcttaaatctcagaggggtggtaggattacttgcatggccagttacaaagtgaagcttattacaccagaaggagctgttgagtttgattgtcccgatgatgtttacattcttgatcaagctgaggaaatgggacatgatcttccttactcatgcagagctggttcttgttcttcttgtgctggaaaagttacagctggaaatgttgatcagtctgatggaaactttcttgatgatgaccaaatggctgatggatttgttctaacttgtgttgcttacccacagtctgatgttactattgagacacacaaggaggaggagctcactgcctaaactcctcaatctcattatttcaaaaaagtttgatgagcatttattttcatatgtaactcttttgttctcataaaagatgccatgttgcaacttctagtcaatgactttgatttgc

SEQ ID NO: 203 - DNA, 665 bp, Nicotiana benthamiana
gccattacggccggggacaaaaaactgacttcttgcagctgtggctggaagaaaaagaagaaaaatgaagttattagctgcaacaactccaactaatggtggtccttctactgaggagcgtgaaggatctgatgagcaaaactcattgttttgtgtaccaatggaaattctagaactgattctctcccggttaaacttgagagaaaacatccgtgcttctgctgtttgcaagcaatggcttgctgtctccatttctgtacgagttgcaaataaaccaccttggcttatgtttttcccaaaattcggtgacttggttgaattctatgacccttcggtgaggcaaacttattcagttgagttaccagagttacgtggctctaggctttgttacgcgaaggatggctggttgctgttatacaaaccgagaactttacgtgtgttgttcttcaatccttatacgaagagtgtgatcaatttgccaagactagaattaacataccagatagttgctttttctgcagctcctacatctccgaactgtatcgttttcacagttaagcatatcagccccactttggtcgcaattagcacatgtcaaccaggggcaacggaatggataactgccaattaccaaaatcgtttgccatttgttagcagcatttgga

SEQ ID NO: 204 - DNA, 421 bp, Nicotiana benthamiana
gccattacggccggggagcagtgaccaaattaagtcgaaagaaaaaatggcaactcctgaagaaaacattgcacctgcagctccaccaccgccggcggcagaaccatcagcggtggaggctttagtgaccactattgaaacagcgaccaaacaggttgaaacaccgaaggaagtcaaggaggagaagaaaggaggagcacaggatctcaagttaacccttttgattccaggggctgtagtagctgttgttggagtagttcttgccattgtcaagaaggtgaaagagtcggctaattgaatgtagatcccttgtatcgtcaactttatatttctgtacattttttccccctttttgtaagacgagcctaaactctttgtcagctttgaagggaaataaataaatttcatatgcttttattat

SEQ ID NO: 205 - DNA, 719 bp, Nicotiana benthamiana
gccattacggccgggggcctaaaacaaatttcagaaggttgacctaaatggctcatgctatggcttcaatgggtggcctaattggttcttctcaaactgtgttggatggtcagctctgtggttcagcccgtttgagcactgttagcaccagcagaattgccttggctagaccaggtctcagcattagagcccaacaggggtctgctgacactgaaactagccgtagagccgtcatcggtcttgttgctgctggccttgctggttcctttgctcaagcagcctttgctgcagctaaatcaatcaagattggtggcgctcctcctccctccggtggattacctggaactttgaactcggatgaggcaagggactttggtctaccacttaagaagaggttttaccttcaaccattgactccagctgaagcagcccagagagttaaggattcagccaaggagattgttagcgtcaagaatttcatcgacaagaaggcctggccatatgtccagaatgaccttcgtctcagagcagaataccttcgctatgaccttaaaaccgtaatctcagctaagccaaaagaagagaagggaaagctccaggacctgactggaaagctcttcaagaccattagtgatctggaccatgcagcaaagaccaagaacagccctgaagcagagaagtactatgctgaaactgtatctaccttaaatgatgttttg

SEQ ID NO: 206 - DNA, 569 bp, Nicotiana benthamiana
gccattacggccggggagagatcgggaagaaaagatgcgtggaatggtagagtatggttggcaaaacacgtcgtcgaatgagtatcttgatcatattaaacgaatggagagatcgccaacgatgcaccctgatcttcctctctacccaaatgtccactccctcttcaaaaatggaatagtgagcaacggacaagaaaagaaatgcactacactaacaccacagtcgcagaagaaagttcatttcgtggaacctaaagctgaacttaccatgaatgaaaagaagagtattgacatggaggctgatggctatataaagcagaagcacgtcaactttgagctccacaaatggagaaccttcaaagcttgttaaaaagtttccaacgtacttcatacaagatatactacatgatatcttagtataaataacatgtaatatatgtctgtcttattagcttctgtttgtactctaaagggaaagatatctcttatatgcgctgtgactatatatttcgtagatgtggtgttttgatttcaatttatctaataataaagctataggtatgtttatt

SEQ ID NO: 207 - DNA, 613 bp, Nicotiana benthamiana
gccattacggccggggaaaggaaaagtaggtaaaccaatggtcagacagcaagatcccagcaaagactagccaagatctgcgtctcctctctctctctctctctctctctctctctaactttcaactgctgattgagtgtacagaagcttagtgttctggtttaaaaaaagatggcgagtgggtatggggatgcgagccagaagatagattatgtattcaaagtggtgttaatcggcgactcagctgtaggcaagtctcagatactggctcgatttgctcgtaatgaatttagcctggattctaaggccacgattggggttgagttcctgacccgaaccctagtcattcaacacaagtctgttaaagctcagatctgggatactgctggtcaagaacgatatagagctgtcacaagtgcatactacaggggcgcagttggagctatgttggtttatgacataacgaaacggcaaacctttgatcacataccccgttggctggaagagttgcgtgcacatgccgataggaatatcgtgatcatgctgatcggaaacaaaacagatcttgaagaccaacgagctgtccctaccgaagatgctaaagaattcgccc

SEQ ID NO: 208 - DNA, 668 bp, Nicotiana benthamiana
ccccgagtatttcgatctcacaacagtgcccgtggctactcaacgaagggcaaaccctagctctctccatctaattactgtattctctctgcttgtcgctgtcgtctccgctgaggtcttcttcgaggagagtttcaacgatggttgggaaagcaggtgggtgaaatctgaatggaagaaagatgaaaacatggctggagagtggaatcacacatctggcaagtggaatggagacactaatgacaaaggtatccaaaccagtgaagactacaggttctatgccatttcagctgagttccctgaatttagcaacaagggaaaaaacttagtgttccagttctctgtgaagcatgagcagaagcttgactgtggtggtgggtacatgaagttgcttagtggggatgttgaccaaaagaaattcggtggtgacactccctacagcatcatgtttggcccagacatctgtggctacagcaccaagaaggtccatgctattctcacttataatgacacaaaccacttgatcaagaaggaagtaccttgtgagactgatcaactgacccatgtctacactttcatcctccgccctgatgctacatacagcattcttattgataatgtggagaaacagtctggtagcttgtactctgactgggaccttctccctc

SEQ ID NO: 209 - DNA, 349 bp, Nicotiana benthamiana
cccaccccccccaagttgttatccaaaaagagggcgccattaaattgtttacacgacagtctaaacctagagtaggatctgtacaggcattaggtgcaatttactcaaaaggcttcctattttttcggaatgccgcctcttttgagctctgtatatctgtcatgttagttatttcattgttgtatcttcctgcctttgaagttttcaaggcacttgccattttagagatgtacccatatttcctttacctccctaaccatttctgttccctgtacaaatgataggcttgtatttgttgtacatttactgggaatacccttatttattttgatattctggaaaattatcg

SEQ ID NO: 210 - DNA, 652 bp, Nicotiana benthamiana
ccgacttcacatcccacttcttacttagaatgttgattgatatatattccttttggatatttgtctaattaggctttaactttagcattagatatgagtttaataacactcaaaaaccactgcattattctactagtgacactgatttttcctgcaatttgctattgtgaagaagccaattctctttacactagagcaacttattatggcagccctgattgctatggaacccctagtggagcatgtggatttggtgaatatgggaggaaaatttatgatgggaaagtgagtggagtttctaggctctacaaaaatggaactggctgtggtgcttgctaccaggttaggtgcaagataccaggtcattgcacagatgagggtacaaaaatagtagtgacagattatggggaaggagaccataccgattttatactaagtgtacgtgcctattcagaaatggctagtcaaggaatggctaatcatttattggcctatggagttgttgacgttgaatatcgcaggattccttgccgttactatggttacaatttaatgattaaagttcatgaaaacagtaggttttgtagctatttggccattctcccaatctatcaaagtggttcatttgacgttcaagctgttgaagtttggc

SEQ ID NO: 211 - DNA, 651 bp, Nicotiana benthamiana
ccccccgagccctgctctatcccatttcccgggtctactctacctgaaaataggagaaatatattctctaaaatgatatccagaaaagagagagaggagagaagaaaagcttagtactgttatgtctactttgtgagagattccacaatttcttatcctccaaattttagaagaatgagttcatatactagcataaaatgccctactgctgttagaaactccacaactcaattccctcatccaagaacaccaacatctaggaatgaaaaagcttcttatcctttcagtaaaactaaacccctcatctcccagatttcactctctactagctgctcatccttcagtcaccaaagtaaagcagataatctcaaccaatgtctagccgaaacaagaacctatagtgctagttctgaagacaaatatcccactatgtcagaaataatggaagcatcaagagcccaaaatcttgatcttcaccttcaaaaattgggacccttttttagaataacagctaggagcttaaaaccccaaagggaacttggaaaagctgagggtttgttaagggtctggtttcaaggtaaaattctacacttggactccataagactaaagagagagactttggggatggaaaaatcaatatttgggatt

SEQ ID NO: 212 - DNA, 652 bp, Nicotiana benthamiana
ccccgactcttcccctatcctttcaatctctgtctccgccgctacgttcacttcaaacccttcaccggcgttcgaaaaccctaggccctaatttcttccatgtcctatcaatcgtttaggtagctccgtaagatcgttatttattcttatccgtcaatttatctgataaaagttggattcggaggaatggcgagttcgactacgagcaatgtttacatccacgtcatcgaagatgtcatcagcaaggtccgtgatgagttcatcaacaacggtggtcccggagagagtatcctcaacgagctccaaggattatgggagatgaaaatgatgcatgctggggcaatattgggtacaacggagaggaatccagctccgaaagggacccctggaggtccaataacaacccctgttcatgaccttaatgtgccttatgaaggcactgaggagtatgaaactcccactgccgatatattgtttcctccaactccattgcagactccgttgcctggtaccgcccagacaccgctacctggaacagtgcggacacccctcccgggaactgcccaaacacctcttcctggaacagcagatagcagctcaatgtataatattcctacaggtggcagtactccctttacaccgaatgagtact

SEQ ID NO: 213 - DNA, 87 bp, Nicotiana benthamiana
cccccccccctaatgacagaatacattatgagggttaaccagtgattgatgctaagcaagccgttgagttggtgatctttctttctt

SEQ ID NO: 214 - DNA, 576 bp, Nicotiana benthamiana
ctgttcccctaacaacaagaattcatttccaccaatggagcatccaaatacaagggaccatactgcacaaaaaagtaatctttgctgaaaacaacaaatggcaagaaacagcacttttacgtattacaattcacggaattcacaactacacaaacagcaaattccgatcaatgagcacagtccataggattgcaatcctaaacaaggaggcttcactcacattactgctgctcctctgctttcgatggtacttcgatctcatcagtcccatcatcctgcatatccgaggtccacaacgtaaggttatcaccaagaagctgcataatcaaggtgctatccttgtaagactcctctccaagggtgtcaagctccgcaatcgcctcatcaaatgcctgttgggcaagattacaagcacggtcaggataattcaatatctcatagtaaaacactgagaaattgagagctatccccaatcggatcggatgtgtacgggctaattcgacattagcaatatcctgagccgacttgtaagccgaaagagtattctcggcggcttcttttctctcagctccggtt

SEQ ID NO: 215 - DNA, 470 bp, Nicotiana benthamiana
cgaccatctcaaaatcacttgcttttttcgtctcattttctagagaaagaaacaacaagacgtacagaacgagagttcaagaatctgcaatgggagtggctcgagttaaccaattctggttgcatcttgtcatcctcttctccatctccgttgcttccatttctagcactgaactgaattgtgtatacacagcttatgttcggactgggacatactgggggtctggaactgactcaaaaatttccttgtctctttacgatgccaatggccatggtcttaaaatcaataacctacaagcctggggtgggcttatgggcccgggttatgactactttgaaatggaccaattggatatgtttacgggccgtggtccatgtttgactggaccaatctgtaaaatgaacttgacttctgatggatcacgtgagcaccacggatggtactgtaactacgtggaagtcacgtctaca

SEQ ID NO: 216 - DNA, 636 bp, Nicotiana benthamiana
cccctctttgttctccgagctgtaacaaaggcaaaagattacttggagcaggctgagtatgatactggtaatcctgaggaagatcttaaagcacagtcccttatgcgacagctactatacagccccaaactgcaggctgcatgtccagttccttttgacgaagctaaactgtggaaaggccaaagtggacctgagctaaagcagcagattcaaaagcaattcaggaatatcagcgctatcatggattgtgtaggatgtgagaaatgccgactgtggggaaagctccaggttcttggtcttggaactgcactaaagattctcttctctgttgatggtgaatatcgccatgataaacatctgcagttgcaaagaaatgaagtgattgctctggtaaacctccttaatcgactatcagaatcgatcaaacttgtacaggaaatgagccctacgtttgagaagacaattggggggctaagtctacagccagctgctaagctaataagttcatggaaaagactatgggaaacagtagtaggggataggtaaacatcactctctgttgtttgtgattagttatttgaatctaagggtcaggtgatttagcttctgctattctttgttttcaaagcttgaaat

SEQ ID NO: 217 - DNA, 678 bp, Oryza sativa
ccccccagataaacccaagaacgattagggcacacgaaaccatggcgacgcaagcgacggcgagagaaattgcggtggtgggagtgatcggcgcggggcagatgggctcgggcatcgcccagctcgccgccgccgccggctgcggcgtcctcctcctcgactccgacaccgccgccctctcccgcgccgtcgactccatctcctcctccctccgccgcctcgtcgccaagggccagctttctcaggcctcctgtgagcattccatcgagcagattaagtgcgtctccagtgtgcaagagcttagggatgcggatcttgtgattgaggctatcgtggagtcagaagacataaaaaagaagctgtttgttgagctggataagatcactaaaccttctgctattcttgcctccaatactagctcaatctctataacccgattggcttcagccactaatcgcccctgtcaggtgattggtatgcacttttttaaccctcctccgataatgaaattgattgaaatcatacgtggggctgatacatcagaagaggttttcactaaagtcaaatctttttctgaaaggcttgggaagacggtaatatgctcacaagactaccctggtttcatcgtgaaccgcatcctcatgccaatgatcaacgaggcgttctgggcactttaca

SEQ ID NO: 218 - DNA, 623 bp, Oryza sativa
cgaccaccctccttgttacagctgtgccgcctcttgcttcctcctcctcatcgtccgccatggcttctctcaccgatctcgtcaacctcaacctctccgacaccacggagaagatcatcgccgagtacatatggatcggtggatctggcatggatctcaggagcaaggctaggactctctccggccctgtgactgatcccagcaagctgcccaagtggaactacgatggctccagcaccggccaggcccccggcgaggacagtgaggtcatcctgtacccacaggctatcttcaaggacccattcaggaagggaaacaacatccttgtcatgtgcgattgctacacgccagccggagaaccgatccccaccaacaagaggcacaatgctgccaagatcttcagctcccctgaggttgcttctgaggagccctggtacggtattgagcaagagtacaccctcctccagaaggacatcaactggccccttggctggcctgttggtggcttccctggtcctcagggtccttactactgtggtatcggtgctgacaagtcttttgggcgtgatattgttgactcccactacaaggcttgcctctatgccggcatcaacatcagtgga

SEQ ID NO: 219 - DNA, 591 bp, Oryza sativa
aaaggtgatcactaataacaatgatgataaaaccacatgtggaaaggaggacgatgatccacaggatgggacaagtaccgtaggtacggccattattggaggattacacaagagcacccaaacgcactcacccaaaagacgaagaaaaagctaatctaaatggcagatgagcaatgtagtagtagtggtagcatgcaaccaaatcgaaatggaatgagaatttttttggcgtgattttcttttttttctctttccttttttttttttttacttctcccagcacaaatgcaattcaccagatcgtccgatcaatggagcaaccggagcgacacggcgagctggggaggacgatgacgaggatgtcgtggcgtcaaaaagccgcttcagggcttccagatgatggtggtctcggcgatcatggaggtgacgacgtaagggtccatgttggacgccggccggcgatcctcgaagtagcccttgccgttctgctccgtctcccggccgacgcggaccgaggcgccgcggttggcaactccccagctgaaggtgttgatgtcggcggtctcgtgcctgccggtgagccggcgctcg

SEQ ID NO: 220 - DNA, 705 bp, Poppy
gaattcgagttttggaaaaaagttcctgtaagggaaccatatcgtgttatacttagtgatgtgagggataagctgtatcagactcgtgagcgctctcgacatttactatccaatgaaatttcagaggttccagaggaggcaacatatacaaatcttgagcagttcttagagcctctcgagctttgttacagatccctttgctcttgtggtgatcgagcaattgctgatggtagccttcttgatttcttacgtcaagtttctacttttggtctctcactcgtgagacttgatattaggcaagaatcagataggcacactgatgtcatagatgccatcacaaatcacctgggcattggttcttacaaagagtggtccgaggaacgccgtcaagagtggctcctctctgaactcagtggaaagcgaccactttttggccctgatcttccaaaaaccgaagaaatcgctgatgtgttggacacattccatgtcctatcagaactcccttctgacaactttggtgcgtatattatctcaatggccacatccccatcagatgtattggctgtagagctcctacaacgtgaatgtcacgtgaagaatcccttgagagttgtaccgttatttgaaaagcttgcggatctagaagctgctcctgctgccatggctcgtcttttctctgtagaatggtacaggaatagaatagac

SEQ ID NO: 221 - DNA, 697 bp, Poppy
gaattcaatcaaatggctactgctagagttttggctgctagtatgttgcatgaatgcaacaacactcacagtgcttcatttcttttgagacaatcttctttcatcttacctattaaacatcaaagtattaatttcagtagaagagcatcttctaggagagcttttacttgcaaatctctttacaaacctgaaattcaaatcaaacaagaaggtgaacctcaaaccctagattacagagtcttctttcatgataaatctggcaaaaagctttcaccttggcatgatgtaccattgcaattgggtgatggagtgttcaattttatcgtggaaataccaaaagagacaagtgcaaagatggaagttgcaactgatgagccatatactcccattaaacaggacaccaagaagggaaaacttagattctacccctacaacatcaattggaactatggattgctcccacagacatgggaagacccaacagtagctaattctgaagttgaaggggcattcggagataatgatccagttgatgttgttgaaattggggagaggcaaggaaaaattggcgagattcttaaagtcaagcctttaggtgctttggctatgattgacgaaggagaactcgactggaaaattgttgcgatttcgttggatgacccaaaagcttcactcgtcaatgatgttggtgatgttg

SEQ ID NO: 222 - DNA, 657 bp, Poppy
gaattcagagtatacggagacgacgaagaagaaggcgcgcgccatcaccatggctgcaaacgcaacccaccaattcctcaaaattctatcttctaaaaccctaaaccctacattatcatcaccattaactcaaattcgaaaattcccaatttctcaaaaccccagaaaatatacttcagttttacaagctgctgtgaacgataatgttagtagtagtggaggtagatctggaggtctttcatcacctcctcctccatctgtgaatgaaatttctgagagaattgatattaatcctcctaaaggaactagggattttcctcctgatgaaatgcgacttcggacttggctttttcagaatttcagagaggtttctcgattgtttgggtttgaagagattgattttcctgtacttgaatctgaagctctttatattagaaaagctggggaagaaattagagaccagttatatagttttgaggatagagggggtcgtcgtgttgcgttgaggccggagcttactccttctttggcaagacttgtgctacagaaaggaaaatcttctccactcccattcaaatggttcgcaataggacagtgttggcgctacgaacgtatgactaggggacgtcgtcgtgagcattaccagtggaatatgga

SEQ ID NO: 223 - DNA, 623 bp, Poppy
gaattcactgcaattattcttgtttgttttgttcatcccgcttttggtctgttggtactccttctgtctcatgctctatattgtcatacagctctctgtaggtacgtgcttgggcttgtgcaagttttcttcctaatgtgtaatgtggctgtcatggttacaccttttcaccacgtcatacatcatctgatttattaccaaatttgttgatgatttattaccatctgattcataaatttaagttttaccctactagctgtcaagctcttgatccgcactacacataagaaatgtatcatctgatttgtaacataatatgttgcttgtttggtgcattatgtttagttttacactacacgcccttgatccttgctacccacaattttagtttttagagtagttatgtaggtttaaaggcttggtttctgtttgaagttgatgacttctcatttaagctatcacaatccttggttcactgctatatacttgattcatgatcgaccggttcaccacttattcatttgttttgtgattggtagaattaatgttagttgaagagacgtgattttatgggaggatgtgagtgacataggttgaccattatacaattgtgaaatttgact

SEQ ID NO: 224 - DNA, 627 bp, Poppy
gaattcgaaacccagtgaagcacttgggaaacgaacacaatgtctttttcgacaatcaaaatcattcaacctgtcccagttactagatctcatgaaaaatccattcttgaccctttaaaatcaaacaacaattccttcttgggcactactaataatcttcgttcaatctcatccaaatcgaatttcccttcatttattcgtcgatcttcttcaatttcagctgtttctgatgtcgttaaggagaaaaaactcaaatctaactccgccatctccaatttgttgataactaaagaggaaggactggtattatatgaagatatggtattagggagagcatttgaagatatgtgtgctcagatgtattacagaggtaaaatgtttggatttgttcatctttacaatggacaagaagctgtttcaactggatttattaagctattgaaaaaggaagattctgtagttagtacttaccgtgatcatgttcatgcactaagtaagggtgtacctgctcgtcaagttatgagtgagctctttggtaaggctactggatgttgtcgtggacaaggaggatctatgcatatgttttccaaagaacataatttacttggtggatttgcgtttattggt

SEQ ID NO: 225 - DNA, 629 bp, Poppy
gaattcaatggcttcttcagtgatttcctctggtgcagtcgcctccgtgaggagctctgctcccgctcaagctagcatggttgcaccattcagcggcttgaaatccgttgctgcattcccagttacccgcaaatcaaacgacatcacctccgttgccagcaacggtggaagagttaactgcatgcaggtgtggccaccaagtggtttgaagaagtttgagaccctctcataccttcctccattgaccgttgagcaactatcaaaggaagtcgattaccttctccgtaatggatgggttccctgtttggaattcgacgccagaggattcgtttacagagaacacggtaacacccctggatactatgatggtcgttactggacaatgtggaagctgcccatgttcggttgtaccgacgcttcccaggttatcaaggagctagaggaggccaaggctgcatacccagactctttcatcagaatcatcggattcgacaacgtccgtcaagtacaatgtgttagtttcatcgcatacaagccagagagtactgcctactgaaaacctttgatggattgtgtctttttattaatttcttccctgttggtttgtacttttggagctggtcgctaat

SEQ ID NO: 226 - DNA, 596 bp, Poppy
gaattcacacacatcttttcctttctctctcggtgttcgtttttctctcaaatctctaaatcaatggcgtccgaaggtattctattgggtatgggtaatccccttcttgatatctctgctgtcgtcgatgagcctttccttgagaaatacgacatcaagttgaacaatgctatccttgctgaggaaaagcatgtgcctatgtacgatgaattggctgctaaagacaatgttgagtacattgctggaggtgcaactcaaaattctatcagagttgctcagtggatgctacaaactcctggtgccactagtttcattggttgcatcggaaaggataaatatggtgaagagatgacgaaaaactcaaagcttgctggtcttaacgttcactactacgaggatgagaccgcagctactggtacatgcgctgtttgtgttgttggtggcgagaggtctctcattgccaacctggccgcagcaaattgctacaaatccgaacatttacagaaaccagaaaactgggctttggttgagaaggctaaatactattacattgctggatttttcctcactgtttcccccgactccattcagcttgt

SEQ ID NO: 227 - DNA, 583 bp, Poppy
gaattcaaggagttctctacatcagatgcaggtgggaaagattgtaaagttgaaagcttttacaaagtttgagaacacctccgaggctttgtccactgctactttacttattgatagcaaaccaagcaagggtcttcgtaagttcttgaaggctcattgcgatggtgaaacattgggagtagctgattctaaactaggaaatgccatcaaggagaaactgcaaattgattgcgtccataacaatggagtaatggagctgatgagaggtgtcagaagccagttgactgaactcatttcaggccttggtgttcaagatttggctccaatgagtttgggtttgtctcacagtttgtccagatacaagctaaagttcagccctgataaggtggataccatgatcattcaagctattggtttgttggatgatcttgacaaagagcttaatacatatgcgatgagggttagggaatggtatggatggcactttccagagcttgcaaagattgtatcagacaatatcctgtacgccaaagcagttaagctgatgggcaaccgtacaaatgccgctgatcttgatttctct

SEQ ID NO: 228 - DNA, 645 bp, Poppy
gaattcaacagaggaagagagagaaaaaagagagcttttatttatttcgctgcttcttctgtttctccttgtttgattcttttcaaatctcaaattcctcacttattcacttacacacacacacactctctctctttcttgattgttgaactcatctcttgtttccttagccgccatggatctagatctgtggattacaaaggttaaagaaggtcaacatttaatggagaacgaacttcaacttctttgtgaatatgtgaaggatatcctcatcgaggaatctaatgttcaacctgtaaatagcccagtcactgtttgcggtgacatccatggccagtttcatgatcttatgaaactcttccagactggcggtcatgtaccagaaactaattatatatttatgggcgatttcgtggatcgtggatataacagtcttgaagtcttcactattcttttgcttctaaaggcaagatatcctgcacatattactctattgcgtggaaatcatgaaagcaggcaattgactcaggtttacggtttttatgacgagtgccaaaggaaatatggtaatgctaatgcctggagatattgcactgatgtatttgactatctcacactctcagctattatagatggaactgttct

SEQ ID NO: 229 - DNA, 503 bp, Poppy
gaattcaaggatacttcctccctatcttccgggggttcaatcgaattacttcaagataagttgtcaatggcatcccagctagtccgtgaatggatcggtattaaacagttccctgcctgccacacagactaaatcgttcgagttacttgggaaactaaagcaagaggaagtgagcacgttgacaatccttgtaatggggaaaggtggagttggaaaatcttccactgtgaattcccttgttggagaacgagttgtagctgtcagtgcattccagtccgaagcatcacgacctgttatggtatcacgatcaagggcagggttcacattgaacatcattgacacccctgggcttatagaaggaggatatgtcaatgatcaagctcttgagattataaaacggtttcttctgaacaagacgatcgatgttttgctcctatgtacaccgcttggatgcctatagagtggataatttggatagacaaattattaaggccattactgat

SEQ ID NO: 230 - DNA, 680 bp, Poppy
gaattcaaggcttacggtggatacctaggcaccgggagacgaggaagggcgtatcaagcgacgaaatgcttcggggagttgaaaataagcatagatccggagattcccgaataggtcaacctttcgaactgctgctgaatccatgggcaggcaagagacaacctggcgaactgaaacatcttagtagccagaggaaaggaaagcaaaagcgattcccgtagtagcggcgagcgaaatgggagcagcctaaaccgtgaaaacggggttgtgggagagcaatacaagcgtcgtgctgctaggcgaagcggtggagtgctgcaccctagatggtgagagtccagtagccgaaagcttctcatcttctcaagtacgattctaccctcggcatttttgatgctgatgtcaagcctgttggtgacgatgctatctctgttgatggcaagatcatcaaggtagtctccagccgtaaccccctcgacctcccctggggggatatggaggtggatctagttattgaagggacaggagtgtttgtggacagagaaggtgcagggaaacacatacaggcaggtgctaagaaggtgttgatcacagcacctggtaaaggtgacattcccacttacgttattggtgtcaaccaaaaactttacacccacgccgatacaatcatcagcaatgct

SEQ ID NO: 231 - DNA, 645 bp, Poppy
gatccgagaagagaaaatcaatggaagccatggctggtgtcggtggaagttcatgtgttatctcgtctattcattcatcatcccgtagaaatggagccttatctttatcttactcttctcaaaatcttaccttgcgcaacactaatcatcttgcagcatttcgttcatcttcttcacttttatcattttctcatgttaaaatacattccaagaaaaataaaccccatatcttccttcctcacttggttgcttccatggaacaagttgatgaaacttatattatgattaagccagatggagttcaacgtgggctggttggagaaataatttctaggtttgaaaagaaagggtttaaattgactggtttgaagctatttcaatgtcctaaagaattagcagaggagcattacaaagatctaagttcgaagccgttcttccctagcctcatcgagtacattacttccggcccagttgtttgtatggcatgggagggtgtcggtgttgttccatcagcacgtaagcttataggggcaacaaatcctctccaagccgaaccaggcaccattagaggggatttagctgttcaaacaggaaggaacgtcgttcatggaagtgacagtcctgagaatggcgagcgtgaaattg

SEQ ID NO: 232 - DNA, 689 bp, Poppy
gaattcaccaactcccatctaatcccaaatcccggcactaaaattatttttttagtgagagaaatctttttttggggttgagaggagagagagagacacacagagaaaaaatggcgatggcaatggcacttcgtaggctctcatcttcttcaatcaacaaacctatccgtcctctcttcaatgccgattcctactattgcatgtcatctcttccaagtgaagctgttgatgattctaaggataaatctcgtgttcaatggccaaagcaattgaatgcaccattagcagaagtggatccagagattgctgacattattgagcttgagaaagctaggcaatggaagggtctggaattgattccttcagagaatttcacatctgtgtcggtcatggaagctgttggttctatcatgactaacaaatacagtgaaggttatcctggtgctagatactatggaggaaacgagtacattgatatggcagaaactttgtgccagaaacgtgccttggaggctttccgtttggatcctgctaaatggggagttaacgtgcaatctttgtctgggtcccctgccaatttccaagtctacactgcactattgaagccccacgagagaattatggcacttgaccttccacatggtgggcatctttctcatgggtatcagactgacaccaaaaagatatct

SEQ ID NO: 233 - DNA, 616 bp, Poppy
gcgacgaattcaagtgaaggcagcccattcctacctctgagccctgaaacaccattcttgtctgtgtctgaatttcactctaatctctgtataatcatggcgattacaacaccattatcacaatcaaatctctattcaacaaacaatacaatcatcaaaacaccaagactgattcatcaaattcaatccaattcaatttcattgaatttgaggaacccaagcttccaaaacgagttgtgggggaataggaattgttctctggttgttcagaggggggtagcggcatctgtgattacagcaactgctgctgctgagaaacagaagaagaggtatcctggtgaagggaaagggtttgtggaagaaatgagatttgtagctatgaaattacatacaaaagatcaagctaaagaaggtgagaaggaatctcaagcgcaacctttggggagatgggaaccttctattgaggggtatattcaatttcttgttgatagcaagtgtgtttatcatactcttgagagtattgttgataaagctgctgttccttcatatgctgagttcagaaatacaggattggaacgggcaggagcattggctaaagatctggagtggtttaaag

SEQ ID NO: 234 - DNA, 616 bp, Poppy
gaattcaggagagagaaactaaaacccccaccaggaaaaaacaagaaaaaaaaaaatggccgtctcagcaggatgtgctagggttctaccggtttttgaatgtagatcagatccagatttctctacaaaccagaaccagcagaaatcaagttccagattcatttctggatctttcaatggtggtggtgggttatattcatcattgattctgcggtttcctcctaatttcgtgaggcaattgagtattaaagcaagaaggaattgtagcaatattggtgtagcacaagttgttgctgcttcctggtcaaacaatgacaataccaacaagaaggttcctaatgtatctgctgtcgattctgcttctgctgcttctgagattgaagaaattcctttgattgatgatgaagttgtggatgctggggttgatggtggtgatatttgtaataataatggtgtacagttgtctggtttggccgctttaaaggcctcatttttacgctccgatgggagcatcacagttcatgcaggagaatgattaggtcgtggaattgctacagatggaatcactaccccagtcgtcaatacttctgcttattggttcaagaactccaatgaa

SEQ ID NO: 235 - DNA, 615 bp, Poppy
gaattcaacaatgggtagtcttccaactaataacggtgaaagcatgtcaatatgttcacagaacccacttgatccatatgaattcagaaggcaaggtcacatgataattgattttcttgccgattactacaaaaatgttgagagttatcctgtcaggagtcaagtcgaacctggttacttgcggaaacgattacccgaatcagctccaaacaactctgaatccattgaaaccattctccaagatgtcacaaacgatatcatcccgggtcttactcattggcagagtccaaattactttgcttattttccttctagtggttccattgctgggttccttggtgaaatgcttagtactgggtttaatgttgttggtttcaattggatgtcttcaccagctgcaactgagttggaaagtattgttatgaattggctcggtcaaatgcttacacttcccaaatcgtttctcttctcgtcagatggaagttcaggaggaggaggtgttctacaaggcactacttgtgaagccattttatgtacactaactgcggcaagagataaaatgttgaacaaaatcggcagagaaaatattaacaagctagttgtctatgcttctga

SEQ ID NO: 236 - DNA, 606 bp, Poppy
gaattcacctaaccaaccagcactaaagatcttcgtccatccctttgttgaattcatttgtctctctgtttcacaccttgaaagtttgaagtagaatctatctatcaatggcaacagtcatggcaaagattgcaccttcaatgctctcatctgattttgcaaatttagcttctgaagctgaaaaaatgatcaaatttggcgctgattggcttcacatggacatcatggatggccattttgtcccaaatcttaccatcggagcaccggtaattgaaggtttaaggaagcacacgaaggcatatctagactgtcatcttatggtcacaaatcctcttgattatgtggaacctctaggaaaggctggtgcttcaggttatacttttcatgtggaggcgtcgaaagatgattggcaagaaattatcgacaaagtcaaggcaaagggcatgcgtgctggggttgcactgaagcctggaactccaatcgaagaagtttatccactggttgaagctaaaaaccctgttgacatggtccttgtcatgacagttgaacctggatttggaggtcaaaagttcatgccagagatgatggataaggttcgtgcattga

SEQ ID NO: 237 - DNA, 601 bp, Poppy
tcgctaattttaataacgcctttaataatgtcgcgtttgggggtaactgactcttcaaatgcctgttgtacatcccgataatcgtaaatatgcgtcaccatcgatttcacatcgaatcgccctgaagaaatagcttcaatcgtgaccggataacgattggcatagcggaataccgtctggatagtgacttcgcgattgattttgaggaaattgattgccgaatcgccgggtacagtaccaacaatcataattttaccgccgcgcattaccagataaggtgcctgtttaacggtgaccgcagaacccgctgtttcgaaaacaatatctgcgcccatgtcttcggtaaattgctgacagcgtgcaatagtgtcttcttttgcgccgttaataaccactgtcgcaccaagctgttccgccattgccagacgtttttccagcacatcaacgacggcaatttccgttgctcccaggcatttgcacgcttgcaacgtcatcaaaccaatacaacctgctcccagaataattatcttcttacccggtttaacatctgccagcatcgcggcatgcatcccgactgcggcaggctccaccagcgcccctt

SEQ ID NO: 238 - DNA, 628 bp, Poppy
gaattcgatcaacatcttttagaatccttcttgagcgaataaatttctatggaaaaatggagcatcctgtagtagtgtttagtaatgattttcagaccttcctatataattcgcattcatatacatgagaattatataggaagaagaaaaagcgttgattctcctttgaaaaaagggaaattgctttattttgagtaataagactatagcaattacgatactcatggagaaagaatcgcaataaatgcaaagagggaacatcctgtagtagtgtttagtaatgattttcagaccttcctatggttgttcaaggatccttttatgcattatgtcagatatcaaggaaaatcaattctggcttcaaagggaagtactcttttgatgaataaatggaaatggaatcttgtaaatttatggcaatgtcatttttccttgtggtctcaaccagatagaattaagataaataaattatccaatcattccctcgagcttttgagctatcttgcaagtgtacgacttaacccttcggtggtaaggagtcaaatgatagaaagtacatttataatggatatttgtattaagaagtttgataccaaagtcccaattatttctttggttgggtcgttgg

SEQ ID NO: 239 - DNA, 629 bp, Poppy
gaattcaggagaaaaaccagaaactggtttcatcgtgagtgatggcaaacatgatcatggcttcctcatctaaaaccctaatcacatctccttcaatccaatcaacaccaaaattccaacttccccaattcacaaccctaagaatcagaagccaagccaatcaaaccagcaccagcagcaacaaaatcaaactcccaactctaaacctaaactcactcaaatcaacagcagcaattgcagcagcagttctaacaatggctccaccatcactagcagcagaaattgagaaagcagcattgtttgatttcaatcttactctaccactaatcatggcagaatttctcatacttatgtttgccttagacaagatttactacactccattgggtaactttatggatgcaagagatgcagatattagagggaaattgaacagtgttaaagatacgtctagtgaagtcaaggaattggatgaacaagctgctgctatcatgagagcagctagagctgaaattgctgctgctttgaaccagatgaagaaagaaacaactgtggaagttgaagcacagatggctgaaggaaggaagaaattggaagctgaattggctgaagctcttggtaatttggag

SEQ ID NO: 240 - DNA, 726 bp, Poppy
gaattcaaggagaaaggggatctccttgtcttatgggtcttgttgggttgaaagaatcacaaggagatccattaagaagtacagacaaagatgttgtacttatacattgatgaattaagtgacaccagtcttcactaaaaccaaaactagtaaggattttcatgataaatggccattctagtctatcaaaagctttggacatgtcaagcttgagggctaaccatccactttcaccttgttttctcttcattgaatgaattaattcatgggcaatgattgtgttatcatttatcattctgccagagacataagcagcttgataaggagaaatgatagagttcatgaaaggcttcattctattgacaaggatttttgagattatcttgtaagaggtattgcaaaggccaattggcctgaattcagatggagaagttggcttacttttctttggaattaaggagatgaaagtcttgttaattttagatggaagatatttagcatggaaaaatcttttaaccatttcacaacagtcagggcccacagtttgccattgtgatttgtagaaaccagcttgaaatccttctggtccaggtgcagaccaattttccatgcctttgagagtttttaagacttcatcatctgaggggagagccatcaaccttatattatcttcatctgtaattacagaaggaagaacagaataatgatgttcttcaataactggtg

SEQ ID NO: 241 - DNA, 584 bp, Poppy
gatccaaaataaaaagagaagcagcactgagaagagaagagcgagaaaccaacaaaaaaatggctctgacactcaatcctctaacatttcaatctcctcaaaagcttccaacttttggtttcccaaatgttgccaatgtcagatctcctaaagttttcatggcttccactctccgcacctccgctaaggagacggagaatgccaagaaacccttcacccctccacgcgaggcgcatgttcaagtaacccactctatgccacctcaaaagattgagattttcaagggcttagaagactgggcagatgacaatatcttggtacacttgaagcctgttgagaaatgttggcaaccacaacatttcctacctgacccagcctcagatgggttctatgatcaagtcaaggagctgacagagagagcaaaggagatccccgatgattactttgtttgtctggttggggatatgatcacagaggaagcccttccaacatatcaaactatgctcaacactttggatggagtcacagatgaaacaggcgcaagccccacttcttgggctcgttggacaagggcttggactgct

SEQ ID NO: 242 - DNA, 672 bp, Poppy
gaattcagagaaaaacagagagctagatagataaggtgtcattgttaattcatcatattcattcgtcaaatatgtctcttctaacagatcttatcaacttagatctctcagacaaaactgagaagatcatcgctgaatacatatggatcggtggatctggtatggaccttcgaagcaaaggaaggacattacctggacctgttagtgatccttcaaagctaccaaaatggaactacgatggttctagcactggacaagctccaggagaagatagtgaagtcatcctatatcctcaggctatcttcaaagacccattcaggaggggaaacaacattcttgttatgtgtgatgcttacactccacaaggagaaccaatcccaactaacaagagatgcgctgctgcaaagatcttcagcaatcctattgttgagaaagaagttccatggtacggaattgagcaagaatacaccctcttgcagaaggatattaactggcctcttggatggccccagggaggctttcctggaccacagggaccttactactgcggtactggtgcggacaaggcattcggacgtgacattgttgatgcccattacaaagcctgtctctatgcaggaattaacatcagtggaatcaacggagaagttatgcccggacagtgggaattcc

SEQ ID NO: 243 - DNA, 728 bp, Poppy
aacaacgcaacaatgggggcctcattaggagctccaagagccacaactttttcatcaaaaactctaataaatctctgcagaagagtaccaattttccttccacgtagatcatttcattcctctactcaattccaaaccctaaaattcattcccaatacttacagagaacgtcgttccagtgttagagctgagactccatcagaaaacggtggtgtaaattacgattatgacctatttacaatcggtgctggtagtggtggtgttcgtgcttctcgtttcgcttctaattttggtgcttctgttgctgtctgtgagctcccttttaacactatctcttctgatactgctggtggcgttggtggaacgtgtgtacttcgtgggtgtgtaccaaagaaattgctcgtctacgcctccaaatattcacatgattttgatgatagttgtgggtttggttggaaatatgaatcggacccagttcatgattggggaacattgatggctaataagaatgctgagttacagcgtcttactggaatttacaagaatatattgaaaaatgctaatgtggccttaatcgaagggcgtggaaagattgtggatcctcacactgttgatgtggatgggaagctgtataaagcaaggcacattcttatatcagttggaggaaggccttttattcctgatatacctggaaaggagtatgctattgattctgatgctgcacttga

SEQ ID NO: 244 - DNA, 709 bp, Poppy
gaattcgaagctaatcaaagaattgcgaggattgcgagctcatcttcacccttctaatctccagatggagggaagttctggtttgagacgggcagattgccgagcaaaaggtagtgcaccagggtttaaagttgctatcttgggtgctgctggagggattggtcaacctcttgcattgttgatgaagatgaacccattggtatcagttctccatctctacgatgttgtcaatgctcctggtgtcaccgccgatgttagtcacatggacactggtgctgtggtacgaggttttcttgggcagccacaacttgagaatgcactaacagggatggatcttgtaatcattcctgctggtgttcctaggaaaccaggaatgacaagagatgatttgttcaagatcaatgctggaattgttagaactctagctgaaggcattgccaagtgctgtcctaatgctattgtgaacttgatcagcaatccagtaaattcaactgttcctatagcagctgaggttttcaagaaggcaggcacctttgatcctaagaagcttctcggagtcacaactcttgatgttgtcagggctaacacttttgtggcagaagttttaggggttgatccttaagaagttaatgttcccgtagttgggggtcatgcaggagttacaattttacctcttctatcacaggttaaccccccctaaatgagtatg

SEQ ID NO: 245 - DNA, 665 bp, Poppy
gaattcaatagtgatggcagcaacagcaacatcagtgtggaggattagttccaacacattcatcatcagttgttaacaaaaatacaacatgtttcttgaaatcttcgaatcaccaatccctctcatcttcatcttcttctcatgtttctagtgatcaactttcactaagaactgtttttaataacacaaaaatctccacatccggtggaagaagaagaattccgtttgttgtttctcccaaagctgtttctgattccaagaattcacaaacttgtcttgatccagatgctagcagaagtgttttgggaattatacttgggggtggagctgggacacggttataccctcttacaaagaagagagcaaagcctgctgttccactgggagcaaattacaggctgattgatatccctgttagcaactgcttgaacagtaacatatcgaaaatatatgttcttacgcaattcaattctgcctcgctgaatcgtcatctttctcgggcatatgctagtaacatgggtggaaaaatgaaggttttgttgaagtccttgctgctcagcagagtccagagaatccgaattggtttcagggcacagctgatgctgtgaggcagtatttatggttgtttgaggaacacaatgttatggagtaccttattctagctg

SEQ ID NO: 246 - DNA, 593 bp, Poppy
gaattcagaggagaaaaacaagaggcggcgataatggggcttcaaggtcagcagactgtgagttaccctagtttcaaactagttattgttggtgatggaggaactggaaagactacttttgtgaagagacatcttactggtgaatttgagaagaaatacgaacccactattggtgttgaagttcatcctttggatttccacactaactgtggacctattaggttttactgttgggatactgccggacaggagaaattcggtgggcttagagatggatattatatccatggacagtgtgctataattatgtttgatgtcactgctcgtttgacctacaagaatgtccctacatggcacagagatctctgcagggtgtgtgaaaatatccctattgttctttgtggaaacaaggttgatgtcaagaacaggcaagtgaaagcaaagcaagttactttccacaggaagaagaacctgcagtactatgagatttctgcaaagagtaactacaactttgagaagcctttcttgtatctcgccaggaagcttgctggtgatgccaatctccactttgttgagtcacctgcacttgttcc

SEQ ID NO: 247 - DNA, 649 bp, Poppy
gaattcaagaacatggtttgcgaaacttaccacgtgtgcttattcgaaaaggttttttatgttaattctcttcgtcttctttctcatctttatgatcggtggagatccagaaagtagacgcttgtgcagaagagaatttccagttggttatggcctgcgcctctattttcattgcgctttatttttgtccttgtatcttgttttacagttgtttcatctacacttgacagtgatgaacaacagatggttgttccaaatacccatgttgtggtaataaagtatcgaatttctggattctcatttcaacaaacatgttcttgtcaccttatcaacacaatcaaattccagtactagcaaaaaccagtcaatcttgggcttctagtgtaatgggccgtttaaatttctatttttttttactttttttttataaagtaagtgaagtaaccctcctacttcaacaaaatattccacttatggaactgttaaatgccaggataccaaaagcagaagttggtttttttttttttgcatataaaagtcgttccgaaattatatacctataaactaatttactgtttgttaacttttagaagttaaaagaactatttcagggagtgtatcaaaaaacgccataaaaacaattctggaa

SEQ ID NO: 248 - DNA, 665 bp, Poppy
gaattcgctctatcacattcttcttcataatttctggtattacgaacttgctctcgtcttcttatcctgttgtcatggttattctgccgaattgcttcctctatttccaatccttccatctgcaaccttattctttctctttcgcgagcatctcgagctcttacttgaccatgttcagtttcctctatttgtggatttctttgattctcaacttcttctccattttgccttccattctcacgattttcttcattgttttgttgatttcttctctttcgtgcttcatttcgcaagctttctgcgttatgttcttggttaggaaggagaatgaatctattttctggatttctttctcctactccttgtgtttgaccttgaactgcattcccattttcctgaggatctcgtccttctctttctgatcttgcacttgatcttgtgatgctttgtgatctcctgctctgcaacatctcattctccctccttagttcgtgattttctctagtaagatttgcacgtgcttctgcttctcttcttcgttcttctagaaatctttcgttttgtgcttgtaatgtttccctttctctgttatgagtaactcttccaagtaatcttccgctttcatctatttgtacttccctttctgctcttgaaagtgaatctga

SEQ ID NO: 249 - DNA, 620 bp, Poppy
gaattcaaaccttggaggagtccaatgcgaatttggatgaagtggtcgctttggcaaaagagcttcagggaaacaaaatccatcctttgtggggcacagctcagttgttcatgcatcctcgctacatgcatggtgctgctactagctccgatgtaggtgtctatgcttatgccgcagcccaagtcaagaaagccatggaggtcacacattatcttggtggtgaaaattacgtcttctggggtggtcgcgagggttatcaaactttattgaacactgatatgaaaagagagcttgatcatttggcaagatttttggaaggtgctgttgcctggaagaaaaagattggattcaaagggactttactgatcgagccaaagcctcaagaaccaactaagcaccagtatgactgggatgcggcaactacagctgcatttctactaaaatatggactttctggtgaattcaaactcaacattgagtgcaaccatgctacactttctggtcacagctgccaccatgagcttgagaccgccagaaattttgggatgcttggaaacattgatgcaaacactggagatcctcagattggatgggatactgatcagttccttactgacatt

SEQ ID NO: 250 - DNA, 752 bp, Poppy
gaattcacaaaacatttcccttccttctctctcccgaaacacacaaaaaaagaaaatggcagctctgcaacaatccccagttgcattccaatcaaaattccccaccaccacatcctcatcatcaaccagagtatttgccaaaactcaaatctccagcaaactctcatccacaggactcagactcccaaaactgagcataaaactctcaaagaagaacaaaatcagcaacaaccatggtggtgcaacaatgttagacacagcagcaagtagatatgcaacagccttagcacaatcagcaaactcaaatggaacattagaagcaacacaacaagacattgaaaagattgaaaaaatcttcacatcaccagaagtttatgatttctttgtcaatccaacagttgctgtggagaagaaatactcattgatcgatgaaattgcaaaatcatcaaacctcaaaacaactacaatcaatttcttgaatatcttagttgatgtcaagagaattgatttgattagagaagttgtgaaggaatttgagttggtttttaatgcaatgactgatactgaattggctgttgttacatctgttgtgaagctggaagctaatcatttagcacagattgctaaaggagtccagagattgacaaattctaagaatgttaggattaagactgtgattggtccttctcttgttgctgggtttacaatcaggtatgggaattctgggtctaaattgattgatatgagtgtta

SEQ ID NO: 251 - DNA, 624 bp, Poppy
aacaacgcattgcgatggtccctgcggatgctaacgcaatgggatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagccgtctttggcggcgaaggtgaaataccactacttttaacgttattttacttattccgtgaggcggaagcggggcatcgcccctctttttagatccaaggctagcttgctatgccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacaaaccgtgaaagcgtggcctatcga

SEQ ID NO: 252 - DNA, 615 bp, Poppy
gaattccaaaacctcactctcatcgatataagcaagaccaccttgagcacgaatatctgctggtacacgttctaatgccatgacagcacaagcacctgcttcttcagcgattctggcttgttctgcattaacaacatccatgattactcctcctctaagcatctgtgctaatcctactttaacagagaatggtgaggtttttgcctctgttattgctccatttccatatactgttactattcctgtcatggctaaagctcgaattggtcatttcgttgaagctcagattcttgaagcgattggtgttgattatatcgatgagagtgaggttttgacccttgctgatgaagaacatcatattaacaagcataatttcaggattccatttgtttgtggttgtcgtaatcttggggaagtcctaaggaggattcgggaaggtgcggccatgattcgaacaaaaggtgaagctggaactggtaatgttgttgaagctgttaagcatgtgaggtctgtcatgggtgatattaggcttttgcgtaatatggatgatgatgaggtgttgtcatatgcaaagaaaattgctgctccttatgattgggctatgcaaactaaaca

SEQ ID NO: 253 - DNA, 657 bp, Poppy
gaattcacaaggaaagaaagtatttgttagagttgagttgaatgtaccattggatgataattctaatatcactgatgataccagagttagagctgctgttcctactattcaatacctaattagtcatggtgctagagttattctatcttcccatcttggacgcccaaagggcgttacaccaaagtacagcttgaagccacttgtgcccagactatcagagcttattggtatcaaggttgagatggcaaacgactgtattggagaggaagttgagaagatggttgctgctatccctaatggaggtgttctacttcttgagaacgtcagattctacaaggaggaagagaagaatgacccagagttcgcacacaagttagcttcccttgctgacctatatgtcaatgatgctttcggaactgcccacagagcccatgcctccactgagggagttaccaagttcttgagaccttctgttgctggattcctcatgcagaaggaacttgactatcttgtcggagctgtatcaaaccccaagaggccatttgctgccattgttggtggttcaaaggtctcatccaagattggagttatcgagtctttgttggagaaagttgatatccttctgttgggtggaggaatgatctttacattttacaa

SEQ ID NO: 254 - DNA, 696 bp, Poppy
gaattcagtttctctctactactccgccatggctaggtcttctgctttctccactccttccgtttttcagcaaaaatcaaatgtgggtaacctaaatatggtttcccctattattacatcatcatcggttaattttttggggaaaagaagtttgttatcatctaggtgttctagatatgcttcaggaggacttcaaatcaaacagatttctaatgttactactccagttgttggacataggaggatggtgtgtactaatgctgttgcaacaaatttacaagcagaagtcacaactaaggtattctttgatgtggacatcggaggagagccagcaggtaggattgtaatgggtttgtttggaaatgaagttccaaggactgttgagaatttccgcgctctgtgcactggagagaaaggttttggttacaaagggtgctcgttccatcgtattatcaaacaattcatgattcagggtggggactttactaatggaaatggaactggaggtaaaagcatttatggggaaaaatttgcagatgaggacttcaccttaaagcacgttggacaaggagtattaagcatggcaaatgcaggccctaataccaatgggagccagtttttcatttgcactgttaagactccatggttggatggccgccacgttgtttttggacatgttattgatggcatggatgt

SEQ ID NO: 255 - DNA, 666 bp, Nicotiana benthamiana
ttttaccaattttctaggatttattttttttaaatgatggtgggattagaagaagttcaaagtgatgagaagagtttgttattagagtatgtgaggaagtcatcgccgtcgccgttcttactgaaaacgtacatgctggtggaggatccggcgacggacgacgtcgtttcttggaattccgatgggacggcgtttgttgtgtggaagccggcggaatttgctagagatttacttccaactctcttcaaacatagcaacttctccagctttgtccggcagctcaatacctatggttttcgtaaaatagcaacaagccagtgggagttcagtaatgacaggtttagaaagggagaaaaggatttactatgtgatattcgtcgtagaaaagcatggacaaacagacaccaaccaaacaataacaataacaacaataataacggacagagtcaatgtgcgaacagtaacaagaaagaaactgaagatcaaaggtcatcgtcatcaacaacatcatcatctgaacttacaattcttgtggatgagaataaaagactcaagatggagaatggagtccttagctctgagctttcagtaatgaaaaacaagtgcaaagaattaattgatatagttaccatttttgctaaaaatccagagaaagaagaaaaaaag

SEQ ID NO: 256 - DNA, 669 bp, Nicotiana benthamiana
gggcttctctaaaacccttatagaagaagagaaaaaagcctctcaaatctcatctcaaaccacctaatttctctcatactcgctcgacccatggctctattagtcgagaaaaccacctctggccgcgagtacaaggtcaaggacatgtctcaggccgatttcggccggctcgaaatcgagctggccgaagttgaaatgcctggtctcatggcttgtcgtactgagtttggcccttcacagccatttaaaggtgctaagattactggatctttacatatgaccattcaaactgcagttttgattgaaacccttactgctttgggtgctgaagttagatggtgttcttgtaatatcttctccactcaagatcacgccgctgctgccattgcacgtgacagcgctgccgtgttcgcgtggaagggtgaaactttgcaggagtactggtggtgcactgagagggcacttgactggggtccaggaggtggtcccgacttgatcgtcgatgatggtggtgatgctacactcttgattcatgagggtgttaaggcagaagaagagtatgctaagaatgggacaatcccagatcctaactctaccgataatgctgagtttcagcttgtgcttactattatcaaggaaagtttaaagactgatcctttaaagtatact

SEQ ID NO: 257 - DNA, 655 bp, Nicotiana benthamiana
aagaacttgactgaattcaagctgaggaaattgctacaaaaggaaagaaaaaaaaaagattttctcaaatgggttttctcagttttacgcttcagttgatcgatttcctcgcttggccggtacttgctctgggctatcctatatgtgcttcaatccgagcgattgagactggctccaagtatcacatgaggaagctagtaacatattggaccatcttttcctttatttctctgttcgagcacgtatttgagaaccttattgaatgggttcctctgtggccttatataaaattaattactatatgttggttggtaatacctgagtttaacggcgcatgttattcatatcaacatcttgttcatccatgtttgcctttgaaactgcacaatgttattgctcagttttatggttcttgttatgtttaccaatactttgcatatttgtgctcgtttgtcaatcttcaaacttttattgactggtttaacaagccaatggaggatccatctctcaagaatgaaacatttctgtctgtggtggaaaggtatcttgaagaaaatggatctgatgctctggtgaaacttatttcaaacaagtggcgcactaatcagacagcatgtgaagggagtggtcctgtttgggaagatatcaaagtgat

SEQ ID NO: 258 - DNA, 637 bp, Nicotiana benthamiana
aactcctgaaatttatgctacagttgatttggaaaaggctaggggtgggagaaccagaaagattaaaaatgaaccaaaaaatccgaggtggtatgagtcttttcacatttactgtgcacatatggcttcaaatgttatattcactgtaaaagatgacaatcccattggtgcaaccttaattggaagagcttatgtaccagttgaagaacttttggaaggggaagagattgataaatgggttgagatactggatagagaaatgaatcctatagaagaaggttccaaaatccatgtgaatctacagttttttgatgtcagtcgagatcctaactgggcacgtggcattagaagttctaaatatcctggtgtcccttacactttctttgcacagagaacaggatgtcgggtttccttatatcaagatgcgcatgtgccagacaattttattcctaaaatccctctcgctgggggaaagtattatgagccccacagatgttgggaagatatctttgatgctattactaatgcaaagcacttgatatatattactggctggtcagtgtatactgaaataaccttggtgagggactcgaggaggcaaaagcccggaggtgatattacacttggggagctgctc

SEQ ID NO: 259 - DNA, 643 bp, Nicotiana benthamiana
ctcattctttcaactaattcaatacccccttttatttcttcaactttctacaacaaacaaactttatccatctccaaggaattgatgtgcagtggttcaaagagtaaagtttgtccttttgatttaaacatggataagaaaggcggggctagtaaaaattgctctaaattgcttgaattgtcagcttcagatgatcttgctggattcatatgtgaagtggaaaaaggttgtgggattgatgagttaagcttttggtatgttagaaattacggttcgaaaaagatggggtttgaggagagaactcctttaatgattgcttctatgtatggaagtattggggttttgaggtttattattggaactgggaaagttgatgtcaacagagcttgtggatctgatggtgcaactgctcttcactgtgctgctgctggtggatctgaattgacaatcgaggtcgttaagatcttgattgatgcttcggcggatgttaatgcttgtgattcaagtggaaacaggccacatgatgtgattgcttcttatcctaagtgtttgaggaattcgaaaaggaaatcgctcgagttgttgttgaatggtagcttggctgagctggaggaagaagaaggaaaagcagtgattcaaacga

SEQ ID NO: 260 - DNA, 681 bp, Nicotiana benthamiana
tatcagccttggactacatttagttcacattggaggaaactcaaagttgtgctaatatcgtctcttctcgctgtagggaacacaagtaaaagttagaagaccaactgattataacccctctctggctgcaacacttggtccgagccaaccgaatccaaaccttgaccttgctgcagtgggattatcaccaggatccactggtgggcttgaaggtcctgaccgtatttttgtgggaggcctgccatactatttcactgaagcccagattagggagttgctcgagtcctttggccctcttcgggggtttaatctggtcaaagataaagaaactggaaactcgaaaggctatgccttttgtgtttactctgacgtgtcggttacagatattgcatgtgcagctcttaacgggattaagatgggtgataaaactcttactgtcagacgtgcaagtcaagatactttacagcctaagccagagcaggagagtatattaatgcatgctcagcaacaaatagcactgcagagactcatgctacaacctggtggacctcctactaaagtcttatgcctaacaaatgtggttagcgcagatgagctcaaagatgatgaagactatgaagatatagtggaagatatgagaactgaatgcgggaaatttggtaatttagtgaatttagtcat

SEQ ID NO: 261 - DNA, 645 bp, Oryza sativa
gaaatctcgtcgcttcccccgggttcgattcgagtcttctctctcgcagcacaaagatggacgcaaacagacgccaaagtggaatccagcaattgttggctgcagagcaagaggctcagcaaatagtaaatgctgctaggactgcaaaatcggcaaggcttaggcaagcaaaagaggaggctgagagggaaatagctgaataccgtgcccagatggaggctgaatttcagaggaaggttgcagagagtagcggtgactctggtgcaaatgtcaagcgtcttgagcaggagacagcggaaaaaatcgcacaactcaagcagcaggctgcaagtatctcccctgaagtgattcagatgcttctgaggcatgtcactactgtgaagaactaagggttgatggcttgctgctaggcgatttgccatacatctgatggcaaacttgtactgtttattttttgagagggtggtaagaataacttcgtctcttctagctgtaattccgtgttccgaataacggaataaactgcttctgttcatcagcagccatgtttcgtactttgaaaacctcggttcctgtctggtaaatattatcctttcatgtatcatttgaacaaaataatgggagattctttttgttaaaaaaaaa

SEQ ID NO: 262 - DNA, 658 bp, Oryza sativa
gattgctttgctctgatctggttgatcgatctcgtcgtcggcgatggagaagttgctttcctcctccggcgccgccgccgccgtggcgtcgcagggccagctcccggactgcttcgtgttcccggccgaccggcgcccaccggcctccaccgcggccgtgtcgctccccgtcatcgacctctccggcccccgcgacgccgtccgccgcgccgtcctcgacgccggcaaggagctcggcttcttccaggtggtgaaccacggcgtgccgccggagacgatgcgggagatggcggcggtgtgcgaggagttcttccggctgccggcggaggacaaggcggcgttctactccgacgcggaggagaaccccaaccgcctcttctccagcaccatctacgaggtcggcgaccagcgctactggcgcgactgcctccgcctcgcctgcggcttccccgtcgccgacgacaccaacacccactggcccgacaagccccaccatctccgggatgtcacggagaagttcttcgtggcgacgaggggattggggatcgagctgctgcggctgctgtgcgaggggatggggctcaggccggactacttcgagcgcgacctcaccgccggcgatgtcatcatcaacgtcaaccactaccctccatgcccg

SEQ ID NO: 263 - DNA, 603 bp, Oryza sativa
ataacattatattgcagcaatgggatcctcctcccttctactcgcctgtgttgtggtggcggctatggtgtccgccgtctcctgcgggccacccaaggtgccaccgggccccaacatcacgacaagctacggcgacaagtggctggaagccaaggccacctggtatggtgcgcccaagggtgctggccccaaggacaacggcggcgcctgcgggtacaaggatgtcgacaaggctcccttcctcggcatgaactcctgcggcaacgaccccatcttcaaggacggcaagggctgcggctcatgcttcgagatcaagtgctccaagccggaggcctgctccgacaagcccgcccttatccacgtcaccgacatgaacgacgagcccatcgctgcctaccactttgacctctccggccttgccttcggcgccatggctaaggatggcaaggacgaagagctccgtaaggccggcatcatcgacacgcagttccgccgcgtcaagtgcaagtatcctgccgacaccaagatcaccttccacatcgagaaggcctccaaccccaactaccttgcgctgctagtcaagtacgtcgctggtgatggtga

SEQ ID NO: 264 - DNA, 623 bp, Oryza sativa
aatagagagagtgaaagaaagcgcccacacacactaacactaacacaaagtgggagagagagagagaggggatggaaatggcggatgagctggggcacttgctggtgttcgggttcctcttcaacctgggcgtttacatggtggcgccggcgatgaccgacgtgaccatggacgccctctgccccggccaggacgagtgctccctcgccatctacctcaccggcctccagcaagccattacagggttgggtgctcttgtggcgactccgatcgtgggcaacctgtcggacaaatatggtcgcaaggcgttgttgctgctccctgcaactgcatccatccttccgttggttattttagcgtgcaaccggacgaaggccttcttctacgcctactacatcaccaggatggtgacagccatggtcgccgagggcagcatgcactgcctctcgctggcctacgtggccgacaaggtgccgccgtcgcggcgagcggcagccttcggcgtgttctccggcgtctgcctcgccggcttcgtcgccggcacggtggcggcccgcttcctcgctgtccagtcgacgttccaggtggccgccgtggtgacggcggcggcggcggtgtacatg

SEQ ID NO: 265 - DNA, 612 bp, Oryza sativa
cggacgcgtgggtgcaaaaacatacaggtacgtctcgccagatggccggccttctccccggcgtgctcgtggccgttctcctcgccgccgccgcggcgccggcgtctgcgaaagactacaccgtcggcgactcgtcggggtggactaccggtgtggactacaccgcctgggccagaggcaagacgttcaacatcggcgatacgctattgttccagtacaccagcgcggggcactcggtggtggaggtgagcgaggcggaccacacctcgtgctcggcggcgaacccgctgcggtcgtacaaggacgggacgaccatcgtcacgctaaccaggtcgggcacccgctacttcatctgcggcagcacgggccactgcggcgccggcatgaagctcaccgtgacggtcgcctccctctccggcagcgccaccggcggcacgaggctggcgaagccgtcgtcgtccgacgcggacccgacgacgacgacgacgaccaggacctcgtcggccacgggcggcgccactggcagctgggccccgcgcactgccacgtggctgctgttcttcgccgccgtgggggccttgctgtgataggctgatcgtatggccgcttgga

SEQ ID NO: 266 - DNA, 625 bp, Oryza sativa
cgccgtcgcagatccgatccgggaagagctcgccgccgccgctgccatggcgctctccgtggagaagacctcgtcggggagggagtacaaggtgaaggacctctcccaggcggacttcggccgcctcgagatcgagctcgccgaggtcgagatgccggggctcatggcgtgccgcgccgagttcggcccctcccagccgttcaagggcgcccggatctccgggtccctccacatgaccatccagaccgccgtcctcatcgagaccctcaccgccctcggcgccgaggtccgctggtgctcctgcaacatcttctccacgcaggaccacgccgccgccgccatcgccagggactccgccgccgtgttcgcctggaagggggagaccctcgaggagtactggtggtgcaccgagcgctgcctcgactggggcgtcggcggcggccccgacctcatcgtcgacgacggcggcgacgccacgctgctcatccacgagggcgtcaaggccgaggaggagttcgagaagtcaggcaaggtccccgacccggagtccaccgacaacgccgagttcaagatcgtgctcaccatcatccgcgacggcctcaagtccgatcccagcaagtaccgc

SEQ ID NO: 267 - DNA, 590 bp, Oryza sativa
gctagccacgccgtccgctcgggccgaggcgcatcgcgcggggggagaaggggaggagaagatgtcgagcgacggagggccggtgcttggcggcctcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtatt

SEQ ID NO: 268 - DNA, 507 bp, Oryza sativa
gctctccccctccccttcctcccgctccggcgaaggcgagcgcgcggatcggcgtgatggcggcggcggcgccctctcccccacccgtcgcggcgctggagcagatgagcaggaccaaaatgttcggcggccacaacctccgcttccgccaccacagcgccacgctcggctgccccatgaccttctccgtcttcctcccgccgtcgccggcatccgacctccccgtgctgtactggctctccggcctcacgtgcaacgacgagaacttcgtcaccaaggccggcgcgcagcgcgccgccgccgcccacggcatcgccctcgtcgcccccgacacctccccacgtgggcttaatatagagggagaggcagacagttgggattttggtgttggtgctggattctatttgaatgcaacaaatgaaaagtggaaaaattggcgcatgtatgactatgttgtgaaggagcttccaaaagttttaagtgacaactttgaacagctgaacactt

SEQ ID NO: 269 - DNA, 323 bp, Oryza sativa
gccattcgtacaatcatggtggcgcaggcctccgatagttcatcataagtttcagtcaatagagttcaagatgatcagagaatgatgatggaagacgtctacagcttgaagcgcatggtgtccgccctcgaagagcaggctgcgagcatcgaatcgcagttccatgactactgcgacatgaaggagcaggaatcaacataccagaagatgcagatcatgtgcctggggatgaagctggagcagctggagtctcagaaccagaggctggaagcagctgctgcggagatccgcgcatctgctgaagagttcgcgacgatgcgagc

SEQ ID NO: 270 - DNA, 641 bp, Oryza sativa
tctatatcttgtcaacttggatttggtaatccctggaactaaaaaggccattcaaaatggtggttcttgcagcttctattatatcgaagtctggaaaagctcttgtttcgagacaatttgttgacatgtcccggataaggatcgaggggctgcttgcagcatttccgaagctggtcggaagtggaaagcaacatacttatgttgagactgaaaatgtccgttatgtctatcaaccaattgaagcactgtatttgcttctcatcacaaataagcaaagtaacattcttgaagatctggatactttaaggctactctccaagcttatacctgaatatgctccctctttggatgaagagggtgtctgtaaggcagcattcgagcttctgtttgcctttattgaagccatttctcttggaaacaaagagaacgtaactgttgcacaagttaaacaatactgtgaaatggagagccatgaagaaaagctgcacaagctggttatgcaaagcaaaataaatgaaactaaggatgtcatgaggaggaaagtcactgagattgagaaaagcaagactgatagagggaagcctgacaagggaggatttggatccttgagaactccaaacagcttcagtggcatgggcatt

SEQ ID NO: 271 - DNA, 561 bp, Oryza sativa
atttcccacttgccctttcagacacagcgccgccactaaacaaatccgcgacacaatcctccgccattaaactctctctctcctctcgacaccacatcacagcagtgaggtggttgttggcggaggagggaggctggctgctgctgctgctgccgccgcctccatccatggcggcttctcctcctcctcctcctcgtcccctgctgctgcttctcccgttgctgctcgtttggggcgtggtggttgcggcggcggcggcgacggatacgttgaggcagggggagtcgctgacgggggcggcgacgctggtgtcgtcgccgtcgggggtgttcgaggtggggttcttcgcgccggacccgaagctgccgtcgcggctctacctcggcatctggtaccgcagcatctcgccgaggaccgtcgtctgggtcgccaaccgcgccgcgccggccaccgcgccgtcgccgtcgctcacgctcgcggccaacggcgagctccgcgtgctcgacggctccgccgcggacgcggacgcgccgctcttgtggaggtcgaacgcgtccacgc

SEQ ID NO: 272 - DNA, 600 bp, Oryza sativa
cccacgcgtccggaggggagaagccgaggaggaggcagcggggagagaggatgccgcggccggaggtgcaggcgccgccggagatattctacaacgagtcggaggcccgcaagtacaccacctcctctcgcatcatcgaaatccagtcgaggattaccgagagggcgctcgagttgcttgcgctacccaacgatggcgtccccaagttgcttctcgacatcgggtgtggttctggacttagtggcgagacattgacagagcagggccatcactggattggttatgatatttcgaagtccatgcttgatgttgctctggagcgtgaagcggagggtgatctccttcttgcagatatgggccagggtttaggcttgcggcctggagttattgatggcgcaatcagtatttcagcagttcagtggttatgcaatgctgacaagtcttgtcacaacccaagattgcggttaaaggctttctttggatcattatatagatgcctagcaaggggagcaagagccgttttgcaattttatgctgataatgtgaagcagagtgaaatgatcgtgactgctgccatgcgtgctggatttgcaggtggag

SEQ ID NO: 273 - DNA, 606 bp, Oryza sativa
gttccagccatggcagcagacgaagggagtgaaggtgttcggcatgtgggcgagccccatggcgatccgtgtggagtgggcgctccggctcaagggcgtcgactacgagtacgtcgacgaggacctcgccaacaagagcgaggcgctgctccggcacaacccggtgaccaagaaggtgcccgtgctggtccacgacggcaagcctctcgccgagtccaccgtcatcgtcgagtacatcgacgaggcctggaagcacggttaccccatcatgccctccgaccccttcgaccgtgctcaggcgaggttctgggccaggttcgctgaagaaaagtgcaacgctgctctgtacccgatcttcatgacgaccggagaggagcagagaaagctggtgcacgaggcccagcagtgcctgaagacgctggagacggccctggaggggaagaagttcttcggcggcgacgccttcggctaccttgacatcgtcaccgggtggttcgcctactggctgccggtcatcgaggaggcctgcggcgtcgaagtcgtcaccgacgaggcgctgcccctgatgaaggcctggttcgaccgggtcctcgccgtcgacgccgt

SEQ ID NO: 274 - DNA, 662 bp, Oryza sativa
caccgcacccaccaatggcgtcctccaccaagatccccttcctcctcctcgccgtcctcctcctcctttccgtcgccttcccagcggaggtgatggcaggagggcacgggcgcggcggaagcagcggcggcggcggaggggtggccggcggcgggaacctgaggccgtgggagtgctcgcccaagtgcgcgggccggtgctccaacacgcagtacaagaaggcgtgcctgacgttctgcaacaagtgctgcgccaagtgcctgtgcgtgccgcccggcacctacggcaacaagggcgcctgcccctgctacaacaactggaagaccaaggaaggcggccccaagtgcccctaagatgcatgctttgtttcttttcttcttctttttttaccctatgattaatacctcctcctactagttctacattggtgtcactgcctcactgacactggtttagctcatggatccggttgattagttaaatggtggtggggtttattgctagatctgggcttataagtattagtttatcctgttctagtaaggttgttggttgggggaatgtgtgtgagagaggagagtgaggattcgtcaaagctggtcaaaaacttggatcccctctccctgtagtgattgattgatttgctactactggagtgagct

SEQ ID NO: 275 - DNA, 105 bp, Oryza sativa
cgctttttttttctttagcaattatacattaaaatcagctcatcacctgcggatactattatgcactattaattactcgaccggcaacagccaccccatcatcct

SEQ ID NO: 276 - DNA, 561 bp, Oryza sativa
cccccccctggagccagagccaaccatggcggcgactagggtttggctctccgccctcctcctcgccttcctcctcgccgccgcccccgtcgtccaagttgccagagctcagtccgaggaagaagctgctacagctgaagttgttgatggggctgatctaggaatcgtcagtgatgatacacaagtttccagcgatgggcctctaagtccggctcctggtgtggagacagtatgtgtttttcccaaaaacgctggcaaaattgtgctagcaggtgaagaaactgaactactggttggcctgcaaaacgagggtgaatcaactttgaatgttgttgctatccattcaactctccatcttccttttgaccataagatgtatggacaaaaccttactgttcagaacttcttcaatgcatcagttcctgtctctgtacaagcaacctttccgtatacattcgccgtgagcaagttcttgcagcctggagcatatgatctagttggttacatagtgtatgagattgatcagaacccataccagaatgtcttttacaatggcactgt

SEQ ID NO: 277 - DNA, 497 bp, Oryza sativa
cccccgagcaactcccctcctccactagaccaccatgcacagatcgatggcctctcaggcggtggcgcccctcctcctcatcctcatgctcgcggcggcggcggggggcgcgtcggcggcggtgcagtgcgggcaggtgatgcagctgatggcgccgtgcatgccgtacctcgccggcgcccccgggatgacgccctacggcatttgctgcgacagcctcggcgtgctcaaccggatggccccggcccccgccgaccgcgtcgccgtctgcaactgcgtcaaggacgccgccgccggcttccccgccgtcgacttctcccgcgcctccgccctccccgccgcctgcggcctctccatcagcttcaccatcgcccccaacatggactgcaaccaggttacagaggaactgagaatctgagagcgtgaggaatcgagttcatgttgcatttatcatcaatcatcatcgactagatcaataaatcgagcaaagctttgat

SEQ ID NO: 278 - DNA, 612 bp, Oryza sativa
cccccgaactttctgcttgcaaagtttcaatgcactggagtgagtcagtgaggttggtgaagcagagtgaggaaaggaggatgggaagggtggcgcctagcgtcgaggaggtcgggggcgagcagccgccgcccgcgcttgggcccggcgagaccgtgagcgggacggtggccgagctgagggcggcgtacgagagcggcaggacgcggagcctggagtggaggcagtcgcagctccgggggctcctccggctcttggcggaggaggaggccgccgcgttccgggcgctccgcgaggacctcggcaagcaccaagccgaggcctacagagacgagatcggcgtgcttgtcaagtcggcgaacgccgcgctgcgtgaggtcgggaaatggatggcgccggagaaggtctgggtgccgctaatcgcgttcccggcaagggcgcagctggagccgcagccgctcggggtcatcctcgtcttctcttgctggaatgtcccgttgggcctctctctggagcctctcgttggagcattggcggccggcaatgcggtcgcgctgaagccatcggagctggcgccggccaccgctaagttcctcggcgacaacgtcggca

SEQ ID NO: 279 - DNA, 431 bp, Oryza sativa
gctaactactccatctagctaagacccgtagtgtatagtagtcaagatcaatggcgtcccgacgccttgccccgctgctggtcctactgctctcgtccagcctcgccgccggccagagcaccggcgacaccgtcgtgttctggggccggaacacggaccagctcgaggggtccctccgtgaggcgtgcgacaccggcctctacaccaccgtcatcatctccttcctcagcgccttcggctacatcccgggcacctacaagctggacatctccggccacaccgtctccgccgtcggccccgacatcaagcactgccagtccaggggcatcctcgtcctcctcgccatcggcggccagggcggcgagtactccctgccgacctcccaggcggccgtcgacctcgaggactacctctggaacgccttcctcggc

SEQ ID NO: 280 - DNA, 158 bp, Oryza sativa
ctacgactgcgggtccaggctgtggaggctcaagggtgagccgcaggcggcggcggggcgcgagatggcggagatcctccgcacgctggaggcggagctccgcgaccgggagatcttcggcggcggcggcggcggcaggctcgggttcgtcgacgtcg

SEQ ID NO: 281 - DNA, 157 bp, Oryza sativa
ttattactcgacccacgcgtcgacaacccaacacccaaaagcaaaagaaaagcagcaaccaaaggatgtgcggcggagcgatccttgcggagctcataccgagcgcgccggcggcgaggcgcgtcacggcgggccacgtctggccgggcgacgccaa

SEQ ID NO: 282 - DNA, 621 bp, Oryza sativa
ccccccggagagagagagaaagggtctcctcctcaacatcaacaatggcggtcgcaacctccttcgccacactcgccatcgcgcggccggcggcggagcgagccctcctcgcctccaaaaccccctcgccgctcctctccatccgcaccggcaccggcaccgcacgcctcccctcatcggccgtctttggaggtttcactcctgcgctttccgctgctcacagccgcgcgcgcttcgtctcctccgccaccgctgaccccaaggaagtggacctccagtccaaaatcacaaacaaggtgtactttgacataagcatcggaaaccctgttgggaagaacgttgggagggtcgttattggcctatacggggatgatgttccccagaccgcagagaacttccgtgctctttgcactggagaaaaagggtttggttacaaggggtccagtttccaccgtgtcattaaggacttcatgattcagggaggagactttgacaagggcaacggtactggagggaaaagcatatatggccggaccttcaaagacgagaacttcaaattggttcatactggacctggagtggtcagcatggccaatgctgggccaaacaccaatggcagcc

SEQ ID NO: 283 - DNA, 224 bp, Oryza sativa
ccacctacgcatccccgaccagcaccggcgaccggcggcggcggcggctaccccccttcaatggcgactgtgccagttaacccgaagcctttcttgaacaacctgacagggaagcctgtcattgtcaaacttaagtggggtatggaatacaaaggatatcttgtttctgtcgactcttatatgaatctgcagctggctaatacagaggagtatattgatgggca

SEQ ID NO: 284 - DNA, 569 bp, Oryza sativa
cccccccccccggacctctctctccccatggtatctcctctccctctccgcccatttctcctctccacctgcgatccatccgcgcccgcgaggaggagggagccggacgccgccgcggggagagcaggggagagaaggagaggaggagatcgccgtcgccgtcgccgtcgtcgatctcgagcgggagcggagatggggctcacgttcacgaagctgttcagccgcctcttcgccaagaaggagatgaggatcctcatggtcggtctcgatgcggccggtaaaaccaccatcctctacaagctcaagctcggcgagatcgtcaccactatccccaccatcggttttaatgtcgaaactgttgagtacaagaacattagcttcaccgtttgggatgttggtggtcaggacaagatcaggcccctgtggaggcactatttccagaacacccagggcctcatttttgttgtggacagcaatgacagagagcgtgttgttgaggccagggatgagctccaccgtatgctaaatgaggatgagctacgtgatgctgtgctgctggtgtttgcaaa

SEQ ID NO: 285 - DNA, 586 bp, Oryza sativa
ccccccgtccatctcatcagcaacgaaccaagtcacaccgatcgatcgagcaacagtagtaggaaccatggcccgtgcacagttggtgttggtcgccgttgtggcagctctgctcctcgccgccccgcacgccgccgtggccatcacctgcggccaggtcaactccgccgttgggccctgcctcacctacgcccgcggcggcgccggcccgtcggcggcctgctgcagcggcgtgaggagcctcaaggccgcagccagcagcaccgctgacaggcgcaccgcgtgcaactgcctcaagaacgcggcccgcggcatcaaggggctcaacgccggcaacgccgccagcatcccctctaagtgcggcgtcagcgtcccctacaccatcagcgcttccatcgactgctccagggtgagctgagctatcgatcggatggatcatttatatgcatacagaagcgcgacggtgggtcgatgtgtggagccgatcgaattctgtatccaatattagtagtatctgtacgtattctggaataaaaagatgagctagctaaggtcgatcaatcaccatgcatgcatgtgtgtgcat

SEQ ID NO: 286 - DNA, 642 bp, Oryza sativa
agagagagagagagagagagagagagatggcgctcgcaatcctggcgaggaggcggggggcggaggcgctgctgcgacggccgctgggggcggcgggggtgtcggcgctgagggcgtcgtacgcggcggtggcgggggaggagagcgacgtggtggtggtgggcggcgggccgggagggtacgtggcggcgatcaaggcggcgcagctggggctcaagaccacctgcatcgagaagaggggcaccctcggcgggacatgcctcaacgtcggctgcatcccctccaaggctctgttgcactcatctcatatgtaccatgaagcaaaaagttcctttgcacaccatggagtgaaattttccaatctggaggtagacctcccagctatgatggcacagaaagacaaggctgtggcaggcctgactaaggggattgaaggtctcttcaagaagaacaaagtgacgtatgtcaaaggctttgggaaacttgcttcgccctcagaggtgtctgttgatctgagcgatggtggcagcacagttgtcaaagggaaaaacataatcattgctacagggtctgatgtaaaatcactccctggagtcacaattgatgaaaagaaaatcgtctcatctactggggccttgtgct

SEQ ID NO: 287 - DNA, 597 bp, Nicotiana benthamiana
  misc_feature (490)..(490): The residue at this position can be any nucleotide.
aaccactagttgatgtgtacaagcaagtaaagattggggaccgtttagaaaaaggtaccttacttgggccactgcatactcgcacttctagggaaaactttcaaaagggaatccaaaatatcaagtcccagtgctttgcagggtggaaagatcctcacagggggttcagtcatagaatctgagggtaactttgtgcatccaacaattgtcgaaatatcttcaaaagctgaagttgtgaaggaagaattgtttgctccagttctttatgtaataaagtttaagactttcgaagaagcagttgaaattaacaactctgtccctcaaggtttaagtagttccatcttcacccgaaatccacaaattatgtttaagtggattggagctcaaggaagtgactgtggcattgtcaatataaacataccaacaaatggagctgaaattggtggtgcatttggaggtgaaaaaggtactggtggtggtcgtgaggcangaagtgactcttggaaacaatatatgaggcgctcaacttgtacaatcaattatgggaatgaactaccattggctcaaggaatcaactttggctaacgaaattgatgc

SEQ ID NO: 288 - DNA, 601 bp, Poppy
gaattcagaaccctcttcatcatcttcttcctcagaaatctcctgatcttctttctaaattcccaatctaaccctctccaatggatcccgtcaatgaatggggtaacacacccttaaacgttgcagatccagacatcttcgatttaatcgaaaaagaaaagagaagacaatgcagaggtatcgaattgatcgcttctgaaaacttcacatctttcgctgtgattgaagcacttggtagtgctttaacaaacaaatactccgaaggtattcccggtaacagatactacggaggtaatgaattcatcgatgagattgaaaatctatgtcgttcaagagctttggaagcattccgatgtgatccagcgaaatggggtgtgaatgtacagccttactctggtagtcctgctaattttgcagcgtatactgctttgttgaatccacatgatagaattatgggtcttgatttgccatcaggtggtcatttgacacatggttattatacatctggtggtaagaagatttctgctacttcaatttactttgagagtttgccttataaggtgaattctactactgggtatattgattatgataagttgga

SEQ ID NO: 289 - DNA, 680 bp, Poppy
gaattcgcagagaaaaaagagagaaacatggggagatcatttggaaatggtgggttgggaggaggcgcaagtggtagtggtggcatgttaagagcagtaaggattagggcaactgttggtggaggattgcaagatcctgtaaccataaaaaaacctaactcaacaaaacccacaacaccaaactcttacaatactaatgtgttaaccctatcaacacatactcgcggtggttcatcagttaataataatcaagttttattatcatcaccaacatcatcagcttcagtttctaatgcttcttcgtctagatattcatcatcttgttcatatttatatgattctactgatgaatgggagtgggaaactgttgacaaagatggtgaggaaaacaaagatgatttggttttatcaaatggatattatgatatctttggcgctgttccttctatggatgaagttagagatgcggtttctaatcttcaacaattttcttcggctgcatcagacgaggattgggtcgaacctgctttacaggttaataatccaagaacattgaggtctcatggatatgaaagggtttatactgctttccatttattgcagacagatccaagtgttcagagaatggtagtttctttatctaccgataaagctctatgggatgctgttttaaataatga

SEQ ID NO: 290 - DNA, 651 bp, Poppy
gaattcaagactttcttctttgtttttatatcgctaagattatttgctagagtctcatccagtaatccttctttcttcatggcagaagagatggttggaagtatcaaatacgaagaagagataatacaggtacctcgtggagtagagctatttacatgtagttgggtacctgctaacacagaacccaaagctttagtttttctctgccatggttatgccatggagtgcagcatctccatgaaagatactgcgattcgtctagcgaaagccggttacggagtttatggaatagattatgaaggtcatggaaaatcttcaggactacaaggtttcgtccctagtttcgacagagttgtcgacgattgttctgaccattactcaagcatttgcgaaaagaaagaaaacaaaagaaagttaagatatctactgggagaatccatgggaggtgcagttcttcttcttttacacaggaagaaaccacagtactgggatggtgctatcttagttgctcccatgtgtaagcttgcggatgatatgaaaccaccagcactggttgtgagtgttttatcaatgctcacccatgtcataccgacatggaaaattgtcccaacaactgatattatcgatatcgccttcaaactaccttccaaa

SEQ ID NO: 291 - DNA, 691 bp, Poppy
gaattcaaactaacctcagtttctccgcctgggtctctctccacatcaatagaactatctctctcatcttttctcacattactctcttctttgtttctcattctgaatctcccgagcagaagaacatggcgacgattttacaaggaattggaaccacaacttcattatcttccacttctttggattccaagagatttgagtcttcatcaggaaaggttttaggaggtatcagatctgattcaagagacatttcttttggatcatctaataacagcaaagctcgtaaattagtagctactaatgcacttacaggtttaaagagctcacaatgtagcttcatggttggaagtggggcgattcctagtcagaaagtacaagccagtcatttaagcctaaagtcaagaagacgggcaggagcattgagcgtgacatgtcgcggtgaaaagattcttgtggcaaatagaggtgaaattgctgttcgtgtcattcgaactgctcatgaaatgggcataccatgtgtggcagtttattcaacaatagacaaagacgcactgcatgttaagcttgctgatgaggctgtttgcattggagaagcacctagtaaccaatccgtatttggtgatcccaaatgttctctctgcagctataagccgtggatgtaccatgctgcatcctggatatggattccttg

SEQ ID NO: 292 - DNA, 624 bp, Poppy
gaattcaggagtcttatttctactccttccgtgctagcttgcagagcattctctcttgaaagctcatcatggcttctgcatttctctcagtagccaagccttctactctccaggttgcaaagggactcggcgaattctctggtctccgcaattcctctgcttcttcccttccctttgcttcaaggaaatccaacgaggattttctctccctcgtggccttccagacatctgctgttgctgttggaagcggttacaggagaggagtaacagaagcaaagttaaaggttgcaatcaacgggtttggaaggatcggaaggaatttcttgaggtgttggcacggtaggaaggattcccccttgaatatcatcgccatcaacgacaccggcggtgtcaagcaagcttctcatcttctcaagtacgattctaccctcggcatttttgatgctgatgtcaagcctgttggtgacgatgctatctccgtcgatggcaagatcatcaaggtagtctccagccgtaaccccctcgacctcccctggggggatatggaggtggatctagttattgaagggacaggagtgtttgtggacagagaaagtgcagggaaacacatacaggcaggtgcta

SEQ ID NO: 293 - DNA, 647 bp, Poppy
gaattcaaacagaaatggcaagaagaagctgaccgatcttaaagcaacttttgcagagatcatcatcagaatcttcatcttcctcatctttgttgaatcctagtattgttggaggaggattatcaggtacaagatatgaaccaaagagatctgtaacgtatatgccaagaccaggtgatggaacaccaagagcagtaaccctaataccaggagatggaatcggaccattagtaacaggtgcggttgaacaagtaatggaagcgatgcacgcacctatttactttgagaaatttgaagtacatggtgatatgccaaaagtacctgatgaagttatggaatcgattaagaaaaacaaagtttgtttgaaaggtggattagcaacaccagttggtggtggtgttagttctttgaatgttgaattgaggaaagaacttgatctttttgcttctcttgttaattgttttaatcttcctggtttggctactagacatgagaatgttgatattgttgtcattcgtgagaatactgaaggtgaatatgctggtcttgagcatgaagtcgttgatggtgttgttgaaagtcttaaggtaatcacaaagttctgttcagaacgtattgcaaagtatgccttcgaatatgcttatctt

SEQ ID NO: 294 - DNA, 738 bp, Poppy
gaattcggaagctatacaagacaaggaccatgaattcgtaacaaaagcagttgaagaagcatacaaaggagtggataatggagatggaggccctttcggtgcagtcgttgttcgcaataatgaagtagttgtgagctgtcacaacatggttttgaagcatactgatcctactgcccatgctgaggtgactgcaataagagaggcatgcaagaagctcaaccaaatcgagctatctgactgtgaaatatatacatcttgcgagccttgtccaatgtgttttggtgcaatccacctttcacgtatcaagaggttggtatatggagccaaagcggaagcagccatagcaattggatttgatgacttcatcgcagatgccctgaggggtactggcttctatcaaaaggctagcatggagatcaagatggctgacgggaatggtgccatcgctgcagaacaggtcttcgagaaaacaaaagctaagttccaaatgtactgatcatcactacatttatcatctgaattcccgtcatttctgcgcatctgcaaaggaaagcacctcgccaggaattcactaatctgctttcaacagcttaccaagaaggaaaaaggaaaaatctgtgaatacatttctgaaaataaaaatgttcccagaaaagacatctaaaactattattggtttcattttacatgcactttctaatagtcagcaaaaaattacaaaactgatcatcactttgt

SEQ ID NO: 295 - DNA, 623 bp, Poppy
gaattcaaagaaggacaaggaagggaaggagagagatggaaaggagaagaaagaaaaaggaagctaagaaggaaaagaaagacaaagaagttaaaaaagataagaaagacaaggagaagaaaaatgaaggtctagaagatgaagaaggcgaagacaaaaagaaagagaagaagaagaaaaagaaagacaaagatggcgaagaagaactgaaggaaggggacggcgaaaagaaagaaaagaagaagaagaaagacaaggatggagaagaagaattgaaggagggggaagacgaaaagaaagaaaagaagaagaagaaaaacaaagatggccaagaagacagcaaggatgaaaagaagactaaagacaaagatgaaaaatcaaagaagaaggagaaggatgaaggcactgacatgaaagaagaaaaaaagaaggacaaggaagggaaggagaaagatggaaaggagaagaaaggaaaagaaaagaaggacaagagcaaagatgagaaagatggcagcagcaagaagaaagaaaaggatggggaatcaaaggaagagaagaaggagaagaagaacaaggatgaagataaagagaagaagaagaacaagaacaaggaaagtgaggaa

SEQ ID NO: 296 - DNA, 714 bp, Poppy
gaattcaacatcagttgattcagactagctagggggggatcaattgcagcaacggcttctcatcagcttctattctctagcactactacctctgctcaccgctcctcatcgtcatatgcatcatcctctgctcgagtactctttgatgtctctaagcagtcgacaaacccaataaccaggaaattatcactcagtaatgaagtcaggtgtgccgcagttgggacaacaacacctgagactgcaacggtaacccccaaaaggagcaagtatgacatagtgactttgacaagttggttattggaccaagagaagtctgggaatatcgatgcagaacttaccgttgtgctgtctagtatttccatggcttgtaaacagattgcttctttggtacagagagccagcatttctaacctcactggaggtcaaggtgccgttaacattcaaggtgaagaccagaagaagctcgatgttatctccaatgaggtgttctcaagctgtttgagatcaagtggaagaacagggatcatagcttcagaggaagaggatgtacctgttgcagtggaggaaagttactcagggaactacattgttgtatttgatccccttgacggctcatccaacattgacgctgctgtatcaaccggatccatctttgggatataccatcctaacgatgaatgtcttgctgattttggccgatgatgtgtccgctct

SEQ ID NO: 297 - DNA, 618 bp, Poppy
gaattccccaccactaaaattattttttagggagagaaatctttttttggggttgagaggagagagagagacacacagagagaaaaaatggcgatggcaatggcacttcgaaggctctcatcttcttcaatcaacaaacctatccgtcctctcttcaatgccgattcctactattgcatgtcatctcttccaagtgaagctgttgatgattctaaggataaatctcgtgttcaatggccaaagcaattgaatgcaccattagcagaagtggatccagagattgctgacattattgagcttgagaaagctaggcaatggaagggtctcgaattgattccttcagagaatttcacatctgtgtcggtcatggaagctgttggctctatcatgactaacaaatacagtgaaggttatcctggtgctagatactatggaggaaatgagtacattgatatggcagaaaccttgtgccagaaacgtgccttggaggcctcccgtttggatcctgctaaatggggagttaacgtgcaatctttgtctgggtcccctgccaatttccaagtctacactgcactattgaagccccacgagagaattatggcacttgaccttccacat

SEQ ID NO: 298 - DNA, 587 bp, Poppy
gaattcaaaatattaacaagctagttgtctgggcttctgatcaaactcattgtgccctgcaaaaagctgctcaaattgctgggataaacccaaagaacttccgtgctatcgctacttcaaaggctacaaactttgggctgtcacccaattcacttcaatctacaattctcgctgatatcgaatccggattagttccattgtttctatgtgctaccgttggtacaacttcatcaacagcagtagatcctattggtcctctctgcgaggttgctaaaatgtatggcatttgggttcatgtggatgcagcatatgccggaagtgcttgtatttgcccagagttcaggcacttcattgatggtgtggaggaggcagactcatttagtctaaatgcacacaagtggttcttcactactttagattgctgttgtttatgggttaaagactctgactcacttgttaaggcattatcaacaaatccagagtacttgaaaaacaaagcaactgaatcaaaacaagttattgattacaaggattggcaaatagctctcagccgaagatttcggtctatgaagctttggttagtactt

SEQ ID NO: 299 - DNA, 608 bp, Poppy
gaattcaataacatttctaatgaacttgtgggatccgtgactcttttatctaatatcaatgtagactctttgcgccataattgaaggtaccaatatattgaagccgtgagttggtgagcctgaaacaaaaattaaaatcaacccaaattagaagagatccaagtgataagtaaactactattttctaaagaaagaaagaaacccagaaaacataatgtatttctacaccaccagaatatgtcaaagtaaaagtaacgaattaattcaaacctgcaagattgtagtactggatagaaattggatgtgcaacaagtactataccatgaaaagttcaaaccactaaacaaatagaagaagcctctgaaatcaaattgaaaatcagagatttatgagatggaaaactgtagtaaattaagaccccagaaaataaaattgcaaacattacggtacctgagaattccatcagcaaccaagtgaaaatattgagaggagaaattatcatgttaaggtaagttgtaacgttgatccgtggttttgatttgatgatcatagatcaaaatttttcttaaaaagaatctggtaatgtgttgatttctagggtctcttct

SEQ ID NO: 300 - DNA, 609 bp, Poppy
gaattcatcatcatcaacaacatctgcactttcatcaagaacatcttctatcttttcagatagaatcagcttccccaagaactctgcttacaccggtggtatctcaatttctaacaatgctgttaccataaaatctcaagttactactactgaagctgctgcacctgtaaagaaggtagaaaagatctccaagaaggatgaggaaggaattgttgtaaacaaattcaaaccaaagaatccttacattggtagatgccttcttaacactaagattactggtgatgatgcccctggagaaacatggcatatggttttcactactgagggtgaagttccttacagagaaggacaatccattgggattattcctgaaggagttgacaagaatgggaagccacataaactcaggttgtactcaattgctagcagtgctattggtgattttggagactccaaaactgtttcattgtgtgtgaagcgactagtttacaccaatgatcaaggtgaagaagttaagggagtttgttcaaatttcctgtgtgactggaaaccaggatctgaagtgacaatcacagggccaattggaaaagaaatgcttatgcctaaaga

SEQ ID NO: 301 - DNA, 611 bp, Poppy
gaattcagcaagattagttgcttctggtttggcgaatttccatggagtatcaagtactaaaattgatggattaaagctgaaagaccagagtaatggaagctatggtgtaatagaagcaaagaaagggaacccaccgaaatacagcaagattagttgcttctggtttgccgaatttccatggagtatcaagtactaaaattgatggattaaagctgaaagaccagagtaatggaagctatggtgtaatagaagcaaggaaagggaacccacctgtaatgccagctgtggtgacaccaggaggacctatagacctttcatctgtgttgttcaggaatcgcataatcttcattggtcaaccaattaattcacaagttgctcaacgagtaatatcacagcttgtaacactagcagctattgatgagaatgcagatattctgatatacctgaactgccctggtggaagtacatactccgtgttagcaatatatgactgcatgtcatggataaagcccaaggtgggcacagtctgttttggtgtagctgcaagccaaggagcacttcttcttgctgggggtgaaaaaggaatgcgctattcaatgccaaatgcacgt

SEQ ID NO: 302 - DNA, 667 bp, Poppy
gaattcacaaccatttcaccctgtaaatcaagggcactttcatcatcgactttcattcccaccatctccactaatattatacctcaaaatttcttacacaaaatacccataaccatgagcaataactcctcaccgtcgaatttaactgtaaagtgtggcggtggagttgaaattagagaaacccaagatgaaaattcatctaataaacccatctttgaaacacttaattcaagtcctgatttgttacagaagttgatttatgatgctcttgtttggacttctcttcatggtcttgttgttggtcacaaatctgtacagaaatcaggaactgttcctggagtaggcatggtacatgccccgtttgcattgttgcctatgtctttccctaagaatcattttgaacaagcgtgtgagttggctccagtttttaatgagctcgttgatcgtgtaagccttgacggcaagtttctacaagattcattgtccagaacaaaaaaagtggatgcttttaccagtagactcttagatattcattcgaagatgctagaactaaataagaaagaggaaattcgattgggtttgcatcgttctgattatatgcttgatgctcaaactaaagaacttctttaaatagagctcaataccatttcttcttcgtttgctggac

SEQ ID NO: 303 - DNA, 616 bp, Poppy
gaattcatgtctatttcttttgtacgtttttgggatcaaacagaaggagatggatatcgaagaagaaaaattgaaagggcaggcagagatatgggacaatatgtttgcatttgtaaattcaatggcattgaaatgtgcagttgaacttggtatacccgatatcataaactctcatggtcgaccggtcacaatatcggagatcataaacagtttgaaaaaaaacacatcatcatcatctcctaatgtcgattatcttactcgtgtaatgagattgttggttcataaacgtatttttgcttctcaatttcatcaagaaagcaatcagattttatatgatttaactccatcatcaaaatggttattaagagattcaaaatgtactctagcaccaatgattttacttcaccttcatcctctctttttaaaaccatggaattatgtgggaaaaagtgttgaagaaagtggttctccttttgagaaagctcatggatgtgatacttgggatttggctttagctaatcctcaatttaatcagcttttcaacgatggcatggaatgcacggctaagatagtcgtcaacaagatgttggctaactacaaagatggatttaatggt

SEQ ID NO: 304 - DNA, 696 bp, Poppy
gaattcaaccctaacaacaagttagaatgggggaagttaaagacggcgagtatgaggaggaacttctcgattacgaagaagacgaagaaaaagcaccagattctatcggtgctaagactaatggagaaactgtcaagaagggatacgttggaattcacagctctggatttagagattttcttttaaagccggaactacttagagctattgttgattctggatttgaacatccttctgaagtgcaacatgagtgtatccctcaagctattttgggaatggatgttatttgccaagccaaatccgggatgggaaagactgccgtttttgttttatctacacttcagcaaattgagcctgttgcaggacaagtggctgcacttgttttgtgccatacaagagagttggcttaccagatctgtcacgagtttgagaggtttagtacatacttaactgacaccaaggttgccgtcttttatggtggggttaacatcaaaagccacaaggatttacttaaaaatgagtgtcctcatattgtcgttggaactcctgggaggatactagcattggcaagagacaaggaccttgctttgaagaatgtgagacacttcatccttgatgaatgtgacaagatgctggagtcgcttgacatgcgaaaggatgtgcaggaaatatttaagatgactcctcatgataagc

SEQ ID NO: 305 - DNA, 663 bp, Poppy
gaattcaactcagttttctcctcaatctctggtgtattggaacttgtttagttctcaatcctttcttttctttcttaagcttagatattcattcttttgcaacatttgtgtgaagttgttttgttgtaagaataagaagaagctaagaagatgaagattcagtgtgatgtgtgtgagaatgcaccagcaacagtaatatgttgtgcagatgaagcagctttgtgtagtaaatgtgatgttgaagttcatgcagctaacaaacttgctagcaagcatcagaggcttcatcttgatgcactctctgataagcttcctaagtgtgatatctgccaagacaaaacagcatttatattctgtgttgaagacagagcactattttgcaaagattgtgatgagccaattcattcagctggtagcatttctagtaaccatcagcgatttttggctactggaattcgtgtagcgttggcctctagttgtgctaaagaaactgagaaacaaattccagaaccaccaagcaaccaaaagttgcagccccaatgtgcagtgaaacatactgttcagagtctccagactgttccacaacaaccgtctaattacgcaaactctccaacttgggctgttgatgatttgctacaattttccgattttgaatctagtgac

SEQ ID NO: 306 - DNA, 702 bp, Poppy
gaattcgcctcaccaacctctgcaatcggttgggaaggtttcgagaaaagactcgaaatctcattctttgagcctggggtatttgctgacccagcaggcaatggccttagggctctaacaaaatctcaactggatgagatactagaaccagctgagtgcactattgtagggtccatgtccaatgctgatctcgactcctacatactctctgagtctagcttctttgtctacccatacaagatgatcatcaaaacttgtggaaccaccaagttattgctttcaatcccacctatccttgagttagcaaaaactctgtccctcactgtaaaagctgtgaattacacccgtggtaacttcattttcccaggtgctcaaactttcccacaccgcagcttctcagaggaagtttcagttctagacagccagtttattaagcttggtctgcaaagcagtgcatatgtgatgggtgataatgaagcacaaaactggcatgtgtactctgcttacgctgaagcaactggtgatcaggctaaccccaatttcactcttgagatgtgtatgactggtctaaacaaggagtgcgcgtctgtgttctacaaaactgaatcaagcacagctaatgagatgactgaagcctctggcataaggaagattcttccagattctaacataaatgactttgagtttgacccatgcggctac

SEQ ID NO: 307 - DNA, 594 bp, Oryza sativa
tggtggtgagggtatgggggctgaaggggtcgggaggaggaggcgggtggtggcgcctgcggtgaacggggtggcgaaggacggggcgccacagccgcctccgcccaagctgctcacgctgcccaccgtgctcaccattggccgcgtcgccgccgtgccgctcctgataagcactttctacatggaggggccttgggcagcaactgcgacaactggcatcttccttgctgctgcagtcactgattggctagatggttatattgcgagaaagatgcagttaggaacaccttttggtgcatttcttgatcctgtggctgacaagcttatggtagctgcaacattagtgttgctgtgcaccaaacctttggaaatttcactgctcagagatgggccatggcttctaacggttcctgccattgctattattgggagagagatcacaatgtcagctgtgagagaatgggctgcgtctcagaataccaaagttcttgaggctgtggcagttaacaatttggggaagtggaagaccgcaacgcagatgacagcattgactatcctccttgcgagcagagacaaaagtcttcctgcacaaga

SEQ ID NO: 308 - DNA, 408 bp, Oryza sativa
cccgcgacaagctcagctgggctaggccaagacggtggcgagcggcggcgatctggtgctctgcttgagttgagttcttgattttgccgaggtgtatcgatggagacgacggcggcgaagaagctgccgccggggttcaggttcaggcccaccgacgaggagcttgtggtgcactacctccgccgccgcgcgctcggctcccctctcccgcccgccgtcgacatccccgatgtccgcctcctcgcgcatgacccctccgacctgcttcctccagggtggagtgagcaggagaggtacttcttcacgtgcaaggaggccaagtatgtcaaggggcgccgcgccaaccgcgccacgggcgccgggtactggaaggcgacggggaaggagaagccggtggcggtgtccgtg

SEQ ID NO: 309 - DNA, 655 bp, Oryza sativa
cttagatcaccatcttgggggagacggttgaagtcacctatcatttctaggctcctggttaccacactttgagctttgggattactgctttctttggcgtgatggcggagcagagaggaaatatgttgatgaaaaagtatgagatggggaaattactcgggcaaggaacctttgccaaggtttaccatgcccgtaacaccgagacttctgagagtgttgctatcaagatgattgataaagagaaggttttgaaaggcgggctcatggatcagatcaaacgtgagatttctgtgatgaagttggtgaggcatccaaacattgtgcagttatatgaggtcatggctaccaagactaagatatattttgtgctggagcacgtcaaaggtggagagttgttcaacaaagttcagagaggaagactaaaggaagatgcagcaaggaagtacttccaacaactgatttgcgctgttgacttttgccacagcaggggtgtttatcaccgtgatttgaagccagaaaatcttcttcttgatgagaacagcaatctgaaggtttcagattttggcctaagtgctcttgctgattgcaaaagacaggatgggctgctccacacaacctgtggcacacctgcttatgttgctccagaagtgatcaa

SEQ ID NO: 310 - DNA, 549 bp, Oryza sativa
cctctcgccagtgccaccggggctcaagcgtgatccagcgttgggccgtgcgtgcgatatgtcggccgccggggaggaggacaagaagccggtggggggagagggcggcggcgcccacatcatcctcaaggtcaagggacaggatgggaacgaggtattctttcgcatcaagagatctacgcagctgaagaagctgatgaacgcctattgtgaccgtcagtctgtggatatgaatgctattgcattcctatttgatggtcgtaggctccgtggcgagcagacccctgacgagctcgagatggaagacggggacgagatcgacgccatgctccaccagactggaggctgcctgcctgcctagaagcttacgagttcttgcagcctcgtaaaattgtgcctttagtaggctcaatatctagaagtacatgaaaaaaaagaagcctaaaagaacttgtgaggctttggtcctgtgccatagctgaaggacattagaagagctttgtttggcaaaaatattttggtacttcggctgttatgactcgtttatcc

SEQ ID NO: 311 - DNA, 584 bp, Oryza sativa
gtagataacgccttcttgcatcgcaggaggtgcgcttcctatccccatcgccacccatggcgactcccgccgcttcccctctcctgctgccgctccccctccccctcccggcctccaccttcccgcctcgccgcgccgtcccctgcgcccgccgcctcgtcttgcggcctccccgcgccggacgccctcgcctccgggacccgcctcccgcggcacccccaccggcggtggaggaggtcggcgaggaggaagaggacgacgatgcccccccgctcaggctcctcgaaccgccccaggaggacgaccccttcccgcccgagatggagccggccgaccccgacttctaccggatagggtacgcgcggatgatgcgggcgtacggggttgagttcttggaaggccccgatgggatggccgtctatgcctcccgggacgtcgacccactccgcagagctagagtgattatggagattccattggagctgatgctgactataactcaaaaacgcccttggatgtttttccccgacattattccactaggccatcccatatttgacatcattgaatcaacagatcctgag

SEQ ID NO: 312 - DNA, 583 bp, Oryza sativa
atccattaattactcggttcgtggtcggaatccatggccgccgccgcagccgctgtcgggaaccctaacgcggctgccgccgctgcgtcggtctcggcgtcgagggtcggtgcgggggcgctgcgcgcggggggtttgagggtggcggcggggggaagtgtggcgaggaggggaggggctgtggtggcggcggcaatgcggccggcgaaggcggtggcgtcgccggcgaaggaggcggccggggaggtgaacggggcggcgccgggggggttcgcgaggcccgacgcgttcgggaggttcgggaagttcgggggcaagtacgtgcccgagacgctgatgcacgcgctcaccgagctcgaggccgcgttccacgccctcgccggcgacgaggatttccagaaagaacttgatggtatcctcaaggattacgtcggccgtgagaccccgctgtactttgcggagcgattgactgagcactacaagcgcgctgatggcacaggccccaagatttacctcaagagggaggatcttaaccacactggcgcccacaagatcaacaatgctgtcgcgcaagtcttgcttg

SEQ ID NO: 313 - DNA, 584 bp, Oryza sativa
ggtttagctcgctctgtgcgttgatttcttgatatcatggccaagaggcacctcttgttggtgacaacttgtttgtgggctctgtcatgtgccttgctgcttcatgcttcctctgatgggttcctgagagtcaacctcaacaagaagagattggacaaggaagatctcactgccgccaagttggcgcagcagggcaaccgtcttctgaagaccggcagttcagacagtgatcctgtccctctggtggactacctcaacacccagtactatggggtgattggcctcggctcaccgccgcagaacttcacggtgatatttgacactggaagctccaacctgtgggttccttcagcaaaatgctatttttcgatagcatgctacctccacagcagatacaactcgaaaaagtcgagctcttacaaagcagatggagaaacttgcaaaattacatacggttctggggcaatttctggattcttcagtaaggataatgtgttggttggagaccttgtagtgaaaaaccagaagttcattgaggcaacacgcgaaacaagcgttacctttatcatcggaaagtttgatgg

SEQ ID NO: 314 - DNA, 508 bp, Oryza sativa
ttcttcttcttctttctgtactcacctgcatctgtagagagagagagagagagagagagagagagagatggcaggaggtgacaacaactcccagaccaccaatggcggctcaggtcacgagcagagagccatggaggaaggcaggaagcaggaggagttcgccgccgacggccagggctgcggcctcgccttctccgtccccttcatccagaagatcatcgcggagatctttgggacatacttcttgatcttcgcggggtgcggggcggtgacgatcaaccagagcaagaacgggcagatcacgttcccgggggtggcgatcgtgtgggggctggcggtgatggtgatggtgtacgccgtggggcacatctccggcgcgcacttcaaccccgcggtgacgctggcgttcgcgacgtgccggaggttcccttggcggcaggtgccggcgtacgcggcggcgcagatgctgggcgccaccctcgccgccggcacgctccggctcatgttc

SEQ ID NO: 315 - DNA, 483 bp, Oryza sativa
ttagctcttgggagaagaaggcaagaagaaaatggacggggtgaacaggctggcggcgcagcgggcggtggtgatcttcagcatgagctcgtgctgcatgtgccacaccgtgacgcgcctcttctgcgagctcggggtgaacccgacggtggtggagctggacgaggacccgagggggaaggagatggagaaggcgctggcgaggctcctcggccgcagccccgccgtgccggcggtgttcatcggcgggaggctcgtcggctccaccgacaaggtcatgtcgctgcacctcagcggcaaccttgtcccgctgcttcgcaatgcgggtgccctctgggtgtagcaccaacgacgcaactatacctaccagcgactggttcttgatttggactgataccgtggcgcagaataattttatacgggtactttggtttgtatcaggcaggtcaggtatatctaagggaaaataaatagtacgtgcag

SEQ ID NO: 316 - DNA, 666 bp, Oryza sativa
ccccccgatgagaatggccgcgccgcagcgggtgcatgtgcgtgccgccccgctcgcgcgcgcgctccgaactcgcgtcgccgccgccgccgcgtctgcgagctctcccgaacgcgcgctcctcggcctctccgaaccagatctccggcagctcgccgtcgacctcggccagcaaagttacagggggaagcagcttcacgacctcctctacaagtccagggccaagcaaatccaagaatttagccacgtaccaaaggtgttccgtgaggccttggtcggcgctggctggaaggttggccgctcgccagtgcaccatgctgtgacggcctccgatggcactaccaagatacttctcaagttggaggataacagattgatcgaaacagtagggatccctgtcgatgatgacaaaggcccgtcaagactcactgcctgcgtttcatcacaggttggctgccccttgcgttgctcattttgtgccactggcaagggagggtttgcaagaaaccttcatgcacatgagattgttgagcaggttttggccatagaggagacgttccaacacagggtgacaaatgtagtgttcatggggatgggtgagcctatgttgaacctgaaatcagttttagaggcacatcgatgcttgaacaaggaactaaaaattgg

SEQ ID NO: 317 - DNA, 616 bp, Oryza sativa
ccccacagcatagtaaccaaccgaaccaggcatcagccatggcgcgaaggctctcgctgctggccgtcgtgctggcgatggtggcggccgtgtcggcgagcacggcggcggcgcagagctgcgggtgcgcgtcggaccagtgctgcagcaagtgggggttctgcggcaccggcagcgactactgcggcacggggtgccaggcgggcccctgcgacgtgccggccaccaacgacgtgtccgtggcgagcatcgtcacgccggagttcttcgcggcgctcgtcgcccaggccgacgacggctgcgccgccaagggcttctacacccgcgacgccttcctcaccgccgccggtggctacccttccttcggccgcaccggctccgtcgacgactccaagcgcgagatcgccgccttcttcgcccacgccaaccacgagaccataaagttctgctacatcgaggagatcgacggaccgagcaagaactactgcgacgagacgagcacgcagtggccgtgcatggcggggaaggggtactacgggcgcgggccgctgcagatctcgtggaacttcaactacgggccggcggggcagagcatcgggttcgacgggctgggcga

SEQ ID NO: 318 - DNA, 629 bp, Oryza sativa
cgatcgcttctcatcgcaaatcgcatcgacttcgattcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtcgccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgccaagtcggccggcatcctctgctcctacgacccc

SEQ ID NO: 319 - DNA, 646 bp, Oryza sativa
gaacaaagacatgacacaataaatttcgccaagtagctgcctcattacacaaattcagaccaaaatatccaccgcaaatccaagagcttcttattaataataatagtaaaaataaacgccaaaagttctcacacggaagcaactaacttagcacacaaaagacagacatgaacacacccaagcccctcctcttccttgtctaaaacgaagcagcaactaaattaaatcgacctaaaattccgaggcccccaatggcggcgatcgacgacgaaaccgaggagctctagttggctgccttgctgatgagctcctgcgcgacggcgacggtgggcagcgccgggatggcacccttcttggtggtgcagatggctccgcacgcgttcgagaacttgagcgcctccctcagcttctcctcgttgtggaagatggagtcgtccttggcgacgttgacgaggagggagccgacgaaggcgtcgccggcgccggtggtgtcgacggtgttgacggagaagccggggacggagcccttgaagtccttggtgaagtacctgcatcccttctcgccgtcggtgacgatgaggagcttgaggccgtcgaaccagagcgagagcacgttcttctcgtcgttggcgtcgccctgggtgag

SEQ ID NO: 320 - DNA, 651 bp, Oryza sativa
cccccccccgactcatccaccacccaaagacaaagcaagcaagtacagtagccatggcgaagcatctcgcgctgtccgtggccgccgcggtggccgtgtcgtggctggcggcgtcgtcggcggcggcggcggggttctacgagaagttcgacgtggtgggcgccggcgaccacgtgagggtggtgagcgacgacgggaagacgcagcaggtggcgctgacgctggaccggagctccgggtccgggttcacctccaaggacacctacctgttcggcgagttcagcgtccagatgaagctcgtcggcggcaactccgccggcaccgtcacctccttctacctctcctccggcgagggcgacggccacgacgagatcgacatcgagttcatgggcaacctcagcggcaacccctacgtcatgaacaccaacgtctgggctaatggcgacggcaagaaggagcaccagttctacctctggttcgaccccaccgccgacttccacacctacaagatcatctggaatccccaaaacatcatattccaggtggacgatgtgccggtgaggacgttcaagaagtacgacgacctggcgtacccgcagagcaagccgatgaggctgcacgcgacgctgtgggacggcagctactgggcga

SEQ ID NO: 321 - DNA, 265 bp, Oryza sativa
ccccgagtgctcggcacgtcggttgttgctggtgctgctgctgctcctcccgttttccgatcgcagccatgggaacccgcagcgtggccttggtgctcctcgcggccgcgctgctccaagccctcctccccgcttcggcggcggagggtttggtgcggatcgcgctgaagaagcgcccgatcgacgagaacagccgcgtcgccgcgcgactctccggtgaggaaggggcgcgccggctgggcctccgcggcgccaactcccttgg

SEQ ID NO: 322 - DNA, 482 bp, Oryza sativa
cccccccggtgctcggggaagttcgatcgatgcctcaccatggcgtcggagaaggaggcggcgctcgccgccgtgcccaacgacaaccccaccatatttgacaagatcatcaagaaggaaataccttccactgtggtatttgacgatgagaaggttctggctttcagagacataaatcctcaagctccgacccacattgtgatcattcccaaagtgaaggatggattaactggcctatcaaaggcagaagagaggcatgtacaaatactcggttacctcctctatgttgccaaagttgttgcaaagcaggagggacttgaagatggctaccgtattgtcatcaatgatggccccactggatgccaatctgtttaccacatacatgtacatctcctcggaggcaggcagatgaactggccgccggcctaacgagtgcccgtctgttgaactgccttcatggcaaggatgtcacactgcctctc

SEQ ID NO: 323 - DNA, 460 bp, Oryza sativa
ccccacccagccagctcgagcgagcgaagccagcagcagaagcagtagagagaaagtagagagatggaggggaaggaggaggatgtccggctgggagccaacaagttctcggagaggcagccgatcggcacggcggcgcagggctccgacgacaaggactacaaggagccgccgccggcgccgctgttcgagccaggggagctcaagtcgtggtccttctaccgcgcagggatcgccgagttcatggccaccttcctcttcctttacatcaccgtcctcaccgtcatgggggtcaacaactccacctccaagtgcgccaccgtcggcatccagggcatcgcctggtccttcggcggcatgatcttcgccctcgtctactgcaccgccggcatctccggcggccacatcaacccggccgtcaccttcggcctcttcctcgccaggaagctgtccctcacca

SEQ ID NO: 324 - DNA, 380 bp, Poppy
tgatactcatcacctacactgaacgagaacaagactaattaattcagctgtatcaaatcttaaacgccagtagcggataaaacaccaatcgctacagagcggataactctccgctactggaggctcaaaacggggtttagagcgcggttccccataaagaaataaaaacatttatctaactttatagataccgcactagtgtcttattcccagtatttagcaacttattatgctcgagtggtgggctcctaggccttgaagtcctgagccgaaccggagcactccgcgcgcgtcgactccggtgcggacgtgaacaggtccgtccggcacgggacacccgggtcaacgaggtggtcgtcaaagccggagaggaccgggtc

SEQ ID NO: 325 - DNA, 411 bp, Poppy
gactccatcccaaatacgttaagcacttactgttaataactctccctaaatatgtactttttggtattacttaacgtggaactcaacaacacagaacccctttaaagaaacactttacacttataattgttgttttgagggtcagggaaagaagattgtgcatgaacacgaggaggaggattaggagttacaccgatagtagataatggataaactccaacagcttcaccaggagtttacttgtttgcaatacgttttcaagctcactttaacctaccagtagaattatttctggctttagcgcttgtgtttaactagtggtaatttctagcaatattatcgaagaagttaacggttactcggcgatttatagtaatcggttgtggtgtttcaggaggaataactgcaacg

SEQ ID NO: 326 - DNA, 602 bp, Poppy
gaattcatcatcaacagtctcaacattactttatttcttaagcttcagcagtctcagctgattcagcagctgcaaggataagctctggtacaatacctcccatgtcactgtagtttccatcaataacattaggttgtcccaatgccttcagtgctaaatgtgctgccttttgccctgagatcatcatggctccgaatgttggtcccattcttggggcaccatcaatttcagccacttccattccagtaacaatcataccaggaacaatttctctagtgagtttaacaatggcatcttcagcggcgttcatgtcaagagctttcattccaggaactgagtcgattaaaccaatactcttcaaccttttaacaccagtagcaccaaaaggaccatcatgaccacatgaactgacaacaatcttggcttccatgacattagggtccatgcaagattgtgtgtcatggttcattgagactaacgcccagttggtgacaactccggcaactttattgttcttaacgatcaaatcctctgctgcaacagcattgaacaacttgacgtttggtctggccaacaactttgacatgatggtggaagtgaac

SEQ ID NO: 327 - DNA, 606 bp, Poppy
gaattcacttgacaataattcaaagagagttcctactcacagaagatttggtagtactatttcaaaaccgattaaaaccgtcatatctctgagaagaagtacattagtattccaccatgtttgccgtgctgctgcctcttctgcagaaggagaatcagggtcatcatcctcaaaccaacagaaaccaattaatagagctccaccaggtgtagacaccagaattcattgggaaaattcagaggatggatggataggaggtagcacaaccactaattcgtcacagtcgacgaaaaacgagacaggcggtgaaggcaagtactcttctcaacaagagagctttcttggccaggatttccctgatttgctcaatagtgcttccaacgattcccactaccagtttctgggaatatcagcagaagcagatttggaagagatcagagcagcatatcggcgactatcaaaagaataccatccagacacaacactgcttccactaaaaactgcatcagaaaaattcatgaagttgagagatatatatgacatattaagcgacgaagaaactcggcgtgtctatgattggactttagctcaagaagcagccagtcg

SEQ ID NO: 328 - DNA, 640 bp, Poppy
gaattcagtactattgtttttctgttttctaacagaaggtatccaaccctgtggcgatatgccgaaactaatgggtataactgaggcccactccataactgaagatgaacgccacagcttatacaagagtctaggcattactaccaagcataagcaaatcttttcaatcactgggatcaccaataatactgccatttctactctcggaagagagattgcaatagctggtcgcttccttgatgaacagccagatattgactggaagaaaactcgattcttctttatatttgggaacagaagtcaccgtgctgtatgcctaggagagtgggtgttctcttgtataccaatgtttcgtctacctggaacagttaacttttatttgagcctcgatggcacaactcccattagccagatcctgaaattcgactttctctcaactccaactaatcaggagctcttctctacatttgtggggttccgccaacaactatgtcttgctcacctgctctactctaaaaccaaaagactgactgatctgtcacgtctctctaattcttcggaggcaaaaattatgcacaacctcgtcttgtcttattgcgaacgcaatactaccaccttcatccgctcaattcaaaaccca

SEQ ID NO: 329 - DNA, 674 bp, Poppy
gaattcaggtaactcctcagctcatcagtagccgccctgtctttgctgctccagctccatacatcactcctagggggagagaagaagttcaaatcgttgaagaagaacaaatggcgtcaaaggataactacgaagaagccattgctgggctcaagaagcttcttagcgagaacaatggtctggaggcagttgccgcggctaagatcgaacagataacagctgaattacagactactgctaacgggaaagccgacggattctgcccggttgaaaggatcaagactggattcgtccaattcaagaaggacaaatacgagactgatccaaaactgtatggggaactttccaagggtcagagccccaagttcatggtgtttgcatgctctgactctcgagtgtgcccttcccacatcttgggattccaaccaggagaagcttttgttgttagaaacattgctaacatggttccagcctattgtcaaaacaggtactctggagttggagctgccatagaatatgctgtcttgcatctcaaggttgggcatattgtggtgattggacacagctgttgtggtgggatcaaaggacttatgtctctttctgacgatggctccacttccactgatttcatcgaagactgggtcaaaatcggtttaacagccaaatccaaggtt

SEQ ID NO: 330 - DNA, 655 bp, Poppy
gaattcgaatctcatcacttatctctctctcaatctctcttttaaatttcaaaaagttcctgaaagaacttcaaaaccatattgagatcttagaaccccaggagaaaaaaatacattcagcgagcgaattgattgatttttcaaatcaattcgctcgtattctggtttatttcagattaacgaatctatttcttgtttgttgaaattatatcaatcacgcatgcctgaattaatcgagatctcatcagaaaattcattatttggcaaatatgagctcggtaaattgcttggttgtggcgcattcgctaaagtttatcacgcaaggaatatcaaaacagggcaaagcgtagcaataaaatgtataagcaaacagaaaatcctcaaaggaggattaatggcacatgtcaagagagaaatcactattatgcgtcgtctccaccataagaatattgtgaagctttatgaagttttggccacgaaaacaaagatttatttcgttatggaatttattaaaggtggtgaattgtttgctaaagtagctaaaggtaaatttagtgaagatttgagtcgtaaatatttccagcaattaatatcagctgttggctattgtcattctcatggtatttttcacagagatttgaaacctgaaaatcta

SEQ ID NO: 331 - DNA, 606 bp, Poppy
gaattcagagagagagttttctcctcctctttctctctttactttcagttcttcttcatccaagaaggagaagaagaaagcttagacaggttagtgttcttcgtgcttggttatatttcaaatctcttgcaatgtcagacagtcaggatactgataagaatatcgagatatggaagatcaagaaattgattaaagcgctagaagctgctagaggtaatggtaccagcatgatttctctcatcatgccaccacgagatcaggttgctcgggtcactaagatgttgggtgatgaatttggtactgcctcaaacatcaagagtagagttaaccgtcaatcagtattgggtgcgattacctctgctcaacagagattgaaactttacaataaggtccctccaaatggtttagttttgtacacaggaactatcatgacagatgatgggaaggagaagaaggttacaattgattttgagcctttcaaggcaattaatgcatcattgtacctttgtgataataagtttcatacagaggctctaaatgaacttttggaatctgatgacaagtttggtttcatagtcatggatggaaatggtacactttttggga

SEQ ID NO: 332 - DNA, 603 bp, Poppy
gaattcaaccccaaccaaatcaaaaacagacgatccgaattcagtcattttctcgctcgctctcttgtttcgtaaaaattttctatcttgaattaagatctaaaagatggcgggacaaaatcaaagattaacagtagtaccaacagtcacgatgcttggagtaatgaaagcacgtttaataggagcaacaagaggtcatgctttacttaagaagaaatctgatgcattaactgttcaatttcgtcagatcttaaaaaacattgtttcagctaaagaatcaatgggtgatattatgaaaacttcatcatttgctttgactgaagctaaatatgtagctggtgagaatattaaacatactgttcttgaaaatgttcataacgcttcgttaaaggtgagatcgcgtactgagaatgttgctggagttaaattacccaagtttgagtatttcactgaaggtgaaactaagaatgatttgactggattagcacgaggtggacaacaggtgcaactttgtaaggctgcttatgtcaaagcaatcgaagttcttgttgaacttgcttcgcttcaaacgtcttttttgactcttgatgaagcaattaagac

SEQ ID NO: 333 - DNA, 75 bp, Poppy
cttgaaaatccggaggaccgagtgccatccacgcccggtcgtactcataaccggatcaggtctccaaggtgaaca

SEQ ID NO: 334 - DNA, 611 bp, Poppy
gaattcgggcttaccatgaatccactgatttctgccgcttccgttattgctgctggattggccgtagggcttgcgtgctattggacccggagttggtcaaggtactgctgcgggacaagccgtagaaggtattgcgagacaaccagaggcagagggtaaaatacgaggtactttattgctgagtctggcttttatggaagctttaacaatttatgggttggttgtggcattagcacttttatttgcaaatccttttgtttaatcctaagaatagaaagtttttttctaaattttattgccctggatttcccacctgcttttttgaattctatcaagattttactcctacaatcactttttgattgagacaatatccgtgggaaggactgatttgaggatgaggaattagcagacctactcgctttcttccttcccgttcttagtccaacgaaacccttttttttagaaagcgttgcaaaagatgaggtatttcacgactgacatgagatctggacctaattctaataagtgtgtttctgagtaggaacttcaattgaaatatcaaaaaaatttcaaaatggaaaaaaataataaatcaaacaataaaaaaa

SEQ ID NO: 335 - DNA, 668 bp, Poppy
gaattccgggacgaatctgtggttaatacttgtgtgtgtgtttcttctctctcagccctcccttcatctttgggagtttggatctcgtatccaataatggcgagttggttctcaccaaaatatggtcttagatccattcttcgtcttcccagaaccttgttctcctcagcttcagcaaacagagtgcacaagaacaatgaatatgcaaagataaatgaggttcaaaatgaagcggaggatgatgggtttaatccaggtgcaccacctccatttaagattgctgagatccgtaatgccattcctaaacactgttggatcaagaatccatggaggtcgatgagttatgttctcagagatattcttgtggttgctgcattagctgcttctgctgagtattttaataactgggttttctggattttctattgggctgctcaaggaaccatgttctgggctatctttgttcttggccatgactgcggccatgggagcttttcaaacagtcagaaacttaacagtattgttggacatcttcttcattccttcattcttgtaccttacaatggatggagaatcagtcacagaactcatcaccagaatcatggacacgttgagaatgatgaatcatggcacccgttgcctgagaaggtttacagaaacatggatga

SEQ ID NO: 336 - DNA, 369 bp, Oryza sativa
gaaggatcacaactcattcttctcttctgtcagtatagagagagagagagagagagatcaagaactagagagagaaaggtaggtagctagagagagagtaggcgatcgatggcggattgggggccggtgttcatagggctggtgctgttcatcctgctgtcgccggggctgctgttccagatcccggggaaggggaggatcgtggagttcggcaacttccagaccagcgggctctccatcctcggccactccatcatctacttcgcgctcatcgccatcttcctcctcgccggcaacgtccacatgtacctcggctagctagctaggaggtaccatgggtggctctggcatgtgaaatgtgcatcgatc

SEQ ID NO: 337 - DNA, 605 bp, Oryza sativa
attcatcatggcgcctgaactattgtgttggtggcgaggtcaccacgatgtatcacttggatcgccctatgtacttgttgggatatctagcgaatcaaagccgagtttatcttattgacaaggaattcaatgtcatggggtacacattacttcttagtttgattgagtacaagacacttgtgatgcgtggggatattgaacgtgcaaatgatattttaccatccataccaaaggcgcaatataataatgttgctcatttcttggagtcaagaggtatgctggaggaagcacttgagatagctactgatgctgattacaggtttgacctagctgtgcaacttggaaaattagaagttgcaaaggctatcgcgatggaagcgcaaagtgaatctaagtggaagcagttgggtgaactggctatgtccacaggcaagctaaatatggcggaagagtgccttgtgcaagcgaaggacttaagtggcctgttgctactatattcatctcttggagatgctgagggaatcgagaagcttgcttctcaagcaaaggagcatggcaaaaacaatgttgcttccctctgtctctttatgcttggtaaattggaa

SEQ ID NO: 338 - DNA, 126 bp, Oryza sativa
tggttctccggcacggggccctccgtctcgtcggcgtcgtcgtcgtcggcgccgccgcagcgcgtcgctggtcgcggaatggaactcctacgccgccgcgcgctccgcggaggaggaggaggacgg

SEQ ID NO: 339 - DNA, 474 bp, Oryza sativa
caggaggctgcggaggcataccttgttggtctcttcgaggacaccaacctgtgcgctattcatgccaagcgtgtgaccatcatgcctaaggacattcagctggctaggaggattcgtggtgagagggcttaaattcccctcggcgactcctttgacaaatgaagcatgcgtcgtagtgttagtagtgggtttaatcttttgcttataagaacaatctgagtagggtgtattttgtggaacaatatgtttctctctgtgacatgatggtgctgtattcgtcttattggtggatctgtcaaaaatactcagaatattgtcagtgtgtttggtgactcgtattttgttagtcggattcgtttgcgtcttattctagcggtgctgcctctttggcactgtgcatggctagatacaattacattgtaattcacctgtctctaatccgtgttaatgtaatgttccgttgctgttcgtgtg

SEQ ID NO: 340 - DNA, 565 bp, Oryza sativa
ctggaatcttgtttaacactagtattgtagaatcagcaatggcagcatacaccagcaagatctttgccctgtttgccttaattgctctttctgcaagtgccactactgcaatcaccactatgcagtatttcccaccaacattagccatgggcaccatggatccgtgtaggcagtacatgatgcaaacgttgggcatgggtagctccacagccatgttcatgtcgcagccaatggcgctcctgcagcagcaatgttgcatgcagctacaaggcatgatgcctcagtgccactgtggcaccagttgccagatgatgcagagcatgcaacaagttatttgtgctggactcgggcagcagcagatgatgaagatggcgatgcagatgccatacatgtgcaacatggcccctgtcaacttccaactctcttcctgtggttgttgttgatcaaacgttggttacatgtactctagtaataaggtgttgcatactatcgtgtgcaaacactagaaataagaaccattgaataaaatatcaatcattttcagaaaaacaaaaacaaacaaccc

SEQ ID NO: 341 - DNA, 632 bp, Oryza sativa
tgaacggtggaacgcgtacttacccacaagttaggtgcatgccatggcaccattcatggcatgcgcctcgccaccggtactcgcgctggccctgctcgcgtcgtgcggtgcctttctcgccacctccatgctcccggcgcgtgcgacggcgagcagctgcttggacgtcggcgacatggtgatgatggacaggttccgcgcttggcagggagctcacaaccggtcgtacccgagcgcagaagaggcgctgcagcggttcgatgtgtaccgccgcaacgcggagttcatcgacgccgtcaacctgcgcggcgacctcacttaccagctcgccgagaacgagttcgcagacctcaccgaggaggagttcctggccacgtacaccgggtactacatcggcgatggccccgtggacgacttcgttttcacgacgggtgccggagacgtcgacgccagcttctcctaccgcgtggacgttccggccagtgtcgactggagggcccaaggcgccgttgtgcctcccaagtcccaaacttcaacatgcactaacagcttgatcactatgtggattttagtttcgagcacgacgacccaacatattcaaaataagtgatttcagatgctctgtataatgc

SEQ ID NO: 342 - DNA, 592 bp, Oryza sativa
attcatggcatcagcttcagacaagctcgtcctctcggccatcgtgctcgccgtcctcgccgccgtggtggcagcggcgtcgggctacggcgacgtcggcgagtactgccgcgtggggaaggcggtgtcccggaacccggtcccgtcgtgccggaactacatcgcgcggtggtgcgccgccgccgggggccgcatggactcccgcaagcagccgccgcgggagttcctggagccgtgctgccgggagctcgccgccgtgccgatgcagtgccggtgcgacgcgctgagcgtgctggtgcgcggcgtggtcacggaggagggcgaccgcgtctccgggatgatctcccagcacgcggcaccggggtgcgacgccgcgacgatcgccgggatggcgagcgcgctgacggactacggccggtgcaacctgcagcacacggccggttcctttgcctgcctcatgtttggtggtggcatggattagatcaattatttcattagtgattaattaattaattaggcctttgcttaattaattatcgatgtttgctagtactagctagcagtatcatggtttggatgctgcttctctatg

SEQ ID NO: 343 - DNA, 578 bp, Oryza sativa
agagagccacgagctcaagtccagctctctatcaatcaatcagatgcatgtcatcctcaaagctttttgttggaggcctttcgtacggcacagatgagcagagcctcagagatacttttgccaattatggtcaagttattgaagctaagatcatcaatgaccgtgaaactgggaggtctagaggttttggcttcataacttacgcatcaagtgaagaggcttcagctgcaatcacagccttggatggaaaggatctcgatgggcgtaacatcagggttaacactgccaatgagagaactggtggcttccgtagtgggggtggtggctatggaggcggtggctatggcggcggcggtggcggctatggtggtggtggctacagtggtggtggtggctatggcggtggtggctacagtggtggtggtggtggcggcaggggctaccaaggaggcggcggtggttatggtggcaacaatggagggtatggcaacaggggtggtggtggaggtggttatggagttgcagaaggatctgcagatgccttctctggaatcaacttaggtggtgatggtagtttt

SEQ ID NO: 344 - DNA, 686 bp, Oryza sativa
cccacgcgtccgccctacaacaacatggcatccataaatcgccccatagttttcttcacagtttgcttgttcctcttgtgcgatggctccctagcccagcagctattaggccagagcactagtcaatggcagagttctcgtcgtggaagtccgagaggatgtagatttgataggttgcaagcatttgagccaattcggagtgtgaggtctcaagctggcacaactgagttcttcgatgtctctaatgagttgtttcaatgtaccggagtatctgttgtccgccgagttattgaacctagaggcctactactaccccattacactaatggtgcatctctagtatatatcatccaagggagaggtataacagggccgactttcccaggctgtcctgagacctaccagcagcagttccaacaatcagggcaagcccaattgaccgaaagtcaaagccaaagccataagttcaaggatgaacatcaaaagattcaccgtttcagacaaggagatgttatcgcgttgcctgctggtgtagctcattggtgctacaatgatggtgaagtgccggttgttgccatatatgtcactgatatcaacaacggtgctaatcaacttgaccctcgacagagggatttcttgttagctggaaataagagaaaccctcaagcatacaggcgtgaagttga

SEQ ID NO: 345 - DNA, 628 bp, Oryza sativa
ggaggagatcgaggaggggatggggatccggttcgtggtgatggtgaacaagcaggggcagacgcgggtggcgcaatactacgagcacctctccgtcgacgagcgccgcgccctcgagggcgagatcgtccgcaagtgcctcgcccgcaccgaccaccagtgttctttcgtggagcaccgcaactacaaggtggtgtaccggcgctacgcctccctcttcttcctagtcggcgtcgacaacgatgagaatgagttagctatccttgaattcattcatcttttggttgaaactatggaccgtcactttggcaatgtgtgtgagctcgacattatgttccatctggagaaggtgcacttcatgctggaagagatggtgatgaatggttgcattgttgaaaccagtaaacagaacatcttggcaccaatccacctgatggagaaaacttcttagaaaaatgctatccaataggggagtgcctcatactcttctgcttatggccaccgcctctgtgattctattgatttttcatctcaatgtgtaaccatcaacgatttccatgtgcatagactattaaacttgacctgataggaaataatgagaatatggcagatgccatctatgttcctt

SEQ ID NO: 346 - DNA, 589 bp, Oryza sativa
caccacaattcaaatattatagttgaagcatagtagtagaatccaacaacaatgaagatcattttcgtatttgctctccttgctattgttgcatgcaatgcctctgcgcggtttgatcctcttagtcaaagttataggcaatatcaactacagtcgcatctcctactacagcaacaagtgctcagcccatgcagtgagttcgtaaggcaacagtatagcatagtggcaacccccttctggcaaccagctacgtttcaattgataaacaaccaagtcatgcagcagcagtgttgccaacagctcaggctggtagcacaacaatctcactaccaggccattagtattgttcaagcgattgtgcaacagctacaactgcagcaatttagtggtgtctactttgatcagactcaagctcaagcccaaactctgttgaccttcaacttgccatccatatgtggtatctaccctaactactatagtgctcccaggagcattgccactgttggtggtgtctggtactgaattgtaacaatataatagttccgtatgttaaaaataaagtcatacatcatcatgtgtgactgttgaa

SEQ ID NO: 347 - DNA, 569 bp, Oryza sativa
cccccccgagctcgtttcacactctcatggcgattccttcatattcttaagctcaagctgatcaagtgtgtactagctagtaattagtcctatcctatatactatagtagctgggttgctcggctcgccggagatctccggccggctgccggcggcggtgagccggtgacactaatcacatatcgatcgtacacgcgcgcgtattacgtgtgtgaaggaacattagatagatagagagagagaggggatgggcggtgggtcgccgtgcgcgtcgtgcaagctgctgcggcggcggtgcaccaaggactgcatcttcgcgcccttcttccccgccgacgacccccacaagttcgccatcgtccacaaggtcttcggcgccagcaatgtcagcaagatgctccaggagctgccggcgcagcagcgaggcgacgcggtgagcagcctggtgtacgaggcgaacgcccggatgcgggaccccgtctacggctgcgtcggggccatctccttcctccagaaccaggtgtcgcagctgcagatgcagctcgccgtcgcgcaggccgagatcctct

SEQ ID NO: 348 - DNA, 554 bp, Saccharomyces cereviseae
gaattccagctgaccaccatgtctcaaagactacaaagtatcaaggatcatgtggtggagagcgccatgggtaagggtgaatcgaagaggaagaactcgttgctggagaaaggacccgaagatgtagttattgtggctgctaacaggtctgccatcggtaaaggttttaaaggtgccttcaaagatgtaaacacagactacttattatacaactttctcaatgagttcatcgggaggtttccggaacctttgagggctgatttgaacttaatcgaagaagttgcctgtggaaatgttctcaatgttggagccggtgctacagaacacagggctgcatgcttggcaagtgggattccctactcgacgccatttgtcgctttaaacagacaatgttcttcaggtttaacggcggtgaacgatattgccaacaagattaaggttgggcaaattgatattggtttggcgctgggagtggaatcaatgaccaataactacaaaaacgtcaatcccttgggcatgatctcctctgaagagctgcaaaaaaaccgagaagc

SEQ ID NO: 349 - DNA, 631 bp, Saccharomyces cereviseae
gaattccagctgaccaccatgacggagactaaggatttgttgcaagacgaggagtttcttaagatccgcagactcaattccgcagaagccaacaaacggcattcggtcacgtacgataacgtgatcctgccacaggagtccatggaggtttcgccacggtcgtctaccacgtcgctggtggagccagtggagtcgactgaaggagtggagtcgactgaggcggaacgtgtggcagggaagcaggagcaggaggaggagtaccctgtggacgcccacatgcaaaagtacctttcacacctgaagagcaagtctcggtcgaggttccaccgaaaggatgctagcaagtatgtgtcgttttttggggacgtgagttttgatcctcgccccacgctcctggacagcgccatcgacgtgcccttccagacgactttcaaaggtccggtgctggagaaacagctcaaaaatttacagttgacaaagaccaagaccaaggccacggtgaagactacggtgaagactacggagaaaacggacaaggcagatgcccccccaggagaaaaactggagtcgaacttttcagggatctacgtgttcgcatggatgttcttgggctggatagccatcagggtgc

SEQ ID NO: 350 - DNA, 631 bp, Saccharomyces cereviseae
gaattccagctgaccaccatgtctaccacactactttggttttcaagtgtgataggctacgtgattcaaacaaaatgtttgtctaacatacaatctaaaaaggaaatctccgtggggcccaatggtacaattgcaacgcctgaaactaacggcgacaacggaaactcaagttcattagccttctatctgacctttatgtattttgcttcgtggctgctcttggtgcctgcatctcgactttgggagaagatgagaccgatgtttgtctctgactcagactcgaacaggaattctcagtttgacaacaacaacagcgggtctgtgacaaacgaagatgtcgatacgttctcgcacgtgttggatgatcctcaaccacggattccagcccaacagcagaagcaaaaaatcatatccgtggctaccttcaaatatgtggctaagctaacagtgctggctctcataatgattgtcgctgatttgacttataacatggctttgtcattgtcaccggcatttgatgttgctttgatgcaaaatactgccattttcgaaattgtcactttactatatggtgtttgtggaatctccaggaagaactacgttttccgtaatttcctcatcatgatgaacg

SEQ ID NO: 351 - DNA, 615 bp, Saccharomyces cereviseae
gaattccagctgaccaccatgattcaaatggtgcccatttattcatgctccgcattacttcggagaactataccgaaaaggccattctatcatgtgttatcagggttaactgtacgctttaaggtaaacccgcaattaaattacaatcttttcagagatctcactaggagggaatatgctaccaatccgagtaaaactcctcatataaagagcaagttgctcaatattcccaacattttgactttatcacgaataggatgtacaccctttatcggactcttcattataacgaataatttgaccccagcattaggtttgtttgcattttccagcatcactgattttatggatgggtatatagcaagaaaatacggcctgaaaaccattgcaggaaccatattagatccacttgcagataaactactcatgatcacaacaactttggcattatctgtaccatccggccctcagattataccggtatctattgcggcgataattctgggtagagatgtgctactagccataagtgctttgtttatacgatatagcactttaaagttgaagtatcctggtcgtgtggcatggaattcctattgggatattgttcgctat

SEQ ID NO: 352 - DNA, 422 bp, Saccharomyces cereviseae
gaattccagctgaccaccatgccaaacttaaagagactacccatcttccgcgacaagtcctggactaccatgcagaacaacgtcttgagcacctccaactgcggtaacccctggctcaagagcttcgggttcgggcctgtcaccggcaacggcttcggcatcggctacatcatcagagaccactccgtctctgtggtggtgtcctcaaggcatcgccagactggtcggtttgcgtcgctcatggaaaagtcgctgctggagatcgaccgcatcttcaaacggcagcaagctcgcgcagcaaaacccgctgccaggaccactggtagcgccaacaccaaatcagaagacatgaaatacctgttgtccggctacgattacttcgacgtgagcgtgtccggttgacatggcaattcccggggatc

SEQ ID NO: 353 - DNA, 546 bp, Saccharomyces cereviseae
gaattccagctgaccaccatggttgaatcagatgaagatttcgcacctcaagaattcccacacacggacacagacgttatcgtaaatgaacacagagacgaaaatgacgggtatgcctcagatgaagttggtggcacattaagcagaagggcctcaagtatattttctataaatacaactccattggccccccctaatgctactgatatccaaaaatttacaagtgacgaacatcatttcagcatgatgaggaatttgcatatggcagattacattactatgctgaatggattttctgggttttactctattgtaagttgtctgagatttacgcttacaggtaaacctcattacgtccagcgtgcccatttccttattttattgggtatgtgtttcgatttccttgacgggagagtagcacgtctgagaaataggtcttccttaatgggtcaagaactggactctttggccgacttggtttcctttggtgtggctccggctgcaattgcttttgccattggatttcaaactacattcgatgtcatg

SEQ ID NO: 354 - DNA, 627 bp, Saccharomyces cereviseae
gaattccagctgaccaccatggtacaagaatcacgtccagggagtgtaagaagttactcggtcggttaccaagcaaggcccagatcgagttctcaaagaagacattcgttaacacgccaacgttcctcgcaaagactgattagaaccatcagtatcgagtctgatgtgtctaatattactgacgatgacgatttgagagctgtcaatgagggagtagcgggtgtgcaactggacgtctctgaaaccgcaaataagggaccaagaagagcatcagcaactgatgtcacagatagtttgggttcgacttcgtcggaatatattgagattccctttgttaaggaaacattggatgcaagtttaccttcggattatctgaagcaggacatattaaatctcattcagagtttgaagatatccaaatggtataacaacaagaaaatccaaccggtagcacaagatatgaacttagtcaagatctctggtgcgatgacaaacgcaattttcaaagttgaataccctaagttaccatcgttgctattgagaatatacggaccgaatattgataatatcattgacagggaatatgaattgcagattttggctagggtttcattgaaaaatataggt

SEQ ID NO: 355 - DNA, 632 bp, Saccharomyces cereviseae
gaattccagctgaccaccatggcaaacccaacaacagggaagtcctcgattagggctaagctttctaactcatcgctatcaaacctatttaaaaaaaataaaaataaaagacagcgtgaggaaacggaagagcaggacaatgaggataaggatgagagtaagaaccaggatgaaaataaggacacacagctcactccccgcaagcgtcgccggttgacgaaggagtttgaagagaaggaggctcgttacaccaacgagttgcccaaggaactgcgcaagtatcgtcctaaaggttccagattcaatttgcctccaacggatagacccatcaggatatatgcagatggtgtttttgatcttttccatcttggccacatgaagcaactggaacagtgtaagaaggctttccccaatgtaacactgatagttggtgtgcctagcgacaaaatcactcacaaactaaaaggtttgactgtgctgaccgataagcagcgttgtgaaactttaacgcactgcagatgggttgacgaagtcgtgcctaacgctccctggtgtgtcaccccagaatttctactagaacacaagattgactacgtggcacatgacgatattccttacgttagcgccgacag

SEQ ID NO: 356 - DNA, 401 bp, Saccharomyces cereviseae
gaattccagctgaccaccatgcctaaagtttacagttaccaagaagttgccgaacacaatggcccagaaaatttctggattatcatcgatgacaaagtttacgatgtttctcaattcaaagatgaacatccaggtggtgatgaaattataatgggtttgggtggacaagatgctacagaaagctttgtcgatatcggtcattctgacgaagcattgagactactgaaaggtttatacattggtgacgttgacaagaccagtgagcgcgtttctgtggaaaaggtatctacctctgaaaaccaaagtaaaggtagtggtacattggttgtcatattggccattttaatgctaggtgttgcttattatttgttgaacgaataacatggcaattcccggggatc

SEQ ID NO: 357 - DNA, 622 bp, Saccharomyces cereviseae
gaattccagctgaccaccatgaacagagtttcgtttattaaaacgcctttcaacataggggcgaaatggagattagaagatgtctttttgctcattatcatgatagttcttaagtacccagtgtattaccaacaaccggtcgaacgtcagttttacattaacgatctcactatatcgcatccttatgcgacaactgaacgtgtaaataacaacgtgttgtttgtttatagttttgtcgtgccatctttaaccatattgataattggttccattttggccgatagaagacatttgatttttattttgtacacatctctccttggtttatcactcgcttggttcagtacgagtttctttacaaacttcatcaagaattggattggaagactaagaccagattttctagatcgttgccaacctgttgaaggcttgccattggacactttatttactgcaaaagatgtgtgtacgactaagaatcacgaacgtctgttggatgggtttaggacaactccgtcaggtcattcaagtgaaagctttgcaggactgggttatttgtacttctggctatgtgggcaacttttgactgaatcaccgttgatgcctttatggagaaaaatgg

SEQ ID NO: 358 - DNA, 627 bp, Saccharomyces cereviseae
gaattccagctgaccaccatgagtggagtatcaaataaaacagtatcaattaatggttggtatggcatgccaattcatttactaagggaagaaggcgactttgcccagtttatgattctaaccatcaacgaattaaaaatagccatacatggttacctcagaaataccccatggtacaacatgttgaaggattatttgtttgtgatcttttgttacaagctaataagtaattttttttatctgttgaaagtttatgggccggtgaggttagcagtgagaacatacgagcatagttccagaagattgtttcgttggttattggactcaccatttttgaggggtaccgtagaaaaggaagtcacaaaggtcaaacaatcgatcgaagacgaactaattagatcggactctcagttaatgaatttcccacaattgccatccaatgggatacctcaggatgatgttattgaagagctaaataaattgaacgacttgataccacatacccaatggaaggaaggaaaggtctctggtgccgtttaccacggtggtgatgatttgatccacttacaaacaatcgcatacgaaaaatattgcgttgccaatcaattacatcccgatgtctttcct

SEQ ID NO: 359 - DNA, 626 bp, Saccharomyces cereviseae
gaattccagctgaccaccatgtccgtttccaagattgctttcgttttaagtgccattgcctctttggccgtcgctgacaccagcgccgccgaaactgctgaactgcaagctattatcggtgacatcaactctcatctttctgactacttgggtctagaaactggcaacagtggattccaaattccatctgatgtcttgagtgtgtatcaacaagtcatgacttacaccgatgacgcttacactaccttgtttagtgaattggactttgatgctatcactaagacaattgttaaattgccatggtacaccacaagattgagttctgaaatcgctgctgctcttgcctccgtttccccagcttcttccgaggctgcatcttcttccgaggctgcatcttcttccaaggctgcatcttcttccgaagctacatcctctgccgctccatcctcttctgctgccccatcttcttctgctgccccatcatcatctgccgaatcatcttctaaggccgtttcttcttctgtcgctccaactacctcttctgtcagcacttctacagtcgaaactgcttccaatgccggtcaaagagtcaatgcaggcgctgcctctttcggtgctgttgttgc

SEQ ID NO: 360 - DNA, 600 bp, Saccharomyces cereviseae
gaattccagctgaccaccatgcaccaagattttcaagaagacgagcatgagtatccagacatcagacgcaatccgctgcatgaggtgaccatgacttcctacatactggggattcttttaggtatatttgttggtctttttccacaaattagattcaagaattttaacctctttattattgccctgtccttattccattttttggagtataatattacagctagatacaatcctcttaaggtacattcagagtcctttcttctgaacaacggcaaaagttacatggcggcacattcctttgctattctggaatgcctcgtagaaagctttctttttcctgatctgaaaatttttagctactctctagctaccaagctttgtacagtacttggatgtcttctagttattctgggacaatataccagaactattgctatgcatactgcgggacattccttttctcatattgtgaagaccaagaaggagtccgatcatgttttagtgaaaactggcgtttactcctggtcaagacatccaagttatcttgggttcttttggtgggcaattggcactcagctactgcttctaaatcccctatca

SEQ ID NO: 361 - DNA, 623 bp, Saccharomyces cereviseae
gaattccagctgaccaccatgagttactttcctcgaacatatgctcacttgatgagaaatgttcttgctcataataaagggaatatatacttacaaattggtacacagctgcacgatactcaaataaaaattcgatttaatggagttcgttatattagtcggaatcatggcgggaaacagcaacatataaacactgcgccgatagaatttactcccaattttggatatggtgatagaacctctaattgcaataaaaaggttgaatcgaccgccatgaaaacgctaagatgcacagatgatatatcaacttcaagtggaagcgaagctactaccgatgcaagcacacaacttccatttaacgtcaaacttgtagacccgatggtaagaaaatctaagagaccatctcacgcaatcagcgaagggctgaatatgaaaactttaaagaagaaggtaattatgccatatcttcagttgaccaagccccgactcaccattctagtgatgttaagtgccatttgttcgtatgctttatctccatatccagcctccgtcaatgaattgttatgtttaacagtaggcactactttgtgttccggttctgcaaacgctataaatatgggcag

SEQ ID NO: 362 - DNA, 597 bp, Saccharomyces cereviseae
gtaaggaattccatctgaccaccatgggaaagctattacaattggcattgcatccggtcgagatgaaggcagctttgaagccgaagttttgcagaacaccgctattctccatctatgatcagtccacgtctccatatctcttgcactgtttcgaactgttgaacttgacctccagatcgtttgctgctgtgatcagagagctggatccagaattgagaaactgtgttactctcttttatttgattttaagggctttggataccatcgaagacgatatgtccatcgaacacgatttgaaaattgacttggggcgtcacttccacgagaaattgttgttaactaaatggagtttcgacggaaatgcccccgatgtgaaggacagagccgttttgacagatttcgaatcgattcttattgaattccacaaattgaaaccagaatatcaagaagtcatcaaggagatcaccgagaaaatgggtaatggtatggccgagtacatcttagatgaaaatgacaagttggatgggttgcaaaccgtccacgactacgacgtgtactgtcactacgtagctggtttggtcggtgatggtttgaccc

SEQ ID NO: 363 - DNA, 599 bp, Saccharomyces cereviseae
gaattccagctgaccaccatggaggccaacatacatgagctgatcaataatgatcctgtttggtccagccaaaatgaaagcttgatttcaaaaccttataatcacatccttttgaaacctggcaagaactttagactaaatttaatagttcaaattaacagagttatgaatttgcccaaagaccagctggccatagtttcgcaaattgttgagctcttgcataattccagccttttaatcgacgatatagaagataatgctcccttgagaaggggacagaccacttctcacttaatcttcggtgtaccctccactataaacaccggaaattatatgtatttcagagccatgcaacttgtatcgcagctaaccacaaaagagcctttgtatcataatttgattacaattttcaacgaaaaattgatcaatctacataggggacaaggcttggatatatactggagagactttctgcctgaaatcatacctactcaggagatgtatttgaatatggttatgaataaaacaggcggccttttcagattaacgttgagactcatggaaacactgtctccttcctcacaccacgggcattcgtt

SEQ ID NO: 364 - DNA, 368 bp, Saccharomyces cereviseae
gaattccagctgaccaccatgtctgacgcaggtagaaaaggattcggtgaaaaagcttctgaagctttgaagccagactctcaaaagtcatacgctgaacaaggtaaggaatacatcactgacaaggccgacaaggtcgctggtaaggttcaaccagaagacaacaagggtgtcttccaaggtgtccacgactctgccgaaaaaggcaaggataacgctgaaggtcaaggtgaatctttggcagaccaagctagagattacatgggagccgccaagtccaagttgaacgatgccgtcgaatatgtttccggtcgtgtccacggtgaagaagacccaaccaagaagtaacatggcaattcccggggatc

SEQ ID NO: 365 - DNA, 586 bp, Saccharomyces cereviseae
gaattccagctgaccaccatgtccacaagcattacagtaagaaatagagatcgatcgctaccaccgctattgctccccaatgtttccctgctagaaaaagatatacggcgtaaaggcacccaaaatgtgggcatcaccgatccagaactcttgtcgaccacttggacgaggaagcgggcttttccgactgacgagcttttaggaggctataagagattaaagcctgctgccactgacagcaatgagtgcgctattggtattgccacggtgacgccgccgccaacgctccccgtaagagcgattgttccccctccacaaaattacactccaccattgtttgagtatcatcctcatgctcttgcttccatggtcaatgaatacgctaatgcgtcatgcactcaaatgtctataatttcgcgctcaacgagcaactcgacaacctcctctgccacatctactagttcaatttccaagagacaaagaagtggcccaagttgtgacaaatgtcgtttgaaaaaaataaaatgtaatgcgaaaattgagattttgcttcaagacgatactataatgccaatgatctcgaaca

SEQ ID NO: 366 - DNA, 634 bp, Saccharomyces cereviseae
gaattccagctgaccaccatgtctagcaaatggtttaatgctatacacctactggtgtgcccgttgacggtactggtaggatatctcatgaacgcgtatggctacggtgcggcactgcaagcaaccctgaataaggatggtctggtaaatgctatgttggtaaagagagggtggttttggacttccttggtcggatggtggtgtattatacgctaccgtgcggtgccgggggcaaccggcagagaccgaagacacattgtccagtcattcaaaaggtatgccatactgacagtgtggtggtacgtattcacgcaaggtatatggtttggcgtaggccccatcatggacttggtattcgtatatacgggtggccattgtcactatgacgtcttcgatgatgcaggtcacgtgaacgaagacttccagggttctgtcacccggactaatcgcgcgttggcgctcattcacaatgtcctcactttgcacggacaccaccaagaacaccgtcagcaacaactctgggaccgctccatagggtcgatccagggcgccctgcaggcgacgcaaccgaaaaccccaaaaaacgtaacggccagcgctgccgctgccatcaatacttttattcatgaccaga

SEQ ID NO: 367 - DNA, 637 bp, Saccharomyces cereviseae
gaattccagctgaccaccatgactgccgacaacaatagtatgccccatggtgcagtatctagttacgccaaattagtgcaaaaccaaacacctgaagacattttggaagagtttcctgaaattattccattacaacaaagacctaatacccgatctagtgagacgtcaaatgacgaaagcggagaaacatgtttttctggtcatgatgaggagcaaattaagttaatgaatgaaaattgtattgttttggattgggacgataatgctattggtgccggtaccaagaaagtttgtcatttaatggaaaatattgaaaagggtttactacatcgtgcattctccgtctttattttcaatgaacaaggtgaattacttttacaacaaagagccactgaaaaaataactttccctgatctttggactaacacatgctgctctcatccactatgtattgatgacgaattaggtttgaagggtaagctagacgataagattaagggcgctattactgcggcggtgagaaaactagatcatgaattaggtattccagaagatgaaactgagacaaggggtaagtttcactttttaaacagaatccattacatggcaccaagcaatgaaccatggggtgaacatg

SEQ ID NO: 368 - DNA, 635 bp, Saccharomyces cereviseae
gaattccagctgaccaccatgatctctgtcatggcggatgagaaacataaggagtattttaagctatactactttcagtacatgataattggtctatgtacgatattattcctctattcggagatatccctggtacctaggggccaaaacatcgaatttagccttgatgaccccagtatatcaaaacgttatgtacctaacgaactcgtgggcccactagaatgtttgattttgagtgttggactgagtaatatggtcgtcttctggacctgcatgtttgacaaggacttactgaagaagaatagagtaaagagactaagagagaggccggacggaatctcgaacgattttcacttcatgcatactagcattctatgtctgatgctgattataagcataaatgctgccctaacaggcgccttaaagttgattataggaaacttgaggcctgactttgttgatagatgtatacctgacctccaaaagatgagtgattcagattctttggtttttggcttggacatttgcaagcagactaacaaatggattctatacgaaggcttaaaaagcactccaagcggacattcaagtttcatagtcagtaccatgggctttacatatcttcggcaaagggt

SEQ ID NO: 369 - DNA, 624 bp, Saccharomyces cereviseae
ggaaggaattccagctgaccaccatgaaggagtcagtccaagagatcatccagcaactcatccacagtgtcgatttacagtcttccaagttccagctggccattgtgtgcacgatgttcaatcctatcttttggaacatcgttgcaagaatggaataccacaagcattctctcaccaagatgtgtggtggggccagaaagggctgttacatgttggcggcgaccatattttcgctaggtatcgtcagagacatggtgtacgagtctgcattgcgtgaacagcctacgtgttctctgatcacgggcgagaactggaccaagctgggtgtggctctctttggtttggggcaagtgcttgttttgagttccatgtacaagctgggtatcacagggacgtacttgggtgactatttcggcatcctgatggatgagagagtcaccggcttccccttcaacgtttccaacaaccccatgtaccagggttccactttgtccttcttgggcatagccctttacaaaggaaagcctgcggggctggttgtttctgccgtagtttacttcatgtacaagatcgctcttcgttgggaagaaccttttactgccatgatctacgctaaccgtgata

SEQ ID NO: 370 - DNA, 629 bp, Saccharomyces cereviseae
gaattccagctgaccaccatgacaagatctccctggaagcgcctactatggttgaaacaggagtacccagataattatacagatccaagttttattgagttgagagcaagacaaaaggctgagagtaaccagaagtctgatagaaaattatcagaagctgctcgcgctcaaattaggttggattttataagtttctaccaaaccatattgaacacttctttcatttacatcacttttacatatatttactattatggcttcgatcctattccgccaactattttcctttcatttataacattgattatatcaaggacgaaagtcgaccctctattgtcctcattcatggacgtaaagtcttcgctgattatcacatttgcaatgttgactctctctccagtcctcaaatctctttctaaaacaactgcatctgattccatatggacattgtctttttggctgaccctatggtacattttcgttatttcgtcaacaaagtccaaagataaaccctctaacctttccaccaatatacttgtcgcccttgttgctgtcctatcatcgaggctttcgaccacaatcgacgtattctgttttcttttaatttgtattcagttgaatatcattct

SEQ ID NO: 371 - DNA, 629 bp, Saccharomyces cereviseae
gaattccagtgaccaccatgaagttgcagagtttgttggtttctgctgcagttttgacttctctaacagagaacgttaacgcttggtcaccaaataacagttacgtccctgcgaacgtaacctgtgatgatgatattaacttagtcagagaagcatctggtttgtcagataacgaaacagaatggctgaaaaaaagagatgcatacaccaaggaggctttgcattcttttttgaatagggccacttcgaatttcagtgacacttccttgctatccactctttttggtagcaactcttccaatatgcctaagattgccgtcgcctgttctggtggtggttaccgtgccatgttgtctggtgctggtatgcttgctgctatggacaatcgtactgatggcgcaaatgagcatggtcttggtgggctgctgcaaggtgcaacttacttggcaggtctgtcgggtggtaactggttaacaagtactttggcttggaacaactggacgtctgtgcaagctatcgtggataatacaacagaatctaactcaatttgggacatctctcattcaattcttaccccagacggcattaacatctttaagactgggagtagatgggacgacatatcagat

SEQ ID NO: 372 - DNA, 875 bp, Saccharomyces cereviseae
gaattccagctgaccaccatgcattatttgcctgttgcgatagtaacaggtgccactaggggtataggcaaggcaatatgtcaaaagttatttcaaaagggtttaagttgcattatacttgggtctactaaagaaagtatagagcgcaccgcgatagatagaggccaattacaatcgggattatcatatcagcggcaatgtgctatagcaattgattttaagaaatggcctcactggcttgactatgagtcatatgacggtatcgaatatttcaaagatagaccgcccttgaaacagaaatattccacattgttcgacccatgtaacaaatggtcaaataatgaacgccgctactacgtaaacttattgattaactgcgcaggcttgactcaagaatcattaagtgtaagaaccactgcatctcaaattcaggacataatgaatgttaactttatgagccctgcgacgatgacaaacatctgtattaagtatatgatgaagtcgcaaaggagatggccggaactcagtggtcaatctgctcgacccaccatcgtaaatatttcctccattctacactccggaaaagtgaaggttccaggtacatctgtttactccgcctctaaagccgcactgtccagatttacagaagttttagctgcagaaatggaaccaagaaacattaggtgttttacgatatctccaggtttagtcaaagggaccgatatgatccaaaatttgccagtggaggctaaagaaatgctggagagaaccattggggcaagcggtacaagcgcacccgctgaaatagcggaagaagtctggtctctatacagtagaactgctttggagacgtaacatggcaattcccggggatc

SEQ ID NO: 373 - DNA, 636 bp, Saccharomyces cereviseae
gaattccagctgaccaccatgtggacaaacactttcaaatggtgcagcaaaactgagaaggagaccactactgcagacgccaaggtgtgtgctagcgtgcagggcctgaaggccctgcagcagcaaattatggatagcaccactgtgcgtgggtccgttaatgacacgatgactccaggcgggattaaccagtggcatttccacaataagcgtgcgaacaaagtgtgcacgcctacagtactaatccgtggatacgctgcctcgtcgatggcgttctacaggacgtttgagaacctgtcagacaacattaaagatctatatgccatcgacttgccagccaatggtgcctcagaggcgccagcattgcaagtgaacaaaaccaagaagatcaagtctctcaggtttaagcatatagaagatgacgtagtaatccctgtgatagagaagcgccccccagcagaggacatcaagtcacacctggagcagtacgaaagctacttcgtagacaggatagagcaatggcggaaggataacaagcttcgcaaaataaacgtggtgggccattcattcggaggatatatttcattcaaatacgccctcaagtaccctgattccattgagaaactgtgtctcata

SEQ ID NO: 374 - DNA, 631 bp, Saccharomyces cereviseae
gaattccagctgaccaccatgtcgactaatacttccaagactttggaactgttttcaaaaaagacggtacaagaacacaatactgccaatgactgctgggtcacttatcaaaacagaaagatttatgacgtgaccaggtttttgagcgaacaccctggtggtgacgagtccatcttggactatgctggtaaggacattactgagatcatgaaagactcagatgtgcatgaacacagcgactccgcgtatgaaatccttgaggacgaatatttgattggttacttggcaactgacgaagaggcagcgagattgttgactaacaagaaccataaggttgaagtgcagttgtcagctgacggtactgagtttgactccactacttttgtaaaggagttgcccgccgaggagaaactaagtattgctacggactacagtaacgactacaaaaagcataaatttttggatctgaaccgtcctttgctgatgcagattctgcgtagtgatttcaagaaagatttttacgttgaccaaatccatagaccaagacattacggtaaggggtctgccccgctatttggtaatttcttggaaccattaactaaaacagcttggtgggttgttccggttgctt

SEQ ID NO: 375 - DNA, 632 bp, Saccharomyces cereviseae
gaattccagctgaccaccatgagaaaagaattaaaataccttatctgcttcaacatactcctcctgttatctataatatactacactttcgatttgctaacgttgtgtattgacgatactgttaaagatgctatacttgaggaagacttaaatccagatgcacctccaaagcctcaactaatacctaaaatcatacatcagacttataaaacggaagacatccctgagcactggaaagagggtagacaaaaatgtctcgatctacatccagattacaagtacatcctatggacggacgagatggcctatgagtttataaaggaagaatacccgtggtttctcgatacttttgagaactacaaataccccatagaacgtgccgatgccattcgttactttatcctgtcccattatggtggtgtatacatcgatttagatgacggctgcgaaaggaaactagatcctttgttagctttcccggccttcttaagaaagacttcacctttaggtgtctcaaacgatgtcatgggttctgtgcctagacatcccttctttttaaaggctttaaagtctttgaaacactatgacaagtactggtttatcccttacatgactattatggggtctactgg

SEQ ID NO: 376 - DNA, 631 bp, Saccharomyces cereviseae
gaattccagctgaccaccatgaacgtaacatcgaatgcaactgcagccggttcctttccactagcatttggtctcaagacctcatttgggtttatgcactatgccaaggcccctgccattaatttacgccccaaggaatccttgctgccggaaatgagtgatggtgtgctggccttggttgcgccggttgttgcctactgggcgttgtctggtatattccatgtaatagacactttccatctggctgagaagtacagaattcatccgagcgaagaggttgccaagaggaacaaggcgtcgagaatgcatgctttccttgaagtgattctacaacatatcatacagaccattgttggccttatctttatgcacttcgagccgatctacatgactgggtttgaagaaaatgccatgtggaagcttcgtgcagaccttcctcggattattccagatgccgctatttattacggctatatgtacggaatgtccgctttgaagatctttgcaggctttttattcgttgatacatggcaatactttttgcatagattgatgcatatgaataagaccttatacaaatggttccactctgttcatcatgaactatacgtgccatatgcttacggtgctc

SEQ ID NO: 377 - DNA, 635 bp, Saccharomyces cereviseae
gaattccagctgaccaccatgagtgaaacagaattgagaaaaagacaggcccaattcactagggagttacatggtgatgatattggtaaaaagacaggtttgagtgcattgatgtcgaagaacaactctgcccaaaaggaagccgttcagaagtacttgagaaattgggatggtagaaccgataaagatgccgaagaacgtcgtcttgaggattataatgaagccacacattcctactataacgtcgttacagatttctatgaatatggttggggttcctctttccatttcagcagattttataaaggtgagagtttcgctgcctcgatagcaagacatgaacattatttagcttacaaggctggtattcaaagaggcgatttagttctcgacgttggttgtggtgttgggggcccagcaagagagattgcaagatttaccggttgtaacgtcatcggtctaaacaataacgattaccaaattgccaaggcaaaatattacgctaaaaaatacaatttgagtgaccaaatggactttgtaaagggtgatttcatgaaaatggatttcgaagaaaacactttcgacaaagtttatgcaattgaggccacatgtcacgctccaaaattagaaggtgt

SEQ ID NO: 378 - DNA, 597 bp, Saccharomyces cereviseae
gaattccagtgaccaccatgccttacactcttccgacgctcatcataagttaatcacctctcatttggtggacaccgaccctgaagtggactccattatcaaggatgaaattgaaagacaaaagcactccatcaatttgattgcttctgaaaatttcacctcaacctccgttttcgatgcccttggaactccattgtccaacaaatactctgaaggttatccaggtgctcgttactacggtggtaatgaacacattgacagaatggaaattctatgtcaacaaagagctttgaaagctttccatgttactccagacaagtggggtgttaacgtccaaactttatctggttctcctgctaacttgcaggtttatcaagctattatgaagcctcatgaaagattgatgggtctatacctaccagatggtggtcatttgtctcacggtcacgctactgaaaacagaaaaatttctgctgtttccacatacttcgaatctttcccatacagagttaacccagaaaccggtattatcgactacgatactttagaaaagaacgccatcctatatagaccaaaggttcttgttgctggtacttc

SEQ ID NO: 379 - DNA, 612 bp, Saccharomyces cereviseae
gaattccagctgaccaccatgggtaaagttattttagttacaggtgtttccagaggtatcggtaagtccatcgtggatgttcttttcagtttggacaaggacacggttgtttacggtgtagccaggtctgaggcacccttgaagaagttgaaagagaagtatggcgacaggtttttttacgttgtcggtgatattaccgaggattccgtgttgaagcagttggttaacgctgctgttaagggccacggcaagatcgactccttggttgccaacgctggtgtcctagagcccgtgcaaaatgtcaacgagattgatgtcaacgcttggaagaagctgtatgacatcaacttcttcagcattgtttccttggttggcattgcgttacctgaattgaagaagaccaacggtaacgtggtattcgtcagttcggacgcctgtaacatgtacttcagcagttggggagcttacggttcttcaaaagccgctctgaaccacttcgccatgactctggccaacgaggaaaggcaagtgaaagccattgccgtcgccccaggtattgtggacacagatatgcaagttaacattagggagaacgtggggccttcctccatg

SEQ ID NO: 380 - DNA, 635 bp, Saccharomyces cereviseae
gaattccagctgaccaccatgggctccaaaaaactgaccgtaggatctgattcgcaccggttgagcaaatccagtttttcaagtaataagtcgtcacattcagcaacaaacgatcagccaattgataccgacgatattgatgaagacgatgaatctggtcataatattatcttgaacatcatctcacaattgagaccaggctgcgatttgaccaggatcaccttgcctacttttatcttagaaaaaaaatcgatgcttgaacgtgtcacaaatcagttacaattccctgagtttttgttacaggcgcattcagaaaaggaccccttgaaaagatttttgtacgtaatgaaatggtatttggcaggctggcatattgctccaaaggctgtaaaaaaaccattgaacccagtccttggtgaatattttacagcttattgggatctaccaaacaagcagcaggcatattatatatctgaacagacaagtcaccatcctccagaatgtgcatatttttacatgattcctgaatcttcgattagagtggatggggtcgttattcctaaatctagatttttaggtaattcaagtgcggccatgatggatggatcaacagtcttgcaatttctggacataaa

SEQ ID NO: 381 - DNA, 619 bp, Saccharomyces cereviseae
gaattccagctgaccaccatgtctgctgttaacgttgcacctgaattgactaatgccgacaacacaattacctacgatgcgattgtcatcggtgccggtgttatcggtccatgtgttgctactggtctagcaagaaagggtaagaaagttcttatcgtagaacgtgactgggctatgcctgatagaattgttggtgaattgatgcaaccaggtggtgttagagcattgagaagtctgggtatgattcaatctatcaacaacatcgaagcatatcctgttaccggttataccgtctttttcaacggcgaacaagttgatattccatacccttacaaggccgatatccctaaagttgaaaaattgaaggacttggtcaaagatggtaatgacaaggtcttggaagacagcactattcacatcaaggattacgaagatgatgaaagagaaggggtgttgcttttgttcatggtagattcttgaacaacttgagaaacattactgctcaagagccaaatgttactagagtgcaaggtaactgtattgagatattgaaggatgaaaagaatgaggttgttggtgccaaggttgacattgatggccgtggcaaggtggaattcaa

SEQ ID NO: 382 - DNA, 266 bp, Trichoderma harzianum
gtggcgggtttacattgataagtgacggatatgcatcccgaaaatgacaaatttgtaagcatgtcactgccggcaaagaaccctgaatgctctagatgcttccgaaggattctccataagatgatatcccatgcagtttgtgccaaaatgggttaacggacgcccgattccgtgggtgtgcatttgattgagacccccatgtttgcagtgaatcggttgggtaagatgcattggagaggatgtacgtaggaggttcatttattgcc

SEQ ID NO: 383 - DNA, 495 bp, Trichoderma harzianum
cccacgcgtccggtttctcaaaacaccaaatgcacctgaatctcagctgagcctcgcccgcccgccaaagtcagttttttatgcttcacgcaatttagaacaaacaaggggaatccgaaaccaaaaccttcctgaatcgccaatcatgggctcctcaagcctgcttgaccagtacggcgacgccgtcagccagagtggcttctcgtctcgtcaccacgcgaagagcagccgccacaagaagcgccgctcgcactcgcactcgccgtcgcgatcccggtcccgggaccgatctcgagatcgtgatcgtgaacgtgaacgggacagagacagagacaggtcgcgctcccggaaccgcggcgggatctttggcggcgagagcggccaccgcaggcacagcggctccaagggctcgttctttggcctgggtggcggtaataacagccgctccagcctgtttggaagcagccgtccctcgtactacaaacgctctcctcg

SEQ ID NO: 384 - DNA, 590 bp, Trichoderma harzianum
ggtgccgggacaagcagcccgagtctttcttctcccagagcgctgtttcttgaatctttgtttccgccacatcctccgtgaagcccgagaaaaaaacatctctagcatcagaagatcctataaaagataaaaaagacttatacaaaaaatccttcctcgcaagggaagcgccggagcaacaacatgcccatagcactgtcccctcccttccggccaagaaatggcttgaccaagttcaccaactgccgcctcctgcgcggcgataagctggtcgaggaggatctctgggtcagctcgctgtctggcaaggttgtcaacagccaggctgcctttttcgatgacctcgttctccctgaccagaccatcgacctcgacggccgcatcatctcgccgggcatgattgatgtgcagctcaacggcgcgttcggcttcaacttctcgacgctgctcgatgacatgtcacagtacggcaaaaaggtcaaggaggtgcagaagttgctggtgcagacgggcgtcacatcgtacaatcccaccatcaccagccagaggccagaactataccagaaggctcttccgttcctaggaccgtc

SEQ ID NO: 385 - DNA, 373 bp, Trichoderma harzianum
cccacgcgtccgcccacgcgtccgaaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattaaccaagttctgcctgccacccaggctctttgtgccaaccagtgaactcatccatcg

SEQ ID NO: 386 - DNA, 529 bp, Trichoderma harzianum
ctttttgatatctcaaaactccccaaacaacccacatcaatcatcatgactggacgcggcaaaggtggcaacgggcctcggcaagggtggtgccaagcgtcaccgcaagattcttcgtgacaacatccagagtattaccaagcccgctatccgacgtctcgctcgtcgtggtggtgtcaagcgtatctctgccatgatctacgaggagacccgtggtgtcctcaagtccttcctcgagggtgtcatccgtgatgccgtcacatacactgagcacgccaagcgcaagaccgtcacatcactagacgttgtctatgctctgaaacgacagggccgcaccctgtacggtttcggtggttaagcgatctgccactaggtcgggtcgacataatgtgttattcgcgtgtttgttacgattgggcttttcactatgggcgcgggtcattgctttttgagatttcgtactgtataacgtactgggaaatgggtgacccccgaaagggggtaattgagacttattcagtggtgacct

SEQ ID NO: 387 - DNA, 289 bp, Trichoderma harzianum
actgaatgagacaagagacaagagacagaagagatcgggaccggcattcgggggggacaccctggccgaactaaatcaatccgtgctactgtacgtcttacacgatttcggctctgctaggggccccgaatggccacggagcccatggacagagagagaaaagtggcggatcaggatgaggctgatggtgatggatgatgccatgctgcatttcgtctgaaacgacttacttttatgtagcttgtgaggccataatctcgcagataaataacacgaatatttcctcacc

SEQ ID NO: 388 - DNA, 147 bp, Trichoderma harzianum
cccacgcgtccgatttggcaattcctcaagctcacccatttgttgactctggcagtgtagcacacagtctgctcaacaaaccacatcaccatgtccgccgcagagaagaccacggtggcgaccgacgtcgcaaatccccccagtcgc

SEQ ID NO: 389 - DNA, 605 bp, Trichoderma harzianum
gcctcgctgctactctcaattgaactcgactcgagctccgtcaatcgcaaatccctacaagatgctgcgctctatggttctacgaggcaatgccttgacgcagaccacccgactggctgcatccagggccatgtcgagccaggcgctctccaacccgaccctgtccaacatcgagaaacgctgggagggaatgcctctccaggagcaggccgacctgtggatggccctgcgtgaccgcatgaagggcagctggaacgacctgaccctgcaggagaagaaggccgcttactggatcgccttcggccctcacggcccccgcaccgttgacgctcccggagccggtgcccgtgttgcctggggagttgccgttggccttgccgcctctctcgctctcttcgctgccatccgagttgccgccaagcctgcgccttacaccatgaacaaggagtaccaggaggccactaacgagcttctcaaggctcaaggtgctgatcccctcactggtatctcttctcccggctatactggcaagggtgtcgtgcagtctcctcccaaaaactaaaataaaacacgataatatcgcttcaagcttcgcacaattgggg

SEQ ID NO: 390 - DNA, 197 bp, Trichoderma harzianum
ggtttcggagagctagattgaatcggaggggctgcctatattgcggcagaggaatagtgacgtcatgactatcaaggaccctgggaggttacctaaaagaaaagcatctggacgaggtgacgtagccatcaatgcgatcgattgtttgctctatctcctcgggtcggctgttgatttagtattaaactaatggatat

SEQ ID NO: 391 - DNA, 350 bp, Trichoderma harzianum
taagattttcagctcacctcaaaaggagcactttcactgctggaaaccagaatctcttgcggatccccagattaagccagaggtactccgtacctacaggacccagttacaatcgtggagaatcctctctccaatcgcctccaatcgtctccaactttggtgtcagatagtacatcgatccgccaattttatgttgctcttgggagtcattctccattcgacgtttgacccgccatcggagccttgtcttgccgactatcctcttaactcccgggcttcccttccaaacttttaatcttccaccgcaacatcttttcttcctttcttcttctttttcctttcttcattga

SEQ ID NO: 392 - DNA, 585 bp, Trichoderma harzianum
cccacgcgtccgcccacgcgtccgggatcttggtgggcaccacgacgttcttctccatcctcatcttctcgatcaacactgtctttgctcaggaaacactcgcgcagtggattggagattacctgactcaatctgctggtgttacggttgtcttcgaatcagccatagtgcccaagtggaagaatggcgttatcgcatttcgtaatgtgtttatttcaagaagacccgggcagatcgaatcatccgtcagcaagggatcgtctgacgctgctgctgttgctgccgcagggcgccaggttcagcataacgggactgttaccgaagacgatggcaactatacgcaatttgatgtaacgatcgcaaacgtcaatgtcacactttcattcctcaactggtggaatggcagggggcttctcaaagatgtggaagtaaatggtgttagaggaattgtcgatcgcacctctgtccgttggccactgcagcaaatcgaccccttgtcttaccgccacaaacaccaaccaggcgattttgagattgaatctttcaaattggaagatcttttgctcaccattcgccaacctgatg

SEQ ID NO: 393 - DNA, 318 bp, Trichoderma harzianum
ggcgcccataaacaatgtctcagggcccaaggaatgtgctgtgaacgagctgctactgcaccgccgattgtctgatgcaagcaagggacttgtttgtttgctccatccttgattcactttaatgcttgttattaggtactttaacagccactttgaaaaggtactttgcaaatgcttaaatctccattctgccttatactccatgcctgtaattgtatattaccaccatggtaatccagtaataccgcaagctggcagtatcaatcgccatttttctctacataaaaggagctgtatcacgtgcctttaaatccatct

SEQ ID NO: 394 - DNA, 212 bp, Trichoderma harzianum
gatgaggacgatgttgaggatgtgattggagaagacatggacgaagacatttatgattaagcggattgatcaatccaggaaacaaagtttcacccaaaagttatttttcttttctcgtcacggatatggcatacggagtttcaggaggaaatggggaaaccgtttttggtttgagtaattactcataaattggccctctataatgtatcata

SEQ ID NO: 395 - DNA, 194 bp, Trichoderma harzianum
gccaagccttgtagttgtgtattcacaaagtgtgggcctgccttcatttatatttattctcctcatgccgtgtcttggctgaagcgcgaagttcttctcttctccaattctatcgatgctactgctgaccaacgtcagttcctctactgattccaccccatatttgacgcctatcctacttaccttgtggtcct

SEQ ID NO: 396 - DNA, 304 bp, Trichoderma harzianum
ggcgcccaggagcaatgtctcagggcccaacgaatgtgcggtgaacgacctgctactgcaccgccgattgtctgatgcaagcaagggagttgtttgtttgctccatccttgattcactttaatgcttgttattaggtactttaagagccatgttgaaagggtactttgcaagtgcttaaatctccattctgccttatactccatgcctgtaattgtatagtagcaccagggtaagccagcaataccgcaagctggcagtatcaatcgccatttttctctacaaaaaaagaaagaaaaaaaaaac

SEQ ID NO: 397 - DNA, 565 bp, Trichoderma harzianum
gatttctccaccactcgctcggcatttgtgggctcttcctcagcgatttaaaggacctgacccgtctcacgaatcaagaggcataaccgttactgccatctcagaccgctaagcagcgatatcgtcatattcgcggcgctgtgaaggacaagaacgagaacgagaactgttgaagcttggctcacccagtccccgcagcaatgggcctggcctacaacacctacctcaccagcaacaagatctacggttgcaaaacatgcaaggcgcatcttgcgaaccacgaggacatcatctctcggaacttccggggccaacatggcaaggcctacctgttccatcgtgtcgtcaatatcgacaccggtgaccctaatgagcgtaacatgaccaccggccgccacattgtccgtgacatcgcctgccatcagtgcaaagaaacggtgggttggaagtacgacaaggcttttgagacttctgaaaagtacaaggagggcaagttcatccttgaagctgagctgctatgtaacgtcgcttgattgtacgaatttcacctctttagcatgatttc

SEQ ID NO: 398 - DNA, 254 bp, Trichoderma harzianum
gggaagcctctcgcaatcggcccaatccgggatttgtgtcgtgccccggcgctctcaacagctccttcaccagctctctcaagtttgagacgcccgaatcataaacagacctgccgacgtacagagtcgtggaccaaaatgggcaattggttgacccctccttcacccctgacatcagcgatgaggccgtcatcaatgctgtacaaggatatgctgtacatctccatcatggatctcatcatggtttgatgctc

SEQ ID NO: 399 - DNA, 439 bp, Trichoderma harzianum
ggcttctggaaatattctagcctccgccctggattagatacccgaagactcgggcaggctgtattctgcgcccaagatctccaagtgccggcaccaacccgggcgctacgggcttttctgtttatgtgtgtgaataccccaatttctggaaaatctccaaaaagaggaaagaaacagccccaaaatgtcccaccgggctagttcgggagactcaccgcctgtgggagcacaggagaagggaaacgcaggccaggccgtgcaggacactggtgtggtgcagcaatcagacgctgccttcacgaattcatacgatgaggaggatttctggacgaggaacggcttgaatgccaagtcattccacaagaaacactatggattgggactggtggaactggaccgagcgatgaagacaaggcaccttacagatgattgccattgg

SEQ ID NO: 400 - DNA, 462 bp, Trichoderma harzianum
cccacgcgtccgcccacgcgtccgggcaaagagatgctacatccataattccatcacatgccggttgcctcgtcatcattatttctcaagcagcacattccgtcaaaaccttgtgttgagccgtggaaatagccagaaagtatcttgctcaaccctcattcagcttgccttgtcgtttcctaatctaccaacatgggatgcctagaagtctgggccttccgtccatttaccgtggggtcggggacttgactgattccgaggagttctggtgacacagcacgcaaggcagccattcctcctggttaagcatatctctttgccatcggattccgaagaggccgaaatttggaaccgcaatgacagatcccgttgataacggcatgccggggagtgtcattccagtattacgcagcgtatgggcggcggttcggtttcgatctacgggcatgctatgcatttgga

SEQ ID NO: 401 - DNA, 431 bp, Trichoderma harzianum
gatcctgtgaacatggtcggatttgttggctcgaacttgctccgcggggactatcagatcgtacacgccgaagacattaacatcaagaatcttcatgcctggcaagtcgtggatgttcgcacacccgaggagtttgcgactggccacctcccgggggcaatcaacttgccaattgcaacactgcgcaatcagaaattggagcttgaccaatccatgccaattcttgtgtactgttatgtgggctatcggggatacttggcctaccgcatcctcagtcagagaggattcagcgtagtaaaccttgatggcggactgaagacagtagtcgaggggggaaccaggctttgaaaatttgttcttcagaaaatttgttcttcatgtttctaacatatttaagtgatatctaagtaatataatctcagtcttacgcg

SEQ ID NO: 402 - DNA, 371 bp, Trichoderma harzianum
gcagttagctcaaagggggcatttcgatgggaacgaagcaatctggaacgtggtaaccaaggagtgtagaggtagtttcgatgtatactcgccacatcgtatcttgagcgagttcctcgtcagtttcgatgtgtcaacgctccgggattggaacaaaacagccaatgcttgacctcgcgtaatctgtatcttgcacaacattgcggggatgatctttagccgatatcttggaaggcagcggcgcgaatgaccatctactacgtccaaaccgggcgataagagaggccgccacgtacgcgattcgcgcggtcctcggtcgttcggagtggtgttgtggatagtgccaggcgaaaaaaaaacagccaacatct

SEQ ID NO: 403 - DNA, 361 bp, Trichoderma harzianum
ccccaatcgccaaatacacaaatccattgcgctacaaagaacaagcaccatggacgccaagcctgccactttctccttggccgctgcgccagttgcttctcccgcagcctccgcgagcgcttccaagcccaagccgtgctgcgtatgcaaagaggaaaagtcgaagcgcgatgagtgcatgctcttctcaacggccaaggatcccgcagccgactgcagatcgctcgttgaccaatacaagagctgcatgcagggcttcggattcactgtataaatcaaaatatcttcatcttggcgctatgcctttgtacattatcaccatatagactactcggaaaagtacagcgctcgattattctac

SEQ ID NO: 404 - DNA, 197 bp, Trichoderma harzianum
gcccaatcgccaaatacacaaatccattgagctacaaataacaagcagcatggacaccaaacctgacactttctccttggccgtatgcgccatgttgacttctcccgcaatctccgctaaacgcttccaaacccaagccgggctgcgtatgctaagaggaaaattctaaccgcgaagagtgaatgatcttctcaacg

SEQ ID NO: 405 - DNA, 466 bp, Trichoderma harzianum
cgcccccatacaatctccaactcaactcaagcaggctatctgtggaccacaagtacaactcatcacaacaatatcagccctttcaacaacagcaacagcaccagtataacaacaacatcaccaacaacaacaacaacctgaacaaccatcatcagacaaagctggacgacttcaccttcggcaactcgaccgactttgacttctcgacctcgaccttcccctcaaccgagctctctgtgtccaatctcgagtatctcaacgccgcaatcgcctctgcgttttcgtctgactcgatgcggcccgaatcctgggacgccgccgctcgcttctcaactcccaagtttggtcgtcttccccatcaacgagaatcctctctgtcttctctgggatctacggggccggggtcgcccttcaactcgcacatcgggaacccccacatcgccggcactgacgccaatggtgacgg

SEQ ID NO: 406 - DNA, 483 bp, Trichoderma harzianum
cgcccgacaggttacccgcaacgccccgcggtgtgctgcgcagctgcgcactcccatgcagggccgcttcgccagcaccgccgagaacgagttcatcgctgagcgccagcacatcaaggaacacgccaagggcaccactgagctttggaagaagatttccatctacgccgttgttcctgcgctggctatcgccggtgccaatgcctactggctgtggactgagcactgggagcactggagccatcttcctcctctgcccgagcgcaccgagtacccctaccagaacatccggaccaagaactaccagtggggtgatggtgacaagactatcttctggaacgacaacgtcaactaccacaacaaggacaagaccaaataagctggaacaatggctcccggaggaaaactgctggtatttgtagattaccctttttgggacccctctgtatatttcccttggagcttcaatcgattacactgtgg

SEQ ID NO: 407 - DNA, 151 bp, Trichoderma harzianum
cccccatagagtcgactcattgctggcatacggagcattcctatcttactcttactagtgtttttgccatcgttcatcatgctgcccaatgcgatcatcgcgattgtcgcattggatttcagcccactaaatgcgctgtggcccattcctc

SEQ ID NO: 408 - DNA, 157 bp, Trichoderma harzianum
agcaattatacattaaaatcacctcatcacctgcggatactattatgcatattaattactcgaccggcaacagccatcccagcatcctcttttggtaaagtagtggccttcacatgcaaacatcggctatcgcaactaacacccccttcccctgtcc

SEQ ID NO: 409 - DNA, 472 bp, Trichoderma harzianum
cgaatacattacaagtagcagattgtttccttcttgcacggactttttacggactctttgttgtcactctggcccgatccttttgaccgtgtggccgtttgcattactagctccgtccagcatcagggatccccatcgataccaggtcgagatacctacctagtagtacctatctgcttgaagttaccacttgcgagttgtccatattgacttcatctgccctgtgctatcatacagcccaggggaacaactcccctgataacaaaaagaagctccagtcccgccgtctctagattttggaccccgtttgtctccgtacagcacgcattggatcccgtgggcctcaaaaattcaagtcagggatatgtctggtgacgtgcatatgcgggccttttcaggcgtctaatcatacgtggcgggtttctccagacgcctctccaggccccctctaggacctgtccaaatgcgctgc

SEQ ID NO: 410 - DNA, 126 bp, Trichoderma harzianum
cagaggattaaggattgggaaataataagagagttgtcgagaggtcactggtggcaaatgtttttgttataggtagcccatcaacccgtatcacacaagactgagcagtatatatagaattctcag

SEQ ID NO: 411 - DNA, 436 bp, Trichoderma harzianum
attcttccccccgttaaaatcgaatccttcagtgctcgccgctagaaaaaaccgcttccactcattcccacgcgacaatctcgatcatcatagcccttttgatcgcttcgccacatcacatagatcatgtctaaccaggactgggattctgccaccaatattggaacccgcgttcgcggtcccggtgcttcggaccgcgaaaccgtcatccgaggaaagattgcgttgaaggctgcccatagatctggtgctgccattagcacggagaagaagtatcccagcgccaatacggtcatcggtactgagggtcagcgtctcaacaaggtcgatcgttccgacgacatcatcaagcccaggattgtcggaaaggaagtcggaaaggccatcgagcagggccgacagaagttggagcctaccatgacccaggctggtctgg

SEQ ID NO: 412 - DNA, 544 bp, Trichoderma harzianum
cataaccacaactaagtcataaggaaacaagtcacgattctgaatatctattcgcgttatatacaacctaaaatgaagccgttttatctgattgctattctatttaccactttgggcactgctatcccaggttatccctagggataataacggaatcctcgataatttcctagctattgtgaaagacgcgacaggaattgatcggacacccgtccacgggctcgtcggcactgtcctgaatggtggcaccaaatctatcttgattaactcgactgtcctgggtcttgcagaggcaatttttgatgaggtgaaatcccaattaggcattcaagatccgcggtcgcttgaagaaactattgcgtctttggaagaggcgggtaatgagacttttaaccaattctgccaactactcgacacgttccgcagagaggataaaggtcctgctggaggaaccattgactcgctaggcgtgggcaatatatcctcattaaacttggcattttctatcgacttgatcataaacttggtcggactacaatgtcca

SEQ ID NO: 413 - DNA, 376 bp, Trichoderma harzianum
gcctataagtcgcgattccttggagataacgcgaaggaatcgggtacagtaaacgaaccccgctgggacaatgcattgataatctcacgcaatcgcccatctcgtgcaagagatccgtcatttgcttcaatgggagcgagcatttgtacttgattggggaaatacagcagaagacagacgaattgaccaagagtggggagttcatttacaactccaaccctcgacttcaccatgatcatctccaacagggtcattggttcgggcattttgctcgctggcagcacgagagctcatttacggcttcccccgttctttacggccaagcagcagggtctgggcccgtctgcccgatcccaattccaaagcttcgggttcg

SEQ ID NO: 414 - DNA, 318 bp, Trichoderma harzianum
ctcgtgtggcgcctcgtctcagggacaacagacgaggaccaattcaaataccagacctaaccatggctgggctagatggcaataaccatagcacgcttcactcgagaacagacgcgctcgacaatcaaggatgtgctacggcacacccattgggacagatgatgtcgcggttcaacggtaactcttgtgatctagtagattgaccatcataccgtgaggccgcctctagttgtccaggacgataaatgccacttgcaatgaccgaagctgtctgagtctcaatacactctgtaccacatgaaagggctgctatgtctg

SEQ ID NO: 415 - DNA, 382 bp, Trichoderma harzianum
cttcgttgccttcgatttccatccgttggtccgttccaagctcgacgggatccggggcggatgacggggacctgactgtgcctgcatcggtcacggtgccggagggcgtgacggaagataccattgtccagcgattcgcctgggcttgctgcggtgacaactgcgtattggccatggggatgtcgcccggggcggcaccgcttgcgcctccggattgtatggaggcgtcgttgtatacgcggcgctctgcagcatttctccgctttgtgagatagaaccacacggttgccgcgacgaggaggccgccgcccaccactgcaccgacggcgatacccgcttccgccccgggagagagacccccggacgatgaggacccggagtt

SEQ ID NO: 416 - DNA, 224 bp, Trichoderma harzianum
ctcgtgtggcgccttgtctcagggacaacagacgagcgagcaactcaaagaccagagctaaacatggcttggctatatggcaataagcagagcacgcttcaagtcgagaacagacgcgctcgacaataaaggatgtgctacggcacagccattgggacagatgatgtcgcggtgcaacggtaactctcccgatcttgttgatggagcatcataacgtgaggccg

SEQ ID NO: 417 - DNA, 188 bp, Trichoderma harzianum
ctttttcggcgtttggcatcaaaatcccttggtcagcgaaccccgagcccgtgcgcttgggaaaagtatgggggattgacttttcgagggagggtcatgtgatcttagtacgtaccgcagtttttagtaacagcctagaggttgcaagtttttttttagaaattcccaacgccaatgttggctgtggc

SEQ ID NO: 418 - DNA, 452 bp, Trichoderma harzianum
cccacgcgtccgcgcatcttcaccaaggcgccgtcatcgcgcggcatcatcgtcattgacttgagcttggaaagctcagcaagatgccagcaaccatggcccctccaacgcagactttcaacctcgatgttgaggcaatctcgggcatttgcggatctatctctatagcctgttgggtggtcgtgttctctccgcaaatcatacaaaatttccaacgcagcagcgccgacgctctttcgattcaattcatcattgcttggctcctaggagatgtcttcaatatcctcggagccgttttacagggagttctccccaccatgatcatcctagccatctactacaccattgccgatctcgtactgctctgccagctgttttactatcgcggatttacgtggcgcgacgagccgactccatccccgcccaagacaaatggccactcttcgacatca

SEQ ID NO: 419 - DNA, 591 bp, Trichoderma harzianum
cccacgcgtccgccgtgactgaagttcaaccacatcccaaacacaatataaaaccctcacattttcaaaagaaaatcgattattatcacactagaaattaagaaaaataacaggaagcatgtctgacgaagagggcggcacaacaagatgctgcgccccgttcctcgctctcaccgagcccattgaagtcagcgaactaggatggcctcgacaaaccatccgcatttttccaatggccctggcccagtcccctcttgttcatcaacgaaagtagcgatgcgcgggatcactgcgccaacgagcgaactttcctttcgtacctccgcctgtcgatatacatggccatcgtctctgtcgccatcaccgtctcgttccacatcaagggtacgcccagcgatctcgagcgccgggtggcaaagccccttggtggcattttttgggtactgtctgttgtgactttggctttaggagcgggaaactatatcaggactgtcaatttatatggtaaaagagccgctattgtgcaatctggctggaagactcaggtggtgtggggtataatagctgcttcaatcattgggacgtgcatca

SEQ ID NO: 420 - DNA, 551 bp, Trichoderma harzianum
cgctacggcttatttactcttctgaccggaggtctcggtattgacatgaccttggagccatcgctgccgcaacgaaatggagtactcgtacatgtagccgcagtctcttgtccatgcgagcgggcatttcgtcggcgtcccaatggtcaccgcgagacctatcatttgagatactgtctatcttcctgcatgttggctgtacgagacgaacgatatgacggctccctgcctttgatttctatgcagcagtagccaaaagagaaaaggtgtaatatgcagcaaggccgctatgttgccaccccacgagacctcgactgcatgcacgtccagcgatacgtctccacgaggccgcgcatgaccgctgtgtcgagagtggatggactgcggacacctctctgcttgcaacggctcagcaaattttgccgttgggccaccgaagccaaacggctcaccgtctacgcaattggcactctaaatgctcctttccgcagccgccttgctttcaatacgcgtccacaagcgtttgtagcccttgtcaggccgttgcggtt

SEQ ID NO: 421 - DNA, 451 bp, Trichoderma harzianum
catacatacacgaggggatatccccaagtccagtcttcttgctttcttgctctcgtcgggaaaatgaggagagggctatagaaaaataaagtctattctcgcaataaagcttagacaaactttgatttgtctgctccggcaaacgcctcatttcgtcatagcgccagtaatatgtcaccggacgtttatgaaagaagagagaccatagggaaaaaaggttggatattatccgagtgggctggcagaaaatgacgccaacccgggcagcgaatggttatcgtatcacctgaactccgcctttttgatttctctttccaatgggacagcgggcgatacagcaaggcaagggacatgtaccgtattggttctcggggctcgaatgcaatagtgcctcatggatattgattgcagtgtgcaataaattgcctatctgcggtggaaaaaaaaaaaa

SEQ ID NO: 422 - DNA, 387 bp, Trichoderma harzianum
cccacgcgtccgctgttcctcctcctagcttcaaaaagacgccaaaccctcaaaactgctcccaaccaaaaataatccactacaaacgctttcgataaacttgctcaaatgctctcagatgggtaacgcagatgcgtgtgattggctggctgtgcgcctggtccctgttttagcctccccgccattcgggatccggaaaccgactgtctcttttggactgggctggaagatttggaagaaagacggtactgtaggggaaagatgatgcttaatatttgctgtaaattcttattgttactcattgcatgttacgcaatcggggccttctttttggcttggcagttggttatgttagtaattggcatgtacagtactgtatgactctgc

SEQ ID NO: 423 - DNA, 477 bp, Trichoderma harzianum
  misc_feature (464)..(465): The residues at these positions can be any nucleotide.
tgccccttatgatgttttgtgtttgagacacggctgatgagggctgagaagttgttcaacattgcacaacgtctggaaagacggcagtgggccattcgagtaagaaaagaacaacagacggatccagactcttggtagtagctaggcagcagtttaacagaaggaacaaaacgggtaatgcgggtggttttggacgccatgtggcgacgtctctccagctttctccatcttctccgtactgactctgtctccatttggcgggttagtcttgtcagtttggggttggtctttgtcatggagccatggccagagccagtgtgggcggccatgccgagttgaatggctgaccaaggacaatgcagcatttacgattatatgaatgtgctcgtatatacgagtgctactccgtaccatgctggtgtaccaagtgatatatgaacggcatgcacgcactgctcacttannaaaaaaaaaaaa

SEQ ID NO: 424 - DNA, 592 bp, Trichoderma harzianum
aagcttctgctacatcgccaacattctgttttgattataacgatctgaatgcctacctcctcaccgttgtgggtgtttctcggcctgagagcgatcaagccacgctttttcatgacatcatgaccaaggctcaagggggagctcgtatatcacttcgcgagatccagaccttgtgttccagagaagccatcgtcaaattggactcgggtgtgaatctagctcaagctatagaaaagcttggtagcggaatacacagaatcttggttactgaacaagctgggaatgttattgggattataagccaacttcgcatggtggagttcttctggaacgaagggatcaattttcccaccattgaccgacttaatccagtcacgctacaagagttaggaattggagtgcggccgataatctctgtccacgccgacgctcctcttactgaagctttatcgctcatgtatgatgagggcctttcaagcgtagctattgtagacaacggacaaaatgtggtgggcaacatctcaacaaaggatgtgcggcatttgacaagctcctcgagtgcatatttgcttggtaactcttgtatgcactt

SEQ ID NO: 425 - DNA, 432 bp, Trichoderma harzianum
ccagcaatccattgattcccgcccgttcctcccgtccaccccttcgacgcatattccgaggtcaaaatggctggtgtcgctacctacactattgctggtcgacagatcggcggtcactaccttgccatgggctggttggctaccctcttcggtggtgcctactatgctgcttccggccccaagaagcctgcgtctgctgtcgctactcccccgatcaacgcttccagctctgacgaggccgacttcatcaaaaaattccttgaggagcaggataagaatcactaaagggcgaaactcgaaaactaccggcatggagggggatagtgtattgttgtcttgtacataatatatgcccatagagcgaatgtgtctcgagatagaaaaatacgatgcgatgtactcacgccaaaattcatggatctctatcaattt

SEQ ID NO: 426 - DNA, 528 bp, Trichoderma harzianum
gtttcctccaaatcaagtcatccgattcgtggacagcatgacacttccccaaacgagattatttccccctcaagcactactccggaatacccaaagccagaagtttatccgaacgattgcttcaatggctactgatgcacctaatttcccatttcggcgagcttctggcatggagccaccagccgagttcgcacggttaagggctgttgatccagtatccagagttaagcttttcgatggaagcttggcttggctggtgactaaatacaaggacgtaattactgttgcaaccgatgaaaggctctccaaggtccggacacgccctggcttccccgagttgggtgctggtggcaaagaggccgccaaagcgaagccaacattcgttgacatggaccctccagaccatatgcatcaaaggagcatggttgagtcgatattctctgctgaccatatcaaggagctgcagccatatattcagaagacggtggatgatctccttggttctctgaaagctaagggttgcgctga

SEQ ID NO: 427 - DNA, 617 bp, Trichoderma harzianum
ccttgtttcttcatcctctattcaattgaggtgattcactcttgtctaacaatcagtgaccacttgcatcattcatcatggcctccaacaacatggtgacgctggctgtgaatccaaacaaagaaaacgatctcttcctccaagaagtccagcaggtcaaagattggtggcgcgattcacgatggaggcacaccaagcgtcccttcactgctgagcagatcgtttctaagagaggccatctgaaaattgagtatcccagcaatgcccaggccaagaatctatggaacatcctggagaaccgttttcagaacaaagatgctagctatacctatggctgcttagagcctacaatggtcactcagatggccaagtacctcgacaccgtctatgtctctggctggcagtcgtcttcaaccgcctctgcgtcagacgagcccggccctgacttggcagactacccatacaccactgtgcccaacaaagttggccacctcttcacggcccagctcttccatgatcgaaagcaacgccaggaacgcttgagcacccccaaggctcagcgtgccaatgtggccaatattgactatctacaacccatcatcgccgatgccgatact

SEQ ID NO: 428 - DNA, 553 bp, Trichoderma harzianum
catccacgacagcttcgatagcttcgacaggagacgaaaatcatcatgaagcttacgctggggattgccgcagcatttgtgagctgcgctgcagcatcgcagcccgccgccgacgtttacgtactggcgaatcgcgaatccgcatcgccgccgtccattcccagcagcgttgcccgactcatcttgctgaagctggcggactccagttccttgtccttggtccgagatattcctgacgacgtccatgtataacaggtggtctcgttgatgaatcgatatggaggcgtcactactccatcgttcgatgagctcgctcatgagcctaagcagctgttcattgcgcttcagggcttgacggacgatcaaatgaaagagaccagagcgaaatgacagcggaagccctcatgcactatccccgatgtgcctcatatcgaccgtctgcaatgggcaacgggcactgaaccgcctccatccgactttgtaaaaggaaaagggatcagatgctcttatgatgagatgaccaacccagtcgagtcccgctgctggaacggaa

SEQ ID NO: 429 - DNA, 600 bp, Trichoderma harzianum
cccacgcgtccggcaccaattcccaattcgtgctatataatcttctatatcccgatcgacaccacatcacatcccgccatggccgctccgacagaagcgcagctcgcgcatatccagctcctcgaacagctcgacatccactccatccacaagaacttccgcaaccccaactggaagcccaaccagcgccgaaacaagaacctcaaggccatcgtaggcgacgcgtcgaaacgagaagcctctgcccttgcgactccacaagacgtcagcggcgatgcgaccccagccgccgacgatggcctctcgaccagcggcacctcgacgccggccacaagcaccaatgggaacccgccgccgccgaatcttgcgcaggcttcgcgtagtttgtcgaagctcgtgctggaaaagacgttgaagccgcctgtgggaggggctggagctgtgtcggcaccaaacgcgacgtacacaaatattgagtcggcgccttcattagcacattcgaagcactactgcgatattacgggccttccggcgccttacttggatcccaagaccaggctgcggtatcacaacaaggaagtgtttgggttgatcagagca

SEQ ID NO: 430 - DNA, 244 bp, Trichoderma harzianum
attgaacgcacagtaaaagtgccactggatagggacgaggatgttcaaatagccgactcagcaattgcactcaaaatgatgattgaccaagtgagtaagaactggtgagtatagcgaattgagaaaaataagacaaggaggggggctattagggaccataactgtctcgtaaattaagagttgtctagctaatacactacgaatgtgtatgtaatgcaaaatttggatgaaaaaaaaaaaacaa

SEQ ID NO: 431 - DNA, 220 bp, Trichoderma harzianum
cccacgcgtccgcaaaacaacgtaagcccggagtttataatcgatcatcgtcaggttgttcaaagccaagatttagaataatcacctatgcgtgtaattaggacggttcagagaagatgcgaccaactccaagtcaggtacaaatttcaatgatgcaaagactggtatatatggccttgttgcgcagagcatgaaagtttctgccgggtcggtacctaaa

SEQ ID NO: 432 - DNA, 615 bp, Trichoderma harzianum
cccacgcgtccgatctattggtttgacgtgctcgacgacaactcagatgtcatcatgactgagaaggatattgagctcaacctccagacgattgtggacgatgctacccagacccccatccaggatgcggcaaagaacgcccttggcgtgctcagcacagagaaccgcaaggtttggtcaagatatctcgtaagcctggttccaacaatgccgactcgcttaatattgtcgactcagccctcttcgtcttgtgccttgactatatcgaaccgaccaatgttgcggatctctgccagaacatgctctgtggaaccagtgaggtcaagaacggagtacagatcggtacctgcaccaaccgttggtacgacaagcttcagatcattgtctgtaagaacggcagtgctggaatcaactttgagcatacgggcgtggacggccacacagtgctccggttcgcaagtgacgtctataccgacaccattcttcgcttcgcacgcaccattaacggacaggcgccgaccctctggacctctaccaggcctgacccgtccaagcgagagattgatagtttcggagacgtcaacaccacccctcgaaagctcgggtgggatatga

SEQ ID NO: 433 - DNA, 682 bp, Trichoderma harzianum
cgcaaacgcacgcactcgcgcacaaggcaggtgataatccaaatctacctacgcataataatcttcaacaacctgcatccaacgaagcgaaacccaaaaacaacatacatgagtgtaacaccaccaaacgtccctcgcatcgaagacaagcaaagcaatacgatgccctcacaacgtcccttcttcctctcctccttcttcaactctttccgccagcaagcgccctccctcacccagcaggcggccagcaaacacacctcgcaagctgctgcatctgcatctgccgtcgcctccacaacagccgcagcagcagcagcagcttcttcaaccgcctccaccgcccgcgcaatctccacaaacgctgctaccacatcatccaccaacgtcgccatccacacgcctcgcggatctcccggcggcgccatccccattcctggcgggcgcagaagaggcagcgatagcagtagtgaaggctttcgcgatgccctcggcgccgacaagtggtatatcggcggcaggacggcgactggagaggagaagttctttaagcttggcgtgatacgccgagtaaggagtaatgatggcctgagtctcgatcgcctaagcttataggtgatgaccacatcactgaacgactcgagaatgactggttttgattttttttccccctctctccttctca

SEQ ID NO: 434 - DNA, 559 bp, Trichoderma harzianum
gtttggcttgcagtaagaccggcttatgagaaagaccattgtgagagatgtaaggctgatccggagctctacgtcatctgagacatgacattggcatgatgagggtccagtaactacctgatgattggggtaatcgaaagagatgcagagagaaacacgcaactctgagaaagcgtcccgttacacacggaacacactgcctccggacagcggcttgtggctcattgcttgagtcccttaatcagcaatccccaggttctcttgacagctcagcggtgcagttttgcgggcacagctgatccacccgtcaacggggcgggacgccgggaagccgggactccggggctaaaatgacatcgccatgacatccgcaccgtccgaccagaactgctactactcaagacggtaagcaagtgctagcaaaagtgagttttacgaggtaagcaagtaggaacgtggcttataaagccacagctagcttgaggcgaaggctgctagtaggaactaaagtcagcttatactattgataagctcactgcatgggctagtaataatagct

SEQ ID NO: 435 - DNA, 608 bp, Trichoderma harzianum
gtcatggagaacgtcctcttcaaggtctcctaccctgccgagttccactcccagaccgtgaccactgcatccagtacatggcctccgtcatgctcgtcttcggccgcctcgaggccaccgactacgtcgacggctctgaggctgctacttcggagcttgtcgagtctctgcgcaagaagatcaagtgcgttgaggacccccagtacactcaggactaccatgaccctgccctgcgaaccatctccaacgccctgaccgttgagctcaacgacggcaccgtcctcgaggaggtcgctgttgaggctcctctgggccaccgtcttcgtcgtgaggaggccaagcccgtcatcctggccaagtacaagcgccacctggctcctcacttccctgaggccaccgtcaacgagctcgttgagctcagccaggacagcaagaagctcgaggccatgaccgtggacgagtacgttgacaagtacgctgtcaaggagagcaagtttgttgtttaaattggggttgtgcaaaagtagaagaaaatcctgatgtacctagatgtttatgatgacggtcatatagaccaaacaaaagtagcattatattaataaaaaaaa

SEQ ID NO: 436 - DNA, 228 bp, Trichoderma harzianum
gctgatctaccaaattttaacaaaagattaaagcttacaagtgcctgatgcgatattgactccttacacatctgtgcggcattccacaccggatcacgtgacaattcacgaggaaatgtgcacggaaccccgatccgtgaatggacctaaatagatgcaaatatgtatccgtgcatgagagaatatccctgataaatgctgcaataatagcacgtgaagagggccatc

SEQ ID NO: 437 - DNA, 429 bp, Trichoderma harzianum
atcgtcccttcggttgcacggtttcagatgggaactcgcgcccacagatacaaatcgccgtatcccatcgaacgtcaaactctactgagcttatatcaattagtactatgccgtcttcgaatatttccagaaaaagacatctgcctttctataaaatcaattaggaaagaatagccagttcttcaccatggatgatgatgacaatcatgtagcatggcctgtcattacagacgtctcccccgtccagtcctatgcggctgcccacaaggagtttcataagcggcttcccggatggatttacaagggccaccacatctttggttgggagatgtactatgcctcatccatagtgcaattcatgatggttgatctcgtgtgtatcctctgccgcgggatgtacaatttcttgactggtctgggatgtggtgg

SEQ ID NO: 438 - DNA, 608 bp, Trichoderma harzianum
gttctgtgtcttctcacctttttgcgtcagctcgactttcgttttgcaccggtcgaccttttaccctctcttctcttctactctagagacatcgaccagttcgctcgttgtcaacccctccgcctgacggaatcccccaccgataaacagacaaacaaacaaaacaaatccaaaaaaatcagccagaaacaagacaccatgggtgccggtcggtttttctgcgtggctctgccgctactcctcacaattgcctccatcggcactctgctctacgcagttctcgctggcgttgcccacgagaacgtcaagctcatccaggtggacctcagcaacctgagcatcagcccgctgagcttaaagaccctcacctcccgagccgaattcaatatgaaggagacccagacggataacatcaccgccgaagccctcggcctccacaagtactatgacctcacgctctggggatcttgctcctccgatgacaacaagaagtggacttgcaccaagagccagttcgactgggccagcaagcagatcaatgccgacgatatcaaggagggtagcaccactatcgagttgcccaaggatatcaaggacgccctcaaggt

SEQ ID NO: 439 - DNA, 368 bp, Trichoderma harzianum
ctcaaataaaccactcaatcgattccttgataccccttgggacaaatctacttgttctctccaaacttatccctccaaataccatcatcaccatcaccatgatcaaagatgtttctaccaacgggtcttctgccgctcctgctaccacctttgccctcaaggctggtctcgcccatatgctcaagggcggggtcatcatggacgtcaccaacgccgagcaggcccgcatcgtcgaagaagctggtgcctgcgccgtcgtggccctcgatcgagtgcccgccgatatccgcaaggacggcggcgtcatccgcatgtccgagccgggtatgatcaaggagatccaatacgccgtcaccatccccgtcatg

SEQ ID NO: 440 - DNA, 652 bp, Trichoderma harzianum
cccacgcgtccgccgtgatgataatagtcgaagaccaaatctcttctacggacattgagacgatatcaatgagccgagacaaaatggaaaaagcggaagcactaacgattcaactctttcttctccttggcgctgccctagtgtccatcggcggacgattatacgcccgatggcggcaggtcggaatgaagaatcttggtcttgatgatgggcttgccattacaggagtgattctctttgtgcccaatgtggtcttggcatacatgatgaacacgcggacccattggatgggcaatcattctgtcggcaacaatactacaacacagccgagccataacgaagatcaaatgagggaactgggatcgaaactctatctatacagctggttatcctattccgctgcattatggacgttcaaggcagcctttctcgcaaatgtccttcgtcgaattcccgaatccggcagacgacaaacccaccagtatctcggctttggcttcctggctgcaacatgggtagcaacgacgatggctctcctccaaagctgtcgaccgttgccccacatgtggcaggtttatcccagcccaggactgtactgccagcctgctacttcaccggtgctggcgtgggtttacttcagcttcgatatcgt

SEQ ID NO: 441 - DNA, 129 bp, Trichoderma harzianum
cataatacataaaagaatcaaccagagctcgcgcgtgaccccgggggtttggtccaccatctgactgctatgtactgctactactgcccggagtgcgactaacagccgctcgtattatcgctacgcctt

SEQ ID NO: 442 - DNA, 603 bp, Trichoderma harzianum
caacttacaaattacaacctacaactgcccacaatgtcgctttctgttggtgcttctctgcggcctgcggccttccgctgcgttggtgcgtctgccgtgcgcatgcgatgtgcttttggcacaactgcgtccagaaggagtgagagctcgacgccgggcgagcttggggttggagagctgcagggcgcatcgtttcgcattgagcctctccggagggttggggaggatgcttcgactatgcgagcgagacttttataccaatctcggaagcgcggaaccctcgagtcggatcttttactgtctacgtttgcctcacagaacctgcccaccatgacggccgaagaactgcggcagtacgacctcttcctcgacgagaacgactgggacatatactactgggcgacgcagcgggagccgaattccacgacgaacccttccgtgacggcgagtccggcgagtgcttcggcgagcgaagggttcgaggcgagacagcaggatgagttgcccaagaatccgccaaagggggagtgggcgcagacggtgggcaattttaagcctgcgtataggccggtgccgcagaggtggaaggatagcgagattttg

SEQ ID NO: 443 - DNA, 381 bp, Trichoderma harzianum
gaaaaaaaaaagttgcgccagacgggatggaaggcgagacaaggggctggcttgggctttgggcatgcactgggactttgggctgaaggttgaccgaaccgagttgctcaaactgcgacatcggtgctgtatcaggctgctatctatgtatcctcgtacaaggcaaatgcacacacggctgatctgagattacgggggggaagaaacgcactcagtggccaatatggtggttcgcacacccagcgtttgctctcctatgtcgtttgtatggcgggtatgctcatgcttgggctgaggtgatgcgcgtctgattccggctagcataccgaacccactaggtagcgagttgatagtatcgccattatattggatgttggatcg

SEQ ID NO: 444 - DNA, 417 bp, Trichoderma harzianum
gatcactccaccacgaagcacttttcaaagcgaagacctacacgcatcttcattttcaaccgccaaaatgggtatgatcgacgccaagaacagggtgacggagcaccagcgcttttaccaggctgcgtacaaggctcacacccgcctgtggaagattaacccccgaagcaactggtacatggccccctacctcgtcgccctctggggaggtttcggagctaccctttacgctgccagccgaaaggttgccggccacaacacctggttcagcaaggattaaagtatcggtatctatgggacgagccaattgagttaccccaacttgcgtcaaatgcaagattgagggtatgtatgagtttaaagtcttatagacagtaaatataggatttgtcagtccgtctcatacgtctcgctgct

SEQ ID NO: 445 - DNA, 300 bp, Trichoderma harzianum
tgaacttttcctccggatcatcatactgagaataaccagtagcccgcaatatccgcctgggggcctcatctcgctgctcttaccgcgatcaaagcccaatgaaaataatcccggtctaccgctaccgggccatcagcgcaagcggatctccagtcccccatcagtgctgcccgctcggaggtttactgttggcgcaaaccgggcctggtgtcgtcatcgagccaactccaaatccacttggccatattgtgataatgcgactctcgcctctgcttgaccgtttcttgtttgatctccctg

SEQ ID NO: 446 - DNA, 146 bp, Trichoderma harzianum
cccacgcgtccgcccacgcgtccgatcggtgggtttctttgggagcgttaatcgaccttgctcattcttcataccatcggcgtcgttggcatttatacggcatctcgtcttgtttccttcgtactcgaggtacggtaccctgaccg

SEQ ID NO: 447 - DNA, 642 bp, Trichoderma harzianum
ccatgtacctctgggatccttcacaaggcgcaaagccggttgcacggcttctgggacaccaaaaggccattaaccacgtgacattttcccctgatggcagtctcatcgcgagtgccggatgggacaatcataccaaaatctggagcgcaagggatggcaaattcatcaacacactccgtggccatgtcgcgcccatataccagtgtgccttttctgccgatagtcggctccttgtgacggcatccaaagataccacattgaaagtgtggtcgatggctacgtgtaagctggccgttgatctaccgggacaccaagatgaagtttttgccgtatgtttgcccccttgcccttccaattttgttaacccccgagcctgtggctgacagcgtgctaggttgattggagtcctgatggacaacgagtaggcagcggaggaaaagacaaggccgtacgcctttggatgaactgatgacgatgatgggagcgaatcaaaaaaggatacatcatgtgtgtcatcggcgtccagtcagggattgattacgtgtatgttctaggtctagactctgtacagctgtatgtgcagcatccgctaatgatagagagcaaatgtggcatttgcccaagggcacggctgatgcaatt

SEQ ID NO: 448 - DNA, 554 bp, Trichoderma harzianum
gaaaagagcagccagaggacagcctctggggcattcaacgtgataccactttggatgtaactcgtcgcccccgttgccggccgatacgtctcttcttctcgactcgcctctctccgtccactgcattatcattgaccccccttacctgcatgtgctcccgccttgctactccgcatacttctcatcactttacaccccaccaatacccgggtacatgactattatttcaatcaggccgttcttttcctccatctctttagggacaatgtccttttacttggaggagggctcttgcagcgccagttttctaacctttgtcttttagctgactccggcgataactaccgaccgcgtgagaggtctcgatcacctcggcgacgatctatgagtccaggccgacagtctcgtcggaggtcttattcgcctcgcagcagatcaaatagtcgggacgactatcgacggggccgcgatcgctccccaatgactggaacaggagctgcaccagccggtggtcccactggcaattatgcgggacagcaatcccatcgatcata

SEQ ID NO: 449 - DNA, 639 bp, Trichoderma harzianum
cgcccctccttcatacgatgatactcccggtcctggcgtccccacgcgctctccggctccggctgggaagcccgttttggcccatgcgagagccttgtaccgctacgatgccagcgatgcccgcgacctgagcctggaaaaggacgataagatcgatgtctacgaatacatgaaccaggactggtggatgggccgtaaccaccgcactggcatggagggcatcttcccccaaaactacgtttttgtcgagcaggagcaaaaggctcctatgccagctcccgtggcctacccccagcagtcggcatatggctacccgcagggacctccggcgcagcagaacccttacaatgccagtgtgccacctatggcgatagcagagggcggccagccgtctcaacagcaaggcggagatggaaacagcaaggttggcgagtacggaaagaagtctggcaagaagcttggtaacgccgccatcttcggtgcgggtgcatcgattggtagcaacatcgtgaacagcatcttctgagggcaatacgcgatcttcttcggcctctattttgctggctctgttttattttattgaactttcaagtttggcgtctggaatgggtttgaggcatcacctacagttctcgaaat

SEQ ID NO: 450 - DNA, 570 bp, Trichoderma harzianum
catacccaacacacaacacagtcatcatggaggttcttctgggaattacaggcaaggactttactctcatcggcgcctccaaagctgccatgaggggagccaccatcctcaaggcatccgacgacaagacaagagcgttgaacaagcacactctgctggctttctctggagaagctggcgatacagtacaattcgccgaatacatccaacgaaatgcccaactctactccatgcgcaacgagaccgagctgtcaccctctggcctcgcccacttcgtccgaggagaactcgccaccagcctccgatcccgaaacccatacaacgtaaatctcctcatgggaggagttgaccccattaccggcaagccctctctatactggctggactacctagcgtctctggcggaggtaccgtacgcagcacacggctatgcgcaatactactgcctgtctctccttgacaagcaccaccacccagacattacactaggacagggaatcaagctcatgacgatgtgcatagatgagctgaagcgtcgactaccgatcgacttcaagggaatggtggtca

SEQ ID NO: 451 - DNA, 621 bp, Trichoderma harzianum
tcttgttcatcttgctaccgctcacaaatcaccagccaagcggagacttaacaagggcttatgtacatgtaggattgggccgtgtccgggaattacctgttaggtactaaggcatgtaagagatgatgcaatcacaaagcaaaacccttttgatggtatcaaagtaaggcatcaacatcaattaatgtctccgaaactacatgcaatccgtagctccaagcccctctcattcttcaacttatcatcatctttactccttttatacaaaccggagcccacaagccttgccgattctaactaaactaaaccctcactccccgcttccaaactaccggcgactttacaaccaacaaatcttcaccatgagtgcctcacagcaacacgacgaggagtccaaagccctcgcctcaatcatcccaaccttcactccttccgaatcttccgaatccactgccgtcaaatcaatcatcagctccctctccctcatcgagcacgtcgaaggaggctatttcgcagtcacagacgtcagcaacatcaagatcccttccccgtacccagccacgcccctctcacagcgcaccatcgacctcgtcaatggcctccccgaagatttcgactacg

SEQ ID NO: 452 - DNA, 701 bp, Trichoderma harzianum
acaacctcagctgcaagcttaccgcccccggggcaagcctttcgcatcgatctctaatatcgttccgtctcgccgacgaagcttctactcaaccaaagcatcatcgtcccatcatcacaatggcggaagcaaagcctgcgtcccagaagatctggttggtctccaacgacaacgcgaccatggaagtcgaccgtgccgtggttgagcgatccatgctcttgaagaacatgttggaggatctgggcggtgccgacgtcagccctgagaacccgattcccatccccaacgtcaacgaagcagtgctgcgaaaggtggtcgagtggtgcgagcaccaccgcaacgaccccgtcgccgctcccgatgacgagtcggatgcccgcaagaagaccactgatatcgaggagtgggaccagaagtttatgcaggtcgaccaagaaatgcttttcgagatcatcttggcctcaaacttcctcgacattaagccgctcttggatgtgggctgtaagactgtggccaacatgatcaagggcaagtcccccgaagagatccgcaagacattcaacatcacaaacgatttctcagccgaggaggaggagcagatccgccgtgagaacgaatgggccgaggaccgataaataatggtctactatgggtgtctcttaactcttcctctttttttcagtggagagcagcagcgtgaa

SEQ ID NO: 453 - DNA, 589 bp, Trichoderma harzianum
gcgttttgcattggccaatatagcctggaactttattttggggcaaaagcaagaagcctggaacaagcttgttgtgtttgttagcgaccaaaaaaaaggtacctgcgactacaactgagggtcccccagtggctgaacgacgacttacacccgttggcagcagagcttttgtcttttcaccacaacaattttgacattcgtctatacaaaacttgcacggtttctttcacctggcaggtagcatctcgacattcaccatgtccaaactccagatttgggcctcgtggcccgaagcccacctcttcaacttccctcctgccaaccctccggccccaatcccaccggcacatgtccctgccactattctgaggcccttcaacatcccagatgatctctatgtgtctgctctggatgctcgagttccgttgacgattgctgctctttatgccatctcggccaagctgctcaacaagtacaacaaggcgcgcaacaagaagccctggggcatcagcaaaacacgccccttcttcgtctttgtcgtcctgcacaacatcttcctcgccgtctactctgcctggaccttctgggg

SEQ ID NO: 454 - DNA, 629 bp, Trichoderma harzianum
aagaaacacaaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccggcgcgcccacgttcacgcacggcacgccgccgaaagccaccccaccgcccacgccgctgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacagggcaaggcattgctgatggtgaatgcacaacacgcgtggcagactggccgaaaattgatgatttactgatgggcgactttggacttgaaatggggcatg

SEQ ID NO: 455 - DNA, 563 bp, Trichoderma harzianum
aagcattcgcctctcgttcagatctcaagacaaaaagcactcaaaccaatcactcaacctcttcaagaccacctttcaaaacaaaccttcaacatgaagttcaccgccgttgcctttgccgccctcgctactctggctacagccagccctcaccctcctcctcctcacggttgcaagcctgctacctactcttgccttcccaacgacagcggttggcaagtgtgcagcactgccggtcagtgggtgtttgctggcacctgccctcccaagactgtctgcaagttcgacagccaaaatggcagcccctactgcgttccccccaacttcaccatcccataaatccattaaatggggatcaacggggctacttacaaaagcctaccggatgagcatgagatttagagtttttggttgctaagacgtttcgtggcctgtcattgtcttgcagatcaatcctggacataaagtttacacataacatatggtacactcctttgaatgcgatgtatctctatagctatatgaatacaataaattgaagcagaaaaaaaaaccgaaaaaaa

SEQ ID NO: 456 - DNA, 650 bp, Trichoderma harzianum
cgaccacgcgtcgaccatctcgaaaaccccccttctgacattttgtgctgaggaggtgtaattactattgataattatttgattggagtcttcattttttttttttggaataacgagatacgaagtgactgcgctctcccccctttatctacctatccatctttgatatccgagtaaaatctacacacacacacacacaacacacaaaaccatgtccagcaacccgcccatccactccggcgccgacgcggcccaaaccgcctcaacctgcgcaagtctcaacatcaccaccgccgagttcgccgagctgcagcgccgcgccacggcggcaaaggccaccgcgtactgccgctacagccggttccgcgtgggcgcgacgctgctctgcgccgacgacgccggcgagacggtttatgtggccggggccaacgtggagaacgcgtcgtatcccgtcgggacgtgcgccgagagggtggcctttgggacggcggtgacgagcgggattaggaactttcgggcgattgctgtggcgacggatattagtccgccggcgagcccttgcgggatgtgcaggcagttcatccgcgagatttgctccctgcagactcccgtcatcatgtttgacaaaaactccgactacgttgtcatga

SEQ ID NO: 457 - DNA, 614 bp, Trichoderma harzianum
ctcgaccacgcgggcgacatattaaagccccagcaggccaagtcatcgacagcgtccctcgcgcatctgccagacttcggaagcttcgcacgagcaccagaaaccactcctccctacgcctctttaaaatctttatcgcttcgataacccatcgtcgtcacaatggccaccgaactttgccccgtctacgcgcccttctttggtgccatgggctgcacctgcgccatcgtcttcacctgcctgggtgcctcatacggtactgccaagtctggtgttggtattgccgccatgggtgtcctccgccctgaccttatcgtcaagaacattgtccccgttattatggctggtatcattggtatttacggcctcgtcgtttccgtcctgatctccgatggtctcaagcaggacctccctctctacactggcttcattcagtttggtgctggtctctctgtcggtctcgctggtctcgctgctggttttgccatcggtattgttggtgatgctggtgtccgaggaactgcccaacagccccgtctcttcgtcggaatgattctgattcttatttttgctgaagtcttgggtctttacggtctcattgttgctctgttgat

SEQ ID NO: 458 - DNA, 565 bp, Trichoderma harzianum
aaaaccccacgatataccccgcgtcatcgcttgtattgccgagctgtaccagtgctagccgttgcctcactacagctctacccgtcttctccaaatagaatcccccaactctttatctcaacctcaattcgattcatttctgtccaattgcctctcataacacccgcgtcgccgagatctacatccagggacacggaatttcaccactaccagcaagctcctctgctgtataactaaaagcaagcttcccccgaattacatcatcgcctcaaaccgccaccatgagcgcagacacgggcgaaaaagtctatacccacatcatcacactcacgcgcttcctcaccgaagagcagattaagcacaaagaagccactggtgatttcacattgctctgccatgctctccaatactccttcaagtccatcgcctactagatccgtcgcgccaccctcgtcaagctgacgggtctggccggttcctccaacaccaccggtgacgatcagaataagctcgacgtcatctccaacgacctcttcatcgaggccatgcgctcctgcggcaaagt

SEQ ID NO: 459 - DNA, 569 bp, Trichoderma harzianum
atcatcagctacaaagacatctactcatctacacacaaacaaacattcaaaaagcatcatcacacaaagcttccaaagctccagcttctcaacaatccactattctctacacttcaaaccacaacaaccacaaccaaaaccttcaaaatgttcgtcggtgacctcgtccacttccgcgctgctctcagcaacggcatcacccacgagatgattctctgcccctcagccgccacttctcccgccacctccgccgcaaacaccccagacaaccgctccctcgcctcggagaagaagaagaagcgtttctcctctttcttctcccgccctcgcccttctgtcaaggccgccaacgtcggtgctggcatgaagctgcccatgaacattgcctaaataaaaccaatctttcacaccaacaaaacaactacaacaatgtgctcctgaactgcggatataaagaggaatggatgaaccggtctatgcccagcacgatggaataaaatacacaaaacacacaaacacaaaaaacacactcctttaagagacgacgaccaacgaaacaacaacaccta

SEQ ID NO: 460 - DNA, 336 bp, Trichoderma harzianum
gccaatcgggaacaaaaaagggctgcgcgttctttttgcctctcctgactccttacagatgggtggcattgctaaggtacagtgtggagtctgcagtggattcgagagctgcgatttcagttgtttggacctggacggagaattttacggagcagctcacccttgatgcagtttaggtaggcggtgtctcttgttggcgtgttttataagagcaactttgctggtggtaataatgatgtccatgctattttcgtatttctggaataggtacctggtatggcaaagagaatagaatgatggtgaatgagattacacagttcgaaacaaaaactacgg

SEQ ID NO: 461 - DNA, 611 bp, Trichoderma harzianum
aaggggaagtaataccatggcatcgctaaacatgcacagagcagcgtcgcgattcgtcgccgcttcaatctcgaggccactgccggcatgtcgaatcgcagtagcctctcagcggcatctcagcaccggcatgcggatcccagtcattgccgcatcacggcctcacgcaaggaagacacagcgccctattccgagcggcgtacggacaatcttcatccagactgaaaatacaccaaacccggatgccctcaaattcttaccgaaccaccgcatcatcccgccagacatgagcaccccgtttatagagtatctcaacccgcgagctacgatttctccgccgcatccctcgcccttggctgcgaagctcatgaacattgacggcattacctcagtcttctacggagccgactttatcactgtaaccaaggctggagatgccaactgggctcatgtgcgacccgagatctttgctctcataaccgaggctatcacttccggcgagactatagtcaatgtcgcggagcgcaagggggatgagtccgcggctgtggaagaagacagtcctggcttacaacgaaaacgacagtgaggtggtgggcatgatcaaggag

SEQ ID NO: 462 - DNA, 524 bp, Trichoderma harzianum
actctctccacaacgccggaactcctgctaattgacaatctctaccccaattgctgcgtcctgccggcgctacagattgttgcccagcatgcacagctccttcacccgtctccagaatgtctttggcttcttcaccacagttgccttcgtcctgggcgcattcatcgctgccacagatctaggctctactcgctctcccagcggtgtcattaagacggacaatattcaagtcgtcaagggccgaccccattactactcttcgaaaaaggaagattatgccatcatccgcttctctctataggccgacctctcctccctcttcagatggaacacaaagcacctttttgtatacgtaacggtagactggaccggtcccggtaatagcaacaactccgctgtcatctgggacagtatcatcaccaaccccagtgccgaccacttacagaacattggacccgtggccatgaagaatctcaacagaagcgccgaaggcaagagcattgcgcctgagcgaggaatactca

SEQ ID NO: 463 - DNA, 542 bp, Trichoderma harzianum
gctccttctaccaatttaagagagcggagactttatgttgttggcggtgaatggctcaacatcgaagctctaggcgccggaggtattgctcctgttgcaagcttggccgcaaatgggaaaacttttatgccgggctgtttttttccggtttgtcaatggggccgtgcgattacctaagatgaggcagagcagcggcggcttcgagtttgaatttacaagaaacatggattgtgctcggagtacgccgtggtatgtaggatggtctgtggctgaggtcgtccagcttcaggtgtttatatatggctttaccggcagatttcacaagctcaatcgacttttggaaagtgtgtttcaggctattcttgaactttatactcgacgtataagtctggctaagagattttgctatttcctatatcattatcataacatgggcatatatgggtcaatggatggtaaatgaaatttgatttgtacgggataaataacagacaccgtccatacgaaataacgctattcattggcttaacacctttcgaaaa

SEQ ID NO: 464 - DNA, 456 bp, Trichoderma harzianum
acagtagtaggtgagtatgatgatacactgggtcaaacggatgttgttaacactacttacctgtagtggcgcttgctttttacttacttgcagatattgtggttaagcagaatcccaactctccagtgcaagacactctgtcaggttcaagcccaatttccttccgctgctcattggcaaactcacgaagctcgccacgaatctcatttaccacgtcccacatatgcactacagattcgtaagtccgattgtagatacgatcagcgcaaagcgatacaatcttcattagcttcaccaaggccgccatcatcttgtcatctgtgggaacaggtatatccaagccgagctcggacatagacgtctggcgcccaagaataaagcaaacccatcttggcacaccagtcaagttagttatttcatcaagataaaaagacattgaggggcactcacacttcc

SEQ ID NO: 465 - DNA, 555 bp, Trichoderma harzianum
ttgcccagccagaggcccttcctcgcgtcacgagacacggccgcctcctcaacacgatgccgtacccaagccgatggccccaccgcaggttgaagctcagtcgccttctccaacaacctcctcagttcctccatctcccaaagccgccgagaccgatgcgcaaaagacacagcctgctcccgctgctcgacctcgttccaagcttcgcgcgcgcaaggccgcaatgaagctcacacccgccgccgtggagcagctgcgcgcactgctcaaccagcccgacccgaagctcatcaaggtcggtgtgcggaaccgaggctgcagtgggctcgcataccagctggaatacgtcgataagccgggcgctttcgatgaactggtggagcaagacggcgtcaaggtcttgattgacagcaaggcactcttcagcatcattggcagcgaaatggactgggcggaagataaactgagtcagaagtttgtgtttaagaaccctaatattaaggagcaatgcggctgcggagagtcatttatggtctaaggagcttgtgaagctac

SEQ ID NO: 466 - DNA, 509 bp, Trichoderma harzianum
gaccacgcgtccgggagtttgttcgtttatttcgttctccctaagatgttgcggatcatgatgtagttgctctccaagtatacataagatagccataaacatagccacagcagcgcccaacaacaactgtgaccaagggtgggtggaagtctggcttccagcacagtactttgcatgatagagtcatgacaatgtcatgaaaagagaattgtatgtacatgtcttatatttcctgatacagcttgggcacggagcgcgtgtgacgaaggtaggtgatggttgctaggtataggtaggttgggattgaagtcacatgcttcatcctcacttgtatgaaacccgtttctcagcccataccagcatatttgaaccagttgggacggcaatcttctcggtggaggaacggctcaccatccgtcagtcgaccagtaacacagcccttgcatttgggagagttggggcagttgaagaaggggatgtgcttggtagccaatatcacggaaccagtg

SEQ ID NO: 467 - DNA, 278 bp, Trichoderma harzianum
agaacaacagacgaggaattgctgtggttgtataagttgaagagtagcggtatgtttaagcaccaccaagtggtcagatgaaaattaagcgcttcggtacttggcctgccagagttcagttgagagtgaagatgctccgtttgatccataattgacatcagccccgagggcctttctttgagggtggagcggcatccctgttggactgtggaaccgatattgtgggcggccttgaagagcacaaagctctcgtgacgatgctgtctgtagctcgaaaa

SEQ ID NO: 468 - DNA, 630 bp, Trichoderma harzianum
actttgtgtacctcgagatcgggtataaagttacctcggggcgcctcttagtgctggcgttcgtggcttgtctgctaacaatcaggttatatccagagcttgggcaccagagctcttcttacactgccaatctctgcatcatctcgtaaacagagtatacaattctggatacaatttttcttcgctccatggggtctcaagtccaagaagagctgacagtgctcgtcactggatttcagcctttccggccagaatatccaatcaacccgtcatgggaaatcgcgagagccctcccagaatacctccctccgctaagggccaaggacccaaactctcgaaatgccgtcgacatcccgcctgtgcgcattctggtgcaccccgaccccatccgagtcaactacaaggtggtgagggagcttgtgccaacactgtgggaggagacgtacgcgggccgcaagattgacgtcgtcattcacatgggcatggcagggccgcggctcatgtatcagatcgagagccgaggacatcgtacgggttacaagtctctcgatgttgacgggaagcaccttgacgagctcgatgggaaacgggacgaagagtggatctggcatggcctcccggatgtgctga

SEQ ID NO: 469 - DNA, 551 bp, Trichoderma harzianum
agtctgccctccaataaacgcttctgccccctcgagtccagactctctgttctgccactggctctggctctggctctaagcgatctccgccccggtccgtccaagcttgccccccgaagatgacggccgatgccatctccggctccgggcccgcatccggctctccccagcctctccggctgctcatcctcgaggccgatacgccgcagcccatcacaaacgccaaatatggtggttaccgcggagtcttcactgctctgttgacggcggcggcggaaatcatggttccgccacggcagctctccgacgtggccacaatcacggcgcacaacattgtggaagacatgcagtcatacccgccgctggacgacgtcgacgccgttctaattactggctcgcgtcacacggcatatgaggatgacccctggatcctgaagctggtggagtatgcaaggcaggccatcgacaccggtcgcatcaaggtcgtgggcgtgtgctttggccaccaaatcattggcagggccatgggtgcgcggctcggcaggagtgat

SEQ ID NO: 470 - DNA, 151 bp, Trichoderma harzianum
gggggggggggatgatatcccgggtgtatttgtactagctatcaaaccaaaaactctttctgtcatctaaaaaagaagagagaacagagatgctatgctcattgctatatgcgaaacaatctatatcaggggggggaaataatacgccaaa

SEQ ID NO: 471 - DNA, 176 bp, Trichoderma harzianum
gtggggggggatgacatcccgggtgtatggggactagctatcaaaccacaaactctttctgtcatctaaaaaagaagagagaacataccatgctatgctcattgcgatatgcgaaacaatctatatcacgggggggaaataatacgccaaaaccgtcaactccaactcatgtgcca

SEQ ID NO: 472 - DNA, 200 bp, Trichoderma harzianum
attattactcgaccacgcgtcggctcatgtagtccctgtatctaatgtactaaggacgtgtactactgcacctgtgaatgggggcctgctttgtgctctggctaccttagtgaatgatatctgacttttgttatttgatttaaattgattcatgtctcgatttgcatttctagagaagccacaggcaaaggcgacaagcc

SEQ ID NO: 473 - DNA, 72 bp, Trichoderma harzianum
tgtgaatgggggcctgctttgtgctctggctaccctactgaatgatatctgacttctgttatttgatttaaa

SEQ ID NO: 474 - DNA, 610 bp, Trichoderma harzianum
ggattaggtttctttcattctttctttctcccttcctctgccgagctcgacgaatacccgcctcgaaccgaatgacgctggcaatatcccgttcttgattccgttgcctctttgtcctccgttgtgccccgcaaaacctgcccaacgcgcttcctcatcatccgtgcttcgcgattttctaccatcgacgcctgaggagacataatttcacccaagatgaaatccatgaagggcctttctatgaataagatgctggggagcatcaggaaaaagaccagtagcacagatcgttcagctgccacgacaccaggggacacccccgaagtaacggcccataacagcgtgaaagcattttgcgaatctggcggaaccgcaaagagcgaggaagtgcttttcctccccccgattgtcgatgccgccgagtcttcacccaccgccgctgccgaatgcgcacgcatcatcaggaaatacatgtccaaggagtattcctcgcggccgtcatggcagtacaacgccattatgctgatgcggatactggccgacaaccctggcgagacgtttacgaggaaccctcgacaccaagtttgtagacaccacgcgggcgctgctc

SEQ ID NO: 475 - DNA, 200 bp, Trichoderma harzianum
gggcgtttgtggttgacagagggagaggctgtgtttggttgaaggaggagaagaagaagaagaagatgtgaagaggaaatgccgaaaagaaggatgaaagatatgttcttgtctcgagctctttccaattgctctggccttgtgcataccatacagaggcaggcagtcgcaagaccaaataacgaggcaatttgcaatgc

SEQ ID NO: 476 - DNA, 516 bp, Trichoderma harzianum
gtcctctcatctcgtcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctgggaatcggcgcctaccgagataacaatgcgaagccatgggttcttcctgtggtaaagaaggctgatgagattctccgaaacaaccccgaactgaaccacgagtatgccccgattgcaggtatcgagagcttcaccagcaaggctgcggagctgatgctcggcgccgattcgcccgctctcgcggagcgccgcactacgtctatgcagaccatctcgggaaccggtgccgttcacttgggagctctgttcctcgccaagttttacaaaggcagccagaccgtctatgtgtcaaatcccacatgggcaaaccaccatcagatct

SEQ ID NO: 477 - DNA, 414 bp, Trichoderma harzianum
ccgctgctctgcaacagctgaagagaggtagtcgtacggcgcgccaagctgcgcctgaatgtcacccgcgggcgtggcaccatgacgtcccgtagaggcgatctgctgtcatacaaccacgtctccgaaaatagcaccctctcggggcgtcttgtcccgaaatgtgccgtcagccgctctgacactgcgtcgacaatatctgtcaattgtttgtcttcgtcgcggagggccgccgagtcgcgactcagctggactcgctgagcaatcacagtcgtccgcatcaccttgctttggctgctatatttggtgtgcagcgtcatgccagcgctctctgcgtctgcttgcagctgctccaggcgcgagagcgtctcttctaggaagctcaataaagcggcatcttgttccttggtcgac

SEQ ID NO: 478 - DNA, 425 bp, Trichoderma harzianum
  misc_feature (245)..(245): The residue at this position can be any nucleotide.
agctgtaaaatcacaactcataaacagatctcgtcctttacatcttattctcttcaagctcatcacagcatcgtatcatcatagtcaacatgtctctccaatacttcccttccgtcaaaccctccgccatcgccctcggcaccttcttcaaccacggcgtcgacctcgtcgtcctcgcccccgtcttcggccagacctaccagcgcgcaaaggcctccaacacaaaggaggagttcatccgctcncgcgaggccagcggcgccgccgtcgcctggggcacctcgtttgtgggatctgccctgcagagctacggcgtgggcgcgctgcttaatgccacgggcaccctgagccacaagggcgctgcgtatctcggcgccttgatcttccgcggcgacgtcagctcctggattcatctctcagatctt

SEQ ID NO: 479 - DNA, 571 bp, Trichoderma harzianum
ctcagatacacagcaaacacccaagcaacaacaaaagcaaagcactccagcaacaaacatctacccacctcacaacaacatcaaccaacctgacaacttcttcacaactccacaaacaacaacactcaaccatcacaatggctttcttccctcgcactttctaccaccccaccgaggcctctttcacgcctctcttccgtctccttgacgactttgacagctacagccgacagaatggcaaaagccgctctgttcgccgccagcaagttccccagtggcagcccaagtttgacgtgcgcgagaccaccgaggcctacgagctccacggcgaacttcctggcataagcaaggagaacatccagatcgaattctctgacgcccagaccttggttgttcgcggcaagactgagcgcacatacactgcgggcacatcagcctctgcttccgtcgaaaacactccttctacagagactgtcgctgaaaaggccgagtctgaacgcaggaactcgcaccaggcgactgttgaggacgaaagacgaggccagcgagcgcgagtcgggctatgaagtcg

SEQ ID NO: 480 - DNA, 644 bp, Trichoderma harzianum
gcagagacacacgcacacatggattcgagcgccttcgttttgacctacccaattgtacggccctagcccacggtcttgcaaatggcgctcagacagcagcaaagcaggcgcaggcgcagcccccattcgagacgagaaacgggcctttgattgggggcgtccgtgtgacccgaagtgctatatctactgcagccgctgcccgcctcgtcgaagcttcttttccgcatctcccctcagaagcattttgcaccaggactatccgccgatagcatatattttttccctaaggcttacgcgcaaattccgatttcttacggacctacacgtacttcagttaaagtccaatcgcccaaaatgaacaccagcaccgtcaagagccgcttcctttctcaccccgaggaccttggtattgtcaccgtaggcttctcgggcggtcagcccaaagccggtgtggatgcaggccctactgccctcatcgagtctggtctcttgacccagattcgagatgagcttggttacaagctgcacggtgatgagacggtcaagttctacaacgacctgactcccgcgtccgaccccgactaccgcggcatgaagaaccctctccttgtctcggctgtcactcaaaagattgcatctgagac

SEQ ID NO: 481 - DNA, 676 bp, Trichoderma harzianum
ggcgaatgatgctgatggattgatgatttgacgttcagtctttttcccttctcgctcgtcgccacaatgtcaattgcagcagcgcccaatgcgcttcgagcctcatcaggctgcgcctcaaggctggggctgtctctccagaaaggcccatcatcaagccttttcctgcgggtagcaagtttctcgacaacggcgccgcaatgcaagcgcaagacaaaggacagcaacaagcgacgaggcgtcagcagcctctacggatcgggcccgcgagagccgctgtccatgtccaacatgccgctgccgaagcccgtcgagttcaagcccaagatcgaggtcgacgagagccacgggctgtgggggttcttccccgcgccggggaagctcctgctgacgcccaaagagacggaggagcacgggcgagcgtgggaggtggaggagctgcggcggaagtcgtgggaagatttacatgctctgtggtggaagtgctgcaaggagaggaacatgcttgctacggcgagggcggagctgttgagggggaagcttgggtttggagagcgggagattgattcacgggatgaggaggttacgaagacgatgagggcgatcaagcatgctcttacggagcgattctatacttggcaggatgccgtcgaggttgccaggtcggaccccgaga

SEQ ID NO: 482 - DNA, 578 bp, Trichoderma harzianum
cgcaagcaaaagatgcgaggcagtgtcgtggctagcaggcccttgagccggataagctgctcggcgtgttgcgcgcggagccggcagtttagcaggtcgtttcgggtgcagtcggcacaaccagtggtcgtgcgagcgggattgagtggcggcgttggaagatatctcgatgctcgagccaagcgtggtacatatcaggtttcattggcgacgacgagatctttggcgacagtttcagatcgtccggtggttggactgggtccgttggaggagtatgaccggcgggtggacgctgggattctgcggaacgacgagcatcaacgaggcatcatcgagaacctgcaacatcttcacaatgagcttcgcaactaccatgcaccgcccgttgtccatcccagcttcgatctcctcaagcccgccaagaaatccgtcttctcatcgttattcggcaatggaggcgccgcaaaggctacaattaaggatatccccgagaacttacctcggggattgtatctatttggtgatgtgggcagtggcaagacgatgctcatggacctattctacgatacactacccag

SEQ ID NO: 483 - DNA, 652 bp, Trichoderma harzianum
gagctcccggcagcttggtgacacggaaggatatatgattcaattccaggcggagcccgaaaagtatgatgcagccgtgaactggcttcgtaccatgatgttcgattccgtctttgacccagtccggatcaaggccgctgttatgaaggcattggctgacatcccagaatcgaagcgtgacgggcgcagcatggccgcggaggtggacacagctattcacatggaaaagtctactcttaccgttgccagacgtgttgttgtcaaggcagtttatctcaagcgtctgaagaagctcttgaagaagaatcccgaccaggttgtggagtggttcaatgaaatccgcaactctcttttcacatttgagaacatgagagtccttgttacggcagacttgcaaaggcttcccaaccccatcgccacttgggatgcgctctcaacagcgctacagtcgcagaatggttctatggctcctattccaaagccatcgagtcttttgaacgctgaaggaaaagcccccggttctgtgggtgtcaccatcatccccatgacagctctagacagctctttctccgtcagcaccgcccctggcctctcttcgtttttagatcccaggctgcctgccattactgttgccggaggatacctcgagtcg

SEQ ID NO: 484 - DNA, 294 bp, Trichoderma harzianum
tccgtatggggggcttcaatcaatcatcacttttgggattaatgggcgttactggacacactacaagcgcggtgcactgatagactttgctattttattatttttttaccatcatttgtttatttctgtatatgtggtacatattctggaaaggggcggtaggggtggaccttgggtcggggatcaatcgataatgggagcgtgacgaagttacggaaacggaaccgaagcaagcaaacagagcttttgaaatagaatgatggcaacaccaatgccactcttgaagtaattcac

SEQ ID NO: 485 - DNA, 234 bp, Trichoderma harzianum
acgcgtcggaggtccagaatcttccaggttgacctctgtattggcggaagttaccatggatgggctgctgttacacaatgattcaacttgtgagcctccttcgatcctttggacatctgaagtcacagatgagtcaattatgtgttgtatccctttcacaaggatcggaacttgggggagggctttgtcttgtttcggaatcatagttgagaggcaatcaacagcgttttgcat

SEQ ID NO: 486 - DNA, 483 bp, Trichoderma harzianum
gcgtccgggggacattattctgtttttcacctctttgtcgttgtccctcatacggcttcgtaattaccgccgttatgtacccatgtcctgtctgatgcgttggtcacgctggtcgacgctgcggggggaaggcaaacgaaggcaacagaacggaaaagggaaataaaaataaaagttgaacctaggggggtttgataatggccagcgtgcggcaggcttacaaaacaacgggaagattttcacgttgggcgggattacggctctgatttgttattcactctagctactagtcatggccgaaaacaataatgccaaggttttttcggtcaagcaagggaaagaaaaagcacaagcccaagctttttgggggccccagaaggagaggagagggagaggcaaacaggcaaacaaaggtgaacgggcgggctttagaaaacacccattcggcatgtaccgtggctcggatctcataagcatcacggc

SEQ ID NO: 487 - DNA, 177 bp, Trichoderma harzianum
cccacgcgtccgcccacgcgtccgcccacgcgtccgcacgataatagcaacattaattgttcttcttttgtctttgttatagacttgtcttccaagcgacctctattagactccgtatagaactatagagccacacggaacaaacccaataggctattgccagcacacacacccggg

SEQ ID NO: 488 - DNA, 549 bp, Trichoderma harzianum
gatttgtctgccgaataacgcgctgcctcatctccatctccatcctccttcaaagcgaccccaaagcaggacaggcgccgcagttccagtggcatcgagagacgatttgtccattgacttcgtcaagaggatgccgcaggccgagcctctagaccccggcttgatcctcgatgattggatcaaccgcgttcagaatctccccgaggagattcgctttatccaagaagagattacagacaaggaccgccagtacaatgagtgtattcgaatgattgaggatcgtgatggaaagattcaaaagtggataaagacgaatgggagccatgagcccaacccaaaggaggatatgctacgggcccagattcgcgaaaactatgctcgcgccgaccagtttgctcaagacaagatcaccttgatacaaaggctacagctcgttatggacaaacatctgcggaatctggatgtccagatcaagctggtatacgaccgtgccgagcctggatttacagaccctgacgaggttccttcactcctccgccccagtgcgac

SEQ ID NO: 489 - DNA, 278 bp, Trichoderma harzianum
caccgcgttgccgaagctctcgaggttggcatgattggtgtcaacacaggcatcatctctgaccctgcggcgccgttcggtggtgttaaggagagcggtttcggccgagagggatcaaagtacggtattgcagagtaccagatcaccaagatgattacttacggcggcatgggtaagcctctgcaaagctaagtagttaaaagcgagatagagtagccaatgctttttaatgtcccacgattcaatgaaataacgataattaccaaaaaaaaaaacac

SEQ ID NO: 490 - DNA, 484 bp, Trichoderma harzianum
caaagaaaaggtctccggctctgcagcaggcctggacctggagagcctaagcagcagtagtgacagcagtactgtcctgtacggagcagtggcggctgcagcaaccagcacaactggacggaacagcagcagcaagcagcagcagcagcacgacctggccctccctgccatctccccacccctgccctggcccgtggttcgactaccgctacgataccagaactgcactgcactgcttgtgctcgctatacctgccgcaccgctgtctgtgacgtgtgaggaggccctacagggaagcacaaccaccaccaagtactgcgcttttcccgcaccagacacttgacctccaaacctctccacacaaccaacccgttttgcccggcgtagcgagaacacgagagcgaaatagaagccgaggccaaaggggaacggagacaagaagcaggaaacaagacagagtgagagagaaaacaaacaaccaaac

SEQ ID NO: 491 - DNA, 554 bp, Trichoderma harzianum
ctccctctaccgcacagcatgtcaagcttcgtcacccccggccagcagcgctacctgcgcgcctgcatggtctgctccatcgtcatgacatacagccgcttccgcgacgaaggatgccccaactgcgaggagttcctgcacctcatcggctcgcaggaccagatcgaaagctgcacgtcgcaggtctttgagggcttgataacgctggccaacccggccaagtcgtgggtcgcaaagtggcagcgcttggacggatatgtgcccggcgtgtacgcgatcaaggtctcgggccagcttcccgacgagattaggtcgtctttggaggatgagtataggatacaatacattccgagagatggcacgcagaccgaggccgatgcttaaacgagtatgaatgttcacacaatgatttggcgtacaacagaggcgaatacggcgttttggtgatggaatcaaacattggaggaccaaagattaatatataagttgttgttaggtcattatggtatctatggaaacgcaacatgctacaaaatacatccgttcccatatgc

SEQ ID NO: 492 - DNA, 615 bp, Trichoderma harzianum
agacaccatattaactccaagattcagctccctcagctcagcaatagcctcagcctcagcctcagcctcagcctcaaaataaaatggccgtcactggccttgttgcagtcgagacgctgccccgattcctcctcccacggctcagctggactgcgccgctcgccgcatctcgatctgctgcagcccaaccctttgcccctctacaagcacgaacgaaccaaagagcagtgcccgccttcaacaccaatttctcggccagaagatacaacaatggccagataccggcgctgaggcgagggtttcacgcgacgagtcgacgatcccgagagcatcatttcgatacgctcaagtttgtcaagcagctcaaggatgagggctttaccgaggagcaatcagtcgccatgatgaaggttctcaacgacgtcatccaggagagcatccaaaacctgacccgaaccatggtcctccgcgacgatgctgccagaaccacatacacgcaaaaggtggacttcgccaagctccgttccgagctcacttcggcagacagcaccgagtccaacacgacgcgcagtgcgcacgagcgcctcaccaacgacattgccaagctcagcagcc

SEQ ID NO: 493 - DNA, 638 bp, Trichoderma harzianum
gctcctctctcattgccccgatgccctccatcgcttgagcgtatttgctgtccccaaagctgtcggtgatgagggatcgtataatggctcccatctgctttgtcgcctctgcaatatgttcgacctcttctgacgagttcaaagctcgcttgaaatcgggaattgcattctcaggactaattgaacccttcttttcttctcccaaaagagcatccacatccagccccgagatgggcttgaccgcttctctttgacgtttacctttagccttgggtggtactaaggagacattagcacattaaatttccagtgtctgggatgcttgtaataatcacctttcttgacatctgcagcctggactagagaatcaatcttggcctgcactgtttcaatcagttccgttggaggagctgcaaatctcagcaagactggggggacttctggtattggcctttctgggtggactgctcgctgcttgatggcatgggtgatgcgatgtattgcagggttatatatttcatcaatggtggcgtattcggcaggctccctgacaaaacgagcaagattagcgatggaaacttatctgaaggggctatctccatatactcacccatcctcgtcaatgccataatttgata

SEQ ID NO: 494 - DNA, 688 bp, Trichoderma harzianum
aagttaaataagggccaatggacggcgatcatgggagcccgtcttcaactcacttttgccaatctgcaggctctcaaccgacagttcaatcaccgcggcgcaatggctgaaaacatcctcgttctgggtgctggcgagcttggcctcgccgttctggaggcgctctccagacaccccaagcgcaaccacagcaagattaccgtcatgatgcggcaggccacgctggactctgccgcacccgataagaagaagctgattcagcaaatcagggcgctgggcgtcgactttgaggcggctgatgtggtgcaggcttcggtgtcggagctcgccgccatcttcaccagatacgacactgtggtgtcctgcaacggcatgggcctgccgtcaggaacgcagaccaaggctctcccaggcggcgctcgaggcaaaggtgcggtggtttccctggcagtttggcatggactacgatgccatcggcctgggcagctcgcaggacctatttgacgagcagctgggcgtgcgagcgatgcttcgcgcccaagacactacggaatggatcatcgtgtcaaccggcctcttcatgagcttcctcttcgttgccgagtttggcatcgtcgacttcagcacccggacggtgcgcgggctcggctcgtgggacaacagcatcacgctcacaacgcccgtggac

SEQ ID NO: 495 - DNA, 95 bp, Trichoderma harzianum
gcggacgcgtgggcgaccagcgtccgggggaggtgaggagggtttgtattcatgaaaggagatttgcgcctaagctcaagcgcaaaatgaatcct

SEQ ID NO: 496 - DNA, 466 bp, Trichoderma harzianum
gccaaagcgaccacgagcgcatgcgcagatgactgactaagcggcccgttggcgaacaaatagtgaggagtttcgctgcgtcaccgcctgcgcatccgcatctgcatccgcccgccctggacaagaacaagcgagtgcgacgatacaatggacaaggacaagccgggggacaacaagccggtggacacctcgggcaaacatggtcacgacgaaacatcgcctatcgcaacaccgaccaagaagcctcgcaccgccagtccagctgagccagccgcagcgtcaacgaggcttgagccgctccaggcgccgctcgtcacagacccgacgttggatgcgggcatcgaagcagacgacacggccagcgatggcggctacgagtccgatttggcgtcgcgagcgtctacgtcggtatgcagcgccgtgcgcgactacgaattcgagaacaacaggcgctaccatcgctttc

SEQ ID NO: 497 - DNA, 407 bp, Trichoderma harzianum
aggaacattacagcccataaaggattacaagcatcgtggcgtactaccgacaagagttcatagtcatcgaaaatttgcgactatggctcgggtagtttcagtggcattatctcggaaggcgggttcgatgactttgtacgccacgggggatagcacgttgtatcaagcctcttcaaattgttagacacggctatgtgctgttggaagtgggtgggcattaaacgaggcgaactttacctgatgagacccggggtctggaggagccataagcgagatacactgggaatgaaataaatcccatgtctctacagttggtggaacttggtggaggaatatgaattgagttgacttaggaagatggctatgcctgtggagaagctgaatagattgagtttttggttccatcg

SEQ ID NO: 498 - DNA, 505 bp, Trichoderma harzianum
cccacgcgtccgcccacgcgtccgagatcagattgcaggcaccctcaattggcatcacatcatgctggcgacaagagcactccgagcggcccacgggcccaagcccaacatcaccggcttcaacatgcgagccctcaaagaggccactggccagccccgatacgacccttgggagagagccgaggcatggcgatacaagggcaccttttccagatggaaccgattccggagcggcttccctggcttgggaatcgcgtctgttgcatttgccggatactgcgcctacgagtacctcttcctcaaggatgaacaccacggcgagggacatggcgaggggcaccactagagcgttttttttttgcgagcgagagcagtcaggagtgtgcgagaggagaagagagaggaaatgtatatacatctctccaaagacaagaaaactcaggcctggtcttgcggcgggcaaaaaatgaatccaacacaaatcaatataaactctatttagagc

SEQ ID NO: 499 - DNA, 428 bp, Trichoderma harzianum
gacaagtcgaaacgaacccaattggcacgcacaccagaggccatatacaaatacaaatatccccccccttgaaccgactctcgcccacccgcccatcatgcatctcatgtacaccctcgacgccagcggcaaccgcctctacagcctcaagaaggtcgcccacggccaggtcaccaagtctgcgcacccggcgcgcttctctcccgacgacaagtggtctcgccagcgcgttacgctgaagcgccgctttaacctgctcttgacgcagcagaaggaggaggctatgtaaattcgcatcatggagataccctcgaaccaaagaaatcccaagcggcgttaattgggagcgacttcgggcatgctttttgaggtgataattgattcgtcattgtcctctgttggcgatacgggataaagagaacggcaag

SEQ ID NO: 500 - DNA, 189 bp, Trichoderma harzianum
acactctccaggctcacacaaaactcactacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacc

SEQ ID NO: 501 - DNA, 508 bp, Trichoderma harzianum
gtcgacaagttcaattcgcagcaacagaagcggcgcagacagcatgagctcatcactgaggagctgcgttgcggcccggccgctggctcgcatctcgcagacggtcgcttcacggaacggcgtccagagcgtccggtgtctgtcccagacaagcccacgatgggaggattcaaaagatgcaaagccagaaccacccaaggcggtgcctccaaagcctcgaaccgagtcgctcctcgacagcatctacagcattacccaggcgccaaacagccggtccgcgcagtccaaccccatgggcagcctctcccagagcatggtcttccaggccctcagcaaatccaacatcgacaccagcgtcctgtcaggcggtccctcgcaggcagcgcagaagaaggaggatgaattggagccattccatttccacgtctactcgcacaagcacaacactcacattacatgcacaaagcccaatcgggaacccatcatctccatgtcatgcggcaacatt

SEQ ID NO: 502 - DNA, 408 bp, Trichoderma harzianum
gtttcctctcgttctactagctgggaaggggaagccggctagcagttagagcggatgggcatcgtgatgggcagtgacgatagtgtacacccggaaaaagtgactgcgtatcgctttgcccctccgtgtcttccgacgggattgtctcgataaaaatgacatcagcacgggaagaagaagagcatctccactaacggcacacacaaacacgcatagaacaagacgctctccgactcctcggagccggtgctctccctgcagggcgttggctacctgatccgcaagggcatcagcctggccaccatcaccctcgaggtcgagcagtacgagggcccgcccaagccgaccaaaaacggcgccgacgtcgtcacgcacatcgacatcaagcagtccgcgtcgggcctgtcg

SEQ ID NO: 503 - DNA, 695 bp, Trichoderma harzianum
ccttcattctcattgtcgacatccatcgtgattcccctgaaactgcgtctttcagttgactctggtgattctctgaggcgccgaggctctgtgtgagcatcccgatccaacatcatggcgatacgcgaggaaatcgtggcgtctgcagcgcaatttctacaagatcccagcgttgccacctcgtccgtcgagaacaaaatctcgtttcttcgaaccaagaatctgacacaggaagagattgatgccgccattgccagagctgggggcggtagcggcgcggtagctcctagggctccctatgctggcgcgcctcagggtcctcctcagggtcctcctcaacagtattaccaatcctacccccagtatgcgtggcagccgcctgcgtcaacacaacgggattggagagattggttcatcatggcaaccgtggttggaggggtcagctatggcctgtactcattgggcaagcgttatgtatacccccttgtagcgccacctacccctgaaaagctggagcaggacaagaagtcgatcgaggagcagtttgacaaggcctttgctctggttgagcagctgtccaaggacacagaggcactaaaggatgccgagaagcagcggacagaacgactggacattacactggcagacctggacacgatcatgacggagctgaaatcagcaaacaagcgccggga

SEQ ID NO: 504 - DNA, 441 bp, Trichoderma harzianum
gcggtcgaataaacaccgactgcatctccatcagattgcgcttggcggccgggtctactgttgcagttgatgccgcccaactctggcaaaacctggcgctgcggctgcggctggagaccgggggagcgattctggctgcccaaacgagaaccgggggggatgtcaatgcacagttgcatcgaaatttggcgattaatttttttacgagggaggattaggattaggactttgcacggtagtattactaggacccctaggcagaaagttggatatagattgcattggatgttttgattgagttgccttgctgggatgttgagagtctatcaagcaagcaaggcagacgaggatgccttgtgcagagacggcatttcaattcactaattggataaaatagatatcaacgtattatacagaaatactgcatgcaaagtaataacg

SEQ ID NO: 505 - DNA, 672 bp, Trichoderma harzianum
tctacatcttccatattggggattgcttgcttacaggtcatcggccatggctctctttggaaacagagctcgcgctcctgcgggacaggccccagcagccaacactacgactacgccgacgacgacgacaaaacggagatggggactcggccgtggtggaggaggatttggccgtggtcgtcaacacactccgtatgcgatgcactcgcgtcctagctttgggcaatggctcagagtcacttggttggacatcttgaccatggtagctatgggagccatcggcctcggtgtctacgaagccaaaccagcgcctacacgctcgttccccgtcacattttccgatggagaaatcgtctggcctgaattcggctaccctcttcgaaaggagattgttcccatctggctggcagctttcctcgcatccatcatccccatcttcatcatcctcgtcatgcagatccgcatccgctcattctgggacgtcaacaacggtgtcattggtctcttgtactctctcatctgcgcagccgtgttccaagtgttctgcaagtggctcatcggaggccttcgcccacactttcttgacgtgtgcaaaccggatctgagccgcgtcacaacttcaggactcgacagaaccggattccagcagatctactttacgcgcgacatttg

SEQ ID NO: 506 - DNA, 608 bp, Trichoderma harzianum
aaattctaatcgaacgacgctggggagatttcaaccacggcgttttcccttcccacatttcgccaatggcacgaataacgaggatgcggagactgcagtctctgcaattggccatcccgtcacaatgcgccgcttccagaccttctttcgccgctgcccgcgccatctcgacgaccggccccgcgcacagcaagaacacggaatggatccggggaaagctctggaagggcgaggcccccggcccggctgatccctatacgcagaggatggagcccgaagcccagtcgaatctgcccgaggaggcactcgagagccgggcgcgccaggataagacgcccgcggccgtggaagagtccaggttgactctgcccgcgaggaggactgaggcgacggcggagaaggaagtgcaggcggcagacccgtcgtatgtgcccgctacggatgccgaagggctggaggagattggggcgttgaacacgtggtgggagcagccaggacactggggcgacgagagtgtcttcaagggattcggcagcgcggacaaggttgtggaaagggaagtcctggaggttcacctgcgacgagccgttgttgaggcactggcgctg

SEQ ID NO: 507 - DNA, 400 bp, Trichoderma harzianum
ggtgtagactatgtgtatactactgtacaagtttggaatcaactaaaattgtgcagaatgaagagagagaaaacagagcttattaggatggcaataatgcaccgtcaaagggtagcgccgtttccaatgtggtgcccaacaaagtggagggaaaatatgctcacttacaaacccacatgcaaaatcgctctcctctatacaggcatcctcacctgcagttcatgtccgttcgatggtgagatgacaagtggattgatttctcatcagtatgtaatctccatctgagtcgtacatgtagttagtttaccgatacacggctgcctacgcaagagaccaacaaccaagacgagttaacgaagtaagactttggtcaacagcagtattagtccagaggtcgaca

SEQ ID NO: 508 - DNA, 665 bp, Trichoderma harzianum
gaggtaaccaccagcacacgcaaacgatacgaaaaaccgagaacaagtataccttcagctccgcggacaacaatcatcaccgcggacaacaatcgtcactgcacgtctgcctagttgagagttccaagtgtaaaaacatcagcagttgccttgctgcgtggttcccaagtccagatagtcaacagatcaaacacaagacaaacctgcctgttcgattactttgcctccttgtagtacaattcgcaatagttcaccaaatcaccagtcatcatgcctgtcactgagtttgccattatcaagctgaggcccaatttcgaccccctcgagtttctcgagacactcatggagtgtcaagagattcaggacaattggattcgccgcaatcagccatgcaatctggcgcctggcatgaacctgagcagcatgtacacggatgccacagaccaatcaacacttctcatcacggcgccgtgggattcgcccgaggggcatggggaatggatccagagtcttgagaacaggacggccaatggcaacttaaccgagttcagcgctccgggttgcgactccgtcttgctcttccacatggacccggcgggagcgaggccacagatgcgggaagcctttcagcacaaggataccaacgacgtattcgacgtctgtcg

SEQ ID NO: 509 - DNA, 236 bp, Trichoderma harzianum
catgtggccacgggaatgacgcaaaaggcgccgagagcggaaatggagagaaaaaaaacccaattgcacctcgctgatgatgccactcaaatgtctgtggtcgagccactgtgcttctacctacgacttacattacctaacaaggcaacgaaacattttgcggcaaggagaattggatcattgacttggcgaatgggctaatgaatgtcgtcaattgcaggcctcgtggtttggcg

SEQ ID NO: 510 - DNA, 376 bp, Trichoderma harzianum
cccacgcgtccgagagcatcaaatctttcgcgagacaagatcgacggatacacaaacatgagctacgaagatactttaattcgatcgagaataacgggtttatcctatataaccaggagaaattccacgagtgacacatcaacaggaggcaccagtcatgactacgtccccataattgttatgactgttattgtcgtggcgatcgttctggtactccttatccttgcgtacgtttcaaaggcgcccagtcttgttcttcaaccatgcctgaaaaatgcaaatagctgatagctgtaacagtcaatacacaaaggtgcttgatcggaaaaagccagccaacggatttgatgatccagaaagcgcacagaatgccggc

SEQ ID NO: 511 - DNA, 178 bp, Trichoderma harzianum
cttgtatcaggcacgagaataggtgaggcaccgagcaagaggctgtcgtttgacaggaacttgtaatatctgctttagcagttaggctctgcagtaatcttactttagtggtccggggatactagaaaaggtgataatttgagcttgctctccaacgactgggaaaggatctcattct

SEQ ID NO: 512 - DNA, 278 bp, Trichoderma harzianum
ctctctgcgataagtcgcagtacaaggacgtcatctcgtcgtttgtcaagtacgttgtgaccgagctgcggctcgtccccatgtggatgcttgtctcgtacgacgtgcagaggattctagcacacgacttgggctggcgaaccctctcctgtaccgaggagcagcgtgtcgataccgcgagacaccagagcccggctggcggacccaaggcccgcagagtcgagcgtgaaggcgtcaagattcacgaagtcaagcccgacgaggactttatctcgcgc

SEQ ID NO: 513 - DNA, 107 bp, Trichoderma harzianum
ctttgtatggcgccagaatcgctagcaccgttctgaatgacgcccagctcttcgccgagtgggaggagaatctgaagaccatgtccggccgcatcatcgacatgcgc

SEQ ID NO: 514 - DNA, 605 bp, Trichoderma harzianum
gactctacactattgattgggataacatgcctctgccccaagcctggtgagagctgaccgtgaggcactgcttaagcttcgccatacctcgttgaccacgccgatatatgccgacgactctttcaatcccagaaagcgcaagtcgaatgattttccaaacaatgatgcatccgtgccgccttggcactctactaactcaggccgatccctcgaggatcgcatttcgtattcccccgataagcgggtagccctcgatgacagtaagttccagaaagaagccaacaagcgaaagcgccgtttcgaaaacgaatacaaggcggccaacgtagcgtcgctcagcccaactccgccatcatccggccccatcgtcggcacctctgaaacccttgaaaagaagtatctccgcctcactgccccccctattccgtccaatgtgcgacccgagagagttctccgtcaaacgttagatttgttgaagaagaagtggcgaaaggagagcaactattcgtacatctgcgaccaatttaaatctatgcgtcaagatcttaccgtgcagcgcatcaagaacgagtttactgtttccgtctatgaaatcatgcccggat

SEQ ID NO: 515 - DNA, 629 bp, Trichoderma harzianum
gcagtctccagcagagtaagcccatcaaactcatcaggctggacagaatgccgtccgaacgccatcctctcctatccaaccgcggcgagtcggccgaagccgcccaagcaaaggctgccttgcgctcttcacgcatccgcgagattgccttcttcgcctggggcctgctcgccactgccgccttcatcgtcgctgctgtctggatccagcatgacgctcagaccggccatggcgacaacaacaataacaataatactgtcgctcccaagcgcaacttggtcttcatggtgtccgacggcatgggaccggcgtcgctctccttgactcgaagctaccgccagtacatcaacaacctccccgagaacgacactctcgtcctggaccagcacttttggggcaccagccgcactcgctccagtaactccctcgtcaccgatagcgctgccggcgccacggcctttgcctgcggcctcaagagctacaacggcgccatctcagttctgcccgactttgagccatgcggatctgtcatggaggcggcaaagagggtcggatacacaacgggacttgtcgtcacaacagacatcacagatgccacgcctgctacctttgccagccacgtcctgagg

SEQ ID NO: 516 - DNA, 77 bp, Trichoderma harzianum
acgaatggagtgacacctgcacatcagcacatccaaatcgctgtgctgagctacaccgaacaagctgaaagcagtga

SEQ ID NO: 517 - DNA, 357 bp, Trichoderma harzianum
catgtggccacgggaatgacgcaaaaggcgccgagagcggaaatggagagaaaaaaaacccaattgcacctcgtgatgatgccactcaaatgtctgtggtcgagccactggcttctacctacgcttacattacctaacaaggaacgaaacattttgcggcaaggagaattggatcattgacttggcgaatggcctaatgaatgtcgtcaattgcaggcctcgtggtttggcggttggatgagagggggaattggagtgagtgggatggggagttggagtcattggattcatttgacaattggttattacgagcggtttaggtaagaatgtaacaatggaacagcaaaacgtgcacgc

SEQ ID NO: 518 - DNA, 198 bp, Trichoderma harzianum
  misc_feature (60)..(60): The residue at this position can be any nucleotide.
ctggcagaacccaatggcgccaaaaggcaaacttggggtcatctggcgtgggtgcatcgnggatcgacaaggagcaacatatacgatgcgtctcccgatgaatccccagcctatatatatgtgtgtgatgggaaatcgtcaggaactctagcttcaactccatagaacaactttaaaaaaccaaaaaaaaaaaacaca

SEQ ID NO: 519 - DNA, 582 bp, Trichoderma harzianum
gcccacgcgtccggcgtgaagataggagagaatagagatagagaggcaattgcacggaatgtttagccaacaagttgctcgtggcgggcgccgcatcggccagatggctcgaggcggccaatatccgtcactcgctgcgctcagaggagctgctcaacgacgatgttatgctgaggctgcacaggcagcccccaagggacgtatcggtcgaggcctcgggctgctcctgtatggcgttgcatttagcggcctcggagcagcagcaacattctattcgatggtacaaaagggtttcgcctcgttcaccgacgccgagtcagccaaactgtttgtcccagatagcgacgagctgcaacaaatcgaagagacaatcaacaaacacccgctcgtccaagagcttcgatcacgaccagagttcaaggagtcacgaccacacctaaagatgtcaagcgaagtccgcagccgcaccctcaccggcggcgctctacaaggcgacggcatgatcatggtcccccccgtcgccttcatcgaggacggcggcaagtccatcgtcagcgtcacgtacattggcgacaaactatg

SEQ ID NO: 520 - DNA, 529 bp, Trichoderma harzianum
ggtgggttctgcggtgccacggctgcttcaacatcaccaaggacatgaacaagcagttctgccccaagtgcggcaacccaccctcacgaggacaagctgctcgacggaccagcatggcaacttcaagatccacctcaagcagaactttcagtggaataaccgcggaaacgtgtttagcgtgcccaagccagtccacggcagcgccaacggaagacttcctaagaatgtcggtggcaagaatggctggggcagggacttgatcctggctgaggaccagaaggagcacgtcaatgcgctggatgaccagcggaggcagaggaagaaggatttgatggacgaggatttcttgcctggtctcttgacgggtaacaggtcgggagcgggcggcaagatcaaggttggtgcaggacgagctgtgaactctaggcggaagcggtagacggagagaggctggttacggttgttatgaaaaagaagataaaaaggcagaatatagaagtgaatatccatcatgattgtatgactttaa

SEQ ID NO: 521 - DNA, 248 bp, Trichoderma harzianum
tgcttgtgatgcgtgttcagataaaattgtcttgaaatgtacatttgatgcttttgagggcttctaaaagtaaatcaactctgagaccagcggggcaaacatggtccataggcacgcatgctacgctgccgtaaatagagcaagacacgcagggttataggagcgcgcccaggtctcaacctaaaaagcttcaatccatgttcaatctgaagcacaacatggatgaaatattcaaaccgaggagctag

SEQ ID NO: 522 - DNA, 263 bp, Trichoderma harzianum
gcccacgcgtccgaagtagggcaggctagctggtcccctggagaaagatgaggaaaagacccggaaggagaaaagggaatcgtgtgatttaatttgctatgccggatcgtagccgtggatgtgagatgaggcgggaagggagaagccggagaaggcgggccttgacacggagctgaagaattttctttttctttgtgtcgcgtgttgtgtgctttgatcgtgattcttttgccgtagccctttttttacatacatttgtgtgc

SEQ ID NO: 523 - DNA, 87 bp, Trichoderma harzianum
gaacctacatcatctaattcaacaaactcaagtataacttatacctactatttatacctactcaacagtatactcgaccttgtccaa

SEQ ID NO: 524 - DNA, 102 bp, Trichoderma harzianum
  misc_feature (1)..(1): The residue at this position can be any nucleotide.
ngaatagagggaaaacaagaagcgctgcttagccccgatcatgcgtacaatcttcacacacttgtgtcagctcataccaaatcgagctgggattggttgcct

SEQ ID NO: 525 - DNA, 418 bp, Trichoderma harzianum
cgtcccggacttctcaaccggtgtacgcaacatcacccttgatctgcctccgcgttcacgtacgctcctgattggtgccaacggtgcgggcaagaccactcttctccgtctgctggctggaaagcgtctggctcccggagatgccatctccatctgcggcgtcgaccccttcaaggagggtctcgagggcgtcacctaccttggtcttgagtgggtgctgaaccccatcgtgcgcaacgacattggcgtcatggagttgcttcgatctgttggtggcgatgcttaccctgagcgccgcgacgagctggttgagatgcttgacattgacatcaactggcgtatgcatgctgtgtctgatggcgaacgccgcagagttcagctggccatgggcctcctgcgtccctggacggttctcttc

SEQ ID NO: 526 - DNA, 447 bp, Trichoderma harzianum
cggacgcgtgggcggacgcgtggggatggaggccctcctgcgcaataccacgcctctccccctatgccaacttatcagcctccctctgacaagccggctattcctcagggatggattcctctctttgaccagagtcgccagcgatggtattatgccaacaaggagaccggggcgacccagtgggaggctccaggctacattgcccctccacgacctcccatggagagctaccccagcgaggaatcacgaggcagcggcccttcgccgtatcccccagcagccccatacgggcctacgcctggaggctacggagctcctcctccaggacctcccccctccgcctcttacggtgcacccctaccacctgctggctacggggctccggcaggagagtatggccatagtagccatggtagttatggtggcgagggccgcggtgagggctac

SEQ ID NO: 527 - DNA, 118 bp, Trichoderma harzianum
aagaaaatagagaagggggagaaaagaagagagcctcttagaggatgatgctgaatgacgctgtggatggtgaaatgtgagatgagcaaggtttgtgttacatgtatattaagaggat

SEQ ID NO: 528 - DNA, 95 bp, Trichoderma harzianum
gcaaagaatccgcggccgacgtgcccaccaacgggcactatgtttccaatggcatgggctctggacagcaattccagccccagcagtatcagcag

SEQ ID NO: 529 - DNA, 79 bp, Trichoderma harzianum
gataaatagtagctgctgttgtgaagcactgctttcatcaaaacaaggtactctccaatcacatctgggtgttcgaaca

SEQ ID NO: 530 - DNA, 300 bp, Trichoderma harzianum
cagcataatctaatcacgatgcccaagttcttttgcgactactgcgatgtctacctcacgcacgactccatgtcggtgcgcaaggcccacaacagcggccgaaaccacctgcgcaacgtcgtagactattaccagcaaatcggccacgaaaaggcccagtccgttattgactcgattacttcttcgtacgctgccgagggccaggcccatgcgaacccgatgcttcttcagaaccagcccggccagtgatttccggcctttggcttccccggcggcatccctccgccattccccggtatg

SEQ ID NO: 531 - DNA, 547 bp, Trichoderma harzianum
  misc_feature (185)..(185): The residue at this position can be any nucleotide.
acgcgtcggcggcgtctcctacaagaaatcgttcgtttccctctgtcattgcgagcctgttgagcaacacaacaaaaaggcgtcaacacacaaagatccaatcgccagatctaaagcctctgtgctactcagtccaacaattgcacaaagcgacacaacataccgaaatctgcaaacaatgtgtntccgcgtggagccaaaggccaaatactactaccaggaggaaatcattccctcacggccgtaccgccatcaccatcaacatcaccattcttcccaccactcgccgcgagcgagctactcggcggttgagcgctacagcccgcggggtagcaccagcagctacagacgcagcgtgccgtcgagggtcgtgtatgaggagacaaacgcgggagtcggtactgaatggggctttgattaggaccaggaatatcctgtgattttcttactcttttgtttttttaacgactctatgggtactggttatgggaaatgagacacatgttagaggctagaataatgggcggattgggatggaaactcgagg

SEQ ID NO: 532 - DNA, 249 bp, Trichoderma harzianum
agcgtccgcggacgcgtgggaacccgaacaaaatgcttatgagcgggccgcgggtaccatgtcagtgtacgggtactcgtacaagttccctctggacgagcagatgcaaccatccggcagtcaaacttgatgctacttgacctgtaacatttgcattgatgagcggcagcagggcctggcaacctgggtagtactcccaagtattgcccgtacacgtcctaacatgcggcaggcgatcaagccgttctc

SEQ ID NO: 533 - DNA, 324 bp, Trichoderma harzianum
gcgtccgcccacgcgtccgcaaccgtcaaaatgggtcacgaagatgctgtttatctggccaagctcgccgagcaggccgagcgatatgaggagatggtcgagaacatgaagatcgtcgcctccgaggaccgcgacctgaccgtcgaggagcgcaacctcctctccgtcgcctacaagaacgtcattggtgcccgccgtgcctcttggagaatagtcacttccatcgagcagaaggaggagtctaagggcaactcttcccaggttacccttatcaaggagtaccgccagaagattgaggccgagcttgccaagatctgcgatgac

SEQ ID NO: 534 - DNA, 579 bp, Trichoderma harzianum
  misc_feature (290)..(290): The residue at this position can be any nucleotide.
  misc_feature (519)..(519): The residue at this position can be any nucleotide.
catcacttattattactggtatatattactggtatttgatgatgtgagcagtggataaagctggattacgaacgaggattgggagcattcaaaattcacattgtcaaccacgcatcgcagcacctatacgtgcattttcgactatggcctccaacaaggatgcgccagctgcgattaaacgcaaggacctctacgaggccctgaggctctcgcgactcccagatgagcagagcggctcacaggatcccatcaagagattcgtcagtcgtacaccagacctggaggcctgnggaatgagctggcccatgggggattccaatcccgactctgaagggtataagaagggcaacacggttgactttaacccggctgcgtttggaggccacgtcttcgcccaggcacccttggcggctgcgagagcggtggaggaagaagagaatggcaatggcaatggcaatgacaaactaggcattcattccatccaaggcgtctttacaaaagcgggcgcgattgatcggncattcatctatgatgtgacaaatgtccactcaagccgttcattcaccaacaagctggtcc

SEQ ID NO: 535 - DNA, 85 bp, Trichoderma harzianum
gtcctttacccaccaagtgatcttatcatgatcaattaagtgccggtcgaaaatacgaatatccggaatcgctcaagacttgata

SEQ ID NO: 536 - DNA, 626 bp, Trichoderma harzianum
agcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacgacttacccaaacctcctcctactggcaatactggtggccagataccagtcgctgcttaaagccatcgctatatttgagcttccctgggcgaatacttgatctattcggcagacacatcgagatactacactaattaggcccgcatagcgtacacagtgcctcaacggccgttctgaagaggcttctcagattgatccgtctaacatcggatgtattgatagacgcggacgagaagacgacgatgtaccagcgacagaccaaagtcatcccaagcatccaagctactgatgcaaaaatatgcgtgccttgggagtaccactctccgaggcaaaaattcagtcacttaaagagacaggcttcgggaatgccatgaagaattcaggctcacgtgggggacatttgatgaaagaa

SEQ ID NO: 537 - DNA, 423 bp, Trichoderma harzianum
  misc_feature (346)..(346): The residue at this position can be any nucleotide.
gcgtcttataacatatatgtagatgaatttgaattatatacagttaataatataccgccccaagccggatacccacccagctcctcttaagccatacctgttttaaccactgtacactaatgataatacgtgaaaaatagaaaaaaccctgcccaataaaagaaaaaagtcatcctagacttaaaacagcgtgcaagcagtggcgttgagctgagtgcagtaagtcatctggatggggaacgcgctgaccccacgggcaagcaagcgttctcggaactcgttcagacgaggaacaacgtccagctggctgcgctgttggccagaggcatcggtattgccggaccancaaagctcaccggcggcgctgccacgaggccagatgatgttgtccaggttgcctggcgtcaatcatctcgctccata

SEQ ID NO: 538 - DNA, 640 bp, Trichoderma harzianum
agactccaagatgcatcatcagcttctcactctcaccgctgctgctggcctcctcgcgacggcctcagctacctactcgaagcttcccagtgtcaatgtgccttcatgtcctcgtgttggcacgattagctacagcaagtcagtgcccgacctgacgcccttcccgctcacacaggtcaacctgtgctacacagacaagagcctcgagctctcattcattgcctatgacgaggtcaattacttcttcaatgcctctcagggtacaaacgacgacatctgggagtacgaagtcatggaggctttcctctacaagggcaccgaagaccctcagacatacgtcgagctcgaggtcaaccccaacaacgtcacataccaggcatttgtttacaacccctccaagaatcgcgcggtcggcgcacccttcgaccacttcttcgtttcggatcccgccacggacggcttcagctcgaagactgtcctcaacaagctcgcaaagacttggaagagcactgttaccgtccctctgggcatcttcaacgtcgacgtcggcaaggccaagggcacatcttggaggatgaacttcttccgaaccgtcgtcagccctgagatttaccctaatcagactcttggtggatggtcg

SEQ ID NO: 539 - DNA, 316 bp, Trichoderma harzianum
tccgtccaagcaagggaggccacgatggcgaatgccgccagcccggaagagatgcctaaaatgcctcctccacggcttcttctggaagcatcagtcaaactcgttcacttgcatgcagaggcgctagcaaggcctggccgcatgctgcgcgacttttgcaagtgagttcgaaggaaagcggccggccacgttttggacatggggagagaagagagaggagggcatgctagttagttgccagattgagcgtcggtgtccaatgtattcatgtttcggaaagatttttgttcttcttccatagctattgtaacggcag

SEQ ID NO: 540 - DNA, 412 bp, Trichoderma harzianum
gagggccggactaacacggaacgagacagggtgtggatgagacgtcgagcacgtgtaccaccacttttgggcagcggaagtgcgggcgcgggatacgtaagattgacggggttttcgaggtagtgggaatggtgtgtctgccaagagaattggcgtttgaatagaggcaagtggtttcttttttctggtgacaaatgaggtgcggggttttgatatgaagatgatgaggattgtggtgatgccggagatgggcttgggatgtggtggtttgatgaggtaccctggatggtgatatttgagattgggaggctcgagatgggggatctcagaggaagcaaaatagaaatagaaacggacctcggccgaaagtaacccaaaacacaatctatgacggttaacaaaaaaaaagaac

SEQ ID NO: 541 - DNA, 340 bp, Trichoderma harzianum
ggcaggcagacagcatagatgaggaacttgttttcatccaggcagccaaaaagggcagtgcaaggcaggcatcgtcagttgcagcgcgggtgattggctcatccgccgggctctttttttgcccttcgacttgctttgatgcccggagggatgtgaatccaaagagaggcgacctgcccaaagagggaaacagggcaacgtgagcgggtagattcgcagctaggaacaggacaagcatcacacatgtatgtaagatggtcactccggcccttgctcggaatcaaccgcggggacccgtgtgagcaaagatagataccgtatgaatatatcgtatcctacg

SEQ ID NO: 542 - DNA, 368 bp, Trichoderma harzianum
aatttacaacagcaacctaagcgcacctagatatcatggcggacaacactaaccccggaaactttgccaaccgccccaaggaggaagtgcagtcgattgcatccaagggtggacaggcgagtcaccagggcggcttcgcttccatggatcctgacaagcagcgcgagattgcgtccaagggcggccaggcctctggaggatcttttgagcccggaagcaagaaagctcaagaggcgggccgcaagggtggtttgcagtaaagcatgaccgtaactctagtgtcgattcactggtagacggtgtgattatctcttattgtagataaacatacactagcaattttgctctaatacaaactaattggtcct

SEQ ID NO: 543 - DNA, 595 bp, Trichoderma harzianum
ggcggctgcgtcttctcacagcgcataatgccgtcgcagaaaatacaagctacctacctaggtattgtgaggaatgtgcaatggtaagtccctaagtactaacagaggttgaattgctactaataagggagtggctattccacatccccggatggagtatcctcagtcgcatatactattctcacataacagtggatgcctagatacctatagtattacactctttcagccagctcttcgccagcattatatcctgaaaaaaaggagctatagcatatatgcatgcaccagcagaaatcatcatcacaccaatctccgtcttagcccccaccacctgtcctcttcatcgtcaatgacatgtagcagaatgctcagcctcatgtcggcatcgagtccggcctggcgccgcttctcactttcttcattatacctttcgaccgcatgaatgatcgccatcttgcttcgtctcggccccaaccactcaagcgcggccctacctgaaatatatgtgtcgtcctcacatacccccttgtaagtgccagtgtggaggaacgcgtcgttgtcatgctcatgctcgggagttggagctgtactt

SEQ ID NO: 544 - DNA, 583 bp, Trichoderma harzianum
aaaaaggtttgaccttggtagaccaaagatcgcccacttctcgagatgacatgacggcaaaccaggctctagtggagtttgcttttaagaaacgacgaagcaaggcgaaggtgcaggccaggcagcatctgcttacttgcctccaattcgccgctcgggatggattgcagcaaatgggctggagatggcttgcccccgctcttggacgcgttggcacatgcgtggcacgatagaagagactcgccttgcaaggcattcatgcattcggaggagaagaatgtttcatctcgattggatcccagtcggctttcttttcattttggcgtgatcgccttgtgatttttgcatcagctggagtagttgaagctgcgtcatagcttcccagtgctgcttggaggctgccacaacacaactggataatgcctgctgtcagtaatgggcaggcaatcgttgagggaagctcaaaggatatcagtcgtcaattggagaggttgttagggcaaatgatattcaaaaccggtgattagacaagccatgtataggcgatggttttttggtcagtatgttggatttgtttggatgt

SEQ ID NO: 545 - DNA, 304 bp, Trichoderma harzianum
gtggatcgtaacaaatagccttgccatagaagacaagggaaacaattttctttgattcagtgttcactgaaccgttgtctgtcgttcatctcgcttgcattgtgccatttatgaatctccagaaccgcaacacctttgtatcgtcatccacccaaacgtatgcctttcaaccatgggaaacacgctattgaacctattcagcttgtccatgtataaaacggaaatcaaggcctacgtggaaggaacatcggatctagtactcctgcgaattatatcataacgccacccgctgtcccaaggattt

SEQ ID NO: 546 - DNA, 269 bp, Trichoderma harzianum
attgagttgaatgacgaaaggagtttcactgctacaaatgtactgtacagaaggtatacagattgacagtcagggtccacgatgcttcaagatcagtcagatcagtctcccatctcagctccgctatgacctcagctgcagagccggggtggaggcagcactcgacggctcggactgctaacaaaatccccaccgaagatcggcatcgtctccgaagggtcccttggccggatacagagcgaaacgaccgtgttggatcgcattgccct

SEQ ID NO: 547 - DNA, 626 bp, Trichoderma harzianum
ggtgatgatgatgatgtatttcacgaactattattgtacatgttcacccctattcaagcagcatctttcccatagtcaccaaacatgacatccgatacaaaagacacacgtcgtgacaaatacaatctaatacaccaatcagacgaatctcgaaattccaccatttgctatcccataaaacgccctgctcccaaatccaagcctaaaacgcaggaaataacaccaattcaaaaagtagtctggctcaaatcaacaacacacacaacacaacaaacactcttacaacgcgctcacacaaccgagtctcaaaagactacatctctttctaagccaatcatcagccatcaaacaaacaaacaatcaccaaacctctcatctcatcatccaaaatggcctttcttcagcgcaacttttacactcccgagacctctttcactcccctcttccgccttcttgaggacttcgacaactactcccgccaaggcaacgacaaccagcgtaccagccgccgcactatcgctcactggcagcccaagtttgatgtccgcgagacgggcgaagcttacgaactccatggcgagctccctgggaatgaagaaccaggatgtgcacatcgagtttaccga

SEQ ID NO: 548 - DNA, 512 bp, Trichoderma harzianum
aaacaacgaaacaaccgcccaatcgccaagtcgccgcctcgacatggtgctcggcgactacgaggaagcacaataggcgggacgcgaagcaaacaagcgctgggcgtctgagaagtagcccgagagtcacagctacagctacagctacagtgaacacgcgatagagtgattcaggacatccagagacgagacgaggcgcctgaacgagatacgaagcaaacagacacgggaaagcagatgcaatgtcggcaaacgtaacaaagccggcgcccaatcggccgcagcggcgcgtaacggccggccagatcctgtcgatgccgccgaaatggctcggcatgtacgacgaattcatcaccaagaacgccggccaggtgtcgcagattgagagcgcgctgaggagcttgacgtatatcattccaggccgctttcgcgatgctgaaatcgcctccgagtcgattcactcgggcgtccagctggtgtcgctctaccacgacggcatcctctcgcaggca

SEQ ID NO: 549 - DNA, 559 bp, Trichoderma harzianum
  misc_feature (431)..(431): The residue at this position can be any nucleotide.
gcgtcgaggcgtcaacttcacggcatcacgaggttcctggacaagccgtcaccatgtccactgacgatctgagcacccatctggccgactccggcatcaccatgcggtccgacagcgagcagtactctccgggcgatgaggtctcatcaccctcgtcatcaaactcaccggttattctctacaagccccccacagcatggagtctgatacggagcgccgccatcaatctggttctgccattcatcaacggaatgatgctgggatttggagagttgtttgctcatgaggcagcattccggttaggatggggcggtacaaaggttttccctctttctcgaagacgagcccaccccattggcccaggcatcgaagtccgtgaacgaccagagcgacccgggccttcactaagtgattacgcaagcttagagtanaagggaagaatggaatgaggacgataggggtattgtatatgaatcaatcatgtctaaataaacagatgcaggcgcttttccaaaagactgtggcccatctgctgcactttcagagctccccaaccata

SEQ ID NO: 550 - DNA, 452 bp, Trichoderma harzianum
ggagcagctgtccttgactccagctaggcatggagagatttttgggcggtttgcggtgccttttgcggtaaggctgagcagtgtttgaggtcggggagaatggatggaacgaaatcgagtttggctgcgtgggggccgcagatcgcatgtcagatcgccggtcggtctgctaagcgatgcttaaagtcggaattgcccgatcgaatctccattccgatggcggagatagaaggctgtatgatggagagccagtctgacgagaacatgggaaaagatggaagatggggatggaaaggaaatggagatggagatggcgatggagatgatagagatggaaaatggaagatgaatatctattactctgggctcgaagagagtcagtagagtcagaacggtgggggagagataccttaggctttgatgtgctgaacgcgcgaaacatcgcgagaacg

SEQ ID NO: 551 - DNA, 531 bp, Trichoderma harzianum
ggagtggttcccgttgtataacagggctggactatacttcttcatcttcagctacacatactctcaggctctttcaaagtattcgccggagtcgtctttccccgacatggtcataacaagcttacagaatgagccacggactcgataacctcaccggcctcgccgagggtatcggtctgcgctttctaaatgaagagtggaacgatagcatctcaaacgaccacccgttcaccatccaatggaacgagtcgctggatggggctcaggcaccagagcttgggctgttcaagattacatatcccaaagatggcgttatcgcatacgagctggtatcaaatctgacaggccgcatgaataatgaaaatgcaacatgcttgtggacaccaagccacttggacgacgaattatatactctatggctctcatcctctcgagacgctcgcgcaaattggacgacgtctcctccttggagactaaaagaaactccccgacattcacatcattgggccgcccccattgttatccccatta

SEQ ID NO: 552 - DNA, 482 bp, Trichoderma harzianum
agaagcttcgaagctctcgagatatatattcgctactgagccacatccctccactctagcttcccatagctatcaccaccgcactcccctacacaaccaacccccaacagtcatcatgaaggtcgtcaccaaagaagaagaagccgcccactacggcgctgtcgtcaagggcggactcattggtggtactcttggtcttgccattggtgtctctggtgttgtctacgcctcaaggcgctaccccagcttccgtggcttgacactccccttccgaactttcctcgtcacatccaccgccacctttggagccattgtccaggctgatcgagctggcatcaagttccagcagggcaaggaccccatgaagacctaccgcgatgcctctcagcgtgctcaggaggttatccgtgagaacgagactgcatacgagcgattcatgaactatggacgcgagcaccgctacagcattgtctgcgcctcat

SEQ ID NO: 553 - DNA, 500 bp, Trichoderma harzianum
gagactgttattgaaaagactctttgccttggttggcagattggttgtattaggcatactgtttcgatacgcttcaacgtactttttgagtcgcaaagctaccatgactgtggctcctgtgattgcgctctcacatggtggaggtcccctccctatccttggtgatccctctcacaaggacattgtttactctctcaagaacagagtgcccaagattctcaagctcggcactcctgagcagccccgtgccattgtccttgttacggcgcactggtcgacgaagaacccgaccatttcatctgcggcttctcacgacctctactatgactactacaactttcccaaggcggcctactcgctcaagtacccagcgtcaggccagccagaggttgcgcgcgaagtcaaggcggcgctggaagagcagggcctcgcatcagttctcgacggcgacagaggatgggatcacggcgtcttcattcccatgctgcttgtgaaccctg

SEQ ID NO: 554 - DNA, 411 bp, Trichoderma harzianum
agagattggagtttgataattcttacaaacttgtacataatactgatgcattcagcccttggtcctgatggcatgagcagacatagcctcggccgacgattttgcccctgcaatggttctctgccgatgtttcccgcagcttcttggcagttggggtaatacgataatacgacgatggcatctttggcctgcacgccgaattggggtcaaatagacggtattccgaacatttcatatttaagaagctgtgctgcacgccaaccaacctttggaatggtgtgaattgtgaaggacatgatgcatggtataggccatgagctagtctcagagagatggagcctccggtgtaaaagttgtacattaatacgatcaaagcccgctacgaaaaaagaatggcaattgtattaaaaa

SEQ ID NO: 555 - DNA, 563 bp, Trichoderma harzianum
cccacgcgtccgcattgactttgaagctctgtaattttgttggaaatttcggggcgtttgaggctgcctttaccatggccgctccattggccaccgccaagcagcagcttaggcgtctccttaagcagaggctctccaaagtctctcaggattccgttctcgcccaaagcagcacaatattcgaaacgctcaaaaccttcaagccctaccaagacgccaaccgcatcagcgtatacctctccatgcccgtcggagagattcagacggacgcaattgttcgccatgctctaaactcgggaaagcaagtctttgtcccgtatctacacaagtcacccctagacgaacctggaactccagctcgcgtaatggacatggttcaactgcaggatgtccaggactacgacggccttcagagagattcttgggggattcctagcatagatccagctaccgttcatctgcggcagcgcatcctcggaggaccagatgtgcacaaatcagatcagtccaccttggatctgatccttatgcctgggtgtggcttttgataccgatagcgcggg

SEQ ID NO: 556 - DNA, 435 bp, Trichoderma harzianum
agcgatggaggacgagattcgaggtccttgcttggcccgggtggcgtggcgtgggtgtgcccggggctgcggtcctgggagccgggccttgctgctgaagaatttcagaagtttggaaacaaggcacgttgggatttgtgcatgtatgtaggtactaatgtatgtatgtatgtacatccaagtacatgtatacctatgcgaggtcggaccagccaccatgtacctacaaaggaatcagtgcaagcgtgcattcaacatgacatgtcaggtagcggacttgacatgtttgctggtcccttgcgcgagacgagattgggatggacaaggtcgaggtggcttaccacgtgagtttagtgcacagggccgcctgcaataatgggatcaatctgattatggcctcaattccaatgattacagttgaaaaacaaaaaccaa

SEQ ID NO: 557 - DNA, 654 bp, Trichoderma harzianum
agccgaagcgctcgtagtatctgatgtttgctttggagcttgactcgagttacttaccttggcagccatgtccatgatgagcttcttggcatagcctttgcctcgggcgctcggcttggtgccgatataagcaaggtaataatactcacgatctcccatgacctcgtccatggtctcatgcagaagaggcaggacgtcttcgtagtagcgcttgcggccctcggaaccaagttggtagtagaggcgccacatgccgcttcggaagatggtccaccagtcgtccatatgcatcccgggaggcatcctaagatgaacagacgtcatagtcaggaccaatggtcgtgacaacgccgctatagcaatgggccgagaccagataggtcatgatgcggacgtgaagcttccacttggtctcgtccgagtagcggtcctcgccgtcgccgtcgagaagatacatgctcagagcatcggcggcgaatgcgtgggcgagagagactcccgcctgctcgcactcggccagaccgatcttacggacagacttctcccaggcctgagggacgagagagcgacgacggtccacaacaacggcagaggaagctgtcgtagcaatggtattgatcgcgggcttacttataacatgcgccatgctgggct

SEQ ID NO: 558 - DNA, 534 bp, Trichoderma harzianum
aaggcgtaatgccaggcagcgtccaccgcctttcgccagctgcctaatctctgccaatgccaatcatcatcacccattagctggctaaactctcacaattcccacttccccaaaacccactgctgcaggagtgctgtgccaattgctggcccacgagctcgaggacgtcgaaccatgactgcagaagcaagcgggcgtcaggccccggccgagtcggttgcaccggcttcggagcgcacgccgttgttgggatccggcgcgtcagagtcacgcacagacggcagtggattgacgggggcggcggcagcagcggcggcgattctgagacggcatcagcgtaatgagagcgagaatgagcggctgctggccggaaacgacgacgacgatgatggcgacaatggcaatggccaggaggaggagacgacggtggtggccgaggaagtgtccttcgccaagctgtgcctcatcatgggaaccgcctacctaggtgtcttcctcggggcaatcgattcgtccatcatcgccacgctctcg

SEQ ID NO: 559 - DNA, 353 bp, Trichoderma harzianum
agacaagagtgaaccacgcatcatccacgctgagattgagatgaccaagggggaaaaaaggggggcaagttttctgtttacgccactgggacgaactccccttttttttgatgagaagaagaaacggatggttttagtgtcttacgcatatatatgaactgagcggcaatgcttaataccgtgtagctgctttgctttgctatttacagagtggcgaggggggagattgaggaggcctctggagaaagcaaagagccttaatgtctgtttttaccattggatggtttcttacttccaaggtggctcttaatttgtgcttactgctttgttggaacaccgactgttgcttcagt

SEQ ID NO: 560 - DNA, 566 bp, Trichoderma harzianum
aagttgtgaaaggggttgcagatccaataatgccacgccgatccatatcgagcaatgtatttatacccaaatcgtccctttaccgaaaattccgagcctctctagcgctcgaatttatcaatttttgacgagtatccatgagctccgtgaaaatcaacaagagatttcaggacatatagaagggagggcttaacatatatggatataaatttttctattgcttcatccagcaacaaacccttactggagctcctgtcagccaccgtcgagatattcctggaggcgtcacaaaactctatgtcgatctcataagatcaatcgtcgttggcgcccatactgtactctgagctacaagtttgagaaaaatacttgggtcaacatacatttactacgtatcttgaattctcaccagcatgattgatggaatacagcaccacgttgagacataatagcttggtagtactgtacggggccgcctcaactatggagacgtctaaccgatcgcgagtttagctctcccggtacgagtagccgtcttccgggccggtatttggtgctcggacctg

SEQ ID NO: 561 - DNA, 304 bp, Trichoderma harzianum
ggcagagctacaacggccctagcacacaattggccacaattcacgcctcacaatcgccaagattgctctaattctcgggcagtcaagtcttgtcaagtcttgtcaagtctcgaactcgtatccttgagcatatgcaggtggcgtctgtgtctcgagacaagagagggtgaacatgtgcacagaacaaggcaccgaagccgaaagggacaaaccgaagccgaggtgggaaaaaggcgccacgaaccagtatccaagagtttagccactgtgtcctaatagaatccccccttcttttttttccttc

SEQ ID NO: 562 - DNA, 483 bp, Trichoderma harzianum
gacccttgcttgagtacaataatttgacaatgggtaaaccattcccgcaagttcagcctggagggagcctgattctggcttaccgcgtcaaggacaagaatgtcctggtggtaggcggtggtgaggtcgcggctggccgcatcctcaactgcctcaatgccgatgcccaagtcaccgtcgtctgccctgcgtcaggcctcaacgaagaggtcgcattccgaattgccgagaagcaggtgacacacatcgaccgcctgttcgagccgtccgatttagacaaagcagacatggtgctggtcgccattgacgatccggcagcctcgacagcgatatggaaactgtgcaaggaaaagagaatcccggccaacattgcggacgtgccccctgagtgcgacttttactttggcagcgtccatcgtgacgggcctctacaggtcatggtcagcaccaacggcaagggaccggggctggcggcatcactac

SEQ ID NO: 563 - DNA, 383 bp, Trichoderma harzianum
  misc_feature (381)..(381): The residue at this position can be any nucleotide.
cgccaatctcgaacgcctgtcaaaatgctctcccgcgccgccactcgcaccacctccgtggtcgcccgccgaggcttccacaccacccgccctcgcatgtcctctccttaccactaccccgagggtccttactccaacttgcccttcaaccctcgcagcaagtggttcggcgccggctactgggccttcatggccaccggcttcttcgctccctttggcattgccgtctaccaaacctacaagacccagtaaacggatgcttcgattacaaaaggcttatatgggctggacgcttggtgctatgaatgggtggtggactgttgcgacagagtaaatagctcgaattagacgtgggaccaattcacaagtcacatacatcanag

SEQ ID NO: 564 - DNA, 567 bp, Trichoderma harzianum
gaagcaaccaagaatctgcacctcactcgataataaaaagaaatcggtactcaaggtttataactcattcaaaatgcgttatactgctgtcctcgctgtcctcggcttctccggagtcatggccaacaaaaacttcggacccttcggatttttcggaccctggttcgatggcgacttaactatcgatgacctcgctgactttcagtttcctgagaacccttgtgagttcattggtggtacttgcgagatcgccacttcccttacattctgcgctggtcggggcgacttcagcgttgatttgccttgtggcgttggcctcggctgctgctggcaccaggacaccagcaatgtttggtttgagcaatggaaggagtggctcgagctacacagccgcatcaactaaagccgctttaatgtcttgacgctttgatggcttgacgcttctatggcttgacgcttctatggcttgatgctttaatggcttgacggagtcttcaattggcacggtagtgggtgatggagaaattagccgtactgaactcaatgagagattgttaaccctgaaaa

SEQ ID NO: 565 - DNA, 592 bp, Trichoderma harzianum
accgcatcttcaatctcgtttgccgtctttgtctttgcgctgacagaagccctgccgaacccgaagagccaccgccatccgtggaacgagattaaaaaccgcgtaaagatccggccaacagcgggagcaaaaaaggaacctggaaaggataagggaacaagagaaagagaagaagaaaaaagggtgcgctctgttacaaaagcaaagatgccggatctcaactcggtgcccccctcgcctcacgtcctggccagcggaacaccttctcgtcgtcagtcggccaacttgcagtccgcatcatcgccgccctctgcgtctgcctctgtcaacatcctgccttccccccgcctcagtcgcccatgggctcagccgatgccgccgttgggccaggcccgggacctctgcggcacccgaggcctctgacagcctctgagcttcacatacagctggaaaaggagcaggaggcagtggtaaatcgtctgactcgcgagctctcgatgcttcgggtcgcccacaatgcgtcggtcgtttcaaacgcctcgtcgacgtcgaatgctacttcttcccacgaccccattgtcgagtcgtcgct

SEQ ID NO: 566 - DNA, 591 bp, Trichoderma harzianum
atcctttttctttcttcaatatcgcctcaaatctcactgcaactctctcccctctgcggcatcttcaccatggctgaaccaacccccggcctcactcccgagcagctctcggccttccaaaaagacggctatctcatcatccgcaacgccctcaagccagaaaccgtctcatcgctccttagcgaaacaaagggcctgctcgagggcttctccctcaaggaccacccgctgactcgcttctccacgggcgagaagtcggaccacgtgggcgacgactacttcctcacgtcgggcgacaagatccgcttcttcttcgaggaggacgcctttgacgacgcgggcaacctgaccaagcccaaggagcgcgccgtcaacaaaatcggacacggcctgcacgtgcactcgccgccgtttgcgcggctcattgacgaggcgtcgacgcgggccgcgggcgaagtgagtcctgcggctgtggctcgtgatctcgggttcaaggatgcgcggtgtctgcagagcatggtgatttgcaagcagcccgagatcgggggcgcggtgccgccgcaccaggactcgacgtttttgtacacgagc

SEQ ID NO: 567 - DNA, 484 bp, Trichoderma harzianum
actgcttcgattccgcgctcgcctgttcatctctctacgaaaccgccccccaacacacgatcctacaagaggaaaagcggattgattaagacccgccaaagaagaggcgtcacgcaacatggcggaggagatcctggacaaagttcgggatgtggtggagggccaaattgactttgagggccagagacgagcagaaggccttgccactctgttacttgccctgacaggactcatcgcattcaacgtcggatacgtactacaagacatcgtcaaatgcctatatgttggactaggaggaacggtcttgacatttctcattatcattccgccgtggcccttctataacaagaacccggtcaagtggctgcctatcggatctgcatttaacacgggcgggacatgacgactggataacgccgctctgagtaggccccggcgttttgtcacgttgtcaaaatcagcatgtagcttaaatcttttcgag

SEQ ID NO: 568 - DNA, 531 bp, Trichoderma harzianum
aaagaccaagatcaggacaagacaattcgagagtgccaaaaacagcaaaagggcagagagacgtcatcatggctcaggccaagttcgccgtttatcccagcctcgtcgaccgcaccgtcgtcatcacaggtggtgcgcagggtatcgccgccgacatggtcgagcagttttccctgcagggttctcaagtcatatttttcgacgtcgaggacgagcttgccgctgatttagtccgaaaagtgtctgatcagggcgtcaaacacaagcccatatactaccactgcgatgtcatcaagatcgacgaggagctcaaacccacagcggccaagatcctgaaagaccatcccaagatcgacggactcataaacagtgccgcgagggcaatggtgaagccctcgcaggatatcacgactgagtggtgggatgagagcgtccccgtgaacctgcggcatcagttcttcctgacccaggccttgctgccggggcttctccttgctgctggaaacgcttcggtgattaacatggggagca

SEQ ID NO: 569 - DNA, 302 bp, Trichoderma harzianum
gttcgatgcactgccaccatcctcggagaaaggtgtgtgtagtggacaatgtatgtgtgtcattgaagaaagtaggagtaggtggcggctccttggcaaagtggcaatgttgcttggtattatggatcggtgggttgtgcccagctggaatggcttgtcttggcgatagggggaatatggagtcgttttgatgggaacggcctttttggtttaccgaggaggggtcaacatgtgcgagcatgtatgttcaaagatgggagagggagagaagaagagagaaaaatcaagaatcagtcgtgcct

SEQ ID NO: 570 - DNA, 595 bp, Trichoderma harzianum
tcaacataatgtcggcatacggcggataccaaaagactagctacggcgcccagggcggcgatgactctggtggcttctttgccggagggggttcacagcaaggcagccaaggtggtggtggtggcaagtcataccaagacgaatcattacggcccttgaccatcaagcaaatcctcgaagctgaggaaccgtactctggtgcagacttcaaagtggacggcgctcccatcactcaaatcacattcgtcggccaggttcgcagcataaatccacaacagacgaatctgacgatcaaggtcgacgacggcacagggcaaattgacgtcaagaagtggatcgacgcggacaaacaaggcgatgcagagcccggctttgagattgattcacacatccgcgtctggggtcgtctcaagtcattttccaacaagcgacacgttggagcccacgtcattcgaccagtaacggattttaacgaggtcaactaccacctactcgaggcgacatacgtacatttgttctacactcgtggcgccagcggtaactccggtgcaggaccaaacaacagtgatagcatgtttgttgatggcggcgatgg

SEQ ID NO: 571 - DNA, 357 bp, Trichoderma harzianum
agagcatcttcctgacatgccggggttgatgcaacgctttgactgtatggaaacatccgtattgctgacatacatgtcttccatgttgtcttacactgcactcaggaggagcagtcatccaccgagttgattcacatggcagcaaaattgtgctggatctactgcagcgcagatcctctatttgggcatttcttctcggagacagacacagatcggctcggcgaacccgagagcaagtgatagcaagacaagcacagatatgcttggcgaggctgtcctcaccaggaaacgaaagaggaggtttcaccagcaactccattcccagcagaggtcagcctgtcctacctgtcacattag

SEQ ID NO: 572 - DNA, 553 bp, Trichoderma harzianum
gcgggaggtcgcaagtccaaggccgccgcaccggctcgtccccaaaagaccctcgtcgtcgacaatggcgcctggacgctcaaggccggcctcgtctgcggcggctcgattccagagcctcgcgtgatccccaactgcatcgcgcgcgaccgctccaagaagatttacgtgggctccgagctcgaaaagtgccgggactttagtgagattcagttccggcggcccgtggaaaagggctacctggtcaactgggaggcgcagaaggagatttgggaccaggagctgtttggcgacaaggcagaggtgaaatgcgaccccagcgagacgagactgatgctcacggagcagccgaacacgctgcctgtgctgcagaccaactgcgatcagattgtctttgaggaatacggcttctcgagctactacagagggatcggatcaacattcaatgcctatcacgacctgcagagcctcttccgcacgccaaaagacgtcctcacagccgcaaacacgccagctgaaatcatgctggtcgtcgactccggcttctcgcaca

SEQ ID NO: 573 - DNA, 596 bp, Trichoderma harzianum
agattgtgagaaatacgaagatattagtggatttctcgtaccaggaacgaggacagacattggtgtgttgatgaaaatagaaacttgaaccggcgaaaccttgaacggtgagtacgagatatggaagacgaatagcagcgtatgagtcaagttgcagcactagacttcttggttaggcccttttctcttcccattttcccgccatgagcgtggatagatgcatctacatggtgataggcgagccgaaatcgaatcatttctcacgtctccaaaggcccagccctacgttacagccggccatcgctaagcagatcgcctactcggtgctaaattctgacttctcaggcagcacgagatgccgtccagtcgctgcttgttcacgggcacaagggggggatctctcccttgatgcctacttgtatacgagaagagagacgacggacattagccgcatgcaagattacgaacgggtcatctcgccaagagaaagcttgtgttgtatgttaccgcttctttggaattaatcgctatcgaaaggaacagggcctagaacttagtagcttcccatcgaaattctcgtgctattgtttccttga

SEQ ID NO: 574 - DNA, 463 bp, Trichoderma harzianum
ggctggctggcctgagacgatctggcagaccaacaacgagacaagggctttgccggcggttagaccccagtgatgagattcgcaaacaggcgcgcccgctgggagacggcccccagctgattgattgatacctggtagtacatgggcagttggagtactcgtatggacaaagtaccgtaccggtactcggggcttgtaagacggctctctggaggggaatacgagctggcaaaacattaaaaggcaaggctcagggcgggctgtaagccgcagcgcagtggctctttttaagttgtcggggagatagatggccacagccgttctggggaccacgacggcaaaaggaattgagagaaaatagtctaaaagtatgtcctcttccgtcaagcacaaagtcgatggacgccgtcaccccaaagaatctgggtgttgctgcaacgggatcatccccaaggctggattc

SEQ ID NO: 575 - DNA, 596 bp, Trichoderma harzianum
tcctgcacaaattcatagccgtacgccttcaggcgcgaagcatggcgtctacaagcaggacttacaatgatgcgattgacaagctcaatgagctgcagacgccgttcgcggtgattgaggcccgtcgcaaggccgggattctgcctgattctgtgcttggcatcgccaagatgagggcgtatctcacaagaatcggatacacacccgcggatcttgatcgcctcaacattgttcatgtcgcgggcacaaaaggaaaaggcagcacctgcgcctttgtcgattccatcttctctcagtaccaacagcaccatggtggccctcgtaagacgggactcttcacatcacctcacctcatggccgtgcgtgaacgcatccgtatcgattccaagcccatatccgaggagctgttcgcaaagtactttttcgaggtatgggaccgactcgaggaatcgcgagaggctcccgaagaggacacgccttttggatcaaagcccgtgtatgctcgctatcttacgctcgtgagctggcacgcattcttgcaggagggcgtcgaggtggcagtgtacgaaaccggaataggcggcgagtacgactca

SEQ ID NO: 576 - DNA, 595 bp, Trichoderma harzianum
aaacgatgacgaaaagagagcttgtgctcgagaataaccaacaagatgtatccagcccagagaagaggtggaagaaggatattgataatgtgcagactcctttgcggaagctgaagcctgatgactatactgtcgggtggatctgtgctatcacagtcgaatacgttgctgcgcaagagtttcttgatgaagaacatgaggggccgaaaaatgtatcgcttcatgacaacaacaattacacgttaggcagcattggggagcacaacgtcgtcatcgccaccttgccccttggggagtatgggatagcgtcagcagcaactgttgctagggacatgatgcactcgtttcccaatgtcagaattggtctaatggtcggcattggcggcggcgctccgagcgaacaacatgacatccgtcttggtgacattgtagtcagcgctccaaagaacggtaacggtggcctgctccagtacgacttgggcaaaaatattcaggaccaggaattcttagctacgggatttttgaatcaaccacccgttgtcctgcgggcagcactggcagggctccaggctcaatacgagagaaaaggccatcg

SEQ ID NO: 577 - DNA, 177 bp, Trichoderma harzianum
aatgtcaatggaattgaatgattgcgtcctggtactacgactaggacttgtacatcaatgtatgccggcggctgacaatcaaggttctcacagcggccggttacccgtcagcatctgcccgtcaaaaagggagttgataagattcgttgggtcgaatagtagatcgttgatatggct

SEQ ID NO: 578 - DNA, 446 bp, Trichoderma harzianum
agccagaatgccgctgcaaaggccagggcggacagcagcatgagccgcagccgccggcgcaacagactatgggggagcaacatatggcttatggtcacaaatcaaatgacctgcgacgcgcgggcatacgtctaggttcgtaaagacgctgtaactccgagcacagcaaactggcgatagtacggtccaggctcacaagcacgtgggctcaatcgagttagtcccttcgcgggggggaatcccgacaacttgcagcacagcacgcaagcacgagatacgagacaatttagacgactgtctgtctctgacaggatgacacgcacaaacagtagctctgttctgttctggaacaaaccggcgaggctcagagggtgcttcgaccaaggcaaggcagagcacaagccatgagccagagcccagagagaacaaggccaaaatccaacacg

SEQ ID NO: 579 - DNA, 282 bp, Trichoderma harzianum
tgatgatgaatagaatgatggaccaagggaatggttggtaagatgttctgggaggaatctgtgtttttctcagggtgagagtgtataaatgtgtagcgtgtacatgtgttgaggctcgtcgatacccggcaacatgatgactgtgcgccaccggccattgatttgtgctgatctctgcttgatgaacactgccctgtttacactgtcgtgtactgttagtatgtccatcgtgaaatggtggtgtgcgatgtttgtcgcgggctatgaagataaagcaatgag

SEQ ID NO: 580 - DNA, 332 bp, Trichoderma harzianum
aggtgcttgttgtctgtttctgtctagaggtattggatgtaaataagatcagcacgagatgagatgagatgagcagacagacgatcagatggcgagattgagaggcaaattgcaagtgaatttaaattgcttcgctggcgcctaaattggaagcatccatggctcgccttttgcctccccacgtgtggaaagtagagccgagagcgatccctagcggctattctattctggcggtttggagtcaatctggccccccggagattgagatggtggctgtcgaggtgccggatgggatgggatgggcttgtctttggatacttcatcttttcatc

SEQ ID NO: 581 - DNA, 598 bp, Trichoderma harzianum
gggcgatacgtcgagatgattcgtccgcagcttcagtccgtgagatgctggtgctatcagatgctagcagatgttatcccaagttacccgatgctacagaccatccacgctgcagatcaacggccgcttcgtgatgcaagtctcacgcaaactttaccctctttcagttcttacgagatgcaagggattgatccactggagtcagagaatctgaaccgcgaccgcgaccgcgacggctacgcgcaaagtttgggccagtgactgacgcggccgttgtttgtcatcaagagtcacagagttcaatggccctcaggacagcggcatttgctgaatacgaagcgctgtgctcatggcatggggcaatgttcctgcagtagcgcgtgatatgcaaaacctctgtgcgtgcagcttgcatgatgctaggatgcaagagccactgcggttcactgggctgagcccccagactcctgacatggcttacaatacaatatggatgctgtgctcgtaagcaaaaggcttctccagtaggtaccttgctgcccgtttggaaaagcgccgagagcccatgagatatcgcaacaccgggcgattagtcgtt

SEQ ID NO: 582 - DNA, 509 bp, Trichoderma harzianum
  misc_feature (495)..(495): The residue at this position can be any nucleotide.
  misc_feature (497)..(497): The residue at this position can be any nucleotide.
gggatcatcgtacatgatactattggcgacttggatttctaagagggtgtccaggcagggctcatttgtaagccgagccgatttgggatgacatgttgcagtgcatatgcatttgacagcgaggttagtaagtttctgttcaagtttagggcgtgtactatttgatgttgtgagatgtgaatttgatttccaagcactgcgacctgggcctcctgcgcgatcagaggtctctatgaggagatgagctattgattgcactcagcgctagatgtttgatgaaccctcaggacacagcattggaagtattattgatcagagaaaggctctgggctattcactccagagttgcgagaactatgattcacgttgacatacgtgtcgggcctgcaagaccgctggagcagccaacgtaaactgcagcatttcatccaacgaagaagagtcatattttgtagtaagagtagccaatgatggcccatctatcaagtacttgcnanaaaaaaaaaaaa

SEQ ID NO: 583 - DNA, 601 bp, Trichoderma harzianum
agcccatcatctgcttcagatattcattattggcgcatctgtcgagcaccaaaatggctcccccgattcacttcatcaccggcaatgcgaataagctgagagaagtcaaagcgatcctcgagccgcaaattgagattgacagccagtcgctggatctcgaggaaatccagggaacgattgaagaggttgccgagtcaaaatgtcgtcgagctgccgacttggtaaacggcccggtgctggttgaagacacggcgctctgttttaatgctctcggaggcctacctgggccttacatcaaatggttcctggataagactggccaccaagggctcaacaaccttcttgcggcatacgaagataaatctgcagaagcagtttgtacatttgcatactcaccaggacctggccgcgacccaatcatcttccaaggacggacgccgggtcgcattgtacctgcgcgaggcccttcgaagtttggctgggacccggtatttgagtttgaagggaaaacgtatgccgagatggagtctgcggagaagaacaagatatcgcatcgtgctcgagctctgaagaagctgcagacatggtttgagagccaaca

SEQ ID NO: 584 - DNA, 177 bp, Trichoderma harzianum
agagacgactacgtttgggtcacatgtgctctggagtttggtacctagttatttgaatggacgacaacgtggaggaggaagctcaggtaatgagtgggattggcttacagtatgttgaataggatgtccgttagaatgcggaatgcaagtagttttcaatgcatcttgatttaagcc

SEQ ID NO: 585 - DNA, 555 bp, Trichoderma harzianum
gacgctcaacgcaaaaatgtcggatctcagcaacaagaagagaaagcgagacggggaaaaggccggttctgcgaagaaaaaggtcgttattgacgcaccggcttcaattgcaaccgtctcctctgttctccggccgaaatcatgccctcctgtgattgcaaacactccaggaatggaaatgccctcgaatctggtctttaactcatatattcccaagaatgcctcttcaaagtccaaaaaggcagccgacaaggcactcctgctgcactccacgacgcaccggaatctggactatacggcaagagaagaagagtcgcgcgactcaaagccgctcctgaaccacttcatcggcatctacgatcccaagactggcaaattgcaagttgtcgaagcgaaaaagatggtcgtacgaggcgccgtccgctctaagcaagtgccgacttctgcagatcagacggaagccaagaacagcatcatggaccagaggacagaccttggacagacttttggaacgaagaaggccaagaaggttatccaacataaggtgttgaacgc

SEQ ID NO: 586 - DNA, 389 bp, Trichoderma harzianum
gcgcgccaaaagactgtacacagacgtcttttgatatattttcaaaatgggtggcggtggaaaaatcccttaccccaagcacgtctggtcgccttctggtggttggtacgcccagcctgccaactggcgcgccaacacgctcatcgccggagccgccatgttcggcgtcatcgctattacgtggaagttcagcgccgacagggaacgatgggcgcataagccggagccgtgggagtggcatcctagccgatactggtcaaagcagttgatcgagtgggacaaggaggacaacctgaaggcagcaagcaacagcaaggagtagagtcttctttttgggagaaggataatacacgaaattgtacaaattctatacgaacaaaaggcaaaca

SEQ ID NO: 587 - DNA, 538 bp, Trichoderma harzianum
gcacagacaaatctcacacaatgtctaccgccgagctcgcatcttcctacgcggccctgatccttgccgacgatggcattgagatcaccgtgagttgctttccaaaatcctcgctctgagtctccctttgtcgccggggcgcagagttcgaaaattctgtgccccgcgaaaaggacgacatggaggaaaaaaaaccgtgggagagtgttttgtgtgctaagcgacaattttcacaaccgtataggccgacaagctccagaccctgatcgccgccgccaaggtcgaggttgagcccatctggacatcaatcttcgccaaggtacgaatttccgaaagacacccgcccatgacggaataggctctacgaagtcgaatttccaatagccgagagaaatgagaattggtcgctgacgagttatggttttttcccgacacacaggctcttgagggcaaggacattaaggacctcctggtcaacgtcggctccggtggtggtgccgccgctgcccctggcgctgccgccgctgctggcggtgcc

SEQ ID NO: 588 - DNA, 581 bp, Trichoderma harzianum
cgacctgtaactgggtacgtgcctacatgtatatccggcatgccctcatgtaggtgacatctaaaccatgttcatgcggagcatctcgacggcgcctatctgctcctatgaacggccaaccctatacacatcgtactctgtacacagtacatgtacgcaactacagtaaaacgacatggtagtatcccgtggtggccatccatgggctactctctgtatgctttataggcccggaataggatcccgcggagccggaaaccgtggggatggaaggctgtgcaaagactacatgtatagtttacggctcagaattgttggccggaagcttgttgtcgttacgggagagagaccgatgtgacaagctcccctcgagtcaagacctcttcatttcatattcaccaacgctggataaggtactgtaaatgaactcaggtgtgctctcaggttcacatttacaggaatcatgccctccacactctcggggcatttacacggcccgaagagaatgaagaaggagtgtgtgctctcctatctggataacggggtttcattgtgggcatcttatgcccgcatggatagca

SEQ ID NO: 589 - DNA, 199 bp, Trichoderma harzianum
tggctggggggagaagaaaagccagaagatgcgatggggccgtgagtttgagtgtgagtattgcggcgttgtccaggtacaacgggggggacgaaatgcgaaaagcgcacaagacaaggtaaaggaaacggctaaaagaacagacagggcgtgaggataggaaaaggaaacaaaaacgaagagattcccagtattaaat

SEQ ID NO: 590 - DNA, 285 bp, Trichoderma harzianum
acgcggtggtgattggaggtgcggatttcacgctttctgatgatactggcagcaattacatttgcgcggctggcgtcctttgcaaggatgcccggaatgcggttgtctttactgtgagctacaacagcgggaagggatatgcgttcaacgtcaagggcacgcaacaagtatctgtctattggcgggcgtggatcgtccagttatgtttccttgacgggggggctgggatactggcaggcttataccgtgagtcattgaatgtctgggaatatatagcatggctag

SEQ ID NO: 591 - DNA, 125 bp, Trichoderma harzianum
aatgaacccaaagaccattgaagtggcctcaatattgatctatcaagtttcacctactctcgaacgtttattctcgaggtaatagcttttggagtcttcatcatgtccaccaaggtggtcatagt

SEQ ID NO: 592 - DNA, 284 bp, Trichoderma harzianum
agcagaacggctgtatttgtatgtatccatcattggatggcgttttctggagcgagtgcgaagcatgcgtactcgtatgtgtatgtctatgtatggactaatgtgcgtgggggttcatggaatcgccatgagtgctttcatgattctgcaatgccgttttgcgtcagtaatgtggagggaagatgtacgactatggatcatgtatatcgcaagtttgatttgtcggaacagcgtatcatcagggagaagatagaattagcattgcacaattcaattgcaaaacc

SEQ ID NO: 593 - DNA, 598 bp, Trichoderma harzianum
attggcctcgacgacggaactgaacagcgacgcttctcgctgcgaggcgccttatcttttggcgcgagactgagattggagtccgattctggccggtgccccgcgagaggcgcatccaatttccagccggaggagcgcgttgacatttgctcgatccttatcttctttttgctgcttgggcggcagtcaatcacatcgacacggcaccaagtttccctgctggccgttgtgtttgatccggtctttgctcgattggcatgactctggacggcgtatcgacaatctaaaccaattcgatttccccctccgacacccaaaaaaaagcacccctgattacgaagtccctgctatcacagatctggcctctatactgccactgccacatctccacaccacattcgatacgaagcctctgtcatcgtcagccacggcctgacctgattcctttttgcccgaccgatttacacgtcgatatttggcttgctgttgctgttcctgccgcataggcaggctggttgctcgtcgccatggacttgttcaggcgatcaaaatcgggtgcgggacgccattcagaacttccgacgtcggatgagaagcg

SEQ ID NO: 594 - DNA, 674 bp, Trichoderma harzianum
ttcctgaggccgcatctcattcagcttttaccccaccatctcacagcccatcatctatctcatccaacctctcaccacaacagcacctacatctacaagagagaacacttccctcttgaaaaagtaaacctaaataaacacatcaaatcaaaatcctccatcatggccgacaaagaccgcatcacctgccacgtcctcgacaccaccgccggccgccccgcaaagggcatccgcgtccgcctcgaaggccccgtccccagctctcccaacgcccacactgccgtcaacaccttcgagtccctcaccaacgacgacggccgcatcaccgtctggctgccctactcctcagagtcctcggccggcgaggtgcccgtctacactctcgaggacgtcctgggcgctatcaaggggccttcccggtggacgctgcgtttcgacactgccggctactttggcgaggaaaaaacattcttcccagaagccaccattgtgtttcgtgttgaagagggccagcattaccatgtgccgctgctgttgagtccgtacagctacaccacttaccggggaagctaaaggggggcatgggaggacaacgcggcttcacagccacagtcgtttcagtttcagagtcagagtcagagtcagtattcagagatacatatgacaacaatgat

SEQ ID NO: 595 - DNA, 229 bp, Trichoderma harzianum
agtattccaaggatagaaggcttccatagggggctcggagcgtacgagccgtcgaatgttgggtcttttaggagaatgccgagagaggggggttgaggtaaggtgaggagctgacgcggatccgaagctgcggctggggatgtggagagccggaaaggcgggatatgcactcgcacggagaatatgatggatcccaaggggcggtgcccgtgtcgacgaggtttatagg

SEQ ID NO: 596 - DNA, 683 bp, Trichoderma harzianum
gaataagcaatcacgagtaacatcctgtttcacagcaaaaaattgagaaaattcaagatgccacctgaaagattgatcgagaccaaagctcagaaagcctgccgccactgccgtctccataagcggagatgtgacaagcgtttaccgaaatgctcgcgatgctccttaaaactcctcagatgcgaatatgatgacgacgcgccgattgaggagacaggaccagataccaagctgctgtggagcgagcacctggccatcaagcgagactcttgcggcctcgaattgactccagcaggcgagaagcagctcctatggatcgcttgccagactcaagagcagcattccgatcaagctgacaccaagtcattaatgagtctggtcagcgacatcttcaagtatggcgacacctccgcggagcaagtctcgaataggtactttgccacagcccatcactggatacccattgtagacgaaccaaggttcaagttcactcttggagtcaatcgaagctatacggaactctaccacgattccttcgcattactactgttgtgcatgctcctgatgaatcaacaaccctgtcaccaccctaatcacacccccaacagcgcgctctatcggaccacaaggcggctattctctctcctcaacacgggctacattgacacatatcccctcgcaag

SEQ ID NO: 597 - DNA, 536 bp, Trichoderma harzianum
aacctcataacaaccacaatggctgcacaagaaggacgagctccatatccgccattcacacttgagacagctcaagtcaaagtcaaggccgctcaagatgcttggaacaccagaaacccagatggtgtcaaaatggcatacaccccagactcaatctggcgcaatcgcggcacatttctacaaggccgcgacgagatcaaggcgttcttaaccgacaaatggagcaaagaagacggctaccgacttcgcaaggagctttttgcttttacagacaacaagattgccgtgcagttctggtacgagtggcatgatgaggcaggccagtggtggcgcacgtacgggcttgaggactggacttttgccgagaatgggctgatgaggaaacgtcagatgagtggaaatgacgtgaagattagcgatgcggagagatggttcaaggatggcgttgatgtgaacaccgtcgacatttccgagaagcactggtgagggaggctatttactaaactttaatgaagtcttttgaatatatagataag

SEQ ID NO: 598 - DNA, 203 bp, Trichoderma harzianum
ggatggatacttgcagtaatatggggtaagtgagtgagtgagtgagtgatatggatacagcgggatgatgatgatggtggtggtggtggtgttgtcactgatgttgtcgagtgagttgtttgttttgtttacctttggaattgattgaaatgaaatgaaatgaaacagcccaatgcacagcctaagtccaaagaaaacaaacc

SEQ ID NO: 599 - DNA, 625 bp, Trichoderma harzianum
gccacatttccatgattgccattggtggtgcgctcggcactggtctcatcattggtaccggaaaagccctcgctcaggctggtcccggctcgctgctcatctcgtattgtttcgttgggattctcgtctacggtgtcatggcttctttgggagaaatggctgcttggttgcctatgagtgctggatttacgggctatgcgacgcgatactgccacccttctctgggatttgctcttggttggacatattggttcaagtacatcattaccaccccgaatcagttgacagctgccgctttggtcatccagtattggtgtcctcgagacaaggtcaatccaggtgtcttcattgccattttcctagtcaccattcttgttgtgaactacctaggaattgaactgtttggcgaacttgagttctggctgtcctctttcaaagtcatcatcatcgttggtatcatcatcttctccttgtgcattgcctgcggtggcggtcccaacggcgatgcccctggattccgatactggcaccaccccggtgcctttgccgaactatattcaacgggctctttgggcaagttcctcggcttttggtctgtcatggtcaatgccacttttgcgtacct

SEQ ID NO: 600 - DNA, 384 bp, Trichoderma harzianum
acacaaccgaaatggagaacgaccgtggcgacatcgtggacctctacgtcccgcgcaagtgcagcgctaccaaccgcatcatcaaggccaaggaccacggctctgtccagatctccattgccaaggtcgacgagaacggccgcgctgtccccggcgagaaccacgtctacgccctctgcggcttcatccgcgccatgggcgagtccgatgactccctgaaccgattggcccagcgtgacggcctcgtcaagagcgtctggagcgctcagcgataaattttgcaaaacaaaaatttggaagagggacaagctcgggtatgaaggcaggcgtggaaactagagttggctgcatgtagcaattccaattcaaggcgttttggctccg

SEQ ID NO: 601 - DNA, 283 bp, Trichoderma harzianum
gtttgttagcctttgtgatgcaatagcatgttgtaagattgtttgtgtaagtgaagtctatagcaatgcctggaatgtgatggaacataggaatacaggatggatgacagagttggtgatggatatgtacacttaccctcgctgatacggcacgtcgtcaacggtctggtattcttgtggctggacgatagacattgttgcggttttcgaacggtttgttatgtgcttcaatggtttcttggctttgtaagttgtcacacgatccaaataacccaaaatcacc

SEQ ID NO: 602 - DNA, 668 bp, Trichoderma harzianum
attgagtccctaggccagaaccgcgcgagtatacatctatctgcaacatctcttacctccatcttcgcaatggcttctgataagatggaccgcggcctcgacgaaatcattgcagacaagcgcagcaatggatctcgaacccgacgcggtggcgaccgccgtcgtgaccgtcaagactatccccgtgatggggtgaaaaagtctctccgcaacgaacctcgaaacttggatagcgaatgggtacatgatcgatacgaagagaacacgtatcgcaatagaggccctgcaccgcgtcgcaggcgcgagtctcccagcgggggagatgcccgcggcgcacgactccgagtcgaaaatatccactacgatctcaccgaggaggatctcgatgaacttttccgaagaattggccccatcacaaaattgcaactgcgttatgatcggtctggacggtccgaaggtgtagctttcgtaacgtatgagagcaaagacgatgccgcagaggctgtgagacaattcgatggtgccaatgcgaacggccagccaattcgtttgtccgtcatgtcaagtgggccttctcgaaacccgtttgatactgctgtgatgccaggcaagcctttgtccgaacgcatttctgctcctggtggcagatctcgatcactctcccctcg

SEQ ID NO: 603 - DNA, 630 bp, Trichoderma harzianum
agcagcgactcttcgtcttcgtctccaaccaccacaatgtctggctacaccgtccgcaaggttgctgcccagaacactctggagcaccgcgtctacatcgagaaggatggcgtccccgtgtcgcccttccacgacattcctctctttgccaaccaggagcagaccatcctgaacatggttgtcgagattcctcgatggaccaatggcaagctcgagatctccaaggaggagctccttaaccccatcaagcaggacgtcaagaagggcaagcttcgcttcgtccgcaactgcttcccccacaagggctacctctggaactacggtgccttcccccagacctgggaagaccccaacaccgtccaccccgagaccaaggccaagggtgacaacgaccctctcgatgtctgcgagatcggtgagcttgttggctaccccggccagatcaagcaggtcaaggtcctcggtgtcatggcccttctcgacgaagaggagactgactggaaggtcattgtcattgacgtcaacgacccccttgctcctaagttgaacgacgttgaggacgtcgagcgccacctgcctggcctgctccgtgccaccaacgagtggttccgtatctacaagatccccgac

SEQ ID NO: 604 - DNA, 373 bp, Trichoderma harzianum
atcatatccgtaatgggggactcattcgatttccacggctaatgttttgcacggcgcataatggcaacggcggaaaaagggctgggttcgaaaaacagaaaaaaaggccgcaaactcctacttactctactcctactgcttgaccctgtattccaacccacttcatacatccatctacgcacttaagtaccttgggctatctgcatgtacgttctgtcctggacgacttcatctacgtttggttatgtttttggctgttcattagatttagctattttatacggcgttgtttacataccacaatacatatgtatagcctatcctgtataacaaggcaaaaaatgcaagagaatagacaaaaactacgcttctc

SEQ ID NO: 605 - DNA, 639 bp, Trichoderma harzianum
aacgagcagcacggcaacgtcccatacagttgcccagcatgtcgctcgtcacgggagagaagacgaactttcagttcattctccgtcttctgaacaccaacgtcgatggaaagcagaaggttatgtacgccttgaccaagatcaagggtgtcggtcgccgatactccaacttggtctgcaagaaggccgatgtcgacctgaacaagcgcgccggtgagcttacctccgaagagctcgagcgtatcgtcaccatcatccaaaaccctacccagtacaagatccccgcctggttcttgaacagacaacgcgatattgttgacggcaaggactctcacatcctggccaacggtgtcgactccaagctccgtgaggatctggagcgcctcaagaagatccgtgcccaccgtggtctccgacactactggggtctccgtgtccgtggtcagcacaccaagactaccggtcgtcgtggccgaactgtcggtgtctccaagaagaagggtggctaatggttttactgttttcggtctggggtggacaggcgtgacggctgggtttttcatcactgtgatgagcatttccatgggactgctttctggcatacgcagctggagctgtactctagatcagagtcaaatg

SEQ ID NO: 606 - DNA, 625 bp, Trichoderma harzianum
tggatggggtccggactggtctcactggattttcttcttcttctttggctgtcctccggttctttcgggctcgggctctggcggtcttcgcggcaaagggagataagagcccacgtgcgaatttacgaaagccctagcgctgatcgggtttaaagcaagtgacgtgatgaatccgagttcatttgcataaaaaaaaaacataaaaataatagagccagagatttgccgaccagggcagggggcgcaaccatcttcatcgtccatcttcgagtgtgtgccacccggagcagcaaagacggtgcctcggccaagagtcaaatgtcaaaagatggagatgcaatatcacggaagccgagctccacttgatgctcgggcggcaagtattacacaatggcaagagatccggggtaaacaccgcagtcccggccgatcctcgaggcctattggatgagcgttccggcacccaaagggatttttcggaaccgatggtcggggattcccacccccagcttgctttctcccatgtgtctgtgggccagaaccagaatgcggggagtagatacatagatctagaattgccttgagatctcctgatatttgaagaataggaaattttttaaccttt

SEQ ID NO: 607 - DNA, 386 bp, Trichoderma harzianum
gaagcatatcgggctgaaacccccacaacgggaagacgggacgatacgaggcaatgaggcaattcagcggccggtagctgtcgggatgttttttccccggggaatttcgcggtggctgacacttggcgtctcgggaaatgatttgacggatggatgcctaagaaatgatccgactgatcaggtacggcttatcggctgttaatgacgcagcataaacaagttgcatgtgtatcctaagagcatgctcgccagatgtagatggacagagggcacaaggattggaagaatacattgccaatagtggttcatatagggagtaactacatgtatcttacgcttgagcgcctgcttttaagtagctatgtagtacagatggaggaagcacc

SEQ ID NO: 608 - DNA, 293 bp, Trichoderma harzianum
aaaccggcaaagaaataccctgcagtcctcgagactcgcgatagagcagaagtacatcagtcttatttactagcgagcaagacagtcaaaatgtcgtgggcgggtacggagcttgcggatgccccgctgagagagagggagaggggctgacgggattctaggattcaagaagaatgtgaaccgcgcgacgacgcaggtgatgatgaagacgggtgagcagcgttggtattcattcggttgggatagcattctgatcttgtggttgcagggcatgtggaaaagacaaacgatcg

SEQ ID NO: 609 - DNA, 679 bp, Trichoderma harzianum
gacgctatcgagggctgacctgcatcgtcgtcagtcggcagacgagcggattaacaacattctcgagacggctctgcaacgagcagaaacgatggatcccgcctctctaagccttctccagaaaggctcttcccacaattcctctcccaactatggagcctccggaacggtgacaagagggatattgcaagactatcaggcggtaccgaccagcgatgaaagcgatgccacccgtccgagaaaggtttcatacagcgatgcggcgaagaaggccgggaaccatgcgaagagccagagctctctgcggcaacgaaacggagtctccggctcggaggatacaagatcgccaacaaaagcaaagtcatcatggacgaaggaaacatttcgaaaatttcagtcccttcagttggaaaacaagggaagcgtggctagagatcacctggctctcgaacgcacatttctagcatggcttcgaacctctctcgcttttgcatcgattggcgtcgccgtgacgcagctattccgcctcaacactgataacgcttccgcctccgatttcgaccacacaaggctacaaaagatgggccgcccgttgggtgcgacattcctcgccattagtattgtgaccttgctcctcggttgcagacgatatttccatgcccaggaatggatccttcag

SEQ ID NO: 610 - DNA, 439 bp, Trichoderma harzianum
atagaagcatttgaagcctcctcctccaggttgcagcaaaagcacaggaagcagcgagatggaaggcaagagccggcgaccggagataaccgtcgtgccggcggcaggcggcggcgccgccgccgccgttgatgcggtgaaggcggcgaacaaggagcccatcagcccgggctcgccgtccctggcgagcggcgccggcaaggagagcctgagccgccatgaggccgccgtcgtgtccctgcccgcgtggaagctcgacgcgctctgccaggagtccggctcgtcgccggcggtgatgagggcgcgcttcccctacttctgaatttctgaatttctgatgaagccatgagctttttgccatcttcgtacgtgtgtgtgtgtgtgtgtgtgtgattgtaactgtgttgttcatggctgagtaaagaattatacttcctac

SEQ ID NO: 611 - DNA, 650 bp, Trichoderma harzianum
taattctatttcactcttctgcagacgaggacggacccgattgaccatgttgcgacaatccttcagagcctttgcccgcacggctgttgcgagaccggccgcggcgagaagctacgctaccttcaactgggaggatcccctcaatgcgaacaacctctttaccgaggaagagcaggccattgcagaaaccgcagagcgatactgccaggaacgactacagcctagggtcttgcaggcctaccgagacgaacactatgaccccaagatcctcgaagagatgggcgagctgggcctgcttggctccagcatcaagggctacggatgcgctggcgtttcttcggtggccggcggcctgattacacgagcggtcgagcgagtcgatagcggctaccggtctggcatgtcggtgcagtcgtccctcgtcatgggcggcatccacgagttcggcaccgaggagcagaaggagagattcctccccgagatggccaggggcaagctcattggcgcctttggtctgacggagcccaatcacggcagcgacccgggcagcatggagagcgtcgcgaagccgcatccgaccaagaagggatactactcactgagcggagccaagacgtggatcaccaacagcccaattgccgacgtgctgt

SEQ ID NO: 612 - DNA, 341 bp, Trichoderma harzianum
tctcgcctcaaaattcatgcgcctcaaagaatggaagaaaacacaggcgaatgacgtgaaacgaaagataaaaagacaggcgccttcatgcgagggtttcgccagtcgcctctagcgtgtttcgaagcgcagggttgaaacgcggctgcatgatgcccggccgcccatctgaggcatggcggctaccggaacaggacgacatccgaagacttgaggaggctccgtgtttgttcgtttcgtttcgtctttcgagtgaagggttggttcttgttttcggctgttgtgtgttttggttgacttgtgtttacgggttgggggtgagttgaattgagtgcgagact

SEQ ID NO: 613 - DNA, 572 bp, Trichoderma harzianum
gggaaaatcaggagagatgaagtggtatagagaaaggaaaaagaaggaaaagcaaggaaaaacccaagccagagccgataaagaggtggaaacgcacgacagcacgcagagaccagacgatcgttgggtctaggattcaatgggctgacatgccacgcgccaaattttctgcttgttcctttcgcctctgacacacacacgcactgacaaagctgactggctgtgggcaactccctaggccgcctcgctctcggtcgtatggcaccgagaaaagggaccagactgatagcggcggggcctcgataaacgccgcagcaagggtctaccgtcaagagccggaagttgttggctcgcagctagttgcccggttggtggatccgataatgcgaagagagtctttgggacctgcgatcagattgcgcaatactagggggtggcaagagatttgtttgttggtgggatgttgttggaggagggaggacgaaggaggaagagaagagaagagaagagaagagaagagaagaagagaaacaagagatgaagaaagaagaagaagtggaaactaagagaga

SEQ ID NO: 614 - DNA, 384 bp, Trichoderma harzianum
gcgagggagaaacgggtatgggctgggggggccgcactagattctttgacgtgtcttgtacggaattccagcgcggtggaagggtgtggctgctgcacgttttcgggggccaggttctttacactattcccacggacaaggttcccaagtgaggctgatggagggtccgcgggccttttggggggggagggtccaatcgagtgttgtttgtgtgttcaccaagttcaagtacatgggtatgcgtatatttcggccatgtatgcgcgatggattcctgctgttcggcagcgagcatgagaaaaaagggaaaatagactgcgagagagagagcgacaaaaagaaggaaatgctccgatcacgattaggggcggaattggaaatccg

SEQ ID NO: 615 - DNA, 628 bp, Trichoderma harzianum
gcattttggggtcgcaaatctacagcaaaaatggcctcgacaacgaccaagcagaccccggcgtcctttgtcgggaccagcaaggtcgtcgagactgactatccgctcatcgacaacgaccctcactttaagcgggttatcggatatgcgagaacgtcagactacgtagctggtgcaacctctgcggcctttgcaccgactgctctctatgccctcgagaggctcgccccgtcgcatgttggccggggaggctttgccaaagccatgcggttagccggattcattggcttggccggcggtttcctctacttttaccagcgatcagcccttcgattctacggcgccactgagaactcaagggaagtcgagatggatatgcgagagatggtttccaaggtcaaggcgggacagcctctgtatggcgagagcaagctgagccctcacctgcagggagttgcggcccgacagagcagatactctgcgctctttttcagcacagtaccgtggttcaactttgtcaaccacaaccagcacggcgtggacacggccaagtactatcagcaggccgagagggaactggaagcagagcgggcggcgggcaagagctagacgggaccaaatgtgtata

SEQ ID NO: 616 - DNA, 186 bp, Trichoderma harzianum
tcaatgccgcctccatgaacgactcgagcgtcgtccaagcccaacagcgcgtcgctgaccgacgagcggcccgcgaggtcgaacaacgggcccgaatcgcggatcagcgcgaatcgtctcgcgtgaacaagcagctgcagcgtctgtcatatcccctcaatcggctcggcggtgtctgggatgcag

SEQ ID NO: 617 - DNA, 348 bp, Trichoderma harzianum
gtttttgctggatggctcggtggttagcaaaacggcacggcgcggcacacggctgaatggcatgtccgcatcttcggctgttcgggagctgcgtcaccagaacaaggttggcccgatgtctggatgtcgctgctgatgggctgagaagtgctgatgtgttccattgcgtgcctgtaagctgtctatcagtcacacaatcaagtcatcctatatggctcgtaatgctgaggtttgatctcgttcgcgggtttcgggccgggggggagctgttttattgtacgagtagcagcacgttaattaaggtggtgccagatcgacgagctgggaccgagtacgggtacatggagg

SEQ ID NO: 618 - DNA, 511 bp, Trichoderma harzianum
aaccgcaaccatgtcgaccctccccaggactctgggcaacctgcgcaagattggcatcaaggaatacttccgccagatgctgtacatcggtgacaccaagtacggtactctcatcggccaggatcgcttcggcaacaaatactacgagaacctcgaggaactgcccctccgaacccgctgggtcgactacgccaagcacgactacgatgcctcccacatcgagcccggctggcacgcctggatcagctactccgtcgacaagcccccgacccaggacagcctcatcgccacgggcaccagacactttgagcccgcccttcccaagcccaactttaccggaacgcgaggcgcttacaagccgtataacacagtgaaatcgaagcttaatgcttgggagccggtggccaaggatcgggtatgagtggtttttacgttttcttttttaaaccgtgggaaaatatggtgtacatattgaaatcgcgcaacaaacgcaaacaaatcaaacaataga

SEQ ID NO: 619 - DNA, 366 bp, Trichoderma harzianum
ggaggatcaggtgcgatgtgaggctgatttggggtgtatgattcgtgagcgtgtaagaggaggcagcccacgactttctctctgtgtctgtgcttgctcacttgctcgcctccttggattcggcctgttgatccgaatcagaagtaaatgtgtttgagactgagacttggtctggtcgagacgatatgagatgtggcatggaattagaaacacgtgtttggtatggcgattgcgatgcgatgatccgcagaaagcaagatctcagggcgactaacacggatatacggaggttcgaccaagacacgaggaatgatggggaaagtctcagtatgtcactacggaatttatgattacgtagcaatgtat

SEQ ID NO: 620 - DNA, 287 bp, Trichoderma harzianum
ggccagttcaattcttcgagggagggcgctgggagccgtgcgccaggcccgttgcttcagctctactccaaggcaatatgccgctgatgtcaagagcgtcggtgttctcggcgccggccagatgggtctgggtatcgctcttgttgctgcgcaaaaggcgcaagttccggttactctcgtcgatgcttctgaccaggcattgagtaaaggcattgcttttgccgagaagctgctggccaaggacgtgtccaagtctagaattactcaggaacaggctgatcaagccc

SEQ ID NO: 621 - DNA, 468 bp, Trichoderma harzianum
aggcatataagtacttaggagcgagtgaaagttgtttcttacgcatttcacatggcaattcatttcatcctagtcagacactgaagtcgtttcttcatcttatcagaatcacaattgcgaaattgcagattgagagaatattcatgaatataaatatcacattatgaattccactacagacgattcgtaagaaggtcaaaactaatgaaaacgataactcacttcagcgactcttccgtattcgcgatttgataagggtacgtgttaattcctctatagactacctgatgctttttcgaaattggccaatgcaacaaattctagtacaacttcaatcaaggtgttaatatagactacgtaggttaaccctggctggagacatgaagcggcattcaactgttcgacttgatcaatgaacaactgcccatcttggaatcataagagcaatcaaagctccatcatcatccc

SEQ ID NO: 622 - DNA, 617 bp, Trichoderma harzianum
agtatctcaaagatgggcaccaagatggatttccaacactttgcgccgcaaatcgacaagatccccaaagttacaccgaggcaaatcgcttctactgctctttggaatactgtccgcgacaacttctccatctcgacgtggatggccattggagccaccctccagggtctcttagttttgttcgctcgacctacattcgcgattgcaccggcaacgctcatcttgctttaccgattctcccacacgatgctcatgcactacggctttattcgcaacacgcagatggaagatgtcatcatgggaaagtataccgtgcaaattcccgacaaggacggtaaaccgccaagtgagccgtcggggacaggcatggctgtcatcatgctgggcttcagaaacaattccgccctcggtatgtttggagcaggcgggctggagacctccctcaagtttcaagcgatgttgaaggatctcgagaatgatccggactccggctttcttggcatgtgtgggtataaagctgccaatgagcgaccgacggccaacggtttcatgtcggtgctttatttccgtagtgttgaggatatcaatcgattcgctcacgccccgcttcatcgtga

SEQ ID NO: 623 - DNA, 536 bp, Trichoderma harzianum
agaaggaaaaggacgtcgattcgtacaccgtcgaagaactagctgccggtaagatcgccggcctcgtctcccagcgcctgcacgagcagtacaaggtcggcgacaaggtccagctcagccctccccacggcgagttcaccttcagcgccgccaacacgcccgtgaccgcccccatcgtgctgctgtctgctggtgttggtgttactcccctgttgtccatcctcgacaccatcctcgacaactcgtcccagggtgctcgccccgtgacttggatccacggagctcgacactctggagccgtgacatacggcaagcacatccgcgaggccgacgccaagcacagcaacctgtccaccaagatcttcatcaagaacgtcagcgaggccgacgtcaagggccagcagtacgactacgccggccgcattagcctggacaccctcgaggctgagggcgtgctgcctgtgagcgatgcctctgccgagtactacatctgtggtcctgaggagtggatgatccagacccgagcggagctgctc

SEQ ID NO: 624 - DNA, 480 bp, Trichoderma harzianum
agaagatgaagccggcgttactgcaacggcagtttggtaagatcaagtatgctaatacggtgtttagggtgtgatagtagaggcatccggcgaggcggctgagacatatgagggcgaaacaggagtagaggagacagtggcagcagcagcagcgttaatggcaataacaatagatggcagagaacggccgggccctcggattccctcttgagagcgaaggcgaaggtgaaggttcagctgatggataaaaccgggagacagccgagcgacgcagaggatgtcaggcgtaggttgcgtgagggtggctgcagaggccgagagcaggttcaatcaatgggcgagagacggctaatcgagcagagcgtgacgaggagcgcggcaatggcgagtgcgtgaaggggtgttgattcaagactgcgcgcgtgagggtgtgggagagatgaggcagaggccagaggcagctcaaaagggttcaaagtt

SEQ ID NO: 625 - DNA, 575 bp, Trichoderma harzianum
aatataccttggtatcccaaaagttgaaaagatgtcgtcgccccctctagccgccaccaagaccccagactccccacaagatagcagcatagaagaagcagaatgcacctctgtcagacagtctgcctccactgcttctattcataagtggagtgatgagaatattgaagatagaggaatgtatcgattactgtcttcaccaaatagagactgccatgacgagatcagaatttcgacacgtcctgcaactccatctaaggcactaatgtgccttatactttcaatacataaaaataggattttggatccaggagactgctatgacgacattaaatcgataggtgctttaactccatctatggcaccttatattttcctaacaaaagaaaacctcgtgtcttcaatccttcgagatcgttttttgcgtcgaggcgagcctgataatttaacctgtacccaaatactgaaatgctagaggagcctgctaacagctcacataagcaagaaggtggcctcgacatctggaaatgctgaagagcttaggacgcgtcgacactgggatgccaaaaatgcga

SEQ ID NO: 626 - DNA, 575 bp, Trichoderma harzianum
gattcctcctttcttcccctccatactatttatcctgcctcttcctcgtcttccatctgttgccggtgtgactcttgcaattcattccctgcccggcttcctcgcttgattgaatagccgttgctacttccaactgcaaatcattatagctatacctccctagcttcatataagctcggctcttctaggaacgcgcaagcaaacatcctcggcagtgacccacgagccttgtctggagattttaaataggaaagctcatcaacggcacctgagcagcgtccaattgctctgttcagctcaattaagctttcaagatgcctagagacggcagtaaacaaccgccctcagcggcgacaaacctcatcgctggtggtggcgccggtatgatggaagccctcgcctgccaccctctagacacaatcaaagtgcgaatgcagctctctcgccgtgcacgaatgcccggcgccccccgccgcggcttcatcaagactggtgtagaggttgtgaaaaaggaaactcctctcgctctatacaagggcctcggcgccgtcttgacgggcattgtccctaaaatg

SEQ ID NO: 627 - DNA, 567 bp, Trichoderma harzianum
aagtttcagcattagcattacaccagtaaccctccagggcagctagcgaagagagcaggcccagttccgggtgacaggtcgggcaacgccgcgacggctgcgattccgagcgaacggcgctggcgttccagacggcacagcagcaagcacagcaacagcacagcacagctacgaacatcgaggatcccgctccaggaaccggtgctatccagaacaaggccccggcgctaggacccgcggttggcagtggtggatcgcaaggctccagtcatgccatgcaagcgagggaaaaacgcttgcatgctcatgctttgctctggctctagatgagtctgaatctcatccatcctcgacctgctgctgtgtctccccgtcccgcacgaggcttcggtcggcgagagccgggatcgaggcgttgggggatggcgtctgtgagccagacatgacctgtcactgccgtgggtatcagcaaggcgcaatggcgaattgcaggtgggcagcgagaaaaattcgaagggatagccttttaccagcgctgcgtcgatgatgaaaatgggctgatttctt

SEQ ID NO: 628 - DNA, 442 bp, Trichoderma harzianum
accgaaccgccagcgaatcgacgagggcatctgtgtcggtaccggatgctgcctttgcggatggagcgtcttcatcgagacggcaggtagaaggaaagacatggccttgtttgtggcgccgcgggcactggcaacgttggtccctcggcggtatcccctggagaagcagtggcgagagaagttgatattcgcagcgagcacggcagtcgtgtttacttgcgcccttgagaatccaaagagagttagaggcgtactaggggggattttgggcatggtgttgaagaaataaaccgggcatatgggcaaatatgatctcttttagggagttctgagacgtgacatgactaatttcttcttcttctttggatgtctttggaataagctacggtttttagatgatatacacaaacaaccctgatgctataattggtaataaatacca

SEQ ID NO: 629 - DNA, 577 bp, Trichoderma harzianum
gcgcctcaagcacagtcccgttgcctgacacccaaaagtccattcctctctctgttcgccttgccgctccacgactctccgtccgtccgtctgtgctctgcggatccaaccaagcaccggcccaagcaccggcatcagcgcgagattcagctccagctccatccagccccagccagctcgctctagcctagcctcacttgcctggctgccagcatgtcctcggcgtctcagcggcggcgacgagatgaagacgactatattccatttggacccccatcactccccagcacacagacgcacctcgacaacatgtcgtcggaacttggctggccaccgccggtgaccatgtccgactcgagcgacgaggaatttcgagaccaccggacgaatgcgcgacgcatttcgcgccgaaaccacatgccgcatggcattgacggactgatgaacaatggccgatactcgcccgacgtgtattcagtcacctccgatcctccaagccagacgcccatgctcgacgccggcatgcaatctcaatacgccggcatacactcgcaatactacgccacgagaacgccca

SEQ ID NO: 630 - DNA, 270 bp, Trichoderma harzianum
atttcttggcaagggtacaacacccaaaacacgcggcgatctgaggccatcgtccgcgccaaagatccctgcctccagaaactctttccaccccctgttgtctttgtcgcctggttacggatacagtatttgctcctccgagtcagtttcgcgggaccctaaatgctgatgggctccgtatcagcgcgactccctcatcgtatcgtagctagtattcgtgttgtccttagccgttcccctttgcaacgaattgcgtgtaagccggcgctt

SEQ ID NO: 631 - DNA, 110 bp, Trichoderma harzianum
aatcgcgctgatggccctgacgaatctcccggggctttgccatggcggatgactatctgctgcaaaatgttcacaccctcaccgacttggagctggccgtgctgctgtgt

SEQ ID NO: 632 - DNA, 637 bp, Trichoderma harzianum
ggaacgtcaagtgcgaaacgcactggtgtcgcctgacgaagcaggacaagagtcaatcaattccaaaccagccgatagatctcgaactctgttcaagaccaataccaagatggaaacgaaaataggagaagagcctatacgacataccgattttgccatgacagatgctcagggagggcgaggcccgctgcagcaaccagccaccacggcacgcaccggcttggcgatgggacgcaggttacaaaaattagctcgcccaaaacgctcggcaagtcatgaacagcagtacataggtgacgagctccgtggccaaactactaggcccagatcatcttacgacccgttggtctcaacagaatatagtctaagacgtccaaagcaacatgcgacacacaactcgactgcagaacctacggtaaatactgtcattaagcctactttacggcgacgaggatccgactctagtgagagcagtttcgtacgtagtaggtccatcggcagtcctcgaagtggatttaggtcatcgatgcgaagcagctctttcgatccgaggccatcatcatctggtaataagggtagaaacaggttgactctacgctcgttatcacccacaacgtcacatcagaggcaccattct

SEQ ID NO: 633 - DNA, 264 bp, Trichoderma harzianum
atggcgctagaaagtcggcacatcgagcctcgggcattgtcagtccattctcgccatggcgaatcctctaatcccaacacagcacacaaatctgcctctatgagcgcatccgtcgaccaggaagcggctcagagggatgaggcacaggcttccaccgtccatgtgcgggctatggtagcagccgtgcagcagcagaagacgcggcgccgcagaggatcactcaggaaagttgcgctgctgggaacaggcgcccaccgtgacagg

SEQ ID NO: 634 - DNA, 532 bp, Trichoderma harzianum
gctcatcctattttgccttccctcctcccaactccttccgaaatctcggcatcgtgaactccgggctccaatggctaccagaacgggttcgaccggcgtggccacctatgccgactgcgtcgattcgctgcgcaactctctcaaattcctcgaggcctccgtggagaccattgaccgtggcgtatctgacttccctcgcctcgtgaacgtcctcaagacagtccgacactacgaactcattccccagcccacactcgctgctgctgaggcttccctgcgcgacgaaattgggccctacatcgcttttctcctcagccgcgctgatgctcaagttgaacgccaggaacgccgcattgagacgctcaaagcccgggctgagttacaacagggacggttaactaggcctgatgaaccggcacgcagcgtatcaaggcctgcttctgcaaggagccggcagctccgaggcgaggacaagctgagagctcggattgtgcgccagcgtaaggaagctctacgttatggcattgagagg

SEQ ID NO: 635 - DNA, 600 bp, Trichoderma harzianum
attattcaaaatgaagttcacaaccatcgtcaccgctgctgtctcttcagccattgccgtctccggcactcccatccacaagcgcgagatcggcggcgtatgtcttctccctctcctctcccttgcatcttctccattcctatcactcgtctgattcaatatcatctctaactattggtcaatccctcacaggtcctcttgtgcaccggcgtcaatgcaaccggcacctgcagctacaacgtctacgaactcaagacgtgccaccagcttcccgcgcctttccaccaaaacaccagcacgtttgcccccgacggcgaagactttgagtgcttccctcgtattggcgactgcggttctatttgcaccagcccgacgggatgtacctttggcagcgtcgactttaactacaagaacaagttcaatctgggggctattaagtgtaacaccttgatttccagctttgactgttcgctgaagacgacgacgacttcaactgagtaaaaaggaaaaaagacaaaattatgttttacaaagtgttggaggatcgcatcttgttttgtttaatgtacgacttataccaacgatgaggatccatctcat

SEQ ID NO: 636 - DNA, 579 bp, Trichoderma harzianum
atatttgaacaatgagcgatgagacagggcaccgaataggcacaacacgtgcgtcagcacactctgcgaacatcagtggatctagttttggggacaacacccgaatacaacaagcatttctaaacatcttcttcagaaaccggagaaatccaacggtgtcccccgaaaacaccccgtcccctgcagtgcaagctcaattacaagagaaagagagaacagactgtcgacgctctctcagcttccgcgatcttgacgcccgcctgcagaatatctcaccagtacaacaaggcacttgcgaatggatttttcaaatgccggtgtttcagaactggtatgagcatactgaatgtgataatggattgctttgggtcaaaggaagccctggtactgggaagtcgacattgatgaagcatgttttacaatactgcgaaaccaaaggaaaatatgctatcgcggcatacttctttaacgctcgaggggccgaacttgagcaaacacctctgggtatgctgcgctccttactatttcaactactccggcatgaacctcgtttatatgaccagcttcttccaatttatc

SEQ ID NO: 637 - DNA, 302 bp, Trichoderma harzianum
gtcccgccgaaaggggcgacaatttgggttgtgaggcggcagacggtgattggggcgatttgggcagctctgccaagggttgggttcatgaagatacagtacgtgttagtgatgtgaagctgctccatgatgggactcggaatggcggacggatgcggtcatgggcttttggagattggcttttcttggtgggccgagacggcatctaactggagatttgatgaaggggaattccagctatcaatacggatatgcaggactggatgattctgatttgatggcccgaggtgaaacttgtctgg

SEQ ID NO: 638 - DNA, 116 bp, Trichoderma harzianum
ggctgacagatgctctatgacggagaggcgaagctgggtcgaagcagacgggcaaagcgatttgaaatggtgaacaggggagaatttgctcgctggccaagggggaagaaatgatg

SEQ ID NO: 639 - DNA, 323 bp, Trichoderma harzianum
ggagcgagattcaccacgggacaccgagtaggaaagggtgatgacggtgttgcggagactgagggtggtattctctcgcccgagtatcacaggagaattcccgcggatggactgtcggtgtagacagagggcatctgggatcaaatcgtgaacaacaaggacctgcatctgccgacgcaacacgagcttctatcccagttccgatgtgacgagatctctccagaagtcctgattgcctttgacctacttctgaccccacttgaggagcagcaggcccaaccctctaagctcggcaaggccaatgtgctccccgatctgggcac

SEQ ID NO: 640 - DNA, 416 bp, Trichoderma harzianum
acgcgtcgggcggatagttgtgctatcgttgtcttcatgttttcatgtttgcacatagatacgagaagagttgtgggagttggttgcgtcatgacataagttgtaattatagtatttgctgattatagctgattacgcagggtgtgtttcctagttgtgtggatggatgtgtgttgatctggccccctgcatatttcggagtaaatcatcctcccgatggctatagtcgagaggttaatgggctctactcgagttctgtcgtgtaacagcatccataaagacagtcataaagaagttcttgagtcatttctgattctccctgtcaacatcatgattcatccaactgaggaaccataatgagcttgtataaacactcactaacctcattctagagcatccttaagagggtctctaag

SEQ ID NO: 641 - DNA, 659 bp, Trichoderma harzianum
gagagacttgcgcttcggcccggcatttgcacattttgagaaccgaaacgaagaagaaaaaggataaaaaaaacatggcttctaatcagtttgattcccaggcctcgaccaactacaaggaggcttttgccctgttcgacaagcgcggcaacggtcgctgtgccgtcgactcgctgggcgacctgctgcgagcatgcggccagaaccccacgctggctgagatccaggaactggagaagggccttggaggcgaatttgatttcgaggccttccagcccatcctgaaccgacccggcggattccgcgaccctggcgagcccgaagaatactgccgtggcttccaagtgtttgataaagacatgacgggctttatcggcgtcggccagctcaagtacatcttgaccaacctgggcgagaagatgacggaggaggaggtcgacgagctgctcaaggccgtggacaccagctctggccagatcaactacacagatcttgtccgaactatcctcgccaactaagattccccttgtacgaagaacctaacccccggtggtatctaagtgcatctgcgaacgggatggcgttgctatgtgtttgttttgattatggcagtgaaattgggcacgcttgggattgatgaatttttcttttgtacggga

SEQ ID NO: 642 - DNA, 608 bp, Trichoderma harzianum
acatatatacccatcatgactatgtggggtggattcacgcgatagcagactatttgctgtcctgggtgaaactcgagcaaaatgcggaaattgggtggcgttcgttcaatcgaaagaccggaaagttagagcgcgaacaacagacactgtggaagaagctcaagcttctcgtcttatttaacccactcatggaatggattgataggagtcaactcatgcgtttatacatgcatgaagagtcaattgcagaagggcgaagagaaagaacaacgagttccaggaggcgcatcaaggctttcgttgacgcctatggaataaacatgcatgatttcgagccctctgatatcagtcgctatcctacctttgaagatttcttcactcgttcactcaaaacagagtcgcgtcccatttgtaaatgttgacgacccttcccatgccgtcgtggtggctgactcgagagtcgtcgtcttcaattccattggggaagcaaaagcgttgtggatcaaaggcaagaactttagcctcaatgatctagtcatgagcaatgaagtaggtgataagtttagagacgctgccattgcgagctttcggctttcaccgcaggacta

SEQ ID NO: 643 - DNA, 188 bp, Trichoderma harzianum
gtgtgaattcgcgagcgaatgaaactcgtcgcatgctttggatcctgcttccgacaagctcccacgacttggcttggataaacctctaacctccattttggaatcgagtgtcctccatggctcgagaataagtcacatattcaatcaacagtatacatagttgtaatcgatacaccaatttctactgg

SEQ ID NO: 644 - DNA, 520 bp, Trichoderma harzianum
gccctcatatattgaaggcatcgccaacccgatcacaaaccttcttgtccagacttgcaaaccactcaatcgattccttgataccccttgggacaactctacttgttctctccaaacttacccctccaaataccatcatcaccatcaccatgaccaacgacgtctctaccaacggctcttctgccgctcctgcgaccacctttgccctcaaggctggtctcgcccagatgctcaagggcggcgtcatcatggacgtcaccaacgccgagcaggcccgcatcgccgaagaagctggtgcctgcgccgtcatggccctcgagcgagttcccgccgatatccgcaaggacggcggcgtcgcccgcatgtccgacccggctatgatcaaggagatccaggacgccgtcaccatccccgtcatggcaaaggcccgtatcggccacttcgtcgagtgccagatcctcgaggctcttggtgtcgactacattgacgagtccgaggtcctgacgcccgccgacgacga

SEQ ID NO: 645 - DNA, 561 bp, Trichoderma harzianum
agcaattcaccatgttgagcttcctcggaaaatcggtagccttgctggctgcgctgcaggctactctcagctctgcaagccccctagccacagaagagcgctctgttgagaagagagccaacggatacgcaaactccgtctatttcaccaactggggcatttacgaccgcaacttccagcctgccgatttggtggcatcagatgtcactcatgtcatctactcattcatgaacctccaggcagacggcacagttgtctctggcgatacctacgctgatttcgagaagcactatgccgatgattcttggaatgatgtcggcaccaatgcctacggctgtgtcaagcagctgttcaaggtcaaaaaggccaaccgaggcctcaaggttctgctctccatcggtggctggacctggtccaccaacttcccctctgcagcaagcacggatgccaaccgaaagaactttgcgaagactgccattaccttcatgaaggattggggtttcgatggcattgacgtcgattgggagtaccctgcagacgccacccaggcctccaacatgg

SEQ ID NO: 646 - DNA, 112 bp, Trichoderma harzianum
acgagaaaaaggaacaagccgcgggttctcaaagtcttccggtgccgccggccgtttggctgcggaccgaaagtgtggacaggaatcaactcgtgatgagatccgggaaatg

SEQ ID NO: 647 - DNA, 477 bp, Trichoderma harzianum
gatgctccaccattgcttgccttatcgcattcaaggccaggtaacgacacttgctgctgagtcgaacgcaacaccgccttcaacagctcctctgcaagtctcccgcaaaaggacaggctcagtcttgtgtgggcagcatgcgcgtcattgcccttttctcggccctgtgtgccgcagctctggtccaggccgatttccacacggcgcaaatctatgtgcagcccgtcgaaaactccgagtcgcccagcctcctcgccgaagtggcatacgatcctagcatcagcgggtcgtcctctatcatctcctacgaagctcctgaaatcccggagtctacacagctggtccgcgtcgggttgtacgacgtcaagtctgcgcgatggatatctggcacaactgttgcctcggtggacaactttggcaacggctactcgcccaatttgatactctcagtcgatgaaaagggagagcttctcagtg

SEQ ID NO: 648 - DNA, 308 bp, Trichoderma harzianum
tgcaggaacctgcgcggcaaggtgacaaggaacatacattgctttcgacacaaccgacccggccagcctcgtcaagaagatgaagagcctgggcgtcaacattggcacatgcggcacccagacggtgcgactccgtcccatgctcatctttgaggaagctcacattcctttcttgatttccgcattggacaaggctcttggatccgcatagattgcaaagttgaaaacattttgggaagcataggggcgttgtttaatcaagagaaagcgatatttcattttacttggacttttgtagtatatattgg

SEQ ID NO: 649 - DNA, 454 bp, Trichoderma harzianum
atcttctacacgattgcggacaaagtctatcgcggtttctactgctgttcaatcattcttcaacattattagcacaatcgccatgccgtatatgctaaatagcgaccaggccaactggggaggtaaggcgggctttttgttcggagggttcagtttcttctgcaccatctggtgtcatttcaggctacctgaaagccagggaaggacatttgaggagcttgatattctgttccagagaagagtgccactgaggcagttcaagacgtatgacctcttgcaagaggttgaaggagaaaagactacgacggcataatacctaataaaggaaagaaattaatgcttctaccactcgttcgccgcgaagtcggttccatagtatgtgaataattatttaatagggttacacctttaataaaaaataattctcgtttgctggaaaaaaaaaaacacaaac

SEQ ID NO: 650 - DNA, 590 bp, Trichoderma harzianum
caattgcagtttagagacatcttagaaatcagaatgtttgccagatcagttttccgtgcggcccagccgctgaagatgcatgcgcgccgctatgccaccgagtctggtgccaagggcagctcaaacactctcctgtatggcgctggcgctgttggtgtagctggtgccgccgcctacttcctcagcggctccaattgctgagagcaaggtcaaggaggtcgttggcgctgctcccaaggcggcgtttaccggtggtgaccagggctggctgtccttgaaggtctcagaggtcgaggatgtgaaccacaacaccaagagagttcgattcgagctgccggagaaggaccaagtttctggcctgcacattgccagcgctgtcctcaccaagttcaaggcccccgatgccgagaaggcaactctccgtccttatactcccgtcagtgatgaggatgaccgaggcttcatcgatctattggtcaagaagtaccccgatggacctatgagcacccacatccacgggctcaaggttggcgaggagcttgccatcaaagggccctctccccaagtacccctggtctgagaacaagcac

SEQ ID NO: 651 - DNA, 422 bp, Trichoderma harzianum
gaccattaccatcatacagccaacctctacataagcacaaataccattcaaaatgtcttacggcggtgacaacaacgacaactctcgccgtaatgacgacaactttggctccggaggagattctttcggctctggtggaaaccagcaatatggctccggaggagactcatttggctctgggggagattcatacggctctggtggaaatcaattcggctccggcaaccgccgtaacgatgacagctcatttggtaccagtggccagggcgagttcggctctggaggtaactatggcagctctggcggtgactcctatgggtctggaggaaacacctatggctccggcggcaatgacaactttggctctgggggcaatgatacgtacggctcgtcccgtaaccaagagtcttcttttggatcca

SEQ ID NO: 652 - DNA, 655 bp, Trichoderma harzianum
gacacaattcctcgctgcgtgtgactcgtgtctccagcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacgacttacccaaacctcctcctactggcaatactggtggccagataccagtcgctgcttaaagccatcgctatatttgagcttccctgggcgaatacttgatctattcggcagacacatcgagatactacactaattaggcccgcatagcgtacacagtgcctcaacggccgttctgaagaggcttctcagattgatccgtctaacatcggatgtattgatagacgcggacgagaagacgacgatgtaccagcgacagaccaaagtcatcccaagcatccaagctactgatgcaaaaatatgcgtgccttgggagtaccactctccgaggcaaaaattcagtcacttaaagagacaggcttcgggaatgccatgaagaattcaggctcacgtgggggacatttgatg

SEQ ID NO: 653 - DNA, 659 bp, Trichoderma harzianum
attgtggccatgaccgtcctcaacaccgcacaagccctctgggcccgcctcgtagcaacccacgatccccataccatagacttcgtcggcaccctcatcatccaattcatcttctggtggatcccctgcatcctctttgtctctctcgactctatcgcgccctccttctccgcgaaacacaagatccagcccgcccccaaacaaccctccgccaacgacatcctccactccgtcctcgtctgcatccgcaaccaagtcatcgtcttcgccctccacgccgtcctcctctatgcctcctctgccaagggccagtcccccagcatcagagtcgacgcgagcttccccacggtccaggagttcacctaccacctcgccgtcagcgtgctcgcccgcgaagtcctcttctacacctcccaccgcatcttccactggcggcccttgtacaggcgcttccacaagacgcaccacaagttcaccgcccccgtggccttctcctcgcagtacgcccatcccgtggagcatctcatggcaaacgtcctgccaatcttgcttccgccgctgctgctggggtctcatatcctgaccatgtgggtttttgtggcctttcagctcatcgagacatcaacggtgcacagcggatacgacttctttgcgggagc

SEQ ID NO: 654 - DNA, 233 bp, Trichoderma harzianum
gactcgacatatcgcactgagactcccccatcgctgacgcaagatggcttctcatgcggcagcaaaggctgctggagtgcgttgtttccattgcaaagaaacaaacctccagtccaccggcttgtgggagaccttccgcaaggccttcgccctcgaccccaatcgctccaacggcgtccccctgaacccttacttccgaaacccgacgcccggagccttggaacccctcagct

SEQ ID NO: 655 - DNA, 657 bp, Trichoderma harzianum
cgtgaaacgagccactctcactctcaccctcattctcactcccactctcactctcacatgtttttcttacagaatctccaccagttcaaaggtctgatccttctggccactgcactgcgcagactccacccggtcagcgccagcgaccaagcaagtcgtgttggtggccgaggcgggagtaaggatgatgttgttgtcgcccgccttgaaggggaacagctgcgaagtcgcggttttgccacctgttgaggttcatcgttagcatttgatctcttgtgaaactaaaacggtacaaacgcgataactcgcatgcccttggatcgggtggatcgagcagatcaccgagatggggtggggggaaatgatgtcaatgacttacttccatcggcgcgtccaccgcaagaaaacatgatgacctggtcgttggcggctctgcggccatcaaagttgatgcagccgttggtgagcacgctgacaagcagcgcctcgccggcctgagcgtcgtcgtggactcccttggtgacaacgtcaaacttctggctcgcgtcttcgctgcaggtagccagtccaacggggatcaggttctcgcggaaatcaccggccgtggggttgacaaagaagcagcgtccatcggcggctcggatgttgacactctcc

SEQ ID NO: 656 - DNA, 269 bp, Trichoderma harzianum
taatgaacgaggaaaagctcggccacagtaatcatgaggacattgtgcctccagaatcctctactggagatgaattacagacaccatctacggattccaagggcaaacagaaggcaggcctggagttagcagcatctcaacttggggcctctacaaagctggtcgtcaatgccatcacaacgtttcgggaaatgccagctttggcatcagaatcaaagtcctctcatggttcaagtagcatgggctcgttttcatctatcgctggcgag

SEQ ID NO: 657 - DNA, 440 bp, Trichoderma harzianum
actcgaccacgcgtccgtcggatcggcctcttttcctctcttccctctctgctttccatctgcccagcagaccgagtttggcagcgcaatgttgcctctatcggtgcggcgcgcggtggccgctgctcctcagggggcaagtgggctgacttctctcgccgcgtcggctccaaagatcacagcctcgagcttcatcctgaatcgtcctcagcggcgctactcctcgtcgaaaccctcaagatccgatgagcccaacgatattgctgccggccagtcggtgccggcatctacctcgcgcggagagagcaaaggcagcaggaaacgaaagagcaaggatttcagccgaccgaaatgcggctttcaagaaactgcccagtgtccctagcactcaccacatgtttcaagaggccctgagcttatcgagcttcttctcactccac

SEQ ID NO: 658 - DNA, 658 bp, Trichoderma harzianum
cccacgcgtccgaagactacaaagcttttggtccagcaaccataaatccaactcattgtccctccaccacgaaatctagcaacctctcctcctcgccacacagcccgcaatgctcacaccagcttcttcaagaatactcgccagcggcgcccgccgtgccctttcgtcgcgcagcttccacgcttcggctcggcatctgaacgactctccccccctgcccgcgcggaagcccatgggcgccttcagaggaggtcttttcggcttcttgtttggcagcgtcctggccggcggtgccgtctacagctacgtcctgcaggagtacaaggcatccaacgagttgcttaccgaggatatctacactcttcaagcctccgtcacccgactgacaaaccacgtcaagatccttgaggagaagatccagcagaagagaaagtaaagcccgaaaagataaaaaacacaaatagcgcaatgtcattagggatggtatgataccagcgcttcaacgctggtggaaaatactgggcaaacgaacagcattatggcaatacttgtgtccttgtttgtaacaacctaacaaagcctcaattgtaaatcgtaccttaagtatctagcctctgaaatatctagcacaggaaacagcacaaaagcccatcatacg

SEQ ID NO: 659 - DNA, 379 bp, Trichoderma harzianum
gttttttttttttttttttttttttttttttttttttttttttttttaaatatgtgaatatgatcatgtatttaaataataacatggaaaataagagcagcaataaatgaacctcctacgtacatcctctccaatgcatcttacccaaccgattcactgcaaacatgggggtctcaatcaaatgcacacccacggaatcgggcgtccgttaacccatttgggcacaaactgcatgggatatcatcttatggagaatccttcggaagcatctagagcattcagggttctttgccggcagtgacatgcttacaaatttgtcattttcgggatgcatatccgtcacttatcaatgtaaacccggactagttctagatcgcga

SEQ ID NO: 660 - DNA, 670 bp, Trichoderma harzianum
tctcatcttctctccaatccccaatcctcaataacctacgccgtgtcagtcaagcagctgtacatcatcgcatatcgaccgacgacgaccttgtcctgccgtcttccatctccaattctcacccaccacttacaccatcacacatcacaatgcctgctcctcaggttaacggcgaggtcaccagccatgtcaattccgccttcctccagcacctcttctcctatcctctagttagcgacggcattcacactgtgaccaccaacgaatacgcacagcggcctatcaagctgggcgaatctgcctataaaacttttgccgcccctgttcttccctacttttccaagccctatggtattgtctctccctacgtccagagggccgactcctttggcgacaagaccctggaccgcattgacgagcgttttcccattgtcaagaagcccactggtgatctctacaacgagacccgtggtctgattctgttcccctaccagaagggactcgagggcaaggagcacgttttcaagatctatgcttccgagcttaagaagcttgagcaggagggcgtcgtggcccaggccaaggctgccgtttccaccgccttcgtcattagcaacgaaacgctggcctggctgagcagctgggtcgctgtcaagaaggccgacgcctc

SEQ ID NO: 661 - DNA, 495 bp, Trichoderma harzianum
  misc_feature (243)..(243): The residue at this position can be any nucleotide.
attctccgtgacatttgcgacgacgcacagcccagcgagccgcgtcaccgcctgaaacgctttgcctaagctattgtcttcatttcccacatagtggcgggaatcctgtggaaaggcgccactccaacagcggaagctgtgggtggctccagtaaaccggactccatcatgtcgcagcctcccggacagcctcgcctttcaccccagttctgcttctcctttggcacgcttcgctgcatttcnctgcgcgctgtctcgcatcatcaatagacgactccatcactcagaatctcaatgctctggtaacaccggctcggacgggcttcgacccgaactcaacttcaaaacgtgccccgcgatcctttgccgagccgatcggccctgaagcatgtcagtctttcaaagagaaagtcttgtttccgtcgtggaaggctagagccgaagtgctcagctattgcggcatcgttgccaccaggccggaccccgatgaccccg

SEQ ID NO: 662 - DNA, 647 bp, Trichoderma harzianum
gcggtcttcgatttcaccctaccgtcaacttgtccattctcaagtttcttggatttgagcagattttcaagaatgctctgaccggtttgtcaatgggtggaggaaaaggtggtgccgatttcgaccccaagggcaagtctgacaatgagatccgccgtttctgccaggcctttatgcgcgagctgtctcgtcacattggcgctgacaccgacgttcccgctggcgacattggtgtttctggccgcgagattggatacatgtttggagcctaccgccaggcgaggaacaagtttgagggtgtcctgaccggaaaggggctgagctgggctggcagtttgattcgacctgaggctaccggctacggcctcgtctactacgtcgagcacatgctccagcacgccggcaagggctctctcgccggcaagcgtgtcgccatctccggctccggaaatgtcgctcaatatgctgctcttaaatgtatcgagctcggcgccaccgtcgtctcgctgtccgattctaatggcgctctcgtggcccccgacagcggatccttcacgccggagcacatcaacgagatcgccgcgctcaaggcccagcgccggcccctgacggatttccagtacggcgacaagttcaagtactaccac

SEQ ID NO: 663 - DNA, 492 bp, Trichoderma harzianum
  misc_feature (123)..(123): The residue at this position can be any nucleotide.
  misc_feature (139)..(140): The residues at these positions can be any nucleotide.
cgcccataaccagcaatcatgttctgtctccgaagctggctcccgctcctcttcatcccgacaaacgcctcgcccgccttcatcctcctcttcttcatctgcacctacttcctcaaccgcccnctgcgtctactcgctnnccgtcctcctcctcatcctcttcctcacctcgtgcaactggtccgaccgctgcttcttcgacctcagcagcaactggttcctccctcgacctccttcgtccctccagctccccgtcgacgatcaagactcgcacgccctcgccctcgccttcaacgacaccctcgtcgacatggtcaattctacagccaaagccgctgcccgcgccgctgcggacggaggtcgctgtgctgcgcaacgagtggactggcttgggcgtcgagtggctgcgtaatttgctgggcaagcgggagtggaggatcgactgcatggacatttacatcaggttgtaaaacgaaggggaattacatacat

SEQ ID NO: 664 - DNA, 524 bp, Trichoderma harzianum
accaccactcagcaagcaactcatcaaaacagccactctcacttttctctcaaagtaaaacacttcaaaccgccaacatgcaggttacttctatgctcgctctcctctttaccgttgccactggcgctcttgcagctcccggccacggagctcctcctcctccccatgttcctccccctccccctcctcctcccaccaaccaaaacaccaacaccaacaacaattggcaatccaacagctgtggcaacggcgcttctccttactgctgcagtgctacagctgatggcctgggagagaactactggaagtgctctgatctcaatgatgtgtgcaacgacgtcattgtttgctgcaacaacaatagcaacaacaacaaccagcagggaaagcaaaacaacatcgacaccggcaaccagtcttgcagtgccttcggacaacagaaggtcatctacctctaagcttgcctgcagaagctcaaagtcggcaatggctctcttatttgcttgtatcttagtcttataagg

SEQ ID NO: 665 - DNA, 632 bp, Trichoderma harzianum
tacattagcagagtggttttagttttggaggagttttactttttattctctttcatattccaattctgtacttgtctcggaagccatatttacaactctcaacaccacaatggcgggcttcaagaaactactccagactctaactgggaaaaagagcgacgatgccactcaacccgaagagcagcaacgccaaactcctcagcccaaaccttggtccggcatcgacaacacccaaccagcaggctcgaaccccatccgcggcttctccaccgaatatctcggcgagcaaaagtccagcaacacggccgtccgccgggacctcggcttcgcgggccacatcggcggccagtggttcggcgtgtacggtgacacgctgtggtgcagtcccggggtgacggacccggatttggagccggatccggaagggttccacggcatggtgcggaactcggtggcggtgttgacggatgatccgctggtagttcggtttgtgcatttgaatggggatgagccggtggcgcatccgttgcagtttacgccgtttgaggagcggtggggggagacgaatttgtttgggtttggggggacgagtcttgtggaggttgatggctatggggagggtgttggggcgc

SEQ ID NO: 666 - DNA, 234 bp, Trichoderma harzianum
ggcaaaatgtccacaatggaggctccagttgagaagaagattgaaaagacagcaaagccttatggcatgcgcaaaaatggaatgcaatggcatgctccgaagaaggcgtttcgcccgaccaaaggcctctcatcgtatgagcagaggactaaggagcgagctgcaatggctcagatgaaggcaaaggaaaaggagatgaaggaggagaaggaggaagagcgccagcgtcggatt

SEQ ID NO: 667 - DNA, 241 bp, Trichoderma harzianum
gggatcacgaaactgaggatgtacgagtacagatatttgcatcatggatctgatattgggagaggagaggagatgcacgggccttgcttttttggggatgcaggcaggggaaaagccgtctgacaagtcattttcgcgtattgagatggacagagttctagatccattactagttgcaagcacggtctgacggcatgtcgtatggtgttactgcgtcttgtgtgaggccaagacaggacat

SEQ ID NO: 668 - DNA, 302 bp, Trichoderma harzianum
aacacctctcaaccatctacctctttattatctcattagttttctcatctctcaggacttgactgcttctacttcatattcataagtgagaaggaatagacgcaatggctgagtccgagaagcatgacctcgagaagcgcgagctcgaggacgtcggcgtcgatccgatccgcgactcggagagcaatgccaagcccatgacgcttcaagacagcgaagaggactttggcttcacgcctgaggagcagcgcaagattctgtggaaggtcgacagacgcttggtcgtcactgttggggccatg

SEQ ID NO: 669 - DNA, 606 bp, Trichoderma harzianum
agcggcaaaccgacgccatgaggtccaatggcgcttctgcactgctgaacgccttccaggggctgaagatttccgcatgcaccccgttgcgacaactgagggccccgattcagcaccagtccaaggttctcggcgccgctctgctccagaatggcagagccttttccacaagcccggccatgatgggcacatggctcgagcctagcttgaaccgaaagaagaaaatggcaaagggacggccgcgagtagcgacgggagggtctacgaagggcacaacggtcatctggggcgactacggattgcgcatggttgatcaccaccgaagaatcagcgccaagtcactaaagatggctgaggatacgattaaagtgcgacttcgaggagagaaataccgactttacaagaggaagtgctgcaacgttggtgtctacgtcagcggtaacgagatgcgaatgggtaaaggaaaaggttctttcgaccactgggccacaagaatggcagtcagccaagtcctgttcgagatcaagggccgaatccacgagcagattgtccgagacgctttccggttggctggcaacaagctcccaggccagtgggaatttgtga

SEQ ID NO: 670 - DNA, 564 bp, Trichoderma harzianum
ctcgcattcgcccatcatgtcggctagaatcccagctcttgtttcagcacacgtcagcgaggcggcgcgacagaagattgacattgtcgccaagtttgtcgaggaagaatgcatccccgccgatcccgtacttgaagcccaggttggcgaaggcgataaccgctgggagaaccacccgtccatcatcgaggagctcaaggacaaggcacgcaagctgggcttgtggaacatgttcctgcccaagggcttctacgccgagtctcccggctggaccaacctcgagtatgccctcatggcagagtggctgggccgctcgcgcagcgcctcggaggcgtgcaactgcgctgctcccgatacaggcaacatggaggtggtggccaagtacggcaatgccgcgcagaaggaggagtggttgaagcccctgatggagggcaagattcgctcggctttcctgatgactgagcccgaagtcgcgtcatcggatgccaccaacattcagctccagatcactcgcgacggcgaccactacgtcctcaatggctccaagtggtggtccagcggtgc

SEQ ID NO: 671 - DNA, 198 bp, Trichoderma harzianum
agaagtccaactaccaattcacccacaagatgctggaccaggagcccaagaagacgtccggtggtgaggtgcgcatcactgactccaagaacttcccaatctccaagaccgtggctgctgcccacgccgtcatcgagcccggcgcgatccgtgagatgcactggcaccccaacgccgacgagtggtccttcttcatca

SEQ ID NO: 672 - DNA, 600 bp, Trichoderma harzianum
ggagcgattggtctccgagaccaagaagctcactcagggcgtcccctgggaccactccaacttcatgggccccgtgattcacagaggcttccttcaagaagctctcgggtgccattgacgaggccaagagcgacaaggacctcgagctcgtctttggcggcacctacgactcgtccaagggctactttgtccagcccaccatctaccaggccatcagcccttcccacaagttcctctccaccgagttcttcggccccatcctcaccgtgcacgtctacgacgatgccgcgcccgatgcctttgccaaggtctgcgagctggtcgatggcacctccgagtatggcctcaccggatccgtctttgccaacgaccgcgaggccgtgcgctttgccgaggagaagctgcgcaacgcggcgggcaacttttacatcaactgcaagagcaccggtgctgttgtcggacagcagccgtttggtggtgccagggccagcggcacagacgacaaggccggtagtcccaacctgctgacgaggttcgtccacatccggtcaattaaggaggagtttgcggccacgacacaggtatcatatcctagcaacg

SEQ ID NO: 673 - DNA, 395 bp, Trichoderma harzianum
gggaagggtttcagggctcggcgcacatgtccacgactggctagtaggcaatgcgtcctgatcgcttcttcaatttagcattcggctgagccctcgcaccgtgatgaaaacaaaccagcaggcgggtcggagccgctttgttgactgaccagggaagcggccaagatgttctatacctagaaatgcgcggccctgaggtacaagtagcgttcgcgccaatgctagcagccattcctggatgggcggaggcgaaaacaaagaccagaggagttggctactgcacccatttcaggactaggtgacattaacgcgaagcacaagggttgctcgtatgggcaagttaggtatgtacgagtacaatatcaccaacaaaagttgtacttgtatgagcacac

SEQ ID NO: 674 - DNA, 561 bp, Trichoderma harzianum
acgcgtcgtcatggtcggctccgcctccgagcgcgacggcatcgccaagcacggcgccaagctcgtcaccgccgtcgcttgtgctgatgtccccaagttcaccgtcgtcgttggtggcagctacggcgcgggcaactacggcatgtgcggccgtgcgtacagcccgcgattcctgtggatgtggcccaacgcccgcgtcggcgtcatgggcggcgagcagctcgcctccgtcatggagacggtcggcaagtcggtcgacccggagctcaaggagcgcattgagaaggagagcgaggctacttactcctcggcccgtctttgggacgacggcatcatccctccccagcacactcgccagtatctcggtctcggcctgagagccgccatgggaggccgcaacgaggtcaaggccggagacaccaaattcggcgtcttccgaatgtaagcaaacaaagaaaagacaagagaaagaaacaagaaaaaatgtatcaaaaaaagatgtaaaaagtaatatatactacacactcatgtaaacatgcaaacaaccccgtgtctttttga

SEQ ID NO: 675 - DNA, 606 bp, Trichoderma harzianum
ccacgcgtccgccaggcaaggtgttcagtcgaaatccaacaagggccctccatcaccgacattggccaatgttgcgcgccactttgctgtggacagcggctcaacattgcttgccacggcggtaatcacagtcttgatattcggtggatggtgctctaacgtgtatgctttagaggccatcatcaacttcgatccgacaaacggaaccctcgtaactttcgttcaattcctattcgtctctataacgggctacgtagcgcaattcgatagatcacgcccgccgttcttcctgactcccaacgtcgtcccgcttagccgctggcttgtcaatatcctgttgttctttaccatcaacgtcttgaacaaccatgccttcagctatgacatatccgtaccggttcacatcattctacgatccggaggtagcataaccaccatggctgccggatacctttacggcaagacgtattcgcgcccccaaatatttgcagtgtttctgctgagtattggcgtcagcctcgctgctttggtcggattcaaaagacaagaaaccgagtgacggtatttctgaccctgtattcaaccctgggctcttgatcatctttg

SEQ ID NO: 676 - DNA, 617 bp, Trichoderma harzianum
acccaccattgagattctatcgcccaccgagcctacaacacacagcacaagtattatcgcccatcatgcctcagcctattcccgcagccagccgtctcaccgacctcttcagcttgaagggcaaggtcgttgtcgtcaccggagcttccgggccccgaggcatgggaattgaagctgcgcgtggttgcgccgagatgggcgccgacctcgccatcacatattcgtctcgcaaggagggtgcagagaaaaacgctgcagaactggagaaagagtacggcgtcaaggtcaaggtgtacaagatcaatgtgagcgagtacaaagacgtcgaaaagttcgtcgatcaagtggtttccgattttggcaagattgatgccttcattgccaacgccggtgcgacagcaaacagcggagttgttgatggcagttctgacgactgggatcatgttatccagatcgatctgagcggcaccgcgtattgcgcaaaggccgtcggcgctcacttcaagaagcagggtcgcggatcctttgtcataacagcttcaatgtctggccatgtcgcaaactaccctcaggaacagacctcatacaacgttgccaaggctggctgcatacatctg

SEQ ID NO: 677 - DNA, 576 bp, Trichoderma harzianum
ggcttctcacgggtagttgtatgaagaggagatatcttgcaggtttttttatctacctgttttcaccccttggacgtattatttcttattagttttgtttgtttgccaagaaattctattcgccatggctgtaagacgaatggtgtttgccgcggctcttgctggtctggcgatggccaagcccatcaagcccatcaagccaacaggcacattctgtggcatcatctgcataagcgcgattagcgattgcggcgtaccatatggaggttgctacgatccttgtgttgacccagcccctacacctcttccttgtgacgtggaaggtccagttccggagagtccagtcgttgtgagcccagtcccagcaacgccaaccagcgaaaatccgttctcagtcacgcctggttcgacctcagtcactcccaccgtggagagtccgagttcagtcactccagcctcacagaccccagtcgttgtggtgagcccagtcccagcgacgacaaccggtgagaacccgagttcagtcactccagcctcggacactccagaagatgaggaaactcgagaagattctga

SEQ ID NO: 678 - DNA, 257 bp, Trichoderma harzianum
gcatgatattgaatggttggaaagtcaggtggaggcgttcaaagcaatcacagcgaccctgccgcagctttcctttcatgagacgaagcggtcggaacatggctttgtcgtcgaacagcggcattccatgtctggctcggatggtgtgcggatcggcctgtccgctactcattcgggtttgatccaatttgagggccgcgatgcaaactaccagacgtttgtagaaaagttccgcgaaatgatacataaagccaagg

SEQ ID NO: 679 - DNA, 364 bp, Trichoderma harzianum
tggcgtggcgcctcagccagaagcgttggtgatgacacccgacctcgcatttgtgtactagtatgtacacaacacagccgtgtgtcagagtatcatatcagagctaaggttaggtagacagacagacggcttcgtttggcaactcgctggatgccagatggcagagcttagatggtcagcttggatggttgagcacagatgtgaataggcacctgcgaggaccagcagtgagcaatattggagcagtaagagtaaggtagctgtcgggatagagacttgaggacgggctgctccgtccggtccccatctcgtggaacccgtaatccagtcaatggataccataatcaatccataactcctccat

SEQ ID NO: 680 - DNA, 552 bp, Trichoderma harzianum
tacaactctcgcccacaatgtctctcaagaatgacgctttcccttcctccgaggccttcgaggccatcaacgccgctctcagcagcagcgaagccgaccgcaaggacgccatcaagaatggcaaggccgtcttcgccttcaccctcaagaacaaggccggcgagacggccagctggcacattgacctcaaggagaagggcacagtgggcactggcgtcggcgagaaccccaccgtcactctgtctctctccgacgaagactttggcaagctcgtcaccggcaaggcccaggcccagcgcctcttcatgtccggcaagctcaaggtcaagggcgacgtcatgaaggctaccaagatggagcccatcctgaagaaggcccagaccaaggccaagctgtaaaaagcgggcattggcaagttgggctgttgattatgggaaaacaggtggaaacaaaccattaaacggcatttttttgtttttatatgtatcataccatcgctgtttactaccactgatgtttactgtgttttctttgttccccggccgcaaaaga

SEQ ID NO: 681 - DNA, 569 bp, Trichoderma harzianum
gcaaatggaacgccgaggggttcgctgaggaggaagacgacgatgtgcagctggattattcccggcctagtctcacaagtgactcggaggctgaggcagttgggcggtccagcgctctggatgctgttgagtcgtctacctggggatccacaagcaagggcaagttcattctcaaggacttgggagacgaggtgcacgacatcttggcctcggcagaggctcagaaagccgagaaggctgcacgagcagacaccaagactggccttttgggcaccggagtcaatgccatcagtgggctgttccggaatgtggtgggcggcaagacgttgaccaaggaggatctcgacaaggccatgaagggcatggaagatcatttgctgcgcaaaaacgtggcgcgcgaagctgccgttcgtctttgcgaaggtgtcgaaaaggagctggtcggtgtcaagactggaaactttgaaagtatcaacgccaagatccaggcggcaatggagtcgtctctcaccaaaatgcttactcccacctcatccctcgatctccttcgcgaaatcgactccatcaca

SEQ ID NO: 682 - DNA, 547 bp, Trichoderma harzianum
aaccacggccacgacgaccgcgtctgtccgggattgatcctgtcaactgctttaccagatatctagccgtgccacgatagagcgcgcatgtcggcgagaggggggcagaagaggagaagagtcaagagaagggggggcacagctgatagacagagcgccgtcgagcctgtagcatcgccaaactcaatgtaggtacgtctgatgagtgtcgctgcatgcagatgacagtcgtggatgcatgtcattggcacttgatcagctccatatttgacagtgcccctccaacggcggcaagcgagagtgaggggtttgctgttgttatttgttgttgctgttgctttgctgttgcattttcctgaggcatatgggccaagatgagagatggatggatgacatggatgagattggtttttgtgtataacaaagcttgataatggcattgaacaaagcttgtgccggctagtcgataaggacgatgtcgataacgcgtatcgcagctatcagcccatctaatcgcagcacagcctaaccccgaggaaaaaaaaaa

SEQ ID NO: 683 - DNA, 639 bp, Trichoderma harzianum
gatacccagtatacagcagaccgtcccgagtatcccaagtatatcaagtgcaagactgggtttataacaatcgtttttgataaactgcaatttttctcatttcatacgcgtattggaagacactttattcgtatatttacgatctgttcctttgcctgtcgagtacaccactacaccactcaacgacacctacatatttcctttcaccatggcaccaaccgctatcgttgatctcggcgagaccttttccgtcggccagaagctggaaaatgtctccgacgccatcgacgacgtaaactgcatcaagtacgattccgagtccaagttcgacgccaacaaagacaaggcaaacttccgccagtacgaggatgcctgcgacagggtcaagaacttttacaaggagcagcacgaaaagcagactgtcgcctacaaccttgctgctcgcaacaggttcaagagcgcttcacgggtgcgcccggagatgaccgtctgggaggccatagagaagctcaacactctcgttgatgaatctgacccagacacgtcgctgtctcagatcgagcacttgctccagtctgctgaggcgattcgccgcgatggcaagccacgatggatgcaggtaacaggtctgatccatga

SEQ ID NO: 684 - DNA, 534 bp, Trichoderma harzianum
attctggtttgttgggggctaagcctttcaacgttatgcgtgttactcccggatattatcttgcaacatgggcttgtcatctcccgccagccattcgctgtgattcgtcccgggatgctccgcggacattgcttcctggcgtatttcagcatccggcattggtgaagttcccactatggagatagaatcatggattttgcccccgccccttttttttttcttcttttccacccttctttatgcttatctctcagcccctagcaaacggtggacggatattctcatctagattgctgacaacatgccgttagcccccatcaaccacgaacccgtcccgacccggggtccaatattcgttcagctcggctgttcacccgtatactcgtgcttgacttttatttttgtttttagttgggagattattttgtattttgcagaagcaatatttgccacctgggcaatattctctcgagtcagccattgtaggcagctgaaaaggctgatctgtcttggccttgctcgtttccccgcgct

SEQ ID NO: 685 - DNA, 574 bp, Trichoderma harzianum
tgaaagcttccatatcgcattctcatggcgactgttgggaatgcggcccggcagatacgagatcgggcactgcgcgaaagatcgatccgcgtgctcgtatcgccaacgccaatctccttcgccgagcgtcgctcagttctgcaggtgctggagcaatatggccctgtcgagttcttcaagatgactcccggctactacgccaactttgtttctataacgagagagccctcgaccgccgaaagattgatagctagcagccctctaacatacaagatcacggagcctgtccgcagcgcggtggaagacatttacgttgcagatctaaacgaaccagagagctttagcaccatgcagccgacaataactgggcaacagacgagcggcgcgaactcttggtccgacggcacggaacagggacaggaacaggaacaaggacgagaggcggaactaaagcaaggggagagagagttcaaactggaaatcttccctgcgcccgagtacaatcatagatttgccatggccggttcaccgctgcacggcatctggaacgatggctacgaacaggatcaatcct

SEQ ID NO: 686 - DNA, 320 bp, Trichoderma harzianum
gcaaacatattgtgagtggatcgagggcaacgagctcacgacatacacatattgcgtaatgacaagtcaaactgcaaataaggaagttctgctctttgagcgttataaggatcttccttccgtcaagacccatggccaaacaaatgagttcaagtctatgttcaaacgaatttcgccttggattgaaacaaagcgtaccgaaataactccatggagcgaattagacggttctttcttctcttccctagacttagaagccacagcgaagctctaaagatagctctatattccttataattttgtattttttcttctattct

SEQ ID NO: 687 - DNA, 191 bp, Trichoderma harzianum
agatgttgattccaacgccagagactagctgtgggactgctattaaaatagaataaagatcttacttggcagccgttttccggttcaccaagctgcggagattagatagagggctacatgcgacccttgtacgatcagcgcatatcatgagaacaattctggactcagaattttgacgagaccagttcctt

SEQ ID NO: 688 - DNA, 583 bp, Trichoderma harzianum
gctacggcttatttactcttctgaccggaggtctcggtattgacatgaccttggagccatcgctgccgcaacgaaatggagtactcgtacatgtagccgcagtctcttgtccatgcgagcgggcatttcgtcggcgtcccaatggtcaccgcgagacctatcatttgagatactgtctatcttcctgcatgttggctgtacgagacgaacgatatgacggctccctgcctttgatttctatgcagcagtagccaaaagagaaaaggtgtaatatgcagcaaggccgctatgttgccaccccacgagacctcgactgcatgcacgtccagcgatacgtctccacgaggccgcgcatgaccgctgtgtcgagagtggatggactgcggacacctctctgcttgcaacggctcagcaaattttgccgttgggccaccgaagccaaacggctcaccgtctacgcaattggcactctaaatgctcctttccgcagccgccttgctttcaatacgcgtccacaagcgtttgtagcccttgtcaggccgttgcggttgcccgcgtaccaccgcccagtggagaacaagcg

SEQ ID NO: 689 - DNA, 528 bp, Trichoderma harzianum
  misc_feature (456)..(456): The residue at this position can be any nucleotide.
aaccaaccatccaacaccgttaaaatgggcggcggaatcaccgttcgcgatgtcgatgcgcaaaagttcatcactgcctatgctgctttcttgaagcgccagggcaagctgcccatccctggttgggttgacaccgtcaagactggtcccgccaaggagctgcctccccaggacattgactggttctacgtccgtgccgcctccgtcgcccgccacgtctacctccgcaagaccgtcggtgttggccgtctccgcaaggttcacggcactgccaagaaccgtggcaaccgccccagccaccacgtcgatgcctccggctccgtcgaccgcaaggtcctccaggccctcgagaagattggcgtcgttgagcaggacgaggacaagggtggccgccgcatcacccagtccggccagcgtgatttggaccgaattgcccagaccaccgctgaggccgangaggaggatgaggagtaaatcaaaataaagaaaaaagtctttttgttttcttcttacaactgtcatggatgg

SEQ ID NO: 690 - DNA, 635 bp, Trichoderma harzianum
aagccctcacctcacataaacacgggagaactacattcaagatggatttctctaaattcagcaagggtttctctgatttcagtgcgcagattactccgtttgcgtcacggaccttccagtttaccaaggagcagttgggccaagcagatgatcgaactgagcttcctgccgattacatcgacctcgagaaaaaggtcgatgcgctgaaacaagcccaccagaagatgcttgcggtgacttcgcaatataccaacgaagcctatgactatcctcccaacatcaaggagacatttcaagatcttggccgaaccgtgagtgagaaggtcagccttctatcttcggctacatctacttcagaggcccaagcagctcttgtggctccagcatctgcgaagccgcaaccaaagactttcaaccatgccatctctcgtgcgagcttatccagcagccagctcctgcaccagcaccacactggtgctggcgaagatcctctggcaacagctctcgagaaatatgcactcgcgatggaacgagtgggcgacgcgcgccttgctcaagattcacaaatccaaagccgattcctagcaggatggaacacaaccctcaataccaatcttacctttgcggcgcgtgct

SEQ ID NO: 691 - DNA, 481 bp, Trichoderma harzianum
tgaaagagaaggactttatcacacaagccgtttcggtttctacttctccttattgttattattacatctcggtgcaccgctgcatatgggcatggaatggaggctttttctttttcttcttttcttcttgttggtcagtcttttacgaaatacgcaacaagaccttgggtggagttctatggatacgaatatgaggcgtttgcagtggatacgtgaatgtggaacgagaaacgtacgcaagacgagtatgagtctcttgcatgaaatagcatgatgggtggtttggagaaggactaagcaagtggttgctgtcctgagcctttggccgtctgcgacttggggttgttggaacaggccttgcatgtctttatgactgacagaggtgagcttggagttagcgcttttgaaggcagctcttttcaacaagttgcaaatttccattttatcattctataagctgttccatctccttatttccact

SEQ ID NO: 692 - DNA, 198 bp, Trichoderma harzianum
gtggagatcattttactgtactataacgggggtggctggatcgtcatgaggcaaatcgggcaatgcgatgcgatacgatggatcacggctaacatgacaatattgattagtagcatgatgatgaaccaacagcacagatctggatggctttagctttgaccacatgccaagcaggctgcccaggttcacagaccagcc

SEQ ID NO: 693 - DNA, 659 bp, Trichoderma harzianum
taatcgcaagatcgcagctcgcgcccaagagtcagtcaaaatggcccctcagaagaagagcaagaaggatgccaacagcatcaactccaagttggcgcttgttatgaagtccggaaaggtcactctcggctacaagtctactctcaagtctctgcgatccggcaagggcaagctgatcatcattgctggcaacactcctcccctgagaaagagtgaactcgagtactacagcatgctgtccaaggctcccatccaccacttcgctggtaacaacgtaagttttgcaatctcagacgccctggacaagtgaagacctggaaacgggtatatctacttgcgccattacacacttctcgcttctttcagaagctactcttgctacccgagaattgccaattcttgcggaattgcccagagaagaagtctttcagactttggagggttcacattggcttacattattcgtaaaacagattgagctcggcactgcctgcggaaagctcttccgctgctccacccttgccatcctggatgctggtgactctgatatcctcagcgaccagcaggcttaaatagccgaaatctagtgcattcaaaacggcgttgggggtaaaacggttcaagggcaatatggataccatacactttcacattatgtg

SEQ ID NO: 694 - DNA, 355 bp, Trichoderma harzianum
acctcggtctctacgcaatcgcgactgcgtcagaagcattcaattgctcgtcaacgtcaacatgtctctcgcacagtctatctacagcaccgtcttccgcaagaacttcaccatgcttgcggccgttttcggtgccggcttcgcttgggagatcggtttcaatgccaccatgaacaaaatctgggacagcaacaaccgaggccgccaatggaaggacatccgacacaagtacattgagggcggcgaggacgaggagtaagatcaacatgcaaattccggttgctacggctagaatgggtgtggcatgggactgcctggggaaaatgtacaaaaccaacgagaaatagaatgattc

SEQ ID NO: 695 - DNA, 655 bp, Trichoderma harzianum
tccgccctcttctcttcaacccgaacaatcgaatctaacgagcagcacggcaacgtcccatacagttgcccagcatgtcgctcgtcacgggagagaagacgaactttcagttcattctccgtcttctgaacaccaacgtcgatggaaagcagaaggttatgtacgccttgaccaagatcaagggtgtcggtcgccgatactccaacttggtctgcaagaaggccgatgtcgacctgaacaagcgcgccggtgagcttacctccgaagagctcgagcgtatcgtcaccatcatccaaaaccctacccagtacaagatccccgcctggttcttgaacagacaacgcgatattgttgacggcaaggactctcacatcctggccaacggtgtcgactccaagctccgtgaggatctggagcgcctcaagaagatccgtgcccaccgtggtctccgacactactggggtctccgtgtccgtggtcagcacaccaagactaccggtcgtcgtggccgaactgtcggtgtctccaagaagaagggtggctaatggttttactgttttcggtctggggtggacaggcgtgacggctgggtttttcatcactgtgatgagcatttccatgggactgctttctggcatacgcagctggagctgta

SEQ ID NO: 696 - DNA, 700 bp, Trichoderma harzianum
ttcaatcctttgcgcagaggcgaggctggacacaatggctgaacaactgatcctcaaaggtaccctcgagggccacaatggctgggttaccagcttggccacctcaatggagaaccccaacatgctcctgtctggtagccgagacaagaccctgatcatctggaacctcacacgcgacgagactcaatacggataccccaagcgatccctccacggccactcccacattgtgtcggactgtgtcatctcctctgacggtgcctacgccctctctgcctcttgggacaagaccctccgtctgtgggagctcgccactggcaccaccacccgaagattcgtcggccacaccaacgatgttctctccgtctccttctccgccgacaaccgacagattgtctccggctctcgtgaccgcaccatcaagctgtggaacaccctcggtgactgcaagtacaccatcaccgacaagggccacactgagtgggtttcctgcgtccgattcagccccaacccccagaaccctgtgattgtttccagcggttgggacaagttggtcaaggtttgggagctgtccagctgcaagctgcagaccgaccacatcggccacaccggctacatcaacaccgtcaccatctcccccgatggctctctctgcgcatctggtggcaaggacggtaccaccatgctctgggacctcaac

SEQ ID NO: 697 - DNA, 571 bp, Trichoderma harzianum
gttaagcgtctcttcatggcgccaggaccactggcactctgccagatttgcccaagtgcagctggggggggaggttgttagcatgtcgtctcggtgccaatcacccggtatgtaccaaagggagatagcctctttctttgctggcacggtacagatgaagcacagcaaggccggcgttacgtatgtgtgacggctcatcccaagatttgtgaacgcacacgcttcctcctaccgacgatcgaagccaccaccgactaacctggagtgaaccaatccagccaaacagctgcgcgagctgaccaccaatgcctctagggatgtgagcacgactgaaagatgtgtccatgcccgccaagcagcatgtgtgtgttccaaccgtgcacatattctattcgtgcaaatccaatgggtgcaattggagcattcatcctgcttttccaactggggctgtaacaagttcgtgctgtagaccaagttcatgttaccagtcacggtgtatgctctgcacccaaggtcaccgacaatacacagatatctgcacaaggcgccatctgtgggatcctgctgtgca

SEQ ID NO: 698 - DNA, 471 bp, Trichoderma harzianum
acggtgtccatggcgggcggatgggcggggcgagagggggaagctcggcgccaccatgcctttacaaaaagtatcattgatgaatagagtcgtaaatccgattcacggctgcggaggcagtgagcggaagatcgaccaacagattagcgatgagcgagagggtcaaggaaactgacagggtgattcagatgccccccggaagtggagaggaaacaagaagccaggggtgtttgtcgtacacatgttgccagcctgcatctggcatctgctgccagctattgacagctactttcattggccagatgctgcaaattggagctgcactgcacgggcacaagttcggatgggggatgacggaagcaaaacggctgcgtattacctgcgttggtagaatactaaggtattgatgtaatatttgggtaggtacggatacggtactttcatacaaagaatcacttagtcatggcaaag

SEQ ID NO: 699 - DNA, 562 bp, Trichoderma harzianum
ggaatagaaagacgatacacaagacaaggagtcagacaggacttgcacaagacatagatcacaagaaacgcgacctcacctcatcctcgacgatgcctttcaacacagagctcacccgccgcctgggcattcgcgtccccgtcatccagggcggcctcatgcacgtcggcaccgcagacctcgcgtccgcagtctccaacggcggcggcctgggcatcatcaccgccctcatctcccccacgcccgaagccctgcgcgccgagatccagcgctgccgcaccctcaccgacaagccctttggcgtcaacctgaccctcctcccgtccctcctcccgcccgactacccggcctacgcccaggccatcatcgacgagggcgtcaagattgtcgagacggccggaaactcgcccggcccggtgattcgccagctcaaggccgcgggcatcacggtgctgcacaagtgtacgacgattcgtcatgcccagagcgcgatcaagttgggcgtcgactttttgagcattgatgggtttgagtgcgcgggacatgttggcgagagcgacat

SEQ ID NO: 700 - DNA, 642 bp, Trichoderma harzianum
acaccagccatggactcttcctcgcgaagatcgcgatcgcgatcacccccgcggaaggcgccaaaaggcagtggtgggtttcggtggaaggataaaagccgcccaagcgaagacaaccgcggcagctatgattcgagaagagaccgatatggagaccgagaccgggatcgagaaagagaacgtgaccgaggccgcgaccgcgattatggagagcgacgacgtgactaccgcgatcgctcgcgagatcgtggtggccgtgatcgatacgagggccgcccaagatcgcgatcacctcggcgacacggttctggaccaaaagacacgggcgacaaggtgaagagagacgacaagaaggaaaagaaagaaaccaaggcgcccaaagctgccgttggagcgggacaagaattcatcattgttcatgtcaacgaccggctgggcaccaaatcagcgattccatgcttgccttcggacacggttgggcagttcaagctcatgattgcggcgcgcattggacgagaagcgggacagattatgctgagacggcagggtgaacggccgttcaaggatcacatcacgttggaggactatggcatttcgaatggagttcagctggatctcgaggttgacactggcgattgagca

SEQ ID NO: 701 - DNA, 503 bp, Trichoderma harzianum
tcttctccaactaaacaagagctcttttctacttctaattttttttttatctcaactcaccatctgagctatcaagctagaaagtaaccacagcaaataatcatcatggagctcgtcaactacaaccacaagacctgccccaagtgctctgccaccatcacctccgagtccaagacttgctcgagctgcggcgctacttgccccgtctaagctacctcagctcgacccgccatcaacctcaaccatcgcaacaacatgacgagaatatcctgaggtgtggcgggactgcaaggacgcgcggatgagtgaatgaatagatgaatgaaggaatgatatacctcagcaggacatggtgcattaagacaaggcgttgatggaagaagagaagcgatcatgtatgtctaatattctaagctatatgccagtccttgttacagacaggcggctagaatagttcctcgcaatggaaggaatctagaatggcaatgggcaatgggcaatgg

SEQ ID NO: 702 - DNA, 670 bp, Trichoderma harzianum
atccgcgactttggcacgtttctcacgacggtaacgcccccaacccttcagacacaatggccaagcaatctcgtggtgcccctggtggcaagctcaagatgaccctcggtctccccgtcggtgccgtcatgaactgcgccgacaactctggtgcccgtaacctgtacatcatctccgtcaagggtatcggtgctcgcctgaaccgcctgcccgccggcggtgtcggtgacatggtcatggccaccgtcaagaagggaaagcctgagctgcgaaagaaggtccaccccgccgtcattgtccgacagtccaagccctggaagcgattcgacggtgttttcctgtacttcgaggacaacgctggtgttatcgtcaaccccaagggtgagatgaagggctctgccatcactggccccgtcggcaaggaggctgctgagctgtggccccgtattgccagcaactccggtgtcgtcatgtaaagaggttgttaaacgaagggagggattttttttttatttaccaaagagaagagaggaatgaaaaaaagacaaatgaccaagtccctcgatgcgatcttatagaagcgtggaaactctttttcccgcctcctgtcccttttttctgatttttttgttctttggggcatgggagggggaaaaaaagaaacgggaaa

SEQ ID NO: 703 - DNA, 702 bp, Trichoderma harzianum
acccacatatcagacacccgagagagtcggtatgtcggccaagcccacgaccaagcagttcgggaagtcgacccgggaggttcccgcctccgcggaccaggcgaagaagtggtaccctgccgacgacgagagcgccccgaagaaggttcgcaagtccgtccgaacttgggccccccgaaagaccctccagcctggtaccgtcctgatcctcctcgctggccgcttccgcggcaagcgtgtcgtcctcctcaagactcttgaccagggtgttctcctcgtcactggtcccttcaagatcaacggcgttcccctgcgaagagtcaacgcccgatacgtcatcgccacctcctacaaggtcgacatctccggccttgacgccgccaagattgaggagatctctcagcccaagtacttcaccgccgagaaggccaaggagaaggcttccgctgaggctttcttcaagcagggagagaagccccagaagaaggagatcaacagcagccgtgctgctgaccagaaggccgtcgacaaggctctgcttgctagcatcaagaaggtggatctgttggccagctacctcgccagcaccttcagcctgcggaagggtgacaagcctcacgagatggggtggtaaatttgattcaaacacaaaatctctctggcaggtcgaaagcacggggtggagtttactggggtgttggt

SEQ ID NO: 704 - DNA, 470 bp, Trichoderma harzianum
cccacgcgtccgcgatgataaagttgtggggtaatttagatagagatgattcggctgcaacgctgaaaagtgttgatcaaactggtaggattcagttcattattgttccttcgcccttcgtggatcgacgcttcgcttaacagtggcagtgctcgcggatgatgatccgtctgacgcgatctggaggcggacccagaatgtggatgagggaatctccacaaggcgtaactccttggtttactcttgttcgcacacagatgtatcttgagagttgttaaggctataacgagtgcggttgagatacgtctacgactaagcatcttgagcagagtgttagttgcgaaacgttcaattgactaagtaagagtagagagtatcaagcctgcaaatccatccccccgaatctccgattttatgagccaccatagctcttttcgccaaatgcaaatgccgtagatagtgcccatccg

SEQ ID NO: 705 - DNA, 488 bp, Trichoderma harzianum
gtctttcaggtgcccagagaagacagctcggaaagtgcggaagtcttgattgaccaggatggagatttggatggttttgatatgaaaggcttaaaagaccaagttcttgtattcaagtacagagggaaattccacgccgttgatcataaatgccctcattcgtcttaccccctctcacaagccactccatttgacattgaggattttggcgttgtcttgagtgcaggactgacctgtccaaaacatggttggtcgtttgatctgtttactggctcaggagaccgtggaaactatcagcttggactttgggaaactcagttgcgtgaagtaaagaattcggatacatcagcagacgaggcttcaggttccgcggaacaggaagtatgggttcggagaaaacagcgacagcgcattggatagattagggatggcgttgggcatgtgcatatagacagggtaataaattacaagcatattttggtcagaac

SEQ ID NO: 706 - DNA, 670 bp, Trichoderma harzianum
cccacgcgtccgagaccggccatcaatcacaactccgtactcgctgcagacagacactcttgcaccttgagcaagttcaattggcgctgagagggcgaaagagtgcaaaagttatcttgctgccaccagttatctgcctgcaacccgcaaagtggcccaaaccaaaggctcagcccaacgctgatcacggctttcgtattcggcagcgatggacaggcaccacaatcgcactccctttcatctgcttcttctctcgagcttctttttttcctttgctcgcctcacatttcttctagtggatgacgcaactggccgcggggatcgtcgacgccaatctatctctctcattctctctctctctttttctgagggttaatttcgtatctacctacttacagccacagtcacagctcgacaagtattggcagtattgcctactagtattcccaccgctcgcttaggcggccaaggcattccctgtcgaatgacacgaatctcatcttacagtagacagacccggaaaagcggggatggacatgacatgtgtgtgtgcttcatggcggcctgagagcctggccatgcgtgaaatgccatgccgtgcgtcaacaagcgtcgagcagcgctggctggctggtgatacgccatggcctcgttcgttctctggtctggg

SEQ ID NO: 707 - DNA, 505 bp, Trichoderma harzianum
tcctcgaggcaatattgttttcgaatttgggcatagcgagtggcttcgttggtggtttgagggctggagccccggtgcccagacaatgagatttgtggagttttacccgtgttggttttctttagtgacgtattgatgaacaggtacaacgacttcaggcgatcggcggcgacgcttatttcttgcacgcccccttggatgggtcccgcgagaaccttggtaggtttaaaggaggtagctgtgctccgtaacggggttgttatttataggctagtattaaggagctgaatgacgcgctcgtgtcgaacccaggaaatggaatattcatttttgtgtggtgatggcgacagagagtagggtttggttaccccgaagaaagcaagatcgagattgaagtgtgtatcggcgatttatcagatctaggccgacttgagcatgtgagatgacacgagctaacaccagcatgatacagctggcagtcaataagagacaaagcttgttgtac

(The sequence listing continues in the following parts.)

What is claimed is:

1. The isolated nucleic acid SEQ ID NO:3459.

2. A vector comprising a nucleic acid according to claim 1.

3. The vector of claim 2 wherein said nucleic acid is operably linked to a plant promoter.

4. The vector of claim 2 wherein said nucleic acid is in sense orientation.

5. The vector of claim 2 wherein said nucleic acid is in antisense orientation.

6. A plant transfected with a nucleic acid according to claim 1 wherein said transfection is selected from the group consisting of calcium phosphate-DNA co-precipitation, DEAE-dextran-mediated transfection, polybrene-mediated transfection, electroporation, microinjection, liposome fusion, lipofection, protoplast fusion, retroviral infection, and biolistics.

7. The plant of claim 6 wherein said transfection is by means of a vector.

8. A plant organ from the plant of claim 6, said organ selected from the group consisting era seed, leaf, root and stem.

9. A process for making a transgenic plant comprising:
   a. providing a nucleic acid according to claim 1, and a plant, and
   b. transfecting said plant with said nucleic acid.

10. The process of claim 9 wherein said transfecting is under conditions such that expression of said nucleic acid confers upon said plant an altered metabolic characteristic selected from the group consisting of an acid, alcohol, fatty acid, branched chain fatty acid, base, alkaloid, amino acid, ester, glyceride, phenolic compound, carbohydrate, sterol, oxygenated terpene, isoprenoid compound, alkene, alkyne, hydrocarbon, ketone and quinone.

11. The process of claim 9 wherein said transfecting is by means of a vector, said vector comprising a nucleic acid according to claim 1.

12. The process of claim 9 wherein said altered metabolic characteristic confers disease resistance upon said plant.

* * * * *